US008163896B1

(12) United States Patent
Bentwich

(10) Patent No.: US 8,163,896 B1
(45) Date of Patent: Apr. 24, 2012

(54) BIOINFORMATICALLY DETECTABLE GROUP OF NOVEL REGULATORY GENES AND USES THEREOF

(75) Inventor: Itzhak Bentwich, Kfar Daniel (IL)

(73) Assignee: Rosetta Genomics Ltd., Rehovot (IL)

( * ) Notice: Subject to any disclaimer, the term of this patent is extended or adjusted under 35 U.S.C. 154(b) by 1817 days.

(21) Appl. No.: 10/707,147

(22) Filed: Nov. 24, 2003

Related U.S. Application Data

(63) Continuation-in-part of application No. 10/604,985, filed on Aug. 29, 2003, now abandoned, and a continuation-in-part of application No. 10/604,926, filed on Aug. 27, 2003, now abandoned, and a continuation-in-part of application No. 10/604,727, filed on Aug. 13, 2003, and a continuation-in-part of application No. 10/604,726, filed on Aug. 13, 2003, and a continuation-in-part of application No. 10/345,201, filed on Jan. 16, 2003, now abandoned, and a continuation-in-part of application No. 10/321,503, filed on Dec. 18, 2002, now abandoned, and a continuation-in-part of application No. 10/310,914, filed on Dec. 6, 2002, now Pat. No. 7,250,496, and a continuation-in-part of application No. 10/293,338, filed on Nov. 14, 2002, now abandoned.

(60) Provisional application No. 60/468,251, filed on May 7, 2003.

(51) Int. Cl.
*C07H 21/04* (2006.01)
*C07H 21/02* (2006.01)
*A61K 48/00* (2006.01)
*C12N 15/63* (2006.01)

(52) U.S. Cl. ............ 536/24.5; 536/23.1; 536/24.31; 536/24.3; 514/44; 435/320.1

(58) Field of Classification Search ................. None
See application file for complete search history.

(56) References Cited

U.S. PATENT DOCUMENTS

| 6,287,813 B1 * | 9/2001 | Fussenegger et al. ....... 435/69.1 |
| 6,573,099 B2 | 6/2003 | Graham |
| 2002/0086356 A1 | 7/2002 | Tuschl et al. |
| 2003/0108923 A1 | 6/2003 | Tuschl et al. |

FOREIGN PATENT DOCUMENTS

| WO | WO 01/68836 | 9/2001 |
| WO | WO 02/44321 | 6/2002 |
| WO | WO 02/094185 | 11/2002 |
| WO | WO 01/75164 | 2/2003 |
| WO | WO 03/029459 | 4/2003 |
| WO | WO 03/070884 | 8/2003 |
| WO | WO 03/070903 | 8/2003 |
| WO | WO 03/070918 | 8/2003 |
| WO | WO 03/074654 | 9/2003 |

OTHER PUBLICATIONS

Krutzfeldt et al., Strategies to determine the biological function of microRNAs, 2006, Nature Genetics Supplement, vol. 38, pp. S14-S19.*
New England Biolabs 1998/99 Catalog, (cover page and pp. 121 and 284).*
Mallory et al., MicroRNA control of Phabulosa in leaf development: importance of pairing to the microRNA 5' region, 2004, The EMBO Journal, 23, pp. 3356-3364.*
Cullen, RNAi the natural way, 2005, Nature Genetics, vol. 37, No. 11, pp. 1163-1165.*
Lee, R. C., R. L. Feinbaum and V. Ambros. The *C. elegans* heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in *C. elegans* Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Educ.
Engdahl HM, Hjalt TA, Wagner EG. A two unit antisense RNA cassette test system for silencing of target genes. Nucleic Acids Res. Aug. 15, 1997 3218-27 25.
Dsouza, M., N. Larsen and R. Overbeek. Searching for patterns in genomic data Trends Genet Dec. 1997 497-498 13.
Moss, E. G., R. C. Lee and V. Ambros. The cold shock domain protein LIN-28 controls developmental timing in *C. elegans* and is regulated by the lin-4 RNA Cell 1997 637 88.
Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998.
Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.
Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.

(Continued)

*Primary Examiner* — Amy Bowman
(74) *Attorney, Agent, or Firm* — Polsinelli Shughart PC; Teddy C. Scott., Jr.

(57) ABSTRACT

The present invention relates to a first group of novel genes, here identified as genomic address messenger or GAM genes, and a second group of novel operon-like genes, here identified as genomic record or GR genes. GAM genes selectively inhibit translation of known 'target' genes, many of which are known to be involved in various diseases. Nucleic acid molecules are provided respectively encoding 200 GAM genes, and 1096 GR genes, as are vectors and probes both comprising the nucleic acid molecules, and methods and systems for detecting GAM and GR genes and specific functions and utilities thereof, for detecting expression of GAM and GR genes, and for selectively enhancing and selectively inhibiting translation of the respective target genes thereof.

6 Claims, 29 Drawing Sheets

OTHER PUBLICATIONS

Verma, S. and F. Eckstein. Modified oligonucleotides: synthesis and strategy for users Annu Rev Biochem *No date in Pubmed* 1998 99-134 67.

Wuchty, S., W. Fontana, I. L. Hofacker and P. Schuster. Complete suboptimal folding of RNA and the stability of secondary structures Biopolymers Feb. 1999 145-165 49.

Mathews, D. H., J. Sabina, M. Zuker and D. H. Turner. Expanded sequence dependence of thermodynamic parameters improves prediction of RNA secondary structure J Mol Biol May 21, 1999.

Chang, P. L. Encapsulation for somatic gene therapy Ann N Y Acad Sci Jun. 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in *Caenorhabditis elegans* by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N., J. A. Schisa and J. R. Priess. P granules in the germ cells of *Caenorhabditis elegans* adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in *Drosophila* cells Nature Mar. 16, 2000 293-296 404.

Slack, F. J., M. Basson, Z. Liu, V. Ambros, H. R. Horvitz and G. Ruvkun. The lin-41 RBCC gene acts in the *C. elegans* heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in *Drosophila* genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. *Arabidopsis* SGS2 and SGS3 genes are required for posttranscriptional gene silencin.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retrovirus.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale *C. briggsae-C. elegans* genomic alignment Genome Res Aug. 2000 1115-1125 10.

Kennerdell, J. R. and R. W. Carthew. Heritable gene silencing in *Drosophila* using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in *Nicotiana benthamiana* Cell Sep. 29, 2000 157-167 103.

Mette MF, Aufsatz W,van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in *Drosophila* embryos Curr Biol Oct. 5, 2000 1191 1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conser.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal. Plan.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of *C. elegans* adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in *Drosophila* using a GAL4-driven hairpin RNA incorporating a heterologous.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control *C. elegans* developmental t.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Begun and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and, high-t.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology. Glimpses of a tiny RNA world Science Oct. 26, 2001 797-799 294.

Lee, R. C. and V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K M. Routzahn, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Ben-arie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in *Dictyostelium*: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the *Caenorhabditis elegans* heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.

Pasquinelli, A. E. and G. Ruvkun. Control of developmental timing by micrornas and their targets Annu Rev Cell Dev Biol Epub 2002 Apr. 2, 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes Cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. Blat—the Blast-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May 3, 2002 15 25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimu.

Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.

Bettencourt, R., O. Terenius and I. Faye. Hemolin gene silencing by ds-RNA injected into *Cecropia pupae* is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins RNA Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates *Drosophila* growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the *Arabidopsis* FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl. Acad Sci U S A Sep. 3, 2002 11981-11986 99.

Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of *Arabidopsis* miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A *Drosophila* fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in *Arabidopsis* Plant.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909.

Froeyen, M. and P. Herdewijn. RnA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and downregulation of micro- RNA genes miR15 and m iR16 at 1.

Gaudilliere, B., Y. Shi and A. Bonni. RNA interference reveals a requirement for myocyte enhancer factor 2A in activity-dependent neuronal survival J Biol Chem Nov. 29, 2002 46442-46446.

Jones, L. Revealing micro-RNAs in plants Trends Plant Sci Nov. 2002 473-475 7.

Schauer, S. E., S. E. Jacobsen, D. W. Meinke and A. Ray. Dicer-Like1: blind men and elephants in *Arabidopsis* development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible suppressible behavioral impairments Mol Psychiatry ***No date in pubme.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of *Caenorhabditis elegans* fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the *Caenorhabditis elegans* genome using RNAi Nature Jan.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells RNA Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamini. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.

Boffelli, D., J. McAuliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington. P1/HC-Pro, a viral suppressor of RNA silencing, interferes with *Arabidopsis* development and miRNA unction Dev Cell Feb. 2003 205-217 4.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs Rna Feb. 2003 180-186 9.

Lagos-Quintana, M., R. Rauhut, J. Meyer, A. Borkhardt and T. Tuschl. New microRNAs from mouse and human Rna Feb. 2003 175-179 9.

Wilson, J. A., S. Jayasena, A. Khvorova, S. Sabatinos, I. G. Rodrigue-Gervais, S. Arya, F. Sarangi, M. Harris-Brandts, S. Beaulieu and C. D. Richardson. RNA interference blocks gene expression and RNA synthesis from hepatitis C replicons propagated in hu.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.

Findley, S. D., M. Tamanaha, N. J. Clegg and H. Ruohola-Baker. Maelstrom, a *Drosophila* spindle-class gene, encodes a protein that colocalizes with Vasa and RDE1/AGO1 homolog, *Aubergine*, in nuage Development Mar. 2003 859-871 130.

Hershberg, R., S. Altuvia and H. Margalit. A survey of small RNA-encoding genes in *Escherichia coli* Nucleic Acids Res Apr. 1, 2003 1813-1820 31.

Zhou, A., S. Scoggin, R. B. Gaynor and N. S. Williams. Identification of NF-kappa B-regulated genes induced by TNFalpha utilizing expression profiling and RNA interference Oncogene Apr. 3, 2003 2054-2064 22.

Brennecke, J., D. R. Hipfner, A. Stark, R. B. Russell and S. M. Cohen. bantam encodes a developmentally regulated microRNA that controls cell proliferation and regulates the proapoptotic gene hid in *Drosophila* Cell Apr. 4, 2003 25-36 113.

Lim, L. P., N. C. Lau, E. G. Weinstein, A. Abdelhakim, S: Yekta, M. W. Rhoades, C. B. Burge and D. P. Bartel. The microRNAs of *Caenorhabditis elegans* Genes Dev Apr. 15, 2003 991-1008 17.

Xu, P., S. Y. Vernooy, M. Guo and B. A. Hay. The *Drosophila* microRNA Mir-14 suppresses cell death and is required for normal fat metabolism Curr Biol Apr. 29, 2003 790-795 13.

Xie, Z., K. D. Kasschau and J. C. Carrington. Negative feedback regulation of Dicer-Like1 in *Arabidopsis* by microRNA-guided mRNA degradation Curr Biol Apr. 29, 2003 784-789 13.

Carmichael, G. G. Antisense starts making more sense Nat Biotechnol Apr. 2003 371-372 21.

Yelin, R., D. Dahary, R. Sorek, E. Y. Levanon, O. Goldstein, A. Shoshan, A. Diber, S. Biton, Y. Tamir, R. Khosravi, S. Nemzer, E. Pinner, S. Walach, J. Bernstein, K. Savitsky and G. Rotman. Widespread occurrence of antisense transcription in the human ge.

Boutet, S., F. Vazquez, J. Liu, C. Beclin, M. Fagard, A. Gratias, J. B. Morel, P. Crete, X. Chen and H. Vaucheret. *Arabidopsis* HEN1: a genetic link between endogenous miRNA controlling development and siRNA controlling transgene silencing and virus resi.

Ambros, V., R. C. Lee, A. Lavanway, P. T. Williams and D. Jewell. MicroRNAs and other tiny endogenous RNAs in *C. elegans* Curr Biol May 13, 2003 807-818 13.

Liang, X. S., J. Q. Lian, Y. X. Zhou, Q. H. Nie and C. Q. Hao. A small yeast RNA inhibits HCV IRES mediated translation and inhibits replication of poliovirus in vivo World J Gastroenterol May 2003 1008-1013 9.

Grad, Y., J. Aach, G. D. Hayes, B. J. Reinhart, G. M. Church, G. Ruvkun and J. Kim. Computational and experimental identification of *C. elegans* microRNAs Mol Cell May 2003 1253-1263 11.

Abrahante, J. E., A. L. Daul, M. Li, M. L. Volk, J. M. Tennessen, E. A. Miller and A. E. Rougvie. The *Caenorhabditis elegans* hunchback-like gene lin-57/hbl-1 controls developmental time and is regulated by microRNAs Dev Cell May 2003 625-637 4.

Lin, S. Y., S. M. Johnson, M. Abraham, M. C. Vella, A. Pasquinelli, C. Gamberi, E. Gottlieb and F. J. Slack. The *C elegans* hunchback homolog, hbl-1, controls temporal patterning and is a probable microRNA target Dev Cell May 2003 639-650 4.

Zamvil, S. S. and L. Steinman. Diverse targets for intervention during inflammatory and neurodegenerative phases of multiple sclerosis Neuron Jun. 5, 2003 685-688 38.

Ambros, V. MicroRNA pathways in flies and worms: growth, death, fat, stress, and timing Cell Jun. 13, 2003 673-676 113.

Moss, E. G. and L. Tang. Conservation of the heterochronic regulator Lin-28, its developmental expression and microRNA complementary sites Dev Biol Jun. 15, 2003 432-442 258.

Smalheiser, N. R. EST analyses predict the existence of a population of chimeric microRNA precursor-mRNA transcripts expressed in normal human and mouse tissues Genome Biol Epub 2003 Jun. 18, 2003 403 4.

Kawasaki, H. and K. Taira. Hes1 is a target of microRNA-23 during retinoic-acid-induced neuronal differentiation of NT2 cells Nature Jun. 19, 2003 838-842 423.

Lai, E. C., P. Tomancak, R. W. Williams and G. M. Rubin. Computational identification of *Drosophila* microRNA genes Genome Biol Epub 2003 Jun. 30, 2003 R42 4.

No author listed. Whither RNAi? Nat Cell Biol Jun. 2003 489-490 5.

Bartel, B. and D. P. Bartel. MicroRNAs: at the root of plant development? Plant Physiol Jun. 2003 709-717 132.

Dykxhoorn, D. M., C. D. Novina and P. A. Sharp. Killing the messenger: short RNAs that silence gene expression Nat Rev Mol Cell Biol Jun. 2003 457-467 4.

Saunders, L. R. and G. N. Barber. The dsRNA binding protein family: critical roles, diverse cellular functions Faseb J Jun. 2003 961-983 17.

Steinman, L. and S. Zamvil. Transcriptional analysis of targets in multiple sclerosis Nat Rev Immunol. Jun. 2003 483-492 3.

Qi, Y. and B. Ding. Inhibition of cell growth and shoot development by a specific nucleotide sequence in a noncoding viroid RNA Plant Cell Jun. 2003 1360-1374 15.

Jackson, A. L., S. R. Bartz, J. Schelter, S. V. Kobayashi, J. Burchard, M. Mao, B. Li, G. Cavet and P. S. Linsley. Expression profiling reveals off-target gene regulation by RNAi Nat Biotechnol Jun. 2003 635-637 21.

Bashirullah, A., A. E. Pasquinelli, A. A. Kiger, N. Perrimon, G. Ruvkun and C. S. Thummel. Coordinate regulation of small temporal RNAs at the onset of *Drosophila* metamorphosis Dev Biol Jul. 1, 2003 1-8 259.

Sempere, L. F., N. S. Sokol, E. B. Dubrovsky, E. M. Berger and V. Ambros. Temporal regulation of microRNA expression in *Drosophila melanogaster* mediated by hormonal signals and broad-Complex gene activity Dev Biol Jul. 1, 2003 9-18 259.

Heetebrij, R. J., E. G. Talman, M. A. V Velzen, R. P. Van Gijlswijk, S. S. Snoeijers, M. Schalk, J. Wiegant, F. V D Rijke, R. M. Kerkhoven, A. K. Raap, H. J. Tanke, J. Reedijk and H. J. Houthoff. Platinum(II)-based coordination compounds as nucleic acid.

Borodina, T. A., H. Lehrach and A. V. Soldatov. Ligation-based synthesis of oligonucleotides with block structure Anal Biochem Jul. 15, 2003 309-313 318.

Johnson, S. M., S. Y. Lin and F. J. Slack. The time of appearance of the *C. elegans* let-7 microRNA is transcriptionally controlled utilizing a temporal regulatory element in its promoter Dev Biol Jul. 15, 2003 364-379 259.

Carrington, J. C. and V. Ambros. Role of microRNAs in plant and animal development Science Jul. 18, 2003 336-338 301.

Smale, S. T. The establishment and maintenance of lymphocyte identity through gene silencing Nat Immunol Jul. 2003 607-615 4.

Bridge, A. J., S. Pebernard, A. Ducraux, A. L. Nicoulaz and R. Iggo. Induction of an interferon response by RNAi vectors in mammalian cells Nat Genet Jul. 2003 263-264 34.

Seitz, H., N. Youngson, S. P. Lin, S. Dalbert, M. Paulsen, J. P. Bachellerie, A. C. Ferguson-Smith and J. Cavaille. Imprinted microRNA genes transcribed antisense to a reciprocally imprinted retrotransposon-like gene Nat Genet Jul. 2003 261-262 34.

Zeng, Y., R. Yi and B. R. Cullen. MicroRNAs and small interfering RNAs can inhibit mRNA expression by similar mechanisms Proc Natl Acad Sci U S A Aug. 19, 2003 9779-9784 100.

Schramke, V. and R. Allshire. Hairpin RNAs and retrotransposon LTRs effect RNAi and chromatin-based gene silencing Science Aug. 22, 2003 1069-1074 301.

Wiznerowicz, M. and D. Trono. Conditional suppression of cellular genes: lentivirus vector-mediated drug-inducible RNA interference J Virol Aug. 2003 8957-8961 77.

Lau, N. C. and D. P. Bartel. Censors of the genome Sci Am Aug. 2003 34-41 289.

Houbaviy, H. B., M. F. Murray and P. A. Sharp. Embryonic stem cell-specific MicroRNAs Dev Cell Aug. 2003 351-358 5.

Aravin, A. A., M. Lagos-Quintana, A. Yalcin, M. Zavolan, D. Marks, B. Snyder, T. Gaasterland, J. Meyer and T. Tuschl. The small RNA profile during *Drosophila melanogaster* development Dev Cell Aug. 2003 337-350 5.

McManus, M. T. MicroRNAs and cancer Semin Cancer Biol Aug. 2003 253-258 13.

Baner, J., A. Isaksson, E. Waldenstrom, J. Jarvius, U. Landegren and M. Nilsson. Parallel gene analysis with allele-specific padlock probes and tag microarrays Nucleic Acids Res Sep. 1, 2003 e103 31.

Boutla, A., C. Delidakis and M. Tabler. Developmental defects by antisense-mediated inactivation of micro-RNAs 2 and 13 in *Drosophila* and the identification of putative target genes Nucleic Acids Res Sep. 1, 2003 4973-4980 31.

Palatnik, J. F., E. Allen, X. Wu, C. Schommer, R. Schwab, J. C. Carrington and D. Weigel. Control of leaf morphogenesis by microRNAs Nature Sep. 18, 2003 257-263 425.

Klein, R. J. and S. R. Eddy. Rsearch: finding homologs of single structured RNA sequences BMC Bioinformatics Sep. 22, 2003 44 4.

Caudy, A. A., R. F. Ketting, S. M. Hammond, A. M. Denli, A. M. Bathoorn, B. B. Tops, J. M. Silva, M. M. Myers, G. J. Hannon and R. H. Plasterk. A micrococcal nuclease homologue in RNAi effector complexes Nature Sep. 25, 2003 411-414 425.

Lee, Y., C. Ahn, J. Han, H. Choi, J. Kim, J. Vim, J. Lee, P. Provost, O. Radmark, S. Kim and V. N. Kim. The nuclear RNase III Drosha initiates microRNA processing Nature Sep. 25, 2003 415-419 425.

Sledz, C. A., M. Holko, M. J. De Veer, R. H. Silverman and B. R. Williams. Activation of the interferon system by short-interfering RNAs Nat Cell Biol Sep. 2003 834-839 5.

Bergmann, A. and M. E. Lane. HIDden targets of microRNAs for growth control Trends Biochem Sci Sep. 2003 461-463 28.

Khvorova, A., A. Reynolds and S. D. Jayasena. Functional siRNAs and miRNAs exhibit strand bias Cell Oct. 17, 2003 209-216 115.

Schwarz, D. S., G. Hutvagner, T. Du, Z. Xu, N. Aronin and P. D. Zamore. Asymmetry in the assembly of the RNAi enzyme complex Cell Oct. 17, 2003 199-208 115.

Abbott; A. L. Heterochronic genes Curr Biol Oct. 28, 2003 R824-825 13.

Hake, S. MicroRNAs: a role in plant development Curr Biol Oct. 28, 2003 R851-852 13.

Carthew, R. W. Making and breaking with nucleases and small RNAs Nat Struct Biol Oct. 2003 776-777 10.

Krichevsky, A. M., K. S. King, C. P. Donahue, K. Khrapko and K. S. Kosik. A microRNA array reveals extensive regulation of microRNAs during brain development Rna Oct. 2003 1274-1281 9.

Mattick, J. S. Challenging the dogma: the hidden layer of non-protein-coding RNAs in complex organisms Bioessays Oct. 2003 930-939 25.

Nelson, P., M. Kiriakidou, A. Sharma, E. Maniataki and Z. Mourelatos. The microRNA world: small is mighty Trends Biochem Sci Oct. 2003 534-540 28.

Michael, M. Z., O. C. SM, N. G. Van Holst Pellekaan, G. P. Young and R. J. James. Reduced accumulation of specific microRNAs in colorectal neoplasia Mol Cancer Res Oct. 2003 882-891 1.

Allinson, T. M., E. T. Parkin, A. J. Turner and N. M. Hooper. ADAMs family members as amyloid precursor protein alpha-secretases J Neurosci Res Nov. 1, 2003 342-352 74.

Kawasaki, H. and K. Taira. Retraction: Hes1 is a target of microRNA-23 during retinoic-acid-induced neuronal differentiation of NT2 cells Nature Nov. 6, 2003 100 426.

Saxena, S., Z. O. Jonsson and A. Dutta. Small RNAs with imperfect match to endogenous mRNA repress translation. Implications for off-target activity of small inhibitory RNA in mammalian cells J Biol Chem Nov. 7, 2003 44312-44319 278.

Basyuk, E., F. Suavet, A. Doglio, R. Bordonne and E. Bertrand. Human let-7 stem-loop precursors harbor features of RNase III cleavage products Nucleic Acids Res Nov. 15, 2003 6593-6597 31.

Stevenson, M. Dissecting HIV-1 through RNA interference Nat Rev Immunol Nov. 2003 851-858 3.

Wienholds, E., M. J. Koudijs, F. J. Van Eeden, E. Cuppen and R. H. Plasterk. The microRNA-producing enzyme Dicer1 is essential for zebrafish development Nat Genet Nov. 2003.

Gibbs, W. W. The unseen genome: gems among the junk Sci Am Nov. 2003 26-33 289.

Chang, J., P. Provost and J. M. Taylor. Resistance of human hepatitis delta virus RNAs to dicer activity J Virol Nov. 2003 11910-11917 77.

Wang, D., A. Urisman, Y. T. Liu, M. Springer, T. G. Ksiazek, D. D. Erdman, E. R. Mardis, M. Hickenbotham, V. Magrini, J. Eldred, J. P. Latreille, R. K. Wilson, D. Ganem and J. L. Derisi. Viral discovery and sequence recovery using DNA microarrays PLoS B.

Aukerman, M. J. and H. Sakai. Regulation of flowering time and floral organ identity by a MicroRNA and its APETALA2-like target genes Plant Cell Nov. 2003 2730-2741 15.

Stein, T. D. and J. A. Johnson. Genetic programming by the proteolytic fragments of the amyloid precursor protein: somewhere between confusion and clarity Rev Neurosci *no date in pubmed* 2003 317-341 14.

Szymanski, M., M. Z. Barciszewska, M. Zywicki and J. Barciszewski. Noncoding RNA transcripts J Appl Genet *No Datein Pubmed* 2003 1-19 44.

Van Den Akker et al. Development, 2001;128:1911-21.

Knoepfler et al. Oncogene, 2001;5440-8.

Lau NC, et al. Science, 2001;294:858-62.

Lagos-Quintana M, et al. Science, 2001;294-853-8.

Moss EG, et al. Cell, 1997;88:637-46.

Reinhart BJ, et al. Nature, 2000;43:901-6.

Slack FJ, et al. Mol Cell, 2000;5:659-69.

Wightman B, et al. Cell, 1993;75:855-62.

Yekta et al. Science, 2004;304:594-6.

Cohen et al. Endocrinology, 2008:149:1687-96; first published Dec. 20, 2007 as doi: 10.1210/en.2007-0969.

Petit, M.M.R. LHFP, a Novel Translocation Partner Gene of HMGIC in a Lipoma, is a Member of a New Family of LHFP-like Genes. Genomics 1999;57(3)438-41 (Abstract Only).

Nagase, T, Prediction of the Coding Sequences of Unidentified Human Genes. VI. The Coding Sequences of 80 New Genes (KIAA0201-KIAA0280) Deduced by Analysis of cDNA Clones from Cell Line KG-1 and Brain. DNA Research 1996;3:321-9.

Longo-Guess, C.M. A missense mutation in the previously undescribed gene Tmhs underlies deafness in hurry-scurry (hscy) mice. PNAS 2005;102(22):7894-9.

Meng et al., MicroRNA-21 Regulates Expression of the PTEN Tumor Suppressor Gene in Human Hepatocellular Gene, Gastroenterology 133:647-658 (2007).

Shabbir et al., Mutations of Human TMHS Cause Recessively Inherited Non-syndromic Hearing Loss, Journal of Medical Genetics 43:634-640 (2006).

* cited by examiner

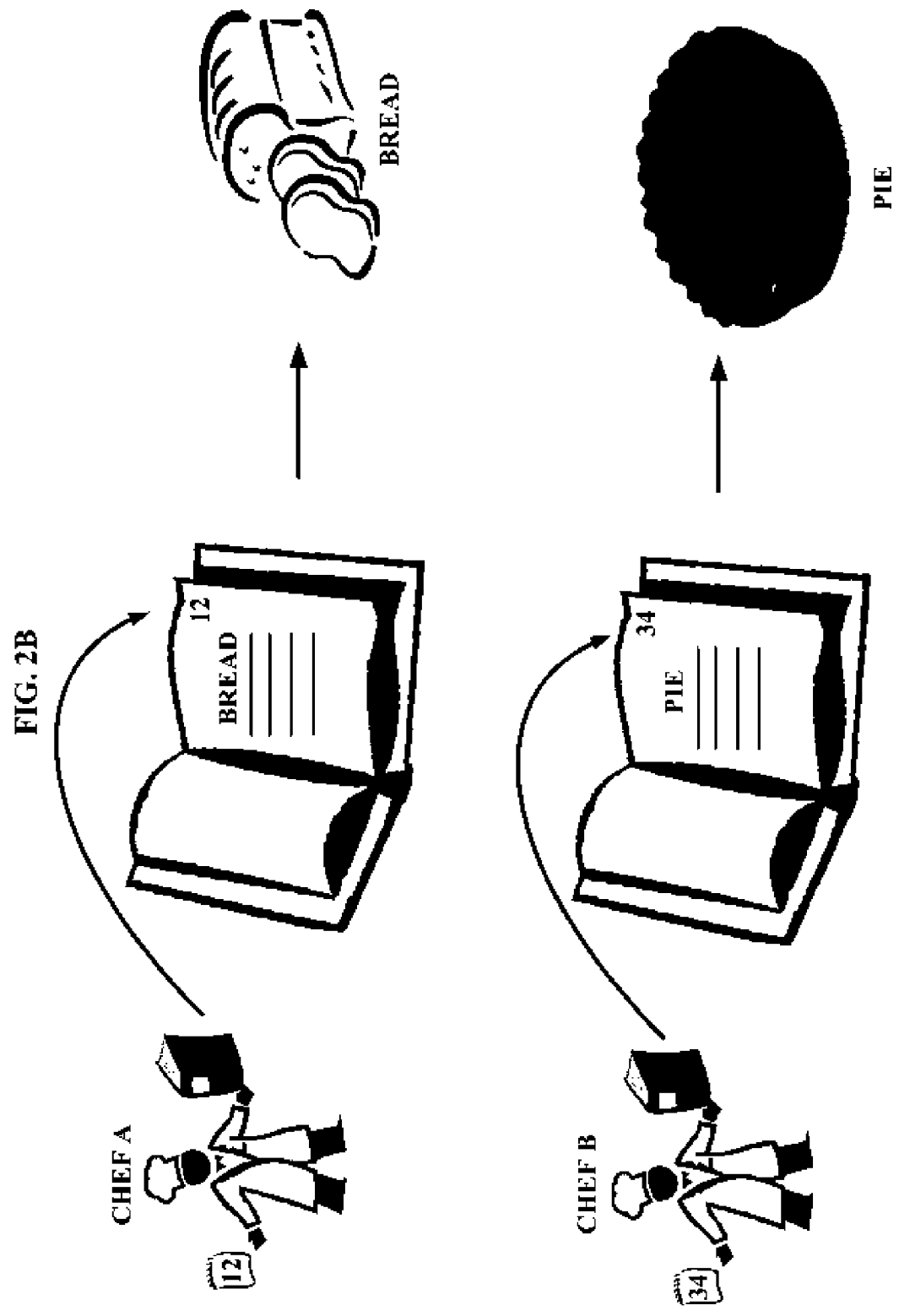

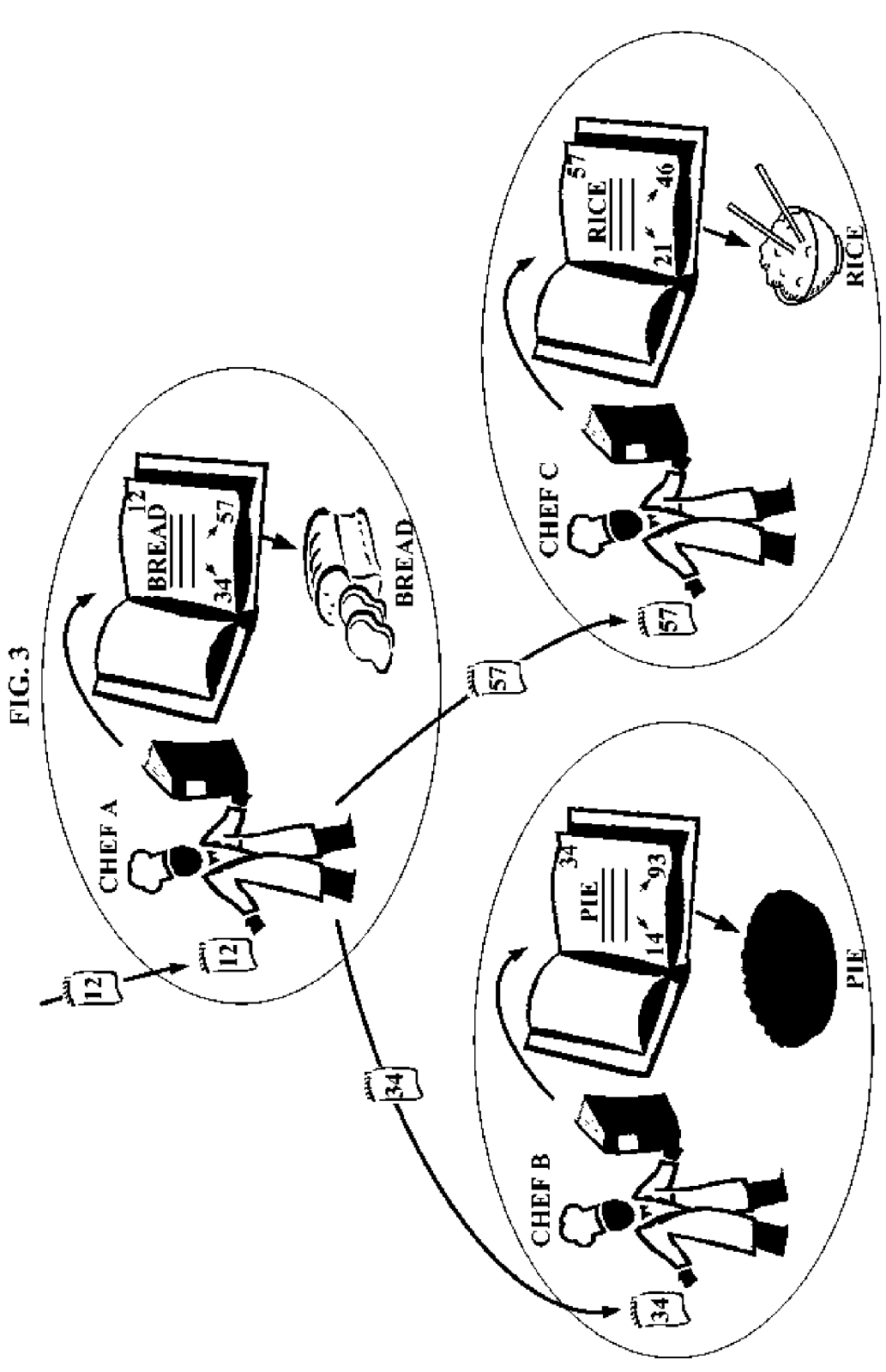

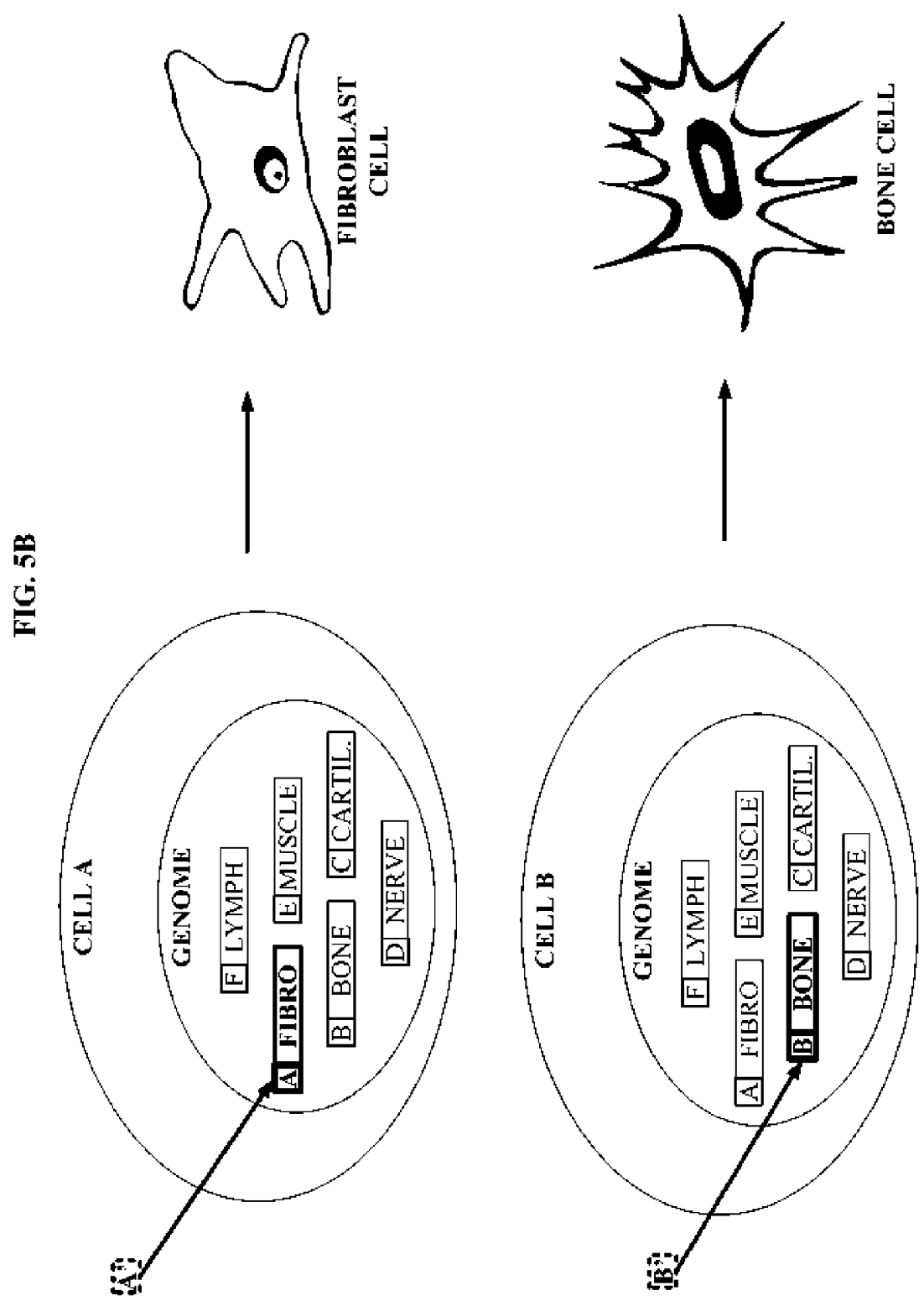

TRAIN ENGINE ON KNOWN GENES — 122

- HAIRPIN DETECTOR TRAINING & VALIDATION — 124
- DICER-CUT LOCATION DETECTOR TRAINING & VALIDATION — 126
- TARGET-GENE BINDING-SITE DETECTOR TRAINING & VALIDATION — 128

DETECT SAMPLE NOVEL GENES — 130

VALIDATE EXPRESSION & FUNCTION OF SAMPLE GENES BY WET-LAB — 132

FIG. 21

| Detection Accuracy Group | Number of Published MIRs | Lab Validation | | | Novel GAMs | Hairpins in RNA Database | |
|---|---|---|---|---|---|---|---|
| | | Sent | Positive | % success | | Number | Expected |
| A | 82 | 10 | 5 | 50% | 562 | 564 | 282 |
| B | 146 | 91 | 32 | 35% | 526 | 813 | 285 |
| C | 38 | 30 | 9 | 30% | 625 | 2080 | 624 |
| D | 78 | 16 | 4 | 25% | 3034 | 11512 | 2878 |
| Overall | 344 | 147 | 50 | 34% | 4747 | 14969 | 4069 |

FIG. 24A

EST72223 (705 nt.)

EST72223 sequence:

CCCTTATTAGAGGATTCTGCTCATGCCAGG**GTGAGGTAGTAAGTTGTATTG
TTGTGGGGTAGGGATATTAGGCCCCAATTAGAAGATAACTATACAACT** MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCT**GAGGCAGGAGAATTGCTTGAACCCAGGAAGTGGAG
GCTTCAGTGAGCTGAGAACACGCCACTGCACTCCAGTCCTGGGCAAC
AGAGCAAGACTCTGTCTC**AGGAAAAAAAAAG  GAM25

FIG. 24B

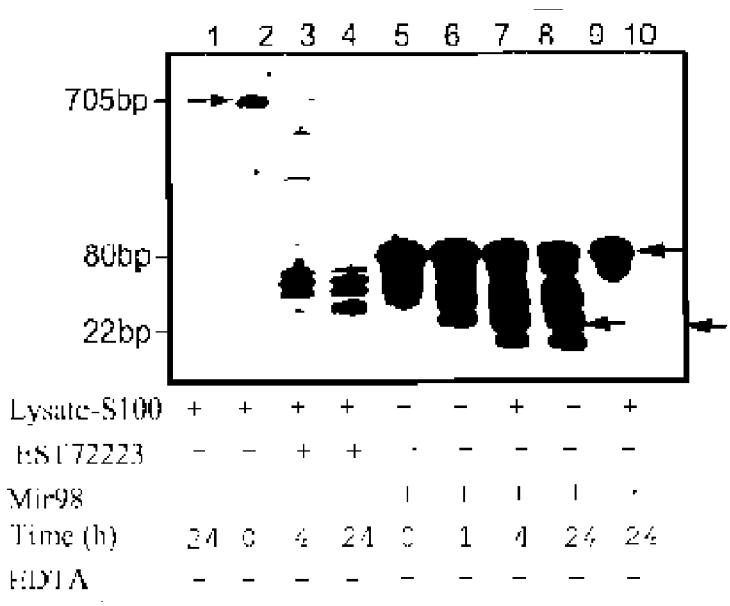

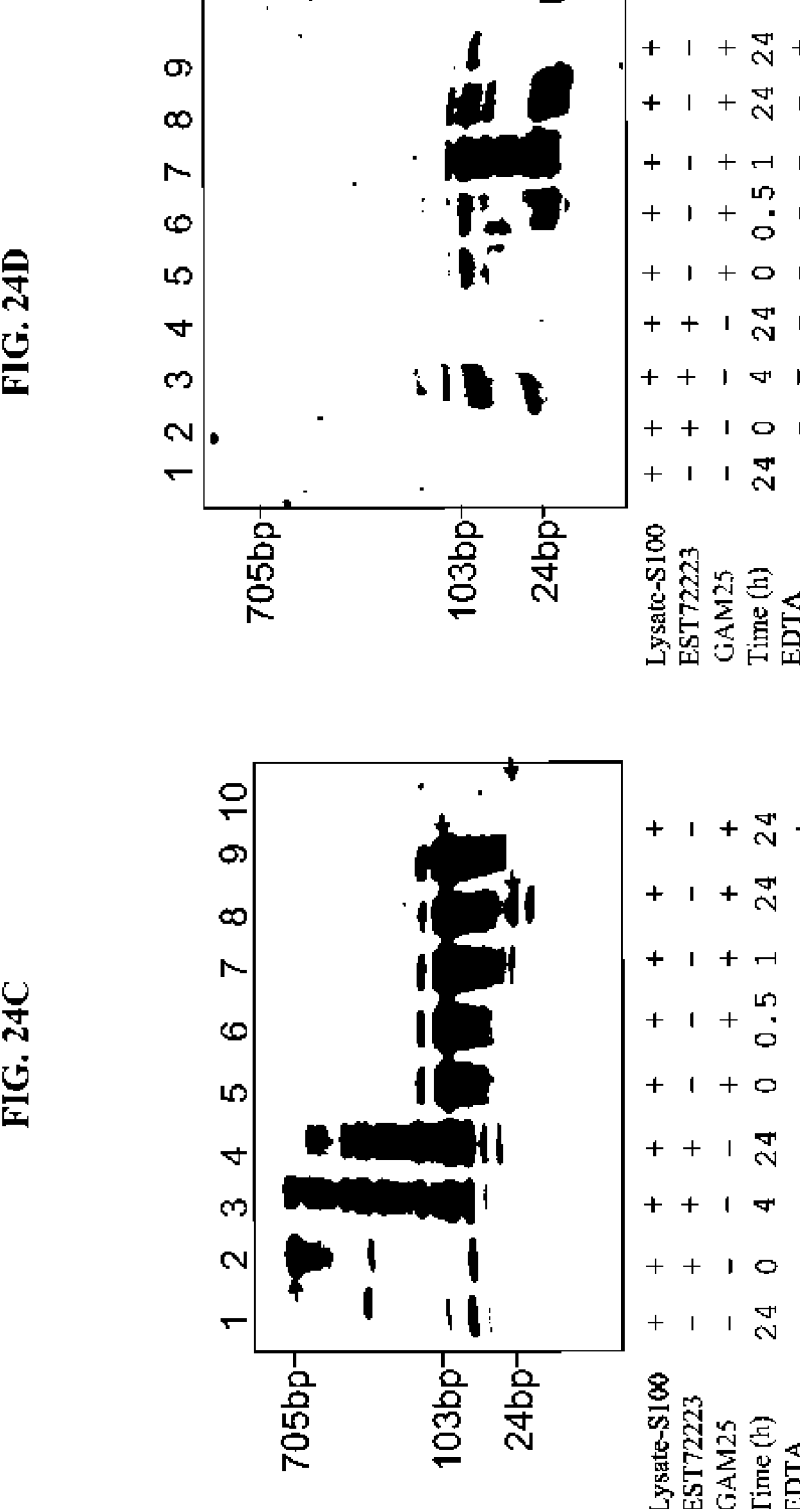

US 8,163,896 B1

BIOINFORMATICALLY DETECTABLE GROUP OF NOVEL REGULATORY GENES AND USES THEREOF

BACKGROUND OF THE INVENTION

Continuation Statement

This application is a continuation in part of U.S. Provisional Patent Application Ser. No. 60/468,251, filed 7 May 2003, entitled "Bioinformatically Detectable Group of Novel Regulatory Genes and Uses Thereof", and is a continuation of U.S. patent application Ser. No. 10/604,985, filed 29 Aug. 2003, entitled "Bioinformatically Detectable Group of Novel Regulatory Genes and Uses Thereof", and is a continuation in part of U.S. Provisional Patent Application Ser. No. 10/345,201, filed 16 Jan. 2003, entitled "Bioinformatically Detectable Group of Novel Regulatory Genes and Uses Thereof", and is a continuation in part of U.S. patent application Ser. No. 10/293,338, filed 14 Nov. 2002, entitled "Bioinformatically Detectable Group of Novel Regulatory Genes and Uses Thereof", and is a continuation in part of U.S. patent application Ser. No. 10/310,914, filed 6 Dec. 2002, entitled "Bioinformatically Detectable Group of Novel Regulatory Genes and Uses Thereof", and is a continuation in part of U.S. patent application Ser. No. 10/321,503, filed 18 Dec. 2002, entitled "Bioinformatically Detectable Group of Novel Regulatory Genes and Uses Thereof", and is a continuation in part of U.S. patent application filed 29 Aug. 2003, entitled "Bioinformatically Detectable Group of Novel Regulatory Genes and Uses of Thereof", and is a continuation in part of U.S. patent application Ser. No. 10/604,926, filed 27 Aug. 2003, entitled "Bioinformatically Detectable Group of Novel Regulatory Genes and Uses Thereof", and is a continuation in part of U.S. patent application, filed 28 Aug. 2003, entitled "Bioinformatically Detectable Group of Novel Regulatory Genes and Uses Thereof", and is a continuation in part of U.S. patent application Ser. No. 10/604,726, filed 13 Aug. 2003, entitled "Bioinformatically Detectable Group of Novel Regulatory Genes and Uses Thereof", and is a continuation in part of U.S. patent application Ser. No. 10/604,727, filed 13 Aug. 2003, entitled "Bioinformatically Detectable Group of Novel Regulatory Genes and Uses Thereof", the disclosures of which applications are all hereby incorporated by reference and claims priority therefrom.

BRIEF DESCRIPTION OF SEQUENCE LISTING, LARGE TABLES AND COMPUTER PROGRAM LISTING

Sequence listing attached to the present invention. The Sequence listing comprising 20,189 genomic sequences, and is contained in a file named SEQ_LIST.EXE (2991KB).

Large tables relating to genomic sequences are stored in 5 text files, each comprising a respective one of the following table files: TABLE1. TXT (18KB); TABLE2. TXT (102KB); TABLE3. TXT (16KB); TABLE4. TXT (13855KB) and TABLE5. TXT (9467KB).

Computer program listing of a computer program constructed and operative in accordance with a preferred embodiment of the present invention is enclosed on an electronic medium in computer readable form, and is hereby incorporated by reference. The computer program listing is contained in 7 text files, the name and sizes of which are as follows: AUXILARY_FILES. TXT (117K); BINDING_SITE_SCORING. TXT (17K); EDIT_DISTANCE. TXT (144K); FIRST-K. TXT (96K); HAIRPIN_PREDICTIO. TXT (47K); TWO_PHASED_PREDICTOR. TXT (74K);and TWO-PHASED-SIDE-SELECTOR. TXT (4K).

FIELD OF THE INVENTION

The present invention relates to a group of bioinformatically detectable novel genes, here identified as Genomic Address Messenger or GAM genes, which are believed to be related to the micro RNA (miRNA) group of genes.

DESCRIPTION OF PRIOR ART

MIR genes are regulatory genes encoding MicroRNA's (miRNA), short ~22 nt non-coding RNA's, found in a wide range of species, believed to function as specific gene translation repressors, sometimes involved in cell-differentiation. Some 110 human MIR genes have been detected by laboratory means. Over the past 6 months, the need for computerized detection of MIR genes has been recognized, and several informatic detection engines have been reported (Lim, 2003; Grad, 2003; Lai, 2003). Collectively these informatic detection engines found 38 more human MIR genes which were later confirmed in zebrafish, 14 human MIR genes which were confirmed in human, and 55 postulated human MIR genes which could not be confirmed by laboratory (Lim, 2003). Extensive efforts to identify novel MIR genes using conventional biological detection techniques such as massive cloning and sequencing efforts, and several bioinformatic detection attempts, have led leading researchers in the field to the conclusion that the total number of human MIR genes is between 200 to 255 (Lau, 2003; Lim 2003 Science; Lim, 2003 Genes Dev). Recent studies postulate that the number of MIR genes may be higher (Grad, 2003; Krichevsky, 2003).

The ability to detect novel MIR genes is limited by the methodologies used to detect such genes. All MIR genes identified so far either present a visibly discernable whole body phenotype, as do Lin-4 and Let-7 (Wightman, 1993; Reinhart, 2000), or produce sufficient quantities of RNA so as to be detected by the standard molecular biological techniques.

Initial studies reporting MIR genes (Bartel, 2001; Tuschl, 2001) discovered 93 MIR genes in several species, by sequencing a limited number of clones (300 by Bartel and 100 by Tuschl) of small segments (i.e. size fractionated) RNA. MiRNA encoded by MIR genes detected in these studies

LENGTHY TABLES

The patent contains a lengthy table section. A copy of the table is available in electronic form from the USPTO web site (http://seqdata.uspto.gov/?pageRequest=docDetail&DocID=US08163896B1). An electronic copy of the table will also be available from the USPTO upon request and payment of the fee set forth in 37 CFR 1.19(b)(3).

therefore, represent the more prevalent among the miRNA gene family, and can not be much rarer than 1% of all small ~20 nt-long RNA segments.

Current methodology has therefore been unable to detect micro RNA genes (MIR genes) which either do not present a visually discernable whole body phenotype, or are rare (e.g. rarer than 0.1% of all size fractionated ~20 nt-long RNA segments expressed in the tissues examined), and therefore do not produce significant enough quantities of RNA so as to be detected by standard biological techniques.

SUMMARY OF THE INVENTION

The present invention relates to a novel group of regulatory, non-protein coding genes, which are functional in specifically inhibiting translation of target proteins. Each gene in this novel group of genes, here identified as GAM or Genomic Address Messengers, specifically inhibits translation of one of more other 'target' genes by means of complementary hybridization of a segment of the RNA transcript encoded by GAM, to an inhibitor site located in an untranslated region (UTR) of the mRNA of the one or more 'target' genes.

In various preferred embodiments, the present invention seeks to provide improved method and system for specific modulation of expression of specific known 'target' genes involved in significant human diseases, and improved method and system for detection of expression of novel genes of the present invention, which modulate these target genes.

Accordingly, the invention provides several substantially pure DNAs (e.g., genomic DNA, cDNA or synthetic DNA) each encoding a novel gene of the GAM group of gene, vectors comprising the DNAs, probes comprising the DNAs, a method and system for selectively modulating translation of known 'target' genes utilizing the vectors, and a method and system for detecting expression of known 'target' genes utilizing the probe.

By "substantially pure DNA" is meant DNA that is free of the genes which, in the naturally-occurring genome of the organism from which the DNA of the invention is derived, flank the genes discovered and isolated by the present invention. The term therefore includes, for example, a recombinant DNA which is incorporated into a vector, into an autonomously replicating plasmid or virus, or into the genomic DNA of a prokaryote or eukaryote at a site other than its natural site; or which exists as a separate molecule (e.g., a cDNA or a genomic or cDNA fragment produced by PCR or restriction endonuclease digestion) independent of other sequences. It also includes a recombinant DNA which is part of a hybrid gene encoding additional polypeptide sequence.

"Inhibiting translation" is defined as the ability to prevent synthesis of a specific protein encoded by a respective gene, by means of inhibiting the translation of the mRNA of this gene. "Translation inhibitor site" is defined as the minimal DNA sequence sufficient to inhibit translation.

There is thus provided in accordance with a preferred embodiment of the present invention a bioinformatically detectable novel gene encoding substantially pure DNA wherein RNA encoded by the bioinformatically detectable novel gene is about 18 to about 24 nucleotides in length, and originates from an RNA precursor, which RNA precursor is about 50 to about 120 nucleotides in length, a nucleotide sequence of a first half of the RNA precursor is a partial or accurate inversed reversed sequence of a nucleotide sequence of a second half thereof, a nucleotide sequence of the RNA encoded by the novel gene is a partial or accurate inversed reversed sequence of a nucleotide sequence of a binding site associated with at least one target gene, the novel gene cannot be detected by either of the following: a visually discernable whole body phenotype, and detection of 99.9% of RNA species shorter than 25 nucleotides expressed in a tissue sample, and a function of the novel gene is bioinformatically deducible.

There is still further provided in accordance with another preferred embodiment of the present invention a bioinformatically detectable novel gene encoding substantially pure DNA wherein RNA encoded by the bioinformatically detectable novel gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel gene is a partial or accurate inversed reversed sequence of nucleotide sequence of a second half thereof, a nucleotide sequence of each of the RNA segments encoded by the novel gene is a partial or accurate inversed reversed sequence of the nucleotide sequence of a binding site associated with at least one target gene, and a function of the novel gene is bioinformatically deducible from the following data elements: the nucleotide sequence of the RNA encoded by the novel gene, a nucleotide sequence of the at least one target gene, and function of the at least one target gene.

There is additionally provided in accordance with another preferred embodiment of the present invention a bioinformatically detectable novel gene encoding substantially pure DNA wherein RNA encoded by the bioinformatically detectable novel gene is about 18 to about 24 nucleotides in length, and originates from an RNA precursor, which RNA precursor is about 50 to about 120 nucleotides in length, a nucleotide sequence of a first half of the RNA precursor is a partial or accurate inversed reversed sequence of a nucleotide sequence of a second half thereof, a nucleotide sequence of the RNA encoded by the novel gene is a partial or accurate inversed reversed sequence of a nucleotide sequence of a binding site associated with at least one target gene, a function of the novel gene is modulation of expression of the at least one target gene, and the at least one target gene does not encode a protein.

There is moreover provided in accordance with another preferred embodiment of the present invention a bioinformatically detectable novel gene encoding substantially pure DNA wherein the bioinformatically detectable novel gene does not encode a protein, RNA encoded by the bioinformatically detectable novel gene is maternally transferred by a cell to at least one daughter cell of the cell, a function of the novel gene includes modulation of a cell type of the daughter cell, and the modulation is bioinformatically deducible.

There is further provided in accordance with another preferred embodiment of the present invention a bioinformatically detectable novel gene encoding substantially pure DNA wherein the bioinformatically detectable novel gene does not encode a protein, a function of the novel gene is promotion of expression of the at lease one target gene, and the at least one target gene is bioinformatically deducible.

Still further in accordance with a preferred embodiment of the present invention the function of the novel gene is bioinformatically deducible from the following data elements: the nucleotide sequence of the RNA encoded by the bioinformatically detectable novel gene, a nucleotide sequence of the at least one target gene, and a function of the at least one target gene.

Additionally in accordance with a preferred embodiment of the present invention the RNA encoded by the novel gene complementarily binds the binding site associated with the at least one target gene, thereby modulating expression of the at least one target gene.

Moreover in accordance with a preferred embodiment of the present invention the binding site associated with at least one target gene is located in an untranslated region of RNA encoded by the at least one target gene.

Further in accordance with a preferred embodiment of the present invention the function of the novel gene is selective inhibition of translation of the at least one target gene, which selective inhibition includes complementary hybridization of the RNA encoded by the novel gene to the binding site.

Still further in accordance with a preferred embodiment of the present invention, the present invention includes a vector including the DNA.

Additionally in accordance with a preferred embodiment of the present invention, the present invention includes a method of selectively inhibiting translation of at least one gene, including introducing the vector into a cell.

Moreover in accordance with a preferred embodiment of the present invention the introducing includes utilizing RNAi pathway.

Further in accordance with a preferred embodiment of the present invention, the present invention includes a gene expression inhibition system including: the vector and a vector inserter, functional to insert the vector of claim 10 into a cell, thereby selectively inhibiting translation of at least one gene.

Still further in accordance with a preferred embodiment of the present invention, the present invention includes a probe including the DNA.

Additionally in accordance with a preferred embodiment of the present invention, the present invention includes a method of selectively detecting expression of at least one gene, including using the probe.

Moreover in accordance with a preferred embodiment of the present invention, the present invention includes a gene expression detection system including: the probe, and a gene expression detector functional to selectively detect expression of at least one gene.

BRIEF DESCRIPTION OF THE DRAWINGS

FIGS. 2, 3 and 4 are schematic diagrams which when taken together provide an analogy that illustrates a conceptual model of the present invention, addressing the genomic differentiation enigma;

FIGS. 5A and 5B are schematic diagrams, which when taken together illustrate a 'genomic records' concept of the conceptual model of the present invention, addressing the genomic differentiation enigma;

FIG. 8 is a simplified diagram illustrating a mode by which genes of a novel group of genes of the present invention, modulate expression of known target genes;

FIG. 10 is a simplified flowchart illustrating operation of a mechanism for training of a computer system to recognize the novel genes of the present invention, which mechanism is constructed and operative in accordance with a preferred embodiment of the present invention;

FIG. 21 is a table summarizing laboratory validation results which validate efficacy of a bioinformatic gene detection system constructed and operative in accordance with a preferred embodiment of the present invention;

FIG. 24A is an annotated sequence of EST72223 (SEQ ID NO: 20200) comprising known miRNA gene MIR98 and novel gene GAM25, both detected by the gene detection system of the present invention; and FIGS. 24B, 24C and 24D are pictures of laboratory results demonstrating laboratory confirmation of expression of known gene MIR98 and of novel bioinformatically detected gene GAM25 respectively, both of FIG. 24A, thus validating the bioinformatic gene detection system of the present invention.

BRIEF DESCRIPTION OF THE SEQUENCES

A Sequence Listing of genomic sequences of the present invention designated SEQ ID:1 through SEQ ID:20189 is attached to this application. The genomic listing comprises the following nucleotide sequences:Genomic sequences designated SEQ ID:1 through SEQ ID:200 are nucleotide sequences of 200 gene precursors of respective novel genes of the present invention;Genomic sequences designated SEQ ID:201 through SEQ ID:400 are nucleotide sequences of 199 genes of the present invention; and Genomic sequences designated SEQ ID:401 through SEQ ID:20189 are nucleotide sequences of 19789 target gene binding sites.

DETAILED DESCRIPTION

Figure 1:
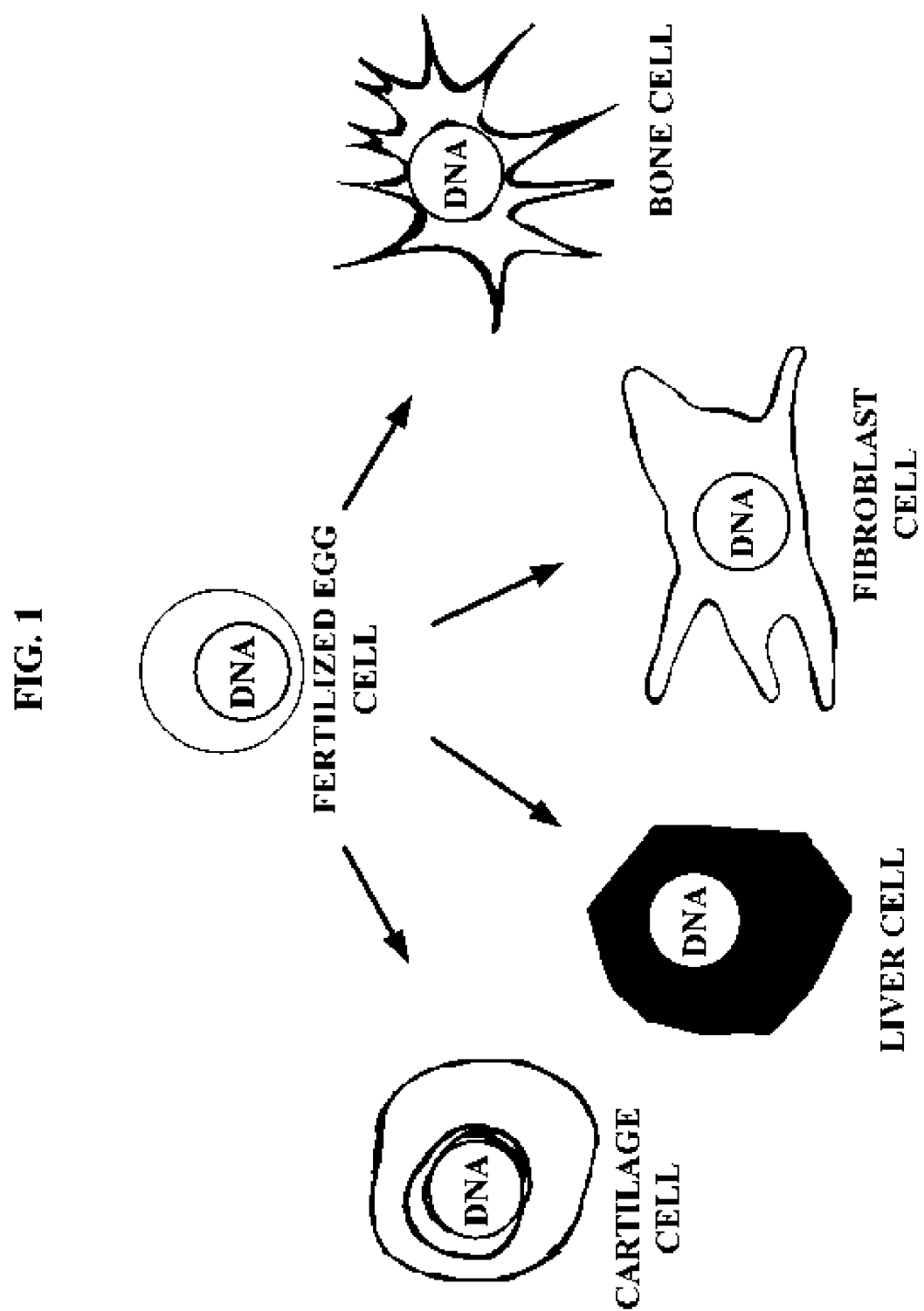
FIG. 1 is a simplified diagram illustrating the genomic differentiation enigma that the present invention addresses.

Reference is now made to FIG. 1 which is a simplified diagram providing a conceptual explanation of a genomic differentiation enigma, which the present invention addresses.

FIG. 1 depicts different cell types in an organism, such as CARTILAGE CELL, LIVER CELL, FIBROBLAST CELL and BONE CELL all containing identical DNA, and deriving from the initial FERTILIZED EGG CELL, and yet each of these cells expressing different proteins, and hence acquiring different shape and function.

The present invention proposes that the inevitable conclusion from this constraint is, however, strikingly simple: the coding system used must be modular. It must comprise multiple modules, or records, one for each cell-type, and a mechanism whereby each cell at its inception is instructed which record to open, and behaves according to instructions in that record.

This modular code concept is somewhat difficult to grasp, since we are strongly habituated to viewing things from an external viewpoint. An architect, for example, looks at a blueprint of a building, which details exactly where each element (block, window, door, electrical switch, etc.) is to be placed relative to all other elements, and then instructs builders to place these elements in their designated places. This is an external viewpoint: the architect is external to the blueprint, which itself is external to the physical building, and its different elements. The architect may therefore act as an "external organizing agent": seeing the full picture and the relationships between all elements, and being able to instruct from the outside where to place each of them.

Genomics differentiation coding evidently works differently, without any such external organizing agent: It comprises only one smart block (the first cell), which is the architect and the blueprint, and which continuously duplicates itself, somehow knowing when to manifest itself as a block and when as a window, door, or electrical switch.

Figure 4:
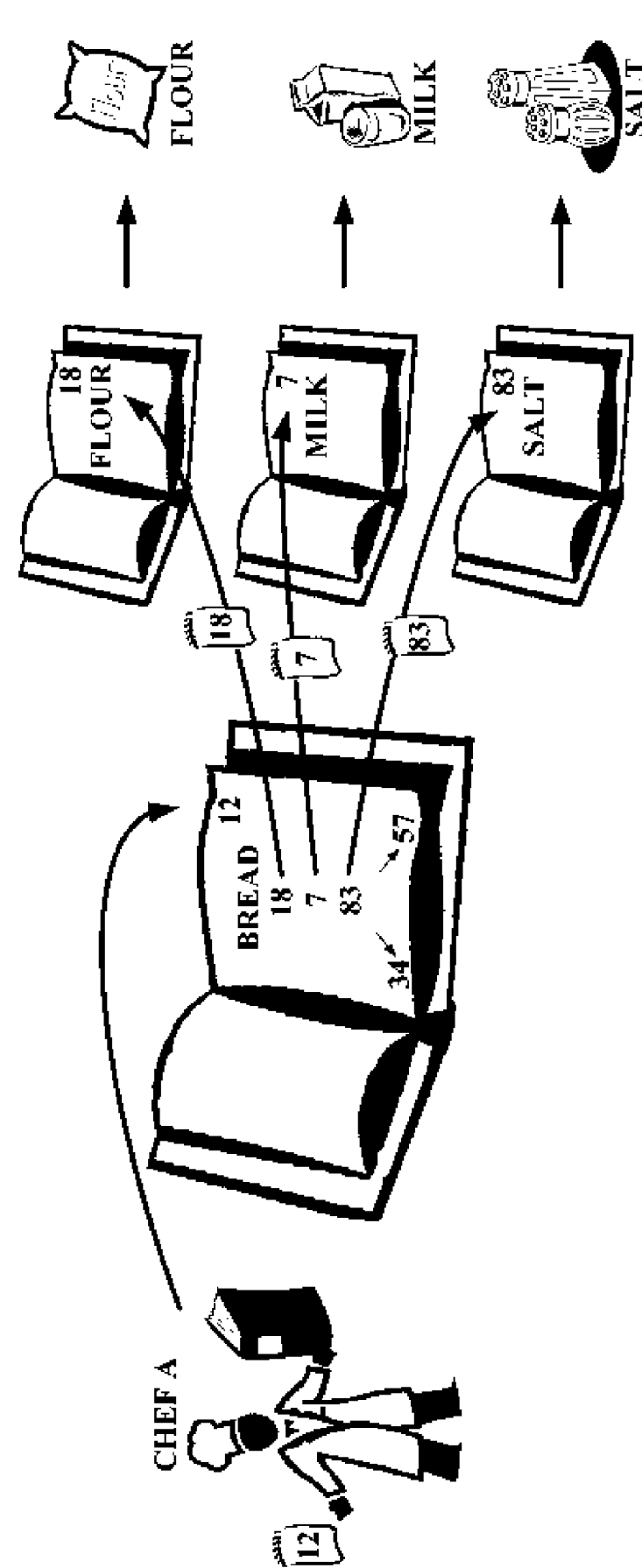

Reference is now made to FIGS. 2 through 4 which are schematic diagrams which when taken together provide an analogy that illustrates a conceptual model of the present invention, addressing the genomic differentiation enigma.

Figure 2A:
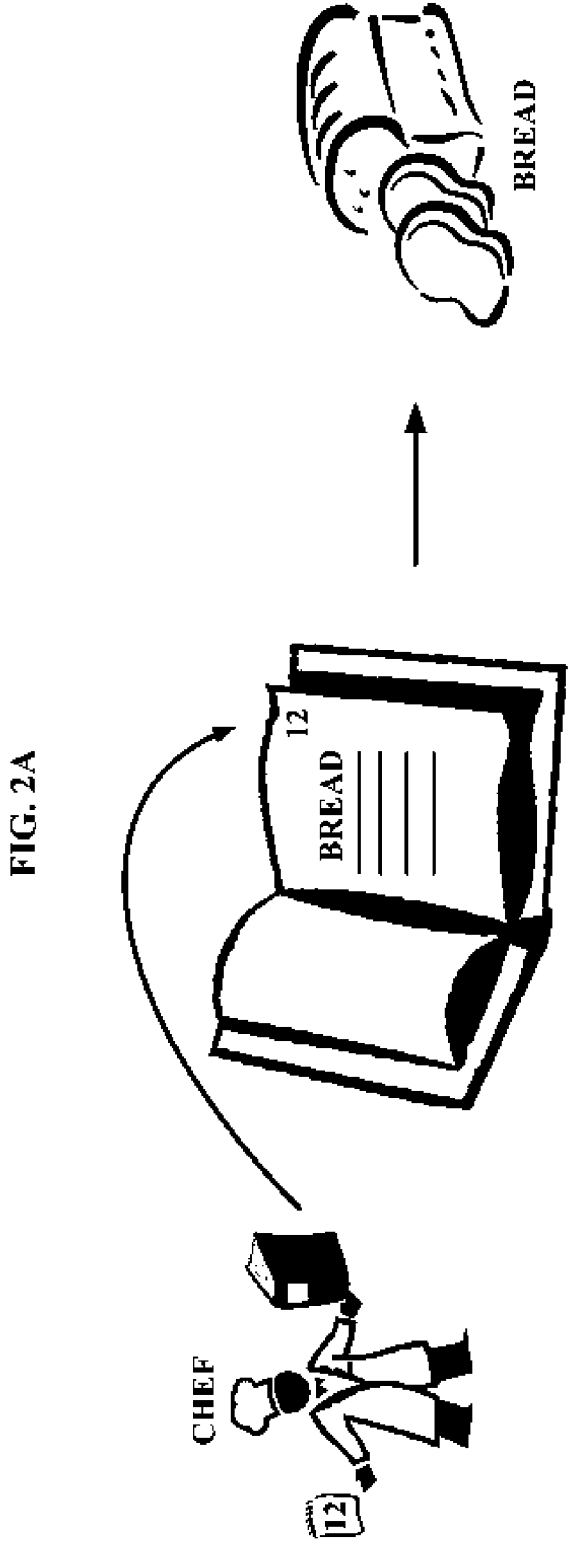

Reference is now made to FIG. 2A. Imagine a very talented chef, capable of preparing any meal provided he is given specific written cooking instructions. This chef is equipped with two items: (a) a thick recipe book, and (b) a small note with a number scribbled on it. The book comprises multiple pages, each page detailing how to prepare a specific meal. The small note indicates the page to be opened, and therefore the meal to be prepared. The chef looks at the page-number written on the note, opens the recipe book at the appropriate page, and prepares the meal according to the written instructions on this page. As an example, FIG. 2A depicts a CHEF holding a note with the number 12 written on it, he opens the book on page 12, and since that page contains the recipe for preparing BREAD, the CHEF prepares a loaf of BREAD.

Reference is now made to FIG. 2B, which depicts two identical chefs, CHEF A and CHEF B, holding an identical recipe book. Despite their identity, and the identity of their recipe book, since CHEF A holds a note numbered 12, and therefore opens the book on page 12 and prepares BREAD, whereas CHEF B holds a note numbered 34 and therefore opens the book on page 34 and prepares a PIE.

Reference is now made to FIG. 3. Imagine the chef of the analogy is also capable of duplicating himself once he has finished preparing the specified meal. The format of the book is such that at the bottom of each page, two numbers are written. When he has finished preparing the meal specified on that page, the chef is trained to do the following: (i) divide himself into two identical duplicate chefs, (ii) duplicate the recipe book and hand a copy to each of his duplicate chefs, and (iii) write down the two numbers found at the bottom of the page of the meal he prepared, on two small notes, handing one note to each of his two duplicate chefs.

Each of the two resulting duplicate chefs are now equipped with the same book, and have the same talent to prepare any meal, but since each of them received a different note, they will now prepare different meals.

FIG. 3 depicts CHEF A holding a recipe book and receiving a note numbered 12. CHEF A therefore opens the book on page 12 and prepares BREAD. When he is finished making bread, CHEF A performs the following actions: (i) divides himself into two duplicate chefs, designated CHEF B and CHEF C, (ii) duplicates his recipe book handing a copy to each of CHEF B and CHEF C, (iii) writes down the numbers found at the bottom of page 12, numbers 34 and 57, on two notes, handing note numbered 34 to CHEF B and note numbered 57 to CHEF C.

Accordingly, CHEF B receives a note numbered 34 and therefore opens the recipe book on page 34 and prepares PIE, whereas CHEF C receives a note numbered 57 and therefore opens the book on page 57 and therefore prepares RICE.

It is appreciated that while CHEF A, CHEF B & CHEF C are identical and hold identical recipe books, they each prepare a different meal. It is also appreciated that the meals prepared by CHEF B and CHEF C are determined CHEF A, and are mediated by the differently numbered notes passed on from CHEF A to CHEF B and CHEF C.

It is further appreciated that the mechanism illustrated by FIG. 3 enables an unlimited lineage of chefs to divide into duplicate, identical chefs and to determine the meals those duplicate chefs would prepare. For example, having been directed to page 34, when CHEF B divides into duplicate chefs (not shown), he will instruct its two duplicate chefs to prepare meals specified on pages 14 and 93 respectively, according to the numbers at the bottom of page 34 to which he was directed. Similarly, CHEF C will instruct its duplicate chefs to prepare meals specified on pages 21 and 46 respectively, etc.

Reference is now made to FIG. 4. Imagine that the cooking instructions on each page of the recipe book are written in shorthand format: The main meal-page to which the chef was directed by the scribbled note, merely contains a list of numbers which direct him to multiple successive pages, each specifying how to prepare an ingredient of that meal.

As an example, FIG. 4 depicts CHEF A of FIGS. 2 and 3, holding a recipe book and a note numbered 12. Accordingly, CHEF A opens the recipe book on page 12, which details the instructions for preparing BREAD. However, the "instructions" on making BREAD found on page 12 comprise only of 3 numbers, 18, 7 and 83, which "refer" CHEF A to pages detailing preparation of the ingredients of BREAD FLOUR, MILK and SALT, respectively.

As illustrated in FIG. 4, turning from the main "meal page" (e.g. 12) to respective "ingredients pages" (e.g. pages 18, 7 & 83) is mediated by scribbled notes with the page-numbers written on them. In this analogy, the scribbled notes are required for seeking the target pages to be turned to both when turning to main "meal pages" (e.g. page 12), as well as when turning to "ingredient pages" (e.g. pages 18, 7 & 83).

The chef in the given analogy, schematically depicted in FIGS. 2 through 4, represents a cell; the thick recipe book represents the DNA; preparing a meal in the given analogy represents the cell manifesting itself as a specific cell-type; and ingredients of a meal represent proteins expressed by that cell-type. Like the chef equipped with the thick recipe book in the given analogy, all cells in an organism contain the same DNA and are therefore each potentially capable of manifesting itself as any cell-type, expressing proteins typical of that cell type.

Figure 5A:
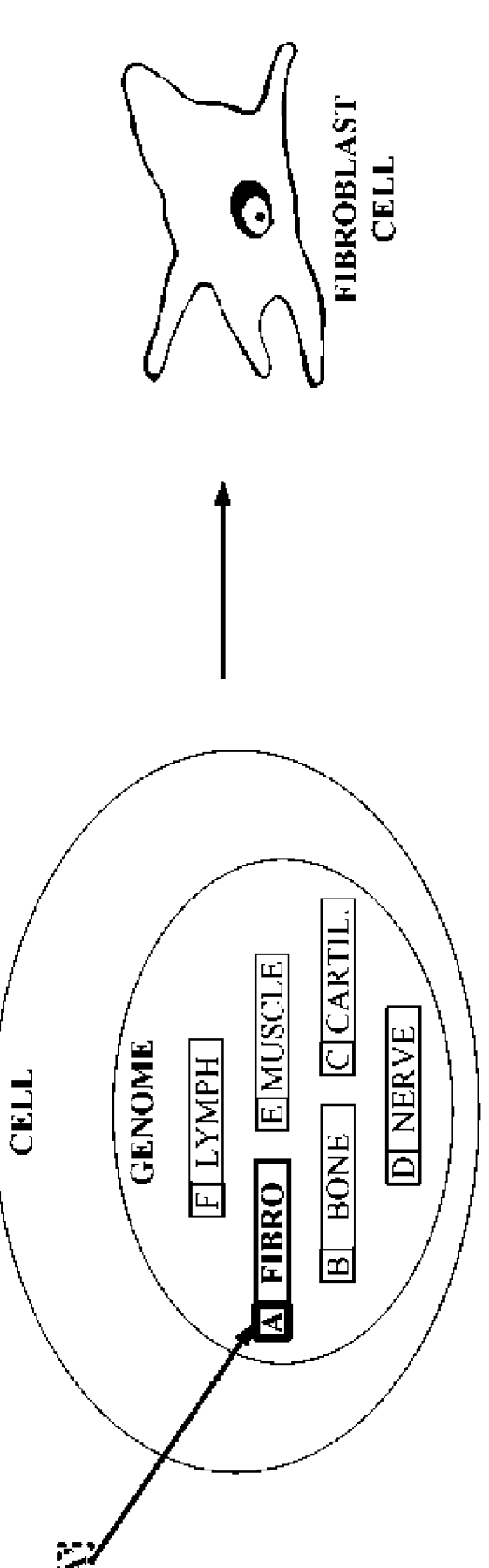

Reference is now made to FIGS. 5A and 5B which are schematic diagrams, which when taken together illustrate a "genomic records" concept of the conceptual model of the present invention, addressing the genomic differentiation enigma.

The Genomic Records concept asserts that the DNA (the thick recipe book in the illustration) comprises a very large number of Genomic Records (analogous to pages in the recipe book), each containing the instructions for differentiation of a different cell-type, or developmental process. Each Genomic Record is headed by a very short genomic sequence which functions as a "Genomic Address" of that Genomic Record (analogous to the page number in the recipe book). At its inception, in addition to the DNA, each cell also receives a short RNA segment (the scribbled note in the illustration). This short RNA segment binds complementarily to a "Genomic Address" sequence of one of the Genomic Records, thereby activating that Genomic Record, and accordingly determining the cell's-fate (analogous to opening the book on the page corresponding to the number on the scribbled note, thereby determining the meal to be prepared).

Reference is now made to FIG. 5A. FIG. 5A illustrates a CELL which comprises a GENOME. The GENOME comprises a plurality of GENOMIC RECORDS, each of which correlates to a specific cell type (for clarity only 6 sample genomic records are shown). Each genomic record comprises genomic instructions on differentiation into a specific cell-type, as further elaborated below with reference to FIG. 7. At cell inception, the CELL receives a maternal short RNA segment, which activates one of the GENOMIC RECORDS, causing the cell to differentiate according to the instructions comprised in that genomic record. As an example, FIG. 5A illustrates reception of a maternal short RNA segment designated A" and outlined by a broken line, which activates the FIBRO genomic record, causing the cell to differentiate into a FIBROBLAST CELL.

Reference is now made to FIG. 5B, which is a simplified schematic diagram, illustrating cellular differentiation mediated by the "Genomic Records" concept. FIG. 5B depicts 2 cells in an organism, designated CELL A and CELL B, each having a GENOME. It is appreciated that since CELL A and CELL B are cells in the same organism, the GENOME of CELL A is identical to that of CELL B. Despite having an identical GENOME, CELL A differentiates differently from CELL B, due to activation of different genomic records in these two cells. In CELL A the FIBRO GENOMIC RECORD is activated, causing CELL A to differentiate into a FIBROBLAST CELL, whereas in CELL B the BONE GENOMIC RECORD is activated, causing the CELL B to differentiate into a BONE CELL. The cause for activation of different genomic records in these two cells is the different maternal short RNA which they both received: CELL A received a maternal short RNA segment designated A" which activated genomic record FIBRO, whereas CELL B received a maternal short RNA segment designated B" which activated genomic record BONE.

Figure 6:
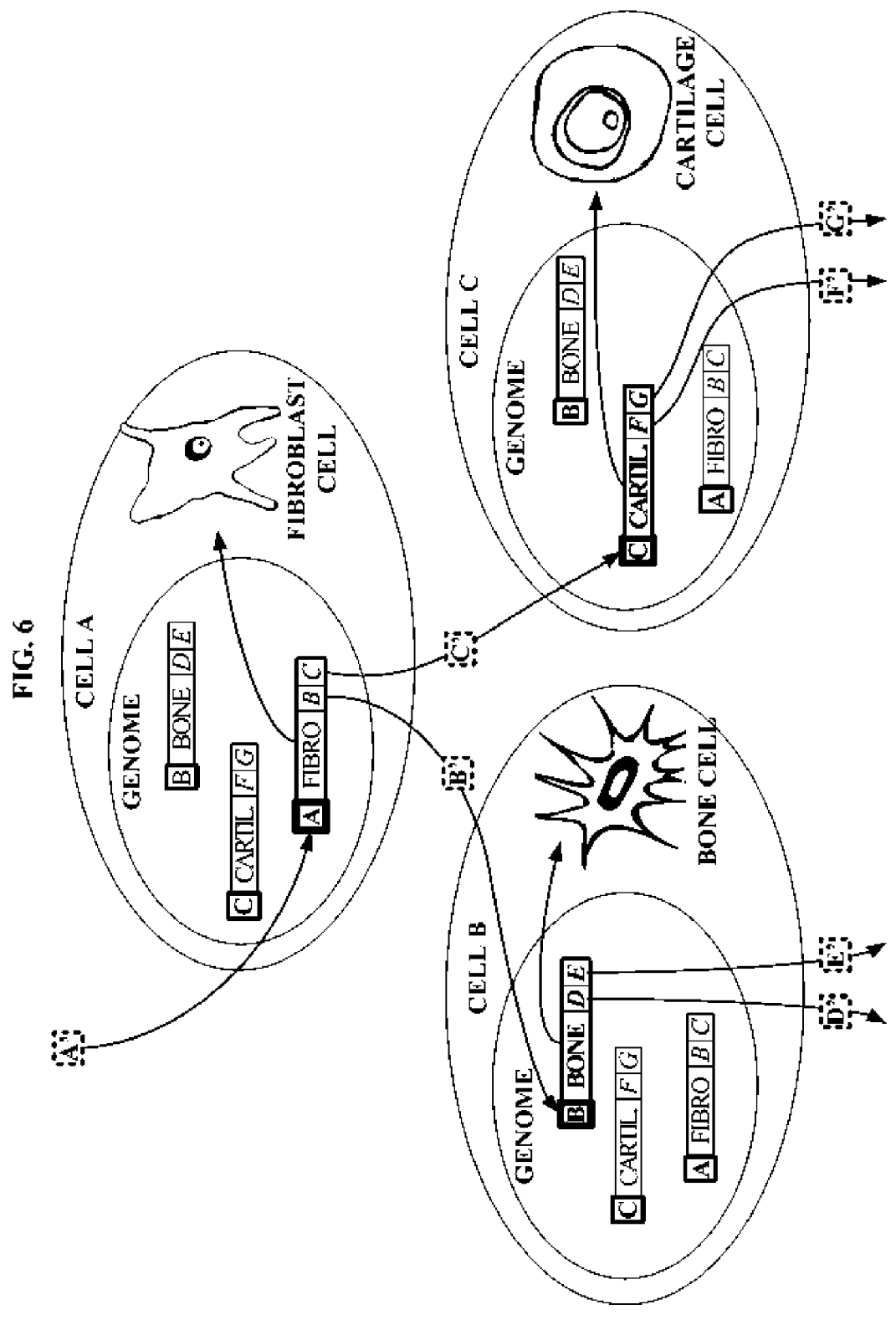
FIG. 6 is a schematic diagram illustrating a 'genomically programmed cell differentiation' concept of the conceptual model of the present invention, addressing the genomic differentiation enigma.

Reference is now made to FIG. 6 which is a schematic diagram illustrating a "genomically programmed cell differentiation" concept of the conceptual model of the present invention, addressing the genomic differentiation enigma.

A cell designated CELL A divides into 2 cells designated CELL B and CELL C. CELL A, CELL B and CELL C each comprise a GENOME, which GENOME comprises a plurality of GENOMIC RECORDS. It is appreciated that since CELL A, CELL B and CELL C are cells in the same organism, the GENOME of these cells, and the GENOMIC RECORDS comprised therein, are identical.

As described above with reference to FIG. 5B, at its inception, CELL A receives a maternal short RNA segment, designated A" and marked by a broken line, which activates the FIBRO genomic record, thereby causing CELL A to differentiate into a FIBROBLAST CELL. However, FIG. 6 shows further details of the genomic records: each cell genomic record also comprises two short genomic sequences, referred to here as Daughter Cell Genomic Addresses. Blocks designated B and C are Daughter Cell Genomic Addresses of the FIBRO Genomic Record. At cell division, each parent cell transcribes two short RNA segments, corresponding to the two Daughter Cell Genomic Addresses of the Genomic Record of that parent cell, and transfers one to each of its two daughter cells. CELL A of FIG. 6 transcribes and transfers to its two respective daughter cells, two short RNA segments, outlined by a broken line and designated B" and C", corresponding to daughter cell genomic addresses designated B and C comprised in the FIBRO genomic record.

CELL B therefore receives the above mentioned maternal short RNA segment designated B", which binds complementarily to genomic address designated B of genomic record BONE, thereby activating this genomic record, which in turn causes CELL B to differentiate into a BONE CELL. Similarly, CELL C receives the above mentioned maternal short RNA segment designated C", which binds complementarily to genomic address designated C of genomic record CARTIL., thereby activating this genomic record, which in turn causes CELL C to differentiate into a CARTILAGE CELL.

It is appreciated that the mechanism illustrated by FIG. 6 enables an unlimited lineage of cells to divide into daughter cells containing the same DNA, and to determine the cell-fate of these daughter cells. For example, when CELL B and CELL C divide into their respective daughter cells (not shown), they will transfer short RNA segments designated D" & E", and F" & G" respectively, to their respective daughter cells. The cell fate of each of these daughter cells would be determined by the identity of the maternal short RNA segment they receive, which would determine the genomic record activated.

Figure 7:
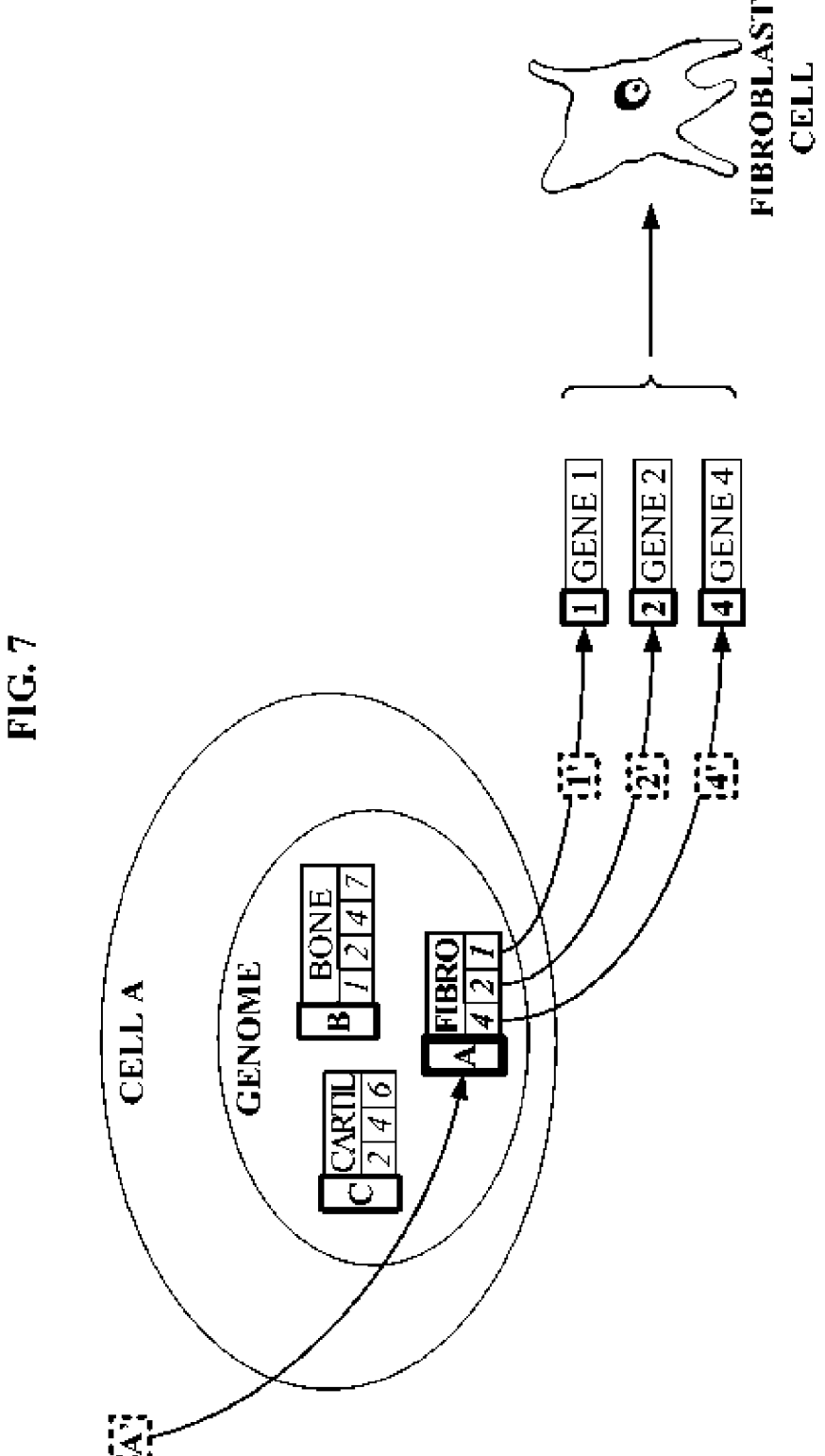
FIG. 7 is a schematic diagram illustrating a 'genomically programmed cell-specific protein expression modulation' concept of the conceptual model of the present invention, addressing the genomic differentiation enigma.

Reference is now made to FIG. 7 which is a schematic diagram illustrating a "genomically programmed cell-specific protein expression modulation" concept of the conceptual model of the present invention, addressing the genomic differentiation enigma.

Cell A receives a maternal short RNA segment designated A", which activates a genomic record designated FIBRO, by anti-sense binding to a binding site "header" of this genomic record, designated A. Genomic record FIBRO encodes 3 short RNA segments, designated 1, 2 and 4 respectively, which modulate expression of target genes designated GENE1, GENE2 and GENE4 respectively. Modulation of expression of these genes results in CELL A differentiating into a FIBROBLAST CELL.

Reference is now made to FIG. 8, which is a simplified diagram describing each of a plurality of novel bioinformatically detected genes of the present invention, referred to here as Genomic Address Messenger (GAM) genes, which modulates expression of respective target genes thereof, the function and utility of which target genes is known in the art.

GAM is a novel bioinformatically detected regulatory, non protein coding, micro RNA (miRNA) gene. The method by which GAM is detected is described hereinabove with reference to FIGS. 8-15.

GAM GENE and GAM TARGET GENE are human genes contained in the human genome.

GAM GENE encodes a GAM PRECURSOR RNA. Similar to other miRNA genes, and unlike most ordinary genes, GAM PRECURSOR RNA does not encode a protein. GAM PRECURSOR RNA folds onto itself, forming GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurately or partially inversed reversed sequence of the nucleotide sequence of the second half thereof. By inversed reversed is meant a sequence which is reversed and wherein each nucleotide is replaced by a complementary nucleotide, as is well known in the art (e.g. ATGGC is the reverse complementary sequence of GCCAT).

An enzyme complex designated DICER COMPLEX, 'dices' the GAM FOLDED PRECURSOR RNA into GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins.

TARGET GENE encodes a corresponding messenger RNA, GAM TARGET RNA. GAM TARGET RNA comprises three regions, as is typical of mRNA of a protein coding gene: a 5' untranslated region, a protein coding region and a 3' untranslated region, designated 5'UTR, PROTEIN CODING and 3'UTR respectively.

GAM RNA binds complementarily to one or more target binding sites located in untranslated regions of GAM TARGET RNA. This complementary binding is due to the fact that the nucleotide sequence of GAM RNA is a partial or accurate inversed reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM RNA may have a different number of target binding sites in untranslated regions of a GAM TARGET RNA. It is further appreciated that while FIG. 8 depicts target binding sites in the 3'UTR region, this is meant as an example only, these target binding sites may be located in the 3'UTR region, the 5'UTR region, or in both 3'UTR and 5'UTR regions.

The complementary binding of GAM RNA to target binding sites on GAM TARGET RNA, such as BINDING SITE I, BINDING SITE II and BINDING SITE III, inhibits translation of GAM TARGET RNA into GAM TARGET PROTEIN. GAM TARGET PROTEIN is therefore outlined by a broken line.

It is appreciated that GAM TARGET GENE in fact represents a plurality of GAM target genes. The mRNA of each one of this plurality of GAM target genes comprises one or more target binding sites, each having a nucleotide sequence which is at least partly complementary to GAM RNA, and which when bound by GAM RNA causes inhibition of translation of respective one or more GAM target proteins.

It is further appreciated by one skilled in the art that the mode of translational inhibition illustrated by FIG. 8 with specific reference to translational inhibition exerted by GAM GENE on one or more TARGET GENE, is in fact common to other known miRNA genes, as is well known in the art.

Nucleotide sequences of each of a plurality of GAM GENEs described by FIG. 8 and their respective genomic source and chromosomal location are further described hereinbelow with reference to Table 1, hereby incorporated by reference.

Nucleotide sequences of GAM PRECURSOR RNA, and a schematic representation of a predicted secondary folding of GAM FOLDED PRECURSOR RNA, of each of a plurality of GAM GENEs described by FIG. 8 are further described hereinbelow with reference to Table 2, hereby incorporated by reference.

Nucleotide sequences of a 'diced' GAM RNA of each of a plurality of GAM GENEs described by FIG. 8 are further described hereinbelow with reference to Table 3, hereby incorporated by reference.

Nucleotide sequences of target binding sites, such as BINDING SITE-I, BINDING SITE-II and BINDING SITE-III of FIG. 8, found on GAM TARGET RNA, of each of a plurality of GAM GENEs described by FIG. 8, and schematic representation of the complementarity of each of these target binding sites to each of a plurality of GAM RNA described by FIG. 8 are described hereinbelow with reference to Table 4, hereby incorporated by reference.

It is appreciated that specific functions and accordingly utilities of each of a plurality of GAM GENEs described by FIG. 8 correlate with, and may be deduced from, the identity of the TARGET GENEs that each of said plurality of GAM GENEs binds and inhibits, and the function of each of said TARGET GENEs, as elaborated hereinbelow. Studies establishing known functions of each of a plurality of TARGET GENEs of GAM GENEs of FIG. 8, and correlation of said each of a plurality of TARGET GENEs to known diseases are listed in Table 5, and are hereby incorporated by reference.

The present invention discloses a novel group of genes, the GAM genes, belonging to the miRNA genes group, and for which a specific complementary binding has been determined.

Figure 9:
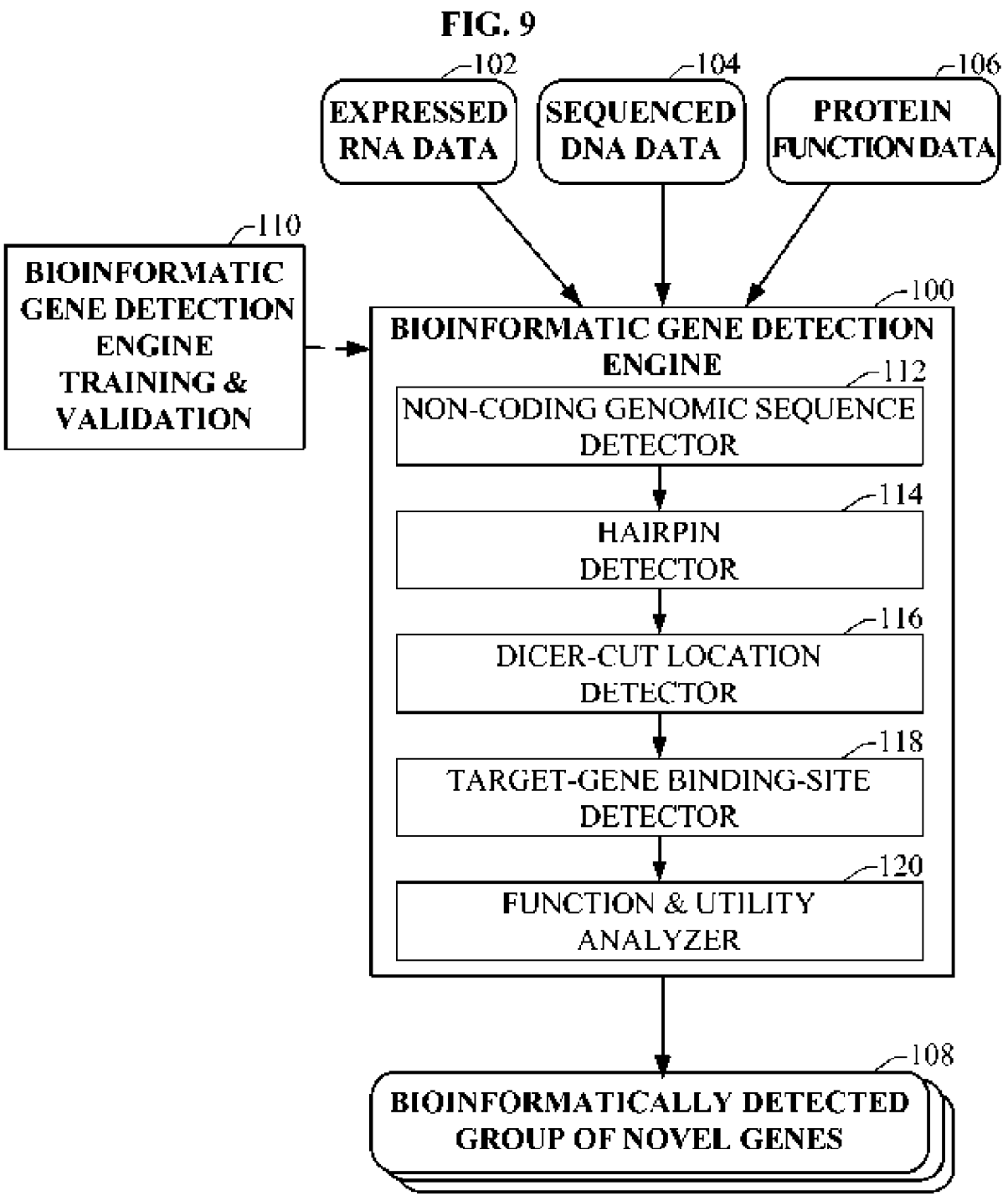
FIG. 9 is a simplified block diagram illustrating a bioinformatic gene detection system capable of detecting genes of the novel group of genes of the present invention, which system is constructed and operative in accordance with a preferred embodiment of the present invention.

Reference is now made to FIG. 9 which is a simplified block diagram illustrating a bioinformatic gene detection system capable of detecting genes of the novel group of genes of the present invention, which system is constructed and operative in accordance with a preferred embodiment of the present invention.

A centerpiece of the present invention is a bioinformatic gene detection engine 100, which is a preferred implementation of a mechanism capable of bioinformatically detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108.

Expressed RNA data 102 comprises published expressed sequence tags (EST) data, published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102 and sequenced DNA data 104 may preferably be obtained from data published by the National Center for Bioinformatics (NCBI) at the National Institute of Health (NIH) (Jenuth, 2000), as well as from various other published data sources. Protein function data 106 may preferably be obtained from any one of numerous relevant published data sources, such as the Online Mendelian Inherited Disease In Man (OMIM(TM)) database developed by John Hopkins University, and also published by NCBI (2000).

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further described hereinbelow with reference to FIG. 10.

The bioinformatic gene detection engine 100 comprises several modules which are preferably activated sequentially, and are described as follows:

A non-coding genomic sequence detector 112 operative to bioinformatically detect non-protein coding genomic sequences. The non-coding genomic sequence detector 112 is further described herein below with reference to FIGS. 11A and 11B.

A hairpin detector 114 operative to bioinformatically detect genomic 'hairpin-shaped' sequences, similar to GAM FOLDED PRECURSOR of FIG. 8. The hairpin detector 114 is further described herein below with reference to FIGS. 12A and 12B.

A dicer-cut location detector 116 operative to bioinformatically detect the location on a hairpin shaped sequence which is enzymatically cut by DICER COMPLEX of FIG. 8. The dicer-cut location detector 116 is further described herein below with reference to FIG. 13A.

A target-gene binding-site detector 118 operative to bioinformatically detect target genes having binding sites, the nucleotide sequence of which is partially complementary to that of a given genomic sequence, such as a sequence cut by DICER COMPLEX of FIG. 8. The target-gene binding-site detector 118 is further described hereinbelow with reference to FIGS. 14A and 14B.

A function & utility analyzer 120 operative to analyze function and utility of target genes, in order to identify target genes which have a significant clinical function and utility. The function & utility analyzer 120 is further described hereinbelow with reference to FIG. 15.

Hardware implementation of the bioinformatic gene detection engine 100 is important, since significant computing power is preferably required in order to perform the computation of bioinformatic gene detection engine 100 in reasonable time and cost. For example, it is estimated that a using a powerful 8-processor server (e.g. DELL POWEREDGE (TM) 8450, 8 XEON (TM) 550 MHz processors, 8 GB RAM), over 6 years (!) of computing time are required to detect all MIR genes in the human EST data, together with their respective binding sites. Various computer hardware and software configurations may be utilized in order to address this computation challenge, as is known in the art. A preferred embodiment of the present invention may preferably comprise a hardware configuration, comprising a cluster of one hundred PCs (PENTIUM (TM) IV, 1.7 GHz, with 40 GB storage each), connected by Ethernet to 12 servers (2-CPU, XEON (TM) 1.2-2.2 GHz, with ~200 GB storage each), combined with an 8-processor server (8-CPU, Xeon 550 Mhz w/ 8 GB RAM) connected via 2 HBA fiber-channels to an EMC CLARIION (TM) 100-disks, 3.6 Terabyte storage device. A preferred embodiment of the present invention may also preferably comprise a software configuration which utilizes a commercial database software program, such as MICROSOFT (TM) SQL Server 2000. Using such preferred hardware and software configuration, may reduce computing time required to detect all MIR genes in the human EST data, and their respective binding sites, from 6 years to 45 days. It is appreciated that the above mentioned hardware configuration is not meant to be limiting, and is given as an illustration only. The present invention may be implemented in a wide variety of hardware and software configurations.

The present invention discloses 200 novel genes of the GAM group of genes, which have been detected bioinformatically, as described hereinbelow with reference to Table 1 through Table 4, and 1096 novel genes of the GR group of genes, which have been detected bioinformatically. Laboratory confirmation of 50 bioinformatically predicted genes of the GAM group of genes, and several bioinformatically predicted genes of the GR group of genes, is described hereinbelow with reference to FIGS. 21 through 24D.

Reference is now made to FIG. 10 which is a simplified flowchart illustrating operation of a mechanism for training a computer system to recognize the novel genes of the present invention. This mechanism is a preferred implementation of the bioinformatic gene detection engine training & validation 110 described hereinabove with reference to FIG. 9.

BIOINFORMATIC GENE DETECTION ENGINE TRAINING & VALIDATION 110 of FIG. 9 begins by training the bioinformatic gene detection engine to recognize known miRNA genes, as designated by numeral 122. This training step comprises HAIRPIN DETECTOR TRAINING & VALIDATION 124, further described hereinbelow with reference to FIG. 12A, DICER-CUT LOCATION DETECTOR TRAINING & VALIDATION 126, further described hereinbelow with reference to FIGS. 13A and 13B, and TARGET-GENE BINDING-SITE DETECTOR TRAINING & VALIDATION 128, further described hereinbelow with reference to FIG. 14A.

Next, the BIOINFORMATIC GENE DETECTION ENGINE 100 is used to bioinformatically detect sample novel genes, as designated by numeral 130. Examples of sample novel genes thus detected are described hereinbelow with reference to FIGS. 21 through 24D. Finally, wet lab experiments are preferably conducted in order to validate expression and preferably function of the sample novel genes detected by the BIOINFORMATIC GENE DETECTION ENGINE 100 in the previous step. An example of wet-lab validation of the above mentioned sample novel gene bioinformatically detected by the system is described hereinbelow with reference to FIG. 22

Figure 11A:
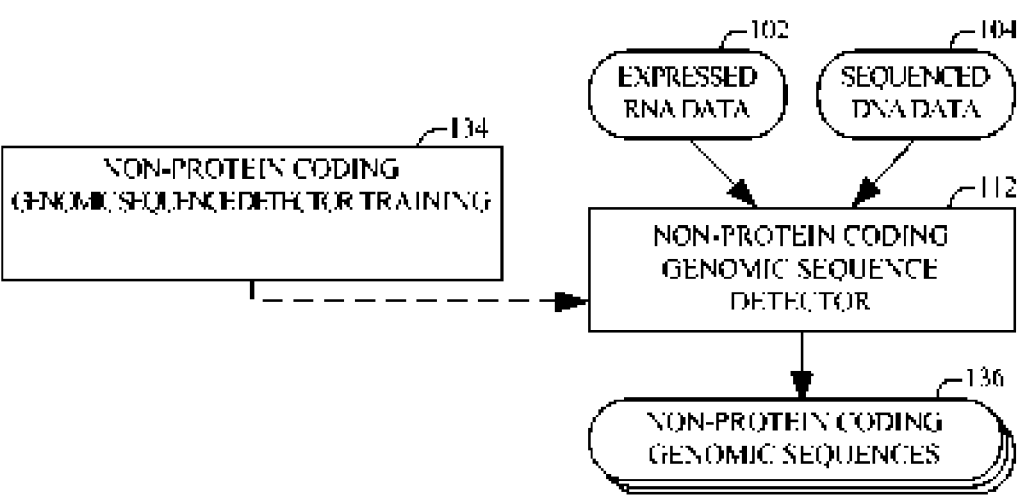
FIG. 11A is a simplified block diagram of a non-coding genomic sequence detector constructed and operative in accordance with a preferred embodiment of the present invention.
Figure 11B:
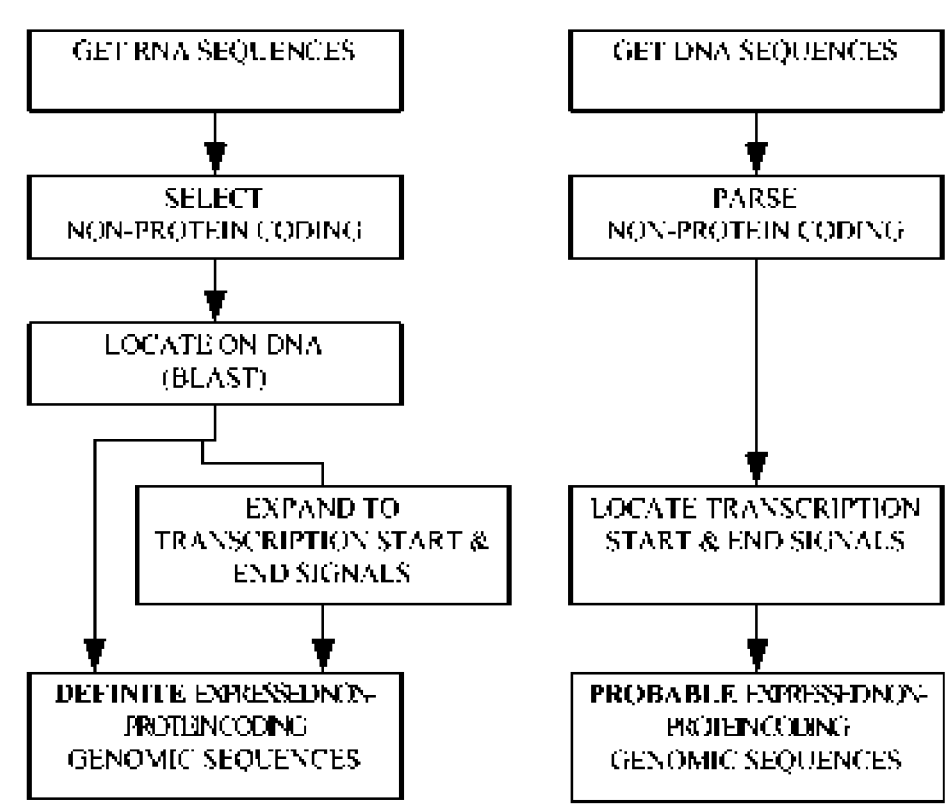
FIG. 11B is a simplified flowchart illustrating operation of a non-coding genomic sequence detector constructed and operative in accordance with a preferred embodiment of the present invention.

Reference is now made to FIG. 11B which is a simplified flowchart illustrating a preferred operation of the NON-CODING GENOMIC SEQUENCE DETECTOR 112 of FIG. 9. Detection of NON-PROTEIN CODING GENOMIC SEQUENCES 136, generally preferably progresses in one of the following two paths:

A first path for detecting NON-PROTEIN CODING GENOMIC SEQUENCES 136 begins by receiving a plurality of known RNA sequences, such as EST data. Each RNA sequence is first compared to all known protein-coding sequences, in order to select only those RNA sequences which are non-protein coding, i.e. intergenic or intronic. This can preferably be performed by sequence comparison of the RNA sequence to known protein coding sequences, using one of many alignment algorithms known in the art, such as BLAST. This sequence comparison to the DNA preferably also provides the localization of the RNA sequence on the DNA.

Alternatively, selection of non-protein coding RNA sequences and their localization to the DNA can be performed by using publicly available EST clusters data and genomic mapping databases, such as UNIGENE database published by NCBI or TIGR database, in order map expressed RNA sequences to DNA sequences encoding them, to find the right orientation of EST sequences, and to exclude ESTs which map to protein coding DNA regions, as is well known in the art. Public databases, such as TIGR, may also be used to map an EST to a cluster of ESTs, assumed to be expressed as one piece, and is known in the art as Tentative Human Consensus.

Publicly available genome annotation databases, such as NCBI's GENBANK, may also be used to deduce expressed intronic sequences.

Optionally, an attempt may be made to "expand" the non-protein RNA sequences thus found, by searching for transcription start and end signals, upstream and downstream of location of the RNA on the DNA respectively, as is well known in the art.

A second path for detecting non-protein coding genomic sequences starts by receiving DNA sequences. The DNA sequences are parsed into non protein coding sequences, based on published DNA annotation data, by extracting those DNA sequences which are between known protein coding sequences. Next, transcription start and end signals are sought. If such signals are found, and depending on their "strength", probable expressed non-protein coding genomic sequences are yielded. Such approach is especially useful for identifying novel GAM genes which are found in proximity to other known miRNA genes, or other wet-lab validated GAM genes. Since, as described hereinbelow with reference to FIG. 16, GAM genes are frequently found in clusters, therefore sequences near a known miRNA are more likely to contain novel GAM genes. Optionally, sequence orthology, i.e. sequences conservation in an evolutionary related species, may be used to select genomic sequences having higher probability of containing expressed novel GAM genes.

Figure 12A:
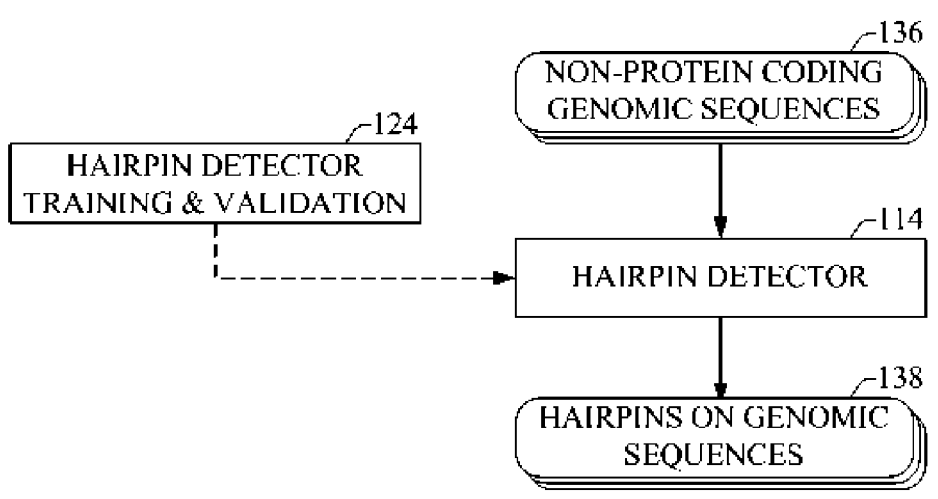
FIG. 12A is a simplified block diagram of a hairpin detector constructed and operative in accordance with a preferred embodiment of the present invention.

Reference is now made to FIG. 12A which is a simplified block diagram of a preferred implementation of the HAIRPIN DETECTOR 114 described hereinabove with reference to FIG. 9.

The goal of the HAIRPIN DETECTOR 114 is to detect "hairpin" shaped genomic sequences, similar to those of known miRNA genes. As mentioned hereinabove with reference to FIG. 8, a "hairpin" genomic sequence refers to a genomic sequence which "folds onto itself" forming a hairpin like shape, due to the fact that nucleotide sequence of the first half of the nucleotide sequence is an accurate or partial complementary sequence of the nucleotide sequence of its second half.

The HAIRPIN DETECTOR 114 of FIG. 9 receives as input a plurality of NON-PROTEIN CODING GENOMIC SEQUENCES 136 of FIG. 11A. After a phase of HAIRPIN DETECTOR TRAINING & VALIDATION 124 of FIG. 10, the HAIRPIN DETECTOR 114 is operative to detect and output "hairpin shaped" sequences, which are found in the input NON-PROTEIN CODING GENOMIC SEQUENCES 138. The hairpin shaped sequences detected by the HAIRPIN DETECTOR 114 are designated HAIRPINS ON GENOMIC SEQUENCES 138. Preferred operation of the HAIRPIN DETECTOR 114 is described hereinbelow with reference to FIG. 12B.

The phase of HAIRPIN DETECTOR TRAINING & VALIDATION 124 is an iterative process of applying the HAIRPIN DETECTOR 114 to known hairpin shaped miRNA genes, calibrating the HAIRPIN DETECTOR 114 such that it identifies the training set of known hairpins, as well as sequences which are similar thereto. In a preferred embodiment of the present invention, THE HAIRPIN DETECTOR TRAINING & VALIDATION 124 trains and validates each of the steps of operation of the HAIRPIN DETECTOR 114, which steps are described hereinbelow with reference to FIG. 12B.

The hairpin detector training and validation 124 preferably uses two sets of data: a training set of known miRNA genes, such as 440 miRNA genes of H. sapiens, M. musculus, C. elegans, C. Brigssae and D. Melanogaster, annotated in RFAM database (Griffiths-Jones 2003), and a large "background set" of hairpins found in expressed non-protein coding genomic sequences, such as a set of 21,985 hairpins found in Tentative Human Concensus (THC) sequences in TIGR database. The "background set" is expected to comprise some valid, previously undetected miRNA hairpins, and many hairpins which are not miRNA hairpins.

In order to validate the performance of the HAIRPIN DETECTOR 114, a validation method is preferably used, which validation method is a variation on the k-fold cross validation method (Mitchell, 1997). This preferred validation method is devised to better cope with the nature of the training set, which includes large families of similareven identical miRNAs. The training set is preferably first divided into clusters of miRNAs such that any two miRNAs that belong to different clusters have an Edit Distance score (see Algorithms and Strings, Dan Gusfield, Cambridge University Press, 1997) of at least D=3, i.e. they differ by at least 3 editingNext, the group of clusters is preferably divided into k sets. Then standard k-fold cross validation is preferably performed on this group of clusters, preferably using k=5, such that the members of each cluster are all in the training set or in the test set. It is appreciated that without the prior clustering, standard cross validation methods results in much higher performance of the predictors due to the redundancy of training examples, within the genome of a species and across genomes of different species.

In a preferred embodiment of the present invention, using the abovementioned validation method, the efficacy of the HAIRPIN DETECTOR 114 is indeed validated: for example, when a similarity threshold is chosen such that 90% of the published miRNA-precursor hairpins are successfully predicted, only 7.6% of the 21,985 background hairpins are predicted to be miRNA-precursors, some of which may indeed be previously unknown miRNA precursors.

Figure 12B:
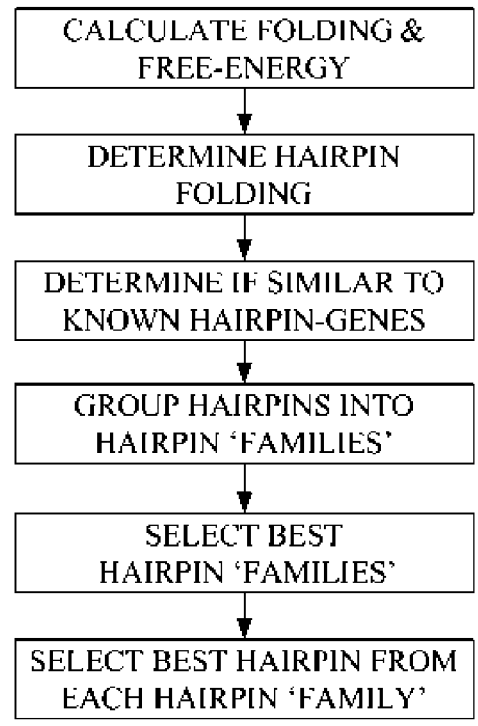
FIG. 12B is a simplified flowchart illustrating operation of a hairpin detector constructed and operative in accordance with a preferred embodiment of the present invention.

Reference is now made to FIG. 12B which is a simplified flowchart illustrating a preferred operation of the HAIRPIN DETECTOR 114 of FIG. 9.

A hairpin structure is a secondary structure, resulting from the nucleotide sequence pattern: the nucleotide sequence of the first half of the hairpin is a partial or accurate inversed reversed sequence of the nucleotide sequence of the second half thereof. Various methodologies are known in the art for prediction of secondary and tertiary hairpin structures, based on given nucleotide sequences.

In a preferred embodiment of the present invention, the HAIRPIN DETECTOR 114 initially calculates possible secondary structure folding patterns of a given one of the non-protein coding genomic sequences 136 and the respective energy of each of these possible secondary folding patterns, preferably using a secondary structure folding algorithm based on free-energy minimization, such as the MFOLD algorithm (Mathews et al., 1999), as is well known in the art.

Next, the HAIRPIN DETECTOR 114 analyzes the results of the secondary structure folding, in order to determine the presence, and location of hairpin folding structures. A secondary structure folding algorithm, such as MFOLD algorithm, typically provides as output a listing of the base-pairing of the folded shape, i.e. a listing of each pair of connected nucleotides in the sequence. The goal of this second step is to asses this base-pairing listing, in order to determine if it describes a hairpin type bonding pattern. Preferably, each of the sequences that is determined to describe a hairpin structure is folded separately in order to determine its exact folding pattern and free-energy.

The HAIRPIN DETECTOR 114 then assess those hairpin structures found by the previous step, comparing them to hairpins of known miRNA genes, using various characteristic hairpin features such as length of the hairpin and of its loop, free-energy and thermodynamic stability, amount and type of mismatched nucleotides, existence of sequence repeat-elements. Only hairpins that bear statistically significant resemblance to the training set of known miRNA hairpins, according to the abovementioned parameters are accepted.

In a preferred embodiment of the present invention, similarity to the training set of known miRNA hairpins is determined using a "similarity score" which is calculated using a weighted sum of terms, where each term is a function of one of the abovementioned hairpin features, and the parameters of each function are learned from the set of known hairpins, as described hereinabove with reference to hairpin detector training & validation 124. The weight of each term in the similarity score is optimized so as to achieve maximal separation between the distribution of similarity scores of hairpins which have been validated as miRNA-precursor hairpins, and the distribution of similarity scores of hairpins detected in the "background set" mentioned hereinabove with reference to FIG. 12B, many of which are expected not to be miRNA-precursor hairpins.

In another preferred embodiment of the present invention, the abovementioned DETERMINE IF SIMILAR TO KNOWN HAIRPIN-GENES step may may preferably be split into two stages. The first stage is a permissive filter that implements a simplified scoring method, based on a subset of the hairpin features described hereinabove, such as minimal length and maximal free energy. The second stage is more stringent, and a full calculation of the weighted sum of terms described hereinabove is performed. This second stage may preferably be performed only on the subset of hairpins that survived prior filtering stages of the hairpin-detector 114.

Lastly, the HAIRPIN DETECTOR 114 attempts to select those hairpin structures which are as thermodynamically stable as the hairpins of known miRNA genes. This may preferably be achieved in various manners. A preferred embodiment of the present invention utilizes the following methodology preferably comprising three logical steps:

First, the HAIRPIN DETECTOR 114 attempts to group potential hairpins into "families" of closely related hairpins. As is known in the art, a free-energy calculation algorithm, typically provides multiple "versions" each describing a different possible secondary structure folding pattern for the given genomic sequence, and the free energy of such possible folding. The HAIRPIN DETECTOR 114 therefore preferably assesses all hairpins found in each of the "versions", grouping hairpins which appear in different versions, but which share near identical locations into a common "family" of hairpins. For example, all hairpins in different versions, the center of which hairpins is within 7 nucleotides of each other may preferably be grouped to a single "family". Hairpins may also be grouped to a single "family" if the sequences of one or more hairpins are identical to, or are subsequences of, the sequence of another hairpin.

Next, hairpin "families" are assessed, in order to select only those families which represent hairpins that are as stable as those of known miRNA hairpins. Preferably only families which are represented in a majority of the secondary structure folding versions, such as at least in 65% or 80% or 100% of the secondary structure folding versions, are considered stable.

Finally, an attempt is made to select the most suitable hairpin from each selected family. For example, a hairpin which appears in more versions than other hairpins, and in versions the free-energy of which is lower, may be preferred.

In another preferred embodiment of the present invention, hairpins with homology to other species, and clusters of thermodynamically stable hairpin are further favored.

Figure 13A:
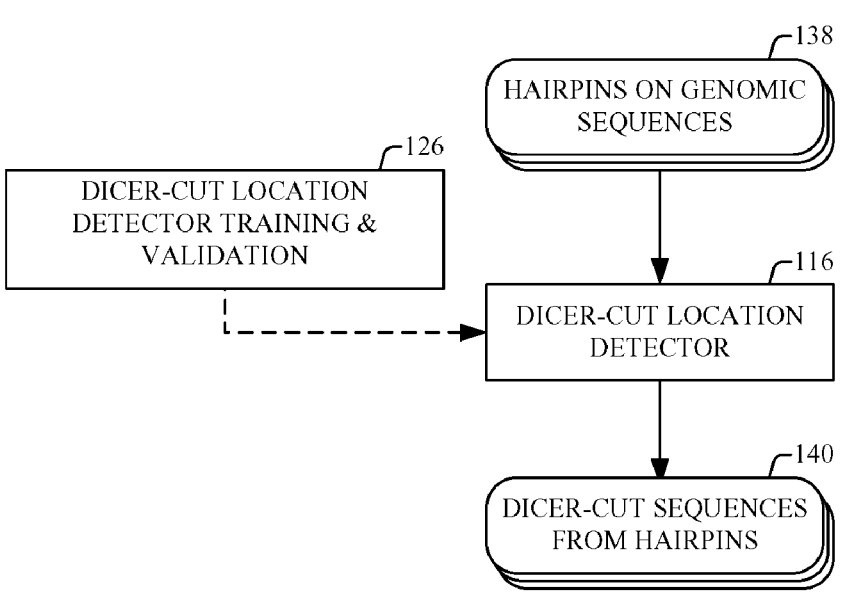
FIG. 13A is a simplified block diagram of a dicer-cut location detector constructed and operative in accordance with a preferred embodiment of the present invention.

Reference is now made to FIG. 13A which is a simplified block diagram of a preferred implementation of the DICER-CUT LOCATION DETECTOR 116 described hereinabove with reference to FIG. 9.

The goal of the DICER-CUT LOCATION DETECTOR 116 is to detect the location in which DICER COMPLEX of FIG. 8, comprising the enzyme Dicer, would "dice" the given hairpin sequence, similar to GAM FOLDED PRECURSOR RNA, yielding GAM RNA both of FIG. 8.

The DICER-CUT LOCATION DETECTOR 116 of FIG. 9 therefore receives as input a plurality of HAIRPINS ON GENOMIC SEQUENCES 138 of FIG. 12A, which were calculated by the previous step, and after a phase of DICER-CUT LOCATION DETECTOR TRAINING & VALIDATION 126, is operative to detect a respective plurality of DICER-CUT SEQUENCES FROM HAIRPINS 140, one for each hairpin.

In a preferred embodiment of the present invention, the DICER-CUT LOCATION DETECTOR 116 preferably uses standard machine learning techniques such as K nearest-neighbors, Bayesian networks and Support Vector Machines (SVM), trained on known dicer-cut locations of known miRNA genes in order to predict dicer-cut locations of novel GAM genes. TheDICER-CUT LOCATION DETECTOR TRAINING & VALIDATION 126 is further described hereinbelow with reference to FIG. 13B.

Figure 13B:
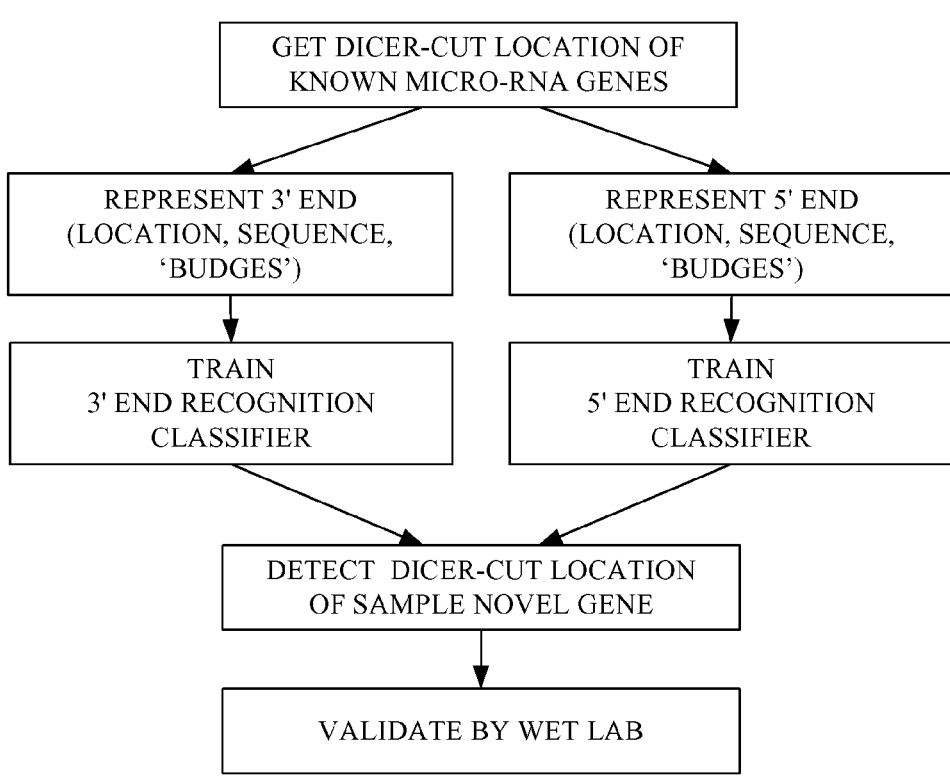
FIG. 13B is a simplified flowchart illustrating training of a dicer-cut location detector constructed and operative in accordance with a preferred embodiment of the present invention.

Reference is now made to FIG. 13B which is a simplified flowchart illustrating a preferred implementation of DICER-CUT LOCATION DETECTOR TRAINING & VALIDATION 126 of FIG. 10.

The general goal of the DICER-CUT LOCATION DETECTOR TRAINING & VALIDATION 126 is to analyze known hairpin shaped miRNA-precursors and their respective dicer-cut miRNA, in order to determine a common pattern to the dicer-cut location of known miRNA genes. Once such a common pattern is deduced, it may preferably be used by the DICER-CUT LOCATION DETECTOR 116, in detecting the predicted DICER-CUT SEQUENCES FROM HAIRPINS 140, from the respective HAIRPINS ON GENOMIC SEQUENCES 138, all of FIG. 13A.

First, the dicer-cut location of all known miRNA genes is obtained and studied, so as to train the DICER-CUT LOCATION DETECTOR 116: for each of the known miRNA, the location of the miRNA relative to its hairpin-shaped miRNA-precursor is noted.

The 5" and 3' ends of the dicer-cut location of each of the known miRNA genes is represented relative to the respective miRNA precursor hairpin, as well as to the nucleotides in each location along the hairpin. Frequency and identity of nucleotides and of nucleotide-pairing, and position of nucleotides and nucleotide pairing relative to the dicer-cut location in the known miRNA precursor hairpins is analyzed and modeled. In a preferred embodiment of the present invention, features learned from published miRNAs include: distance from hairpin's loop, nucleotide content, positional distribution of nucleotides and mismatched-nucleotides, and symmetry of mismatched-nucleotides.

Different techniques are well known in the art of machine learning for analysis of existing pattern from a given "training set" of examples, which techniques are then capable, to a certain degree, to detect similar patterns in other, previously unseen examples. Such machine learning techniques include, but are not limited to neural networks, Bayesian networks, Support Vector Machines (SVM), Genetic Algorithms, Markovian modeling, Maximum Liklyhood modeling, Nearest Neighbor algorithms, Decision trees and other techniques, as is well known in the art.

The DICER-CUT LOCATION DETECTOR 116 preferably uses such standard machine learning techniques to predict either the 5" end or both the 5" and 3" ends of the miRNA excised, or "diced" by the Dicer enzyme from the miRNA hairpin shaped precursor, based on known pairs of miRNA-precursors and their respective resulting miRNAs. The nucleotide sequences of 440 published miRNA and their corresponding hairpin precursors are preferably used for training and evaluation of the dicer-cut location detector module. AAmir-964985515 the set of 440 published miRs has all precursors. Also, we do no longer split into two disjoint sets, but use k-fold cross validation.

Using the abovementioned training set, machine learning predictors, such as a Support Vector Machine (SVM) predictor, are implemented, which predictors test every possible nucleotide on a hairpin as a candidate for being the 5" end or the 3" end of a miRNA. Other machine learning predictors include predictors based on Nearest Neighbor, Bayesian modeling, and K-nearest-neighbor algorithms. The training set of the published miRNA precursor sequences is preferably used for training multiple separate classifiers or predictors, each of which produces a model for the 5" or 3" end of a miRNA relative to its hairpin precursor. The models take into account various miRNA properties such as the distance of the respective (3" or 5") end of the miRNA from the hairpin's loop, the nucleotides at its vicinity and the local "bulge" (i.e. base-pair mismatch) structure.

Performance of the resulting predictors, evaluated on the abovementioned validation set of 440 published miRNAs using k-fold cross validation (Mitchell, 1997) with k=3, is found to be as follows: in 70% of known miRNAs 5'-end location is correctly determined by an SVM predictor within up to 2 nucleotides; a Nearest Neighbor (EDIT DISTANCE) predictor achieves 53% accuracy (233/440); a Two-Phased predictor that uses Baysian modeling (TWO PHASED) achieves 79% accuracy (348/440), when only the first phase is used, and 63% (277/440) when both phases are used; a K-nearest-neighbor predictor (FIRST-K) achieves 61% accuracy (268/440). The accuracies of all predictors are considerably higher on top scoring subsets of published miRNA.

Finally, in order to validate the efficacy and accuracy of the dicer-cut location detector 116, a sample of novel genes detected thereby is preferably selected, and validated by wet lab. Laboratory results validating the efficacy of the dicer-cut location detector 116 are described hereinbelow with reference to FIGS. 21 through 24D.

Figure 13C:
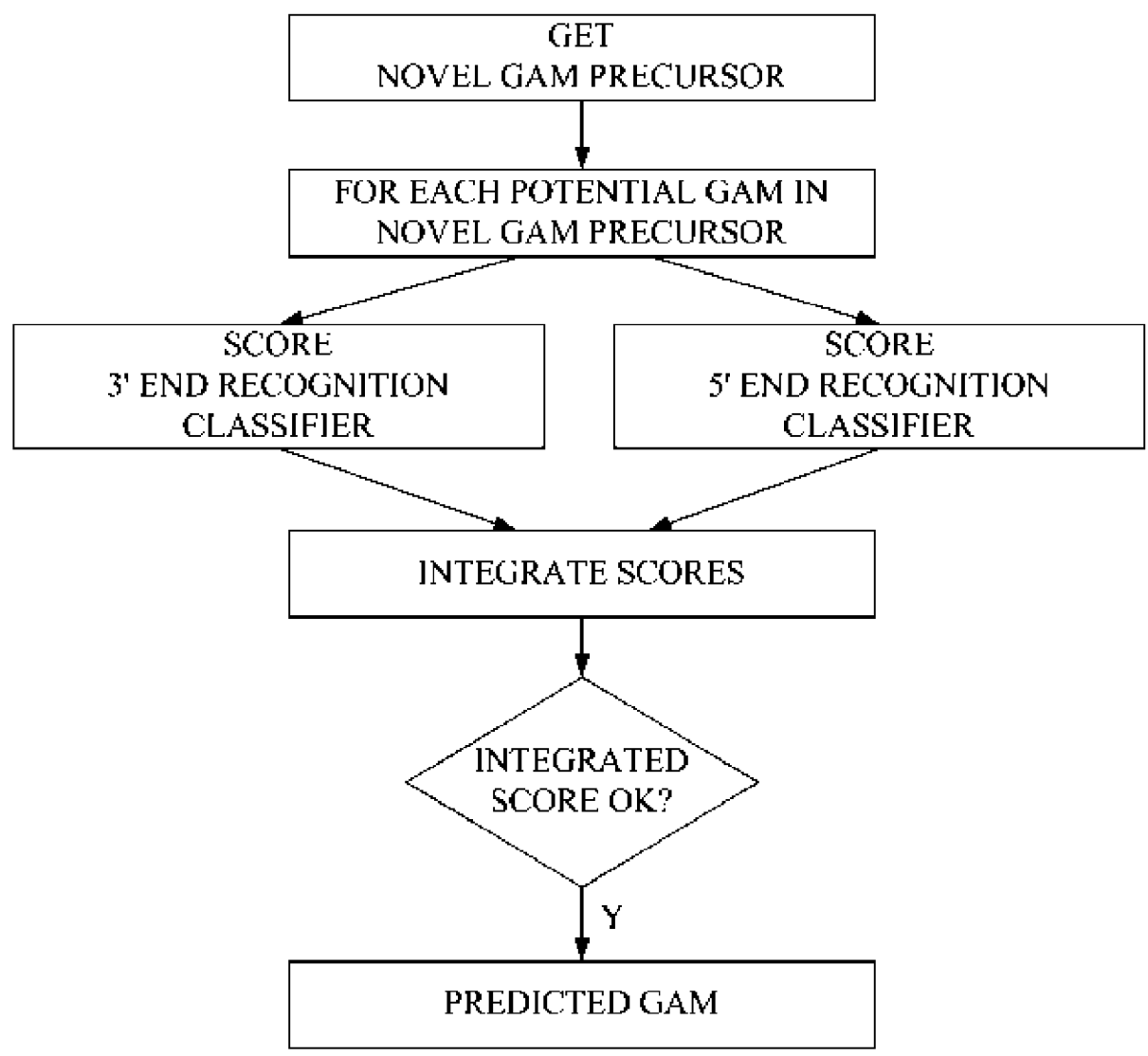
FIG. 13C is a simplified flowchart illustrating operation of a dicer-cut location detector constructed and operative in accordance with a preferred embodiment of the present invention.

Reference is now made to FIG. 13C which is a simplified flowchart illustrating operation of DICER-CUT LOCATION DETECTOR 116 of FIG. 9, constructed and operative in accordance with a preferred embodiment of the present invention.

The DICER CUT LOCATION DETECTOR 116 is a machine learning computer program module, which is trained on recognizing dicer-cut location of known miRNA genes, and based on this training, is operable to detect dicer cut location of novel GAM FOLDED PRECURSOR RNA. In a preferred embodiment of the present invention, the dicer-cut location module preferably utilizes machine learning algorithms, such as Support Vector Machine (SVM), Bayesian modeling, Nearest Neighbors, and K-nearest-neighbor, as is well known in the art.

When assessing a novel GAM precursor, all 19-24 nucleotide long segments comprised in the GAM precursor are initially considered as "potential GAMs", since the dicer-cut location is initially unknown.

For each such potential GAM, its 5" end, or its 5" and 3' ends are scored by two or more recognition classifiers or predictors.

In a preferred embodiment of the present invention, the DICER-CUT LOCATION DETECTOR 116 preferably uses a Support Vector Machine predictor trained on features such as distance from hairpin's loop, nucleotide content, positional distribution of nucleotides and mismatched-nucleotides, and symmetry of mismatched-nucleotides.

In another preferred embodiment of the present invention, the DICER-CUT LOCATION DETECTOR 116 preferably uses an "EDIT DISTANCE" predictor, which seeks sequences that are similar to those of published miRNAs, utilizing the Nearest Neighbor algorithm, where the similarity metric between two sequences is a variant of the edit distance algorithm (Algorithms and Strings, Dan Gusfield, Cambridge University Press, 1997). This predictor is based on the observation that miRNAs tend to form clusters (Dostie, 2003), the members of which show marked sequence similarity to each other.

In yet another preferred embodiment of the present invention, the DICER-CUT LOCATION DETECTOR 116 preferably uses a "TWO PHASED" predictor, which predicts the dicer-cut location in two distinct phases: (a) selecting the double-stranded segment of the hairpin comprising the miRNA by naïve Bayesian modeling (Mitchell, 1997), and (b) detecting which strand contains the miRNA by either naïve or by K-nearest-neighbor modeling. The latter is a variant of the 'FIRST-K' predictor described herein below, with parameters optimized for this specific task. The 'TWO PHASED' predictor may be operated in two modes: either utilizing only the first phase and thereby producing two alternative dicer-cut location predictions, or utilizing both phases and thereby producing only one final dicer-cut location.

In still another preferred embodiment of the present invention, the DICER-CUT LOCATION DETECTOR 116 preferably uses a "FIRST-K" predictor, which utilizes the K-nearest-neighbor algorithm. The similarity metric between any two sequences is 1-E/L, where L is a parameter, preferably 8-10 and E is the edit distance between the two sequences, taking into account only the first L nucleotides of each sequence. If the K-nearest-neighbor scores of two or more locations on the hairpin are not significantly different, these locations are further ranked by a Bayesian model, similar to the one described hereinabove.

Scores of two or more of the abovementioned classifiers or predictors are integrated, yielding an integrated score for each "potential GAM". As an example, FIG. 13C illustrates integration of scores from two classifiers, a 3" end recognition classifier and a 5" end recognition classifier, the scores of which are integrated to yield an integrated score. In a preferred embodiment of the present invention, INTEGRATED SCORE of 13C preferably implements a "best-of-breed" approach, accepting only "potential GAMs" that score highly on one of the above mentioned "EDIT DISTANCE", or "TWO-PHASED" predictors. In this context, "high scores" means scores which have been demonstrated to have low false positive value when scoring known miRNAs.

The INTEGRATED SCORE is then evaluated as follows: (a) the "potential GAM" having the highest score is taken to be the most probable GAM, and (b) if the integrated score of this "potential GAM" is higher than a pre-defined threshold, then the potential GAM is accepted as the PREDICTED GAM.

Figure 14A:
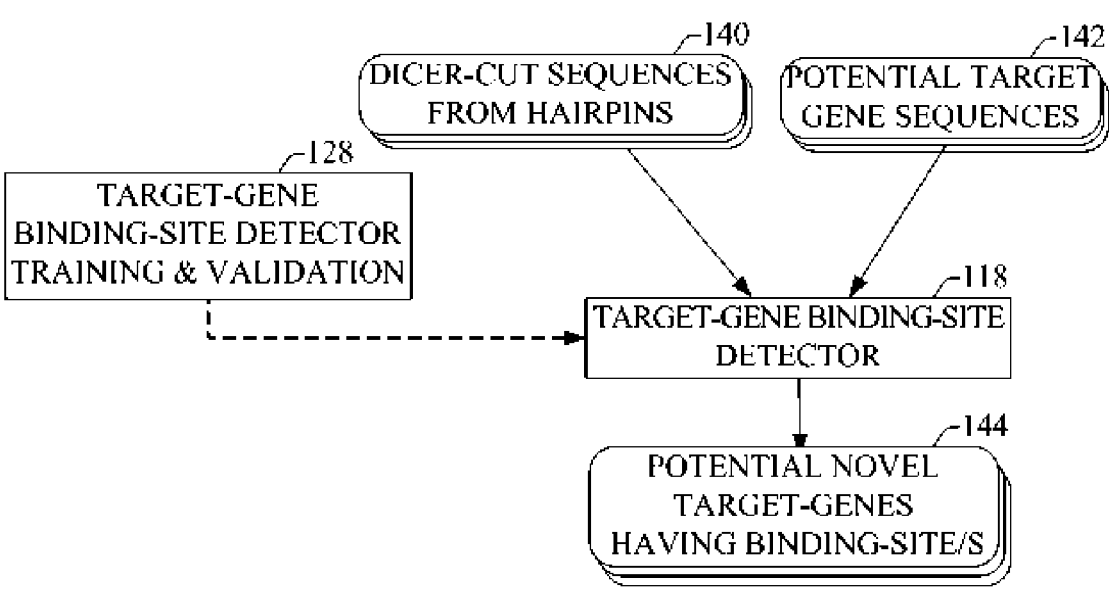
FIG. 14A is a simplified block diagram of a target-gene binding-site detector constructed and operative in accordance with a preferred embodiment of the present invention.

Reference is now made to FIG. 14A which is a simplified block diagram of a preferred implementation of the TARGET-GENE BINDING-SITE DETECTOR 118 described hereinabove with reference to FIG. 9. The goal of the TARGET-GENE BINDING-SITE DETECTOR 118 is to detect a BINDING SITE of FIG. 8, including binding sites located in untranslated regions of the RNA of a known gene, the nucleotide sequence of which BINDING SITE is a partial or accurate inversed reversed sequence to that of a GAM RNA of FIG. 8, thereby determining that the above mentioned known gene is a target gene of GAM of FIG. 8.

The TARGET-GENE BINDING-SITE DETECTOR 118 of FIG. 9 therefore receives as input a plurality of DICER-CUT SEQUENCES FROM HAIRPINS 140 of FIG. 13A which were calculated by the previous step, and a plurality of POTENTIAL TARGET GENE SEQUENCES 142 which derive from SEQUENCED DNA DATA 104 of FIG. 9, and after a phase of TARGET-GENE BINDING-SITE DETECTOR TRAINING & VALIDATION 128 is operative to detect a plurality of POTENTIAL NOVEL TARGET-GENES HAVING BINDING SITE/S 144 the nucleotide sequence of which is a partial or accurate inversed reversed sequence to that of each of the plurality of DICER-CUT SEQUENCES FROM HAIRPINS 140. Preferred operation of the TARGET-GENE BINDING-SITE DETECTOR 118 is further described hereinbelow with reference to FIG. 14B.

Figure 14B:
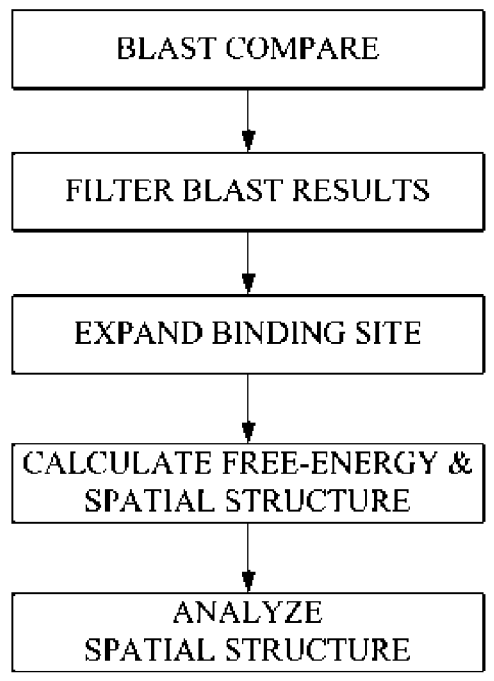
FIG. 14B is a simplified flowchart illustrating operation of a target-gene binding-site detector constructed and operative in accordance with a preferred embodiment of the present invention.

Reference is now made to FIG. 14B which is a simplified flowchart illustrating a preferred operation of the target-gene binding-site detector 118 of FIG. 9.

In a preferred embodiment of the present invention, the target-gene binding-site detector 118 first uses a sequence comparison algorithm such as BLAST in order to compare the nucleotide sequence of each of the plurality of dicer-cut sequences from hairpins 140, to the potential target gene sequences 142, such a untranslated regions of known mRNAs, in order to find crude potential matches. Alternatively, the sequence comparison may preferably be performed using a sequence match search tool that is essentially a variant of the EDIT DISTANCE algorithm described hereinabove with reference to FIG. 13C, and the Nearest Neighbor algorithm (Mitchell, 1997).

Results of the sequence comparison, performed by BLAST or other algorithms such as EDIT DISTANCE, are then filtered, preferably utilizing BLAST or EDIT DISTANCE score, to results which are similar to those of known binding sites (e.g. binding sites of miRNA genes Lin-4 and Let-7 to target genes Lin-14, Lin-41, Lin 28 etc.). Next the binding site is expanded, checking if nucleotide sequenced immediately adjacent to the binding site found by the sequence comparison algorithm (e.g. BLAST or EDIT DISTANCE), may improve the match. Suitable binding sites, then are computed for free-energy and spatial structure. The results are analyzed, accepting only those binding sites, which have free-energy and spatial structure similar to that of known binding sites. Since known binding sites of known miRNA genes frequently have multiple adjacent binding sites on the same target RNA, accordingly binding sites which are clustered are strongly preferred. Binding sites found in evolutionarily conserved sequences may preferably also be preferred.

For each candidate binding site a score, Binding Site Prediction Accuracy, is calculated which estimates their similarity of its binding to that of known binding sites. This score is based on GAM binding site folding features including, but not limited to the free-energy, the total number and distribution of base pairs, the total number and distribution of unpaired nucleotides.

In another preferred embodiment of the present invention binding sites are searched by a reversed process: sequences of K (preferably 22) nucleotides of the untranslated regions of the target gene are assessed as potential binding sites. A sequence comparison algorithm, such as BLAST or EDIT DISTANCE, is then used to search for partially or accurately complementary sequences elsewhere in the genome, which complementary sequences are found in known miRNA genes or computationally predicted GAM genes. Only complementary sequences, the complementarity of which withstands the spatial structure and free energy analysis requirements described above are accepted. Clustered binding sites are strongly favored, as are potential binding sites and potential GAM genes which occur in evolutionarily conserved genomic sequences.

Target binding sites, identified by the TARGET-GENE BINDING-SITE DETECTOR 118, are divided into 3 groups: a) comprises binding sites that are exactly complementary to the predicted GAM. b) and c) comprise binding sites that are not exactly complementary to the predicted GAM: b) has binding sites with 0.9 < Binding Site Prediction Accuracy <=1 and c) has binding sites with 0.8 < Binding Site Prediction Accuracy <=0.9. The average number of mismatching nucleotides in the alignment of predicted GAM and target binding site is smallest in category a and largest in category c.

In a preferred embodiment of the current invention a ranking of GAM to target gene binding is performed by calculating a score, Mir Target Accuracy. This score is the dominant group identifier of all binding sites of a specific GAM to a specific target gene UTR, where 'a' dominates 'b' and 'b' dominates 'c'.

In yet another preferred embodiment of the current invention a ranking of GAM to target gene binding is performed directly from the set of Binding Site Prediction Accuracies corresponding to all the binding sites of a specific GAM to a specific target gene UTR. This set of scores is sorted in descending order. The final score is a weighted sum of these scores where the weights are exponentially decreasing as a function of the rank.

Figure 15:
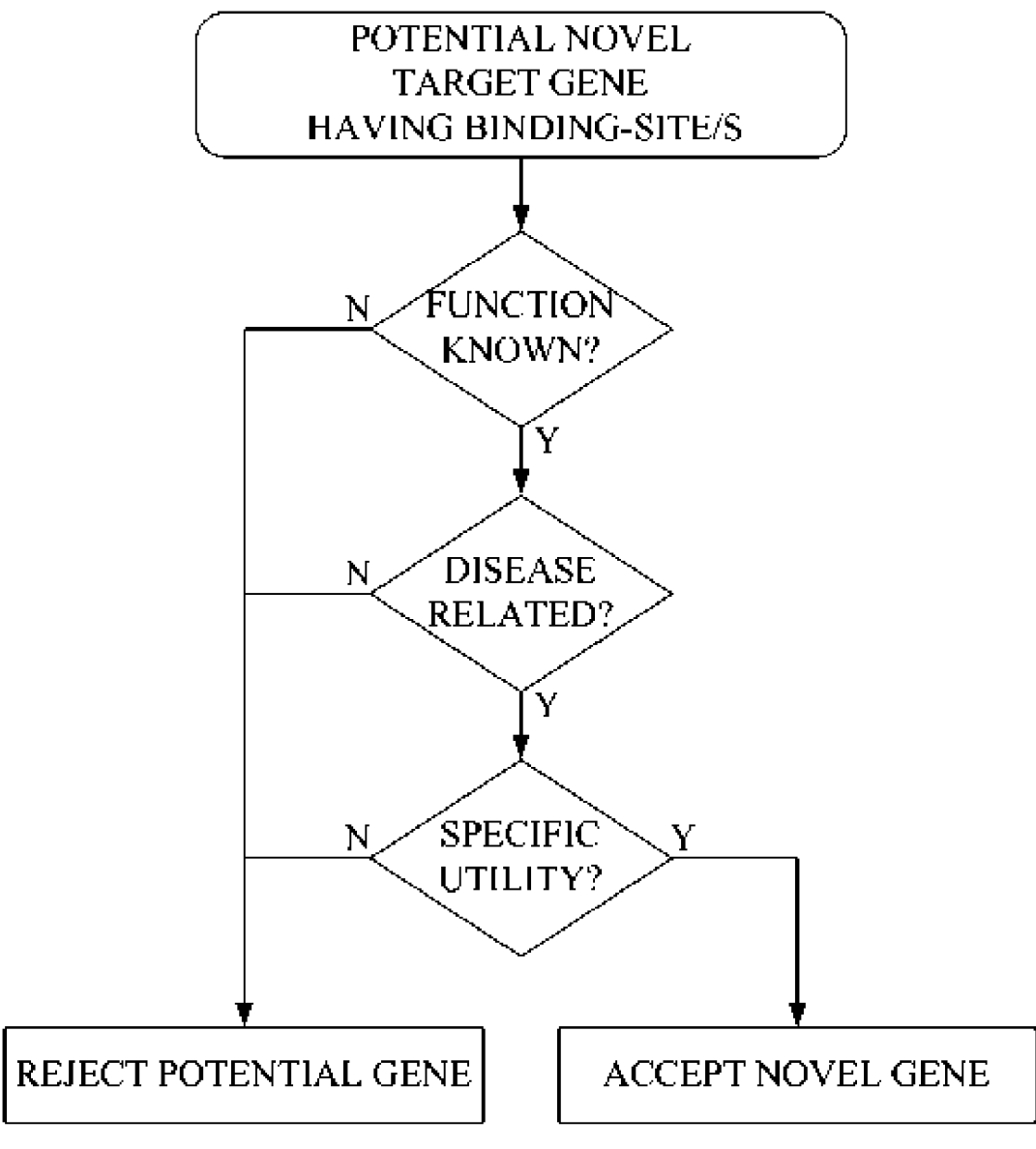
FIG. 15 is a simplified flowchart illustrating operation of a function & utility analyzer constructed and operative in accordance with a preferred embodiment of the present invention.

Reference is now made to FIG. 15 which is a simplified flowchart illustrating a preferred operation of the function & utility analyzer 120 described hereinabove with reference to FIG. 9. The goal of the function & utility analyzer 120 is to determine if a potential target gene is in fact a valid clinically useful target gene. Since a potential novel GAM gene binding a binding site in the UTR of a target gene is understood to inhibit expression of that target gene, and if that target gene is shown to have a valid clinical utility, then in such a case it follows that the potential novel gene itself also has a valid useful function which is the opposite of that of the target gene.

The function & utility analyzer 120 preferably receives as input a plurality of potential novel target genes having binding-site/s 144, generated by the target-gene binding-site detector 118, both of FIG. 14A. Each potential gene is evaluated as follows: First, the system checks to see if the function of the potential target gene is scientifically well established. Preferably, this can be achieved bioinformatically by searching various published data sources presenting information on known function of proteins. Many such data sources exist and are published as is well known in the art. Next, for those target genes the function of which is scientifically known and is well documented, the system then checks if scientific research data exists which links them to known diseases. For example, a preferred embodiment of the present invention utilizes the OMIM(TM) database published by NCBI, which summarizes research publications relating to genes which have been shown to be associated with diseases. Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel genes, the target-genes of which have passed all three examinations, are accepted as novel genes.

Figure 16:
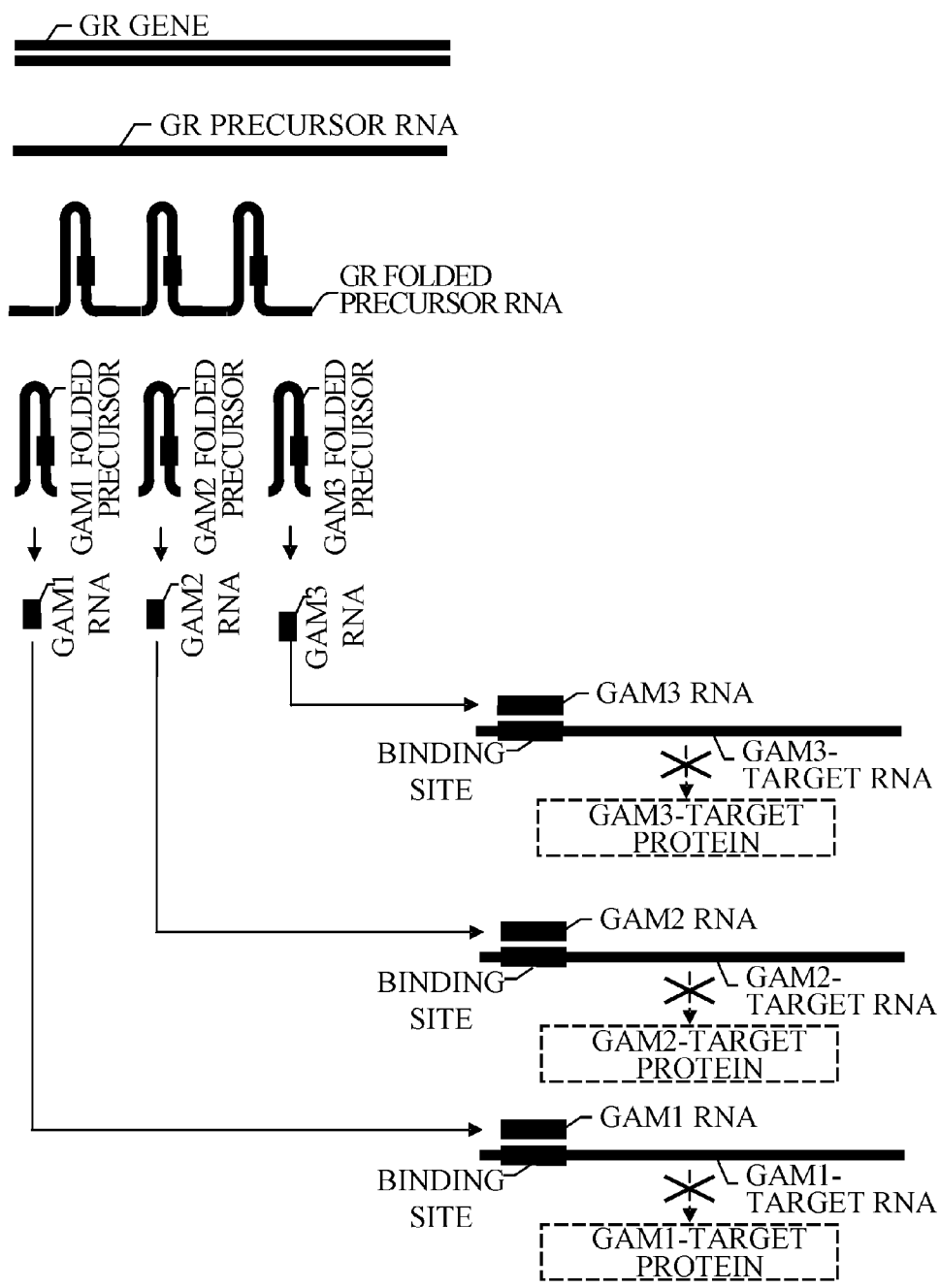
FIG. 16 is a simplified diagram describing a novel bioinformatically detected group of regulatory genes, referred to here as Genomic Record (GR) genes, each of which encodes an 'operon-like' cluster of novel miRNA-like genes, which in turn modulate expression of one or more target genes.

Reference is now made to FIG. 16, which is a simplified diagram describing each of a plurality of novel bioinformatically detected regulatory genes, referred to here as Genomic Record (GR) genes, which encodes an 'operon-like' cluster of novel micro RNA-like genes, each of which in turn modulates expression of at least one target gene, the function and utility of which at least one target gene is known in the art. GR GENE is a novel bioinformatically detected regulatory, non protein coding, RNA gene. The method by which GR GENE was detected is described hereinabove with reference to FIGS. 9-18. GR GENE encodes GR PRECURSOR RNA, an RNA molecule, typically several hundred nucleotides long. GR PRECURSOR RNA folds spatially, forming GR FOLDED PRECURSOR RNA. It is appreciated that GR FOLDED PRECURSOR RNA comprises a plurality of what is known in the art as 'hairpin' structures. These 'hairpin' structures are due to the fact that the nucleotide sequence of GR PRECURSOR RNA comprises a plurality of segments, the first half of each such segment having a nucleotide sequence which is at least a partial or accurate inversed reversed sequence of the second half thereof, as is well known in the art. GR FOLDED PRECURSOR RNA is naturally processed by cellular enzymatic activity into separate GAM precursor RNAs, herein schematically represented by GAM1 FOLDED PRECURSOR RNA through GAM3 FOLDED PRECURSOR RNA, each of which GAM precursor RNAs being a hairpin shaped RNA segment, corresponding to GAM FOLDED PRECURSOR RNA of FIG. 8. The above mentioned GAM precursor RNAs are diced by DICER COMPLEX of FIG. 8, yielding respective short RNA segments of about 22 nucleotides in length, schematically represented by GAM1 RNA through GAM3 RNA, each of which GAM RNAs corresponding to GAM RNA of FIG. 8. GAM1 RNA, GAM2 RNA and GAM3 RNA, each bind complementarily to binding sites located in untranslated regions of respective target genes, designated GAM1-TARGET RNA, GAM2-TARGET RNA and GAM3-TARGET RNA, respectively, which target binding site corresponds to a target binding site such as BINDING SITE I, BINDING SITE II or BINDING SITE III of FIG. 8. This binding inhibits translation of the respective target proteins designated GAM1-TARGET PROTEIN, GAM2-TARGET PROTEIN and GAM3-TARGET PROTEIN respectively. It is appreciated that specific functions, and accordingly utilities, of each GR GENE of the present invention, correlates with, and may be deduced from, the identity of the target genes, which are inhibited by GAM RNAs comprised in the 'operon-like' cluster of said GR GENE, schematically represented by GAM1 TARGET PROTEIN through GAM3 TARGET PROTEIN.

The present invention discloses 1096 novel genes of the GR group of genes, which have been detected bioinformatically. Laboratory confirmation of 2 genes of the GR group of genes is described hereinbelow with reference to FIGS. 23A through 24D.

In summary, the current invention discloses a very large number of novel GR genes, each of which encodes a plurality of GAM genes, which in turn may modulate expression of a plurality of target proteins. It is appreciated therefore that the function of GR genes is in fact similar to that of the Genomic Records concept of the present invention addressing the differentiation enigma, described hereinabove with reference to FIG. 7.

Figure 17:
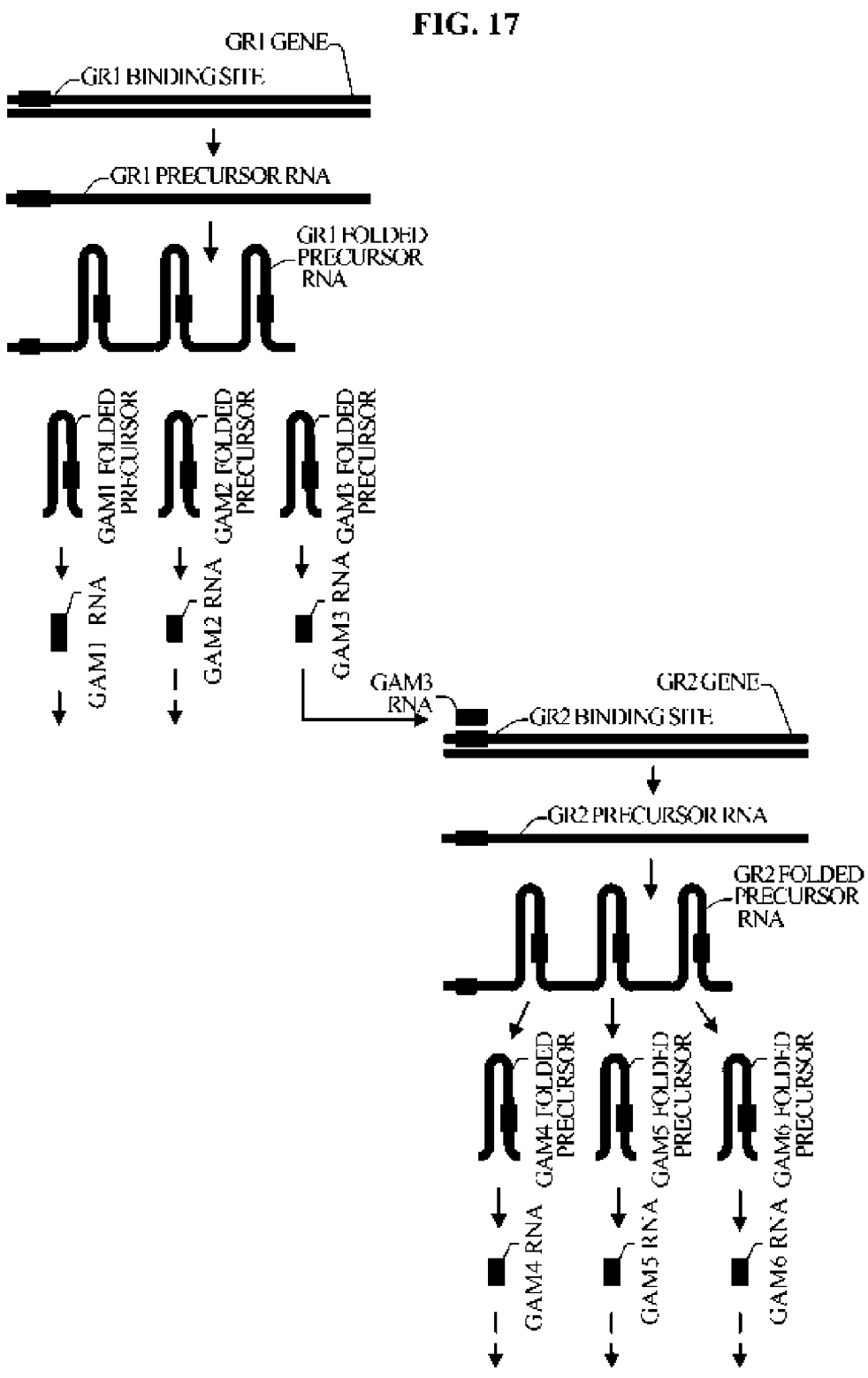
FIG. 17 is a simplified diagram illustrating a mode by which genes of a novel group of operon-like genes of the present invention, modulate expression of other such genes, in a cascading manner.

Reference is now made to FIG. 17 which is a simplified diagram illustrating a mode by which genes of a novel group of operon-like genes, described hereinabove with reference to FIG. 16 of the present invention, modulate expression of other such genes, in a cascading manner. GR1 GENE and GR2 GENE are two genes of the novel group of operon-like genes designated GR of FIG. 16. As is typical of genes of the GR group of genes, GR1 and GR2 each encode a long RNA precursor, which in turn folds into a folded RNA precursor comprising multiple hairpin shapes, and is cut into respective separate hairpin shaped RNA segments, each of which RNA segments being diced to yield a gene of a group of genes designated GAM of FIG. 8. In this manner GR1 yields GAM1 RNA, GAM2 RNA and GAM3 RNA, and GR2 yields GAM4 RNA, GAM5 RNA and GAM6 RNA. As FIG. 17 shows, GAM3 RNA, which derives from GR1, binds a binding site located adjacent to GR2 GENE, thus modulating expression of GR2, thereby invoking expression of GAM4 RNA, GAM5 RNA and GAM6 RNA which derive from GR2. It is appreciated that the mode of modulation of expression presented by FIG. 17 enables an unlimited 'cascading effect' in which a GR gene comprises multiple GAM genes, each of which may modulate expression of other GR genes, each such GR gene comprising additional GAM genes, etc., whereby eventually certain GAM genes modulate expression of target proteins. This mechanism is in accord with the conceptual model of the present invention addressing the differentiation enigma, described hereinabove with specific reference to FIGS. 6 and 7.

Figure 18:
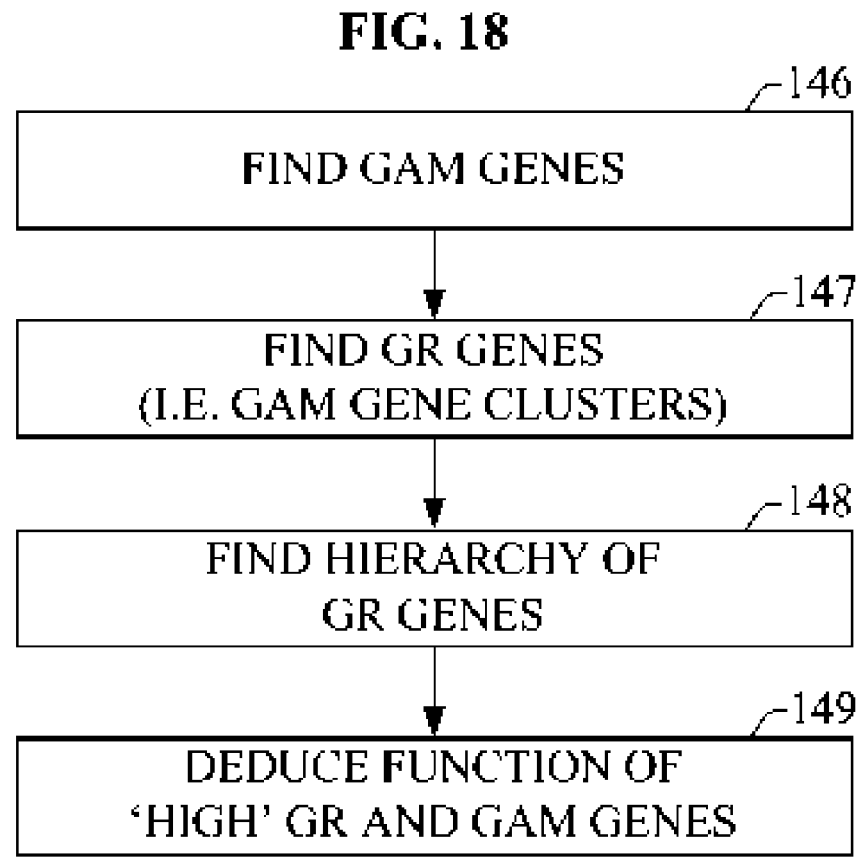
FIG. 18 is a block diagram illustrating an overview of a methodology for finding novel genes and novel operon-like genes of the present invention, and their respective functions.

Reference is now made to FIG. 18 which is a block diagram illustrating an overview of a methodology for finding novel genes and operon-like genes of the present invention, and their respective functions. According to a preferred embodiment of the present invention, the methodology to finding novel genes of the present invention and their function comprises of the following major steps: First, genes of the novel group of genes of the present invention, referred to here as GAM genes, are located and their function elicited by detecting target proteins they bind and the function of those target proteins, as described hereinabove with reference to FIGS. 9 through 15. Next, genes of a novel group of operon-like genes of the present invention, referred to here as GR genes, are located, by locating clusters of proximally located GAM genes, based on the previous step. Consequently, the hierarchy of GR and GAM genes is elicited: binding sites for non-protein-binding GAM genes comprised in each GR gene found are sought adjacent to other GR genes. When found, such a binding site indicates that the connection between the GAM and the GR the expression of which it modulates, and thus the hierarchy of the GR genes and the GAM genes they comprise. Lastly, the function of GR genes and GAM genes which are 'high' in the hierarchy, i.e. GAM genes which modulate expression of other GR genes rather than directly modulating expression of target proteins, may be deduced. A preferred approach is as follows: The function of protein-modulating GAM genes is deducible from the proteins which they modulate, provided that the function of these target proteins is known. The function of 'higher' GAM genes may be deduced by comparing the function of protein-modulating GAM genes, with the hierarchical relationships by which the 'higher' GAM genes are connected to the protein-modulating GAM genes. For example, given a group of several protein-modulating GAM genes, which collectively cause a protein expression pattern typical of a certain cell-type, then a 'higher' GAM gene is sought which modulates expression of GR genes which perhaps modulate expression of other genes which eventually modulate expression of the given group of protein-modulating GAM genes. The 'higher' GAM gene found in this manner is taken to be responsible for differentiation of that cell-type, as per the conceptual model of the invention described hereinabove with reference to FIG. 6.

Figure 19:
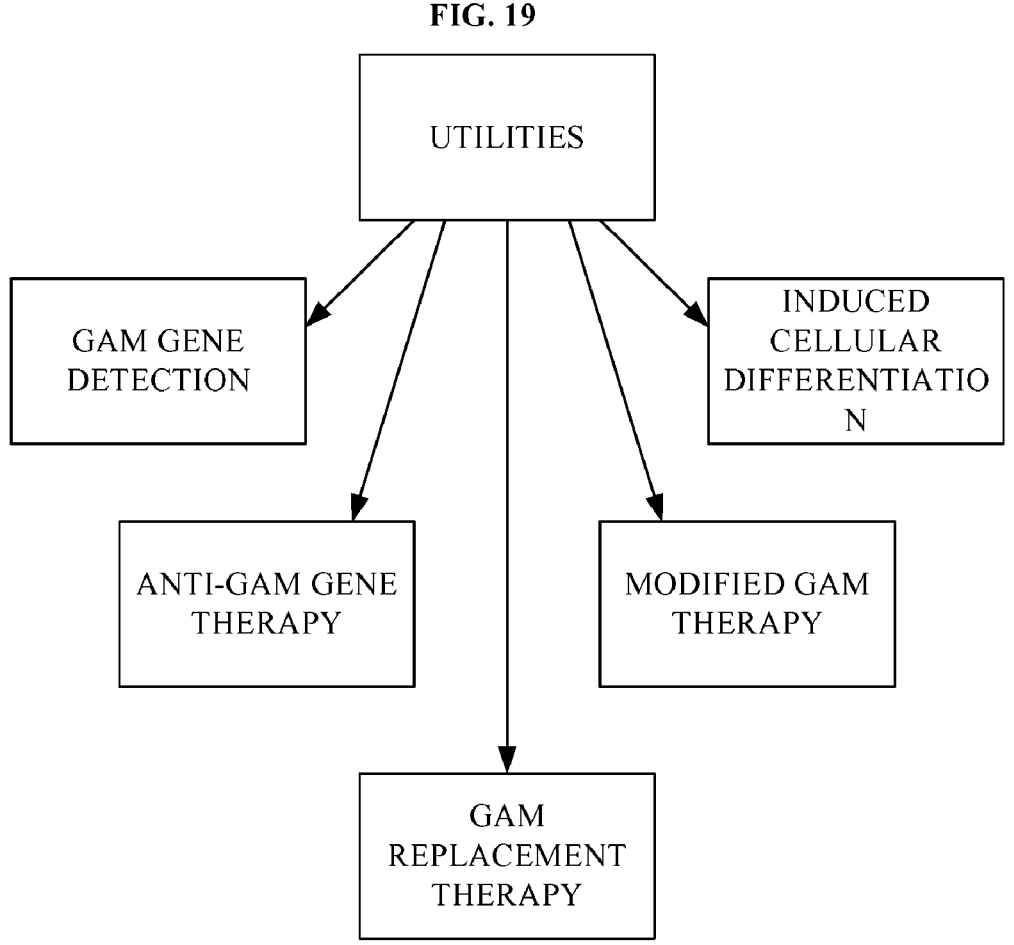
FIG. 19 is a block diagram illustrating different utilities of novel genes and novel operon-like genes, both of the present invention.

Reference is now made to FIG. 19 which is a block diagram illustrating different utilities of genes of the novel group of genes of the present invention referred to here as GAM genes and GR genes. The present invention discloses a first plurality of novel genes referred to here as GAM genes, and a second plurality of operon-like genes referred to here as GR genes, each of the GR genes encoding a plurality of GAM genes. The present invention further discloses a very large number of known target-genes, which are bound by, and the expression of which is modulated by each of the novel genes of the present invention. Published scientific data referenced by the present invention provides specific, substantial, and credible evidence that the above mentioned target genes modulated by novel genes of the present invention, are associated with various diseases. Specific novel genes of the present invention, target genes thereof and diseases associated therewith, are described hereinbelow with reference to Tables 1 through 7. It is therefore appreciated that a function of GAM genes and GR genes of the present invention is modulation of expression of target genes related to known diseases, and that therefore utilities of novel genes of the present invention include diagnosis and treatment of the above mentioned diseases. FIG. 19 describes various types of diagnostic and therapeutic utilities of novel genes of the present invention. A utility of novel genes of the present invention is detection of GAM genes and of GR genes. It is appreciated that since GAM genes and GR genes modulate expression of disease related target genes, that detection of expression of GAM genes in clinical scenarios associated with said diseases is a specific, substantial and credible utility. Diagnosis of novel genes of the present invention may preferably be implemented by RNA expression detection techniques, including but not limited to biochips, as is well known in the art. Diagnosis of expression of genes of the present invention may be useful for research purposes, in order to further understand the connection between the novel genes of the present invention and the above mentioned related diseases, for disease diagnosis and prevention purposes, and for monitoring disease progress. Another utility of novel genes of the present invention is anti-GAM gene therapy, a mode of therapy which allows up regulation of a disease related target-gene of a novel GAM gene of the present invention, by lowering levels of the novel GAM gene which naturally inhibits expression of that target gene. This mode of therapy is particularly useful with respect to target genes which have been shown to be under-expressed in association with a specific disease. Anti-GAM gene therapy is further discussed hereinbelow with reference to FIGS. 20A and 20B. A further utility of novel genes of the present invention is GAM replacement therapy, a mode of therapy which achieves down regulation of a disease related target-gene of a novel GAM gene of the present invention, by raising levels of the GAM gene which naturally inhibits expression of that target gene. This mode of therapy is particularly useful with respect to target genes which have been shown to be over-expressed in association with a specific disease. GAM replacement therapy involves introduction of supplementary GAM gene products into a cell, or stimulation of a cell to produce excess GAM gene products. GAM replacement therapy may preferably be achieved by transfecting cells with an artificial DNA molecule encoding a GAM gene, which causes the cells to produce the GAM gene product, as is well known in the art. Yet a further utility of novel genes of the present invention is modified GAM therapy. Disease conditions are likely to exist, in which a mutation in a binding site of a GAM gene prevents natural GAM gene to effectively bind inhibit a disease related target-gene, causing up regulation of that target gene, and thereby contributing to the disease pathology. In such conditions, a modified GAM gene is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM gene, which causes the cells to produce the modified GAM gene product, as is well known in the art. An additional utility of novel genes of the present invention is induced cellular differentiation therapy. As aspect of the present invention is finding genes which determine cellular differentiation, as described hereinabove with reference to FIG. 18. Induced cellular differentiation therapy comprises transfection of cell with such GAM genes thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining GAM gene, thus stimulating these cells to differentiate appropriately.

Figure 20:
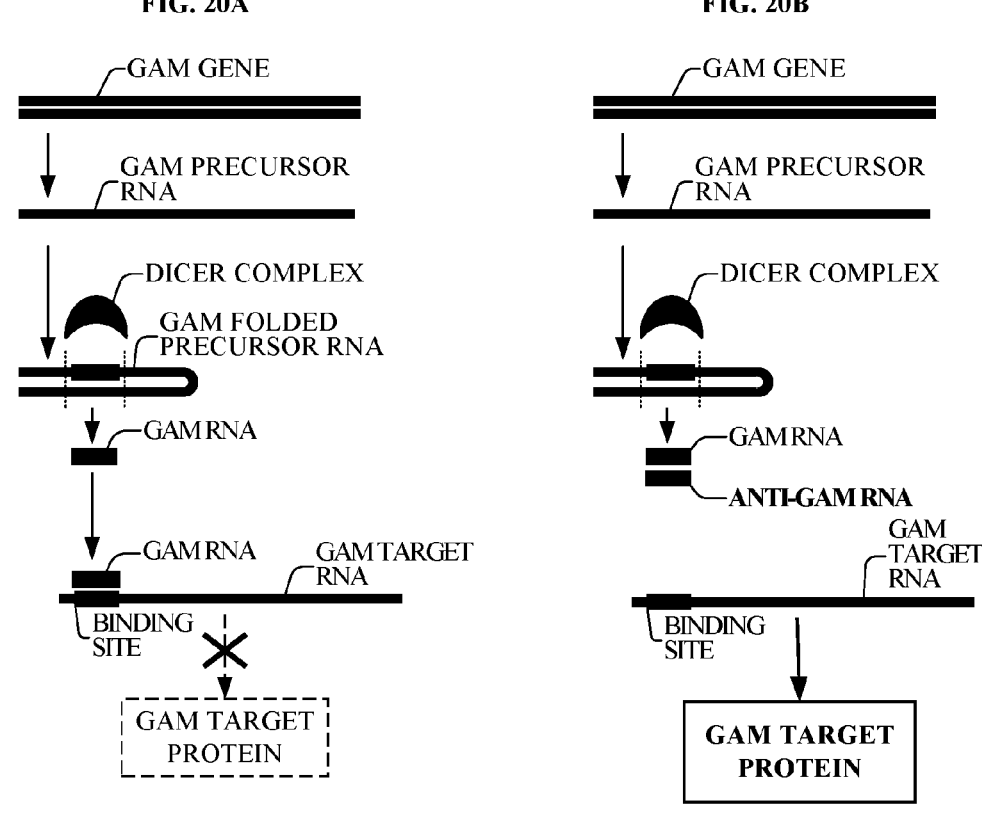
FIGS. 20A and 20B are simplified diagrams, which when taken together illustrate a mode of gene therapy applicable to novel genes of the present invention.

Reference is now made to FIGS. 20A and 20B, simplified diagrams which when taken together illustrate anti-GAM gene therapy mentioned hereinabove with reference to FIG. 19. A utility of novel genes of the present invention is anti-GAM gene therapy, a mode of therapy which allows up regulation of a disease related target-gene of a novel GAM gene of the present invention, by lowering levels of the novel GAM gene which naturally inhibits expression of that target gene. FIG. 20A shows a normal GAM gene, inhibiting translation of a target gene of GAM gene, by binding to a BINDING SITE found in an untranslated region of GAM TARGET RNA, as described hereinabove with reference to FIG. 8.

FIG. 20B shows an example of anti-GAM gene therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM gene therapy is particularly useful with respect to target genes which have been shown to be under-expressed in association with a specific disease. Furthermore, anti-GAM therapy is particularly useful, since it may be used in situations in which technologies known in the art as RNAi and siRNA can not be utilized. As is known in the art, RNAi and siRNA are technologies which offer means for artificially inhibiting expression of a target protein, by artificially designed short RNA segments which bind complementarily to mRNA of said target protein. However, RNAi and siRNA can not be used to directly upregulate translation of target proteins.

Reference is now made to FIG. 21, which is a table summarizing laboratory validation results that validate efficacy of the bioinformatic gene detection engine 100 of FIG. 9. In order to assess efficacy of the bioinformatic gene detection engine 100, novel genes predicted thereby are preferably divided into 4 DETECTION ACCURACY GROUPS (first column), designated A through D, ranking GAMS from the most probable GAMs to the least probable GAMs, using the scores of HAIRPIN DETECTOR 114 and DICER-CUT LOCATION DETECTOR 116 as follows:

Group A: The score of the HAIRPIN-DETECTOR is above 0.7, the overall score of the two-phased predictor is above 0.55, and the score of the second phase of the two-phased predictor is above 0.75. Group B: The score of the EDIT-DISTANCE predictor is equal or above 17. In both groups A and B one miRNA is predicted for each hairpin. Group C: The score of the HAIRPIN-DETECTOR is between 0.6 and 0.7, and the overall score of the two-phased predictor is above 0.55. Group D: The score of the HAIRPIN-DETECTOR is between 0.3 and 0.6, and the overall score of the two-phased predictor is above 0.55. In both groups C and D, for each hairpin both sides of the double stranded window are given as output, and are examined in the lab. The groups are mutually exclusive, i.e. in groups A, C and D all hairpins score less than 17 in the EDIT-DISTANCE predictor. It is appreciated that the division into groups is not exhaustive: 344 of the 440 published hairpins, and 4747 of the 8607 novel GAMs, detected bioinformatically by bioinformatic gene detection engine 100 of the present invention, belong to one of the groups.

Sample novel bioinformatically predicted genes, of each of these groups are sent to the laboratory for validation (third column), and the number (fourth column) and percent (fifth column) of successful validation of predicted genes is noted for each of the groups, as well as overall (bottom line). The number of novel genes explicitly specified by present invention belonging to each of the four groups is noted (sixth column), as is the number of novel genes found in intergenic and intronic RNA (seventh and eighth columns). Expected positives (eighth column) is deduced by multiplying the % success in the lab validation by the number of novel GAMs detected in intronic and intergenic RNA databases.

It is appreciated that the bioinformatic gene detection engine 100 of the present invention detected 200 novel GAM genes, which fall into one of these four detection accuracy groups, and that the bioinformatic prediction is substantiated by a group of 50 novel GAM genes validated by laboratory means, out of 147 genes which were tested in the lab, resulting in validation of an overall 34% accuracy. The top group demonstrated 50% accuracy. Pictures of test-results of specific genes in the abovementioned four groups, as well as the methodology used for validating the expression of predicted genes is elaborated hereinbelow with reference to FIG. 22.

It is further appreciated that failure to detect a gene in the lab does not necessarily indicate a mistaken bioinformatic prediction. Rather, it may be due to technical sensitivity limitation of the lab test, or because the gene is not expressed in the tissue examined, or at the development phase tested.

It is still further appreciated that in general these findings are in agreement with the expected bioinformatic accuracy, as describe hereinabove with reference to FIG. 13B: assuming 80% accuracy of the hairpin detector 114 and 80% accuracy of the dicer-cut location detector 116 and 80% accuracy of the lab validation, this would result in 50% overall accuracy of the genes validated in the lab.

It is further appreciated that up to date, 71 novel GAMs detected by the bioinformatic gene detection engine 100, were confirmed by laboratory PCR-product Hybridization approach, as described hereinbelow with reference to FIG. 22. Furthermore, 22 novel GAMs out of the 71, were further confirmed by cloning and sequencing. Detailed references and laboratory pictures of sample of these GAMs is given in FIG. 22.

Figure 22:
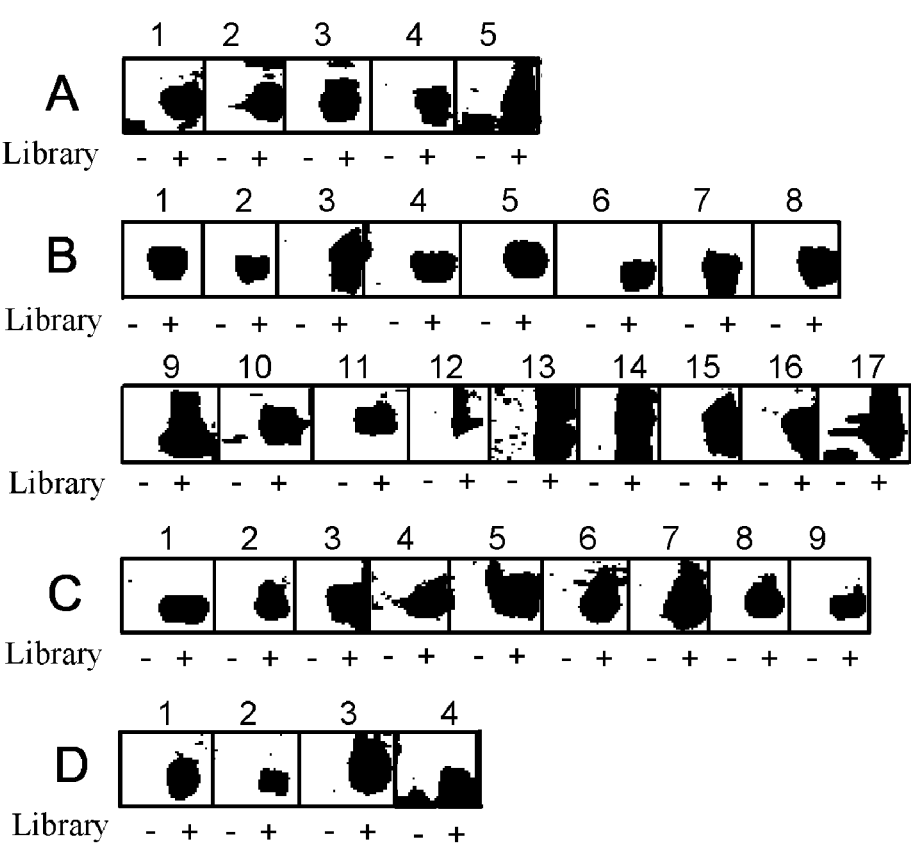
FIG. 22 is a picture of laboratory results validating the expression of 35 novel genes detected by a bioinformatic gene detection engine constructed and operative in accordance with a preferred embodiment of the present invention, thereby validating the efficacy of the gene detection engine of the present invention.

Reference is now made to FIG. 22 which is a picture of laboratory results validating the expression of 35 novel genes detected by the bioinformatic gene detection engine 100, in the four detection accuracy groups A through D described hereinabove with reference to FIG. 21.

Each row in FIG. 22, designated A through D, correlates to a corresponding one of the four detection accuracy groups A-D, described hereinabove with reference to FIG. 21. In each row, pictures of several genes validated by hybridization of PCR-product southern-blots, are provided, each corresponding to a specific GAM gene, as elaborated hereinbelow. These PCR-product hybridization pictures are designated 1 through 5 in the A group, 1 through 12 in the B group, 1 through 9 in the C group, and 1 through 4 in the D group. In each PCR hybridization picture, 2 lanes are seen: the test lane, designated "+" and the control lane, designated "-". For convenience of viewing the results, all PCR-product hybridization pictures of FIG. 22 have been shrunk x4 vertically. It is appreciated that for each of the tested genes, a clear hybridization band appears in the test ("+") lane, but not in the control ("-") lane.

Specifically, FIG. 22 shows pictures of PCR-product hybridization validation by southern-blot, the methodology of which is described hereinbelow, to the following novel GAM genes:DETECTION ACCURACY GROUP A: (1) GAM8297; (2) GAM5346; (3) GAM281; (4) GAM8554; and (5) GAM2071. DETECTION ACCURACY GROUP B: (1) GAM7553; (2) GAM5385; (3) GAM5227; (4) GAM7809; (5) GAM1032; (6) GAM3431; (7) GAM7933; (8) GAM3298; (9) GAM116; (10) GAM3418 (later published by other researchers as MIR23); (11) GAM3499; (12) GAM3027; (13) GAM7080; (14) GAM895; and (15) GAM2608, (16) GAM20, (17) GAM21DETECTION ACCURACY GROUP C: (1) GAM3770; (2) GAM1338; (3) GAM7957; (4) GAM391; (5) GAM 8678; (6) GAM2033; (7) GAM7776; (8) GAM8145.1; and (9) GAM 633DETECTION ACCURACY GROUP D: (1) GAM19; (2) GAM8358; (3) GAM3229; and (4) GAM7052.

In addition to the PCR detection, the following GAMs were confirmed by cloning and sequencing: GAM1338, GAM7809, GAM116, GAM3418 (later published by other researchers as MIR23), GAM3499, GAM3027, GAM7080, and GAM21.

The PCR-product hybridization validation methodology used is briefly described as follows. In order to validate the expression of predicted novel GAM genes, and assuming that these novel genes are probably expressed at low concentrations, a PCR product cloning approach was set up through the following strategy: two types of cDNA libraries designated "One tailed" and "Ligation" were prepared from frozen HeLa S100 extract (4c Biotech, Belgium) size fractionated RNA. Essentially, Total S100 RNA was prepared through an SDS Proteinase K incubation followed by an acid Phenol-Chloroform purification and Isopropanol precipitation. Alternatively, total HeLa RNA was also used as starting material for these libraries. Fractionation was done by loading up to 500 µg per YM100 Amicon Microcon column (Millipore) followed by a 500 g centrifugation for 40 minutes at 4° C. Flowthrough "YM100" RNA consisting of about ¼ of the total RNA was used for library preparation or fractionated further by loading onto a YM30 Amicon Microcon column (Millipore) followed by a 13,500 g centrifugation for 25 minutes at 4° C. Flowthrough "YM30" was used for library preparation as is and consists of less than 0.5% of total RNA. For the both the "ligation" and the "One-tailed" libraries RNA was dephosphorylated and ligated to an RNA (lowercase)-DNA (UPPERCASE) hybrid 5"-phosphorylated, 3" idT blocked 3"-adapter (5"-P-uuuAACCGCATTCTC-idT-3" (SEQ ID NO: 20201) Dharmacon # P-002045-01-05) (as elaborated in Elbashir et al 2001) resulting in ligation only of RNase III type cleavage products. 3"-Ligated RNA was excised and purified from a half 6%, half 13% polyacrylamide gel to remove excess adapter with a Nanosep 0.2 µM centrifugal device (Pall) according to instructions, and precipitated with glycogen and 3 volumes of Ethanol. Pellet was resuspended in a minimal volume of water. For the "ligation" library a DNA (UPPERCASE)-RNA (lowercase) hybrid 5"-adapter (5"-TACTAATACGACTCACTaaa-3" (SEQ ID NO: 20202) Dharmacon # P-002046-01-05) was ligated to the 3"-adapted RNA, reverse transcribed with "EcoRI-RT": (5"-GACTAGCTGGAATTCAAGGATGCGGTTAAA-3" (SEQ ID NO: 20203)), PCR amplified with two external primers essentially as in Elbashir et al 2001 except that primers were "EcoRI-RT" and "PstI Fwd" (5"-CAGCCAACGCT-GCAGATACGACTCACTAAA-3" (SEQ ID NO: 20204)). This PCR product was used as a template for a second round of PCR with one hemispecific and one external primer or with two hemispecific primers.

For the "One tailed" library the 3"-Adapted RNA was annealed to 20 pmol primer "EcoRI RT" by heating to 70° C. and cooling 0.1° C./sec to 30° C. and then reverse transcribed with Superscript II RT (According to instructions, Invitrogen) in a 20 µl volume for 10 alternating 5 minute cycles of 37° C. and 45° C. Subsequently, RNA was digested with 1 µl 2 M NaOH, 2 mM EDTA at 65° C. for 10 minutes. cDNA was loaded on a polyacrylamide gel, excised and gel-purified from excess primer as above (invisible, judged by primer run alongside) and resuspended in 13 µl of water. Purified cDNA was then oligo-dC tailed with 400 U of recombinant terminal transferase (Roche molecular biochemicals), 1 µl 100 µM dCTP, 1 µl 15 mM CoCl2, and 4 µl reaction buffer, to a final volume of 20 µl for 15 minutes at 37° C. Reaction was stopped with 2 µl 0.2 M EDTA and 15 µl 3 M NaOAc pH 5.2. Volume was adjusted to 150 µl with water, Phenol:Bromochloropropane 10:1 extracted and subsequently precipitated with glycogen and 3 volumes of Ethanol. C-tailed cDNA was used as a template for PCR with the external primers "T3-PstBsg(G/I)18" (5"-AATTAACCCTCACTAAAGGCTGCAGGTG-CAGGIGGGIIGGGIIGGGIIGN-3" (SEQ ID NO: 20205) where I stands for Inosine and N for any of the 4 possible deoxynucleotides), and with "EcoRI Nested" (5"-GGAAT-TCAAGGATGCGGTTA-3"(SEQ ID NO: 20206)). This PCR product was used as a template for a second round of PCR with one hemispecific and one external primer or with two hemispecific primers. Hemispecific primers were constructed for each predicted GAM by an in-house program designed to choose about half of the 5" or 3" sequence of the GAM corresponding to a TM of about 30°-34° C. constrained by an optimized 3" clamp, appended to the cloning adapter sequence (for "One-tailed" libraries 5"-GGNNGGGNNG (SEQ ID NO: 20207) on the 5" end of the GAM, or 5"-TT-TAACCGCATC-3" (SEQ ID NO: 20208) on the 3" end of the GAM. For "Ligation" libraries the same 3" adapter and 5"-CGACTCACTAAA (SEQ ID NO: 20209) on the 5" end). Consequently, a fully complementary primer of a TM higher than 60° C. was created covering only one half of the GAM sequence permitting the unbiased elucidation by sequencing of the other half.

CONFIRMATION OF GAM SEQUENCE AUTHENTICITY OF PCR PRODUCTS:SOUTHERN BLOT:PCR-product sequences were confirmed by southern blot (Southern EM. Biotechnology. 1992; 24:122-39. (1975)) and hybridization with DNA oligonucleotide probes synthesized against predicted GAMs. Gels were transferred onto a Biodyne PLUS 0.45 µm, (Pall) positively charged nylon membrane and UV cross-linked. Hybridization was performed overnight with DIG-labeled probes at 42°C in DIG Easy-Hyb buffer (Roche). Membranes were washed twice with 2xSSC and 0.1% SDS for 10 min. at 42°C and then washed twice with 0.5xSSC and 0.1% SDS for 5 min at 42°C. The membrane was then developed by using a DIG luminescent detection kit (Roche) using anti-DIG and CSPD reaction, according to the manufacturer's protocol. All probes were prepared according to the manufacturers (Roche Molecular Biochemicals) protocols: Digoxigenin (DIG) labeled antisense transcripts was prepared from purified PCR products using a DIG RNA labeling kit with T3 RNA polymerase. DIG labeled PCR was prepared by using a DIG PCR labeling kit. 3"-DIG-tailed oligo ssDNA antisense probes, containing DIG-dUTP and dATP at an average tail length of 50 nucleotides were prepared from 100 pmole oligonucleotides with the DIG Oligonucleotide Labeling Kit.

CLONING: PCR products were inserted into pGEM-T (Promega) or pTZ57 (MBI Fermentas), transformed into competent JM109 E. coli (Promega) and sown on LB-Amp plates with IPTG/Xgal. White and light-blue colonies were transferred to duplicate gridded plates, one of which was blotted onto a membrane (Biodyne Plus, Pall) for hybridization with DIG tailed oligo probes (according to instructions, Roche) corresponding to the expected GAM. Plasmid DNA from positive colonies was sequenced.

Figures 23A, 23B, 23C:
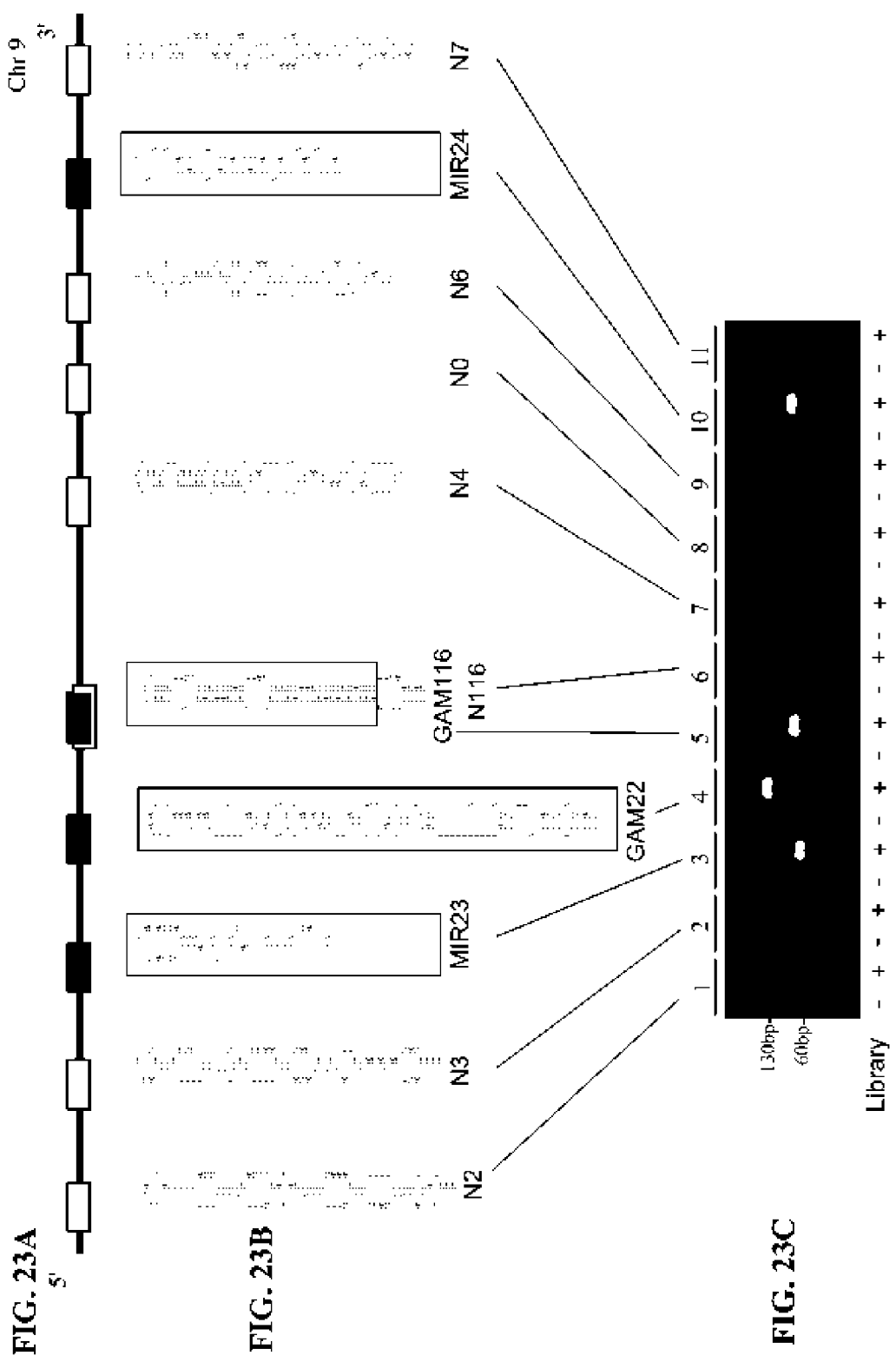
FIG. 23A is a schematic representation of an "operon like" cluster of novel gene hairpin sequences detected bioinformatically by a bioinformatic gene detection engine constructed and operative in accordance with a preferred embodiment of the present invention, and non-GAM hairpin useful as negative controls thereto.
FIG. 23B is a schematic representation of secondary folding of hairpins of the operon-like cluster of FIG. 23A. The hairpins shown are as follows: N2 (SEQ ID NO: 20190), N3 (SEQ ID NO: 20191), MIR23 (SEQ ID NO: 20192), GAM22 (SEQ ID NO: 20193), GAM116 (SEQ ID NO: 20194), N4 (SEQ ID NO: 20195), N0 (SEQ ID NO: 20196), N6 (SEQ ID NO: 20197), MIR24 ((SEQ ID NO: 20198), N7 (SEQ ID NO: 20199), and N116 (SEQ ID NO: 20216)
FIG. 23C is a picture of laboratory results demonstrating expression of novel genes of FIGS. 23A and 23B, and lack of expression of the negative controls, thereby validating efficacy of bioinformatic detection of GAM genes and GR genes of the present invention, by a bioinformatic gene detection engine constructed and operative in accordance with a preferred embodiment of the present invention.

Reference is now made to FIG. 23A, which is a schematic representation of a novel human GR gene, herein designated GR12731 (RosettaGenomics Ltd. Gene Nomenclature), located on chromosome 9, comprising 2 known MIR genes-MIR24 and MIR23, and 2 novel GAM genes, herein designated GAM22 and GAM116, all marked by solid black boxes. FIG. 23A also schematically illustrates 6 non-GAM hairpin sequences, and one non-hairpin sequence, all marked by white boxes, and serving as negative controls. By "non-GAM hairpin sequences" is meant sequences of a similar length to known MIR PRECURSOR sequences, which form hairpin secondary folding pattern similar to MIR PRECURSOR hairpins, and yet which are assessed by the bioinformatic gene detection engine 100 not to be valid GAM PRECURSOR hairpins. It is appreciated that FIG. 23A is a simplified schematic representation, reflecting only the order in which the segments of interest appear relative to one another, and not a proportional distance between the segments.

Reference is now made to FIG. 23B, which is a schematic representation of secondary folding of each of the MIRs and GAMs of GR GR12731 MIR24 (SEQ ID NO: 20198), MIR23 (SEQ ID NO: 20192), GAM22 (SEQ ID NO: 20193) and GAM116 (SEQ ID NO: 20194), and of the negative control non-GAM hairpins, herein designated N2, (SEQ ID NO: 20190) N3 (SEQ ID NO: 20191), N116 (SEQ ID NO: 20216), N4 (SEQ ID NO: 20195), N6 (SEQ ID NO: 20197) and N7 (SEQ ID NO: 20199). N0 (SEQ ID NO: 20196) is a non-hairpin control, of a similar length to that of known MIR PRECURSOR hairpins. It is appreciated that the negative controls are situated adjacent to and in between real MIR genes and GAM predicted oligonucleotide and demonstrates similar secondary folding patterns to that of known MIRs and GAMs.

Reference is now made to FIG. 23C, which is a picture of laboratory results of a PCR test upon a YM100 "ligation"-library, utilizing specific primer sets directly inside the boundaries of the hairpins. Due to the nature of the library the only PCR amplifiable products can result from RNaseIII type enzyme cleaved RNA, as expected for legitimate hairpin precursors presumed to be produced by DROSHA (Lee et al, Nature 425 415-419, 2003). FIG. 23C demonstrates expression of hairpin precursors of known MIR genes-MIR23 and MIR24, and of novel bioinformatically detected GAM22 and GAM116 genes predicted bioinformatically by a system constructed and operative in accordance with a preferred embodiment of the present invention. FIG. 23C also shows that none of the 7 controls (6 hairpins designated N2, N3, N23, N4, N6 and N7 and 1 non-hairpin sequence designated N0) were expressed. N116 is a negative control sequence partially overlapping GAM116.

In the picture, test lanes including template are designated "+" and the control lane is designated "-". It is appreciated that for each of the tested hairpins, a clear PCR band appears in the test ("+") lane, but not in the control ("-") lane.

FIGS. 23A through 23C, when taken together validate the efficacy of the bioinformatic gene detection engine in: (a) detecting known MIR genes; (b) detecting novel GAM genes which are found adjacent to these MIR genes, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM genes, since hairpins in general are highly abundant in the genome. Other MIR prediction programs have not been able to address this challenge successfully.

Reference is now made to FIG. 24A which is an annotated sequence of an EST comprising a novel gene detected by the gene detection system of the present invention. FIG. 24A shows the nucleotide sequence of a known human non-protein coding EST (Expressed Sequence Tag), identified as EST72223 (SEQ ID NO: 20200). The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA gene, identified as MIR98, and of one novel GAM gene, referred to here as GAM25, detected by the bioinformatic gene detection system of the present invention and described hereinabove with reference to FIG. 9.

The sequences of the precursors of the known MIR98 and of the predicted GAM25 are in bold, the sequences of the established miRNA 98 and of the predicted miRNA GAM25 are underlined.

Reference is now made to FIGS. 24B, 24C and 24D that are pictures of laboratory results, which when taken together demonstrate laboratory confirmation of expression of the bioinformatically detected novel gene of FIG. 24A. In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with a 102 nt and a 145 nt antisense MIR98 and GAM25 precursor transcript probes respectively. The Northern blot results of these experiments demonstrated processing of EST72223 RNA by Hela lysate (lanes 2-4, in 24B and 24C), into ~80 bp and ~22 bp segments, which reacted with the MIR98 precursor probe (24B), and into ~100 bp and ~24 bp segments, which reacted with the GAM25 precursor probe (24C). These results demonstrate the processing of EST72223 by Hela lysate into MIR98 precursor and GAM25 precursor. It is also appreciated from FIG. 24C (lane 1) that Hela lysate itself reacted with the GAM25 precursor probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 miRNA precursors into their respective miRNA's, transcripts of MIR98 and of the bioinformatically predicted GAM25, were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 precursor probes. Capped transcripts were prepared for in-vitro RNA cleavage assays with T7 RNA polymerase including a $m^7G(5')ppp(5')G$-capping reaction the mMessage mMachine kit (Ambion). Purified PCR products were used as template for the reaction. These were amplified for each assay with specific primers containing a T7 promoter at the 5" end and a T3 RNA polymerase promoter at the 3"end. Capped RNA transcripts were incubated at 30° C. in supplemented, dialysis concentrated, Hela S100 cytoplasmic extract (4C Biotech, Seneffe, Belgium). The Hela S100 was supplemented by dialysis to a final concentration of 20 mM Hepes, 100 mM KCl, 2.5 mM $MgCl_2$, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 µg/ml creatine kinase, 25 mM creatine phosphate, 2.5 mM DTT and 50% S100 extract. Proteinase K, used to enhance Dicer activity (Zhang H, Kolb FA, Brondani V, Billy E, Filipowicz W. Human Dicer preferentially cleaves dsRNAs at their termini without a requirement for ATP.EMBO J. 2002 Nov 1; 21(21):5875-85) was dissolved in 50 mM Tris-HCl pH 8, 5 mM $CaCl_2$, and 50% glycerol, was added to a final concentration of 0.6 mg/ml. Cleavage reactions were stopped by the addition of 8 volumes of proteinase K buffer (200 Mm Tris-Hcl, pH 7.5, 25 mM EDTA, 300 mM NaCl, and 2% SDS) and incubated at 65° C. for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1XTBE-7 M Urea gel.

The Northern blot results of these experiments demonstrated an accumulation of a ~22 bp segment which reacted with the MIR98 precursor probe, and of a ~24 bp segment which reacted with the GAM25 precursor probe, over time (lanes 5-8). Absence of these segments when incubated with EDTA (lane 9), which is known to inhibit Dicer enzyme (Zhang et al., 2002), supports the notion that the processing of MIR98 and GAM25 miRNA's from their precursors is mediated by Dicer enzyme, found in Hela lysate. The molecular sizes of EST72223, MIR98 and GAM25 and their corresponding precursors are indicated by arrows.

FIG. 24D present Northern blot results of same above experiments with GAM25 probe (24 nt). The results clearly demonstrated the accumulation of mature GAM25 gene after 24 h.

To validate the identity of the band shown by the lower arrow in FIGS. 24C and 24D, a RNA band parallel to a marker of 24 base was excised from the gel and cloned as in Elbashir et al (2001) and sequenced. 90 clones corresponded to the sequence of mature GAM25 gene, three corresponded to GAM25 (the opposite arm of the hairpin with a 1-3 nucleotide 3" overhang) and two to the hairpin-loop.

GAM25 was also validated endogenously by sequencing from both sides from a HeLa YM100 total-RNA "ligation" libraries, utilizing hemispecific primers as detailed in FIG. 22.

Taken together, these results validate the presence and processing of a novel MIR gene product, GAM25, which was predicted bioinformatically. The processing of this novel gene product, by Hela lysate from EST72223, through its precursor, to its final form was similar to that observed for known gene, MIR98.

Transcript products were 705 nt (EST72223), 102 nt (MIR98 precursor), 125 nt (GAM25 precursor) long. EST72223 was PCR amplified with T7-EST72223 forward primer: 5"-TAATACGACTCACTATAGGCCCTTATTA-GAGGATTCTGCT-3" (SEQ ID NO: 20210) and T3-EST72223 reverse primer: 5"-AATTAACCCTCAC-TAAAGGTTTTTTTTTCCTGAGACAGAGT-3"(SEQ ID NO: 20211). MIR98 was PCR amplified using EST72223 as a template with T7MIR98 forward primer: 5-"TAATAC-GACTCACTATAGGGTGAGGTAGTAAGTTGTATTGTT-3" (SEQ ID NO: 20212) and T3MIR98 reverse primer: 5"-AATTAACCCTCACTAAAGGGAAAGTAG-TAAGTTGTATAGTT-3" (SEQ ID NO: 20213). GAM25 was PCR amplified using EST72223 as a template with GAM25 forward primer: 5"-GAGGCAGGAGAATTGCTTGA-3" (SEQ ID NO: 20214) and T3-EST72223 reverse primer: 5"-AATTAACCCTCACTAAAGGCCTGAGACA-GAGTCTTGCTC-3"(SEQ ID NO: 20215).

It is appreciated that the data presented in FIGS. 24A, 24B, 24C and 24D when taken together validate the function of the bioinformatic gene detection engine 100 of FIG. 9. FIG. 24A shows a novel GAM gene bioinformatically detected by the bioinformatic gene detection engine 100, and FIGS. 24C and 24D show laboratory confirmation of the expression of this novel gene. This is in accord with the engine training and validation methodology described hereinabove with reference to FIG. 10.

FIG. 8 further provides a conceptual description of a novel bioinformatically detected of the present invention, referred to here as Genomic Address Messenger 25 (GAM25), which modulates expression of respective target genes thereof, the function and utility of which target genes is known in the art.

GAM25 is a novel bioinformatically detected regulatory, non protein coding, micro RNA (miRNA) gene. The method by which GAM25 was detected is described hereinabove with reference to FIGS. 8-15.

GAM25 gene, herein designated GAM GENE, and GAM25 target gene, herein designated TARGET GENE, are human genes contained in the human genome.

GAM25 gene encodes a GAM25 precursor RNA, herein designated GAM PRECURSOR RNA. Similar to other miRNA genes, and unlike most ordinary genes, GAM25 precursor RNA does not encode a protein. A nucleotide sequence identical or highly similar to the nucleotide sequence of GAM25 precursor RNA is designated SEQ ID:156, and is provided hereinbelow with reference to the sequence listing part.

GAM25 precursor RNA folds onto itself, forming GAM25 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM25 precursor RNA folds onto itself, forming GAM25 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM25 precursor RNA, designated SEQ-ID: 156, and a schematic representation of a predicted secondary folding of GAM25 folded precursor RNA are further described with reference to Table 2, hereby incorporated by reference.

An enzyme complex designated DICER COMPLEX, 'dices' the GAM25 folded precursor RNA into GAM25 rNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM25 RNA is designated SEQ ID:206, and is provided hereinbelow with references to the sequence listing part and Table 3, hereby incorporated by reference.

GAM25 target gene, herein designated TARGET GENE, encodes a corresponding messenger RNA, GAM25 target RNA, herein designated GAM TARGET RNA. GAM25 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM25 rNA, herein designated GAM RNA, binds complementarily to one or more target binding sites located in untranslated regions of GAM25 target RNA, herein designated GAM TARGET RNA. This complementary binding is due to the fact that the nucleotide sequence of GAM25 rNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM25 rNA may have a different number of target binding sites in untranslated regions of a GAM25 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM25 rNA, herein designated GAM RNA, to target binding sites on GAM25 target RNA, herein designated GAM TARGET RNA, such as BINDING SITE I, BINDING SITE II and BINDING SITE III, inhibits translation of GAM25 target RNA into GAM25 target protein, herein designated GAM TARGET PROTEIN. GAM target protein is therefore outlined by a broken line.

It is appreciated that GAM25 target gene, herein designated TARGET GENE, in fact represents a plurality of GAM25 target genes. The mRNA of each one of this plurality of GAM25 target genes comprises one or more target binding sites, each having a nucleotide sequence which is at least partly complementary to GAM25 RNA, herein designated GAM RNA, and which when bound by GAM25 rNA causes inhibition of translation of respective one or more GAM25 target proteins.

It is further appreciated by one skilled in the art that the mode of translational inhibition illustrated by FIG. 8 with specific reference to translational inhibition exerted by GAM25 gene, herein designated GAM GENE, on one or more GAM25 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM25 correlate with, and may be deduced from, the identity of the target genes which GAM25 binds and inhibits, and the function of these target genes, as elaborated hereinbelow.

Alpha-1-b glycoprotein (A1BG, Accession NP_570602.2) is a GAM25 target gene, herein designated TARGET GENE. A1BG BINDING SITE is a target binding site found in the 3' untranslated region of mRNA encoded by A1BG, corresponding to a target binding site such as BINDING SITE I, BINDING SITE II or BINDING SITE III of FIG. 8. Table 4 illustrates the complementarity of the nucleotide sequences of A1BG BINDING SITE, designated SEQ ID:10249, to the nucleotide sequence of GAM25 rNA, herein designated GAM RNA, also designated SEQ ID:206.

A function of GAM25 is therefore inhibition of Alpha-1-b glycoprotein (A1BG, Accession NP_570602.2), a gene which a plasma protein of unknown function. Accordingly, utilities of GAM25 include diagnosis, prevention and treatment of diseases and clinical conditions associated with A1BG.

The function of A1BG has been established by previous studies. The complete amino acid sequence of alpha-1B-glycoprotein, a plasma protein of unknown function, was determined by Ishioka et al. (1986). Sequence homology to immunoglobulins was recognized. Alpha-1B-glycoprotein is present in normal adult plasma at an average concentration of 22 mg/dl. Gahne et al. (1987) observed genetic polymorphism of A1B using one-dimensional horizontal polyacrylamide gel electrophoresis followed by Western blotting with specific antiserum. Three different phenotypes, designated 1-1, 1-2, and 2-2, were observed. Family data supported the hypothesis that the three phenotypes are determined by 2 codominant alleles at an autosomal locus. In pigs the homologous locus is linked to malignant hyperthermia (OMIM Ref. No. 145600). Several other linkages in pigs and in horses suggest that human chromosomes 19, 6, and 1 are 'candidate chromosomes' for bearing the human A1B. Juneja et al. (1988) found a higher degree of A1B polymorphism in American blacks than in Caucasian populations. They described new alleles. Eiberg et al. (1989) reported exclusion data for localization of the alpha-1B-glycoprotein gene polymorphism. Eiberg et al. (1989) found linkage between A1BG and Lutheran blood group (OMIM Ref. No. 111150); lod =3.06 at theta =0.05 in males, and lod =1.42 at theta =0.10 in females. They suggested that the most likely order of genes on chromosome 19 is C3-SE-LU-A1BG.

Full details of the abovementioned studies are described in the following publications, the disclosure of which are hereby incorporated by reference:

Ishioka, N.; Takahashi, N.; Putnam, F. W.: Amino acid sequence of human plasma alpha- 1B-glycoprotein: homology to the immunoglobulin supergene family. Proc. Nat. Acad. Sci. 83:2363-2367, 1986; and Eiberg, H.; Bisgaard, M. L.; Mohr, J.: Linkage between alpha-1-B-glycoprotein (A1BG) and Lutheran (LU) red blood group system: assignment to chromosome 19: new genetic variants of A1BG.

Further studies establishing the function and utilities of A1BG are found in John Hopkins OMIM database record ID 138670, and in cited publications listed in Table 5, which are hereby incorporated by reference. Acyl-coenzyme a dehydrogenase, short/branched chain (ACADSB, Accession NP_001600.1) is another GAM25 target gene, herein designated TARGET GENE. ACADSB BINDING SITE is a target binding site found in the 3' untranslated region of mRNA encoded by ACADSB, corresponding to a target binding site such as BINDING SITE I, BINDING SITE II or BINDING SITE III of FIG. 8. Table 4 illustrates the complementarity of the nucleotide sequences of ACADSB BINDING SITE, designated SEQ ID:2370, to the nucleotide sequence of GAM25 rNA, herein designated GAM RNA, also designated SEQ ID:206.

Another function of GAM25 is therefore inhibition of Acyl-coenzyme a dehydrogenase, short/branched chain (ACADSB, Accession NP_001600.1). Accordingly, utilities of GAM25 include diagnosis, prevention and treatment of diseases and clinical conditions associated with ACADSB.

A disintegrin-like and metalloprotease (reprolysin type) with thrombospondin type 1 motif, 4 (ADAMTS4, Accession NP_005090.1) is another GAM25 target gene, herein designated TARGET GENE. ADAMTS4 BINDING SITE1 and ADAMTS4 BINDING SITE2 are target binding sites found in untranslated regions of mRNA encoded by ADAMTS4, corresponding to target binding sites such as BINDING SITE I, BINDING SITE II or BINDING SITE III of FIG. 8. Table 4 illustrates the complementarity of the nucleotide sequences of ADAMTS4 BINDING SITE1 and ADAMTS4 BINDING SITE2, designated SEQ ID:12986 and SEQ ID:7708 respectively, to the nucleotide sequence of GAM25 rNA, herein designated GAM RNA, also designated SEQ ID:206.

Another function of GAM25 is therefore inhibition of A disintegrin-like and metalloprotease (reprolysin type) with thrombospondin type 1 motif, 4 (ADAMTS4, Accession NP_005090.1), a gene which cleaves aggrecan, a cartilage proteoglycan, and may be involved in its turnover. Accordingly, utilities of GAM25 include diagnosis, prevention and treatment of diseases and clinical conditions associated with ADAMTS4.

The function of ADAMTS4 has been established by previous studies. Aggrecan degradation is an important factor in the erosion of articular cartilage in arthritic diseases. This degradation involves proteolysis of the aggrecan core protein near the N terminus, where 2 major cleavage sites have been identified. Matrix metalloproteinases (MMPs) cleave aggrecan between asn341 and phe342. Aggrecanase cleaves aggrecan between glu373 and ala374. Tortorella et al. (1999) purified and partially sequenced bovine aggrecanase-1. By PCR with primers designed from a highly homologous murine EST, they cloned sequences from the homologous human cDNA. They assembled a full-length open reading frame from this initial human PCR product and from another human EST. The human aggrecanase-1 (ADAMTS4) open reading frame encodes an 837-amino acid protein with a signal sequence, a propeptide domain, a catalytic domain, a disintegrin-like domain, and a C-terminal domain with a thrombospondin (TSP) type 1 motif. There is a conserved zinc-binding domain and a furin-sensitive sequence. The presence of a probable cysteine switch sequence in aggrecanase-1 suggested that, like the MMPs, it is synthesized as a zymogen and is cleaved to remove the propeptide domain and generate the mature active enzyme. A cloned portion of the bovine aggrecanase-1 cDNA was 94% homologous to the human cDNA. Human aggrecanase-1 cleaved bovine aggrecan between the glu373-ala374, but not the asn341-phe342, bond. Tortorella et al. (1999) stated that ADAMTS4 mRNA is present in brain, lung, and heart, and at very low levels in placenta and muscle tissues. By RT-PCR, Tortorella et al. (1999) observed upregulation of the aggrecanase-1 message in stimulated human fetal chondrocytes and in joint tissues from adjuvant arthritic rats. Using a GeneBridge 4 radiation hybrid panel, Ishikawa et al. (1998) mapped the ADAMTS4 gene to chromosome 1. Hurskainen et al. (1999) mapped the human ADAMTS4 gene to chromosome 1 by somatic cell hybrid analysis. They mapped the mouse Adamts4 gene to chromosome 1.

Full details of the abovementioned studies are described in the following publications, the disclosure of which are hereby incorporated by reference:

Tortorella, M. D.; Burn, T. C.; Pratta, M. A.; Abbaszade, I.; Hollis, J. M.; Liu, R.; Rosenfeld, S. A.; Copeland, R. A.; Decicco, C. P.; Wynn, R.; Rockwell, A.; Yang, F.; and 16 others: Purification and cloning of aggrecanase-1: a member of the ADAMTS family of proteins. Science 284: 1664-1666, 1999; and Hurskainen, T. L.; Hirohata, S.; Seldin, M. F.; Apte, S. S.: ADAM-TS5, ADAM-TS6, and ADAM-TS7, novel members of a new family of zinc metalloproteases: general features and genomic dist.

Further studies establishing the function and utilities of ADAMTS4 are found in John Hopkins OMIM database record ID 603876, and in cited publications listed in Table 5, which are hereby incorporated by reference. Aryl hydrocarbon receptor (AHR, Accession NP_001612.1) is another GAM25 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:13044, to the nucleotide sequence of GAM25 rNA, herein designated GAM RNA, also designated SEQ ID:206.

Another function of GAM25 is therefore inhibition of Aryl hydrocarbon receptor (AHR, Accession NP_001612.1), a gene which plays a role in modulating carcinogenesis through the induction of xenobiotic-metabolizing enzymes and therefore may be associated with Stomach tumors. Accordingly, utilities of GAM25 include diagnosis, prevention and treatment of Stomach tumors, and of other diseases and clinical conditions associated with AHR.

The function of AHR has been established by previous studies. Halogenated aromatic hydrocarbons, represented by 2,3,7,8-tetrachlorodibenzo-p-dioxin (TCDD), are environmental pollutants that are produced by minor side-reactions in chemical manufacturing processes and by combustion of waste materials. These chemicals cause potent and pleiotropic toxicity, including teratogenesis, immune suppression, epithelial disorders, and tumor production in experimental animals. At the molecular level, aldehyde dehydrogenase, quinone reductase, and various drug-metabolizing enzymes are induced by the chemicals in some cultured cells and some tissues of experimental animals. All these biologic effects are thought to be mediated by an intracellular aryl hydrocarbon receptor (AHR). By fluorescence in situ hybridization and by DNA blot hybridization using human/mouse or human/Chinese hamster hybrid cell DNAs, Ema et al. (1994) assigned the AHR gene to 7p21. By use of PCR analysis of somatic cell hybrids and fluorescence in situ hybridization of metaphase cells, Le Beau et al. (1994) localized the AHR gene to 7p21-p15. Micka et al. (1997) localized the AHR gene to 7p15 using fluorescence in situ hybridization. Performing linkage analysis in a 3-generation family, they showed with good probability that the high CYP1A1 (OMIM Ref. No. 108330) inducibility phenotype segregates with the 7p15 region.

Animal model experiments lend further support to the function of AHR. To determine whether the aryl hydrocarbon receptor plays a role in modulating carcinogenesis through the induction of xenobiotic-metabolizing enzymes, Shimizu et al. (2000) studied Ahr-deficient mice exposed to benzo(a) pyrene, a widely distributed environmental carcinogen.

It is appreciated that the abovementioned animal model for AHR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ema, M.; Matsushita, N.; Sogawa, K.; Ariyama, T.; Inazawa, J.; Nemoto, T.; Ota, M.; Oshimura, M.; Fujii-Kuriyama, Y.: Human arylhydrocarbon receptor: functional expression and chromosomal assignment to 7p21. J. Biochem. 116:845-851, 1994; and Shimizu, Y.; Nakatsuru, Y.; Ichinose, M.; Takahashi, Y.; Kume, H.; Mimura, J.; Fujii-Kuriyama, Y.; Ishikawa, T.: Benzo[a]pyrene carcinogenicity is lost in mice lacking the aryl hydrocar.

Further studies establishing the function and utilities of AHR are found in John Hopkins OMIM database record ID 600253, and in cited publications listed in Table 5, which are hereby incorporated by reference. AP1S3 (Accession XP_291023.1) is another GAM25 target gene, herein designated TARGET GENE. AP1S3 BINDING SITE is a target binding site found in the 3' untranslated region of multiple transcripts of mRNA encoded by AP1S3, corresponding to a target binding site such as BINDING SITE I, BINDING SITE II or BINDING SITE III of FIG. 8. Table 4 illustrates the complementarity of the nucleotide sequences of AP1S3 BINDING SITE, designated SEQ ID:16221, to the nucleotide sequence of GAM25 rNA, herein designated GAM RNA, also designated SEQ ID:206.

Another function of GAM25 is therefore inhibition of AP1S3 (Accession XP_291023.1). Accordingly, utilities of GAM25 include diagnosis, prevention and treatment of diseases and clinical conditions associated with AP1S3.

Apoptotic protease activating factor (APAF1, Accession NP_001151.1) is another GAM25 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:8675 and SEQ ID:8675 respectively, to the nucleotide sequence of GAM25 rNA, herein designated GAM RNA, also designated SEQ ID:206.

Another function of GAM25 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM25 include diagnosis, prevention and treatment of Cancer, and of other diseases and clinical conditions associated with APAF1.

The function of APAF1 has been established by previous studies. Metastatic melanoma is a deadly cancer that fails to respond to conventional chemotherapy. Mutations in p53 (OMIM Ref. No. 191170) often occur in aggressive and chemoresistant cancers but are rarely observed in melanoma. Soengas et al. (2001) showed that metastatic melanomas often lose APAF1. Loss of APAF1 expression was accompanied by allelic loss in metastatic melanomas, but could be recovered in melanoma cell lines by treatment with the methylation inhibitor 5-aza-2-prime-deoxycytidine (5aza2dC). APAF1-negative melanomas were invariably chemoresistant and were unable to execute a typical apoptotic program in response to p53 activation. Restoring physiologic levels of APAF1 through gene transfer or 5aza2dC treatment markedly enhanced chemosensitivity and rescued the apoptotic defects associated with APAF1 loss. Soengas et al. (2001) concluded that APAF1 is inactivated in metastatic melanomas, leading to defects in the execution of apoptotic cell death.

Animal model experiments lend further support to the function of APAF1. Yoshida et al. (1998) also produced Apaf1-deficient mice which exhibited reduced apoptosis in the brain and striking craniofacial abnormalities with hyperproliferation of neuronal cells. Apaf1-deficient cells were resistant to a variety of apoptotic stimuli, and the processing of caspases-2, -3, and -8 was impaired. However, both Apaf1 -/- thymocytes and activated T lymphocytes were sensitive to Fas-induced killing, showing that Fas-mediated apoptosis in these cells is independent of Apaf1. These data indicated that Apaf1 plays a central role in the common events of mitochondria-dependent apoptosis in most death pathways and that this role is critical for normal development.

It is appreciated that the abovementioned animal model for APAF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Soengas, M. S.; Capodieci, P.; Polsky, D.; Mora, J.; Esteller, M.; Opitz-Aray, X.; McCombie, R.; Herman, J. G.; Gerald, W. L.; Lazebnik, Y. A.; Cordon-Cardo, C.; Lowe, S. W.: Inactivation of the apoptosis effector Apaf-1 in malignant melanoma. Nature 409:207-211, 2001; and Yoshida, H.; Kong, Y.-Y.; Yoshida, R.; Elia, A. J.; Hakem, A.; Hakem, R.; Penninger, J. M.; Mak, T. W.: Apaf1 is required for mitochondrial pathways of apoptosis and brain development.

Further studies establishing the function and utilities of APAF1 are found in John Hopkins OMIM database record ID 602233, and in cited publications listed in Table 5, which are hereby incorporated by reference. Apoptotic protease activating factor (APAF, Accession NP_001151.1) is another GAM25 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:9041 and SEQ ID:9041 respectively, to the nucleotide sequence of GAM25 rNA, herein designated GAM RNA, also designated SEQ ID:206.

Another function of GAM25 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM25 include diagnosis, prevention and treatment of Cancer, and of other diseases and clinical conditions associated with APAF1.

The function of APAF1 has been established by previous studies. Metastatic melanoma is a deadly cancer that fails to respond to conventional chemotherapy. Mutations in p53 (OMIM Ref. No. 191170) often occur in aggressive and chemoresistant cancers but are rarely observed in melanoma. Soengas et al. (2001) showed that metastatic melanomas often lose APAF1. Loss of APAF1 expression was accompanied by allelic loss in metastatic melanomas, but could be recovered in melanoma cell lines by treatment with the methylation inhibitor 5-aza-2-prime-deoxycytidine (5aza2dC). APAF1-negative melanomas were invariably chemoresistant and were unable to execute a typical apoptotic program in response to p53 activation. Restoring physiologic levels of APAF1 through gene transfer or 5aza2dC treatment markedly enhanced chemosensitivity and rescued the apoptotic defects associated with APAF1 loss. Soengas et al. (2001) concluded that APAF1 is inactivated in metastatic melanomas, leading to defects in the execution of apoptotic cell death.

Animal model experiments lend further support to the function of APAF1. Yoshida et al. (1998) also produced Apaf1-deficient mice which exhibited reduced apoptosis in the brain and striking craniofacial abnormalities with hyperproliferation of neuronal cells. Apaf1-deficient cells were resistant to a variety of apoptotic stimuli, and the processing of caspases-2, -3, and -8 was impaired. However, both Apaf1 -/-thymocytes and activated T lymphocytes were sensitive to Fas-induced killing, showing that Fas-mediated apoptosis in these cells is independent of Apaf1. These data indicated that Apaf1 plays a central role in the common events of mitochondria-dependent apoptosis in most death pathways and that this role is critical for normal development.

It is appreciated that the abovementioned animal model for APAF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Soengas, M. S.; Capodieci, P.; Polsky, D.; Mora, J.; Esteller, M.; Opitz-Aray, X.; McCombie, R.; Herman, J. G.; Gerald, W. L.; Lazebnik, Y. A.; Cordon-Cardo, C.; Lowe, S. W.: Inactivation of the apoptosis effector Apaf-1 in malignant melanoma. Nature 409:207-211, 2001; and Yoshida, H.; Kong, Y.-Y.; Yoshida, R.; Elia, A. J.; Hakem, A.; Hakem, R.; Penninger, J. M.; Mak, T. W.: Apaf1 is required for mitochondrial pathways of apoptosis and brain development.

Further studies establishing the function and utilities of APAF1 are found in John Hopkins OMIM database record ID 602233, and in cited publications listed in Table 5, which are hereby incorporated by reference. APM1 (Accession NP_004788.1) is another GAM25 target gene, herein designated TARGET GENE. APM1 BINDING SITE is a target binding site found in the 3' untranslated region of mRNA encoded by APM1, corresponding to a target binding site such as BINDING SITE I, BINDING SITE II or BINDING SITE III of FIG. 8. Table 4 illustrates the complementarity of the nucleotide sequences of APM1 BINDING SITE, designated SEQ ID:10422, to the nucleotide sequence of GAM25 RNA, herein designated GAM RNA, also designated SEQ ID:206.

Another function of GAM25 is therefore inhibition of APM1 (Accession NP_004788.1). Accordingly, utilities of GAM25 include diagnosis, prevention and treatment of diseases and clinical conditions associated with APM1.

Apolipoprotein b mrna editing enzyme, catalytic polypeptide-like 3f (APOBEC3F, Accession NP_660341.2) is another GAM25 target gene, herein designated TARGET GENE. APOBEC3F BINDING SITE is a target binding site found in the 3' untranslated region of mRNA encoded by APOBEC3F, corresponding to a target binding site such as BINDING SITE I, BINDING SITE II or BINDING SITE III of FIG. 8. Table 4 illustrates the complementarity of the nucleotide sequences of APOBEC3F BINDING SITE, designated SEQ ID:11252, to the nucleotide sequence of GAM25 rNA, herein designated GAM RNA, also designated SEQ ID:206.

Another function of GAM25 is therefore inhibition of Apolipoprotein b mrna editing enzyme, catalytic polypeptide-like 3f (APOBEC3F, Accession NP_660341.2). Accordingly, utilities of GAM25 include diagnosis, prevention and treatment of diseases and clinical conditions associated with APOBEC3F.

Aquaporin 6, kidney specific (AQP6, Accession NP_001643.1) is another GAM25 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:6016, to the nucleotide sequence of GAM25 rNA, herein designated GAM RNA, also designated SEQ ID:206.

Another function of GAM25 is therefore inhibition of Aquaporin 6, kidney specific (AQP6, Accession NP_001643.1), a gene which participates in distinct physiologic function such as glomerular filtration, tubular endocytosis, and acid-base metabolism. Accordingly, utilities of GAM25 include diagnosis, prevention and treatment of diseases and clinical conditions associated with AQP6.

The function of AQP6 has been established by previous studies. Ma et al. (1997), who referred to this gene as aquaporin-6 (AQP6), demonstrated that, among the 7 human aquaporins cloned to that time (AQPs 0 to 6), the genes encoding the 4 most closely related aquaporins all mapped to 12q13: AQP0, AQP2, AQP5 (OMIM Ref. No. 600442), and AQP6. To construct a physical map and identify novel aquaporin gene members of this cluster, Ma et al. (1997) screened a human CEPH B YAC library by PCR using primers derived from exon 4 of the AQP2 and AQP0 genes. A YAC clone with 200 kb of human DNA was isolated an analyzed. Primary pulsed field gel electrophoresis and Southern blot analysis indicated the presence of AQP2, AQP5, and AQP6 genes, but not AQP0. Restriction mapping and PCR analysis yielded a precise physical map in which the 3 aquaporin genes spanned only approximately 27 kb with the order, transcription orientation, and spacer length as follows: 5-prime-AQP2-5kb spacer-AQP5-7kb spacer-AQP6-3-prime. Yasui et al. (1999) showed that AQP6 is localized exclusively in intracellular membranes in renal epithelia. Sequential ultracentrifugation of rat kidney homogenates confirmed that AQP6 resides predominantly in vesicular fractions, and immunohistochemical and immunoelectron microscopic studies confirmed that more than 98% of AQP6 is located in intracellular membrane vesicles. In glomeruli, AQP6 is present in membrane vesicles within podocyte cell bodies and foot processes. In proximal tubules, AQP6 is also abundant in membrane vesicles within the subapical compartment of segment 2 and segment 3 cells, but was not detected in the brush border or basolateral membranes. In collecting duct, AQP6 resides in intracellular membrane vesicles in apical, mid, and basolateral cytoplasm of type A intercalated cells, but was not observed in the plasma membrane. Unlike other members of the AQP family, the unique distribution in intracellular membrane vesicles in multiple types of renal epithelia indicated that AQP6 is not simply involved in transcellular fluid absorption. These studies predicted that AQP6 participates in distinct physiologic function such as glomerular filtration, tubular endocytosis, and acid-base metabolism.

Full details of the abovementioned studies are described in the following publications, the disclosure of which are hereby incorporated by reference:

Ma, T.; Yang, B.; Umenishi, F.; Verkman, A. S.: Closely spaced tandem arrangement of AQP2, AQP5, and AQP6 genes in a 27-kilobase segment at chromosome locus 12q13. Genomics 43:387-389, 1997; and Yasui, M.; Kwon, T.-H.; Knepper, M. A.; Nielsen, S.; Agre, P.: Aquaporin-6: an intracellular vesicle water channel protein in renal epithelia. Proc. Nat. Acad. Sci. 96:5808-5813, 1999.

Further studies establishing the function and utilities of AQP6 are found in John Hopkins OMIM database record ID 601383, and in cited publications listed in Table 5, which are hereby incorporated by reference. Aquaporin 6, kidney specific (AQP6, Accession NP_445738.1) is another GAM25 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:6016, to the nucleotide sequence of GAM25 rNA, herein designated GAM RNA, also designated SEQ ID:206.

Another function of GAM25 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM25 include diagnosis, prevention and treatment of diseases and clinical conditions associated with AQP6.

The function of AQP6 has been established by previous studies. Ma et al. (1997), who referred to this gene as aquaporin-6 (AQP6), demonstrated that, among the 7 human aquaporins cloned to that time (AQPs 0 to 6), the genes encoding the 4 most closely related aquaporins all mapped to 12q13: AQP0, AQP2, AQP5 (OMIM Ref. No. 600442), and AQP6. To construct a physical map and identify novel aquaporin gene members of this cluster, Ma et al. (1997) screened a human CEPH B YAC library by PCR using primers derived from exon 4 of the AQP2 and AQP0 genes. A YAC clone with 200 kb of human DNA was isolated an analyzed. Primary pulsed field gel electrophoresis and Southern blot analysis indicated the presence of AQP2, AQP5, and AQP6 genes, but not AQP0. Restriction mapping and PCR analysis yielded a precise physical map in which the 3 aquaporin genes spanned only approximately 27 kb with the order, transcription orientation, and spacer length as follows: 5-prime-AQP2-5kb spacer-AQP5-7kb spacer-AQP6-3-prime. Yasui et al. (1999) showed that AQP6 is localized exclusively in intracellular membranes in renal epithelia. Sequential ultracentrifugation of rat kidney homogenates confirmed that AQP6 resides predominantly in vesicular fractions, and immunohistochemical and immunoelectron microscopic studies confirmed that more than 98% of AQP6 is located in intracellular membrane vesicles. In glomeruli, AQP6 is present in membrane vesicles within podocyte cell bodies and foot processes. In proximal tubules, AQP6 is also abundant in membrane vesicles within the subapical compartment of segment 2 and segment 3 cells, but was not detected in the brush border or basolateral membranes. In collecting duct, AQP6 resides in intracellular membrane vesicles in apical, mid, and basolateral cytoplasm of type A intercalated cells, but was not observed in the plasma membrane. Unlike other members of the AQP family, the unique distribution in intracellular membrane vesicles in multiple types of renal epithelia indicated that AQP6 is not simply involved in transcellular fluid absorption. These studies predicted that AQP6 participates in distinct physiologic function such as glomerular filtration, tubular endocytosis, and acid-base-metabolism.

Full details of the abovementioned studies are described in the following publications, the disclosure of which are hereby incorporated by reference:

Ma, T.; Yang, B.; Umenishi, F.; Verkman, A. S.: Closely spaced tandem arrangement of AQP2, AQP5, and AQP6 genes in a 27-kilobase segment at chromosome locus 12q13. Genomics 43: 387-389, 1997; and Yasui, M.; Kwon, T.-H.; Knepper, M. A.; Nielsen, S.; Agre, P.: Aquaporin-6: an intracellular vesicle water channel protein in renal epithelia. Proc. Nat. Acad. Sci. 96:5808-5813, 1999.

Further studies establishing the function and utilities of AQP6 are found in John Hopkins OMIM database record ID 601383, and in cited publications listed in Table 5, which are hereby incorporated by reference. Archain 1 (ARCN1, Accession NP_001646.2) is another GAM25 target gene, herein designated TARGET GENE. ARCN1 BINDING SITE is a target binding site found in the 3' untranslated region of mRNA encoded by ARCN1, corresponding to a target binding site such as BINDING SITE I, BINDING SITE II or BINDING SITE III of FIG. 8. Table 4 illustrates the complementarity of the nucleotide sequences of ARCN1 BINDING SITE, designated SEQ ID:17729, to the nucleotide sequence of GAM25 rNA, herein designated GAM RNA, also designated SEQ ID:206.

Another function of GAM25 is therefore inhibition of Archain 1 (ARCN1, Accession NP_001646.2), a gene which plays a fundamental role in eukaryotic cell biology. Accordingly, utilities of GAM25 include diagnosis, prevention and treatment of diseases and clinical conditions associated with ARCN1.

The function of ARCN1 has been established by previous studies. Radice et al. (1995) identified a gene that maps approximately 50-kb telomeric to MLL (OMIM Ref. No. 159555) in band 11q23.3, a locus disrupted in certain leukemia-associated translocation chromosomes. A 200-kb genomic fragment from a YAC that includes MLL was used to screen a cDNA library of the R54; 11 cell line which carries a translocation chromosome t(4;11)(q21; q23). The cDNA sequence predicts a 511-amino acid protein which shares similarity with predicted proteins of unknown function from rice (Oryza sativa) and Drosophila. Because of this ancient conservation the authors proposed the name archain (ARCN1). Radice et al. (1995) detected 4-kb ARCN1 transcripts by Northern blot analysis in all tissues examined. The protein encoded by the ARCN1 gene, the coatomer protein delta-COP, probably plays a fundamental role in eukaryotic cell biology. Tunnacliffe at al. (1996)demonstrated that it is conserved across diverse eukaryotes. Very close or identical matches were seen in rat and cow; highly significant matches were seen with 2 plant species, A. thaliana (cress) and S. tuberosum (OMIM Ref. No. potato). Of particular biologic significance was the match with a sequence on yeast chromosome VI, from which Tunnacliffe et al. (1996) were able to determine the yeast archain gene and protein sequence. Unpublished data indicated that in situ hybridizations on mouse embryo sections showed archain transcripts throughout the whole animal.

Full details of the abovementioned studies are described in the following publications, the disclosure of which are hereby incorporated by reference:

Radice, P.; Pensotti, V.; Jones, C.; Perry, H.; Pierotti, M. A.; Tunnacliffe, A.: The human archain gene, ARCN1, has highly conserved homologs in rice and Drosophila. Genomics 26:101-106, 1995; and Tunnacliffe, A.; van de Vrugt, H.; Pensotti, V.; Radice, P.: The coatomer protein delta-COP, encoded by the archain gene, is conserved across diverse eukaryotes. Mammalian Genome 7:78.

Further studies establishing the function and utilities of ARCN1 are found in John Hopkins OMIM database record ID 600820, and in cited publications listed in Table 5, which are hereby incorporated by reference. Ras homolog gene family, member f (in filopodia) (ARHF, Accession NP_061907.1) is another GAM25 target gene, herein designated TARGET GENE. ARHF BINDING SITE is a target binding site found in the 3' untranslated region of mRNA encoded by ARHF, corresponding to a target binding site such as BINDING SITE I, BINDING SITE II or BINDING SITE III of FIG. 8. Table 4 illustrates the complementarity of the nucleotide sequences of ARHF BINDING SITE, designated SEQ ID:8788, to the nucleotide sequence of GAM25 rNA, herein designated GAM RNA, also designated SEQ ID:206.

Another function of GAM25 is therefore inhibition of Ras homolog gene family, member f (in filopodia) (ARHF, Accession NP_061907.1). Accordingly, utilities of GAM25 include diagnosis, prevention and treatment of diseases and clinical conditions associated with ARHF.

Rho gtpase activating protein 1 (ARHGAP1, Accession NP_004299.1) is another GAM25 target gene, herein designated TARGET GENE. ARHGAP1 BINDING SITE is a target binding site found in the 3' untranslated region of mRNA encoded by ARHGAP1, corresponding to a target binding site such as BINDING SITE I, BINDING SITE II or BINDING SITE III of FIG. 8. Table 4 illustrates the complementarity of the nucleotide sequences of ARHGAP1 BINDING SITE, designated SEQ ID:13340, to the nucleotide sequence of GAM25 RNA, herein designated GAM RNA, also designated SEQ ID:206.

Another function of GAM25 is therefore inhibition of Rho gtpase activating protein 1 (ARHGAP1, Accession NP_004299.1). Accordingly, utilities of GAM25 include diagnosis, prevention and treatment of diseases and clinical conditions associated with ARHGAP1.

ARPP-19 (Accession NP_006619.1) is another GAM25 target gene, herein designated TARGET GENE. ARPP-19 BINDING SITE is a target binding site found in the 3' untranslated region of mRNA encoded by ARPP-19, corresponding to a target binding site such as BINDING SITE I, BINDING SITE II or BINDING SITE III of FIG. 8. Table 4 illustrates the complementarity of the nucleotide sequences of ARPP-19 BINDING SITE, designated SEQ ID:15452, to the nucleotide sequence of GAM25 rNA, herein designated GAM RNA, also designated SEQ ID:206.

Another function of GAM25 is therefore inhibition of ARPP-19 (Accession NP_006619.1). Accordingly, utilities of GAM25 include diagnosis, prevention and treatment of diseases and clinical conditions associated with ARPP-19.

ART5 (Accession NP_443750.2) is another GAM25 target gene, herein designated TARGET GENE. ART5 BINDING SITE is a target binding site found in the 3' untranslated region of mRNA encoded by ART5, corresponding to a target binding site such as BINDING SITE I, BINDING SITE II or BINDING SITE III of FIG. 8. Table 4 illustrates the complementarity of the nucleotide sequences of ART5 BINDING SITE, designated SEQ ID:5997, to the nucleotide sequence of GAM25 rNA, herein designated GAM RNA, also designated SEQ ID:206.

Another function of GAM25 is therefore inhibition of ART5 (Accession NP_443750.2). Accordingly, utilities of GAM25 include diagnosis, prevention and treatment of diseases and clinical conditions associated with ART5.

Ankyrin repeat and socs box-containing 16 (ASB16, Accession NP_543139.4) is another GAM25 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:7753, to the nucleotide sequence of GAM25 rNA, herein designated GAM RNA, also designated SEQ ID:206.

Another function of GAM25 is therefore inhibition of Ankyrin repeat and socs box-containing 16 (ASB16, Accession NP_543139.4). Accordingly, utilities of GAM25 include diagnosis, prevention and treatment of diseases and clinical conditions associated with ASB16.

ASE-1 (Accession NP_036231.1) is another GAM25 target gene, herein designated TARGET GENE. ASE-1 BINDING SITE is a target binding site found in the 3' untranslated region of mRNA encoded by ASE-1, corresponding to a target binding site such as BINDING SITE I, BINDING SITE II or BINDING SITE III of FIG. 8. Table 4 illustrates the complementarity of the nucleotide sequences of ASE-1 BINDING SITE, designated SEQ ID:17464, to the nucleotide sequence of GAM25 rNA, herein designated GAM RNA, also designated SEQ ID:206.

Another function of GAM25 is therefore inhibition of ASE-1 (Accession NP_036231.1). Accordingly, utilities of GAM25 include diagnosis, prevention and treatment of diseases and clinical conditions associated with ASE-1.

ATF7IP2 (Accession NP_079273.1) is another GAM25 target gene, herein designated TARGET GENE. ATF7IP2 BINDING SITE is a target binding site found in the 3' untranslated region of mRNA encoded by ATF7IP2, corresponding to a target binding site such as BINDING SITE I, BINDING SITE II or BINDING SITE III of FIG. 8. Table 4 illustrates the complementarity of the nucleotide sequences of ATF7IP2 BINDING SITE, designated SEQ ID:17594, to the nucleotide sequence of GAM25 rNA, herein designated GAM RNA, also designated SEQ ID:206.

Another function of GAM25 is therefore inhibition of ATF7IP2 (Accession NP_079273.1). Accordingly, utilities of GAM25 include diagnosis, prevention and treatment of diseases and clinical conditions associated with ATF7IP2.

Atpase, na+/k+ transporting, beta 2 polypeptide (ATP1B2, Accession NP_001669.1) is another GAM25 target gene, herein designated TARGET GENE. ATP1B2 BINDING SITE is a target binding site found in the 3' untranslated region of mRNA encoded by ATP1B2, corresponding to a target binding site such as BINDING SITE I, BINDING SITE II or BINDING SITE III of FIG. 8. Table 4 illustrates the complementarity of the nucleotide sequences of ATP1B2 BINDING SITE, designated SEQ ID:9693, to the nucleotide sequence of GAM25 rNA, herein designated GAM RNA, also designated SEQ ID:206.

Another function of GAM25 is therefore inhibition of Atpase, na+/k+ transporting, beta 2 polypeptide (ATP1B2, Accession NP_001669.1), a gene which catalyzes the hydrolysis of ATP coupled with the exchange of Na+/K+ ions across the plasma membrane. Accordingly, utilities of GAM25 include diagnosis, prevention and treatment of diseases and clinical conditions associated with ATP1B2.

The function of ATP1B2 has been established by previous studies. In the mouse, Malo et al. (1990) mapped the beta-2 subunit of sodium-potassium-ATPase to chromosome 11 in a segment that is conserved on the pericentromeric region of human chromosome 17. Thus, Malo et al. (1990) speculated that the human ATP1B2 gene is on the proximal short arm or pericentric area of chromosome 17. By somatic cell hybrid analysis, Hsieh et al. (1990) demonstrated that the gene is indeed located on human chromosome 17 and confirmed the assignment to mouse chromosome 11, They referred to the gene as AMOG (adhesion molecule on glia). The adhesion molecule on glia is an integral membrane glycoprotein of MW 45-50 K that is expressed by glial cells and mediates granule neuron migration along Bergmann glial cells in the developing cerebellum. The cDNA sequence of the mouse gene (Pagliusi et al., 1989) shows structural similarity to the beta subunit of Na,K-ATPase (ATP1B1; 182330). This enzyme consists of 2 subunits: a catalytic alpha subunit and a beta subunit of unknown function. Like ATP1B1, AMOG is molecularly associated with the alpha subunit and influences its catalytic activity. AMOG may be the same as what is referred to here as ATP1B2. Another beta-isoform gene expressed primarily in brain was isolated by Martin-Vasallo et al. (1989); its sequence is 97% identical to that for AMOG (Gloor et al., 1990). By study of recombinant inbred strains, Hsieh et al. (1990) placed the Amog locus close to the genes for zinc finger protein-3 (OMIM Ref. No. 194480) and the asialoglycoprotein receptor (108360, 108361) in a region of mouse chromosome 11 that is homologous to human 17p.

Full details of the abovementioned studies are described in the following publications, the disclosure of which are hereby incorporated by reference:

Gloor, S.; Antonicek, H.; Sweadner, K. J.; Pagliusi, S.; Frank, R.; Moos, M.; Schachner, M.: The adhesion molecule on glia (AMOG) is a homologue of the beta subunit of the Na,K-ATPase. J. Cell Biol. 110:165-174, 1990; and Martin-Vasallo, P.; Dackowski, P.; Emanuel, J. R.; Levenson, R.: Identification of a putative isoform of the Na,K-ATPase beta subunit: primary structure and tissue- specific expression.

Further studies establishing the function and utilities of ATP1B2 are found in John Hopkins OMIM database record ID 182331, and in cited publications listed in Table 5, which are hereby incorporated by reference. ATP6V1A (Accession NP_001681.2) is another GAM25 target gene, herein designated TARGET GENE. ATP6V1A BINDING SITE is a target binding site found in the 3' untranslated region of mRNA encoded by ATP6V1A, corresponding to a target binding site such as BINDING SITE I, BINDING SITE II or BINDING SITE III of FIG. 8. Table 4 illustrates the complementarity of the nucleotide sequences of ATP6V1A BINDING SITE, designated SEQ ID:12374, to the nucleotide sequence of GAM25 rNA, herein designated GAM RNA, also designated SEQ ID:206.

Another function of GAM25 is therefore inhibition of ATP6V1A (Accession NP_001681.2). Accordingly, utilities of GAM25 include diagnosis, prevention and treatment of diseases and clinical conditions associated with ATP6V1A.

Atpase, class i, type 8b, member 2 (ATP8B2, Accession XP_290875.1) is another GAM25 target gene, herein designated TARGET GENE. ATP8B2 BINDING SITE is a target binding site found in the 3' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:4561, to the nucleotide sequence of GAM25 rNA, herein designated GAM RNA, also designated SEQ ID:206.

Another function of GAM25 is therefore inhibition of Atpase, class i, type 8b, member 2 (ATP8B2, Accession XP_290875.1). Accordingly, utilities of GAM25 include diagnosis, prevention and treatment of diseases and clinical conditions associated with ATP8B2.

Udp-gal:betaglcnac beta 1,3-galactosyltransferase, polypeptide 3 (B3GALT3, Accession NP_003772.1) is another GAM25 target gene, herein designated TARGET GENE. B3GALT3 BINDING SITE is a target binding site found in the 3' untranslated region of multiple transcripts of mRNA encoded by B3GALT3, corresponding to a target binding site such as BINDING SITE I, BINDING SITE II or BINDING SITE III of FIG. 8. Table 4 illustrates the complementarity of the nucleotide sequences of B3GALT3 BINDING SITE, designated SEQ ID:20124, to the nucleotide sequence of GAM25 RNA, herein designated GAM RNA, also designated SEQ ID:206.

Another function of GAM25 is therefore inhibition of Udp-gal:betaglcnac beta 1,3-galactosyltransferase, polypeptide 3 (B3GALT3, Accession NP_003772.1). Accordingly, utilities of GAM25 include diagnosis, prevention and treatment of diseases and clinical conditions associated with B3GALT3.

Udp-gal:betaglcnac beta 1,4-galactosyltransferase, polypeptide 5 (B4GALT5, Accession NP_004767.1) is another GAM25 target gene, herein designated TARGET GENE. B4GALT5 BINDING SITE is a target binding site found in the 3' untranslated region of mRNA encoded by B4GALT5, corresponding to a target binding site such as BINDING SITE I, BINDING SITE II or BINDING SITE III of FIG. 8. Table 4 illustrates the complementarity of the nucleotide sequences of B4GALT5 BINDING SITE, designated SEQ ID:15509, to the nucleotide sequence of GAM25 rNA, herein designated GAM RNA, also designated SEQ ID:206.

Another function of GAM25 is therefore inhibition of Udp-gal:betaglcnac beta 1,4-galactosyltransferase, polypeptide 5 (B4GALT5, Accession NP_004767.1). Accordingly, utilities of GAM25 include diagnosis, prevention and treatment of diseases and clinical conditions associated with B4GALT5.

Bcl2-associated athanogene 5 (BAG5, Accession NP_004864.1) is another GAM25 target gene, herein designated TARGET GENE. BAG5 BINDING SITE is a target binding site found in the 3' untranslated region of mRNA encoded by BAG5, corresponding to a target binding site such as BINDING SITE I, BINDING SITE II or BINDING SITE III of FIG. 8. Table 4 illustrates the complementarity of the nucleotide sequences of BAG5 BINDING SITE, designated SEQ ID:14301, to the nucleotide sequence of GAM25 rNA, herein designated GAM RNA, also designated SEQ ID:206.

Another function of GAM25 is therefore inhibition of Bcl2-associated athanogene 5 (BAG5, Accession NP_004864.1). Accordingly, utilities of GAM25 include diagnosis, prevention and treatment of diseases and clinical conditions associated with BAG5.

BHD (Accession NP_659434.2) is another GAM25 target gene, herein designated TARGET GENE. BHD BINDING SITE1 and BHD BINDING SITE2 are target binding sites found in untranslated regions of multiple transcripts of mRNA encoded by BHD, corresponding to target binding sites such as BINDING SITE I, BINDING SITE II or BINDING SITE III of FIG. 8. Table 4 illustrates the complementarity of the nucleotide sequences of BHD BINDING SITE1 and BHD BINDING SITE2, designated SEQ ID:11559 and SEQ ID:19921 respectively, to the nucleotide sequence of GAM25 rNA, herein designated GAM RNA, also designated SEQ ID:206.

Another function of GAM25 is therefore inhibition of BHD (Accession NP_659434.2). Accordingly, utilities of GAM25 include diagnosis, prevention and treatment of diseases and clinical conditions associated with BHD.

Bcl2/adenovirus e1b 19 kda interacting protein 2 (BNIP2, Accession NP_004321.1) is another GAM25 target gene, herein designated TARGET GENE. BNIP2 BINDING SITE is a target binding site found in the 3' untranslated region of mRNA encoded by BNIP2, corresponding to a target binding site such as BINDING SITE I, BINDING SITE II or BINDING SITE III of FIG. 8. Table 4 illustrates the complementarity of the nucleotide sequences of BNIP2 BINDING SITE, designated SEQ ID:20177, to the nucleotide sequence of GAM25 rNA, herein designated GAM RNA, also designated SEQ ID:206.

Another function of GAM25 is therefore inhibition of Bcl2/adenovirus e1b 19 kda interacting protein 2 (BNIP2, Accession NP_004321.1). Accordingly, utilities of GAM25 include diagnosis, prevention and treatment of diseases and clinical conditions associated with BNIP2.

BRIP1 (Accession NP_114432.1) is another GAM25 target gene, herein designated TARGET GENE. BRIP1 BINDING SITE is a target binding site found in the 3' untranslated region of mRNA encoded by BRIP1, corresponding to a target binding site such as BINDING SITE I, BINDING SITE II or BINDING SITE III of FIG. 8. Table 4 illustrates the complementarity of the nucleotide sequences of BRIP1 BINDING SITE, designated SEQ ID:11243, to the nucleotide sequence of GAM25 rNA, herein designated GAM RNA, also designated SEQ ID:206.

Another function of GAM25 is therefore inhibition of BRIP1 (Accession NP_114432.1). Accordingly, utilities of GAM25 include diagnosis, prevention and treatment of diseases and clinical conditions associated with BRIP1.

Butyrophilin, subfamily 3, member a1 (BTN3A1, Accession NP_008979.2) is another GAM25 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:17690, to the nucleotide sequence of GAM25 rNA, herein designated GAM RNA, also designated SEQ ID:206.

Another function of GAM25 is therefore inhibition of Butyrophilin, subfamily 3, member a1 (BTN3A1, Accession NP_008979.2). Accordingly, utilities of GAM25 include diagnosis, prevention and treatment of diseases and clinical conditions associated with BTN3A1.

C14orf53 (Accession XP_058620.2) is another GAM25 target gene, herein designated TARGET GENE. C14orf53 BINDING SITE is a target binding site found in the 3' untranslated region of mRNA encoded by C14orf53, corresponding to a target binding site such as BINDING SITE I, BINDING SITE II or BINDING SITE III of FIG. 8. Table 4 illustrates the complementarity of the nucleotide sequences of C14orf53 BINDING SITE, designated SEQ ID:16501, to the nucleotide sequence of GAM25 rNA, herein designated GAM RNA, also designated SEQ ID:206.

Another function of GAM25 is therefore inhibition of C14orf53 (Accession XP_058620.2). Accordingly, utilities of GAM25 include diagnosis, prevention and treatment of diseases and clinical conditions associated with C14orf53.

Chromosome 1 open reading frame 24 (C1orf24, Accession NP_443198.1) is another GAM25 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:14976, to the nucleotide sequence of GAM25 rNA, herein designated GAM RNA, also designated SEQ ID:206.

Another function of GAM25 is therefore inhibition of Chromosome 1 open reading frame 24 (C1orf24, Accession NP_443198.1). Accordingly, utilities of GAM25 include diagnosis, prevention and treatment of diseases and clinical conditions associated with C1orf24.

Chromosome 1 open reading frame 34 (C1orf34, Accession XP_027172.1) is another GAM25 target gene, herein designated TARGET GENE. C1orf34 BINDING SITE is a target binding site found in the 3' untranslated region of mRNA encoded by C1orf34, corresponding to a target binding site such as BINDING SITE I, BINDING SITE II or BINDING SITE III of FIG. 8. Table 4 illustrates the complementarity of the nucleotide sequences of C1orf34 BINDING SITE, designated SEQ ID:4034, to the nucleotide sequence of GAM25 rNA, herein designated GAM RNA, also designated SEQ ID:206.

Another function of GAM25 is therefore inhibition of Chromosome 1 open reading frame 34 (C1orf34, Accession XP_027172.1). Accordingly, utilities of GAM25 include diagnosis, prevention and treatment of diseases and clinical conditions associated with C1orf34.

C3F (Accession NP_005759.2) is another GAM25 target gene, herein designated TARGET GENE. C3F BINDING SITE is a target binding site found in the 3' untranslated region of mRNA encoded by C3F, corresponding to a target binding site such as BINDING SITE I, BINDING SITE II or BINDING SITE III of FIG. 8. Table 4 illustrates the complementarity of the nucleotide sequences of C3F BINDING SITE, designated SEQ ID:12542, to the nucleotide sequence of GAM25 rNA, herein designated GAM RNA, also designated SEQ ID:206.

Another function of GAM25 is therefore inhibition of C3F (Accession NP_005759.2). Accordingly, utilities of GAM25 include diagnosis, prevention and treatment of diseases and clinical conditions associated with C3F.

C4orf9 (Accession XP_035572.1) is another GAM25 target gene, herein designated TARGET GENE. C4orf9 BINDING SITE is a target binding site found in the 3' untranslated region of mRNA encoded by C4orf9, corresponding to a target binding site such as BINDING SITE I, BINDING SITE II or BINDING SITE III of FIG. 8. Table 4 illustrates the complementarity of the nucleotide sequences of C4orf9 BINDING SITE, designated SEQ ID:4561, to the nucleotide sequence of GAM25 rNA, herein designated GAM RNA, also designated SEQ ID:206.

Another function of GAM25 is therefore inhibition of C4orf9 (Accession XP_035572.1). Accordingly, utilities of GAM25 include diagnosis, prevention and treatment of diseases and clinical conditions associated with C4orf9.

C6orf165 (Accession NP_849145.1) is another GAM25 target gene, herein designated TARGET GENE. C6orf165 BINDING SITE is a target binding site found in the 3' untranslated region of mRNA encoded by C6orf165, corresponding to a target binding site such as BINDING SITE I, BINDING SITE II or BINDING SITE III of FIG. 8. Table 4 illustrates the complementarity of the nucleotide sequences of C6orf165 BINDING SITE, designated SEQ ID:5162, to the nucleotide sequence of GAM25 rNA, herein designated GAM RNA, also designated SEQ ID:206.

Another function of GAM25 is therefore inhibition of C6orf165 (Accession NP_849145.1). Accordingly, utilities of GAM25 include diagnosis, prevention and treatment of diseases and clinical conditions associated with C6orf165.

C6orf5 (Accession NP_056339.2) is another GAM25 target gene, herein designated TARGET GENE. C6orf5 BINDING SITE is a target binding site found in the 3' untranslated region of mRNA encoded by C6orf5, corresponding to a target binding site such as BINDING SITE I, BINDING SITE II or BINDING SITE III of FIG. 8. Table 4 illustrates the complementarity of the nucleotide sequences of C6orf5 BINDING SITE, designated SEQ ID:11730, to the nucleotide sequence of GAM25 rNA, herein designated GAM RNA, also designated SEQ ID:206.

Another function of GAM25 is therefore inhibition of C6orf5 (Accession NP_056339.2). Accordingly, utilities of GAM25 include diagnosis, prevention and treatment of diseases and clinical conditions associated with C6orf5.

Complement component 7 (C7, Accession NP_000578.1) is another GAM25 target gene, herein designated TARGET GENE. C7 BINDING SITE is a target binding site found in the 3' untranslated region of mRNA encoded by C7, corresponding to a target binding site such as BINDING SITE I, BINDING SITE II or BINDING SITE III of FIG. 8. Table 4 illustrates the complementarity of the nucleotide sequences of C7 BINDING SITE, designated SEQ ID:17349, to the nucleotide sequence of GAM25 rNA, herein designated GAM RNA, also designated SEQ ID:206.

Another function of GAM25 is therefore inhibition of Complement component 7 (C7, Accession NP_000578.1). Accordingly, utilities of GAM25 include diagnosis, prevention and treatment of diseases and clinical conditions associated with C7.

Chromosome 9 open reading frame 9 (C9orf9, Accession NP_061829.2) is another GAM25 target gene, herein designated TARGET GENE. C9orf9 BINDING SITE is a target binding site found in the 3' untranslated region of mRNA encoded by C9orf9, corresponding to a target binding site such as BINDING SITE I, BINDING SITE II or BINDING SITE III of FIG. 8. Table 4 illustrates the complementarity of the nucleotide sequences of C9orf9 BINDING SITE, designated SEQ ID:5324, to the nucleotide sequence of GAM25 rNA, herein designated GAM RNA, also designated SEQ ID:206.

Another function of GAM25 is therefore inhibition of Chromosome 9 open reading frame 9 (C9orf9, Accession NP_061829.2). Accordingly, utilities of GAM25 include diagnosis, prevention and treatment of diseases and clinical conditions associated with C9orf9.

Calneuron 1 (CALN1, Accession NP_113656.1) is another GAM25 target gene, herein designated TARGET GENE. CALN1 BINDING SITE is a target binding site found in the 3' untranslated region of mRNA encoded by CALN1, corresponding to a target binding site such as BINDING SITE I, BINDING SITE II or BINDING SITE III of FIG. 8. Table 4 illustrates the complementarity of the nucleotide sequences of CALN1 BINDING SITE, designated SEQ ID:5444, to the nucleotide sequence of GAM25 rNA, herein designated GAM RNA, also designated SEQ ID:206.

Another function of GAM25 is therefore inhibition of Calneuron 1 (CALN1, Accession NP_113656.1). Accordingly, utilities of GAM25 include diagnosis, prevention and treatment of diseases and clinical conditions associated with CALN1.

Calcium modulating ligand (CAMLG, Accession NP_001736.1) is another GAM25 target gene, herein designated TARGET GENE. CAMLG BINDING SITE1 and CAMLG BINDING SITE2 are target binding sites found in untranslated regions of mRNA encoded by CAMLG, corresponding to target binding sites such as BINDING SITE I, BINDING SITE II or BINDING SITE III of FIG. 8. Table 4 illustrates the complementarity of the nucleotide sequences of CAMLG BINDING SITE1 and CAMLG BINDING SITE2, designated SEQ ID:17054 and SEQ ID:15900 respectively, to the nucleotide sequence of GAM25 rNA, herein designated GAM RNA, also designated SEQ ID:206.

Another function of GAM25 is therefore inhibition of Calcium modulating ligand (CAMLG, Accession NP_001736.1), a gene which is likely involved in the mobilization of calcium as a result of the tcr/cd3 complex interaction. Accordingly, utilities of GAM25 include diagnosis, prevention and treatment of diseases and clinical conditions associated with CAMLG.

The function of CAMLG has been established by previous studies. Calcium-modulating cyclophilin ligand was discovered by Bram and Crabtree (1994) in a 2-hybrid screen for signaling molecules that interact with cyclophilin B (OMIM Ref. No. 123841). It appears to be involved in the regulation of calcium signaling to T lymphocytes and other cells. The murine gene, symbolized Caml, was localized by interspecific backcross analysis of the middle of chromosome 13. By fluorescence in situ hybridization, Bram et al. (1996) localized the human CAMLG gene to chromosome 5q23, a region known to be syntenic to mouse chromosome 13.

Full details of the abovementioned studies are described in the following publications, the disclosure of which are hereby incorporated by reference:

Bram, R. J.; Crabtree, G. R.: Calcium signalling in T cells stimulated by a cyclophilin B-binding protein. Nature 371: 355-358, 1994; and Bram, R. J.; Valentine, V.; Shapiro, D. N.; Jenkins, N. A.; Gilbert, D. J.; Copeland, N. G.: The gene for calcium-modulating cyclophilin ligand (CAMLG) is located on human chromosome 5.

Further studies establishing the function and utilities of CAMLG are found in John Hopkins OMIM database record ID 601118, and in cited publications listed in Table 5, which are hereby incorporated by reference. Chemokine (c-c motif) ligand 22 (CCL22, Accession NP_002981.2) is another GAM25 target gene, herein designated TARGET GENE. CCL22 BINDING SITE is a target binding site found in the 3' untranslated region of mRNA encoded by CCL22, corresponding to a target binding site such as BINDING SITE I, BINDING SITE II or BINDING SITE III of FIG. 8. Table 4 illustrates the complementarity of the nucleotide sequences of CCL22 BINDING SITE, designated SEQ ID:11778, to the nucleotide sequence of GAM25 rNA, herein designated GAM RNA, also designated SEQ ID:206.

Another function of GAM25 is therefore inhibition of Chemokine (c-c motif) ligand 22 (CCL22, Accession NP_002981.2). Accordingly, utilities of GAM25 include diagnosis, prevention and treatment of diseases and clinical conditions associated with CCL22.

Cd209 antigen (CD209, Accession NP_066978.1) is another GAM25 target gene, herein designated TARGET GENE. CD209 BINDING SITE is a target binding site found in the 3' untranslated region of mRNA encoded by CD209, corresponding to a target binding site such as BINDING SITE I, BINDING SITE II or BINDING SITE III of FIG. 8. Table 4 illustrates the complementarity of the nucleotide sequences of CD209 BINDING SITE, designated SEQ ID:18420, to the nucleotide sequence of GAM25 rNA, herein designated GAM RNA, also designated SEQ ID:206.

Another function of GAM25 is therefore inhibition of Cd209 antigen (CD209, Accession NP_066978.1), a gene which may play an important role in the CD4-independent association of HIV with cells. Accordingly, utilities of GAM25 include diagnosis, prevention and treatment of diseases and clinical conditions associated with CD209.

The function of CD209 has been established by previous studies. DCs capture microorganisms that enter peripheral mucosal tissues, and then migrate to secondary lymphoid organs, where they present these in antigenic form to resting T cells, thus initiating adaptive immune responses. Geijtenbeek et al. (2000) described the properties of DCSIGN, which is highly expressed on DCs present in mucosal tissues and binds to the HIV-1 envelope glycoprotein gp120. DCSIGN does not function as a receptor for viral entry into DCs but instead promotes efficient infection in trans of cells that express CD4 and chemokine receptors. Geijtenbeek et al. (2000) proposed that DCSIGN efficiently captures HIV-1 in the periphery and facilitates its transport to secondary lymphoid organs rich in T cells, to enhance infection in trans of these target cells. The binding of the human immunodeficiency virus (HIV) envelope glycoprotein gp120 to the cell surface receptor CD4 (OMIM Ref. No. 186940) had been considered a primary determinant of viral tropism. A number of cell types, however, can be infected by the virus, or bind gp120, in the absence of CD4 expression. Human placenta had been identified as a tissue that binds gp120 in a CD4-independent manner. By expression cloning, Curtis et al. (1992) screened a placenta cDNA library and isolated a cDNA (clone 11) encoding a gp120-binding protein unrelated to CD4. The 1.3-kb cDNA predicts a 404-amino acid protein with a calculated molecular mass of 45,775 Da. The gp120-binding protein is organized into 3 domains: an N-terminal cytoplasmic and hydrophobic region, a set of tandem repeats (7 complete and 1 incomplete), and a C-terminal domain with homology to C-type (calcium-dependent) lectins. A type II membrane orientation (N-terminal cytoplasmic) was predicted both by the cDNA sequence and by the reactivity of C-terminal peptide-specific antiserum with the surface of clone 11-transfected cells. Native and recombinant gp120 and whole virus bound transfected cells. Gp120 binding was high affinity (Kd, 1.3 to 1.6 nM) and was inhibited by mannan, D-mannose, and L-fucose; once bound, gp120 was internalized rapidly. These data demonstrated that the gp120-binding protein is a membrane-associated mannose-binding lectin. Curtis et al. (1992) suggested that proteins of this type may play an important role in the CD4-independent association of HIV with cells.

Full details of the abovementioned studies are described in the following publications, the disclosure of which are hereby incorporated by reference:

Geijtenbeek, T. B. H.; Kwon, D. S.; Torensma, R.; van Vliet, S. J.; van Duijnhoven, G. C. F.; Middel, J.; Cornelissen, I. L. M. H. A.; Nottet, H. S. L. M.; KewalRamani, V. N.; Littman, D. R.; Figdor, C. G.; van Kooy, Y.: DC-SIGN, a dendritic cell-specific HIV-1-binding protein that enhances trans-infection of T cells. Cell 100:587-597, 2000; and Curtis, B. M.; Scharnowske, S.; Watson, A. J.: Sequence and expression of a membrane- associated C-type lectin that exhibits CD4-independent binding of human immunodeficiency virus enve.

Further studies establishing the function and utilities of CD209 are found in John Hopkins OMIM database record ID 604672, and in cited publications listed in Table 5, which are hereby incorporated by reference. Cd34 antigen (CD34, Accession NP_001764.1) is another GAM25 target gene, herein designated TARGET GENE. CD34 BINDING SITE is a target binding site found in the 3' untranslated region of mRNA encoded by CD34, corresponding to a target binding site such as BINDING SITE I, BINDING SITE II or BINDING SITE III of FIG. 8. Table 4 illustrates the complementarity of the nucleotide sequences of CD34 BINDING SITE, designated SEQ ID:18308, to the nucleotide sequence of GAM25 rNA, herein designated GAM RNA, also designated SEQ ID:206.

Another function of GAM25 is therefore inhibition of Cd34 antigen (CD34, Accession NP_001764.1), a gene which is a monomeric cell surface antigen that is selectively expressed on human hematopoietic progenitor cells. Accordingly, utilities of GAM25 include diagnosis, prevention and treatment of diseases and clinical conditions associated with CD34.

The function of CD34 has been established by previous studies. CD34 is a monomeric cell surface antigen with a molecular mass of approximately 110 kD that is selectively expressed on human hematopoietic progenitor cells. In the hands of Sutherland et al. (1988), partial amino acid analysis of highly purified CD34 antigen revealed no significant sequence similarity with any previously described structures. Sequential immunoprecipitation and Western blot analysis indicated that this antigen is not a member of the leukosialin/sialophorin family, despite the fact that these molecules share several structural similarities.

Animal model experiments lend further support to the function of CD34. To analyze the involvement of CD34 in hematopoiesis, Cheng et al. (1996) produced both embryonic stem (ES) cells in mice null for the expression of this mucin. Analysis of yolk sac-like hematopoietic development in embryoid bodies derived from CD34-null ES cells showed a significant delay in both erythroid and myeloid differentiation that could be reversed by transfection of the mutant ES cells with CD34 constructs expressing either a complete or truncated cytoplasmic domain. In spite of these diminished embryonic hematopoietic progenitor numbers, the CD34-null mice developed normally, and the hematopoietic profile of adult blood appeared typical. However, the colony-forming activity of hematopoietic progenitors derived from both bone marrow and spleen was significantly reduced in adult CD34-deficient animals.

It is appreciated that the abovementioned animal model for CD34 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Cheng, J.; Baumhueter, S.; Cacalano, G.; Carver-Moore, K.; Thibodeaux, H.; Thomas, R.; Broxmeyer, H. E.; Cooper, S.; Hague, N.; Moore, M.; Lasky, L. A.: Hematopoietic defects in mice lacking the sialomucin CD34. Blood 87:479-490, 1996; and Sutherland, D. R.; Watt, S. M.; Dowden, G.; Karhi, K.; Baker, M. A.; Greaves, M. F.; Smart, J. E.: Structural and partial amino acid sequence analysis of the human hemopoietic progenito.

Further studies establishing the function and utilities of CD34 are found in John Hopkins OMIM database record ID 142230, and in cited publications listed in Table 5, which are hereby incorporated by reference. Cell division cycle 2-like 2 (CDC2L2, Accession NP_296370.1) is another GAM25 target gene, herein designated TARGET GENE. CDC2L2 BINDING SITE is a target binding site found in the 5' untranslated region of multiple transcripts of mRNA encoded by CDC2L2, corresponding to a target binding site such as BINDING SITE I, BINDING SITE II or BINDING SITE III of FIG. 8. Table 4 illustrates the complementarity of the nucleotide sequences of CDC2L2 BINDING SITE, designated SEQ ID:9240, to the nucleotide sequence of GAM25 RNA, herein designated GAM RNA, also designated SEQ ID:206.

Another function of GAM25 is therefore inhibition of Cell division cycle 2-like 2 (CDC2L2, Accession NP_296370.1). Accordingly, utilities of GAM25 include diagnosis, prevention and treatment of diseases and clinical conditions associated with CDC2L2.

CDCP1 (Accession NP_073753.3) is another GAM25 target gene, herein designated TARGET GENE. CDCP1 BINDING SITE1 and CDCP1 BINDING SITE2 are target binding sites found in untranslated regions of multiple transcripts of mRNA encoded by CDCP1, corresponding to target binding sites such as BINDING SITE I, BINDING SITE II or BINDING SITE III of FIG. 8. Table 4 illustrates the complementarity of the nucleotide sequences of CDCP1 BINDING SITE1 and CDCP1 BINDING SITE2, designated SEQ ID:14151 and SEQ ID:19953 respectively, to the nucleotide sequence of GAM25 RNA, herein designated GAM RNA, also designated SEQ ID:206.

Another function of GAM25 is therefore inhibition of CDCP1 (Accession NP_073753.3). Accordingly, utilities of GAM25 include diagnosis, prevention and treatment of diseases and clinical conditions associated with CDCP1.

Cadherin 1, type 1, e-cadherin (epithelial) (CDH1, Accession NP_004351.1) is another GAM25 target gene, herein designated TARGET GENE. CDH1 BINDING SITE is a target binding site found in the 3' untranslated region of mRNA encoded by CDH1, corresponding to a target binding site such as BINDING SITE I, BINDING SITE II or BINDING SITE III of FIG. 8. Table 4 illustrates the complementarity of the nucleotide sequences of CDH1 BINDING SITE, designated SEQ ID:2489, to the nucleotide sequence of GAM25 rNA, herein designated GAM RNA, also designated SEQ ID:206.

Another function of GAM25 is therefore inhibition of Cadherin 1, type 1, e-cadherin (epithelial) (CDH1, Accession NP_004351.1). Accordingly, utilities of GAM25 include diagnosis, prevention and treatment of diseases and clinical conditions associated with CDH1.

Cadherin 17, li cadherin (liver-intestine) (CDH17, Accession NP_004054.2) is another GAM25 target gene, herein designated TARGET GENE. CDH17 BINDING SITE is a target binding site found in the 3' untranslated region of mRNA encoded by CDH17, corresponding to a target binding site such as BINDING SITE I, BINDING SITE II or BINDING SITE III of FIG. 8. Table 4 illustrates the complementarity of the nucleotide sequences of CDH17 BINDING SITE, designated SEQ ID:3901, to the nucleotide sequence of GAM25 rNA, herein designated GAM RNA, also designated SEQ ID:206.

Another function of GAM25 is therefore inhibition of Cadherin 17, li cadherin (liver-intestine) (CDH17, Accession NP_004054.2), a gene which may have a role in the morphological organization of liver and intestine and involved in intestinal peptide transport. Accordingly, utilities of GAM25 include diagnosis, prevention and treatment of diseases and clinical conditions associated with CDH17.

The function of CDH17 has been established by previous studies. The first step in oral absorption of many medically important peptide-based drugs, such as beta- lactam antibiotics, is mediated by an intestinal proton-dependent peptide transporter. Dantzig et al. (1994) identified a monoclonal antibody that blocked uptake of the beta-lactam cephalexin by human cells. By screening an expression library with this antibody, the authors isolated cDNAs encoding a protein that they designated 'human peptide transporter-1,' or HPT1. Sequence analysis revealed that the predicted 832-amino acid protein shares several structural features with the cadherin superfamily of calcium-dependent cell-cell adhesion proteins. See 603006. Like the cadherins, HPT1 contains an extracellular region with conserved motifs and a transmembrane domain. However, HPT1 lacks the cytoplasmic domain found in other cadherins. Using immunohistochemical staining, Dantzig et al. (1994) localized HPT1 along the gastrointestinal tract and the pancreatic ducts, but not in kidney, lung, or several other tissues. Mammalian cells expressing HPT1 showed consistently higher cephalexin uptake activity than controls. Uptake was dependent on an inwardly directed proton gradient.

Full details of the abovementioned studies are described in the following publications, the disclosure of which are hereby incorporated by reference:

Dantzig, A. H.; Hoskins, J.; Tabas, L. B.; Bright, S.; Shepard, R. L.; Jenkins, I. L.; Duckworth, D. C.; Sportsman, J. R.; Mackensen, D.; Rosteck, P. R., Jr.; Skatrud, P. L.: Association of intestinal peptide transport with a protein related to the cadherin superfamily. Science 264:430-433, 1994; and Kremmidiotis, G.; Baker, E.; Crawford, J.; Eyre, H. J.; Nahmias, J.; Callen, D. F.: Localization of human cadherin genes to chromosome regions exhibiting cancer-related loss of heteroz.

Further studies establishing the function and utilities of CDH17 are found in John Hopkins OMIM database record ID 603017, and in cited publications listed in Table 5, which are hereby incorporated by reference. Carbohydrate (chondroitin) synthase 1 (CHSY1, Accession NP_055733.2) is another GAM25 target gene, herein designated TARGET GENE. CHSY1 BINDING SITE is a target binding site found in the 3' untranslated region of mRNA encoded by CHSY1, corresponding to a target binding site such as BINDING SITE I, BINDING SITE II or BINDING SITE III of FIG. 8. Table 4 illustrates the complementarity of the nucleotide sequences of CHSY1 BINDING SITE, designated SEQ ID:14947, to the nucleotide sequence of GAM25 rNA, herein designated GAM RNA, also designated SEQ ID:206.

Another function of GAM25 is therefore inhibition of Carbohydrate (chondroitin) synthase 1 (CHSY1, Accession NP_055733.2). Accordingly, utilities of GAM25 include diagnosis, prevention and treatment of diseases and clinical conditions associated with CHSY1.

Cold autoinflammatory syndrome 1 (CIAS1, Accession NP_004886.2) is another GAM25 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:2330, to the nucleotide sequence of GAM25 rNA, herein designated GAM RNA, also designated SEQ ID:206.

Another function of GAM25 is therefore inhibition of Cold autoinflammatory syndrome 1 (CIAS1, Accession NP_004886.2), a gene which may mediate protein-protein interactions; contains a leucine rich repeat and therefore may be associated with Familial cold autoinflammatory syndrome, muckle-wells syndrome. Accordingly, utilities of GAM25 include diagnosis, prevention and treatment of Familial cold autoinflammatory syndrome, muckle-wells syndrome, and of other diseases and clinical conditions associated with CIAS1.

The function of CIAS1 has been established by previous studies. In a positional cloning effort to identify the gene mutated in familial cold autoinflammatory syndrome and Muckle-Wells syndrome, both of which map to 1q44, Hoffman et al. (2001) cloned and characterized the CIAS1 gene, so named for 'cold-induced autoinflammatory syndrome.' The full-length cDNA corresponds to a 9-exon gene encoding an open reading frame of 3,105 basepairs with 2 potential start codons in exon 1, with the second start codon meeting more Kozak criteria, and a stop codon at exon 9. Northern blot analysis identified a broad mRNA band of approximately 4 kb expressed at a low level in peripheral blood leukocytes; little or no expression was detectable in other tissues. Further analysis revealed extensive alternative splicing of exons 4 through 8 that resulted in mRNAs ranging from 3,315 to 4,170 bp, consistent with the Northern blot analysis. The predicted protein encoded by the first splice form of CIAS1 (exons 1-3, 5, and 7-9), called cryopyrin, consists of 920 amino acids with a size of 105.7 kD and a PI of 6.16. The protein sequence contains several distinct motifs including a pyrin domain in the amino terminus (amino acids 13 through 83), a central nucleotide- binding site (NACHT subfamily) domain in exon 3 (amino acids 217 to 533), and a C-terminal leucine-rich repeat domain containing 7 leucine- rich repeats (amino acids 697 through 920). No nuclear localization signals were identified and no clear transmembrane regions were found. The largest protein potentially encoded by the 9 exons of CIAS1 consists of 1,034 amino acids with a size of 117.9 kD and 11 C-terminal leucine-rich repeats. Hoffman et al. (2001) suggested that cryopyrin is a signaling protein involved in the regulation of apoptosis. Dode et al. (2002) identified CIAS1 mutations, all located in exon 3, in 9 unrelated families with MWS and in 3 unrelated families with familial cold urticaria (FCU), originating from France, England, and Algeria. Five mutations were novel. The R260W mutation (606416.0005) was identified in 2 families with MWS and in 2 families with FCU, of different ethnic origins, thereby demonstrating that a single CIAS1 mutation may cause both syndromes. This result indicated that modifier genes are involved in determining either an MWS or an FCU phenotype. The finding of the G569R mutation (606416.0006) in asymptomatic individuals further emphasized the importance of a modifier gene (or genes) in determining disease phenotype. The authors suggested that identification of modifiers was likely to have significant therapeutic implications for these severe diseases.

Full details of the abovementioned studies are described in the following publications, the disclosure of which are hereby incorporated by reference:

Dode, C.; Le Du, N.; Cuisset, L.; Letourneur, F.; Berthelot, J.-M.; Vaudour, G.; Meyrier, A.; Watts, R. A.; Scott, D. G. I.; Nicholls, A.; Granel, B.; Frances, C.; Garcier, F.; Edery, P.; Boulinguez, S.; Domergues, J.-P.; Delpech, M.; Grateau, G.: New mutations of CIAS1 that are responsible for Muckle-Wells syndrome and familial cold urticaria: a novel mutation underlies both syndromes. Am. J. Hum. Genet. 70:1498-1506, 2002; and Hoffman, H. M.; Mueller, J. L.; Broide, D. H.; Wanderer, A. A.; Kolodner, R. D.: Mutation of a new gene encoding a putative pyrin-like protein causes familial cold autoinflammatory syn.

Further studies establishing the function and utilities of CIAS1 are found in John Hopkins OMIM database record ID 606416, and in cited publications listed in Table 5, which are hereby incorporated by reference. CIP29 (Accession NP_115740.3) is another GAM25 target gene, herein designated TARGET GENE. CIP29 BINDING SITE is a target binding site found in the 3' untranslated region of mRNA encoded by CIP29, corresponding to a target binding site such as BINDING SITE I, BINDING SITE II or BINDING SITE III of FIG. 8. Table 4 illustrates the complementarity of the nucleotide sequences of CIP29 BINDING SITE, designated SEQ ID:12541, to the nucleotide sequence of GAM25 RNA, herein designated GAM RNA, also designated SEQ ID:206.

Another function of GAM25 is therefore inhibition of CIP29 (Accession NP_115740.3). Accordingly, utilities of GAM25 include diagnosis, prevention and treatment of diseases and clinical conditions associated with CIP29.

Cytoskeleton associated protein 2 (CKAP2, Accession NP_060674.2) is another GAM25 target gene, herein designated TARGET GENE. CKAP2 BINDING SITE is a target binding site found in the 3' untranslated region of mRNA encoded by CKAP2, corresponding to a target binding site such as BINDING SITE I, BINDING SITE II or BINDING SITE III of FIG. 8. Table 4 illustrates the complementarity of the nucleotide sequences of CKAP2 BINDING SITE, designated SEQ ID:6323, to the nucleotide sequence of GAM25 rNA, herein designated GAM RNA, also designated SEQ ID:206.

Another function of GAM25 is therefore inhibition of Cytoskeleton associated protein 2 (CKAP2, Accession NP_060674.2). Accordingly, utilities of GAM25 include diagnosis, prevention and treatment of diseases and clinical conditions associated with CKAP2.

C-type (calcium dependent, carbohydrate-recognition domain) lectin, superfamily member 12 (CLECSF12, Accession NP_072092.2) is another GAM25 target gene, herein designated TARGET GENE. CLECSF12 BINDING SITE is a target binding site found in the 3' untranslated region of mRNA encoded by CLECSF12, corresponding to a target binding site such as BINDING SITE I, BINDING SITE II or BINDING SITE III of FIG. 8. Table 4 illustrates the complementarity of the nucleotide sequences of CLECSF12 BIND- ING SITE, designated SEQ ID:18038, to the nucleotide sequence of GAM25 rNA, herein designated GAM RNA, also designated SEQ ID:206.

Another function of GAM25 is therefore inhibition of C-type (calcium dependent, carbohydrate-recognition domain) lectin, superfamily member 12 (CLECSF12, Accession NP__072092.2), a gene which is a pattern- recognition receptor. Accordingly, utilities of GAM25 include diagnosis, prevention and treatment of diseases and clinical conditions associated with CLECSF12.

The function of CLECSF12 has been established by previous studies. Yokota et al. (2001) cloned human dectin-1 using degenerative PCR amplification of mRNA isolated from dendritic cells and subsequent cDNA cloning. The human dectin-1 gene encodes a polypeptide of 247 amino acids, 3 amino acids longer than the mouse protein. Dectin-1 contains an immunoreceptor tyrosine-based activation motif within the cytoplasmic domain. Human dectin-1 mRNA is expressed predominantly in peripheral blood leukocytes and preferentially by dendritic cells. The mRNA encodes a 33-kD glycoprotein. In human epidermis, the protein is expressed selectively by Langerhans cells, which are an epidermal subset of dendritic cells. A truncated form of dectin-1 RNA encodes a polypeptide lacking almost the entire neck domain, which is required for accessibility of the carbohydrate recognition domain to ligands. Truncated dectin is produced by alternative splicing. Brown and Gordon (2001) identified dectin-1 as a beta-glucan receptor present on macrophages. In contrast to its reported specificity for dendritic cells (Yokota et al. (2001), Brown and Gordon (2001)) found that dectin-1 was expressed in every macrophage population examined and in more tissues than was previously reported with the highest expression being in the liver, lung, and thymus. Brown and Gordon (2001) found that dectin-1 is a pattern-recognition receptor that recognizes a variety of beta-1,3-linked and beta-1,6-linked glucans from fungi and plants. Dectin-1 did not recognize monosaccharides or carbohydrates with different linkages. Laminarin and glucan phosphate, a structurally defined immunologically active beta-glucan, were the most effective inhibitors; both bind to the beta-glucan receptor on monocytes and macrophages. Soluble recombinant dectin-1 stimulates the proliferation of T lymphocytes (Ariizumi et al. (2000)). In a whole-cell binding assay, binding of T cells to NIH 3T3 cells expressing dectin-1 was not inhibited by beta-glucans. Therefore, Brown and Gordon (2001) concluded that dectin-1 has 2 ligand binding sites: one that recognizes an endogenous ligand on T cells, and another for exogenous carbohydrates.

Full details of the abovementioned studies are described in the following publications, the disclosure of which are hereby incorporated by reference:

Ariizumi, K.; Shen, G.-L.; Shikano, S.; Xu, S.; Ritter, R., III; Kumamoto, T.; Edelbaum, D.; Morita, A.; Bergstresser, P. R.; Takashima, A.: Identification of a novel, dendritic cell-associated molecule, dectin-1, by subtractive cDNA cloning. J. Biol. Chem. 275:20157-20167, 2000; and Brown, G. D.; Gordon, S.: A new receptor for beta-glucans. Nature 413:36-37, 2001.

Further studies establishing the function and utilities of CLECSF12 are found in John Hopkins OMIM database record ID 606264, and in cited publications listed in Table 5, which are hereby incorporated by reference. 2',3'-cyclic nucleotide 3' phosphodiesterase (CNP, Accession NP__149124.1) is another GAM25 target gene, herein designated TARGET GENE. CNP BINDING SITE is a target binding site found in the 3' untranslated region of mRNA encoded by CNP, corresponding to a target binding site such as BINDING SITE I, BINDING SITE II or BINDING SITE III of FIG. 8. Table 4 illustrates the complementarity of the nucleotide sequences of CNP BINDING SITE, designated SEQ ID:16430, to the nucleotide sequence of GAM25 rNA, herein designated GAM RNA, also designated SEQ ID:206.

Another function of GAM25 is therefore inhibition of 2',3'-cyclic nucleotide 3' phosphodiesterase (CNP, Accession NP__149124.1), a gene which can link tubulin to membranes and may regulate cytoplasmic microtubule distribution. Accordingly, utilities of GAM25 include diagnosis, prevention and treatment of diseases and clinical conditions associated with CNP.

The function of CNP has been established by previous studies. Cyclic nucleotide phosphodiesterase is a useful marker of myelin. CNPase is a membrane-bound enzyme found at high concentrations in central nervous system myelin and in the outer segments of photoreceptors in the retina (Vogel and Thompson, 1988). Two proteins with CNP activity are known to exist in brain and lymphoid tissues. They appear to be the products of distinct but related mRNA species. Kurihara et al. (1990) showed that the 2 gene products can arise by translation of 2 mRNAs alternatively spliced from a single transcript. In bovine and human brain, there appears to be a single species of mRNA (Vogel and Thompson, 1988), and the bovine brain and retinal forms of the enzyme appear to be identical in sequence Bifulco et al. (2002) demonstrated that CNP is firmly associated with tubulin (OMIM Ref. No. 602529) from brain tissue and thyroid cells. They showed that CNP acts as a microtubule-associated protein in promoting microtubule assembly. This activity was found to reside in the C terminus of the enzyme. The authors concluded that CNP is a membrane-bound microtubule-associated protein that can link tubulin to membranes and may regulate cytoplasmic microtubule distribution Full details of the abovementioned studies are described in the following publications, the disclosure of which are hereby incorporated by reference:

Vogel, U.S.; Thompson, R. J.: Molecular structure, localization, and possible functions of the myelin-associated enzyme 2-prime,3-prime-cyclic nucleotide 3-prime-phosphodiesterase. J. Neurochem. 50:1667-1677, 1988; and Bifulco, M.; Laezza, C.; Stingo, S.; Wolff, J.:.:2-prime,3-prime-cyclic nucleotide 3-prime-phosphodiesterase: a membrane-bound, microtubule-associated protein and membrane anchor for tub.

Further studies establishing the function and utilities of CNP are found in John Hopkins OMIM database record ID 123830, and in cited publications listed in Table 5, which are hereby incorporated by reference. Component of oligomeric golgi complex 3 (COG3, Accession NP__113619.1) is another GAM25 target gene, herein designated TARGET GENE. COG3 BINDING SITE is a target binding site found in the 3' untranslated region of mRNA encoded by COG3, corresponding to a target binding site such as BINDING SITE I, BINDING SITE II or BINDING SITE III of FIG. 8. Table 4 illustrates the complementarity of the nucleotide sequences of COG3 BINDING SITE, designated SEQ ID:12970, to the nucleotide sequence of GAM25 rNA, herein designated GAM RNA, also designated SEQ ID:206.

Another function of GAM25 is therefore inhibition of Component of oligomeric golgi complex 3 (COG3, Accession NP__113619.1), a gene which is critical for the structure and function of the Golgi apparatus. Accordingly, utilities of GAM25 include diagnosis, prevention and treatment of diseases and clinical conditions associated with COG3.

The function of COG3 has been established by previous studies. Multiprotein complexes are key determinants of Golgi apparatus structure and its capacity for intracellular transport and glycoprotein modification. Several complexes have been identified, including the Golgi transport complex (GTC), the LDLC complex, which is involved in glycosylation reactions, and the SEC34 complex, which is involved in vesicular transport. These 3 complexes are identical and have been termed the conserved oligomeric Golgi (COG) complex, which includes COG3 (Ungar et al., 2002). By SDS-PAGE analysis of bovine brain cytosol, Ungar et al. (2002) identified the 8 subunits of the COG complex. Immunofluorescence microscopy demonstrated that COG1 (LDLB; 606973) colocalizes with COG7 (OMIM Ref. No. 606978), as well as with COG3 and COG5 (OMIM Ref. No. 606821), with a Golgi marker in a perinuclear distribution. Immunoprecipitation analysis showed that all COG subunits interact with COG2 (LDLC; 606974). Ungar et al. (2002) concluded that the COG complex is critical for the structure and function of the Golgi apparatus and can influence intracellular membrane trafficking Full details of the abovementioned studies are described in the following publications, the disclosure of which are hereby incorporated by reference:

Suvorova, E. S.; Kurten, R. C.; Lupashin, V. V.: Identification of a human orthologue of Sec34p as a component of the cis-Golgi vesicle tethering machinery. J. Biol. Chem. 276: 22810-22818, 2001; and Ungar, D.; Oka, T.; Brittle, E. E.; Vasile, E.; Lupashin, V. V.; Chatterton, J. E.; Heuser, J. E.; Krieger, M.; Waters, M. G.: Characterization of a mammalian Golgi- localized protein c.

Further studies establishing the function and utilities of COG3 are found in John Hopkins OMIM database record ID 606975, and in cited publications listed in Table 5, which are hereby incorporated by reference. Collectin sub-family member 12 (COLEC12, Accession NP_110408.2) is another GAM25 target gene, herein designated TARGET GENE. COLEC12 BINDING SITE is a target binding site found in the 3' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:583, to the nucleotide sequence of GAM25 rNA, herein designated GAM RNA, also designated SEQ ID:206.

Another function of GAM25 is therefore inhibition of Collectin sub-family member 12 (COLEC12, Accession NP_110408.2). Accordingly, utilities of GAM25 include diagnosis, prevention and treatment of diseases and clinical conditions associated with COLEC12.

Cox15 homolog, cytochrome c oxidase assembly protein (yeast) (COX15, Accession NP_510870.1) is another GAM25 target gene, herein designated TARGET GENE. COX15 BINDING SITE is a target binding site found in the 3' untranslated region of multiple transcripts of mRNA encoded by COX15, corresponding to a target binding site such as BINDING SITE I, BINDING SITE II or BINDING SITE III of FIG. 8. Table 4 illustrates the complementarity of the nucleotide sequences of COX15 BINDING SITE, designated SEQ ID:907, to the nucleotide sequence of GAM25 rNA, herein designated GAM RNA, also designated SEQ ID:206.

Another function of GAM25 is therefore inhibition of Cox15 homolog, cytochrome c oxidase assembly protein (yeast) (COX15, Accession NP_510870.1). Accordingly, utilities of GAM25 include diagnosis, prevention and treatment of diseases and clinical conditions associated with COX15.

Carboxypeptidase a4 (CPA4, Accession NP_057436.1) is another GAM25 target gene, herein designated TARGET GENE. CPA4 BINDING SITE is a target binding site found in the 3' untranslated region of mRNA encoded by CPA4, corresponding to a target binding site such as BINDING SITE I, BINDING SITE II or BINDING SITE III of FIG. 8. Table 4 illustrates the complementarity of the nucleotide sequences of CPA4 BINDING SITE, designated SEQ ID:11559, to the nucleotide sequence of GAM25 rNA, herein designated GAM RNA, also designated SEQ ID:206.

Another function of GAM25 is therefore inhibition of Carboxypeptidase a4 (CPA4, Accession NP_057436.1). Accordingly, utilities of GAM25 include diagnosis, prevention and treatment of diseases and clinical conditions associated with CPA4.

cPLA2delta (Accession XP_208820.2) is another GAM25 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:7513, to the nucleotide sequence of GAM25 rNA, herein designated GAM RNA, also designated SEQ ID:206.

Another function of GAM25 is therefore inhibition of cPLA2delta (Accession XP_208820.2). Accordingly, utilities of GAM25 include diagnosis, prevention and treatment of diseases and clinical conditions associated with cPLA2delta.

cPLA2delta (Accession NP_828848.1) is another GAM25 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:7513, to the nucleotide sequence of GAM25 rNA, herein designated GAM RNA, also designated SEQ ID:206.

Another function of GAM25 is therefore inhibition of cPLA2delta (Accession NP_828848.1). Accordingly, utilities of GAM25 include diagnosis, prevention and treatment of diseases and clinical conditions associated with cPLA2delta.

Cleavage and polyadenylation specific factor 2, 100 kda (CPSF2, Accession XP_029311.2) is another GAM25 target gene, herein designated TARGET GENE. CPSF2 BINDING SITE1 and CPSF2 BINDING SITE2 are target binding sites found in untranslated regions of mRNA encoded by CPSF2, corresponding to target binding sites such as BINDING SITE I, BINDING SITE II or BINDING SITE III of FIG. 8. Table 4 illustrates the complementarity of the nucleotide sequences of CPSF2 BINDING SITE1 and CPSF2 BINDING SITE2, designated SEQ ID:7665 and SEQ ID:4882 respectively, to the nucleotide sequence of GAM25 rNA, herein designated GAM RNA, also designated SEQ ID:206.

Another function of GAM25 is therefore inhibition of Cleavage and polyadenylation specific factor 2, 100 kda (CPSF2, Accession XP_029311.2). Accordingly, utilities of GAM25 include diagnosis, prevention and treatment of diseases and clinical conditions associated with CPSF2.

CRB3 (Accession NP_777378.1) is another GAM25 target gene, herein designated TARGET GENE. CRB3 BINDING SITE is a target binding site found in the 5' untranslated region of multiple transcripts of mRNA encoded by CRB3, corresponding to a target binding site such as BINDING SITE I, BINDING SITE II or BINDING SITE III of FIG. 8. Table 4 illustrates the complementarity of the nucleotide sequences of CRB3 BINDING SITE, designated SEQ ID:16619, to the nucleotide sequence of GAM25 rNA, herein designated GAM RNA, also designated SEQ ID:206.

Another function of GAM25 is therefore inhibition of CRB3 (Accession NP_777378.1). Accordingly, utilities of GAM25 include diagnosis, prevention and treatment of diseases and clinical conditions associated with CRB3.

Cartilage associated protein (CRTAP, Accession NP_006362.1) is another GAM25 target gene, herein designated TARGET GENE. CRTAP BINDING SITE is a target binding site found in the 3' untranslated region of mRNA encoded by CRTAP, corresponding to a target binding site such as BINDING SITE I, BINDING SITE II or BINDING SITE III of FIG. 8. Table 4 illustrates the complementarity of the nucleotide sequences of CRTAP BINDING SITE, designated SEQ ID:18797, to the nucleotide sequence of GAM25 rNA, herein designated GAM RNA, also designated SEQ ID:206.

Another function of GAM25 is therefore inhibition of Cartilage associated protein (CRTAP, Accession NP_006362.1), a gene which is a novel developmentally regulated chick embryo protein. Accordingly, utilities of GAM25 include diagnosis, prevention and treatment of diseases and clinical conditions associated with CRTAP.

The function of CRTAP has been established by previous studies. Castagnola et al. (1997) isolated a mouse Crtap cDNA from a subtracted library specific for mRNAs highly expressed in hypertrophic chondrocytes compared to proliferating and early differentiating chondrocytes. Using a mouse Crtap clone to screen a human fetal brain cDNA library, Tonachini et al. (1999) identified human CRTAP cDNA clones. Human CRTAP encodes a deduced 401-amino acid protein with a a putative signal peptide of 26 amino acids. CRTAP contains 2 potential N-glycosylation signals. CRTAP shares 89% amino acid sequence identity with mouse Crtap and 51% identity with the chick homolog. The mouse and human genes contain a C-terminal region of approximately 120 amino acids not present in the chick protein Using Northern blot analysis of human tissues, Tonachini et al. (1999) detected 2-kb and 4-kb CRTAP transcripts in brain, heart, kidney, lung, small intestine, and skeletal muscle. In all tissues except brain, the 2-kb transcript was more abundant. Using immunohistochemistry, the authors detected CRTAP expression in articular chondrocytes. In mouse, Morello et al. (1999) detected 3 Crtap transcripts in a range of tissues, including all mouse embryonic cartilages. In chick, Castagnola et al. (1997) detected a single Crtap transcript in a broad range of embryonic tissues with the strongest expression in the developing cartilage. They detected expression in the extracellular matrix of the forming cartilage surrounding the notochord, the developing sclera, the sphenoid and mandibular cartilage, the long bone cartilage, and the developing sternal cartilage Full details of the abovementioned studies are described in the following publications, the disclosure of which are hereby incorporated by reference:

Castagnola, P.; Gennari, M.; Morello, R.; Tonachini, L.; Marin, O.; Gaggero, A.; Cancedda, R.: Cartilage associated protein (CASP) is a novel developmentally regulated chick embryo protein. J. Cell Sci. 110:1351-1359, 1997; and Morello, R.; Tonachini, L.; Monticone, M.; Viggiano, L.; Rocchi, M.; Cancedda, R.; Castagnola, P.: cDNA cloning, characterization and chromosome mapping of Crtap encoding the mouse carti.

Further studies establishing the function and utilities of CRTAP are found in John Hopkins OMIM database record ID 605497, and in cited publications listed in Table 5, which are hereby incorporated by reference. Casein kinase 2, alpha prime polypeptide (CSNK2A2, Accession NP_001887.1) is another GAM25 target gene, herein designated TARGET GENE. CSNK2A2 BINDING SITE is a target binding site found in the 5' untranslated region of mRNA encoded by CSNK2A2, corresponding to a target binding site such as BINDING SITE I, BINDING SITE II or BINDING SITE III of FIG. 8. Table 4 illustrates the complementarity of the nucleotide sequences of CSNK2A2 BINDING SITE, designated SEQ ID:19142, to the nucleotide sequence of GAM25 rNA, herein designated GAM RNA, also designated SEQ ID:206.

Another function of GAM25 is therefore inhibition of Casein kinase 2, alpha prime polypeptide (CSNK2A2, Accession NP_001887.1), a gene which catalyzes the phosphorylation of serine or threonine residues in proteins. Accordingly, utilities of GAM25 include diagnosis, prevention and treatment of diseases and clinical conditions associated with CSNK2A2.

The function of CSNK2A2 has been established by previous studies. Phosphorylation of the human p53 protein (OMIM Ref. No. 191170) at ser392 is responsive to ultraviolet (UV) but not gamma irradiation. Keller et al. (2001) identified and purified a mammalian UV-activated protein kinase complex that phosphorylates ser392 in vitro. This kinase complex contains CK2 and the chromatin transcriptional elongation factor FACT, a heterodimer of SPT16 (OMIM Ref. No. 605012) and SSRP1 (OMIM Ref. No. 604328). In vitro studies showed that FACT alters the specificity of CK2 in the complex such that it selectively phosphorylates p53 over other substrates, including casein. In addition, phosphorylation by the kinase complex was found to enhance p53 activity. These results provided a potential mechanism for p53 activation by UV irradiation Doray et al. (2002) demonstrated that the Golgi-localized, gamma-ear-containing adenosine diphosphate ribosylation factor-binding proteins (GGA1, 606004 and GGA3, 606006) and the coat protein adaptor protein-1 (AP-1) complex (see OMIM Ref. No. AP1G2, 603534) colocalize in clathrin-coated buds of the trans-Golgi networks of mouse L cells and human HeLa cells. Binding studies revealed a direct interaction between the hinge domains of the GGAs and the gamma-ear domain of AP-1. Further, AP-1 contained bound casein kinase-2 that phosphorylated GGA1 and GGA3, thereby causing autoinhibition. Doray et al. (2002) demonstrated that this autoinhibition could induce the directed transfer of mannose 6-phosphate receptors (see OMIM Ref. No. 154540) from the GGAs to AP-1. Mannose 6-phosphate receptors that were defective in binding to GGAs were poorly incorporated into adaptor protein complex containing clathrin coated vesicles. Thus, Doray et al. (2002) concluded that GGAs and the AP-1 complex interact to package mannose 6-phosphate receptors into AP-1-containing coated vesicles Animal model experiments lend further support to the function of CSNK2A2. To determine the functional and developmental role of protein kinase casein kinase II, Xu et al. (1999) used homologous recombination to disrupt the gene encoding Csnk2a2 in transgenic mice. They found that Csnk2a2 is preferentially expressed in late stages of spermatogenesis, and male mice in which Csnk2a2 has been disrupted are infertile, with oligospermia and globozoospermia ('round-headed spermatozoa'). This was the first demonstration of the unique role for a Ck2 isoform in development. The primary spermatogenic defect in the Csnk2a2-/- testis is a specific abnormality of anterior head shaping of elongating spermatids; this is the first defined gene that regulates sperm head morphogenesis. As the germ cells differentiate, they are capable of undergoing chromatin condensation, although many abnormal cells are deleted through apoptosis or Sertoli cell phagocytosis. The few that survived to populate the epididymis exhibited head abnormalities similar to those described in human globozoospermia; thus, Csnk2a2 may be a candidate gene for inherited abnormalities of sperm morphogenesis It is appreciated that the abovementioned animal model for CSNK2A2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Doray, B.; Ghosh, P.; Griffith, J.; Geuze, H. J.; Kornfeld, S.: Cooperation of GGAs and AP-1 in packaging MPRs at the trans-Golgi network. Science 297:1700-1703, 2002; and Xu, X.; Toselli, P. A.; Russell, L. D.; Seldin, D. C.: Globozoospermia in mice lacking the casein kinase II alpha-prime catalytic subunit. Nature Genet. 23:118-121, 1999.

Further studies establishing the function and utilities of CSNK2A2 are found in John Hopkins OMIM database record ID 115442, and in cited publications listed in Table 5, which are hereby incorporated by reference. CTEN (Accession NP_116254.3) is another GAM25 target gene, herein designated TARGET GENE. CTEN BINDING SITE is a target binding site found in the 3' untranslated region of mRNA encoded by CTEN, corresponding to a target binding site such as BINDING SITE I, BINDING SITE II or BINDING SITE III of FIG. 8. Table 4 illustrates the complementarity of the nucleotide sequences of CTEN BINDING SITE, designated SEQ ID:9806, to the nucleotide sequence of GAM25 rNA, herein designated GAM RNA, also designated SEQ ID:206.

Another function of GAM25 is therefore inhibition of CTEN (Accession NP_116254.3). Accordingly, utilities of GAM25 include diagnosis, prevention and treatment of diseases and clinical conditions associated with CTEN.

Chemokine (c-x-c motif) ligand 16 (CXCL16, Accession NP_071342.1) is another GAM25 target gene, herein designated TARGET GENE. CXCL16 BINDING SITE is a target binding site found in the 3' untranslated region of mRNA encoded by CXCL16, corresponding to a target binding site such as BINDING SITE I, BINDING SITE II or BINDING SITE III of FIG. 8. Table 4 illustrates the complementarity of the nucleotide sequences of CXCL16 BINDING SITE, designated SEQ ID:3618, to the nucleotide sequence of GAM25 rNA, herein designated GAM RNA, also designated SEQ ID:206.

Another function of GAM25 is therefore inhibition of Chemokine (c-x-c motif) ligand 16 (CXCL16, Accession NP_071342.1), a gene which induces calcium mobilization. Accordingly, utilities of GAM25 include diagnosis, prevention and treatment of diseases and clinical conditions associated with CXCL16.

The function of CXCL16 has been established by previous studies. Using a 2-step EST database search in which putative transcripts were scanned for the occurrence of functional patterns, Matloubian et al. (2000) identified a cDNA encoding a CXC chemokine that they termed CXCL16. The predicted 273-amino acid CXCL16 protein, which is 49% identical to the 246-amino acid mouse sequence, contains a non-glu/leu/arg (ELR) motif-containing CXC chemokine domain, a mucin-like spacer region, a transmembrane domain, and a cytoplasmic tail with a potential tyrosine phosphorylation and SH2 protein-binding site. CXCL16 was the first transmembrane CXC chemokine identified; CX3CL1 (SCYD1; 601880), which also has a mucin-like spacer region, was the only other known transmembrane chemokine. Northern blot analysis of mouse and human tissues detected a 2.2-kb CXCL16 transcript in spleen, lymph nodes, Peyer patches, lung, kidney, small intestine, and thymus, with weak expression in heart and liver and no expression in brain and bone marrow. Flow cytometry and Western blot analysis demonstrated expression of an approximately 60-kD glycosylated cell-surface protein as well as a cell supernatant 35-kD soluble protein. Flow cytometry of cells from mouse tissues indicated that CXCL16 is found on CD11C (ITGAX; 151510)-positive splenic and lymph node dendritic cells; this expression was increased after injection with lipopolysaccharide. Immunohistochemical analysis showed that CXCL16 is expressed in T-cell areas of the splenic white pulp, lymph nodes, the thymus medulla, and, interestingly, in the splenic red pulp. No staining was observed in B-cell areas. After injection of inflammatory mediators, expression was enhanced in T-cell zones and, more prominently, in splenic red pulp. Chemotaxis assays found that CXCL16 induced a strong chemotactic response in activated CD8 T cells. In addition, CXCL16 induced calcium mobilization. Expression cloning of mouse Cxcl16 identified a protein with 71% amino acid identity to human BONZO (OMIM Ref. No. 605163), which Matloubian et al. (2000) renamed CXCR6. Human and mouse cells expressing CXCR6 showed a strong chemotactic response to CXCL16 but not to other chemokines. The authors concluded that CXCL16 and CXCR6 probably function in interactions between dendritic cells and T cells and in regulating T-cell migration in the splenic red pulp. Macrophages endocytose oxidized low density lipoprotein (OxLDL) by a receptor-mediated mechanism. By expression cloning from a phorbol ester-stimulated THP-1 cell library, Shimaoka et al. (2000) isolated a cDNA encoding SRPSOX (scavenger receptor that binds phophatidylserine and oxidized lipoprotein). The deduced 254-amino acid type I transmembrane protein is identical to the CXCL16 protein reported by Matloubian et al. (2000) except that SRPSOX differs by 2 residues and lacks the N-terminal 19 amino acids. Cells expressing SRPSOX bound to phophatidylserine-coated plates; this binding could be inhibited by OxLDL. Scatchard analysis confirmed that SRPSOX is a specific receptor for OxLDL but not LDL or acetyl- LDL. Fluorescence microscopy demonstrated OxLDL uptake in SRPSOX-expressing cells. Immunoblot analysis showed that SRPSOX is expressed as a 30-kD protein in human and mouse macrophages. Northern blot analysis revealed differentiation-inducible expression of 1.8- and 2.5-kb transcripts in macrophages.

Full details of the abovementioned studies are described in the following publications, the disclosure of which are hereby incorporated by reference:

Matloubian, M.; David, A.; Engel, S.; Ryan, J. E.; Cyster, J. G.: A transmembrane CXC chemokine is a ligand for HIV-coreceptor Bonzo. Nature Immun. 1:298-304, 2000; and Shimaoka, T.; Kume, N.; Minami, M.; Hayashida, K.; Kataoka, H.; Kita, T.; Yonehara, S.: Molecular cloning of a novel scavenger receptor for oxidized low density lipoprotein, SR-PSOX.

Further studies establishing the function and utilities of CXCL16 are found in John Hopkins OMIM database record ID 605398, and in cited publications listed in Table 5, which are hereby incorporated by reference. CYCS (Accession NP_061820.1) is another GAM25 target gene, herein designated TARGET GENE. CYCS BINDING SITE is a target binding site found in the 3' untranslated region of mRNA encoded by CYCS, corresponding to a target binding site such as BINDING SITE I, BINDING SITE II or BINDING SITE III of FIG. 8. Table 4 illustrates the complementarity of the nucleotide sequences of CYCS BINDING SITE, designated SEQ ID:18428, to the nucleotide sequence of GAM25 rNA, herein designated GAM RNA, also designated SEQ ID:206.

Another function of GAM25 is therefore inhibition of CYCS (Accession NP_061820.1). Accordingly, utilities of GAM25 include diagnosis, prevention and treatment of diseases and clinical conditions associated with CYCS.

Chromosome y open reading frame 15b (CYorf15B, Accession NP_115965.1) is another GAM25 target gene, herein designated TARGET GENE. CYorf15B BINDING SITE is a target binding site found in the 5' untranslated region of mRNA encoded by CYorf15B, corresponding to a target binding site such as BINDING SITE I, BINDING SITE II or BINDING SITE III of FIG. 8. Table 4 illustrates the complementarity of the nucleotide sequences of CYorf15B BINDING SITE, designated SEQ ID:7001, to the nucleotide sequence of GAM25 rNA, herein designated GAM RNA, also designated SEQ ID:206.

Another function of GAM25 is therefore inhibition of Chromosome y open reading frame 15b (CYorf15B, Accession NP_115965.1). Accordingly, utilities of GAM25 include diagnosis, prevention and treatment of diseases and clinical conditions associated with CYorf15B.

Cytochrome p450, subfamily i (aromatic compound-inducible), polypeptide 2 (CYP1A2, Accession NP_000752.1) is another GAM25 target gene, herein designated TARGET GENE. CYP1A2 BINDING SITE is a target binding site found in the 3' untranslated region of mRNA encoded by CYP1A2, corresponding to a target binding site such as BINDING SITE I, BINDING SITE II or BINDING SITE III of FIG. 8. Table 4 illustrates the complementarity of the nucleotide sequences of CYP1A2 BINDING SITE, designated SEQ ID:1202, to the nucleotide sequence of GAM25 rNA, herein designated GAM RNA, also designated SEQ ID:206.

Another function of GAM25 is therefore inhibition of Cytochrome p450, subfamily i (aromatic compound-inducible), polypeptide 2 (CYP1A2, Accession NP_000752.1), a gene which intervenes in an NADPH-dependent electron transport pathway. and therefore may be associated with Porphyria cutanea tarda. Accordingly, utilities of GAM25 include diagnosis, prevention and treatment of Porphyria cutanea tarda, and of other diseases and clinical conditions associated with CYP1A2.

The function of CYP1A2 has been established by previous studies. P1-450 (CYP1A1; 108330) and P3-450 are 2 members of the dioxin-inducible P450 gene family. Jaiswal et al. (1987) determined the cDNA (3,064 bp) and protein (515 residues; M(r) =58,294) sequences of P3-450. They showed by study of somatic cell hybrids that both the P3-450 and the P1-450 loci reside on human chromosome 15. In the mouse and hamster, the 2 genes are located near the equivalent of the mannosephosphate isomerase (MPI) locus (OMIM Ref. No. 154550). The same may be true in man; MPI is located in the region 15q22-qter. The 2 CYP1 genes are within 25 kb of each other and probably are not separated by other genes (Nebert, 1988). The enzyme involved in O-deethylation of phenacetin is 1 of 9 forms of cytochrome P-450 that have been purified to electrophoretic homogeneity from human liver microsomes (Guengerich et al., 1986). Phenacetin O-deethylase differs from another cytochrome P-450 enzyme that shows genetic polymorphism, debrisoquine 4-hydroxylase (OMIM Ref. No. 124030), in molecular mass, amino acid composition, catalytic activity, and immunochemical properties. Butler et al. (1989) reviewed the evidence that phenacetin O-deethylase, otherwise known as P450(PA), is the product of the CYP1A2 gene. Devonshire et al. (1983) demonstrated a genetic polymorphism for phenacetin O-deethylation, with 5 to 10% of the population deficient in this activity. Cigarette smoking has been shown to increase microsomal phenacetin O-deethylase activity (Sesardic et al., 1988). Butler et al. (1989) reported that human hepatic microsomal caffeine 3-demethylation, the initial major step in caffeine biotransformation in humans, is selectively catalyzed by this cytochrome P-450. Estimation of caffeine 3-demethylation activity in humans may be useful in the characterization of arylamine N-oxidation phenotypes and in the assessment of whether or not the hepatic levels of this cytochrome, as affected by environmental or genetic factors, contribute to interindividual differences in susceptibility to arylamine-induced cancers. Smokers have been demonstrated to have increased rates of caffeine disposition, with plasma half lives one-half that of nonsmokers. Furthermore, rates of caffeine metabolism vary between individuals, as caffeine half-life values ranging from 1.5 to 9.5 hours have been reported. Buters et al. (1996) showed that in mice the clearance of caffeine is determined primarily by CYP1A2.

Full details of the abovementioned studies are described in the following publications, the disclosure of which are hereby incorporated by reference:

Butler, M. A.; Iwasaki, M.; Guengerich, F. P.; Kadlubar, F. F.: Human cytochrome P-450(PA) (P-450IA2), the phenacetin O-deethylase, is primarily responsible for the hepatic 3-demethylation of caffeine and N-oxidation of carcinogenic arylamines. Proc. Nat. Acad. Sci. 86:7696-7700, 1989; and Christiansen, L.; Bygum, A.; Jensen, A.; Thomsen, K.; Brandrup, F.; Horder, M.; Petersen, N. E.: Association between CYP1A2 polymorphism and susceptibility to porphyria cutanea tarda.

Further studies establishing the function and utilities of CYP1A2 are found in John Hopkins OMIM database record ID 124060, and in cited publications listed in Table 5, which are hereby incorporated by reference. Cytochrome p450, subfamily iib (phenobarbital-inducible), polypeptide 6 (CYP2B6, Accession NP_000758.1) is another GAM25 target gene, herein designated TARGET GENE. CYP2B6 BINDING SITE is a target binding site found in the 3' untranslated region of mRNA encoded by CYP2B6, corresponding to a target binding site such as BINDING SITE I, BINDING SITE II or BINDING SITE III of FIG. 8. Table 4 illustrates the complementarity of the nucleotide sequences of CYP2B6 BINDING SITE, designated SEQ ID:6624, to the nucleotide sequence of GAM25 rNA, herein designated GAM RNA, also designated SEQ ID:206.

Another function of GAM25 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM25 include diagnosis, prevention and treatment of diseases and clinical conditions associated with CYP2B6.

The function of CYP2B6 has been established by previous studies. Thum and Borlak (2000) investigated the gene expression of major human cytochrome P450 genes in various regions of explanted hearts from 6 patients with dilated cardiomyopathy and 1 with transposition of the arterial trunk and 2 samples of normal heart. mRNA for cytochrome 2B6 was predominantly expressed in the right ventricle. A strong correlation between tissue-specific gene expression and enzyme activity was found. Thum and Borlak (2000) concluded that their findings showed that expression of genes for cytochrome P450 monooxgenases and verapamil metabolism are found predominantly in the right side of the heart, and suggested that this observation may explain the lack of efficacy of certain cardioselective drugs. Using a cloned cDNA that codes for a human ortholog of the phenobarbital-inducible cytochrome P450IIB subfamily in rodents, Santisteban et al. (1988) localized the CYP2B gene family to 19cen-q13.3 by Southern blot hybridization to DNA extracted from a panel of human-rodent somatic cell hybrids. Miles et al. (1988) established the chromosomal localization of the CYP2B gene subfamily to be 19q12-q13.2, close to the location of CYP2A (OMIM Ref. No. 123960), by Southern blot analysis of human-rodent somatic cell hybrids.

Full details of the abovementioned studies are described in the following publications, the disclosure of which are hereby incorporated by reference:

Santisteban, I.; Povey, S.; Shephard, E. A.; Phillips, I. R.: The major phenobarbital-inducible cytochrome P-450 gene subfamily (P450IIB) mapped to the long arm of human chromosome 19. Ann. Hum. Genet. 52:129-135, 1988; and Thum, T.; Borlak, J.: Gene expression in distinct regions of the heart. Lancet 355:979-983, 2000.

Further studies establishing the function and utilities of CYP2B6 are found in John Hopkins OMIM database record ID 605059, and in cited publications listed in Table 5, which are hereby incorporated by reference. CYP51A1 (Accession NP_000777.1) is another GAM25 target gene, herein designated TARGET GENE. CYP51A1 BINDING SITE is a target binding site found in the 3' untranslated region of mRNA encoded by CYP51A1, corresponding to a target binding site such as BINDING SITE I, BINDING SITE II or BINDING SITE III of FIG. 8. Table 4 illustrates the complementarity of the nucleotide sequences of CYP51A1 BINDING SITE, designated SEQ ID:17115, to the nucleotide sequence of GAM25 rNA, herein designated GAM RNA, also designated SEQ ID:206.

Another function of GAM25 is therefore inhibition of CYP51A1 (Accession NP_000777.1). Accordingly, utilities of GAM25 include diagnosis, prevention and treatment of diseases and clinical conditions associated with CYP51A1.

Cytochrome p450, subfamily viiib (sterol 12-alpha-hydroxylase), polypeptide 1 (CYP8B1, Accession NP_004382.1) is another GAM25 target gene, herein designated TARGET GENE. CYP8B1 BINDING SITE is a target binding site found in the 3' untranslated region of mRNA encoded by CYP8B1, corresponding to a target binding site such as BINDING SITE I, BINDING SITE II or BINDING SITE III of FIG. 8. Table 4 illustrates the complementarity of the nucleotide sequences of CYP8B1 BINDING SITE, designated SEQ ID:10741, to the nucleotide sequence of GAM25 RNA, herein designated GAM RNA, also designated SEQ ID:206.

Another function of GAM25 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM25 include diagnosis, prevention and treatment of diseases and clinical conditions associated with CYP8B1.

The function of CYP8B1 has been established by previous studies. Zhang and Chiang (2001) showed that hepatocyte nuclear factor-4-alpha (HNF4A; 600281) strongly activates CYP8B1 promoter activity, whereas CYP7A promoter-binding factor (CPF, or NR5A2; 604453) has much less effect. The promoter activities were strongly repressed by bile acid. EMSA and site-directed mutagenesis analysis indicated that HNF4A, CPF, and the bile acid response element have overlapping binding sites in CYP8B1. Mammalian 2-hybrid analysis demonstrated interaction of HNF4A with the small heterodimer partner (SHP; 604630). Functional analysis determined that SHP represses HNF4A-induced CYP8B1 transcription. Zhang and Chiang (2001) concluded that bile acids repress human CYP8B1 transcription by reducing the transactivation activity of HNF4A through the interaction of HNF4A with SHP and a reduction of HNF4A expression in liver. Gafvels et al. (1999) obtained cDNAs encoding human and mouse CYP8B1. The deduced 501-amino acid human CYP8B1 protein is approximately 75% identical to the mouse and rabbit proteins. It contains a hydrophobic, membrane-spanning N terminus and conserved oxygen- binding, steroidogenic, and heme-binding segments. Northern blot analysis revealed expression of a 3.9-kb CYP8B1 transcript in liver. In mouse, expression was restricted to liver.

Full details of the abovementioned studies are described in the following publications, the disclosure of which are hereby incorporated by reference:

Gafvels, M.; Olin, M.; Chowdhary, B. P.; Raudsepp, T.; Andersson, U.; Persson, B.; Jansson, M.; Bjorkhem, I.; Eggertsen, G.: Structure and chromosomal assignment of the sterol 12-alpha-hydroxylase gene (CYP8B1) in human and mouse: eukaryotic cytochrome P-450 gene devoid of introns. Genomics 56:184-196, 1999; and Zhang, M.; Chiang, J. Y. L.: Transcriptional regulation of the human sterol 12-alpha-hydroxylase gene (CYP8B1): roles of hepatocyte nuclear factor 4-alpha in mediating bile acid repre.

Further studies establishing the function and utilities of CYP8B1 are found in John Hopkins OMIM database record ID 602172, and in cited publications listed in Table 5, which are hereby incorporated by reference. Debranching enzyme homolog 1 (s. cerevisiae) (DBR1, Accession NP_057300.1) is another GAM25 target gene, herein designated TARGET GENE. DBR1 BINDING SITE is a target binding site found in the 3' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:19169, to the nucleotide sequence of GAM25 rNA, herein designated GAM RNA, also designated SEQ ID:206.

Another function of GAM25 is therefore inhibition of Debranching enzyme homolog 1 (s. cerevisiae) (DBR1, Accession NP_057300.1). Accordingly, utilities of GAM25 include diagnosis, prevention and treatment of diseases and clinical conditions associated with DBR1.

Density-regulated protein (DENR, Accession XP_113714.2) is another GAM25 target gene, herein designated TARGET GENE. DENR BINDING SITE is a target binding site found in the 3' untranslated region of multiple transcripts of mRNA encoded by DENR, corresponding to a target binding site such as BINDING SITE I, BINDING SITE II or BINDING SITE III of FIG. 8. Table 4 illustrates the complementarity of the nucleotide sequences of DENR BINDING SITE, designated SEQ ID:3444, to the nucleotide sequence of GAM25 rNA, herein designated GAM RNA, also designated SEQ ID:206.

Another function of GAM25 is therefore inhibition of Density-regulated protein (DENR, Accession XP_113714.2). Accordingly, utilities of GAM25 include diagnosis, prevention and treatment of diseases and clinical conditions associated with DENR.

Density-regulated protein (DENR, Accession NP_003668.2) is another GAM25 target gene, herein designated TARGET GENE. DENR BINDING SITE is a target binding site found in the 3' untranslated region of multiple transcripts of mRNA encoded by DENR, corresponding to a target binding site such as BINDING SITE I, BINDING SITE II or BINDING SITE III of FIG. 8. Table 4 illustrates the complementarity of the nucleotide sequences of DENR BINDING SITE, designated SEQ ID:3444, to the nucleotide sequence of GAM25 rNA, herein designated GAM RNA, also designated SEQ ID:206.

Another function of GAM25 is therefore inhibition of Density-regulated protein (DENR, Accession NP_003668.2). Accordingly, utilities of GAM25 include diagnosis, prevention and treatment of diseases and clinical conditions associated with DENR.

DKFZP434B044 (Accession NP_113664.1) is another GAM25 target gene, herein designated TARGET GENE. DKFZP434B044 BINDING SITE is a target binding site found in the 3' untranslated region of mRNA encoded by DKFZP434B044, corresponding to a target binding site such as BINDING SITE I, BINDING SITE II or BINDING SITE III of FIG. 8. Table 4 illustrates the complementarity of the nucleotide sequences of DKFZP434B044 BINDING SITE, designated SEQ ID:5045, to the nucleotide sequence of GAM25 RNA, herein designated GAM RNA, also designated SEQ ID:206.

Another function of GAM25 is therefore inhibition of DKFZP434B044 (Accession NP_113664.1). Accordingly, utilities of GAM25 include diagnosis, prevention and treatment of diseases and clinical conditions associated with DKFZP434B044.

DKFZp434C0923 (Accession NP_060068.1) is another GAM25 target gene, herein designated TARGET GENE. DKFZp434C0923 BINDING SITE is a target binding site found in the 3' untranslated region of mRNA encoded by DKFZp434C0923, corresponding to a target binding site such as BINDING SITE I, BINDING SITE II or BINDING SITE III of FIG. 8. Table 4 illustrates the complementarity of the nucleotide sequences of DKFZp434C0923 BINDING SITE, designated SEQ ID:3728, to the nucleotide sequence of GAM25 RNA, herein designated GAM RNA, also designated SEQ ID:206.

Another function of GAM25 is therefore inhibition of DKFZp434C0923 (Accession NP_060068.1). Accordingly, utilities of GAM25 include diagnosis, prevention and treatment of diseases and clinical conditions associated with DKFZp434C0923.

DKFZP434D146 (Accession NP_056410.2) is another GAM25 target gene, herein designated TARGET GENE. DKFZP434D146 BINDING SITE is a target binding site found in the 3' untranslated region of mRNA encoded by DKFZP434D146, corresponding to a target binding site such as BINDING SITE I, BINDING SITE II or BINDING SITE III of FIG. 8. Table 4 illustrates the complementarity of the nucleotide sequences of DKFZP434D146BINDING SITE, designated SEQ ID:10108, to the nucleotide sequence of GAM25 RNA, herein designated GAM RNA, also designated SEQ ID:206.

Another function of GAM25 is therefore inhibition of DKFZP434D146 (Accession NP_056410.2). Accordingly, utilities of GAM25 include diagnosis, prevention and treatment of diseases and clinical conditions associated with DKFZP434D146.

DKFZp434E2220 (Accession NP_060082.1) is another GAM25 target gene, herein designated TARGET GENE. DKFZp434E2220 BINDING SITE is a target binding site found in the 5' untranslated region of mRNA encoded by DKFZp434E2220, corresponding to a target binding site such as BINDING SITE I, BINDING SITE II or BINDING SITE III of FIG. 8. Table 4 illustrates the complementarity of the nucleotide sequences of DKFZp434E2220 BINDING SITE, designated SEQ ID:17183, to the nucleotide sequence of GAM25 RNA, herein designated GAM RNA, also designated SEQ ID:206.

Another function of GAM25 is therefore inhibition of DKFZp434E2220 (Accession NP_060082.1). Accordingly, utilities of GAM25 include diagnosis, prevention and treatment of diseases and clinical conditions associated with DKFZp434E2220.

DKFZP434F0318 (Accession NP_110444.1) is another GAM25 target gene, herein designated TARGET GENE. DKFZP434F0318 BINDING SITE is a target binding site found in the 3' untranslated region of mRNA encoded by DKFZP434F0318, corresponding to a target binding site such as BINDING SITE I, BINDING SITE II or BINDING SITE III of FIG. 8. Table 4 illustrates the complementarity of the nucleotide sequences of DKFZP434F0318 BINDING SITE, designated SEQ ID:14934, to the nucleotide sequence of GAM25 RNA, herein designated GAM RNA, also designated SEQ ID:206.

Another function of GAM25 is therefore inhibition of DKFZP434F0318 (Accession NP_110444.1). Accordingly, utilities of GAM25 include diagnosis, prevention and treatment of diseases and clinical conditions associated with DKFZP434F0318.

DKFZp547H025 (Accession NP_064546.1) is another GAM25 target gene, herein designated TARGET GENE. DKFZp547H025 BINDING SITE is a target binding site found in the 3' untranslated region of mRNA encoded by DKFZp547H025, corresponding to a target binding site such as BINDING SITE I, BINDING SITE II or BINDING SITE III of FIG. 8. Table 4 illustrates the complementarity of the nucleotide sequences of DKFZp547H025 BINDING SITE, designated SEQ ID:10247, to the nucleotide sequence of GAM25 RNA, herein designated GAM RNA, also designated SEQ ID:206.

Another function of GAM25 is therefore inhibition of DKFZp547H025 (Accession NP_064546.1). Accordingly, utilities of GAM25 include diagnosis, prevention and treatment of diseases and clinical conditions associated with DKFZp547H025.

DKFZP564J0863 (Accession NP_056274.1) is another GAM25 target gene, herein designated TARGET GENE. DKFZP564J0863 BINDING SITE is a target binding site found in the 3' untranslated region of mRNA encoded by DKFZP564J0863, corresponding to a target binding site such as BINDING SITE I, BINDING SITE II or BINDING SITE III of FIG. 8. Table 4 illustrates the complementarity of the nucleotide sequences of DKFZP564J0863 BINDING SITE, designated SEQ ID:2610, to the nucleotide sequence of GAM25 RNA, herein designated GAM RNA, also designated SEQ ID:206.

Another function of GAM25 is therefore inhibition of DKFZP564J0863 (Accession NP_056274.1). Accordingly, utilities of GAM25 include diagnosis, prevention and treatment of diseases and clinical conditions associated with DKFZP564J0863.

DKFZP564O0523 (Accession NP_115496.1) is another GAM25 target gene, herein designated TARGET GENE. DKFZP564O0523 BINDING SITE is a target binding site found in the 3' untranslated region of mRNA encoded by DKFZP564O0523, corresponding to a target binding site such as BINDING SITE I, BINDING SITE II or BINDING SITE III of FIG. 8. Table 4 illustrates the complementarity of the nucleotide sequences of DKFZP564O0523 BINDING SITE, designated SEQ ID:6069, to the nucleotide sequence of GAM25 RNA, herein designated GAM RNA, also designated SEQ ID:206.

Another function of GAM25 is therefore inhibition of DKFZP564O0523 (Accession NP_115496.1). Accordingly, utilities of GAM25 include diagnosis, prevention and treatment of diseases and clinical conditions associated with DKFZP564O0523.

DKFZP566I1024 (Accession NP_056226.1) is another GAM25 target gene, herein designated TARGET GENE. DKFZP566I1024 BINDING SITE is a target binding site found in the 3' untranslated region of mRNA encoded by DKFZP566I1024, corresponding to a target binding site such as BINDING SITE I, BINDING SITE II or BINDING SITE III of FIG. 8. Table 4 illustrates the complementarity of the nucleotide sequences of DKFZP566I1024 BINDING SITE, designated SEQ ID:3248, to the nucleotide sequence of GAM25 RNA, herein designated GAM RNA, also designated SEQ ID:206.

Another function of GAM25 is therefore inhibition of DKFZP566I1024(Accession NP_056226.1). Accordingly, utilities of GAM25 include diagnosis, prevention and treatment of diseases and clinical conditions associated with DKFZP566I1024.

DKFZp667B1218 (Accession NP_808881.1) is another GAM25 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:19212, to the nucleotide sequence of GAM25 RNA, herein designated GAM RNA, also designated SEQ ID:206.

Another function of GAM25 is therefore inhibition of DKFZp667B1218 (Accession NP_808881.1). Accordingly, utilities of GAM25 include diagnosis, prevention and treatment of diseases and clinical conditions associated with DKFZp667B1218.

DKFZp667E0512 (Accession XP_117353.1) is another GAM25 target gene, herein designated TARGET GENE. DKFZp667E0512 BINDING SITE is a target binding site found in the 3' untranslated region of mRNA encoded by DKFZp667E0512, corresponding to a target binding site such as BINDING SITE I, BINDING SITE II or BINDING SITE III of FIG. 8. Table 4 illustrates the complementarity of the nucleotide sequences of DKFZp667E0512 BINDING SITE, designated SEQ ID:19169, to the nucleotide sequence of GAM25 RNA, herein designated GAM RNA, also designated SEQ ID:206.

Another function of GAM25 is therefore inhibition of DKFZp667E0512 (Accession XP_117353.1). Accordingly, utilities of GAM25 include diagnosis, prevention and treatment of diseases and clinical conditions associated with DKFZp667E0512.

DKFZp761B107 (Accession NP_775734.1) is another GAM25 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:13045, to the nucleotide sequence of GAM25 RNA, herein designated GAM RNA, also designated SEQ ID:206.

Another function of GAM25 is therefore inhibition of DKFZp761B107 (Accession NP_775734.1). Accordingly, utilities of GAM25 include diagnosis, prevention and treatment of diseases and clinical conditions associated with DKFZp761B107.

DKFZp761H039 (Accession NP_061181.1) is another GAM25 target gene, herein designated TARGET GENE. DKFZp761H039 BINDING SITE is a target binding site found in the 3' untranslated region of mRNA encoded by DKFZp761H039, corresponding to a target binding site such as BINDING SITE I, BINDING SITE II or BINDING SITE III of FIG. 8. Table 4 illustrates the complementarity of the nucleotide sequences of DKFZp761H039 BINDING SITE, designated SEQ ID:16380, to the nucleotide sequence of GAM25 RNA, herein designated GAM RNA, also designated SEQ ID:206.

Another function of GAM25 is therefore inhibition of DKFZp761H039 (Accession NP_061181.1). Accordingly, utilities of GAM25 include diagnosis, prevention and treatment of diseases and clinical conditions associated with DKFZp761H039.

DKFZp761J139 (Accession NP_115656.1) is another GAM25 target gene, herein designated TARGET GENE. DKFZp761J139 BINDING SITE is a target binding site found in the 5' untranslated region of mRNA encoded by DKFZp761J139, corresponding to a target binding site such as BINDING SITE I, BINDING SITE II or BINDING SITE III of FIG. 8. Table 4 illustrates the complementarity of the nucleotide sequences of DKFZp761J139 BINDING SITE, designated SEQ ID:17889, to the nucleotide sequence of GAM25 RNA, herein designated GAM RNA, also designated SEQ ID:206.

Another function of GAM25 is therefore inhibition of DKFZp761J139 (Accession NP_115656.1). Accordingly, utilities of GAM25 include diagnosis, prevention and treatment of diseases and clinical conditions associated with DKFZp761J139.

DKFZp762H185 (Accession XP_172976.2) is another GAM25 target gene, herein designated TARGET GENE. DKFZp762H185 BINDING SITE is a target binding site found in the 3' untranslated region of mRNA encoded by DKFZp762H185, corresponding to a target binding site such as BINDING SITE I, BINDING SITE II or BINDING SITE III of FIG. 8. Table 4 illustrates the complementarity of the nucleotide sequences of DKFZp762H185 BINDING SITE, designated SEQ ID:18358, to the nucleotide sequence of GAM25 RNA, herein designated GAM RNA, also designated SEQ ID:206.

Another function of GAM25 is therefore inhibition of DKFZp762H185 (Accession XP_172976.2). Accordingly, utilities of GAM25 include diagnosis, prevention and treatment of diseases and clinical conditions associated with DKFZp762H185.

Down syndrome critical region gene 6 (DSCR6, Accession NP_061835.1) is another GAM25 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:13892, to the nucleotide sequence of GAM25 rNA, herein designated GAM RNA, also designated SEQ ID:206.

Another function of GAM25 is therefore inhibition of Down syndrome critical region gene 6 (DSCR6, Accession NP_061835.1). Accordingly, utilities of GAM25 include diagnosis, prevention and treatment of diseases and clinical conditions associated with DSCR6.

DUSP18 (Accession NP_689724.2) is another GAM25 target gene, herein designated TARGET GENE. DUSP18 BINDING SITE is a target binding site found in the 3' untranslated region of mRNA encoded by DUSP18, corresponding to a target binding site such as BINDING SITE I, BINDING SITE II or BINDING SITE III of FIG. 8. Table 4 illustrates the complementarity of the nucleotide sequences of DUSP18 BINDING SITE, designated SEQ ID:17445, to the nucleotide sequence of GAM25 rNA, herein designated GAM RNA, also designated SEQ ID:206.

Another function of GAM25 is therefore inhibition of DUSP18 (Accession NP_689724.2). Accordingly, utilities of GAM25 include diagnosis, prevention and treatment of diseases and clinical conditions associated with DUSP18.

EEF2K (Accession NP_037434.1) is another GAM25 target gene, herein designated TARGET GENE. EEF2K BINDING SITE is a target binding site found in the 3' untranslated region of mRNA encoded by EEF2K, corresponding to a target binding site such as BINDING SITE I, BINDING SITE II or BINDING SITE III of FIG. 8. Table 4 illustrates the complementarity of the nucleotide sequences of EEF2K BINDING SITE, designated SEQ ID:1130, to the nucleotide sequence of GAM25 rNA, herein designated GAM RNA, also designated SEQ ID:206.

Another function of GAM25 is therefore inhibition of EEF2K (Accession NP_037434.1), a gene which phosphorylates serine or threonine on the eukaryotic elongation factor-2 and therefore may be associated with Systemic lupus erythematosus and cancer. Accordingly, utilities of GAM25 include diagnosis, prevention and treatment of Systemic lupus erythematosus and cancer, and of other diseases and clinical conditions associated with EEF2K.

The function of EEF2K has been established by previous studies. Using degenerate PCR primers based on worm and rabbit peptide sequences for Eef2k, followed by 5-prime and 3-prime RACE and RT-PCR on a glioma cell line, Ryazanov et al. (1997) obtained cDNAs encoding rodent and human EEF2K. The deduced 725-amino acid human protein is 90% identical to the rodent proteins. EEF2K lacks homology to other serine/threonine kinases or to other calmodulin-dependent kinases, apart from a glycine-rich loop that is part of the ATP-binding site. All EEF2K sequences contain a highly-conserved 200-residue catalytic domain. There is also a conserved C-terminal coiled-coil region. SDS-PAGE and functional analysis showed expression of a 100-kD protein whose activity was strictly calmodulin-dependent. Northern blot analysis revealed ubiquitous expression of a major 3.1-kb transcript and minor 6.1- and 2.5-kb transcripts. Expression was particularly abundant in heart and skeletal muscle, suggesting that EEF2 phosphorylation may be particularly important in muscle. Arora et al. (2002) found that a majority of patients with systemic lupus erythematosus (SLE; 152700) have high titer anti-EEF2K antibodies capable of immunoprecipitating functional enzyme.

Full details of the abovementioned studies are described in the following publications, the disclosure of which are hereby incorporated by reference:

Ryazanov, A. G.; Ward, M. D.; Mendola, C. E.; Pavur, K. S.; Dorovkov, M. V.; Wiedmann, M.; Erdjument-Bromage, H.; Tempst, P.; Parmer, T. G.; Prostko, C. R.; Germino, F. J.; Hait, W. N.: Identification of a new class of protein kinases represented by eukaryotic elongation factor-2 kinase. Proc. Nat. Acad. Sci. 94:4884-4889, 1997; and Arora, S.; Yang, J.-M.; Craft, J.; Hait, W.: Detection of anti-elongation factor 2 kinase (calmodulin-dependent protein kinase III) antibodies in patients with systemic lupus erythemato.

Further studies establishing the function and utilities of EEF2K are found in John Hopkins OMIM database record ID 606968, and in cited publications listed in Table 5, which are hereby incorporated by reference. Eh-domain containing 2 (EHD2, Accession NP_055416.2) is another GAM25 target gene, herein designated TARGET GENE. EHD2 BINDING SITE is a target binding site found in the 3' untranslated region of mRNA encoded by EHD2, corresponding to a target binding site such as BINDING SITE I, BINDING SITE II or BINDING SITE III of FIG. 8. Table 4 illustrates the complementarity of the nucleotide sequences of EHD2 BINDING SITE, designated SEQ ID:7811, to the nucleotide sequence of GAM25 rNA, herein designated GAM RNA, also designated SEQ ID:206.

Another function of GAM25 is therefore inhibition of Eh-domain containing 2 (EHD2, Accession NP_055416.2). Accordingly, utilities of GAM25 include diagnosis, prevention and treatment of diseases and clinical conditions associated with EHD2.

ELP3 (Accession NP_060561.3) is another GAM25 target gene, herein designated TARGET GENE. ELP3 BINDING SITE is a target binding site found in the 3' untranslated region of mRNA encoded by ELP3, corresponding to a target binding site such as BINDING SITE I, BINDING SITE II or BINDING SITE III of FIG. 8. Table 4 illustrates the complementarity of the nucleotide sequences of ELP3 BINDING SITE, designated SEQ ID:4705, to the nucleotide sequence of GAM25 rNA, herein designated GAM RNA, also designated SEQ ID:206.

Another function of GAM25 is therefore inhibition of ELP3 (Accession NP_060561.3). Accordingly, utilities of GAM25 include diagnosis, prevention and treatment of diseases and clinical conditions associated with ELP3.

ET(B)R-LP-2 (Accession NP_004758.2) is another GAM25 target gene, herein designated TARGET GENE. ET(B)R-LP-2 BINDING SITE is a target binding site found in the 3' untranslated region of mRNA encoded by ET(B)R-LP-2, corresponding to a target binding site such as BINDING SITE I, BINDING SITE II or BINDING SITE III of FIG. 8. Table 4 illustrates the complementarity of the nucleotide sequences of ET(B)R-LP-2 BINDING SITE, designated SEQ ID:3185, to the nucleotide sequence of GAM25 rNA, herein designated GAM RNA, also designated SEQ ID:206.

Another function of GAM25 is therefore inhibition of ET(B)R-LP-2 (Accession NP_004758.2). Accordingly, utilities of GAM25 include diagnosis, prevention and treatment of diseases and clinical conditions associated with ET(B)R-LP-2.

Ellis van creveld syndrome (EVC, Accession NP_055371.1) is another GAM25 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:6657, to the nucleotide sequence of GAM25 rNA, herein designated GAM RNA, also designated SEQ ID:206.

Another function of GAM25 is therefore inhibition of Ellis van creveld syndrome (EVC, Accession NP_055371.1). Accordingly, utilities of GAM25 include diagnosis, prevention and treatment of diseases and clinical conditions associated with EVC.

Ellis van creveld syndrome (EVC, Accession NP_714928.1) is another GAM25 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:6657, to the nucleotide sequence of GAM25 rNA, herein designated GAM RNA, also designated SEQ ID:206.

Another function of GAM25 is therefore inhibition of Ellis van creveld syndrome (EVC, Accession NP_714928.1). Accordingly, utilities of GAM25 include diagnosis, prevention and treatment of diseases and clinical conditions associated with EVC.

Ecotropic viral integration site 5 (EVI5, Accession NP_005656.2) is another GAM25 target gene, herein designated TARGET GENE. EVI5 BINDING SITE1 and EVI5 BINDING SITE2 are target binding sites found in untranslated regions of mRNA encoded by EVI5, corresponding to target binding sites such as BINDING SITE I, BINDING SITE II or BINDING SITE III of FIG. 8. Table 4 illustrates the complementarity of the nucleotide sequences of EVI5 BINDING SITE1 and EVI5 BINDING SITE2, designated SEQ ID:19835 and SEQ ID:19191 respectively, to the nucleotide sequence of GAM25 rNA, herein designated GAM RNA, also designated SEQ ID:206.

Another function of GAM25 is therefore inhibition of Ecotropic viral integration site 5 (EVI5, Accession NP_005656.2). Accordingly, utilities of GAM25 include diagnosis, prevention and treatment of diseases and clinical conditions associated with EVI5.

Coagulation factor ii (thrombin) receptor-like 3 (F2RL3, Accession NP_003941.1) is another GAM25 target gene, herein designated TARGET GENE. F2RL3 BINDING SITE is a target binding site found in the 3' untranslated region of mRNA encoded by F2RL3, corresponding to a target binding site such as BINDING SITE I, BINDING SITE II or BINDING SITE III of FIG. 8. Table 4 illustrates the complementarity of the nucleotide sequences of F2RL3 BINDING SITE, designated SEQ ID:18613, to the nucleotide sequence of GAM25 rNA, herein designated GAM RNA, also designated SEQ ID:206.

Another function of GAM25 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM25 include diagnosis, prevention and treatment of diseases and clinical conditions associated with F2RL3.

The function of F2RL3 has been established by previous studies. Protease-activated receptors 1 (PAR1; 187930), 2 (PAR2; 600933), and 3 (PAR3; 601919) are members of a unique G protein-coupled receptor family. They are characterized by a tethered peptide ligand at the extracellular amino terminus that is generated by minor proteolysis. Xu et al. (1998) identified a partial cDNA sequence of a fourth member of this family, PAR4, in an expressed sequence tag (EST) database, and a full-length cDNA clone was isolated from a lymphoma Daudi cell cDNA library. The open reading frame coded for a 7-transmembrane domain protein of 385 amino acids with 33% amino acid sequence identity with PAR1-3. A putative protease cleavage site was identified within the extracellular amino terminus. Northern blot analysis showed that PAR4 mRNA is expressed in a number of human tissues, with high levels being present in lung, pancreas, thyroid, testis, and small intestine. By fluorescence in situ hybridization, Xu et al. (1998) mapped the PAR4 gene to 19p12.

Animal model experiments lend further support to the function of F2RL3. Sambrano et al. (2001) demonstrated that platelets from Par4-deficient mice failed to change shape, mobilize calcium, secrete ATP, or aggregate in response to thrombin.

It is appreciated that the abovementioned animal model for F2RL3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Xu, W.-F.; Andersen, H.; Whitmore, T. E.; Presnell, S. R.; Yee, D. P.; Ching, A.; Gilbert, T.; Davie, E. W.; Foster, D. C.: Cloning and characterization of human protease-activated receptor 4. Proc. Nat. Acad. Sci. 95:6642-6646, 1998; and Sambrano, G. R.; Weiss, E. J.; Zheng, Y.-W.; Huang, W.; Coughlin, S. R.: Role of thrombin signalling in platelets in haemostasis and thrombosis. Nature 413:74-78, 2001.

Further studies establishing the function and utilities of F2RL3 are found in John Hopkins OMIM database record ID 602779, and in cited publications listed in Table 5, which are hereby incorporated by reference. Coagulation factor iii (thromboplastin, tissue factor) (F3, Accession NP_001984.1) is another GAM25 target gene, herein designated TARGET GENE. F3 BINDING SITE is a target binding site found in the 3' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:14357, to the nucleotide sequence of GAM25 rNA, herein designated GAM RNA, also designated SEQ ID:206.

Another function of GAM25 is therefore inhibition of Coagulation factor iii (thromboplastin, tissue factor) (F3, Accession NP_001984.1), a gene which functions in normal hemostasis. Accordingly, utilities of GAM25 include diagnosis, prevention and treatment of diseases and clinical conditions associated with F3.

The function of F3 has been established by previous studies. Factor III, a glycoprotein component of cell membranes, is an essential cofactor for factor VII- dependent activation of blood coagulation and activates the extrinsic pathway of blood coagulation in the presence of factor XII and calcium. It may be the primary physiologic initiator of blood coagulation. This may explain why factor III is the only protein in the coagulation pathway for which a congenital deficiency has not been described. Carson et al. (1985) mapped F3 to 1pter-p21 by study of somatic cell hybrids with a species-specific sensitive chromogenic assay. Spicer et al. (1987) isolated cDNA clones for tissue factor. The amino acid sequence deduced from the nucleotide sequence of the cDNAs indicates that tissue factor is synthesized as a higher molecular weight precursor with a leader sequence of 32 amino acids, while the sequence of the mature protein suggests that there are 3 distinct domains: extracellular (residues 1-219), hydrophobic (residues 220-242), and cytoplasmic (residues 243-263). Scarpati et al. (1987) screened a human placenta cDNA library in lambda-gt11 for expression of tissue factor antigens. Among 4 million recombinant clones screened, one that was positive expressed a protein that shares epitopes with authentic human brain tissue factor. The 1.1-kb cDNA insert encodes a peptide containing the N-terminal protein sequence of brain tissue factor. By means of this clone used in hybridization to flow-sorted human chromosomes, Scarpati et al. (1987) showed that the tissue factor gene is located on chromosome 1. Scarpati et al. (1987) used a RFLP to map factor 3 to proximal 1p by multipoint linkage analysis with probes known to span that region. Judging by the location arrived at by somatic cell hybridization, the location of F3 may be in the region 1p22-p21. By in situ hybridization, Kao et al. (1988) likewise mapped F3 to 1p22-p21. Mackman et al. (1989) presented the complete sequence of the F3 gene. It is 12.4 kb long and has 6 exons separated by 5 introns. Mackman et al. (1990) concluded that the tissue factor promoter is relatively complex. Tissue factor (TF) is an integral membrane glycoprotein that, when exposed to plasma, is a potent procoagulant. As stated earlier, it is believed to be the physiologic initiator of blood coagulation. Toomey et al. (1997) found that, in contrast to findings of earlier studies which showed that TF-null mouse embryos did not survive beyond midgestation, 14% of TF-deficient embryos from a hybrid background escaped this early mortality and survived to birth. On gross and microscopic inspection, these late gestation, TF-deficient embryos appeared normal. Furthermore, the growth and vascularity of TF +/+, TF +/-, and TF- /-teratomas and teratocarcinomas were indistinguishable. Toomey et al. (1997) concluded that tumor-derived TF is not required for tumor growth and angiogenesis and that the combined data do not support an essential role for TF in embryonic vascular development.

Full details of the abovementioned studies are described in the following publications, the disclosure of which are hereby incorporated by reference:

Mackman, N.; Fowler, B. J.; Edgington, T. S.; Morrissey, J. H.: Functional analysis of the human tissue factor promoter and induction by serum. Proc. Nat. Acad. Sci. 87:2254-2258, 1990; and Toomey, J. R.; Kratzer, K. E.; Lasky, N. M.; Broze, G. J., Jr.: Effect of tissue factor deficiency on mouse and tumor development. Proc. Nat. Acad. Sci. 94:6922-6926, 1997.

Further studies establishing the function and utilities of F3 are found in John Hopkins OMIM database record ID 134390, and in cited publications listed in Table 5, which are hereby incorporated by reference. FAT3 (Accession XP_061871.5) is another GAM25 target gene, herein designated TARGET GENE. FAT3 BINDING SITE is a target binding site found in the 3' untranslated region of mRNA encoded by FAT3, corresponding to a target binding site such as BINDING SITE I, BINDING SITE II or BINDING SITE III of FIG. 8. Table 4 illustrates the complementarity of the nucleotide sequences of FAT3 BINDING SITE, designated SEQ ID:421, to the nucleotide sequence of GAM25 rNA, herein designated GAM RNA, also designated SEQ ID:206.

Another function of GAM25 is therefore inhibition of FAT3 (Accession XP_061871.5). Accordingly, utilities of GAM25 include diagnosis, prevention and treatment of diseases and clinical conditions associated with FAT3.

Fc fragment of iga, receptor for (FCAR, Accession NP_579803.1) is another GAM25 target gene, herein designated TARGET GENE. FCAR BINDING SITE1 and FCAR BINDING SITE2 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 and FCAR BINDING SITE2, designated SEQ ID:17765 and SEQ ID:17765 respectively, to the nucleotide sequence of GAM25 rNA, herein designated GAM RNA, also designated SEQ ID:206.

Another function of GAM25 is therefore inhibition of Fc fragment of iga, receptor for (FCAR, Accession NP_579803.1), a gene which binds to the fc region of immunoglobulins alpha and mediates several functions including cytokine production and therefore may be associated with Iga nephropathy. Accordingly, utilities of GAM25 include diagnosis, prevention and treatment of Iga nephropathy, and of other diseases and clinical conditions associated with FCAR.

The function of FCAR has been established by previous studies. Human Fc-alpha receptor (FCAR) is present on a number of cell types, including neutrophils, monocytes, macrophages, and eosinophils. FCAR interacts with aggregated IgAs, such as IgA coated on the surface of an invading microorganism, and mediates several immunologic defense processes such as phagocytosis, antibody-dependent cell-mediated cytotoxicity, and stimulation of the release of inflammatory mediators. FCAR is a glycoprotein of 50 to 100 kD, with diversity on different cell types. Narita et al. (2001) examined polymorphisms in the promoter and 5-prime untranslated region of the FCAR gene in 151 patients with IgA nephropathy and 163 patients with other glomerular diseases shown to have no mesangial IgA deposition by renal biopsy. Haplotype analysis showed tight linkage disequilibrium among the polymorphisms. No significant association for the genotype, allele, and haplotype frequencies of the polymorphisms were shown between the patients with histologically proven IgA nephropathy and those with other glomerular diseases. Thus, the analyzed polymorphisms did not appear to be primarily involved in susceptibility to IgA nephropathy.

Full details of the abovementioned studies are described in the following publications, the disclosure of which are hereby incorporated by reference:

Narita, I.; Goto, S.; Saito, N.; Sakatsume, M.; Jin, S.; Omori, K.; Gejy, F.: Genetic polymorphisms in the promoter and 5-prime UTR region of the Fc alpha receptor (CD89) are not associated with a risk of IgA nephropathy. J. Hum. Genet. 46:694-698, 2001; and Maliszewski, C. R.; March, C. J.; Schoenborn, M. A.; Gimpel, S.; Shen, L.: Expression cloning of a human Fc receptor for IgA. J. Exp. Med. 172:1665-1672, 1990.

Further studies establishing the function and utilities of FCAR are found in John Hopkins OMIM database record ID 147045, and in cited publications listed in Table 5, which are hereby incorporated by reference. Fc fragment of iga, receptor for (FCAR, Accession NP_579806.1) is another GAM25 target gene, herein designated TARGET GENE. FCAR BINDING SITE1 and FCAR BINDING SITE2 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 and FCAR BINDING SITE2, designated SEQ ID:17765 and SEQ ID:17765 respectively, to the nucleotide sequence of GAM25 rNA, herein designated GAM RNA, also designated SEQ ID:206.

Another function of GAM25 is therefore inhibition of Fc fragment of iga, receptor for (FCAR, Accession NP_579806.1), a gene which binds to the fc region of immunoglobulins alpha and mediates several functions including cytokine production and therefore may be associated with Iga nephropathy. Accordingly, utilities of GAM25 include diagnosis, prevention and treatment of Iga nephropathy, and of other diseases and clinical conditions associated with FCAR.

The function of FCAR has been established by previous studies. Human Fc-alpha receptor (FCAR) is present on a number of cell types, including neutrophils, monocytes, macrophages, and eosinophils. FCAR interacts with aggregated IgAs, such as IgA coated on the surface of an invading microorganism, and mediates several immunologic defense processes such as phagocytosis, antibody-dependent cell-mediated cytotoxicity, and stimulation of the release of inflammatory mediators. FCAR is a glycoprotein of 50 to 100 kD, with diversity on different cell types. Narita et al. (2001) examined polymorphisms in the promoter and 5-prime untranslated region of the FCAR gene in 151 patients with IgA nephropathy and 163 patients with other glomerular diseases shown to have no mesangial IgA deposition by renal biopsy. Haplotype analysis showed tight linkage disequilibrium among the polymorphisms. No significant association for the genotype, allele, and haplotype frequencies of the polymorphisms were shown between the patients with histologically proven IgA nephropathy and those with other glomerular diseases. Thus, the analyzed polymorphisms did not appear to be primarily involved in susceptibility to IgA nephropathy.

Full details of the abovementioned studies are described in the following publications, the disclosure of which are hereby incorporated by reference:

Narita, I.; Goto, S.; Saito, N.; Sakatsume, M.; Jin, S.; Omori, K.; Gejy, F.: Genetic polymorphisms in the promoter and 5-prime UTR region of the Fc alpha receptor (CD89) are not associated with a risk of IgA nephropathy. J. Hum. Genet. 46:694-698, 2001; and Maliszewski, C. R.; March, C. J.; Schoenborn, M. A.; Gimpel, S.; Shen, L.: Expression cloning of a human Fc receptor for IgA. J. Exp. Med. 172:1665-1672, 1990.

Further studies establishing the function and utilities of FCAR are found in John Hopkins OMIM database record ID 147045, and in cited publications listed in Table 5, which are hereby incorporated by reference. Fc fragment of iga, receptor for (FCAR, Accession NP_579811.1) is another GAM25 target gene, herein designated TARGET GENE. FCAR BINDING SITE1 and FCAR BINDING SITE2 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 and FCAR BINDING SITE2, designated SEQ ID:17765 and SEQ ID:17765 respectively, to the nucleotide sequence of GAM25 rNA, herein designated GAM RNA, also designated SEQ ID:206.

Another function of GAM25 is therefore inhibition of Fc fragment of iga, receptor for (FCAR, Accession NP_579811.1), a gene which binds to the fc region of immunoglobulins alpha and mediates several functions including cytokine production. and therefore may be associated with Iga nephropathy. Accordingly, utilities of GAM25 include diagnosis, prevention and treatment of Iga nephropathy, and of other diseases and clinical conditions associated with FCAR.

The function of FCAR has been established by previous studies. Human Fc-alpha receptor (FCAR) is present on a number of cell types, including neutrophils, monocytes, macrophages, and eosinophils. FCAR interacts with aggregated IgAs, such as IgA coated on the surface of an invading microorganism, and mediates several immunologic defense processes such as phagocytosis, antibody-dependent cell-mediated cytotoxicity, and stimulation of the release of inflammatory mediators. FCAR is a glycoprotein of 50 to 100 kD, with diversity on different cell types. Narita et al. (2001) examined polymorphisms in the promoter and 5-prime untranslated region of the FCAR gene in 151 patients with IgA nephropathy and 163 patients with other glomerular diseases shown to have no mesangial IgA deposition by renal biopsy. Haplotype analysis showed tight linkage disequilibrium among the polymorphisms. No significant association for the genotype, allele, and haplotype frequencies of the polymorphisms were shown between the patients with histologically proven IgA nephropathy and those with other glomerular diseases. Thus, the analyzed polymorphisms did not appear to be primarily involved in susceptibility to IgA nephropathy.

Full details of the abovementioned studies are described in the following publications, the disclosure of which are hereby incorporated by reference:

Narita, I.; Goto, S.; Saito, N.; Sakatsume, M.; Jin, S.; Omori, K.; Gejy, F.: Genetic polymorphisms in the promoter and 5-prime UTR region of the Fc alpha receptor (CD89) are not associated with a risk of IgA nephropathy. J. Hum. Genet. 46:694-698, 2001; and Maliszewski, C. R.; March, C. J.; Schoenborn, M. A.; Gimpel, S.; Shen, L.: Expression cloning of a human Fc receptor for IgA. J. Exp. Med. 172:1665-1672, 1990.

Further studies establishing the function and utilities of FCAR are found in John Hopkins OMIM database record ID 147045, and in cited publications listed in Table 5, which are hereby incorporated by reference. Fc fragment of iga, receptor for (FCAR, Accession NP_001991.1) is another GAM25 target gene, herein designated TARGET GENE. FCAR BINDING SITE1 and FCAR BINDING SITE2 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 and FCAR BINDING SITE2, designated SEQ ID:17765 and SEQ ID:19049 respectively, to the nucleotide sequence of GAM25 rNA, herein designated GAM RNA, also designated SEQ ID:206.

Another function of GAM25 is therefore inhibition of Fc fragment of iga, receptor for (FCAR, Accession NP_001991.1), a gene which binds to the fc region of immunoglobulins alpha and mediates several functions including cytokine production. and therefore may be associated with Iga nephropathy. Accordingly, utilities of GAM25 include diagnosis, prevention and treatment of Iga nephropathy, and of other diseases and clinical conditions associated with FCAR.

The function of FCAR has been established by previous studies. Human Fc-alpha receptor (FCAR) is present on a number of cell types, including neutrophils, monocytes, macrophages, and eosinophils. FCAR interacts with aggregated IgAs, such as IgA coated on the surface of an invading microorganism, and mediates several immunologic defense processes such as phagocytosis, antibody-dependent cell-mediated cytotoxicity, and stimulation of the release of inflammatory mediators. FCAR is a glycoprotein of 50 to 100 kD, with diversity on different cell types. Narita et al. (2001) examined polymorphisms in the promoter and 5-prime untranslated region of the FCAR gene in 151 patients with IgA nephropathy and 163 patients with other glomerular diseases shown to have no mesangial IgA deposition by renal biopsy. Haplotype analysis showed tight linkage disequilibrium among the polymorphisms. No significant association for the genotype, allele, and haplotype frequencies of the polymorphisms were shown between the patients with histologically proven IgA nephropathy and those with other glomerular diseases. Thus, the analyzed polymorphisms did not appear to be primarily involved in susceptibility to IgA nephropathy.

Full details of the abovementioned studies are described in the following publications, the disclosure of which are hereby incorporated by reference:

Narita, I.; Goto, S.; Saito, N.; Sakatsume, M.; Jin, S.; Omori, K.; Gejy, F.: Genetic polymorphisms in the promoter and 5-prime UTR region of the Fc alpha receptor (CD89) are not associated with a risk of IgA nephropathy. J. Hum. Genet. 46:694-698, 2001; and Maliszewski, C. R.; March, C. J.; Schoenborn, M. A.; Gimpel, S.; Shen, L.: Expression cloning of a human Fc receptor for IgA. J. Exp. Med. 172:1665-1672, 1990.

Further studies establishing the function and utilities of FCAR are found in John Hopkins OMIM database record ID 147045, and in cited publications listed in Table 5, which are hereby incorporated by reference. Fc fragment of iga, receptor for (FCAR, Accession NP_579808.1) is another GAM25 target gene, herein designated TARGET GENE. FCAR BINDING SITE1 and FCAR BINDING SITE2 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 and FCAR BINDING SITE2, designated SEQ ID:17765 and SEQ ID:17141 respectively, to the nucleotide sequence of GAM25 rNA, herein designated GAM RNA, also designated SEQ ID:206.

Another function of GAM25 is therefore inhibition of Fc fragment of iga, receptor for (FCAR, Accession NP_579808.1), a gene which binds to the fc region of immunoglobulins alpha and mediates several functions including cytokine production, and therefore may be associated with Iga nephropathy. Accordingly, utilities of GAM25 include diagnosis, prevention and treatment of Iga nephropathy, and of other diseases and clinical conditions associated with FCAR.

The function of FCAR has been established by previous studies. Human Fc-alpha receptor (FCAR) is present on a number of cell types, including neutrophils, monocytes, macrophages, and eosinophils. FCAR interacts with aggregated IgAs, such as IgA coated on the surface of an invading microorganism, and mediates several immunologic defense processes such as phagocytosis, antibody-dependent cell-mediated cytotoxicity, and stimulation of the release of inflammatory mediators. FCAR is a glycoprotein of 50 to 100 kD, with diversity on different cell types. Narita et al. (2001) examined polymorphisms in the promoter and 5-prime untranslated region of the FCAR gene in 151 patients with IgA nephropathy and 163 patients with other glomerular diseases shown to have no mesangial IgA deposition by renal biopsy. Haplotype analysis showed tight linkage disequilibrium among the polymorphisms. No significant association for the genotype, allele, and haplotype frequencies of the polymorphisms were shown between the patients with histologically proven IgA nephropathy and those with other glomerular diseases. Thus, the analyzed polymorphisms did not appear to be primarily involved in susceptibility to IgA nephropathy.

Full details of the abovementioned studies are described in the following publications, the disclosure of which are hereby incorporated by reference:

Narita, I.; Goto, S.; Saito, N.; Sakatsume, M.; Jin, S.; Omori, K.; Gejy, F.: Genetic polymorphisms in the promoter and 5-prime UTR region of the Fc alpha receptor (CD89) are not associated with a risk of IgA nephropathy. J. Hum. Genet. 46:694-698, 2001; and Maliszewski, C. R.; March, C. J.; Schoenborn, M. A.; Gimpel, S.; Shen, L.: Expression cloning of a human Fc receptor for IgA. J. Exp. Med. 172:1665-1672, 1990.

Further studies establishing the function and utilities of FCAR are found in John Hopkins OMIM database record ID 147045, and in cited publications listed in Table 5, which are hereby incorporated by reference. Fer-1-like 4 (c. elegans) (FER1L4, Accession XP_300246.1) is another GAM25 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:4561, to the nucleotide sequence of GAM25 rNA, herein designated GAM RNA, also designated SEQ ID:206.

Another function of GAM25 is therefore inhibition of Fer-1-like 4 (c. elegans) (FER1L4, Accession XP_300246.1). Accordingly, utilities of GAM25 include diagnosis, prevention and treatment of diseases and clinical conditions associated with FER1L4.

Fer-1-like 4 (c. elegans) (FER1L4, Accession XP_300246.1) is another GAM25 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:4561, to the nucleotide sequence of GAM25 RNA, herein designated GAM RNA, also designated SEQ ID:206.

Another function of GAM25 is therefore inhibition of Fer-1-like 4 (c. elegans) (FER1L4, Accession XP_300246.1). Accordingly, utilities of GAM25 include diagnosis, prevention and treatment of diseases and clinical conditions associated with FER1L4.

FLJ10232 (Accession NP_060503.1) is another GAM25 target gene, herein designated TARGET GENE. FLJ10232 BINDING SITE is a target binding site found in the 3' untranslated region of mRNA encoded by FLJ10232, corresponding to a target binding site such as BINDING SITE I, BINDING SITE II or BINDING SITE III of FIG. 8. Table 4 illustrates the complementarity of the nucleotide sequences of FLJ10232 BINDING SITE, designated SEQ ID:7686, to the nucleotide sequence of GAM25 rNA, herein designated GAM RNA, also designated SEQ ID:206.

Another function of GAM25 is therefore inhibition of FLJ10232 (Accession NP_060503.1). Accordingly, utilities of GAM25 include diagnosis, prevention and treatment of diseases and clinical conditions associated with FLJ10232.

FLJ10298 (Accession NP_060520.2) is another GAM25 target gene, herein designated TARGET GENE. FLJ10298 BINDING SITE is a target binding site found in the 3' untranslated region of mRNA encoded by FLJ10298, corresponding to a target binding site such as BINDING SITE I, BINDING SITE II or BINDING SITE III of FIG. 8. Table 4 illustrates the complementarity of the nucleotide sequences of FLJ10298 BINDING SITE, designated SEQ ID:6660, to the nucleotide sequence of GAM25 rNA, herein designated GAM RNA, also designated SEQ ID:206.

Another function of GAM25 is therefore inhibition of FLJ10298 (Accession NP_060520.2). Accordingly, utilities of GAM25 include diagnosis, prevention and treatment of diseases and clinical conditions associated with FLJ10298.

FLJ10520 (Accession NP_060594.2) is another GAM25 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:18266, to the nucleotide sequence of GAM25 rNA, herein designated GAM RNA, also designated SEQ ID:206.

Another function of GAM25 is therefore inhibition of FLJ10520 (Accession NP_060594.2). Accordingly, utilities of GAM25 include diagnosis, prevention and treatment of diseases and clinical conditions associated with FLJ10520.

FLJ10713 (Accession NP_060659.1) is another GAM25 target gene, herein designated TARGET GENE. FLJ10713 BINDING SITE is a target binding site found in the 3' untranslated region of mRNA encoded by FLJ10713, corresponding to a target binding site such as BINDING SITE I, BINDING SITE II or BINDING SITE III of FIG. 8. Table 4 illustrates the complementarity of the nucleotide sequences of FLJ10713 BINDING SITE, designated SEQ ID:6272, to the nucleotide sequence of GAM25 rNA, herein designated GAM RNA, also designated SEQ ID:206.

Another function of GAM25 is therefore inhibition of FLJ10713 (Accession NP_060659.1). Accordingly, utilities of GAM25 include diagnosis, prevention and treatment of diseases and clinical conditions associated with FLJ10713.

FLJ10847 (Accession NP_060712.2) is another GAM25 target gene, herein designated TARGET GENE. FLJ10847 BINDING SITE is a target binding site found in the 3' untranslated region of mRNA encoded by FLJ10847, corresponding to a target binding site such as BINDING SITE I, BINDING SITE II or BINDING SITE III of FIG. 8. Table 4 illustrates the complementarity of the nucleotide sequences of FLJ10847 BINDING SITE, designated SEQ ID:14648, to the nucleotide sequence of GAM25 rNA, herein designated GAM RNA, also designated SEQ ID:206.

Another function of GAM25 is therefore inhibition of FLJ10847 (Accession NP_060712.2). Accordingly, utilities of GAM25 include diagnosis, prevention and treatment of diseases and clinical conditions associated with FLJ10847.

FLJ10871 (Accession NP_060720.1) is another GAM25 target gene, herein designated TARGET GENE. FLJ10871 BINDING SITE is a target binding site found in the 5' untranslated region of mRNA encoded by FLJ10871, corresponding to a target binding site such as BINDING SITE I, BINDING SITE II or BINDING SITE III of FIG. 8. Table 4 illustrates the complementarity of the nucleotide sequences of FLJ10871 BINDING SITE, designated SEQ ID:12436, to the nucleotide sequence of GAM25 rNA, herein designated GAM RNA, also designated SEQ ID:206.

Another function of GAM25 is therefore inhibition of FLJ10871 (Accession NP_060720.1). Accordingly, utilities of GAM25 include diagnosis, prevention and treatment of diseases and clinical conditions associated with FLJ10871.

FLJ10922 (Accession NP_060743.1) is another GAM25 target gene, herein designated TARGET GENE. FLJ10922 BINDING SITE is a target binding site found in the 3' untranslated region of mRNA encoded by FLJ10922, corresponding to a target binding site such as BINDING SITE I, BINDING SITE II or BINDING SITE III of FIG. 8. Table 4 illustrates the complementarity of the nucleotide sequences of FLJ10922 BINDING SITE, designated SEQ ID:14510, to the nucleotide sequence of GAM25 rNA, herein designated GAM RNA, also designated SEQ ID:206.

Another function of GAM25 is therefore inhibition of FLJ10922 (Accession NP_060743.1). Accordingly, utilities of GAM25 include diagnosis, prevention and treatment of diseases and clinical conditions associated with FLJ10922.

FLJ10936 (Accession NP_060749.2) is another GAM25 target gene, herein designated TARGET GENE. FLJ10936 BINDING SITE is a target binding site found in the 3' untranslated region of mRNA encoded by FLJ10936, corresponding to a target binding site such as BINDING SITE I, BINDING SITE II or BINDING SITE III of FIG. 8. Table 4 illustrates the complementarity of the nucleotide sequences of FLJ10936 BINDING SITE, designated SEQ ID:2724, to the nucleotide sequence of GAM25 rNA, herein designated GAM RNA, also designated SEQ ID:206.

Another function of GAM25 is therefore inhibition of FLJ10936 (Accession NP_060749.2). Accordingly, utilities of GAM25 include diagnosis, prevention and treatment of diseases and clinical conditions associated with FLJ10936.

FLJ11193 (Accession NP_060826.1) is another GAM25 target gene, herein designated TARGET GENE. FLJ11193 BINDING SITE is a target binding site found in the 3' untranslated region of mRNA encoded by FLJ11193, corresponding to a target binding site such as BINDING SITE I, BINDING SITE II or BINDING SITE III of FIG. 8. Table 4 illustrates the complementarity of the nucleotide sequences of FLJ11193 BINDING SITE, designated SEQ ID:17071, to the nucleotide sequence of GAM25 rNA, herein designated GAM RNA, also designated SEQ ID:206.

Another function of GAM25 is therefore inhibition of FLJ11193 (Accession NP_060826.1). Accordingly, utilities of GAM25 include diagnosis, prevention and treatment of diseases and clinical conditions associated with FLJ11193.

FLJ11710 (Accession NP_079122.1) is another GAM25 target gene, herein designated TARGET GENE. FLJ11710 BINDING SITE is a target binding site found in the 3' untranslated region of mRNA encoded by FLJ11710, corresponding to a target binding site such as BINDING SITE I, BINDING SITE II or BINDING SITE III of FIG. 8. Table 4 illustrates the complementarity of the nucleotide sequences of FLJ11710 BINDING SITE, designated SEQ ID:6789, to the nucleotide sequence of GAM25 rNA, herein designated GAM RNA, also designated SEQ ID:206.

Another function of GAM25 is therefore inhibition of FLJ11710 (Accession NP_079122.1). Accordingly, utilities of GAM25 include diagnosis, prevention and treatment of diseases and clinical conditions associated with FLJ11710.

FLJ11800 (Accession NP_079250.1) is another GAM25 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:11881, to the nucleotide sequence of GAM25 rNA, herein designated GAM RNA, also designated SEQ ID:206.

Another function of GAM25 is therefore inhibition of FLJ11800 (Accession NP_079250.1). Accordingly, utilities of GAM25 include diagnosis, prevention and treatment of diseases and clinical conditions associated with FLJ11800.

FLJ12687 (Accession NP_079193.2) is another GAM25 target gene, herein designated TARGET GENE. FLJ12687 BINDING SITE is a target binding site found in the 3' untranslated region of mRNA encoded by FLJ12687, corresponding to a target binding site such as BINDING SITE I, BINDING SITE II or BINDING SITE III of FIG. 8. Table 4 illustrates the complementarity of the nucleotide sequences of FLJ12687 BINDING SITE, designated SEQ ID:7950, to the nucleotide sequence of GAM25 rNA, herein designated GAM RNA, also designated SEQ ID:206.

Another function of GAM25 is therefore inhibition of FLJ12687 (Accession NP_079193.2). Accordingly, utilities of GAM25 include diagnosis, prevention and treatment of diseases and clinical conditions associated with FLJ12687.

FLJ12903 (Accession NP_073590.1) is another GAM25 target gene, herein designated TARGET GENE. FLJ12903 BINDING SITE is a target binding site found in the 3' untranslated region of mRNA encoded by FLJ12903, corresponding to a target binding site such as BINDING SITE I, BINDING SITE II or BINDING SITE III of FIG. 8. Table 4 illustrates the complementarity of the nucleotide sequences of FLJ12903 BINDING SITE, designated SEQ ID:5568, to the nucleotide sequence of GAM25 rNA, herein designated GAM RNA, also designated SEQ ID:206.

Another function of GAM25 is therefore inhibition of FLJ12903 (Accession NP_073590.1). Accordingly, utilities of GAM25 include diagnosis, prevention and treatment of diseases and clinical conditions associated with FLJ12903.

FLJ12973 (Accession NP_079184.1) is another GAM25 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:5363, to the nucleotide sequence of GAM25 rNA, herein designated GAM RNA, also designated SEQ ID:206.

Another function of GAM25 is therefore inhibition of FLJ12973 (Accession NP_079184.1). Accordingly, utilities of GAM25 include diagnosis, prevention and treatment of diseases and clinical conditions associated with FLJ12973.

FLJ12975 (Accession NP_079085.2) is another GAM25 target gene, herein designated TARGET GENE. FLJ12975 BINDING SITE is a target binding site found in the 3' untranslated region of mRNA encoded by FLJ12975, corresponding to a target binding site such as BINDING SITE I, BINDING SITE II or BINDING SITE III of FIG. 8. Table 4 illustrates the complementarity of the nucleotide sequences of FLJ12975 BINDING SITE, designated SEQ ID:1128, to the nucleotide sequence of GAM25 rNA, herein designated GAM RNA, also designated SEQ ID:206.

Another function of GAM25 is therefore inhibition of FLJ12975 (Accession NP_079085.2). Accordingly, utilities of GAM25 include diagnosis, prevention and treatment of diseases and clinical conditions associated with FLJ12975.

FLJ13114 (Accession NP_078817.1) is another GAM25 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:19143, to the nucleotide sequence of GAM25 rNA, herein designated GAM RNA, also designated SEQ ID:206.

Another function of GAM25 is therefore inhibition of FLJ13114 (Accession NP_078817.1). Accordingly, utilities of GAM25 include diagnosis, prevention and treatment of diseases and clinical conditions associated with FLJ13114.

FLJ13188 (Accession NP_071346.1) is another GAM25 target gene, herein designated TARGET GENE. FLJ13188 BINDING SITE is a target binding site found in the 3' untranslated region of mRNA encoded by FLJ13188, corresponding to a target binding site such as BINDING SITE I, BINDING SITE II or BINDING SITE III of FIG. 8. Table 4 illustrates the complementarity of the nucleotide sequences of FLJ13188 BINDING SITE, designated SEQ ID:8655, to the nucleotide sequence of GAM25 rNA, herein designated GAM RNA, also designated SEQ ID:206.

Another function of GAM25 is therefore inhibition of FLJ13188 (Accession NP_071346.1). Accordingly, utilities of GAM25 include diagnosis, prevention and treatment of diseases and clinical conditions associated with FLJ13188.

FLJ14106 (Accession NP_079343.1) is another GAM25 target gene, herein designated TARGET GENE. FLJ14106 BINDING SITE is a target binding site found in the 3' untranslated region of mRNA encoded by FLJ14106, corresponding to a target binding site such as BINDING SITE I, BINDING SITE II or BINDING SITE III of FIG. 8. Table 4 illustrates the complementarity of the nucleotide sequences of FLJ14106 BINDING SITE, designated SEQ ID:2043, to the nucleotide sequence of GAM25 rNA, herein designated GAM RNA, also designated SEQ ID:206.

Another function of GAM25 is therefore inhibition of FLJ14106 (Accession NP_079343.1). Accordingly, utilities of GAM25 include diagnosis, prevention and treatment of diseases and clinical conditions associated with FLJ14106.

FLJ14442 (Accession NP_116174.1) is another GAM25 target gene, herein designated TARGET GENE. FLJ14442 BINDING SITE is a target binding site found in the 3' untranslated region of mRNA encoded by FLJ14442, corresponding to a target binding site such as BINDING SITE I, BINDING SITE II or BINDING SITE III of FIG. 8. Table 4 illustrates the complementarity of the nucleotide sequences of FLJ14442 BINDING SITE, designated SEQ ID:12170, to the nucleotide sequence of GAM25 rNA, herein designated GAM RNA, also designated SEQ ID:206.

Another function of GAM25 is therefore inhibition of FLJ14442 (Accession NP_116174.1). Accordingly, utilities of GAM25 include diagnosis, prevention and treatment of diseases and clinical conditions associated with FLJ14442.

FLJ20045 (Accession NP_060108.1) is another GAM25 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:3234, to the nucleotide sequence of GAM25 rNA, herein designated GAM RNA, also designated SEQ ID:206.

Another function of GAM25 is therefore inhibition of FLJ20045 (Accession NP_060108.1). Accordingly, utilities of GAM25 include diagnosis, prevention and treatment of diseases and clinical conditions associated with FLJ20045.

FLJ20245 (Accession NP_060193.1) is another GAM25 target gene, herein designated TARGET GENE. FLJ20245 BINDING SITE is a target binding site found in the 3' untranslated region of mRNA encoded by FLJ20245, corresponding to a target binding site such as BINDING SITE I, BINDING SITE II or BINDING SITE III of FIG. 8. Table 4 illustrates the complementarity of the nucleotide sequences of FLJ20245 BINDING SITE, designated SEQ ID:4882, to the nucleotide sequence of GAM25 rNA, herein designated GAM RNA, also designated SEQ ID:206.

Another function of GAM25 is therefore inhibition of FLJ20245 (Accession NP_060193.1). Accordingly, utilities of GAM25 include diagnosis, prevention and treatment of diseases and clinical conditions associated with FLJ20245.

FLJ20344 (Accession NP_060246.1) is another GAM25 target gene, herein designated TARGET GENE. FLJ20344 BINDING SITE is a target binding site found in the 3' untranslated region of mRNA encoded by FLJ20344, corresponding to a target binding site such as BINDING SITE I, BINDING SITE II or BINDING SITE III of FIG. 8. Table 4 illustrates the complementarity of the nucleotide sequences of FLJ20344 BINDING SITE, designated SEQ ID:6297, to the nucleotide sequence of GAM25 rNA, herein designated GAM RNA, also designated SEQ ID:206.

Another function of GAM25 is therefore inhibition of FLJ20344 (Accession NP_060246.1). Accordingly, utilities of GAM25 include diagnosis, prevention and treatment of diseases and clinical conditions associated with FLJ20344.

FLJ20507 (Accession NP_060319.1) is another GAM25 target gene, herein designated TARGET GENE. FLJ20507 BINDING SITE is a target binding site found in the 3' untranslated region of mRNA encoded by FLJ20507, corresponding to a target binding site such as BINDING SITE I, BINDING SITE II or BINDING SITE III of FIG. 8. Table 4 illustrates the complementarity of the nucleotide sequences of FLJ20507 BINDING SITE, designated SEQ ID:14232, to the nucleotide sequence of GAM25 rNA, herein designated GAM RNA, also designated SEQ ID:206.

Another function of GAM25 is therefore inhibition of FLJ20507 (Accession NP_060319.1). Accordingly, utilities of GAM25 include diagnosis, prevention and treatment of diseases and clinical conditions associated with FLJ20507.

FLJ20671 (Accession NP_060394.1) is another GAM25 target gene, herein designated TARGET GENE. FLJ20671 BINDING SITE is a target binding site found in the 3' untranslated region of mRNA encoded by FLJ20671, corresponding to a target binding site such as BINDING SITE I, BINDING SITE II or BINDING SITE III of FIG. 8. Table 4 illustrates the complementarity of the nucleotide sequences of FLJ20671 BINDING SITE, designated SEQ ID:9310, to the nucleotide sequence of GAM25 rNA, herein designated GAM RNA, also designated SEQ ID:206.

Another function of GAM25 is therefore inhibition of FLJ20671 (Accession NP_060394.1). Accordingly, utilities of GAM25 include diagnosis, prevention and treatment of diseases and clinical conditions associated with FLJ20671.

FLJ21302 (Accession NP_075052.1) is another GAM25 target gene, herein designated TARGET GENE. FLJ21302 BINDING SITE is a target binding site found in the 3' untranslated region of mRNA encoded by FLJ21302, corresponding to a target binding site such as BINDING SITE I, BINDING SITE II or BINDING SITE III of FIG. 8. Table 4 illustrates the complementarity of the nucleotide sequences of FLJ21302 BINDING SITE, designated SEQ ID:11560, to the nucleotide sequence of GAM25 rNA, herein designated GAM RNA, also designated SEQ ID:206.

Another function of GAM25 is therefore inhibition of FLJ21302 (Accession NP_075052.1). Accordingly, utilities of GAM25 include diagnosis, prevention and treatment of diseases and clinical conditions associated with FLJ21302.

FLJ22529 (Accession NP_079065.1) is another GAM25 target gene, herein designated TARGET GENE. FLJ22529 BINDING SITE is a target binding site found in the 3' untranslated region of mRNA encoded by FLJ22529, corresponding to a target binding site such as BINDING SITE I, BINDING SITE II or BINDING SITE III of FIG. 8. Table 4 illustrates the complementarity of the nucleotide sequences of FLJ22529 BINDING SITE, designated SEQ ID:7859, to the nucleotide sequence of GAM25 rNA, herein designated GAM RNA, also designated SEQ ID:206.

Another function of GAM25 is therefore inhibition of FLJ22529 (Accession NP_079065.1). Accordingly, utilities of GAM25 include diagnosis, prevention and treatment of diseases and clinical conditions associated with FLJ22529.

FLJ22531 (Accession NP_078926.2) is another GAM25 target gene, herein designated TARGET GENE. FLJ22531 BINDING SITE is a target binding site found in the 5' untranslated region of mRNA encoded by FLJ22531, corresponding to a target binding site such as BINDING SITE I, BINDING SITE II or BINDING SITE III of FIG. 8. Table 4 illustrates the complementarity of the nucleotide sequences of FLJ22531 BINDING SITE, designated SEQ ID:1207, to the nucleotide sequence of GAM25 rNA, herein designated GAM RNA, also designated SEQ ID:206.

Another function of GAM25 is therefore inhibition of FLJ22531 (Accession NP_078926.2). Accordingly, utilities of GAM25 include diagnosis, prevention and treatment of diseases and clinical conditions associated with FLJ22531.

FLJ22794 (Accession NP_071357.1) is another GAM25 target gene, herein designated TARGET GENE. FLJ22794 BINDING SITE is a target binding site found in the 3' untranslated region of mRNA encoded by FLJ22794, corresponding to a target binding site such as BINDING SITE I, BINDING SITE II or BINDING SITE III of FIG. 8. Table 4 illustrates the complementarity of the nucleotide sequences of FLJ22794 BINDING SITE, designated SEQ ID:15478, to the nucleotide sequence of GAM25 rNA, herein designated GAM RNA, also designated SEQ ID:206.

Another function of GAM25 is therefore inhibition of FLJ22794 (Accession NP_071357.1). Accordingly, utilities of GAM25 include diagnosis, prevention and treatment of diseases and clinical conditions associated with FLJ22794.

FLJ23024 (Accession NP_079212.1) is another GAM25 target gene, herein designated TARGET GENE. FLJ23024 BINDING SITE is a target binding site found in the 3' untranslated region of mRNA encoded by FLJ23024, corresponding to a target binding site such as BINDING SITE I, BINDING SITE II or BINDING SITE III of FIG. 8. Table 4 illustrates the complementarity of the nucleotide sequences of FLJ23024 BINDING SITE, designated SEQ ID:12540, to the nucleotide sequence of GAM25 rNA, herein designated GAM RNA, also designated SEQ ID:206.

Another function of GAM25 is therefore inhibition of FLJ23024 (Accession NP_079212.1). Accordingly, utilities of GAM25 include diagnosis, prevention and treatment of diseases and clinical conditions associated with FLJ23024.

FLJ23040 (Accession NP_079450.1) is another GAM25 target gene, herein designated TARGET GENE. FLJ23040 BINDING SITE is a target binding site found in the 3' untranslated region of mRNA encoded by FLJ23040, corresponding to a target binding site such as BINDING SITE I, BINDING SITE II or BINDING SITE III of FIG. 8. Table 4 illustrates the complementarity of the nucleotide sequences of FLJ23040 BINDING SITE, designated SEQ ID:18555, to the nucleotide sequence of GAM25 rNA, herein designated GAM RNA, also designated SEQ ID:206.

Another function of GAM25 is therefore inhibition of FLJ23040 (Accession NP_079450.1). Accordingly, utilities of GAM25 include diagnosis, prevention and treatment of diseases and clinical conditions associated with FLJ23040.

FLJ23556 (Accession NP_079156.1) is another GAM25 target gene, herein designated TARGET GENE. FLJ23556 BINDING SITE is a target binding site found in the 3' untranslated region of mRNA encoded by FLJ23556, corresponding to a target binding site such as BINDING SITE I, BINDING SITE II or BINDING SITE III of FIG. 8. Table 4 illustrates the complementarity of the nucleotide sequences of FLJ23556 BINDING SITE, designated SEQ ID:4537, to the nucleotide sequence of GAM25 rNA, herein designated GAM RNA, also designated SEQ ID:206.

Another function of GAM25 is therefore inhibition of FLJ23556 (Accession NP_079156.1). Accordingly, utilities of GAM25 include diagnosis, prevention and treatment of diseases and clinical conditions associated with FLJ23556.

FLJ30507 (Accession NP_694555.1) is another GAM25 target gene, herein designated TARGET GENE. FLJ30507 BINDING SITE is a target binding site found in the 5' untranslated region of mRNA encoded by FLJ30507, corresponding to a target binding site such as BINDING SITE I, BINDING SITE II or BINDING SITE III of FIG. 8. Table 4 illustrates the complementarity of the nucleotide sequences of FLJ30507 BINDING SITE, designated SEQ ID:9488, to the nucleotide sequence of GAM25 rNA, herein designated GAM RNA, also designated SEQ ID:206.

Another function of GAM25 is therefore inhibition of FLJ30507 (Accession NP_694555.1). Accordingly, utilities of GAM25 include diagnosis, prevention and treatment of diseases and clinical conditions associated with FLJ30507.

FLJ30532 (Accession NP_653325.1) is another GAM25 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:5994, to the nucleotide sequence of GAM25 rNA, herein designated GAM RNA, also designated SEQ ID:206.

Another function of GAM25 is therefore inhibition of FLJ30532 (Accession NP_653325.1). Accordingly, utilities of GAM25 include diagnosis, prevention and treatment of diseases and clinical conditions associated with FLJ30532.

FLJ31139 (Accession NP_775928.1) is another GAM25 target gene, herein designated TARGET GENE. FLJ31139 BINDING SITE is a target binding site found in the 3' untranslated region of mRNA encoded by FLJ31139, corresponding to a target binding site such as BINDING SITE I, BINDING SITE II or BINDING SITE III of FIG. 8. Table 4 illustrates the complementarity of the nucleotide sequences of FLJ31139 BINDING SITE, designated SEQ ID:6914, to the nucleotide sequence of GAM25 rNA, herein designated GAM RNA, also designated SEQ ID:206.

Another function of GAM25 is therefore inhibition of FLJ31139 (Accession NP_775928.1). Accordingly, utilities of GAM25 include diagnosis, prevention and treatment of diseases and clinical conditions associated with FLJ31139.

FLJ31166 (Accession NP_694567.1) is another GAM25 target gene, herein designated TARGET GENE. FLJ31166 BINDING SITE is a target binding site found in the 3' untranslated region of mRNA encoded by FLJ31166, corresponding to a target binding site such as BINDING SITE I, BINDING SITE II or BINDING SITE III of FIG. 8. Table 4 illustrates the complementarity of the nucleotide sequences of FLJ31166 BINDING SITE, designated SEQ ID:13479, to the nucleotide sequence of GAM25 rNA, herein designated GAM RNA, also designated SEQ ID:206.

Another function of GAM25 is therefore inhibition of FLJ31166 (Accession NP_694567.1). Accordingly, utilities of GAM25 include diagnosis, prevention and treatment of diseases and clinical conditions associated with FLJ31166.

FLJ31384 (Accession NP_689685.1) is another GAM25 target gene, herein designated TARGET GENE. FLJ31384 BINDING SITE is a target binding site found in the 3' untranslated region of mRNA encoded by FLJ31384, corresponding to a target binding site such as BINDING SITE I, BINDING SITE II or BINDING SITE III of FIG. 8. Table 4 illustrates the complementarity of the nucleotide sequences of FLJ31384 BINDING SITE, designated SEQ ID:13568, to the nucleotide sequence of GAM25 rNA, herein designated GAM RNA, also designated SEQ ID:206.

Another function of GAM25 is therefore inhibition of FLJ31384 (Accession NP_689685.1). Accordingly, utilities of GAM25 include diagnosis, prevention and treatment of diseases and clinical conditions associated with FLJ31384.

FLJ32096 (Accession NP_776156.1) is another GAM25 target gene, herein designated TARGET GENE. FLJ32096 BINDING SITE1 and FLJ32096 BINDING SITE2 are target binding sites found in untranslated regions of mRNA encoded by FLJ32096, corresponding to target binding sites such as BINDING SITE I, BINDING SITE II or BINDING SITE III of FIG. 8. Table 4 illustrates the complementarity of the nucleotide sequences of FLJ32096 BINDING SITE1 and FLJ32096 BINDING SITE2, designated SEQ ID:4882 and SEQ ID:5363 respectively, to the nucleotide sequence of GAM25 rNA, herein designated GAM RNA, also designated SEQ ID:206.

Another function of GAM25 is therefore inhibition of FLJ32096 (Accession NP_776156.1). Accordingly, utilities of GAM25 include diagnosis, prevention and treatment of diseases and clinical conditions associated with FLJ32096.

FLJ32130 (Accession NP_689671.2) is another GAM25 target gene, herein designated TARGET GENE. FLJ32130 BINDING SITE is a target binding site found in the 3' untranslated region of mRNA encoded by FLJ32130, corresponding to a target binding site such as BINDING SITE I, BINDING SITE II or BINDING SITE III of FIG. 8. Table 4 illustrates the complementarity of the nucleotide sequences of FLJ32130 BINDING SITE, designated SEQ ID:19156, to the nucleotide sequence of GAM25 rNA, herein designated GAM RNA, also designated SEQ ID:206.

Another function of GAM25 is therefore inhibition of FLJ32130 (Accession NP_689671.2). Accordingly, utilities of GAM25 include diagnosis, prevention and treatment of diseases and clinical conditions associated with FLJ32130.

FLJ33655 (Accession NP_775912.1) is another GAM25 target gene, herein designated TARGET GENE. FLJ33655 BINDING SITE is a target binding site found in the 3' untranslated region of mRNA encoded by FLJ33655, corresponding to a target binding site such as BINDING SITE I, BINDING SITE II or BINDING SITE III of FIG. 8. Table 4 illustrates the complementarity of the nucleotide sequences of FLJ33655 BINDING SITE, designated SEQ ID:17105, to the nucleotide sequence of GAM25 rNA, herein designated GAM RNA, also designated SEQ ID:206.

Another function of GAM25 is therefore inhibition of FLJ33655 (Accession NP_775912.1). Accordingly, utilities of GAM25 include diagnosis, prevention and treatment of diseases and clinical conditions associated with FLJ33655.

FLJ33814 (Accession NP_775781.1) is another GAM25 target gene, herein designated TARGET GENE. FLJ33814

BINDING SITE is a target binding site found in the 3' untranslated region of mRNA encoded by FLJ33814, corresponding to a target binding site such as BINDING SITE I, BINDING SITE II or BINDING SITE III of FIG. 8. Table 4 illustrates the complementarity of the nucleotide sequences of FLJ33814 BINDING SITE, designated SEQ ID:17298, to the nucleotide sequence of GAM25 rNA, herein designated GAM RNA, also designated SEQ ID:206.

Another function of GAM25 is therefore inhibition of FLJ33814 (Accession NP_775781.1). Accordingly, utilities of GAM25 include diagnosis, prevention and treatment of diseases and clinical conditions associated with FLJ33814.

FLJ34817 (Accession NP_689516.1) is another GAM25 target gene, herein designated TARGET GENE. FLJ34817 BINDING SITE is a target binding site found in the 3' untranslated region of mRNA encoded by FLJ34817, corresponding to a target binding site such as BINDING SITE I, BINDING SITE II or BINDING SITE III of FIG. 8. Table 4 illustrates the complementarity of the nucleotide sequences of FLJ34817 BINDING SITE, designated SEQ ID:4161, to the nucleotide sequence of GAM25 rNA, herein designated GAM RNA, also designated SEQ ID:206.

Another function of GAM25 is therefore inhibition of FLJ34817 (Accession NP_689516.1). Accordingly, utilities of GAM25 include diagnosis, prevention and treatment of diseases and clinical conditions associated with FLJ34817.

FLJ35487 (Accession NP_776181.1) is another GAM25 target gene, herein designated TARGET GENE. FLJ35487 BINDING SITE is a target binding site found in the 3' untranslated region of mRNA encoded by FLJ35487, corresponding to a target binding site such as BINDING SITE I, BINDING SITE II or BINDING SITE III of FIG. 8. Table 4 illustrates the complementarity of the nucleotide sequences of FLJ35487 BINDING SITE, designated SEQ ID:19925, to the nucleotide sequence of GAM25 rNA, herein designated GAM RNA, also designated SEQ ID:206.

Another function of GAM25 is therefore inhibition of FLJ35487 (Accession NP_776181.1). Accordingly, utilities of GAM25 include diagnosis, prevention and treatment of diseases and clinical conditions associated with FLJ35487.

FLJ35721 (Accession NP_775955.1) is another GAM25 target gene, herein designated TARGET GENE. FLJ35721 BINDING SITE is a target binding site found in the 3' untranslated region of mRNA encoded by FLJ35721, corresponding to a target binding site such as BINDING SITE I, BINDING SITE II or BINDING SITE III of FIG. 8. Table 4 illustrates the complementarity of the nucleotide sequences of FLJ35721 BINDING SITE, designated SEQ ID:16439, to the nucleotide sequence of GAM25 rNA, herein designated GAM RNA, also designated SEQ ID:206.

Another function of GAM25 is therefore inhibition of FLJ35721 (Accession NP_775955.1). Accordingly, utilities of GAM25 include diagnosis, prevention and treatment of diseases and clinical conditions associated with FLJ35721.

FLJ37045 (Accession NP_787085.1) is another GAM25 target gene, herein designated TARGET GENE. FLJ37045 BINDING SITE is a target binding site found in the 3' untranslated region of mRNA encoded by FLJ37045, corresponding to a target binding site such as BINDING SITE I, BINDING SITE II or BINDING SITE III of FIG. 8. Table 4 illustrates the complementarity of the nucleotide sequences of FLJ37045 BINDING SITE, designated SEQ ID:14054, to the nucleotide sequence of GAM25 rNA, herein designated GAM RNA, also designated SEQ ID:206.

Another function of GAM25 is therefore inhibition of FLJ37045 (Accession NP_787085.1). Accordingly, utilities of GAM25 include diagnosis, prevention and treatment of diseases and clinical conditions associated with FLJ37045.

FLJ37433 (Accession NP_848612.1) is another GAM25 target gene, herein designated TARGET GENE. FLJ37433 BINDING SITE is a target binding site found in the 3' untranslated region of mRNA encoded by FLJ37433, corresponding to a target binding site such as BINDING SITE I, BINDING SITE II or BINDING SITE III of FIG. 8. Table 4 illustrates the complementarity of the nucleotide sequences of FLJ37433 BINDING SITE, designated SEQ ID:13505, to the nucleotide sequence of GAM25 rNA, herein designated GAM RNA, also designated SEQ ID:206.

Another function of GAM25 is therefore inhibition of FLJ37433 (Accession NP_848612.1). Accordingly, utilities of GAM25 include diagnosis, prevention and treatment of diseases and clinical conditions associated with FLJ37433.

FLJ38149 (Accession XP_091919.5) is another GAM25 target gene, herein designated TARGET GENE. FLJ38149 BINDING SITE1 and FLJ38149 BINDING SITE2 are target binding sites found in untranslated regions of mRNA encoded by FLJ38149, corresponding to target binding sites such as BINDING SITE I, BINDING SITE II or BINDING SITE III of FIG. 8. Table 4 illustrates the complementarity of the nucleotide sequences of FLJ38149 BINDING SITE1 and FLJ38149 BINDING SITE2, designated SEQ ID:5834 and SEQ ID:14301 respectively, to the nucleotide sequence of GAM25 rNA, herein designated GAM RNA, also designated SEQ ID:206.

Another function of GAM25 is therefore inhibition of FLJ38149 (Accession XP_091919.5). Accordingly, utilities of GAM25 include diagnosis, prevention and treatment of diseases and clinical conditions associated with FLJ38149.

FLJ38281 (Accession NP_689814.1) is another GAM25 target gene, herein designated TARGET GENE. FLJ38281 BINDING SITE1 and FLJ38281 BINDING SITE2 are target binding sites found in untranslated regions of mRNA encoded by FLJ38281, corresponding to target binding sites such as BINDING SITE I, BINDING SITE II or BINDING SITE III of FIG. 8. Table 4 illustrates the complementarity of the nucleotide sequences of FLJ38281 BINDING SITE1 and FLJ38281 BINDING SITE2, designated SEQ ID:761 and SEQ ID:13396 respectively, to the nucleotide sequence of GAM25 rNA, herein designated GAM RNA, also designated SEQ ID:206.

Another function of GAM25 is therefore inhibition of FLJ38281 (Accession NP_689814.1). Accordingly, utilities of GAM25 include diagnosis, prevention and treatment of diseases and clinical conditions associated with FLJ38281.

FLJ38792 (Accession NP_848615.1) is another GAM25 target gene, herein designated TARGET GENE. FLJ38792 BINDING SITE is a target binding site found in the 3' untranslated region of mRNA encoded by FLJ38792, corresponding to a target binding site such as BINDING SITE I, BINDING SITE II or BINDING SITE III of FIG. 8. Table 4 illustrates the complementarity of the nucleotide sequences of FLJ38792 BINDING SITE, designated SEQ ID:7709, to the nucleotide sequence of GAM25 rNA, herein designated GAM RNA, also designated SEQ ID:206.

Another function of GAM25 is therefore inhibition of FLJ38792 (Accession NP_848615.1). Accordingly, utilities of GAM25 include diagnosis, prevention and treatment of diseases and clinical conditions associated with FLJ38792.

FLJ38819 (Accession NP_665872.1) is another GAM25 target gene, herein designated TARGET GENE. FLJ38819 BINDING SITE is a target binding site found in the 3' untranslated region of mRNA encoded by FLJ38819, corresponding to a target binding site such as BINDING SITE I, BINDING SITE II or BINDING SITE III of FIG. 8. Table 4 illustrates the complementarity of the nucleotide sequences of FLJ38819 BINDING SITE, designated SEQ ID:16529, to the nucleotide sequence of GAM25 rNA, herein designated GAM RNA, also designated SEQ ID:206.

Another function of GAM25 is therefore inhibition of FLJ38819 (Accession NP_665872.1). Accordingly, utilities of GAM25 include diagnosis, prevention and treatment of diseases and clinical conditions associated with FLJ38819.

FLJ39599 (Accession NP_776164.1) is another GAM25 target gene, herein designated TARGET GENE. FLJ39599 BINDING SITE is a target binding site found in the 3' untranslated region of mRNA encoded by FLJ39599, corresponding to a target binding site such as BINDING SITE I, BINDING SITE II or BINDING SITE III of FIG. 8. Table 4 illustrates the complementarity of the nucleotide sequences of FLJ39599 BINDING SITE, designated SEQ ID:14114, to the nucleotide sequence of GAM25 rNA, herein designated GAM RNA, also designated SEQ ID:206.

Another function of GAM25 is therefore inhibition of FLJ39599 (Accession NP_776164.1). Accordingly, utilities of GAM25 include diagnosis, prevention and treatment of diseases and clinical conditions associated with FLJ39599.

Formin binding protein 1 (FNBP1, Accession XP_052666.3) is another GAM25 target gene, herein designated TARGET GENE. FNBP1 BINDING SITE is a target binding site found in the 3' untranslated region of mRNA encoded by FNBP1, corresponding to a target binding site such as BINDING SITE I, BINDING SITE II or BINDING SITE III of FIG. 8. Table 4 illustrates the complementarity of the nucleotide sequences of FNBP1 BINDING SITE, designated SEQ ID:4631, to the nucleotide sequence of GAM25 rNA, herein designated GAM RNA, also designated SEQ ID:206.

Another function of GAM25 is therefore inhibition of Formin binding protein 1 (FNBP1, Accession XP_052666.3). Accordingly, utilities of GAM25 include diagnosis, prevention and treatment of diseases and clinical conditions associated with FNBP1.

Fucosyltransferase 1 (galactoside 2-alpha-l-fucosyltransferase, bombay phenotype included) (FUT1, Accession NP_000139.1) is another GAM25 target gene, herein designated TARGET GENE. FUT1 BINDING SITE is a target binding site found in the 3' untranslated region of mRNA encoded by FUT1, corresponding to a target binding site such as BINDING SITE I, BINDING SITE II or BINDING SITE III of FIG. 8. Table 4 illustrates the complementarity of the nucleotide sequences of FUT1 BINDING SITE, designated SEQ ID:5787, to the nucleotide sequence of GAM25 rNA, herein designated GAM RNA, also designated SEQ ID:206.

Another function of GAM25 is therefore inhibition of Fucosyltransferase 1 (galactoside 2-alpha-l-fucosyltransferase, bombay phenotype included) (FUT1, Accession NP_000139.1). Accordingly, utilities of GAM25 include diagnosis, prevention and treatment of diseases and clinical conditions associated with FUT1.

Glucose-6-phosphatase, catalytic (glycogen storage disease type i, von gierke disease) (G6PC, Accession NP_000142.1) is another GAM25 target gene, herein designated TARGET GENE. G6PC BINDING SITE is a target binding site found in the 3' untranslated region of mRNA encoded by G6PC, corresponding to a target binding site such as BINDING SITE I, BINDING SITE II or BINDING SITE III of FIG. 8. Table 4 illustrates the complementarity of the nucleotide sequences of G6PC BINDING SITE, designated SEQ ID:5991, to the nucleotide sequence of GAM25 rNA, herein designated GAM RNA, also designated SEQ ID:206.

Another function of GAM25 is therefore inhibition of Glucose-6-phosphatase, catalytic (glycogen storage disease type i, von gierke disease) (G6PC, Accession NP_000142.1). Accordingly, utilities of GAM25 include diagnosis, prevention and treatment of diseases and clinical conditions associated with G6PC.

Gamma-glutamyl carboxylase (GGCX, Accession NP_000812.2) is another GAM25 target gene, herein designated TARGET GENE. GGCX BINDING SITE is a target binding site found in the 3' untranslated region of mRNA encoded by GGCX, corresponding to a target binding site such as BINDING SITE I, BINDING SITE II or BINDING SITE III of FIG. 8. Table 4 illustrates the complementarity of the nucleotide sequences of GGCX BINDING SITE, designated SEQ ID:15130, to the nucleotide sequence of GAM25 rNA, herein designated GAM RNA, also designated SEQ ID:206.

Another function of GAM25 is therefore inhibition of Gamma-glutamyl carboxylase (GGCX, Accession NP_000812.2). Accordingly, utilities of GAM25 include diagnosis, prevention and treatment of diseases and clinical conditions associated with GGCX.

Gm2 ganglioside activator protein (GM2A, Accession NP_000396.1) is another GAM25 target gene, herein designated TARGET GENE. GM2A BINDING SITE is a target binding site found in the 3' untranslated region of mRNA encoded by GM2A, corresponding to a target binding site such as BINDING SITE I, BINDING SITE II or BINDING SITE III of FIG. 8. Table 4 illustrates the complementarity of the nucleotide sequences of GM2A BINDING SITE, designated SEQ ID:17079, to the nucleotide sequence of GAM25 rNA, herein designated GAM RNA, also designated SEQ ID:206.

Another function of GAM25 is therefore inhibition of Gm2 ganglioside activator protein (GM2A, Accession NP_000396.1). Accordingly, utilities of GAM25 include diagnosis, prevention and treatment of diseases and clinical conditions associated with GM2A.

Guanine nucleotide binding protein (g protein), alpha 15 (gq class) (GNA15, Accession NP_002059.1) is another GAM25 target gene, herein designated TARGET GENE. GNA15 BINDING SITE is a target binding site found in the 5' untranslated region of mRNA encoded by GNA15, corresponding to a target binding site such as BINDING SITE I, BINDING SITE II or BINDING SITE III of FIG. 8. Table 4 illustrates the complementarity of the nucleotide sequences of GNA15 BINDING SITE, designated SEQ ID:9918, to the nucleotide sequence of GAM25 rNA, herein designated GAM RNA, also designated SEQ ID:206.

Another function of GAM25 is therefore inhibition of Guanine nucleotide binding protein (g protein), alpha 15 (gq class) (GNA15, Accession NP_002059.1). Accordingly, utilities of GAM25 include diagnosis, prevention and treatment of diseases and clinical conditions associated with GNA15.

Guanine nucleotide binding protein (g protein), gamma 4 (GNG4, Accession NP_004476.1) is another GAM25 target gene, herein designated TARGET GENE. GNG4 BINDING SITE is a target binding site found in the 3' untranslated region of mRNA encoded by GNG4, corresponding to a target binding site such as BINDING SITE I, BINDING SITE II or BINDING SITE III of FIG. 8. Table 4 illustrates the complementarity of the nucleotide sequences of GNG4 BINDING SITE, designated SEQ ID:4561, to the nucleotide sequence of GAM25 rNA, herein designated GAM RNA, also designated SEQ ID:206.

Another function of GAM25 is therefore inhibition of Guanine nucleotide binding protein (g protein), gamma 4 (GNG4, Accession NP_004476.1). Accordingly, utilities of GAM25 include diagnosis, prevention and treatment of diseases and clinical conditions associated with GNG4.

Golgi autoantigen, golgin subfamily a, 3 (GOLGA3, Accession NP_005886.2) is another GAM25 target gene, herein designated TARGET GENE. GOLGA3 BINDING SITE is a target binding site found in the 3' untranslated region of multiple transcripts of mRNA encoded by GOLGA3, corresponding to a target binding site such as BINDING SITE I, BINDING SITE II or BINDING SITE III of FIG. 8. Table 4 illustrates the complementarity of the nucleotide sequences of GOLGA3 BINDING SITE, designated SEQ ID:2365, to the nucleotide sequence of GAM25 rNA, herein designated GAM RNA, also designated SEQ ID:206.

Another function of GAM25 is therefore inhibition of Golgi autoantigen, golgin subfamily a, 3 (GOLGA3, Accession NP_005886.2) . Accordingly, utilities of GAM25 include diagnosis, prevention and treatment of diseases and clinical conditions associated with GOLGA3.

GPP34R (Accession NP_060648.2) is another GAM25 target gene, herein designated TARGET GENE. GPP34R BINDING SITE is a target binding site found in the 3' untranslated region of mRNA encoded by GPP34R, corresponding to a target binding site such as BINDING SITE I, BINDING SITE II or BINDING SITE III of FIG. 8. Table 4 illustrates the complementarity of the nucleotide sequences of GPP34R BINDING SITE, designated SEQ ID:6905, to the nucleotide sequence of GAM25 rNA, herein designated GAM RNA, also designated SEQ ID:206.

Another function of GAM25 is therefore inhibition of GPP34R (Accession NP_060648.2). Accordingly, utilities of GAM25 include diagnosis, prevention and treatment of diseases and clinical conditions associated with GPP34R.

G protein-coupled receptor 48 (GPR48, Accession NP_060960.1) is another GAM25 target gene, herein designated TARGET GENE. GPR48 BINDING SITE is a target binding site found in the 3' untranslated region of mRNA encoded by GPR48, corresponding to a target binding site such as BINDING SITE I, BINDING SITE II or BINDING SITE III of FIG. 8. Table 4 illustrates the complementarity of the nucleotide sequences of GPR48 BINDING SITE, designated SEQ ID:15965, to the nucleotide sequence of GAM25 rNA, herein designated GAM RNA, also designated SEQ ID:206.

Another function of GAM25 is therefore inhibition of G protein-coupled receptor 48 (GPR48, Accession NP_060960.1), a gene which binds to follicle-stimulating hormone and thyroid-stimulating hormone. Accordingly, utilities of GAM25 include diagnosis, prevention and treatment of diseases and clinical conditions associated with GPR48.

The function of GPR48 has been established by previous studies. By EST database searching with known GPCRs as queries, Hsu et al. (1998) identified ESTs encoding transmembrane domains 4 and 5 of human GPR48, which they called LGR4. By RT-PCR and repeated screening of a rat ovary cDNA library, they isolated a full-length cDNA encoding rat Lgr4. Sequence analysis predicted that the 951-amino acid rat Lgr4 protein contains a signal peptide; N- and C-flanking cysteine-rich sequences separated by 17 LRRs; 5 potential N-glycosylation sites; a transmembrane region; and a 145-residue cytoplasmic tail with multiple phosphorylation sites and a conserved potential protein kinase A (see OMIM Ref. No. 176911) phosphorylation site. Northern blot analysis of human tissues detected a 5.5-kb LGR4 transcript in multiple steroidogenic tissues and in a number of other tissues. Functional analysis showed that expression of a chimeric receptor composed of the extracellular domain of luteinizing hormone receptor (OMIM Ref. No. 152790) with the transmembrane and cytoplasmic domains of Lgr4 resulted in binding of hCG (OMIM Ref. No. 118860) but no increase in basal production of cAMP, suggesting that LGR4 may signal through another mechanism. Loh et al. (2001) cloned human GPR48. Like rat Lgr4, the deduced human GPR48 protein has 951 amino acids and a similar structure. Northern blot analysis detected wide expression of GPR48 that was highest in pancreas. Within brain, highest expression of GPR48 was in hippocampus and amygdala. Expression of Gpr48 in mouse embryos occurred as early as embryonic day 7 and peaked at day 15.

Full details of the abovementioned studies are described in the following publications, the disclosure of which are hereby incorporated by reference:

Hsu, S. Y.; Liang, S.-G.; Hsueh, A. J. W.: Characterization of two LGR genes homologous to gonadotropin and thyrotropin receptors with extracellular leucine-rich repeats and a G protein-coupled, seven-transmembrane region. Molec. Endocr. 12:1830-1845, 1998; and Loh, E. D.; Broussard, S. R.; Kolakowski, L. F.: Molecular characterization of a novel glycoprotein hormone G-protein-coupled receptor. Biochem. Biophys. Res. Commun. 282: 757-764, 2001.

Further studies establishing the function and utilities of GPR48 are found in John Hopkins OMIM database record ID 606666, and in cited publications listed in Table 5, which are hereby incorporated by reference. G protein-coupled receptor 56 (GPR56, Accession NP_005673.2) is another GAM25 target gene, herein designated TARGET GENE. GPR56 BINDING SITE is a target binding site found in the 5' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:7949, to the nucleotide sequence of GAM25 rNA, herein designated GAM RNA, also designated SEQ ID:206.

Another function of GAM25 is therefore inhibition of G protein-coupled receptor 56 (GPR56, Accession NP_005673.2), a gene which transduces extracellular signals through heterotrimeric G proteins. Accordingly, utilities of GAM25 include diagnosis, prevention and treatment of diseases and clinical conditions associated with GPR56.

The function of GPR56 has been established by previous studies. G protein- coupled receptors (GPRs), which are characterized by the presence of 7 transmembrane domains, are divided into several classes based on sequence characteristics. Class B GPRs, or the secretin-like receptors, include the secretin receptor (OMIM Ref. No. 182098) and the calcitonin receptor (OMIM Ref. No. 114131). The orphan receptors HE6 (OMIM Ref. No. 602657), CD97 (OMIM Ref. No. 601211), EMR1 (OMIM Ref. No. 600493), and BAI1 (OMIM Ref. No. 602682) share significant homology with class B GPRs across the 7-transmembrane region, but have a distinct N-terminal region containing a characteristic cysteine box, which precedes the first membrane-spanning domain, and a mucin-like domain. By PCR of human cDNAs with degenerate primers based on conserved regions from secretin-like receptors, Liu et al. (1999) isolated a cDNA encoding a novel receptor, which they designated GPR56. The predicted 693-amino acid GPR56 protein shares 26 to 32% sequence identity with the 4 class B-like orphan receptors. Like these receptors, GPR56 contains 7 transmembrane domains as well as a mucin-like domain and cysteine box in the N-terminal region. Northern blot analysis revealed that the GPR56 gene was expressed as a 3-kb mRNA in a wide range of tissues, with the highest levels in thyroid. Using in situ hybridization, Liu et al. (1999) determined that the GPR56 gene was expressed selectively within the monolayer of cuboidal epithelial cells of the smaller, more actively secreting follicles of human thyroid. The GPR56 gene contains 13 exons and spans approximately 15 kb. Using differential display, Zendman et al. (1999) identified a GPR56 cDNA as a transcript that was differentially expressed in melanoma cell lines with different metastatic potential. They designated the gene TM7XN1 (7-transmembrane protein with no EGF-like N-terminal domains-1) because the protein lacks the EGF-like domains found in the related GPRs CD97 and EMR1. Zendman et al. (1999) reported that the TM7XN1 protein contains 687 amino acids. RT-PCR and Northern blot analyses indicated that TM7XN1 gene expression was inversely correlated with metastatic potential in melanoma cell lines.

Full details of the abovementioned studies are described in the following publications, the disclosure of which are hereby incorporated by reference:

Liu, M.; Parker, R. M. C.; Darby, K.; Eyre, H. J.; Copeland, N. G.; Crawford, J.; Gilbert, D. J.; Sutherland, G. R.; Jenkins, N. A.; Herzog, H.: GPR56, a novel secretin-like human G-protein-coupled receptor gene. Genomics 55:296-305, 1999; and Zendman, A. J. W.; Cornelissen, I. M. H. A.; Weidle, U. H.; Ruiter, D. J.; van Muijen, G. N. P.: TM7XN1, a novel human EGF-TM7-like cDNA, detected with mRNA differential display using.

Further studies establishing the function and utilities of GPR56 are found in John Hopkins OMIM database record ID 604110, and in cited publications listed in Table 5, which are hereby incorporated by reference. G protein-coupled receptor 66 (GPR66, Accession NP_006047.2) is another GAM25 target gene, herein designated TARGET GENE. GPR66 BINDING SITE is a target binding site found in the 3' untranslated region of mRNA encoded by GPR66, corresponding to a target binding site such as BINDING SITE I, BINDING SITE II or BINDING SITE III of FIG. 8. Table 4 illustrates the complementarity of the nucleotide sequences of GPR66 BINDING SITE, designated SEQ ID:7428, to the nucleotide sequence of GAM25 rNA, herein designated GAM RNA, also designated SEQ ID:206.

Another function of GAM25 is therefore inhibition of G protein-coupled receptor 66 (GPR66, Accession NP_006047.2). Accordingly, utilities of GAM25 include diagnosis, prevention and treatment of diseases and clinical conditions associated with GPR66.

G protein-coupled receptor 81 (GPR81, Accession NP_115943.1) is another GAM25 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:12540, to the nucleotide sequence of GAM25 rNA, herein designated GAM RNA, also designated SEQ ID:206.

Another function of GAM25 is therefore inhibition of G protein-coupled receptor 81 (GPR81, Accession NP_115943.1). Accordingly, utilities of GAM25 include diagnosis, prevention and treatment of diseases and clinical conditions associated with GPR81.

GRAF (Accession NP_055886.1) is another GAM25 target gene, herein designated TARGET GENE. GRAF BINDING SITE is a target binding site found in the 3' untranslated region of mRNA encoded by GRAF, corresponding to a target binding site such as BINDING SITE I, BINDING SITE II or BINDING SITE III of FIG. 8. Table 4 illustrates the complementarity of the nucleotide sequences of GRAF BINDING SITE, designated SEQ ID:3444, to the nucleotide sequence of GAM25 rNA, herein designated GAM RNA, also designated SEQ ID:206.

Another function of GAM25 is therefore inhibition of GRAF (Accession NP_055886.1), a gene which ia a GTPase activating protein for p21-rac and therefore may be associated with Juvenile myelomonocytic leukemia. Accordingly, utilities of GAM25 include diagnosis, prevention and treatment of Juvenile myelomonocytic leukemia, and of other diseases and clinical conditions associated with GRAF.

The function of GRAF has been established by previous studies. Borkhardt et al. (2000) stated that mutual translocations involving 11q23 in acute leukemias had been demonstrated to show fusion between the mixed lineage leukemia (MLL; 159555) gene and a variety of different partner genes to a total of 23. The detection of a unique t(5;11)(q31;q23) in an infant with juvenile myelomonocytic leukemia and an MLL gene rearrangement provided an opportunity to clone another MLL fusion partner gene. By cloning the breakpoints in this translocation, Borkhardt et al. (2000) recovered a member of the GTPase-activating protein (GAP) family, which they identified as the human homolog of the avian GRAF gene (Hildebrand et al., 1996). Ishikawa et al. (1998) cloned a GRAF cDNA, which they designated KIAA0621, from a human brain cDNA library and found that it encodes a deduced 753-amino acid protein with a molecular mass of 87 kD. Hildebrand et al. (1996) determined that the GRAF gene is highly homologous to the BCR gene (OMIM Ref. No. 151410), which is also involved in a leukemia- associated translocation. The avian GRAF protein binds to the C-terminal domain of pp125(FAK), one of the tyrosine kinases predicted to be a critical component of the integrin signaling transduction pathway, in an SH3 domain-dependent manner and stimulates the GTPase activity of the GTP-binding protein RhoA. Thus, GRAF acts as a negative regulator of RhoA.

Full details of the abovementioned studies are described in the following publications, the disclosure of which are hereby incorporated by reference:

Borkhardt, A.; Bojesen, S.; Haas, O. A.; Fuchs, U.; Bartelheimer, D.; Loncarevic, I. F.; Bohle, R. M.; Harbott, J.; Repp, R.; Jaeger, U.; Viehmann, S.; Henn, T.; Korth, P.; Scharr, D.; Lampert, F.: The human GRAF gene is fused to MLL in a unique t(5;11)(q31;q23) and both alleles are disrupted in three cases of myelodysplastic syndrome/acute myeloid leukemia with a deletion 5q. Proc. Nat. Acad. Sci. 97:9168-9173, 2000; and Hildebrand, J. D.; Taylor, J. M.; Parsons, T. J.: An SH3 domain-containing GTPase-activating protein for Rho and Cdc42 associates with focal adhesion kinase. Molec. Cell. Biol. 16:31.

Further studies establishing the function and utilities of GRAF are found in John Hopkins OMIM database record ID 605370, and in cited publications listed in Table 5, which are hereby incorporated by reference. GRWD (Accession NP_113673.2) is another GAM25 target gene, herein designated TARGET GENE. GRWD BINDING SITE is a target binding site found in the 3' untranslated region of mRNA encoded by GRWD, corresponding to a target binding site such as BINDING SITE I, BINDING SITE II or BINDING SITE III of FIG. 8. Table 4 illustrates the complementarity of the nucleotide sequences of GRWD BINDING SITE, designated SEQ ID:18015, to the nucleotide sequence of GAM25 rNA, herein designated GAM RNA, also designated SEQ ID:206.

Another function of GAM25 is therefore inhibition of GRWD (Accession NP_113673.2). Accordingly, utilities of GAM25 include diagnosis, prevention and treatment of diseases and clinical conditions associated with GRWD.

GSDM (Accession XP_209009.1) is another GAM25 target gene, herein designated TARGET GENE. GSDM BINDING SITE1 and GSDM BINDING SITE2 are target binding sites found in untranslated regions of multiple transcripts of mRNA encoded by GSDM, corresponding to target binding sites such as BINDING SITE I, BINDING SITE II or BINDING SITE III of FIG. 8. Table 4 illustrates the complementarity of the nucleotide sequences of GSDM BINDING SITE1 and GSDM BINDING SITE2, designated SEQ ID:19169 and SEQ ID:13018 respectively, to the nucleotide sequence of GAM25 rNA, herein designated GAM RNA, also designated SEQ ID:206.

Another function of GAM25 is therefore inhibition of GSDM (Accession XP_209009.1). Accordingly, utilities of GAM25 include diagnosis, prevention and treatment of diseases and clinical conditions associated with GSDM.

General transcription factor iie, polypeptide 1, alpha 56 kda (GTF2E1, Accession NP_005504.1) is another GAM25 target gene, herein designated TARGET GENE. GTF2E1 BINDING SITE is a target binding site found in the 3' untranslated region of mRNA encoded by GTF2E1, corresponding to a target binding site such as BINDING SITE I, BINDING SITE II or BINDING SITE III of FIG. 8. Table 4 illustrates the complementarity of the nucleotide sequences of GTF2E1 BINDING SITE, designated SEQ ID:4882, to the nucleotide sequence of GAM25 rNA, herein designated GAM RNA, also designated SEQ ID:206.

Another function of GAM25 is therefore inhibition of General transcription factor iie, polypeptide 1, alpha 56 kda (GTF2E1, Accession NP_005504.1). Accordingly, utilities of GAM25 include diagnosis, prevention and treatment of diseases and clinical conditions associated with GTF2E1.

GTF2IRD2 (Accession NP_775808.1) is another GAM25 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:5571, to the nucleotide sequence of GAM25 RNA, herein designated GAM RNA, also designated SEQ ID:206.

Another function of GAM25 is therefore inhibition of GTF2IRD2 (Accession NP_775808.1). Accordingly, utilities of GAM25 include diagnosis, prevention and treatment of diseases and clinical conditions associated with GTF2IRD2.

GTF2IRD2 (Accession NP_115579.3) is another GAM25 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:5571, to the nucleotide sequence of GAM25 RNA, herein designated GAM RNA, also designated SEQ ID:206.

Another function of GAM25 is therefore inhibition of GTF2IRD2 (Accession NP_115579.3). Accordingly, utilities of GAM25 include diagnosis, prevention and treatment of diseases and clinical conditions associated with GTF2IRD2.

GTPBG3 (Accession NP_116009.1) is another GAM25 target gene, herein designated TARGET GENE. GTPBG3 BINDING SITE is a target binding site found in the 3' untranslated region of mRNA encoded by GTPBG3, corresponding to a target binding site such as BINDING SITE I, BINDING SITE II or BINDING SITE III of FIG. 8. Table 4 illustrates the complementarity of the nucleotide sequences of GTPBG3 BINDING SITE, designated SEQ ID:13666, to the nucleotide sequence of GAM25 rNA, herein designated GAM RNA, also designated SEQ ID:206.

Another function of GAM25 is therefore inhibition of GTPBG3 (Accession NP_116009.1). Accordingly, utilities of GAM25 include diagnosis, prevention and treatment of diseases and clinical conditions associated with GTPBG3.

H63 (Accession NP_816929.1) is another GAM25 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:2380, to the nucleotide sequence of GAM25 rNA, herein designated GAM RNA, also designated SEQ ID:206.

Another function of GAM25 is therefore inhibition of H63 (Accession NP_816929.1). Accordingly, utilities of GAM25 include diagnosis, prevention and treatment of diseases and clinical conditions associated with H63.

H63 (Accession NP_612432.2) is another GAM25 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:2380, to the nucleotide sequence of GAM25 rNA, herein designated GAM RNA, also designated SEQ ID:206.

Another function of GAM25 is therefore inhibition of H63 (Accession NP_612432.2). Accordingly, utilities of GAM25 include diagnosis, prevention and treatment of diseases and clinical conditions associated with H63.

Hepatitis a virus cellular receptor 2 (HAVCR2, Accession NP_116171.2) is another GAM25 target gene, herein designated TARGET GENE. HAVCR2 BINDING SITE is a target binding site found in the 3' untranslated region of mRNA encoded by HAVCR2, corresponding to a target binding site such as BINDING SITE I, BINDING SITE II or BINDING SITE III of FIG. 8. Table 4 illustrates the complementarity of the nucleotide sequences of HAVCR2 BINDING SITE, designated SEQ ID:14385, to the nucleotide sequence of GAM25 RNA, herein designated GAM RNA, also designated SEQ ID:206.

Another function of GAM25 is therefore inhibition of Hepatitis a virus cellular receptor 2 (HAVCR2, Accession NP_116171.2). Accordingly, utilities of GAM25 include diagnosis, prevention and treatment of diseases and clinical conditions associated with HAVCR2.

HE9 (Accession NP_741997.1) is another GAM25 target gene, herein designated TARGET GENE. HE9 BINDING SITE is a target binding site found in the 3' untranslated region of mRNA encoded by HE9, corresponding to a target binding site such as BINDING SITE I, BINDING SITE II or BINDING SITE III of FIG. 8. Table 4 illustrates the complementarity of the nucleotide sequences of HE9 BINDING SITE, designated SEQ ID:6046, to the nucleotide sequence of GAM25 rNA, herein designated GAM RNA, also designated SEQ ID:206.

Another function of GAM25 is therefore inhibition of HE9 (Accession NP_741997.1). Accordingly, utilities of GAM25 include diagnosis, prevention and treatment of diseases and clinical conditions associated with HE9.

Hypoxia inducible factor 3, alpha subunit (HIF3A, Accession NP_690009.1) is another GAM25 target gene, herein designated TARGET GENE. HIF3A BINDING SITE is a target binding site found in the 3' untranslated region of multiple transcripts of mRNA encoded by HIF3A, corresponding to a target binding site such as BINDING SITE I, BINDING SITE II or BINDING SITE III of FIG. 8. Table 4 illustrates the complementarity of the nucleotide sequences of HIF3A BINDING SITE, designated SEQ ID:10710, to the nucleotide sequence of GAM25 RNA, herein designated GAM RNA, also designated SEQ ID:206.

Another function of GAM25 is therefore inhibition of Hypoxia inducible factor 3, alpha subunit (HIF3A, Accession NP_690009.1). Accordingly, utilities of GAM25 include diagnosis, prevention and treatment of diseases and clinical conditions associated with HIF3A.

Histamine receptor h4 (HRH4, Accession NP_067637.2) is another GAM25 target gene, herein designated TARGET GENE. HRH4 BINDING SITE is a target binding site found in the 3' untranslated region of mRNA encoded by HRH4, corresponding to a target binding site such as BINDING SITE I, BINDING SITE II or BINDING SITE III of FIG. 8. Table 4 illustrates the complementarity of the nucleotide sequences of HRH4 BINDING SITE, designated SEQ ID:5567, to the nucleotide sequence of GAM25 rRNA, herein designated GAM RNA, also designated SEQ ID:206.

Another function of GAM25 is therefore inhibition of Histamine receptor h4 (HRH4, Accession NP_067637.2). Accordingly, utilities of GAM25 include diagnosis, prevention and treatment of diseases and clinical conditions associated with HRH4.

HSD3B7 (Accession NP_079469.2) is another GAM25 target gene, herein designated TARGET GENE. HSD3B7 BINDING SITE is a target binding site found in the 3' untranslated region of mRNA encoded by HSD3B7, corresponding to a target binding site such as BINDING SITE I, BINDING SITE II or BINDING SITE III of FIG. 8. Table 4 illustrates the complementarity of the nucleotide sequences of HSD3B7 BINDING SITE, designated SEQ ID:18589, to the nucleotide sequence of GAM25 rNA, herein designated GAM RNA, also designated SEQ ID:206.

Another function of GAM25 is therefore inhibition of HSD3B7 (Accession NP_079469.2). Accordingly, utilities of GAM25 include diagnosis, prevention and treatment of diseases and clinical conditions associated with HSD3B7.

HSPC065 (Accession NP_054876.2) is another GAM25 target gene, herein designated TARGET GENE. HSPC065 BINDING SITE1 and HSPC065 BINDING SITE2 are target binding sites found in untranslated regions of mRNA encoded by HSPC065, corresponding to target binding sites such as BINDING SITE I, BINDING SITE II or BINDING SITE III of FIG. 8. Table 4 illustrates the complementarity of the nucleotide sequences of HSPC065 BINDING SITE1 and HSPC065 BINDING SITE2, designated SEQ ID:17865 and SEQ ID:2552 respectively, to the nucleotide sequence of GAM25 RNA, herein designated GAM RNA, also designated SEQ ID:206.

Another function of GAM25 is therefore inhibition of HSPC065 (Accession NP_054876.2). Accordingly, utilities of GAM25 include diagnosis, prevention and treatment of diseases and clinical conditions associated with HSPC065.

5-hydroxytryptamine (serotonin) receptor 1d (HTR1D, Accession NP_000855.1) is another GAM25 target gene, herein designated TARGET GENE. HTR1D BINDING SITE is a target binding site found in the 3' untranslated region of mRNA encoded by HTR1D, corresponding to a target binding site such as BINDING SITE I, BINDING SITE II or BINDING SITE III of FIG. 8. Table 4 illustrates the complementarity of the nucleotide sequences of HTR1D BINDING SITE, designated SEQ ID:9485, to the nucleotide sequence of GAM25 rNA, herein designated GAM RNA, also designated SEQ ID:206.

Another function of GAM25 is therefore inhibition of 5-hydroxytryptamine (serotonin) receptor 1d (HTR1D, Accession NP_000855.1), a gene which belongs to g-protein coupled receptor. Accordingly, utilities of GAM25 include diagnosis, prevention and treatment of diseases and clinical conditions associated with HTR1D.

The function of HTR1D has been established by previous studies. The serotonin 1D receptor was initially characterized by radioligand binding procedures using membranes derived from bovine caudate nucleus. The 5-HT-1D receptor is known to be a G protein-coupled receptor. Sumatriptan, an agent effective in the treatment of acute migraine, is the only ligand yet identified that is selective for the 5-HT-1D receptor. Weinshank et al. (1992) reported the cloning, deduced amino acid sequences, pharmacologic properties, and second-messenger coupling of a pair of human 5-HT-1D receptor genes, which they designated alpha and beta due to their strong similarities. Both genes have no introns in their coding regions, are expressed in the human cerebral cortex, and can couple to inhibition of adenylate cyclase activity. Their pharmacologic binding properties match closely those of human, bovine, and guinea pig 5-HT-1D sites. Libert et al. (1991) obtained cDNA clones encoding 4 receptors of the G protein-coupled receptor family by selective amplification and cloning from thyroid cDNA. One of these clones, termed RDC4 by them, showed close structural similarity with the serotonin 5HT1A receptor (OMIM Ref. No. 109760). By in situ hybridization, they demonstrated that the gene (HTR1D) is located on chromosome 1 at 1p36.3-p34.3. By Southern blot analysis of a hybrid cell panel, Jin et al. (1992) showed that the HTR1D gene is located on chromosome 1. Wilkie et al. (1993) showed that the homologous gene in the mouse is located on chromosome 4.

Full details of the abovementioned studies are described in the following publications, the disclosure of which are hereby incorporated by reference:

Weinshank, R. L.; Zgombick, J. M.; Macchi, M. J.; Branchek, T. A.; Hartig, P. R.: Human serotonin 1D receptor is encoded by a subfamily of two distinct genes:5-HT(1D-alpha) and 5-HT(1D-beta). Proc. Nat. Acad. Sci. 89:3630-3634, 1992; and Wilkie, T. M.; Chen, Y.; Gilbert, D. J.; Moore, K. J.; y, L.; Simon, M. I.; Copeland, N. G.; Jenkins, N. A.: Identification, chromosomal location, and genome organization of mammalian.

Further studies establishing the function and utilities of HTR1D are found in John Hopkins OMIM database record ID 182133, and in cited publications listed in Table 5, which are hereby incorporated by reference. Hyaluronoglucosaminidase 4 (HYAL4, Accession NP_036401.1) is another GAM25 target gene, herein designated TARGET GENE. HYAL4 BINDING SITE is a target binding site found in the 5' untranslated region of mRNA encoded by HYAL4, corresponding to a target binding site such as BINDING SITE I, BINDING SITE II or BINDING SITE III of FIG. 8. Table 4 illustrates the complementarity of the nucleotide sequences of HYAL4 BINDING SITE, designated SEQ ID:4683, to the nucleotide sequence of GAM25 rNA, herein designated GAM RNA, also designated SEQ ID:206.

Another function of GAM25 is therefore inhibition of Hyaluronoglucosaminidase 4 (HYAL4, Accession NP_036401.1). Accordingly, utilities of GAM25 include diagnosis, prevention and treatment of diseases and clinical conditions associated with HYAL4.

Insulin-like growth factor 1 (somatomedin c) (IGF1, Accession NP_000609.1) is another GAM25 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:4732, to the nucleotide sequence of GAM25 rNA, herein designated GAM RNA, also designated SEQ ID:206.

Another function of GAM25 is therefore inhibition of Insulin-like growth factor 1 (somatomedin c) (IGF1, Accession NP_000609.1), a gene which are structurally and functionally related to insulin but have a much higher growth-promoting activity and therefore may be associated with Growth retardation with sensorineural deafness and mental retardation. Accordingly, utilities of GAM25 include diagnosis, prevention and treatment of Growth retardation with sensorineural deafness and mental retardation, and of other diseases and clinical conditions associated with IGF1.

The function of IGF1 has been established by previous studies. By the solid-phase method, Li et al. (1983) synthesized human somatomedin C, which has 70 amino acid residues and 3 disulfide bridges. Using cDNA probes in the analysis of somatic cell hybrids, Brissenden et al. (1984) and Tricoli et al. (1984) independently assigned the IGF1 structural gene to chromosome 12. Tricoli et al. (1984) regionalized the locus tentatively to 12q22-qter, where the KRAS2 (OMIM Ref. No. 190070) gene is situated. This proximity, as well as that of the HRAS1 (OMIM Ref. No. 190020) and IGF2 (OMIM Ref. No. 147470) genes on 11p and that of the NRAS (OMIM Ref. No. 164790) and NGFB (OMIM Ref. No. 162030) genes in band 1p22, suggested to Brissenden et al. (1984) that a functional or evolutionary relationship may exist between members of the RAS family of protooncogenes and growth factor genes. Chromosomal abnormalities in the region of these genes have been associated with specific forms of neoplasia. Both IGF1 and IGF2 have a striking structural homology to proinsulin. Deficiency of IGF1 was proposed as the nature of the basic defect in the African pygmy (OMIM Ref. No. 265850) and possibly also in the Laron type of dwarfism (OMIM Ref. No. 262500). The homology of chromosomes 11 and 12 is supported by the finding of yet another pair of structurally homologous loci on these 2 chromosomes. See 146000 for description of the work of Mullis et al. (1991) suggesting that the IGF1 gene may be the site of the mutation causing one form of hypochondroplasia. Using stored sera from men followed in the Baltimore Longitudinal Study on Aging, Harman et al. (2000) investigated whether the circulating IGF1 level is an independent predictor of prostate cancer and compared its predictive value with those of IGF2, IGFBP3, and prostate-specific antigen (PSA; 176820). High IGF1 and low IGF2 were independently associated with increased risk for prostate cancer, but PSA level was a much stronger predictor of prostate cancer than either IGF1 or IGF2. The absence of a relationship of IGF1 to prostate size is inconsistent with increased ascertainment in men with large prostates as the source of greater prostate cancer risk associated with IGF1. The authors concluded that IGF2 may inhibit both prostate growth and development of prostate cancer. Low birthweight is associated with later risk of type 2 diabetes and related disorders. Vaessen et al. (2002) studied the relationship between low birthweight and a polymorphism in the IGF1 gene that raises risk of type 2 diabetes and myocardial infarction. They recorded birthweight and obtained DNA for 463 adults. Individuals who did not have the wildtype allele of the polymorphism had a 215-gram lower birthweight than those homozygous for the wildtype allele. The data lent support to the hypothesis that genetic variation affecting fetal growth could account for the association between low birthweight and susceptibility to diabetes and cardiovascular disease in later life. Postnatal growth and development are coordinated by genetic and environmental influences and numerous growth factors. Le Roith et al. (2001) reviewed the essential role that the GH-IGFI axis plays in these processes. Although the GH-IGFI axis is a closely coordinated system, both GH and IGFI have independent actions, many of which have become apparent more recently following the characterization of clinical syndromes and the development of mouse models. Genetic manipulation of mice has enabled investigators to reexamine many of the established hypotheses regarding the GH-IGFI axis. Results gleaned from a mouse model created by tissue-specific gene deletion of liver IGFI (Yakar et. al, 1999; Sjogren et al., 1999) enabled investigators to reevaluate the original 'somatomedin hypothesis.'

Animal model experiments lend further support to the function of IGF1. Aging skeletal muscles suffer a steady decline in mass and functional performance, and compromised muscle integrity as fibrotic invasions replace contractile tissue. The same programmed deficits in muscle structure and function are found in numerous neurodegenerative syndromes and disease-related cachexia. Musaro et al. (2001) generated a model of persistent, functional myocyte hypertrophy using a tissue-restricted transgene encoding a locally acting isoform of Igf1 that is expressed in skeletal muscle. Transgenic embryos developed normally, and postnatal increases in muscle mass and strength were not accompanied by the additional pathologic changes seen in other Igf1 transgenic models. Expression of Gata2 (OMIM Ref. No. 137295), a transcription factor normally undetected in skeletal muscle, marked hypertrophic myocytes that escaped age-related muscle atrophy and retained the proliferative response to muscle injury characteristic of younger animals. The observations were thought to suggest usefulness of localized expression of this transgene as a clinical strategy for the treatment of age-or disease-related muscle frailty.

It is appreciated that the abovementioned animal model for IGF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Musaro, A.; McCullagh, K.; Paul, A.; Houghton, L.; Dobrowolny, G.; Molinaro, M.; Barton, E. R.; Sweeney, H. L.; Rosenthal, N.: Localized Igf-1 transgene expression sustains hypertrophy and regeneration in senescent skeletal muscle. Nature Genet. 27:195-200, 2001; and Le Roith, D.; Scavo, L.; Butler, A.: What is the role of circulating IGF-I? Trends Endocr. Metab. 12:48-52, 2001.

Further studies establishing the function and utilities of IGF1 are found in John Hopkins OMIM database record ID 147440, and in cited publications listed in Table 5, which are hereby incorporated by reference. Interleukin 11 (IL11, Accession NP_000632.1) is another GAM25 target gene, herein designated TARGET GENE. IL11 BINDING SITE is a target binding site found in the 3' untranslated region of mRNA encoded by IL11, corresponding to a target binding site such as BINDING SITE I, BINDING SITE II or BINDING SITE III of FIG. 8. Table 4 illustrates the complementarity of the nucleotide sequences of IL11 BINDING SITE, designated SEQ ID:13505, to the nucleotide sequence of GAM25 rNA, herein designated GAM RNA, also designated SEQ ID:206.

Another function of GAM25 is therefore inhibition of Interleukin 11 (IL11, Accession NP_000632.1), a gene which stimulates the proliferation of hematopoietic stem cells and megakaryocyte progenitor cells and induces megakaryocyte maturation. Accordingly, utilities of GAM25 include diagnosis, prevention and treatment of diseases and clinical conditions associated with IL11.

The function of IL11 has been established by previous studies. Paul et al. (1990) identified and cloned the gene for a new stromal cell-derived lymphopoietic and hematopoietic cytokine which they called interleukin-11. The cDNA indicated a single reading frame of 597 nucleotides encoding a predicted 199-amino acid polypeptide. The IL11 produced in COS-1 cells showed an apparent molecular mass of about 23 kD. McKinley et al. (1992) determined that the genomic sequence is 7 kb long and consists of 5 exons and 4 introns. Biologic characterization indicated that in addition to stimulating plasmacytoma proliferation, IL11 stimulates T-cell-dependent development of immunoglobulin-producing B cells and collaborates with IL3 in supporting murine megakaryocyte colony formation (Paul et al., 1990). Du and Williams (1994) reviewed the pleiotropic effects of IL11 on hematopoietic cells. Yang-Feng et al. (1991) demonstrated by in situ hybridization that a cDNA for IL11 maps to 19q13.3-q13.4. Since translocations involving 19q13 occur in patients with acute lymphocytic leukemia, the IL11 gene may be implicated. Du and Williams (1997) reviewed the molecular, cell biologic, and clinical aspects of interleukin-11.

Full details of the abovementioned studies are described in the following publications, the disclosure of which are hereby incorporated by reference:

Du, X.; Williams, D. A.: Interleukin-11: review of molecular, cell biology, and clinical use. Blood 89:3897-3908, 1997; and Du, X. X.; Williams, D. A.: Interleukin-11: a multifunctional growth factor derived from the hematopoietic microenvironment. Blood 83:2023-2030, 1994.

Further studies establishing the function and utilities of IL11 are found in John Hopkins OMIM database record ID 147681, and in cited publications listed in Table 5, which are hereby incorporated by reference. Interleukin 19 (IL19, Accession NP_037503.2) is another GAM25 target gene, herein designated TARGET GENE. IL19 BINDING SITE is a target binding site found in the 5' untranslated region of multiple transcripts of mRNA encoded by IL19, corresponding to a target binding site such as BINDING SITE I, BINDING SITE II or BINDING SITE III of FIG. 8. Table 4 illustrates the complementarity of the nucleotide sequences of IL19 BINDING SITE, designated SEQ ID:6724, to the nucleotide sequence of GAM25 rNA, herein designated GAM RNA, also designated SEQ ID:206.

Another function of GAM25 is therefore inhibition of Interleukin 19 (IL19, Accession NP_037503.2), a gene which may play a role in B-cell activation and autoantibody production. Accordingly, utilities of GAM25 include diagnosis, prevention and treatment of diseases and clinical conditions associated with IL19.

The function of IL19 has been established by previous studies. Interleukin-10 (IL10; 124092) is a multifunctional cytokine that has antiinflammatory properties through its ability to downregulate antigen presentation and macrophage activation. It also plays a role in B-cell activation and autoantibody production. The IL10 family of cytokines includes IL19, IL20 (OMIM Ref. No. 605619), MDA7 (OMIM Ref. No. 604136), and IL22 (OMIM Ref. No. 605330). By searching EST databases using IL10 as the probe, followed by screening an Epstein-Barr virus-transformed B-cell cDNA library, Gallagher et al. (2000) obtained a cDNA encoding IL19. Sequence analysis predicted that the 177-amino acid protein contains a signal peptide, 2 potential N-linked glycosylation sites, and 4 conserved cysteine residues necessary for correct folding of the IL10 monomer. IL19 shares 82% identity with IL10 in the hydrophobic core, but only 53% similarity in the putative IL10 receptor-alpha (OMIM Ref. No. 146933)-interacting residues. Northern blot kinetic analysis detected expression of IL10 before IL19 in lipopolysaccharide (LPS)-stimulated monocytes. IL19 expression was enhanced in the presence of IL4 (OMIM Ref. No. 147780) or IL13 (OMIM Ref. No. 147683), but not gamma-interferon (OMIM Ref. No. 147570), in LPS-stimulated monocytes. Granulocyte-macrophage colony-stimulating factor (GMCSF; 138960), but not other cytokines, was capable of inducing IL19 expression. Western blot analysis showed expression of a 35- to 40-kD protein that was reduced to 21 kD by glycosidase treatment. Genomic sequence analysis determined that the IL19 gene spans nearly 6 kb and, like IL10, contains 5 exons Full details of the abovementioned studies are described in the following publications, the disclosure of which are hereby incorporated by reference:

Blumberg, H.; Conklin, D.; Xu, W.; Grossmann, A.; Brender, T.; Carollo, S.; Eagan, M.; Foster, D.; Haldeman, B. A.; Hammond, A.; Haugen, H.; Jelinek, L.; and 14 others: Interleukin 20: discovery, receptor identification, and role in epidermal function. Cell 104:9-19, 2001; and Gallagher, G.; Dickensheets, H.; Eskdale, J.; Izotova, L. S.; Mirochnitchenko, O. V.; Peat, J. D.; Vazquez, N.; Pestka, S.; Donnelly, R. P.; Kotenko, S. V.: Cloning, expression and ini.

Further studies establishing the function and utilities of IL19 are found in John Hopkins OMIM database record ID 605687, and in cited publications listed in Table 5, which are hereby incorporated by reference. Interleukin 28 receptor, alpha (IL28RA, Accession NP_775087.1) is another GAM25 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:13666, to the nucleotide sequence of GAM25 rNA, herein designated GAM RNA, also designated SEQ ID:206.

Another function of GAM25 is therefore inhibition of Interleukin 28 receptor, alpha (IL28RA, Accession NP_775087.1). Accordingly, utilities of GAM25 include diagnosis, prevention and treatment of diseases and clinical conditions associated with IL28RA.

Interleukin 28 receptor, alpha (IL28RA, Accession NP_734464.1) is another GAM25 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:13666, to the nucleotide sequence of GAM25 RNA, herein designated GAM RNA, also designated SEQ ID:206.

Another function of GAM25 is therefore inhibition of Interleukin 28 receptor, alpha (IL28RA, Accession NP_734464.1). Accordingly, utilities of GAM25 include diagnosis, prevention and treatment of diseases and clinical conditions associated with IL28RA.

Interleukin 28 receptor, alpha (IL28RA, Accession NP_775088.1) is another GAM25 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:13666, to the nucleotide sequence of GAM25 RNA, herein designated GAM RNA, also designated SEQ ID:206.

Another function of GAM25 is therefore inhibition of Interleukin 28 receptor, alpha (IL28RA, Accession NP_775088.1). Accordingly, utilities of GAM25 include diagnosis, prevention and treatment of diseases and clinical conditions associated with IL28RA.

INHBE (Accession NP_113667.1) is another GAM25 target gene, herein designated TARGET GENE. INHBE BINDING SITE is a target binding site found in the 3' untranslated region of mRNA encoded by INHBE, corresponding to a target binding site such as BINDING SITE I, BINDING SITE II or BINDING SITE III of FIG. 8. Table 4 illustrates the complementarity of the nucleotide sequences of INHBE BINDING SITE, designated SEQ ID:17098, to the nucleotide sequence of GAM25 rNA, herein designated GAM RNA, also designated SEQ ID:206.

Another function of GAM25 is therefore inhibition of INHBE (Accession NP_113667.1). Accordingly, utilities of GAM25 include diagnosis, prevention and treatment of diseases and clinical conditions associated with INHBE.

Integrin, alpha x (antigen cd11c (p150), alpha polypeptide) (ITGAX, Accession NP_000878.1) is another GAM25 target gene, herein designated TARGET GENE. ITGAX BINDING SITE is a target binding site found in the 3' untranslated region of mRNA encoded by ITGAX, corresponding to a target binding site such as BINDING SITE I, BINDING SITE II or BINDING SITE III of FIG. 8. Table 4 illustrates the complementarity of the nucleotide sequences of ITGAX BINDING SITE, designated SEQ ID:5590, to the nucleotide sequence of GAM25 rNA, herein designated GAM RNA, also designated SEQ ID:206.

Another function of GAM25 is therefore inhibition of Integrin, alpha x (antigen cd11c (p150), alpha polypeptide) (ITGAX, Accession NP_000878.1). Accordingly, utilities of GAM25 include diagnosis, prevention and treatment of diseases and clinical conditions associated with ITGAX.

Janus kinase 3 (a protein tyrosine kinase, leukocyte) (JAK3, Accession NP_000206.1) is another GAM25 target gene, herein designated TARGET GENE. JAK3 BINDING SITE is a target binding site found in the 3' untranslated region of mRNA encoded by JAK3, corresponding to a target binding site such as BINDING SITE I, BINDING SITE II or BINDING SITE III of FIG. 8. Table 4 illustrates the complementarity of the nucleotide sequences of JAK3 BINDING SITE, designated SEQ ID:9292, to the nucleotide sequence of GAM25 RNA, herein designated GAM RNA, also designated SEQ ID:206.

Another function of GAM25 is therefore inhibition of Janus kinase 3 (a protein tyrosine kinase, leukocyte) (JAK3, Accession NP_000206.1). Accordingly, utilities of GAM25 include diagnosis, prevention and treatment of diseases and clinical conditions associated with JAK3.

Potassium inwardly-rectifying channel, subfamily j, member 11 (KCNJ11, Accession NP_000516.2) is another GAM25 target gene, herein designated TARGET GENE. KCNJ11 BINDING SITE is a target binding site found in the 5' untranslated region of mRNA encoded by KCNJ11, corresponding to a target binding site such as BINDING SITE I, BINDING SITE II or BINDING SITE III of FIG. 8. Table 4 illustrates the complementarity of the nucleotide sequences of KCNJ11 BINDING SITE, designated SEQ ID:612, to the nucleotide sequence of GAM25 rNA, herein designated GAM RNA, also designated SEQ ID:206.

Another function of GAM25 is therefore inhibition of Potassium inwardly-rectifying channel, subfamily j, member 11 (KCNJ11, Accession NP_000516.2), a gene which is controlled by g proteins. inward rectifier k+ channels are characterized by a greater tendency to allow potassium to flow into the cell rather than out of it. and therefore is associated with Persistent hyperinsulinemic hypoglycemia of infancy. Accordingly, utilities of GAM25 include diagnosis, prevention and treatment of Persistent hyperinsulinemic hypoglycemia of infancy, and of other diseases and clinical conditions associated with KCNJ11.

The function of KCNJ11 has been established by previous studies. ATP-sensitive potassium currents, I(KATP), were discovered in cardiac muscle and later found in pancreatic beta cells, pituitary tissue, skeletal muscle, brain, and vascular and nonvascular smooth muscle. I(KATP) functions in secretion and muscle contraction by coupling metabolic activity to membrane potential. In pancreatic beta cells, ATP-potassium channels are crucial for the regulation of glucose-induced insulin secretion and are the target for the sulfonylureas, oral hypoglycemic agents widely used in the treatment of noninsulin-dependent diabetes mellitus (NIDDM; 125853), and for diazoxide, a potassium channel opener. The sulfonylurea receptor SUR (OMIM Ref. No. 600509) is a member of the ATP-binding cassette superfamily with multiple transmembrane-spanning domains and 2 potential nucleotide-binding folds. Truncation of SUR that removes the second nucleotide-binding fold causes familial persistent hyperinsulinemic hypoglycemia of infancy (see, OMIM Ref. No., for example, 600509.0001), a rare disorder of glucose homeostasis characterized by unregulated insulin secretion despite severe hypoglycemia. Although these observations imply that SUR is closely associated with, or even a subunit of, K(ATP) channels, expression of SUR alone had not produced a measurable I(KATP). Inagaki et al. (1995) cloned a member of the inwardly rectifying potassium channel family, which they called BIR or Kir6.2, in the nomenclature of Chandy and Gutman (1993). The channel was expressed in large amounts in rat pancreatic islets and glucose-responsive insulin- secreting cell lines. The sequence showed a single open reading frame encoding a 390-amino acid protein with 2 putative transmembrane segments. The mouse homolog also had a single open reading frame encoding a 390-amino acid protein with 96% amino acid identity with human BIR, thus confirming that the gene encoding human BIR is intronless in the protein-coding region. Several other genes encoding inward rectifiers lack introns. This gene is also symbolized KCNJ11.

Animal model experiments lend further support to the function of KCNJ11. ATP-sensitive potassium channels are activated by various metabolic stresses, including hypoxia. The substantia nigra pars reticulata, the area with the highest expression of ATP-sensitive potassium channels in the brain, plays a pivotal role in the control of seizures. Yamada et al. (2001) studied mutant mice lacking the Kir6.2 subunit of ATP-sensitive potassium channels and found that they were susceptible to generalized seizures after brief hypoxia. In normal mice, the substantia nigra pars reticulata neuron activity was inactivated during hypoxia by the opening of the postsynaptic ATP-sensitive potassium channels, whereas in knockout mice, the activity of these neurons was enhanced. ATP-sensitive potassium channels exert a depressant effect on substantia nigra pars reticulata neuronal activity during hypoxia and may be involved in the nigral protection mechanism against generalized seizures It is appreciated that the abovementioned animal model for KCNJ11 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Thomas, P. M.; Cote, G. J.; Hallman, D. M.; Mathew, P. M.: Homozygosity mapping, to chromosome 11p, of the gene for familial persistent hyperinsulinemic hypoglycemia of infancy. Am. J. Hum. Genet. 56:416-421, 1995; and Yamada, K.; Ji, J. J.; Yuan, H.; Miki, T.; Sata, S.; Horimoto, N.; Shimizu, T.; Seino, S.; Inagaki, N.: Protective role of ATP-sensitive potassium channels in hypoxia- induced generalize.

Further studies establishing the function and utilities of KCNJ11 are found in John Hopkins OMIM database record ID 600937, and in cited publications listed in Table 5, which are hereby incorporated by reference. KIAA0063 (Accession NP_055691.1) is another GAM25 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:6721, to the nucleotide sequence of GAM25 rNA, herein designated GAM RNA, also designated SEQ ID:206.

Another function of GAM25 is therefore inhibition of KIAA0063 (Accession NP_055691.1). Accordingly, utilities of GAM25 include diagnosis, prevention and treatment of diseases and clinical conditions associated with KIAA0063.

KIAA0087 (Accession NP_055584.1) is another GAM25 target gene, herein designated TARGET GENE. KIAA0087 BINDING SITE is a target binding site found in the 3' untranslated region of mRNA encoded by KIAA0087, corresponding to a target binding site such as BINDING SITE I, BINDING SITE II or BINDING SITE III of FIG. 8. Table 4 illustrates the complementarity of the nucleotide sequences of KIAA0087 BINDING SITE, designated SEQ ID:1183, to the nucleotide sequence of GAM25 rNA, herein designated GAM RNA, also designated SEQ ID:206.

Another function of GAM25 is therefore inhibition of KIAA0087 (Accession NP_055584.1). Accordingly, utilities of GAM25 include diagnosis, prevention and treatment of diseases and clinical conditions associated with KIAA0087.

KIAA0391 (Accession NP_055487.1) is another GAM25 target gene, herein designated TARGET GENE. KIAA0391 BINDING SITE is a target binding site found in the 3' untranslated region of mRNA encoded by KIAA0391, corresponding to a target binding site such as BINDING SITE I, BINDING SITE II or BINDING SITE III of FIG. 8. Table 4 illustrates the complementarity of the nucleotide sequences of KIAA0391 BINDING SITE, designated SEQ ID:4805, to the nucleotide sequence of GAM25 rNA, herein designated GAM RNA, also designated SEQ ID:206.

Another function of GAM25 is therefore inhibition of KIAA0391 (Accession NP_055487.1). Accordingly, utilities of GAM25 include diagnosis, prevention and treatment of diseases and clinical conditions associated with KIAA0391.

KIAA0459 (Accession XP_027862.1) is another GAM25 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:6069, to the nucleotide sequence of GAM25 rNA, herein designated GAM RNA, also designated SEQ ID:206.

Another function of GAM25 is therefore inhibition of KIAA0459 (Accession XP_027862.1). Accordingly, utilities of GAM25 include diagnosis, prevention and treatment of diseases and clinical conditions associated with KIAA0459.

KIAA0475 (Accession NP_055679.1) is another GAM25 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:11244, to the nucleotide sequence of GAM25 rNA, herein designated GAM RNA, also designated SEQ ID:206.

Another function of GAM25 is therefore inhibition of KIAA0475 (Accession NP_055679.1). Accordingly, utilities of GAM25 include diagnosis, prevention and treatment of diseases and clinical conditions associated with KIAA0475.

KIAA0495 (Accession XP_031397.1) is another GAM25 target gene, herein designated TARGET GENE. KIAA0495 BINDING SITE is a target binding site found in the 3' untranslated region of mRNA encoded by KIAA0495, corresponding to a target binding site such as BINDING SITE I, BINDING SITE II or BINDING SITE III of FIG. 8. Table 4 illustrates the complementarity of the nucleotide sequences of KIAA0495 BINDING SITE, designated SEQ ID:10283, to the nucleotide sequence of GAM25 rNA, herein designated GAM RNA, also designated SEQ ID:206.

Another function of GAM25 is therefore inhibition of KIAA0495 (Accession XP_031397.1). Accordingly, utilities of GAM25 include diagnosis, prevention and treatment of diseases and clinical conditions associated with KIAA0495.

KIAA0513 (Accession NP_055547.1) is another GAM25 target gene, herein designated TARGET GENE. KIAA0513

BINDING SITE1 and KIAA0513 BINDING SITE2 are target binding sites found in untranslated regions of mRNA encoded by KIAA0513, corresponding to target binding sites such as BINDING SITE I, BINDING SITE II or BINDING SITE III of FIG. 8. Table 4 illustrates the complementarity of the nucleotide sequences of KIAA0513 BINDING SITE1 and KIAA0513 BINDING SITE2, designated SEQ ID:14774 and SEQ ID:13505 respectively, to the nucleotide sequence of GAM25 rNA, herein designated GAM RNA, also designated SEQ ID:206.

Another function of GAM25 is therefore inhibition of KIAA0513 (Accession NP_055547.1). Accordingly, utilities of GAM25 include diagnosis, prevention and treatment of diseases and clinical conditions associated with KIAA0513.

KIAA0557 (Accession XP_085507.1) is another GAM25 target gene, herein designated TARGET GENE. KIAA0557 BINDING SITE is a target binding site found in the 3' untranslated region of mRNA encoded by KIAA0557, corresponding to a target binding site such as BINDING SITE I, BINDING SITE II or BINDING SITE III of FIG. 8. Table 4 illustrates the complementarity of the nucleotide sequences of KIAA0557 BINDING SITE, designated SEQ ID:13127, to the nucleotide sequence of GAM25 rNA, herein designated GAM RNA, also designated SEQ ID:206.

Another function of GAM25 is therefore inhibition of KIAA0557 (Accession XP_085507.1). Accordingly, utilities of GAM25 include diagnosis, prevention and treatment of diseases and clinical conditions associated with KIAA0557.

KIAA0561 (Accession XP_038150.2) is another GAM25 target gene, herein designated TARGET GENE. KIAA0561 BINDING SITE is a target binding site found in the 3' untranslated region of mRNA encoded by KIAA0561, corresponding to a target binding site such as BINDING SITE I, BINDING SITE II or BINDING SITE III of FIG. 8. Table 4 illustrates the complementarity of the nucleotide sequences of KIAA0561 BINDING SITE, designated SEQ ID:14373, to the nucleotide sequence of GAM25 rNA, herein designated GAM RNA, also designated SEQ ID:206.

Another function of GAM25 is therefore inhibition of KIAA0561 (Accession XP_038150.2). Accordingly, utilities of GAM25 include diagnosis, prevention and treatment of diseases and clinical conditions associated with KIAA0561.

KIAA0605 (Accession NP_055509.1) is another GAM25 target gene, herein designated TARGET GENE. KIAA0605 BINDING SITE is a target binding site found in the 5' untranslated region of mRNA encoded by KIAA0605, corresponding to a target binding site such as BINDING SITE I, BINDING SITE II or BINDING SITE III of FIG. 8. Table 4 illustrates the complementarity of the nucleotide sequences of KIAA0605 BINDING SITE, designated SEQ ID:16135, to the nucleotide sequence of GAM25 rNA, herein designated GAM RNA, also designated SEQ ID:206.

Another function of GAM25 is therefore inhibition of KIAA0605 (Accession NP_055509.1). Accordingly, utilities of GAM25 include diagnosis, prevention and treatment of diseases and clinical conditions associated with KIAA0605.

KIAA0650 (Accession XP_113962.1) is another GAM25 target gene, herein designated TARGET GENE. KIAA0650 BINDING SITE is a target binding site found in the 3' untranslated region of mRNA encoded by KIAA0650, corresponding to a target binding site such as BINDING SITE I, BINDING SITE II or BINDING SITE III of FIG. 8. Table 4 illustrates the complementarity of the nucleotide sequences of KIAA0650 BINDING SITE, designated SEQ ID:1046, to the nucleotide sequence of GAM25 rNA, herein designated GAM RNA, also designated SEQ ID:206.

Another function of GAM25 is therefore inhibition of KIAA0650 (Accession XP_113962.1). Accordingly, utilities of GAM25 include diagnosis, prevention and treatment of diseases and clinical conditions associated with KIAA0650.

KIAA0663 (Accession NP_055642.1) is another GAM25 target gene, herein designated TARGET GENE. KIAA0663 BINDING SITE is a target binding site found in the 5' untranslated region of mRNA encoded by KIAA0663, corresponding to a target binding site such as BINDING SITE I, BINDING SITE II or BINDING SITE III of FIG. 8. Table 4 illustrates the complementarity of the nucleotide sequences of KIAA0663 BINDING SITE, designated SEQ ID:887, to the nucleotide sequence of GAM25 rNA, herein designated GAM RNA, also designated SEQ ID:206.

Another function of GAM25 is therefore inhibition of KIAA0663 (Accession NP_055642.1). Accordingly, utilities of GAM25 include diagnosis, prevention and treatment of diseases and clinical conditions associated with KIAA0663.

KIAA0682 (Accession NP_055667.1) is another GAM25 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:9165, to the nucleotide sequence of GAM25 rNA, herein designated GAM RNA, also designated SEQ ID:206.

Another function of GAM25 is therefore inhibition of KIAA0682 (Accession NP_055667.1). Accordingly, utilities of GAM25 include diagnosis, prevention and treatment of diseases and clinical conditions associated with KIAA0682.

KIAA0828 (Accession NP_056143.1) is another GAM25 target gene, herein designated TARGET GENE. KIAA0828 BINDING SITE is a target binding site found in the 3' untranslated region of mRNA encoded by KIAA0828, corresponding to a target binding site such as BINDING SITE I, BINDING SITE II or BINDING SITE III of FIG. 8. Table 4 illustrates the complementarity of the nucleotide sequences of KIAA0828 BINDING SITE, designated SEQ ID:8283, to the nucleotide sequence of GAM25 rNA, herein designated GAM RNA, also designated SEQ ID:206.

Another function of GAM25 is therefore inhibition of KIAA0828 (Accession NP_056143.1). Accordingly, utilities of GAM25 include diagnosis, prevention and treatment of diseases and clinical conditions associated with KIAA0828.

KIAA0831 (Accession NP_055739.1) is another GAM25 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:9780, to the nucleotide sequence of GAM25 rNA, herein designated GAM RNA, also designated SEQ ID:206.

Another function of GAM25 is therefore inhibition of KIAA0831 (Accession NP_055739.1). Accordingly, utilities of GAM25 include diagnosis, prevention and treatment of diseases and clinical conditions associated with KIAA0831.

KIAA0889 (Accession NP_056192.1) is another GAM25 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:18023, to the nucleotide sequence of GAM25 rNA, herein designated GAM RNA, also designated SEQ ID:206.

Another function of GAM25 is therefore inhibition of KIAA0889 (Accession NP_056192.1). Accordingly, utilities of GAM25 include diagnosis, prevention and treatment of diseases and clinical conditions associated with KIAA0889.

KIAA0924 (Accession NP_055712.1) is another GAM25 target gene, herein designated TARGET GENE. KIAA0924 BINDING SITE is a target binding site found in the 3' untranslated region of mRNA encoded by KIAA0924, corresponding to a target binding site such as BINDING SITE I, BINDING SITE II or BINDING SITE III of FIG. 8. Table 4 illustrates the complementarity of the nucleotide sequences of KIAA0924 BINDING SITE, designated SEQ ID:13300, to the nucleotide sequence of GAM25 rNA, herein designated GAM RNA, also designated SEQ ID:206.

Another function of GAM25 is therefore inhibition of KIAA0924 (Accession NP_055712.1). Accordingly, utilities of GAM25 include diagnosis, prevention and treatment of diseases and clinical conditions associated with KIAA0924.

KIAA0935 (Accession XP_052620.6) is another GAM25 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:7586, to the nucleotide sequence of GAM25 rNA, herein designated GAM RNA, also designated SEQ ID:206.

Another function of GAM25 is therefore inhibition of KIAA0935 (Accession XP_052620.6). Accordingly, utilities of GAM25 include diagnosis, prevention and treatment of diseases and clinical conditions associated with KIAA0935.

KIAA0962 (Accession XP_290942.1) is another GAM25 target gene, herein designated TARGET GENE. KIAA0962 BINDING SITE is a target binding site found in the 3' untranslated region of mRNA encoded by KIAA0962, corresponding to a target binding site such as BINDING SITE I, BINDING SITE II or BINDING SITE III of FIG. 8. Table 4 illustrates the complementarity of the nucleotide sequences of KIAA0962 BINDING SITE, designated SEQ ID:8363, to the nucleotide sequence of GAM25 rNA, herein designated GAM RNA, also designated SEQ ID:206.

Another function of GAM25 is therefore inhibition of KIAA0962 (Accession XP_290942.1). Accordingly, utilities of GAM25 include diagnosis, prevention and treatment of diseases and clinical conditions associated with KIAA0962.

KIAA1002 (Accession XP_290584.1) is another GAM25 target gene, herein designated TARGET GENE. KIAA1002 BINDING SITE is a target binding site found in the 3' untranslated region of mRNA encoded by KIAA1002, corresponding to a target binding site such as BINDING SITE I, BINDING SITE II or BINDING SITE III of FIG. 8. Table 4 illustrates the complementarity of the nucleotide sequences of KIAA1002 BINDING SITE, designated SEQ ID:18510, to the nucleotide sequence of GAM25 rNA, herein designated GAM RNA, also designated SEQ ID:206.

Another function of GAM25 is therefore inhibition of KIAA1002 (Accession XP_290584.1). Accordingly, utilities of GAM25 include diagnosis, prevention and treatment of diseases and clinical conditions associated with KIAA1002.

KIAA1040 (Accession XP_051091.3) is another GAM25 target gene, herein designated TARGET GENE. KIAA1040 BINDING SITE is a target binding site found in the 3' untranslated region of mRNA encoded by KIAA1040, corresponding to a target binding site such as BINDING SITE I, BINDING SITE II or BINDING SITE III of FIG. 8. Table 4 illustrates the complementarity of the nucleotide sequences of KIAA1040 BINDING SITE, designated SEQ ID:19942, to the nucleotide sequence of GAM25 rNA, herein designated GAM RNA, also designated SEQ ID:206.

Another function of GAM25 is therefore inhibition of KIAA1040 (Accession XP_051091.3). Accordingly, utilities of GAM25 include diagnosis, prevention and treatment of diseases and clinical conditions associated with KIAA1040.

KIAA1041 (Accession NP_055762.1) is another GAM25 target gene, herein designated TARGET GENE. KIAA1041 BINDING SITE is a target binding site found in the 3' untranslated region of mRNA encoded by KIAA1041, corresponding to a target binding site such as BINDING SITE I, BINDING SITE II or BINDING SITE III of FIG. 8. Table 4 illustrates the complementarity of the nucleotide sequences of KIAA1041 BINDING SITE, designated SEQ ID:16595, to the nucleotide sequence of GAM25 rNA, herein designated GAM RNA, also designated SEQ ID:206.

Another function of GAM25 is therefore inhibition of KIAA1041 (Accession NP_055762.1). Accordingly, utilities of GAM25 include diagnosis, prevention and treatment of diseases and clinical conditions associated with KIAA1041.

KIAA1170 (Accession XP_045907.2) is another GAM25 target gene, herein designated TARGET GENE. KIAA1170 BINDING SITE is a target binding site found in the 3' untranslated region of mRNA encoded by KIAA1170, corresponding to a target binding site such as BINDING SITE I, BINDING SITE II or BINDING SITE III of FIG. 8. Table 4 illustrates the complementarity of the nucleotide sequences of KIAA1170 BINDING SITE, designated SEQ ID:17183, to the nucleotide sequence of GAM25 rNA, herein designated GAM RNA, also designated SEQ ID:206.

Another function of GAM25 is therefore inhibition of KIAA1170 (Accession XP_045907.2). Accordingly, utilities of GAM25 include diagnosis, prevention and treatment of diseases and clinical conditions associated with KIAA1170.

KIAA1185 (Accession NP_065761.1) is another GAM25 target gene, herein designated TARGET GENE. KIAA1185 BINDING SITE is a target binding site found in the 3' untranslated region of mRNA encoded by KIAA1185, corresponding to a target binding site such as BINDING SITE I, BINDING SITE II or BINDING SITE III of FIG. 8. Table 4 illustrates the complementarity of the nucleotide sequences of KIAA1185 BINDING SITE, designated SEQ ID:7542, to the nucleotide sequence of GAM25 rNA, herein designated GAM RNA, also designated SEQ ID:206.

Another function of GAM25 is therefore inhibition of KIAA1185 (Accession NP_065761.1). Accordingly, utilities of GAM25 include diagnosis, prevention and treatment of diseases and clinical conditions associated with KIAA1185.

KIAA1198 (Accession NP_065765.1) is another GAM25 target gene, herein designated TARGET GENE. KIAA1198 BINDING SITE1 through KIAA1198 BINDING SITE3 are target binding sites found in untranslated regions of mRNA encoded by KIAA1198, corresponding to target binding sites such as BINDING SITE I, BINDING SITE II or BINDING SITE III of FIG. 8. Table 4 illustrates the complementarity of the nucleotide sequences of KIAA1198 BINDING SITE1 through KIAA1198 BINDING SITE3, designated SEQ ID:17079, SEQ ID:14842 and SEQ ID:9534 respectively, to the nucleotide sequence of GAM25 rNA, herein designated GAM RNA, also designated SEQ ID:206.

Another function of GAM25 is therefore inhibition of KIAA1198 (Accession NP_065765.1). Accordingly, utilities of GAM25 include diagnosis, prevention and treatment of diseases and clinical conditions associated with KIAA1198.

KIAA1257 (Accession XP_031577.2) is another GAM25 target gene, herein designated TARGET GENE. KIAA1257 BINDING SITE is a target binding site found in the 3' untranslated region of mRNA encoded by KIAA1257, corresponding to a target binding site such as BINDING SITE I, BINDING SITE II or BINDING SITE III of FIG. 8. Table 4 illustrates the complementarity of the nucleotide sequences of KIAA1257 BINDING SITE, designated SEQ ID:17183, to the nucleotide sequence of GAM25 rNA, herein designated GAM RNA, also designated SEQ ID:206.

Another function of GAM25 is therefore inhibition of KIAA1257 (Accession XP_031577.2). Accordingly, utilities of GAM25 include diagnosis, prevention and treatment of diseases and clinical conditions associated with KIAA1257.

KIAA1268 (Accession XP_291055.1) is another GAM25 target gene, herein designated TARGET GENE. KIAA1268 BINDING SITE is a target binding site found in the 3' untranslated region of mRNA encoded by KIAA1268, corresponding to a target binding site such as BINDING SITE I, BINDING SITE II or BINDING SITE III of FIG. 8. Table 4 illustrates the complementarity of the nucleotide sequences of KIAA1268 BINDING SITE, designated SEQ ID:11503, to the nucleotide sequence of GAM25 rNA, herein designated GAM RNA, also designated SEQ ID:206.

Another function of GAM25 is therefore inhibition of KIAA1268 (Accession XP_291055.1). Accordingly, utilities of GAM25 include diagnosis, prevention and treatment of diseases and clinical conditions associated with KIAA1268.

KIAA1273 (Accession XP_300760.1) is another GAM25 target gene, herein designated TARGET GENE. KIAA1273 BINDING SITE is a target binding site found in the 5' untranslated region of mRNA encoded by KIAA1273, corresponding to a target binding site such as BINDING SITE I, BINDING SITE II or BINDING SITE III of FIG. 8. Table 4 illustrates the complementarity of the nucleotide sequences of KIAA1273 BINDING SITE, designated SEQ ID:16475, to the nucleotide sequence of GAM25 rNA, herein designated GAM RNA, also designated SEQ ID:206.

Another function of GAM25 is therefore inhibition of KIAA1273 (Accession XP_300760.1). Accordingly, utilities of GAM25 include diagnosis, prevention and treatment of diseases and clinical conditions associated with KIAA1273.

KIAA1465 (Accession XP_027396.4) is another GAM25 target gene, herein designated TARGET GENE. KIAA1465 BINDING SITE is a target binding site found in the 3' untranslated region of mRNA encoded by KIAA1465, corresponding to a target binding site such as BINDING SITE I, BINDING SITE II or BINDING SITE III of FIG. 8. Table 4 illustrates the complementarity of the nucleotide sequences of KIAA1465 BINDING SITE, designated SEQ ID:11959, to the nucleotide sequence of GAM25 rNA, herein designated GAM RNA, also designated SEQ ID:206.

Another function of GAM25 is therefore inhibition of KIAA1465 (Accession XP_027396.4). Accordingly, utilities of GAM25 include diagnosis, prevention and treatment of diseases and clinical conditions associated with KIAA1465.

KIAA1493 (Accession XP_034415.1) is another GAM25 target gene, herein designated TARGET GENE. KIAA1493 BINDING SITE is a target binding site found in the 3' untranslated region of mRNA encoded by KIAA1493, corresponding to a target binding site such as BINDING SITE I, BINDING SITE II or BINDING SITE III of FIG. 8. Table 4 illustrates the complementarity of the nucleotide sequences of KIAA1493 BINDING SITE, designated SEQ ID:6658, to the nucleotide sequence of GAM25 rNA, herein designated GAM RNA, also designated SEQ ID:206.

Another function of GAM25 is therefore inhibition of KIAA1493 (Accession XP_034415.1). Accordingly, utilities of GAM25 include diagnosis, prevention and treatment of diseases and clinical conditions associated with KIAA1493.

KIAA1530 (Accession XP_042661.5) is another GAM25 target gene, herein designated TARGET GENE. KIAA1530 BINDING SITE is a target binding site found in the 3' untranslated region of mRNA encoded by KIAA1530, corresponding to a target binding site such as BINDING SITE I, BINDING SITE II or BINDING SITE III of FIG. 8. Table 4 illustrates the complementarity of the nucleotide sequences of KIAA1530 BINDING SITE, designated SEQ ID:2247, to the nucleotide sequence of GAM25 rNA, herein designated GAM RNA, also designated SEQ ID:206.

Another function of GAM25 is therefore inhibition of KIAA1530 (Accession XP_042661.5). Accordingly, utilities of GAM25 include diagnosis, prevention and treatment of diseases and clinical conditions associated with KIAA1530.

KIAA1571 (Accession XP_027744.1) is another GAM25 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:13505, to the nucleotide sequence of GAM25 rNA, herein designated GAM RNA, also designated SEQ ID:206.

Another function of GAM25 is therefore inhibition of KIAA1571 (Accession XP_027744.1). Accordingly, utilities of GAM25 include diagnosis, prevention and treatment of diseases and clinical conditions associated with KIAA1571.

KIAA1615 (Accession NP_066002.1) is another GAM25 target gene, herein designated TARGET GENE. KIAA1615 BINDING SITE is a target binding site found in the 3' untranslated region of mRNA encoded by KIAA1615, corresponding to a target binding site such as BINDING SITE I, BINDING SITE II or BINDING SITE III of FIG. 8. Table 4 illustrates the complementarity of the nucleotide sequences of KIAA1615 BINDING SITE, designated SEQ ID:16197, to the nucleotide sequence of GAM25 rNA, herein designated GAM RNA, also designated SEQ ID:206.

Another function of GAM25 is therefore inhibition of KIAA1615 (Accession NP_066002.1). Accordingly, utilities of GAM25 include diagnosis, prevention and treatment of diseases and clinical conditions associated with KIAA1615.

KIAA1671 (Accession XP_037809.1) is another GAM25 target gene, herein designated TARGET GENE. KIAA1671 BINDING SITE1 and KIAA1671 BINDING SITE2 are target binding sites found in untranslated regions of mRNA encoded by KIAA1671, corresponding to target binding sites such as BINDING SITE I, BINDING SITE II or BINDING SITE III of FIG. 8. Table 4 illustrates the complementarity of the nucleotide sequences of KIAA1671 BINDING SITE1 and KIAA1671 BINDING SITE2, designated SEQ ID:613 and SEQ ID:6719 respectively, to the nucleotide sequence of GAM25 rNA, herein designated GAM RNA, also designated SEQ ID:206.

Another function of GAM25 is therefore inhibition of KIAA1671 (Accession XP_037809.1). Accordingly, utilities of GAM25 include diagnosis, prevention and treatment of diseases and clinical conditions associated with KIAA1671.

KIAA1737 (Accession NP_219494.1) is another GAM25 target gene, herein designated TARGET GENE. KIAA1737 BINDING SITE is a target binding site found in the 3' untranslated region of mRNA encoded by KIAA1737, corresponding to a target binding site such as BINDING SITE I, BINDING SITE II or BINDING SITE III of FIG. 8. Table 4 illustrates the complementarity of the nucleotide sequences of KIAA1737 BINDING SITE, designated SEQ ID:1130, to the nucleotide sequence of GAM25 rNA, herein designated GAM RNA, also designated SEQ ID:206.

Another function of GAM25 is therefore inhibition of KIAA1737 (Accession NP_219494.1). Accordingly, utilities of GAM25 include diagnosis, prevention and treatment of diseases and clinical conditions associated with KIAA1737.

KIAA1784 (Accession NP_115820.1) is another GAM25 target gene, herein designated TARGET GENE. KIAA1784 BINDING SITE is a target binding site found in the 3' untranslated region of mRNA encoded by KIAA1784, corresponding to a target binding site such as BINDING SITE I, BINDING SITE II or BINDING SITE III of FIG. 8. Table 4 illustrates the complementarity of the nucleotide sequences of KIAA1784 BINDING SITE, designated SEQ ID:16595, to the nucleotide sequence of GAM25 rNA, herein designated GAM RNA, also designated SEQ ID:206.

Another function of GAM25 is therefore inhibition of KIAA1784 (Accession NP_115820.1). Accordingly, utilities of GAM25 include diagnosis, prevention and treatment of diseases and clinical conditions associated with KIAA1784.

KIAA1827 (Accession XP_290834.1) is another GAM25 target gene, herein designated TARGET GENE. KIAA1827 BINDING SITE is a target binding site found in the 3' untranslated region of mRNA encoded by KIAA1827, corresponding to a target binding site such as BINDING SITE I, BINDING SITE II or BINDING SITE III of FIG. 8. Table 4 illustrates the complementarity of the nucleotide sequences of KIAA1827 BINDING SITE, designated SEQ ID:16595, to the nucleotide sequence of GAM25 rNA, herein designated GAM RNA, also designated SEQ ID:206.

Another function of GAM25 is therefore inhibition of KIAA1827 (Accession XP_290834.1). Accordingly, utilities of GAM25 include diagnosis, prevention and treatment of diseases and clinical conditions associated with KIAA1827.

KIAA1836 (Accession XP_114087.2) is another GAM25 target gene, herein designated TARGET GENE. KIAA1836 BINDING SITE is a target binding site found in the 3' untranslated region of mRNA encoded by KIAA1836, corresponding to a target binding site such as BINDING SITE I, BINDING SITE II or BINDING SITE III of FIG. 8. Table 4 illustrates the complementarity of the nucleotide sequences of KIAA1836 BINDING SITE, designated SEQ ID:4984, to the nucleotide sequence of GAM25 rNA, herein designated GAM RNA, also designated SEQ ID:206.

Another function of GAM25 is therefore inhibition of KIAA1836 (Accession XP_114087.2). Accordingly, utilities of GAM25 include diagnosis, prevention and treatment of diseases and clinical conditions associated with KIAA1836.

KIAA1971 (Accession XP_058720.4) is another GAM25 target gene, herein designated TARGET GENE. KIAA1971 BINDING SITE is a target binding site found in the 3' untranslated region of mRNA encoded by KIAA1971, corresponding to a target binding site such as BINDING SITE I, BINDING SITE II or BINDING SITE III of FIG. 8. Table 4 illustrates the complementarity of the nucleotide sequences of KIAA1971 BINDING SITE, designated SEQ ID:9625, to the nucleotide sequence of GAM25 rNA, herein designated GAM RNA, also designated SEQ ID:206.

Another function of GAM25 is therefore inhibition of KIAA1971 (Accession XP_058720.4). Accordingly, utilities of GAM25 include diagnosis, prevention and treatment of diseases and clinical conditions associated with KIAA1971.

KIAA1987 (Accession XP_113870.1) is another GAM25 target gene, herein designated TARGET GENE. KIAA1987 BINDING SITE is a target binding site found in the 5' untranslated region of mRNA encoded by KIAA1987, corresponding to a target binding site such as BINDING SITE I, BINDING SITE II or BINDING SITE III of FIG. 8. Table 4 illustrates the complementarity of the nucleotide sequences of KIAA1987 BINDING SITE, designated SEQ ID:3377, to the nucleotide sequence of GAM25 rNA, herein designated GAM RNA, also designated SEQ ID:206.

Another function of GAM25 is therefore inhibition of KIAA1987 (Accession XP_113870.1). Accordingly, utilities of GAM25 include diagnosis, prevention and treatment of diseases and clinical conditions associated with KIAA1987.

KIAA2028 (Accession XP_059415.2) is another GAM25 target gene, herein designated TARGET GENE. KIAA2028 BINDING SITE1 and KIAA2028 BINDING SITE2 are target binding sites found in untranslated regions of mRNA encoded by KIAA2028, corresponding to target binding sites such as BINDING SITE I, BINDING SITE II or BINDING SITE III of FIG. 8. Table 4 illustrates the complementarity of the nucleotide sequences of KIAA2028 BINDING SITE1 and KIAA2028 BINDING SITE2, designated SEQ ID:3481 and SEQ ID:4224 respectively, to the nucleotide sequence of GAM25 rNA, herein designated GAM RNA, also designated SEQ ID:206.

Another function of GAM25 is therefore inhibition of KIAA2028 (Accession XP_059415.2). Accordingly, utilities of GAM25 include diagnosis, prevention and treatment of diseases and clinical conditions associated with KIAA2028.

Kallikrein 7 (chymotryptic, stratum corneum) (KLK7, Accession NP_005037.1) is another GAM25 target gene, herein designated TARGET GENE. KLK7 BINDING SITE is a target binding site found in the 3' untranslated region of multiple transcripts of mRNA encoded by KLK7, corresponding to a target binding site such as BINDING SITE I, BINDING SITE II or BINDING SITE III of FIG. 8. Table 4 illustrates the complementarity of the nucleotide sequences of KLK7 BINDING SITE, designated SEQ ID:2523, to the nucleotide sequence of GAM25 rNA, herein designated GAM RNA, also designated SEQ ID:206.

Another function of GAM25 is therefore inhibition of Kallikrein 7 (chymotryptic, stratum corneum) (KLK7, Accession NP_005037.1). Accordingly, utilities of GAM25 include diagnosis, prevention and treatment of diseases and clinical conditions associated with KLK7.

Kallikrein 7 (chymotryptic, stratum corneum) (KLK7, Accession NP_644806.1) is another GAM25 target gene, herein designated TARGET GENE. KLK7 BINDING SITE is a target binding site found in the 3' untranslated region of multiple transcripts of mRNA encoded by KLK7, corresponding to a target binding site such as BINDING SITE I, BINDING SITE II or BINDING SITE III of FIG. 8. Table 4 illustrates the complementarity of the nucleotide sequences of KLK7 BINDING SITE, designated SEQ ID:2523, to the nucleotide sequence of GAM25 rNA, herein designated GAM RNA, also designated SEQ ID:206.

Another function of GAM25 is therefore inhibition of Kallikrein 7 (chymotryptic, stratum corneum) (KLK7, Accession NP_644806.1). Accordingly, utilities of GAM25 include diagnosis, prevention and treatment of diseases and clinical conditions associated with KLK7.

Kinase suppressor of ras (KSR, Accession XP_290793.1) is another GAM25 target gene, herein designated TARGET GENE. KSR BINDING SITE is a target binding site found in the 5' untranslated region of mRNA encoded by KSR, corresponding to a target binding site such as BINDING SITE I, BINDING SITE II or BINDING SITE III of FIG. 8. Table 4 illustrates the complementarity of the nucleotide sequences of KSR BINDING SITE, designated SEQ ID:9413, to the nucleotide sequence of GAM25 RNA, herein designated GAM RNA, also designated SEQ ID:206.

Another function of GAM25 is therefore inhibition of Kinase suppressor of ras (KSR, Accession XP_290793.1). Accordingly, utilities of GAM25 include diagnosis, prevention and treatment of diseases and clinical conditions associated with KSR.

Lysosomal-associated membrane protein 3 (LAMP3, Accession NP_055213.1) is another GAM25 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:3444, to the nucleotide sequence of GAM25 rNA, herein designated GAM RNA, also designated SEQ ID:206.

Another function of GAM25 is therefore inhibition of Lysosomal-associated membrane protein 3 (LAMP3, Accession NP_055213.1). Accordingly, utilities of GAM25 include diagnosis, prevention and treatment of diseases and clinical conditions associated with LAMP3.

LIPT1 (Accession NP_057013.1) is another GAM25 target gene, herein designated TARGET GENE. LIPT1 BINDING SITE is a target binding site found in the 5' untranslated region of multiple transcripts of mRNA encoded by LIPT1, corresponding to a target binding site such as BINDING SITE I, BINDING SITE II or BINDING SITE III of FIG. 8. Table 4 illustrates the complementarity of the nucleotide sequences of LIPT1 BINDING SITE, designated SEQ ID:6069, to the nucleotide sequence of GAM25 rNA, herein designated GAM RNA, also designated SEQ ID:206.

Another function of GAM25 is therefore inhibition of LIPT1 (Accession NP_057013.1). Accordingly, utilities of GAM25 include diagnosis, prevention and treatment of diseases and clinical conditions associated with LIPT1.

LIPT1 (Accession NP_660198.1) is another GAM25 target gene, herein designated TARGET GENE. LIPT1 BINDING SITE is a target binding site found in the 5' untranslated region of multiple transcripts of mRNA encoded by LIPT1, corresponding to a target binding site such as BINDING SITE I, BINDING SITE II or BINDING SITE III of FIG. 8. Table 4 illustrates the complementarity of the nucleotide sequences of LIPT1 BINDING SITE, designated SEQ ID:6069, to the nucleotide sequence of GAM25 rNA, herein designated GAM RNA, also designated SEQ ID:206.

Another function of GAM25 is therefore inhibition of LIPT1 (Accession NP_660198.1). Accordingly, utilities of GAM25 include diagnosis, prevention and treatment of diseases and clinical conditions associated with LIPT1.

LIPT1 (Accession NP_660199.1) is another GAM25 target gene, herein designated TARGET GENE. LIPT1 BINDING SITE is a target binding site found in the 5' untranslated region of multiple transcripts of mRNA encoded by LIPT1, corresponding to a target binding site such as BINDING SITE I, BINDING SITE II or BINDING SITE III of FIG. 8. Table 4 illustrates the complementarity of the nucleotide sequences of LIPT1 BINDING SITE, designated SEQ ID:6069, to the nucleotide sequence of GAM25 rNA, herein designated GAM RNA, also designated SEQ ID:206.

Another function of GAM25 is therefore inhibition of LIPT1 (Accession NP_660199.1). Accordingly, utilities of GAM25 include diagnosis, prevention and treatment of diseases and clinical conditions associated with LIPT1.

LNIR (Accession NP_112178.1) is another GAM25 target gene, herein designated TARGET GENE. LNIR BINDING SITE is a target binding site found in the 3' untranslated region of mRNA encoded by LNIR, corresponding to a target binding site such as BINDING SITE I, BINDING SITE II or BINDING SITE III of FIG. 8. Table 4 illustrates the complementarity of the nucleotide sequences of LNIR BINDING SITE, designated SEQ ID:14735, to the nucleotide sequence of GAM25 rNA, herein designated GAM RNA, also designated SEQ ID:206.

Another function of GAM25 is therefore inhibition of LNIR (Accession NP_112178.1). Accordingly, utilities of GAM25 include diagnosis, prevention and treatment of diseases and clinical conditions associated with LNIR.

LNK (Accession NP_005466.1) is another GAM25 target gene, herein designated TARGET GENE. LNK BINDING SITE1 and LNK BINDING SITE2 are target binding sites found in untranslated regions of mRNA encoded by LNK, corresponding to target binding sites such as BINDING SITE I, BINDING SITE II or BINDING SITE III of FIG. 8. Table 4 illustrates the complementarity of the nucleotide sequences of LNK BINDING SITE1 and LNK BINDING SITE2, designated SEQ ID:6553 and SEQ ID:19673 respectively, to the nucleotide sequence of GAM25 RNA, herein designated GAM RNA, also designated SEQ ID:206.

Another function of GAM25 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM25 include diagnosis, prevention and treatment of diseases and clinical conditions associated with LNK.

The function of LNK has been established by previous studies. By PCR using primers based on the rat Lnk sequence and by screening a Jurkat cDNA library, Li et al. (2000) obtained a cDNA encoding human LNK. Sequence analysis predicted that the 575-amino acid LNK protein contains an N-terminal proline-rich region, a pleckstrin homology (PH) domain, and an Src homology 2 (SH2) domain; the PH and SH2 domains are similar to those of the APS protein. Northern blot analysis detected low expression of a 6.8-kb LNK transcript in various lymphoid cell lines. Confocal fluorescence microscopy showed that the majority of LNK is located in the juxtanuclear region with some found near the plasma membrane. Immunoprecipitation analysis demonstrated that LNK is phosphorylated by LCK (OMIM Ref. No. 153390) but not by SYK (OMIM Ref. No. 600085) and that LNK binds to the tyrosine-phosphorylated TCR zeta chain via its SH2 domain. Functional analysis indicated that LNK inhibits the activation of NFAT (see OMIM Ref. No. 600489) in stimulated T cells Animal model experiments lend further support to the function of LNK. Takaki et al. (2000) generated Lnk-deficient mice and found that although they had unimpaired T-cell development in thymus, pre-B and immature B cells accumulated in enlarged spleens. In bone marrow, there was also an increase in B-lineage cells, reflecting enhanced production of B-cell progenitors due in part to hypersensitivity to SCF (KITLG; 184745) in the presence or absence of IL7 (OMIM Ref. No. 146660). Western blot analysis showed that mouse Lnk is actually a 68-kD protein It is appreciated that the abovementioned animal model for LNK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, Y.; He, X.; Schembri-King, J.; Jakes, S.; Hayashi, J.: Cloning and characterization of human Lnk, an adaptor protein with pleckstrin homology and Src homology 2 domains that can inhibit T cell activation. J. Immun. 164: 5199-5206, 2000; and Takaki, S.; Sauer, K.; Iritani, B. M.; Chien, S.; Ebihara, Y.; Tsuji, K.; Takatsu, K.; Perlmutter, R. M.: Control of B cell production by the adaptor protein Lnk: definition of a conserve.

Further studies establishing the function and utilities of LNK are found in John Hopkins OMIM database record ID 605093, and in cited publications listed in Table 5, which are hereby incorporated by reference. LOC112817 (Accession NP_612422.2) is another GAM25 target gene, herein designated TARGET GENE. LOC112817 BINDING SITE is a target binding site found in the 3' untranslated region of mRNA encoded by LOC112817, corresponding to a target binding site such as BINDING SITE I, BINDING SITE II or BINDING SITE III of FIG. 8. Table 4 illustrates the complementarity of the nucleotide sequences of LOC112817 BINDING SITE, designated SEQ ID:19177, to the nucleotide sequence of GAM25 RNA, herein designated GAM RNA, also designated SEQ ID:206.

Another function of GAM25 is therefore inhibition of LOC112817 (Accession NP_612422.2). Accordingly, utilities of GAM25 include diagnosis, prevention and treatment of diseases and clinical conditions associated with LOC112817.

LOC113444 (Accession NP_612437.2) is another GAM25 target gene, herein designated TARGET GENE. LOC113444 BINDING SITE1 and LOC113444 BINDING SITE2 are target binding sites found in untranslated regions of mRNA encoded by LOC113444, corresponding to target binding sites such as BINDING SITE I, BINDING SITE II or BINDING SITE III of FIG. 8. Table 4 illustrates the complementarity of the nucleotide sequences of LOC113444 BINDING SITE1 and LOC113444 BINDING SITE2, designated SEQ ID:4156 and SEQ ID:7668 respectively, to the nucleotide sequence of GAM25 rNA, herein designated GAM RNA, also designated SEQ ID:206.

Another function of GAM25 is therefore inhibition of LOC113444 (Accession NP_612437.2). Accordingly, utilities of GAM25 include diagnosis, prevention and treatment of diseases and clinical conditions associated with LOC113444.

LOC115098 (Accession NP_612451.1) is another GAM25 target gene, herein designated TARGET GENE. LOC115098 BINDING SITE is a target binding site found in the 5' untranslated region of mRNA encoded by LOC115098, corresponding to a target binding site such as BINDING SITE I, BINDING SITE II or BINDING SITE III of FIG. 8. Table 4 illustrates the complementarity of the nucleotide sequences of LOC115098 BINDING SITE, designated SEQ ID:5447, to the nucleotide sequence of GAM25 rNA, herein designated GAM RNA, also designated SEQ ID:206.

Another function of GAM25 is therefore inhibition of LOC115098 (Accession NP_612451.1). Accordingly, utilities of GAM25 include diagnosis, prevention and treatment of diseases and clinical conditions associated with LOC115098.

LOC115219 (Accession XP_055499.2) is another GAM25 target gene, herein designated TARGET GENE. LOC115219 BINDING SITE is a target binding site found in the 5' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:19046, to the nucleotide sequence of GAM25 rNA, herein designated GAM RNA, also designated SEQ ID:206.

Another function of GAM25 is therefore inhibition of LOC115219 (Accession XP_055499.2). Accordingly, utilities of GAM25 include diagnosis, prevention and treatment of diseases and clinical conditions associated with LOC115219.

LOC115648 (Accession NP_663299.1) is another GAM25 target gene, herein designated TARGET GENE. LOC115648 BINDING SITE is a target binding site found in the 3' untranslated region of mRNA encoded by LOC115648, corresponding to a target binding site such as BINDING SITE I, BINDING SITE II or BINDING SITE III of FIG. 8. Table 4 illustrates the complementarity of the nucleotide sequences of LOC115648 BINDING SITE, designated SEQ ID:6718, to the nucleotide sequence of GAM25 rNA, herein designated GAM RNA, also designated SEQ ID:206.

Another function of GAM25 is therefore inhibition of LOC115648 (Accession NP_663299.1). Accordingly, utilities of GAM25 include diagnosis, prevention and treatment of diseases and clinical conditions associated with LOC115648.

LOC118490 (Accession XP_060981.3) is another GAM25 target gene, herein designated TARGET GENE. LOC118490 BINDING SITE is a target binding site found in the 3' untranslated region of mRNA encoded by LOC118490, corresponding to a target binding site such as BINDING SITE I, BINDING SITE II or BINDING SITE III of FIG. 8. Table 4 illustrates the complementarity of the nucleotide sequences of LOC118490 BINDING SITE, designated SEQ ID:1129, to the nucleotide sequence of GAM25 rNA, herein designated GAM RNA, also designated SEQ ID:206.

Another function of GAM25 is therefore inhibition of LOC118490 (Accession XP_060981.3). Accordingly, utilities of GAM25 include diagnosis, prevention and treatment of diseases and clinical conditions associated with LOC118490.

LOC120526 (Accession XP_058475.1) is another GAM25 target gene, herein designated TARGET GENE. LOC120526 BINDING SITE is a target binding site found in the 3' untranslated region of mRNA encoded by LOC120526, corresponding to a target binding site such as BINDING SITE I, BINDING SITE II or BINDING SITE III of FIG. 8. Table 4 illustrates the complementarity of the nucleotide sequences of LOC120526 BINDING SITE, designated SEQ ID:5254, to the nucleotide sequence of GAM25 rNA, herein designated GAM RNA, also designated SEQ ID:206.

Another function of GAM25 is therefore inhibition of LOC120526 (Accession XP_058475.1). Accordingly, utilities of GAM25 include diagnosis, prevention and treatment of diseases and clinical conditions associated with LOC120526.

LOC125061 (Accession XP_058889.3) is another GAM25 target gene, herein designated TARGET GENE. LOC125061 BINDING SITE is a target binding site found in the 3' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:13505, to the nucleotide sequence of GAM25 rNA, herein designated GAM RNA, also designated SEQ ID:206.

Another function of GAM25 is therefore inhibition of LOC125061 (Accession XP_058889.3). Accordingly, utilities of GAM25 include diagnosis, prevention and treatment of diseases and clinical conditions associated with LOC125061.

LOC126669 (Accession XP_060121.4) is another GAM25 target gene, herein designated TARGET GENE. LOC126669 BINDING SITE is a target binding site found in the 3' untranslated region of mRNA encoded by LOC126669, corresponding to a target binding site such as BINDING SITE I, BINDING SITE II or BINDING SITE III of FIG. 8. Table 4 illustrates the complementarity of the nucleotide sequences of LOC126669 BINDING SITE, designated SEQ ID:5257, to the nucleotide sequence of GAM25 rNA, herein designated GAM RNA, also designated SEQ ID:206.

Another function of GAM25 is therefore inhibition of LOC126669 (Accession XP_060121.4). Accordingly, utilities of GAM25 include diagnosis, prevention and treatment of diseases and clinical conditions associated with LOC126669.

LOC132241 (Accession XP_059583.1) is another GAM25 target gene, herein designated TARGET GENE. LOC132241 BINDING SITE is a target binding site found in the 5' untranslated region of mRNA encoded by LOC132241, corresponding to a target binding site such as BINDING SITE I, BINDING SITE II or BINDING SITE III of FIG. 8. Table 4 illustrates the complementarity of the nucleotide sequences of LOC132241 BINDING SITE, designated SEQ ID:7296, to the nucleotide sequence of GAM25 rNA, herein designated GAM RNA, also designated SEQ ID:206.

Another function of GAM25 is therefore inhibition of LOC132241 (Accession XP_059583.1). Accordingly, utilities of GAM25 include diagnosis, prevention and treatment of diseases and clinical conditions associated with LOC132241.

LOC135293 (Accession XP_072402.4) is another GAM25 target gene, herein designated TARGET GENE. LOC135293 BINDING SITE is a target binding site found in the 3' untranslated region of mRNA encoded by LOC135293, corresponding to a target binding site such as BINDING SITE I, BINDING SITE II or BINDING SITE III of FIG. 8. Table 4 illustrates the complementarity of the nucleotide sequences of LOC135293 BINDING SITE, designated SEQ ID:19636, to the nucleotide sequence of GAM25 rNA, herein designated GAM RNA, also designated SEQ ID:206.

Another function of GAM25 is therefore inhibition of LOC135293 (Accession XP_072402.4). Accordingly, utilities of GAM25 include diagnosis, prevention and treatment of diseases and clinical conditions associated with LOC135293.

LOC135763 (Accession NP_612639.1) is another GAM25 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:11364, to the nucleotide sequence of GAM25 rNA, herein designated GAM RNA, also designated SEQ ID:206.

Another function of GAM25 is therefore inhibition of LOC135763 (Accession NP_612639.1). Accordingly, utilities of GAM25 include diagnosis, prevention and treatment of diseases and clinical conditions associated with LOC135763.

LOC144481 (Accession XP_096611.2) is another GAM25 target gene, herein designated TARGET GENE. LOC144481 BINDING SITE is a target binding site found in the 3' untranslated region of mRNA encoded by LOC144481, corresponding to a target binding site such as BINDING SITE I, BINDING SITE II or BINDING SITE III of FIG. 8. Table 4 illustrates the complementarity of the nucleotide sequences of LOC144481 BINDING SITE, designated SEQ ID:6245, to the nucleotide sequence of GAM25 rNA, herein designated GAM RNA, also designated SEQ ID:206.

Another function of GAM25 is therefore inhibition of LOC144481 (Accession XP_096611.2). Accordingly, utilities of GAM25 include diagnosis, prevention and treatment of diseases and clinical conditions associated with LOC144481.

LOC144871 (Accession XP_096698.1) is another GAM25 target gene, herein designated TARGET GENE. LOC144871 BINDING SITE is a target binding site found in the 3' untranslated region of mRNA encoded by LOC144871, corresponding to a target binding site such as BINDING SITE I, BINDING SITE II or BINDING SITE III of FIG. 8. Table 4 illustrates the complementarity of the nucleotide sequences of LOC144871 BINDING SITE, designated SEQ ID:2317, to the nucleotide sequence of GAM25 rNA, herein designated GAM RNA, also designated SEQ ID:206.

Another function of GAM25 is therefore inhibition of LOC144871 (Accession XP_096698.1). Accordingly, utilities of GAM25 include diagnosis, prevention and treatment of diseases and clinical conditions associated with LOC144871.

LOC145268 (Accession XP_085072.1) is another GAM25 target gene, herein designated TARGET GENE. LOC145268 BINDING SITE is a target binding site found in the 5' untranslated region of mRNA encoded by LOC145268, corresponding to a target binding site such as BINDING SITE I, BINDING SITE II or BINDING SITE III of FIG. 8. Table 4 illustrates the complementarity of the nucleotide sequences of LOC145268 BINDING SITE, designated SEQ ID:1754, to the nucleotide sequence of GAM25 rNA, herein designated GAM RNA, also designated SEQ ID:206.

Another function of GAM25 is therefore inhibition of LOC145268 (Accession XP_085072.1). Accordingly, utilities of GAM25 include diagnosis, prevention and treatment of diseases and clinical conditions associated with LOC145268.

LOC145800 (Accession XP_085242.1) is another GAM25 target gene, herein designated TARGET GENE. LOC145800 BINDING SITE is a target binding site found in the 3' untranslated region of mRNA encoded by LOC145800, corresponding to a target binding site such as BINDING SITE I, BINDING SITE II or BINDING SITE III of FIG. 8. Table 4 illustrates the complementarity of the nucleotide sequences of LOC145800 BINDING SITE, designated SEQ ID:2677, to the nucleotide sequence of GAM25 rNA, herein designated GAM RNA, also designated SEQ ID:206.

Another function of GAM25 is therefore inhibition of LOC145800 (Accession XP_085242.1). Accordingly, utilities of GAM25 include diagnosis, prevention and treatment of diseases and clinical conditions associated with LOC145800.

LOC145813 (Accession XP_096873.1) is another GAM25 target gene, herein designated TARGET GENE. LOC145813 BINDING SITE is a target binding site found in the 5' untranslated region of mRNA encoded by LOC145813, corresponding to a target binding site such as BINDING SITE I, BINDING SITE II or BINDING SITE III of FIG. 8. Table 4 illustrates the complementarity of the nucleotide sequences of LOC145813 BINDING SITE, designated SEQ ID:634, to the nucleotide sequence of GAM25 rNA, herein designated GAM RNA, also designated SEQ ID:206.

Another function of GAM25 is therefore inhibition of LOC145813 (Accession XP_096873.1). Accordingly, utilities of GAM25 include diagnosis, prevention and treatment of diseases and clinical conditions associated with LOC145813.

LOC146177 (Accession NP_778229.1) is another GAM25 target gene, herein designated TARGET GENE. LOC146177 BINDING SITE is a target binding site found in the 5' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:4315, to the nucleotide sequence of GAM25 rNA, herein designated GAM RNA, also designated SEQ ID:206.

Another function of GAM25 is therefore inhibition of LOC146177 (Accession NP_778229.1). Accordingly, utilities of GAM25 include diagnosis, prevention and treatment of diseases and clinical conditions associated with LOC146177.

LOC146229 (Accession XP_085387.1) is another GAM25 target gene, herein designated TARGET GENE. LOC146229 BINDING SITE1 and LOC146229 BINDING SITE2 are target binding sites found in untranslated regions of mRNA encoded by LOC146229, corresponding to target binding sites such as BINDING SITE I, BINDING SITE II or BINDING SITE III of FIG. 8. Table 4 illustrates the complementarity of the nucleotide sequences of LOC146229 BINDING SITE1 and LOC146229 BINDING SITE2, designated SEQ ID:6069 and SEQ ID:11151 respectively, to the nucleotide sequence of GAM25 rNA, herein designated GAM RNA, also designated SEQ ID:206.

Another function of GAM25 is therefore inhibition of LOC146229 (Accession XP_085387.1). Accordingly, utilities of GAM25 include diagnosis, prevention and treatment of diseases and clinical conditions associated with LOC146229.

LOC146346 (Accession XP_085430.1) is another GAM25 target gene, herein designated TARGET GENE. LOC146346 BINDING SITE is a target binding site found in the 5' untranslated region of mRNA encoded by LOC146346, corresponding to a target binding site such as BINDING SITE I, BINDING SITE II or BINDING SITE III of FIG. 8. Table 4 illustrates the complementarity of the nucleotide sequences of LOC146346 BINDING SITE, designated SEQ ID:15193, to the nucleotide sequence of GAM25 rNA, herein designated GAM RNA, also designated SEQ ID:206.

Another function of GAM25 is therefore inhibition of LOC146346 (Accession XP_085430.1). Accordingly, utilities of GAM25 include diagnosis, prevention and treatment of diseases and clinical conditions associated with LOC146346.

LOC146429 (Accession XP_096998.2) is another GAM25 target gene, herein designated TARGET GENE. LOC146429 BINDING SITE is a target binding site found in the 5' untranslated region of mRNA encoded by LOC146429, corresponding to a target binding site such as BINDING SITE I, BINDING SITE II or BINDING SITE III of FIG. 8. Table 4 illustrates the complementarity of the nucleotide sequences of LOC146429 BINDING SITE, designated SEQ ID:11432, to the nucleotide sequence of GAM25 rNA, herein designated GAM RNA, also designated SEQ ID:206.

Another function of GAM25 is therefore inhibition of LOC146429 (Accession XP_096998.2). Accordingly, utilities of GAM25 include diagnosis, prevention and treatment of diseases and clinical conditions associated with LOC146429.

LOC146784 (Accession XP_085588.1) is another GAM25 target gene, herein designated TARGET GENE. LOC146784 BINDING SITE is a target binding site found in the 5' untranslated region of mRNA encoded by LOC146784, corresponding to a target binding site such as BINDING SITE I, BINDING SITE II or BINDING SITE III of FIG. 8. Table 4 illustrates the complementarity of the nucleotide sequences of LOC146784 BINDING SITE, designated SEQ ID:14301, to the nucleotide sequence of GAM25 rNA, herein designated GAM RNA, also designated SEQ ID:206.

Another function of GAM25 is therefore inhibition of LOC146784 (Accession XP_085588.1). Accordingly, utilities of GAM25 include diagnosis, prevention and treatment of diseases and clinical conditions associated with LOC146784.

LOC146820 (Accession XP_085603.1) is another GAM25 target gene, herein designated TARGET GENE. LOC146820 BINDING SITE is a target binding site found in the 5' untranslated region of mRNA encoded by LOC146820, corresponding to a target binding site such as BINDING SITE I, BINDING SITE II or BINDING SITE III of FIG. 8. Table 4 illustrates the complementarity of the nucleotide sequences of LOC146820 BINDING SITE, designated SEQ ID:4887, to the nucleotide sequence of GAM25 rNA, herein designated GAM RNA, also designated SEQ ID:206.

Another function of GAM25 is therefore inhibition of LOC146820 (Accession XP_085603.1). Accordingly, utilities of GAM25 include diagnosis, prevention and treatment of diseases and clinical conditions associated with LOC146820.

LOC146894 (Accession NP_660316.1) is another GAM25 target gene, herein designated TARGET GENE. LOC146894 BINDING SITE is a target binding site found in the 3' untranslated region of mRNA encoded by LOC146894, corresponding to a target binding site such as BINDING SITE I, BINDING SITE II or BINDING SITE III of FIG. 8. Table 4 illustrates the complementarity of the nucleotide sequences of LOC146894 BINDING SITE, designated SEQ ID:14231, to the nucleotide sequence of GAM25 rNA, herein designated GAM RNA, also designated SEQ ID:206.

Another function of GAM25 is therefore inhibition of LOC146894 (Accession NP_660316.1). Accordingly, utilities of GAM25 include diagnosis, prevention and treatment of diseases and clinical conditions associated with LOC146894.

LOC146909 (Accession XP_085634.2) is another GAM25 target gene, herein designated TARGET GENE. LOC146909 BINDING SITE is a target binding site found in the 3' untranslated region of mRNA encoded by LOC146909, corresponding to a target binding site such as BINDING SITE I, BINDING SITE II or BINDING SITE III of FIG. 8. Table 4 illustrates the complementarity of the nucleotide sequences of LOC146909 BINDING SITE, designated SEQ ID:18521, to the nucleotide sequence of GAM25 rNA, herein designated GAM RNA, also designated SEQ ID:206.

Another function of GAM25 is therefore inhibition of LOC146909 (Accession XP_085634.2). Accordingly, utilities of GAM25 include diagnosis, prevention and treatment of diseases and clinical conditions associated with LOC146909.

LOC147166 (Accession XP_085722.2) is another GAM25 target gene, herein designated TARGET GENE. LOC147166 BINDING SITE is a target binding site found in the 3' untranslated region of mRNA encoded by LOC147166, corresponding to a target binding site such as BINDING SITE I, BINDING SITE II or BINDING SITE III of FIG. 8. Table 4 illustrates the complementarity of the nucleotide sequences of LOC147166 BINDING SITE, designated SEQ ID:1828, to the nucleotide sequence of GAM25 rNA, herein designated GAM RNA, also designated SEQ ID:206.

Another function of GAM25 is therefore inhibition of LOC147166 (Accession XP_085722.2). Accordingly, utilities of GAM25 include diagnosis, prevention and treatment of diseases and clinical conditions associated with LOC147166.

LOC147817 (Accession XP_085903.1) is another GAM25 target gene, herein designated TARGET GENE. LOC147817 BINDING SITE1 and LOC147817 BINDING SITE2 are target binding sites found in untranslated regions of mRNA encoded by LOC147817, corresponding to target binding sites such as BINDING SITE I, BINDING SITE II or BINDING SITE III of FIG. 8. Table 4 illustrates the complementarity of the nucleotide sequences of LOC147817 BINDING SITE1 and LOC147817 BINDING SITE2, designated SEQ ID:13127 and SEQ ID:20074 respectively, to the nucleotide sequence of GAM25 rNA, herein designated GAM RNA, also designated SEQ ID:206.

Another function of GAM25 is therefore inhibition of LOC147817 (Accession XP_085903.1). Accordingly, utilities of GAM25 include diagnosis, prevention and treatment of diseases and clinical conditions associated with LOC147817.

LOC147841 (Accession XP_085924.2) is another GAM25 target gene, herein designated TARGET GENE. LOC147841 BINDING SITE is a target binding site found in the 3' untranslated region of mRNA encoded by LOC147841, corresponding to a target binding site such as BINDING SITE I, BINDING SITE II or BINDING SITE III of FIG. 8. Table 4 illustrates the complementarity of the nucleotide sequences of LOC147841 BINDING SITE, designated SEQ ID:4882, to the nucleotide sequence of GAM25 rNA, herein designated GAM RNA, also designated SEQ ID:206.

Another function of GAM25 is therefore inhibition of LOC147841 (Accession XP_085924.2). Accordingly, utilities of GAM25 include diagnosis, prevention and treatment of diseases and clinical conditions associated with LOC147841.

LOC148137 (Accession NP_653293.1) is another GAM25 target gene, herein designated TARGET GENE. LOC148137 BINDING SITE is a target binding site found in the 3' untranslated region of mRNA encoded by LOC148137, corresponding to a target binding site such as BINDING SITE I, BINDING SITE II or BINDING SITE III of FIG. 8. Table 4 illustrates the complementarity of the nucleotide sequences of LOC148137 BINDING SITE, designated SEQ ID:6069, to the nucleotide sequence of GAM25 rNA, herein designated GAM RNA, also designated SEQ ID:206.

Another function of GAM25 is therefore inhibition of LOC148137 (Accession NP_653293.1). Accordingly, utilities of GAM25 include diagnosis, prevention and treatment of diseases and clinical conditions associated with LOC148137.

LOC148189 (Accession XP_086087.1) is another GAM25 target gene, herein designated TARGET GENE. LOC148189 BINDING SITE is a target binding site found in the 5' untranslated region of mRNA encoded by LOC148189, corresponding to a target binding site such as BINDING SITE I, BINDING SITE II or BINDING SITE III of FIG. 8. Table 4 illustrates the complementarity of the nucleotide sequences of LOC148189 BINDING SITE, designated SEQ ID:4479, to the nucleotide sequence of GAM25 rNA, herein designated GAM RNA, also designated SEQ ID:206.

Another function of GAM25 is therefore inhibition of LOC148189 (Accession XP_086087.1). Accordingly, utilities of GAM25 include diagnosis, prevention and treatment of diseases and clinical conditions associated with LOC148189.

LOC148203 (Accession XP_086095.1) is another GAM25 target gene, herein designated TARGET GENE. LOC148203 BINDING SITE is a target binding site found in the 3' untranslated region of mRNA encoded by LOC148203, corresponding to a target binding site such as BINDING SITE I, BINDING SITE II or BINDING SITE III of FIG. 8. Table 4 illustrates the complementarity of the nucleotide sequences of LOC148203 BINDING SITE, designated SEQ ID:16166, to the nucleotide sequence of GAM25 rNA, herein designated GAM RNA, also designated SEQ ID:206.

Another function of GAM25 is therefore inhibition of LOC148203 (Accession XP_086095.1). Accordingly, utilities of GAM25 include diagnosis, prevention and treatment of diseases and clinical conditions associated with LOC148203.

LOC148709 (Accession XP_086281.1) is another GAM25 target gene, herein designated TARGET GENE. LOC148709 BINDING SITE1 and LOC148709 BINDING SITE2 are target binding sites found in untranslated regions of mRNA encoded by LOC148709, corresponding to target binding sites such as BINDING SITE I, BINDING SITE II or BINDING SITE III of FIG. 8. Table 4 illustrates the complementarity of the nucleotide sequences of LOC148709 BINDING SITE1 and LOC148709 BINDING SITE2, designated SEQ ID:11549 and SEQ ID:18101 respectively, to the nucleotide sequence of GAM25 rNA, herein designated GAM RNA, also designated SEQ ID:206.

Another function of GAM25 is therefore inhibition of LOC148709 (Accession XP_086281.1). Accordingly, utilities of GAM25 include diagnosis, prevention and treatment of diseases and clinical conditions associated with LOC148709.

LOC149149 (Accession XP_097598.1) is another GAM25 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:16301, to the nucleotide sequence of GAM25 rNA, herein designated GAM RNA, also designated SEQ ID:206.

Another function of GAM25 is therefore inhibition of LOC149149 (Accession XP_097598.1). Accordingly, utilities of GAM25 include diagnosis, prevention and treatment of diseases and clinical conditions associated with LOC149149.

LOC149466 (Accession XP_086546.1) is another GAM25 target gene, herein designated TARGET GENE. LOC149466 BINDING SITE is a target binding site found in the 3' untranslated region of mRNA encoded by LOC149466, corresponding to a target binding site such as BINDING SITE I, BINDING SITE II or BINDING SITE III of FIG. 8. Table 4 illustrates the complementarity of the nucleotide sequences of LOC149466 BINDING SITE, designated SEQ ID:3185, to the nucleotide sequence of GAM25 rNA, herein designated GAM RNA, also designated SEQ ID:206.

Another function of GAM25 is therefore inhibition of LOC149466 (Accession XP_086546.1). Accordingly, utilities of GAM25 include diagnosis, prevention and treatment of diseases and clinical conditions associated with LOC149466.

LOC149478 (Accession XP_086536.1) is another GAM25 target gene, herein designated TARGET GENE. LOC149478 BINDING SITE is a target binding site found in the 3' untranslated region of mRNA encoded by LOC149478, corresponding to a target binding site such as BINDING SITE I, BINDING SITE II or BINDING SITE III of FIG. 8. Table 4 illustrates the complementarity of the nucleotide sequences of LOC149478 BINDING SITE, designated SEQ ID:18212, to the nucleotide sequence of GAM25 rNA, herein designated GAM RNA, also designated SEQ ID:206.

Another function of GAM25 is therefore inhibition of LOC149478 (Accession XP_086536.1). Accordingly, utilities of GAM25 include diagnosis, prevention and treatment of diseases and clinical conditions associated with LOC149478.

LOC149506 (Accession XP_097661.1) is another GAM25 target gene, herein designated TARGET GENE. LOC149506 BINDING SITE is a target binding site found in the 3' untranslated region of mRNA encoded by LOC149506, corresponding to a target binding site such as BINDING SITE I, BINDING SITE II or BINDING SITE III of FIG. 8. Table 4 illustrates the complementarity of the nucleotide sequences of LOC149506 BINDING SITE, designated SEQ ID:14533, to the nucleotide sequence of GAM25 rNA, herein designated GAM RNA, also designated SEQ ID:206.

Another function of GAM25 is therefore inhibition of LOC149506 (Accession XP_097661.1). Accordingly, utilities of GAM25 include diagnosis, prevention and treatment of diseases and clinical conditions associated with LOC149506.

LOC150054 (Accession XP_097797.1) is another GAM25 target gene, herein designated TARGET GENE. LOC150054 BINDING SITE is a target binding site found in the 5' untranslated region of mRNA encoded by LOC150054, corresponding to a target binding site such as BINDING SITE I, BINDING SITE II or BINDING SITE III of FIG. 8. Table 4 illustrates the complementarity of the nucleotide sequences of LOC150054 BINDING SITE, designated SEQ ID:9448, to the nucleotide sequence of GAM25 rNA, herein designated GAM RNA, also designated SEQ ID:206.

Another function of GAM25 is therefore inhibition of LOC150054 (Accession XP_097797.1). Accordingly, utilities of GAM25 include diagnosis, prevention and treatment of diseases and clinical conditions associated with LOC150054.

LOC150397 (Accession XP_086907.1) is another GAM25 target gene, herein designated TARGET GENE. LOC150397 BINDING SITE is a target binding site found in the 3' untranslated region of mRNA encoded by LOC150397, corresponding to a target binding site such as BINDING SITE I, BINDING SITE II or BINDING SITE III of FIG. 8. Table 4 illustrates the complementarity of the nucleotide sequences of LOC150397 BINDING SITE, designated SEQ ID:17183, to the nucleotide sequence of GAM25 rNA, herein designated GAM RNA, also designated SEQ ID:206.

Another function of GAM25 is therefore inhibition of LOC150397 (Accession XP_086907.1). Accordingly, utilities of GAM25 include diagnosis, prevention and treatment of diseases and clinical conditions associated with LOC150397.

LOC150587 (Accession XP_097917.1) is another GAM25 target gene, herein designated TARGET GENE. LOC150587 BINDING SITE is a target binding site found in the 3' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:19636, to the nucleotide sequence of GAM25 rNA, herein designated GAM RNA, also designated SEQ ID:206.

Another function of GAM25 is therefore inhibition of LOC150587 (Accession XP_097917.1). Accordingly, utilities of GAM25 include diagnosis, prevention and treatment of diseases and clinical conditions associated with LOC150587.

LOC150886 (Accession XP_097963.1) is another GAM25 target gene, herein designated TARGET GENE. LOC150886 BINDING SITE is a target binding site found in the 3' untranslated region of mRNA encoded by LOC150886, corresponding to a target binding site such as BINDING SITE I, BINDING SITE II or BINDING SITE III of FIG. 8. Table 4 illustrates the complementarity of the nucleotide sequences of LOC150886 BINDING SITE, designated SEQ ID:7130, to the nucleotide sequence of GAM25 rNA, herein designated GAM RNA, also designated SEQ ID:206.

Another function of GAM25 is therefore inhibition of LOC150886 (Accession XP_097963.1). Accordingly, utilities of GAM25 include diagnosis, prevention and treatment of diseases and clinical conditions associated with LOC150886.

LOC151201 (Accession XP_098021.1) is another GAM25 target gene, herein designated TARGET GENE. LOC151201 BINDING SITE is a target binding site found in the 5' untranslated region of mRNA encoded by LOC151201, corresponding to a target binding site such as BINDING SITE I, BINDING SITE II or BINDING SITE III of FIG. 8. Table 4 illustrates the complementarity of the nucleotide sequences of LOC151201 BINDING SITE, designated SEQ ID:9269, to the nucleotide sequence of GAM25 rNA, herein designated GAM RNA, also designated SEQ ID:206.

Another function of GAM25 is therefore inhibition of LOC151201 (Accession XP_098021.1). Accordingly, utilities of GAM25 include diagnosis, prevention and treatment of diseases and clinical conditions associated with LOC151201.

LOC151475 (Accession XP_098063.1) is another GAM25 target gene, herein designated TARGET GENE. LOC151475 BINDING SITE1 and LOC151475 BINDING SITE2 are target binding sites found in untranslated regions of mRNA encoded by LOC151475, corresponding to target binding sites such as BINDING SITE I, BINDING SITE II or BINDING SITE III of FIG. 8. Table 4 illustrates the complementarity of the nucleotide sequences of LOC151475 BINDING SITE1 and LOC151475 BINDING SITE2, designated SEQ ID:14301 and SEQ ID:4882 respectively, to the nucleotide sequence of GAM25 rNA, herein designated GAM RNA, also designated SEQ ID:206.

Another function of GAM25 is therefore inhibition of LOC151475 (Accession XP_098063.1). Accordingly, utilities of GAM25 include diagnosis, prevention and treatment of diseases and clinical conditions associated with LOC151475.

LOC151636 (Accession NP_612144.1) is another GAM25 target gene, herein designated TARGET GENE. LOC151636 BINDING SITE is a target binding site found in the 3' untranslated region of mRNA encoded by LOC151636, corresponding to a target binding site such as BINDING SITE I, BINDING SITE II or BINDING SITE III of FIG. 8. Table 4 illustrates the complementarity of the nucleotide sequences of LOC151636 BINDING SITE, designated SEQ ID:17818, to the nucleotide sequence of GAM25 rNA, herein designated GAM RNA, also designated SEQ ID:206.

Another function of GAM25 is therefore inhibition of LOC151636 (Accession NP_612144.1). Accordingly, utilities of GAM25 include diagnosis, prevention and treatment of diseases and clinical conditions associated with LOC151636.

LOC152445 (Accession XP_098231.1) is another GAM25 target gene, herein designated TARGET GENE. LOC152445 BINDING SITE is a target binding site found in the 3' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:11559, to the nucleotide sequence of GAM25 rNA, herein designated GAM RNA, also designated SEQ ID:206.

Another function of GAM25 is therefore inhibition of LOC152445 (Accession XP_098231.1). Accordingly, utilities of GAM25 include diagnosis, prevention and treatment of diseases and clinical conditions associated with LOC152445.

LOC152620 (Accession XP_011108.2) is another GAM25 target gene, herein designated TARGET GENE. LOC152620 BINDING SITE is a target binding site found in the 3' untranslated region of mRNA encoded by LOC152620, corresponding to a target binding site such as BINDING SITE I, BINDING SITE II or BINDING SITE III of FIG. 8. Table 4 illustrates the complementarity of the nucleotide sequences of LOC152620 BINDING SITE, designated SEQ ID:3060, to the nucleotide sequence of GAM25 rNA, herein designated GAM RNA, also designated SEQ ID:206.

Another function of GAM25 is therefore inhibition of LOC152620 (Accession XP_011108.2). Accordingly, utilities of GAM25 include diagnosis, prevention and treatment of diseases and clinical conditions associated with LOC152620.

LOC152667 (Accession XP_087500.1) is another GAM25 target gene, herein designated TARGET GENE. LOC152667 BINDING SITE is a target binding site found in the 5' untranslated region of mRNA encoded by LOC152667, corresponding to a target binding site such as BINDING SITE I, BINDING SITE II or BINDING SITE III of FIG. 8. Table 4 illustrates the complementarity of the nucleotide sequences of LOC152667 BINDING SITE, designated SEQ ID:4383, to the nucleotide sequence of GAM25 rNA, herein designated GAM RNA, also designated SEQ ID:206.

Another function of GAM25 is therefore inhibition of LOC152667 (Accession XP_087500.1). Accordingly, utilities of GAM25 include diagnosis, prevention and treatment of diseases and clinical conditions associated with LOC152667.

LOC152719 (Accession XP_098257.1) is another GAM25 target gene, herein designated TARGET GENE. LOC152719 BINDING SITE is a target binding site found in the 5' untranslated region of mRNA encoded by LOC152719, corresponding to a target binding site such as BINDING SITE I, BINDING SITE II or BINDING SITE III of FIG. 8. Table 4 illustrates the complementarity of the nucleotide sequences of LOC152719 BINDING SITE, designated SEQ ID:12540, to the nucleotide sequence of GAM25 rNA, herein designated GAM RNA, also designated SEQ ID:206.

Another function of GAM25 is therefore inhibition of LOC152719 (Accession XP_098257.1). Accordingly, utilities of GAM25 include diagnosis, prevention and treatment of diseases and clinical conditions associated with LOC152719.

LOC153077 (Accession XP_098307.1) is another GAM25 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:16720, to the nucleotide sequence of GAM25 rNA, herein designated GAM RNA, also designated SEQ ID:206.

Another function of GAM25 is therefore inhibition of LOC153077 (Accession XP_098307.1). Accordingly, utilities of GAM25 include diagnosis, prevention and treatment of diseases and clinical conditions associated with LOC153077.

LOC153684 (Accession XP_098412.1) is another GAM25 target gene, herein designated TARGET GENE. LOC153684 BINDING SITE is a target binding site found in the 5' untranslated region of mRNA encoded by LOC153684, corresponding to a target binding site such as BINDING SITE I, BINDING SITE II or BINDING SITE III of FIG. 8. Table 4 illustrates the complementarity of the nucleotide sequences of LOC153684 BINDING SITE, designated SEQ ID:14611, to the nucleotide sequence of GAM25 rNA, herein designated GAM RNA, also designated SEQ ID:206.

Another function of GAM25 is therefore inhibition of LOC153684 (Accession XP_098412.1). Accordingly, utilities of GAM25 include diagnosis, prevention and treatment of diseases and clinical conditions associated with LOC153684.

LOC154282 (Accession XP_098505.1) is another GAM25 target gene, herein designated TARGET GENE. LOC154282 BINDING SITE is a target binding site found in the 5' untranslated region of mRNA encoded by LOC154282, corresponding to a target binding site such as BINDING SITE I, BINDING SITE II or BINDING SITE III of FIG. 8. Table 4 illustrates the complementarity of the nucleotide sequences of LOC154282 BINDING SITE, designated SEQ ID:16702, to the nucleotide sequence of GAM25 rNA, herein designated GAM RNA, also designated SEQ ID:206.

Another function of GAM25 is therefore inhibition of LOC154282 (Accession XP_098505.1). Accordingly, utilities of GAM25 include diagnosis, prevention and treatment of diseases and clinical conditions associated with LOC154282.

LOC154822 (Accession XP_098618.3) is another GAM25 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:14064, to the nucleotide sequence of GAM25 rNA, herein designated GAM RNA, also designated SEQ ID:206.

Another function of GAM25 is therefore inhibition of LOC154822 (Accession XP_098618.3). Accordingly, utilities of GAM25 include diagnosis, prevention and treatment of diseases and clinical conditions associated with LOC154822.

LOC154877 (Accession XP_098626.1) is another GAM25 target gene, herein designated TARGET GENE. LOC154877 BINDING SITE1 through LOC154877 BINDING SITE3 are target binding sites found in untranslated regions of mRNA encoded by LOC154877, corresponding to target binding sites such as BINDING SITE I, BINDING SITE II or BINDING SITE III of FIG. 8. Table 4 illustrates the complementarity of the nucleotide sequences of LOC154877 BINDING SITE1 through LOC154877 BINDING SITE3, designated SEQ ID:11691, SEQ ID:13635 and SEQ ID:13046 respectively, to the nucleotide sequence of GAM25 rNA, herein designated GAM RNA, also designated SEQ ID:206.

Another function of GAM25 is therefore inhibition of LOC154877 (Accession XP_098626.1). Accordingly, utilities of GAM25 include diagnosis, prevention and treatment of diseases and clinical conditions associated with LOC154877.

LOC158014 (Accession XP_088442.1) is another GAM25 target gene, herein designated TARGET GENE. LOC158014 BINDING SITE is a target binding site found in the 5' untranslated region of mRNA encoded by LOC158014, corresponding to a target binding site such as BINDING SITE I, BINDING SITE II or BINDING SITE III of FIG. 8. Table 4 illustrates the complementarity of the nucleotide sequences of LOC158014 BINDING SITE, designated SEQ ID:684, to the nucleotide sequence of GAM25 rNA, herein designated GAM RNA, also designated SEQ ID:206.

Another function of GAM25 is therefore inhibition of LOC158014 (Accession XP_088442.1). Accordingly, utilities of GAM25 include diagnosis, prevention and treatment of diseases and clinical conditions associated with LOC158014.

LOC158310 (Accession XP_098919.1) is another GAM25 target gene, herein designated TARGET GENE. LOC158310 BINDING SITE is a target binding site found in the 5' untranslated region of mRNA encoded by LOC158310, corresponding to a target binding site such as BINDING SITE I, BINDING SITE II or BINDING SITE III of FIG. 8. Table 4 illustrates the complementarity of the nucleotide sequences of LOC158310 BINDING SITE, designated SEQ ID:19625, to the nucleotide sequence of GAM25 rNA, herein designated GAM RNA, also designated SEQ ID:206.

Another function of GAM25 is therefore inhibition of LOC158310 (Accession XP_098919.1). Accordingly, utilities of GAM25 include diagnosis, prevention and treatment of diseases and clinical conditions associated with LOC158310.

LOC158476 (Accession XP_098955.1) is another GAM25 target gene, herein designated TARGET GENE. LOC158476 BINDING SITE1 and LOC158476 BINDING SITE2 are target binding sites found in untranslated regions of mRNA encoded by LOC158476, corresponding to target binding sites such as BINDING SITE I, BINDING SITE II or BINDING SITE III of FIG. 8. Table 4 illustrates the complementarity of the nucleotide sequences of LOC158476 BINDING SITE1 and LOC158476 BINDING SITE2, designated SEQ ID:18466 and SEQ ID:15086 respectively, to the nucleotide sequence of GAM25 rNA, herein designated GAM RNA, also designated SEQ ID:206.

Another function of GAM25 is therefore inhibition of LOC158476 (Accession XP_098955.1). Accordingly, utilities of GAM25 include diagnosis, prevention and treatment of diseases and clinical conditions associated with LOC158476.

LOC158865 (Accession XP_099000.1) is another GAM25 target gene, herein designated TARGET GENE. LOC158865 BINDING SITE is a target binding site found in the 5' untranslated region of mRNA encoded by LOC158865, corresponding to a target binding site such as BINDING SITE I, BINDING SITE II or BINDING SITE III of FIG. 8. Table 4 illustrates the complementarity of the nucleotide sequences of LOC158865 BINDING SITE, designated SEQ ID:11559, to the nucleotide sequence of GAM25 rNA, herein designated GAM RNA, also designated SEQ ID:206.

Another function of GAM25 is therefore inhibition of LOC158865 (Accession XP_099000.1). Accordingly, utilities of GAM25 include diagnosis, prevention and treatment of diseases and clinical conditions associated with LOC158865.

LOC161145 (Accession XP_101622.1) is another GAM25 target gene, herein designated TARGET GENE. LOC161145 BINDING SITE is a target binding site found in the 3' untranslated region of mRNA encoded by LOC161145, corresponding to a target binding site such as BINDING SITE I, BINDING SITE II or BINDING SITE III of FIG. 8. Table 4 illustrates the complementarity of the nucleotide sequences of LOC161145 BINDING SITE, designated SEQ ID:12540, to the nucleotide sequence of GAM25 rNA, herein designated GAM RNA, also designated SEQ ID:206.

Another function of GAM25 is therefore inhibition of LOC161145 (Accession XP_101622.1). Accordingly, utilities of GAM25 include diagnosis, prevention and treatment of diseases and clinical conditions associated with LOC161145.

LOC163227 (Accession NP_775802.1) is another GAM25 target gene, herein designated TARGET GENE. LOC163227 BINDING SITE1 and LOC163227 BINDING SITE2 are target binding sites found in untranslated regions of mRNA encoded by LOC163227, corresponding to target binding sites such as BINDING SITE I, BINDING SITE II or BINDING SITE III of FIG. 8. Table 4 illustrates the complementarity of the nucleotide sequences of LOC163227 BINDING SITE1 and LOC163227 BINDING SITE2, designated SEQ ID:15025 and SEQ ID:1888 respectively, to the nucleotide sequence of GAM25 rNA, herein designated GAM RNA, also designated SEQ ID:206.

Another function of GAM25 is therefore inhibition of LOC163227 (Accession NP_775802.1). Accordingly, utilities of GAM25 include diagnosis, prevention and treatment of diseases and clinical conditions associated with LOC163227.

LOC164091 (Accession XP_089356.1) is another GAM25 target gene, herein designated TARGET GENE. LOC164091 BINDING SITE is a target binding site found in the 3' untranslated region of mRNA encoded by LOC164091, corresponding to a target binding site such as BINDING SITE I, BINDING SITE II or BINDING SITE III of FIG. 8. Table 4 illustrates the complementarity of the nucleotide sequences of LOC164091 BINDING SITE, designated SEQ ID:8030, to the nucleotide sequence of GAM25 rNA, herein designated GAM RNA, also designated SEQ ID:206.

Another function of GAM25 is therefore inhibition of LOC164091 (Accession XP_089356.1). Accordingly, utilities of GAM25 include diagnosis, prevention and treatment of diseases and clinical conditions associated with LOC164091.

LOC169611 (Accession XP_095809.4) is another GAM25 target gene, herein designated TARGET GENE. LOC169611 BINDING SITE is a target binding site found in the 3' untranslated region of mRNA encoded by LOC169611, corresponding to a target binding site such as BINDING SITE I, BINDING SITE II or BINDING SITE III of FIG. 8. Table 4 illustrates the complementarity of the nucleotide sequences of LOC169611 BINDING SITE, designated SEQ ID:17790, to the nucleotide sequence of GAM25 rNA, herein designated GAM RNA, also designated SEQ ID:206.

Another function of GAM25 is therefore inhibition of LOC169611 (Accession XP_095809.4). Accordingly, utilities of GAM25 include diagnosis, prevention and treatment of diseases and clinical conditions associated with LOC169611.

LOC196264 (Accession XP_113683.1) is another GAM25 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:5567, to the nucleotide sequence of GAM25 rNA, herein designated GAM RNA, also designated SEQ ID:206.

Another function of GAM25 is therefore inhibition of LOC196264 (Accession XP_113683.1). Accordingly, utilities of GAM25 include diagnosis, prevention and treatment of diseases and clinical conditions associated with LOC196264.

LOC196988 (Accession XP_113795.1) is another GAM25 target gene, herein designated TARGET GENE. LOC196988 BINDING SITE is a target binding site found in the 3' untranslated region of mRNA encoded by LOC196988, corresponding to a target binding site such as BINDING SITE I, BINDING SITE II or BINDING SITE III of FIG. 8. Table 4 illustrates the complementarity of the nucleotide sequences of LOC196988 BINDING SITE, designated SEQ ID:2677, to the nucleotide sequence of GAM25 rNA, herein designated GAM RNA, also designated SEQ ID:206.

Another function of GAM25 is therefore inhibition of LOC196988 (Accession XP_113795.1). Accordingly, utilities of GAM25 include diagnosis, prevention and treatment of diseases and clinical conditions associated with LOC196988.

LOC199906 (Accession XP_114052.1) is another GAM25 target gene, herein designated TARGET GENE. LOC199906 BINDING SITE is a target binding site found in the 3' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:9410, to the nucleotide sequence of GAM25 rNA, herein designated GAM RNA, also designated SEQ ID:206.

Another function of GAM25 is therefore inhibition of LOC199906 (Accession XP_114052.1). Accordingly, utilities of GAM25 include diagnosis, prevention and treatment of diseases and clinical conditions associated with LOC199906.

LOC200169 (Accession XP_117200.1) is another GAM25 target gene, herein designated TARGET GENE. LOC200169 BINDING SITE is a target binding site found in the 5' untranslated region of multiple transcripts of mRNA encoded by LOC200169, corresponding to a target binding site such as BINDING SITE I, BINDING SITE II or BINDING SITE III of FIG. 8. Table 4 illustrates the complementarity of the nucleotide sequences of LOC200169 BINDING SITE, designated SEQ ID:5567, to the nucleotide sequence of GAM25 rNA, herein designated GAM RNA, also designated SEQ ID:206.

Another function of GAM25 is therefore inhibition of LOC200169 (Accession XP_117200.1). Accordingly, utilities of GAM25 include diagnosis, prevention and treatment of diseases and clinical conditions associated with LOC200169.

LOC200860 (Accession XP_117289.1) is another GAM25 target gene, herein designated TARGET GENE. LOC200860 BINDING SITE is a target binding site found in the 3' untranslated region of mRNA encoded by LOC200860, corresponding to a target binding site such as BINDING SITE I, BINDING SITE II or BINDING SITE III of FIG. 8. Table 4 illustrates the complementarity of the nucleotide sequences of LOC200860 BINDING SITE, designated SEQ ID:13127, to the nucleotide sequence of GAM25 rNA, herein designated GAM RNA, also designated SEQ ID:206.

Another function of GAM25 is therefore inhibition of LOC200860 (Accession XP_117289.1). Accordingly, utilities of GAM25 include diagnosis, prevention and treatment of diseases and clinical conditions associated with LOC200860.

LOC200895 (Accession NP_789785.1) is another GAM25 target gene, herein designated TARGET GENE. LOC200895 BINDING SITE is a target binding site found in the 3' untranslated region of mRNA encoded by LOC200895, corresponding to a target binding site such as BINDING SITE I, BINDING SITE II or BINDING SITE III of FIG. 8. Table 4 illustrates the complementarity of the nucleotide sequences of LOC200895 BINDING SITE, designated SEQ ID:3030, to the nucleotide sequence of GAM25 rNA, herein designated GAM RNA, also designated SEQ ID:206.

Another function of GAM25 is therefore inhibition of LOC200895 (Accession NP_789785.1). Accordingly, utilities of GAM25 include diagnosis, prevention and treatment of diseases and clinical conditions associated with LOC200895.

LOC202460 (Accession XP_114493.1) is another GAM25 target gene, herein designated TARGET GENE. LOC202460 BINDING SITE is a target binding site found in the 5' untranslated region of mRNA encoded by LOC202460, corresponding to a target binding site such as BINDING SITE I, BINDING SITE II or BINDING SITE III of FIG. 8. Table 4 illustrates the complementarity of the nucleotide sequences of LOC202460 BINDING SITE, designated SEQ ID:12745, to the nucleotide sequence of GAM25 rNA, herein designated GAM RNA, also designated SEQ ID:206.

Another function of GAM25 is therefore inhibition of LOC202460 (Accession XP_114493.1). Accordingly, utilities of GAM25 include diagnosis, prevention and treatment of diseases and clinical conditions associated with LOC202460.

LOC203547 (Accession XP_114719.1) is another GAM25 target gene, herein designated TARGET GENE. LOC203547 BINDING SITE is a target binding site found in the 3' untranslated region of mRNA encoded by LOC203547, corresponding to a target binding site such as BINDING SITE I, BINDING SITE II or BINDING SITE III of FIG. 8. Table 4 illustrates the complementarity of the nucleotide sequences of LOC203547 BINDING SITE, designated SEQ ID:18584, to the nucleotide sequence of GAM25 rNA, herein designated GAM RNA, also designated SEQ ID:206.

Another function of GAM25 is therefore inhibition of LOC203547 (Accession XP_114719.1). Accordingly, utilities of GAM25 include diagnosis, prevention and treatment of diseases and clinical conditions associated with LOC203547.

LOC219293 (Accession XP_166599.2) is another GAM25 target gene, herein designated TARGET GENE. LOC219293 BINDING SITE is a target binding site found in the 3' untranslated region of mRNA encoded by LOC219293, corresponding to a target binding site such as BINDING SITE I, BINDING SITE II or BINDING SITE III of FIG. 8. Table 4 illustrates the complementarity of the nucleotide sequences of LOC219293 BINDING SITE, designated SEQ ID:4935, to the nucleotide sequence of GAM25 rNA, herein designated GAM RNA, also designated SEQ ID:206.

Another function of GAM25 is therefore inhibition of LOC219293 (Accession XP_166599.2). Accordingly, utilities of GAM25 include diagnosis, prevention and treatment of diseases and clinical conditions associated with LOC219293.

LOC220074 (Accession NP_660352.1) is another GAM25 target gene, herein designated TARGET GENE. LOC220074 BINDING SITE is a target binding site found in the 3' untranslated region of mRNA encoded by LOC220074, corresponding to a target binding site such as BINDING SITE I, BINDING SITE II or BINDING SITE III of FIG. 8. Table 4 illustrates the complementarity of the nucleotide sequences of LOC220074 BINDING SITE, designated SEQ ID:2821, to the nucleotide sequence of GAM25 rNA, herein designated GAM RNA, also designated SEQ ID:206.

Another function of GAM25 is therefore inhibition of LOC220074 (Accession NP_660352.1). Accordingly, utilities of GAM25 include diagnosis, prevention and treatment of diseases and clinical conditions associated with LOC220074.

LOC221091 (Accession XP_169026.1) is another GAM25 target gene, herein designated TARGET GENE. LOC221091 BINDING SITE is a target binding site found in the 3' untranslated region of mRNA encoded by LOC221091, corresponding to a target binding site such as BINDING SITE I, BINDING SITE II or BINDING SITE III of FIG. 8. Table 4 illustrates the complementarity of the nucleotide sequences of LOC221091 BINDING SITE, designated SEQ ID:1598, to the nucleotide sequence of GAM25 rNA, herein designated GAM RNA, also designated SEQ ID:206.

Another function of GAM25 is therefore inhibition of LOC221091 (Accession XP_169026.1). Accordingly, utilities of GAM25 include diagnosis, prevention and treatment of diseases and clinical conditions associated with LOC221091.

LOC222031 (Accession XP_168371.1) is another GAM25 target gene, herein designated TARGET GENE. LOC222031 BINDING SITE is a target binding site found in the 3' untranslated region of mRNA encoded by LOC222031, corresponding to a target binding site such as BINDING SITE I, BINDING SITE II or BINDING SITE III of FIG. 8. Table 4 illustrates the complementarity of the nucleotide sequences of LOC222031 BINDING SITE, designated SEQ ID:1130, to the nucleotide sequence of GAM25 rNA, herein designated GAM RNA, also designated SEQ ID:206.

Another function of GAM25 is therefore inhibition of LOC222031 (Accession XP_168371.1). Accordingly, utilities of GAM25 include diagnosis, prevention and treatment of diseases and clinical conditions associated with LOC222031.

LOC222159 (Accession XP_212100.1) is another GAM25 target gene, herein designated TARGET GENE. LOC222159 BINDING SITE is a target binding site found in the 5' untranslated region of multiple transcripts of mRNA encoded by LOC222159, corresponding to a target binding site such as BINDING SITE I, BINDING SITE II or BINDING SITE III of FIG. 8. Table 4 illustrates the complementarity of the nucleotide sequences of LOC222159 BINDING SITE, designated SEQ ID:12545, to the nucleotide sequence of GAM25 rNA, herein designated GAM RNA, also designated SEQ ID:206.

Another function of GAM25 is therefore inhibition of LOC222159 (Accession XP_212100.1). Accordingly, utilities of GAM25 include diagnosis, prevention and treatment of diseases and clinical conditions associated with LOC222159.

LOC222224 (Accession XP_168473.1) is another GAM25 target gene, herein designated TARGET GENE. LOC222224 BINDING SITE is a target binding site found in the 5' untranslated region of mRNA encoded by LOC222224, corresponding to a target binding site such as BINDING SITE I, BINDING SITE II or BINDING SITE III of FIG. 8. Table 4 illustrates the complementarity of the nucleotide sequences of LOC222224 BINDING SITE, designated SEQ ID:13949, to the nucleotide sequence of GAM25 rNA, herein designated GAM RNA, also designated SEQ ID:206.

Another function of GAM25 is therefore inhibition of LOC222224 (Accession XP_168473.1). Accordingly, utilities of GAM25 include diagnosis, prevention and treatment of diseases and clinical conditions associated with LOC222224.

LOC252983 (Accession XP_170858.2) is another GAM25 target gene, herein designated TARGET GENE. LOC252983 BINDING SITE is a target binding site found in the 3' untranslated region of mRNA encoded by LOC252983, corresponding to a target binding site such as BINDING SITE I, BINDING SITE II or BINDING SITE III of FIG. 8. Table 4 illustrates the complementarity of the nucleotide sequences of LOC252983 BINDING SITE, designated SEQ ID:13976, to the nucleotide sequence of GAM25 rNA, herein designated GAM RNA, also designated SEQ ID:206.

Another function of GAM25 is therefore inhibition of LOC252983 (Accession XP_170858.2). Accordingly, utilities of GAM25 include diagnosis, prevention and treatment of diseases and clinical conditions associated with LOC252983.

LOC255177 (Accession XP_172941.1) is another GAM25 target gene, herein designated TARGET GENE. LOC255177 BINDING SITE is a target binding site found in the 3' untranslated region of mRNA encoded by LOC255177, corresponding to a target binding site such as BINDING SITE I, BINDING SITE II or BINDING SITE III of FIG. 8. Table 4 illustrates the complementarity of the nucleotide sequences of LOC255177 BINDING SITE, designated SEQ ID:2252, to the nucleotide sequence of GAM25 rNA, herein designated GAM RNA, also designated SEQ ID:206.

Another function of GAM25 is therefore inhibition of LOC255177 (Accession XP_172941.1). Accordingly, utilities of GAM25 include diagnosis, prevention and treatment of diseases and clinical conditions associated with LOC255177.

LOC255458 (Accession XP_173150.1) is another GAM25 target gene, herein designated TARGET GENE. LOC255458 BINDING SITE is a target binding site found in the 3' untranslated region of mRNA encoded by LOC255458, corresponding to a target binding site such as BINDING SITE I, BINDING SITE II or BINDING SITE III of FIG. 8. Table 4 illustrates the complementarity of the nucleotide sequences of LOC255458 BINDING SITE, designated SEQ ID:15698, to the nucleotide sequence of GAM25 rNA, herein designated GAM RNA, also designated SEQ ID:206.

Another function of GAM25 is therefore inhibition of LOC255458 (Accession XP_173150.1). Accordingly, utilities of GAM25 include diagnosis, prevention and treatment of diseases and clinical conditions associated with LOC255458.

LOC256614 (Accession XP_172864.1) is another GAM25 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:16894, to the nucleotide sequence of GAM25 rNA, herein designated GAM RNA, also designated SEQ ID:206.

Another function of GAM25 is therefore inhibition of LOC256614 (Accession XP_172864.1). Accordingly, utilities of GAM25 include diagnosis, prevention and treatment of diseases and clinical conditions associated with LOC256614.

LOC282997 (Accession XP_208473.1) is another GAM25 target gene, herein designated TARGET GENE. LOC282997 BINDING SITE is a target binding site found in the 3' untranslated region of mRNA encoded by LOC282997, corresponding to a target binding site such as BINDING SITE I, BINDING SITE II or BINDING SITE III of FIG. 8. Table 4 illustrates the complementarity of the nucleotide sequences of LOC282997 BINDING SITE, designated SEQ ID:17558, to the nucleotide sequence of GAM25 rNA, herein designated GAM RNA, also designated SEQ ID:206.

Another function of GAM25 is therefore inhibition of LOC282997 (Accession XP_208473.1). Accordingly, utilities of GAM25 include diagnosis, prevention and treatment of diseases and clinical conditions associated with LOC282997.

LOC283031 (Accession XP_210859.1) is another GAM25 target gene, herein designated TARGET GENE. LOC283031 BINDING SITE is a target binding site found in the 3' untranslated region of mRNA encoded by LOC283031, corresponding to a target binding site such as BINDING SITE I, BINDING SITE II or BINDING SITE III of FIG. 8. Table 4 illustrates the complementarity of the nucleotide sequences of LOC283031 BINDING SITE, designated SEQ ID:10453, to the nucleotide sequence of GAM25 rNA, herein designated GAM RNA, also designated SEQ ID:206.

Another function of GAM25 is therefore inhibition of LOC283031 (Accession XP_210859.1). Accordingly, utilities of GAM25 include diagnosis, prevention and treatment of diseases and clinical conditions associated with LOC283031.

LOC283061 (Accession XP_210875.1) is another GAM25 target gene, herein designated TARGET GENE. LOC283061 BINDING SITE is a target binding site found in the 3' untranslated region of mRNA encoded by LOC283061, corresponding to a target binding site such as BINDING SITE I, BINDING SITE II or BINDING SITE III of FIG. 8. Table 4 illustrates the complementarity of the nucleotide sequences of LOC283061 BINDING SITE, designated SEQ ID:18635, to the nucleotide sequence of GAM25 rNA, herein designated GAM RNA, also designated SEQ ID:206.

Another function of GAM25 is therefore inhibition of LOC283061 (Accession XP_210875.1). Accordingly, utilities of GAM25 include diagnosis, prevention and treatment of diseases and clinical conditions associated with LOC283061.

LOC283089 (Accession XP_210885.1) is another GAM25 target gene, herein designated TARGET GENE. LOC283089 BINDING SITE is a target binding site found in the 5' untranslated region of mRNA encoded by LOC283089, corresponding to a target binding site such as BINDING SITE I, BINDING SITE II or BINDING SITE III of FIG. 8. Table 4 illustrates the complementarity of the nucleotide sequences of LOC283089 BINDING SITE, designated SEQ ID:1684, to the nucleotide sequence of GAM25 rNA, herein designated GAM RNA, also designated SEQ ID:206.

Another function of GAM25 is therefore inhibition of LOC283089 (Accession XP_210885.1). Accordingly, utilities of GAM25 include diagnosis, prevention and treatment of diseases and clinical conditions associated with LOC283089.

LOC283119 (Accession XP_210895.1) is another GAM25 target gene, herein designated TARGET GENE. LOC283119 BINDING SITE is a target binding site found in the 3' untranslated region of mRNA encoded by LOC283119, corresponding to a target binding site such as BINDING SITE I, BINDING SITE II or BINDING SITE III of FIG. 8. Table 4 illustrates the complementarity of the nucleotide sequences of LOC283119 BINDING SITE, designated SEQ ID:1051, to the nucleotide sequence of GAM25 rNA, herein designated GAM RNA, also designated SEQ ID:206.

Another function of GAM25 is therefore inhibition of LOC283119 (Accession XP_210895.1). Accordingly, utilities of GAM25 include diagnosis, prevention and treatment of diseases and clinical conditions associated with LOC283119.

LOC283241 (Accession NP_787089.1) is another GAM25 target gene, herein designated TARGET GENE. LOC283241 BINDING SITE is a target binding site found in the 5' untranslated region of mRNA encoded by LOC283241, corresponding to a target binding site such as BINDING SITE I, BINDING SITE II or BINDING SITE III of FIG. 8. Table 4 illustrates the complementarity of the nucleotide sequences of LOC283241 BINDING SITE, designated SEQ ID:14301, to the nucleotide sequence of GAM25 rNA, herein designated GAM RNA, also designated SEQ ID:206.

Another function of GAM25 is therefore inhibition of LOC283241 (Accession NP_787089.1). Accordingly, utilities of GAM25 include diagnosis, prevention and treatment of diseases and clinical conditions associated with LOC283241.

LOC283323 (Accession XP_210973.1) is another GAM25 target gene, herein designated TARGET GENE. LOC283323 BINDING SITE is a target binding site found in the 3' untranslated region of mRNA encoded by LOC283323, corresponding to a target binding site such as BINDING SITE I, BINDING SITE II or BINDING SITE III of FIG. 8. Table 4 illustrates the complementarity of the nucleotide sequences of LOC283323 BINDING SITE, designated SEQ ID:14710, to the nucleotide sequence of GAM25 rNA, herein designated GAM RNA, also designated SEQ ID:206.

Another function of GAM25 is therefore inhibition of LOC283323 (Accession XP_210973.1). Accordingly, utilities of GAM25 include diagnosis, prevention and treatment of diseases and clinical conditions associated with LOC283323.

LOC283335 (Accession XP_210981.1) is another GAM25 target gene, herein designated TARGET GENE. LOC283335 BINDING SITE is a target binding site found in the 3' untranslated region of mRNA encoded by LOC283335, corresponding to a target binding site such as BINDING SITE I, BINDING SITE II or BINDING SITE III of FIG. 8. Table 4 illustrates the complementarity of the nucleotide sequences of LOC283335 BINDING SITE, designated SEQ ID:11355, to the nucleotide sequence of GAM25 rNA, herein designated GAM RNA, also designated SEQ ID:206.

Another function of GAM25 is therefore inhibition of LOC283335 (Accession XP_210981.1). Accordingly, utilities of GAM25 include diagnosis, prevention and treatment of diseases and clinical conditions associated with LOC283335.

LOC283400 (Accession XP_211024.1) is another GAM25 target gene, herein designated TARGET GENE. LOC283400 BINDING SITE is a target binding site found in the 5' untranslated region of mRNA encoded by LOC283400, corresponding to a target binding site such as BINDING SITE I, BINDING SITE II or BINDING SITE III of FIG. 8. Table 4 illustrates the complementarity of the nucleotide sequences of LOC283400 BINDING SITE, designated SEQ ID:10938, to the nucleotide sequence of GAM25 rNA, herein designated GAM RNA, also designated SEQ ID:206.

Another function of GAM25 is therefore inhibition of LOC283400 (Accession XP_211024.1). Accordingly, utilities of GAM25 include diagnosis, prevention and treatment of diseases and clinical conditions associated with LOC283400.

LOC283454 (Accession XP_211049.1) is another GAM25 target gene, herein designated TARGET GENE. LOC283454 BINDING SITE is a target binding site found in the 5' untranslated region of mRNA encoded by LOC283454, corresponding to a target binding site such as BINDING SITE I, BINDING SITE II or BINDING SITE III of FIG. 8. Table 4 illustrates the complementarity of the nucleotide sequences of LOC283454 BINDING SITE, designated SEQ ID:14301, to the nucleotide sequence of GAM25 rNA, herein designated GAM RNA, also designated SEQ ID:206.

Another function of GAM25 is therefore inhibition of LOC283454 (Accession XP_211049.1). Accordingly, utilities of GAM25 include diagnosis, prevention and treatment of diseases and clinical conditions associated with LOC283454.

LOC283487 (Accession XP_211062.1) is another GAM25 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:3816, to the nucleotide sequence of GAM25 rNA, herein designated GAM RNA, also designated SEQ ID:206.

Another function of GAM25 is therefore inhibition of LOC283487 (Accession XP_211062.1). Accordingly, utilities of GAM25 include diagnosis, prevention and treatment of diseases and clinical conditions associated with LOC283487.

LOC283507 (Accession XP_211075.1) is another GAM25 target gene, herein designated TARGET GENE. LOC283507 BINDING SITE is a target binding site found in the 3' untranslated region of mRNA encoded by LOC283507, corresponding to a target binding site such as BINDING SITE I, BINDING SITE II or BINDING SITE III of FIG. 8. Table 4 illustrates the complementarity of the nucleotide sequences of LOC283507 BINDING SITE, designated SEQ ID:4772, to the nucleotide sequence of GAM25 rNA, herein designated GAM RNA, also designated SEQ ID:206.

Another function of GAM25 is therefore inhibition of LOC283507 (Accession XP_211075.1). Accordingly, utilities of GAM25 include diagnosis, prevention and treatment of diseases and clinical conditions associated with LOC283507.

LOC283534 (Accession XP_211083.1) is another GAM25 target gene, herein designated TARGET GENE. LOC283534 BINDING SITE is a target binding site found in the 3' untranslated region of mRNA encoded by LOC283534, corresponding to a target binding site such as BINDING SITE I, BINDING SITE II or BINDING SITE III of FIG. 8. Table 4 illustrates the complementarity of the nucleotide sequences of LOC283534 BINDING SITE, designated SEQ ID:13127, to the nucleotide sequence of GAM25 rNA, herein designated GAM RNA, also designated SEQ ID:206.

Another function of GAM25 is therefore inhibition of LOC283534 (Accession XP_211083.1). Accordingly, utilities of GAM25 include diagnosis, prevention and treatment of diseases and clinical conditions associated with LOC283534.

LOC283551 (Accession XP_211110.1) is another GAM25 target gene, herein designated TARGET GENE. LOC283551 BINDING SITE is a target binding site found in the 3' untranslated region of mRNA encoded by LOC283551, corresponding to a target binding site such as BINDING SITE I, BINDING SITE II or BINDING SITE III of FIG. 8. Table 4 illustrates the complementarity of the nucleotide sequences of LOC283551 BINDING SITE, designated SEQ ID:15674, to the nucleotide sequence of GAM25 rNA, herein designated GAM RNA, also designated SEQ ID:206.

Another function of GAM25 is therefore inhibition of LOC283551 (Accession XP_211110.1). Accordingly, utilities of GAM25 include diagnosis, prevention and treatment of diseases and clinical conditions associated with LOC283551.

LOC283575 (Accession XP_211095.1) is another GAM25 target gene, herein designated TARGET GENE. LOC283575 BINDING SITE1 and LOC283575 BINDING SITE2 are target binding sites found in untranslated regions of mRNA encoded by LOC283575, corresponding to target binding sites such as BINDING SITE I, BINDING SITE II or BINDING SITE III of FIG. 8. Table 4 illustrates the complementarity of the nucleotide sequences of LOC283575 BINDING SITE1 and LOC283575 BINDING SITE2, designated SEQ ID:17611 and SEQ ID:16702 respectively, to the nucleotide sequence of GAM25 rNA, herein designated GAM RNA, also designated SEQ ID:206.

Another function of GAM25 is therefore inhibition of LOC283575 (Accession XP_211095.1). Accordingly, utilities of GAM25 include diagnosis, prevention and treatment of diseases and clinical conditions associated with LOC283575.

LOC283590 (Accession XP_208741.1) is another GAM25 target gene, herein designated TARGET GENE. LOC283590 BINDING SITE is a target binding site found in the 3' untranslated region of mRNA encoded by LOC283590, corresponding to a target binding site such as BINDING SITE I, BINDING SITE II or BINDING SITE III of FIG. 8. Table 4 illustrates the complementarity of the nucleotide sequences of LOC283590 BINDING SITE, designated SEQ ID:7310, to the nucleotide sequence of GAM25 rNA, herein designated GAM RNA, also designated SEQ ID:206.

Another function of GAM25 is therefore inhibition of LOC283590 (Accession XP_208741.1). Accordingly, utilities of GAM25 include diagnosis, prevention and treatment of diseases and clinical conditions associated with LOC283590.

LOC283624 (Accession XP_211126.1) is another GAM25 target gene, herein designated TARGET GENE. LOC283624 BINDING SITE is a target binding site found in the 5' untranslated region of mRNA encoded by LOC283624, corresponding to a target binding site such as BINDING SITE I, BINDING SITE II or BINDING SITE III of FIG. 8. Table 4 illustrates the complementarity of the nucleotide sequences of LOC283624 BINDING SITE, designated SEQ ID:15694, to the nucleotide sequence of GAM25 rNA, herein designated GAM RNA, also designated SEQ ID:206.

Another function of GAM25 is therefore inhibition of LOC283624 (Accession XP_211126.1). Accordingly, utilities of GAM25 include diagnosis, prevention and treatment of diseases and clinical conditions associated with LOC283624.

LOC283641 (Accession XP_208764.1) is another GAM25 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:18297, to the nucleotide sequence of GAM25 rNA, herein designated GAM RNA, also designated SEQ ID:206.

Another function of GAM25 is therefore inhibition of LOC283641 (Accession XP_208764.1). Accordingly, utilities of GAM25 include diagnosis, prevention and treatment of diseases and clinical conditions associated with LOC283641.

LOC283672 (Accession XP_211152.1) is another GAM25 target gene, herein designated TARGET GENE. LOC283672 BINDING SITE is a target binding site found in the 5' untranslated region of mRNA encoded by LOC283672, corresponding to a target binding site such as BINDING SITE I, BINDING SITE II or BINDING SITE III of FIG. 8. Table 4 illustrates the complementarity of the nucleotide sequences of LOC283672 BINDING SITE, designated SEQ ID:14685, to the nucleotide sequence of GAM25 rNA, herein designated GAM RNA, also designated SEQ ID:206.

Another function of GAM25 is therefore inhibition of LOC283672 (Accession XP_211152.1). Accordingly, utilities of GAM25 include diagnosis, prevention and treatment of diseases and clinical conditions associated with LOC283672.

LOC283767 (Accession XP_208835.1) is another GAM25 target gene, herein designated TARGET GENE. LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:11559, to the nucleotide sequence of GAM25 rNA, herein designated GAM RNA, also designated SEQ ID:206.

Another function of GAM25 is therefore inhibition of LOC283767 (Accession XP_208835.1). Accordingly, utilities of GAM25 include diagnosis, prevention and treatment of diseases and clinical conditions associated with LOC283767.

LOC283857 (Accession XP_211236.1) is another GAM25 target gene, herein designated TARGET GENE. LOC283857 BINDING SITE is a target binding site found in the 5' untranslated region of mRNA encoded by LOC283857, corresponding to a target binding site such as BINDING SITE I, BINDING SITE II or BINDING SITE III of FIG. 8. Table 4 illustrates the complementarity of the nucleotide sequences of LOC283857 BINDING SITE, designated SEQ ID:5363, to the nucleotide sequence of GAM25 rNA, herein designated GAM RNA, also designated SEQ ID:206.

Another function of GAM25 is therefore inhibition of LOC283857 (Accession XP_211236.1). Accordingly, utilities of GAM25 include diagnosis, prevention and treatment of diseases and clinical conditions associated with LOC283857.

LOC283861 (Accession NP_787095.1) is another GAM25 target gene, herein designated TARGET GENE. LOC283861 BINDING SITE is a target binding site found in the 3' untranslated region of mRNA encoded by LOC283861, corresponding to a target binding site such as BINDING SITE I, BINDING SITE II or BINDING SITE III of FIG. 8. Table 4 illustrates the complementarity of the nucleotide sequences of LOC283861 BINDING SITE, designated SEQ ID:5363, to the nucleotide sequence of GAM25 rNA, herein designated GAM RNA, also designated SEQ ID:206.

Another function of GAM25 is therefore inhibition of LOC283861 (Accession NP_787095.1). Accordingly, utilities of GAM25 include diagnosis, prevention and treatment of diseases and clinical conditions associated with LOC283861.

LOC283863 (Accession XP_208875.1) is another GAM25 target gene, herein designated TARGET GENE. LOC283863 BINDING SITE is a target binding site found in the 3' untranslated region of mRNA encoded by LOC283863, corresponding to a target binding site such as BINDING SITE I, BINDING SITE II or BINDING SITE III of FIG. 8. Table 4 illustrates the complementarity of the nucleotide sequences of LOC283863 BINDING SITE, designated SEQ ID:10892, to the nucleotide sequence of GAM25 rNA, herein designated GAM RNA, also designated SEQ ID:206.

Another function of GAM25 is therefore inhibition of LOC283863 (Accession XP_208875.1). Accordingly, utilities of GAM25 include diagnosis, prevention and treatment of diseases and clinical conditions associated with LOC283863.

LOC283889 (Accession XP_208899.1) is another GAM25 target gene, herein designated TARGET GENE. LOC283889 BINDING SITE is a target binding site found in the 5' untranslated region of mRNA encoded by LOC283889, corresponding to a target binding site such as BINDING SITE I, BINDING SITE II or BINDING SITE III of FIG. 8. Table 4 illustrates the complementarity of the nucleotide sequences of LOC283889 BINDING SITE, designated SEQ ID:5497, to the nucleotide sequence of GAM25 rNA, herein designated GAM RNA, also designated SEQ ID:206.

Another function of GAM25 is therefore inhibition of LOC283889 (Accession XP_208899.1). Accordingly, utilities of GAM25 include diagnosis, prevention and treatment of diseases and clinical conditions associated with LOC283889.

LOC283928 (Accession XP_208909.1) is another GAM25 target gene, herein designated TARGET GENE. LOC283928 BINDING SITE is a target binding site found in the 5' untranslated region of mRNA encoded by LOC283928, corresponding to a target binding site such as BINDING SITE I, BINDING SITE II or BINDING SITE III of FIG. 8. Table 4 illustrates the complementarity of the nucleotide sequences of LOC283928 BINDING SITE, designated SEQ ID:13152, to the nucleotide sequence of GAM25 rNA, herein designated GAM RNA, also designated SEQ ID:206.

Another function of GAM25 is therefore inhibition of LOC283928 (Accession XP_208909.1). Accordingly, utilities of GAM25 include diagnosis, prevention and treatment of diseases and clinical conditions associated with LOC283928.

LOC284001 (Accession XP_208958.2) is another GAM25 target gene, herein designated TARGET GENE. LOC284001 BINDING SITE is a target binding site found in the 3' untranslated region of mRNA encoded by LOC284001, corresponding to a target binding site such as BINDING SITE I, BINDING SITE II or BINDING SITE III of FIG. 8. Table 4 illustrates the complementarity of the nucleotide sequences of LOC284001 BINDING SITE, designated SEQ ID:20163, to the nucleotide sequence of GAM25 rNA, herein designated GAM RNA, also designated SEQ ID:206.

Another function of GAM25 is therefore inhibition of LOC284001 (Accession XP_208958.2). Accordingly, utilities of GAM25 include diagnosis, prevention and treatment of diseases and clinical conditions associated with LOC284001.

LOC284016 (Accession XP_211298.1) is another GAM25 target gene, herein designated TARGET GENE. LOC284016 BINDING SITE is a target binding site found in the 3' untranslated region of mRNA encoded by LOC284016, corresponding to a target binding site such as BINDING SITE I, BINDING SITE II or BINDING SITE III of FIG. 8. Table 4 illustrates the complementarity of the nucleotide sequences of LOC284016 BINDING SITE, designated SEQ ID:13339, to the nucleotide sequence of GAM25 rNA, herein designated GAM RNA, also designated SEQ ID:206.

Another function of GAM25 is therefore inhibition of LOC284016 (Accession XP_211298.1). Accordingly, utilities of GAM25 include diagnosis, prevention and treatment of diseases and clinical conditions associated with LOC284016.

LOC284023 (Accession XP_208983.3) is another GAM25 target gene, herein designated TARGET GENE. LOC284023 BINDING SITE is a target binding site found in the 3' untranslated region of mRNA encoded by LOC284023, corresponding to a target binding site such as BINDING SITE I, BINDING SITE II or BINDING SITE III of FIG. 8. Table 4 illustrates the complementarity of the nucleotide sequences of LOC284023 BINDING SITE, designated SEQ ID:12195, to the nucleotide sequence of GAM25 rNA, herein designated GAM RNA, also designated SEQ ID:206.

Another function of GAM25 is therefore inhibition of LOC284023 (Accession XP_208983.3). Accordingly, utilities of GAM25 include diagnosis, prevention and treatment of diseases and clinical conditions associated with LOC284023.

LOC284039 (Accession XP_211312.1) is another GAM25 target gene, herein designated TARGET GENE. LOC284039 BINDING SITE is a target binding site found in the 5' untranslated region of mRNA encoded by LOC284039, corresponding to a target binding site such as BINDING SITE I, BINDING SITE II or BINDING SITE III of FIG. 8. Table 4 illustrates the complementarity of the nucleotide sequences of LOC284039 BINDING SITE, designated SEQ ID:11517, to the nucleotide sequence of GAM25 rNA, herein designated GAM RNA, also designated SEQ ID:206.

Another function of GAM25 is therefore inhibition of LOC284039 (Accession XP_211312.1). Accordingly, utilities of GAM25 include diagnosis, prevention and treatment of diseases and clinical conditions associated with LOC284039.

LOC284041 (Accession XP_211309.1) is another GAM25 target gene, herein designated TARGET GENE. LOC284041 BINDING SITE is a target binding site found in the 3' untranslated region of mRNA encoded by LOC284041, corresponding to a target binding site such as BINDING SITE I, BINDING SITE II or BINDING SITE III of FIG. 8. Table 4 illustrates the complementarity of the nucleotide sequences of LOC284041 BINDING SITE, designated SEQ ID:15667, to the nucleotide sequence of GAM25 rNA, herein designated GAM RNA, also designated SEQ ID:206.

Another function of GAM25 is therefore inhibition of LOC284041 (Accession XP_211309.1). Accordingly, utilities of GAM25 include diagnosis, prevention and treatment of diseases and clinical conditions associated with LOC284041.

LOC284074 (Accession XP_211321.1) is another GAM25 target gene, herein designated TARGET GENE. LOC284074 BINDING SITE is a target binding site found in the 3' untranslated region of mRNA encoded by LOC284074, corresponding to a target binding site such as BINDING SITE I, BINDING SITE II or BINDING SITE III of FIG. 8. Table 4 illustrates the complementarity of the nucleotide sequences of LOC284074 BINDING SITE, designated SEQ ID:15234, to the nucleotide sequence of GAM25 rNA, herein designated GAM RNA, also designated SEQ ID:206.

Another function of GAM25 is therefore inhibition of LOC284074 (Accession XP_211321.1). Accordingly, utilities of GAM25 include diagnosis, prevention and treatment of diseases and clinical conditions associated with LOC284074.

LOC284095 (Accession XP_211324.1) is another GAM25 target gene, herein designated TARGET GENE. LOC284095 BINDING SITE is a target binding site found in the 3' untranslated region of mRNA encoded by LOC284095, corresponding to a target binding site such as BINDING SITE I, BINDING SITE II or BINDING SITE III of FIG. 8. Table 4 illustrates the complementarity of the nucleotide sequences of LOC284095 BINDING SITE, designated SEQ ID:5191, to the nucleotide sequence of GAM25 rNA, herein designated GAM RNA, also designated SEQ ID:206.

Another function of GAM25 is therefore inhibition of LOC284095 (Accession XP_211324.1). Accordingly, utilities of GAM25 include diagnosis, prevention and treatment of diseases and clinical conditions associated with LOC284095.

LOC284098 (Accession XP_209008.3) is another GAM25 target gene, herein designated TARGET GENE. LOC284098 BINDING SITE is a target binding site found in the 3' untranslated region of mRNA encoded by LOC284098, corresponding to a target binding site such as BINDING SITE I, BINDING SITE II or BINDING SITE III of FIG. 8. Table 4 illustrates the complementarity of the nucleotide sequences of LOC284098 BINDING SITE, designated SEQ ID:13505, to the nucleotide sequence of GAM25 rNA, herein designated GAM RNA, also designated SEQ ID:206.

Another function of GAM25 is therefore inhibition of LOC284098 (Accession XP_209008.3). Accordingly, utilities of GAM25 include diagnosis, prevention and treatment of diseases and clinical conditions associated with LOC284098.

LOC284102 (Accession XP_211327.3) is another GAM25 target gene, herein designated TARGET GENE. LOC284102 BINDING SITE1 through LOC284102 BINDING SITE4 are target binding sites found in untranslated regions of mRNA encoded by LOC284102, corresponding to target binding sites such as BINDING SITE I, BINDING SITE II or BINDING SITE III of FIG. 8. Table 4 illustrates the complementarity of the nucleotide sequences of LOC284102 BINDING SITE1 through LOC284102 BINDING SITE4, designated SEQ ID:18323, SEQ ID:18496, SEQ ID:18051 and SEQ ID:5279 respectively, to the nucleotide sequence of GAM25 rNA, herein designated GAM RNA, also designated SEQ ID:206.

Another function of GAM25 is therefore inhibition of LOC284102 (Accession XP_211327.3). Accordingly, utilities of GAM25 include diagnosis, prevention and treatment of diseases and clinical conditions associated with LOC284102.

LOC284135 (Accession XP_209032.1) is another GAM25 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:7936, to the nucleotide sequence of GAM25 rNA, herein designated GAM RNA, also designated SEQ ID:206.

Another function of GAM25 is therefore inhibition of LOC284135 (Accession XP_209032.1). Accordingly, utilities of GAM25 include diagnosis, prevention and treatment of diseases and clinical conditions associated with LOC284135.

LOC284174 (Accession XP_211363.1) is another GAM25 target gene, herein designated TARGET GENE. LOC284174 BINDING SITE is a target binding site found in the 5' untranslated region of mRNA encoded by LOC284174, corresponding to a target binding site such as BINDING SITE I, BINDING SITE II or BINDING SITE III of FIG. 8. Table 4 illustrates the complementarity of the nucleotide sequences of LOC284174 BINDING SITE, designated SEQ ID:5339, to the nucleotide sequence of GAM25 rNA, herein designated GAM RNA, also designated SEQ ID:206.

Another function of GAM25 is therefore inhibition of LOC284174 (Accession XP_211363.1). Accordingly, utilities of GAM25 include diagnosis, prevention and treatment of diseases and clinical conditions associated with LOC284174.

LOC284183 (Accession XP_209059.1) is another GAM25 target gene, herein designated TARGET GENE. LOC284183 BINDING SITE1 and LOC284183 BINDING SITE2 are target binding sites found in untranslated regions of mRNA encoded by LOC284183, corresponding to target binding sites such as BINDING SITE I, BINDING SITE II or BINDING SITE III of FIG. 8. Table 4 illustrates the complementarity of the nucleotide sequences of LOC284183 BINDING SITE1 and LOC284183 BINDING SITE2, designated SEQ ID:19169 and SEQ ID:4426 respectively, to the nucleotide sequence of GAM25 rNA, herein designated GAM RNA, also designated SEQ ID:206.

Another function of GAM25 is therefore inhibition of LOC284183 (Accession XP_209059.1). Accordingly, utilities of GAM25 include diagnosis, prevention and treatment of diseases and clinical conditions associated with LOC284183.

LOC284186 (Accession XP_209060.2) is another GAM25 target gene, herein designated TARGET GENE. LOC284186 BINDING SITE is a target binding site found in the 3' untranslated region of mRNA encoded by LOC284186, corresponding to a target binding site such as BINDING SITE I, BINDING SITE II or BINDING SITE III of FIG. 8. Table 4 illustrates the complementarity of the nucleotide sequences of LOC284186 BINDING SITE, designated SEQ ID:7709, to the nucleotide sequence of GAM25 rNA, herein designated GAM RNA, also designated SEQ ID:206.

Another function of GAM25 is therefore inhibition of LOC284186 (Accession XP_209060.2). Accordingly, utilities of GAM25 include diagnosis, prevention and treatment of diseases and clinical conditions associated with LOC284186.

LOC284191 (Accession XP_211377.1) is another GAM25 target gene, herein designated TARGET GENE. LOC284191 BINDING SITE is a target binding site found in the 5' untranslated region of mRNA encoded by LOC284191, corresponding to a target binding site such as BINDING SITE I, BINDING SITE II or BINDING SITE III of FIG. 8. Table 4 illustrates the complementarity of the nucleotide sequences of LOC284191 BINDING SITE, designated SEQ ID:18296, to the nucleotide sequence of GAM25 rNA, herein designated GAM RNA, also designated SEQ ID:206.

Another function of GAM25 is therefore inhibition of LOC284191 (Accession XP_211377.1). Accordingly, utilities of GAM25 include diagnosis, prevention and treatment of diseases and clinical conditions associated with LOC284191.

LOC284260 (Accession XP_211408.1) is another GAM25 target gene, herein designated TARGET GENE. LOC284260 BINDING SITE is a target binding site found in the 3' untranslated region of mRNA encoded by LOC284260, corresponding to a target binding site such as BINDING SITE I, BINDING SITE II or BINDING SITE III of FIG. 8. Table 4 illustrates the complementarity of the nucleotide sequences of LOC284260 BINDING SITE, designated SEQ ID:5343, to the nucleotide sequence of GAM25 rNA, herein designated GAM RNA, also designated SEQ ID:206.

Another function of GAM25 is therefore inhibition of LOC284260 (Accession XP_211408.1). Accordingly, utilities of GAM25 include diagnosis, prevention and treatment of diseases and clinical conditions associated with LOC284260.

LOC284276 (Accession XP_211412.1) is another GAM25 target gene, herein designated TARGET GENE. LOC284276 BINDING SITE is a target binding site found in the 5' untranslated region of mRNA encoded by LOC284276, corresponding to a target binding site such as BINDING SITE I, BINDING SITE II or BINDING SITE III of FIG. 8. Table 4 illustrates the complementarity of the nucleotide sequences of LOC284276 BINDING SITE, designated SEQ ID:13505, to the nucleotide sequence of GAM25 rNA, herein designated GAM RNA, also designated SEQ ID:206.

Another function of GAM25 is therefore inhibition of LOC284276 (Accession XP_211412.1). Accordingly, utilities of GAM25 include diagnosis, prevention and treatment of diseases and clinical conditions associated with LOC284276.

LOC284286 (Accession XP_211419.1) is another GAM25 target gene, herein designated TARGET GENE. LOC284286 BINDING SITE is a target binding site found in the 3' untranslated region of mRNA encoded by LOC284286, corresponding to a target binding site such as BINDING SITE I, BINDING SITE II or BINDING SITE III of FIG. 8. Table 4 illustrates the complementarity of the nucleotide sequences of LOC284286 BINDING SITE, designated SEQ ID:17183, to the nucleotide sequence of GAM25 rNA, herein designated GAM RNA, also designated SEQ ID:206.

Another function of GAM25 is therefore inhibition of LOC284286 (Accession XP_211419.1). Accordingly, utilities of GAM25 include diagnosis, prevention and treatment of diseases and clinical conditions associated with LOC284286.

LOC284311 (Accession XP_302720.1) is another GAM25 target gene, herein designated TARGET GENE. LOC284311 BINDING SITE is a target binding site found in the 3' untranslated region of mRNA encoded by LOC284311, corresponding to a target binding site such as BINDING SITE I, BINDING SITE II or BINDING SITE III of FIG. 8. Table 4 illustrates the complementarity of the nucleotide sequences of LOC284311 BINDING SITE, designated SEQ ID:12209, to the nucleotide sequence of GAM25 rNA, herein designated GAM RNA, also designated SEQ ID:206.

Another function of GAM25 is therefore inhibition of LOC284311 (Accession XP_302720.1). Accordingly, utilities of GAM25 include diagnosis, prevention and treatment of diseases and clinical conditions associated with LOC284311.

LOC284325 (Accession XP_209143.1) is another GAM25 target gene, herein designated TARGET GENE. LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:13899, to the nucleotide sequence of GAM25 rNA, herein designated GAM RNA, also designated SEQ ID:206.

Another function of GAM25 is therefore inhibition of LOC284325 (Accession XP_209143.1). Accordingly, utilities of GAM25 include diagnosis, prevention and treatment of diseases and clinical conditions associated with LOC284325.

LOC284362 (Accession XP_211435.1) is another GAM25 target gene, herein designated TARGET GENE. LOC284362 BINDING SITE is a target binding site found in the 3' untranslated region of mRNA encoded by LOC284362, corresponding to a target binding site such as BINDING SITE I, BINDING SITE II or BINDING SITE III of FIG. 8. Table 4 illustrates the complementarity of the nucleotide sequences of LOC284362 BINDING SITE, designated SEQ ID:19019, to the nucleotide sequence of GAM25 rNA, herein designated GAM RNA, also designated SEQ ID:206.

Another function of GAM25 is therefore inhibition of LOC284362 (Accession XP_211435.1). Accordingly, utilities of GAM25 include diagnosis, prevention and treatment of diseases and clinical conditions associated with LOC284362.

LOC284376 (Accession XP_209157.1) is another GAM25 target gene, herein designated TARGET GENE. LOC284376 BINDING SITE is a target binding site found in the 3' untranslated region of mRNA encoded by LOC284376, corresponding to a target binding site such as BINDING SITE I, BINDING SITE II or BINDING SITE III of FIG. 8. Table 4 illustrates the complementarity of the nucleotide sequences of LOC284376 BINDING SITE, designated SEQ ID:8491, to the nucleotide sequence of GAM25 rNA, herein designated GAM RNA, also designated SEQ ID:206.

Another function of GAM25 is therefore inhibition of LOC284376 (Accession XP_209157.1). Accordingly, utilities of GAM25 include diagnosis, prevention and treatment of diseases and clinical conditions associated with LOC284376.

LOC284379 (Accession XP_209163.1) is another GAM25 target gene, herein designated TARGET GENE. LOC284379 BINDING SITE is a target binding site found in the 3' untranslated region of mRNA encoded by LOC284379, corresponding to a target binding site such as BINDING SITE I, BINDING SITE II or BINDING SITE III of FIG. 8. Table 4 illustrates the complementarity of the nucleotide sequences of LOC284379 BINDING SITE, designated SEQ ID:1125, to the nucleotide sequence of GAM25 rNA, herein designated GAM RNA, also designated SEQ ID:206.

Another function of GAM25 is therefore inhibition of LOC284379 (Accession XP_209163.1). Accordingly, utilities of GAM25 include diagnosis, prevention and treatment of diseases and clinical conditions associated with LOC284379.

LOC284421 (Accession XP_209200.1) is another GAM25 target gene, herein designated TARGET GENE. LOC284421 BINDING SITE is a target binding site found in the 3' untranslated region of mRNA encoded by LOC284421, corresponding to a target binding site such as BINDING SITE I, BINDING SITE II or BINDING SITE III of FIG. 8. Table 4 illustrates the complementarity of the nucleotide sequences of LOC284421 BINDING SITE, designated SEQ ID:1637, to the nucleotide sequence of GAM25 rNA, herein designated GAM RNA, also designated SEQ ID:206.

Another function of GAM25 is therefore inhibition of LOC284421 (Accession XP_209200.1). Accordingly, utilities of GAM25 include diagnosis, prevention and treatment of diseases and clinical conditions associated with LOC284421.

LOC284426 (Accession XP_209198.1) is another GAM25 target gene, herein designated TARGET GENE. LOC284426 BINDING SITE1 through LOC284426 BINDING SITE3 are target binding sites found in untranslated regions of mRNA encoded by LOC284426, corresponding to target binding sites such as BINDING SITE I, BINDING SITE II or BINDING SITE III of FIG. 8. Table 4 illustrates the complementarity of the nucleotide sequences of LOC284426 BINDING SITE1 through LOC284426 BINDING SITE3, designated SEQ ID:4541, SEQ ID:4108 and SEQ ID:10929 respectively, to the nucleotide sequence of GAM25 rNA, herein designated GAM RNA, also designated SEQ ID:206.

Another function of GAM25 is therefore inhibition of LOC284426 (Accession XP_209198.1). Accordingly, utilities of GAM25 include diagnosis, prevention and treatment of diseases and clinical conditions associated with LOC284426.

LOC284454 (Accession XP_209216.1) is another GAM25 target gene, herein designated TARGET GENE. LOC284454 BINDING SITE is a target binding site found in the 5' untranslated region of mRNA encoded by LOC284454, corresponding to a target binding site such as BINDING SITE I, BINDING SITE II or BINDING SITE III of FIG. 8. Table 4 illustrates the complementarity of the nucleotide sequences of LOC284454 BINDING SITE, designated SEQ ID:4882, to the nucleotide sequence of GAM25 rNA, herein designated GAM RNA, also designated SEQ ID:206.

Another function of GAM25 is therefore inhibition of LOC284454 (Accession XP_209216.1). Accordingly, utilities of GAM25 include diagnosis, prevention and treatment of diseases and clinical conditions associated with LOC284454.

LOC284551 (Accession XP_211515.1) is another GAM25 target gene, herein designated TARGET GENE. LOC284551 BINDING SITE is a target binding site found in the 3' untranslated region of mRNA encoded by LOC284551, corresponding to a target binding site such as BINDING SITE I, BINDING SITE II or BINDING SITE III of FIG. 8. Table 4 illustrates the complementarity of the nucleotide sequences of LOC284551 BINDING SITE, designated SEQ ID:18133, to the nucleotide sequence of GAM25 rNA, herein designated GAM RNA, also designated SEQ ID:206.

Another function of GAM25 is therefore inhibition of LOC284551 (Accession XP_211515.1). Accordingly, utilities of GAM25 include diagnosis, prevention and treatment of diseases and clinical conditions associated with LOC284551.

LOC284628 (Accession XP_211561.1) is another GAM25 target gene, herein designated TARGET GENE. LOC284628 BINDING SITE is a target binding site found in the 5' untranslated region of mRNA encoded by LOC284628, corresponding to a target binding site such as BINDING SITE I, BINDING SITE II or BINDING SITE III of FIG. 8. Table 4 illustrates the complementarity of the nucleotide sequences of LOC284628 BINDING SITE, designated SEQ ID:12373, to the nucleotide sequence of GAM25 rNA, herein designated GAM RNA, also designated SEQ ID:206.

Another function of GAM25 is therefore inhibition of LOC284628 (Accession XP_211561.1). Accordingly, utilities of GAM25 include diagnosis, prevention and treatment of diseases and clinical conditions associated with LOC284628.

LOC284632 (Accession XP_211563.1) is another GAM25 target gene, herein designated TARGET GENE. LOC284632 BINDING SITE is a target binding site found in the 5' untranslated region of mRNA encoded by LOC284632, corresponding to a target binding site such as BINDING SITE I, BINDING SITE II or BINDING SITE III of FIG. 8. Table 4 illustrates the complementarity of the nucleotide sequences of LOC284632 BINDING SITE, designated SEQ ID:10320, to the nucleotide sequence of GAM25 rNA, herein designated GAM RNA, also designated SEQ ID:206.

Another function of GAM25 is therefore inhibition of LOC284632 (Accession XP_211563.1). Accordingly, utilities of GAM25 include diagnosis, prevention and treatment of diseases and clinical conditions associated with LOC284632.

LOC284646 (Accession XP_211573.1) is another GAM25 target gene, herein designated TARGET GENE. LOC284646 BINDING SITE is a target binding site found in the 5' untranslated region of mRNA encoded by LOC284646, corresponding to a target binding site such as BINDING SITE I, BINDING SITE II or BINDING SITE III of FIG. 8. Table 4 illustrates the complementarity of the nucleotide sequences of LOC284646 BINDING SITE, designated SEQ ID:4131, to the nucleotide sequence of GAM25 rNA, herein designated GAM RNA, also designated SEQ ID:206.

Another function of GAM25 is therefore inhibition of LOC284646 (Accession XP_211573.1). Accordingly, utilities of GAM25 include diagnosis, prevention and treatment of diseases and clinical conditions associated with LOC284646.

LOC284663 (Accession XP_209310.1) is another GAM25 target gene, herein designated TARGET GENE. LOC284663 BINDING SITE is a target binding site found in the 5' untranslated region of mRNA encoded by LOC284663, corresponding to a target binding site such as BINDING SITE I, BINDING SITE II or BINDING SITE III of FIG. 8. Table 4 illustrates the complementarity of the nucleotide sequences of LOC284663 BINDING SITE, designated SEQ ID:3190, to the nucleotide sequence of GAM25 rNA, herein designated GAM RNA, also designated SEQ ID:206.

Another function of GAM25 is therefore inhibition of LOC284663 (Accession XP_209310.1). Accordingly, utilities of GAM25 include diagnosis, prevention and treatment of diseases and clinical conditions associated with LOC284663.

LOC284723 (Accession XP_211602.1) is another GAM25 target gene, herein designated TARGET GENE. LOC284723 BINDING SITE1 and LOC284723 BINDING SITE2 are target binding sites found in untranslated regions of mRNA encoded by LOC284723, corresponding to target binding sites such as BINDING SITE I, BINDING SITE II or BINDING SITE III of FIG. 8. Table 4 illustrates the complementarity of the nucleotide sequences of LOC284723 BINDING SITE1 and LOC284723 BINDING SITE2, designated SEQ ID:5347 and SEQ ID:13127 respectively, to the nucleotide sequence of GAM25 rNA, herein designated GAM RNA, also designated SEQ ID:206.

Another function of GAM25 is therefore inhibition of LOC284723 (Accession XP_211602.1). Accordingly, utilities of GAM25 include diagnosis, prevention and treatment of diseases and clinical conditions associated with LOC284723.

LOC284805 (Accession XP_209371.1) is another GAM25 target gene, herein designated TARGET GENE. LOC284805 BINDING SITE is a target binding site found in the 3' untranslated region of mRNA encoded by LOC284805, corresponding to a target binding site such as BINDING SITE I, BINDING SITE II or BINDING SITE III of FIG. 8. Table 4 illustrates the complementarity of the nucleotide sequences of LOC284805 BINDING SITE, designated SEQ ID:12293, to the nucleotide sequence of GAM25 rNA, herein designated GAM RNA, also designated SEQ ID:206.

Another function of GAM25 is therefore inhibition of LOC284805 (Accession XP_209371.1). Accordingly, utilities of GAM25 include diagnosis, prevention and treatment of diseases and clinical conditions associated with LOC284805.

LOC284853 (Accession XP_209383.1) is another GAM25 target gene, herein designated TARGET GENE. LOC284853 BINDING SITE is a target binding site found in the 3' untranslated region of mRNA encoded by LOC284853, corresponding to a target binding site such as BINDING SITE I, BINDING SITE II or BINDING SITE III of FIG. 8. Table 4 illustrates the complementarity of the nucleotide sequences of LOC284853 BINDING SITE, designated SEQ ID:15964, to the nucleotide sequence of GAM25 rNA, herein designated GAM RNA, also designated SEQ ID:206.

Another function of GAM25 is therefore inhibition of LOC284853 (Accession XP_209383.1). Accordingly, utilities of GAM25 include diagnosis, prevention and treatment of diseases and clinical conditions associated with LOC284853.

LOC284856 (Accession XP_302835.1) is another GAM25 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:15861, to the nucleotide sequence of GAM25 rNA, herein designated GAM RNA, also designated SEQ ID:206.

Another function of GAM25 is therefore inhibition of LOC284856 (Accession XP_302835.1). Accordingly, utilities of GAM25 include diagnosis, prevention and treatment of diseases and clinical conditions associated with LOC284856.

LOC284856 (Accession XP_211668.2) is another GAM25 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:15861, to the nucleotide sequence of GAM25 rNA, herein designated GAM RNA, also designated SEQ ID:206.

Another function of GAM25 is therefore inhibition of LOC284856 (Accession XP_211668.2). Accordingly, utilities of GAM25 include diagnosis, prevention and treatment of diseases and clinical conditions associated with LOC284856.

LOC284865 (Accession XP_211672.1) is another GAM25 target gene, herein designated TARGET GENE. LOC284865 BINDING SITE is a target binding site found in the 3' untranslated region of mRNA encoded by LOC284865, corresponding to a target binding site such as BINDING SITE I, BINDING SITE II or BINDING SITE III of FIG. 8. Table 4 illustrates the complementarity of the nucleotide sequences of LOC284865 BINDING SITE, designated SEQ ID:16384, to the nucleotide sequence of GAM25 rNA, herein designated GAM RNA, also designated SEQ ID:206.

Another function of GAM25 is therefore inhibition of LOC284865 (Accession XP_211672.1). Accordingly, utilities of GAM25 include diagnosis, prevention and treatment of diseases and clinical conditions associated with LOC284865.

LOC284934 (Accession XP_211696.1) is another GAM25 target gene, herein designated TARGET GENE. LOC284934 BINDING SITE1 and LOC284934 BINDING SITE2 are target binding sites found in untranslated regions of mRNA encoded by LOC284934, corresponding to target binding sites such as BINDING SITE I, BINDING SITE II or BINDING SITE III of FIG. 8. Table 4 illustrates the complementarity of the nucleotide sequences of LOC284934 BINDING SITE1 and LOC284934 BINDING SITE2, designated SEQ ID:2551 and SEQ ID:11777 respectively, to the nucleotide sequence of GAM25 rNA, herein designated GAM RNA, also designated SEQ ID:206.

Another function of GAM25 is therefore inhibition of LOC284934 (Accession XP_211696.1). Accordingly, utilities of GAM25 include diagnosis, prevention and treatment of diseases and clinical conditions associated with LOC284934.

LOC284950 (Accession XP_211703.1) is another GAM25 target gene, herein designated TARGET GENE. LOC284950 BINDING SITE is a target binding site found in the 3' untranslated region of mRNA encoded by LOC284950, corresponding to a target binding site such as BINDING SITE I, BINDING SITE II or BINDING SITE III of FIG. 8. Table 4 illustrates the complementarity of the nucleotide sequences of LOC284950 BINDING SITE, designated SEQ ID:3185, to the nucleotide sequence of GAM25 rNA, herein designated GAM RNA, also designated SEQ ID:206.

Another function of GAM25 is therefore inhibition of LOC284950 (Accession XP_211703.1). Accordingly, utilities of GAM25 include diagnosis, prevention and treatment of diseases and clinical conditions associated with LOC284950.

LOC285002 (Accession XP_211731.2) is another GAM25 target gene, herein designated TARGET GENE. LOC285002 BINDING SITE is a target binding site found in the 3' untranslated region of mRNA encoded by LOC285002, corresponding to a target binding site such as BINDING SITE I, BINDING SITE II or BINDING SITE III of FIG. 8. Table 4 illustrates the complementarity of the nucleotide sequences of LOC285002 BINDING SITE, designated SEQ ID:11586, to the nucleotide sequence of GAM25 rNA, herein designated GAM RNA, also designated SEQ ID:206.

Another function of GAM25 is therefore inhibition of LOC285002 (Accession XP_211731.2). Accordingly, utilities of GAM25 include diagnosis, prevention and treatment of diseases and clinical conditions associated with LOC285002.

LOC285026 (Accession XP_209440.1) is another GAM25 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:13592, to the nucleotide sequence of GAM25 rNA, herein designated GAM RNA, also designated SEQ ID:206.

Another function of GAM25 is therefore inhibition of LOC285026 (Accession XP_209440.1). Accordingly, utilities of GAM25 include diagnosis, prevention and treatment of diseases and clinical conditions associated with LOC285026.

LOC285033 (Accession XP_211739.1) is another GAM25 target gene, herein designated TARGET GENE. LOC285033 BINDING SITE is a target binding site found in the 3' untranslated region of mRNA encoded by LOC285033, corresponding to a target binding site such as BINDING SITE I, BINDING SITE II or BINDING SITE III of FIG. 8. Table 4 illustrates the complementarity of the nucleotide sequences of LOC285033 BINDING SITE, designated SEQ ID:20139, to the nucleotide sequence of GAM25 rNA, herein designated GAM RNA, also designated SEQ ID:206.

Another function of GAM25 is therefore inhibition of LOC285033 (Accession XP_211739.1). Accordingly, utilities of GAM25 include diagnosis, prevention and treatment of diseases and clinical conditions associated with LOC285033.

LOC285088 (Accession XP_209465.1) is another GAM25 target gene, herein designated TARGET GENE. LOC285088 BINDING SITE is a target binding site found in the 3' untranslated region of mRNA encoded by LOC285088, corresponding to a target binding site such as BINDING SITE I, BINDING SITE II or BINDING SITE III of FIG. 8. Table 4 illustrates the complementarity of the nucleotide sequences of LOC285088 BINDING SITE, designated SEQ ID:12540, to the nucleotide sequence of GAM25 rNA, herein designated GAM RNA, also designated SEQ ID:206.

Another function of GAM25 is therefore inhibition of LOC285088 (Accession XP_209465.1). Accordingly, utilities of GAM25 include diagnosis, prevention and treatment of diseases and clinical conditions associated with LOC285088.

LOC285127 (Accession XP_211771.1) is another GAM25 target gene, herein designated TARGET GENE. LOC285127 BINDING SITE is a target binding site found in the 3' untranslated region of mRNA encoded by LOC285127, corresponding to a target binding site such as BINDING SITE I, BINDING SITE II or BINDING SITE III of FIG. 8. Table 4 illustrates the complementarity of the nucleotide sequences of LOC285127 BINDING SITE, designated SEQ ID:14649, to the nucleotide sequence of GAM25 rNA, herein designated GAM RNA, also designated SEQ ID:206.

Another function of GAM25 is therefore inhibition of LOC285127 (Accession XP_211771.1). Accordingly, utilities of GAM25 include diagnosis, prevention and treatment of diseases and clinical conditions associated with LOC285127.

LOC285136 (Accession XP_211777.1) is another GAM25 target gene, herein designated TARGET GENE. LOC285136 BINDING SITE is a target binding site found in the 5' untranslated region of mRNA encoded by LOC285136, corresponding to a target binding site such as BINDING SITE I, BINDING SITE II or BINDING SITE III of FIG. 8. Table 4 illustrates the complementarity of the nucleotide sequences of LOC285136 BINDING SITE, designated SEQ ID:3517, to the nucleotide sequence of GAM25 rNA, herein designated GAM RNA, also designated SEQ ID:206.

Another function of GAM25 is therefore inhibition of LOC285136 (Accession XP_211777.1). Accordingly, utilities of GAM25 include diagnosis, prevention and treatment of diseases and clinical conditions associated with LOC285136.

LOC285299 (Accession XP_209554.1) is another GAM25 target gene, herein designated TARGET GENE. LOC285299 BINDING SITE is a target binding site found in the 3' untranslated region of mRNA encoded by LOC285299, corresponding to a target binding site such as BINDING SITE I, BINDING SITE II or BINDING SITE III of FIG. 8. Table 4 illustrates the complementarity of the nucleotide sequences of LOC285299 BINDING SITE, designated SEQ ID:2421, to the nucleotide sequence of GAM25 rNA, herein designated GAM RNA, also designated SEQ ID:206.

Another function of GAM25 is therefore inhibition of LOC285299 (Accession XP_209554.1). Accordingly, utilities of GAM25 include diagnosis, prevention and treatment of diseases and clinical conditions associated with LOC285299.

LOC285334 (Accession XP_211844.1) is another GAM25 target gene, herein designated TARGET GENE. LOC285334 BINDING SITE is a target binding site found in the 3' untranslated region of mRNA encoded by LOC285334, corresponding to a target binding site such as BINDING SITE I, BINDING SITE II or BINDING SITE III of FIG. 8. Table 4 illustrates the complementarity of the nucleotide sequences of LOC285334 BINDING SITE, designated SEQ ID:9968, to the nucleotide sequence of GAM25 rNA, herein designated GAM RNA, also designated SEQ ID:206.

Another function of GAM25 is therefore inhibition of LOC285334 (Accession XP_211844.1). Accordingly, utilities of GAM25 include diagnosis, prevention and treatment of diseases and clinical conditions associated with LOC285334.

LOC285344 (Accession XP_211853.1) is another GAM25 target gene, herein designated TARGET GENE. LOC285344 BINDING SITE is a target binding site found in the 5' untranslated region of mRNA encoded by LOC285344, corresponding to a target binding site such as BINDING SITE I, BINDING SITE II or BINDING SITE III of FIG. 8. Table 4 illustrates the complementarity of the nucleotide sequences of LOC285344 BINDING SITE, designated SEQ ID:14925, to the nucleotide sequence of GAM25 rNA, herein designated GAM RNA, also designated SEQ ID:206.

Another function of GAM25 is therefore inhibition of LOC285344 (Accession XP_211853.1). Accordingly, utilities of GAM25 include diagnosis, prevention and treatment of diseases and clinical conditions associated with LOC285344.

LOC285345 (Accession XP_211854.1) is another GAM25 target gene, herein designated TARGET GENE. LOC285345 BINDING SITE is a target binding site found in the 3' untranslated region of mRNA encoded by LOC285345, corresponding to a target binding site such as BINDING SITE I, BINDING SITE II or BINDING SITE III of FIG. 8. Table 4 illustrates the complementarity of the nucleotide sequences of LOC285345 BINDING SITE, designated SEQ ID:1100, to the nucleotide sequence of GAM25 rNA, herein designated GAM RNA, also designated SEQ ID:206.

Another function of GAM25 is therefore inhibition of LOC285345 (Accession XP_211854.1). Accordingly, utilities of GAM25 include diagnosis, prevention and treatment of diseases and clinical conditions associated with LOC285345.

LOC285398 (Accession XP_209593.1) is another GAM25 target gene, herein designated TARGET GENE. LOC285398 BINDING SITE1 and LOC285398 BINDING SITE2 are target binding sites found in untranslated regions of mRNA encoded by LOC285398, corresponding to target binding sites such as BINDING SITE I, BINDING SITE II or BINDING SITE III of FIG. 8. Table 4 illustrates the complementarity of the nucleotide sequences of LOC285398 BINDING SITE1 and LOC285398 BINDING SITE2, designated SEQ ID:17312 and SEQ ID:2929 respectively, to the nucleotide sequence of GAM25 rNA, herein designated GAM RNA, also designated SEQ ID:206.

Another function of GAM25 is therefore inhibition of LOC285398 (Accession XP_209593.1). Accordingly, utilities of GAM25 include diagnosis, prevention and treatment of diseases and clinical conditions associated with LOC285398.

LOC285510 (Accession XP_209643.1) is another GAM25 target gene, herein designated TARGET GENE. LOC285510 BINDING SITE is a target binding site found in the 3' untranslated region of mRNA encoded by LOC285510, corresponding to a target binding site such as BINDING SITE I, BINDING SITE II or BINDING SITE III of FIG. 8. Table 4 illustrates the complementarity of the nucleotide sequences of LOC285510 BINDING SITE, designated SEQ ID:1520, to the nucleotide sequence of GAM25 rNA, herein designated GAM RNA, also designated SEQ ID:206.

Another function of GAM25 is therefore inhibition of LOC285510 (Accession XP_209643.1). Accordingly, utilities of GAM25 include diagnosis, prevention and treatment of diseases and clinical conditions associated with LOC285510.

LOC285533 (Accession NP_775933.1) is another GAM25 target gene, herein designated TARGET GENE. LOC285533 BINDING SITE is a target binding site found in the 3' untranslated region of mRNA encoded by LOC285533, corresponding to a target binding site such as BINDING SITE I, BINDING SITE II or BINDING SITE III of FIG. 8. Table 4 illustrates the complementarity of the nucleotide sequences of LOC285533 BINDING SITE, designated SEQ ID:13006, to the nucleotide sequence of GAM25 rNA, herein designated GAM RNA, also designated SEQ ID:206.

Another function of GAM25 is therefore inhibition of LOC285533 (Accession NP_775933.1). Accordingly, utilities of GAM25 include diagnosis, prevention and treatment of diseases and clinical conditions associated with LOC285533.

LOC285589 (Accession XP_209671.1) is another GAM25 target gene, herein designated TARGET GENE. LOC285589 BINDING SITE1 and LOC285589 BINDING SITE2 are target binding sites found in untranslated regions of mRNA encoded by LOC285589, corresponding to target binding sites such as BINDING SITE I, BINDING SITE II or BINDING SITE III of FIG. 8. Table 4 illustrates the complementarity of the nucleotide sequences of LOC285589 BINDING SITE1 and LOC285589 BINDING SITE2, designated SEQ ID:8906 and SEQ ID:16135 respectively, to the nucleotide sequence of GAM25 rNA, herein designated GAM RNA, also designated SEQ ID:206.

Another function of GAM25 is therefore inhibition of LOC285589 (Accession XP_209671.1). Accordingly, utilities of GAM25 include diagnosis, prevention and treatment of diseases and clinical conditions associated with LOC285589.

LOC285626 (Accession XP_211959.1) is another GAM25 target gene, herein designated TARGET GENE. LOC285626 BINDING SITE is a target binding site found in the 5' untranslated region of mRNA encoded by LOC285626, corresponding to a target binding site such as BINDING SITE I, BINDING SITE II or BINDING SITE III of FIG. 8. Table 4 illustrates the complementarity of the nucleotide sequences of LOC285626 BINDING SITE, designated SEQ ID:9340, to the nucleotide sequence of GAM25 rNA, herein designated GAM RNA, also designated SEQ ID:206.

Another function of GAM25 is therefore inhibition of LOC285626 (Accession XP_211959.1). Accordingly, utilities of GAM25 include diagnosis, prevention and treatment of diseases and clinical conditions associated with LOC285626.

LOC285683 (Accession XP_211980.1) is another GAM25 target gene, herein designated TARGET GENE. LOC285683 BINDING SITE is a target binding site found in the 5' untranslated region of mRNA encoded by LOC285683, corresponding to a target binding site such as BINDING SITE I, BINDING SITE II or BINDING SITE III of FIG. 8. Table 4 illustrates the complementarity of the nucleotide sequences of LOC285683 BINDING SITE, designated SEQ ID:4038, to the nucleotide sequence of GAM25 rNA, herein designated GAM RNA, also designated SEQ ID:206.

Another function of GAM25 is therefore inhibition of LOC285683 (Accession XP_211980.1). Accordingly, utilities of GAM25 include diagnosis, prevention and treatment of diseases and clinical conditions associated with LOC285683.

LOC285689 (Accession XP_209724.1) is another GAM25 target gene, herein designated TARGET GENE. LOC285689 BINDING SITE is a target binding site found in the 3' untranslated region of mRNA encoded by LOC285689, corresponding to a target binding site such as BINDING SITE I, BINDING SITE II or BINDING SITE III of FIG. 8. Table 4 illustrates the complementarity of the nucleotide sequences of LOC285689 BINDING SITE, designated SEQ ID:12373, to the nucleotide sequence of GAM25 rNA, herein designated GAM RNA, also designated SEQ ID:206.

Another function of GAM25 is therefore inhibition of LOC285689 (Accession XP_209724.1). Accordingly, utilities of GAM25 include diagnosis, prevention and treatment of diseases and clinical conditions associated with LOC285689.

LOC285744 (Accession XP_209743.1) is another GAM25 target gene, herein designated TARGET GENE. LOC285744 BINDING SITE1 and LOC285744 BINDING SITE2 are target binding sites found in untranslated regions of mRNA encoded by LOC285744, corresponding to target binding sites such as BINDING SITE I, BINDING SITE II or BINDING SITE III of FIG. 8. Table 4 illustrates the complementarity of the nucleotide sequences of LOC285744 BINDING SITE1 and LOC285744 BINDING SITE2, designated SEQ ID:18188 and SEQ ID:13900 respectively, to the nucleotide sequence of GAM25 rNA, herein designated GAM RNA, also designated SEQ ID:206.

Another function of GAM25 is therefore inhibition of LOC285744 (Accession XP_209743.1). Accordingly, utilities of GAM25 include diagnosis, prevention and treatment of diseases and clinical conditions associated with LOC285744.

LOC285760 (Accession XP_209750.1) is another GAM25 target gene, herein designated TARGET GENE. LOC285760 BINDING SITE is a target binding site found in the 3' untranslated region of mRNA encoded by LOC285760, corresponding to a target binding site such as BINDING SITE I, BINDING SITE II or BINDING SITE III of FIG. 8. Table 4 illustrates the complementarity of the nucleotide sequences of LOC285760 BINDING SITE, designated SEQ ID:8007, to the nucleotide sequence of GAM25 rNA, herein designated GAM RNA, also designated SEQ ID:206.

Another function of GAM25 is therefore inhibition of LOC285760 (Accession XP_209750.1). Accordingly, utilities of GAM25 include diagnosis, prevention and treatment of diseases and clinical conditions associated with LOC285760.

LOC285768 (Accession XP_212017.1) is another GAM25 target gene, herein designated TARGET GENE. LOC285768 BINDING SITE is a target binding site found in the 5' untranslated region of mRNA encoded by LOC285768, corresponding to a target binding site such as BINDING SITE I, BINDING SITE II or BINDING SITE III of FIG. 8. Table 4 illustrates the complementarity of the nucleotide sequences of LOC285768 BINDING SITE, designated SEQ ID:15725, to the nucleotide sequence of GAM25 rNA, herein designated GAM RNA, also designated SEQ ID:206.

Another function of GAM25 is therefore inhibition of LOC285768 (Accession XP_212017.1). Accordingly, utilities of GAM25 include diagnosis, prevention and treatment of diseases and clinical conditions associated with LOC285768.

LOC285812 (Accession XP_212055.1) is another GAM25 target gene, herein designated TARGET GENE. LOC285812 BINDING SITE is a target binding site found in the 3' untranslated region of mRNA encoded by LOC285812, corresponding to a target binding site such as BINDING SITE I, BINDING SITE II or BINDING SITE III of FIG. 8. Table 4 illustrates the complementarity of the nucleotide sequences of LOC285812 BINDING SITE, designated SEQ ID:6449, to the nucleotide sequence of GAM25 rNA, herein designated GAM RNA, also designated SEQ ID:206.

Another function of GAM25 is therefore inhibition of LOC285812 (Accession XP_212055.1). Accordingly, utilities of GAM25 include diagnosis, prevention and treatment of diseases and clinical conditions associated with LOC285812.

LOC285813 (Accession XP_212036.1) is another GAM25 target gene, herein designated TARGET GENE. LOC285813 BINDING SITE is a target binding site found in the 5' untranslated region of mRNA encoded by LOC285813, corresponding to a target binding site such as BINDING SITE I, BINDING SITE II or BINDING SITE III of FIG. 8. Table 4 illustrates the complementarity of the nucleotide sequences of LOC285813 BINDING SITE, designated SEQ ID:7686, to the nucleotide sequence of GAM25 rNA, herein designated GAM RNA, also designated SEQ ID:206.

Another function of GAM25 is therefore inhibition of LOC285813 (Accession XP_212036.1). Accordingly, utilities of GAM25 include diagnosis, prevention and treatment of diseases and clinical conditions associated with LOC285813.

LOC285822 (Accession XP_209777.1) is another GAM25 target gene, herein designated TARGET GENE. LOC285822 BINDING SITE is a target binding site found in the 5' untranslated region of mRNA encoded by LOC285822, corresponding to a target binding site such as BINDING SITE I, BINDING SITE II or BINDING SITE III of FIG. 8. Table 4 illustrates the complementarity of the nucleotide sequences of LOC285822 BINDING SITE, designated SEQ ID:7527, to the nucleotide sequence of GAM25 rNA, herein designated GAM RNA, also designated SEQ ID:206.

Another function of GAM25 is therefore inhibition of LOC285822 (Accession XP_209777.1). Accordingly, utilities of GAM25 include diagnosis, prevention and treatment of diseases and clinical conditions associated with LOC285822.

LOC285843 (Accession XP_212034.1) is another GAM25 target gene, herein designated TARGET GENE. LOC285843 BINDING SITE is a target binding site found in the 5' untranslated region of mRNA encoded by LOC285843, corresponding to a target binding site such as BINDING SITE I, BINDING SITE II or BINDING SITE III of FIG. 8. Table 4 illustrates the complementarity of the nucleotide sequences of LOC285843 BINDING SITE, designated SEQ ID:11310, to the nucleotide sequence of GAM25 rNA, herein designated GAM RNA, also designated SEQ ID:206.

Another function of GAM25 is therefore inhibition of LOC285843 (Accession XP_212034.1). Accordingly, utilities of GAM25 include diagnosis, prevention and treatment of diseases and clinical conditions associated with LOC285843.

LOC285853 (Accession XP_209779.1) is another GAM25 target gene, herein designated TARGET GENE. LOC285853 BINDING SITE is a target binding site found in the 3' untranslated region of mRNA encoded by LOC285853, corresponding to a target binding site such as BINDING SITE I, BINDING SITE II or BINDING SITE III of FIG. 8. Table 4 illustrates the complementarity of the nucleotide sequences of LOC285853 BINDING SITE, designated SEQ ID:4561, to the nucleotide sequence of GAM25 rNA, herein designated GAM RNA, also designated SEQ ID:206.

Another function of GAM25 is therefore inhibition of LOC285853 (Accession XP_209779.1). Accordingly, utilities of GAM25 include diagnosis, prevention and treatment of diseases and clinical conditions associated with LOC285853.

LOC285896 (Accession XP_209806.1) is another GAM25 target gene, herein designated TARGET GENE. LOC285896 BINDING SITE is a target binding site found in the 3' untranslated region of mRNA encoded by LOC285896, corresponding to a target binding site such as BINDING SITE I, BINDING SITE II or BINDING SITE III of FIG. 8. Table 4 illustrates the complementarity of the nucleotide sequences of LOC285896 BINDING SITE, designated SEQ ID:9727, to the nucleotide sequence of GAM25 rNA, herein designated GAM RNA, also designated SEQ ID:206.

Another function of GAM25 is therefore inhibition of LOC285896 (Accession XP_209806.1). Accordingly, utilities of GAM25 include diagnosis, prevention and treatment of diseases and clinical conditions associated with LOC285896.

LOC285923 (Accession XP_212104.1) is another GAM25 target gene, herein designated TARGET GENE. LOC285923 BINDING SITE is a target binding site found in the 3' untranslated region of mRNA encoded by LOC285923, corresponding to a target binding site such as BINDING SITE I, BINDING SITE II or BINDING SITE III of FIG. 8. Table 4 illustrates the complementarity of the nucleotide sequences of LOC285923 BINDING SITE, designated SEQ ID:951, to the nucleotide sequence of GAM25 rNA, herein designated GAM RNA, also designated SEQ ID:206.

Another function of GAM25 is therefore inhibition of LOC285923 (Accession XP_212104.1). Accordingly, utilities of GAM25 include diagnosis, prevention and treatment of diseases and clinical conditions associated with LOC285923.

LOC285930 (Accession XP_209818.1) is another GAM25 target gene, herein designated TARGET GENE. LOC285930 BINDING SITE is a target binding site found in the 5' untranslated region of mRNA encoded by LOC285930, corresponding to a target binding site such as BINDING SITE I, BINDING SITE II or BINDING SITE III of FIG. 8. Table 4 illustrates the complementarity of the nucleotide sequences of LOC285930 BINDING SITE, designated SEQ ID:12786, to the nucleotide sequence of GAM25 rNA, herein designated GAM RNA, also designated SEQ ID:206.

Another function of GAM25 is therefore inhibition of LOC285930 (Accession XP_209818.1). Accordingly, utilities of GAM25 include diagnosis, prevention and treatment of diseases and clinical conditions associated with LOC285930.

LOC285972 (Accession XP_212105.1) is another GAM25 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:20178, to the nucleotide sequence of GAM25 rNA, herein designated GAM RNA, also designated SEQ ID:206.

Another function of GAM25 is therefore inhibition of LOC285972 (Accession XP_212105.1). Accordingly, utilities of GAM25 include diagnosis, prevention and treatment of diseases and clinical conditions associated with LOC285972.

LOC286007 (Accession XP_212133.1) is another GAM25 target gene, herein designated TARGET GENE. LOC286007 BINDING SITE is a target binding site found in the 5' untranslated region of mRNA encoded by LOC286007, corresponding to a target binding site such as BINDING SITE I, BINDING SITE II or BINDING SITE III of FIG. 8. Table 4 illustrates the complementarity of the nucleotide sequences of LOC286007 BINDING SITE, designated SEQ ID:8978, to the nucleotide sequence of GAM25 rNA, herein designated GAM RNA, also designated SEQ ID:206.

Another function of GAM25 is therefore inhibition of LOC286007 (Accession XP_212133.1). Accordingly, utilities of GAM25 include diagnosis, prevention and treatment of diseases and clinical conditions associated with LOC286007.

LOC286078 (Accession XP_212163.1) is another GAM25 target gene, herein designated TARGET GENE. LOC286078 BINDING SITE1 and LOC286078 BINDING SITE2 are target binding sites found in untranslated regions of mRNA encoded by LOC286078, corresponding to target binding sites such as BINDING SITE I, BINDING SITE II or BINDING SITE III of FIG. 8. Table 4 illustrates the complementarity of the nucleotide sequences of LOC286078 BINDING SITE1 and LOC286078 BINDING SITE2, designated SEQ ID:1126 and SEQ ID:11384 respectively, to the nucleotide sequence of GAM25 rNA, herein designated GAM RNA, also designated SEQ ID:206.

Another function of GAM25 is therefore inhibition of LOC286078 (Accession XP_212163.1). Accordingly, utilities of GAM25 include diagnosis, prevention and treatment of diseases and clinical conditions associated with LOC286078.

LOC286090 (Accession XP_212166.3) is another GAM25 target gene, herein designated TARGET GENE. LOC286090 BINDING SITE is a target binding site found in the 5' untranslated region of mRNA encoded by LOC286090, corresponding to a target binding site such as BINDING SITE I, BINDING SITE II or BINDING SITE III of FIG. 8. Table 4 illustrates the complementarity of the nucleotide sequences of LOC286090 BINDING SITE, designated SEQ ID:6502, to the nucleotide sequence of GAM25 rNA, herein designated GAM RNA, also designated SEQ ID:206.

Another function of GAM25 is therefore inhibition of LOC286090 (Accession XP_212166.3). Accordingly, utilities of GAM25 include diagnosis, prevention and treatment of diseases and clinical conditions associated with LOC286090.

LOC286108 (Accession XP_212175.1) is another GAM25 target gene, herein designated TARGET GENE. LOC286108 BINDING SITE is a target binding site found in the 5' untranslated region of mRNA encoded by LOC286108, corresponding to a target binding site such as BINDING SITE I, BINDING SITE II or BINDING SITE III of FIG. 8. Table 4 illustrates the complementarity of the nucleotide sequences of LOC286108 BINDING SITE, designated SEQ ID:9054, to the nucleotide sequence of GAM25 rNA, herein designated GAM RNA, also designated SEQ ID:206.

Another function of GAM25 is therefore inhibition of LOC286108 (Accession XP_212175.1). Accordingly, utilities of GAM25 include diagnosis, prevention and treatment of diseases and clinical conditions associated with LOC286108.

LOC286208 (Accession XP_212230.1) is another GAM25 target gene, herein designated TARGET GENE. LOC286208 BINDING SITE1 through LOC286208 BINDING SITE3 are target binding sites found in untranslated regions of mRNA encoded by LOC286208, corresponding to target binding sites such as BINDING SITE I, BINDING SITE II or BINDING SITE III of FIG. 8. Table 4 illustrates the complementarity of the nucleotide sequences of LOC286208 BINDING SITE1 through LOC286208 BINDING SITE3, designated SEQ ID:2802, SEQ ID:4183 and SEQ ID:16198 respectively, to the nucleotide sequence of GAM25 rNA, herein designated GAM RNA, also designated SEQ ID:206.

Another function of GAM25 is therefore inhibition of LOC286208 (Accession XP_212230.1). Accordingly, utilities of GAM25 include diagnosis, prevention and treatment of diseases and clinical conditions associated with LOC286208.

LOC286215 (Accession XP_212228.1) is another GAM25 target gene, herein designated TARGET GENE. LOC286215 BINDING SITE is a target binding site found in the 5' untranslated region of mRNA encoded by LOC286215, corresponding to a target binding site such as BINDING SITE I, BINDING SITE II or BINDING SITE III of FIG. 8. Table 4 illustrates the complementarity of the nucleotide sequences of LOC286215 BINDING SITE, designated SEQ ID:18265, to the nucleotide sequence of GAM25 rNA, herein designated GAM RNA, also designated SEQ ID:206.

Another function of GAM25 is therefore inhibition of LOC286215 (Accession XP_212228.1). Accordingly, utilities of GAM25 include diagnosis, prevention and treatment of diseases and clinical conditions associated with LOC286215.

LOC286341 (Accession XP_212278.1) is another GAM25 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:12540, to the nucleotide sequence of GAM25 rNA, herein designated GAM RNA, also designated SEQ ID:206.

Another function of GAM25 is therefore inhibition of LOC286341 (Accession XP_212278.1). Accordingly, utilities of GAM25 include diagnosis, prevention and treatment of diseases and clinical conditions associated with LOC286341.

LOC286381 (Accession XP_212298.1) is another GAM25 target gene, herein designated TARGET GENE. LOC286381 BINDING SITE is a target binding site found in the 3' untranslated region of mRNA encoded by LOC286381, corresponding to a target binding site such as BINDING SITE I, BINDING SITE II or BINDING SITE III of FIG. 8. Table 4 illustrates the complementarity of the nucleotide sequences of LOC286381 BINDING SITE, designated SEQ ID:18747, to the nucleotide sequence of GAM25 rNA, herein designated GAM RNA, also designated SEQ ID:206.

Another function of GAM25 is therefore inhibition of LOC286381 (Accession XP_212298.1). Accordingly, utilities of GAM25 include diagnosis, prevention and treatment of diseases and clinical conditions associated with LOC286381.

LOC286401 (Accession XP_212310.1) is another GAM25 target gene, herein designated TARGET GENE. LOC286401 BINDING SITE is a target binding site found in the 5' untranslated region of mRNA encoded by LOC286401, corresponding to a target binding site such as BINDING SITE I, BINDING SITE II or BINDING SITE III of FIG. 8. Table 4 illustrates the complementarity of the nucleotide sequences of LOC286401 BINDING SITE, designated SEQ ID:7029, to the nucleotide sequence of GAM25 rNA, herein designated GAM RNA, also designated SEQ ID:206.

Another function of GAM25 is therefore inhibition of LOC286401 (Accession XP_212310.1). Accordingly, utilities of GAM25 include diagnosis, prevention and treatment of diseases and clinical conditions associated with LOC286401.

LOC286435 (Accession XP_210047.1) is another GAM25 target gene, herein designated TARGET GENE. LOC286435 BINDING SITE is a target binding site found in the 3' untranslated region of mRNA encoded by LOC286435, corresponding to a target binding site such as BINDING SITE I, BINDING SITE II or BINDING SITE III of FIG. 8. Table 4 illustrates the complementarity of the nucleotide sequences of LOC286435 BINDING SITE, designated SEQ ID:18922, to the nucleotide sequence of GAM25 rNA, herein designated GAM RNA, also designated SEQ ID:206.

Another function of GAM25 is therefore inhibition of LOC286435 (Accession XP_210047.1). Accordingly, utilities of GAM25 include diagnosis, prevention and treatment of diseases and clinical conditions associated with LOC286435.

LOC338562 (Accession XP_294654.1) is another GAM25 target gene, herein designated TARGET GENE. LOC338562 BINDING SITE is a target binding site found in the 3' untranslated region of mRNA encoded by LOC338562, corresponding to a target binding site such as BINDING SITE I, BINDING SITE II or BINDING SITE III of FIG. 8. Table 4 illustrates the complementarity of the nucleotide sequences of LOC338562 BINDING SITE, designated SEQ ID:9042, to the nucleotide sequence of GAM25 rNA, herein designated GAM RNA, also designated SEQ ID:206.

Another function of GAM25 is therefore inhibition of LOC338562 (Accession XP_294654.1). Accordingly, utilities of GAM25 include diagnosis, prevention and treatment of diseases and clinical conditions associated with LOC338562.

LOC338773 (Accession XP_290570.1) is another GAM25 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:8986, to the nucleotide sequence of GAM25 rNA, herein designated GAM RNA, also designated SEQ ID:206.

Another function of GAM25 is therefore inhibition of LOC338773 (Accession XP_290570.1). Accordingly, utilities of GAM25 include diagnosis, prevention and treatment of diseases and clinical conditions associated with LOC338773.

LOC338841 (Accession XP_290597.1) is another GAM25 target gene, herein designated TARGET GENE. LOC338841 BINDING SITE is a target binding site found in the 3' untranslated region of mRNA encoded by LOC338841, corresponding to a target binding site such as BINDING SITE I, BINDING SITE II or BINDING SITE III of FIG. 8. Table 4 illustrates the complementarity of the nucleotide sequences of LOC338841 BINDING SITE, designated SEQ ID:3313, to the nucleotide sequence of GAM25 rNA, herein designated GAM RNA, also designated SEQ ID:206.

Another function of GAM25 is therefore inhibition of LOC338841 (Accession XP_290597.1). Accordingly, utilities of GAM25 include diagnosis, prevention and treatment of diseases and clinical conditions associated with LOC338841.

LOC338899 (Accession XP_294740.1) is another GAM25 target gene, herein designated TARGET GENE. LOC338899 BINDING SITE is a target binding site found in the 5' untranslated region of mRNA encoded by LOC338899, corresponding to a target binding site such as BINDING SITE I, BINDING SITE II or BINDING SITE III of FIG. 8. Table 4 illustrates the complementarity of the nucleotide sequences of LOC338899 BINDING SITE, designated SEQ ID:7214, to the nucleotide sequence of GAM25 rNA, herein designated GAM RNA, also designated SEQ ID:206.

Another function of GAM25 is therefore inhibition of LOC338899 (Accession XP_294740.1). Accordingly, utilities of GAM25 include diagnosis, prevention and treatment of diseases and clinical conditions associated with LOC338899.

LOC338923 (Accession XP_294742.1) is another GAM25 target gene, herein designated TARGET GENE. LOC338923 BINDING SITE1 and LOC338923 BINDING SITE2 are target binding sites found in untranslated regions of mRNA encoded by LOC338923, corresponding to target binding sites such as BINDING SITE I, BINDING SITE II or BINDING SITE III of FIG. 8. Table 4 illustrates the complementarity of the nucleotide sequences of LOC338923 BINDING SITE1 and LOC338923 BINDING SITE2, designated SEQ ID:14301 and SEQ ID:9654 respectively, to the nucleotide sequence of GAM25 rNA, herein designated GAM RNA, also designated SEQ ID:206.

Another function of GAM25 is therefore inhibition of LOC338923 (Accession XP_294742.1). Accordingly, utilities of GAM25 include diagnosis, prevention and treatment of diseases and clinical conditions associated with LOC338923.

LOC338991 (Accession XP_290663.1) is another GAM25 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:11559, to the nucleotide sequence of GAM25 rNA, herein designated GAM RNA, also designated SEQ ID:206.

Another function of GAM25 is therefore inhibition of LOC338991 (Accession XP_290663.1). Accordingly, utilities of GAM25 include diagnosis, prevention and treatment of diseases and clinical conditions associated with LOC338991.

LOC338999 (Accession XP_290659.1) is another GAM25 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:11559, to the nucleotide sequence of GAM25 rNA, herein designated GAM RNA, also designated SEQ ID:206.

Another function of GAM25 is therefore inhibition of LOC338999 (Accession XP_290659.1). Accordingly, utilities of GAM25 include diagnosis, prevention and treatment of diseases and clinical conditions associated with LOC338999.

LOC339077 (Accession XP_294802.2) is another GAM25 target gene, herein designated TARGET GENE. LOC339077 BINDING SITE is a target binding site found in the 3' untranslated region of mRNA encoded by LOC339077, corresponding to a target binding site such as BINDING SITE I, BINDING SITE II or BINDING SITE III of FIG. 8. Table 4 illustrates the complementarity of the nucleotide sequences of LOC339077 BINDING SITE, designated SEQ ID:4804, to the nucleotide sequence of GAM25 rNA, herein designated GAM RNA, also designated SEQ ID:206.

Another function of GAM25 is therefore inhibition of LOC339077 (Accession XP_294802.2). Accordingly, utilities of GAM25 include diagnosis, prevention and treatment of diseases and clinical conditions associated with LOC339077.

LOC339078 (Accession XP_290692.1) is another GAM25 target gene, herein designated TARGET GENE. LOC339078 BINDING SITE is a target binding site found in the 3' untranslated region of mRNA encoded by LOC339078, corresponding to a target binding site such as BINDING SITE I, BINDING SITE II or BINDING SITE III of FIG. 8. Table 4 illustrates the complementarity of the nucleotide sequences of LOC339078 BINDING SITE, designated SEQ ID:7452, to the nucleotide sequence of GAM25 rNA, herein designated GAM RNA, also designated SEQ ID:206.

Another function of GAM25 is therefore inhibition of LOC339078 (Accession XP_290692.1). Accordingly, utilities of GAM25 include diagnosis, prevention and treatment of diseases and clinical conditions associated with LOC339078.

LOC339146 (Accession XP_294825.1) is another GAM25 target gene, herein designated TARGET GENE. LOC339146 BINDING SITE is a target binding site found in the 5' untranslated region of mRNA encoded by LOC339146, corresponding to a target binding site such as BINDING SITE I, BINDING SITE II or BINDING SITE III of FIG. 8. Table 4 illustrates the complementarity of the nucleotide sequences of LOC339146 BINDING SITE, designated SEQ ID:9303, to the nucleotide sequence of GAM25 rNA, herein designated GAM RNA, also designated SEQ ID:206.

Another function of GAM25 is therefore inhibition of LOC339146 (Accession XP_294825.1). Accordingly, utilities of GAM25 include diagnosis, prevention and treatment of diseases and clinical conditions associated with LOC339146.

LOC339178 (Accession XP_290742.1) is another GAM25 target gene, herein designated TARGET GENE. LOC339178 BINDING SITE is a target binding site found in the 3' untranslated region of mRNA encoded by LOC339178, corresponding to a target binding site such as BINDING SITE I, BINDING SITE II or BINDING SITE III of FIG. 8. Table 4 illustrates the complementarity of the nucleotide sequences of LOC339178 BINDING SITE, designated SEQ ID:12883, to the nucleotide sequence of GAM25 rNA, herein designated GAM RNA, also designated SEQ ID:206.

Another function of GAM25 is therefore inhibition of LOC339178 (Accession XP_290742.1). Accordingly, utilities of GAM25 include diagnosis, prevention and treatment of diseases and clinical conditions associated with LOC339178.

LOC339283 (Accession XP_294899.2) is another GAM25 target gene, herein designated TARGET GENE. LOC339283 BINDING SITE is a target binding site found in the 5' untranslated region of mRNA encoded by LOC339283, corresponding to a target binding site such as BINDING SITE I, BINDING SITE II or BINDING SITE III of FIG. 8. Table 4 illustrates the complementarity of the nucleotide sequences of LOC339283 BINDING SITE, designated SEQ ID:13583, to the nucleotide sequence of GAM25 rNA, herein designated GAM RNA, also designated SEQ ID:206.

Another function of GAM25 is therefore inhibition of LOC339283 (Accession XP_294899.2). Accordingly, utilities of GAM25 include diagnosis, prevention and treatment of diseases and clinical conditions associated with LOC339283.

LOC339448 (Accession XP_290902.1) is another GAM25 target gene, herein designated TARGET GENE. LOC339448 BINDING SITE is a target binding site found in the 3' untranslated region of mRNA encoded by LOC339448, corresponding to a target binding site such as BINDING SITE I, BINDING SITE II or BINDING SITE III of FIG. 8. Table 4 illustrates the complementarity of the nucleotide sequences of LOC339448 BINDING SITE, designated SEQ ID:14390, to the nucleotide sequence of GAM25 rNA, herein designated GAM RNA, also designated SEQ ID:206.

Another function of GAM25 is therefore inhibition of LOC339448 (Accession XP_290902.1). Accordingly, utilities of GAM25 include diagnosis, prevention and treatment of diseases and clinical conditions associated with LOC339448.

LOC339492 (Accession XP_290919.1) is another GAM25 target gene, herein designated TARGET GENE. LOC339492 BINDING SITE1 and LOC339492 BINDING SITE2 are target binding sites found in untranslated regions of mRNA encoded by LOC339492, corresponding to target binding sites such as BINDING SITE I, BINDING SITE II or BINDING SITE III of FIG. 8. Table 4 illustrates the complementarity of the nucleotide sequences of LOC339492 BINDING SITE1 and LOC339492 BINDING SITE2, designated SEQ ID:14483 and SEQ ID:5531 respectively, to the nucleotide sequence of GAM25 rNA, herein designated GAM RNA, also designated SEQ ID:206.

Another function of GAM25 is therefore inhibition of LOC339492 (Accession XP_290919.1). Accordingly, utilities of GAM25 include diagnosis, prevention and treatment of diseases and clinical conditions associated with LOC339492.

LOC339622 (Accession XP_295016.1) is another GAM25 target gene, herein designated TARGET GENE. LOC339622 BINDING SITE is a target binding site found in the 5' untranslated region of mRNA encoded by LOC339622, corresponding to a target binding site such as BINDING SITE I, BINDING SITE II or BINDING SITE III of FIG. 8. Table 4 illustrates the complementarity of the nucleotide sequences of LOC339622 BINDING SITE, designated SEQ ID:12194, to the nucleotide sequence of GAM25 rNA, herein designated GAM RNA, also designated SEQ ID:206.

Another function of GAM25 is therefore inhibition of LOC339622 (Accession XP_295016.1). Accordingly, utilities of GAM25 include diagnosis, prevention and treatment of diseases and clinical conditions associated with LOC339622.

LOC339659 (Accession XP_290981.1) is another GAM25 target gene, herein designated TARGET GENE. LOC339659 BINDING SITE is a target binding site found in the 3' untranslated region of mRNA encoded by LOC339659, corresponding to a target binding site such as BINDING SITE I, BINDING SITE II or BINDING SITE III of FIG. 8. Table 4 illustrates the complementarity of the nucleotide sequences of LOC339659 BINDING SITE, designated SEQ ID:5829, to the nucleotide sequence of GAM25 rNA, herein designated GAM RNA, also designated SEQ ID:206.

Another function of GAM25 is therefore inhibition of LOC339659 (Accession XP_290981.1). Accordingly, utilities of GAM25 include diagnosis, prevention and treatment of diseases and clinical conditions associated with LOC339659.

LOC339694 (Accession XP_295035.1) is another GAM25 target gene, herein designated TARGET GENE. LOC339694 BINDING SITE is a target binding site found in the 5' untranslated region of mRNA encoded by LOC339694, corresponding to a target binding site such as BINDING SITE I, BINDING SITE II or BINDING SITE III of FIG. 8. Table 4 illustrates the complementarity of the nucleotide sequences of LOC339694 BINDING SITE, designated SEQ ID:3727, to the nucleotide sequence of GAM25 rNA, herein designated GAM RNA, also designated SEQ ID:206.

Another function of GAM25 is therefore inhibition of LOC339694 (Accession XP_295035.1). Accordingly, utilities of GAM25 include diagnosis, prevention and treatment of diseases and clinical conditions associated with LOC339694.

LOC339711 (Accession XP_295038.1) is another GAM25 target gene, herein designated TARGET GENE. LOC339711 BINDING SITE is a target binding site found in the 3' untranslated region of mRNA encoded by LOC339711, corresponding to a target binding site such as BINDING SITE I, BINDING SITE II or BINDING SITE III of FIG. 8. Table 4 illustrates the complementarity of the nucleotide sequences of LOC339711 BINDING SITE, designated SEQ ID:13056, to the nucleotide sequence of GAM25 rNA, herein designated GAM RNA, also designated SEQ ID:206.

Another function of GAM25 is therefore inhibition of LOC339711 (Accession XP_295038.1). Accordingly, utilities of GAM25 include diagnosis, prevention and treatment of diseases and clinical conditions associated with LOC339711.

LOC339813 (Accession XP_295074.1) is another GAM25 target gene, herein designated TARGET GENE. LOC339813 BINDING SITE1 and LOC339813 BINDING SITE2 are target binding sites found in untranslated regions of mRNA encoded by LOC339813, corresponding to target binding sites such as BINDING SITE I, BINDING SITE II or BINDING SITE III of FIG. 8. Table 4 illustrates the complementarity of the nucleotide sequences of LOC339813BINDING SITE1 and LOC339813 BINDING SITE2, designated SEQ ID:13017 and SEQ ID:1207 respectively, to the nucleotide sequence of GAM25 rNA, herein designated GAM RNA, also designated SEQ ID:206.

Another function of GAM25 is therefore inhibition of LOC339813 (Accession XP_295074.1). Accordingly, utilities of GAM25 include diagnosis, prevention and treatment of diseases and clinical conditions associated with LOC339813.

LOC339832 (Accession XP_295079.1) is another GAM25 target gene, herein designated TARGET GENE. LOC339832 BINDING SITE1 and LOC339832 BINDING SITE2 are target binding sites found in untranslated regions of mRNA encoded by LOC339832, corresponding to target binding sites such as BINDING SITE I, BINDING SITE II or BINDING SITE III of FIG. 8. Table 4 illustrates the complementarity of the nucleotide sequences of LOC339832BINDING SITE1 and LOC339832 BINDING SITE2, designated SEQ ID:7498 and SEQ ID:3980 respectively, to the nucleotide sequence of GAM25 rNA, herein designated GAM RNA, also designated SEQ ID:206.

Another function of GAM25 is therefore inhibition of LOC339832 (Accession XP_295079.1). Accordingly, utilities of GAM25 include diagnosis, prevention and treatment of diseases and clinical conditions associated with LOC339832.

LOC339833 (Accession XP_291031.1) is another GAM25 target gene, herein designated TARGET GENE. LOC339833 BINDING SITE is a target binding site found in the 3' untranslated region of mRNA encoded by LOC339833, corresponding to a target binding site such as BINDING SITE I, BINDING SITE II or BINDING SITE III of FIG. 8. Table 4 illustrates the complementarity of the nucleotide sequences of LOC339833 BINDING SITE, designated SEQ ID:1624, to the nucleotide sequence of GAM25 rNA, herein designated GAM RNA, also designated SEQ ID:206.

Another function of GAM25 is therefore inhibition of LOC339833 (Accession XP_291031.1). Accordingly, utilities of GAM25 include diagnosis, prevention and treatment of diseases and clinical conditions associated with LOC339833.

LOC339872 (Accession XP_291050.1) is another GAM25 target gene, herein designated TARGET GENE. LOC339872 BINDING SITE is a target binding site found in the 5' untranslated region of mRNA encoded by LOC339872, corresponding to a target binding site such as BINDING SITE I, BINDING SITE II or BINDING SITE III of FIG. 8. Table 4 illustrates the complementarity of the nucleotide sequences of LOC339872 BINDING SITE, designated SEQ ID:1784, to the nucleotide sequence of GAM25 rNA, herein designated GAM RNA, also designated SEQ ID:206.

Another function of GAM25 is therefore inhibition of LOC339872 (Accession XP_291050.1). Accordingly, utilities of GAM25 include diagnosis, prevention and treatment of diseases and clinical conditions associated with LOC339872.

LOC339924 (Accession XP_295103.1) is another GAM25 target gene, herein designated TARGET GENE. LOC339924 BINDING SITE is a target binding site found in the 3' untranslated region of mRNA encoded by LOC339924, corresponding to a target binding site such as BINDING SITE I, BINDING SITE II or BINDING SITE III of FIG. 8. Table 4 illustrates the complementarity of the nucleotide sequences of LOC339924 BINDING SITE, designated SEQ ID:6629, to the nucleotide sequence of GAM25 rNA, herein designated GAM RNA, also designated SEQ ID:206.

Another function of GAM25 is therefore inhibition of LOC339924 (Accession XP_295103.1). Accordingly, utilities of GAM25 include diagnosis, prevention and treatment of diseases and clinical conditions associated with LOC339924.

LOC340037 (Accession XP_295137.1) is another GAM25 target gene, herein designated TARGET GENE. LOC340037 BINDING SITE is a target binding site found in the 3' untranslated region of mRNA encoded by LOC340037, corresponding to a target binding site such as BINDING SITE I, BINDING SITE II or BINDING SITE III of FIG. 8. Table 4 illustrates the complementarity of the nucleotide sequences of LOC340037 BINDING SITE, designated SEQ ID:1128, to the nucleotide sequence of GAM25 rNA, herein designated GAM RNA, also designated SEQ ID:206.

Another function of GAM25 is therefore inhibition of LOC340037 (Accession XP_295137.1). Accordingly, utilities of GAM25 include diagnosis, prevention and treatment of diseases and clinical conditions associated with LOC340037.

LOC340138 (Accession XP_291153.1) is another GAM25 target gene, herein designated TARGET GENE. LOC340138 BINDING SITE is a target binding site found in the 3' untranslated region of mRNA encoded by LOC340138, corresponding to a target binding site such as BINDING SITE I, BINDING SITE II or BINDING SITE III of FIG. 8. Table 4 illustrates the complementarity of the nucleotide sequences of LOC340138 BINDING SITE, designated SEQ ID:18048, to the nucleotide sequence of GAM25 rNA, herein designated GAM RNA, also designated SEQ ID:206.

Another function of GAM25 is therefore inhibition of LOC340138 (Accession XP_291153.1). Accordingly, utilities of GAM25 include diagnosis, prevention and treatment of diseases and clinical conditions associated with LOC340138.

LOC340156 (Accession XP_291158.1) is another GAM25 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:5363, to the nucleotide sequence of GAM25 rNA, herein designated GAM RNA, also designated SEQ ID:206.

Another function of GAM25 is therefore inhibition of LOC340156 (Accession XP_291158.1). Accordingly, utilities of GAM25 include diagnosis, prevention and treatment of diseases and clinical conditions associated with LOC340156.

LOC340249 (Accession XP_291211.1) is another GAM25 target gene, herein designated TARGET GENE. LOC340249 BINDING SITE is a target binding site found in the 3' untranslated region of mRNA encoded by LOC340249, corresponding to a target binding site such as BINDING SITE I, BINDING SITE II or BINDING SITE III of FIG. 8. Table 4 illustrates the complementarity of the nucleotide sequences of LOC340249 BINDING SITE, designated SEQ ID:2255, to the nucleotide sequence of GAM25 rNA, herein designated GAM RNA, also designated SEQ ID:206.

Another function of GAM25 is therefore inhibition of LOC340249 (Accession XP_291211.1). Accordingly, utilities of GAM25 include diagnosis, prevention and treatment of diseases and clinical conditions associated with LOC340249.

LOC340259 (Accession XP_295190.1) is another GAM25 target gene, herein designated TARGET GENE. LOC340259 BINDING SITE is a target binding site found in the 5' untranslated region of mRNA encoded by LOC340259, corresponding to a target binding site such as BINDING SITE I, BINDING SITE II or BINDING SITE III of FIG. 8. Table 4 illustrates the complementarity of the nucleotide sequences of LOC340259 BINDING SITE, designated SEQ ID:4561, to the nucleotide sequence of GAM25 rNA, herein designated GAM RNA, also designated SEQ ID:206.

Another function of GAM25 is therefore inhibition of LOC340259 (Accession XP_295190.1). Accordingly, utilities of GAM25 include diagnosis, prevention and treatment of diseases and clinical conditions associated with LOC340259.

LOC340414 (Accession XP_295240.1) is another GAM25 target gene, herein designated TARGET GENE. LOC340414 BINDING SITE is a target binding site found in the 3' untranslated region of mRNA encoded by LOC340414, corresponding to a target binding site such as BINDING SITE I, BINDING SITE II or BINDING SITE III of FIG. 8. Table 4 illustrates the complementarity of the nucleotide sequences of LOC340414 BINDING SITE, designated SEQ ID:11179, to the nucleotide sequence of GAM25 rNA, herein designated GAM RNA, also designated SEQ ID:206.

Another function of GAM25 is therefore inhibition of LOC340414 (Accession XP_295240.1). Accordingly, utilities of GAM25 include diagnosis, prevention and treatment of diseases and clinical conditions associated with LOC340414.

LOC340547 (Accession XP_291331.1) is another GAM25 target gene, herein designated TARGET GENE. LOC340547 BINDING SITE is a target binding site found in the 3' untranslated region of mRNA encoded by LOC340547, corresponding to a target binding site such as BINDING SITE I, BINDING SITE II or BINDING SITE III of FIG. 8. Table 4 illustrates the complementarity of the nucleotide sequences of LOC340547 BINDING SITE, designated SEQ ID:15544, to the nucleotide sequence of GAM25 rNA, herein designated GAM RNA, also designated SEQ ID:206.

Another function of GAM25 is therefore inhibition of LOC340547 (Accession XP_291331.1). Accordingly, utilities of GAM25 include diagnosis, prevention and treatment of diseases and clinical conditions associated with LOC340547.

LOC342926 (Accession XP_292790.2) is another GAM25 target gene, herein designated TARGET GENE. LOC342926 BINDING SITE is a target binding site found in the 3' untranslated region of mRNA encoded by LOC342926, corresponding to a target binding site such as BINDING SITE I, BINDING SITE II or BINDING SITE III of FIG. 8. Table 4 illustrates the complementarity of the nucleotide sequences of LOC342926 BINDING SITE, designated SEQ ID:12088, to the nucleotide sequence of GAM25 rNA, herein designated GAM RNA, also designated SEQ ID:206.

Another function of GAM25 is therefore inhibition of LOC342926 (Accession XP_292790.2). Accordingly, utilities of GAM25 include diagnosis, prevention and treatment of diseases and clinical conditions associated with LOC342926.

LOC346653 (Accession XP_294357.2) is another GAM25 target gene, herein designated TARGET GENE. LOC346653 BINDING SITE is a target binding site found in the 3' untranslated region of mRNA encoded by LOC346653, corresponding to a target binding site such as BINDING SITE I, BINDING SITE II or BINDING SITE III of FIG. 8. Table 4 illustrates the complementarity of the nucleotide sequences of LOC346653 BINDING SITE, designated SEQ ID:16571, to the nucleotide sequence of GAM25 rNA, herein designated GAM RNA, also designated SEQ ID:206.

Another function of GAM25 is therefore inhibition of LOC346653 (Accession XP_294357.2). Accordingly, utilities of GAM25 include diagnosis, prevention and treatment of diseases and clinical conditions associated with LOC346653.

LOC347882 (Accession XP_302618.1) is another GAM25 target gene, herein designated TARGET GENE. LOC347882 BINDING SITE is a target binding site found in the 3' untranslated region of mRNA encoded by LOC347882, corresponding to a target binding site such as BINDING SITE I, BINDING SITE II or BINDING SITE III of FIG. 8. Table 4 illustrates the complementarity of the nucleotide sequences of LOC347882 BINDING SITE, designated SEQ ID:3732, to the nucleotide sequence of GAM25 rNA, herein designated GAM RNA, also designated SEQ ID:206.

Another function of GAM25 is therefore inhibition of LOC347882 (Accession XP_302618.1). Accordingly, utilities of GAM25 include diagnosis, prevention and treatment of diseases and clinical conditions associated with LOC347882.

LOC347918 (Accession XP_300565.1) is another GAM25 target gene, herein designated TARGET GENE. LOC347918 BINDING SITE is a target binding site found in the 5' untranslated region of mRNA encoded by LOC347918, corresponding to a target binding site such as BINDING SITE I, BINDING SITE II or BINDING SITE III of FIG. 8. Table 4 illustrates the complementarity of the nucleotide sequences of LOC347918 BINDING SITE, designated SEQ ID:5342, to the nucleotide sequence of GAM25 rNA, herein designated GAM RNA, also designated SEQ ID:206.

Another function of GAM25 is therefore inhibition of LOC347918 (Accession XP_300565.1). Accordingly, utilities of GAM25 include diagnosis, prevention and treatment of diseases and clinical conditions associated with LOC347918.

LOC348024 (Accession XP_300592.1) is another GAM25 target gene, herein designated TARGET GENE. LOC348024 BINDING SITE is a target binding site found in the 5' untranslated region of mRNA encoded by LOC348024, corresponding to a target binding site such as BINDING SITE I, BINDING SITE II or BINDING SITE III of FIG. 8. Table 4 illustrates the complementarity of the nucleotide sequences of LOC348024 BINDING SITE, designated SEQ ID:19164, to the nucleotide sequence of GAM25 rNA, herein designated GAM RNA, also designated SEQ ID:206.

Another function of GAM25 is therefore inhibition of LOC348024 (Accession XP_300592.1). Accordingly, utilities of GAM25 include diagnosis, prevention and treatment of diseases and clinical conditions associated with LOC348024.

LOC348094 (Accession XP_300615.1) is another GAM25 target gene, herein designated TARGET GENE. LOC348094 BINDING SITE is a target binding site found in the 5' untranslated region of mRNA encoded by LOC348094, corresponding to a target binding site such as BINDING SITE I, BINDING SITE II or BINDING SITE III of FIG. 8. Table 4 illustrates the complementarity of the nucleotide sequences of LOC348094 BINDING SITE, designated SEQ ID:14669, to the nucleotide sequence of GAM25 rNA, herein designated GAM RNA, also designated SEQ ID:206.

Another function of GAM25 is therefore inhibition of LOC348094 (Accession XP_300615.1). Accordingly, utilities of GAM25 include diagnosis, prevention and treatment of diseases and clinical conditions associated with LOC348094.

LOC348113 (Accession XP_300623.1) is another GAM25 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:11559, to the nucleotide sequence of GAM25 rNA, herein designated GAM RNA, also designated SEQ ID:206.

Another function of GAM25 is therefore inhibition of LOC348113 (Accession XP_300623.1). Accordingly, utilities of GAM25 include diagnosis, prevention and treatment of diseases and clinical conditions associated with LOC348113.

LOC348115 (Accession XP_300626.1) is another GAM25 target gene, herein designated TARGET GENE. LOC348115 BINDING SITE is a target binding site found in the 5' untranslated region of mRNA encoded by LOC348115, corresponding to a target binding site such as BINDING SITE I, BINDING SITE II or BINDING SITE III of FIG. 8. Table 4 illustrates the complementarity of the nucleotide sequences of LOC348115 BINDING SITE, designated SEQ ID:5344, to the nucleotide sequence of GAM25 rNA, herein designated GAM RNA, also designated SEQ ID:206.

Another function of GAM25 is therefore inhibition of LOC348115 (Accession XP_300626.1). Accordingly, utilities of GAM25 include diagnosis, prevention and treatment of diseases and clinical conditions associated with LOC348115.

LOC348137 (Accession XP_300635.1) is another GAM25 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:11559, to the nucleotide sequence of GAM25 rNA, herein designated GAM RNA, also designated SEQ ID:206.

Another function of GAM25 is therefore inhibition of LOC348137 (Accession XP_300635.1). Accordingly, utilities of GAM25 include diagnosis, prevention and treatment of diseases and clinical conditions associated with LOC348137.

LOC348142 (Accession XP_300636.1) is another GAM25 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:11559, to the nucleotide sequence of GAM25 rNA, herein designated GAM RNA, also designated SEQ ID:206.

Another function of GAM25 is therefore inhibition of LOC348142 (Accession XP_300636.1). Accordingly, utilities of GAM25 include diagnosis, prevention and treatment of diseases and clinical conditions associated with LOC348142.

LOC348235 (Accession XP_300670.1) is another GAM25 target gene, herein designated TARGET GENE. LOC348235 BINDING SITE is a target binding site found in the 3' untranslated region of mRNA encoded by LOC348235, corresponding to a target binding site such as BINDING SITE I, BINDING SITE II or BINDING SITE III of FIG. 8. Table 4 illustrates the complementarity of the nucleotide sequences of LOC348235 BINDING SITE, designated SEQ ID:8807, to the nucleotide sequence of GAM25 rNA, herein designated GAM RNA, also designated SEQ ID:206.

Another function of GAM25 is therefore inhibition of LOC348235 (Accession XP_300670.1). Accordingly, utilities of GAM25 include diagnosis, prevention and treatment of diseases and clinical conditions associated with LOC348235.

LOC348326 (Accession XP_300696.1) is another GAM25 target gene, herein designated TARGET GENE. LOC348326 BINDING SITE is a target binding site found in the 3' untranslated region of mRNA encoded by LOC348326, corresponding to a target binding site such as BINDING SITE I, BINDING SITE II or BINDING SITE III of FIG. 8. Table 4 illustrates the complementarity of the nucleotide sequences of LOC348326 BINDING SITE, designated SEQ ID:4883, to the nucleotide sequence of GAM25 rNA, herein designated GAM RNA, also designated SEQ ID:206.

Another function of GAM25 is therefore inhibition of LOC348326 (Accession XP_300696.1). Accordingly, utilities of GAM25 include diagnosis, prevention and treatment of diseases and clinical conditions associated with LOC348326.

LOC348393 (Accession XP_302741.1) is another GAM25 target gene, herein designated TARGET GENE. LOC348393 BINDING SITE1 and LOC348393 BINDING SITE2 are target binding sites found in untranslated regions of mRNA encoded by LOC348393, corresponding to target binding sites such as BINDING SITE I, BINDING SITE II or BINDING SITE III of FIG. 8. Table 4 illustrates the complementarity of the nucleotide sequences of LOC348393 BINDING SITE1 and LOC348393 BINDING SITE2, designated SEQ ID:2896 and SEQ ID:4259 respectively, to the nucleotide sequence of GAM25 rNA, herein designated GAM RNA, also designated SEQ ID:206.

Another function of GAM25 is therefore inhibition of LOC348393 (Accession XP_302741.1). Accordingly, utilities of GAM25 include diagnosis, prevention and treatment of diseases and clinical conditions associated with LOC348393.

LOC348396 (Accession XP_300729.1) is another GAM25 target gene, herein designated TARGET GENE. LOC348396 BINDING SITE is a target binding site found in the 3' untranslated region of mRNA encoded by LOC348396, corresponding to a target binding site such as BINDING SITE I, BINDING SITE II or BINDING SITE III of FIG. 8. Table 4 illustrates the complementarity of the nucleotide sequences of LOC348396 BINDING SITE, designated SEQ ID:15782, to the nucleotide sequence of GAM25 rNA, herein designated GAM RNA, also designated SEQ ID:206.

Another function of GAM25 is therefore inhibition of LOC348396 (Accession XP_300729.1). Accordingly, utilities of GAM25 include diagnosis, prevention and treatment of diseases and clinical conditions associated with LOC348396.

LOC348402 (Accession XP_300730.1) is another GAM25 target gene, herein designated TARGET GENE. LOC348402 BINDING SITE1 and LOC348402 BINDING SITE2 are target binding sites found in untranslated regions of mRNA encoded by LOC348402, corresponding to target binding sites such as BINDING SITE I, BINDING SITE II or BINDING SITE III of FIG. 8. Table 4 illustrates the complementarity of the nucleotide sequences of LOC348402 BINDING SITE1 and LOC348402 BINDING SITE2, designated SEQ ID:14483 and SEQ ID:5531 respectively, to the nucleotide sequence of GAM25 rNA, herein designated GAM RNA, also designated SEQ ID:206.

Another function of GAM25 is therefore inhibition of LOC348402 (Accession XP_300730.1). Accordingly, utilities of GAM25 include diagnosis, prevention and treatment of diseases and clinical conditions associated with LOC348402.

LOC348428 (Accession XP_302753.1) is another GAM25 target gene, herein designated TARGET GENE. LOC348428 BINDING SITE is a target binding site found in the 5' untranslated region of mRNA encoded by LOC348428, corresponding to a target binding site such as BINDING SITE I, BINDING SITE II or BINDING SITE III of FIG. 8. Table 4 illustrates the complementarity of the nucleotide sequences of LOC348428 BINDING SITE, designated SEQ ID:15122, to the nucleotide sequence of GAM25 rNA, herein designated GAM RNA, also designated SEQ ID:206.

Another function of GAM25 is therefore inhibition of LOC348428 (Accession XP_302753.1). Accordingly, utilities of GAM25 include diagnosis, prevention and treatment of diseases and clinical conditions associated with LOC348428.

LOC348445 (Accession XP_300738.1) is another GAM25 target gene, herein designated TARGET GENE. LOC348445 BINDING SITE is a target binding site found in the 3' untranslated region of mRNA encoded by LOC348445, corresponding to a target binding site such as BINDING SITE I, BINDING SITE II or BINDING SITE III of FIG. 8. Table 4 illustrates the complementarity of the nucleotide sequences of LOC348445 BINDING SITE, designated SEQ ID:4883, to the nucleotide sequence of GAM25 rNA, herein designated GAM RNA, also designated SEQ ID:206.

Another function of GAM25 is therefore inhibition of LOC348445 (Accession XP_300738.1). Accordingly, utilities of GAM25 include diagnosis, prevention and treatment of diseases and clinical conditions associated with LOC348445.

LOC348503 (Accession XP_300762.1) is another GAM25 target gene, herein designated TARGET GENE. LOC348503 BINDING SITE is a target binding site found in the 3' untranslated region of mRNA encoded by LOC348503, corresponding to a target binding site such as BINDING SITE I, BINDING SITE II or BINDING SITE III of FIG. 8. Table 4 illustrates the complementarity of the nucleotide sequences of LOC348503 BINDING SITE, designated SEQ ID:4935, to the nucleotide sequence of GAM25 rNA, herein designated GAM RNA, also designated SEQ ID:206.

Another function of GAM25 is therefore inhibition of LOC348503 (Accession XP_300762.1). Accordingly, utilities of GAM25 include diagnosis, prevention and treatment of diseases and clinical conditions associated with LOC348503.

LOC348532 (Accession XP_302818.1) is another GAM25 target gene, herein designated TARGET GENE. LOC348532 BINDING SITE1 and LOC348532 BINDING SITE2 are target binding sites found in untranslated regions of mRNA encoded by LOC348532, corresponding to target binding sites such as BINDING SITE I, BINDING SITE II or BINDING SITE III of FIG. 8. Table 4 illustrates the complementarity of the nucleotide sequences of LOC348532 BINDING SITE1 and LOC348532 BINDING SITE2, designated SEQ ID:2896 and SEQ ID:4259 respectively, to the nucleotide sequence of GAM25 rNA, herein designated GAM RNA, also designated SEQ ID:206.

Another function of GAM25 is therefore inhibition of LOC348532 (Accession XP_302818.1). Accordingly, utilities of GAM25 include diagnosis, prevention and treatment of diseases and clinical conditions associated with LOC348532.

LOC348567 (Accession XP_300378.1) is another GAM25 target gene, herein designated TARGET GENE. LOC348567 BINDING SITE is a target binding site found in the 3' untranslated region of mRNA encoded by LOC348567, corresponding to a target binding site such as BINDING SITE I, BINDING SITE II or BINDING SITE III of FIG. 8. Table 4 illustrates the complementarity of the nucleotide sequences of LOC348567 BINDING SITE, designated SEQ ID:12540, to the nucleotide sequence of GAM25 rNA, herein designated GAM RNA, also designated SEQ ID:206.

Another function of GAM25 is therefore inhibition of LOC348567 (Accession XP_300378.1). Accordingly, utilities of GAM25 include diagnosis, prevention and treatment of diseases and clinical conditions associated with LOC348567.

LOC348583 (Accession XP_302833.1) is another GAM25 target gene, herein designated TARGET GENE. LOC348583 BINDING SITE is a target binding site found in the 3' untranslated region of mRNA encoded by LOC348583, corresponding to a target binding site such as BINDING SITE I, BINDING SITE II or BINDING SITE III of FIG. 8. Table 4 illustrates the complementarity of the nucleotide sequences of LOC348583 BINDING SITE, designated SEQ ID:5363, to the nucleotide sequence of GAM25 rNA, herein designated GAM RNA, also designated SEQ ID:206.

Another function of GAM25 is therefore inhibition of LOC348583 (Accession XP_302833.1). Accordingly, utilities of GAM25 include diagnosis, prevention and treatment of diseases and clinical conditions associated with LOC348583.

LOC348790 (Accession XP_300843.1) is another GAM25 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:9567, to the nucleotide sequence of GAM25 rNA, herein designated GAM RNA, also designated SEQ ID:206.

Another function of GAM25 is therefore inhibition of LOC348790 (Accession XP_300843.1). Accordingly, utilities of GAM25 include diagnosis, prevention and treatment of diseases and clinical conditions associated with LOC348790.

LOC348798 (Accession XP_300845.1) is another GAM25 target gene, herein designated TARGET GENE. LOC348798 BINDING SITE is a target binding site found in the 3' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:1441, to the nucleotide sequence of GAM25 rNA, herein designated GAM RNA, also designated SEQ ID:206.

Another function of GAM25 is therefore inhibition of LOC348798 (Accession XP_300845.1). Accordingly, utilities of GAM25 include diagnosis, prevention and treatment of diseases and clinical conditions associated with LOC348798.

LOC348947 (Accession XP_302929.1) is another GAM25 target gene, herein designated TARGET GENE. LOC348947 BINDING SITE is a target binding site found in the 3' untranslated region of mRNA encoded by LOC348947, corresponding to a target binding site such as BINDING SITE I, BINDING SITE II or BINDING SITE III of FIG. 8. Table 4 illustrates the complementarity of the nucleotide sequences of LOC348947 BINDING SITE, designated SEQ ID:12770, to the nucleotide sequence of GAM25 rNA, herein designated GAM RNA, also designated SEQ ID:206.

Another function of GAM25 is therefore inhibition of LOC348947 (Accession XP_302929.1). Accordingly, utilities of GAM25 include diagnosis, prevention and treatment of diseases and clinical conditions associated with LOC348947.

LOC348995 (Accession XP_300434.1) is another GAM25 target gene, herein designated TARGET GENE. LOC348995 BINDING SITE is a target binding site found in the 3' untranslated region of mRNA encoded by LOC348995, corresponding to a target binding site such as BINDING SITE I, BINDING SITE II or BINDING SITE III of FIG. 8. Table 4 illustrates the complementarity of the nucleotide sequences of LOC348995 BINDING SITE, designated SEQ ID:16135, to the nucleotide sequence of GAM25 rNA, herein designated GAM RNA, also designated SEQ ID:206.

Another function of GAM25 is therefore inhibition of LOC348995 (Accession XP_300434.1). Accordingly, utilities of GAM25 include diagnosis, prevention and treatment of diseases and clinical conditions associated with LOC348995.

LOC349024 (Accession XP_300250.1) is another GAM25 target gene, herein designated TARGET GENE. LOC349024 BINDING SITE is a target binding site found in the 5' untranslated region of mRNA encoded by LOC349024, corresponding to a target binding site such as BINDING SITE I, BINDING SITE II or BINDING SITE III of FIG. 8. Table 4 illustrates the complementarity of the nucleotide sequences of LOC349024 BINDING SITE, designated SEQ ID:644, to the nucleotide sequence of GAM25 rNA, herein designated GAM RNA, also designated SEQ ID:206.

Another function of GAM25 is therefore inhibition of LOC349024 (Accession XP_300250.1). Accordingly, utilities of GAM25 include diagnosis, prevention and treatment of diseases and clinical conditions associated with LOC349024.

LOC349075 (Accession XP_300932.1) is another GAM25 target gene, herein designated TARGET GENE. LOC349075 BINDING SITE is a target binding site found in the 3' untranslated region of mRNA encoded by LOC349075, corresponding to a target binding site such as BINDING SITE I, BINDING SITE II or BINDING SITE III of FIG. 8. Table 4 illustrates the complementarity of the nucleotide sequences of LOC349075 BINDING SITE, designated SEQ ID:12101, to the nucleotide sequence of GAM25 rNA, herein designated GAM RNA, also designated SEQ ID:206.

Another function of GAM25 is therefore inhibition of LOC349075 (Accession XP_300932.1). Accordingly, utilities of GAM25 include diagnosis, prevention and treatment of diseases and clinical conditions associated with LOC349075.

LOC349080 (Accession XP_302952.1) is another GAM25 target gene, herein designated TARGET GENE. LOC349080 BINDING SITE is a target binding site found in the 3' untranslated region of mRNA encoded by LOC349080, corresponding to a target binding site such as BINDING SITE I, BINDING SITE II or BINDING SITE III of FIG. 8. Table 4 illustrates the complementarity of the nucleotide sequences of LOC349080 BINDING SITE, designated SEQ ID:997, to the nucleotide sequence of GAM25 rNA, herein designated GAM RNA, also designated SEQ ID:206.

Another function of GAM25 is therefore inhibition of LOC349080 (Accession XP_302952.1). Accordingly, utilities of GAM25 include diagnosis, prevention and treatment of diseases and clinical conditions associated with LOC349080.

LOC349170 (Accession XP_300969.1) is another GAM25 target gene, herein designated TARGET GENE. LOC349170 BINDING SITE1 and LOC349170 BINDING SITE2 are target binding sites found in untranslated regions of mRNA encoded by LOC349170, corresponding to target binding sites such as BINDING SITE I, BINDING SITE II or BINDING SITE III of FIG. 8. Table 4 illustrates the complementarity of the nucleotide sequences of LOC349170 BINDING SITE1 and LOC349170 BINDING SITE2, designated SEQ ID:4803 and SEQ ID:14563 respectively, to the nucleotide sequence of GAM25 rNA, herein designated GAM RNA, also designated SEQ ID:206.

Another function of GAM25 is therefore inhibition of LOC349170 (Accession XP_300969.1). Accordingly, utilities of GAM25 include diagnosis, prevention and treatment of diseases and clinical conditions associated with LOC349170.

LOC349261 (Accession XP_300998.1) is another GAM25 target gene, herein designated TARGET GENE. LOC349261 BINDING SITE is a target binding site found in the 5' untranslated region of mRNA encoded by LOC349261, corresponding to a target binding site such as BINDING SITE I, BINDING SITE II or BINDING SITE III of FIG. 8. Table 4 illustrates the complementarity of the nucleotide sequences of LOC349261 BINDING SITE, designated SEQ ID:18801, to the nucleotide sequence of GAM25 rNA, herein designated GAM RNA, also designated SEQ ID:206.

Another function of GAM25 is therefore inhibition of LOC349261 (Accession XP_300998.1). Accordingly, utilities of GAM25 include diagnosis, prevention and treatment of diseases and clinical conditions associated with LOC349261.

LOC349360 (Accession XP_088528.1) is another GAM25 target gene, herein designated TARGET GENE. LOC349360 BINDING SITE is a target binding site found in the 5' untranslated region of mRNA encoded by LOC349360, corresponding to a target binding site such as BINDING SITE I, BINDING SITE II or BINDING SITE III of FIG. 8. Table 4 illustrates the complementarity of the nucleotide sequences of LOC349360 BINDING SITE, designated SEQ ID:17187, to the nucleotide sequence of GAM25 rNA, herein designated GAM RNA, also designated SEQ ID:206.

Another function of GAM25 is therefore inhibition of LOC349360 (Accession XP_088528.1). Accordingly, utilities of GAM25 include diagnosis, prevention and treatment of diseases and clinical conditions associated with LOC349360.

LOC349430 (Accession XP_301084.1) is another GAM25 target gene, herein designated TARGET GENE. LOC349430 BINDING SITE is a target binding site found in the 3' untranslated region of mRNA encoded by LOC349430, corresponding to a target binding site such as BINDING SITE I, BINDING SITE II or BINDING SITE III of FIG. 8. Table 4 illustrates the complementarity of the nucleotide sequences of LOC349430 BINDING SITE, designated SEQ ID:18922, to the nucleotide sequence of GAM25 rNA, herein designated GAM RNA, also designated SEQ ID:206.

Another function of GAM25 is therefore inhibition of LOC349430 (Accession XP_301084.1). Accordingly, utilities of GAM25 include diagnosis, prevention and treatment of diseases and clinical conditions associated with LOC349430.

LOC51193 (Accession NP_057415.1) is another GAM25 target gene, herein designated TARGET GENE. LOC51193 BINDING SITE is a target binding site found in the 3' untranslated region of mRNA encoded by LOC51193, corresponding to a target binding site such as BINDING SITE I, BINDING SITE II or BINDING SITE III of FIG. 8. Table 4 illustrates the complementarity of the nucleotide sequences of LOC51193 BINDING SITE, designated SEQ ID:5306, to the nucleotide sequence of GAM25 rNA, herein designated GAM RNA, also designated SEQ ID:206.

Another function of GAM25 is therefore inhibition of LOC51193 (Accession NP_057415.1). Accordingly, utilities of GAM25 include diagnosis, prevention and treatment of diseases and clinical conditions associated with LOC51193.

LOC57107 (Accession NP_065114.2) is another GAM25 target gene, herein designated TARGET GENE. LOC57107 BINDING SITE is a target binding site found in the 3' untranslated region of mRNA encoded by LOC57107, corresponding to a target binding site such as BINDING SITE I, BINDING SITE II or BINDING SITE III of FIG. 8. Table 4 illustrates the complementarity of the nucleotide sequences of LOC57107 BINDING SITE, designated SEQ ID:1130, to the nucleotide sequence of GAM25 rNA, herein designated GAM RNA, also designated SEQ ID:206.

Another function of GAM25 is therefore inhibition of LOC57107 (Accession NP_065114.2). Accordingly, utilities of GAM25 include diagnosis, prevention and treatment of diseases and clinical conditions associated with LOC57107.

LOC90408 (Accession XP_031517.1) is another GAM25 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:16076, to the nucleotide sequence of GAM25 rNA, herein designated GAM RNA, also designated SEQ ID:206.

Another function of GAM25 is therefore inhibition of LOC90408 (Accession XP_031517.1). Accordingly, utilities of GAM25 include diagnosis, prevention and treatment of diseases and clinical conditions associated with LOC90408.

LOC90485 (Accession XP_032059.1) is another GAM25 target gene, herein designated TARGET GENE. LOC90485 BINDING SITE is a target binding site found in the 3' untranslated region of mRNA encoded by LOC90485, corresponding to a target binding site such as BINDING SITE I, BINDING SITE II or BINDING SITE III of FIG. 8. Table 4 illustrates the complementarity of the nucleotide sequences of LOC90485 BINDING SITE, designated SEQ ID:1125, to the nucleotide sequence of GAM25 rNA, herein designated GAM RNA, also designated SEQ ID:206.

Another function of GAM25 is therefore inhibition of LOC90485 (Accession XP_032059.1). Accordingly, utilities of GAM25 include diagnosis, prevention and treatment of diseases and clinical conditions associated with LOC90485.

LOC91170 (Accession XP_036612.1) is another GAM25 target gene, herein designated TARGET GENE. LOC91170 BINDING SITE is a target binding site found in the 5' untranslated region of mRNA encoded by LOC91170, corresponding to a target binding site such as BINDING SITE I, BINDING SITE II or BINDING SITE III of FIG. 8. Table 4 illustrates the complementarity of the nucleotide sequences of LOC91170 BINDING SITE, designated SEQ ID:12009, to the nucleotide sequence of GAM25 rNA, herein designated GAM RNA, also designated SEQ ID:206.

Another function of GAM25 is therefore inhibition of LOC91170 (Accession XP_036612.1). Accordingly, utilities of GAM25 include diagnosis, prevention and treatment of diseases and clinical conditions associated with LOC91170.

LOC91250 (Accession XP_037135.1) is another GAM25 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:11626, to the nucleotide sequence of GAM25 rNA, herein designated GAM RNA, also designated SEQ ID:206.

Another function of GAM25 is therefore inhibition of LOC91250 (Accession XP_037135.1). Accordingly, utilities of GAM25 include diagnosis, prevention and treatment of diseases and clinical conditions associated with LOC91250.

LOC91663 (Accession NP_612382.1) is another GAM25 target gene, herein designated TARGET GENE. LOC91663 BINDING SITE is a target binding site found in the 3' untranslated region of mRNA encoded by LOC91663, corresponding to a target binding site such as BINDING SITE I, BINDING SITE II or BINDING SITE III of FIG. 8. Table 4 illustrates the complementarity of the nucleotide sequences of LOC91663 BINDING SITE, designated SEQ ID:10068, to the nucleotide sequence of GAM25 rNA, herein designated GAM RNA, also designated SEQ ID:206.

Another function of GAM25 is therefore inhibition of LOC91663 (Accession NP_612382.1). Accordingly, utilities of GAM25 include diagnosis, prevention and treatment of diseases and clinical conditions associated with LOC91663.

LOC93132 (Accession XP_049396.1) is another GAM25 target gene, herein designated TARGET GENE. LOC93132 BINDING SITE is a target binding site found in the 5' untranslated region of mRNA encoded by LOC93132, corresponding to a target binding site such as BINDING SITE I, BINDING SITE II or BINDING SITE III of FIG. 8. Table 4 illustrates the complementarity of the nucleotide sequences of LOC93132 BINDING SITE, designated SEQ ID:17183, to the nucleotide sequence of GAM25 rNA, herein designated GAM RNA, also designated SEQ ID:206.

Another function of GAM25 is therefore inhibition of LOC93132 (Accession XP_049396.1). Accordingly, utilities of GAM25 include diagnosis, prevention and treatment of diseases and clinical conditions associated with LOC93132.

LOST1 (Accession NP_758955.1) is another GAM25 target gene, herein designated TARGET GENE. LOST1 BINDING SITE is a target binding site found in the 3' untranslated region of mRNA encoded by LOST1, corresponding to a target binding site such as BINDING SITE I, BINDING SITE II or BINDING SITE III of FIG. 8. Table 4 illustrates the complementarity of the nucleotide sequences of LOST1 BINDING SITE, designated SEQ ID:1474, to the nucleotide sequence of GAM25 rNA, herein designated GAM RNA, also designated SEQ ID:206.

Another function of GAM25 is therefore inhibition of LOST1 (Accession NP_758955.1). Accordingly, utilities of GAM25 include diagnosis, prevention and treatment of diseases and clinical conditions associated with LOST1.

Leukotriene b4 receptor (LTB4R, Accession NP_000743.1) is another GAM25 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:12498, to the nucleotide sequence of GAM25 rNA, herein designated GAM RNA, also designated SEQ ID:206.

Another function of GAM25 is therefore inhibition of Leukotriene b4 receptor (LTB4R, Accession NP_000743.1), a gene which may be the cardiac p2y receptor involved in the regulation of cardiac muscle contraction through modulation of l-type calcium currents. Accordingly, utilities of GAM25 include diagnosis, prevention and treatment of diseases and clinical conditions associated with LTB4R.

The function of LTB4R has been established by previous studies. Yokomizo et al. (1997) found that the putative purinoceptor P2Y7 has a primary structure identical to that of a BLTR clone, HL-5. To determine whether BLTR also functions as a purinoceptor, they established stable transformants of BLTR in glioma cells that possess negligible amounts of intrinsic purinoceptors. In these cells, up to 300 microM caused no change in intracellular calcium levels, but significant increases in the calcium concentrations were induced by exposure to 10 nanoM LTB4. These results were interpreted to indicate that this receptor is not a purinoceptor, but a BLTR By genomic sequence analysis, Kato et al. (2000) determined that BLT1 lacks TATA and CAAT elements but possesses a GC-rich sequence in the promoter region. Luciferase reporter analysis showed that the region required for basal transcription, which is activated by SP1, is about 80 bp upstream from the initiator sequence. Southern blot analysis revealed that the CpG sites of the BLT1 promoter are highly methylated in cells not expressing BLT1, but are unmethylated in cells expressing BLT1. Kato et al. (2000) also found that the promoter region of BLT1 is localized within the open reading frame encoding BLT2 (OMIM Ref. No. 605773).

Full details of the abovementioned studies are described in the following publications, the disclosure of which are hereby incorporated by reference:

Yokomizo, T.; Izumi, T.; Chang, K.; Takuwa, Y.; Shimizu, T.: A G-protein-coupled receptor for leukotriene B4 that mediates chemotaxis. Nature 387:620-624, 1997; and Kato, K.; Yokomizo, T.; Izumi, T.; Shimizu, T.: Cell-specific transcriptional regulation of human leukotriene B4 receptor gene. J. Exp. Med. 192:413-420, 2000.

Further studies establishing the function and utilities of LTB4R are found in John Hopkins OMIM database record ID 601531, and in cited publications listed in Table 5, which are hereby incorporated by reference. Lymphocyte antigen 75 (LY75, Accession NP_002340.1) is another GAM25 target gene, herein designated TARGET GENE. LY75 BINDING SITE is a target binding site found in the 3' untranslated region of mRNA encoded by LY75, corresponding to a target binding site such as BINDING SITE I, BINDING SITE II or BINDING SITE III of FIG. 8. Table 4 illustrates the complementarity of the nucleotide sequences of LY75 BINDING SITE, designated SEQ ID:13431, to the nucleotide sequence of GAM25 rNA, herein designated GAM RNA, also designated SEQ ID:206.

Another function of GAM25 is therefore inhibition of Lymphocyte antigen 75 (LY75, Accession NP_002340.1). Accordingly, utilities of GAM25 include diagnosis, prevention and treatment of diseases and clinical conditions associated with LY75.

Leucine zipper, putative tumor suppressor 1 (LZTS1, Accession NP_066300.1) is another GAM25 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:9584, to the nucleotide sequence of GAM25 rNA, herein designated GAM RNA, also designated SEQ ID:206.

Another function of GAM25 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM25 include diagnosis, prevention and treatment of diseases and clinical conditions associated with LZTS1.

The function of LZTS1 has been established by previous studies. Ishii et al. (1999) positionally cloned and characterized the FEZ1/LZTS1 (leucine zipper, putative tumor suppressor-1) gene at 8p22, a region that is lost in many tumors, including prostate, breast, head and neck, esophageal, and urinary bladder carcinomas. The predicted FEZ1 protein contained a leucine- zipper region with similarity to the DNA-binding domain of the cAMP-responsive activating transcription factor-5 (OMIM Ref. No. 606398). Northern blot analysis revealed that FEZ2 is expressed almost ubiquitously in normal tissues, although expression is most abundant in testes. FEZ1 expression was undetectable in more than 60% of epithelial tumors, but FEZ1 mutations were found in primary esophageal cancers and in a prostate cancer cell line. Transcript analysis from several FEZ1-expressing tumors revealed truncated mRNAs, including a frameshift. Alteration and inactivation of the FEZ1 gene may play a role in various human tumors. Ishii et al. (2001) showed that introduction of FEZ1/LZTS1 into FEZ1/LZTS1-negative cancer cells resulted in suppression of tumorigenicity and reduced cell growth with accumulation of cells at late S-G2/M stage of the cell cycle. Their data showed that FEZ1/LZTS1 inhibits cancer cell growth through regulation of mitosis, and that its alterations result in abnormal cell growth Full details of the abovementioned studies are described in the following publications, the disclosure of which are hereby incorporated by reference:

Ishii, H.; Baffa, R.; Numata, S.-I.; Murakumo, Y.; Rattan, S.; Inoue, H.; Mori, M.; Fidanza, V.; Alder, H.; Croce, C. M.: The FEZ1 gene at chromosome 8p22 encodes a leucine-zipper protein, and its expression is altered in multiple human tumors. Proc. Nat. Acad. Sci. 96:3928-3933, 1999; and Ishii, H.; Vecchione, A.; Murakumo, Y.; Baldassarre, G.; Numata, S.; Trapasso, F.; Alder, H.; Baffa, R.; Croce, C. M.: FEZ1/LZTS1 gene at 8p22 suppresses cancer cell growth and regulat.

Further studies establishing the function and utilities of LZTS1 are found in John Hopkins OMIM database record ID 606551, and in cited publications listed in Table 5, which are hereby incorporated by reference. Male germ cell-associated kinase (MAK, Accession NP_005897.1) is another GAM25 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:14390, to the nucleotide sequence of GAM25 rNA, herein designated GAM RNA, also designated SEQ ID:206.

Another function of GAM25 is therefore inhibition of Male germ cell-associated kinase (MAK, Accession NP_005897.1), a gene which plays an important role in spermatogenesis. Accordingly, utilities of GAM25 include diagnosis, prevention and treatment of diseases and clinical conditions associated with MAK.

The function of MAK has been established by previous studies. Male germ cell-associated kinase is one of the protein kinases that was isolated by weak cross- hybridization with the v-ros (OMIM Ref. No. 165020) protein kinase sequence (Matsushime et al., 1990). The gene encoding this kinase is expressed almost exclusively in testis, mainly in germ cells at and/or after the pachytene stage, as 66- and 60-kD proteins that form a distinct complex with cellular phosphoprotein p210. The p210 protein is sufficiently phosphorylated in vitro by the MAK gene product at serine and threonine residues. These results suggest that the MAK gene plays an important role in spermatogenesis. Using a panel of DNA samples from an interspecific cross, Taketo et al. (1994) mapped the Mak gene to mouse chromosome 13 in an area situated between 2 regions that are homologous with human chromosome 6p and chromosome 5. Taketo et al. (1994) stated that preliminary Southern analysis of DNA samples from a panel of mouse/human somatic cell hybrids showed concordant hybridization of the MAK gene and the ROS1 gene, previously mapped to 6q22

Full details of the abovementioned studies are described in the following publications, the disclosure of which are hereby incorporated by reference:

Matsushime, H.; Jinno, A.; Takagi, N.; Shibuy, M.: A novel mammalian protein kinase gene (mak) is highly expressed in testicular germ cells at and after meiosis. Molec. Cell. Biol. 10:2261-2268, 1990; and Taketo, M.; Jinno, A.; Yamaguchi, S.; Matushime, H.; Shibuy, M.; Seldin, M. F.: Mouse Mak gene for male germ cell-associated kinase maps to chromosome 13. Genomics 19:397-398, 1994.

Further studies establishing the function and utilities of MAK are found in John Hopkins OMIM database record ID 154235, and in cited publications listed in Table 5, which are hereby incorporated by reference. MAPA (Accession NP_660299.1) is another GAM25 target gene, herein designated TARGET GENE. MAPA BINDING SITE is a target binding site found in the 3' untranslated region of mRNA encoded by MAPA, corresponding to a target binding site such as BINDING SITE I, BINDING SITE II or BINDING SITE III of FIG. 8. Table 4 illustrates the complementarity of the nucleotide sequences of MAPA BINDING SITE, designated SEQ ID:1130, to the nucleotide sequence of GAM25 rNA, herein designated GAM RNA, also designated SEQ ID:206.

Another function of GAM25 is therefore inhibition of MAPA (Accession NP_660299.1). Accordingly, utilities of GAM25 include diagnosis, prevention and treatment of diseases and clinical conditions associated with MAPA.

Mediterranean fever (MEFV, Accession NP_000234.1) is another GAM25 target gene, herein designated TARGET GENE. MEFV BINDING SITE is a target binding site found in the 3' untranslated region of mRNA encoded by MEFV, corresponding to a target binding site such as BINDING SITE I, BINDING SITE II or BINDING SITE III of FIG. 8. Table 4 illustrates the complementarity of the nucleotide sequences of MEFV BINDING SITE, designated SEQ ID:14301, to the nucleotide sequence of GAM25 rNA, herein designated GAM RNA, also designated SEQ ID:206.

Another function of GAM25 is therefore inhibition of Mediterranean fever (MEFV, Accession NP_000234.1). Accordingly, utilities of GAM25 include diagnosis, prevention and treatment of diseases and clinical conditions associated with MEFV.

MGC10818 (Accession NP_085045.2) is another GAM25 target gene, herein designated TARGET GENE. MGC10818 BINDING SITE is a target binding site found in the 3' untranslated region of mRNA encoded by MGC10818, corresponding to a target binding site such as BINDING SITE I, BINDING SITE II or BINDING SITE III of FIG. 8. Table 4 illustrates the complementarity of the nucleotide sequences of MGC10818 BINDING SITE, designated SEQ ID:12698, to the nucleotide sequence of GAM25 rNA, herein designated GAM RNA, also designated SEQ ID:206.

Another function of GAM25 is therefore inhibition of MGC10818 (Accession NP_085045.2). Accordingly, utilities of GAM25 include diagnosis, prevention and treatment of diseases and clinical conditions associated with MGC10818.

MGC11386 (Accession NP_116322.1) is another GAM25 target gene, herein designated TARGET GENE. MGC11386 BINDING SITE is a target binding site found in the 3' untranslated region of mRNA encoded by MGC11386, corresponding to a target binding site such as BINDING SITE I, BINDING SITE II or BINDING SITE III of FIG. 8. Table 4 illustrates the complementarity of the nucleotide sequences of MGC11386 BINDING SITE, designated SEQ ID:9968, to the nucleotide sequence of GAM25 rNA, herein designated GAM RNA, also designated SEQ ID:206.

Another function of GAM25 is therefore inhibition of MGC11386 (Accession NP_116322.1). Accordingly, utilities of GAM25 include diagnosis, prevention and treatment of diseases and clinical conditions associated with MGC11386.

MGC13204 (Accession NP_113653.1) is another GAM25 target gene, herein designated TARGET GENE. MGC13204 BINDING SITE is a target binding site found in the 3' untranslated region of mRNA encoded by MGC13204, corresponding to a target binding site such as BINDING SITE I, BINDING SITE II or BINDING SITE III of FIG. 8. Table 4 illustrates the complementarity of the nucleotide sequences of MGC13204 BINDING SITE, designated SEQ ID:19279, to the nucleotide sequence of GAM25 rNA, herein designated GAM RNA, also designated SEQ ID:206.

Another function of GAM25 is therefore inhibition of MGC13204 (Accession NP_113653.1). Accordingly, utilities of GAM25 include diagnosis, prevention and treatment of diseases and clinical conditions associated with MGC13204.

MGC14289 (Accession NP_542391.1) is another GAM25 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:13910, to the nucleotide sequence of GAM25 rNA, herein designated GAM RNA, also designated SEQ ID:206.

Another function of GAM25 is therefore inhibition of MGC14289 (Accession NP_542391.1). Accordingly, utilities of GAM25 include diagnosis, prevention and treatment of diseases and clinical conditions associated with MGC14289.

MGC15606 (Accession NP_659474.1) is another GAM25 target gene, herein designated TARGET GENE. MGC15606 BINDING SITE is a target binding site found in the 5' untranslated region of mRNA encoded by MGC15606, corresponding to a target binding site such as BINDING SITE I, BINDING SITE II or BINDING SITE III of FIG. 8. Table 4 illustrates the complementarity of the nucleotide sequences of MGC15606 BINDING SITE, designated SEQ ID:9022, to the nucleotide sequence of GAM25 rNA, herein designated GAM RNA, also designated SEQ ID:206.

Another function of GAM25 is therefore inhibition of MGC15606 (Accession NP_659474.1). Accordingly, utilities of GAM25 include diagnosis, prevention and treatment of diseases and clinical conditions associated with MGC15606.

MGC17919 (Accession NP_653222.2) is another GAM25 target gene, herein designated TARGET GENE. MGC17919 BINDING SITE is a target binding site found in the 3' untranslated region of mRNA encoded by MGC17919, corresponding to a target binding site such as BINDING SITE I, BINDING SITE II or BINDING SITE III of FIG. 8. Table 4 illustrates the complementarity of the nucleotide sequences of MGC17919 BINDING SITE, designated SEQ ID:1373, to the nucleotide sequence of GAM25 rNA, herein designated GAM RNA, also designated SEQ ID:206.

Another function of GAM25 is therefore inhibition of MGC17919 (Accession NP_653222.2). Accordingly, utilities of GAM25 include diagnosis, prevention and treatment of diseases and clinical conditions associated with MGC17919.

MGC1842 (Accession XP_037797.2) is another GAM25 target gene, herein designated TARGET GENE. MGC1842 BINDING SITE is a target binding site found in the 3' untranslated region of mRNA encoded by MGC1842, corresponding to a target binding site such as BINDING SITE I, BINDING SITE II or BINDING SITE III of FIG. 8. Table 4 illustrates the complementarity of the nucleotide sequences of MGC1842 BINDING SITE, designated SEQ ID:1785, to the nucleotide sequence of GAM25 rNA, herein designated GAM RNA, also designated SEQ ID:206.

Another function of GAM25 is therefore inhibition of MGC1842 (Accession XP_037797.2). Accordingly, utilities of GAM25 include diagnosis, prevention and treatment of diseases and clinical conditions associated with MGC1842.

MGC24180 (Accession NP_689565.1) is another GAM25 target gene, herein designated TARGET GENE. MGC24180 BINDING SITE is a target binding site found in the 5' untranslated region of mRNA encoded by MGC24180, corresponding to a target binding site such as BINDING SITE I, BINDING SITE II or BINDING SITE III of FIG. 8. Table 4 illustrates the complementarity of the nucleotide sequences of MGC24180 BINDING SITE, designated SEQ ID:9950, to the nucleotide sequence of GAM25 rNA, herein designated GAM RNA, also designated SEQ ID:206.

Another function of GAM25 is therefore inhibition of MGC24180 (Accession NP_689565.1). Accordingly, utilities of GAM25 include diagnosis, prevention and treatment of diseases and clinical conditions associated with MGC24180.

MGC2474 (Accession NP_076420.1) is another GAM25 target gene, herein designated TARGET GENE. MGC2474 BINDING SITE is a target binding site found in the 3' untranslated region of mRNA encoded by MGC2474, corresponding to a target binding site such as BINDING SITE I, BINDING SITE II or BINDING SITE III of FIG. 8. Table 4 illustrates the complementarity of the nucleotide sequences of MGC2474 BINDING SITE, designated SEQ ID:18706, to the nucleotide sequence of GAM25 rNA, herein designated GAM RNA, also designated SEQ ID:206.

Another function of GAM25 is therefore inhibition of MGC2474 (Accession NP_076420.1). Accordingly, utilities of GAM25 include diagnosis, prevention and treatment of diseases and clinical conditions associated with MGC2474.

MGC27345 (Accession XP_300964.1) is another GAM25 target gene, herein designated TARGET GENE. MGC27345 BINDING SITE is a target binding site found in the 5' untranslated region of multiple transcripts of mRNA encoded by MGC27345, corresponding to a target binding site such as BINDING SITE I, BINDING SITE II or BINDING SITE III of FIG. 8. Table 4 illustrates the complementarity of the nucleotide sequences of MGC27345 BINDING SITE, designated SEQ ID:17971, to the nucleotide sequence of GAM25 rNA, herein designated GAM RNA, also designated SEQ ID:206.

Another function of GAM25 is therefore inhibition of MGC27345 (Accession XP_300964.1). Accordingly, utilities of GAM25 include diagnosis, prevention and treatment of diseases and clinical conditions associated with MGC27345.

MGC3113 (Accession NP_076940.1) is another GAM25 target gene, herein designated TARGET GENE. MGC3113 BINDING SITE is a target binding site found in the 3' untranslated region of mRNA encoded by MGC3113, corresponding to a target binding site such as BINDING SITE I, BINDING SITE II or BINDING SITE III of FIG. 8. Table 4 illustrates the complementarity of the nucleotide sequences of MGC3113 BINDING SITE, designated SEQ ID:1235, to the nucleotide sequence of GAM25 rNA, herein designated GAM RNA, also designated SEQ ID:206.

Another function of GAM25 is therefore inhibition of MGC3113 (Accession NP_076940.1). Accordingly, utilities of GAM25 include diagnosis, prevention and treatment of diseases and clinical conditions associated with MGC3113.

MGC33637 (Accession NP_689809.1) is another GAM25 target gene, herein designated TARGET GENE. MGC33637 BINDING SITE is a target binding site found in the 3' untranslated region of mRNA encoded by MGC33637, corresponding to a target binding site such as BINDING SITE I, BINDING SITE II or BINDING SITE III of FIG. 8. Table 4 illustrates the complementarity of the nucleotide sequences of MGC33637 BINDING SITE, designated SEQ ID:16595, to the nucleotide sequence of GAM25 rNA, herein designated GAM RNA, also designated SEQ ID:206.

Another function of GAM25 is therefore inhibition of MGC33637 (Accession NP_689809.1). Accordingly, utilities of GAM25 include diagnosis, prevention and treatment of diseases and clinical conditions associated with MGC33637.

MGC35163 (Accession NP_689765.1) is another GAM25 target gene, herein designated TARGET GENE. MGC35163 BINDING SITE is a target binding site found in the 3' untranslated region of mRNA encoded by MGC35163, corresponding to a target binding site such as BINDING SITE I, BINDING SITE II or BINDING SITE III of FIG. 8. Table 4 illustrates the complementarity of the nucleotide sequences of MGC35163 BINDING SITE, designated SEQ ID:6047, to the nucleotide sequence of GAM25 rNA, herein designated GAM RNA, also designated SEQ ID:206.

Another function of GAM25 is therefore inhibition of MGC35163 (Accession NP_689765.1). Accordingly, utilities of GAM25 include diagnosis, prevention and treatment of diseases and clinical conditions associated with MGC35163.

MGC3771 (Accession NP_112232.1) is another GAM25 target gene, herein designated TARGET GENE. MGC3771 BINDING SITE is a target binding site found in the 5' untranslated region of mRNA encoded by MGC3771, corresponding to a target binding site such as BINDING SITE I, BINDING SITE II or BINDING SITE III of FIG. 8. Table 4 illustrates the complementarity of the nucleotide sequences of MGC3771 BINDING SITE, designated SEQ ID:13827, to the nucleotide sequence of GAM25 rNA, herein designated GAM RNA, also designated SEQ ID:206.

Another function of GAM25 is therefore inhibition of MGC3771 (Accession NP_112232.1). Accordingly, utilities of GAM25 include diagnosis, prevention and treatment of diseases and clinical conditions associated with MGC3771.

MGC40579 (Accession NP_689989.1) is another GAM25 target gene, herein designated TARGET GENE. MGC40579 BINDING SITE is a target binding site found in the 3' untranslated region of mRNA encoded by MGC40579, corresponding to a target binding site such as BINDING SITE I, BINDING SITE II or BINDING SITE III of FIG. 8. Table 4 illustrates the complementarity of the nucleotide sequences of MGC40579 BINDING SITE, designated SEQ ID:7100, to the nucleotide sequence of GAM25 rNA, herein designated GAM RNA, also designated SEQ ID:206.

Another function of GAM25 is therefore inhibition of MGC40579 (Accession NP_689989.1). Accordingly, utilities of GAM25 include diagnosis, prevention and treatment of diseases and clinical conditions associated with MGC40579.

MGC50337 (Accession NP_848604.1) is another GAM25 target gene, herein designated TARGET GENE. MGC50337 BINDING SITE is a target binding site found in the 3' untranslated region of mRNA encoded by MGC50337, corresponding to a target binding site such as BINDING SITE I, BINDING SITE II or BINDING SITE III of FIG. 8. Table 4 illustrates the complementarity of the nucleotide sequences of MGC50337 BINDING SITE, designated SEQ ID:13976, to the nucleotide sequence of GAM25 rNA, herein designated GAM RNA, also designated SEQ ID:206.

Another function of GAM25 is therefore inhibition of MGC50337 (Accession NP_848604.1). Accordingly, utilities of GAM25 include diagnosis, prevention and treatment of diseases and clinical conditions associated with MGC50337.

Mhc class ii transactivator (MHC2TA, Accession NP_000237.1) is another GAM25 target gene, herein designated TARGET GENE. MHC2TA BINDING SITE is a target binding site found in the 3' untranslated region of mRNA encoded by MHC2TA, corresponding to a target binding site such as BINDING SITE I, BINDING SITE II or BINDING SITE III of FIG. 8. Table 4 illustrates the complementarity of the nucleotide sequences of MHC2TA BINDING SITE, designated SEQ ID:15607, to the nucleotide sequence of GAM25 rNA, herein designated GAM RNA, also designated SEQ ID:206.

Another function of GAM25 is therefore inhibition of Mhc class ii transactivator (MHC2TA, Accession NP_000237.1). Accordingly, utilities of GAM25 include diagnosis, prevention and treatment of diseases and clinical conditions associated with MHC2TA.

Melan-a (MLANA, Accession NP_005502.1) is another GAM25 target gene, herein designated TARGET GENE. MLANA BINDING SITE is a target binding site found in the 3' untranslated region of mRNA encoded by MLANA, corresponding to a target binding site such as BINDING SITE I, BINDING SITE II or BINDING SITE III of FIG. 8. Table 4 illustrates the complementarity of the nucleotide sequences of MLANA BINDING SITE, designated SEQ ID:19169, to the nucleotide sequence of GAM25 RNA, herein designated GAM RNA, also designated SEQ ID:206.

Another function of GAM25 is therefore inhibition of Melan-a (MLANA, Accession NP_005502.1). Accordingly, utilities of GAM25 include diagnosis, prevention and treatment of diseases and clinical conditions associated with MLANA.

moblak (Accession NP_570719.1) is another GAM25 target gene, herein designated TARGET GENE. moblak BINDING SITE is a target binding site found in the 3' untranslated region of mRNA encoded by moblak, corresponding to a target binding site such as BINDING SITE I, BINDING SITE II or BINDING SITE III of FIG. 8. Table 4 illustrates the complementarity of the nucleotide sequences of moblak BINDING SITE, designated SEQ ID:17041, to the nucleotide sequence of GAM25 rNA, herein designated GAM RNA, also designated SEQ ID:206.

Another function of GAM25 is therefore inhibition of moblak (Accession NP_570719.1). Accordingly, utilities of GAM25 include diagnosis, prevention and treatment of diseases and clinical conditions associated with moblak.

Molybdenum cofactor synthesis 3 (MOCS3, Accession NP_055299.1) is another GAM25 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:5363, to the nucleotide sequence of GAM25 rNA, herein designated GAM RNA, also designated SEQ ID:206.

Another function of GAM25 is therefore inhibition of Molybdenum cofactor synthesis 3 (MOCS3, Accession NP_055299.1). Accordingly, utilities of GAM25 include diagnosis, prevention and treatment of diseases and clinical conditions associated with MOCS3.

Mannose phosphate isomerase (MPI, Accession NP_002426.1) is another GAM25 target gene, herein designated TARGET GENE. MPI BINDING SITE is a target binding site found in the 3' untranslated region of mRNA encoded by MPI, corresponding to a target binding site such as BINDING SITE I, BINDING SITE II or BINDING SITE III of FIG. 8. Table 4 illustrates the complementarity of the nucleotide sequences of MPI BINDING SITE, designated SEQ ID:11116, to the nucleotide sequence of GAM25 rNA, herein designated GAM RNA, also designated SEQ ID:206.

Another function of GAM25 is therefore inhibition of Mannose phosphate isomerase (MPI, Accession NP_002426.1). Accordingly, utilities of GAM25 include diagnosis, prevention and treatment of diseases and clinical conditions associated with MPI.

Myeloproliferative leukemia virus oncogene (MPL, Accession NP_005364.1) is another GAM25 target gene, herein designated TARGET GENE. MPL BINDING SITE is a target binding site found in the 3' untranslated region of mRNA encoded by MPL, corresponding to a target binding site such as BINDING SITE I, BINDING SITE II or BINDING SITE III of FIG. 8. Table 4 illustrates the complementarity of the nucleotide sequences of MPL BINDING SITE, designated SEQ ID:12310, to the nucleotide sequence of GAM25 rNA, herein designated GAM RNA, also designated SEQ ID:206.

Another function of GAM25 is therefore inhibition of Myeloproliferative leukemia virus oncogene (MPL, Accession NP_005364.1). Accordingly, utilities of GAM25 include diagnosis, prevention and treatment of diseases and clinical conditions associated with MPL.

Mitochondrial ribosomal protein l44 (MRPL44, Accession NP_075066.1) is another GAM25 target gene, herein designated TARGET GENE. MRPL44 BINDING SITE is a target binding site found in the 3' untranslated region of mRNA encoded by MRPL44, corresponding to a target binding site such as BINDING SITE I, BINDING SITE II or BINDING SITE III of FIG. 8. Table 4 illustrates the complementarity of the nucleotide sequences of MRPL44 BINDING SITE, designated SEQ ID:400, to the nucleotide sequence of GAM25 RNA, herein designated GAM RNA, also designated SEQ ID:206.

Another function of GAM25 is therefore inhibition of Mitochondrial ribosomal protein l44 (MRPL44, Accession NP_075066.1). Accordingly, utilities of GAM25 include diagnosis, prevention and treatment of diseases and clinical conditions associated with MRPL44.

Mitochondrial ribosomal protein s27 (MRPS27, Accession NP_055899.1) is another GAM25 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:8246, to the nucleotide sequence of GAM25 RNA, herein designated GAM RNA, also designated SEQ ID:206.

Another function of GAM25 is therefore inhibition of Mitochondrial ribosomal protein s27 (MRPS27, Accession NP_055899.1). Accordingly, utilities of GAM25 include diagnosis, prevention and treatment of diseases and clinical conditions associated with MRPS27.

MSTP028 (Accession NP_114160.1) is another GAM25 target gene, herein designated TARGET GENE. MSTP028 BINDING SITE is a target binding site found in the 3' untranslated region of mRNA encoded by MSTP028, corresponding to a target binding site such as BINDING SITE I, BINDING SITE II or BINDING SITE III of FIG. 8. Table 4 illustrates the complementarity of the nucleotide sequences of MSTP028 BINDING SITE, designated SEQ ID:9881, to the nucleotide sequence of GAM25 rNA, herein designated GAM RNA, also designated SEQ ID:206.

Another function of GAM25 is therefore inhibition of MSTP028 (Accession NP_114160.1). Accordingly, utilities of GAM25 include diagnosis, prevention and treatment of diseases and clinical conditions associated with MSTP028.

MtFMT (Accession NP_640335.1) is another GAM25 target gene, herein designated TARGET GENE. MtFMT BINDING SITE is a target binding site found in the 3' untranslated region of mRNA encoded by MtFMT, corresponding to a target binding site such as BINDING SITE I, BINDING SITE II or BINDING SITE III of FIG. 8. Table 4 illustrates the complementarity of the nucleotide sequences of MtFMT BINDING SITE, designated SEQ ID:19169, to the nucleotide sequence of GAM25 rNA, herein designated GAM RNA, also designated SEQ ID:206.

Another function of GAM25 is therefore inhibition of MtFMT (Accession NP_640335.1). Accordingly, utilities of GAM25 include diagnosis, prevention and treatment of diseases and clinical conditions associated with MtFMT.

MTH2 (Accession NP_060753.1) is another GAM25 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:12362, to the nucleotide sequence of GAM25 rNA, herein designated GAM RNA, also designated SEQ ID:206.

Another function of GAM25 is therefore inhibition of MTH2 (Accession NP_060753.1). Accordingly, utilities of GAM25 include diagnosis, prevention and treatment of diseases and clinical conditions associated with MTH2.

MYLC2PL (Accession NP_612412.1) is another GAM25 target gene, herein designated TARGET GENE. MYLC2PL BINDING SITE is a target binding site found in the 5' untranslated region of mRNA encoded by MYLC2PL, corresponding to a target binding site such as BINDING SITE I, BINDING SITE II or BINDING SITE III of FIG. 8. Table 4 illustrates the complementarity of the nucleotide sequences of MYLC2PL BINDING SITE, designated SEQ ID:2680, to the nucleotide sequence of GAM25 rNA, herein designated GAM RNA, also designated SEQ ID:206.

Another function of GAM25 is therefore inhibition of MYLC2PL (Accession NP_612412.1). Accordingly, utilities of GAM25 include diagnosis, prevention and treatment of diseases and clinical conditions associated with MYLC2PL.

Myosin 5c (MYO5C, Accession NP_061198.1) is another GAM25 target gene, herein designated TARGET GENE. MYO5C BINDING SITE is a target binding site found in the 3' untranslated region of mRNA encoded by MYO5C, corresponding to a target binding site such as BINDING SITE I, BINDING SITE II or BINDING SITE III of FIG. 8. Table 4 illustrates the complementarity of the nucleotide sequences of MYO5C BINDING SITE, designated SEQ ID:3499, to the nucleotide sequence of GAM25 rNA, herein designated GAM RNA, also designated SEQ ID:206.

Another function of GAM25 is therefore inhibition of Myosin 5c (MYO5C, Accession NP_061198.1). Accordingly, utilities of GAM25 include diagnosis, prevention and treatment of diseases and clinical conditions associated with MYO5C.

Ndrg family member 3 (NDRG3, Accession NP_114402.1) is another GAM25 target gene, herein designated TARGET GENE. NDRG3 BINDING SITE is a target binding site found in the 3' untranslated region of multiple transcripts of mRNA encoded by NDRG3, corresponding to a target binding site such as BINDING SITE I, BINDING SITE II or BINDING SITE III of FIG. 8. Table 4 illustrates the complementarity of the nucleotide sequences of NDRG3 BINDING SITE, designated SEQ ID:6322, to the nucleotide sequence of GAM25 rNA, herein designated GAM RNA, also designated SEQ ID:206.

Another function of GAM25 is therefore inhibition of Ndrg family member 3 (NDRG3, Accession NP_114402.1). Accordingly, utilities of GAM25 include diagnosis, prevention and treatment of diseases and clinical conditions associated with NDRG3.

Nadh dehydrogenase (ubiquinone) 1, subcomplex unknown, 2, 14.5 kda (NDUFC2, Accession NP_004540.1) is another GAM25 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:18323, to the nucleotide sequence of GAM25 rNA, herein designated GAM RNA, also designated SEQ ID:206.

Another function of GAM25 is therefore inhibition of Nadh dehydrogenase (ubiquinone) 1, subcomplex unknown, 2, 14.5 kda (NDUFC2, Accession NP_004540.1). Accordingly, utilities of GAM25 include diagnosis, prevention and treatment of diseases and clinical conditions associated with NDUFC2.

Nima (never in mitosis gene a)-related kinase 4 (NEK4, Accession NP_003148.1) is another GAM25 target gene, herein designated TARGET GENE. NEK4 BINDING SITE is a target binding site found in the 3' untranslated region of mRNA encoded by NEK4, corresponding to a target binding site such as BINDING SITE I, BINDING SITE II or BINDING SITE III of FIG. 8. Table 4 illustrates the complementarity of the nucleotide sequences of NEK4 BINDING SITE, designated SEQ ID:15238, to the nucleotide sequence of GAM25 rNA, herein designated GAM RNA, also designated SEQ ID:206.

Another function of GAM25 is therefore inhibition of Nima (never in mitosis gene a)-related kinase 4 (NEK4, Accession NP_003148.1). Accordingly, utilities of GAM25 include diagnosis, prevention and treatment of diseases and clinical conditions associated with NEK4.

Neurofibromin 2 (bilateral acoustic neuroma) (NF2, Accession NP_057502.1) is another GAM25 target gene, herein designated TARGET GENE. NF2 BINDING SITE is a target binding site found in the 5' untranslated region of multiple transcripts of mRNA encoded by NF2, corresponding to a target binding site such as BINDING SITE I, BINDING SITE II or BINDING SITE III of FIG. 8. Table 4 illustrates the complementarity of the nucleotide sequences of NF2 BINDING SITE, designated SEQ ID:18419, to the nucleotide sequence of GAM25 rNA, herein designated GAM RNA, also designated SEQ ID:206.

Another function of GAM25 is therefore inhibition of Neurofibromin 2 (bilateral acoustic neuroma) (NF2, Accession NP_057502.1). Accordingly, utilities of GAM25 include diagnosis, prevention and treatment of diseases and clinical conditions associated with NF2.

Nuclear factor of activated t-cells 5, tonicity-responsive (NFAT5, Accession NP_619728.2) is another GAM25 target gene, herein designated TARGET GENE. NFAT5 BINDING SITE is a target binding site found in the 3' untranslated region of multiple transcripts of mRNA encoded by NFAT5, corresponding to a target binding site such as BINDING SITE I, BINDING SITE II or BINDING SITE III of FIG. 8. Table 4 illustrates the complementarity of the nucleotide sequences of NFAT5 BINDING SITE, designated SEQ ID:18076, to the nucleotide sequence of GAM25 rNA, herein designated GAM RNA, also designated SEQ ID:206.

Another function of GAM25 is therefore inhibition of Nuclear factor of activated t-cells 5, tonicity-responsive (NFAT5, Accession NP_619728.2). Accordingly, utilities of GAM25 include diagnosis, prevention and treatment of diseases and clinical conditions associated with NFAT5.

Nuclear factor of activated t-cells 5, tonicity-responsive (NFAT5, Accession NP_775321.1) is another GAM25 target gene, herein designated TARGET GENE. NFAT5 BINDING SITE is a target binding site found in the 3' untranslated region of multiple transcripts of mRNA encoded by NFAT5, corresponding to a target binding site such as BINDING SITE I, BINDING SITE II or BINDING SITE III of FIG. 8. Table 4 illustrates the complementarity of the nucleotide sequences of NFAT5 BINDING SITE, designated SEQ ID:18076, to the nucleotide sequence of GAM25 rNA, herein designated GAM RNA, also designated SEQ ID:206.

Another function of GAM25 is therefore inhibition of Nuclear factor of activated t-cells 5, tonicity-responsive (NFAT5, Accession NP_775321.1). Accordingly, utilities of GAM25 include diagnosis, prevention and treatment of diseases and clinical conditions associated with NFAT5.

Nuclear factor of activated t-cells 5, tonicity-responsive (NFAT5, Accession NP_619727.1) is another GAM25 target gene, herein designated TARGET GENE. NFAT5 BINDING SITE is a target binding site found in the 3' untranslated region of multiple transcripts of mRNA encoded by NFAT5, corresponding to a target binding site such as BINDING SITE I, BINDING SITE II or BINDING SITE III of FIG. 8. Table 4 illustrates the complementarity of the nucleotide sequences of NFAT5 BINDING SITE, designated SEQ ID:18076, to the nucleotide sequence of GAM25 rNA, herein designated GAM RNA, also designated SEQ ID:206.

Another function of GAM25 is therefore inhibition of Nuclear factor of activated t-cells 5, tonicity-responsive (NFAT5, Accession NP_619727.1). Accordingly, utilities of GAM25 include diagnosis, prevention and treatment of diseases and clinical conditions associated with NFAT5.

Nuclear factor of activated t-cells 5, tonicity-responsive (NFAT5, Accession NP_006590.1) is another GAM25 target gene, herein designated TARGET GENE. NFAT5 BINDING SITE is a target binding site found in the 3' untranslated region of multiple transcripts of mRNA encoded by NFAT5, corresponding to a target binding site such as BINDING SITE I, BINDING SITE II or BINDING SITE III of FIG. 8. Table 4 illustrates the complementarity of the nucleotide sequences of NFAT5 BINDING SITE, designated SEQ ID:18076, to the nucleotide sequence of GAM25 rNA, herein designated GAM RNA, also designated SEQ ID:206.

Another function of GAM25 is therefore inhibition of Nuclear factor of activated t-cells 5, tonicity-responsive (NFAT5, Accession NP_006590.1). Accordingly, utilities of GAM25 include diagnosis, prevention and treatment of diseases and clinical conditions associated with NFAT5.

Nudix (nucleoside diphosphate linked moiety x)-type motif 4 (NUDT4, Accession NP_061967.2) is another GAM25 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:17183, to the nucleotide sequence of GAM25 rNA, herein designated GAM RNA, also designated SEQ ID:206.

Another function of GAM25 is therefore inhibition of Nudix (nucleoside diphosphate linked moiety x)-type motif 4 (NUDT4, Accession NP_061967.2). Accordingly, utilities of GAM25 include diagnosis, prevention and treatment of diseases and clinical conditions associated with NUDT4.

Nuclear mitotic apparatus protein 1 (NUMA1, Accession NP_006176.1) is another GAM25 target gene, herein designated TARGET GENE. NUMA1 BINDING SITE is a target binding site found in the 5' untranslated region of mRNA encoded by NUMA1, corresponding to a target binding site such as BINDING SITE I, BINDING SITE II or BINDING SITE III of FIG. 8. Table 4 illustrates the complementarity of the nucleotide sequences of NUMA1 BINDING SITE, designated SEQ ID:14301, to the nucleotide sequence of GAM25 rNA, herein designated GAM RNA, also designated SEQ ID:206.

Another function of GAM25 is therefore inhibition of Nuclear mitotic apparatus protein 1 (NUMA1, Accession NP_006176.1), a gene which is nuclear mitotic apparatus protein. Accordingly, utilities of GAM25 include diagnosis, prevention and treatment of diseases and clinical conditions associated with NUMA1.

The function of NUMA1 has been established by previous studies. The NuMA protein was one of the first to be described as a cell cycle-related protein based on a distinct immunofluorescent staining pattern: in interphase, NuMA is present throughout the nucleus, and in mitosis, it localizes to the spindle apparatus (Lydersen and Pettijohn, 1980). Some patients with autoimmune disease have antibodies directed against the NuMA protein. The full-length NUMA cDNA (Compton et al., 1992; Yang et al., 1992) predicts a protein with the largest known coiled-coil region in a protein. By fluorescence in situ hybridization, Sparks et al. (1993) demonstrated that the NUMA1 gene is present in single copy and located on 11q13. Acute promyelocytic leukemia (APL) is uniquely associated with chromosomal translocations that disrupt the gene encoding the retinoic acid receptor, RARA (OMIM Ref. No. 180240). In more than 99% of cases, this disruption results in the formation of a fusion of the RARA gene with the PML gene (OMIM Ref. No. 102578). In rare variants of APL, the RARA gene has been found to be fused to 1 of 2 other genes, PLZF (OMIM Ref. No. 176797) and NPM (OMIM Ref. No. 164040). Although RARA dysregulation is evidently important in APL, the role of the various fusion partners is unclear. Wells et al. (1997) characterized a fourth APL gene fusion, which linked exons encoding the retinoic acid and DNA-binding domains of RARA to 5-prime exons of NUMA1. The NUMA/RARA fusion protein existed in sheet- like nuclear aggregates with which normal NUMA partly colocalized. In contrast to t(15;17) APL (the usual variety) the intracellular distribution of PML was normal in these cells. Wells et al. (1997) suggested that interference with retinoid signaling, and not disruption of PML organization, is essential to the APL phenotype. Their work implicated for the first time an element of the mitotic apparatus in the molecular pathogenesis of human malignancy. The proband of their study was a Caucasian male first seen at 6 months of age for investigation of multiple cutaneous lesions. Despite this unusual clinical presentation, peripheral blood morphology and cell-surface immunophenotype were typical of APL. Routine analysis of diagnostic bone marrow revealed a clonal cytogenetic abnormality, t(11;17)(q13;q21). The patient was treated with all-trans retinoic acid and achieved complete remission; he remained in morphologic remission 38 months after autologous bone marrow transplantation.

Full details of the abovementioned studies are described in the following publications, the disclosure of which are hereby incorporated by reference:

Lydersen, B. K.; Pettijohn, D. E.: Human-specific nuclear protein that associates with the polar region of the mitotic apparatus: distribution in a human/hamster hybrid cell. Cell 22:489-499, 1980; and Wells, R. A.; Catzavelos, C.; Kamel-Reid, S.: Fusion of retinoic acid receptor alpha to NuMA, the nuclear mitotic apparatus protein, by a variant translocation in acute promyelocytic l.

Further studies establishing the function and utilities of NUMA1 are found in John Hopkins OMIM database record ID 164009, and in cited publications listed in Table 5, which are hereby incorporated by reference. NUP43 (Accession NP_078923.2) is another GAM25 target gene, herein designated TARGET GENE. NUP43 BINDING SITE is a target binding site found in the 3' untranslated region of mRNA encoded by NUP43, corresponding to a target binding site such as BINDING SITE I, BINDING SITE II or BINDING SITE III of FIG. 8. Table 4 illustrates the complementarity of the nucleotide sequences of NUP43 BINDING SITE, designated SEQ ID:15705, to the nucleotide sequence of GAM25 RNA, herein designated GAM RNA, also designated SEQ ID:206.

Another function of GAM25 is therefore inhibition of NUP43 (Accession NP_078923.2). Accordingly, utilities of GAM25 include diagnosis, prevention and treatment of diseases and clinical conditions associated with NUP43.

Oligophrenin 1 (OPHN1, Accession NP_002538.1) is another GAM25 target gene, herein designated TARGET GENE. OPHN1 BINDING SITE is a target binding site found in the 3' untranslated region of mRNA encoded by OPHN1, corresponding to a target binding site such as BINDING SITE I, BINDING SITE II or BINDING SITE III of FIG. 8. Table 4 illustrates the complementarity of the nucleotide sequences of OPHN1 BINDING SITE, designated SEQ ID:1657, to the nucleotide sequence of GAM25 rNA, herein designated GAM RNA, also designated SEQ ID:206.

Another function of GAM25 is therefore inhibition of Oligophrenin 1 (OPHN1, Accession NP_002538.1). Accordingly, utilities of GAM25 include diagnosis, prevention and treatment of diseases and clinical conditions associated with OPHN1.

Oxysterol binding protein-like 2 (OSBPL2, Accession NP_055650.1) is another GAM25 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:17183, to the nucleotide sequence of GAM25 rNA, herein designated GAM RNA, also designated SEQ ID:206.

Another function of GAM25 is therefore inhibition of Oxysterol binding protein-like 2 (OSBPL2, Accession NP_055650.1). Accordingly, utilities of GAM25 include diagnosis, prevention and treatment of diseases and clinical conditions associated with OSBPL2.

Oxysterol binding protein-like 2 (OSBPL2, Accession NP_653081.1) is another GAM25 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:17183, to the nucleotide sequence of GAM25 rNA, herein designated GAM RNA, also designated SEQ ID:206.

Another function of GAM25 is therefore inhibition of Oxysterol binding protein-like 2 (OSBPL2, Accession NP_653081.1). Accordingly, utilities of GAM25 include diagnosis, prevention and treatment of diseases and clinical conditions associated with OSBPL2.

Protocadherin alpha 9 (PCDHA9, Accession NP_054724.1) is another GAM25 target gene, herein designated TARGET GENE. PCDHA9 BINDING SITE is a target binding site found in the 3' untranslated region of multiple transcripts of mRNA encoded by PCDHA9, corresponding to a target binding site such as BINDING SITE I, BINDING SITE II or BINDING SITE III of FIG. 8. Table 4 illustrates the complementarity of the nucleotide sequences of PCDHA9 BINDING SITE, designated SEQ ID:12010, to the nucleotide sequence of GAM25 RNA, herein designated GAM RNA, also designated SEQ ID:206.

Another function of GAM25 is therefore inhibition of Protocadherin alpha 9 (PCDHA9, Accession NP_054724.1), a gene which is a calcium-dependent cell-adhesion protein. Accordingly, utilities of GAM25 include diagnosis, prevention and treatment of diseases and clinical conditions associated with PCDHA9.

The function of PCDHA9 has been established by previous studies. Cadherins are calcium-dependent cell-cell adhesion molecules that mediate neural cell-cell interactions. Protocadherins constitute a subfamily of nonclassic cadherins. PCDHA9 is a member of the alpha cluster of protocadherin genes on 5q31. By screening a brain cDNA library for sequences with the potential to encode large proteins, Nagase et al. (1997) identified a cDNA encoding PCDHA9, which they termed KIAA0345. The deduced protein has 842 amino acids. RT-PCR analysis detected strongest expression of KIAA0345 in kidney and testis, followed by brain, lung, pancreas, and ovary.

Full details of the abovementioned studies are described in the following publications, the disclosure of which are hereby incorporated by reference:

Nagase, T.; Ishikawa, I.; Nakajima, D.; Ohira, M.; Seki, N.; Miyajima, N.; Tanaka, A.; Kotani, H.; Nomura, N.; O'Hara, O.: Prediction of the coding sequences of unidentified human genes. VII. The complete sequences of 100 new cDNA clones from brain which can code for large proteins in vitro. DNA Res. 4:141-150, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse and.

Further studies establishing the function and utilities of PCDHA9 are found in John Hopkins OMIM database record ID 606315, and in cited publications listed in Table 5, which are hereby incorporated by reference. Protocadherin beta 11 (PCDHB11, Accession NP_061754.1) is another GAM25 target gene, herein designated TARGET GENE. PCDHB11 BINDING SITE is a target binding site found in the 3' untranslated region of mRNA encoded by PCDHB11, corresponding to a target binding site such as BINDING SITE I, BINDING SITE II or BINDING SITE III of FIG. 8. Table 4 illustrates the complementarity of the nucleotide sequences of PCDHB11 BINDING SITE, designated SEQ ID:13873, to the nucleotide sequence of GAM25 rNA, herein designated GAM RNA, also designated SEQ ID:206.

Another function of GAM25 is therefore inhibition of Protocadherin beta 11 (PCDHB11, Accession NP_061754.1). Accordingly, utilities of GAM25 include diagnosis, prevention and treatment of diseases and clinical conditions associated with PCDHB11.

Protocadherin beta 9 (PCDHB9, Accession NP_061992.2) is another GAM25 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:5363, to the nucleotide sequence of GAM25 rNA, herein designated GAM RNA, also designated SEQ ID:206.

Another function of GAM25 is therefore inhibition of Protocadherin beta 9 (PCDHB9, Accession NP_061992.2), a gene which is a potential calcium-dependent cell-adhesion protein. Accordingly, utilities of GAM25 include diagnosis, prevention and treatment of diseases and clinical conditions associated with PCDHB9.

The function of PCDHB9 has been established by previous studies. Cadherins are calcium-dependent cell-cell adhesion molecules that mediate neural cell-cell interactions. Protocadherins constitute a subfamily of nonclassic cadherins. PCDHB9 is a member of the beta cluster of protocadherin genes on 5q31. For specific information on the PCDHB genes, see 604967. Vanhalst et al. (2001) determined that unlike most PCDHB proteins, PCDHB9 has not 1 but 2 PXXP motifs, putative SH3 protein-binding sites, at the end of the conserved region of its cytoplasmic domain.

Full details of the abovementioned studies are described in the following publications, the disclosure of which are hereby incorporated by reference:

Vanhalst, K.; Kools, P.; Eynde, E. V.; van Roy, F.: The human and murine protocadherin-beta one-exon gene families show high evolutionary conservation, despite the difference in gene number. FEBS Lett. 495:120-125, 2001; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse a.

Further studies establishing the function and utilities of PCDHB9 are found in John Hopkins OMIM database record ID 606335, and in cited publications listed in Table 5, which are hereby incorporated by reference. Phosducin-like (PDCL, Accession NP_005379.2) is another GAM25 target gene, herein designated TARGET GENE. PDCL BINDING SITE is a target binding site found in the 3' untranslated region of mRNA encoded by PDCL, corresponding to a target binding site such as BINDING SITE I, BINDING SITE II or BINDING SITE III of FIG. 8. Table 4 illustrates the complementarity of the nucleotide sequences of PDCL BINDING SITE, designated SEQ ID:6421, to the nucleotide sequence of GAM25 rNA, herein designated GAM RNA, also designated SEQ ID:206.

Another function of GAM25 is therefore inhibition of Phosducin-like (PDCL, Accession NP_005379.2), a gene which may regulate G-protein signaling and similar to phosducins. Accordingly, utilities of GAM25 include diagnosis, prevention and treatment of diseases and clinical conditions associated with PDCL.

The function of PDCL has been established by previous studies. Phosducin-like protein (PDCL) is a putative modulator of heterotrimeric G proteins. It was initially isolated as the product of an ethanol-responsive gene in neural cell cultures (Miles et al., 1993). PDCL shares extensive amino acid sequence homology with phosducin (PDC; 171490), a phosphoprotein expressed in retina and pineal gland that inhibits several G protein-coupled signaling pathways by binding to the beta-gamma subunits of G proteins. By screening a human genomic library with a rat Pdcl cDNA, Thibault et al. (1999) isolated a partial PDCL genomic sequence. They also identified several PDCL ESTs. The authors derived the complete PDCL coding sequence by aligning the genomic and EST sequences. The predicted 301-amino acid PDCL protein shows homology to areas of rat Pdc that contact G protein beta-gamma subunits. The N-terminal regions of human, rat, and Drosophila PDCL are highly homologous to each other, but show little homology to the N-terminal region of rat Pdc. By somatic cell hybrid analysis, Thibault et al. (1999) mapped the PDCL gene to chromosome 9. Using a radiation hybrid mapping panel, they found that the PDCL gene is linked to markers D9S1876 and D9S1674.

Full details of the abovementioned studies are described in the following publications, the disclosure of which are hereby incorporated by reference:

Miles, M. F.; Barhite, S.; Sganga, M.; Elliott, M.: Phosducin-like protein: an ethanol-responsive potential modulator of guanine nucleotide-binding protein function. Proc. Nat. Acad. Sci. 90:10831-10835, 1993; and Thibault, C.; Wang, J. F.; Charnas, R.; Mirel, D.; Barhite, S.; Miles, M. F.: Cloning and characterization of the rat and human phosducin-like protein genes: structure, expression and.

Further studies establishing the function and utilities of PDCL are found in John Hopkins OMIM database record ID 604421, and in cited publications listed in Table 5, which are hereby incorporated by reference. Phosphodiesterase 6b, cgmp-specific, rod, beta (congenital stationary night blindness 3, autosomal dominant) (PDE6B, Accession NP_000274.1) is another GAM25 target gene, herein designated TARGET GENE. PDE6B BINDING SITE is a target binding site found in the 3' untranslated region of mRNA encoded by PDE6B, corresponding to a target binding site such as BINDING SITE I, BINDING SITE II or BINDING SITE III of FIG. 8. Table 4 illustrates the complementarity of the nucleotide sequences of PDE6B BINDING SITE, designated SEQ ID:2250, to the nucleotide sequence of GAM25 rNA, herein designated GAM RNA, also designated SEQ ID:206.

Another function of GAM25 is therefore inhibition of Phosphodiesterase 6b, cgmp-specific, rod, beta (congenital stationary night blindness 3, autosomal dominant) (PDE6B, Accession NP_000274.1). Accordingly, utilities of GAM25 include diagnosis, prevention and treatment of diseases and clinical conditions associated with PDE6B.

Phosphoribosylformylglycinamidine synthase (fgar amidotransferase) (PFAS, Accession NP_036525.1) is another GAM25 target gene, herein designated TARGET GENE. PFAS BINDING SITE is a target binding site found in the 3' untranslated region of mRNA encoded by PFAS, corresponding to a target binding site such as BINDING SITE I, BINDING SITE II or BINDING SITE III of FIG. 8. Table 4 illustrates the complementarity of the nucleotide sequences of PFAS BINDING SITE, designated SEQ ID:12883, to the nucleotide sequence of GAM25 rNA, herein designated GAM RNA, also designated SEQ ID:206.

Another function of GAM25 is therefore inhibition of Phosphoribosylformylglycinamidine synthase (fgar amidotransferase) (PFAS, Accession NP_036525.1). Accordingly, utilities of GAM25 include diagnosis, prevention and treatment of diseases and clinical conditions associated with PFAS.

Reserved (PHF6, Accession NP_115834.1) is another GAM25 target gene, herein designated TARGET GENE. PHF6 BINDING SITE is a target binding site found in the 3' untranslated region of multiple transcripts of mRNA encoded by PHF6, corresponding to a target binding site such as BINDING SITE I, BINDING SITE II or BINDING SITE III of FIG. 8. Table 4 illustrates the complementarity of the nucleotide sequences of PHF6 BINDING SITE, designated SEQ ID:19225, to the nucleotide sequence of GAM25 rNA, herein designated GAM RNA, also designated SEQ ID:206.

Another function of GAM25 is therefore inhibition of Reserved (PHF6, Accession NP_115834.1). Accordingly, utilities of GAM25 include diagnosis, prevention and treatment of diseases and clinical conditions associated with PHF6.

Pbx/knotted 1 homeobox 1 (PKNOX1, Accession NP_004562.2) is another GAM25 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:4340, to the nucleotide sequence of GAM25 RNA, herein designated GAM RNA, also designated SEQ ID:206.

Another function of GAM25 is therefore inhibition of Pbx/knotted 1 homeobox 1 (PKNOX1, Accession NP_004562.2), a gene which may regulate gene expression and control cell differentiation. Accordingly, utilities of GAM25 include diagnosis, prevention and treatment of diseases and clinical conditions associated with PKNOX1.

The function of PKNOX1 has been established by previous studies. As part of developing a transcript map of human chromosome 21, Chen et al. (1997) used exon trapping to identify portions of genes from chromosome 21-specific cosmids. They identified a trapped exon that is identical to a region of the human expressed sequence tag (EST) L12425. Using the exon and EST as probes, they screened human fetal brain and kidney cDNA libraries and cloned the corresponding gene, which encodes a homeodomain-containing polypeptide of 436 amino acids. Chen et al. (1997) used the EST as a probe for Northern analysis and detected transcripts of 2.5 and 5 kb in every human tissue examined, including heart, brain and brain subregions, placenta, lung, liver, muscle, and several fetal tissues. The gene, designated PBX/knotted-1 homeo box-1 (OMIM Ref. No. PKNOX1), has a homeodomain closely related to those of the mammalian PBX family (such as mouse Meis1) and the plant knotted-1 family (involved in plant development). Chen et al. (1997) used PCR amplification, hybridization, and genetic linkage analysis to map PKNOX1 to 21q22.3 between markers D21S212 and D21S25 on YAC350F7. By fluorescence in situ hybridization, Berthelsen et al. (1998) mapped the PKNOX1 gene to human chromosome 21q22.3 and mouse chromosome 17B/C.

Full details of the abovementioned studies are described in the following publications, the disclosure of which are hereby incorporated by reference:

Berthelsen, J.; Viggiano, L.; Schulz, H.; Ferretti, E.; Consalez, G. G.; Rocchi, M.; Blasi, F.: PKNOX1, a gene encoding PREP1, a new regulator of Pbx activity, maps on human chromosome 21q22.3 and murine chromosome 17B/C. Genomics 47:323-324, 1998; and Chen, H.; Rossier, C.; Nakamura, Y.; Lynn, A.; Chakravarti, A.; Antonarakis, S. E.: Cloning of a novel homeobox-containing gene, PKNOX1, and mapping to human chromosome 21q22.3. Genomi.

Further studies establishing the function and utilities of PKNOX1 are found in John Hopkins OMIM database record ID 602100, and in cited publications listed in Table 5, which are hereby incorporated by reference. Pro-melanin-concentrating hormone-like 1 (PMCHL1, Accession NP_114093.1) is another GAM25 target gene, herein designated TARGET GENE. PMCHL1 BINDING SITE is a target binding site found in the 3' untranslated region of mRNA encoded by PMCHL1, corresponding to a target binding site such as BINDING SITE I, BINDING SITE II or BINDING SITE III of FIG. 8. Table 4 illustrates the complementarity of the nucleotide sequences of PMCHL1 BINDING SITE, designated SEQ ID:15693, to the nucleotide sequence of GAM25 rNA, herein designated GAM RNA, also designated SEQ ID:206.

Another function of GAM25 is therefore inhibition of Pro-melanin-concentrating hormone-like 1 (PMCHL1, Accession NP_114093.1). Accordingly, utilities of GAM25 include diagnosis, prevention and treatment of diseases and clinical conditions associated with PMCHL1.

Pro-melanin-concentrating hormone-like 2 (PMCHL2, Accession NP_114094.1) is another GAM25 target gene, herein designated TARGET GENE. PMCHL2 BINDING SITE is a target binding site found in the 3' untranslated region of mRNA encoded by PMCHL2, corresponding to a target binding site such as BINDING SITE I, BINDING SITE II or BINDING SITE III of FIG. 8. Table 4 illustrates the complementarity of the nucleotide sequences of PMCHL2 BINDING SITE, designated SEQ ID:14075, to the nucleotide sequence of GAM25 RNA, herein designated GAM RNA, also designated SEQ ID:206.

Another function of GAM25 is therefore inhibition of Pro-melanin-concentrating hormone-like 2 (PMCHL2, Accession NP_114094.1). Accordingly, utilities of GAM25 include diagnosis, prevention and treatment of diseases and clinical conditions associated with PMCHL2.

Peptidylprolyl isomerase d (cyclophilin d) (PPID, Accession NP_005029.1) is another GAM25 target gene, herein designated TARGET GENE. PPID BINDING SITE is a target binding site found in the 3' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:15356, to the nucleotide sequence of GAM25 rNA, herein designated GAM RNA, also designated SEQ ID:206.

Another function of GAM25 is therefore inhibition of Peptidylprolyl isomerase d (cyclophilin d) (PPID, Accession NP_005029.1), a gene which catalyzes the cis-trans isomerization of proline imidic peptide bonds in oligopeptides. Accordingly, utilities of GAM25 include diagnosis, prevention and treatment of diseases and clinical conditions associated with PPID.

The function of PPID has been established by previous studies. The cyclophilins are a conserved gene family of peptidyl-prolyl cis-trans isomerases (PPIases; OMIM Ref. No. 123840), the members of which bind the immunosuppressant cyclosporin A. Cyclophilin 40 (CyP-40, also CYPD) was identified by Kieffer et al. (1992) as a 40-kD cyclophilin-like protein with PPIase activity. In the bovine uterus, CyP-40 is a component of the estrogen receptor complex (see OMIM Ref. No. 133430). Kieffer et al. (1993) reported the cloning of a human cDNA homologous to the bovine CyP-40. The cDNA encodes a predicted 370-amino acid protein. The amino end is similar to that of other cyclophilins, while the carboxyl region resembles FKBP59 (OMIM Ref. No. 600611), a component of the glucocorticoid receptor complex. Yokoi et al. (1996) showed that the cyclophilin 40 (or PPID) gene contains 10 exons and spans 14.2 kb of genomic DNA. Ten Alu repeats occur within noncoding regions of the gene. Yokoi et al. (1996) mapped the PPID gene to chromosome 4 using a panel of somatic cell hybrid DNAs. By fluorescence in situ hybridization, Ratajczak et al. (1997) mapped the PPID gene to 4q31.3.

Full details of the abovementioned studies are described in the following publications, the disclosure of which are hereby incorporated by reference:

Ratajczak, T.; Woollatt, E.; Kumar, P.; Ward, B. K.; Minchin, R. F.; Baker, E.: Cyclophilin 40 (PPID) gene map position 4q31.3. Chromosome Res. 5:151 only, 1997; and Yokoi, H.; Shimizu, Y.; Anazawa, H.; Lefebvre, C. A.; Korneluk, R. G.; Ikeda; J.-E.: The structure and complete nucleotide sequence of the human cyclophilin 40 (PPID) gene. Genomics 35.

Further studies establishing the function and utilities of PPID are found in John Hopkins OMIM database record ID 601753, and in cited publications listed in Table 5, which are hereby incorporated by reference. Peptidylprolyl isomerase (cyclophilin)-like 2 (PPIL2, Accession NP_055152.1) is another GAM25 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:12323, to the nucleotide sequence of GAM25 rNA, herein designated GAM RNA, also designated SEQ ID:206.

Another function of GAM25 is therefore inhibition of Peptidylprolyl isomerase (cyclophilin)-like 2 (PPIL2, Accession NP_055152.1). Accordingly, utilities of GAM25 include diagnosis, prevention and treatment of diseases and clinical conditions associated with PPIL2.

Protein kinase, lysine deficient 3 (PRKWNK3, Accession NP_065973.1) is another GAM25 target gene, herein designated TARGET GENE. PRKWNK3 BINDING SITE is a target binding site found in the 3' untranslated region of mRNA encoded by PRKWNK3, corresponding to a target binding site such as BINDING SITE I, BINDING SITE II or BINDING SITE III of FIG. 8. Table 4 illustrates the complementarity of the nucleotide sequences of PRKWNK3 BINDING SITE, designated SEQ ID:5566, to the nucleotide sequence of GAM25 RNA, herein designated GAM RNA, also designated SEQ ID:206.

Another function of GAM25 is therefore inhibition of Protein kinase, lysine deficient 3 (PRKWNK3, Accession NP_065973.1). Accordingly, utilities of GAM25 include diagnosis, prevention and treatment of diseases and clinical conditions associated with PRKWNK3.

PRO1787 (Accession NP_061076.1) is another GAM25 target gene, herein designated TARGET GENE. PRO1787 BINDING SITE is a target binding site found in the 3' untranslated region of mRNA encoded by PRO1787, corresponding to a target binding site such as BINDING SITE I, BINDING SITE II or BINDING SITE III of FIG. 8. Table 4 illustrates the complementarity of the nucleotide sequences of PRO1787 BINDING SITE, designated SEQ ID:4037, to the nucleotide sequence of GAM25 rNA, herein designated GAM RNA, also designated SEQ ID:206.

Another function of GAM25 is therefore inhibition of PRO1787 (Accession NP_061076.1). Accordingly, utilities of GAM25 include diagnosis, prevention and treatment of diseases and clinical conditions associated with PRO1787.

Prostaglandin e synthase (PTGES, Accession NP_004869.1) is another GAM25 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:16132, to the nucleotide sequence of GAM25 rNA, herein designated GAM RNA, also designated SEQ ID:206.

Another function of GAM25 is therefore inhibition of Prostaglandin e synthase (PTGES, Accession NP_004869.1). Accordingly, utilities of GAM25 include diagnosis, prevention and treatment of diseases and clinical conditions associated with PTGES.

Prostaglandin i2 (prostacyclin) synthase (PTGIS, Accession NP_000952.1) is another GAM25 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:11686, to the nucleotide sequence of GAM25 rNA, herein designated GAM RNA, also designated SEQ ID:206.

Another function of GAM25 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM25 include diagnosis, prevention and treatment of diseases and clinical conditions associated with PTGIS.

The function of PTGIS has been established by previous studies. Yokoyama et al. (1996) demonstrated that the prostacyclin synthase gene, which they symbolized PTGIS, consists of 10 exons spanning approximately 60 kb. All the splice donor and acceptor sites conformed to the GT/AG rule. The major product of the primer extension analysis suggested that the transcription of the gene started from the positions around 49 bp upstream of the translation initiation codon. By fluorescence in situ hybridization, they demonstrated that the gene is located at 20q13.11-q13.13. Prostacyclin (also known as prostaglandin I2) is a potent vasodilator and inhibitor of platelet aggregation. The enzyme prostacyclin synthase (EC 5.3.99.4) catalyzes the isomerization of prostaglandin H2 (PGH2) to prostacyclin. Wang and Chen (1996) noted that although it has absorbance spectral features characteristic of the cytochrome P450s, PGIS has no monooxygenase activity and does not require an external source of electrons to initiate its enzyme reaction. Prostacyclin synthase is the single member of family 8 of the cytochrome P450 superfamily (Nelson et al., 1996).

Full details of the abovementioned studies are described in the following publications, the disclosure of which are hereby incorporated by reference:

Wang, L.-H.; Chen, L.: Organization of the gene encoding human prostacyclin synthase. Biochem. Biophys. Res. Commun. 226:631-637, 1996. ; and Yokoyama, C.; Yabuki, T.; Inoue, H.; Tone, Y.; Hara, S.; Hatae, T.; Nagata, M.; Takahashi, E.-I.; Tanabe, T.: Human gene encoding prostacyclin synthase (PTGIS): genomic organization, ch.

Further studies establishing the function and utilities of PTGIS are found in John Hopkins OMIM database record ID 601699, and in cited publications listed in Table 5, which are hereby incorporated by reference. PXK (Accession NP_060241.2) is another GAM25 target gene, herein designated TARGET GENE. PXK BINDING SITE is a target binding site found in the 3' untranslated region of mRNA encoded by PXK, corresponding to a target binding site such as BINDING SITE I, BINDING SITE II or BINDING SITE III of FIG. 8. Table 4 illustrates the complementarity of the nucleotide sequences of PXK BINDING SITE, designated SEQ ID:18264, to the nucleotide sequence of GAM25 rNA, herein designated GAM RNA, also designated SEQ ID:206.

Another function of GAM25 is therefore inhibition of PXK (Accession NP_060241.2). Accordingly, utilities of GAM25 include diagnosis, prevention and treatment of diseases and clinical conditions associated with PXK.

Rab33b, member ras oncogene family (RAB33B, Accession NP_112586.1) is another GAM25 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:797, to the nucleotide sequence of GAM25 rNA, herein designated GAM RNA, also designated SEQ ID:206.

Another function of GAM25 is therefore inhibition of Rab33b, member ras oncogene family (RAB33B, Accession NP_112586.1). Accordingly, utilities of GAM25 include diagnosis, prevention and treatment of diseases and clinical conditions associated with RAB33B.

Rab39, member ras oncogene family (RAB39, Accession XP_084662.1) is another GAM25 target gene, herein designated TARGET GENE. RAB39 BINDING SITE1 and RAB39 BINDING SITE2 are target binding sites found in untranslated regions of mRNA encoded by RAB39, corresponding to target binding sites such as BINDING SITE I, BINDING SITE II or BINDING SITE III of FIG. 8. Table 4 illustrates the complementarity of the nucleotide sequences of RAB39 BINDING SITE1 and RAB39 BINDING SITE2, designated SEQ ID:9341 and SEQ ID:4103 respectively, to the nucleotide sequence of GAM25 rNA, herein designated GAM RNA, also designated SEQ ID:206.

Another function of GAM25 is therefore inhibition of Rab39, member ras oncogene family (RAB39, Accession XP_084662.1). Accordingly, utilities of GAM25 include diagnosis, prevention and treatment of diseases and clinical conditions associated with RAB39.

RAI (Accession NP_006654.1) is another GAM25 target gene, herein designated TARGET GENE. RAI BINDING SITE is a target binding site found in the 5' untranslated region of mRNA encoded by RAI, corresponding to a target binding site such as BINDING SITE I, BINDING SITE II or BINDING SITE III of FIG. 8. Table 4 illustrates the complementarity of the nucleotide sequences of RAI BINDING SITE, designated SEQ ID:14580, to the nucleotide sequence of GAM25 rNA, herein designated GAM RNA, also designated SEQ ID:206.

Another function of GAM25 is therefore inhibition of RAI (Accession NP_006654.1). Accordingly, utilities of GAM25 include diagnosis, prevention and treatment of diseases and clinical conditions associated with RAI.

Ras association (ralgds/af-6) domain family 2 (RASSF2, Accession NP_055552.1) is another GAM25 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:13814, to the nucleotide sequence of GAM25 rNA, herein designated GAM RNA, also designated SEQ ID:206.

Another function of GAM25 is therefore inhibition of Ras association (ralgds/af-6) domain family 2 (RASSF2, Accession NP_055552.1). Accordingly, utilities of GAM25 include diagnosis, prevention and treatment of diseases and clinical conditions associated with RASSF2.

Ras association (ralgds/af-6) domain family 2 (RASSF2, Accession NP_739580.1) is another GAM25 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:13814, to the nucleotide sequence of GAM25 rNA, herein designated GAM RNA, also designated SEQ ID:206.

Another function of GAM25 is therefore inhibition of Ras association (ralgds/af-6) domain family 2 (RASSF2, Accession NP_739580.1). Accordingly, utilities of GAM25 include diagnosis, prevention and treatment of diseases and clinical conditions associated with RASSF2.

Ras association (ralgds/af-6) domain family 2 (RASSF2, Accession NP_739579.1) is another GAM25 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:13814, to the nucleotide sequence of GAM25 rNA, herein designated GAM RNA, also designated SEQ ID:206.

Another function of GAM25 is therefore inhibition of Ras association (ralgds/af-6) domain family 2 (RASSF2, Accession NP_739579.1). Accordingly, utilities of GAM25 include diagnosis, prevention and treatment of diseases and clinical conditions associated with RASSF2.

Retinoblastoma binding protein 9 (RBBP9, Accession NP_006597.2) is another GAM25 target gene, herein designated TARGET GENE. RBBP9 BINDING SITE is a target binding site found in the 3' untranslated region of multiple transcripts of mRNA encoded by RBBP9, corresponding to a target binding site such as BINDING SITE I, BINDING SITE II or BINDING SITE III of FIG. 8. Table 4 illustrates the complementarity of the nucleotide sequences of RBBP9 BINDING SITE, designated SEQ ID:1307, to the nucleotide sequence of GAM25 RNA, herein designated GAM RNA, also designated SEQ ID:206.

Another function of GAM25 is therefore inhibition of Retinoblastoma binding protein 9 (RBBP9, Accession NP_006597.2). Accordingly, utilities of GAM25 include diagnosis, prevention and treatment of diseases and clinical conditions associated with RBBP9.

RE2 (Accession NP_722561.1) is another GAM25 target gene, herein designated TARGET GENE. RE2 BINDING SITE is a target binding site found in the 5' untranslated region of multiple transcripts of mRNA encoded by RE2, corresponding to a target binding site such as BINDING SITE I, BINDING SITE II or BINDING SITE III of FIG. 8. Table 4 illustrates the complementarity of the nucleotide sequences of RE2 BINDING SITE, designated SEQ ID:3366, to the nucleotide sequence of GAM25 rNA, herein designated GAM RNA, also designated SEQ ID:206.

Another function of GAM25 is therefore inhibition of RE2 (Accession NP_722561.1). Accordingly, utilities of GAM25 include diagnosis, prevention and treatment of diseases and clinical conditions associated with RE2.

Rhesus blood group, d antigen (RHD, Accession NP_057208.2) is another GAM25 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:10248 and SEQ ID:10248 respectively, to the nucleotide sequence of GAM25 rNA, herein designated GAM RNA, also designated SEQ ID:206.

Another function of GAM25 is therefore inhibition of Rhesus blood group, d antigen (RHD, Accession NP_057208.2), a gene which Major antigen of the RH system. Accordingly, utilities of GAM25 include diagnosis, prevention and treatment of diseases and clinical conditions associated with RHD.

The function of RHD has been established by previous studies. Bennett et al. (1993) demonstrated that DNA testing can be used to determine RhD type in chorionic villus samples or amniotic cells. An RhD-negative woman whose partner is heterozygous may have preexisting anti-RhD antibodies that may or may not affect a subsequent fetus, depending on whether it is heterozygous. A safe method of determining fetal RhD type early in pregnancy would eliminate the risks to an RhD-negative fetus of fetal blood sampling or Ser. amniocenteses. Levine et al. (1941) showed that hemolytic disease of the fetus occurs in an RhD-positive fetus carried by an RhD-negative woman who has been immunized by transplacental passage of RhD-positive red cells during a previous pregnancy. When the father of the fetus being carried by a sensitized RhD- negative woman is heterozygous for RhD, as more than 50% of people are, half the fetuses will be RhD-negative and therefore require no treatment to avoid erythroblastosis fetalis. The others will be RhD-positive and require sophisticated investigative measures and treatments. Lo et al. (1998) described a noninvasive method of determining fetal RhD status by analyzing maternal plasma. Using a fluorescent- based PCR assay that was sensitive enough to detect the amount of RhD DNA found in a single cell, they determined the RhD status of singleton fetuses from 57 RhD- negative women whose partners were heterozygous for the RhD gene. This method correctly identified the RhD status of 10 of 12 fetuses whose mothers were in their first trimester of pregnancy, that of all 30 fetuses whose mothers were in their second trimester, and that of all 15 fetuses whose mothers were in their third trimester. The method they described was rapid, providing results within 1 day, and represented a major advance in RhD genotyping.

Full details of the abovementioned studies are described in the following publications, the disclosure of which are hereby incorporated by reference:

Bennett, P. R.; Le Van Kim, C.; Colin, Y.; Warwick, R. M.; Cherif-Zahar, B.; Fisk, N. M.; Cartron, J.-P.: Prenatal determination of fetal RhD type by DNA amplification. New Eng. J. Med. 329:607-610, 1993; and Lo, Y. M. D.; Hjelm, N. M.; Fidler, C.; Sargent, I. L.; Murphy, M. F.; Chamberlain, P. F.; Poon, P. M. K.; Redman, C. W. G.; Wainscoat, J. S.: Prenatal diagnosis of fetal RhD status by mol.

Further studies establishing the function and utilities of RHD are found in John Hopkins OMIM database record ID 111680, and in cited publications listed in Table 5, which are hereby incorporated by reference. Rhesus blood group, d antigen (RHD, Accession NP_057208.2) is another GAM25 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:19169 and SEQ ID:19169 respectively, to the nucleotide sequence of GAM25 rNA, herein designated GAM RNA, also designated SEQ ID:206.

Another function of GAM25 is therefore inhibition of Rhesus blood group, d antigen (RHD, Accession NP_057208.2), a gene which Major antigen of the RH system. Accordingly, utilities of GAM25 include diagnosis, prevention and treatment of diseases and clinical conditions associated with RHD.

The function of RHD has been established by previous studies. Bennett et al. (1993) demonstrated that DNA testing can be used to determine RhD type in chorionic villus samples or amniotic cells. An RhD-negative woman whose partner is heterozygous may have preexisting anti-RhD antibodies that may or may not affect a subsequent fetus, depending on whether it is heterozygous. A safe method of determining fetal RhD type early in pregnancy would eliminate the risks to an RhD-negative fetus of fetal blood sampling or Ser. amniocenteses. Levine et al. (1941) showed that hemolytic disease of the fetus occurs in an RhD-positive fetus carried by an RhD-negative woman who has been immunized by transplacental passage of RhD-positive red cells during a previous pregnancy. When the father of the fetus being carried by a sensitized RhD- negative woman is heterozygous for RhD, as more than 50% of people are, half the fetuses will be RhD-negative and therefore require no treatment to avoid erythroblastosis fetalis. The others will be RhD-positive and require sophisticated investigative measures and treatments. Lo et al. (1998) described a noninvasive method of determining fetal RhD status by analyzing maternal plasma. Using a fluorescent- based PCR assay that was sensitive enough to detect the amount of RhD DNA found in a single cell, they determined the RhD status of singleton fetuses from 57 RhD- negative women whose partners were heterozygous for the RhD gene. This method correctly identified the RhD status of 10 of 12 fetuses whose mothers were in their first trimester of pregnancy, that of all 30 fetuses whose mothers were in their second trimester, and that of all 15 fetuses whose mothers were in their third trimester. The method they described was rapid, providing results within 1 day, and represented a major advance in RhD genotyping.

Full details of the abovementioned studies are described in the following publications, the disclosure of which are hereby incorporated by reference:

Bennett, P. R.; Le Van Kim, C.; Colin, Y.; Warwick, R. M.; Cherif-Zahar, B.; Fisk, N. M.; Cartron, J.-P.: Prenatal determination of fetal RhD type by DNA amplification. New Eng. J. Med. 329:607-610, 1993; and Lo, Y. M. D.; Hjelm, N. M.; Fidler, C.; Sargent, I. L.; Murphy, M. F.; Chamberlain, P. F.; Poon, P. M. K.; Redman, C. W. G.; Wainscoat, J. S.: Prenatal diagnosis of fetal RhD status by mol.

Further studies establishing the function and utilities of RHD are found in John Hopkins OMIM database record ID 111680, and in cited publications listed in Table 5, which are hereby incorporated by reference. Retinitis pigmentosa 2 (x-linked recessive) (RP2, Accession NP_008846.1) is another GAM25 target gene, herein designated TARGET GENE. RP2 BINDING SITE is a target binding site found in the 3' untranslated region of mRNA encoded by RP2, corresponding to a target binding site such as BINDING SITE I, BINDING SITE II or BINDING SITE III of FIG. 8. Table 4 illustrates the complementarity of the nucleotide sequences of RP2 BINDING SITE, designated SEQ ID:9423, to the nucleotide sequence of GAM25 rNA, herein designated GAM RNA, also designated SEQ ID:206.

Another function of GAM25 is therefore inhibition of Retinitis pigmentosa 2 (x-linked recessive) (RP2, Accession NP_008846.1). Accordingly, utilities of GAM25 include diagnosis, prevention and treatment of diseases and clinical conditions associated with RP2.

SBLF (Accession NP_006864.2) is another GAM25 target gene, herein designated TARGET GENE. SBLF BINDING SITE is a target binding site found in the 3' untranslated region of mRNA encoded by SBLF, corresponding to a target binding site such as BINDING SITE I, BINDING SITE II or BINDING SITE III of FIG. 8. Table 4 illustrates the complementarity of the nucleotide sequences of SBLF BINDING SITE, designated SEQ ID:5568, to the nucleotide sequence of GAM25 rNA, herein designated GAM RNA, also designated SEQ ID:206.

Another function of GAM25 is therefore inhibition of SBLF (Accession NP_006864.2). Accordingly, utilities of GAM25 include diagnosis, prevention and treatment of diseases and clinical conditions associated with SBLF.

Sex comb on midleg-like 2 (drosophila) (SCML2, Accession NP_006080.1) is another GAM25 target gene, herein designated TARGET GENE. SCML2 BINDING SITE is a target binding site found in the 3' untranslated region of mRNA encoded by SCML2, corresponding to a target binding site such as BINDING SITE I, BINDING SITE II or BINDING SITE III of FIG. 8. Table 4 illustrates the complementarity of the nucleotide sequences of SCML2 BINDING SITE, designated SEQ ID:18167, to the nucleotide sequence of GAM25 rNA, herein designated GAM RNA, also designated SEQ ID:206.

Another function of GAM25 is therefore inhibition of Sex comb on midleg-like 2 (drosophila) (SCML2, Accession NP_006080.1). Accordingly, utilities of GAM25 include diagnosis, prevention and treatment of diseases and clinical conditions associated with SCML2.

SCN3B (Accession NP_060870.1) is another GAM25 target gene, herein designated TARGET GENE. SCN3B BINDING SITE1 and SCN3B BINDING SITE2 are target binding sites found in untranslated regions of mRNA encoded by SCN3B, corresponding to target binding sites such as BINDING SITE I, BINDING SITE II or BINDING SITE III of FIG. 8. Table 4 illustrates the complementarity of the nucleotide sequences of SCN3B BINDING SITE1 and SCN3B BINDING SITE2, designated SEQ ID:1161 and SEQ ID:6473 respectively, to the nucleotide sequence of GAM25 rNA, herein designated GAM RNA, also designated SEQ ID:206.

Another function of GAM25 is therefore inhibition of SCN3B (Accession NP_060870.1). Accordingly, utilities of GAM25 include diagnosis, prevention and treatment of diseases and clinical conditions associated with SCN3B.

SDS-RS1 (Accession NP_612441.1) is another GAM25 target gene, herein designated TARGET GENE. SDS-RS1 BINDING SITE is a target binding site found in the 5' untranslated region of mRNA encoded by SDS-RS1, corresponding to a target binding site such as BINDING SITE I, BINDING SITE II or BINDING SITE III of FIG. 8. Table 4 illustrates the complementarity of the nucleotide sequences of SDS-RS1 BINDING SITE, designated SEQ ID:3444, to the nucleotide sequence of GAM25 rNA, herein designated GAM RNA, also designated SEQ ID:206.

Another function of GAM25 is therefore inhibition of SDS-RS1 (Accession NP_612441.1). Accordingly, utilities of GAM25 include diagnosis, prevention and treatment of diseases and clinical conditions associated with SDS-RS1.

Spondyloepiphyseal dysplasia, late (SEDL, Accession NP_055378.1) is another GAM25 target gene, herein designated TARGET GENE. SEDL BINDING SITE1 and SEDL BINDING SITE2 are target binding sites found in untranslated regions of mRNA encoded by SEDL, corresponding to target binding sites such as BINDING SITE I, BINDING SITE II or BINDING SITE III of FIG. 8. Table 4 illustrates the complementarity of the nucleotide sequences of SEDL BINDING SITE1 and SEDL BINDING SITE2, designated SEQ ID:13505 and SEQ ID:18323 respectively, to the nucleotide sequence of GAM25 rNA, herein designated GAM RNA, also designated SEQ ID:206.

Another function of GAM25 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM25 include diagnosis, prevention and treatment of Spondyloepiphyseal dysplasia, and of other diseases and clinical conditions associated with SEDL.

The function of SEDL has been established by previous studies. Gedeon et al. (2001) reviewed the spectrum of mutations found in 30 of 36 unrelated cases of X-linked SEDL ascertained from different ethnic populations. It brought the total number of different disease-associated mutations to 21 and showed that they were distributed throughout the SEDL gene. Four recurrent mutations accounted for 13 of the 30 (43%). Haplotype analyses and the diverse ethnic origins of the patients supported recurrent mutations. Two patients with large deletions of SEDL exons were found, 1 with childhood onset of painful complications, the other relatively free of additional symptoms. Since no clear genotype/phenotype correlation could be established, they concluded that the complete unaltered SEDL gene product is essential for normal bone growth. Christie et al. (2001) characterized the SEDL mutations in 4 unrelated spondyloepiphyseal dysplasia tarda kindreds of European origin. They identified 2 nonsense and 2 intragenic deletional frameshift mutations. The nonsense mutations occurred in exons 4 and 6. Both of the intragenic deletions, which were approximately 750 and 1300 to 1445 bp in size, involved intron 5 and part of exon 6 and resulted in frameshifts that led to premature termination signals.

Full details of the abovementioned studies are described in the following publications, the disclosure of which are hereby incorporated by reference:

Christie, P. T.; Curley, A.; Nesbit, M. A.; Chapman, C.; Genet, S.; Harper, P. S.; Keeling, S. L.; Wilkie, A. O. M.; Winter, R. M.; Thakker, R. V.: Mutational analysis in X-linked spondyloepiphyseal dysplasia tarda. J. Clin. Endocr. Metab. 86:3233-3236, 2001; and Gedeon, A. K.; Tiller, G. E.; Le Merrer, M.; Heuertz, S.; Tranebjaerg, L.; Chitayat, D.; Robertson, S.; Glass, I. A.; Savarirayan, R.; Cole, W. G.; Rimoin, D. L.; Kousseff, B. G.; Ohas.

Further studies establishing the function and utilities of SEDL are found in John Hopkins OMIM database record ID 300202, and in cited publications listed in Table 5, which are hereby incorporated by reference. Selenoprotein n, 1 (SEPN1, Accession NP_065184.1) is another GAM25 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:19019, to the nucleotide sequence of GAM25 rNA, herein designated GAM RNA, also designated SEQ ID:206.

Another function of GAM25 is therefore inhibition of Selenoprotein n, 1 (SEPN1, Accession NP_065184.1). Accordingly, utilities of GAM25 include diagnosis, prevention and treatment of diseases and clinical conditions associated with SEPN1.

Small edrk-rich factor 1a (telomeric) (SERF1A, Accession NP_068802.1) is another GAM25 target gene, herein designated TARGET GENE. SERF1A BINDING SITE1 and SERF1A BINDING SITE2 are target binding sites found in untranslated regions of mRNA encoded by SERF1A, corresponding to target binding sites such as BINDING SITE I, BINDING SITE II or BINDING SITE III of FIG. 8. Table 4 illustrates the complementarity of the nucleotide sequences of SERF1A BINDING SITE1 and SERF1A BINDING SITE2, designated SEQ ID:13469 and SEQ ID:4475 respectively, to the nucleotide sequence of GAM25 rNA, herein designated GAM RNA, also designated SEQ ID:206.

Another function of GAM25 is therefore inhibition of Small edrk-rich factor 1a (telomeric) (SERF1A, Accession NP_068802.1). Accordingly, utilities of GAM25 include diagnosis, prevention and treatment of diseases and clinical conditions associated with SERF1A.

Small edrk-rich factor 1b (centromeric) (SERF1B, Accession NP_075267.1) is another GAM25 target gene, herein designated TARGET GENE. SERF1B BINDING SITE1 and SERF1B BINDING SITE2 are target binding sites found in untranslated regions of mRNA encoded by SERF1B, corresponding to target binding sites such as BINDING SITE I, BINDING SITE II or BINDING SITE III of FIG. 8. Table 4 illustrates the complementarity of the nucleotide sequences of SERF1B BINDING SITE1 and SERF1B BINDING SITE2, designated SEQ ID:13469 and SEQ ID:4475 respectively, to the nucleotide sequence of GAM25 rNA, herein designated GAM RNA, also designated SEQ ID:206.

Another function of GAM25 is therefore inhibition of Small edrk-rich factor 1b (centromeric) (SERF1B, Accession NP_075267.1). Accordingly, utilities of GAM25 include diagnosis, prevention and treatment of diseases and clinical conditions associated with SERF1B.

Serine (or cysteine) proteinase inhibitor, clade b (ovalbumin), member 9 (SERPINB9, Accession NP_004146.1) is another GAM25 target gene, herein designated TARGET GENE. SERPINB9 BINDING SITE1 and SERPINB9 BINDING SITE2 are target binding sites found in untranslated regions of mRNA encoded by SERPINB9, corresponding to target binding sites such as BINDING SITE I, BINDING SITE II or BINDING SITE III of FIG. 8. Table 4 illustrates the complementarity of the nucleotide sequences of SERPINB9 BINDING SITE1 and SERPINB9 BINDING SITE2, designated SEQ ID:5564 and SEQ ID:8945 respectively, to the nucleotide sequence of GAM25 RNA, herein designated GAM RNA, also designated SEQ ID:206.

Another function of GAM25 is therefore inhibition of Serine (or cysteine) proteinase inhibitor, clade b (ovalbumin), member 9 (SERPINB9, Accession NP_004146.1), a gene which may be a serpin serine protease inhibitor that interacts with granzyme B (GZMB). Accordingly, utilities of GAM25 include diagnosis, prevention and treatment of diseases and clinical conditions associated with SERPINB9.

The function of SERPINB9 has been established by previous studies. Serine proteinase inhibitors (serpins) are a large superfamily of proteins which bind to and inactivate serine proteinases. These interactions are involved in many cellular processes including coagulation, fibrinolysis, complement fixation, matrix remodeling, and apoptosis. Sprecher et al.

(1995) isolated PI8 (OMIM Ref. No. 601697) and PI9 cDNAs from a human placenta cDNA library. The authors found that PI9 encodes a 374-amino acid polypeptide with over 60% identity with PI6. Northern blot analysis by Sprecher et al. (1995) demonstrated that PI9 is expressed as 2 transcripts of 3.4 and 4.4 kb which were detected in greatest abundance in lung and placenta. In searching for serpins related to PI6, Sun et al. (1996) isolated and cloned PI9 from human bone marrow mRNA using a PCR cloning strategy. They confirmed that the sequence of PI9 is closely related to PI6 (OMIM Ref. No. 173321) and the viral serpin CrmA. Sun et al. (1996) showed that PI9 forms an SDS-resistant complex with granzyme B (OMIM Ref. No. 123910), suggesting that these 2 proteins may form a physiologically significant serpin-serine proteinase interaction. Sun et al. (1996) also observed that PI9 was expressed in immune tissue, including lymphocytes, natural killer cell leukemia cell lines, and peripheral blood mononuclear cells. Sun et al. (1996) used fractionation experiments to show that PI9 is localized to the cytosol, in a separate subcellular compartment from granzyme B. PI9 was identified as an endogenous inhibitor of caspase-1 (OMIM Ref. No. 147678). Krieg et al. (2001) reported that PI9 mRNA and protein are rapidly and directly induced by estrogen in human liver cells. Using transient transfections to assay PI9 promoter truncations and mutations, they showed that this strong estrogen induction is mediated by a unique downstream estrogen responsive unit (ERU) approximately 200 nucleotides downstream of the transcription start site. They also demonstrated estrogen-dependent binding of ER to the cellular PI9 promoter. The ERU consists of an imperfect estrogen response element (ERE) palindrome immediately adjacent to a direct repeat containing two consensus ERE half-sites separated by 13 nucleotides (DR13). In transient transfections, all 4 of the ERE half-sites in the imperfect ERE and in the DR13 were important for estrogen inducibility. They concluded that a direct repeat can function with an imperfect ERE palindrome to confer estrogen inducibility on a native gene, which extends the repertoire of DNA sequences able to function as EREs.

Full details of the abovementioned studies are described in the following publications, the disclosure of which are hereby incorporated by reference:

Sun, J.; Bird, C. H.; Sutton, V.; McDonald, L.; Coughlin, P. B.; De Jong, T. A.; Trapani, J. A.; Bird, P. I.: A cytosolic granzyme B inhibitor related to the viral apoptotic regulator cytokine response modifier A is present in cytotoxic lymphocytes. J. Biol. Chem. 271:27802-27809, 1996; and Krieg, S. A.; Krieg, A. J.; Shapiro, D. J.: A unique downstream estrogen responsive unit mediates estrogen induction of proteinase inhibitor-9, a cellular inhibitor of IL-1-beta-conver.

Further studies establishing the function and utilities of SERPINB9 are found in John Hopkins OMIM database record ID 601799, and in cited publications listed in Table 5, which are hereby incorporated by reference. Sh3-domain binding protein 4 (SH3BP4, Accession NP_055336.1) is another GAM25 target gene, herein designated TARGET GENE. SH3BP4 BINDING SITE is a target binding site found in the 3' untranslated region of mRNA encoded by SH3BP4, corresponding to a target binding site such as BINDING SITE I, BINDING SITE II or BINDING SITE III of FIG. 8. Table 4 illustrates the complementarity of the nucleotide sequences of SH3BP4 BINDING SITE, designated SEQ ID:5112, to the nucleotide sequence of GAM25 rNA, herein designated GAM RNA, also designated SEQ ID:206.

Another function of GAM25 is therefore inhibition of Sh3-domain binding protein 4 (SH3BP4, Accession NP_055336.1), a gene which is of unknown function, contains SH3-domain binding protein 4; similar to the EH-binding protein. Accordingly, utilities of GAM25 include diagnosis, prevention and treatment of diseases and clinical conditions associated with SH3BP4.

The function of SH3BP4 has been established by previous studies. A major element of the cornea is a transparent stroma produced and maintained by corneal fibroblasts, or keratocytes. Using differential display of RNA from normal and macular corneal dystrophy cultured keratocytes, followed by screening a corneal fibroblast library, Dunlevy et al. (1999) identified a cDNA encoding SH3BP4. The deduced 963-amino acid SH3BP4 protein contains 3 asn-pro-phe (NPF) motifs, which are EPS15 (OMIM Ref. No. 600051) homology (EH)-binding sites (see OMIM Ref. No. NUMB; 603728); an SH3 domain; a PXXP motif; a bipartite nuclear targeting signal; and a tyrosine phosphorylation site. Sequence analysis predicted that SH3BP4 is identical to a 479-amino acid EH-binding protein (Wong et al., 1995) except for the presence of an additional 73 N-terminal and 411 mid- to C-terminal residues in SH3BP4. Northern blot analysis revealed ubiquitous expression of a 5.6-kb transcript, with highest levels in pancreas, low levels in kidney, skeletal muscle, and liver, and lowest levels in lung and brain. Expression was also detected in cultured normal keratocytes. Using FISH, Dunlevy et al. (1999) mapped the SH3BP4 gene to 2q37.1-q37.2.

Full details of the abovementioned studies are described in the following publications, the disclosure of which are hereby incorporated by reference:

Dunlevy, J. R.; Berryhill, B. L.; Vergnes, J.-P.; SundarRaj, N.; Hassell, J. R.: Cloning, chromosomal localization, and characterization of cDNA from a novel gene, SH3BP4, expressed by human corneal fibroblasts. Genomics 62:519-524, 1999; and Wong, W. T.; Schumacher, C.; Salcini, A. E.; Romano, A.; Castagnino, P.; Pelicci, P. G.; DiFiore, P. P.: A protein-binding domain, EH, identified in the receptor tyrosine kinase substrat.

Further studies establishing the function and utilities of SH3BP4 are found in John Hopkins OMIM database record ID 605611, and in cited publications listed in Table 5, which are hereby incorporated by reference. Short stature homeobox (SHOX, Accession NP_006874.1) is another GAM25 target gene, herein designated TARGET GENE. SHOX BINDING SITE1 and SHOX BINDING SITE2 are target binding sites found in untranslated regions of multiple transcripts of mRNA encoded by SHOX, corresponding to target binding sites such as BINDING SITE I, BINDING SITE II or BINDING SITE III of FIG. 8. Table 4 illustrates the complementarity of the nucleotide sequences of SHOX BINDING SITE1 and SHOX BINDING SITE2, designated SEQ ID:6046 and SEQ ID:2929 respectively, to the nucleotide sequence of GAM25 rNA, herein designated GAM RNA, also designated SEQ ID:206.

Another function of GAM25 is therefore inhibition of Short stature homeobox (SHOX, Accession NP_006874.1). Accordingly, utilities of GAM25 include diagnosis, prevention and treatment of diseases and clinical conditions associated with SHOX.

Sialic acid binding ig-like lectin 11 (SIGLEC11, Accession NP_443116.1) is another GAM25 target gene, herein designated TARGET GENE. SIGLEC11 BINDING SITE is a target binding site found in the 3' untranslated region of mRNA encoded by SIGLEC11, corresponding to a target binding site such as BINDING SITE I, BINDING SITE II or BINDING SITE III of FIG. 8. Table 4 illustrates the complementarity of the nucleotide sequences of SIGLEC11 BINDING SITE, designated SEQ ID:17145, to the nucleotide sequence of GAM25 RNA, herein designated GAM RNA, also designated SEQ ID:206.

Another function of GAM25 is therefore inhibition of Sialic acid binding ig-like lectin 11 (SIGLEC11, Accession NP_443116.1). Accordingly, utilities of GAM25 include diagnosis, prevention and treatment of diseases and clinical conditions associated with SIGLEC11.

Tal1 (scl) interrupting locus (SIL, Accession NP_003026.1) is another GAM25 target gene, herein designated TARGET GENE. SIL BINDING SITE is a target binding site found in the 3' untranslated region of mRNA encoded by SIL, corresponding to a target binding site such as BINDING SITE I, BINDING SITE II or BINDING SITE III of FIG. 8. Table 4 illustrates the complementarity of the nucleotide sequences of SIL BINDING SITE, designated SEQ ID:15610, to the nucleotide sequence of GAM25 rNA, herein designated GAM RNA, also designated SEQ ID:206.

Another function of GAM25 is therefore inhibition of Tal1 (scl) interrupting locus (SIL, Accession NP_003026.1), a gene which may be required for axial development and left-right specification and therefore may be associated with Prominent midline neural tube defects, abnormal left-right development. Accordingly, utilities of GAM25 include diagnosis, prevention and treatment of Prominent midline neural tube defects, abnormal left-right development, and of other diseases and clinical conditions associated with SIL.

The function of SIL has been established by previous studies. Aplan et al. (1997) demonstrated that transgenic mice in which inappropriately expressed scl protein, driven by sil regulatory elements, developed aggressive T-cell malignancies in collaboration with a misexpressed LMO1 (OMIM Ref. No. 186921) protein, thus recapitulating the situation seen in a subset of human T-cell ALL. Aplan et al. (1997) also demonstrated that inappropriately expressed scl can interfere with the development of other tissues derived from mesoderm. Finally, Aplan et al. (1997) demonstrated that an scl construct lacking the scl transactivation domain collaborates with misexpressed LMO1, demonstrating that the scl transactivation domain is dispensable for oncogenesis, and supporting the hypothesis that the scl gene product exerts its oncogenic action through a dominant-negative mechanism.

Animal model experiments lend further support to the function of SIL. Izraeli et al. (1999) disrupted the Sil gene in mouse by homologous recombination. Heterozygotes were normal but mutant homozygotes died in utero after embryonic day 10.5. Between embryonic days 7.5 and 8.5, striking developmental anomalies appeared in Sil -/- embryos. In addition to reduced size and limited developmental progress compared to wildtype embryos, Sil mutants displayed prominent midline neural tube defects. These included delay or failure of neural tube closure and holoprosencephaly (OMIM Ref. No. 236100). In addition, left-right development was abnormal. In heterozygous and wildtype embryos, the embryonic heart tube always loops to the right, whereas in Sil mutants the direction of heart looping is randomized. Nodal (OMIM Ref. No. 601265), lefty-2 (OMIM Ref. No. 603037) and Pitx2 (OMIM Ref. No. 601542) are normally expressed only in the left lateral- plate mesoderm before heart looping, with continued expression of Pitx2 on the left side of the looping heart tube. In contrast, Sil mutants showed bilaterally symmetric expression of nodal and Pitx2 at all stages examined. For lefty-2, most Sil -/- embryos also showed bilaterally symmetric expression. However, a small number of mutants expressed lefty-2 only on the right. Expression of both Patched (OMIM Ref. No. 601309) and Gli1 (OMIM Ref. No. 165220) was greatly reduced in Sil -/- embryos. Shh (OMIM Ref. No. 600725) and Hnf3b (OMIM Ref. No. 600288) were expressed in the notochord of Sil mutants. However, the markedly reduced expression of their target genes indicated that Shh signaling in the midline may be blocked in Sil -/- embryos. Comparison with Shh mutant embryos, which have axial defects but normal cardiac looping, indicated that the consequences of abnormal midline development for left-right patterning depend on the time of onset, duration, and severity of disruption of the normal asymmetric patterns of expression of nodal, lefty-2, and Pitx2.

It is appreciated that the abovementioned animal model for SIL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aplan, P. D.; Jones, C. A.; Chervinsky, D. S.; Zhao, X.; Ellsworth, M.; Wu, C.; McGuire, E. A.; Gross, K. W.: An scl gene product lacking the transactivation domain induces bony abnormalities and cooperates with LMO1 to generate T-cell malignancies in transgenic mice. EMBO J. 16:2408-2419, 1997; and Izraeli, S.; Lowe, L. A.; Bertness, V. L.; Good, D. J.; Dorward, D. W.; Kirsch, I. R.; Kuehn, M. R.: The SIL gene is required for mouse embryonic axial development and left-right spec.

Further studies establishing the function and utilities of SIL are found in John Hopkins OMIM database record ID 181590, and in cited publications listed in Table 5, which are hereby incorporated by reference. Signal-regulatory protein beta 1 (SIRPB1, Accession NP_006056.1) is another GAM25 target gene, herein designated TARGET GENE. SIRPB1 BINDING SITE is a target binding site found in the 3' untranslated region of mRNA encoded by SIRPB1, corresponding to a target binding site such as BINDING SITE I, BINDING SITE II or BINDING SITE III of FIG. 8. Table 4 illustrates the complementarity of the nucleotide sequences of SIRPB1 BINDING SITE, designated SEQ ID:14288, to the nucleotide sequence of GAM25 rNA, herein designated GAM RNA, also designated SEQ ID:206.

Another function of GAM25 is therefore inhibition of Signal-regulatory protein beta 1 (SIRPB1, Accession NP_006056.1). Accordingly, utilities of GAM25 include diagnosis, prevention and treatment of diseases and clinical conditions associated with SIRPB1.

Solute carrier family 12 (potassium/chloride transporters), member 8 (SLC12A8, Accession NP_078904.1) is another GAM25 target gene, herein designated TARGET GENE. SLC12A8 BINDING SITE is a target binding site found in the 3' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:2145, to the nucleotide sequence of GAM25 rNA, herein designated GAM RNA, also designated SEQ ID:206.

Another function of GAM25 is therefore inhibition of Solute carrier family 12 (potassium/chloride transporters), member 8 (SLC12A8, Accession NP_078904.1). Accordingly, utilities of GAM25 include diagnosis, prevention and treatment of diseases and clinical conditions associated with SLC12A8.

Solute carrier family 15 (oligopeptide transporter), member 1 (SLC15A1, Accession NP_005064.1) is another GAM25 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:9045, to the nucleotide sequence of GAM25 rNA, herein designated GAM RNA, also designated SEQ ID:206.

Another function of GAM25 is therefore inhibition of Solute carrier family 15 (oligopeptide transporter), member 1 (SLC15A1, Accession NP_005064.1), a gene which is a H(+)-coupled peptide transporter. Accordingly, utilities of GAM25 include diagnosis, prevention and treatment of diseases and clinical conditions associated with SLC15A1.

The function of SLC15A1 has been established by previous studies. In mammalian small intestine, the proton-coupled peptide transporter is responsible for the absorption of small peptides arising from digestion of dietary proteins. Fei et al. (1994) isolated a cDNA clone encoding a hydrogen ion/peptide cotransporter from a rabbit intestinal cDNA library. Liang et al. (1995) screened a human intestinal cDNA library with a probe derived from the rabbit cotransporter cDNA and identified a cDNA which, when expressed in HeLa cells or in Xenopus laevis oocytes, induced proton-dependent peptide transport activity. The predicted protein consisted of 708 amino acids with 12 membrane-spanning domains and 2 putative sites for protein kinase C-dependent phosphorylation. The cDNA-induced transport process accepted dipeptides, tripeptides, and amino beta-lactam antibiotics as substrates, but could not transport free amino acids. The human cotransporter showed 81% identity and 92% similarity to the rabbit cotransporter, but showed only a weak homology to the proton-coupled peptide transport proteins present in bacteria and yeast. By analysis of somatic cell hybrids and by isotopic in situ hybridization, Liang et al. (1995) mapped the human gene to 13q33-q34. Adibi (1997) reviewed the biology and function of the human intestinal oligopeptide transporter, which he symbolized PEPT1. Studies indicated that it transports dipeptides and tripeptides but not free amino acids or peptides with more than 3 amino acid residues and that its driving force for uphill transport requires proton binding and presence of an inside-negative membrane potential. A membrane protein, HTP1, which appeared to be associated with the oligopeptide transporter, had also been cloned. Adibi (1997) pointed out the importance of the transporter in nutritional and pharmacologic therapies; for example, it has allowed the use of oligopeptides as a source of nitrogen for enteral feeding and the use of the oral route for delivery of peptidomimetic drugs such as beta-lactam antibiotics.

Full details of the abovementioned studies are described in the following publications, the disclosure of which are hereby incorporated by reference:

Liang, R.; Fei, Y.-J.; Prasad, P. D.; Ramamoorthy, S.; Han, H.; Yang-Feng, T. L.; Hediger, M. A.; Ganapathy, V.; Leibach, F. H.: Human intestinal H(+)/peptide cotransporter: cloning, functional expression, and chromosomal localization. J. Biol. Chem. 270:6456-6463, 1995; and Adibi, S. A.: The oligopeptide transporter (Pept-1) in human intestine: biology and function. Gastroenterology 113:332-340, 1997.

Further studies establishing the function and utilities of SLC15A1 are found in John Hopkins OMIM database record ID 600544, and in cited publications listed in Table 5, which are hereby incorporated by reference. Solute carrier family 16 (monocarboxylic acid transporters), member 4 (SLC16A4, Accession NP_004687.1) is another GAM25 target gene, herein designated TARGET GENE. SLC16A4 BINDING SITE is a target binding site found in the 3' untranslated region of mRNA encoded by SLC16A4, corresponding to a target binding site such as BINDING SITE I, BINDING SITE II or BINDING SITE III of FIG. 8. Table 4 illustrates the complementarity of the nucleotide sequences of SLC16A4 BINDING SITE, designated SEQ ID:9949, to the nucleotide sequence of GAM25 rNA, herein designated GAM RNA, also designated SEQ ID:206.

Another function of GAM25 is therefore inhibition of Solute carrier family 16 (monocarboxylic acid transporters), member 4 (SLC16A4, Accession NP_004687.1). Accordingly, utilities of GAM25 include diagnosis, prevention and treatment of diseases and clinical conditions associated with SLC16A4.

Solute carrier family 24 (sodium/potassium/calcium exchanger), member 1 (SLC24A1, Accession NP_004718.1) is another GAM25 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:4560, to the nucleotide sequence of GAM25 rNA, herein designated GAM RNA, also designated SEQ ID:206.

Another function of GAM25 is therefore inhibition of Solute carrier family 24 (sodium/potassium/calcium exchanger), member 1 (SLC24A1, Accession NP_004718.1), a gene which is a critical component of the visual transduction cascade, controlling the calcium concentration of outer segments during light and darkness. Accordingly, utilities of GAM25 include diagnosis, prevention and treatment of diseases and clinical conditions associated with SLC24A1.

The function of SLC24A1 has been established by previous studies. By screening a human retinal cDNA library using the entire bovine rod sodium/potassium/calcium (Na-Ca+K) exchanger cDNA as a probe, Tucker et al. (1998) cloned the human NCKX1 gene. Human NCKX1 codes for a protein of 1,081 amino acids that shows 64% overall identity with the bovine protein. The 2 sets of putative transmembrane domains and their short connecting loops showed 94% identity, while the extracellular loop at the amino terminus was only 59% identical. Tucker et al. (1998) determined the genomic structure of the NCKX1 gene and found 1 intron in the 5-prime untranslated region and 8 within the coding region. Exon length varies from 54 to 2,037 bp Using fluorescence in situ hybridization and analysis of a radiation hybrid panel, Tucker et al. (1998) mapped the NCKX1 gene to chromosome 15q22

Full details of the abovementioned studies are described in the following publications, the disclosure of which are hereby incorporated by reference:

Tucker, J. E.; Winkfein, R. J.; Cooper, C. B.; Schnetkamp, P. P.: cDNA cloning of the human retinal rod Na-Ca + K exchanger: comparison with a revised bovine sequence. Invest. Ophthal. Vis. Sci. 39:435-440, 1998; and Tucker, J. E.; Winkfein, R. J.; Murthy, S. K.; Friedman, J. S.; Walter, M. A.; Demetrick, D. J.; Schnetkamp, P. P. M.: Chromosomal localization and genomic organization of the human retina.

Further studies establishing the function and utilities of SLC24A1 are found in John Hopkins OMIM database record ID 603617, and in cited publications listed in Table 5, which are hereby incorporated by reference. Solute carrier family 2 (facilitated glucose transporter), member 10 (SLC2A10, Accession NP_110404.1) is another GAM25 target gene, herein designated TARGET GENE. SLC2A10 BINDING SITE is a target binding site found in the 3' untranslated region of mRNA encoded by SLC2A10, corresponding to a target binding site such as BINDING SITE I, BINDING SITE II or BINDING SITE III of FIG. 8. Table 4 illustrates the complementarity of the nucleotide sequences of SLC2A10 BINDING SITE, designated SEQ ID:8872, to the nucleotide sequence of GAM25 rNA, herein designated GAM RNA, also designated SEQ ID:206.

Another function of GAM25 is therefore inhibition of Solute carrier family 2 (facilitated glucose transporter), member 10 (SLC2A10, Accession NP_110404.1). Accordingly, utilities of GAM25 include diagnosis, prevention and treatment of diseases and clinical conditions associated with SLC2A10.

Solute carrier family 7 (cationic amino acid transporter, y+ system), member 6 (SLC7A6, Accession NP_003974.1) is another GAM25 target gene, herein designated TARGET GENE. SLC7A6 BINDING SITE is a target binding site found in the 5' untranslated region of mRNA encoded by SLC7A6, corresponding to a target binding site such as BINDING SITE I, BINDING SITE II or BINDING SITE III of FIG. 8. Table 4 illustrates the complementarity of the nucleotide sequences of SLC7A6 BINDING SITE, designated SEQ ID:6848, to the nucleotide sequence of GAM25 rNA, herein designated GAM RNA, also designated SEQ ID:206.

Another function of GAM25 is therefore inhibition of Solute carrier family 7 (cationic amino acid transporter, y+ system), member 6 (SLC7A6, Accession NP_003974.1), a gene which is involved in mediating amino acid transport. Accordingly, utilities of GAM25 include diagnosis, prevention and treatment of diseases and clinical conditions associated with SLC7A6.

The function of SLC7A6 has been established by previous studies. Using RT-PCR with degenerate primers to screen for amino acid transporters in opossum kidney, followed by searching EST databases, Torrents et al. (1998) obtained a cDNA encoding SLC7A6, which they called y(+)LAT2. SLC7A6 is identical to the KIAA0245 gene reported by Nagase et al. (1996). Sequence analysis predicted that SLC7A6 is a 515-amino acid, typical organic solute transporter protein with 12 transmembrane domains, 3 potential phosphorylation sites, and N- and C-terminal cytoplasmic segments. SLC7A6 shares 75% amino acid identity with the opossum sequence and y(+)LAT1 (SLC7A7; 603593). By RT-PCR analysis, Nagase et al. (1996) detected SLC7A6 expression in all tissues tested except liver; expression was weak in pancreas and highest in thymus.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996; and Torrents, D.; Estevez, R.; Pineda, M.; Fernandez, E.; Lloberas, J.; Shi, Y.-B.; Zorzano, A.; Palacin, M.: Identification and characterization of a membrane protein (y(+)L amino acid tr.

Further studies establishing the function and utilities of SLC7A6 are found in John Hopkins OMIM database record ID 605641, and in cited publications listed in Table 5, which are hereby incorporated by reference. Synaptosomal-associated protein, 23 kda (SNAP23, Accession NP_003816.2) is another GAM25 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:12860, to the nucleotide sequence of GAM25 rNA, herein designated GAM RNA, also designated SEQ ID:206.

Another function of GAM25 is therefore inhibition of Synaptosomal-associated protein, 23 kda (SNAP23, Accession NP_003816.2), a gene which is essential component of the high affinity receptor for the general membrane fusion machinery. Accordingly, utilities of GAM25 include diagnosis, prevention and treatment of diseases and clinical conditions associated with SNAP23.

The function of SNAP23 has been established by previous studies. Synaptosomal-associated proteins (SNAPs) are involved in the process of membrane fusion in intracellular vesicle traffic. By fluorescence in situ hybridization, Lazo et al. (2001) mapped the SNAP23 gene to chromosome 15q21-q22. Lazo et al. (2001) suggested that alterations in the SNAP23 gene may be involved in neurologic and other diseases with defects in vesicle-membrane fusion processes that map to 15q15-q21.

Full details of the abovementioned studies are described in the following publications, the disclosure of which are hereby incorporated by reference:

Lazo, P. A.; Nadal, M.; Ferrer, M.; Area, E.; Hernandez-torres, J.; Nabokina, S. M.; Mollinedo, F.; Estivill, X.: Genomic organization, chromosomal localization, alternative splicing, and isoforms of the human synaptosome-associated protein-23 gene implicated in vesicle-membrane fusion processes. Hum. Genet. 108:211-215, 2001; and Mollinedo, F.; Lazo, P. A.: Identification of two isoforms of the vesicle-membrane fusion protein SNAP-23 in human neutrophils and HL-60 cells. Biochem. Biophys. Res. Commun. 231:808.

Further studies establishing the function and utilities of SNAP23 are found in John Hopkins OMIM database record ID 602534, and in cited publications listed in Table 5, which are hereby incorporated by reference. Synaptosomal-associated protein, 23 kda (SNAP23, Accession NP_570710.1) is another GAM25 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:12860, to the nucleotide sequence of GAM25 rNA, herein designated GAM RNA, also designated SEQ ID:206.

Another function of GAM25 is therefore inhibition of Synaptosomal-associated protein, 23 kda (SNAP23, Accession NP_570710.1), a gene which is essential component of the high affinity receptor for the general membrane fusion machinery. Accordingly, utilities of GAM25 include diagnosis, prevention and treatment of diseases and clinical conditions associated with SNAP23.

The function of SNAP23 has been established by previous studies. Synaptosomal-associated proteins (SNAPs) are involved in the process of membrane fusion in intracellular vesicle traffic. By fluorescence in situ hybridization, Lazo et al. (2001) mapped the SNAP23 gene to chromosome 15q21-q22. Lazo et al. (2001) suggested that alterations in the SNAP23 gene may be involved in neurologic and other diseases with defects in vesicle-membrane fusion processes that map to 15q15-q21.

Full details of the abovementioned studies are described in the following publications, the disclosure of which are hereby incorporated by reference:

Lazo, P. A.; Nadal, M.; Ferrer, M.; Area, E.; Hernandez-torres, J.; Nabokina, S. M.; Mollinedo, F.; Estivill, X.: Genomic organization, chromosomal localization, alternative splicing, and isoforms of the human synaptosome-associated protein-23 gene implicated in vesicle-membrane fusion processes. Hum. Genet. 108:211-215, 2001; and Mollinedo, F.; Lazo, P. A.: Identification of two isoforms of the vesicle-membrane fusion protein SNAP-23 in human neutrophils and HL-60 cells. Biochem. Biophys. Res. Commun. 231:808.

Further studies establishing the function and utilities of SNAP23 are found in John Hopkins OMIM database record ID 602534, and in cited publications listed in Table 5, which are hereby incorporated by reference. SNARK (Accession NP_112214.1) is another GAM25 target gene, herein designated TARGET GENE. SNARK BINDING SITE is a target binding site found in the 3' untranslated region of mRNA encoded by SNARK, corresponding to a target binding site such as BINDING SITE I, BINDING SITE II or BINDING SITE III of FIG. 8. Table 4 illustrates the complementarity of the nucleotide sequences of SNARK BINDING SITE, designated SEQ ID:17183, to the nucleotide sequence of GAM25 rNA, herein designated GAM RNA, also designated SEQ ID:206.

Another function of GAM25 is therefore inhibition of SNARK (Accession NP_112214.1). Accordingly, utilities of GAM25 include diagnosis, prevention and treatment of diseases and clinical conditions associated with SNARK.

Sorting nexin 15 (SNX15, Accession NP_037438.2) is another GAM25 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:2251, to the nucleotide sequence of GAM25 rNA, herein designated GAM RNA, also designated SEQ ID:206.

Another function of GAM25 is therefore inhibition of Sorting nexin 15 (SNX15, Accession NP_037438.2). Accordingly, utilities of GAM25 include diagnosis, prevention and treatment of diseases and clinical conditions associated with SNX15.

Sorting nexin 15 (SNX15, Accession NP_680086.1) is another GAM25 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:2251, to the nucleotide sequence of GAM25 rNA, herein designated GAM RNA, also designated SEQ ID:206.

Another function of GAM25 is therefore inhibition of Sorting nexin 15(SNX15, Accession NP_680086.1). Accordingly, utilities of GAM25 include diagnosis, prevention and treatment of diseases and clinical conditions associated with SNX15.

SNX22 (Accession NP_079074.1) is another GAM25 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:1855, to the nucleotide sequence of GAM25 rNA, herein designated GAM RNA, also designated SEQ ID:206.

Another function of GAM25 is therefore inhibition of SNX22 (Accession NP_079074.1). Accordingly, utilities of GAM25 include diagnosis, prevention and treatment of diseases and clinical conditions associated with SNX22.

SNX27 (Accession NP_112180.4) is another GAM25 target gene, herein designated TARGET GENE. SNX27 BINDING SITE is a target binding site found in the 3' untranslated region of mRNA encoded by SNX27, corresponding to a target binding site such as BINDING SITE I, BINDING SITE II or BINDING SITE III of FIG. 8. Table 4 illustrates the complementarity of the nucleotide sequences of SNX27 BINDING SITE, designated SEQ ID:5280, to the nucleotide sequence of GAM25 rNA, herein designated GAM RNA, also designated SEQ ID:206.

Another function of GAM25 is therefore inhibition of SNX27 (Accession NP_112180.4). Accordingly, utilities of GAM25 include diagnosis, prevention and treatment of diseases and clinical conditions associated with SNX27.

SPCX (Accession NP_775260.1) is another GAM25 target gene, herein designated TARGET GENE. SPCX BINDING SITE is a target binding site found in the 5' untranslated region of mRNA encoded by SPCX, corresponding to a target binding site such as BINDING SITE I, BINDING SITE II or BINDING SITE III of FIG. 8. Table 4 illustrates the complementarity of the nucleotide sequences of SPCX BINDING SITE, designated SEQ ID:4224, to the nucleotide sequence of GAM25 rNA, herein designated GAM RNA, also designated SEQ ID:206.

Another function of GAM25 is therefore inhibition of SPCX (Accession NP_775260.1). Accordingly, utilities of GAM25 include diagnosis, prevention and treatment of diseases and clinical conditions associated with SPCX.

Speckle-type poz protein (SPOP, Accession NP_003554.1) is another GAM25 target gene, herein designated TARGET GENE. SPOP BINDING SITE is a target binding site found in the 5' untranslated region of mRNA encoded by SPOP, corresponding to a target binding site such as BINDING SITE I, BINDING SITE II or BINDING SITE III of FIG. 8. Table 4 illustrates the complementarity of the nucleotide sequences of SPOP BINDING SITE, designated SEQ ID:17186, to the nucleotide sequence of GAM25 rNA, herein designated GAM RNA, also designated SEQ ID:206.

Another function of GAM25 is therefore inhibition of Speckle-type poz protein (SPOP, Accession NP_003554.1). Accordingly, utilities of GAM25 include diagnosis, prevention and treatment of diseases and clinical conditions associated with SPOP.

Sarcalumenin (SRL, Accession XP_064152.3) is another GAM25 target gene, herein designated TARGET GENE. SRL BINDING SITE is a target binding site found in the 3' untranslated region of mRNA encoded by SRL, corresponding to a target binding site such as BINDING SITE I, BIND- ING SITE II or BINDING SITE III of FIG. 8. Table 4 illustrates the complementarity of the nucleotide sequences of SRL BINDING SITE, designated SEQ ID:5566, to the nucleotide sequence of GAM25 RNA, herein designated GAM RNA, also designated SEQ ID:206.

Another function of GAM25 is therefore inhibition of Sarcalumenin (SRL, Accession XP_064152.3). Accordingly, utilities of GAM25 include diagnosis, prevention and treatment of diseases and clinical conditions associated with SRL.

Synovial sarcoma translocation, chromosome 18 (SS18, Accession NP_005628.1) is another GAM25 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:13018, to the nucleotide sequence of GAM25 rNA, herein designated GAM RNA, also designated SEQ ID:206.

Another function of GAM25 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM25 include diagnosis, prevention and treatment of Human synovial sarcomas, and of other diseases and clinical conditions associated with SS18.

The function of SS18 has been established by previous studies. Human synovial sarcomas contain a recurrent and specific chromosomal translocation t(X;18)(p11.2;q11.2). By screening a synovial sarcoma cDNA library with a YAC spanning the X chromosome breakpoint, Clark et al. (1994) identified a hybrid transcript that contained 5-prime sequences mapping to chromosome 18 and 3-prime sequences mapping to the X chromosome (see OMIM Ref. No. SSX1; 312820). A probe from the chromosome 18 gene sequence, symbolized SS18, detected genomic rearrangements in 10 of 13 synovial sarcomas. The chromosome 18 gene was symbolized SYT by Clark et al. (1994), but that symbol had already been used for synaptotagmin (OMIM Ref. No. 185605). Sequencing of cDNA clones showed that the normal SS18 gene encodes a protein rich in glutamine, proline, and glycine, and that in synovial sarcoma, rearrangement of the SS18 gene results in the formation of a fusion protein. Both the chromosome 18 and the X chromosome components failed to exhibit significant homology to known gene sequences. The SYT protein appears to act as a transcriptional coactivator and the SSX proteins as corepressors. Thaete et al. (1999) investigated the functional domains of the proteins. The SYT protein was found to contain a novel conserved 54-amino acid domain at the N terminus of the protein (the SNH domain) that is found in proteins from a wide variety of species, and a C-terminal domain, rich in glutamine, proline, glycine, and tyrosine (the QPGY domain), which contains the transcriptional activator sequences. Deletion of the SNH domain resulted in a more active transcriptional activator, suggesting that this domain acts as an inhibitor of the activation domain. The C-terminal SSX domain present in the SYT-SSX translocation protein contributes a transcriptional repressor domain to the protein. Thus, the fusion protein has transcriptional activating and repressing domains. Thaete et al. (1999) demonstrated that the human homolog of the SNF2/Brahma protein BRM (SMARCA2; 600014) colocalizes with SYT and SYT-SSX in nuclear speckles, and also interacts with SYT and SYT-SSX proteins in vitro. They suggested that this interaction may provide an explanation of how the SYT protein activates gene transcription.

Full details of the abovementioned studies are described in the following publications, the disclosure of which are hereby incorporated by reference:

Clark, J.; Rocques, P. J.; Crew, A. J.; Gill, S.; Shipley, J.; Chan, A. M.-L.; Gusterson, B. A.; Cooper, C. S.: Identification of novel genes, SYT and SSX, involved in the t(X;18) (p11.2;q11.2) translocation found in human synovial sarcoma. Nature Genet. 7:502-508, 1994; and Thaete, C.; Brett, D.; Monaghan, P.; Whitehouse, S.; Rennie, G.; Rayner, E.; Cooper, C. S.; Goodwin, G.: Functional domains of the SYT and SYT-SSX synovial sarcoma translocation prote.

Further studies establishing the function and utilities of SS18 are found in John Hopkins OMIM database record ID 600192, and in cited publications listed in Table 5, which are hereby incorporated by reference. Stomatin (STOM, Accession NP_004090.3) is another GAM25 target gene, herein designated TARGET GENE. STOM BINDING SITE is a target binding site found in the 3' untranslated region of mRNA encoded by STOM, corresponding to a target binding site such as BINDING SITE I, BINDING SITE II or BINDING SITE III of FIG. 8. Table 4 illustrates the complementarity of the nucleotide sequences of STOM BINDING SITE, designated SEQ ID:12669, to the nucleotide sequence of GAM25 rNA, herein designated GAM RNA, also designated SEQ ID:206.

Another function of GAM25 is therefore inhibition of Stomatin (STOM, Accession NP_004090.3). Accordingly, utilities of GAM25 include diagnosis, prevention and treatment of diseases and clinical conditions associated with STOM.

Synaptotagmin xiii (SYT13, Accession NP_065877.1) is another GAM25 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:14302, to the nucleotide sequence of GAM25 rNA, herein designated GAM RNA, also designated SEQ ID:206.

Another function of GAM25 is therefore inhibition of Synaptotagmin xiii (SYT13, Accession NP_065877.1). Accordingly, utilities of GAM25 include diagnosis, prevention and treatment of diseases and clinical conditions associated with SYT13.

Taf11 rna polymerase ii, tata box binding protein (tbp)-associated factor, 28 kda (TAF11, Accession NP_005634.1) is another GAM25 target gene, herein designated TARGET GENE. TAF11 BINDING SITE is a target binding site found in the 3' untranslated region of mRNA encoded by TAF11, corresponding to a target binding site such as BINDING SITE I, BINDING SITE II or BINDING SITE III of FIG. 8. Table 4 illustrates the complementarity of the nucleotide sequences of TAF11 BINDING SITE, designated SEQ ID:11091, to the nucleotide sequence of GAM25 rNA, herein designated GAM RNA, also designated SEQ ID:206.

Another function of GAM25 is therefore inhibition of Taf11 rna polymerase ii, tata box binding protein (tbp)-associated factor, 28 kda (TAF11, Accession NP_005634.1), a gene which plays a central role in mediating promoter responses to various activators and repressors. Accordingly, utilities of GAM25 include diagnosis, prevention and treatment of diseases and clinical conditions associated with TAF11.

The function of TAF11 has been established by previous studies. Mengus et al. (1995) immunopurified TFIID, separated the components by SDS-PAGE and transferred the bands to PVDF membrane for tryptic digestion, purified the resulting TAF peptides by reverse phase chromatography and subsequently obtained partial peptide sequence data. Degenerate oligomers of TAF2I (also referred to as TAFII28) were then used to screen a HeLa cell cDNA library. The TAFII28 cDNA encodes a 211-amino acid protein containing the expected tryptic peptides. It is about 50% identical to the Drosophila TAFII30-beta protein. The authors demonstrated that different domains of TAFII28 interact with TAFII18 (TAF2K; 600774) and TBP. Birck et al. (1998) determined the crystal structure of the human TBP-associated factor TAFII28/TAFII18 heterodimer and showed that these TAFIIs form a novel histone-like pair in the TFIID complex. The histone folds in TAFII28 and TAFII18 were not predicted from their primary sequence, indicating that these TAFIIs define a novel family of atypical histone fold sequences.

Full details of the abovementioned studies are described in the following publications, the disclosure of which are hereby incorporated by reference:

Birck, C.; Poch, O.; Romier, C.; Ruff, M.; Mengus, G.; Lavigne, A.-C.; Davidson, I.; Moras, D.: Human TAFII28 and TAFII18 interact through a histone fold encoded by atypical evolutionary conserved motifs also found in the SPT3 family. Cell 94:239-249, 1998; and Mengus, G.; May, M.; Jacq, X.; Staub, A.; Tora, L.; Chambon, P.; Davidson, I.: Cloning and characterization of hTAFII18, hTAFII20 and hTAFII28: three subunits of the human transcriptio.

Further studies establishing the function and utilities of TAF11 are found in John Hopkins OMIM database record ID 600772, and in cited publications listed in Table 5, which are hereby incorporated by reference. Tap binding protein (tapasin) (TAPBP, Accession NP_003181.3) is another GAM25 target gene, herein designated TARGET GENE. TAPBP BINDING SITE is a target binding site found in the 3' untranslated region of multiple transcripts of mRNA encoded by TAPBP, corresponding to a target binding site such as BINDING SITE I, BINDING SITE II or BINDING SITE III of FIG. 8. Table 4 illustrates the complementarity of the nucleotide sequences of TAPBP BINDING SITE, designated SEQ ID:14128, to the nucleotide sequence of GAM25 rNA, herein designated GAM RNA, also designated SEQ ID:206.

Another function of GAM25 is therefore inhibition of Tap binding protein (tapasin) (TAPBP, Accession NP_003181.3), a gene which is involved in MHC class I-restricted antigen processing. Accordingly, utilities of GAM25 include diagnosis, prevention and treatment of diseases and clinical conditions associated with TAPBP.

The function of TAPBP has been established by previous studies. Newly assembled major histocompatibility complex (MHC) class I molecules (see OMIM Ref. No. 142800), together with the endoplasmic reticulum (ER) chaperone calreticulin (OMIM Ref. No. 109091), interact with the transporter associated with antigen processing (TAP1; 170260) through a molecule called tapasin (Sadasivan et al., 1996). By molecular cloning of tapasin, Ortmann et al. (1997) found it to be a type I transmembrane glycoprotein encoded by an MHC-linked gene. The mature protein has 428 amino acids with a single N-linked glycosylation site at position 233. It is a member of the immunoglobulin superfamily with a probable cytoplasmic ER retention signal. Up to 4 MHC class I/tapasin complexes were found to bind to each TAP molecule in Daudi and L001 cells. Expression of tapasin in a negative mutant human cell line restored class I/TAP association and normal class I cell surface expression. Tapasin expression also corrected the defective recognition of virus- infected cells of the same line by class I-restricted cytotoxic T cells, thus establishing a critical functional role for tapasin in MHC class I-restricted antigen processing. Herberg et al. (1998) identified an EST encoding the mouse tapasin homolog. Mayer and Klein (2001) proposed that tapasin is in reality an MHC class I molecule with a different function from that currently executed by conventional class I molecules. They based this proposal on the amino acid sequence similarity between tapasin and conventional class I molecules, on similarity of predicted tertiary structure and domain organization of the molecules, on similarity of exon/intron organization of the encoding genes, and on the mapping of the class IA and tapasin genes into the same chromosomal region in all jawed vertebrates that had been tested to that time (Michalova et al., 2000).

Full details of the abovementioned studies are described in the following publications, the disclosure of which are hereby incorporated by reference:

Mayer, W. E.; Klein, J.: Is tapasin a modified Mhc class I molecule? Immunogenetics 53:719-723, 2001; and Ortmann, B.; Copeman, J.; Lehner, P. J.; Sadasivan, B.; Herberg, J. A.; Grandea, A. G.; Riddell, S. R.; Tampe, R.; Spies, T.; Trowsdale, J.; Cresswell, P.: A critical role for tapasin.

Further studies establishing the function and utilities of TAPBP are found in John Hopkins OMIM database record ID 601962, and in cited publications listed in Table 5, which are hereby incorporated by reference. Tyrosine aminotransferase (TAT, Accession NP_000344.1) is another GAM25 target gene, herein designated TARGET GENE. TAT BINDING SITE is a target binding site found in the 3' untranslated region of mRNA encoded by TAT, corresponding to a target binding site such as BINDING SITE I, BINDING SITE II or BINDING SITE III of FIG. 8. Table 4 illustrates the complementarity of the nucleotide sequences of TAT BINDING SITE, designated SEQ ID:14386, to the nucleotide sequence of GAM25 rNA, herein designated GAM RNA, also designated SEQ ID:206.

Another function of GAM25 is therefore inhibition of Tyrosine aminotransferase (TAT, Accession NP_000344.1), a gene which is tyrosine aminotransferase and strongly similar to rat Rn.9947, which plays a role in gluconeogenesis. Accordingly, utilities of GAM25 include diagnosis, prevention and treatment of diseases and clinical conditions associated with TAT.

The function of TAT has been established by previous studies. Richner (1938) and Hanhart (1947) described an oculocutaneous syndrome characterized by herpetiform corneal ulcers and painful punctate keratoses of digits, palms, and soles. Richner (1938) described skin lesions in brother and sister. Only the brother had corneal lesions. Hanhart (1947) reported that the parents of his patient were second cousins. Hanhart (1947) also described associated severe mental and somatic retardation. The pedigree he reported was reproduced by Waardenburg et al. (1961). Waardenburg et al. (1961) described children of a first-cousin marriage, one with the full syndrome and one with only corneal changes. Ventura et al. (1965) described the syndrome in 2 sons of first-cousin parents. Buist (1967) referred to studies of a child with tyrosinemia and tyrosine transaminase deficiency, but normal p-hydroxyphenylpyruvic acid oxidase. Phenylalanine level was normal. Hydroxyphenylpyruvic acid was elevated in the urine. Fellman et al. (1969) reported chemical studies on the same patient. Only the mitochondrial form of tyrosine aminotransferase (TAT) was present in the liver. The soluble form of TAT (EC 2.6.1.5) was lacking. The patient had markedly elevated tyrosine blood levels and an increase in urinary p-hydroxyphenylpyruvate and p-hydroxyphenyllactate. A regulator gene for tyrosine transaminase is X-linked (OMIM Ref. No. 314350). Goldsmith et al. (1973) demonstrated tyrosinemia and phenylaceticacidemia in this disorder. Their patient was the 14-year-old son of consanguineous Italian parents. The urine contained excessive P-hydroxyphenylactic acid. Urinary P-hydroxyphenylpyruvic acid was normal. Clinical and biochemical improvement accompanied low phenylalanine-low tyrosine diet. They suggested that soluble TAT may be deficient. Mitochondrial tyrosine transaminase is normal. Beinfang et al. (1976) described the ophthalmologic findings in the patient reported by Goldsmith et al. (1973). This condition is also known as tyrosinemia with palmar and plantar keratosis and keratitis. Garibaldi et al. (1977) observed this disorder, which they called oculocutaneous tyrosinosis, in a 42-month-old girl and her maternal aunt. The parents of the maternal aunt were first cousins. They emphasized the importance of early diagnosis in order to prevent mental retardation by means of a diet restricted in phenylalanine and tyrosine. Hunziker (1980) reported brother and sister with unusually late onset (about age 15). Their patients' skin lesions were improved with a diet restricted in phenylalanine and tyrosine. In a consanguineous sibship, Rehak et al. (1981) reported 4 cases of Richner-Hanhart syndrome. Cutaneous manifestations were typical but the eyes were not involved, suggesting heterogeneity in this disorder. Bohnert and Anton-Lamprecht (1982) reported unique ultrastructural changes: thickening of the granular layer and increased synthesis of tonofibrils and keratohyalin; in the ridged palmar or plantar skin, large numbers of microtubules and unusually tight packing of tonofibrillar masses, which contained tubular channels or inclusions of microtubules. The authors assumed that increased cohesion and tight packing of tonofilaments prevent normal spreading of keratohyalin and result in its globular appearance. Further, they suggested that excessive amounts of intracellular tyrosine enhance crosslinks between aggregated tonofilaments. In an Ashkenazi Jewish family, Chitayat et al. (1992) observed 2 adult sibs, offspring of a first-cousin marriage, with persistent hypertyrosinemia. A curious feature was that the affected female sib, aged 41 years, had hypertyrosinemia and characteristic oculocutaneous signs; the brother, aged 39 years, had hypertyrosinemia but no oculocutaneous disease. Both sibs had 2 children; none had signs of metabolic fetopathy.

Full details of the abovementioned studies are described in the following publications, the disclosure of which are hereby incorporated by reference:

Goldsmith, L. A.; Kang, E. S.; Bienfang, D. C.; Jimbow, K.; Gerald, P. S.; Baden, H. P.: Tyrosinemia with plantar and palmar keratosis and keratitis. J. Pediat. 83:798-805, 1973; and Hunziker, N.: Richner-Hanhart syndrome and tyrosinemia type II. Dermatologica 160:180-189, 1980.

Further studies establishing the function and utilities of TAT are found in John Hopkins OMIM database record ID 276600, and in cited publications listed in Table 5, which are hereby incorporated by reference. T-cell leukemia/lymphoma 6 (TCL6, Accession NP_055233.1) is another GAM25 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17146, to the nucleotide sequence of GAM25 rNA, herein designated GAM RNA, also designated SEQ ID:206.

Another function of GAM25 is therefore inhibition of T-cell leukemia/lymphoma 6 (TCL6, Accession NP_055233.1). Accordingly, utilities of GAM25 include diagnosis, prevention and treatment of diseases and clinical conditions associated with TCL6.

T-cell leukemia/lymphoma 6 (TCL6, Accession NP_065577.2) is another GAM25 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17146, to the nucleotide sequence of GAM25 rNA, herein designated GAM RNA, also designated SEQ ID:206.

Another function of GAM25 is therefore inhibition of T-cell leukemia/lymphoma 6 (TCL6, Accession NP_065577.2). Accordingly, utilities of GAM25 include diagnosis, prevention and treatment of diseases and clinical conditions associated with TCL6.

T-cell leukemia/lymphoma 6 (TCL6, Accession NP_036600.2) is another GAM25 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17146, to the nucleotide sequence of GAM25 rNA, herein designated GAM RNA, also designated SEQ ID:206.

Another function of GAM25 is therefore inhibition of T-cell leukemia/lymphoma 6 (TCL6, Accession NP_036600.2). Accordingly, utilities of GAM25 include diagnosis, prevention and treatment of diseases and clinical conditions associated with TCL6.

T-cell leukemia/lymphoma 6 (TCL6, Accession NP_065575.1) is another GAM25 gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17146, to the nucleotide sequence of GAM25 rNA, herein designated GAM RNA, also designated SEQ ID:206.

Another function of GAM25 is therefore inhibition of T-cell leukemia/lymphoma 6 (TCL6, Accession NP_065575.1). Accordingly, utilities of GAM25 include diagnosis, prevention and treatment of diseases and clinical conditions associated with TCL6.

TIM50L (Accession XP_053074.2) is another GAM25 target gene, herein designated TARGET GENE. TIM50L BINDING SITE is a target binding site found in the 3' untranslated region of mRNA encoded by TIM50L, corresponding to a target binding site such as BINDING SITE I, BINDING SITE II or BINDING SITE III of FIG. 8. Table 4 illustrates the complementarity of the nucleotide sequences of TIM50L BINDING SITE, designated SEQ ID:20014, to the nucleotide sequence of GAM25 rNA, herein designated GAM RNA, also designated SEQ ID:206.

Another function of GAM25 is therefore inhibition of TIM50L (Accession XP_053074.2). Accordingly, utilities of GAM25 include diagnosis, prevention and treatment of diseases and clinical conditions associated with TIM50L.

Toll-like receptor 5 (TLR5, Accession NP_003259.2) is another GAM25 target gene, herein designated TARGET GENE. TLR5 BINDING SITE is a target binding site found in the 5' untranslated region of mRNA encoded by TLR5, corresponding to a target binding site such as BINDING SITE I, BINDING SITE II or BINDING SITE III of FIG. 8. Table 4 illustrates the complementarity of the nucleotide sequences of TLR5 BINDING SITE, designated SEQ ID:5535, to the nucleotide sequence of GAM25 rNA, herein designated GAM RNA, also designated SEQ ID:206.

Another function of GAM25 is therefore inhibition of Toll-like receptor 5 (TLR5, Accession NP_003259.2), a gene which participates in the innate immune response to bacterial flagellins. Accordingly, utilities of GAM25 include diagnosis, prevention and treatment of diseases and clinical conditions associated with TLR5.

The function of TLR5 has been established by previous studies. By searching an EST database for human Toll homologs, Chaudhary et al. (1998) identified cDNA sequences from 2 genes that they called TIL3 and TIL4 (TLR2; 603028). Muzio et al. (2000) determined the differential expression pattern of the TLRs in leukocytes. Like TLR2 and TLR4, TLR5 was expressed in myelomonocytic cells, but at lower levels. Hayashi et al. (2001) showed that expression of TLR5 induces NF-kappa-B activation and TNFA (OMIM Ref. No. 191160) production. Pathogen-associated molecular patterns (PAMPs) known to stimulate other TLR family members failed to stimulate TLR5; however, luciferase reporter assays indicated TLR5 activation in gram-positive and -negative bacterial culture supernatants. By fractionation of Listeria culture supernatants followed by SDS-PAGE, Hayashi et al. (2001) identified flagellin as the TLR5 ligand. Flagellin, a principal component of bacterial flagella, is a virulence factor recognized by the innate immune system in plants, insects, and mammals. Expression of flagellin in nonflagellated bacteria resulted in TLR5 activation, and deletion of flagellin from flagellated bacteria abrogated TLR5 activation. Hayashi et al. (2001) demonstrated that injection of flagellin induces the production of IL6 (OMIM Ref. No. 147620) in wildtype mice, but not in those lacking the MyD88 (OMIM Ref. No. 602170) adaptor protein, required for TLR signaling. Hayashi et al. (2001) concluded that TLR5 is a pattern-recognition receptor and that its PAMP is flagellin, a protein with conserved N and C termini in a broad group of motile pathogens.

Full details of the abovementioned studies are described in the following publications, the disclosure of which are hereby incorporated by reference:

Chaudhary, P. M.; Ferguson, C.; Nguyen, V.; Nguyen, O.; Massa, H. F.; Eby, M.; Jasmin, A.; Trask, B. J.; Hood, L.; Nelson, P. S.: Cloning and characterization of two Toll/interleukin-1 receptor-like genes TIL3 and TIL4: evidence for a multi-gene receptor family in humans. Blood 91:4020-4027, 1998; and Hayashi, F.; Smith, K. D.; Ozinsky, A.; Hawn, T. R.; y, E. C.; Goodlett, D. R.; Eng, J. K.; Akira, S.; Underhill, D. M.; Aderem, A.: The innate immune response to bacterial flagellin.

Further studies establishing the function and utilities of TLR5 are found in John Hopkins OMIM database record ID 603031, and in cited publications listed in Table 5, which are hereby incorporated by reference. Transmembrane protease, serine 3 (TMPRSS3, Accession NP_076927.1) is another GAM25 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:2655, to the nucleotide sequence of GAM25 rNA, herein designated GAM RNA, also designated SEQ ID:206.

Another function of GAM25 is therefore inhibition of Transmembrane protease, serine 3 (TMPRSS3, Accession NP_076927.1). Accordingly, utilities of GAM25 include diagnosis, prevention and treatment of diseases and clinical conditions associated with TMPRSS3.

Transmembrane protease, serine 3 (TMPRSS3, Accession NP_115780.1) is another GAM25 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:2655, to the nucleotide sequence of GAM25 rNA, herein designated GAM RNA, also designated SEQ ID:206.

Another function of GAM25 is therefore inhibition of Transmembrane protease, serine 3 (TMPRSS3, Accession NP_115780.1). Accordingly, utilities of GAM25 include diagnosis, prevention and treatment of diseases and clinical conditions associated with TMPRSS3.

Transmembrane protease, serine 3 (TMPRSS3, Accession NP_115777.1) is another GAM25 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:2655, to the nucleotide sequence of GAM25 rNA, herein designated GAM RNA, also designated SEQ ID:206.

Another function of GAM25 is therefore inhibition of Transmembrane protease, serine 3 (TMPRSS3, Accession NP_115777.1). Accordingly, utilities of GAM25 include diagnosis, prevention and treatment of diseases and clinical conditions associated with TMPRSS3.

Tumor necrosis factor receptor superfamily, member 10b (TNFRSF10B, Accession NP_003833.3) is another GAM25 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:5563, to the nucleotide sequence of GAM25 rNA, herein designated GAM RNA, also designated SEQ ID:206.

Another function of GAM25 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM25 include diagnosis, prevention and treatment of Squamous cell carcinoma, and of other diseases and clinical conditions associated with TNFRSF10B.

The function of TNFRSF10B has been established by previous studies. The 8p21 region contains a number of putative tumor suppressor genes and is a frequent site of translocations in head and neck tumors. Pai et al. (1998) determined the genomic structure of KILLER/DR5 and performed sequence analysis of all 10 coding exons in 20 primary head and neck cancers with allelic loss of 8p. To screen for a subset of mutations localized to the functional cytoplasmic death domain, they sequenced this region in an additional 40 primary head and neck cancers. They found 2 alterations, including a 2-bp insertion at a minimal repeat site, introducing a premature stop codon and resulting in a truncated protein. This KILLER/DR5 mutation was also present in the germline of the affected patient, and the tumor did not have a p53 mutation by sequence analysis. Transfection studies in head and neck squamous cell carcinoma and colon and ovarian carcinoma cell lines revealed loss of growth suppressive function associated with the tumor-derived KILLER/DR5 truncation mutant. These observations provided the first evidence for mutation of a TRAIL death receptor gene in a human cancer, leading to loss of its apoptotic function. The second alteration identified by Pai et al. (1998) was a single T - to - C point mutation at residue 1109 that resulted in an amino acid change from val to ala. This mutation was not present in the germline; however, sequence analysis of p53 in this tumor revealed a point mutation of T to C in codon 242, resulting in a change from arg to cys. In a case of a head and neck squamous cell carcinoma (OMIM Ref. No. 601400), Pai et al. (1998) found a 2-bp insertion in the TNFRSF10B gene at a minimal repeat site (ACAC) at residue 1065, which introduced a premature stop codon and resulted in a truncated protein. Sequence analysis of normal tissue from the patient showed that the truncating mutation was also present in the germline, and that the tumor did not have a p53 mutation. A significant impairment in the ability of the truncation mutant to suppress colony formation was observed when mutant cDNA was transfected into human colon and ovarian cancer cell lines. In the wildtype transfected cells, there was no observed colony survival; however, there was more than 50% colony growth in cells transfected with the tumor-derived mutant. Pai et al. (1998) suspected that the mutant retained partial function, because its overexpression in a background of cells containing the endogenous wildtype gene could further reduce the percentage of colony survival.

Full details of the abovementioned studies are described in the following publications, the disclosure of which are hereby incorporated by reference:

Pai, S. I.; Wu, G. S.; Ozoren, N.; Wu, L.; Jen, J.; Sidransky, D.; El-Deiry, W. S.: Rare loss-of-function mutation of a death receptor gene in head and neck cancer. Cancer Res. 58:3513-3518, 1998; and Screaton, G. R.; Mongkolsapay, J.; Xu, X.-N.; Cowper, A. E.; McMichael, A. J.; Bell, J. I.: TRICK2, a new alternatively spliced receptor that transduces the cytotoxic signal from TRAIL.

Further studies establishing the function and utilities of TNFRSF10B are found in John Hopkins OMIM database record ID 603612, and in cited publications listed in Table 5, which are hereby incorporated by reference. Tumor necrosis factor receptor superfamily, member 10b (TNFRSF10B, Accession NP_671716.1) is another GAM25 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:5563, to the nucleotide sequence of GAM25 rNA, herein designated GAM RNA, also designated SEQ ID:206.

Another function of GAM25 is therefore inhibition of Tumor necrosis factor receptor superfamily, member 10b (TNFRSF10B, Accession NP_671716.1), a gene which forms complex that induces apoptosis. and therefore may be associated with Squamous cell carcinoma. Accordingly, utilities of GAM25 include diagnosis, prevention and treatment of Squamous cell carcinoma, and of other diseases and clinical conditions associated with TNFRSF10B.

The function of TNFRSF10B has been established by previous studies. The 8p21 region contains a number of putative tumor suppressor genes and is a frequent site of translocations in head and neck tumors. Pai et al. (1998) determined the genomic structure of KILLER/DR5 and performed sequence analysis of all 10 coding exons in 20 primary head and neck cancers with allelic loss of 8p. To screen for a subset of mutations localized to the functional cytoplasmic death domain, they sequenced this region in an additional 40 primary head and neck cancers. They found 2 alterations, including a 2-bp insertion at a minimal repeat site, introducing a premature stop codon and resulting in a truncated protein. This KILLER/DR5 mutation was also present in the germline of the affected patient, and the tumor did not have a p53 mutation by sequence analysis. Transfection studies in head and neck squamous cell carcinoma and colon and ovarian carcinoma cell lines revealed loss of growth suppressive function associated with the tumor-derived KILLER/DR5 truncation mutant. These observations provided the first evidence for mutation of a TRAIL death receptor gene in a human cancer, leading to loss of its apoptotic function. The second alteration identified by Pai et al. (1998) was a single T- to - C point mutation at residue 1109 that resulted in an amino acid change from val to ala. This mutation was not present in the germline; however, sequence analysis of p53 in this tumor revealed a point mutation of T to C in codon 242, resulting in a change from arg to cys. In a case of a head and neck squamous cell carcinoma (OMIM Ref. No. 601400), Pai et al. (1998) found a 2-bp insertion in the TNFRSF10B gene at a minimal repeat site (ACAC) at residue 1065, which introduced a premature stop codon and resulted in a truncated protein. Sequence analysis of normal tissue from the patient showed that the truncating mutation was also present in the germline, and that the tumor did not have a p53 mutation. A significant impairment in the ability of the truncation mutant to suppress colony formation was observed when mutant cDNA was transfected into human colon and ovarian cancer cell lines. In the wildtype transfected cells, there was no observed colony survival; however, there was more than 50% colony growth in cells transfected with the tumor-derived mutant. Pai et al. (1998) suspected that the mutant retained partial function, because its overexpression in a background of cells containing the endogenous wildtype gene could further reduce the percentage of colony survival.

Full details of the abovementioned studies are described in the following publications, the disclosure of which are hereby incorporated by reference:

Pai, S. I.; Wu, G. S.; Ozoren, N.; Wu, L.; Jen, J.; Sidransky, D.; El-Deiry, W. S. : Rare loss-of-function mutation of a death receptor gene in head and neck cancer. Cancer Res. 58:3513-3518, 1998; and Screaton, G. R.; Mongkolsapay, J.; Xu, X.-N.; Cowper, A. E.; McMichael, A. J.; Bell, J. I.: TRICK2, a new alternatively spliced receptor that transduces the cytotoxic signal from TRAIL.

Further studies establishing the function and utilities of TNFRSF10B are found in John Hopkins OMIM database record ID 603612, and in cited publications listed in Table 5, which are hereby incorporated by reference. Tumor necrosis factor receptor superfamily, member 11a, activator of nfkb (TNFRSF11A, Accession NP_003830.1) is another GAM25 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:9317, to the nucleotide sequence of GAM25 RNA, herein designated GAM RNA, also designated SEQ ID:206.

Another function of GAM25 is therefore inhibition of Tumor necrosis factor receptor superfamily, member 11a, activator of nfkb (TNFRSF11A, Accession NP_003830.1). Accordingly, utilities of GAM25 include diagnosis, prevention and treatment of diseases and clinical conditions associated with TNFRSF11A.

TPH2 (Accession NP_775489.1) is another GAM25 target gene, herein designated TARGET GENE. TPH2 BINDING SITE is a target binding site found in the 3' untranslated region of mRNA encoded by TPH2, corresponding to a target binding site such as BINDING SITE I, BINDING SITE II or BINDING SITE III of FIG. 8. Table 4 illustrates the complementarity of the nucleotide sequences of TPH2 BINDING SITE, designated SEQ ID:3185, to the nucleotide sequence of GAM25 rNA, herein designated GAM RNA, also designated SEQ ID:206.

Another function of GAM25 is therefore inhibition of TPH2 (Accession NP_775489.1). Accordingly, utilities of GAM25 include diagnosis, prevention and treatment of diseases and clinical conditions associated with TPH2.

Tripartite motif-containing 16 (TRIM16, Accession NP_006461.2) is another GAM25 target gene, herein designated TARGET GENE. TRIM16 BINDING SITE is a target binding site found in the 3' untranslated region of mRNA encoded by TRIM16, corresponding to a target binding site such as BINDING SITE I, BINDING SITE II or BINDING SITE III of FIG. 8. Table 4 illustrates the complementarity of the nucleotide sequences of TRIM16 BINDING SITE, designated SEQ ID:1828, to the nucleotide sequence of GAM25 rNA, herein designated GAM RNA, also designated SEQ ID:206.

Another function of GAM25 is therefore inhibition of Tripartite motif-containing 16 (TRIM16, Accession NP_006461.2). Accordingly, utilities of GAM25 include diagnosis, prevention and treatment of diseases and clinical conditions associated with TRIM16.

Tripartite motif-containing 5 (TRIM5, Accession NP_149023.1) is another GAM25 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:4983, to the nucleotide sequence of GAM25 RNA, herein designated GAM RNA, also designated SEQ ID:206.

Another function of GAM25 is therefore inhibition of Tripartite motif-containing 5 (TRIM5, Accession NP_149023.1). Accordingly, utilities of GAM25 include diagnosis, prevention and treatment of diseases and clinical conditions associated with TRIM5.

Transient receptor potential cation channel, subfamily m, member 6 (TRPM6, Accession NP_060132.3) is another GAM25 target gene, herein designated TARGET GENE. TRPM6 BINDING SITE is a target binding site found in the 3' untranslated region of mRNA encoded by TRPM6, corresponding to a target binding site such as BINDING SITE I, BINDING SITE II or BINDING SITE III of FIG. 8. Table 4 illustrates the complementarity of the nucleotide sequences of TRPM6 BINDING SITE, designated SEQ ID:18834, to the nucleotide sequence of GAM25 rNA, herein designated GAM RNA, also designated SEQ ID:206.

Another function of GAM25 is therefore inhibition of Transient receptor potential cation channel, subfamily m, member 6 (TRPM6, Accession NP_060132.3), a gene which contains a predicted ion channel domain and a protein kinase domain. and therefore is associated with Hypomagnesemia with secondary hypocalcemia. Accordingly, utilities of GAM25 include diagnosis, prevention and treatment of Hypomagnesemia with secondary hypocalcemia, and of other diseases and clinical conditions associated with TRPM6.

The function of TRPM6 has been established by previous studies. Schlingmann et al. (2002) and Walder et al. (2002) studied hypomagnesemia with secondary hypocalcemia (HSH; 602014), which maps to 9q22, and by positional cloning identified the TRPM6 gene as the site of causative mutations. Walder et al. (2002) found that the complete cDNA sequence of TRPM6 contains 8,429 nucleotides, including an open reading frame of 6,069 nucleotides. The predicted TRPM6 protein contains 2,022 amino acids, has a calculated molecular mass of roughly 234 kD, and contains a predicted ion channel domain and a protein kinase domain. Northern blot analysis detected an 8.5-kb transcript abundantly expressed in kidney and colon. By in situ hybridization to various human tissues, Schlingmann et al. (2002) observed TRPM6 mRNA in colon epithelial cells, duodenum, jejunum, and ileum. Schlingmann et al. (2002) studied 5 families (2 Turkish, 1 Swedish, 1 Israeli, and 1 Albanian) with typical HSH and discovered 7 mutations in the TRPM6 gene; the Swedish and Israeli families were nonconsanguineous and the affected children were compound heterozygotes for TRPM6 mutations. The age at onset of symptoms varied from 3 weeks to 4 months. Neurologic symptoms included tetany, muscle spasms, and seizures due to hypomagnesemic hypocalcemia. Walder et al. (2002) identified mutations in the TRPM6 gene in 7 families:3 Bedouin Arab families from Israel, 1 Arab family from Greece, a family in Germany, and 2 additional Arab families from Israel. This was the first case of a human disorder attributed to mutation in a channel kinase.

Full details of the abovementioned studies are described in the following publications, the disclosure of which are hereby incorporated by reference:

Walder, R. Y.; Landau, D.; Meyer, P.; Shalev, H.; Tsolia, M.; Borochowitz, Z.; Boettger, M. B.; Beck, G. E.; Englehardt, R. K.; Carmi, R.; Sheffield, V. C.: Mutation of TRPM6 causes familial hypomagnesemia with secondary hypocalcemia. Nature Genet. 31:171-174, 2002; and Schlingmann, K. P.; Weber, S.; Peters, M.; Nejsum, L. N.; Vitzthum, H.; Klingel, K.; Kratz, M.; Haddad, E.; Ristoff, E.; Dinour, D.; Syrrou, M.; Nielsen, S.; Sassen, M.; Waldegger, S.; S.

Further studies establishing the function and utilities of TRPM6 are found in John Hopkins OMIM database record ID 607009, and in cited publications listed in Table 5, which are hereby incorporated by reference. Tspy-like (TSPy, Accession XP_166325.1) is another GAM25 target gene, herein designated TARGET GENE. TSPYL BINDING SITE is a target binding site found in the 3' untranslated region of mRNA encoded by TSPy, corresponding to a target binding site such as BINDING SITE I, BINDING SITE II or BINDING SITE III of FIG. 8. Table 4 illustrates the complementarity of the nucleotide sequences of TSPYL BINDING SITE, designated SEQ ID:6069, to the nucleotide sequence of GAM25 rNA, herein designated GAM RNA, also designated SEQ ID:206.

Another function of GAM25 is therefore inhibition of Tspy-like (TSPy, Accession XP_166325.1). Accordingly, utilities of GAM25 include diagnosis, prevention and treatment of diseases and clinical conditions associated with TSPYL.

TU12B1-TY (Accession NP_057659.1) is another GAM25 target gene, herein designated TARGET GENE. TU12B1-TY BINDING SITE is a target binding site found in the 3' untranslated region of mRNA encoded by TU12B1-TY, corresponding to a target binding site such as BINDING SITE I, BINDING SITE II or BINDING SITE III of FIG. 8. Table 4 illustrates the complementarity of the nucleotide sequences of TU12B1-TY BINDING SITE, designated SEQ ID:1130, to the nucleotide sequence of GAM25 rNA, herein designated GAM RNA, also designated SEQ ID:206.

Another function of GAM25 is therefore inhibition of TU12B1-TY (Accession NP_057659.1). Accordingly, utilities of GAM25 include diagnosis, prevention and treatment of diseases and clinical conditions associated with TU12B1-TY.

TUCAN (Accession NP_055774.1) is another GAM25 target gene, herein designated TARGET GENE. TUCAN BINDING SITE is a target binding site found in the 3' untranslated region of mRNA encoded by TUCAN, corresponding to a target binding site such as BINDING SITE I, BINDING SITE II or BINDING SITE III of FIG. 8. Table 4 illustrates the complementarity of the nucleotide sequences of TUCAN BINDING SITE, designated SEQ ID:16692, to the nucleotide sequence of GAM25 rNA, herein designated GAM RNA, also designated SEQ ID:206.

Another function of GAM25 is therefore inhibition of TUCAN (Accession NP_055774.1). Accordingly, utilities of GAM25 include diagnosis, prevention and treatment of diseases and clinical conditions associated with TUCAN.

Ubiquitin specific protease 22 (USP22, Accession XP_042698.2) is another GAM25 target gene, herein designated TARGET GENE. USP22 BINDING SITE is a target binding site found in the 3' untranslated region of mRNA encoded by USP22, corresponding to a target binding site such as BINDING SITE I, BINDING SITE II or BINDING SITE III of FIG. 8. Table 4 illustrates the complementarity of the nucleotide sequences of USP22 BINDING SITE, designated SEQ ID:18783, to the nucleotide sequence of GAM25 rNA, herein designated GAM RNA, also designated SEQ ID:206.

Another function of GAM25 is therefore inhibition of Ubiquitin specific protease 22 (USP22, Accession XP_042698.2). Accordingly, utilities of GAM25 include diagnosis, prevention and treatment of diseases and clinical conditions associated with USP22.

VDU1 (Accession NP_055832.2) is another GAM25 target gene, herein designated TARGET GENE. VDU1 BINDING SITE is a target binding site found in the 3' untranslated region of mRNA encoded by VDU1, corresponding to a target binding site such as BINDING SITE I, BINDING SITE II or BINDING SITE III of FIG. 8. Table 4 illustrates the complementarity of the nucleotide sequences of VDU1 BINDING SITE, designated SEQ ID:15118, to the nucleotide sequence of GAM25 rNA, herein designated GAM RNA, also designated SEQ ID:206.

Another function of GAM25 is therefore inhibition of VDU1 (Accession NP_055832.2). Accordingly, utilities of GAM25 include diagnosis, prevention and treatment of diseases and clinical conditions associated with VDU1.

Vent-like homeobox 2 (VENTX2, Accession NP_055283.1) is another GAM25 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:7014, to the nucleotide sequence of GAM25 rNA, herein designated GAM RNA, also designated SEQ ID:206.

Another function of GAM25 is therefore inhibition of Vent-like homeobox 2 (VENTX2, Accession NP_055283.1). Accordingly, utilities of GAM25 include diagnosis, prevention and treatment of diseases and clinical conditions associated with VENTX2.

Vacuolar protein sorting 33a (yeast) (VPS33A, Accession NP_075067.2) is another GAM25 target gene, herein designated TARGET GENE. VPS33A BINDING SITE is a target binding site found in the 3' untranslated region of mRNA encoded by VPS33A, corresponding to a target binding site such as BINDING SITE I, BINDING SITE II or BINDING SITE III of FIG. 8. Table 4 illustrates the complementarity of the nucleotide sequences of VPS33A BINDING SITE, designated SEQ ID:17693, to the nucleotide sequence of GAM25 rNA, herein designated GAM RNA, also designated SEQ ID:206.

Another function of GAM25 is therefore inhibition of Vacuolar protein sorting 33a (yeast) (VPS33A, Accession NP_075067.2). Accordingly, utilities of GAM25 include diagnosis, prevention and treatment of diseases and clinical conditions associated with VPS33A.

Williams beuren syndrome chromosome region 18 (WBSCR18, Accession NP_115693.2) is another GAM25 target gene, herein designated TARGET GENE. WBSCR18 BINDING SITE is a target binding site found in the 3' untranslated region of mRNA encoded by WBSCR18, corresponding to a target binding site such as BINDING SITE I, BINDING SITE II or BINDING SITE III of FIG. 8. Table 4 illustrates the complementarity of the nucleotide sequences of WBSCR18 BINDING SITE, designated SEQ ID:6069, to the nucleotide sequence of GAM25 RNA, herein designated GAM RNA, also designated SEQ ID:206.

Another function of GAM25 is therefore inhibition of Williams beuren syndrome chromosome region 18 (WBSCR18, Accession NP_115693.2). Accordingly, utilities of GAM25 include diagnosis, prevention and treatment of diseases and clinical conditions associated with WBSCR18.

WBSCR20B (Accession NP_663620.1) is another GAM25 target gene, herein designated TARGET GENE. WBSCR20B BINDING SITE is a target binding site found in the 5' untranslated region of mRNA encoded by WBSCR20B, corresponding to a target binding site such as BINDING SITE I, BINDING SITE II or BINDING SITE III of FIG. 8. Table 4 illustrates the complementarity of the nucleotide sequences of WBSCR20B BINDING SITE, designated SEQ ID:4882, to the nucleotide sequence of GAM25 rNA, herein designated GAM RNA, also designated SEQ ID:206.

Another function of GAM25 is therefore inhibition of WBSCR20B (Accession NP_663620.1). Accordingly, utilities of GAM25 include diagnosis, prevention and treatment of diseases and clinical conditions associated with WBSCR20B.

WBSCR20C (Accession NP_115534.2) is another GAM25 target gene, herein designated TARGET GENE. WBSCR20C BINDING SITE is a target binding site found in the 5' untranslated region of multiple transcripts of mRNA encoded by WBSCR20C, corresponding to a target binding site such as BINDING SITE I, BINDING SITE II or BINDING SITE III of FIG. 8. Table 4 illustrates the complementarity of the nucleotide sequences of WBSCR20C BINDING SITE, designated SEQ ID:4882, to the nucleotide sequence of GAM25 rNA, herein designated GAM RNA, also designated SEQ ID:206.

Another function of GAM25 is therefore inhibition of WBSCR20C (Accession NP_115534.2). Accordingly, utilities of GAM25 include diagnosis, prevention and treatment of diseases and clinical conditions associated with WBSCR20C.

WBSCR20C (Accession NP_683738.1) is another GAM25 target gene, herein designated TARGET GENE. WBSCR20C BINDING SITE is a target binding site found in the 5' untranslated region of multiple transcripts of mRNA encoded by WBSCR20C, corresponding to a target binding site such as BINDING SITE I, BINDING SITE II or BINDING SITE III of FIG. 8. Table 4 illustrates the complementarity of the nucleotide sequences of WBSCR20C BINDING SITE, designated SEQ ID:4882, to the nucleotide sequence of GAM25 rNA, herein designated GAM RNA, also designated SEQ ID:206.

Another function of GAM25 is therefore inhibition of WBSCR20C (Accession NP_683738.1). Accordingly, utilities of GAM25 include diagnosis, prevention and treatment of diseases and clinical conditions associated with WBSCR20C.

WBSCR20C (Accession NP_683881.1) is another GAM25 target gene, herein designated TARGET GENE. WBSCR20C BINDING SITE is a target binding site found in the 5' untranslated region of multiple transcripts of mRNA encoded by WBSCR20C, corresponding to a target binding site such as BINDING SITE I, BINDING SITE II or BINDING SITE III of FIG. 8. Table 4 illustrates the complementarity of the nucleotide sequences of WBSCR20C BINDING SITE, designated SEQ ID:4882, to the nucleotide sequence of GAM25 rNA, herein designated GAM RNA, also designated SEQ ID:206.

Another function of GAM25 is therefore inhibition of WBSCR20C (Accession NP_683881.1). Accordingly, utilities of GAM25 include diagnosis, prevention and treatment of diseases and clinical conditions associated with WBSCR20C.

Williams-beuren syndrome chromosome region 23 (WBSCR23, Accession NP_079318.1) is another GAM25 target gene, herein designated TARGET GENE. WBSCR23 BINDING SITE is a target binding site found in the 3' untranslated region of mRNA encoded by WBSCR23, corresponding to a target binding site such as BINDING SITE I, BINDING SITE II or BINDING SITE III of FIG. 8. Table 4 illustrates the complementarity of the nucleotide sequences of WBSCR23 BINDING SITE, designated SEQ ID:9809, to the nucleotide sequence of GAM25 RNA, herein designated GAM RNA, also designated SEQ ID:206.

Another function of GAM25 is therefore inhibition of Williams-beuren syndrome chromosome region 23 (WBSCR23, Accession NP_079318.1). Accordingly, utilities of GAM25 include diagnosis, prevention and treatment of diseases and clinical conditions associated with WBSCR23.

WFDC8 (Accession NP_852611.1) is another GAM25 target gene, herein designated TARGET GENE. WFDC8 BINDING SITE is a target binding site found in the 3' untranslated region of multiple transcripts of mRNA encoded by WFDC8, corresponding to a target binding site such as BINDING SITE I, BINDING SITE II or BINDING SITE III of FIG. 8. Table 4 illustrates the complementarity of the nucleotide sequences of WFDC8 BINDING SITE, designated SEQ ID:11481, to the nucleotide sequence of GAM25 rNA, herein designated GAM RNA, also designated SEQ ID:206.

Another function of GAM25 is therefore inhibition of WFDC8 (Accession NP_852611.1). Accordingly, utilities of GAM25 include diagnosis, prevention and treatment of diseases and clinical conditions associated with WFDC8.

ZAP (Accession NP_064504.2) is another GAM25 target gene, herein designated TARGET GENE. ZAP BINDING SITE is a target binding site found in the 3' untranslated region of multiple transcripts of mRNA encoded by ZAP, corresponding to a target binding site such as BINDING SITE I, BINDING SITE II or BINDING SITE III of FIG. 8. Table 4 illustrates the complementarity of the nucleotide sequences of ZAP BINDING SITE, designated SEQ ID:12540, to the nucleotide sequence of GAM25 rNA, herein designated GAM RNA, also designated SEQ ID:206.

Another function of GAM25 is therefore inhibition of ZAP (Accession NP_064504.2). Accordingly, utilities of GAM25 include diagnosis, prevention and treatment of diseases and clinical conditions associated with ZAP.

ZFP42 (Accession NP_777560.1) is another GAM25 target gene, herein designated TARGET GENE. ZFP42 BINDING SITE is a target binding site found in the 3' untranslated region of mRNA encoded by ZFP42, corresponding to a target binding site such as BINDING SITE I, BINDING SITE II or BINDING SITE III of FIG. 8. Table 4 illustrates the complementarity of the nucleotide sequences of ZFP42 BINDING SITE, designated SEQ ID:14670, to the nucleotide sequence of GAM25 rNA, herein designated GAM RNA, also designated SEQ ID:206.

Another function of GAM25 is therefore inhibition of ZFP42 (Accession NP_777560.1). Accordingly, utilities of GAM25 include diagnosis, prevention and treatment of diseases and clinical conditions associated with ZFP42.

Zinc finger protein 64 homolog (mouse) (ZFP64, Accession NP_060667.1) is another GAM25 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:667, to the nucleotide sequence of GAM25 rNA, herein designated GAM RNA, also designated SEQ ID:206.

Another function of GAM25 is therefore inhibition of Zinc finger protein 64 homolog (mouse) (ZFP64, Accession NP_060667.1). Accordingly, utilities of GAM25 include diagnosis, prevention and treatment of diseases and clinical conditions associated with ZFP64.

Zinc finger protein 64 homolog (mouse) (ZFP64, Accession NP_071371.2) is another GAM25 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:667, to the nucleotide sequence of GAM25 rNA, herein designated GAM RNA, also designated SEQ ID:206.

Another function of GAM25 is therefore inhibition of Zinc finger protein 64 homolog (mouse) (ZFP64, Accession NP_071371.2). Accordingly, utilities of GAM25 include diagnosis, prevention and treatment of diseases and clinical conditions associated with ZFP64.

ZMYND17 (Accession NP_848546.1) is another GAM25 target gene, herein designated TARGET GENE. ZMYND17 BINDING SITE is a target binding site found in the 3' untranslated region of mRNA encoded by ZMYND17, corresponding to a target binding site such as BINDING SITE I, BINDING SITE II or BINDING SITE III of FIG. 8. Table 4 illustrates the complementarity of the nucleotide sequences of ZMYND17 BINDING SITE, designated SEQ ID:1129, to the nucleotide sequence of GAM25 rNA, herein designated GAM RNA, also designated SEQ ID:206.

Another function of GAM25 is therefore inhibition of ZMYND17 (Accession NP_848546.1). Accordingly, utilities of GAM25 include diagnosis, prevention and treatment of diseases and clinical conditions associated with ZMYND17.

Zinc finger protein 264 (ZNF264, Accession NP_003408.1) is another GAM25 target gene, herein designated TARGET GENE. ZNF264 BINDING SITE1 and ZNF264 BINDING SITE2 are target binding sites found in untranslated regions of mRNA encoded by ZNF264, corresponding to target binding sites such as BINDING SITE I, BINDING SITE II or BINDING SITE III of FIG. 8. Table 4 illustrates the complementarity of the nucleotide sequences of ZNF264 BINDING SITE1 and ZNF264 BINDING SITE2, designated SEQ ID:16732 and SEQ ID:3185 respectively, to the nucleotide sequence of GAM25 rNA, herein designated GAM RNA, also designated SEQ ID:206.

Another function of GAM25 is therefore inhibition of Zinc finger protein 264 (ZNF264, Accession NP_003408.1). Accordingly, utilities of GAM25 include diagnosis, prevention and treatment of diseases and clinical conditions associated with ZNF264.

Zinc finger protein 398 (ZNF398, Accession NP_065832.1) is another GAM25 target gene, herein designated TARGET GENE. ZNF398 BINDING SITE is a target binding site found in the 5' untranslated region of multiple transcripts of mRNA encoded by ZNF398, corresponding to a target binding site such as BINDING SITE I, BINDING SITE II or BINDING SITE III of FIG. 8. Table 4 illustrates the complementarity of the nucleotide sequences of ZNF398 BINDING SITE, designated SEQ ID:13567, to the nucleotide sequence of GAM25 RNA, herein designated GAM RNA, also designated SEQ ID:206.

Another function of GAM25 is therefore inhibition of Zinc finger protein 398 (ZNF398, Accession NP_065832.1). Accordingly, utilities of GAM25 include diagnosis, prevention and treatment of diseases and clinical conditions associated with ZNF398.

ZNF440 (Accession NP_689570.1) is another GAM25 target gene, herein designated TARGET GENE. ZNF440 BINDING SITE is a target binding site found in the 3' untranslated region of mRNA encoded by ZNF440, corresponding to a target binding site such as BINDING SITE I, BINDING SITE II or BINDING SITE III of FIG. 8. Table 4 illustrates the complementarity of the nucleotide sequences of ZNF440 BINDING SITE, designated SEQ ID:8954, to the nucleotide sequence of GAM25 rNA, herein designated GAM RNA, also designated SEQ ID:206.

Another function of GAM25 is therefore inhibition of ZNF440 (Accession NP_689570.1). Accordingly, utilities of GAM25 include diagnosis, prevention and treatment of diseases and clinical conditions associated with ZNF440.

Zinc finger protein 70 (cos17) (ZNF70, Accession NP_068735.1) is another GAM25 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:5829, to the nucleotide sequence of GAM25 rNA, herein designated GAM RNA, also designated SEQ ID:206.

Another function of GAM25 is therefore inhibition of Zinc finger protein 70 (cos17) (ZNF70, Accession NP_068735.1). Accordingly, utilities of GAM25 include diagnosis, prevention and treatment of diseases and clinical conditions associated with ZNF70.

Zinc finger protein 70 (cos17) (ZNF70, Accession NP_852101.1) is another GAM25 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:5829, to the nucleotide sequence of GAM25 rNA, herein designated GAM RNA, also designated SEQ ID:206.

Another function of GAM25 is therefore inhibition of Zinc finger protein 70 (cos17) (ZNF70, Accession NP_852101.1). Accordingly, utilities of GAM25 include diagnosis, prevention and treatment of diseases and clinical conditions associated with ZNF70.

FIG. 8 further provides a conceptual description of a novel bioinformatically detected of the present invention, referred to here as Genomic Address Messenger 28 (GAM28), which modulates expression of respective target genes thereof, the function and utility of which target genes is known in the art.

GAM28 is a novel bioinformatically detected regulatory, non protein coding, micro RNA (miRNA) gene. The method by which GAM28 was detected is described hereinabove with reference to FIGS. 8-15.

GAM28 gene, herein designated GAM GENE, and GAM28 target gene, herein designated TARGET GENE, are human genes contained in the human genome.

GAM28 gene encodes a GAM28 precursor RNA, herein designated GAM PRECURSOR RNA. Similar to other miRNA genes, and unlike most ordinary genes, GAM28 precursor RNA does not encode a protein. A nucleotide sequence identical or highly similar to the nucleotide sequence of GAM28 precursor RNA is designated SEQ ID:141, and is provided hereinbelow with reference to the sequence listing part. Nucleotide sequence SEQ ID:141 is located at position 54105760 relative to chromosome 12.

GAM28 precursor RNA folds onto itself, forming GAM28 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM28 precursor RNA folds onto itself, forming GAM28 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM28 precursor RNA, designated SEQ-ID:141, and a schematic representation of a predicted secondary folding of GAM28 folded precursor RNA are further described with reference to Table 2, hereby incorporated by reference.

An enzyme complex designated DICER COMPLEX, 'dices' the GAM28 folded precursor RNA into GAM28 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM28 RNA is designated SEQ ID:260, and is provided hereinbelow with references to the sequence listing part and Table 3, hereby incorporated by reference.

GAM28 target gene, herein designated TARGET GENE, encodes a corresponding messenger RNA, GAM28 target RNA, herein designated GAM TARGET RNA. GAM28 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM28 RNA, herein designated GAM RNA, binds complementarily to one or more target binding sites located in untranslated regions of GAM28 target RNA, herein designated GAM TARGET RNA. This complementary binding is due to the fact that the nucleotide sequence of GAM28 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM28 RNA may have a different number of target binding sites in untranslated regions of a GAM28 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM28 RNA, herein designated GAM RNA, to target binding sites on GAM28 target RNA, herein designated GAM TARGET RNA, such as BINDING SITE I, BINDING SITE II and BINDING SITE III, inhibits translation of GAM28 target RNA into GAM28 target protein, herein designated GAM TARGET PROTEIN. GAM target protein is therefore outlined by a broken line.

It is appreciated that GAM28 target gene, herein designated TARGET GENE, in fact represents a plurality of GAM28 target genes. The mRNA of each one of this plurality of GAM28 target genes comprises one or more target binding sites, each having a nucleotide sequence which is at least partly complementary to GAM28 RNA, herein designated GAM RNA, and which when bound by GAM28 RNA causes inhibition of translation of respective one or more GAM28 target proteins.

It is further appreciated by one skilled in the art that the mode of translational inhibition illustrated by FIG. 8 with specific reference to translational inhibition exerted by GAM28 gene, herein designated GAM GENE, on one or more GAM28 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM28 correlate with, and may be deduced from, the identity of the target genes which GAM28 binds and inhibits, and the function of these target genes, as elaborated hereinbelow.

Component of oligomeric golgi complex 3 (COG3, Accession NM_031431.2) is a GAM28 target gene, herein designated TARGET GENE. COG3 BINDING SITE is a target binding site found in the 3' untranslated region of mRNA encoded by COG3, corresponding to a target binding site such as BINDING SITE I, BINDING SITE II or BINDING SITE III of FIG. 8. Table 4 illustrates the complementarity of the nucleotide sequences of COG3 BINDING SITE, designated SEQ ID:8233, to the nucleotide sequence of GAM28 RNA, herein designated GAM RNA, also designated SEQ ID:260.

A function of GAM28 is therefore inhibition of Component of oligomeric golgi complex 3 (COG3, Accession NM_031431.2), a gene which is critical for the structure and function of the Golgi apparatus. Accordingly, utilities of GAM28 include diagnosis, prevention and treatment of diseases and clinical conditions associated with COG3.

The function of COG3 has been established by previous studies. Multiprotein complexes are key determinants of Golgi apparatus structure and its capacity for intracellular transport and glycoprotein modification. Several complexes have been identified, including the Golgi transport complex (GTC), the LDLC complex, which is involved in glycosylation reactions, and the SEC34 complex, which is involved in vesicular transport. These 3 complexes are identical and have been termed the conserved oligomeric Golgi (COG) complex, which includes COG3 (Ungar et al., 2002). By SDS-PAGE analysis of bovine brain cytosol, Ungar et al. (2002) identified the 8 subunits of the COG complex. Immunofluorescence microscopy demonstrated that COG1 (LDLB; 606973) colocalizes with COG7 (OMIM Ref. No. 606978), as well as with COG3 and COG5 (OMIM Ref. No. 606821), with a Golgi marker in a perinuclear distribution. Immunoprecipitation analysis showed that all COG subunits interact with COG2 (LDLC; 606974). Ungar et al. (2002) concluded that the COG complex is critical for the structure and function of the Golgi apparatus and can influence intracellular membrane trafficking Full details of the abovementioned studies are described in the following publications, the disclosure of which are hereby incorporated by reference:

Suvorova, E. S.; Kurten, R. C.; Lupashin, V. V.: Identification of a human orthologue of Sec34p as a component of the cis-Golgi vesicle tethering machinery. J. Biol. Chem. 276: 22810-22818, 2001; and Ungar, D.; Oka, T.; Brittle, E. E.; Vasile, E.; Lupashin, V. V.; Chatterton, J. E.; Heuser, J. E.; Krieger, M.; Waters, M. G.: Characterization of a mammalian Golgi-localized protein c.

Further studies establishing the function and utilities of COG3 are found in John Hopkins OMIM database record ID 606975, and in cited publications listed in Table 5, which are hereby incorporated by reference. Estrogen-related receptor beta like 1 (ESRRBL1, Accession NM_018010.2) is another GAM28 target gene, herein designated TARGET GENE. ESRRBL1 BINDING SITE is a target binding site found in the 3' untranslated region of mRNA encoded by ESRRBL1, corresponding to a target binding site such as BINDING SITE I, BINDING SITE II or BINDING SITE III of FIG. 8. Table 4 illustrates the complementarity of the nucleotide sequences of ESRRBL1 BINDING SITE, designated SEQ ID:8766, to the nucleotide sequence of GAM28 RNA, herein designated GAM RNA, also designated SEQ ID:260.

Another function of GAM28 is therefore inhibition of Estrogen-related receptor beta like 1 (ESRRBL1, Accession NM_018010.2). Accordingly, utilities of GAM28 include diagnosis, prevention and treatment of diseases and clinical conditions associated with ESRRBL1.

KRT6IRS (Accession NM_033448.1) is another GAM28 target gene, herein designated TARGET GENE. KRT6IRS BINDING SITE is a target binding site found in the 3' untranslated region of mRNA encoded by KRT6IRS, corresponding to a target binding site such as BINDING SITE I, BINDING SITE II or BINDING SITE III of FIG. 8. Table 4 illustrates the complementarity of the nucleotide sequences of KRT6IRS BINDING SITE, designated SEQ ID:4708, to the nucleotide sequence of GAM28 RNA, herein designated GAM RNA, also designated SEQ ID:260.

Another function of GAM28 is therefore inhibition of KRT6IRS (Accession NM_033448.1). Accordingly, utilities of GAM28 include diagnosis, prevention and treatment of diseases and clinical conditions associated with KRT6IRS.

Transducin (beta)-like 1x-linked (TBL1X, Accession NM_005647.2) is another GAM28 target gene, herein designated TARGET GENE. TBL1X BINDING SITE is a target binding site found in the 3' untranslated region of mRNA encoded by TBL1X, corresponding to a target binding site such as BINDING SITE I, BINDING SITE II or BINDING SITE III of FIG. 8. Table 4 illustrates the complementarity of the nucleotide sequences of TBL1X BINDING SITE, designated SEQ ID:12893, to the nucleotide sequence of GAM28 RNA, herein designated GAM RNA, also designated SEQ ID:260.

Another function of GAM28 is therefore inhibition of Transducin (beta)-like 1x-linked (TBL1X, Accession NM_005647.2), a gene which activates latent HDAC3 activity. Accordingly, utilities of GAM28 include diagnosis, prevention and treatment of diseases and clinical conditions associated with TBL1X.

The function of TBL1X has been established by previous studies. In the course of constructing a deletion map of the distal portion of the short arm of the X chromosome and the identification of the OA1 gene (OMIM Ref. No. 300500), Bassi et al. (1999) performed cDNA selection experiments that resulted in the isolation of a novel gene, TBL1, located outside the OA1 critical region on the telomeric side. The TBL1 gene maps to the Xp22.3 region and shares significant homology with members of the WD40 repeat-containing protein family. The open reading frame encodes a 526-amino acid protein containing 6 beta-transducin repeats (WD40 motif) in the C-terminal domain. The homology with known beta-subunits of G proteins and other WD40 repeat-containing proteins is restricted to the WD40 motif. Northern blot analysis indicated that the TBL1 gene is ubiquitously expressed as 2 transcripts of approximately 2.1 and 6.0 kb. Matsuzawa and Reed (2001) elucidated a network of protein interactions in which SIAH1 (OMIM Ref. No. 602212), SIP (OMIM Ref. No. 606186), SKP1 (OMIM Ref. No. 601434), and EBI collaborate in a pathway controlling beta-catenin (OMIM Ref. No. 116806) levels, affecting activity of beta-catenin-dependent TCF (e.g., TCF1; 142410) and LEF (e.g., LEF1; 153245) transcription factors. This pathway is inducible by p53 (OMIM Ref. No. 191170), revealing a link between genotoxic injury responses and beta-catenin degradation. SIAH1 is physically linked to EBI by association with SIP, which binds SKP1.

Full details of the abovementioned studies are described in the following publications, the disclosure of which are hereby incorporated by reference:

Bassi, M. T.; Ramesar, R. S.; Caciotti, B.; Winship, I. M.; De Grandi, A.; Riboni, M.; Townes, P. L.; Beighton, P.; Ballabio, A.; Borsani, G.: X-linked late-onset sensorineural deafness caused by a deletion involving OA1 and a novel gene containing WD-40 repeats. Am. J. Hum. Genet. 64:1604-1616, 1999; and Matsuzawa, S.; Reed, J. C.: Siah-1, SIP, and Ebi collaborate in a novel pathway for beta-catenin degradation linked to p53 responses. Molec. Cell 7:915-926, 2001.

Further studies establishing the function and utilities of TBL1X are found in John Hopkins OMIM database record ID 300196, and in cited publications listed in Table 5, which are hereby incorporated by reference.

FIG. 8 further provides a conceptual description of a novel bioinformatically detected of the present invention, referred to here as Genomic Address Messenger 29 (GAM29), which modulates expression of respective target genes thereof, the function and utility of which target genes is known in the art.

GAM29 is a novel bioinformatically detected regulatory, non protein coding, micro RNA (miRNA) gene. The method by which GAM29 was detected is described hereinabove with reference to FIGS. 8-15.

GAM29 gene, herein designated GAM GENE, and GAM29 target gene, herein designated TARGET GENE, are human genes contained in the human genome.

GAM29 gene encodes a GAM29 precursor RNA, herein designated GAM PRECURSOR RNA. Similar to other miRNA genes, and unlike most ordinary genes, GAM29 precursor RNA does not encode a protein. A nucleotide sequence identical or highly similar to the nucleotide sequence of GAM29 precursor RNA is designated SEQ ID:81, and is provided hereinbelow with reference to the sequence listing part.

GAM29 precursor RNA folds onto itself, forming GAM29 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM29 precursor RNA folds onto itself, forming GAM29 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM29 precursor RNA, designated SEQ-ID:81, and a schematic representation of a predicted secondary folding of GAM29 folded precursor RNA are further described with reference to Table 2, hereby incorporated by reference.

An enzyme complex designated DICER COMPLEX, 'dices' the GAM29 folded precursor RNA into GAM29 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM29 RNA is designated SEQ ID:380, and is provided hereinbelow with references to the sequence listing part and Table 3, hereby incorporated by reference.

GAM29 target gene, herein designated TARGET GENE, encodes a corresponding messenger RNA, GAM29 target RNA, herein designated GAM TARGET RNA. GAM29 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM29 RNA, herein designated GAM RNA, binds complementarily to one or more target binding sites located in untranslated regions of GAM29 target RNA, herein designated GAM TARGET RNA. This complementary binding is due to the fact that the nucleotide sequence of GAM29 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM29 RNA may have a different number of target binding sites in untranslated regions of a GAM29 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM29 RNA, herein designated GAM RNA, to target binding sites on GAM29 target RNA, herein designated GAM TARGET RNA, such as BINDING SITE I, BINDING SITE II and BINDING SITE III, inhibits translation of GAM29 target RNA into GAM29 target protein, herein designated GAM TARGET PROTEIN. GAM target protein is therefore outlined by a broken line.

It is appreciated that GAM29 target gene, herein designated TARGET GENE, in fact represents a plurality of GAM29 target genes. The mRNA of each one of this plurality of GAM29 target genes comprises one or more target binding sites, each having a nucleotide sequence which is at least partly complementary to GAM29 RNA, herein designated GAM RNA, and which when bound by GAM29 RNA causes inhibition of translation of respective one or more GAM29 target proteins.

It is further appreciated by one skilled in the art that the mode of translational inhibition illustrated by FIG. 8 with specific reference to translational inhibition exerted by GAM29 gene, herein designated GAM GENE, on one or more GAM29 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM29 correlate with, and may be deduced from, the identity of the target genes which GAM29 binds and inhibits, and the function of these target genes, as elaborated hereinbelow.

KIAA0222 (Accession NM_014643.1) is a GAM29 target gene, herein designated TARGET GENE. KIAA0222 BINDING SITE is a target binding site found in the 5' untranslated region of mRNA encoded by KIAA0222, corresponding to a target binding site such as BINDING SITE I, BINDING SITE II or BINDING SITE III of FIG. 8. Table 4 illustrates the complementarity of the nucleotide sequences of KIAA0222 BINDING SITE, designated SEQ ID:11419, to the nucleotide sequence of GAM29 RNA, herein designated GAM RNA, also designated SEQ ID:380.

A function of GAM29 is therefore inhibition of KIAA0222 (Accession NM_014643.1). Accordingly, utilities of GAM29 include diagnosis, prevention and treatment of diseases and clinical conditions associated with KIAA0222.

LOC254778 (Accession) is another GAM29 target gene, herein designated TARGET GENE. LOC254778 BINDING SITE is a target binding site found in the 3' untranslated region of mRNA encoded by LOC254778, corresponding to a target binding site such as BINDING SITE I, BINDING SITE II or BINDING SITE III of FIG. 8. Table 4 illustrates the complementarity of the nucleotide sequences of LOC254778 BINDING SITE, designated SEQ ID:8734, to the nucleotide sequence of GAM29 RNA, herein designated GAM RNA, also designated SEQ ID:380.

Another function of GAM29 is therefore inhibition of LOC254778 (Accession). Accordingly, utilities of GAM29 include diagnosis, prevention and treatment of diseases and clinical conditions associated with LOC254778.

FIG. 8 further provides a conceptual description of a novel bioinformatically detected of the present invention, referred to here as Genomic Address Messenger 30 (GAM30), which modulates expression of respective target genes thereof, the function and utility of which target genes is known in the art.

GAM30 is a novel bioinformatically detected regulatory, non protein coding, micro RNA (miRNA) gene. The method by which GAM30 was detected is described hereinabove with reference to FIGS. 8-15.

GAM30 gene, herein designated GAM GENE, and GAM30 target gene, herein designated TARGET GENE, are human genes contained in the human genome.

GAM30 gene encodes a GAM30 precursor RNA, herein designated GAM PRECURSOR RNA. Similar to other miRNA genes, and unlike most ordinary genes, GAM30 precursor RNA does not encode a protein. A nucleotide sequence identical or highly similar to the nucleotide sequence of GAM30 precursor RNA is designated SEQ ID:125, and is provided hereinbelow with reference to the sequence listing part.

GAM30 precursor RNA folds onto itself, forming GAM30 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM30 precursor RNA folds onto itself, forming GAM30 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM30 precursor RNA, designated SEQ-ID:125, and a schematic representation of a predicted secondary folding of GAM30 folded precursor RNA are further described with reference to Table 2, hereby incorporated by reference.

An enzyme complex designated DICER COMPLEX, 'dices' the GAM30 folded precursor RNA into GAM30 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM30 RNA is designated SEQ ID:346, and is provided hereinbelow with references to the sequence listing part and Table 3, hereby incorporated by reference.

GAM30 target gene, herein designated TARGET GENE, encodes a corresponding messenger RNA, GAM30 target RNA, herein designated GAM TARGET RNA. GAM30 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM30 RNA, herein designated GAM RNA, binds complementarily to one or more target binding sites located in untranslated regions of GAM30 target RNA, herein designated GAM TARGET RNA. This complementary binding is due to the fact that the nucleotide sequence of GAM30 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM30 RNA may have a different number of target binding sites in untranslated regions of a GAM30 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM30 RNA, herein designated GAM RNA, to target binding sites on GAM30 target RNA, herein designated GAM TARGET RNA, such as BINDING SITE I, BINDING SITE II and BINDING SITE III, inhibits translation of GAM30 target RNA into GAM30 target protein, herein designated GAM TARGET PROTEIN. GAM target protein is therefore outlined by a broken line.

It is appreciated that GAM30 target gene, herein designated TARGET GENE, in fact represents a plurality of GAM30 target genes. The mRNA of each one of this plurality of GAM30 target genes comprises one or more target binding sites, each having a nucleotide sequence which is at least partly complementary to GAM30 RNA, herein designated GAM RNA, and which when bound by GAM30 RNA causes inhibition of translation of respective one or more GAM30 target proteins.

It is further appreciated by one skilled in the art that the mode of translational inhibition illustrated by FIG. 8 with specific reference to translational inhibition exerted by GAM30 gene, herein designated GAM GENE, on one or more GAM30 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM30 correlate with, and may be deduced from, the identity of the target genes which GAM30 binds and inhibits, and the function of these target genes, as elaborated hereinbelow.

Aryl hydrocarbon receptor (AHR, Accession NM_001621.2) is a GAM30 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:10227, to the nucleotide sequence of GAM30 RNA, herein designated GAM RNA, also designated SEQ ID:346.

A function of GAM30 is therefore inhibition of Aryl hydrocarbon receptor (AHR, Accession NM_001621.2), a gene which plays a role in modulating carcinogenesis through the induction of xenobiotic-metabolizing enzymes and therefore may be associated with Stomach tumors. Accordingly, utilities of GAM30 include diagnosis, prevention and treatment of Stomach tumors, and of other diseases and clinical conditions associated with AHR.

The function of AHR has been established by previous studies. Halogenated aromatic hydrocarbons, represented by 2,3,7,8-tetrachlorodibenzo-p-dioxin (TCDD), are environmental pollutants that are produced by minor side-reactions in chemical manufacturing processes and by combustion of waste materials. These chemicals cause potent and pleiotropic toxicity, including teratogenesis, immune suppression, epithelial disorders, and tumor production in experimental animals. At the molecular level, aldehyde dehydrogenase, quinone reductase, and various drug-metabolizing enzymes are induced by the chemicals in some cultured cells and some tissues of experimental animals. All these biologic effects are thought to be mediated by an intracellular aryl hydrocarbon receptor (AHR). By fluorescence in situ hybridization and by DNA blot hybridization using human/mouse or human/Chinese hamster hybrid cell DNAs, Ema et al. (1994) assigned the AHR gene to 7p21. By use of PCR analysis of somatic cell hybrids and fluorescence in situ hybridization of metaphase cells, Le Beau et al. (1994) localized the AHR gene to 7p21-p15. Micka et al. (1997) localized the AHR gene to 7p15 using fluorescence in situ hybridization. Performing linkage analysis in a 3-generation family, they showed with good probability that the high CYP1A1 (OMIM Ref. No. 108330) inducibility phenotype segregates with the 7p15 region.

Animal model experiments lend further support to the function of AHR. To determine whether the aryl hydrocarbon receptor plays a role in modulating carcinogenesis through the induction of xenobiotic-metabolizing enzymes, Shimizu et al. (2000) studied Ahr-deficient mice exposed to benzo(a)pyrene, a widely distributed environmental carcinogen.

It is appreciated that the abovementioned animal model for AHR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ema, M.; Matsushita, N.; Sogawa, K.; Ariyama, T.; Inazawa, J.; Nemoto, T.; Ota, M.; Oshimura, M.; Fujii-Kuriyama, Y.: Human arylhydrocarbon receptor: functional expression and chromosomal assignment to 7p21. J. Biochem. 116:845-851, 1994; and Shimizu, Y.; Nakatsuru, Y.; Ichinose, M.; Takahashi, Y.; Kume, H.; Mimura, J.; Fujii- Kuriyama, Y.; Ishikawa, T.: Benzo[a]pyrene carcinogenicity is lost in mice lacking the aryl hydrocar.

Further studies establishing the function and utilities of AHR are found in John Hopkins OMIM database record ID 600253, and in cited publications listed in Table 5, which are hereby incorporated by reference. Apoptotic protease activating factor (APAF1, Accession NM_013229.1) is another GAM30 target gene, herein designated TARGET GENE. APAF1 BINDING SITE is a target binding site found in the 3' untranslated region of multiple transcripts of mRNA encoded by APAF1, corresponding to a target binding site such as BINDING SITE I, BINDING SITE II or BINDING SITE III of FIG. 8. Table 4 illustrates the complementarity of the nucleotide sequences of APAF1 BINDING SITE, designated SEQ ID:8324, to the nucleotide sequence of GAM30 RNA, herein designated GAM RNA, also designated SEQ ID:346.

Another function of GAM30 is therefore inhibition of Apoptotic protease activating factor (APAF1, Accession NM_013229.1), a gene which functions in the mitochondrial apoptotic pathway that leads to caspase 9 dependent activation of caspase 3 and therefore may be associated with Cancer. Accordingly, utilities of GAM30 include diagnosis, prevention and treatment of Cancer, and of other diseases and clinical conditions associated with APAF1.

The function of APAF1 has been established by previous studies. Metastatic melanoma is a deadly cancer that fails to respond to conventional chemotherapy. Mutations in p53 (OMIM Ref. No. 191170) often occur in aggressive and chemoresistant cancers but are rarely observed in melanoma. Soengas et al. (2001) showed that metastatic melanomas often lose APAF1. Loss of APAF1 expression was accompanied by allelic loss in metastatic melanomas, but could be recovered in melanoma cell lines by treatment with the methylation inhibitor 5-aza-2-prime-deoxycytidine (5aza2dC). APAF1-negative melanomas were invariably chemoresistant and were unable to execute a typical apoptotic program in response to p53 activation. Restoring physiologic levels of APAF1 through gene transfer or 5aza2dC treatment markedly enhanced chemosensitivity and rescued the apoptotic defects associated with APAF1 loss. Soengas et al. (2001) concluded that APAF1 is inactivated in metastatic melanomas, leading to defects in the execution of apoptotic cell death.

Animal model experiments lend further support to the function of APAF1. Yoshida et al. (1998) also produced Apaf1-deficient mice which exhibited reduced apoptosis in the brain and striking craniofacial abnormalities with hyperproliferation of neuronal cells. Apaf1-deficient cells were resistant to a variety of apoptotic stimuli, and the processing of caspases-2, -3, and -8 was impaired. However, both Apaf1 -/-thymocytes and activated T lymphocytes were sensitive to Fas-induced killing, showing that Fas-mediated apoptosis in these cells is independent of Apaf1. These data indicated that Apaf1 plays a central role in the common events of mitochondria-dependent apoptosis in most death pathways and that this role is critical for normal development.

It is appreciated that the abovementioned animal model for APAF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Soengas, M. S.; Capodieci, P.; Polsky, D.; Mora, J.; Esteller, M.; Opitz-Aray, X.; McCombie, R.; Herman, J. G.; Gerald, W. L.; Lazebnik, Y. A.; Cordon-Cardo, C.; Lowe, S. W.: Inactivation of the apoptosis effector Apaf-1 in malignant melanoma. Nature 409:207-211, 2001; and Yoshida, H.; Kong, Y.-Y.; Yoshida, R.; Elia, A. J.; Hakem, A.; Hakem, R.; Penninger, J. M.; Mak, T. W.: Apaf1 is required for mitochondrial pathways of apoptosis and brain development.

Further studies establishing the function and utilities of APAF1 are found in John Hopkins OMIM database record ID 602233, and in cited publications listed in Table 5, which are hereby incorporated by reference. APM1 (Accession NM_004797.1) is another GAM30 target gene, herein designated TARGET GENE. APM1 BINDING SITE is a target binding site found in the 3' untranslated region of mRNA encoded by APM1, corresponding to a target binding site such as BINDING SITE I, BINDING SITE II or BINDING SITE III of FIG. 8. Table 4 illustrates the complementarity of the nucleotide sequences of APM1 BINDING SITE, designated SEQ ID:11325, to the nucleotide sequence of GAM30 RNA, herein designated GAM RNA, also designated SEQ ID:346.

Another function of GAM30 is therefore inhibition of APM1 (Accession NM_004797.1). Accordingly, utilities of GAM30 include diagnosis, prevention and treatment of diseases and clinical conditions associated with APM1.

Apolipoprotein l, 1 (APOL1, Accession NM_145343.1) is another GAM30 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:19014, to the nucleotide sequence of GAM30 RNA, herein designated GAM RNA, also designated SEQ ID:346.

Another function of GAM30 is therefore inhibition of Apolipoprotein l, 1 (APOL1, Accession NM_145343.1), a gene which may participate in reverse cholesterol transport from peripheral cells to the liver. and therefore may be associated with Schizophrenia. Accordingly, utilities of GAM30 include diagnosis, prevention and treatment of Schizophrenia, and of other diseases and clinical conditions associated with APOL1.

The function of APOL1 has been established by previous studies. By genomic sequence analysis, Page et al. (2001) identified APOL1 within the APOL gene cluster. The predicted 398-amino acid protein has a calculated molecular mass of 43.9 kD. They noted that the APOL proteins share significant identity within the predicted amphipathic alpha helices. Semiquantitative RT-PCR revealed ubiquitous expression of APOL1, with highest levels in lung, spleen, prostate, and placenta, and weak expression in fetal brain and pancreas. In situ hybridization of human placenta revealed expression in all 3 tissue layers, including the basal plate, cytiotrophoblast, and chorionic plate. In a microarray analysis of gene expression in the prefrontal cortex of schizophrenia (OMIM Ref. No. 181500) and control brains, Mimmack et al. (2002) found significant upregulation of the APOL1, APOL2 (OMIM Ref. No. 607252), and APOL4 (OMIM Ref. No. 607254) genes.

Full details of the abovementioned studies are described in the following publications, the disclosure of which are hereby incorporated by reference:

Mimmack, M. L.; Ryan, M.; Baba, H.; Navarro-Ruiz, J.; Iritani, S.; Faull, R. L. M.; McKenna, P. J.; Jones, P. B.; Arai, H.; Starkey, M.; Emson, P. C.; Bahn, S.: Gene expression analysis in schizophrenia: reproducible up-regulation of several members of the apolipoprotein L family located in a high-susceptibility locus for schizophrenia on chromosome 22. Proc. Nat. Acad. Sci. 99:4680-4685, 2002; and Page, N. M.; Butlin, D. J.; Lomthaisong, K.; Lowry, P. J.: The human apolipoprotein L gene cluster: identification, classification, and sites of distribution. Genomics 74:71-78, 200.

Further studies establishing the function and utilities of APOL1 are found in John Hopkins OMIM database record ID 603743, and in cited publications listed in Table 5, which are hereby incorporated by reference. Archain 1 (ARCN1, Accession NM_001655.3) is another GAM30 target gene, herein designated TARGET GENE. ARCN1 BINDING SITE is a target binding site found in the 3' untranslated region of mRNA encoded by ARCN1, corresponding to a target binding site such as BINDING SITE I, BINDING SITE II or BINDING SITE III of FIG. 8. Table 4 illustrates the complementarity of the nucleotide sequences of ARCN1 BINDING SITE, designated SEQ ID:19563, to the nucleotide sequence of GAM30 RNA, herein designated GAM RNA, also designated SEQ ID:346.

Another function of GAM30 is therefore inhibition of Archain 1 (ARCN1, Accession NM_001655.3), a gene which plays a fundamental role in eukaryotic cell biology. Accordingly, utilities of GAM30 include diagnosis, prevention and treatment of diseases and clinical conditions associated with ARCN1.

The function of ARCN1 has been established by previous studies. Radice et al. (1995) identified a gene that maps approximately 50-kb telomeric to MLL (OMIM Ref. No. 159555) in band 11q23.3, a locus disrupted in certain leukemia-associated translocation chromosomes. A 200-kb genomic fragment from a YAC that includes MLL was used to screen a cDNA library of the R54; 11 cell line which carries a translocation chromosome t(4;11)(q21; q23). The cDNA sequence predicts a 511-amino acid protein which shares similarity with predicted proteins of unknown function from rice (Oryza sativa) and Drosophila. Because of this ancient conservation the authors proposed the name archain (ARCN1). Radice et al. (1995) detected 4-kb ARCN1 transcripts by Northern blot analysis in all tissues examined. The protein encoded by the ARCN1 gene, the coatomer protein delta-COP, probably plays a fundamental role in eukaryotic cell biology. Tunnacliffe at al. (1996)demonstrated that it is conserved across diverse eukaryotes. Very close or identical matches were seen in rat and cow; highly significant matches were seen with 2 plant species, A. thaliana (cress) and S. tuberosum (OMIM Ref. No. potato). Of particular biologic significance was the match with a sequence on yeast chromosome VI, from which Tunnacliffe et al. (1996) were able to determine the yeast archain gene and protein sequence. Unpublished data indicated that in situ hybridizations on mouse embryo sections showed archain transcripts throughout the whole animal.

Full details of the abovementioned studies are described in the following publications, the disclosure of which are hereby incorporated by reference:

Radice, P.; Pensotti, V.; Jones, C.; Perry, H.; Pierotti, M. A.; Tunnacliffe, A.: The human archain gene, ARCN1, has highly conserved homologs in rice and Drosophila. Genomics 26:101-106, 1995; and Tunnacliffe, A.; van de Vrugt, H.; Pensotti, V.; Radice, P.: The coatomer protein delta-COP, encoded by the archain gene, is conserved across diverse eukaryotes. Mammalian Genome 7:78.

Further studies establishing the function and utilities of ARCN1 are found in John Hopkins OMIM database record ID 600820, and in cited publications listed in Table 5, which are hereby incorporated by reference. Ras homolog gene family, member f (in filopodia) (ARHF, Accession NM_019034.1) is another GAM30 target gene, herein designated TARGET GENE. ARHF BINDING SITE is a target binding site found in the 3' untranslated region of mRNA encoded by ARHF, corresponding to a target binding site such as BINDING SITE I, BINDING SITE II or BINDING SITE III of FIG. 8. Table 4 illustrates the complementarity of the nucleotide sequences of ARHF BINDING SITE, designated SEQ ID:11167, to the nucleotide sequence of GAM30 RNA, herein designated GAM RNA, also designated SEQ ID:346.

Another function of GAM30 is therefore inhibition of Ras homolog gene family, member f (in filopodia) (ARHF, Accession NM_019034.1). Accordingly, utilities of GAM30 include diagnosis, prevention and treatment of diseases and clinical conditions associated with ARHF.

ARHGAP11A (Accession NM_014783.1) is another GAM30 target gene, herein designated TARGET GENE. ARHGAP11A BINDING SITE is a target binding site found in the 5' untranslated region of mRNA encoded by ARHGAP11A, corresponding to a target binding site such as BINDING SITE I, BINDING SITE II or BINDING SITE III of FIG. 8. Table 4 illustrates the complementarity of the nucleotide sequences of ARHGAP11A BINDING SITE, designated SEQ ID:13439, to the nucleotide sequence of GAM30 RNA, herein designated GAM RNA, also designated SEQ ID:346.

Another function of GAM30 is therefore inhibition of ARHGAP11A (Accession NM_014783.1). Accordingly, utilities of GAM30 include diagnosis, prevention and treatment of diseases and clinical conditions associated with ARHGAP11A.

Ankyrin repeat and socs box-containing 16 (ASB16, Accession NM_080863.4) is another GAM30 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:16342, to the nucleotide sequence of GAM30 RNA, herein designated GAM RNA, also designated SEQ ID:346.

Another function of GAM30 is therefore inhibition of Ankyrin repeat and socs box-containing 16 (ASB16, Accession NM_080863.4). Accordingly, utilities of GAM30 include diagnosis, prevention and treatment of diseases and clinical conditions associated with ASB16.

BA108L7.2 (Accession NM_030971.1) is another GAM30 target gene, herein designated TARGET GENE. BA108L7.2 BINDING SITE is a target binding site found in the 5' untranslated region of mRNA encoded by BA108L7.2, corresponding to a target binding site such as BINDING SITE I, BINDING SITE II or BINDING SITE III of FIG. 8. Table 4 illustrates the complementarity of the nucleotide sequences of BA108L7.2 BINDING SITE, designated SEQ ID:15814, to the nucleotide sequence of GAM30 RNA, herein designated GAM RNA, also designated SEQ ID:346.

Another function of GAM30 is therefore inhibition of BA108L7.2 (Accession NM_030971.1). Accordingly, utilities of GAM30 include diagnosis, prevention and treatment of diseases and clinical conditions associated with BA108L7.2.

Butyrophilin, subfamily 3, member a1 (BTN3A1, Accession NM_007048.2) is another GAM30 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:1769, to the nucleotide sequence of GAM30 RNA, herein designated GAM RNA, also designated SEQ ID:346.

Another function of GAM30 is therefore inhibition of Butyrophilin, subfamily 3, member a1 (BTN3A1, Accession NM_007048.2). Accordingly, utilities of GAM30 include diagnosis, prevention and treatment of diseases and clinical conditions associated with BTN3A1.

BY55 (Accession NM_007053.1) is another GAM30 target gene, herein designated TARGET GENE. BY55 BINDING SITE is a target binding site found in the 5' untranslated region of mRNA encoded by BY55, corresponding to a target binding site such as BINDING SITE I, BINDING SITE II or BINDING SITE III of FIG. 8. Table 4 illustrates the complementarity of the nucleotide sequences of BY55 BINDING SITE, designated SEQ ID:3163, to the nucleotide sequence of GAM30 RNA, herein designated GAM RNA, also designated SEQ ID:346.

Another function of GAM30 is therefore inhibition of BY55 (Accession NM_007053.1). Accordingly, utilities of GAM30 include diagnosis, prevention and treatment of diseases and clinical conditions associated with BY55.

Chromosome 22 open reading frame 19 (C22orf19, Accession NM_003678.2) is another GAM30 target gene, herein designated TARGET GENE. C22orf19 BINDING SITE is a target binding site found in the 3' untranslated region of mRNA encoded by C22orf19, corresponding to a target binding site such as BINDING SITE I, BINDING SITE II or BINDING SITE III of FIG. 8. Table 4 illustrates the complementarity of the nucleotide sequences of C22orf19 BINDING SITE, designated SEQ ID:2557, to the nucleotide sequence of GAM30 RNA, herein designated GAM RNA, also designated SEQ ID:346.

Another function of GAM30 is therefore inhibition of Chromosome 22 open reading frame 19 (C22orf19, Accession NM_003678.2). Accordingly, utilities of GAM30 include diagnosis, prevention and treatment of diseases and clinical conditions associated with C22orf19.

Cdc14 cell division cycle 14 homolog b (s. cerevisiae) (CDC14B, Accession NM_033332.1) is another GAM30 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:1166, to the nucleotide sequence of GAM30 RNA, herein designated GAM RNA, also designated SEQ ID:346.

Another function of GAM30 is therefore inhibition of Cdc14 cell division cycle 14 homolog b (s. cerevisiae) (CDC14B, Accession NM_033332.1). Accordingly, utilities of GAM30 include diagnosis, prevention and treatment of diseases and clinical conditions associated with CDC14B.

Cadherin 1, type 1, e-cadherin (epithelial) (CDH1, Accession NM_004360.2) is another GAM30 target gene, herein designated TARGET GENE. CDH1 BINDING SITE is a target binding site found in the 3' untranslated region of mRNA encoded by CDH1, corresponding to a target binding site such as BINDING SITE I, BINDING SITE II or BINDING SITE III of FIG. 8. Table 4 illustrates the complementarity of the nucleotide sequences of CDH1 BINDING SITE, designated SEQ ID:8905, to the nucleotide sequence of GAM30 RNA, herein designated GAM RNA, also designated SEQ ID:346.

Another function of GAM30 is therefore inhibition of Cadherin 1, type 1, e-cadherin (epithelial) (CDH1, Accession NM_004360.2). Accordingly, utilities of GAM30 include diagnosis, prevention and treatment of diseases and clinical conditions associated with CDH1.

Coronin, actin binding protein, 2b (CORO2B, Accession NM_006091.1) is another GAM30 target gene, herein designated TARGET GENE. CORO2B BINDING SITE is a target binding site found in the 5' untranslated region of mRNA encoded by CORO2B, corresponding to a target binding site such as BINDING SITE I, BINDING SITE II or BINDING SITE III of FIG. 8. Table 4 illustrates the complementarity of the nucleotide sequences of CORO2B BINDING SITE, designated SEQ ID:9083, to the nucleotide sequence of GAM30 RNA, herein designated GAM RNA, also designated SEQ ID:346.

Another function of GAM30 is therefore inhibition of Coronin, actin binding protein, 2b (CORO2B, Accession NM_006091.1), a gene which may play a role in the reorganization of neuronal actin structure. Accordingly, utilities of GAM30 include diagnosis, prevention and treatment of diseases and clinical conditions associated with CORO2B.

The function of CORO2B has been established by previous studies. The Dictyostelium actin-binding protein coronin accumulates at the leading edges of motile cells and in crown-shaped extensions on the dorsal cell surface. Coronin is involved in cell motility, cytokinesis, and phagocytosis, all of which depend on cytoskeletal rearrangement; see CORO1A (OMIM Ref. No. 605000). By screening a frontal cortex cDNA library with a brain-enriched clone showing similarity to Dictyostelium coronin, Nakamura et al. (1999) isolated a full-length cDNA encoding CORO2B, which they called CLIPINC. The predicted 475-amino acid CORO2B protein has an N-terminal domain containing 5 WD repeats and a succeeding domain with a tendency to form alpha helices. Northern blot analysis detected abundant expression of an approximately 4.0-kb CORO2B transcript in brain, with moderate expression in heart and ovary, and little or no expression in other tissues tested. In contrast, CORO1A is primarily expressed in immune system tissues, and CORO2A (OMIM Ref. No. 602159) is predominantly expressed in colon, prostate, and testis. Immunohistochemical analysis revealed Coro2a expression in mouse cerebral cortex, hippocampus, thalamus, olfactory bulb, and cerebellum, as well as in the inner nuclear layer of embryonic retina and embryonic olfactory bulb. Cosedimentation analysis demonstrated that CORO2B associates with F-actin. Immunofluorescence analysis indicated that CORO2B accumulates at neurite tips, at focal adhesions in association with VCL (OMIM Ref. No. 193065), and along stress fibers.

Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XIII. The complete sequences of 100 new cDNA clones from brain which code for large proteins in vitro. DNA Res. 6:63-70, 1999; and Nakamura, T.; Takeuchi, K.; Muraoka, S.; Takezoe, H.; Takahashi, N.; Mori, N.: A neurally enriched coronin-like protein, ClipnC, is a novel candidate for an actin cytoskeleton-cortical.

Further studies establishing the function and utilities of CORO2B are found in John Hopkins OMIM database record ID 605002, and in cited publications listed in Table 5, which are hereby incorporated by reference. Cytochrome p450, subfamily i (aromatic compound-inducible), polypeptide 2 (CYP1A2, Accession NM_000761.2) is another GAM30 target gene, herein designated TARGET GENE. CYP1A2 BINDING SITE is a target binding site found in the 3' untranslated region of mRNA encoded by CYP1A2, corresponding to a target binding site such as BINDING SITE I, BINDING SITE II or BINDING SITE III of FIG. 8. Table 4 illustrates the complementarity of the nucleotide sequences of CYP1A2 BINDING SITE, designated SEQ ID:12133, to the nucleotide sequence of GAM30 RNA, herein designated GAM RNA, also designated SEQ ID:346.

Another function of GAM30 is therefore inhibition of Cytochrome p450, subfamily i (aromatic compound-inducible), polypeptide 2 (CYP1A2, Accession NM_000761.2), a gene which intervenes in an NADPH-dependent electron transport pathway. and therefore may be associated with Porphyria cutanea tarda. Accordingly, utilities of GAM30 include diagnosis, prevention and treatment of Porphyria cutanea tarda, and of other diseases and clinical conditions associated with CYP1A2.

The function of CYP1A2 has been established by previous studies. P1-450 (CYP1A1; 108330) and P3-450 are 2 members of the dioxin-inducible P450 gene family. Jaiswal et al. (1987) determined the cDNA (3,064 bp) and protein (515 residues; M(r) =58,294) sequences of P3-450. They showed by study of somatic cell hybrids that both the P3-450 and the P1-450 loci reside on human chromosome 15. In the mouse and hamster, the 2 genes are located near the equivalent of the mannosephosphate isomerase (MPI) locus (OMIM Ref. No. 154550). The same may be true in man; MPI is located in the region 15q22-qter. The 2 CYP1 genes are within 25 kb of each other and probably are not separated by other genes (Nebert, 1988). The enzyme involved in O-deethylation of phenacetin is 1 of 9 forms of cytochrome P-450 that have been purified to electrophoretic homogeneity from human liver microsomes (Guengerich et al., 1986). Phenacetin O-deethylase differs from another cytochrome P-450 enzyme that shows genetic polymorphism, debrisoquine 4-hydroxylase (OMIM Ref. No. 124030), in molecular mass, amino acid composition, catalytic activity, and immunochemical properties. Butler et al. (1989) reviewed the evidence that phenacetin O-deethylase, otherwise known as P450(PA), is the product of the CYP1A2 gene. Devonshire et al. (1983) demonstrated a genetic polymorphism for phenacetin O-deethylation, with 5 to 10% of the population deficient in this activity. Cigarette smoking has been shown to increase microsomal phenacetin O-deethylase activity (Sesardic et al., 1988). Butler et al. (1989) reported that human hepatic microsomal caffeine 3-demethylation, the initial major step in caffeine biotransformation in humans, is selectively catalyzed by this cytochrome P-450. Estimation of caffeine 3-demethylation activity in humans may be useful in the characterization of arylamine N-oxidation phenotypes and in the assessment of whether or not the hepatic levels of this cytochrome, as affected by environmental or genetic factors, contribute to interindividual differences in susceptibility to arylamine-induced cancers. Smokers have been demonstrated to have increased rates of caffeine disposition, with plasma half lives one-half that of nonsmokers. Furthermore, rates of caffeine metabolism vary between individuals, as caffeine half-life values ranging from 1.5 to 9.5 hours have been reported. Buters et al. (1996) showed that in mice the clearance of caffeine is determined primarily by CYP1A2.

Full details of the abovementioned studies are described in the following publications, the disclosure of which are hereby incorporated by reference:

Butler, M. A.; Iwasaki, M.; Guengerich, F. P.; Kadlubar, F. F.: Human cytochrome P-450(PA) (P-450IA2), the phenacetin O-deethylase, is primarily responsible for the hepatic 3-demethylation of caffeine and N-oxidation of carcinogenic arylamines. Proc. Nat. Acad. Sci. 86:7696-7700, 1989; and Christiansen, L.; Bygum, A.; Jensen, A.; Thomsen, K.; Brandrup, F.; Horder, M.; Petersen, N. E.: Association between CYP1A2 polymorphism and susceptibility to porphyria cutanea tarda.

Further studies establishing the function and utilities of CYP1A2 are found in John Hopkins OMIM database record ID 124060, and in cited publications listed in Table 5, which are hereby incorporated by reference. Cytochrome p450, subfamily iib (phenobarbital-inducible), polypeptide 6 (CYP2B6, Accession NM_000767.3) is another GAM30 target gene, herein designated TARGET GENE. CYP2B6 BINDING SITE is a target binding site found in the 3' untranslated region of mRNA encoded by CYP2B6, corresponding to a target binding site such as BINDING SITE I, BINDING SITE II or BINDING SITE III of FIG. 8. Table 4 illustrates the complementarity of the nucleotide sequences of CYP2B6 BINDING SITE, designated SEQ ID:19432, to the nucleotide sequence of GAM30 RNA, herein designated GAM RNA, also designated SEQ ID:346.

Another function of GAM30 is therefore inhibition of Cytochrome p450, subfamily iib (phenobarbital-inducible), polypeptide 6 (CYP2B6, Accession NM_000767.3), a gene which oxidizes a variety of structurally unrelated compounds, including steroids, fatty acids, and xenobiotics. Accordingly, utilities of GAM30 include diagnosis, prevention and treatment of diseases and clinical conditions associated with CYP2B6.

The function of CYP2B6 has been established by previous studies. Thum and Borlak (2000) investigated the gene expression of major human cytochrome P450 genes in various regions of explanted hearts from 6 patients with dilated cardiomyopathy and 1 with transposition of the arterial trunk and 2 samples of normal heart. mRNA for cytochrome 2B6 was predominantly expressed in the right ventricle. A strong correlation between tissue-specific gene expression and enzyme activity was found. Thum and Borlak (2000) concluded that their findings showed that expression of genes for cytochrome P450 monooxgenases and verapamil metabolism are found predominantly in the right side of the heart, and suggested that this observation may explain the lack of efficacy of certain cardioselective drugs. Using a cloned cDNA that codes for a human ortholog of the phenobarbital-inducible cytochrome P450IIB subfamily in rodents, Santisteban et al. (1988) localized the CYP2B gene family to 19cen-q13.3 by Southern blot hybridization to DNA extracted from a panel of human-rodent somatic cell hybrids. Miles et al. (1988) established the chromosomal localization of the CYP2B gene subfamily to be 19q12-q13.2, close to the location of CYP2A (OMIM Ref. No. 123960), by Southern blot analysis of human-rodent somatic cell hybrids.

Full details of the abovementioned studies are described in the following publications, the disclosure of which are hereby incorporated by reference:

Santisteban, I.; Povey, S.; Shephard, E. A.; Phillips, I. R.: The major phenobarbital-inducible cytochrome P-450 gene subfamily (P450IIB) mapped to the long arm of human chromosome 19. Ann. Hum. Genet. 52:129-135, 1988; and Thum, T.; Borlak, J.: Gene expression in distinct regions of the heart. Lancet 355:979-983, 2000.

Further studies establishing the function and utilities of CYP2B6 are found in John Hopkins OMIM database record ID 605059, and in cited publications listed in Table 5, which are hereby incorporated by reference. Debranching enzyme homolog 1 (s. cerevisiae) (DBR1, Accession NM_016216.1) is another GAM30 target gene, herein designated TARGET GENE. DBR1 BINDING SITE is a target binding site found in the 3' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:13182, to the nucleotide sequence of GAM30 RNA, herein designated GAM RNA, also designated SEQ ID:346.

Another function of GAM30 is therefore inhibition of Debranching enzyme homolog 1 (s. cerevisiae) (DBR1, Accession NM_016216.1). Accordingly, utilities of GAM30 include diagnosis, prevention and treatment of diseases and clinical conditions associated with DBR1.

DCOHM (Accession NM_032151.2) is another GAM30 target gene, herein designated TARGET GENE. DCOHM BINDING SITE is a target binding site found in the 3' untranslated region of mRNA encoded by DCOHM, corresponding to a target binding site such as BINDING SITE I, BINDING SITE II or BINDING SITE III of FIG. 8. Table 4 illustrates the complementarity of the nucleotide sequences of DCOHM BINDING SITE, designated SEQ ID:5214, to the nucleotide sequence of GAM30 RNA, herein designated GAM RNA, also designated SEQ ID:346.

Another function of GAM30 is therefore inhibition of DCOHM (Accession NM_032151.2). Accordingly, utilities of GAM30 include diagnosis, prevention and treatment of diseases and clinical conditions associated with DCOHM.

DKFZP434C212 (Accession XM_044196.4) is another GAM30 target gene, herein designated TARGET GENE. DKFZP434C212 BINDING SITE is a target binding site found in the 5' untranslated region of mRNA encoded by DKFZP434C212, corresponding to a target binding site such as BINDING SITE I, BINDING SITE II or BINDING SITE III of FIG. 8. Table 4 illustrates the complementarity of the nucleotide sequences of DKFZP434C212 BINDING SITE, designated SEQ ID:19580, to the nucleotide sequence of GAM30 RNA, herein designated GAM RNA, also designated SEQ ID:346.

Another function of GAM30 is therefore inhibition of DKFZP434C212 (Accession XM_044196.4). Accordingly, utilities of GAM30 include diagnosis, prevention and treatment of diseases and clinical conditions associated with DKFZP434C212.

DKFZp761N1114 (Accession XM_086327.6) is another GAM30 target gene, herein designated TARGET GENE. DKFZp761N1114 BINDING SITE is a target binding site found in the 3' untranslated region of mRNA encoded by DKFZp761N1114, corresponding to a target binding site such as BINDING SITE I, BINDING SITE II or BINDING SITE III of FIG. 8. Table 4 illustrates the complementarity of the nucleotide sequences of DKFZp761N1114 BINDING SITE, designated SEQ ID:1969, to the nucleotide sequence of GAM30 RNA, herein designated GAM RNA, also designated SEQ ID:346.

Another function of GAM30 is therefore inhibition of DKFZp761N1114 (Accession XM_086327.6). Accordingly, utilities of GAM30 include diagnosis, prevention and treatment of diseases and clinical conditions associated with DKFZp761N1114.

Desmocollin 3 (DSC3, Accession NM_001941.2) is another GAM30 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:17152, to the nucleotide sequence of GAM30 RNA, herein designated GAM RNA, also designated SEQ ID:346.

Another function of GAM30 is therefore inhibition of Desmocollin 3 (DSC3, Accession NM_001941.2), a gene which is a component of intercellular desmosome junctions. Accordingly, utilities of GAM30 include diagnosis, prevention and treatment of diseases and clinical conditions associated with DSC3.

The function of DSC3 has been established by previous studies. From a bladder carcinoma cell line cDNA library, Kawamura et al. (1994) cloned a human cDNA encoding for a novel transmembrane protein. Sequence analysis revealed an open reading frame of 2,691 bp encoding a protein of 896 amino acids. Sequence comparisons showed significant homology to desmocollins, intercellular adhesion molecules belonging to the cadherin superfamily. The protein consisted of a signal peptide of 30 amino acids, a precursor segment of 105 amino acids, and a mature protein of 761 amino acids. Antibodies recognizing the predicted mature adhesion molecule of the protein stained antigens along the cell boundaries of normal human keratinocytes resembling the pattern of desmosome localization. Kawamura et al. (1994) concluded that the clone represented a new member of the desmocollin family and tentatively referred to it as desmocollin type 4. King et al. (1995) used the designation DSC3 for a gene encoding a desmocollin present in human foreskin epidermis and stated that the gene is identical to that encoding the desmocollin isolated from a bladder carcinoma cell line and called DSC4 by Kawamura et al. (1994). They likewise mapped the gene to chromosome 18 by PCR analysis of rodent/human somatic cell hybrids. They stated that the cDNA sequence showed 67% amino acid identity with the original human desmocollin, designated DSC2, and 52% amino acid identity with DSC1. By in situ hybridization studies, they showed that DSC1 was not present in any of the nonkeratinizing human epithelia, such as buccal mucosa, cervix, and esophagus, whereas all these internal epithelia expressed DSC2 and DSC3 and were present in most of the living layers of tissues, including the basal layers.

Full details of the abovementioned studies are described in the following publications, the disclosure of which are hereby incorporated by reference:

Kawamura, K.; Watanabe, K.; Suzuki, T.; Yamakawa, T.; Kamiyama, T.; Nakagawa, H.; Tsurufuji, S.: cDNA cloning and expression of a novel human desmocollin. J. Biol. Chem. 269:26295-26302, 1994; and King, I. A.; Sullivan, K. H.; Bennett, R., Jr.; Buxton, R. S.: The desmocollins of human foreskin epidermis: identification and chromosomal assignment of a third gene and expression p.

Further studies establishing the function and utilities of DSC3 are found in John Hopkins OMIM database record ID 600271, and in cited publications listed in Table 5, which are hereby incorporated by reference. Ecotropic viral integration site 5 (EVI5, Accession NM_005665.2) is another GAM30 target gene, herein designated TARGET GENE. EVI5 BINDING SITE is a target binding site found in the 3' untranslated region of mRNA encoded by EVI5, corresponding to a target binding site such as BINDING SITE I, BINDING SITE II or BINDING SITE III of FIG. 8. Table 4 illustrates the complementarity of the nucleotide sequences of EVI5 BINDING SITE, designated SEQ ID:12844, to the nucleotide sequence of GAM30 RNA, herein designated GAM RNA, also designated SEQ ID:346.

Another function of GAM30 is therefore inhibition of Ecotropic viral integration site 5 (EVI5, Accession NM_005665.2). Accordingly, utilities of GAM30 include diagnosis, prevention and treatment of diseases and clinical conditions associated with EVI5.

Fasciculation and elongation protein zeta 1 (zygin i) (FEZ1, Accession NM_005103.3) is another GAM30 target gene, herein designated TARGET GENE. FEZ1 BINDING SITE is a target binding site found in the 3' untranslated region of multiple transcripts of mRNA encoded by FEZ1, corresponding to a target binding site such as BINDING SITE I, BINDING SITE II or BINDING SITE III of FIG. 8. Table 4 illustrates the complementarity of the nucleotide sequences of FEZ1 BINDING SITE, designated SEQ ID:14745, to the nucleotide sequence of GAM30 RNA, herein designated GAM RNA, also designated SEQ ID:346.

Another function of GAM30 is therefore inhibition of Fasciculation and elongation protein zeta 1 (zygin i) (FEZ1, Accession NM_005103.3), a gene which Zygin 1; may have a role in axonal outgrowth; has similarity to C. elegans UNC-76. Accordingly, utilities of GAM30 include diagnosis, prevention and treatment of diseases and clinical conditions associated with FEZ1.

The function of FEZ1 has been established by previous studies. Ishii et al. (1999) positionally cloned and characterized the FEZ1/LZTS1 (leucine zipper, putative tumor suppressor-1) gene at 8p22, a region that is lost in many tumors, including prostate, breast, head and neck, esophageal, and urinary bladder carcinomas. The predicted FEZ1 protein contained a leucine-zipper region with similarity to the DNA-binding domain of the cAMP-responsive activating transcription factor-5 (OMIM Ref. No. 606398). Northern blot analysis revealed that FEZ2 is expressed almost ubiquitously in normal tissues, although expression is most abundant in testes. FEZ1 expression was undetectable in more than 60% of epithelial tumors, but FEZ1 mutations were found in primary esophageal cancers and in a prostate cancer cell line. Transcript analysis from several FEZ1-expressing tumors revealed truncated mRNAs, including a frameshift. Alteration and inactivation of the FEZ1 gene may play a role in various human tumors. Ishii et al. (2001) showed that introduction of FEZ1/LZTS1 into FEZ1/LZTS1-negative cancer cells resulted in suppression of tumorigenicity and reduced cell growth with accumulation of cells at late S-G2/M stage of the cell cycle. Their data showed that FEZ1/LZTS1 inhibits cancer cell growth through regulation of mitosis, and that its alterations result in abnormal cell growth. Ishii et al. (1999) analyzed the nucleotide sequence of the FEZ1 gene open reading frame in 194 cancers, including 72 primary esophageal cancers. They found a point mutation in 2 primary esophageal cancers and in a prostate cancer cell line.

Full details of the abovementioned studies are described in the following publications, the disclosure of which are hereby incorporated by reference:

Ishii, H.; Baffa, R.; Numata, S.-I.; Murakumo, Y.; Rattan, S.; Inoue, H.; Mori, M.; Fidanza, V.; Alder, H.; Croce, C. M.: The FEZ1 gene at chromosome 8p22 encodes a leucine-zipper protein, and its expression is altered in multiple human tumors. Proc. Nat. Acad. Sci. 96:3928-3933, 1999; and Ishii, H.; Vecchione, A.; Murakumo, Y.; Baldassarre, G.; Numata, S.; Trapasso, F.; Alder, H.; Baffa, R.; Croce, C. M.: FEZ1/LZTS1 gene at 8p22 suppresses cancer cell growth and regula.

Further studies establishing the function and utilities of FEZ1 are found in John Hopkins OMIM database record ID 606551, and in cited publications listed in Table 5, which are hereby incorporated by reference. FLJ10101 (Accession NM_024718.1) is another GAM30 target gene, herein designated TARGET GENE. FLJ10101 BINDING SITE is a target binding site found in the 3' untranslated region of mRNA encoded by FLJ10101, corresponding to a target binding site such as BINDING SITE I, BINDING SITE II or BINDING SITE III of FIG. 8. Table 4 illustrates the complementarity of the nucleotide sequences of FLJ10101 BINDING SITE, designated SEQ ID:8594, to the nucleotide sequence of GAM30 RNA, herein designated GAM RNA, also designated SEQ ID:346.

Another function of GAM30 is therefore inhibition of FLJ10101 (Accession NM_024718.1). Accordingly, utilities of GAM30 include diagnosis, prevention and treatment of diseases and clinical conditions associated with FLJ10101.

FLJ10232 (Accession NM_018033.1) is another GAM30 target gene, herein designated TARGET GENE. FLJ10232 BINDING SITE is a target binding site found in the 3' untranslated region of mRNA encoded by FLJ10232, corresponding to a target binding site such as BINDING SITE I, BINDING SITE II or BINDING SITE III of FIG. 8. Table 4 illustrates the complementarity of the nucleotide sequences of FLJ10232 BINDING SITE, designated SEQ ID:1399, to the nucleotide sequence of GAM30 RNA, herein designated GAM RNA, also designated SEQ ID:346.

Another function of GAM30 is therefore inhibition of FLJ10232 (Accession NM_018033.1). Accordingly, utilities of GAM30 include diagnosis, prevention and treatment of diseases and clinical conditions associated with FLJ10232.

FLJ10297 (Accession) is another GAM30 target gene, herein designated TARGET GENE. FLJ10297 BINDING SITE is a target binding site found in the 3' untranslated region of mRNA encoded by FLJ10297, corresponding to a target binding site such as BINDING SITE I, BINDING SITE II or BINDING SITE III of FIG. 8. Table 4 illustrates the complementarity of the nucleotide sequences of FLJ10297 BINDING SITE, designated SEQ ID:2525, to the nucleotide sequence of GAM30 RNA, herein designated GAM RNA, also designated SEQ ID:346.

Another function of GAM30 is therefore inhibition of FLJ10297 (Accession). Accordingly, utilities of GAM30 include diagnosis, prevention and treatment of diseases and clinical conditions associated with FLJ10297.

FLJ13072 (Accession XM_117117.2) is another GAM30 target gene, herein designated TARGET GENE. FLJ13072 BINDING SITE is a target binding site found in the 5' untranslated region of mRNA encoded by FLJ13072, corresponding to a target binding site such as BINDING SITE I, BINDING SITE II or BINDING SITE III of FIG. 8. Table 4 illustrates the complementarity of the nucleotide sequences of FLJ13072 BINDING SITE, designated SEQ ID:17545, to the nucleotide sequence of GAM30 RNA, herein designated GAM RNA, also designated SEQ ID:346.

Another function of GAM30 is therefore inhibition of FLJ13072 (Accession XM_117117.2). Accordingly, utilities of GAM30 include diagnosis, prevention and treatment of diseases and clinical conditions associated with FLJ13072.

FLJ13456 (Accession XM_038291.5) is another GAM30 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:4252, to the nucleotide sequence of GAM30 RNA, herein designated GAM RNA, also designated SEQ ID:346.

Another function of GAM30 is therefore inhibition of FLJ13456 (Accession XM_038291.5). Accordingly, utilities of GAM30 include diagnosis, prevention and treatment of diseases and clinical conditions associated with FLJ13456.

FLJ14803 (Accession NM_032842.1) is another GAM30 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:9230, to the nucleotide sequence of GAM30 RNA, herein designated GAM RNA, also designated SEQ ID:346.

Another function of GAM30 is therefore inhibition of FLJ14803 (Accession NM_032842.1). Accordingly, utilities of GAM30 include diagnosis, prevention and treatment of diseases and clinical conditions associated with FLJ14803.

FLJ20147 (Accession NM_017687.1) is another GAM30 target gene, herein designated TARGET GENE. FLJ20147 BINDING SITE is a target binding site found in the 3' untranslated region of mRNA encoded by FLJ20147, corresponding to a target binding site such as BINDING SITE I, BINDING SITE II or BINDING SITE III of FIG. 8. Table 4 illustrates the complementarity of the nucleotide sequences of FLJ20147 BINDING SITE, designated SEQ ID:1636, to the nucleotide sequence of GAM30 RNA, herein designated GAM RNA, also designated SEQ ID:346.

Another function of GAM30 is therefore inhibition of FLJ20147 (Accession NM_017687.1). Accordingly, utilities of GAM30 include diagnosis, prevention and treatment of diseases and clinical conditions associated with FLJ20147.

FLJ20344 (Accession NM_017776.1) is another GAM30 target gene, herein designated TARGET GENE. FLJ20344 BINDING SITE is a target binding site found in the 3' untranslated region of mRNA encoded by FLJ20344, corresponding to a target binding site such as BINDING SITE I, BINDING SITE II or BINDING SITE III of FIG. 8. Table 4 illustrates the complementarity of the nucleotide sequences of FLJ20344 BINDING SITE, designated SEQ ID:3352, to the nucleotide sequence of GAM30 RNA, herein designated GAM RNA, also designated SEQ ID:346.

Another function of GAM30 is therefore inhibition of FLJ20344 (Accession NM_017776.1). Accordingly, utilities of GAM30 include diagnosis, prevention and treatment of diseases and clinical conditions associated with FLJ20344.

FLJ23024 (Accession NM_014150.1) is another GAM30 target gene, herein designated TARGET GENE. FLJ23024 BINDING SITE is a target binding site found in the 3' untranslated region of mRNA encoded by FLJ23024, corresponding to a target binding site such as BINDING SITE I, BINDING SITE II or BINDING SITE III of FIG. 8. Table 4 illustrates the complementarity of the nucleotide sequences of FLJ23024 BINDING SITE, designated SEQ ID:13913, to the nucleotide sequence of GAM30 RNA, herein designated GAM RNA, also designated SEQ ID:346.

Another function of GAM30 is therefore inhibition of FLJ23024 (Accession NM_014150.1). Accordingly, utilities of GAM30 include diagnosis, prevention and treatment of diseases and clinical conditions associated with FLJ23024.

FLJ32894 (Accession NM_144667.1) is another GAM30 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:16385, to the nucleotide sequence of GAM30 RNA, herein designated GAM RNA, also designated SEQ ID:346.

Another function of GAM30 is therefore inhibition of FLJ32894 (Accession NM_144667.1). Accordingly, utilities of GAM30 include diagnosis, prevention and treatment of diseases and clinical conditions associated with FLJ32894.

Fucosyltransferase 1 (galactoside 2-alpha-l-fucosyltransferase, bombay phenotype included) (FUT1, Accession NM_000148.1) is another GAM30 target gene, herein designated TARGET GENE. FUT1 BINDING SITE is a target binding site found in the 3' untranslated region of mRNA encoded by FUT1, corresponding to a target binding site such as BINDING SITE I, BINDING SITE II or BINDING SITE III of FIG. 8. Table 4 illustrates the complementarity of the nucleotide sequences of FUT1 BINDING SITE, designated SEQ ID:18831, to the nucleotide sequence of GAM30 RNA, herein designated GAM RNA, also designated SEQ ID:346.

Another function of GAM30 is therefore inhibition of Fucosyltransferase 1 (galactoside 2-alpha-l-fucosyltransferase, bombay phenotype included) (FUT1, Accession NM_000148.1). Accordingly, utilities of GAM30 include diagnosis, prevention and treatment of diseases and clinical conditions associated with FUT1.

GMPPB (Accession NM_021971.1) is another GAM30 target gene, herein designated TARGET GENE. GMPPB BINDING SITE is a target binding site found in the 5' untranslated region of multiple transcripts of mRNA encoded by GMPPB, corresponding to a target binding site such as BINDING SITE I, BINDING SITE II or BINDING SITE III of FIG. 8. Table 4 illustrates the complementarity of the nucleotide sequences of GMPPB BINDING SITE, designated SEQ ID:4133, to the nucleotide sequence of GAM30 RNA, herein designated GAM RNA, also designated SEQ ID:346.

Another function of GAM30 is therefore inhibition of GMPPB (Accession NM_021971.1). Accordingly, utilities of GAM30 include diagnosis, prevention and treatment of diseases and clinical conditions associated with GMPPB.

Glycoprotein v (platelet) (GP5, Accession NM_004488.1) is another GAM30 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:17377, to the nucleotide sequence of GAM30 RNA, herein designated GAM RNA, also designated SEQ ID:346.

Another function of GAM30 is therefore inhibition of Glycoprotein v (platelet) (GP5, Accession NM_004488.1). Accordingly, utilities of GAM30 include diagnosis, prevention and treatment of diseases and clinical conditions associated with GP5.

G protein-coupled receptor 81 (GPR81, Accession NM_032554.2) is another GAM30 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:10820, to the nucleotide sequence of GAM30 RNA, herein designated GAM RNA, also designated SEQ ID:346.

Another function of GAM30 is therefore inhibition of G protein-coupled receptor 81 (GPR81, Accession NM_032554.2). Accordingly, utilities of GAM30 include diagnosis, prevention and treatment of diseases and clinical conditions associated with GPR81.

Interferon (alpha, beta and omega) receptor 2 (IFNAR2, Accession NM_000874.2) is another GAM30 target gene, herein designated TARGET GENE. IFNAR2 BINDING SITE is a target binding site found in the 3' untranslated region of mRNA encoded by IFNAR2, corresponding to a target binding site such as BINDING SITE I, BINDING SITE II or BINDING SITE III of FIG. 8. Table 4 illustrates the complementarity of the nucleotide sequences of IFNAR2 BINDING SITE, designated SEQ ID:15858, to the nucleotide sequence of GAM30 RNA, herein designated GAM RNA, also designated SEQ ID:346.

Another function of GAM30 is therefore inhibition of Interferon (alpha, beta and omega) receptor 2 (IFNAR2, Accession NM_000874.2), a gene which is a receptor for interferons alpha and beta. Accordingly, utilities of GAM30 include diagnosis, prevention and treatment of diseases and clinical conditions associated with IFNAR2.

The function of IFNAR2 has been established by previous studies. Alpha-type antiviral protein is a factor, presumably protein in nature, that mediates specific interferon inhibition of virus replication. According to studies of mouse-man hybrid clones, the locus determining this protein is carried on chromosome 21 (Tan et al., 1973). Tan et al. (1974) made observations of dosage effect in monosomy-21 and trisomy-21 cells which supported assignment of the locus to chromosome 21. This character was also called interferon sensitivity (IS). Chany et al. (1975) showed that trisomy-21 cells have increased interferon sensitivity. Trisomy-16 cells have reduced sensitivity. This might suggest the presence on chromosome 16 of a regulator of mouse antiviral protein. Reve et al. (1976) showed that antibody to a cell surface component coded by human chromosome 21 inhibited the action of interferon. This suggested that antiviral protein is an interferon receptor. See 147570, 147640, 147660 for a discussion of the gamma, beta, and alpha interferons, respectively. De Clercq et al. (1976) concluded that it is not a cell membrane receptor for interferon that is encoded by chromosome 21 Raziuddin et al. (1984) showed that the receptors for alpha- and beta-interferons are specified by chromosome 21. It was presumed that separate genes encoded the alpha- and beta-interferon receptors. Novick et al. (1994) described a universal ligand-binding receptor for human interferons alpha and interferon beta. Sarkar and Gupta (1984) showed that gamma-interferon binds to a separate receptor that is carried by WISH cells (a human amnion cell line). The gene for the receptor was designated also IFNAR. Langer et al. (1990) sublocalized the IFNAR gene to 21q22.1-q22.2 by hybridization of (32)P-labeled recombinant interferon-alpha/beta receptor with human-hamster somatic cell hybrids containing various fragments of human chromosome 21. By in situ hybridization, Lutfalla et al. (1990) refined the assignment to 21q22.1. Lutfalla et al. (1992) further refined the localization by pulsed field gel electrophoresis and its linkage to adjacent markers. They compared the exon structure of the IFNAR gene with that of the genes for receptors of the cytokine/growth hormone/prolactin/interferon receptor family and concluded that they have a common origin and have diverged from the immunoglobulin superfamily with which they share a common ancestor. Cellular responses to cytokines involve cross-communication through their respective receptors. The IFNs alpha, beta, and gamma mediate innate immune responses to viral infection through IFNAR1/IFNAR2 (OMIM Ref. No. 602376) for IFNA and IFNB, and IFNGR1 (OMIM Ref. No. 107470)/IFNGR2 (OMIM Ref. No. 147569) for IFNG. Stimulation of these receptors activates Janus protein kinases (e.g., JAK1, 147795 and JAK2, 147796), which leads to the tyrosine phosphorylation of STAT1 (OMIM Ref. No. 600555) and STAT2 (OMIM Ref. No. 600556). Although the IFN receptors are expressed at low levels in cells, they may be clustered in the cell membrane to permit efficient signal transduction. Using mouse embryonic fibroblasts (MEFs) from IFNAR1- and IFNGR1-deficient mice, Takaoka et al. (2000) observed that the STAT1-mediated DNA-binding activity and the antiviral response to IFNG in IFNAR-null MEFs but not to IFNA in IFNGR-null MEFs are impaired. Restoration of the IFNG response requires constitutive subthreshold IFNA/IFNB signaling and an intact IFNAR1 capable of interacting with STAT1 after tyrosine phosphorylation. Immunoblot analysis showed that IFNAR1 coimmunoprecipitated with the nonligand-binding component, IFNGR2, of the IFNGR complex in wildtype MEFs but less well in IFNB-null MEFs. Immunoblot analysis also demonstrated that the IFN receptor components are exclusively localized in the caveolar membrane fractions (see OMIM Ref. No. CAV1; 601047) where there is a concentration of cytoplasmically oriented signaling molecules.

Full details of the abovementioned studies are described in the following publications, the disclosure of which are hereby incorporated by reference:

Takaoka, A.; Mitani, Y.; Suemori, H.; Sato, M.; Yokochi, T.; Noguchi, S.; Tanaka, N.; Taniguchi, T.: Cross talk between interferon-gamma and -alpha/beta signaling components in caveolar membrane domains. Science 288:2357-2360, 2000; and Novick, D.; Cohen, B.; Rubinstein, M.: The human interferon alpha/beta receptor: characterization and molecular cloning. Cell 77:391-400, 1994.

Further studies establishing the function and utilities of IFNAR2 are found in John Hopkins OMIM database record ID 602376, and in cited publications listed in Table 5, which are hereby incorporated by reference. IL22R (Accession) is another GAM30 target gene, herein designated TARGET GENE. IL22R BINDING SITE is a target binding site found in the 3' untranslated region of mRNA encoded by IL22R, corresponding to a target binding site such as BINDING SITE I, BINDING SITE II or BINDING SITE III of FIG. 8. Table 4 illustrates the complementarity of the nucleotide sequences of IL22R BINDING SITE, designated SEQ ID:3063, to the nucleotide sequence of GAM30 RNA, herein designated GAM RNA, also designated SEQ ID:346.

Another function of GAM30 is therefore inhibition of IL22R (Accession). Accordingly, utilities of GAM30 include diagnosis, prevention and treatment of diseases and clinical conditions associated with IL22R.

JM11 (Accession NM_033626.1) is another GAM30 target gene, herein designated TARGET GENE. JM11 BINDING SITE is a target binding site found in the 3' untranslated region of mRNA encoded by JM11, corresponding to a target binding site such as BINDING SITE I, BINDING SITE II or BINDING SITE III of FIG. 8. Table 4 illustrates the complementarity of the nucleotide sequences of JM11 BINDING SITE, designated SEQ ID:19790, to the nucleotide sequence of GAM30 RNA, herein designated GAM RNA, also designated SEQ ID:346.

Another function of GAM30 is therefore inhibition of JM11 (Accession NM_033626.1). Accordingly, utilities of GAM30 include diagnosis, prevention and treatment of diseases and clinical conditions associated with JM11.

KIAA0924 (Accession NM_014897.1) is another GAM30 target gene, herein designated TARGET GENE. KIAA0924 BINDING SITE is a target binding site found in the 3' untranslated region of mRNA encoded by KIAA0924, corresponding to a target binding site such as BINDING SITE I, BINDING SITE II or BINDING SITE III of FIG. 8. Table 4 illustrates the complementarity of the nucleotide sequences of KIAA0924 BINDING SITE, designated SEQ ID:8885, to the nucleotide sequence of GAM30 RNA, herein designated GAM RNA, also designated SEQ ID:346.

Another function of GAM30 is therefore inhibition of KIAA0924 (Accession NM_014897.1). Accordingly, utilities of GAM30 include diagnosis, prevention and treatment of diseases and clinical conditions associated with KIAA0924.

KIAA0931 (Accession XM_041191.4) is another GAM30 target gene, herein designated TARGET GENE. KIAA0931 BINDING SITE is a target binding site found in the 3' untranslated region of mRNA encoded by KIAA0931, corresponding to a target binding site such as BINDING SITE I, BINDING SITE II or BINDING SITE III of FIG. 8. Table 4 illustrates the complementarity of the nucleotide sequences of KIAA0931 BINDING SITE, designated SEQ ID:17048, to the nucleotide sequence of GAM30 RNA, herein designated GAM RNA, also designated SEQ ID:346.

Another function of GAM30 is therefore inhibition of KIAA0931 (Accession XM_041191.4). Accordingly, utilities of GAM30 include diagnosis, prevention and treatment of diseases and clinical conditions associated with KIAA0931.

KIAA1028 (Accession) is another GAM30 target gene, herein designated TARGET GENE. KIAA1028 BINDING SITE is a target binding site found in the 3' untranslated region of mRNA encoded by KIAA1028, corresponding to a target binding site such as BINDING SITE I, BINDING SITE II or BINDING SITE III of FIG. 8. Table 4 illustrates the complementarity of the nucleotide sequences of KIAA1028 BINDING SITE, designated SEQ ID:7839, to the nucleotide sequence of GAM30 RNA, herein designated GAM RNA, also designated SEQ ID:346.

Another function of GAM30 is therefore inhibition of KIAA1028 (Accession). Accordingly, utilities of GAM30 include diagnosis, prevention and treatment of diseases and clinical conditions associated with KIAA1028.

KIAA1209 (Accession XM_027307.2) is another GAM30 target gene, herein designated TARGET GENE. KIAA1209 BINDING SITE is a target binding site found in the 3' untranslated region of mRNA encoded by KIAA1209, corresponding to a target binding site such as BINDING SITE I, BINDING SITE II or BINDING SITE III of FIG. 8. Table 4 illustrates the complementarity of the nucleotide sequences of KIAA1209 BINDING SITE, designated SEQ ID:11820, to the nucleotide sequence of GAM30 RNA, herein designated GAM RNA, also designated SEQ ID:346.

Another function of GAM30 is therefore inhibition of KIAA1209 (Accession XM_027307.2). Accordingly, utilities of GAM30 include diagnosis, prevention and treatment of diseases and clinical conditions associated with KIAA1209.

KIAA1443 (Accession NM_020834.1) is another GAM30 target gene, herein designated TARGET GENE. KIAA1443 BINDING SITE is a target binding site found in the 3' untranslated region of mRNA encoded by KIAA1443, corresponding to a target binding site such as BINDING SITE I, BINDING SITE II or BINDING SITE III of FIG. 8. Table 4 illustrates the complementarity of the nucleotide sequences of KIAA1443 BINDING SITE, designated SEQ ID:10360, to the nucleotide sequence of GAM30 RNA, herein designated GAM RNA, also designated SEQ ID:346.

Another function of GAM30 is therefore inhibition of KIAA1443 (Accession NM_020834.1). Accordingly, utilities of GAM30 include diagnosis, prevention and treatment of diseases and clinical conditions associated with KIAA1443.

KIAA1530 (Accession XM_042661.5) is another GAM30 target gene, herein designated TARGET GENE. KIAA1530 BINDING SITE is a target binding site found in the 3' untranslated region of mRNA encoded by KIAA1530, corresponding to a target binding site such as BINDING SITE I, BINDING SITE II or BINDING SITE III of FIG. 8. Table 4 illustrates the complementarity of the nucleotide sequences of KIAA1530 BINDING SITE, designated SEQ ID:10234, to the nucleotide sequence of GAM30 RNA, herein designated GAM RNA, also designated SEQ ID:346.

Another function of GAM30 is therefore inhibition of KIAA1530 (Accession XM_042661.5). Accordingly, utilities of GAM30 include diagnosis, prevention and treatment of diseases and clinical conditions associated with KIAA1530.

KIAA1615 (Accession NM_020951.1) is another GAM30 target gene, herein designated TARGET GENE. KIAA1615 BINDING SITE is a target binding site found in the 3' untranslated region of mRNA encoded by KIAA1615, corresponding to a target binding site such as BINDING SITE I, BINDING SITE II or BINDING SITE III of FIG. 8. Table 4 illustrates the complementarity of the nucleotide sequences of KIAA1615 BINDING SITE, designated SEQ ID:11333, to the nucleotide sequence of GAM30 RNA, herein designated GAM RNA, also designated SEQ ID:346.

Another function of GAM30 is therefore inhibition of KIAA1615 (Accession NM_020951.1). Accordingly, utilities of GAM30 include diagnosis, prevention and treatment of diseases and clinical conditions associated with KIAA1615.

KIAA1671 (Accession XM_037809.3) is another GAM30 target gene, herein designated TARGET GENE. KIAA1671 BINDING SITE is a target binding site found in the 3' untranslated region of mRNA encoded by KIAA1671, corresponding to a target binding site such as BINDING SITE I, BINDING SITE II or BINDING SITE III of FIG. 8. Table 4 illustrates the complementarity of the nucleotide sequences of KIAA1671 BINDING SITE, designated SEQ ID:6380, to the nucleotide sequence of GAM30 RNA, herein designated GAM RNA, also designated SEQ ID:346.

Another function of GAM30 is therefore inhibition of KIAA1671 (Accession XM_037809.3). Accordingly, utilities of GAM30 include diagnosis, prevention and treatment of diseases and clinical conditions associated with KIAA1671.

KIAA1755 (Accession XM_028810.4) is another GAM30 target gene, herein designated TARGET GENE. KIAA1755 BINDING SITE is a target binding site found in the 3' untranslated region of mRNA encoded by KIAA1755, corresponding to a target binding site such as BINDING SITE I, BINDING SITE II or BINDING SITE III of FIG. 8. Table 4 illustrates the complementarity of the nucleotide sequences of KIAA1755 BINDING SITE, designated SEQ ID:14311, to the nucleotide sequence of GAM30 RNA, herein designated GAM RNA, also designated SEQ ID:346.

Another function of GAM30 is therefore inhibition of KIAA1755 (Accession XM_028810.4). Accordingly, utilities of GAM30 include diagnosis, prevention and treatment of diseases and clinical conditions associated with KIAA1755.

KIAA1971 (Accession XM_058720.5) is another GAM30 target gene, herein designated TARGET GENE. KIAA1971 BINDING SITE is a target binding site found in the 3' untranslated region of mRNA encoded by KIAA1971, corresponding to a target binding site such as BINDING SITE I, BINDING SITE II or BINDING SITE III of FIG. 8. Table 4 illustrates the complementarity of the nucleotide sequences of KIAA1971 BINDING SITE, designated SEQ ID:16931, to the nucleotide sequence of GAM30 RNA, herein designated GAM RNA, also designated SEQ ID:346.

Another function of GAM30 is therefore inhibition of KIAA1971 (Accession XM_058720.5). Accordingly, utilities of GAM30 include diagnosis, prevention and treatment of diseases and clinical conditions associated with KIAA1971.

Kynurenine 3-monooxygenase (kynurenine 3-hydroxylase) (KMO, Accession NM_003679.1) is another GAM30 target gene, herein designated TARGET GENE. KMO BINDING SITE is a target binding site found in the 3' untranslated region of mRNA encoded by KMO, corresponding to a target binding site such as BINDING SITE I, BINDING SITE II or BINDING SITE III of FIG. 8. Table 4 illustrates the complementarity of the nucleotide sequences of KMO BINDING SITE, designated SEQ ID:4388, to the nucleotide sequence of GAM30 RNA, herein designated GAM RNA, also designated SEQ ID:346.

Another function of GAM30 is therefore inhibition of Kynurenine 3-monooxygenase (kynurenine 3-hydroxylase) (KMO, Accession NM_003679.1), a gene which may play a role in encephalic photoreception. Accordingly, utilities of GAM30 include diagnosis, prevention and treatment of diseases and clinical conditions associated with KMO.

The function of KMO has been established by previous studies. Kynurenine 3-monooxygenase (KMO; EC 1.14.13.9) is an NADPH-dependent flavin monooxygenase that catalyzes the hydroxylation of the L-tryptophan metabolite L-kynurenine to form L-3-hydroxykynurenine. By screening a human liver cDNA library with a partial Drosophila KMO cDNA, Alberati-Giani et al. (1997) isolated cDNAs encoding human KMO. The predicted 486-amino acid human protein shares 47% sequence identity with Drosophila KMO. When expressed in mammalian cells, recombinant human KMO exhibited kinetic properties similar to those of the native human protein. Northern blot analysis revealed that human KMO is expressed as an approximately 2-kb mRNA in liver and placenta, and at lower levels in kidney. By comparing genomic and cDNA sequences, Halford et al. (2001) determined that the KMO gene contains at least 15 exons spanning approximately 68 kb. By genomic sequence analysis, Halford et al. (2001) determined that the KMO gene overlaps with the OPN3 gene (OMIM Ref. No. 606695) on chromosome 1q43 and that the 2 genes are transcribed from opposite strands.

Full details of the abovementioned studies are described in the following publications, the disclosure of which are hereby incorporated by reference:

Alberati-Giani, D.; Cesura, A. M.; Broger, C.; Warren, W. D.; Rover, S.; Malherbe, P.: Cloning and functional expression of human kynurenine 3-monooxygenase. FEBS Lett. 410:407-412, 1997; and Halford, S.; Freedman, M. S.; Bellingham, J.; Inglis, S. L.; Poopalasundaram, S.; Soni, B. G.; Foster, R. G.; Hunt, D. M.: Characterization of a novel human opsin gene with wide tissue.

Further studies establishing the function and utilities of KMO are found in John Hopkins OMIM database record ID 603538, and in cited publications listed in Table 5, which are hereby incorporated by reference. Leukocyte immunoglobulin-like receptor, subfamily a (without tm domain), member 3 (LILRA3, Accession NM_006865.1) is another GAM30 target gene, herein designated TARGET GENE. LILRA3 BINDING SITE is a target binding site found in the 3' untranslated region of mRNA encoded by LILRA3, corresponding to a target binding site such as BINDING SITE I, BINDING SITE II or BINDING SITE III of FIG. 8. Table 4 illustrates the complementarity of the nucleotide sequences of LILRA3 BINDING SITE, designated SEQ ID:6616, to the nucleotide sequence of GAM30 RNA, herein designated GAM RNA, also designated SEQ ID:346.

Another function of GAM30 is therefore inhibition of Leukocyte immunoglobulin-like receptor, subfamily a (without tm domain), member 3 (LILRA3, Accession NM_006865.1). Accordingly, utilities of GAM30 include diagnosis, prevention and treatment of diseases and clinical conditions associated with LILRA3.

LOC112687 (Accession XM_053145.2) is another GAM30 target gene, herein designated TARGET GENE. LOC112687 BINDING SITE is a target binding site found in the 3' untranslated region of mRNA encoded by LOC112687, corresponding to a target binding site such as BINDING SITE I, BINDING SITE II or BINDING SITE III of FIG. 8. Table 4 illustrates the complementarity of the nucleotide sequences of LOC112687 BINDING SITE, designated SEQ ID:17001, to the nucleotide sequence of GAM30 RNA, herein designated GAM RNA, also designated SEQ ID:346.

Another function of GAM30 is therefore inhibition of LOC112687 (Accession XM_053145.2). Accordingly, utilities of GAM30 include diagnosis, prevention and treatment of diseases and clinical conditions associated with LOC112687.

LOC112724 (Accession) is another GAM30 target gene, herein designated TARGET GENE. LOC112724 BINDING SITE is a target binding site found in the 5' untranslated region of mRNA encoded by LOC112724, corresponding to a target binding site such as BINDING SITE I, BINDING SITE II or BINDING SITE III of FIG. 8. Table 4 illustrates the complementarity of the nucleotide sequences of LOC112724 BINDING SITE, designated SEQ ID:18154, to the nucleotide sequence of GAM30 RNA, herein designated GAM RNA, also designated SEQ ID:346.

Another function of GAM30 is therefore inhibition of LOC112724 (Accession). Accordingly, utilities of GAM30 include diagnosis, prevention and treatment of diseases and clinical conditions associated with LOC112724.

LOC120114 (Accession) is another GAM30 target gene, herein designated TARGET GENE. LOC120114 BINDING SITE is a target binding site found in the 3' untranslated region of mRNA encoded by LOC120114, corresponding to a target binding site such as BINDING SITE I, BINDING SITE II or BINDING SITE III of FIG. 8. Table 4 illustrates the complementarity of the nucleotide sequences of LOC120114 BINDING SITE, designated SEQ ID:3066, to the nucleotide sequence of GAM30 RNA, herein designated GAM RNA, also designated SEQ ID:346.

Another function of GAM30 is therefore inhibition of LOC120114 (Accession). Accordingly, utilities of GAM30 include diagnosis, prevention and treatment of diseases and clinical conditions associated with LOC120114.

LOC126669 (Accession XM_060121.4) is another GAM30 target gene, herein designated TARGET GENE. LOC126669 BINDING SITE is a target binding site found in the 3' untranslated region of mRNA encoded by LOC126669, corresponding to a target binding site such as BINDING SITE I, BINDING SITE II or BINDING SITE III of FIG. 8. Table 4 illustrates the complementarity of the nucleotide sequences of LOC126669 BINDING SITE, designated SEQ ID:2535, to the nucleotide sequence of GAM30 RNA, herein designated GAM RNA, also designated SEQ ID:346.

Another function of GAM30 is therefore inhibition of LOC126669 (Accession XM_060121.4). Accordingly, utilities of GAM30 include diagnosis, prevention and treatment of diseases and clinical conditions associated with LOC126669.

LOC130813 (Accession XM_065904.2) is another GAM30 target gene, herein designated TARGET GENE. LOC130813 BINDING SITE is a target binding site found in the 3' untranslated region of mRNA encoded by LOC130813, corresponding to a target binding site such as BINDING SITE I, BINDING SITE II or BINDING SITE III of FIG. 8. Table 4 illustrates the complementarity of the nucleotide sequences of LOC130813 BINDING SITE, designated SEQ ID:9431, to the nucleotide sequence of GAM30 RNA, herein designated GAM RNA, also designated SEQ ID:346.

Another function of GAM30 is therefore inhibition of LOC130813 (Accession XM_065904.2). Accordingly, utilities of GAM30 include diagnosis, prevention and treatment of diseases and clinical conditions associated with LOC130813.

LOC131308 (Accession) is another GAM30 target gene, herein designated TARGET GENE. LOC131308 BINDING SITE is a target binding site found in the 3' untranslated region of mRNA encoded by LOC131308, corresponding to a target binding site such as BINDING SITE I, BINDING SITE II or BINDING SITE III of FIG. 8. Table 4 illustrates the complementarity of the nucleotide sequences of LOC131308 BINDING SITE, designated SEQ ID:19649, to the nucleotide sequence of GAM30 RNA, herein designated GAM RNA, also designated SEQ ID:346.

Another function of GAM30 is therefore inhibition of LOC131308 (Accession). Accordingly, utilities of GAM30 include diagnosis, prevention and treatment of diseases and clinical conditions associated with LOC131308.

LOC144317 (Accession XM_084813.4) is another GAM30 target gene, herein designated TARGET GENE. LOC144317 BINDING SITE is a target binding site found in the 5' untranslated region of mRNA encoded by LOC144317, corresponding to a target binding site such as BINDING SITE I, BINDING SITE II or BINDING SITE III of FIG. 8. Table 4 illustrates the complementarity of the nucleotide sequences of LOC144317 BINDING SITE, designated SEQ ID:10860, to the nucleotide sequence of GAM30 RNA, herein designated GAM RNA, also designated SEQ ID:346.

Another function of GAM30 is therefore inhibition of LOC144317 (Accession XM_084813.4). Accordingly, utilities of GAM30 include diagnosis, prevention and treatment of diseases and clinical conditions associated with LOC144317.

LOC144776 (Accession XM_084964.1) is another GAM30 target gene, herein designated TARGET GENE. LOC144776 BINDING SITE is a target binding site found in the 5' untranslated region of mRNA encoded by LOC144776, corresponding to a target binding site such as BINDING SITE I, BINDING SITE II or BINDING SITE III of FIG. 8. Table 4 illustrates the complementarity of the nucleotide sequences of LOC144776 BINDING SITE, designated SEQ ID:12238, to the nucleotide sequence of GAM30 RNA, herein designated GAM RNA, also designated SEQ ID:346.

Another function of GAM30 is therefore inhibition of LOC144776 (Accession XM_084964.1). Accordingly, utilities of GAM30 include diagnosis, prevention and treatment of diseases and clinical conditions associated with LOC144776.

LOC145725 (Accession XM_085211.7) is another GAM30 target gene, herein designated TARGET GENE. LOC145725 BINDING SITE is a target binding site found in the 3' untranslated region of mRNA encoded by LOC145725, corresponding to a target binding site such as BINDING SITE I, BINDING SITE II or BINDING SITE III of FIG. 8. Table 4 illustrates the complementarity of the nucleotide sequences of LOC145725 BINDING SITE, designated SEQ ID:18697, to the nucleotide sequence of GAM30 RNA, herein designated GAM RNA, also designated SEQ ID:346.

Another function of GAM30 is therefore inhibition of LOC145725 (Accession XM_085211.7). Accordingly, utilities of GAM30 include diagnosis, prevention and treatment of diseases and clinical conditions associated with LOC145725.

LOC146894 (Accession NM_145273.1) is another GAM30 target gene, herein designated TARGET GENE. LOC146894 BINDING SITE is a target binding site found in the 3' untranslated region of mRNA encoded by LOC146894, corresponding to a target binding site such as BINDING SITE I, BINDING SITE II or BINDING SITE III of FIG. 8. Table 4 illustrates the complementarity of the nucleotide sequences of LOC146894 BINDING SITE, designated SEQ ID:2861, to the nucleotide sequence of GAM30 RNA, herein designated GAM RNA, also designated SEQ ID:346.

Another function of GAM30 is therefore inhibition of LOC146894 (Accession NM_145273.1). Accordingly, utilities of GAM30 include diagnosis, prevention and treatment of diseases and clinical conditions associated with LOC146894.

LOC147660 (Accession) is another GAM30 target gene, herein designated TARGET GENE. LOC147660 BINDING SITE is a target binding site found in the 3' untranslated region of mRNA encoded by LOC147660, corresponding to a target binding site such as BINDING SITE I, BINDING SITE II or BINDING SITE III of FIG. 8. Table 4 illustrates the complementarity of the nucleotide sequences of LOC147660 BINDING SITE, designated SEQ ID:10444, to the nucleotide sequence of GAM30 RNA, herein designated GAM RNA, also designated SEQ ID:346.

Another function of GAM30 is therefore inhibition of LOC147660 (Accession). Accordingly, utilities of GAM30 include diagnosis, prevention and treatment of diseases and clinical conditions associated with LOC147660.

LOC147817 (Accession XM_085903.2) is another GAM30 target gene, herein designated TARGET GENE. LOC147817 BINDING SITE is a target binding site found in the 3' untranslated region of mRNA encoded by LOC147817, corresponding to a target binding site such as BINDING SITE I, BINDING SITE II or BINDING SITE III of FIG. 8. Table 4 illustrates the complementarity of the nucleotide sequences of LOC147817 BINDING SITE, designated SEQ ID:1405, to the nucleotide sequence of GAM30 RNA, herein designated GAM RNA, also designated SEQ ID:346.

Another function of GAM30 is therefore inhibition of LOC147817 (Accession XM_085903.2). Accordingly, utilities of GAM30 include diagnosis, prevention and treatment of diseases and clinical conditions associated with LOC147817.

LOC147841 (Accession XM_085924.6) is another GAM30 target gene, herein designated TARGET GENE. LOC147841 BINDING SITE is a target binding site found in the 3' untranslated region of mRNA encoded by LOC147841, corresponding to a target binding site such as BINDING SITE I, BINDING SITE II or BINDING SITE III of FIG. 8. Table 4 illustrates the complementarity of the nucleotide sequences of LOC147841 BINDING SITE, designated SEQ ID:9060, to the nucleotide sequence of GAM30 RNA, herein designated GAM RNA, also designated SEQ ID:346.

Another function of GAM30 is therefore inhibition of LOC147841 (Accession XM_085924.6). Accordingly, utilities of GAM30 include diagnosis, prevention and treatment of diseases and clinical conditions associated with LOC147841.

LOC148137 (Accession NM_144692.1) is another GAM30 target gene, herein designated TARGET GENE. LOC148137 BINDING SITE is a target binding site found in the 5' untranslated region of mRNA encoded by LOC148137, corresponding to a target binding site such as BINDING SITE I, BINDING SITE II or BINDING SITE III of FIG. 8. Table 4 illustrates the complementarity of the nucleotide sequences of LOC148137 BINDING SITE, designated SEQ ID:4235, to the nucleotide sequence of GAM30 RNA, herein designated GAM RNA, also designated SEQ ID:346.

Another function of GAM30 is therefore inhibition of LOC148137 (Accession NM_144692.1). Accordingly, utilities of GAM30 include diagnosis, prevention and treatment of diseases and clinical conditions associated with LOC148137.

LOC149506 (Accession XM_097661.4) is another GAM30 target gene, herein designated TARGET GENE. LOC149506 BINDING SITE is a target binding site found in the 3' untranslated region of mRNA encoded by LOC149506, corresponding to a target binding site such as BINDING SITE I, BINDING SITE II or BINDING SITE III of FIG. 8. Table 4 illustrates the complementarity of the nucleotide sequences of LOC149506 BINDING SITE, designated SEQ ID:13189, to the nucleotide sequence of GAM30 RNA, herein designated GAM RNA, also designated SEQ ID:346.

Another function of GAM30 is therefore inhibition of LOC149506 (Accession XM_097661.4). Accordingly, utilities of GAM30 include diagnosis, prevention and treatment of diseases and clinical conditions associated with LOC149506.

LOC149577 (Accession) is another GAM30 target gene, herein designated TARGET GENE. LOC149577 BINDING SITE is a target binding site found in the 3' untranslated region of mRNA encoded by LOC149577, corresponding to a target binding site such as BINDING SITE I, BINDING SITE II or BINDING SITE III of FIG. 8. Table 4 illustrates the complementarity of the nucleotide sequences of LOC149577 BINDING SITE, designated SEQ ID:14550, to the nucleotide sequence of GAM30 RNA, herein designated GAM RNA, also designated SEQ ID:346.

Another function of GAM30 is therefore inhibition of LOC149577 (Accession). Accordingly, utilities of GAM30 include diagnosis, prevention and treatment of diseases and clinical conditions associated with LOC149577.

LOC150225 (Accession XM_097870.1) is another GAM30 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:4075, to the nucleotide sequence of GAM30 RNA, herein designated GAM RNA, also designated SEQ ID:346.

Another function of GAM30 is therefore inhibition of LOC150225 (Accession XM_097870.1). Accordingly, utilities of GAM30 include diagnosis, prevention and treatment of diseases and clinical conditions associated with LOC150225.

LOC150397 (Accession XM_086907.1) is another GAM30 target gene, herein designated TARGET GENE. LOC150397 BINDING SITE is a target binding site found in the 3' untranslated region of mRNA encoded by LOC150397, corresponding to a target binding site such as BINDING SITE I, BINDING SITE II or BINDING SITE III of FIG. 8. Table 4 illustrates the complementarity of the nucleotide sequences of LOC150397 BINDING SITE, designated SEQ ID:2564, to the nucleotide sequence of GAM30 RNA, herein designated GAM RNA, also designated SEQ ID:346.

Another function of GAM30 is therefore inhibition of LOC150397 (Accession XM_086907.1). Accordingly, utilities of GAM30 include diagnosis, prevention and treatment of diseases and clinical conditions associated with LOC150397.

LOC150407 (Accession XM_086906.1) is another GAM30 target gene, herein designated TARGET GENE. LOC150407 BINDING SITE is a target binding site found in the 3' untranslated region of mRNA encoded by LOC150407, corresponding to a target binding site such as BINDING SITE I, BINDING SITE II or BINDING SITE III of FIG. 8. Table 4 illustrates the complementarity of the nucleotide sequences of LOC150407 BINDING SITE, designated SEQ ID:7870, to the nucleotide sequence of GAM30 RNA, herein designated GAM RNA, also designated SEQ ID:346.

Another function of GAM30 is therefore inhibition of LOC150407 (Accession XM_086906.1). Accordingly, utilities of GAM30 include diagnosis, prevention and treatment of diseases and clinical conditions associated with LOC150407.

LOC151195 (Accession) is another GAM30 target gene, herein designated TARGET GENE. LOC151195 BINDING SITE is a target binding site found in the 3' untranslated region of mRNA encoded by LOC151195, corresponding to a target binding site such as BINDING SITE I, BINDING SITE II or BINDING SITE III of FIG. 8. Table 4 illustrates the complementarity of the nucleotide sequences of LOC151195 BINDING SITE, designated SEQ ID:11539, to the nucleotide sequence of GAM30 RNA, herein designated GAM RNA, also designated SEQ ID:346.

Another function of GAM30 is therefore inhibition of LOC151195 (Accession). Accordingly, utilities of GAM30 include diagnosis, prevention and treatment of diseases and clinical conditions associated with LOC151195.

LOC151201 (Accession XM_098021.1) is another GAM30 target gene, herein designated TARGET GENE. LOC151201 BINDING SITE is a target binding site found in the 3' untranslated region of mRNA encoded by LOC151201, corresponding to a target binding site such as BINDING SITE I, BINDING SITE II or BINDING SITE III of FIG. 8. Table 4 illustrates the complementarity of the nucleotide sequences of LOC151201 BINDING SITE, designated SEQ ID:8212, to the nucleotide sequence of GAM30 RNA, herein designated GAM RNA, also designated SEQ ID:346.

Another function of GAM30 is therefore inhibition of LOC151201 (Accession XM_098021.1). Accordingly, utilities of GAM30 include diagnosis, prevention and treatment of diseases and clinical conditions associated with LOC151201.

LOC151475 (Accession XM_098063.1) is another GAM30 target gene, herein designated TARGET GENE. LOC151475 BINDING SITE is a target binding site found in the 5' untranslated region of mRNA encoded by LOC151475, corresponding to a target binding site such as BINDING SITE I, BINDING SITE II or BINDING SITE III of FIG. 8. Table 4 illustrates the complementarity of the nucleotide sequences of LOC151475 BINDING SITE, designated SEQ ID:9643, to the nucleotide sequence of GAM30 RNA, herein designated GAM RNA, also designated SEQ ID:346.

Another function of GAM30 is therefore inhibition of LOC151475 (Accession XM_098063.1). Accordingly, utilities of GAM30 include diagnosis, prevention and treatment of diseases and clinical conditions associated with LOC151475.

LOC152220 (Accession) is another GAM30 target gene, herein designated TARGET GENE. LOC152220 BINDING SITE is a target binding site found in the 3' untranslated region of mRNA encoded by LOC152220, corresponding to a target binding site such as BINDING SITE I, BINDING SITE II or BINDING SITE III of FIG. 8. Table 4 illustrates the complementarity of the nucleotide sequences of LOC152220 BINDING SITE, designated SEQ ID:13105, to the nucleotide sequence of GAM30 RNA, herein designated GAM RNA, also designated SEQ ID:346.

Another function of GAM30 is therefore inhibition of LOC152220 (Accession). Accordingly, utilities of GAM30 include diagnosis, prevention and treatment of diseases and clinical conditions associated with LOC152220.

LOC152245 (Accession XM_098182.1) is another GAM30 target gene, herein designated TARGET GENE. LOC152245 BINDING SITE is a target binding site found in the 3' untranslated region of mRNA encoded by LOC152245, corresponding to a target binding site such as BINDING SITE I, BINDING SITE II or BINDING SITE III of FIG. 8. Table 4 illustrates the complementarity of the nucleotide sequences of LOC152245 BINDING SITE, designated SEQ ID:8742, to the nucleotide sequence of GAM30 RNA, herein designated GAM RNA, also designated SEQ ID:346.

Another function of GAM30 is therefore inhibition of LOC152245 (Accession XM_098182.1). Accordingly, utilities of GAM30 include diagnosis, prevention and treatment of diseases and clinical conditions associated with LOC152245.

LOC152851 (Accession) is another GAM30 target gene, herein designated TARGET GENE. LOC152851 BINDING SITE is a target binding site found in the 3' untranslated region of mRNA encoded by LOC152851, corresponding to a target binding site such as BINDING SITE I, BINDING SITE II or BINDING SITE III of FIG. 8. Table 4 illustrates the complementarity of the nucleotide sequences of LOC152851 BINDING SITE, designated SEQ ID:3475, to the nucleotide sequence of GAM30 RNA, herein designated GAM RNA, also designated SEQ ID:346.

Another function of GAM30 is therefore inhibition of LOC152851 (Accession). Accordingly, utilities of GAM30 include diagnosis, prevention and treatment of diseases and clinical conditions associated with LOC152851.

LOC153910 (Accession XM_087801.1) is another GAM30 target gene, herein designated TARGET GENE. LOC153910 BINDING SITE is a target binding site found in the 5' untranslated region of mRNA encoded by LOC153910, corresponding to a target binding site such as BINDING SITE I, BINDING SITE II or BINDING SITE III of FIG. 8. Table 4 illustrates the complementarity of the nucleotide sequences of LOC153910 BINDING SITE, designated SEQ ID:18292, to the nucleotide sequence of GAM30 RNA, herein designated GAM RNA, also designated SEQ ID:346.

Another function of GAM30 is therefore inhibition of LOC153910 (Accession XM_087801.1). Accordingly, utilities of GAM30 include diagnosis, prevention and treatment of diseases and clinical conditions associated with LOC153910.

LOC154877 (Accession XM_098626.4) is another GAM30 target gene, herein designated TARGET GENE. LOC154877 BINDING SITE is a target binding site found in the 3' untranslated region of mRNA encoded by LOC154877, corresponding to a target binding site such as BINDING SITE I, BINDING SITE II or BINDING SITE III of FIG. 8. Table 4 illustrates the complementarity of the nucleotide sequences of LOC154877 BINDING SITE, designated SEQ ID:19686, to the nucleotide sequence of GAM30 RNA, herein designated GAM RNA, also designated SEQ ID:346.

Another function of GAM30 is therefore inhibition of LOC154877 (Accession XM_098626.4). Accordingly, utilities of GAM30 include diagnosis, prevention and treatment of diseases and clinical conditions associated with LOC154877.

LOC196264 (Accession XM_113683.2) is another GAM30 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:1093, to the nucleotide sequence of GAM30 RNA, herein designated GAM RNA, also designated SEQ ID:346.

Another function of GAM30 is therefore inhibition of LOC196264 (Accession XM_113683.2). Accordingly, utilities of GAM30 include diagnosis, prevention and treatment of diseases and clinical conditions associated with LOC196264.

LOC199899 (Accession XM_117153.2) is another GAM30 target gene, herein designated TARGET GENE. LOC199899 BINDING SITE is a target binding site found in the 5' untranslated region of mRNA encoded by LOC199899, corresponding to a target binding site such as BINDING SITE I, BINDING SITE II or BINDING SITE III of FIG. 8. Table 4 illustrates the complementarity of the nucleotide sequences of LOC199899 BINDING SITE, designated SEQ ID:3354, to the nucleotide sequence of GAM30 RNA, herein designated GAM RNA, also designated SEQ ID:346.

Another function of GAM30 is therefore inhibition of LOC199899 (Accession XM_117153.2). Accordingly, utilities of GAM30 include diagnosis, prevention and treatment of diseases and clinical conditions associated with LOC199899.

LOC199906 (Accession XM_114052.1) is another GAM30 target gene, herein designated TARGET GENE. LOC199906 BINDING SITE is a target binding site found in the 3' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:4862, to the nucleotide sequence of GAM30 RNA, herein designated GAM RNA, also designated SEQ ID:346.

Another function of GAM30 is therefore inhibition of LOC199906 (Accession XM_114052.1). Accordingly, utilities of GAM30 include diagnosis, prevention and treatment of diseases and clinical conditions associated with LOC199906.

LOC200316 (Accession) is another GAM30 target gene, herein designated TARGET GENE. LOC200316 BINDING SITE is a target binding site found in the 3' untranslated region of mRNA encoded by LOC200316, corresponding to a target binding site such as BINDING SITE I, BINDING SITE II or BINDING SITE III of FIG. 8. Table 4 illustrates the complementarity of the nucleotide sequences of LOC200316 BINDING SITE, designated SEQ ID:737, to the nucleotide sequence of GAM30 RNA, herein designated GAM RNA, also designated SEQ ID:346.

Another function of GAM30 is therefore inhibition of LOC200316 (Accession). Accordingly, utilities of GAM30 include diagnosis, prevention and treatment of diseases and clinical conditions associated with LOC200316.

LOC201294 (Accession XM_113950.4) is another GAM30 target gene, herein designated TARGET GENE. LOC201294 BINDING SITE is a target binding site found in the 3' untranslated region of mRNA encoded by LOC201294, corresponding to a target binding site such as BINDING SITE I, BINDING SITE II or BINDING SITE III of FIG. 8. Table 4 illustrates the complementarity of the nucleotide sequences of LOC201294 BINDING SITE, designated SEQ ID:10229, to the nucleotide sequence of GAM30 RNA, herein designated GAM RNA, also designated SEQ ID:346.

Another function of GAM30 is therefore inhibition of LOC201294 (Accession XM_113950.4). Accordingly, utilities of GAM30 include diagnosis, prevention and treatment of diseases and clinical conditions associated with LOC201294.

LOC203297 (Accession) is another GAM30 target gene, herein designated TARGET GENE. LOC203297 BINDING SITE is a target binding site found in the 5' untranslated region of mRNA encoded by LOC203297, corresponding to a target binding site such as BINDING SITE I, BINDING SITE II or BINDING SITE III of FIG. 8. Table 4 illustrates the complementarity of the nucleotide sequences of LOC203297 BINDING SITE, designated SEQ ID:10855, to the nucleotide sequence of GAM30 RNA, herein designated GAM RNA, also designated SEQ ID:346.

Another function of GAM30 is therefore inhibition of LOC203297 (Accession). Accordingly, utilities of GAM30 include diagnosis, prevention and treatment of diseases and clinical conditions associated with LOC203297.

LOC219731 (Accession XM_167596.2) is another GAM30 target gene, herein designated TARGET GENE. LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:6006, to the nucleotide sequence of GAM30 RNA, herein designated GAM RNA, also designated SEQ ID:346.

Another function of GAM30 is therefore inhibition of LOC219731 (Accession XM_167596.2). Accordingly, utilities of GAM30 include diagnosis, prevention and treatment of diseases and clinical conditions associated with LOC219731.

LOC220074 (Accession NM_145309.1) is another GAM30 target gene, herein designated TARGET GENE. LOC220074 BINDING SITE is a target binding site found in the 5' untranslated region of mRNA encoded by LOC220074, corresponding to a target binding site such as BINDING SITE I, BINDING SITE II or BINDING SITE III of FIG. 8. Table 4 illustrates the complementarity of the nucleotide sequences of LOC220074 BINDING SITE, designated SEQ ID:18789, to the nucleotide sequence of GAM30 RNA, herein designated GAM RNA, also designated SEQ ID:346.

Another function of GAM30 is therefore inhibition of LOC220074 (Accession NM_145309.1). Accordingly, utilities of GAM30 include diagnosis, prevention and treatment of diseases and clinical conditions associated with LOC220074.

LOC220846 (Accession) is another GAM30 target gene, herein designated TARGET GENE. LOC220846 BINDING SITE is a target binding site found in the 3' untranslated region of mRNA encoded by LOC220846, corresponding to a target binding site such as BINDING SITE I, BINDING SITE II or BINDING SITE III of FIG. 8. Table 4 illustrates the complementarity of the nucleotide sequences of LOC220846 BINDING SITE, designated SEQ ID:17037, to the nucleotide sequence of GAM30 RNA, herein designated GAM RNA, also designated SEQ ID:346.

Another function of GAM30 is therefore inhibition of LOC220846 (Accession). Accordingly, utilities of GAM30 include diagnosis, prevention and treatment of diseases and clinical conditions associated with LOC220846.

LOC221035 (Accession XM_167640.4) is another GAM30 target gene, herein designated TARGET GENE. LOC221035 BINDING SITE is a target binding site found in the 5' untranslated region of mRNA encoded by LOC221035, corresponding to a target binding site such as BINDING SITE I, BINDING SITE II or BINDING SITE III of FIG. 8. Table 4 illustrates the complementarity of the nucleotide sequences of LOC221035 BINDING SITE, designated SEQ ID:10230, to the nucleotide sequence of GAM30 RNA, herein designated GAM RNA, also designated SEQ ID:346.

Another function of GAM30 is therefore inhibition of LOC221035 (Accession XM_167640.4). Accordingly, utilities of GAM30 include diagnosis, prevention and treatment of diseases and clinical conditions associated with LOC221035.

LOC221122 (Accession XM_167867.3) is another GAM30 target gene, herein designated TARGET GENE. LOC221122 BINDING SITE is a target binding site found in the 3' untranslated region of mRNA encoded by LOC221122, corresponding to a target binding site such as BINDING SITE I, BINDING SITE II or BINDING SITE III of FIG. 8. Table 4 illustrates the complementarity of the nucleotide sequences of LOC221122 BINDING SITE, designated SEQ ID:8153, to the nucleotide sequence of GAM30 RNA, herein designated GAM RNA, also designated SEQ ID:346.

Another function of GAM30 is therefore inhibition of LOC221122 (Accession XM_167867.3). Accordingly, utilities of GAM30 include diagnosis, prevention and treatment of diseases and clinical conditions associated with LOC221122.

LOC221271 (Accession) is another GAM30 target gene, herein designated TARGET GENE. LOC221271 BINDING SITE is a target binding site found in the 3' untranslated region of mRNA encoded by LOC221271, corresponding to a target binding site such as BINDING SITE I, BINDING SITE II or BINDING SITE III of FIG. 8. Table 4 illustrates the complementarity of the nucleotide sequences of LOC221271 BINDING SITE, designated SEQ ID:11173, to the nucleotide sequence of GAM30 RNA, herein designated GAM RNA, also designated SEQ ID:346.

Another function of GAM30 is therefore inhibition of LOC221271 (Accession). Accordingly, utilities of GAM30 include diagnosis, prevention and treatment of diseases and clinical conditions associated with LOC221271.

LOC221814 (Accession XM_168226.1) is another GAM30 target gene, herein designated TARGET GENE. LOC221814 BINDING SITE is a target binding site found in the 5' untranslated region of mRNA encoded by LOC221814, corresponding to a target binding site such as BINDING SITE I, BINDING SITE II or BINDING SITE III of FIG. 8. Table 4 illustrates the complementarity of the nucleotide sequences of LOC221814 BINDING SITE, designated SEQ ID:7134, to the nucleotide sequence of GAM30 RNA, herein designated GAM RNA, also designated SEQ ID:346.

Another function of GAM30 is therefore inhibition of LOC221814 (Accession XM_168226.1). Accordingly, utilities of GAM30 include diagnosis, prevention and treatment of diseases and clinical conditions associated with LOC221814.

LOC221960 (Accession XM_165859.1) is another GAM30 target gene, herein designated TARGET GENE. LOC221960 BINDING SITE is a target binding site found in the 3' untranslated region of mRNA encoded by LOC221960, corresponding to a target binding site such as BINDING SITE I, BINDING SITE II or BINDING SITE III of FIG. 8. Table 4 illustrates the complementarity of the nucleotide sequences of LOC221960 BINDING SITE, designated SEQ ID:5655, to the nucleotide sequence of GAM30 RNA, herein designated GAM RNA, also designated SEQ ID:346.

Another function of GAM30 is therefore inhibition of LOC221960 (Accession XM_165859.1). Accordingly, utilities of GAM30 include diagnosis, prevention and treatment of diseases and clinical conditions associated with LOC221960.

LOC222070 (Accession) is another GAM30 target gene, herein designated TARGET GENE. LOC222070 BINDING SITE is a target binding site found in the 5' untranslated region of mRNA encoded by LOC222070, corresponding to a target binding site such as BINDING SITE I, BINDING SITE II or BINDING SITE III of FIG. 8. Table 4 illustrates the complementarity of the nucleotide sequences of LOC222070 BINDING SITE, designated SEQ ID:3096, to the nucleotide sequence of GAM30 RNA, herein designated GAM RNA, also designated SEQ ID:346.

Another function of GAM30 is therefore inhibition of LOC222070 (Accession). Accordingly, utilities of GAM30 include diagnosis, prevention and treatment of diseases and clinical conditions associated with LOC222070.

LOC254082 (Accession) is another GAM30 target gene, herein designated TARGET GENE. LOC254082 BINDING SITE is a target binding site found in the 5' untranslated region of mRNA encoded by LOC254082, corresponding to a target binding site such as BINDING SITE I, BINDING SITE II or BINDING SITE III of FIG. 8. Table 4 illustrates the complementarity of the nucleotide sequences of LOC254082 BINDING SITE, designated SEQ ID:6592, to the nucleotide sequence of GAM30 RNA, herein designated GAM RNA, also designated SEQ ID:346.

Another function of GAM30 is therefore inhibition of LOC254082 (Accession). Accordingly, utilities of GAM30 include diagnosis, prevention and treatment of diseases and clinical conditions associated with LOC254082.

LOC254381 (Accession) is another GAM30 target gene, herein designated TARGET GENE. LOC254381 BINDING SITE is a target binding site found in the 5' untranslated region of mRNA encoded by LOC254381, corresponding to a target binding site such as BINDING SITE I, BINDING SITE II or BINDING SITE III of FIG. 8. Table 4 illustrates the complementarity of the nucleotide sequences of LOC254381 BINDING SITE, designated SEQ ID:5429, to the nucleotide sequence of GAM30 RNA, herein designated GAM RNA, also designated SEQ ID:346.

Another function of GAM30 is therefore inhibition of LOC254381 (Accession). Accordingly, utilities of GAM30 include diagnosis, prevention and treatment of diseases and clinical conditions associated with LOC254381.

LOC255196 (Accession) is another GAM30 target gene, herein designated TARGET GENE. LOC255196 BINDING SITE is a target binding site found in the 5' untranslated region of mRNA encoded by LOC255196, corresponding to a target binding site such as BINDING SITE I, BINDING SITE II or BINDING SITE III of FIG. 8. Table 4 illustrates the complementarity of the nucleotide sequences of LOC255196 BINDING SITE, designated SEQ ID:6253, to the nucleotide sequence of GAM30 RNA, herein designated GAM RNA, also designated SEQ ID:346.

Another function of GAM30 is therefore inhibition of LOC255196 (Accession). Accordingly, utilities of GAM30 include diagnosis, prevention and treatment of diseases and clinical conditions associated with LOC255196.

LOC256221 (Accession) is another GAM30 target gene, herein designated TARGET GENE. LOC256221 BINDING SITE is a target binding site found in the 3' untranslated region of mRNA encoded by LOC256221, corresponding to a target binding site such as BINDING SITE I, BINDING SITE II or BINDING SITE III of FIG. 8. Table 4 illustrates the complementarity of the nucleotide sequences of LOC256221 BINDING SITE, designated SEQ ID:19801, to the nucleotide sequence of GAM30 RNA, herein designated GAM RNA, also designated SEQ ID:346.

Another function of GAM30 is therefore inhibition of LOC256221 (Accession). Accordingly, utilities of GAM30 include diagnosis, prevention and treatment of diseases and clinical conditions associated with LOC256221.

LOC257465 (Accession) is another GAM30 target gene, herein designated TARGET GENE. LOC257465 BINDING SITE is a target binding site found in the 3' untranslated region of mRNA encoded by LOC257465, corresponding to a target binding site such as BINDING SITE I, BINDING SITE II or BINDING SITE III of FIG. 8. Table 4 illustrates the complementarity of the nucleotide sequences of LOC257465 BINDING SITE, designated SEQ ID:8329, to the nucleotide sequence of GAM30 RNA, herein designated GAM RNA, also designated SEQ ID:346.

Another function of GAM30 is therefore inhibition of LOC257465 (Accession). Accordingly, utilities of GAM30 include diagnosis, prevention and treatment of diseases and clinical conditions associated with LOC257465.

LOC51031 (Accession) is another GAM30 target gene, herein designated TARGET GENE. LOC51031 BINDING SITE is a target binding site found in the 5' untranslated region of mRNA encoded by LOC51031, corresponding to a target binding site such as BINDING SITE I, BINDING SITE II or BINDING SITE III of FIG. 8. Table 4 illustrates the complementarity of the nucleotide sequences of LOC51031 BINDING SITE, designated SEQ ID:20151, to the nucleotide sequence of GAM30 RNA, herein designated GAM RNA, also designated SEQ ID:346.

Another function of GAM30 is therefore inhibition of LOC51031 (Accession). Accordingly, utilities of GAM30 include diagnosis, prevention and treatment of diseases and clinical conditions associated with LOC51031.

LOC51336 (Accession NM_016646.1) is another GAM30 target gene, herein designated TARGET GENE. LOC51336 BINDING SITE is a target binding site found in the 3' untranslated region of mRNA encoded by LOC51336, corresponding to a target binding site such as BINDING SITE I, BINDING SITE II or BINDING SITE III of FIG. 8. Table 4 illustrates the complementarity of the nucleotide sequences of LOC51336 BINDING SITE, designated SEQ ID:4139, to the nucleotide sequence of GAM30 RNA, herein designated GAM RNA, also designated SEQ ID:346.

Another function of GAM30 is therefore inhibition of LOC51336 (Accession NM_016646.1). Accordingly, utilities of GAM30 include diagnosis, prevention and treatment of diseases and clinical conditions associated with LOC51336.

LOC90155 (Accession) is another GAM30 target gene, herein designated TARGET GENE. LOC90155 BINDING SITE is a target binding site found in the 3' untranslated region of mRNA encoded by LOC90155, corresponding to a target binding site such as BINDING SITE I, BINDING SITE II or BINDING SITE III of FIG. 8. Table 4 illustrates the complementarity of the nucleotide sequences of LOC90155 BINDING SITE, designated SEQ ID:12504, to the nucleotide sequence of GAM30 RNA, herein designated GAM RNA, also designated SEQ ID:346.

Another function of GAM30 is therefore inhibition of LOC90155 (Accession). Accordingly, utilities of GAM30 include diagnosis, prevention and treatment of diseases and clinical conditions associated with LOC90155.

LOC91661 (Accession NM_138372.1) is another GAM30 target gene, herein designated TARGET GENE. LOC91661 BINDING SITE is a target binding site found in the 3' untranslated region of mRNA encoded by LOC91661, corresponding to a target binding site such as BINDING SITE I, BINDING SITE II or BINDING SITE III of FIG. 8. Table 4 illustrates the complementarity of the nucleotide sequences of LOC91661 BINDING SITE, designated SEQ ID:3371, to the nucleotide sequence of GAM30 RNA, herein designated GAM RNA, also designated SEQ ID:346.

Another function of GAM30 is therefore inhibition of LOC91661 (Accession NM_138372.1). Accordingly, utilities of GAM30 include diagnosis, prevention and treatment of diseases and clinical conditions associated with LOC91661.

LOC92148 (Accession XM_043160.9) is another GAM30 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:14208, to the nucleotide sequence of GAM30 RNA, herein designated GAM RNA, also designated SEQ ID:346.

Another function of GAM30 is therefore inhibition of LOC92148 (Accession XM_043160.9). Accordingly, utilities of GAM30 include diagnosis, prevention and treatment of diseases and clinical conditions associated with LOC92148.

LOC92303 (Accession) is another GAM30 target gene, herein designated TARGET GENE. LOC92303 BINDING SITE is a target binding site found in the 3' untranslated region of mRNA encoded by LOC92303, corresponding to a target binding site such as BINDING SITE I, BINDING SITE II or BINDING SITE III of FIG. 8. Table 4 illustrates the complementarity of the nucleotide sequences of LOC92303 BINDING SITE, designated SEQ ID:16126, to the nucleotide sequence of GAM30 RNA, herein designated GAM RNA, also designated SEQ ID:346.

Another function of GAM30 is therefore inhibition of LOC92303 (Accession). Accordingly, utilities of GAM30 include diagnosis, prevention and treatment of diseases and clinical conditions associated with LOC92303.

LOC93408 (Accession NM_138403.1) is another GAM30 target gene, herein designated TARGET GENE. LOC93408 BINDING SITE is a target binding site found in the 5' untranslated region of mRNA encoded by LOC93408, corresponding to a target binding site such as BINDING SITE I, BINDING SITE II or BINDING SITE III of FIG. 8. Table 4 illustrates the complementarity of the nucleotide sequences of LOC93408 BINDING SITE, designated SEQ ID:3385, to the nucleotide sequence of GAM30 RNA, herein designated GAM RNA, also designated SEQ ID:346.

Another function of GAM30 is therefore inhibition of LOC93408 (Accession NM_138403.1). Accordingly, utilities of GAM30 include diagnosis, prevention and treatment of diseases and clinical conditions associated with LOC93408.

Leukotriene b4 receptor (LTB4R, Accession NM_000752.1) is another GAM30 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:14766, to the nucleotide sequence of GAM30 RNA, herein designated GAM RNA, also designated SEQ ID:346.

Another function of GAM30 is therefore inhibition of Leukotriene b4 receptor (LTB4R, Accession NM_000752.1), a gene which may be the cardiac p2y receptor involved in the regulation of cardiac muscle contraction through modulation of l-type calcium currents. Accordingly, utilities of GAM30 include diagnosis, prevention and treatment of diseases and clinical conditions associated with LTB4R.

The function of LTB4R has been established by previous studies. Yokomizo et al. (1997) found that the putative purinoceptor P2Y7 has a primary structure identical to that of a BLTR clone, HL-5. To determine whether BLTR also functions as a purinoceptor, they established stable transformants of BLTR in glioma cells that possess negligible amounts of intrinsic purinoceptors. In these cells, up to 300 microM caused no change in intracellular calcium levels, but significant increases in the calcium concentrations were induced by exposure to 10 nanoM LTB4. These results were interpreted to indicate that this receptor is not a purinoceptor, but a BLTR By genomic sequence analysis, Kato et al. (2000) determined that BLT1 lacks TATA and CAAT elements but possesses a GC-rich sequence in the promoter region. Luciferase reporter analysis showed that the region required for basal transcription, which is activated by SP1, is about 80 bp upstream from the initiator sequence. Southern blot analysis revealed that the CpG sites of the BLT1 promoter are highly methylated in cells not expressing BLT1, but are unmethylated in cells expressing BLT1. Kato et al. (2000) also found that the promoter region of BLT1 is localized within the open reading frame encoding BLT2 (OMIM Ref. No. 605773).

Full details of the abovementioned studies are described in the following publications, the disclosure of which are hereby incorporated by reference:

Yokomizo, T.; Izumi, T.; Chang, K.; Takuwa, Y.; Shimizu, T.: A G-protein-coupled receptor for leukotriene B4 that mediates chemotaxis. Nature 387:620-624, 1997; and Kato, K.; Yokomizo, T.; Izumi, T.; Shimizu, T.: Cell-specific transcriptional regulation of human leukotriene B4 receptor gene. J. Exp. Med. 192:413-420, 2000.

Further studies establishing the function and utilities of LTB4R are found in John Hopkins OMIM database record ID 601531, and in cited publications listed in Table 5, which are hereby incorporated by reference. Lymphocyte antigen 75 (LY75, Accession NM_002349.1) is another GAM30 target gene, herein designated TARGET GENE. LY75 BINDING SITE is a target binding site found in the 3' untranslated region of mRNA encoded by LY75, corresponding to a target binding site such as BINDING SITE I, BINDING SITE II or BINDING SITE III of FIG. 8. Table 4 illustrates the complementarity of the nucleotide sequences of LY75 BINDING SITE, designated SEQ ID:5206, to the nucleotide sequence of GAM30 RNA, herein designated GAM RNA, also designated SEQ ID:346.

Another function of GAM30 is therefore inhibition of Lymphocyte antigen 75 (LY75, Accession NM_002349.1). Accordingly, utilities of GAM30 include diagnosis, prevention and treatment of diseases and clinical conditions associated with LY75.

Male germ cell-associated kinase (MAK, Accession NM_005906.2) is another GAM30 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:12945, to the nucleotide sequence of GAM30 RNA, herein designated GAM RNA, also designated SEQ ID:346.

Another function of GAM30 is therefore inhibition of Male germ cell-associated kinase (MAK, Accession NM_005906.2), a gene which plays an important role in spermatogenesis. Accordingly, utilities of GAM30 include diagnosis, prevention and treatment of diseases and clinical conditions associated with MAK.

The function of MAK has been established by previous studies. Male germ cell- associated kinase is one of the protein kinases that was isolated by weak cross- hybridization with the v-ros (OMIM Ref. No. 165020) protein kinase sequence (Matsushime et al., 1990). The gene encoding this kinase is expressed almost exclusively in testis, mainly in germ cells at and/or after the pachytene stage, as 66- and 60-kD proteins that form a distinct complex with cellular phosphoprotein p210. The p210 protein is sufficiently phosphorylated in vitro by the MAK gene product at serine and threonine residues. These results suggest that the MAK gene plays an important role in spermatogenesis. Using a panel of DNA samples from an interspecific cross, Taketo et al. (1994) mapped the Mak gene to mouse chromosome 13 in an area situated between 2 regions that are homologous with human chromosome 6p and chromosome 5. Taketo et al. (1994) stated that preliminary Southern analysis of DNA samples from a panel of mouse/human somatic cell hybrids showed concordant hybridization of the MAK gene and the ROS1 gene, previously mapped to 6q22

Full details of the abovementioned studies are described in the following publications, the disclosure of which are hereby incorporated by reference:

Matsushime, H.; Jinno, A.; Takagi, N.; Shibuy, M.: A novel mammalian protein kinase gene (mak) is highly expressed in testicular germ cells at and after meiosis. Molec. Cell. Biol. 10:2261-2268, 1990; and Taketo, M.; Jinno, A.; Yamaguchi, S.; Matushime, H.; Shibuy, M.; Seldin, M. F.: Mouse Mak gene for male germ cell-associated kinase maps to chromosome 13. Genomics 19:397-398, 1994.

Further studies establishing the function and utilities of MAK are found in John Hopkins OMIM database record ID 154235, and in cited publications listed in Table 5, which are hereby incorporated by reference. MGC10818 (Accession NM_030568.2) is another GAM30 target gene, herein designated TARGET GENE. MGC10818 BINDING SITE is a target binding site found in the 3' untranslated region of mRNA encoded by MGC10818, corresponding to a target binding site such as BINDING SITE I, BINDING SITE II or BINDING SITE III of FIG. 8. Table 4 illustrates the complementarity of the nucleotide sequences of MGC10818 BINDING SITE, designated SEQ ID:6357, to the nucleotide sequence of GAM30 RNA, herein designated GAM RNA, also designated SEQ ID:346.

Another function of GAM30 is therefore inhibition of MGC10818 (Accession NM_030568.2). Accordingly, utilities of GAM30 include diagnosis, prevention and treatment of diseases and clinical conditions associated with MGC10818.

MGC5149 (Accession XM_051200.4) is another GAM30 target gene, herein designated TARGET GENE. MGC5149 BINDING SITE is a target binding site found in the 3' untranslated region of mRNA encoded by MGC5149, corresponding to a target binding site such as BINDING SITE I, BINDING SITE II or BINDING SITE III of FIG. 8. Table 4 illustrates the complementarity of the nucleotide sequences of MGC5149 BINDING SITE, designated SEQ ID:1092, to the nucleotide sequence of GAM30 RNA, herein designated GAM RNA, also designated SEQ ID:346.

Another function of GAM30 is therefore inhibition of MGC5149 (Accession XM_051200.4). Accordingly, utilities of GAM30 include diagnosis, prevention and treatment of diseases and clinical conditions associated with MGC5149.

MGC9912 (Accession NM_080664.1) is another GAM30 target gene, herein designated TARGET GENE. MGC9912 BINDING SITE is a target binding site found in the 3' untranslated region of mRNA encoded by MGC9912, corresponding to a target binding site such as BINDING SITE I, BINDING SITE II or BINDING SITE III of FIG. 8. Table 4 illustrates the complementarity of the nucleotide sequences of MGC9912 BINDING SITE, designated SEQ ID:12264, to the nucleotide sequence of GAM30 RNA, herein designated GAM RNA, also designated SEQ ID:346.

Another function of GAM30 is therefore inhibition of MGC9912 (Accession NM_080664.1). Accordingly, utilities of GAM30 include diagnosis, prevention and treatment of diseases and clinical conditions associated with MGC9912.

Matrix metalloproteinase-like 1 (MMPL1, Accession) is another GAM30 target gene, herein designated TARGET GENE. MMPL1 BINDING SITE is a target binding site found in the 3' untranslated region of mRNA encoded by MMPL1, corresponding to a target binding site such as BINDING SITE I, BINDING SITE II or BINDING SITE III of FIG. 8. Table 4 illustrates the complementarity of the nucleotide sequences of MMPL1 BINDING SITE, designated SEQ ID:4015, to the nucleotide sequence of GAM30 RNA, herein designated GAM RNA, also designated SEQ ID:346.

Another function of GAM30 is therefore inhibition of Matrix metalloproteinase-like 1 (MMPL1, Accession). Accordingly, utilities of GAM30 include diagnosis, prevention and treatment of diseases and clinical conditions associated with MMPL1.

Myeloproliferative leukemia virus oncogene (MPL, Accession NM_005373.1) is another GAM30 target gene, herein designated TARGET GENE. MPL BINDING SITE1 and MPL BINDING SITE2 are target binding sites found in untranslated regions of mRNA encoded by MPL, corresponding to target binding sites such as BINDING SITE I, BINDING SITE II or BINDING SITE III of FIG. 8. Table 4 illustrates the complementarity of the nucleotide sequences of MPL BINDING SITE1 and MPL BINDING SITE2, designated SEQ ID:6226 and SEQ ID:17342 respectively, to the nucleotide sequence of GAM30 RNA, herein designated GAM RNA, also designated SEQ ID:346.

Another function of GAM30 is therefore inhibition of Myeloproliferative leukemia virus oncogene (MPL, Accession NM_005373.1). Accordingly, utilities of GAM30 include diagnosis, prevention and treatment of diseases and clinical conditions associated with MPL.

Nuclear receptor coactivator 6 interacting protein (NCOA6IP, Accession NM_024831.5) is another GAM30 target gene, herein designated TARGET GENE. NCOA6IP BINDING SITE is a target binding site found in the 3' untranslated region of mRNA encoded by NCOA6IP, corresponding to a target binding site such as BINDING SITE I, BINDING SITE II or BINDING SITE III of FIG. 8. Table 4 illustrates the complementarity of the nucleotide sequences of NCOA6IP BINDING SITE, designated SEQ ID:10449, to the nucleotide sequence of GAM30 RNA, herein designated GAM RNA, also designated SEQ ID:346.

Another function of GAM30 is therefore inhibition of Nuclear receptor coactivator 6 interacting protein (NCOA6IP, Accession NM_024831.5). Accordingly, utilities of GAM30 include diagnosis, prevention and treatment of diseases and clinical conditions associated with NCOA6IP.

NOSIP (Accession NM_015953.2) is another GAM30 target gene, herein designated TARGET GENE. NOSIP BINDING SITE is a target binding site found in the 5' untranslated region of mRNA encoded by NOSIP, corresponding to a target binding site such as BINDING SITE I, BINDING SITE II or BINDING SITE III of FIG. 8. Table 4 illustrates the complementarity of the nucleotide sequences of NOSIP BINDING SITE, designated SEQ ID:12237, to the nucleotide sequence of GAM30 RNA, herein designated GAM RNA, also designated SEQ ID:346.

Another function of GAM30 is therefore inhibition of NOSIP (Accession NM_015953.2). Accordingly, utilities of GAM30 include diagnosis, prevention and treatment of diseases and clinical conditions associated with NOSIP.

5'-nucleotidase, cytosolic ii (NT5C2, Accession NM_012229.2) is another GAM30 target gene, herein designated TARGET GENE. NT5C2 BINDING SITE is a target binding site found in the 5' untranslated region of mRNA encoded by NT5C2, corresponding to a target binding site such as BINDING SITE I, BINDING SITE II or BINDING SITE III of FIG. 8. Table 4 illustrates the complementarity of the nucleotide sequences of NT5C2 BINDING SITE, designated SEQ ID:13752, to the nucleotide sequence of GAM30 RNA, herein designated GAM RNA, also designated SEQ ID:346.

Another function of GAM30 is therefore inhibition of 5'-nucleotidase, cytosolic ii (NT5C2, Accession NM_012229.2). Accordingly, utilities of GAM30 include diagnosis, prevention and treatment of diseases and clinical conditions associated with NT5C2.

Protocadherin alpha 9 (PCDHA9, Accession NM_031857.1) is another GAM30 target gene, herein designated TARGET GENE. PCDHA9 BINDING SITE is a target binding site found in the 3' untranslated region of multiple transcripts of mRNA encoded by PCDHA9, corresponding to a target binding site such as BINDING SITE I, BINDING SITE II or BINDING SITE III of FIG. 8. Table 4 illustrates the complementarity of the nucleotide sequences of PCDHA9 BINDING SITE, designated SEQ ID:1499, to the nucleotide sequence of GAM30 RNA, herein designated GAM RNA, also designated SEQ ID:346.

Another function of GAM30 is therefore inhibition of Protocadherin alpha 9 (PCDHA9, Accession NM_031857.1), a gene which is a calcium-dependent cell-adhesion protein. Accordingly, utilities of GAM30 include diagnosis, prevention and treatment of diseases and clinical conditions associated with PCDHA9.

The function of PCDHA9 has been established by previous studies. Cadherins are calcium-dependent cell-cell adhesion molecules that mediate neural cell-cell interactions. Protocadherins constitute a subfamily of nonclassic cadherins. PCDHA9 is a member of the alpha cluster of protocadherin genes on 5q31. By screening a brain cDNA library for sequences with the potential to encode large proteins, Nagase et al. (1997) identified a cDNA encoding PCDHA9, which they termed KIAA0345. The deduced protein has 842 amino acids. RT-PCR analysis detected strongest expression of KIAA0345 in kidney and testis, followed by brain, lung, pancreas, and ovary.

Full details of the abovementioned studies are described in the following publications, the disclosure of which are hereby incorporated by reference:

Nagase, T.; Ishikawa, I.; Nakajima, D.; Ohira, M.; Seki, N.; Miyajima, N.; Tanaka, A.; Kotani, H.; Nomura, N.; O'Hara, O.: Prediction of the coding sequences of unidentified human genes. VII. The complete sequences of 100 new cDNA clones from brain which can code for large proteins in vitro. DNA Res. 4:141-150, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse and.

Further studies establishing the function and utilities of PCDHA9 are found in John Hopkins OMIM database record ID 606315, and in cited publications listed in Table 5, which are hereby incorporated by reference. Protocadherin beta 11 (PCDHB11, Accession NM_018931.2) is another GAM30 target gene, herein designated TARGET GENE. PCDHB11 BINDING SITE is a target binding site found in the 3' untranslated region of mRNA encoded by PCDHB11, corresponding to a target binding site such as BINDING SITE I, BINDING SITE II or BINDING SITE III of FIG. 8. Table 4 illustrates the complementarity of the nucleotide sequences of PCDHB11 BINDING SITE, designated SEQ ID:1970, to the nucleotide sequence of GAM30 RNA, herein designated GAM RNA, also designated SEQ ID:346.

Another function of GAM30 is therefore inhibition of Protocadherin beta 11 (PCDHB11, Accession NM_018931.2).

Accordingly, utilities of GAM30 include diagnosis, prevention and treatment of diseases and clinical conditions associated with PCDHB11.

Phosducin-like (PDCL, Accession NM_005388.2) is another GAM30 target gene, herein designated TARGET GENE. PDCL BINDING SITE is a target binding site found in the 3' untranslated region of mRNA encoded by PDCL, corresponding to a target binding site such as BINDING SITE I, BINDING SITE II or BINDING SITE III of FIG. 8. Table 4 illustrates the complementarity of the nucleotide sequences of PDCL BINDING SITE, designated SEQ ID:13181, to the nucleotide sequence of GAM30 RNA, herein designated GAM RNA, also designated SEQ ID:346.

Another function of GAM30 is therefore inhibition of Phosducin-like (PDCL, Accession NM_005388.2), a gene which may regulate G-protein signaling and similar to phosducins. Accordingly, utilities of GAM30 include diagnosis, prevention and treatment of diseases and clinical conditions associated with PDCL.

The function of PDCL has been established by previous studies. Phosducin-like protein (PDCL) is a putative modulator of heterotrimeric G proteins. It was initially isolated as the product of an ethanol-responsive gene in neural cell cultures (Miles et al., 1993). PDCL shares extensive amino acid sequence homology with phosducin (PDC; 171490), a phosphoprotein expressed in retina and pineal gland that inhibits several G protein-coupled signaling pathways by binding to the beta-gamma subunits of G proteins. By screening a human genomic library with a rat Pdcl cDNA, Thibault et al. (1999) isolated a partial PDCL genomic sequence. They also identified several PDCL ESTs. The authors derived the complete PDCL coding sequence by aligning the genomic and EST sequences. The predicted 301-amino acid PDCL protein shows homology to areas of rat Pdc that contact G protein beta-gamma subunits. The N-terminal regions of human, rat, and Drosophila PDCL are highly homologous to each other, but show little homology to the N-terminal region of rat Pdc. By somatic cell hybrid analysis, Thibault et al. (1999) mapped the PDCL gene to chromosome 9. Using a radiation hybrid mapping panel, they found that the PDCL gene is linked to markers D9S1876 and D9S1674.

Full details of the abovementioned studies are described in the following publications, the disclosure of which are hereby incorporated by reference:

Miles, M. F.; Barhite, S.; Sganga, M.; Elliott, M.: Phosducin-like protein: an ethanol-responsive potential modulator of guanine nucleotide-binding protein function. Proc. Nat. Acad. Sci. 90:10831-10835, 1993; and Thibault, C.; Wang, J. F.; Charnas, R.; Mirel, D.; Barhite, S.; Miles, M. F.: Cloning and characterization of the rat and human phosducin-like protein genes: structure, expression and.

Further studies establishing the function and utilities of PDCL are found in John Hopkins OMIM database record ID 604421, and in cited publications listed in Table 5, which are hereby incorporated by reference. Polymerase (dna directed), epsilon 3 (p17 subunit) (POLE3, Accession NM_017443.2) is another GAM30 target gene, herein designated TARGET GENE. POLE3 BINDING SITE is a target binding site found in the 3' untranslated region of mRNA encoded by POLE3, corresponding to a target binding site such as BINDING SITE I, BINDING SITE II or BINDING SITE III of FIG. 8. Table 4 illustrates the complementarity of the nucleotide sequences of POLE3 BINDING SITE, designated SEQ ID:11472, to the nucleotide sequence of GAM30 RNA, herein designated GAM RNA, also designated SEQ ID:346.

Another function of GAM30 is therefore inhibition of Polymerase (dna directed), epsilon 3 (p17 subunit) (POLE3, Accession NM_017443.2). Accordingly, utilities of GAM30 include diagnosis, prevention and treatment of diseases and clinical conditions associated with POLE3.

Pou domain, class 2, associating factor 1 (POU2AF1, Accession NM_006235.1) is another GAM30 target gene, herein designated TARGET GENE. POU2AF1 BINDING SITE is a target binding site found in the 3' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:1335, to the nucleotide sequence of GAM30 RNA, herein designated GAM RNA, also designated SEQ ID:346.

Another function of GAM30 is therefore inhibition of Pou domain, class 2, associating factor 1 (POU2AF1, Accession NM_006235.1), a gene which is a transcriptional coactivator that specifically associates with either oct1 or oct2 and therefore may be associated with A form of b-cell leukemia. Accordingly, utilities of GAM30 include diagnosis, prevention and treatment of A form of b-cell leukemia, and of other diseases and clinical conditions associated with POU2AF1.

The function of POU2AF1 has been established by previous studies. POU domain proteins contain a bipartite DNA-binding domain divided by a flexible linker that enables them to adopt various monomer configurations on DNA. The versatility of POU protein operation is additionally conferred at the dimerization level. Tomilin et al. (2000) found that the POU dimer from the OCT1 gene formed on the palindromic OCT factor recognition element, or PORE (ATTTGAAATG-CAAAT), could recruit the transcriptional coactivator OBF1, whereas POU dimers formed on the consensus MORE (more PORE) (ATGCATATGCAT) or on MOREs from Ig heavy chain promoters (AT[G/A][C/A]ATATGCAA) failed to interact. An interaction with OBF1 was precluded since the same OCT1 residues that form the MORE dimerization interface are also used for OBF1/OCT1 interactions on the PORE. These findings provided a paradigm of how specific POU dimer assemblies can differentially recruit a coregulatory activity with distinct transcriptional readouts.

Animal model experiments lend further support to the function of POU2AF1. Schubart et al. (2001) noted that Oct2-deficient mice die at birth but have normal B-cell development and transcription of Ig genes. Obf1-deficient mice are viable with unaffected B-cell development in bone marrow and normal serum IgM but have reduced B-cell numbers in spleen and low serum IgG. By creating double knockout mice, Schubart et al. (2001) confirmed that B-cell development and Ig gene transcription can proceed normally without these B-cell specific factors. However, in these animals the mature B-cell pool was strongly reduced, suggesting that these factors play an important role in controlling the expansion and/or maintenance of mature B cells.

It is appreciated that the abovementioned animal model for POU2AF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schubart, K.; Massa, S.; Schubart, D.; Corcoran, L. M.; Rolink, A. G.; Matthias, P.: B cell development and immunoglobulin gene transcription in the absence of Oct-2 and OBF-1. Nature Immun. 2:69-74, 2001; and Tomilin, A.; Remeny, A.; Lins, K.; Bak, H.; Leidel, S.; Vriend, G.; Wilmanns, M.; Scholer, H. R.: Synergism with the coactivator OBF-1 (OCA-B, BOB-1) is mediated by a specific POU dimer.

Further studies establishing the function and utilities of POU2AF1 are found in John Hopkins OMIM database record ID 601206, and in cited publications listed in Table 5, which are hereby incorporated by reference. PRO0365 (Accession NM_014126.1) is another GAM30 target gene, herein designated TARGET GENE. PRO0365 BINDING SITE is a target binding site found in the 5' untranslated region of mRNA encoded by PRO0365, corresponding to a target binding site such as BINDING SITE I, BINDING SITE II or BINDING SITE III of FIG. 8. Table 4 illustrates the complementarity of the nucleotide sequences of PRO0365 BINDING SITE, designated SEQ ID:7384, to the nucleotide sequence of GAM30 RNA, herein designated GAM RNA, also designated SEQ ID:346.

Another function of GAM30 is therefore inhibition of PRO0365 (Accession NM_014126.1). Accordingly, utilities of GAM30 include diagnosis, prevention and treatment of diseases and clinical conditions associated with PRO0365.

Periaxin (PRX, Accession NM_020956.1) is another GAM30 target gene, herein designated TARGET GENE. PRX BINDING SITE is a target binding site found in the 3' untranslated region of mRNA encoded by PRX, corresponding to a target binding site such as BINDING SITE I, BINDING SITE II or BINDING SITE III of FIG. 8. Table 4 illustrates the complementarity of the nucleotide sequences of PRX BINDING SITE, designated SEQ ID:6453, to the nucleotide sequence of GAM30 RNA, herein designated GAM RNA, also designated SEQ ID:346.

Another function of GAM30 is therefore inhibition of Periaxin (PRX, Accession NM_020956.1), a gene which seems to be required for maintenance of peripheral nerve myelin sheath. may have a role in axon-glial interactions, possibly by interacting with the cytoplasmic domains of integral membrane proteins such as myelin- associated glycoprotein in the periaxonal regions of the schwann cell plasma membrane. may have a role in the early phases of myelin deposition and therefore is associated with Dejerine-sottas neuropathy, autosomal recessive. Accordingly, utilities of GAM30 include diagnosis, prevention and treatment of Dejerine-sottas neuropathy, autosomal recessive, and of other diseases and clinical conditions associated with PRX.

The function of PRX has been established by previous studies. The periaxin gene (PRX) encodes 2 PDZ-domain proteins, L- and S-periaxin, that are required for maintenance of peripheral nerve myelin. The PDZ domain, which consists of a nearly 90-amino acid protein-binding motif that interacts with the C termini of plasma membrane proteins and with the cortical cytoskeleton, has been implicated in the assembly of signaling complexes at sites of cell-cell contact. By FISH and electronic PCR (Schuler, 1997), Boerkoel et al. (2001) mapped the PRX gene between D19S324 and D19S223 within a BAC on 19q13.1-q13.2, a position showing conserved synteny with mouse chromosome 7 where the Prx gene maps (Gillespie et al., 1997). They pointed out that the interactions among L-periaxin, the cytoskeleton, and a membrane complex are reminiscent of the interactions among the proteins of the dystrophin-sarcoglycan complex (Cohn and Campbell, 2000) and the signaling complexes organized by other PDZ domain proteins. They hypothesized that mutations in cytoskeletal and membrane proteins interacting with L-periaxin may also cause Charcot-Marie- tooth disease or related neuropathies. In 3 unrelated patients with Dejerine-Sottas neuropathy (OMIM Ref. No. 145900), Boerkoel et al. (2001) identified recessive mutations in the PRX gene (605725.0001-605725.004). They mapped recessive Dejerine-Sottas neuropathy to 19q13.1-q13.2, a region associated with a severe autosomal recessive demyelinating neuropathy in a Lebanese family reported by Delague et al. (2000) as Charcot- Marie- tooth disease type 4F.

Animal model experiments lend further support to the function of PRX. Confirming the necessity of periaxin for maintenance of the myelin sheath, Gillespie et al. (2000) demonstrated that Prx -/- mice ensheath and myelinate peripheral axons apparently normally but subsequently develop a severe demyelinating neuropathy associated with allodynia (pain from non-noxious stimuli) and hyperalgesia (hypersensitivity to pain).

It is appreciated that the abovementioned animal model for PRX is acknowledged by those skilled in the art as a scientifically valid animal model, as can be further appreciated from the publications sited hereinbelow.

Full details of the abovementioned studies are described in the following publications, the disclosure of which are hereby incorporated by reference:

Takashima, H.; Boerkoel, C. F.; De Jonghe, P.; Ceuterick, C.; Martin, J.-J.; Voit, T.; Schroder, J.-M.; Williams, A.; Brophy, P. J.; Timmerman, V.; Lupski, J. R.: Periaxin mutations cause a broad spectrum of demyelinating neuropathies. Ann. Neurol. 51:709-715, 2002; and Boerkoel, C. F.; Takashima, H.; Stankiewicz, P.; Garcia, C. A.; Leber, S. M.; Rhee- Morris, L.; Lupski, J. R.: Periaxin mutations cause recessive Dejerine-Sottas neuropathy. Am. J. Hum.

Further studies establishing the function and utilities of PRX are found in John Hopkins OMIM database record ID 605725, and in cited publications listed in Table 5, which are hereby incorporated by reference. Proteasome (prosome, macropain) 26s subunit, non-atpase, 9 (PSMD9, Accession NM_002813.3) is another GAM30 target gene, herein designated TARGET GENE. PSMD9 BINDING SITE is a target binding site found in the 3' untranslated region of mRNA encoded by PSMD9, corresponding to a target binding site such as BINDING SITE I, BINDING SITE II or BINDING SITE III of FIG. 8. Table 4 illustrates the complementarity of the nucleotide sequences of PSMD9 BINDING SITE, designated SEQ ID:8316, to the nucleotide sequence of GAM30 RNA, herein designated GAM RNA, also designated SEQ ID:346.

Another function of GAM30 is therefore inhibition of Proteasome (prosome, macropain) 26s subunit, non-atpase, 9 (PSMD9, Accession NM_002813.3), a gene which acts as a regulatory subunit of the 26 proteasome. Accordingly, utilities of GAM30 include diagnosis, prevention and treatment of diseases and clinical conditions associated with PSMD9.

The function of PSMD9 has been established by previous studies. The 26S proteasome is a eukaryotic ATP-dependent protease that selectively degrades intracellular target proteins that are modified by the covalent attachment of ubiquitin. It is composed of a central catalytic 20S proteasome, which consists of a family of small proteins, and 2 large regulatory modules, named PA700, which consist of approximately 20 heterogeneous proteins. A proteasomal modulator complex, composed of p27, p42, and p50 subunits, stimulates the association of the 20S proteasome with PA700 to form the active 26S proteasome. Watanabe et al. (1998) cloned 2 distinct human brain cDNAs encoding p27, or PSMD9. Compared with the longer cDNA, the shorter cDNA has a 65-bp deletion near the 3-prime region that results in a new inframe termination codon farther downstream. The longer cDNA encodes a deduced 209-amino acid protein with a calculated molecular mass of 22,764 Da. The shorter cDNA encodes a deduced 223-amino acid protein with a calculated molecular mass of 24,652 Da. The longer PSMD9 protein exhibits 36% sequence identity with an S. cerevisiae protein, which the authors named NAS2 for 'non-ATPase subunit 2,' and 31.9% identity with a C. elegans protein. Disruption of the yeast NAS2 gene did not affect cell viability or proliferation. Watanabe et al. (1998) demonstrated that the PSMD9 protein, along with the ATPase components TBP1 (PSMC3; 186852) and p42 (PSMC6; 602708), associated with both the modulator complex and the 26S proteasome complex. Northern blot analysis detected an approximately 1.3-kb PSMD9 transcript in all tissues examined, with highest levels in liver and kidney. E12 and E47 (see OMIM Ref. No. TCF3; 147141), members of the ubiquitous E2A protein family, function with basic helix-loop-helix (bHLH) proteins to bind and transactivate promoters via conserved sequence elements known as E boxes. By yeast 2-hybrid screening of a rat insulinoma cell cDNA library using the bHLH domain-containing C terminus of E12 as bait, Thomas et al. (1999) obtained a cDNA encoding rat Bridge-1. Sequence analysis predicted that the 222-amino acid Bridge-1 protein shares 98% amino acid similarity with human PSMD9 over the first 184 amino acids but diverges in the C terminus Bridge-1 contains a PDZ-like domain from amino acids 138 to 178, forming 3 beta sheets and 2 alpha helices. SDS-PAGE analysis showed that Bridge-1 is expressed as a 28-kD protein, close to the deduced value of 25 kD. Using Bridge-1 cDNA as probe, Northern blot analysis detected a 1.0-kb transcript in all rat and human tissues tested, with highest expression in pancreas, testis, kidney, and liver. Immunocytochemistry assessment demonstrated predominant nuclear localization of Bridge-1, with lower levels in cytoplasm. Immunoprecipitation analysis determined that anti-Bridge-1 coimmunoprecipitates E12 or E12 and E47 through their C-terminal bHLH domains, but only in the presence of the PDZ domain of Bridge-1. CAT assays indicated that Bridge-1 together with E12 or E47 coactivates insulin (OMIM Ref. No. 176730) promoter elements.

Full details of the abovementioned studies are described in the following publications, the disclosure of which are hereby incorporated by reference:

Thomas, M. K.; Yao, K.-M.; Tenser, M. S.; Wong, G. G.; Habener, J. F.: Bridge-1, a novel PDZ-domain coactivator of E2A-mediated regulation of insulin gene transcription. Molec. Cell. Biol. 19:8492-8504, 1999; and Watanabe, T. K.; Saito, A.; Suzuki, M.; Fujiwara, T.; Takahashi, E.; Slaughter, C. A.; DeMartino, G. N.; Hendil, K. B.; Chung, C. H.; Tanahashi, N.; Tanaka, K.: cDNA cloning and chara.

Further studies establishing the function and utilities of PSMD9 are found in John Hopkins OMIM database record ID 603146, and in cited publications listed in Table 5, which are hereby incorporated by reference. Prostaglandin i2 (prostacyclin) synthase (PTGIS, Accession NM_000961.2) is another GAM30 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:701, to the nucleotide sequence of GAM30 RNA, herein designated GAM RNA, also designated SEQ ID:346.

Another function of GAM30 is therefore inhibition of Prostaglandin i2 (prostacyclin) synthase (PTGIS, Accession NM_000961.2), a gene which catalyzes the isomerization of prostaglandin h2 to prostacyclin (=prostaglandin i2). Accordingly, utilities of GAM30 include diagnosis, prevention and treatment of diseases and clinical conditions associated with PTGIS.

The function of PTGIS has been established by previous studies. Yokoyama et al. (1996) demonstrated that the prostacyclin synthase gene, which they symbolized PTGIS, consists of 10 exons spanning approximately 60 kb. All the splice donor and acceptor sites conformed to the GT/AG rule. The major product of the primer extension analysis suggested that the transcription of the gene started from the positions around 49 bp upstream of the translation initiation codon. By fluorescence in situ hybridization, they demonstrated that the gene is located at 20q13.11-q13.13. Prostacyclin (also known as prostaglandin I2) is a potent vasodilator and inhibitor of platelet aggregation. The enzyme prostacyclin synthase (EC 5.3.99.4) catalyzes the isomerization of prostaglandin H2 (PGH2) to prostacyclin. Wang and Chen (1996) noted that although it has absorbance spectral features characteristic of the cytochrome P450s, PGIS has no monooxygenase activity and does not require an external source of electrons to initiate its enzyme reaction. Prostacyclin synthase is the single member of family 8 of the cytochrome P450 superfamily (Nelson et al., 1996).

Full details of the abovementioned studies are described in the following publications, the disclosure of which are hereby incorporated by reference:

Wang, L.-H.; Chen, L.: Organization of the gene encoding human prostacyclin synthase. Biochem. Biophys. Res. Commun. 226:631-637, 1996. ; and Yokoyama, C.; Yabuki, T.; Inoue, H.; Tone, Y.; Hara, S.; Hatae, T.; Nagata, M.; Takahashi, E.-I.; Tanabe, T.: Human gene encoding prostacyclin synthase (PTGIS): genomic organization, ch.

Further studies establishing the function and utilities of PTGIS are found in John Hopkins OMIM database record ID 601699, and in cited publications listed in Table 5, which are hereby incorporated by reference. Rab14, member ras oncogene family (RAB14, Accession NM_016322.2) is another GAM30 target gene, herein designated TARGET GENE. RAB14 BINDING SITE is a target binding site found in the 3' untranslated region of mRNA encoded by RAB14, corresponding to a target binding site such as BINDING SITE I, BINDING SITE II or BINDING SITE III of FIG. 8. Table 4 illustrates the complementarity of the nucleotide sequences of RAB14 BINDING SITE, designated SEQ ID:14594, to the nucleotide sequence of GAM30 RNA, herein designated GAM RNA, also designated SEQ ID:346.

Another function of GAM30 is therefore inhibition of Rab14, member ras oncogene family (RAB14, Accession NM_016322.2). Accordingly, utilities of GAM30 include diagnosis, prevention and treatment of diseases and clinical conditions associated with RAB14.

Rab33b, member ras oncogene family (RAB33B, Accession NM_031296.1) is another GAM30 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:8204, to the nucleotide sequence of GAM30 RNA, herein designated GAM RNA, also designated SEQ ID:346.

Another function of GAM30 is therefore inhibition of Rab33b, member ras oncogene family (RAB33B, Accession NM_031296.1). Accordingly, utilities of GAM30 include diagnosis, prevention and treatment of diseases and clinical conditions associated with RAB33B.

RAP140 (Accession NM_015224.1) is another GAM30 target gene, herein designated TARGET GENE. RAP140 BINDING SITE is a target binding site found in the 3' untranslated region of mRNA encoded by RAP140, corresponding to a target binding site such as BINDING SITE I, BINDING SITE II or BINDING SITE III of FIG. 8. Table 4 illustrates the complementarity of the nucleotide sequences of RAP140 BINDING SITE, designated SEQ ID:7259, to the nucleotide sequence of GAM30 RNA, herein designated GAM RNA, also designated SEQ ID:346.

Another function of GAM30 is therefore inhibition of RAP140 (Accession NM_015224.1). Accordingly, utilities of GAM30 include diagnosis, prevention and treatment of diseases and clinical conditions associated with RAP140.

Ring finger protein (c3hc4 type) 8 (RNF8, Accession NM_003958.1) is another GAM30 target gene, herein designated TARGET GENE. RNF8 BINDING SITE is a target binding site found in the 3' untranslated region of mRNA encoded by RNF8, corresponding to a target binding site such as BINDING SITE I, BINDING SITE II or BINDING SITE III of FIG. 8. Table 4 illustrates the complementarity of the nucleotide sequences of RNF8 BINDING SITE, designated SEQ ID:9153, to the nucleotide sequence of GAM30 RNA, herein designated GAM RNA, also designated SEQ ID:346.

Another function of GAM30 is therefore inhibition of Ring finger protein (c3hc4 type) 8 (RNF8, Accession NM_003958.1). Accordingly, utilities of GAM30 include diagnosis, prevention and treatment of diseases and clinical conditions associated with RNF8.

SCYA20 (Accession) is another GAM30 target gene, herein designated TARGET GENE. SCYA20 BINDING SITE is a target binding site found in the 3' untranslated region of mRNA encoded by SCYA20, corresponding to a target binding site such as BINDING SITE I, BINDING SITE II or BINDING SITE III of FIG. 8. Table 4 illustrates the complementarity of the nucleotide sequences of SCYA20 BINDING SITE, designated SEQ ID:4575, to the nucleotide sequence of GAM30 RNA, herein designated GAM RNA, also designated SEQ ID:346.

Another function of GAM30 is therefore inhibition of SCYA20 (Accession). Accordingly, utilities of GAM30 include diagnosis, prevention and treatment of diseases and clinical conditions associated with SCYA20.

Spondyloepiphyseal dysplasia, late (SEDL, Accession NM_014563.1) is another GAM30 target gene, herein designated TARGET GENE. SEDL BINDING SITE1 and SEDL BINDING SITE2 are target binding sites found in untranslated regions of mRNA encoded by SEDL, corresponding to target binding sites such as BINDING SITE I, BINDING SITE II or BINDING SITE III of FIG. 8. Table 4 illustrates the complementarity of the nucleotide sequences of SEDL BINDING SITE1 and SEDL BINDING SITE2, designated SEQ ID:8461 and SEQ ID:7862 respectively, to the nucleotide sequence of GAM30 RNA, herein designated GAM RNA, also designated SEQ ID:346.

Another function of GAM30 is therefore inhibition of Spondyloepiphyseal dysplasia, late (SEDL, Accession NM_014563.1), a gene which may play role in vesicular transport from endoplasmic reticulum to golgi. and therefore may be associated with Spondyloepiphyseal dysplasia. Accordingly, utilities of GAM30 include diagnosis, prevention and treatment of Spondyloepiphyseal dysplasia, and of other diseases and clinical conditions associated with SEDL.

The function of SEDL has been established by previous studies. Gedeon et al. (2001) reviewed the spectrum of mutations found in 30 of 36 unrelated cases of X-linked SEDL ascertained from different ethnic populations. It brought the total number of different disease-associated mutations to 21 and showed that they were distributed throughout the SEDL gene. Four recurrent mutations accounted for 13 of the 30 (43%). Haplotype analyses and the diverse ethnic origins of the patients supported recurrent mutations. Two patients with large deletions of SEDL exons were found, 1 with childhood onset of painful complications, the other relatively free of additional symptoms. Since no clear genotype/phenotype correlation could be established, they concluded that the complete unaltered SEDL gene product is essential for normal bone growth. Christie et al. (2001) characterized the SEDL mutations in 4 unrelated spondyloepiphyseal dysplasia tarda kindreds of European origin. They identified 2 nonsense and 2 intragenic deletional frameshift mutations. The nonsense mutations occurred in exons 4 and 6. Both of the intragenic deletions, which were approximately 750 and 1300 to 1445 bp in size, involved intron 5 and part of exon 6 and resulted in frameshifts that led to premature termination signals.

Full details of the abovementioned studies are described in the following publications, the disclosure of which are hereby incorporated by reference:

Christie, P. T.; Curley, A.; Nesbit, M. A.; Chapman, C.; Genet, S.; Harper, P. S.; Keeling, S. L.; Wilkie, A. O. M.; Winter, R. M.; Thakker, R. V.: Mutational analysis in X-linked spondyloepiphyseal dysplasia tarda. J. Clin. Endocr. Metab. 86:3233-3236, 2001; and Gedeon, A. K.; Tiller, G. E.; Le Merrer, M.; Heuertz, S.; Tranebjaerg, L.; Chitayat, D.; Robertson, S.; Glass, I. A.; Savarirayan, R.; Cole, W. G.; Rimoin, D. L.; Kousseff, B. G.; Ohas.

Further studies establishing the function and utilities of SEDL are found in John Hopkins OMIM database record ID 300202, and in cited publications listed in Table 5, which are hereby incorporated by reference. Small edrk-rich factor 1b (centromeric) (SERF1B, Accession NM_022978.1) is another GAM30 target gene, herein designated TARGET GENE. SERF1B BINDING SITE is a target binding site found in the 3' untranslated region of mRNA encoded by SERF1B, corresponding to a target binding site such as BINDING SITE I, BINDING SITE II or BINDING SITE III of FIG. 8. Table 4 illustrates the complementarity of the nucleotide sequences of SERF1B BINDING SITE, designated SEQ ID:18696, to the nucleotide sequence of GAM30 RNA, herein designated GAM RNA, also designated SEQ ID:346.

Another function of GAM30 is therefore inhibition of Small edrk-rich factor 1b (centromeric) (SERF1B, Accession NM_022978.1). Accordingly, utilities of GAM30 include diagnosis, prevention and treatment of diseases and clinical conditions associated with SERF1B.

Tal1 (scl) interrupting locus (SIL, Accession NM_003035.1) is another GAM30 target gene, herein designated TARGET GENE. SIL BINDING SITE is a target binding site found in the 3' untranslated region of mRNA encoded by SIL, corresponding to a target binding site such as BINDING SITE I, BINDING SITE II or BINDING SITE III of FIG. 8. Table 4 illustrates the complementarity of the nucleotide sequences of SIL BINDING SITE, designated SEQ ID:14916, to the nucleotide sequence of GAM30 RNA, herein designated GAM RNA, also designated SEQ ID:346.

Another function of GAM30 is therefore inhibition of Tal1 (scl) interrupting locus (SIL, Accession NM_003035.1), a gene which may be required for axial development and left-right specification and therefore may be associated with Prominent midline neural tube defects, abnormal left-right development. Accordingly, utilities of GAM30 include diagnosis, prevention and treatment of Prominent midline neural tube defects, abnormal left-right development, and of other diseases and clinical conditions associated with SIL.

The function of SIL has been established by previous studies. Aplan et al. (1997) demonstrated that transgenic mice in which inappropriately expressed scl protein, driven by sil regulatory elements, developed aggressive T-cell malignancies in collaboration with a misexpressed LMO1 (OMIM Ref. No. 186921) protein, thus recapitulating the situation seen in a subset of human T-cell ALL. Aplan et al. (1997) also demonstrated that inappropriately expressed scl can interfere with the development of other tissues derived from mesoderm. Finally, Aplan et al. (1997) demonstrated that an scl construct lacking the scl transactivation domain collaborates with misexpressed LMO1, demonstrating that the scl transactivation domain is dispensable for oncogenesis, and supporting the hypothesis that the scl gene product exerts its oncogenic action through a dominant-negative mechanism.

Animal model experiments lend further support to the function of SIL. Izraeli et al. (1999) disrupted the Sil gene in mouse by homologous recombination. Heterozygotes were normal but mutant homozygotes died in utero after embryonic day 10.5. Between embryonic days 7.5 and 8.5, striking developmental anomalies appeared in Sil -/- embryos. In addition to reduced size and limited developmental progress compared to wildtype embryos, Sil mutants displayed prominent midline neural tube defects. These included delay or failure of neural tube closure and holoprosencephaly (OMIM Ref. No. 236100). In addition, left-right development was abnormal. In heterozygous and wildtype embryos, the embryonic heart tube always loops to the right, whereas in Sil mutants the direction of heart looping is randomized. Nodal (OMIM Ref. No. 601265), lefty-2 (OMIM Ref. No. 603037) and Pitx2 (OMIM Ref. No. 601542) are normally expressed only in the left lateral- plate mesoderm before heart looping, with continued expression of Pitx2 on the left side of the looping heart tube. In contrast, Sil mutants showed bilaterally symmetric expression of nodal and Pitx2 at all stages examined. For lefty-2, most Sil -/- embryos also showed bilaterally symmetric expression. However, a small number of mutants expressed lefty-2 only on the right. Expression of both Patched (OMIM Ref. No. 601309) and Gli1 (OMIM Ref. No. 165220) was greatly reduced in Sil -/- embryos. Shh (OMIM Ref. No. 600725) and Hnf3b (OMIM Ref. No. 600288) were expressed in the notochord of Sil mutants. However, the markedly reduced expression of their target genes indicated that Shh signaling in the midline may be blocked in Sil -/- embryos. Comparison with Shh mutant embryos, which have axial defects but normal cardiac looping, indicated that the consequences of abnormal midline development for left-right patterning depend on the time of onset, duration, and severity of disruption of the normal asymmetric patterns of expression of nodal, lefty-2, and Pitx2.

It is appreciated that the abovementioned animal model for SIL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aplan, P. D.; Jones, C. A.; Chervinsky, D. S.; Zhao, X.; Ellsworth, M.; Wu, C.; McGuire, E. A.; Gross, K. W.: An scl gene product lacking the transactivation domain induces bony abnormalities and cooperates with LMO1 to generate T-cell malignancies in transgenic mice. EMBO J. 16:2408-2419, 1997; and Izraeli, S.; Lowe, L. A.; Bertness, V. L.; Good, D. J.; Dorward, D. W.; Kirsch, I. R.; Kuehn, M. R.: The SIL gene is required for mouse embryonic axial development and left-right spec.

Further studies establishing the function and utilities of SIL are found in John Hopkins OMIM database record ID 181590, and in cited publications listed in Table 5, which are hereby incorporated by reference. Solute carrier family 15 (oligopeptide transporter), member 1 (SLC15A1, Accession NM_005073.1) is another GAM30 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:18389, to the nucleotide sequence of GAM30 RNA, herein designated GAM RNA, also designated SEQ ID:346.

Another function of GAM30 is therefore inhibition of Solute carrier family 15 (oligopeptide transporter), member 1 (SLC15A1, Accession NM_005073.1), a gene which is a H(+)-coupled peptide transporter. Accordingly, utilities of GAM30 include diagnosis, prevention and treatment of diseases and clinical conditions associated with SLC15A1.

The function of SLC15A1 has been established by previous studies. In mammalian small intestine, the proton-coupled peptide transporter is responsible for the absorption of small peptides arising from digestion of dietary proteins. Fei et al. (1994) isolated a cDNA clone encoding a hydrogen ion/peptide cotransporter from a rabbit intestinal cDNA library. Liang et al. (1995) screened a human intestinal cDNA library with a probe derived from the rabbit cotransporter cDNA and identified a cDNA which, when expressed in HeLa cells or in Xenopus laevis oocytes, induced proton- dependent peptide transport activity. The predicted protein consisted of 708 amino acids with 12 membrane-spanning domains and 2 putative sites for protein kinase C-dependent phosphorylation. The cDNA-induced transport process accepted dipeptides, tripeptides, and amino beta-lactam antibiotics as substrates, but could not transport free amino acids. The human cotransporter showed 81% identity and 92% similarity to the rabbit cotransporter, but showed only a weak homology to the proton-coupled peptide transport proteins present in bacteria and yeast. By analysis of somatic cell hybrids and by isotopic in situ hybridization, Liang et al. (1995) mapped the human gene to 13q33-q34. Adibi (1997) reviewed the biology and function of the human intestinal oligopeptide transporter, which he symbolized PEPT1. Studies indicated that it transports dipeptides and tripeptides but not free amino acids or peptides with more than 3 amino acid residues and that its driving force for uphill transport requires proton binding and presence of an inside-negative membrane potential. A membrane protein, HTP1, which appeared to be associated with the oligopeptide transporter, had also been cloned. Adibi (1997) pointed out the importance of the transporter in nutritional and pharmacologic therapies; for example, it has allowed the use of oligopeptides as a source of nitrogen for enteral feeding and the use of the oral route for delivery of peptidomimetic drugs such as beta-lactam antibiotics.

Full details of the abovementioned studies are described in the following publications, the disclosure of which are hereby incorporated by reference:

Liang, R.; Fei, Y.-J.; Prasad, P. D.; Ramamoorthy, S.; Han, H.; Yang-Feng, T. L.; Hediger, M. A.; Ganapathy, V.; Leibach, F. H.: Human intestinal H(+)/peptide cotransporter: cloning, functional expression, and chromosomal localization. J. Biol. Chem. 270:6456-6463, 1995; and Adibi, S. A.: The oligopeptide transporter (Pept-1) in human intestine: biology and function. Gastroenterology 113:332-340, 1997.

Further studies establishing the function and utilities of SLC15A1 are found in John Hopkins OMIM database record ID 600544, and in cited publications listed in Table 5, which are hereby incorporated by reference. Synaptosomal-associated protein, 23 kda (SNAP23, Accession NM_003825.2) is another GAM30 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:12976, to the nucleotide sequence of GAM30 RNA, herein designated GAM RNA, also designated SEQ ID:346.

Another function of GAM30 is therefore inhibition of Synaptosomal-associated protein, 23 kda (SNAP23, Accession NM_003825.2), a gene which is essential component of the high affinity receptor for the general membrane fusion machinery. Accordingly, utilities of GAM30 include diagnosis, prevention and treatment of diseases and clinical conditions associated with SNAP23.

The function of SNAP23 has been established by previous studies. Synaptosomal-associated proteins (SNAPs) are involved in the process of membrane fusion in intracellular vesicle traffic. By fluorescence in situ hybridization, Lazo et al. (2001) mapped the SNAP23 gene to chromosome 15q21-q22. Lazo et al. (2001) suggested that alterations in the SNAP23 gene may be involved in neurologic and other diseases with defects in vesicle-membrane fusion processes that map to 15q15-q21.

Full details of the abovementioned studies are described in the following publications, the disclosure of which are hereby incorporated by reference:

Lazo, P. A.; Nadal, M.; Ferrer, M.; Area, E.; Hernandez-torres, J.; Nabokina, S. M.; Mollinedo, F.; Estivill, X.: Genomic organization, chromosomal localization, alternative splicing, and isoforms of the human synaptosome-associated protein-23 gene implicated in vesicle-membrane fusion processes. Hum. Genet. 108:211-215, 2001; and Mollinedo, F.; Lazo, P. A.: Identification of two isoforms of the vesicle-membrane fusion protein SNAP-23 in human neutrophils and HL-60 cells. Biochem. Biophys. Res. Commun. 231:808.

Further studies establishing the function and utilities of SNAP23 are found in John Hopkins OMIM database record ID 602534, and in cited publications listed in Table 5, which are hereby incorporated by reference. T-cell acute lymphocytic leukemia 1 (TAL1, Accession NM_003189.1) is another GAM30 target gene, herein designated TARGET GENE. TAL1 BINDING SITE is a target binding site found in the 3' untranslated region of mRNA encoded by TAL1, corresponding to a target binding site such as BINDING SITE I, BINDING SITE II or BINDING SITE III of FIG. 8. Table 4 illustrates the complementarity of the nucleotide sequences of TAL1 BINDING SITE, designated SEQ ID:4348, to the nucleotide sequence of GAM30 RNA, herein designated GAM RNA, also designated SEQ ID:346.

Another function of GAM30 is therefore inhibition of T-cell acute lymphocytic leukemia 1 (TAL1, Accession NM_003189.1), a gene which may help control cell growth and differentiation. Accordingly, utilities of GAM30 include diagnosis, prevention and treatment of diseases and clinical conditions associated with TAL1.

The function of TAL1 has been established by previous studies. Finger et al. (1989) analyzed a t(1;14)(p32;q11) chromosomal translocation in a lymphohemopoietic stem cell line derived from a patient with acute T-lymphoblastic leukemia (Kurtzberg et al., 1985). The chromosomal joining of 14 to 1p occurred at the T-cell receptor delta diversity (D-delta-2) segment, and the reciprocal joining on chromosome 14 occurred at the T- cell delta diversity segment D-delta-1. Involvement of delta diversity segments at the translocation junctions suggested that the translocation occurred during an attempt at delta-1/delta-2 joining in a stem cell. Finger et al. (1989) found that the segment of chromosome 1 at band p32, adjacent to the chromosomal breakpoint, encodes a transcriptional unit designated TCL5. Finger et al. (1989) also demonstrated a rearrangement of the TCL5 locus in a human melanoma cell line carrying a deletion at 1p32. The occurrence of 'biphenotypic' leukemias with lymphoid and myeloid characteristics and evidence of stem cell origin of myeloid, erythroid, megakaryocytic, and lymphoid lineages in chronic myeloid leukemia suggested that leukemias may arise from pluripotent hematopoietic cells. Begley et al. (1989) studied a leukemic stem cell line that was capable of differentiating into either myeloid or lymphoid cells and that carried a translocation between chromosomes 1 and 14, t(1;14)(p33;q11). By means of molecular cloning and sequencing, they showed that as a consequence of the translocation an unusual fusion transcript was generated. The chromosome 1 region involved in the breakpoint was the site of transcriptional activity apparently occurring only in hematopoietic tissues. Begley et al. (1989) concluded that the translocation may identify a gene located on chromosome 1 which is important for hematopoietic development and oncogenesis. They suggested the designation SCL (stem cell leukemia hematopoietic transcription factor).

Full details of the abovementioned studies are described in the following publications, the disclosure of which are hereby incorporated by reference:

Begley, C. G.; Aplan, P. D.; Davey, M. P.; Nakahara, K.; Tchorz, K.; Kurtzberg, J.; Hershfield, M. S.; Haynes, B. F.; Cohen, D. I.; Waldmann, T. A.; Kirsch, I. R.: Chromosomal translocation in a human leukemic stem-cell line disrupts the T-cell antigen receptor delta-chain diversity region and results in a previously unreported fusion transcript. Proc. Nat. Acad. Sci. 86:2031-2035, 1989; and Finger, L. R.; Kagan, J.; Christopher, G.; Kurtzberg, J.; Hershfield, M. S.; Nowell, P. C.; Croce, C. M.: Involvement of the TCL5 gene on human chromosome 1 in T-cell leukemia and mel.

Further studies establishing the function and utilities of TAL1 are found in John Hopkins OMIM database record ID 187040, and in cited publications listed in Table 5, which are hereby incorporated by reference. Thromboxane a2 receptor (TBXA2R, Accession NM_001060.2) is another GAM30 target gene, herein designated TARGET GENE. TBXA2R BINDING SITE is a target binding site found in the 3' untranslated region of mRNA encoded by TBXA2R, corresponding to a target binding site such as BINDING SITE I, BINDING SITE II or BINDING SITE III of FIG. 8. Table 4 illustrates the complementarity of the nucleotide sequences of TBXA2R BINDING SITE, designated SEQ ID:3670, to the nucleotide sequence of GAM30 RNA, herein designated GAM RNA, also designated SEQ ID:346.

Another function of GAM30 is therefore inhibition of Thromboxane a2 receptor (TBXA2R, Accession NM_001060.2), a gene which activates Ca2+-activated chloride channels; stimulates platelet aggregation and smooth muscle constriction and therefore may be associated with Bleeding disorder. Accordingly, utilities of GAM30 include diagnosis, prevention and treatment of Bleeding disorder, and of other diseases and clinical conditions associated with TBXA2R.

The function of TBXA2R has been established by previous studies. Thromboxane A2 (TXA2), an arachidonate metabolite, is a potent stimulator of platelet aggregation and a constrictor of vascular and respiratory smooth muscles. It has been implicated as a mediator in diseases such as myocardial infarction, stroke, and bronchial asthma. Ushikubi et al. (1989) purified the cell surface receptor for TXA2, using a stable analog of TXA2. Using an oligonucleotide probe corresponding to its partial amino acid sequence, Hirata et al. (1991) obtained a cDNA encoding the receptor from human placenta and a partial cDNA clone from cultured human megakaryocytic leukemia cells. The placenta cDNA encoded a protein of 343 amino acids with 7 putative transmembrane domains. The protein expressed in COS-7 cells bound drugs with affinities identical to those of the platelet receptor, and that expressed in Xenopus oocytes opened calcium-ion-activated chloride channels on agonist stimulation. Northern blot analysis and nucleotide sequences of the 2 clones suggested that an identical form of thromboxane A2 receptor is present in platelets and vascular tissues.

Animal model experiments lend further support to the function of TBXA2R. The actions of TXA2 are mediated by G protein-coupled thromboxane- prostanoid (TP) receptors. TP receptors have been implicated in the pathogenesis of cardiovascular diseases. To investigate the physiologic functions of TP receptors, Thomas et al. (1998) generated TP receptor-deficient mice by gene targeting. Tp -/- animals reproduced and survived in expected numbers, and their major organ systems were normal. Thromboxane agonist binding could not be detected in tissues from Tp -/- mice. Bleeding times were prolonged in these mice and their platelets did not aggregate after exposure to TXA2 agonists. Aggregation responses after collagen stimulation were also delayed, although ADP-stimulated aggregation was normal. In summary, Tp - /-mice had a mild bleeding disorder and altered vascular responses to TXA2 and arachidonic acid. Their studies suggested that most of the recognized functions of TXA2 are mediated by the single known Tp gene locus.

It is appreciated that the abovementioned animal model for TBXA2R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hirata, M.; Hayashi, Y.; Ushikubi, F.; Yokota, Y.; Kageyama, R.; Nakanishi, S.; Narumiy, S.: Cloning and expression of cDNA for a human thromboxane A2 receptor. Nature 349:617-620, 1991; and Thomas, D. W.; Mannon, R. B.; Mannon, P. J.; Latour, A.; Oliver, J. A.; Hoffman, M.; Smithies, O.; Koller, B. H.; Coffman, T. M.: Coagulation defects and altered hemodynamic responses.

Further studies establishing the function and utilities of TBXA2R are found in John Hopkins OMIM database record ID 188070, and in cited publications listed in Table 5, which are hereby incorporated by reference. T-cell leukemia/lymphoma 6 (TCL6, Accession NM_020553.2) is another GAM30 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:16523 and SEQ ID:8729 respectively, to the nucleotide sequence of GAM30 RNA, herein designated GAM RNA, also designated SEQ ID:346.

Another function of GAM30 is therefore inhibition of T-cell leukemia/lymphoma 6 (TCL6, Accession NM_020553.2). Accordingly, utilities of GAM30 include diagnosis, prevention and treatment of diseases and clinical conditions associated with TCL6.

Teratocarcinoma-derived growth factor 1 (TDGF1, Accession NM_003212.1) is another GAM30 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:14244, to the nucleotide sequence of GAM30 RNA, herein designated GAM RNA, also designated SEQ ID:346.

Another function of GAM30 is therefore inhibition of Teratocarcinoma-derived growth factor 1 (TDGF1, Accession NM_003212.1), a gene which can play a role in the determination of the epiblastic cells that subsequently give rise to the mesoderm. and therefore may be associated with Forebrain defects. Accordingly, utilities of GAM30 include diagnosis, prevention and treatment of Forebrain defects, and of other diseases and clinical conditions associated with TDGF1.

The function of TDGF1 has been established by previous studies. Cryptic protein is required for proper laterality development in humans. TDGF1, like CFC1, is an EGF-CFC family member and an obligate coreceptor involved in NODAL signaling, a developmental program implicated in midline, forebrain, and left-right axis development in model organisms. A mutation in the conserved CFC domain of the TDGF1 gene (187395.0001) was demonstrated by de la Cruz et al. (2002) in a patient with midline anomalies of the forebrain. The mutant protein was inactive in a zebrafish rescue assay, indicating a role for TDGF1 in human midline and forebrain development. From a teratocarcinoma cell line, Ciccodicola et al. (1989) isolated a human cDNA (referred to as CRIPTO by them) encoding a protein of 188 amino acids. The central portion of this protein shared structural similarities with the human transforming growth factor alpha (OMIM Ref. No. 190170) and epidermal growth factor (EGF; 131530). Northern blot analysis of a wide variety of tumor and normal cell lines and tissues showed that CRIPTO transcripts are detected only in undifferentiated cells and disappear after cell differentiation induced by retinoic acid treatment.

Full details of the abovementioned studies are described in the following publications, the disclosure of which are hereby incorporated by reference:

de la Cruz, J. M.; Bamford, R. N.; Burdine, R. D.; Roessler, E.; Barkovich, A. J.; Donnai, D.; Schier, A. F.; Muenke, M.: A loss-of-function mutation in the CFC domain of TDGF1 is associated with human forebrain defects. Hum. Genet. 110: 422-428, 2002; and Ciccodicola, A.; Dono, R.; Obici, S.; Simeone, A.; Zollo, M.; Persico, M. G.: Molecular characterization of a gene of the 'EGF family' expressed in undifferentiated human NTERA2 terato.

Further studies establishing the function and utilities of TDGF1 are found in John Hopkins OMIM database record ID 187395, and in cited publications listed in Table 5, which are hereby incorporated by reference. Tumor necrosis factor, alpha-induced protein 2 (TNFAIP2, Accession NM_006291.2) is another GAM30 target gene, herein designated TARGET GENE. TNFAIP2 BINDING SITE is a target binding site found in the 3' untranslated region of mRNA encoded by TNFAIP2, corresponding to a target binding site such as BINDING SITE I, BINDING SITE II or BINDING SITE III of FIG. 8. Table 4 illustrates the complementarity of the nucleotide sequences of TNFAIP2 BINDING SITE, designated SEQ ID:14761, to the nucleotide sequence of GAM30 RNA, herein designated GAM RNA, also designated SEQ ID:346.

Another function of GAM30 is therefore inhibition of Tumor necrosis factor, alpha-induced protein 2 (TNFAIP2, Accession NM_006291.2). Accordingly, utilities of GAM30 include diagnosis, prevention and treatment of diseases and clinical conditions associated with TNFAIP2.

Tumor necrosis factor receptor superfamily, member 10b (TNFRSF10B, Accession NM_147187.1) is another GAM30 target gene, herein designated TARGET GENE. TNFRSF10B BINDING SITE is a target binding site found in the 5' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:1494, to the nucleotide sequence of GAM30 RNA, herein designated GAM RNA, also designated SEQ ID:346.

Another function of GAM30 is therefore inhibition of Tumor necrosis factor receptor superfamily, member 10b (TNFRSF10B, Accession NM_147187.1), a gene which forms complex that induces apoptosis. and therefore may be associated with Squamous cell carcinoma. Accordingly, utilities of GAM30 include diagnosis, prevention and treatment of Squamous cell carcinoma, and of other diseases and clinical conditions associated with TNFRSF10B.

The function of TNFRSF10B has been established by previous studies. The 8p21 region contains a number of putative tumor suppressor genes and is a frequent site of translocations in head and neck tumors. Pai et al. (1998) determined the genomic structure of KILLER/DR5 and performed sequence analysis of all 10 coding exons in 20 primary head and neck cancers with allelic loss of 8p. To screen for a subset of mutations localized to the functional cytoplasmic death domain, they sequenced this region in an additional 40 primary head and neck cancers. They found 2 alterations, including a 2-bp insertion at a minimal repeat site, introducing a premature stop codon and resulting in a truncated protein. This KILLER/DR5 mutation was also present in the germline of the affected patient, and the tumor did not have a p53 mutation by sequence analysis. Transfection studies in head and neck squamous cell carcinoma and colon and ovarian carcinoma cell lines revealed loss of growth suppressive function associated with the tumor-derived KILLER/DR5 truncation mutant. These observations provided the first evidence for mutation of a TRAIL death receptor gene in a human cancer, leading to loss of its apoptotic function. The second alteration identified by Pai et al. (1998) was a single T- to - C point mutation at residue 1109 that resulted in an amino acid change from val to ala. This mutation was not present in the germline; however, sequence analysis of p53 in this tumor revealed a point mutation of T to C in codon 242, resulting in a change from arg to cys. In a case of a head and neck squamous cell carcinoma (OMIM Ref. No. 601400), Pai et al. (1998) found a 2-bp insertion in the TNFRSF10B gene at a minimal repeat site (ACAC) at residue 1065, which introduced a premature stop codon and resulted in a truncated protein. Sequence analysis of normal tissue from the patient showed that the truncating mutation was also present in the germline, and that the tumor did not have a p53 mutation. A significant impairment in the ability of the truncation mutant to suppress colony formation was observed when mutant cDNA was transfected into human colon and ovarian cancer cell lines. In the wildtype transfected cells, there was no observed colony survival; however, there was more than 50% colony growth in cells transfected with the tumor-derived mutant. Pai et al. (1998) suspected that the mutant retained partial function, because its overexpression in a background of cells containing the endogenous wildtype gene could further reduce the percentage of colony survival.

Full details of the abovementioned studies are described in the following publications, the disclosure of which are hereby incorporated by reference:

Pai, S. I.; Wu, G. S.; Ozoren, N.; Wu, L.; Jen, J.; Sidransky, D.; El-Deiry, W. S.: Rare loss-of-function mutation of a death receptor gene in head and neck cancer. Cancer Res. 58:3513-3518, 1998; and Screaton, G. R.; Mongkolsapay, J.; Xu, X.-N.; Cowper, A. E.; McMichael, A. J.; Bell, J. I.: TRICK2, a new alternatively spliced receptor that transduces the cytotoxic signal from TRAIL.

Further studies establishing the function and utilities of TNFRSF10B are found in John Hopkins OMIM database record ID 603612, and in cited publications listed in Table 5, which are hereby incorporated by reference. Tumor necrosis factor receptor superfamily, member 11a, activator of nfkb (TNFRSF11A, Accession NM_003839.2) is another GAM30 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:4393, to the nucleotide sequence of GAM30 RNA, herein designated GAM RNA, also designated SEQ ID:346.

Another function of GAM30 is therefore inhibition of Tumor necrosis factor receptor superfamily, member 11a, activator of nfkb (TNFRSF11A, Accession NM_003839.2). Accordingly, utilities of GAM30 include diagnosis, prevention and treatment of diseases and clinical conditions associated with TNFRSF11A.

Torsin family 1, member b (torsin b) (TOR1B, Accession NM_014506.1) is another GAM30 target gene, herein designated TARGET GENE. TOR1B BINDING SITE is a target binding site found in the 3' untranslated region of mRNA encoded by TOR1B, corresponding to a target binding site such as BINDING SITE I, BINDING SITE II or BINDING SITE III of FIG. 8. Table 4 illustrates the complementarity of the nucleotide sequences of TOR1B BINDING SITE, designated SEQ ID:17084, to the nucleotide sequence of GAM30 RNA, herein designated GAM RNA, also designated SEQ ID:346.

Another function of GAM30 is therefore inhibition of Torsin family 1, member b (torsin b) (TOR1B, Accession NM_014506.1). Accordingly, utilities of GAM30 include diagnosis, prevention and treatment of diseases and clinical conditions associated with TOR1B.

TUCAN (Accession NM_014959.1) is another GAM30 target gene, herein designated TARGET GENE. TUCAN BINDING SITE is a target binding site found in the 3' untranslated region of mRNA encoded by TUCAN, corresponding to a target binding site such as BINDING SITE I, BINDING SITE II or BINDING SITE III of FIG. 8. Table 4 illustrates the complementarity of the nucleotide sequences of TUCAN BINDING SITE, designated SEQ ID:19251, to the nucleotide sequence of GAM30 RNA, herein designated GAM RNA, also designated SEQ ID:346.

Another function of GAM30 is therefore inhibition of TUCAN (Accession NM_014959.1). Accordingly, utilities of GAM30 include diagnosis, prevention and treatment of diseases and clinical conditions associated with TUCAN.

Wolf-hirschhorn syndrome candidate 1 (WHSC1, Accession NM_133332.1) is another GAM30 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:12757, to the nucleotide sequence of GAM30 RNA, herein designated GAM RNA, also designated SEQ ID:346.

Another function of GAM30 is therefore inhibition of Wolf-hirschhorn syndrome candidate 1 (WHSC1, Accession NM_133332.1), a gene which binds covalently to and repairs g/t mismatches. and therefore may be associated with Wolf-hirschhorn syndrome. Accordingly, utilities of GAM30 include diagnosis, prevention and treatment of Wolf-hirschhorn syndrome, and of other diseases and clinical conditions associated with WHSC1.

The function of WHSC1 has been established by previous studies. Wolf- Hirschhorn syndrome (WHS; 194190) is a malformation syndrome associated with a hemizygous deletion of the distal short arm of chromosome 4 (OMIM Ref. No. 4p16.3). The shortest region of overlap of the deletions observed in WHS patients, the WHS critical region, has been confined to a region of 165 kb (Wright et al., 1997). This region was sequenced completely during the search for the Huntington disease gene (Baxendale et al., 1993). Stec et al. (1998) described a novel developmental gene, two-thirds of which maps in the distal part of the WHS critical region. They designated the gene WHSC1 (Wolf-Hirschhorn syndrome candidate-1). The WHSC1 gene was identified initially through its high similarity to the translation product of an expressed sequence tag, located in the 165-kb WHCR, with the SET domain (see OMIM Ref. No. 600960) of the Drosophila protein ASH1 (OMIM Ref. No. 100790). The SET domain is found in proteins that are involved in embryonic development. The 25-exon WHSC1 gene was found to be expressed ubiquitously in early development and to undergo complex alternative splicing and differential polyadenylation. It encodes a 136-kD protein containing 4 domains present in other developmental proteins: a PWWP domain, an HMG box, a SET domain also found in the Drosophila dysmorphy gene ash- encoded protein, and a PHD-type zinc finger. It is expressed preferentially in rapidly growing embryonic tissues, in a pattern corresponding to affected organs in WHS patients. The nature of the protein motifs, the expression pattern, and its mapping to the critical region led Stec et al. (1998) to propose WHSC1 as a good candidate gene to be responsible for many of the phenotypic features of WHS. Stec et al. (1998) noted that the t(4;14)(p16.3;q32.3) translocations described in a significant fraction of multiple myelomas (Richelda et al., 1997; Chesi et al., 1997) have breakpoints located less than 100 kb centromeric of the FGFR3 gene (OMIM Ref. No. 134934) on 4p16.3. They found that at least 3 of the breakpoints merged the immunoglobulin heavy-chain gene (IGHG1; 147100) on chromosome 14 with the WHSC1 gene. This fusion of genes and their untimely expression in the myeloid lineage driven from the 5-prime IgH enhancer may indicate that WHSC1-encoded proteins are involved in the clinical heterogeneity of multiple myeloma.

Full details of the abovementioned studies are described in the following publications, the disclosure of which are hereby incorporated by reference:

Chesi, M.; Nardini, E.; Brents, L. A.; Schrock, E.; Ried, T.; Kuehl, W. M.; Bergsagel, P. L.: Frequent translocation t(4; 14)(p16.3;q32.3) in multiple myeloma is associated with increased expression and activating mutations of fibroblast growth factor receptor 3. Nature Genet. 16:260-264, 1997 and Richelda, R.; Ronchetti, D.; Baldini, L.; Cro, L.; Viggiano, L.; Marzella, R.; Rocchi, M.; Otsuki, T.; Lombardi, L.; Maiolo, A. T.; Neri, A.: A novel chromosomal translocation t(4;14)(p16.

Further studies establishing the function and utilities of WHSC1 are found in John Hopkins OMIM database record ID 602952, and in cited publications listed in Table 5, which are hereby incorporated by reference. V-yes-1 yamaguchi sarcoma viral oncogene homolog 1 (YES1, Accession NM_005433.2) is another GAM30 target gene, herein designated TARGET GENE. YES1 BINDING SITE is a target binding site found in the 3' untranslated region of mRNA encoded by YES1, corresponding to a target binding site such as BINDING SITE I, BINDING SITE II or BINDING SITE III of FIG. 8. Table 4 illustrates the complementarity of the nucleotide sequences of YES1 BINDING SITE, designated SEQ ID:3761, to the nucleotide sequence of GAM30 RNA, herein designated GAM RNA, also designated SEQ ID:346.

Another function of GAM30 is therefore inhibition of V-yes-1 yamaguchi sarcoma viral oncogene homolog 1 (YES1, Accession NM_005433.2), a gene which is a putative protein-tyrosine kinase. Accordingly, utilities of GAM30 include diagnosis, prevention and treatment of diseases and clinical conditions associated with YES1.

The function of YES1 has been established by previous studies. The YES oncogene is homologous to the gene of the Yamaguchi sarcoma virus. The product of the gene is associated with tyrosine-specific protein kinase activity and its amino acid sequence shows a high degree of homology with that of the SRC gene product of Rous sarcoma virus. Semba et al. (1985) found in DNA from human embryo fibroblasts 10 EcoRI fragments that hybridized with the Yamaguchi sarcoma virus oncogene. Four of these (designated YES1) were assigned to chromosome 18 and 1 (designated YES2) was assigned to chromosome 6 by a study of human-mouse cell hybrids. (YES2 was later found (Semba et al., 1988) to be a pseudogene of YES1 and to be located at 22q11.2. Semba et al. (1988) stated: 'The failure of proper mapping in our earlier experiment might have been caused by instability of hybrid cell clones.') The other 5 fragments could not be mapped either because hybridization signals were too weak or differentiation from mouse YES fragments was impossible. There was evidence for multiple copies of YES- related genes in the human genome, but only a single RNA species, 4.8 kb long, was found. At least 3 of the human YES gene copies had both introns and exons and 1 gene copy appeared to be a pseudogene. By isotopic in situ hybridization, Yoshida et al. (1985) mapped the YES1 gene to 18q21.3. These workers suggested that the localization is consistent with a role in the pathogenesis of follicular lymphoma, which is frequently associated with a 14;18 translocation with the breakpoint at 18q21 (Fukuhara et al., 1979); see 151430. Ohno et al. (1987) found that although it is in the same chromosome region as BCL2 (OMIM Ref. No. 151430), the YES gene is intact in cases of follicular lymphoma. Using yeast artificial chromosomes (YACs) containing the YES1 gene as probes and fluorescence in situ hybridization, Silverman et al. (1993) detected a strong signal in the region corresponding to 18p11.3. These YACs were found to contain another 18p11.32 gene, thymidylate synthase (OMIM Ref. No. 188350); the genes were less than 50 kb apart. Overhauser et al. (1993) identified a sequence tagged site (STS) in the YES1 gene and used it in studies of somatic cell hybrids with deletion of various segments of chromosome 18 to map the gene to 18pter-p11.21.

Full details of the abovementioned studies are described in the following publications, the disclosure of which are hereby incorporated by reference:

Semba, K.; Yamanashi, Y.; Nishizawa, M.; Sukegawa, J.; Yoshida, M.; Sasaki, M.; Yamamoto, T.; Toyoshima, K.: Location of the c-yes gene on the human chromosome and its expression in various tissues. Science 227:1038-1040, 1985; and Overhauser, J.; Mewar, R.; Rojas, K.; Lia, K.; Kline, A. D.; Silverman, G. A.: STS map of genes and anonymous DNA fragments on human chromosome 18 using a panel of somatic cell hybrids.

Further studies establishing the function and utilities of YES1 are found in John Hopkins OMIM database record ID 164880, and in cited publications listed in Table 5, which are hereby incorporated by reference.

FIG. 8 further provides a conceptual description of a novel bioinformatically detected of the present invention, referred to here as Genomic Address Messenger 31 (GAM31), which modulates expression of respective target genes thereof, the function and utility of which target genes is known in the art.

GAM31 is a novel bioinformatically detected regulatory, non protein coding, micro RNA (miRNA) gene. The method by which GAM31 was detected is described hereinabove with reference to FIGS. 8-15.

GAM31 gene, herein designated GAM GENE, and GAM31 target gene, herein designated TARGET GENE, are human genes contained in the human genome.

GAM31 gene encodes a GAM31 precursor RNA, herein designated GAM PRECURSOR RNA. Similar to other miRNA genes, and unlike most ordinary genes, GAM31 precursor RNA does not encode a protein. A nucleotide sequence identical or highly similar to the nucleotide sequence of GAM31 precursor RNA is designated SEQ ID:118, and is provided hereinbelow with reference to the sequence listing part. Nucleotide sequence SEQ ID:118 is located at position 57935221 relative to chromosome 12.

GAM31 precursor RNA folds onto itself, forming GAM31 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM31 precursor RNA folds onto itself, forming GAM31 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM31 precursor RNA, designated SEQ-ID:118, and a schematic representation of a predicted secondary folding of GAM31 folded precursor RNA are further described with reference to Table 2, hereby incorporated by reference.

An enzyme complex designated DICER COMPLEX, 'dices' the GAM31 folded precursor RNA into GAM31 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM31 RNA is designated SEQ ID:250, and is provided hereinbelow with references to the sequence listing part and Table 3, hereby incorporated by reference.

GAM31 target gene, herein designated TARGET GENE, encodes a corresponding messenger RNA, GAM31 target RNA, herein designated GAM TARGET RNA. GAM31 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM31 RNA, herein designated GAM RNA, binds complementarily to one or more target binding sites located in untranslated regions of GAM31 target RNA, herein designated GAM TARGET RNA. This complementary binding is due to the fact that the nucleotide sequence of GAM31 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM31 RNA may have a different number of target binding sites in untranslated regions of a GAM31 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM31 RNA, herein designated GAM RNA, to target binding sites on GAM31 target RNA, herein designated GAM TARGET RNA, such as BINDING SITE I, BINDING SITE II and BINDING SITE III, inhibits translation of GAM31 target RNA into GAM31 target protein, herein designated GAM TARGET PROTEIN. GAM target protein is therefore outlined by a broken line.

It is appreciated that GAM31 target gene, herein designated TARGET GENE, in fact represents a plurality of GAM31 target genes. The mRNA of each one of this plurality of GAM31 target genes comprises one or more target binding sites, each having a nucleotide sequence which is at least partly complementary to GAM31 RNA, herein designated GAM RNA, and which when bound by GAM31 RNA causes inhibition of translation of respective one or more GAM31 target proteins.

It is further appreciated by one skilled in the art that the mode of translational inhibition illustrated by FIG. 8 with specific reference to translational inhibition exerted by GAM31 gene, herein designated GAM GENE, on one or more GAM31 target genes, herein collectively designated TARGET GENE, is common to other known miRNA genes.

As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM31 correlate with, and may be deduced from, the identity of the target genes which GAM31 binds and inhibits, and the function of these target genes, as elaborated hereinbelow.

(Accession NP_444285.1) is a GAM31 target gene, herein designated TARGET GENE. BINDING SITE is a target binding site found in the 5' untranslated region of multiple transcripts of mRNA encoded by, corresponding to a target binding site such as BINDING SITE I, BINDING SITE II or BINDING SITE III of FIG. 8. Table 4 illustrates the complementarity of the nucleotide sequences of BINDING SITE, designated SEQ ID:12532, to the nucleotide sequence of GAM31 RNA, herein designated GAM RNA, also designated SEQ ID:250.

A function of GAM31 is therefore inhibition of (Accession NP_444285.1). Accordingly, utilities of GAM31 include diagnosis, prevention and treatment of diseases and clinical conditions associated with .

Acidic repeat containing (ACRC, Accession NP_443189.1) is another GAM31 target gene, herein designated TARGET GENE. ACRC BINDING SITE is a target binding site found in the 3' untranslated region of mRNA encoded by ACRC, corresponding to a target binding site such as BINDING SITE I, BINDING SITE II or BINDING SITE III of FIG. 8. Table 4 illustrates the complementarity of the nucleotide sequences of ACRC BINDING SITE, designated SEQ ID:8811, to the nucleotide sequence of GAM31 RNA, herein designated GAM RNA, also designated SEQ ID:250.

Another function of GAM31 is therefore inhibition of Acidic repeat containing (ACRC, Accession NP_443189.1). Accordingly, utilities of GAM31 include diagnosis, prevention and treatment of diseases and clinical conditions associated with ACRC.

Reserved (ASRGL1, Accession NP_079356.2) is another GAM31 target gene, herein designated TARGET GENE. ASRGL1 BINDING SITE is a target binding site found in the 3' untranslated region of mRNA encoded by ASRGL1, corresponding to a target binding site such as BINDING SITE I, BINDING SITE II or BINDING SITE III of FIG. 8. Table 4 illustrates the complementarity of the nucleotide sequences of ASRGL1 BINDING SITE, designated SEQ ID:8589, to the nucleotide sequence of GAM31 RNA, herein designated GAM RNA, also designated SEQ ID:250.

Another function of GAM31 is therefore inhibition of Reserved (ASRGL1, Accession NP_079356.2). Accordingly, utilities of GAM31 include diagnosis, prevention and treatment of diseases and clinical conditions associated with ASRGL1.

Ataxia telangiectasia mutated (includes complementation groups a, c and d) (ATM, Accession NP_612150.1) is another GAM31 target gene, herein designated TARGET GENE. ATM BINDING SITE is a target binding site found in the 3' untranslated region of multiple transcripts of mRNA encoded by ATM, corresponding to a target binding site such as BINDING SITE I, BINDING SITE II or BINDING SITE III of FIG. 8. Table 4 illustrates the complementarity of the nucleotide sequences of ATM BINDING SITE, designated SEQ ID:12329, to the nucleotide sequence of GAM31 RNA, herein designated GAM RNA, also designated SEQ ID:250.

Another function of GAM31 is therefore inhibition of Ataxia telangiectasia mutated (includes complementation groups a, c and d) (ATM, Accession NP_612150.1). Accordingly, utilities of GAM31 include diagnosis, prevention and treatment of diseases and clinical conditions associated with ATM.

BA526D8.4 (Accession XP_046861.2) is another GAM31 target gene, herein designated TARGET GENE. BA526D8.4 BINDING SITE is a target binding site found in the 3' untranslated region of mRNA encoded by BA526D8.4, corresponding to a target binding site such as BINDING SITE I, BINDING SITE II or BINDING SITE III of FIG. 8. Table 4 illustrates the complementarity of the nucleotide sequences of BA526D8.4 BINDING SITE, designated SEQ ID:10428, to the nucleotide sequence of GAM31 RNA, herein designated GAM RNA, also designated SEQ ID:250.

Another function of GAM31 is therefore inhibition of BA526D8.4 (Accession XP_046861.2). Accordingly, utilities of GAM31 include diagnosis, prevention and treatment of diseases and clinical conditions associated with BA526D8.4.

B-cell cll/lymphoma 7b (BCL7B, Accession NP_001698.2) is another GAM31 target gene, herein designated TARGET GENE. BCL7B BINDING SITE1 and BCL7B BINDING SITE2 are target binding sites found in untranslated regions of multiple transcripts of mRNA encoded by BCL7B, corresponding to target binding sites such as BINDING SITE I, BINDING SITE II or BINDING SITE III of FIG. 8. Table 4 illustrates the complementarity of the nucleotide sequences of BCL7B BINDING SITE1 and BCL7B BINDING SITE2, designated SEQ ID:12161 and SEQ ID:18017 respectively, to the nucleotide sequence of GAM31 RNA, herein designated GAM RNA, also designated SEQ ID:250.

Another function of GAM31 is therefore inhibition of B-cell cll/lymphoma 7b (BCL7B, Accession NP_001698.2), a gene which is of yet unknown fanction and therefore may be associated with Williams-beuren syndrome. Accordingly, utilities of GAM31 include diagnosis, prevention and treatment of Williams-beuren syndrome, and of other diseases and clinical conditions associated with BCL7B.

The function of BCL7B has been established by previous studies. Meng et al. (1998) constructed a physical map encompassing the 1.5-Mb region of chromosome 7q11.23 that is commonly deleted in Williams-Beuren syndrome (WBS; 194050). They identified 3 genes within this region, including BCL7B, which contains 6 exons. By EST database searching, screening of a liver cDNA library, and sequencing, they cloned a BCL7B cDNA encoding a deduced 202-amino acid protein that shows high homology to the BCL7A gene (OMIM Ref. No. 601406), which was cloned from a complex chromosomal translocation in Burkitt lymphoma cell lines. BCL7B is highly conserved from C. elegans to human, suggesting that it has been conserved through evolution.

Full details of the abovementioned studies are described in the following publications, the disclosure of which are hereby incorporated by reference:

Jadayel, D. M.; Osborne, L. R.; Coignet, L. J. A.; Zani, V. J.; Tsui, L.-C.; Scherer, S. W.; Dyer, M. J. S.: The BCL7 gene family: deletion of BCL7B in Williams syndrome. Gene 224: 35-44, 1998; and Meng, X.; Lu, X.; Li, Z.; Green, E. D.; Massa, H.; Trask, B. J.; Morris, C. A.; Keating, M. T.: Complete physical map of the common deletion region in Williams syndrome and identificat.

Further studies establishing the function and utilities of BCL7B are found in John Hopkins OMIM database record ID 605846, and in cited publications listed in Table 5, which are hereby incorporated by reference. Chromosome 1 open reading frame 22 (C1orf22, Accession NP_079467.2) is another GAM31 target gene, herein designated TARGET GENE. C1orf22 BINDING SITE is a target binding site found in the 3' untranslated region of mRNA encoded by C1orf22, corresponding to a target binding site such as BINDING SITE I, BINDING SITE II or BINDING SITE III of FIG. 8. Table 4 illustrates the complementarity of the nucleotide sequences of C1orf22 BINDING SITE, designated SEQ ID:17483, to the nucleotide sequence of GAM31 RNA, herein designated GAM RNA, also designated SEQ ID:250.

Another function of GAM31 is therefore inhibition of Chromosome 1 open reading frame 22 (C1orf22, Accession NP_079467.2). Accordingly, utilities of GAM31 include diagnosis, prevention and treatment of diseases and clinical conditions associated with C1orf22.

Chromosome 21 open reading frame 108 (C21orf108, Accession XP_114191.2) is another GAM31 target gene, herein designated TARGET GENE. C21orf108 BINDING SITE is a target binding site found in the 3' untranslated region of mRNA encoded by C21orf108, corresponding to a target binding site such as BINDING SITE I, BINDING SITE II or BINDING SITE III of FIG. 8. Table 4 illustrates the complementarity of the nucleotide sequences of C21orf108 BINDING SITE, designated SEQ ID:1584, to the nucleotide sequence of GAM31 RNA, herein designated GAM RNA, also designated SEQ ID:250.

Another function of GAM31 is therefore inhibition of Chromosome 21 open reading frame 108 (C21orf108, Accession XP_114191.2). Accordingly, utilities of GAM31 include diagnosis, prevention and treatment of diseases and clinical conditions associated with C21orf108.

Chromosome 6 open reading frame 33 (C6orf33, Accession NP_588608.1) is another GAM31 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:8970, to the nucleotide sequence of GAM31 RNA, herein designated GAM RNA, also designated SEQ ID:250.

Another function of GAM31 is therefore inhibition of Chromosome 6 open reading frame 33 (C6orf33, Accession NP_588608.1). Accordingly, utilities of GAM31 include diagnosis, prevention and treatment of diseases and clinical conditions associated with C6orf33.

Chemokine (c-c motif) ligand 15 (CCL15, Accession NP_116740.1) is another GAM31 target gene, herein designated TARGET GENE. CCL15 BINDING SITE is a target binding site found in the 3' untranslated region of multiple transcripts of mRNA encoded by CCL15, corresponding to a target binding site such as BINDING SITE I, BINDING SITE II or BINDING SITE III of FIG. 8. Table 4 illustrates the complementarity of the nucleotide sequences of CCL15 BINDING SITE, designated SEQ ID:13409, to the nucleotide sequence of GAM31 RNA, herein designated GAM RNA, also designated SEQ ID:250.

Another function of GAM31 is therefore inhibition of Chemokine (c-c motif) ligand 15 (CCL15, Accession NP_116740.1). Accordingly, utilities of GAM31 include diagnosis, prevention and treatment of diseases and clinical conditions associated with CCL15.

Chemokine (c-c motif) ligand 15 (CCL15, Accession NP_004158.1) is another GAM31 target gene, herein designated TARGET GENE. CCL15 BINDING SITE is a target binding site found in the 3' untranslated region of multiple transcripts of mRNA encoded by CCL15, corresponding to a target binding site such as BINDING SITE I, BINDING SITE II or BINDING SITE III of FIG. 8. Table 4 illustrates the complementarity of the nucleotide sequences of CCL15 BINDING SITE, designated SEQ ID:13409, to the nucleotide sequence of GAM31 RNA, herein designated GAM RNA, also designated SEQ ID:250.

Another function of GAM31 is therefore inhibition of Chemokine (c-c motif) ligand 15 (CCL15, Accession NP_004158.1). Accordingly, utilities of GAM31 include diagnosis, prevention and treatment of diseases and clinical conditions associated with CCL15.

Cd5 antigen-like (scavenger receptor cysteine rich family) (CD5L, Accession NP_005885.1) is another GAM31 target gene, herein designated TARGET GENE. CD5L BINDING SITE is a target binding site found in the 3' untranslated region of mRNA encoded by CD5L, corresponding to a target binding site such as BINDING SITE I, BINDING SITE II or BINDING SITE III of FIG. 8. Table 4 illustrates the complementarity of the nucleotide sequences of CD5L BINDING SITE, designated SEQ ID:1774, to the nucleotide sequence of GAM31 RNA, herein designated GAM RNA, also designated SEQ ID:250.

Another function of GAM31 is therefore inhibition of Cd5 antigen-like (scavenger receptor cysteine rich family) (CD5L, Accession NP_005885.1). Accordingly, utilities of GAM31 include diagnosis, prevention and treatment of diseases and clinical conditions associated with CD5L.

Chloride intracellular channel 6 (CLIC6, Accession NP_444507.1) is another GAM31 target gene, herein designated TARGET GENE. CLIC6 BINDING SITE is a target binding site found in the 3' untranslated region of mRNA encoded by CLIC6, corresponding to a target binding site such as BINDING SITE I, BINDING SITE II or BINDING SITE III of FIG. 8. Table 4 illustrates the complementarity of the nucleotide sequences of CLIC6 BINDING SITE, designated SEQ ID:15773, to the nucleotide sequence of GAM31 RNA, herein designated GAM RNA, also designated SEQ ID:250.

Another function of GAM31 is therefore inhibition of Chloride intracellular channel 6 (CLIC6, Accession NP_444507.1). Accordingly, utilities of GAM31 include diagnosis, prevention and treatment of diseases and clinical conditions associated with CLIC6.

Cyclic nucleotide gated channel alpha 3 (CNGA3, Accession NP_001289.1) is another GAM31 target gene, herein designated TARGET GENE. CNGA3 BINDING SITE is a target binding site found in the 3' untranslated region of mRNA encoded by CNGA3, corresponding to a target binding site such as BINDING SITE I, BINDING SITE II or BINDING SITE III of FIG. 8. Table 4 illustrates the complementarity of the nucleotide sequences of CNGA3 BINDING SITE, designated SEQ ID:5811, to the nucleotide sequence of GAM31 RNA, herein designated GAM RNA, also designated SEQ ID:250.

Another function of GAM31 is therefore inhibition of Cyclic nucleotide gated channel alpha 3 (CNGA3, Accession NP_001289.1). Accordingly, utilities of GAM31 include diagnosis, prevention and treatment of diseases and clinical conditions associated with CNGA3.

Chemokine (c-x-c motif) ligand 5 (CXCL5, Accession NP_002985.1) is another GAM31 target gene, herein designated TARGET GENE. CXCL5 BINDING SITE is a target binding site found in the 3' untranslated region of mRNA encoded by CXCL5, corresponding to a target binding site such as BINDING SITE I, BINDING SITE II or BINDING SITE III of FIG. 8. Table 4 illustrates the complementarity of the nucleotide sequences of CXCL5 BINDING SITE, designated SEQ ID:1275, to the nucleotide sequence of GAM31 RNA, herein designated GAM RNA, also designated SEQ ID:250.

Another function of GAM31 is therefore inhibition of Chemokine (c-x-c motif) ligand 5 (CXCL5, Accession NP_002985.1). Accordingly, utilities of GAM31 include diagnosis, prevention and treatment of diseases and clinical conditions associated with CXCL5.

DKFZP572C163 (Accession NP_149350.1) is another GAM31 target gene, herein designated TARGET GENE. DKFZP572C163 BINDING SITE is a target binding site found in the 5' untranslated region of mRNA encoded by DKFZP572C163, corresponding to a target binding site such as BINDING SITE I, BINDING SITE II or BINDING SITE III of FIG. 8. Table 4 illustrates the complementarity of the nucleotide sequences of DKFZP572C163 BINDING SITE, designated SEQ ID:17529, to the nucleotide sequence of GAM31 RNA, herein designated GAM RNA, also designated SEQ ID:250.

Another function of GAM31 is therefore inhibition of DKFZP572C163 (Accession NP_149350.1). Accordingly, utilities of GAM31 include diagnosis, prevention and treatment of diseases and clinical conditions associated with DKFZP572C163.

Egf-like-domain, multiple 5 (EGFL5, Accession XP_098838.1) is another GAM31 target gene, herein designated TARGET GENE. EGFL5 BINDING SITE is a target binding site found in the 5' untranslated region of mRNA encoded by EGFL5, corresponding to a target binding site such as BINDING SITE I, BINDING SITE II or BINDING SITE III of FIG. 8. Table 4 illustrates the complementarity of the nucleotide sequences of EGFL5 BINDING SITE, designated SEQ ID:14518, to the nucleotide sequence of GAM31 RNA, herein designated GAM RNA, also designated SEQ ID:250.

Another function of GAM31 is therefore inhibition of Egf-like-domain, multiple 5 (EGFL5, Accession XP_098838.1). Accordingly, utilities of GAM31 include diagnosis, prevention and treatment of diseases and clinical conditions associated with EGFL5.

FLJ10292 (Accession NP_060518.1) is another GAM31 target gene, herein designated TARGET GENE. FLJ10292 BINDING SITE is a target binding site found in the 3' untranslated region of mRNA encoded by FLJ10292, corresponding to a target binding site such as BINDING SITE I, BINDING SITE II or BINDING SITE III of FIG. 8. Table 4 illustrates the complementarity of the nucleotide sequences of FLJ10292 BINDING SITE, designated SEQ ID:2300, to the nucleotide sequence of GAM31 RNA, herein designated GAM RNA, also designated SEQ ID:250.

Another function of GAM31 is therefore inhibition of FLJ10292 (Accession NP_060518.1). Accordingly, utilities of GAM31 include diagnosis, prevention and treatment of diseases and clinical conditions associated with FLJ10292.

FLJ10785 (Accession XP_291008.1) is another GAM31 target gene, herein designated TARGET GENE. FLJ10785 BINDING SITE is a target binding site found in the 3' untranslated region of mRNA encoded by FLJ10785, corresponding to a target binding site such as BINDING SITE I, BINDING SITE II or BINDING SITE III of FIG. 8. Table 4 illustrates the complementarity of the nucleotide sequences of FLJ10785 BINDING SITE, designated SEQ ID:8309, to the nucleotide sequence of GAM31 RNA, herein designated GAM RNA, also designated SEQ ID:250.

Another function of GAM31 is therefore inhibition of FLJ10785 (Accession XP_291008.1). Accordingly, utilities of GAM31 include diagnosis, prevention and treatment of diseases and clinical conditions associated with FLJ10785.

FLJ14437 (Accession NP_115967.1) is another GAM31 target gene, herein designated TARGET GENE. FLJ14437 BINDING SITE is a target binding site found in the 3' untranslated region of mRNA encoded by FLJ14437, corresponding to a target binding site such as BINDING SITE I, BINDING SITE II or BINDING SITE III of FIG. 8. Table 4 illustrates the complementarity of the nucleotide sequences of FLJ14437 BINDING SITE, designated SEQ ID:15994, to the nucleotide sequence of GAM31 RNA, herein designated GAM RNA, also designated SEQ ID:250.

Another function of GAM31 is therefore inhibition of FLJ14437 (Accession NP_115967.1). Accordingly, utilities of GAM31 include diagnosis, prevention and treatment of diseases and clinical conditions associated with FLJ14437.

FLJ25955 (Accession XP_092154.2) is another GAM31 target gene, herein designated TARGET GENE. FLJ25955 BINDING SITE is a target binding site found in the 3' untranslated region of mRNA encoded by FLJ25955, corresponding to a target binding site such as BINDING SITE I, BINDING SITE II or BINDING SITE III of FIG. 8. Table 4 illustrates the complementarity of the nucleotide sequences of FLJ25955 BINDING SITE, designated SEQ ID:586, to the nucleotide sequence of GAM31 RNA, herein designated GAM RNA, also designated SEQ ID:250.

Another function of GAM31 is therefore inhibition of FLJ25955 (Accession XP_092154.2). Accordingly, utilities of GAM31 include diagnosis, prevention and treatment of diseases and clinical conditions associated with FLJ25955.

FLJ38723 (Accession NP_776166.1) is another GAM31 target gene, herein designated TARGET GENE. FLJ38723 BINDING SITE is a target binding site found in the 3' untranslated region of mRNA encoded by FLJ38723, corresponding to a target binding site such as BINDING SITE I, BINDING SITE II or BINDING SITE III of FIG. 8. Table 4 illustrates the complementarity of the nucleotide sequences of FLJ38723 BINDING SITE, designated SEQ ID:19912, to the nucleotide sequence of GAM31 RNA, herein designated GAM RNA, also designated SEQ ID:250.

Another function of GAM31 is therefore inhibition of FLJ38723 (Accession NP_776166.1). Accordingly, utilities of GAM31 include diagnosis, prevention and treatment of diseases and clinical conditions associated with FLJ38723.

FLJ38819 (Accession NP_665872.1) is another GAM31 target gene, herein designated TARGET GENE. FLJ38819 BINDING SITE is a target binding site found in the 3' untranslated region of mRNA encoded by FLJ38819, corresponding to a target binding site such as BINDING SITE I, BINDING SITE II or BINDING SITE III of FIG. 8. Table 4 illustrates the complementarity of the nucleotide sequences of FLJ38819 BINDING SITE, designated SEQ ID:12225, to the nucleotide sequence of GAM31 RNA, herein designated GAM RNA, also designated SEQ ID:250.

Another function of GAM31 is therefore inhibition of FLJ38819 (Accession NP_665872.1). Accordingly, utilities of GAM31 include diagnosis, prevention and treatment of diseases and clinical conditions associated with FLJ38819.

Fucosyltransferase 9 (alpha (1,3) fucosyltransferase) (FUT9, Accession NP_006572.1) is another GAM31 target gene, herein designated TARGET GENE. FUT9 BINDING SITE is a target binding site found in the 3' untranslated region of mRNA encoded by FUT9, corresponding to a target binding site such as BINDING SITE I, BINDING SITE II or BINDING SITE III of FIG. 8. Table 4 illustrates the complementarity of the nucleotide sequences of FUT9 BINDING SITE, designated SEQ ID:6340, to the nucleotide sequence of GAM31 RNA, herein designated GAM RNA, also designated SEQ ID:250.

Another function of GAM31 is therefore inhibition of Fucosyltransferase 9 (alpha (1,3) fucosyltransferase) (FUT9, Accession NP_006572.1), a gene which catalyzes alpha-1,3 glycosidic linkages. Accordingly, utilities of GAM31 include diagnosis, prevention and treatment of diseases and clinical conditions associated with FUT9.

The function of FUT9 has been established by previous studies. FUT9 is one of several alpha-3-fucosyltransferases that can catalyze the last step in the biosynthesis of Lewis antigen, the addition of a fucose to precursor polysaccharides. FUT9 synthesizes the LeX oligosaccharide, which is expressed in organ buds progressing in mesenchyma during human embryogenesis.

Full details of the abovementioned studies are described in the following publications, the disclosure of which are hereby incorporated by reference:

Cailleau-Thomas, A.; Coullin, P.; Candelier, J.-J.; Balanzino, L.; Mennesson, B.; Oriol, R.; Mollicone, R.: FUT4 and FUT9 genes are expressed early in human embryogenesis. Glycobiology 10:789-802, 2000; and Kaneko, M.; Kudo, T.; Iwasaki, H.; Ikehara, Y.; Nishihara, S.; Nakagawa, S.; Sasaki, K.; Shiina, T.; Inoko, H.; Saitou, N.; Narimatsu, H.: Alpha-1,3- fucoslytransferase (sic) IX (Fuc-T.

Further studies establishing the function and utilities of FUT9 are found in John Hopkins OMIM database record ID 606865, and in cited publications listed in Table 5, which are hereby incorporated by reference. KBRAS2 (Accession NP_060065.2) is another GAM31 target gene, herein designated TARGET GENE. KBRAS2 BINDING SITE is a target binding site found in the 3' untranslated region of mRNA encoded by KBRAS2, corresponding to a target binding site such as BINDING SITE I, BINDING SITE II or BINDING SITE III of FIG. 8. Table 4 illustrates the complementarity of the nucleotide sequences of KBRAS2 BINDING SITE, designated SEQ ID:703, to the nucleotide sequence of GAM31 RNA, herein designated GAM RNA, also designated SEQ ID:250.

Another function of GAM31 is therefore inhibition of KBRAS2 (Accession NP_060065.2). Accordingly, utilities of GAM31 include diagnosis, prevention and treatment of diseases and clinical conditions associated with KBRAS2.

Potassium inwardly-rectifying channel, subfamily j, member 10 (KCNJ10, Accession NP_002232.2) is another GAM31 target gene, herein designated TARGET GENE. KCNJ10 BINDING SITE is a target binding site found in the 3' untranslated region of mRNA encoded by KCNJ10, corresponding to a target binding site such as BINDING SITE I, BINDING SITE II or BINDING SITE III of FIG. 8. Table 4 illustrates the complementarity of the nucleotide sequences of KCNJ10 BINDING SITE, designated SEQ ID:10380, to the nucleotide sequence of GAM31 RNA, herein designated GAM RNA, also designated SEQ ID:250.

Another function of GAM31 is therefore inhibition of Potassium inwardly-rectifying channel, subfamily j, member 10 (KCNJ10, Accession NP_002232.2), a gene which may be responsible for potassium buffering action of glial cells in the brain. Accordingly, utilities of GAM31 include diagnosis, prevention and treatment of diseases and clinical conditions associated with KCNJ10.

The function of KCNJ10 has been established by previous studies. Potassium channels have been found in virtually all cells, and a large number of K(+) channel cDNAs have been cloned. They are generally classified into voltage-dependent (Kv) type (e.g., 176258 and 176264) and inwardly rectifying (Kir) type (e.g., 602106 and 600937). The former possesses 6 putative transmembrane regions, while the latter has 2 putative transmembrane regions. Doupnik et al. (1995) reported that Kir channels exhibit various physiologic functions, such as the maintenance of the resting membrane potential, the generation of prolonged action potentials, the modulation of cell excitability, and the transport of potassium ions. Takumi et al. (1995) reported that the K(AB)-2/Kir4.1 inwardly rectifying K(+) channel of rat has an ATP-binding domain of Walker-type A motif in the C-terminal intracellular region and is expressed in brain and kidney. In situ hybridization demonstrated that it is expressed predominantly in glial cells of rat membrane but also in the retinal Muller glial cells and marginal cells of the inner ear. By interspecific backcross analysis, Tada et al. (1997) demonstrated that the mouse gene encoding the glial inwardly rectifying potassium channel, symbolized Kcnj10 by them, maps to distal chromosome 1. Because of homology of this region of the mouse genome to human 1q, Tada et al. (1997) suggested that the putative human homolog, KCNJ10, maps to 1q Full details of the abovementioned studies are described in the following publications, the disclosure of which are hereby incorporated by reference:

Doupnik, C. A.; Davidson, N.; Lester, H. A.: The inward rectifier potassium channel family. Curr. Opin. Neurobiol. 5:268-277, 1995; and Tada, Y.; Horio, Y.; Takumi, T.; Terayama, M.; Tsuji, L.; Copeland, N. G.; Jenkins, N. A.; Kurachi, Y.: Assignment of the glial inwardly rectifying potassium channel K(AB)-2/Kir4.1 (Kcn.

Further studies establishing the function and utilities of KCNJ10 are found in John Hopkins OMIM database record ID 602208, and in cited publications listed in Table 5, which are hereby incorporated by reference. KIAA0010 (Accession NP_055486.1) is another GAM31 target gene, herein designated TARGET GENE. KIAA0010 BINDING SITE is a target binding site found in the 3' untranslated region of mRNA encoded by KIAA0010, corresponding to a target binding site such as BINDING SITE I, BINDING SITE II or BINDING SITE III of FIG. 8. Table 4 illustrates the complementarity of the nucleotide sequences of KIAA0010 BINDING SITE, designated SEQ ID:2192, to the nucleotide sequence of GAM31 RNA, herein designated GAM RNA, also designated SEQ ID:250.

Another function of GAM31 is therefore inhibition of KIAA0010 (Accession NP_055486.1). Accordingly, utilities of GAM31 include diagnosis, prevention and treatment of diseases and clinical conditions associated with KIAA0010.

KIAA0152 (Accession NP_055545.1) is another GAM31 target gene, herein designated TARGET GENE. KIAA0152 BINDING SITE is a target binding site found in the 3' untranslated region of mRNA encoded by KIAA0152, corresponding to a target binding site such as BINDING SITE I, BINDING SITE II or BINDING SITE III of FIG. 8. Table 4 illustrates the complementarity of the nucleotide sequences of KIAA0152 BINDING SITE, designated SEQ ID:10689, to the nucleotide sequence of GAM31 RNA, herein designated GAM RNA, also designated SEQ ID:250.

Another function of GAM31 is therefore inhibition of KIAA0152 (Accession NP_055545.1). Accordingly, utilities of GAM31 include diagnosis, prevention and treatment of diseases and clinical conditions associated with KIAA0152.

KIAA0459 (Accession XP_027862.1) is another GAM31 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:5812, to the nucleotide sequence of GAM31 RNA, herein designated GAM RNA, also designated SEQ ID:250.

Another function of GAM31 is therefore inhibition of KIAA0459 (Accession XP_027862.1). Accordingly, utilities of GAM31 include diagnosis, prevention and treatment of diseases and clinical conditions associated with KIAA0459.

KIAA1559 (Accession XP_054472.2) is another GAM31 target gene, herein designated TARGET GENE. KIAA1559 BINDING SITE is a target binding site found in the 3' untranslated region of mRNA encoded by KIAA1559, corresponding to a target binding site such as BINDING SITE I, BINDING SITE II or BINDING SITE III of FIG. 8. Table 4 illustrates the complementarity of the nucleotide sequences of KIAA1559 BINDING SITE, designated SEQ ID:528, to the nucleotide sequence of GAM31 RNA, herein designated GAM RNA, also designated SEQ ID:250.

Another function of GAM31 is therefore inhibition of KIAA1559 (Accession XP_054472.2). Accordingly, utilities of GAM31 include diagnosis, prevention and treatment of diseases and clinical conditions associated with KIAA1559.

KIDINS220 (Accession XP_291015.1) is another GAM31 target gene, herein designated TARGET GENE. KIDINS220 BINDING SITE is a target binding site found in the 3' untranslated region of mRNA encoded by KIDINS220, corresponding to a target binding site such as BINDING SITE I, BINDING SITE II or BINDING SITE III of FIG. 8. Table 4 illustrates the complementarity of the nucleotide sequences of KIDINS220 BINDING SITE, designated SEQ ID:13145, to the nucleotide sequence of GAM31 RNA, herein designated GAM RNA, also designated SEQ ID:250.

Another function of GAM31 is therefore inhibition of KIDINS220 (Accession XP_291015.1). Accordingly, utilities of GAM31 include diagnosis, prevention and treatment of diseases and clinical conditions associated with KIDINS220.

LARP (Accession NP_056130.1) is another GAM31 target gene, herein designated TARGET GENE. LARP BINDING SITE is a target binding site found in the 5' untranslated region of mRNA encoded by LARP, corresponding to a target binding site such as BINDING SITE I, BINDING SITE II or BINDING SITE III of FIG. 8. Table 4 illustrates the complementarity of the nucleotide sequences of LARP BINDING SITE, designated SEQ ID:7293, to the nucleotide sequence of GAM31 RNA, herein designated GAM RNA, also designated SEQ ID:250.

Another function of GAM31 is therefore inhibition of LARP (Accession NP_056130.1). Accordingly, utilities of GAM31 include diagnosis, prevention and treatment of diseases and clinical conditions associated with LARP.

Leucine zipper-ef-hand containing transmembrane protein 1 (LETM1, Accession NP_036450.1) is another GAM31 target gene, herein designated TARGET GENE. LETM1 BINDING SITE is a target binding site found in the 3' untranslated region of mRNA encoded by LETM1, corresponding to a target binding site such as BINDING SITE I, BINDING SITE II or BINDING SITE III of FIG. 8. Table 4 illustrates the complementarity of the nucleotide sequences of LETM1 BINDING SITE, designated SEQ ID:15302, to the nucleotide sequence of GAM31 RNA, herein designated GAM RNA, also designated SEQ ID:250.

Another function of GAM31 is therefore inhibition of Leucine zipper-ef-hand containing transmembrane protein 1 (LETM1, Accession NP_036450.1). Accordingly, utilities of GAM31 include diagnosis, prevention and treatment of diseases and clinical conditions associated with LETM1.

LOC138961 (Accession XP_071218.2) is another GAM31 target gene, herein designated TARGET GENE. LOC138961 BINDING SITE is a target binding site found in the 5' untranslated region of mRNA encoded by LOC138961, corresponding to a target binding site such as BINDING SITE I, BINDING SITE II or BINDING SITE III of FIG. 8. Table 4 illustrates the complementarity of the nucleotide sequences of LOC138961 BINDING SITE, designated SEQ ID:11374, to the nucleotide sequence of GAM31 RNA, herein designated GAM RNA, also designated SEQ ID:250.

Another function of GAM31 is therefore inhibition of LOC138961 (Accession XP_071218.2). Accordingly, utilities of GAM31 include diagnosis, prevention and treatment of diseases and clinical conditions associated with LOC138961.

LOC144438 (Accession XP_084860.1) is another GAM31 target gene, herein designated TARGET GENE. LOC144438 BINDING SITE is a target binding site found in the 5' untranslated region of mRNA encoded by LOC144438, corresponding to a target binding site such as BINDING SITE I, BINDING SITE II or BINDING SITE III of FIG. 8. Table 4 illustrates the complementarity of the nucleotide sequences of LOC144438 BINDING SITE, designated SEQ ID:10309, to the nucleotide sequence of GAM31 RNA, herein designated GAM RNA, also designated SEQ ID:250.

Another function of GAM31 is therefore inhibition of LOC144438 (Accession XP_084860.1). Accordingly, utilities of GAM31 include diagnosis, prevention and treatment of diseases and clinical conditions associated with LOC144438.

LOC145098 (Accession XP_085022.1) is another GAM31 target gene, herein designated TARGET GENE. LOC145098 BINDING SITE is a target binding site found in the 5' untranslated region of mRNA encoded by LOC145098, corresponding to a target binding site such as BINDING SITE I, BINDING SITE II or BINDING SITE III of FIG. 8. Table 4 illustrates the complementarity of the nucleotide sequences of LOC145098 BINDING SITE, designated SEQ ID:5430, to the nucleotide sequence of GAM31 RNA, herein designated GAM RNA, also designated SEQ ID:250.

Another function of GAM31 is therefore inhibition of LOC145098 (Accession XP_085022.1). Accordingly, utilities of GAM31 include diagnosis, prevention and treatment of diseases and clinical conditions associated with LOC145098.

LOC145663 (Accession XP_096829.1) is another GAM31 target gene, herein designated TARGET GENE. LOC145663 BINDING SITE is a target binding site found in the 3' untranslated region of mRNA encoded by LOC145663, corresponding to a target binding site such as BINDING SITE I, BINDING SITE II or BINDING SITE III of FIG. 8. Table 4 illustrates the complementarity of the nucleotide sequences of LOC145663 BINDING SITE, designated SEQ ID:15718, to the nucleotide sequence of GAM31 RNA, herein designated GAM RNA, also designated SEQ ID:250.

Another function of GAM31 is therefore inhibition of LOC145663 (Accession XP_096829.1). Accordingly, utilities of GAM31 include diagnosis, prevention and treatment of diseases and clinical conditions associated with LOC145663.

LOC145678 (Accession XP_096832.1) is another GAM31 target gene, herein designated TARGET GENE. LOC145678 BINDING SITE is a target binding site found in the 3' untranslated region of mRNA encoded by LOC145678, corresponding to a target binding site such as BINDING SITE I, BINDING SITE II or BINDING SITE III of FIG. 8. Table 4 illustrates the complementarity of the nucleotide sequences of LOC145678 BINDING SITE, designated SEQ ID:2590, to the nucleotide sequence of GAM31 RNA, herein designated GAM RNA, also designated SEQ ID:250.

Another function of GAM31 is therefore inhibition of LOC145678 (Accession XP_096832.1). Accordingly, utilities of GAM31 include diagnosis, prevention and treatment of diseases and clinical conditions associated with LOC145678.

LOC146958 (Accession XP_097142.1) is another GAM31 target gene, herein designated TARGET GENE. LOC146958 BINDING SITE is a target binding site found in the 3' untranslated region of mRNA encoded by LOC146958, corresponding to a target binding site such as BINDING SITE I, BINDING SITE II or BINDING SITE III of FIG. 8. Table 4 illustrates the complementarity of the nucleotide sequences of LOC146958 BINDING SITE, designated SEQ ID:5431, to the nucleotide sequence of GAM31 RNA, herein designated GAM RNA, also designated SEQ ID:250.

Another function of GAM31 is therefore inhibition of LOC146958 (Accession XP_097142.1). Accordingly, utilities of GAM31 include diagnosis, prevention and treatment of diseases and clinical conditions associated with LOC146958.

LOC151878 (Accession XP_087329.1) is another GAM31 target gene, herein designated TARGET GENE. LOC151878 BINDING SITE is a target binding site found in the 3' untranslated region of mRNA encoded by LOC151878, corresponding to a target binding site such as BINDING SITE I, BINDING SITE II or BINDING SITE III of FIG. 8. Table 4 illustrates the complementarity of the nucleotide sequences of LOC151878 BINDING SITE, designated SEQ ID:11456, to the nucleotide sequence of GAM31 RNA, herein designated GAM RNA, also designated SEQ ID:250.

Another function of GAM31 is therefore inhibition of LOC151878 (Accession XP_087329.1). Accordingly, utilities of GAM31 include diagnosis, prevention and treatment of diseases and clinical conditions associated with LOC151878.

LOC157693 (Accession XP_088366.2) is another GAM31 target gene, herein designated TARGET GENE. LOC157693 BINDING SITE is a target binding site found in the 5' untranslated region of mRNA encoded by LOC157693, corresponding to a target binding site such as BINDING SITE I, BINDING SITE II or BINDING SITE III of FIG. 8. Table 4 illustrates the complementarity of the nucleotide sequences of LOC157693 BINDING SITE, designated SEQ ID:11401, to the nucleotide sequence of GAM31 RNA, herein designated GAM RNA, also designated SEQ ID:250.

Another function of GAM31 is therefore inhibition of LOC157693 (Accession XP_088366.2). Accordingly, utilities of GAM31 include diagnosis, prevention and treatment of diseases and clinical conditions associated with LOC157693.

LOC219918 (Accession XP_166197.1) is another GAM31 target gene, herein designated TARGET GENE. LOC219918 BINDING SITE is a target binding site found in the 3' untranslated region of mRNA encoded by LOC219918, corresponding to a target binding site such as BINDING SITE I, BINDING SITE II or BINDING SITE III of FIG. 8. Table 4 illustrates the complementarity of the nucleotide sequences of LOC219918 BINDING SITE, designated SEQ ID:7818, to the nucleotide sequence of GAM31 RNA, herein designated GAM RNA, also designated SEQ ID:250.

Another function of GAM31 is therefore inhibition of LOC219918 (Accession XP_166197.1). Accordingly, utilities of GAM31 include diagnosis, prevention and treatment of diseases and clinical conditions associated with LOC219918.

LOC221981 (Accession XP_168344.1) is another GAM31 target gene, herein designated TARGET GENE. LOC221981 BINDING SITE is a target binding site found in the 3' untranslated region of mRNA encoded by LOC221981, corresponding to a target binding site such as BINDING SITE I, BINDING SITE II or BINDING SITE III of FIG. 8. Table 4 illustrates the complementarity of the nucleotide sequences of LOC221981 BINDING SITE, designated SEQ ID:8106, to the nucleotide sequence of GAM31 RNA, herein designated GAM RNA, also designated SEQ ID:250.

Another function of GAM31 is therefore inhibition of LOC221981 (Accession XP_168344.1). Accordingly, utilities of GAM31 include diagnosis, prevention and treatment of diseases and clinical conditions associated with LOC221981.

LOC282958 (Accession XP_212615.1) is another GAM31 target gene, herein designated TARGET GENE. LOC282958 BINDING SITE is a target binding site found in the 5' untranslated region of mRNA encoded by LOC282958, corresponding to a target binding site such as BINDING SITE I, BINDING SITE II or BINDING SITE III of FIG. 8. Table 4 illustrates the complementarity of the nucleotide sequences of LOC282958 BINDING SITE, designated SEQ ID:19230, to the nucleotide sequence of GAM31 RNA, herein designated GAM RNA, also designated SEQ ID:250.

Another function of GAM31 is therefore inhibition of LOC282958 (Accession XP_212615.1). Accordingly, utilities of GAM31 include diagnosis, prevention and treatment of diseases and clinical conditions associated with LOC282958.

LOC282989 (Accession XP_208472.1) is another GAM31 target gene, herein designated TARGET GENE. LOC282989 BINDING SITE is a target binding site found in the 5' untranslated region of mRNA encoded by LOC282989, corresponding to a target binding site such as BINDING SITE I, BINDING SITE II or BINDING SITE III of FIG. 8. Table 4 illustrates the complementarity of the nucleotide sequences of LOC282989 BINDING SITE, designated SEQ ID:19230, to the nucleotide sequence of GAM31 RNA, herein designated GAM RNA, also designated SEQ ID:250.

Another function of GAM31 is therefore inhibition of LOC282989 (Accession XP_208472.1). Accordingly, utilities of GAM31 include diagnosis, prevention and treatment of diseases and clinical conditions associated with LOC282989.

LOC283170 (Accession XP_208535.1) is another GAM31 target gene, herein designated TARGET GENE. LOC283170 BINDING SITE is a target binding site found in the 3' untranslated region of mRNA encoded by LOC283170, corresponding to a target binding site such as BINDING SITE I, BINDING SITE II or BINDING SITE III of FIG. 8. Table 4 illustrates the complementarity of the nucleotide sequences of LOC283170 BINDING SITE, designated SEQ ID:7739, to the nucleotide sequence of GAM31 RNA, herein designated GAM RNA, also designated SEQ ID:250.

Another function of GAM31 is therefore inhibition of LOC283170 (Accession XP_208535.1). Accordingly, utilities of GAM31 include diagnosis, prevention and treatment of diseases and clinical conditions associated with LOC283170.

LOC283263 (Accession XP_208593.1) is another GAM31 target gene, herein designated TARGET GENE. LOC283263 BINDING SITE is a target binding site found in the 5' untranslated region of mRNA encoded by LOC283263, corresponding to a target binding site such as BINDING SITE I, BINDING SITE II or BINDING SITE III of FIG. 8. Table 4 illustrates the complementarity of the nucleotide sequences of LOC283263 BINDING SITE, designated SEQ ID:19000, to the nucleotide sequence of GAM31 RNA, herein designated GAM RNA, also designated SEQ ID:250.

Another function of GAM31 is therefore inhibition of LOC283263 (Accession XP_208593.1). Accordingly, utilities of GAM31 include diagnosis, prevention and treatment of diseases and clinical conditions associated with LOC283263.

LOC283309 (Accession XP_208611.1) is another GAM31 target gene, herein designated TARGET GENE. LOC283309 BINDING SITE is a target binding site found in the 5' untranslated region of mRNA encoded by LOC283309, corresponding to a target binding site such as BINDING SITE I, BINDING SITE II or BINDING SITE III of FIG. 8. Table 4 illustrates the complementarity of the nucleotide sequences of LOC283309 BINDING SITE, designated SEQ ID:19230, to the nucleotide sequence of GAM31 RNA, herein designated GAM RNA, also designated SEQ ID:250.

Another function of GAM31 is therefore inhibition of LOC283309 (Accession XP_208611.1). Accordingly, utilities of GAM31 include diagnosis, prevention and treatment of diseases and clinical conditions associated with LOC283309.

LOC283495 (Accession XP_208697.1) is another GAM31 target gene, herein designated TARGET GENE. LOC283495 BINDING SITE is a target binding site found in the 5' untranslated region of mRNA encoded by LOC283495, corresponding to a target binding site such as BINDING SITE I, BINDING SITE II or BINDING SITE III of FIG. 8. Table 4 illustrates the complementarity of the nucleotide sequences of LOC283495 BINDING SITE, designated SEQ ID:19230, to the nucleotide sequence of GAM31 RNA, herein designated GAM RNA, also designated SEQ ID:250.

Another function of GAM31 is therefore inhibition of LOC283495 (Accession XP_208697.1). Accordingly, utilities of GAM31 include diagnosis, prevention and treatment of diseases and clinical conditions associated with LOC283495.

LOC283538 (Accession XP_211082.1) is another GAM31 target gene, herein designated TARGET GENE. LOC283538 BINDING SITE is a target binding site found in the 3' untranslated region of mRNA encoded by LOC283538, corresponding to a target binding site such as BINDING SITE I, BINDING SITE II or BINDING SITE III of FIG. 8. Table 4 illustrates the complementarity of the nucleotide sequences of LOC283538 BINDING SITE, designated SEQ ID:19620, to the nucleotide sequence of GAM31 RNA, herein designated GAM RNA, also designated SEQ ID:250.

Another function of GAM31 is therefore inhibition of LOC283538 (Accession XP_211082.1). Accordingly, utilities of GAM31 include diagnosis, prevention and treatment of diseases and clinical conditions associated with LOC283538.

LOC283550 (Accession XP_208740.1) is another GAM31 target gene, herein designated TARGET GENE. LOC283550 BINDING SITE is a target binding site found in the 5' untranslated region of mRNA encoded by LOC283550, corresponding to a target binding site such as BINDING SITE I, BINDING SITE II or BINDING SITE III of FIG. 8. Table 4 illustrates the complementarity of the nucleotide sequences of LOC283550 BINDING SITE, designated SEQ ID:19230, to the nucleotide sequence of GAM31 RNA, herein designated GAM RNA, also designated SEQ ID:250.

Another function of GAM31 is therefore inhibition of LOC283550 (Accession XP_208740.1). Accordingly, utilities of GAM31 include diagnosis, prevention and treatment of diseases and clinical conditions associated with LOC283550.

LOC283640 (Accession XP_208767.1) is another GAM31 target gene, herein designated TARGET GENE. LOC283640 BINDING SITE is a target binding site found in the 5' untranslated region of mRNA encoded by LOC283640, corresponding to a target binding site such as BINDING SITE I, BINDING SITE II or BINDING SITE III of FIG. 8. Table 4 illustrates the complementarity of the nucleotide sequences of LOC283640 BINDING SITE, designated SEQ ID:19230, to the nucleotide sequence of GAM31 RNA, herein designated GAM RNA, also designated SEQ ID:250.

Another function of GAM31 is therefore inhibition of LOC283640 (Accession XP_208767.1). Accordingly, utilities of GAM31 include diagnosis, prevention and treatment of diseases and clinical conditions associated with LOC283640.

LOC283914 (Accession XP_211257.2) is another GAM31 target gene, herein designated TARGET GENE. LOC283914 BINDING SITE is a target binding site found in the 3' untranslated region of mRNA encoded by LOC283914, corresponding to a target binding site such as BINDING SITE I, BINDING SITE II or BINDING SITE III of FIG. 8. Table 4 illustrates the complementarity of the nucleotide sequences of LOC283914 BINDING SITE, designated SEQ ID:20102, to the nucleotide sequence of GAM31 RNA, herein designated GAM RNA, also designated SEQ ID:250.

Another function of GAM31 is therefore inhibition of LOC283914 (Accession XP_211257.2). Accordingly, utilities of GAM31 include diagnosis, prevention and treatment of diseases and clinical conditions associated with LOC283914.

LOC284019 (Accession XP_211302.1) is another GAM31 target gene, herein designated TARGET GENE. LOC284019 BINDING SITE is a target binding site found in the 5' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:14941, to the nucleotide sequence of GAM31 RNA, herein designated GAM RNA, also designated SEQ ID:250.

Another function of GAM31 is therefore inhibition of LOC284019 (Accession XP_211302.1). Accordingly, utilities of GAM31 include diagnosis, prevention and treatment of diseases and clinical conditions associated with LOC284019.

LOC284324 (Accession XP_209151.1) is another GAM31 target gene, herein designated TARGET GENE. LOC284324 BINDING SITE is a target binding site found in the 5' untranslated region of mRNA encoded by LOC284324, corresponding to a target binding site such as BINDING SITE I, BINDING SITE II or BINDING SITE III of FIG. 8. Table 4 illustrates the complementarity of the nucleotide sequences of LOC284324 BINDING SITE, designated SEQ ID:19230, to the nucleotide sequence of GAM31 RNA, herein designated GAM RNA, also designated SEQ ID:250.

Another function of GAM31 is therefore inhibition of LOC284324 (Accession XP_209151.1). Accordingly, utilities of GAM31 include diagnosis, prevention and treatment of diseases and clinical conditions associated with LOC284324.

LOC284397 (Accession XP_209180.1) is another GAM31 target gene, herein designated TARGET GENE. LOC284397 BINDING SITE is a target binding site found in the 5' untranslated region of mRNA encoded by LOC284397, corresponding to a target binding site such as BINDING SITE I, BINDING SITE II or BINDING SITE III of FIG. 8. Table 4 illustrates the complementarity of the nucleotide sequences of LOC284397 BINDING SITE, designated SEQ ID:19230, to the nucleotide sequence of GAM31 RNA, herein designated GAM RNA, also designated SEQ ID:250.

Another function of GAM31 is therefore inhibition of LOC284397 (Accession XP_209180.1). Accordingly, utilities of GAM31 include diagnosis, prevention and treatment of diseases and clinical conditions associated with LOC284397.

LOC284453 (Accession XP_209215.1) is another GAM31 target gene, herein designated TARGET GENE. LOC284453 BINDING SITE is a target binding site found in the 5' untranslated region of mRNA encoded by LOC284453, corresponding to a target binding site such as BINDING SITE I, BINDING SITE II or BINDING SITE III of FIG. 8. Table 4 illustrates the complementarity of the nucleotide sequences of LOC284453 BINDING SITE, designated SEQ ID:19230, to the nucleotide sequence of GAM31 RNA, herein designated GAM RNA, also designated SEQ ID:250.

Another function of GAM31 is therefore inhibition of LOC284453 (Accession XP_209215.1). Accordingly, utilities of GAM31 include diagnosis, prevention and treatment of diseases and clinical conditions associated with LOC284453.

LOC284455 (Accession XP_209218.1) is another GAM31 target gene, herein designated TARGET GENE. LOC284455 BINDING SITE is a target binding site found in the 5' untranslated region of mRNA encoded by LOC284455, corresponding to a target binding site such as BINDING SITE I, BINDING SITE II or BINDING SITE III of FIG. 8. Table 4 illustrates the complementarity of the nucleotide sequences of LOC284455 BINDING SITE, designated SEQ ID:2443, to the nucleotide sequence of GAM31 RNA, herein designated GAM RNA, also designated SEQ ID:250.

Another function of GAM31 is therefore inhibition of LOC284455 (Accession XP_209218.1). Accordingly, utilities of GAM31 include diagnosis, prevention and treatment of diseases and clinical conditions associated with LOC284455.

LOC284570 (Accession XP_211521.1) is another GAM31 target gene, herein designated TARGET GENE. LOC284570 BINDING SITE is a target binding site found in the 3' untranslated region of mRNA encoded by LOC284570, corresponding to a target binding site such as BINDING SITE I, BINDING SITE II or BINDING SITE III of FIG. 8. Table 4 illustrates the complementarity of the nucleotide sequences of LOC284570 BINDING SITE, designated SEQ ID:17707, to the nucleotide sequence of GAM31 RNA, herein designated GAM RNA, also designated SEQ ID:250.

Another function of GAM31 is therefore inhibition of LOC284570 (Accession XP_211521.1). Accordingly, utilities of GAM31 include diagnosis, prevention and treatment of diseases and clinical conditions associated with LOC284570.

LOC284673 (Accession XP_211591.1) is another GAM31 target gene, herein designated TARGET GENE. LOC284673 BINDING SITE is a target binding site found in the 3' untranslated region of mRNA encoded by LOC284673, corresponding to a target binding site such as BINDING SITE I, BINDING SITE II or BINDING SITE III of FIG. 8. Table 4 illustrates the complementarity of the nucleotide sequences of LOC284673 BINDING SITE, designated SEQ ID:16822, to the nucleotide sequence of GAM31 RNA, herein designated GAM RNA, also designated SEQ ID:250.

Another function of GAM31 is therefore inhibition of LOC284673 (Accession XP_211591.1). Accordingly, utilities of GAM31 include diagnosis, prevention and treatment of diseases and clinical conditions associated with LOC284673.

LOC284707 (Accession XP_211598.1) is another GAM31 target gene, herein designated TARGET GENE. LOC284707 BINDING SITE is a target binding site found in the 3' untranslated region of mRNA encoded by LOC284707, corresponding to a target binding site such as BINDING SITE I, BINDING SITE II or BINDING SITE III of FIG. 8. Table 4 illustrates the complementarity of the nucleotide sequences of LOC284707 BINDING SITE, designated SEQ ID:3831, to the nucleotide sequence of GAM31 RNA, herein designated GAM RNA, also designated SEQ ID:250.

Another function of GAM31 is therefore inhibition of LOC284707 (Accession XP_211598.1). Accordingly, utilities of GAM31 include diagnosis, prevention and treatment of diseases and clinical conditions associated with LOC284707.

LOC285333 (Accession XP_209571.1) is another GAM31 target gene, herein designated TARGET GENE. LOC285333 BINDING SITE is a target binding site found in the 5' untranslated region of mRNA encoded by LOC285333, corresponding to a target binding site such as BINDING SITE I, BINDING SITE II or BINDING SITE III of FIG. 8. Table 4 illustrates the complementarity of the nucleotide sequences of LOC285333 BINDING SITE, designated SEQ ID:19230, to the nucleotide sequence of GAM31 RNA, herein designated GAM RNA, also designated SEQ ID:250.

Another function of GAM31 is therefore inhibition of LOC285333 (Accession XP_209571.1). Accordingly, utilities of GAM31 include diagnosis, prevention and treatment of diseases and clinical conditions associated with LOC285333.

LOC285504 (Accession XP_209642.1) is another GAM31 target gene, herein designated TARGET GENE. LOC285504 BINDING SITE is a target binding site found in the 5' untranslated region of mRNA encoded by LOC285504, corresponding to a target binding site such as BINDING SITE I, BINDING SITE II or BINDING SITE III of FIG. 8. Table 4 illustrates the complementarity of the nucleotide sequences of LOC285504 BINDING SITE, designated SEQ ID:19230, to the nucleotide sequence of GAM31 RNA, herein designated GAM RNA, also designated SEQ ID:250.

Another function of GAM31 is therefore inhibition of LOC285504 (Accession XP_209642.1). Accordingly, utilities of GAM31 include diagnosis, prevention and treatment of diseases and clinical conditions associated with LOC285504.

LOC285709 (Accession XP_209730.2) is another GAM31 target gene, herein designated TARGET GENE.

LOC285709 BINDING SITE is a target binding site found in the 5' untranslated region of mRNA encoded by LOC285709, corresponding to a target binding site such as BINDING SITE I, BINDING SITE II or BINDING SITE III of FIG. 8. Table 4 illustrates the complementarity of the nucleotide sequences of LOC285709 BINDING SITE, designated SEQ ID:6281, to the nucleotide sequence of GAM31 RNA, herein designated GAM RNA, also designated SEQ ID:250.

Another function of GAM31 is therefore inhibition of LOC285709 (Accession XP_209730.2). Accordingly, utilities of GAM31 include diagnosis, prevention and treatment of diseases and clinical conditions associated with LOC285709.

LOC285717 (Accession XP_211991.1) is another GAM31 target gene, herein designated TARGET GENE. LOC285717 BINDING SITE is a target binding site found in the 5' untranslated region of mRNA encoded by LOC285717, corresponding to a target binding site such as BINDING SITE I, BINDING SITE II or BINDING SITE III of FIG. 8. Table 4 illustrates the complementarity of the nucleotide sequences of LOC285717 BINDING SITE, designated SEQ ID:12265, to the nucleotide sequence of GAM31 RNA, herein designated GAM RNA, also designated SEQ ID:250.

Another function of GAM31 is therefore inhibition of LOC285717 (Accession XP_211991.1). Accordingly, utilities of GAM31 include diagnosis, prevention and treatment of diseases and clinical conditions associated with LOC285717.

LOC285797 (Accession XP_212026.1) is another GAM31 target gene, herein designated TARGET GENE. LOC285797 BINDING SITE is a target binding site found in the 3' untranslated region of mRNA encoded by LOC285797, corresponding to a target binding site such as BINDING SITE I, BINDING SITE II or BINDING SITE III of FIG. 8. Table 4 illustrates the complementarity of the nucleotide sequences of LOC285797 BINDING SITE, designated SEQ ID:13675, to the nucleotide sequence of GAM31 RNA, herein designated GAM RNA, also designated SEQ ID:250.

Another function of GAM31 is therefore inhibition of LOC285797 (Accession XP_212026.1). Accordingly, utilities of GAM31 include diagnosis, prevention and treatment of diseases and clinical conditions associated with LOC285797.

LOC285838 (Accession XP_209771.1) is another GAM31 target gene, herein designated TARGET GENE. LOC285838 BINDING SITE is a target binding site found in the 5' untranslated region of mRNA encoded by LOC285838, corresponding to a target binding site such as BINDING SITE I, BINDING SITE II or BINDING SITE III of FIG. 8. Table 4 illustrates the complementarity of the nucleotide sequences of LOC285838 BINDING SITE, designated SEQ ID:19230, to the nucleotide sequence of GAM31 RNA, herein designated GAM RNA, also designated SEQ ID:250.

Another function of GAM31 is therefore inhibition of LOC285838 (Accession XP_209771.1). Accordingly, utilities of GAM31 include diagnosis, prevention and treatment of diseases and clinical conditions associated with LOC285838.

LOC285982 (Accession XP_209861.1) is another GAM31 target gene, herein designated TARGET GENE. LOC285982 BINDING SITE is a target binding site found in the 5' untranslated region of mRNA encoded by LOC285982, corresponding to a target binding site such as BINDING SITE I, BINDING SITE II or BINDING SITE III of FIG. 8. Table 4 illustrates the complementarity of the nucleotide sequences of LOC285982 BINDING SITE, designated SEQ ID:9426, to the nucleotide sequence of GAM31 RNA, herein designated GAM RNA, also designated SEQ ID:250.

Another function of GAM31 is therefore inhibition of LOC285982 (Accession XP_209861.1). Accordingly, utilities of GAM31 include diagnosis, prevention and treatment of diseases and clinical conditions associated with LOC285982.

LOC286007 (Accession XP_212133.1) is another GAM31 target gene, herein designated TARGET GENE. LOC286007 BINDING SITE is a target binding site found in the 5' untranslated region of mRNA encoded by LOC286007, corresponding to a target binding site such as BINDING SITE I, BINDING SITE II or BINDING SITE III of FIG. 8. Table 4 illustrates the complementarity of the nucleotide sequences of LOC286007 BINDING SITE, designated SEQ ID:9960, to the nucleotide sequence of GAM31 RNA, herein designated GAM RNA, also designated SEQ ID:250.

Another function of GAM31 is therefore inhibition of LOC286007 (Accession XP_212133.1). Accordingly, utilities of GAM31 include diagnosis, prevention and treatment of diseases and clinical conditions associated with LOC286007.

LOC286182 (Accession XP_209929.1) is another GAM31 target gene, herein designated TARGET GENE. LOC286182 BINDING SITE is a target binding site found in the 5' untranslated region of mRNA encoded by LOC286182, corresponding to a target binding site such as BINDING SITE I, BINDING SITE II or BINDING SITE III of FIG. 8. Table 4 illustrates the complementarity of the nucleotide sequences of LOC286182 BINDING SITE, designated SEQ ID:19230, to the nucleotide sequence of GAM31 RNA, herein designated GAM RNA, also designated SEQ ID:250.

Another function of GAM31 is therefore inhibition of LOC286182 (Accession XP_209929.1). Accordingly, utilities of GAM31 include diagnosis, prevention and treatment of diseases and clinical conditions associated with LOC286182.

LOC286383 (Accession XP_210030.1) is another GAM31 target gene, herein designated TARGET GENE. LOC286383 BINDING SITE is a target binding site found in the 5' untranslated region of mRNA encoded by LOC286383, corresponding to a target binding site such as BINDING SITE I, BINDING SITE II or BINDING SITE III of FIG. 8. Table 4 illustrates the complementarity of the nucleotide sequences of LOC286383 BINDING SITE, designated SEQ ID:19230, to the nucleotide sequence of GAM31 RNA, herein designated GAM RNA, also designated SEQ ID:250.

Another function of GAM31 is therefore inhibition of LOC286383 (Accession XP_210030.1). Accordingly, utilities of GAM31 include diagnosis, prevention and treatment of diseases and clinical conditions associated with LOC286383.

LOC338739 (Accession XP_294690.1) is another GAM31 target gene, herein designated TARGET GENE. LOC338739 BINDING SITE is a target binding site found in the 3' untranslated region of mRNA encoded by LOC338739, corresponding to a target binding site such as BINDING SITE I, BINDING SITE II or BINDING SITE III of FIG. 8. Table 4 illustrates the complementarity of the nucleotide sequences of LOC338739 BINDING SITE, designated SEQ ID:15655, to the nucleotide sequence of GAM31 RNA, herein designated GAM RNA, also designated SEQ ID:250.

Another function of GAM31 is therefore inhibition of LOC338739 (Accession XP_294690.1). Accordingly, utilities of GAM31 include diagnosis, prevention and treatment of diseases and clinical conditions associated with LOC338739.

LOC339187 (Accession XP_294842.1) is another GAM31 target gene, herein designated TARGET GENE. LOC339187 BINDING SITE is a target binding site found in the 3' untranslated region of mRNA encoded by LOC339187, corresponding to a target binding site such as BINDING SITE I, BINDING SITE II or BINDING SITE III of FIG. 8. Table 4 illustrates the complementarity of the nucleotide sequences of LOC339187 BINDING SITE, designated SEQ ID:12276, to the nucleotide sequence of GAM31 RNA, herein designated GAM RNA, also designated SEQ ID:250.

Another function of GAM31 is therefore inhibition of LOC339187 (Accession XP_294842.1). Accordingly, utilities of GAM31 include diagnosis, prevention and treatment of diseases and clinical conditions associated with LOC339187.

LOC339807 (Accession XP_295070.1) is another GAM31 target gene, herein designated TARGET GENE. LOC339807 BINDING SITE is a target binding site found in the 3' untranslated region of mRNA encoded by LOC339807, corresponding to a target binding site such as BINDING SITE I, BINDING SITE II or BINDING SITE III of FIG. 8. Table 4 illustrates the complementarity of the nucleotide sequences of LOC339807 BINDING SITE, designated SEQ ID:13170, to the nucleotide sequence of GAM31 RNA, herein designated GAM RNA, also designated SEQ ID:250.

Another function of GAM31 is therefore inhibition of LOC339807 (Accession XP_295070.1). Accordingly, utilities of GAM31 include diagnosis, prevention and treatment of diseases and clinical conditions associated with LOC339807.

LOC340112 (Accession XP_291146.1) is another GAM31 target gene, herein designated TARGET GENE. LOC340112 BINDING SITE is a target binding site found in the 5' untranslated region of mRNA encoded by LOC340112, corresponding to a target binding site such as BINDING SITE I, BINDING SITE II or BINDING SITE III of FIG. 8. Table 4 illustrates the complementarity of the nucleotide sequences of LOC340112 BINDING SITE, designated SEQ ID:2443, to the nucleotide sequence of GAM31 RNA, herein designated GAM RNA, also designated SEQ ID:250.

Another function of GAM31 is therefore inhibition of LOC340112 (Accession XP_291146.1). Accordingly, utilities of GAM31 include diagnosis, prevention and treatment of diseases and clinical conditions associated with LOC340112.

LOC340156 (Accession XP_291158.1) is another GAM31 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:14005, to the nucleotide sequence of GAM31 RNA, herein designated GAM RNA, also designated SEQ ID:250.

Another function of GAM31 is therefore inhibition of LOC340156 (Accession XP_291158.1). Accordingly, utilities of GAM31 include diagnosis, prevention and treatment of diseases and clinical conditions associated with LOC340156.

LOC348241 (Accession XP_300667.1) is another GAM31 target gene, herein designated TARGET GENE. LOC348241 BINDING SITE is a target binding site found in the 3' untranslated region of mRNA encoded by LOC348241, corresponding to a target binding site such as BINDING SITE I, BINDING SITE II or BINDING SITE III of FIG. 8. Table 4 illustrates the complementarity of the nucleotide sequences of LOC348241 BINDING SITE, designated SEQ ID:11369, to the nucleotide sequence of GAM31 RNA, herein designated GAM RNA, also designated SEQ ID:250.

Another function of GAM31 is therefore inhibition of LOC348241 (Accession XP_300667.1). Accordingly, utilities of GAM31 include diagnosis, prevention and treatment of diseases and clinical conditions associated with LOC348241.

LOC348526 (Accession XP_300775.1) is another GAM31 target gene, herein designated TARGET GENE. LOC348526 BINDING SITE is a target binding site found in the 3' untranslated region of mRNA encoded by LOC348526, corresponding to a target binding site such as BINDING SITE I, BINDING SITE II or BINDING SITE III of FIG. 8. Table 4 illustrates the complementarity of the nucleotide sequences of LOC348526 BINDING SITE, designated SEQ ID:16926, to the nucleotide sequence of GAM31 RNA, herein designated GAM RNA, also designated SEQ ID:250.

Another function of GAM31 is therefore inhibition of LOC348526 (Accession XP_300775.1). Accordingly, utilities of GAM31 include diagnosis, prevention and treatment of diseases and clinical conditions associated with LOC348526.

LOC348768 (Accession XP_302883.1) is another GAM31 target gene, herein designated TARGET GENE. LOC348768 BINDING SITE is a target binding site found in the 5' untranslated region of mRNA encoded by LOC348768, corresponding to a target binding site such as BINDING SITE I, BINDING SITE II or BINDING SITE III of FIG. 8. Table 4 illustrates the complementarity of the nucleotide sequences of LOC348768 BINDING SITE, designated SEQ ID:9248, to the nucleotide sequence of GAM31 RNA, herein designated GAM RNA, also designated SEQ ID:250.

Another function of GAM31 is therefore inhibition of LOC348768 (Accession XP_302883.1). Accordingly, utilities of GAM31 include diagnosis, prevention and treatment of diseases and clinical conditions associated with LOC348768.

LOC349257 (Accession XP_300996.1) is another GAM31 target gene, herein designated TARGET GENE. LOC349257 BINDING SITE is a target binding site found in the 5' untranslated region of mRNA encoded by LOC349257, corresponding to a target binding site such as BINDING SITE I, BINDING SITE II or BINDING SITE III of FIG. 8. Table 4 illustrates the complementarity of the nucleotide sequences of LOC349257 BINDING SITE, designated SEQ ID:17529, to the nucleotide sequence of GAM31 RNA, herein designated GAM RNA, also designated SEQ ID:250.

Another function of GAM31 is therefore inhibition of LOC349257 (Accession XP_300996.1). Accordingly, utilities of GAM31 include diagnosis, prevention and treatment of diseases and clinical conditions associated with LOC349257.

LOC349258 (Accession XP_300995.1) is another GAM31 target gene, herein designated TARGET GENE. LOC349258 BINDING SITE is a target binding site found in the 3' untranslated region of mRNA encoded by LOC349258, corresponding to a target binding site such as BINDING SITE I, BINDING SITE II or BINDING SITE III of FIG. 8. Table 4 illustrates the complementarity of the nucleotide sequences of LOC349258 BINDING SITE, designated SEQ ID:17529, to the nucleotide sequence of GAM31 RNA, herein designated GAM RNA, also designated SEQ ID:250.

Another function of GAM31 is therefore inhibition of LOC349258 (Accession XP_300995.1). Accordingly, utilities of GAM31 include diagnosis, prevention and treatment of diseases and clinical conditions associated with LOC349258.

LOC349265 (Accession XP_301000.1) is another GAM31 target gene, herein designated TARGET GENE. LOC349265 BINDING SITE is a target binding site found in the 5' untranslated region of mRNA encoded by LOC349265, corresponding to a target binding site such as BINDING SITE I, BINDING SITE II or BINDING SITE III of FIG. 8. Table 4 illustrates the complementarity of the nucleotide sequences of LOC349265 BINDING SITE, designated SEQ ID:17529, to the nucleotide sequence of GAM31 RNA, herein designated GAM RNA, also designated SEQ ID:250.

Another function of GAM31 is therefore inhibition of LOC349265 (Accession XP_301000.1). Accordingly, utilities of GAM31 include diagnosis, prevention and treatment of diseases and clinical conditions associated with LOC349265.

LOC349266 (Accession XP_300999.1) is another GAM31 target gene, herein designated TARGET GENE. LOC349266 BINDING SITE is a target binding site found in the 3' untranslated region of mRNA encoded by LOC349266, corresponding to a target binding site such as BINDING SITE I, BINDING SITE II or BINDING SITE III of FIG. 8. Table 4 illustrates the complementarity of the nucleotide sequences of LOC349266 BINDING SITE, designated SEQ ID:17529, to the nucleotide sequence of GAM31 RNA, herein designated GAM RNA, also designated SEQ ID:250.

Another function of GAM31 is therefore inhibition of LOC349266 (Accession XP_300999.1). Accordingly, utilities of GAM31 include diagnosis, prevention and treatment of diseases and clinical conditions associated with LOC349266.

LOC350905 (Accession XP_301844.1) is another GAM31 target gene, herein designated TARGET GENE. LOC350905 BINDING SITE is a target binding site found in the 5' untranslated region of mRNA encoded by LOC350905, corresponding to a target binding site such as BINDING SITE I, BINDING SITE II or BINDING SITE III of FIG. 8. Table 4 illustrates the complementarity of the nucleotide sequences of LOC350905 BINDING SITE, designated SEQ ID:607, to the nucleotide sequence of GAM31 RNA, herein designated GAM RNA, also designated SEQ ID:250.

Another function of GAM31 is therefore inhibition of LOC350905 (Accession XP_301844.1). Accordingly, utilities of GAM31 include diagnosis, prevention and treatment of diseases and clinical conditions associated with LOC350905.

LOC352739 (Accession XP_305938.1) is another GAM31 target gene, herein designated TARGET GENE. LOC352739 BINDING SITE is a target binding site found in the 5' untranslated region of mRNA encoded by LOC352739, corresponding to a target binding site such as BINDING SITE I, BINDING SITE II or BINDING SITE III of FIG. 8. Table 4 illustrates the complementarity of the nucleotide sequences of LOC352739 BINDING SITE, designated SEQ ID:8832, to the nucleotide sequence of GAM31 RNA, herein designated GAM RNA, also designated SEQ ID:250.

Another function of GAM31 is therefore inhibition of LOC352739 (Accession XP_305938.1). Accordingly, utilities of GAM31 include diagnosis, prevention and treatment of diseases and clinical conditions associated with LOC352739.

LOC51619 (Accession NP_057067.1) is another GAM31 target gene, herein designated TARGET GENE. LOC51619 BINDING SITE is a target binding site found in the 3' untranslated region of mRNA encoded by LOC51619, corresponding to a target binding site such as BINDING SITE I, BINDING SITE II or BINDING SITE III of FIG. 8. Table 4 illustrates the complementarity of the nucleotide sequences of LOC51619 BINDING SITE, designated SEQ ID:20004, to the nucleotide sequence of GAM31 RNA, herein designated GAM RNA, also designated SEQ ID:250.

Another function of GAM31 is therefore inhibition of LOC51619 (Accession NP_057067.1). Accordingly, utilities of GAM31 include diagnosis, prevention and treatment of diseases and clinical conditions associated with LOC51619.

LOC90670 (Accession XP_033352.1) is another GAM31 target gene, herein designated TARGET GENE. LOC90670 BINDING SITE is a target binding site found in the 3' untranslated region of mRNA encoded by LOC90670, corresponding to a target binding site such as BINDING SITE I, BINDING SITE II or BINDING SITE III of FIG. 8. Table 4 illustrates the complementarity of the nucleotide sequences of LOC90670 BINDING SITE, designated SEQ ID:9139, to the nucleotide sequence of GAM31 RNA, herein designated GAM RNA, also designated SEQ ID:250.

Another function of GAM31 is therefore inhibition of LOC90670 (Accession XP_033352.1). Accordingly, utilities of GAM31 include diagnosis, prevention and treatment of diseases and clinical conditions associated with LOC90670.

LOC91526 (Accession NP_710181.1) is another GAM31 target gene, herein designated TARGET GENE. LOC91526 BINDING SITE is a target binding site found in the 3' untranslated region of mRNA encoded by LOC91526, corresponding to a target binding site such as BINDING SITE I, BINDING SITE II or BINDING SITE III of FIG. 8. Table 4 illustrates the complementarity of the nucleotide sequences of LOC91526 BINDING SITE, designated SEQ ID:16059, to the nucleotide sequence of GAM31 RNA, herein designated GAM RNA, also designated SEQ ID:250.

Another function of GAM31 is therefore inhibition of LOC91526 (Accession NP_710181.1). Accordingly, utilities of GAM31 include diagnosis, prevention and treatment of diseases and clinical conditions associated with LOC91526.

LOC96597 (Accession XP_039922.1) is another GAM31 target gene, herein designated TARGET GENE. LOC96597 BINDING SITE is a target binding site found in the 3' untranslated region of mRNA encoded by LOC96597, corresponding to a target binding site such as BINDING SITE I, BINDING SITE II or BINDING SITE III of FIG. 8. Table 4 illustrates the complementarity of the nucleotide sequences of LOC96597 BINDING SITE, designated SEQ ID:19996, to the nucleotide sequence of GAM31 RNA, herein designated GAM RNA, also designated SEQ ID:250.

Another function of GAM31 is therefore inhibition of LOC96597 (Accession XP_039922.1). Accordingly, utilities of GAM31 include diagnosis, prevention and treatment of diseases and clinical conditions associated with LOC96597.

Lipin 2 (LPIN2, Accession NP_055461.1) is another GAM31 target gene, herein designated TARGET GENE. LPIN2 BINDING SITE is a target binding site found in the 3' untranslated region of mRNA encoded by LPIN2, corresponding to a target binding site such as BINDING SITE I, BINDING SITE II or BINDING SITE III of FIG. 8. Table 4 illustrates the complementarity of the nucleotide sequences of LPIN2 BINDING SITE, designated SEQ ID:8573, to the nucleotide sequence of GAM31 RNA, herein designated GAM RNA, also designated SEQ ID:250.

Another function of GAM31 is therefore inhibition of Lipin 2 (LPIN2, Accession NP_055461.1). Accordingly, utilities of GAM31 include diagnosis, prevention and treatment of diseases and clinical conditions associated with LPIN2.

LRRN4 (Accession NP_002310.2) is another GAM31 target gene, herein designated TARGET GENE. LRRN4 BINDING SITE is a target binding site found in the 3' untranslated region of mRNA encoded by LRRN4, corresponding to a target binding site such as BINDING SITE I, BINDING SITE II or BINDING SITE III of FIG. 8. Table 4 illustrates the complementarity of the nucleotide sequences of LRRN4 BINDING SITE, designated SEQ ID:8168, to the nucleotide sequence of GAM31 RNA, herein designated GAM RNA, also designated SEQ ID:250.

Another function of GAM31 is therefore inhibition of LRRN4 (Accession NP_002310.2). Accordingly, utilities of GAM31 include diagnosis, prevention and treatment of diseases and clinical conditions associated with LRRN4.

Mitogen-activated protein kinase kinase kinase 2 (MAP3K2, Accession NP_006600.2) is another GAM31 target gene, herein designated TARGET GENE. MAP3K2 BINDING SITE is a target binding site found in the 3' untranslated region of mRNA encoded by MAP3K2, corresponding to a target binding site such as BINDING SITE I, BINDING SITE II or BINDING SITE III of FIG. 8. Table 4 illustrates the complementarity of the nucleotide sequences of MAP3K2 BINDING SITE, designated SEQ ID:17136, to the nucleotide sequence of GAM31 RNA, herein designated GAM RNA, also designated SEQ ID:250.

Another function of GAM31 is therefore inhibition of Mitogen-activated protein kinase kinase kinase 2 (MAP3K2, Accession NP_006600.2). Accordingly, utilities of GAM31 include diagnosis, prevention and treatment of diseases and clinical conditions associated with MAP3K2.

MCLC (Accession NP_055942.1) is another GAM31 target gene, herein designated TARGET GENE. MCLC BINDING SITE is a target binding site found in the 3' untranslated region of mRNA encoded by MCLC, corresponding to a target binding site such as BINDING SITE I, BINDING SITE II or BINDING SITE III of FIG. 8. Table 4 illustrates the complementarity of the nucleotide sequences of MCLC BINDING SITE, designated SEQ ID:17231, to the nucleotide sequence of GAM31 RNA, herein designated GAM RNA, also designated SEQ ID:250.

Another function of GAM31 is therefore inhibition of MCLC (Accession NP_055942.1). Accordingly, utilities of GAM31 include diagnosis, prevention and treatment of diseases and clinical conditions associated with MCLC.

Mads box transcription enhancer factor 2, polypeptide b (myocyte enhancer factor 2b) (MEF2B, Accession NP_005910.1) is another GAM31 target gene, herein designated TARGET GENE. MEF2B BINDING SITE is a target binding site found in the 5' untranslated region of mRNA encoded by MEF2B, corresponding to a target binding site such as BINDING SITE I, BINDING SITE II or BINDING SITE III of FIG. 8. Table 4 illustrates the complementarity of the nucleotide sequences of MEF2B BINDING SITE, designated SEQ ID:16083, to the nucleotide sequence of GAM31 RNA, herein designated GAM RNA, also designated SEQ ID:250.

Another function of GAM31 is therefore inhibition of Mads box transcription enhancer factor 2, polypeptide b (myocyte enhancer factor 2b) (MEF2B, Accession NP_005910.1), a gene which binds a consensus sequence that regulates transcription. Accordingly, utilities of GAM31 include diagnosis, prevention and treatment of diseases and clinical conditions associated with MEF2B.

The function of MEF2B has been established by previous studies. See MEF2A (OMIM Ref. No. 600660). The process of differentiation from mesodermal precursor cells to myoblasts has led to the discovery of a variety of tissue-specific factors that regulate muscle gene expression (e.g., 159970). Pollock and Treisman (1991) cloned a cDNA for MEF2B which they designated as a member of the RSRF (related to serum response factor) family. They described its DNA binding properties and discussed its potential role as a regulator of muscle-specific genes. Yu et al. (1992) also obtained MEF2B cDNAs by screening an expression library of primary human skeletal myocytes from vastus lateralis with a DNA probe containing the MEF2 binding sequence. The predicted MEF2B protein includes the conserved MADS and MEF2 domains but otherwise is distinct from MEF2A. Hobson et al. (1995) mapped the MEF2B gene using somatic cell hybrid panel DNAs including deletion or derivative chromosome cell lines and regionalized it to 19p12 by identifying cosmids in a chromosome 19 contig, members of which had previously been mapped to this band and close to the beginning of 19p13.1. T cell receptor (TCR)-induced apoptosis of thymocytes is mediated by calcium- dependent expression of the steroid receptors Nur77 (see OMIM Ref. No. 139139) and Nor1 (see OMIM Ref. No. 600542). MEF2 had been implicated as a calcium-dependent transcription factor for Nur77 expression. Youn et al. (1999) demonstrated that Cabin1 (OMIM Ref. No. 604251), a calcineurin (see OMIM Ref. No. 114105) inhibitor, regulated MEF2. MEF2 was normally sequestered by Cabin1 in a transcriptionally inactive state. TCR engagement led to an increase in intracellular calcium concentration and the dissociation of MEF2 from Cabin1, as a result of competitive binding of activated calmodulin (OMIM Ref. No. 114180) to Cabin1. The interplay between Cabin1, MEF2, and calmodulin defines a distinct signaling pathway from the TCR to the Nur77 promoter during T cell apoptosis.

Full details of the abovementioned studies are described in the following publications, the disclosure of which are hereby incorporated by reference:

Pollock, R.; Treisman, R.: Human SRF-related proteins: DNA-binding properties and potential regulatory targets. Genes Dev. 5:2327-2341, 1991; and Youn, H.-D.; Sun, L.; Prywes, R.; Liu, J. O.: Apoptosis of T cells mediated by Ca(2+)-induced release of the transcription factor MEF2. Science 286: 790-793, 1999.

Further studies establishing the function and utilities of MEF2B are found in John Hopkins OMIM database record ID 600661, and in cited publications listed in Table 5, which are hereby incorporated by reference. MEGF11 (Accession NP_115821.1) is another GAM31 target gene, herein designated TARGET GENE. MEGF11 BINDING SITE is a target binding site found in the 3' untranslated region of mRNA encoded by MEGF11, corresponding to a target binding site such as BINDING SITE I, BINDING SITE II or BINDING SITE III of FIG. 8. Table 4 illustrates the complementarity of the nucleotide sequences of MEGF11 BINDING SITE, designated SEQ ID:10033, to the nucleotide sequence of GAM31 RNA, herein designated GAM RNA, also designated SEQ ID:250.

Another function of GAM31 is therefore inhibition of MEGF11 (Accession NP_115821.1). Accordingly, utilities of GAM31 include diagnosis, prevention and treatment of diseases and clinical conditions associated with MEGF11.

MGC24665 (Accession NP_689521.1) is another GAM31 target gene, herein designated TARGET GENE.

MGC24665 BINDING SITE is a target binding site found in the 3' untranslated region of mRNA encoded by MGC24665, corresponding to a target binding site such as BINDING SITE I, BINDING SITE II or BINDING SITE III of FIG. 8. Table 4 illustrates the complementarity of the nucleotide sequences of MGC24665 BINDING SITE, designated SEQ ID:755, to the nucleotide sequence of GAM31 RNA, herein designated GAM RNA, also designated SEQ ID:250.

Another function of GAM31 is therefore inhibition of MGC24665 (Accession NP_689521.1). Accordingly, utilities of GAM31 include diagnosis, prevention and treatment of diseases and clinical conditions associated with MGC24665.

MGC2941 (Accession NP_077273.1) is another GAM31 target gene, herein designated TARGET GENE. MGC2941 BINDING SITE is a target binding site found in the 3' untranslated region of mRNA encoded by MGC2941, corresponding to a target binding site such as BINDING SITE I, BINDING SITE II or BINDING SITE III of FIG. 8. Table 4 illustrates the complementarity of the nucleotide sequences of MGC2941 BINDING SITE, designated SEQ ID:789, to the nucleotide sequence of GAM31 RNA, herein designated GAM RNA, also designated SEQ ID:250.

Another function of GAM31 is therefore inhibition of MGC2941 (Accession NP_077273.1). Accordingly, utilities of GAM31 include diagnosis, prevention and treatment of diseases and clinical conditions associated with MGC2941.

MGC33926 (Accession NP_689603.1) is another GAM31 target gene, herein designated TARGET GENE. MGC33926 BINDING SITE is a target binding site found in the 3' untranslated region of mRNA encoded by MGC33926, corresponding to a target binding site such as BINDING SITE I, BINDING SITE II or BINDING SITE III of FIG. 8. Table 4 illustrates the complementarity of the nucleotide sequences of MGC33926 BINDING SITE, designated SEQ ID:18620, to the nucleotide sequence of GAM31 RNA, herein designated GAM RNA, also designated SEQ ID:250.

Another function of GAM31 is therefore inhibition of MGC33926 (Accession NP_689603.1). Accordingly, utilities of GAM31 include diagnosis, prevention and treatment of diseases and clinical conditions associated with MGC33926.

MGC35468 (Accession NP_694976.1) is another GAM31 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:19738, to the nucleotide sequence of GAM31 RNA, herein designated GAM RNA, also designated SEQ ID:250.

Another function of GAM31 is therefore inhibition of MGC35468 (Accession NP_694976.1). Accordingly, utilities of GAM31 include diagnosis, prevention and treatment of diseases and clinical conditions associated with MGC35468.

MGC4504 (Accession NP_077016.1) is another GAM31 target gene, herein designated TARGET GENE. MGC4504 BINDING SITE is a target binding site found in the 3' untranslated region of mRNA encoded by MGC4504, corresponding to a target binding site such as BINDING SITE I, BINDING SITE II or BINDING SITE III of FIG. 8. Table 4 illustrates the complementarity of the nucleotide sequences of MGC4504 BINDING SITE, designated SEQ ID:8302, to the nucleotide sequence of GAM31 RNA, herein designated GAM RNA, also designated SEQ ID:250.

Another function of GAM31 is therefore inhibition of MGC4504 (Accession NP_077016.1). Accordingly, utilities of GAM31 include diagnosis, prevention and treatment of diseases and clinical conditions associated with MGC4504.

MIDORI (Accession NP_065829.1) is another GAM31 target gene, herein designated TARGET GENE. MIDORI BINDING SITE is a target binding site found in the 3' untranslated region of mRNA encoded by MIDORI, corresponding to a target binding site such as BINDING SITE I, BINDING SITE II or BINDING SITE III of FIG. 8. Table 4 illustrates the complementarity of the nucleotide sequences of MIDORI BINDING SITE, designated SEQ ID:1428, to the nucleotide sequence of GAM31 RNA, herein designated GAM RNA, also designated SEQ ID:250.

Another function of GAM31 is therefore inhibition of MIDORI (Accession NP_065829.1). Accordingly, utilities of GAM31 include diagnosis, prevention and treatment of diseases and clinical conditions associated with MIDORI.

Paired basic amino acid cleaving system 4 (PACE4, Accession NP_612196.1) is another GAM31 target gene, herein designated TARGET GENE. PACE4 BINDING SITE is a target binding site found in the 3' untranslated region of multiple transcripts of mRNA encoded by PACE4, corresponding to a target binding site such as BINDING SITE I, BINDING SITE II or BINDING SITE III of FIG. 8. Table 4 illustrates the complementarity of the nucleotide sequences of PACE4 BINDING SITE, designated SEQ ID:3372, to the nucleotide sequence of GAM31 RNA, herein designated GAM RNA, also designated SEQ ID:250.

Another function of GAM31 is therefore inhibition of Paired basic amino acid cleaving system 4 (PACE4, Accession NP_612196.1), a gene which processes hormone precursors by cleaving paired basic amino acids. Accordingly, utilities of GAM31 include diagnosis, prevention and treatment of diseases and clinical conditions associated with PACE4.

The function of PACE4 has been established by previous studies. Using PCR methods, Kiefer et al. (1991) identified a second human subtilisin-like protease gene on chromosome 15. PCR primers were designed to be specific for the subfamily of eukaryotic subtilisin-like proteases with specificity for paired basic amino acid residue processing motifs. The gene encoding this protease, designated PACE4, also encoded a smaller subtilisin-related polypeptide derived by alternative mRNA splicing. As with the product of the PACE gene (OMIM Ref. No. 136950), the tissue distribution of PACE4 was widespread, with comparatively higher levels in the liver. By in situ hybridization using isolated cosmid clones, Kiefer et al. (1991) mapped the PACE4 gene to chromosome 15 in close proximity to the PACE gene at 15q25-q26. Double labeling in situ hybridization suggested that the 2 genes are within 5 megabases of each other. Mbikay et al. (1995) mapped the gene for PACE4 (Pcsk6) to mouse chromosome 7 by RFLP analysis of a DNA panel from an interspecific backcross. It was located at a distance of 13 cM from the Pcsk3 locus, which specifies furin (OMIM Ref. No. 136950), another member of this family of enzymes previously mapped to mouse chromosome 7. This is in concordance with the known close proximity of these 2 loci in the homologous region on human 15q25-qter. Pcsk3 and Pcsk6 map to a region of mouse chromosome 7 that has been associated cytogenetically with postnatal lethality in maternal disomy, suggesting that these genes may be imprinted.

Full details of the abovementioned studies are described in the following publications, the disclosure of which are hereby incorporated by reference:

Kiefer, M. C.; Tucker, J. E.; Joh, R.; Landsberg, K. E.; Saltman, D.; Barr, P. J.: Identification of a second human subtilisin-like protease gene in the fes/fps region of chromosome 15. DNA Cell Biol. 10:757-769, 1991; and Mbikay, M.; Seidah, N. G.; Chretien, M.; Simpson, E. M.: Chromosomal assignment of the genes for proprotein convertases PC4, PC5, and PACE 4 in mouse and human. Genomics 26:123-129, 19.

Further studies establishing the function and utilities of PACE4 are found in John Hopkins OMIM database record ID 167405, and in cited publications listed in Table 5, which are hereby incorporated by reference. Paired basic amino acid cleaving system 4 (PACE4, Accession NP_612197.1) is another GAM31 target gene, herein designated TARGET GENE. PACE4 BINDING SITE is a target binding site found in the 3' untranslated region of multiple transcripts of mRNA encoded by PACE4, corresponding to a target binding site such as BINDING SITE I, BINDING SITE II or BINDING SITE III of FIG. 8. Table 4 illustrates the complementarity of the nucleotide sequences of PACE4 BINDING SITE, designated SEQ ID:3372, to the nucleotide sequence of GAM31 RNA, herein designated GAM RNA, also designated SEQ ID:250.

Another function of GAM31 is therefore inhibition of Paired basic amino acid cleaving system 4 (PACE4, Accession NP_612197.1), a gene which processes hormone precursors by cleaving paired basic amino acids. Accordingly, utilities of GAM31 include diagnosis, prevention and treatment of diseases and clinical conditions associated with PACE4.

The function of PACE4 has been established by previous studies. Using PCR methods, Kiefer et al. (1991) identified a second human subtilisin-like protease gene on chromosome 15. PCR primers were designed to be specific for the subfamily of eukaryotic subtilisin-like proteases with specificity for paired basic amino acid residue processing motifs. The gene encoding this protease, designated PACE4, also encoded a smaller subtilisin-related polypeptide derived by alternative mRNA splicing. As with the product of the PACE gene (OMIM Ref. No. 136950), the tissue distribution of PACE4 was widespread, with comparatively higher levels in the liver. By in situ hybridization using isolated cosmid clones, Kiefer et al. (1991) mapped the PACE4 gene to chromosome 15 in close proximity to the PACE gene at 15q25-q26. Double labeling in situ hybridization suggested that the 2 genes are within 5 megabases of each other. Mbikay et al. (1995) mapped the gene for PACE4 (Pcsk6) to mouse chromosome 7 by RFLP analysis of a DNA panel from an interspecific backcross. It was located at a distance of 13 cM from the Pcsk3 locus, which specifies furin (OMIM Ref. No. 136950), another member of this family of enzymes previously mapped to mouse chromosome 7. This is in concordance with the known close proximity of these 2 loci in the homologous region on human 15q25-qter. Pcsk3 and Pcsk6 map to a region of mouse chromosome 7 that has been associated cytogenetically with postnatal lethality in maternal disomy, suggesting that these genes may be imprinted.

Full details of the abovementioned studies are described in the following publications, the disclosure of which are hereby incorporated by reference:

Kiefer, M. C.; Tucker, J. E.; Joh, R.; Landsberg, K. E.; Saltman, D.; Barr, P. J.: Identification of a second human subtilisin-like protease gene in the fes/fps region of chromosome 15. DNA Cell Biol. 10:757-769, 1991; and Mbikay, M.; Seidah, N. G.; Chretien, M.; Simpson, E. M.: Chromosomal assignment of the genes for proprotein convertases PC4, PC5, and PACE 4 in mouse and human. Genomics 26:123-129, 19.

Further studies establishing the function and utilities of PACE4 are found in John Hopkins OMIM database record ID 167405, and in cited publications listed in Table 5, which are hereby incorporated by reference. Phosphodiesterase 4b, camp-specific (phosphodiesterase e4 dunce homolog, drosophila) (PDE4B, Accession NP_002591.1) is another GAM31 target gene, herein designated TARGET GENE. PDE4B BINDING SITE is a target binding site found in the 3' untranslated region of mRNA encoded by PDE4B, corresponding to a target binding site such as BINDING SITE I, BINDING SITE II or BINDING SITE III of FIG. 8. Table 4 illustrates the complementarity of the nucleotide sequences of PDE4B BINDING SITE, designated SEQ ID:17193, to the nucleotide sequence of GAM31 RNA, herein designated GAM RNA, also designated SEQ ID:250.

Another function of GAM31 is therefore inhibition of Phosphodiesterase 4b, camp-specific (phosphodiesterase e4 dunce homolog, drosophila) (PDE4B, Accession NP_002591.1), a gene which may be involved in mediating central nervous system effects of therapeutic agents ranging from antidepressants to antiasthmatic and anti-inflammatory agents. Accordingly, utilities of GAM31 include diagnosis, prevention and treatment of diseases and clinical conditions associated with PDE4B.

The function of PDE4B has been established by previous studies. Huston et al. (1997) cloned a novel human (plus its cognate rat) PDE4B splice variant and compared its activities to the 2 other splice variants from this locus. Alternative splicing of mRNA generated from both the human and rat PDE4B genes produced long and short splice variants that had unique N-terminal regions. It was suggested that these alternatively spliced regions determined changes in the maximal catalytic activity of the isoforms, their susceptibility to inhibition by rolipram, and mode of interaction with particulate fractions. Milatovich et al. (1994) mapped the PDE4B gene to human 1p31 by a combination of Southern analysis of somatic cell hybrid lines and fluorescence in situ hybridization (FISH); they assigned the mouse homolog to chromosome 4 by Southern analysis of recombinant inbred (RI) mouse strains. Through the use of somatic cell hybrids segregating either human or rat chromosomes, Szpirer et al. (1995) mapped the PDE4B gene to human chromosome 1 and rat chromosome 5.

Full details of the abovementioned studies are described in the following publications, the disclosure of which are hereby incorporated by reference:

Huston, E.; Lumb, S.; Russell, A.; Catterall, C.; Ross, A. H.; Steele, M. R.; Bolger, G. B.; Perry, M. J.; Owens, R. J.; Houslay, M. D.: Molecular cloning and transient expression in COS7 cells of a novel human PDE4B cAMP-specific phosphodiesterase, HSPDE4B3. Biochem. J. 328:549-558, 1997; and Milatovich, A.; Bolger, G.; Michaeli, T.; Francke, U.: Chromosome localizations of genes for five cAMP-specific phosphodiesterases in man and mouse. Somat. Cell Molec. Genet. 20:75-86.

Further studies establishing the function and utilities of PDE4B are found in John Hopkins OMIM database record ID 600127, and in cited publications listed in Table 5, which are hereby incorporated by reference. Paternally expressed 10 (PEG10, Accession NP_055883.1) is another GAM31 target gene, herein designated TARGET GENE. PEG10 BINDING SITE is a target binding site found in the 3' untranslated region of mRNA encoded by PEG10, corresponding to a target binding site such as BINDING SITE I, BINDING SITE II or BINDING SITE III of FIG. 8. Table 4 illustrates the complementarity of the nucleotide sequences of PEG10 BINDING SITE, designated SEQ ID:1451, to the nucleotide sequence of GAM31 RNA, herein designated GAM RNA, also designated SEQ ID:250.

Another function of GAM31 is therefore inhibition of Paternally expressed 10 (PEG10, Accession NP_055883.1). Accordingly, utilities of GAM31 include diagnosis, prevention and treatment of diseases and clinical conditions associated with PEG10.

Phospholipase c, gamma 1 (formerly subtype 148) (PLCG1, Accession NP_002651.1) is another GAM31 target gene, herein designated TARGET GENE. PLCG1 BINDING SITE is a target binding site found in the 3' untranslated region of mRNA encoded by PLCG1, corresponding to a target binding site such as BINDING SITE I, BINDING SITE II or BINDING SITE III of FIG. 8. Table 4 illustrates the complementarity of the nucleotide sequences of PLCG1 BINDING SITE, designated SEQ ID:760, to the nucleotide sequence of GAM31 RNA, herein designated GAM RNA, also designated SEQ ID:250.

Another function of GAM31 is therefore inhibition of Phospholipase c, gamma 1 (formerly subtype 148) (PLCG1, Accession NP_002651.1), a gene which is a major substrate for heparin-binding growth factor 1-activated tyrosine kinase. Accordingly, utilities of GAM31 include diagnosis, prevention and treatment of diseases and clinical conditions associated with PLCG1.

The function of PLCG1 has been established by previous studies. The binding of various agonists to their specific cell-surface receptors rapidly induces formation of 2 second-messenger molecules derived from phosphatidylinositol 4,5-bisphosphate, namely, diacylglycerol and inositol 1,4,5-triphosphate. The production of these second-messenger molecules is mediated by activated phosphatidyl inositol-specific phospholipase C (PLC) enzymes. There are several immunologically distinct enzymes with phosphatidylinositol-specific PLC activities. Stahl et al. (1988) purified, cloned, and expressed 1 of these PLC subtypes, which they referred to as PLC-148. They found that PLC-148 mRNA is expressed in most cell types and is present as a single-copy gene. Structural homology with SRC (OMIM Ref. No. 190090) was noted. Bristol et al. (1988) found by in situ hybridization that the PLCG1 gene is located on 20q12-q13.1. Southern blot analysis of DNA from human-mouse hybrid cells supported the assignment to chromosome 20. The location of both SRC and PLC148 on chromosome 20 is of interest. The region is often involved in interstitial deletions and breakpoints in myeloid malignancy. Using the highly polymorphic (dC-dA)n/(dG-dT)n dinucleotide repeat at the PLC1 locus, Rothschild et al. (1992) demonstrated close linkage to several chromosome 20 markers including adenosine deaminase (ADA; 102700); maximum lod =57.24 at theta =0.05. In addition, the PLC1 gene showed linkage to the MODY locus (OMIM Ref. No. 125850); lod score =4.57 at theta =0.089. Nelson et al. (1992) mapped the Plcg1 gene to mouse chromosome 2. Chuang et al. (2001) demonstrated that bradykinin-or NGF-mediated potentiation of thermal sensitivity in vivo requires expression of VR1 (OMIM Ref. No. 602076), a heat-activated ion channel on sensory neurons. Diminution of plasma membrane phosphatidylinositol-4,5,bisphosphate levels through antibody sequestration or PLC-mediated hydrolysis mimics the potentiating effects of bradykinin or NGF at the cellular level. Moreover, recruitment of PLC-gamma to TRK-alpha (OMIM Ref. No. 191315) is essential for NGF-mediated potentiation of channel activity, and biochemical studies suggested that VR1 associates with this complex. Chuang et al. (2001) concluded that their studies delineate a biochemical mechanism through which bradykinin and NGF produce hypersensitivity and might explain how the activation of PLC signaling systems regulates other members of the TRP channel family. Ye et al. (2002) demonstrated that PLCG1 acts as a guanine nucleotide exchange factor for PIKE (OMIM Ref. No. 605476). PIKE is a nuclear GTPase that activates nuclear phosphatidylinositol-3-hydroxykinase (PI(3)K) activity, and mediates the physiologic activation by nerve growth factor (see OMIM Ref. No. 162020) of nuclear PI(3)K activity. This enzymatic activity accounts for the mitogenic properties of PLCG1.

Full details of the abovementioned studies are described in the following publications, the disclosure of which are hereby incorporated by reference:

Stahl, M. L.; Ferenz, C. R.; Kelleher, K. L.; Kriz, R. W.; Knopf, J. L.: Sequence similarity of phospholipase C with the non-catalytic region of src. Nature 332:269-272, 1988; and y, K.; Aghdasi, B.; Luo, H. R.; Moriarity, J. L.; Wu, F. Y.; Hong, J. J.; Hurt, K. J.; Bae, S. S.; Suh, P.-G.; Snyder, S. H.: Phospholipase C-gamma-1 is a physiological guanine nucleo.

Further studies establishing the function and utilities of PLCG1 are found in John Hopkins OMIM database record ID 172420, and in cited publications listed in Table 5, which are hereby incorporated by reference. Procollagen-lysine, 2-oxoglutarate 5-dioxygenase (lysine hydroxylase, ehlers-danlos syndrome type vi) (PLOD, Accession NP_000293.1) is another GAM31 target gene, herein designated TARGET GENE. PLOD BINDING SITE is a target binding site found in the 3' untranslated region of mRNA encoded by PLOD, corresponding to a target binding site such as BINDING SITE I, BINDING SITE II or BINDING SITE III of FIG. 8. Table 4 illustrates the complementarity of the nucleotide sequences of PLOD BINDING SITE, designated SEQ ID:15113, to the nucleotide sequence of GAM31 RNA, herein designated GAM RNA, also designated SEQ ID:250.

Another function of GAM31 is therefore inhibition of Procollagen-lysine, 2-oxoglutarate 5-dioxygenase (lysine hydroxylase, ehlers-danlos syndrome type vi) (PLOD, Accession NP_000293.1). Accordingly, utilities of GAM31 include diagnosis, prevention and treatment of diseases and clinical conditions associated with PLOD.

RODH (Accession NP_003716.2) is another GAM31 target gene, herein designated TARGET GENE. RODH BINDING SITE is a target binding site found in the 3' untranslated region of mRNA encoded by RODH, corresponding to a target binding site such as BINDING SITE I, BINDING SITE II or BINDING SITE III of FIG. 8. Table 4 illustrates the complementarity of the nucleotide sequences of RODH BINDING SITE, designated SEQ ID:14449, to the nucleotide sequence of GAM31 RNA, herein designated GAM RNA, also designated SEQ ID:250.

Another function of GAM31 is therefore inhibition of RODH (Accession NP_003716.2). Accordingly, utilities of GAM31 include diagnosis, prevention and treatment of diseases and clinical conditions associated with RODH.

Spastic ataxia of charlevoix-saguenay (sacsin) (SACS, Accession NP_055178.1) is another GAM31 target gene, herein designated TARGET GENE. SACS BINDING SITE is a target binding site found in the 3' untranslated region of mRNA encoded by SACS, corresponding to a target binding site such as BINDING SITE I, BINDING SITE II or BINDING SITE III of FIG. 8. Table 4 illustrates the complementarity of the nucleotide sequences of SACS BINDING SITE, designated SEQ ID:14450, to the nucleotide sequence of GAM31 RNA, herein designated GAM RNA, also designated SEQ ID:250.

Another function of GAM31 is therefore inhibition of Spastic ataxia of charlevoix-saguenay (sacsin) (SACS, Accession NP_055178.1). Accordingly, utilities of GAM31 include diagnosis, prevention and treatment of diseases and clinical conditions associated with SACS.

Sar1a gene homolog 1 (s. cerevisiae) (SARA1, Accession NP_064535.1) is another GAM31 target gene, herein designated TARGET GENE. SARA1 BINDING SITE is a target binding site found in the 3' untranslated region of mRNA encoded by SARA1, corresponding to a target binding site such as BINDING SITE I, BINDING SITE II or BINDING SITE III of FIG. 8. Table 4 illustrates the complementarity of the nucleotide sequences of SARA1 BINDING SITE, designated SEQ ID:9126, to the nucleotide sequence of GAM31 RNA, herein designated GAM RNA, also designated SEQ ID:250.

Another function of GAM31 is therefore inhibition of Sar1a gene homolog 1 (s. cerevisiae) (SARA1, Accession NP_064535.1). Accordingly, utilities of GAM31 include diagnosis, prevention and treatment of diseases and clinical conditions associated with SARA1.

Splicing factor proline/glutamine rich (polypyrimidine tract binding protein associated) (SFPQ, Accession NP_005057.1) is another GAM31 target gene, herein designated TARGET GENE. SFPQ BINDING SITE is a target binding site found in the 3' untranslated region of mRNA encoded by SFPQ, corresponding to a target binding site such as BINDING SITE I, BINDING SITE II or BINDING SITE III of FIG. 8. Table 4 illustrates the complementarity of the nucleotide sequences of SFPQ BINDING SITE, designated SEQ ID:16010, to the nucleotide sequence of GAM31 RNA, herein designated GAM RNA, also designated SEQ ID:250.

Another function of GAM31 is therefore inhibition of Splicing factor proline/glutamine rich (polypyrimidine tract binding protein associated) (SFPQ, Accession NP_005057.1), a gene which binds intronic polypyrimidine tracts. Accordingly, utilities of GAM31 include diagnosis, prevention and treatment of diseases and clinical conditions associated with SFPQ.

The function of SFPQ has been established by previous studies. Patton et al. (1993) identified a 100-kD protein that copurified and associated with polypyrimidine tract-binding protein (PTB; 600693). By microsequence analysis and PCR, followed by screening a fetal brain cDNA library, Patton et al. (1993) isolated cDNAs encoding alternatively spliced isoforms of this protein, which they called PSF (PTB-associated splicing factor). The deduced 669 - and 707-amino acid PSF isoforms contain 2 consensus RNA-binding domains and an unusual N terminus rich in proline and glutamine residues. PSF is highly basic and has a predicted molecular mass of 76 kD, which is much lower than the experimentally determined molecular mass of 100 kD. Northern blot analysis detected PSF transcripts of 2.5 and 3.0 kb, consistent with the alternative splicing. The authors found that the RNA-binding properties of PSF are identical to those of PTB and that both proteins, together and independently, bind the polypyrimidine tract of mammalian introns. Biochemical complementation, antibody inhibition, and immunodepletion experiments demonstrated that PSF is an essential pre-mRNA splicing factor required early in spliceosome formation. Bacterially synthesized PSF was able to complement immunodepleted extracts and restore splicing activity. Despite its association with PSF, complementary experiments with antibodies against PTB did not suggest an essential role for PTB in pre-mRNA splicing. Clark et al. (1997) identified cases of papillary renal cell carcinoma in which the splicing factor gene PSF was partnered with the TFE3 gene as a result of a translocation, t(X;1)(p11.2;p34).

Full details of the abovementioned studies are described in the following publications, the disclosure of which are hereby incorporated by reference:

Patton, J. G.; Porro, E. B.; Galceran, J.; Tempst, P.; Nadal-Ginard, B.: Cloning and characterization of PSF, a novel pre-mRNA splicing factor. Genes Dev. 7:393-406, 1993; and Clark, J.; Lu, Y.-J.; Sidhar, S. K.; Parker, C.; Gill, S.; Smedley, D.; Hamoudi, R.; Linehan, W. M.; Shipley, J.; Cooper, C. S.: Fusion of splicing factor genes PSF and NonO (p54-nrb) to.

Further studies establishing the function and utilities of SFPQ are found in John Hopkins OMIM database record ID 605199, and in cited publications listed in Table 5, which are hereby incorporated by reference. Siat7c (Accession NP_694541.1) is another GAM31 target gene, herein designated TARGET GENE. Siat7c BINDING SITE is a target binding site found in the 3' untranslated region of mRNA encoded by Siat7c, corresponding to a target binding site such as BINDING SITE I, BINDING SITE II or BINDING SITE III of FIG. 8. Table 4 illustrates the complementarity of the nucleotide sequences of Siat7c BINDING SITE, designated SEQ ID:11487, to the nucleotide sequence of GAM31 RNA, herein designated GAM RNA, also designated SEQ ID:250.

Another function of GAM31 is therefore inhibition of Siat7c (Accession NP_694541.1). Accordingly, utilities of GAM31 include diagnosis, prevention and treatment of diseases and clinical conditions associated with Siat7c.

Solute carrier family 19, member 3 (SLC19A3, Accession NP_079519.1) is another GAM31 target gene, herein designated TARGET GENE. SLC19A3 BINDING SITE is a target binding site found in the 3' untranslated region of mRNA encoded by SLC19A3, corresponding to a target binding site such as BINDING SITE I, BINDING SITE II or BINDING SITE III of FIG. 8. Table 4 illustrates the complementarity of the nucleotide sequences of SLC19A3 BINDING SITE, designated SEQ ID:16645, to the nucleotide sequence of GAM31 RNA, herein designated GAM RNA, also designated SEQ ID:250.

Another function of GAM31 is therefore inhibition of Solute carrier family 19, member 3 (SLC19A3, Accession NP_079519.1). Accordingly, utilities of GAM31 include diagnosis, prevention and treatment of diseases and clinical conditions associated with SLC19A3.

Serine protease inhibitor-like, with kunitz and wap domains 1 (eppin) (SPINLW1, Accession NP_852479.1) is another GAM31 target gene, herein designated TARGET GENE. SPINLW1 BINDING SITE is a target binding site found in the 3' untranslated region of multiple transcripts of mRNA encoded by SPINLW1, corresponding to a target binding site such as BINDING SITE I, BINDING SITE II or BINDING SITE III of FIG. 8. Table 4 illustrates the complementarity of the nucleotide sequences of SPINLW1 BINDING SITE, designated SEQ ID:10499, to the nucleotide sequence of GAM31 RNA, herein designated GAM RNA, also designated SEQ ID:250.

Another function of GAM31 is therefore inhibition of Serine protease inhibitor-like, with kunitz and wap domains 1 (eppin) (SPINLW1, Accession NP_852479.1). Accordingly, utilities of GAM31 include diagnosis, prevention and treatment of diseases and clinical conditions associated with SPINLW1.

Serine protease inhibitor-like, with kunitz and wap domains 1 (eppin) (SPINLW1, Accession NP_065131.1) is another GAM31 target gene, herein designated TARGET GENE. SPINLW1 BINDING SITE is a target binding site found in the 3' untranslated region of multiple transcripts of mRNA encoded by SPINLW1, corresponding to a target binding site such as BINDING SITE I, BINDING SITE II or BINDING SITE III of FIG. 8. Table 4 illustrates the complementarity of the nucleotide sequences of SPINLW1 BINDING SITE, designated SEQ ID:10499, to the nucleotide sequence of GAM31 RNA, herein designated GAM RNA, also designated SEQ ID:250.

Another function of GAM31 is therefore inhibition of Serine protease inhibitor-like, with kunitz and wap domains 1 (eppin) (SPINLW1, Accession NP_065131.1). Accordingly, utilities of GAM31 include diagnosis, prevention and treatment of diseases and clinical conditions associated with SPINLW1.

Synovial sarcoma, x breakpoint 2 interacting protein (SSX2IP, Accession NP_054740.1) is another GAM31 target gene, herein designated TARGET GENE. SSX2IP BINDING SITE is a target binding site found in the 3' untranslated region of mRNA encoded by SSX2IP, corresponding to a target binding site such as BINDING SITE I, BINDING SITE II or BINDING SITE III of FIG. 8. Table 4 illustrates the complementarity of the nucleotide sequences of SSX2IP BINDING SITE, designated SEQ ID:5546, to the nucleotide sequence of GAM31 RNA, herein designated GAM RNA, also designated SEQ ID:250.

Another function of GAM31 is therefore inhibition of Synovial sarcoma, x breakpoint 2 interacting protein (SSX2IP, Accession NP_054740.1). Accordingly, utilities of GAM31 include diagnosis, prevention and treatment of diseases and clinical conditions associated with SSX2IP.

Thyroid hormone receptor, alpha (erythroblastic leukemia viral (v-erb-a) oncogene homolog, avian) (THRA, Accession NP_003241.2) is another GAM31 target gene, herein designated TARGET GENE. THRA BINDING SITE is a target binding site found in the 5' untranslated region of mRNA encoded by THRA, corresponding to a target binding site such as BINDING SITE I, BINDING SITE II or BINDING SITE III of FIG. 8. Table 4 illustrates the complementarity of the nucleotide sequences of THRA BINDING SITE, designated SEQ ID:5656, to the nucleotide sequence of GAM31 RNA, herein designated GAM RNA, also designated SEQ ID:250.

Another function of GAM31 is therefore inhibition of Thyroid hormone receptor, alpha (erythroblastic leukemia viral (v-erb-a) oncogene homolog, avian) (THRA, Accession NP_003241.2), a gene which is a high affinity receptor for thyroid hormone and therefore may be associated with Non-functioning pituitary adenoma. Accordingly, utilities of GAM31 include diagnosis, prevention and treatment of Non-functioning pituitary adenoma, and of other diseases and clinical conditions associated with THRA.

The function of THRA has been established by previous studies. Debuire et al. (1984) found that ERBA, which potentiates ERBB (OMIM Ref. No. 131550), has an amino acid sequence different from that of other known oncogene products and related to those of the carbonic anhydrases. ERBA potentiates ERBB by blocking differentiation of erythroblasts at an immature stage. Carbonic anhydrases participate in the transport of carbon dioxide in erythrocytes. Sap et al. (1986) and Weinberger et al. (1986) showed that the ERBA protein is a high-affinity receptor for thyroid hormone. The cDNA sequence indicates a relationship to steroid-hormone receptors, and binding studies indicate that it is a receptor for thyroid hormones. It is located in the nucleus, where it binds to DNA and activates transcription. McCabe et al. (1999) hypothesized that aberrant THRA expression in nonfunctioning pituitary tumors may reflect mutations in the receptor coding and regulatory sequences. They screened THRA mRNA and THRB response elements and ligand-binding domains for sequence anomalies. Screening THRA mRNA from 23 tumors by RNase mismatch and sequencing candidate fragments identified 1 silent and 3 missense mutations, 2 in the common THRA region (190120.0001, 190120.0002) and 1 that was specific for the alpha-2 isoform (190120.0003). No THRB response element differences were detected in 14 nonfunctioning tumors, and no THRB ligand-binding domain differences were detected in 23 nonfunctioning tumors. The authors suggested that the novel thyroid receptor mutations may be of functional significance in terms of thyroid receptor action, and further definition of their functional properties may provide insight into the role of thyroid receptors in growth control in pituitary cells.

Animal model experiments lend further support to the function of THRA. To evaluate the respective contributions of THRA and THRB in the regulation of CYP7A (OMIM Ref. No. 118455), the rate-limiting enzyme in the synthesis of bile acids, Gullberg et al. (2000) studied the responses to 2% dietary cholesterol and T3 in THRA and THRB knockout mice under hypo- and hyperthyroid conditions. Their experiments showed that the normal stimulation in CYP7A activity and mRNA level by T3 is lost in THRB -/-, but not in THRA -/-, mice, identifying THRB as the mediator of T3 action on CYP7A and, consequently, as a major regulator of cholesterol metabolism in vivo. Somewhat unexpectedly, T3-deficient THRB -/- mice showed an augmented CYP7A response after challenge with dietary cholesterol, and these animals did not develop hypercholesterolemia to the extent that wildtype controls did. The authors concluded that the latter results lend strong support to the concept that THRs may exert regulatory effects in vivo independent of T3.

It is appreciated that the abovementioned animal model for THRA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weinberger, C.; Thompson, C. C.; Ong, E. S.; Lebo, R.; Gruol, D. J.; Evans, R. M.: The c-erb-A gene encodes a thyroid hormone receptor. Nature 324:641-646, 1986; and Gullberg, H.; Rudling, M.; Forrest, D.; Angelin, B.; Vennstrom, B.: Thyroid hormone receptor beta-deficient mice show complete loss of the normal cholesterol 7-alpha-hydroxylase (CYP7A).

Further studies establishing the function and utilities of THRA are found in John Hopkins OMIM database record ID 190120, and in cited publications listed in Table 5, which are hereby incorporated by reference. Tyrosine kinase, non-receptor, 1 (TNK1, Accession NP_003976.1) is another GAM31 target gene, herein designated TARGET GENE. TNK1 BINDING SITE is a target binding site found in the 3' untranslated region of mRNA encoded by TNK1, corresponding to a target binding site such as BINDING SITE I, BINDING SITE II or BINDING SITE III of FIG. 8. Table 4 illustrates the complementarity of the nucleotide sequences of TNK1 BINDING SITE, designated SEQ ID:16242, to the nucleotide sequence of GAM31 RNA, herein designated GAM RNA, also designated SEQ ID:250.

Another function of GAM31 is therefore inhibition of Tyrosine kinase, non-receptor, 1 (TNK1, Accession NP_003976.1). Accordingly, utilities of GAM31 include diagnosis, prevention and treatment of diseases and clinical conditions associated with TNK1.

Tripartite motif-containing 8 (TRIM8, Accession NP_112174.1) is another GAM31 target gene, herein designated TARGET GENE. TRIM8 BINDING SITE is a target binding site found in the 3' untranslated region of mRNA encoded by TRIM8, corresponding to a target binding site such as BINDING SITE I, BINDING SITE II or BINDING SITE III of FIG. 8. Table 4 illustrates the complementarity of the nucleotide sequences of TRIM8 BINDING SITE, designated SEQ ID:7224, to the nucleotide sequence of GAM31 RNA, herein designated GAM RNA, also designated SEQ ID:250.

Another function of GAM31 is therefore inhibition of Tripartite motif-containing 8 (TRIM8, Accession NP_112174.1). Accordingly, utilities of GAM31 include diagnosis, prevention and treatment of diseases and clinical conditions associated with TRIM8.

Thioredoxin-like, 32 kda (TXNL, Accession NP_004777.1) is another GAM31 target gene, herein designated TARGET GENE. TXNL BINDING SITE is a target binding site found in the 3' untranslated region of mRNA encoded by TXNL, corresponding to a target binding site such as BINDING SITE I, BINDING SITE II or BINDING SITE III of FIG. 8. Table 4 illustrates the complementarity of the nucleotide sequences of TXNL BINDING SITE, designated SEQ ID:18077, to the nucleotide sequence of GAM31 RNA, herein designated GAM RNA, also designated SEQ ID:250.

Another function of GAM31 is therefore inhibition of Thioredoxin-like, 32 kda (TXNL, Accession NP_004777.1). Accordingly, utilities of GAM31 include diagnosis, prevention and treatment of diseases and clinical conditions associated with TXNL.

VTS58635 (Accession NP_201572.1) is another GAM31 target gene, herein designated TARGET GENE. VTS58635 BINDING SITE is a target binding site found in the 3' untranslated region of mRNA encoded by VTS58635, corresponding to a target binding site such as BINDING SITE I, BINDING SITE II or BINDING SITE III of FIG. 8. Table 4 illustrates the complementarity of the nucleotide sequences of VTS58635 BINDING SITE, designated SEQ ID:11083, to the nucleotide sequence of GAM31 RNA, herein designated GAM RNA, also designated SEQ ID:250.

Another function of GAM31 is therefore inhibition of VTS58635 (Accession NP_201572.1). Accordingly, utilities of GAM31 include diagnosis, prevention and treatment of diseases and clinical conditions associated with VTS58635.

Zinc finger, dhhc domain containing 6 (ZDHHC6, Accession NP_071939.1) is another GAM31 target gene, herein designated TARGET GENE. ZDHHC6 BINDING SITE is a target binding site found in the 3' untranslated region of mRNA encoded by ZDHHC6, corresponding to a target binding site such as BINDING SITE I, BINDING SITE II or BINDING SITE III of FIG. 8. Table 4 illustrates the complementarity of the nucleotide sequences of ZDHHC6 BINDING SITE, designated SEQ ID:11341, to the nucleotide sequence of GAM31 RNA, herein designated GAM RNA, also designated SEQ ID:250.

Another function of GAM31 is therefore inhibition of Zinc finger, dhhc domain containing 6 (ZDHHC6, Accession NP_071939.1). Accordingly, utilities of GAM31 include diagnosis, prevention and treatment of diseases and clinical conditions associated with ZDHHC6.

ZF (Accession NP_067035.1) is another GAM31 target gene, herein designated TARGET GENE. ZF BINDING SITE is a target binding site found in the 3' untranslated region of mRNA encoded by ZF, corresponding to a target binding site such as BINDING SITE I, BINDING SITE II or BINDING SITE III of FIG. 8. Table 4 illustrates the complementarity of the nucleotide sequences of ZF BINDING SITE, designated SEQ ID:16486, to the nucleotide sequence of GAM31 RNA, herein designated GAM RNA, also designated SEQ ID:250.

Another function of GAM31 is therefore inhibition of ZF (Accession NP_067035.1). Accordingly, utilities of GAM31 include diagnosis, prevention and treatment of diseases and clinical conditions associated with ZF.

Zinc finger protein 238 (ZNF238, Accession NP_006343.2) is another GAM31 target gene, herein designated TARGET GENE. ZNF238 BINDING SITE is a target binding site found in the 3' untranslated region of mRNA encoded by ZNF238, corresponding to a target binding site such as BINDING SITE I, BINDING SITE II or BINDING SITE III of FIG. 8. Table 4 illustrates the complementarity of the nucleotide sequences of ZNF238 BINDING SITE, designated SEQ ID:5764, to the nucleotide sequence of GAM31 RNA, herein designated GAM RNA, also designated SEQ ID:250.

Another function of GAM31 is therefore inhibition of Zinc finger protein 238 (ZNF238, Accession NP_006343.2). Accordingly, utilities of GAM31 include diagnosis, prevention and treatment of diseases and clinical conditions associated with ZNF238.

Zinc finger protein 259 (ZNF259, Accession NP_003895.1) is another GAM31 target gene, herein designated TARGET GENE. ZNF259 BINDING SITE is a target binding site found in the 3' untranslated region of mRNA encoded by ZNF259, corresponding to a target binding site such as BINDING SITE I, BINDING SITE II or BINDING SITE III of FIG. 8. Table 4 illustrates the complementarity of the nucleotide sequences of ZNF259 BINDING SITE, designated SEQ ID:13366, to the nucleotide sequence of GAM31 RNA, herein designated GAM RNA, also designated SEQ ID:250.

Another function of GAM31 is therefore inhibition of Zinc finger protein 259 (ZNF259, Accession NP_003895.1). Accordingly, utilities of GAM31 include diagnosis, prevention and treatment of diseases and clinical conditions associated with ZNF259.

Zinc finger protein 294 (ZNF294, Accession XP_047829.3) is another GAM31 target gene, herein designated TARGET GENE. ZNF294 BINDING SITE is a target binding site found in the 3' untranslated region of multiple transcripts of mRNA encoded by ZNF294, corresponding to a target binding site such as BINDING SITE I, BINDING SITE II or BINDING SITE III of FIG. 8. Table 4 illustrates the complementarity of the nucleotide sequences of ZNF294 BINDING SITE, designated SEQ ID:13175, to the nucleotide sequence of GAM31 RNA, herein designated GAM RNA, also designated SEQ ID:250.

Another function of GAM31 is therefore inhibition of Zinc finger protein 294 (ZNF294, Accession XP_047829.3). Accordingly, utilities of GAM31 include diagnosis, prevention and treatment of diseases and clinical conditions associated with ZNF294.

Zinc finger protein 294 (ZNF294, Accession NP_056380.1) is another GAM31 target gene, herein designated TARGET GENE. ZNF294 BINDING SITE is a target binding site found in the 3' untranslated region of multiple transcripts of mRNA encoded by ZNF294, corresponding to a target binding site such as BINDING SITE I, BINDING SITE II or BINDING SITE III of FIG. 8. Table 4 illustrates the complementarity of the nucleotide sequences of ZNF294

BINDING SITE, designated SEQ ID:13175, to the nucleotide sequence of GAM31 RNA, herein designated GAM RNA, also designated SEQ ID:250.

Another function of GAM31 is therefore inhibition of Zinc finger protein 294 (ZNF294, Accession NP_056380.1). Accordingly, utilities of GAM31 include diagnosis, prevention and treatment of diseases and clinical conditions associated with ZNF294.

Zinc finger protein 36 (kox 18) (ZNF36, Accession XP_168302.1) is another GAM31 target gene, herein designated TARGET GENE. ZNF36 BINDING SITE is a target binding site found in the 3' untranslated region of mRNA encoded by ZNF36, corresponding to a target binding site such as BINDING SITE I, BINDING SITE II or BINDING SITE III of FIG. 8. Table 4 illustrates the complementarity of the nucleotide sequences of ZNF36 BINDING SITE, designated SEQ ID:13144, to the nucleotide sequence of GAM31 RNA, herein designated GAM RNA, also designated SEQ ID:250.

Another function of GAM31 is therefore inhibition of Zinc finger protein 36 (kox 18) (ZNF36, Accession XP_168302.1), a gene which may be involved in transcriptional regulation. Accordingly, utilities of GAM31 include diagnosis, prevention and treatment of diseases and clinical conditions associated with ZNF36.

The function of ZNF36 has been established by previous studies. By screening a human insulinoma cDNA library with a degenerate oligonucleotide corresponding to the H/C linker sequence, Tommerup et al. (1993) isolated cDNAs potentially encoding zinc finger proteins. Tommerup and Vissing (1995) performed sequence analysis on a number of these cDNAs and identified several novel zinc finger protein genes, including ZNF36, which they called ZNF139. The ZNF139 cDNA predicts a protein belonging to the Kruppel family of zinc finger proteins. By isotopic in situ hybridization, Rousseau-Merck et al. (1995) mapped the ZNF36 gene, which they called KOX18, to 7q21-q22. From pulsed field gel electrophoresis studies, they showed that KOX18 is within less than 250 kb of KOX25 (ZNF38; 601261). Rousseau-Merck et al. (1995) tabulated 18 different KOX genes that had been located in pairs within 9 DNA fragments of 200 to 580 kb on 7 different chromosomes. By FISH, Tommerup and Vissing (1995) mapped the ZNF36 gene to 7q21.3-q22.1.

Full details of the abovementioned studies are described in the following publications, the disclosure of which are hereby incorporated by reference:

Tommerup, N.; Vissing, H.: Isolation and fine mapping of 16 novel human zinc finger-encoding cDNAs identify putative candidate genes for developmental and malignant disorders. Genomics 27:259-264, 1995; and Rousseau-Merck, M.-F.; Duro, D.; Berger, R.; Thiesen, H. J.: Chromosomal localization of two KOX zinc finger genes on chromosome bands 7q21-q22. Ann. Genet. 38:81-84, 1995.

Further studies establishing the function and utilities of ZNF36 are found in John Hopkins OMIM database record ID 601260, and in cited publications listed in Table 5, which are hereby incorporated by reference.

FIG. 8 further provides a conceptual description of a novel bioinformatically detected of the present invention, referred to here as Genomic Address Messenger 32 (GAM32), which modulates expression of respective target genes thereof, the function and utility of which target genes is known in the art.

GAM32 is a novel bioinformatically detected regulatory, non protein coding, micro RNA (miRNA) gene. The method by which GAM32 was detected is described hereinabove with reference to FIGS. 8-15.

GAM32 gene, herein designated GAM GENE, and GAM32 target gene, herein designated TARGET GENE, are human genes contained in the human genome.

GAM32 gene encodes a GAM32 precursor RNA, herein designated GAM PRECURSOR RNA. Similar to other miRNA genes, and unlike most ordinary genes, GAM32 precursor RNA does not encode a protein. A nucleotide sequence identical or highly similar to the nucleotide sequence of GAM32 precursor RNA is designated SEQ ID:187, and is provided hereinbelow with reference to the sequence listing part.

GAM32 precursor RNA folds onto itself, forming GAM32 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM32 precursor RNA folds onto itself, forming GAM32 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM32 precursor RNA, designated SEQ-ID:187, and a schematic representation of a predicted secondary folding of GAM32 folded precursor RNA are further described with reference to Table 2, hereby incorporated by reference.

An enzyme complex designated DICER COMPLEX, 'dices' the GAM32 folded precursor RNA into GAM32 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM32 RNA is designated SEQ ID:384, and is provided hereinbelow with references to the sequence listing part and Table 3, hereby incorporated by reference.

GAM32 target gene, herein designated TARGET GENE, encodes a corresponding messenger RNA, GAM32 target RNA, herein designated GAM TARGET RNA. GAM32 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM32 RNA, herein designated GAM RNA, binds complementarily to one or more target binding sites located in untranslated regions of GAM32 target RNA, herein designated GAM TARGET RNA. This complementary binding is due to the fact that the nucleotide sequence of GAM32 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM32 RNA may have a different number of target binding sites in untranslated regions of a GAM32 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM32 RNA, herein designated GAM RNA, to target binding sites on GAM32 target RNA, herein designated GAM TARGET RNA, such as BINDING SITE I, BINDING SITE II and BINDING SITE III, inhibits translation of GAM32 target RNA into GAM32 target protein, herein designated GAM TARGET PROTEIN. GAM target protein is therefore outlined by a broken line.

It is appreciated that GAM32 target gene, herein designated TARGET GENE, in fact represents a plurality of GAM32 target genes. The mRNA of each one of this plurality of GAM32 target genes comprises one or more target binding sites, each having a nucleotide sequence which is at least partly complementary to GAM32 RNA, herein designated GAM RNA, and which when bound by GAM32 RNA causes inhibition of translation of respective one or more GAM32 target proteins.

It is further appreciated by one skilled in the art that the mode of translational inhibition illustrated by FIG. 8 with specific reference to translational inhibition exerted by GAM32 gene, herein designated GAM GENE, on one or more GAM32 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM32 correlate with, and may be deduced from, the identity of the target genes which GAM32 binds and inhibits, and the function of these target genes, as elaborated hereinbelow.

Cullin 3 (CUL3, Accession NM_003590.1) is a GAM32 target gene, herein designated TARGET GENE. CUL3 BINDING SITE is a target binding site found in the 3' untranslated region of mRNA encoded by CUL3, corresponding to a target binding site such as BINDING SITE I, BINDING SITE II or BINDING SITE III of FIG. 8. Table 4 illustrates the complementarity of the nucleotide sequences of CUL3 BINDING SITE, designated SEQ ID:7209, to the nucleotide sequence of GAM32 RNA, herein designated GAM RNA, also designated SEQ ID:384.

A function of GAM32 is therefore inhibition of Cullin 3 (CUL3, Accession NM_003590.1), a gene which may target other proteins for ubiquitin-dependent proteolysis. Accordingly, utilities of GAM32 include diagnosis, prevention and treatment of diseases and clinical conditions associated with CUL3.

The function of CUL3 has been established by previous studies. Kipreos et al. (1996) identified a conserved gene family, designated cullins, with at least 5 members in nematodes, 6 in humans, and 3 in S. cerevisiae. See CUL1 (OMIM Ref. No. 603134). Human CUL3 is an ortholog of nematode cul3. Michel and Xiong (1998) identified human CUL3 cDNAs and reported that the predicted protein is 768 amino acids long. Ishikawa et al. (1998) isolated a CUL3 cDNA, KIAA0617, as 1 of 100 brain cDNAs encoding large proteins. Using RT-PCR, they found that CUL3 is expressed in several tissues. Du et al. (1998) identified CUL3 as a gene whose expression in human fibroblasts is induced by phorbol 12-myristate 13-acetate (PMA) and suppressed by salicylate. They reported that the sequences of the human and C. elegans cul3 proteins share 46% identity. Northern blot analysis revealed that CUL3 is expressed as major 2.8- and minor 4.3-kb transcripts in various human tissues, with the highest levels in skeletal muscle and heart.

Full details of the abovementioned studies are described in the following publications, the disclosure of which are hereby incorporated by reference:

Du, M.; Sansores-Garcia, L.; Zu, Z.; Wu, K. K.: Cloning and expression analysis of a novel salicylate suppressible gene, Hs-CUL-3, a member of cullin/Cdc53 family. J. Biol. Chem. 273:24289-24292, 1998; and Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete seque.

Further studies establishing the function and utilities of CUL3 are found in John Hopkins OMIM database record ID 603136, and in cited publications listed in Table 5, which are hereby incorporated by reference. KIAA0237 (Accession NM_014747.1) is another GAM32 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:16243, to the nucleotide sequence of GAM32 RNA, herein designated GAM RNA, also designated SEQ ID:384.

Another function of GAM32 is therefore inhibition of KIAA0237 (Accession NM_014747.1). Accordingly, utilities of GAM32 include diagnosis, prevention and treatment of diseases and clinical conditions associated with KIAA0237.

KIAA0514 (Accession NM_014696.1) is another GAM32 target gene, herein designated TARGET GENE. KIAA0514 BINDING SITE is a target binding site found in the 3' untranslated region of mRNA encoded by KIAA0514, corresponding to a target binding site such as BINDING SITE I, BINDING SITE II or BINDING SITE III of FIG. 8. Table 4 illustrates the complementarity of the nucleotide sequences of KIAA0514 BINDING SITE, designated SEQ ID:11389, to the nucleotide sequence of GAM32 RNA, herein designated GAM RNA, also designated SEQ ID:384.

Another function of GAM32 is therefore inhibition of KIAA0514 (Accession NM_014696.1). Accordingly, utilities of GAM32 include diagnosis, prevention and treatment of diseases and clinical conditions associated with KIAA0514.

LOC149734 (Accession) is another GAM32 target gene, herein designated TARGET GENE. LOC149734 BINDING SITE is a target binding site found in the 3' untranslated region of mRNA encoded by LOC149734, corresponding to a target binding site such as BINDING SITE I, BINDING SITE II or BINDING SITE III of FIG. 8. Table 4 illustrates the complementarity of the nucleotide sequences of LOC149734 BINDING SITE, designated SEQ ID:1549, to the nucleotide sequence of GAM32 RNA, herein designated GAM RNA, also designated SEQ ID:384.

Another function of GAM32 is therefore inhibition of LOC149734 (Accession). Accordingly, utilities of GAM32 include diagnosis, prevention and treatment of diseases and clinical conditions associated with LOC149734.

LOC151959 (Accession XM_098144.1) is another GAM32 target gene, herein designated TARGET GENE. LOC151959 BINDING SITE is a target binding site found in the 3' untranslated region of mRNA encoded by LOC151959, corresponding to a target binding site such as BINDING SITE I, BINDING SITE II or BINDING SITE III of FIG. 8. Table 4 illustrates the complementarity of the nucleotide sequences of LOC151959 BINDING SITE, designated SEQ ID:11716, to the nucleotide sequence of GAM32 RNA, herein designated GAM RNA, also designated SEQ ID:384.

Another function of GAM32 is therefore inhibition of LOC151959 (Accession XM_098144.1). Accordingly, utilities of GAM32 include diagnosis, prevention and treatment of diseases and clinical conditions associated with LOC151959.

LOC90362 (Accession) is another GAM32 target gene, herein designated TARGET GENE. LOC90362 BINDING SITE is a target binding site found in the 5' untranslated region of mRNA encoded by LOC90362, corresponding to a target binding site such as BINDING SITE I, BINDING SITE II or BINDING SITE III of FIG. 8. Table 4 illustrates the complementarity of the nucleotide sequences of LOC90362 BINDING SITE, designated SEQ ID:5001, to the nucleotide sequence of GAM32 RNA, herein designated GAM RNA, also designated SEQ ID:384.

Another function of GAM32 is therefore inhibition of LOC90362 (Accession). Accordingly, utilities of GAM32 include diagnosis, prevention and treatment of diseases and clinical conditions associated with LOC90362.

Protocadherin 11 y-linked (PCDH11Y, Accession NM_032972.1) is another GAM32 target gene, herein designated TARGET GENE. PCDH11Y BINDING SITE is a target binding site found in the 3' untranslated region of multiple transcripts of mRNA encoded by PCDH11Y, corresponding to a target binding site such as BINDING SITE I, BINDING SITE II or BINDING SITE III of FIG. 8. Table 4 illustrates the complementarity of the nucleotide sequences of PCDH11Y BINDING SITE, designated SEQ ID:14519, to the nucleotide sequence of GAM32 RNA, herein designated GAM RNA, also designated SEQ ID:384.

Another function of GAM32 is therefore inhibition of Protocadherin 11 y-linked (PCDH11Y, Accession NM_032972.1). Accordingly, utilities of GAM32 include diagnosis, prevention and treatment of diseases and clinical conditions associated with PCDH11Y.

Protocadherin beta 3 (PCDHB3, Accession NM_018937.2) is another GAM32 target gene, herein designated TARGET GENE. PCDHB3 BINDING SITE is a target binding site found in the 3' untranslated region of mRNA encoded by PCDHB3, corresponding to a target binding site such as BINDING SITE I, BINDING SITE II or BINDING SITE III of FIG. 8. Table 4 illustrates the complementarity of the nucleotide sequences of PCDHB3 BINDING SITE, designated SEQ ID:4570, to the nucleotide sequence of GAM32 RNA, herein designated GAM RNA, also designated SEQ ID:384.

Another function of GAM32 is therefore inhibition of Protocadherin beta 3 (PCDHB3, Accession NM_018937.2). Accordingly, utilities of GAM32 include diagnosis, prevention and treatment of diseases and clinical conditions associated with PCDHB3.

Pou domain, class 4, transcription factor 2 (POU4F2, Accession NM_004575.1) is another GAM32 target gene, herein designated TARGET GENE. POU4F2 BINDING SITE is a target binding site found in the 3' untranslated region of mRNA encoded by POU4F2, corresponding to a target binding site such as BINDING SITE I, BINDING SITE II or BINDING SITE III of FIG. 8. Table 4 illustrates the complementarity of the nucleotide sequences of POU4F2 BINDING SITE, designated SEQ ID:19158, to the nucleotide sequence of GAM32 RNA, herein designated GAM RNA, also designated SEQ ID:384.

Another function of GAM32 is therefore inhibition of Pou domain, class 4, transcription factor 2 (POU4F2, Accession NM_004575.1). Accordingly, utilities of GAM32 include diagnosis, prevention and treatment of diseases and clinical conditions associated with POU4F2.

PRO2266 (Accession) is another GAM32 target gene, herein designated TARGET GENE. PRO2266 BINDING SITE is a target binding site found in the 3' untranslated region of mRNA encoded by PRO2266, corresponding to a target binding site such as BINDING SITE I, BINDING SITE II or BINDING SITE III of FIG. 8. Table 4 illustrates the complementarity of the nucleotide sequences of PRO2266 BINDING SITE, designated SEQ ID:12617, to the nucleotide sequence of GAM32 RNA, herein designated GAM RNA, also designated SEQ ID:384.

Another function of GAM32 is therefore inhibition of PRO2266 (Accession). Accordingly, utilities of GAM32 include diagnosis, prevention and treatment of diseases and clinical conditions associated with PRO2266.

Secreted phosphoprotein 1 (osteopontin, bone sialoprotein i, early t-lymphocyte activation 1) (SPP1, Accession NM_000582.1) is another GAM32 target gene, herein designated TARGET GENE. SPP1 BINDING SITE is a target binding site found in the 3' untranslated region of mRNA encoded by SPP1, corresponding to a target binding site such as BINDING SITE I, BINDING SITE II or BINDING SITE III of FIG. 8. Table 4 illustrates the complementarity of the nucleotide sequences of SPP1 BINDING SITE, designated SEQ ID:13484, to the nucleotide sequence of GAM32 RNA, herein designated GAM RNA, also designated SEQ ID:384.

Another function of GAM32 is therefore inhibition of Secreted phosphoprotein 1 (osteopontin, bone sialoprotein i, early t-lymphocyte activation 1) (SPP1, Accession NM_000582.1), a gene which binds tightly to hydroxyapatite. appears to form an integral part of the mineralized matrix. probably important to cell-matrix interaction. and therefore may be associated with Urinary stone formation. Accordingly, utilities of GAM32 include diagnosis, prevention and treatment of Urinary stone formation, and of other diseases and clinical conditions associated with SPP1.

The function of SPP1 has been established by previous studies. Kohri et al. (1992) sequenced a cDNA of urinary stone protein, the proteinaceous matrix of urinary stones. The sequence showed complete homology with that of osteopontin. Furthermore, Kohri et al. (1993) showed that urinary calcium oxalate stones consist of osteopontin protein. By means of in situ hybridization, they demonstrated osteopontin mRNA in the kidney, specifically in the distal tubular cells. In a rat model of stone formation induced with glyoxylic acid, they found that staining for osteopontin was remarkably increased in distal tubular cells, whereas proximal tubular cells and glomeruli remained negative as in the normal kidney. Two genes, TAP1 (OMIM Ref. No. 170260) and SCYD1 (encoding fractalkine; 601880), may contribute to suppress tumor growth through host immunosurveillance. These genes were identified as downstream targets of the TP53 tumor suppressor gene (OMIM Ref. No. 191170). As noted by Ashkar et al. (2000), osteopontin is one of the key cytokines for type 1 immune responses mediated by macrophages in mice. Osteopontin may also play a role in suppressing tumor growth in vivo. Morimoto et al. (2002) identified the OPN gene as a TP53 target gene and found that its expression was upregulated by DNA damage-induced TP53 activity and by adenovirus-mediated transfer of the human TP53 gene. They demonstrated that the OPN gene has a functional TP53-responsive element in its promoter region and confirmed an interaction between the OPN promoter and Tp53 protein in vivo. The results suggested that OPN is a direct transcriptional target of TP53. The TP53-directed regulation of OPN expression suggested a novel mechanism of TP53 participation in immunosurveillance, involving interaction with the host immune system to prevent damaged cells from undergoing malignant transformation.

Animal model experiments lend further support to the function of SPP1. Ashkar et al. (2000) reported that mice deficient in osteopontin gene expression have severely impaired type 1 immunity to viral infection and bacterial infection and do not develop sarcoid-type granulomas. IL12 (see OMIM Ref. No. 161560) and interferon-gamma (OMIM Ref. No. 147570) production is diminished, and IL10 (OMIM Ref. No. 124092) production is increased. A phosphorylation-dependent interaction between the amino-terminal portion of osteopontin and its integrin receptor stimulated IL12 expression, whereas phosphorylation- independent interaction with CD44 inhibited IL10 expression. Ashkar et al. (2000) concluded that osteopontin is a key cytokine that sets the stage for efficient type 1 immune responses through differential regulation of macrophage IL12 and IL10 cytokine expression.

It is appreciated that the abovementioned animal model for SPP1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kohri, K.; Nomura, S.; Kitamura, Y.; Nagata, T.; Yoshioka, K.; Iguchi, M.; Yamate, T.; Umekawa, T.; Suzuki, Y.; Sinohara, H.; Kurita, T.: Structure and expression of the mRNA encoding urinary stone protein (osteopontin). J. Biol. Chem. 268:15180-15184, 1993; and Ashkar, S.; Weber, G. F.; Panoutsakopoulou, V.; Sanchirico, M. E.; Jansson, M.; Zawaideh, S.; Rittling, S. R.; Denhardt, D. T.; Glimchar, M. J.; Cantor, H.: Eta-1 (osteopontin): an early c.

Further studies establishing the function and utilities of SPP1 are found in John Hopkins OMIM database record ID 166490, and in cited publications listed in Table 5, which are hereby incorporated by reference. Timeless homolog (drosophila) (TIMELESS, Accession NM_003920.1) is another GAM32target gene, herein designated TARGET GENE. TIMELESS BINDING SITE is a target binding site found in the 3' untranslated region of mRNA encoded by TIMELESS, corresponding to a target binding site such as BINDING SITE I, BINDING SITE II or BINDING SITE III of FIG. 8. Table 4 illustrates the complementarity of the nucleotide sequences of TIMELESS BINDING SITE, designated SEQ ID:11356, to the nucleotide sequence of GAM32 RNA, herein designated GAM RNA, also designated SEQ ID:384.

Another function of GAM32 is therefore inhibition of Timeless homolog (drosophila) (TIMELESS, Accession NM_003920.1), a gene which involves in circadian oscillation autoregulation. Accordingly, utilities of GAM32 include diagnosis, prevention and treatment of diseases and clinical conditions associated with TIMELESS.

The function of TIMELESS has been established by previous studies. Cellular pacemakers located in the suprachiasmatic nucleus (SCN) of the anterior hypothalamus control circadian rhythms. In Drosophila, a central clock mechanism involves the dynamic regulation of 2 genes, 'period' (per; OMIM Ref. No. 602260) and 'timeless' (tim), which physically interact and participate in an intracellular transcriptional/translational feedback loop. The transcription of per and tim is positively regulated by the Clock (OMIM Ref. No. 601851) and BMAL1 (OMIM Ref. No. 602550) proteins, which form heterodimers. By searching EST databases, Sangoram et al. (1998), Zylka et al. (1998), and Koike et al. (1998) identified cDNAs corresponding to human (TIM) and mouse (Tim) homologs of Drosophila timeless. Sangoram et al. (1998) reported that the predicted 1,208-amino acid human protein is 84% identical to mouse Tim. The mammalian proteins share 4 regions of homology with Drosophila tim, including regions involved in nuclear localization, protein-protein interaction with PER, and cytoplasmic localization. Northern blot analysis revealed that TIM was expressed as a 4.5-kb mRNA in all human tissues tested, with the highest levels in placenta, pancreas, thymus, and testis. In situ hybridization indicated that unlike those of Drosophila, mouse Tim transcript levels do not oscillate in the SCN or in the retina. Sangoram et al. (1998) demonstrated that human TIM interacts with Drosophila per, mouse PER1, and mouse PER2 (see OMIM Ref. No. 603426) in vitro. When expressed in Drosophila cells, TIM mimicked a Drosophila tim cellular function by interacting with Drosophila per and translocating into the nucleus. In addition, when expressed in mammalian cells, human TIM and mouse PER1 specifically inhibited CLOCK-BMAL1-induced transactivation of the mouse PER1 promoter. These authors concluded that TIM and Tim are the mammalian orthologs of Drosophila tim. In contrast, Zylka et al. (1998) were unable to detect mouse Per-Tim interactions in yeast 2-hybrid assays. They found an array of interactions between the various mouse Per proteins, and suggested that Per-Per interactions have replaced the function of Per-Tim dimers in the molecular workings of the mammalian circadian clock.

Full details of the abovementioned studies are described in the following publications, the disclosure of which are hereby incorporated by reference:

Sangoram, A. M.; Saez, L.; Antoch, M. P.; Gekakis, N.; Staknis, D.; Whiteley, A.; Fruechte, E. M.; Vitaterna, M. H.; Shimomura, K.; King, D. P.; Young, M. W.; Weitz, C. J.; Takahashi, J. S.: Mammalian circadian autoregulatory loop: a timeless ortholog and mPer1 interact and negatively regulate CLOCK-BMAL1-induced transcription. Neuron 21:1101-1113, 1998; and Zylka, M. J.; Shearman, L. P.; Levine, J. D.; Jin, X.; Weaver, D. R.; Reppert, S. M.: Molecular analysis of mammalian timeless. Neuron 21:1115-1122, 1998.

Further studies establishing the function and utilities of TIMELESS are found in John Hopkins OMIM database record ID 603887, and in cited publications listed in Table 5, which are hereby incorporated by reference.

FIG. 8 further provides a conceptual description of a novel bioinformatically detected of the present invention, referred to here as Genomic Address Messenger 33 (GAM33), which modulates expression of respective target genes thereof, the function and utility of which target genes is known in the art.

GAM33 is a novel bioinformatically detected regulatory, non protein coding, micro RNA (miRNA) gene. The method by which GAM33 was detected is described hereinabove with reference to FIGS. 8-15.

GAM33 gene, herein designated GAM GENE, and GAM33 target gene, herein designated TARGET GENE, are human genes contained in the human genome.

GAM33 gene encodes a GAM33 precursor RNA, herein designated GAM PRECURSOR RNA. Similar to other miRNA genes, and unlike most ordinary genes, GAM33 precursor RNA does not encode a protein. A nucleotide sequence identical or highly similar to the nucleotide sequence of GAM33 precursor RNA is designated SEQ ID:77, and is provided hereinbelow with reference to the sequence listing part.

GAM33 precursor RNA folds onto itself, forming GAM33 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM33 precursor RNA folds onto itself, forming GAM33 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM33 precursor RNA, designated SEQ-ID:77, and a schematic representation of a predicted secondary folding of GAM33 folded precursor RNA are further described with reference to Table 2, hereby incorporated by reference.

An enzyme complex designated DICER COMPLEX, 'dices' the GAM33 folded precursor RNA into GAM33 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM33 RNA is designated SEQ ID:317, and is provided hereinbelow with references to the sequence listing part and Table 3, hereby incorporated by reference.

GAM33 target gene, herein designated TARGET GENE, encodes a corresponding messenger RNA, GAM33 target RNA, herein designated GAM TARGET RNA. GAM33 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM33 RNA, herein designated GAM RNA, binds complementarily to one or more target binding sites located in untranslated regions of GAM33 target RNA, herein designated GAM TARGET RNA. This complementary binding is due to the fact that the nucleotide sequence of GAM33 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM33 RNA may have a different number of target binding sites in untranslated regions of a GAM33 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM33 RNA, herein designated GAM RNA, to target binding sites on GAM33 target RNA, herein designated GAM TARGET RNA, such as BINDING SITE I, BINDING SITE II and BINDING SITE III, inhibits translation of GAM33target RNA into GAM33 target protein, herein designated GAM TARGET PROTEIN. GAM target protein is therefore outlined by a broken line.

It is appreciated that GAM33 target gene, herein designated TARGET GENE, in fact represents a plurality of GAM33 target genes. The mRNA of each one of this plurality of GAM33 target genes comprises one or more target binding sites, each having a nucleotide sequence which is at least partly complementary to GAM33 RNA, herein designated GAM RNA, and which when bound by GAM33 RNA causes inhibition of translation of respective one or more GAM33 target proteins.

It is further appreciated by one skilled in the art that the mode of translational inhibition illustrated by FIG. 8 with specific reference to translational inhibition exerted by GAM33 gene, herein designated GAM GENE, on one or more GAM33target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM33 correlate with, and may be deduced from, the identity of the target genes which GAM33 binds and inhibits, and the function of these target genes, as elaborated hereinbelow.

KIAA0940 (Accession NM_014912.1) is a GAM33 target gene, herein designated TARGET GENE. KIAA0940 BINDING SITE is a target binding site found in the 3' untranslated region of mRNA encoded by KIAA0940, corresponding to a target binding site such as BINDING SITE I, BINDING SITE II or BINDING SITE III of FIG. 8. Table 4 illustrates the complementarity of the nucleotide sequences of KIAA0940 BINDING SITE, designated SEQ ID:14036, to the nucleotide sequence of GAM33 RNA, herein designated GAM RNA, also designated SEQ ID:317.

A function of GAM33 is therefore inhibition of KIAA0940 (Accession NM_014912.1). Accordingly, utilities of GAM33 include diagnosis, prevention and treatment of diseases and clinical conditions associated with KIAA0940.

LOC133688 (Accession) is another GAM33 target gene, herein designated TARGET GENE. LOC133688 BINDING SITE is a target binding site found in the 3' untranslated region of mRNA encoded by LOC133688, corresponding to a target binding site such as BINDING SITE I, BINDING SITE II or BINDING SITE III of FIG. 8. Table 4 illustrates the complementarity of the nucleotide sequences of LOC133688 BINDING SITE, designated SEQ ID:18335, to the nucleotide sequence of GAM33 RNA, herein designated GAM RNA, also designated SEQ ID:317.

Another function of GAM33 is therefore inhibition of LOC133688 (Accession). Accordingly, utilities of GAM33 include diagnosis, prevention and treatment of diseases and clinical conditions associated with LOC133688.

LOC159199 (Accession) is another GAM33 target gene, herein designated TARGET GENE. LOC159199 BINDING SITE is a target binding site found in the 5' untranslated region of mRNA encoded by LOC159199, corresponding to a target binding site such as BINDING SITE I, BINDING SITE II or BINDING SITE III of FIG. 8. Table 4 illustrates the complementarity of the nucleotide sequences of LOC159199 BINDING SITE, designated SEQ ID:6634, to the nucleotide sequence of GAM33 RNA, herein designated GAM RNA, also designated SEQ ID:317.

Another function of GAM33 is therefore inhibition of LOC159199 (Accession). Accordingly, utilities of GAM33 include diagnosis, prevention and treatment of diseases and clinical conditions associated with LOC159199.

LOC205360 (Accession) is another GAM33 target gene, herein designated TARGET GENE. LOC205360 BINDING SITE is a target binding site found in the 5' untranslated region of mRNA encoded by LOC205360, corresponding to a target binding site such as BINDING SITE I, BINDING SITE II or BINDING SITE III of FIG. 8. Table 4 illustrates the complementarity of the nucleotide sequences of LOC205360 BINDING SITE, designated SEQ ID:17537, to the nucleotide sequence of GAM33 RNA, herein designated GAM RNA, also designated SEQ ID:317.

Another function of GAM33 is therefore inhibition of LOC205360 (Accession). Accordingly, utilities of GAM33 include diagnosis, prevention and treatment of diseases and clinical conditions associated with LOC205360.

FIG. 8 further provides a conceptual description of a novel bioinformatically detected of the present invention, referred to here as Genomic Address Messenger 34 (GAM34), which modulates expression of respective target genes thereof, the function and utility of which target genes is known in the art.

GAM34 is a novel bioinformatically detected regulatory, non protein coding, micro RNA (miRNA) gene. The method by which GAM34 was detected is described hereinabove with reference to FIGS. 8-15.

GAM34 gene, herein designated GAM GENE, and GAM34 target gene, herein designated TARGET GENE, are human genes contained in the human genome.

GAM34 gene encodes a GAM34 precursor RNA, herein designated GAM PRECURSOR RNA. Similar to other miRNA genes, and unlike most ordinary genes, GAM34 precursor RNA does not encode a protein. A nucleotide sequence identical or highly similar to the nucleotide sequence of GAM34 precursor RNA is designated SEQ ID:59, and is provided hereinbelow with reference to the sequence listing part.

GAM34 precursor RNA folds onto itself, forming GAM34 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM34 precursor RNA folds onto itself, forming GAM34 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM34 precursor RNA, designated SEQ-ID:59, and a schematic representation of a predicted secondary folding of GAM34 folded precursor RNA are further described with reference to Table 2, hereby incorporated by reference.

An enzyme complex designated DICER COMPLEX, 'dices' the GAM34 folded precursor RNA into GAM34 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM34 RNA is designated SEQ ID:314, and is provided hereinbelow with references to the sequence listing part and Table 3, hereby incorporated by reference.

GAM34 target gene, herein designated TARGET GENE, encodes a corresponding messenger RNA, GAM34 target RNA, herein designated GAM TARGET RNA. GAM34target RNA comprises three regions, as is typical of mRNA of a protein coding gene: a 5' untranslated region, a protein coding region and a 3' untranslated region, designated 5'UTR, PROTEIN CODING and 3'UTR respectively.

GAM34 RNA, herein designated GAM RNA, binds complementarily to one or more target binding sites located in untranslated regions of GAM34 target RNA, herein designated GAM TARGET RNA. This complementary binding is due to the fact that the nucleotide sequence of GAM34 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM34 RNA may have a different number of target binding sites in untranslated regions of a GAM34 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM34 RNA, herein designated GAM RNA, to target binding sites on GAM34 target RNA, herein designated GAM TARGET RNA, such as BINDING SITE I, BINDING SITE II and BINDING SITE III, inhibits translation of GAM34target RNA into GAM34 target protein, herein designated GAM TARGET PROTEIN. GAM target protein is therefore outlined by a broken line.

It is appreciated that GAM34 target gene, herein designated TARGET GENE, in fact represents a plurality of GAM34 target genes. The mRNA of each one of this plurality of GAM34 target genes comprises one or more target binding sites, each having a nucleotide sequence which is at least partly complementary to GAM34 RNA, herein designated GAM RNA, and which when bound by GAM34 RNA causes inhibition of translation of respective one or more GAM34 target proteins.

It is further appreciated by one skilled in the art that the mode of translational inhibition illustrated by FIG. 8 with specific reference to translational inhibition exerted by GAM34 gene, herein designated GAM GENE, on one or more GAM34target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM34 correlate with, and may be deduced from, the identity of the target genes which GAM34 binds and inhibits, and the function of these target genes, as elaborated hereinbelow.

DKFZP434C171 (Accession NM_015621.1) is a GAM34target gene, herein designated TARGET GENE. DKFZP434C171 BINDING SITE is a target binding site found in the 3' untranslated region of mRNA encoded by DKFZP434C171, corresponding to a target binding site such as BINDING SITE I, BINDING SITE II or BINDING SITE III of FIG. 8. Table 4 illustrates the complementarity of the nucleotide sequences of DKFZP434C171 BINDING SITE, designated SEQ ID:6705, to the nucleotide sequence of GAM34 RNA, herein designated GAM RNA, also designated SEQ ID:314.

A function of GAM34 is therefore inhibition of DKFZP434C171 (Accession NM_015621.1). Accordingly, utilities of GAM34 include diagnosis, prevention and treatment of diseases and clinical conditions associated with DKFZP434C171.

FLJ10583 (Accession) is another GAM34 target gene, herein designated TARGET GENE. FLJ10583 BINDING SITE is a target binding site found in the 3' untranslated region of mRNA encoded by FLJ10583, corresponding to a target binding site such as BINDING SITE I, BINDING SITE II or BINDING SITE III of FIG. 8. Table 4 illustrates the complementarity of the nucleotide sequences of FLJ10583 BINDING SITE, designated SEQ ID:13120, to the nucleotide sequence of GAM34 RNA, herein designated GAM RNA, also designated SEQ ID:314.

Another function of GAM34 is therefore inhibition of FLJ10583 (Accession). Accordingly, utilities of GAM34 include diagnosis, prevention and treatment of diseases and clinical conditions associated with FLJ10583.

FLJ12587 (Accession NM_022480.2) is another GAM34 target gene, herein designated TARGET GENE. FLJ12587 BINDING SITE is a target binding site found in the 3' untranslated region of mRNA encoded by FLJ12587, corresponding to a target binding site such as BINDING SITE I, BINDING SITE II or BINDING SITE III of FIG. 8. Table 4 illustrates the complementarity of the nucleotide sequences of FLJ12587 BINDING SITE, designated SEQ ID:11111, to the nucleotide sequence of GAM34 RNA, herein designated GAM RNA, also designated SEQ ID:314.

Another function of GAM34 is therefore inhibition of FLJ12587 (Accession NM_022480.2). Accordingly, utilities of GAM34 include diagnosis, prevention and treatment of diseases and clinical conditions associated with FLJ12587.

FLJ21841 (Accession NM_024609.1) is another GAM34 target gene, herein designated TARGET GENE. FLJ21841 BINDING SITE is a target binding site found in the 3' untranslated region of mRNA encoded by FLJ21841, corresponding to a target binding site such as BINDING SITE I, BINDING SITE II or BINDING SITE III of FIG. 8. Table 4 illustrates the complementarity of the nucleotide sequences of FLJ21841 BINDING SITE, designated SEQ ID:6943, to the nucleotide sequence of GAM34 RNA, herein designated GAM RNA, also designated SEQ ID:314.

Another function of GAM34 is therefore inhibition of FLJ21841 (Accession NM_024609.1). Accordingly, utilities of GAM34 include diagnosis, prevention and treatment of diseases and clinical conditions associated with FLJ21841.

FLJ22559 (Accession NM_024928.2) is another GAM34 target gene, herein designated TARGET GENE. FLJ22559 BINDING SITE is a target binding site found in the 3' untranslated region of mRNA encoded by FLJ22559, corresponding to a target binding site such as BINDING SITE I, BINDING SITE II or BINDING SITE III of FIG. 8. Table 4 illustrates the complementarity of the nucleotide sequences of FLJ22559 BINDING SITE, designated SEQ ID:12516, to the nucleotide sequence of GAM34 RNA, herein designated GAM RNA, also designated SEQ ID:314.

Another function of GAM34 is therefore inhibition of FLJ22559 (Accession NM_024928.2). Accordingly, utilities of GAM34 include diagnosis, prevention and treatment of diseases and clinical conditions associated with FLJ22559.

FLJ31762 (Accession) is another GAM34 target gene, herein designated TARGET GENE. FLJ31762 BINDING SITE is a target binding site found in the 3' untranslated region of mRNA encoded by FLJ31762, corresponding to a target binding site such as BINDING SITE I, BINDING SITE II or BINDING SITE III of FIG. 8. Table 4 illustrates the complementarity of the nucleotide sequences of FLJ31762 BINDING SITE, designated SEQ ID:6375, to the nucleotide sequence of GAM34 RNA, herein designated GAM RNA, also designated SEQ ID:314.

Another function of GAM34 is therefore inhibition of FLJ31762 (Accession). Accordingly, utilities of GAM34 include diagnosis, prevention and treatment of diseases and clinical conditions associated with FLJ31762.

KIAA0662 (Accession) is another GAM34 target gene, herein designated TARGET GENE. KIAA0662 BINDING SITE is a target binding site found in the 3' untranslated region of mRNA encoded by KIAA0662, corresponding to a target binding site such as BINDING SITE I, BINDING SITE II or BINDING SITE III of FIG. 8. Table 4 illustrates the complementarity of the nucleotide sequences of KIAA0662 BINDING SITE, designated SEQ ID:12553, to the nucleotide sequence of GAM34 RNA, herein designated GAM RNA, also designated SEQ ID:314.

Another function of GAM34 is therefore inhibition of KIAA0662 (Accession). Accordingly, utilities of GAM34 include diagnosis, prevention and treatment of diseases and clinical conditions associated with KIAA0662.

LOC144317 (Accession XM_084813.4) is another GAM34 target gene, herein designated TARGET GENE. LOC144317 BINDING SITE is a target binding site found in the 5' untranslated region of mRNA encoded by LOC144317, corresponding to a target binding site such as BINDING SITE I, BINDING SITE II or BINDING SITE III of FIG. 8. Table 4 illustrates the complementarity of the nucleotide sequences of LOC144317 BINDING SITE, designated SEQ ID:5515, to the nucleotide sequence of GAM34 RNA, herein designated GAM RNA, also designated SEQ ID:314.

Another function of GAM34 is therefore inhibition of LOC144317 (Accession XM_084813.4). Accordingly, utilities of GAM34 include diagnosis, prevention and treatment of diseases and clinical conditions associated with LOC144317.

LOC148166 (Accession XM_086077.1) is another GAM34 target gene, herein designated TARGET GENE. LOC148166 BINDING SITE is a target binding site found in the 5' untranslated region of mRNA encoded by LOC148166, corresponding to a target binding site such as BINDING SITE I, BINDING SITE II or BINDING SITE III of FIG. 8. Table 4 illustrates the complementarity of the nucleotide sequences of LOC148166 BINDING SITE, designated SEQ ID:2036, to the nucleotide sequence of GAM34 RNA, herein designated GAM RNA, also designated SEQ ID:314.

Another function of GAM34 is therefore inhibition of LOC148166 (Accession XM_086077.1). Accordingly, utilities of GAM34 include diagnosis, prevention and treatment of diseases and clinical conditions associated with LOC148166.

LOC149134 (Accession XM_097594.1) is another GAM34 target gene, herein designated TARGET GENE. LOC149134 BINDING SITE is a target binding site found in the 5' untranslated region of mRNA encoded by LOC149134, corresponding to a target binding site such as BINDING SITE I, BINDING SITE II or BINDING SITE III of FIG. 8. Table 4 illustrates the complementarity of the nucleotide sequences of LOC149134 BINDING SITE, designated SEQ ID:2210, to the nucleotide sequence of GAM34 RNA, herein designated GAM RNA, also designated SEQ ID:314.

Another function of GAM34 is therefore inhibition of LOC149134 (Accession XM_097594.1). Accordingly, utilities of GAM34 include diagnosis, prevention and treatment of diseases and clinical conditions associated with LOC149134.

LOC169611 (Accession XM_095809.4) is another GAM34 target gene, herein designated TARGET GENE. LOC169611 BINDING SITE is a target binding site found in the 3' untranslated region of mRNA encoded by LOC169611, corresponding to a target binding site such as BINDING SITE I, BINDING SITE II or BINDING SITE III of FIG. 8. Table 4 illustrates the complementarity of the nucleotide sequences of LOC169611 BINDING SITE, designated SEQ ID:7929, to the nucleotide sequence of GAM34 RNA, herein designated GAM RNA, also designated SEQ ID:314.

Another function of GAM34 is therefore inhibition of LOC169611 (Accession XM_095809.4). Accordingly, utilities of GAM34 include diagnosis, prevention and treatment of diseases and clinical conditions associated with LOC169611.

Nerve growth factor, beta polypeptide (NGFB, Accession NM_002506.1) is another GAM34 target gene, herein designated TARGET GENE. NGFB BINDING SITE is a target binding site found in the 5' untranslated region of mRNA encoded by NGFB, corresponding to a target binding site such as BINDING SITE I, BINDING SITE II or BINDING SITE III of FIG. 8. Table 4 illustrates the complementarity of the nucleotide sequences of NGFB BINDING SITE, designated SEQ ID:7978, to the nucleotide sequence of GAM34 RNA, herein designated GAM RNA, also designated SEQ ID:314.

Another function of GAM34 is therefore inhibition of Nerve growth factor, beta polypeptide (NGFB, Accession NM_002506.1), a gene which is important for the development and maintenance of the sympathetic and sensory nervous systems. Accordingly, utilities of GAM34 include diagnosis, prevention and treatment of diseases and clinical conditions associated with NGFB.

The function of NGFB has been established by previous studies. Nerve growth factor is a polypeptide involved in the regulation of growth and differentiation of sympathetic and certain sensory neurons. (See review by Levi-Montalcini, 1987.) Ullrich et al. (1983) showed that the nucleotide sequence of human and mouse beta-NGF are very similar. NGF consists of 3 types of subunits, alpha, beta and gamma, which specifically interact to form a 7S, 130,000-molecular weight complex. This complex contains 2 identical 118-amino acid beta-chains, which are solely responsible for nerve growth stimulating activity of NGF. Human DNA fragments coding for NGF were identified by Zabel et al. (1984) using a mouse submaxillary cDNA probe. In somatic cell hybrid studies they found that the human HindIII DNA fragments for NGF, as demonstrated in Southern blots, cosegregated with chromosome 1. Using a cell line with a 1;2 translocation, they narrowed the assignment to 1p21-pter. This is the same area as that implicated cytogenetically in neuroblastoma (1p32-pter) and the segment containing a neuroblastoma-related RAS oncogene. Furthermore, abnormality of NGF had been suspected, with some supporting evidence, in familial dysautonomia (OMIM Ref. No. 223900) and in 2 forms of neurofibromatosis (101000, 162200). The use of the 'candidate gene' approach to mapping disease and determining its cause is illustrated by the work of Breakefield et al. (1984). Using a cloned genomic probe for human beta-NGF, they identified RFLPs in the beta-NGF gene, and in 4 informative families with 2 children with familial dysautonomia found 'no consistent co-inheritance of specific alleles with the disease.' Thus, they appear to have excluded a defect in or near the structural gene for beta-NGF as the cause of familial dysautonomia. Using 2 RFLPs related to the beta-NGF gene, Darby et al. (1985) could exclude this gene as the site of the mutation in 4 families with neurofibromatosis of the classic type (OMIM Ref. No. 162200). Using fragments of a cloned human gene for the beta subunit of nerve growth factor as hybridization probes in somatic cell hybrid studies, Francke et al. (1983) mapped the NGFB locus to 1p22. Oncogene NRAS (OMIM Ref. No. 164790) maps to the same band. Both nerve growth factor and epidermal growth factor (OMIM Ref. No. 131530) are on mouse chromosome 3; in man they are on different chromosomes (Zabel et al., 1985). Both factors are present in unusually high levels in male mouse submaxillary glands and both show similarities in temporal activation during development and androgen regulation. There is no known structural homology between them, however. Arguing from comparative mapping data, Zabel et al. (1985) suggested that the NGFB locus is localized in the p22.1 to distal p21 region of chromosome 1. The distal part of human 1p shows conserved homology with mouse chromosome 4. The region of homology includes the genes ENO1, PGD, GDH, AK2, and PGM1. The conserved segment extends to PGM1 (homologous to mouse Pgm-2), which is localized to human 1p22.1. From about 1p22.1 toward the centromere, there is a region of homology to mouse chromosome 3. This region contains AMY1 and AMY2 in mouse and man and NGF in the mouse. AMY is mapped to human 1p21. Using a method for improved resolution of in situ hybridization, Middleton-Price et al. (1987) concluded that NGFB is located within band 1p13. This explains the apparently anomalous linkage data between NGFB and PGM1, both of which had previously been assigned to 1p22.1 but showed no positive linkage. Garson et al. (1987) confirmed the assignment of NGFB to 1p13. The confusion has, however, not been completely dispelled. According to Dracopoli (1988), NGFB is telomeric to TSHB (OMIM Ref. No. 188540). The 2 loci are in the same 100-kb PFGE fragment, show virtually no recombination (lod =43 at theta =0.0), and are antithetically regulated by thyroid hormone (Dracopoli et al., 1988), yet TSHB has been mapped to 1p22. Dracopoli and Meisler (1990) concluded from linkage analysis and pulsed field gel electrophoresis that TSHB, NGFB, and NRAS form a tightly linked gene cluster located in the same chromosomal band. Their location proximal to the AMY2B gene in 1p21 and close linkage to the alpha-satellite centromeric repeat D1Z5 provided strong evidence that the correct assignment for these 3 loci is 1p13 and not 1p22. By fluorescence in situ hybridization, Mitchell et al. (1995) mapped NGFB to 1p13.1.

Full details of the abovementioned studies are described in the following publications, the disclosure of which are hereby incorporated by reference:

Ullrich, A.; Gray, A.; Berman, C.; Dull, T. J.: Human beta-nerve growth factor gene sequence highly homologous to that of mouse. Nature 303:821-825, 1983; and Zabel, B. U.; Eddy, R. L.; Lalley, P. A.; Scott, J.; Bell, G. I.; Shows, T. B.: Chromosomal locations of the human and mouse genes for precursors of epidermal growth factor and the b.

Further studies establishing the function and utilities of NGFB are found in John Hopkins OMIM database record ID 162030, and in cited publications listed in Table 5, which are hereby incorporated by reference. Rad50 homolog (s. cerevisiae) (RAD50, Accession NM_005732.2) is another GAM34target gene, herein designated TARGET GENE. RAD50 BINDING SITE is a target binding site found in the 3' untranslated region of multiple transcripts of mRNA encoded by RAD50, corresponding to a target binding site such as BINDING SITE I, BINDING SITE II or BINDING SITE III of FIG. 8. Table 4 illustrates the complementarity of the nucleotide sequences of RAD50 BINDING SITE, designated SEQ ID:15035, to the nucleotide sequence of GAM34 RNA, herein designated GAM RNA, also designated SEQ ID:314.

Another function of GAM34 is therefore inhibition of Rad50 homolog (s. cerevisiae) (RAD50, Accession NM_005732.2), a gene which is involved in dna double-strand break repair (dsbr). and therefore may be associated with Myeloid leukemia and breast cancer. Accordingly, utilities of GAM34 include diagnosis, prevention and treatment of Myeloid leukemia and breast cancer, and of other diseases and clinical conditions associated with RAD50.

The function of RAD50 has been established by previous studies. The S. cerevisiae Rad50 gene encodes a protein that is essential for double-stranded DNA break repair by nonhomologous DNA end joining and chromosomal integration. The yeast Rad50, Mre11 (OMIM Ref. No. 600814), and Xrs2 proteins appear to act in a multiprotein complex, consistent with the observation that mutations in these genes confer nearly identical phenotypes of no meiotic recombination and elevated rates of homologous mitotic recombination. By direct selection of cDNAs from the 5q23-q31 chromosomal interval, Dolganov et al. (1996) isolated a cDNA encoding a human Rad50 homolog. The human RAD50 gene spans 100 to 130 kb. Northern blot analysis revealed that the RAD50 gene was expressed as a 5.5-kb mRNA predominantly in testis. A faint 7-kb transcript, which the authors considered to be an mRNA with an alternatively processed 3-prime end, was also detected. Yeast Rad50 and the predicted 1,312-amino acid human RAD50 protein share more than 50% identity in their N- and C-termini. The central heptad repeat domains of the proteins have relatively divergent primary sequences but are predicted to adopt very similar coiled-coil structures. Using immunoprecipitation, Dolganov et al. (1996) demonstrated that the 153-kD RAD50 is stably associated with MRE11 in a protein complex, which may also include proteins of 95 kD, 200 kD, and 350 kD. By inclusion within mapped clones and by analysis of somatic cell hybrids, Dolganov et al. (1996) mapped the RAD50 gene to 5q31. They suggested that a recombinational DNA repair deficiency may be associated with the development of myeloid leukemia, since this chromosomal region is frequently altered in acute myeloid leukemia and myelodysplastic disease.

Full details of the abovementioned studies are described in the following publications, the disclosure of which are hereby incorporated by reference:

Dolganov, G. M.; Maser, R. S.; Novikov, A.; Tosto, L.; Chong, S.; Bressan, D. A.; Petrini, J. H. J.: Human Rad50 is physically associated with human Mre11: identification of a conserved multiprotein complex implicated in recombinational DNA repair. Molec. Cell Biol. 16:4832-4841, 1996; and Hopfner, K.-P.; Craig, L.; Moncalian, G.; Zinkel, R. A.; Usui, T.; Owen, B. A. L.; Karcher, A.; Henderson, B.; Bodmer, J.-L.; McMurray, C. T.; Carney, J. P.; Petrini, J. H. J.; Tainer.

Further studies establishing the function and utilities of RAD50 are found in John Hopkins OMIM database record ID 604040, and in cited publications listed in Table 5, which are hereby incorporated by reference. Ribonuclease, rnase a family, 4 (RNASE4, Accession NM_002937.2) is another GAM34 target gene, herein designated TARGET GENE. RNASE4 BINDING SITE is a target binding site found in the 3' untranslated region of mRNA encoded by RNASE4, corresponding to a target binding site such as BINDING SITE I, BINDING SITE II or BINDING SITE III of FIG. 8. Table 4 illustrates the complementarity of the nucleotide sequences of RNASE4 BINDING SITE, designated SEQ ID:1775, to the nucleotide sequence of GAM34 RNA, herein designated GAM RNA, also designated SEQ ID:314.

Another function of GAM34 is therefore inhibition of Ribonuclease, rnase a family, 4 (RNASE4, Accession NM_002937.2). Accordingly, utilities of GAM34 include diagnosis, prevention and treatment of diseases and clinical conditions associated with RNASE4.

FIG. 8 further provides a conceptual description of a novel bioinformatically detected of the present invention, referred to here as Genomic Address Messenger 35 (GAM35), which modulates expression of respective target genes thereof, the function and utility of which target genes is known in the art.

GAM35 is a novel bioinformatically detected regulatory, non protein coding, micro RNA (miRNA) gene. The method by which GAM35 was detected is described hereinabove with reference to FIGS. 8-15.

GAM35 gene, herein designated GAM GENE, and GAM35 target gene, herein designated TARGET GENE, are human genes contained in the human genome.

GAM35 gene encodes a GAM35 precursor RNA, herein designated GAM PRECURSOR RNA. Similar to other miRNA genes, and unlike most ordinary genes, GAM35 precursor RNA does not encode a protein. A nucleotide sequence identical or highly similar to the nucleotide sequence of GAM35 precursor RNA is designated SEQ ID:101, and is provided hereinbelow with reference to the sequence listing part.

GAM35 precursor RNA folds onto itself, forming GAM35 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM35 precursor RNA folds onto itself, forming GAM35 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM35 precursor RNA, designated SEQ-ID:101, and a schematic representation of a predicted secondary folding of GAM35 folded precursor RNA are further described with reference to Table 2, hereby incorporated by reference.

An enzyme complex designated DICER COMPLEX, 'dices' the GAM35 folded precursor RNA into GAM35 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM35 RNA is designated SEQ ID:247, and is provided hereinbelow with references to the sequence listing part and Table 3, hereby incorporated by reference.

GAM35 target gene, herein designated TARGET GENE, encodes a corresponding messenger RNA, GAM35 target RNA, herein designated GAM TARGET RNA. GAM35target RNA comprises three regions, as is typical of mRNA of a protein coding gene: a 5' untranslated region, a protein coding region and a 3' untranslated region, designated 5'UTR, PROTEIN CODING and 3'UTR respectively.

GAM35 RNA, herein designated GAM RNA, binds complementarily to one or more target binding sites located in untranslated regions of GAM35 target RNA, herein designated GAM TARGET RNA. This complementary binding is due to the fact that the nucleotide sequence of GAM35 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM35 RNA may have a different number of target binding sites in untranslated regions of a GAM35 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM35 RNA, herein designated GAM RNA, to target binding sites on GAM35 target RNA, herein designated GAM TARGET RNA, such as BINDING SITE I, BINDING SITE II and BINDING SITE III, inhibits translation of GAM35target RNA into GAM35 target protein, herein designated GAM TARGET PROTEIN. GAM target protein is therefore outlined by a broken line.

It is appreciated that GAM35 target gene, herein designated TARGET GENE, in fact represents a plurality of GAM35 target genes. The mRNA of each one of this plurality of GAM35 target genes comprises one or more target binding sites, each having a nucleotide sequence which is at least partly complementary to GAM35 RNA, herein designated GAM RNA, and which when bound by GAM35 RNA causes inhibition of translation of respective one or more GAM35 target proteins.

It is further appreciated by one skilled in the art that the mode of translational inhibition illustrated by FIG. 8 with specific reference to translational inhibition exerted by GAM35 gene, herein designated GAM GENE, on one or more GAM35target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM35 correlate with, and may be deduced from, the identity of the target genes which GAM35 binds and inhibits, and the function of these target genes, as elaborated hereinbelow.

LOC144558 (Accession) is a GAM35 target gene, herein designated TARGET GENE. LOC144558 BINDING SITE is a target binding site found in the 3' untranslated region of mRNA encoded by LOC144558, corresponding to a target binding site such as BINDING SITE I, BINDING SITE II or BINDING SITE III of FIG. 8. Table 4 illustrates the complementarity of the nucleotide sequences of LOC144558 BINDING SITE, designated SEQ ID:14499, to the nucleotide sequence of GAM35 RNA, herein designated GAM RNA, also designated SEQ ID:247.

A function of GAM35 is therefore inhibition of LOC144558 (Accession). Accordingly, utilities of GAM35 include diagnosis, prevention and treatment of diseases and clinical conditions associated with LOC144558.

LOC144871 (Accession XM_096698.4) is another GAM35 target gene, herein designated TARGET GENE. LOC144871 BINDING SITE is a target binding site found in the 3' untranslated region of mRNA encoded by LOC144871, corresponding to a target binding site such as BINDING SITE I, BINDING SITE II or BINDING SITE III of FIG. 8. Table 4 illustrates the complementarity of the nucleotide sequences of LOC144871 BINDING SITE, designated SEQ ID:6700, to the nucleotide sequence of GAM35 RNA, herein designated GAM RNA, also designated SEQ ID:247.

Another function of GAM35 is therefore inhibition of LOC144871 (Accession XM_096698.4). Accordingly, utilities of GAM35 include diagnosis, prevention and treatment of diseases and clinical conditions associated with LOC144871.

LOC51652 (Accession) is another GAM35 target gene, herein designated TARGET GENE. LOC51652 BINDING SITE is a target binding site found in the 3' untranslated region of mRNA encoded by LOC51652, corresponding to a target binding site such as BINDING SITE I, BINDING SITE II or BINDING SITE III of FIG. 8. Table 4 illustrates the complementarity of the nucleotide sequences of LOC51652 BINDING SITE, designated SEQ ID:17491, to the nucleotide sequence of GAM35 RNA, herein designated GAM RNA, also designated SEQ ID:247.

Another function of GAM35 is therefore inhibition of LOC51652 (Accession). Accordingly, utilities of GAM35 include diagnosis, prevention and treatment of diseases and clinical conditions associated with LOC51652.

My015 (Accession) is another GAM35 target gene, herein designated TARGET GENE. My015 BINDING SITE is a target binding site found in the 3' untranslated region of mRNA encoded by My015, corresponding to a target binding site such as BINDING SITE I, BINDING SITE II or BINDING SITE III of FIG. 8. Table 4 illustrates the complementarity of the nucleotide sequences of My015 BINDING SITE, designated SEQ ID:12036, to the nucleotide sequence of GAM35 RNA, herein designated GAM RNA, also designated SEQ ID:247.

Another function of GAM35 is therefore inhibition of My015 (Accession). Accordingly, utilities of GAM35 include diagnosis, prevention and treatment of diseases and clinical conditions associated with My015.

FIG. 8 further provides a conceptual description of a novel bioinformatically detected of the present invention, referred to here as Genomic Address Messenger 36 (GAM36), which modulates expression of respective target genes thereof, the function and utility of which target genes is known in the art.

GAM36 is a novel bioinformatically detected regulatory, non protein coding, micro RNA (miRNA) gene. The method by which GAM36 was detected is described hereinabove with reference to FIGS. 8-15.

GAM36 gene, herein designated GAM GENE, and GAM36 target gene, herein designated TARGET GENE, are human genes contained in the human genome.

GAM36 gene encodes a GAM36 precursor RNA, herein designated GAM PRECURSOR RNA. Similar to other miRNA genes, and unlike most ordinary genes, GAM36 precursor RNA does not encode a protein. A nucleotide sequence identical or highly similar to the nucleotide sequence of GAM36 precursor RNA is designated SEQ ID:149, and is provided hereinbelow with reference to the sequence listing part.

GAM36 precursor RNA folds onto itself, forming GAM36 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM36 precursor RNA folds onto itself, forming GAM36 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM36 precursor RNA, designated SEQ-ID:149, and a schematic representation of a predicted secondary folding of GAM36 folded precursor RNA are further described with reference to Table 2, hereby incorporated by reference.

An enzyme complex designated DICER COMPLEX, 'dices' the GAM36 folded precursor RNA into GAM36 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM36 RNA is designated SEQ ID:351, and is provided hereinbelow with references to the sequence listing part and Table 3, hereby incorporated by reference.

GAM36 target gene, herein designated TARGET GENE, encodes a corresponding messenger RNA, GAM36 target RNA, herein designated GAM TARGET RNA. GAM36target RNA comprises three regions, as is typical of mRNA of a protein coding gene: a 5' untranslated region, a protein coding region and a 3' untranslated region, designated 5'UTR, PROTEIN CODING and 3'UTR respectively.

GAM36 RNA, herein designated GAM RNA, binds complementarily to one or more target binding sites located in untranslated regions of GAM36 target RNA, herein designated GAM TARGET RNA. This complementary binding is due to the fact that the nucleotide sequence of GAM36 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM36 RNA may have a different number of target binding sites in untranslated regions of a GAM36 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM36 RNA, herein designated GAM RNA, to target binding sites on GAM36 target RNA, herein designated GAM TARGET RNA, such as BINDING SITE I, BINDING SITE II and BINDING SITE III, inhibits translation of GAM36target RNA into GAM36 target protein, herein designated GAM TARGET PROTEIN. GAM target protein is therefore outlined by a broken line.

It is appreciated that GAM36 target gene, herein designated TARGET GENE, in fact represents a plurality of GAM36 target genes. The mRNA of each one of this plurality of GAM36 target genes comprises one or more target binding sites, each having a nucleotide sequence which is at least partly complementary to GAM36 RNA, herein designated GAM RNA, and which when bound by GAM36 RNA causes inhibition of translation of respective one or more GAM36 target proteins.

It is further appreciated by one skilled in the art that the mode of translational inhibition illustrated by FIG. 8 with specific reference to translational inhibition exerted by GAM36 gene, herein designated GAM GENE, on one or more GAM36target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM36 correlate with, and may be deduced from, the identity of the target genes which GAM36 binds and inhibits, and the function of these target genes, as elaborated hereinbelow.

CIS4 (Accession) is a GAM36 target gene, herein designated TARGET GENE. CIS4 BINDING SITE is a target binding site found in the 5' untranslated region of mRNA encoded by CIS4, corresponding to a target binding site such as BINDING SITE I, BINDING SITE II or BINDING SITE III of FIG. 8. Table 4 illustrates the complementarity of the nucleotide sequences of CIS4 BINDING SITE, designated SEQ ID:11967, to the nucleotide sequence of GAM36 RNA, herein designated GAM RNA, also designated SEQ ID:351.

A function of GAM36 is therefore inhibition of CIS4 (Accession). Accordingly, utilities of GAM36 include diagnosis, prevention and treatment of diseases and clinical conditions associated with CIS4.

Fibroblast growth factor 2 (basic) (FGF2, Accession NM_002006.2) is another GAM36 target gene, herein designated TARGET GENE. FGF2 BINDING SITE is a target binding site found in the 3' untranslated region of mRNA encoded by FGF2, corresponding to a target binding site such as BINDING SITE I, BINDING SITE II or BINDING SITE III of FIG. 8. Table 4 illustrates the complementarity of the nucleotide sequences of FGF2 BINDING SITE, designated SEQ ID:14146, to the nucleotide sequence of GAM36 RNA, herein designated GAM RNA, also designated SEQ ID:351.

Another function of GAM36 is therefore inhibition of Fibroblast growth factor 2 (basic) (FGF2, Accession NM_002006.2), a gene which the Basic fibroblast growth factor 2; is mitogenic, angiogenic, and neurotrophic factor. Accordingly, utilities of GAM36 include diagnosis, prevention and treatment of diseases and clinical conditions associated with FGF2.

The function of FGF2 has been established by previous studies. See fibroblast growth factor-12 (FGF12; 601513). By Southern blot hybridization of genomic DNA from rodent/human hybrid cell lines carrying individual human chromosomes, Smallwood et al. (1996) mapped the FHF2 gene (also symbolized FGF13) to the X chromosome. By using an interspecific backcross mapping panel, they demonstrated that the mouse gene, Fhf2, shows no recombination with the gene for CD40 antigen ligand (OMIM Ref. No. 300386). Thus the human gene is probably located at Xq26. By use of isotopic in situ hybridization, Lovec et al. (1997) assigned the FHF2 gene to Xq21. Gecz et al. (1999), however, provided evidence that the FHF2 gene is located in Xq26.3. They identified a male patient with features of Borjeson-Forssman-Lehmann syndrome (BFLS; 301900) and a duplication of the Xq26-q28 region. By FISH using YAC clones from Xq26, they localized the duplication breakpoint to an interval of approximately 400 kb in the Xq26.3 region between DXS155 and DXS294/DXS730. Database searches and an analysis of available genomic sequence from the region showed that the FHF2 gene is located within the duplication breakpoint interval. Gecz et al. (1999) determined the structure of the FHF2 gene and identified 2 new exons, including a new 5- prime end exon, designated 1B. FHF2 is a large gene, extending over approximately 200 kb in Xq26.3, and contains at least 7 exons. It shows tissue-specific alternative splicing and alternative transcription starts. Northern blot hybridization showed highest expression in brain and skeletal muscle. The localization and tissue-specific expression pattern of FHF2 made it a possible candidate gene for familial cases of BFLS and for other syndromal and nonspecific forms of X-linked mental retardation mapping to that region.

Animal model experiments lend further support to the function of FGF2.

It is appreciated that the abovementioned animal model for FGF2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gecz, J.; Baker, E.; Donnelly, A.; Ming, J. E.; McDonald-McGinn, D. M.; Spinner, N. B.; Zackai, E. H.; Sutherland, G. R.; Mulley, J. C.: Fibroblast growth factor homologous factor 2 (FHF2): gene structure, expression and mapping to the Borjeson-Forssman-Lehmann syndrome region in Xq26 delineated by a duplication breakpoint in a BFLS-like patient. Hum. Genet. 104:56-63, 1999; and Lovec, H.; Hartung, H.; Verdier, A.-S.; Mattei, M.-G.; Birnbaum, D.; Goldfarb, M.; Coulier, F.: Assignment of FGF13 to human chromosome band Xq21 by in situ hybridization. Cytogenet.

Further studies establishing the function and utilities of FGF2 are found in John Hopkins OMIM database record ID 134920, and in cited publications listed in Table 5, which are hereby incorporated by reference. LOC147837 (Accession NM_145276.1) is another GAM36 target gene, herein designated TARGET GENE. LOC147837 BINDING SITE is a target binding site found in the 3' untranslated region of mRNA encoded by LOC147837, corresponding to a target binding site such as BINDING SITE I, BINDING SITE II or BINDING SITE III of FIG. 8. Table 4 illustrates the complementarity of the nucleotide sequences of LOC147837 BINDING SITE, designated SEQ ID:13329, to the nucleotide sequence of GAM36 RNA, herein designated GAM RNA, also designated SEQ ID:351.

Another function of GAM36 is therefore inhibition of LOC147837 (Accession NM_145276.1). Accordingly, utilities of GAM36 include diagnosis, prevention and treatment of diseases and clinical conditions associated with LOC147837.

Latrophilin 1 (LPHH1, Accession NM_012302.1) is another GAM36 target gene, herein designated TARGET GENE. LPHH1 BINDING SITE is a target binding site found in the 3' untranslated region of mRNA encoded by LPHH1, corresponding to a target binding site such as BINDING SITE I, BINDING SITE II or BINDING SITE III of FIG. 8. Table 4 illustrates the complementarity of the nucleotide sequences of LPHH1 BINDING SITE, designated SEQ ID:8148, to the nucleotide sequence of GAM36 RNA, herein designated GAM RNA, also designated SEQ ID:351.

Another function of GAM36 is therefore inhibition of Latrophilin 1 (LPHH1, Accession NM_012302.1), a gene which probably involved in cell adhesion within tissues and receptor signalling and therefore may be associated with Cancer. Accordingly, utilities of GAM36 include diagnosis, prevention and treatment of Cancer, and of other diseases and clinical conditions associated with LPHH1.

The function of LPHH1 has been established by previous studies. In a study of breast tumor samples, Hoggard et al. (1995) reported a region, 1p31.1, with a high frequency of loss of heterozygosity (LOH). In order to identify candidate sequences, mutation of which might contribute to the development of breast cancer, White et al. (1998) carried out mapping studies of ESTs localized to 1p31.1. They identified and characterized a novel gene, LPHH1 (latrophilin homolog- 1), located adjacent to the smallest region of overlapping loss seen in tumors. The 4,209-bp open reading frame of the 7-kb LPHH1 transcript encoded a peptide that showed approximately 65% identity to rat latrophilin, a G-coupled, 7-span transmembrane protein that binds alpha-latrotoxin. Surprisingly, while expression of the rat gene was strictly restricted to neurologic and perhaps some endocrine cells, the human sequence appeared to be expressed very widely in all normal tissues tested. The range of transcripts encoded in a breast tumor cell line, compared to normal breast, suggested that gene product variability was higher in the tumor Full details of the abovementioned studies are described in the following publications, the disclosure of which are hereby incorporated by reference:

Hoggard, N.; Brintell, B.; Howell, A.; Weissenbach, J.; Varley, J.: Allelic imbalance on chromosome 1 in human breast cancer. II. Microsatellite repeat analysis. Genes Chromosomes Cancer 12:24-31, 1995; and White, G. R. M.; Varley, J. M.; Heighway, J.: Isolation and characterization of a human homologue of the latrophilin gene from a region of 1p31.1 implicated in breast cancer. Oncogene 17.

Further studies establishing the function and utilities of LPHH1 are found in John Hopkins OMIM database record ID 607018, and in cited publications listed in Table 5, which are hereby incorporated by reference. Oxysterol binding protein-like 10 (OSBPL10, Accession NM_017784.3) is another GAM36 target gene, herein designated TARGET GENE. OSBPL10 BINDING SITE is a target binding site found in the 3' untranslated region of mRNA encoded by OSBPL10, corresponding to a target binding site such as BINDING SITE I, BINDING SITE II or BINDING SITE III of FIG. 8. Table 4 illustrates the complementarity of the nucleotide sequences of OSBPL10 BINDING SITE, designated SEQ ID:19783, to the nucleotide sequence of GAM36 RNA, herein designated GAM RNA, also designated SEQ ID:351.

Another function of GAM36 is therefore inhibition of Oxysterol binding protein-like 10 (OSBPL10, Accession NM_017784.3). Accordingly, utilities of GAM36 include diagnosis, prevention and treatment of diseases and clinical conditions associated with OSBPL10.

Reticulon 4 interacting protein 1 (RTN4IP1, Accession NM_032730.1) is another GAM36 target gene, herein designated TARGET GENE. RTN4IP1 BINDING SITE is a target binding site found in the 5' untranslated region of mRNA encoded by RTN4IP1, corresponding to a target binding site such as BINDING SITE I, BINDING SITE II or BINDING SITE III of FIG. 8. Table 4 illustrates the complementarity of the nucleotide sequences of RTN4IP1 BINDING SITE, designated SEQ ID:14226, to the nucleotide sequence of GAM36 RNA, herein designated GAM RNA, also designated SEQ ID:351.

Another function of GAM36 is therefore inhibition of Reticulon 4 interacting protein 1 (RTN4IP1, Accession NM_032730.1). Accordingly, utilities of GAM36 include diagnosis, prevention and treatment of diseases and clinical conditions associated with RTN4IP1.

FIG. 8 further provides a conceptual description of a novel bioinformatically detected of the present invention, referred to here as Genomic Address Messenger 37 (GAM37), which modulates expression of respective target genes thereof, the function and utility of which target genes is known in the art.

GAM37 is a novel bioinformatically detected regulatory, non protein coding, micro RNA (miRNA) gene. The method by which GAM37 was detected is described hereinabove with reference to FIGS. 8-15.

GAM37 gene, herein designated GAM GENE, and GAM37 target gene, herein designated TARGET GENE, are human genes contained in the human genome.

GAM37 gene encodes a GAM37 precursor RNA, herein designated GAM PRECURSOR RNA. Similar to other miRNA genes, and unlike most ordinary genes, GAM37 precursor RNA does not encode a protein. A nucleotide sequence identical or highly similar to the nucleotide sequence of GAM37 precursor RNA is designated SEQ ID:197, and is provided hereinbelow with reference to the sequence listing part.

GAM37 precursor RNA folds onto itself, forming GAM37 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM37 precursor RNA folds onto itself, forming GAM37 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM37 precursor RNA, designated SEQ-ID:197, and a schematic representation of a predicted secondary folding of GAM37 folded precursor RNA are further described with reference to Table 2, hereby incorporated by reference.

An enzyme complex designated DICER COMPLEX, 'dices' the GAM37 folded precursor RNA into GAM37 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM37 RNA is designated SEQ ID:266, and is provided hereinbelow with references to the sequence listing part and Table 3, hereby incorporated by reference.

GAM37 target gene, herein designated TARGET GENE, encodes a corresponding messenger RNA, GAM37 target RNA, herein designated GAM TARGET RNA. GAM37target RNA comprises three regions, as is typical of mRNA of a protein coding gene: a 5' untranslated region, a protein coding region and a 3' untranslated region, designated 5'UTR, PROTEIN CODING and 3'UTR respectively.

GAM37 RNA, herein designated GAM RNA, binds complementarily to one or more target binding sites located in untranslated regions of GAM37 target RNA, herein designated GAM TARGET RNA. This complementary binding is due to the fact that the nucleotide sequence of GAM37 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM37 RNA may have a different number of target binding sites in untranslated regions of a GAM37 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM37 RNA, herein designated GAM RNA, to target binding sites on GAM37 target RNA, herein designated GAM TARGET RNA, such as BINDING SITE I, BINDING SITE II and BINDING SITE III, inhibits translation of GAM37target RNA into GAM37 target protein, herein designated GAM TARGET PROTEIN. GAM target protein is therefore outlined by a broken line.

It is appreciated that GAM37 target gene, herein designated TARGET GENE, in fact represents a plurality of GAM37 target genes. The mRNA of each one of this plurality of GAM37 target genes comprises one or more target binding sites, each having a nucleotide sequence which is at least partly complementary to GAM37 RNA, herein designated GAM RNA, and which when bound by GAM37 RNA causes inhibition of translation of respective one or more GAM37 target proteins.

It is further appreciated by one skilled in the art that the mode of translational inhibition illustrated by FIG. 8 with specific reference to translational inhibition exerted by GAM37 gene, herein designated GAM GENE, on one or more GAM37target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM37 correlate with, and may be deduced from, the identity of the target genes which GAM37 binds and inhibits, and the function of these target genes, as elaborated hereinbelow.

Clock homolog (mouse) (CLOCK, Accession NM_004898.2) is a GAM37target gene, herein designated TARGET GENE. CLOCK BINDING SITE is a target binding site found in the 3' untranslated region of mRNA encoded by CLOCK, corresponding to a target binding site such as BINDING SITE I, BINDING SITE II or BINDING SITE III of FIG. 8. Table 4 illustrates the complementarity of the nucleotide sequences of CLOCK BINDING SITE, designated SEQ ID:9594, to the nucleotide sequence of GAM37 RNA, herein designated GAM RNA, also designated SEQ ID:266.

A function of GAM37 is therefore inhibition of Clock homolog (mouse) (CLOCK, Accession NM_004898.2). Accordingly, utilities of GAM37 include diagnosis, prevention and treatment of diseases and clinical conditions associated with CLOCK.

HSC3 (Accession NM_145174.1) is another GAM37 target gene, herein designated TARGET GENE. HSC3 BINDING SITE is a target binding site found in the 3' untranslated region of mRNA encoded by HSC3, corresponding to a target binding site such as BINDING SITE I, BINDING SITE II or BINDING SITE III of FIG. 8. Table 4 illustrates the complementarity of the nucleotide sequences of HSC3 BINDING SITE, designated SEQ ID:19698, to the nucleotide sequence of GAM37 RNA, herein designated GAM RNA, also designated SEQ ID:266.

Another function of GAM37 is therefore inhibition of HSC3 (Accession NM_145174.1). Accordingly, utilities of GAM37 include diagnosis, prevention and treatment of diseases and clinical conditions associated with HSC3.

LOC151005 (Accession) is another GAM37 target gene, herein designated TARGET GENE. LOC151005 BINDING SITE is a target binding site found in the 3' untranslated region of mRNA encoded by LOC151005, corresponding to a target binding site such as BINDING SITE I, BINDING SITE II or BINDING SITE III of FIG. 8. Table 4 illustrates the complementarity of the nucleotide sequences of LOC151005 BINDING SITE, designated SEQ ID:12533, to the nucleotide sequence of GAM37 RNA, herein designated GAM RNA, also designated SEQ ID:266.

Another function of GAM37 is therefore inhibition of LOC151005 (Accession). Accordingly, utilities of GAM37 include diagnosis, prevention and treatment of diseases and clinical conditions associated with LOC151005.

Staufen, rna binding protein (drosophila) (STAU, Accession NM_017454.1) is another GAM37 target gene, herein designated TARGET GENE. STAU BINDING SITE is a target binding site found in the 3' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:602, to the nucleotide sequence of GAM37 RNA, herein designated GAM RNA, also designated SEQ ID:266.

Another function of GAM37 is therefore inhibition of Staufen, rna binding protein (drosophila) (STAU, Accession NM_017454.1), a gene which may play a role in specific positioning of mrnas at given sites in the cell and in stimulating their translation at the site. Accordingly, utilities of GAM37 include diagnosis, prevention and treatment of diseases and clinical conditions associated with STAU.

The function of STAU has been established by previous studies. In Drosophila, genetic studies have identified a number of potential genes that are necessary for localization of mRNAs in oocytes, one of which is the staufen gene. The staufen gene product is a double-stranded RNA (dsRNA)-binding protein that contains several copies of a consensus dsRNA-binding domain (RBD). By searching an EST database for staufen-related sequences, Wickham et al. (1999) identified a partial cDNA encoding STAU, a human staufen homolog. Using RACE and library screening, they recovered additional cDNAs corresponding to the entire STAU coding region. Northern blot analysis indicated that the STAU gene was expressed as an unresolved band of approximately 3.6 kb in all tissues tested. Characterization of STAU cDNAs revealed that there are 4 different STAU transcripts encoding predicted 496- and 577-amino acid isoforms differing in their N-terminal extremities. Wickham et al. (1999) also cloned a mouse Stau cDNA. Mouse and human STAU are 90% identical on the amino acid level. The RBDs are well conserved between Drosophila and mammalian staufen proteins in terms of overall structure and relative positions, and share 47 to 66% identity. However, the mammalian proteins lack the first RBD found in Drosophila staufen and contain a putative microtubule-binding domain not found in the Drosophila protein. In vitro, STAU bound dsRNA and tubulin, suggesting that it crosslinks cytoskeletal and RNA components. In mammalian cells expressing epitope-tagged STAU, immunofluorescence experiments revealed that STAU is localized to the rough endoplasmic reticulum. Wickham et al. (1999) proposed that STAU plays a role in the targeting of RNA to its site of translation. The influenza virus nonstructural protein NS1 is an RNA-binding protein that may be involved in regulatory processes during viral infection, including pre-mRNA splicing, retention of poly(A)-containing RNA in the nucleus, and the stimulation of viral mRNA translation. Using a yeast 2-hybrid screen, Marion et al. (1999) identified staufen-like as a protein that bound NS1. By immunofluorescence, they localized endogenous staufen-like to the rough endoplasmic reticulum in HeLa cells. Sedimentation analyses indicated that staufen-like associates with polysomes in these cells. Marion et al. (1999) suggested that staufen-like might therefore play a dual role: positioning specific mRNAs at given sites in the cell, and stimulating their translation at the site.

Full details of the abovementioned studies are described in the following publications, the disclosure of which are hereby incorporated by reference:

Marion, R. M.; Fortes, P.; Beloso, A.; Dotti, C.; Ortin, J.: A human sequence homologue of staufen is an RNA-binding protein that is associated with polysomes and localizes to the rough endoplasmic reticulum. Molec. Cell. Biol. 19:2212-2219, 1999; and Wickham, L.; Duchaine, T.; Luo, M.; Nabi, I. R.; Des-Groseillers, L.: Mammalian staufen is a double-stranded-RNA- and tubulin-binding protein which localizes to the rough endoplasmic r.

Further studies establishing the function and utilities of STAU are found in John Hopkins OMIM database record ID 601716, and in cited publications listed in Table 5, which are hereby incorporated by reference.

FIG. 8 further provides a conceptual description of a novel bioinformatically detected of the present invention, referred to here as Genomic Address Messenger 38 (GAM38), which modulates expression of respective target genes thereof, the function and utility of which target genes is known in the art.

GAM38 is a novel bioinformatically detected regulatory, non protein coding, micro RNA (miRNA) gene. The method by which GAM38 was detected is described hereinabove with reference to FIGS. 8-15.

GAM38 gene, herein designated GAM GENE, and GAM38 target gene, herein designated TARGET GENE, are human genes contained in the human genome.

GAM38 gene encodes a GAM38 precursor RNA, herein designated GAM PRECURSOR RNA. Similar to other miRNA genes, and unlike most ordinary genes, GAM38 precursor RNA does not encode a protein. A nucleotide sequence identical or highly similar to the nucleotide sequence of GAM38 precursor RNA is designated SEQ ID:89, and is provided hereinbelow with reference to the sequence listing part.

GAM38 precursor RNA folds onto itself, forming GAM38 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM38 precursor RNA folds onto itself, forming GAM38 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM38 precursor RNA, designated SEQ-ID:89, and a schematic representation of a predicted secondary folding of GAM38 folded precursor RNA are further described with reference to Table 2, hereby incorporated by reference.

An enzyme complex designated DICER COMPLEX, 'dices' the GAM38 folded precursor RNA into GAM38 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM38 RNA is designated SEQ ID:271, and is provided hereinbelow with references to the sequence listing part and Table 3, hereby incorporated by reference.

GAM38 target gene, herein designated TARGET GENE, encodes a corresponding messenger RNA, GAM38 target RNA, herein designated GAM TARGET RNA. GAM38target RNA comprises three regions, as is typical of mRNA of a protein coding gene: a 5' untranslated region, a protein coding region and a 3' untranslated region, designated 5'UTR, PROTEIN CODING and 3'UTR respectively.

GAM38 RNA, herein designated GAM RNA, binds complementarily to one or more target binding sites located in untranslated regions of GAM38 target RNA, herein designated GAM TARGET RNA. This complementary binding is due to the fact that the nucleotide sequence of GAM38 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM38 RNA may have a different number of target binding sites in untranslated regions of a GAM38 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM38 RNA, herein designated GAM RNA, to target binding sites on GAM38 target RNA, herein designated GAM TARGET RNA, such as BINDING SITE I, BINDING SITE II and BINDING SITE III, inhibits translation of GAM38target RNA into GAM38 target protein, herein designated GAM TARGET PROTEIN. GAM target protein is therefore outlined by a broken line.

It is appreciated that GAM38 target gene, herein designated TARGET GENE, in fact represents a plurality of GAM38 target genes. The mRNA of each one of this plurality of GAM38 target genes comprises one or more target binding sites, each having a nucleotide sequence which is at least partly complementary to GAM38 RNA, herein designated GAM RNA, and which when bound by GAM38 RNA causes inhibition of translation of respective one or more GAM38 target proteins.

It is further appreciated by one skilled in the art that the mode of translational inhibition illustrated by FIG. 8 with specific reference to translational inhibition exerted by GAM38 gene, herein designated GAM GENE, on one or more GAM38target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM38 correlate with, and may be deduced from, the identity of the target genes which GAM38 binds and inhibits, and the function of these target genes, as elaborated hereinbelow.

Cd34 antigen (CD34, Accession NM_001773.1) is a GAM38 target gene, herein designated TARGET GENE. CD34 BINDING SITE is a target binding site found in the 3' untranslated region of mRNA encoded by CD34, corresponding to a target binding site such as BINDING SITE I, BINDING SITE II or BINDING SITE III of FIG. 8. Table 4 illustrates the complementarity of the nucleotide sequences of CD34 BINDING SITE, designated SEQ ID:10905, to the nucleotide sequence of GAM38 RNA, herein designated GAM RNA, also designated SEQ ID:271.

A function of GAM38 is therefore inhibition of Cd34 antigen (CD34, Accession NM_001773.1), a gene which is a monomeric cell surface antigen that is selectively expressed on human hematopoietic progenitor cells. Accordingly, utilities of GAM38 include diagnosis, prevention and treatment of diseases and clinical conditions associated with CD34.

The function of CD34 has been established by previous studies. CD34 is a monomeric cell surface antigen with a molecular mass of approximately 110 kD that is selectively expressed on human hematopoietic progenitor cells. In the hands of Sutherland et al. (1988), partial amino acid analysis of highly purified CD34 antigen revealed no significant sequence similarity with any previously described structures. Sequential immunoprecipitation and Western blot analysis indicated that this antigen is not a member of the leukosialin/sialophorin family, despite the fact that these molecules share several structural similarities.

Animal model experiments lend further support to the function of CD34. To analyze the involvement of CD34 in hematopoiesis, Cheng et al. (1996) produced both embryonic stem (ES) cells in mice null for the expression of this mucin. Analysis of yolk sac-like hematopoietic development in embryoid bodies derived from CD34-null ES cells showed a significant delay in both erythroid and myeloid differentiation that could be reversed by transfection of the mutant ES cells with CD34 constructs expressing either a complete or truncated cytoplasmic domain. In spite of these diminished embryonic hematopoietic progenitor numbers, the CD34-null mice developed normally, and the hematopoietic profile of adult blood appeared typical. However, the colony-forming activity of hematopoietic progenitors derived from both bone marrow and spleen was significantly reduced in adult CD34-deficient animals.

It is appreciated that the abovementioned animal model for CD34 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Cheng, J.; Baumhueter, S.; Cacalano, G.; Carver-Moore, K.; Thibodeaux, H.; Thomas, R.; Broxmeyer, H. E.; Cooper, S.; Hague, N.; Moore, M.; Lasky, L. A.: Hematopoietic defects in mice lacking the sialomucin CD34. Blood 87:479-490, 1996; and Sutherland, D. R.; Watt, S. M.; Dowden, G.; Karhi, K.; Baker, M. A.; Greaves, M. F.; Smart, J. E.: Structural and partial amino acid sequence analysis of the human hemopoietic progenito.

Further studies establishing the function and utilities of CD34 are found in John Hopkins OMIM database record ID 142230, and in cited publications listed in Table 5, which are hereby incorporated by reference. DKFZP434P211 (Accession NM_014549.1) is another GAM38 target gene, herein designated TARGET GENE. DKFZP434P211 BINDING SITE is a target binding site found in the 3' untranslated region of mRNA encoded by DKFZP434P211, corresponding to a target binding site such as BINDING SITE I, BINDING SITE II or BINDING SITE III of FIG. 8. Table 4 illustrates the complementarity of the nucleotide sequences of DKFZP434P211 BINDING SITE, designated SEQ ID:15656, to the nucleotide sequence of GAM38 RNA, herein designated GAM RNA, also designated SEQ ID:271.

Another function of GAM38 is therefore inhibition of DKFZP434P211 (Accession NM_014549.1). Accordingly, utilities of GAM38 include diagnosis, prevention and treatment of diseases and clinical conditions associated with DKFZP434P211.

FLJ20507 (Accession NM_017849.1) is another GAM38 target gene, herein designated TARGET GENE. FLJ20507 BINDING SITE is a target binding site found in the 3' untranslated region of mRNA encoded by FLJ20507, corresponding to a target binding site such as BINDING SITE I, BINDING SITE II or BINDING SITE III of FIG. 8. Table 4 illustrates the complementarity of the nucleotide sequences of FLJ20507 BINDING SITE, designated SEQ ID:1188, to the nucleotide sequence of GAM38 RNA, herein designated GAM RNA, also designated SEQ ID:271.

Another function of GAM38 is therefore inhibition of FLJ20507 (Accession NM_017849.1). Accordingly, utilities of GAM38 include diagnosis, prevention and treatment of diseases and clinical conditions associated with FLJ20507.

LOC151720 (Accession XM_087279.6) is another GAM38 target gene, herein designated TARGET GENE. LOC151720 BINDING SITE is a target binding site found in the 5' untranslated region of mRNA encoded by LOC151720, corresponding to a target binding site such as BINDING SITE I, BINDING SITE II or BINDING SITE III of FIG. 8. Table 4 illustrates the complementarity of the nucleotide sequences of LOC151720 BINDING SITE, designated SEQ ID:3460, to the nucleotide sequence of GAM38 RNA, herein designated GAM RNA, also designated SEQ ID:271.

Another function of GAM38 is therefore inhibition of LOC151720 (Accession XM_087279.6). Accordingly, utilities of GAM38 include diagnosis, prevention and treatment of diseases and clinical conditions associated with LOC151720.

LOC254848 (Accession XM_173133.4) is another GAM38 target gene, herein designated TARGET GENE. LOC254848 BINDING SITE is a target binding site found in the 3' untranslated region of mRNA encoded by LOC254848, corresponding to a target binding site such as BINDING SITE I, BINDING SITE II or BINDING SITE III of FIG. 8. Table 4 illustrates the complementarity of the nucleotide sequences of LOC254848 BINDING SITE, designated SEQ ID:19887, to the nucleotide sequence of GAM38 RNA, herein designated GAM RNA, also designated SEQ ID:271.

Another function of GAM38 is therefore inhibition of LOC254848 (Accession XM_173133.4). Accordingly, utilities of GAM38 include diagnosis, prevention and treatment of diseases and clinical conditions associated with LOC254848.

LOC255975 (Accession XM_171083.2) is another GAM38 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:20152, to the nucleotide sequence of GAM38 RNA, herein designated GAM RNA, also designated SEQ ID:271.

Another function of GAM38 is therefore inhibition of LOC255975 (Accession XM_171083.2). Accordingly, utilities of GAM38 include diagnosis, prevention and treatment of diseases and clinical conditions associated with LOC255975.

MAAT1 (Accession) is another GAM38 target gene, herein designated TARGET GENE. MAAT1 BINDING SITE is a target binding site found in the 3' untranslated region of mRNA encoded by MAAT1, corresponding to a target binding site such as BINDING SITE I, BINDING SITE II or BINDING SITE III of FIG. 8. Table 4 illustrates the complementarity of the nucleotide sequences of MAAT1 BINDING SITE, designated SEQ ID:18969, to the nucleotide sequence of GAM38 RNA, herein designated GAM RNA, also designated SEQ ID:271.

Another function of GAM38 is therefore inhibition of MAAT1 (Accession). Accordingly, utilities of GAM38 include diagnosis, prevention and treatment of diseases and clinical conditions associated with MAAT1.

Microtubule-associated protein 1b (MAP1B, Accession NM_005909.2) is another GAM38 target gene, herein designated TARGET GENE. MAP1B BINDING SITE is a target binding site found in the 5' untranslated region of multiple transcripts of mRNA encoded by MAP1B, corresponding to a target binding site such as BINDING SITE I, BINDING SITE II or BINDING SITE III of FIG. 8. Table 4 illustrates the complementarity of the nucleotide sequences of MAP1B BINDING SITE, designated SEQ ID:6168, to the nucleotide sequence of GAM38 RNA, herein designated GAM RNA, also designated SEQ ID:271.

Another function of GAM38 is therefore inhibition of Microtubule-associated protein 1b (MAP1B, Accession NM_005909.2), a gene which may have a role in neuronal plasticity and brain development. Accordingly, utilities of GAM38 include diagnosis, prevention and treatment of diseases and clinical conditions associated with MAP1B.

The function of MAP1B has been established by previous studies. Using a polyclonal antiserum directed against the C-terminal domain of dystrophin, Lien et al. (1991) isolated a cDNA clone encoding an antigenically crossreactive protein, microtubule-associated protein 1B (MAP1B). By in situ hybridization, the gene was mapped to 5q13 in proximity to the spinal muscular atrophy (SMA; 253300) locus. Genetic linkage analysis of SMA families using a human dinucleotide repeat polymorphism just 3-prime of the MAP1B gene has shown tight linkage to SMA mutations. These mapping data, together with the postulated role of MAP1B in neuronal morphogenesis and its localization in anterior horn motor neurons, suggest a possible association with SMA. The maximum lod score between SMA and MAP1B for combined sexes was 20.24 at a recombination fraction of 0.02. The 2 recombinants between MAP1B and SMA might appear to eliminate the possibility of an etiologic relationship between MAP1B and SMA. However, there is likely to be nonallelic heterogeneity, particularly among chronic cases of SMA. If MAP1B were indeed the SMA locus, it would be expected to be recombinant in families that have mutations at another locus. MAP1B was found to be the closest marker distal to the locus for SMA; its 5-prime end was oriented toward the centromere (Wirth et al., 1993). Hammarback et al. (1991) found that LC1, one of the 3 light chains that makes up the MAP1B complex, is encoded within the 3-prime end of the MAP1B heavy chain gene. Their data suggested that the heavy chain and light chain 1 are produced by proteolytic processing of a precursor polypeptide. Lien et al. (1994) completely cloned and sequenced the human MAP1B gene. The expressed protein showed 91% overall identity with rat and mouse MAP1B. The gene has 7 exons; the third exon contains sequence not represented in mouse or rat MAP1B. This sequence, labeled 3A, is present at the 5-prime end of an alternative transcript that is expressed at approximately one-tenth the level of the full-length transcript. Neuronal microtubules are considered to have a role in dendrite and axon formation. Different portions of the developing and adult brain microtubules are associated with different microtubule-associated proteins. MAP1B is expressed in different portions of the brain and may have a role in neuronal plasticity and brain development. Edelmann et al. (1996) generated mice that carry an insertion in MAP1B by gene-targeting methods. Mice homozygous for the modification died during embryogenesis. The heterozygotes exhibited a spectrum of phenotypes including slower growth rates, lack of visual acuity in one or both eyes, and motor system abnormalities. Histochemical analysis of the severely affected mice revealed that their Purkinje cell dendritic processes were abnormal, did not react with MAP1B antibodies, and showed reduced staining with MAP1A (OMIM Ref. No. 600178) antibodies. Similar histologic and immunochemical changes were observed in the olfactory bulb, hippocampus, and retina, providing a basis for the observed phenotypes Full details of the abovementioned studies are described in the following publications, the disclosure of which are hereby incorporated by reference:

Lien, L. L.; Feener, C. A.; Fischbach, N.; Kunkel, L. M.: Cloning of human microtubule-associated protein 1B and the identification of a related gene on chromosome 15. Genomics 22:273-280, 1994; and Edelmann, W.; Zervas, M.; Costello, P.; Roback. L.; Fischer, I.; Hammarback, J. A.; Cowan, N.; Davies, P.; Wainer, B.; Kucherlapati, R.: Neuronal abnormalities in microtubule-associated pr.

Further studies establishing the function and utilities of MAP1B are found in John Hopkins OMIM database record ID 157129, and in cited publications listed in Table 5, which are hereby incorporated by reference. MGC21688 (Accession NM_144635.1) is another GAM38 target gene, herein designated TARGET GENE. MGC21688 BINDING SITE is a target binding site found in the 3' untranslated region of mRNA encoded by MGC21688, corresponding to a target binding site such as BINDING SITE I, BINDING SITE II or BINDING SITE III of FIG. 8. Table 4 illustrates the complementarity of the nucleotide sequences of MGC21688 BINDING SITE, designated SEQ ID:6874, to the nucleotide sequence of GAM38 RNA, herein designated GAM RNA, also designated SEQ ID:271.

Another function of GAM38 is therefore inhibition of MGC21688 (Accession NM_144635.1). Accordingly, utilities of GAM38 include diagnosis, prevention and treatment of diseases and clinical conditions associated with MGC21688.

Procollagen (type iii) n-endopeptidase (PCOLN3, Accession NM_002768.1) is another GAM38 target gene, herein designated TARGET GENE. PCOLN3 BINDING SITE is a target binding site found in the 3' untranslated region of mRNA encoded by PCOLN3, corresponding to a target binding site such as BINDING SITE I, BINDING SITE II or BINDING SITE III of FIG. 8. Table 4 illustrates the complementarity of the nucleotide sequences of PCOLN3 BINDING SITE, designated SEQ ID:14968, to the nucleotide sequence of GAM38 RNA, herein designated GAM RNA, also designated SEQ ID:271.

Another function of GAM38 is therefore inhibition of Procollagen (type iii) n-endopeptidase (PCOLN3, Accession NM_002768.1), a gene which is a member of the zincin superfamily of zinc-dependent metalloproteases. Accordingly, utilities of GAM38 include diagnosis, prevention and treatment of diseases and clinical conditions associated with PCOLN3.

The function of PCOLN3 has been established by previous studies. Metallopeptidases are a functionally diverse group of enzymes that are involved in critical stages of many biologic processes including bacterial pathogenesis, growth factor activation, and cancer metastasis. They are essential for the synthesis of the collagen that forms the fibrous scaffold of the extracellular matrix of tissues. Most metallopeptidases contain a zinc cation necessary for both structure coordination of the active site and catalysis. The zincin superfamily comprises metallopeptidases that contain the HEXXH zinc-binding consensus sequence. The 2 histidine residues serve as zinc ligands, and the glutamic acid residue polarizes a water molecule involved in the nucleophilic attack of peptide bonds. Subclassification is based on the identity of other amino acids that act as zinc ligands. Gluzincins, for example, have glutamic acid as a third zinc ligand. Halila et al. (1989) isolated a possible cDNA for type III procollagen N-proteinase (OMIM Ref. No. PCOLN3) from a human placenta cDNA library. By screening a human placenta cDNA library with polyclonal antibodies raised against human PCOLN3 and the use of 5-prime RACE and primer extension strategies on the isolated cDNAs, Scott et al. (1996) identified a gene, which they symbolized PRSM1, that is a member of the gluzincin subfamily of metallopeptidases. The full-length composite sequence of the PRSM1 gene encodes a deduced 318-amino acid protein with an HELGH pentapeptide fitting the consensus sequence characteristic of zincins, and a glutamic acid 25 residues C-terminal of the first histidine, fitting the pattern of gluzincins for a third zinc-binding ligand. PRSM1 contains 3 clusters of cysteine residues:1 cluster of 4 residues and 1 cluster of 6 residues at the N terminus and a cluster of 6 residues at the C terminus. However, the predicted sequence lacks potential glycosylation sites. Immunoblot analysis of placental tissue revealed an approximately 30-kD protein. Northern blot analysis of human fibroblast culture mRNA detected a transcript of approximately 2.5 kb. By Northern blot analysis, Nomura et al. (1994) found that PRSM1, which they designated KIAA0047, is expressed ubiquitously, with highest levels in lung and kidney as well as in HeLa and KG-1 cell lines.

Full details of the abovementioned studies are described in the following publications, the disclosure of which are hereby incorporated by reference:

Scott, I. C.; Halila, R.; Jenkins, J. M.; Mehan, S.; Apostolou, S.; Winqvist, R.; Callen, D. F.; Prockop, D. J.; Peltonen, L.; Kadler, K. E.: Molecular cloning, expression and chromosomal localization of a human gene encoding a 33 kDa putative metallopeptidase (PRSM1). Gene 174:135-143, 1996 and Nomura, N.; Nagase, T.; Miyajima, N.; Sazuka, T.; Tanaka, A.; Sato, S.; Seki, N.; Kawarabayasi, Y.; Ishikawa, K.; Tabata, S.: Prediction of the coding sequences of unidentified human ge.

Further studies establishing the function and utilities of PCOLN3 are found in John Hopkins OMIM database record ID 164010, and in cited publications listed in Table 5, which are hereby incorporated by reference.

FIG. 8 further provides a conceptual description of a novel bioinformatically detected of the present invention, referred to here as Genomic Address Messenger 39 (GAM39), which modulates expression of respective target genes thereof, the function and utility of which target genes is known in the art.

GAM39 is a novel bioinformatically detected regulatory, non protein coding, micro RNA (miRNA) gene. The method by which GAM39 was detected is described hereinabove with reference to FIGS. 8-15.

GAM39 gene, herein designated GAM GENE, and GAM39 target gene, herein designated TARGET GENE, are human genes contained in the human genome.

GAM39 gene encodes a GAM39 precursor RNA, herein designated GAM PRECURSOR RNA. Similar to other miRNA genes, and unlike most ordinary genes, GAM39 precursor RNA does not encode a protein. A nucleotide sequence identical or highly similar to the nucleotide sequence of GAM39 precursor RNA is designated SEQ ID:27, and is provided hereinbelow with reference to the sequence listing part.

GAM39 precursor RNA folds onto itself, forming GAM39 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM39 precursor RNA folds onto itself, forming GAM39 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM39 precursor RNA, designated SEQ-ID:27, and a schematic representation of a predicted secondary folding of GAM39 folded precursor RNA are further described with reference to Table 2, hereby incorporated by reference.

An enzyme complex designated DICER COMPLEX, 'dices' the GAM39 folded precursor RNA into GAM39 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM39 RNA is designated SEQ ID:386, and is provided hereinbelow with references to the sequence listing part and Table 3, hereby incorporated by reference.

GAM39 target gene, herein designated TARGET GENE, encodes a corresponding messenger RNA, GAM39 target RNA, herein designated GAM TARGET RNA. GAM39target RNA comprises three regions, as is typical of mRNA of a protein coding gene: a 5' untranslated region, a protein coding region and a 3' untranslated region, designated 5'UTR, PROTEIN CODING and 3'UTR respectively.

GAM39 RNA, herein designated GAM RNA, binds complementarily to one or more target binding sites located in untranslated regions of GAM39 target RNA, herein designated GAM TARGET RNA. This complementary binding is due to the fact that the nucleotide sequence of GAM39 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM39 RNA may have a different number of target binding sites in untranslated regions of a GAM39 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM39 RNA, herein designated GAM RNA, to target binding sites on GAM39 target RNA, herein designated GAM TARGET RNA, such as BINDING SITE I, BINDING SITE II and BINDING SITE III, inhibits translation of GAM39target RNA into GAM39 target protein, herein designated GAM TARGET PROTEIN. GAM target protein is therefore outlined by a broken line.

It is appreciated that GAM39 target gene, herein designated TARGET GENE, in fact represents a plurality of GAM39 target genes. The mRNA of each one of this plurality of GAM39 target genes comprises one or more target binding sites, each having a nucleotide sequence which is at least partly complementary to GAM39 RNA, herein designated GAM RNA, and which when bound by GAM39 RNA causes inhibition of translation of respective one or more GAM39 target proteins.

It is further appreciated by one skilled in the art that the mode of translational inhibition illustrated by FIG. 8 with specific reference to translational inhibition exerted by GAM39 gene, herein designated GAM GENE, on one or more GAM39target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM39 correlate with, and may be deduced from, the identity of the target genes which GAM39 binds and inhibits, and the function of these target genes, as elaborated hereinbelow.

Chromosome 20 open reading frame 177 (C20orf177, Accession XM_290955.1) is a GAM39 target gene, herein designated TARGET GENE. C20orf177 BINDING SITE is a target binding site found in the 3' untranslated region of mRNA encoded by C20orf177, corresponding to a target binding site such as BINDING SITE I, BINDING SITE II or BINDING SITE III of FIG. 8. Table 4 illustrates the complementarity of the nucleotide sequences of C20orf177 BINDING SITE, designated SEQ ID:13958, to the nucleotide sequence of GAM39 RNA, herein designated GAM RNA, also designated SEQ ID:386.

A function of GAM39 is therefore inhibition of Chromosome 20 open reading frame 177 (C20orf177, Accession XM_290955.1). Accordingly, utilities of GAM39 include diagnosis, prevention and treatment of diseases and clinical conditions associated with C20orf177.

Cholinergic receptor, nicotinic, alpha polypeptide 10 (CHRNA10, Accession NM_020402.2) is another GAM39 target gene, herein designated TARGET GENE. CHRNA10 BINDING SITE is a target binding site found in the 3' untranslated region of mRNA encoded by CHRNA10, corresponding to a target binding site such as BINDING SITE I, BINDING SITE II or BINDING SITE III of FIG. 8. Table 4 illustrates the complementarity of the nucleotide sequences of CHRNA10 BINDING SITE, designated SEQ ID:3642, to the nucleotide sequence of GAM39 RNA, herein designated GAM RNA, also designated SEQ ID:386.

Another function of GAM39 is therefore inhibition of Cholinergic receptor, nicotinic, alpha polypeptide 10 (CHRNA10, Accession NM_020402.2). Accordingly, utilities of GAM39 include diagnosis, prevention and treatment of diseases and clinical conditions associated with CHRNA10.

Dehydrogenase/reductase (sdr family) member 2 (DHRS2, Accession NM_005794.1) is another GAM39 target gene, herein designated TARGET GENE. DHRS2 BINDING SITE is a target binding site found in the 3' untranslated region of mRNA encoded by DHRS2, corresponding to a target binding site such as BINDING SITE I, BINDING SITE II or BINDING SITE III of FIG. 8. Table 4 illustrates the complementarity of the nucleotide sequences of DHRS2 BINDING SITE, designated SEQ ID:1429, to the nucleotide sequence of GAM39 RNA, herein designated GAM RNA, also designated SEQ ID:386.

Another function of GAM39 is therefore inhibition of Dehydrogenase/reductase (sdr family) member 2 (DHRS2, Accession NM_005794.1). Accordingly, utilities of GAM39 include diagnosis, prevention and treatment of diseases and clinical conditions associated with DHRS2.

FLJ23476 (Accession NM_024640.1) is another GAM39 target gene, herein designated TARGET GENE. FLJ23476 BINDING SITE is a target binding site found in the 3' untranslated region of mRNA encoded by FLJ23476, corresponding to a target binding site such as BINDING SITE I, BINDING SITE II or BINDING SITE III of FIG. 8. Table 4 illustrates the complementarity of the nucleotide sequences of FLJ23476 BINDING SITE, designated SEQ ID:18143, to the nucleotide sequence of GAM39 RNA, herein designated GAM RNA, also designated SEQ ID:386.

Another function of GAM39 is therefore inhibition of FLJ23476 (Accession NM_024640.1). Accordingly, utilities of GAM39 include diagnosis, prevention and treatment of diseases and clinical conditions associated with FLJ23476.

KIAA1924 (Accession NM_153239.2) is another GAM39 target gene, herein designated TARGET GENE. KIAA1924 BINDING SITE is a target binding site found in the 3' untranslated region of mRNA encoded by KIAA1924, corresponding to a target binding site such as BINDING SITE I, BINDING SITE II or BINDING SITE III of FIG. 8. Table 4 illustrates the complementarity of the nucleotide sequences of KIAA1924 BINDING SITE, designated SEQ ID:17872, to the nucleotide sequence of GAM39 RNA, herein designated GAM RNA, also designated SEQ ID:386.

Another function of GAM39 is therefore inhibition of KIAA1924 (Accession NM_153239.2). Accordingly, utilities of GAM39 include diagnosis, prevention and treatment of diseases and clinical conditions associated with KIAA1924.

LOC51161 (Accession NM_016210.1) is another GAM39 target gene, herein designated TARGET GENE. LOC51161 BINDING SITE is a target binding site found in the 5' untranslated region of mRNA encoded by LOC51161, corresponding to a target binding site such as BINDING SITE I, BINDING SITE II or BINDING SITE III of FIG. 8. Table 4 illustrates the complementarity of the nucleotide sequences of LOC51161 BINDING SITE, designated SEQ ID:15881, to the nucleotide sequence of GAM39 RNA, herein designated GAM RNA, also designated SEQ ID:386.

Another function of GAM39 is therefore inhibition of LOC51161 (Accession NM_016210.1). Accordingly, utilities of GAM39 include diagnosis, prevention and treatment of diseases and clinical conditions associated with LOC51161.

LOC91040 (Accession) is another GAM39 target gene, herein designated TARGET GENE. LOC91040 BINDING SITE is a target binding site found in the 3' untranslated region of mRNA encoded by LOC91040, corresponding to a target binding site such as BINDING SITE I, BINDING SITE II or BINDING SITE III of FIG. 8. Table 4 illustrates the complementarity of the nucleotide sequences of LOC91040

BINDING SITE, designated SEQ ID:18287, to the nucleotide sequence of GAM39 RNA, herein designated GAM RNA, also designated SEQ ID:386.

Another function of GAM39 is therefore inhibition of LOC91040 (Accession). Accordingly, utilities of GAM39 include diagnosis, prevention and treatment of diseases and clinical conditions associated with LOC91040.

MGC10701 (Accession NM_032658.1) is another GAM39 target gene, herein designated TARGET GENE. MGC10701 BINDING SITE is a target binding site found in the 5' untranslated region of mRNA encoded by MGC10701, corresponding to a target binding site such as BINDING SITE I, BINDING SITE II or BINDING SITE III of FIG. 8. Table 4 illustrates the complementarity of the nucleotide sequences of MGC10701 BINDING SITE, designated SEQ ID:19440, to the nucleotide sequence of GAM39 RNA, herein designated GAM RNA, also designated SEQ ID:386.

Another function of GAM39 is therefore inhibition of MGC10701 (Accession NM_032658.1). Accordingly, utilities of GAM39 include diagnosis, prevention and treatment of diseases and clinical conditions associated with MGC10701.

MGC11335 (Accession NM_030819.2) is another GAM39 target gene, herein designated TARGET GENE. MGC11335 BINDING SITE is a target binding site found in the 3' untranslated region of mRNA encoded by MGC11335, corresponding to a target binding site such as BINDING SITE I, BINDING SITE II or BINDING SITE III of FIG. 8. Table 4 illustrates the complementarity of the nucleotide sequences of MGC11335 BINDING SITE, designated SEQ ID:15461, to the nucleotide sequence of GAM39 RNA, herein designated GAM RNA, also designated SEQ ID:386.

Another function of GAM39 is therefore inhibition of MGC11335 (Accession NM_030819.2). Accordingly, utilities of GAM39 include diagnosis, prevention and treatment of diseases and clinical conditions associated with MGC11335.

Rad1 homolog (s. pombe) (RAD1, Accession NM_133377.1) is another GAM39 target gene, herein designated TARGET GENE. RAD1 BINDING SITE is a target binding site found in the 3' untranslated region of multiple transcripts of mRNA encoded by RAD1, corresponding to a target binding site such as BINDING SITE I, BINDING SITE II or BINDING SITE III of FIG. 8. Table 4 illustrates the complementarity of the nucleotide sequences of RAD1 BINDING SITE, designated SEQ ID:16511, to the nucleotide sequence of GAM39 RNA, herein designated GAM RNA, also designated SEQ ID:386.

Another function of GAM39 is therefore inhibition of Rad1 homolog (s. pombe) (RAD1, Accession NM_133377.1), a gene which has important roles in DNA damage-activated mitotic and meiotic cell cycle checkpoints. Accordingly, utilities of GAM39 include diagnosis, prevention and treatment of diseases and clinical conditions associated with RAD1.

The function of RAD1 has been established by previous studies. In the fission yeast S. pombe, the rad1+ gene product is required for DNA repair and replication. Parker et al. (1998) cloned 2 alternatively spliced human cDNAs encoding proteins with significant homology to yeast rad1+. The longer cDNA, called Hrad1A, encodes a 282-amino acid polypeptide, while Hrad1B encodes a 163-amino acid polypeptide. Northern blot analysis revealed that human RAD1 is expressed as mRNAs of 5, 3, and 1.3 kb in a variety of human tissues, with higher levels present in some cancer cell lines. Northern blot analysis of cells subjected to ultraviolet radiation demonstrated that human RAD1 expression is not induced in response to DNA damage. Purified RAD1 exhibited terminal exonuclease activity on double-stranded DNA, with a preference for 3-prime ends. Independently, Udell et al. (1998) isolated RAD1 cDNAs from a spontaneously transformed human keratinocyte cDNA library. The cDNAs encode the 282-amino acid RAD1 isoform, which is 90% and 27% identical to mouse Rad1 and S. pombe rad1+, respectively. Udell et al. (1998) found that expression of human RAD1 in yeast rad1 mutants partially restores radiation resistance and G2 checkpoint proficiency.

Full details of the abovementioned studies are described in the following publications, the disclosure of which are hereby incorporated by reference:

Parker, A. E.; Van de Weyer, I.; Laus, M. C.; Oostveen, I.; Yon, J.; Verhasselt, P.; Luyten, W. H. M. L.: A human homologue of Schizosaccharomyces pombe rad1+ checkpoint gene encodes an exonuclease. J. Biol. Chem. 273:18332-18339, 1998; and Udell, C. M.; Lee, S. K.; Davey, S.: HRAD1 and MRAD1 encode mammalian homologues of the fission yeast rad1+ cell cycle checkpoint control gene. Nucleic Acids Res. 26:3971-3976, 1998.

Further studies establishing the function and utilities of RAD1 are found in John Hopkins OMIM database record ID 603153, and in cited publications listed in Table 5, which are hereby incorporated by reference. Small nuclear rna activating complex, polypeptide 4, 190 kda (SNAPC4, Accession NM_003086.1) is another GAM39 target gene, herein designated TARGET GENE. SNAPC4 BINDING SITE is a target binding site found in the 5' untranslated region of mRNA encoded by SNAPC4, corresponding to a target binding site such as BINDING SITE I, BINDING SITE II or BINDING SITE III of FIG. 8. Table 4 illustrates the complementarity of the nucleotide sequences of SNAPC4 BINDING SITE, designated SEQ ID:8252, to the nucleotide sequence of GAM39 RNA, herein designated GAM RNA, also designated SEQ ID:386.

Another function of GAM39 is therefore inhibition of Small nuclear rna activating complex, polypeptide 4, 190 kda (SNAPC4, Accession NM_003086.1). Accordingly, utilities of GAM39 include diagnosis, prevention and treatment of diseases and clinical conditions associated with SNAPC4.

FIG. 8 further provides a conceptual description of a novel bioinformatically detected gene of the present invention, referred to here as Genomic Address Messenger 40 (GAM40), which modulates expression of respective target genes thereof, the function and utility of which target genes is known in the art.

GAM40 is a novel bioinformatically detected regulatory, non protein coding, micro RNA (miRNA) gene. The method by which GAM40 was detected is described hereinabove with reference to FIGS. 8-15.

GAM40 gene, herein designated GAM GENE, and GAM40 target gene, herein designated TARGET GENE, are human genes contained in the human genome.

GAM40 gene encodes a GAM40 precursor RNA, herein designated GAM PRECURSOR RNA. Similar to other miRNA genes, and unlike most ordinary genes, GAM40 precursor RNA does not encode a protein. A nucleotide sequence identical or highly similar to the nucleotide sequence of GAM40 precursor RNA is designated SEQ ID:126, and is provided hereinbelow with reference to the sequence listing part. Nucleotide sequence SEQ ID:126 is located at position 72533165 relative to chromosome 10.

GAM40 precursor RNA folds onto itself, forming GAM40 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM40 precursor RNA folds onto itself, forming GAM40 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM40 precursor RNA, designated SEQ-ID:126, and a schematic representation of a predicted secondary folding of GAM40 folded precursor RNA are further described with reference to Table 2, hereby incorporated by reference.

An enzyme complex designated DICER COMPLEX, 'dices' the GAM40 folded precursor RNA into GAM40 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM40 RNA is designated SEQ ID:396, and is provided hereinbelow with references to the sequence listing part and Table 3, hereby incorporated by reference.

GAM40 target gene, herein designated TARGET GENE, encodes a corresponding messenger RNA, GAM40 target RNA, herein designated GAM TARGET RNA. GAM40target RNA comprises three regions, as is typical of mRNA of a protein coding gene: a 5' untranslated region, a protein coding region and a 3' untranslated region, designated 5'UTR, PROTEIN CODING and 3'UTR respectively.

GAM40 RNA, herein designated GAM RNA, binds complementarily to one or more target binding sites located in untranslated regions of GAM40 target RNA, herein designated GAM TARGET RNA. This complementary binding is due to the fact that the nucleotide sequence of GAM40 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM40 RNA may have a different number of target binding sites in untranslated regions of a GAM40 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM40 RNA, herein designated GAM RNA, to target binding sites on GAM40 target RNA, herein designated GAM TARGET RNA, such as BINDING SITE I, BINDING SITE II and BINDING SITE III, inhibits translation of GAM40target RNA into GAM40 target protein, herein designated GAM TARGET PROTEIN. GAM target protein is therefore outlined by a broken line.

It is appreciated that GAM40 target gene, herein designated TARGET GENE, in fact represents a plurality of GAM40 target genes. The mRNA of each one of this plurality of GAM40 target genes comprises one or more target binding sites, each having a nucleotide sequence which is at least partly complementary to GAM40 RNA, herein designated GAM RNA, and which when bound by GAM40 RNA causes inhibition of translation of respective one or more GAM40 target proteins.

It is further appreciated by one skilled in the art that the mode of translational inhibition illustrated by FIG. 8 with specific reference to translational inhibition exerted by GAM40 gene, herein designated GAM GENE, on one or more GAM40target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM40 correlate with, and may be deduced from, the identity of the target genes which GAM40 binds and inhibits, and the function of these target genes, as elaborated hereinbelow.

Atp-binding cassette, sub-family a (abc1), member 9 (ABCA9, Accession NP_759018.1) is a GAM40 target gene, herein designated TARGET GENE. ABCA9 BINDING SITE is a target binding site found in the 5' untranslated region of multiple transcripts of mRNA encoded by ABCA9, corresponding to a target binding site such as BINDING SITE I, BINDING SITE II or BINDING SITE III of FIG. 8. Table 4 illustrates the complementarity of the nucleotide sequences of ABCA9 BINDING SITE, designated SEQ ID:10551, to the nucleotide sequence of GAM40 RNA, herein designated GAM RNA, also designated SEQ ID:396.

A function of GAM40 is therefore inhibition of Atp-binding cassette, sub-family a (abc1), member 9 (ABCA9, Accession NP_759018.1). Accordingly, utilities of GAM40 include diagnosis, prevention and treatment of diseases and clinical conditions associated with ABCA9.

Atp-binding cassette, sub-family a (abc1), member 9 (ABCA9, Accession NP_525022.2) is another GAM40 target gene, herein designated TARGET GENE. ABCA9 BINDING SITE is a target binding site found in the 5' untranslated region of multiple transcripts of mRNA encoded by ABCA9, corresponding to a target binding site such as BINDING SITE I, BINDING SITE II or BINDING SITE III of FIG. 8. Table 4 illustrates the complementarity of the nucleotide sequences of ABCA9 BINDING SITE, designated SEQ ID:10551, to the nucleotide sequence of GAM40 RNA, herein designated GAM RNA, also designated SEQ ID:396.

Another function of GAM40 is therefore inhibition of Atp-binding cassette, sub-family a (abc1), member 9 (ABCA9, Accession NP_525022.2). Accordingly, utilities of GAM40 include diagnosis, prevention and treatment of diseases and clinical conditions associated with ABCA9.

Actin, gamma 2, smooth muscle, enteric (ACTG2, Accession NP_001606.1) is another GAM40 target gene, herein designated TARGET GENE. ACTG2 BINDING SITE is a target binding site found in the 5' untranslated region of mRNA encoded by ACTG2, corresponding to a target binding site such as BINDING SITE I, BINDING SITE II or BINDING SITE III of FIG. 8. Table 4 illustrates the complementarity of the nucleotide sequences of ACTG2 BINDING SITE, designated SEQ ID:465, to the nucleotide sequence of GAM40 RNA, herein designated GAM RNA, also designated SEQ ID:396.

Another function of GAM40 is therefore inhibition of Actin, gamma 2, smooth muscle, enteric (ACTG2, Accession NP_001606.1), a gene which are involved in various types of cell motility and are ubiquitously expressed in all eukaryotic cells. Accordingly, utilities of GAM40 include diagnosis, prevention and treatment of diseases and clinical conditions associated with ACTG2.

The function of ACTG2 has been established by previous studies. Miwa et al. (1991) isolated recombinant phages that carried the human smooth muscle (enteric) gamma-actin gene (which they symbolized ACTSG) from human genomic DNA libraries. The gene, designated ACTG2, contained one 5-prime untranslated exon and 8 coding exons extending for 27 kb; the mapping of the gene to chromosome 2 was demonstrated by study of rodent-human somatic cell hybrids. Ueyama et al. (1995) isolated genomic clones containing the gene (which has also been symbolized ACTA3) and mapped the gene to 2p13.1 by fluorescence in situ hybridization. From the characterized molecular structures of the 6 human actin isoform genes, Miwa et al. (1991) proposed a hypothesis of the evolutionary pathway of the actin gene family. Each of the 5 other actin genes maps to a separate chromosome. Ueyama et al. (1995) demonstrated that the HindIII RFLP in the first intron of the gene is due to the presence/absence of a 24-bp sequence harboring a HindIII restriction site. A biallelic system was found to have allelic frequencies of 45 (HindIII-minus):55 (HindIII-Plus).

Full details of the abovementioned studies are described in the following publications, the disclosure of which are hereby incorporated by reference:

Miwa, T.; Manabe, Y.; Kurokawa, K.; Kamada, S.; Kanda, N.; Bruns, G.; Ueyama, H.; Kakunaga, T.: Structure, chromosome location, and expression of the human smooth muscle (enteric type) gamma-actin gene: evolution of six human actin genes. Molec. Cell. Biol. 11:3296-3306, 1991; and Ueyama, H.; Inazawa, J.; Nishino, H.; Han-Xiang, D.; Ochiai, Y.; Ohkubo, I.: Chromosomal mapping of the human smooth muscle actin gene (enteric type, ACTA3) to 2p13.1 and molecular natur.

Further studies establishing the function and utilities of ACTG2 are found in John Hopkins OMIM database record ID 102545, and in cited publications listed in Table 5, which are hereby incorporated by reference. Adp-ribosyltransferase (nad+; poly (adp-ribose) polymerase)-like 3 (ADPRTL3, Accession NP_005476.1) is another GAM40 target gene, herein designated TARGET GENE. ADPRTL3 BINDING SITE is a target binding site found in the 3' untranslated region of mRNA encoded by ADPRTL3, corresponding to a target binding site such as BINDING SITE I, BINDING SITE II or BINDING SITE III of FIG. 8. Table 4 illustrates the complementarity of the nucleotide sequences of ADPRTL3 BINDING SITE, designated SEQ ID:2591, to the nucleotide sequence of GAM40 RNA, herein designated GAM RNA, also designated SEQ ID:396.

Another function of GAM40 is therefore inhibition of Adp-ribosyltransferase (nad+; poly (adp-ribose) polymerase)-like 3 (ADPRTL3, Accession NP_005476.1). Accordingly, utilities of GAM40 include diagnosis, prevention and treatment of diseases and clinical conditions associated with ADPRTL3.

Adenylate kinase 5 (AK5, Accession NP_777283.1) is another GAM40 target gene, herein designated TARGET GENE. AK5 BINDING SITE is a target binding site found in the 3' untranslated region of multiple transcripts of mRNA encoded by AK5, corresponding to a target binding site such as BINDING SITE I, BINDING SITE II or BINDING SITE III of FIG. 8. Table 4 illustrates the complementarity of the nucleotide sequences of AK5 BINDING SITE, designated SEQ ID:6701, to the nucleotide sequence of GAM40 RNA, herein designated GAM RNA, also designated SEQ ID:396.

Another function of GAM40 is therefore inhibition of Adenylate kinase 5 (AK5, Accession NP_777283.1). Accordingly, utilities of GAM40 include diagnosis, prevention and treatment of diseases and clinical conditions associated with AK5.

Adenylate kinase 5 (AK5, Accession NP_036225.2) is another GAM40 target gene, herein designated TARGET GENE. AK5 BINDING SITE is a target binding site found in the 3' untranslated region of multiple transcripts of mRNA encoded by AK5, corresponding to a target binding site such as BINDING SITE I, BINDING SITE II or BINDING SITE III of FIG. 8. Table 4 illustrates the complementarity of the nucleotide sequences of AK5 BINDING SITE, designated SEQ ID:6701, to the nucleotide sequence of GAM40 RNA, herein designated GAM RNA, also designated SEQ ID:396.

Another function of GAM40 is therefore inhibition of Adenylate kinase 5 (AK5, Accession NP_036225.2). Accordingly, utilities of GAM40 include diagnosis, prevention and treatment of diseases and clinical conditions associated with AK5.

Amelogenin (x chromosome, amelogenesis imperfecta 1) (AMELX, Accession NP_001133.1) is another GAM40 target gene, herein designated TARGET GENE. AMELX BINDING SITE is a target binding site found in the 3' untranslated region of mRNA encoded by AMELX, corresponding to a target binding site such as BINDING SITE I, BINDING SITE II or BINDING SITE III of FIG. 8. Table 4 illustrates the complementarity of the nucleotide sequences of AMELX BINDING SITE, designated SEQ ID:5458, to the nucleotide sequence of GAM40 RNA, herein designated GAM RNA, also designated SEQ ID:396.

Another function of GAM40 is therefore inhibition of Amelogenin (x chromosome, amelogenesis imperfecta 1) (AMELX, Accession NP_001133.1). Accordingly, utilities of GAM40 include diagnosis, prevention and treatment of diseases and clinical conditions associated with AMELX.

Basic, immunoglobulin-like variable motif containing (BIVM, Accession NP_060163.2) is another GAM40 target gene, herein designated TARGET GENE. BIVM BINDING SITE is a target binding site found in the 3' untranslated region of mRNA encoded by BIVM, corresponding to a target binding site such as BINDING SITE I, BINDING SITE II or BINDING SITE III of FIG. 8. Table 4 illustrates the complementarity of the nucleotide sequences of BIVM BINDING SITE, designated SEQ ID:10429, to the nucleotide sequence of GAM40 RNA, herein designated GAM RNA, also designated SEQ ID:396.

Another function of GAM40 is therefore inhibition of Basic, immunoglobulin-like variable motif containing (BIVM, Accession NP_060163.2). Accordingly, utilities of GAM40 include diagnosis, prevention and treatment of diseases and clinical conditions associated with BIVM.

C14orf45 (Accession NP_079333.1) is another GAM40target gene, herein designated TARGET GENE. C14orf45 BINDING SITE is a target binding site found in the 3' untranslated region of mRNA encoded by C14orf45, corresponding to a target binding site such as BINDING SITE I, BINDING SITE II or BINDING SITE III of FIG. 8. Table 4 illustrates the complementarity of the nucleotide sequences of C14orf45 BINDING SITE, designated SEQ ID:7225, to the nucleotide sequence of GAM40 RNA, herein designated GAM RNA, also designated SEQ ID:396.

Another function of GAM40 is therefore inhibition of C14orf45 (Accession NP_079333.1). Accordingly, utilities of GAM40 include diagnosis, prevention and treatment of diseases and clinical conditions associated with C14orf45.

Calsequestrin 2 (cardiac muscle) (CASQ2, Accession NP_001223.1) is another GAM40 target gene, herein designated TARGET GENE. CASQ2 BINDING SITE is a target binding site found in the 3' untranslated region of mRNA encoded by CASQ2, corresponding to a target binding site such as BINDING SITE I, BINDING SITE II or BINDING SITE III of FIG. 8. Table 4 illustrates the complementarity of the nucleotide sequences of CASQ2 BINDING SITE, designated SEQ ID:14756, to the nucleotide sequence of GAM40 RNA, herein designated GAM RNA, also designated SEQ ID:396.

Another function of GAM40 is therefore inhibition of Calsequestrin 2 (cardiac muscle) (CASQ2, Accession NP_001223.1). Accordingly, utilities of GAM40 include diagnosis, prevention and treatment of diseases and clinical conditions associated with CASQ2.

CDK11 (Accession XP_166324.1) is another GAM40 target gene, herein designated TARGET GENE. CDK11 BINDING SITE is a target binding site found in the 3' untranslated region of multiple transcripts of mRNA encoded by CDK11, corresponding to a target binding site such as BINDING SITE I, BINDING SITE II or BINDING SITE III of FIG. 8. Table 4 illustrates the complementarity of the nucleotide sequences of CDK11 BINDING SITE, designated SEQ ID:2021, to the nucleotide sequence of GAM40 RNA, herein designated GAM RNA, also designated SEQ ID:396.

Another function of GAM40 is therefore inhibition of CDK11 (Accession XP_166324.1). Accordingly, utilities of GAM40 include diagnosis, prevention and treatment of diseases and clinical conditions associated with CDK11.

CGI-01 (Accession NP_057019.2) is another GAM40 target gene, herein designated TARGET GENE. CGI-01 BINDING SITE is a target binding site found in the 3' untranslated region of mRNA encoded by CGI-01, corresponding to a target binding site such as BINDING SITE I, BINDING SITE II or BINDING SITE III of FIG. 8. Table 4 illustrates the complementarity of the nucleotide sequences of CGI-01 BINDING SITE, designated SEQ ID:18067, to the nucleotide sequence of GAM40 RNA, herein designated GAM RNA, also designated SEQ ID:396.

Another function of GAM40 is therefore inhibition of CGI-01 (Accession NP_057019.2). Accordingly, utilities of GAM40 include diagnosis, prevention and treatment of diseases and clinical conditions associated with CGI-01.

Chloride channel 6 (CLCN6, Accession NP_068504.1) is another GAM40 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:2020, to the nucleotide sequence of GAM40 RNA, herein designated GAM RNA, also designated SEQ ID:396.

Another function of GAM40 is therefore inhibition of Chloride channel 6 (CLCN6, Accession NP_068504.1), a gene which is a voltage-gated chloride channel. Accordingly, utilities of GAM40 include diagnosis, prevention and treatment of diseases and clinical conditions associated with CLCN6.

The function of CLCN6 has been established by previous studies. Members of the mammalian CLCN family of voltage-gated chloride channels display differential tissue distribution and perform diverse functions. Nomura et al. (1994) identified a partial human CLCN6 cDNA, which they called KIAA0046. Northern blot analysis revealed that CLCN6 was expressed widely. Using the partial cDNA sequence of Nomura et al. (1994), Brandt and Jentsch (1995) cloned human cerebral cortex cDNAs that covered the entire CLCN6 coding region. The predicted 869-amino acid protein was called CLC6 by them. The amino acid sequence of CLCN6 is 45% identical to that of CLCN7 (OMIM Ref. No. 602727) but only 23 to 29% identical to the sequences of other known CLCNs. Therefore, Brandt and Jentsch (1995) stated that CLCN6 and CLCN7 together define a new branch of the chloride channel protein family. By Northern blot analysis, Brandt and Jentsch (1995) found that CLCN6 was expressed as an approximately 6-kb mRNA in all tissues examined. Eggermont et al. (1997) identified 4 different CLCN6 cDNAs that represent alternatively spliced transcripts. Nomura et al. (1994) mapped the CLCN6 gene to chromosome 1 using a somatic cell hybrid panel. By fluorescence in situ hybridization, Brandt and Jentsch (1995) refined the localization of the CLCN6 gene to 1p36. They noted that 2 genes encoding kidney-specific chloride channels, CLCNKA (OMIM Ref. No. 602024) and CLCNKB (OMIM Ref. No. 602023), also map to 1p36.

Full details of the abovementioned studies are described in the following publications, the disclosure of which are hereby incorporated by reference:

REFERENCES 1. Brandt, S.; Jentsch, T. J.: ClC-6 and ClC-7 are two novel broadly expressed members of the CLC chloride channel family. FEBS Lett. 377:15-20, 1995; and Eggermont, J.; Buyse, G.; Voets, T.; Tytgat, J.; De Smedt, H.; Droogmans, G.: Alternative splicing of ClC-6 (a member of the ClC chloride-channel family) transcripts generates three tr.

Further studies establishing the function and utilities of CLCN6 are found in John Hopkins OMIM database record ID 602726, and in cited publications listed in Table 5, which are hereby incorporated by reference. Chloride channel 6 (CLCN6, Accession NP_001277.1) is another GAM40 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:2020, to the nucleotide sequence of GAM40 RNA, herein designated GAM RNA, also designated SEQ ID:396.

Another function of GAM40 is therefore inhibition of Chloride channel 6 (CLCN6, Accession NP_001277.1), a gene which is a voltage-gated chloride channel. Accordingly, utilities of GAM40 include diagnosis, prevention and treatment of diseases and clinical conditions associated with CLCN6.

The function of CLCN6 has been established by previous studies. Members of the mammalian CLCN family of voltage-gated chloride channels display differential tissue distribution and perform diverse functions. Nomura et al. (1994) identified a partial human CLCN6 cDNA, which they called KIAA0046. Northern blot analysis revealed that CLCN6 was expressed widely. Using the partial cDNA sequence of Nomura et al. (1994), Brandt and Jentsch (1995) cloned human cerebral cortex cDNAs that covered the entire CLCN6 coding region. The predicted 869-amino acid protein was called CLC6 by them. The amino acid sequence of CLCN6 is 45% identical to that of CLCN7 (OMIM Ref. No. 602727) but only 23 to 29% identical to the sequences of other known CLCNs. Therefore, Brandt and Jentsch (1995) stated that CLCN6 and CLCN7 together define a new branch of the chloride channel protein family. By Northern blot analysis, Brandt and Jentsch (1995) found that CLCN6 was expressed as an approximately 6-kb mRNA in all tissues examined. Eggermont et al. (1997) identified 4 different CLCN6 cDNAs that represent alternatively spliced transcripts. Nomura et al. (1994) mapped the CLCN6 gene to chromosome 1 using a somatic cell hybrid panel. By fluorescence in situ hybridization, Brandt and Jentsch (1995) refined the localization of the CLCN6 gene to 1p36. They noted that 2 genes encoding kidney- specific chloride channels, CLCNKA (OMIM Ref. No. 602024) and CLCNKB (OMIM Ref. No. 602023), also map to 1p36.

Full details of the abovementioned studies are described in the following publications, the disclosure of which are hereby incorporated by reference:

REFERENCES 1. Brandt, S.; Jentsch, T. J.: ClC-6 and ClC-7 are two novel broadly expressed members of the CLC chloride channel family. FEBS Lett. 377:15-20, 1995; and Eggermont, J.; Buyse, G.; Voets, T.; Tytgat, J.; De Smedt, H.; Droogmans, G.: Alternative splicing of ClC-6 (a member of the ClC chloride-channel family) transcripts generates three tr.

Further studies establishing the function and utilities of CLCN6 are found in John Hopkins OMIM database record ID 602726, and in cited publications listed in Table 5, which are hereby incorporated by reference. Chloride channel 6 (CLCN6, Accession NP_068503.1) is another GAM40 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:2020, to the nucleotide sequence of GAM40 RNA, herein designated GAM RNA, also designated SEQ ID:396.

Another function of GAM40 is therefore inhibition of Chloride channel 6 (CLCN6, Accession NP_068503.1), a gene which is a voltage- gated chloride channel. Accordingly, utilities of GAM40 include diagnosis, prevention and treatment of diseases and clinical conditions associated with CLCN6.

The function of CLCN6 has been established by previous studies. Members of the mammalian CLCN family of voltage-gated chloride channels display differential tissue distribution and perform diverse functions. Nomura et al. (1994) identified a partial human CLCN6 cDNA, which they called KIAA0046. Northern blot analysis revealed that CLCN6 was expressed widely. Using the partial cDNA sequence of Nomura et al. (1994), Brandt and Jentsch (1995) cloned human cerebral cortex cDNAs that covered the entire CLCN6 coding region. The predicted 869-amino acid protein was called CLC6 by them. The amino acid sequence of CLCN6 is 45% identical to that of CLCN7 (OMIM Ref. No. 602727) but only 23 to 29% identical to the sequences of other known CLCNs. Therefore, Brandt and Jentsch (1995) stated that CLCN6 and CLCN7 together define a new branch of the chloride channel protein family. By Northern blot analysis, Brandt and Jentsch (1995) found that CLCN6 was expressed as an approximately 6-kb mRNA in all tissues examined. Eggermont et al. (1997) identified 4 different CLCN6 cDNAs that represent alternatively spliced transcripts. Nomura et al. (1994) mapped the CLCN6 gene to chromosome 1 using a somatic cell hybrid panel. By fluorescence in situ hybridization, Brandt and Jentsch (1995) refined the localization of the CLCN6 gene to 1p36. They noted that 2 genes encoding kidney- specific chloride channels, CLCNKA (OMIM Ref. No. 602024) and CLCNKB (OMIM Ref. No. 602023), also map to 1p36.

Full details of the abovementioned studies are described in the following publications, the disclosure of which are hereby incorporated by reference:

REFERENCES 1. Brandt, S.; Jentsch, T. J.: ClC-6 and ClC-7 are two novel broadly expressed members of the CLC chloride channel family. FEBS Lett. 377:15-20, 1995; and Eggermont, J.; Buyse, G.; Voets, T.; Tytgat, J.; De Smedt, H.; Droogmans, G.: Alternative splicing of ClC-6 (a member of the ClC chloride-channel family) transcripts generates three tr.

Further studies establishing the function and utilities of CLCN6 are found in John Hopkins OMIM database record ID 602726, and in cited publications listed in Table 5, which are hereby incorporated by reference. Chloride channel 6 (CLCN6, Accession NP_068505.1) is another GAM40 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:2020, to the nucleotide sequence of GAM40 RNA, herein designated GAM RNA, also designated SEQ ID:396.

Another function of GAM40 is therefore inhibition of Chloride channel 6 (CLCN6, Accession NP_068505.1), a gene which is a voltage- gated chloride channel. Accordingly, utilities of GAM40 include diagnosis, prevention and treatment of diseases and clinical conditions associated with CLCN6.

The function of CLCN6 has been established by previous studies. Members of the mammalian CLCN family of voltage-gated chloride channels display differential tissue distribution and perform diverse functions. Nomura et al. (1994) identified a partial human CLCN6 cDNA, which they called KIAA0046. Northern blot analysis revealed that CLCN6 was expressed widely. Using the partial cDNA sequence of Nomura et al. (1994), Brandt and Jentsch (1995) cloned human cerebral cortex cDNAs that covered the entire CLCN6 coding region. The predicted 869-amino acid protein was called CLC6 by them. The amino acid sequence of CLCN6 is 45% identical to that of CLCN7 (OMIM Ref. No. 602727) but only 23 to 29% identical to the sequences of other known CLCNs. Therefore, Brandt and Jentsch (1995) stated that CLCN6 and CLCN7 together define a new branch of the chloride channel protein family. By Northern blot analysis, Brandt and Jentsch (1995) found that CLCN6 was expressed as an approximately 6-kb mRNA in all tissues examined. Eggermont et al. (1997) identified 4 different CLCN6 cDNAs that represent alternatively spliced transcripts. Nomura et al. (1994) mapped the CLCN6 gene to chromosome 1 using a somatic cell hybrid panel. By fluorescence in situ hybridization, Brandt and Jentsch (1995) refined the localization of the CLCN6 gene to 1p36. They noted that 2 genes encoding kidney- specific chloride channels, CLCNKA (OMIM Ref. No. 602024) and CLCNKB (OMIM Ref. No. 602023), also map to 1p36.

Full details of the abovementioned studies are described in the following publications, the disclosure of which are hereby incorporated by reference:

REFERENCES 1. Brandt, S.; Jentsch, T. J.: ClC-6 and ClC-7 are two novel broadly expressed members of the CLC chloride channel family. FEBS Lett. 377:15-20, 1995; and Eggermont, J.; Buyse, G.; Voets, T.; Tytgat, J.; De Smedt, H.; Droogmans, G.: Alternative splicing of ClC-6 (a member of the ClC chloride-channel family) transcripts generates three tr.

Further studies establishing the function and utilities of CLCN6 are found in John Hopkins OMIM database record ID 602726, and in cited publications listed in Table 5, which are hereby incorporated by reference. Chemokine (c-x-c motif) receptor 4 (CXCR4, Accession NP_003458.1) is another GAM40 target gene, herein designated TARGET GENE. CXCR4 BINDING SITE is a target binding site found in the 3' untranslated region of mRNA encoded by CXCR4, corresponding to a target binding site such as BINDING SITE I, BINDING SITE II or BINDING SITE III of FIG. 8. Table 4 illustrates the complementarity of the nucleotide sequences of CXCR4 BINDING SITE, designated SEQ ID:7288, to the nucleotide sequence of GAM40 RNA, herein designated GAM RNA, also designated SEQ ID:396.

Another function of GAM40 is therefore inhibition of Chemokine (c-x-c motif) receptor 4 (CXCR4, Accession NP_003458.1), a gene which mediates intracellular calcium flux. Accordingly, utilities of GAM40 include diagnosis, prevention and treatment of diseases and clinical conditions associated with CXCR4.

The function of CXCR4 has been established by previous studies. Several receptors for neuropeptide Y (NPY; 162640) have been demonstrated and shown to differ in pharmacologic characteristics, tissue distribution, and structure of the encoding genes; see the NPY Y1 receptor (NPY1R; 162641) and the NPY Y2 receptor (NPY2R; 162642). Herzog et al. (1993) cloned, sequenced, and mapped the human homolog of a proposed bovine NPY Y3 receptor reported by Rimland et al. (1991). The human cDNA clone was derived from a human lung cDNA library. The 1,670-bp sequence predicts a single open reading frame (ORF) of 352 amino acids, with 92% amino acid identity to the reported bovine sequence. The amino acid sequence shares features common to many other G protein-coupled receptors, including the 7-transmembrane regions and putative glycosylation and phosphorylation sites. The receptor shows 36% identity to the interleukin-8 receptor (IL8RA; 146929), which is located on chromosome 2, and to the angiotensin II receptor (AGTR1; 106165), but only 21% identity to the NPY Y1 receptor. Furthermore, Herzog et al. (1993) reported that NPY and a number of other ligands failed to induce any change in cytosolic calcium levels in transfected cells, suggesting that this clone represented a novel neuropeptide receptor. By PCR analysis of human/hamster hybrid cell DNA they showed that the NPY3R gene is located on human chromosome 2. Jazin et al. (1993) independently found that the Y3 receptor does not respond to NPY. The recruitment of leukocytes to inflamed tissues involves interleukin-8 (IL8; 146930) and several related chemotactic cytokines that attract and activate leukocytes. Loetscher et al. (1994) noted that these proteins are similar in size, have marked sequence similarities, and are characterized by 4 conserved cysteines that form 2 essential disulfide bonds. Two subfamilies are distinguished according to the arrangement of the first 2 cysteines, which are either adjacent (CC subfamily) or separated by one amino acid (CXC subfamily). The CXC cytokines activate primarily neutrophil leukocytes, while CC cytokines act on monocytes, basophils, and eosinophils. These chemotactic agonists act via 7-transmembrane domain, G protein-coupled receptors, e.g., the 2 interleukin-8 receptors, IL8RA and IL8RB (OMIM Ref. No. 146928). Chemotactic cytokines of the CC subfamily do not bind to IL8 receptors. Loetscher et al. (1994) isolated from a human blood monocyte cDNA library a cDNA clone encoding a protein of 352 amino acids, corresponding to a receptor of the 7-transmembrane domain, G protein-coupled type. They referred to the gene and the deduced protein as LESTR for 'leukocyte-derived seven-transmembrane domain receptor.' It shows 92.6% identity with a bovine neuropeptide Y receptor. In the monocyte library, LESTR cDNA fragments were about 20 times as frequent as cDNA coding for IL8RA and IL8RB, and much higher levels of mRNA specific for LESTR than for IL8R were found in human blood neutrophils and lymphocytes. Although the ligand for LESTR could not be identified among a large number of chemotactic cytokines, the high expression in white blood cells and the marked sequence relation to IL8RA and IL8RB suggested to Loetscher et al. (1994) that LESTR may function in the activation of inflammatory cells. CXCR4 mRNA is expressed at sites of neuronal and progenitor cell migration in the hippocampus at late embryonic and early postnatal ages. SDF1 mRNA, the only known ligand for the CXCR4 receptor, is expressed close to these migration sites, in the meninges investing the hippocampal primordium and in the primordium itself. In mice engineered to lack the CXCR4 receptor, Lu et al. (2002) found that the morphology of the hippocampal dentate gyrus was dramatically altered. Gene expression markers for dentate gyrus granule neurons and bromodeoxyuridine labeling of dividing cells showed an underlying defect in the stream of postmitotic cells and secondary dentate progenitor cells that migrate toward and form the dentate gyrus. In the absence of CXCR4, the number of dividing cells in the migratory stream and in the dentate gyrus itself was reduced, and neurons appeared to differentiate prematurely before reaching their target. Thus, Lu et al. (2002) concluded that the SDF1/CXCR4 chemokine signaling system has a role in dentate gyrus morphogenesis. The dentate gyrus is unusual as a site of adult neurogenesis. They found that both CXCR4 and SDF1 are expressed in the adult dentate gyrus, suggesting an ongoing role in dentate gyrus morphogenesis Full details of the abovementioned studies are described in the following publications, the disclosure of which are hereby incorporated by reference:

Lu, M.; Grove, E. A.; Miller, R. J.: Abnormal development of the hippocampal dentate gyrus in mice lacking the CXCR4 chemokine receptor. Proc. Nat. Acad. Sci. 99:7090-7095, 2002; and Ma, Q.; Jones, D.; Borghesani, P. R.; Segal, R. A.; Nagasawa, T.; Kishimoto, T.; Bronson, R. T.; Springer, T. A.: Impaired B-lymphopoiesis, myelopoiesis, and derailed cerebellar neur.

Further studies establishing the function and utilities of CXCR4 are found in John Hopkins OMIM database record ID 162643, and in cited publications listed in Table 5, which are hereby incorporated by reference. CYP19A1 (Accession NP_000094.2) is another GAM40 target gene, herein designated TARGET GENE. CYP19A1 BINDING SITE is a target binding site found in the 3' untranslated region of multiple transcripts of mRNA encoded by CYP19A1, corresponding to a target binding site such as BINDING SITE I, BINDING SITE II or BINDING SITE III of FIG. 8. Table 4 illustrates the complementarity of the nucleotide sequences of CYP19A1 BINDING SITE, designated SEQ ID:20107, to the nucleotide sequence of GAM40 RNA, herein designated GAM RNA, also designated SEQ ID:396.

Another function of GAM40 is therefore inhibition of CYP19A1 (Accession NP_000094.2). Accordingly, utilities of GAM40 include diagnosis, prevention and treatment of diseases and clinical conditions associated with CYP19A1.

CYP19A1 (Accession NP_112503.1) is another GAM40target gene, herein designated TARGET GENE. CYP19A1 BINDING SITE is a target binding site found in the 3' untranslated region of multiple transcripts of mRNA encoded by CYP19A1, corresponding to a target binding site such as BINDING SITE I, BINDING SITE II or BINDING SITE III of FIG. 8. Table 4 illustrates the complementarity of the nucleotide sequences of CYP19A1 BINDING SITE, designated SEQ ID:20107, to the nucleotide sequence of GAM40 RNA, herein designated GAM RNA, also designated SEQ ID:396.

Another function of GAM40 is therefore inhibition of CYP19A1 (Accession NP_112503.1). Accordingly, utilities of GAM40 include diagnosis, prevention and treatment of diseases and clinical conditions associated with CYP19A1.

DKFZp547G183 (Accession NP_061175.1) is another GAM40 target gene, herein designated TARGET GENE. DKFZp547G183 BINDING SITE is a target binding site found in the 3' untranslated region of mRNA encoded by DKFZp547G183, corresponding to a target binding site such as BINDING SITE I, BINDING SITE II or BINDING SITE III of FIG. 8. Table 4 illustrates the complementarity of the nucleotide sequences of DKFZp547G183 BINDING SITE, designated SEQ ID:18002, to the nucleotide sequence of GAM40 RNA, herein designated GAM RNA, also designated SEQ ID:396.

Another function of GAM40 is therefore inhibition of DKFZp547G183 (Accession NP_061175.1). Accordingly, utilities of GAM40 include diagnosis, prevention and treatment of diseases and clinical conditions associated with DKFZp547G183.

Dystrophin (muscular dystrophy, duchenne and becker types) (DMD, Accession NP_004004.1) is another GAM40 target gene, herein designated TARGET GENE. DMD BINDING SITE is a target binding site found in the 5' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:16644, to the nucleotide sequence of GAM40 RNA, herein designated GAM RNA, also designated SEQ ID:396.

Another function of GAM40 is therefore inhibition of Dystrophin (muscular dystrophy, duchenne and becker types) (DMD, Accession NP_004004.1), a gene which muscular dystrophy and therefore is associated with Duchenne muscular dystrophy (dmd) and becker muscular dystrophy. Accordingly, utilities of GAM40 include diagnosis, prevention and treatment of Duchenne muscular dystrophy (dmd) and becker muscular dystrophy, and of other diseases and clinical conditions associated with DMD.

The function of DMD has been established by previous studies. Roberts et al. (1992) described a general approach to the identification of the basic defect in the one-third of DMD patients who do not show a gross rearrangement of the dystrophin gene. The method involved nested amplification, chemical mismatched detection, and sequencing of reverse transcripts of trace amounts of dystrophin mRNA from peripheral blood lymphocytes. Analysis of the entire coding region (11 kb) in 7 patients resulted in detection of a sequence change in each case that was clearly sufficient to cause the disease. All the mutations were expected to cause premature translation termination, and the resulting phenotypes were thus equivalent to those caused by frameshifting deletions; see 300377.0003-300377.0009. Deletions and point mutations in the DMD gene cause either DMD or the milder Becker muscular dystrophy, depending on whether the translational reading frame is lost or maintained. De Angelis et al. (2002) reasoned that because internal in-frame deletions in the protein produce only mild myopathic symptoms, a partially corrected phenotype could be restored by preventing the inclusion of specific mutated exons in the mature dystrophin mRNA. Such control had previously been accomplished by the use of synthetic oligonucleotides. To circumvent the disadvantageous necessity for periodic administration of the synthetic oligonucleotides, De Angelis et al. (2002) produced several constructs able to express in vivo, in a stable fashion, large amounts of chimeric RNAs containing antisense sequences. They showed that antisense molecules against exon 51 splice junctions were able to direct skipping of that exon in the human DMD deletion 48-50 and to rescue dystrophin synthesis. They also showed that the highest skipping activity occurred when antisense constructs against the 5-prime and 3-prime splice sites were coexpressed in the same cell. The effects were tested in cultured myoblasts from a DMD patient. The deletion of exons 48-50 resulted in a premature termination codon in exon 51. The antisense sequences complementary to exon 51 splice junctions induced efficient skipping of exon 51 and partial rescue of dystrophin synthesis. X-linked dilated cardiomyopathy is a dystrophinopathy characterized by severe cardiomyopathy with no skeletal muscle involvement. Several XLCM patients have been described with mutations that abolish dystrophin muscle isoform expression, but with increased expression of brain and cerebellar Purkinje isoforms of the gene exclusively in the skeletal muscle. Bastianutto et al. (2001) determined that 2 XLCM patients bore deletions that removed the muscle promoter and exon 1, but not the brain and cerebellar Purkinje promoters. The brain and cerebellar Purkinje promoters were found to be essentially inactive in muscle cell lines and primary cultures. Since dystrophin muscle enhancer 1 (DME1), a muscle-specific enhancer, is preserved in these patients, the authors tested its ability to upregulate the brain and cerebellar Purkinje promoters in muscle cells. Brain and cerebellar Purkinje promoter activity was significantly increased in the presence of DME1, and activation was observed exclusively in cells presenting a skeletal muscle phenotype versus cardiomyocytes. The authors suggested a role for DME1 in the induction of brain and cerebellar Purkinje isoform expression in the skeletal muscle of XLCM patients defective for muscle isoform expression.

Animal model experiments lend further support to the function of DMD. Using DNA microarray, Porter et al. (2002) established a molecular signature of dystrophinopathy in the mdx mouse. In leg muscle, 242 differentially expressed genes were identified. Data provided evidence for coordinated activity of numerous components of a chronic inflammatory response, including cytokine and chemokine signaling, leukocyte adhesion and diapedesis, invasive cell type-specific markers, and complement system activation. Upregulation of secreted phosphoprotein 1 (SPP1; 166490) mRNA and protein in dystrophic muscle identified a novel linkage between inflammatory cells and repair processes. Extracellular matrix genes were upregulated in mdx to levels similar to those in DMD. Since, unlike DMD, mdx exhibits little fibrosis, data suggested that collagen regulation at posttranscriptional stages may mediate extensive fibrosis in DMD.

It is appreciated that the abovementioned animal model for DMD is acknowledged by those skilled in the art as a scientifically valid animal model, as can be further appreciated from the publications sited hereinbelow.

Full details of the abovementioned studies are described in the following publications, the disclosure of which are hereby incorporated by reference:

De Angelis, F. G.; Sthandier, O.; Berarducci, B.; Toso, S.; Galluzzi, G.; Ricci, E.; Cossu, G.; Bozzoni, I.: Chimeric snRNA molecules carrying antisense sequences against the splice junctions of exon 51 of the dystrophin pre-mRNA induce exon skipping and restoration of a dystrophin synthesis in delta-48-50 DMD cells. Proc Nat. Acad. Sci. 99:9456-9461, 2002; and Bastianutto, C.; Bestard, J. A.; Lahnakoski, K.; Broere, D.; DeVisser, M.; Zaccolo, M.; Pozzan, T.; Ferlini, A.; Muntoni, F.; Patarnello, T.; Klamut, H. J.: Dystrophin muscle enhance.

Further studies establishing the function and utilities of DMD are found in John Hopkins OMIM database record ID 300377, and in cited publications listed in Table 5, which are hereby incorporated by reference. Dystrophin (muscular dystrophy, duchenne and becker types) (DMD, Accession NP_004014.1) is another GAM40 target gene, herein designated TARGET GENE. DMD BINDING SITE is a target binding site found in the 5' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:16644, to the nucleotide sequence of GAM40 RNA, herein designated GAM RNA, also designated SEQ ID:396.

Another function of GAM40 is therefore inhibition of Dystrophin (muscular dystrophy, duchenne and becker types) (DMD, Accession NP_004014.1), a gene which muscular dystrophy.and therefore is associated with Duchenne muscular dystrophy (dmd) and becker muscular dystrophy. Accordingly, utilities of GAM40 include diagnosis, prevention and treatment of Duchenne muscular dystrophy (dmd) and becker muscular dystrophy, and of other diseases and clinical conditions associated with DMD.

The function of DMD has been established by previous studies. Roberts et al. (1992) described a general approach to the identification of the basic defect in the one-third of DMD patients who do not show a gross rearrangement of the dystrophin gene. The method involved nested amplification, chemical mismatched detection, and sequencing of reverse transcripts of trace amounts of dystrophin mRNA from peripheral blood lymphocytes. Analysis of the entire coding region (11 kb) in 7 patients resulted in detection of a sequence change in each case that was clearly sufficient to cause the disease. All the mutations were expected to cause premature translation termination, and the resulting phenotypes were thus equivalent to those caused by frameshifting deletions; see 300377.0003-300377.0009. Deletions and point mutations in the DMD gene cause either DMD or the milder Becker muscular dystrophy, depending on whether the translational reading frame is lost or maintained. De Angelis et al. (2002) reasoned that because internal in-frame deletions in the protein produce only mild myopathic symptoms, a partially corrected phenotype could be restored by preventing the inclusion of specific mutated exons in the mature dystrophin mRNA. Such control had previously been accomplished by the use of synthetic oligonucleotides. To circumvent the disadvantageous necessity for periodic administration of the synthetic oligonucleotides, DeAngelis et al. (2002) produced several constructs able to express in vivo, in a stable fashion, large amounts of chimeric RNAs containing antisense sequences. They showed that antisense molecules against exon 51 splice junctions were able to direct skipping of that exon in the human DMD deletion 48-50 and to rescue dystrophin synthesis. They also showed that the highest skipping activity occurred when antisense constructs against the 5-prime and 3-prime splice sites were coexpressed in the same cell. The effects were tested in cultured myoblasts from a DMD patient. The deletion of exons 48-50 resulted in a premature termination codon in exon 51. The antisense sequences complementary to exon 51 splice junctions induced efficient skipping of exon 51 and partial rescue of dystrophin synthesis. X-linked dilated cardiomyopathy is a dystrophinopathy characterized by severe cardiomyopathy with no skeletal muscle involvement. Several XLCM patients have been described with mutations that abolish dystrophin muscle isoform expression, but with increased expression of brain and cerebellar Purkinje isoforms of the gene exclusively in the skeletal muscle. Bastianutto et al. (2001) determined that 2 XLCM patients bore deletions that removed the muscle promoter and exon 1, but not the brain and cerebellar Purkinje promoters. The brain and cerebellar Purkinje promoters were found to be essentially inactive in muscle cell lines and primary cultures. Since dystrophin muscle enhancer 1 (DME1), a muscle-specific enhancer, is preserved in these patients, the authors tested its ability to upregulate the brain and cerebellar Purkinje promoters in muscle cells. Brain and cerebellar Purkinje promoter activity was significantly increased in the presence of DME1, and activation was observed exclusively in cells presenting a skeletal muscle phenotype versus cardiomyocytes. The authors suggested a role for DME1 in the induction of brain and cerebellar Purkinje isoform expression in the skeletal muscle of XLCM patients defective for muscle isoform expression.

Animal model experiments lend further support to the function of DMD. Using DNA microarray, Porter et al. (2002) established a molecular signature of dystrophinopathy in the mdx mouse. In leg muscle, 242 differentially expressed genes were identified. Data provided evidence for coordinated activity of numerous components of a chronic inflammatory response, including cytokine and chemokine signaling, leukocyte adhesion and diapedesis, invasive cell type-specific markers, and complement system activation. Upregulation of secreted phosphoprotein 1 (SPP1; 166490) mRNA and protein in dystrophic muscle identified a novel linkage between inflammatory cells and repair processes. Extracellular matrix genes were upregulated in mdx to levels similar to those in DMD. Since, unlike DMD, mdx exhibits little fibrosis, data suggested that collagen regulation at posttranscriptional stages may mediate extensive fibrosis in DMD.

It is appreciated that the abovementioned animal model for DMD is acknowledged by those skilled in the art as a scientifically valid animal model, as can be further appreciated from the publications sited hereinbelow.

Full details of the abovementioned studies are described in the following publications, the disclosure of which are hereby incorporated by reference:

De Angelis, F. G.; Sthandier, O.; Berarducci, B.; Toso, S.; Galluzzi, G.; Ricci, E.; Cossu, G.; Bozzoni, I.: Chimeric snRNA molecules carrying antisense sequences against the splice junctions of exon 51 of the dystrophin pre-mRNA induce exon skipping and restoration of a dystrophin synthesis in delta-48-50 DMD cells. Proc Nat. Acad. Sci. 99:9456-9461, 2002; and Bastianutto, C.; Bestard, J. A.; Lahnakoski, K.; Broere, D.; DeVisser, M.; Zaccolo, M.; Pozzan, T.; Ferlini, A.; Muntoni, F.; Patarnello, T.; Klamut, H. J.: Dystrophin muscle enhance.

Further studies establishing the function and utilities of DMD are found in John Hopkins OMIM database record ID 300377, and in cited publications listed in Table 5, which are hereby incorporated by reference. Dystrophin (muscular dystrophy, duchenne and becker types) (DMD, Accession NP_004013.1) is another GAM40 target gene, herein designated TARGET GENE. DMD BINDING SITE is a target binding site found in the 5' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:16644, to the nucleotide sequence of GAM40 RNA, herein designated GAM RNA, also designated SEQ ID:396.

Another function of GAM40 is therefore inhibition of Dystrophin (muscular dystrophy, duchenne and becker types) (DMD, Accession NP_004013.1), a gene which muscular dystrophy.and therefore is associated with Duchenne muscular dystrophy (dmd) and becker muscular dystrophy. Accordingly, utilities of GAM40 include diagnosis, prevention and treatment of Duchenne muscular dystrophy (dmd) and becker muscular dystrophy, and of other diseases and clinical conditions associated with DMD.

The function of DMD has been established by previous studies. Roberts et al. (1992) described a general approach to the identification of the basic defect in the one-third of DMD patients who do not show a gross rearrangement of the dystrophin gene. The method involved nested amplification, chemical mismatched detection, and sequencing of reverse transcripts of trace amounts of dystrophin mRNA from peripheral blood lymphocytes. Analysis of the entire coding region (11 kb) in 7 patients resulted in detection of a sequence change in each case that was clearly sufficient to cause the disease. All the mutations were expected to cause premature translation termination, and the resulting phenotypes were thus equivalent to those caused by frameshifting deletions; see 300377.0003-300377.0009. Deletions and point mutations in the DMD gene cause either DMD or the milder Becker muscular dystrophy, depending on whether the translational reading frame is lost or maintained. De Angelis et al. (2002) reasoned that because internal in-frame deletions in the protein produce only mild myopathic symptoms, a partially corrected phenotype could be restored by preventing the inclusion of specific mutated exons in the mature dystrophin mRNA. Such control had previously been accomplished by the use of synthetic oligonucleotides. To circumvent the disadvantageous necessity for periodic administration of the synthetic oligonucleotides, De Angelis et al. (2002) produced several constructs able to express in vivo, in a stable fashion, large amounts of chimeric RNAs containing antisense sequences. They showed that antisense molecules against exon 51 splice junctions were able to direct skipping of that exon in the human DMD deletion 48-50 and to rescue dystrophin synthesis. They also showed that the highest skipping activity occurred when antisense constructs against the 5-prime and 3-prime splice sites were coexpressed in the same cell. The effects were tested in cultured myoblasts from a DMD patient. The deletion of exons 48-50 resulted in a premature termination codon in exon 51. The antisense sequences complementary to exon 51 splice junctions induced efficient skipping of exon 51 and partial rescue of dystrophin synthesis. X-linked dilated cardiomyopathy is a dystrophinopathy characterized by severe cardiomyopathy with no skeletal muscle involvement. Several XLCM patients have been described with mutations that abolish dystrophin muscle isoform expression, but with increased expression of brain and cerebellar Purkinje isoforms of the gene exclusively in the skeletal muscle. Bastianutto et al. (2001) determined that 2 XLCM patients bore deletions that removed the muscle promoter and exon 1, but not the brain and cerebellar Purkinje promoters. The brain and cerebellar Purkinje promoters were found to be essentially inactive in muscle cell lines and primary cultures. Since dystrophin muscle enhancer 1 (DME1), a muscle-specific enhancer, is preserved in these patients, the authors tested its ability to upregulate the brain and cerebellar Purkinje promoters in muscle cells. Brain and cerebellar Purkinje promoter activity was significantly increased in the presence of DME1, and activation was observed exclusively in cells presenting a skeletal muscle phenotype versus cardiomyocytes. The authors suggested a role for DME1 in the induction of brain and cerebellar Purkinje isoform expression in the skeletal muscle of XLCM patients defective for muscle isoform expression.

Animal model experiments lend further support to the function of DMD. Using DNA microarray, Porter et al. (2002) established a molecular signature of dystrophinopathy in the mdx mouse. In leg muscle, 242 differentially expressed genes were identified. Data provided evidence for coordinated activity of numerous components of a chronic inflammatory response, including cytokine and chemokine signaling, leukocyte adhesion and diapedesis, invasive cell type-specific markers, and complement system activation. Upregulation of secreted phosphoprotein 1 (SPP1; 166490) mRNA and protein in dystrophic muscle identified a novel linkage between inflammatory cells and repair processes. Extracellular matrix genes were upregulated in mdx to levels similar to those in DMD. Since, unlike DMD, mdx exhibits little fibrosis, data suggested that collagen regulation at posttranscriptional stages may mediate extensive fibrosis in DMD.

It is appreciated that the abovementioned animal model for DMD is acknowledged by those skilled in the art as a scientifically valid animal model, as can be further appreciated from the publications sited hereinbelow.

Full details of the abovementioned studies are described in the following publications, the disclosure of which are hereby incorporated by reference:

De Angelis, F. G.; Sthandier, O.; Berarducci, B.; Toso, S.; Galluzzi, G.; Ricci, E.; Cossu, G.; Bozzoni, I.: Chimeric snRNA molecules carrying antisense sequences against the splice junctions of exon 51 of the dystrophin pre-mRNA induce exon skipping and restoration of a dystrophin synthesis in delta-48-50 DMD cells. Proc Nat. Acad. Sci. 99:9456-9461, 2002; and Bastianutto, C.; Bestard, J. A.; Lahnakoski, K.; Broere, D.; De Visser, M.; Zaccolo, M.; Pozzan, T.; Ferlini, A.; Muntoni, F.; Patarnello, T.; Klamut, H. J.: Dystrophin muscle enhance.

Further studies establishing the function and utilities of DMD are found in John Hopkins OMIM database record ID 300377, and in cited publications listed in Table 5, which are hereby incorporated by reference. Dystrophin (muscular dystrophy, duchenne and becker types) (DMD, Accession NP_004011.1) is another GAM40 target gene, herein designated TARGET GENE. DMD BINDING SITE is a target binding site found in the 5' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:16644, to the nucleotide sequence of GAM40 RNA, herein designated GAM RNA, also designated SEQ ID:396.

Another function of GAM40 is therefore inhibition of Dystrophin (muscular dystrophy, duchenne and becker types) (DMD, Accession NP_004011.1), a gene which muscular dystrophy.and therefore is associated with Duchenne muscular dystrophy (dmd) and becker muscular dystrophy. Accordingly, utilities of GAM40 include diagnosis, prevention and treatment of Duchenne muscular dystrophy (dmd) and becker muscular dystrophy, and of other diseases and clinical conditions associated with DMD.

The function of DMD has been established by previous studies. Roberts et al. (1992) described a general approach to the identification of the basic defect in the one-third of DMD patients who do not show a gross rearrangement of the dystrophin gene. The method involved nested amplification, chemical mismatched detection, and sequencing of reverse transcripts of trace amounts of dystrophin mRNA from peripheral blood lymphocytes. Analysis of the entire coding region (11 kb) in 7 patients resulted in detection of a sequence change in each case that was clearly sufficient to cause the disease. All the mutations were expected to cause premature translation termination, and the resulting phenotypes were thus equivalent to those caused by frameshifting deletions; see 300377.0003-300377.0009. Deletions and point mutations in the DMD gene cause either DMD or the milder Becker muscular dystrophy, depending on whether the translational reading frame is lost or maintained. De Angelis et al. (2002) reasoned that because internal in-frame deletions in the protein produce only mild myopathic symptoms, a partially corrected phenotype could be restored by preventing the inclusion of specific mutated exons in the mature dystrophin mRNA. Such control had previously been accomplished by the use of synthetic oligonucleotides. To circumvent the disadvantageous necessity for periodic administration of the synthetic oligonucleotides, De Angelis et al. (2002) produced several constructs able to express in vivo, in a stable fashion, large amounts of chimeric RNAs containing antisense sequences. They showed that antisense molecules against exon 51 splice junctions were able to direct skipping of that exon in the human DMD deletion 48-50 and to rescue dystrophin synthesis. They also showed that the highest skipping activity occurred when antisense constructs against the 5-prime and 3-prime splice sites were coexpressed in the same cell. The effects were tested in cultured myoblasts from a DMD patient. The deletion of exons 48-50 resulted in a premature termination codon in exon 51. The antisense sequences complementary to exon 51 splice junctions induced efficient skipping of exon 51 and partial rescue of dystrophin synthesis. X-linked dilated cardiomyopathy is a dystrophinopathy characterized by severe cardiomyopathy with no skeletal muscle involvement. Several XLCM patients have been described with mutations that abolish dystrophin muscle isoform expression, but with increased expression of brain and cerebellar Purkinje isoforms of the gene exclusively in the skeletal muscle. Bastianutto et al. (2001) determined that 2 XLCM patients bore deletions that removed the muscle promoter and exon 1, but not the brain and cerebellar Purkinje promoters. The brain and cerebellar Purkinje promoters were found to be essentially inactive in muscle cell lines and primary cultures. Since dystrophin muscle enhancer 1 (DME1), a muscle-specific enhancer, is preserved in these patients, the authors tested its ability to upregulate the brain and cerebellar Purkinje promoters in muscle cells. Brain and cerebellar Purkinje promoter activity was significantly increased in the presence of DME1, and activation was observed exclusively in cells presenting a skeletal muscle phenotype versus cardiomyocytes. The authors suggested a role for DME1 in the induction of brain and cerebellar Purkinje isoform expression in the skeletal muscle of XLCM patients defective for muscle isoform expression.

Animal model experiments lend further support to the function of DMD. Using DNA microarray, Porter et al. (2002) established a molecular signature of dystrophinopathy in the mdx mouse. In leg muscle, 242 differentially expressed genes were identified. Data provided evidence for coordinated activity of numerous components of a chronic inflammatory response, including cytokine and chemokine signaling, leukocyte adhesion and diapedesis, invasive cell type-specific markers, and complement system activation. Upregulation of secreted phosphoprotein 1 (SPP1; 166490) mRNA and protein in dystrophic muscle identified a novel linkage between inflammatory cells and repair processes. Extracellular matrix genes were upregulated in mdx to levels similar to those in DMD. Since, unlike DMD, mdx exhibits little fibrosis, data suggested that collagen regulation at posttranscriptional stages may mediate extensive fibrosis in DMD.

It is appreciated that the abovementioned animal model for DMD is acknowledged by those skilled in the art as a scientifically valid animal model, as can be further appreciated from the publications sited hereinbelow.

Full details of the abovementioned studies are described in the following publications, the disclosure of which are hereby incorporated by reference:

De Angelis, F. G.; Sthandier, O.; Berarducci, B.; Toso, S.; Galluzzi, G.; Ricci, E.; Cossu, G.; Bozzoni, I.: Chimeric snRNA molecules carrying antisense sequences against the splice junctions of exon 51 of the dystrophin pre-mRNA induce exon skipping and restoration of a dystrophin synthesis in delta-48-50 DMD cells. Proc Nat. Acad. Sci. 99:9456-9461, 2002; and Bastianutto, C.; Bestard, J. A.; Lahnakoski, K.; Broere, D.; De Visser, M.; Zaccolo, M.; Pozzan, T.; Ferlini, A.; Muntoni, F.; Patarnello, T.; Klamut, H. J.: Dystrophin muscle enhance.

Further studies establishing the function and utilities of DMD are found in John Hopkins OMIM database record ID 300377, and in cited publications listed in Table 5, which are hereby incorporated by reference. Dystrophin (muscular dystrophy, duchenne and becker types) (DMD, Accession NP_004012.1) is another GAM40 target gene, herein designated TARGET GENE. DMD BINDING SITE is a target binding site found in the 5' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:16644, to the nucleotide sequence of GAM40 RNA, herein designated GAM RNA, also designated SEQ ID:396.

Another function of GAM40 is therefore inhibition of Dystrophin (muscular dystrophy, duchenne and becker types) (DMD, Accession NP_004012.1), a gene which muscular dystrophy.and therefore is associated with Duchenne muscular dystrophy (dmd) and becker muscular dystrophy. Accordingly, utilities of GAM40 include diagnosis, prevention and treatment of Duchenne muscular dystrophy (dmd) and becker muscular dystrophy, and of other diseases and clinical conditions associated with DMD.

The function of DMD has been established by previous studies. Roberts et al. (1992) described a general approach to the identification of the basic defect in the one-third of DMD patients who do not show a gross rearrangement of the dystrophin gene. The method involved nested amplification, chemical mismatched detection, and sequencing of reverse transcripts of trace amounts of dystrophin mRNA from peripheral blood lymphocytes. Analysis of the entire coding region (11 kb) in 7 patients resulted in detection of a sequence change in each case that was clearly sufficient to cause the disease. All the mutations were expected to cause premature translation termination, and the resulting phenotypes were thus equivalent to those caused by frameshifting deletions; see 300377.0003-300377.0009. Deletions and point mutations in the DMD gene cause either DMD or the milder Becker muscular dystrophy, depending on whether the translational reading frame is lost or maintained. De Angelis et al. (2002) reasoned that because internal in-frame deletions in the protein produce only mild myopathic symptoms, a partially corrected phenotype could be restored by preventing the inclusion of specific mutated exons in the mature dystrophin mRNA. Such control had previously been accomplished by the use of synthetic oligonucleotides. To circumvent the disadvantageous necessity for periodic administration of the synthetic oligonucleotides, De Angelis et al. (2002) produced several constructs able to express in vivo, in a stable fashion, large amounts of chimeric RNAs containing antisense sequences. They showed that antisense molecules against exon 51 splice junctions were able to direct skipping of that exon in the human DMD deletion 48-50 and to rescue dystrophin synthesis. They also showed that the highest skipping activity occurred when antisense constructs against the 5-prime and 3-prime splice sites were coexpressed in the same cell. The effects were tested in cultured myoblasts from a DMD patient. The deletion of exons 48-50 resulted in a premature termination codon in exon 51. The antisense sequences complementary to exon 51 splice junctions induced efficient skipping of exon 51 and partial rescue of dystrophin synthesis. X-linked dilated cardiomyopathy is a dystrophinopathy characterized by severe cardiomyopathy with no skeletal muscle involvement. Several XLCM patients have been described with mutations that abolish dystrophin muscle isoform expression, but with increased expression of brain and cerebellar Purkinje isoforms of the gene exclusively in the skeletal muscle. Bastianutto et al. (2001) determined that 2 XLCM patients bore deletions that removed the muscle promoter and exon 1, but not the brain and cerebellar Purkinje promoters. The brain and cerebellar Purkinje promoters were found to be essentially inactive in muscle cell lines and primary cultures. Since dystrophin muscle enhancer 1 (DME1), a muscle-specific enhancer, is preserved in these patients, the authors tested its ability to upregulate the brain and cerebellar Purkinje promoters in muscle cells. Brain and cerebellar Purkinje promoter activity was significantly increased in the presence of DME1, and activation was observed exclusively in cells presenting a skeletal muscle phenotype versus cardiomyocytes. The authors suggested a role for DME1 in the induction of brain and cerebellar Purkinje isoform expression in the skeletal muscle of XLCM patients defective for muscle isoform expression.

Animal model experiments lend further support to the function of DMD. Using DNA microarray, Porter et al. (2002) established a molecular signature of dystrophinopathy in the mdx mouse. In leg muscle, 242 differentially expressed genes were identified. Data provided evidence for coordinated activity of numerous components of a chronic inflammatory response, including cytokine and chemokine signaling, leukocyte adhesion and diapedesis, invasive cell type-specific markers, and complement system activation. Upregulation of secreted phosphoprotein 1 (SPP1; 166490) mRNA and protein in dystrophic muscle identified a novel linkage between inflammatory cells and repair processes. Extracellular matrix genes were upregulated in mdx to levels similar to those in DMD. Since, unlike DMD, mdx exhibits little fibrosis, data suggested that collagen regulation at posttranscriptional stages may mediate extensive fibrosis in DMD.

It is appreciated that the abovementioned animal model for DMD is acknowledged by those skilled in the art as a scientifically valid animal model, as can be further appreciated from the publications sited hereinbelow.

Full details of the abovementioned studies are described in the following publications, the disclosure of which are hereby incorporated by reference:

De Angelis, F. G.; Sthandier, O.; Berarducci, B.; Toso, S.; Galluzzi, G.; Ricci, E.; Cossu, G.; Bozzoni, I.: Chimeric snRNA molecules carrying antisense sequences against the splice junctions of exon 51 of the dystrophin pre-mRNA induce exon skipping and restoration of a dystrophin synthesis in delta-48-50 DMD cells. Proc Nat. Acad. Sci. 99:9456-9461, 2002; and Bastianutto, C.; Bestard, J. A.; Lahnakoski, K.; Broere, D.; De Visser, M.; Zaccolo, M.; Pozzan, T.; Ferlini, A.; Muntoni, F.; Patarnello, T.; Klamut, H. J.: Dystrophin muscle enhance.

Further studies establishing the function and utilities of DMD are found in John Hopkins OMIM database record ID 300377, and in cited publications listed in Table 5, which are hereby incorporated by reference. Dolichyl-phosphate mannosyltransferase polypeptide 2, regulatory subunit (DPM2, Accession NP_689903.1) is another GAM40 target gene, herein designated TARGET GENE. DPM2 BINDING SITE is a target binding site found in the 3' untranslated region of multiple transcripts of mRNA encoded by DPM2, corresponding to a target binding site such as BINDING SITE I, BINDING SITE II or BINDING SITE III of FIG. 8. Table 4 illustrates the complementarity of the nucleotide sequences of DPM2 BINDING SITE, designated SEQ ID:18873, to the nucleotide sequence of GAM40 RNA, herein designated GAM RNA, also designated SEQ ID:396.

Another function of GAM40 is therefore inhibition of Dolichyl-phosphate mannosyltransferase polypeptide 2, regulatory subunit (DPM2, Accession NP_689903.1). Accordingly, utilities of GAM40 include diagnosis, prevention and treatment of diseases and clinical conditions associated with DPM2.

Dolichyl-phosphate mannosyltransferase polypeptide 2, regulatory subunit (DPM2, Accession NP_003854.1) is another GAM40 target gene, herein designated TARGET GENE. DPM2 BINDING SITE is a target binding site found in the 3' untranslated region of multiple transcripts of mRNA encoded by DPM2, corresponding to a target binding site such as BINDING SITE I, BINDING SITE II or BINDING SITE III of FIG. 8. Table 4 illustrates the complementarity of the nucleotide sequences of DPM2 BINDING SITE, designated SEQ ID:18873, to the nucleotide sequence of GAM40 RNA, herein designated GAM RNA, also designated SEQ ID:396.

Another function of GAM40 is therefore inhibition of Dolichyl-phosphate mannosyltransferase polypeptide 2, regulatory subunit (DPM2, Accession NP_003854.1). Accordingly, utilities of GAM40 include diagnosis, prevention and treatment of diseases and clinical conditions associated with DPM2.

DT1P1A10 (Accession NP_477511.1) is another GAM40 target gene, herein designated TARGET GENE. DT1P1A10 BINDING SITE is a target binding site found in the 3' untranslated region of mRNA encoded by DT1P1A10, corresponding to a target binding site such as BINDING SITE I, BINDING SITE II or BINDING SITE III of FIG. 8. Table 4 illustrates the complementarity of the nucleotide sequences of DT1P1A10 BINDING SITE, designated SEQ ID:3408, to the nucleotide sequence of GAM40 RNA, herein designated GAM RNA, also designated SEQ ID:396.

Another function of GAM40 is therefore inhibition of DT1P1A10 (Accession NP_477511.1). Accordingly, utilities of GAM40 include diagnosis, prevention and treatment of diseases and clinical conditions associated with DT1P1A10.

E74-like factor 5 (ets domain transcription factor) (ELF5, Accession NP_001413.1) is another GAM40 target gene, herein designated TARGET GENE. ELF5 BINDING SITE is a target binding site found in the 5' untranslated region of mRNA encoded by ELF5, corresponding to a target binding site such as BINDING SITE I, BINDING SITE II or BINDING SITE III of FIG. 8. Table 4 illustrates the complementarity of the nucleotide sequences of ELF5 BINDING SITE, designated SEQ ID:16375, to the nucleotide sequence of GAM40 RNA, herein designated GAM RNA, also designated SEQ ID:396.

Another function of GAM40 is therefore inhibition of E74-like factor 5 (ets domain transcription factor) (ELF5, Accession NP_001413.1), a gene which may have a role in germline development. Accordingly, utilities of GAM40 include diagnosis, prevention and treatment of diseases and clinical conditions associated with ELF5.

The function of ELF5 has been established by previous studies. Members of the ETS family of transcription factors (see OMIM Ref. No. 164720) have been implicated in control of cell proliferation and tumorigenesis. See Sharrocks et al. (1997) for further discussion of the ETS family. Oettgen et al. (1999) isolated a novel epithelium-specific ETS gene, ESE2, by screening a human cDNA database for sequences showing homology to ETS family members. Two isoforms of ESE2 were identified, differing at the amino terminus. ESE2a encodes a predicted protein of 265 amino acids with molecular weight 31.3 kD. ESE2b encodes a protein of 255 amino acids with molecular weight 30.1 kD. ESE2a has a 10-amino acid extension at its amino terminus as compared to ESE2b. ESE2 has several tyrosine kinase, casein kinase II (see OMIM Ref. No. 115440), and protein kinase C (see OMIM Ref. No. 176960) consensus phosphorylation sites. Northern blot analysis of poly(A+) RNA identified an ESE2 transcript between 2.4 and 2.6 kb in length. Expression was highest in kidney and prostate, both of which have high epithelial cell content. Further analysis by dot blot confirmed expression in epithelial cell-rich tissues, including salivary gland, mammary gland, fetal kidney, and trachea. RT-PCR using isoform-specific PCR primers showed differential expression of ESE2a and 2b. Kidney expressed only ESE2a, while prostate expressed both isoforms, with levels of ESE2b being higher. ESE2 expression was upregulated during keratinocyte differentiation, similar to that of ESE1, but occurred at a later stage. In electrophoretic mobility shift assay, ESE2a did not demonstrate specific binding to a Drosophila E74 ETS binding site. A truncated version of ESE2a lacking the first 42 amino acids did bind this site specifically. The truncated ESE2a also bound to the regulatory regions of several glandular epithelium-specific genes. Zhou et al. (1998) isolated a human ELF5 cDNA from a human lung cDNA library. By PCR using gene-specific primers and the Genebridge 4 radiation hybrid DNA panel, they mapped the ELF5/ESE2 gene to chromosome 11p15-p13, a region of the genome that frequently undergoes loss of heterozygosity in several types of cancer. Upon screening several cancer cell lines for expression, the authors observed ELF5/ESE2 mRNA in a progesterone-sensitive ductal breast carcinoma cell line only. Southern blot analysis showed evidence of loss of heterozygosity in the lung carcinoma cell lines NCI-H358 and NCI-H441, and rearrangement of the gene in 2 other lung carcinoma cell lines, SK-LU-1 and NCI-H661.

Full details of the abovementioned studies are described in the following publications, the disclosure of which are hereby incorporated by reference:

Oettgen, P.; Kas, K.; Dube, A.; Gu, X.; Grall, F.; Thamrongsak, U.; Akbarali, Y.; Finger, E.; Boltax, J.; Endress, G.; Munger, K.; Kunsch, C.; Libermann, T. A.: Characterization of ESE-2, a novel ESE-1-related ETS transcription factor that is restricted to glandular epithelium and differentiated keratinocytes. J. Biol. Chem. 274:29439-29452, 1999; and Sharrocks, A. D.; Brown, A. L.; Ling, Y.; Yates, P. R.: The ETS-domain transcription factor family. Int. J. Biochem. Cell Biol. 29:1371-1387, 1997.

Further studies establishing the function and utilities of ELF5 are found in John Hopkins OMIM database record ID 605169, and in cited publications listed in Table 5, which are hereby incorporated by reference. Epithelial membrane protein 1 (EMP1, Accession NP_001414.1) is another GAM40 target gene, herein designated TARGET GENE. EMP1 BINDING SITE is a target binding site found in the 3' untranslated region of mRNA encoded by EMP1, corresponding to a target binding site such as BINDING SITE I, BINDING SITE II or BINDING SITE III of FIG. 8. Table 4 illustrates the complementarity of the nucleotide sequences of EMP1 BINDING SITE, designated SEQ ID:8730, to the nucleotide sequence of GAM40 RNA, herein designated GAM RNA, also designated SEQ ID:396.

Another function of GAM40 is therefore inhibition of Epithelial membrane protein 1 (EMP1, Accession NP_001414.1), a gene which plays a role in squamous cell differentiation; member of the PMP22/EMP/MP20 family of membrane glycoproteins. Accordingly, utilities of GAM40 include diagnosis, prevention and treatment of diseases and clinical conditions associated with EMP1.

The function of EMP1 has been established by previous studies. Ben-Porath and Benvenisty (1996) cloned a cDNA encoding epithelial membrane protein-1 (EMP1), named TMP by them, using RT-PCR on human embryo kidney RNA. Ruegg et al. (1996) independently isolated a cDNA encoding EMP1, termed B4B by them, using differential display PCR. The predicted 157-amino acid EMP1 protein contains 4 transmembrane domains and 2 potential N-linked glycosylation sites in the first extracellular loop. Chen et al. (1997) found that EMP1, named CL-20 by them, shares 39% amino acid identity with peripheral myelin protein-22 (PMP22; 601097); the conserved amino acids are located predominantly within the membrane-spanning domains. Due to the high amino acid sequence homology among PMP22, EMP1, EMP2 (OMIM Ref. No. 602334), and EMP3 (OMIM Ref. No. 602335), Ben-Porath and Benvenisty (1996) proposed that these proteins are members of a novel family. Based on the suggested functions of PMP22, they proposed that EMP1 is involved in cell-cell interactions and the control of cell proliferation. Chen et al. (1997) found that the EMP1 gene contains 5 exons and 4 introns, and they noted that the exon/intron junctions are located at the same positions as those of PMP22, suggesting that EMP1 and PMP22 arose by duplication of a common ancestral gene. Using Northern blot analysis, they detected a 2.8-kb EMP1 transcript in most of the adult tissues examined, but not in brain, liver, pancreas, or peripheral blood leukocytes. Using RT-PCR, Ben-Porath and Benvenisty (1996) detected EMP1 expression in embryonic kidney, brain, and gut, but not in liver and thymus. Marvin et al. (1995) localized the EMP1 gene to chromosome 12 using a somatic cell hybrid panel. By fluorescence in situ hybridization, Chen et al. (1997) and Ruegg et al. (1996) mapped the EMP1 gene to 12p12 and 20q12-q13.1, respectively. By FISH, somatic cell hybridization, and radiation hybrid analysis, Liehr et al. (1999) confirmed assignment of the EMP1 gene to chromosome 12p12.3. Ben Porath et al. (1998) mapped the homologous gene in the mouse to chromosome 6.

Full details of the abovementioned studies are described in the following publications, the disclosure of which are hereby incorporated by reference:

Ben Porath, I.; Kozak, C. A.; Benvenisty, N.: Chromosomal mapping of Tmp (Emp1), Xmp (Emp2), and Ymp (Emp3), genes encoding membrane proteins related to Pmp22. Genomics 49:443-447, 1998; and Chen, Y.; Medvedev, A.; Ruzanov, P.; Marvin, K. W.; Jetten, A. M.: cDNA cloning, genomic structure, and chromosome mapping of the human epithelial membrane protein CL- 20 gene (EMP1), a.

Further studies establishing the function and utilities of EMP1 are found in John Hopkins OMIM database record ID 602333, and in cited publications listed in Table 5, which are hereby incorporated by reference. Erythropoietin (EPO, Accession NP_000790.1) is another GAM40 target gene, herein designated TARGET GENE. EPO BINDING SITE is a target binding site found in the 3' untranslated region of mRNA encoded by EPO, corresponding to a target binding site such as BINDING SITE I, BINDING SITE II or BINDING SITE III of FIG. 8. Table 4 illustrates the complementarity of the nucleotide sequences of EPO BINDING SITE, designated SEQ ID:3988, to the nucleotide sequence of GAM40 RNA, herein designated GAM RNA, also designated SEQ ID:396.

Another function of GAM40 is therefore inhibition of Erythropoietin (EPO, Accession NP_000790.1). Accordingly, utilities of GAM40 include diagnosis, prevention and treatment of diseases and clinical conditions associated with EPO.

FAT3 (Accession XP_061871.5) is another GAM40 target gene, herein designated TARGET GENE. FAT3 BINDING SITE is a target binding site found in the 3' untranslated region of mRNA encoded by FAT3, corresponding to a target binding site such as BINDING SITE I, BINDING SITE II or BINDING SITE III of FIG. 8. Table 4 illustrates the complementarity of the nucleotide sequences of FAT3 BINDING SITE, designated SEQ ID:4550, to the nucleotide sequence of GAM40 RNA, herein designated GAM RNA, also designated SEQ ID:396.

Another function of GAM40 is therefore inhibition of FAT3 (Accession XP_061871.5). Accordingly, utilities of GAM40 include diagnosis, prevention and treatment of diseases and clinical conditions associated with FAT3.

F-box and leucine-rich repeat protein 7 (FBXL7, Accession NP_036436.1) is another GAM40 target gene, herein designated TARGET GENE. FBXL7 BINDING SITE is a target binding site found in the 3' untranslated region of mRNA encoded by FBXL7, corresponding to a target binding site such as BINDING SITE I, BINDING SITE II or BINDING SITE III of FIG. 8. Table 4 illustrates the complementarity of the nucleotide sequences of FBXL7 BINDING SITE, designated SEQ ID:13859, to the nucleotide sequence of GAM40 RNA, herein designated GAM RNA, also designated SEQ ID:396.

Another function of GAM40 is therefore inhibition of F-box and leucine-rich repeat protein 7 (FBXL7, Accession NP_036436.1), a gene which may be involved in in phosphorylation-dependent ubiquitination. Accordingly, utilities of GAM40 include diagnosis, prevention and treatment of diseases and clinical conditions associated with FBXL7.

The function of FBXL7 has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). Winston et al. (1999) predicted the presence of 12 leucine-rich repeats (LRRs) in FBXL7. RT-PCR analysis detected strong expression in all tissues tested, with highest levels in heart, kidney, liver, and lung.

Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XII. The complete sequences of 100 new cDNA clones from brain which code for large proteins in vitro. DNA Res. 5:355-364, 1998; and Winston, J. T.; Koepp, D. M.; Zhu, C.; Elledge, S. J.; Harper, J. W.: A family of mammalian F-box proteins. Curr. Biol. 9:1180-1182, 1999.

Further studies establishing the function and utilities of FBXL7 are found in John Hopkins OMIM database record ID 605656, and in cited publications listed in Table 5, which are hereby incorporated by reference. FLJ12800 (Accession NP_075054.1) is another GAM40 target gene, herein designated TARGET GENE. FLJ12800 BINDING SITE is a target binding site found in the 3' untranslated region of mRNA encoded by FLJ12800, corresponding to a target binding site such as BINDING SITE I, BINDING SITE II or BINDING SITE III of FIG. 8. Table 4 illustrates the complementarity of the nucleotide sequences of FLJ12800 BINDING SITE, designated SEQ ID:1742, to the nucleotide sequence of GAM40 RNA, herein designated GAM RNA, also designated SEQ ID:396.

Another function of GAM40 is therefore inhibition of FLJ12800 (Accession NP_075054.1). Accordingly, utilities of GAM40 include diagnosis, prevention and treatment of diseases and clinical conditions associated with FLJ12800.

FLJ12875 (Accession NP_078820.1) is another GAM40 target gene, herein designated TARGET GENE. FLJ12875 BINDING SITE is a target binding site found in the 3' untranslated region of mRNA encoded by FLJ12875, corresponding to a target binding site such as BINDING SITE I, BINDING SITE II or BINDING SITE III of FIG. 8. Table 4 illustrates the complementarity of the nucleotide sequences of FLJ12875 BINDING SITE, designated SEQ ID:5414, to the nucleotide sequence of GAM40 RNA, herein designated GAM RNA, also designated SEQ ID:396.

Another function of GAM40 is therefore inhibition of FLJ12875 (Accession NP_078820.1). Accordingly, utilities of GAM40 include diagnosis, prevention and treatment of diseases and clinical conditions associated with FLJ12875.

FLJ13154 (Accession NP_078874.1) is another GAM40 target gene, herein designated TARGET GENE. FLJ13154 BINDING SITE is a target binding site found in the 3' untranslated region of mRNA encoded by FLJ13154, corresponding to a target binding site such as BINDING SITE I, BINDING SITE II or BINDING SITE III of FIG. 8. Table 4 illustrates the complementarity of the nucleotide sequences of FLJ13154 BINDING SITE, designated SEQ ID:14841, to the nucleotide sequence of GAM40 RNA, herein designated GAM RNA, also designated SEQ ID:396.

Another function of GAM40 is therefore inhibition of FLJ13154 (Accession NP_078874.1). Accordingly, utilities of GAM40 include diagnosis, prevention and treatment of diseases and clinical conditions associated with FLJ13154.

FLJ14082 (Accession NP_079300.1) is another GAM40 target gene, herein designated TARGET GENE. FLJ14082 BINDING SITE is a target binding site found in the 3' untranslated region of mRNA encoded by FLJ14082, corresponding to a target binding site such as BINDING SITE I, BINDING SITE II or BINDING SITE III of FIG. 8. Table 4 illustrates the complementarity of the nucleotide sequences of FLJ14082 BINDING SITE, designated SEQ ID:6617, to the nucleotide sequence of GAM40 RNA, herein designated GAM RNA, also designated SEQ ID:396.

Another function of GAM40 is therefore inhibition of FLJ14082 (Accession NP_079300.1). Accordingly, utilities of GAM40 include diagnosis, prevention and treatment of diseases and clinical conditions associated with FLJ14082.

FLJ14753 (Accession NP_115947.1) is another GAM40 target gene, herein designated TARGET GENE. FLJ14753 BINDING SITE is a target binding site found in the 5' untranslated region of mRNA encoded by FLJ14753, corresponding to a target binding site such as BINDING SITE I, BINDING SITE II or BINDING SITE III of FIG. 8. Table 4 illustrates the complementarity of the nucleotide sequences of FLJ14753 BINDING SITE, designated SEQ ID:17383, to the nucleotide sequence of GAM40 RNA, herein designated GAM RNA, also designated SEQ ID:396.

Another function of GAM40 is therefore inhibition of FLJ14753 (Accession NP_115947.1). Accordingly, utilities of GAM40 include diagnosis, prevention and treatment of diseases and clinical conditions associated with FLJ14753.

FLJ22833 (Accession NP_073748.1) is another GAM40 target gene, herein designated TARGET GENE. FLJ22833 BINDING SITE is a target binding site found in the 3' untranslated region of mRNA encoded by FLJ22833, corresponding to a target binding site such as BINDING SITE I, BINDING SITE II or BINDING SITE III of FIG. 8. Table 4 illustrates the complementarity of the nucleotide sequences of FLJ22833 BINDING SITE, designated SEQ ID:18402, to the nucleotide sequence of GAM40 RNA, herein designated GAM RNA, also designated SEQ ID:396.

Another function of GAM40 is therefore inhibition of FLJ22833 (Accession NP_073748.1). Accordingly, utilities of GAM40 include diagnosis, prevention and treatment of diseases and clinical conditions associated with FLJ22833.

FLJ25976 (Accession NP_777603.1) is another GAM40 target gene, herein designated TARGET GENE. FLJ25976 BINDING SITE is a target binding site found in the 5' untranslated region of mRNA encoded by FLJ25976, corresponding to a target binding site such as BINDING SITE I, BINDING SITE II or BINDING SITE III of FIG. 8. Table 4 illustrates the complementarity of the nucleotide sequences of FLJ25976 BINDING SITE, designated SEQ ID:11913, to the nucleotide sequence of GAM40 RNA, herein designated GAM RNA, also designated SEQ ID:396.

Another function of GAM40 is therefore inhibition of FLJ25976 (Accession NP_777603.1). Accordingly, utilities of GAM40 include diagnosis, prevention and treatment of diseases and clinical conditions associated with FLJ25976.

FLJ32310 (Accession NP_689549.1) is another GAM40 target gene, herein designated TARGET GENE. FLJ32310 BINDING SITE is a target binding site found in the 3' untranslated region of mRNA encoded by FLJ32310, corresponding to a target binding site such as BINDING SITE I, BINDING SITE II or BINDING SITE III of FIG. 8. Table 4 illustrates the complementarity of the nucleotide sequences of FLJ32310 BINDING SITE, designated SEQ ID:2295, to the nucleotide sequence of GAM40 RNA, herein designated GAM RNA, also designated SEQ ID:396.

Another function of GAM40 is therefore inhibition of FLJ32310 (Accession NP_689549.1). Accordingly, utilities of GAM40 include diagnosis, prevention and treatment of diseases and clinical conditions associated with FLJ32310.

FLJ38771 (Accession NP_775782.1) is another GAM40 target gene, herein designated TARGET GENE. FLJ38771 BINDING SITE1 and FLJ38771 BINDING SITE2 are target binding sites found in untranslated regions of mRNA encoded by FLJ38771, corresponding to target binding sites such as BINDING SITE I, BINDING SITE II or BINDING SITE III of FIG. 8. Table 4 illustrates the complementarity of the nucleotide sequences of FLJ38771 BINDING SITE1 and FLJ38771 BINDING SITE2, designated SEQ ID:10364 and SEQ ID:16753 respectively, to the nucleotide sequence of GAM40 RNA, herein designated GAM RNA, also designated SEQ ID:396.

Another function of GAM40 is therefore inhibition of FLJ38771 (Accession NP_775782.1). Accordingly, utilities of GAM40 include diagnosis, prevention and treatment of diseases and clinical conditions associated with FLJ38771.

FLJ39249 (Accession NP_775935.1) is another GAM40 target gene, herein designated TARGET GENE. FLJ39249 BINDING SITE is a target binding site found in the 3' untranslated region of mRNA encoded by FLJ39249, corresponding to a target binding site such as BINDING SITE I, BINDING SITE II or BINDING SITE III of FIG. 8. Table 4 illustrates the complementarity of the nucleotide sequences of FLJ39249 BINDING SITE, designated SEQ ID:17581, to the nucleotide sequence of GAM40 RNA, herein designated GAM RNA, also designated SEQ ID:396.

Another function of GAM40 is therefore inhibition of FLJ39249 (Accession NP_775935.1). Accordingly, utilities of GAM40 include diagnosis, prevention and treatment of diseases and clinical conditions associated with FLJ39249.

FLJ40434 (Accession NP_848596.1) is another GAM40 target gene, herein designated TARGET GENE. FLJ40434 BINDING SITE is a target binding site found in the 3' untranslated region of mRNA encoded by FLJ40434, corresponding to a target binding site such as BINDING SITE I, BINDING SITE II or BINDING SITE III of FIG. 8. Table 4 illustrates the complementarity of the nucleotide sequences of FLJ40434 BINDING SITE, designated SEQ ID:5127, to the nucleotide sequence of GAM40 RNA, herein designated GAM RNA, also designated SEQ ID:396.

Another function of GAM40 is therefore inhibition of FLJ40434 (Accession NP_848596.1). Accordingly, utilities of GAM40 include diagnosis, prevention and treatment of diseases and clinical conditions associated with FLJ40434.

Interleukin 1 receptor, type i (IL1R1, Accession NP_000868.1) is another GAM40 target gene, herein designated TARGET GENE. IL1R1 BINDING SITE is a target binding site found in the 3' untranslated region of mRNA encoded by IL1R1, corresponding to a target binding site such as BINDING SITE I, BINDING SITE II or BINDING SITE III of FIG. 8. Table 4 illustrates the complementarity of the nucleotide sequences of IL1R1 BINDING SITE, designated SEQ ID:6956, to the nucleotide sequence of GAM40 RNA, herein designated GAM RNA, also designated SEQ ID:396.

Another function of GAM40 is therefore inhibition of Interleukin 1 receptor, type i (IL1R1, Accession NP_000868.1), a gene which is a receptor for interleukin-1 alpha (il-1a), beta (il-1b), and interleukin-1 receptor antagonist protein (il-1ra). Accordingly, utilities of GAM40 include diagnosis, prevention and treatment of diseases and clinical conditions associated with IL1R1.

The function of IL1R1 has been established by previous studies. Interleukin-1, which has a role as a mediator in inflammation, actually consists of 2 separate but related proteins, IL1-alpha (OMIM Ref. No. 147720) and IL1-beta (OMIM Ref. No. 147760). Dower et al. (1986) showed that the cell surface receptors for the 2 forms of interleukin-1 are identical. Sims et al. (1989) cloned the human IL1R gene and compared it with the mouse gene. Both contain a single membrane-spanning segment, a large cytoplasmic region, and an extracellular, IL1-binding portion composed of 3 immunoglobulin-like domains. The IL1R gene expressed in human dermal fibroblasts was found to be identical to that expressed in T cells. By a combination of somatic cell hybrid analysis and chromosomal in situ hybridization, Copeland et al. (1991) mapped the IL1R gene to human chromosome 2q12. By RFLP analysis in interspecific backcrosses, Copeland et al. (1991) mapped the corresponding mouse gene at the centromeric end of chromosome 1, a region homologous to a portion of human chromosome 2

Full details of the abovementioned studies are described in the following publications, the disclosure of which are hereby incorporated by reference:

Dower, S. K.; Kronheim, S. R.; Hopp, T. P.; Cantrell, M.; Deeley, M.; Gillis, S.; Henney, C. S.; Urdal, D. L.: The cell surface receptors for interleukin-1(alpha) and interleukin-1 (beta) are identical. Nature 324:266-268, 1986; and Sims, J. E.; Acres, R. B.; Grubin, C. E.; McMahan, C. J.; Wignall, J. M.; March, C. J.; Dower, S. K.: Cloning the interleukin 1 receptor from human T cells. Proc. Nat. Acad. Sci. 86:89.

Further studies establishing the function and utilities of IL1R1 are found in John Hopkins OMIM database record ID 147810, and in cited publications listed in Table 5, which are hereby incorporated by reference. Interferon regulatory factor 4 (IRF4, Accession NP_002451.1) is another GAM40 target gene, herein designated TARGET GENE. IRF4 BINDING SITE is a target binding site found in the 3' untranslated region of mRNA encoded by IRF4, corresponding to a target binding site such as BINDING SITE I, BINDING SITE II or BINDING SITE III of FIG. 8. Table 4 illustrates the complementarity of the nucleotide sequences of IRF4 BINDING SITE, designated SEQ ID:18288, to the nucleotide sequence of GAM40 RNA, herein designated GAM RNA, also designated SEQ ID:396.

Another function of GAM40 is therefore inhibition of Interferon regulatory factor 4 (IRF4, Accession NP_002451.1). Accordingly, utilities of GAM40 include diagnosis, prevention and treatment of diseases and clinical conditions associated with IRF4.

Insulin receptor substrate 3-like (IRS3L, Accession XP_295210.1) is another GAM40 target gene, herein designated TARGET GENE. IRS3L BINDING SITE is a target binding site found in the 3' untranslated region of mRNA encoded by IRS3L, corresponding to a target binding site such as BINDING SITE I, BINDING SITE II or BINDING SITE III of FIG. 8. Table 4 illustrates the complementarity of the nucleotide sequences of IRS3L BINDING SITE, designated SEQ ID:11000, to the nucleotide sequence of GAM40 RNA, herein designated GAM RNA, also designated SEQ ID:396.

Another function of GAM40 is therefore inhibition of Insulin receptor substrate 3-like (IRS3L, Accession XP_295210.1). Accordingly, utilities of GAM40 include diagnosis, prevention and treatment of diseases and clinical conditions associated with IRS3L.

Integrin, alpha 10 (ITGA10, Accession NP_003628.1) is another GAM40 target gene, herein designated TARGET GENE. ITGA10 BINDING SITE is a target binding site found in the 3' untranslated region of mRNA encoded by ITGA10, corresponding to a target binding site such as BINDING SITE I, BINDING SITE II or BINDING SITE III of FIG. 8. Table 4 illustrates the complementarity of the nucleotide sequences of ITGA10 BINDING SITE, designated SEQ ID:19590, to the nucleotide sequence of GAM40 RNA, herein designated GAM RNA, also designated SEQ ID:396.

Another function of GAM40 is therefore inhibition of Integrin, alpha 10 (ITGA10, Accession NP_003628.1). Accordingly, utilities of GAM40 include diagnosis, prevention and treatment of diseases and clinical conditions associated with ITGA10.

Kallmann syndrome 1 sequence (KAL1, Accession NP_000207.1) is another GAM40 target gene, herein designated TARGET GENE. KAL1 BINDING SITE is a target binding site found in the 3' untranslated region of mRNA encoded by KAL1, corresponding to a target binding site such as BINDING SITE I, BINDING SITE II or BINDING SITE III of FIG. 8. Table 4 illustrates the complementarity of the nucleotide sequences of KAL1 BINDING SITE, designated SEQ ID:4267, to the nucleotide sequence of GAM40 RNA, herein designated GAM RNA, also designated SEQ ID:396.

Another function of GAM40 is therefore inhibition of Kallmann syndrome 1 sequence (KAL1, Accession NP_000207.1). Accordingly, utilities of GAM40 include diagnosis, prevention and treatment of diseases and clinical conditions associated with KAL1.

Potassium voltage-gated channel, shaker-related subfamily, beta member 2 (KCNAB2, Accession NP_742128.1) is another GAM40 target gene, herein designated TARGET GENE. KCNAB2 BINDING SITE is a target binding site found in the 3' untranslated region of multiple transcripts of mRNA encoded by KCNAB2, corresponding to a target binding site such as BINDING SITE I, BINDING SITE II or BINDING SITE III of FIG. 8. Table 4 illustrates the complementarity of the nucleotide sequences of KCNAB2 BINDING SITE, designated SEQ ID:13392, to the nucleotide sequence of GAM40 RNA, herein designated GAM RNA, also designated SEQ ID:396.

Another function of GAM40 is therefore inhibition of Potassium voltage-gated channel, shaker-related subfamily, beta member 2 (KCNAB2, Accession NP_742128.1), a gene which is the beta subunit of shaker voltage-gated potassium channels. Accordingly, utilities of GAM40 include diagnosis, prevention and treatment of diseases and clinical conditions associated with KCNAB2.

The function of KCNAB2 has been established by previous studies. 'Shaker' and other voltage-dependent potassium channel proteins help to determine the electrical properties of excitable cells and play additional physiologic roles in non-excitable cell types. See KCNA1 (OMIM Ref. No. 176260). Mammalian Shaker potassium channel alpha subunits associate with cytoplasmic beta subunits that modulate the inactivation of the channel. The beta subunits belong to a superfamily of NAD(P)H-dependent enzymes, suggesting that they may be involved in additional physiologic processes. Shaker potassium channel complexes are thought to be composed of 4 alpha and 4 beta subunits. By PCR of a human hippocampal library with degenerate primers based on conserved regions of rat beta-1 (KCNA1B; 601141) and beta-2 subunits, McCormack et al. (1995) isolated cDNAs encoding human beta-1 and beta-2. The predicted 367-amino acid human, bovine, and rat beta-2 subunits are 99% identical.

Unlike beta-1, the beta-2 subunit does not contain an N-terminal inactivation 'ball' domain. Instead, functional studies of beta-2 expressed in Xenopus oocytes indicated that it increased the rate of the endogenous Kv1.4 alpha subunit (OMIM Ref. No. 176266) inactivation process. Leicher et al. (1998) reported that the KCNA2B gene contains 15 exons and spans approximately 70 kb. The exon/intron structure of KCNA2B is comparable to that of KCNA1B and KCNA3B (OMIM Ref. No. 604111), although the size of the introns varies significantly among the genes. By analysis of somatic cell hybrids and by FISH, Schultz et al. (1996) mapped the KCNA2B gene to 1p36.3. The results of Gong et al. (1999) suggested that ZIP, the rat homolog of p62 (OMIM Ref. No. 601530), acts as a link that targets the activity of Kv-beta- 2 and PKC-zeta Full details of the abovementioned studies are described in the following publications, the disclosure of which are hereby incorporated by reference:

Gong, J.; Xu, J.; Bezanilla, M.; van Huizen, R.; Derin, R.; Li, M.: Differential stimulation of PKC phosphorylation of potassium channels by ZIP1 and ZIP2. Science 285:1565-1569, 1999; and Leicher, T.; Bahring, R.; Isbrandt, D.; Pongs, O.: Coexpression of the KCNA3B gene product with Kv1.5 leads to a novel A-type potassium channel. J. Biol. Chem. 273:35095-35101, 1998.

Further studies establishing the function and utilities of KCNAB2 are found in John Hopkins OMIM database record ID 601142, and in cited publications listed in Table 5, which are hereby incorporated by reference. Potassium voltage-gated channel, shaker-related subfamily, beta member 2 (KCNAB2, Accession NP_003627.1) is another GAM40 target gene, herein designated TARGET GENE. KCNAB2 BINDING SITE is a target binding site found in the 3' untranslated region of multiple transcripts of mRNA encoded by KCNAB2, corresponding to a target binding site such as BINDING SITE I, BINDING SITE II or BINDING SITE III of FIG. 8. Table 4 illustrates the complementarity of the nucleotide sequences of KCNAB2 BINDING SITE, designated SEQ ID:13392, to the nucleotide sequence of GAM40 RNA, herein designated GAM RNA, also designated SEQ ID:396.

Another function of GAM40 is therefore inhibition of Potassium voltage-gated channel, shaker-related subfamily, beta member 2 (KCNAB2, Accession NP_003627.1), a gene which is the beta subunit of shaker voltage-gated potassium channels. Accordingly, utilities of GAM40 include diagnosis, prevention and treatment of diseases and clinical conditions associated with KCNAB2.

The function of KCNAB2 has been established by previous studies. 'Shaker' and other voltage-dependent potassium channel proteins help to determine the electrical properties of excitable cells and play additional physiologic roles in nonexcitable cell types. See KCNA1 (OMIM Ref. No. 176260). Mammalian Shaker potassium channel alpha subunits associate with cytoplasmic beta subunits that modulate the inactivation of the channel. The beta subunits belong to a superfamily of NAD(P)H-dependent enzymes, suggesting that they may be involved in additional physiologic processes. Shaker potassium channel complexes are thought to be composed of 4 alpha and 4 beta subunits. By PCR of a human hippocampal library with degenerate primers based on conserved regions of rat beta-1 (KCNA1B; 601141) and beta-2 subunits, McCormack et al. (1995) isolated cDNAs encoding human beta-1 and beta-2. The predicted 367-amino acid human, bovine, and rat beta-2 subunits are 99% identical. Unlike beta-1, the beta-2 subunit does not contain an N-terminal inactivation 'ball' domain. Instead, functional studies of beta-2 expressed in Xenopus oocytes indicated that it increased the rate of the endogenous Kv1.4 alpha subunit (OMIM Ref. No. 176266) inactivation process. Leicher et al. (1998) reported that the KCNA2B gene contains 15 exons and spans approximately 70 kb. The exon/intron structure of KCNA2B is comparable to that of KCNA1B and KCNA3B (OMIM Ref. No. 604111), although the size of the introns varies significantly among the genes. By analysis of somatic cell hybrids and by FISH, Schultz et al. (1996) mapped the KCNA2B gene to 1p36.3. The results of Gong et al. (1999) suggested that ZIP, the rat homolog of p62 (OMIM Ref. No. 601530), acts as a link that targets the activity of Kv-beta- 2 and PKC-zeta Full details of the abovementioned studies are described in the following publications, the disclosure of which are hereby incorporated by reference:

Gong, J.; Xu, J.; Bezanilla, M.; van Huizen, R.; Derin, R.; Li, M.: Differential stimulation of PKC phosphorylation of potassium channels by ZIP1 and ZIP2. Science 285:1565-1569, 1999; and Leicher, T.; Bahring, R.; Isbrandt, D.; Pongs, O.: Coexpression of the KCNA3B gene product with Kv1.5 leads to a novel A-type potassium channel. J. Biol. Chem. 273:35095-35101, 1998.

Further studies establishing the function and utilities of KCNAB2 are found in John Hopkins OMIM database record ID 601142, and in cited publications listed in Table 5, which are hereby incorporated by reference. KIAA0215 (Accession NP_055550.1) is another GAM40 target gene, herein designated TARGET GENE. KIAA0215 BINDING SITE is a target binding site found in the 3' untranslated region of mRNA encoded by KIAA0215, corresponding to a target binding site such as BINDING SITE I, BINDING SITE II or BINDING SITE III of FIG. 8. Table 4 illustrates the complementarity of the nucleotide sequences of KIAA0215 BINDING SITE, designated SEQ ID:13419, to the nucleotide sequence of GAM40 RNA, herein designated GAM RNA, also designated SEQ ID:396.

Another function of GAM40 is therefore inhibition of KIAA0215 (Accession NP_055550.1). Accordingly, utilities of GAM40 include diagnosis, prevention and treatment of diseases and clinical conditions associated with KIAA0215.

KIAA0239 (Accession NP_056103.2) is another GAM40 target gene, herein designated TARGET GENE. KIAA0239 BINDING SITE is a target binding site found in the 3' untranslated region of mRNA encoded by KIAA0239, corresponding to a target binding site such as BINDING SITE I, BINDING SITE II or BINDING SITE III of FIG. 8. Table 4 illustrates the complementarity of the nucleotide sequences of KIAA0239 BINDING SITE, designated SEQ ID:7703, to the nucleotide sequence of GAM40 RNA, herein designated GAM RNA, also designated SEQ ID:396.

Another function of GAM40 is therefore inhibition of KIAA0239 (Accession NP_056103.2). Accordingly, utilities of GAM40 include diagnosis, prevention and treatment of diseases and clinical conditions associated with KIAA0239.

KIAA0326 (Accession XP_034819.1) is another GAM40 target gene, herein designated TARGET GENE. KIAA0326 BINDING SITE is a target binding site found in the 3' untranslated region of mRNA encoded by KIAA0326, corresponding to a target binding site such as BINDING SITE I, BINDING SITE II or BINDING SITE III of FIG. 8. Table 4 illustrates the complementarity of the nucleotide sequences of KIAA0326 BINDING SITE, designated SEQ ID:1236, to the nucleotide sequence of GAM40 RNA, herein designated GAM RNA, also designated SEQ ID:396.

Another function of GAM40 is therefore inhibition of KIAA0326 (Accession XP_034819.1). Accordingly, utilities of GAM40 include diagnosis, prevention and treatment of diseases and clinical conditions associated with KIAA0326.

KIAA0534 (Accession XP_049349.8) is another GAM40 target gene, herein designated TARGET GENE. KIAA0534 BINDING SITE is a target binding site found in the 3' untranslated region of mRNA encoded by KIAA0534, corresponding to a target binding site such as BINDING SITE I, BINDING SITE II or BINDING SITE III of FIG. 8. Table 4 illustrates the complementarity of the nucleotide sequences of KIAA0534 BINDING SITE, designated SEQ ID:6434, to the nucleotide sequence of GAM40 RNA, herein designated GAM RNA, also designated SEQ ID:396.

Another function of GAM40 is therefore inhibition of KIAA0534 (Accession XP_049349.8). Accordingly, utilities of GAM40 include diagnosis, prevention and treatment of diseases and clinical conditions associated with KIAA0534.

KIAA0794 (Accession XP_087353.4) is another GAM40 target gene, herein designated TARGET GENE. KIAA0794 BINDING SITE is a target binding site found in the 3' untranslated region of mRNA encoded by KIAA0794, corresponding to a target binding site such as BINDING SITE I, BINDING SITE II or BINDING SITE III of FIG. 8. Table 4 illustrates the complementarity of the nucleotide sequences of KIAA0794 BINDING SITE, designated SEQ ID:1060, to the nucleotide sequence of GAM40 RNA, herein designated GAM RNA, also designated SEQ ID:396.

Another function of GAM40 is therefore inhibition of KIAA0794 (Accession XP_087353.4). Accordingly, utilities of GAM40 include diagnosis, prevention and treatment of diseases and clinical conditions associated with KIAA0794.

KIAA1157 (Accession XP_051093.2) is another GAM40 target gene, herein designated TARGET GENE. KIAA1157 BINDING SITE is a target binding site found in the 3' untranslated region of mRNA encoded by KIAA1157, corresponding to a target binding site such as BINDING SITE I, BINDING SITE II or BINDING SITE III of FIG. 8. Table 4 illustrates the complementarity of the nucleotide sequences of KIAA1157 BINDING SITE, designated SEQ ID:14430, to the nucleotide sequence of GAM40 RNA, herein designated GAM RNA, also designated SEQ ID:396.

Another function of GAM40 is therefore inhibition of KIAA1157 (Accession XP_051093.2). Accordingly, utilities of GAM40 include diagnosis, prevention and treatment of diseases and clinical conditions associated with KIAA1157.

KIAA1463 (Accession XP_051160.2) is another GAM40 target gene, herein designated TARGET GENE. KIAA1463 BINDING SITE is a target binding site found in the 3' untranslated region of mRNA encoded by KIAA1463, corresponding to a target binding site such as BINDING SITE I, BINDING SITE II or BINDING SITE III of FIG. 8. Table 4 illustrates the complementarity of the nucleotide sequences of KIAA1463 BINDING SITE, designated SEQ ID:4325, to the nucleotide sequence of GAM40 RNA, herein designated GAM RNA, also designated SEQ ID:396.

Another function of GAM40 is therefore inhibition of KIAA1463 (Accession XP_051160.2). Accordingly, utilities of GAM40 include diagnosis, prevention and treatment of diseases and clinical conditions associated with KIAA1463.

KIAA1729 (Accession XP_114418.2) is another GAM40 target gene, herein designated TARGET GENE. KIAA1729 BINDING SITE is a target binding site found in the 3' untranslated region of mRNA encoded by KIAA1729, corresponding to a target binding site such as BINDING SITE I, BINDING SITE II or BINDING SITE III of FIG. 8. Table 4 illustrates the complementarity of the nucleotide sequences of KIAA1729 BINDING SITE, designated SEQ ID:4832, to the nucleotide sequence of GAM40 RNA, herein designated GAM RNA, also designated SEQ ID:396.

Another function of GAM40 is therefore inhibition of KIAA1729 (Accession XP_114418.2). Accordingly, utilities of GAM40 include diagnosis, prevention and treatment of diseases and clinical conditions associated with KIAA1729.

KIAA1935 (Accession XP_087672.1) is another GAM40 target gene, herein designated TARGET GENE. KIAA1935 BINDING SITE is a target binding site found in the 3' untranslated region of mRNA encoded by KIAA1935, corresponding to a target binding site such as BINDING SITE I, BINDING SITE II or BINDING SITE III of FIG. 8. Table 4 illustrates the complementarity of the nucleotide sequences of KIAA1935 BINDING SITE, designated SEQ ID:19854, to the nucleotide sequence of GAM40 RNA, herein designated GAM RNA, also designated SEQ ID:396.

Another function of GAM40 is therefore inhibition of KIAA1935 (Accession XP_087672.1). Accordingly, utilities of GAM40 include diagnosis, prevention and treatment of diseases and clinical conditions associated with KIAA1935.

KIAA2001 (Accession XP_291322.1) is another GAM40 target gene, herein designated TARGET GENE. KIAA2001 BINDING SITE is a target binding site found in the 3' untranslated region of mRNA encoded by KIAA2001, corresponding to a target binding site such as BINDING SITE I, BINDING SITE II or BINDING SITE III of FIG. 8. Table 4 illustrates the complementarity of the nucleotide sequences of KIAA2001 BINDING SITE, designated SEQ ID:9738, to the nucleotide sequence of GAM40 RNA, herein designated GAM RNA, also designated SEQ ID:396.

Another function of GAM40 is therefore inhibition of KIAA2001 (Accession XP_291322.1). Accordingly, utilities of GAM40 include diagnosis, prevention and treatment of diseases and clinical conditions associated with KIAA2001.

Kruppel-like factor 12 (KLF12, Accession NP_057369.1) is another GAM40 target gene, herein designated TARGET GENE. KLF12 BINDING SITE is a target binding site found in the 3' untranslated region of multiple transcripts of mRNA encoded by KLF12, corresponding to a target binding site such as BINDING SITE I, BINDING SITE II or BINDING SITE III of FIG. 8. Table 4 illustrates the complementarity of the nucleotide sequences of KLF12 BINDING SITE, designated SEQ ID:8149, to the nucleotide sequence of GAM40 RNA, herein designated GAM RNA, also designated SEQ ID:396.

Another function of GAM40 is therefore inhibition of Kruppel-like factor 12 (KLF12, Accession NP_057369.1). Accordingly, utilities of GAM40 include diagnosis, prevention and treatment of diseases and clinical conditions associated with KLF12.

Kelch-like 3 (drosophila) (KLHL3, Accession NP_059111.1) is another GAM40 target gene, herein designated TARGET GENE. KLHL3 BINDING SITE is a target binding site found in the 3' untranslated region of mRNA encoded by KLHL3, corresponding to a target binding site such as BINDING SITE I, BINDING SITE II or BINDING SITE III of FIG. 8. Table 4 illustrates the complementarity of the nucleotide sequences of KLHL3 BINDING SITE, designated SEQ ID:3437, to the nucleotide sequence of GAM40 RNA, herein designated GAM RNA, also designated SEQ ID:396.

Another function of GAM40 is therefore inhibition of Kelch-like 3 (drosophila) (KLHL3, Accession NP_059111.1). Accordingly, utilities of GAM40 include diagnosis, prevention and treatment of diseases and clinical conditions associated with KLHL3.

Kelch-like 6 (drosophila) (KLHL6, Accession NP_569713.1) is another GAM40 target gene, herein designated TARGET GENE. KLHL6 BINDING SITE is a target binding site found in the 3' untranslated region of mRNA encoded by KLHL6, corresponding to a target binding site such as BINDING SITE I, BINDING SITE II or BINDING SITE III of FIG. 8. Table 4 illustrates the complementarity of the nucleotide sequences of KLHL6 BINDING SITE, designated SEQ ID:5266, to the nucleotide sequence of GAM40 RNA, herein designated GAM RNA, also designated SEQ ID:396.

Another function of GAM40 is therefore inhibition of Kelch-like 6 (drosophila) (KLHL6, Accession NP_569713.1). Accordingly, utilities of GAM40 include diagnosis, prevention and treatment of diseases and clinical conditions associated with KLHL6.

Lim domain binding 3 (LDB3, Accession XP_084376.6) is another GAM40 target gene, herein designated TARGET GENE. LDB3 BINDING SITE is a target binding site found in the 3' untranslated region of mRNA encoded by LDB3, corresponding to a target binding site such as BINDING SITE I, BINDING SITE II or BINDING SITE III of FIG. 8. Table 4 illustrates the complementarity of the nucleotide sequences of LDB3 BINDING SITE, designated SEQ ID:3058, to the nucleotide sequence of GAM40 RNA, herein designated GAM RNA, also designated SEQ ID:396.

Another function of GAM40 is therefore inhibition of Lim domain binding 3 (LDB3, Accession XP_084376.6), a gene which could play a role during mating. Accordingly, utilities of GAM40 include diagnosis, prevention and treatment of diseases and clinical conditions associated with LDB3.

The function of LDB3 has been established by previous studies. PDZ domain- containing proteins interact with each other in cytoskeletal assembly or with other proteins involved in targeting and clustering of membrane proteins By screening a muscle cDNA library using a muscle EST sequence as the probe, Faulkner et al. (1999) obtained cDNAs encoding mouse and human ZASP. The deduced 283-amino acid human ZASP protein has an 85-residue N-terminal PDZ domain and shares significant similarity with the 734-amino acid protein encoded by the KIAA0613 cDNA isolated by Ishikawa et al. (1998). Database, PCR, and genomic DNA analyses indicated the presence of alternatively spliced isoforms of ZASP that encode proteins of 470, 617, and 727 (KIAA0613) amino acids. Northern blot analysis detected a major 1.9-kb ZASP transcript that was most abundant in skeletal muscle and heart but absent in other tissues tested. Additional transcripts of 4.0 and 5.4 kb were detected when using a 5-prime rather than a 3-prime probe. RT-PCR analysis detected wide expression of KIAA0613, with weak or undetectable expression in liver, pancreas, and spleen (Ishikawa et al., 1998). Western blot analysis showed expression of 32- and 78-kD proteins in heart and muscle. Immunofluorescence microscopy demonstrated that ZASP is expressed in pseudopodia and in the cytoplasm around the nucleus, and that it colocalizes with actin in the I-band. Immunoelectron microscopy localized ZASP within the Z-band. Yeast 2-hybrid analysis determined that the PDZ domain of ZASP interacts with the C terminus of alpha-actinin-2 (ACTN2; 102573

Full details of the abovementioned studies are described in the following publications, the disclosure of which are hereby incorporated by reference:

Faulkner, G.; Pallavicini, A.; Formentin, E.; Comelli, A.; Ievolella, C.; Trevisan, S.; Bortoletto, G.; Scannapieco, P.; Salamon, M.; Mouly, V.; Valle, G.; Lanfranchi, G. : ZASP: a new Z-band alternatively spliced PDZ-motif protein. J. Cell Biol. 146:465-475, 1999; and Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequence.

Further studies establishing the function and utilities of LDB3 are found in John Hopkins OMIM database record ID 605906, and in cited publications listed in Table 5, which are hereby incorporated by reference. Link-GEFII (Accession NP_057423.1) is another GAM40 target gene, herein designated TARGET GENE. Link-GEFII BINDING SITE is a target binding site found in the 3' untranslated region of mRNA encoded by Link-GEFII, corresponding to a target binding site such as BINDING SITE I, BINDING SITE II or BINDING SITE III of FIG. 8. Table 4 illustrates the complementarity of the nucleotide sequences of Link-GEFII BINDING SITE, designated SEQ ID:576, to the nucleotide sequence of GAM40 RNA, herein designated GAM RNA, also designated SEQ ID:396.

Another function of GAM40 is therefore inhibition of Link-GEFII (Accession NP_057423.1). Accordingly, utilities of GAM40 include diagnosis, prevention and treatment of diseases and clinical conditions associated with Link-GEFII.

LOC116064 (Accession XP_057296.1) is another GAM40 target gene, herein designated TARGET GENE. LOC116064 BINDING SITE is a target binding site found in the 3' untranslated region of mRNA encoded by LOC116064, corresponding to a target binding site such as BINDING SITE I, BINDING SITE II or BINDING SITE III of FIG. 8. Table 4 illustrates the complementarity of the nucleotide sequences of LOC116064 BINDING SITE, designated SEQ ID:16127, to the nucleotide sequence of GAM40 RNA, herein designated GAM RNA, also designated SEQ ID:396.

Another function of GAM40 is therefore inhibition of LOC116064 (Accession XP_057296.1). Accordingly, utilities of GAM40 include diagnosis, prevention and treatment of diseases and clinical conditions associated with LOC116064.

LOC130612 (Accession XP_059461.1) is another GAM40 target gene, herein designated TARGET GENE. LOC130612 BINDING SITE is a target binding site found in the 5' untranslated region of mRNA encoded by LOC130612, corresponding to a target binding site such as BINDING SITE I, BINDING SITE II or BINDING SITE III of FIG. 8. Table 4 illustrates the complementarity of the nucleotide sequences of LOC130612 BINDING SITE, designated SEQ ID:14210, to the nucleotide sequence of GAM40 RNA, herein designated GAM RNA, also designated SEQ ID:396.

Another function of GAM40 is therefore inhibition of LOC130612 (Accession XP_059461.1). Accordingly, utilities of GAM40 include diagnosis, prevention and treatment of diseases and clinical conditions associated with LOC130612.

LOC133926 (Accession XP_059674.1) is another GAM40 target gene, herein designated TARGET GENE. LOC133926 BINDING SITE is a target binding site found in the 5' untranslated region of mRNA encoded by LOC133926, corresponding to a target binding site such as BINDING SITE I, BINDING SITE II or BINDING SITE III of FIG. 8. Table 4 illustrates the complementarity of the nucleotide sequences of LOC133926 BINDING SITE, designated SEQ ID:2660, to the nucleotide sequence of GAM40 RNA, herein designated GAM RNA, also designated SEQ ID:396.

Another function of GAM40 is therefore inhibition of LOC133926 (Accession XP_059674.1). Accordingly, utilities of GAM40 include diagnosis, prevention and treatment of diseases and clinical conditions associated with LOC133926.

LOC146333 (Accession XP_091306.2) is another GAM40 target gene, herein designated TARGET GENE. LOC146333 BINDING SITE is a target binding site found in the 5' untranslated region of mRNA encoded by LOC146333, corresponding to a target binding site such as BINDING SITE I, BINDING SITE II or BINDING SITE III of FIG. 8. Table 4 illustrates the complementarity of the nucleotide sequences of LOC146333 BINDING SITE, designated SEQ ID:2307, to the nucleotide sequence of GAM40 RNA, herein designated GAM RNA, also designated SEQ ID:396.

Another function of GAM40 is therefore inhibition of LOC146333 (Accession XP_091306.2). Accordingly, utilities of GAM40 include diagnosis, prevention and treatment of diseases and clinical conditions associated with LOC146333.

LOC147123 (Accession XP_085714.2) is another GAM40 target gene, herein designated TARGET GENE. LOC147123 BINDING SITE is a target binding site found in the 3' untranslated region of mRNA encoded by LOC147123, corresponding to a target binding site such as BINDING SITE I, BINDING SITE II or BINDING SITE III of FIG. 8. Table 4 illustrates the complementarity of the nucleotide sequences of LOC147123 BINDING SITE, designated SEQ ID:9200, to the nucleotide sequence of GAM40 RNA, herein designated GAM RNA, also designated SEQ ID:396.

Another function of GAM40 is therefore inhibition of LOC147123 (Accession XP_085714.2). Accordingly, utilities of GAM40 include diagnosis, prevention and treatment of diseases and clinical conditions associated with LOC147123.

LOC149271 (Accession XP_086475.1) is another GAM40 target gene, herein designated TARGET GENE. LOC149271 BINDING SITE is a target binding site found in the 3' untranslated region of mRNA encoded by LOC149271, corresponding to a target binding site such as BINDING SITE I, BINDING SITE II or BINDING SITE III of FIG. 8. Table 4 illustrates the complementarity of the nucleotide sequences of LOC149271 BINDING SITE, designated SEQ ID:3643, to the nucleotide sequence of GAM40 RNA, herein designated GAM RNA, also designated SEQ ID:396.

Another function of GAM40 is therefore inhibition of LOC149271 (Accession XP_086475.1). Accordingly, utilities of GAM40 include diagnosis, prevention and treatment of diseases and clinical conditions associated with LOC149271.

LOC157623 (Accession XP_088346.6) is another GAM40 target gene, herein designated TARGET GENE. LOC157623 BINDING SITE is a target binding site found in the 5' untranslated region of mRNA encoded by LOC157623, corresponding to a target binding site such as BINDING SITE I, BINDING SITE II or BINDING SITE III of FIG. 8. Table 4 illustrates the complementarity of the nucleotide sequences of LOC157623 BINDING SITE, designated SEQ ID:16783, to the nucleotide sequence of GAM40 RNA, herein designated GAM RNA, also designated SEQ ID:396.

Another function of GAM40 is therefore inhibition of LOC157623 (Accession XP_088346.6). Accordingly, utilities of GAM40 include diagnosis, prevention and treatment of diseases and clinical conditions associated with LOC157623.

LOC157693 (Accession XP_088366.2) is another GAM40 target gene, herein designated TARGET GENE. LOC157693 BINDING SITE is a target binding site found in the 5' untranslated region of mRNA encoded by LOC157693, corresponding to a target binding site such as BINDING SITE I, BINDING SITE II or BINDING SITE III of FIG. 8. Table 4 illustrates the complementarity of the nucleotide sequences of LOC157693 BINDING SITE, designated SEQ ID:545, to the nucleotide sequence of GAM40 RNA, herein designated GAM RNA, also designated SEQ ID:396.

Another function of GAM40 is therefore inhibition of LOC157693 (Accession XP_088366.2). Accordingly, utilities of GAM40 include diagnosis, prevention and treatment of diseases and clinical conditions associated with LOC157693.

LOC158969 (Accession XP_088728.1) is another GAM40 target gene, herein designated TARGET GENE. LOC158969 BINDING SITE is a target binding site found in the 3' untranslated region of mRNA encoded by LOC158969, corresponding to a target binding site such as BINDING SITE I, BINDING SITE II or BINDING SITE III of FIG. 8. Table 4 illustrates the complementarity of the nucleotide sequences of LOC158969 BINDING SITE, designated SEQ ID:14337, to the nucleotide sequence of GAM40 RNA, herein designated GAM RNA, also designated SEQ ID:396.

Another function of GAM40 is therefore inhibition of LOC158969 (Accession XP_088728.1). Accordingly, utilities of GAM40 include diagnosis, prevention and treatment of diseases and clinical conditions associated with LOC158969.

LOC162083 (Accession XP_091339.2) is another GAM40 target gene, herein designated TARGET GENE. LOC162083 BINDING SITE is a target binding site found in the 5' untranslated region of mRNA encoded by LOC162083, corresponding to a target binding site such as BINDING SITE I, BINDING SITE II or BINDING SITE III of FIG. 8. Table 4 illustrates the complementarity of the nucleotide sequences of LOC162083 BINDING SITE, designated SEQ ID:8480, to the nucleotide sequence of GAM40 RNA, herein designated GAM RNA, also designated SEQ ID:396.

Another function of GAM40 is therefore inhibition of LOC162083 (Accession XP_091339.2). Accordingly, utilities of GAM40 include diagnosis, prevention and treatment of diseases and clinical conditions associated with LOC162083.

LOC163742 (Accession XP_089112.3) is another GAM40 target gene, herein designated TARGET GENE. LOC163742 BINDING SITE is a target binding site found in the 3' untranslated region of mRNA encoded by LOC163742, corresponding to a target binding site such as BINDING SITE I, BINDING SITE II or BINDING SITE III of FIG. 8. Table 4 illustrates the complementarity of the nucleotide sequences of LOC163742 BINDING SITE, designated SEQ ID:5127, to the nucleotide sequence of GAM40 RNA, herein designated GAM RNA, also designated SEQ ID:396.

Another function of GAM40 is therefore inhibition of LOC163742 (Accession XP_089112.3). Accordingly, utilities of GAM40 include diagnosis, prevention and treatment of diseases and clinical conditions associated with LOC163742.

LOC197342 (Accession XP_113869.1) is another GAM40 target gene, herein designated TARGET GENE.

LOC197342 BINDING SITE is a target binding site found in the 3' untranslated region of mRNA encoded by LOC197342, corresponding to a target binding site such as BINDING SITE I, BINDING SITE II or BINDING SITE III of FIG. 8. Table 4 illustrates the complementarity of the nucleotide sequences of LOC197342 BINDING SITE, designated SEQ ID:8342, to the nucleotide sequence of GAM40 RNA, herein designated GAM RNA, also designated SEQ ID:396.

Another function of GAM40 is therefore inhibition of LOC197342 (Accession XP_113869.1). Accordingly, utilities of GAM40 include diagnosis, prevention and treatment of diseases and clinical conditions associated with LOC197342.

LOC197358 (Accession XP_113872.2) is another GAM40 target gene, herein designated TARGET GENE. LOC197358 BINDING SITE is a target binding site found in the 3' untranslated region of mRNA encoded by LOC197358, corresponding to a target binding site such as BINDING SITE I, BINDING SITE II or BINDING SITE III of FIG. 8. Table 4 illustrates the complementarity of the nucleotide sequences of LOC197358 BINDING SITE, designated SEQ ID:9461, to the nucleotide sequence of GAM40 RNA, herein designated GAM RNA, also designated SEQ ID:396.

Another function of GAM40 is therefore inhibition of LOC197358 (Accession XP_113872.2). Accordingly, utilities of GAM40 include diagnosis, prevention and treatment of diseases and clinical conditions associated with LOC197358.

LOC201617 (Accession XP_117315.1) is another GAM40 target gene, herein designated TARGET GENE. LOC201617 BINDING SITE is a target binding site found in the 3' untranslated region of mRNA encoded by LOC201617, corresponding to a target binding site such as BINDING SITE I, BINDING SITE II or BINDING SITE III of FIG. 8. Table 4 illustrates the complementarity of the nucleotide sequences of LOC201617 BINDING SITE, designated SEQ ID:15732, to the nucleotide sequence of GAM40 RNA, herein designated GAM RNA, also designated SEQ ID:396.

Another function of GAM40 is therefore inhibition of LOC201617 (Accession XP_117315.1). Accordingly, utilities of GAM40 include diagnosis, prevention and treatment of diseases and clinical conditions associated with LOC201617.

LOC253228 (Accession XP_171113.3) is another GAM40 target gene, herein designated TARGET GENE. LOC253228 BINDING SITE is a target binding site found in the 3' untranslated region of mRNA encoded by LOC253228, corresponding to a target binding site such as BINDING SITE I, BINDING SITE II or BINDING SITE III of FIG. 8. Table 4 illustrates the complementarity of the nucleotide sequences of LOC253228 BINDING SITE, designated SEQ ID:12568, to the nucleotide sequence of GAM40 RNA, herein designated GAM RNA, also designated SEQ ID:396.

Another function of GAM40 is therefore inhibition of LOC253228 (Accession XP_171113.3). Accordingly, utilities of GAM40 include diagnosis, prevention and treatment of diseases and clinical conditions associated with LOC253228.

LOC253559 (Accession NP_694854.1) is another GAM40 target gene, herein designated TARGET GENE. LOC253559 BINDING SITE is a target binding site found in the 3' untranslated region of mRNA encoded by LOC253559, corresponding to a target binding site such as BINDING SITE I, BINDING SITE II or BINDING SITE III of FIG. 8. Table 4 illustrates the complementarity of the nucleotide sequences of LOC253559 BINDING SITE, designated SEQ ID:17582, to the nucleotide sequence of GAM40 RNA, herein designated GAM RNA, also designated SEQ ID:396.

Another function of GAM40 is therefore inhibition of LOC253559 (Accession NP_694854.1). Accordingly, utilities of GAM40 include diagnosis, prevention and treatment of diseases and clinical conditions associated with LOC253559.

LOC256372 (Accession XP_170878.1) is another GAM40 target gene, herein designated TARGET GENE. LOC256372 BINDING SITE is a target binding site found in the 5' untranslated region of mRNA encoded by LOC256372, corresponding to a target binding site such as BINDING SITE I, BINDING SITE II or BINDING SITE III of FIG. 8. Table 4 illustrates the complementarity of the nucleotide sequences of LOC256372 BINDING SITE, designated SEQ ID:7091, to the nucleotide sequence of GAM40 RNA, herein designated GAM RNA, also designated SEQ ID:396.

Another function of GAM40 is therefore inhibition of LOC256372 (Accession XP_170878.1). Accordingly, utilities of GAM40 include diagnosis, prevention and treatment of diseases and clinical conditions associated with LOC256372.

LOC283877 (Accession XP_211240.1) is another GAM40 target gene, herein designated TARGET GENE. LOC283877 BINDING SITE is a target binding site found in the 5' untranslated region of mRNA encoded by LOC283877, corresponding to a target binding site such as BINDING SITE I, BINDING SITE II or BINDING SITE III of FIG. 8. Table 4 illustrates the complementarity of the nucleotide sequences of LOC283877 BINDING SITE, designated SEQ ID:13171, to the nucleotide sequence of GAM40 RNA, herein designated GAM RNA, also designated SEQ ID:396.

Another function of GAM40 is therefore inhibition of LOC283877 (Accession XP_211240.1). Accordingly, utilities of GAM40 include diagnosis, prevention and treatment of diseases and clinical conditions associated with LOC283877.

LOC283894 (Accession XP_211250.1) is another GAM40 target gene, herein designated TARGET GENE. LOC283894 BINDING SITE is a target binding site found in the 3' untranslated region of mRNA encoded by LOC283894, corresponding to a target binding site such as BINDING SITE I, BINDING SITE II or BINDING SITE III of FIG. 8. Table 4 illustrates the complementarity of the nucleotide sequences of LOC283894 BINDING SITE, designated SEQ ID:16848, to the nucleotide sequence of GAM40 RNA, herein designated GAM RNA, also designated SEQ ID:396.

Another function of GAM40 is therefore inhibition of LOC283894 (Accession XP_211250.1). Accordingly, utilities of GAM40 include diagnosis, prevention and treatment of diseases and clinical conditions associated with LOC283894.

LOC283909 (Accession XP_211256.1) is another GAM40 target gene, herein designated TARGET GENE. LOC283909 BINDING SITE is a target binding site found in the 3' untranslated region of mRNA encoded by LOC283909, corresponding to a target binding site such as BINDING SITE I, BINDING SITE II or BINDING SITE III of FIG. 8. Table 4 illustrates the complementarity of the nucleotide sequences of LOC283909 BINDING SITE, designated SEQ ID:16848, to the nucleotide sequence of GAM40 RNA, herein designated GAM RNA, also designated SEQ ID:396.

Another function of GAM40 is therefore inhibition of LOC283909 (Accession XP_211256.1). Accordingly, utilities of GAM40 include diagnosis, prevention and treatment of diseases and clinical conditions associated with LOC283909.

LOC284173 (Accession XP_211362.1) is another GAM40 target gene, herein designated TARGET GENE. LOC284173 BINDING SITE is a target binding site found in the 3' untranslated region of mRNA encoded by LOC284173, corresponding to a target binding site such as BINDING SITE I, BINDING SITE II or BINDING SITE III of FIG. 8. Table 4 illustrates the complementarity of the nucleotide sequences of LOC284173 BINDING SITE, designated SEQ ID:9638, to the nucleotide sequence of GAM40 RNA, herein designated GAM RNA, also designated SEQ ID:396.

Another function of GAM40 is therefore inhibition of LOC284173 (Accession XP_211362.1). Accordingly, utilities of GAM40 include diagnosis, prevention and treatment of diseases and clinical conditions associated with LOC284173.

LOC284573 (Accession XP_209272.1) is another GAM40 target gene, herein designated TARGET GENE. LOC284573 BINDING SITE is a target binding site found in the 3' untranslated region of mRNA encoded by LOC284573, corresponding to a target binding site such as BINDING SITE I, BINDING SITE II or BINDING SITE III of FIG. 8. Table 4 illustrates the complementarity of the nucleotide sequences of LOC284573 BINDING SITE, designated SEQ ID:17120, to the nucleotide sequence of GAM40 RNA, herein designated GAM RNA, also designated SEQ ID:396.

Another function of GAM40 is therefore inhibition of LOC284573 (Accession XP_209272.1). Accordingly, utilities of GAM40 include diagnosis, prevention and treatment of diseases and clinical conditions associated with LOC284573.

LOC284857 (Accession XP_211671.1) is another GAM40 target gene, herein designated TARGET GENE. LOC284857 BINDING SITE is a target binding site found in the 5' untranslated region of mRNA encoded by LOC284857, corresponding to a target binding site such as BINDING SITE I, BINDING SITE II or BINDING SITE III of FIG. 8. Table 4 illustrates the complementarity of the nucleotide sequences of LOC284857 BINDING SITE, designated SEQ ID:1215, to the nucleotide sequence of GAM40 RNA, herein designated GAM RNA, also designated SEQ ID:396.

Another function of GAM40 is therefore inhibition of LOC284857 (Accession XP_211671.1). Accordingly, utilities of GAM40 include diagnosis, prevention and treatment of diseases and clinical conditions associated with LOC284857.

LOC285122 (Accession XP_211770.1) is another GAM40 target gene, herein designated TARGET GENE. LOC285122 BINDING SITE is a target binding site found in the 5' untranslated region of mRNA encoded by LOC285122, corresponding to a target binding site such as BINDING SITE I, BINDING SITE II or BINDING SITE III of FIG. 8. Table 4 illustrates the complementarity of the nucleotide sequences of LOC285122 BINDING SITE, designated SEQ ID:16376, to the nucleotide sequence of GAM40 RNA, herein designated GAM RNA, also designated SEQ ID:396.

Another function of GAM40 is therefore inhibition of LOC285122 (Accession XP_211770.1). Accordingly, utilities of GAM40 include diagnosis, prevention and treatment of diseases and clinical conditions associated with LOC285122.

LOC285397 (Accession XP_211876.1) is another GAM40 target gene, herein designated TARGET GENE. LOC285397 BINDING SITE is a target binding site found in the 3' untranslated region of mRNA encoded by LOC285397, corresponding to a target binding site such as BINDING SITE I, BINDING SITE II or BINDING SITE III of FIG. 8. Table 4 illustrates the complementarity of the nucleotide sequences of LOC285397 BINDING SITE, designated SEQ ID:10325, to the nucleotide sequence of GAM40 RNA, herein designated GAM RNA, also designated SEQ ID:396.

Another function of GAM40 is therefore inhibition of LOC285397 (Accession XP_211876.1). Accordingly, utilities of GAM40 include diagnosis, prevention and treatment of diseases and clinical conditions associated with LOC285397.

LOC285582 (Accession XP_211943.1) is another GAM40 target gene, herein designated TARGET GENE. LOC285582 BINDING SITE is a target binding site found in the 3' untranslated region of mRNA encoded by LOC285582, corresponding to a target binding site such as BINDING SITE I, BINDING SITE II or BINDING SITE III of FIG. 8. Table 4 illustrates the complementarity of the nucleotide sequences of LOC285582 BINDING SITE, designated SEQ ID:2315, to the nucleotide sequence of GAM40 RNA, herein designated GAM RNA, also designated SEQ ID:396.

Another function of GAM40 is therefore inhibition of LOC285582 (Accession XP_211943.1). Accordingly, utilities of GAM40 include diagnosis, prevention and treatment of diseases and clinical conditions associated with LOC285582.

LOC285733 (Accession XP_212006.1) is another GAM40 target gene, herein designated TARGET GENE. LOC285733 BINDING SITE is a target binding site found in the 3' untranslated region of mRNA encoded by LOC285733, corresponding to a target binding site such as BINDING SITE I, BINDING SITE II or BINDING SITE III of FIG. 8. Table 4 illustrates the complementarity of the nucleotide sequences of LOC285733 BINDING SITE, designated SEQ ID:6307, to the nucleotide sequence of GAM40 RNA, herein designated GAM RNA, also designated SEQ ID:396.

Another function of GAM40 is therefore inhibition of LOC285733 (Accession XP_212006.1). Accordingly, utilities of GAM40 include diagnosis, prevention and treatment of diseases and clinical conditions associated with LOC285733.

LOC317671 (Accession NP_775498.1) is another GAM40 target gene, herein designated TARGET GENE. LOC317671 BINDING SITE is a target binding site found in the 5' untranslated region of mRNA encoded by LOC317671, corresponding to a target binding site such as BINDING SITE I, BINDING SITE II or BINDING SITE III of FIG. 8. Table 4 illustrates the complementarity of the nucleotide sequences of LOC317671 BINDING SITE, designated SEQ ID:13035, to the nucleotide sequence of GAM40 RNA, herein designated GAM RNA, also designated SEQ ID:396.

Another function of GAM40 is therefore inhibition of LOC317671 (Accession NP_775498.1). Accordingly, utilities of GAM40 include diagnosis, prevention and treatment of diseases and clinical conditions associated with LOC317671.

LOC338909 (Accession XP_294744.1) is another GAM40 target gene, herein designated TARGET GENE. LOC338909 BINDING SITE is a target binding site found in the 3' untranslated region of mRNA encoded by LOC338909, corresponding to a target binding site such as BINDING SITE I, BINDING SITE II or BINDING SITE III of FIG. 8. Table 4 illustrates the complementarity of the nucleotide sequences of LOC338909 BINDING SITE, designated SEQ ID:9478, to the nucleotide sequence of GAM40 RNA, herein designated GAM RNA, also designated SEQ ID:396.

Another function of GAM40 is therefore inhibition of LOC338909 (Accession XP_294744.1). Accordingly, utilities of GAM40 include diagnosis, prevention and treatment of diseases and clinical conditions associated with LOC338909.

LOC339604 (Accession XP_293152.2) is another GAM40 target gene, herein designated TARGET GENE. LOC339604 BINDING SITE is a target binding site found in the 5' untranslated region of mRNA encoded by LOC339604, corresponding to a target binding site such as BINDING SITE I, BINDING SITE II or BINDING SITE III of FIG. 8. Table 4 illustrates the complementarity of the nucleotide sequences of LOC339604 BINDING SITE, designated SEQ ID:5510, to the nucleotide sequence of GAM40 RNA, herein designated GAM RNA, also designated SEQ ID:396.

Another function of GAM40 is therefore inhibition of LOC339604 (Accession XP_293152.2). Accordingly, utilities of GAM40 include diagnosis, prevention and treatment of diseases and clinical conditions associated with LOC339604.

LOC339694 (Accession XP_295035.1) is another GAM40 target gene, herein designated TARGET GENE. LOC339694 BINDING SITE is a target binding site found in the 3' untranslated region of mRNA encoded by LOC339694, corresponding to a target binding site such as BINDING SITE I, BINDING SITE II or BINDING SITE III of FIG. 8. Table 4 illustrates the complementarity of the nucleotide sequences of LOC339694 BINDING SITE, designated SEQ ID:4299, to the nucleotide sequence of GAM40 RNA, herein designated GAM RNA, also designated SEQ ID:396.

Another function of GAM40 is therefore inhibition of LOC339694 (Accession XP_295035.1). Accordingly, utilities of GAM40 include diagnosis, prevention and treatment of diseases and clinical conditions associated with LOC339694.

LOC344543 (Accession XP_297702.2) is another GAM40 target gene, herein designated TARGET GENE. LOC344543 BINDING SITE is a target binding site found in the 5' untranslated region of mRNA encoded by LOC344543, corresponding to a target binding site such as BINDING SITE I, BINDING SITE II or BINDING SITE III of FIG. 8. Table 4 illustrates the complementarity of the nucleotide sequences of LOC344543 BINDING SITE, designated SEQ ID:18874, to the nucleotide sequence of GAM40 RNA, herein designated GAM RNA, also designated SEQ ID:396.

Another function of GAM40 is therefore inhibition of LOC344543 (Accession XP_297702.2). Accordingly, utilities of GAM40 include diagnosis, prevention and treatment of diseases and clinical conditions associated with LOC344543.

LOC345422 (Accession XP_298768.2) is another GAM40 target gene, herein designated TARGET GENE. LOC345422 BINDING SITE is a target binding site found in the 5' untranslated region of mRNA encoded by LOC345422, corresponding to a target binding site such as BINDING SITE I, BINDING SITE II or BINDING SITE III of FIG. 8. Table 4 illustrates the complementarity of the nucleotide sequences of LOC345422 BINDING SITE, designated SEQ ID:14296, to the nucleotide sequence of GAM40 RNA, herein designated GAM RNA, also designated SEQ ID:396.

Another function of GAM40 is therefore inhibition of LOC345422 (Accession XP_298768.2). Accordingly, utilities of GAM40 include diagnosis, prevention and treatment of diseases and clinical conditions associated with LOC345422.

LOC351887 (Accession XP_305245.1) is another GAM40 target gene, herein designated TARGET GENE. LOC351887 BINDING SITE is a target binding site found in the 5' untranslated region of mRNA encoded by LOC351887, corresponding to a target binding site such as BINDING SITE I, BINDING SITE II or BINDING SITE III of FIG. 8. Table 4 illustrates the complementarity of the nucleotide sequences of LOC351887 BINDING SITE, designated SEQ ID:19662, to the nucleotide sequence of GAM40 RNA, herein designated GAM RNA, also designated SEQ ID:396.

Another function of GAM40 is therefore inhibition of LOC351887 (Accession XP_305245.1). Accordingly, utilities of GAM40 include diagnosis, prevention and treatment of diseases and clinical conditions associated with LOC351887.

LOC91464 (Accession XP_038589.1) is another GAM40 target gene, herein designated TARGET GENE. LOC91464 BINDING SITE is a target binding site found in the 3' untranslated region of mRNA encoded by LOC91464, corresponding to a target binding site such as BINDING SITE I, BINDING SITE II or BINDING SITE III of FIG. 8. Table 4 illustrates the complementarity of the nucleotide sequences of LOC91464 BINDING SITE, designated SEQ ID:3304, to the nucleotide sequence of GAM40 RNA, herein designated GAM RNA, also designated SEQ ID:396.

Another function of GAM40 is therefore inhibition of LOC91464 (Accession XP_038589.1). Accordingly, utilities of GAM40 include diagnosis, prevention and treatment of diseases and clinical conditions associated with LOC91464.

LOC92597 (Accession NP_775739.1) is another GAM40 target gene, herein designated TARGET GENE. LOC92597 BINDING SITE is a target binding site found in the 3' untranslated region of mRNA encoded by LOC92597, corresponding to a target binding site such as BINDING SITE I, BINDING SITE II or BINDING SITE III of FIG. 8. Table 4 illustrates the complementarity of the nucleotide sequences of LOC92597 BINDING SITE, designated SEQ ID:5178, to the nucleotide sequence of GAM40 RNA, herein designated GAM RNA, also designated SEQ ID:396.

Another function of GAM40 is therefore inhibition of LOC92597 (Accession NP_775739.1). Accordingly, utilities of GAM40 include diagnosis, prevention and treatment of diseases and clinical conditions associated with LOC92597.

Mannan-binding lectin serine protease 1 (c4/c2 activating component of ra-reactive factor) (MASP1, Accession NP_001870.3) is another GAM40 target gene, herein designated TARGET GENE. MASP1 BINDING SITE is a target binding site found in the 3' untranslated region of multiple transcripts of mRNA encoded by MASP1, corresponding to a target binding site such as BINDING SITE I, BINDING SITE II or BINDING SITE III of FIG. 8. Table 4 illustrates the complementarity of the nucleotide sequences of MASP1 BINDING SITE, designated SEQ ID:18072, to the nucleotide sequence of GAM40 RNA, herein designated GAM RNA, also designated SEQ ID:396.

Another function of GAM40 is therefore inhibition of Mannan-binding lectin serine protease 1 (c4/c2 activating component of ra-reactive factor) (MASP1, Accession NP_001870.3), a gene which a complement- dependent bactericidal factor. Accordingly, utilities of GAM40 include diagnosis, prevention and treatment of diseases and clinical conditions associated with MASP1.

The function of MASP1 has been established by previous studies. The Ra- reactive factor (RARF) is a complement-dependent bactericidal factor that binds to the Ra and R2 polysaccharides expressed by certain enterobacteria. RARF activity is found in the sera of a diverse group of vertebrates, suggesting that it is an evolutionarily conserved mechanism to resist infection by these bacterial strains. RARF includes a 100-kD component, CRARF, also called MASP1 or p100, that was thought to activate the complement components C4 (C4F, 120820; C4S, 120810), C2 (OMIM Ref. No. 217000), and C3 (OMIM Ref. No. 120700). Subsequent work, however, separated MASP1 from MASP2 (OMIM Ref. No. 605102) and showed that MASP1 activates C3 and C2, whereas MASP2 activates C4 and C2. The other component of RARF is mannan-binding lectin (OMIM Ref. No. 154545), a plasma protein member of the complement system that binds to microbial carbohydrates and activates the MASPs. The MASPs then recruit C4 and C2 to generate the C3 convertase or directly activate C3. Takada et al. (1993) cloned a partial human CRARF cDNA from a liver library. The human CRARF amino acid sequence is similar to the human complement subcomponents C1R (OMIM Ref. No. 216950) and C1S (OMIM Ref. No. 120580). Takada et al. (1995) obtained a corresponding mouse cDNA. By RT-PCR with primers based on N-terminal peptide sequence analysis and the consensus sequence of serine proteases, followed by screening a fetal liver cDNA library, Sato et al. (1994) isolated a cDNA encoding MASP. Sequence analysis predicted that the 699-amino acid protein contains a leader peptide; 2 structural domains similar to those of C1R and C1S; an EGF-like domain thought to be related to calcium-binding activity; 2 short consensus repeat domains; and a serine protease domain. Northern blot analysis revealed expression of 4.8- and 3.4-kb MASP transcripts in fetal liver; no expression was detected in adult tissues or in fetal heart, brain, lung, or kidney. Sato et al. (1994) proposed that the MBL-MASP complex is a novel activator of complement in what they designated the lectin pathway. By biochemical purification of plasma proteins and immunoblot analysis, Dahl et al. (2001) detected a 42-kD serine protease associated with MBL. They identified a cDNA encoding this protein, MASP3, which is generated by alternative splicing of MASP1. The MASP3 transcription product is composed of an A chain, which is common to both MASP1 and MASP3, and a B chain, which is unique to MASP3. The deduced 728-amino acid MASP3 protein has a signal peptide, 3 N-glycosylation sites on the B chain and 4 on the A chain. Sato et al. (1994) mapped the MASP1 gene to 3q27-q28 by FISH. Using FISH, Takada et al. (1995) mapped the human CRARF gene to 3q27-q28 and the mouse gene to 16B2-B3, regions thought to share homology of synteny.

Full details of the abovementioned studies are described in the following publications, the disclosure of which are hereby incorporated by reference:

Dahl, M. R.; Thiel, S.; Matsushita, M.; Fujita, T.; Willis, A. C.; Christensen, T.; Vorup-Jensen, T.; Jensenius, J. C.: MASP-3 and its association with distinct complexes of the mannan-binding lectin complement activation pathway. Immunity 15:127-135, 2001; and Takada, F.; Seki, N.; Matsuda, Y.; Takayama, Y.; Kawakami, M.: Localization of the genes for the 100-kDa complement-activating components of Ra-reactive factor (CRARF and Crarf) to hum.

Further studies establishing the function and utilities of MASP1 are found in John Hopkins OMIM database record ID 600521, and in cited publications listed in Table 5, which are hereby incorporated by reference. MGC20481 (Accession NP_443081.1) is another GAM40 target gene, herein designated TARGET GENE. MGC20481 BINDING SITE is a target binding site found in the 3' untranslated region of mRNA encoded by MGC20481, corresponding to a target binding site such as BINDING SITE I, BINDING SITE II or BINDING SITE III of FIG. 8. Table 4 illustrates the complementarity of the nucleotide sequences of MGC20481 BINDING SITE, designated SEQ ID:5846, to the nucleotide sequence of GAM40 RNA, herein designated GAM RNA, also designated SEQ ID:396.

Another function of GAM40 is therefore inhibition of MGC20481 (Accession NP_443081.1). Accordingly, utilities of GAM40 include diagnosis, prevention and treatment of diseases and clinical conditions associated with MGC20481.

MGC21874 (Accession XP_291105.1) is another GAM40 target gene, herein designated TARGET GENE. MGC21874 BINDING SITE is a target binding site found in the 3' untranslated region of mRNA encoded by MGC21874, corresponding to a target binding site such as BINDING SITE I, BINDING SITE II or BINDING SITE III of FIG. 8. Table 4 illustrates the complementarity of the nucleotide sequences of MGC21874 BINDING SITE, designated SEQ ID:11186, to the nucleotide sequence of GAM40 RNA, herein designated GAM RNA, also designated SEQ ID:396.

Another function of GAM40 is therefore inhibition of MGC21874 (Accession XP_291105.1). Accordingly, utilities of GAM40 include diagnosis, prevention and treatment of diseases and clinical conditions associated with MGC21874.

MGC26778 (Accession NP_659447.1) is another GAM40 target gene, herein designated TARGET GENE. MGC26778 BINDING SITE1 and MGC26778 BINDING SITE2 are target binding sites found in untranslated regions of mRNA encoded by MGC26778, corresponding to target binding sites such as BINDING SITE I, BINDING SITE II or BINDING SITE III of FIG. 8. Table 4 illustrates the complementarity of the nucleotide sequences of MGC26778 BINDING SITE1 and MGC26778 BINDING SITE2, designated SEQ ID:19180 and SEQ ID:2280 respectively, to the nucleotide sequence of GAM40 RNA, herein designated GAM RNA, also designated SEQ ID:396.

Another function of GAM40 is therefore inhibition of MGC26778 (Accession NP_659447.1). Accordingly, utilities of GAM40 include diagnosis, prevention and treatment of diseases and clinical conditions associated with MGC26778.

MGC3101 (Accession NP_076948.1) is another GAM40 target gene, herein designated TARGET GENE. MGC3101 BINDING SITE is a target binding site found in the 3' untranslated region of mRNA encoded by MGC3101, corresponding to a target binding site such as BINDING SITE I, BINDING SITE II or BINDING SITE III of FIG. 8. Table 4 illustrates the complementarity of the nucleotide sequences of MGC3101 BINDING SITE, designated SEQ ID:756, to the nucleotide sequence of GAM40 RNA, herein designated GAM RNA, also designated SEQ ID:396.

Another function of GAM40 is therefore inhibition of MGC3101 (Accession NP_076948.1). Accordingly, utilities of GAM40 include diagnosis, prevention and treatment of diseases and clinical conditions associated with MGC3101.

MGC39325 (Accession NP_671722.1) is another GAM40 target gene, herein designated TARGET GENE. MGC39325 BINDING SITE is a target binding site found in the 3' untranslated region of mRNA encoded by MGC39325, corresponding to a target binding site such as BINDING SITE I, BINDING SITE II or BINDING SITE III of FIG. 8. Table 4 illustrates the complementarity of the nucleotide sequences of MGC39325 BINDING SITE, designated SEQ ID:3154, to the nucleotide sequence of GAM40 RNA, herein designated GAM RNA, also designated SEQ ID:396.

Another function of GAM40 is therefore inhibition of MGC39325 (Accession NP_671722.1). Accordingly, utilities of GAM40 include diagnosis, prevention and treatment of diseases and clinical conditions associated with MGC39325.

Nerve growth factor, beta polypeptide (NGFB, Accession NP_002497.1) is another GAM40 target gene, herein designated TARGET GENE. NGFB BINDING SITE is a target binding site found in the 5' untranslated region of mRNA encoded by NGFB, corresponding to a target binding site such as BINDING SITE I, BINDING SITE II or BINDING SITE III of FIG. 8. Table 4 illustrates the complementarity of the nucleotide sequences of NGFB BINDING SITE, designated SEQ ID:19589, to the nucleotide sequence of GAM40 RNA, herein designated GAM RNA, also designated SEQ ID:396.

Another function of GAM40 is therefore inhibition of Nerve growth factor, beta polypeptide (NGFB, Accession NP_002497.1), a gene which is important for the development and maintenance of the sympathetic and sensory nervous systems. Accordingly, utilities of GAM40 include diagnosis, prevention and treatment of diseases and clinical conditions associated with NGFB.

The function of NGFB and its association with various diseases and clinical conditions, has been established by previous studies, as described hereinabove with reference to GAM34.1. NLI-IF (Accession NP_067021.1) is another GAM40 target gene, herein designated TARGET GENE. NLI-IF BINDING SITE is a target binding site found in the 3' untranslated region of mRNA encoded by NLI-IF, corresponding to a target binding site such as BINDING SITE I, BINDING SITE II or BINDING SITE III of FIG. 8. Table 4 illustrates the complementarity of the nucleotide sequences of NLI-IF BINDING SITE, designated SEQ ID:12146, to the nucleotide sequence of GAM40 RNA, herein designated GAM RNA, also designated SEQ ID:396.

Another function of GAM40 is therefore inhibition of NLI-IF (Accession NP_067021.1). Accordingly, utilities of GAM40 include diagnosis, prevention and treatment of diseases and clinical conditions associated with NLI-IF.

Nephronophthisis 4 (NPHP4, Accession NP_055917.1) is another GAM40 target gene, herein designated TARGET GENE. NPHP4 BINDING SITE is a target binding site found in the 3' untranslated region of mRNA encoded by NPHP4, corresponding to a target binding site such as BINDING SITE I, BINDING SITE II or BINDING SITE III of FIG. 8. Table 4 illustrates the complementarity of the nucleotide sequences of NPHP4 BINDING SITE, designated SEQ ID:19408, to the nucleotide sequence of GAM40 RNA, herein designated GAM RNA, also designated SEQ ID:396.

Another function of GAM40 is therefore inhibition of Nephronophthisis 4 (NPHP4, Accession NP_055917.1). Accordingly, utilities of GAM40 include diagnosis, prevention and treatment of diseases and clinical conditions associated with NPHP4.

Nuclear receptor subfamily 0, group b, member 2 (NR0B2, Accession NP_068804.1) is another GAM40 target gene, herein designated TARGET GENE. NR0B2 BINDING SITE is a target binding site found in the 3' untranslated region of mRNA encoded by NR0B2, corresponding to a target binding site such as BINDING SITE I, BINDING SITE II or BINDING SITE III of FIG. 8. Table 4 illustrates the complementarity of the nucleotide sequences of NR0B2 BINDING SITE, designated SEQ ID:17061, to the nucleotide sequence of GAM40 RNA, herein designated GAM RNA, also designated SEQ ID:396.

Another function of GAM40 is therefore inhibition of Nuclear receptor subfamily 0, group b, member 2 (NR0B2, Accession NP_068804.1), a gene which may be a negative regulator of receptor-dependent signaling pathways. Accordingly, utilities of GAM40 include diagnosis, prevention and treatment of diseases and clinical conditions associated with NR0B2.

The function of NR0B2 has been established by previous studies. Using a yeast 2-hybrid system with a mouse relative of human MB67 (NR1I3; 603881) as the bait, Seol et al. (1996) cloned mouse liver cDNAs encoding Nr0b2, which they named Shp for 'small heterodimer partner.' By screening a human liver cDNA library with a mouse Nr0b2 cDNA, they isolated a human NR0B2 cDNA. Northern blot analysis of human tissues detected an approximately 1.3-kb NR0B2 transcript in liver; lower levels of expression were detected in heart and pancreas. The predicted 257-amino acid NR0B2 protein contains the ligand-binding and dimerization domains found in other nuclear hormone receptor superfamily members but lacks the conserved DNA-binding domain. The closest relative of Nr0b2 among known family members is Dax1 (NR0B1; 300200). Both in vitro and in the yeast 2-hybrid system, Nr0b2 interacted with several conventional and orphan members of the receptor superfamily, including retinoid receptors RAR (see OMIM Ref. No. 180240) and RXR (see OMIM Ref. No. 180245), thyroid hormone receptor (see OMIM Ref. No. 190160), and the orphan receptor MB67. In mammalian cells, Nr0b2 specifically inhibited transactivation by the superfamily members with which it interacted. Seol et al. (1996) suggested that NR0B2 functions as a negative regulator of receptor-dependent signaling pathways. Goodwin et al. (2000) used a potent, nonsteroidal FXR ligand to show that FXR induces expression of SHP1, an atypical member of the nuclear receptor family that lacks a DNA-binding domain. SHP1 represses expression of CYP7A1 by inhibiting the activity of LRH1, an orphan nuclear receptor that regulates CYP7A1 expression positively. This bile acid-activated regulatory cascade provides a molecular basis for the coordinate suppression of CYP7A1 and other genes involved in bile acid biosynthesis.

Full details of the abovementioned studies are described in the following publications, the disclosure of which are hereby incorporated by reference:

Goodwin, B.; Jones, S. A.; Price, R. R.; Watson, M. A.; McKee, D. D.; Moore, L. B.; Galardi, C.; Wilson, J. G.; Lewis, M. C.; Roth, M. E.; Maloney, P. R.; Willson, T. M.; Kliewer, S. A.: A regulatory cascade of the nuclear receptors FXR, SHP-1, and LRH-1 represses bile acid biosynthesis. Molec. Cell 6:517-526, 2000; and Seol, W.; Choi, H.-S.; Moore, D. D.: An orphan nuclear hormone receptor that lacks a DNA binding domain and heterodimerizes with other receptors. Science 272:1336-1339, 1996.

Further studies establishing the function and utilities of NR0B2 are found in John Hopkins OMIM database record ID 604630, and in cited publications listed in Table 5, which are hereby incorporated by reference. Nuclear receptor subfamily 3, group c, member 2 (NR3C2, Accession NP_000892.1) is another GAM40 target gene, herein designated TARGET GENE. NR3C2 BINDING SITE is a target binding site found in the 3' untranslated region of mRNA encoded by NR3C2, corresponding to a target binding site such as BINDING SITE I, BINDING SITE II or BINDING SITE III of FIG. 8. Table 4 illustrates the complementarity of the nucleotide sequences of NR3C2 BINDING SITE, designated SEQ ID:13835, to the nucleotide sequence of GAM40 RNA, herein designated GAM RNA, also designated SEQ ID:396.

Another function of GAM40 is therefore inhibition of Nuclear receptor subfamily 3, group c, member 2 (NR3C2, Accession NP_000892.1), a gene which is to increase ion and water transport and thus raise extracellular fluid volume and blood pressure and lower potassium levels. Accordingly, utilities of GAM40 include diagnosis, prevention and treatment of diseases and clinical conditions associated with NR3C2.

The function of NR3C2 has been established by previous studies. Arriza et al. (1987) used low-stringency hybridization with human glucocorticoid receptor cDNA to isolate a new gene encoding a predicted 107-kD polypeptide. Expression studies demonstrated its ability to bind aldosterone with high affinity and to activate gene transcription in response to aldosterone, thus establishing its identity as the human mineralocorticoid receptor. This molecule also showed high affinity for glucocorticoids. They speculated that, since the circulating level of glucocorticoids is several times higher than those of aldosterone, the primary mineralocorticoid, glucocorticoid activation of the mineralocorticoid receptor may be functionally significant. The gene for the estrogen receptor (OMIM Ref. No. 133430) and that for the progesterone receptor (OMIM Ref. No. 607311) have also been cloned.

Animal model experiments lend further support to the function of NR3C2. Berger et al. (1998) generated MLR-deficient mice by gene targeting. These mice had a normal prenatal development. During the first week of life, the MLR-deficient mice developed symptoms of pseudohypoaldosteronism. They lost weight and eventually died at approximately 10 days after birth from dehydration by renal sodium and water loss. At day 8, MLR -/- mice showed hyperkalemia, hyponatremia, and a strong increase in renin, angiotensin II, and aldosterone plasma concentrations. The fractional renal Na+ excretion was elevated more than 8-fold. The glomerular filtration rate in MLR -/- mice was not different from that in controls. The effect of amiloride on renal Na+ excretion in colonic transepithelial voltage reflected the function of amiloride-sensitive epithelial Na+ channels.

It is appreciated that the abovementioned animal model for NR3C2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Arriza, J. L.; Weinberger, C.; Cerelli, G.; Glaser, T. M.; Handelin, B. L.; Housman, D. E.; Evans, R. M.: Cloning of human mineralocorticoid receptor complementary DNA: structural and functional kinship with the glucocorticoid receptor. Science 237:268-275, 1987; and Berger, S.; Bleich, M.; Schmid, W.; Cole, T. J.; Peters, J.; Watanabe, H.; Kriz, W.; Warth, R.; Greger, R.; Schutz, G.: Mineralocorticoid receptor knockout mice: pathophysiology of Na+.

Further studies establishing the function and utilities of NR3C2 are found in John Hopkins OMIM database record ID 600983, and in cited publications listed in Table 5, which are hereby incorporated by reference. Purinergic receptor p2y, g-protein coupled, 2 (P2RY2, Accession NP_002555.2) is another GAM40 target gene, herein designated TARGET GENE. P2RY2 BINDING SITE is a target binding site found in the 3' untranslated region of multiple transcripts of mRNA encoded by P2RY2, corresponding to a target binding site such as BINDING SITE I, BINDING SITE II or BINDING SITE III of FIG. 8. Table 4 illustrates the complementarity of the nucleotide sequences of P2RY2 BINDING SITE, designated SEQ ID:15265, to the nucleotide sequence of GAM40 RNA, herein designated GAM RNA, also designated SEQ ID:396.

Another function of GAM40 is therefore inhibition of Purinergic receptor p2y, g-protein coupled, 2 (P2RY2, Accession NP_002555.2), a gene which mediates cellular responses to ATP. Accordingly, utilities of GAM40 include diagnosis, prevention and treatment of diseases and clinical conditions associated with P2RY2.

The function of P2RY2 has been established by previous studies. The chloride ion secretory pathway that is defective in cystic fibrosis (OMIM Ref. No. 219700) can be bypassed by an alternative pathway for chloride ion transport that is activated by extracellular nucleotides. Accordingly, the P2 receptor that mediates this effect is a therapeutic target for improving chloride secretion in CF patients. Parr et al. (1994) reported the sequence and functional expression of a cDNA cloned from human airway epithelial cells that encodes a protein with properties of a P2U nucleotide receptor. With a retrovirus system, the human airway clone was stably expressed in 1321N1 astrocytoma cells, a human cell line unresponsive to extracellular nucleotides. Studies of inositol phosphate accumulation and intracellular Ca(2+) mobilization induced by extracellular nucleotides in 1321N1 cells expressing the receptor identified this clone as the target receptor in human airway epithelia. Parr et al. (1994) also isolated an identical cDNA from human colonic epithelial cells, indicating that this is the same P2U receptor that had been functionally identified in other human tissues. Expression of the human P2U receptor in 1321N1 cells revealed evidence for autocrine ATP release and stimulation of transduced receptors. Thus, P2U expression in the cell line was proposed as a useful system for studying autocrine regulatory mechanisms and for screening potential therapeutic drugs. Tai et al. (2000) studied the expression and regulation of the P2UR gene in human granulosa-luteal cells (GLCs) by RT-PCR and Northern blot analysis. Expression of P2UR mRNA was downregulated by human chorionic gonadotropin (CG) in a dose- and time-dependent manner. Treatment with 8-bromo-cAMP and forskolin also attenuated P2UR mRNA levels. The authors concluded that the P2UR mRNA is expressed in human GLCs and that P2UR mRNA is regulated by human CG, cAMP, and forskolin. These findings further supported a potential role of this neurotransmitter receptor in the human ovary.

Full details of the abovementioned studies are described in the following publications, the disclosure of which are hereby incorporated by reference:

Parr, C. E.; Sullivan, D. M.; Paradiso, A. M.; Lazarowski, E. R.; Burch, L. H.; Olsen, J. C.; Erb, L.; Weisman, G. A.; Boucher, R. C.; Turner, J. T.: Cloning and expression of a human P(2U) nucleotide receptor, a target for cystic fibrosis pharmacotherapy. Proc. Nat. Acad. Sci. 91:3275-3279, 1994; and Tai, C.-J.; Kang, S. K.; Cheng, K. W.; Choi, K.-C.; Nathwani, P. S.; Leung, P. C. K.: Expression and regulation of P2U-purinergic receptor in human granulosa-luteal cells. J. Clin. End.

Further studies establishing the function and utilities of P2RY2 are found in John Hopkins OMIM database record ID 600041, and in cited publications listed in Table 5, which are hereby incorporated by reference. Purinergic receptor p2y, g-protein coupled, 2 (P2RY2, Accession NP_788086.1) is another GAM40 target gene, herein designated TARGET GENE. P2RY2 BINDING SITE is a target binding site found in the 3' untranslated region of multiple transcripts of mRNA encoded by P2RY2, corresponding to a target binding site such as BINDING SITE I, BINDING SITE II or BINDING SITE III of FIG. 8. Table 4 illustrates the complementarity of the nucleotide sequences of P2RY2 BINDING SITE, designated SEQ ID:15265, to the nucleotide sequence of GAM40 RNA, herein designated GAM RNA, also designated SEQ ID:396.

Another function of GAM40 is therefore inhibition of Purinergic receptor p2y, g-protein coupled, 2 (P2RY2, Accession NP_788086.1), a gene which mediates cellular responses to ATP. Accordingly, utilities of GAM40 include diagnosis, prevention and treatment of diseases and clinical conditions associated with P2RY2.

The function of P2RY2 has been established by previous studies. The chloride ion secretory pathway that is defective in cystic fibrosis (OMIM Ref. No. 219700) can be bypassed by an alternative pathway for chloride ion transport that is activated by extracellular nucleotides. Accordingly, the P2 receptor that mediates this effect is a therapeutic target for improving chloride secretion in CF patients. Parr et al. (1994) reported the sequence and functional expression of a cDNA cloned from human airway epithelial cells that encodes a protein with properties of a P2U nucleotide receptor. With a retrovirus system, the human airway clone was stably expressed in 1321N1 astrocytoma cells, a human cell line unresponsive to extracellular nucleotides. Studies of inositol phosphate accumulation and intracellular Ca(2+) mobilization induced by extracellular nucleotides in 1321N1 cells expressing the receptor identified this clone as the target receptor in human airway epithelia. Parr et al. (1994) also isolated an identical cDNA from human colonic epithelial cells, indicating that this is the same P2U receptor that had been functionally identified in other human tissues. Expression of the human P2U receptor in 1321N1 cells revealed evidence for autocrine ATP release and stimulation of transduced receptors. Thus, P2U expression in the cell line was proposed as a useful system for studying autocrine regulatory mechanisms and for screening potential therapeutic drugs. Tai et al. (2000) studied the expression and regulation of the P2UR gene in human granulosa-luteal cells (GLCs) by RT-PCR and Northern blot analysis. Expression of P2UR mRNA was downregulated by human chorionic gonadotropin (CG) in a dose- and time-dependent manner. Treatment with 8-bromo-cAMP and forskolin also attenuated P2UR mRNA levels. The authors concluded that the P2UR mRNA is expressed in human GLCs and that P2UR mRNA is regulated by human CG, cAMP, and forskolin. These findings further supported a potential role of this neurotransmitter receptor in the human ovary.

Full details of the abovementioned studies are described in the following publications, the disclosure of which are hereby incorporated by reference:

Parr, C. E.; Sullivan, D. M.; Paradiso, A. M.; Lazarowski, E. R.; Burch, L. H.; Olsen, J. C.; Erb, L.; Weisman, G. A.; Boucher, R. C.; Turner, J. T.: Cloning and expression of a human P(2U) nucleotide receptor, a target for cystic fibrosis pharmacotherapy. Proc. Nat. Acad. Sci. 91:3275-3279, 1994; and Tai, C.-J.; Kang, S. K.; Cheng, K. W.; Choi, K.-C.; Nathwani, P. S.; Leung, P. C. K.: Expression and regulation of P2U-purinergic receptor in human granulosa- luteal cells. J. Clin. End.

Further studies establishing the function and utilities of P2RY2 are found in John Hopkins OMIM database record ID 600041, and in cited publications listed in Table 5, which are hereby incorporated by reference. Purinergic receptor p2y, g-protein coupled, 2 (P2RY2, Accession NP_788085.1) is another GAM40 target gene, herein designated TARGET GENE. P2RY2 BINDING SITE is a target binding site found in the 3' untranslated region of multiple transcripts of mRNA encoded by P2RY2, corresponding to a target binding site such as BINDING SITE I, BINDING SITE II or BINDING SITE III of FIG. 8. Table 4 illustrates the complementarity of the nucleotide sequences of P2RY2 BINDING SITE, designated SEQ ID:15265, to the nucleotide sequence of GAM40 RNA, herein designated GAM RNA, also designated SEQ ID:396.

Another function of GAM40 is therefore inhibition of Purinergic receptor p2y, g-protein coupled, 2 (P2RY2, Accession NP_788085.1), a gene which mediates cellular responses to ATP. Accordingly, utilities of GAM40 include diagnosis, prevention and treatment of diseases and clinical conditions associated with P2RY2.

The function of P2RY2 has been established by previous studies. The chloride ion secretory pathway that is defective in cystic fibrosis (OMIM Ref. No. 219700) can be bypassed by an alternative pathway for chloride ion transport that is activated by extracellular nucleotides. Accordingly, the P2 receptor that mediates this effect is a therapeutic target for improving chloride secretion in CF patients. Parr et al. (1994) reported the sequence and functional expression of a cDNA cloned from human airway epithelial cells that encodes a protein with properties of a P2U nucleotide receptor. With a retrovirus system, the human airway clone was stably expressed in 1321N1 astrocytoma cells, a human cell line unresponsive to extracellular nucleotides. Studies of inositol phosphate accumulation and intracellular Ca(2+) mobilization induced by extracellular nucleotides in 1321N1 cells expressing the receptor identified this clone as the target receptor in human airway epithelia. Parr et al. (1994) also isolated an identical cDNA from human colonic epithelial cells, indicating that this is the same P2U receptor that had been functionally identified in other human tissues. Expression of the human P2U receptor in 1321N1 cells revealed evidence for autocrine ATP release and stimulation of transduced receptors. Thus, P2U expression in the cell line was proposed as a useful system for studying autocrine regulatory mechanisms and for screening potential therapeutic drugs. Tai et al. (2000) studied the expression and regulation of the P2UR gene in human granulosa-luteal cells (GLCs) by RT-PCR and Northern blot analysis. Expression of P2UR mRNA was downregulated by human chorionic gonadotropin (CG) in a dose- and time-dependent manner. Treatment with 8-bromo-cAMP and forskolin also attenuated P2UR mRNA levels. The authors concluded that the P2UR mRNA is expressed in human GLCs and that P2UR mRNA is regulated by human CG, cAMP, and forskolin. These findings further supported a potential role of this neurotransmitter receptor in the human ovary.

Full details of the abovementioned studies are described in the following publications, the disclosure of which are hereby incorporated by reference:

Parr, C. E.; Sullivan, D. M.; Paradiso, A. M.; Lazarowski, E. R.; Burch, L. H.; Olsen, J. C.; Erb, L.; Weisman, G. A.; Boucher, R. C.; Turner, J. T.: Cloning and expression of a human P(2U) nucleotide receptor, a target for cystic fibrosis pharmacotherapy. Proc. Nat. Acad. Sci. 91:3275-3279, 1994; and Tai, C.-J.; Kang, S. K.; Cheng, K. W.; Choi, K.-C.; Nathwani, P. S.; Leung, P. C. K.: Expression and regulation of P2U-purinergic receptor in human granulosa- luteal cells. J. Clin. End.

Further studies establishing the function and utilities of P2RY2 are found in John Hopkins OMIM database record ID 600041, and in cited publications listed in Table 5, which are hereby incorporated by reference. Paired box gene 5 (b-cell lineage specific activator protein) (PAX5, Accession NP_057953.1) is another GAM40 target gene, herein designated TARGET GENE. PAX5 BINDING SITE is a target binding site found in the 5' untranslated region of mRNA encoded by PAX5, corresponding to a target binding site such as BINDING SITE I, BINDING SITE II or BINDING SITE III of FIG. 8. Table 4 illustrates the complementarity of the nucleotide sequences of PAX5 BINDING SITE, designated SEQ ID:1514, to the nucleotide sequence of GAM40 RNA, herein designated GAM RNA, also designated SEQ ID:396.

Another function of GAM40 is therefore inhibition of Paired box gene 5 (b-cell lineage specific activator protein) (PAX5, Accession NP_057953.1), a gene which plays a role in B-cell differentiation, neural development and spermatogenesis and therefore may be associated with Human primary immunodeficiencies. Accordingly, utilities of GAM40 include diagnosis, prevention and treatment of Human primary immunodeficiencies, and of other diseases and clinical conditions associated with PAX5.

The function of PAX5 has been established by previous studies. The PAX5 gene is located in the 9p13 region, which is involved in t(9;14)(p13;q32) translocations recurring in small lymphocytic lymphomas of the plasmacytoid subtype and in derived large cell lymphomas. Ohno et al. (1990) showed that in a diffuse large cell lymphoma (KIS-1) with a translocation, the immunoglobulin heavy-chain (IgH) locus on 14q32 is juxtaposed to 9p13 sequences of unknown function. Busslinger et al. (1996) showed that the KIS-1 translocation breakpoint is located 1,807 bp upstream of exon 1A of PAX5, thus bringing the potent E-mu enhancer of the IgH gene into close proximity with the PAX5 promoters. The data suggested to them that deregulation of PAX5 gene transcription by the t(9;14) translocation contributes to the pathogenesis of small lymphocytic lymphomas with plasmacytoid differentiation. In addition to immunoglobulin V genes, the 5-prime sequences of BCL6 (OMIM Ref. No. 109565) and FAS (TNFRSF6; 134637) are mutated in normal germinal center B lymphocytes. Genomic instability promotes tumorigenesis through defective chromosome segregation and DNA mismatch repair inactivation. By screening 18 loci for mutations, Pasqualucci et al. (2001) identified changes in the germline sequences of PIM1 (OMIM Ref. No. 164960), MYC (OMIM Ref. No. 190080), ARHH (OMIM Ref. No. 602037), and/or PAX5, in addition to BCL6, in a majority of diffuse large cell lymphomas (DLCLs; OMIM Ref. No. 601889). No mutations in PIM1, My, ARHH, and PAX5 were detected in germinal-center lymphocytes, naive B cells, or B-cell malignancies other than DLCLs. PAX5 mutations, which were observed in 57% of DLCLs, were identified downstream of both transcription sites, predominantly in noncoding sequences around exon 1B. FISH analysis indicated that hypermutation in these genes is not due to chromosomal translocation, as seen in Burkitt lymphoma (OMIM Ref. No. 113970). Chromosomal translocation, however, may be an outcome of hypermutation. Specific features of the hypermutation process, including the predominance of single nucleotide substitutions with occasional deletions or duplications, a preference for transitions over transversions, and a specific motif targeting RGy, were recognizable in each of the hypermutated loci. Pasqualucci et al. (2001) proposed that aberrant hypermutation of regulatory and coding sequences of genes that do not represent physiologic targets may provide the basis for DLCL pathogenesis and explain its phenotypic and clinical heterogeneity. This hypermutation malfunction is unlikely to be due to defective DNA mismatch repair and does not appear to involve activation-induced deaminase (AICDA; 605257)

Animal model experiments lend further support to the function of PAX5. Nutt et al. (1999) demonstrated that pro-B cells lacking Pax5 are incapable of in vitro B-cell differentiation unless Pax5 expression is restored by retroviral transduction. Pax5 -/- pro-B cells are not restricted in their lineage fate, as stimulation with appropriate cytokines induces them to differentiate into functional macrophages, osteoclasts, dendritic cells, granulocytes, and natural killer cells. As expected for a clonogenic hematopoietic progenitor with lymphomyeloid developmental potential, the Pax5 -/- pro-B cell expresses genes of different lineage-affiliated programs, and restoration of Pax5 activity represses this lineage-promiscuous transcription. Pax5 therefore plays an essential role in B-lineage commitment by suppressing alternative lineage choices. Differentiation of the hematopoietic stem cell into distinct blood cell types was thought to progress through intermediate progenitor cells with restricted developmental potential. This view of hematopoiesis was challenged by the findings of Nutt et al. (1999) that the Pax5 -/- pro-B cell possesses, at least under in vitro conditions, a broad, developmental potential similar to that of the hematopoietic stem cell itself. However, Pax5 -/- pro-B cells are unable to differentiate along the erythroid and megakaryocytic lineages, and cannot reconstitute the entire hematopoietic system under transplantation experiments. Therefore, Nutt et al. (1999) concluded that the Pax5 -/- pro-B cell must be classified as a hematopoietic progenitor cell with broad lymphoid and myeloid differentiation potential. Nutt et al. (1999) also concluded that their data supported the notion that B-lineage commitment is a stochastic rather than a deterministic process.

It is appreciated that the abovementioned animal model for PAX5 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pasqualucci, L.; Neumeister, P.; Goossens, T.; Nanjangud, G.; Chaganti, R. S. K.; Kuppers, R.; Dalla-Favera, R.: Hypermutation of multiple proto - oncogenes in B-cell diffuse large-cell lymphomas. Nature 412:341-346, 2001; and Nutt, S. L.; Heavey, B.; Rolink, A. G.; Busslinger, M.: Commitment to the B-lymphoid lineage depends on the transcription factor Pax5. Nature 401:556-562, 1999.

Further studies establishing the function and utilities of PAX5 are found in John Hopkins OMIM database record ID 167414, and in cited publications listed in Table 5, which are hereby incorporated by reference. Pancreatic polypeptide receptor 1 (PPYR1, Accession NP_005963.1) is another GAM40 target gene, herein designated TARGET GENE. PPYR1 BINDING SITE is a target binding site found in the 3' untranslated region of mRNA encoded by PPYR1, corresponding to a target binding site such as BINDING SITE I, BINDING SITE II or BINDING SITE III of FIG. 8. Table 4 illustrates the complementarity of the nucleotide sequences of PPYR1 BINDING SITE, designated SEQ ID:4618, to the nucleotide sequence of GAM40 RNA, herein designated GAM RNA, also designated SEQ ID:396.

Another function of GAM40 is therefore inhibition of Pancreatic polypeptide receptor 1 (PPYR1, Accession NP_005963.1), a gene which binds (from highest to lowest affinity) PP, Py, and NPY hormones. Accordingly, utilities of GAM40 include diagnosis, prevention and treatment of diseases and clinical conditions associated with PPYR1.

The function of PPYR1 has been established by previous studies. Pancreatic polypeptide (PP; 167780), neuropeptide Y (NPY; 162640) and peptide YY (PYY; 600781) are related 36-amino acid hormones. A number of structurally related receptors for these peptides have been isolated (e.g., NPY2R; 162642). Bard et al. (1995) used the rat Y1 receptor (NPY1R; 162641) as a probe to clone a novel receptor, PPYR1 (termed Y4 by them), from a human genomic DNA library. PPYR1 is an intronless gene that encodes a predicted 375-amino acid polypeptide having highest homology to the Y1 receptor gene (42% amino acid identity). Using RT-PCR, they showed that the PPYR1 receptor is expressed in several human tissues, including brain, coronary artery, and ileum. Bard et al. (1995) expressed the PPYR1 gene in COS-7 cells and performed a hormone-binding assay which showed that the PPYR1 receptor binds (from highest to lowest affinity) PP, Py, and NPY hormones. The genes encoding NPY1R and NPY2R have been mapped to 4q31.3-q32 and 4q31, respectively. They are located approximately 6 cM apart and have been mapped to conserved syntenic linkage groups on mouse chromosome 8 and 3, respectively. The human type 5 receptor (NPY5R; 602001) is also thought to be located on 4q31-q32; part of its sequence is nearly identical to, but in the opposite orientation from, that of the Y1 receptor sequence. To determine whether all functional human NPY receptor genes are clustered on chromosome 4, Lutz et al. (1997) mapped PPYR1 and NPY5R using somatic cell hybrids. They found that PPYR1 maps to chromosome 10. For regionalization, they used mapping to a YAC library using PCR and the primers for the PPYR1 gene. Their findings suggested that 10q11.2-q21.2 is the likely cytogenetic location of PPYR1. Lutz et al. (1997) mapped the Ppyr1 gene to mouse chromosome 14, approximately 15 cM from the centromere.

Full details of the abovementioned studies are described in the following publications, the disclosure of which are hereby incorporated by reference:

Bard, J. A.; Walker, M. W.; Branchek, T. A.; Weinshank, R. L.: Cloning and functional expression of a human Y4 subtype receptor for pancreatic polypeptide, neuropeptide Y, and peptide YY J. Biol. Chem 270:26762-26765, 1995; and Lutz, C. M.; Richards, J. E.; Scott, K. L.; Sinha, S.; Yang-Feng, T. L.; Frankel, W. N.; Thompson, D. A.: Neuropeptide Y receptor genes mapped in human and mouse: receptors with high af.

Further studies establishing the function and utilities of PPYR1 are found in John Hopkins OMIM database record ID 601790, and in cited publications listed in Table 5, which are hereby incorporated by reference. Prostaglandin-endoperoxide synthase 1 (prostaglandin g/h synthase and cyclooxygenase) (PTGS1, Accession NP_000953.2) is another GAM40 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:11891, to the nucleotide sequence of GAM40 RNA, herein designated GAM RNA, also designated SEQ ID:396.

Another function of GAM40 is therefore inhibition of Prostaglandin-endoperoxide synthase 1 (prostaglandin g/h synthase and cyclooxygenase) (PTGS1, Accession NP_000953.2), a gene which may play an important role in regulating or promoting cell proliferation in some normal and neoplastically transformed cells. Accordingly, utilities of GAM40 include diagnosis, prevention and treatment of diseases and clinical conditions associated with PTGS1.

The function of PTGS1 has been established by previous studies. Prostaglandin H2 synthase is known to pharmacologists (Vane et al., 1994) as cyclooxygenase (COX), and its 2 isoforms are known as COX1 and COX2. Vane et al. (1994) outlined the actions of the 2 isoforms of COX. Stemming from this outline was a hypothesis that the therapeutic effects of drugs such as aspirin are due to inhibition of COX2, whereas the unwanted side-effects (and the action on platelets) result from inhibition of COX1. Prostaglandin-endoperoxide synthase (PTGS; EC 1.14.99.1; fatty acid cyclooxygenase; PGH synthase) is the key enzyme in prostaglandin biosynthesis. The cyclooxygenase activity of the enzyme is inhibited by nonsteroidal antiinflammatory drugs such as aspirin and endomethacin.

Animal model experiments lend further support to the function of PTGS1. To study the separate roles of the 2 isoforms of cyclooxygenase, Langenbach et al. (1995) used homologous recombination to disrupt the mouse Ptgs1 gene encoding COX1. Homozygous Ptgs1 mutant mice survived well, had no gastric pathology, and showed less indomethacin-induced gastric ulceration than wildtype mice, even though their gastric prostaglandin E2 levels were about 1% of wildtype. Homozygous mutant mice had reduced platelet aggregation and a decreased inflammatory response to arachidonic acid, but not to tetradecanoyl phorbol acetate. Ptgs1 homozygous mutant females mated to homozygous mutant males produced few live offspring. Langenbach et al. (1995) stated that COX1-deficient mice provided a useful model for distinguishing the physiologic roles of the 2 cyclooxygenases, COX1 and COX2.

It is appreciated that the abovementioned animal model for PTGS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Vane, J. R.; Mitchell, J. A.; Appleton, I.; Tomlinson, A.; Bishop-Bailey, D.; Croxtall, J.; Willoughby, D. A.: Inducible isoforms of cyclooxygenase and nitric-oxide synthase in inflammation. Proc. Nat. Acad. Sci. 91:2046-2050, 1994; and Langenbach, R.; Morham, S. G.; Tiano, H. F.; Loftin, C. D.; Ghanayem, B. I.; Chulada, P. C.; Mahler, J. F.; Lee, C. A.; Goulding, E. H.; Kluckman, K. D.; Kim, H. S.; Smithies, O.: Prost.

Further studies establishing the function and utilities of PTGS1 are found in John Hopkins OMIM database record ID 176805, and in cited publications listed in Table 5, which are hereby incorporated by reference. Prostaglandin-endoperoxide synthase 1 (prostaglandin g/h synthase and cyclooxygenase) (PTGS1, Accession NP_542158.1) is another GAM40 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:11891, to the nucleotide sequence of GAM40 RNA, herein designated GAM RNA, also designated SEQ ID:396.

Another function of GAM40 is therefore inhibition of Prostaglandin-endoperoxide synthase 1 (prostaglandin g/h synthase and cyclooxygenase) (PTGS1, Accession NP_542158.1), a gene which may play an important role in regulating or promoting cell proliferation in some normal and neoplastically transformed cells. Accordingly, utilities of GAM40 include diagnosis, prevention and treatment of diseases and clinical conditions associated with PTGS1.

The function of PTGS1 has been established by previous studies. Prostaglandin H2 synthase is known to pharmacologists (Vane et al., 1994) as cyclooxygenase (COX), and its 2 isoforms are known as COX1 and COX2. Vane et al. (1994) outlined the actions of the 2 isoforms of COX. Stemming from this outline was a hypothesis that the therapeutic effects of drugs such as aspirin are due to inhibition of COX2, whereas the unwanted side-effects (and the action on platelets) result from inhibition of COX1. Prostaglandin- endoperoxide synthase (PTGS; EC 1.14.99.1; fatty acid cyclooxygenase; PGH synthase) is the key enzyme in prostaglandin biosynthesis. The cyclooxygenase activity of the enzyme is inhibited by nonsteroidal antiinflammatory drugs such as aspirin and endomethacin.

Animal model experiments lend further support to the function of PTGS1. To study the separate roles of the 2 isoforms of cyclooxygenase, Langenbach et al. (1995) used homologous recombination to disrupt the mouse Ptgs1 gene encoding COX1. Homozygous Ptgs1 mutant mice survived well, had no gastric pathology, and showed less indomethacin-induced gastric ulceration than wildtype mice, even though their gastric prostaglandin E2 levels were about 1% of wildtype. Homozygous mutant mice had reduced platelet aggregation and a decreased inflammatory response to arachidonic acid, but not to tetradecanoyl phorbol acetate. Ptgs1 homozygous mutant females mated to homozygous mutant males produced few live offspring. Langenbach et al. (1995) stated that COX1-deficient mice provided a useful model for distinguishing the physiologic roles of the 2 cyclooxygenases, COX1 and COX2.

It is appreciated that the abovementioned animal model for PTGS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Vane, J. R.; Mitchell, J. A.; Appleton, I.; Tomlinson, A.; Bishop-Bailey, D.; Croxtall, J.; Willoughby, D. A.: Inducible isoforms of cyclooxygenase and nitric-oxide synthase in inflammation. Proc. Nat. Acad. Sci. 91:2046-2050, 1994; and Langenbach, R.; Morham, S. G.; Tiano, H. F.; Loftin, C. D.; Ghanayem, B. I.; Chulada, P. C.; Mahler, J. F.; Lee, C. A.; Goulding, E. H.; Kluckman, K. D.; Kim, H. S.; Smithies, O.: Prost.

Further studies establishing the function and utilities of PTGS1 are found in John Hopkins OMIM database record ID 176805, and in cited publications listed in Table 5, which are hereby incorporated by reference. Rna binding motif protein 7 (RBM7, Accession NP_057174.1) is another GAM40target gene, herein designated TARGET GENE. RBM7 BINDING SITE is a target binding site found in the 3' untranslated region of mRNA encoded by RBM7, corresponding to a target binding site such as BINDING SITE I, BINDING SITE II or BINDING SITE III of FIG. 8. Table 4 illustrates the complementarity of the nucleotide sequences of RBM7 BINDING SITE, designated SEQ ID:651, to the nucleotide sequence of GAM40 RNA, herein designated GAM RNA, also designated SEQ ID:396.

Another function of GAM40 is therefore inhibition of Rna binding motif protein 7 (RBM7, Accession NP_057174.1). Accordingly, utilities of GAM40 include diagnosis, prevention and treatment of diseases and clinical conditions associated with RBM7.

Regulator of g-protein signalling 5 (RGS5, Accession NP_003608.1) is another GAM40 target gene, herein designated TARGET GENE. RGS5 BINDING SITE1 and RGS5 BINDING SITE2 are target binding sites found in untranslated regions of mRNA encoded by RGS5, corresponding to target binding sites such as BINDING SITE I, BINDING SITE II or BINDING SITE III of FIG. 8. Table 4 illustrates the complementarity of the nucleotide sequences of RGS5 BINDING SITE1 and RGS5 BINDING SITE2, designated SEQ ID:7379 and SEQ ID:12110 respectively, to the nucleotide sequence of GAM40 RNA, herein designated GAM RNA, also designated SEQ ID:396.

Another function of GAM40 is therefore inhibition of Regulator of g-protein signalling 5 (RGS5, Accession NP_003608.1). Accordingly, utilities of GAM40 include diagnosis, prevention and treatment of diseases and clinical conditions associated with RGS5.

RNAH (Accession NP_006819.1) is another GAM40 target gene, herein designated TARGET GENE. RNAH BINDING SITE is a target binding site found in the 3' untranslated region of mRNA encoded by RNAH, corresponding to a target binding site such as BINDING SITE I, BINDING SITE II or BINDING SITE III of FIG. 8. Table 4 illustrates the complementarity of the nucleotide sequences of RNAH BINDING SITE, designated SEQ ID:4545, to the nucleotide sequence of GAM40 RNA, herein designated GAM RNA, also designated SEQ ID:396.

Another function of GAM40 is therefore inhibition of RNAH (Accession NP_006819.1). Accordingly, utilities of GAM40 include diagnosis, prevention and treatment of diseases and clinical conditions associated with RNAH.

Ribosomal protein l15 (RPL15, Accession NP_002939.2) is another GAM40 target gene, herein designated TARGET GENE. RPL15 BINDING SITE is a target binding site found in the 3' untranslated region of mRNA encoded by RPL15, corresponding to a target binding site such as BINDING SITE I, BINDING SITE II or BINDING SITE III of FIG. 8. Table 4 illustrates the complementarity of the nucleotide sequences of RPL15 BINDING SITE, designated SEQ ID:14209, to the nucleotide sequence of GAM40 RNA, herein designated GAM RNA, also designated SEQ ID:396.

Another function of GAM40 is therefore inhibition of Ribosomal protein l15 (RPL15, Accession NP_002939.2). Accordingly, utilities of GAM40 include diagnosis, prevention and treatment of diseases and clinical conditions associated with RPL15.

SCOTIN (Accession NP_057563.3) is another GAM40 target gene, herein designated TARGET GENE. SCOTIN BINDING SITE is a target binding site found in the 3' untranslated region of mRNA encoded by SCOTIN, corresponding to a target binding site such as BINDING SITE I, BINDING SITE II or BINDING SITE III of FIG. 8. Table 4 illustrates the complementarity of the nucleotide sequences of SCOTIN BINDING SITE, designated SEQ ID:13969, to the nucleotide sequence of GAM40 RNA, herein designated GAM RNA, also designated SEQ ID:396.

Another function of GAM40 is therefore inhibition of SCOTIN (Accession NP_057563.3). Accordingly, utilities of GAM40 include diagnosis, prevention and treatment of diseases and clinical conditions associated with SCOTIN.

SEC15L (Accession NP_061926.2) is another GAM40 target gene, herein designated TARGET GENE. SEC15L BINDING SITE is a target binding site found in the 3' untranslated region of mRNA encoded by SEC15L, corresponding to a target binding site such as BINDING SITE I, BINDING SITE II or BINDING SITE III of FIG. 8. Table 4 illustrates the complementarity of the nucleotide sequences of SEC15L BINDING SITE, designated SEQ ID:870, to the nucleotide sequence of GAM40 RNA, herein designated GAM RNA, also designated SEQ ID:396.

Another function of GAM40 is therefore inhibition of SEC15L (Accession NP_061926.2). Accordingly, utilities of GAM40 include diagnosis, prevention and treatment of diseases and clinical conditions associated with SEC15L.

Secreted frizzled-related protein 1 (SFRP1, Accession NP_003003.2) is another GAM40 target gene, herein designated TARGET GENE. SFRP1 BINDING SITE is a target binding site found in the 3' untranslated region of mRNA encoded by SFRP1, corresponding to a target binding site such as BINDING SITE I, BINDING SITE II or BINDING SITE III of FIG. 8. Table 4 illustrates the complementarity of the nucleotide sequences of SFRP1 BINDING SITE, designated SEQ ID:597, to the nucleotide sequence of GAM40 RNA, herein designated GAM RNA, also designated SEQ ID:396.

Another function of GAM40 is therefore inhibition of Secreted frizzled-related protein 1 (SFRP1, Accession NP_003003.2), a gene which is a receptor for wnt proteins that may have an anti-apoptotic function and therefore may be associated with Colorectal cancer, gastric cancer, uterine leiomyomas. Accordingly, utilities of GAM40 include diagnosis, prevention and treatment of Colorectal cancer, gastric cancer, uterine leiomyomas, and of other diseases and clinical conditions associated with SFRP1.

The function of SFRP1 has been established by previous studies. A frequent epigenetic change in cancer involves aberrantly hypermethylated CpG islands in gene promoters, with loss of transcription of the genes (Baylin and Herman, (2000)) Cameron et al. (1999) showed that silencing of hypermethylated genes in cancer is dependent on both methylation of dense CpG islands and histone deacetylase (see OMIM Ref. No. 601241) activity. Suzuki et al. (2002) used cDNA microarray analysis to screen for genes that are epigenetically silenced in human colorectal cancer. By screening over 10,000 genes, they showed that they could identify a substantial number of genes with promoter hypermethylation in a given cancer; these are distinct from genes with unmethylated promoters, for which increased expression is produced by histone deacetylase inhibition alone. Many of the hypermethylated genes identified have high potential for roles in tumorigenesis by virtue of their predicted function and chromosome position. They also identified a group of genes that are preferentially hypermethylated in colorectal cancer and gastric cancer. One of these genes, SFRP1, belongs to a gene family; Suzuki et al. (2002) showed that hypermethylation of 4 genes in this family occur frequently in colorectal cancer, providing for (i) a unique potential mechanism for loss of tumor suppressor gene function and (ii) construction of a molecular marker panel that could detect virtually all colorectal cancer. Fukuhara et al. (2002) investigated the expression and function of SFRP1 in uterine leiomyomas. Northern and Western blot analyses detected increased SFRP1 expression in leiomyomas compared with normal myometrium. Expression was strongest in the late follicular phase (high estrogenic milieu) of the menstrual cycle. Interestingly, expression was negligible in leiomyomas treated with GNRH agonist. They authors concluded that strong SFRP1 expression, which appeared to be independent of cell proliferation, under high estrogenic conditions contributes to the development of uterine leiomyomas through the antiapoptotic effect of SFRP1.

Full details of the abovementioned studies are described in the following publications, the disclosure of which are hereby incorporated by reference:

Suzuki, H.; Gabrielson, E.; Chen, W.; Anbazhagan, R.; van Engeland, M.; Weijenberg, M. P.; Herman, J. G.; Baylin, S. B.: A genomic screen for genes upregulated by demethylation and histone deacetylase inhibition in human colorectal cancer. Nature Genet. 31:141-149, 2002; and Fukuhara, K.; Kariy, M.; Kita, M.; Shime, H.; Kanamori, T.; Kosaka, C.; Orii, A.; Fujita, J.; Fujii, S.: Secreted frizzled related protein 1 is overexpressed in uterine leiomyomas, ass.

Further studies establishing the function and utilities of SFRP1 are found in John Hopkins OMIM database record ID 604156, and in cited publications listed in Table 5, which are hereby incorporated by reference. Sideroflexin 1 (SFXN1, Accession NP_073591.2) is another GAM40 target gene, herein designated TARGET GENE. SFXN1 BINDING SITE is a target binding site found in the 3' untranslated region of mRNA encoded by SFXN1, corresponding to a target binding site such as BINDING SITE I, BINDING SITE II or BINDING SITE III of FIG. 8. Table 4 illustrates the complementarity of the nucleotide sequences of SFXN1 BINDING SITE, designated SEQ ID:1452, to the nucleotide sequence of GAM40 RNA, herein designated GAM RNA, also designated SEQ ID:396.

Another function of GAM40 is therefore inhibition of Sideroflexin 1 (SFXN1, Accession NP_073591.2). Accordingly, utilities of GAM40 include diagnosis, prevention and treatment of diseases and clinical conditions associated with SFXN1.

Solute carrier family 1 (neutral amino acid transporter), member 5 (SLC1A5, Accession NP_005619.1) is another GAM40 target gene, herein designated TARGET GENE. SLC1A5 BINDING SITE is a target binding site found in the 5' untranslated region of mRNA encoded by SLC1A5, corresponding to a target binding site such as BINDING SITE I, BINDING SITE II or BINDING SITE III of FIG. 8. Table 4 illustrates the complementarity of the nucleotide sequences of SLC1A5 BINDING SITE, designated SEQ ID:6435, to the nucleotide sequence of GAM40 RNA, herein designated GAM RNA, also designated SEQ ID:396.

Another function of GAM40 is therefore inhibition of Solute carrier family 1 (neutral amino acid transporter), member 5 (SLC1A5, Accession NP_005619.1). Accordingly, utilities of GAM40 include diagnosis, prevention and treatment of diseases and clinical conditions associated with SLC1A5.

Solute carrier family 9 (sodium/hydrogen exchanger), isoform 6 (SLC9A6, Accession NP_006350.1) is another GAM40 target gene, herein designated TARGET GENE. SLC9A6 BINDING SITE is a target binding site found in the 3' untranslated region of mRNA encoded by SLC9A6, corresponding to a target binding site such as BINDING SITE I, BINDING SITE II or BINDING SITE III of FIG. 8. Table 4 illustrates the complementarity of the nucleotide sequences of SLC9A6 BINDING SITE, designated SEQ ID:8100, to the nucleotide sequence of GAM40 RNA, herein designated GAM RNA, also designated SEQ ID:396.

Another function of GAM40 is therefore inhibition of Solute carrier family 9 (sodium/hydrogen exchanger), isoform 6 (SLC9A6, Accession NP_006350.1), a gene which is involved electroneutral exchange of protons for na+ and k+ across the mitochondrial inner membrane. Accordingly, utilities of GAM40 include diagnosis, prevention and treatment of diseases and clinical conditions associated with SLC9A6.

The function of SLC9A6 has been established by previous studies. By searching sequence databases for proteins with sequence similarity to the S. cerevisiae mitochondrial sodium/hydrogen exchanger Nha2, Numata et al. (1998) identified the deduced protein product of the KIAA0267 cDNA (Nagase et al., 1996), SLC9A6. The KIAA0267-encoded protein shares 30% amino acid sequence identity with S. cerevisiae Nha2, and approximately 20 to 24% identity with the mammalian NHE isoforms NHE1 to NHE5 (see OMIM Ref. No. SLC9A5; 600477). Numata et al. (1998), who concluded that the KIAA0267 cDNA lacks 5-prime coding sequence, isolated a human cDNA containing the complete coding sequence of SLC9A6, which they called NHE6. The deduced 669-amino acid SLC9A6 protein has 12 putative membrane-spanning segments within the N-terminal region, and a hydrophilic C terminus, similar to the topologies predicted for other NHEs. In addition, SLC9A6 has a putative mitochondrial inner membrane targeting signal at its N terminus. Northern blot analysis detected an approximately 5.5-kb SLC9A6 transcript that was ubiquitously expressed, with the most abundant expression in mitochondrion-rich tissues such as brain, skeletal muscle, and heart. Fluorescence microscopy suggested that SLC9A6 localizes to mitochondria. Numata et al. (1998) deleted the S. cerevisiae NHA2 gene by homologous disruption and found that benzamil-inhibitable, acid-activated sodium uptake into mitochondria was abolished in the mutant strain. The mutant strain also showed retarded growth on nonfermentable carbon sources and severely reduced survival during the stationary phase of the cell cycle compared with the parental strain, consistent with a defect in aerobic metabolism. The authors suggested that Nha2 and SLC9A6 are homologous sodium/hydrogen exchangers that are important for mitochondrial function.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996. Note: Supplement: DNA Res. 3:341-354, 1996; and Numata, M.; Petrecca, K.; Lake, N.; Orlowski, J.: Identification of a mitochondrial Na+/H+ exchanger. J. Biol. Chem. 273:6951-6959, 1998.

Further studies establishing the function and utilities of SLC9A6 are found in John Hopkins OMIM database record ID 300231, and in cited publications listed in Table 5, which are hereby incorporated by reference. SMAP-1 (Accession NP_061141.2) is another GAM40 target gene, herein designated TARGET GENE. SMAP-1 BINDING SITE is a target binding site found in the 3' untranslated region of multiple transcripts of mRNA encoded by SMAP-1, corresponding to a target binding site such as BINDING SITE I, BINDING SITE II or BINDING SITE III of FIG. 8. Table 4 illustrates the complementarity of the nucleotide sequences of SMAP-1 BINDING SITE, designated SEQ ID:11457, to the nucleotide sequence of GAM40 RNA, herein designated GAM RNA, also designated SEQ ID:396.

Another function of GAM40 is therefore inhibition of SMAP-1 (Accession NP_061141.2). Accordingly, utilities of GAM40 include diagnosis, prevention and treatment of diseases and clinical conditions associated with SMAP-1.

Sperm associated antigen 4 (SPAG4, Accession NP_003107.1) is another GAM40 target gene, herein designated TARGET GENE. SPAG4 BINDING SITE is a target binding site found in the 5' untranslated region of mRNA encoded by SPAG4, corresponding to a target binding site such as BINDING SITE I, BINDING SITE II or BINDING SITE III of FIG. 8. Table 4 illustrates the complementarity of the nucleotide sequences of SPAG4 BINDING SITE, designated SEQ ID:7992, to the nucleotide sequence of GAM40 RNA, herein designated GAM RNA, also designated SEQ ID:396.

Another function of GAM40 is therefore inhibition of Sperm associated antigen 4 (SPAG4, Accession NP_003107.1), a gene which predicted ortholog of rat SPAG4 which interacts with rat ODF27, the 27 kda outer dense fiber protein. Accordingly, utilities of GAM40 include diagnosis, prevention and treatment of diseases and clinical conditions associated with SPAG4.

The function of SPAG4 has been established by previous studies. Mammalian sperm tails contain, besides an axoneme, 2 unique components: outer dense fibers (ODF), which extend along the entire tail, and a fibrous sheath (FS), which initiates at the stack of mitochondria and surrounds the ODF until the end of the sperm tail. Defects in these structures have been associated with reduced sperm tail motility and human infertility. Early studies indicated that ODF proteins are testis-specific and are synthesized in elongating spermatids. One ODF gene, ODF27 (ODF1; 182878), was cloned by van der Hoorn et al. (1990) and others. Shao and van der Hoorn (1996) used a yeast 2-hybrid screening with the leucine zipper region of ODF27 as bait to isolate rat testis-specific proteins that could interact with ODF27 (Shao et al., 1997). One of the novel genes encoded the major 84-kD ODF protein (OMIM Ref. No. 602015), the human homolog of which maps to 9q34. Another of the new genes, SPAG4, also encoded a product that interacted strongly with ODF27 via a leucine zipper and was expressed exclusively, although transiently, in elongating spermatids; protein synthesis of SPAG4 was maximal during maximal ODF27 synthesis and growth of the sperm tail. However, the product of the SPAG4 gene was not incorporated into the mature sperm tail. Tarnasky et al. (1998) cloned the human SPAG4 homolog and by fluorescence in situ hybridization demonstrated that the gene maps to 20q11.

Full details of the abovementioned studies are described in the following publications, the disclosure of which are hereby incorporated by reference:

Shao, X.; van der Hoorn, F. A.: Self-interaction of the major 27-kilodalton outer dense fiber protein is in part mediated by a leucine zipper domain in the rat. Biol. Reprod. 55:1343-1350, 1996; and Tarnasky, H.; Gill, D.; Murthy, S.; Shao, X.; Demetrick, D. J.; van der Hoorn, F. A.: A novel testis-specific gene, SPAG4, whose product interacts specifically with outer dense fiber pr.

Further studies establishing the function and utilities of SPAG4 are found in John Hopkins OMIM database record ID 603038, and in cited publications listed in Table 5, which are hereby incorporated by reference. Toll-like receptor 5 (TLR5, Accession NP_003259.2) is another GAM40 target gene, herein designated TARGET GENE. TLR5 BINDING SITE is a target binding site found in the 5' untranslated region of mRNA encoded by TLR5, corresponding to a target binding site such as BINDING SITE I, BINDING SITE II or BINDING SITE III of FIG. 8. Table 4 illustrates the complementarity of the nucleotide sequences of TLR5 BINDING SITE, designated SEQ ID:9677, to the nucleotide sequence of GAM40 RNA, herein designated GAM RNA, also designated SEQ ID:396.

Another function of GAM40 is therefore inhibition of Toll-like receptor 5 (TLR5, Accession NP_003259.2), a gene which participates in the innate immune response to bacterial flagellins. Accordingly, utilities of GAM40 include diagnosis, prevention and treatment of diseases and clinical conditions associated with TLR5.

The function of TLR5 has been established by previous studies. By searching an EST database for human Toll homologs, Chaudhary et al. (1998) identified cDNA sequences from 2 genes that they called TIL3 and TIL4 (TLR2; 603028). Muzio et al. (2000) determined the differential expression pattern of the TLRs in leukocytes. Like TLR2 and TLR4, TLR5 was expressed in myelomonocytic cells, but at lower levels. Hayashi et al. (2001) showed that expression of TLR5 induces NF-kappa-B activation and TNFA (OMIM Ref. No. 191160) production. Pathogen-associated molecular patterns (PAMPs) known to stimulate other TLR family members failed to stimulate TLR5; however, luciferase reporter assays indicated TLR5 activation in gram-positive and -negative bacterial culture supernatants. By fractionation of Listeria culture supernatants followed by SDS-PAGE, Hayashi et al. (2001) identified flagellin as the TLR5 ligand. Flagellin, a principal component of bacterial flagella, is a virulence factor recognized by the innate immune system in plants, insects, and mammals. Expression of flagellin in nonflagellated bacteria resulted in TLR5 activation, and deletion of flagellin from flagellated bacteria abrogated TLR5 activation. Hayashi et al. (2001) demonstrated that injection of flagellin induces the production of IL6 (OMIM Ref. No. 147620) in wildtype mice, but not in those lacking the MyD88 (OMIM Ref. No. 602170) adaptor protein, required for TLR signaling. Hayashi et al. (2001) concluded that TLR5 is a pattern- recognition receptor and that its PAMP is flagellin, a protein with conserved N and C termini in a broad group of motile pathogens.

Full details of the abovementioned studies are described in the following publications, the disclosure of which are hereby incorporated by reference:

Chaudhary, P. M.; Ferguson, C.; Nguyen, V.; Nguyen, O.; Massa, H. F.; Eby, M.; Jasmin, A.; Trask, B. J.; Hood, L.; Nelson, P. S.: Cloning and characterization of two Toll/interleukin-1 receptor-like genes TIL3 and TIL4: evidence for a multi-gene receptor family in humans. Blood 91:4020-4027, 1998; and Hayashi, F.; Smith, K. D.; Ozinsky, A.,; Hawn, T. R.; y, E. C.; Goodlett, D. R.; Eng, J. K.; Akira, S.; Underhill, D. M.; Aderem, A.: The innate immune response to bacterial flagellin.

Further studies establishing the function and utilities of TLR5 are found in John Hopkins OMIM database record ID 603031, and in cited publications listed in Table 5, which are hereby incorporated by reference. Translocase of outer mitochondrial membrane 70 homolog a (yeast) (TOMM70A, Accession NP_055635.1) is another GAM40 target gene, herein designated TARGET GENE. TOMM70A BINDING SITE is a target binding site found in the 3' untranslated region of mRNA encoded by TOMM70A, corresponding to a target binding site such as BINDING SITE I, BINDING SITE II or BINDING SITE III of FIG. 8. Table 4 illustrates the complementarity of the nucleotide sequences of TOMM70A BINDING SITE, designated SEQ ID:14026, to the nucleotide sequence of GAM40 RNA, herein designated GAM RNA, also designated SEQ ID:396.

Another function of GAM40 is therefore inhibition of Translocase of outer mitochondrial membrane 70 homolog a (yeast) (TOMM70A, Accession NP_055635.1). Accordingly, utilities of GAM40 include diagnosis, prevention and treatment of diseases and clinical conditions associated with TOMM70A.

Tnfrsf1a-associated via death domain (TRADD, Accession NP_003780.1) is another GAM40 target gene, herein designated TARGET GENE. TRADD BINDING SITE is a target binding site found in the 3' untranslated region of multiple transcripts of mRNA encoded by TRADD, corresponding to a target binding site such as BINDING SITE I, BINDING SITE II or BINDING SITE III of FIG. 8. Table 4 illustrates the complementarity of the nucleotide sequences of TRADD BINDING SITE, designated SEQ ID:9944, to the nucleotide sequence of GAM40 RNA, herein designated GAM RNA, also designated SEQ ID:396.

Another function of GAM40 is therefore inhibition of Tnfrsf1a-associated via death domain (TRADD, Accession NP_003780.1), a gene which specifically interacts with the cytoplasmic domain of activated tnfr1. interacts with trafs (traf1 and traf2), fadd and rip. acts as an adaptor molecule for tnfr1 mediating its interaction with fadd. overexpression of tradd leads to two major tnf-induced responses, apoptosis and activation of nf-kappa b. Accordingly, utilities of GAM40 include diagnosis, prevention and treatment of diseases and clinical conditions associated with TRADD.

The function of TRADD has been established by previous studies. Many diverse activities of tumor necrosis factor (TNF) are signaled through TNF receptor-1 (TNFR1; 191190). TNFR1 contains an intracellular death domain (see OMIM Ref. No. DR3; 603366) that is required for signaling antiviral activity, programmed cell death, and NF-kappa-B (OMIM Ref. No. 164011) activation. TNF- induced apoptosis involves activation of the ICE cysteine protease (OMIM Ref. No. 147678). By using a yeast 2-hybrid screen to identify proteins that interact with the death domain of TNFR1, Hsu et al. (1995) isolated cDNAs encoding a 34-kD protein that they designated TRADD (TNFR1-associated death domain protein). Overexpression of TRADD led to 2 major TNF-induced responses, apoptosis and activation of NF-kappa-B. The predicted 312-amino acid TRADD protein contains a 111-amino acid death domain with sequence similarity to that of TNFR1. This region of TRADD is capable of mediating TRADD oligomerization, TNFR1 interaction, stimulation of apoptosis, and NF-kappa-B activation. TRADD- mediated cell death can be suppressed by expression of the cowpox virus crmA gene, which encodes an inhibitor of ICE. However, crmA expression does not inhibit NF-kappa-B activation by TRADD, demonstrating that the 2 signaling pathways emanating from TRADD are distinct. Northern blot analysis revealed that the 1.4-kb TRADD mRNA is expressed ubiquitously. Park et al. (2000) determined the crystal structure of the complex between the N-terminal domain of TRADD (residues 1 to 169) and the TRAF domain of TRAF2 (601895; residues 327 to 501) at 2.0-angstrom resolution. The structure revealed a novel mode of interaction mediated by a relatively extensive protein-protein interface. Pan et al. (1996) isolated the mouse Tradd gene and found that it contains 4 exons and spans less than 7 kb. The predicted mouse and human TRADD proteins are 75% identical. By analysis of an interspecific backcross, they mapped the Tradd gene to the distal region of mouse chromosome 8, in a region showing homology of synteny to human chromosome 16q22. By FISH, Scheuerpflug et al. (2001) mapped the human TRADD gene to chromosome 16q22.

Full details of the abovementioned studies are described in the following publications, the disclosure of which are hereby incorporated by reference:

Park, Y. C.; y, H.; Hsia, C.; Segal, D.; Rich, R. L.; Liou, H.-C.; Myszka, D. G.; Wu, H.: A novel mechanism of TRAF signaling revealed by structural and functional analyses of the TRADD-TRAF2 interaction. Cell 101:777-787, 2000; and Scheuerpflug, C. G.; Lichter, P.; Debatin, K.-M.; Mincheva, A.: Assignment of TRADD to human chromosome band 16q22 by in situ hybridization. Cytogenet. Cell Genet. 92:347-348, 2001.

Further studies establishing the function and utilities of TRADD are found in John Hopkins OMIM database record ID 603500, and in cited publications listed in Table 5, which are hereby incorporated by reference. Tnfrsf1a-associated via death domain (TRADD, Accession NP_700474.1) is another GAM40 target gene, herein designated TARGET GENE. TRADD BINDING SITE is a target binding site found in the 3' untranslated region of multiple transcripts of mRNA encoded by TRADD, corresponding to a target binding site such as BINDING SITE I, BINDING SITE II or BINDING SITE III of FIG. 8. Table 4 illustrates the complementarity of the nucleotide sequences of TRADD BINDING SITE, designated SEQ ID:9944, to the nucleotide sequence of GAM40 RNA, herein designated GAM RNA, also designated SEQ ID:396.

Another function of GAM40 is therefore inhibition of Tnfrsf1a-associated via death domain (TRADD, Accession NP_700474.1), a gene which specifically interacts with the cytoplasmic domain of activated tnfr1. interacts with trafs (traf1 and traf2), fadd and rip. acts as an adaptor molecule for tnfr1 mediating its interaction with fadd. overexpression of tradd leads to two major tnf-induced responses, apoptosis and activation of nf-kappa b. Accordingly, utilities of GAM40 include diagnosis, prevention and treatment of diseases and clinical conditions associated with TRADD.

The function of TRADD has been established by previous studies. Many diverse activities of tumor necrosis factor (TNF) are signaled through TNF receptor-1 (TNFR1; 191190). TNFR1 contains an intracellular death domain (see OMIM Ref. No. DR3; 603366) that is required for signaling antiviral activity, programmed cell death, and NF-kappa-B (OMIM Ref. No. 164011) activation. TNF- induced apoptosis involves activation of the ICE cysteine protease (OMIM Ref. No. 147678). By using a yeast 2-hybrid screen to identify proteins that interact with the death domain of TNFR1, Hsu et al. (1995) isolated cDNAs encoding a 34-kD protein that they designated TRADD (TNFR1-associated death domain protein). Overexpression of TRADD led to 2 major TNF-induced responses, apoptosis and activation of NF-kappa-B. The predicted 312-amino acid TRADD protein contains a 111-amino acid death domain with sequence similarity to that of TNFR1. This region of TRADD is capable of mediating TRADD oligomerization, TNFR1 interaction, stimulation of apoptosis, and NF-kappa-B activation. TRADD- mediated cell death can be suppressed by expression of the cowpox virus crmA gene, which encodes an inhibitor of ICE. However, crmA expression does not inhibit NF-kappa-B activation by TRADD, demonstrating that the 2 signaling pathways emanating from TRADD are distinct. Northern blot analysis revealed that the 1.4-kb TRADD mRNA is expressed ubiquitously. Park et al. (2000) determined the crystal structure of the complex between the N-terminal domain of TRADD (residues 1 to 169) and the TRAF domain of TRAF2 (601895; residues 327 to 501) at 2.0-angstrom resolution. The structure revealed a novel mode of interaction mediated by a relatively extensive protein-protein interface. Pan et al. (1996) isolated the mouse Tradd gene and found that it contains 4 exons and spans less than 7 kb. The predicted mouse and human TRADD proteins are 75% identical. By analysis of an interspecific backcross, they mapped the Tradd gene to the distal region of mouse chromosome 8, in a region showing homology of synteny to human chromosome 16q22. By FISH, Scheuerpflug et al. (2001) mapped the human TRADD gene to chromosome 16q22.

Full details of the abovementioned studies are described in the following publications, the disclosure of which are hereby incorporated by reference:

Park, Y. C.; y, H.; Hsia, C.; Segal, D.; Rich, R. L.; Liou, H.-C.; Myszka, D. G.; Wu, H.: A novel mechanism of TRAF signaling revealed by structural and functional analyses of the TRADD-TRAF2 interaction. Cell 101:777-787, 2000; and Scheuerpflug, C. G.; Lichter, P.; Debatin, K.-M.; Mincheva, A.: Assignment of TRADD to human chromosome band 16q22 by in situ hybridization. Cytogenet. Cell Genet. 92:347-348, 2001.

Further studies establishing the function and utilities of TRADD are found in John Hopkins OMIM database record ID 603500, and in cited publications listed in Table 5, which are hereby incorporated by reference. Winged-helix nude (WHN, Accession NP_003584.2) is another GAM40 target gene, herein designated TARGET GENE. WHN BINDING SITE is a target binding site found in the 3' untranslated region of mRNA encoded by WHN, corresponding to a target binding site such as BINDING SITE I, BINDING SITE II or BINDING SITE III of FIG. 8. Table 4 illustrates the complementarity of the nucleotide sequences of WHN BINDING SITE, designated SEQ ID:9862, to the nucleotide sequence of GAM40 RNA, herein designated GAM RNA, also designated SEQ ID:396.

Another function of GAM40 is therefore inhibition of Winged-helix nude (WHN, Accession NP_003584.2), a gene which plays a role in transcriptional regulation and therefore may be associated with T-cell immunodeficiency, the skin disorder congenital alopecia, and nail dystrophy. Accordingly, utilities of GAM40 include diagnosis, prevention and treatment of T-cell immunodeficiency, the skin disorder congenital alopecia, and nail dystrophy, and of other diseases and clinical conditions associated with WHN.

The function of WHN has been established by previous studies. In 2 sisters with T-cell immunodeficiency, congenital alopecia, and nail dystrophy (OMIM Ref. No. 601705), Frank et al. (1999) identified a homozygous nonsense mutation in the WHN gene. In mammals, whn expression occurs in epithelial cells of the thymus as well as specific cells of the hair follicle. In the human, WHN is expressed in the differentiating cells of the hair follicle precortex and the innermost cell layer of the outer root sheath. Expression in the thymus was not determine.

Animal model experiments lend further support to the function of WHN. Mutations at the 'nude' locus of mice and rats disrupt normal hair growth and thymus development, causing nude mice and rats to be immune-deficient. Nehls et al. (1994) showed that a gene designated whn, located in the region of mouse chromosome 11 known to contain the nude locus, encodes a new member of the winged-helix domain family of transcription factors. The predicted protein is 648 amino acids long. The whn gene was disrupted on the mouse and rat nude alleles. Mutant transcripts did not encode the characteristic DNA-binding domain, strongly suggesting that the whn gene is the nude gene. Mutations in winged-helix domain genes cause homeotic transformations in Drosophila and distort cell-fate decisions during vulval development in C. elegans. The whn gene was thus the first member of this class of genes to be implicated in a specific developmental defect in vertebrates It is appreciated that the abovementioned animal model for WHN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Frank, J.; Pignata, C.; Panteleyev, A. A.; Prowse, D. M.; Baden, H.; Weiner, L.; Gaetaniello, L.; Ahmad, W.; Pozzi, N.; Caerhalmi-Friedman, P. B.; Aita, V. M.; Uyttendaele, H.; Gordon, D.; Ott, J.; Brissette, J. L.; Christiano, A. M.: Exposing the human nude phenotype. Nature 398:473-474, 1999; and Nehls, M.; Pfeifer, D.; Schorpp, M.; Hedrich, H.; Boehm, T.: New member of the winged-helix protein family disrupted in mouse and rat nude mutations. Nature 372:103-107, 1994.

Further studies establishing the function and utilities of WHN are found in John Hopkins OMIM database record ID 600838, and in cited publications listed in Table 5, which are hereby incorporated by reference. Tyrosine 3-monooxygenase/tryptophan 5-monooxygenase activation protein, gamma polypeptide (YWHAG, Accession NP_036611.2) is another GAM40 target gene, herein designated TARGET GENE. YWHAG BINDING SITE is a target binding site found in the 3' untranslated region of mRNA encoded by YWHAG, corresponding to a target binding site such as BINDING SITE I, BINDING SITE II or BINDING SITE III of FIG. 8. Table 4 illustrates the complementarity of the nucleotide sequences of YWHAG BINDING SITE, designated SEQ ID:19676, to the nucleotide sequence of GAM40 RNA, herein designated GAM RNA, also designated SEQ ID:396.

Another function of GAM40 is therefore inhibition of Tyrosine 3-monooxygenase/tryptophan 5-monooxygenase activation protein, gamma polypeptide (YWHAG, Accession NP_036611.2), a gene which mediates mitogenic signals of PDGF in vascular smooth muscle cells. Accordingly, utilities of GAM40 include diagnosis, prevention and treatment of diseases and clinical conditions associated with YWHAG.

The function of YWHAG has been established by previous studies. Members of the 14-3-3 protein family play an important role in signal transduction leading to mitosis and cellular proliferation (Morrison, 1994). For background information on 14-3-3 proteins, see 113508. Autieri et al. (1995, 1996) found that rat 14-3-3-gamma (YWHAG) is upregulated in injured rat carotid arteries and that YWHAG mRNA is upregulated in cytokine-stimulated human vascular smooth muscle cells (VSMC). Using PCR primers based on the rat YWHAG sequence to screen human VSMC, Autieri and Carbone (1999) isolated a cDNA encoding YWHAG. The deduced 246-amino acid protein, which shares 98% sequence identity with the rat sequence, has preserved 14-3-3 family signature motifs, a predicted annexin motif, and several potential phosphorylation sites but not the CDK2 (OMIM Ref. No. 116953) phosphorylation motif. By EST database searching, Horie et al. (1999) also obtained a cDNA encoding YWHAG, which they found to be 100% identical to the 247-amino acid rat sequence. Northern blot analysis revealed ubiquitous expression of a 3.8-kb YWHAG transcript that is relatively strong in brain, skeletal muscle, and heart but weak in peripheral blood leukocytes. By SDS-PAGE and autoradiographic analysis, Autieri and Carbone (1999) found that YWHAG is expressed and phosphorylated by activation with platelet-derived growth factor (OMIM Ref. No. 190040) and other activators of several isoforms of protein kinase C (PKC; e.g., 176960). Inhibitors of PKC block YWHAG phosphorylation. Western blot analysis showed that YWHAG interacts with PKC and with RAF1 (OMIM Ref. No. 164760).

Full details of the abovementioned studies are described in the following publications, the disclosure of which are hereby incorporated by reference:

Autieri, M. V.; Carbone, C. J.:.: 14-3-3-Gamma interacts with and is phosphorylated by multiple protein kinase C isoforms in PDGF-stimulated human vascular smooth muscle cells. DNA Cell Biol. 18:555-564, 1999; and Horie, M.; Suzuki, M.; Takahashi, E.; Tanigami, A.: Cloning, expression, and chromosomal mapping of the human 14-3-3gamma gene (YWHAG) to 7q11.23. Genomics 60:241-243, 1999.

Further studies establishing the function and utilities of YWHAG are found in John Hopkins OMIM database record ID 605356, and in cited publications listed in Table 5, which are hereby incorporated by reference. ZNF408 (Accession NP_079017.1) is another GAM40 target gene, herein designated TARGET GENE. ZNF408 BINDING SITE is a target binding site found in the 3' untranslated region of mRNA encoded by ZNF408, corresponding to a target binding site such as BINDING SITE I, BINDING SITE II or BINDING SITE III of FIG. 8. Table 4 illustrates the complementarity of the nucleotide sequences of ZNF408 BINDING SITE, designated SEQ ID:14053, to the nucleotide sequence of GAM40 RNA, herein designated GAM RNA, also designated SEQ ID:396.

Another function of GAM40 is therefore inhibition of ZNF408 (Accession NP_079017.1). Accordingly, utilities of GAM40 include diagnosis, prevention and treatment of diseases and clinical conditions associated with ZNF408.

FIG. 8 further provides a conceptual description of a novel bioinformatically detected of the present invention, referred to here as Genomic Address Messenger 41 (GAM41), which modulates expression of respective target genes thereof, the function and utility of which target genes is known in the art.

GAM41 is a novel bioinformatically detected regulatory, non protein coding, micro RNA (miRNA) gene. The method by which GAM41 was detected is described hereinabove with reference to FIGS. 8-15.

GAM41 gene, herein designated GAM GENE, and GAM41 target gene, herein designated TARGET GENE, are human genes contained in the human genome.

GAM41 gene encodes a GAM41 precursor RNA, herein designated GAM PRECURSOR RNA. Similar to other miRNA genes, and unlike most ordinary genes, GAM41 precursor RNA does not encode a protein. A nucleotide sequence identical or highly similar to the nucleotide sequence of GAM41 precursor RNA is designated SEQ ID:13, and is provided hereinbelow with reference to the sequence listing part. Nucleotide sequence SEQ ID:13 is located at position 66039675 relative to chromosome 5.

GAM41 precursor RNA folds onto itself, forming GAM41 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM41 precursor RNA folds onto itself, forming GAM41 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM41 precursor RNA, designated SEQ-ID:13, and a schematic representation of a predicted secondary folding of GAM41 folded precursor RNA are further described with reference to Table 2, hereby incorporated by reference.

An enzyme complex designated DICER COMPLEX, 'dices' the GAM41 folded precursor RNA into GAM41 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM41 RNA is designated SEQ ID:215, and is provided hereinbelow with references to the sequence listing part and Table 3, hereby incorporated by reference.

GAM41 target gene, herein designated TARGET GENE, encodes a corresponding messenger RNA, GAM41 target RNA, herein designated GAM TARGET RNA. GAM41target RNA comprises three regions, as is typical of mRNA of a protein coding gene: a 5' untranslated region, a protein coding region and a 3' untranslated region, designated 5'UTR, PROTEIN CODING and 3'UTR respectively.

GAM41 RNA, herein designated GAM RNA, binds complementarily to one or more target binding sites located in untranslated regions of GAM41 target RNA, herein designated GAM TARGET RNA. This complementary binding is due to the fact that the nucleotide sequence of GAM41 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM41 RNA may have a different number of target binding sites in untranslated regions of a GAM41 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM41 RNA, herein designated GAM RNA, to target binding sites on GAM41 target RNA, herein designated GAM TARGET RNA, such as BINDING SITE I, BINDING SITE II and BINDING SITE III, inhibits translation of GAM41target RNA into GAM41 target protein, herein designated GAM TARGET PROTEIN. GAM target protein is therefore outlined by a broken line.

It is appreciated that GAM41 target gene, herein designated TARGET GENE, in fact represents a plurality of GAM41 target genes. The mRNA of each one of this plurality of GAM41 target genes comprises one or more target binding sites, each having a nucleotide sequence which is at least partly complementary to GAM41 RNA, herein designated GAM RNA, and which when bound by GAM41 RNA causes inhibition of translation of respective one or more GAM41 target proteins.

It is further appreciated by one skilled in the art that the mode of translational inhibition illustrated by FIG. 8 with specific reference to translational inhibition exerted by GAM41 gene, herein designated GAM GENE, on one or more GAM41target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM41 correlate with, and may be deduced from, the identity of the target genes which GAM41 binds and inhibits, and the function of these target genes, as elaborated hereinbelow.

AF3P21 (Accession NM_016453.1) is a GAM41 target gene, herein designated TARGET GENE. AF3P21 BINDING SITE is a target binding site found in the 3' untranslated region of mRNA encoded by AF3P21, corresponding to a target binding site such as BINDING SITE I, BINDING SITE II or BINDING SITE III of FIG. 8. Table 4 illustrates the complementarity of the nucleotide sequences of AF3P21 BINDING SITE, designated SEQ ID:6543, to the nucleotide sequence of GAM41 RNA, herein designated GAM RNA, also designated SEQ ID:215.

A function of GAM41 is therefore inhibition of AF3P21 (Accession NM_016453.1), a gene which has an important role in stress fiber formation induced by active diaphanous protein homolog 1 (drf1). and therefore is associated with Involved in therapy-related leukemia. Accordingly, utilities of GAM41 include diagnosis, prevention and treatment of Involved in therapy-related leukemia, and of other diseases and clinical conditions associated with AF3P21.

The function of AF3P21 has been established by previous studies. Sano et al. (2000) identified the AF3p21 gene as a novel fusion partner of the MLL gene (OMIM Ref. No. 159555) in a 23-year-old patient who developed therapy-related leukemia (AML, FAB M5b) with t(3;11)(p21;q23). Hayakawa et al. (2001) further characterized the AF3p21 gene. AF3p21 encodes a nuclear protein consisting of 722 amino acids with an SH3 domain, a proline-rich domain, and a bipartite nuclear localization signal. The protein's SH3 domain has high homology with that of FYN (OMIM Ref. No. 137025). Hayakawa et al. (2001) found that in DNA from the patient's leukemic cells, intron 6 of the MLL gene was fused at a point upstream of exon 1 in the AF3p21 gene, and that the der(11) chromosome formed an MLL-AF3p21 fusion transcript in leukemic cells, whereas the der(3) chromosome did not form any fusion transcript. Dot blot RNA analysis showed that the AF3p21 gene was expressed in all adult and embryonic human tissues examined, including bone marrow, brain, liver, thymus, lung, and skeletal muscle. Northern blot analysis of HeLa cell RNA detected a 3.5-kb transcript. The protein has an apparent molecular weight of 80 kD and is localized exclusively in the cell nucleus. These results suggested that AF3p21 protein plays a role in signal transduction in the nucleus. Hayakawa et al. (2001) determined that the AF3p21 gene on 3p21 is 19 kb long and consists of 13 exons.

Full details of the abovementioned studies are described in the following publications, the disclosure of which are hereby incorporated by reference:

Hayakawa, A.; Matsuda, Y.; Daibata, M.; Nakamura, H.; Sano, K.: Genomic organization, tissue expression, and cellular localization of AF3p21, a fusion partner of MLL in therapy-related leukemia. Genes Chromosomes Cancer 30:364-374, 2001; and Sano, K.; Hayakawa, A.; Piao, J.-H.; Kosaka, Y.; Nakamura, H.: Novel SH3 protein encoded by the AF3p21 gene is fused to the mixed lineage leukemia protein in a therapy-related leukemi.

Further studies establishing the function and utilities of AF3P21 are found in John Hopkins OMIM database record ID 606671, and in cited publications listed in Table 5, which are hereby incorporated by reference. Adaptor-related protein complex 2, alpha 1 subunit (AP2A1, Accession NM_014203.2) is another GAM41 target gene, herein designated TARGET GENE. AP2A1 BINDING SITE is a target binding site found in the 3' untranslated region of multiple transcripts of mRNA encoded by AP2A1, corresponding to a target binding site such as BINDING SITE I, BINDING SITE II or BINDING SITE III of FIG. 8. Table 4 illustrates the complementarity of the nucleotide sequences of AP2A1 BINDING SITE, designated SEQ ID:16866, to the nucleotide sequence of GAM41 RNA, herein designated GAM RNA, also designated SEQ ID:215.

Another function of GAM41 is therefore inhibition of Adaptor-related protein complex 2, alpha 1 subunit (AP2A1, Accession NM_014203.2), a gene which plays a role in protein sorting in the late-golgi/trans-golgi network (tgn) and/or endosomes. Accordingly, utilities of GAM41 include diagnosis, prevention and treatment of diseases and clinical conditions associated with AP2A1.

The function of AP2A1 has been established by previous studies. Two separate AP2-alpha adaptor subunits of the clathrin coat assembly complex of the mouse were cloned by Robinson (1989). The alpha subunit is part of the so-called AP2 coat assembly protein complex (see OMIM Ref. No. 601024) which links clathrin (OMIM Ref. No. 118960) to receptors in the coated vesicles. The alpha adaptins are exclusively found in the endocytic coated vesicles. The 2 mouse proteins are 84% identical. Huntingtin-interacting protein 1 (HIP1; 601767) is enriched in membrane-containing cell fractions and has been implicated in vesicle trafficking. It is a multidomain protein containing an epsin (OMIM Ref. No. 607262) N-terminal homology (ENTH) domain, a central coiled-coil- forming region, and a C-terminal actin-binding domain. Waelter et al. (2001) identified 3 HIP1-associated proteins, clathrin heavy chain (CLTC; 118955) and alpha-adaptin A and C. In vitro binding studies revealed that the central coiled-coil domain of HIP1 is required for the interaction with clathrin, whereas DPF-like motifs located upstream to this domain are important for HIP1 binding to the C-terminal 'appendage' domain of alpha-adaptin A and C. Expression of full-length HIP1 in mammalian cells resulted in a punctate cytoplasmic immunostaining characteristic of clathrin-coated vesicles. The authors hypothesized that HIP1 is an endocytic protein, the structural integrity of which may be crucial for maintenance of normal vesicle size in vivo.

Full details of the abovementioned studies are described in the following publications, the disclosure of which are hereby incorporated by reference:

Robinson, M. S.: Cloning of cDNAs encoding two related 100-kD coated vesicle proteins (alpha-adaptins). J. Cell Biol. 108:833-42, 1989; and Waelter, S.; Scherzinger, E.; Hasenbank, R.; Nordhoff, E.; Lurz, R.; Goehler, H.; Gauss, C.; Sathasivam, K.; Bates, G. P.; Lehrach, H.; Wanker, E. E.: The huntingtin interacting protei.

Further studies establishing the function and utilities of AP2A1 are found in John Hopkins OMIM database record ID 601026, and in cited publications listed in Table 5, which are hereby incorporated by reference. Calpain 1, (mu/i) large subunit (CAPN1, Accession NM_005186.2) is another GAM41 target gene, herein designated TARGET GENE. CAPN1 BINDING SITE is a target binding site found in the 3' untranslated region of mRNA encoded by CAPN1, corresponding to a target binding site such as BINDING SITE I, BINDING SITE II or BINDING SITE III of FIG. 8. Table 4 illustrates the complementarity of the nucleotide sequences of CAPN1 BINDING SITE, designated SEQ ID:3659, to the nucleotide sequence of GAM41 RNA, herein designated GAM RNA, also designated SEQ ID:215.

Another function of GAM41 is therefore inhibition of Calpain 1, (mu/i) large subunit (CAPN1, Accession NM_005186.2), a gene which is an intracellular protease that requires calcium for its catalytic activity. Accordingly, utilities of GAM41 include diagnosis, prevention and treatment of diseases and clinical conditions associated with CAPN1.

The function of CAPN1 has been established by previous studies. Calpain (calcium-dependent protease; EC 3.4.22.17) is an intracellular protease that requires calcium for its catalytic activity. Two isozymes (CANP1 and CANP2), with different calcium requirements, have been identified. Both are heterodimers composed of L (large, catalytic, 80 kD) and S (small, regulatory, 30 kD) subunits. The isozymes share an identical S subunit (OMIM Ref. No. 114170); differences arise from the L subunits (L1 and L2). Using cDNA clones as probes, Ohno et al. (1989, 1990) mapped the CANPL1 and CANPL2 genes as well as the CANPS gene and a gene for another protein, L3, that is homologous to the other 2 L subunits; they used a combination of spot blot hybridization with sorted chromosomes and Southern hybridization with human-mouse cell hybrid DNAs. In this way they were able to assign CANPL1 to chromosome 11; CANPL2 to chromosome 1; CANPL3 to chromosome 15; and CANPS to chromosome 19. Courseaux et al. (1996) used a combination of methods to refine maps of the approximately 5-Mb region of 11q13 that includes MEN1 (OMIM Ref. No. 131100). They proposed the following gene order: cen-PGA-FTH1-UGB-AHNAK-ROM1-MDU1-CHRM1-COX8-EMK1-FKBP2-PLCB3-[PYGM, ZFM1]-FAU-CAPN1-[MLK3, RELA]-FOSL1-SEA-CFL1-tel.

Full details of the abovementioned studies are described in the following publications, the disclosure of which are hereby incorporated by reference:

Ohno, S.; Minoshima, S.; Kudoh, J.; Fukuyama, R.; Shimizu, Y.; Ohmi-Imajoh, S.; Shimizu, N.; Suzuki, K.: Four genes for the calpain family locate on four distinct human chromosomes. Cytogenet. Cell Genet. 53:225-229, 1990; and Courseaux, A.; Grosgeorge, J.; Gaudray, P.; Pannett, A. A. J.; Forbes, S. A.; Williamson, C.; Bassett, D.; Thakker, R. V.; Teh, B. T.; Farnebo, F.; Shepherd, J.; Skogseid, B.; Larsson, C.

Further studies establishing the function and utilities of CAPN1 are found in John Hopkins OMIM database record ID 114220, and in cited publications listed in Table 5, which are hereby incorporated by reference. Calsequestrin 1 (fast-twitch, skeletal muscle) (CASQ1, Accession NM_001231.2) is another GAM41 target gene, herein designated TARGET GENE. CASQ1 BINDING SITE is a target binding site found in the 3' untranslated region of mRNA encoded by CASQ1, corresponding to a target binding site such as BINDING SITE I, BINDING SITE II or BINDING SITE III of FIG. 8. Table 4 illustrates the complementarity of the nucleotide sequences of CASQ1 BINDING SITE, designated SEQ ID:4693, to the nucleotide sequence of GAM41 RNA, herein designated GAM RNA, also designated SEQ ID:215.

Another function of GAM41 is therefore inhibition of Calsequestrin 1 (fast-twitch, skeletal muscle) (CASQ1, Accession NM_001231.2), a gene which is a mitochondrial calcium-binding protein specific for fast-twitch muscle fibers. Accordingly, utilities of GAM41 include diagnosis, prevention and treatment of diseases and clinical conditions associated with CASQ1.

The function of CASQ1 has been established by previous studies. Calsequestrin, an acid glycoprotein located in the luminal space of the terminal cisternae of the sarcoplasmic reticulum, binds calcium ion and is believed to function as a storage protein for calcium. Comparison of the complete amino acid sequences of rabbit fast-twitch muscle calsequestrin and dog cardiac muscle calsequestrin, as derived from sequence cDNAs, indicate that these isoforms are clearly the products of different genes. The rabbit fast-twitch muscle calsequestrin has, in the mature protein, 367 amino acid residues. It is synthesized with a 28-residue N-terminal signal sequence that is cleaved off during synthesis. The gene in the rabbit has 11 exons and spans approximately 14 kb of genomic DNA. Fujii et al. (1990) isolated a genomic clone for human fast-twitch skeletal muscle calsequestrin and deduced the amino acid sequence of the protein and the exon-intron boundaries of the gene from its sequence. They assigned the gene to human chromosome 1 through the use of a human-mouse somatic cell hybrid mapping panel. Like the rabbit gene, the human gene has 11 exons, but 5 amino acids near the COOH terminus of the rabbit sequence are lacking in the human protein. By fluorescence in situ hybridization, Otsu et al. (1993) mapped the CASQ1 gene to 1q21. Calmitine is a mitochondrial calcium-binding protein specific for fast-twitch muscle fibers. It is absent in patients with Duchenne and Becker types of muscular dystrophy and in dystrophic dy/dy mice. Bataille et al. (1994) cloned the human cDNA of calmitine. Sequence analysis demonstrated that it was identical to the low affinity but high capacity calcium-binding protein from the sarcoplasmic reticulum, calsequestrin. Calmitine represents the Ca(2+) reservoir of mitochondria; calsequestrin may play a similar role in the sarcoplasmic reticulum.

Full details of the abovementioned studies are described in the following publications, the disclosure of which are hereby incorporated by reference:

Fujii, J.; Willard, H. F.; MacLennan, D. H.: Characterization and localization to human chromosome 1 of human fast-twitch skeletal muscle calsequestrin gene. Somat. Cell Molec. Genet. 16:185-189, 1990; and Bataille, N.; Schmitt, N.; Aumercier-Maes, P.; Ollivier, B.; Lucas-Heron, B.; Lestienne, P.: Molecular cloning of human calmitine, a mitochondrial calcium binding protein, reveals ident.

Further studies establishing the function and utilities of CASQ1 are found in John Hopkins OMIM database record ID 114250, and in cited publications listed in Table 5, which are hereby incorporated by reference. Chemokine (c-c motif) receptor 5 (CCR5, Accession NM_000579.1) is another GAM41 target gene, herein designated TARGET GENE. CCR5 BINDING SITE is a target binding site found in the 3' untranslated region of mRNA encoded by CCR5, corresponding to a target binding site such as BINDING SITE I, BINDING SITE II or BINDING SITE III of FIG. 8. Table 4 illustrates the complementarity of the nucleotide sequences of CCR5 BINDING SITE, designated SEQ ID:8238, to the nucleotide sequence of GAM41 RNA, herein designated GAM RNA, also designated SEQ ID:215.

Another function of GAM41 is therefore inhibition of Chemokine (c-c motif) receptor 5 (CCR5, Accession NM_000579.1). Accordingly, utilities of GAM41 include diagnosis, prevention and treatment of diseases and clinical conditions associated with CCR5.

FLJ22814 (Accession NM_024916.1) is another GAM41 target gene, herein designated TARGET GENE. FLJ22814 BINDING SITE is a target binding site found in the 3' untranslated region of mRNA encoded by FLJ22814, corresponding to a target binding site such as BINDING SITE I, BINDING SITE II or BINDING SITE III of FIG. 8. Table 4 illustrates the complementarity of the nucleotide sequences of FLJ22814 BINDING SITE, designated SEQ ID:2530, to the nucleotide sequence of GAM41 RNA, herein designated GAM RNA, also designated SEQ ID:215.

Another function of GAM41 is therefore inhibition of FLJ22814 (Accession NM_024916.1). Accordingly, utilities of GAM41 include diagnosis, prevention and treatment of diseases and clinical conditions associated with FLJ22814.

Interleukin 11 (IL11, Accession NM_000641.2) is another GAM41 target gene, herein designated TARGET GENE. IL11 BINDING SITE is a target binding site found in the 3' untranslated region of mRNA encoded by IL11, corresponding to a target binding site such as BINDING SITE I, BINDING SITE II or BINDING SITE III of FIG. 8. Table 4 illustrates the complementarity of the nucleotide sequences of IL11 BINDING SITE, designated SEQ ID:20064, to the nucleotide sequence of GAM41 RNA, herein designated GAM RNA, also designated SEQ ID:215.

Another function of GAM41 is therefore inhibition of Interleukin 11 (IL11, Accession NM_000641.2), a gene which stimulates the proliferation of hematopoietic stem cells and megakaryocyte progenitor cells and induces megakaryocyte maturation. Accordingly, utilities of GAM41 include diagnosis, prevention and treatment of diseases and clinical conditions associated with IL11.

The function of IL11 has been established by previous studies. Paul et al. (1990) identified and cloned the gene for a new stromal cell-derived lymphopoietic and hematopoietic cytokine which they called interleukin-11. The cDNA indicated a single reading frame of 597 nucleotides encoding a predicted 199-amino acid polypeptide. The IL11 produced in COS-1 cells showed an apparent molecular mass of about 23 kD. McKinley et al. (1992) determined that the genomic sequence is 7 kb long and consists of 5 exons and 4 introns. Biologic characterization indicated that in addition to stimulating plasmacytoma proliferation, IL11 stimulates T-cell-dependent development of immunoglobulin-producing B cells and collaborates with IL3 in supporting murine megakaryocyte colony formation (Paul et al., 1990). Du and Williams (1994) reviewed the pleiotropic effects of IL11 on hematopoietic cells. Yang-Feng et al. (1991) demonstrated by in situ hybridization that a cDNA for IL11 maps to 19q13.3-q13.4. Since translocations involving 19q13 occur in patients with acute lymphocytic leukemia, the IL11 gene may be implicated. Du and Williams (1997) reviewed the molecular, cell biologic, and clinical aspects of interleukin-11.

Full details of the abovementioned studies are described in the following publications, the disclosure of which are hereby incorporated by reference:

Du, X.; Williams, D. A.: Interleukin-11: review of molecular, cell biology, and clinical use. Blood 89:3897-3908, 1997; and Du, X. X.; Williams, D. A.: Interleukin-11: a multifunctional growth factor derived from the hematopoietic microenvironment. Blood 83:2023-2030, 1994.

Further studies establishing the function and utilities of IL11 are found in John Hopkins OMIM database record ID 147681, and in cited publications listed in Table 5, which are hereby incorporated by reference. LOC143915 (Accession) is another GAM41 target gene, herein designated TARGET GENE. LOC143915 BINDING SITE is a target binding site found in the 3' untranslated region of mRNA encoded by LOC143915, corresponding to a target binding site such as BINDING SITE I, BINDING SITE II or BINDING SITE III of FIG. 8. Table 4 illustrates the complementarity of the nucleotide sequences of LOC143915 BINDING SITE, designated SEQ ID:15225, to the nucleotide sequence of GAM41 RNA, herein designated GAM RNA, also designated SEQ ID:215.

Another function of GAM41 is therefore inhibition of LOC143915 (Accession). Accordingly, utilities of GAM41 include diagnosis, prevention and treatment of diseases and clinical conditions associated with LOC143915.

LOC151720 (Accession XM_087279.6) is another GAM41 target gene, herein designated TARGET GENE. LOC151720 BINDING SITE is a target binding site found in the 5' untranslated region of mRNA encoded by LOC151720, corresponding to a target binding site such as BINDING SITE I, BINDING SITE II or BINDING SITE III of FIG. 8. Table 4 illustrates the complementarity of the nucleotide sequences of LOC151720 BINDING SITE, designated SEQ ID:17948, to the nucleotide sequence of GAM41 RNA, herein designated GAM RNA, also designated SEQ ID:215.

Another function of GAM41 is therefore inhibition of LOC151720 (Accession XM_087279.6). Accordingly, utilities of GAM41 include diagnosis, prevention and treatment of diseases and clinical conditions associated with LOC151720.

LOC196463 (Accession NM_173542.1) is another GAM41 target gene, herein designated TARGET GENE. LOC196463 BINDING SITE is a target binding site found in the 3' untranslated region of mRNA encoded by LOC196463, corresponding to a target binding site such as BINDING SITE I, BINDING SITE II or BINDING SITE III of FIG. 8. Table 4 illustrates the complementarity of the nucleotide sequences of LOC196463 BINDING SITE, designated SEQ ID:1265, to the nucleotide sequence of GAM41 RNA, herein designated GAM RNA, also designated SEQ ID:215.

Another function of GAM41 is therefore inhibition of LOC196463 (Accession NM_173542.1). Accordingly, utilities of GAM41 include diagnosis, prevention and treatment of diseases and clinical conditions associated with LOC196463.

LOC200205 (Accession XM_114152.1) is another GAM41 target gene, herein designated TARGET GENE. LOC200205 BINDING SITE is a target binding site found in the 3' untranslated region of mRNA encoded by LOC200205, corresponding to a target binding site such as BINDING SITE I, BINDING SITE II or BINDING SITE III of FIG. 8. Table 4 illustrates the complementarity of the nucleotide sequences of LOC200205 BINDING SITE, designated SEQ ID:14178, to the nucleotide sequence of GAM41 RNA, herein designated GAM RNA, also designated SEQ ID:215.

Another function of GAM41 is therefore inhibition of LOC200205 (Accession XM_114152.1). Accordingly, utilities of GAM41 include diagnosis, prevention and treatment of diseases and clinical conditions associated with LOC200205.

Paired-like homeodomain transcription factor 3 (PITX3, Accession NM_005029.3) is another GAM41 target gene, herein designated TARGET GENE. PITX3 BINDING SITE is a target binding site found in the 3' untranslated region of mRNA encoded by PITX3, corresponding to a target binding site such as BINDING SITE I, BINDING SITE II or BINDING SITE III of FIG. 8. Table 4 illustrates the complementarity of the nucleotide sequences of PITX3 BINDING SITE, designated SEQ ID:8284, to the nucleotide sequence of GAM41 RNA, herein designated GAM RNA, also designated SEQ ID:215.

Another function of GAM41 is therefore inhibition of Paired-like homeodomain transcription factor 3 (PITX3, Accession NM_005029.3), a gene which may play a role in normal anterior-chamber and lens development. and therefore may be associated with Anterior segment mesenchymal dysgenesis (asmd). Accordingly, utilities of GAM41 include diagnosis, prevention and treatment of Anterior segment mesenchymal dysgenesis (asmd), and of other diseases and clinical conditions associated with PITX3.

The function of PITX3 has been established by previous studies. The PITX3 gene is the human homolog of the mouse Pitx3 gene and is a member of the RIEG/PITX homeo box gene family. The protein encoded by PITX3 shows 99% amino acid identity to the mouse Pitx3 protein, with 100% identity in the homeodomain and approximately 70% overall identity to other members of this family. Semina et al. (1998) screened a collection of 80 DNA samples from individuals with various eye anomalies for mutations in the PITX3 gene. A mutation was identified in each of 2 unrelated patients. The 17-bp insertion in the 3-prime end of the coding sequence, resulting in a frameshift (602669.0001), occurred in a patient with anterior segment mesenchymal dysgenesis (ASMD; 107250) and cataracts; a G- to - A substitution in the 5-prime end of the gene, changing a codon for serine into a codon for asparagine (602669.0002), occurred in a patient with congenital cataracts. Each mutation cosegregated with the disease phenotype in families and was not found in up to 300 control individuals studied. Further expression analysis of Pitx3 in the mouse supported a unique role in early ocular development, with later expression extending to the midbrain, tongue, incisors, sternum, vertebrae, and limbs. The findings strongly suggested the role of PITX3 in ASMD and cataracts and provided new evidence of the contribution of the RIEG/PITX gene family to the developmental program underpinning normal eye formation. The PTX1 (OMIM Ref. No. 601542), PTX2 (OMIM Ref. No. 602149), and PTX3 genes define a novel family of transcription factors, the PTX subfamily, within the paired-like class of homeodomain factors. In mice, Ptx1 and Ptx2 gene expression has been detected in the area of the pituitary primordium and is maintained throughout development in the Rathke pouch and adult pituitary. Pellegrini-Bouiller et al. (1999) characterized the expression of the PTX1, PTX2, and PTX3 genes in the normal human pituitary and in the different types of human pituitary adenomas. RT-PCR analysis detected no PTX3 expression in adult and fetal normal human pituitary, although a specific band was readily amplified from fetal mesencephalon, a tissue known to express this gene.

Animal model experiments lend further support to the function of PITX3. Mouse 'aphakia' (ak) is a recessive phenotype that spontaneously occurs in the 129/Sv-SlJ strain and is characterized by small eyes that lack a lens. Semina et al. (1997) determined that the Pitx3 gene is expressed in the developing lens and maps to chromosome 19, close to ak in mouse. In further studies, Semina et al. (2000) did not detect by in situ hybridization Pitx3 transcripts in ak/ak mice, either in the lens placode or at later developmental stages of the lens. Although no differences were previously found between ak/ak and wildtype sequences in the Pitx3 coding region, the authors identified a deletion of 652 bp located 2.5 kb upstream from the start point of the Pitx3 5-prime untranslated region sequence in ak/ak mice. The deletion cosegregated with the ak mutation and was not detected in 16 samples from 10 different mouse strains, including the founder strains. Analysis of the 652-bp region identified sequences similar to consensus binding sites for transcription factors AP2 (see OMIM Ref. No. 107580) and Maf (see OMIM Ref. No. 177075) that were shown to play a critical role in lens determination. The authors concluded that the abnormal ocular development in the aphakia mouse is due to the deletion upstream of the Pitx3 gene.

It is appreciated that the abovementioned animal model for PITX3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Semina, E. V.; Ferrell, R. E.; Mintz-Hittner, H. A.; Bitoun, P.; Alward, W. L. M.; Reiter, R. S.; Funkhauser, C.; Daack-Hirsch, S.; Murray, J. C.: A novel homeobox gene PITX3 is mutated in families with autosomal-dominant cataracts and ASMD. Nature Genet. 19:167-170, 1998; and Semina, E. V.; Murray, J. C.; Reiter, R.; Hrstka, R. F.; Graw, J.: Deletion in the promoter region and altered expression of Pitx3 homeobox gene in aphakia mice. Hum. Molec. Genet. 9.

Further studies establishing the function and utilities of PITX3 are found in John Hopkins OMIM database record ID 602669, and in cited publications listed in Table 5, which are hereby incorporated by reference. POLA2 (Accession NM_002689.2) is another GAM41 target gene, herein designated TARGET GENE. POLA2 BINDING SITE is a target binding site found in the 5' untranslated region of mRNA encoded by POLA2, corresponding to a target binding site such as BINDING SITE I, BINDING SITE II or BINDING SITE III of FIG. 8. Table 4 illustrates the complementarity of the nucleotide sequences of POLA2 BINDING SITE, designated SEQ ID:16991, to the nucleotide sequence of GAM41 RNA, herein designated GAM RNA, also designated SEQ ID:215.

Another function of GAM41 is therefore inhibition of POLA2 (Accession NM_002689.2). Accordingly, utilities of GAM41 include diagnosis, prevention and treatment of diseases and clinical conditions associated with POLA2.

SSH2 (Accession XM_290798.1) is another GAM41 target gene, herein designated TARGET GENE. SSH2 BINDING SITE is a target binding site found in the 3' untranslated region of multiple transcripts of mRNA encoded by SSH2, corresponding to a target binding site such as BINDING SITE I, BINDING SITE II or BINDING SITE III of FIG. 8. Table 4 illustrates the complementarity of the nucleotide sequences of SSH2 BINDING SITE, designated SEQ ID:8354, to the nucleotide sequence of GAM41 RNA, herein designated GAM RNA, also designated SEQ ID:215.

Another function of GAM41 is therefore inhibition of SSH2 (Accession XM_290798.1). Accordingly, utilities of GAM41 include diagnosis, prevention and treatment of diseases and clinical conditions associated with SSH2.

TRIAD3 (Accession NM_019011.3) is another GAM41 target gene, herein designated TARGET GENE. TRIAD3 BINDING SITE is a target binding site found in the 3' untranslated region of mRNA encoded by TRIAD3, corresponding to a target binding site such as BINDING SITE I, BINDING SITE II or BINDING SITE III of FIG. 8. Table 4 illustrates the complementarity of the nucleotide sequences of TRIAD3 BINDING SITE, designated SEQ ID:11583, to the nucleotide sequence of GAM41 RNA, herein designated GAM RNA, also designated SEQ ID:215.

Another function of GAM41 is therefore inhibition of TRIAD3 (Accession NM_019011.3). Accordingly, utilities of GAM41 include diagnosis, prevention and treatment of diseases and clinical conditions associated with TRIAD3.

FIG. 8 further provides a conceptual description of a novel bioinformatically detected of the present invention, referred to here as Genomic Address Messenger 42 (GAM42), which modulates expression of respective target genes thereof, the function and utility of which target genes is known in the art.

GAM42 is a novel bioinformatically detected regulatory, non protein coding, micro RNA (miRNA) gene. The method by which GAM42 was detected is described hereinabove with reference to FIGS. 8-15.

GAM42 gene, herein designated GAM GENE, and GAM42 target gene, herein designated TARGET GENE, are human genes contained in the human genome.

GAM42 gene encodes a GAM42 precursor RNA, herein designated GAM PRECURSOR RNA. Similar to other miRNA genes, and unlike most ordinary genes, GAM42 precursor RNA does not encode a protein. A nucleotide sequence identical or highly similar to the nucleotide sequence of GAM42 precursor RNA is designated SEQ ID:190, and is provided hereinbelow with reference to the sequence listing part.

GAM42 precursor RNA folds onto itself, forming GAM42 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM42 precursor RNA folds onto itself, forming GAM42 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM42 precursor RNA, designated SEQ-ID:190, and a schematic representation of a predicted secondary folding of GAM42 folded precursor RNA are further described with reference to Table 2, hereby incorporated by reference.

An enzyme complex designated DICER COMPLEX, 'dices' the GAM42 folded precursor RNA into GAM42 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM42 RNA is designated SEQ ID:224, and is provided hereinbelow with references to the sequence listing part and Table 3, hereby incorporated by reference.

GAM42 target gene, herein designated TARGET GENE, encodes a corresponding messenger RNA, GAM42 target RNA, herein designated GAM TARGET RNA. GAM42target RNA comprises three regions, as is typical of mRNA of a protein coding gene: a 5' untranslated region, a protein coding region and a 3' untranslated region, designated 5'UTR, PROTEIN CODING and 3'UTR respectively.

GAM42 RNA, herein designated GAM RNA, binds complementarily to one or more target binding sites located in untranslated regions of GAM42 target RNA, herein designated GAM TARGET RNA. This complementary binding is due to the fact that the nucleotide sequence of GAM42 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM42 RNA may have a different number of target binding sites in untranslated regions of a GAM42 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM42 RNA, herein designated GAM RNA, to target binding sites on GAM42 target RNA, herein designated GAM TARGET RNA, such as BINDING SITE I, BINDING SITE II and BINDING SITE III, inhibits translation of GAM42target RNA into GAM42 target protein, herein designated GAM TARGET PROTEIN. GAM target protein is therefore outlined by a broken line.

It is appreciated that GAM42 target gene, herein designated TARGET GENE, in fact represents a plurality of GAM42 target genes. The mRNA of each one of this plurality of GAM42 target genes comprises one or more target binding sites, each having a nucleotide sequence which is at least partly complementary to GAM42 RNA, herein designated GAM RNA, and which when bound by GAM42 RNA causes inhibition of translation of respective one or more GAM42 target proteins.

It is further appreciated by one skilled in the art that the mode of translational inhibition illustrated by FIG. 8 with specific reference to translational inhibition exerted by GAM42 gene, herein designated GAM GENE, on one or more GAM42target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM42 correlate with, and may be deduced from, the identity of the target genes which GAM42 binds and inhibits, and the function of these target genes, as elaborated hereinbelow.

Cerebellar degeneration-related protein 2, 62 kda (CDR2, Accession XM_071866.2) is a GAM42 target gene, herein designated TARGET GENE. CDR2 BINDING SITE is a target binding site found in the 3' untranslated region of mRNA encoded by CDR2, corresponding to a target binding site such as BINDING SITE I, BINDING SITE II or BINDING SITE III of FIG. 8. Table 4 illustrates the complementarity of the nucleotide sequences of CDR2 BINDING SITE, designated SEQ ID:4901, to the nucleotide sequence of GAM42 RNA, herein designated GAM RNA, also designated SEQ ID:224.

A function of GAM42 is therefore inhibition of Cerebellar degeneration-related protein 2, 62 kda (CDR2, Accession XM_071866.2), a gene which plays a role in cytokinesis, cell shape, and functions such as secretion and capping. and therefore may be associated with Paraneoplastic cerebellar degeneration. Accordingly, utilities of GAM42 include diagnosis, prevention and treatment of Paraneoplastic cerebellar degeneration, and of other diseases and clinical conditions associated with CDR2.

The function of CDR2 has been established by previous studies. Paraneoplastic cerebellar degeneration is an autoimmune disorder associated with neoplasms of lung, ovary, breast, or Hodgkin disease. Patients with paraneoplastic cerebellar degeneration carry a characteristic antibody called anti-Yo. On Western blot analysis of Purkinje cells and tumor tissue, the anti-Yo sera react with at least 2 antigens, a major species of 62 kD called CDR62 and a minor species of 34 kD called CDR34, where CDR means cerebellar degeneration-related. CDR34 is encoded by a gene on the X chromosome (CDR1; 302650). Furneaux et al. (1990) cloned and characterized the gene encoding CDR62, a leucine- zipper DNA-binding protein; see Fathallah-Shaykh et al. (1991). By a combination of study of rodent/human somatic cell hybrids and in situ hybridization, Gress et al. (1991, 1992) assigned the CDR2 gene to 16p13.1-p12. The gene is positioned in an interval that contains 2 rare heritable fragile sites. Fletcher et al. (1997) determined the mouse chromosomal locations of 9 genes that encode 'onconeuronal antigens,' i.e., antigens that are expressed by systemic tumors and elicit an immune response that may develop into an autoimmune neuronal degeneration. One of these genes was the Cdr2 gene, which they mapped to mouse chromosome 7 in a region of homology to 16p13.1-p12.

Full details of the abovementioned studies are described in the following publications, the disclosure of which are hereby incorporated by reference:

Fathallah-Shaykh, H.; Wolf, S.; Wong, E.; Posner, J. B.: Cloning of a leucine- zipper protein recognized by the sera of patients with antibody-associated paraneoplastic cerebellar degeneration. Proc. Nat. Acad. Sci. 88:3451-3454, 1991; and Furneaux, H. M.; Rosenblum, M. K.; Dalmau, J.; Wong, E.; Woodruff, P.; Graus, F.; Posner, J. B.: Selective expression of Purkinje-cell antigens in tumor tissue from patients with parane.

Further studies establishing the function and utilities of CDR2 are found in John Hopkins OMIM database record ID 117340, and in cited publications listed in Table 5, which are hereby incorporated by reference. CDT1 (Accession NM_030928.2) is another GAM42 target gene, herein designated TARGET GENE. CDT1 BINDING SITE is a target binding site found in the 3' untranslated region of mRNA encoded by CDT1, corresponding to a target binding site such as BINDING SITE I, BINDING SITE II or BINDING SITE III of FIG. 8. Table 4 illustrates the complementarity of the nucleotide sequences of CDT1 BINDING SITE, designated SEQ ID:1061, to the nucleotide sequence of GAM42 RNA, herein designated GAM RNA, also designated SEQ ID:224.

Another function of GAM42 is therefore inhibition of CDT1 (Accession NM_030928.2). Accordingly, utilities of GAM42 include diagnosis, prevention and treatment of diseases and clinical conditions associated with CDT1.

Fragile x mental retardation 2 (FMR2, Accession NM_002025.1) is another GAM42 target gene, herein designated TARGET GENE. FMR2 BINDING SITE is a target binding site found in the 3' untranslated region of mRNA encoded by FMR2, corresponding to a target binding site such as BINDING SITE I, BINDING SITE II or BINDING SITE III of FIG. 8. Table 4 illustrates the complementarity of the nucleotide sequences of FMR2 BINDING SITE, designated SEQ ID:17857, to the nucleotide sequence of GAM42 RNA, herein designated GAM RNA, also designated SEQ ID:224.

Another function of GAM42 is therefore inhibition of Fragile x mental retardation 2 (FMR2, Accession NM_002025.1). Accordingly, utilities of GAM42 include diagnosis, prevention and treatment of diseases and clinical conditions associated with FMR2.

Fucosyltransferase 1 (galactoside 2-alpha-l-fucosyltransferase, bombay phenotype included) (FUT1, Accession NM_000148.1) is another GAM42 target gene, herein designated TARGET GENE. FUT1 BINDING SITE is a target binding site found in the 3' untranslated region of mRNA encoded by FUT1, corresponding to a target binding site such as BINDING SITE I, BINDING SITE II or BINDING SITE III of FIG. 8. Table 4 illustrates the complementarity of the nucleotide sequences of FUT1 BINDING SITE, designated SEQ ID:10946, to the nucleotide sequence of GAM42 RNA, herein designated GAM RNA, also designated SEQ ID:224.

Another function of GAM42 is therefore inhibition of Fucosyltransferase 1 (galactoside 2-alpha-l-fucosyltransferase, bombay phenotype included) (FUT1, Accession NM_000148.1). Accordingly, utilities of GAM42 include diagnosis, prevention and treatment of diseases and clinical conditions associated with FUT1.

Growth arrest and dna-damage-inducible, alpha (GADD45A, Accession NM_001924.2) is another GAM42 target gene, herein designated TARGET GENE. GADD45A BINDING SITE is a target binding site found in the 5' untranslated region of mRNA encoded by GADD45A, corresponding to a target binding site such as BINDING SITE I, BINDING SITE II or BINDING SITE III of FIG. 8. Table 4 illustrates the complementarity of the nucleotide sequences of GADD45A BINDING SITE, designated SEQ ID:510, to the nucleotide sequence of GAM42 RNA, herein designated GAM RNA, also designated SEQ ID:224.

Another function of GAM42 is therefore inhibition of Growth arrest and dna-damage-inducible, alpha (GADD45A, Accession NM_001924.2). Accordingly, utilities of GAM42 include diagnosis, prevention and treatment of diseases and clinical conditions associated with GADD45A.

HCGIV.9 (Accession NM_018985.1) is another GAM42 target gene, herein designated TARGET GENE. HCGIV.9 BINDING SITE is a target binding site found in the 3' untranslated region of mRNA encoded by HCGIV.9, corresponding to a target binding site such as BINDING SITE I, BINDING SITE II or BINDING SITE III of FIG. 8. Table 4 illustrates the complementarity of the nucleotide sequences of HCGIV.9 BINDING SITE, designated SEQ ID:5331, to the nucleotide sequence of GAM42 RNA, herein designated GAM RNA, also designated SEQ ID:224.

Another function of GAM42 is therefore inhibition of HCGIV.9 (Accession NM_018985.1). Accordingly, utilities of GAM42 include diagnosis, prevention and treatment of diseases and clinical conditions associated with HCGIV.9.

LOC123872 (Accession XM_058742.3) is another GAM42 target gene, herein designated TARGET GENE. LOC123872 BINDING SITE is a target binding site found in the 5' untranslated region of multiple transcripts of mRNA encoded by LOC123872, corresponding to a target binding site such as BINDING SITE I, BINDING SITE II or BINDING SITE III of FIG. 8. Table 4 illustrates the complementarity of the nucleotide sequences of LOC123872 BINDING SITE, designated SEQ ID:13097, to the nucleotide sequence of GAM42 RNA, herein designated GAM RNA, also designated SEQ ID:224.

Another function of GAM42 is therefore inhibition of LOC123872 (Accession XM_058742.3). Accordingly, utilities of GAM42 include diagnosis, prevention and treatment of diseases and clinical conditions associated with LOC123872.

LOC158427 (Accession NM_139246.2) is another GAM42 target gene, herein designated TARGET GENE. LOC158427 BINDING SITE is a target binding site found in the 3' untranslated region of mRNA encoded by LOC158427, corresponding to a target binding site such as BINDING SITE I, BINDING SITE II or BINDING SITE III of FIG. 8. Table 4 illustrates the complementarity of the nucleotide sequences of LOC158427 BINDING SITE, designated SEQ ID:11756, to the nucleotide sequence of GAM42 RNA, herein designated GAM RNA, also designated SEQ ID:224.

Another function of GAM42 is therefore inhibition of LOC158427 (Accession NM_139246.2). Accordingly, utilities of GAM42 include diagnosis, prevention and treatment of diseases and clinical conditions associated with LOC158427.

LOC197201 (Accession XM_113839.4) is another GAM42 target gene, herein designated TARGET GENE. LOC197201 BINDING SITE is a target binding site found in the 3' untranslated region of mRNA encoded by LOC197201, corresponding to a target binding site such as BINDING SITE I, BINDING SITE II or BINDING SITE III of FIG. 8. Table 4 illustrates the complementarity of the nucleotide sequences of LOC197201 BINDING SITE, designated SEQ ID:3966, to the nucleotide sequence of GAM42 RNA, herein designated GAM RNA, also designated SEQ ID:224.

Another function of GAM42 is therefore inhibition of LOC197201 (Accession XM_113839.4). Accordingly, utilities of GAM42 include diagnosis, prevention and treatment of diseases and clinical conditions associated with LOC197201.

LOC203202 (Accession XM_038391.6) is another GAM42 target gene, herein designated TARGET GENE. LOC203202 BINDING SITE is a target binding site found in the 3' untranslated region of mRNA encoded by LOC203202, corresponding to a target binding site such as BINDING SITE I, BINDING SITE II or BINDING SITE III of FIG. 8. Table 4 illustrates the complementarity of the nucleotide sequences of LOC203202 BINDING SITE, designated SEQ ID:4902, to the nucleotide sequence of GAM42 RNA, herein designated GAM RNA, also designated SEQ ID:224.

Another function of GAM42 is therefore inhibition of LOC203202 (Accession XM_038391.6). Accordingly, utilities of GAM42 include diagnosis, prevention and treatment of diseases and clinical conditions associated with LOC203202.

LOC256830 (Accession) is another GAM42 target gene, herein designated TARGET GENE. LOC256830 BINDING SITE is a target binding site found in the 5' untranslated region of mRNA encoded by LOC256830, corresponding to a target binding site such as BINDING SITE I, BINDING SITE II or BINDING SITE III of FIG. 8. Table 4 illustrates the complementarity of the nucleotide sequences of LOC256830 BINDING SITE, designated SEQ ID:18604, to the nucleotide sequence of GAM42 RNA, herein designated GAM RNA, also designated SEQ ID:224.

Another function of GAM42 is therefore inhibition of LOC256830 (Accession). Accordingly, utilities of GAM42 include diagnosis, prevention and treatment of diseases and clinical conditions associated with LOC256830.

Protein o-fucosyltransferase 1 (POFUT1, Accession NM_015352.1) is another GAM42 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:7440, to the nucleotide sequence of GAM42 RNA, herein designated GAM RNA, also designated SEQ ID:224.

Another function of GAM42 is therefore inhibition of Protein o-fucosyltransferase 1 (POFUT1, Accession NM_015352.1) . Accordingly, utilities of GAM42 include diagnosis, prevention and treatment of diseases and clinical conditions associated with POFUT1.

Swi/snf related, matrix associated, actin dependent regulator of chromatin, subfamily d, member 1 (SMARCD1, Accession NM_139071.1) is another GAM42 target gene, herein designated TARGET GENE. SMARCD1 BINDING SITE is a target binding site found in the 3' untranslated region of multiple transcripts of mRNA encoded by SMARCD1, corresponding to a target binding site such as BINDING SITE I, BINDING SITE II or BINDING SITE III of FIG. 8. Table 4 illustrates the complementarity of the nucleotide sequences of SMARCD1 BINDING SITE, designated SEQ ID:9206, to the nucleotide sequence of GAM42 RNA, herein designated GAM RNA, also designated SEQ ID:224.

Another function of GAM42 is therefore inhibition of Swi/snf related, matrix associated, actin dependent regulator of chromatin, subfamily d, member 1 (SMARCD1, Accession NM_139071.1), a gene which is involved in chromatin assembly and remodeling. Accordingly, utilities of GAM42 include diagnosis, prevention and treatment of diseases and clinical conditions associated with SMARCD1.

The function of SMARCD1 has been established by previous studies. Chromatin is actively remodeled during development. Chromatin remodeling of certain genes appears to precede their transcriptional activation. In yeast, the multisubunit SWI/SNF complex is thought to be responsible for chromatin remodeling. Wang et al. (1996) isolated an analogous SWI/SNF complex from the human YT cell line. They found that the resultant complexes are composed of 9 to 12 polypeptides, which they termed BAFs (for BRG1-associated factors). Wang et al. (1996) isolated the BAF60a subunit, which encodes a polypeptide of 435 amino acids and is homologous to the yeast SWP73 gene. The authors used BAF60a as a probe to isolate 2 closely related homologs, BAF60b (OMIM Ref. No. 601736) and BAF60c (OMIM Ref. No. 601737). By PCR of a somatic cell hybrid panel and radiation hybrid analysis, Ring et al. (1998) mapped the SMARCD1 gene to chromosome 12q13-q14.

Full details of the abovementioned studies are described in the following publications, the disclosure of which are hereby incorporated by reference:

Ring, H. Z.; Vameghi-Meyers, V.; Wang, W.; Crabtree, G. R.; Francke, U.: Five SWI/SNF-related, matrix-associated, actin-dependent regulator of chromatin (SMARC) genes are dispersed in the human genome. Genomics 51:140-143, 1998; and Wang, W.; Xue, Y.; Zhou, S.; Kuo, A.; Cairns, B. R.; Crabtree, G. R.: Diversity and specialization of mammalian SWI/SNF complexes. Genes Dev. 10:2117-2130, 1996.

Further studies establishing the function and utilities of SMARCD1 are found in John Hopkins OMIM database record ID 601735, and in cited publications listed in Table 5, which are hereby incorporated by reference.

FIG. 8 further provides a conceptual description of a novel bioinformatically detected of the present invention, referred to here as Genomic Address Messenger 43 (GAM43), which modulates expression of respective target genes thereof, the function and utility of which target genes is known in the art.

GAM43 is a novel bioinformatically detected regulatory, non protein coding, micro RNA (miRNA) gene. The method by which GAM43 was detected is described hereinabove with reference to FIGS. 8-15.

GAM43 gene, herein designated GAM GENE, and GAM43 target gene, herein designated TARGET GENE, are human genes contained in the human genome.

GAM43 gene encodes a GAM43 precursor RNA, herein designated GAM PRECURSOR RNA. Similar to other miRNA genes, and unlike most ordinary genes, GAM43 precursor RNA does not encode a protein. A nucleotide sequence identical or highly similar to the nucleotide sequence of GAM43 precursor RNA is designated SEQ ID:95, and is provided hereinbelow with reference to the sequence listing part.

GAM43 precursor RNA folds onto itself, forming GAM43 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM43 precursor RNA folds onto itself, forming GAM43 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM43 precursor RNA, designated SEQ-ID:95, and a schematic representation of a predicted secondary folding of GAM43 folded precursor RNA are further described with reference to Table 2, hereby incorporated by reference.

An enzyme complex designated DICER COMPLEX, 'dices' the GAM43 folded precursor RNA into GAM43 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM43 RNA is designated SEQ ID:234, and is provided hereinbelow with references to the sequence listing part and Table 3, hereby incorporated by reference.

GAM43 target gene, herein designated TARGET GENE, encodes a corresponding messenger RNA, GAM43 target RNA, herein designated GAM TARGET RNA. GAM43 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM43 RNA, herein designated GAM RNA, binds complementarily to one or more target binding sites located in untranslated regions of GAM43 target RNA, herein designated GAM TARGET RNA. This complementary binding is due to the fact that the nucleotide sequence of GAM43 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM43 RNA may have a different number of target binding sites in untranslated regions of a GAM43 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM43 RNA, herein designated GAM RNA, to target binding sites on GAM43 target RNA, herein designated GAM TARGET RNA, such as BINDING SITE I, BINDING SITE II and BINDING SITE III, inhibits translation of GAM43target RNA into GAM43 target protein, herein designated GAM TARGET PROTEIN. GAM target protein is therefore outlined by a broken line.

It is appreciated that GAM43 target gene, herein designated TARGET GENE, in fact represents a plurality of GAM43 target genes. The mRNA of each one of this plurality of GAM43 target genes comprises one or more target binding sites, each having a nucleotide sequence which is at least partly complementary to GAM43 RNA, herein designated GAM RNA, and which when bound by GAM43 RNA causes inhibition of translation of respective one or more GAM43 target proteins.

It is further appreciated by one skilled in the art that the mode of translational inhibition illustrated by FIG. 8 with specific reference to translational inhibition exerted by GAM43 gene, herein designated GAM GENE, on one or more GAM43target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM43 correlate with, and may be deduced from, the identity of the target genes which GAM43 binds and inhibits, and the function of these target genes, as elaborated hereinbelow.

MYLE (Accession NM_014015.2) is a GAM43 target gene, herein designated TARGET GENE. MYLE BINDING SITE is a target binding site found in the 3' untranslated region of mRNA encoded by MYLE, corresponding to a target binding site such as BINDING SITE I, BINDING SITE II or BINDING SITE III of FIG. 8. Table 4 illustrates the complementarity of the nucleotide sequences of MYLE BINDING SITE, designated SEQ ID:19493, to the nucleotide sequence of GAM43 RNA, herein designated GAM RNA, also designated SEQ ID:234.

A function of GAM43 is therefore inhibition of MYLE (Accession NM_014015.2). Accordingly, utilities of GAM43 include diagnosis, prevention and treatment of diseases and clinical conditions associated with MYLE.

NRF (Accession NM_017544.1) is another GAM43 target gene, herein designated TARGET GENE. NRF BINDING SITE is a target binding site found in the 3' untranslated region of mRNA encoded by NRF, corresponding to a target binding site such as BINDING SITE I, BINDING SITE II or BINDING SITE III of FIG. 8. Table 4 illustrates the complementarity of the nucleotide sequences of NRF BINDING SITE, designated SEQ ID:18272, to the nucleotide sequence of GAM43 RNA, herein designated GAM RNA, also designated SEQ ID:234.

Another function of GAM43 is therefore inhibition of NRF (Accession NM_017544.1). Accordingly, utilities of GAM43 include diagnosis, prevention and treatment of diseases and clinical conditions associated with NRF.

FIG. 8 further provides a conceptual description of a novel bioinformatically detected gene of the present invention, referred to here as Genomic Address Messenger 44 (GAM44), which modulates expression of respective target genes thereof, the function and utility of which target genes is known in the art.

GAM44 is a novel bioinformatically detected regulatory, non protein coding, micro RNA (miRNA) gene. The method by which GAM44 was detected is described hereinabove with reference to FIGS. 8-15.

GAM44 gene, herein designated GAM GENE, and GAM44 target gene, herein designated TARGET GENE, are human genes contained in the human genome.

GAM44 gene encodes a GAM44 precursor RNA, herein designated GAM PRECURSOR RNA. Similar to other miRNA genes, and unlike most ordinary genes, GAM44 precursor RNA does not encode a protein. A nucleotide sequence identical or highly similar to the nucleotide sequence of GAM44 precursor RNA is designated SEQ ID:188, and is provided hereinbelow with reference to the sequence listing part. Nucleotide sequence SEQ ID:188 is located at position 48222381 relative to chromosome 11.

GAM44 precursor RNA folds onto itself, forming GAM44 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM44 precursor RNA folds onto itself, forming GAM44 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM44 precursor RNA, designated SEQ-ID:188, and a schematic representation of a predicted secondary folding of GAM44 folded precursor RNA are further described with reference to Table 2, hereby incorporated by reference.

An enzyme complex designated DICER COMPLEX, 'dices' the GAM44 folded precursor RNA into GAM44 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM44 RNA is designated SEQ ID:287, and is provided hereinbelow with references to the sequence listing part and Table 3, hereby incorporated by reference.

GAM44 target gene, herein designated TARGET GENE, encodes a corresponding messenger RNA, GAM44 target RNA, herein designated GAM TARGET RNA. GAM44target RNA comprises three regions, as is typical of mRNA of a protein coding gene: a 5' untranslated region, a protein coding region and a 3' untranslated region, designated 5'UTR, PROTEIN CODING and 3'UTR respectively.

GAM44 RNA, herein designated GAM RNA, binds complementarily to one or more target binding sites located in untranslated regions of GAM44 target RNA, herein designated GAM TARGET RNA. This complementary binding is due to the fact that the nucleotide sequence of GAM44 RNA is an accurate or a partial inversed-reversed sequence of the nucleotide sequence of each of the target binding sites. As an illustration, FIG. 8 shows three such target binding sites, designated BINDING SITE I, BINDING SITE II and BIND- ING SITE III respectively. It is appreciated that the number of target binding sites shown in FIG. 8 is meant as an illustration only, and is not meant to be limiting GAM44 RNA may have a different number of target binding sites in untranslated regions of a GAM44 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM44 RNA, herein designated GAM RNA, to target binding sites on GAM44 target RNA, herein designated GAM TARGET RNA, such as BINDING SITE I, BINDING SITE II and BINDING SITE III, inhibits translation of GAM44target RNA into GAM44 target protein, herein designated GAM TARGET PROTEIN. GAM target protein is therefore outlined by a broken line.

It is appreciated that GAM44 target gene, herein designated TARGET GENE, in fact represents a plurality of GAM44 target genes. The mRNA of each one of this plurality of GAM44 target genes comprises one or more target binding sites, each having a nucleotide sequence which is at least partly complementary to GAM44 RNA, herein designated GAM RNA, and which when bound by GAM44 RNA causes inhibition of translation of respective one or more GAM44 target proteins.

It is further appreciated by one skilled in the art that the mode of translational inhibition illustrated by FIG. 8 with specific reference to translational inhibition exerted by GAM44 gene, herein designated GAM GENE, on one or more GAM44target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM44 correlate with, and may be deduced from, the identity of the target genes which GAM44 binds and inhibits, and the function of these target genes, as elaborated hereinbelow.

Angiotensin i converting enzyme (peptidyl-dipeptidase a) 1 (ACE, Accession NP_690044.1) is a GAM44 target gene, herein designated TARGET GENE. ACE BINDING SITE is a target binding site found in the 3' untranslated region of multiple transcripts of mRNA encoded by ACE, corresponding to a target binding site such as BINDING SITE I, BINDING SITE II or BINDING SITE III of FIG. 8. Table 4 illustrates the complementarity of the nucleotide sequences of ACE BINDING SITE, designated SEQ ID:2830, to the nucleotide sequence of GAM44 RNA, herein designated GAM RNA, also designated SEQ ID:287.

A function of GAM44 is therefore inhibition of Angiotensin i converting enzyme (peptidyl-dipeptidase a) 1 (ACE, Accession NP_690044.1), a gene which Angiotensin I-converting enzyme (dipeptidyl carboxypeptidase 1). Accordingly, utilities of GAM44 include diagnosis, prevention and treatment of diseases and clinical conditions associated with ACE.

The function of ACE has been established by previous studies. Angiotensin I- converting enzyme (EC 3.4.15.1), or kininase II, is a dipeptidyl carboxypeptidase that plays an important role in blood pressure regulation and electrolyte balance by hydrolyzing angiotensin I into angiotensin II, a potent vasopressor, and aldosterone- stimulating peptide. The enzyme is also able to inactivate bradykinin, a potent vasodilator. Howard et al. (1990) found that the testis-specific form of ACE has its own promoter within intron 12, is encoded by the 3-prime region of the gene, and is found only in postmeiotic spermatogenic cells and sperm. Exner et al. (2001) focused on the fact that black patients with heart failure have a poorer prognosis than white patients and performed a study comparing racial groups.

Full details of the abovementioned studies are described in the following publications, the disclosure of which are hereby incorporated by reference:

Howard, T. E.; Shai, S. Y.; Langford, K. G.; Martin, B. M.; Bernstein, K. E.: Transcription of testicular angiotensin-converting enzyme (ACE) is initiated within the 12th intron of the somatic ACE gene. Molec. Cell. Biol. 10:4294-4302, 1990; and Exner, D. V.; Dries, D. L.; Domanski, M. J.; Cohn, J. N.: Lesser response to angiotensin-converting-enzyme inhibitor therapy in black as compared with white patients with left ventricu.

Further studies establishing the function and utilities of ACE are found in John Hopkins OMIM database record ID 106180, and in cited publications listed in Table 5, which are hereby incorporated by reference. ANP32E (Accession NP_112182.1) is another GAM44 target gene, herein designated TARGET GENE. ANP32E BINDING SITE1 and ANP32E BINDING SITE2 are target binding sites found in untranslated regions of mRNA encoded by ANP32E, corresponding to target binding sites such as BINDING SITE I, BINDING SITE II or BINDING SITE III of FIG. 8. Table 4 illustrates the complementarity of the nucleotide sequences of ANP32E BINDING SITE1 and ANP32E BINDING SITE2, designated SEQ ID:16172 and SEQ ID:11390 respectively, to the nucleotide sequence of GAM44 RNA, herein designated GAM RNA, also designated SEQ ID:287.

Another function of GAM44 is therefore inhibition of ANP32E (Accession NP_112182.1). Accordingly, utilities of GAM44 include diagnosis, prevention and treatment of diseases and clinical conditions associated with ANP32E.

Adaptor-related protein complex 3, mu 2 subunit (AP3M2, Accession NP_006794.1) is another GAM44 target gene, herein designated TARGET GENE. AP3M2 BINDING SITE is a target binding site found in the 3' untranslated region of mRNA encoded by AP3M2, corresponding to a target binding site such as BINDING SITE I, BINDING SITE II or BINDING SITE III of FIG. 8. Table 4 illustrates the complementarity of the nucleotide sequences of AP3M2 BINDING SITE, designated SEQ ID:17766, to the nucleotide sequence of GAM44 RNA, herein designated GAM RNA, also designated SEQ ID:287.

Another function of GAM44 is therefore inhibition of Adaptor-related protein complex 3, mu 2 subunit (AP3M2, Accession NP_006794.1). Accordingly, utilities of GAM44 include diagnosis, prevention and treatment of diseases and clinical conditions associated with AP3M2.

Rho guanine nucleotide exchange factor (gef) 12 (ARHGEF12, Accession NP_056128.1) is another GAM44 target gene, herein designated TARGET GENE. ARHGEF12 BINDING SITE is a target binding site found in the 3' untranslated region of mRNA encoded by ARHGEF12, corresponding to a target binding site such as BINDING SITE I, BINDING SITE II or BINDING SITE III of FIG. 8. Table 4 illustrates the complementarity of the nucleotide sequences of ARHGEF12 BINDING SITE, designated SEQ ID:6308, to the nucleotide sequence of GAM44 RNA, herein designated GAM RNA, also designated SEQ ID:287.

Another function of GAM44 is therefore inhibition of Rho guanine nucleotide exchange factor (gef) 12 (ARHGEF12, Accession NP_056128.1). Accordingly, utilities of GAM44 include diagnosis, prevention and treatment of diseases and clinical conditions associated with ARHGEF12.

Aspartate beta-hydroxylase (ASPH, Accession NP_064549.1) is another GAM44 target gene, herein designated TARGET GENE. ASPH BINDING SITE is a target binding site found in the 3' untranslated region of multiple transcripts of mRNA encoded by ASPH, corresponding to a target binding site such as BINDING SITE I, BINDING SITE II or BINDING SITE III of FIG. 8. Table 4 illustrates the complementarity of the nucleotide sequences of ASPH BINDING SITE, designated SEQ ID:11418, to the nucleotide sequence of GAM44 RNA, herein designated GAM RNA, also designated SEQ ID:287.

Another function of GAM44 is therefore inhibition of Aspartate beta-hydroxylase (ASPH, Accession NP_064549.1), a gene which specifically hydroxylates the beta carbon of aspartic acid or asparagine residues in certain epidermal growth factor (EGF)-like domains of a number of proteins. Accordingly, utilities of GAM44 include diagnosis, prevention and treatment of diseases and clinical conditions associated with ASPH.

The function of ASPH has been established by previous studies. In hepatocellular carcinoma (HCC; 114550), one of the most prevalent tumors in the world which occurs with especially high frequency in sub-Saharan Africa and the Far East, a specific antigen is highly expressed; it is highly expressed also in cholangiocarcinomas. Lavaissiere et al. (1996) reported cDNA cloning of the human gene encoding this antigen, aspartyl(asparaginyl)-beta-hydroxylase (symbolized HAAH by them), and demonstrated that in these tumor lines it is expressed in an enzymatically active form. The gene encodes a deduced 744-amino acid polypeptide with high homology (81%) to the bovine gene (Jia et al., 1992). Lavaissiere et al. (1996) found that their cDNA human sequence was 99% homologous to the sequence for ASPH reported by Korioth et al. (1994), differing only at amino acid residues 565 (tyr to ile), 575 (trp-trp-thr to cys-gly, 585 (asp to gln), and 709 (arg to lys). They noted also a silent TCG- to - TCA transition at peptide residue 161. Lavaissiere et al. (1996) speculated about the possible relationship of the malignant phenotype of regulated aspartyl/asparaginyl-beta-hydroxylation in EGF-like domains of proteins such as the mammalian Notch homologs (e.g., 190198, 600275, and 600276), which are known to be involved in cell differentiation and whose cytoplasmic domains have been shown to be oncogenic. By screening a heart cDNA library, followed by RT-PCR, Lim et al. (2000) isolated cDNAs encoding the 225-amino acid junctin protein and a 210-amino acid isoform. The authors noted that a 73-residue stretch in junctin has a completely matched region in the ASPH protein. Southern blot analysis indicated that junctin and ASPH exist as a single-copy gene. Northern blot analysis revealed expression of 3.0- and 4.2-kb transcripts in cardiac and skeletal muscle; expression was higher in skeletal muscle. SDS-PAGE analysis of the translated cDNAs showed expression of 26 - and 28-kD proteins. By screening a skeletal muscle cDNA library with a dog junctin probe, Treves et al. (2000) identified cDNAs encoding human junctin and junctate. Sequence analysis predicted that junctate, a 299-amino acid protein, shares the first 93 amino acids of the long isoform of junctin (and, partially, of ASPH), whereas its 64 C-terminal residues are identical to the central region of ASPH. Northern blot analysis detected a 2.6-kb transcript in heart, brain, pancreas, placenta, lung, liver, kidney, and skeletal muscle; highest levels were in heart, brain, and pancreas, and lowest levels were in skeletal muscle. In contrast, junctin was expressed only in cardiac and skeletal muscle. Southern blot and PCR analyses indicated that ASPH, junctin, and junctate are splice variants of the same gene; ASPH uses exons 1, 3, 5, and 8 through 16, whereas junctin uses exons 2, 3, 5, and 6, and junctate uses exons 2 through 5 and 8 through 16. Fluorescence microscopy showed junctate expression in sarco(endo) plasmic reticulum membranes. Immunoblot analysis indicated that junctate is expressed as a 32-kD protein in kidney microsomes. Binding analysis determined that junctate binds calcium with high capacity and moderate affinity.

Full details of the abovementioned studies are described in the following publications, the disclosure of which are hereby incorporated by reference:

Lavaissiere, L.; Jia, S.; Nishiyama, M.; de la Monte, S.; Stern, A. M.; Wands, J. R.; Friedman, P. A.: Overexpression of human aspartyl(asparaginyl)-beta-hydroxylase in hepatocellular carcinoma and cholangiocarcinoma. J. Clin. Invest. 98:1313-1323, 1996; and Treves, S.; Feriotto, G.; Moccagatta, L.; Gambari, R.; Zorzato, F.: Molecular cloning, expression, functional characterization, chromosomal localization, and gene structure of junctate.

Further studies establishing the function and utilities of ASPH are found in John Hopkins OMIM database record ID 600582, and in cited publications listed in Table 5, which are hereby incorporated by reference. Aspartate beta-hydroxylase (ASPH, Accession NP_115856.1) is another GAM44 target gene, herein designated TARGET GENE. ASPH BINDING SITE is a target binding site found in the 3' untranslated region of multiple transcripts of mRNA encoded by ASPH, corresponding to a target binding site such as BINDING SITE I, BINDING SITE II or BINDING SITE III of FIG. 8. Table 4 illustrates the complementarity of the nucleotide sequences of ASPH BINDING SITE, designated SEQ ID:11418, to the nucleotide sequence of GAM44 RNA, herein designated GAM RNA, also designated SEQ ID:287.

Another function of GAM44 is therefore inhibition of Aspartate beta-hydroxylase (ASPH, Accession NP_115856.1), a gene which specifically hydroxylates the beta carbon of aspartic acid or asparagine residues in certain epidermal growth factor (EGF)-like domains of a number of proteins. Accordingly, utilities of GAM44 include diagnosis, prevention and treatment of diseases and clinical conditions associated with ASPH.

The function of ASPH has been established by previous studies. In hepatocellular carcinoma (HCC; 114550), one of the most prevalent tumors in the world which occurs with especially high frequency in sub-Saharan Africa and the Far East, a specific antigen is highly expressed; it is highly expressed also in cholangiocarcinomas. Lavaissiere et al. (1996) reported cDNA cloning of the human gene encoding this antigen, aspartyl(asparaginyl)-beta-hydroxylase (symbolized HAAH by them), and demonstrated that in these tumor lines it is expressed in an enzymatically active form. The gene encodes a deduced 744-amino acid polypeptide with high homology (81%) to the bovine gene (Jia et al., 1992). Lavaissiere et al. (1996) found that their cDNA human sequence was 99% homologous to the sequence for ASPH reported by Korioth et al. (1994), differing only at amino acid residues 565 (tyr to ile), 575 (trp-trp-thr to cys-gly, 585 (asp to gln), and 709 (arg to lys). They noted also a silent TCG- to - TCA transition at peptide residue 161. Lavaissiere et al. (1996) speculated about the possible relationship of the malignant phenotype of regulated aspartyl/asparaginyl-beta-hydroxylation in EGF-like domains of proteins such as the mammalian Notch homologs (e.g., 190198, 600275, and 600276), which are known to be involved in cell differentiation and whose cytoplasmic domains have been shown to be oncogenic. By screening a heart cDNA library, followed by RT-PCR, Lim et al. (2000) isolated cDNAs encoding the 225-amino acid junctin protein and a 210-amino acid isoform. The authors noted that a 73-residue stretch in junctin has a completely matched region in the ASPH protein. Southern blot analysis indicated that junctin and ASPH exist as a single-copy gene. Northern blot analysis revealed expression of 3.0 - and 4.2-kb transcripts in cardiac and skeletal muscle; expression was higher in skeletal muscle. SDS-PAGE analysis of the translated cDNAs showed expression of 26 - and 28-kD proteins. By screening a skeletal muscle cDNA library with a dog junctin probe, Treves et al. (2000) identified cDNAs encoding human junctin and junctate. Sequence analysis predicted that junctate, a 299-amino acid protein, shares the first 93 amino acids of the long isoform of junctin (and, partially, of ASPH), whereas its 64 C-terminal residues are identical to the central region of ASPH. Northern blot analysis detected a 2.6-kb transcript in heart, brain, pancreas, placenta, lung, liver, kidney, and skeletal muscle; highest levels were in heart, brain, and pancreas, and lowest levels were in skeletal muscle. In contrast, junctin was expressed only in cardiac and skeletal muscle. Southern blot and PCR analyses indicated that ASPH, junctin, and junctate are splice variants of the same gene; ASPH uses exons 1, 3, 5, and 8 through 16, whereas junctin uses exons 2, 3, 5, and 6, and junctate uses exons 2 through 5 and 8 through 16. Fluorescence microscopy showed junctate expression in sarco(endo) plasmic reticulum membranes. Immunoblot analysis indicated that junctate is expressed as a 32-kD protein in kidney microsomes. Binding analysis determined that junctate binds calcium with high capacity and moderate affinity.

Full details of the abovementioned studies are described in the following publications, the disclosure of which are hereby incorporated by reference:

Lavaissiere, L.; Jia, S.; Nishiyama, M.; de la Monte, S.; Stern, A. M.; Wands, J. R.; Friedman, P. A.: Overexpression of human aspartyl(asparaginyl)-beta-hydroxylase in hepatocellular carcinoma and cholangiocarcinoma. J. Clin. Invest. 98:1313-1323, 1996; and Treves, S.; Feriotto, G.; Moccagatta, L.; Gambari, R.; Zorzato, F.: Molecular cloning, expression, functional characterization, chromosomal localization, and gene structure of junctate.

Further studies establishing the function and utilities of ASPH are found in John Hopkins OMIM database record ID 600582, and in cited publications listed in Table 5, which are hereby incorporated by reference. Atpase, na+/k+ transporting, beta 3 polypeptide (ATP1B3, Accession NP_001670.1) is another GAM44 target gene, herein designated TARGET GENE. ATP1B3 BINDING SITE is a target binding site found in the 3' untranslated region of mRNA encoded by ATP1B3, corresponding to a target binding site such as BINDING SITE I, BINDING SITE II or BINDING SITE III of FIG. 8. Table 4 illustrates the complementarity of the nucleotide sequences of ATP1B3 BINDING SITE, designated SEQ ID:9521, to the nucleotide sequence of GAM44 RNA, herein designated GAM RNA, also designated SEQ ID:287.

Another function of GAM44 is therefore inhibition of Atpase, na+/k+ transporting, beta 3 polypeptide (ATP1B3, Accession NP_001670.1). Accordingly, utilities of GAM44 include diagnosis, prevention and treatment of diseases and clinical conditions associated with ATP1B3.

Atpase, ca++ transporting, type 2c, member 1 (ATP2C1, Accession NP_055197.1) is another GAM44 target gene, herein designated TARGET GENE. ATP2C1 BINDING SITE is a target binding site found in the 3' untranslated region of mRNA encoded by ATP2C1, corresponding to a target binding site such as BINDING SITE I, BINDING SITE II or BINDING SITE III of FIG. 8. Table 4 illustrates the complementarity of the nucleotide sequences of ATP2C1 BINDING SITE, designated SEQ ID:9108, to the nucleotide sequence of GAM44 RNA, herein designated GAM RNA, also designated SEQ ID:287.

Another function of GAM44 is therefore inhibition of Atpase, ca++ transporting, type 2c, member 1 (ATP2C1, Accession NP_055197.1). Accordingly, utilities of GAM44 include diagnosis, prevention and treatment of diseases and clinical conditions associated with ATP2C1.

Btb and cnc homology 1, basic leucine zipper transcription factor 2 (BACH2, Accession NP_068585.1) is another GAM44 target gene, herein designated TARGET GENE. BACH2 BINDING SITE is a target binding site found in the 3' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:13836, to the nucleotide sequence of GAM44 RNA, herein designated GAM RNA, also designated SEQ ID:287.

Another function of GAM44 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM44 include diagnosis, prevention and treatment of Non-hodgkin lymphoma, and of other diseases and clinical conditions associated with BACH2.

The function of BACH2 has been established by previous studies. By screening a K562 erythroleukemia cell line with mouse Bach2 cDNA as the probe, Sasaki et al. (2000) isolated a cDNA encoding BACH2. The deduced 841-amino acid protein is 89.5% identical to mouse Bach2, with 97% identity shared in the BTB and bZip functional domains and 94% identity shared in the serine-rich region. Northern blot analysis revealed expression of an approximately 11.0-kb BACH2 transcript restricted to thymus, spleen, and leukocytes; low levels were also detected in small intestine and brain. Sasaki et al. (2000) found mRNA and protein expression primarily in B-lymphoid rather than other hematopoietic cell lines. RT-PCR analysis showed that BACH2, like mouse Bach2, is expressed in primary B cells at the progenitor, precursor, immature, and mature B-cell stages. Mouse Bach2 is not expressed in plasma cells (Muto et al., 1998). Gel shift analysis showed that when overexpressed, BACH2 binds to MAF recognition elements (MARE). Overexpression also resulted in a loss of clonogenic activity. Southern blot analysis determined that BACH2 is a single-copy gene. BACH2/CA-1 microsatellite analysis indicated that loss of heterozygosity occurred in 5 of 25 non-Hodgkin lymphoma (OMIM Ref. No. 605027) patients.

Full details of the abovementioned studies are described in the following publications, the disclosure of which are hereby incorporated by reference:

Sasaki, S.; Ito, E.; Toki, T.; Maekawa, T.; Kanezaki, R.; Umenai, T.; Muto, A.; Nagai, H.; Kinoshita, T.; Yamamoto, M.; Inazawa, J.; Taketo, M. M.; Nakahata, T.; Igarashi, K.; Yokoyama, M.: Cloning and expression of human B cell-specific transcription factor BACH2 mapped to chromosome 6q15. Oncogene 19:3739-3749, 2000; and Muto, A.; Hoshino, H.; Madisen, L.; Yanai, N.; Obinata, M.; Karasuyama, H.; Hayashi, N.; Nakauchi, H.; Yamamoto, M.; Groudine, M.; Igarashi, K.: Identification of Bach2 as a B-cell-spe.

Further studies establishing the function and utilities of BACH2 are found in John Hopkins OMIM database record ID 605394, and in cited publications listed in Table 5, which are hereby incorporated by reference. BHC80 (Accession NP_057705.2) is another GAM44 target gene, herein designated TARGET GENE. BHC80 BINDING SITE is a target binding site found in the 5' untranslated region of mRNA encoded by BHC80, corresponding to a target binding site such as BINDING SITE I, BINDING SITE II or BINDING SITE III of FIG. 8. Table 4 illustrates the complementarity of the nucleotide sequences of BHC80 BINDING SITE, designated SEQ ID:7380, to the nucleotide sequence of GAM44 RNA, herein designated GAM RNA, also designated SEQ ID:287.

Another function of GAM44 is therefore inhibition of BHC80 (Accession NP_057705.2). Accordingly, utilities of GAM44 include diagnosis, prevention and treatment of diseases and clinical conditions associated with BHC80.

C14orf24 (Accession NP_775878.1) is another GAM44target gene, herein designated TARGET GENE. C14orf24 BINDING SITE is a target binding site found in the 3' untranslated region of mRNA encoded by C14orf24, corresponding to a target binding site such as BINDING SITE I, BINDING SITE II or BINDING SITE III of FIG. 8. Table 4 illustrates the complementarity of the nucleotide sequences of C14orf24 BINDING SITE, designated SEQ ID:831, to the nucleotide sequence of GAM44 RNA, herein designated GAM RNA, also designated SEQ ID:287.

Another function of GAM44 is therefore inhibition of C14orf24 (Accession NP_775878.1). Accordingly, utilities of GAM44 include diagnosis, prevention and treatment of diseases and clinical conditions associated with C14orf24.

C14orf39 (Accession NP_777638.1) is another GAM44target gene, herein designated TARGET GENE. C14orf39 BINDING SITE is a target binding site found in the 3' untranslated region of mRNA encoded by C14orf39, corresponding to a target binding site such as BINDING SITE I, BINDING SITE II or BINDING SITE III of FIG. 8. Table 4 illustrates the complementarity of the nucleotide sequences of C14orf39 BINDING SITE, designated SEQ ID:10766, to the nucleotide sequence of GAM44 RNA, herein designated GAM RNA, also designated SEQ ID:287.

Another function of GAM44 is therefore inhibition of C14orf39 (Accession NP_777638.1). Accordingly, utilities of GAM44 include diagnosis, prevention and treatment of diseases and clinical conditions associated with C14orf39.

C14orf78 (Accession XP_290629.1) is another GAM44target gene, herein designated TARGET GENE. C14orf78 BINDING SITE is a target binding site found in the 3' untranslated region of mRNA encoded by C14orf78, corresponding to a target binding site such as BINDING SITE I, BINDING SITE II or BINDING SITE III of FIG. 8. Table 4 illustrates the complementarity of the nucleotide sequences of C14orf78 BINDING SITE, designated SEQ ID:11042, to the nucleotide sequence of GAM44 RNA, herein designated GAM RNA, also designated SEQ ID:287.

Another function of GAM44 is therefore inhibition of C14orf78 (Accession XP_290629.1). Accordingly, utilities of GAM44 include diagnosis, prevention and treatment of diseases and clinical conditions associated with C14orf78.

Chromosome 21 open reading frame 55 (C21orf55, Accession NP_060303.1) is another GAM44 target gene, herein designated TARGET GENE. C21orf55 BINDING SITE is a target binding site found in the 5' untranslated region of mRNA encoded by C21orf55, corresponding to a target binding site such as BINDING SITE I, BINDING SITE II or BINDING SITE III of FIG. 8. Table 4 illustrates the complementarity of the nucleotide sequences of C21orf55 BINDING SITE, designated SEQ ID:15819, to the nucleotide sequence of GAM44 RNA, herein designated GAM RNA, also designated SEQ ID:287.

Another function of GAM44 is therefore inhibition of Chromosome 21 open reading frame 55 (C21orf55, Accession NP_060303.1). Accordingly, utilities of GAM44 include diagnosis, prevention and treatment of diseases and clinical conditions associated with C21orf55.

Chromosome 5 open reading frame 4 (C5orf4, Accession NP_115761.1) is another GAM44 target gene, herein designated TARGET GENE. C5orf4 BINDING SITE1 and C5orf4 BINDING SITE2 are target binding sites found in untranslated regions of multiple transcripts of mRNA encoded by C5orf4, corresponding to target binding sites such as BINDING SITE I, BINDING SITE II or BINDING SITE III of FIG. 8. Table 4 illustrates the complementarity of the nucleotide sequences of C5orf4 BINDING SITE1 and C5orf4 BINDING SITE2, designated SEQ ID:2131 and SEQ ID:16902 respectively, to the nucleotide sequence of GAM44 RNA, herein designated GAM RNA, also designated SEQ ID:287.

Another function of GAM44 is therefore inhibition of Chromosome 5 open reading frame 4 (C5orf4, Accession NP_115761.1). Accordingly, utilities of GAM44 include diagnosis, prevention and treatment of diseases and clinical conditions associated with C5orf4.

Chromosome 5 open reading frame 4 (C5orf4, Accession NP_115761.1) is another GAM44 target gene, herein designated TARGET GENE. C5orf4 BINDING SITE1 and C5orf4 BINDING SITE2 are target binding sites found in untranslated regions of multiple transcripts of mRNA encoded by C5orf4, corresponding to target binding sites such as BINDING SITE I, BINDING SITE II or BINDING SITE III of FIG. 8. Table 4 illustrates the complementarity of the nucleotide sequences of C5orf4 BINDING SITE1 and C5orf4 BINDING SITE2, designated SEQ ID:16902 and SEQ ID:18232 respectively, to the nucleotide sequence of GAM44 RNA, herein designated GAM RNA, also designated SEQ ID:287.

Another function of GAM44 is therefore inhibition of Chromosome 5 open reading frame 4 (C5orf4, Accession NP_115761.1). Accordingly, utilities of GAM44 include diagnosis, prevention and treatment of diseases and clinical conditions associated with C5orf4.

Cholecystokinin b receptor (CCKBR, Accession NP_795344.1) is another GAM44 target gene, herein designated TARGET GENE. CCKBR BINDING SITE is a target binding site found in the 3' untranslated region of multiple transcripts of mRNA encoded by CCKBR, corresponding to a target binding site such as BINDING SITE I, BINDING SITE II or BINDING SITE III of FIG. 8. Table 4 illustrates the complementarity of the nucleotide sequences of CCKBR BINDING SITE, designated SEQ ID:6458, to the nucleotide sequence of GAM44 RNA, herein designated GAM RNA, also designated SEQ ID:287.

Another function of GAM44 is therefore inhibition of Cholecystokinin b receptor (CCKBR, Accession NP_795344.1), a gene which bonds cholecystokinin, regulates emotion and gastric acid secretion. Accordingly, utilities of GAM44 include diagnosis, prevention and treatment of diseases and clinical conditions associated with CCKBR.

The function of CCKBR has been established by previous studies. The cholecystokinin (CCK) family of peptides (see OMIM Ref. No. 118440) and their receptors are widely distributed throughout the central nervous system and gastrointestinal tract. The receptors can be divided into 2 subtypes on the basis of their affinity for nonsulfated analogs of CCK. Type A receptors, which have a high affinity only for sulfated CCK-8, are found principally in the gastrointestinal tract and select areas of the CNS, while type B (gastrin) receptors, having a high affinity for both sulfated and nonsulfated CCK analogs, are found principally in the CNS and select areas of the gastrointestinal tract. Highly selective, nonpeptide antagonists have been developed that support this subtype classification. In the CNS, type B receptors regulate anxiety, arousal, neuroleptic activity, and opiate-induced analgesia. Outside the CNS, they regulate gastric acid secretion and may play a role in gastrointestinal motility and growth of normal and neoplastic gastrointestinal tissue. The CCKB/gastrin receptor (CCKBR) can selectively be blocked by nonpeptide benzodiazepine-based antagonists. Beinborn et al. (1993) found that a single amino acid, valine-319, is critical in determining the binding affinity for these nonpeptide antagonists. They showed that it is the variability in the aliphatic side chain of the amino acid in position 319 that confers antagonist specificity and concluded that the residues underlying nonpeptide antagonist affinity must differ from those that confer against specificity. Pisegna et al. (1992) used a rat type B receptor cDNA to isolate cDNA for the human counterpart. They found that it encodes a 447-amino acid protein with 90% identity to both rat type B CCK receptor and canine gastrin receptor. Northern hybridization identified transcripts in stomach, pancreas, brain, and gall bladder. Using a somatic cell hybrid panel of human/hamster DNAs and Southern blot analysis, they demonstrated that the CCKBR gene is located on chromosome 11. Expression of the receptor of the cDNA in COS-7 cells was characteristic of a type B CCK receptor pharmacology. Zimonjic et al. (1994) assigned the CCKBR gene to 11p15.5-p15.4 by in situ hybridization.

Full details of the abovementioned studies are described in the following publications, the disclosure of which are hereby incorporated by reference:

Beinborn, M.; Lee, Y.-M.; McBride, E. W.; Quinn, S. M.; Kopin, A. S.: A single amino acid of the cholecystokinin-B/gastrin receptor determines specificity for non-peptide antagonists. Nature 362:348-350, 1993; and Pisegna, J. R.; de Weerth, A.; Huppi, K.; Wank, S. A.: Molecular cloning of the human brain and gastric cholecystokinin receptor: structure, functional expression and chromosomal locali.

Further studies establishing the function and utilities of CCKBR are found in John Hopkins OMIM database record ID 118445, and in cited publications listed in Table 5, which are hereby incorporated by reference. Cholecystokinin b receptor (CCKBR, Accession NP_000722.2) is another GAM44 target gene, herein designated TARGET GENE. CCKBR BINDING SITE is a target binding site found in the 3' untranslated region of multiple transcripts of mRNA encoded by CCKBR, corresponding to a target binding site such as BINDING SITE I, BINDING SITE II or BINDING SITE III of FIG. 8. Table 4 illustrates the complementarity of the nucleotide sequences of CCKBR BINDING SITE, designated SEQ ID:6458, to the nucleotide sequence of GAM44 RNA, herein designated GAM RNA, also designated SEQ ID:287.

Another function of GAM44 is therefore inhibition of Cholecystokinin b receptor (CCKBR, Accession NP_000722.2), a gene which bonds cholecystokinin, regulates emotion and gastric acid secretion. Accordingly, utilities of GAM44 include diagnosis, prevention and treatment of diseases and clinical conditions associated with CCKBR.

The function of CCKBR has been established by previous studies. The cholecystokinin (CCK) family of peptides (see OMIM Ref. No. 118440) and their receptors are widely distributed throughout the central nervous system and gastrointestinal tract. The receptors can be divided into 2 subtypes on the basis of their affinity for nonsulfated analogs of CCK. Type A receptors, which have a high affinity only for sulfated CCK-8, are found principally in the gastrointestinal tract and select areas of the CNS, while type B (gastrin) receptors, having a high affinity for both sulfated and nonsulfated CCK analogs, are found principally in the CNS and select areas of the gastrointestinal tract. Highly selective, nonpeptide antagonists have been developed that support this subtype classification. In the CNS, type B receptors regulate anxiety, arousal, neuroleptic activity, and opiate-induced analgesia. Outside the CNS, they regulate gastric acid secretion and may play a role in gastrointestinal motility and growth of normal and neoplastic gastrointestinal tissue. The CCKB/gastrin receptor (CCKBR) can selectively be blocked by nonpeptide benzodiazepine-based antagonists. Beinborn et al. (1993) found that a single amino acid, valine-319, is critical in determining the binding affinity for these nonpeptide antagonists. They showed that it is the variability in the aliphatic side chain of the amino acid in position 319 that confers antagonist specificity and concluded that the residues underlying nonpeptide antagonist affinity must differ from those that confer against specificity. Pisegna et al. (1992) used a rat type B receptor cDNA to isolate cDNA for the human counterpart. They found that it encodes a 447-amino acid protein with 90% identity to both rat type B CCK receptor and canine gastrin receptor. Northern hybridization identified transcripts in stomach, pancreas, brain, and gall bladder. Using a somatic cell hybrid panel of human/hamster DNAs and Southern blot analysis, they demonstrated that the CCKBR gene is located on chromosome 11. Expression of the receptor of the cDNA in COS-7 cells was characteristic of a type B CCK receptor pharmacology. Zimonjic et al. (1994) assigned the CCKBR gene to 11p15.5-p15.4 by in situ hybridization.

Full details of the abovementioned studies are described in the following publications, the disclosure of which are hereby incorporated by reference:

Beinborn, M.; Lee, Y.-M.; McBride, E. W.; Quinn, S. M.; Kopin, A. S.: A single amino acid of the cholecystokinin-B/gastrin receptor determines specificity for non-peptide antagonists. Nature 362:348-350, 1993; and Pisegna, J. R.; de Weerth, A.; Huppi, K.; Wank, S. A.: Molecular cloning of the human brain and gastric cholecystokinin receptor: structure, functional expression and chromosomal locali.

Further studies establishing the function and utilities of CCKBR are found in John Hopkins OMIM database record ID 118445, and in cited publications listed in Table 5, which are hereby incorporated by reference. Collagen-like tail subunit (single strand of homotrimer) of asymmetric acetylcholinesterase (COLQ, Accession NP_536803.1) is another GAM44 target gene, herein designated TARGET GENE. COLQ BINDING SITE is a target binding site found in the 3' untranslated region of multiple transcripts of mRNA encoded by COLQ, corresponding to a target binding site such as BINDING SITE I, BINDING SITE II or BINDING SITE III of FIG. 8. Table 4 illustrates the complementarity of the nucleotide sequences of COLQ BINDING SITE, designated SEQ ID:9718, to the nucleotide sequence of GAM44 RNA, herein designated GAM RNA, also designated SEQ ID:287.

Another function of GAM44 is therefore inhibition of Collagen-like tail subunit (single strand of homotrimer) of asymmetric acetylcholinesterase (COLQ, Accession NP_536803.1). Accordingly, utilities of GAM44 include diagnosis, prevention and treatment of diseases and clinical conditions associated with COLQ.

Collagen-like tail subunit (single strand of homotrimer) of asymmetric acetylcholinesterase (COLQ, Accession NP_536804.1) is another GAM44target gene, herein designated TARGET GENE. COLQ BINDING SITE is a target binding site found in the 3' untranslated region of multiple transcripts of mRNA encoded by COLQ, corresponding to a target binding site such as BINDING SITE I, BINDING SITE II or BINDING SITE III of FIG. 8. Table 4 illustrates the complementarity of the nucleotide sequences of COLQ BINDING SITE, designated SEQ ID:9718, to the nucleotide sequence of GAM44 RNA, herein designated GAM RNA, also designated SEQ ID:287.

Another function of GAM44 is therefore inhibition of Collagen-like tail subunit (single strand of homotrimer) of asymmetric acetylcholinesterase (COLQ, Accession NP_536804.1). Accordingly, utilities of GAM44 include diagnosis, prevention and treatment of diseases and clinical conditions associated with COLQ.

Complement component (3b/4b) receptor 1, including knops blood group system (CR1, Accession NP_000564.1) is another GAM44 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:10491, to the nucleotide sequence of GAM44 RNA, herein designated GAM RNA, also designated SEQ ID:287.

Another function of GAM44 is therefore inhibition of Complement component (3b/4b) receptor 1, including knops blood group system (CR1, Accession NP_000564.1). Accordingly, utilities of GAM44 include diagnosis, prevention and treatment of diseases and clinical conditions associated with CR1.

Chemokine (c-x3-c motif) receptor 1 (CX3CR1, Accession NP_001328.1) is another GAM44 target gene, herein designated TARGET GENE. CX3CR1 BINDING SITE is a target binding site found in the 3' untranslated region of mRNA encoded by CX3CR1, corresponding to a target binding site such as BINDING SITE I, BINDING SITE II or BINDING SITE III of FIG. 8. Table 4 illustrates the complementarity of the nucleotide sequences of CX3CR1 BINDING SITE, designated SEQ ID:10405, to the nucleotide sequence of GAM44 RNA, herein designated GAM RNA, also designated SEQ ID:287.

Another function of GAM44 is therefore inhibition of Chemokine (c-x3-c motif) receptor 1 (CX3CR1, Accession NP_001328.1), a gene which mediates both the adhesive and migratory functions of fractalkine and therefore may be associated with Human immunodeficiency virus type 1. Accordingly, utilities of GAM44 include diagnosis, prevention and treatment of Human immunodeficiency virus type 1., and of other diseases and clinical conditions associated with CX3CR1.

The function of CX3CR1 has been established by previous studies. Leukocyte trafficking at the endothelium requires both cellular adhesion molecules and chemotactic factors. Fractalkine (OMIM Ref. No. 601880), a transmembrane molecule with a CX3C-motif chemokine domain atop a mucin stalk, induces both adhesion and migration of leukocytes. Imai et al. (1997) identified a 7-transmembrane high-affinity receptor for fractalkine and showed that it mediates both the adhesive and migratory functions of fractalkine. The receptor, which the authors termed CX3CR1, requires pertussis toxin-sensitive G protein signaling to induce migration but not to support adhesion, which also occurs without other adhesion molecules but requires the architecture of a chemokine domain atop the mucin stalk. Natural killer cells predominantly express CX3CR1 and respond to fractalkine in both migration and adhesion. Imai et al. (1997) concluded that fractalkine and CX3CR1 represent new types of leukocyte trafficking regulators, performing both adhesive and chemotactic functions. CX3CR1 is an HIV coreceptor as well as a leukocyte chemotactic/adhesion receptor for fractalkine. Faure et al. (2000) identified 2 single nucleotide polymorphisms in the CX3CR1 gene in Caucasians and demonstrated that HIV-infected patients homozygous for I249/M280 (601470.0001) progressed to AIDS more rapidly than those with other haplotypes (relative risk =2.13, P =0.039). Functional CX3CR1 analysis showed that fractalkine binding is reduced among patients homozygous for this particular haplotype. Thus, Faure et al. (2000) concluded that CX3CR1-I249/M280 is a recessive genetic risk factor for HIV/AIDS. Tripp et al. (2001) showed that the G glycoprotein of respiratory syncytial virus (RSV) shares a heparin-binding domain and a CX3C chemokine motif with CX3CL1. Binding analysis indicated that RSV can use CX3CR1 as a receptor. G glycoprotein binding mimics fractalkine binding and induces leukocyte chemotaxis. Tripp et al. (2001) concluded that RSV G glycoprotein uses its similarities with CX3C to facilitate infection and to modify the immune response.

Full details of the abovementioned studies are described in the following publications, the disclosure of which are hereby incorporated by reference:

Faure, S.; Meyer, L.; Costagliola, D.; Vaneensberghe, C.; Genin, E.; Autran, B.; French ALT and IMMUNOCO Study Groups; Delfraisay, J.-F.; SEROCO Study Group; McDermott, D. H.; Murphy, P. M.; Debre, P.; Theodorou, I.; Cambadiere, C.: Rapid progression to AIDS in HIV+ individuals with a structural variant of the chemokine receptor CX(3) CR1. Science 287:2274-2277, 2000; and Moatti, D.; Faure, S.; Fumeron, F.; Amara, M. E. W.; Seknadji, P.; McDermott, D. H.; Debre, P.; Aumont, M. C.; Murphy, P. M.; de Prost, D.; Combadiere, C.: Polymorphism in the fractalk.

Further studies establishing the function and utilities of CX3CR1 are found in John Hopkins OMIM database record ID 601470, and in cited publications listed in Table 5, which are hereby incorporated by reference. Cylindromatosis (turban tumor syndrome) (CYLD, Accession NP_056062.1) is another GAM44 target gene, herein designated TARGET GENE. CYLD BINDING SITE is a target binding site found in the 5' untranslated region of mRNA encoded by CYLD, corresponding to a target binding site such as BINDING SITE I, BINDING SITE II or BINDING SITE III of FIG. 8. Table 4 illustrates the complementarity of the nucleotide sequences of CYLD BINDING SITE, designated SEQ ID:11043, to the nucleotide sequence of GAM44 RNA, herein designated GAM RNA, also designated SEQ ID:287.

Another function of GAM44 is therefore inhibition of Cylindromatosis (turban tumor syndrome) (CYLD, Accession NP_056062.1). Accordingly, utilities of GAM44 include diagnosis, prevention and treatment of diseases and clinical conditions associated with CYLD.

24-dehydrocholesterol reductase (DHCR24, Accession NP_055577.1) is another GAM44 target gene, herein designated TARGET GENE. DHCR24 BINDING SITE is a target binding site found in the 3' untranslated region of mRNA encoded by DHCR24, corresponding to a target binding site such as BINDING SITE I, BINDING SITE II or BINDING SITE III of FIG. 8. Table 4 illustrates the complementarity of the nucleotide sequences of DHCR24 BINDING SITE, designated SEQ ID:14070, to the nucleotide sequence of GAM44 RNA, herein designated GAM RNA, also designated SEQ ID:287.

Another function of GAM44 is therefore inhibition of 24-dehydrocholesterol reductase (DHCR24, Accession NP_055577.1), a gene which catalyzes the reduction of sterol intermediates. and therefore is associated with Desmosterolosis. Accordingly, utilities of GAM44 include diagnosis, prevention and treatment of Desmosterolosis, and of other diseases and clinical conditions associated with DHCR24.

The function of DHCR24 has been established by previous studies. Sarkar et al. (2001) showed that the gene encoding seladin-1, a human homolog of the Diminuto/Dwarf1 gene described in plants and C. elegans, has adenoma-specific overexpression. Northern blot analysis revealed that seladin-1 mRNA was overexpressed in the adenoma tissue of 14 patients with Cushing syndrome in comparison to the adjacent nontumorous adrenal gland. In situ hybridization using a seladin-1 cRNA probe showed its abundant expression in the tumor cells, whereas the nontumorous cells showed a low level of expression. Almost no apoptotic cell was detected in the tumor or in the normal adrenal cortex where seladin-1 expression was abundant. The authors noted that their results were compatible with a recent report that seladin-1 acts as an antiapoptotic factor in neurons (Greeve et al., 2000). In addition, expression of seladin-1 in the normal adrenal cortex was most abundant in the zona fasciculata, suggesting its possible regulation by ACTH/cAMP. The authors concluded that the overexpression of seladin-1 in the adenoma could be due to the abundant expression of ACTH receptor and hypothesized that seladin-1 might be involved in the molecular events of adrenocortical tumorigenesis by facilitating steroid synthesis and cell growth. In a severely affected infant with desmosterolosis (OMIM Ref. No. 602398), Waterham et al. (2001) identified 3 mutations in the DHCR24 gene. The mutation inherited from the mother was a 1412A-C change resulting in a tyr471- to - ser (Y471S) substitution. Expression studies in S. cerevisiae showed nondetectable activity of this variant, consistent with the severe phenotype of the patient. Two mutations on the same allele were inherited from the father: an 881A-C change resulting in an asn294- to - thr substitution (N294T), and a 918G-C change resulting in a lys306- to - asn (K306N) substitution (606418.0002). Expression studies in S. cerevisiae of the N294T and K306N variants showed 14.4% and 49.8% of wildtype activity, respectively. Expression studies in S. cerevisiae of an allele with both mutations from the father showed less than 1% of wildtype activity. To determine whether one of the mutations inherited from the father was a common polymorphic variant, 50 alleles of controls were analyzed but neither mutation was detected.

Full details of the abovementioned studies are described in the following publications, the disclosure of which are hereby incorporated by reference:

Sarkar, D.; Imai, T.; Kambe, F.; Shibata, A.; Ohmori, S.; Siddiq, A.; Hayasaka, S.; Funahashi, H.; Seo, H.: The human homolog of Diminuto/Dwarf1 gene (hDiminuto): a novel ACTH-responsive gene overexpressed in benign cortisol-producing adrenocortical adenomas. J. Clin. Endocr. Metab. 86:5130-5137, 2001; and Greeve, I.; Hermans-Borgmeyer, I.; Brellinger, C.; Kasper, D.; Gomez-Isla, T.; Behl, C.; Levkau, B.; Nitsch, R. M.: The human DIMINUTO/DWARF1 homolog seladin-1 confers resistance to A.

Further studies establishing the function and utilities of DHCR24 are found in John Hopkins OMIM database record ID 606418, and in cited publications listed in Table 5, which are hereby incorporated by reference. DIRAS2 (Accession NP_060064.2) is another GAM44 target gene, herein designated TARGET GENE. DIRAS2 BINDING SITE1 and DIRAS2 BINDING SITE2 are target binding sites found in untranslated regions of mRNA encoded by DIRAS2, corresponding to target binding sites such as BINDING SITE I, BINDING SITE II or BINDING SITE III of FIG. 8. Table 4 illustrates the complementarity of the nucleotide sequences of DIRAS2 BINDING SITE1 and DIRAS2 BINDING SITE2, designated SEQ ID:16186 and SEQ ID:14097 respectively, to the nucleotide sequence of GAM44 RNA, herein designated GAM RNA, also designated SEQ ID:287.

Another function of GAM44 is therefore inhibition of DIRAS2 (Accession NP_060064.2). Accordingly, utilities of GAM44 include diagnosis, prevention and treatment of diseases and clinical conditions associated with DIRAS2.

DKFZp547I094 (Accession NP_115531.1) is another GAM44 target gene, herein designated TARGET GENE. DKFZp547I094 BINDING SITE is a target binding site found in the 5' untranslated region of mRNA encoded by DKFZp547I094, corresponding to a target binding site such as BINDING SITE I, BINDING SITE II or BINDING SITE III of FIG. 8. Table 4 illustrates the complementarity of the nucleotide sequences of DKFZp547I094 BINDING SITE, designated SEQ ID:2790, to the nucleotide sequence of GAM44 RNA, herein designated GAM RNA, also designated SEQ ID:287.

Another function of GAM44 is therefore inhibition of DKFZp547I094 (Accession NP_115531.1). Accordingly, utilities of GAM44 include diagnosis, prevention and treatment of diseases and clinical conditions associated with DKFZp547I094.

DKFZP564O0423 (Accession XP_166254.2) is another GAM44 target gene, herein designated TARGET GENE. DKFZP564O0423 BINDING SITE is a target binding site found in the 3' untranslated region of mRNA encoded by DKFZP564O0423, corresponding to a target binding site such as BINDING SITE I, BINDING SITE II or BINDING SITE III of FIG. 8. Table 4 illustrates the complementarity of the nucleotide sequences of DKFZP564O0423 BINDING SITE, designated SEQ ID:1156, to the nucleotide sequence of GAM44 RNA, herein designated GAM RNA, also designated SEQ ID:287.

Another function of GAM44 is therefore inhibition of DKFZP564O0423 (Accession XP_166254.2). Accordingly, utilities of GAM44 include diagnosis, prevention and treatment of diseases and clinical conditions associated with DKFZP564O0423.

DKFZP586F2423 (Accession XP_291242.1) is another GAM44 target gene, herein designated TARGET GENE. DKFZP586F2423 BINDING SITE is a target binding site found in the 3' untranslated region of mRNA encoded by DKFZP586F2423, corresponding to a target binding site such as BINDING SITE I, BINDING SITE II or BINDING SITE III of FIG. 8. Table 4 illustrates the complementarity of the nucleotide sequences of DKFZP586F2423 BINDING SITE, designated SEQ ID:12701, to the nucleotide sequence of GAM44 RNA, herein designated GAM RNA, also designated SEQ ID:287.

Another function of GAM44 is therefore inhibition of DKFZP586F2423 (Accession XP_291242.1). Accordingly, utilities of GAM44 include diagnosis, prevention and treatment of diseases and clinical conditions associated with DKFZP586F2423.

DKFZp761B107 (Accession NP_775734.1) is another GAM44 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:19365, to the nucleotide sequence of GAM44 RNA, herein designated GAM RNA, also designated SEQ ID:287.

Another function of GAM44 is therefore inhibition of DKFZp761B107 (Accession NP_775734.1). Accordingly, utilities of GAM44 include diagnosis, prevention and treatment of diseases and clinical conditions associated with DKFZp761B107.

E2f transcription factor 3 (E2F3, Accession NP_001940.1) is another GAM44 target gene, herein designated TARGET GENE. E2F3 BINDING SITE is a target binding site found in the 3' untranslated region of mRNA encoded by E2F3, corresponding to a target binding site such as BINDING SITE I, BINDING SITE II or BINDING SITE III of FIG. 8. Table 4 illustrates the complementarity of the nucleotide sequences of E2F3 BINDING SITE, designated SEQ ID:13295, to the nucleotide sequence of GAM44 RNA, herein designated GAM RNA, also designated SEQ ID:287.

Another function of GAM44 is therefore inhibition of E2f transcription factor 3 (E2F3, Accession NP_001940.1), a gene which binds dna and controls cell-cycle progression from g1 to s phase. and therefore may be associated with Hereditary autosomal dominant myoclonus dystonia. Accordingly, utilities of GAM44 include diagnosis, prevention and treatment of Hereditary autosomal dominant myoclonus dystonia, and of other diseases and clinical conditions associated with E2F3.

The function of E2F3 has been established by previous studies. MYC (OMIM Ref. No. 190080) induces transcription of the E2F1, E2F2 (OMIM Ref. No. 600426), and E2F3 genes. Using primary mouse embryo fibroblasts deleted for individual E2f genes, Leone et al. (2001) showed that MYC-induced S phase and apoptosis requires distinct E2F activities. The ability of Myc to induce S phase was impaired in the absence of either E2f2 or E2f3 but not E2f1 or E2f4 (OMIM Ref. No. 600659). In contrast, the ability of Myc to induce apoptosis was markedly reduced in cells deleted for E2f1 but not E2f2 or E2f3. The authors proposed that the induction of specific E2F activities is an essential component in the MYC pathways that control cell proliferation and cell fate decisions.

Animal model experiments lend further support to the function of E2F3. Cloud et al. (2002) generated E2f3-null mice. They found that E2f3 was essential for embryonic viability in the pure 129/Sv background, but that the presence of C57BL/6 alleles yielded some adult survivors. Although growth retarded, surviving E2f3 -/- animals were initially healthy and exhibited no obvious tumor phenotype. They died prematurely, however, with signs typical of congestive heart failure, a defect completely distinct from those reported in E2f1-null mice. Cloud et al. (2002) also generated E2f1/E2f3 compound mutant mice and found that almost all of the developmental and age-related defects arising in the individual E2f1- or E2f3-null mice were exacerbated by the mutation of the other E2f. One major difference in the properties of E2f1 and E2f3 loss was that, either alone or in combination with loss of E2f1, E2f3 mutants did not show an increase in the incidence of tumor formation.

It is appreciated that the abovementioned animal model for E2F3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leone, G.; Sears, R.; Huang, E.; Rempel, R.; Nuckolls, F.; Park, C.-H.; Giangrande, P.; Wu, L.; Saavedra, H. I.; Field, S. J.; Thompson, M. A.; Yang, H.; Fujiwara, Y.; Greenberg, M. E.; Orkin, S.; Smith, C.; Nevins, J. R.: Myc requires distinct E2F activities to induce S phase and apoptosis. Molec. Cell 8:105-113, 2001; and Cloud, J. E.; Rogers, C.; Reza, T. L.; Ziebold, U.; Stone, J. R.; Picard, M. H.; Caron, A. M.; Bronson, R. T.; Lees, J. A.: Mutant mouse models reveal the relative roles of E2F1 and E2.

Further studies establishing the function and utilities of E2F3 are found in John Hopkins OMIM database record ID 600427, and in cited publications listed in Table 5, which are hereby incorporated by reference. Endothelial differentiation, lysophosphatidic acid g-protein-coupled receptor, 2 (EDG2, Accession NP_476500.1) is another GAM44 target gene, herein designated TARGET GENE. EDG2 BINDING SITE is a target binding site found in the 3' untranslated region of multiple transcripts of mRNA encoded by EDG2, corresponding to a target binding site such as BINDING SITE I, BINDING SITE II or BINDING SITE III of FIG. 8. Table 4 illustrates the complementarity of the nucleotide sequences of EDG2 BINDING SITE, designated SEQ ID:10299, to the nucleotide sequence of GAM44 RNA, herein designated GAM RNA, also designated SEQ ID:287.

Another function of GAM44 is therefore inhibition of Endothelial differentiation, lysophosphatidic acid g-protein-coupled receptor, 2 (EDG2, Accession NP_476500.1). Accordingly, utilities of GAM44 include diagnosis, prevention and treatment of diseases and clinical conditions associated with EDG2.

Endothelial differentiation, lysophosphatidic acid g-protein-coupled receptor, 2 (EDG2, Accession NP_001392.2) is another GAM44 target gene, herein designated TARGET GENE. EDG2 BINDING SITE is a target binding site found in the 3' untranslated region of multiple transcripts of mRNA encoded by EDG2, corresponding to a target binding site such as BINDING SITE I, BINDING SITE II or BINDING SITE III of FIG. 8. Table 4 illustrates the complementarity of the nucleotide sequences of EDG2 BINDING SITE, designated SEQ ID:10299, to the nucleotide sequence of GAM44 RNA, herein designated GAM RNA, also designated SEQ ID:287.

Another function of GAM44 is therefore inhibition of Endothelial differentiation, lysophosphatidic acid g-protein-coupled receptor, 2 (EDG2, Accession NP_001392.2). Accordingly, utilities of GAM44 include diagnosis, prevention and treatment of diseases and clinical conditions associated with EDG2.

Fk506 binding protein 2, 13 kda (FKBP2, Accession NP_004461.2) is another GAM44 target gene, herein designated TARGET GENE. FKBP2 BINDING SITE is a target binding site found in the 3' untranslated region of multiple transcripts of mRNA encoded by FKBP2, corresponding to a target binding site such as BINDING SITE I, BINDING SITE II or BINDING SITE III of FIG. 8. Table 4 illustrates the complementarity of the nucleotide sequences of FKBP2

BINDING SITE, designated SEQ ID:11911, to the nucleotide sequence of GAM44 RNA, herein designated GAM RNA, also designated SEQ ID:287.

Another function of GAM44 is therefore inhibition of Fk506 binding protein 2, 13 kda (FKBP2, Accession NP_004461.2), a gene which ppiases accelerate the folding of proteins. Accordingly, utilities of GAM44 include diagnosis, prevention and treatment of diseases and clinical conditions associated with FKBP2.

The function of FKBP2 has been established by previous studies. See 186945. DiLella et al. (1992) found that the FKBP2 gene is 3 kb long and contains 6 exons. By fluorescence in situ hybridization, they mapped the gene to 11q13.1-q13.3. Jin et al. (1991) reported the cloning and subcellular localization of a 13-kD FK506-binding protein (OMIM Ref. No. FKBP13), which has a 21-amino acid signal peptide and appears to be membrane-associated. The 120-amino acid mature protein appears to lack a transmembrane domain but a potential endoplasmic reticulum retention sequence (Arg-Thr-Glu-Leu) is found at its C-terminus. FKBP13 has 51% nucleotide sequence identity and 43% amino acid sequence identity to FKBP12 (OMIM Ref. No. 186945). Jin et al. (1991) noted that conserved residues that comprise the drug binding site and rotamase active site of FKBP12 are completely conserved in FKBP13. Courseaux et al. (1996) used a combination of methods to refine maps of the approximately 5-Mb region of 11q13 that includes MEN1 (OMIM Ref. No. 131100). They proposed the following gene order: cen-PGA-FTH1-UGB-AHNAK-ROM1-MDU1-CHRM1-COX8-EMK1-FKBP2-PLCB3-[PYGM, ZFM1]-FAU-CAPN1-[MLK3, RELA]-FOSL1-SEA-CFL1-tel.

Full details of the abovementioned studies are described in the following publications, the disclosure of which are hereby incorporated by reference:

Courseaux, A.; Grosgeorge, J.; Gaudray, P.; Pannett, A. A. J.; Forbes, S. A.; Williamson, C.; Bassett, D.; Thakker, R. V.; Teh, B. T.; Farnebo, F.; Shepherd, J.; Skogseid, B.; Larsson, C.; Giraud, S.; Zhang, C. X.; Salandre, J.; Calender, A.: Definition of the minimal MEN1 candidate area based on a 5-Mb integrated map of proximal 11q13. Genomics 37:354-365, 1996; and DiLella, A. G.; Hawkins, A.; Craig, R. J.; Schreiber, S. L.; Griffin, C. A.: Chromosomal band assignments of the genes encoding human FKBP12 and FKBP13. Biochem. Biophys. Res. Commun.

Further studies establishing the function and utilities of FKBP2 are found in John Hopkins OMIM database record ID 186946, and in cited publications listed in Table 5, which are hereby incorporated by reference. Fk506 binding protein 2, 13 kda (FKBP2, Accession NP_476433.1) is another GAM44 target gene, herein designated TARGET GENE. FKBP2 BINDING SITE is a target binding site found in the 3' untranslated region of multiple transcripts of mRNA encoded by FKBP2, corresponding to a target binding site such as BINDING SITE I, BINDING SITE II or BINDING SITE III of FIG. 8. Table 4 illustrates the complementarity of the nucleotide sequences of FKBP2 BINDING SITE, designated SEQ ID:11911, to the nucleotide sequence of GAM44 RNA, herein designated GAM RNA, also designated SEQ ID:287.

Another function of GAM44 is therefore inhibition of Fk506 binding protein 2, 13 kda (FKBP2, Accession NP_476433.1), a gene which ppiases accelerate the folding of proteins. Accordingly, utilities of GAM44 include diagnosis, prevention and treatment of diseases and clinical conditions associated with FKBP2.

The function of FKBP2 has been established by previous studies. See 186945. DiLella et al. (1992) found that the FKBP2 gene is 3 kb long and contains 6 exons. By fluorescence in situ hybridization, they mapped the gene to 11q13.1-q13.3. Jin et al. (1991) reported the cloning and subcellular localization of a 13-kD FK506-binding protein (OMIM Ref. No. FKBP13), which has a 21-amino acid signal peptide and appears to be membrane-associated. The 120-amino acid mature protein appears to lack a transmembrane domain but a potential endoplasmic reticulum retention sequence (Arg-Thr-Glu-Leu) is found at its C-terminus. FKBP13 has 51% nucleotide sequence identity and 43% amino acid sequence identity to FKBP12 (OMIM Ref. No. 186945). Jin et al. (1991) noted that conserved residues that comprise the drug binding site and rotamase active site of FKBP12 are completely conserved in FKBP13. Courseaux et al. (1996) used a combination of methods to refine maps of the approximately 5-Mb region of 11q13 that includes MEN1 (OMIM Ref. No. 131100). They proposed the following gene order: cen-PGA-FTH1-UGB-AHNAK-ROM1-MDU1-CHRM1-COX8-EMK1-FKBP2-PLCB3-[PYGM, ZFM1]-FAU-CAPN1-[MLK3, RELA]-FOSL1-SEA-CFL1-tel.

Full details of the abovementioned studies are described in the following publications, the disclosure of which are hereby incorporated by reference:

Courseaux, A.; Grosgeorge, J.; Gaudray, P.; Pannett, A. A. J.; Forbes, S. A.; Williamson, C.; Bassett, D.; Thakker, R. V.; Teh, B. T.; Farnebo, F.; Shepherd, J.; Skogseid, B.; Larsson, C.; Giraud, S.; Zhang, C. X.; Salandre, J.; Calender, A.: Definition of the minimal MEN1 candidate area based on a 5-Mb integrated map of proximal 11q13. Genomics 37:354-365, 1996; and DiLella, A. G.; Hawkins, A.; Craig, R. J.; Schreiber, S. L.; Griffin, C. A.: Chromosomal band assignments of the genes encoding human FKBP12 and FKBP13. Biochem. Biophys. Res. Commun.

Further studies establishing the function and utilities of FKBP2 are found in John Hopkins OMIM database record ID 186946, and in cited publications listed in Table 5, which are hereby incorporated by reference. FLJ10945 (Accession NP_060750.1) is another GAM44 target gene, herein designated TARGET GENE. FLJ10945 BINDING SITE is a target binding site found in the 3' untranslated region of mRNA encoded by FLJ10945, corresponding to a target binding site such as BINDING SITE I, BINDING SITE II or BINDING SITE III of FIG. 8. Table 4 illustrates the complementarity of the nucleotide sequences of FLJ10945 BINDING SITE, designated SEQ ID:3221, to the nucleotide sequence of GAM44 RNA, herein designated GAM RNA, also designated SEQ ID:287.

Another function of GAM44 is therefore inhibition of FLJ10945 (Accession NP_060750.1). Accordingly, utilities of GAM44 include diagnosis, prevention and treatment of diseases and clinical conditions associated with FLJ10945.

FLJ11730 (Accession NP_073593.1) is another GAM44 target gene, herein designated TARGET GENE. FLJ11730 BINDING SITE is a target binding site found in the 3' untranslated region of mRNA encoded by FLJ11730, corresponding to a target binding site such as BINDING SITE I, BINDING SITE II or BINDING SITE III of FIG. 8. Table 4 illustrates the complementarity of the nucleotide sequences of FLJ11730 BINDING SITE, designated SEQ ID:13471, to the nucleotide sequence of GAM44 RNA, herein designated GAM RNA, also designated SEQ ID:287.

Another function of GAM44 is therefore inhibition of FLJ11730 (Accession NP_073593.1). Accordingly, utilities of GAM44 include diagnosis, prevention and treatment of diseases and clinical conditions associated with FLJ11730.

FLJ11871 (Accession NP_079393.1) is another GAM44 target gene, herein designated TARGET GENE. FLJ11871 BINDING SITE is a target binding site found in the 3' untranslated region of mRNA encoded by FLJ11871, corresponding to a target binding site such as BINDING SITE I, BINDING SITE II or BINDING SITE III of FIG. 8. Table 4 illustrates the complementarity of the nucleotide sequences of FLJ11871 BINDING SITE, designated SEQ ID:18221, to the nucleotide sequence of GAM44 RNA, herein designated GAM RNA, also designated SEQ ID:287.

Another function of GAM44 is therefore inhibition of FLJ11871 (Accession NP_079393.1). Accordingly, utilities of GAM44 include diagnosis, prevention and treatment of diseases and clinical conditions associated with FLJ11871.

FLJ12425 (Accession XP_098290.1) is another GAM44 target gene, herein designated TARGET GENE. FLJ12425 BINDING SITE is a target binding site found in the 3' untranslated region of mRNA encoded by FLJ12425, corresponding to a target binding site such as BINDING SITE I, BINDING SITE II or BINDING SITE III of FIG. 8. Table 4 illustrates the complementarity of the nucleotide sequences of FLJ12425 BINDING SITE, designated SEQ ID:7079, to the nucleotide sequence of GAM44 RNA, herein designated GAM RNA, also designated SEQ ID:287.

Another function of GAM44 is therefore inhibition of FLJ12425 (Accession XP_098290.1). Accordingly, utilities of GAM44 include diagnosis, prevention and treatment of diseases and clinical conditions associated with FLJ12425.

FLJ12529 (Accession NP_079087.2) is another GAM44 target gene, herein designated TARGET GENE. FLJ12529 BINDING SITE is a target binding site found in the 3' untranslated region of mRNA encoded by FLJ12529, corresponding to a target binding site such as BINDING SITE I, BINDING SITE II or BINDING SITE III of FIG. 8. Table 4 illustrates the complementarity of the nucleotide sequences of FLJ12529 BINDING SITE, designated SEQ ID:17806, to the nucleotide sequence of GAM44 RNA, herein designated GAM RNA, also designated SEQ ID:287.

Another function of GAM44 is therefore inhibition of FLJ12529 (Accession NP_079087.2). Accordingly, utilities of GAM44 include diagnosis, prevention and treatment of diseases and clinical conditions associated with FLJ12529.

FLJ13089 (Accession NP_079229.1) is another GAM44 target gene, herein designated TARGET GENE. FLJ13089 BINDING SITE is a target binding site found in the 3' untranslated region of mRNA encoded by FLJ13089, corresponding to a target binding site such as BINDING SITE I, BINDING SITE II or BINDING SITE III of FIG. 8. Table 4 illustrates the complementarity of the nucleotide sequences of FLJ13089 BINDING SITE, designated SEQ ID:10552, to the nucleotide sequence of GAM44 RNA, herein designated GAM RNA, also designated SEQ ID:287.

Another function of GAM44 is therefore inhibition of FLJ13089 (Accession NP_079229.1). Accordingly, utilities of GAM44 include diagnosis, prevention and treatment of diseases and clinical conditions associated with FLJ13089.

FLJ13848 (Accession NP_079047.1) is another GAM44 target gene, herein designated TARGET GENE. FLJ13848 BINDING SITE is a target binding site found in the 3' untranslated region of mRNA encoded by FLJ13848, corresponding to a target binding site such as BINDING SITE I, BINDING SITE II or BINDING SITE III of FIG. 8. Table 4 illustrates the complementarity of the nucleotide sequences of FLJ13848 BINDING SITE, designated SEQ ID:19252, to the nucleotide sequence of GAM44 RNA, herein designated GAM RNA, also designated SEQ ID:287.

Another function of GAM44 is therefore inhibition of FLJ13848 (Accession NP_079047.1). Accordingly, utilities of GAM44 include diagnosis, prevention and treatment of diseases and clinical conditions associated with FLJ13848.

FLJ14721 (Accession NP_116218.1) is another GAM44 target gene, herein designated TARGET GENE. FLJ14721 BINDING SITE is a target binding site found in the 3' untranslated region of mRNA encoded by FLJ14721, corresponding to a target binding site such as BINDING SITE I, BINDING SITE II or BINDING SITE III of FIG. 8. Table 4 illustrates the complementarity of the nucleotide sequences of FLJ14721 BINDING SITE, designated SEQ ID:14879, to the nucleotide sequence of GAM44 RNA, herein designated GAM RNA, also designated SEQ ID:287.

Another function of GAM44 is therefore inhibition of FLJ14721 (Accession NP_116218.1). Accordingly, utilities of GAM44 include diagnosis, prevention and treatment of diseases and clinical conditions associated with FLJ14721.

FLJ20856 (Accession NP_079419.1) is another GAM44 target gene, herein designated TARGET GENE. FLJ20856 BINDING SITE is a target binding site found in the 5' untranslated region of mRNA encoded by FLJ20856, corresponding to a target binding site such as BINDING SITE I, BINDING SITE II or BINDING SITE III of FIG. 8. Table 4 illustrates the complementarity of the nucleotide sequences of FLJ20856 BINDING SITE, designated SEQ ID:3537, to the nucleotide sequence of GAM44 RNA, herein designated GAM RNA, also designated SEQ ID:287.

Another function of GAM44 is therefore inhibition of FLJ20856 (Accession NP_079419.1). Accordingly, utilities of GAM44 include diagnosis, prevention and treatment of diseases and clinical conditions associated with FLJ20856.

FLJ21156 (Accession NP_078878.1) is another GAM44 target gene, herein designated TARGET GENE. FLJ21156 BINDING SITE is a target binding site found in the 3' untranslated region of mRNA encoded by FLJ21156, corresponding to a target binding site such as BINDING SITE I, BINDING SITE II or BINDING SITE III of FIG. 8. Table 4 illustrates the complementarity of the nucleotide sequences of FLJ21156 BINDING SITE, designated SEQ ID:485, to the nucleotide sequence of GAM44 RNA, herein designated GAM RNA, also designated SEQ ID:287.

Another function of GAM44 is therefore inhibition of FLJ21156 (Accession NP_078878.1). Accordingly, utilities of GAM44 include diagnosis, prevention and treatment of diseases and clinical conditions associated with FLJ21156.

FLJ23518 (Accession NP_079001.2) is another GAM44 target gene, herein designated TARGET GENE. FLJ23518 BINDING SITE is a target binding site found in the 3' untranslated region of mRNA encoded by FLJ23518, corresponding to a target binding site such as BINDING SITE I, BINDING SITE II or BINDING SITE III of FIG. 8. Table 4 illustrates the complementarity of the nucleotide sequences of FLJ23518 BINDING SITE, designated SEQ ID:11473, to the nucleotide sequence of GAM44 RNA, herein designated GAM RNA, also designated SEQ ID:287.

Another function of GAM44 is therefore inhibition of FLJ23518 (Accession NP_079001.2). Accordingly, utilities of GAM44 include diagnosis, prevention and treatment of diseases and clinical conditions associated with FLJ23518.

FLJ25534 (Accession NP_694966.2) is another GAM44 target gene, herein designated TARGET GENE. FLJ25534 BINDING SITE is a target binding site found in the 3' untranslated region of mRNA encoded by FLJ25534, corresponding to a target binding site such as BINDING SITE I, BINDING SITE II or BINDING SITE III of FIG. 8. Table 4 illustrates the complementarity of the nucleotide sequences of FLJ25534 BINDING SITE, designated SEQ ID:1034, to the nucleotide sequence of GAM44 RNA, herein designated GAM RNA, also designated SEQ ID:287.

Another function of GAM44 is therefore inhibition of FLJ25534 (Accession NP_694966.2). Accordingly, utilities of GAM44 include diagnosis, prevention and treatment of diseases and clinical conditions associated with FLJ25534.

FLJ30532 (Accession NP_653325.1) is another GAM44 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:1559, to the nucleotide sequence of GAM44 RNA, herein designated GAM RNA, also designated SEQ ID:287.

Another function of GAM44 is therefore inhibition of FLJ30532 (Accession NP_653325.1). Accordingly, utilities of GAM44 include diagnosis, prevention and treatment of diseases and clinical conditions associated with FLJ30532.

FLJ32069 (Accession NP_694578.1) is another GAM44 target gene, herein designated TARGET GENE. FLJ32069 BINDING SITE is a target binding site found in the 3' untranslated region of mRNA encoded by FLJ32069, corresponding to a target binding site such as BINDING SITE I, BINDING SITE II or BINDING SITE III of FIG. 8. Table 4 illustrates the complementarity of the nucleotide sequences of FLJ32069 BINDING SITE, designated SEQ ID:19969, to the nucleotide sequence of GAM44 RNA, herein designated GAM RNA, also designated SEQ ID:287.

Another function of GAM44 is therefore inhibition of FLJ32069 (Accession NP_694578.1). Accordingly, utilities of GAM44 include diagnosis, prevention and treatment of diseases and clinical conditions associated with FLJ32069.

FLJ32312 (Accession NP_653310.1) is another GAM44 target gene, herein designated TARGET GENE. FLJ32312 BINDING SITE is a target binding site found in the 3' untranslated region of mRNA encoded by FLJ32312, corresponding to a target binding site such as BINDING SITE I, BINDING SITE II or BINDING SITE III of FIG. 8. Table 4 illustrates the complementarity of the nucleotide sequences of FLJ32312 BINDING SITE, designated SEQ ID:6992, to the nucleotide sequence of GAM44 RNA, herein designated GAM RNA, also designated SEQ ID:287.

Another function of GAM44 is therefore inhibition of FLJ32312 (Accession NP_653310.1). Accordingly, utilities of GAM44 include diagnosis, prevention and treatment of diseases and clinical conditions associated with FLJ32312.

FLJ34047 (Accession NP_775940.1) is another GAM44 target gene, herein designated TARGET GENE. FLJ34047 BINDING SITE is a target binding site found in the 3' untranslated region of mRNA encoded by FLJ34047, corresponding to a target binding site such as BINDING SITE I, BINDING SITE II or BINDING SITE III of FIG. 8. Table 4 illustrates the complementarity of the nucleotide sequences of FLJ34047 BINDING SITE, designated SEQ ID:5426, to the nucleotide sequence of GAM44 RNA, herein designated GAM RNA, also designated SEQ ID:287.

Another function of GAM44 is therefore inhibition of FLJ34047 (Accession NP_775940.1). Accordingly, utilities of GAM44 include diagnosis, prevention and treatment of diseases and clinical conditions associated with FLJ34047.

FLJ39639 (Accession XP_290687.1) is another GAM44 target gene, herein designated TARGET GENE. FLJ39639 BINDING SITE is a target binding site found in the 3' untranslated region of mRNA encoded by FLJ39639, corresponding to a target binding site such as BINDING SITE I, BINDING SITE II or BINDING SITE III of FIG. 8. Table 4 illustrates the complementarity of the nucleotide sequences of FLJ39639 BINDING SITE, designated SEQ ID:7460, to the nucleotide sequence of GAM44 RNA, herein designated GAM RNA, also designated SEQ ID:287.

Another function of GAM44 is therefore inhibition of FLJ39639 (Accession XP_290687.1). Accordingly, utilities of GAM44 include diagnosis, prevention and treatment of diseases and clinical conditions associated with FLJ39639.

FLJ40288 (Accession NP_775953.1) is another GAM44 target gene, herein designated TARGET GENE. FLJ40288 BINDING SITE is a target binding site found in the 3' untranslated region of mRNA encoded by FLJ40288, corresponding to a target binding site such as BINDING SITE I, BINDING SITE II or BINDING SITE III of FIG. 8. Table 4 illustrates the complementarity of the nucleotide sequences of FLJ40288 BINDING SITE, designated SEQ ID:15256, to the nucleotide sequence of GAM44 RNA, herein designated GAM RNA, also designated SEQ ID:287.

Another function of GAM44 is therefore inhibition of FLJ40288 (Accession NP_775953.1). Accordingly, utilities of GAM44 include diagnosis, prevention and treatment of diseases and clinical conditions associated with FLJ40288.

Formin binding protein 4 (FNBP4, Accession NP_056123.1) is another GAM44 target gene, herein designated TARGET GENE. FNBP4 BINDING SITE is a target binding site found in the 3' untranslated region of mRNA encoded by FNBP4, corresponding to a target binding site such as BINDING SITE I, BINDING SITE II or BINDING SITE III of FIG. 8. Table 4 illustrates the complementarity of the nucleotide sequences of FNBP4 BINDING SITE, designated SEQ ID:13556, to the nucleotide sequence of GAM44 RNA, herein designated GAM RNA, also designated SEQ ID:287.

Another function of GAM44 is therefore inhibition of Formin binding protein 4 (FNBP4, Accession NP_056123.1). Accordingly, utilities of GAM44 include diagnosis, prevention and treatment of diseases and clinical conditions associated with FNBP4.

GAS8 (Accession NP_001472.1) is another GAM44 target gene, herein designated TARGET GENE. GAS8 BINDING SITE is a target binding site found in the 3' untranslated region of mRNA encoded by GAS8, corresponding to a target binding site such as BINDING SITE I, BINDING SITE II or BINDING SITE III of FIG. 8. Table 4 illustrates the complementarity of the nucleotide sequences of GAS8 BINDING SITE, designated SEQ ID:6978, to the nucleotide sequence of GAM44 RNA, herein designated GAM RNA, also designated SEQ ID:287.

Another function of GAM44 is therefore inhibition of GAS8 (Accession NP_001472.1). Accordingly, utilities of GAM44 include diagnosis, prevention and treatment of diseases and clinical conditions associated with GAS8.

Gata binding protein 2 (GATA2, Accession NP_116027.2) is another GAM44 target gene, herein designated TARGET GENE. GATA2 BINDING SITE is a target binding site found in the 3' untranslated region of mRNA encoded by GATA2, corresponding to a target binding site such as BINDING SITE I, BINDING SITE II or BINDING SITE III of FIG. 8. Table 4 illustrates the complementarity of the nucleotide sequences of GATA2 BINDING SITE, designated SEQ ID:2059, to the nucleotide sequence of GAM44 RNA, herein designated GAM RNA, also designated SEQ ID:287.

Another function of GAM44 is therefore inhibition of Gata binding protein 2 (GATA2, Accession NP_116027.2).

Accordingly, utilities of GAM44 include diagnosis, prevention and treatment of diseases and clinical conditions associated with GATA2.

Glycosylphosphatidylinositol specific phospholipase d1 (GPLD1, Accession NP_001494.2) is another GAM44 target gene, herein designated TARGET GENE. GPLD1 BINDING SITE is a target binding site found in the 3' untranslated region of multiple transcripts of mRNA encoded by GPLD1, corresponding to a target binding site such as BINDING SITE I, BINDING SITE II or BINDING SITE III of FIG. 8. Table 4 illustrates the complementarity of the nucleotide sequences of GPLD1 BINDING SITE, designated SEQ ID:17577, to the nucleotide sequence of GAM44 RNA, herein designated GAM RNA, also designated SEQ ID:287.

Another function of GAM44 is therefore inhibition of Glycosylphosphatidylinositol specific phospholipase d1 (GPLD1, Accession NP_001494.2), a gene which hydrolyses the inositol phosphate linkage in proteins anchored by phosphatidylinositol glycans to release these proteins from the membrane. Accordingly, utilities of GAM44 include diagnosis, prevention and treatment of diseases and clinical conditions associated with GPLD1.

The function of GPLD1 has been established by previous studies. Many proteins are attached to the plasma membrane via a glycosylphosphatidylinositol (GPI) anchor. Phosphatidylinositol-glycan (PIG)-specific phospholipases D (PLDs) selectively hydrolyze the inositol phosphate linkage, allowing release of the protein. Scallon et al. (1991) cloned a cDNA encoding a PIGPLD from a bovine liver cDNA library. The deduced amino acid sequence contains 4 regions of internal homology that are similar to the metal ion binding domains of integrin alpha subunits (see OMIM Ref. No. ITGA2, 192974). Bovine PIGPLD does not exhibit phosphatidylcholine-specific PLD (OMIM Ref. No. 602382) activity. By PCR and screening of a human liver cDNA library, Tsang et al. (1992) isolated a cDNA (OMIM Ref. No. L11701) encoding a PIGPLD. The protein product contains 841 amino acids, including a 24-residue signal sequence. Tsang et al. (1992) isolated a cDNA (OMIM Ref. No. L11702) encoding a related but distinct PIGPLD from a human pancreas cDNA library. The pancreas-derived PIGPLD contains 840 amino acids, including a 23-residue signal sequence. Schofield and Rademacher (2000) determined that the GPLD1 gene contains 25 exons and spans at least 80 kb. Northern blot analysis revealed expression of 5.8-kb transcript that was restricted to liver. Southern blot analysis indicated that GPLD1 is a single-copy gene.

Full details of the abovementioned studies are described in the following publications, the disclosure of which are hereby incorporated by reference:

Schofield, J. N.; Rademacher, T. W.: Structure and expression of the human glycosylphosphatidylinositol phospholipase D1 (GPLD1) gene. Biochim. Biophys. Acta 1494:189-194, 2000; and Tsang, T. C.; Fung, W.-J.; Levine, J.; Metz, C. N.; Davitz, M. A.; Burns, D. K.; Huang, K.-S.; Kochan, J. P.: Isolation and expression of two human glycosylphosphatidylinositol phospho.

Further studies establishing the function and utilities of GPLD1 are found in John Hopkins OMIM database record ID 602515, and in cited publications listed in Table 5, which are hereby incorporated by reference. G protein-coupled receptor 68 (GPR68, Accession NP_003476.1) is another GAM44target gene, herein designated TARGET GENE. GPR68 BINDING SITE is a target binding site found in the 5' untranslated region of mRNA encoded by GPR68, corresponding to a target binding site such as BINDING SITE I, BINDING SITE II or BINDING SITE III of FIG. 8. Table 4 illustrates the complementarity of the nucleotide sequences of GPR68 BINDING SITE, designated SEQ ID:4765, to the nucleotide sequence of GAM44 RNA, herein designated GAM RNA, also designated SEQ ID:287.

Another function of GAM44 is therefore inhibition of G protein-coupled receptor 68 (GPR68, Accession NP_003476.1). Accordingly, utilities of GAM44 include diagnosis, prevention and treatment of diseases and clinical conditions associated with GPR68.

G protein-coupled receptor 77 (GPR77, Accession NP_060955.1) is another GAM44 target gene, herein designated TARGET GENE. GPR77 BINDING SITE is a target binding site found in the 5' untranslated region of mRNA encoded by GPR77, corresponding to a target binding site such as BINDING SITE I, BINDING SITE II or BINDING SITE III of FIG. 8. Table 4 illustrates the complementarity of the nucleotide sequences of GPR77 BINDING SITE, designated SEQ ID:2326, to the nucleotide sequence of GAM44 RNA, herein designated GAM RNA, also designated SEQ ID:287.

Another function of GAM44 is therefore inhibition of G protein-coupled receptor 77 (GPR77, Accession NP_060955.1). Accordingly, utilities of GAM44 include diagnosis, prevention and treatment of diseases and clinical conditions associated with GPR77.

GW112 (Accession NP_006409.2) is another GAM44 target gene, herein designated TARGET GENE. GW112 BINDING SITE is a target binding site found in the 5' untranslated region of mRNA encoded by GW112, corresponding to a target binding site such as BINDING SITE I, BINDING SITE II or BINDING SITE III of FIG. 8. Table 4 illustrates the complementarity of the nucleotide sequences of GW112 BINDING SITE, designated SEQ ID:17202, to the nucleotide sequence of GAM44 RNA, herein designated GAM RNA, also designated SEQ ID:287.

Another function of GAM44 is therefore inhibition of GW112 (Accession NP_006409.2). Accordingly, utilities of GAM44 include diagnosis, prevention and treatment of diseases and clinical conditions associated with GW112.

Hepatitis a virus cellular receptor 1 (HAVCR1, Accession NP_036338.1) is another GAM44 target gene, herein designated TARGET GENE. HAVCR1 BINDING SITE is a target binding site found in the 3' untranslated region of mRNA encoded by HAVCR1, corresponding to a target binding site such as BINDING SITE I, BINDING SITE II or BINDING SITE III of FIG. 8. Table 4 illustrates the complementarity of the nucleotide sequences of HAVCR1 BINDING SITE, designated SEQ ID:1838, to the nucleotide sequence of GAM44 RNA, herein designated GAM RNA, also designated SEQ ID:287.

Another function of GAM44 is therefore inhibition of Hepatitis a virus cellular receptor 1 (HAVCR1, Accession NP_036338.1). Accordingly, utilities of GAM44 include diagnosis, prevention and treatment of diseases and clinical conditions associated with HAVCR1.

Homeo box b7 (HOXB7, Accession NP_004493.2) is another GAM44 target gene, herein designated TARGET GENE. HOXB7 BINDING SITE is a target binding site found in the 3' untranslated region of mRNA encoded by HOXB7, corresponding to a target binding site such as BINDING SITE I, BINDING SITE II or BINDING SITE III of FIG. 8. Table 4 illustrates the complementarity of the nucleotide sequences of HOXB7 BINDING SITE, designated SEQ ID:14802, to the nucleotide sequence of GAM44 RNA, herein designated GAM RNA, also designated SEQ ID:287.

Another function of GAM44 is therefore inhibition of Homeo box b7 (HOXB7, Accession NP_004493.2), a gene which is a member of homeodomain family of DNA binding proteins; may regulate gene expression, morphogenesis, and differentiation. Accordingly, utilities of GAM44 include diagnosis, prevention and treatment of diseases and clinical conditions associated with HOXB7.

The function of HOXB7 has been established by previous studies. In mouse, Hoxb7 expression is confined to macrophages. Using RT-PCR, Lill et al. (1995) detected expression of HOXB7 in monocytes differentiated from HL60 cells by stimulation with vitamin D3. Overexpression of HOXB7 inhibited differentiation into granulocytes but not monocytes. However, RT-PCR analysis failed to detect HOXB7 expression in mature monocytes. HOX proteins have a conserved DNA-binding homeodomain, a pentapeptide motif that mediates interactions with PBX proteins (e.g., PBX1; 176310), and an N-terminal octapeptide motif. Yaron et al. (2001) found that wildtype HOXB7 inhibited differentiation of a murine myelomonocytic cell line, 32D, but that mutations in any of the conserved regions blocked this inhibitory effect. Mutations in casein kinase phosphorylation sites, the glutamate-rich C terminus, or the N-terminal 14 residues of HOXB7 enhanced 32D differentiation.

Full details of the abovementioned studies are described in the following publications, the disclosure of which are hereby incorporated by reference:

Lill, M. C.; Fuller, J. F.; Herzig, R.; Crooks, G. M.; Gasson, J. C.: The role of the homeobox gene, HOX B7, in human myelomonocytic differentiation. Blood 85:692-697, 1995; and Yaron, Y.; McAdara, J. K.; Lynch, M.; Hughes, E.; Gasson, J. C.: Identification of novel functional regions important for the activity of HOXB7 in mammalian cells. J. Immun. 166: 5058-5.

Further studies establishing the function and utilities of HOXB7 are found in John Hopkins OMIM database record ID 142962, and in cited publications listed in Table 5, which are hereby incorporated by reference. Hermansky-pudlak syndrome 3 (HPS3, Accession NP_115759.2) is another GAM44target gene, herein designated TARGET GENE. HPS3 BINDING SITE is a target binding site found in the 3' untranslated region of mRNA encoded by HPS3, corresponding to a target binding site such as BINDING SITE I, BINDING SITE II or BINDING SITE III of FIG. 8. Table 4 illustrates the complementarity of the nucleotide sequences of HPS3 BINDING SITE, designated SEQ ID:10776, to the nucleotide sequence of GAM44 RNA, herein designated GAM RNA, also designated SEQ ID:287.

Another function of GAM44 is therefore inhibition of Hermansky-pudlak syndrome 3 (HPS3, Accession NP_115759.2). Accordingly, utilities of GAM44 include diagnosis, prevention and treatment of diseases and clinical conditions associated with HPS3.

HSPC133 (Accession NP_054887.1) is another GAM44 target gene, herein designated TARGET GENE. HSPC133 BINDING SITE is a target binding site found in the 3' untranslated region of mRNA encoded by HSPC133, corresponding to a target binding site such as BINDING SITE I, BINDING SITE II or BINDING SITE III of FIG. 8. Table 4 illustrates the complementarity of the nucleotide sequences of HSPC133 BINDING SITE, designated SEQ ID:19037, to the nucleotide sequence of GAM44 RNA, herein designated GAM RNA, also designated SEQ ID:287.

Another function of GAM44 is therefore inhibition of HSPC133 (Accession NP_054887.1). Accordingly, utilities of GAM44 include diagnosis, prevention and treatment of diseases and clinical conditions associated with HSPC133.

HT001 (Accession NP_054784.1) is another GAM44 target gene, herein designated TARGET GENE. HT001 BINDING SITE is a target binding site found in the 5' untranslated region of mRNA encoded by HT001, corresponding to a target binding site such as BINDING SITE I, BINDING SITE II or BINDING SITE III of FIG. 8. Table 4 illustrates the complementarity of the nucleotide sequences of HT001 BINDING SITE, designated SEQ ID:2559, to the nucleotide sequence of GAM44 RNA, herein designated GAM RNA, also designated SEQ ID:287.

Another function of GAM44 is therefore inhibition of HT001 (Accession NP_054784.1). Accordingly, utilities of GAM44 include diagnosis, prevention and treatment of diseases and clinical conditions associated with HT001.

ICK (Accession NP_057597.2) is another GAM44 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:4546, to the nucleotide sequence of GAM44 RNA, herein designated GAM RNA, also designated SEQ ID:287.

Another function of GAM44 is therefore inhibition of ICK (Accession NP_057597.2). Accordingly, utilities of GAM44 include diagnosis, prevention and treatment of diseases and clinical conditions associated with ICK.

ICK (Accession NP_055735.1) is another GAM44 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:4546, to the nucleotide sequence of GAM44 RNA, herein designated GAM RNA, also designated SEQ ID:287.

Another function of GAM44 is therefore inhibition of ICK (Accession NP_055735.1). Accordingly, utilities of GAM44 include diagnosis, prevention and treatment of diseases and clinical conditions associated with ICK.

Insulin-like growth factor 2 receptor (IGF2R, Accession NP_000867.1) is another GAM44 target gene, herein designated TARGET GENE. IGF2R BINDING SITE is a target binding site found in the 3' untranslated region of mRNA encoded by IGF2R, corresponding to a target binding site such as BINDING SITE I, BINDING SITE II or BINDING SITE III of FIG. 8. Table 4 illustrates the complementarity of the nucleotide sequences of IGF2R BINDING SITE, designated SEQ ID:11950, to the nucleotide sequence of GAM44 RNA, herein designated GAM RNA, also designated SEQ ID:287.

Another function of GAM44 is therefore inhibition of Insulin-like growth factor 2 receptor (IGF2R, Accession NP_000867.1), a gene which transport of phosphorylated lysosomal enzymes from the golgi complex and the cell surface to lysosomes. lysosomal enzymes bearing phosphomannosyl residues bind specifically to mannose-6-phosphate receptors in the golgi apparatus and the resulting receptor-ligand complex is transported to an acidic prelyosomal compartment where the low ph mediates the dissociation of the complex. this receptor also binds insulin growth factor ii. and therefore may be associated with Hepatocellular carcinoma, somatic. Accordingly, utilities of GAM44 include diagnosis, prevention and treatment of Hepatocellular carcinoma, somatic, and of other diseases and clinical conditions associated with IGF2R.

The function of IGF2R has been established by previous studies. The mannose 6-phosphate/insulin-like growth factor II receptor functions in the intracellular trafficking of lysosomal enzymes, the activation of the potent growth inhibitor, transforming growth factor beta, and the degradation of IGF2, a mitogen often overproduced in tumors. De Souza et al. (1995) demonstrated that 70% of human hepatocellular tumors have loss of heterozygosity (LOH) at the M6P/IGF2R locus at 6q26. In a separate report, De Souza et al. (1995) described a mutation screen that identified point mutations in the remaining allele of 25% of human hepatocellular carcinomas with LOH. One mutation created an alternative splice site within an intron (corresponding to intron 40 in mouse) and resulted in a truncated receptor; 2 others (147280.0001, 147280.0002) gave rise to significant amino acid substitutions. These mutations provided evidence to the authors that the M6P/IGF2R gene functions as a tumor suppressor in human liver carcinogenesis. Souza et al. (1996) reported that the IGF2R gene contains a number of microsatellite repeats within its coding sequence. They demonstrated microsatellite instability in this gene in 12 of 92 gastrointestinal tumors studied which were replication/repair error-positive. Mutations occurred in 6 of the poorly differentiated tumors. They noted an anticorrespondence of IGF2R and TGFBR2 (OMIM Ref. No. 190182) mutations. Of 31 gastrointestinal lesions studied with IGF2R or TGFBR2 mutations, 90% (28) contained mutations in one or the other, but not both, of these genes. Souza et al. (1996) demonstrated that all but 1 of the mutations occurred within an 8-polydeoxyguanine tract spanning nucleotides 4089-4096 of the IGF2R coding sequence. In 1 case of gastric adenocarcinoma, mutation occurred in a polyCT tract spanning nucleotides 6169-6180. These mutations all comprised 1 -or 2-bp deletions or insertions within the microsatellite region, causing frameshifts and premature stop codons downstream. Souza et al. (1996) noted that the TGFBR2 gene is also subject to microsatellite instability within its coding region. They noted further that IGF2R and TGFBR2 genes comprise Ser. points in the same tumorigenesis pathway, since mutation of either gene alone occurred in 90% of the gastrointestinal tumors that they analyzed. To facilitate genetic analyses of the imprint status of human M6P/IGF2R and loss of heterozygosity at this locus in cancer, Killian et al. (2001) screened American and Japanese populations for M6P/IGF2R single nucleotide polymorphisms (SNPs). They identified 9 novel intragenic SNPs and 3 amino acid variants in the ligand-binding domains of M6P/IGF2R that may be under selection in humans Animal model experiments lend further support to the function of IGF2R. To determine whether paternal expression of the Igf2r gene is necessary for early development in the mouse, Lau et al. (1994) derived mice in which the gene had been disrupted by targeted mutagenesis in embryonic stem (ES) cells with the subsequent introduction of the mutation into the germline of mice. Lau et al. (1994) found that murine embryos that inherit a nonfunctional Igf2r gene from their father are viable and develop normally into adults; however, most mice inheriting the same mutated allele from their mothers die around the time of birth as a consequence of major cardiac abnormalities. The mice that inherit the mutant allele from their mothers do not express Igf2r in their tissues, are 25 to 30% larger than their normal sibs, have elevated levels of circulating IGF2 and IGF-binding proteins, and exhibit a slight kink in the tail. The findings of overgrowth may support the suggestion that relaxation of maternal imprinting of IGF2 plays a role in the features of Beckwith-Wiedemann syndrome (OMIM Ref. No. 130650) (Feinberg, 1993).

It is appreciated that the abovementioned animal model for IGF2R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lau, M. M. H.; Stewart, C. E. H.; Liu, Z.; Bhatt, H.; Rotwein, P.; Stewart, C. L. : Loss of the imprinted IGF2/cation-independent mannose 6-phosphate receptor results in fetal overgrowth and perinatal lethality. Genes Dev. 8:2953-2963, 1994; and Sleutels, F.; Zwart, R.; Barlow, D. P.: The non-coding Air RNA is required for silencing autosomal imprinted genes. Nature 415:810-813, 2002.

Further studies establishing the function and utilities of IGF2R are found in John Hopkins OMIM database record ID 147280, and in cited publications listed in Table 5, which are hereby incorporated by reference. Interleukin 28 receptor, alpha (IL28RA, Accession NP_775088.1) is another GAM44 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:3043, to the nucleotide sequence of GAM44 RNA, herein designated GAM RNA, also designated SEQ ID:287.

Another function of GAM44 is therefore inhibition of Interleukin 28 receptor, alpha (IL28RA, Accession NP_775088.1). Accordingly, utilities of GAM44 include diagnosis, prevention and treatment of diseases and clinical conditions associated with IL28RA.

IMMP2L (Accession NP_115938.1) is another GAM44 target gene, herein designated TARGET GENE. IMMP2L BINDING SITE is a target binding site found in the 3' untranslated region of mRNA encoded by IMMP2L, corresponding to a target binding site such as BINDING SITE I, BINDING SITE II or BINDING SITE III of FIG. 8. Table 4 illustrates the complementarity of the nucleotide sequences of IMMP2L BINDING SITE, designated SEQ ID:2346, to the nucleotide sequence of GAM44 RNA, herein designated GAM RNA, also designated SEQ ID:287.

Another function of GAM44 is therefore inhibition of IMMP2L (Accession NP_115938.1), a gene which is a HOMOLOG of YEAST INNER MITOCHONDRIAL MEMBRANE PEPTIDASE and therefore may be associated with Tourette syndrome. Accordingly, utilities of GAM44 include diagnosis, prevention and treatment of Tourette syndrome, and of other diseases and clinical conditions associated with IMMP2L.

The function of IMMP2L has been established by previous studies. In a patient with Gilles de la Tourette syndrome (GTS; 137580) and a de novo duplication of a segment of the long arm of chromosome 7, Petek et al. (2001) found that a distal chromosomal breakpoint occurred between 2 markers that define a region previously shown to be disrupted in a case of GTS (Boghosian-Sell et al., 1996). By further study, Petek et al. (2001) found that a novel gene, which they designated IMMP2L, that encodes the homolog of the yeast inner mitochondrial membrane peptidase subunit-2 (Imp2) was disrupted by both the breakpoint in the duplicated fragment and the insertion site in 7q31. The 175-amino acid human IMMP2L protein is 41% identical to the yeast protein and 90% identical to the mouse protein. RT-PCR analysis detected IMMP2L expression in all tissues tested except adult liver and lung. The IMMP2L gene contains 6 exons and spans 860 kb Full details of the abovementioned studies are described in the following publications, the disclosure of which are hereby incorporated by reference:

Boghosian-Sell, L.; Comings, D. E.; Overhauser, J.: Tourette syndrome in a pedigree with a 7;18 translocation: identification of a YAC spanning the translocation breakpoint at 18q22.3. Am. J. Hum. Genet. 59:999-1005, 1996; and Petek, E.; Windpassinger, C.; Vincent, J. B.; Cheung, J.; Boright, A. P.; Scherer, S. W.; Kroisel, P. M.; Wagner, K.: Disruption of a novel gene (IMMP2L) by a breakpoint in 7q31 associ.

Further studies establishing the function and utilities of IMMP2L are found in John Hopkins OMIM database record ID 605977, and in cited publications listed in Table 5, which are hereby incorporated by reference. Inositol polyphosphate-5-phosphatase, 72 kda (INPP5E, Accession NP_063945.1) is another GAM44 target gene, herein designated TARGET GENE. INPP5E BINDING SITE is a target binding site found in the 3' untranslated region of mRNA encoded by INPP5E, corresponding to a target binding site such as BINDING SITE I, BINDING SITE II or BINDING SITE III of FIG. 8. Table 4 illustrates the complementarity of the nucleotide sequences of INPP5E BINDING SITE, designated SEQ ID:17360, to the nucleotide sequence of GAM44 RNA, herein designated GAM RNA, also designated SEQ ID:287.

Another function of GAM44 is therefore inhibition of Inositol polyphosphate-5-phosphatase, 72 kda (INPP5E, Accession NP_063945.1). Accordingly, utilities of GAM44 include diagnosis, prevention and treatment of diseases and clinical conditions associated with INPP5E.

Il2-inducible t-cell kinase (ITK, Accession NP_005537.3) is another GAM44 target gene, herein designated TARGET GENE. ITK BINDING SITE is a target binding site found in the 5' untranslated region of mRNA encoded by ITK, corresponding to a target binding site such as BINDING SITE I, BINDING SITE II or BINDING SITE III of FIG. 8. Table 4 illustrates the complementarity of the nucleotide sequences of ITK BINDING SITE, designated SEQ ID:1134, to the nucleotide sequence of GAM44 RNA, herein designated GAM RNA, also designated SEQ ID:287.

Another function of GAM44 is therefore inhibition of Il2-inducible t-cell kinase (ITK, Accession NP_005537.3), a gene which plays a role in t cell proliferation and differentiation. and therefore may be associated with Myelodysplastic syndrome. Accordingly, utilities of GAM44 include diagnosis, prevention and treatment of Myelodysplastic syndrome, and of other diseases and clinical conditions associated with ITK.

The function of ITK has been established by previous studies. Signal transduction through the T-cell receptor (TCR; OMIM Ref. No. 186880) and cytokine receptors on the surface of T lymphocytes occurs largely via tyrosine phosphorylation of intracellular substrates. Signal transduction is thought to occur via association of these receptors with intracellular protein tyrosine kinases. To identify unique T-cell tyrosine kinases, Gibson et al. (1993) used PCR-based cloning with degenerate oligonucleotides directed at highly conserved motifs of tyrosine kinase domains. In this way, they cloned the complete cDNA for a unique human tyrosine kinase that is expressed mainly in T lymphocytes and natural killer (NK) cells. The cDNA predicted an open reading frame of 1,866 bp encoding a protein with a predicted size of 72 kD, which was in keeping with its size on Western blotting. A single 6.2-kb mRNA and 72-kD protein were detected in T lymphocytes and NK-like cell lines, but were not detected in other cell lineages. Sequence comparisons suggested that the protein is probably the human homolog of a murine interleukin-2-inducible T-cell kinase (ITK). However, unlike ITK, the message and protein levels for the new entity did not vary markedly on stimulation of human IL-2 responsive T cells with IL-2. They referred to the gene and its protein product as EMT ('expressed mainly in T cells'). They concluded that EMT is a member of a new family of intracellular kinases that includes BPK (the kinase mutant in X-linked agammaglobulinemia, 300300). The expression of EMT message and protein in thymocytes and mature T cells, combined with its homology to BPK and its chromosomal localization, suggested that EMT may play a role in thymic ontogeny and growth regulation of mature T cells. Integrin adhesion receptors mediate critical interactions of T cells with other cells and extracellular matrix components during trafficking, as well as during antigen-specific recognition events in tissue. Phosphatidylinositol 3-kinase (PI3K; OMIM Ref. No. 601232) has a role in the regulation of integrin activity by CD3 (see OMIM Ref. No. 186790)-TCR and in the regulation of ITK. Woods et al. (2001) determined that TCR-mediated activation of beta-1 integrins (see OMIM Ref. No. ITGB1; 135630) requires activation of ITK and PI3K-dependent recruitment of ITK to detergent-insoluble glycosphingolipid-enriched microdomains (DIGs) via binding of the pleckstrin homology domain of ITK to the PI3K product PI(3,4,5)-P3. Likewise, activation of PI3K and LCK (OMIM Ref. No. 153390) via CD4 (OMIM Ref. No. 186940) coreceptor stimulation can initiate beta-1 integrin activation dependent on ITK function. CD4 stimulation, together with targeting of ITK to DIGs, also activates TCR-independent beta-1 integrin function. Changes in beta-1 integrin function mediated by TCR-induced activation of ITK are accompanied by ITK-dependent modulation of the actin cytoskeleton. Woods et al. (2001) concluded that TCR-mediated activation of beta-1 integrin involves membrane relocalization and activation of ITK via coordinate action of PI3K and an SRC family tyrosine kinase.

Animal model experiments lend further support to the function of ITK. By homologous recombination, Schaeffer et al. (1999) disrupted the Rlk (TXK; 600058) gene in mice. Heterozygotes were completely normal. Homozygous null Rlk mice showed increased amounts of Itk mRNA. The authors hypothesized that upregulation of related Tec kinases may partially compensate for the lack of Rlk. Schaeffer et al. (1999) therefore generated Rlk -/- Itk -/- mice by interbreeding. Itk-deficient mice have reduced numbers of mature T cells, particularly CD4+ cells, causing a decreased CD4- to - CD8 ratio. Rlk -/- Itk -/- mutants, however, had normal T cell numbers. Both CD4+ and CD8+ cell numbers are increased relative to Itk -/- mice. The persistent abnormal ratio of CD4+ to CD8+ cells suggested an altered regulation of lymphoid development and homeostasis in the double mutants. The double mutants had marked defects in T-cell receptor responses including proliferation, cytokine production, and apoptosis in vitro and adaptive immune responses to Toxoplasma gondii in vivo. Molecular events immediately downstream from the T-cell receptor were intact in Rlk -/- Itk -/- cells, but intermediate events including inositol trisphosphate production, calcium mobilization, and mitogen-activated protein kinase activation were impaired, establishing Tec kinases as critical regulators of T-cell receptor signaling required for phospholipase C-gamma activation.

It is appreciated that the abovementioned animal model for ITK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schaeffer, E. M.; Debnath, J.; Yap, G.; McVicar, D.; Liao, X. C.; Littman, D. R.; Sher, A.; Varmus, H. E.; Lenardo, M. J.; Schwartzberg, P. L.: Requirement for Tec kinases Rlk and Itk in T cell receptor signaling and immunity. Science 284:638-641, 1999; and Woods, M. L.; Kivens, W. J.; Adelsman, M. A.; Qiu, Y.; August, A.; Shimizu, Y.: A novel function for the Tec family tyrosine kinase Itk in activation of beta-1 integrins by the T-cell.

Further studies establishing the function and utilities of ITK are found in John Hopkins OMIM database record ID 186973, and in cited publications listed in Table 5, which are hereby incorporated by reference. KIAA0391 (Accession NP_055487.1) is another GAM44 target gene, herein designated TARGET GENE. KIAA0391 BINDING SITE is a target binding site found in the 5' untranslated region of mRNA encoded by KIAA0391, corresponding to a target binding site such as BINDING SITE I, BINDING SITE II or BINDING SITE III of FIG. 8. Table 4 illustrates the complementarity of the nucleotide sequences of KIAA0391 BINDING SITE, designated SEQ ID:728, to the nucleotide sequence of GAM44 RNA, herein designated GAM RNA, also designated SEQ ID:287.

Another function of GAM44 is therefore inhibition of KIAA0391 (Accession NP_055487.1). Accordingly, utilities of GAM44 include diagnosis, prevention and treatment of diseases and clinical conditions associated with KIAA0391.

KIAA0523 (Accession XP_041964.5) is another GAM44 target gene, herein designated TARGET GENE. KIAA0523 BINDING SITE is a target binding site found in the 3' untranslated region of mRNA encoded by KIAA0523, corresponding to a target binding site such as BINDING SITE I, BINDING SITE II or BINDING SITE III of FIG. 8. Table 4 illustrates the complementarity of the nucleotide sequences of KIAA0523 BINDING SITE, designated SEQ ID:2007, to the nucleotide sequence of GAM44 RNA, herein designated GAM RNA, also designated SEQ ID:287.

Another function of GAM44 is therefore inhibition of KIAA0523 (Accession XP_041964.5). Accordingly, utilities of GAM44 include diagnosis, prevention and treatment of diseases and clinical conditions associated with KIAA0523.

KIAA0789 (Accession XP_033113.1) is another GAM44 target gene, herein designated TARGET GENE. KIAA0789 BINDING SITE is a target binding site found in the 3' untranslated region of mRNA encoded by KIAA0789, corresponding to a target binding site such as BINDING SITE I, BINDING SITE II or BINDING SITE III of FIG. 8. Table 4 illustrates the complementarity of the nucleotide sequences of KIAA0789 BINDING SITE, designated SEQ ID:1640, to the nucleotide sequence of GAM44 RNA, herein designated GAM RNA, also designated SEQ ID:287.

Another function of GAM44 is therefore inhibition of KIAA0789 (Accession XP_033113.1). Accordingly, utilities of GAM44 include diagnosis, prevention and treatment of diseases and clinical conditions associated with KIAA0789.

KIAA0984 (Accession XP_037557.2) is another GAM44 target gene, herein designated TARGET GENE. KIAA0984 BINDING SITE is a target binding site found in the 3' untranslated region of mRNA encoded by KIAA0984, corresponding to a target binding site such as BINDING SITE I, BINDING SITE II or BINDING SITE III of FIG. 8. Table 4 illustrates the complementarity of the nucleotide sequences of KIAA0984 BINDING SITE, designated SEQ ID:12474, to the nucleotide sequence of GAM44 RNA, herein designated GAM RNA, also designated SEQ ID:287.

Another function of GAM44 is therefore inhibition of KIAA0984 (Accession XP_037557.2). Accordingly, utilities of GAM44 include diagnosis, prevention and treatment of diseases and clinical conditions associated with KIAA0984.

KIAA1332 (Accession XP_048774.2) is another GAM44 target gene, herein designated TARGET GENE. KIAA1332 BINDING SITE is a target binding site found in the 3' untranslated region of mRNA encoded by KIAA1332, corresponding to a target binding site such as BINDING SITE I, BINDING SITE II or BINDING SITE III of FIG. 8. Table 4 illustrates the complementarity of the nucleotide sequences of KIAA1332 BINDING SITE, designated SEQ ID:12318, to the nucleotide sequence of GAM44 RNA, herein designated GAM RNA, also designated SEQ ID:287.

Another function of GAM44 is therefore inhibition of KIAA1332 (Accession XP_048774.2). Accordingly, utilities of GAM44 include diagnosis, prevention and treatment of diseases and clinical conditions associated with KIAA1332.

KIAA1684 (Accession XP_290806.1) is another GAM44 target gene, herein designated TARGET GENE. KIAA1684 BINDING SITE is a target binding site found in the 3' untranslated region of mRNA encoded by KIAA1684, corresponding to a target binding site such as BINDING SITE I, BINDING SITE II or BINDING SITE III of FIG. 8. Table 4 illustrates the complementarity of the nucleotide sequences of KIAA1684 BINDING SITE, designated SEQ ID:12907, to the nucleotide sequence of GAM44 RNA, herein designated GAM RNA, also designated SEQ ID:287.

Another function of GAM44 is therefore inhibition of KIAA1684 (Accession XP_290806.1). Accordingly, utilities of GAM44 include diagnosis, prevention and treatment of diseases and clinical conditions associated with KIAA1684.

KIAA1720 (Accession NP_085148.1) is another GAM44 target gene, herein designated TARGET GENE. KIAA1720 BINDING SITE is a target binding site found in the 3' untranslated region of mRNA encoded by KIAA1720, corresponding to a target binding site such as BINDING SITE I, BINDING SITE II or BINDING SITE III of FIG. 8. Table 4 illustrates the complementarity of the nucleotide sequences of KIAA1720 BINDING SITE, designated SEQ ID:15787, to the nucleotide sequence of GAM44 RNA, herein designated GAM RNA, also designated SEQ ID:287.

Another function of GAM44 is therefore inhibition of KIAA1720 (Accession NP_085148.1). Accordingly, utilities of GAM44 include diagnosis, prevention and treatment of diseases and clinical conditions associated with KIAA1720.

KIAA1920 (Accession XP_085210.1) is another GAM44 target gene, herein designated TARGET GENE. KIAA1920 BINDING SITE is a target binding site found in the 5' untranslated region of mRNA encoded by KIAA1920, corresponding to a target binding site such as BINDING SITE I, BINDING SITE II or BINDING SITE III of FIG. 8. Table 4 illustrates the complementarity of the nucleotide sequences of KIAA1920 BINDING SITE, designated SEQ ID:8388, to the nucleotide sequence of GAM44 RNA, herein designated GAM RNA, also designated SEQ ID:287.

Another function of GAM44 is therefore inhibition of KIAA1920 (Accession XP_085210.1). Accordingly, utilities of GAM44 include diagnosis, prevention and treatment of diseases and clinical conditions associated with KIAA1920.

KIAA1946 (Accession NP_803237.1) is another GAM44 target gene, herein designated TARGET GENE. KIAA1946 BINDING SITE is a target binding site found in the 3' untranslated region of mRNA encoded by KIAA1946, corresponding to a target binding site such as BINDING SITE I, BINDING SITE II or BINDING SITE III of FIG. 8. Table 4 illustrates the complementarity of the nucleotide sequences of KIAA1946 BINDING SITE, designated SEQ ID:8568, to the nucleotide sequence of GAM44 RNA, herein designated GAM RNA, also designated SEQ ID:287.

Another function of GAM44 is therefore inhibition of KIAA1946 (Accession NP_803237.1). Accordingly, utilities of GAM44 include diagnosis, prevention and treatment of diseases and clinical conditions associated with KIAA1946.

Karyopherin alpha 6 (importin alpha 7) (KPNA6, Accession NP_036448.1) is another GAM44 target gene, herein designated TARGET GENE. KPNA6 BINDING SITE is a target binding site found in the 3' untranslated region of mRNA encoded by KPNA6, corresponding to a target binding site such as BINDING SITE I, BINDING SITE II or BINDING SITE III of FIG. 8. Table 4 illustrates the complementarity of the nucleotide sequences of KPNA6 BINDING SITE, designated SEQ ID:16094, to the nucleotide sequence of GAM44 RNA, herein designated GAM RNA, also designated SEQ ID:287.

Another function of GAM44 is therefore inhibition of Karyopherin alpha 6 (importin alpha 7) (KPNA6, Accession NP_036448.1) . Accordingly, utilities of GAM44 include diagnosis, prevention and treatment of diseases and clinical conditions associated with KPNA6.

Like-glycosyltransferase (LARGE, Accession NP_598397.1) is another GAM44 target gene, herein designated TARGET GENE. LARGE BINDING SITE is a target binding site found in the 3' untranslated region of multiple transcripts of mRNA encoded by LARGE, corresponding to a target binding site such as BINDING SITE I, BINDING SITE II or BINDING SITE III of FIG. 8. Table 4 illustrates the complementarity of the nucleotide sequences of LARGE BINDING SITE, designated SEQ ID:14179, to the nucleotide sequence of GAM44 RNA, herein designated GAM RNA, also designated SEQ ID:287.

Another function of GAM44 is therefore inhibition of Like-glycosyltransferase (LARGE, Accession NP_598397.1), a gene which is a member of the N- acetylglucosaminyltransferase family. Accordingly, utilities of GAM44 include diagnosis, prevention and treatment of diseases and clinical conditions associated with LARGE.

The function of LARGE has been established by previous studies. Peyrard et al. (1999) investigated the gene content of a segment of 22q12.3-q13.1 that had been shown to contain meningioma-related genes (OMIM Ref. No. 156100) on the basis of studies of deletions. They characterized a new member of the N-acetylglucosaminyltransferase gene family, which they designated the LARGE gene. The LARGE gene spans more than 664 kb of genomic DNA, making it the fifth largest in the human genome, after dystrophin (DMD; 300377), with 2.3 Mb; DCC (OMIM Ref. No. 120470), with 1.4 Mb; GRM8 (OMIM Ref. No. 601116), with 1 Mb; and utrophin (UTRN; 128240), with 900 kb. The LARGE gene contains 16 exons (4,326-bp cDNA) and has an exon content of less than 0.66%, which is similar to the exon content of the DMD gene (0.6%). The chromosomal segment of 22q containing the LARGE gene is apparently poor in genes. By fluorescence in situ hybridization, Peyrard et al. (1999) mapped the mouse Large gene to 8C1 in a region of conserved synteny with 22q12.3-q13.1. The expression pattern of the human and mouse LARGE orthologs is similar. Both genes are expressed ubiquitously, consistent with their function as housekeeping genes. These genes are also evolutionarily well conserved, as Peyrard et al. (1999) identified an ortholog in C. elegans encoding a polypeptide that is 33% identical with the human protein. Michele et al. (2002) demonstrated in both muscle-eye-brain disease (OMIM Ref. No. 253280) and Fukuyama congenital muscular dystrophy (FCMD; 253800) patients that alpha- dystroglycan is expressed at the muscle membrane, but similar hypoglycosylation in the diseases directly abolishes binding activity of dystroglycan for the ligands laminin (see OMIM Ref. No. 150240), neurexin (see OMIM Ref. No. 600565), and agrin (OMIM Ref. No. 103320). Michele et al. (2002) showed that this posttranslational biochemical and functional disruption of alpha-dystroglycan is recapitulated in the muscle and central nervous system of myd mice. Michele et al. (2002) demonstrated that myd mice have abnormal neuronal migration in the cerebral cortex, cerebellum, and hippocampus, and show disruption of the basal lamina. In addition, myd mice reveal that dystroglycan targets proteins to functional sites in brain through its interactions with extracellular matrix proteins. Michele et al. (2002) suggested that at least 3 mammalian genes function within a convergent posttranslational processing pathway during the biosynthesis of dystroglycan and that abnormal dystroglycan-ligand interactions underlie the pathogenic mechanism of muscular dystrophy with brain abnormalities.

Animal model experiments lend further support to the function of LARGE. Michele et al. (2002) demonstrated in both muscle-eye-brain disease (OMIM Ref. No. 253280) and Fukuyama congenital muscular dystrophy (FCMD; 253800) patients that alpha-dystroglycan is expressed at the muscle membrane, but similar hypoglycosylation in the diseases directly abolishes binding activity of dystroglycan for the ligands laminin (see OMIM Ref. No. 150240), neurexin (see OMIM Ref. No. 600565), and agrin (OMIM Ref. No. 103320). Michele et al. (2002) showed that this posttranslational biochemical and functional disruption of alpha-dystroglycan is recapitulated in the muscle and central nervous system of myd mice. Michele et al. (2002) demonstrated that myd mice have abnormal neuronal migration in the cerebral cortex, cerebellum, and hippocampus, and show disruption of the basal lamina. In addition, myd mice reveal that dystroglycan targets proteins to functional sites in brain through its interactions with extracellular matrix proteins. Michele et al. (2002) suggested that at least 3 mammalian genes function within a convergent posttranslational processing pathway during the biosynthesis of dystroglycan and that abnormal dystroglycan-ligand interactions underlie the pathogenic mechanism of muscular dystrophy with brain abnormalities.

It is appreciated that the abovementioned animal model for LARGE is acknowledged by those skilled in the art as a scientifically valid animal model, as can be further appreciated from the publications sited hereinbelow.

Full details of the abovementioned studies are described in the following publications, the disclosure of which are hereby incorporated by reference:

Grewal, P. K.; Holzfeind, P. J.; Bittner, R. E.; Hewitt, J. E.: Mutant glycosyltransferase and altered glycosylation of alpha-dystroglycan in the myodystrophy mouse. Nature Genet. 28:151-154, 2001; and Michele, D. E.; Barresi, R.; Kanagawa, M.; Saito, F.; Cohn, R. D.; Satz, J. S.; Dollar, J.; Nishino, I.; Kelley, R. I.; Somer, H.; Straub, V.; Mathews, K. D.; Moore, S. A.; Campbell, K.

Further studies establishing the function and utilities of LARGE are found in John Hopkins OMIM database record ID 603590, and in cited publications listed in Table 5, which are hereby incorporated by reference. Like-glycosyltransferase (LARGE, Accession NP_004728.1) is another GAM44 target gene, herein designated TARGET GENE. LARGE BINDING SITE is a target binding site found in the 3' untranslated region of multiple transcripts of mRNA encoded by LARGE, corresponding to a target binding site such as BINDING SITE I, BINDING SITE II or BINDING SITE III of FIG. 8. Table 4 illustrates the complementarity of the nucleotide sequences of LARGE BINDING SITE, designated SEQ ID:14179, to the nucleotide sequence of GAM44 RNA, herein designated GAM RNA, also designated SEQ ID:287.

Another function of GAM44 is therefore inhibition of Like-glycosyltransferase (LARGE, Accession NP_004728.1), a gene which is a member of the N- acetylglucosaminyltransferase family. Accordingly, utilities of GAM44 include diagnosis, prevention and treatment of diseases and clinical conditions associated with LARGE.

The function of LARGE has been established by previous studies. Peyrard et al. (1999) investigated the gene content of a segment of 22q12.3-q13.1 that had been shown to contain meningioma-related genes (OMIM Ref. No. 156100) on the basis of studies of deletions. They characterized a new member of the N-acetylglucosaminyltransferase gene family, which they designated the LARGE gene. The LARGE gene spans more than 664 kb of genomic DNA, making it the fifth largest in the human genome, after dystrophin (DMD; 300377), with 2.3 Mb; DCC (OMIM Ref. No. 120470), with 1.4 Mb; GRM8 (OMIM Ref. No. 601116), with 1 Mb; and utrophin (UTRN; 128240), with 900 kb. The LARGE gene contains 16 exons (4,326-bp cDNA) and has an exon content of less than 0.66%, which is similar to the exon content of the DMD gene (0.6%). The chromosomal segment of 22q containing the LARGE gene is apparently poor in genes. By fluorescence in situ hybridization, Peyrard et al. (1999) mapped the mouse Large gene to 8C1 in a region of conserved synteny with 22q12.3-q13.1. The expression pattern of the human and mouse LARGE orthologs is similar. Both genes are expressed ubiquitously, consistent with their function as housekeeping genes. These genes are also evolutionarily well conserved, as Peyrard et al. (1999) identified an ortholog in C. elegans encoding a polypeptide that is 33% identical with the human protein. Michele et al. (2002) demonstrated in both muscle-eye-brain disease (OMIM Ref. No. 253280) and Fukuyama congenital muscular dystrophy (FCMD; 253800) patients that alpha- dystroglycan is expressed at the muscle membrane, but similar hypoglycosylation in the diseases directly abolishes binding activity of dystroglycan for the ligands laminin (see OMIM Ref. No. 150240), neurexin (see OMIM Ref. No. 600565), and agrin (OMIM Ref. No. 103320). Michele et al. (2002) showed that this posttranslational biochemical and functional disruption of alpha-dystroglycan is recapitulated in the muscle and central nervous system of myd mice. Michele et al. (2002) demonstrated that myd mice have abnormal neuronal migration in the cerebral cortex, cerebellum, and hippocampus, and show disruption of the basal lamina. In addition, myd mice reveal that dystroglycan targets proteins to functional sites in brain through its interactions with extracellular matrix proteins. Michele et al. (2002) suggested that at least 3 mammalian genes function within a convergent posttranslational processing pathway during the biosynthesis of dystroglycan and that abnormal dystroglycan-ligand interactions underlie the pathogenic mechanism of muscular dystrophy with brain abnormalities.

Animal model experiments lend further support to the function of LARGE. Michele et al. (2002) demonstrated in both muscle-eye-brain disease (OMIM Ref. No. 253280) and Fukuyama congenital muscular dystrophy (FCMD; 253800) patients that alpha-dystroglycan is expressed at the muscle membrane, but similar hypoglycosylation in the diseases directly abolishes binding activity of dystroglycan for the ligands laminin (see OMIM Ref. No. 150240), neurexin (see OMIM Ref. No. 600565), and agrin (OMIM Ref. No. 103320). Michele et al. (2002) showed that this posttranslational biochemical and functional disruption of alpha-dystroglycan is recapitulated in the muscle and central nervous system of myd mice. Michele et al. (2002) demonstrated that myd mice have abnormal neuronal migration in the cerebral cortex, cerebellum, and hippocampus, and show disruption of the basal lamina. In addition, myd mice reveal that dystroglycan targets proteins to functional sites in brain through its interactions with extracellular matrix proteins. Michele et al. (2002) suggested that at least 3 mammalian genes function within a convergent posttranslational processing pathway during the biosynthesis of dystroglycan and that abnormal dystroglycan-ligand interactions underlie the pathogenic mechanism of muscular dystrophy with brain abnormalities.

It is appreciated that the abovementioned animal model for LARGE is acknowledged by those skilled in the art as a scientifically valid animal model, as can be further appreciated from the publications sited hereinbelow.

Full details of the abovementioned studies are described in the following publications, the disclosure of which are hereby incorporated by reference:

Grewal, P. K.; Holzfeind, P. J.; Bittner, R. E.; Hewitt, J. E.: Mutant glycosyltransferase and altered glycosylation of alpha-dystroglycan in the myodystrophy mouse. Nature Genet. 28:151-154, 2001; and Michele, D. E.; Barresi, R.; Kanagawa, M.; Saito, F.; Cohn, R. D.; Satz, J. S.; Dollar, J.; Nishino, I.; Kelley, R. I.; Somer, H.; Straub, V.; Mathews, K. D.; Moore, S. A.; Campbell, K.

Further studies establishing the function and utilities of LARGE are found in John Hopkins OMIM database record ID 603590, and in cited publications listed in Table 5, which are hereby incorporated by reference. LAX (Accession NP_060243.1) is another GAM44 target gene, herein designated TARGET GENE. LAX BINDING SITE is a target binding site found in the 3' untranslated region of mRNA encoded by LAX, corresponding to a target binding site such as BINDING SITE I, BINDING SITE II or BINDING SITE III of FIG. 8. Table 4 illustrates the complementarity of the nucleotide sequences of LAX BINDING SITE, designated SEQ ID:9263, to the nucleotide sequence of GAM44 RNA, herein designated GAM RNA, also designated SEQ ID:287.

Another function of GAM44 is therefore inhibition of LAX (Accession NP_060243.1). Accordingly, utilities of GAM44 include diagnosis, prevention and treatment of diseases and clinical conditions associated with LAX.

Leucine zipper, down-regulated in cancer 1 (LDOC1, Accession NP_036449.1) is another GAM44 target gene, herein designated TARGET GENE. LDOC1 BINDING SITE is a target binding site found in the 3' untranslated region of mRNA encoded by LDOC1, corresponding to a target binding site such as BINDING SITE I, BINDING SITE II or BINDING SITE III of FIG. 8. Table 4 illustrates the complementarity of the nucleotide sequences of LDOC1 BINDING SITE, designated SEQ ID:2933, to the nucleotide sequence of GAM44 RNA, herein designated GAM RNA, also designated SEQ ID:287.

Another function of GAM44 is therefore inhibition of Leucine zipper, down-regulated in cancer 1 (LDOC1, Accession NP_036449.1). Accordingly, utilities of GAM44 include diagnosis, prevention and treatment of diseases and clinical conditions associated with LDOC1.

Lipoma hmgic fusion partner (LHFP, Accession NP_005771.1) is another GAM44 target gene, herein designated TARGET GENE. LHFP BINDING SITE is a target binding site found in the 3' untranslated region of mRNA encoded by LHFP, corresponding to a target binding site such as BINDING SITE I, BINDING SITE II or BINDING SITE III of FIG. 8. Table 4 illustrates the complementarity of the nucleotide sequences of LHFP BINDING SITE, designated SEQ ID:12839, to the nucleotide sequence of GAM44 RNA, herein designated GAM RNA, also designated SEQ ID:287.

Another function of GAM44 is therefore inhibition of Lipoma hmgic fusion partner (LHFP, Accession NP_005771.1). Accordingly, utilities of GAM44 include diagnosis, prevention and treatment of diseases and clinical conditions associated with LHFP.

Lin-7 homolog a (c. elegans) (LIN7A, Accession NP_004655.1) is another GAM44 target gene, herein designated TARGET GENE. LIN7A BINDING SITE is a target binding site found in the 5' untranslated region of mRNA encoded by LIN7A, corresponding to a target binding site such as BINDING SITE I, BINDING SITE II or BINDING SITE III of FIG. 8. Table 4 illustrates the complementarity of the nucleotide sequences of LIN7A BINDING SITE, designated SEQ ID:3012, to the nucleotide sequence of GAM44 RNA, herein designated GAM RNA, also designated SEQ ID:287.

Another function of GAM44 is therefore inhibition of Lin-7 homolog a (c. elegans) (LIN7A, Accession NP_004655.1). Accordingly, utilities of GAM44 include diagnosis, prevention and treatment of diseases and clinical conditions associated with LIN7A.

LOC118987 (Accession NP_776152.1) is another GAM44 target gene, herein designated TARGET GENE. LOC118987 BINDING SITE is a target binding site found in the 3' untranslated region of mRNA encoded by LOC118987, corresponding to a target binding site such as BINDING SITE I, BINDING SITE II or BINDING SITE III of FIG. 8. Table 4 illustrates the complementarity of the nucleotide sequences of LOC118987 BINDING SITE, designated SEQ ID:9092, to the nucleotide sequence of GAM44 RNA, herein designated GAM RNA, also designated SEQ ID:287.

Another function of GAM44 is therefore inhibition of LOC118987 (Accession NP_776152.1). Accordingly, utilities of GAM44 include diagnosis, prevention and treatment of diseases and clinical conditions associated with LOC118987.

LOC126017 (Accession XP_064903.7) is another GAM44 target gene, herein designated TARGET GENE. LOC126017 BINDING SITE is a target binding site found in the 3' untranslated region of mRNA encoded by LOC126017, corresponding to a target binding site such as BINDING SITE I, BINDING SITE II or BINDING SITE III of FIG. 8. Table 4 illustrates the complementarity of the nucleotide sequences of LOC126017 BINDING SITE, designated SEQ ID:19476, to the nucleotide sequence of GAM44 RNA, herein designated GAM RNA, also designated SEQ ID:287.

Another function of GAM44 is therefore inhibition of LOC126017 (Accession XP_064903.7). Accordingly, utilities of GAM44 include diagnosis, prevention and treatment of diseases and clinical conditions associated with LOC126017.

LOC126731 (Accession NP_660300.1) is another GAM44 target gene, herein designated TARGET GENE. LOC126731 BINDING SITE is a target binding site found in the 3' untranslated region of mRNA encoded by LOC126731, corresponding to a target binding site such as BINDING SITE I, BINDING SITE II or BINDING SITE III of FIG. 8. Table 4 illustrates the complementarity of the nucleotide sequences of LOC126731 BINDING SITE, designated SEQ ID:18542, to the nucleotide sequence of GAM44 RNA, herein designated GAM RNA, also designated SEQ ID:287.

Another function of GAM44 is therefore inhibition of LOC126731 (Accession NP_660300.1). Accordingly, utilities of GAM44 include diagnosis, prevention and treatment of diseases and clinical conditions associated with LOC126731.

LOC130752 (Accession XP_059468.3) is another GAM44 target gene, herein designated TARGET GENE. LOC130752 BINDING SITE is a target binding site found in the 3' untranslated region of mRNA encoded by LOC130752, corresponding to a target binding site such as BINDING SITE I, BINDING SITE II or BINDING SITE III of FIG. 8. Table 4 illustrates the complementarity of the nucleotide sequences of LOC130752 BINDING SITE, designated SEQ ID:10734, to the nucleotide sequence of GAM44 RNA, herein designated GAM RNA, also designated SEQ ID:287.

Another function of GAM44 is therefore inhibition of LOC130752 (Accession XP_059468.3). Accordingly, utilities of GAM44 include diagnosis, prevention and treatment of diseases and clinical conditions associated with LOC130752.

LOC144486 (Accession XP_096608.1) is another GAM44 target gene, herein designated TARGET GENE. LOC144486 BINDING SITE is a target binding site found in the 3' untranslated region of mRNA encoded by LOC144486, corresponding to a target binding site such as BINDING SITE I, BINDING SITE II or BINDING SITE III of FIG. 8. Table 4 illustrates the complementarity of the nucleotide sequences of LOC144486 BINDING SITE, designated SEQ ID:16849, to the nucleotide sequence of GAM44 RNA, herein designated GAM RNA, also designated SEQ ID:287.

Another function of GAM44 is therefore inhibition of LOC144486 (Accession XP_096608.1). Accordingly, utilities of GAM44 include diagnosis, prevention and treatment of diseases and clinical conditions associated with LOC144486.

LOC145053 (Accession XP_096714.1) is another GAM44 target gene, herein designated TARGET GENE. LOC145053 BINDING SITE is a target binding site found in the 3' untranslated region of mRNA encoded by LOC145053, corresponding to a target binding site such as BINDING SITE I, BINDING SITE II or BINDING SITE III of FIG. 8. Table 4 illustrates the complementarity of the nucleotide sequences of LOC145053 BINDING SITE, designated SEQ ID:16596, to the nucleotide sequence of GAM44 RNA, herein designated GAM RNA, also designated SEQ ID:287.

Another function of GAM44 is therefore inhibition of LOC145053 (Accession XP_096714.1). Accordingly, utilities of GAM44 include diagnosis, prevention and treatment of diseases and clinical conditions associated with LOC145053.

LOC145216 (Accession XP_096730.1) is another GAM44 target gene, herein designated TARGET GENE.

LOC145216 BINDING SITE is a target binding site found in the 3' untranslated region of mRNA encoded by LOC145216, corresponding to a target binding site such as BINDING SITE I, BINDING SITE II or BINDING SITE III of FIG. 8. Table 4 illustrates the complementarity of the nucleotide sequences of LOC145216 BINDING SITE, designated SEQ ID:18659, to the nucleotide sequence of GAM44 RNA, herein designated GAM RNA, also designated SEQ ID:287.

Another function of GAM44 is therefore inhibition of LOC145216 (Accession XP_096730.1). Accordingly, utilities of GAM44 include diagnosis, prevention and treatment of diseases and clinical conditions associated with LOC145216.

LOC146227 (Accession XP_085374.2) is another GAM44 target gene, herein designated TARGET GENE. LOC146227 BINDING SITE is a target binding site found in the 3' untranslated region of mRNA encoded by LOC146227, corresponding to a target binding site such as BINDING SITE I, BINDING SITE II or BINDING SITE III of FIG. 8. Table 4 illustrates the complementarity of the nucleotide sequences of LOC146227 BINDING SITE, designated SEQ ID:1810, to the nucleotide sequence of GAM44 RNA, herein designated GAM RNA, also designated SEQ ID:287.

Another function of GAM44 is therefore inhibition of LOC146227 (Accession XP_085374.2). Accordingly, utilities of GAM44 include diagnosis, prevention and treatment of diseases and clinical conditions associated with LOC146227.

LOC146443 (Accession XP_085461.6) is another GAM44 target gene, herein designated TARGET GENE. LOC146443 BINDING SITE is a target binding site found in the 3' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:15013, to the nucleotide sequence of GAM44 RNA, herein designated GAM RNA, also designated SEQ ID:287.

Another function of GAM44 is therefore inhibition of LOC146443 (Accession XP_085461.6). Accordingly, utilities of GAM44 include diagnosis, prevention and treatment of diseases and clinical conditions associated with LOC146443.

LOC146728 (Accession XP_097074.1) is another GAM44 target gene, herein designated TARGET GENE. LOC146728 BINDING SITE is a target binding site found in the 5' untranslated region of mRNA encoded by LOC146728, corresponding to a target binding site such as BINDING SITE I, BINDING SITE II or BINDING SITE III of FIG. 8. Table 4 illustrates the complementarity of the nucleotide sequences of LOC146728 BINDING SITE, designated SEQ ID:16534, to the nucleotide sequence of GAM44 RNA, herein designated GAM RNA, also designated SEQ ID:287.

Another function of GAM44 is therefore inhibition of LOC146728 (Accession XP_097074.1). Accordingly, utilities of GAM44 include diagnosis, prevention and treatment of diseases and clinical conditions associated with LOC146728.

LOC146856 (Accession XP_096086.1) is another GAM44 target gene, herein designated TARGET GENE. LOC146856 BINDING SITE is a target binding site found in the 3' untranslated region of mRNA encoded by LOC146856, corresponding to a target binding site such as BINDING SITE I, BINDING SITE II or BINDING SITE III of FIG. 8. Table 4 illustrates the complementarity of the nucleotide sequences of LOC146856 BINDING SITE, designated SEQ ID:17740, to the nucleotide sequence of GAM44 RNA, herein designated GAM RNA, also designated SEQ ID:287.

Another function of GAM44 is therefore inhibition of LOC146856 (Accession XP_096086.1). Accordingly, utilities of GAM44 include diagnosis, prevention and treatment of diseases and clinical conditions associated with LOC146856.

LOC147947 (Accession XP_085974.1) is another GAM44 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:6702, to the nucleotide sequence of GAM44 RNA, herein designated GAM RNA, also designated SEQ ID:287.

Another function of GAM44 is therefore inhibition of LOC147947 (Accession XP_085974.1). Accordingly, utilities of GAM44 include diagnosis, prevention and treatment of diseases and clinical conditions associated with LOC147947.

LOC148490 (Accession XP_086210.2) is another GAM44 target gene, herein designated TARGET GENE. LOC148490 BINDING SITE is a target binding site found in the 5' untranslated region of mRNA encoded by LOC148490, corresponding to a target binding site such as BINDING SITE I, BINDING SITE II or BINDING SITE III of FIG. 8. Table 4 illustrates the complementarity of the nucleotide sequences of LOC148490 BINDING SITE, designated SEQ ID:18524, to the nucleotide sequence of GAM44 RNA, herein designated GAM RNA, also designated SEQ ID:287.

Another function of GAM44 is therefore inhibition of LOC148490 (Accession XP_086210.2). Accordingly, utilities of GAM44 include diagnosis, prevention and treatment of diseases and clinical conditions associated with LOC148490.

LOC149420 (Accession NP_690048.1) is another GAM44 target gene, herein designated TARGET GENE. LOC149420 BINDING SITE is a target binding site found in the 5' untranslated region of mRNA encoded by LOC149420, corresponding to a target binding site such as BINDING SITE I, BINDING SITE II or BINDING SITE III of FIG. 8. Table 4 illustrates the complementarity of the nucleotide sequences of LOC149420 BINDING SITE, designated SEQ ID:19107, to the nucleotide sequence of GAM44 RNA, herein designated GAM RNA, also designated SEQ ID:287.

Another function of GAM44 is therefore inhibition of LOC149420 (Accession NP_690048.1). Accordingly, utilities of GAM44 include diagnosis, prevention and treatment of diseases and clinical conditions associated with LOC149420.

LOC151242 (Accession XP_087137.2) is another GAM44 target gene, herein designated TARGET GENE. LOC151242 BINDING SITE is a target binding site found in the 3' untranslated region of mRNA encoded by LOC151242, corresponding to a target binding site such as BINDING SITE I, BINDING SITE II or BINDING SITE III of FIG. 8. Table 4 illustrates the complementarity of the nucleotide sequences of LOC151242 BINDING SITE, designated SEQ ID:1944, to the nucleotide sequence of GAM44 RNA, herein designated GAM RNA, also designated SEQ ID:287.

Another function of GAM44 is therefore inhibition of LOC151242 (Accession XP_087137.2). Accordingly, utilities of GAM44 include diagnosis, prevention and treatment of diseases and clinical conditions associated with LOC151242.

LOC151610 (Accession XP_087245.1) is another GAM44 target gene, herein designated TARGET GENE. LOC151610 BINDING SITE is a target binding site found in the 5' untranslated region of mRNA encoded by LOC151610, corresponding to a target binding site such as BINDING SITE I, BINDING SITE II or BINDING SITE III of FIG. 8. Table 4 illustrates the complementarity of the nucleotide sequences of LOC151610 BINDING SITE, designated SEQ ID:12037, to the nucleotide sequence of GAM44 RNA, herein designated GAM RNA, also designated SEQ ID:287.

Another function of GAM44 is therefore inhibition of LOC151610 (Accession XP_087245.1). Accordingly, utilities of GAM44 include diagnosis, prevention and treatment of diseases and clinical conditions associated with LOC151610.

LOC152519 (Accession XP_087483.3) is another GAM44 target gene, herein designated TARGET GENE. LOC152519 BINDING SITE is a target binding site found in the 3' untranslated region of mRNA encoded by LOC152519, corresponding to a target binding site such as BINDING SITE I, BINDING SITE II or BINDING SITE III of FIG. 8. Table 4 illustrates the complementarity of the nucleotide sequences of LOC152519 BINDING SITE, designated SEQ ID:12979, to the nucleotide sequence of GAM44 RNA, herein designated GAM RNA, also designated SEQ ID:287.

Another function of GAM44 is therefore inhibition of LOC152519 (Accession XP_087483.3). Accordingly, utilities of GAM44 include diagnosis, prevention and treatment of diseases and clinical conditions associated with LOC152519.

LOC153077 (Accession XP_098307.1) is another GAM44 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:16808, to the nucleotide sequence of GAM44 RNA, herein designated GAM RNA, also designated SEQ ID:287.

Another function of GAM44 is therefore inhibition of LOC153077 (Accession XP_098307.1). Accordingly, utilities of GAM44 include diagnosis, prevention and treatment of diseases and clinical conditions associated with LOC153077.

LOC157531 (Accession XP_098772.1) is another GAM44 target gene, herein designated TARGET GENE. LOC157531 BINDING SITE is a target binding site found in the 3' untranslated region of multiple transcripts of mRNA encoded by LOC157531, corresponding to a target binding site such as BINDING SITE I, BINDING SITE II or BINDING SITE III of FIG. 8. Table 4 illustrates the complementarity of the nucleotide sequences of LOC157531 BINDING SITE, designated SEQ ID:3461, to the nucleotide sequence of GAM44 RNA, herein designated GAM RNA, also designated SEQ ID:287.

Another function of GAM44 is therefore inhibition of LOC157531 (Accession XP_098772.1). Accordingly, utilities of GAM44 include diagnosis, prevention and treatment of diseases and clinical conditions associated with LOC157531.

LOC158125 (Accession XP_088492.2) is another GAM44 target gene, herein designated TARGET GENE. LOC158125 BINDING SITE is a target binding site found in the 3' untranslated region of mRNA encoded by LOC158125, corresponding to a target binding site such as BINDING SITE I, BINDING SITE II or BINDING SITE III of FIG. 8. Table 4 illustrates the complementarity of the nucleotide sequences of LOC158125 BINDING SITE, designated SEQ ID:8554, to the nucleotide sequence of GAM44 RNA, herein designated GAM RNA, also designated SEQ ID:287.

Another function of GAM44 is therefore inhibition of LOC158125 (Accession XP_088492.2). Accordingly, utilities of GAM44 include diagnosis, prevention and treatment of diseases and clinical conditions associated with LOC158125.

LOC202781 (Accession XP_117455.1) is another GAM44 target gene, herein designated TARGET GENE. LOC202781 BINDING SITE is a target binding site found in the 3' untranslated region of mRNA encoded by LOC202781, corresponding to a target binding site such as BINDING SITE I, BINDING SITE II or BINDING SITE III of FIG. 8. Table 4 illustrates the complementarity of the nucleotide sequences of LOC202781 BINDING SITE, designated SEQ ID:9377, to the nucleotide sequence of GAM44 RNA, herein designated GAM RNA, also designated SEQ ID:287.

Another function of GAM44 is therefore inhibition of LOC202781 (Accession XP_117455.1). Accordingly, utilities of GAM44 include diagnosis, prevention and treatment of diseases and clinical conditions associated with LOC202781.

LOC219612 (Accession XP_168585.2) is another GAM44 target gene, herein designated TARGET GENE. LOC219612 BINDING SITE is a target binding site found in the 5' untranslated region of mRNA encoded by LOC219612, corresponding to a target binding site such as BINDING SITE I, BINDING SITE II or BINDING SITE III of FIG. 8. Table 4 illustrates the complementarity of the nucleotide sequences of LOC219612 BINDING SITE, designated SEQ ID:690, to the nucleotide sequence of GAM44 RNA, herein designated GAM RNA, also designated SEQ ID:287.

Another function of GAM44 is therefore inhibition of LOC219612 (Accession XP_168585.2). Accordingly, utilities of GAM44 include diagnosis, prevention and treatment of diseases and clinical conditions associated with LOC219612.

LOC219731 (Accession XP_167596.1) is another GAM44 target gene, herein designated TARGET GENE. LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:5054, to the nucleotide sequence of GAM44 RNA, herein designated GAM RNA, also designated SEQ ID:287.

Another function of GAM44 is therefore inhibition of LOC219731 (Accession XP_167596.1). Accordingly, utilities of GAM44 include diagnosis, prevention and treatment of diseases and clinical conditions associated with LOC219731.

LOC219914 (Accession XP_167788.1) is another GAM44 target gene, herein designated TARGET GENE. LOC219914 BINDING SITE is a target binding site found in the 3' untranslated region of mRNA encoded by LOC219914, corresponding to a target binding site such as BINDING SITE I, BINDING SITE II or BINDING SITE III of FIG. 8. Table 4 illustrates the complementarity of the nucleotide sequences of LOC219914 BINDING SITE, designated SEQ ID:15995, to the nucleotide sequence of GAM44 RNA, herein designated GAM RNA, also designated SEQ ID:287.

Another function of GAM44 is therefore inhibition of LOC219914 (Accession XP_167788.1). Accordingly, utilities of GAM44 include diagnosis, prevention and treatment of diseases and clinical conditions associated with LOC219914.

LOC219942 (Accession XP_167790.1) is another GAM44 target gene, herein designated TARGET GENE. LOC219942 BINDING SITE is a target binding site found in the 3' untranslated region of mRNA encoded by LOC219942, corresponding to a target binding site such as BINDING SITE I, BINDING SITE II or BINDING SITE III of FIG. 8. Table 4 illustrates the complementarity of the nucleotide sequences of LOC219942 BINDING SITE, designated SEQ ID:10767, to the nucleotide sequence of GAM44 RNA, herein designated GAM RNA, also designated SEQ ID:287.

Another function of GAM44 is therefore inhibition of LOC219942 (Accession XP_167790.1). Accordingly, utilities of GAM44 include diagnosis, prevention and treatment of diseases and clinical conditions associated with LOC219942.

LOC282976 (Accession XP_210838.1) is another GAM44 target gene, herein designated TARGET GENE. LOC282976 BINDING SITE is a target binding site found in the 3' untranslated region of mRNA encoded by LOC282976, corresponding to a target binding site such as BINDING SITE I, BINDING SITE II or BINDING SITE III of FIG. 8. Table 4 illustrates the complementarity of the nucleotide sequences of LOC282976 BINDING SITE, designated SEQ ID:2531, to the nucleotide sequence of GAM44 RNA, herein designated GAM RNA, also designated SEQ ID:287.

Another function of GAM44 is therefore inhibition of LOC282976 (Accession XP_210838.1). Accordingly, utilities of GAM44 include diagnosis, prevention and treatment of diseases and clinical conditions associated with LOC282976.

LOC283314 (Accession XP_210969.1) is another GAM44 target gene, herein designated TARGET GENE. LOC283314 BINDING SITE is a target binding site found in the 3' untranslated region of mRNA encoded by LOC283314, corresponding to a target binding site such as BINDING SITE I, BINDING SITE II or BINDING SITE III of FIG. 8. Table 4 illustrates the complementarity of the nucleotide sequences of LOC283314 BINDING SITE, designated SEQ ID:19120, to the nucleotide sequence of GAM44 RNA, herein designated GAM RNA, also designated SEQ ID:287.

Another function of GAM44 is therefore inhibition of LOC283314 (Accession XP_210969.1). Accordingly, utilities of GAM44 include diagnosis, prevention and treatment of diseases and clinical conditions associated with LOC283314.

LOC283337 (Accession XP_300560.1) is another GAM44 target gene, herein designated TARGET GENE. LOC283337 BINDING SITE is a target binding site found in the 3' untranslated region of mRNA encoded by LOC283337, corresponding to a target binding site such as BINDING SITE I, BINDING SITE II or BINDING SITE III of FIG. 8. Table 4 illustrates the complementarity of the nucleotide sequences of LOC283337 BINDING SITE, designated SEQ ID:7249, to the nucleotide sequence of GAM44 RNA, herein designated GAM RNA, also designated SEQ ID:287.

Another function of GAM44 is therefore inhibition of LOC283337 (Accession XP_300560.1). Accordingly, utilities of GAM44 include diagnosis, prevention and treatment of diseases and clinical conditions associated with LOC283337.

LOC283484 (Accession XP_211053.1) is another GAM44 target gene, herein designated TARGET GENE. LOC283484 BINDING SITE is a target binding site found in the 3' untranslated region of mRNA encoded by LOC283484, corresponding to a target binding site such as BINDING SITE I, BINDING SITE II or BINDING SITE III of FIG. 8. Table 4 illustrates the complementarity of the nucleotide sequences of LOC283484 BINDING SITE, designated SEQ ID:17012, to the nucleotide sequence of GAM44 RNA, herein designated GAM RNA, also designated SEQ ID:287.

Another function of GAM44 is therefore inhibition of LOC283484 (Accession XP_211053.1). Accordingly, utilities of GAM44 include diagnosis, prevention and treatment of diseases and clinical conditions associated with LOC283484.

LOC283767 (Accession XP_208835.1) is another GAM44 target gene, herein designated TARGET GENE. LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:1502, to the nucleotide sequence of GAM44 RNA, herein designated GAM RNA, also designated SEQ ID:287.

Another function of GAM44 is therefore inhibition of LOC283767 (Accession XP_208835.1). Accordingly, utilities of GAM44 include diagnosis, prevention and treatment of diseases and clinical conditions associated with LOC283767.

LOC283776 (Accession XP_211196.1) is another GAM44 target gene, herein designated TARGET GENE. LOC283776 BINDING SITE is a target binding site found in the 5' untranslated region of mRNA encoded by LOC283776, corresponding to a target binding site such as BINDING SITE I, BINDING SITE II or BINDING SITE III of FIG. 8. Table 4 illustrates the complementarity of the nucleotide sequences of LOC283776 BINDING SITE, designated SEQ ID:14021, to the nucleotide sequence of GAM44 RNA, herein designated GAM RNA, also designated SEQ ID:287.

Another function of GAM44 is therefore inhibition of LOC283776 (Accession XP_211196.1). Accordingly, utilities of GAM44 include diagnosis, prevention and treatment of diseases and clinical conditions associated with LOC283776.

LOC283818 (Accession XP_211218.1) is another GAM44 target gene, herein designated TARGET GENE. LOC283818 BINDING SITE is a target binding site found in the 5' untranslated region of mRNA encoded by LOC283818, corresponding to a target binding site such as BINDING SITE I, BINDING SITE II or BINDING SITE III of FIG. 8. Table 4 illustrates the complementarity of the nucleotide sequences of LOC283818 BINDING SITE, designated SEQ ID:3222, to the nucleotide sequence of GAM44 RNA, herein designated GAM RNA, also designated SEQ ID:287.

Another function of GAM44 is therefore inhibition of LOC283818 (Accession XP_211218.1). Accordingly, utilities of GAM44 include diagnosis, prevention and treatment of diseases and clinical conditions associated with LOC283818.

LOC283906 (Accession XP_211254.1) is another GAM44 target gene, herein designated TARGET GENE. LOC283906 BINDING SITE is a target binding site found in the 5' untranslated region of mRNA encoded by LOC283906, corresponding to a target binding site such as BINDING SITE I, BINDING SITE II or BINDING SITE III of FIG. 8. Table 4 illustrates the complementarity of the nucleotide sequences of LOC283906 BINDING SITE, designated SEQ ID:19383, to the nucleotide sequence of GAM44 RNA, herein designated GAM RNA, also designated SEQ ID:287.

Another function of GAM44 is therefore inhibition of LOC283906 (Accession XP_211254.1). Accordingly, utilities of GAM44 include diagnosis, prevention and treatment of diseases and clinical conditions associated with LOC283906.

LOC284031 (Accession XP_208982.1) is another GAM44 target gene, herein designated TARGET GENE. LOC284031 BINDING SITE is a target binding site found in the 3' untranslated region of mRNA encoded by LOC284031, corresponding to a target binding site such as BINDING SITE I, BINDING SITE II or BINDING SITE III of FIG. 8. Table 4 illustrates the complementarity of the nucleotide sequences of LOC284031 BINDING SITE, designated SEQ ID:1826, to the nucleotide sequence of GAM44 RNA, herein designated GAM RNA, also designated SEQ ID:287.

Another function of GAM44 is therefore inhibition of LOC284031 (Accession XP_208982.1). Accordingly, utilities of GAM44 include diagnosis, prevention and treatment of diseases and clinical conditions associated with LOC284031.

LOC284462 (Accession XP_211475.1) is another GAM44 target gene, herein designated TARGET GENE. LOC284462 BINDING SITE is a target binding site found in the 3' untranslated region of mRNA encoded by LOC284462, corresponding to a target binding site such as BINDING SITE I, BINDING SITE II or BINDING SITE III of FIG. 8. Table 4 illustrates the complementarity of the nucleotide sequences of LOC284462 BINDING SITE, designated SEQ ID:17281, to the nucleotide sequence of GAM44 RNA, herein designated GAM RNA, also designated SEQ ID:287.

Another function of GAM44 is therefore inhibition of LOC284462 (Accession XP_211475.1). Accordingly, utilities of GAM44 include diagnosis, prevention and treatment of diseases and clinical conditions associated with LOC284462.

LOC284473 (Accession XP_211474.1) is another GAM44 target gene, herein designated TARGET GENE. LOC284473 BINDING SITE is a target binding site found in the 3' untranslated region of mRNA encoded by LOC284473, corresponding to a target binding site such as BINDING SITE I, BINDING SITE II or BINDING SITE III of FIG. 8. Table 4 illustrates the complementarity of the nucleotide sequences of LOC284473 BINDING SITE, designated SEQ ID:7971, to the nucleotide sequence of GAM44 RNA, herein designated GAM RNA, also designated SEQ ID:287.

Another function of GAM44 is therefore inhibition of LOC284473 (Accession XP_211474.1). Accordingly, utilities of GAM44 include diagnosis, prevention and treatment of diseases and clinical conditions associated with LOC284473.

LOC284578 (Accession XP_211526.1) is another GAM44 target gene, herein designated TARGET GENE. LOC284578 BINDING SITE is a target binding site found in the 5' untranslated region of mRNA encoded by LOC284578, corresponding to a target binding site such as BINDING SITE I, BINDING SITE II or BINDING SITE III of FIG. 8. Table 4 illustrates the complementarity of the nucleotide sequences of LOC284578 BINDING SITE, designated SEQ ID:13654, to the nucleotide sequence of GAM44 RNA, herein designated GAM RNA, also designated SEQ ID:287.

Another function of GAM44 is therefore inhibition of LOC284578 (Accession XP_211526.1). Accordingly, utilities of GAM44 include diagnosis, prevention and treatment of diseases and clinical conditions associated with LOC284578.

LOC284671 (Accession XP_209313.2) is another GAM44 target gene, herein designated TARGET GENE. LOC284671 BINDING SITE is a target binding site found in the 3' untranslated region of mRNA encoded by LOC284671, corresponding to a target binding site such as BINDING SITE I, BINDING SITE II or BINDING SITE III of FIG. 8. Table 4 illustrates the complementarity of the nucleotide sequences of LOC284671 BINDING SITE, designated SEQ ID:1698, to the nucleotide sequence of GAM44 RNA, herein designated GAM RNA, also designated SEQ ID:287.

Another function of GAM44 is therefore inhibition of LOC284671 (Accession XP_209313.2). Accordingly, utilities of GAM44 include diagnosis, prevention and treatment of diseases and clinical conditions associated with LOC284671.

LOC284684 (Accession XP_209316.1) is another GAM44 target gene, herein designated TARGET GENE. LOC284684 BINDING SITE is a target binding site found in the 3' untranslated region of mRNA encoded by LOC284684, corresponding to a target binding site such as BINDING SITE I, BINDING SITE II or BINDING SITE III of FIG. 8. Table 4 illustrates the complementarity of the nucleotide sequences of LOC284684 BINDING SITE, designated SEQ ID:2205, to the nucleotide sequence of GAM44 RNA, herein designated GAM RNA, also designated SEQ ID:287.

Another function of GAM44 is therefore inhibition of LOC284684 (Accession XP_209316.1). Accordingly, utilities of GAM44 include diagnosis, prevention and treatment of diseases and clinical conditions associated with LOC284684.

LOC284775 (Accession XP_211635.1) is another GAM44 target gene, herein designated TARGET GENE. LOC284775 BINDING SITE is a target binding site found in the 3' untranslated region of mRNA encoded by LOC284775, corresponding to a target binding site such as BINDING SITE I, BINDING SITE II or BINDING SITE III of FIG. 8. Table 4 illustrates the complementarity of the nucleotide sequences of LOC284775 BINDING SITE, designated SEQ ID:19513, to the nucleotide sequence of GAM44 RNA, herein designated GAM RNA, also designated SEQ ID:287.

Another function of GAM44 is therefore inhibition of LOC284775 (Accession XP_211635.1). Accordingly, utilities of GAM44 include diagnosis, prevention and treatment of diseases and clinical conditions associated with LOC284775.

LOC284798 (Accession XP_211639.1) is another GAM44 target gene, herein designated TARGET GENE. LOC284798 BINDING SITE is a target binding site found in the 3' untranslated region of mRNA encoded by LOC284798, corresponding to a target binding site such as BINDING SITE I, BINDING SITE II or BINDING SITE III of FIG. 8. Table 4 illustrates the complementarity of the nucleotide sequences of LOC284798 BINDING SITE, designated SEQ ID:18378, to the nucleotide sequence of GAM44 RNA, herein designated GAM RNA, also designated SEQ ID:287.

Another function of GAM44 is therefore inhibition of LOC284798 (Accession XP_211639.1). Accordingly, utilities of GAM44 include diagnosis, prevention and treatment of diseases and clinical conditions associated with LOC284798.

LOC285351 (Accession XP_211856.1) is another GAM44 target gene, herein designated TARGET GENE. LOC285351 BINDING SITE is a target binding site found in the 5' untranslated region of mRNA encoded by LOC285351, corresponding to a target binding site such as BINDING SITE I, BINDING SITE II or BINDING SITE III of FIG. 8. Table 4 illustrates the complementarity of the nucleotide sequences of LOC285351 BINDING SITE, designated SEQ ID:7404, to the nucleotide sequence of GAM44 RNA, herein designated GAM RNA, also designated SEQ ID:287.

Another function of GAM44 is therefore inhibition of LOC285351 (Accession XP_211856.1). Accordingly, utilities of GAM44 include diagnosis, prevention and treatment of diseases and clinical conditions associated with LOC285351.

LOC285404 (Accession XP_211885.1) is another GAM44 target gene, herein designated TARGET GENE. LOC285404 BINDING SITE is a target binding site found in the 3' untranslated region of mRNA encoded by LOC285404, corresponding to a target binding site such as BINDING SITE I, BINDING SITE II or BINDING SITE III of FIG. 8. Table 4 illustrates the complementarity of the nucleotide sequences of LOC285404 BINDING SITE, designated SEQ ID:2002, to the nucleotide sequence of GAM44 RNA, herein designated GAM RNA, also designated SEQ ID:287.

Another function of GAM44 is therefore inhibition of LOC285404 (Accession XP_211885.1). Accordingly, utilities of GAM44 include diagnosis, prevention and treatment of diseases and clinical conditions associated with LOC285404.

LOC285422 (Accession XP_211894.1) is another GAM44 target gene, herein designated TARGET GENE. LOC285422 BINDING SITE is a target binding site found in the 3' untranslated region of mRNA encoded by LOC285422, corresponding to a target binding site such as BINDING SITE I, BINDING SITE II or BINDING SITE III of FIG. 8. Table 4 illustrates the complementarity of the nucleotide sequences of LOC285422 BINDING SITE, designated SEQ ID:5221, to the nucleotide sequence of GAM44 RNA, herein designated GAM RNA, also designated SEQ ID:287.

Another function of GAM44 is therefore inhibition of LOC285422 (Accession XP_211894.1). Accordingly, utilities of GAM44 include diagnosis, prevention and treatment of diseases and clinical conditions associated with LOC285422.

LOC285441 (Accession XP_211897.1) is another GAM44 target gene, herein designated TARGET GENE. LOC285441 BINDING SITE is a target binding site found in the 3' untranslated region of mRNA encoded by LOC285441, corresponding to a target binding site such as BINDING SITE I, BINDING SITE II or BINDING SITE III of FIG. 8. Table 4 illustrates the complementarity of the nucleotide sequences of LOC285441 BINDING SITE, designated SEQ ID:18486, to the nucleotide sequence of GAM44 RNA, herein designated GAM RNA, also designated SEQ ID:287.

Another function of GAM44 is therefore inhibition of LOC285441 (Accession XP_211897.1). Accordingly, utilities of GAM44 include diagnosis, prevention and treatment of diseases and clinical conditions associated with LOC285441.

LOC285548 (Accession XP_211936.1) is another GAM44 target gene, herein designated TARGET GENE. LOC285548 BINDING SITE is a target binding site found in the 3' untranslated region of mRNA encoded by LOC285548, corresponding to a target binding site such as BINDING SITE I, BINDING SITE II or BINDING SITE III of FIG. 8. Table 4 illustrates the complementarity of the nucleotide sequences of LOC285548 BINDING SITE, designated SEQ ID:3710, to the nucleotide sequence of GAM44 RNA, herein designated GAM RNA, also designated SEQ ID:287.

Another function of GAM44 is therefore inhibition of LOC285548 (Accession XP_211936.1). Accordingly, utilities of GAM44 include diagnosis, prevention and treatment of diseases and clinical conditions associated with LOC285548.

LOC285623 (Accession XP_211958.1) is another GAM44 target gene, herein designated TARGET GENE. LOC285623 BINDING SITE is a target binding site found in the 3' untranslated region of mRNA encoded by LOC285623, corresponding to a target binding site such as BINDING SITE I, BINDING SITE II or BINDING SITE III of FIG. 8. Table 4 illustrates the complementarity of the nucleotide sequences of LOC285623 BINDING SITE, designated SEQ ID:1605, to the nucleotide sequence of GAM44 RNA, herein designated GAM RNA, also designated SEQ ID:287.

Another function of GAM44 is therefore inhibition of LOC285623 (Accession XP_211958.1). Accordingly, utilities of GAM44 include diagnosis, prevention and treatment of diseases and clinical conditions associated with LOC285623.

LOC285747 (Accession XP_209742.1) is another GAM44 target gene, herein designated TARGET GENE. LOC285747 BINDING SITE is a target binding site found in the 3' untranslated region of mRNA encoded by LOC285747, corresponding to a target binding site such as BINDING SITE I, BINDING SITE II or BINDING SITE III of FIG. 8. Table 4 illustrates the complementarity of the nucleotide sequences of LOC285747 BINDING SITE, designated SEQ ID:16029, to the nucleotide sequence of GAM44 RNA, herein designated GAM RNA, also designated SEQ ID:287.

Another function of GAM44 is therefore inhibition of LOC285747 (Accession XP_209742.1). Accordingly, utilities of GAM44 include diagnosis, prevention and treatment of diseases and clinical conditions associated with LOC285747.

LOC285946 (Accession XP_212103.1) is another GAM44 target gene, herein designated TARGET GENE. LOC285946 BINDING SITE is a target binding site found in the 3' untranslated region of mRNA encoded by LOC285946, corresponding to a target binding site such as BINDING SITE I, BINDING SITE II or BINDING SITE III of FIG. 8. Table 4 illustrates the complementarity of the nucleotide sequences of LOC285946 BINDING SITE, designated SEQ ID:19964, to the nucleotide sequence of GAM44 RNA, herein designated GAM RNA, also designated SEQ ID:287.

Another function of GAM44 is therefore inhibition of LOC285946 (Accession XP_212103.1). Accordingly, utilities of GAM44 include diagnosis, prevention and treatment of diseases and clinical conditions associated with LOC285946.

LOC286345 (Accession XP_210021.1) is another GAM44 target gene, herein designated TARGET GENE. LOC286345 BINDING SITE is a target binding site found in the 5' untranslated region of mRNA encoded by LOC286345, corresponding to a target binding site such as BINDING SITE I, BINDING SITE II or BINDING SITE III of FIG. 8. Table 4 illustrates the complementarity of the nucleotide sequences of LOC286345 BINDING SITE, designated SEQ ID:1540, to the nucleotide sequence of GAM44 RNA, herein designated GAM RNA, also designated SEQ ID:287.

Another function of GAM44 is therefore inhibition of LOC286345 (Accession XP_210021.1). Accordingly, utilities of GAM44 include diagnosis, prevention and treatment of diseases and clinical conditions associated with LOC286345.

LOC286452 (Accession XP_212323.1) is another GAM44 target gene, herein designated TARGET GENE. LOC286452 BINDING SITE is a target binding site found in the 5' untranslated region of mRNA encoded by LOC286452, corresponding to a target binding site such as BINDING SITE I, BINDING SITE II or BINDING SITE III of FIG. 8. Table 4 illustrates the complementarity of the nucleotide sequences of LOC286452 BINDING SITE, designated SEQ ID:17170, to the nucleotide sequence of GAM44 RNA, herein designated GAM RNA, also designated SEQ ID:287.

Another function of GAM44 is therefore inhibition of LOC286452 (Accession XP_212323.1). Accordingly, utilities of GAM44 include diagnosis, prevention and treatment of diseases and clinical conditions associated with LOC286452.

LOC286484 (Accession XP_208434.1) is another GAM44 target gene, herein designated TARGET GENE. LOC286484 BINDING SITE is a target binding site found in the 5' untranslated region of mRNA encoded by LOC286484, corresponding to a target binding site such as BINDING SITE I, BINDING SITE II or BINDING SITE III of FIG. 8. Table 4 illustrates the complementarity of the nucleotide sequences of LOC286484 BINDING SITE, designated SEQ ID:14618, to the nucleotide sequence of GAM44 RNA, herein designated GAM RNA, also designated SEQ ID:287.

Another function of GAM44 is therefore inhibition of LOC286484 (Accession XP_208434.1). Accordingly, utilities of GAM44 include diagnosis, prevention and treatment of diseases and clinical conditions associated with LOC286484.

LOC338588 (Accession XP_294659.1) is another GAM44 target gene, herein designated TARGET GENE. LOC338588 BINDING SITE is a target binding site found in the 5' untranslated region of mRNA encoded by LOC338588, corresponding to a target binding site such as BINDING SITE I, BINDING SITE II or BINDING SITE III of FIG. 8. Table 4 illustrates the complementarity of the nucleotide sequences of LOC338588 BINDING SITE, designated SEQ ID:10340, to the nucleotide sequence of GAM44 RNA, herein designated GAM RNA, also designated SEQ ID:287.

Another function of GAM44 is therefore inhibition of LOC338588 (Accession XP_294659.1). Accordingly, utilities of GAM44 include diagnosis, prevention and treatment of diseases and clinical conditions associated with LOC338588.

LOC338991 (Accession XP_290663.1) is another GAM44 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:1502, to the nucleotide sequence of GAM44 RNA, herein designated GAM RNA, also designated SEQ ID:287.

Another function of GAM44 is therefore inhibition of LOC338991 (Accession XP_290663.1). Accordingly, utilities of GAM44 include diagnosis, prevention and treatment of diseases and clinical conditions associated with LOC338991.

LOC338999 (Accession XP_290659.1) is another GAM44 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:1502, to the nucleotide sequence of GAM44 RNA, herein designated GAM RNA, also designated SEQ ID:287.

Another function of GAM44 is therefore inhibition of LOC338999 (Accession XP_290659.1). Accordingly, utilities of GAM44 include diagnosis, prevention and treatment of diseases and clinical conditions associated with LOC338999.

LOC339161 (Accession XP_294835.1) is another GAM44 target gene, herein designated TARGET GENE. LOC339161 BINDING SITE is a target binding site found in the 5' untranslated region of mRNA encoded by LOC339161, corresponding to a target binding site such as BINDING SITE I, BINDING SITE II or BINDING SITE III of FIG. 8. Table 4 illustrates the complementarity of the nucleotide sequences of LOC339161 BINDING SITE, designated SEQ ID:7871, to the nucleotide sequence of GAM44 RNA, herein designated GAM RNA, also designated SEQ ID:287.

Another function of GAM44 is therefore inhibition of LOC339161 (Accession XP_294835.1). Accordingly, utilities of GAM44 include diagnosis, prevention and treatment of diseases and clinical conditions associated with LOC339161.

LOC339184 (Accession XP_290743.1) is another GAM44 target gene, herein designated TARGET GENE. LOC339184 BINDING SITE is a target binding site found in the 3' untranslated region of mRNA encoded by LOC339184, corresponding to a target binding site such as BINDING SITE I, BINDING SITE II or BINDING SITE III of FIG. 8. Table 4 illustrates the complementarity of the nucleotide sequences of LOC339184 BINDING SITE, designated SEQ ID:5261, to the nucleotide sequence of GAM44 RNA, herein designated GAM RNA, also designated SEQ ID:287.

Another function of GAM44 is therefore inhibition of LOC339184 (Accession XP_290743.1). Accordingly, utilities of GAM44 include diagnosis, prevention and treatment of diseases and clinical conditions associated with LOC339184.

LOC339437 (Accession XP_290899.1) is another GAM44 target gene, herein designated TARGET GENE. LOC339437 BINDING SITE is a target binding site found in the 5' untranslated region of mRNA encoded by LOC339437, corresponding to a target binding site such as BINDING SITE I, BINDING SITE II or BINDING SITE III of FIG. 8. Table 4 illustrates the complementarity of the nucleotide sequences of LOC339437 BINDING SITE, designated SEQ ID:19567, to the nucleotide sequence of GAM44 RNA, herein designated GAM RNA, also designated SEQ ID:287.

Another function of GAM44 is therefore inhibition of LOC339437 (Accession XP_290899.1). Accordingly, utilities of GAM44 include diagnosis, prevention and treatment of diseases and clinical conditions associated with LOC339437.

LOC340478 (Accession XP_295258.1) is another GAM44 target gene, herein designated TARGET GENE. LOC340478 BINDING SITE is a target binding site found in the 5' untranslated region of mRNA encoded by LOC340478, corresponding to a target binding site such as BINDING SITE I, BINDING SITE II or BINDING SITE III of FIG. 8. Table 4 illustrates the complementarity of the nucleotide sequences of LOC340478 BINDING SITE, designated SEQ ID:2003, to the nucleotide sequence of GAM44 RNA, herein designated GAM RNA, also designated SEQ ID:287.

Another function of GAM44 is therefore inhibition of LOC340478 (Accession XP_295258.1). Accordingly, utilities of GAM44 include diagnosis, prevention and treatment of diseases and clinical conditions associated with LOC340478.

LOC341744 (Accession XP_296409.1) is another GAM44 target gene, herein designated TARGET GENE. LOC341744 BINDING SITE is a target binding site found in the 3' untranslated region of mRNA encoded by LOC341744, corresponding to a target binding site such as BINDING SITE I, BINDING SITE II or BINDING SITE III of FIG. 8. Table 4 illustrates the complementarity of the nucleotide sequences of LOC341744 BINDING SITE, designated SEQ ID:11667, to the nucleotide sequence of GAM44 RNA, herein designated GAM RNA, also designated SEQ ID:287.

Another function of GAM44 is therefore inhibition of LOC341744 (Accession XP_296409.1). Accordingly, utilities of GAM44 include diagnosis, prevention and treatment of diseases and clinical conditions associated with LOC341744.

LOC348113 (Accession XP_300623.1) is another GAM44 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:1502, to the nucleotide sequence of GAM44 RNA, herein designated GAM RNA, also designated SEQ ID:287.

Another function of GAM44 is therefore inhibition of LOC348113 (Accession XP_300623.1). Accordingly, utilities of GAM44 include diagnosis, prevention and treatment of diseases and clinical conditions associated with LOC348113.

LOC348137 (Accession XP_300635.1) is another GAM44 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:10142, to the nucleotide sequence of GAM44 RNA, herein designated GAM RNA, also designated SEQ ID:287.

Another function of GAM44 is therefore inhibition of LOC348137 (Accession XP_300635.1). Accordingly, utilities of GAM44 include diagnosis, prevention and treatment of diseases and clinical conditions associated with LOC348137.

LOC348142 (Accession XP_300636.1) is another GAM44 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:1502, to the nucleotide sequence of GAM44 RNA, herein designated GAM RNA, also designated SEQ ID:287.

Another function of GAM44 is therefore inhibition of LOC348142 (Accession XP_300636.1). Accordingly, utilities of GAM44 include diagnosis, prevention and treatment of diseases and clinical conditions associated with LOC348142.

LOC348144 (Accession XP_300638.1) is another GAM44 target gene, herein designated TARGET GENE. LOC348144 BINDING SITE is a target binding site found in the 3' untranslated region of mRNA encoded by LOC348144, corresponding to a target binding site such as BINDING SITE I, BINDING SITE II or BINDING SITE III of FIG. 8. Table 4 illustrates the complementarity of the nucleotide sequences of LOC348144 BINDING SITE, designated SEQ ID:18221, to the nucleotide sequence of GAM44 RNA, herein designated GAM RNA, also designated SEQ ID:287.

Another function of GAM44 is therefore inhibition of LOC348144 (Accession XP_300638.1). Accordingly, utilities of GAM44 include diagnosis, prevention and treatment of diseases and clinical conditions associated with LOC348144.

LOC348182 (Accession XP_302676.1) is another GAM44 target gene, herein designated TARGET GENE. LOC348182 BINDING SITE is a target binding site found in the 5' untranslated region of mRNA encoded by LOC348182, corresponding to a target binding site such as BINDING SITE I, BINDING SITE II or BINDING SITE III of FIG. 8. Table 4 illustrates the complementarity of the nucleotide sequences of LOC348182 BINDING SITE, designated SEQ ID:11592, to the nucleotide sequence of GAM44 RNA, herein designated GAM RNA, also designated SEQ ID:287.

Another function of GAM44 is therefore inhibition of LOC348182 (Accession XP_302676.1). Accordingly, utilities of GAM44 include diagnosis, prevention and treatment of diseases and clinical conditions associated with LOC348182.

LOC348768 (Accession XP_302883.1) is another GAM44 target gene, herein designated TARGET GENE. LOC348768 BINDING SITE is a target binding site found in the 3' untranslated region of mRNA encoded by LOC348768, corresponding to a target binding site such as BINDING SITE I, BINDING SITE II or BINDING SITE III of FIG. 8. Table 4 illustrates the complementarity of the nucleotide sequences of LOC348768 BINDING SITE, designated SEQ ID:14195, to the nucleotide sequence of GAM44 RNA, herein designated GAM RNA, also designated SEQ ID:287.

Another function of GAM44 is therefore inhibition of LOC348768 (Accession XP_302883.1). Accordingly, utilities of GAM44 include diagnosis, prevention and treatment of diseases and clinical conditions associated with LOC348768.

LOC350132 (Accession XP_303867.1) is another GAM44 target gene, herein designated TARGET GENE. LOC350132 BINDING SITE is a target binding site found in the 5' untranslated region of mRNA encoded by LOC350132, corresponding to a target binding site such as BINDING SITE I, BINDING SITE II or BINDING SITE III of FIG. 8. Table 4 illustrates the complementarity of the nucleotide sequences of LOC350132 BINDING SITE, designated SEQ ID:3208, to the nucleotide sequence of GAM44 RNA, herein designated GAM RNA, also designated SEQ ID:287.

Another function of GAM44 is therefore inhibition of LOC350132 (Accession XP_303867.1). Accordingly, utilities of GAM44 include diagnosis, prevention and treatment of diseases and clinical conditions associated with LOC350132.

LOC350147 (Accession XP_303825.1) is another GAM44 target gene, herein designated TARGET GENE. LOC350147 BINDING SITE is a target binding site found in the 5' untranslated region of mRNA encoded by LOC350147, corresponding to a target binding site such as BINDING SITE I, BINDING SITE II or BINDING SITE III of FIG. 8. Table 4 illustrates the complementarity of the nucleotide sequences of LOC350147 BINDING SITE, designated SEQ ID:15430, to the nucleotide sequence of GAM44 RNA, herein designated GAM RNA, also designated SEQ ID:287.

Another function of GAM44 is therefore inhibition of LOC350147 (Accession XP_303825.1). Accordingly, utilities of GAM44 include diagnosis, prevention and treatment of diseases and clinical conditions associated with LOC350147.

LOC351042 (Accession XP_304632.1) is another GAM44 target gene, herein designated TARGET GENE.

LOC351042 BINDING SITE is a target binding site found in the 5' untranslated region of mRNA encoded by LOC351042, corresponding to a target binding site such as BINDING SITE I, BINDING SITE II or BINDING SITE III of FIG. 8. Table 4 illustrates the complementarity of the nucleotide sequences of LOC351042 BINDING SITE, designated SEQ ID:8285, to the nucleotide sequence of GAM44 RNA, herein designated GAM RNA, also designated SEQ ID:287.

Another function of GAM44 is therefore inhibition of LOC351042 (Accession XP_304632.1). Accordingly, utilities of GAM44 include diagnosis, prevention and treatment of diseases and clinical conditions associated with LOC351042.

LOC57107 (Accession NP_065114.2) is another GAM44 target gene, herein designated TARGET GENE. LOC57107 BINDING SITE is a target binding site found in the 3' untranslated region of mRNA encoded by LOC57107, corresponding to a target binding site such as BINDING SITE I, BINDING SITE II or BINDING SITE III of FIG. 8. Table 4 illustrates the complementarity of the nucleotide sequences of LOC57107 BINDING SITE, designated SEQ ID:5002, to the nucleotide sequence of GAM44 RNA, herein designated GAM RNA, also designated SEQ ID:287.

Another function of GAM44 is therefore inhibition of LOC57107 (Accession NP_065114.2). Accordingly, utilities of GAM44 include diagnosis, prevention and treatment of diseases and clinical conditions associated with LOC57107.

LOC90148 (Accession XP_029430.1) is another GAM44 target gene, herein designated TARGET GENE. LOC90148 BINDING SITE is a target binding site found in the 3' untranslated region of mRNA encoded by LOC90148, corresponding to a target binding site such as BINDING SITE I, BINDING SITE II or BINDING SITE III of FIG. 8. Table 4 illustrates the complementarity of the nucleotide sequences of LOC90148 BINDING SITE, designated SEQ ID:4641, to the nucleotide sequence of GAM44 RNA, herein designated GAM RNA, also designated SEQ ID:287.

Another function of GAM44 is therefore inhibition of LOC90148 (Accession XP_029430.1). Accordingly, utilities of GAM44 include diagnosis, prevention and treatment of diseases and clinical conditions associated with LOC90148.

LOC92973 (Accession XP_048529.2) is another GAM44 target gene, herein designated TARGET GENE. LOC92973 BINDING SITE is a target binding site found in the 5' untranslated region of mRNA encoded by LOC92973, corresponding to a target binding site such as BINDING SITE I, BINDING SITE II or BINDING SITE III of FIG. 8. Table 4 illustrates the complementarity of the nucleotide sequences of LOC92973 BINDING SITE, designated SEQ ID:14969, to the nucleotide sequence of GAM44 RNA, herein designated GAM RNA, also designated SEQ ID:287.

Another function of GAM44 is therefore inhibition of LOC92973 (Accession XP_048529.2). Accordingly, utilities of GAM44 include diagnosis, prevention and treatment of diseases and clinical conditions associated with LOC92973.

LOC93349 (Accession NP_612411.2) is another GAM44 target gene, herein designated TARGET GENE. LOC93349 BINDING SITE is a target binding site found in the 3' untranslated region of mRNA encoded by LOC93349, corresponding to a target binding site such as BINDING SITE I, BINDING SITE II or BINDING SITE III of FIG. 8. Table 4 illustrates the complementarity of the nucleotide sequences of LOC93349 BINDING SITE, designated SEQ ID:17460, to the nucleotide sequence of GAM44 RNA, herein designated GAM RNA, also designated SEQ ID:287.

Another function of GAM44 is therefore inhibition of LOC93349 (Accession NP_612411.2). Accordingly, utilities of GAM44 include diagnosis, prevention and treatment of diseases and clinical conditions associated with LOC93349.

LSM10 (Accession NP_116270.1) is another GAM44 target gene, herein designated TARGET GENE. LSM10 BINDING SITE is a target binding site found in the 3' untranslated region of mRNA encoded by LSM10, corresponding to a target binding site such as BINDING SITE I, BINDING SITE II or BINDING SITE III of FIG. 8. Table 4 illustrates the complementarity of the nucleotide sequences of LSM10 BINDING SITE, designated SEQ ID:918, to the nucleotide sequence of GAM44 RNA, herein designated GAM RNA, also designated SEQ ID:287.

Another function of GAM44 is therefore inhibition of LSM10 (Accession NP_116270.1). Accordingly, utilities of GAM44 include diagnosis, prevention and treatment of diseases and clinical conditions associated with LSM10.

Lymphotoxin alpha (tnf superfamily, member 1) (LTA, Accession NP_000586.2) is another GAM44 target gene, herein designated TARGET GENE. LTA BINDING SITE is a target binding site found in the 5' untranslated region of mRNA encoded by LTA, corresponding to a target binding site such as BINDING SITE I, BINDING SITE II or BINDING SITE III of FIG. 8. Table 4 illustrates the complementarity of the nucleotide sequences of LTA BINDING SITE, designated SEQ ID:3286, to the nucleotide sequence of GAM44 RNA, herein designated GAM RNA, also designated SEQ ID:287.

Another function of GAM44 is therefore inhibition of Lymphotoxin alpha (tnf superfamily, member 1) (LTA, Accession NP_000586.2), a gene which is a cytokine that in its homotrimeric form binds to tnfrsf1a/tnfr1, tnfrsf1b/tnfbr and tnfrsf14/hvem. Accordingly, utilities of GAM44 include diagnosis, prevention and treatment of diseases and clinical conditions associated with LTA.

The function of LTA has been established by previous studies. Lymphotoxin was first characterized as a biologic factor in mitogen-stimulated lymphocytes having anticellular activity on neoplastic cell lines. It is a glycoprotein with a relative molecular mass (Mr) of 60,000-70,000, whereas monomeric lymphotoxin has an Mr of 25,000. Gray et al. (1984) isolated a chemically synthesized gene and natural complementary DNA coding for human lymphotoxin and engineered them for expression in E. coli. Cytotoxic and necrosis effects were observed in murine and human tumor cell lines in vitro and in murine sarcomas in vivo. TNF-beta (also known as lymphotoxin-alpha, or LTA) shows 35% identity and 50% homology in amino acid sequence with the TNF-alpha (OMIM Ref. No. 191160). Aggarwal et al. (1985) showed that the 2 TNFs share a common receptor on tumor cells See 191160 for information on the situation of both TNFA and TNFB on 6p. By analysis of deletions induced in lymphoblastoid cells by gamma-irradiation, Evans et al. (1989) concluded that TNFB maps to the interval between C4 and HLA-B. Spies et al. (1989) showed that the TNF-alpha and TNF-beta gene cluster is about 210 kb from HLA-B on 6p21.3. Jongeneel et al. (1991) described polymorphic microsatellites within a 12-kb region of the major histocompatibility complex that includes the TNFB locus. Lymphotoxin-alpha in a homotrimeric form is a soluble protein secreted by activated lymphocytes and presumed to act as a modulator in the immune response. The LT-alpha homotrimer shares its receptor with tumor necrosis factor and binds to both TNF receptor-1 (OMIM Ref. No. 191190) and -2 (191191

Full details of the abovementioned studies are described in the following publications, the disclosure of which are hereby incorporated by reference:

Aggarwal, B. B.; Eessalu, T. E.; Hass, P. E.: Characterization of receptors for human tumour necrosis factor and their regulation by gamma-interferon. Nature 318:665-667, 1985; and Evans, A. M.; Petersen, J. W.; Sekhon, G. S.; DeMars, R.: Mapping of prolactin and tumor necrosis factor-beta genes on human chromosome 6p using lymphoblastoid cell deletion mutants. Somat.

Further studies establishing the function and utilities of LTA are found in John Hopkins OMIM database record ID 153440, and in cited publications listed in Table 5, which are hereby incorporated by reference. Methyl cpg binding protein 2 (rett syndrome) (MECP2, Accession NP_004983.1) is another GAM44 target gene, herein designated TARGET GENE. MECP2 BINDING SITE is a target binding site found in the 3' untranslated region of mRNA encoded by MECP2, corresponding to a target binding site such as BINDING SITE I, BINDING SITE II or BINDING SITE III of FIG. 8. Table 4 illustrates the complementarity of the nucleotide sequences of MECP2 BINDING SITE, designated SEQ ID:689, to the nucleotide sequence of GAM44 RNA, herein designated GAM RNA, also designated SEQ ID:287.

Another function of GAM44 is therefore inhibition of Methyl cpg binding protein 2 (rett syndrome) (MECP2, Accession NP_004983.1). Accordingly, utilities of GAM44 include diagnosis, prevention and treatment of diseases and clinical conditions associated with MECP2.

Meis1, myeloid ecotropic viral integration site 1 homolog (mouse) (MEIS1, Accession NP_002389.1) is another GAM44 target gene, herein designated TARGET GENE. MEIS1 BINDING SITE is a target binding site found in the 3' untranslated region of mRNA encoded by MEIS1, corresponding to a target binding site such as BINDING SITE I, BINDING SITE II or BINDING SITE III of FIG. 8. Table 4 illustrates the complementarity of the nucleotide sequences of MEIS1 BINDING SITE, designated SEQ ID:12764, to the nucleotide sequence of GAM44 RNA, herein designated GAM RNA, also designated SEQ ID:287.

Another function of GAM44 is therefore inhibition of Meis1, myeloid ecotropic viral integration site 1 homolog (mouse) (MEIS1, Accession NP_002389.1), a gene which may regulate gene expression and control cell differentiation. Accordingly, utilities of GAM44 include diagnosis, prevention and treatment of diseases and clinical conditions associated with MEIS1.

The function of MEIS1 has been established by previous studies. Homeo box genes, of which the most well-characterized category is represented by the HOX genes, play a crucial role in normal development. In addition, several homeoproteins are involved in neoplasia: PPX1 (OMIM Ref. No. 176310), HOXA10 (OMIM Ref. No. 142957), and HOXB8 (OMIM Ref. No. 142963) play important roles in leukemia. The Meis1 locus was isolated by Moskow et al. (1995) as a common site of viral integration involved in myeloid leukemia in BXH-2 mice. MEIS1 encodes a novel homeo box protein belonging to the TALE (three amino acid loop extension) family of homeodomain-containing proteins. The homeodomain of MEIS1 is the only conserved motif within the entire 390-amino acid protein. Steelman et al. (1997) described additional members of a related gene family, which they called Meis1-related genes (MRGs; OMIM Ref. No. 601740). Mercader et al. (1999) described the role of homeo box genes Meis1, Meis2, and Pbx1 in the development of mouse, chicken, and Drosophila limbs. Mercader et al. (1999) found that Meis1 and Meis2 expression is restricted to the proximal domain, coincident with the previously reported domain in which Pbx1 is localized to the nucleus. Meis1 regulates Pbx1 activity by promoting nuclear import of the Pbx1 protein. Mercader et al. (1999) also demonstrated that ectopic expression of Meis1 in chicken disrupts distal limb development and induces distal- to - proximal transformations. Mercader et al. (1999) concluded that the restriction of Meis1 to proximal regions of the vertebrate limb is essential to specify cell fates and differentiation patterns along the proximodistal axis of the limb. Thorsteinsdottir et al. (2001) identified MEIS1 as a common collaborator with 2 divergent HOX genes, HOXA9 (OMIM Ref. No. 142956) and HOXB3 (OMIM Ref. No. 142966), in leukemic transformation. Using overexpression studies in bone marrow cells, they also demonstrated that each HOX gene studied predisposes to leukemias that are phenotypically distinct and that MEIS1 acts primarily to accelerate the occurrence of these leukemias without altering their phenotype. By fluorescence in situ hybridization, Moskow et al. (1995) mapped the human MEIS1 gene to 2p14-p13 near 3 translocation breakpoints involved in human leukemia. They mapped the murine homolog to mouse 11.

Full details of the abovementioned studies are described in the following publications, the disclosure of which are hereby incorporated by reference:

Moskow, J. J.; Bullrich, F.; Huebner, K.; Daar, I. O.; Buchberg, A. M.: Meis1, a PBX1-related homeobox gene involved in myeloid leukemia in BXH-2 mice. Molec. Cell. Biol. 15:5434-5443, 1995; and Steelman, S.; Moskow, J. J.; Muzynski, K.; North, C.; Druck, T.; Montgomery, J. C.; Huebner, K.; Daar, I. O.; Buchberg, A. M.: Identification of a conserved family of Meis1-related home.

Further studies establishing the function and utilities of MEIS1 are found in John Hopkins OMIM database record ID 601739, and in cited publications listed in Table 5, which are hereby incorporated by reference. Microfibrillar-associated protein 2 (MFAP2, Accession NP_002394.1) is another GAM44 target gene, herein designated TARGET GENE. MFAP2 BINDING SITE is a target binding site found in the 3' untranslated region of multiple transcripts of mRNA encoded by MFAP2, corresponding to a target binding site such as BINDING SITE I, BINDING SITE II or BINDING SITE III of FIG. 8. Table 4 illustrates the complementarity of the nucleotide sequences of MFAP2 BINDING SITE, designated SEQ ID:2746, to the nucleotide sequence of GAM44 RNA, herein designated GAM RNA, also designated SEQ ID:287.

Another function of GAM44 is therefore inhibition of Microfibrillar-associated protein 2 (MFAP2, Accession NP_002394.1), a gene which is a component of the elastin-associated microfibrils. Accordingly, utilities of GAM44 include diagnosis, prevention and treatment of diseases and clinical conditions associated with MFAP2.

The function of MFAP2 has been established by previous studies. The extracellular matrix contains a heterogeneous population of 3-20 nanometer filaments that Low (1962) termed microfibrils. Microfibrils 10 nm in diameter are present in elastic and nonelastic tissues and have a similar, if not identical, structure and composition. Gibson et al. (1986) showed that an acidic glycoprotein of 31 kD, termed the microfibril-associated glycoprotein, is a major antigen of elastin-associated microfibrils. Other elastin-associated microfibril components include fibrillin (OMIM Ref. No.

134797) and emilin (OMIM Ref. No. 130660). Chen et al. (1993) demonstrated that the mouse Magp transcript consists of 1,037 bp; that the Magp gene has 9 exons with the initiator Met codon located in exon 2; that the gene is on mouse chromosome 4 as indicated by analysis of somatic cell hybrid lines and by fluorescence in situ hybridization; and that the Magp transcript is a widespread product of mesenchymal/connective tissue cells throughout mouse development. The human homolog of MFAP2 was cloned by Faraco et al. (1995) from a human lung cDNA library using a human probe initially identified with primers from the bovine MFAP2 gene. They also studied the genomic organization of human MFAP2. Like the bovine and murine homologs, the human gene has 8 coding exons. However, it also contains two alternatively used 5-prime untranslated exons, compared with one in each of the other species. Faraco et al. (1995) mapped the gene to 1p36.1-p35 using rodent-human somatic cell hybrids and fluorescence in situ hybridization. They used a polymorphism in intron 7 to demonstrate tight linkage to the marker D1S170 with a physical distance between the two of under 100 kb.

Full details of the abovementioned studies are described in the following publications, the disclosure of which are hereby incorporated by reference:

Gibson, M. A.; Hughes, J. L.; Fanning, J. C.; Cleary, E. G.: The major antigen of elastin-associated microfibrils is a 31-kDa glycoprotein. J. Biol. Chem. 261:11429-11436, 1986; and Faraco, J.; Bashir, M.; Rosenbloom, J.; Francke, U.: Characterization of the human gene for microfibril-associated glycoprotein (MFAP2), assignment to chromosome 1p36.1-p35, and linkage to.

Further studies establishing the function and utilities of MFAP2 are found in John Hopkins OMIM database record ID 156790, and in cited publications listed in Table 5, which are hereby incorporated by reference. Microfibrillar-associated protein 2 (MFAP2, Accession NP_059453.1) is another GAM44 target gene, herein designated TARGET GENE. MFAP2 BINDING SITE is a target binding site found in the 3' untranslated region of multiple transcripts of mRNA encoded by MFAP2, corresponding to a target binding site such as BINDING SITE I, BINDING SITE II or BINDING SITE III of FIG. 8. Table 4 illustrates the complementarity of the nucleotide sequences of MFAP2 BINDING SITE, designated SEQ ID:2746, to the nucleotide sequence of GAM44 RNA, herein designated GAM RNA, also designated SEQ ID:287.

Another function of GAM44 is therefore inhibition of Microfibrillar-associated protein 2 (MFAP2, Accession NP_059453.1), a gene which is a component of the elastin-associated microfibrils. Accordingly, utilities of GAM44 include diagnosis, prevention and treatment of diseases and clinical conditions associated with MFAP2.

The function of MFAP2 has been established by previous studies. The extracellular matrix contains a heterogeneous population of 3-20 nanometer filaments that Low (1962) termed microfibrils. Microfibrils 10 nm in diameter are present in elastic and nonelastic tissues and have a similar, if not identical, structure and composition. Gibson et al. (1986) showed that an acidic glycoprotein of 31 kD, termed the microfibril-associated glycoprotein, is a major antigen of elastin-associated microfibrils. Other elastin-associated microfibril components include fibrillin (OMIM Ref. No. 134797) and emilin (OMIM Ref. No. 130660). Chen et al. (1993) demonstrated that the mouse Magp transcript consists of 1,037 bp; that the Magp gene has 9 exons with the initiator Met codon located in exon 2; that the gene is on mouse chromosome 4 as indicated by analysis of somatic cell hybrid lines and by fluorescence in situ hybridization; and that the Magp transcript is a widespread product of mesenchymal/connective tissue cells throughout mouse development. The human homolog of MFAP2 was cloned by Faraco et al. (1995) from a human lung cDNA library using a human probe initially identified with primers from the bovine MFAP2 gene. They also studied the genomic organization of human MFAP2. Like the bovine and murine homologs, the human gene has 8 coding exons. However, it also contains two alternatively used 5-prime untranslated exons, compared with one in each of the other species. Faraco et al. (1995) mapped the gene to 1p36.1-p35 using rodent-human somatic cell hybrids and fluorescence in situ hybridization. They used a polymorphism in intron 7 to demonstrate tight linkage to the marker D1S170 with a physical distance between the two of under 100 kb.

Full details of the abovementioned studies are described in the following publications, the disclosure of which are hereby incorporated by reference:

Gibson, M. A.; Hughes, J. L.; Fanning, J. C.; Cleary, E. G.: The major antigen of elastin-associated microfibrils is a 31-kDa glycoprotein. J. Biol. Chem. 261:11429-11436, 1986; and Faraco, J.; Bashir, M.; Rosenbloom, J.; Francke, U.: Characterization of the human gene for microfibril-associated glycoprotein (MFAP2), assignment to chromosome 1p36.1-p35, and linkage to.

Further studies establishing the function and utilities of MFAP2 are found in John Hopkins OMIM database record ID 156790, and in cited publications listed in Table 5, which are hereby incorporated by reference. MGC10646 (Accession NP_116082.1) is another GAM44 target gene, herein designated TARGET GENE. MGC10646 BINDING SITE is a target binding site found in the 3' untranslated region of mRNA encoded by MGC10646, corresponding to a target binding site such as BINDING SITE I, BINDING SITE II or BINDING SITE III of FIG. 8. Table 4 illustrates the complementarity of the nucleotide sequences of MGC10646 BINDING SITE, designated SEQ ID:5646, to the nucleotide sequence of GAM44 RNA, herein designated GAM RNA, also designated SEQ ID:287.

Another function of GAM44 is therefore inhibition of MGC10646 (Accession NP_116082.1). Accordingly, utilities of GAM44 include diagnosis, prevention and treatment of diseases and clinical conditions associated with MGC10646.

MGC12435 (Accession NP_113615.1) is another GAM44 target gene, herein designated TARGET GENE. MGC12435 BINDING SITE is a target binding site found in the 3' untranslated region of mRNA encoded by MGC12435, corresponding to a target binding site such as BINDING SITE I, BINDING SITE II or BINDING SITE III of FIG. 8. Table 4 illustrates the complementarity of the nucleotide sequences of MGC12435 BINDING SITE, designated SEQ ID:7109, to the nucleotide sequence of GAM44 RNA, herein designated GAM RNA, also designated SEQ ID:287.

Another function of GAM44 is therefore inhibition of MGC12435 (Accession NP_113615.1). Accordingly, utilities of GAM44 include diagnosis, prevention and treatment of diseases and clinical conditions associated with MGC12435.

MGC13071 (Accession NP_116078.2) is another GAM44 target gene, herein designated TARGET GENE. MGC13071 BINDING SITE is a target binding site found in the 3' untranslated region of mRNA encoded by MGC13071, corresponding to a target binding site such as BINDING SITE I, BINDING SITE II or BINDING SITE III of FIG. 8. Table 4 illustrates the complementarity of the nucleotide sequences of MGC13071 BINDING SITE, designated SEQ ID:8673, to the nucleotide sequence of GAM44 RNA, herein designated GAM RNA, also designated SEQ ID:287.

Another function of GAM44 is therefore inhibition of MGC13071 (Accession NP_116078.2). Accordingly, utilities of GAM44 include diagnosis, prevention and treatment of diseases and clinical conditions associated with MGC13071.

MGC17515 (Accession NP_689684.1) is another GAM44 target gene, herein designated TARGET GENE. MGC17515 BINDING SITE is a target binding site found in the 5' untranslated region of mRNA encoded by MGC17515, corresponding to a target binding site such as BINDING SITE I, BINDING SITE II or BINDING SITE III of FIG. 8. Table 4 illustrates the complementarity of the nucleotide sequences of MGC17515 BINDING SITE, designated SEQ ID:16554, to the nucleotide sequence of GAM44 RNA, herein designated GAM RNA, also designated SEQ ID:287.

Another function of GAM44 is therefore inhibition of MGC17515 (Accession NP_689684.1). Accordingly, utilities of GAM44 include diagnosis, prevention and treatment of diseases and clinical conditions associated with MGC17515.

MGC2306 (Accession NP_002041.2) is another GAM44 target gene, herein designated TARGET GENE. MGC2306 BINDING SITE is a target binding site found in the 3' untranslated region of mRNA encoded by MGC2306, corresponding to a target binding site such as BINDING SITE I, BINDING SITE II or BINDING SITE III of FIG. 8. Table 4 illustrates the complementarity of the nucleotide sequences of MGC2306 BINDING SITE, designated SEQ ID:2059, to the nucleotide sequence of GAM44 RNA, herein designated GAM RNA, also designated SEQ ID:287.

Another function of GAM44 is therefore inhibition of MGC2306 (Accession NP_002041.2). Accordingly, utilities of GAM44 include diagnosis, prevention and treatment of diseases and clinical conditions associated with MGC2306.

MGC3101 (Accession NP_076948.1) is another GAM44 target gene, herein designated TARGET GENE. MGC3101 BINDING SITE is a target binding site found in the 3' untranslated region of mRNA encoded by MGC3101, corresponding to a target binding site such as BINDING SITE I, BINDING SITE II or BINDING SITE III of FIG. 8. Table 4 illustrates the complementarity of the nucleotide sequences of MGC3101 BINDING SITE, designated SEQ ID:6021, to the nucleotide sequence of GAM44 RNA, herein designated GAM RNA, also designated SEQ ID:287.

Another function of GAM44 is therefore inhibition of MGC3101 (Accession NP_076948.1). Accordingly, utilities of GAM44 include diagnosis, prevention and treatment of diseases and clinical conditions associated with MGC3101.

MGC33215 (Accession NP_722517.1) is another GAM44 target gene, herein designated TARGET GENE. MGC33215 BINDING SITE is a target binding site found in the 3' untranslated region of mRNA encoded by MGC33215, corresponding to a target binding site such as BINDING SITE I, BINDING SITE II or BINDING SITE III of FIG. 8. Table 4 illustrates the complementarity of the nucleotide sequences of MGC33215 BINDING SITE, designated SEQ ID:9985, to the nucleotide sequence of GAM44 RNA, herein designated GAM RNA, also designated SEQ ID:287.

Another function of GAM44 is therefore inhibition of MGC33215 (Accession NP_722517.1). Accordingly, utilities of GAM44 include diagnosis, prevention and treatment of diseases and clinical conditions associated with MGC33215.

MGC33974 (Accession NP_699181.1) is another GAM44 target gene, herein designated TARGET GENE. MGC33974 BINDING SITE is a target binding site found in the 3' untranslated region of mRNA encoded by MGC33974, corresponding to a target binding site such as BINDING SITE I, BINDING SITE II or BINDING SITE III of FIG. 8. Table 4 illustrates the complementarity of the nucleotide sequences of MGC33974 BINDING SITE, designated SEQ ID:19531, to the nucleotide sequence of GAM44 RNA, herein designated GAM RNA, also designated SEQ ID:287.

Another function of GAM44 is therefore inhibition of MGC33974 (Accession NP_699181.1). Accordingly, utilities of GAM44 include diagnosis, prevention and treatment of diseases and clinical conditions associated with MGC33974.

MGC35440 (Accession NP_694952.1) is another GAM44 target gene, herein designated TARGET GENE. MGC35440 BINDING SITE is a target binding site found in the 3' untranslated region of mRNA encoded by MGC35440, corresponding to a target binding site such as BINDING SITE I, BINDING SITE II or BINDING SITE III of FIG. 8. Table 4 illustrates the complementarity of the nucleotide sequences of MGC35440 BINDING SITE, designated SEQ ID:1776, to the nucleotide sequence of GAM44 RNA, herein designated GAM RNA, also designated SEQ ID:287.

Another function of GAM44 is therefore inhibition of MGC35440 (Accession NP_694952.1). Accordingly, utilities of GAM44 include diagnosis, prevention and treatment of diseases and clinical conditions associated with MGC35440.

Molybdenum cofactor synthesis 3 (MOCS3, Accession NP_055299.1) is another GAM44 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:4326, to the nucleotide sequence of GAM44 RNA, herein designated GAM RNA, also designated SEQ ID:287.

Another function of GAM44 is therefore inhibition of Molybdenum cofactor synthesis 3 (MOCS3, Accession NP_055299.1). Accordingly, utilities of GAM44 include diagnosis, prevention and treatment of diseases and clinical conditions associated with MOCS3.

Mitochondrial ribosomal protein l21 (MRPL21, Accession NP_852616.1) is another GAM44 target gene, herein designated TARGET GENE. MRPL21 BINDING SITE is a target binding site found in the 5' untranslated region of multiple transcripts of mRNA encoded by MRPL21, corresponding to a target binding site such as BINDING SITE I, BINDING SITE II or BINDING SITE III of FIG. 8. Table 4 illustrates the complementarity of the nucleotide sequences of MRPL21 BINDING SITE, designated SEQ ID:1724, to the nucleotide sequence of GAM44 RNA, herein designated GAM RNA, also designated SEQ ID:287.

Another function of GAM44 is therefore inhibition of Mitochondrial ribosomal protein l21 (MRPL21, Accession NP_852616.1). Accordingly, utilities of GAM44 include diagnosis, prevention and treatment of diseases and clinical conditions associated with MRPL21.

Mitochondrial ribosomal protein l30 (MRPL30, Accession NP_660213.1) is another GAM44 target gene, herein designated TARGET GENE. MRPL30 BINDING SITE is a target binding site found in the 3' untranslated region of multiple transcripts of mRNA encoded by MRPL30, corresponding to a target binding site such as BINDING SITE I, BINDING SITE II or BINDING SITE III of FIG. 8. Table 4 illustrates the complementarity of the nucleotide sequences of MRPL30 BINDING SITE, designated SEQ ID:8553, to the nucleotide sequence of GAM44 RNA, herein designated GAM RNA, also designated SEQ ID:287.

Another function of GAM44 is therefore inhibition of Mitochondrial ribosomal protein l30 (MRPL30, Accession NP_660213.1). Accordingly, utilities of GAM44 include diagnosis, prevention and treatment of diseases and clinical conditions associated with MRPL30.

Myosin, light polypeptide 9, regulatory (MYL9, Accession NP_006088.2) is another GAM44 target gene, herein designated TARGET GENE. MYL9 BINDING SITE is a target binding site found in the 3' untranslated region of multiple transcripts of mRNA encoded by MYL9, corresponding to a target binding site such as BINDING SITE I, BINDING SITE II or BINDING SITE III of FIG. 8. Table 4 illustrates the complementarity of the nucleotide sequences of MYL9 BINDING SITE, designated SEQ ID:1500, to the nucleotide sequence of GAM44 RNA, herein designated GAM RNA, also designated SEQ ID:287.

Another function of GAM44 is therefore inhibition of Myosin, light polypeptide 9, regulatory (MYL9, Accession NP_006088.2). Accordingly, utilities of GAM44 include diagnosis, prevention and treatment of diseases and clinical conditions associated with MYL9.

Myosin, light polypeptide 9, regulatory (MYL9, Accession NP_852667.1) is another GAM44 target gene, herein designated TARGET GENE. MYL9 BINDING SITE is a target binding site found in the 3' untranslated region of multiple transcripts of mRNA encoded by MYL9, corresponding to a target binding site such as BINDING SITE I, BINDING SITE II or BINDING SITE III of FIG. 8. Table 4 illustrates the complementarity of the nucleotide sequences of MYL9 BINDING SITE, designated SEQ ID:1500, to the nucleotide sequence of GAM44 RNA, herein designated GAM RNA, also designated SEQ ID:287.

Another function of GAM44 is therefore inhibition of Myosin, light polypeptide 9, regulatory (MYL9, Accession NP_852667.1). Accordingly, utilities of GAM44 include diagnosis, prevention and treatment of diseases and clinical conditions associated with MYL9.

Neural cell adhesion molecule 2 (NCAM2, Accession NP_004531.1) is another GAM44 target gene, herein designated TARGET GENE. NCAM2 BINDING SITE is a target binding site found in the 3' untranslated region of mRNA encoded by NCAM2, corresponding to a target binding site such as BINDING SITE I, BINDING SITE II or BINDING SITE III of FIG. 8. Table 4 illustrates the complementarity of the nucleotide sequences of NCAM2 BINDING SITE, designated SEQ ID:15637, to the nucleotide sequence of GAM44 RNA, herein designated GAM RNA, also designated SEQ ID:287.

Another function of GAM44 is therefore inhibition of Neural cell adhesion molecule 2 (NCAM2, Accession NP_004531.1). Accordingly, utilities of GAM44 include diagnosis, prevention and treatment of diseases and clinical conditions associated with NCAM2.

Nima (never in mitosis gene a)-related kinase 6 (NEK6, Accession NP_055212.2) is another GAM44 target gene, herein designated TARGET GENE. NEK6 BINDING SITE is a target binding site found in the 3' untranslated region of mRNA encoded by NEK6, corresponding to a target binding site such as BINDING SITE I, BINDING SITE II or BINDING SITE III of FIG. 8. Table 4 illustrates the complementarity of the nucleotide sequences of NEK6 BINDING SITE, designated SEQ ID:1469, to the nucleotide sequence of GAM44 RNA, herein designated GAM RNA, also designated SEQ ID:287.

Another function of GAM44 is therefore inhibition of Nima (never in mitosis gene a)-related kinase 6 (NEK6, Accession NP_055212.2), a gene which regulates nuclear and cytoplasmic aspects of the mitotic cycle. Accordingly, utilities of GAM44 include diagnosis, prevention and treatment of diseases and clinical conditions associated with NEK6.

The function of NEK6 has been established by previous studies. The Aspergillus nidulans 'never in mitosis A' (NIMA) gene encodes a serine/threonine kinase that controls initiation of mitosis. NIMA-related kinases (NEKs) are a group of protein kinases that are homologous to NIMA. Evidence suggests that NEKs perform functions similar to those of NIMA. Li et al. (1999) reported the cloning of a human liver cDNA encoding NEK6. Kimura and Okano (2001) determined that NEK6 and NEK7 (OMIM Ref. No. 606848) share 77% amino acid identity. By Northern blot analysis, Li et al. (1999) detected 1.6-, 2.6-, and 9.5-kb NEK6 transcripts. The 1.6-kb transcript was expressed at highest levels in liver and placenta. By RT-PCR, Kimura and Okano (2001) found expression of NEK6 in all tissues examined.

Full details of the abovementioned studies are described in the following publications, the disclosure of which are hereby incorporated by reference:

Kimura, M.; Okano, Y.: Identification and assignment of the human NIMA-related protein kinase 7 gene (NEK7) to human chromosome 1q31.3. Cytogenet. Cell Genet. 94:33-38, 2001; and Li, M. Z.; y, L.; Liu, Q.; Chu, J. Y.; Zhao, S. Y.: Assignment of NEK6, a NIMA-related gene, to human chromosome 9q33.3-q34.11 by radiation hybrid mapping. Cytogenet. Cell Genet. 87.

Further studies establishing the function and utilities of NEK6 are found in John Hopkins OMIM database record ID 604884, and in cited publications listed in Table 5, which are hereby incorporated by reference. NFASC (Accession XP_046808.8) is another GAM44 target gene, herein designated TARGET GENE. NFASC BINDING SITE is a target binding site found in the 3' untranslated region of mRNA encoded by NFASC, corresponding to a target binding site such as BINDING SITE I, BINDING SITE II or BINDING SITE III of FIG. 8. Table 4 illustrates the complementarity of the nucleotide sequences of NFASC BINDING SITE, designated SEQ ID:8725, to the nucleotide sequence of GAM44 RNA, herein designated GAM RNA, also designated SEQ ID:287.

Another function of GAM44 is therefore inhibition of NFASC (Accession XP_046808.8). Accordingly, utilities of GAM44 include diagnosis, prevention and treatment of diseases and clinical conditions associated with NFASC.

NK4 (Accession NP_004212.3) is another GAM44 target gene, herein designated TARGET GENE. NK4 BINDING SITE is a target binding site found in the 3' untranslated region of mRNA encoded by NK4, corresponding to a target binding site such as BINDING SITE I, BINDING SITE II or BINDING SITE III of FIG. 8. Table 4 illustrates the complementarity of the nucleotide sequences of NK4 BINDING SITE, designated SEQ ID:19318, to the nucleotide sequence of GAM44 RNA, herein designated GAM RNA, also designated SEQ ID:287.

Another function of GAM44 is therefore inhibition of NK4 (Accession NP_004212.3). Accordingly, utilities of GAM44 include diagnosis, prevention and treatment of diseases and clinical conditions associated with NK4.

NP220 (Accession NP_055312.2) is another GAM44 target gene, herein designated TARGET GENE. NP220 BINDING SITE is a target binding site found in the 5' untranslated region of mRNA encoded by NP220, corresponding to a target binding site such as BINDING SITE I, BINDING SITE II or BINDING SITE III of FIG. 8. Table 4 illustrates the complementarity of the nucleotide sequences of NP220 BINDING SITE, designated SEQ ID:9969, to the nucleotide sequence of GAM44 RNA, herein designated GAM RNA, also designated SEQ ID:287.

Another function of GAM44 is therefore inhibition of NP220 (Accession NP_055312.2). Accordingly, utilities of GAM44 include diagnosis, prevention and treatment of diseases and clinical conditions associated with NP220.

Neuronal pentraxin receptor (NPTXR, Accession NP_055108.2) is another GAM44 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:3192, to the nucleotide sequence of GAM44 RNA, herein designated GAM RNA, also designated SEQ ID:287.

Another function of GAM44 is therefore inhibition of Neuronal pentraxin receptor (NPTXR, Accession NP_055108.2). Accordingly, utilities of GAM44 include diagnosis, prevention and treatment of diseases and clinical conditions associated with NPTXR.

Neuronal pentraxin receptor (NPTXR, Accession NP_478058.1) is another GAM44 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:3192, to the nucleotide sequence of GAM44 RNA, herein designated GAM RNA, also designated SEQ ID:287.

Another function of GAM44 is therefore inhibition of Neuronal pentraxin receptor (NPTXR, Accession NP_478058.1). Accordingly, utilities of GAM44 include diagnosis, prevention and treatment of diseases and clinical conditions associated with NPTXR.

Purinergic receptor p2x, ligand-gated ion channel, 5 (P2RX5, Accession NP_002552.2) is another GAM44 target gene, herein designated TARGET GENE. P2RX5 BINDING SITE is a target binding site found in the 3' untranslated region of multiple transcripts of mRNA encoded by P2RX5, corresponding to a target binding site such as BINDING SITE I, BINDING SITE II or BINDING SITE III of FIG. 8. Table 4 illustrates the complementarity of the nucleotide sequences of P2RX5 BINDING SITE, designated SEQ ID:4268, to the nucleotide sequence of GAM44 RNA, herein designated GAM RNA, also designated SEQ ID:287.

Another function of GAM44 is therefore inhibition of Purinergic receptor p2x, ligand-gated ion channel, 5 (P2RX5, Accession NP_002552.2). Accordingly, utilities of GAM44 include diagnosis, prevention and treatment of diseases and clinical conditions associated with P2RX5.

Purinergic receptor p2x, ligand-gated ion channel, 5 (P2RX5, Accession NP_778255.1) is another GAM44 target gene, herein designated TARGET GENE. P2RX5 BINDING SITE is a target binding site found in the 3' untranslated region of multiple transcripts of mRNA encoded by P2RX5, corresponding to a target binding site such as BINDING SITE I, BINDING SITE II or BINDING SITE III of FIG. 8. Table 4 illustrates the complementarity of the nucleotide sequences of P2RX5 BINDING SITE, designated SEQ ID:4268, to the nucleotide sequence of GAM44 RNA, herein designated GAM RNA, also designated SEQ ID:287.

Another function of GAM44 is therefore inhibition of Purinergic receptor p2x, ligand-gated ion channel, 5 (P2RX5, Accession NP_778255.1). Accordingly, utilities of GAM44 include diagnosis, prevention and treatment of diseases and clinical conditions associated with P2RX5.

Phosphodiesterase 5a, cgmp-specific (PDE5A, Accession NP_246273.1) is another GAM44 target gene, herein designated TARGET GENE. PDE5A BINDING SITE is a target binding site found in the 5' untranslated region of multiple transcripts of mRNA encoded by PDE5A, corresponding to a target binding site such as BINDING SITE I, BINDING SITE II or BINDING SITE III of FIG. 8. Table 4 illustrates the complementarity of the nucleotide sequences of PDE5A BINDING SITE, designated SEQ ID:19020, to the nucleotide sequence of GAM44 RNA, herein designated GAM RNA, also designated SEQ ID:287.

Another function of GAM44 is therefore inhibition of Phosphodiesterase 5a, cgmp-specific (PDE5A, Accession NP_246273.1), a gene which plays a role in signal transduction by regulating the intracellular concentration of cyclic nucleotides. Accordingly, utilities of GAM44 include diagnosis, prevention and treatment of diseases and clinical conditions associated with PDE5A.

The function of PDE5A has been established by previous studies. Cyclic nucleotide phosphodiesterases (PDEs; EC 3.1.4.17) are a superfamily of enzymes that catalyze the hydrolysis of 3-prime, 5-prime-cyclic nucleotides to the corresponding nucleoside 5-prime-monophosphates. The PDEs have been subdivided into several families on the basis of sequence, substrate specificity, kinetic properties, and regulatory features. See 171885. Members of the PDE5 family are cGMP-binding, cGMP-specific enzymes. By screening several human cDNA libraries with a bovine PDE5 cDNA, Loughney et al. (1998) isolated cDNAs encoding human PDE5A. The predicted 875-amino acid human protein is approximately 96% identical to bovine PDE5A. Like the bovine protein, human PDE5A contains a cGMP-binding domain in its N-terminal portion and a catalytic domain in its C-terminal region. Recombinant PDE5A protein hydrolyzed cGMP in vitro. Northern blot analysis revealed that PDE5A is expressed as a 7.9-kb mRNA and a less abundant 6-kb mRNA in various human tissues. Loughney et al. (1998) isolated an alternatively spliced PDE5A mRNA, PDE5A2, which encodes a protein with a differing N terminus. Independently, Stacey et al. (1998) and Yanaka et al. (1998) cloned PDE5A cDNAs. Yanaka et al. (1998) reported that the PDE5A gene contains 21 exons and spans more than 100 kb.

Full details of the abovementioned studies are described in the following publications, the disclosure of which are hereby incorporated by reference:

Loughney, K.; Hill, T. R.; Florio, V. A.; Uher, L.; Rosman, G. J.; Wolda, S. L.; Jones, B. A.; Howard, M. L.; McAllister-Lucas, L. M.; Sonnenburg, W. K.; Francis, S. H.; Corbin, J. D.; Beavo, J. A.; Ferguson, K.: Isolation and characterization of cDNAs encoding PDE5A, a human cGMP-binding, cGMP-specific 3-prime,5-prime-cyclic nucleotide phosphodiesterase. Gene 216:139-147, 1998; and Stacey, P.; Rulten, S.; Dapling, A.; Phillips, S. C.: Molecular cloning and expression of human cGMP-binding cGMP-specific phosphodiesterase (PDE5). Biochem. Biophys. Res. Commun. 247.

Further studies establishing the function and utilities of PDE5A are found in John Hopkins OMIM database record ID 603310, and in cited publications listed in Table 5, which are hereby incorporated by reference. Pellino homolog 2 (drosophila) (PELI2, Accession NP_067078.1) is another GAM44target gene, herein designated TARGET GENE. PELI2 BINDING SITE is a target binding site found in the 3' untranslated region of mRNA encoded by PELI2, corresponding to a target binding site such as BINDING SITE I, BINDING SITE II or BINDING SITE III of FIG. 8. Table 4 illustrates the complementarity of the nucleotide sequences of PELI2 BINDING SITE, designated SEQ ID:7435, to the nucleotide sequence of GAM44 RNA, herein designated GAM RNA, also designated SEQ ID:287.

Another function of GAM44 is therefore inhibition of Pellino homolog 2 (drosophila) (PELI2, Accession NP_067078.1). Accordingly, utilities of GAM44 include diagnosis, prevention and treatment of diseases and clinical conditions associated with PELI2.

Peptidase d (PEPD, Accession NP_000276.1) is another GAM44 target gene, herein designated TARGET GENE. PEPD BINDING SITE is a target binding site found in the 3' untranslated region of mRNA encoded by PEPD, corresponding to a target binding site such as BINDING SITE I, BINDING SITE II or BINDING SITE III of FIG. 8. Table 4 illustrates the complementarity of the nucleotide sequences of PEPD BINDING SITE, designated SEQ ID:4327, to the nucleotide sequence of GAM44 RNA, herein designated GAM RNA, also designated SEQ ID:287.

Another function of GAM44 is therefore inhibition of Peptidase d (PEPD, Accession NP_000276.1). Accordingly, utilities of GAM44 include diagnosis, prevention and treatment of diseases and clinical conditions associated with PEPD.

PILRB (Accession NP_778212.2) is another GAM44 target gene, herein designated TARGET GENE. PILRB BINDING SITE is a target binding site found in the 5' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:5459, to the nucleotide sequence of GAM44 RNA, herein designated GAM RNA, also designated SEQ ID:287.

Another function of GAM44 is therefore inhibition of PILRB (Accession NP_778212.2). Accordingly, utilities of GAM44 include diagnosis, prevention and treatment of diseases and clinical conditions associated with PILRB.

PILRB (Accession NP_038468.3) is another GAM44 target gene, herein designated TARGET GENE. PILRB BINDING SITE is a target binding site found in the 5' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:5459, to the nucleotide sequence of GAM44 RNA, herein designated GAM RNA, also designated SEQ ID:287.

Another function of GAM44 is therefore inhibition of PILRB (Accession NP_038468.3). Accordingly, utilities of GAM44 include diagnosis, prevention and treatment of diseases and clinical conditions associated with PILRB.

Pogo transposable element with znf domain (POGZ, Accession NP_055915.1) is another GAM44 target gene, herein designated TARGET GENE. POGZ BINDING SITE is a target binding site found in the 3' untranslated region of multiple transcripts of mRNA encoded by POGZ, corresponding to a target binding site such as BINDING SITE I, BINDING SITE II or BINDING SITE III of FIG. 8. Table 4 illustrates the complementarity of the nucleotide sequences of POGZ BINDING SITE, designated SEQ ID:11143, to the nucleotide sequence of GAM44 RNA, herein designated GAM RNA, also designated SEQ ID:287.

Another function of GAM44 is therefore inhibition of Pogo transposable element with znf domain (POGZ, Accession NP_055915.1). Accordingly, utilities of GAM44 include diagnosis, prevention and treatment of diseases and clinical conditions associated with POGZ.

Polymerase (rna) ii (dna directed) polypeptide d (POLR2D, Accession NP_004796.1) is another GAM44 target gene, herein designated TARGET GENE. POLR2D BINDING SITE is a target binding site found in the 3' untranslated region of mRNA encoded by POLR2D, corresponding to a target binding site such as BINDING SITE I, BINDING SITE II or BINDING SITE III of FIG. 8. Table 4 illustrates the complementarity of the nucleotide sequences of POLR2D BINDING SITE, designated SEQ ID:4052, to the nucleotide sequence of GAM44 RNA, herein designated GAM RNA, also designated SEQ ID:287.

Another function of GAM44 is therefore inhibition of Polymerase (rna) ii (dna directed) polypeptide d (POLR2D, Accession NP_004796.1). Accordingly, utilities of GAM44 include diagnosis, prevention and treatment of diseases and clinical conditions associated with POLR2D.

Pou domain, class 2, associating factor 1 (POU2AF1, Accession NP_006226.1) is another GAM44 target gene, herein designated TARGET GENE. POU2AF1 BINDING SITE is a target binding site found in the 5' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:16639, to the nucleotide sequence of GAM44 RNA, herein designated GAM RNA, also designated SEQ ID:287.

Another function of GAM44 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM44 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. Protein phosphatase 1, regulatory (inhibitor) subunit 3a (glycogen and sarcoplasmic reticulum binding subunit, skeletal muscle) (PPP1R3A, Accession NP_002702.1) is another GAM44 target gene, herein designated TARGET GENE. PPP1R3A BINDING SITE is a target binding site found in the 3' untranslated region of mRNA encoded by PPP1R3A, corresponding to a target binding site such as BINDING SITE I, BINDING SITE II or BINDING SITE III of FIG. 8. Table 4 illustrates the complementarity of the nucleotide sequences of PPP1R3A BINDING SITE, designated SEQ ID:20165, to the nucleotide sequence of GAM44 RNA, herein designated GAM RNA, also designated SEQ ID:287.

Another function of GAM44 is therefore inhibition of Protein phosphatase 1, regulatory (inhibitor) subunit 3a (glycogen and sarcoplasmic reticulum binding subunit, skeletal muscle) (PPP1R3A, Accession NP_002702.1), a gene which regulates phosphatase activity towards glycogen synthase, active in skeletal muscle and therefore may be associated with Insulin resistance and glycemia variation. Accordingly, utilities of GAM44 include diagnosis, prevention and treatment of Insulin resistance and glycemia variation, and of other diseases and clinical conditions associated with PPP1R3A.

The function of PPP1R3A has been established by previous studies. The glycogen-associated form of protein phosphatase-1 (PP1) derived from skeletal muscle is a heterodimer composed of a 37-kD catalytic subunit (OMIM Ref. No. 176875) and a 124-kD targeting and regulatory subunit, referred to as PP1G by Hansen et al. (1995). PP1G binds to muscle glycogen with high affinity, thereby enhancing dephosphorylation of glycogen-bound substrates for PP1 such as glycogen synthase (e.g., 138570) and glycogen phosphorylase kinase (e.g., 306000). Phosphorylation at ser46 of the PP1G subunit in response to insulin increases PP1 activity, while phosphorylation at ser65 in response to adrenaline causes dissociation of the catalytic subunit from the G subunit and inhibits glycogen synthesis. Because of these functions, PP1G was postulated to be involved in noninsulin-dependent diabetes mellitus (NIDDM; 125853) and obesity. Savage et al. (2002) described an example of digenic inheritance of severe insulin resistance. In a family they referred to as 'a Europid pedigree' they found 5 members with severe insulin resistance and heterozygosity for frameshift/premature stop mutations in each of 2 unlinked genes, PPARG (601487.0011) and PPP1R3A (600917.0003). PPARG is highly expressed in adipocytes, and PPP1R3A, the muscle-specific regulatory subunit of protein phosphatase 1, is centrally involved in the regulation of carbohydrate and lipid metabolism, respectively. That mutant molecules primarily involved in either carbohydrate or lipid metabolism can combine to produce a phenotype of extreme insulin resistance provides a model of interaction among genes that may underlie common human metabolic disorders such as type 2 diabetes (NIDDM). In the Europid family reported by Savage et al. (2002), the grandfather was heterozygous for the PPARG mutation, the grandmother was heterozygous for the PPP1R3A mutation. Three of their children and 2 of their grandchildren carried both mutations in heterozygous state, and all 5, but only these 5, had severe insulin resistance manifest by acanthosis nigricans, a dermatologic marker of extreme insulin resistance, and markedly elevated fasting plasma insulin levels.

Full details of the abovementioned studies are described in the following publications, the disclosure of which are hereby incorporated by reference:

Savage, D. B.; Agostini, M.; Barroso, I.; Gurnell, M.; Luan, J.; Meirhaeghe, A.; Harding, A.-H.; Ihrke, G.; Rajanayagam, O.; Soos, M. A.; George, S.; Berger, D.; and 9 others: Digenic inheritance of severe insulin resistance in a human pedigree. Nature Genet. 31:379-384, 2002; and Tang, P. M.; Bondor, J. A.; Swiderek, K. M.; DePaoli-Roach, A. A.: Molecular cloning and expression of the regulatory (RG1) subunit of the glycogen-associated protein phosphatase. J. B.

Further studies establishing the function and utilities of PPP1R3A are found in John Hopkins OMIM database record ID 600917, and in cited publications listed in Table 5, which are hereby incorporated by reference. Pr domain containing 2, with znf domain (PRDM2, Accession NP_056950.2) is another GAM44 target gene, herein designated TARGET GENE. PRDM2 BINDING SITE is a target binding site found in the 3' untranslated region of multiple transcripts of mRNA encoded by PRDM2, corresponding to a target binding site such as BINDING SITE I, BINDING SITE II or BINDING SITE III of FIG. 8. Table 4 illustrates the complementarity of the nucleotide sequences of PRDM2 BINDING SITE, designated SEQ ID:12854, to the nucleotide sequence of GAM44 RNA, herein designated GAM RNA, also designated SEQ ID:287.

Another function of GAM44 is therefore inhibition of Pr domain containing 2, with znf domain (PRDM2, Accession NP_056950.2), a gene which plays a role in transcriptional regulation during neuronal differentiation and pathogenesis of retinoblastoma. and therefore may be associated with Tumor. Accordingly, utilities of GAM44 include diagnosis, prevention and treatment of Tumor, and of other diseases and clinical conditions associated with PRDM2.

The function of PRDM2 has been established by previous studies. The retinoblastoma protein (OMIM Ref. No. 180200) is a target of viral oncoproteins. To explore the hypothesis that viral proteins may be structural mimics of cellular RB- binding proteins that normally mediate RB function, Buyse et al. (1995) searched cDNA libraries for RB-binding proteins. They reported the cloning of a cDNA for the zinc finger protein they called RIZ from rat and human cells. It is a 250-kD nuclear protein containing 8 zinc finger motifs. It contains an RB-binding motif that is related to that of the adenovirus E1A oncoprotein; RIZ also shares an antigenic epitope with the C terminus of E1A. It is expressed in human retinoblastoma cells and at low levels in all other human cell lines examined. While the function of RIZ was not clear, its structure and pattern of expression suggested to Buyse et al. (1995) a role in transcriptional regulation during neuronal differentiation and pathogenesis of retinoblastoma. The distal portion of chromosome 1p is one of the most commonly affected regions in human cancer. In a study of hereditary and sporadic colorectal cancer, Chadwick et al. (2000) identified a region of frequent deletion at 32.2 centimorgans from 1ptel. Deletion breakpoints clustered in the vicinity of or inside the gene RIZ. Sequence analysis demonstrated frequent frameshift mutations of the RIZ gene. The mutations consisted of 1-or 2-bp deletions of coding poly(A) tracts (A)8 or (A)9, and were confined to microsatellite-unstable colorectal tumors, being present in 9 of 24 (37.5%) primary tumors and in 6 of 11 (54.5%) cell lines; in 2 cell lines the mutation was homozygous (or hemizygous). The mutations apparently were selected clonally in tumorigenesis, because similar poly(A) tracts in other genes were not affected. Of the 2 alternative products of the gene, RIZ1 contains a PR domain implicated in tumor suppressor function and RIZ2 lacks this motif. Chadwick et al. (2000) proposed that RIZ is a target of observed 1p alterations, with impairment of the PR domain-mediated function through either frameshift mutation or genomic deletion.

Full details of the abovementioned studies are described in the following publications, the disclosure of which are hereby incorporated by reference:

Buyse, I. M.; Shao, G.; Huang, S.: The retinoblastoma protein binds to RIZ, a zinc-finger protein that shares an epitope with the adenovirus E1A protein. Proc. Nat. Acad. Sci. 92:4467-4471, 1995; and Chadwick, R. B.; Jiang, G.-L.; Bennington, G. A.; Yuan, B.; Johnson, C. K.; Stevens, M. W.; Niemann, T. H.; Peltomaki, P.; Huang, S.; de la Chapelle, A.: Candidate tumor suppressor RIZ.

Further studies establishing the function and utilities of PRDM2 are found in John Hopkins OMIM database record ID 601196, and in cited publications listed in Table 5, which are hereby incorporated by reference. Protein kinase c, nu (PRKCN, Accession NP_005804.1) is another GAM44 target gene, herein designated TARGET GENE. PRKCN BINDING SITE is a target binding site found in the 3' untranslated region of mRNA encoded by PRKCN, corresponding to a target binding site such as BINDING SITE I, BINDING SITE II or BINDING SITE III of FIG. 8. Table 4 illustrates the complementarity of the nucleotide sequences of PRKCN BINDING SITE, designated SEQ ID:19159, to the nucleotide sequence of GAM44 RNA, herein designated GAM RNA, also designated SEQ ID:287.

Another function of GAM44 is therefore inhibition of Protein kinase c, nu (PRKCN, Accession NP_005804.1). Accordingly, utilities of GAM44 include diagnosis, prevention and treatment of diseases and clinical conditions associated with PRKCN.

PRO0461 (Accession NP_112558.1) is another GAM44 target gene, herein designated TARGET GENE. PRO0461 BINDING SITE is a target binding site found in the 5' untranslated region of mRNA encoded by PRO0461, corresponding to a target binding site such as BINDING SITE I, BINDING SITE II or BINDING SITE III of FIG. 8. Table 4 illustrates the complementarity of the nucleotide sequences of PRO0461 BINDING SITE, designated SEQ ID:19001, to the nucleotide sequence of GAM44 RNA, herein designated GAM RNA, also designated SEQ ID:287.

Another function of GAM44 is therefore inhibition of PRO0461 (Accession NP_112558.1). Accordingly, utilities of GAM44 include diagnosis, prevention and treatment of diseases and clinical conditions associated with PRO0461.

Pyrroline-5-carboxylate reductase 1 (PYCR1, Accession NP_008838.2) is another GAM44 target gene, herein designated TARGET GENE. PYCR1 BINDING SITE1 and PYCR1 BINDING SITE2 are target binding sites found in untranslated regions of multiple transcripts of mRNA encoded by PYCR1, corresponding to target binding sites such as BINDING SITE I, BINDING SITE II or BINDING SITE III of FIG. 8. Table 4 illustrates the complementarity of the nucleotide sequences of PYCR1 BINDING SITE1 and PYCR1 BINDING SITE2, designated SEQ ID:17062 and SEQ ID:7092 respectively, to the nucleotide sequence of GAM44 RNA, herein designated GAM RNA, also designated SEQ ID:287.

Another function of GAM44 is therefore inhibition of Pyrroline-5-carboxylate reductase 1 (PYCR1, Accession NP_008838.2), a gene which catalyzes the NAD(P)H-dependent conversion of pyrroline-5-carboxylate to proline. Accordingly, utilities of GAM44 include diagnosis, prevention and treatment of diseases and clinical conditions associated with PYCR1.

The function of PYCR1 has been established by previous studies. Pyrroline- 5-carboxylate reductase (EC 1.5.1.2) catalyzes the NAD(P)H-dependent conversion of pyrroline-5-carboxylate to proline. Merrill et al. (1989) studied the properties of human erythrocyte pyrroline-5-carboxylate reductase. They concluded that in addition to the traditional role of catalyzing the obligatory and final unidirectional step in pyrroline biosynthesis, the enzyme may play a physiologic role in the generation of NADP(+) in some cell types including human erythrocytes. Dougherty et al. (1992) cloned a cDNA by complementation of proline auxotrophy in a Saccharomyces cerevisiae mutant strain (OMIM Ref. No. 'pro3'). The 1,810-bp cDNA hybridized to a 1.85-kb mRNA in samples from human cell lines and predicated a 319-amino acid, 33.4-kD protein. Studies of somatic cell hybrids indicated that PYCR1 is a single-copy gene that is located on chromosome 17.

Full details of the abovementioned studies are described in the following publications, the disclosure of which are hereby incorporated by reference:

Dougherty, K. M.; Brandriss, M. C.; Valle, D.: Cloning human pyrroline-5-carboxylate reductase cDNA by complementation in Saccharomyces cerevisiae. J. Biol. Chem. 267: 871-875, 1992; and Merrill, M. J.; Yeh, G. C.; Phang, J. M.: Purified human erythrocyte pyrroline-5-carboxylate reductase: preferential oxidation of NADPH. J. Biol. Chem. 264:9352-9358, 1989.

Further studies establishing the function and utilities of PYCR1 are found in John Hopkins OMIM database record ID 179035, and in cited publications listed in Table 5, which are hereby incorporated by reference. Rab11-FIP2 (Accession NP_055719.1) is another GAM44 target gene, herein designated TARGET GENE. Rab11-FIP2 BINDING SITE is a target binding site found in the 3' untranslated region of mRNA encoded by Rab11-FIP2, corresponding to a target binding site such as BINDING SITE I, BINDING SITE II or BINDING SITE III of FIG. 8. Table 4 illustrates the complementarity of the nucleotide sequences of Rab11-FIP2 BINDING SITE, designated SEQ ID:7165, to the nucleotide sequence of GAM44 RNA, herein designated GAM RNA, also designated SEQ ID:287.

Another function of GAM44 is therefore inhibition of Rab11-FIP2 (Accession NP_055719.1). Accordingly, utilities of GAM44 include diagnosis, prevention and treatment of diseases and clinical conditions associated with Rab11-FIP2.

Rab39b, member ras oncogene family (RAB39B, Accession NP_741995.1) is another GAM44 target gene, herein designated TARGET GENE. RAB39B BINDING SITE is a target binding site found in the 3' untranslated region of mRNA encoded by RAB39B, corresponding to a target binding site such as BINDING SITE I, BINDING SITE II or BINDING SITE III of FIG. 8. Table 4 illustrates the complementarity of the nucleotide sequences of RAB39B BINDING SITE, designated SEQ ID:14419, to the nucleotide sequence of GAM44 RNA, herein designated GAM RNA, also designated SEQ ID:287.

Another function of GAM44 is therefore inhibition of Rab39b, member ras oncogene family (RAB39B, Accession NP_741995.1). Accordingly, utilities of GAM44 include diagnosis, prevention and treatment of diseases and clinical conditions associated with RAB39B.

Rap1b, member of ras oncogene family (RAP1B, Accession NP_056461.1) is another GAM44 target gene, herein designated TARGET GENE. RAP1B BINDING SITE is a target binding site found in the 3' untranslated region of mRNA encoded by RAP1B, corresponding to a target binding site such as BINDING SITE I, BINDING SITE II or BINDING SITE III of FIG. 8. Table 4 illustrates the complementarity of the nucleotide sequences of RAP1B BINDING SITE, designated SEQ ID:7459, to the nucleotide sequence of GAM44 RNA, herein designated GAM RNA, also designated SEQ ID:287.

Another function of GAM44 is therefore inhibition of Rap1b, member of ras oncogene family (RAP1B, Accession NP_056461.1), a gene which induces morphological reversion of a cell line transformed by a ras oncogene. Accordingly, utilities of GAM44 include diagnosis, prevention and treatment of diseases and clinical conditions associated with RAP1B.

The function of RAP1B has been established by previous studies. Three human cDNAs encoding 'new' RAS-related proteins, designated RAP1A, RAP1B, and RAP2, were isolated by Pizon et al. (1988). These proteins share approximately 50% amino acid identity with the classical RAS proteins and have numerous structural features in common. The most striking difference between the RAP and RAS proteins resides in their 61st amino acid: glutamine in RAS is replaced by threonine in RAP proteins.

Animal model experiments lend further support to the function of RAP1B. Using mice transgenic for constitutive expression of Rap1a within the T cell lineage, Sebzda et al. (2002) found that instead of anergy, these T cells showed enhanced T cell receptor-mediated responses, both in thymocytes and in mature T cells. In addition, Rap1a activation induces strong activation of beta-1 (OMIM Ref. No. 135630) and beta-2 (OMIM Ref. No. 600065) integrins. The authors concluded that Rap1a positively influences T cells by augmenting their responses and directing integrin activation.

It is appreciated that the abovementioned animal model for RAP1B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pizon, V.; Chardin, P.; Lerosey, I.; Olofsson, B.; Tavitian, A.: Human cDNAs RAP1 and RAP2 homologous to the Drosophila gene Dras3 encode proteins closely related to ras in the 'effector' region. Oncogene 3:201-204, 1988; and Kitayama, H.; Sugimoto, Y.; Matsuzaki, T.; Ikawa, Y.; Noda, M.: A ras-related gene with transformation suppressor activity. Cell 56:77-84, 1989. PubMed ID:2642744 9. Sebzda, E.; Brac.

Further studies establishing the function and utilities of RAP1B are found in John Hopkins OMIM database record ID 179530, and in cited publications listed in Table 5, which are hereby incorporated by reference. Rap2a, member of ras oncogene family (RAP2A, Accession NP_066361.1) is another GAM44 target gene, herein designated TARGET GENE. RAP2A BINDING SITE is a target binding site found in the 3' untranslated region of mRNA encoded by RAP2A, corresponding to a target binding site such as BINDING SITE I, BINDING SITE II or BINDING SITE III of FIG. 8. Table 4 illustrates the complementarity of the nucleotide sequences of RAP2A BINDING SITE, designated SEQ ID:12939, to the nucleotide sequence of GAM44 RNA, herein designated GAM RNA, also designated SEQ ID:287.

Another function of GAM44 is therefore inhibition of Rap2a, member of ras oncogene family (RAP2A, Accession NP_066361.1). Accordingly, utilities of GAM44 include diagnosis, prevention and treatment of diseases and clinical conditions associated with RAP2A.

Ras guanyl releasing protein 2 (calcium and dag-regulated) (RASGRP2, Accession NP_722541.1) is another GAM44 target gene, herein designated TARGET GENE. RASGRP2 BINDING SITE is a target binding site found in the 5' untranslated region of multiple transcripts of mRNA encoded by RASGRP2, corresponding to a target binding site such as BINDING SITE I, BINDING SITE II or BINDING SITE III of FIG. 8. Table 4 illustrates the complementarity of the nucleotide sequences of RASGRP2 BINDING SITE, designated SEQ ID:18244, to the nucleotide sequence of GAM44 RNA, herein designated GAM RNA, also designated SEQ ID:287.

Another function of GAM44 is therefore inhibition of Ras guanyl releasing protein 2 (calcium and dag-regulated) (RASGRP2, Accession NP_722541.1), a gene which promotes the exchange of ras-bound gdp by gtp. Accordingly, utilities of GAM44 include diagnosis, prevention and treatment of diseases and clinical conditions associated with RASGRP2.

The function of RASGRP2 has been established by previous studies. Rap proteins (see OMIM Ref. No. RAP1A; 179520) are members of the Ras small G protein superfamily that can inhibit Ras signaling through the Ras/RAF1 (OMIM Ref. No. 164760)/mitogen-activated protein kinase (MAPK) pathway, or, through BRAF (OMIM Ref. No. 164757), can activate MAPK. Like Ras, Rap proteins can be activated through guanine nucleotide exchange factors, or GEFs (e.g., RASGRP1; 603962). By screening a frontal cortex cDNA library, Kawasaki et al. (1998) isolated a cDNA encoding RASGRP2, which they termed CALDAG-GEFI. The deduced 609-amino acid protein has an N-terminal GEF domain, 2 tandem repeats of EF-hand calcium-binding motifs, and a C-terminal diacylglycerol/phorbol ester- binding domain. Cells transfected with RASGRP2 showed a dramatic increase in GTP-bound RAP1A without activation of Ras proteins. Expression of RASGRP2 reduced RasV12 activation of ELK1 (OMIM Ref. No. 311040). Northern blot analysis detected an approximately 2.5-kb transcript in brain, with a striking enrichment in the striatum. Immunohistochemistry showed a basal ganglia-enriched distribution pattern in adult rat brain.

Full details of the abovementioned studies are described in the following publications, the disclosure of which are hereby incorporated by reference:

Kawasaki, H.; Springett, G. M.; Toki, S.; Canales, J. J.; Harlan, P.; Blumenstiel, J. P.; Chen, E. J.; Bany, I. A.; Mochizuki, N.; Ashbacher, A.; Matsuda, M.; Housman, D. E.; Graybiel, A. M.: A Rap guanine nucleotide exchange factor enriched highly in the basal ganglia. Proc. Nat. Acad. Sci. 95:13278-13283, 1998; and Kedra, D.; Seroussi, E.; Fransson, I.; Trifunovic, J.; Clark, M.; Lagercrantz, J.; Blennow, E.; Mehlin, H.; Dumanski, J.: The germinal center kinase gene and a novel CDC25-like gene are.

Further studies establishing the function and utilities of RASGRP2 are found in John Hopkins OMIM database record ID 605577, and in cited publications listed in Table 5, which are hereby incorporated by reference. Ras guanyl releasing protein 2 (calcium and dag-regulated) (RASGRP2, Accession NP_005816.2) is another GAM44 target gene, herein designated TARGET GENE. RASGRP2 BINDING SITE is a target binding site found in the 5' untranslated region of multiple transcripts of mRNA encoded by RASGRP2, corresponding to a target binding site such as BINDING SITE I, BINDING SITE II or BINDING SITE III of FIG. 8. Table 4 illustrates the complementarity of the nucleotide sequences of RASGRP2 BINDING SITE, designated SEQ ID:18244, to the nucleotide sequence of GAM44 RNA, herein designated GAM RNA, also designated SEQ ID:287.

Another function of GAM44 is therefore inhibition of Ras guanyl releasing protein 2 (calcium and dag-regulated) (RASGRP2, Accession NP_005816.2), a gene which promotes the exchange of ras-bound gdp by gtp. Accordingly, utilities of GAM44 include diagnosis, prevention and treatment of diseases and clinical conditions associated with RASGRP2.

The function of RASGRP2 has been established by previous studies. Rap proteins (see OMIM Ref. No. RAP1A; 179520) are members of the Ras small G protein superfamily that can inhibit Ras signaling through the Ras/RAF1 (OMIM Ref. No. 164760)/mitogen-activated protein kinase (MAPK) pathway, or, through BRAF (OMIM Ref. No. 164757), can activate MAPK. Like Ras, Rap proteins can be activated through guanine nucleotide exchange factors, or GEFs (e.g., RASGRP1; 603962). By screening a frontal cortex cDNA library, Kawasaki et al. (1998) isolated a cDNA encoding RASGRP2, which they termed CALDAG-GEFI. The deduced 609-amino acid protein has an N-terminal GEF domain, 2 tandem repeats of EF-hand calcium-binding motifs, and a C-terminal diacylglycerol/phorbol ester- binding domain. Cells transfected with RASGRP2 showed a dramatic increase in GTP-bound RAP1A without activation of Ras proteins. Expression of RASGRP2 reduced RasV12 activation of ELK1 (OMIM Ref. No. 311040). Northern blot analysis detected an approximately 2.5-kb transcript in brain, with a striking enrichment in the striatum. Immunohistochemistry showed a basal ganglia- enriched distribution pattern in adult rat brain.

Full details of the abovementioned studies are described in the following publications, the disclosure of which are hereby incorporated by reference:

Kawasaki, H.; Springett, G. M.; Toki, S.; Canales, J. J.; Harlan, P.; Blumenstiel, J. P.; Chen, E. J.; Bany, I. A.; Mochizuki, N.; Ashbacher, A.; Matsuda, M.; Housman, D. E.; Graybiel, A. M.: A Rap guanine nucleotide exchange factor enriched highly in the basal ganglia. Proc. Nat. Acad. Sci. 95:13278-13283, 1998; and Kedra, D.; Seroussi, E.; Fransson, I.; Trifunovic, J.; Clark, M.; Lagercrantz, J.; Blennow, E.; Mehlin, H.; Dumanski, J.: The germinal center kinase gene and a novel CDC25-like gene are.

Further studies establishing the function and utilities of RASGRP2 are found in John Hopkins OMIM database record ID 605577, and in cited publications listed in Table 5, which are hereby incorporated by reference. Ring finger protein 1 (RING1, Accession NP_002922.1) is another GAM44 target gene, herein designated TARGET GENE. RING1 BINDING SITE is a target binding site found in the 5' untranslated region of mRNA encoded by RING1, corresponding to a target binding site such as BINDING SITE I, BINDING SITE II or BINDING SITE III of FIG. 8. Table 4 illustrates the complementarity of the nucleotide sequences of RING1 BINDING SITE, designated SEQ ID:11106, to the nucleotide sequence of GAM44 RNA, herein designated GAM RNA, also designated SEQ ID:287.

Another function of GAM44 is therefore inhibition of Ring finger protein 1 (RING1, Accession NP_002922.1), a gene which involves in transcriptional regulation. Accordingly, utilities of GAM44 include diagnosis, prevention and treatment of diseases and clinical conditions associated with RING1.

The function of RING1 has been established by previous studies. The RING finger motif is a specialized zinc finger domain found in many transcriptional regulatory proteins. This motif was defined by Lovering et al. (1993) in their characterization of the human RING1 gene. They showed that the RING finger domain of RING1 was able to bind zinc with tetrahedral coordination, as well as DNA. While screening for proteins that interact with the polycomb group protein BMI1 (OMIM Ref. No. 164831), Satijn et al. (1997) isolated the RING1 protein. They showed that RING1 binds to and colocalizes with BMI and that RING1 can act as a transcriptional repressor.

Full details of the abovementioned studies are described in the following publications, the disclosure of which are hereby incorporated by reference:

Lovering, R.; Hanson, I. M.; Borden, K. L. B.; Martin, S.; O'Reilly, N. J.; Evan, G. I.; Rahman, D.; Pappin, D. J. C.; Trowsdale, J.; Freemont, P. S.: Identification and preliminary characterization of a protein motif related to the zinc finger. Proc. Nat. Acad. Sci. 90:2112-2116, 1993; and Satijn, D. P. E.; Gunster, M. J.; van der Vlag, J.; Hamer, K. M.; Schul, W.; Alkema, M. J.; Saurin, A. J.; Freemont, P. S.; van Driel, R.; Otte, A. P.: RING1 is associated with the polyc.

Further studies establishing the function and utilities of RING1 are found in John Hopkins OMIM database record ID 602045, and in cited publications listed in Table 5, which are hereby incorporated by reference. RNF39 (Accession NP_079512.1) is another GAM44 target gene, herein designated TARGET GENE. RNF39 BINDING SITE is a target binding site found in the 3' untranslated region of multiple transcripts of mRNA encoded by RNF39, corresponding to a target binding site such as BINDING SITE I, BINDING SITE II or BINDING SITE III of FIG. 8. Table 4 illustrates the complementarity of the nucleotide sequences of RNF39 BINDING SITE, designated SEQ ID:5743, to the nucleotide sequence of GAM44 RNA, herein designated GAM RNA, also designated SEQ ID:287.

Another function of GAM44 is therefore inhibition of RNF39 (Accession NP_079512.1). Accordingly, utilities of GAM44 include diagnosis, prevention and treatment of diseases and clinical conditions associated with RNF39.

RNF39 (Accession NP_739575.1) is another GAM44 target gene, herein designated TARGET GENE. RNF39 BINDING SITE is a target binding site found in the 3' untranslated region of multiple transcripts of mRNA encoded by RNF39, corresponding to a target binding site such as BINDING SITE I, BINDING SITE II or BINDING SITE III of FIG. 8. Table 4 illustrates the complementarity of the nucleotide sequences of RNF39 BINDING SITE, designated SEQ ID:5743, to the nucleotide sequence of GAM44 RNA, herein designated GAM RNA, also designated SEQ ID:287.

Another function of GAM44 is therefore inhibition of RNF39 (Accession NP_739575.1). Accordingly, utilities of GAM44 include diagnosis, prevention and treatment of diseases and clinical conditions associated with RNF39.

SALPR (Accession NP_057652.1) is another GAM44 target gene, herein designated TARGET GENE. SALPR BINDING SITE is a target binding site found in the 5' untranslated region of mRNA encoded by SALPR, corresponding to a target binding site such as BINDING SITE I, BINDING SITE II or BINDING SITE III of FIG. 8. Table 4 illustrates the complementarity of the nucleotide sequences of SALPR BINDING SITE, designated SEQ ID:1044, to the nucleotide sequence of GAM44 RNA, herein designated GAM RNA, also designated SEQ ID:287.

Another function of GAM44 is therefore inhibition of SALPR (Accession NP_057652.1). Accordingly, utilities of GAM44 include diagnosis, prevention and treatment of diseases and clinical conditions associated with SALPR.

Spinocerebellar ataxia 1 (olivopontocerebellar ataxia 1, autosomal dominant, ataxin 1) (SCA1, Accession NP_000323.1) is another GAM44 target gene, herein designated TARGET GENE. SCA1 BINDING SITE is a target binding site found in the 3' untranslated region of mRNA encoded by SCA1, corresponding to a target binding site such as BINDING SITE I, BINDING SITE II or BINDING SITE III of FIG. 8. Table 4 illustrates the complementarity of the nucleotide sequences of SCA1 BINDING SITE, designated SEQ ID:17933, to the nucleotide sequence of GAM44 RNA, herein designated GAM RNA, also designated SEQ ID:287.

Another function of GAM44 is therefore inhibition of Spinocerebellar ataxia 1 (olivopontocerebellar ataxia 1, autosomal dominant, ataxin 1) (SCA1, Accession NP_000323.1). Accordingly, utilities of GAM44 include diagnosis, prevention and treatment of diseases and clinical conditions associated with SCA1.

Sodium channel, nonvoltage-gated 1 alpha (SCNN1A, Accession NP_001029.1) is another GAM44 target gene, herein designated TARGET GENE. SCNN1A BINDING SITE is a target binding site found in the 3' untranslated region of mRNA encoded by SCNN1A, corresponding to a target binding site such as BINDING SITE I, BINDING SITE II or BINDING SITE III of FIG. 8. Table 4 illustrates the complementarity of the nucleotide sequences of SCNN1A BINDING SITE, designated SEQ ID:16640, to the nucleotide sequence of GAM44 RNA, herein designated GAM RNA, also designated SEQ ID:287.

Another function of GAM44 is therefore inhibition of Sodium channel, nonvoltage-gated 1 alpha (SCNN1A, Accession NP_001029.1). Accordingly, utilities of GAM44 include diagnosis, prevention and treatment of diseases and clinical conditions associated with SCNN1A.

Sema domain, immunoglobulin domain (ig), transmembrane domain (tm) and short cytoplasmic domain, (semaphorin) 4c (SEMA4C, Accession NP_060259.2) is another GAM44 target gene, herein designated TARGET GENE. SEMA4C BINDING SITE is a target binding site found in the 5' untranslated region of mRNA encoded by SEMA4C, corresponding to a target binding site such as BINDING SITE I, BINDING SITE II or BINDING SITE III of FIG. 8. Table 4 illustrates the complementarity of the nucleotide sequences of SEMA4C BINDING SITE, designated SEQ ID:13121, to the nucleotide sequence of GAM44 RNA, herein designated GAM RNA, also designated SEQ ID:287.

Another function of GAM44 is therefore inhibition of Sema domain, immunoglobulin domain (ig), transmembrane domain (tm) and short cytoplasmic domain, (semaphorin) 4c (SEMA4C, Accession NP_060259.2). Accordingly, utilities of GAM44 include diagnosis, prevention and treatment of diseases and clinical conditions associated with SEMA4C.

Splicing factor, arginine/serine-rich 2, interacting protein (SFRS2IP, Accession NP_004710.1) is another GAM44 target gene, herein designated TARGET GENE. SFRS2IP BINDING SITE is a target binding site found in the 3' untranslated region of mRNA encoded by SFRS2IP, corresponding to a target binding site such as BINDING SITE I, BINDING SITE II or BINDING SITE III of FIG. 8. Table 4 illustrates the complementarity of the nucleotide sequences of SFRS2IP BINDING SITE, designated SEQ ID:13515, to the nucleotide sequence of GAM44 RNA, herein designated GAM RNA, also designated SEQ ID:287.

Another function of GAM44 is therefore inhibition of Splicing factor, arginine/serine-rich 2, interacting protein (SFRS2IP, Accession NP_004710.1), a gene which plays an essential role in pre-mRNA splicing. Accordingly, utilities of GAM44 include diagnosis, prevention and treatment of diseases and clinical conditions associated with SFRS2IP.

The function of SFRS2IP has been established by previous studies. Like other SR proteins, the SC35 (OMIM Ref. No. 600813) splicing factor contains an arginine/serine-rich (RS) domain and an RNA-binding motif. Using a yeast 2-hybrid screen with SC35 as bait, Zhang and Wu (1998) isolated a HeLa cell partial cDNA encoding SIP1, a novel SC35-interacting protein. They used the partial cDNA to screen a HeLa cell library and recovered cDNAs corresponding to the entire SIP1 coding region. The predicted 1,403-amino acid protein contains an RS domain similar to those found in several SR proteins and a region of weak similarity to the Drosophila splicing regulator suppressor of white-apricot (SWAP; 601945). In addition, the C-terminal region of SIP1 contains an RNA polymerase II C-terminal domain (CTD)-binding motif. Although the predicted molecular mass of SIP1 is 158 kD, the protein migrates at 210 kD by SDS-PAGE. The authors suggested that this discrepancy might result from posttranslational modifications such as phosphorylation, which is known to cause aberrant migration of several RS domain-containing proteins in SDS-PAGE. Yeast 2-hybrid assays and immunoprecipitation studies showed that SIP1 interacts with several SR proteins as well as with U2AF65 (OMIM Ref. No. 191318) and U1-70K (OMIM Ref. No. 180740), proteins associated with the 3-prime and 5-prime splice sites, respectively. Antibodies against SIP1 depleted splicing activity from a HeLa cell nuclear extract. In the SIP1-depleted nuclear extracts, the authors found that the formation of prespliceosomal complexes A and B was deficient. Zhang and Wu (1998) concluded that SIP1 is a novel RS domain protein required for pre-mRNA splicing. By performing a yeast 2-hybrid assay to identify proteins that interact with CTD, Tanner et al. (1997) isolated partial cDNAs encoding SIP1, which they called CTD-associated SR protein 11 (OMIM Ref. No. CASP11) or SR-related protein of 129 kD (SRrp129). Northern blot analysis detected expression of the approximately 6-kb SRrp129 mRNA in all tissues tested.

Full details of the abovementioned studies are described in the following publications, the disclosure of which are hereby incorporated by reference:

Zhang, W.-J.; Wu, J. Y.: Sip1, a novel RS domain-containing protein essential for pre-mRNA splicing. Molec. Cell. Biol. 18:676-684, 1998; and Tanner, S.; Stagljar, I.; Georgiev, O.; Schaffner, W.; Bourquin, J.-P.: A novel SR-related protein specifically interacts with the carboxy-terminal domain (CTD) of RNA polymerase II throug.

Further studies establishing the function and utilities of SFRS2IP are found in John Hopkins OMIM database record ID 603668, and in cited publications listed in Table 5, which are hereby incorporated by reference. Sialyltransferase 6 (n-acetyllacosaminide alpha 2,3-sialyltransferase) (SIAT6, Accession NP_006270.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_006270.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777627.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777627.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777628.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777628.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777624.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777624.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777626.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777626.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777632.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777632.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777630.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777630.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777623.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777623.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777631.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777631.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777629.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777629.1). Accordingly, utilities of GAM44 include diagnosis, prevention and treatment of diseases and clinical conditions associated with SIAT6.

Sialyltransferase 6 (n-acetyllacosaminide alpha 2,3-sialyltransferase) (SIAT6, Accession NP_777625.1) is another GAM44 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM44 RNA, herein designated GAM RNA, also designated SEQ ID:287.

Another function of GAM44 is therefore inhibition of Sialyltransferase 6 (n-acetyllacosaminide alpha 2,3-sialyltransferase) (SIAT6, Accession NP_777625.1). Accordingly, utilities of GAM44 include diagnosis, prevention and treatment of diseases and clinical conditions associated with SIAT6.

SLC30A7 (Accession NP_598003.1) is another GAM44 target gene, herein designated TARGET GENE. SLC30A7 BINDING SITE is a target binding site found in the 3' untranslated region of mRNA encoded by SLC30A7, corresponding to a target binding site such as BINDING SITE I, BINDING SITE II or BINDING SITE III of FIG. 8. Table 4 illustrates the complementarity of the nucleotide sequences of SLC30A7 BINDING SITE, designated SEQ ID:7436, to the nucleotide sequence of GAM44 RNA, herein designated GAM RNA, also designated SEQ ID:287.

Another function of GAM44 is therefore inhibition of SLC30A7 (Accession NP_598003.1). Accordingly, utilities of GAM44 include diagnosis, prevention and treatment of diseases and clinical conditions associated with SLC30A7.

Syntrophin, gamma 2 (SNTG2, Accession NP_061841.1) is another GAM44 target gene, herein designated TARGET GENE. SNTG2 BINDING SITE is a target binding site found in the 3' untranslated region of multiple transcripts of mRNA encoded by SNTG2, corresponding to a target binding site such as BINDING SITE I, BINDING SITE II or BINDING SITE III of FIG. 8. Table 4 illustrates the complementarity of the nucleotide sequences of SNTG2 BINDING SITE, designated SEQ ID:9285, to the nucleotide sequence of GAM44 RNA, herein designated GAM RNA, also designated SEQ ID:287.

Another function of GAM44 is therefore inhibition of Syntrophin, gamma 2 (SNTG2, Accession NP_061841.1). Accordingly, utilities of GAM44 include diagnosis, prevention and treatment of diseases and clinical conditions associated with SNTG2.

Sry (sex determining region y)-box 4 (SOX4, Accession NP_003098.1) is another GAM44 target gene, herein designated TARGET GENE. SOX4 BINDING SITE is a target binding site found in the 3' untranslated region of mRNA encoded by SOX4, corresponding to a target binding site such as BINDING SITE I, BINDING SITE II or BINDING SITE III of FIG. 8. Table 4 illustrates the complementarity of the nucleotide sequences of SOX4 BINDING SITE, designated SEQ ID:9249, to the nucleotide sequence of GAM44 RNA, herein designated GAM RNA, also designated SEQ ID:287.

Another function of GAM44 is therefore inhibition of Sry (sex determining region y)-box 4 (SOX4, Accession NP_003098.1), a gene which binds with high affinity to the t-cell enhancer motif 5'-aacaaag-3' motif. Accordingly, utilities of GAM44 include diagnosis, prevention and treatment of diseases and clinical conditions associated with SOX4.

The function of SOX4 has been established by previous studies. SOX4 from both human and mouse was shown by van de Wetering et al. (1993) to be expressed primarily in T and pre-B lymphocyte cell lines. They also showed that the mouse Sox4 protein binds with high affinity to the (A/T)(A/T)CAAAG motif found in several T-cell specific enhancers. By transient expression of chimeric Sox4 constructs, van de Wetering et al. (1993) showed that Sox4 has separable DNA-binding and transactivation domains. The authors concluded that SOX4 is a lymphocyte-specific transcriptional activator. Using a yeast 2-hybrid screen, Geijsen et al. (2001) identified the mouse transcriptional factor Sox4 as a binding partner for syntenin (SDCBP; 602217) but not for interleukin-5 receptor-alpha (IL5RA; 147851), which interacts with the PDZ domains of syntenin. The syntenin-Sox4 interaction occurs outside of the PDZ domains of syntenin. Luciferase reporter analysis and fluorescence microscopy showed that IL5 (OMIM Ref. No. 147850), but not IL3 (OMIM Ref. No. 147740), induces cytoplasmic and nuclear expression of syntenin and, in a syntenin- and cytoplasmic IL5RA-dependent manner, of Sox4. Geijsen et al. (2001) concluded that syntenin acts as an adaptor molecule in the IL5RA- mediated activation of SOX4. They also noted that mice lacking either Il5ra or Sox4 have defects in B-cell developmen Full details of the abovementioned studies are described in the following publications, the disclosure of which are hereby incorporated by reference:

Geijsen, N.; Uings, I. J.; Pals, C.; Armstrong, J.; McKinnon, M.; Raaijmakers, J. A. M.; Lammers, J.-W. J.; Koenderman, L.; Coffer, P. J.: Cytokine-specific transcriptional regulation through an IL-5R-alpha interacting protein. Science 293:1136-1138, 2001; and Suzuki, T.; Shen, H.; Akagi, K.; Morse, H. C., III; Malley, J. D.; Naiman, D. Q.; Jenkins, N. A.; Copeland, N. G.: New genes involved in cancer identified by retroviral tagging. Nature.

Further studies establishing the function and utilities of SOX4 are found in John Hopkins OMIM database record ID 184430, and in cited publications listed in Table 5, which are hereby incorporated by reference. Sry (sex determining region y)-box 7 (SOX7, Accession NP_113627.1) is another GAM44 target gene, herein designated TARGET GENE. SOX7 BINDING SITE is a target binding site found in the 3' untranslated region of mRNA encoded by SOX7, corresponding to a target binding site such as BINDING SITE I, BINDING SITE II or BINDING SITE III of FIG. 8. Table 4 illustrates the complementarity of the nucleotide sequences of SOX7 BINDING SITE, designated SEQ ID:4922, to the nucleotide sequence of GAM44 RNA, herein designated GAM RNA, also designated SEQ ID:287.

Another function of GAM44 is therefore inhibition of Sry (sex determining region y)-box 7 (SOX7, Accession NP_113627.1). Accordingly, utilities of GAM44 include diagnosis, prevention and treatment of diseases and clinical conditions associated with SOX7.

SPRR4 (Accession NP_775103.1) is another GAM44 target gene, herein designated TARGET GENE. SPRR4 BINDING SITE is a target binding site found in the 3' untranslated region of mRNA encoded by SPRR4, corresponding to a target binding site such as BINDING SITE I, BINDING SITE II or BINDING SITE III of FIG. 8. Table 4 illustrates the complementarity of the nucleotide sequences of SPRR4 BINDING SITE, designated SEQ ID:1276, to the nucleotide sequence of GAM44 RNA, herein designated GAM RNA, also designated SEQ ID:287.

Another function of GAM44 is therefore inhibition of SPRR4 (Accession NP_775103.1). Accordingly, utilities of GAM44 include diagnosis, prevention and treatment of diseases and clinical conditions associated with SPRR4.

Signal recognition particle receptor ('docking protein') (SRPR, Accession NP_003130.2) is another GAM44 target gene, herein designated TARGET GENE. SRPR BINDING SITE is a target binding site found in the 3' untranslated region of mRNA encoded by SRPR, corresponding to a target binding site such as BINDING SITE I, BINDING SITE II or BINDING SITE III of FIG. 8. Table 4 illustrates the complementarity of the nucleotide sequences of SRPR BINDING SITE, designated SEQ ID:14130, to the nucleotide sequence of GAM44 RNA, herein designated GAM RNA, also designated SEQ ID:287.

Another function of GAM44 is therefore inhibition of Signal recognition particle receptor ('docking protein') (SRPR, Accession NP_003130.2). Accordingly, utilities of GAM44 include diagnosis, prevention and treatment of diseases and clinical conditions associated with SRPR.

Sjogren syndrome antigen a1 (52 kda, ribonucleoprotein autoantigen ss-a/ro) (SSA1, Accession NP_003132.2) is another GAM44 target gene, herein designated TARGET GENE. SSA1 BINDING SITE is a target binding site found in the 3' untranslated region of mRNA encoded by SSA1, corresponding to a target binding site such as BINDING SITE I, BINDING SITE II or BINDING SITE III of FIG. 8. Table 4 illustrates the complementarity of the nucleotide sequences of SSA1 BINDING SITE, designated SEQ ID:18743, to the nucleotide sequence of GAM44 RNA, herein designated GAM RNA, also designated SEQ ID:287.

Another function of GAM44 is therefore inhibition of Sjogren syndrome antigen a1 (52 kda, ribonucleoprotein autoantigen ss-a/ro) (SSA1, Accession NP_003132.2), a gene which is a Minor component of Ro/SSA ribonucleoprotein complexes, recognized by autoantibodies and therefore may be associated with Systemic lupus erythematosus and sjogren syndrome. Accordingly, utilities of GAM44 include diagnosis, prevention and treatment of Systemic lupus erythematosus and sjogren syndrome., and of other diseases and clinical conditions associated with SSA1.

The function of SSA1 has been established by previous studies. Ro/SSA is a ribonucleoprotein that binds to autoantibodies in 35 to 50% of patients with systemic lupus erythematosus (SLE; 152700) and in up to 97% of patients with Sjogren syndrome (OMIM Ref. No. 270150). The Ro/SSA particle consists of a single 60-kD immunoreactive protein noncovalently bound with 1 of 4 small RNA molecules. Most anti-Ro/SSA-positive sera have antibodies not only against the 60-kD protein (OMIM Ref. No. 600063), but also against a 52-kD Ro/SSA protein. Itoh et al. (1991) demonstrated that the 52-kD and 60-kD autoantigens are encoded by separate genes. By radioisotopic in situ hybridization, Frank et al. (1993) mapped the RO52 gene to 11p15.5. Hybridization of portions of the cDNA probe to restriction enzyme-digested DNA indicated that the gene is composed of at least 3 exons. The exon encoding the putative zinc fingers of this protein was found to be distinct from that which encodes the leucine zipper. Frank et al. (1993) identified a RFLP of the RO52 gene and demonstrated that it is associated with SLE, primarily in black Americans. The RO60 gene maps to chromosome 1 (Frank and Mattei, 1994). A third molecule with the properties of a Ro/SSA autoantigen is calreticulin (OMIM Ref. No. 109091), a 48,000-Da protein encoded by a gene on chromosome 19. Schoenlebe et al. (1993) reported an experience indicating that neonatal hemochromatosis, also known as perinatal hemochromatosis or neonatal iron storage disease, can occur as part of the neonatal lupus erythematosus syndrome, associated with maternal anti-Ro/SS-A and anti-La/SS-B (OMIM Ref. No. 109090) autoantibodies. They reported a 6-week-old girl with neonatal hemochromatosis whose mother had these autoantibodies associated with Sjogren syndrome; an older child had congenital heart block.

Full details of the abovementioned studies are described in the following publications, the disclosure of which are hereby incorporated by reference:

Frank, M. B.; Itoh, K.; Fujisaku, A.; Pontarotti, P.; Mattei, M.-G.; Neas, B. R.: The mapping of the human 52-kD Ro/SSA autoantigen gene to human chromosome 11, and its polymorphisms. Am. J. Hum. Genet. 52:183-191, 1993; and Schoenlebe, J.; Buyon, J. P.; Zitelli, B. J.; Friedman, D.; Greco, M. A.; Knisely, A. S.: Neonatal hemochromatosis associated with maternal autoantibodies against Ro/SS-A and La/SS-B.

Further studies establishing the function and utilities of SSA1 are found in John Hopkins OMIM database record ID 109092, and in cited publications listed in Table 5, which are hereby incorporated by reference. Signal transducer and activator of transcription 1, 91 kda (STAT1, Accession NP_644671.1) is another GAM44 target gene, herein designated TARGET GENE. STAT1 BINDING SITE is a target binding site found in the 3' untranslated region of multiple transcripts of mRNA encoded by STAT1, corresponding to a target binding site such as BINDING SITE I, BINDING SITE II or BINDING SITE III of FIG. 8. Table 4 illustrates the complementarity of the nucleotide sequences of STAT1 BINDING SITE, designated SEQ ID:15202, to the nucleotide sequence of GAM44 RNA, herein designated GAM RNA, also designated SEQ ID:287.

Another function of GAM44 is therefore inhibition of Signal transducer and activator of transcription 1, 91 kda (STAT1, Accession NP_644671.1), a gene which is involved in transcriptional regulation. Accordingly, utilities of GAM44 include diagnosis, prevention and treatment of diseases and clinical conditions associated with STAT1.

The function of STAT1 has been established by previous studies. STAT proteins have the dual function of signal transduction and activation of transcription (Darnell et al., 1994). These proteins are activated by phosphorylation on tyrosine in response to different ligands after which they form homodimers or heterodimers that translocate to the cell nucleus where they either directly bind to DNA or act together with other DNA-binding proteins in multiprotein transcription complexes to direct transcription. The first of these proteins to be described, which they termed STAT1 (for signal transduction and activator of transcription-1), is activated by a number of different ligands, including interferon-alpha (IFNA; 147660), interferon-gamma (IFNG; 147570), EGF (OMIM Ref. No. 131530), PDGF (see OMIM Ref. No. 173430), and IL6 (OMIM Ref. No. 147620). The same tyrosine residue is activated at least by IFN-alpha, IFN-gamma, and EGF. STAT2 (OMIM Ref. No. 600556), in contrast, is activated by IFN-alpha but not by IFN-gamma or any of the other ligands mentioned above. STAT3 is known to be activated by IGF, IL6, LIF, and perhaps other ligands but is not activated by IFN-gamma. STAT4 (OMIM Ref. No. 600558) is present in high concentration in the testis but has not been found in a phosphorylated form in cells. The STAT proteins differ in the DNA sites to which they bind. STAT1 homodimer binds to a site termed GAS, first defined as required for IFN-gamma induction. Variations on this site are also used in response to IL6, PDGF, and other ligands.

Animal model experiments lend further support to the function of STAT1. Meraz et al. (1996) reported the generation and characterization of mice deficient in Stat1. Stat1-deficient mice showed no overt development abnormalities but displayed a complete lack of responsiveness to either interferon-alpha or interferon-gamma and were highly sensitive to infection by microbial pathogens and viruses. In contrast, these mice responded normally to several other cytokines that activate Stat1 in vitro. These observations documented that STAT1 plays an obligate and dedicated role in mediating IFN-dependent biologic responses and revealed an unexpected level of physiologic specificity for STAT1 action.

It is appreciated that the abovementioned animal model for STAT1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Darnell, J. E., Jr.; Kerr, I. M.; Stark, G. M.: Jak-STAT pathways and transcriptional activation in response to IFNs and other extracellular signaling proteins. Science 264:1415-1421, 1994; and Meraz, M. A.; White, J. M.; Sheehan, K. C. F.; Bach, E. A.; Rodig, S. J.; Dighe, A. S.; Kaplan, D. H.; Riley, J. K.; Greenlund, A. C. Campbell, D.; Carver-Moore, K.; DuBois, R. N.; Clar.

Further studies establishing the function and utilities of STAT1 are found in John Hopkins OMIM database record ID 600555, and in cited publications listed in Table 5, which are hereby incorporated by reference. STHM (Accession NP_006447.1) is another GAM44 target gene, herein designated TARGET GENE. STHM BINDING SITE is a target binding site found in the 3' untranslated region of mRNA encoded by STHM, corresponding to a target binding site such as BINDING SITE I, BINDING SITE II or BINDING SITE III of FIG. 8. Table 4 illustrates the complementarity of the nucleotide sequences of STHM BINDING SITE, designated SEQ ID:1189, to the nucleotide sequence of GAM44 RNA, herein designated GAM RNA, also designated SEQ ID:287.

Another function of GAM44 is therefore inhibition of STHM (Accession NP_006447.1). Accordingly, utilities of GAM44 include diagnosis, prevention and treatment of diseases and clinical conditions associated with STHM.

Suppressor of ty 4 homolog 1 (s. cerevisiae) (SUPT4H1, Accession NP_003159.1) is another GAM44 target gene, herein designated TARGET GENE. SUPT4H1 BINDING SITE is a target binding site found in the 3' untranslated region of mRNA encoded by SUPT4H1, corresponding to a target binding site such as BINDING SITE I, BINDING SITE II or BINDING SITE III of FIG. 8. Table 4 illustrates the complementarity of the nucleotide sequences of SUPT4H1 BINDING SITE, designated SEQ ID:16861, to the nucleotide sequence of GAM44 RNA, herein designated GAM RNA, also designated SEQ ID:287.

Another function of GAM44 is therefore inhibition of Suppressor of ty 4 homolog 1 (s. cerevisiae) (SUPT4H1, Accession NP_003159.1). Accordingly, utilities of GAM44 include diagnosis, prevention and treatment of diseases and clinical conditions associated with SUPT4H1.

Supervillin (SVIL, Accession NP_003165.1) is another GAM44 target gene, herein designated TARGET GENE. SVIL BINDING SITE is a target binding site found in the 3' untranslated region of multiple transcripts of mRNA encoded by SVIL, corresponding to a target binding site such as BINDING SITE I, BINDING SITE II or BINDING SITE III of FIG. 8. Table 4 illustrates the complementarity of the nucleotide sequences of SVIL BINDING SITE, designated SEQ ID:2228, to the nucleotide sequence of GAM44 RNA, herein designated GAM RNA, also designated SEQ ID:287.

Another function of GAM44 is therefore inhibition of Supervillin (SVIL, Accession NP_003165.1), a gene which binds actin, links filamentous actin with the plasma membrane; and contains putative nuclear localization signals. Accordingly, utilities of GAM44 include diagnosis, prevention and treatment of diseases and clinical conditions associated with SVIL.

The function of SVIL has been established by previous studies. Pope et al. (1998) used PCR with primers based on bovine sequence to clone human supervillin. The human gene encodes a 1,788-amino acid polypeptide that contains 3 predicted nuclear localization signals, several consensus phosphorylation sites, 1 ATP/GTP-binding motif, 1 potential RNP-binding site, and 3 potential actin-binding sites. The region containing the actin-binding sites is similar to the 'headpiece' of villin (OMIM Ref. No. 193040). Dot blots showed that many tissues express supervillin, with the highest expression in muscle tissues. Northern blot analysis revealed a 7.5-kb mRNA that is abundant in some human cancer cell lines. Southern blot analysis revealed that supervillin is a single-copy gene. Activation of androgen receptor (AR; 313700) via androgen in muscle cells is closely linked to their growth and differentiation. Ting et al. (2002) cloned and characterized supervillin as an AR coregulator from a skeletal muscle cDNA library. They identified a domain within supervillin (amino acids 594 to 1,268) that could interact with the AR N terminus and DNA-binding domain-ligand-binding domain in a ligand-enhanced manner. Subcellular colocalization studies with fluorescence staining indicated that supervillin colocalized with AR in the presence of 5-alpha-dihydrotestosterone in COS-1 cells. Furthermore, supervillin could enhance expression of the endogenous AR target gene p27(KIP1) (OMIM Ref. No. 600778) in prostate cells. Thus, supervillin is an AR coregulator that can enhance AR transactivation in muscle and other cells.

Full details of the abovementioned studies are described in the following publications, the disclosure of which are hereby incorporated by reference:

Pope, R. K.; Pestonjamasp, K. N.; Smith, K. P.; Wulfkuhle, J. D.; Strassel, C. P.; Lawrence, J. B.; Luna, E. J.: Cloning, characterization, and chromosomal localization of human supervillin (SVIL). Genomics 52:342-351, 1998; and Ting, H.-J.; Yeh, S.; Nishimura, K.; Chang, C.: Supervillin associates with androgen receptor and modulates its transcriptional activity. Proc. Nat. Acad. Sci. 99: 661-666, 2002.

Further studies establishing the function and utilities of SVIL are found in John Hopkins OMIM database record ID 604126, and in cited publications listed in Table 5, which are hereby incorporated by reference. Supervillin (SVIL, Accession NP_068506.1) is another GAM44 target gene, herein designated TARGET GENE. SVIL BINDING SITE is a target binding site found in the 3' untranslated region of multiple transcripts of mRNA encoded by SVIL, corresponding to a target binding site such as BINDING SITE I, BINDING SITE II or BINDING SITE III of FIG. 8. Table 4 illustrates the complementarity of the nucleotide sequences of SVIL BIND- ING SITE, designated SEQ ID:2228, to the nucleotide sequence of GAM44 RNA, herein designated GAM RNA, also designated SEQ ID:287.

Another function of GAM44 is therefore inhibition of Supervillin (SVIL, Accession NP_068506.1), a gene which binds actin, links filamentous actin with the plasma membrane; and contains putative nuclear localization signals. Accordingly, utilities of GAM44 include diagnosis, prevention and treatment of diseases and clinical conditions associated with SVIL.

The function of SVIL has been established by previous studies. Pope et al. (1998) used PCR with primers based on bovine sequence to clone human supervillin. The human gene encodes a 1,788-amino acid polypeptide that contains 3 predicted nuclear localization signals, several consensus phosphorylation sites, 1 ATP/GTP-binding motif, 1 potential RNP-binding site, and 3 potential actin-binding sites. The region containing the actin-binding sites is similar to the 'headpiece' of villin (OMIM Ref. No. 193040). Dot blots showed that many tissues express supervillin, with the highest expression in muscle tissues. Northern blot analysis revealed a 7.5-kb mRNA that is abundant in some human cancer cell lines. Southern blot analysis revealed that supervillin is a single-copy gene. Activation of androgen receptor (AR; 313700) via androgen in muscle cells is closely linked to their growth and differentiation. Ting et al. (2002) cloned and characterized supervillin as an AR coregulator from a skeletal muscle cDNA library. They identified a domain within supervillin (amino acids 594 to 1,268) that could interact with the AR N terminus and DNA-binding domain-ligand-binding domain in a ligand-enhanced manner. Subcellular colocalization studies with fluorescence staining indicated that supervillin colocalized with AR in the presence of 5- alpha-dihydrotestosterone in COS-1 cells. Furthermore, supervillin could enhance expression of the endogenous AR target gene p27(KIP1) (OMIM Ref. No. 600778) in prostate cells. Thus, supervillin is an AR coregulator that can enhance AR transactivation in muscle and other cells.

Full details of the abovementioned studies are described in the following publications, the disclosure of which are hereby incorporated by reference:

Pope, R. K.; Pestonjamasp, K. N.; Smith, K. P.; Wulfkuhle, J. D.; Strassel, C. P.; Lawrence, J. B.; Luna, E. J.: Cloning, characterization, and chromosomal localization of human supervillin (SVIL). Genomics 52:342-351, 1998; and Ting, H.-J.; Yeh, S.; Nishimura, K.; Chang, C.: Supervillin associates with androgen receptor and modulates its transcriptional activity. Proc. Nat. Acad. Sci. 99: 661-666, 2002.

Further studies establishing the function and utilities of SVIL are found in John Hopkins OMIM database record ID 604126, and in cited publications listed in Table 5, which are hereby incorporated by reference. TARSH (Accession NP_079077.1) is another GAM44 target gene, herein designated TARGET GENE. TARSH BINDING SITE is a target binding site found in the 3' untranslated region of multiple transcripts of mRNA encoded by TARSH, corresponding to a target binding site such as BINDING SITE I, BINDING SITE II or BINDING SITE III of FIG. 8. Table 4 illustrates the complementarity of the nucleotide sequences of TARSH BINDING SITE, designated SEQ ID:14655, to the nucleotide sequence of GAM44 RNA, herein designated GAM RNA, also designated SEQ ID:287.

Another function of GAM44 is therefore inhibition of TARSH (Accession NP_079077.1). Accordingly, utilities of GAM44 include diagnosis, prevention and treatment of diseases and clinical conditions associated with TARSH.

Treacher collins-franceschetti syndrome 1 (TCOF1, Accession NP_000347.1) is another GAM44 target gene, herein designated TARGET GENE. TCOF1 BINDING SITE is a target binding site found in the 3' untranslated region of mRNA encoded by TCOF1, corresponding to a target binding site such as BINDING SITE I, BINDING SITE II or BINDING SITE III of FIG. 8. Table 4 illustrates the complementarity of the nucleotide sequences of TCOF1 BINDING SITE, designated SEQ ID:12765, to the nucleotide sequence of GAM44 RNA, herein designated GAM RNA, also designated SEQ ID:287.

Another function of GAM44 is therefore inhibition of Treacher collins-franceschetti syndrome 1 (TCOF1, Accession NP_000347.1). Accordingly, utilities of GAM44 include diagnosis, prevention and treatment of diseases and clinical conditions associated with TCOF1.

TD-60 (Accession NP_061185.1) is another GAM44 target gene, herein designated TARGET GENE. TD-60 BINDING SITE is a target binding site found in the 3' untranslated region of mRNA encoded by TD-60, corresponding to a target binding site such as BINDING SITE I, BINDING SITE II or BINDING SITE III of FIG. 8. Table 4 illustrates the complementarity of the nucleotide sequences of TD-60 BINDING SITE, designated SEQ ID:17170, to the nucleotide sequence of GAM44 RNA, herein designated GAM RNA, also designated SEQ ID:287.

Another function of GAM44 is therefore inhibition of TD-60 (Accession NP_061185.1). Accordingly, utilities of GAM44 include diagnosis, prevention and treatment of diseases and clinical conditions associated with TD-60.

Trinucleotide repeat containing 6 (TNRC6, Accession NP_055309.1) is another GAM44 target gene, herein designated TARGET GENE. TNRC6 BINDING SITE is a target binding site found in the 3' untranslated region of multiple transcripts of mRNA encoded by TNRC6, corresponding to a target binding site such as BINDING SITE I, BINDING SITE II or BINDING SITE III of FIG. 8. Table 4 illustrates the complementarity of the nucleotide sequences of TNRC6 BINDING SITE, designated SEQ ID:3142, to the nucleotide sequence of GAM44 RNA, herein designated GAM RNA, also designated SEQ ID:287.

Another function of GAM44 is therefore inhibition of Trinucleotide repeat containing 6 (TNRC6, Accession NP_055309.1). Accordingly, utilities of GAM44 include diagnosis, prevention and treatment of diseases and clinical conditions associated with TNRC6.

Trinucleotide repeat containing 6 (TNRC6, Accession NP_065898.1) is another GAM44 target gene, herein designated TARGET GENE. TNRC6 BINDING SITE is a target binding site found in the 3' untranslated region of multiple transcripts of mRNA encoded by TNRC6, corresponding to a target binding site such as BINDING SITE I, BINDING SITE II or BINDING SITE III of FIG. 8. Table 4 illustrates the complementarity of the nucleotide sequences of TNRC6 BINDING SITE, designated SEQ ID:3142, to the nucleotide sequence of GAM44 RNA, herein designated GAM RNA, also designated SEQ ID:287.

Another function of GAM44 is therefore inhibition of Trinucleotide repeat containing 6 (TNRC6, Accession NP_065898.1). Accordingly, utilities of GAM44 include diagnosis, prevention and treatment of diseases and clinical conditions associated with TNRC6.

TP53I11 (Accession NP_006025.1) is another GAM44target gene, herein designated TARGET GENE. TP53I11 BINDING SITE is a target binding site found in the 3' untranslated region of multiple transcripts of mRNA encoded by TP53I11, corresponding to a target binding site such as BINDING SITE I, BINDING SITE II or BINDING SITE III of FIG. 8. Table 4 illustrates the complementarity of the nucleotide sequences of TP53I11 BINDING SITE, designated SEQ ID:10684, to the nucleotide sequence of GAM44 RNA, herein designated GAM RNA, also designated SEQ ID:287.

Another function of GAM44 is therefore inhibition of TP53I11 (Accession NP_006025.1). Accordingly, utilities of GAM44 include diagnosis, prevention and treatment of diseases and clinical conditions associated with TP53I11.

Tripartite motif-containing 37 (TRIM37, Accession NP_056109.1) is another GAM44 target gene, herein designated TARGET GENE. TRIM37 BINDING SITE is a target binding site found in the 3' untranslated region of mRNA encoded by TRIM37, corresponding to a target binding site such as BINDING SITE I, BINDING SITE II or BINDING SITE III of FIG. 8. Table 4 illustrates the complementarity of the nucleotide sequences of TRIM37 BINDING SITE, designated SEQ ID:19079, to the nucleotide sequence of GAM44 RNA, herein designated GAM RNA, also designated SEQ ID:287.

Another function of GAM44 is therefore inhibition of Tripartite motif-containing 37 (TRIM37, Accession NP_056109.1). Accordingly, utilities of GAM44 include diagnosis, prevention and treatment of diseases and clinical conditions associated with TRIM37.

TRIP-Br2 (Accession NP_055570.1) is another GAM44 target gene, herein designated TARGET GENE. TRIP-Br2 BINDING SITE1 and TRIP-Br2 BINDING SITE2 are target binding sites found in untranslated regions of mRNA encoded by TRIP-Br2, corresponding to target binding sites such as BINDING SITE I, BINDING SITE II or BINDING SITE III of FIG. 8. Table 4 illustrates the complementarity of the nucleotide sequences of TRIP-Br2 BINDING SITE1 and TRIP-Br2 BINDING SITE2, designated SEQ ID:18572 and SEQ ID:1237 respectively, to the nucleotide sequence of GAM44 RNA, herein designated GAM RNA, also designated SEQ ID:287.

Another function of GAM44 is therefore inhibition of TRIP-Br2 (Accession NP_055570.1). Accordingly, utilities of GAM44 include diagnosis, prevention and treatment of diseases and clinical conditions associated with TRIP-Br2.

TUBA3 (Accession NP_006000.2) is another GAM44 target gene, herein designated TARGET GENE. TUBA3 BINDING SITE is a target binding site found in the 3' untranslated region of mRNA encoded by TUBA3, corresponding to a target binding site such as BINDING SITE I, BINDING SITE II or BINDING SITE III of FIG. 8. Table 4 illustrates the complementarity of the nucleotide sequences of TUBA3 BINDING SITE, designated SEQ ID:7845, to the nucleotide sequence of GAM44 RNA, herein designated GAM RNA, also designated SEQ ID:287.

Another function of GAM44 is therefore inhibition of TUBA3 (Accession NP_006000.2), a gene which is the major constituent of microtubules. Accordingly, utilities of GAM44 include diagnosis, prevention and treatment of diseases and clinical conditions associated with TUBA3.

The function of TUBA3 has been established by previous studies. Hall and Cowan (1985) screened a human genomic library with the 3-prime UTR of b-alpha-1 and isolated the b-alpha-1 gene and a pseudogene. The b-alpha-1 gene is composed of 4 exons and spans less than 4 kb. It encodes a predicted 451-amino acid protein that is 100% identical to the rat homolog and differs by only 2 and 3 amino acids from the pig and chicken homologs, respectively. Furthermore, the authors observed that the first and largest intron of the b-alpha-1 gene is homologous to that of the rat gene. Northern blotting showed that b-alpha-1 expression was restricted to morphologically differentiated neurologic cells Gerhard et al. (1985) studied what they thought was the testis-specific alpha-tubulin gene (OMIM Ref. No. 191110), which they designated TUBA1. By somatic cell hybrid analysis, Gerhard et al. (1985) found complete coordinate segregation of this gene with IDH1 (OMIM Ref. No. 147700), a chromosome 2 marker. Since 4 of 22 cases showed discordance with the 2p marker MDH1 (OMIM Ref. No. 154200), they concluded that this gene is probably on 2q. Todd and Naylor (1991) found that the gene studied by Gerhard et al. (1985) contains a polymorphic GT repeat sequence. Searches for homology to the primers used by Todd and Naylor (1991) revealed that Gerhard et al. (1985) and Todd and Naylor (1991) were actually studying the b-alpha-1 gene (Rasooly, 1998).

Full details of the abovementioned studies are described in the following publications, the disclosure of which are hereby incorporated by reference:

Hall, J. L.; Cowan, N. J.: Structural features and restricted expression of a human alpha-tubulin gene. Nucleic Acids Res. 13:207-223, 1985; and Todd, S.; Naylor, S. L.: Dinucleotide repeat polymorphism in the human tubulin alpha 1 (testis specific) gene (TUBA1). Nucleic Acids Res. 19:3755 only, 1991.

Further studies establishing the function and utilities of TUBA3 are found in John Hopkins OMIM database record ID 602529, and in cited publications listed in Table 5, which are hereby incorporated by reference. TWISTNB (Accession XP_166508.1) is another GAM44 target gene, herein designated TARGET GENE. TWISTNB BINDING SITE is a target binding site found in the 3' untranslated region of mRNA encoded by TWISTNB, corresponding to a target binding site such as BINDING SITE I, BINDING SITE II or BINDING SITE III of FIG. 8. Table 4 illustrates the complementarity of the nucleotide sequences of TWISTNB BINDING SITE, designated SEQ ID:8569, to the nucleotide sequence of GAM44 RNA, herein designated GAM RNA, also designated SEQ ID:287.

Another function of GAM44 is therefore inhibition of TWISTNB (Accession XP_166508.1). Accordingly, utilities of GAM44 include diagnosis, prevention and treatment of diseases and clinical conditions associated with TWISTNB.

Ubiquitin-conjugating enzyme e2 variant 1 (UBE2V1, Accession NP_068823.1) is another GAM44 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8971, to the nucleotide sequence of GAM44 RNA, herein designated GAM RNA, also designated SEQ ID:287.

Another function of GAM44 is therefore inhibition of Ubiquitin-conjugating enzyme e2 variant 1 (UBE2V1, Accession NP_068823.1), a gene which may play a role in signaling for DNA repair. Accordingly, utilities of GAM44 include diagnosis, prevention and treatment of diseases and clinical conditions associated with UBE2V1.

The function of UBE2V1 has been established by previous studies. Rothofsky and Lin (1997) isolated human brain cDNAs encoding UBE2V1, which they called CROC1. They identified 2 alternative 5-prime CROC1 cDNA sequences, which resulted in predicted 221- and 170- amino acid proteins that differ at their N-terminal ends. The CROC1 isoforms have an acidic domain and a C-terminal basic domain. They show sequence similarity to ubiquitin-conjugating enzymes (UBCs, or E2s, e.g., UBE2D1; 602961) but lack the conserved cysteine residue that is critical for the catalytic activity of E2s. The CROC1 C-terminal domain has 42% sequence identity with the potential DNA-binding domain of TAFII250 (TAF2A; 313650). Immunofluorescence microscopy showed that recombinant CROC1 was located in the nucleus, excluding the nucleolar organizer regions. The authors demonstrated that CROC1 can cause transcriptional activation of the human FOS (OMIM Ref. No. 164810) promoter. Northern blot analysis detected approximately 2.1- and 2.5-kb CROC1 transcripts in all human tissues examined, with the highest levels in brain, skeletal muscle, and kidney. Sancho et al. (1998) isolated partial human intestinal epithelial cell cDNAs containing the 3-prime coding sequence and 3-prime untranslated region of UBE2V1, which they called UEV1. The UEV1 gene contains at least 6 exons and has at least 3 alternative polyadenylation sites in the 3-prime untranslated region. RT-PCR identified 4 alternatively spliced UEV1 transcripts that encode proteins with identical 90-amino acid C-terminal sequences, including the region homologous to the conserved Ubc domain of E2 enzymes, but unique N-terminal sequences. The 140-amino acid C terminus of the deduced 221- and 170-amino acid UEV1 isoforms identified by Rothofsky and Lin (1997) is 90% identical to UEV2 (UBE2V2; 603001); it is 18%, 24%, and 22% identical to the Ubc domain of human UBE2I (OMIM Ref. No. 601661), S. cerevisiae UBC4 and UBC7, and A. thaliana UBC1, respectively. The authors showed that UEV1 does not have ubiquitin-conjugating activity in vitro. UEV1 transcripts were downregulated upon differentiation of a colon carcinoma cell line. Constitutive expression of exogenous UEV1 protein in these colon carcinoma cells inhibited their capacity to differentiate upon confluence and induced changes in their cell cycle behavior, which was associated with an inhibition of the mitotic kinase CDK1 (see OMIM Ref. No. CDC2; 116940).

Full details of the abovementioned studies are described in the following publications, the disclosure of which are hereby incorporated by reference:

Rothofsky, M. L.; Lin, S. L.: CROC-1 encodes a protein which mediates transcriptional activation of the human FOS promoter. Gene 195:141-149, 1997; and Sancho, E.; Vila, M. R.; Sanchez-Pulido, L.; Lozano, J. J.; Paciucci, R.; Nadal, M.; Fox, M.; Harvey, C.; Bercovich, B.; Loukili, N.; Ciechanover, A.; Lin, S. L.; Sanz, F.; Estivill, X.

Further studies establishing the function and utilities of UBE2V1 are found in John Hopkins OMIM database record ID 602995, and in cited publications listed in Table 5, which are hereby incorporated by reference. Ubiquitin-conjugating enzyme e2 variant 1 (UBE2V1, Accession NP_071887.1) is another GAM44 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8971, to the nucleotide sequence of GAM44 RNA, herein designated GAM RNA, also designated SEQ ID:287.

Another function of GAM44 is therefore inhibition of Ubiquitin-conjugating enzyme e2 variant 1 (UBE2V1, Accession NP_071887.1), a gene which may play a role in signaling for DNA repair. Accordingly, utilities of GAM44 include diagnosis, prevention and treatment of diseases and clinical conditions associated with UBE2V1.

The function of UBE2V1 has been established by previous studies. Rothofsky and Lin (1997) isolated human brain cDNAs encoding UBE2V1, which they called CROC1. They identified 2 alternative 5-prime CROC1 cDNA sequences, which resulted in predicted 221- and 170- amino acid proteins that differ at their N-terminal ends. The CROC1 isoforms have an acidic domain and a C-terminal basic domain. They show sequence similarity to ubiquitin-conjugating enzymes (UBCs, or E2s, e.g., UBE2D1; 602961) but lack the conserved cysteine residue that is critical for the catalytic activity of E2s. The CROC1 C-terminal domain has 42% sequence identity with the potential DNA-binding domain of TAFII250 (TAF2A; 313650). Immunofluorescence microscopy showed that recombinant CROC1 was located in the nucleus, excluding the nucleolar organizer regions. The authors demonstrated that CROC1 can cause transcriptional activation of the human FOS (OMIM Ref. No. 164810) promoter. Northern blot analysis detected approximately 2.1- and 2.5-kb CROC1 transcripts in all human tissues examined, with the highest levels in brain, skeletal muscle, and kidney. Sancho et al. (1998) isolated partial human intestinal epithelial cell cDNAs containing the 3-prime coding sequence and 3-prime untranslated region of UBE2V1, which they called UEV1. The UEV1 gene contains at least 6 exons and has at least 3 alternative polyadenylation sites in the 3-prime untranslated region. RT-PCR identified 4 alternatively spliced UEV1 transcripts that encode proteins with identical 90-amino acid C-terminal sequences, including the region homologous to the conserved Ubc domain of E2 enzymes, but unique N-terminal sequences. The 140-amino acid C terminus of the deduced 221- and 170-amino acid UEV1 isoforms identified by Rothofsky and Lin (1997) is 90% identical to UEV2 (UBE2V2; 603001); it is 18%, 24%, and 22% identical to the Ubc domain of human UBE2I (OMIM Ref. No. 601661), S. cerevisiae UBC4 and UBC7, and A. thaliana UBC1, respectively. The authors showed that UEV1 does not have ubiquitin- conjugating activity in vitro. UEV1 transcripts were downregulated upon differentiation of a colon carcinoma cell line. Constitutive expression of exogenous UEV1 protein in these colon carcinoma cells inhibited their capacity to differentiate upon confluence and induced changes in their cell cycle behavior, which was associated with an inhibition of the mitotic kinase CDK1 (see OMIM Ref. No. CDC2; 116940).

Full details of the abovementioned studies are described in the following publications, the disclosure of which are hereby incorporated by reference:

Rothofsky, M. L.; Lin, S. L.: CROC-1 encodes a protein which mediates transcriptional activation of the human FOS promoter. Gene 195:141-149, 1997; and Sancho, E.; Vila, M. R.; Sanchez-Pulido, L.; Lozano, J. J.; Paciucci, R.; Nadal, M.; Fox, M.; Harvey, C.; Bercovich, B.; Loukili, N.; Ciechanover, A.; Lin, S. L.; Sanz, F.; Estivill, X.

Further studies establishing the function and utilities of UBE2V1 are found in John Hopkins OMIM database record ID 602995, and in cited publications listed in Table 5, which are hereby incorporated by reference. Ubiquitin-conjugating enzyme e2 variant 1 (UBE2V1, Accession NP_003340.1) is another GAM44 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8971, to the nucleotide sequence of GAM44 RNA, herein designated GAM RNA, also designated SEQ ID:287.

Another function of GAM44 is therefore inhibition of Ubiquitin-conjugating enzyme e2 variant 1 (UBE2V1, Accession NP_003340.1), a gene which may play a role in signaling for DNA repair. Accordingly, utilities of GAM44 include diagnosis, prevention and treatment of diseases and clinical conditions associated with UBE2V1.

The function of UBE2V1 has been established by previous studies. Rothofsky and Lin (1997) isolated human brain cDNAs encoding UBE2V1, which they called CROC1. They identified 2 alternative 5-prime CROC1 cDNA sequences, which resulted in predicted 221- and 170- amino acid proteins that differ at their N-terminal ends. The CROC1 isoforms have an acidic domain and a C-terminal basic domain. They show sequence similarity to ubiquitin-conjugating enzymes (UBCs, or E2s, e.g., UBE2D1; 602961) but lack the conserved cysteine residue that is critical for the catalytic activity of E2s. The CROC1 C-terminal domain has 42% sequence identity with the potential DNA-binding domain of TAFII250 (TAF2A; 313650). Immunofluorescence microscopy showed that recombinant CROC1 was located in the nucleus, excluding the nucleolar organizer regions. The authors demonstrated that CROC1 can cause transcriptional activation of the human FOS (OMIM Ref. No. 164810) promoter. Northern blot analysis detected approximately 2.1- and 2.5-kb CROC1 transcripts in all human tissues examined, with the highest levels in brain, skeletal muscle, and kidney. Sancho et al. (1998) isolated partial human intestinal epithelial cell cDNAs containing the 3-prime coding sequence and 3-prime untranslated region of UBE2V1, which they called UEV1. The UEV1 gene contains at least 6 exons and has at least 3 alternative polyadenylation sites in the 3-prime untranslated region. RT-PCR identified 4 alternatively spliced UEV1 transcripts that encode proteins with identical 90-amino acid C-terminal sequences, including the region homologous to the conserved Ubc domain of E2 enzymes, but unique N-terminal sequences. The 140-amino acid C terminus of the deduced 221- and 170-amino acid UEV1 isoforms identified by Rothofsky and Lin (1997) is 90% identical to UEV2 (UBE2V2; 603001); it is 18%, 24%, and 22% identical to the Ubc domain of human UBE2I (OMIM Ref. No. 601661), S. cerevisiae UBC4 and UBC7, and A. thaliana UBC1, respectively. The authors showed that UEV1 does not have ubiquitin- conjugating activity in vitro. UEV1 transcripts were downregulated upon differentiation of a colon carcinoma cell line. Constitutive expression of exogenous UEV1 protein in these colon carcinoma cells inhibited their capacity to differentiate upon confluence and induced changes in their cell cycle behavior, which was associated with an inhibition of the mitotic kinase CDK1 (see OMIM Ref. No. CDC2; 116940).

Full details of the abovementioned studies are described in the following publications, the disclosure of which are hereby incorporated by reference:

Rothofsky, M. L.; Lin, S. L.: CROC-1 encodes a protein which mediates transcriptional activation of the human FOS promoter. Gene 195:141-149, 1997; and Sancho, E.; Vila, M. R.; Sanchez-Pulido, L.; Lozano, J. J.; Paciucci, R.; Nadal, M.; Fox, M.; Harvey, C.; Bercovich, B.; Loukili, N.; Ciechanover, A.; Lin, S. L.; Sanz, F.; Estivill, X.

Further studies establishing the function and utilities of UBE2V1 are found in John Hopkins OMIM database record ID 602995, and in cited publications listed in Table 5, which are hereby incorporated by reference. Ubinuclein 1 (UBN1, Accession NP_058632.1) is another GAM44 target gene, herein designated TARGET GENE. UBN1 BINDING SITE is a target binding site found in the 3' untranslated region of mRNA encoded by UBN1, corresponding to a target binding site such as BINDING SITE I, BINDING SITE II or BINDING SITE III of FIG. 8. Table 4 illustrates the complementarity of the nucleotide sequences of UBN1 BINDING SITE, designated SEQ ID:17578, to the nucleotide sequence of GAM44 RNA, herein designated GAM RNA, also designated SEQ ID:287.

Another function of GAM44 is therefore inhibition of Ubinuclein 1 (UBN1, Accession NP_058632.1). Accordingly, utilities of GAM44 include diagnosis, prevention and treatment of diseases and clinical conditions associated with UBN1.

WBP3 (Accession NP_783863.2) is another GAM44 target gene, herein designated TARGET GENE. WBP3 BINDING SITE is a target binding site found in the 3' untranslated region of mRNA encoded by WBP3, corresponding to a target binding site such as BINDING SITE I, BINDING SITE II or BINDING SITE III of FIG. 8. Table 4 illustrates the complementarity of the nucleotide sequences of WBP3 BINDING SITE, designated SEQ ID:1501, to the nucleotide sequence of GAM44 RNA, herein designated GAM RNA, also designated SEQ ID:287.

Another function of GAM44 is therefore inhibition of WBP3 (Accession NP_783863.2). Accordingly, utilities of GAM44 include diagnosis, prevention and treatment of diseases and clinical conditions associated with WBP3.

Tyrosine 3-monooxygenase/tryptophan 5-monooxygenase activation protein, gamma polypeptide (YWHAG, Accession NP_036611.2) is another GAM44target gene, herein designated TARGET GENE. YWHAG BINDING SITE is a target binding site found in the 3' untranslated region of mRNA encoded by YWHAG, corresponding to a target binding site such as BINDING SITE I, BINDING SITE II or BINDING SITE III of FIG. 8. Table 4 illustrates the complementarity of the nucleotide sequences of YWHAG BINDING SITE, designated SEQ ID:15404, to the nucleotide sequence of GAM44 RNA, herein designated GAM RNA, also designated SEQ ID:287.

Another function of GAM44 is therefore inhibition of Tyrosine 3-monooxygenase/tryptophan 5-monooxygenase activation protein, gamma polypeptide (YWHAG, Accession NP_036611.2), a gene which mediates mitogenic signals of PDGF in vascular smooth muscle cells. Accordingly, utilities of GAM44 include diagnosis, prevention and treatment of diseases and clinical conditions associated with YWHAG.

The function of YWHAG and its association with various diseases and clinical conditions, has been established by previous studies, as described hereinabove with reference to GAM40.1. ZFYVE26 (Accession XP_031077.1) is another GAM44 target gene, herein designated TARGET GENE. ZFYVE26 BINDING SITE is a target binding site found in the 3' untranslated region of mRNA encoded by ZFYVE26, corresponding to a target binding site such as BINDING SITE I, BINDING SITE II or BINDING SITE III of FIG. 8. Table 4 illustrates the complementarity of the nucleotide sequences of ZFYVE26 BINDING SITE, designated SEQ ID:7546, to the nucleotide sequence of GAM44 RNA, herein designated GAM RNA, also designated SEQ ID:287.

Another function of GAM44 is therefore inhibition of ZFYVE26 (Accession XP_031077.1). Accordingly, utilities of GAM44 include diagnosis, prevention and treatment of diseases and clinical conditions associated with ZFYVE26.

FIG. 8 further provides a conceptual description of a novel bioinformatically detected of the present invention, referred to here as Genomic Address Messenger 45 (GAM45), which modulates expression of respective target genes thereof, the function and utility of which target genes is known in the art.

GAM45 is a novel bioinformatically detected regulatory, non protein coding, micro RNA (miRNA) gene. The method by which GAM45 was detected is described hereinabove with reference to FIGS. 8-15.

GAM45 gene, herein designated GAM GENE, and GAM45 target gene, herein designated TARGET GENE, are human genes contained in the human genome.

GAM45 gene encodes a GAM45 precursor RNA, herein designated GAM PRECURSOR RNA. Similar to other miRNA genes, and unlike most ordinary genes, GAM45 precursor RNA does not encode a protein. A nucleotide sequence identical or highly similar to the nucleotide sequence of GAM45 precursor RNA is designated SEQ ID:25, and is provided hereinbelow with reference to the sequence listing part. Nucleotide sequence SEQ ID:25 is located at position 35395141 relative to chromosome 9.

GAM45 precursor RNA folds onto itself, forming GAM45 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM45 precursor RNA folds onto itself, forming GAM45 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM45 precursor RNA, designated SEQ-ID:25, and a schematic representation of a predicted secondary folding of GAM45 folded precursor RNA are further described with reference to Table 2, hereby incorporated by reference.

An enzyme complex designated DICER COMPLEX, 'dices' the GAM45 folded precursor RNA into GAM45 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM45 RNA is designated SEQ ID:324, and is provided hereinbelow with references to the sequence listing part and Table 3, hereby incorporated by reference.

GAM45 target gene, herein designated TARGET GENE, encodes a corresponding messenger RNA, GAM45 target RNA, herein designated GAM TARGET RNA. GAM45target RNA comprises three regions, as is typical of mRNA of a protein coding gene: a 5' untranslated region, a protein coding region and a 3' untranslated region, designated 5'UTR, PROTEIN CODING and 3'UTR respectively.

GAM45 RNA, herein designated GAM RNA, binds complementarily to one or more target binding sites located in untranslated regions of GAM45 target RNA, herein designated GAM TARGET RNA. This complementary binding is due to the fact that the nucleotide sequence of GAM45 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM45 RNA may have a different number of target binding sites in untranslated regions of a GAM45 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM45 RNA, herein designated GAM RNA, to target binding sites on GAM45 target RNA, herein designated GAM TARGET RNA, such as BINDING SITE I, BINDING SITE II and BINDING SITE III, inhibits translation of GAM45target RNA into GAM45 target protein, herein designated GAM TARGET PROTEIN. GAM target protein is therefore outlined by a broken line.

It is appreciated that GAM45 target gene, herein designated TARGET GENE, in fact represents a plurality of GAM45 target genes. The mRNA of each one of this plurality of GAM45 target genes comprises one or more target binding sites, each having a nucleotide sequence which is at least partly complementary to GAM45 RNA, herein designated GAM RNA, and which when bound by GAM45 RNA causes inhibition of translation of respective one or more GAM45 target proteins.

It is further appreciated by one skilled in the art that the mode of translational inhibition illustrated by FIG. 8 with specific reference to translational inhibition exerted by GAM45 gene, herein designated GAM GENE, on one or more GAM45target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM45 correlate with, and may be deduced from, the identity of the target genes which GAM45 binds and inhibits, and the function of these target genes, as elaborated hereinbelow.

FLJ25179 (Accession NM_144670.1) is a GAM45 target gene, herein designated TARGET GENE. FLJ25179 BINDING SITE is a target binding site found in the 3' untranslated region of mRNA encoded by FLJ25179, corresponding to a target binding site such as BINDING SITE I, BINDING SITE II or BINDING SITE III of FIG. 8. Table 4 illustrates the complementarity of the nucleotide sequences of FLJ25179 BINDING SITE, designated SEQ ID:9905, to the nucleotide sequence of GAM45 RNA, herein designated GAM RNA, also designated SEQ ID:324.

A function of GAM45 is therefore inhibition of FLJ25179 (Accession NM_144670.1). Accordingly, utilities of GAM45 include diagnosis, prevention and treatment of diseases and clinical conditions associated with FLJ25179.

LOC91351 (Accession) is another GAM45 target gene, herein designated TARGET GENE. LOC91351 BINDING SITE is a target binding site found in the 3' untranslated region of mRNA encoded by LOC91351, corresponding to a target binding site such as BINDING SITE I, BINDING SITE II or BINDING SITE III of FIG. 8. Table 4 illustrates the complementarity of the nucleotide sequences of LOC91351

BINDING SITE, designated SEQ ID:7915, to the nucleotide sequence of GAM45 RNA, herein designated GAM RNA, also designated SEQ ID:324.

Another function of GAM45 is therefore inhibition of LOC91351 (Accession). Accordingly, utilities of GAM45 include diagnosis, prevention and treatment of diseases and clinical conditions associated with LOC91351.

Unc-13-like (c. elegans) (UNC13, Accession NM_006377.1) is another GAM45 target gene, herein designated TARGET GENE. UNC13 BINDING SITE is a target binding site found in the 3' untranslated region of mRNA encoded by UNC13, corresponding to a target binding site such as BINDING SITE I, BINDING SITE II or BINDING SITE III of FIG. 8. Table 4 illustrates the complementarity of the nucleotide sequences of UNC13 BINDING SITE, designated SEQ ID:4217, to the nucleotide sequence of GAM45 RNA, herein designated GAM RNA, also designated SEQ ID:324.

Another function of GAM45 is therefore inhibition of Unc-13-like (c. elegans) (UNC13, Accession NM_006377.1), a gene which is a putative diacylglycerol receptor and may act in PKC-independent, diacylglycerol-activated apoptosis pathway. Accordingly, utilities of GAM45 include diagnosis, prevention and treatment of diseases and clinical conditions associated with UNC13.

The function of UNC13 has been established by previous studies. The priming step of synaptic vesicle exocytosis is thought to require the formation of the SNARE complex, which comprises the proteins synaptobrevin (OMIM Ref. No. 185881), SNAP25 (OMIM Ref. No. 600322), and syntaxin (see OMIM Ref. No. 186590). In solution, syntaxin adopts a default, closed configuration that is incompatible with formation of the SNARE complex. Specifically, the amino terminus of syntaxin binds the SNARE motif and occludes interactions with the other SNARE proteins. The N terminus of syntaxin also binds the presynaptic protein UNC13. Studies in mouse, Drosophila, and Caenorhabditis elegans suggest that UNC13 functions at a post-docking step of exocytosis, most likely during synaptic vesicle priming. Therefore, UNC13 binding to the N terminus of syntaxin may promote the open configuration of syntaxin. To test this model, Richmond et al. (2001) engineered mutations into C. elegans syntaxin that caused the protein to adopt the open configuration constitutively. Richmond et al. (2001) demonstrated that the open form of syntaxin can bypass the requirement for UNC13 in synaptic vesicle priming. Thus, Richmond et al. (2001) concluded that it is likely that UNC13 primes synaptic vesicles for fusion by promoting the open configuration of syntaxin.

Animal model experiments lend further support to the function of UNC13. Munc13-1 is a presynaptic protein with an essential role in synaptic vesicle priming. It contains a diacylglycerol (DAG)/beta phorbol ester-binding C1 domain and is a potential target of the DAG second messenger pathway that may act in parallel with protein kinases C (PKCs; OMIM Ref. No. 600448). Using genetically modified mice that expressed a DAG/beta phorbol ester-binding-deficient Munc13-1 variant (missense mutation his567 to lys) instead of the wildtype protein, Rhee et al. (2002) determined the relative contribution of PKCs and Munc13-1 to DAG/beta phorbol ester-dependent regulation of neurotransmitter release. They showed that Munc13s are the main presynaptic DAG/beta phorbol ester receptors in hippocampal neurons. Modulation of Munc13-1 activity by second messengers via the DAG/beta phorbol ester-binding C1 domain is essential for use-dependent alterations of synaptic efficacy and survival.

It is appreciated that the abovementioned animal model for UNC13 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Richmond, J. E.; Weimer, R. M.; Jorgensen, E. M.: An open form of syntaxin bypasses the requirement for UNC-13 in vesicle priming. Nature 412:338- 341, 2001; and Rhee, J.-S.; Betz, A.; Pyott, S.; Reim, K.; Varoqueaux, F.; Augustin, I.; Hesse, D.; Sudhof, T. C.; Takahashi, M.; Rosenmund, C.; Brose, N.: Beta phorbol ester- and diacylglycerol-indu.

Further studies establishing the function and utilities of UNC13 are found in John Hopkins OMIM database record ID 605836, and in cited publications listed in Table 5, which are hereby incorporated by reference.

FIG. 8 further provides a conceptual description of a novel bioinformatically detected of the present invention, referred to here as Genomic Address Messenger 46 (GAM46), which modulates expression of respective target genes thereof, the function and utility of which target genes is known in the art.

GAM46 is a novel bioinformatically detected regulatory, non protein coding, micro RNA (miRNA) gene. The method by which GAM46 was detected is described hereinabove with reference to FIGS. 8-15.

GAM46 gene, herein designated GAM GENE, and GAM46 target gene, herein designated TARGET GENE, are human genes contained in the human genome.

GAM46 gene encodes a GAM46 precursor RNA, herein designated GAM PRECURSOR RNA. Similar to other miRNA genes, and unlike most ordinary genes, GAM46 precursor RNA does not encode a protein. A nucleotide sequence identical or highly similar to the nucleotide sequence of GAM46 precursor RNA is designated SEQ ID:41, and is provided hereinbelow with reference to the sequence listing part.

GAM46 precursor RNA folds onto itself, forming GAM46 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM46 precursor RNA folds onto itself, forming GAM46 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM46 precursor RNA, designated SEQ-ID:41, and a schematic representation of a predicted secondary folding of GAM46 folded precursor RNA are further described with reference to Table 2, hereby incorporated by reference.

An enzyme complex designated DICER COMPLEX, 'dices' the GAM46 folded precursor RNA into GAM46 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM46 RNA is designated SEQ ID:364, and is provided hereinbelow with references to the sequence listing part and Table 3, hereby incorporated by reference.

GAM46 target gene, herein designated TARGET GENE, encodes a corresponding messenger RNA, GAM46 target RNA, herein designated GAM TARGET RNA. GAM46target RNA comprises three regions, as is typical of mRNA of a protein coding gene: a 5' untranslated region, a protein coding region and a 3' untranslated region, designated 5'UTR, PROTEIN CODING and 3'UTR respectively.

GAM46 RNA, herein designated GAM RNA, binds complementarily to one or more target binding sites located in untranslated regions of GAM46 target RNA, herein designated GAM TARGET RNA. This complementary binding is due to the fact that the nucleotide sequence of GAM46 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM46 RNA may have a different number of target binding sites in untranslated regions of a GAM46 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM46 RNA, herein designated GAM RNA, to target binding sites on GAM46 target RNA, herein designated GAM TARGET RNA, such as BINDING SITE I, BINDING SITE II and BINDING SITE III, inhibits translation of GAM46target RNA into GAM46 target protein, herein designated GAM TARGET PROTEIN. GAM target protein is therefore outlined by a broken line.

It is appreciated that GAM46 target gene, herein designated TARGET GENE, in fact represents a plurality of GAM46 target genes. The mRNA of each one of this plurality of GAM46 target genes comprises one or more target binding sites, each having a nucleotide sequence which is at least partly complementary to GAM46 RNA, herein designated GAM RNA, and which when bound by GAM46 RNA causes inhibition of translation of respective one or more GAM46 target proteins.

It is further appreciated by one skilled in the art that the mode of translational inhibition illustrated by FIG. 8 with specific reference to translational inhibition exerted by GAM46 gene, herein designated GAM GENE, on one or more GAM46target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM46 correlate with, and may be deduced from, the identity of the target genes which GAM46 binds and inhibits, and the function of these target genes, as elaborated hereinbelow.

FLJ23186 (Accession NM_024616.1) is a GAM46 target gene, herein designated TARGET GENE. FLJ23186 BINDING SITE is a target binding site found in the 3' untranslated region of mRNA encoded by FLJ23186, corresponding to a target binding site such as BINDING SITE I, BINDING SITE II or BINDING SITE III of FIG. 8. Table 4 illustrates the complementarity of the nucleotide sequences of FLJ23186 BINDING SITE, designated SEQ ID:5875, to the nucleotide sequence of GAM46 RNA, herein designated GAM RNA, also designated SEQ ID:364.

A function of GAM46 is therefore inhibition of FLJ23186 (Accession NM_024616.1). Accordingly, utilities of GAM46 include diagnosis, prevention and treatment of diseases and clinical conditions associated with FLJ23186.

FIG. 8 further provides a conceptual description of a novel bioinformatically detected of the present invention, referred to here as Genomic Address Messenger 47 (GAM47), which modulates expression of respective target genes thereof, the function and utility of which target genes is known in the art.

GAM47 is a novel bioinformatically detected regulatory, non protein coding, micro RNA (miRNA) gene. The method by which GAM47 was detected is described hereinabove with reference to FIGS. 8-15.

GAM47 gene, herein designated GAM GENE, and GAM47 target gene, herein designated TARGET GENE, are human genes contained in the human genome.

GAM47 gene encodes a GAM47 precursor RNA, herein designated GAM PRECURSOR RNA. Similar to other miRNA genes, and unlike most ordinary genes, GAM47 precursor RNA does not encode a protein. A nucleotide sequence identical or highly similar to the nucleotide sequence of GAM47 precursor RNA is designated SEQ ID:113, and is provided hereinbelow with reference to the sequence listing part. Nucleotide sequence SEQ ID:113 is located at position 149681013 relative to chromosome 4.

GAM47 precursor RNA folds onto itself, forming GAM47 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM47 precursor RNA folds onto itself, forming GAM47 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM47 precursor RNA, designated SEQ-ID:113, and a schematic representation of a predicted secondary folding of GAM47 folded precursor RNA are further described with reference to Table 2, hereby incorporated by reference.

An enzyme complex designated DICER COMPLEX, 'dices' the GAM47 folded precursor RNA into GAM47 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM47 RNA is designated SEQ ID:269, and is provided hereinbelow with references to the sequence listing part and Table 3, hereby incorporated by reference.

GAM47 target gene, herein designated TARGET GENE, encodes a corresponding messenger RNA, GAM47 target RNA, herein designated GAM TARGET RNA. GAM47 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM47 RNA, herein designated GAM RNA, binds complementarily to one or more target binding sites located in untranslated regions of GAM47 target RNA, herein designated GAM TARGET RNA. This complementary binding is due to the fact that the nucleotide sequence of GAM47 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM47 RNA may have a different number of target binding sites in untranslated regions of a GAM47 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM47 RNA, herein designated GAM RNA, to target binding sites on GAM47 target RNA, herein designated GAM TARGET RNA, such as BINDING SITE I, BINDING SITE II and BINDING SITE III, inhibits translation of GAM47 target RNA into GAM47 target protein, herein designated GAM TARGET PROTEIN. GAM target protein is therefore outlined by a broken line.

It is appreciated that GAM47 target gene, herein designated TARGET GENE, in fact represents a plurality of GAM47 target genes. The mRNA of each one of this plurality of GAM47 target genes comprises one or more target binding sites, each having a nucleotide sequence which is at least partly complementary to GAM47 RNA, herein designated GAM RNA, and which when bound by GAM47 RNA causes inhibition of translation of respective one or more GAM47 target proteins.

It is further appreciated by one skilled in the art that the mode of translational inhibition illustrated by FIG. 8 with specific reference to translational inhibition exerted by GAM47 gene, herein designated GAM GENE, on one or more GAM47 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM47 correlate with, and may be deduced from, the identity of the target genes which GAM47 binds and inhibits, and the function of these target genes, as elaborated hereinbelow.

Atp-binding cassette, sub-family a (abc1), member 6 (ABCA6, Accession NP_758854.1) is a GAM47 target gene, herein designated TARGET GENE. ABCA6 BINDING SITE is a target binding site found in the 3' untranslated region of multiple transcripts of mRNA encoded by ABCA6, corresponding to a target binding site such as BINDING SITE I, BINDING SITE II or BINDING SITE III of FIG. 8. Table 4 illustrates the complementarity of the nucleotide sequences of ABCA6 BINDING SITE, designated SEQ ID:8771, to the nucleotide sequence of GAM47 RNA, herein designated GAM RNA, also designated SEQ ID:269.

A function of GAM47 is therefore inhibition of Atp-binding cassette, sub-family a (abc1), member 6 (ABCA6, Accession NP_758854.1). Accordingly, utilities of GAM47 include diagnosis, prevention and treatment of diseases and clinical conditions associated with ABCA6.

Atp-binding cassette, sub-family b (mdr/tap), member 9 (ABCB9, Accession NP_062571.1) is another GAM47 target gene, herein designated TARGET GENE. ABCB9 BINDING SITE is a target binding site found in the 3' untranslated region of multiple transcripts of mRNA encoded by ABCB9, corresponding to a target binding site such as BINDING SITE I, BINDING SITE II or BINDING SITE III of FIG. 8. Table 4 illustrates the complementarity of the nucleotide sequences of ABCB9 BINDING SITE, designated SEQ ID:9595, to the nucleotide sequence of GAM47 RNA, herein designated GAM RNA, also designated SEQ ID:269.

Another function of GAM47 is therefore inhibition of Atp-binding cassette, sub-family b (mdr/tap), member 9 (ABCB9, Accession NP_062571.1), a gene which ATP binding cassette transporter B9; has transmembrane domain, nucleotide-binding domain with Walker motifs. Accordingly, utilities of GAM47 include diagnosis, prevention and treatment of diseases and clinical conditions associated with ABCB9.

The function of ABCB9 has been established by previous studies. For background information on the ATP-binding cassette (ABC) family of transporter proteins, see ABCA4 (OMIM Ref. No. 601691). In addition to the 'full' ABC transporters with 2 transmembrane domains and 2 nucleotide-binding domains, there are 'half' proteins that contain only 1 of each domain (e.g., ABCB1; 171050). Full transporters are usually found in the plasma membrane, whereas half transporters are found in subcellular organelles. By searching an EST database and screening a T-lymphoblast cDNA library, Zhang et al. (2000) obtained a cDNA encoding ABCB9. Sequence analysis predicted that the 766-amino acid ABCB9 protein has 10 potential N-terminal transmembrane segments. ABCB9 shares 94% identity with the rodent sequences and is approximately 39% identical to 2 human endoplasmic reticulum half transporters, TAP1 (ABCB2; 170260) and TAP2 (ABCB3; 170261). RT-PCR and genomic sequence analysis established the existence of a splice variant with a 129-bp deletion expressed in testis and brain. Northern blot analysis detected low expression of a 3.7-kb transcript in most tissues tested, with an additional 2.2-kb transcript detected in tissues with relatively high expression, such as testis. Western blot analysis showed expression of a 72-kD nonglycosylated protein, significantly smaller than the predicted mass of 84.5 kD, that was enriched in lysosomes. Immunofluorescence microscopy demonstrated colocalization of ABCB9 with the lysosomal proteins LAMP1 (OMIM Ref. No. 153330) and LAMP2 (OMIM Ref. No. 309060). Immunohistochemical analysis detected ABCB9 expression in Sertoli cells of rodent seminiferous tubules. Allikmets et al. (1996) mapped an EST corresponding to the ABCB9 gene to 12q24.

Full details of the abovementioned studies are described in the following publications, the disclosure of which are hereby incorporated by reference:

Allikmets, R.; Gerrard, B.; Hutchinson, A.; Dean, M.: Characterization of the human ABC superfamily: isolation and mapping of 21 new genes using the expressed sequence tags database. Hum. Molec. Genet. 5:1649-1655, 1996; and Zhang, F.; Zhang, W.; Liu, L.; Fisher, C. L.; Hui, D.; Childs, S.; Dorovini-Zis, K.; Ling, V.: Characterization of ABCB9, an ATP binding cassette protein associated with lysosomes. J.

Further studies establishing the function and utilities of ABCB9 are found in John Hopkins OMIM database record ID 605453, and in cited publications listed in Table 5, which are hereby incorporated by reference. Atp-binding cassette, sub-family b (mdr/tap), member 9 (ABCB9, Accession NP_062570.1) is another GAM47 target gene, herein designated TARGET GENE. ABCB9 BINDING SITE is a target binding site found in the 3' untranslated region of multiple transcripts of mRNA encoded by ABCB9, corresponding to a target binding site such as BINDING SITE I, BINDING SITE II or BINDING SITE III of FIG. 8. Table 4 illustrates the complementarity of the nucleotide sequences of ABCB9 BINDING SITE, designated SEQ ID:9595, to the nucleotide sequence of GAM47 RNA, herein designated GAM RNA, also designated SEQ ID:269.

Another function of GAM47 is therefore inhibition of Atp-binding cassette, sub-family b (mdr/tap), member 9 (ABCB9, Accession NP_062570.1), a gene which ATP binding cassette transporter B9; has transmembrane domain, nucleotide-binding domain with Walker motifs. Accordingly, utilities of GAM47 include diagnosis, prevention and treatment of diseases and clinical conditions associated with ABCB9.

The function of ABCB9 has been established by previous studies. For background information on the ATP-binding cassette (ABC) family of transporter proteins, see ABCA4 (OMIM Ref. No. 601691). In addition to the 'full' ABC transporters with 2 transmembrane domains and 2 nucleotide-binding domains, there are 'half' proteins that contain only 1 of each domain (e.g., ABCB1; 171050). Full transporters are usually found in the plasma membrane, whereas half transporters are found in subcellular organelles. By searching an EST database and screening a T-lymphoblast cDNA library, Zhang et al. (2000) obtained a cDNA encoding ABCB9. Sequence analysis predicted that the 766-amino acid ABCB9 protein has 10 potential N-terminal transmembrane segments. ABCB9 shares 94% identity with the rodent sequences and is approximately 39% identical to 2 human endoplasmic reticulum half transporters, TAP1 (ABCB2; 170260) and TAP2 (ABCB3; 170261). RT-PCR and genomic sequence analysis established the existence of a splice variant with a 129-bp deletion expressed in testis and brain. Northern blot analysis detected low expression of a 3.7-kb transcript in most tissues tested, with an additional 2.2-kb transcript detected in tissues with relatively high expression, such as testis. Western blot analysis showed expression of a 72-kD nonglycosylated protein, significantly smaller than the predicted mass of 84.5 kD, that was enriched in lysosomes. Immunofluorescence microscopy demonstrated colocalization of ABCB9 with the lysosomal proteins LAMP1 (OMIM Ref. No. 153330) and LAMP2 (OMIM Ref. No. 309060). Immunohistochemical analysis detected ABCB9 expression in Sertoli cells of rodent seminiferous tubules. Allikmets et al. (1996) mapped an EST corresponding to the ABCB9 gene to 12q24.

Full details of the abovementioned studies are described in the following publications, the disclosure of which are hereby incorporated by reference:

Allikmets, R.; Gerrard, B.; Hutchinson, A.; Dean, M.: Characterization of the human ABC superfamily: isolation and mapping of 21 new genes using the expressed sequence tags database. Hum. Molec. Genet. 5:1649-1655, 1996; and Zhang, F.; Zhang, W.; Liu, L.; Fisher, C. L.; Hui, D.; Childs, S.; Dorovini-Zis, K.; Ling, V.: Characterization of ABCB9, an ATP binding cassette protein associated with lysosomes. J.

Further studies establishing the function and utilities of ABCB9 are found in John Hopkins OMIM database record ID 605453, and in cited publications listed in Table 5, which are hereby incorporated by reference. Atp-binding cassette, sub-family d (ald), member 2 (ABCD2, Accession NP_005155.1) is another GAM47 target gene, herein designated TARGET GENE. ABCD2 BINDING SITE is a target binding site found in the 5' untranslated region of mRNA encoded by ABCD2, corresponding to a target binding site such as BINDING SITE I, BINDING SITE II or BINDING SITE III of FIG. 8. Table 4 illustrates the complementarity of the nucleotide sequences of ABCD2 BINDING SITE, designated SEQ ID:2296, to the nucleotide sequence of GAM47 RNA, herein designated GAM RNA, also designated SEQ ID:269.

Another function of GAM47 is therefore inhibition of Atp-binding cassette, sub-family d (ald), member 2 (ABCD2, Accession NP_005155.1), a gene which probable transporter. and therefore may be associated with Adrenoleukodystrophy. Accordingly, utilities of GAM47 include diagnosis, prevention and treatment of Adrenoleukodystrophy, and of other diseases and clinical conditions associated with ABCD2.

The function of ABCD2 has been established by previous studies. Lombard-Platet et al. (1996) described the cloning and characterization of a mouse Ald-related gene, symbolized Aldr by them, that codes for a 741-amino acid protein sharing the same half-ABC transporter structure and 66% amino acid identity with the protein that is mutant in X-linked adrenoleukodystrophy (ALD; 300100). PMP70 (OMIM Ref. No. 170995), another half-ABC transporter in the peroxisomal membrane protein, had 38% sequence identity to the mouse Aldr protein. Lombard-Platet et al. (1996) showed that the mouse Aldr protein is associated with peroxisomes. The mouse Ald and Aldr genes show overlapping but distinctive expression patterns. Interestingly, at least in mouse, Aldr is expressed at high levels in brain and adrenal, 2 organs with major involvement in adrenoleukodystrophy. Using oligonucleotide primers designed from the mouse sequence, the authors PCR-amplified 2 overlapping fragments of an 866-bp segment from human genomic DNA. This segment from the human ALDR ortholog shares 90% amino acid identity with the mouse protein. Lombard-Platet et al. (1996) speculated that the human gene may be a candidate for a modifier gene that accounts for some of the extreme phenotypic variability of ALD. The human ALDR gene was also a candidate for 1 of the complementation groups of Zellweger syndrome (see OMIM Ref. No. 214100), a genetically heterogeneous disorder of peroxisomal biogenesis. By isotopic in situ hybridization, Savary et al. (1997) mapped the ALDR gene to 12q11-q12 and its murine homolog to a region of homology of synteny on mouse chromosome 15. The mapping to chromosome 12 was confirmed by PCR analysis of a panel of whole genome radiation hybrids.

Full details of the abovementioned studies are described in the following publications, the disclosure of which are hereby incorporated by reference:

Lombard-Platet, G.; Savary, S.; Sarde, C.-O.; Mandel, J.-L.; Chimini, G.: A close relative of the adrenoleukodystrophy (ALD) gene codes for a peroxisomal protein with a specific expression pattern. Proc. Nat. Acad. Sci. 93:1265-1269, 1996; and Savary, S.; Troffer-Charlier, N.; Gyapay, G.; Mattei, M.-G.; Chimini, G.: Chromosomal localization of the adrenoleukodystrophy-related gene in man and mice. Europ. J. Hum. Genet. 5:99.

Further studies establishing the function and utilities of ABCD2 are found in John Hopkins OMIM database record ID 601081, and in cited publications listed in Table 5, which are hereby incorporated by reference. ABHD4 (Accession NP_071343.1) is another GAM47 target gene, herein designated TARGET GENE. ABHD4 BINDING SITE is a target binding site found in the 3' untranslated region of mRNA encoded by ABHD4, corresponding to a target binding site such as BINDING SITE I, BINDING SITE II or BINDING SITE III of FIG. 8. Table 4 illustrates the complementarity of the nucleotide sequences of ABHD4 BINDING SITE, designated SEQ ID:14056, to the nucleotide sequence of GAM47 RNA, herein designated GAM RNA, also designated SEQ ID:269.

Another function of GAM47 is therefore inhibition of ABHD4 (Accession NP_071343.1). Accordingly, utilities of GAM47 include diagnosis, prevention and treatment of diseases and clinical conditions associated with ABHD4.

ACINUS (Accession NP_055792.1) is another GAM47 target gene, herein designated TARGET GENE. ACINUS BINDING SITE is a target binding site found in the 3' untranslated region of mRNA encoded by ACINUS, corresponding to a target binding site such as BINDING SITE I, BINDING SITE II or BINDING SITE III of FIG. 8. Table 4 illustrates the complementarity of the nucleotide sequences of ACINUS BINDING SITE, designated SEQ ID:5032, to the nucleotide sequence of GAM47 RNA, herein designated GAM RNA, also designated SEQ ID:269.

Another function of GAM47 is therefore inhibition of ACINUS (Accession NP_055792.1). Accordingly, utilities of GAM47 include diagnosis, prevention and treatment of diseases and clinical conditions associated with ACINUS.

A disintegrin and metalloproteinase domain 10 (ADAM10, Accession NP_001101.1) is another GAM47 target gene, herein designated TARGET GENE. ADAM10 BINDING SITE is a target binding site found in the 3' untranslated region of mRNA encoded by ADAM10, corresponding to a target binding site such as BINDING SITE I, BINDING SITE II or BINDING SITE III of FIG. 8. Table 4 illustrates the complementarity of the nucleotide sequences of ADAM10 BINDING SITE, designated SEQ ID:9109, to the nucleotide sequence of GAM47 RNA, herein designated GAM RNA, also designated SEQ ID:269.

Another function of GAM47 is therefore inhibition of A disintegrin and metalloproteinase domain 10 (ADAM10, Accession NP_001101.1), a gene which Member of ADAM family of zinc metalloproteases. Accordingly, utilities of GAM47 include diagnosis, prevention and treatment of diseases and clinical conditions associated with ADAM10.

The function of ADAM10 has been established by previous studies. Wolfsberg et al. (1995) identified a family of proteins containing a disintegrin and metalloproteinase (ADAM) domain. Members of this family are cell surface proteins with a unique structure possessing both potential adhesion and protease domains. Tumor necrosis factor-alpha (TNFA; 191160) is synthesized as a proinflammatory cytokine from a 233-amino acid precursor. Conversion of the membrane-bound precursor to a secreted mature protein is mediated by a protease termed TNFA convertase. Lunn et al. (1997) found that ADAM10 possesses TNFA convertase activity. TNFA is involved in a variety of diseases. To elucidate whether the ADAM10 locus maps to the same region as a disease susceptibility, Yamazaki et al. (1997) mapped the ADAM10 locus. Using a radiation hybrid mapping method, they showed that ADAM10 is located on 15q21.3-q23. Although ephrins form a high- affinity multivalent complex with their receptors present on axons, axons can be rapidly repelled rather than being bound. Hattori et al. (2000) showed that ephrin-A2 (OMIM Ref. No. 602756) forms a stable complex with the metalloproteinase Kuzbanian (OMIM Ref. No. ADAM10) involving interactions outside the cleavage region and the protease domain. Eph receptor binding triggered ephrin-A2 cleavage in a localized reaction specific to the cognate ligand. The cleavage-inhibiting mutation in ephrin-A2 delayed axon withdrawal. Hattori et al. (2000) concluded that their studies reveal mechanisms for protease recognition and control of cell surface proteins, and, for ephrin-A2, they may provide a means for efficient axon detachment and termination of signaling.

Full details of the abovementioned studies are described in the following publications, the disclosure of which are hereby incorporated by reference:

Lunn, C. A.; Fan, X.; Dalie, B.; Miller, K.; Zavodny, P. J.; Narula, S. K.; Lundell, D.: Purification of ADAM 10 from bovine spleen as a TNFalpha convertase. FEBS Lett. 400: 333-335, 1997; and Hattori, M.; Osterfield, M.; Flanagan, J. G.: Regulated cleavage of a contact- mediated axon repellent. Science 289: 1360-1365, 2000.

Further studies establishing the function and utilities of ADAM10 are found in John Hopkins OMIM database record ID 602192, and in cited publications listed in Table 5, which are hereby incorporated by reference. A disintegrin-like and metalloprotease (reprolysin type) with thrombospondin type 1 motif, 5 (aggrecanase-2) (ADAMTS5, Accession NP_008969.1) is another GAM47 target gene, herein designated TARGET GENE. ADAMTS5 BINDING SITE is a target binding site found in the 3' untranslated region of mRNA encoded by ADAMTS5, corresponding to a target binding site such as BINDING SITE I, BINDING SITE II or BINDING SITE III of FIG. 8. Table 4 illustrates the complementarity of the nucleotide sequences of ADAMTS5 BINDING SITE, designated SEQ ID:13500, to the nucleotide sequence of GAM47 RNA, herein designated GAM RNA, also designated SEQ ID:269.

Another function of GAM47 is therefore inhibition of A disintegrin-like and metalloprotease (reprolysin type) with thrombospondin type 1 motif, 5 (aggrecanase-2) (ADAMTS5, Accession NP_008969.1), a gene which cleaves aggrecan, a cartilage proteoglycan, and may be involved in its turnover. and therefore is associated with Arthritic diseases. Accordingly, utilities of GAM47 include diagnosis, prevention and treatment of Arthritic diseases, and of other diseases and clinical conditions associated with ADAMTS5.

The function of ADAMTS5 has been established by previous studies. Proteolysis of the extracellular matrix plays a critical role in establishing tissue architecture during development and in tissue degradation in diseases such as cancer, arthritis, Alzheimer disease, and a variety of inflammatory conditions. The proteolytic enzymes responsible include members of diverse protease families and they may work in concert or in cascades to degrade or process molecules. Two groups of zinc metalloproteinases in particular, ADAMs and MMPs (e.g., 600754), appear broadly relevant to extracellular proteolysis. Most ADAM family members are quite similar in domain organization, bearing, from amino to carboxyl termini, a signal peptide, a proregion, a zinc metalloprotease catalytic domain with the typical reprolysin signature motif, a disintegrin domain, a cysteine-rich domain, an EGF-like domain, and, in many cases, a membrane-spanning region and a cytoplasmic domain with signaling potential. Members of the ADAMTS family differ substantially from the prototypic ADAM structure in that they lack the EGF-like domain, do not have a canonical disintegrin sequence, and possess modules with similar thrombospondin type 1 repeats. By searching an EST database using the protein sequences of human ADAMTS1 to ADAMTS4 and a C. elegans ADAMTS as queries, Hurskainen et al. (1999) identified ADAMTS5, ADAMTS6 (OMIM Ref. No. 605008), and ADAMTS7 (OMIM Ref. No. 605009). They determined a partial human ADAMTS5 cDNA sequence that lacked 5-prime coding sequence. The predicted partial ADAMTS5 protein has the domain structure characteristic of ADAMTSs, beginning with a partial metalloproteinase domain. Northern blot analysis of several human tissues detected an approximately 10-kb ADAMTS5 transcript that was expressed at a low level in placenta and at barely detectable levels in a number of other tissues. Northern blot analysis showed that mouse Adamts5 was specifically expressed in a 7-day mouse embry, and at low or undetectable levels thereafter. In situ hybridization of an 8.5- day mouse embryo showed uniform Adamts5 expression throughout the embryo. In addition, Adamts5 expression was found in trophoblastic cells lining the uterine cavity, in the developing placenta, and in the decidual reaction within the uterus. In a 10.5-day mouse embry, Adamts5 expression was widespread, but at a lower level than in the 8.5-day embryo. Expression was found in mesenchyme and somites, as well as in the neural tube and developing hindgut. Abbaszade et al. (1999) demonstrated that recombinant ADAMTS5 expressed in insect cells cleaves aggrecan at the glu373-ala374 site, with the cleavage pattern and inhibitor profile indistinguishable from that observed with native aggrecanase. Northern blot analysis of several human tissues showed highest ADAMTS5 expression in placenta, with much lower expression in heart and brain. Major transcripts of 12.4, 10.7, 8.6, and 6.6 kb were detected. Real time PCR of a number of normal human tissues detected ADAMTS5 expression in placenta, cervix, uterus, bladder, and esophagus. Expression was also found in rib cartilage, chondroblastoma, and fibrous tissue and joint capsule samples from an arthritic patient.

Full details of the abovementioned studies are described in the following publications, the disclosure of which are hereby incorporated by reference:

Abbaszade, I.; Liu, R.-Q.; Yang, F.; Rosenfeld, S. A.; Ross, O. H.; Link, J. R.; Ellis, D. M.; Tortorella, M. D.; Pratta, M. A.; Hollis, J. M.; Wynn, R.; Duke, J. L.; and 15 others: Cloning and characterization of ADAMTS11, an aggrecanase from the ADAMTS family. J. Biol. Chem. 274:23443-23450, 1999; and Hurskainen, T. L.; Hirohata, S.; Seldin, M. F.; Apte, S. S.: ADAM-TS5, ADAM-TS6, and ADAM-TS7, novel members of a new family of zinc metalloproteases: general features and genomic dis.

Further studies establishing the function and utilities of ADAMTS5 are found in John Hopkins OMIM database record ID 605007, and in cited publications listed in Table 5, which are hereby incorporated by reference. ADMP (Accession NP_659472.1) is another GAM47 target gene, herein designated TARGET GENE. ADMP BINDING SITE is a target binding site found in the 3' untranslated region of mRNA encoded by ADMP, corresponding to a target binding site such as BINDING SITE I, BINDING SITE II or BINDING SITE III of FIG. 8. Table 4 illustrates the complementarity of the nucleotide sequences of ADMP BINDING SITE, designated SEQ ID:20029, to the nucleotide sequence of GAM47 RNA, herein designated GAM RNA, also designated SEQ ID:269.

Another function of GAM47 is therefore inhibition of ADMP (Accession NP_659472.1). Accordingly, utilities of GAM47 include diagnosis, prevention and treatment of diseases and clinical conditions associated with ADMP.

Aldo-keto reductase family 1, member b1 (aldose reductase) (AKR1B1, Accession NP_001619.1) is another GAM47 target gene, herein designated TARGET GENE. AKR1B1 BINDING SITE is a target binding site found in the 3' untranslated region of mRNA encoded by AKR1B1, corresponding to a target binding site such as BINDING SITE I, BINDING SITE II or BINDING SITE III of FIG. 8. Table 4 illustrates the complementarity of the nucleotide sequences of AKR1B1 BINDING SITE, designated SEQ ID:5813, to the nucleotide sequence of GAM47 RNA, herein designated GAM RNA, also designated SEQ ID:269.

Another function of GAM47 is therefore inhibition of Aldo-keto reductase family 1, member b1 (aldose reductase) (AKR1B1, Accession NP_001619.1), a gene which reduces glucose and other carbonyl-containing substrates and therefore may be associated with Diabetes, galactosemia. Accordingly, utilities of GAM47 include diagnosis, prevention and treatment of Diabetes, galactosemia, and of other diseases and clinical conditions associated with AKR1B1.

The function of AKR1B1 has been established by previous studies. See aldehyde reductase (OMIM Ref. No. 103830). Aldose reductase (EC 1.1.1.21) is a member of the monomeric, NADPH-dependent aldoketoreductase family. It catalyzes the reduction of a number of aldehydes, including the aldehyde form of glucose, which is reduced to the corresponding sugar alcohol, sorbitol. Sorbitol is subsequently metabolized to fructose by sorbitol dehydrogenase. Under normal conditions, this pathway plays a minor role in glucose metabolism in most tissues. In diabetic hyperglycemia, however, cells undergoing insulin-independent uptake of glucose produce significant quantities of sorbitol. The sorbitol accumulates in cells because of its poor penetration across cellular membranes and its slow metabolism by sorbitol dehydrogenase. The resulting hyperosmotic stress to cells may be a cause of diabetic complications such as neuropathy, retinopathy, and cataracts. Chung and LaMendola (1989) cloned and sequenced the aldose reductase gene from a human placental cDNA library using antibodies against the bovine lens aldose reductase. The deduced amino acid sequence indicated that maturation of aldose reductase involves removal of the N-terminal methionine. Nishimura et al. (1990) also cloned the aldose reductase gene using synthetic oligonucleotide probes based on partial amino acid sequences of purified human psoas muscle aldose reductase. Bohren et al. (1989) isolated aldose reductase and aldehyde reductase cDNAs. They reported that the 2 proteins are 51% identical. Northern blot analysis revealed that aldose reductase was expressed as an approximately 1.4-kb mRNA in placenta. Graham et al. (1991) determined the structure and sequence of the ALDR1 gene by analysis of cDNA and genomic clones. The gene extends over approximately 18 kb and consists of 10 exons, giving rise to a 1,384 nucleotide mRNA, excluding the poly (A) tail. The gene codes for a 316-amino acid protein with a molecular mass of 35,858 Da. The exons range in size from 82 to 168 bp, whereas the introns range from 325 to about 7,160 bp. A major site of transcription initiation in liver was mapped to an adenine residue 31 nucleotides upstream from the A of the ATG initiation codon. The promoter region of the gene contains a TATA (OMIM Ref. No. TATTTA) box and a CCAAT box, located 37 and 104 nucleotides upstream, respectively, from the transcription initiation site. Graham et al. (1991) found 4 Alu elements in the ALDR1 gene: two in intron 1 and one each in introns 4 and 9. Using the PCR to amplify specifically the human AR sequence in hamster/human hybrid DNA and also in mouse/human monochromosome hybrids, Graham et al. (1991) assigned the gene to chromosome 7. The assignment was confirmed and regionalized to 7q35 by in situ hybridization to human metaphase chromosomes using a novel, rapid method.

Full details of the abovementioned studies are described in the following publications, the disclosure of which are hereby incorporated by reference:

Graham, A.; Brown, L.; Hedge, P. J.; Gammack, A. J.; Markham, A. F.: Structure of the human aldose reductase gene. J. Biol. Chem. 266:6872-6877, 1991; and Nishimura, C.; Matsuura, Y.; Kokai, Y.; Akera, T.; Carper, D.; Morjana, N.; Lyons, C.; Flynn, T. G.: Cloning and expression of human aldose reductase. J. Biol. Chem. 265:9788-9792, 199.

Further studies establishing the function and utilities of AKR1B1 are found in John Hopkins OMIM database record ID 103880, and in cited publications listed in Table 5, which are hereby incorporated by reference. Alkb, alkylation repair homolog (e. coli) (ALKBH, Accession NP_006011.1) is another GAM47 target gene, herein designated TARGET GENE. ALKBH BINDING SITE is a target binding site found in the 3' untranslated region of mRNA encoded by ALKBH, corresponding to a target binding site such as BINDING SITE I, BINDING SITE II or BINDING SITE III of FIG. 8. Table 4 illustrates the complementarity of the nucleotide sequences of ALKBH BINDING SITE, designated SEQ ID:8481, to the nucleotide sequence of GAM47 RNA, herein designated GAM RNA, also designated SEQ ID:269.

Another function of GAM47 is therefore inhibition of Alkb, alkylation repair homolog (e. coli) (ALKBH, Accession NP_006011.1). Accordingly, utilities of GAM47 include diagnosis, prevention and treatment of diseases and clinical conditions associated with ALKBH.

Arachidonate 12-lipoxygenase, 12r type (ALOX12B, Accession NP_001130.1) is another GAM47 target gene, herein designated TARGET GENE. ALOX12B BINDING SITE is a target binding site found in the 5' untranslated region of mRNA encoded by ALOX12B, corresponding to a target binding site such as BINDING SITE I, BINDING SITE II or BINDING SITE III of FIG. 8. Table 4 illustrates the complementarity of the nucleotide sequences of ALOX12B BINDING SITE, designated SEQ ID:9630, to the nucleotide sequence of GAM47 RNA, herein designated GAM RNA, also designated SEQ ID:269.

Another function of GAM47 is therefore inhibition of Arachidonate 12-lipoxygenase, 12r type (ALOX12B, Accession NP_001130.1), a gene which converts arachidonic acid to 12r-hydroperoxyeicosatetraenoic acid (12r-hpete). and therefore is associated with Ichthyosiform erythroderma. Accordingly, utilities of GAM47 include diagnosis, prevention and treatment of Ichthyosiform erythroderma, and of other diseases and clinical conditions associated with ALOX12B.

The function of ALOX12B has been established by previous studies. 12R- lipoxygenase catalyzes the conversion of arachidonic acid to 12R- hydroxyeicosatetraenoic acid (12R-HETE). In a database search for novel lipoxygenases, Sun et al. (1998) identified a novel lipoxygenase gene. The cDNA encoded a 701-amino acid polypeptide which when expressed produced a protein with specific 12R-lipoxygenase activity. By RT-PCR, but not by Northern blot analysis, Sun et al. (1998) detected 12R-lipoxygenase mRNA in B cells and adult skin. Boeglin et al. (1998) also cloned the ALOX12B gene. The ALOX12B cDNA showed the greatest sequence similarity to the second type of human 15S-lipoxygenase (ALOX15B; 603697), and was more distantly related to human 12S-lipoxygenase (ALOX12; 152391). They showed that ALOX12B is expressed in keratinocytes and psoriatic scales, but they were not able to detect any transcription of the gene on several multiple-tissue Northern blots. Boeglin et al. (1998) provided mechanistic evidence for a lipoxygenase route to 12R-HETE in human psoriatic tissue and described a 12R-lipoxygenase that could account for the biosynthesis.

Full details of the abovementioned studies are described in the following publications, the disclosure of which are hereby incorporated by reference:

Boeglin, W. E.; Kim, R. B.; Brash, A. R.: A 12R-lipoxygenase in human skin: mechanistic evidence, molecular cloning, and expression. Proc. Nat. Acad. Sci. 95:6744-6749, 1998; and Jobard, F.; Lefevre, C.; Karaduman, A.; Blanchet-Bardon, C.; Emre, S.; Weissenbach, J.; Ozguc, M.; Lathrop, M.; Prud'homme, J.-F.; Fischer, J.: Lipoxygenase-3 (ALOXE3) and 12(R)-lipoxy.

Further studies establishing the function and utilities of ALOX12B are found in John Hopkins OMIM database record ID 603741, and in cited publications listed in Table 5, which are hereby incorporated by reference. Amphiphysin (stiff-man syndrome with breast cancer 128 kda autoantigen) (AMPH, Accession NP_647477.1) is another GAM47 target gene, herein designated TARGET GENE. AMPH BINDING SITE is a target binding site found in the 3' untranslated region of multiple transcripts of mRNA encoded by AMPH, corresponding to a target binding site such as BINDING SITE I, BINDING SITE II or BINDING SITE III of FIG. 8. Table 4 illustrates the complementarity of the nucleotide sequences of AMPH BINDING SITE, designated SEQ ID:18267, to the nucleotide sequence of GAM47 RNA, herein designated GAM RNA, also designated SEQ ID:269.

Another function of GAM47 is therefore inhibition of Amphiphysin (stiff-man syndrome with breast cancer 128 kda autoantigen) (AMPH, Accession NP_647477.1), a gene which is a synaptic vesicle protein and therefore may be associated with Stiff-man syndrome. Accordingly, utilities of GAM47 include diagnosis, prevention and treatment of Stiff-man syndrome, and of other diseases and clinical conditions associated with AMPH.

The function of AMPH has been established by previous studies. Stiff-man syndrome (OMIM Ref. No. 184850) is a rare disease of the central nervous system characterized by progressive rigidity of the body musculature with superimposed painful spasms. An autoimmune origin of the disease has been proposed. Approximately 60% of patients are positive for autoantibodies directed against the GABA-synthesizing enzyme glutamic acid decarboxylase (GAD; 605363). A few patients, all women affected by breast cancer, were found to be negative for GAD autoantibodies but positive for autoantibodies directed against a 128-kD synaptic protein. De Camilli et al. (1993) found that this antigen is amphiphysin. Both GAD and amphiphysin are nonintrinsic membrane proteins that are concentrated in nerve terminals, where a pool of the 2 proteins is associated with the cytoplasmic surface of synaptic vesicles. David et al. (1994) found that the N- and C-terminal domains of the amphiphysin protein are highly conserved between chicken and human. Autoantibodies from patients with the stiff-man syndrome show a dominant autoepitope located in the C-terminal region, which contains an SH3 domain. By PCR analysis of hybrid cell DNAs and by fluorescence in situ hybridization, Yamamoto et al. (1995) mapped the AMPH gene to 7p14-p13. They noted that the tissue distribution of AMPH and its association with neurotransmitter vesicles make the gene a candidate for involvement in such diverse heritable disorders as those of the nervous system, certain endocrine tissues (such as the adrenal medulla, pituitary gland or endocrine pancreas), or male fertility. They noted further that 2 disorders of the retina, retinitis pigmentosa-9 (RP9; 180104) and dominant cystoid macular dystrophy (MDDC; 153880), have been assigned to the same chromosomal region. Clearly, AMPH expression is not restricted to the retina, but neither are the products of genes responsible for some other forms of retinal degeneration, such as gyrate atrophy (OMIM Ref. No. 258870) and choroideremia (OMIM Ref. No. 303100).

Full details of the abovementioned studies are described in the following publications, the disclosure of which are hereby incorporated by reference:

David, C.; Solimena, M.; De Camilli, P.: Autoimmunity in stiff-man syndrome with breast cancer is targeted to the C-terminal region of human amphiphysin, a protein similar to the yeast proteins, Rvs167 and Rvs161. FEBS Lett. 351:73-79, 1994; and De Camilli, P.; Thomas, A.; Cofiell, R.; Folli, F.; Lichte, B.; Piccolo, G.; Meinck, H.-M.; Austoni, M.; Fassetta, G.; Bottazzo, G.; Bates, D.; Cartlidge, N.; Solimena, M.; Kilimann, M.

Further studies establishing the function and utilities of AMPH are found in John Hopkins OMIM database record ID 600418, and in cited publications listed in Table 5, which are hereby incorporated by reference. Amphiphysin (stiff-man syndrome with breast cancer 128 kda autoantigen) (AMPH, Accession NP_001626.1) is another GAM47 target gene, herein designated TARGET GENE. AMPH BINDING SITE is a target binding site found in the 3' untranslated region of multiple transcripts of mRNA encoded by AMPH, corresponding to a target binding site such as BINDING SITE I, BINDING SITE II or BINDING SITE III of FIG. 8. Table 4 illustrates the complementarity of the nucleotide sequences of AMPH BINDING SITE, designated SEQ ID:18267, to the nucleotide sequence of GAM47 RNA, herein designated GAM RNA, also designated SEQ ID:269.

Another function of GAM47 is therefore inhibition of Amphiphysin (stiff-man syndrome with breast cancer 128 kda autoantigen) (AMPH, Accession NP_001626.1), a gene which is a synaptic vesicle protein and therefore may be associated with Stiff-man syndrome. Accordingly, utilities of GAM47 include diagnosis, prevention and treatment of Stiff-man syndrome, and of other diseases and clinical conditions associated with AMPH.

The function of AMPH has been established by previous studies. Stiff-man syndrome (OMIM Ref. No. 184850) is a rare disease of the central nervous system characterized by progressive rigidity of the body musculature with superimposed painful spasms. An autoimmune origin of the disease has been proposed. Approximately 60% of patients are positive for autoantibodies directed against the GABA-synthesizing enzyme glutamic acid decarboxylase (GAD; 605363). A few patients, all women affected by breast cancer, were found to be negative for GAD autoantibodies but positive for autoantibodies directed against a 128-kD synaptic protein. De Camilli et al. (1993) found that this antigen is amphiphysin. Both GAD and amphiphysin are nonintrinsic membrane proteins that are concentrated in nerve terminals, where a pool of the 2 proteins is associated with the cytoplasmic surface of synaptic vesicles. David et al. (1994) found that the N- and C-terminal domains of the amphiphysin protein are highly conserved between chicken and human. Autoantibodies from patients with the stiff-man syndrome show a dominant autoepitope located in the C-terminal region, which contains an SH3 domain. By PCR analysis of hybrid cell DNAs and by fluorescence in situ hybridization, Yamamoto et al. (1995) mapped the AMPH gene to 7p14-p13. They noted that the tissue distribution of AMPH and its association with neurotransmitter vesicles make the gene a candidate for involvement in such diverse heritable disorders as those of the nervous system, certain endocrine tissues (such as the adrenal medulla, pituitary gland or endocrine pancreas), or male fertility. They noted further that 2 disorders of the retina, retinitis pigmentosa-9 (RP9; 180104) and dominant cystoid macular dystrophy (MDDC; 153880), have been assigned to the same chromosomal region. Clearly, AMPH expression is not restricted to the retina, but neither are the products of genes responsible for some other forms of retinal degeneration, such as gyrate atrophy (OMIM Ref. No. 258870) and choroideremia (OMIM Ref. No. 303100).

Full details of the abovementioned studies are described in the following publications, the disclosure of which are hereby incorporated by reference:

David, C.; Solimena, M.; De Camilli, P.: Autoimmunity in stiff-man syndrome with breast cancer is targeted to the C-terminal region of human amphiphysin, a protein similar to the yeast proteins, Rvs167 and Rvs161. FEBS Lett. 351:73-79, 1994; and De Camilli, P.; Thomas, A.; Cofiell, R.; Folli, F.; Lichte, B.; Piccolo, G.; Meinck, H.-M.; Austoni, M.; Fassetta, G.; Bottazzo, G.; Bates, D.; Cartlidge, N.; Solimena, M.; Kilimann, M.

Further studies establishing the function and utilities of AMPH are found in John Hopkins OMIM database record ID 600418, and in cited publications listed in Table 5, which are hereby incorporated by reference. Ankyrin 2, neuronal (ANK2, Accession NP_001139.2) is another GAM47 target gene, herein designated TARGET GENE. ANK2 BINDING SITE is a target binding site found in the 3' untranslated region of multiple transcripts of mRNA encoded by ANK2, corresponding to a target binding site such as BINDING SITE I, BINDING SITE II or BINDING SITE III of FIG. 8. Table 4 illustrates the complementarity of the nucleotide sequences of ANK2 BINDING SITE, designated SEQ ID:17426, to the nucleotide sequence of GAM47 RNA, herein designated GAM RNA, also designated SEQ ID:269.

Another function of GAM47 is therefore inhibition of Ankyrin 2, neuronal (ANK2, Accession NP_001139.2), a gene which attaches integral membrane proteins to cytoskeletal elements. also binds to cytoskeletal proteins. Accordingly, utilities of GAM47 include diagnosis, prevention and treatment of diseases and clinical conditions associated with ANK2.

The function of ANK2 has been established by previous studies. Tse et al. (1991) studied immunoreactive isoforms of erythrocyte ankyrin found in nonerythroid tissues. Using an erythrocyte ankyrin cDNA clone as a hybridization probe, they isolated a clone from a human genomic library that hybridized at low but not at high stringency. Further studies suggested that the clone represented part of a gene for non-erythroid ankyrin, which they designated ANK2. By analysis of somatic cell hybrids and by fluorescence in situ hybridization, they assigned ANK2 to 4q25-q27. Otto et al. (1991) isolated and sequenced cDNAs related to 2 brain ankyrin isoforms and showed that they are produced through alternative splicing of the mRNA from a single gene. By analysis of human/rodent cell hybrids, Otto et al. (1991) assigned the brain ankyrin gene to chromosome 4.

Full details of the abovementioned studies are described in the following publications, the disclosure of which are hereby incorporated by reference:

Otto, E.; Kunimoto, M.; McLaughlin, T.; Bennett, V.: Isolation and characterization of cDNAs encoding human brain ankyrins reveal a family of alternatively spliced genes. J. Cell Biol. 114:241-253, 1991; and Tse, W. T.; Menninger, J. C.; Yang-Feng, T. L.; Francke, U.; Sahr, K. E.; Lux, S. E.; Ward, D. C.; Forget, B. G.: Isolation and chromosomal localization of a novel non-erythroid ankyri.

Further studies establishing the function and utilities of ANK2 are found in John Hopkins OMIM database record ID 106410, and in cited publications listed in Table 5, which are hereby incorporated by reference. Ankyrin 2, neuronal (ANK2, Accession NP_066187.1) is another GAM47 target gene, herein designated TARGET GENE. ANK2 BINDING SITE is a target binding site found in the 3' untranslated region of multiple transcripts of mRNA encoded by ANK2, corresponding to a target binding site such as BINDING SITE I, BINDING SITE II or BINDING SITE III of FIG. 8. Table 4 illustrates the complementarity of the nucleotide sequences of ANK2 BINDING SITE, designated SEQ ID:17426, to the nucleotide sequence of GAM47 RNA, herein designated GAM RNA, also designated SEQ ID:269.

Another function of GAM47 is therefore inhibition of Ankyrin 2, neuronal (ANK2, Accession NP_066187.1), a gene which attaches integral membrane proteins to cytoskeletal elements. also binds to cytoskeletal proteins. Accordingly, utilities of GAM47 include diagnosis, prevention and treatment of diseases and clinical conditions associated with ANK2.

The function of ANK2 has been established by previous studies. Tse et al. (1991) studied immunoreactive isoforms of erythrocyte ankyrin found in nonerythroid tissues. Using an erythrocyte ankyrin cDNA clone as a hybridization probe, they isolated a clone from a human genomic library that hybridized at low but not at high stringency. Further studies suggested that the clone represented part of a gene for non-erythroid ankyrin, which they designated ANK2. By analysis of somatic cell hybrids and by fluorescence in situ hybridization, they assigned ANK2 to 4q25- q27. Otto et al. (1991) isolated and sequenced cDNAs related to 2 brain ankyrin isoforms and showed that they are produced through alternative splicing of the mRNA from a single gene. By analysis of human/rodent cell hybrids, Otto et al. (1991) assigned the brain ankyrin gene to chromosome 4.

Full details of the abovementioned studies are described in the following publications, the disclosure of which are hereby incorporated by reference:

Otto, E.; Kunimoto, M.; McLaughlin, T.; Bennett, V.: Isolation and characterization of cDNAs encoding human brain ankyrins reveal a family of alternatively spliced genes. J. Cell Biol. 114:241-253, 1991; and Tse, W. T.; Menninger, J. C.; Yang-Feng, T. L.; Francke, U.; Sahr, K. E.; Lux, S. E.; Ward, D. C.; Forget, B. G.: Isolation and chromosomal localization of a novel non- erythroid ankyri.

Further studies establishing the function and utilities of ANK2 are found in John Hopkins OMIM database record ID 106410, and in cited publications listed in Table 5, which are hereby incorporated by reference. ANP32E (Accession NP_112182.1) is another GAM47 target gene, herein designated TARGET GENE. ANP32E BINDING SITE is a target binding site found in the 5' untranslated region of mRNA encoded by ANP32E, corresponding to a target binding site such as BINDING SITE I, BINDING SITE II or BINDING SITE III of FIG. 8. Table 4 illustrates the complementarity of the nucleotide sequences of ANP32E BINDING SITE, designated SEQ ID:16499, to the nucleotide sequence of GAM47 RNA, herein designated GAM RNA, also designated SEQ ID:269.

Another function of GAM47 is therefore inhibition of ANP32E (Accession NP_112182.1). Accordingly, utilities of GAM47 include diagnosis, prevention and treatment of diseases and clinical conditions associated with ANP32E.

Amine oxidase, copper containing 3 (vascular adhesion protein 1) (AOC3, Accession NP_003725.1) is another GAM47 target gene, herein designated TARGET GENE. AOC3 BINDING SITE is a target binding site found in the 3' untranslated region of mRNA encoded by AOC3, corresponding to a target binding site such as BINDING SITE I, BINDING SITE II or BINDING SITE III of FIG. 8. Table 4 illustrates the complementarity of the nucleotide sequences of AOC3 BINDING SITE, designated SEQ ID:17921, to the nucleotide sequence of GAM47 RNA, herein designated GAM RNA, also designated SEQ ID:269.

Another function of GAM47 is therefore inhibition of Amine oxidase, copper containing 3 (vascular adhesion protein 1) (AOC3, Accession NP_003725.1), a gene which catalyze the oxidative conversion of amines to aldehydes in the presence of copper and quinone cofactor. Accordingly, utilities of GAM47 include diagnosis, prevention and treatment of diseases and clinical conditions associated with AOC3.

The function of AOC3 has been established by previous studies. Zhang and McIntire (1996) cloned a novel amine oxidase, HPAO, from a human placenta cDNA library. The gene encodes a 763-amino acid polypeptide which contains a secretory signal sequence. Morris et al. (1997) cloned a partial rat cDNA which they identified as the rat homolog of HPAO. They reported that the product is a major protein on the adipocyte plasma membrane. Smith et al. (1998) studied vascular adhesion protein-1 (VAP1), a molecule expressed in endothelial cells that mediates binding of lymphocytes. These authors noted that the amino acid sequence of VAP1 was identical to that of HPAO. Expression studies revealed that the VAP1 protein has adhesive properties and also has functional monoamine oxidase activity. Northern blot analysis detected a 4.1-kb mRNA in a wide variety of human tissues.

Full details of the abovementioned studies are described in the following publications, the disclosure of which are hereby incorporated by reference:

Morris, N. J.; Ducret, A.; Aebersold, R.; Ross, S. A.; Keller, S. R.; Lienhard, G. E.: Membrane amine oxidase cloning and identification as a major protein in the adipocyte plasma membrane. J. Biol. Chem. 272:9388-9392, 1997; and Smith, D. J.; Salmi, M.; Bono, P.; Hellman, J.; Leu, T.; Jalkanen, S.: Cloning of vascular adhesion protein 1 reveals a novel multifunctional adhesion molecule. J. Exp. Med. 188: 17-27.

Further studies establishing the function and utilities of AOC3 are found in John Hopkins OMIM database record ID 603735, and in cited publications listed in Table 5, which are hereby incorporated by reference. Ap1 gamma subunit binding protein 1 (AP1GBP1, Accession NP_542118.1) is another GAM47 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:6227, to the nucleotide sequence of GAM47 RNA, herein designated GAM RNA, also designated SEQ ID:269.

Another function of GAM47 is therefore inhibition of Ap1 gamma subunit binding protein 1 (AP1GBP1, Accession NP_542118.1). Accordingly, utilities of GAM47 include diagnosis, prevention and treatment of diseases and clinical conditions associated with AP1GBP1.

Adaptor-related protein complex 1, sigma 1 subunit (AP1S1, Accession NP_476430.1) is another GAM47 target gene, herein designated TARGET GENE. AP1S1 BINDING SITE is a target binding site found in the 3' untranslated region of multiple transcripts of mRNA encoded by AP1S1, corresponding to a target binding site such as BINDING SITE I, BINDING SITE II or BINDING SITE III of FIG. 8. Table 4 illustrates the complementarity of the nucleotide sequences of AP1S1 BINDING SITE, designated SEQ ID:5641, to the nucleotide sequence of GAM47 RNA, herein designated GAM RNA, also designated SEQ ID:269.

Another function of GAM47 is therefore inhibition of Adaptor-related protein complex 1, sigma 1 subunit (AP1S1, Accession NP_476430.1), a gene which promotes the formation of clathrin-coated pits and vesicles. Accordingly, utilities of GAM47 include diagnosis, prevention and treatment of diseases and clinical conditions associated with AP1S1.

The function of AP1S1 has been established by previous studies. Clathrin and its associated heterotetrameric protein complexes (APs) are the main protein components of the coat surrounding the cytoplasmic face of coated vesicles. Two main types of APs, AP-1 and AP-2, are found in clathrin-coated structures located at the Golgi complex and the plasma membrane of mammalian cells, respectively. AP-1 is composed of 2 large chains, beta-prime-adaptin (OMIM Ref. No. 600157) and gamma-adaptin (OMIM Ref. No. 603533); a medium (mu) chain, AP47 (OMIM Ref. No. 603535); and a small (sigma) chain, AP19. Kirchhausen et al. (1991) isolated cDNAs encoding mouse AP19 and rat AP17 (OMIM Ref. No. 602242), the small subunit of AP-2. The predicted rat AP17 shares 45% protein sequence identity with mouse AP19. Takatsu et al. (1998) identified a human cDNA encoding AP19, which they designated sigma-1A. They reported that the predicted mouse and human AP19 proteins are identical. Northern blot analysis revealed that the approximately 1.4-kb AP19 mRNA was expressed ubiquitously in human tissues Full details of the abovementioned studies are described in the following publications, the disclosure of which are hereby incorporated by reference:

Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002; and Kirchhausen, T.; Davis, A. C.; Frucht, S.; O'Brine Greco, B.; Payne, G. S.; Tubb, B.: AP17 and AP19, the mammalian small chains of the clathrin-associated protein complexes show homol.

Further studies establishing the function and utilities of AP1S1 are found in John Hopkins OMIM database record ID 603531, and in cited publications listed in Table 5, which are hereby incorporated by reference. APLN (Accession NP_059109.2) is another GAM47 target gene, herein designated TARGET GENE. APLN BINDING SITE is a target binding site found in the 3' untranslated region of mRNA encoded by APLN, corresponding to a target binding site such as BINDING SITE I, BINDING SITE II or BINDING SITE III of FIG. 8. Table 4 illustrates the complementarity of the nucleotide sequences of APLN BINDING SITE, designated SEQ ID:12239, to the nucleotide sequence of GAM47 RNA, herein designated GAM RNA, also designated SEQ ID:269.

Another function of GAM47 is therefore inhibition of APLN (Accession NP_059109.2). Accordingly, utilities of GAM47 include diagnosis, prevention and treatment of diseases and clinical conditions associated with APLN.

APM1 (Accession NP_004788.1) is another GAM47 target gene, herein designated TARGET GENE. APM1 BINDING SITE is a target binding site found in the 3' untranslated region of mRNA encoded by APM1, corresponding to a target binding site such as BINDING SITE I, BINDING SITE II or BINDING SITE III of FIG. 8. Table 4 illustrates the complementarity of the nucleotide sequences of APM1 BINDING SITE, designated SEQ ID:913, to the nucleotide sequence of GAM47 RNA, herein designated GAM RNA, also designated SEQ ID:269.

Another function of GAM47 is therefore inhibition of APM1 (Accession NP_004788.1). Accordingly, utilities of GAM47 include diagnosis, prevention and treatment of diseases and clinical conditions associated with APM1.

Apolipoprotein b mrna editing enzyme, catalytic polypeptide-like 3c (APOBEC3C, Accession NP_055323.2) is another GAM47 target gene, herein designated TARGET GENE. APOBEC3C BINDING SITE is a target binding site found in the 3' untranslated region of mRNA encoded by APOBEC3C, corresponding to a target binding site such as BINDING SITE I, BINDING SITE II or BINDING SITE III of FIG. 8. Table 4 illustrates the complementarity of the nucleotide sequences of APOBEC3C BINDING SITE, designated SEQ ID:19621, to the nucleotide sequence of GAM47 RNA, herein designated GAM RNA, also designated SEQ ID:269.

Another function of GAM47 is therefore inhibition of Apolipoprotein b mrna editing enzyme, catalytic polypeptide-like 3c (APOBEC3C, Accession NP_055323.2). Accordingly, utilities of GAM47 include diagnosis, prevention and treatment of diseases and clinical conditions associated with APOBEC3C.

Apolipoprotein b mrna editing enzyme, catalytic polypeptide-like 3f (APOBEC3F, Accession NP_660341.2) is another GAM47 target gene, herein designated TARGET GENE. APOBEC3F BINDING SITE is a target binding site found in the 3' untranslated region of mRNA encoded by APOBEC3F, corresponding to a target binding site such as BINDING SITE I, BINDING SITE II or BINDING SITE III of FIG. 8. Table 4 illustrates the complementarity of the nucleotide sequences of APOBEC3F BINDING SITE, designated SEQ ID:18776, to the nucleotide sequence of GAM47 RNA, herein designated GAM RNA, also designated SEQ ID:269.

Another function of GAM47 is therefore inhibition of Apolipoprotein b mrna editing enzyme, catalytic polypeptide-like 3f (APOBEC3F, Accession NP_660341.2). Accordingly, utilities of GAM47 include diagnosis, prevention and treatment of diseases and clinical conditions associated with APOBEC3F.

Amyloid beta (a4) precursor protein (protease nexin-ii, alzheimer disease) (APP, Accession NP_000475.1) is another GAM47 target gene, herein designated TARGET GENE. APP BINDING SITE is a target binding site found in the 3' untranslated region of mRNA encoded by APP, corresponding to a target binding site such as BINDING SITE I, BINDING SITE II or BINDING SITE III of FIG. 8. Table 4 illustrates the complementarity of the nucleotide sequences of APP BINDING SITE, designated SEQ ID:4997, to the nucleotide sequence of GAM47 RNA, herein designated GAM RNA, also designated SEQ ID:269.

Another function of GAM47 is therefore inhibition of Amyloid beta (a4) precursor protein (protease nexin-ii, alzheimer disease) (APP, Accession NP_000475.1). Accordingly, utilities of GAM47 include diagnosis, prevention and treatment of diseases and clinical conditions associated with APP.

Androgen receptor (dihydrotestosterone receptor; testicular feminization; spinal and bulbar muscular atrophy; kennedy disease) (AR, Accession NP_000035.2) is another GAM47 target gene, herein designated TARGET GENE. AR BINDING SITE is a target binding site found in the 3' untranslated region of mRNA encoded by AR, corresponding to a target binding site such as BINDING SITE I, BINDING SITE II or BINDING SITE III of FIG. 8. Table 4 illustrates the complementarity of the nucleotide sequences of AR BINDING SITE, designated SEQ ID:7646, to the nucleotide sequence of GAM47 RNA, herein designated GAM RNA, also designated SEQ ID:269.

Another function of GAM47 is therefore inhibition of Androgen receptor (dihydrotestosterone receptor; testicular feminization; spinal and bulbar muscular atrophy; kennedy disease) (AR, Accession NP_000035.2), a gene which are involved in the regulation of eukaryotic gene expression and affect cellular proliferation and differentiation in target tissues. and therefore is associated with Androgen insensitivity syndrome. Accordingly, utilities of GAM47 include diagnosis, prevention and treatment of Androgen insensitivity syndrome, and of other diseases and clinical conditions associated with AR.

The function of AR has been established by previous studies. The length of a polymorphic CAG repeat sequence occurring in the androgen receptor gene is inversely correlated with transcriptional activity by the androgen receptor. Men who possess exceptionally long CAG repeat lengths experience clinical androgen insensitivity, presumably related to reduced transcriptional activity of the receptor. Prostate carcinogenesis is dependent on androgens. Because shorter CAG repeat lengths are associated with high transcriptional activity of AR, Irvine et al. (1995) proposed that men with shorter repeat lengths will be at higher risk for prostate cancer. Some indirect evidence is consistent with this hypothesis. African-Americans, who have generally shorter CAG repeat lengths in the AR gene, have a higher incidence and mortality rate from prostate cancer (Coetzee and Ross, 1994). Moreover, because of X linkage, a history of disease in a brother carries greater risk than paternal history. Against this background, Giovannucci et al. (1997) conducted within the Physician's Health Study a nested case-controlled study of 587 newly diagnosed cases of prostate cancer detected between 1982 and 1995, and 588 controls without prostate cancer. They found an association between fewer androgen receptor gene CAG repeats and higher risk of total prostate cancer. In particular, a shorter CAG repeat sequence was associated with cancers characterized by extraprostatic extension, distant metastases, or high histologic grade. Variability in the CAG repeat length was not associated with low-grade or low-stage disease.

Animal model experiments lend further support to the function of AR. Abel et al. (2001) created transgenic mice that developed many of the motor symptoms of SBMA and had a truncated, highly expanded androgen receptor gene driven by the neurofilament light chain (OMIM Ref. No. 162280) promoter. In addition, transgenic mice created with the prion protein (OMIM Ref. No. 176640) promoter developed widespread neurologic disease, reminiscent of juvenile forms of other polyglutamine diseases. The distribution of neurologic symptoms depended on the expression level and pattern of the promoter used, rather than on specific characteristics of androgen receptor metabolism or function. The transgenic mice that were generated developed neuronal intranuclear inclusions (NIIs), a hallmark of SBMA and the other polyglutamine diseases. These inclusions were ubiquitinated and sequestered molecular chaperones, components of the 26S proteasome (OMIM Ref. No. 604449) and the transcriptional activator CREB-binding protein. Apart from the presence of NIIs, evidence of neuropathology or neurogenic muscle atrophy was absent, suggesting to the authors that the neurologic phenotypes observed were the result of neuronal dysfunction rather than neuronal degeneration.

It is appreciated that the abovementioned animal model for AR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Abel, A.; Walcott, J.; Woods, J.; Duda, J.; Merry, D. E.: Expression of expanded repeat androgen receptor produces neurologic disease in transgenic mice. Hum. Molec. Genet. 10:107-116, 2001; and Irvine, R. A.; y, M. C.; Ross, R. K.; Coetzee, G. A.: The CAG and GGC microsatellites of the androgen receptor gene are in linkage disequilibrium in men with prostate cancer. Cancer.

Further studies establishing the function and utilities of AR are found in John Hopkins OMIM database record ID 313700, and in cited publications listed in Table 5, which are hereby incorporated by reference. Artemin (ARTN, Accession NP_003967.1) is another GAM47 target gene, herein designated TARGET GENE. ARTN BINDING SITE is a target binding site found in the 5' untranslated region of multiple transcripts of mRNA encoded by ARTN, corresponding to a target binding site such as BINDING SITE I, BINDING SITE II or BINDING SITE III of FIG. 8. Table 4 illustrates the complementarity of the nucleotide sequences of ARTN BINDING SITE, designated SEQ ID:2193, to the nucleotide sequence of GAM47 RNA, herein designated GAM RNA, also designated SEQ ID:269.

Another function of GAM47 is therefore inhibition of Artemin (ARTN, Accession NP_003967.1). Accordingly, utilities of GAM47 include diagnosis, prevention and treatment of diseases and clinical conditions associated with ARTN.

N-acylsphingosine amidohydrolase (acid ceramidase) 1 (ASAH1, Accession NP_808592.1) is another GAM47 target gene, herein designated TARGET GENE. ASAH1 BINDING SITE is a target binding site found in the 3' untranslated region of multiple transcripts of mRNA encoded by ASAH1, corresponding to a target binding site such as BINDING SITE I, BINDING SITE II or BINDING SITE III of FIG. 8. Table 4 illustrates the complementarity of the nucleotide sequences of ASAH1 BINDING SITE, designated SEQ ID:17659, to the nucleotide sequence of GAM47 RNA, herein designated GAM RNA, also designated SEQ ID:269.

Another function of GAM47 is therefore inhibition of N-acylsphingosine amidohydrolase (acid ceramidase) 1 (ASAH1, Accession NP_808592.1). Accordingly, utilities of GAM47 include diagnosis, prevention and treatment of diseases and clinical conditions associated with ASAH1.

N-acylsphingosine amidohydrolase (acid ceramidase) 1 (ASAH1, Accession NP_004306.2) is another GAM47 target gene, herein designated TARGET GENE. ASAH1 BINDING SITE is a target binding site found in the 3' untranslated region of multiple transcripts of mRNA encoded by ASAH1, corresponding to a target binding site such as BINDING SITE I, BINDING SITE II or BINDING SITE III of FIG. 8. Table 4 illustrates the complementarity of the nucleotide sequences of ASAH1 BINDING SITE, designated SEQ ID:17659, to the nucleotide sequence of GAM47 RNA, herein designated GAM RNA, also designated SEQ ID:269.

Another function of GAM47 is therefore inhibition of N-acylsphingosine amidohydrolase (acid ceramidase) 1 (ASAH1, Accession NP_004306.2). Accordingly, utilities of GAM47 include diagnosis, prevention and treatment of diseases and clinical conditions associated with ASAH1.

Ankyrin repeat and socs box-containing 1 (ASB1, Accession NP_057198.1) is another GAM47 target gene, herein designated TARGET GENE. ASB1 BINDING SITE is a target binding site found in the 3' untranslated region of mRNA encoded by ASB1, corresponding to a target binding site such as BINDING SITE I, BINDING SITE II or BINDING SITE III of FIG. 8. Table 4 illustrates the complementarity of the nucleotide sequences of ASB1 BINDING SITE, designated SEQ ID:18379, to the nucleotide sequence of GAM47 RNA, herein designated GAM RNA, also designated SEQ ID:269.

Another function of GAM47 is therefore inhibition of Ankyrin repeat and socs box-containing 1 (ASB1, Accession NP_057198.1), a gene which May mediate protein-protein interactions. Accordingly, utilities of GAM47 include diagnosis, prevention and treatment of diseases and clinical conditions associated with ASB1.

The function of ASB1 has been established by previous studies. Suppressor of cytokine signaling (SOCS) protein expression is induced by cytokines in a range of tissues, and they appear to act in a negative feedback loop to regulate signal transduction. Members of the SOCS family are characterized by a variable N-terminal sequence, a central SH2 domain, and a conserved C-terminal SOCS box. They mediate their inhibitory functions through interactions with JAK (e.g., JAK3; 600173) kinases. By EST database searching, probing a mouse spleen cDNA library, and further database searching, Kile et al. (2000) identified a cDNA encoding ASB1, which is identical to the KIAA1146 gene identified by Hirosawa et al. (1999). Sequence analysis predicted that the 335-amino acid protein, which is 94% identical to the mouse protein, contains 6 ankyrin repeats and a C-terminal SOCS box. Northern blot analysis of mouse tissues revealed wide expression of a 5.5-kb transcript, with highest expression in testis, spleen, and bone marrow. Genomic sequence analysis determined that the ASB1 gene contains at least 5 exons.

Full details of the abovementioned studies are described in the following publications, the disclosure of which are hereby incorporated by reference:

Hirosawa, M.; Nagase, T.; Ishikawa, K.; Kikuno, R.; Nomura, N.; Ohara, O.: Characterization of cDNA clones selected by the GeneMark analysis from size-fractionated cDNA libraries from human brain. DNA Res. 6:329-336, 1999. ; and Kile, B. T.; Viney, E. M.; Willson, T. A.; Brodnicki, T. C.; Cancilla, M. R.; Herlihy, A. S.; Croker, B. A.; Baca, M.; Nicola, N. A.; Hilton, D. J.; Alexander, W. S.: Cloning and char.

Further studies establishing the function and utilities of ASB1 are found in John Hopkins OMIM database record ID 605758, and in cited publications listed in Table 5, which are hereby incorporated by reference. Atpase, na+/k+ transporting, alpha 3 polypeptide (ATP1A3, Accession NP_689509.1) is another GAM47 target gene, herein designated TARGET GENE. ATP1A3 BINDING SITE is a target binding site found in the 3' untranslated region of mRNA encoded by ATP1A3, corresponding to a target binding site such as BINDING SITE I, BINDING SITE II or BINDING SITE III of FIG. 8. Table 4 illustrates the complementarity of the nucleotide sequences of ATP1A3 BINDING SITE, designated SEQ ID:12442, to the nucleotide sequence of GAM47 RNA, herein designated GAM RNA, also designated SEQ ID:269.

Another function of GAM47 is therefore inhibition of Atpase, na+/k+ transporting, alpha 3 polypeptide (ATP1A3, Accession NP_689509.1). Accordingly, utilities of GAM47 include diagnosis, prevention and treatment of diseases and clinical conditions associated with ATP1A3.

Atpase inhibitory factor 1 (ATPIF1, Accession NP_835498.1) is another GAM47 target gene, herein designated TARGET GENE. ATPIF1 BINDING SITE is a target binding site found in the 3' untranslated region of multiple transcripts of mRNA encoded by ATPIF1, corresponding to a target binding site such as BINDING SITE I, BINDING SITE II or BINDING SITE III of FIG. 8. Table 4 illustrates the complementarity of the nucleotide sequences of ATPIF1 BINDING SITE, designated SEQ ID:6903, to the nucleotide sequence of GAM47 RNA, herein designated GAM RNA, also designated SEQ ID:269.

Another function of GAM47 is therefore inhibition of Atpase inhibitory factor 1 (ATPIF1, Accession NP_835498.1). Accordingly, utilities of GAM47 include diagnosis, prevention and treatment of diseases and clinical conditions associated with ATPIF1.

Attractin (ATRN, Accession NP_647537.1) is another GAM47 target gene, herein designated TARGET GENE. ATRN BINDING SITE is a target binding site found in the 3' untranslated region of multiple transcripts of mRNA encoded by ATRN, corresponding to a target binding site such as BINDING SITE I, BINDING SITE II or BINDING SITE III of FIG. 8. Table 4 illustrates the complementarity of the nucleotide sequences of ATRN BINDING SITE, designated SEQ ID:1478, to the nucleotide sequence of GAM47 RNA, herein designated GAM RNA, also designated SEQ ID:269.

Another function of GAM47 is therefore inhibition of Attractin (ATRN, Accession NP_647537.1), a gene which is involved in the initial immune cell clustering during inflammatory response. Accordingly, utilities of GAM47 include diagnosis, prevention and treatment of diseases and clinical conditions associated with ATRN.

The function of ATRN has been established by previous studies. Attractin is a human serum glycoprotein that is rapidly expressed on activated T cells and released extracellularly after 48 to 72 hours. Duke-Cohan et al. (1998) cloned attractin and found that, as in its natural serum form, it mediates the spreading of monocytes that becomes the focus for the clustering of nonproliferating T lymphocytes. There are 2 mRNA species with hematopoietic tissue-specific expression that code for a 134-kD protein with a putative serine protease catalytic serine, 4 EGF-like motifs, a CUB domain, a C-type lectin domain, and a domain homologous with the ligand-binding region of the common gamma cytokine chain. Except for the last 2 domains, the overall structure shares high homology with a protein of Caenorhabditis elegans, suggesting that attractin has evolved new domains and functions in parallel with the development of cell-mediated immunity. When attractin was identified as the product of the murine 'mahogany' gene with connections to control of pigmentation and energy metabolism, and the 'mahogany' product was identified and shown to be a transmembrane protein, the possibility of a human membrane attractin in addition to the secreted form was raised. Tang et al. (2000) described the complete genomic sequence of attractin, focusing in particular on the exons coding for the 3-prime region, and showed how both human membrane and secreted attractin arise as a result of alternate splicing of the same gene. They found that soluble attractin arises from transcription of 25 sequential exons on 20p13, where the 3-prime terminal exon contains sequence from a long interspersed nuclear element-1 (OMIM Ref. No. LINE-1) retrotransposon insertion that includes a stop codon and a polyadenylation signal. The mRNA isoform for membrane attraction splices over the LINE-1 exon and includes 5 exons encoding transmembrane and cytoplasmic domains with organization and coding potential almost identical to that of the mouse gene. The relative abundance of soluble and transmembrane isoforms measured by RT-PCR is differentially regulated in lymphoid tissues. Because activation of peripheral blood leukocytes with phytohemagglutinin induces strong expression of cell surface attractin followed by release of soluble attractin, these results suggested to Tang et al. (2000) that LINE-1 insertion, a genomic event unique to mammals, provided an evolutionarily mechanism for regulating cell interactions during an inflammatory reaction.

Full details of the abovementioned studies are described in the following publications, the disclosure of which are hereby incorporated by reference:

Duke-Cohan, J. S.; Gu, J.; McLaughlin, D. F.; Xu, Y.; Freeman, G. J.; Schlossman, S. F.: Attractin (DPPT-L), a member of the CUB family of cell adhesion and guidance proteins, is secreted by activated human T lymphocytes and modulates immune cell interactions. Proc. Nat. Acad. Sci. 95:11336-11341, 1998; and Tang, W.; Gunn, T. M.; McLaughlin, D. F.; Barsh, G. S.; Schlossman, S. F.; Duke-Cohan, J. S.: Secreted and membrane attractin result from alternative splicing of the human ATRN gene. Pr.

Further studies establishing the function and utilities of ATRN are found in John Hopkins OMIM database record ID 603130, and in cited publications listed in Table 5, which are hereby incorporated by reference. Axl receptor tyrosine kinase (AXL, Accession NP_001690.2) is another GAM47 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:5379, to the nucleotide sequence of GAM47 RNA, herein designated GAM RNA, also designated SEQ ID:269.

Another function of GAM47 is therefore inhibition of Axl receptor tyrosine kinase (AXL, Accession NP_001690.2). Accordingly, utilities of GAM47 include diagnosis, prevention and treatment of diseases and clinical conditions associated with AXL.

Axl receptor tyrosine kinase (AXL, Accession NP_068713.2) is another GAM47 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:5379, to the nucleotide sequence of GAM47 RNA, herein designated GAM RNA, also designated SEQ ID:269.

Another function of GAM47 is therefore inhibition of Axl receptor tyrosine kinase (AXL, Accession NP_068713.2). Accordingly, utilities of GAM47 include diagnosis, prevention and treatment of diseases and clinical conditions associated with AXL.

Brain and acute leukemia, cytoplasmic (BAALC, Accession NP_079088.1) is another GAM47 target gene, herein designated TARGET GENE. BAALC BINDING SITE is a target binding site found in the 3' untranslated region of mRNA encoded by BAALC, corresponding to a target binding site such as BINDING SITE I, BINDING SITE II or BINDING SITE III of FIG. 8. Table 4 illustrates the complementarity of the nucleotide sequences of BAALC BINDING SITE, designated SEQ ID:7066, to the nucleotide sequence of GAM47 RNA, herein designated GAM RNA, also designated SEQ ID:269.

Another function of GAM47 is therefore inhibition of Brain and acute leukemia, cytoplasmic (BAALC, Accession NP_079088.1). Accordingly, utilities of GAM47 include diagnosis, prevention and treatment of diseases and clinical conditions associated with BAALC.

Bromodomain adjacent to zinc finger domain, 2a (BAZ2A, Accession NP_038477.1) is another GAM47 target gene, herein designated TARGET GENE. BAZ2A BINDING SITE is a target binding site found in the 5' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:12314, to the nucleotide sequence of GAM47 RNA, herein designated GAM RNA, also designated SEQ ID:269.

Another function of GAM47 is therefore inhibition of Bromodomain adjacent to zinc finger domain, 2a (BAZ2A, Accession NP_038477.1). Accordingly, utilities of GAM47 include diagnosis, prevention and treatment of diseases and clinical conditions associated with BAZ2A.

Bcl2-like 13 (apoptosis facilitator) (BCL2L13, Accession NP_056182.1) is another GAM47 target gene, herein designated TARGET GENE. BCL2L13 BINDING SITE is a target binding site found in the 3' untranslated region of mRNA encoded by BCL2L13, corresponding to a target binding site such as BINDING SITE I, BINDING SITE II or BINDING SITE III of FIG. 8. Table 4 illustrates the complementarity of the nucleotide sequences of BCL2L13 BINDING SITE, designated SEQ ID:1370, to the nucleotide sequence of GAM47 RNA, herein designated GAM RNA, also designated SEQ ID:269.

Another function of GAM47 is therefore inhibition of Bcl2-like 13 (apoptosis facilitator) (BCL2L13, Accession NP_056182.1). Accordingly, utilities of GAM47 include diagnosis, prevention and treatment of diseases and clinical conditions associated with BCL2L13.

BIA2 (Accession NP_056246.1) is another GAM47 target gene, herein designated TARGET GENE. BIA2 BINDING SITE1 and BIA2 BINDING SITE2 are target binding sites found in untranslated regions of mRNA encoded by BIA2, corresponding to target binding sites such as BINDING SITE I, BINDING SITE II or BINDING SITE III of FIG. 8. Table 4 illustrates the complementarity of the nucleotide sequences of BIA2 BINDING SITE1 and BIA2 BINDING SITE2, designated SEQ ID:18069 and SEQ ID:11493 respectively, to the nucleotide sequence of GAM47 RNA, herein designated GAM RNA, also designated SEQ ID:269.

Another function of GAM47 is therefore inhibition of BIA2 (Accession NP_056246.1). Accordingly, utilities of GAM47 include diagnosis, prevention and treatment of diseases and clinical conditions associated with BIA2.

BIG1 (Accession NP_006412.1) is another GAM47 target gene, herein designated TARGET GENE. BIG1 BINDING SITE is a target binding site found in the 5' untranslated region of mRNA encoded by BIG1, corresponding to a target binding site such as BINDING SITE I, BINDING SITE II or BINDING SITE III of FIG. 8. Table 4 illustrates the complementarity of the nucleotide sequences of BIG1 BINDING SITE, designated SEQ ID:7522, to the nucleotide sequence of GAM47 RNA, herein designated GAM RNA, also designated SEQ ID:269.

Another function of GAM47 is therefore inhibition of BIG1 (Accession NP_006412.1), a gene which is a guanine nucleotide-exchange protein, has a role in vesicular transport. Accordingly, utilities of GAM47 include diagnosis, prevention and treatment of diseases and clinical conditions associated with BIG1.

The function of BIG1 has been established by previous studies. After peptide sequencing of purified bovine p200, Togawa et al. (1999) used PCR generated probes to screen a human frontal cortex cDNA library and isolated BIG1 and BIG2 (OMIM Ref. No. 605371) cDNAs. The assembled full-length BIG1 cDNA encodes a protein of 1,849 amino acids containing a Sec7 domain characteristic of ARF guanine nucleotide-exchange proteins. BIG1 shares 74% overall amino acid identity with BIG2 and 90% identity in the Sec7 domain. Using Northern blot analysis, Togawa et al. (1999) detected a 7.5-kb BIG1 transcript in placenta and lung. Weaker expression was detected in heart, brain, kidney, and pancreas. Mansour et al. (1999) studied the ubiquitously expressed ARFGEP1 protein and proposed that accumulation of an abortive p200-ARF complex in the presence of BFA likely leads to disruption of Golgi morphology. Database searches revealed the presence of putative isoforms whose inhibition may account for the effects of BFA on various organelles.

Full details of the abovementioned studies are described in the following publications, the disclosure of which are hereby incorporated by reference:

Togawa, A.; Morinaga, N.; Ogasawara, M.; Moss, J.; Vaughan, M.: Purification and cloning of a brefeldin A-inhibited guanine nucleotide-exchange protein for ADP-ribosylation factors. J. Biol. Chem. 274:12308-12315, 1999. ; and Mansour, S. J.; Skaug, J.; Zhao, X.-H.; Giordano, J.; Scherer, S. W.; Melancon, P. : p200 ARF-GEP1: a Golgi-localized guanine nucleotide exchange protein whose Sec7 domain is targeted b.

Further studies establishing the function and utilities of BIG1 are found in John Hopkins OMIM database record ID 604141, and in cited publications listed in Table 5, which are hereby incorporated by reference. Bone morphogenetic protein 4 (BMP4, Accession NP_570912.1) is another GAM47 target gene, herein designated TARGET GENE. BMP4 BINDING SITE is a target binding site found in the 5' untranslated region of multiple transcripts of mRNA encoded by BMP4, corresponding to a target binding site such as BINDING SITE I, BINDING SITE II or BINDING SITE III of FIG. 8. Table 4 illustrates the complementarity of the nucleotide sequences of BMP4 BINDING SITE, designated SEQ ID:18502, to the nucleotide sequence of GAM47 RNA, herein designated GAM RNA, also designated SEQ ID:269.

Another function of GAM47 is therefore inhibition of Bone morphogenetic protein 4 (BMP4, Accession NP_570912.1), a gene which acts in mesoderm induction, tooth development, limb formation and fracture repair and therefore may be associated with Fibrodysplasia ossificans progressiva. Accordingly, utilities of GAM47 include diagnosis, prevention and treatment of Fibrodysplasia ossificans progressiva, and of other diseases and clinical conditions associated with BMP4.

The function of BMP4 has been established by previous studies. Shafritz et al. (1996) found overexpression of BMP4 in lymphoblastoid cell lines from 26 of 32 patients with fibrodysplasia ossificans progressiva (FOP; 135100), but from only 1 of 12 normal subjects (P less than 0.001). Furthermore, BMP4 and its mRNA were detected in the lymphoblastoid cell lines from a man with FOP and his 3 affected children, but not from the children's unaffected mother. Cosegregation of DNA markers for the BMP4 locus on chromosome 14 in the rare families in which FOP is inherited would strengthen the candidacy of BMP4, and the demonstration of mutations in the BMP4 gene, especially in the promoter sequences, would be confirmatory.

Animal model experiments lend further support to the function of BMP4. Connor (1996) speculated that transgenic mice with selective overexpression of BMP4 may serve as animal models of FOP and may make it possible to evaluate potential therapies directed at influencing the expression of BMP4 or its 2 types of cell-surface receptors. Not only may this knowledge provide a rational basis for therapy for FOP, but possibly also measures for the control of local ectopic bone development which occurs in 10 to 20% of patients who have undergone surgical hip replacement. According to Connor (1996), there appears to be an individual propensity to the phenomenon of secondary ectopic ossification of soft tissue. In the 10 to 20% of patients who develop local ectopic bone formation after hip replacement, if surgical removal of that bone is attempted or the opposite hip is replaced, ectopic bone almost invariably recurs or occurs.

It is appreciated that the abovementioned animal model for BMP4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shafritz, A. B.; Shore, E. M.; Gannon, F. H.; Zasloff, M. A.; Taub, R.; Muenke, M.; Kaplan, F. S.: Overexpression of an osteogenic morphogen in fibrodysplasia ossificans progressiva. New Eng. J. Med. 335:555-561, 1996; and Connor, J. M.: Fibrodysplasia ossificans progressiva: lessons from rare maladies. (Editorial) New Eng. J. Med. 335: 591-593, 1996.

Further studies establishing the function and utilities of BMP4 are found in John Hopkins OMIM database record ID 112262, and in cited publications listed in Table 5, which are hereby incorporated by reference. Bone morphogenetic protein 4 (BMP4, Accession NP_001193.1) is another GAM47 target gene, herein designated TARGET GENE. BMP4 BINDING SITE is a target binding site found in the 5' untranslated region of multiple transcripts of mRNA encoded by BMP4, corresponding to a target binding site such as BINDING SITE I, BINDING SITE II or BINDING SITE III of FIG. 8. Table 4 illustrates the complementarity of the nucleotide sequences of BMP4 BINDING SITE, designated SEQ ID:18502, to the nucleotide sequence of GAM47 RNA, herein designated GAM RNA, also designated SEQ ID:269.

Another function of GAM47 is therefore inhibition of Bone morphogenetic protein 4 (BMP4, Accession NP_001193.1), a gene which acts in mesoderm induction, tooth development, limb formation and fracture repair and therefore may be associated with Fibrodysplasia ossificans progressiva. Accordingly, utilities of GAM47 include diagnosis, prevention and treatment of Fibrodysplasia ossificans progressiva, and of other diseases and clinical conditions associated with BMP4.

The function of BMP4 has been established by previous studies. Shafritz et al. (1996) found overexpression of BMP4 in lymphoblastoid cell lines from 26 of 32 patients with fibrodysplasia ossificans progressiva (FOP; 135100), but from only 1 of 12 normal subjects (P less than 0.001). Furthermore, BMP4 and its mRNA were detected in the lymphoblastoid cell lines from a man with FOP and his 3 affected children, but not from the children's unaffected mother. Cosegregation of DNA markers for the BMP4 locus on chromosome 14 in the rare families in which FOP is inherited would strengthen the candidacy of BMP4, and the demonstration of mutations in the BMP4 gene, especially in the promoter sequences, would be confirmatory.

Animal model experiments lend further support to the function of BMP4. Connor (1996) speculated that transgenic mice with selective overexpression of BMP4 may serve as animal models of FOP and may make it possible to evaluate potential therapies directed at influencing the expression of BMP4 or its 2 types of cell-surface receptors. Not only may this knowledge provide a rational basis for therapy for FOP, but possibly also measures for the control of local ectopic bone development which occurs in 10 to 20% of patients who have undergone surgical hip replacement. According to Connor (1996), there appears to be an individual propensity to the phenomenon of secondary ectopic ossification of soft tissue. In the 10 to 20% of patients who develop local ectopic bone formation after hip replacement, if surgical removal of that bone is attempted or the opposite hip is replaced, ectopic bone almost invariably recurs or occurs.

It is appreciated that the abovementioned animal model for BMP4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shafritz, A. B.; Shore, E. M.; Gannon, F. H.; Zasloff, M. A.; Taub, R.; Muenke, M.; Kaplan, F. S.: Overexpression of an osteogenic morphogen in fibrodysplasia ossificans progressiva. New Eng. J. Med. 335:555-561, 1996; and Connor, J. M.: Fibrodysplasia ossificans progressiva: lessons from rare maladies. (Editorial) New Eng. J. Med. 335: 591-593, 1996.

Further studies establishing the function and utilities of BMP4 are found in John Hopkins OMIM database record ID 112262, and in cited publications listed in Table 5, which are hereby incorporated by reference. Bone morphogenetic protein 4 (BMP4, Accession NP_570911.1) is another GAM47 target gene, herein designated TARGET GENE. BMP4 BINDING SITE is a target binding site found in the 5' untranslated region of multiple transcripts of mRNA encoded by BMP4, corresponding to a target binding site such as BINDING SITE I, BINDING SITE II or BINDING SITE III of FIG. 8. Table 4 illustrates the complementarity of the nucleotide sequences of BMP4 BINDING SITE, designated SEQ ID:18502, to the nucleotide sequence of GAM47 RNA, herein designated GAM RNA, also designated SEQ ID:269.

Another function of GAM47 is therefore inhibition of Bone morphogenetic protein 4 (BMP4, Accession NP_570911.1), a gene which acts in mesoderm induction, tooth development, limb formation and fracture repair and therefore may be associated with Fibrodysplasia ossificans progressiva. Accordingly, utilities of GAM47 include diagnosis, prevention and treatment of Fibrodysplasia ossificans progressiva, and of other diseases and clinical conditions associated with BMP4.

The function of BMP4 has been established by previous studies. Shafritz et al. (1996) found overexpression of BMP4 in lymphoblastoid cell lines from 26 of 32 patients with fibrodysplasia ossificans progressiva (FOP; 135100), but from only 1 of 12 normal subjects (P less than 0.001). Furthermore, BMP4 and its mRNA were detected in the lymphoblastoid cell lines from a man with FOP and his 3 affected children, but not from the children's unaffected mother. Cosegregation of DNA markers for the BMP4 locus on chromosome 14 in the rare families in which FOP is inherited would strengthen the candidacy of BMP4, and the demonstration of mutations in the BMP4 gene, especially in the promoter sequences, would be confirmatory.

Animal model experiments lend further support to the function of BMP4. Connor (1996) speculated that transgenic mice with selective overexpression of BMP4 may serve as animal models of FOP and may make it possible to evaluate potential therapies directed at influencing the expression of BMP4 or its 2 types of cell-surface receptors. Not only may this knowledge provide a rational basis for therapy for FOP, but possibly also measures for the control of local ectopic bone development which occurs in 10 to 20% of patients who have undergone surgical hip replacement. According to Connor (1996), there appears to be an individual propensity to the phenomenon of secondary ectopic ossification of soft tissue. In the 10 to 20% of patients who develop local ectopic bone formation after hip replacement, if surgical removal of that bone is attempted or the opposite hip is replaced, ectopic bone almost invariably recurs or occurs.

It is appreciated that the abovementioned animal model for BMP4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shafritz, A. B.; Shore, E. M.; Gannon, F. H.; Zasloff, M. A.; Taub, R.; Muenke, M.; Kaplan, F. S.: Overexpression of an osteogenic morphogen in fibrodysplasia ossificans progressiva. New Eng. J. Med. 335:555-561, 1996; and Connor, J. M.: Fibrodysplasia ossificans progressiva: lessons from rare maladies. (Editorial) New Eng. J. Med. 335: 591-593, 1996.

Further studies establishing the function and utilities of BMP4 are found in John Hopkins OMIM database record ID 112262, and in cited publications listed in Table 5, which are hereby incorporated by reference. Bone morphogenetic protein receptor, type ii (serine/threonine kinase) (BMPR2, Accession NP_001195.2) is another GAM47 target gene, herein designated TARGET GENE. BMPR2 BINDING SITE is a target binding site found in the 5' untranslated region of multiple transcripts of mRNA encoded by BMPR2, corresponding to a target binding site such as BINDING SITE I, BINDING SITE II or BINDING SITE III of FIG. 8. Table 4 illustrates the complementarity of the nucleotide sequences of BMPR2 BINDING SITE, designated SEQ ID:14836, to the nucleotide sequence of GAM47 RNA, herein designated GAM RNA, also designated SEQ ID:269.

Another function of GAM47 is therefore inhibition of Bone morphogenetic protein receptor, type ii (serine/threonine kinase) (BMPR2, Accession NP_001195.2). Accordingly, utilities of GAM47 include diagnosis, prevention and treatment of diseases and clinical conditions associated with BMPR2.

BOCT (Accession NP_065105.2) is another GAM47 target gene, herein designated TARGET GENE. BOCT BINDING SITE is a target binding site found in the 5' untranslated region of multiple transcripts of mRNA encoded by BOCT, corresponding to a target binding site such as BINDING SITE I, BINDING SITE II or BINDING SITE III of FIG. 8. Table 4 illustrates the complementarity of the nucleotide sequences of BOCT BINDING SITE, designated SEQ ID:18592, to the nucleotide sequence of GAM47 RNA, herein designated GAM RNA, also designated SEQ ID:269.

Another function of GAM47 is therefore inhibition of BOCT (Accession NP_065105.2). Accordingly, utilities of GAM47 include diagnosis, prevention and treatment of diseases and clinical conditions associated with BOCT.

Block of proliferation 1 (BOP1, Accession NP_056016.1) is another GAM47 target gene, herein designated TARGET GENE. BOP1 BINDING SITE is a target binding site found in the 3' untranslated region of mRNA encoded by BOP1, corresponding to a target binding site such as BINDING SITE I, BINDING SITE II or BINDING SITE III of FIG. 8. Table 4 illustrates the complementarity of the nucleotide sequences of BOP1 BINDING SITE, designated SEQ ID:13557, to the nucleotide sequence of GAM47 RNA, herein designated GAM RNA, also designated SEQ ID:269.

Another function of GAM47 is therefore inhibition of Block of proliferation 1 (BOP1, Accession NP_056016.1). Accordingly, utilities of GAM47 include diagnosis, prevention and treatment of diseases and clinical conditions associated with BOP1.

Bromodomain containing 2 (BRD2, Accession NP_005095.1) is another GAM47 target gene, herein designated TARGET GENE. BRD2 BINDING SITE is a target binding site found in the 5' untranslated region of mRNA encoded by BRD2, corresponding to a target binding site such as BINDING SITE I, BINDING SITE II or BINDING SITE III of FIG. 8. Table 4 illustrates the complementarity of the nucleotide sequences of BRD2 BINDING SITE, designated SEQ ID:2747, to the nucleotide sequence of GAM47 RNA, herein designated GAM RNA, also designated SEQ ID:269.

Another function of GAM47 is therefore inhibition of Bromodomain containing 2 (BRD2, Accession NP_005095.1). Accordingly, utilities of GAM47 include diagnosis, prevention and treatment of diseases and clinical conditions associated with BRD2.

Basic transcription factor 3 (BTF3, Accession NP_001198.2) is another GAM47 target gene, herein designated TARGET GENE. BTF3 BINDING SITE is a target binding site found in the 3' untranslated region of mRNA encoded by BTF3, corresponding to a target binding site such as BINDING SITE I, BINDING SITE II or BINDING SITE III of FIG. 8. Table 4 illustrates the complementarity of the nucleotide sequences of BTF3 BINDING SITE, designated SEQ ID:14803, to the nucleotide sequence of GAM47 RNA, herein designated GAM RNA, also designated SEQ ID:269.

Another function of GAM47 is therefore inhibition of Basic transcription factor 3 (BTF3, Accession NP_001198.2). Accordingly, utilities of GAM47 include diagnosis, prevention and treatment of diseases and clinical conditions associated with BTF3.

BXDC1 (Accession XP_166303.1) is another GAM47 target gene, herein designated TARGET GENE. BXDC1 BINDING SITE is a target binding site found in the 3' untranslated region of mRNA encoded by BXDC1, corresponding to a target binding site such as BINDING SITE I, BINDING SITE II or BINDING SITE III of FIG. 8. Table 4 illustrates the complementarity of the nucleotide sequences of BXDC1 BINDING SITE, designated SEQ ID:577, to the nucleotide sequence of GAM47 RNA, herein designated GAM RNA, also designated SEQ ID:269.

Another function of GAM47 is therefore inhibition of BXDC1 (Accession XP_166303.1). Accordingly, utilities of GAM47 include diagnosis, prevention and treatment of diseases and clinical conditions associated with BXDC1.

Chromosome 11 open reading frame 9 (C11orf9, Accession NP_037411.1) is another GAM47 target gene, herein designated TARGET GENE. C11orf9 BINDING SITE is a target binding site found in the 3' untranslated region of mRNA encoded by C11orf9, corresponding to a target binding site such as BINDING SITE I, BINDING SITE II or BINDING SITE III of FIG. 8. Table 4 illustrates the complementarity of the nucleotide sequences of C11orf9 BINDING SITE, designated SEQ ID:5599, to the nucleotide sequence of GAM47 RNA, herein designated GAM RNA, also designated SEQ ID:269.

Another function of GAM47 is therefore inhibition of Chromosome 11 open reading frame 9 (C11orf9, Accession NP_037411.1). Accordingly, utilities of GAM47 include diagnosis, prevention and treatment of diseases and clinical conditions associated with C11orf9.

C14orf130 (Accession NP_060578.2) is another GAM47 target gene, herein designated TARGET GENE. C14orf130 BINDING SITE is a target binding site found in the 3' untranslated region of multiple transcripts of mRNA encoded by C14orf130, corresponding to a target binding site such as BINDING SITE I, BINDING SITE II or BINDING SITE III of FIG. 8. Table 4 illustrates the complementarity of the nucleotide sequences of C14orf130 BINDING SITE, designated SEQ ID:9006, to the nucleotide sequence of GAM47 RNA, herein designated GAM RNA, also designated SEQ ID:269.

Another function of GAM47 is therefore inhibition of C14orf130 (Accession NP_060578.2). Accordingly, utilities of GAM47 include diagnosis, prevention and treatment of diseases and clinical conditions associated with C14orf130.

C14orf132 (Accession NP_064600.1) is another GAM47 target gene, herein designated TARGET GENE. C14orf132 BINDING SITE is a target binding site found in the 3' untranslated region of mRNA encoded by C14orf132, corresponding to a target binding site such as BINDING SITE I, BINDING SITE II or BINDING SITE III of FIG. 8. Table 4 illustrates the complementarity of the nucleotide sequences of C14orf132 BINDING SITE, designated SEQ ID:3922, to the nucleotide sequence of GAM47 RNA, herein designated GAM RNA, also designated SEQ ID:269.

Another function of GAM47 is therefore inhibition of C14orf132 (Accession NP_064600.1). Accordingly, utilities of GAM47 include diagnosis, prevention and treatment of diseases and clinical conditions associated with C14orf132.

C14orf137 (Accession NP_075601.1) is another GAM47 target gene, herein designated TARGET GENE. C14orf137 BINDING SITE is a target binding site found in the 3' untranslated region of mRNA encoded by C14orf137, corresponding to a target binding site such as BINDING SITE I, BINDING SITE II or BINDING SITE III of FIG. 8. Table 4 illustrates the complementarity of the nucleotide sequences of C14orf137 BINDING SITE, designated SEQ ID:8260, to the nucleotide sequence of GAM47 RNA, herein designated GAM RNA, also designated SEQ ID:269.

Another function of GAM47 is therefore inhibition of C14orf137 (Accession NP_075601.1). Accordingly, utilities of GAM47 include diagnosis, prevention and treatment of diseases and clinical conditions associated with C14orf137.

C14orf56 (Accession XP_027244.1) is another GAM47 target gene, herein designated TARGET GENE. C14orf56 BINDING SITE is a target binding site found in the 5' untranslated region of mRNA encoded by C14orf56, corresponding to a target binding site such as BINDING SITE I, BINDING SITE II or BINDING SITE III of FIG. 8. Table 4 illustrates the complementarity of the nucleotide sequences of C14orf56 BINDING SITE, designated SEQ ID:529, to the nucleotide sequence of GAM47 RNA, herein designated GAM RNA, also designated SEQ ID:269.

Another function of GAM47 is therefore inhibition of C14orf56 (Accession XP_027244.1). Accordingly, utilities of GAM47 include diagnosis, prevention and treatment of diseases and clinical conditions associated with C14orf56.

Chromosome 1 open reading frame 34 (C1orf34, Accession XP_027172.1) is another GAM47 target gene, herein designated TARGET GENE. C1orf34 BINDING SITE is a target binding site found in the 3' untranslated region of mRNA encoded by C1orf34, corresponding to a target binding site such as BINDING SITE I, BINDING SITE II or BINDING SITE III of FIG. 8. Table 4 illustrates the complementarity of the nucleotide sequences of C1orf34 BINDING SITE, designated SEQ ID:6254, to the nucleotide sequence of GAM47 RNA, herein designated GAM RNA, also designated SEQ ID:269.

Another function of GAM47 is therefore inhibition of Chromosome 1 open reading frame 34 (C1orf34, Accession XP_027172.1). Accordingly, utilities of GAM47 include diagnosis, prevention and treatment of diseases and clinical conditions associated with C1orf34.

Chromosome 1 open reading frame 6 (C1orf6, Accession NP_064516.1) is another GAM47 target gene, herein designated TARGET GENE. C1orf6 BINDING SITE is a target binding site found in the 3' untranslated region of mRNA encoded by C1orf6, corresponding to a target binding site such as BINDING SITE I, BINDING SITE II or BINDING SITE III of FIG. 8. Table 4 illustrates the complementarity of the nucleotide sequences of C1orf6 BINDING SITE, designated SEQ ID:8781, to the nucleotide sequence of GAM47 RNA, herein designated GAM RNA, also designated SEQ ID:269.

Another function of GAM47 is therefore inhibition of Chromosome 1 open reading frame 6 (C1orf6, Accession NP_064516.1), a gene which may link ataxin-1 with the chaperone and ubiquitin/proteasome pathways. Accordingly, utilities of GAM47 include diagnosis, prevention and treatment of diseases and clinical conditions associated with C1orf6.

The function of C1orf6 has been established by previous studies. By a yeast 2-hybrid screen of an adult human brain cDNA library, Davidson et al. (2000) isolated cDNA clones which they used to assemble a complete cDNA encoding the 601-amino acid ataxin-1 ubiquitin-like interacting protein (A1U). Sequence comparison revealed that A1U contains an N-terminal ubiquitin- like region, placing it within a large family of similar proteins. In addition, A1U shows substantial homology to human UBQLN2 (OMIM Ref. No. 300264), a protein that binds the ATPase domain of the HSP70-like STCH protein (OMIM Ref. No. 601100). Expression analyses demonstrated that A1U mRNA is widely expressed as a 4.0-kb transcript and is present in Purkinje cells, the primary site of spinocerebellar ataxia-1 (SCA1; 164400) cerebellar pathology. The A1U protein localized to the nucleus and cytoplasm of transfected COS-1 cells. Sequences important for the transport of A1U into the nucleus appeared to lie within the C terminus. In the nucleus, A1U colocalized with mutant ataxin-1 (ATX1; 601556), further demonstrating that A1U interacts with ataxin-1. Davidson et al. (2000) suggested that A1U may link ataxin-1 with the chaperone and ubiquitin/proteasome pathways and that ataxin-1 may function in the formation and regulation of multimeric protein complexes within the nucleus.

Full details of the abovementioned studies are described in the following publications, the disclosure of which are hereby incorporated by reference:

Davidson, J. D.; Riley, B.; Burright, E. N.; Duvick, L. A.; Zoghbi, H.Y.; Orr, H. T. : Identification and characterization of an ataxin-1-interacting protein: A1Up, a ubiquitin-like nuclear protein. Hum. Molec. Genet. 9:2305-2312, 2000; and Fogli, A.; Giglio, S.; Arrigo, G.; Lo Nigro, C.; Zollo, M.; Viggiano, L.; Rocchi, M.; Archidiacono, N.; Zuffardi, O.; Carrozzo, R.: Identification of two paralogous regions mapping to.

Further studies establishing the function and utilities of C1orf6 are found in John Hopkins OMIM database record ID 605440, and in cited publications listed in Table 5, which are hereby incorporated by reference. Complement component 1, q subcomponent, receptor 1 (C1QR1, Accession NP_036204.1) is another GAM47 target gene, herein designated TARGET GENE. C1QR1 BINDING SITE is a target binding site found in the 3' untranslated region of mRNA encoded by C1QR1, corresponding to a target binding site such as BINDING SITE I, BINDING SITE II or BINDING SITE III of FIG. 8. Table 4 illustrates the complementarity of the nucleotide sequences of C1QR1 BINDING SITE, designated SEQ ID:8931, to the nucleotide sequence of GAM47 RNA, herein designated GAM RNA, also designated SEQ ID:269.

Another function of GAM47 is therefore inhibition of Complement component 1, q subcomponent, receptor 1 (C1QR1, Accession NP_036204.1). Accordingly, utilities of GAM47 include diagnosis, prevention and treatment of diseases and clinical conditions associated with C1QR1.

C1q and tumor necrosis factor related protein 6 (C1QTNF6, Accession NP_114116.2) is another GAM47 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:621, to the nucleotide sequence of GAM47 RNA, herein designated GAM RNA, also designated SEQ ID:269.

Another function of GAM47 is therefore inhibition of C1q and tumor necrosis factor related protein 6 (C1QTNF6, Accession NP_114116.2). Accordingly, utilities of GAM47 include diagnosis, prevention and treatment of diseases and clinical conditions associated with C1QTNF6.

Chromosome 20 open reading frame 110 (C20orf110, Accession XP_086728.2) is another GAM47 target gene, herein designated TARGET GENE. C20orf110 BINDING SITE is a target binding site found in the 3' untranslated region of mRNA encoded by C20orf110, corresponding to a target binding site such as BINDING SITE I, BINDING SITE II or BINDING SITE III of FIG. 8. Table 4 illustrates the complementarity of the nucleotide sequences of C20orf110

BINDING SITE, designated SEQ ID:4643, to the nucleotide sequence of GAM47 RNA, herein designated GAM RNA, also designated SEQ ID:269.

Another function of GAM47 is therefore inhibition of Chromosome 20 open reading frame 110 (C20orf110, Accession XP_086728.2). Accordingly, utilities of GAM47 include diagnosis, prevention and treatment of diseases and clinical conditions associated with C20orf110.

Chromosome 20 open reading frame 150 (C20orf150, Accession XP_037265.1) is another GAM47 target gene, herein designated TARGET GENE. C20orf150 BINDING SITE is a target binding site found in the 3' untranslated region of mRNA encoded by C20orf150, corresponding to a target binding site such as BINDING SITE I, BINDING SITE II or BINDING SITE III of FIG. 8. Table 4 illustrates the complementarity of the nucleotide sequences of C20orf150 BINDING SITE, designated SEQ ID:12630, to the nucleotide sequence of GAM47 RNA, herein designated GAM RNA, also designated SEQ ID:269.

Another function of GAM47 is therefore inhibition of Chromosome 20 open reading frame 150 (C20orf150, Accession XP_037265.1). Accordingly, utilities of GAM47 include diagnosis, prevention and treatment of diseases and clinical conditions associated with C20orf150.

Chromosome 20 open reading frame 177 (C20orf177, Accession XP_290955.1) is another GAM47 target gene, herein designated TARGET GENE. C20orf177 BINDING SITE is a target binding site found in the 3' untranslated region of mRNA encoded by C20orf177, corresponding to a target binding site such as BINDING SITE I, BINDING SITE II or BINDING SITE III of FIG. 8. Table 4 illustrates the complementarity of the nucleotide sequences of C20orf177 BINDING SITE, designated SEQ ID:893, to the nucleotide sequence of GAM47 RNA, herein designated GAM RNA, also designated SEQ ID:269.

Another function of GAM47 is therefore inhibition of Chromosome 20 open reading frame 177 (C20orf177, Accession XP_290955.1). Accordingly, utilities of GAM47 include diagnosis, prevention and treatment of diseases and clinical conditions associated with C20orf177.

Chromosome 20 open reading frame 29 (C20orf29, Accession NP_060817.1) is another GAM47 target gene, herein designated TARGET GENE. C20orf29 BINDING SITE is a target binding site found in the 3' untranslated region of mRNA encoded by C20orf29, corresponding to a target binding site such as BINDING SITE I, BINDING SITE II or BINDING SITE III of FIG. 8. Table 4 illustrates the complementarity of the nucleotide sequences of C20orf29 BINDING SITE, designated SEQ ID:13011, to the nucleotide sequence of GAM47 RNA, herein designated GAM RNA, also designated SEQ ID:269.

Another function of GAM47 is therefore inhibition of Chromosome 20 open reading frame 29 (C20orf29, Accession NP_060817.1). Accordingly, utilities of GAM47 include diagnosis, prevention and treatment of diseases and clinical conditions associated with C20orf29.

Chromosome 20 open reading frame 9 (C20orf9, Accession NP_057088.1) is another GAM47 target gene, herein designated TARGET GENE. C20orf9 BINDING SITE is a target binding site found in the 3' untranslated region of mRNA encoded by C20orf9, corresponding to a target binding site such as BINDING SITE I, BINDING SITE II or BINDING SITE III of FIG. 8. Table 4 illustrates the complementarity of the nucleotide sequences of C20orf9 BINDING SITE, designated SEQ ID:4613, to the nucleotide sequence of GAM47 RNA, herein designated GAM RNA, also designated SEQ ID:269.

Another function of GAM47 is therefore inhibition of Chromosome 20 open reading frame 9 (C20orf9, Accession NP_057088.1). Accordingly, utilities of GAM47 include diagnosis, prevention and treatment of diseases and clinical conditions associated with C20orf9.

Chromosome 21 open reading frame 85 (C21orf85, Accession NP_715634.1) is another GAM47 target gene, herein designated TARGET GENE. C21orf85 BINDING SITE is a target binding site found in the 5' untranslated region of mRNA encoded by C21orf85, corresponding to a target binding site such as BINDING SITE I, BINDING SITE II or BINDING SITE III of FIG. 8. Table 4 illustrates the complementarity of the nucleotide sequences of C21orf85 BINDING SITE, designated SEQ ID:3085, to the nucleotide sequence of GAM47 RNA, herein designated GAM RNA, also designated SEQ ID:269.

Another function of GAM47 is therefore inhibition of Chromosome 21 open reading frame 85 (C21orf85, Accession NP_715634.1). Accordingly, utilities of GAM47 include diagnosis, prevention and treatment of diseases and clinical conditions associated with C21orf85.

Chromosome 21 open reading frame 88 (C21orf88, Accession NP_715635.1) is another GAM47 target gene, herein designated TARGET GENE. C21orf88 BINDING SITE is a target binding site found in the 3' untranslated region of mRNA encoded by C21orf88, corresponding to a target binding site such as BINDING SITE I, BINDING SITE II or BINDING SITE III of FIG. 8. Table 4 illustrates the complementarity of the nucleotide sequences of C21orf88 BINDING SITE, designated SEQ ID:7197, to the nucleotide sequence of GAM47 RNA, herein designated GAM RNA, also designated SEQ ID:269.

Another function of GAM47 is therefore inhibition of Chromosome 21 open reading frame 88 (C21orf88, Accession NP_715635.1). Accordingly, utilities of GAM47 include diagnosis, prevention and treatment of diseases and clinical conditions associated with C21orf88.

Chromosome 5 open reading frame 7 (C5orf7, Accession NP_057688.1) is another GAM47 target gene, herein designated TARGET GENE. C5orf7 BINDING SITE is a target binding site found in the 3' untranslated region of mRNA encoded by C5orf7, corresponding to a target binding site such as BINDING SITE I, BINDING SITE II or BINDING SITE III of FIG. 8. Table 4 illustrates the complementarity of the nucleotide sequences of C5orf7 BINDING SITE, designated SEQ ID:13501, to the nucleotide sequence of GAM47 RNA, herein designated GAM RNA, also designated SEQ ID:269.

Another function of GAM47 is therefore inhibition of Chromosome 5 open reading frame 7 (C5orf7, Accession NP_057688.1). Accordingly, utilities of GAM47 include diagnosis, prevention and treatment of diseases and clinical conditions associated with C5orf7.

Chromosome 6 open reading frame 33 (C6orf33, Accession NP_588608.1) is another GAM47 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:14931, to the nucleotide sequence of GAM47 RNA, herein designated GAM RNA, also designated SEQ ID:269.

Another function of GAM47 is therefore inhibition of Chromosome 6 open reading frame 33 (C6orf33, Accession NP_588608.1). Accordingly, utilities of GAM47 include diagnosis, prevention and treatment of diseases and clinical conditions associated with C6orf33.

C6orf50 (Accession XP_166460.1) is another GAM47 target gene, herein designated TARGET GENE. C6orf50 BINDING SITE is a target binding site found in the 3' untranslated region of mRNA encoded by C6orf50, corresponding to a target binding site such as BINDING SITE I, BINDING SITE II or BINDING SITE III of FIG. 8. Table 4 illustrates the complementarity of the nucleotide sequences of C6orf50 BINDING SITE, designated SEQ ID:3566, to the nucleotide sequence of GAM47 RNA, herein designated GAM RNA, also designated SEQ ID:269.

Another function of GAM47 is therefore inhibition of C6orf50 (Accession XP_166460.1). Accordingly, utilities of GAM47 include diagnosis, prevention and treatment of diseases and clinical conditions associated with C6orf50.

C6orf67 (Accession NP_060717.1) is another GAM47 target gene, herein designated TARGET GENE. C6orf67 BINDING SITE is a target binding site found in the 3' untranslated region of mRNA encoded by C6orf67, corresponding to a target binding site such as BINDING SITE I, BINDING SITE II or BINDING SITE III of FIG. 8. Table 4 illustrates the complementarity of the nucleotide sequences of C6orf67 BINDING SITE, designated SEQ ID:10872, to the nucleotide sequence of GAM47 RNA, herein designated GAM RNA, also designated SEQ ID:269.

Another function of GAM47 is therefore inhibition of C6orf67 (Accession NP_060717.1). Accordingly, utilities of GAM47 include diagnosis, prevention and treatment of diseases and clinical conditions associated with C6orf67.

Carbonic anhydrase x (CA10, Accession NP_064563.1) is another GAM47 target gene, herein designated TARGET GENE. CA10 BINDING SITE is a target binding site found in the 3' untranslated region of mRNA encoded by CA10, corresponding to a target binding site such as BINDING SITE I, BINDING SITE II or BINDING SITE III of FIG. 8. Table 4 illustrates the complementarity of the nucleotide sequences of CA10 BINDING SITE, designated SEQ ID:9177, to the nucleotide sequence of GAM47 RNA, herein designated GAM RNA, also designated SEQ ID:269.

Another function of GAM47 is therefore inhibition of Carbonic anhydrase x (CA10, Accession NP_064563.1). Accordingly, utilities of GAM47 include diagnosis, prevention and treatment of diseases and clinical conditions associated with CA10.

Chaperone, abc1 activity of bc1 complex like (s. pombe) (CABC1, Accession NP_064632.1) is another GAM47 target gene, herein designated TARGET GENE. CABC1 BINDING SITE is a target binding site found in the 5' untranslated region of mRNA encoded by CABC1, corresponding to a target binding site such as BINDING SITE I, BINDING SITE II or BINDING SITE III of FIG. 8. Table 4 illustrates the complementarity of the nucleotide sequences of CABC1 BINDING SITE, designated SEQ ID:2169, to the nucleotide sequence of GAM47 RNA, herein designated GAM RNA, also designated SEQ ID:269.

Another function of GAM47 is therefore inhibition of Chaperone, abc1 activity of bc1 complex like (s. pombe) (CABC1, Accession NP_064632.1). Accordingly, utilities of GAM47 include diagnosis, prevention and treatment of diseases and clinical conditions associated with CABC1.

Calcium channel, voltage-dependent, gamma subunit 4 (CACNG4, Accession NP_055220.1) is another GAM47 target gene, herein designated TARGET GENE. CACNG4 BINDING SITE is a target binding site found in the 3' untranslated region of mRNA encoded by CACNG4, corresponding to a target binding site such as BINDING SITE I, BINDING SITE II or BINDING SITE III of FIG. 8. Table 4 illustrates the complementarity of the nucleotide sequences of CACNG4 BINDING SITE, designated SEQ ID:9768, to the nucleotide sequence of GAM47 RNA, herein designated GAM RNA, also designated SEQ ID:269.

Another function of GAM47 is therefore inhibition of Calcium channel, voltage-dependent, gamma subunit 4 (CACNG4, Accession NP_055220.1). Accordingly, utilities of GAM47 include diagnosis, prevention and treatment of diseases and clinical conditions associated with CACNG4.

Calneuron 1 (CALN1, Accession NP_113656.1) is another GAM47 target gene, herein designated TARGET GENE. CALN1 BINDING SITE is a target binding site found in the 3' untranslated region of mRNA encoded by CALN1, corresponding to a target binding site such as BINDING SITE I, BINDING SITE II or BINDING SITE III of FIG. 8. Table 4 illustrates the complementarity of the nucleotide sequences of CALN1 BINDING SITE, designated SEQ ID:9427, to the nucleotide sequence of GAM47 RNA, herein designated GAM RNA, also designated SEQ ID:269.

Another function of GAM47 is therefore inhibition of Calneuron 1 (CALN1, Accession NP_113656.1). Accordingly, utilities of GAM47 include diagnosis, prevention and treatment of diseases and clinical conditions associated with CALN1.

Calcium/calmodulin-dependent protein kinase kinase 2, beta (CAMKK2, Accession NP_705720.1) is another GAM47 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:10400, to the nucleotide sequence of GAM47 RNA, herein designated GAM RNA, also designated SEQ ID:269.

Another function of GAM47 is therefore inhibition of Calcium/calmodulin-dependent protein kinase kinase 2, beta (CAMKK2, Accession NP_705720.1). Accordingly, utilities of GAM47 include diagnosis, prevention and treatment of diseases and clinical conditions associated with CAMKK2.

Calcium/calmodulin-dependent protein kinase kinase 2, beta (CAMKK2, Accession NP_006540.3) is another GAM47 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:10400, to the nucleotide sequence of GAM47 RNA, herein designated GAM RNA, also designated SEQ ID:269.

Another function of GAM47 is therefore inhibition of Calcium/calmodulin-dependent protein kinase kinase 2, beta (CAMKK2, Accession NP_006540.3). Accordingly, utilities of GAM47 include diagnosis, prevention and treatment of diseases and clinical conditions associated with CAMKK2.

Calcium/calmodulin-dependent protein kinase kinase 2, beta (CAMKK2, Accession NP_757380.1) is another GAM47 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:10400, to the nucleotide sequence of GAM47 RNA, herein designated GAM RNA, also designated SEQ ID:269.

Another function of GAM47 is therefore inhibition of Calcium/calmodulin-dependent protein kinase kinase 2, beta (CAMKK2, Accession NP_757380.1). Accordingly, utilities of GAM47 include diagnosis, prevention and treatment of diseases and clinical conditions associated with CAMKK2.

Calcium/calmodulin-dependent protein kinase kinase 2, beta (CAMKK2, Accession NP_705719.2) is another GAM47 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:10400, to the nucleotide sequence of GAM47 RNA, herein designated GAM RNA, also designated SEQ ID:269.

Another function of GAM47 is therefore inhibition of Calcium/calmodulin-dependent protein kinase kinase 2, beta (CAMKK2, Accession NP_705719.2). Accordingly, utilities of GAM47 include diagnosis, prevention and treatment of diseases and clinical conditions associated with CAMKK2.

Calcium/calmodulin-dependent protein kinase kinase 2, beta (CAMKK2, Accession NP_757365.1) is another GAM47 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:10400, to the nucleotide sequence of GAM47 RNA, herein designated GAM RNA, also designated SEQ ID:269.

Another function of GAM47 is therefore inhibition of Calcium/calmodulin-dependent protein kinase kinase 2, beta (CAMKK2, Accession NP_757365.1). Accordingly, utilities of GAM47 include diagnosis, prevention and treatment of diseases and clinical conditions associated with CAMKK2.

Capping protein (actin filament), gelsolin-like (CAPG, Accession NP_001738.1) is another GAM47 target gene, herein designated TARGET GENE. CAPG BINDING SITE is a target binding site found in the 3' untranslated region of mRNA encoded by CAPG, corresponding to a target binding site such as BINDING SITE I, BINDING SITE II or BINDING SITE III of FIG. 8. Table 4 illustrates the complementarity of the nucleotide sequences of CAPG BINDING SITE, designated SEQ ID:15413, to the nucleotide sequence of GAM47 RNA, herein designated GAM RNA, also designated SEQ ID:269.

Another function of GAM47 is therefore inhibition of Capping protein (actin filament), gelsolin-like (CAPG, Accession NP_001738.1), a gene which reis a macrophage capping protein which versibly blocks the barbed ends of actin filaments but does not sever preformed actin filaments. Accordingly, utilities of GAM47 include diagnosis, prevention and treatment of diseases and clinical conditions associated with CAPG.

The function of CAPG has been established by previous studies. For a nonmuscle cell to change shape during movement, the actin filament network in the cell periphery must undergo a marked reorganization. The gelsolin family of proteins profoundly affects the architecture of actin filaments, rapidly modulating the actin structures in response to external stimuli. These proteins are able to sever, nucleate, and/or cap actin filaments in a Ca(2+)- and phosphoinositide-regulated manner. Gelsolin (GSN; 137350), the founding member of the family, is found in nearly all cells. Villin (VIL1; 193040) has a slightly higher molecular weight than gelsolin and a very restricted tissue distribution, being found only in intestinal microvilli and renal tubular epithelial cells. Southwick and DiNubile (1986) found another mammalian member of the gelsolin family. This protein, first purified from rabbit alveolar macrophages, was named macrophage capping protein. The protein was subsequently renamed Cap G (gene symbol CAPG). 'Cap' was chosen because unlike other members of the gelsolin/villin family, this protein caps the barbed ends of actin filaments but does not sever them. 'G' was included in the name because the derived amino acid sequence of Cap G most closely resembles gelsolin, possessing 49% identity with its amino terminal half. Dabiri et al. (1992) cloned and sequenced the human cDNA for CAPG. The CAPG gene is 16.6 kb long and contains 10 exons and 9 introns. By PCR analysis of somatic cell hybrid DNAs and fluorescence in situ hybridization, Mishra et al. (1994) found that the CAPG gene is located on the proximal part of the long arm of chromosome 2.

Full details of the abovementioned studies are described in the following publications, the disclosure of which are hereby incorporated by reference:

Southwick, F. S.; DiNubile, M. J.: Rabbit alveolar macrophages contain a Ca(2+)-sensitive, 41,000-Dalton protein which reversibly blocks the 'barbed' ends of actin filaments but does not sever them. J. Biol. Chem. 261:14191-14195, 1986; and Mishra, V. S.; Henske, E. P.; Kwiatkowski, D. J.; Southwick, F. S.: The human actin-regulatory protein cap G: gene structure and chromosome location. Genomics 23: 560-565, 1994.

Further studies establishing the function and utilities of CAPG are found in John Hopkins OMIM database record ID 153615, and in cited publications listed in Table 5, which are hereby incorporated by reference. Cerebellin 1 precursor (CBLN1, Accession NP_004343.1) is another GAM47 target gene, herein designated TARGET GENE. CBLN1 BINDING SITE is a target binding site found in the 3' untranslated region of mRNA encoded by CBLN1, corresponding to a target binding site such as BINDING SITE I, BINDING SITE II or BINDING SITE III of FIG. 8. Table 4 illustrates the complementarity of the nucleotide sequences of CBLN1 BINDING SITE, designated SEQ ID:10839, to the nucleotide sequence of GAM47 RNA, herein designated GAM RNA, also designated SEQ ID:269.

Another function of GAM47 is therefore inhibition of Cerebellin 1 precursor (CBLN1, Accession NP_004343.1). Accordingly, utilities of GAM47 include diagnosis, prevention and treatment of diseases and clinical conditions associated with CBLN1.

Chemokine (c-c motif) ligand 2 (CCL2, Accession NP_002973.1) is another GAM47 target gene, herein designated TARGET GENE. CCL2 BINDING SITE is a target binding site found in the 3' untranslated region of mRNA encoded by CCL2, corresponding to a target binding site such as BINDING SITE I, BINDING SITE II or BINDING SITE III of FIG. 8. Table 4 illustrates the complementarity of the nucleotide sequences of CCL2 BINDING SITE, designated SEQ ID:10130, to the nucleotide sequence of GAM47 RNA, herein designated GAM RNA, also designated SEQ ID:269.

Another function of GAM47 is therefore inhibition of Chemokine (c-c motif) ligand 2 (CCL2, Accession NP_002973.1). Accordingly, utilities of GAM47 include diagnosis, prevention and treatment of diseases and clinical conditions associated with CCL2.

Cyclin d2 (CCND2, Accession NP_001750.1) is another GAM47 target gene, herein designated TARGET GENE. CCND2 BINDING SITE is a target binding site found in the 3' untranslated region of mRNA encoded by CCND2, corresponding to a target binding site such as BINDING SITE I, BINDING SITE II or BINDING SITE III of FIG. 8. Table 4 illustrates the complementarity of the nucleotide sequences of CCND2 BINDING SITE, designated SEQ ID:18032, to the nucleotide sequence of GAM47 RNA, herein designated GAM RNA, also designated SEQ ID:269.

Another function of GAM47 is therefore inhibition of Cyclin d2 (CCND2, Accession NP_001750.1), a gene which is essential for the control of the cell cycle at the g1/s (start) transition. Accordingly, utilities of GAM47 include diagnosis, prevention and treatment of diseases and clinical conditions associated with CCND2.

The function of CCND2 has been established by previous studies. Inaba et al. (1992) used murine cDNA clones for 3 cyclin D genes that are normally expressed during the G1 phase of the cell cycle to clone the cognate human genes. By analysis of somatic cell hybrids containing different human chromosomes and by fluorescence in situ hybridization, they assigned the gene for cyclin D2 (CCND2) to 12p13. (Since the CCND1 gene (OMIM Ref. No. 168461) is on 11q13, this may be another bit of evidence of the homology of chromosomes 11 and 12.) Xiong et al. (1992) reported the cloning of the CCND2 gene and its assignment to 12p13 by fluorescence in situ hybridization. A pseudogene of CCND2 was mapped to 11q13 by Inaba et al. (1992). Kim et al. (2000) used Ccnd1- and Ccnd2-deficient mice to investigate the role of cyclins in Schwann cell growth. They concluded that neither Ccnd1 nor Ccnd2 is specifically required for the initial growth and maturation of Schwann cells during mouse development (see OMIM Ref. No. CCND1; 168461).

Full details of the abovementioned studies are described in the following publications, the disclosure of which are hereby incorporated by reference:

Inaba, T.; Matsushime, H.; Valentine, M.; Roussel, M. F.; Sherr, C. J.; Look, A. T. : Genomic organization, chromosomal localization, and independent expression of human cyclin D genes. Genomics 13:565-574, 1992; and Kim, H. A.; Pomeroy, S. L.; Whoriskey, W.; Pawlitzky, I.; Benowitz, L. I.; Sicinski, P.; Stiles, C. D.; Roberts, T. M.: A developmentally regulated switch directs regenerative growth o.

Further studies establishing the function and utilities of CCND2 are found in John Hopkins OMIM database record ID 123833, and in cited publications listed in Table 5, which are hereby incorporated by reference. Cyclin e1 (CCNE1, Accession NP_001229.1) is another GAM47 target gene, herein designated TARGET GENE. CCNE1 BINDING SITE is a target binding site found in the 3' untranslated region of multiple transcripts of mRNA encoded by CCNE1, corresponding to a target binding site such as BINDING SITE I, BINDING SITE II or BINDING SITE III of FIG. 8. Table 4 illustrates the complementarity of the nucleotide sequences of CCNE1 BINDING SITE, designated SEQ ID:11860, to the nucleotide sequence of GAM47 RNA, herein designated GAM RNA, also designated SEQ ID:269.

Another function of GAM47 is therefore inhibition of Cyclin e1 (CCNE1, Accession NP_001229.1). Accordingly, utilities of GAM47 include diagnosis, prevention and treatment of diseases and clinical conditions associated with CCNE1.

Cyclin e1 (CCNE1, Accession NP_476530.1) is another GAM47 target gene, herein designated TARGET GENE. CCNE1 BINDING SITE is a target binding site found in the 3' untranslated region of multiple transcripts of mRNA encoded by CCNE1, corresponding to a target binding site such as BINDING SITE I, BINDING SITE II or BINDING SITE III of FIG. 8. Table 4 illustrates the complementarity of the nucleotide sequences of CCNE1 BINDING SITE, designated SEQ ID:11860, to the nucleotide sequence of GAM47 RNA, herein designated GAM RNA, also designated SEQ ID:269.

Another function of GAM47 is therefore inhibition of Cyclin e1 (CCNE1, Accession NP_476530.1). Accordingly, utilities of GAM47 include diagnosis, prevention and treatment of diseases and clinical conditions associated with CCNE1.

Chemokine (c-c motif) receptor 7 (CCR7, Accession NP_001829.1) is another GAM47 target gene, herein designated TARGET GENE. CCR7 BINDING SITE is a target binding site found in the 3' untranslated region of mRNA encoded by CCR7, corresponding to a target binding site such as BINDING SITE I, BINDING SITE II or BINDING SITE III of FIG. 8. Table 4 illustrates the complementarity of the nucleotide sequences of CCR7 BINDING SITE, designated SEQ ID:13600, to the nucleotide sequence of GAM47 RNA, herein designated GAM RNA, also designated SEQ ID:269.

Another function of GAM47 is therefore inhibition of Chemokine (c-c motif) receptor 7 (CCR7, Accession NP_001829.1). Accordingly, utilities of GAM47 include diagnosis, prevention and treatment of diseases and clinical conditions associated with CCR7.

Cdc42 effector protein (rho gtpase binding) 5 (CDC42EP5, Accession NP_659494.2) is another GAM47 target gene, herein designated TARGET GENE. CDC42EP5 BINDING SITE is a target binding site found in the 5' untranslated region of mRNA encoded by CDC42EP5, corresponding to a target binding site such as BINDING SITE I, BINDING SITE II or BINDING SITE III of FIG. 8. Table 4 illustrates the complementarity of the nucleotide sequences of CDC42EP5 BINDING SITE, designated SEQ ID:18102, to the nucleotide sequence of GAM47 RNA, herein designated GAM RNA, also designated SEQ ID:269.

Another function of GAM47 is therefore inhibition of Cdc42 effector protein (rho gtpase binding) 5 (CDC42EP5, Accession NP_659494.2). Accordingly, utilities of GAM47 include diagnosis, prevention and treatment of diseases and clinical conditions associated with CDC42EP5.

Cadherin 1, type 1, e-cadherin (epithelial) (CDH1, Accession NP_004351.1) is another GAM47 target gene, herein designated TARGET GENE. CDH1 BINDING SITE is a target binding site found in the 3' untranslated region of mRNA encoded by CDH1, corresponding to a target binding site such as BINDING SITE I, BINDING SITE II or BINDING SITE III of FIG. 8. Table 4 illustrates the complementarity of the nucleotide sequences of CDH1 BINDING SITE, designated SEQ ID:6768, to the nucleotide sequence of GAM47 RNA, herein designated GAM RNA, also designated SEQ ID:269.

Another function of GAM47 is therefore inhibition of Cadherin 1, type 1, e-cadherin (epithelial) (CDH1, Accession NP_004351.1). Accordingly, utilities of GAM47 include diagnosis, prevention and treatment of diseases and clinical conditions associated with CDH1.

Glycoprotein hormones, alpha polypeptide (CGA, Accession NP_000726.1) is another GAM47 target gene, herein designated TARGET GENE. CGA BINDING SITE is a target binding site found in the 3' untranslated region of mRNA encoded by CGA, corresponding to a target binding site such as BINDING SITE I, BINDING SITE II or BINDING SITE III of FIG. 8. Table 4 illustrates the complementarity of the nucleotide sequences of CGA BINDING SITE, designated SEQ ID:4642, to the nucleotide sequence of GAM47 RNA, herein designated GAM RNA, also designated SEQ ID:269.

Another function of GAM47 is therefore inhibition of Glycoprotein hormones, alpha polypeptide (CGA, Accession NP_000726.1), a gene which is a precursor of the alpha subunit of chorionic gonadotropin hormone. and therefore may be associated with Secondary infertility. Accordingly, utilities of GAM47 include diagnosis, prevention and treatment of Secondary infertility, and of other diseases and clinical conditions associated with CGA.

The function of CGA has been established by previous studies. By in situ hybridization, Trent (1982) concluded that chromosome 18 carries the (an) HCG locus. That the alpha subunit of all 4 glycoprotein hormones is coded by a single gene was demonstrated by Fiddes and Goodman (1981) and Boothby et al. (1981). The 5-prime untranslated portion bears sequence homology to the corresponding part of the growth hormone gene. By use of restriction probes in human- rodent hybrids, Naylor et al. (1983) assigned the alpha subunit to chromosome 6 and the beta subunit to chromosome 19. Special attention was paid to the exclusion of chromosomes 10 and 18 as sites of these genes. CGA mapped to the 6q12-6q21 region. The alpha and beta genes are on mouse chromosomes 4 and 7, respectively. Mouse 7 carries 2 other homologs of human 19: Pep-7 and Gpi (homologous to PEPD and GPI). Hardin et al. (1983), by Southern blot analysis of DNA from somatic cell hybrids and by in situ hybridization, concluded that the alpha-HCG gene is on chromosome 18 (p11). A full-length cDNA probe for the alpha subunit was used in these studies. The reason for the discrepancy with the studies that place the alpha subunit on chromosome 6 is unknown. Hoshina et al. (1984) found at least 2 polymorphic sites in its 3-prime flanking region detected by restriction enzymes HindIII and EcoRI. In family studies, as expected, only a paternal genetic contribution was found in most hydatidiform moles. However, one uncommon pattern of DNA polymorphism, homozygosity for absent EcoRI site and presence of the HindIII site, predominated in choriocarcinoma. Thus, the authors suggested that moles with this uncommon pattern are particularly prone to development of choriocarcinoma. Amato et al. (2002) reported a patient with a 9-year history of secondary infertility due to an anti-CG autoantibody. Although she had regular menstrual cycles, had conceived spontaneously, and had good hormonal and follicular responses to gonadotropic stimulation regimens during the in vitro fertilization workup, she presented with apparent recurrent pregnancy loss associated with prolonged raised CG levels. She was found to have specific, low-affinity, but high-capacity anti-CG antibody. Crossreaction with recombinant FSH, recombinant LH, CG-alpha, and CG-beta was low. In addition, heat- inactivated serum and the affinity-purified IgG were shown to inhibit the action of CG in an in vitro bioassay. The authors concluded that the persisting titer of the antibody was responsible for the patient's infertility.

Full details of the abovementioned studies are described in the following publications, the disclosure of which are hereby incorporated by reference:

Amato, F.; Warnes, G. M.; Kirby, C. A.; Norman, R. J.: Infertility caused by hCG autoantibody. J. Clin. Endocr. Metab. 87:993-997, 2002; and Fiddes, J. C.; Goodman, H. M.: The gene encoding the common alpha subunit of the four human glycoprotein hormones. J. Molec. Appl. Genet. 1:3-18, 1981.

Further studies establishing the function and utilities of CGA are found in John Hopkins OMIM database record ID 118850, and in cited publications listed in Table 5, which are hereby incorporated by reference. CGI-115 (Accession NP_057136.1) is another GAM47 target gene, herein designated TARGET GENE. CGI-115 BINDING SITE is a target binding site found in the 3' untranslated region of mRNA encoded by CGI-115, corresponding to a target binding site such as BINDING SITE I, BINDING SITE II or BINDING SITE III of FIG. 8. Table 4 illustrates the complementarity of the nucleotide sequences of CGI-115 BINDING SITE, designated SEQ ID:5086, to the nucleotide sequence of GAM47 RNA, herein designated GAM RNA, also designated SEQ ID:269.

Another function of GAM47 is therefore inhibition of CGI-115 (Accession NP_057136.1). Accordingly, utilities of GAM47 include diagnosis, prevention and treatment of diseases and clinical conditions associated with CGI-115.

CGI-30 (Accession NP_057042.1) is another GAM47 target gene, herein designated TARGET GENE. CGI-30 BINDING SITE is a target binding site found in the 5' untranslated region of mRNA encoded by CGI-30, corresponding to a target binding site such as BINDING SITE I, BINDING SITE II or BINDING SITE III of FIG. 8. Table 4 illustrates the complementarity of the nucleotide sequences of CGI-30 BINDING SITE, designated SEQ ID:4236, to the nucleotide sequence of GAM47 RNA, herein designated GAM RNA, also designated SEQ ID:269.

Another function of GAM47 is therefore inhibition of CGI-30 (Accession NP_057042.1). Accordingly, utilities of GAM47 include diagnosis, prevention and treatment of diseases and clinical conditions associated with CGI-30.

Choline kinase-like (CHKL, Accession NP_689466.1) is another GAM47 target gene, herein designated TARGET GENE. CHKL BINDING SITE is a target binding site found in the 3' untranslated region of multiple transcripts of mRNA encoded by CHKL, corresponding to a target binding site such as BINDING SITE I, BINDING SITE II or BINDING SITE III of FIG. 8. Table 4 illustrates the complementarity of the nucleotide sequences of CHKL BINDING SITE, designated SEQ ID:4091, to the nucleotide sequence of GAM47 RNA, herein designated GAM RNA, also designated SEQ ID:269.

Another function of GAM47 is therefore inhibition of Choline kinase-like (CHKL, Accession NP_689466.1). Accordingly, utilities of GAM47 include diagnosis, prevention and treatment of diseases and clinical conditions associated with CHKL.

Chromatin accessibility complex 1 (CHRAC1, Accession NP_059140.1) is another GAM47 target gene, herein designated TARGET GENE. CHRAC1 BINDING SITE is a target binding site found in the 3' untranslated region of mRNA encoded by CHRAC1, corresponding to a target binding site such as BINDING SITE I, BINDING SITE II or BINDING SITE III of FIG. 8. Table 4 illustrates the complementarity of the nucleotide sequences of CHRAC1 BINDING SITE, designated SEQ ID:15944, to the nucleotide sequence of GAM47 RNA, herein designated GAM RNA, also designated SEQ ID:269.

Another function of GAM47 is therefore inhibition of Chromatin accessibility complex 1 (CHRAC1, Accession NP_059140.1). Accordingly, utilities of GAM47 include diagnosis, prevention and treatment of diseases and clinical conditions associated with CHRAC1.

Cytokine inducible sh2-containing protein (CISH, Accession NP_659508.1) is another GAM47 target gene, herein designated TARGET GENE. CISH BINDING SITE is a target binding site found in the 3' untranslated region of multiple transcripts of mRNA encoded by CISH, corresponding to a target binding site such as BINDING SITE I, BINDING SITE II or BINDING SITE III of FIG. 8. Table 4 illustrates the complementarity of the nucleotide sequences of CISH BINDING SITE, designated SEQ ID:1811, to the nucleotide sequence of GAM47 RNA, herein designated GAM RNA, also designated SEQ ID:269.

Another function of GAM47 is therefore inhibition of Cytokine inducible sh2-containing protein (CISH, Accession NP_659508.1), a gene which intervenes in the negative regulation of cytokines. Accordingly, utilities of GAM47 include diagnosis, prevention and treatment of diseases and clinical conditions associated with CISH.

The function of CISH has been established by previous studies. As part of the search for immediate-early cytokine-responsive genes, Yoshimura et al. (1995) cloned murine Cish, which was shown to have a growth inhibitory function. Cis, the protein product of Cish, has a Src homology 2 (SH2) domain in the middle of its sole structural motif. Tight linkage of Cish to the Gnai2 gene (OMIM Ref. No. 139360) on mouse chromosome 9, a region syntenic to human 3p21, prompted Uchida et al. (1997) to isolate a human CISH cDNA and map the gene to 3p21.3 by fluorescence in situ hybridization. Northern blot analysis showed expression of CISH as a 2-kb transcript in various epithelial tissues, including lung and kidney, which develop tumors frequently exhibiting 3p21.3 deletions. The CISH gene contains 2 introns, about 3 kb and 0.4 kb in size, and has 3 repeats of the pentameric mRNA destabilization signal, ATTTA, in its 3-prime untranslated region. The CIS protein consists of 258 amino acids.

Full details of the abovementioned studies are described in the following publications, the disclosure of which are hereby incorporated by reference:

Uchida, K.; Yoshimura, A.; Inazawa, J.; Yanagisawa, K.; Osada, H.; Masuda, A.; Saito, T.; Takahashi, T.; Miyajima, A.; Takahashi, T.: Molecular cloning of CISH, chromosome assignment to 3p21.3, and analysis of expression in fetal and adult tissues. Cytogenet. Cell Genet. 78:209-212, 1997; and Yoshimura, A.; Ohkubo, T.; Kiguchi, T.; Jenkins, N. A.; Gilbert, D. J.; Copeland, N. G.; Hara, T.; Miyajima, A.: A novel cytokine-inducible gene CIS, encodes an SH2-containing protein.

Further studies establishing the function and utilities of CISH are found in John Hopkins OMIM database record ID 602441, and in cited publications listed in Table 5, which are hereby incorporated by reference. Cytokine inducible sh2-containing protein (CISH, Accession NP_037456.4) is another GAM47 target gene, herein designated TARGET GENE. CISH BINDING SITE is a target binding site found in the 3' untranslated region of multiple transcripts of mRNA encoded by CISH, corresponding to a target binding site such as BINDING SITE I, BINDING SITE II or BINDING SITE III of FIG. 8. Table 4 illustrates the complementarity of the nucleotide sequences of CISH BINDING SITE, designated SEQ ID:1811, to the nucleotide sequence of GAM47 RNA, herein designated GAM RNA, also designated SEQ ID:269.

Another function of GAM47 is therefore inhibition of Cytokine inducible sh2-containing protein (CISH, Accession NP_037456.4), a gene which intervenes in the negative regulation of cytokines. Accordingly, utilities of GAM47 include diagnosis, prevention and treatment of diseases and clinical conditions associated with CISH.

The function of CISH has been established by previous studies. As part of the search for immediate-early cytokine-responsive genes, Yoshimura et al. (1995) cloned murine Cish, which was shown to have a growth inhibitory function. Cis, the protein product of Cish, has a Src homology 2 (SH2) domain in the middle of its sole structural motif. Tight linkage of Cish to the Gnai2 gene (OMIM Ref. No. 139360) on mouse chromosome 9, a region syntenic to human 3p21, prompted Uchida et al. (1997) to isolate a human CISH cDNA and map the gene to 3p21.3 by fluorescence in situ hybridization. Northern blot analysis showed expression of CISH as a 2-kb transcript in various epithelial tissues, including lung and kidney, which develop tumors frequently exhibiting 3p21.3 deletions. The CISH gene contains 2 introns, about 3 kb and 0.4 kb in size, and has 3 repeats of the pentameric mRNA destabilization signal, ATTTA, in its 3-prime untranslated region. The CIS protein consists of 258 amino acids.

Full details of the abovementioned studies are described in the following publications, the disclosure of which are hereby incorporated by reference:

Uchida, K.; Yoshimura, A.; Inazawa, J.; Yanagisawa, K.; Osada, H.; Masuda, A.; Saito, T.; Takahashi, T.; Miyajima, A.; Takahashi, T.: Molecular cloning of CISH, chromosome assignment to 3p21.3, and analysis of expression in fetal and adult tissues. Cytogenet. Cell Genet. 78:209-212, 1997; and Yoshimura, A.; Ohkubo, T.; Kiguchi, T.; Jenkins, N. A.; Gilbert, D. J.; Copeland, N. G.; Hara, T.; Miyajima, A.: A novel cytokine-inducible gene CIS, encodes an SH2-containing protein.

Further studies establishing the function and utilities of CISH are found in John Hopkins OMIM database record ID 602441, and in cited publications listed in Table 5, which are hereby incorporated by reference. Citron (rho-interacting, serine/threonine kinase 21) (CIT, Accession XP_045786.2) is another GAM47 target gene, herein designated TARGET GENE. CIT BINDING SITE is a target binding site found in the 3' untranslated region of mRNA encoded by CIT, corresponding to a target binding site such as BINDING SITE I, BINDING SITE II or BINDING SITE III of FIG. 8. Table 4 illustrates the complementarity of the nucleotide sequences of CIT BINDING SITE, designated SEQ ID:9863, to the nucleotide sequence of GAM47 RNA, herein designated GAM RNA, also designated SEQ ID:269.

Another function of GAM47 is therefore inhibition of Citron (rho-interacting, serine/threonine kinase 21) (CIT, Accession XP_045786.2), a gene which is increased several-fold by coexpression of constitutively active Rho. Accordingly, utilities of GAM47 include diagnosis, prevention and treatment of diseases and clinical conditions associated with CIT.

The function of CIT has been established by previous studies. Activated Rho GTPases (see OMIM Ref. No. 602924) trigger distinctive kinase cascades. In particular, ROCK (see OMIM Ref. No. ROCK1, 601702) binds to Rho, and its kinase activity is moderately stimulated by this association. The citron molecule (Madaule et al., 1995), a specific interactor of Rho and Rac (see OMIM Ref. No. 602048), shares a significant degree of structural homology with ROCK; however, its lack of a kinase domain raised the question of its biologic function. By PCR of a mouse primary keratinocyte cDNA library, Di Cunto et al. (1998) identified a novel serine/threonine kinase, CRIK (citron Rho-interacting kinase), belonging to the myotonic dystrophy kinase (see OMIM Ref. No. 605377) family. CRIK can be expressed as at least 2 isoforms, one of which encompasses the previously reported form of citron in almost its entirety. The long form of CRIK is a 240-kD protein in which the kinase domain is followed by the sequence of citron. The short form, CRIK-SK (short kinase), is an approximately 54-kD protein that consists mostly of the kinase domain. CRIK and CRIK-SK proteins are capable of phosphorylating exogenous substrates as well as of autophosphorylation, when tested by in vitro kinase assays after expression into COS-7 cells. CRIK kinase activity is increased several-fold by coexpression of constitutively active Rho, while active Rac has more limited effects. Kinase activity of the endogenous CRIK is indicated by in vitro kinase assays after immunoprecipitation with antibodies recognizing the citron moiety of the protein. When expressed in keratinocytes, full-length CRIK, but not CRIK-SK, localizes into corpuscular cytoplasmic structures and elicits recruitment of actin into these structures. The previously reported Rho-associated kinases ROCK1 and ROCK2 (OMIM Ref. No. 604002) are ubiquitously expressed. Northern blot analysis of mouse tissues revealed a restricted pattern of expression limited to keratinocytes, brain, spleen, lung, kidney, and an especially strong signal in testis. No expression was detectable in heart, liver, or skeletal muscle. The CRIK protein contains a kinase domain, a coiled-coil domain, a leucine-rich domain, a Rho-Rac binding domain, a zinc finger region, a pleckstrin homology domain, and a putative SH3-binding domain. Di Cunto et al. (1998) reported cloning the human homolog of the CRIK kinase domain. They stated that the human homolog of citron is contained within a PAC clone (GenBank AC002563) mapping to chromosome 12q.

Animal model experiments lend further support to the function of CIT. Di Cunto et al. (2000) generated mice deficient in citron kinase by targeted disruption. Citron-K -/- mice grow at slower rates, are severely ataxic, and die before adulthood as a consequence of fatal seizures. Their brains display defective neurogenesis, with dramatic depletion of microneurons in the olfactory bulb, hippocampus, and cerebellum. These abnormalities arise during development of the central nervous system due to altered cytokinesis and massive apoptosis. Di Cunto et al. (2000) concluded that citron-K is essential for cytokinesis in vivo, in specific neuronal precursors only. Moreover, they suggested a novel molecular mechanism for a subset of human malformation syndromes of the central nervous system.

It is appreciated that the abovementioned animal model for CIT is acknowledged by those skilled in the art as a scientifically valid animal model, as can be further appreciated from the publications sited hereinbelow.

Full details of the abovementioned studies are described in the following publications, the disclosure of which are hereby incorporated by reference:

Di Cunto, F.; Imarisio, S.; Hirsch, E.; Broccoli, V.; Bulfone, A.; Migheli, A.; Atzori, C.; Turco, E.; Triolo, R.; Dotto, G. P.; Silengo, L.; Altruda, F.: Defective neurogenesis in citron kinase knockout mice by altered cytokinesis and massive apoptosis. Neuron 28:115-127, 2000; and Madaule, P.; Furuyashiki, T.; Reid, T.; Ishizaki, T.; Watanabe, G.; Morii, N.; Narumiy, S.: A novel partner for the GTP-bound forms of rho and rac. FEBS Lett. 377:243-248, 1995.

Further studies establishing the function and utilities of CIT are found in John Hopkins OMIM database record ID 605629, and in cited publications listed in Table 5, which are hereby incorporated by reference. C-type (calcium dependent, carbohydrate-recognition domain) lectin, superfamily member 12 (CLECSF12, Accession NP_072092.2) is another GAM47 target gene, herein designated TARGET GENE. CLECSF12 BINDING SITE is a target binding site found in the 3' untranslated region of mRNA encoded by CLECSF12, corresponding to a target binding site such as BINDING SITE I, BINDING SITE II or BINDING SITE III of FIG. 8. Table 4 illustrates the complementarity of the nucleotide sequences of CLECSF12 BINDING SITE, designated SEQ ID:11168, to the nucleotide sequence of GAM47 RNA, herein designated GAM RNA, also designated SEQ ID:269.

Another function of GAM47 is therefore inhibition of C-type (calcium dependent, carbohydrate-recognition domain) lectin, superfamily member 12 (CLECSF12, Accession NP_072092.2), a gene which is a pattern-recognition receptor. Accordingly, utilities of GAM47 include diagnosis, prevention and treatment of diseases and clinical conditions associated with CLECSF12.

The function of CLECSF12 has been established by previous studies. Yokota et al. (2001) cloned human dectin-1 using degenerate PCR amplification of mRNA isolated from dendritic cells and subsequent cDNA cloning. The human dectin-1 gene encodes a polypeptide of 247 amino acids, 3 amino acids longer than the mouse protein. Dectin-1 contains an immunoreceptor tyrosine-based activation motif within the cytoplasmic domain. Human dectin-1 mRNA is expressed predominantly in peripheral blood leukocytes and preferentially by dendritic cells. The mRNA encodes a 33-kD glycoprotein. In human epidermis, the protein is expressed selectively by Langerhans cells, which are an epidermal subset of dendritic cells. A truncated form of dectin-1 RNA encodes a polypeptide lacking almost the entire neck domain, which is required for accessibility of the carbohydrate recognition domain to ligands. Truncated dectin is produced by alternative splicing. Brown and Gordon (2001) identified dectin-1 as a beta-glucan receptor present on macrophages. In contrast to its reported specificity for dendritic cells (Yokota et al. (2001), Brown and Gordon (2001)) found that dectin-1 was expressed in every macrophage population examined and in more tissues than was previously reported with the highest expression being in the liver, lung, and thymus. Brown and Gordon (2001) found that dectin-1 is a pattern-recognition receptor that recognizes a variety of beta-1,3-linked and beta-1,6-linked glucans from fungi and plants. Dectin-1 did not recognize monosaccharides or carbohydrates with different linkages. Laminarin and glucan phosphate, a structurally defined immunologically active beta-glucan, were the most effective inhibitors; both bind to the beta-glucan receptor on monocytes and macrophages. Soluble recombinant dectin-1 stimulates the proliferation of T lymphocytes (Ariizumi et al. (2000)). In a whole-cell binding assay, binding of T cells to NIH 3T3 cells expressing dectin-1 was not inhibited by beta-glucans. Therefore, Brown and Gordon (2001) concluded that dectin-1 has 2 ligand binding sites: one that recognizes an endogenous ligand on T cells, and another for exogenous carbohydrates.

Full details of the abovementioned studies are described in the following publications, the disclosure of which are hereby incorporated by reference:

Ariizumi, K.; Shen, G.-L.; Shikano, S.; Xu, S.; Ritter, R., III; Kumamoto, T.; Edelbaum, D.; Morita, A.; Bergstresser, P. R.; Takashima, A.: Identification of a novel, dendritic cell-associated molecule, dectin-1, by subtractive cDNA cloning. J. Biol. Chem. 275:20157-20167, 2000; and Brown, G. D.; Gordon, S.: A new receptor for beta-glucans. Nature 413:36-37, 2001.

Further studies establishing the function and utilities of CLECSF12 are found in John Hopkins OMIM database record ID 606264, and in cited publications listed in Table 5, which are hereby incorporated by reference. C-type (calcium dependent, carbohydrate-recognition domain) lectin, superfamily member 5 (CLECSF5, Accession NP_037384.1) is another GAM47 target gene, herein designated TARGET GENE. CLECSF5 BINDING SITE is a target binding site found in the 3' untranslated region of mRNA encoded by CLECSF5, corresponding to a target binding site such as BINDING SITE I, BINDING SITE II or BINDING SITE III of FIG. 8. Table 4 illustrates the complementarity of the nucleotide sequences of CLECSF5 BINDING SITE, designated SEQ ID:2913, to the nucleotide sequence of GAM47 RNA, herein designated GAM RNA, also designated SEQ ID:269.

Another function of GAM47 is therefore inhibition of C-type (calcium dependent, carbohydrate-recognition domain) lectin, superfamily member 5 (CLECSF5, Accession NP_037384.1). Accordingly, utilities of GAM47 include diagnosis, prevention and treatment of diseases and clinical conditions associated with CLECSF5.

C-type (calcium dependent, carbohydrate-recognition domain) lectin, superfamily member 9 (CLECSF9, Accession NP_055173.1) is another GAM47 target gene, herein designated TARGET GENE. CLECSF9 BINDING SITE is a target binding site found in the 3' untranslated region of mRNA encoded by CLECSF9, corresponding to a target binding site such as BINDING SITE I, BINDING SITE II or BINDING SITE III of FIG. 8. Table 4 illustrates the complementarity of the nucleotide sequences of CLECSF9 BINDING SITE, designated SEQ ID:8709, to the nucleotide sequence of GAM47 RNA, herein designated GAM RNA, also designated SEQ ID:269.

Another function of GAM47 is therefore inhibition of C-type (calcium dependent, carbohydrate-recognition domain) lectin, superfamily member 9 (CLECSF9, Accession NP_055173.1). Accordingly, utilities of GAM47 include diagnosis, prevention and treatment of diseases and clinical conditions associated with CLECSF9.

Chloride intracellular channel 6 (CLIC6, Accession NP_444507.1) is another GAM47 target gene, herein designated TARGET GENE. CLIC6 BINDING SITE is a target binding site found in the 3' untranslated region of mRNA encoded by CLIC6, corresponding to a target binding site such as BINDING SITE I, BINDING SITE II or BINDING SITE III of FIG. 8. Table 4 illustrates the complementarity of the nucleotide sequences of CLIC6 BINDING SITE, designated SEQ ID:2170, to the nucleotide sequence of GAM47 RNA, herein designated GAM RNA, also designated SEQ ID:269.

Another function of GAM47 is therefore inhibition of Chloride intracellular channel 6 (CLIC6, Accession NP_444507.1). Accordingly, utilities of GAM47 include diagnosis, prevention and treatment of diseases and clinical conditions associated with CLIC6.

Calsyntenin 2 (CLSTN2, Accession NP_071414.1) is another GAM47 target gene, herein designated TARGET GENE. CLSTN2 BINDING SITE is a target binding site found in the 3' untranslated region of mRNA encoded by CLSTN2, corresponding to a target binding site such as BINDING SITE I, BINDING SITE II or BINDING SITE III of FIG. 8. Table 4 illustrates the complementarity of the nucleotide sequences of CLSTN2 BINDING SITE, designated SEQ ID:15486, to the nucleotide sequence of GAM47 RNA, herein designated GAM RNA, also designated SEQ ID:269.

Another function of GAM47 is therefore inhibition of Calsyntenin 2 (CLSTN2, Accession NP_071414.1). Accordingly, utilities of GAM47 include diagnosis, prevention and treatment of diseases and clinical conditions associated with CLSTN2.

Cyclin m4 (CNNM4, Accession NP_064569.1) is another GAM47 target gene, herein designated TARGET GENE. CNNM4 BINDING SITE is a target binding site found in the 3' untranslated region of mRNA encoded by CNNM4, corresponding to a target binding site such as BINDING SITE I, BINDING SITE II or BINDING SITE III of FIG. 8. Table 4 illustrates the complementarity of the nucleotide sequences of CNNM4 BINDING SITE, designated SEQ ID:14167, to the nucleotide sequence of GAM47 RNA, herein designated GAM RNA, also designated SEQ ID:269.

Another function of GAM47 is therefore inhibition of Cyclin m4 (CNNM4, Accession NP_064569.1). Accordingly, utilities of GAM47 include diagnosis, prevention and treatment of diseases and clinical conditions associated with CNNM4.

Coatomer protein complex, subunit alpha (COPA, Accession NP_004362.1) is another GAM47 target gene, herein designated TARGET GENE. COPA BINDING SITE is a target binding site found in the 3' untranslated region of mRNA encoded by COPA, corresponding to a target binding site such as BINDING SITE I, BINDING SITE II or BINDING SITE III of FIG. 8. Table 4 illustrates the complementarity of the nucleotide sequences of COPA BINDING SITE, designated SEQ ID:5791, to the nucleotide sequence of GAM47 RNA, herein designated GAM RNA, also designated SEQ ID:269.

Another function of GAM47 is therefore inhibition of Coatomer protein complex, subunit alpha (COPA, Accession NP_004362.1), a gene which is invovled protein transport between the endoplasmic reticulum (ER) and Golgi compartments. Accordingly, utilities of GAM47 include diagnosis, prevention and treatment of diseases and clinical conditions associated with COPA.

The function of COPA has been established by previous studies. In eukaryotic cells, protein transport between the endoplasmic reticulum (ER) and Golgi compartments is mediated in part by non-clathrin-coated vesicular coat proteins (COPs). Seven COP subunits have been recognized, and represent components of a complex known as coatomer, or COPI. The subunits are designated alpha-COP, beta-COP (OMIM Ref. No. 600959), beta-prime-COP, gamma-COP, delta-COP (OMIM Ref. No. 600820), epsilon-COP (OMIM Ref. No. 606942), and zeta-COP COPI is a heptameric protein recruited to membranes by ARF1 (OMIM Ref. No. 103180), a GTP-binding protein. Coat assembly helps in the transport of budding off membrane between the ER and Golgi apparatus. Using fluorescence microscopy, Presley et al. (2002) showed that guanine nucleotide exchange-activated ARF1 at the Golgi membrane recruits and binds cytoplasmic COPI to the membranes. Photobleaching experiments demonstrated that COPI remains at the membranes after ARF1 has been hydrolysed by GTPase-activating protein (GAP; 139150). COPI binds to membrane cargo, soluble-cargo receptors, or other Golgi proteins. Uncoating, or the release of COPI from Golgi membranes to the cytoplasm, then occurs, which is inhibited by AIF (PDCD8; 300169). Presley et al. (2002) concluded from their kinetic and biochemical analyses that COPI and ARF1 continuously bind and release from Golgi membranes, allowing the membrane at these sites to recruit cargo, alter their phospholipid composition, and become larger, phase-separated domains Chow (1997) reported the genomic organization of the COPA gene. It contains 33 exons ranging in size from 67 to 611 bp. All exon-intron junctions conform with the GT-AG rule. The 32 introns range from about 80 bp to 4 kb, with the genomic DNA of COPA estimated to span approximately 37 kb. The untranscribed and noncoding portions of the 5-prime end of the gene lacked TATA and CAAT boxes but displayed a high GC content, consistent with its being a housekeeping gene Full details of the abovementioned studies are described in the following publications, the disclosure of which are hereby incorporated by reference:

Presley, J. F.; Ward, T. H.; Pfeifer, A. C.; Siggia, E. D.; Phair, R. D.; Lippincott-Schwartz, J.: Dissection of COPI and Arf1 dynamics in vivo and role in Golgi membrane transport. Nature 417:187-193, 2002; and Quek, H. H.; Chow, V. T. K.: Genomic organization and mapping of the human HEP-COP gene (COPA) to 1q. Cytogenet. Cell Genet. 76:139-143, 1997.

Further studies establishing the function and utilities of COPA are found in John Hopkins OMIM database record ID 601924, and in cited publications listed in Table 5, which are hereby incorporated by reference. Carnitine palmitoyltransferase 1b (muscle) (CPT1B, Accession NP_689453.1) is another GAM47 target gene, herein designated TARGET GENE. CPT1B BINDING SITE is a target binding site found in the 3' untranslated region of multiple transcripts of mRNA encoded by CPT1B, corresponding to a target binding site such as BINDING SITE I, BINDING SITE II or BINDING SITE III of FIG. 8. Table 4 illustrates the complementarity of the nucleotide sequences of CPT1B BINDING SITE, designated SEQ ID:4091, to the nucleotide sequence of GAM47 RNA, herein designated GAM RNA, also designated SEQ ID:269.

Another function of GAM47 is therefore inhibition of Carnitine palmitoyltransferase 1b (muscle) (CPT1B, Accession NP_689453.1), a gene which is a rate-controlling enzyme of long-chain fatty acid b-oxidation pathway. Accordingly, utilities of GAM47 include diagnosis, prevention and treatment of diseases and clinical conditions associated with CPT1B.

The function of CPT1B has been established by previous studies. The mitochondrial carnitine palmitoyltransferases (CPTs; EC 2.3.1.21) are required to allow net transport of long-chain fatty acyl-CoAs from the cytoplasm into the mitochondria. Type I CPT (see OMIM Ref. No. CPT1A; 600528) resides in the outer mitochondrial membrane. At least 2 isoforms of type I CPT are expressed in human and rat. Yamazaki et al. (1996) used a cDNA probe for the rat muscle-type CPT I to isolate cDNA clones for the human homolog. By Northern analysis, they determined that this isoform is expressed primarily in heart and skeletal muscle Van der Leij et al. (1997) isolated and sequenced cDNA and genomic DNA fragments of the human CPT1B gene, encoding muscle type carnitine palmitoyltransferase I. Analysis of CPT1B cDNA sequences revealed the presence of an untranslated 5-prime exon and differential processing of introns 13 and 19. The alternative splicing of intron 13 caused an in-frame deletion leading to a protein smaller by 10 amino acids. By using different splice acceptor sites, van der Leij et al. (1997) found that intron 19 was spliced in most cases, but 4 of 14 sequenced CPT1B 3-prime cDNA clones contained part of intron 19 instead of exon 20

Full details of the abovementioned studies are described in the following publications, the disclosure of which are hereby incorporated by reference:

Yamazaki, N.; Shinohara, Y.; Shima, A.; Yamanaka, Y.; Terada, H.: Isolation and characterization of cDNA and genomic clones encoding human muscle type carnitine palmitoyltransferase I. Biochim. Biophys. Acta 1307:157-161, 1996; and van der Leij, F. R.; Takens, J.; van der Veen, A. Y.; Terpstra, P.; Kuipers, J. R. G.: Localization and intron usage analysis of the human CPT1B gene for muscle type carnitine palmitoyl.

Further studies establishing the function and utilities of CPT1B are found in John Hopkins OMIM database record ID 601987, and in cited publications listed in Table 5, which are hereby incorporated by reference. Cofactor required for sp1 transcriptional activation, subunit 2, 150 kda (CRSP2, Accession NP_004220.2) is another GAM47 target gene, herein designated TARGET GENE. CRSP2 BINDING SITE is a target binding site found in the 3' untranslated region of mRNA encoded by CRSP2, corresponding to a target binding site such as BINDING SITE I, BINDING SITE II or BINDING SITE III of FIG. 8. Table 4 illustrates the complementarity of the nucleotide sequences of CRSP2 BINDING SITE, designated SEQ ID:14259, to the nucleotide sequence of GAM47 RNA, herein designated GAM RNA, also designated SEQ ID:269.

Another function of GAM47 is therefore inhibition of Cofactor required for sp1 transcriptional activation, subunit 2, 150 kda (CRSP2, Accession NP_004220.2). Accordingly, utilities of GAM47 include diagnosis, prevention and treatment of diseases and clinical conditions associated with CRSP2.

Cysteine sulfinic acid decarboxylase (CSAD, Accession NP_057073.2) is another GAM47 target gene, herein designated TARGET GENE. CSAD BINDING SITE is a target binding site found in the 5' untranslated region of mRNA encoded by CSAD, corresponding to a target binding site such as BINDING SITE I, BINDING SITE II or BINDING SITE III of FIG. 8. Table 4 illustrates the complementarity of the nucleotide sequences of CSAD BINDING SITE, designated SEQ ID:12878, to the nucleotide sequence of GAM47 RNA, herein designated GAM RNA, also designated SEQ ID:269.

Another function of GAM47 is therefore inhibition of Cysteine sulfinic acid decarboxylase (CSAD, Accession NP_057073.2). Accordingly, utilities of GAM47 include diagnosis, prevention and treatment of diseases and clinical conditions associated with CSAD.

Cug triplet repeat, rna binding protein 1 (CUGBP1, Accession NP_006551.1) is another GAM47 target gene, herein designated TARGET GENE. CUGBP1 BINDING SITE is a target binding site found in the 3' untranslated region of mRNA encoded by CUGBP1, corresponding to a target binding site such as BINDING SITE I, BINDING SITE II or BINDING SITE III of FIG. 8. Table 4 illustrates the complementarity of the nucleotide sequences of CUGBP1 BINDING SITE, designated SEQ ID:7087, to the nucleotide sequence of GAM47 RNA, herein designated GAM RNA, also designated SEQ ID:269.

Another function of GAM47 is therefore inhibition of Cug triplet repeat, rna binding protein 1 (CUGBP1, Accession NP_006551.1), a gene which regulates splicing and translation of various rnas. and therefore may be associated with Myotonic dystrophy. Accordingly, utilities of GAM47 include diagnosis, prevention and treatment of Myotonic dystrophy, and of other diseases and clinical conditions associated with CUGBP1.

The function of CUGBP1 has been established by previous studies. While an unstable CTG triplet repeat expansion is responsible for myotonic dystrophy (DM; 160900), the mechanism whereby this genetic defect induces the disease is unknown. To detect proteins that bind to CTG triplet repeats, Timchenko et al. (1996) performed bandshift analysis using as probes double-stranded DNA fragments having CTG repeats and single-stranded oligonucleotides having CTG repeats or RNA CUG repeats. The proteins were derived from nuclear and cytoplasmic extracts of HeLa cells, fibroblasts, and myotubes. Proteins binding to the double-stranded DNA repeat were inhibited by the nonlabeled repeat but not by a nonspecific DNA fragment. Another protein binding to the single-stranded CTG probe and the RNA CUG probe was inhibited by nonlabeled CTG(8) and CUG(8) repeats. The protein binding only to the RNA repeat (CUG)8 was inhibited by nonlabeled (CUG)8 but not by nonlabeled single-or double-stranded CTG repeats. Furthermore, the protein, designated CUG- binding protein (CUGBP) by the authors, exhibited no binding to an RNA oligonucleotide of triplet repeats of the same length but having a different sequence, CGG. The CUG- binding protein was localized to the cytoplasm, whereas double-stranded DNA binding proteins were localized to the nuclear extract. Thus, Timchenko et al. (1996) concluded that several trinucleotide-binding proteins exist and their specificity is determined by the triplet sequence. CTG trinucleotide repeats encode CUG repeat regions in the corresponding mRNAs. Timchenko et al. (1996) identified 2 proteins, termed CUGBP1 and CUGBP2, that bind specifically to CUG repeats in RNA. They suggested that these 2 proteins, with masses of 49 kD and 51 kD, respectively, are isoforms encoded by the same gene. Timchenko et al. (1996) cloned a gene, termed NAB50 by them, based on the interaction between its protein product and the yeast Nab2 protein. The authors stated that the NAB50 gene encodes the CUGBP1 and CUGBP2 proteins because anti- Nab50 antibodies crossreacted with both CUGBP isoforms. The gene predicts a 482-amino acid protein with a calculated molecular mass of 52 kD. The predicted protein contains 3 RNA-binding domains and is homologous to the hnRNPs Full details of the abovementioned studies are described in the following publications, the disclosure of which are hereby incorporated by reference:

Timchenko, L. T.; Miller, J. W.; Timchenko, N. A.; DeVore, D. R.; Datar, K. V.; Lin, L.; Roberts, R.; Caskey, C. T.; Swanson, M. S.: Identification of a (CUG)n triplet repeat RNA-binding protein and its expression in myotonic dystrophy. Nucleic Acids Res. 24:4407-4414, 1996; and Good, P. J.; Chen, Q.; Warner, S. J.; Herring, D. C.: A family of human RNA-binding proteins related to the Drosophila Bruno transcriptional regulator. J. Biol. Chem. 275: 28583-28592.

Further studies establishing the function and utilities of CUGBP1 are found in John Hopkins OMIM database record ID 601074, and in cited publications listed in Table 5, which are hereby incorporated by reference. Chemokine (c-x-c motif) ligand 3 (CXCL3, Accession NP_002081.1) is another GAM47 target gene, herein designated TARGET GENE. CXCL3 BINDING SITE is a target binding site found in the 3' untranslated region of mRNA encoded by CXCL3, corresponding to a target binding site such as BINDING SITE I, BINDING SITE II or BINDING SITE III of FIG. 8. Table 4 illustrates the complementarity of the nucleotide sequences of CXCL3 BINDING SITE, designated SEQ ID:16187, to the nucleotide sequence of GAM47 RNA, herein designated GAM RNA, also designated SEQ ID:269.

Another function of GAM47 is therefore inhibition of Chemokine (c-x-c motif) ligand 3 (CXCL3, Accession NP_002081.1). Accordingly, utilities of GAM47 include diagnosis, prevention and treatment of diseases and clinical conditions associated with CXCL3.

Cytochrome p450, subfamily iic (mephenytoin 4-hydroxylase), polypeptide 9 (CYP2C9, Accession NP_000762.2) is another GAM47 target gene, herein designated TARGET GENE. CYP2C9 BINDING SITE is a target binding site found in the 3' untranslated region of mRNA encoded by CYP2C9, corresponding to a target binding site such as BINDING SITE I, BINDING SITE II or BINDING SITE III of FIG. 8. Table 4 illustrates the complementarity of the nucleotide sequences of CYP2C9 BINDING SITE, designated SEQ ID:10215, to the nucleotide sequence of GAM47 RNA, herein designated GAM RNA, also designated SEQ ID:269.

Another function of GAM47 is therefore inhibition of Cytochrome p450, subfamily iic (mephenytoin 4-hydroxylase), polypeptide 9 (CYP2C9, Accession NP_000762.2). Accordingly, utilities of GAM47 include diagnosis, prevention and treatment of diseases and clinical conditions associated with CYP2C9.

CYP51A1 (Accession NP_000777.1) is another GAM47 target gene, herein designated TARGET GENE. CYP51A1 BINDING SITE is a target binding site found in the 5' untranslated region of mRNA encoded by CYP51A1, corresponding to a target binding site such as BINDING SITE I, BINDING SITE II or BINDING SITE III of FIG. 8. Table 4 illustrates the complementarity of the nucleotide sequences of CYP51A1 BINDING SITE, designated SEQ ID:2685, to the nucleotide sequence of GAM47 RNA, herein designated GAM RNA, also designated SEQ ID:269.

Another function of GAM47 is therefore inhibition of CYP51A1 (Accession NP_000777.1). Accordingly, utilities of GAM47 include diagnosis, prevention and treatment of diseases and clinical conditions associated with CYP51A1.

Cytochrome p450, subfamily viiib (sterol 12-alpha-hydroxylase), polypeptide 1 (CYP8B1, Accession NP_004382.1) is another GAM47 target gene, herein designated TARGET GENE. CYP8B1 BINDING SITE1 and CYP8B1 BINDING SITE2 are target binding sites found in untranslated regions of mRNA encoded by CYP8B1, corresponding to target binding sites such as BINDING SITE I, BINDING SITE II or BINDING SITE III of FIG. 8. Table 4 illustrates the complementarity of the nucleotide sequences of CYP8B1 BINDING SITE1 and CYP8B1 BINDING SITE2, designated SEQ ID:704 and SEQ ID:3660 respectively, to the nucleotide sequence of GAM47 RNA, herein designated GAM RNA, also designated SEQ ID:269.

Another function of GAM47 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM47 include diagnosis, prevention and treatment of diseases and clinical conditions associated with CYP8B1.

The function of CYP8B1 has been established by previous studies. Zhang and Chiang (2001) showed that hepatocyte nuclear factor-4-alpha (HNF4A; 600281) strongly activates CYP8B1 promoter activity, whereas CYP7A promoter-binding factor (CPF, or NR5A2; 604453) has much less effect. The promoter activities were strongly repressed by bile acid. EMSA and site-directed mutagenesis analysis indicated that HNF4A, CPF, and the bile acid response element have overlapping binding sites in CYP8B1. Mammalian 2-hybrid analysis demonstrated interaction of HNF4A with the small heterodimer partner (SHP; 604630). Functional analysis determined that SHP represses HNF4A-induced CYP8B1 transcription. Zhang and Chiang (2001) concluded that bile acids repress human CYP8B1 transcription by reducing the transactivation activity of HNF4A through the interaction of HNF4A with SHP and a reduction of HNF4A expression in liver. Gafvels et al. (1999) obtained cDNAs encoding human and mouse CYP8B1. The deduced 501-amino acid human CYP8B1 protein is approximately 75% identical to the mouse and rabbit proteins. It contains a hydrophobic, membrane-spanning N terminus and conserved oxygen- binding, steroidogenic, and heme-binding segments. Northern blot analysis revealed expression of a 3.9-kb CYP8B1 transcript in liver. In mouse, expression was restricted to liver.

Full details of the abovementioned studies are described in the following publications, the disclosure of which are hereby incorporated by reference:

Gafvels, M.; Olin, M.; Chowdhary, B. P.; Raudsepp, T.; Andersson, U.; Persson, B.; Jansson, M.; Bjorkhem, I.; Eggertsen, G.: Structure and chromosomal assignment of the sterol 12-alpha-hydroxylase gene (CYP8B1) in human and mouse: eukaryotic cytochrome P-450 gene devoid of introns. Genomics 56:184-196, 1999; and Zhang, M.; Chiang, J. Y. L.: Transcriptional regulation of the human sterol 12-alpha-hydroxylase gene (CYP8B1): roles of hepatocyte nuclear factor 4-alpha in mediating bile acid repre.

Further studies establishing the function and utilities of CYP8B1 are found in John Hopkins OMIM database record ID 602172, and in cited publications listed in Table 5, which are hereby incorporated by reference. Dishevelled associated activator of morphogenesis 2 (DAAM2, Accession XP_166434.3) is another GAM47 target gene, herein designated TARGET GENE. DAAM2 BINDING SITE is a target binding site found in the 3' untranslated region of mRNA encoded by DAAM2, corresponding to a target binding site such as BINDING SITE I, BINDING SITE II or BINDING SITE III of FIG. 8. Table 4 illustrates the complementarity of the nucleotide sequences of DAAM2 BINDING SITE, designated SEQ ID:3097, to the nucleotide sequence of GAM47 RNA, herein designated GAM RNA, also designated SEQ ID:269.

Another function of GAM47 is therefore inhibition of Dishevelled associated activator of morphogenesis 2 (DAAM2, Accession XP_166434.3), a gene which controls cell polarity and movement during development. Accordingly, utilities of GAM47 include diagnosis, prevention and treatment of diseases and clinical conditions associated with DAAM2.

The function of DAAM2 has been established by previous studies. By sequencing randomly selected cDNAs corresponding to relatively long transcripts from brain, Nagase et al. (1997) identified a cDNA which they designated KIAA0381. The KIAA0381 cDNA encodes an 864-amino acid protein predicted to be involved in cell division. RT-PCR analysis detected expression of KIAA0381 in most tissues tested. Wnt (see OMIM Ref. No. 164975) signaling via the frizzled receptor (Fz; OMIM Ref. No. 600667) controls cell polarity and movement during development. Habas et al. (2001) reported that in human cells and during Xenopus embryogenesis, Wnt/Fz signaling activates the small GTPase Rho (OMIM Ref. No. 165390), a key regulator of cytoskeleton architecture. Wnt/Fz activation of Rho requires the cytoplasmic protein dishevelled (DVL; OMIM Ref. No. 601365) and a novel formin (see OMIM Ref. No. 136535) homology (FH) protein that they identified and named DAAM1 (OMIM Ref. No. 606626). Habas et al. (2001) identified DAAM2, which is identical to KIAA0381, as a protein that is closely related to DAAM1.

Full details of the abovementioned studies are described in the following publications, the disclosure of which are hereby incorporated by reference:

Habas, R.; Kato, Y.; He, X.: Wnt/Frizzled activation of Rho regulates vertebrate gastrulation and requires a novel Formin homology protein Daam1. Cell 107:843-854, 2001; and Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human gene.

Further studies establishing the function and utilities of DAAM2 are found in John Hopkins OMIM database record ID 606627, and in cited publications listed in Table 5, which are hereby incorporated by reference. Dynactin 1 (p150, glued homolog, drosophila) (DCTN1, Accession NP_004073.2) is another GAM47 target gene, herein designated TARGET GENE. DCTN1 BINDING SITE is a target binding site found in the 5' untranslated region of multiple transcripts of mRNA encoded by DCTN1, corresponding to a target binding site such as BINDING SITE I, BINDING SITE II or BINDING SITE III of FIG. 8. Table 4 illustrates the complementarity of the nucleotide sequences of DCTN1 BINDING SITE, designated SEQ ID:5744, to the nucleotide sequence of GAM47 RNA, herein designated GAM RNA, also designated SEQ ID:269.

Another function of GAM47 is therefore inhibition of Dynactin 1 (p150, glued homolog, drosophila) (DCTN1, Accession NP_004073.2), a gene which is a microtubule-based biologic motor protein. Accordingly, utilities of GAM47 include diagnosis, prevention and treatment of diseases and clinical conditions associated with DCTN1.

The function of DCTN1 has been established by previous studies. Cytoplasmic dynein is a microtubule-based biologic motor protein. Holzbaur and Tokito (1996) noted that dyneins were initially discovered as enzymes that couple ATP hydrolysis to provide a force for cellular motility in eukaryotic cilia and flagella. A distinct cytoplasmic form of dynein (OMIM Ref. No. 600112) was subsequently characterized and thought to be responsible for the intracellular retrograde motility of vesicles and organelles along microtubules (Holzbaur and Vallee, 1994). A large macromolecular complex, dynactin, is required for the cytoplasmic dynein-driven movement of organelles along microtubules. Dynactin is composed of 10 distinct polypeptides of 150, 135, 62, 50, 45, 42, 37, 32, 27, and 24 kD, with a combined mass of 10 million daltons. The largest polypeptide of the dynactin complex, p150(Glued), binds directly to microtubules and to cytoplasmic dynein. The binding of dynactin to dynein is critical for neuronal function, as antibodies that specifically disrupt this binding block vesicle motility along microtubules in extruded squid axoplasm. Holzbaur and Tokito (1996) stated that the dynein-dynactin interaction is probably a key component of the mechanism of axonal transport of vesicles and organelles. Further evidence for a critical role for dynactin in vivo comes from the analysis of mutations in the homologous gene in Drosophila. Mutant alleles of the 'glued' gene induced disruption of the neurons of the optic lobe and compound eye in heterozygotes; null mutations are lethal.

Full details of the abovementioned studies are described in the following publications, the disclosure of which are hereby incorporated by reference:

Holzbaur, E. L. F.; Tokito, M. K.: Localization of the DCTN1 gene encoding p150(Glued) to human chromosome 2p13 by fluorescence in situ hybridization. Genomics 31:398-399, 1996; and Holzbaur, E. L. F.; Vallee, R. B.: Dyneins: molecular structure and cellular function. Ann. Rev. Cell Biol. 10:339-372, 1994.

Further studies establishing the function and utilities of DCTN1 are found in John Hopkins OMIM database record ID 601143, and in cited publications listed in Table 5, which are hereby incorporated by reference. DEC1 (Accession NP_059114.1) is another GAM47 target gene, herein designated TARGET GENE. DEC1 BINDING SITE is a target binding site found in the 5' untranslated region of mRNA encoded by DEC1, corresponding to a target binding site such as BINDING SITE I, BINDING SITE II or BINDING SITE III of FIG. 8. Table 4 illustrates the complementarity of the nucleotide sequences of DEC1 BINDING SITE, designated SEQ ID:927, to the nucleotide sequence of GAM47 RNA, herein designated GAM RNA, also designated SEQ ID:269.

Another function of GAM47 is therefore inhibition of DEC1 (Accession NP_059114.1), a gene which acts as a tumor suppressor associated with esophageal cancer. and therefore may be associated with Esophageal cancer. Accordingly, utilities of GAM47 include diagnosis, prevention and treatment of Esophageal cancer, and of other diseases and clinical conditions associated with DEC1.

The function of DEC1 has been established by previous studies. Loss of heterozygosity (LOH) is often shown at 9q31 in esophageal squamous cell carcinomas (OMIM Ref. No. 133239) as well as in squamous cell carcinomas of developmentally related tissues such as bladder (OMIM Ref. No. 109800), lung (OMIM Ref. No. 211980), and head and neck. Miura et al. (1996) delineated a region commonly deleted in esophageal squamous cell carcinomas to a 200-kb segment at 9q32. Nishiwaki et al. (2000) sequenced overlapping clones in this commonly deleted region and identified a possible candidate gene, which they named 'deleted in esophageal cancer-1' (DEC1). The DEC1 gene encodes a deduced 70-amino acid protein. Northern blot analysis detected a 1.4-kb DEC1 transcript in all tissues tested, with highest expression in prostate and testis. DEC1 expression was lower than normal and often absent in more than half of the esophageal carcinomas examined. Furthermore, DEC1 cDNA was able to exert growth suppressive activity in vitro. Although expression was reduced, no genetic alteration was detected in the DEC1 gene in any of the cancers examined.

Full details of the abovementioned studies are described in the following publications, the disclosure of which are hereby incorporated by reference:

Miura, K.; Suzuki, K.; Tokino, T.; Isomura, M.; Inazawa, J.; Matsuno, S.; Nakamura, Y.: Detailed deletion mapping in squamous cell carcinomas of the esophagus narrows a region containing a putative tumor suppressor gene to about 200 kilobases on distal chromosome 9q. Cancer Res. 56:1629-1634, 1996. ; and Nishiwaki, T.; Daigo, Y.; Kawasoe, T.; Nakamura, Y.: Isolation and mutational analysis of a novel human cDNA, DEC1 (deleted in esophageal cancer 1), derived from the tumor suppressor 1.

Further studies establishing the function and utilities of DEC1 are found in John Hopkins OMIM database record ID 604767, and in cited publications listed in Table 5, which are hereby incorporated by reference. Defensin, beta 123 (DEFB123, Accession NP_697019.1) is another GAM47 target gene, herein designated TARGET GENE. DEFB123 BINDING SITE is a target binding site found in the 5' untranslated region of mRNA encoded by DEFB123, corresponding to a target binding site such as BINDING SITE I, BINDING SITE II or BINDING SITE III of FIG. 8. Table 4 illustrates the complementarity of the nucleotide sequences of DEFB123 BINDING SITE, designated SEQ ID:13953, to the nucleotide sequence of GAM47 RNA, herein designated GAM RNA, also designated SEQ ID:269.

Another function of GAM47 is therefore inhibition of Defensin, beta 123 (DEFB123, Accession NP_697019.1). Accordingly, utilities of GAM47 include diagnosis, prevention and treatment of diseases and clinical conditions associated with DEFB123.

Digeorge syndrome critical region gene 7 (DGCR7, Accession XP_295022.1) is another GAM47 target gene, herein designated TARGET GENE. DGCR7 BINDING SITE is a target binding site found in the 5' untranslated region of mRNA encoded by DGCR7, corresponding to a target binding site such as BINDING SITE I, BINDING SITE II or BINDING SITE III of FIG. 8. Table 4 illustrates the complementarity of the nucleotide sequences of DGCR7 BINDING SITE, designated SEQ ID:5400, to the nucleotide sequence of GAM47 RNA, herein designated GAM RNA, also designated SEQ ID:269.

Another function of GAM47 is therefore inhibition of Digeorge syndrome critical region gene 7 (DGCR7, Accession XP_295022.1) . Accordingly, utilities of GAM47 include diagnosis, prevention and treatment of diseases and clinical conditions associated with DGCR7.

DJ473B4 (Accession NP_062456.1) is another GAM47 target gene, herein designated TARGET GENE. DJ473B4 BINDING SITE is a target binding site found in the 3' untranslated region of mRNA encoded by DJ473B4, corresponding to a target binding site such as BINDING SITE I, BINDING SITE II or BINDING SITE III of FIG. 8. Table 4 illustrates the complementarity of the nucleotide sequences of DJ473B4 BINDING SITE, designated SEQ ID:7830, to the nucleotide sequence of GAM47 RNA, herein designated GAM RNA, also designated SEQ ID:269.

Another function of GAM47 is therefore inhibition of DJ473B4 (Accession NP_062456.1). Accordingly, utilities of GAM47 include diagnosis, prevention and treatment of diseases and clinical conditions associated with DJ473B4.

DKFZP434A1315 (Accession NP_115508.2) is another GAM47 target gene, herein designated TARGET GENE. DKFZP434A1315 BINDING SITE is a target binding site found in the 5' untranslated region of mRNA encoded by DKFZP434A1315, corresponding to a target binding site such as BINDING SITE I, BINDING SITE II or BINDING SITE III of FIG. 8. Table 4 illustrates the complementarity of the nucleotide sequences of DKFZP434A1315 BINDING SITE, designated SEQ ID:18103, to the nucleotide sequence of GAM47 RNA, herein designated GAM RNA, also designated SEQ ID:269.

Another function of GAM47 is therefore inhibition of DKFZP434A1315 (Accession NP_115508.2). Accordingly, utilities of GAM47 include diagnosis, prevention and treatment of diseases and clinical conditions associated with DKFZP434A1315.

DKFZP434B172 (Accession XP_046264.6) is another GAM47 target gene, herein designated TARGET GENE. DKFZP434B172 BINDING SITE is a target binding site found in the 3' untranslated region of mRNA encoded by DKFZP434B172, corresponding to a target binding site such as BINDING SITE I, BINDING SITE II or BINDING SITE III of FIG. 8. Table 4 illustrates the complementarity of the nucleotide sequences of DKFZP434B172 BINDING SITE, designated SEQ ID:1801, to the nucleotide sequence of GAM47 RNA, herein designated GAM RNA, also designated SEQ ID:269.

Another function of GAM47 is therefore inhibition of DKFZP434B172 (Accession XP_046264.6). Accordingly, utilities of GAM47 include diagnosis, prevention and treatment of diseases and clinical conditions associated with DKFZP434B172.

DKFZp434F054 (Accession NP_115635.1) is another GAM47 target gene, herein designated TARGET GENE. DKFZp434F054 BINDING SITE is a target binding site found in the 5' untranslated region of mRNA encoded by DKFZp434F054, corresponding to a target binding site such as BINDING SITE I, BINDING SITE II or BINDING SITE III of FIG. 8. Table 4 illustrates the complementarity of the nucleotide sequences of DKFZp434F054 BINDING SITE, designated SEQ ID:9333, to the nucleotide sequence of GAM47 RNA, herein designated GAM RNA, also designated SEQ ID:269.

Another function of GAM47 is therefore inhibition of DKFZp434F054 (Accession NP_115635.1). Accordingly, utilities of GAM47 include diagnosis, prevention and treatment of diseases and clinical conditions associated with DKFZp434F054.

DKFZp434F142 (Accession NP_115630.1) is another GAM47 target gene, herein designated TARGET GENE. DKFZp434F142 BINDING SITE is a target binding site found in the 3' untranslated region of mRNA encoded by DKFZp434F142, corresponding to a target binding site such as BINDING SITE I, BINDING SITE II or BINDING SITE III of FIG. 8. Table 4 illustrates the complementarity of the nucleotide sequences of DKFZp434F142 BINDING SITE, designated SEQ ID:16769, to the nucleotide sequence of GAM47 RNA, herein designated GAM RNA, also designated SEQ ID:269.

Another function of GAM47 is therefore inhibition of DKFZp434F142 (Accession NP_115630.1). Accordingly, utilities of GAM47 include diagnosis, prevention and treatment of diseases and clinical conditions associated with DKFZp434F142.

DKFZP434H132 (Accession NP_056307.1) is another GAM47 target gene, herein designated TARGET GENE. DKFZP434H132 BINDING SITE is a target binding site found in the 3' untranslated region of mRNA encoded by DKFZP434H132, corresponding to a target binding site such as BINDING SITE I, BINDING SITE II or BINDING SITE III of FIG. 8. Table 4 illustrates the complementarity of the nucleotide sequences of DKFZP434H132 BINDING SITE, designated SEQ ID:15842, to the nucleotide sequence of GAM47 RNA, herein designated GAM RNA, also designated SEQ ID:269.

Another function of GAM47 is therefore inhibition of DKFZP434H132 (Accession NP_056307.1). Accordingly, utilities of GAM47 include diagnosis, prevention and treatment of diseases and clinical conditions associated with DKFZP434H132.

DKFZP434O047 (Accession NP_056409.1) is another GAM47 target gene, herein designated TARGET GENE. DKFZP434O047 BINDING SITE is a target binding site found in the 5' untranslated region of mRNA encoded by DKFZP434O047, corresponding to a target binding site such as BINDING SITE I, BINDING SITE II or BINDING SITE III of FIG. 8. Table 4 illustrates the complementarity of the nucleotide sequences of DKFZP434O047 BINDING SITE, designated SEQ ID:7685, to the nucleotide sequence of GAM47 RNA, herein designated GAM RNA, also designated SEQ ID:269.

Another function of GAM47 is therefore inhibition of DKFZP434O047 (Accession NP_056409.1). Accordingly, utilities of GAM47 include diagnosis, prevention and treatment of diseases and clinical conditions associated with DKFZP434O047.

DKFZp451A175 (Accession NP_694967.1) is another GAM47 target gene, herein designated TARGET GENE. DKFZp451A175 BINDING SITE is a target binding site found in the 5' untranslated region of mRNA encoded by DKFZp451A175, corresponding to a target binding site such as BINDING SITE I, BINDING SITE II or BINDING SITE III of FIG. 8. Table 4 illustrates the complementarity of the nucleotide sequences of DKFZp451A175 BINDING SITE, designated SEQ ID:9563, to the nucleotide sequence of GAM47 RNA, herein designated GAM RNA, also designated SEQ ID:269.

Another function of GAM47 is therefore inhibition of DKFZp451A175 (Accession NP_694967.1). Accordingly, utilities of GAM47 include diagnosis, prevention and treatment of diseases and clinical conditions associated with DKFZp451A175.

DKFZp547I094 (Accession NP_115531.1) is another GAM47 target gene, herein designated TARGET GENE. DKFZp547I094 BINDING SITE is a target binding site found in the 3' untranslated region of mRNA encoded by DKFZp547I094, corresponding to a target binding site such as BINDING SITE I, BINDING SITE II or BINDING SITE III of FIG. 8. Table 4 illustrates the complementarity of the nucleotide sequences of DKFZp547I094 BINDING SITE, designated SEQ ID:18222, to the nucleotide sequence of GAM47 RNA, herein designated GAM RNA, also designated SEQ ID:269.

Another function of GAM47 is therefore inhibition of DKFZp547I094 (Accession NP_115531.1). Accordingly, utilities of GAM47 include diagnosis, prevention and treatment of diseases and clinical conditions associated with DKFZp547I094.

DKFZP564C196 (Accession XP_294974.1) is another GAM47 target gene, herein designated TARGET GENE. DKFZP564C196 BINDING SITE is a target binding site found in the 3' untranslated region of mRNA encoded by DKFZP564C196, corresponding to a target binding site such as BINDING SITE I, BINDING SITE II or BINDING SITE III of FIG. 8. Table 4 illustrates the complementarity of the nucleotide sequences of DKFZP564C196 BINDING SITE, designated SEQ ID:16836, to the nucleotide sequence of GAM47 RNA, herein designated GAM RNA, also designated SEQ ID:269.

Another function of GAM47 is therefore inhibition of DKFZP564C196 (Accession XP_294974.1). Accordingly, utilities of GAM47 include diagnosis, prevention and treatment of diseases and clinical conditions associated with DKFZP564C196.

DKFZP564D172 (Accession NP_114431.2) is another GAM47 target gene, herein designated TARGET GENE. DKFZP564D172 BINDING SITE is a target binding site found in the 3' untranslated region of mRNA encoded by DKFZP564D172, corresponding to a target binding site such as BINDING SITE I, BINDING SITE II or BINDING SITE III of FIG. 8. Table 4 illustrates the complementarity of the nucleotide sequences of DKFZP564D172 BINDING SITE, designated SEQ ID:8181, to the nucleotide sequence of GAM47 RNA, herein designated GAM RNA, also designated SEQ ID:269.

Another function of GAM47 is therefore inhibition of DKFZP564D172 (Accession NP_114431.2). Accordingly, utilities of GAM47 include diagnosis, prevention and treatment of diseases and clinical conditions associated with DKFZP564D172.

DKFZP586B1621 (Accession NP_056348.2) is another GAM47 target gene, herein designated TARGET GENE. DKFZP586B1621 BINDING SITE is a target binding site found in the 3' untranslated region of mRNA encoded by DKFZP586B1621, corresponding to a target binding site such as BINDING SITE I, BINDING SITE II or BINDING SITE III of FIG. 8. Table 4 illustrates the complementarity of the nucleotide sequences of DKFZP586B1621 BINDING SITE, designated SEQ ID:17013, to the nucleotide sequence of GAM47 RNA, herein designated GAM RNA, also designated SEQ ID:269.

Another function of GAM47 is therefore inhibition of DKFZP586B1621 (Accession NP_056348.2). Accordingly, utilities of GAM47 include diagnosis, prevention and treatment of diseases and clinical conditions associated with DKFZP586B1621.

DKFZP586M1523 (Accession NP_056291.1) is another GAM47 target gene, herein designated TARGET GENE. DKFZP586M1523 BINDING SITE is a target binding site found in the 3' untranslated region of mRNA encoded by DKFZP586M1523, corresponding to a target binding site such as BINDING SITE I, BINDING SITE II or BINDING SITE III of FIG. 8. Table 4 illustrates the complementarity of the nucleotide sequences of DKFZP586M1523 BINDING SITE, designated SEQ ID:7358, to the nucleotide sequence of GAM47 RNA, herein designated GAM RNA, also designated SEQ ID:269.

Another function of GAM47 is therefore inhibition of DKFZP586M1523 (Accession NP_056291.1). Accordingly, utilities of GAM47 include diagnosis, prevention and treatment of diseases and clinical conditions associated with DKFZP586M1523.

DKFZP761F241 (Accession NP_113643.1) is another GAM47 target gene, herein designated TARGET GENE. DKFZP761F241 BINDING SITE is a target binding site found in the 3' untranslated region of mRNA encoded by DKFZP761F241, corresponding to a target binding site such as BINDING SITE I, BINDING SITE II or BINDING SITE III of FIG. 8. Table 4 illustrates the complementarity of the nucleotide sequences of DKFZP761F241 BINDING SITE, designated SEQ ID:4962, to the nucleotide sequence of GAM47 RNA, herein designated GAM RNA, also designated SEQ ID:269.

Another function of GAM47 is therefore inhibition of DKFZP761F241 (Accession NP_113643.1). Accordingly, utilities of GAM47 include diagnosis, prevention and treatment of diseases and clinical conditions associated with DKFZP761F241.

DKFZp761G0122 (Accession NP_689874.1) is another GAM47 target gene, herein designated TARGET GENE. DKFZp761G0122 BINDING SITE1 through DKFZp761G0122 BINDING SITE3 are target binding sites found in untranslated regions of mRNA encoded by DKFZp761G0122, corresponding to target binding sites such as BINDING SITE I, BINDING SITE II or BINDING SITE III of FIG. 8. Table 4 illustrates the complementarity of the nucleotide sequences of DKFZp761G0122 BINDING SITE1 through DKFZp761G0122 BINDING SITE3, designated SEQ ID:8022, SEQ ID:6944 and SEQ ID:10800 respectively, to the nucleotide sequence of GAM47 RNA, herein designated GAM RNA, also designated SEQ ID:269.

Another function of GAM47 is therefore inhibition of DKFZp761G0122 (Accession NP_689874.1). Accordingly, utilities of GAM47 include diagnosis, prevention and treatment of diseases and clinical conditions associated with DKFZp761G0122.

DKFZP761M1511 (Accession XP_295135.1) is another GAM47 target gene, herein designated TARGET GENE. DKFZP761M1511 BINDING SITE is a target binding site found in the 3' untranslated region of mRNA encoded by DKFZP761M1511, corresponding to a target binding site such as BINDING SITE I, BINDING SITE II or BINDING SITE III of FIG. 8. Table 4 illustrates the complementarity of the nucleotide sequences of DKFZP761M1511 BINDING SITE, designated SEQ ID:20088, to the nucleotide sequence of GAM47 RNA, herein designated GAM RNA, also designated SEQ ID:269.

Another function of GAM47 is therefore inhibition of DKFZP761M1511 (Accession XP_295135.1). Accordingly, utilities of GAM47 include diagnosis, prevention and treatment of diseases and clinical conditions associated with DKFZP761M1511.

Dickkopf homolog 2 (xenopus laevis) (DKK2, Accession NP_055236.1) is another GAM47 target gene, herein designated TARGET GENE. DKK2 BINDING SITE is a target binding site found in the 3' untranslated region of mRNA encoded by DKK2, corresponding to a target binding site such as BINDING SITE I, BINDING SITE II or BINDING SITE III of FIG. 8. Table 4 illustrates the complementarity of the nucleotide sequences of DKK2 BINDING SITE, designated SEQ ID:17469, to the nucleotide sequence of GAM47 RNA, herein designated GAM RNA, also designated SEQ ID:269.

Another function of GAM47 is therefore inhibition of Dickkopf homolog 2 (xenopus laevis) (DKK2, Accession NP_055236.1). Accordingly, utilities of GAM47 include diagnosis, prevention and treatment of diseases and clinical conditions associated with DKK2.

Dmrt-like family b with proline-rich c-terminal, 1 (DMRTB1, Accession NP_149056.1) is another GAM47 target gene, herein designated TARGET GENE. DMRTB1 BINDING SITE is a target binding site found in the 3' untranslated region of mRNA encoded by DMRTB1, corresponding to a target binding site such as BINDING SITE I, BINDING SITE II or BINDING SITE III of FIG. 8. Table 4 illustrates the complementarity of the nucleotide sequences of DMRTB1 BINDING SITE, designated SEQ ID:18599, to the nucleotide sequence of GAM47 RNA, herein designated GAM RNA, also designated SEQ ID:269.

Another function of GAM47 is therefore inhibition of Dmrt-like family b with proline-rich c-terminal, 1 (DMRTB1, Accession NP_149056.1). Accordingly, utilities of GAM47 include diagnosis, prevention and treatment of diseases and clinical conditions associated with DMRTB1.

Dna (cytosine-5-)-methyltransferase 3 alpha (DNMT3A, Accession NP_783329.1) is another GAM47 target gene, herein designated TARGET GENE. DNMT3A BINDING SITE is a target binding site found in the 3' untranslated region of multiple transcripts of mRNA encoded by DNMT3A, corresponding to a target binding site such as BINDING SITE I, BINDING SITE II or BINDING SITE III of FIG. 8. Table 4 illustrates the complementarity of the nucleotide sequences of DNMT3A BINDING SITE, designated SEQ ID:18807, to the nucleotide sequence of GAM47 RNA, herein designated GAM RNA, also designated SEQ ID:269.

Another function of GAM47 is therefore inhibition of Dna (cytosine-5-)-methyltransferase 3 alpha (DNMT3A, Accession NP_783329.1), a gene which intervenes in de novo methylation of DNA. Accordingly, utilities of GAM47 include diagnosis, prevention and treatment of diseases and clinical conditions associated with DNMT3A.

The function of DNMT3A has been established by previous studies. De novo methylation of genomic DNA is a developmentally regulated process that appears to play a pivotal role in regulation of genomic imprinting and X-chromosome inactivation in mammals. Aberrant de novo methylation of growth regulatory genes is associated with tumorigenesis in humans (Baylin et al., 1998). However, Lei et al. (1996) showed that de novo methylation persists in embryonic stem (ES) cells lacking Dnmt1 (OMIM Ref. No. 126375), which encodes the constitutive DNA methyltransferase 1, indicating the existence of independently encoded de novo methyltransferases. By a TBLASTN search of the dbEST database using full-length bacterial type II cytosine-5 methyltransferase sequences as queries, followed by isolation and sequencing of overlapping cDNA clones, Okano et al. (1998) identified 2 homologous genes in both human and mouse that contain the highly conserved cytosine-5 methyltransferase motifs. The mouse genes, termed Dnmt3a and Dnmt3b (OMIM Ref. No. 602900), show little sequence similarity to mouse Dnmt1 and Dnmt2 (OMIM Ref. No. 602478), and masc1 from Ascobolus. The Dnmt3a cDNA is 4,192 bp in length, encoding a protein of 908 amino acids. The human DNMT3A and DNMT3B cDNA are highly homologous to the mouse genes. Dnmt3a and Dnmt3b transcripts are abundantly expressed in undifferentiated embryonic stem cells. Okano et al. (1998) performed other experiments suggesting that Dnmt3a and Dnmt3b encode the long-sought de novo DNA methyltransferases. By FISH, Xie et al. (1999) mapped the DNMT3A gene to 2p23. Robertson et al. (1999) also mapped the DNMT3A gene to 2p23 using FISH Animal model experiments lend further support to the function of DNMT3A. Okano et al. (1999) generated mice with targeted disruption of the Dnmt3a and Dnmt3b genes. Inactivation of both genes blocked de novo methylation in embryonic stem cells and early embryos but had no effect on maintenance of imprinted methylation patterns. Dnmt3a -/- mice developed to term and appeared to be normal at birth. However, most homozygous mutant mice became runted and died at about 4 weeks of age. In contrast, no viable Dnmt3b -/- mice were recovered at birth. Dissection of embryos at different stages of development revealed that Dnmt3b -/- embryos had multiple developmental defects, including growth impairment and rostral neural tube defects with variable severity at later stages of development, though most of them appeared to develop normally before E9.5. Dnmt3a and Dnmt3b also exhibited nonoverlapping functions in development, with Dnmt3b specifically required for methylation of centromeric minor satellite repeats. These results indicated that both Dnmt3a and Dnmt3b are required for genomewide de novo methylation and are essential for mammalian development.

It is appreciated that the abovementioned animal model for DNMT3A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okano, M.; Xie, S.; Li, E.: Cloning and characterization of a family of novel mammalian DNA (cytosine-5) methyltransferases. (Letter) Nature Genet. 19:219-220, 1998; and Robertson, K. D.; Uzvolgy, E.; Liang, G.; Talmadge, C.; Sumegi, J.; Gonzales, F. A.; Jones, P. A.: The human DNA methyltransferases (DNMTs) 1, 3a and 3b: coordinate mRNA expression in.

Further studies establishing the function and utilities of DNMT3A are found in John Hopkins OMIM database record ID 602769, and in cited publications listed in Table 5, which are hereby incorporated by reference. Dihydropyrimidinase-like 2 (DPYSL2, Accession NP_001377.1) is another GAM47 target gene, herein designated TARGET GENE. DPYSL2 BINDING SITE is a target binding site found in the 3' untranslated region of mRNA encoded by DPYSL2, corresponding to a target binding site such as BINDING SITE I, BINDING SITE II or BINDING SITE III of FIG. 8. Table 4 illustrates the complementarity of the nucleotide sequences of DPYSL2 BINDING SITE, designated SEQ ID:9773, to the nucleotide sequence of GAM47 RNA, herein designated GAM RNA, also designated SEQ ID:269.

Another function of GAM47 is therefore inhibition of Dihydropyrimidinase-like 2 (DPYSL2, Accession NP_001377.1), a gene which is a member of the dihydropyrimidinase family. Accordingly, utilities of GAM47 include diagnosis, prevention and treatment of diseases and clinical conditions associated with DPYSL2.

The function of DPYSL2 has been established by previous studies. Hamajima et al. (1996) isolated a human cDNA encoding dihydropyrimidinase-like 2 (OMIM Ref. No. DPYSL2), called DRP2 by them, from a fetal brain cDNA library (see OMIM Ref. No. 222748). The DPYSL2 protein has 572 amino acids. Northern blot analysis detected a 4.9-kb DPYSL2 transcript in all tissues examined except liver. Hamajima et al. (1996) noted that 3 ESTs mapped to 8p21 by Koyama et al. (1995) correspond to a portion of the coding region of DPYSL2.

Full details of the abovementioned studies are described in the following publications, the disclosure of which are hereby incorporated by reference:

Hamajima, N.; Matsuda, K.; Sakata, S.; Tamaki, N.; Sasaki, M.; Nonaka, M.: A novel gene family defined by human dihydropyrimidinase and three related proteins with differential tissue distribution. Gene 180:157-163, 1996; and Koyama, K.; Sudo, K.; Nakamura, Y.: Isolation of 115 human chromosome 8-specific expressed-sequence tags by exon amplification. Genomics 26:245-253, 1995.

Further studies establishing the function and utilities of DPYSL2 are found in John Hopkins OMIM database record ID 602463, and in cited publications listed in Table 5, which are hereby incorporated by reference. Developmentally regulated gtp binding protein 2 (DRG2, Accession NP_001379.1) is another GAM47 target gene, herein designated TARGET GENE. DRG2 BINDING SITE is a target binding site found in the 3' untranslated region of mRNA encoded by DRG2, corresponding to a target binding site such as BINDING SITE I, BINDING SITE II or BINDING SITE III of FIG. 8. Table 4 illustrates the complementarity of the nucleotide sequences of DRG2 BINDING SITE, designated SEQ ID:8205, to the nucleotide sequence of GAM47 RNA, herein designated GAM RNA, also designated SEQ ID:269.

Another function of GAM47 is therefore inhibition of Developmentally regulated gtp binding protein 2 (DRG2, Accession NP_001379.1), a gene which may play a role in cell proliferation, differentiation and death. Accordingly, utilities of GAM47 include diagnosis, prevention and treatment of diseases and clinical conditions associated with DRG2.

The function of DRG2 has been established by previous studies. Using a subtractive hybridization strategy, Schenker et al. (1994) identified embryonic lung fibroblast cDNAs whose expression was selectively repressed in SV40- transformed cells. One cDNA encoded a predicted 364-amino acid protein that was designated DRG2. DRG2 contains the 5 sequence motifs that are conserved in all GTP-binding proteins. Northern blot analysis detected DRG2 expression as a major 2-kb and a minor 1.5-kb transcript in various tissues. The shorter mRNA appeared to result from use of an alternative polyadenylation site. By fluorescence in situ hybridization, Schenker and Trueb (1997) mapped the DRG2 gene to 17p13-p12. Vlangos et al. (2000) mapped the DRG2 gene to 17p11.2 within the Smith-Magenis syndrome critical region by somatic cell hybrid analysis.

Full details of the abovementioned studies are described in the following publications, the disclosure of which are hereby incorporated by reference:

Schenker, T.; Lach, C.; Kessler, B.; Calderara, S.; Trueb, B.: A novel GTP-binding protein which is selectively repressed in SV40 transformed fibroblasts. J. Biol. Chem. 269:25447-25453, 1994; and Vlangos, C. N.; Das, P.; Patel, P. I.; Elsea, S. H.: Assignment of developmentally regulated GTP-binding protein (DRG2) to human chromosome band 17p11.2 with somatic cell hybrids and 1.

Further studies establishing the function and utilities of DRG2 are found in John Hopkins OMIM database record ID 602986, and in cited publications listed in Table 5, which are hereby incorporated by reference. Deltex homolog 2 (drosophila) (DTX2, Accession NP_065943.1) is another GAM47 target gene, herein designated TARGET GENE. DTX2 BINDING SITE is a target binding site found in the 3' untranslated region of mRNA encoded by DTX2, corresponding to a target binding site such as BINDING SITE I, BINDING SITE II or BINDING SITE III of FIG. 8. Table 4 illustrates the complementarity of the nucleotide sequences of DTX2 BINDING SITE, designated SEQ ID:15714, to the nucleotide sequence of GAM47 RNA, herein designated GAM RNA, also designated SEQ ID:269.

Another function of GAM47 is therefore inhibition of Deltex homolog 2 (drosophila) (DTX2, Accession NP_065943.1). Accordingly, utilities of GAM47 include diagnosis, prevention and treatment of diseases and clinical conditions associated with DTX2.

Deoxythymidylate kinase (thymidylate kinase) (DTYMK, Accession NP_036277.1) is another GAM47 target gene, herein designated TARGET GENE. DTYMK BINDING SITE is a target binding site found in the 3' untranslated region of mRNA encoded by DTYMK, corresponding to a target binding site such as BINDING SITE I, BINDING SITE II or BINDING SITE III of FIG. 8. Table 4 illustrates the complementarity of the nucleotide sequences of DTYMK BINDING SITE, designated SEQ ID:3722, to the nucleotide sequence of GAM47 RNA, herein designated GAM RNA, also designated SEQ ID:269.

Another function of GAM47 is therefore inhibition of Deoxythymidylate kinase (thymidylate kinase) (DTYMK, Accession NP_036277.1). Accordingly, utilities of GAM47 include diagnosis, prevention and treatment of diseases and clinical conditions associated with DTYMK.

DULLARD (Accession NP_056158.2) is another GAM47 target gene, herein designated TARGET GENE. DULLARD BINDING SITE is a target binding site found in the 5' untranslated region of mRNA encoded by DULLARD, corresponding to a target binding site such as BINDING SITE I, BINDING SITE II or BINDING SITE III of FIG. 8. Table 4 illustrates the complementarity of the nucleotide sequences of DULLARD BINDING SITE, designated SEQ ID:11968, to the nucleotide sequence of GAM47 RNA, herein designated GAM RNA, also designated SEQ ID:269.

Another function of GAM47 is therefore inhibition of DULLARD (Accession NP_056158.2). Accordingly, utilities of GAM47 include diagnosis, prevention and treatment of diseases and clinical conditions associated with DULLARD.

Dishevelled, dsh homolog 3 (drosophila) (DVL3, Accession NP_004414.2) is another GAM47 target gene, herein designated TARGET GENE. DVL3 BINDING SITE is a target binding site found in the 3' untranslated region of mRNA encoded by DVL3, corresponding to a target binding site such as BINDING SITE I, BINDING SITE II or BINDING SITE III of FIG. 8. Table 4 illustrates the complementarity of the nucleotide sequences of DVL3 BINDING SITE, designated SEQ ID:18567, to the nucleotide sequence of GAM47 RNA, herein designated GAM RNA, also designated SEQ ID:269.

Another function of GAM47 is therefore inhibition of Dishevelled, dsh homolog 3 (drosophila) (DVL3, Accession NP_004414.2), a gene which regulates cell proliferation. Accordingly, utilities of GAM47 include diagnosis, prevention and treatment of diseases and clinical conditions associated with DVL3.

The function of DVL3 has been established by previous studies. The Drosophila dishevelled gene (dsh) encodes a cytoplasmic phosphoprotein (Klingensmith et al., 1994) that regulates cell proliferation, acting as a transducer molecule for developmental processes, including segmentation and neuroblast specification. Pizzuti et al. (1996) noted that dsh is required for the function of the wingless gene product wg, a segment polarity gene homologous to the mammalian protooncogene WNT1 (OMIM Ref. No. 164820). Pizzuti et al. (1996) reported the isolation and chromosomal mapping of 2 human dsh homologs, designated DVL1 (OMIM Ref. No. 601365) and DVL3 by them. The human dsh homologs were isolated from a fetal brain cDNA library. DVL3 encodes a predicted 716-amino acid polypeptide that shows 74% nucleotide homology with human DVL1 and 71% homology with the mouse Dvl1 gene. DVL1 and DVL3 share 64% amino acid identity. Pizzuti et al. (1996) reported that homology is particularly high in the N-terminal region and that there is more divergence in the C-terminal regions. PCR carried out using DNA from rodent human somatic cell hybrids and DVL3 specific primers led to the assignment of DVL3 to human chromosome 3. Pizzuti et al. (1996) regionally assigned DVL3 to band 3q27 using fluorescence in situ hybridization. Hybridization of poly(A) mRNA with the DVL3 cDNA revealed a 2.9-kb transcript with abundant expression in skeletal muscle, pancreas and heart. They also detected 5.9-kb and 5.0-kb transcripts in skeletal muscle, adult liver, adult heart, pancreas, and placenta. The 5.9-kb form was abundant in fetal tissues but the 5.0-kb form was absent from these tissues. Pizzuti et al. (1996) noted that Charcot-Marie- tooth type 2B (OMIM Ref. No. 600882) maps to chromosome 3q. Bui et al. (1997) also isolated human DVL3, which shares 98% amino acid identity with mouse Dvl3 and 49% with Drosophila dsh. The authors confirmed the chromosomal localization at 3p27. Semenov and Snyder (1997) isolated 3 human genes encoding proteins homologous to Drosophila dsh. The cDNA sequence of DVL3 reported by Semenov and Snyder (1997) differs from the previously reported sequences deposited in GenBank. Bui et al. (1997) detected expression of DVL3 mRNA in B cells, breast, kidney, bladder, endometrium, and 2 primary endometrial cultures. It was detected equally in normal human breast tissues and tumors and in colorectal samples of normal tissues, polyps, and tumors.

Full details of the abovementioned studies are described in the following publications, the disclosure of which are hereby incorporated by reference:

Pizzuti, A.; Amati, F.; Calabrese, G.; Mari, A.; Colosimo, A; Silani, V.; Giardino, L.; Ratti, A.; Penso, D.; Calza, L.; Palka, G.; Scarlato, G.; Novelli, G.; Dallapicolla, B.: cDNA characterization and chromosomal mapping of two human homologs of the Drosophila dishevelled polarity gene. Hum. Molec. Genet. 5:953-958, 1996; and Semenov, M. V.; Snyder, M.: Human dishevelled genes constitute a DHR-containing multigene family. Genomics 42:302-310, 1997.

Further studies establishing the function and utilities of DVL3 are found in John Hopkins OMIM database record ID 601368, and in cited publications listed in Table 5, which are hereby incorporated by reference. Ephrin-b2 (EFNB2, Accession NP_004084.1) is another GAM47 target gene, herein designated TARGET GENE. EFNB2 BINDING SITE is a target binding site found in the 3' untranslated region of mRNA encoded by EFNB2, corresponding to a target binding site such as BINDING SITE I, BINDING SITE II or BINDING SITE III of FIG. 8. Table 4 illustrates the complementarity of the nucleotide sequences of EFNB2 BINDING SITE, designated SEQ ID:8500, to the nucleotide sequence of GAM47 RNA, herein designated GAM RNA, also designated SEQ ID:269.

Another function of GAM47 is therefore inhibition of Ephrin-b2 (EFNB2, Accession NP_004084.1). Accordingly, utilities of GAM47 include diagnosis, prevention and treatment of diseases and clinical conditions associated with EFNB2.

Ets homologous factor (EHF, Accession NP_758433.1) is another GAM47 target gene, herein designated TARGET GENE. EHF BINDING SITE is a target binding site found in the 3' untranslated region of multiple transcripts of mRNA encoded by EHF, corresponding to a target binding site such as BINDING SITE I, BINDING SITE II or BINDING SITE III of FIG. 8. Table 4 illustrates the complementarity of the nucleotide sequences of EHF BINDING SITE, designated SEQ ID:7855, to the nucleotide sequence of GAM47 RNA, herein designated GAM RNA, also designated SEQ ID:269.

Another function of GAM47 is therefore inhibition of Ets homologous factor (EHF, Accession NP_758433.1), a gene which is Member of the ESE subfamily of Ets transcription factors. Accordingly, utilities of GAM47 include diagnosis, prevention and treatment of diseases and clinical conditions associated with EHF.

The function of EHF has been established by previous studies. By searching an EST database, Kas et al. (2000) identified an EST with sequence similarity to the ETS domain of human ESE1 (ELF3; 602191). They obtained a full-length cDNA encoding EHF, which they called ESE3, by using 5-prime RACE on human prostate cDNA. RT-PCR analysis identified 2 alternatively spliced forms of ESE3, ESE3a and ESE3b. Sequence analysis predicted that ESE3a encodes a 277-amino acid protein with a molecular mass of 32.3 kD, while ESE3b encodes a 300-amino acid protein with a molecular mass of 34.9 kD. The C-terminal ETS domain of ESE3 is 84% and 65% identical to the ETS domains of ESE1 and ESE2 (ELF5; 605169), respectively. Northern blot analysis detected a 5.9-kb ESE3 transcript in pancreas and prostate, with lower levels detected in kidney and colon. Dot blot analysis detected high levels of ESE3 expression in salivary gland, prostate, and trachea, with lower levels detected in colon, mammary gland, pancreas, lung, stomach, appendix, fetal kidney, and fetal lung. Using RT-PCR on primary and tumor-derived cell lines, the authors detected expression of ESE3 in tumor cells of epithelial origin. Gel-shift experiments showed binding of ESE3 to 3 high- affinity binding sites in the MET (OMIM Ref. No. 164860) promoter. Cotransfection of ESE3 expression vectors with a MET promoter-luciferase reporter construct demonstrated that both ESE3a and ESE3b act as transcriptional activators on this promoter. Kleinbaum et al. (1999) mapped the EHF gene to 11p12 by somatic cell hybrid analysis and FISH.

Full details of the abovementioned studies are described in the following publications, the disclosure of which are hereby incorporated by reference:

Kas, K.; Finger, E.; Grall, F.; Gu, X.; Akbarali, Y.; Boltax, J.; Weiss, A.; Oettgen, P.; Kapeller, R.; Libermann, T. A.: ESE-3, a novel member of an epithelium- specific Ets transcription factor subfamily, demonstrates different target gene specificity from ESE-1. J. Biol. Chem. 275:2986-2998, 2000; and Kleinbaum, L. A.; Duggan, C.; Ferreira, E.; Coffey, G. P.; Buttice, G.; Burton, F. H.: Human chromosomal localization, tissue/tumor expression, and regulatory function of the ets fami.

Further studies establishing the function and utilities of EHF are found in John Hopkins OMIM database record ID 605439, and in cited publications listed in Table 5, which are hereby incorporated by reference. Ets homologous factor (EHF, Accession NP_036285.2) is another GAM47 target gene, herein designated TARGET GENE. EHF BINDING SITE is a target binding site found in the 3' untranslated region of multiple transcripts of mRNA encoded by EHF, corresponding to a target binding site such as BINDING SITE I, BINDING SITE II or BINDING SITE III of FIG. 8. Table 4 illustrates the complementarity of the nucleotide sequences of EHF BINDING SITE, designated SEQ ID:7855, to the nucleotide sequence of GAM47 RNA, herein designated GAM RNA, also designated SEQ ID:269.

Another function of GAM47 is therefore inhibition of Ets homologous factor (EHF, Accession NP_036285.2), a gene which is Member of the ESE subfamily of Ets transcription factors. Accordingly, utilities of GAM47 include diagnosis, prevention and treatment of diseases and clinical conditions associated with EHF.

The function of EHF has been established by previous studies. By searching an EST database, Kas et al. (2000) identified an EST with sequence similarity to the ETS domain of human ESE1 (ELF3; 602191). They obtained a full-length cDNA encoding EHF, which they called ESE3, by using 5-prime RACE on human prostate cDNA. RT-PCR analysis identified 2 alternatively spliced forms of ESE3, ESE3a and ESE3b. Sequence analysis predicted that ESE3a encodes a 277-amino acid protein with a molecular mass of 32.3 kD, while ESE3b encodes a 300-amino acid protein with a molecular mass of 34.9 kD. The C-terminal ETS domain of ESE3 is 84% and 65% identical to the ETS domains of ESE1 and ESE2 (ELF5; 605169), respectively. Northern blot analysis detected a 5.9-kb ESE3 transcript in pancreas and prostate, with lower levels detected in kidney and colon. Dot blot analysis detected high levels of ESE3 expression in salivary gland, prostate, and trachea, with lower levels detected in colon, mammary gland, pancreas, lung, stomach, appendix, fetal kidney, and fetal lung. Using RT-PCR on primary and tumor-derived cell lines, the authors detected expression of ESE3 in tumor cells of epithelial origin. Gel-shift experiments showed binding of ESE3 to 3 high- affinity binding sites in the MET (OMIM Ref. No. 164860) promoter. Cotransfection of ESE3 expression vectors with a MET promoter-luciferase reporter construct demonstrated that both ESE3a and ESE3b act as transcriptional activators on this promoter. Kleinbaum et al. (1999) mapped the EHF gene to 11p12 by somatic cell hybrid analysis and FISH.

Full details of the abovementioned studies are described in the following publications, the disclosure of which are hereby incorporated by reference:

Kas, K.; Finger, E.; Grall, F.; Gu, X.; Akbarali, Y.; Boltax, J.; Weiss, A.; Oettgen, P.; Kapeller, R.; Libermann, T. A.: ESE-3, a novel member of an epithelium- specific Ets transcription factor subfamily, demonstrates different target gene specificity from ESE-1. J. Biol. Chem. 275:2986-2998, 2000; and Kleinbaum, L. A.; Duggan, C.; Ferreira, E.; Coffey, G. P.; Buttice, G.; Burton, F. H.: Human chromosomal localization, tissue/tumor expression, and regulatory function of the ets fami.

Further studies establishing the function and utilities of EHF are found in John Hopkins OMIM database record ID 605439, and in cited publications listed in Table 5, which are hereby incorporated by reference. Enoyl-coenzyme a, hydratase/3-hydroxyacyl coenzyme a dehydrogenase (EHHADH, Accession NP_001957.1) is another GAM47 target gene, herein designated TARGET GENE. EHHADH BINDING SITE is a target binding site found in the 3' untranslated region of mRNA encoded by EHHADH, corresponding to a target binding site such as BINDING SITE I, BINDING SITE II or BINDING SITE III of FIG. 8. Table 4 illustrates the complementarity of the nucleotide sequences of EHHADH BINDING SITE, designated SEQ ID:11906, to the nucleotide sequence of GAM47 RNA, herein designated GAM RNA, also designated SEQ ID:269.

Another function of GAM47 is therefore inhibition of Enoyl-coenzyme a, hydratase/3-hydroxyacyl coenzyme a dehydrogenase (EHHADH, Accession NP_001957.1), a gene which functions in the peroxisomal beta-oxidation pathway and therefore may be associated with Peroxisomal disorders. Accordingly, utilities of GAM47 include diagnosis, prevention and treatment of Peroxisomal disorders, and of other diseases and clinical conditions associated with EHHADH.

The function of EHHADH has been established by previous studies. Hoefler et al. (1994) reported the full-length cDNA sequence of the enoyl-CoA-hydratase:3-hydroxyacyl-CoA dehydrogenase bifunctional enzyme. The cDNA sequence spans 3,779 nucleotides with an open reading frame of 2,169 nucleotides.

Animal model experiments lend further support to the function of EHHADH. Qi et al. (1999) generated Lpb null mice. Mutant mice were viable and fertile and exhibited no detectable gross phenotypic defects. The only defect was a blunting of peroxisome proliferative response upon challenge with a peroxisome proliferator. The absence of appreciable changes in lipid metabolism indicated that enoyl-CoAs, generated in the classical system in Lpb null mice, were diverted to the D-hydroxy-specific system for metabolism by Dpb (OMIM Ref. No. 601860).

It is appreciated that the abovementioned animal model for EHHADH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hoefler, G.; Forstner, M.; McGuinness, M. C.; Hulla, W.; Hiden, M.; Krisper, P.; Kenner, L.; Ried, T.; Lengauer, C.; Zechner, R.; mOser, H. W.; Chen, G. L.: cDNA cloning of the human peroxisomal enoyl-CoA hydratase:3-hydroxyacyl-CoA dehydrogenase bifunctional enzyme and localization to chromosome 3q26.3-3q28: a free left Alu arm is inserted in the 3-prime noncoding region. Genomics 19:60-67, 1994; and Qi, C.; Zhu, Y.; Pan, J.; Usuda, N.; Maeda, N.; Yeldandi, A. V.; Rao, M. S.; Hashimoto, T.; Reddy, J. K.: Absence of spontaneous peroxisome proliferation in enoyl- CoA hydratase/L-3-hyd.

Further studies establishing the function and utilities of EHHADH are found in John Hopkins OMIM database record ID 607037, and in cited publications listed in Table 5, which are hereby incorporated by reference. EI24 (Accession NP_004870.2) is another GAM47 target gene, herein designated TARGET GENE. EI24 BINDING SITE is a target binding site found in the 3' untranslated region of mRNA encoded by EI24, corresponding to a target binding site such as BINDING SITE I, BINDING SITE II or BINDING SITE III of FIG. 8. Table 4 illustrates the complementarity of the nucleotide sequences of EI24 BINDING SITE, designated SEQ ID:3180, to the nucleotide sequence of GAM47 RNA, herein designated GAM RNA, also designated SEQ ID:269.

Another function of GAM47 is therefore inhibition of EI24 (Accession NP_004870.2). Accordingly, utilities of GAM47 include diagnosis, prevention and treatment of diseases and clinical conditions associated with EI24.

Elongation of very long chain fatty acids (fen1/elo2, sur4/elo3, yeast)-like 2 (ELOVL2, Accession NP_060240.1) is another GAM47 target gene, herein designated TARGET GENE. ELOVL2 BINDING SITE is a target binding site found in the 3' untranslated region of mRNA encoded by ELOVL2, corresponding to a target binding site such as BINDING SITE I, BINDING SITE II or BINDING SITE III of FIG. 8. Table 4 illustrates the complementarity of the nucleotide sequences of ELOVL2 BINDING SITE, designated SEQ ID:11804, to the nucleotide sequence of GAM47 RNA, herein designated GAM RNA, also designated SEQ ID:269.

Another function of GAM47 is therefore inhibition of Elongation of very long chain fatty acids (fen1/elo2, sur4/elo3, yeast)-like 2 (ELOVL2, Accession NP_060240.1). Accordingly, utilities of GAM47 include diagnosis, prevention and treatment of diseases and clinical conditions associated with ELOVL2.

EMR3 (Accession NP_693634.1) is another GAM47 target gene, herein designated TARGET GENE. EMR3 BINDING SITE is a target binding site found in the 3' untranslated region of multiple transcripts of mRNA encoded by EMR3, corresponding to a target binding site such as BINDING SITE I, BINDING SITE II or BINDING SITE III of FIG. 8. Table 4 illustrates the complementarity of the nucleotide sequences of EMR3 BINDING SITE, designated SEQ ID:3525, to the nucleotide sequence of GAM47 RNA, herein designated GAM RNA, also designated SEQ ID:269.

Another function of GAM47 is therefore inhibition of EMR3 (Accession NP_693634.1). Accordingly, utilities of GAM47 include diagnosis, prevention and treatment of diseases and clinical conditions associated with EMR3.

ENDOGLYX1 (Accession NP_079032.1) is another GAM47 target gene, herein designated TARGET GENE. ENDOGLYX1 BINDING SITE is a target binding site found in the 3' untranslated region of mRNA encoded by ENDOGLYX1, corresponding to a target binding site such as BINDING SITE I, BINDING SITE II or BINDING SITE III of FIG. 8. Table 4 illustrates the complementarity of the nucleotide sequences of ENDOGLYX1 BINDING SITE, designated SEQ ID:11245, to the nucleotide sequence of GAM47 RNA, herein designated GAM RNA, also designated SEQ ID:269.

Another function of GAM47 is therefore inhibition of ENDOGLYX1 (Accession NP_079032.1). Accordingly, utilities of GAM47 include diagnosis, prevention and treatment of diseases and clinical conditions associated with ENDOGLYX1.

Enolase 1, (alpha) (ENO1, Accession NP_001419.1) is another GAM47 target gene, herein designated TARGET GENE. ENO1 BINDING SITE is a target binding site found in the 5' untranslated region of mRNA encoded by ENO1, corresponding to a target binding site such as BINDING SITE I, BINDING SITE II or BINDING SITE III of FIG. 8. Table 4 illustrates the complementarity of the nucleotide sequences of ENO1 BINDING SITE, designated SEQ ID:19121, to the nucleotide sequence of GAM47 RNA, herein designated GAM RNA, also designated SEQ ID:269.

Another function of GAM47 is therefore inhibition of Enolase 1, (alpha) (ENO1, Accession NP_001419.1), a gene which is a glycolytic enzyme. Accordingly, utilities of GAM47 include diagnosis, prevention and treatment of diseases and clinical conditions associated with ENO1.

The function of ENO1 has been established by previous studies. Enolase is a glycolytic enzyme (2-phospho-D-glycerate hydrolyase; EC 4.2.1.11). Each of the 3 ENO isoenzymes is a homodimer composed of 2 alpha (ENO1), 2 gamma (ENO2; 131360), or 2 beta (ENO3; 131370) subunits. Isoenzyme alpha (ENO1) is present in most tissues, whereas the beta form (ENO3) is localized to muscle and the gamma form (ENO2) is found only in nervous tissue. Giallongo et al. (1986) cloned and sequenced a full-length cDNA for human alpha-enolase. Its coding region was found to be 1,299 bases long. The 433-amino acid protein shows 67% homology to yeast enolase and 94% homology to rat nonneural enolase. Wistow et al. (1988) presented evidence for the remarkable conclusion that alpha-enolase is encoded by the same gene that encodes tau-crystallin, a lens structural protein. Giblett et al. (1974) observed an electrophoretic variant of red cell PPH among Cree Indians. Linkage was found with the Rhesus locus. Since the Rh locus has been assigned to chromosome 1 and since cell hybridization studies assign the PPH locus to chromosome 1, the new data are consistent. The Goss-Harris method of mapping combines features of recombinational study in families and synteny tests in hybrid cells. As applied to chromosome 1, the method shows that AK2 and UMPK are distal to PGM1 and that the order of the loci is PGM1: UMPK: (AK2, alpha-FUC): ENO1 (Goss and Harris, 1977). Comings (1972) and Ohno (1973) suggested that during vertebrate evolution tetraploidization occurred 2-3 hundred million years ago and that chromosomal events that tend to preserve ancestral linkage groups, such as Robertsonian fusions, inversions and gene duplications, have been favored. Demonstration of linkage of homologous genes supports this hypothesis. D'Ancona et al. (1977) regionalized ENO1 to 1pter-p36.13. Lalley et al. (1978) demonstrated synteny of enolase, PGD (OMIM Ref. No. 172200), PGM1 (OMIM Ref. No. 171900), and AK2 (OMIM Ref. No. 103020) on chromosome 4 of the mouse; they are on 1p of man. Feo et al. (1990) concluded that there is a single alpha-enolase pseudogene in the human genome. This intronless, processed pseudogene was mapped to chromosome 1 by Southern blot analysis of rodent-human hybrid cell DNAs; thus, it is on the same chromosome as the functional gene. Ribaudo et al. (1996) confirmed the assignment of ENO1P to chromosome 1. By fluorescence in situ hybridization, they found that it is located on 1q41-q42, whereas the functional gene is located on the short arm of that chromosome. Lachant et al. (1986) and Lachant and Tanaka (1987) reported 4 generations of a Caucasian family with hereditary red cell enolase deficiency. Partial deficiency in this kindred behaved as an autosomal dominant and was associated with a spherocytic phenotype, although a normal acidified glycerol lysis test suggested that the spherocytes of enolase deficiency are different from those of hereditary spherocytosis (OMIM Ref. No. 182900). Clinical expression of enolase deficiency varied in this family. Some had slightly low hematocrit with elevated reticulocytes, while others had no evidence of anemia or hemolysis.

Full details of the abovementioned studies are described in the following publications, the disclosure of which are hereby incorporated by reference:

Ribaudo, M. R.; Di Leonardo, A.; Rubino, P.; Giallongo, A.; Feo, S.: Assignment of enolase processed pseudogene (ENO1P) to human genome 1 bands 1q41-q42. Cytogenet. Cell Genet. 74:201-202, 1996; and Feo, S.; Oliva, D.; Arico, B.; Barba, G.; Cali, L.; Giallongo, A.: The human genome contains a single processed pseudogene for alpha enolase located on chromosome 1. DNA Sequence 1:79.

Further studies establishing the function and utilities of ENO1 are found in John Hopkins OMIM database record ID 172430, and in cited publications listed in Table 5, which are hereby incorporated by reference. Erythrocyte membrane protein band 4.9 (dematin) (EPB49, Accession NP_001969.1) is another GAM47 target gene, herein designated TARGET GENE. EPB49 BINDING SITE is a target binding site found in the 3' untranslated region of mRNA encoded by EPB49, corresponding to a target binding site such as BINDING SITE I, BINDING SITE II or BINDING SITE III of FIG. 8. Table 4 illustrates the complementarity of the nucleotide sequences of EPB49 BINDING SITE, designated SEQ ID:9779, to the nucleotide sequence of GAM47 RNA, herein designated GAM RNA, also designated SEQ ID:269.

Another function of GAM47 is therefore inhibition of Erythrocyte membrane protein band 4.9 (dematin) (EPB49, Accession NP_001969.1), a gene which is an actin-bundling protein. Accordingly, utilities of GAM47 include diagnosis, prevention and treatment of diseases and clinical conditions associated with EPB49.

The function of EPB49 has been established by previous studies. Chishti et al. (1989) proposed the name dematin (from the Greek 'dema,' a bundle) for an actin-bundling protein originally identified in the human erythroid membrane skeleton. It consists of 2 polypeptide chains of 48 and 52 kD that have been identified as protein 4.9 on SDS/polyacrylamide gels. In solution, dematin exists as a trimer and bundles actin filaments in a phosphorylation- dependent manner. Its actin-bundling activity is abolished upon phosphorylation by cAMP- dependent protein kinase and is restored after dephosphorylation. See review of Gilligan and Bennett (1993). Rana et al. (1993) reported the complete primary structure of human erythroid dematin, whose sequence includes a homolog of the 'headpiece' sequence found at the C-terminus of villin (OMIM Ref. No. 193040). The headpiece is essential for villin function in inducing microvillar development and actin redistribution. The widespread expression of dematin transcripts in human tissue suggests that dematin and its homologs may substitute for villin in villin- negative tissues to regulate actin reorganization by a phosphorylation-regulated mechanism. Peters et al. (1995) demonstrated that the murine dematin gene, symbolized Epb4.9, maps to chromosome 14. They raised the possibility that dematin mutations may be involved in neurologic abnormalities in the mouse. Although dematin is an actin-bundling protein of the erythroid membrane skeleton, it is abundantly expressed in human brain, heart, skeletal muscle, kidney, and lung. Azim et al. (1995) noted that the 48-kD subunit of dematin contains the headpiece domain of villin which is essential for its morphogenic function in vivo. Azim et al. (1995) reported the primary structure of the 52-kD subunit of dematin which differs from the 48-kD subunit by a 22-amino acid insertion within its headpiece domain. A unique feature of the insertion sequence of the 52-kD subunit is its homology to erythrocyte protein 4.2 (OMIM Ref. No. 177070). Using somatic cell hybrid panels and fluorescence in situ hybridization, Azim et al. (1995) localized the dematin gene to 8p21.1, a site distal to the locus of ankyrin (OMIM Ref. No. 182900) at 8p11.2. Azim et al. (1996) demonstrated that dematin and protein 4.2 (OMIM Ref. No. 177070) bind ATP. Although the functional significance is not clear, the findings open new perspectives for the function of these 2 proteins in vivo. By using homologous recombination in mouse embryonic stem cells, Khanna et al. (2002) deleted the headpiece domain of dematin to evaluate its function in vivo. Dematin headpiece-null mice were viable and born at the expected mendelian ratio. Hematologic evaluation showed evidence of compensated anemia and spherocytosis in these mice, however. The headpiece-null erythrocytes were osmotically fragile, and displayed reduced deformability and filterability. In vitro, significantly greater membrane fragmentation of these erythrocytes was demonstrated. Biochemical characterization showed a weakened membrane skeleton evidenced by reduced association of spectrin and actin to the plasma membrane. Together, these results provided evidence for the physiologic significance of dermatin and demonstrated a role for the headpiece domain in the maintenance of structural integrity and mechanical properties of red cells in vivo.

Full details of the abovementioned studies are described in the following publications, the disclosure of which are hereby incorporated by reference:

Khanna, R.; Chang, S. H.; Andrabi, S.; Azam, M.; Kim, A.; Rivera, A.; Brugnara, C.; Low, P. S.; Liu, S.-C.; Chishti, A. H.: Headpiece domain of dematin is required for the stability of the erythrocyte membrane. Proc. Nat. Acad. Sci. 99:6637-6642, 2002; and Peters, L. L.; Eicher, E. M.; Azim, A. C.; Chishti, A. H.: The gene encoding the erythrocyte membrane skeleton protein dematin (Epb4.9) maps to mouse chromosome 14. Genomics 26:634-63.

Further studies establishing the function and utilities of EPB49 are found in John Hopkins OMIM database record ID 125305, and in cited publications listed in Table 5, which are hereby incorporated by reference. F11R (Accession NP_653084.1) is another GAM47 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:7420, to the nucleotide sequence of GAM47 RNA, herein designated GAM RNA, also designated SEQ ID:269.

Another function of GAM47 is therefore inhibition of F11R (Accession NP_653084.1). Accordingly, utilities of GAM47 include diagnosis, prevention and treatment of diseases and clinical conditions associated with F11R.

F11R (Accession NP_058642.1) is another GAM47 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:7420, to the nucleotide sequence of GAM47 RNA, herein designated GAM RNA, also designated SEQ ID:269.

Another function of GAM47 is therefore inhibition of F11R (Accession NP_058642.1). Accordingly, utilities of GAM47 include diagnosis, prevention and treatment of diseases and clinical conditions associated with F11R.

F11R (Accession NP_653085.1) is another GAM47 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:7420, to the nucleotide sequence of GAM47 RNA, herein designated GAM RNA, also designated SEQ ID:269.

Another function of GAM47 is therefore inhibition of F11R (Accession NP_653085.1). Accordingly, utilities of GAM47 include diagnosis, prevention and treatment of diseases and clinical conditions associated with F11R.

F11R (Accession NP_653086.1) is another GAM47 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:7420, to the nucleotide sequence of GAM47 RNA, herein designated GAM RNA, also designated SEQ ID:269.

Another function of GAM47 is therefore inhibition of F11R (Accession NP_653086.1). Accordingly, utilities of GAM47 include diagnosis, prevention and treatment of diseases and clinical conditions associated with F11R.

F11R (Accession NP_653087.1) is another GAM47 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:7420, to the nucleotide sequence of GAM47 RNA, herein designated GAM RNA, also designated SEQ ID:269.

Another function of GAM47 is therefore inhibition of F11R (Accession NP_653087.1). Accordingly, utilities of GAM47 include diagnosis, prevention and treatment of diseases and clinical conditions associated with F11R.

Fatty-acid-coenzyme a ligase, long-chain 4 (FACL4, Accession NP_075266.1) is another GAM47 target gene, herein designated TARGET GENE. FACL4 BINDING SITE is a target binding site found in the 3' untranslated region of multiple transcripts of mRNA encoded by FACL4, corresponding to a target binding site such as BINDING SITE I, BINDING SITE II or BINDING SITE III of FIG. 8. Table 4 illustrates the complementarity of the nucleotide sequences of FACL4 BINDING SITE, designated SEQ ID:7050, to the nucleotide sequence of GAM47 RNA, herein designated GAM RNA, also designated SEQ ID:269.

Another function of GAM47 is therefore inhibition of Fatty-acid-coenzyme a ligase, long-chain 4 (FACL4, Accession NP_075266.1) . Accordingly, utilities of GAM47 include diagnosis, prevention and treatment of diseases and clinical conditions associated with FACL4.

Fatty-acid-coenzyme a ligase, long-chain 4 (FACL4, Accession NP_004449.1) is another GAM47 target gene, herein designated TARGET GENE. FACL4 BINDING SITE is a target binding site found in the 3' untranslated region of multiple transcripts of mRNA encoded by FACL4, corresponding to a target binding site such as BINDING SITE I, BINDING SITE II or BINDING SITE III of FIG. 8. Table 4 illustrates the complementarity of the nucleotide sequences of FACL4 BINDING SITE, designated SEQ ID:7050, to the nucleotide sequence of GAM47 RNA, herein designated GAM RNA, also designated SEQ ID:269.

Another function of GAM47 is therefore inhibition of Fatty-acid-coenzyme a ligase, long-chain 4 (FACL4, Accession NP_004449.1) . Accordingly, utilities of GAM47 include diagnosis, prevention and treatment of diseases and clinical conditions associated with FACL4.

Fatty-acid-coenzyme a ligase, long-chain 5 (FACL5, Accession NP_057318.1) is another GAM47 target gene, herein designated TARGET GENE. FACL5 BINDING SITE is a target binding site found in the 5' untranslated region of mRNA encoded by FACL5, corresponding to a target binding site such as BINDING SITE I, BINDING SITE II or BINDING SITE III of FIG. 8. Table 4 illustrates the complementarity of the nucleotide sequences of FACL5 BINDING SITE, designated SEQ ID:17702, to the nucleotide sequence of GAM47 RNA, herein designated GAM RNA, also designated SEQ ID:269.

Another function of GAM47 is therefore inhibition of Fatty-acid-coenzyme a ligase, long-chain 5 (FACL5, Accession NP_057318.1), a gene which may be involved in fatty acid metabolism; contains an AMP-binding domain and therefore may be associated with Malignant gliomas. Accordingly, utilities of GAM47 include diagnosis, prevention and treatment of Malignant gliomas, and of other diseases and clinical conditions associated with FACL5.

The function of FACL5 has been established by previous studies. Acyl-CoA synthetase (ACS; EC 6.2.1.3) catalyzes the formation of acyl-CoA from fatty acid, ATP, and CoA. This reaction is essential in mammalian fatty acid metabolism. In addition, ACS mediates the transportation of fatty acids into cells by cooperating with the fatty acid transporter protein (FATP; 600691). Oikawa et al. (1998) cloned rat Acs5 and found that it is highly expressed in proliferating 3T3-L1 cells. By screening a liver cDNA library with rat ACS5 as the probe, Yamashita et al. (2000) isolated a cDNA encoding human ACS5. The deduced 683-amino acid protein shares approximately 80% amino acid identity with the rat sequence. Northern blot analysis detected 2 major ACS5 transcripts of 2.5 and 3.7 kb in a wide range of tissues, with highest expression in uterus and spleen. Markedly increased levels of ACS5 transcripts were detected in a glioma line and in primary gliomas of grade IV malignancy, while ACS5 expression was found to be low in normal brain. Yamashita et al. (2000) found that cultured glioma cells infected with an adenovirus encoding ACS5 displayed induced cell growth on exposure to palmitate. Consistent with the induction of cell growth, the virus-infected cells displayed induced uptake of palmitate. These results demonstrated a novel fatty acid-induced glioma cell growth mediated by ACS5.

Full details of the abovementioned studies are described in the following publications, the disclosure of which are hereby incorporated by reference:

Oikawa, E.; Iijima, H.; Suzuki, T.; Sasano, H.; Sato, H.; Kamataki, A.; Nagura, H.; Kang, M. J.; Fujino, T.; Suzuki, H.; Yamamoto, T. T.: A novel acyl-CoA synthetase, ACS5, expressed in intestinal epithelial cells and proliferating preadipocytes. J. Biochem. 124:679-685, 1998; and Yamashita, Y.; Kumabe, T.; Cho, Y.-Y.; Watanabe, M.; Kawagishi, J.; Yoshimoto, T.; Fujino, T.; Kang, M.-J.; Yamamoto, T. T.: Fatty acid induced glioma cell growth is mediated by the a.

Further studies establishing the function and utilities of FACL5 are found in John Hopkins OMIM database record ID 605677, and in cited publications listed in Table 5, which are hereby incorporated by reference. F-box and leucine-rich repeat protein 2 (FBXL2, Accession NP_036289.2) is another GAM47 target gene, herein designated TARGET GENE. FBXL2 BINDING SITE is a target binding site found in the 3' untranslated region of mRNA encoded by FBXL2, corresponding to a target binding site such as BINDING SITE I, BINDING SITE II or BINDING SITE III of FIG. 8. Table 4 illustrates the complementarity of the nucleotide sequences of FBXL2 BINDING SITE, designated SEQ ID:11065, to the nucleotide sequence of GAM47 RNA, herein designated GAM RNA, also designated SEQ ID:269.

Another function of GAM47 is therefore inhibition of F-box and leucine-rich repeat protein 2 (FBXL2, Accession NP_036289.2). Accordingly, utilities of GAM47 include diagnosis, prevention and treatment of diseases and clinical conditions associated with FBXL2.

Fibroblast growth factor 23 (FGF23, Accession NP_065689.1) is another GAM47 target gene, herein designated TARGET GENE. FGF23 BINDING SITE is a target binding site found in the 3' untranslated region of mRNA encoded by FGF23, corresponding to a target binding site such as BINDING SITE I, BINDING SITE II or BINDING SITE III of FIG. 8. Table 4 illustrates the complementarity of the nucleotide sequences of FGF23 BINDING SITE, designated SEQ ID:15431, to the nucleotide sequence of GAM47 RNA, herein designated GAM RNA, also designated SEQ ID:269.

Another function of GAM47 is therefore inhibition of Fibroblast growth factor 23 (FGF23, Accession NP_065689.1), a gene which a member of the fibroblast growth factor family. And therefore is associated with Autosomal dominant hypophosphatemic rickets. Accordingly, utilities of GAM47 include diagnosis, prevention and treatment of Autosomal dominant hypophosphatemic rickets, and of other diseases and clinical conditions associated with FGF23.

The function of FGF23 has been established by previous studies. The FGF23 gene encodes a member of the fibroblast growth factor family that is mutant in autosomal dominant hypophosphatemic rickets (OMIM Ref. No. 193100). Using the mouse Fgf23 sequence as query, Yamashita et al. (2000) identified FGF23 in a genomic database. They cloned the full-length cDNA from a placenta library. The deduced 251-amino acid protein contains an N-terminal 24-amino acid signal sequence. FGF23 shares 72% sequence identity with mouse Fgf23, and 24% and 22% identity with human FGF21 and FGF19, respectively. By quantitative PCR, Yamashita et al. (2000) found highest expression of Fgf23 in mouse brain and lower expression in thymus. In situ hybridization of mouse brain revealed discrete specific labeling only in the ventrolateral thalamic nucleus. Autosomal dominant hypophosphatemic rickets (ADHR; 193100) is characterized by low serum phosphorus concentrations, rickets, osteomalacia, leg deformities, short stature, bone pain, and dental abscesses. The ADHR Consortium (2000) described a positional cloning approach used to identify the gene mutated in ADHR. They identified mutations in the FGF23 gene in affected members of families segregating ADHR. The ADHR Consortium (2000) found that the FGF23 gene lies 54 kb telomeric of FGF6 (OMIM Ref. No. 134921) on 12p13.

Full details of the abovementioned studies are described in the following publications, the disclosure of which are hereby incorporated by reference:

Yamashita, T.; Yoshioka, M.; Itoh, N.: Identification of a novel fibroblast growth factor, FGF-23, preferentially expressed in the ventrolateral thalamic nucleus of the brain. Biochem. Biophys. Res. Commun. 277:494-498, 2000; and ADHR Consortium : Autosomal dominant hypophosphataemic rickets is associated with mutations in FGF23. Nature Genet. 26:345-348, 2000.

Further studies establishing the function and utilities of FGF23 are found in John Hopkins OMIM database record ID 605380, and in cited publications listed in Table 5, which are hereby incorporated by reference. FKSG44 (Accession NP_114110.1) is another GAM47 target gene, herein designated TARGET GENE. FKSG44 BINDING SITE is a target binding site found in the 3' untranslated region of mRNA encoded by FKSG44, corresponding to a target binding site such as BINDING SITE I, BINDING SITE II or BINDING SITE III of FIG. 8. Table 4 illustrates the complementarity of the nucleotide sequences of FKSG44 BINDING SITE, designated SEQ ID:14084, to the nucleotide sequence of GAM47 RNA, herein designated GAM RNA, also designated SEQ ID:269.

Another function of GAM47 is therefore inhibition of FKSG44 (Accession NP_114110.1). Accordingly, utilities of GAM47 include diagnosis, prevention and treatment of diseases and clinical conditions associated with FKSG44.

FLJ11259 (Accession NP_060840.1) is another GAM47 target gene, herein designated TARGET GENE. FLJ11259 BINDING SITE is a target binding site found in the 3' untranslated region of mRNA encoded by FLJ11259, corresponding to a target binding site such as BINDING SITE I, BINDING SITE II or BINDING SITE III of FIG. 8. Table 4 illustrates the complementarity of the nucleotide sequences of FLJ11259 BINDING SITE, designated SEQ ID:1282, to the nucleotide sequence of GAM47 RNA, herein designated GAM RNA, also designated SEQ ID:269.

Another function of GAM47 is therefore inhibition of FLJ11259 (Accession NP_060840.1). Accordingly, utilities of GAM47 include diagnosis, prevention and treatment of diseases and clinical conditions associated with FLJ11259.

FLJ11280 (Accession NP_060849.2) is another GAM47 target gene, herein designated TARGET GENE. FLJ11280 BINDING SITE is a target binding site found in the 3' untranslated region of mRNA encoded by FLJ11280, corresponding to a target binding site such as BINDING SITE I, BINDING SITE II or BINDING SITE III of FIG. 8. Table 4 illustrates the complementarity of the nucleotide sequences of FLJ11280 BINDING SITE, designated SEQ ID:5027, to the nucleotide sequence of GAM47 RNA, herein designated GAM RNA, also designated SEQ ID:269.

Another function of GAM47 is therefore inhibition of FLJ11280 (Accession NP_060849.2). Accordingly, utilities of GAM47 include diagnosis, prevention and treatment of diseases and clinical conditions associated with FLJ11280.

FLJ11539 (Accession NP_079024.1) is another GAM47 target gene, herein designated TARGET GENE. FLJ11539 BINDING SITE is a target binding site found in the 3' untranslated region of mRNA encoded by FLJ11539, corresponding to a target binding site such as BINDING SITE I, BINDING SITE II or BINDING SITE III of FIG. 8. Table 4 illustrates the complementarity of the nucleotide sequences of FLJ11539 BINDING SITE, designated SEQ ID:16128, to the nucleotide sequence of GAM47 RNA, herein designated GAM RNA, also designated SEQ ID:269.

Another function of GAM47 is therefore inhibition of FLJ11539 (Accession NP_079024.1). Accordingly, utilities of GAM47 include diagnosis, prevention and treatment of diseases and clinical conditions associated with FLJ11539.

FLJ11565 (Accession NP_078933.2) is another GAM47 target gene, herein designated TARGET GENE. FLJ11565 BINDING SITE is a target binding site found in the 3' untranslated region of mRNA encoded by FLJ11565, corresponding to a target binding site such as BINDING SITE I, BINDING SITE II or BINDING SITE III of FIG. 8. Table 4 illustrates the complementarity of the nucleotide sequences of FLJ11565 BINDING SITE, designated SEQ ID:4833, to the nucleotide sequence of GAM47 RNA, herein designated GAM RNA, also designated SEQ ID:269.

Another function of GAM47 is therefore inhibition of FLJ11565 (Accession NP_078933.2). Accordingly, utilities of GAM47 include diagnosis, prevention and treatment of diseases and clinical conditions associated with FLJ11565.

FLJ11608 (Accession NP_078833.2) is another GAM47 target gene, herein designated TARGET GENE. FLJ11608 BINDING SITE is a target binding site found in the 3' untranslated region of mRNA encoded by FLJ11608, corresponding to a target binding site such as BINDING SITE I, BINDING SITE II or BINDING SITE III of FIG. 8. Table 4 illustrates the complementarity of the nucleotide sequences of FLJ11608 BINDING SITE, designated SEQ ID:4010, to the nucleotide sequence of GAM47 RNA, herein designated GAM RNA, also designated SEQ ID:269.

Another function of GAM47 is therefore inhibition of FLJ11608 (Accession NP_078833.2). Accordingly, utilities of GAM47 include diagnosis, prevention and treatment of diseases and clinical conditions associated with FLJ11608.

FLJ12221 (Accession XP_031342.1) is another GAM47 target gene, herein designated TARGET GENE. FLJ12221 BINDING SITE is a target binding site found in the 3' untranslated region of mRNA encoded by FLJ12221, corresponding to a target binding site such as BINDING SITE I, BINDING SITE II or BINDING SITE III of FIG. 8. Table 4 illustrates the complementarity of the nucleotide sequences of FLJ12221 BINDING SITE, designated SEQ ID:15788, to the nucleotide sequence of GAM47 RNA, herein designated GAM RNA, also designated SEQ ID:269.

Another function of GAM47 is therefore inhibition of FLJ12221 (Accession XP_031342.1). Accordingly, utilities of GAM47 include diagnosis, prevention and treatment of diseases and clinical conditions associated with FLJ12221.

FLJ12270 (Accession XP_290704.1) is another GAM47 target gene, herein designated TARGET GENE. FLJ12270 BINDING SITE is a target binding site found in the 3' untranslated region of mRNA encoded by FLJ12270, corresponding to a target binding site such as BINDING SITE I, BINDING SITE II or BINDING SITE III of FIG. 8. Table 4 illustrates the complementarity of the nucleotide sequences of FLJ12270 BINDING SITE, designated SEQ ID:6928, to the nucleotide sequence of GAM47 RNA, herein designated GAM RNA, also designated SEQ ID:269.

Another function of GAM47 is therefore inhibition of FLJ12270 (Accession XP_290704.1). Accordingly, utilities of GAM47 include diagnosis, prevention and treatment of diseases and clinical conditions associated with FLJ12270.

FLJ12425 (Accession XP_098290.1) is another GAM47 target gene, herein designated TARGET GENE. FLJ12425 BINDING SITE is a target binding site found in the 3' untranslated region of mRNA encoded by FLJ12425, corresponding to a target binding site such as BINDING SITE I, BINDING SITE II or BINDING SITE III of FIG. 8. Table 4 illustrates the complementarity of the nucleotide sequences of FLJ12425 BINDING SITE, designated SEQ ID:3483, to the nucleotide sequence of GAM47 RNA, herein designated GAM RNA, also designated SEQ ID:269.

Another function of GAM47 is therefore inhibition of FLJ12425 (Accession XP_098290.1). Accordingly, utilities of GAM47 include diagnosis, prevention and treatment of diseases and clinical conditions associated with FLJ12425.

FLJ12552 (Accession NP_073743.2) is another GAM47 target gene, herein designated TARGET GENE. FLJ12552 BINDING SITE is a target binding site found in the 3' untranslated region of mRNA encoded by FLJ12552, corresponding to a target binding site such as BINDING SITE I, BINDING SITE II or BINDING SITE III of FIG. 8. Table 4 illustrates the complementarity of the nucleotide sequences of FLJ12552 BINDING SITE, designated SEQ ID:3923, to the nucleotide sequence of GAM47 RNA, herein designated GAM RNA, also designated SEQ ID:269.

Another function of GAM47 is therefore inhibition of FLJ12552 (Accession NP_073743.2). Accordingly, utilities of GAM47 include diagnosis, prevention and treatment of diseases and clinical conditions associated with FLJ12552.

FLJ12704 (Accession NP_079274.1) is another GAM47 target gene, herein designated TARGET GENE. FLJ12704 BINDING SITE is a target binding site found in the 3' untranslated region of mRNA encoded by FLJ12704, corresponding to a target binding site such as BINDING SITE I, BINDING SITE II or BINDING SITE III of FIG. 8. Table 4 illustrates the complementarity of the nucleotide sequences of FLJ12704 BINDING SITE, designated SEQ ID:871, to the nucleotide sequence of GAM47 RNA, herein designated GAM RNA, also designated SEQ ID:269.

Another function of GAM47 is therefore inhibition of FLJ12704 (Accession NP_079274.1). Accordingly, utilities of GAM47 include diagnosis, prevention and treatment of diseases and clinical conditions associated with FLJ12704.

FLJ12788 (Accession NP_071937.1) is another GAM47 target gene, herein designated TARGET GENE. FLJ12788 BINDING SITE is a target binding site found in the 3' untranslated region of mRNA encoded by FLJ12788, corresponding to a target binding site such as BINDING SITE I, BINDING SITE II or BINDING SITE III of FIG. 8. Table 4 illustrates the complementarity of the nucleotide sequences of FLJ12788 BINDING SITE, designated SEQ ID:2532, to the nucleotide sequence of GAM47 RNA, herein designated GAM RNA, also designated SEQ ID:269.

Another function of GAM47 is therefore inhibition of FLJ12788 (Accession NP_071937.1). Accordingly, utilities of GAM47 include diagnosis, prevention and treatment of diseases and clinical conditions associated with FLJ12788.

FLJ13154 (Accession NP_078874.1) is another GAM47 target gene, herein designated TARGET GENE. FLJ13154 BINDING SITE is a target binding site found in the 3' untranslated region of mRNA encoded by FLJ13154, corresponding to a target binding site such as BINDING SITE I, BINDING SITE II or BINDING SITE III of FIG. 8. Table 4 illustrates the complementarity of the nucleotide sequences of FLJ13154 BINDING SITE, designated SEQ ID:17478, to the nucleotide sequence of GAM47 RNA, herein designated GAM RNA, also designated SEQ ID:269.

Another function of GAM47 is therefore inhibition of FLJ13154 (Accession NP_078874.1). Accordingly, utilities of GAM47 include diagnosis, prevention and treatment of diseases and clinical conditions associated with FLJ13154.

FLJ13204 (Accession NP_079037.2) is another GAM47 target gene, herein designated TARGET GENE. FLJ13204 BINDING SITE is a target binding site found in the 3' untranslated region of mRNA encoded by FLJ13204, corresponding to a target binding site such as BINDING SITE I, BINDING SITE II or BINDING SITE III of FIG. 8. Table 4 illustrates the complementarity of the nucleotide sequences of FLJ13204 BINDING SITE, designated SEQ ID:7166, to the nucleotide sequence of GAM47 RNA, herein designated GAM RNA, also designated SEQ ID:269.

Another function of GAM47 is therefore inhibition of FLJ13204 (Accession NP_079037.2). Accordingly, utilities of GAM47 include diagnosis, prevention and treatment of diseases and clinical conditions associated with FLJ13204.

FLJ13710 (Accession NP_079093.1) is another GAM47 target gene, herein designated TARGET GENE. FLJ13710 BINDING SITE is a target binding site found in the 3' untranslated region of mRNA encoded by FLJ13710, corresponding to a target binding site such as BINDING SITE I, BINDING SITE II or BINDING SITE III of FIG. 8. Table 4 illustrates the complementarity of the nucleotide sequences of FLJ13710 BINDING SITE, designated SEQ ID:18875, to the nucleotide sequence of GAM47 RNA, herein designated GAM RNA, also designated SEQ ID:269.

Another function of GAM47 is therefore inhibition of FLJ13710 (Accession NP_079093.1). Accordingly, utilities of GAM47 include diagnosis, prevention and treatment of diseases and clinical conditions associated with FLJ13710.

FLJ13855 (Accession NP_075567.1) is another GAM47 target gene, herein designated TARGET GENE. FLJ13855 BINDING SITE1 and FLJ13855 BINDING SITE2 are target binding sites found in untranslated regions of mRNA encoded by FLJ13855, corresponding to target binding sites such as BINDING SITE I, BINDING SITE II or BINDING SITE III of FIG. 8. Table 4 illustrates the complementarity of the nucleotide sequences of FLJ13855 BINDING SITE1 and FLJ13855 BINDING SITE2, designated SEQ ID:5049 and SEQ ID:13447 respectively, to the nucleotide sequence of GAM47 RNA, herein designated GAM RNA, also designated SEQ ID:269.

Another function of GAM47 is therefore inhibition of FLJ13855 (Accession NP_075567.1). Accordingly, utilities of GAM47 include diagnosis, prevention and treatment of diseases and clinical conditions associated with FLJ13855.

FLJ14146 (Accession NP_078985.1) is another GAM47 target gene, herein designated TARGET GENE. FLJ14146 BINDING SITE is a target binding site found in the 3' untranslated region of mRNA encoded by FLJ14146, corresponding to a target binding site such as BINDING SITE I, BINDING SITE II or BINDING SITE III of FIG. 8. Table 4 illustrates the complementarity of the nucleotide sequences of FLJ14146 BINDING SITE, designated SEQ ID:888, to the nucleotide sequence of GAM47 RNA, herein designated GAM RNA, also designated SEQ ID:269.

Another function of GAM47 is therefore inhibition of FLJ14146 (Accession NP_078985.1). Accordingly, utilities of GAM47 include diagnosis, prevention and treatment of diseases and clinical conditions associated with FLJ14146.

FLJ14442 (Accession NP_116174.1) is another GAM47 target gene, herein designated TARGET GENE. FLJ14442 BINDING SITE1 and FLJ14442 BINDING SITE2 are target binding sites found in untranslated regions of mRNA encoded by FLJ14442, corresponding to target binding sites such as BINDING SITE I, BINDING SITE II or BINDING SITE III of FIG. 8. Table 4 illustrates the complementarity of the nucleotide sequences of FLJ14442 BINDING SITE1 and FLJ14442 BINDING SITE2, designated SEQ ID:8273 and SEQ ID:17024 respectively, to the nucleotide sequence of GAM47 RNA, herein designated GAM RNA, also designated SEQ ID:269.

Another function of GAM47 is therefore inhibition of FLJ14442 (Accession NP_116174.1). Accordingly, utilities of GAM47 include diagnosis, prevention and treatment of diseases and clinical conditions associated with FLJ14442.

FLJ14751 (Accession NP_116223.1) is another GAM47 target gene, herein designated TARGET GENE. FLJ14751 BINDING SITE is a target binding site found in the 3' untranslated region of mRNA encoded by FLJ14751, corresponding to a target binding site such as BINDING SITE I, BINDING SITE II or BINDING SITE III of FIG. 8. Table 4 illustrates the complementarity of the nucleotide sequences of FLJ14751 BINDING SITE, designated SEQ ID:3661, to the nucleotide sequence of GAM47 RNA, herein designated GAM RNA, also designated SEQ ID:269.

Another function of GAM47 is therefore inhibition of FLJ14751 (Accession NP_116223.1). Accordingly, utilities of GAM47 include diagnosis, prevention and treatment of diseases and clinical conditions associated with FLJ14751.

FLJ20060 (Accession NP_060115.3) is another GAM47 target gene, herein designated TARGET GENE. FLJ20060 BINDING SITE is a target binding site found in the 3' untranslated region of mRNA encoded by FLJ20060, corresponding to a target binding site such as BINDING SITE I, BINDING SITE II or BINDING SITE III of FIG. 8. Table 4 illustrates the complementarity of the nucleotide sequences of FLJ20060 BINDING SITE, designated SEQ ID:14321, to the nucleotide sequence of GAM47 RNA, herein designated GAM RNA, also designated SEQ ID:269.

Another function of GAM47 is therefore inhibition of FLJ20060 (Accession NP_060115.3). Accordingly, utilities of GAM47 include diagnosis, prevention and treatment of diseases and clinical conditions associated with FLJ20060.

FLJ20232 (Accession NP_061881.2) is another GAM47 target gene, herein designated TARGET GENE. FLJ20232 BINDING SITE is a target binding site found in the 3' untranslated region of mRNA encoded by FLJ20232, corresponding to a target binding site such as BINDING SITE I, BINDING SITE II or BINDING SITE III of FIG. 8. Table 4 illustrates the complementarity of the nucleotide sequences of FLJ20232 BINDING SITE, designated SEQ ID:8193, to the nucleotide sequence of GAM47 RNA, herein designated GAM RNA, also designated SEQ ID:269.

Another function of GAM47 is therefore inhibition of FLJ20232 (Accession NP_061881.2). Accordingly, utilities of GAM47 include diagnosis, prevention and treatment of diseases and clinical conditions associated with FLJ20232.

FLJ20400 (Accession NP_060274.1) is another GAM47 target gene, herein designated TARGET GENE. FLJ20400 BINDING SITE1 and FLJ20400 BINDING SITE2 are target binding sites found in untranslated regions of mRNA encoded by FLJ20400, corresponding to target binding sites such as BINDING SITE I, BINDING SITE II or BINDING SITE III of FIG. 8. Table 4 illustrates the complementarity of the nucleotide sequences of FLJ20400 BINDING SITE1 and FLJ20400 BINDING SITE2, designated SEQ ID:12810 and SEQ ID:4963 respectively, to the nucleotide sequence of GAM47 RNA, herein designated GAM RNA, also designated SEQ ID:269.

Another function of GAM47 is therefore inhibition of FLJ20400 (Accession NP_060274.1). Accordingly, utilities of GAM47 include diagnosis, prevention and treatment of diseases and clinical conditions associated with FLJ20400.

FLJ20489 (Accession NP_060312.1) is another GAM47 target gene, herein designated TARGET GENE. FLJ20489 BINDING SITE is a target binding site found in the 3' untranslated region of mRNA encoded by FLJ20489, corresponding to a target binding site such as BINDING SITE I, BINDING SITE II or BINDING SITE III of FIG. 8. Table 4 illustrates the complementarity of the nucleotide sequences of FLJ20489 BINDING SITE, designated SEQ ID:7395, to the nucleotide sequence of GAM47 RNA, herein designated GAM RNA, also designated SEQ ID:269.

Another function of GAM47 is therefore inhibition of FLJ20489 (Accession NP_060312.1). Accordingly, utilities of GAM47 include diagnosis, prevention and treatment of diseases and clinical conditions associated with FLJ20489.

FLJ20758 (Accession NP_060422.2) is another GAM47 target gene, herein designated TARGET GENE. FLJ20758 BINDING SITE is a target binding site found in the 3' untranslated region of mRNA encoded by FLJ20758, corresponding to a target binding site such as BINDING SITE I, BINDING SITE II or BINDING SITE III of FIG. 8. Table 4 illustrates the complementarity of the nucleotide sequences of FLJ20758 BINDING SITE, designated SEQ ID:19231, to the nucleotide sequence of GAM47 RNA, herein designated GAM RNA, also designated SEQ ID:269.

Another function of GAM47 is therefore inhibition of FLJ20758 (Accession NP_060422.2). Accordingly, utilities of GAM47 include diagnosis, prevention and treatment of diseases and clinical conditions associated with FLJ20758.

FLJ20813 (Accession NP_060431.1) is another GAM47 target gene, herein designated TARGET GENE. FLJ20813 BINDING SITE is a target binding site found in the 3' untranslated region of mRNA encoded by FLJ20813, corresponding to a target binding site such as BINDING SITE I, BINDING SITE II or BINDING SITE III of FIG. 8. Table 4 illustrates the complementarity of the nucleotide sequences of FLJ20813 BINDING SITE, designated SEQ ID:11077, to the nucleotide sequence of GAM47 RNA, herein designated GAM RNA, also designated SEQ ID:269.

Another function of GAM47 is therefore inhibition of FLJ20813 (Accession NP_060431.1). Accordingly, utilities of GAM47 include diagnosis, prevention and treatment of diseases and clinical conditions associated with FLJ20813.

FLJ20886 (Accession NP_079475.1) is another GAM47 target gene, herein designated TARGET GENE. FLJ20886 BINDING SITE is a target binding site found in the 3' untranslated region of mRNA encoded by FLJ20886, corresponding to a target binding site such as BINDING SITE I, BINDING SITE II or BINDING SITE III of FIG. 8. Table 4 illustrates the complementarity of the nucleotide sequences of FLJ20886 BINDING SITE, designated SEQ ID:636, to the nucleotide sequence of GAM47 RNA, herein designated GAM RNA, also designated SEQ ID:269.

Another function of GAM47 is therefore inhibition of FLJ20886 (Accession NP_079475.1). Accordingly, utilities of GAM47 include diagnosis, prevention and treatment of diseases and clinical conditions associated with FLJ20886.

FLJ21596 (Accession NP_079099.1) is another GAM47 target gene, herein designated TARGET GENE. FLJ21596 BINDING SITE is a target binding site found in the 3' untranslated region of mRNA encoded by FLJ21596, corresponding to a target binding site such as BINDING SITE I, BINDING SITE II or BINDING SITE III of FIG. 8. Table 4 illustrates the complementarity of the nucleotide sequences of FLJ21596 BINDING SITE, designated SEQ ID:19872, to the nucleotide sequence of GAM47 RNA, herein designated GAM RNA, also designated SEQ ID:269.

Another function of GAM47 is therefore inhibition of FLJ21596 (Accession NP_079099.1). Accordingly, utilities of GAM47 include diagnosis, prevention and treatment of diseases and clinical conditions associated with FLJ21596.

FLJ22175 (Accession NP_079437.2) is another GAM47 target gene, herein designated TARGET GENE. FLJ22175 BINDING SITE is a target binding site found in the 5' untranslated region of mRNA encoded by FLJ22175, corresponding to a target binding site such as BINDING SITE I, BINDING SITE II or BINDING SITE III of FIG. 8. Table 4 illustrates the complementarity of the nucleotide sequences of FLJ22175 BINDING SITE, designated SEQ ID:12089, to the nucleotide sequence of GAM47 RNA, herein designated GAM RNA, also designated SEQ ID:269.

Another function of GAM47 is therefore inhibition of FLJ22175 (Accession NP_079437.2). Accordingly, utilities of GAM47 include diagnosis, prevention and treatment of diseases and clinical conditions associated with FLJ22175.

FLJ22184 (Accession XP_300713.1) is another GAM47 target gene, herein designated TARGET GENE. FLJ22184 BINDING SITE is a target binding site found in the 5' untranslated region of mRNA encoded by FLJ22184, corresponding to a target binding site such as BINDING SITE I, BINDING SITE II or BINDING SITE III of FIG. 8. Table 4 illustrates the complementarity of the nucleotide sequences of FLJ22184 BINDING SITE, designated SEQ ID:8410, to the nucleotide sequence of GAM47 RNA, herein designated GAM RNA, also designated SEQ ID:269.

Another function of GAM47 is therefore inhibition of FLJ22184 (Accession XP_300713.1). Accordingly, utilities of GAM47 include diagnosis, prevention and treatment of diseases and clinical conditions associated with FLJ22184.

FLJ22301 (Accession NP_079112.1) is another GAM47 target gene, herein designated TARGET GENE. FLJ22301 BINDING SITE is a target binding site found in the 3' untranslated region of mRNA encoded by FLJ22301, corresponding to a target binding site such as BINDING SITE I, BINDING SITE II or BINDING SITE III of FIG. 8. Table 4 illustrates the complementarity of the nucleotide sequences of FLJ22301 BINDING SITE, designated SEQ ID:889, to the nucleotide sequence of GAM47 RNA, herein designated GAM RNA, also designated SEQ ID:269.

Another function of GAM47 is therefore inhibition of FLJ22301 (Accession NP_079112.1). Accordingly, utilities of GAM47 include diagnosis, prevention and treatment of diseases and clinical conditions associated with FLJ22301.

FLJ22944 (Accession NP_079421.2) is another GAM47 target gene, herein designated TARGET GENE. FLJ22944 BINDING SITE is a target binding site found in the 3' untranslated region of mRNA encoded by FLJ22944, corresponding to a target binding site such as BINDING SITE I, BINDING SITE II or BINDING SITE III of FIG. 8. Table 4 illustrates the complementarity of the nucleotide sequences of FLJ22944 BINDING SITE, designated SEQ ID:5374, to the nucleotide sequence of GAM47 RNA, herein designated GAM RNA, also designated SEQ ID:269.

Another function of GAM47 is therefore inhibition of FLJ22944 (Accession NP_079421.2). Accordingly, utilities of GAM47 include diagnosis, prevention and treatment of diseases and clinical conditions associated with FLJ22944.

FLJ23510 (Accession NP_078996.1) is another GAM47 target gene, herein designated TARGET GENE. FLJ23510 BINDING SITE is a target binding site found in the 3' untranslated region of mRNA encoded by FLJ23510, corresponding to a target binding site such as BINDING SITE I, BINDING SITE II or BINDING SITE III of FIG. 8. Table 4 illustrates the complementarity of the nucleotide sequences of FLJ23510 BINDING SITE, designated SEQ ID:12934, to the nucleotide sequence of GAM47 RNA, herein designated GAM RNA, also designated SEQ ID:269.

Another function of GAM47 is therefore inhibition of FLJ23510 (Accession NP_078996.1). Accordingly, utilities of GAM47 include diagnosis, prevention and treatment of diseases and clinical conditions associated with FLJ23510.

FLJ30594 (Accession NP_694556.1) is another GAM47 target gene, herein designated TARGET GENE. FLJ30594 BINDING SITE is a target binding site found in the 5' untranslated region of mRNA encoded by FLJ30594, corresponding to a target binding site such as BINDING SITE I, BINDING SITE II or BINDING SITE III of FIG. 8. Table 4 illustrates the complementarity of the nucleotide sequences of FLJ30594 BINDING SITE, designated SEQ ID:2004, to the nucleotide sequence of GAM47 RNA, herein designated GAM RNA, also designated SEQ ID:269.

Another function of GAM47 is therefore inhibition of FLJ30594 (Accession NP_694556.1). Accordingly, utilities of GAM47 include diagnosis, prevention and treatment of diseases and clinical conditions associated with FLJ30594.

FLJ30681 (Accession XP_166291.1) is another GAM47 target gene, herein designated TARGET GENE. FLJ30681 BINDING SITE is a target binding site found in the 3' untranslated region of mRNA encoded by FLJ30681, corresponding to a target binding site such as BINDING SITE I, BINDING SITE II or BINDING SITE III of FIG. 8. Table 4 illustrates the complementarity of the nucleotide sequences of FLJ30681 BINDING SITE, designated SEQ ID:8907, to the nucleotide sequence of GAM47 RNA, herein designated GAM RNA, also designated SEQ ID:269.

Another function of GAM47 is therefore inhibition of FLJ30681 (Accession XP_166291.1). Accordingly, utilities of GAM47 include diagnosis, prevention and treatment of diseases and clinical conditions associated with FLJ30681.

FLJ31052 (Accession NP_689591.1) is another GAM47 target gene, herein designated TARGET GENE. FLJ31052 BINDING SITE is a target binding site found in the 3' untranslated region of mRNA encoded by FLJ31052, corresponding to a target binding site such as BINDING SITE I, BINDING SITE II or BINDING SITE III of FIG. 8. Table 4 illustrates the complementarity of the nucleotide sequences of FLJ31052 BINDING SITE, designated SEQ ID:18738, to the nucleotide sequence of GAM47 RNA, herein designated GAM RNA, also designated SEQ ID:269.

Another function of GAM47 is therefore inhibition of FLJ31052 (Accession NP_689591.1). Accordingly, utilities of GAM47 include diagnosis, prevention and treatment of diseases and clinical conditions associated with FLJ31052.

FLJ31121 (Accession NP_653324.1) is another GAM47 target gene, herein designated TARGET GENE. FLJ31121 BINDING SITE is a target binding site found in the 3' untranslated region of mRNA encoded by FLJ31121, corresponding to a target binding site such as BINDING SITE I, BINDING SITE II or BINDING SITE III of FIG. 8. Table 4 illustrates the complementarity of the nucleotide sequences of FLJ31121 BINDING SITE, designated SEQ ID:12105, to the nucleotide sequence of GAM47 RNA, herein designated GAM RNA, also designated SEQ ID:269.

Another function of GAM47 is therefore inhibition of FLJ31121 (Accession NP_653324.1). Accordingly, utilities of GAM47 include diagnosis, prevention and treatment of diseases and clinical conditions associated with FLJ31121.

FLJ31614 (Accession NP_689786.1) is another GAM47 target gene, herein designated TARGET GENE. FLJ31614 BINDING SITE is a target binding site found in the 3' untranslated region of mRNA encoded by FLJ31614, corresponding to a target binding site such as BINDING SITE I, BINDING SITE II or BINDING SITE III of FIG. 8. Table 4 illustrates the complementarity of the nucleotide sequences of FLJ31614 BINDING SITE, designated SEQ ID:3137, to the nucleotide sequence of GAM47 RNA, herein designated GAM RNA, also designated SEQ ID:269.

Another function of GAM47 is therefore inhibition of FLJ31614 (Accession NP_689786.1). Accordingly, utilities of GAM47 include diagnosis, prevention and treatment of diseases and clinical conditions associated with FLJ31614.

FLJ32115 (Accession NP_689534.1) is another GAM47 target gene, herein designated TARGET GENE. FLJ32115 BINDING SITE is a target binding site found in the 3' untranslated region of mRNA encoded by FLJ32115, corresponding to a target binding site such as BINDING SITE I, BINDING SITE II or BINDING SITE III of FIG. 8. Table 4 illustrates the complementarity of the nucleotide sequences of FLJ32115 BINDING SITE, designated SEQ ID:17063, to the nucleotide sequence of GAM47 RNA, herein designated GAM RNA, also designated SEQ ID:269.

Another function of GAM47 is therefore inhibition of FLJ32115 (Accession NP_689534.1). Accordingly, utilities of GAM47 include diagnosis, prevention and treatment of diseases and clinical conditions associated with FLJ32115.

FLJ32784 (Accession NP_653224.1) is another GAM47 target gene, herein designated TARGET GENE. FLJ32784 BINDING SITE is a target binding site found in the 3' untranslated region of mRNA encoded by FLJ32784, corresponding to a target binding site such as BINDING SITE I, BINDING SITE II or BINDING SITE III of FIG. 8. Table 4 illustrates the complementarity of the nucleotide sequences of FLJ32784 BINDING SITE, designated SEQ ID:15892, to the nucleotide sequence of GAM47 RNA, herein designated GAM RNA, also designated SEQ ID:269.

Another function of GAM47 is therefore inhibition of FLJ32784 (Accession NP_653224.1). Accordingly, utilities of GAM47 include diagnosis, prevention and treatment of diseases and clinical conditions associated with FLJ32784.

FLJ33084 (Accession NP_689713.1) is another GAM47 target gene, herein designated TARGET GENE. FLJ33084 BINDING SITE is a target binding site found in the 3' untranslated region of mRNA encoded by FLJ33084, corresponding to a target binding site such as BINDING SITE I, BINDING SITE II or BINDING SITE III of FIG. 8. Table 4 illustrates the complementarity of the nucleotide sequences of FLJ33084 BINDING SITE, designated SEQ ID:17824, to the nucleotide sequence of GAM47 RNA, herein designated GAM RNA, also designated SEQ ID:269.

Another function of GAM47 is therefore inhibition of FLJ33084 (Accession NP_689713.1). Accordingly, utilities of GAM47 include diagnosis, prevention and treatment of diseases and clinical conditions associated with FLJ33084.

FLJ33620 (Accession XP_087304.2) is another GAM47 target gene, herein designated TARGET GENE. FLJ33620 BINDING SITE is a target binding site found in the 5' untranslated region of multiple transcripts of mRNA encoded by FLJ33620, corresponding to a target binding site such as BINDING SITE I, BINDING SITE II or BINDING SITE III of FIG. 8. Table 4 illustrates the complementarity of the nucleotide sequences of FLJ33620 BINDING SITE, designated SEQ ID:20089, to the nucleotide sequence of GAM47 RNA, herein designated GAM RNA, also designated SEQ ID:269.

Another function of GAM47 is therefore inhibition of FLJ33620 (Accession XP_087304.2). Accordingly, utilities of GAM47 include diagnosis, prevention and treatment of diseases and clinical conditions associated with FLJ33620.

FLJ33641 (Accession NP_689900.1) is another GAM47 target gene, herein designated TARGET GENE. FLJ33641 BINDING SITE is a target binding site found in the 3' untranslated region of mRNA encoded by FLJ33641, corresponding to a target binding site such as BINDING SITE I, BINDING SITE II or BINDING SITE III of FIG. 8. Table 4 illustrates the complementarity of the nucleotide sequences of FLJ33641 BINDING SITE, designated SEQ ID:460, to the nucleotide sequence of GAM47 RNA, herein designated GAM RNA, also designated SEQ ID:269.

Another function of GAM47 is therefore inhibition of FLJ33641 (Accession NP_689900.1). Accordingly, utilities of GAM47 include diagnosis, prevention and treatment of diseases and clinical conditions associated with FLJ33641.

FLJ36208 (Accession XP_208927.2) is another GAM47 target gene, herein designated TARGET GENE. FLJ36208 BINDING SITE is a target binding site found in the 5' untranslated region of mRNA encoded by FLJ36208, corresponding to a target binding site such as BINDING SITE I, BINDING SITE II or BINDING SITE III of FIG. 8. Table 4 illustrates the complementarity of the nucleotide sequences of FLJ36208 BINDING SITE, designated SEQ ID:17922, to the nucleotide sequence of GAM47 RNA, herein designated GAM RNA, also designated SEQ ID:269.

Another function of GAM47 is therefore inhibition of FLJ36208 (Accession XP_208927.2). Accordingly, utilities of GAM47 include diagnosis, prevention and treatment of diseases and clinical conditions associated with FLJ36208.

FLJ36888 (Accession NP_849152.1) is another GAM47 target gene, herein designated TARGET GENE. FLJ36888 BINDING SITE is a target binding site found in the 3' untranslated region of multiple transcripts of mRNA encoded by FLJ36888, corresponding to a target binding site such as BINDING SITE I, BINDING SITE II or BINDING SITE III of FIG. 8. Table 4 illustrates the complementarity of the nucleotide sequences of FLJ36888 BINDING SITE, designated SEQ ID:2080, to the nucleotide sequence of GAM47 RNA, herein designated GAM RNA, also designated SEQ ID:269.

Another function of GAM47 is therefore inhibition of FLJ36888 (Accession NP_849152.1). Accordingly, utilities of GAM47 include diagnosis, prevention and treatment of diseases and clinical conditions associated with FLJ36888.

FLJ36888 (Accession XP_059053.7) is another GAM47 target gene, herein designated TARGET GENE. FLJ36888 BINDING SITE is a target binding site found in the 3' untranslated region of multiple transcripts of mRNA encoded by FLJ36888, corresponding to a target binding site such as BINDING SITE I, BINDING SITE II or BINDING SITE III of FIG. 8. Table 4 illustrates the complementarity of the nucleotide sequences of FLJ36888 BINDING SITE, designated SEQ ID:2080, to the nucleotide sequence of GAM47 RNA, herein designated GAM RNA, also designated SEQ ID:269.

Another function of GAM47 is therefore inhibition of FLJ36888 (Accession XP_059053.7). Accordingly, utilities of GAM47 include diagnosis, prevention and treatment of diseases and clinical conditions associated with FLJ36888.

FLJ37735 (Accession NP_787087.1) is another GAM47 target gene, herein designated TARGET GENE. FLJ37735 BINDING SITE is a target binding site found in the 3' untranslated region of mRNA encoded by FLJ37735, corresponding to a target binding site such as BINDING SITE I, BINDING SITE II or BINDING SITE III of FIG. 8. Table 4 illustrates the complementarity of the nucleotide sequences of FLJ37735 BINDING SITE, designated SEQ ID:890, to the nucleotide sequence of GAM47 RNA, herein designated GAM RNA, also designated SEQ ID:269.

Another function of GAM47 is therefore inhibition of FLJ37735 (Accession NP_787087.1). Accordingly, utilities of GAM47 include diagnosis, prevention and treatment of diseases and clinical conditions associated with FLJ37735.

FLJ37927 (Accession NP_689836.1) is another GAM47 target gene, herein designated TARGET GENE. FLJ37927 BINDING SITE is a target binding site found in the 3' untranslated region of mRNA encoded by FLJ37927, corresponding to a target binding site such as BINDING SITE I, BINDING SITE II or BINDING SITE III of FIG. 8. Table 4 illustrates the complementarity of the nucleotide sequences of FLJ37927 BINDING SITE, designated SEQ ID:832, to the nucleotide sequence of GAM47 RNA, herein designated GAM RNA, also designated SEQ ID:269.

Another function of GAM47 is therefore inhibition of FLJ37927 (Accession NP_689836.1). Accordingly, utilities of GAM47 include diagnosis, prevention and treatment of diseases and clinical conditions associated with FLJ37927.

FLJ38359 (Accession NP_689731.1) is another GAM47 target gene, herein designated TARGET GENE. FLJ38359 BINDING SITE is a target binding site found in the 3' untranslated region of mRNA encoded by FLJ38359, corresponding to a target binding site such as BINDING SITE I, BINDING SITE II or BINDING SITE III of FIG. 8. Table 4 illustrates the complementarity of the nucleotide sequences of FLJ38359 BINDING SITE, designated SEQ ID:7421, to the nucleotide sequence of GAM47 RNA, herein designated GAM RNA, also designated SEQ ID:269.

Another function of GAM47 is therefore inhibition of FLJ38359 (Accession NP_689731.1). Accordingly, utilities of GAM47 include diagnosis, prevention and treatment of diseases and clinical conditions associated with FLJ38359.

FLJ38705 (Accession NP_776193.1) is another GAM47 target gene, herein designated TARGET GENE. FLJ38705 BINDING SITE is a target binding site found in the 3' untranslated region of mRNA encoded by FLJ38705, corresponding to a target binding site such as BINDING SITE I, BINDING SITE II or BINDING SITE III of FIG. 8. Table 4 illustrates the complementarity of the nucleotide sequences of FLJ38705 BINDING SITE, designated SEQ ID:13655, to the nucleotide sequence of GAM47 RNA, herein designated GAM RNA, also designated SEQ ID:269.

Another function of GAM47 is therefore inhibition of FLJ38705 (Accession NP_776193.1). Accordingly, utilities of GAM47 include diagnosis, prevention and treatment of diseases and clinical conditions associated with FLJ38705.

FLJ90254 (Accession NP_775962.1) is another GAM47 target gene, herein designated TARGET GENE. FLJ90254 BINDING SITE is a target binding site found in the 3' untranslated region of mRNA encoded by FLJ90254, corresponding to a target binding site such as BINDING SITE I, BINDING SITE II or BINDING SITE III of FIG. 8. Table 4 illustrates the complementarity of the nucleotide sequences of FLJ90254 BINDING SITE, designated SEQ ID:4053, to the nucleotide sequence of GAM47 RNA, herein designated GAM RNA, also designated SEQ ID:269.

Another function of GAM47 is therefore inhibition of FLJ90254 (Accession NP_775962.1). Accordingly, utilities of GAM47 include diagnosis, prevention and treatment of diseases and clinical conditions associated with FLJ90254.

FLJ90583 (Accession NP_776189.1) is another GAM47 target gene, herein designated TARGET GENE. FLJ90583 BINDING SITE is a target binding site found in the 3' untranslated region of mRNA encoded by FLJ90583, corresponding to a target binding site such as BINDING SITE I, BINDING SITE II or BINDING SITE III of FIG. 8. Table 4 illustrates the complementarity of the nucleotide sequences of FLJ90583 BINDING SITE, designated SEQ ID:4834, to the nucleotide sequence of GAM47 RNA, herein designated GAM RNA, also designated SEQ ID:269.

Another function of GAM47 is therefore inhibition of FLJ90583 (Accession NP_776189.1). Accordingly, utilities of GAM47 include diagnosis, prevention and treatment of diseases and clinical conditions associated with FLJ90583.

FOXP4 (Accession NP_612466.1) is another GAM47 target gene, herein designated TARGET GENE. FOXP4 BINDING SITE is a target binding site found in the 3' untranslated region of mRNA encoded by FOXP4, corresponding to a target binding site such as BINDING SITE I, BINDING SITE II or BINDING SITE III of FIG. 8. Table 4 illustrates the complementarity of the nucleotide sequences of FOXP4 BINDING SITE, designated SEQ ID:4743, to the nucleotide sequence of GAM47 RNA, herein designated GAM RNA, also designated SEQ ID:269.

Another function of GAM47 is therefore inhibition of FOXP4 (Accession NP_612466.1). Accordingly, utilities of GAM47 include diagnosis, prevention and treatment of diseases and clinical conditions associated with FOXP4.

FRCP2 (Accession NP_715637.1) is another GAM47 target gene, herein designated TARGET GENE. FRCP2 BINDING SITE is a target binding site found in the 3' untranslated region of mRNA encoded by FRCP2, corresponding to a target binding site such as BINDING SITE I, BINDING SITE II or BINDING SITE III of FIG. 8. Table 4 illustrates the complementarity of the nucleotide sequences of FRCP2 BINDING SITE, designated SEQ ID:7324, to the nucleotide sequence of GAM47 RNA, herein designated GAM RNA, also designated SEQ ID:269.

Another function of GAM47 is therefore inhibition of FRCP2 (Accession NP_715637.1). Accordingly, utilities of GAM47 include diagnosis, prevention and treatment of diseases and clinical conditions associated with FRCP2.

Fucosyltransferase 6 (alpha (1,3) fucosyltransferase) (FUT6, Accession NP_000141.1) is another GAM47 target gene, herein designated TARGET GENE. FUT6 BINDING SITE is a target binding site found in the 3' untranslated region of mRNA encoded by FUT6, corresponding to a target binding site such as BINDING SITE I, BINDING SITE II or BINDING SITE III of FIG. 8. Table 4 illustrates the complementarity of the nucleotide sequences of FUT6 BINDING SITE, designated SEQ ID:979, to the nucleotide sequence of GAM47 RNA, herein designated GAM RNA, also designated SEQ ID:269.

Another function of GAM47 is therefore inhibition of Fucosyltransferase 6 (alpha (1,3) fucosyltransferase) (FUT6, Accession NP_000141.1), a gene which is involved in the biosynthesis of the e-selectin ligand, sialyl-lewis x. catalyzes the transfer of fucose from gdp-beta-fucose to alpha-2,3 sialylated substrates. Accordingly, utilities of GAM47 include diagnosis, prevention and treatment of diseases and clinical conditions associated with FUT6.

The function of FUT6 has been established by previous studies. The alpha-1,3-fucosyltransferases constitute a large family of glycosyltransferases with a high degree of homology. The enzymes of this family comprise 3 main activity patterns called myeloid, plasma, and Lewis, based on their capacity to transfer alpha- L-fucose to distinct oligosaccharide acceptors, their sensitivity to N-ethylmaleimide inhibition, their cation requirements, and their tissue-specific expression patterns. The different categories of alpha-1,3-fucosyltransferases are sequentially expressed during embryo-fetal development.

Full details of the abovementioned studies are described in the following publications, the disclosure of which are hereby incorporated by reference:

Brinkman-Van der Linden, E. C. M.; Mollicone, R.; Oriol, R.; Larson, G.; Van den Eijnden, D. H.; Van Dijk, W.: A missense mutation in the FUT6 gene results in total absence of alpha-3-fucosylation of human alpha-1-acid glycoprotein. J. Biol. Chem. 271:14492-14495, 1996; and Cameron, H. S.; Szczepaniak, D.; Weston, B. W.: Expression of human chromosome 19p alpha-(1,3)-fucosyltransferase genes in normal tissues: alternative splicing, polyadenylation, and is.

Further studies establishing the function and utilities of FUT6 are found in John Hopkins OMIM database record ID 136836, and in cited publications listed in Table 5, which are hereby incorporated by reference. Gamma-aminobutyric acid (gaba) b receptor, 1 (GABBR1, Accession NP_068704.1) is another GAM47 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:9955, to the nucleotide sequence of GAM47 RNA, herein designated GAM RNA, also designated SEQ ID:269.

Another function of GAM47 is therefore inhibition of Gamma-aminobutyric acid (gaba) b receptor, 1 (GABBR1, Accession NP_068704.1). Accordingly, utilities of GAM47 include diagnosis, prevention and treatment of diseases and clinical conditions associated with GABBR1.

Gamma-aminobutyric acid (gaba) b receptor, 1 (GABBR1, Accession NP_068705.1) is another GAM47 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:9955, to the nucleotide sequence of GAM47 RNA, herein designated GAM RNA, also designated SEQ ID:269.

Another function of GAM47 is therefore inhibition of Gamma-aminobutyric acid (gaba) b receptor, 1 (GABBR1, Accession NP_068705.1). Accordingly, utilities of GAM47 include diagnosis, prevention and treatment of diseases and clinical conditions associated with GABBR1.

Gamma-aminobutyric acid (gaba) b receptor, 1 (GABBR1, Accession NP_001461.1) is another GAM47 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:9955, to the nucleotide sequence of GAM47 RNA, herein designated GAM RNA, also designated SEQ ID:269.

Another function of GAM47 is therefore inhibition of Gamma-aminobutyric acid (gaba) b receptor, 1 (GABBR1, Accession NP_001461.1). Accordingly, utilities of GAM47 include diagnosis, prevention and treatment of diseases and clinical conditions associated with GABBR1.

Gamma-aminobutyric acid (gaba) b receptor, 1 (GABBR1, Accession NP_068703.1) is another GAM47 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:9955, to the nucleotide sequence of GAM47 RNA, herein designated GAM RNA, also designated SEQ ID:269.

Another function of GAM47 is therefore inhibition of Gamma-aminobutyric acid (gaba) b receptor, 1 (GABBR1, Accession NP_068703.1). Accordingly, utilities of GAM47 include diagnosis, prevention and treatment of diseases and clinical conditions associated with GABBR1.

Glutamate decarboxylase 1 (brain, 67 kda) (GAD1, Accession NP_000808.1) is another GAM47 target gene, herein designated TARGET GENE. GAD1 BINDING SITE is a target binding site found in the 5' untranslated region of multiple transcripts of mRNA encoded by GAD1, corresponding to a target binding site such as BINDING SITE I, BINDING SITE II or BINDING SITE III of FIG. 8. Table 4 illustrates the complementarity of the nucleotide sequences of GAD1 BINDING SITE, designated SEQ ID:10685, to the nucleotide sequence of GAM47 RNA, herein designated GAM RNA, also designated SEQ ID:269.

Another function of GAM47 is therefore inhibition of Glutamate decarboxylase 1 (brain, 67 kda) (GAD1, Accession NP_000808.1), a gene which catalyzes the conversion of glutamic acid to gamma-aminobutyric acid. Accordingly, utilities of GAM47 include diagnosis, prevention and treatment of diseases and clinical conditions associated with GAD1.

The function of GAD1 has been established by previous studies. Using a genomic probe from a human fetal brain library, Sparkes et al. (1987) probed the DNA of a mouse/human somatic cell hybrid panel and assigned the GAD gene to human chromosome 2. Kelly et al. (1992) confirmed the assignment of GAD1 to chromosome 2, using PCR to amplify specifically the human sequence in rodent/human somatic cell hybrid DNAs. They also reported the full nucleotide sequence of the cDNA and the deduced amino acid sequence. Bu et al. (1992) mapped the GAD1 gene to 2q31 by in situ hybridization of fluorescently labeled GAD probes to human chromosomes. They demonstrated that the GAD1 gene encodes a polypeptide of 67,000 molecular weight, with 594 amino acid residues. The GAD2 gene (OMIM Ref. No. 138275), located on 10p11.23, encodes a polypeptide of 65,000 molecular weight (GAD65), with 585 amino acid residues. Brilliant et al. (1990) showed by Southern analysis of mouse-hamster hybrid cells and by interspecific backcrosses and recombinant inbred strains that the mouse equivalent (Gad1) is located on chromosome 2 and that an apparent pseudogene is located on mouse chromosome 10. The mouse Gad1 locus is part of a conserved homology between mouse chromosome 2 and human 2q. By in situ hybridization, Edelhoff et al. (1993) also assigned GAD1 to human 2q31 and to mouse chromosome 2D in a known region of conservation between human and mouse.

Animal model experiments lend further support to the function of GAD1. The remaining exon-intron boundaries occur at identical positions in the 2 cDNAs, suggesting that they derive from a common ancestral GAD gene. In addition to its role as an inhibitory neurotransmitter, GABA is presumed to be involved in the development and plasticity of the nervous system. GABA is synthesized by glutamic acid decarboxylase, but the respective roles of its 2 isoforms, GAD65 and GAD67, had not been determined. Asada et al. (1996, 1997) undertook the selective elimination of each GAD isoform by gene targeting to clarify this issue. Asada et al. (1996) found that GAD65 -/- mice showed no change in brain GABA content or animal behavior, except for a slight increase in susceptibility to seizures. Asada et al. (1997) produced GAD67 -/- mice. These mice were born at the expected frequency but died of severe cleft palate during the first morning after birth. GAD activities and GABA contents were reduced to 20 and 7%, respectively, in the cerebral cortex of the newborn GAD67 -/- mice. Their brains, however, did not show any discernible defects. Previous pharmacologic and genetic investigations suggested the involvement of GABA in palate formation, but this was the first demonstration of a role for GAD67-derived GABA in the development of nonneural tissue. Independently, Condie et al. (1997) found defects in the formation of the palate in mice with a targeted mutation in the gene encoding GAD67. Previous observations had suggested a role of GABA in palate development. Analysis of mice with mutations in the beta-3 gamma-GABA receptor (GABRB3; 137192) had demonstrated that these mutations are associated with cleft secondary palate in mice. The phenotype in the GABRB3 mutants showed that this gene is somehow involved in palate development but did not demonstrate that GABA is the ligand involved in this particular function. The results of Condie et al. (1997), demonstrating a similar phenotype between the receptor and ligand mutations, demonstrated a role for GABA signaling in normal palate development.

It is appreciated that the abovementioned animal model for GAD1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Asada, H.; Kawamura, Y.; Maruyama, K.; Kume, H.; Ding, R.-G.; Ji, F. Y.; Kanbara, N.; Kuzume, H.; Sanbo, M.; Yagi, T.; Obata, K.: Mice lacking the 65 kDa isoform of glutamic acid decarboxylase (GAD65) maintain normal levels of GAD67 and GABA in their brains but are susceptible to seizures. Biochem. Biophys. Res. Commun. 229:891-895, 1996; and Scriver, C. R.; Hutchison, J. H.: The vitamin B6 deficiency syndrome in human infancy: biochemical and clinical observations. Pediatrics 31:240-250, 1963.

Further studies establishing the function and utilities of GAD1 are found in John Hopkins OMIM database record ID 605363, and in cited publications listed in Table 5, which are hereby incorporated by reference. Udp-n-acetyl-alpha-d-galactosamine:polypeptide n-acetylgalactosaminyltransferase 10 (galnac-t10) (GALNT10, Accession NP_060010.2) is another GAM47 target gene, herein designated TARGET GENE. GALNT10 BINDING SITE is a target binding site found in the 5' untranslated region of mRNA encoded by GALNT10, corresponding to a target binding site such as BINDING SITE I, BINDING SITE II or BINDING SITE III of FIG. 8. Table 4 illustrates the complementarity of the nucleotide sequences of GALNT10 BINDING SITE, designated SEQ ID:8570, to the nucleotide sequence of GAM47 RNA, herein designated GAM RNA, also designated SEQ ID:269.

Another function of GAM47 is therefore inhibition of Udp-n-acetyl-alpha-d-galactosamine:polypeptide n-acetylgalactosaminyltransferase 10 (galnac-t10) (GALNT10, Accession NP_060010.2). Accordingly, utilities of GAM47 include diagnosis, prevention and treatment of diseases and clinical conditions associated with GALNT10.

Galactose-1-phosphate uridylyltransferase (GALT, Accession NP_667343.1) is another GAM47 target gene, herein designated TARGET GENE. GALT BINDING SITE is a target binding site found in the 3' untranslated region of multiple transcripts of mRNA encoded by GALT, corresponding to a target binding site such as BINDING SITE I, BINDING SITE II or BINDING SITE III of FIG. 8. Table 4 illustrates the complementarity of the nucleotide sequences of GALT BINDING SITE, designated SEQ ID:14804, to the nucleotide sequence of GAM47 RNA, herein designated GAM RNA, also designated SEQ ID:269.

Another function of GAM47 is therefore inhibition of Galactose-1-phosphate uridylyltransferase (GALT, Accession NP_667343.1). Accordingly, utilities of GAM47 include diagnosis, prevention and treatment of diseases and clinical conditions associated with GALT.

Galactose-1-phosphate uridylyltransferase (GALT, Accession NP_667342.1) is another GAM47 target gene, herein designated TARGET GENE. GALT BINDING SITE is a target binding site found in the 3' untranslated region of multiple transcripts of mRNA encoded by GALT, corresponding to a target binding site such as BINDING SITE I, BINDING SITE II or BINDING SITE III of FIG. 8. Table 4 illustrates the complementarity of the nucleotide sequences of GALT BINDING SITE, designated SEQ ID:14804, to the nucleotide sequence of GAM47 RNA, herein designated GAM RNA, also designated SEQ ID:269.

Another function of GAM47 is therefore inhibition of Galactose-1-phosphate uridylyltransferase (GALT, Accession NP_667342.1). Accordingly, utilities of GAM47 include diagnosis, prevention and treatment of diseases and clinical conditions associated with GALT.

Giant axonal neuropathy (gigaxonin) (GAN, Accession NP_071324.1) is another GAM47 target gene, herein designated TARGET GENE. GAN BINDING SITE is a target binding site found in the 3' untranslated region of mRNA encoded by GAN, corresponding to a target binding site such as BINDING SITE I, BINDING SITE II or BINDING SITE III of FIG. 8. Table 4 illustrates the complementarity of the nucleotide sequences of GAN BINDING SITE, designated SEQ ID:1594, to the nucleotide sequence of GAM47 RNA, herein designated GAM RNA, also designated SEQ ID:269.

Another function of GAM47 is therefore inhibition of Giant axonal neuropathy (gigaxonin) (GAN, Accession NP_071324.1), a gene which plays an important role in neurofilament architecture. and therefore may be associated with Giant axonal neuropathy 1. Accordingly, utilities of GAM47 include diagnosis, prevention and treatment of Giant axonal neuropathy 1., and of other diseases and clinical conditions associated with GAN.

The function of GAN has been established by previous studies. Giant axonal neuropathy (GAN; 256850), a severe autosomal recessive sensorineural neuropathy affecting both the peripheral nerves and the central nervous system, is characterized by neurofilament accumulation, leading to segmental distention of axons. The neuropathy is part of a generalized disorganization of the cytoskeletal intermediate filaments (IFs), to which neurofilaments belong, as abnormal aggregation of multiple tissue- specific IFs has been reported in this disorder: vimentin (VIM; 193060) in endothelial cells, Schwann cells, and cultured skin fibroblasts, and glial fibrillary acidic protein (GFAP; 137780) in astrocytes (Prineas et al., 1976; Pena, 1982; Bousquet et al., 1996). Keratin intermediate filaments also seem to be altered, as most patients present characteristic curly or kinky hairs (Treiber-Held et al., 1994). Bomont et al. (2000) used a positional cloning approach to isolate a novel, ubiquitously expressed gene that encoded a protein they named gigaxonin and contained mutations associated with giant axonal neuropathy. Gigaxonin contains an N-terminal BTB (broad-complex, tramtrack, and bric-a-brac) domain followed by 6 kelch repeats, which were predicted to adopt a beta-propeller shape. Distantly related proteins sharing a similar domain organization have various functions associated with the cytoskeleton, predicting that gigaxonin is a novel and distinct cytoskeletal protein that may represent a general pathologic target for other neurodegenerative disorders with alterations in the neurofilament network.

Full details of the abovementioned studies are described in the following publications, the disclosure of which are hereby incorporated by reference:

Bomont, P.; Cavalier, L.; Blondeau, F.; Ben Hamida, C.; Belal, S.; Tazir, M.; Demir, E.; Topaloglu, H.; Korinthenberg, R.; Tuysuz, B.; Landrieu, P.; Hentati, F.; Koenig, M.: The gene encoding gigaxonin, a new member of the cytoskeletal BTB/kelch repeat family, is mutated in giant axonal neuropathy. Nature Genet. 26:370-374, 2000; and Bousquet, O.; Basseville, M.; Vila-Porcile, E.; Billette de Villemeur, T.; Hauw, J.-J.; Landrieu, P.; Portier, M.-M.: Aggregation of a subpopulation of vimentin filaments in cultured.

Further studies establishing the function and utilities of GAN are found in John Hopkins OMIM database record ID 605379, and in cited publications listed in Table 5, which are hereby incorporated by reference. Gata binding protein 2 (GATA2, Accession NP_116027.2) is another GAM47 target gene, herein designated TARGET GENE. GATA2 BINDING SITE is a target binding site found in the 3' untranslated region of mRNA encoded by GATA2, corresponding to a target binding site such as BINDING SITE I, BINDING SITE II or BINDING SITE III of FIG. 8. Table 4 illustrates the complementarity of the nucleotide sequences of GATA2 BINDING SITE, designated SEQ ID:3495, to the nucleotide sequence of GAM47 RNA, herein designated GAM RNA, also designated SEQ ID:269.

Another function of GAM47 is therefore inhibition of Gata binding protein 2 (GATA2, Accession NP_116027.2). Accordingly, utilities of GAM47 include diagnosis, prevention and treatment of diseases and clinical conditions associated with GATA2.

GBP5 (Accession NP_443174.1) is another GAM47 target gene, herein designated TARGET GENE. GBP5 BINDING SITE1 and GBP5 BINDING SITE2 are target binding sites found in untranslated regions of mRNA encoded by GBP5, corresponding to target binding sites such as BINDING SITE I, BINDING SITE II or BINDING SITE III of FIG. 8. Table 4 illustrates the complementarity of the nucleotide sequences of GBP5 BINDING SITE1 and GBP5 BINDING SITE2, designated SEQ ID:14365 and SEQ ID:10024 respectively, to the nucleotide sequence of GAM47 RNA, herein designated GAM RNA, also designated SEQ ID:269.

Another function of GAM47 is therefore inhibition of GBP5 (Accession NP_443174.1). Accordingly, utilities of GAM47 include diagnosis, prevention and treatment of diseases and clinical conditions associated with GBP5.

Gcn5 general control of amino-acid synthesis 5-like 2 (yeast) (GCN5L2, Accession NP_066564.1) is another GAM47 target gene, herein designated TARGET GENE. GCN5L2 BINDING SITE is a target binding site found in the 3' untranslated region of mRNA encoded by GCN5L2, corresponding to a target binding site such as BINDING SITE I, BINDING SITE II or BINDING SITE III of FIG. 8. Table 4 illustrates the complementarity of the nucleotide sequences of GCN5L2 BINDING SITE, designated SEQ ID:1805, to the nucleotide sequence of GAM47 RNA, herein designated GAM RNA, also designated SEQ ID:269.

Another function of GAM47 is therefore inhibition of Gcn5 general control of amino-acid synthesis 5-like 2 (yeast) (GCN5L2, Accession NP_066564.1), a gene which functions as a histone acetyltransferase (hat) to promote transcriptional activation. Accordingly, utilities of GAM47 include diagnosis, prevention and treatment of diseases and clinical conditions associated with GCN5L2.

The function of GCN5L2 has been established by previous studies. The ability of DNA-bound transcriptional activator proteins to enhance the initiation rate of RNA polymerase II-mediated gene transcription hinges on their potential to interact functionally with the general transcription machinery bound at the basal promoter. Candau et al. (1996) identified expressed sequence tags of possible human homologs of the yeast transcriptional activator proteins ADA2 and GCN5. Full-length cDNAs, designated TADA2L (OMIM Ref. No. 602276) and GCN5L2, were isolated from testis. The GCN5L2 predicted 427-amino acid protein is 43% identical to the yeast protein. GCN5L2 was shown to function experimentally as an adaptor in a human cell line. Yang et al. (1996) also cloned GCN5L2; their clone had an additional 49 N-terminal amino acids. Yang et al. (1996) reported that GCN5L2 has significant histone acetyltransferase activity with core histones, but not with nucleosome core particles. By Northern blot analysis, Carter et al. (1997) detected a 4.0-kb GCN5L2 message in all tissues examined, with most abundant expression in ovary.

Animal model experiments lend further support to the function of GCN5L2. Histone acetyltransferases regulate transcription. Gcn5 (encoded by Gcn5l2) and Pcaf (OMIM Ref. No. 602305), histone acetyltransferases in the mouse, share similar sequences and enzymatic activities. Both interact with p300 and CBP, encoded by Ep300 (OMIM Ref. No. 602700) and Crebbp (OMIM Ref. No. 600140), respectively, which are 2 other histone acetyltransferases that integrate multiple signaling pathways. Xu et al. (2000) showed that the gene Pcaf is dispensable in mice. In contrast, Gcn5l2-null embryos died during embryogenesis. Growth was severely retarded by day 8.5 postcoitum, and embryos failed to form dorsal mesoderm lineages, including chordamesoderm and paraxial mesoderm. Loss of dorsal mesoderm lineages was due to a high incidence of apoptosis in the Gcn5l2 mutants that began before the onset of morphologic abnormalities. Embryos null for both Gcn5l2 and Pcaf showed even more severe defects, indicating that these histone acetyltransferases have overlapping function during embryogenesis.

It is appreciated that the abovementioned animal model for GCN5L2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Candau, R.; Moore, P. A.; Wang, L.; Barlev, N.; Ying, C. Y.; Rosen, C. A.; Berger, S. L.: Identification of human proteins functionally conserved with the yeast putative adaptors ADA2 and GCN5. Molec. Cell. Biol. 16:593-602, 1996; and Carter, K. C.; Wang, L.; Shell, B. K.; Zamir, I.; Berger, S. L.; Moore, P. A.: The human transcriptional adaptor genes TADA2L and GCN5L2 colocalize to chromosome 17q12-q21 and display.

Further studies establishing the function and utilities of GCN5L2 are found in John Hopkins OMIM database record ID 602301, and in cited publications listed in Table 5, which are hereby incorporated by reference. Growth differentiation factor 1 (GDF1, Accession NP_001483.2) is another GAM47 target gene, herein designated TARGET GENE. GDF1 BINDING SITE is a target binding site found in the 5' untranslated region of mRNA encoded by GDF1, corresponding to a target binding site such as BINDING SITE I, BINDING SITE II or BINDING SITE III of FIG. 8. Table 4 illustrates the complementarity of the nucleotide sequences of GDF1 BINDING SITE, designated SEQ ID:13970, to the nucleotide sequence of GAM47 RNA, herein designated GAM RNA, also designated SEQ ID:269.

Another function of GAM47 is therefore inhibition of Growth differentiation factor 1 (GDF1, Accession NP_001483.2). Accordingly, utilities of GAM47 include diagnosis, prevention and treatment of diseases and clinical conditions associated with GDF1.

Glioma tumor suppressor candidate region gene 1 (GLTSCR1, Accession NP_056526.1) is another GAM47 target gene, herein designated TARGET GENE. GLTSCR1

BINDING SITE is a target binding site found in the 5' untranslated region of mRNA encoded by GLTSCR1, corresponding to a target binding site such as BINDING SITE I, BINDING SITE II or BINDING SITE III of FIG. 8. Table 4 illustrates the complementarity of the nucleotide sequences of GLTSCR1 BINDING SITE, designated SEQ ID:18169, to the nucleotide sequence of GAM47 RNA, herein designated GAM RNA, also designated SEQ ID:269.

Another function of GAM47 is therefore inhibition of Glioma tumor suppressor candidate region gene 1 (GLTSCR1, Accession NP_056526.1). Accordingly, utilities of GAM47 include diagnosis, prevention and treatment of diseases and clinical conditions associated with GLTSCR1.

Guanosine monophosphate reductase (GMPR, Accession NP_006868.2) is another GAM47 target gene, herein designated TARGET GENE. GMPR BINDING SITE is a target binding site found in the 3' untranslated region of mRNA encoded by GMPR, corresponding to a target binding site such as BINDING SITE I, BINDING SITE II or BINDING SITE III of FIG. 8. Table 4 illustrates the complementarity of the nucleotide sequences of GMPR BINDING SITE, designated SEQ ID:9389, to the nucleotide sequence of GAM47 RNA, herein designated GAM RNA, also designated SEQ ID:269.

Another function of GAM47 is therefore inhibition of Guanosine monophosphate reductase (GMPR, Accession NP_006868.2), a gene which functions in the conversion and maintaining the intracellular balance of a and g nucleotides. Accordingly, utilities of GAM47 include diagnosis, prevention and treatment of diseases and clinical conditions associated with GMPR.

The function of GMPR has been established by previous studies. Kanno et al. (1989) suggested that red cell G6PD is a fusion protein consisting of an NH2- terminus encoded by chromosome 6 and a COOH-portion coded by an X chromosome. This was subsequently disproved by Beutler et al. (1990) and by Mason et al. (1990) who also presented evidence that the gene that had been mapped to chromosome 6 by Southern hybridization to flow-sorted chromosomes and to somatic cell hybrids was in fact GMP reductase. By fluorescence in situ hybridization, Murano et al. (1994) mapped the GMPR gene to 6p23. Henikoff and Smith (1989) had pointed out similarities between the sequence described by Kanno et al. (1989) for the chromosome 6-encoded gene and the sequence of E. coli GMP reductase. Kondoh et al. (1991) further delineated the structure of the gene. It spans about 50 kb and is composed of 9 exons, which encode 345 amino acid residues. The gene contains 2 potential SpI binding sites within exon 1, and a functional, atypical polyadenylation signal in exon 9.

Full details of the abovementioned studies are described in the following publications, the disclosure of which are hereby incorporated by reference:

Kanno, H.; Huang, I.-Y.; Kan, Y. W.; Yoshida, A.: Two structural genes on different chromosomes are required for encoding the major subunit of human red cell glucose-6-phosphate dehydrogenase. Cell 58:595-606, 1989; and Murano, I.; Tsukahara, M.; Kajii, T.; Yoshida, A.: Mapping of the human guanosine monophosphate reductase gene (GMPR) to chromosome 6p23 by fluorescence in situ hybridization. Genomics.

Further studies establishing the function and utilities of GMPR are found in John Hopkins OMIM database record ID 139265, and in cited publications listed in Table 5, which are hereby incorporated by reference. Guanine nucleotide binding protein (g protein), alpha 15 (gq class) (GNA15, Accession NP_002059.1) is another GAM47 target gene, herein designated TARGET GENE. GNA15 BINDING SITE is a target binding site found in the 3' untranslated region of mRNA encoded by GNA15, corresponding to a target binding site such as BINDING SITE I, BINDING SITE II or BINDING SITE III of FIG. 8. Table 4 illustrates the complementarity of the nucleotide sequences of GNA15 BINDING SITE, designated SEQ ID:1917, to the nucleotide sequence of GAM47 RNA, herein designated GAM RNA, also designated SEQ ID:269.

Another function of GAM47 is therefore inhibition of Guanine nucleotide binding protein (g protein), alpha 15 (gq class) (GNA15, Accession NP_002059.1). Accordingly, utilities of GAM47 include diagnosis, prevention and treatment of diseases and clinical conditions associated with GNA15.

Glycoprotein ib (platelet), alpha polypeptide (GP1BA, Accession NP_000164.1) is another GAM47 target gene, herein designated TARGET GENE. GP1BA BINDING SITE is a target binding site found in the 5' untranslated region of mRNA encoded by GP1BA, corresponding to a target binding site such as BINDING SITE I, BINDING SITE II or BINDING SITE III of FIG. 8. Table 4 illustrates the complementarity of the nucleotide sequences of GP1BA BINDING SITE, designated SEQ ID:19965, to the nucleotide sequence of GAM47 RNA, herein designated GAM RNA, also designated SEQ ID:269.

Another function of GAM47 is therefore inhibition of Glycoprotein ib (platelet), alpha polypeptide (GP1BA, Accession NP_000164.1). Accordingly, utilities of GAM47 include diagnosis, prevention and treatment of diseases and clinical conditions associated with GP1BA.

G protein-coupled receptor 74 (GPR74, Accession NP_444264.1) is another GAM47 target gene, herein designated TARGET GENE. GPR74 BINDING SITE is a target binding site found in the 5' untranslated region of multiple transcripts of mRNA encoded by GPR74, corresponding to a target binding site such as BINDING SITE I, BINDING SITE II or BINDING SITE III of FIG. 8. Table 4 illustrates the complementarity of the nucleotide sequences of GPR74 BINDING SITE, designated SEQ ID:16837, to the nucleotide sequence of GAM47 RNA, herein designated GAM RNA, also designated SEQ ID:269.

Another function of GAM47 is therefore inhibition of G protein-coupled receptor 74 (GPR74, Accession NP_444264.1). Accordingly, utilities of GAM47 include diagnosis, prevention and treatment of diseases and clinical conditions associated with GPR74.

G protein-coupled receptor 92 (GPR92, Accession NP_065133.1) is another GAM47 target gene, herein designated TARGET GENE. GPR92 BINDING SITE is a target binding site found in the 3' untranslated region of mRNA encoded by GPR92, corresponding to a target binding site such as BINDING SITE I, BINDING SITE II or BINDING SITE III of FIG. 8. Table 4 illustrates the complementarity of the nucleotide sequences of GPR92 BINDING SITE, designated SEQ ID:17507, to the nucleotide sequence of GAM47 RNA, herein designated GAM RNA, also designated SEQ ID:269.

Another function of GAM47 is therefore inhibition of G protein-coupled receptor 92 (GPR92, Accession NP_065133.1), a gene which transduces extracellular signals through heterotrimeric G proteins. Accordingly, utilities of GAM47 include diagnosis, prevention and treatment of diseases and clinical conditions associated with GPR92.

The function of GPR92 has been established by previous studies. Lee et al. (2001) identified GPR92, which they designated GPR93, in a genomic database using the sequences of the cysteinyl leukotriene-2 receptor (OMIM Ref. No. 605666) as query. GPR92 encodes a deduced 372-amino acid protein that shares 36 to 40% sequence identity in the transmembrane regions with the G protein-coupled purinergic receptor P2Y5, GPR23 (OMIM Ref. No. 300086), and GPR17 (OMIM Ref. No. 603071). Lee et al. (2001) mapped the GPR92 gene to chromosome 12 based on sequence similarity between the GPR92 sequence and a BAC clone (GenBank AC006087) localized to chromosome 12. The ADHR Consortium (2000) identified GPR92 near the FGF23 gene on chromosome 12p13.

Full details of the abovementioned studies are described in the following publications, the disclosure of which are hereby incorporated by reference:

Lee, D. K.; Nguyen, T.; Lynch, K. R.; Cheng, R.; Vanti, W. B.; Arkhitko, O.; Lewis, T.; Evans, J. F.; George, S. R.; O'Dowd, B. F.: Discovery and mapping of ten novel G protein-coupled receptor genes. Gene 275:83-91, 2001; and The ADHR Consortium: Autosomal dominant hypophosphataemic rickets is associated with mutations in FGF23. Nature Genet. 26:345-348, 2000.

Further studies establishing the function and utilities of GPR92 are found in John Hopkins OMIM database record ID 606926, and in cited publications listed in Table 5, which are hereby incorporated by reference. Glutathione s-transferase m5 (GSTM5, Accession NP_000842.2) is another GAM47 target gene, herein designated TARGET GENE. GSTM5 BINDING SITE is a target binding site found in the 3' untranslated region of mRNA encoded by GSTM5, corresponding to a target binding site such as BINDING SITE I, BINDING SITE II or BINDING SITE III of FIG. 8. Table 4 illustrates the complementarity of the nucleotide sequences of GSTM5 BINDING SITE, designated SEQ ID:10604, to the nucleotide sequence of GAM47 RNA, herein designated GAM RNA, also designated SEQ ID:269.

Another function of GAM47 is therefore inhibition of Glutathione s-transferase m5 (GSTM5, Accession NP_000842.2), a gene which conjugates reduced glutathione to a wide number of exogenous and endogenous hydrophobic electrophiles. Accordingly, utilities of GAM47 include diagnosis, prevention and treatment of diseases and clinical conditions associated with GSTM5.

The function of GSTM5 has been established by previous studies. The glutathione S-transferases (GSTs) are dimeric enzymes that metabolize a broad range of xenobiotics and carcinogens. They are encoded by several multigene families. See GSTM1 (OMIM Ref. No. 138350) for additional background. By screening a human frontal cortex cDNA library with a rat cDNA that cross-hybridized with other rodent and human mu class GST cDNAs, Takahashi et al. (1993) isolated a cDNA encoding GSTM5. Northern blot analysis revealed that GSTM5 is expressed primarily in brain and lung and to a lesser extent in heart. The GSTM5 gene encodes a predicted 217-amino acid protein. By Western blot analysis using antibodies against the unique C-terminal region of GSTM5, Takahashi et al. (1993) detected GSTM5 in brain and testis but not liver.

Full details of the abovementioned studies are described in the following publications, the disclosure of which are hereby incorporated by reference:

Pearson, W. R.; Vorachek, W. R.; Xu, S.; Berger, R.; Hart, I.; Vannais, D.; Patterson, D.: Identification of class-mu glutathione transferase genes GSTM1-GSTM5 on human chromosome 1p13. Am. J. Hum. Genet. 53:220-233, 1993; and Takahashi, Y.; Campbell, E. A.; Hirata, Y.; Takayama, T.; Listowsky, I.: A basis for differentiating among the multiple human mu-glutathione S-transferases and molecular cloning of bra.

Further studies establishing the function and utilities of GSTM5 are found in John Hopkins OMIM database record ID 138385, and in cited publications listed in Table 5, which are hereby incorporated by reference. Hyaluronan binding protein 2 (HABP2, Accession NP_004123.1) is another GAM47 target gene, herein designated TARGET GENE. HABP2 BINDING SITE is a target binding site found in the 3' untranslated region of mRNA encoded by HABP2, corresponding to a target binding site such as BINDING SITE I, BINDING SITE II or BINDING SITE III of FIG. 8. Table 4 illustrates the complementarity of the nucleotide sequences of HABP2 BINDING SITE, designated SEQ ID:14769, to the nucleotide sequence of GAM47 RNA, herein designated GAM RNA, also designated SEQ ID:269.

Another function of GAM47 is therefore inhibition of Hyaluronan binding protein 2 (HABP2, Accession NP_004123.1). Accordingly, utilities of GAM47 include diagnosis, prevention and treatment of diseases and clinical conditions associated with HABP2.

Histone deacetylase 5 (HDAC5, Accession NP_631944.1) is another GAM47 target gene, herein designated TARGET GENE. HDAC5 BINDING SITE is a target binding site found in the 3' untranslated region of multiple transcripts of mRNA encoded by HDAC5, corresponding to a target binding site such as BINDING SITE I, BINDING SITE II or BINDING SITE III of FIG. 8. Table 4 illustrates the complementarity of the nucleotide sequences of HDAC5 BINDING SITE, designated SEQ ID:1806, to the nucleotide sequence of GAM47 RNA, herein designated GAM RNA, also designated SEQ ID:269.

Another function of GAM47 is therefore inhibition of Histone deacetylase 5 (HDAC5, Accession NP_631944.1), a gene which is responsible for the deacetylation of lysine residues on the n-terminal part of the core histones and mediate transcriptional regulation. Accordingly, utilities of GAM47 include diagnosis, prevention and treatment of diseases and clinical conditions associated with HDAC5.

The function of HDAC5 has been established by previous studies. Members of the myocyte enhancer factor-2 (MEF2A; 600660) family of transcription factors associate with myogenic basic helix-loop-helix transcription factors such as MYOD1 (OMIM Ref. No. 159970) to activate skeletal myogenesis. MEF2 proteins also interact with the class II histone deacetylases HDAC4 and HDAC5, resulting in repression of MEF2-dependent genes. Execution of the muscle differentiation program requires release of MEF2 from repression by HDACs, which are expressed constitutively in myoblasts and myotubes. McKinsey et al. (2000) demonstrated that HDAC5 shuttles from the nucleus to the cytoplasm when myoblasts are triggered to differentiate. Calcium/calmodulin- dependent protein kinase (CAMK1; 604998) signaling, which stimulates myogenesis and prevents formation of MEF2-HDAC complexes, also induces nuclear export of HDAC4 and HDAC5 by phosphorylation of these transcriptional repressors. An HDAC5 mutant lacking 2 CAMK phosphorylation sites is resistant to CAMK-mediated nuclear export and acts as a dominant inhibitor of skeletal myogenesis, whereas a cytoplasmic HDAC5 mutant is unable to block efficiently the muscle differentiation program. McKinsey et al. (2000) concluded that their results highlight a mechanism for transcriptional regulation through signal and differentiation-dependent nuclear export of a chromatin-remodeling enzyme, and suggest that nucleocytoplasmic trafficking of HDACs is involved in the control of cellular differentiation. Nagase et al. (1998) isolated a partial cDNA encoding HDAC5, which they called KIAA0600, from a brain cDNA library. RT-PCR analysis detected HDAC5 expression in all tissues tested, with relatively low expression in spleen and pancreas. By serologic analysis of recombinant colon cancer cDNA expression libraries, Scanlan et al. (1998) identified a partial cDNA encoding HDAC5, which they called NYCO9. Northern blot and RT-PCR analysis indicated weak but universal expression of a 3.7-kb HDAC5 transcript. Serologic analysis demonstrated that 5 of 29 colon cancer patients had antibodies to HDAC5.

Full details of the abovementioned studies are described in the following publications, the disclosure of which are hereby incorporated by reference:

Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 100 new cDNA clones from brain which can code for large proteins in vitro. DNA Res. 5:31-39, 1998; and McKinsey, T. A.; Zhang, C.-L.; Lu, J.; Olson, E. N.: Signal-dependent nuclear export of a histone deacetylase regulates muscle differentiation. Nature 408:106-111, 2000.

Further studies establishing the function and utilities of HDAC5 are found in John Hopkins OMIM database record ID 605315, and in cited publications listed in Table 5, which are hereby incorporated by reference. HES2 (Accession XP_290879.1) is another GAM47 target gene, herein designated TARGET GENE. HES2 BINDING SITE is a target binding site found in the 3' untranslated region of mRNA encoded by HES2, corresponding to a target binding site such as BINDING SITE I, BINDING SITE II or BINDING SITE III of FIG. 8. Table 4 illustrates the complementarity of the nucleotide sequences of HES2 BINDING SITE, designated SEQ ID:4547, to the nucleotide sequence of GAM47 RNA, herein designated GAM RNA, also designated SEQ ID:269.

Another function of GAM47 is therefore inhibition of HES2 (Accession XP_290879.1). Accordingly, utilities of GAM47 include diagnosis, prevention and treatment of diseases and clinical conditions associated with HES2.

Hexosaminidase a (alpha polypeptide) (HEXA, Accession NP_000511.1) is another GAM47 target gene, herein designated TARGET GENE. HEXA BINDING SITE is a target binding site found in the 3' untranslated region of mRNA encoded by HEXA, corresponding to a target binding site such as BINDING SITE I, BINDING SITE II or BINDING SITE III of FIG. 8. Table 4 illustrates the complementarity of the nucleotide sequences of HEXA BINDING SITE, designated SEQ ID:13753, to the nucleotide sequence of GAM47 RNA, herein designated GAM RNA, also designated SEQ ID:269.

Another function of GAM47 is therefore inhibition of Hexosaminidase a (alpha polypeptide) (HEXA, Accession NP_000511.1). Accordingly, utilities of GAM47 include diagnosis, prevention and treatment of diseases and clinical conditions associated with HEXA.

Hepatocyte growth factor-regulated tyrosine kinase substrate (HGS, Accession NP_004703.1) is another GAM47 target gene, herein designated TARGET GENE. HGS BINDING SITE is a target binding site found in the 3' untranslated region of mRNA encoded by HGS, corresponding to a target binding site such as BINDING SITE I, BINDING SITE II or BINDING SITE III of FIG. 8. Table 4 illustrates the complementarity of the nucleotide sequences of HGS BINDING SITE, designated SEQ ID:10117, to the nucleotide sequence of GAM47 RNA, herein designated GAM RNA, also designated SEQ ID:269.

Another function of GAM47 is therefore inhibition of Hepatocyte growth factor-regulated tyrosine kinase substrate (HGS, Accession NP_004703.1). Accordingly, utilities of GAM47 include diagnosis, prevention and treatment of diseases and clinical conditions associated with HGS.

Hira interacting protein 3 (HIRIP3, Accession NP_003600.2) is another GAM47 target gene, herein designated TARGET GENE. HIRIP3 BINDING SITE is a target binding site found in the 5' untranslated region of mRNA encoded by HIRIP3, corresponding to a target binding site such as BINDING SITE I, BINDING SITE II or BINDING SITE III of FIG. 8. Table 4 illustrates the complementarity of the nucleotide sequences of HIRIP3 BINDING SITE, designated SEQ ID:12016, to the nucleotide sequence of GAM47 RNA, herein designated GAM RNA, also designated SEQ ID:269.

Another function of GAM47 is therefore inhibition of Hira interacting protein 3 (HIRIP3, Accession NP_003600.2). Accordingly, utilities of GAM47 include diagnosis, prevention and treatment of diseases and clinical conditions associated with HIRIP3.

Major histocompatibility complex, class ii, do beta (HLA-DOB, Accession NP_002111.1) is another GAM47 target gene, herein designated TARGET GENE. HLA-DOB BINDING SITE is a target binding site found in the 3' untranslated region of mRNA encoded by HLA-DOB, corresponding to a target binding site such as BINDING SITE I, BINDING SITE II or BINDING SITE III of FIG. 8. Table 4 illustrates the complementarity of the nucleotide sequences of HLA-DOB BINDING SITE, designated SEQ ID:11289, to the nucleotide sequence of GAM47 RNA, herein designated GAM RNA, also designated SEQ ID:269.

Another function of GAM47 is therefore inhibition of Major histocompatibility complex, class ii, do beta (HLA-DOB, Accession NP_002111.1). Accordingly, utilities of GAM47 include diagnosis, prevention and treatment of diseases and clinical conditions associated with HLA-DOB.

Homeo box a3 (HOXA3, Accession NP_705896.1) is another GAM47 target gene, herein designated TARGET GENE. HOXA3 BINDING SITE is a target binding site found in the 5' untranslated region of multiple transcripts of mRNA encoded by HOXA3, corresponding to a target binding site such as BINDING SITE I, BINDING SITE II or BINDING SITE III of FIG. 8. Table 4 illustrates the complementarity of the nucleotide sequences of HOXA3 BINDING SITE, designated SEQ ID:2711, to the nucleotide sequence of GAM47 RNA, herein designated GAM RNA, also designated SEQ ID:269.

Another function of GAM47 is therefore inhibition of Homeo box a3 (HOXA3, Accession NP_705896.1). Accordingly, utilities of GAM47 include diagnosis, prevention and treatment of diseases and clinical conditions associated with HOXA3.

Homeo box b8 (HOXB8, Accession NP_076921.1) is another GAM47 target gene, herein designated TARGET GENE. HOXB8 BINDING SITE is a target binding site found in the 3' untranslated region of mRNA encoded by HOXB8, corresponding to a target binding site such as BINDING SITE I, BINDING SITE II or BINDING SITE III of FIG. 8. Table 4 illustrates the complementarity of the nucleotide sequences of HOXB8 BINDING SITE, designated SEQ ID:1287, to the nucleotide sequence of GAM47 RNA, herein designated GAM RNA, also designated SEQ ID:269.

Another function of GAM47 is therefore inhibition of Homeo box b8 (HOXB8, Accession NP_076921.1), a gene which is part of a developmental regulatory system. Accordingly, utilities of GAM47 include diagnosis, prevention and treatment of diseases and clinical conditions associated with HOXB8.

The function of HOXB8 has been established by previous studies. Using RT-PCR and in situ hybridization, Greer and Capecchi (2002) detected Hoxb8 expression in regions of the adult mouse central nervous system including the cervical spinal cord, brainstem, forebrain, olfactory bulb, basal ganglia, hippocampus, cortex, and cerebellum. Greer and Capecchi (2002) noted that the behavior of Hoxb8 knockout mice is not unlike that of humans suffering from the obsessive-compulsive spectrum disorder (OCD) trichotillomania. Consistent with this, they detected expression of Hoxb8 in regions of the CNS known as the 'OCD-circuit,' where OCD patients are thought to have abnormal metabolic activity. They hypothesized that trichotillomania may arise from a misregulation of an innate autogrooming behavior and presented the Hoxb8 mutant mice as a model of OCD-like phenotypes.

Animal model experiments lend further support to the function of HOXB8. The grooming phenotype in Hoxb8 knockout mice reported by Greer and Capecchi (2002) differs significantly from the axial skeletal defects and abnormal forearm clasping reflex reported for Hoxb8 mutant mice generated by van den Akker et al. (1999). Greer and Capecchi (2002) argued that the skeletal and forelimb defects observed by van den Akker et al. (1999) were due to the presence of the bacterial lacZ gene in the mutant mice. Greer and Capecchi (2002) similarly concluded that skeletal defects observed in one of their Hoxb8 mutant lines were due to the presence of a bacterial neo(r) gene in the Hoxb8 locus interfering with the expression of neighboring Hox genes.

It is appreciated that the abovementioned animal model for HOXB8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Greer, J. M.; Capecchi, M. R.: Hoxb8 is required for normal grooming behavior in mice. Neuron 33:23-34, 2002; and van den Akker, E.; Reijnen, M.; Korving, J.; Brouwer, A.; Meijlink, F.; Deschamps, J.: Targeted inactivation of Hoxb8 affects survival of a spinal ganglion and causes aberrant limb re.

Further studies establishing the function and utilities of HOXB8 are found in John Hopkins OMIM database record ID 142963, and in cited publications listed in Table 5, which are hereby incorporated by reference. Histamine receptor h1 (HRH1, Accession NP_000852.1) is another GAM47 target gene, herein designated TARGET GENE. HRH1 BINDING SITE is a target binding site found in the 3' untranslated region of mRNA encoded by HRH1, corresponding to a target binding site such as BINDING SITE I, BINDING SITE II or BINDING SITE III of FIG. 8. Table 4 illustrates the complementarity of the nucleotide sequences of HRH1 BINDING SITE, designated SEQ ID:16395, to the nucleotide sequence of GAM47 RNA, herein designated GAM RNA, also designated SEQ ID:269.

Another function of GAM47 is therefore inhibition of Histamine receptor h1 (HRH1, Accession NP_000852.1), a gene which stimulates the synthesis of inositol phosphate. Accordingly, utilities of GAM47 include diagnosis, prevention and treatment of diseases and clinical conditions associated with HRH1.

The function of HRH1 has been established by previous studies. Histamine is a ubiquitous messenger molecule released from mast cells, enterochromaffin-like cells, and neurons. Its various actions are mediated by 3 pharmacologically defined receptors termed the H1, H2 (OMIM Ref. No. 142703), and H3 (OMIM Ref. No. 604525) receptors. The H1 receptor was the first member of this family to be pharmacologically defined with the design of selective antagonists, the 'antihistamines,' which are used to treat allergic and inflammatory reactions. The H1 receptor is expressed by various peripheral tissues, such as smooth muscle, and by neurons in the brain, where histamine may be involved in the control of wakefulness, mood, and hormone secretion. Yamashita et al. (1991) cloned a bovine H1 receptor cDNA and established its nucleotide sequence. Its homology with the corresponding sequence of other receptors confirmed that it belongs to the superfamily of receptors coupled with G proteins with 7 putative transmembrane domains. In addition to their expression in neuronal, gastric, and muscular tissue, the G protein-coupled receptors HRH1 and HRH2 are also expressed on T-helper lymphocytes and trigger different intracellular events upon activation. Using flow cytometric analysis, Jutel et al. (2001) demonstrated that histamine binds more strongly to Th1 than to Th2 cells. Flow cytometry and RT-PCR analysis showed that HRH1 is predominantly expressed on Th1 cells in an IL3 (OMIM Ref. No. 147740)-upregulatable manner, while HRH2 is predominant on Th2 cells. Stimulation of naive, CD45RA+ (see OMIM Ref. No. 151460) T cells with IL12 (OMIM Ref. No. 161560) resulted in preferential expression of HRH1, but stimulation with IL4 (OMIM Ref. No. 147780) resulted in suppressed expression of HRH1, demonstrating that mature CD45RO+ Th1 and Th2 lymphocytes preferentially but not exclusively express HRH1 and HRH2, and that HRH1 and HRH2 are regulated by cytokines present in the immune environment. Histamine stimulation of Th1 cells resulted in significant calcium flux that could be blocked by an HRH1 antagonist, while stimulation of Th2 cells led to cAMP formation that could be blocked by an HRH2, but not an HRH1, antagonist. Furthermore, histamine enhanced Th1 but inhibited Th2 responses to anti-CD3. Histamine also enhanced peripheral blood mononuclear cell responses in sensitized individuals to a predominantly Th1 antigen, but suppressed responses to Th2 allergens.

Animal model experiments lend further support to the function of HRH1. Ma et al. (2002) noted that pertussis toxin (PTX) elicits a range of responses in mice, including sensitization to vasoactive amines (VAAS) and increased vascular permeability subsequent to PTX-induced changes in vascular endothelial cells. Susceptible mouse strains die from hypotensive and hypovolemic shock on vasoactive amine challenge, whereas resistant strains do not. This hypersensitivity is controlled by an autosomal dominant locus, designated Bphs, localized to mouse chromosome 6. Using positional cloning, Ma et al. (2002) linked the Bphs locus to Hrh1. Mice lacking Hrh1 were protected from VAAS hypersensitivity, as well as from experimental allergic encephalomyelitis and experimental autoimmune orchitis. Sequence analysis showed that leu263- to - pro (L263P), met313- to - val (M313V), and ser331- to - pro (S331P) polymorphisms were associated with resistance to vasoactive amine challenge. The authors concluded that these Hrh1 alleles control both the autoimmune T-cell and vascular responses regulated by histamine after PTX sensitization.

It is appreciated that the abovementioned animal model for HRH1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jutel, M.; Watanabe, T.; Klunker, S.; Akdis, M.; Thomet, O. A. R.; Malolepszy, J.; Zak-Nejmark, T.; Koga, R.; Kobayashi, T.; Blaser, K.; Akdis, C. A.: Histamine regulates T-cell and antibody responses by differential expression of H1 and H2 receptors. Nature 413:420-425, 2001; and Ma, R. Z.; Gao, J.; Meeker, N. D.; Fillmore, P. D.; Tung, K. S. K.; Watanabe, T.; Zachary, J. F.; Offner, H.; Blankenhorn, E. P.; Teuscher, C.: Identification of Bphs, an autoimmune di.

Further studies establishing the function and utilities of HRH1 are found in John Hopkins OMIM database record ID 600167, and in cited publications listed in Table 5, which are hereby incorporated by reference. Heparan sulfate 2-o-sulfotransferase 1 (HS2ST1, Accession NP_036394.1) is another GAM47 target gene, herein designated TARGET GENE. HS2ST1 BINDING SITE1 and HS2ST1 BINDING SITE2 are target binding sites found in untranslated regions of mRNA encoded by HS2ST1, corresponding to target binding sites such as BINDING SITE I, BINDING SITE II or BINDING SITE III of FIG. 8. Table 4 illustrates the complementarity of the nucleotide sequences of HS2ST1 BINDING SITE1 and HS2ST1 BINDING SITE2, designated SEQ ID:2206 and SEQ ID:10600 respectively, to the nucleotide sequence of GAM47 RNA, herein designated GAM RNA, also designated SEQ ID:269.

Another function of GAM47 is therefore inhibition of Heparan sulfate 2-o-sulfotransferase 1 (HS2ST1, Accession NP_036394.1). Accordingly, utilities of GAM47 include diagnosis, prevention and treatment of diseases and clinical conditions associated with HS2ST1.

Heparan sulfate (glucosamine) 3-o-sulfotransferase 4 (HS3ST4, Accession XP_056254.4) is another GAM47 target gene, herein designated TARGET GENE. HS3ST4 BINDING SITE is a target binding site found in the 3' untranslated region of mRNA encoded by HS3ST4, corresponding to a target binding site such as BINDING SITE I, BINDING SITE II or BINDING SITE III of FIG. 8. Table 4 illustrates the complementarity of the nucleotide sequences of HS3ST4 BINDING SITE, designated SEQ ID:3789, to the nucleotide sequence of GAM47 RNA, herein designated GAM RNA, also designated SEQ ID:269.

Another function of GAM47 is therefore inhibition of Heparan sulfate (glucosamine) 3-o-sulfotransferase 4 (HS3ST4, Accession XP_056254.4). Accordingly, utilities of GAM47 include diagnosis, prevention and treatment of diseases and clinical conditions associated with HS3ST4.

HSD3B7 (Accession NP_079469.2) is another GAM47 target gene, herein designated TARGET GENE. HSD3B7 BINDING SITE is a target binding site found in the 3' untranslated region of mRNA encoded by HSD3B7, corresponding to a target binding site such as BINDING SITE I, BINDING SITE II or BINDING SITE III of FIG. 8. Table 4 illustrates the complementarity of the nucleotide sequences of HSD3B7 BINDING SITE, designated SEQ ID:17703, to the nucleotide sequence of GAM47 RNA, herein designated GAM RNA, also designated SEQ ID:269.

Another function of GAM47 is therefore inhibition of HSD3B7 (Accession NP_079469.2). Accordingly, utilities of GAM47 include diagnosis, prevention and treatment of diseases and clinical conditions associated with HSD3B7.

Hiv-1 tat interactive protein, 60 kda (HTATIP, Accession NP_006379.1) is another GAM47 target gene, herein designated TARGET GENE. HTATIP BINDING SITE is a target binding site found in the 3' untranslated region of mRNA encoded by HTATIP, corresponding to a target binding site such as BINDING SITE I, BINDING SITE II or BINDING SITE III of FIG. 8. Table 4 illustrates the complementarity of the nucleotide sequences of HTATIP BINDING SITE, designated SEQ ID:10365, to the nucleotide sequence of GAM47 RNA, herein designated GAM RNA, also designated SEQ ID:269.

Another function of GAM47 is therefore inhibition of Hiv-1 tat interactive protein, 60 kda (HTATIP, Accession NP_006379.1). Accordingly, utilities of GAM47 include diagnosis, prevention and treatment of diseases and clinical conditions associated with HTATIP.

Hypoxia up-regulated 1 (HYOU1, Accession NP_006380.1) is another GAM47 target gene, herein designated TARGET GENE. HYOU1 BINDING SITE is a target binding site found in the 3' untranslated region of mRNA encoded by HYOU1, corresponding to a target binding site such as BINDING SITE I, BINDING SITE II or BINDING SITE III of FIG. 8. Table 4 illustrates the complementarity of the nucleotide sequences of HYOU1 BINDING SITE, designated SEQ ID:10294, to the nucleotide sequence of GAM47 RNA, herein designated GAM RNA, also designated SEQ ID:269.

Another function of GAM47 is therefore inhibition of Hypoxia up-regulated 1 (HYOU1, Accession NP_006380.1). Accordingly, utilities of GAM47 include diagnosis, prevention and treatment of diseases and clinical conditions associated with HYOU1.

HYPB (Accession NP_036403.1) is another GAM47 target gene, herein designated TARGET GENE. HYPB BINDING SITE is a target binding site found in the 3' untranslated region of multiple transcripts of mRNA encoded by HYPB, corresponding to a target binding site such as BINDING SITE I, BINDING SITE II or BINDING SITE III of FIG. 8. Table 4 illustrates the complementarity of the nucleotide sequences of HYPB BINDING SITE, designated SEQ ID:10651, to the nucleotide sequence of GAM47 RNA, herein designated GAM RNA, also designated SEQ ID:269.

Another function of GAM47 is therefore inhibition of HYPB (Accession NP_036403.1). Accordingly, utilities of GAM47 include diagnosis, prevention and treatment of diseases and clinical conditions associated with HYPB.

Immune associated nucleotide 4 like 1 (mouse) (IAN4L1, Accession NP_060854.2) is another GAM47 target gene, herein designated TARGET GENE. IAN4L1 BINDING SITE is a target binding site found in the 3' untranslated region of mRNA encoded by IAN4L1, corresponding to a target binding site such as BINDING SITE I, BINDING SITE II or BINDING SITE III of FIG. 8. Table 4 illustrates the complementarity of the nucleotide sequences of IAN4L1 BINDING SITE, designated SEQ ID:18040, to the nucleotide sequence of GAM47 RNA, herein designated GAM RNA, also designated SEQ ID:269.

Another function of GAM47 is therefore inhibition of Immune associated nucleotide 4 like 1 (mouse) (IAN4L1, Accession NP_060854.2). Accordingly, utilities of GAM47 include diagnosis, prevention and treatment of diseases and clinical conditions associated with IAN4L1.

IBA2 (Accession NP_113614.1) is another GAM47 target gene, herein designated TARGET GENE. IBA2 BINDING SITE is a target binding site found in the 3' untranslated region of mRNA encoded by IBA2, corresponding to a target binding site such as BINDING SITE I, BINDING SITE II or BINDING SITE III of FIG. 8. Table 4 illustrates the complementarity of the nucleotide sequences of IBA2 BINDING SITE, designated SEQ ID:6376, to the nucleotide sequence of GAM47 RNA, herein designated GAM RNA, also designated SEQ ID:269.

Another function of GAM47 is therefore inhibition of IBA2 (Accession NP_113614.1). Accordingly, utilities of GAM47 include diagnosis, prevention and treatment of diseases and clinical conditions associated with IBA2.

Interleukin 1 receptor-like 1 (IL1RL1, Accession NP_775661.1) is another GAM47 target gene, herein designated TARGET GENE. IL1RL1 BINDING SITE is a target binding site found in the 3' untranslated region of multiple transcripts of mRNA encoded by IL1RL1, corresponding to a target binding site such as BINDING SITE I, BINDING SITE II or BINDING SITE III of FIG. 8. Table 4 illustrates the complementarity of the nucleotide sequences of IL1RL1 BINDING SITE, designated SEQ ID:1862, to the nucleotide sequence of GAM47 RNA, herein designated GAM RNA, also designated SEQ ID:269.

Another function of GAM47 is therefore inhibition of Interleukin 1 receptor-like 1 (IL1RL1, Accession NP_775661.1), a gene which is possibly involved in regulation of t-lymphocyte action. Accordingly, utilities of GAM47 include diagnosis, prevention and treatment of diseases and clinical conditions associated with IL1RL1.

The function of IL1RL1 has been established by previous studies. Tominaga (1989) isolated a murine gene, which they termed St2, as one of the genes specifically expressed by growth stimulation in BALB/c-3T3 cells. The gene encodes 2 protein products: St2, the soluble secreted form; and St2L, the transmembrane receptor form which is very similar to the interleukin-1 receptors (147810; 147911) that map to human chromosome 2. Tominaga (1989) suggested that St2 gene expression is related to the growth of cells and that an unknown signal is transduced to control cell proliferation by binding of specific ligand(s). Because the symbol ST2 had already been assigned to a locus on 11p (see OMIM Ref. No. 185440), the HUGO Nomenclature Committee designated the human homolog of the mouse St2 gene as IL1RL1. By use of a mouse St2 probe to screen an activated human helper T-cell line library, Tominaga et al. (1992) isolated a cDNA for IL1RL1, which encodes a 328-amino acid protein with 9 potential glycosylation sites and 3 Ig-like domains. By Northern blot analysis, Kumar et al. (1997) detected expression of a 1.4-kb IL1RL1 transcript in skeletal muscle, heart, brain, and pancreas, with additional 2.5- and 4.2-kb transcripts in lung, liver, placenta, and kidney. By RT-PCR analysis, they observed constitutive expression in mesenchymal and myeloblastic cell lines, with further induction by phorbol ester or cytokine stimulation. Expression in mouse, in contrast, occurs only between days 2 and 4 after exposure to UVB irradiation.

Full details of the abovementioned studies are described in the following publications, the disclosure of which are hereby incorporated by reference:

Tago, K.; Noda, T.; Hayakawa, M.; Iwahana, H.; Yanagisawa, K.; Yashiro, T.; Tominaga, S.: Tissue distribution and subcellular localization of a variant form of the human ST2 gene product, ST2V. Biochem. Biophys. Res. Commun. 285: 1377-1383, 2001; and Tominaga, S.: A putative protein of a growth specific cDNA from BALB/c-3T3 cells is highly similar to the extracellular portion of mouse interleukin 1 receptor. FEBS Lett. 258:301-304.

Further studies establishing the function and utilities of IL1RL1 are found in John Hopkins OMIM database record ID 601203, and in cited publications listed in Table 5, which are hereby incorporated by reference. Interleukin 1 receptor-like 1 (IL1RL1, Accession NP_003847.2) is another GAM47 target gene, herein designated TARGET GENE. IL1RL1 BINDING SITE is a target binding site found in the 3' untranslated region of multiple transcripts of mRNA encoded by IL1RL1, corresponding to a target binding site such as BINDING SITE I, BINDING SITE II or BINDING SITE III of FIG. 8. Table 4 illustrates the complementarity of the nucleotide sequences of IL1RL1 BINDING SITE, designated SEQ ID:1862, to the nucleotide sequence of GAM47 RNA, herein designated GAM RNA, also designated SEQ ID:269.

Another function of GAM47 is therefore inhibition of Interleukin 1 receptor-like 1 (IL1RL1, Accession NP_003847.2), a gene which is possibly involved in regulation of t-lymphocyte action. Accordingly, utilities of GAM47 include diagnosis, prevention and treatment of diseases and clinical conditions associated with IL1RL1.

The function of IL1RL1 has been established by previous studies. Tominaga (1989) isolated a murine gene, which they termed St2, as one of the genes specifically expressed by growth stimulation in BALB/c-3T3 cells. The gene encodes 2 protein products: St2, the soluble secreted form; and St2L, the transmembrane receptor form which is very similar to the interleukin-1 receptors (147810; 147911) that map to human chromosome 2. Tominaga (1989) suggested that St2 gene expression is related to the growth of cells and that an unknown signal is transduced to control cell proliferation by binding of specific ligand(s). Because the symbol ST2 had already been assigned to a locus on 11p (see OMIM Ref. No. 185440), the HUGO Nomenclature Committee designated the human homolog of the mouse St2 gene as IL1RL1. By use of a mouse St2 probe to screen an activated human helper T-cell line library, Tominaga et al. (1992) isolated a cDNA for IL1RL1, which encodes a 328-amino acid protein with 9 potential glycosylation sites and 3 Ig-like domains. By Northern blot analysis, Kumar et al. (1997) detected expression of a 1.4-kb IL1RL1 transcript in skeletal muscle, heart, brain, and pancreas, with additional 2.5- and 4.2-kb transcripts in lung, liver, placenta, and kidney. By RT-PCR analysis, they observed constitutive expression in mesenchymal and myeloblastic cell lines, with further induction by phorbol ester or cytokine stimulation. Expression in mouse, in contrast, occurs only between days 2 and 4 after exposure to UVB irradiation.

Full details of the abovementioned studies are described in the following publications, the disclosure of which are hereby incorporated by reference:

Tago, K.; Noda, T.; Hayakawa, M.; Iwahana, H.; Yanagisawa, K.; Yashiro, T.; Tominaga, S.: Tissue distribution and subcellular localization of a variant form of the human ST2 gene product, ST2V. Biochem. Biophys. Res. Commun. 285: 1377-1383, 2001; and Tominaga, S.: A putative protein of a growth specific cDNA from BALB/c-3T3 cells is highly similar to the extracellular portion of mouse interleukin 1 receptor. FEBS Lett. 258:301-304.

Further studies establishing the function and utilities of IL1RL1 are found in John Hopkins OMIM database record ID 601203, and in cited publications listed in Table 5, which are hereby incorporated by reference. Insulin receptor substrate 3-like (IRS3L, Accession XP_295210.1) is another GAM47 target gene, herein designated TARGET GENE. IRS3L BINDING SITE is a target binding site found in the 3' untranslated region of mRNA encoded by IRS3L, corresponding to a target binding site such as BINDING SITE I, BINDING SITE II or BINDING SITE III of FIG. 8. Table 4 illustrates the complementarity of the nucleotide sequences of IRS3L BINDING SITE, designated SEQ ID:3181, to the nucleotide sequence of GAM47 RNA, herein designated GAM RNA, also designated SEQ ID:269.

Another function of GAM47 is therefore inhibition of Insulin receptor substrate 3-like (IRS3L, Accession XP_295210.1). Accordingly, utilities of GAM47 include diagnosis, prevention and treatment of diseases and clinical conditions associated with IRS3L.

Integrin, alpha d (ITGAD, Accession XP_113880.1) is another GAM47 target gene, herein designated TARGET GENE. ITGAD BINDING SITE is a target binding site found in the 3' untranslated region of mRNA encoded by ITGAD, corresponding to a target binding site such as BINDING SITE I, BINDING SITE II or BINDING SITE III of FIG. 8. Table 4 illustrates the complementarity of the nucleotide sequences of ITGAD BINDING SITE, designated SEQ ID:15692, to the nucleotide sequence of GAM47 RNA, herein designated GAM RNA, also designated SEQ ID:269.

Another function of GAM47 is therefore inhibition of Integrin, alpha d (ITGAD, Accession XP_113880.1). Accordingly, utilities of GAM47 include diagnosis, prevention and treatment of diseases and clinical conditions associated with ITGAD.

Inositol 1,4,5-triphosphate receptor, type 2 (ITPR2, Accession NP_002214.1) is another GAM47 target gene, herein designated TARGET GENE. ITPR2 BINDING SITE is a target binding site found in the 5' untranslated region of mRNA encoded by ITPR2, corresponding to a target binding site such as BINDING SITE I, BINDING SITE II or BINDING SITE III of FIG. 8. Table 4 illustrates the complementarity of the nucleotide sequences of ITPR2 BINDING SITE, designated SEQ ID:15620, to the nucleotide sequence of GAM47 RNA, herein designated GAM RNA, also designated SEQ ID:269.

Another function of GAM47 is therefore inhibition of Inositol 1,4,5-triphosphate receptor, type 2 (ITPR2, Accession NP_002214.1). Accordingly, utilities of GAM47 include diagnosis, prevention and treatment of diseases and clinical conditions associated with ITPR2.

Jumonji homolog (mouse) (JMJ, Accession NP_004964.2) is another GAM47 target gene, herein designated TARGET GENE. JMJ BINDING SITE1 and JMJ BINDING SITE2 are target binding sites found in untranslated regions of mRNA encoded by JMJ, corresponding to target binding sites such as BINDING SITE I, BINDING SITE II or BINDING SITE III of FIG. 8. Table 4 illustrates the complementarity of the nucleotide sequences of JMJ BINDING SITE1 and JMJ BINDING SITE2, designated SEQ ID:14768 and SEQ ID:14602 respectively, to the nucleotide sequence of GAM47 RNA, herein designated GAM RNA, also designated SEQ ID:269.

Another function of GAM47 is therefore inhibition of Jumonji homolog (mouse) (JMJ, Accession NP_004964.2), a gene which participates in the negative regulation of cell growth. Accordingly, utilities of GAM47 include diagnosis, prevention and treatment of diseases and clinical conditions associated with JMJ.

The function of JMJ has been established by previous studies. Berge-Lefranc et al. (1996) isolated clones highly homologous to the mouse gene jumonji from a human embryonic cDNA library. In mouse, jumonji (jmj) is required for neural tube formation. Berge-Lefranc et al. (1996) reported that the human jumonji (JMJ) and mouse jmj gene products are 90% identical. Northern blot analysis revealed a low level of expression of JMJ in all human embryonic and adult tissues analyzed. In situ hybridization studies on embryonic slices revealed high levels of expression in dorsal root ganglia neurons. The authors detected high levels of expression in adult cerebral cortex. Toyoda et al. (2000) determined that JMJ is expressed as a 160-kD protein by Western blot analysis. Immunofluorescence and Western blot analysis demonstrated that JMJ specifically localizes to the cell nucleus. Overexpression of JMJ appeared to inhibit cell growth, whereas Jmj-deficient mice had cell growth enhancement. Berge-Lefranc et al. (1996) mapped the human JMJ gene to chromosome 6p24-p23 using autoradiographic in situ hybridization Full details of the abovementioned studies are described in the following publications, the disclosure of which are hereby incorporated by reference:

Berge-Lefranc, J.-L.; Jay, P.; Massacrier, A.; Cau, P.; Mattei, M. G.; Bauer, S.; Marsollier, C.; Berta, P.; Fontes, M.: Characterization of the human jumonji gene. Hum. Molec. Genet. 5:1637-1641, 1996; and Toyoda, M.; Kojima, M.; Takeuchi, T.: Jumonji is a nuclear protein that participates in the negative regulation of cell growth. Biochem. Biophys. Res. Commun. 274: 332-336, 2000.

Further studies establishing the function and utilities of JMJ are found in John Hopkins OMIM database record ID 601594, and in cited publications listed in Table 5, which are hereby incorporated by reference. JPHL1 (Accession XP_033366.1) is another GAM47 target gene, herein designated TARGET GENE. JPHL1 BINDING SITE1 and JPHL1 BINDING SITE2 are target binding sites found in untranslated regions of mRNA encoded by JPHL1, corresponding to target binding sites such as BINDING SITE I, BINDING SITE II or BINDING SITE III of FIG. 8. Table 4 illustrates the complementarity of the nucleotide sequences of JPHL1 BINDING SITE1 and JPHL1 BINDING SITE2, designated SEQ ID:7827 and SEQ ID:511 respectively, to the nucleotide sequence of GAM47 RNA, herein designated GAM RNA, also designated SEQ ID:269.

Another function of GAM47 is therefore inhibition of JPHL1 (Accession XP_033366.1). Accordingly, utilities of GAM47 include diagnosis, prevention and treatment of diseases and clinical conditions associated with JPHL1.

K5B (Accession NP_775487.1) is another GAM47 target gene, herein designated TARGET GENE. K5B BINDING SITE is a target binding site found in the 5' untranslated region of mRNA encoded by K5B, corresponding to a target binding site such as BINDING SITE I, BINDING SITE II or BINDING SITE III of FIG. 8. Table 4 illustrates the complementarity of the nucleotide sequences of K5B BINDING SITE, designated SEQ ID:19844, to the nucleotide sequence of GAM47 RNA, herein designated GAM RNA, also designated SEQ ID:269.

Another function of GAM47 is therefore inhibition of K5B (Accession NP_775487.1). Accordingly, utilities of GAM47 include diagnosis, prevention and treatment of diseases and clinical conditions associated with K5B.

KBF2 (Accession NP_056958.1) is another GAM47 target gene, herein designated TARGET GENE. KBF2 BINDING SITE is a target binding site found in the 3' untranslated region of mRNA encoded by KBF2, corresponding to a target binding site such as BINDING SITE I, BINDING SITE II or BINDING SITE III of FIG. 8. Table 4 illustrates the complementarity of the nucleotide sequences of KBF2 BINDING SITE, designated SEQ ID:16939, to the nucleotide sequence of GAM47 RNA, herein designated GAM RNA, also designated SEQ ID:269.

Another function of GAM47 is therefore inhibition of KBF2 (Accession NP_056958.1). Accordingly, utilities of GAM47 include diagnosis, prevention and treatment of diseases and clinical conditions associated with KBF2.

Potassium inwardly-rectifying channel, subfamily j, member 10 (KCNJ10, Accession NP_002232.2) is another GAM47 target gene, herein designated TARGET GENE. KCNJ10 BINDING SITE is a target binding site found in the 3' untranslated region of mRNA encoded by KCNJ10, corresponding to a target binding site such as BINDING SITE I, BINDING SITE II or BINDING SITE III of FIG. 8. Table 4 illustrates the complementarity of the nucleotide sequences of KCNJ10 BINDING SITE, designated SEQ ID:13377, to the nucleotide sequence of GAM47 RNA, herein designated GAM RNA, also designated SEQ ID:269.

Another function of GAM47 is therefore inhibition of Potassium inwardly-rectifying channel, subfamily j, member 10 (KCNJ10, Accession NP_002232.2), a gene which may be responsible for potassium buffering action of glial cells in the brain. Accordingly, utilities of GAM47 include diagnosis, prevention and treatment of diseases and clinical conditions associated with KCNJ10.

The function of KCNJ10 and its association with various diseases and clinical conditions, has been established by previous studies, as described hereinabove with reference to GAM31.1. Potassium intermediate/small conductance calcium-activated channel, subfamily n, member 2 (KCNN2, Accession NP_740721.1) is another GAM47 target gene, herein designated TARGET GENE. KCNN2 BINDING SITE1 and KCNN2 BINDING SITE2 are target binding sites found in untranslated regions of multiple transcripts of mRNA encoded by KCNN2, corresponding to target binding sites such as BINDING SITE I, BINDING SITE II or BINDING SITE III of FIG. 8. Table 4 illustrates the complementarity of the nucleotide sequences of KCNN2 BINDING SITE1 and KCNN2 BINDING SITE2, designated SEQ ID:7656 and SEQ ID:17552 respectively, to the nucleotide sequence of GAM47 RNA, herein designated GAM RNA, also designated SEQ ID:269.

Another function of GAM47 is therefore inhibition of Potassium intermediate/small conductance calcium-activated channel, subfamily n, member 2 (KCNN2, Accession NP_740721.1), a gene which forms a voltage-independent potassium channel activated by intracellular calcium. Accordingly, utilities of GAM47 include diagnosis, prevention and treatment of diseases and clinical conditions associated with KCNN2.

The function of KCNN2 has been established by previous studies. Calcium-activated potassium channels respond to changes in intracellular calcium concentration and couple calcium metabolism to potassium flux and membrane excitability. Based on their electrophysiologic properties, calcium-activated potassium channels are classified as large conductance, calcium- and voltage-gated channels (BK, e.g., KCNMB4; 605223), intermediate conductance, voltage-independent channels (IK, e.g., KCNN4; 602754), and small conductance, voltage-independent channels (SK, e.g., KCNN3; 602983). By screening a Jurkat T-cell cDNA library using RT-PCR with degenerate primers based on rat and human SK channels, followed by searching an EST database, Desai et al. (2000) isolated a cDNA encoding KCNN2, which they termed SK2. Sequence analysis predicted that the 579-amino acid protein, which is 97% identical to the rat sequence, contains multiple phosphorylation sites and no N-glycosylation sites. Northern blot analysis detected a major 2.5-kb transcript that was expressed most strongly in liver and brain, with lower levels in kidney and Jurkat (but not peripheral) T cells. A minor 4.4-kb transcript was expressed in heart and skeletal muscle, and a 1.3-kb transcript was expressed in brain and liver. Functional analysis showed that KCNN2 expresses a potassium current that is sensitive to apamin, scyllatoxin, and tubocurarine and is insensitive to charybdotoxin. Schumacher et al. (2001) determined the crystal structure of calmodulin (OMIM Ref. No. 114180) bound to KCNN2. The calmodulin-binding domain forms an elongated dimer with a calmodulin molecule bound at each end; each calmodulin wraps around 3 alpha helices, 2 from 1 calmodulin-binding domain subunit and 1 from the other.

Full details of the abovementioned studies are described in the following publications, the disclosure of which are hereby incorporated by reference:

Desai, R.; Peretz, A.; Idelson, H.; Lazarovici, P.; Attali, B.: Ca(2+)-activated K(+) channels in human leukemic Jurkat T cells: molecular cloning, biochemical and functional characterization. J. Biol. Chem. 275:39954-39963, 2000; and Schumacher, M. A.; Rivard, A. F.; Bachinger, H. P.; Adelman, J. P.: Structure of the gating domain of a Ca(2+)-activated K+ channel complexed with Ca(2+)/calmodulin. Nature 410:1120.

Further studies establishing the function and utilities of KCNN2 are found in John Hopkins OMIM database record ID 605879, and in cited publications listed in Table 5, which are hereby incorporated by reference. Potassium voltage-gated channel, kqt-like subfamily, member 2 (KCNQ2, Accession NP_004509.2) is another GAM47 target gene, herein designated TARGET GENE. KCNQ2 BINDING SITE is a target binding site found in the 3' untranslated region of multiple transcripts of mRNA encoded by KCNQ2, corresponding to a target binding site such as BINDING SITE I, BINDING SITE II or BINDING SITE III of FIG. 8. Table 4 illustrates the complementarity of the nucleotide sequences of KCNQ2 BINDING SITE, designated SEQ ID:5313, to the nucleotide sequence of GAM47 RNA, herein designated GAM RNA, also designated SEQ ID:269.

Another function of GAM47 is therefore inhibition of Potassium voltage-gated channel, kqt-like subfamily, member 2 (KCNQ2, Accession NP_004509.2), a gene which is probably important in the regulation of neuronal excitability. and therefore is associated with Epilepsy, benign neonatal, 1. Accordingly, utilities of GAM47 include diagnosis, prevention and treatment of Epilepsy, benign neonatal, 1, and of other diseases and clinical conditions associated with KCNQ2.

The function of KCNQ2 has been established by previous studies. Of 12 BFNC probands selected by Singh et al. (1998), 3 were from families that showed significant linkage, with lod scores greater than 3.0 on chromosome 20. Two mutations of the KCNQ2 gene were found in all 3 families. Two were single probands, and a splice site mutation was found in 1. The remaining 7 families were too small for linkage to chromosome 20 to be demonstrated. In this group, however, mutations in KCNQ2 were observed in 2 families. The complete KCNQ2 gene had not been screened for mutations in the 6 remaining pedigrees. In a large pedigree with BFNC, Biervert et al. (1998) found a 5-bp insertion (602235.0003) that was predicted to delete more than 300 amino acids from the C terminus of KCNQ2. Expression of the mutant channel did not yield measurable currents. Thus, impairment of potassium-dependent repolarization was indicated as the cause of this age-specific epileptic syndrome. In a Caucasian family, Dedek et al. (2001) described a syndrome (OMIM Ref. No. 606437) in which benign familial neonatal convulsions (BFNC) was followed later in life by myokymia, involuntary contractions of skeletal muscles. All affected members of the family carried an arg207- to - trp (R207W) mutation (602235.0006) that neutralized a charged amino acid in the S4 voltage-sensor segment of KCNQ2. This substitution led to a shift of voltage-dependent activation of KCNQ2 and a dramatic slowing of activation upon depolarization. Myokymia was thought to result from hyperexcitability of the lower motoneuron; indeed both KCNQ2 and KCNQ3 mRNAs were detected in the anterior horn of the spinal cord where the cells of the lower motoneurons arise.

Dedek et al. (2001) proposed that a difference in firing patterns between motoneurons and central neurons, combined with the drastically slowed voltage activation of the R207W mutant, explained by this particular KCNQ2 mutant caused myokymia in addition to BFNC.

Full details of the abovementioned studies are described in the following publications, the disclosure of which are hereby incorporated by reference:

Dedek, K.; Kunath, B.; Kananura, C.; Reuner, U.; Jentsch, T. J.; Steinlein, O. K.: Myokymia and neonatal epilepsy caused by a mutation in the voltage sensor of the KCNQ2 K(+) channel. Proc. Nat. Acad. Sci. 98:12272-12277, 2001; and Biervert, C.; Schroeder, B. C.; Kubisch, C.; Berkovic, S. F.; Propping, P.; Jentsch, T. J.; Steinlein, O. K.: A potassium channel mutation in neonatal human epilepsy. Science 279: 406.

Further studies establishing the function and utilities of KCNQ2 are found in John Hopkins OMIM database record ID 602235, and in cited publications listed in Table 5, which are hereby incorporated by reference. Ketohexokinase (fructokinase) (KHK, Accession NP_000212.1) is another GAM47 target gene, herein designated TARGET GENE. KHK BINDING SITE is a target binding site found in the 3' untranslated region of multiple transcripts of mRNA encoded by KHK, corresponding to a target binding site such as BINDING SITE I, BINDING SITE II or BINDING SITE III of FIG. 8. Table 4 illustrates the complementarity of the nucleotide sequences of KHK BINDING SITE, designated SEQ ID:14640, to the nucleotide sequence of GAM47 RNA, herein designated GAM RNA, also designated SEQ ID:269.

Another function of GAM47 is therefore inhibition of Ketohexokinase (fructokinase) (KHK, Accession NP_000212.1). Accordingly, utilities of GAM47 include diagnosis, prevention and treatment of diseases and clinical conditions associated with KHK.

Ketohexokinase (fructokinase) (KHK, Accession NP_006479.1) is another GAM47 target gene, herein designated TARGET GENE. KHK BINDING SITE is a target binding site found in the 3' untranslated region of multiple transcripts of mRNA encoded by KHK, corresponding to a target binding site such as BINDING SITE I, BINDING SITE II or BINDING SITE III of FIG. 8. Table 4 illustrates the complementarity of the nucleotide sequences of KHK BINDING SITE, designated SEQ ID:14640, to the nucleotide sequence of GAM47 RNA, herein designated GAM RNA, also designated SEQ ID:269.

Another function of GAM47 is therefore inhibition of Ketohexokinase (fructokinase) (KHK, Accession NP_006479.1). Accordingly, utilities of GAM47 include diagnosis, prevention and treatment of diseases and clinical conditions associated with KHK.

KIAA0040 (Accession NP_055471.1) is another GAM47 target gene, herein designated TARGET GENE. KIAA0040 BINDING SITE is a target binding site found in the 3' untranslated region of mRNA encoded by KIAA0040, corresponding to a target binding site such as BINDING SITE I, BINDING SITE II or BINDING SITE III of FIG. 8. Table 4 illustrates the complementarity of the nucleotide sequences of KIAA0040 BINDING SITE, designated SEQ ID:9372, to the nucleotide sequence of GAM47 RNA, herein designated GAM RNA, also designated SEQ ID:269.

Another function of GAM47 is therefore inhibition of KIAA0040 (Accession NP_055471.1). Accordingly, utilities of GAM47 include diagnosis, prevention and treatment of diseases and clinical conditions associated with KIAA0040.

KIAA0125 (Accession NP_055607.1) is another GAM47 target gene, herein designated TARGET GENE. KIAA0125 BINDING SITE is a target binding site found in the 3' untranslated region of mRNA encoded by KIAA0125, corresponding to a target binding site such as BINDING SITE I, BINDING SITE II or BINDING SITE III of FIG. 8. Table 4 illustrates the complementarity of the nucleotide sequences of KIAA0125 BINDING SITE, designated SEQ ID:11734, to the nucleotide sequence of GAM47 RNA, herein designated GAM RNA, also designated SEQ ID:269.

Another function of GAM47 is therefore inhibition of KIAA0125 (Accession NP_055607.1). Accordingly, utilities of GAM47 include diagnosis, prevention and treatment of diseases and clinical conditions associated with KIAA0125.

KIAA0140 (Accession NP_055476.1) is another GAM47 target gene, herein designated TARGET GENE. KIAA0140 BINDING SITE is a target binding site found in the 3' untranslated region of mRNA encoded by KIAA0140, corresponding to a target binding site such as BINDING SITE I, BINDING SITE II or BINDING SITE III of FIG. 8. Table 4 illustrates the complementarity of the nucleotide sequences of KIAA0140 BINDING SITE, designated SEQ ID:19181, to the nucleotide sequence of GAM47 RNA, herein designated GAM RNA, also designated SEQ ID:269.

Another function of GAM47 is therefore inhibition of KIAA0140 (Accession NP_055476.1). Accordingly, utilities of GAM47 include diagnosis, prevention and treatment of diseases and clinical conditions associated with KIAA0140.

KIAA0152 (Accession NP_055545.1) is another GAM47 target gene, herein designated TARGET GENE. KIAA0152 BINDING SITE is a target binding site found in the 3' untranslated region of mRNA encoded by KIAA0152, corresponding to a target binding site such as BINDING SITE I, BINDING SITE II or BINDING SITE III of FIG. 8. Table 4 illustrates the complementarity of the nucleotide sequences of KIAA0152 BINDING SITE, designated SEQ ID:15014, to the nucleotide sequence of GAM47 RNA, herein designated GAM RNA, also designated SEQ ID:269.

Another function of GAM47 is therefore inhibition of KIAA0152 (Accession NP_055545.1). Accordingly, utilities of GAM47 include diagnosis, prevention and treatment of diseases and clinical conditions associated with KIAA0152.

KIAA0247 (Accession NP_055549.1) is another GAM47 target gene, herein designated TARGET GENE. KIAA0247 BINDING SITE is a target binding site found in the 3' untranslated region of mRNA encoded by KIAA0247, corresponding to a target binding site such as BINDING SITE I, BINDING SITE II or BINDING SITE III of FIG. 8. Table 4 illustrates the complementarity of the nucleotide sequences of KIAA0247 BINDING SITE, designated SEQ ID:11188, to the nucleotide sequence of GAM47 RNA, herein designated GAM RNA, also designated SEQ ID:269.

Another function of GAM47 is therefore inhibition of KIAA0247 (Accession NP_055549.1). Accordingly, utilities of GAM47 include diagnosis, prevention and treatment of diseases and clinical conditions associated with KIAA0247.

KIAA0265 (Accession XP_045954.2) is another GAM47 target gene, herein designated TARGET GENE. KIAA0265 BINDING SITE is a target binding site found in the 3' untranslated region of mRNA encoded by KIAA0265, corresponding to a target binding site such as BINDING SITE I, BINDING SITE II or BINDING SITE III of FIG. 8. Table 4 illustrates the complementarity of the nucleotide sequences of KIAA0265 BINDING SITE, designated SEQ ID:19568, to the nucleotide sequence of GAM47 RNA, herein designated GAM RNA, also designated SEQ ID:269.

Another function of GAM47 is therefore inhibition of KIAA0265 (Accession XP_045954.2). Accordingly, utilities of GAM47 include diagnosis, prevention and treatment of diseases and clinical conditions associated with KIAA0265.

KIAA0342 (Accession XP_047357.3) is another GAM47 target gene, herein designated TARGET GENE. KIAA0342 BINDING SITE is a target binding site found in the 3' untranslated region of mRNA encoded by KIAA0342, corresponding to a target binding site such as BINDING SITE I, BINDING SITE II or BINDING SITE III of FIG. 8. Table 4 illustrates the complementarity of the nucleotide sequences of KIAA0342 BINDING SITE, designated SEQ ID:9739, to the nucleotide sequence of GAM47 RNA, herein designated GAM RNA, also designated SEQ ID:269.

Another function of GAM47 is therefore inhibition of KIAA0342 (Accession XP_047357.3). Accordingly, utilities of GAM47 include diagnosis, prevention and treatment of diseases and clinical conditions associated with KIAA0342.

KIAA0453 (Accession XP_044546.3) is another GAM47 target gene, herein designated TARGET GENE. KIAA0453 BINDING SITE is a target binding site found in the 3' untranslated region of mRNA encoded by KIAA0453, corresponding to a target binding site such as BINDING SITE I, BINDING SITE II or BINDING SITE III of FIG. 8. Table 4 illustrates the complementarity of the nucleotide sequences of KIAA0453 BINDING SITE, designated SEQ ID:9509, to the nucleotide sequence of GAM47 RNA, herein designated GAM RNA, also designated SEQ ID:269.

Another function of GAM47 is therefore inhibition of KIAA0453 (Accession XP_044546.3). Accordingly, utilities of GAM47 include diagnosis, prevention and treatment of diseases and clinical conditions associated with KIAA0453.

KIAA0455 (Accession NP_055654.1) is another GAM47 target gene, herein designated TARGET GENE. KIAA0455 BINDING SITE is a target binding site found in the 3' untranslated region of multiple transcripts of mRNA encoded by KIAA0455, corresponding to a target binding site such as BINDING SITE I, BINDING SITE II or BINDING SITE III of FIG. 8. Table 4 illustrates the complementarity of the nucleotide sequences of KIAA0455 BINDING SITE, designated SEQ ID:8206, to the nucleotide sequence of GAM47 RNA, herein designated GAM RNA, also designated SEQ ID:269.

Another function of GAM47 is therefore inhibition of KIAA0455 (Accession NP_055654.1). Accordingly, utilities of GAM47 include diagnosis, prevention and treatment of diseases and clinical conditions associated with KIAA0455.

KIAA0455 (Accession XP_051785.3) is another GAM47 target gene, herein designated TARGET GENE. KIAA0455 BINDING SITE is a target binding site found in the 3' untranslated region of multiple transcripts of mRNA encoded by KIAA0455, corresponding to a target binding site such as BINDING SITE I, BINDING SITE II or BINDING SITE III of FIG. 8. Table 4 illustrates the complementarity of the nucleotide sequences of KIAA0455 BINDING SITE, designated SEQ ID:8206, to the nucleotide sequence of GAM47 RNA, herein designated GAM RNA, also designated SEQ ID:269.

Another function of GAM47 is therefore inhibition of KIAA0455 (Accession XP_051785.3). Accordingly, utilities of GAM47 include diagnosis, prevention and treatment of diseases and clinical conditions associated with KIAA0455.

KIAA0471 (Accession NP_055672.1) is another GAM47 target gene, herein designated TARGET GENE. KIAA0471 BINDING SITE is a target binding site found in the 3' untranslated region of mRNA encoded by KIAA0471, corresponding to a target binding site such as BINDING SITE I, BINDING SITE II or BINDING SITE III of FIG. 8. Table 4 illustrates the complementarity of the nucleotide sequences of KIAA0471 BINDING SITE, designated SEQ ID:15061, to the nucleotide sequence of GAM47 RNA, herein designated GAM RNA, also designated SEQ ID:269.

Another function of GAM47 is therefore inhibition of KIAA0471 (Accession NP_055672.1). Accordingly, utilities of GAM47 include diagnosis, prevention and treatment of diseases and clinical conditions associated with KIAA0471.

KIAA0472 (Accession XP_290898.1) is another GAM47 target gene, herein designated TARGET GENE. KIAA0472 BINDING SITE is a target binding site found in the 5' untranslated region of mRNA encoded by KIAA0472, corresponding to a target binding site such as BINDING SITE I, BINDING SITE II or BINDING SITE III of FIG. 8. Table 4 illustrates the complementarity of the nucleotide sequences of KIAA0472 BINDING SITE, designated SEQ ID:18719, to the nucleotide sequence of GAM47 RNA, herein designated GAM RNA, also designated SEQ ID:269.

Another function of GAM47 is therefore inhibition of KIAA0472 (Accession XP_290898.1). Accordingly, utilities of GAM47 include diagnosis, prevention and treatment of diseases and clinical conditions associated with KIAA0472.

KIAA0532 (Accession XP_047659.6) is another GAM47 target gene, herein designated TARGET GENE. KIAA0532 BINDING SITE is a target binding site found in the 3' untranslated region of mRNA encoded by KIAA0532, corresponding to a target binding site such as BINDING SITE I, BINDING SITE II or BINDING SITE III of FIG. 8. Table 4 illustrates the complementarity of the nucleotide sequences of KIAA0532 BINDING SITE, designated SEQ ID:5472, to the nucleotide sequence of GAM47 RNA, herein designated GAM RNA, also designated SEQ ID:269.

Another function of GAM47 is therefore inhibition of KIAA0532 (Accession XP_047659.6). Accordingly, utilities of GAM47 include diagnosis, prevention and treatment of diseases and clinical conditions associated with KIAA0532.

KIAA0570 (Accession XP_291018.1) is another GAM47 target gene, herein designated TARGET GENE. KIAA0570 BINDING SITE is a target binding site found in the 3' untranslated region of mRNA encoded by KIAA0570, corresponding to a target binding site such as BINDING SITE I, BINDING SITE II or BINDING SITE III of FIG. 8. Table 4 illustrates the complementarity of the nucleotide sequences of KIAA0570 BINDING SITE, designated SEQ ID:4468, to the nucleotide sequence of GAM47 RNA, herein designated GAM RNA, also designated SEQ ID:269.

Another function of GAM47 is therefore inhibition of KIAA0570 (Accession XP_291018.1). Accordingly, utilities of GAM47 include diagnosis, prevention and treatment of diseases and clinical conditions associated with KIAA0570.

KIAA0605 (Accession NP_055509.1) is another GAM47 target gene, herein designated TARGET GENE. KIAA0605 BINDING SITE is a target binding site found in the 3' untranslated region of mRNA encoded by KIAA0605, corresponding to a target binding site such as BINDING SITE I, BINDING SITE II or BINDING SITE III of FIG. 8. Table 4 illustrates the complementarity of the nucleotide sequences of KIAA0605 BINDING SITE, designated SEQ ID:19802, to the nucleotide sequence of GAM47 RNA, herein designated GAM RNA, also designated SEQ ID:269.

Another function of GAM47 is therefore inhibition of KIAA0605 (Accession NP_055509.1). Accordingly, utilities of GAM47 include diagnosis, prevention and treatment of diseases and clinical conditions associated with KIAA0605.

KIAA0721 (Accession NP_067680.2) is another GAM47 target gene, herein designated TARGET GENE. KIAA0721 BINDING SITE is a target binding site found in the 3' untranslated region of mRNA encoded by KIAA0721, corresponding to a target binding site such as BINDING SITE I, BINDING SITE II or BINDING SITE III of FIG. 8. Table 4 illustrates the complementarity of the nucleotide sequences of KIAA0721 BINDING SITE, designated SEQ ID:5642, to the nucleotide sequence of GAM47 RNA, herein designated GAM RNA, also designated SEQ ID:269.

Another function of GAM47 is therefore inhibition of KIAA0721 (Accession NP_067680.2). Accordingly, utilities of GAM47 include diagnosis, prevention and treatment of diseases and clinical conditions associated with KIAA0721.

KIAA0790 (Accession NP_056093.1) is another GAM47 target gene, herein designated TARGET GENE. KIAA0790 BINDING SITE is a target binding site found in the 3' untranslated region of mRNA encoded by KIAA0790, corresponding to a target binding site such as BINDING SITE I, BINDING SITE II or BINDING SITE III of FIG. 8. Table 4 illustrates the complementarity of the nucleotide sequences of KIAA0790 BINDING SITE, designated SEQ ID:12202, to the nucleotide sequence of GAM47 RNA, herein designated GAM RNA, also designated SEQ ID:269.

Another function of GAM47 is therefore inhibition of KIAA0790 (Accession NP_056093.1). Accordingly, utilities of GAM47 include diagnosis, prevention and treatment of diseases and clinical conditions associated with KIAA0790.

KIAA0795 (Accession NP_079286.1) is another GAM47 target gene, herein designated TARGET GENE. KIAA0795 BINDING SITE is a target binding site found in the 3' untranslated region of mRNA encoded by KIAA0795, corresponding to a target binding site such as BINDING SITE I, BINDING SITE II or BINDING SITE III of FIG. 8. Table 4 illustrates the complementarity of the nucleotide sequences of KIAA0795 BINDING SITE, designated SEQ ID:6957, to the nucleotide sequence of GAM47 RNA, herein designated GAM RNA, also designated SEQ ID:269.

Another function of GAM47 is therefore inhibition of KIAA0795 (Accession NP_079286.1). Accordingly, utilities of GAM47 include diagnosis, prevention and treatment of diseases and clinical conditions associated with KIAA0795.

KIAA0841 (Accession XP_049237.1) is another GAM47 target gene, herein designated TARGET GENE. KIAA0841 BINDING SITE is a target binding site found in the 3' untranslated region of mRNA encoded by KIAA0841, corresponding to a target binding site such as BINDING SITE I, BINDING SITE II or BINDING SITE III of FIG. 8. Table 4 illustrates the complementarity of the nucleotide sequences of KIAA0841 BINDING SITE, designated SEQ ID:11413, to the nucleotide sequence of GAM47 RNA, herein designated GAM RNA, also designated SEQ ID:269.

Another function of GAM47 is therefore inhibition of KIAA0841 (Accession XP_049237.1). Accordingly, utilities of GAM47 include diagnosis, prevention and treatment of diseases and clinical conditions associated with KIAA0841.

KIAA0843 (Accession NP_055760.1) is another GAM47 target gene, herein designated TARGET GENE. KIAA0843 BINDING SITE is a target binding site found in the 3' untranslated region of mRNA encoded by KIAA0843, corresponding to a target binding site such as BINDING SITE I, BINDING SITE II or BINDING SITE III of FIG. 8. Table 4 illustrates the complementarity of the nucleotide sequences of KIAA0843 BINDING SITE, designated SEQ ID:5395, to the nucleotide sequence of GAM47 RNA, herein designated GAM RNA, also designated SEQ ID:269.

Another function of GAM47 is therefore inhibition of KIAA0843 (Accession NP_055760.1). Accordingly, utilities of GAM47 include diagnosis, prevention and treatment of diseases and clinical conditions associated with KIAA0843.

KIAA0889 (Accession NP_056192.1) is another GAM47 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:4048, to the nucleotide sequence of GAM47 RNA, herein designated GAM RNA, also designated SEQ ID:269.

Another function of GAM47 is therefore inhibition of KIAA0889 (Accession NP_056192.1). Accordingly, utilities of GAM47 include diagnosis, prevention and treatment of diseases and clinical conditions associated with KIAA0889.

KIAA0889 (Accession NP_689470.1) is another GAM47 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:4048, to the nucleotide sequence of GAM47 RNA, herein designated GAM RNA, also designated SEQ ID:269.

Another function of GAM47 is therefore inhibition of KIAA0889 (Accession NP_689470.1). Accordingly, utilities of GAM47 include diagnosis, prevention and treatment of diseases and clinical conditions associated with KIAA0889.

KIAA1076 (Accession XP_037523.6) is another GAM47 target gene, herein designated TARGET GENE. KIAA1076 BINDING SITE is a target binding site found in the 3' untranslated region of mRNA encoded by KIAA1076, corresponding to a target binding site such as BINDING SITE I, BINDING SITE II or BINDING SITE III of FIG. 8. Table 4 illustrates the complementarity of the nucleotide sequences of KIAA1076 BINDING SITE, designated SEQ ID:6169, to the nucleotide sequence of GAM47 RNA, herein designated GAM RNA, also designated SEQ ID:269.

Another function of GAM47 is therefore inhibition of KIAA1076 (Accession XP_037523.6). Accordingly, utilities of GAM47 include diagnosis, prevention and treatment of diseases and clinical conditions associated with KIAA1076.

KIAA1145 (Accession NP_065749.1) is another GAM47 target gene, herein designated TARGET GENE. KIAA1145 BINDING SITE is a target binding site found in the 3' untranslated region of mRNA encoded by KIAA1145, corresponding to a target binding site such as BINDING SITE I, BINDING SITE II or BINDING SITE III of FIG. 8. Table 4 illustrates the complementarity of the nucleotide sequences of KIAA1145 BINDING SITE, designated SEQ ID:14401, to the nucleotide sequence of GAM47 RNA, herein designated GAM RNA, also designated SEQ ID:269.

Another function of GAM47 is therefore inhibition of KIAA1145 (Accession NP_065749.1). Accordingly, utilities of GAM47 include diagnosis, prevention and treatment of diseases and clinical conditions associated with KIAA1145.

KIAA1155 (Accession XP_030864.2) is another GAM47 target gene, herein designated TARGET GENE. KIAA1155 BINDING SITE is a target binding site found in the 3' untranslated region of mRNA encoded by KIAA1155, corresponding to a target binding site such as BINDING SITE I, BINDING SITE II or BINDING SITE III of FIG. 8. Table 4 illustrates the complementarity of the nucleotide sequences of KIAA1155 BINDING SITE, designated SEQ ID:17447, to the nucleotide sequence of GAM47 RNA, herein designated GAM RNA, also designated SEQ ID:269.

Another function of GAM47 is therefore inhibition of KIAA1155 (Accession XP_030864.2). Accordingly, utilities of GAM47 include diagnosis, prevention and treatment of diseases and clinical conditions associated with KIAA1155.

KIAA1157 (Accession XP_051093.2) is another GAM47 target gene, herein designated TARGET GENE. KIAA1157 BINDING SITE is a target binding site found in the 3' untranslated region of mRNA encoded by KIAA1157, corresponding to a target binding site such as BINDING SITE I, BINDING SITE II or BINDING SITE III of FIG. 8. Table 4 illustrates the complementarity of the nucleotide sequences of KIAA1157 BINDING SITE, designated SEQ ID:715, to the nucleotide sequence of GAM47 RNA, herein designated GAM RNA, also designated SEQ ID:269.

Another function of GAM47 is therefore inhibition of KIAA1157 (Accession XP_051093.2). Accordingly, utilities of GAM47 include diagnosis, prevention and treatment of diseases and clinical conditions associated with KIAA1157.

KIAA1198 (Accession NP_065765.1) is another GAM47 target gene, herein designated TARGET GENE. KIAA1198 BINDING SITE is a target binding site found in the 3' untranslated region of mRNA encoded by KIAA1198, corresponding to a target binding site such as BINDING SITE I, BINDING SITE II or BINDING SITE III of FIG. 8. Table 4 illustrates the complementarity of the nucleotide sequences of KIAA1198 BINDING SITE, designated SEQ ID:11270, to the nucleotide sequence of GAM47 RNA, herein designated GAM RNA, also designated SEQ ID:269.

Another function of GAM47 is therefore inhibition of KIAA1198 (Accession NP_065765.1). Accordingly, utilities of GAM47 include diagnosis, prevention and treatment of diseases and clinical conditions associated with KIAA1198.

KIAA1257 (Accession XP_031577.2) is another GAM47 target gene, herein designated TARGET GENE. KIAA1257 BINDING SITE is a target binding site found in the 5' untranslated region of mRNA encoded by KIAA1257, corresponding to a target binding site such as BINDING SITE I, BINDING SITE II or BINDING SITE III of FIG. 8. Table 4 illustrates the complementarity of the nucleotide sequences of KIAA1257 BINDING SITE, designated SEQ ID:5577, to the nucleotide sequence of GAM47 RNA, herein designated GAM RNA, also designated SEQ ID:269.

Another function of GAM47 is therefore inhibition of KIAA1257 (Accession XP_031577.2). Accordingly, utilities of GAM47 include diagnosis, prevention and treatment of diseases and clinical conditions associated with KIAA1257.

KIAA1474 (Accession NP_065907.1) is another GAM47 target gene, herein designated TARGET GENE. KIAA1474 BINDING SITE is a target binding site found in the 3' untranslated region of mRNA encoded by KIAA1474, corresponding to a target binding site such as BINDING SITE I, BINDING SITE II or BINDING SITE III of FIG. 8. Table 4 illustrates the complementarity of the nucleotide sequences of KIAA1474 BINDING SITE, designated SEQ ID:13050, to the nucleotide sequence of GAM47 RNA, herein designated GAM RNA, also designated SEQ ID:269.

Another function of GAM47 is therefore inhibition of KIAA1474 (Accession NP_065907.1). Accordingly, utilities of GAM47 include diagnosis, prevention and treatment of diseases and clinical conditions associated with KIAA1474.

KIAA1511 (Accession XP_046581.5) is another GAM47 target gene, herein designated TARGET GENE. KIAA1511 BINDING SITE is a target binding site found in the 3' untranslated region of mRNA encoded by KIAA1511, corresponding to a target binding site such as BINDING SITE I, BINDING SITE II or BINDING SITE III of FIG. 8. Table 4 illustrates the complementarity of the nucleotide sequences of KIAA1511 BINDING SITE, designated SEQ ID:15469, to the nucleotide sequence of GAM47 RNA, herein designated GAM RNA, also designated SEQ ID:269.

Another function of GAM47 is therefore inhibition of KIAA1511 (Accession XP_046581.5). Accordingly, utilities of GAM47 include diagnosis, prevention and treatment of diseases and clinical conditions associated with KIAA1511.

KIAA1579 (Accession NP_060681.1) is another GAM47 target gene, herein designated TARGET GENE. KIAA1579 BINDING SITE is a target binding site found in the 3' untranslated region of mRNA encoded by KIAA1579, corresponding to a target binding site such as BINDING SITE I, BINDING SITE II or BINDING SITE III of FIG. 8. Table 4 illustrates the complementarity of the nucleotide sequences of KIAA1579 BINDING SITE, designated SEQ ID:2423, to the nucleotide sequence of GAM47 RNA, herein designated GAM RNA, also designated SEQ ID:269.

Another function of GAM47 is therefore inhibition of KIAA1579 (Accession NP_060681.1). Accordingly, utilities of GAM47 include diagnosis, prevention and treatment of diseases and clinical conditions associated with KIAA1579.

KIAA1596 (Accession XP_048128.4) is another GAM47 target gene, herein designated TARGET GENE. KIAA1596 BINDING SITE is a target binding site found in the 3' untranslated region of mRNA encoded by KIAA1596, corresponding to a target binding site such as BINDING SITE I, BINDING SITE II or BINDING SITE III of FIG. 8. Table 4 illustrates the complementarity of the nucleotide sequences of KIAA1596 BINDING SITE, designated SEQ ID:16420, to the nucleotide sequence of GAM47 RNA, herein designated GAM RNA, also designated SEQ ID:269.

Another function of GAM47 is therefore inhibition of KIAA1596 (Accession XP_048128.4). Accordingly, utilities of GAM47 include diagnosis, prevention and treatment of diseases and clinical conditions associated with KIAA1596.

KIAA1691 (Accession XP_166523.1) is another GAM47 target gene, herein designated TARGET GENE. KIAA1691 BINDING SITE is a target binding site found in the 3' untranslated region of mRNA encoded by KIAA1691, corresponding to a target binding site such as BINDING SITE I, BINDING SITE II or BINDING SITE III of FIG. 8. Table 4 illustrates the complementarity of the nucleotide sequences of KIAA1691 BINDING SITE, designated SEQ ID:8926, to the nucleotide sequence of GAM47 RNA, herein designated GAM RNA, also designated SEQ ID:269.

Another function of GAM47 is therefore inhibition of KIAA1691 (Accession XP_166523.1). Accordingly, utilities of GAM47 include diagnosis, prevention and treatment of diseases and clinical conditions associated with KIAA1691.

KIAA1735 (Accession XP_290496.1) is another GAM47 target gene, herein designated TARGET GENE. KIAA1735 BINDING SITE1 and KIAA1735 BINDING SITE2 are target binding sites found in untranslated regions of mRNA encoded by KIAA1735, corresponding to target binding sites such as BINDING SITE I, BINDING SITE II or BINDING SITE III of FIG. 8. Table 4 illustrates the complementarity of the nucleotide sequences of KIAA1735 BINDING SITE1 and KIAA1735 BINDING SITE2, designated SEQ ID:11569 and SEQ ID:15572 respectively, to the nucleotide sequence of GAM47 RNA, herein designated GAM RNA, also designated SEQ ID:269.

Another function of GAM47 is therefore inhibition of KIAA1735 (Accession XP_290496.1). Accordingly, utilities of GAM47 include diagnosis, prevention and treatment of diseases and clinical conditions associated with KIAA1735.

KIAA1750 (Accession NP_277047.1) is another GAM47 target gene, herein designated TARGET GENE. KIAA1750 BINDING SITE is a target binding site found in the 3' untranslated region of mRNA encoded by KIAA1750, corresponding to a target binding site such as BINDING SITE I, BINDING SITE II or BINDING SITE III of FIG. 8. Table 4 illustrates the complementarity of the nucleotide sequences of KIAA1750 BINDING SITE, designated SEQ ID:15393, to the nucleotide sequence of GAM47 RNA, herein designated GAM RNA, also designated SEQ ID:269.

Another function of GAM47 is therefore inhibition of KIAA1750 (Accession NP_277047.1). Accordingly, utilities of GAM47 include diagnosis, prevention and treatment of diseases and clinical conditions associated with KIAA1750.

KIAA1754 (Accession NP_203755.1) is another GAM47 target gene, herein designated TARGET GENE. KIAA1754 BINDING SITE is a target binding site found in the 3' untranslated region of mRNA encoded by KIAA1754, corresponding to a target binding site such as BINDING SITE I, BINDING SITE II or BINDING SITE III of FIG. 8. Table 4 illustrates the complementarity of the nucleotide sequences of KIAA1754 BINDING SITE, designated SEQ ID:18714, to the nucleotide sequence of GAM47 RNA, herein designated GAM RNA, also designated SEQ ID:269.

Another function of GAM47 is therefore inhibition of KIAA1754 (Accession NP_203755.1). Accordingly, utilities of GAM47 include diagnosis, prevention and treatment of diseases and clinical conditions associated with KIAA1754.

KIAA1827 (Accession XP_290834.1) is another GAM47 target gene, herein designated TARGET GENE. KIAA1827 BINDING SITE is a target binding site found in the 3' untranslated region of mRNA encoded by KIAA1827, corresponding to a target binding site such as BINDING SITE I, BINDING SITE II or BINDING SITE III of FIG. 8. Table 4 illustrates the complementarity of the nucleotide sequences of KIAA1827 BINDING SITE, designated SEQ ID:8005, to the nucleotide sequence of GAM47 RNA, herein designated GAM RNA, also designated SEQ ID:269.

Another function of GAM47 is therefore inhibition of KIAA1827 (Accession XP_290834.1). Accordingly, utilities of GAM47 include diagnosis, prevention and treatment of diseases and clinical conditions associated with KIAA1827.

KIAA1847 (Accession NP_852149.1) is another GAM47 target gene, herein designated TARGET GENE. KIAA1847 BINDING SITE is a target binding site found in the 3' untranslated region of multiple transcripts of mRNA encoded by KIAA1847, corresponding to a target binding site such as BINDING SITE I, BINDING SITE II or BINDING SITE III of FIG. 8. Table 4 illustrates the complementarity of the nucleotide sequences of KIAA1847 BINDING SITE, designated SEQ ID:9906, to the nucleotide sequence of GAM47 RNA, herein designated GAM RNA, also designated SEQ ID:269.

Another function of GAM47 is therefore inhibition of KIAA1847 (Accession NP_852149.1). Accordingly, utilities of GAM47 include diagnosis, prevention and treatment of diseases and clinical conditions associated with KIAA1847.

KIAA1854 (Accession XP_049884.1) is another GAM47 target gene, herein designated TARGET GENE. KIAA1854 BINDING SITE1 and KIAA1854 BINDING SITE2 are target binding sites found in untranslated regions of mRNA encoded by KIAA1854, corresponding to target binding sites such as BINDING SITE I, BINDING SITE II or BINDING SITE III of FIG. 8. Table 4 illustrates the complementarity of the nucleotide sequences of KIAA1854 BINDING SITE1 and KIAA1854 BINDING SITE2, designated SEQ ID:9110 and SEQ ID:16614 respectively, to the nucleotide sequence of GAM47 RNA, herein designated GAM RNA, also designated SEQ ID:269.

Another function of GAM47 is therefore inhibition of KIAA1854 (Accession XP_049884.1). Accordingly, utilities of GAM47 include diagnosis, prevention and treatment of diseases and clinical conditions associated with KIAA1854.

KIAA1904 (Accession XP_056282.1) is another GAM47 target gene, herein designated TARGET GENE. KIAA1904 BINDING SITE is a target binding site found in the 3' untranslated region of mRNA encoded by KIAA1904, corresponding to a target binding site such as BINDING SITE I, BINDING SITE II or BINDING SITE III of FIG. 8. Table 4 illustrates the complementarity of the nucleotide sequences of KIAA1904 BINDING SITE, designated SEQ ID:1062, to the nucleotide sequence of GAM47 RNA, herein designated GAM RNA, also designated SEQ ID:269.

Another function of GAM47 is therefore inhibition of KIAA1904 (Accession XP_056282.1). Accordingly, utilities of GAM47 include diagnosis, prevention and treatment of diseases and clinical conditions associated with KIAA1904.

KIAA1908 (Accession XP_055834.1) is another GAM47 target gene, herein designated TARGET GENE. KIAA1908 BINDING SITE is a target binding site found in the 5' untranslated region of mRNA encoded by KIAA1908, corresponding to a target binding site such as BINDING SITE I, BINDING SITE II or BINDING SITE III of FIG. 8. Table 4 illustrates the complementarity of the nucleotide sequences of KIAA1908 BINDING SITE, designated SEQ ID:4011, to the nucleotide sequence of GAM47 RNA, herein designated GAM RNA, also designated SEQ ID:269.

Another function of GAM47 is therefore inhibition of KIAA1908 (Accession XP_055834.1). Accordingly, utilities of GAM47 include diagnosis, prevention and treatment of diseases and clinical conditions associated with KIAA1908.

KIAA1977 (Accession XP_058800.3) is another GAM47 target gene, herein designated TARGET GENE. KIAA1977 BINDING SITE is a target binding site found in the 5' untranslated region of mRNA encoded by KIAA1977, corresponding to a target binding site such as BINDING SITE I, BINDING SITE II or BINDING SITE III of FIG. 8. Table 4 illustrates the complementarity of the nucleotide sequences of KIAA1977 BINDING SITE, designated SEQ ID:1151, to the nucleotide sequence of GAM47 RNA, herein designated GAM RNA, also designated SEQ ID:269.

Another function of GAM47 is therefore inhibition of KIAA1977 (Accession XP_058800.3). Accordingly, utilities of GAM47 include diagnosis, prevention and treatment of diseases and clinical conditions associated with KIAA1977.

KIF12 (Accession NP_612433.1) is another GAM47 target gene, herein designated TARGET GENE. KIF12 BINDING SITE is a target binding site found in the 5' untranslated region of mRNA encoded by KIF12, corresponding to a target binding site such as BINDING SITE I, BINDING SITE II or BINDING SITE III of FIG. 8. Table 4 illustrates the complementarity of the nucleotide sequences of KIF12 BINDING SITE, designated SEQ ID:13316, to the nucleotide sequence of GAM47 RNA, herein designated GAM RNA, also designated SEQ ID:269.

Another function of GAM47 is therefore inhibition of KIF12 (Accession NP_612433.1). Accordingly, utilities of GAM47 include diagnosis, prevention and treatment of diseases and clinical conditions associated with KIF12.

Kinesin family member 5a (KIF5A, Accession NP_004975.1) is another GAM47 target gene, herein designated TARGET GENE. KIF5A BINDING SITE is a target binding site found in the 3' untranslated region of mRNA encoded by KIF5A, corresponding to a target binding site such as BINDING SITE I, BINDING SITE II or BINDING SITE III of FIG. 8. Table 4 illustrates the complementarity of the nucleotide sequences of KIF5A BINDING SITE, designated SEQ ID:12319, to the nucleotide sequence of GAM47 RNA, herein designated GAM RNA, also designated SEQ ID:269.

Another function of GAM47 is therefore inhibition of Kinesin family member 5a (KIF5A, Accession NP_004975.1), a gene which is a microtubule-associated force-producing protein that may play a role in organelle transport. Accordingly, utilities of GAM47 include diagnosis, prevention and treatment of diseases and clinical conditions associated with KIF5A.

The function of KIF5A has been established by previous studies. By screening a human hippocampal cDNA library with a fragment of a human kinesin heavy chain (KHC) expressed sequence tag clone, Niclas et al. (1994) isolated cDNAs encoding NKHC. The predicted 1,032-amino acid protein has the characteristic features of a KHC, as well as a unique C-terminal stretch of 69 amino acids. The amino acid sequence of NKHC is 65% and 54% identical to the amino acid sequences of KNS1 and the Drosophila KHC, respectively. Northern blot analysis of rat tissues detected Nkhc expression only in brain, where multiple transcripts were found. Immunoblot analysis of rat tissue extracts using antibodies specific for NKHC detected a doublet of approximately 120 and 133 kD only in brain and sciatic nerve tissue. By indirect immunofluorescence, the authors showed that NKHC is distributed throughout the central nervous system but is highly enriched in subsets of neurons. Within cultured hippocampal neurons, NKHC is concentrated in the cell body, particularly in the perinuclear region. By FISH, Hamlin et al. (1998) mapped the KIF5A and GALGT (OMIM Ref. No. 601873) genes to 12q13. They found that these genes are contained within the same approximately 200-kb YAC insert as the GLI (OMIM Ref. No. 165220) and DDIT3 (OMIM Ref. No. 126337) genes.

Full details of the abovementioned studies are described in the following publications, the disclosure of which are hereby incorporated by reference:

Hamlin, P. J.; Jones, P. F.; Leek, J. P.; Bransfield, K.; Lench, N. J.; Aldersley, M. A.; Howdle, P. D.; Markham, A. F.; Robinson, P. A.: Assignment of GALGT encoding beta-1,4N-acetylgalactosaminyl-transferase (GalNAc-T) and KIF5A encoding neuronal kinesin (D12S1889) to human chromosome band 12q13 by assignment to ICI YAC 26EG10 and in situ hybridization. Cytogenet. Cell Genet. 82:267-268, 1998; and Niclas, J.; Navone, F.; Hom-Booher, N.; Vale, R. D.: Cloning and localization of a conventional kinesin motor expressed exclusively in neurons. Neuron 12:1059-1072, 1994.

Further studies establishing the function and utilities of KIF5A are found in John Hopkins OMIM database record ID 602821, and in cited publications listed in Table 5, which are hereby incorporated by reference. Karyopherin alpha 4 (importin alpha 3) (KPNA4, Accession NP_002259.1) is another GAM47 target gene, herein designated TARGET GENE. KPNA4 BINDING SITE is a target binding site found in the 3' untranslated region of mRNA encoded by KPNA4, corresponding to a target binding site such as BINDING SITE I, BINDING SITE II or BINDING SITE III of FIG. 8. Table 4 illustrates the complementarity of the nucleotide sequences of KPNA4 BINDING SITE, designated SEQ ID:18627, to the nucleotide sequence of GAM47 RNA, herein designated GAM RNA, also designated SEQ ID:269.

Another function of GAM47 is therefore inhibition of Karyopherin alpha 4 (importin alpha 3) (KPNA4, Accession NP_002259.1), a gene which promotes docking of import substrates to the nuclear pore complex. Accordingly, utilities of GAM47 include diagnosis, prevention and treatment of diseases and clinical conditions associated with KPNA4.

The function of KPNA4 has been established by previous studies. The nuclear import of karyophilic proteins is directed by short amino acid sequences termed nuclear localization signals (NLSs). Karyopherins, or importins, are cytoplasmic proteins that recognize NLSs and dock NLS-containing proteins to the nuclear pore complex. See KPNA2 (OMIM Ref. No. 600685). Using a yeast 2-hybrid system to identify proteins that interact with the DNA helicase Q1 (RECQL; 600537), Seki et al. (1997) isolated HeLa cell cDNAs encoding QIP1. The predicted 521-amino acid QIP1 protein contains the conserved N-terminal binding site for karyopherin-beta (see OMIM Ref. No. KPNB1; 602738) and a series of 7 degenerate 'armadillo' repeats, which are 42-amino acid motifs implicated in protein-protein interactions. Human QIP1 has 50% amino acid identity with human KPNA2, 49% with Xenopus importin-alpha, 47% with human KPNA1 (OMIM Ref. No. 600686), and 46% with S. cerevisiae Srp1. The authors demonstrated that QIP1 interacted with the NLSs of DNA helicase Q1 and SV40 T antigen. Kohler et al. (1997)

isolated a human KPNA4 cDNA. The predicted KPNA4 protein contains an N-terminal importin-beta-binding (IBB) domain, 8 armadillo repeats, and a C-terminal acidic region, all of which are characteristics of importin-alphas. Of the known human importin-alphas, KPNA4 shares the highest sequence identity with KPNA3 (OMIM Ref. No. 601892). Northern blot analysis detected a 4.4-kb KPNA4 transcript in all tissues tested. However, expression levels varied considerably among tissues, with the highest expression in testis, ovary, small intestine, and pancreas, and the lowest expression in kidney, thymus, colon, and peripheral blood leukocytes.

Full details of the abovementioned studies are described in the following publications, the disclosure of which are hereby incorporated by reference:

Ayala-Madrigal, M. L.; Doerr, S.; Ramirez-Duenas, M. L.; Hansmann, I.: Assignment of KPNA4 and KPNB1 encoding karyopherin alpha 4 and beta 1 to human chromosome bands 11q22 and 17q21 respectively, by in situ hybridization. Cytogenet. Cell Genet. 89:258-259, 2000; and Kohler, M.; Ansieau, S.; Prehn, S.; Leutz, A.; Haller, H.; Hartmann, E.: Cloning of two novel human importin-alpha subunits and analysis of the expression pattern of the importin-alpha.

Further studies establishing the function and utilities of KPNA4 are found in John Hopkins OMIM database record ID 602970, and in cited publications listed in Table 5, which are hereby incorporated by reference. KSP37 (Accession NP_114156.1) is another GAM47 target gene, herein designated TARGET GENE. KSP37 BINDING SITE is a target binding site found in the 3' untranslated region of mRNA encoded by KSP37, corresponding to a target binding site such as BINDING SITE I, BINDING SITE II or BINDING SITE III of FIG. 8. Table 4 illustrates the complementarity of the nucleotide sequences of KSP37 BINDING SITE, designated SEQ ID:11509, to the nucleotide sequence of GAM47 RNA, herein designated GAM RNA, also designated SEQ ID:269.

Another function of GAM47 is therefore inhibition of KSP37 (Accession NP_114156.1). Accordingly, utilities of GAM47 include diagnosis, prevention and treatment of diseases and clinical conditions associated with KSP37.

LENG8 (Accession NP_443157.1) is another GAM47 target gene, herein designated TARGET GENE. LENG8 BINDING SITE is a target binding site found in the 3' untranslated region of mRNA encoded by LENG8, corresponding to a target binding site such as BINDING SITE I, BINDING SITE II or BINDING SITE III of FIG. 8. Table 4 illustrates the complementarity of the nucleotide sequences of LENG8 BINDING SITE, designated SEQ ID:5511, to the nucleotide sequence of GAM47 RNA, herein designated GAM RNA, also designated SEQ ID:269.

Another function of GAM47 is therefore inhibition of LENG8 (Accession NP_443157.1). Accordingly, utilities of GAM47 include diagnosis, prevention and treatment of diseases and clinical conditions associated with LENG8.

LEP5 (Accession NP_848130.1) is another GAM47 target gene, herein designated TARGET GENE. LEP5 BINDING SITE is a target binding site found in the 3' untranslated region of mRNA encoded by LEP5, corresponding to a target binding site such as BINDING SITE I, BINDING SITE II or BINDING SITE III of FIG. 8. Table 4 illustrates the complementarity of the nucleotide sequences of LEP5 BINDING SITE, designated SEQ ID:598, to the nucleotide sequence of GAM47 RNA, herein designated GAM RNA, also designated SEQ ID:269.

Another function of GAM47 is therefore inhibition of LEP5 (Accession NP_848130.1). Accordingly, utilities of GAM47 include diagnosis, prevention and treatment of diseases and clinical conditions associated with LEP5.

Leucine-rich repeat lgi family, member 3 (LGI3, Accession NP_644807.1) is another GAM47 target gene, herein designated TARGET GENE. LGI3 BINDING SITE is a target binding site found in the 3' untranslated region of mRNA encoded by LGI3, corresponding to a target binding site such as BINDING SITE I, BINDING SITE II or BINDING SITE III of FIG. 8. Table 4 illustrates the complementarity of the nucleotide sequences of LGI3 BINDING SITE, designated SEQ ID:11001, to the nucleotide sequence of GAM47 RNA, herein designated GAM RNA, also designated SEQ ID:269.

Another function of GAM47 is therefore inhibition of Leucine-rich repeat lgi family, member 3 (LGI3, Accession NP_644807.1). Accordingly, utilities of GAM47 include diagnosis, prevention and treatment of diseases and clinical conditions associated with LGI3.

Lim homeobox protein 1 (LHX1, Accession NP_005559.2) is another GAM47 target gene, herein designated TARGET GENE. LHX1 BINDING SITE is a target binding site found in the 5' untranslated region of mRNA encoded by LHX1, corresponding to a target binding site such as BINDING SITE I, BINDING SITE II or BINDING SITE III of FIG. 8. Table 4 illustrates the complementarity of the nucleotide sequences of LHX1 BINDING SITE, designated SEQ ID:2371, to the nucleotide sequence of GAM47 RNA, herein designated GAM RNA, also designated SEQ ID:269.

Another function of GAM47 is therefore inhibition of Lim homeobox protein 1 (LHX1, Accession NP_005559.2). Accordingly, utilities of GAM47 include diagnosis, prevention and treatment of diseases and clinical conditions associated with LHX1.

Leukemia inhibitory factor (cholinergic differentiation factor) (LIF, Accession NP_002300.1) is another GAM47 target gene, herein designated TARGET GENE. LIF BINDING SITE is a target binding site found in the 3' untranslated region of mRNA encoded by LIF, corresponding to a target binding site such as BINDING SITE I, BINDING SITE II or BINDING SITE III of FIG. 8. Table 4 illustrates the complementarity of the nucleotide sequences of LIF BINDING SITE, designated SEQ ID:3616, to the nucleotide sequence of GAM47 RNA, herein designated GAM RNA, also designated SEQ ID:269.

Another function of GAM47 is therefore inhibition of Leukemia inhibitory factor (cholinergic differentiation factor) (LIF, Accession NP_002300.1). Accordingly, utilities of GAM47 include diagnosis, prevention and treatment of diseases and clinical conditions associated with LIF.

Lipase, endothelial (LIPG, Accession NP_006024.1) is another GAM47 target gene, herein designated TARGET GENE. LIPG BINDING SITE is a target binding site found in the 3' untranslated region of mRNA encoded by LIPG, corresponding to a target binding site such as BINDING SITE I, BINDING SITE II or BINDING SITE III of FIG. 8. Table 4 illustrates the complementarity of the nucleotide sequences of LIPG BINDING SITE, designated SEQ ID:19350, to the nucleotide sequence of GAM47 RNA, herein designated GAM RNA, also designated SEQ ID:269.

Another function of GAM47 is therefore inhibition of Lipase, endothelial (LIPG, Accession NP_006024.1). Accordingly, utilities of GAM47 include diagnosis, prevention and treatment of diseases and clinical conditions associated with LIPG.

LITAF (Accession NP_004853.1) is another GAM47 target gene, herein designated TARGET GENE. LITAF BIND- ING SITE is a target binding site found in the 3' untranslated region of mRNA encoded by LITAF, corresponding to a target binding site such as BINDING SITE I, BINDING SITE II or BINDING SITE III of FIG. 8. Table 4 illustrates the complementarity of the nucleotide sequences of LITAF BINDING SITE, designated SEQ ID:18731, to the nucleotide sequence of GAM47 RNA, herein designated GAM RNA, also designated SEQ ID:269.

Another function of GAM47 is therefore inhibition of LITAF (Accession NP_004853.1). Accordingly, utilities of GAM47 include diagnosis, prevention and treatment of diseases and clinical conditions associated with LITAF.

LNIR (Accession NP_112178.1) is another GAM47 target gene, herein designated TARGET GENE. LNIR BINDING SITE is a target binding site found in the 5' untranslated region of mRNA encoded by LNIR, corresponding to a target binding site such as BINDING SITE I, BINDING SITE II or BINDING SITE III of FIG. 8. Table 4 illustrates the complementarity of the nucleotide sequences of LNIR BINDING SITE, designated SEQ ID:9127, to the nucleotide sequence of GAM47 RNA, herein designated GAM RNA, also designated SEQ ID:269.

Another function of GAM47 is therefore inhibition of LNIR (Accession NP_112178.1). Accordingly, utilities of GAM47 include diagnosis, prevention and treatment of diseases and clinical conditions associated with LNIR.

LOC113612 (Accession XP_054492.1) is another GAM47 target gene, herein designated TARGET GENE. LOC113612 BINDING SITE is a target binding site found in the 3' untranslated region of mRNA encoded by LOC113612, corresponding to a target binding site such as BINDING SITE I, BINDING SITE II or BINDING SITE III of FIG. 8. Table 4 illustrates the complementarity of the nucleotide sequences of LOC113612 BINDING SITE, designated SEQ ID:7603, to the nucleotide sequence of GAM47 RNA, herein designated GAM RNA, also designated SEQ ID:269.

Another function of GAM47 is therefore inhibition of LOC113612 (Accession XP_054492.1). Accordingly, utilities of GAM47 include diagnosis, prevention and treatment of diseases and clinical conditions associated with LOC113612.

LOC122282 (Accession XP_063046.4) is another GAM47 target gene, herein designated TARGET GENE. LOC122282 BINDING SITE is a target binding site found in the 3' untranslated region of mRNA encoded by LOC122282, corresponding to a target binding site such as BINDING SITE I, BINDING SITE II or BINDING SITE III of FIG. 8. Table 4 illustrates the complementarity of the nucleotide sequences of LOC122282 BINDING SITE, designated SEQ ID:18448, to the nucleotide sequence of GAM47 RNA, herein designated GAM RNA, also designated SEQ ID:269.

Another function of GAM47 is therefore inhibition of LOC122282 (Accession XP_063046.4). Accordingly, utilities of GAM47 include diagnosis, prevention and treatment of diseases and clinical conditions associated with LOC122282.

LOC122553 (Accession NP_803235.1) is another GAM47 target gene, herein designated TARGET GENE. LOC122553 BINDING SITE is a target binding site found in the 3' untranslated region of mRNA encoded by LOC122553, corresponding to a target binding site such as BINDING SITE I, BINDING SITE II or BINDING SITE III of FIG. 8. Table 4 illustrates the complementarity of the nucleotide sequences of LOC122553 BINDING SITE, designated SEQ ID:4360, to the nucleotide sequence of GAM47 RNA, herein designated GAM RNA, also designated SEQ ID:269.

Another function of GAM47 is therefore inhibition of LOC122553 (Accession NP_803235.1). Accordingly, utilities of GAM47 include diagnosis, prevention and treatment of diseases and clinical conditions associated with LOC122553.

LOC124751 (Accession XP_064298.4) is another GAM47 target gene, herein designated TARGET GENE. LOC124751 BINDING SITE is a target binding site found in the 5' untranslated region of mRNA encoded by LOC124751, corresponding to a target binding site such as BINDING SITE I, BINDING SITE II or BINDING SITE III of FIG. 8. Table 4 illustrates the complementarity of the nucleotide sequences of LOC124751 BINDING SITE, designated SEQ ID:9596, to the nucleotide sequence of GAM47 RNA, herein designated GAM RNA, also designated SEQ ID:269.

Another function of GAM47 is therefore inhibition of LOC124751 (Accession XP_064298.4). Accordingly, utilities of GAM47 include diagnosis, prevention and treatment of diseases and clinical conditions associated with LOC124751.

LOC124976 (Accession XP_058879.5) is another GAM47 target gene, herein designated TARGET GENE. LOC124976 BINDING SITE1 and LOC124976 BINDING SITE2 are target binding sites found in untranslated regions of mRNA encoded by LOC124976, corresponding to target binding sites such as BINDING SITE I, BINDING SITE II or BINDING SITE III of FIG. 8. Table 4 illustrates the complementarity of the nucleotide sequences of LOC124976 BINDING SITE1 and LOC124976 BINDING SITE2, designated SEQ ID:16219 and SEQ ID:8653 respectively, to the nucleotide sequence of GAM47 RNA, herein designated GAM RNA, also designated SEQ ID:269.

Another function of GAM47 is therefore inhibition of LOC124976 (Accession XP_058879.5). Accordingly, utilities of GAM47 include diagnosis, prevention and treatment of diseases and clinical conditions associated with LOC124976.

LOC128954 (Accession XP_066252.3) is another GAM47 target gene, herein designated TARGET GENE. LOC128954 BINDING SITE1 through LOC128954 BINDING SITE3 are target binding sites found in untranslated regions of mRNA encoded by LOC128954, corresponding to target binding sites such as BINDING SITE I, BINDING SITE II or BINDING SITE III of FIG. 8. Table 4 illustrates the complementarity of the nucleotide sequences of LOC128954 BINDING SITE1 through LOC128954 BINDING SITE3, designated SEQ ID:8782, SEQ ID:2506 and SEQ ID:8041 respectively, to the nucleotide sequence of GAM47 RNA, herein designated GAM RNA, also designated SEQ ID:269.

Another function of GAM47 is therefore inhibition of LOC128954 (Accession XP_066252.3). Accordingly, utilities of GAM47 include diagnosis, prevention and treatment of diseases and clinical conditions associated with LOC128954.

LOC130888 (Accession NP_777559.2) is another GAM47 target gene, herein designated TARGET GENE. LOC130888 BINDING SITE is a target binding site found in the 3' untranslated region of mRNA encoded by LOC130888, corresponding to a target binding site such as BINDING SITE I, BINDING SITE II or BINDING SITE III of FIG. 8. Table 4 illustrates the complementarity of the nucleotide sequences of LOC130888 BINDING SITE, designated SEQ ID:1990, to the nucleotide sequence of GAM47 RNA, herein designated GAM RNA, also designated SEQ ID:269.

Another function of GAM47 is therefore inhibition of LOC130888 (Accession NP_777559.2). Accordingly, utilities of GAM47 include diagnosis, prevention and treatment of diseases and clinical conditions associated with LOC130888.

LOC136345 (Accession XP_072455.2) is another GAM47 target gene, herein designated TARGET GENE. LOC136345 BINDING SITE is a target binding site found in the 3' untranslated region of mRNA encoded by LOC136345, corresponding to a target binding site such as BINDING SITE I, BINDING SITE II or BINDING SITE III of FIG. 8. Table 4 illustrates the complementarity of the nucleotide sequences of LOC136345 BINDING SITE, designated SEQ ID:11849, to the nucleotide sequence of GAM47 RNA, herein designated GAM RNA, also designated SEQ ID:269.

Another function of GAM47 is therefore inhibition of LOC136345 (Accession XP_072455.2). Accordingly, utilities of GAM47 include diagnosis, prevention and treatment of diseases and clinical conditions associated with LOC136345.

LOC138307 (Accession NP_848564.1) is another GAM47 target gene, herein designated TARGET GENE. LOC138307 BINDING SITE is a target binding site found in the 3' untranslated region of multiple transcripts of mRNA encoded by LOC138307, corresponding to a target binding site such as BINDING SITE I, BINDING SITE II or BINDING SITE III of FIG. 8. Table 4 illustrates the complementarity of the nucleotide sequences of LOC138307 BINDING SITE, designated SEQ ID:7694, to the nucleotide sequence of GAM47 RNA, herein designated GAM RNA, also designated SEQ ID:269.

Another function of GAM47 is therefore inhibition of LOC138307 (Accession NP_848564.1). Accordingly, utilities of GAM47 include diagnosis, prevention and treatment of diseases and clinical conditions associated with LOC138307.

LOC143425 (Accession NP_783860.1) is another GAM47 target gene, herein designated TARGET GENE. LOC143425 BINDING SITE is a target binding site found in the 3' untranslated region of mRNA encoded by LOC143425, corresponding to a target binding site such as BINDING SITE I, BINDING SITE II or BINDING SITE III of FIG. 8. Table 4 illustrates the complementarity of the nucleotide sequences of LOC143425 BINDING SITE, designated SEQ ID:5310, to the nucleotide sequence of GAM47 RNA, herein designated GAM RNA, also designated SEQ ID:269.

Another function of GAM47 is therefore inhibition of LOC143425 (Accession NP_783860.1). Accordingly, utilities of GAM47 include diagnosis, prevention and treatment of diseases and clinical conditions associated with LOC143425.

LOC143677 (Accession XP_096471.1) is another GAM47 target gene, herein designated TARGET GENE. LOC143677 BINDING SITE is a target binding site found in the 3' untranslated region of mRNA encoded by LOC143677, corresponding to a target binding site such as BINDING SITE I, BINDING SITE II or BINDING SITE III of FIG. 8. Table 4 illustrates the complementarity of the nucleotide sequences of LOC143677 BINDING SITE, designated SEQ ID:16903, to the nucleotide sequence of GAM47 RNA, herein designated GAM RNA, also designated SEQ ID:269.

Another function of GAM47 is therefore inhibition of LOC143677 (Accession XP_096471.1). Accordingly, utilities of GAM47 include diagnosis, prevention and treatment of diseases and clinical conditions associated with LOC143677.

LOC144481 (Accession XP_096611.2) is another GAM47 target gene, herein designated TARGET GENE. LOC144481 BINDING SITE is a target binding site found in the 3' untranslated region of mRNA encoded by LOC144481, corresponding to a target binding site such as BINDING SITE I, BINDING SITE II or BINDING SITE III of FIG. 8. Table 4 illustrates the complementarity of the nucleotide sequences of LOC144481 BINDING SITE, designated SEQ ID:7641, to the nucleotide sequence of GAM47 RNA, herein designated GAM RNA, also designated SEQ ID:269.

Another function of GAM47 is therefore inhibition of LOC144481 (Accession XP_096611.2). Accordingly, utilities of GAM47 include diagnosis, prevention and treatment of diseases and clinical conditions associated with LOC144481.

LOC144766 (Accession XP_084963.2) is another GAM47 target gene, herein designated TARGET GENE. LOC144766 BINDING SITE is a target binding site found in the 5' untranslated region of mRNA encoded by LOC144766, corresponding to a target binding site such as BINDING SITE I, BINDING SITE II or BINDING SITE III of FIG. 8. Table 4 illustrates the complementarity of the nucleotide sequences of LOC144766 BINDING SITE, designated SEQ ID:17282, to the nucleotide sequence of GAM47 RNA, herein designated GAM RNA, also designated SEQ ID:269.

Another function of GAM47 is therefore inhibition of LOC144766 (Accession XP_084963.2). Accordingly, utilities of GAM47 include diagnosis, prevention and treatment of diseases and clinical conditions associated with LOC144766.

LOC144845 (Accession NP_612483.1) is another GAM47 target gene, herein designated TARGET GENE. LOC144845 BINDING SITE is a target binding site found in the 3' untranslated region of mRNA encoded by LOC144845, corresponding to a target binding site such as BINDING SITE I, BINDING SITE II or BINDING SITE III of FIG. 8. Table 4 illustrates the complementarity of the nucleotide sequences of LOC144845 BINDING SITE, designated SEQ ID:4355, to the nucleotide sequence of GAM47 RNA, herein designated GAM RNA, also designated SEQ ID:269.

Another function of GAM47 is therefore inhibition of LOC144845 (Accession NP_612483.1). Accordingly, utilities of GAM47 include diagnosis, prevention and treatment of diseases and clinical conditions associated with LOC144845.

LOC144874 (Accession XP_096696.1) is another GAM47 target gene, herein designated TARGET GENE. LOC144874 BINDING SITE is a target binding site found in the 5' untranslated region of mRNA encoded by LOC144874, corresponding to a target binding site such as BINDING SITE I, BINDING SITE II or BINDING SITE III of FIG. 8. Table 4 illustrates the complementarity of the nucleotide sequences of LOC144874 BINDING SITE, designated SEQ ID:8101, to the nucleotide sequence of GAM47 RNA, herein designated GAM RNA, also designated SEQ ID:269.

Another function of GAM47 is therefore inhibition of LOC144874 (Accession XP_096696.1). Accordingly, utilities of GAM47 include diagnosis, prevention and treatment of diseases and clinical conditions associated with LOC144874.

LOC145125 (Accession XP_085025.1) is another GAM47 target gene, herein designated TARGET GENE. LOC145125 BINDING SITE1 and LOC145125 BINDING SITE2 are target binding sites found in untranslated regions of mRNA encoded by LOC145125, corresponding to target binding sites such as BINDING SITE I, BINDING SITE II or BINDING SITE III of FIG. 8. Table 4 illustrates the complementarity of the nucleotide sequences of LOC145125 BINDING SITE1 and LOC145125 BINDING SITE2, designated SEQ ID:3438 and SEQ ID:18124 respectively, to the nucleotide sequence of GAM47 RNA, herein designated GAM RNA, also designated SEQ ID:269.

Another function of GAM47 is therefore inhibition of LOC145125 (Accession XP_085025.1). Accordingly, utilities of GAM47 include diagnosis, prevention and treatment of diseases and clinical conditions associated with LOC145125.

LOC145678 (Accession XP_096832.1) is another GAM47 target gene, herein designated TARGET GENE. LOC145678 BINDING SITE is a target binding site found in the 5' untranslated region of mRNA encoded by LOC145678, corresponding to a target binding site such as BINDING SITE I, BINDING SITE II or BINDING SITE III of FIG. 8. Table 4 illustrates the complementarity of the nucleotide sequences of LOC145678 BINDING SITE, designated SEQ ID:11711, to the nucleotide sequence of GAM47 RNA, herein designated GAM RNA, also designated SEQ ID:269.

Another function of GAM47 is therefore inhibition of LOC145678 (Accession XP_096832.1). Accordingly, utilities of GAM47 include diagnosis, prevention and treatment of diseases and clinical conditions associated with LOC145678.

LOC145814 (Accession XP_085243.1) is another GAM47 target gene, herein designated TARGET GENE. LOC145814 BINDING SITE is a target binding site found in the 5' untranslated region of mRNA encoded by LOC145814, corresponding to a target binding site such as BINDING SITE I, BINDING SITE II or BINDING SITE III of FIG. 8. Table 4 illustrates the complementarity of the nucleotide sequences of LOC145814 BINDING SITE, designated SEQ ID:11784, to the nucleotide sequence of GAM47 RNA, herein designated GAM RNA, also designated SEQ ID:269.

Another function of GAM47 is therefore inhibition of LOC145814 (Accession XP_085243.1). Accordingly, utilities of GAM47 include diagnosis, prevention and treatment of diseases and clinical conditions associated with LOC145814.

LOC146756 (Accession XP_097085.5) is another GAM47 target gene, herein designated TARGET GENE. LOC146756 BINDING SITE is a target binding site found in the 3' untranslated region of mRNA encoded by LOC146756, corresponding to a target binding site such as BINDING SITE I, BINDING SITE II or BINDING SITE III of FIG. 8. Table 4 illustrates the complementarity of the nucleotide sequences of LOC146756 BINDING SITE, designated SEQ ID:2465, to the nucleotide sequence of GAM47 RNA, herein designated GAM RNA, also designated SEQ ID:269.

Another function of GAM47 is therefore inhibition of LOC146756 (Accession XP_097085.5). Accordingly, utilities of GAM47 include diagnosis, prevention and treatment of diseases and clinical conditions associated with LOC146756.

LOC147515 (Accession XP_097243.1) is another GAM47 target gene, herein designated TARGET GENE. LOC147515 BINDING SITE is a target binding site found in the 3' untranslated region of mRNA encoded by LOC147515, corresponding to a target binding site such as BINDING SITE I, BINDING SITE II or BINDING SITE III of FIG. 8. Table 4 illustrates the complementarity of the nucleotide sequences of LOC147515 BINDING SITE, designated SEQ ID:7233, to the nucleotide sequence of GAM47 RNA, herein designated GAM RNA, also designated SEQ ID:269.

Another function of GAM47 is therefore inhibition of LOC147515 (Accession XP_097243.1). Accordingly, utilities of GAM47 include diagnosis, prevention and treatment of diseases and clinical conditions associated with LOC147515.

LOC148490 (Accession XP_086210.2) is another GAM47 target gene, herein designated TARGET GENE. LOC148490 BINDING SITE is a target binding site found in the 3' untranslated region of mRNA encoded by LOC148490, corresponding to a target binding site such as BINDING SITE I, BINDING SITE II or BINDING SITE III of FIG. 8. Table 4 illustrates the complementarity of the nucleotide sequences of LOC148490 BINDING SITE, designated SEQ ID:16652, to the nucleotide sequence of GAM47 RNA, herein designated GAM RNA, also designated SEQ ID:269.

Another function of GAM47 is therefore inhibition of LOC148490 (Accession XP_086210.2). Accordingly, utilities of GAM47 include diagnosis, prevention and treatment of diseases and clinical conditions associated with LOC148490.

LOC148760 (Accession XP_097514.1) is another GAM47 target gene, herein designated TARGET GENE. LOC148760 BINDING SITE is a target binding site found in the 3' untranslated region of mRNA encoded by LOC148760, corresponding to a target binding site such as BINDING SITE I, BINDING SITE II or BINDING SITE III of FIG. 8. Table 4 illustrates the complementarity of the nucleotide sequences of LOC148760 BINDING SITE, designated SEQ ID:14757, to the nucleotide sequence of GAM47 RNA, herein designated GAM RNA, also designated SEQ ID:269.

Another function of GAM47 is therefore inhibition of LOC148760 (Accession XP_097514.1). Accordingly, utilities of GAM47 include diagnosis, prevention and treatment of diseases and clinical conditions associated with LOC148760.

LOC148987 (Accession XP_086385.2) is another GAM47 target gene, herein designated TARGET GENE. LOC148987 BINDING SITE is a target binding site found in the 5' untranslated region of mRNA encoded by LOC148987, corresponding to a target binding site such as BINDING SITE I, BINDING SITE II or BINDING SITE III of FIG. 8. Table 4 illustrates the complementarity of the nucleotide sequences of LOC148987 BINDING SITE, designated SEQ ID:17867, to the nucleotide sequence of GAM47 RNA, herein designated GAM RNA, also designated SEQ ID:269.

Another function of GAM47 is therefore inhibition of LOC148987 (Accession XP_086385.2). Accordingly, utilities of GAM47 include diagnosis, prevention and treatment of diseases and clinical conditions associated with LOC148987.

LOC149086 (Accession XP_097580.2) is another GAM47 target gene, herein designated TARGET GENE. LOC149086 BINDING SITE is a target binding site found in the 3' untranslated region of mRNA encoded by LOC149086, corresponding to a target binding site such as BINDING SITE I, BINDING SITE II or BINDING SITE III of FIG. 8. Table 4 illustrates the complementarity of the nucleotide sequences of LOC149086 BINDING SITE, designated SEQ ID:18240, to the nucleotide sequence of GAM47 RNA, herein designated GAM RNA, also designated SEQ ID:269.

Another function of GAM47 is therefore inhibition of LOC149086 (Accession XP_097580.2). Accordingly, utilities of GAM47 include diagnosis, prevention and treatment of diseases and clinical conditions associated with LOC149086.

LOC149182 (Accession XP_097605.1) is another GAM47 target gene, herein designated TARGET GENE. LOC149182 BINDING SITE is a target binding site found in the 3' untranslated region of mRNA encoded by LOC149182, corresponding to a target binding site such as BINDING SITE I, BINDING SITE II or BINDING SITE III of FIG. 8. Table 4 illustrates the complementarity of the nucleotide sequences of LOC149182 BINDING SITE, designated SEQ ID:4614, to the nucleotide sequence of GAM47 RNA, herein designated GAM RNA, also designated SEQ ID:269.

Another function of GAM47 is therefore inhibition of LOC149182 (Accession XP_097605.1). Accordingly, utilities of GAM47 include diagnosis, prevention and treatment of diseases and clinical conditions associated with LOC149182.

LOC149837 (Accession XP_097747.1) is another GAM47 target gene, herein designated TARGET GENE. LOC149837 BINDING SITE is a target binding site found in the 5' untranslated region of mRNA encoded by LOC149837, corresponding to a target binding site such as BINDING SITE I, BINDING SITE II or BINDING SITE III of FIG. 8. Table 4 illustrates the complementarity of the nucleotide sequences of LOC149837 BINDING SITE, designated SEQ ID:967, to the nucleotide sequence of GAM47 RNA, herein designated GAM RNA, also designated SEQ ID:269.

Another function of GAM47 is therefore inhibition of LOC149837 (Accession XP_097747.1). Accordingly, utilities of GAM47 include diagnosis, prevention and treatment of diseases and clinical conditions associated with LOC149837.

LOC150166 (Accession XP_097824.1) is another GAM47 target gene, herein designated TARGET GENE. LOC150166 BINDING SITE is a target binding site found in the 5' untranslated region of mRNA encoded by LOC150166, corresponding to a target binding site such as BINDING SITE I, BINDING SITE II or BINDING SITE III of FIG. 8. Table 4 illustrates the complementarity of the nucleotide sequences of LOC150166 BINDING SITE, designated SEQ ID:2818, to the nucleotide sequence of GAM47 RNA, herein designated GAM RNA, also designated SEQ ID:269.

Another function of GAM47 is therefore inhibition of LOC150166 (Accession XP_097824.1). Accordingly, utilities of GAM47 include diagnosis, prevention and treatment of diseases and clinical conditions associated with LOC150166.

LOC150933 (Accession XP_097971.1) is another GAM47 target gene, herein designated TARGET GENE. LOC150933 BINDING SITE1 and LOC150933 BINDING SITE2 are target binding sites found in untranslated regions of mRNA encoded by LOC150933, corresponding to target binding sites such as BINDING SITE I, BINDING SITE II or BINDING SITE III of FIG. 8. Table 4 illustrates the complementarity of the nucleotide sequences of LOC150933 BINDING SITE1 and LOC150933 BINDING SITE2, designated SEQ ID:17336 and SEQ ID:19544 respectively, to the nucleotide sequence of GAM47 RNA, herein designated GAM RNA, also designated SEQ ID:269.

Another function of GAM47 is therefore inhibition of LOC150933 (Accession XP_097971.1). Accordingly, utilities of GAM47 include diagnosis, prevention and treatment of diseases and clinical conditions associated with LOC150933.

LOC150946 (Accession XP_097977.2) is another GAM47 target gene, herein designated TARGET GENE. LOC150946 BINDING SITE is a target binding site found in the 3' untranslated region of mRNA encoded by LOC150946, corresponding to a target binding site such as BINDING SITE I, BINDING SITE II or BINDING SITE III of FIG. 8. Table 4 illustrates the complementarity of the nucleotide sequences of LOC150946 BINDING SITE, designated SEQ ID:6510, to the nucleotide sequence of GAM47 RNA, herein designated GAM RNA, also designated SEQ ID:269.

Another function of GAM47 is therefore inhibition of LOC150946 (Accession XP_097977.2). Accordingly, utilities of GAM47 include diagnosis, prevention and treatment of diseases and clinical conditions associated with LOC150946.

LOC151512 (Accession XP_098072.2) is another GAM47 target gene, herein designated TARGET GENE. LOC151512 BINDING SITE is a target binding site found in the 3' untranslated region of mRNA encoded by LOC151512, corresponding to a target binding site such as BINDING SITE I, BINDING SITE II or BINDING SITE III of FIG. 8. Table 4 illustrates the complementarity of the nucleotide sequences of LOC151512 BINDING SITE, designated SEQ ID:17844, to the nucleotide sequence of GAM47 RNA, herein designated GAM RNA, also designated SEQ ID:269.

Another function of GAM47 is therefore inhibition of LOC151512 (Accession XP_098072.2). Accordingly, utilities of GAM47 include diagnosis, prevention and treatment of diseases and clinical conditions associated with LOC151512.

LOC153364 (Accession XP_087657.1) is another GAM47 target gene, herein designated TARGET GENE. LOC153364 BINDING SITE is a target binding site found in the 3' untranslated region of mRNA encoded by LOC153364, corresponding to a target binding site such as BINDING SITE I, BINDING SITE II or BINDING SITE III of FIG. 8. Table 4 illustrates the complementarity of the nucleotide sequences of LOC153364 BINDING SITE, designated SEQ ID:15715, to the nucleotide sequence of GAM47 RNA, herein designated GAM RNA, also designated SEQ ID:269.

Another function of GAM47 is therefore inhibition of LOC153364 (Accession XP_087657.1). Accordingly, utilities of GAM47 include diagnosis, prevention and treatment of diseases and clinical conditions associated with LOC153364.

LOC153442 (Accession XP_098373.1) is another GAM47 target gene, herein designated TARGET GENE. LOC153442 BINDING SITE is a target binding site found in the 3' untranslated region of mRNA encoded by LOC153442, corresponding to a target binding site such as BINDING SITE I, BINDING SITE II or BINDING SITE III of FIG. 8. Table 4 illustrates the complementarity of the nucleotide sequences of LOC153442 BINDING SITE, designated SEQ ID:11271, to the nucleotide sequence of GAM47 RNA, herein designated GAM RNA, also designated SEQ ID:269.

Another function of GAM47 is therefore inhibition of LOC153442 (Accession XP_098373.1). Accordingly, utilities of GAM47 include diagnosis, prevention and treatment of diseases and clinical conditions associated with LOC153442.

LOC154822 (Accession XP_098618.3) is another GAM47 target gene, herein designated TARGET GENE. LOC154822 BINDING SITE1 and LOC154822 BINDING SITE2 are target binding sites found in untranslated regions of mRNA encoded by LOC154822, corresponding to target binding sites such as BINDING SITE I, BINDING SITE II or BINDING SITE III of FIG. 8. Table 4 illustrates the complementarity of the nucleotide sequences of LOC154822 BINDING SITE1 and LOC154822 BINDING SITE2, designated SEQ ID:6200 and SEQ ID:14022 respectively, to the nucleotide sequence of GAM47 RNA, herein designated GAM RNA, also designated SEQ ID:269.

Another function of GAM47 is therefore inhibition of LOC154822 (Accession XP_098618.3). Accordingly, utilities of GAM47 include diagnosis, prevention and treatment of diseases and clinical conditions associated with LOC154822.

LOC154990 (Accession XP_088109.3) is another GAM47 target gene, herein designated TARGET GENE.

LOC154990 BINDING SITE is a target binding site found in the 5' untranslated region of mRNA encoded by LOC154990, corresponding to a target binding site such as BINDING SITE I, BINDING SITE II or BINDING SITE III of FIG. 8. Table 4 illustrates the complementarity of the nucleotide sequences of LOC154990 BINDING SITE, designated SEQ ID:18568, to the nucleotide sequence of GAM47 RNA, herein designated GAM RNA, also designated SEQ ID:269.

Another function of GAM47 is therefore inhibition of LOC154990 (Accession XP_088109.3). Accordingly, utilities of GAM47 include diagnosis, prevention and treatment of diseases and clinical conditions associated with LOC154990.

LOC155006 (Accession XP_088117.1) is another GAM47 target gene, herein designated TARGET GENE. LOC155006 BINDING SITE is a target binding site found in the 3' untranslated region of mRNA encoded by LOC155006, corresponding to a target binding site such as BINDING SITE I, BINDING SITE II or BINDING SITE III of FIG. 8. Table 4 illustrates the complementarity of the nucleotide sequences of LOC155006 BINDING SITE, designated SEQ ID:7762, to the nucleotide sequence of GAM47 RNA, herein designated GAM RNA, also designated SEQ ID:269.

Another function of GAM47 is therefore inhibition of LOC155006 (Accession XP_088117.1). Accordingly, utilities of GAM47 include diagnosis, prevention and treatment of diseases and clinical conditions associated with LOC155006.

LOC155032 (Accession XP_098647.1) is another GAM47 target gene, herein designated TARGET GENE. LOC155032 BINDING SITE is a target binding site found in the 5' untranslated region of mRNA encoded by LOC155032, corresponding to a target binding site such as BINDING SITE I, BINDING SITE II or BINDING SITE III of FIG. 8. Table 4 illustrates the complementarity of the nucleotide sequences of LOC155032 BINDING SITE, designated SEQ ID:11849, to the nucleotide sequence of GAM47 RNA, herein designated GAM RNA, also designated SEQ ID:269.

Another function of GAM47 is therefore inhibition of LOC155032 (Accession XP_098647.1). Accordingly, utilities of GAM47 include diagnosis, prevention and treatment of diseases and clinical conditions associated with LOC155032.

LOC155036 (Accession XP_098651.1) is another GAM47 target gene, herein designated TARGET GENE. LOC155036 BINDING SITE is a target binding site found in the 5' untranslated region of mRNA encoded by LOC155036, corresponding to a target binding site such as BINDING SITE I, BINDING SITE II or BINDING SITE III of FIG. 8. Table 4 illustrates the complementarity of the nucleotide sequences of LOC155036 BINDING SITE, designated SEQ ID:5512, to the nucleotide sequence of GAM47 RNA, herein designated GAM RNA, also designated SEQ ID:269.

Another function of GAM47 is therefore inhibition of LOC155036 (Accession XP_098651.1). Accordingly, utilities of GAM47 include diagnosis, prevention and treatment of diseases and clinical conditions associated with LOC155036.

LOC157381 (Accession XP_098754.5) is another GAM47 target gene, herein designated TARGET GENE. LOC157381 BINDING SITE is a target binding site found in the 5' untranslated region of mRNA encoded by LOC157381, corresponding to a target binding site such as BINDING SITE I, BINDING SITE II or BINDING SITE III of FIG. 8. Table 4 illustrates the complementarity of the nucleotide sequences of LOC157381 BINDING SITE, designated SEQ ID:19137, to the nucleotide sequence of GAM47 RNA, herein designated GAM RNA, also designated SEQ ID:269.

Another function of GAM47 is therefore inhibition of LOC157381 (Accession XP_098754.5). Accordingly, utilities of GAM47 include diagnosis, prevention and treatment of diseases and clinical conditions associated with LOC157381.

LOC157421 (Accession XP_098756.1) is another GAM47 target gene, herein designated TARGET GENE. LOC157421 BINDING SITE is a target binding site found in the 5' untranslated region of mRNA encoded by LOC157421, corresponding to a target binding site such as BINDING SITE I, BINDING SITE II or BINDING SITE III of FIG. 8. Table 4 illustrates the complementarity of the nucleotide sequences of LOC157421 BINDING SITE, designated SEQ ID:2791, to the nucleotide sequence of GAM47 RNA, herein designated GAM RNA, also designated SEQ ID:269.

Another function of GAM47 is therefore inhibition of LOC157421 (Accession XP_098756.1). Accordingly, utilities of GAM47 include diagnosis, prevention and treatment of diseases and clinical conditions associated with LOC157421.

LOC157784 (Accession XP_088391.4) is another GAM47 target gene, herein designated TARGET GENE. LOC157784 BINDING SITE is a target binding site found in the 3' untranslated region of mRNA encoded by LOC157784, corresponding to a target binding site such as BINDING SITE I, BINDING SITE II or BINDING SITE III of FIG. 8. Table 4 illustrates the complementarity of the nucleotide sequences of LOC157784 BINDING SITE, designated SEQ ID:15243, to the nucleotide sequence of GAM47 RNA, herein designated GAM RNA, also designated SEQ ID:269.

Another function of GAM47 is therefore inhibition of LOC157784 (Accession XP_088391.4). Accordingly, utilities of GAM47 include diagnosis, prevention and treatment of diseases and clinical conditions associated with LOC157784.

LOC158527 (Accession XP_088594.1) is another GAM47 target gene, herein designated TARGET GENE. LOC158527 BINDING SITE is a target binding site found in the 5' untranslated region of mRNA encoded by LOC158527, corresponding to a target binding site such as BINDING SITE I, BINDING SITE II or BINDING SITE III of FIG. 8. Table 4 illustrates the complementarity of the nucleotide sequences of LOC158527 BINDING SITE, designated SEQ ID:8854, to the nucleotide sequence of GAM47 RNA, herein designated GAM RNA, also designated SEQ ID:269.

Another function of GAM47 is therefore inhibition of LOC158527 (Accession XP_088594.1). Accordingly, utilities of GAM47 include diagnosis, prevention and treatment of diseases and clinical conditions associated with LOC158527.

LOC158563 (Accession XP_088606.1) is another GAM47 target gene, herein designated TARGET GENE. LOC158563 BINDING SITE is a target binding site found in the 5' untranslated region of mRNA encoded by LOC158563, corresponding to a target binding site such as BINDING SITE I, BINDING SITE II or BINDING SITE III of FIG. 8. Table 4 illustrates the complementarity of the nucleotide sequences of LOC158563 BINDING SITE, designated SEQ ID:13743, to the nucleotide sequence of GAM47 RNA, herein designated GAM RNA, also designated SEQ ID:269.

Another function of GAM47 is therefore inhibition of LOC158563 (Accession XP_088606.1). Accordingly, utilities of GAM47 include diagnosis, prevention and treatment of diseases and clinical conditions associated with LOC158563.

LOC158997 (Accession XP_088736.1) is another GAM47 target gene, herein designated TARGET GENE. LOC158997 BINDING SITE is a target binding site found in the 5' untranslated region of mRNA encoded by LOC158997, corresponding to a target binding site such as BINDING SITE I, BINDING SITE II or BINDING SITE III of FIG. 8. Table 4 illustrates the complementarity of the nucleotide sequences of LOC158997 BINDING SITE, designated SEQ ID:4356, to the nucleotide sequence of GAM47 RNA, herein designated GAM RNA, also designated SEQ ID:269.

Another function of GAM47 is therefore inhibition of LOC158997 (Accession XP_088736.1). Accordingly, utilities of GAM47 include diagnosis, prevention and treatment of diseases and clinical conditions associated with LOC158997.

LOC166449 (Accession XP_093876.5) is another GAM47 target gene, herein designated TARGET GENE. LOC166449 BINDING SITE is a target binding site found in the 5' untranslated region of mRNA encoded by LOC166449, corresponding to a target binding site such as BINDING SITE I, BINDING SITE II or BINDING SITE III of FIG. 8. Table 4 illustrates the complementarity of the nucleotide sequences of LOC166449 BINDING SITE, designated SEQ ID:18985, to the nucleotide sequence of GAM47 RNA, herein designated GAM RNA, also designated SEQ ID:269.

Another function of GAM47 is therefore inhibition of LOC166449 (Accession XP_093876.5). Accordingly, utilities of GAM47 include diagnosis, prevention and treatment of diseases and clinical conditions associated with LOC166449.

LOC196415 (Accession XP_116917.2) is another GAM47 target gene, herein designated TARGET GENE. LOC196415 BINDING SITE is a target binding site found in the 3' untranslated region of mRNA encoded by LOC196415, corresponding to a target binding site such as BINDING SITE I, BINDING SITE II or BINDING SITE III of FIG. 8. Table 4 illustrates the complementarity of the nucleotide sequences of LOC196415 BINDING SITE, designated SEQ ID:7300, to the nucleotide sequence of GAM47 RNA, herein designated GAM RNA, also designated SEQ ID:269.

Another function of GAM47 is therefore inhibition of LOC196415 (Accession XP_116917.2). Accordingly, utilities of GAM47 include diagnosis, prevention and treatment of diseases and clinical conditions associated with LOC196415.

LOC196996 (Accession XP_113796.1) is another GAM47 target gene, herein designated TARGET GENE. LOC196996 BINDING SITE is a target binding site found in the 3' untranslated region of mRNA encoded by LOC196996, corresponding to a target binding site such as BINDING SITE I, BINDING SITE II or BINDING SITE III of FIG. 8. Table 4 illustrates the complementarity of the nucleotide sequences of LOC196996 BINDING SITE, designated SEQ ID:16202, to the nucleotide sequence of GAM47 RNA, herein designated GAM RNA, also designated SEQ ID:269.

Another function of GAM47 is therefore inhibition of LOC196996 (Accession XP_113796.1). Accordingly, utilities of GAM47 include diagnosis, prevention and treatment of diseases and clinical conditions associated with LOC196996.

LOC197379 (Accession XP_117029.1) is another GAM47 target gene, herein designated TARGET GENE. LOC197379 BINDING SITE is a target binding site found in the 5' untranslated region of mRNA encoded by LOC197379, corresponding to a target binding site such as BINDING SITE I, BINDING SITE II or BINDING SITE III of FIG. 8. Table 4 illustrates the complementarity of the nucleotide sequences of LOC197379 BINDING SITE, designated SEQ ID:7381, to the nucleotide sequence of GAM47 RNA, herein designated GAM RNA, also designated SEQ ID:269.

Another function of GAM47 is therefore inhibition of LOC197379 (Accession XP_117029.1). Accordingly, utilities of GAM47 include diagnosis, prevention and treatment of diseases and clinical conditions associated with LOC197379.

LOC200008 (Accession XP_114089.3) is another GAM47 target gene, herein designated TARGET GENE. LOC200008 BINDING SITE is a target binding site found in the 3' untranslated region of mRNA encoded by LOC200008, corresponding to a target binding site such as BINDING SITE I, BINDING SITE II or BINDING SITE III of FIG. 8. Table 4 illustrates the complementarity of the nucleotide sequences of LOC200008 BINDING SITE, designated SEQ ID:8828, to the nucleotide sequence of GAM47 RNA, herein designated GAM RNA, also designated SEQ ID:269.

Another function of GAM47 is therefore inhibition of LOC200008 (Accession XP_114089.3). Accordingly, utilities of GAM47 include diagnosis, prevention and treatment of diseases and clinical conditions associated with LOC200008.

LOC200609 (Accession XP_117256.1) is another GAM47 target gene, herein designated TARGET GENE. LOC200609 BINDING SITE1 and LOC200609 BINDING SITE2 are target binding sites found in untranslated regions of mRNA encoded by LOC200609, corresponding to target binding sites such as BINDING SITE I, BINDING SITE II or BINDING SITE III of FIG. 8. Table 4 illustrates the complementarity of the nucleotide sequences of LOC200609 BINDING SITE1 and LOC200609 BINDING SITE2, designated SEQ ID:14180 and SEQ ID:2866 respectively, to the nucleotide sequence of GAM47 RNA, herein designated GAM RNA, also designated SEQ ID:269.

Another function of GAM47 is therefore inhibition of LOC200609 (Accession XP_117256.1). Accordingly, utilities of GAM47 include diagnosis, prevention and treatment of diseases and clinical conditions associated with LOC200609.

LOC201952 (Accession XP_117345.1) is another GAM47 target gene, herein designated TARGET GENE. LOC201952 BINDING SITE is a target binding site found in the 5' untranslated region of mRNA encoded by LOC201952, corresponding to a target binding site such as BINDING SITE I, BINDING SITE II or BINDING SITE III of FIG. 8. Table 4 illustrates the complementarity of the nucleotide sequences of LOC201952 BINDING SITE, designated SEQ ID:16641, to the nucleotide sequence of GAM47 RNA, herein designated GAM RNA, also designated SEQ ID:269.

Another function of GAM47 is therefore inhibition of LOC201952 (Accession XP_117345.1). Accordingly, utilities of GAM47 include diagnosis, prevention and treatment of diseases and clinical conditions associated with LOC201952.

LOC202134 (Accession XP_117365.1) is another GAM47 target gene, herein designated TARGET GENE. LOC202134 BINDING SITE is a target binding site found in the 3' untranslated region of mRNA encoded by LOC202134, corresponding to a target binding site such as BINDING SITE I, BINDING SITE II or BINDING SITE III of FIG. 8. Table 4 illustrates the complementarity of the nucleotide sequences of LOC202134 BINDING SITE, designated SEQ ID:18733, to the nucleotide sequence of GAM47 RNA, herein designated GAM RNA, also designated SEQ ID:269.

Another function of GAM47 is therefore inhibition of LOC202134 (Accession XP_117365.1). Accordingly, utilities of GAM47 include diagnosis, prevention and treatment of diseases and clinical conditions associated with LOC202134.

LOC219914 (Accession XP_167788.1) is another GAM47 target gene, herein designated TARGET GENE. LOC219914 BINDING SITE is a target binding site found in the 5' untranslated region of mRNA encoded by LOC219914, corresponding to a target binding site such as BINDING SITE I, BINDING SITE II or BINDING SITE III of FIG. 8. Table 4 illustrates the complementarity of the nucleotide sequences of LOC219914 BINDING SITE, designated SEQ ID:7987, to the nucleotide sequence of GAM47 RNA, herein designated GAM RNA, also designated SEQ ID:269.

Another function of GAM47 is therefore inhibition of LOC219914 (Accession XP_167788.1). Accordingly, utilities of GAM47 include diagnosis, prevention and treatment of diseases and clinical conditions associated with LOC219914.

LOC220980 (Accession XP_167629.1) is another GAM47 target gene, herein designated TARGET GENE. LOC220980 BINDING SITE is a target binding site found in the 3' untranslated region of mRNA encoded by LOC220980, corresponding to a target binding site such as BINDING SITE I, BINDING SITE II or BINDING SITE III of FIG. 8. Table 4 illustrates the complementarity of the nucleotide sequences of LOC220980 BINDING SITE, designated SEQ ID:10560, to the nucleotide sequence of GAM47 RNA, herein designated GAM RNA, also designated SEQ ID:269.

Another function of GAM47 is therefore inhibition of LOC220980 (Accession XP_167629.1). Accordingly, utilities of GAM47 include diagnosis, prevention and treatment of diseases and clinical conditions associated with LOC220980.

LOC221509 (Accession XP_166477.2) is another GAM47 target gene, herein designated TARGET GENE. LOC221509 BINDING SITE is a target binding site found in the 5' untranslated region of mRNA encoded by LOC221509, corresponding to a target binding site such as BINDING SITE I, BINDING SITE II or BINDING SITE III of FIG. 8. Table 4 illustrates the complementarity of the nucleotide sequences of LOC221509 BINDING SITE, designated SEQ ID:15414, to the nucleotide sequence of GAM47 RNA, herein designated GAM RNA, also designated SEQ ID:269.

Another function of GAM47 is therefore inhibition of LOC221509 (Accession XP_166477.2). Accordingly, utilities of GAM47 include diagnosis, prevention and treatment of diseases and clinical conditions associated with LOC221509.

LOC221663 (Accession XP_168131.1) is another GAM47 target gene, herein designated TARGET GENE. LOC221663 BINDING SITE is a target binding site found in the 5' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:7560, to the nucleotide sequence of GAM47 RNA, herein designated GAM RNA, also designated SEQ ID:269.

Another function of GAM47 is therefore inhibition of LOC221663 (Accession XP_168131.1). Accordingly, utilities of GAM47 include diagnosis, prevention and treatment of diseases and clinical conditions associated with LOC221663.

LOC221683 (Accession XP_168089.1) is another GAM47 target gene, herein designated TARGET GENE. LOC221683 BINDING SITE is a target binding site found in the 3' untranslated region of mRNA encoded by LOC221683, corresponding to a target binding site such as BINDING SITE I, BINDING SITE II or BINDING SITE III of FIG. 8. Table 4 illustrates the complementarity of the nucleotide sequences of LOC221683 BINDING SITE, designated SEQ ID:493, to the nucleotide sequence of GAM47 RNA, herein designated GAM RNA, also designated SEQ ID:269.

Another function of GAM47 is therefore inhibition of LOC221683 (Accession XP_168089.1). Accordingly, utilities of GAM47 include diagnosis, prevention and treatment of diseases and clinical conditions associated with LOC221683.

LOC221889 (Accession XP_166513.1) is another GAM47 target gene, herein designated TARGET GENE. LOC221889 BINDING SITE is a target binding site found in the 3' untranslated region of mRNA encoded by LOC221889, corresponding to a target binding site such as BINDING SITE I, BINDING SITE II or BINDING SITE III of FIG. 8. Table 4 illustrates the complementarity of the nucleotide sequences of LOC221889 BINDING SITE, designated SEQ ID:9970, to the nucleotide sequence of GAM47 RNA, herein designated GAM RNA, also designated SEQ ID:269.

Another function of GAM47 is therefore inhibition of LOC221889 (Accession XP_166513.1). Accordingly, utilities of GAM47 include diagnosis, prevention and treatment of diseases and clinical conditions associated with LOC221889.

LOC221929 (Accession XP_166553.1) is another GAM47 target gene, herein designated TARGET GENE. LOC221929 BINDING SITE is a target binding site found in the 5' untranslated region of mRNA encoded by LOC221929, corresponding to a target binding site such as BINDING SITE I, BINDING SITE II or BINDING SITE III of FIG. 8. Table 4 illustrates the complementarity of the nucleotide sequences of LOC221929 BINDING SITE, designated SEQ ID:5808, to the nucleotide sequence of GAM47 RNA, herein designated GAM RNA, also designated SEQ ID:269.

Another function of GAM47 is therefore inhibition of LOC221929 (Accession XP_166553.1). Accordingly, utilities of GAM47 include diagnosis, prevention and treatment of diseases and clinical conditions associated with LOC221929.

LOC221964 (Accession XP_168342.1) is another GAM47 target gene, herein designated TARGET GENE. LOC221964 BINDING SITE is a target binding site found in the 3' untranslated region of mRNA encoded by LOC221964, corresponding to a target binding site such as BINDING SITE I, BINDING SITE II or BINDING SITE III of FIG. 8. Table 4 illustrates the complementarity of the nucleotide sequences of LOC221964 BINDING SITE, designated SEQ ID:14006, to the nucleotide sequence of GAM47 RNA, herein designated GAM RNA, also designated SEQ ID:269.

Another function of GAM47 is therefore inhibition of LOC221964 (Accession XP_168342.1). Accordingly, utilities of GAM47 include diagnosis, prevention and treatment of diseases and clinical conditions associated with LOC221964.

LOC253221 (Accession XP_173010.1) is another GAM47 target gene, herein designated TARGET GENE. LOC253221 BINDING SITE1 and LOC253221 BINDING SITE2 are target binding sites found in untranslated regions of mRNA encoded by LOC253221, corresponding to target binding sites such as BINDING SITE I, BINDING SITE II or BINDING SITE III of FIG. 8. Table 4 illustrates the complementarity of the nucleotide sequences of LOC253221 BINDING SITE1 and LOC253221 BINDING SITE2, designated SEQ ID:18027 and SEQ ID:6102 respectively, to the nucleotide sequence of GAM47 RNA, herein designated GAM RNA, also designated SEQ ID:269.

Another function of GAM47 is therefore inhibition of LOC253221 (Accession XP_173010.1). Accordingly, utilities of GAM47 include diagnosis, prevention and treatment of diseases and clinical conditions associated with LOC253221.

LOC254266 (Accession XP_173221.1) is another GAM47 target gene, herein designated TARGET GENE. LOC254266 BINDING SITE is a target binding site found in the 3' untranslated region of mRNA encoded by LOC254266, corresponding to a target binding site such as BINDING SITE I, BINDING SITE II or BINDING SITE III of FIG. 8. Table 4 illustrates the complementarity of the nucleotide sequences of LOC254266 BINDING SITE, designated SEQ ID:6802, to the nucleotide sequence of GAM47 RNA, herein designated GAM RNA, also designated SEQ ID:269.

Another function of GAM47 is therefore inhibition of LOC254266 (Accession XP_173221.1). Accordingly, utilities of GAM47 include diagnosis, prevention and treatment of diseases and clinical conditions associated with LOC254266.

LOC255975 (Accession XP_171083.2) is another GAM47 target gene, herein designated TARGET GENE. LOC255975 BINDING SITE1 and LOC255975 BINDING SITE2 are target binding sites found in untranslated regions of mRNA encoded by LOC255975, corresponding to target binding sites such as BINDING SITE I, BINDING SITE II or BINDING SITE III of FIG. 8. Table 4 illustrates the complementarity of the nucleotide sequences of LOC255975 BINDING SITE1 and LOC255975 BINDING SITE2, designated SEQ ID:11873 and SEQ ID:2592 respectively, to the nucleotide sequence of GAM47 RNA, herein designated GAM RNA, also designated SEQ ID:269.

Another function of GAM47 is therefore inhibition of LOC255975 (Accession XP_171083.2). Accordingly, utilities of GAM47 include diagnosis, prevention and treatment of diseases and clinical conditions associated with LOC255975.

LOC257239 (Accession XP_173125.1) is another GAM47 target gene, herein designated TARGET GENE. LOC257239 BINDING SITE is a target binding site found in the 5' untranslated region of mRNA encoded by LOC257239, corresponding to a target binding site such as BINDING SITE I, BINDING SITE II or BINDING SITE III of FIG. 8. Table 4 illustrates the complementarity of the nucleotide sequences of LOC257239 BINDING SITE, designated SEQ ID:17331, to the nucleotide sequence of GAM47 RNA, herein designated GAM RNA, also designated SEQ ID:269.

Another function of GAM47 is therefore inhibition of LOC257239 (Accession XP_173125.1). Accordingly, utilities of GAM47 include diagnosis, prevention and treatment of diseases and clinical conditions associated with LOC257239.

LOC257358 (Accession XP_173138.1) is another GAM47 target gene, herein designated TARGET GENE. LOC257358 BINDING SITE is a target binding site found in the 3' untranslated region of mRNA encoded by LOC257358, corresponding to a target binding site such as BINDING SITE I, BINDING SITE II or BINDING SITE III of FIG. 8. Table 4 illustrates the complementarity of the nucleotide sequences of LOC257358 BINDING SITE, designated SEQ ID:12197, to the nucleotide sequence of GAM47 RNA, herein designated GAM RNA, also designated SEQ ID:269.

Another function of GAM47 is therefore inhibition of LOC257358 (Accession XP_173138.1). Accordingly, utilities of GAM47 include diagnosis, prevention and treatment of diseases and clinical conditions associated with LOC257358.

LOC282890 (Accession XP_212581.1) is another GAM47 target gene, herein designated TARGET GENE. LOC282890 BINDING SITE is a target binding site found in the 5' untranslated region of mRNA encoded by LOC282890, corresponding to a target binding site such as BINDING SITE I, BINDING SITE II or BINDING SITE III of FIG. 8. Table 4 illustrates the complementarity of the nucleotide sequences of LOC282890 BINDING SITE, designated SEQ ID:6358, to the nucleotide sequence of GAM47 RNA, herein designated GAM RNA, also designated SEQ ID:269.

Another function of GAM47 is therefore inhibition of LOC282890 (Accession XP_212581.1). Accordingly, utilities of GAM47 include diagnosis, prevention and treatment of diseases and clinical conditions associated with LOC282890.

LOC282927 (Accession XP_212629.1) is another GAM47 target gene, herein designated TARGET GENE. LOC282927 BINDING SITE is a target binding site found in the 5' untranslated region of mRNA encoded by LOC282927, corresponding to a target binding site such as BINDING SITE I, BINDING SITE II or BINDING SITE III of FIG. 8. Table 4 illustrates the complementarity of the nucleotide sequences of LOC282927 BINDING SITE, designated SEQ ID:6358, to the nucleotide sequence of GAM47 RNA, herein designated GAM RNA, also designated SEQ ID:269.

Another function of GAM47 is therefore inhibition of LOC282927 (Accession XP_212629.1). Accordingly, utilities of GAM47 include diagnosis, prevention and treatment of diseases and clinical conditions associated with LOC282927.

LOC283049 (Accession XP_210868.1) is another GAM47 target gene, herein designated TARGET GENE. LOC283049 BINDING SITE is a target binding site found in the 3' untranslated region of mRNA encoded by LOC283049, corresponding to a target binding site such as BINDING SITE I, BINDING SITE II or BINDING SITE III of FIG. 8. Table 4 illustrates the complementarity of the nucleotide sequences of LOC283049 BINDING SITE, designated SEQ ID:1447, to the nucleotide sequence of GAM47 RNA, herein designated GAM RNA, also designated SEQ ID:269.

Another function of GAM47 is therefore inhibition of LOC283049 (Accession XP_210868.1). Accordingly, utilities of GAM47 include diagnosis, prevention and treatment of diseases and clinical conditions associated with LOC283049.

LOC283168 (Accession XP_210910.1) is another GAM47 target gene, herein designated TARGET GENE. LOC283168 BINDING SITE is a target binding site found in the 3' untranslated region of mRNA encoded by LOC283168, corresponding to a target binding site such as BINDING SITE I, BINDING SITE II or BINDING SITE III of FIG. 8. Table 4 illustrates the complementarity of the nucleotide sequences of LOC283168 BINDING SITE, designated SEQ ID:3946, to the nucleotide sequence of GAM47 RNA, herein designated GAM RNA, also designated SEQ ID:269.

Another function of GAM47 is therefore inhibition of LOC283168 (Accession XP_210910.1). Accordingly, utilities of GAM47 include diagnosis, prevention and treatment of diseases and clinical conditions associated with LOC283168.

LOC283199 (Accession XP_210929.1) is another GAM47 target gene, herein designated TARGET GENE. LOC283199 BINDING SITE is a target binding site found in the 5' untranslated region of mRNA encoded by LOC283199, corresponding to a target binding site such as BINDING SITE I, BINDING SITE II or BINDING SITE III of FIG. 8. Table 4 illustrates the complementarity of the nucleotide sequences of LOC283199 BINDING SITE, designated SEQ ID:17013, to the nucleotide sequence of GAM47 RNA, herein designated GAM RNA, also designated SEQ ID:269.

Another function of GAM47 is therefore inhibition of LOC283199 (Accession XP_210929.1). Accordingly, utilities of GAM47 include diagnosis, prevention and treatment of diseases and clinical conditions associated with LOC283199.

LOC283391 (Accession XP_208657.1) is another GAM47 target gene, herein designated TARGET GENE. LOC283391 BINDING SITE is a target binding site found in the 3' untranslated region of mRNA encoded by LOC283391, corresponding to a target binding site such as BINDING SITE I, BINDING SITE II or BINDING SITE III of FIG. 8. Table 4 illustrates the complementarity of the nucleotide sequences of LOC283391 BINDING SITE, designated SEQ ID:11579, to the nucleotide sequence of GAM47 RNA, herein designated GAM RNA, also designated SEQ ID:269.

Another function of GAM47 is therefore inhibition of LOC283391 (Accession XP_208657.1). Accordingly, utilities of GAM47 include diagnosis, prevention and treatment of diseases and clinical conditions associated with LOC283391.

LOC283442 (Accession XP_211037.1) is another GAM47 target gene, herein designated TARGET GENE. LOC283442 BINDING SITE is a target binding site found in the 5' untranslated region of mRNA encoded by LOC283442, corresponding to a target binding site such as BINDING SITE I, BINDING SITE II or BINDING SITE III of FIG. 8. Table 4 illustrates the complementarity of the nucleotide sequences of LOC283442 BINDING SITE, designated SEQ ID:20097, to the nucleotide sequence of GAM47 RNA, herein designated GAM RNA, also designated SEQ ID:269.

Another function of GAM47 is therefore inhibition of LOC283442 (Accession XP_211037.1). Accordingly, utilities of GAM47 include diagnosis, prevention and treatment of diseases and clinical conditions associated with LOC283442.

LOC283468 (Accession XP_211051.1) is another GAM47 target gene, herein designated TARGET GENE. LOC283468 BINDING SITE is a target binding site found in the 3' untranslated region of mRNA encoded by LOC283468, corresponding to a target binding site such as BINDING SITE I, BINDING SITE II or BINDING SITE III of FIG. 8. Table 4 illustrates the complementarity of the nucleotide sequences of LOC283468 BINDING SITE, designated SEQ ID:1821, to the nucleotide sequence of GAM47 RNA, herein designated GAM RNA, also designated SEQ ID:269.

Another function of GAM47 is therefore inhibition of LOC283468 (Accession XP_211051.1). Accordingly, utilities of GAM47 include diagnosis, prevention and treatment of diseases and clinical conditions associated with LOC283468.

LOC283493 (Accession XP_208091.1) is another GAM47 target gene, herein designated TARGET GENE. LOC283493 BINDING SITE is a target binding site found in the 3' untranslated region of mRNA encoded by LOC283493, corresponding to a target binding site such as BINDING SITE I, BINDING SITE II or BINDING SITE III of FIG. 8. Table 4 illustrates the complementarity of the nucleotide sequences of LOC283493 BINDING SITE, designated SEQ ID:1898, to the nucleotide sequence of GAM47 RNA, herein designated GAM RNA, also designated SEQ ID:269.

Another function of GAM47 is therefore inhibition of LOC283493 (Accession XP_208091.1). Accordingly, utilities of GAM47 include diagnosis, prevention and treatment of diseases and clinical conditions associated with LOC283493.

LOC283526 (Accession XP_211081.1) is another GAM47 target gene, herein designated TARGET GENE. LOC283526 BINDING SITE is a target binding site found in the 3' untranslated region of mRNA encoded by LOC283526, corresponding to a target binding site such as BINDING SITE I, BINDING SITE II or BINDING SITE III of FIG. 8. Table 4 illustrates the complementarity of the nucleotide sequences of LOC283526 BINDING SITE, designated SEQ ID:8927, to the nucleotide sequence of GAM47 RNA, herein designated GAM RNA, also designated SEQ ID:269.

Another function of GAM47 is therefore inhibition of LOC283526 (Accession XP_211081.1). Accordingly, utilities of GAM47 include diagnosis, prevention and treatment of diseases and clinical conditions associated with LOC283526.

LOC283575 (Accession XP_211095.1) is another GAM47 target gene, herein designated TARGET GENE. LOC283575 BINDING SITE is a target binding site found in the 3' untranslated region of mRNA encoded by LOC283575, corresponding to a target binding site such as BINDING SITE I, BINDING SITE II or BINDING SITE III of FIG. 8. Table 4 illustrates the complementarity of the nucleotide sequences of LOC283575 BINDING SITE, designated SEQ ID:15864, to the nucleotide sequence of GAM47 RNA, herein designated GAM RNA, also designated SEQ ID:269.

Another function of GAM47 is therefore inhibition of LOC283575 (Accession XP_211095.1). Accordingly, utilities of GAM47 include diagnosis, prevention and treatment of diseases and clinical conditions associated with LOC283575.

LOC283582 (Accession XP_211119.1) is another GAM47 target gene, herein designated TARGET GENE. LOC283582 BINDING SITE is a target binding site found in the 5' untranslated region of mRNA encoded by LOC283582, corresponding to a target binding site such as BINDING SITE I, BINDING SITE II or BINDING SITE III of FIG. 8. Table 4 illustrates the complementarity of the nucleotide sequences of LOC283582 BINDING SITE, designated SEQ ID:7987, to the nucleotide sequence of GAM47 RNA, herein designated GAM RNA, also designated SEQ ID:269.

Another function of GAM47 is therefore inhibition of LOC283582 (Accession XP_211119.1). Accordingly, utilities of GAM47 include diagnosis, prevention and treatment of diseases and clinical conditions associated with LOC283582.

LOC283655 (Accession XP_211144.1) is another GAM47 target gene, herein designated TARGET GENE. LOC283655 BINDING SITE is a target binding site found in the 3' untranslated region of mRNA encoded by LOC283655, corresponding to a target binding site such as BINDING SITE I, BINDING SITE II or BINDING SITE III of FIG. 8. Table 4 illustrates the complementarity of the nucleotide sequences of LOC283655 BINDING SITE, designated SEQ ID:19410, to the nucleotide sequence of GAM47 RNA, herein designated GAM RNA, also designated SEQ ID:269.

Another function of GAM47 is therefore inhibition of LOC283655 (Accession XP_211144.1). Accordingly, utilities of GAM47 include diagnosis, prevention and treatment of diseases and clinical conditions associated with LOC283655.

LOC283690 (Accession XP_211167.1) is another GAM47 target gene, herein designated TARGET GENE.

LOC283690 BINDING SITE is a target binding site found in the 3' untranslated region of mRNA encoded by LOC283690, corresponding to a target binding site such as BINDING SITE I, BINDING SITE II or BINDING SITE III of FIG. 8. Table 4 illustrates the complementarity of the nucleotide sequences of LOC283690 BINDING SITE, designated SEQ ID:19850, to the nucleotide sequence of GAM47 RNA, herein designated GAM RNA, also designated SEQ ID:269.

Another function of GAM47 is therefore inhibition of LOC283690 (Accession XP_211167.1). Accordingly, utilities of GAM47 include diagnosis, prevention and treatment of diseases and clinical conditions associated with LOC283690.

LOC283701 (Accession XP_211170.3) is another GAM47 target gene, herein designated TARGET GENE. LOC283701 BINDING SITE is a target binding site found in the 3' untranslated region of mRNA encoded by LOC283701, corresponding to a target binding site such as BINDING SITE I, BINDING SITE II or BINDING SITE III of FIG. 8. Table 4 illustrates the complementarity of the nucleotide sequences of LOC283701 BINDING SITE, designated SEQ ID:16095, to the nucleotide sequence of GAM47 RNA, herein designated GAM RNA, also designated SEQ ID:269.

Another function of GAM47 is therefore inhibition of LOC283701 (Accession XP_211170.3). Accordingly, utilities of GAM47 include diagnosis, prevention and treatment of diseases and clinical conditions associated with LOC283701.

LOC283728 (Accession XP_211183.3) is another GAM47 target gene, herein designated TARGET GENE. LOC283728 BINDING SITE is a target binding site found in the 3' untranslated region of mRNA encoded by LOC283728, corresponding to a target binding site such as BINDING SITE I, BINDING SITE II or BINDING SITE III of FIG. 8. Table 4 illustrates the complementarity of the nucleotide sequences of LOC283728 BINDING SITE, designated SEQ ID:1631, to the nucleotide sequence of GAM47 RNA, herein designated GAM RNA, also designated SEQ ID:269.

Another function of GAM47 is therefore inhibition of LOC283728 (Accession XP_211183.3). Accordingly, utilities of GAM47 include diagnosis, prevention and treatment of diseases and clinical conditions associated with LOC283728.

LOC283777 (Accession XP_208837.1) is another GAM47 target gene, herein designated TARGET GENE. LOC283777 BINDING SITE is a target binding site found in the 3' untranslated region of mRNA encoded by LOC283777, corresponding to a target binding site such as BINDING SITE I, BINDING SITE II or BINDING SITE III of FIG. 8. Table 4 illustrates the complementarity of the nucleotide sequences of LOC283777 BINDING SITE, designated SEQ ID:10019, to the nucleotide sequence of GAM47 RNA, herein designated GAM RNA, also designated SEQ ID:269.

Another function of GAM47 is therefore inhibition of LOC283777 (Accession XP_208837.1). Accordingly, utilities of GAM47 include diagnosis, prevention and treatment of diseases and clinical conditions associated with LOC283777.

LOC283843 (Accession XP_208867.3) is another GAM47 target gene, herein designated TARGET GENE. LOC283843 BINDING SITE is a target binding site found in the 3' untranslated region of mRNA encoded by LOC283843, corresponding to a target binding site such as BINDING SITE I, BINDING SITE II or BINDING SITE III of FIG. 8. Table 4 illustrates the complementarity of the nucleotide sequences of LOC283843 BINDING SITE, designated SEQ ID:3242, to the nucleotide sequence of GAM47 RNA, herein designated GAM RNA, also designated SEQ ID:269.

Another function of GAM47 is therefore inhibition of LOC283843 (Accession XP_208867.3). Accordingly, utilities of GAM47 include diagnosis, prevention and treatment of diseases and clinical conditions associated with LOC283843.

LOC283846 (Accession XP_208126.1) is another GAM47 target gene, herein designated TARGET GENE. LOC283846 BINDING SITE is a target binding site found in the 5' untranslated region of mRNA encoded by LOC283846, corresponding to a target binding site such as BINDING SITE I, BINDING SITE II or BINDING SITE III of FIG. 8. Table 4 illustrates the complementarity of the nucleotide sequences of LOC283846 BINDING SITE, designated SEQ ID:3242, to the nucleotide sequence of GAM47 RNA, herein designated GAM RNA, also designated SEQ ID:269.

Another function of GAM47 is therefore inhibition of LOC283846 (Accession XP_208126.1). Accordingly, utilities of GAM47 include diagnosis, prevention and treatment of diseases and clinical conditions associated with LOC283846.

LOC283851 (Accession XP_211229.1) is another GAM47 target gene, herein designated TARGET GENE. LOC283851 BINDING SITE is a target binding site found in the 3' untranslated region of mRNA encoded by LOC283851, corresponding to a target binding site such as BINDING SITE I, BINDING SITE II or BINDING SITE III of FIG. 8. Table 4 illustrates the complementarity of the nucleotide sequences of LOC283851 BINDING SITE, designated SEQ ID:15767, to the nucleotide sequence of GAM47 RNA, herein designated GAM RNA, also designated SEQ ID:269.

Another function of GAM47 is therefore inhibition of LOC283851 (Accession XP_211229.1). Accordingly, utilities of GAM47 include diagnosis, prevention and treatment of diseases and clinical conditions associated with LOC283851.

LOC283862 (Accession XP_211237.1) is another GAM47 target gene, herein designated TARGET GENE. LOC283862 BINDING SITE is a target binding site found in the 5' untranslated region of mRNA encoded by LOC283862, corresponding to a target binding site such as BINDING SITE I, BINDING SITE II or BINDING SITE III of FIG. 8. Table 4 illustrates the complementarity of the nucleotide sequences of LOC283862 BINDING SITE, designated SEQ ID:652, to the nucleotide sequence of GAM47 RNA, herein designated GAM RNA, also designated SEQ ID:269.

Another function of GAM47 is therefore inhibition of LOC283862 (Accession XP_211237.1). Accordingly, utilities of GAM47 include diagnosis, prevention and treatment of diseases and clinical conditions associated with LOC283862.

LOC283911 (Accession XP_211259.2) is another GAM47 target gene, herein designated TARGET GENE. LOC283911 BINDING SITE is a target binding site found in the 5' untranslated region of mRNA encoded by LOC283911, corresponding to a target binding site such as BINDING SITE I, BINDING SITE II or BINDING SITE III of FIG. 8. Table 4 illustrates the complementarity of the nucleotide sequences of LOC283911 BINDING SITE, designated SEQ ID:18771, to the nucleotide sequence of GAM47 RNA, herein designated GAM RNA, also designated SEQ ID:269.

Another function of GAM47 is therefore inhibition of LOC283911 (Accession XP_211259.2). Accordingly, utilities of GAM47 include diagnosis, prevention and treatment of diseases and clinical conditions associated with LOC283911.

LOC283963 (Accession XP_211275.2) is another GAM47 target gene, herein designated TARGET GENE. LOC283963 BINDING SITE is a target binding site found in the 3' untranslated region of mRNA encoded by LOC283963, corresponding to a target binding site such as BINDING SITE I, BINDING SITE II or BINDING SITE III of FIG. 8. Table 4 illustrates the complementarity of the nucleotide sequences of LOC283963 BINDING SITE, designated SEQ ID:10020, to the nucleotide sequence of GAM47 RNA, herein designated GAM RNA, also designated SEQ ID:269.

Another function of GAM47 is therefore inhibition of LOC283963 (Accession XP_211275.2). Accordingly, utilities of GAM47 include diagnosis, prevention and treatment of diseases and clinical conditions associated with LOC283963.

LOC283980 (Accession XP_208940.2) is another GAM47 target gene, herein designated TARGET GENE. LOC283980 BINDING SITE is a target binding site found in the 3' untranslated region of mRNA encoded by LOC283980, corresponding to a target binding site such as BINDING SITE I, BINDING SITE II or BINDING SITE III of FIG. 8. Table 4 illustrates the complementarity of the nucleotide sequences of LOC283980 BINDING SITE, designated SEQ ID:8565, to the nucleotide sequence of GAM47 RNA, herein designated GAM RNA, also designated SEQ ID:269.

Another function of GAM47 is therefore inhibition of LOC283980 (Accession XP_208940.2). Accordingly, utilities of GAM47 include diagnosis, prevention and treatment of diseases and clinical conditions associated with LOC283980.

LOC284077 (Accession XP_210779.1) is another GAM47 target gene, herein designated TARGET GENE. LOC284077 BINDING SITE is a target binding site found in the 5' untranslated region of mRNA encoded by LOC284077, corresponding to a target binding site such as BINDING SITE I, BINDING SITE II or BINDING SITE III of FIG. 8. Table 4 illustrates the complementarity of the nucleotide sequences of LOC284077 BINDING SITE, designated SEQ ID:13640, to the nucleotide sequence of GAM47 RNA, herein designated GAM RNA, also designated SEQ ID:269.

Another function of GAM47 is therefore inhibition of LOC284077 (Accession XP_210779.1). Accordingly, utilities of GAM47 include diagnosis, prevention and treatment of diseases and clinical conditions associated with LOC284077.

LOC284080 (Accession XP_211322.1) is another GAM47 target gene, herein designated TARGET GENE. LOC284080 BINDING SITE is a target binding site found in the 5' untranslated region of mRNA encoded by LOC284080, corresponding to a target binding site such as BINDING SITE I, BINDING SITE II or BINDING SITE III of FIG. 8. Table 4 illustrates the complementarity of the nucleotide sequences of LOC284080 BINDING SITE, designated SEQ ID:15510, to the nucleotide sequence of GAM47 RNA, herein designated GAM RNA, also designated SEQ ID:269.

Another function of GAM47 is therefore inhibition of LOC284080 (Accession XP_211322.1). Accordingly, utilities of GAM47 include diagnosis, prevention and treatment of diseases and clinical conditions associated with LOC284080.

LOC284095 (Accession XP_211324.1) is another GAM47 target gene, herein designated TARGET GENE. LOC284095 BINDING SITE is a target binding site found in the 3' untranslated region of mRNA encoded by LOC284095, corresponding to a target binding site such as BINDING SITE I, BINDING SITE II or BINDING SITE III of FIG. 8. Table 4 illustrates the complementarity of the nucleotide sequences of LOC284095 BINDING SITE, designated SEQ ID:15774, to the nucleotide sequence of GAM47 RNA, herein designated GAM RNA, also designated SEQ ID:269.

Another function of GAM47 is therefore inhibition of LOC284095 (Accession XP_211324.1). Accordingly, utilities of GAM47 include diagnosis, prevention and treatment of diseases and clinical conditions associated with LOC284095.

LOC284172 (Accession XP_211361.1) is another GAM47 target gene, herein designated TARGET GENE. LOC284172 BINDING SITE is a target binding site found in the 3' untranslated region of mRNA encoded by LOC284172, corresponding to a target binding site such as BINDING SITE I, BINDING SITE II or BINDING SITE III of FIG. 8. Table 4 illustrates the complementarity of the nucleotide sequences of LOC284172 BINDING SITE, designated SEQ ID:13676, to the nucleotide sequence of GAM47 RNA, herein designated GAM RNA, also designated SEQ ID:269.

Another function of GAM47 is therefore inhibition of LOC284172 (Accession XP_211361.1). Accordingly, utilities of GAM47 include diagnosis, prevention and treatment of diseases and clinical conditions associated with LOC284172.

LOC284219 (Accession XP_211385.1) is another GAM47 target gene, herein designated TARGET GENE. LOC284219 BINDING SITE is a target binding site found in the 3' untranslated region of mRNA encoded by LOC284219, corresponding to a target binding site such as BINDING SITE I, BINDING SITE II or BINDING SITE III of FIG. 8. Table 4 illustrates the complementarity of the nucleotide sequences of LOC284219 BINDING SITE, designated SEQ ID:14057, to the nucleotide sequence of GAM47 RNA, herein designated GAM RNA, also designated SEQ ID:269.

Another function of GAM47 is therefore inhibition of LOC284219 (Accession XP_211385.1). Accordingly, utilities of GAM47 include diagnosis, prevention and treatment of diseases and clinical conditions associated with LOC284219.

LOC284233 (Accession XP_211388.1) is another GAM47 target gene, herein designated TARGET GENE. LOC284233 BINDING SITE is a target binding site found in the 3' untranslated region of mRNA encoded by LOC284233, corresponding to a target binding site such as BINDING SITE I, BINDING SITE II or BINDING SITE III of FIG. 8. Table 4 illustrates the complementarity of the nucleotide sequences of LOC284233 BINDING SITE, designated SEQ ID:705, to the nucleotide sequence of GAM47 RNA, herein designated GAM RNA, also designated SEQ ID:269.

Another function of GAM47 is therefore inhibition of LOC284233 (Accession XP_211388.1). Accordingly, utilities of GAM47 include diagnosis, prevention and treatment of diseases and clinical conditions associated with LOC284233.

LOC284244 (Accession XP_211399.1) is another GAM47 target gene, herein designated TARGET GENE. LOC284244 BINDING SITE is a target binding site found in the 3' untranslated region of mRNA encoded by LOC284244, corresponding to a target binding site such as BINDING SITE I, BINDING SITE II or BINDING SITE III of FIG. 8. Table 4 illustrates the complementarity of the nucleotide sequences of LOC284244 BINDING SITE, designated SEQ ID:3763, to the nucleotide sequence of GAM47 RNA, herein designated GAM RNA, also designated SEQ ID:269.

Another function of GAM47 is therefore inhibition of LOC284244 (Accession XP_211399.1). Accordingly, utilities of GAM47 include diagnosis, prevention and treatment of diseases and clinical conditions associated with LOC284244.

LOC284259 (Accession XP_211410.1) is another GAM47 target gene, herein designated TARGET GENE. LOC284259 BINDING SITE is a target binding site found in the 5' untranslated region of mRNA encoded by LOC284259, corresponding to a target binding site such as BINDING SITE I, BINDING SITE II or BINDING SITE III of FIG. 8. Table 4 illustrates the complementarity of the nucleotide sequences of LOC284259 BINDING SITE, designated SEQ ID:8411, to the nucleotide sequence of GAM47 RNA, herein designated GAM RNA, also designated SEQ ID:269.

Another function of GAM47 is therefore inhibition of LOC284259 (Accession XP_211410.1). Accordingly, utilities of GAM47 include diagnosis, prevention and treatment of diseases and clinical conditions associated with LOC284259.

LOC284267 (Accession XP_211411.1) is another GAM47 target gene, herein designated TARGET GENE. LOC284267 BINDING SITE is a target binding site found in the 5' untranslated region of mRNA encoded by LOC284267, corresponding to a target binding site such as BINDING SITE I, BINDING SITE II or BINDING SITE III of FIG. 8. Table 4 illustrates the complementarity of the nucleotide sequences of LOC284267 BINDING SITE, designated SEQ ID:11107, to the nucleotide sequence of GAM47 RNA, herein designated GAM RNA, also designated SEQ ID:269.

Another function of GAM47 is therefore inhibition of LOC284267 (Accession XP_211411.1). Accordingly, utilities of GAM47 include diagnosis, prevention and treatment of diseases and clinical conditions associated with LOC284267.

LOC284395 (Accession XP_211454.1) is another GAM47 target gene, herein designated TARGET GENE. LOC284395 BINDING SITE is a target binding site found in the 3' untranslated region of mRNA encoded by LOC284395, corresponding to a target binding site such as BINDING SITE I, BINDING SITE II or BINDING SITE III of FIG. 8. Table 4 illustrates the complementarity of the nucleotide sequences of LOC284395 BINDING SITE, designated SEQ ID:1174, to the nucleotide sequence of GAM47 RNA, herein designated GAM RNA, also designated SEQ ID:269.

Another function of GAM47 is therefore inhibition of LOC284395 (Accession XP_211454.1). Accordingly, utilities of GAM47 include diagnosis, prevention and treatment of diseases and clinical conditions associated with LOC284395.

LOC284433 (Accession XP_210787.1) is another GAM47 target gene, herein designated TARGET GENE. LOC284433 BINDING SITE is a target binding site found in the 5' untranslated region of mRNA encoded by LOC284433, corresponding to a target binding site such as BINDING SITE I, BINDING SITE II or BINDING SITE III of FIG. 8. Table 4 illustrates the complementarity of the nucleotide sequences of LOC284433 BINDING SITE, designated SEQ ID:12213, to the nucleotide sequence of GAM47 RNA, herein designated GAM RNA, also designated SEQ ID:269.

Another function of GAM47 is therefore inhibition of LOC284433 (Accession XP_210787.1). Accordingly, utilities of GAM47 include diagnosis, prevention and treatment of diseases and clinical conditions associated with LOC284433.

LOC284445 (Accession XP_209212.1) is another GAM47 target gene, herein designated TARGET GENE. LOC284445 BINDING SITE is a target binding site found in the 3' untranslated region of mRNA encoded by LOC284445, corresponding to a target binding site such as BINDING SITE I, BINDING SITE II or BINDING SITE III of FIG. 8. Table 4 illustrates the complementarity of the nucleotide sequences of LOC284445 BINDING SITE, designated SEQ ID:18092, to the nucleotide sequence of GAM47 RNA, herein designated GAM RNA, also designated SEQ ID:269.

Another function of GAM47 is therefore inhibition of LOC284445 (Accession XP_209212.1). Accordingly, utilities of GAM47 include diagnosis, prevention and treatment of diseases and clinical conditions associated with LOC284445.

LOC284456 (Accession XP_211470.1) is another GAM47 target gene, herein designated TARGET GENE. LOC284456 BINDING SITE1 and LOC284456 BINDING SITE2 are target binding sites found in untranslated regions of mRNA encoded by LOC284456, corresponding to target binding sites such as BINDING SITE I, BINDING SITE II or BINDING SITE III of FIG. 8. Table 4 illustrates the complementarity of the nucleotide sequences of LOC284456 BINDING SITE1 and LOC284456 BINDING SITE2, designated SEQ ID:18111 and SEQ ID:6952 respectively, to the nucleotide sequence of GAM47 RNA, herein designated GAM RNA, also designated SEQ ID:269.

Another function of GAM47 is therefore inhibition of LOC284456 (Accession XP_211470.1). Accordingly, utilities of GAM47 include diagnosis, prevention and treatment of diseases and clinical conditions associated with LOC284456.

LOC284473 (Accession XP_211474.1) is another GAM47 target gene, herein designated TARGET GENE. LOC284473 BINDING SITE is a target binding site found in the 3' untranslated region of mRNA encoded by LOC284473, corresponding to a target binding site such as BINDING SITE I, BINDING SITE II or BINDING SITE III of FIG. 8. Table 4 illustrates the complementarity of the nucleotide sequences of LOC284473 BINDING SITE, designated SEQ ID:3315, to the nucleotide sequence of GAM47 RNA, herein designated GAM RNA, also designated SEQ ID:269.

Another function of GAM47 is therefore inhibition of LOC284473 (Accession XP_211474.1). Accordingly, utilities of GAM47 include diagnosis, prevention and treatment of diseases and clinical conditions associated with LOC284473.

LOC284491 (Accession XP_211488.1) is another GAM47 target gene, herein designated TARGET GENE. LOC284491 BINDING SITE is a target binding site found in the 3' untranslated region of mRNA encoded by LOC284491, corresponding to a target binding site such as BINDING SITE I, BINDING SITE II or BINDING SITE III of FIG. 8. Table 4 illustrates the complementarity of the nucleotide sequences of LOC284491 BINDING SITE, designated SEQ ID:598, to the nucleotide sequence of GAM47 RNA, herein designated GAM RNA, also designated SEQ ID:269.

Another function of GAM47 is therefore inhibition of LOC284491 (Accession XP_211488.1). Accordingly, utilities of GAM47 include diagnosis, prevention and treatment of diseases and clinical conditions associated with LOC284491.

LOC284499 (Accession XP_209237.1) is another GAM47 target gene, herein designated TARGET GENE. LOC284499 BINDING SITE is a target binding site found in the 5' untranslated region of mRNA encoded by LOC284499, corresponding to a target binding site such as BINDING SITE I, BINDING SITE II or BINDING SITE III of FIG. 8. Table 4 illustrates the complementarity of the nucleotide sequences of LOC284499 BINDING SITE, designated SEQ ID:1464, to the nucleotide sequence of GAM47 RNA, herein designated GAM RNA, also designated SEQ ID:269.

Another function of GAM47 is therefore inhibition of LOC284499 (Accession XP_209237.1). Accordingly, utilities of GAM47 include diagnosis, prevention and treatment of diseases and clinical conditions associated with LOC284499.

LOC284559 (Accession XP_208220.1) is another GAM47 target gene, herein designated TARGET GENE. LOC284559 BINDING SITE is a target binding site found in the 3' untranslated region of mRNA encoded by LOC284559, corresponding to a target binding site such as BINDING SITE I, BINDING SITE II or BINDING SITE III of FIG. 8. Table 4 illustrates the complementarity of the nucleotide sequences of LOC284559 BINDING SITE, designated SEQ ID:6672, to the nucleotide sequence of GAM47 RNA, herein designated GAM RNA, also designated SEQ ID:269.

Another function of GAM47 is therefore inhibition of LOC284559 (Accession XP_208220.1). Accordingly, utilities of GAM47 include diagnosis, prevention and treatment of diseases and clinical conditions associated with LOC284559.

LOC284615 (Accession XP_211553.1) is another GAM47 target gene, herein designated TARGET GENE. LOC284615 BINDING SITE is a target binding site found in the 3' untranslated region of mRNA encoded by LOC284615, corresponding to a target binding site such as BINDING SITE I, BINDING SITE II or BINDING SITE III of FIG. 8. Table 4 illustrates the complementarity of the nucleotide sequences of LOC284615 BINDING SITE, designated SEQ ID:9093, to the nucleotide sequence of GAM47 RNA, herein designated GAM RNA, also designated SEQ ID:269.

Another function of GAM47 is therefore inhibition of LOC284615 (Accession XP_211553.1). Accordingly, utilities of GAM47 include diagnosis, prevention and treatment of diseases and clinical conditions associated with LOC284615.

LOC284688 (Accession XP_211588.1) is another GAM47 target gene, herein designated TARGET GENE. LOC284688 BINDING SITE is a target binding site found in the 3' untranslated region of mRNA encoded by LOC284688, corresponding to a target binding site such as BINDING SITE I, BINDING SITE II or BINDING SITE III of FIG. 8. Table 4 illustrates the complementarity of the nucleotide sequences of LOC284688 BINDING SITE, designated SEQ ID:8169, to the nucleotide sequence of GAM47 RNA, herein designated GAM RNA, also designated SEQ ID:269.

Another function of GAM47 is therefore inhibition of LOC284688 (Accession XP_211588.1). Accordingly, utilities of GAM47 include diagnosis, prevention and treatment of diseases and clinical conditions associated with LOC284688.

LOC284758 (Accession XP_211634.1) is another GAM47 target gene, herein designated TARGET GENE. LOC284758 BINDING SITE is a target binding site found in the 3' untranslated region of mRNA encoded by LOC284758, corresponding to a target binding site such as BINDING SITE I, BINDING SITE II or BINDING SITE III of FIG. 8. Table 4 illustrates the complementarity of the nucleotide sequences of LOC284758 BINDING SITE, designated SEQ ID:18028, to the nucleotide sequence of GAM47 RNA, herein designated GAM RNA, also designated SEQ ID:269.

Another function of GAM47 is therefore inhibition of LOC284758 (Accession XP_211634.1). Accordingly, utilities of GAM47 include diagnosis, prevention and treatment of diseases and clinical conditions associated with LOC284758.

LOC284836 (Accession XP_211654.1) is another GAM47 target gene, herein designated TARGET GENE. LOC284836 BINDING SITE is a target binding site found in the 5' untranslated region of mRNA encoded by LOC284836, corresponding to a target binding site such as BINDING SITE I, BINDING SITE II or BINDING SITE III of FIG. 8. Table 4 illustrates the complementarity of the nucleotide sequences of LOC284836 BINDING SITE, designated SEQ ID:11298, to the nucleotide sequence of GAM47 RNA, herein designated GAM RNA, also designated SEQ ID:269.

Another function of GAM47 is therefore inhibition of LOC284836 (Accession XP_211654.1). Accordingly, utilities of GAM47 include diagnosis, prevention and treatment of diseases and clinical conditions associated with LOC284836.

LOC284851 (Accession XP_211667.1) is another GAM47 target gene, herein designated TARGET GENE. LOC284851 BINDING SITE is a target binding site found in the 3' untranslated region of mRNA encoded by LOC284851, corresponding to a target binding site such as BINDING SITE I, BINDING SITE II or BINDING SITE III of FIG. 8. Table 4 illustrates the complementarity of the nucleotide sequences of LOC284851 BINDING SITE, designated SEQ ID:4964, to the nucleotide sequence of GAM47 RNA, herein designated GAM RNA, also designated SEQ ID:269.

Another function of GAM47 is therefore inhibition of LOC284851 (Accession XP_211667.1). Accordingly, utilities of GAM47 include diagnosis, prevention and treatment of diseases and clinical conditions associated with LOC284851.

LOC284858 (Accession XP_209386.1) is another GAM47 target gene, herein designated TARGET GENE. LOC284858 BINDING SITE is a target binding site found in the 3' untranslated region of mRNA encoded by LOC284858, corresponding to a target binding site such as BINDING SITE I, BINDING SITE II or BINDING SITE III of FIG. 8. Table 4 illustrates the complementarity of the nucleotide sequences of LOC284858 BINDING SITE, designated SEQ ID:5108, to the nucleotide sequence of GAM47 RNA, herein designated GAM RNA, also designated SEQ ID:269.

Another function of GAM47 is therefore inhibition of LOC284858 (Accession XP_209386.1). Accordingly, utilities of GAM47 include diagnosis, prevention and treatment of diseases and clinical conditions associated with LOC284858.

LOC284939 (Accession XP_211700.1) is another GAM47 target gene, herein designated TARGET GENE. LOC284939 BINDING SITE is a target binding site found in the 5' untranslated region of mRNA encoded by LOC284939, corresponding to a target binding site such as BINDING SITE I, BINDING SITE II or BINDING SITE III of FIG. 8. Table 4 illustrates the complementarity of the nucleotide sequences of LOC284939 BINDING SITE, designated SEQ ID:1266, to the nucleotide sequence of GAM47 RNA, herein designated GAM RNA, also designated SEQ ID:269.

Another function of GAM47 is therefore inhibition of LOC284939 (Accession XP_211700.1). Accordingly, utilities of GAM47 include diagnosis, prevention and treatment of diseases and clinical conditions associated with LOC284939.

LOC284974 (Accession XP_211713.1) is another GAM47 target gene, herein designated TARGET GENE. LOC284974 BINDING SITE is a target binding site found in the 5' untranslated region of mRNA encoded by LOC284974, corresponding to a target binding site such as BINDING SITE I, BINDING SITE II or BINDING SITE III of FIG. 8. Table 4 illustrates the complementarity of the nucleotide sequences of LOC284974 BINDING SITE, designated SEQ ID:7359, to the nucleotide sequence of GAM47 RNA, herein designated GAM RNA, also designated SEQ ID:269.

Another function of GAM47 is therefore inhibition of LOC284974 (Accession XP_211713.1). Accordingly, utilities of GAM47 include diagnosis, prevention and treatment of diseases and clinical conditions associated with LOC284974.

LOC285002 (Accession XP_211731.2) is another GAM47 target gene, herein designated TARGET GENE. LOC285002 BINDING SITE is a target binding site found in the 3' untranslated region of mRNA encoded by LOC285002, corresponding to a target binding site such as BINDING SITE I, BINDING SITE II or BINDING SITE III of FIG. 8. Table 4 illustrates the complementarity of the nucleotide sequences of LOC285002 BINDING SITE, designated SEQ ID:9504, to the nucleotide sequence of GAM47 RNA, herein designated GAM RNA, also designated SEQ ID:269.

Another function of GAM47 is therefore inhibition of LOC285002 (Accession XP_211731.2). Accordingly, utilities of GAM47 include diagnosis, prevention and treatment of diseases and clinical conditions associated with LOC285002.

LOC285122 (Accession XP_211770.1) is another GAM47 target gene, herein designated TARGET GENE. LOC285122 BINDING SITE is a target binding site found in the 5' untranslated region of mRNA encoded by LOC285122, corresponding to a target binding site such as BINDING SITE I, BINDING SITE II or BINDING SITE III of FIG. 8. Table 4 illustrates the complementarity of the nucleotide sequences of LOC285122 BINDING SITE, designated SEQ ID:18888, to the nucleotide sequence of GAM47 RNA, herein designated GAM RNA, also designated SEQ ID:269.

Another function of GAM47 is therefore inhibition of LOC285122 (Accession XP_211770.1). Accordingly, utilities of GAM47 include diagnosis, prevention and treatment of diseases and clinical conditions associated with LOC285122.

LOC285329 (Accession XP_209569.1) is another GAM47 target gene, herein designated TARGET GENE. LOC285329 BINDING SITE is a target binding site found in the 3' untranslated region of mRNA encoded by LOC285329, corresponding to a target binding site such as BINDING SITE I, BINDING SITE II or BINDING SITE III of FIG. 8. Table 4 illustrates the complementarity of the nucleotide sequences of LOC285329 BINDING SITE, designated SEQ ID:16710, to the nucleotide sequence of GAM47 RNA, herein designated GAM RNA, also designated SEQ ID:269.

Another function of GAM47 is therefore inhibition of LOC285329 (Accession XP_209569.1). Accordingly, utilities of GAM47 include diagnosis, prevention and treatment of diseases and clinical conditions associated with LOC285329.

LOC285338 (Accession XP_209573.1) is another GAM47 target gene, herein designated TARGET GENE. LOC285338 BINDING SITE is a target binding site found in the 5' untranslated region of mRNA encoded by LOC285338, corresponding to a target binding site such as BINDING SITE I, BINDING SITE II or BINDING SITE III of FIG. 8. Table 4 illustrates the complementarity of the nucleotide sequences of LOC285338 BINDING SITE, designated SEQ ID:671, to the nucleotide sequence of GAM47 RNA, herein designated GAM RNA, also designated SEQ ID:269.

Another function of GAM47 is therefore inhibition of LOC285338 (Accession XP_209573.1). Accordingly, utilities of GAM47 include diagnosis, prevention and treatment of diseases and clinical conditions associated with LOC285338.

LOC285369 (Accession XP_211861.3) is another GAM47 target gene, herein designated TARGET GENE. LOC285369 BINDING SITE is a target binding site found in the 3' untranslated region of mRNA encoded by LOC285369, corresponding to a target binding site such as BINDING SITE I, BINDING SITE II or BINDING SITE III of FIG. 8. Table 4 illustrates the complementarity of the nucleotide sequences of LOC285369 BINDING SITE, designated SEQ ID:19888, to the nucleotide sequence of GAM47 RNA, herein designated GAM RNA, also designated SEQ ID:269.

Another function of GAM47 is therefore inhibition of LOC285369 (Accession XP_211861.3). Accordingly, utilities of GAM47 include diagnosis, prevention and treatment of diseases and clinical conditions associated with LOC285369.

LOC285402 (Accession XP_211884.1) is another GAM47 target gene, herein designated TARGET GENE. LOC285402 BINDING SITE is a target binding site found in the 5' untranslated region of mRNA encoded by LOC285402, corresponding to a target binding site such as BINDING SITE I, BINDING SITE II or BINDING SITE III of FIG. 8. Table 4 illustrates the complementarity of the nucleotide sequences of LOC285402 BINDING SITE, designated SEQ ID:7301, to the nucleotide sequence of GAM47 RNA, herein designated GAM RNA, also designated SEQ ID:269.

Another function of GAM47 is therefore inhibition of LOC285402 (Accession XP_211884.1). Accordingly, utilities of GAM47 include diagnosis, prevention and treatment of diseases and clinical conditions associated with LOC285402.

LOC285526 (Accession XP_211927.1) is another GAM47 target gene, herein designated TARGET GENE. LOC285526 BINDING SITE is a target binding site found in the 5' untranslated region of mRNA encoded by LOC285526, corresponding to a target binding site such as BINDING SITE I, BINDING SITE II or BINDING SITE III of FIG. 8. Table 4 illustrates the complementarity of the nucleotide sequences of LOC285526 BINDING SITE, designated SEQ ID:14586, to the nucleotide sequence of GAM47 RNA, herein designated GAM RNA, also designated SEQ ID:269.

Another function of GAM47 is therefore inhibition of LOC285526 (Accession XP_211927.1). Accordingly, utilities of GAM47 include diagnosis, prevention and treatment of diseases and clinical conditions associated with LOC285526.

LOC285544 (Accession XP_209655.2) is another GAM47 target gene, herein designated TARGET GENE. LOC285544 BINDING SITE is a target binding site found in the 3' untranslated region of mRNA encoded by LOC285544, corresponding to a target binding site such as BINDING SITE I, BINDING SITE II or BINDING SITE III of FIG. 8. Table 4 illustrates the complementarity of the nucleotide sequences of LOC285544 BINDING SITE, designated SEQ ID:1609, to the nucleotide sequence of GAM47 RNA, herein designated GAM RNA, also designated SEQ ID:269.

Another function of GAM47 is therefore inhibition of LOC285544 (Accession XP_209655.2). Accordingly, utilities of GAM47 include diagnosis, prevention and treatment of diseases and clinical conditions associated with LOC285544.

LOC285647 (Accession XP_209700.3) is another GAM47 target gene, herein designated TARGET GENE. LOC285647 BINDING SITE is a target binding site found in the 3' untranslated region of mRNA encoded by LOC285647, corresponding to a target binding site such as BINDING SITE I, BINDING SITE II or BINDING SITE III of FIG. 8. Table 4 illustrates the complementarity of the nucleotide sequences of LOC285647 BINDING SITE, designated SEQ ID:7695, to the nucleotide sequence of GAM47 RNA, herein designated GAM RNA, also designated SEQ ID:269.

Another function of GAM47 is therefore inhibition of LOC285647 (Accession XP_209700.3). Accordingly, utilities of GAM47 include diagnosis, prevention and treatment of diseases and clinical conditions associated with LOC285647.

LOC285654 (Accession XP_211975.1) is another GAM47 target gene, herein designated TARGET GENE. LOC285654 BINDING SITE1 and LOC285654 BINDING SITE2 are target binding sites found in untranslated regions of mRNA encoded by LOC285654, corresponding to target binding sites such as BINDING SITE I, BINDING SITE II or BINDING SITE III of FIG. 8. Table 4 illustrates the complementarity of the nucleotide sequences of LOC285654 BINDING SITE1 and LOC285654 BINDING SITE2, designated SEQ ID:18509 and SEQ ID:19966 respectively, to the nucleotide sequence of GAM47 RNA, herein designated GAM RNA, also designated SEQ ID:269.

Another function of GAM47 is therefore inhibition of LOC285654 (Accession XP_211975.1). Accordingly, utilities of GAM47 include diagnosis, prevention and treatment of diseases and clinical conditions associated with LOC285654.

LOC285671 (Accession XP_209709.2) is another GAM47 target gene, herein designated TARGET GENE. LOC285671 BINDING SITE is a target binding site found in the 3' untranslated region of multiple transcripts of mRNA encoded by LOC285671, corresponding to a target binding site such as BINDING SITE I, BINDING SITE II or BINDING SITE III of FIG. 8. Table 4 illustrates the complementarity of the nucleotide sequences of LOC285671 BINDING SITE, designated SEQ ID:13387, to the nucleotide sequence of GAM47 RNA, herein designated GAM RNA, also designated SEQ ID:269.

Another function of GAM47 is therefore inhibition of LOC285671 (Accession XP_209709.2). Accordingly, utilities of GAM47 include diagnosis, prevention and treatment of diseases and clinical conditions associated with LOC285671.

LOC285682 (Accession XP_211979.1) is another GAM47 target gene, herein designated TARGET GENE. LOC285682 BINDING SITE is a target binding site found in the 5' untranslated region of mRNA encoded by LOC285682, corresponding to a target binding site such as BINDING SITE I, BINDING SITE II or BINDING SITE III of FIG. 8. Table 4 illustrates the complementarity of the nucleotide sequences of LOC285682 BINDING SITE, designated SEQ ID:5657, to the nucleotide sequence of GAM47 RNA, herein designated GAM RNA, also designated SEQ ID:269.

Another function of GAM47 is therefore inhibition of LOC285682 (Accession XP_211979.1). Accordingly, utilities of GAM47 include diagnosis, prevention and treatment of diseases and clinical conditions associated with LOC285682.

LOC285719 (Accession XP_211990.1) is another GAM47 target gene, herein designated TARGET GENE. LOC285719 BINDING SITE is a target binding site found in the 5' untranslated region of mRNA encoded by LOC285719, corresponding to a target binding site such as BINDING SITE I, BINDING SITE II or BINDING SITE III of FIG. 8. Table 4 illustrates the complementarity of the nucleotide sequences of LOC285719 BINDING SITE, designated SEQ ID:13540, to the nucleotide sequence of GAM47 RNA, herein designated GAM RNA, also designated SEQ ID:269.

Another function of GAM47 is therefore inhibition of LOC285719 (Accession XP_211990.1). Accordingly, utilities of GAM47 include diagnosis, prevention and treatment of diseases and clinical conditions associated with LOC285719.

LOC285756 (Accession XP_209751.1) is another GAM47 target gene, herein designated TARGET GENE. LOC285756 BINDING SITE is a target binding site found in the 3' untranslated region of mRNA encoded by LOC285756, corresponding to a target binding site such as BINDING SITE I, BINDING SITE II or BINDING SITE III of FIG. 8. Table 4 illustrates the complementarity of the nucleotide sequences of LOC285756 BINDING SITE, designated SEQ ID:3336, to the nucleotide sequence of GAM47 RNA, herein designated GAM RNA, also designated SEQ ID:269.

Another function of GAM47 is therefore inhibition of LOC285756 (Accession XP_209751.1). Accordingly, utilities of GAM47 include diagnosis, prevention and treatment of diseases and clinical conditions associated with LOC285756.

LOC285805 (Accession XP_212027.1) is another GAM47 target gene, herein designated TARGET GENE. LOC285805 BINDING SITE is a target binding site found in the 5' untranslated region of mRNA encoded by LOC285805, corresponding to a target binding site such as BINDING SITE I, BINDING SITE II or BINDING SITE III of FIG. 8. Table 4 illustrates the complementarity of the nucleotide sequences of LOC285805 BINDING SITE, designated SEQ ID:17058, to the nucleotide sequence of GAM47 RNA, herein designated GAM RNA, also designated SEQ ID:269.

Another function of GAM47 is therefore inhibition of LOC285805 (Accession XP_212027.1). Accordingly, utilities of GAM47 include diagnosis, prevention and treatment of diseases and clinical conditions associated with LOC285805.

LOC285822 (Accession XP_209777.1) is another GAM47 target gene, herein designated TARGET GENE. LOC285822 BINDING SITE is a target binding site found in the 5' untranslated region of mRNA encoded by LOC285822, corresponding to a target binding site such as BINDING SITE I, BINDING SITE II or BINDING SITE III of FIG. 8. Table 4 illustrates the complementarity of the nucleotide sequences of LOC285822 BINDING SITE, designated SEQ ID:17839, to the nucleotide sequence of GAM47 RNA, herein designated GAM RNA, also designated SEQ ID:269.

Another function of GAM47 is therefore inhibition of LOC285822 (Accession XP_209777.1). Accordingly, utilities of GAM47 include diagnosis, prevention and treatment of diseases and clinical conditions associated with LOC285822.

LOC285908 (Accession XP_209812.1) is another GAM47 target gene, herein designated TARGET GENE. LOC285908 BINDING SITE is a target binding site found in the 3' untranslated region of mRNA encoded by LOC285908, corresponding to a target binding site such as BINDING SITE I, BINDING SITE II or BINDING SITE III of FIG. 8. Table 4 illustrates the complementarity of the nucleotide sequences of LOC285908 BINDING SITE, designated SEQ ID:1135, to the nucleotide sequence of GAM47 RNA, herein designated GAM RNA, also designated SEQ ID:269.

Another function of GAM47 is therefore inhibition of LOC285908 (Accession XP_209812.1). Accordingly, utilities of GAM47 include diagnosis, prevention and treatment of diseases and clinical conditions associated with LOC285908.

LOC285909 (Accession XP_209811.1) is another GAM47 target gene, herein designated TARGET GENE. LOC285909 BINDING SITE is a target binding site found in the 3' untranslated region of mRNA encoded by LOC285909, corresponding to a target binding site such as BINDING SITE I, BINDING SITE II or BINDING SITE III of FIG. 8. Table 4 illustrates the complementarity of the nucleotide sequences of LOC285909 BINDING SITE, designated SEQ ID:6593, to the nucleotide sequence of GAM47 RNA, herein designated GAM RNA, also designated SEQ ID:269.

Another function of GAM47 is therefore inhibition of LOC285909 (Accession XP_209811.1). Accordingly, utilities of GAM47 include diagnosis, prevention and treatment of diseases and clinical conditions associated with LOC285909.

LOC285915 (Accession XP_209802.1) is another GAM47 target gene, herein designated TARGET GENE. LOC285915 BINDING SITE is a target binding site found in the 3' untranslated region of mRNA encoded by LOC285915, corresponding to a target binding site such as BINDING SITE I, BINDING SITE II or BINDING SITE III of FIG. 8. Table 4 illustrates the complementarity of the nucleotide sequences of LOC285915 BINDING SITE, designated SEQ ID:15820, to the nucleotide sequence of GAM47 RNA, herein designated GAM RNA, also designated SEQ ID:269.

Another function of GAM47 is therefore inhibition of LOC285915 (Accession XP_209802.1). Accordingly, utilities of GAM47 include diagnosis, prevention and treatment of diseases and clinical conditions associated with LOC285915.

LOC285931 (Accession NP_777609.1) is another GAM47 target gene, herein designated TARGET GENE. LOC285931 BINDING SITE is a target binding site found in the 3' untranslated region of mRNA encoded by LOC285931, corresponding to a target binding site such as BINDING SITE I, BINDING SITE II or BINDING SITE III of FIG. 8. Table 4 illustrates the complementarity of the nucleotide sequences of LOC285931 BINDING SITE, designated SEQ ID:8682, to the nucleotide sequence of GAM47 RNA, herein designated GAM RNA, also designated SEQ ID:269.

Another function of GAM47 is therefore inhibition of LOC285931 (Accession NP_777609.1). Accordingly, utilities of GAM47 include diagnosis, prevention and treatment of diseases and clinical conditions associated with LOC285931.

LOC285951 (Accession XP_212090.1) is another GAM47 target gene, herein designated TARGET GENE. LOC285951 BINDING SITE is a target binding site found in the 5' untranslated region of mRNA encoded by LOC285951, corresponding to a target binding site such as BINDING SITE I, BINDING SITE II or BINDING SITE III of FIG. 8. Table 4 illustrates the complementarity of the nucleotide sequences of LOC285951 BINDING SITE, designated SEQ ID:1535, to the nucleotide sequence of GAM47 RNA, herein designated GAM RNA, also designated SEQ ID:269.

Another function of GAM47 is therefore inhibition of LOC285951 (Accession XP_212090.1). Accordingly, utilities of GAM47 include diagnosis, prevention and treatment of diseases and clinical conditions associated with LOC285951.

LOC286007 (Accession XP_212133.1) is another GAM47 target gene, herein designated TARGET GENE. LOC286007 BINDING SITE1 and LOC286007 BINDING SITE2 are target binding sites found in untranslated regions of mRNA encoded by LOC286007, corresponding to target binding sites such as BINDING SITE I, BINDING SITE II or BINDING SITE III of FIG. 8. Table 4 illustrates the complementarity of the nucleotide sequences of LOC286007 BINDING SITE1 and LOC286007 BINDING SITE2, designated SEQ ID:3734 and SEQ ID:17618 respectively, to the nucleotide sequence of GAM47 RNA, herein designated GAM RNA, also designated SEQ ID:269.

Another function of GAM47 is therefore inhibition of LOC286007 (Accession XP_212133.1). Accordingly, utilities of GAM47 include diagnosis, prevention and treatment of diseases and clinical conditions associated with LOC286007.

LOC286030 (Accession XP_209868.1) is another GAM47 target gene, herein designated TARGET GENE. LOC286030 BINDING SITE is a target binding site found in the 5' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:3883, to the nucleotide sequence of GAM47 RNA, herein designated GAM RNA, also designated SEQ ID:269.

Another function of GAM47 is therefore inhibition of LOC286030 (Accession XP_209868.1). Accordingly, utilities of GAM47 include diagnosis, prevention and treatment of diseases and clinical conditions associated with LOC286030.

LOC286041 (Accession XP_212140.3) is another GAM47 target gene, herein designated TARGET GENE. LOC286041 BINDING SITE is a target binding site found in the 5' untranslated region of mRNA encoded by LOC286041, corresponding to a target binding site such as BINDING SITE I, BINDING SITE II or BINDING SITE III of FIG. 8. Table 4 illustrates the complementarity of the nucleotide sequences of LOC286041 BINDING SITE, designated SEQ ID:18519, to the nucleotide sequence of GAM47 RNA, herein designated GAM RNA, also designated SEQ ID:269.

Another function of GAM47 is therefore inhibition of LOC286041 (Accession XP_212140.3). Accordingly, utilities of GAM47 include diagnosis, prevention and treatment of diseases and clinical conditions associated with LOC286041.

LOC286078 (Accession XP_212163.1) is another GAM47 target gene, herein designated TARGET GENE. LOC286078 BINDING SITE is a target binding site found in the 5' untranslated region of mRNA encoded by LOC286078, corresponding to a target binding site such as BINDING SITE I, BINDING SITE II or BINDING SITE III of FIG. 8. Table 4 illustrates the complementarity of the nucleotide sequences of LOC286078 BINDING SITE, designated SEQ ID:7355, to the nucleotide sequence of GAM47 RNA, herein designated GAM RNA, also designated SEQ ID:269.

Another function of GAM47 is therefore inhibition of LOC286078 (Accession XP_212163.1). Accordingly, utilities of GAM47 include diagnosis, prevention and treatment of diseases and clinical conditions associated with LOC286078.

LOC286154 (Accession XP_212204.1) is another GAM47 target gene, herein designated TARGET GENE. LOC286154 BINDING SITE is a target binding site found in the 3' untranslated region of mRNA encoded by LOC286154, corresponding to a target binding site such as BINDING SITE I, BINDING SITE II or BINDING SITE III of FIG. 8. Table 4 illustrates the complementarity of the nucleotide sequences of LOC286154 BINDING SITE, designated SEQ ID:18003, to the nucleotide sequence of GAM47 RNA, herein designated GAM RNA, also designated SEQ ID:269.

Another function of GAM47 is therefore inhibition of LOC286154 (Accession XP_212204.1). Accordingly, utilities of GAM47 include diagnosis, prevention and treatment of diseases and clinical conditions associated with LOC286154.

LOC286208 (Accession XP_212230.1) is another GAM47 target gene, herein designated TARGET GENE. LOC286208 BINDING SITE is a target binding site found in the 3' untranslated region of mRNA encoded by LOC286208, corresponding to a target binding site such as BINDING SITE I, BINDING SITE II or BINDING SITE III of FIG. 8. Table 4 illustrates the complementarity of the nucleotide sequences of LOC286208 BINDING SITE, designated SEQ ID:12697, to the nucleotide sequence of GAM47 RNA, herein designated GAM RNA, also designated SEQ ID:269.

Another function of GAM47 is therefore inhibition of LOC286208 (Accession XP_212230.1). Accordingly, utilities of GAM47 include diagnosis, prevention and treatment of diseases and clinical conditions associated with LOC286208.

LOC286217 (Accession XP_212232.1) is another GAM47 target gene, herein designated TARGET GENE. LOC286217 BINDING SITE is a target binding site found in the 3' untranslated region of mRNA encoded by LOC286217, corresponding to a target binding site such as BINDING SITE I, BINDING SITE II or BINDING SITE III of FIG. 8. Table 4 illustrates the complementarity of the nucleotide sequences of LOC286217 BINDING SITE, designated SEQ ID:4829, to the nucleotide sequence of GAM47 RNA, herein designated GAM RNA, also designated SEQ ID:269.

Another function of GAM47 is therefore inhibition of LOC286217 (Accession XP_212232.1). Accordingly, utilities of GAM47 include diagnosis, prevention and treatment of diseases and clinical conditions associated with LOC286217.

LOC286332 (Accession XP_212273.1) is another GAM47 target gene, herein designated TARGET GENE. LOC286332 BINDING SITE is a target binding site found in the 3' untranslated region of mRNA encoded by LOC286332, corresponding to a target binding site such as BINDING SITE I, BINDING SITE II or BINDING SITE III of FIG. 8. Table 4 illustrates the complementarity of the nucleotide sequences of LOC286332 BINDING SITE, designated SEQ ID:14402, to the nucleotide sequence of GAM47 RNA, herein designated GAM RNA, also designated SEQ ID:269.

Another function of GAM47 is therefore inhibition of LOC286332 (Accession XP_212273.1). Accordingly, utilities of GAM47 include diagnosis, prevention and treatment of diseases and clinical conditions associated with LOC286332.

LOC286333 (Accession XP_212271.1) is another GAM47 target gene, herein designated TARGET GENE. LOC286333 BINDING SITE is a target binding site found in the 3' untranslated region of mRNA encoded by LOC286333, corresponding to a target binding site such as BINDING SITE I, BINDING SITE II or BINDING SITE III of FIG. 8. Table 4 illustrates the complementarity of the nucleotide sequences of LOC286333 BINDING SITE, designated SEQ ID:14402, to the nucleotide sequence of GAM47 RNA, herein designated GAM RNA, also designated SEQ ID:269.

Another function of GAM47 is therefore inhibition of LOC286333 (Accession XP_212271.1). Accordingly, utilities of GAM47 include diagnosis, prevention and treatment of diseases and clinical conditions associated with LOC286333.

LOC286399 (Accession NP_789789.1) is another GAM47 target gene, herein designated TARGET GENE. LOC286399 BINDING SITE is a target binding site found in the 3' untranslated region of mRNA encoded by LOC286399, corresponding to a target binding site such as BINDING SITE I, BINDING SITE II or BINDING SITE III of FIG. 8. Table 4 illustrates the complementarity of the nucleotide sequences of LOC286399 BINDING SITE, designated SEQ ID:13526, to the nucleotide sequence of GAM47 RNA, herein designated GAM RNA, also designated SEQ ID:269.

Another function of GAM47 is therefore inhibition of LOC286399 (Accession NP_789789.1). Accordingly, utilities of GAM47 include diagnosis, prevention and treatment of diseases and clinical conditions associated with LOC286399.

LOC286434 (Accession XP_301085.1) is another GAM47 target gene, herein designated TARGET GENE. LOC286434 BINDING SITE is a target binding site found in the 5' untranslated region of mRNA encoded by LOC286434, corresponding to a target binding site such as BINDING SITE I, BINDING SITE II or BINDING SITE III of FIG. 8. Table 4 illustrates the complementarity of the nucleotide sequences of LOC286434 BINDING SITE, designated SEQ ID:15266, to the nucleotide sequence of GAM47 RNA, herein designated GAM RNA, also designated SEQ ID:269.

Another function of GAM47 is therefore inhibition of LOC286434 (Accession XP_301085.1). Accordingly, utilities of GAM47 include diagnosis, prevention and treatment of diseases and clinical conditions associated with LOC286434.

LOC338817 (Accession XP_290588.1) is another GAM47 target gene, herein designated TARGET GENE. LOC338817 BINDING SITE is a target binding site found in the 5' untranslated region of mRNA encoded by LOC338817, corresponding to a target binding site such as BINDING SITE I, BINDING SITE II or BINDING SITE III of FIG. 8. Table 4 illustrates the complementarity of the nucleotide sequences of LOC338817 BINDING SITE, designated SEQ ID:1464, to the nucleotide sequence of GAM47 RNA, herein designated GAM RNA, also designated SEQ ID:269.

Another function of GAM47 is therefore inhibition of LOC338817 (Accession XP_290588.1). Accordingly, utilities of GAM47 include diagnosis, prevention and treatment of diseases and clinical conditions associated with LOC338817.

LOC339056 (Accession XP_290675.1) is another GAM47 target gene, herein designated TARGET GENE. LOC339056 BINDING SITE is a target binding site found in the 5' untranslated region of mRNA encoded by LOC339056, corresponding to a target binding site such as BINDING SITE I, BINDING SITE II or BINDING SITE III of FIG. 8. Table 4 illustrates the complementarity of the nucleotide sequences of LOC339056 BINDING SITE, designated SEQ ID:3242, to the nucleotide sequence of GAM47 RNA, herein designated GAM RNA, also designated SEQ ID:269.

Another function of GAM47 is therefore inhibition of LOC339056 (Accession XP_290675.1). Accordingly, utilities of GAM47 include diagnosis, prevention and treatment of diseases and clinical conditions associated with LOC339056.

LOC339166 (Accession XP_294837.1) is another GAM47 target gene, herein designated TARGET GENE. LOC339166 BINDING SITE is a target binding site found in the 5' untranslated region of mRNA encoded by LOC339166, corresponding to a target binding site such as BINDING SITE I, BINDING SITE II or BINDING SITE III of FIG. 8. Table 4 illustrates the complementarity of the nucleotide sequences of LOC339166 BINDING SITE, designated SEQ ID:1464, to the nucleotide sequence of GAM47 RNA, herein designated GAM RNA, also designated SEQ ID:269.

Another function of GAM47 is therefore inhibition of LOC339166 (Accession XP_294837.1). Accordingly, utilities of GAM47 include diagnosis, prevention and treatment of diseases and clinical conditions associated with LOC339166.

LOC339184 (Accession XP_290743.1) is another GAM47 target gene, herein designated TARGET GENE. LOC339184 BINDING SITE is a target binding site found in the 3' untranslated region of mRNA encoded by LOC339184, corresponding to a target binding site such as BINDING SITE I, BINDING SITE II or BINDING SITE III of FIG. 8. Table 4 illustrates the complementarity of the nucleotide sequences of LOC339184 BINDING SITE, designated SEQ ID:784, to the nucleotide sequence of GAM47 RNA, herein designated GAM RNA, also designated SEQ ID:269.

Another function of GAM47 is therefore inhibition of LOC339184 (Accession XP_290743.1). Accordingly, utilities of GAM47 include diagnosis, prevention and treatment of diseases and clinical conditions associated with LOC339184.

LOC339212 (Accession XP_290271.2) is another GAM47 target gene, herein designated TARGET GENE. LOC339212 BINDING SITE is a target binding site found in the 3' untranslated region of mRNA encoded by LOC339212, corresponding to a target binding site such as BINDING SITE I, BINDING SITE II or BINDING SITE III of FIG. 8. Table 4 illustrates the complementarity of the nucleotide sequences of LOC339212 BINDING SITE, designated SEQ ID:15710, to the nucleotide sequence of GAM47 RNA, herein designated GAM RNA, also designated SEQ ID:269.

Another function of GAM47 is therefore inhibition of LOC339212 (Accession XP_290271.2). Accordingly, utilities of GAM47 include diagnosis, prevention and treatment of diseases and clinical conditions associated with LOC339212.

LOC339290 (Accession XP_294901.1) is another GAM47 target gene, herein designated TARGET GENE. LOC339290 BINDING SITE is a target binding site found in the 5' untranslated region of mRNA encoded by LOC339290, corresponding to a target binding site such as BINDING SITE I, BINDING SITE II or BINDING SITE III of FIG. 8. Table 4 illustrates the complementarity of the nucleotide sequences of LOC339290 BINDING SITE, designated SEQ ID:9358, to the nucleotide sequence of GAM47 RNA, herein designated GAM RNA, also designated SEQ ID:269.

Another function of GAM47 is therefore inhibition of LOC339290 (Accession XP_294901.1). Accordingly, utilities of GAM47 include diagnosis, prevention and treatment of diseases and clinical conditions associated with LOC339290.

LOC339298 (Accession XP_294903.1) is another GAM47 target gene, herein designated TARGET GENE. LOC339298 BINDING SITE is a target binding site found in the 3' untranslated region of mRNA encoded by LOC339298, corresponding to a target binding site such as BINDING SITE I, BINDING SITE II or BINDING SITE III of FIG. 8. Table 4 illustrates the complementarity of the nucleotide sequences of LOC339298 BINDING SITE, designated SEQ ID:14984, to the nucleotide sequence of GAM47 RNA, herein designated GAM RNA, also designated SEQ ID:269.

Another function of GAM47 is therefore inhibition of LOC339298 (Accession XP_294903.1). Accordingly, utilities of GAM47 include diagnosis, prevention and treatment of diseases and clinical conditions associated with LOC339298.

LOC339389 (Accession XP_290857.1) is another GAM47 target gene, herein designated TARGET GENE. LOC339389 BINDING SITE is a target binding site found in the 5' untranslated region of mRNA encoded by LOC339389, corresponding to a target binding site such as BINDING SITE I, BINDING SITE II or BINDING SITE III of FIG. 8. Table 4 illustrates the complementarity of the nucleotide sequences of LOC339389 BINDING SITE, designated SEQ ID:5262, to the nucleotide sequence of GAM47 RNA, herein designated GAM RNA, also designated SEQ ID:269.

Another function of GAM47 is therefore inhibition of LOC339389 (Accession XP_290857.1). Accordingly, utilities of GAM47 include diagnosis, prevention and treatment of diseases and clinical conditions associated with LOC339389.

LOC339417 (Accession XP_294944.1) is another GAM47 target gene, herein designated TARGET GENE. LOC339417 BINDING SITE is a target binding site found in the 5' untranslated region of mRNA encoded by LOC339417, corresponding to a target binding site such as BINDING SITE I, BINDING SITE II or BINDING SITE III of FIG. 8. Table 4 illustrates the complementarity of the nucleotide sequences of LOC339417 BINDING SITE, designated SEQ ID:11819, to the nucleotide sequence of GAM47 RNA, herein designated GAM RNA, also designated SEQ ID:269.

Another function of GAM47 is therefore inhibition of LOC339417 (Accession XP_294944.1). Accordingly, utilities of GAM47 include diagnosis, prevention and treatment of diseases and clinical conditions associated with LOC339417.

LOC339435 (Accession XP_294950.1) is another GAM47 target gene, herein designated TARGET GENE. LOC339435 BINDING SITE is a target binding site found in the 5' untranslated region of mRNA encoded by LOC339435, corresponding to a target binding site such as BINDING SITE I, BINDING SITE II or BINDING SITE III of FIG. 8. Table 4 illustrates the complementarity of the nucleotide sequences of LOC339435 BINDING SITE, designated SEQ ID:6001, to the nucleotide sequence of GAM47 RNA, herein designated GAM RNA, also designated SEQ ID:269.

Another function of GAM47 is therefore inhibition of LOC339435 (Accession XP_294950.1). Accordingly, utilities of GAM47 include diagnosis, prevention and treatment of diseases and clinical conditions associated with LOC339435.

LOC339440 (Accession XP_294951.1) is another GAM47 target gene, herein designated TARGET GENE. LOC339440 BINDING SITE is a target binding site found in the 5' untranslated region of mRNA encoded by LOC339440, corresponding to a target binding site such as BINDING SITE I, BINDING SITE II or BINDING SITE III of FIG. 8. Table 4 illustrates the complementarity of the nucleotide sequences of LOC339440 BINDING SITE, designated SEQ ID:18568, to the nucleotide sequence of GAM47 RNA, herein designated GAM RNA, also designated SEQ ID:269.

Another function of GAM47 is therefore inhibition of LOC339440 (Accession XP_294951.1). Accordingly, utilities of GAM47 include diagnosis, prevention and treatment of diseases and clinical conditions associated with LOC339440.

LOC339738 (Accession XP_295048.1) is another GAM47 target gene, herein designated TARGET GENE. LOC339738 BINDING SITE is a target binding site found in the 3' untranslated region of mRNA encoded by LOC339738, corresponding to a target binding site such as BINDING SITE I, BINDING SITE II or BINDING SITE III of FIG. 8. Table 4 illustrates the complementarity of the nucleotide sequences of LOC339738 BINDING SITE, designated SEQ ID:11933, to the nucleotide sequence of GAM47 RNA, herein designated GAM RNA, also designated SEQ ID:269.

Another function of GAM47 is therefore inhibition of LOC339738 (Accession XP_295048.1). Accordingly, utilities of GAM47 include diagnosis, prevention and treatment of diseases and clinical conditions associated with LOC339738.

LOC339740 (Accession XP_290339.1) is another GAM47 target gene, herein designated TARGET GENE. LOC339740 BINDING SITE is a target binding site found in the 3' untranslated region of mRNA encoded by LOC339740, corresponding to a target binding site such as BINDING SITE I, BINDING SITE II or BINDING SITE III of FIG. 8. Table 4 illustrates the complementarity of the nucleotide sequences of LOC339740 BINDING SITE, designated SEQ ID:7421, to the nucleotide sequence of GAM47 RNA, herein designated GAM RNA, also designated SEQ ID:269.

Another function of GAM47 is therefore inhibition of LOC339740 (Accession XP_290339.1). Accordingly, utilities of GAM47 include diagnosis, prevention and treatment of diseases and clinical conditions associated with LOC339740.

LOC339975 (Accession XP_295115.1) is another GAM47 target gene, herein designated TARGET GENE. LOC339975 BINDING SITE is a target binding site found in the 5' untranslated region of mRNA encoded by LOC339975, corresponding to a target binding site such as BINDING SITE I, BINDING SITE II or BINDING SITE III of FIG. 8. Table 4 illustrates the complementarity of the nucleotide sequences of LOC339975 BINDING SITE, designated SEQ ID:11593, to the nucleotide sequence of GAM47 RNA, herein designated GAM RNA, also designated SEQ ID:269.

Another function of GAM47 is therefore inhibition of LOC339975 (Accession XP_295115.1). Accordingly, utilities of GAM47 include diagnosis, prevention and treatment of diseases and clinical conditions associated with LOC339975.

LOC339975 (Accession XP_295115.1) is another GAM47 target gene, herein designated TARGET GENE. LOC339975 BINDING SITE is a target binding site found in the 5' untranslated region of mRNA encoded by LOC339975, corresponding to a target binding site such as BINDING SITE I, BINDING SITE II or BINDING SITE III of FIG. 8. Table 4 illustrates the complementarity of the nucleotide sequences of LOC339975 BINDING SITE, designated SEQ ID:11593, to the nucleotide sequence of GAM47 RNA, herein designated GAM RNA, also designated SEQ ID:269.

Another function of GAM47 is therefore inhibition of LOC339975 (Accession XP_295115.1). Accordingly, utilities of GAM47 include diagnosis, prevention and treatment of diseases and clinical conditions associated with LOC339975.

LOC340012 (Accession XP_291113.2) is another GAM47 target gene, herein designated TARGET GENE. LOC340012 BINDING SITE is a target binding site found in the 3' untranslated region of mRNA encoded by LOC340012, corresponding to a target binding site such as BINDING SITE I, BINDING SITE II or BINDING SITE III of FIG. 8. Table 4 illustrates the complementarity of the nucleotide sequences of LOC340012 BINDING SITE, designated SEQ ID:18520, to the nucleotide sequence of GAM47 RNA, herein designated GAM RNA, also designated SEQ ID:269.

Another function of GAM47 is therefore inhibition of LOC340012 (Accession XP_291113.2). Accordingly, utilities of GAM47 include diagnosis, prevention and treatment of diseases and clinical conditions associated with LOC340012.

LOC340024 (Accession XP_291120.2) is another GAM47 target gene, herein designated TARGET GENE. LOC340024 BINDING SITE1 and LOC340024 BINDING SITE2 are target binding sites found in untranslated regions of mRNA encoded by LOC340024, corresponding to target binding sites such as BINDING SITE I, BINDING SITE II or BINDING SITE III of FIG. 8. Table 4 illustrates the complementarity of the nucleotide sequences of LOC340024 BINDING SITE1 and LOC340024 BINDING SITE2, designated SEQ ID:15024 and SEQ ID:13577 respectively, to the nucleotide sequence of GAM47 RNA, herein designated GAM RNA, also designated SEQ ID:269.

Another function of GAM47 is therefore inhibition of LOC340024 (Accession XP_291120.2). Accordingly, utilities of GAM47 include diagnosis, prevention and treatment of diseases and clinical conditions associated with LOC340024.

LOC340073 (Accession XP_295149.1) is another GAM47 target gene, herein designated TARGET GENE. LOC340073 BINDING SITE is a target binding site found in the 3' untranslated region of mRNA encoded by LOC340073, corresponding to a target binding site such as BINDING SITE I, BINDING SITE II or BINDING SITE III of FIG. 8. Table 4 illustrates the complementarity of the nucleotide sequences of LOC340073 BINDING SITE, designated SEQ ID:4588, to the nucleotide sequence of GAM47 RNA, herein designated GAM RNA, also designated SEQ ID:269.

Another function of GAM47 is therefore inhibition of LOC340073 (Accession XP_295149.1). Accordingly, utilities of GAM47 include diagnosis, prevention and treatment of diseases and clinical conditions associated with LOC340073.

LOC340150 (Accession XP_295167.1) is another GAM47 target gene, herein designated TARGET GENE. LOC340150 BINDING SITE is a target binding site found in the 3' untranslated region of mRNA encoded by LOC340150, corresponding to a target binding site such as BINDING SITE I, BINDING SITE II or BINDING SITE III of FIG. 8. Table 4 illustrates the complementarity of the nucleotide sequences of LOC340150 BINDING SITE, designated SEQ ID:3367, to the nucleotide sequence of GAM47 RNA, herein designated GAM RNA, also designated SEQ ID:269.

Another function of GAM47 is therefore inhibition of LOC340150 (Accession XP_295167.1). Accordingly, utilities of GAM47 include diagnosis, prevention and treatment of diseases and clinical conditions associated with LOC340150.

LOC340290 (Accession XP_291214.1) is another GAM47 target gene, herein designated TARGET GENE. LOC340290 BINDING SITE1 and LOC340290 BINDING SITE2 are target binding sites found in untranslated regions of mRNA encoded by LOC340290, corresponding to target binding sites such as BINDING SITE I, BINDING SITE II or BINDING SITE III of FIG. 8. Table 4 illustrates the complementarity of the nucleotide sequences of LOC340290 BINDING SITE1 and LOC340290 BINDING SITE2, designated SEQ ID:1256 and SEQ ID:11873 respectively, to the nucleotide sequence of GAM47 RNA, herein designated GAM RNA, also designated SEQ ID:269.

Another function of GAM47 is therefore inhibition of LOC340290 (Accession XP_291214.1). Accordingly, utilities of GAM47 include diagnosis, prevention and treatment of diseases and clinical conditions associated with LOC340290.

LOC340318 (Accession XP_290401.1) is another GAM47 target gene, herein designated TARGET GENE. LOC340318 BINDING SITE is a target binding site found in the 3' untranslated region of mRNA encoded by LOC340318, corresponding to a target binding site such as BINDING SITE I, BINDING SITE II or BINDING SITE III of FIG. 8. Table 4 illustrates the complementarity of the nucleotide sequences of LOC340318 BINDING SITE, designated SEQ ID:2631, to the nucleotide sequence of GAM47 RNA, herein designated GAM RNA, also designated SEQ ID:269.

Another function of GAM47 is therefore inhibition of LOC340318 (Accession XP_290401.1). Accordingly, utilities of GAM47 include diagnosis, prevention and treatment of diseases and clinical conditions associated with LOC340318.

LOC340346 (Accession XP_295213.2) is another GAM47 target gene, herein designated TARGET GENE. LOC340346 BINDING SITE is a target binding site found in the 5' untranslated region of mRNA encoded by LOC340346, corresponding to a target binding site such as BINDING SITE I, BINDING SITE II or BINDING SITE III of FIG. 8. Table 4 illustrates the complementarity of the nucleotide sequences of LOC340346 BINDING SITE, designated SEQ ID:18568, to the nucleotide sequence of GAM47 RNA, herein designated GAM RNA, also designated SEQ ID:269.

Another function of GAM47 is therefore inhibition of LOC340346 (Accession XP_295213.2). Accordingly, utilities of GAM47 include diagnosis, prevention and treatment of diseases and clinical conditions associated with LOC340346.

LOC340371 (Accession NP_848659.1) is another GAM47 target gene, herein designated TARGET GENE. LOC340371 BINDING SITE is a target binding site found in the 3' untranslated region of multiple transcripts of mRNA encoded by LOC340371, corresponding to a target binding site such as BINDING SITE I, BINDING SITE II or BINDING SITE III of FIG. 8. Table 4 illustrates the complementarity of the nucleotide sequences of LOC340371 BINDING SITE, designated SEQ ID:2445, to the nucleotide sequence of GAM47 RNA, herein designated GAM RNA, also designated SEQ ID:269.

Another function of GAM47 is therefore inhibition of LOC340371 (Accession NP_848659.1). Accordingly, utilities of GAM47 include diagnosis, prevention and treatment of diseases and clinical conditions associated with LOC340371.

LOC340371 (Accession XP_291255.2) is another GAM47 target gene, herein designated TARGET GENE. LOC340371 BINDING SITE is a target binding site found in the 3' untranslated region of multiple transcripts of mRNA encoded by LOC340371, corresponding to a target binding site such as BINDING SITE I, BINDING SITE II or BINDING SITE III of FIG. 8. Table 4 illustrates the complementarity of the nucleotide sequences of LOC340371 BINDING SITE, designated SEQ ID:2445, to the nucleotide sequence of GAM47 RNA, herein designated GAM RNA, also designated SEQ ID:269.

Another function of GAM47 is therefore inhibition of LOC340371 (Accession XP_291255.2). Accordingly, utilities of GAM47 include diagnosis, prevention and treatment of diseases and clinical conditions associated with LOC340371.

LOC342663 (Accession XP_297028.1) is another GAM47 target gene, herein designated TARGET GENE. LOC342663 BINDING SITE is a target binding site found in the 5' untranslated region of mRNA encoded by LOC342663, corresponding to a target binding site such as BINDING SITE I, BINDING SITE II or BINDING SITE III of FIG. 8. Table 4 illustrates the complementarity of the nucleotide sequences of LOC342663 BINDING SITE, designated SEQ ID:1726, to the nucleotide sequence of GAM47 RNA, herein designated GAM RNA, also designated SEQ ID:269.

Another function of GAM47 is therefore inhibition of LOC342663 (Accession XP_297028.1). Accordingly, utilities of GAM47 include diagnosis, prevention and treatment of diseases and clinical conditions associated with LOC342663.

LOC343895 (Accession XP_297948.1) is another GAM47 target gene, herein designated TARGET GENE. LOC343895 BINDING SITE is a target binding site found in the 5' untranslated region of mRNA encoded by LOC343895, corresponding to a target binding site such as BINDING SITE I, BINDING SITE II or BINDING SITE III of FIG. 8. Table 4 illustrates the complementarity of the nucleotide sequences of LOC343895 BINDING SITE, designated SEQ ID:19955, to the nucleotide sequence of GAM47 RNA, herein designated GAM RNA, also designated SEQ ID:269.

Another function of GAM47 is therefore inhibition of LOC343895 (Accession XP_297948.1). Accordingly, utilities of GAM47 include diagnosis, prevention and treatment of diseases and clinical conditions associated with LOC343895.

LOC344256 (Accession XP_297483.2) is another GAM47 target gene, herein designated TARGET GENE. LOC344256 BINDING SITE is a target binding site found in the 5' untranslated region of mRNA encoded by LOC344256, corresponding to a target binding site such as BINDING SITE I, BINDING SITE II or BINDING SITE III of FIG. 8. Table 4 illustrates the complementarity of the nucleotide sequences of LOC344256 BINDING SITE, designated SEQ ID:12043, to the nucleotide sequence of GAM47 RNA, herein designated GAM RNA, also designated SEQ ID:269.

Another function of GAM47 is therefore inhibition of LOC344256 (Accession XP_297483.2). Accordingly, utilities of GAM47 include diagnosis, prevention and treatment of diseases and clinical conditions associated with LOC344256.

LOC345190 (Accession XP_298603.1) is another GAM47 target gene, herein designated TARGET GENE. LOC345190 BINDING SITE1 and LOC345190 BINDING SITE2 are target binding sites found in untranslated regions of mRNA encoded by LOC345190, corresponding to target binding sites such as BINDING SITE I, BINDING SITE II or BINDING SITE III of FIG. 8. Table 4 illustrates the complementarity of the nucleotide sequences of LOC345190 BINDING SITE1 and LOC345190 BINDING SITE2, designated SEQ ID:15447 and SEQ ID:17998 respectively, to the nucleotide sequence of GAM47 RNA, herein designated GAM RNA, also designated SEQ ID:269.

Another function of GAM47 is therefore inhibition of LOC345190 (Accession XP_298603.1). Accordingly, utilities of GAM47 include diagnosis, prevention and treatment of diseases and clinical conditions associated with LOC345190.

LOC347644 (Accession XP_300206.1) is another GAM47 target gene, herein designated TARGET GENE. LOC347644 BINDING SITE is a target binding site found in the 5' untranslated region of mRNA encoded by LOC347644, corresponding to a target binding site such as BINDING SITE I, BINDING SITE II or BINDING SITE III of FIG. 8. Table 4 illustrates the complementarity of the nucleotide sequences of LOC347644 BINDING SITE, designated SEQ ID:6358, to the nucleotide sequence of GAM47 RNA, herein designated GAM RNA, also designated SEQ ID:269.

Another function of GAM47 is therefore inhibition of LOC347644 (Accession XP_300206.1). Accordingly, utilities of GAM47 include diagnosis, prevention and treatment of diseases and clinical conditions associated with LOC347644.

LOC347924 (Accession XP_300570.1) is another GAM47 target gene, herein designated TARGET GENE. LOC347924 BINDING SITE is a target binding site found in the 3' untranslated region of mRNA encoded by LOC347924, corresponding to a target binding site such as BINDING SITE I, BINDING SITE II or BINDING SITE III of FIG. 8. Table 4 illustrates the complementarity of the nucleotide sequences of LOC347924 BINDING SITE, designated SEQ ID:19514, to the nucleotide sequence of GAM47 RNA, herein designated GAM RNA, also designated SEQ ID:269.

Another function of GAM47 is therefore inhibition of LOC347924 (Accession XP_300570.1). Accordingly, utilities of GAM47 include diagnosis, prevention and treatment of diseases and clinical conditions associated with LOC347924.

LOC348035 (Accession XP_300595.1) is another GAM47 target gene, herein designated TARGET GENE. LOC348035 BINDING SITE is a target binding site found in the 3' untranslated region of mRNA encoded by LOC348035, corresponding to a target binding site such as BINDING SITE I, BINDING SITE II or BINDING SITE III of FIG. 8. Table 4 illustrates the complementarity of the nucleotide sequences of LOC348035 BINDING SITE, designated SEQ ID:13822, to the nucleotide sequence of GAM47 RNA, herein designated GAM RNA, also designated SEQ ID:269.

Another function of GAM47 is therefore inhibition of LOC348035 (Accession XP_300595.1). Accordingly, utilities of GAM47 include diagnosis, prevention and treatment of diseases and clinical conditions associated with LOC348035.

LOC348075 (Accession XP_302653.1) is another GAM47 target gene, herein designated TARGET GENE. LOC348075 BINDING SITE is a target binding site found in the 3' untranslated region of mRNA encoded by LOC348075, corresponding to a target binding site such as BINDING SITE I, BINDING SITE II or BINDING SITE III of FIG. 8. Table 4 illustrates the complementarity of the nucleotide sequences of LOC348075 BINDING SITE, designated SEQ ID:16095, to the nucleotide sequence of GAM47 RNA, herein designated GAM RNA, also designated SEQ ID:269.

Another function of GAM47 is therefore inhibition of LOC348075 (Accession XP_302653.1). Accordingly, utilities of GAM47 include diagnosis, prevention and treatment of diseases and clinical conditions associated with LOC348075.

LOC348258 (Accession XP_300686.1) is another GAM47 target gene, herein designated TARGET GENE. LOC348258 BINDING SITE1 and LOC348258 BINDING SITE2 are target binding sites found in untranslated regions of mRNA encoded by LOC348258, corresponding to target binding sites such as BINDING SITE I, BINDING SITE II or BINDING SITE III of FIG. 8. Table 4 illustrates the complementarity of the nucleotide sequences of LOC348258 BINDING SITE1 and LOC348258 BINDING SITE2, designated SEQ ID:4358 and SEQ ID:670 respectively, to the nucleotide sequence of GAM47 RNA, herein designated GAM RNA, also designated SEQ ID:269.

Another function of GAM47 is therefore inhibition of LOC348258 (Accession XP_300686.1). Accordingly, utilities of GAM47 include diagnosis, prevention and treatment of diseases and clinical conditions associated with LOC348258.

LOC348261 (Accession XP_302704.1) is another GAM47 target gene, herein designated TARGET GENE. LOC348261 BINDING SITE is a target binding site found in the 3' untranslated region of mRNA encoded by LOC348261, corresponding to a target binding site such as BINDING SITE I, BINDING SITE II or BINDING SITE III of FIG. 8. Table 4 illustrates the complementarity of the nucleotide sequences of LOC348261 BINDING SITE, designated SEQ ID:3316, to the nucleotide sequence of GAM47 RNA, herein designated GAM RNA, also designated SEQ ID:269.

Another function of GAM47 is therefore inhibition of LOC348261 (Accession XP_302704.1). Accordingly, utilities of GAM47 include diagnosis, prevention and treatment of diseases and clinical conditions associated with LOC348261.

LOC348373 (Accession XP_302735.1) is another GAM47 target gene, herein designated TARGET GENE. LOC348373 BINDING SITE is a target binding site found in the 5' untranslated region of mRNA encoded by LOC348373, corresponding to a target binding site such as BINDING SITE I, BINDING SITE II or BINDING SITE III of FIG. 8. Table 4 illustrates the complementarity of the nucleotide sequences of LOC348373 BINDING SITE, designated SEQ ID:19986, to the nucleotide sequence of GAM47 RNA, herein designated GAM RNA, also designated SEQ ID:269.

Another function of GAM47 is therefore inhibition of LOC348373 (Accession XP_302735.1). Accordingly, utilities of GAM47 include diagnosis, prevention and treatment of diseases and clinical conditions associated with LOC348373.

LOC348422 (Accession XP_301160.1) is another GAM47 target gene, herein designated TARGET GENE. LOC348422 BINDING SITE is a target binding site found in the 5' untranslated region of mRNA encoded by LOC348422, corresponding to a target binding site such as BINDING SITE I, BINDING SITE II or BINDING SITE III of FIG. 8. Table 4 illustrates the complementarity of the nucleotide sequences of LOC348422 BINDING SITE, designated SEQ ID:15244, to the nucleotide sequence of GAM47 RNA, herein designated GAM RNA, also designated SEQ ID:269.

Another function of GAM47 is therefore inhibition of LOC348422 (Accession XP_301160.1). Accordingly, utilities of GAM47 include diagnosis, prevention and treatment of diseases and clinical conditions associated with LOC348422.

LOC348427 (Accession XP_302755.1) is another GAM47 target gene, herein designated TARGET GENE. LOC348427 BINDING SITE is a target binding site found in the 3' untranslated region of mRNA encoded by LOC348427, corresponding to a target binding site such as BINDING SITE I, BINDING SITE II or BINDING SITE III of FIG. 8. Table 4 illustrates the complementarity of the nucleotide sequences of LOC348427 BINDING SITE, designated SEQ ID:18772, to the nucleotide sequence of GAM47 RNA, herein designated GAM RNA, also designated SEQ ID:269.

Another function of GAM47 is therefore inhibition of LOC348427 (Accession XP_302755.1). Accordingly, utilities of GAM47 include diagnosis, prevention and treatment of diseases and clinical conditions associated with LOC348427.

LOC348450 (Accession XP_302758.1) is another GAM47 target gene, herein designated TARGET GENE. LOC348450 BINDING SITE is a target binding site found in the 5' untranslated region of mRNA encoded by LOC348450, corresponding to a target binding site such as BINDING SITE I, BINDING SITE II or BINDING SITE III of FIG. 8. Table 4 illustrates the complementarity of the nucleotide sequences of LOC348450 BINDING SITE, designated SEQ ID:18568, to the nucleotide sequence of GAM47 RNA, herein designated GAM RNA, also designated SEQ ID:269.

Another function of GAM47 is therefore inhibition of LOC348450 (Accession XP_302758.1). Accordingly, utilities of GAM47 include diagnosis, prevention and treatment of diseases and clinical conditions associated with LOC348450.

LOC348528 (Accession XP_302814.1) is another GAM47 target gene, herein designated TARGET GENE. LOC348528 BINDING SITE1 and LOC348528 BINDING SITE2 are target binding sites found in untranslated regions of mRNA encoded by LOC348528, corresponding to target binding sites such as BINDING SITE I, BINDING SITE II or BINDING SITE III of FIG. 8. Table 4 illustrates the complementarity of the nucleotide sequences of LOC348528 BINDING SITE1 and LOC348528 BINDING SITE2, designated SEQ ID:18124 and SEQ ID:3438 respectively, to the nucleotide sequence of GAM47 RNA, herein designated GAM RNA, also designated SEQ ID:269.

Another function of GAM47 is therefore inhibition of LOC348528 (Accession XP_302814.1). Accordingly, utilities of GAM47 include diagnosis, prevention and treatment of diseases and clinical conditions associated with LOC348528.

LOC348552 (Accession XP_209362.1) is another GAM47 target gene, herein designated TARGET GENE. LOC348552 BINDING SITE is a target binding site found in the 3' untranslated region of mRNA encoded by LOC348552, corresponding to a target binding site such as BINDING SITE I, BINDING SITE II or BINDING SITE III of FIG. 8. Table 4 illustrates the complementarity of the nucleotide sequences of LOC348552 BINDING SITE, designated SEQ ID:967, to the nucleotide sequence of GAM47 RNA, herein designated GAM RNA, also designated SEQ ID:269.

Another function of GAM47 is therefore inhibition of LOC348552 (Accession XP_209362.1). Accordingly, utilities of GAM47 include diagnosis, prevention and treatment of diseases and clinical conditions associated with LOC348552.

LOC348798 (Accession XP_300845.1) is another GAM47 target gene, herein designated TARGET GENE. LOC348798 BINDING SITE is a target binding site found in the 3' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:6335, to the nucleotide sequence of GAM47 RNA, herein designated GAM RNA, also designated SEQ ID:269.

Another function of GAM47 is therefore inhibition of LOC348798 (Accession XP_300845.1). Accordingly, utilities of GAM47 include diagnosis, prevention and treatment of diseases and clinical conditions associated with LOC348798.

LOC349062 (Accession XP_302948.1) is another GAM47 target gene, herein designated TARGET GENE. LOC349062 BINDING SITE is a target binding site found in the 5' untranslated region of mRNA encoded by LOC349062, corresponding to a target binding site such as BINDING SITE I, BINDING SITE II or BINDING SITE III of FIG. 8. Table 4 illustrates the complementarity of the nucleotide sequences of LOC349062 BINDING SITE, designated SEQ ID:15010, to the nucleotide sequence of GAM47 RNA, herein designated GAM RNA, also designated SEQ ID:269.

Another function of GAM47 is therefore inhibition of LOC349062 (Accession XP_302948.1). Accordingly, utilities of GAM47 include diagnosis, prevention and treatment of diseases and clinical conditions associated with LOC349062.

LOC349339 (Accession XP_301042.1) is another GAM47 target gene, herein designated TARGET GENE. LOC349339 BINDING SITE is a target binding site found in the 3' untranslated region of mRNA encoded by LOC349339, corresponding to a target binding site such as BINDING SITE I, BINDING SITE II or BINDING SITE III of FIG. 8. Table 4 illustrates the complementarity of the nucleotide sequences of LOC349339 BINDING SITE, designated SEQ ID:18092, to the nucleotide sequence of GAM47 RNA, herein designated GAM RNA, also designated SEQ ID:269.

Another function of GAM47 is therefore inhibition of LOC349339 (Accession XP_301042.1). Accordingly, utilities of GAM47 include diagnosis, prevention and treatment of diseases and clinical conditions associated with LOC349339.

LOC350629 (Accession XP_304260.1) is another GAM47 target gene, herein designated TARGET GENE. LOC350629 BINDING SITE is a target binding site found in the 3' untranslated region of mRNA encoded by LOC350629, corresponding to a target binding site such as BINDING SITE I, BINDING SITE II or BINDING SITE III of FIG. 8. Table 4 illustrates the complementarity of the nucleotide sequences of LOC350629 BINDING SITE, designated SEQ ID:15197, to the nucleotide sequence of GAM47 RNA, herein designated GAM RNA, also designated SEQ ID:269.

Another function of GAM47 is therefore inhibition of LOC350629 (Accession XP_304260.1). Accordingly, utilities of GAM47 include diagnosis, prevention and treatment of diseases and clinical conditions associated with LOC350629.

LOC352258 (Accession XP_305527.1) is another GAM47 target gene, herein designated TARGET GENE. LOC352258 BINDING SITE is a target binding site found in the 5' untranslated region of mRNA encoded by LOC352258, corresponding to a target binding site such as BINDING SITE I, BINDING SITE II or BINDING SITE III of FIG. 8. Table 4 illustrates the complementarity of the nucleotide sequences of LOC352258 BINDING SITE, designated SEQ ID:6201, to the nucleotide sequence of GAM47 RNA, herein designated GAM RNA, also designated SEQ ID:269.

Another function of GAM47 is therefore inhibition of LOC352258 (Accession XP_305527.1). Accordingly, utilities of GAM47 include diagnosis, prevention and treatment of diseases and clinical conditions associated with LOC352258.

LOC352287 (Accession XP_305558.1) is another GAM47 target gene, herein designated TARGET GENE. LOC352287 BINDING SITE1 and LOC352287 BINDING SITE2 are target binding sites found in untranslated regions of mRNA encoded by LOC352287, corresponding to target binding sites such as BINDING SITE I, BINDING SITE II or BINDING SITE III of FIG. 8. Table 4 illustrates the complementarity of the nucleotide sequences of LOC352287 BINDING SITE1 and LOC352287 BINDING SITE2, designated SEQ ID:16371 and SEQ ID:3237 respectively, to the nucleotide sequence of GAM47 RNA, herein designated GAM RNA, also designated SEQ ID:269.

Another function of GAM47 is therefore inhibition of LOC352287 (Accession XP_305558.1). Accordingly, utilities of GAM47 include diagnosis, prevention and treatment of diseases and clinical conditions associated with LOC352287.

LOC51337 (Accession NP_057731.1) is another GAM47 target gene, herein designated TARGET GENE. LOC51337

BINDING SITE is a target binding site found in the 3' untranslated region of mRNA encoded by LOC51337, corresponding to a target binding site such as BINDING SITE I, BINDING SITE II or BINDING SITE III of FIG. 8. Table 4 illustrates the complementarity of the nucleotide sequences of LOC51337 BINDING SITE, designated SEQ ID:16030, to the nucleotide sequence of GAM47 RNA, herein designated GAM RNA, also designated SEQ ID:269.

Another function of GAM47 is therefore inhibition of LOC51337 (Accession NP_057731.1). Accordingly, utilities of GAM47 include diagnosis, prevention and treatment of diseases and clinical conditions associated with LOC51337.

LOC56181 (Accession NP_062457.2) is another GAM47 target gene, herein designated TARGET GENE. LOC56181 BINDING SITE is a target binding site found in the 3' untranslated region of mRNA encoded by LOC56181, corresponding to a target binding site such as BINDING SITE I, BINDING SITE II or BINDING SITE III of FIG. 8. Table 4 illustrates the complementarity of the nucleotide sequences of LOC56181 BINDING SITE, designated SEQ ID:19514, to the nucleotide sequence of GAM47 RNA, herein designated GAM RNA, also designated SEQ ID:269.

Another function of GAM47 is therefore inhibition of LOC56181 (Accession NP_062457.2). Accordingly, utilities of GAM47 include diagnosis, prevention and treatment of diseases and clinical conditions associated with LOC56181.

LOC90133 (Accession XP_029323.1) is another GAM47 target gene, herein designated TARGET GENE. LOC90133 BINDING SITE is a target binding site found in the 5' untranslated region of mRNA encoded by LOC90133, corresponding to a target binding site such as BINDING SITE I, BINDING SITE II or BINDING SITE III of FIG. 8. Table 4 illustrates the complementarity of the nucleotide sequences of LOC90133 BINDING SITE, designated SEQ ID:17943, to the nucleotide sequence of GAM47 RNA, herein designated GAM RNA, also designated SEQ ID:269.

Another function of GAM47 is therefore inhibition of LOC90133 (Accession XP_029323.1). Accordingly, utilities of GAM47 include diagnosis, prevention and treatment of diseases and clinical conditions associated with LOC90133.

LOC90408 (Accession XP_031517.1) is another GAM47 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:3764, to the nucleotide sequence of GAM47 RNA, herein designated GAM RNA, also designated SEQ ID:269.

Another function of GAM47 is therefore inhibition of LOC90408 (Accession XP_031517.1). Accordingly, utilities of GAM47 include diagnosis, prevention and treatment of diseases and clinical conditions associated with LOC90408.

LOC90841 (Accession XP_034427.2) is another GAM47 target gene, herein designated TARGET GENE. LOC90841 BINDING SITE is a target binding site found in the 3' untranslated region of mRNA encoded by LOC90841, corresponding to a target binding site such as BINDING SITE I, BINDING SITE II or BINDING SITE III of FIG. 8. Table 4 illustrates the complementarity of the nucleotide sequences of LOC90841 BINDING SITE, designated SEQ ID:18600, to the nucleotide sequence of GAM47 RNA, herein designated GAM RNA, also designated SEQ ID:269.

Another function of GAM47 is therefore inhibition of LOC90841 (Accession XP_034427.2). Accordingly, utilities of GAM47 include diagnosis, prevention and treatment of diseases and clinical conditions associated with LOC90841.

LOC91056 (Accession NP_612377.1) is another GAM47 target gene, herein designated TARGET GENE. LOC91056 BINDING SITE is a target binding site found in the 3' untranslated region of multiple transcripts of mRNA encoded by LOC91056, corresponding to a target binding site such as BINDING SITE I, BINDING SITE II or BINDING SITE III of FIG. 8. Table 4 illustrates the complementarity of the nucleotide sequences of LOC91056 BINDING SITE, designated SEQ ID:3924, to the nucleotide sequence of GAM47 RNA, herein designated GAM RNA, also designated SEQ ID:269.

Another function of GAM47 is therefore inhibition of LOC91056 (Accession NP_612377.1). Accordingly, utilities of GAM47 include diagnosis, prevention and treatment of diseases and clinical conditions associated with LOC91056.

LOC91097 (Accession XP_035977.1) is another GAM47 target gene, herein designated TARGET GENE. LOC91097 BINDING SITE is a target binding site found in the 3' untranslated region of mRNA encoded by LOC91097, corresponding to a target binding site such as BINDING SITE I, BINDING SITE II or BINDING SITE III of FIG. 8. Table 4 illustrates the complementarity of the nucleotide sequences of LOC91097 BINDING SITE, designated SEQ ID:1470, to the nucleotide sequence of GAM47 RNA, herein designated GAM RNA, also designated SEQ ID:269.

Another function of GAM47 is therefore inhibition of LOC91097 (Accession XP_035977.1). Accordingly, utilities of GAM47 include diagnosis, prevention and treatment of diseases and clinical conditions associated with LOC91097.

LOC91208 (Accession XP_036935.1) is another GAM47 target gene, herein designated TARGET GENE. LOC91208 BINDING SITE is a target binding site found in the 5' untranslated region of mRNA encoded by LOC91208, corresponding to a target binding site such as BINDING SITE I, BINDING SITE II or BINDING SITE III of FIG. 8. Table 4 illustrates the complementarity of the nucleotide sequences of LOC91208 BINDING SITE, designated SEQ ID:6400, to the nucleotide sequence of GAM47 RNA, herein designated GAM RNA, also designated SEQ ID:269.

Another function of GAM47 is therefore inhibition of LOC91208 (Accession XP_036935.1). Accordingly, utilities of GAM47 include diagnosis, prevention and treatment of diseases and clinical conditions associated with LOC91208.

LOC91496 (Accession XP_038788.1) is another GAM47 target gene, herein designated TARGET GENE. LOC91496 BINDING SITE is a target binding site found in the 5' untranslated region of mRNA encoded by LOC91496, corresponding to a target binding site such as BINDING SITE I, BINDING SITE II or BINDING SITE III of FIG. 8. Table 4 illustrates the complementarity of the nucleotide sequences of LOC91496 BINDING SITE, designated SEQ ID:6539, to the nucleotide sequence of GAM47 RNA, herein designated GAM RNA, also designated SEQ ID:269.

Another function of GAM47 is therefore inhibition of LOC91496 (Accession XP_038788.1). Accordingly, utilities of GAM47 include diagnosis, prevention and treatment of diseases and clinical conditions associated with LOC91496.

LOC91632 (Accession XP_039721.2) is another GAM47 target gene, herein designated TARGET GENE. LOC91632 BINDING SITE is a target binding site found in the 5' untranslated region of mRNA encoded by LOC91632, corresponding to a target binding site such as BINDING SITE I, BINDING SITE II or BINDING SITE III of FIG. 8. Table 4 illustrates the complementarity of the nucleotide sequences of LOC91632 BINDING SITE, designated SEQ ID:6540, to the nucleotide sequence of GAM47 RNA, herein designated GAM RNA, also designated SEQ ID:269.

Another function of GAM47 is therefore inhibition of LOC91632 (Accession XP_039721.2). Accordingly, utilities of GAM47 include diagnosis, prevention and treatment of diseases and clinical conditions associated with LOC91632.

LOC92148 (Accession XP_043160.1) is another GAM47 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:18532, to the nucleotide sequence of GAM47 RNA, herein designated GAM RNA, also designated SEQ ID:269.

Another function of GAM47 is therefore inhibition of LOC92148 (Accession XP_043160.1). Accordingly, utilities of GAM47 include diagnosis, prevention and treatment of diseases and clinical conditions associated with LOC92148.

LOC92659 (Accession XP_046434.3) is another GAM47 target gene, herein designated TARGET GENE. LOC92659 BINDING SITE is a target binding site found in the 3' untranslated region of mRNA encoded by LOC92659, corresponding to a target binding site such as BINDING SITE I, BINDING SITE II or BINDING SITE III of FIG. 8. Table 4 illustrates the complementarity of the nucleotide sequences of LOC92659 BINDING SITE, designated SEQ ID:3316, to the nucleotide sequence of GAM47 RNA, herein designated GAM RNA, also designated SEQ ID:269.

Another function of GAM47 is therefore inhibition of LOC92659 (Accession XP_046434.3). Accordingly, utilities of GAM47 include diagnosis, prevention and treatment of diseases and clinical conditions associated with LOC92659.

LOC95803 (Accession XP_047816.5) is another GAM47 target gene, herein designated TARGET GENE. LOC95803 BINDING SITE is a target binding site found in the 3' untranslated region of mRNA encoded by LOC95803, corresponding to a target binding site such as BINDING SITE I, BINDING SITE II or BINDING SITE III of FIG. 8. Table 4 illustrates the complementarity of the nucleotide sequences of LOC95803 BINDING SITE, designated SEQ ID:16795, to the nucleotide sequence of GAM47 RNA, herein designated GAM RNA, also designated SEQ ID:269.

Another function of GAM47 is therefore inhibition of LOC95803 (Accession XP_047816.5). Accordingly, utilities of GAM47 include diagnosis, prevention and treatment of diseases and clinical conditions associated with LOC95803.

LRP11 (Accession NP_116221.2) is another GAM47 target gene, herein designated TARGET GENE. LRP11 BINDING SITE is a target binding site found in the 3' untranslated region of mRNA encoded by LRP11, corresponding to a target binding site such as BINDING SITE I, BINDING SITE II or BINDING SITE III of FIG. 8. Table 4 illustrates the complementarity of the nucleotide sequences of LRP11 BINDING SITE, designated SEQ ID:15632, to the nucleotide sequence of GAM47 RNA, herein designated GAM RNA, also designated SEQ ID:269.

Another function of GAM47 is therefore inhibition of LRP11 (Accession NP_116221.2). Accordingly, utilities of GAM47 include diagnosis, prevention and treatment of diseases and clinical conditions associated with LRP11.

Leucine zipper protein 1 (LUZP1, Accession NP_361013.1) is another GAM47 target gene, herein designated TARGET GENE. LUZP1 BINDING SITE is a target binding site found in the 3' untranslated region of mRNA encoded by LUZP1, corresponding to a target binding site such as BINDING SITE I, BINDING SITE II or BINDING SITE III of FIG. 8. Table 4 illustrates the complementarity of the nucleotide sequences of LUZP1 BINDING SITE, designated SEQ ID:13539, to the nucleotide sequence of GAM47 RNA, herein designated GAM RNA, also designated SEQ ID:269.

Another function of GAM47 is therefore inhibition of Leucine zipper protein 1 (LUZP1, Accession NP_361013.1). Accordingly, utilities of GAM47 include diagnosis, prevention and treatment of diseases and clinical conditions associated with LUZP1.

V-maf musculoaponeurotic fibrosarcoma oncogene homolog g (avian) (MAFG, Accession NP_002350.1) is another GAM47 target gene, herein designated TARGET GENE. MAFG BINDING SITE1 and MAFG BINDING SITE2 are target binding sites found in untranslated regions of mRNA encoded by MAFG, corresponding to target binding sites such as BINDING SITE I, BINDING SITE II or BINDING SITE III of FIG. 8. Table 4 illustrates the complementarity of the nucleotide sequences of MAFG BINDING SITE1 and MAFG BINDING SITE2, designated SEQ ID:4358 and SEQ ID:670 respectively, to the nucleotide sequence of GAM47 RNA, herein designated GAM RNA, also designated SEQ ID:269.

Another function of GAM47 is therefore inhibition of V-maf musculoaponeurotic fibrosarcoma oncogene homolog g (avian) (MAFG, Accession NP_002350.1), a gene which act as transcriptional repressors upon formation of homodimers however, they seem to serve as transcriptional activators by dimerizing with other (usually larger) basic-zipper proteins and recruiting them to specific dna-binding sites. Accordingly, utilities of GAM47 include diagnosis, prevention and treatment of diseases and clinical conditions associated with MAFG.

The function of MAFG has been established by previous studies. The analysis of globin gene transcription serves as a model for understanding tissue-specific and developmental regulation of gene expression. Globin gene expression is regulated through nuclear factor erythroid-2 (NFE2) elements located in enhancer-like locus control regions positioned many kb upstream of alpha- and beta-gene clusters. NFE2 DNA-binding activity consists of a heterodimer containing a ubiquitous small Maf protein (MafF, MafG, or MafK (OMIM Ref. No. 600197)) and the tissue-restricted protein p45 NFE2 (OMIM Ref. No. 601490). Both subunits are members of the activator protein-1-like superfamily of basic leucine zipper (bZIP) proteins (see OMIM Ref. No. 165160). Blank et al. (1997) isolated a cDNA encoding human MAFG, which is expressed in a wide array of tissues and cell lines. They showed that human MAFG protein, like its chicken counterpart, is able to dimerize with p45 NFE2. A p45/MAFG heterodimer was fully functional in supporting expression of alpha- and beta-globin genes and in promoting erythroid differentiation in a p45-deficient mouse erythroleukemia cell line. Blank et al. (1997) showed that human MAFG contains at least 3 exons, which are separated by small introns. The first exon is not translated Motohashi et al. (2000) found that mouse embryos expressing abundant transgene-derived Mafk died of severe anemia, while lines expressing lower levels of small Maf lived to adulthood. Megakaryocytes from the latter overexpressing lines exhibited reduced proplatelet formation and MARE (Maf recognition element)-dependent transcription, phenocopying Mafg null mice (see OMIM Ref. No. Shavit et al. (1998)). When the Mafg null mice were bred to small Maf-overexpressing transgenic animals, both loss- and gain-of-function phenotypes were reversed Full details of the abovementioned studies are described in the following publications, the disclosure of which are hereby incorporated by reference:

Motohashi, H.; Katsuoka, F.; Shavit, J. A.; Engel, J. D.; Yamamoto, M.: Positive or negative MARE-dependent transcriptional regulation is determined by the abundance of small Maf proteins. Cell 103:865-875, 2000; and Blank, V.; Kim, M. J.; Andrews, N. C.: Human MAFG is a functional partner for p45 NF-E2 in activating globin gene expression. Blood 89:3925-3935, 1997.

Further studies establishing the function and utilities of MAFG are found in John Hopkins OMIM database record ID 602020, and in cited publications listed in Table 5, which are hereby incorporated by reference. Methyl-cpg binding domain protein 4 (MBD4, Accession NP_003916.1) is another GAM47 target gene, herein designated TARGET GENE. MBD4 BINDING SITE is a target binding site found in the 3' untranslated region of mRNA encoded by MBD4, corresponding to a target binding site such as BINDING SITE I, BINDING SITE II or BINDING SITE III of FIG. 8. Table 4 illustrates the complementarity of the nucleotide sequences of MBD4 BINDING SITE, designated SEQ ID:6697, to the nucleotide sequence of GAM47 RNA, herein designated GAM RNA, also designated SEQ ID:269.

Another function of GAM47 is therefore inhibition of Methyl-cpg binding domain protein 4 (MBD4, Accession NP_003916.1), a gene which are likely to be mediators of the effects of DNA methylation in mammalian cells. Accordingly, utilities of GAM47 include diagnosis, prevention and treatment of diseases and clinical conditions associated with MBD4.

The function of MBD4 has been established by previous studies. DNA methylation is the major modification of eukaryotic genomes and plays an essential role in mammalian development. The MECP2 (OMIM Ref. No. 300005) and MBD1 (OMIM Ref. No. 156535) proteins bind specifically to methylated DNA via a methyl-CpG-binding domain (MBD). By searching an EST database for proteins containing an MBD-like motif, Hendrich and Bird (1998) identified human and mouse cDNAs encoding the 3 novel proteins MBD2 (OMIM Ref. No. 603547), MBD3 (OMIM Ref. No. 603573), and MBD4. The predicted 580-amino acid human MBD4 protein (GenBank AF072250) is 66% identical to mouse Mbd4. The authors found evidence of alternatively spliced human and mouse MBD4 transcripts; one form encodes a truncated human MBD4 protein lacking the C-terminal 42 amino acids. Both MBD2 and MBD4 specifically bound methylated DNA in vitro and colocalized with methylated sequences in vivo. Hendrich and Bird (1998) concluded that MBD2 and MBD4 are likely to be mediators of the effects of DNA methylation in mammalian cells. The DNA mismatch repair (MMR) is a specialized system, highly conserved throughout evolution, involved in the maintenance of genomic integrity. To identify novel human genes that may function in MMR, Bellacosa et al. (1999) used the yeast interaction trap. Using the MMR protein MLH1 (OMIM Ref. No. 120436) as bait, they cloned MED1. The MED1 protein forms a complex with MLH1, binds to methyl-CpG- containing DNA, has homology to bacterial DNA repair glycosylases/lyases, and displays endonuclease activity. Transfection of a MED1 mutant lacking the MBD was associated with microsatellite instability. These findings suggested that MED1 is a human DNA repair protein that may be involved in MMR and, as such, may be a candidate eukaryotic homolog of the bacterial MMR endonuclease, MutH. In addition, these results suggested that cytosine methylation may play a role in human DNA repair. After submission of their manuscript, Bellacosa et al. (1999) learned that the protein they designated MED1 is identical to MBD4 described by Hendrich and Bird (1998). Using PCR on a hybrid panel and FISH, Hendrich et al. (1999) mapped the MBD4 gene to chromosome 3q. They mapped the mouse gene to chromosome 6. Riccio et al. (1999) mapped the MBD4 gene to chromosome 3q21-q22 by FISH.

Animal model experiments lend further support to the function of MBD4. Millar et al. (2002) generated Mbd4 knockout mice by targeted disruption. Mbd4 -/- mice had a 3-fold increase in the frequency of C- to - T transitions at CpG sites. When bred onto the Apc(Min/+) background (see OMIM Ref. No. 175100), Mbd4 -/- mice showed accelerated tumor formation with CpG- to - TpG mutations in the Apc gene. Thus, Millar et al. (2002) concluded that MBD4 suppresses CpG mutability and tumorigenesis in vivo.

It is appreciated that the abovementioned animal model for MBD4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hendrich, B.; Bird, A.: Identification and characterization of a family of mammalian methyl-CpG binding proteins. Molec. Cell. Biol. 18:6538-6547, 1998; and Millar, C. B.; Guy, J.; Sansom, O. J.; Selfridge, J.; MacDougall, E.; Hendrich, B.; Keightley, P. D.; Bishop, S. M.; Clarke, A. R.; Bird, A.: Enhanced CpG mutability and tumorigenesis i.

Further studies establishing the function and utilities of MBD4 are found in John Hopkins OMIM database record ID 603574, and in cited publications listed in Table 5, which are hereby incorporated by reference. Mcf.2 cell line derived transforming sequence-like (MCF2L, Accession NP_079255.2) is another GAM47 target gene, herein designated TARGET GENE. MCF2L BINDING SITE is a target binding site found in the 3' untranslated region of mRNA encoded by MCF2L, corresponding to a target binding site such as BINDING SITE I, BINDING SITE II or BINDING SITE III of FIG. 8. Table 4 illustrates the complementarity of the nucleotide sequences of MCF2L BINDING SITE, designated SEQ ID:2630, to the nucleotide sequence of GAM47 RNA, herein designated GAM RNA, also designated SEQ ID:269.

Another function of GAM47 is therefore inhibition of Mcf.2 cell line derived transforming sequence-like (MCF2L, Accession NP_079255.2). Accordingly, utilities of GAM47 include diagnosis, prevention and treatment of diseases and clinical conditions associated with MCF2L.

MCOLN2 (Accession NP_694991.1) is another GAM47 target gene, herein designated TARGET GENE. MCOLN2

BINDING SITE is a target binding site found in the 3' untranslated region of mRNA encoded by MCOLN2, corresponding to a target binding site such as BINDING SITE I, BINDING SITE II or BINDING SITE III of FIG. 8. Table 4 illustrates the complementarity of the nucleotide sequences of MCOLN2 BINDING SITE, designated SEQ ID:4917, to the nucleotide sequence of GAM47 RNA, herein designated GAM RNA, also designated SEQ ID:269.

Another function of GAM47 is therefore inhibition of MCOLN2 (Accession NP_694991.1). Accordingly, utilities of GAM47 include diagnosis, prevention and treatment of diseases and clinical conditions associated with MCOLN2.

Mam domain containing glycosylphosphatidylinositol anchor 1 (MDGA1, Accession NP_705691.1) is another GAM47 target gene, herein designated TARGET GENE. MDGA1 BINDING SITE is a target binding site found in the 3' untranslated region of mRNA encoded by MDGA1, corresponding to a target binding site such as BINDING SITE I, BINDING SITE II or BINDING SITE III of FIG. 8. Table 4 illustrates the complementarity of the nucleotide sequences of MDGA1 BINDING SITE, designated SEQ ID:10254, to the nucleotide sequence of GAM47 RNA, herein designated GAM RNA, also designated SEQ ID:269.

Another function of GAM47 is therefore inhibition of Mam domain containing glycosylphosphatidylinositol anchor 1 (MDGA1, Accession NP_705691.1). Accordingly, utilities of GAM47 include diagnosis, prevention and treatment of diseases and clinical conditions associated with MDGA1.

Membrane frizzled-related protein (MFRP, Accession NP_113621.1) is another GAM47 target gene, herein designated TARGET GENE. MFRP BINDING SITE is a target binding site found in the 3' untranslated region of mRNA encoded by MFRP, corresponding to a target binding site such as BINDING SITE I, BINDING SITE II or BINDING SITE III of FIG. 8. Table 4 illustrates the complementarity of the nucleotide sequences of MFRP BINDING SITE, designated SEQ ID:9575, to the nucleotide sequence of GAM47 RNA, herein designated GAM RNA, also designated SEQ ID:269.

Another function of GAM47 is therefore inhibition of Membrane frizzled-related protein (MFRP, Accession NP_113621.1). Accordingly, utilities of GAM47 include diagnosis, prevention and treatment of diseases and clinical conditions associated with MFRP.

Max gene associated (MGA, Accession XP_031689.3) is another GAM47 target gene, herein designated TARGET GENE. MGA BINDING SITE is a target binding site found in the 3' untranslated region of mRNA encoded by MGA, corresponding to a target binding site such as BINDING SITE I, BINDING SITE II or BINDING SITE III of FIG. 8. Table 4 illustrates the complementarity of the nucleotide sequences of MGA BINDING SITE, designated SEQ ID:4593, to the nucleotide sequence of GAM47 RNA, herein designated GAM RNA, also designated SEQ ID:269.

Another function of GAM47 is therefore inhibition of Max gene associated (MGA, Accession XP_031689.3), a gene which plays a role in the final steps of digestion of starch. Accordingly, utilities of GAM47 include diagnosis, prevention and treatment of diseases and clinical conditions associated with MGA.

The function of MGA has been established by previous studies. Maltase-glucoamylase (MGA; EC 3.2.1.20) is a brush border membrane enzyme that plays a role in the final steps of digestion of starch. Naim et al. (1988) showed that it is synthesized as a single-chain polypeptide precursor, acquires N- and O-linked carbohydrates, and does not undergo intracellular or extracellular proteolytic cleavage. Nichols et al. (1998) purified and partially sequenced the human maltase-glucoamylase protein. By RT-PCR using degenerate oligonucleotides based on the MGA protein sequence, they isolated human small intestine MGA cDNAs. The deduced 1,857-amino acid MGA protein has a putative type II membrane anchor, 2 WIDMNE catalytic sites, which are characteristic of carbohydrate hydrolases such as sucrase-isomaltase (SI; 222900), and 2 glycosyl hydrolase family 31 signature 2 sequences. MGA also has 19 potential N-glycosylation sites and 253 potential O-glycosylation sites. The MGA protein shares 59% sequence identity with SI. RT-PCR detected MGA expression in human small intestine, granulocyte, and kidney but not in salivary gland or pancreas.

Full details of the abovementioned studies are described in the following publications, the disclosure of which are hereby incorporated by reference:

Naim, H. Y.; Sterchi, E. E.; Lentze, M. J.: Structure, biosynthesis, and glycosylation of human small intestinal maltase-glucoamylase. J. Biol. Chem. 263:19709-19717, 1988; and Nichols, B. L.; Eldering, J.; Avery, S.; Hahn, D.; Quaroni, A.; Sterchi, E.: Human small intestinal maltase-glucoamylase cDNA cloning: homology to sucrase-isomaltase. J. Biol. Chem. 273:3.

Further studies establishing the function and utilities of MGA are found in John Hopkins OMIM database record ID 154360, and in cited publications listed in Table 5, which are hereby incorporated by reference. MGC11102 (Accession NP_115701.2) is another GAM47 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:16794, to the nucleotide sequence of GAM47 RNA, herein designated GAM RNA, also designated SEQ ID:269.

Another function of GAM47 is therefore inhibition of MGC11102 (Accession NP_115701.2). Accordingly, utilities of GAM47 include diagnosis, prevention and treatment of diseases and clinical conditions associated with MGC11102.

MGC12760 (Accession NP_116112.1) is another GAM47 target gene, herein designated TARGET GENE. MGC12760 BINDING SITE is a target binding site found in the 3' untranslated region of mRNA encoded by MGC12760, corresponding to a target binding site such as BINDING SITE I, BINDING SITE II or BINDING SITE III of FIG. 8. Table 4 illustrates the complementarity of the nucleotide sequences of MGC12760 BINDING SITE, designated SEQ ID:16318, to the nucleotide sequence of GAM47 RNA, herein designated GAM RNA, also designated SEQ ID:269.

Another function of GAM47 is therefore inhibition of MGC12760 (Accession NP_116112.1). Accordingly, utilities of GAM47 include diagnosis, prevention and treatment of diseases and clinical conditions associated with MGC12760.

MGC14289 (Accession NP_542391.1) is another GAM47 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:20024, to the nucleotide sequence of GAM47 RNA, herein designated GAM RNA, also designated SEQ ID:269.

Another function of GAM47 is therefore inhibition of MGC14289 (Accession NP_542391.1). Accordingly, utilities of GAM47 include diagnosis, prevention and treatment of diseases and clinical conditions associated with MGC14289.

MGC14376 (Accession NP_116284.1) is another GAM47 target gene, herein designated TARGET GENE. MGC14376 BINDING SITE is a target binding site found in the 3' untranslated region of mRNA encoded by MGC14376, corresponding to a target binding site such as BINDING SITE I, BINDING SITE II or BINDING SITE III of FIG. 8. Table 4 illustrates the complementarity of the nucleotide sequences of MGC14376 BINDING SITE, designated SEQ ID:12840, to the nucleotide sequence of GAM47 RNA, herein designated GAM RNA, also designated SEQ ID:269.

Another function of GAM47 is therefore inhibition of MGC14376 (Accession NP_116284.1). Accordingly, utilities of GAM47 include diagnosis, prevention and treatment of diseases and clinical conditions associated with MGC14376.

MGC15429 (Accession NP_116139.1) is another GAM47 target gene, herein designated TARGET GENE. MGC15429 BINDING SITE is a target binding site found in the 3' untranslated region of mRNA encoded by MGC15429, corresponding to a target binding site such as BINDING SITE I, BINDING SITE II or BINDING SITE III of FIG. 8. Table 4 illustrates the complementarity of the nucleotide sequences of MGC15429 BINDING SITE, designated SEQ ID:12226, to the nucleotide sequence of GAM47 RNA, herein designated GAM RNA, also designated SEQ ID:269.

Another function of GAM47 is therefore inhibition of MGC15429 (Accession NP_116139.1). Accordingly, utilities of GAM47 include diagnosis, prevention and treatment of diseases and clinical conditions associated with MGC15429.

MGC22014 (Accession XP_035307.1) is another GAM47 target gene, herein designated TARGET GENE. MGC22014 BINDING SITE is a target binding site found in the 3' untranslated region of mRNA encoded by MGC22014, corresponding to a target binding site such as BINDING SITE I, BINDING SITE II or BINDING SITE III of FIG. 8. Table 4 illustrates the complementarity of the nucleotide sequences of MGC22014 BINDING SITE, designated SEQ ID:3989, to the nucleotide sequence of GAM47 RNA, herein designated GAM RNA, also designated SEQ ID:269.

Another function of GAM47 is therefore inhibition of MGC22014 (Accession XP_035307.1). Accordingly, utilities of GAM47 include diagnosis, prevention and treatment of diseases and clinical conditions associated with MGC22014.

MGC2474 (Accession NP_076420.1) is another GAM47 target gene, herein designated TARGET GENE. MGC2474 BINDING SITE is a target binding site found in the 3' untranslated region of mRNA encoded by MGC2474, corresponding to a target binding site such as BINDING SITE I, BINDING SITE II or BINDING SITE III of FIG. 8. Table 4 illustrates the complementarity of the nucleotide sequences of MGC2474 BINDING SITE, designated SEQ ID:7232, to the nucleotide sequence of GAM47 RNA, herein designated GAM RNA, also designated SEQ ID:269.

Another function of GAM47 is therefore inhibition of MGC2474 (Accession NP_076420.1). Accordingly, utilities of GAM47 include diagnosis, prevention and treatment of diseases and clinical conditions associated with MGC2474.

MGC33215 (Accession NP_722517.1) is another GAM47 target gene, herein designated TARGET GENE. MGC33215 BINDING SITE is a target binding site found in the 3' untranslated region of mRNA encoded by MGC33215, corresponding to a target binding site such as BINDING SITE I, BINDING SITE II or BINDING SITE III of FIG. 8. Table 4 illustrates the complementarity of the nucleotide sequences of MGC33215 BINDING SITE, designated SEQ ID:19827, to the nucleotide sequence of GAM47 RNA, herein designated GAM RNA, also designated SEQ ID:269.

Another function of GAM47 is therefore inhibition of MGC33215 (Accession NP_722517.1). Accordingly, utilities of GAM47 include diagnosis, prevention and treatment of diseases and clinical conditions associated with MGC33215.

MGC34728 (Accession NP_689746.1) is another GAM47 target gene, herein designated TARGET GENE. MGC34728 BINDING SITE is a target binding site found in the 5' untranslated region of mRNA encoded by MGC34728, corresponding to a target binding site such as BINDING SITE I, BINDING SITE II or BINDING SITE III of FIG. 8. Table 4 illustrates the complementarity of the nucleotide sequences of MGC34728 BINDING SITE, designated SEQ ID:1406, to the nucleotide sequence of GAM47 RNA, herein designated GAM RNA, also designated SEQ ID:269.

Another function of GAM47 is therefore inhibition of MGC34728 (Accession NP_689746.1). Accordingly, utilities of GAM47 include diagnosis, prevention and treatment of diseases and clinical conditions associated with MGC34728.

MGC34800 (Accession NP_694959.1) is another GAM47 target gene, herein designated TARGET GENE. MGC34800 BINDING SITE is a target binding site found in the 3' untranslated region of mRNA encoded by MGC34800, corresponding to a target binding site such as BINDING SITE I, BINDING SITE II or BINDING SITE III of FIG. 8. Table 4 illustrates the complementarity of the nucleotide sequences of MGC34800 BINDING SITE, designated SEQ ID:8668, to the nucleotide sequence of GAM47 RNA, herein designated GAM RNA, also designated SEQ ID:269.

Another function of GAM47 is therefore inhibition of MGC34800 (Accession NP_694959.1). Accordingly, utilities of GAM47 include diagnosis, prevention and treatment of diseases and clinical conditions associated with MGC34800.

MGC40579 (Accession NP_689989.1) is another GAM47 target gene, herein designated TARGET GENE. MGC40579 BINDING SITE1 and MGC40579 BINDING SITE2 are target binding sites found in untranslated regions of mRNA encoded by MGC40579, corresponding to target binding sites such as BINDING SITE I, BINDING SITE II or BINDING SITE III of FIG. 8. Table 4 illustrates the complementarity of the nucleotide sequences of MGC40579 BINDING SITE1 and MGC40579 BINDING SITE2, designated SEQ ID:7455 and SEQ ID:9195 respectively, to the nucleotide sequence of GAM47 RNA, herein designated GAM RNA, also designated SEQ ID:269.

Another function of GAM47 is therefore inhibition of MGC40579 (Accession NP_689989.1). Accordingly, utilities of GAM47 include diagnosis, prevention and treatment of diseases and clinical conditions associated with MGC40579.

MGC42105 (Accession NP_699192.1) is another GAM47 target gene, herein designated TARGET GENE. MGC42105 BINDING SITE is a target binding site found in the 5' untranslated region of mRNA encoded by MGC42105, corresponding to a target binding site such as BINDING SITE I, BINDING SITE II or BINDING SITE III of FIG. 8. Table 4 illustrates the complementarity of the nucleotide sequences of MGC42105 BINDING SITE, designated SEQ ID:1753, to the nucleotide sequence of GAM47 RNA, herein designated GAM RNA, also designated SEQ ID:269.

Another function of GAM47 is therefore inhibition of MGC42105 (Accession NP_699192.1). Accordingly, utilities of GAM47 include diagnosis, prevention and treatment of diseases and clinical conditions associated with MGC42105.

MGC4504 (Accession NP_077016.1) is another GAM47 target gene, herein designated TARGET GENE. MGC4504 BINDING SITE is a target binding site found in the 3' untranslated region of mRNA encoded by MGC4504, corresponding to a target binding site such as BINDING SITE I, BINDING SITE II or BINDING SITE III of FIG. 8. Table 4 illustrates the complementarity of the nucleotide sequences of MGC4504 BINDING SITE, designated SEQ ID:2337, to the nucleotide sequence of GAM47 RNA, herein designated GAM RNA, also designated SEQ ID:269.

Another function of GAM47 is therefore inhibition of MGC4504 (Accession NP_077016.1). Accordingly, utilities of GAM47 include diagnosis, prevention and treatment of diseases and clinical conditions associated with MGC4504.

MI-ER1 (Accession NP_065999.1) is another GAM47 target gene, herein designated TARGET GENE. MI-ER1 BINDING SITE is a target binding site found in the 3' untranslated region of mRNA encoded by MI-ER1, corresponding to a target binding site such as BINDING SITE I, BINDING SITE II or BINDING SITE III of FIG. 8. Table 4 illustrates the complementarity of the nucleotide sequences of MI-ER1 BINDING SITE, designated SEQ ID:10996, to the nucleotide sequence of GAM47 RNA, herein designated GAM RNA, also designated SEQ ID:269.

Another function of GAM47 is therefore inhibition of MI-ER1 (Accession NP_065999.1). Accordingly, utilities of GAM47 include diagnosis, prevention and treatment of diseases and clinical conditions associated with MI-ER1.

MIDORI (Accession NP_065829.1) is another GAM47 target gene, herein designated TARGET GENE. MIDORI BINDING SITE is a target binding site found in the 3' untranslated region of mRNA encoded by MIDORI, corresponding to a target binding site such as BINDING SITE I, BINDING SITE II or BINDING SITE III of FIG. 8. Table 4 illustrates the complementarity of the nucleotide sequences of MIDORI BINDING SITE, designated SEQ ID:16823, to the nucleotide sequence of GAM47 RNA, herein designated GAM RNA, also designated SEQ ID:269.

Another function of GAM47 is therefore inhibition of MIDORI (Accession NP_065829.1). Accordingly, utilities of GAM47 include diagnosis, prevention and treatment of diseases and clinical conditions associated with MIDORI.

Multiple inositol polyphosphate histidine phosphatase, 1 (MINPP1, Accession NP_004888.2) is another GAM47 target gene, herein designated TARGET GENE. MINPP1 BINDING SITE is a target binding site found in the 3' untranslated region of mRNA encoded by MINPP1, corresponding to a target binding site such as BINDING SITE I, BINDING SITE II or BINDING SITE III of FIG. 8. Table 4 illustrates the complementarity of the nucleotide sequences of MINPP1 BINDING SITE, designated SEQ ID:3843, to the nucleotide sequence of GAM47 RNA, herein designated GAM RNA, also designated SEQ ID:269.

Another function of GAM47 is therefore inhibition of Multiple inositol polyphosphate histidine phosphatase, 1 (MINPP1, Accession NP_004888.2), a gene which is Multiple inositol polyphosphate phosphatase 1 and therefore may be associated with Follicular thyroid adenoma, follicular thyroid carcinoma. Accordingly, utilities of GAM47 include diagnosis, prevention and treatment of Follicular thyroid adenoma, follicular thyroid carcinoma, and of other diseases and clinical conditions associated with MINPP1.

The function of MINPP1 has been established by previous studies. Germline mutations in the tumor suppressor gene PTEN, which encodes a dual-specificity phosphatase, have been found in up to 80% of patients with Cowden syndrome, suggesting a role of PTEN in the pathogenesis of follicular thyroid tumors. Although somatic intragenic mutations in PTEN, which maps to 10q23.3, are rarely found in follicular tumors, loss of heterozygosity (LOH) of markers within 10q22-q24 occurs in about 25%. MINPP1, another phosphatase gene, had also been mapped to 10q23.3. MINPP1 has the ability to remove 3-phosphate from inositol phosphate substrates, a function that overlaps that of PTEN. Because of this overlapping function with PTEN and the physical location of MINPP1 to a region with frequent LOH in follicular thyroid tumors, Gimm et al. (2001) considered it to be an excellent candidate gene that could contribute to the pathogenesis of follicular thyroid tumors. They analyzed DNA from tumor and corresponding normal tissue from 23 patients with follicular thyroid adenoma (FA) and 15 patients with follicular thyroid carcinoma (FTC; 188470) for LOH or mutations at the MINPP1 locus. LOH was identified in 4 malignant and 3 benign tumors. One of these FTCs with LOH was found to harbor a somatic ser41- to - leu mutation (S41L; 605391.0001). They also found 2 germline sequence variants, gln270 to arg (Q270R; 605391.0002) and IVS3+34T-A (605391.0003). Q270R was found in only 1 patient with FA but not in patients with FTC or normal controls. Interestingly, IVS3+34T-A was found in about 15% of FA cases and normal controls but not in patients with FTC. The authors concluded that these results suggest a role for MINPP1 in the pathogenesis of at least a subset of malignant follicular thyroid tumors, and that MINPP1 might act as a low penetrance predisposition allele for FTC.

Animal model experiments lend further support to the function of MINPP1. Chi et al. (2000) used homologous recombination to generate Minpp1-deficient mice. They observed that these mice were fertile, lacked obvious defects, and had normal chondrocyte differentiation. An increase in levels of cytosolic inositol polyphosphates was reversible by the introduction of Minpp1 to the ER, showing that ER-based Minpp1 plays a role in the maintenance of steady-state levels of these polyphosphates. In contrast, introduction into the cytosol of truncated Minpp1 lacking the ER-targeting domain reduced the polyphosphates to below their natural levels and was accompanied by slowed cellular proliferation.

It is appreciated that the abovementioned animal model for MINPP1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chi, H.; Yang, X.; Kingsley, P. D.; O'Keefe, R. J.; Puzas, J. E.; Rosier, R. N.; Shears, S. B.; Reynolds, P. R.: Targeted deletion of Minpp1 provides new insight into the activity of multiple inositol polyphosphate phosphatase in vivo. Molec. Cell. Biol. 20:6496-6507, 2000; and Gimm, O.; Chi, H.; Dahia, P. L. M.; Perren, A.; Hinze, R.; Komminoth, P.; Dralle, H.; Reynolds, P. R.; Eng, C.: Somatic mutation and germline variants of MINPP1, a phosphatase gene lo.

Further studies establishing the function and utilities of MINPP1 are found in John Hopkins OMIM database record ID 605391, and in cited publications listed in Table 5, which are hereby incorporated by reference. Meningioma (disrupted in balanced translocation) 1 (MN1, Accession NP_002421.2) is another GAM47 target gene, herein designated TARGET GENE. MN1 BINDING SITE is a target binding site found in the 3' untranslated region of mRNA encoded by MN1, corresponding to a target binding site such as BINDING SITE I, BINDING SITE II or BINDING SITE III of FIG. 8. Table 4 illustrates the complementarity of the nucleotide sequences of MN1 BINDING SITE, designated SEQ ID:16715, to the nucleotide sequence of GAM47 RNA, herein designated GAM RNA, also designated SEQ ID:269.

Another function of GAM47 is therefore inhibition of Meningioma (disrupted in balanced translocation) 1 (MN1, Accession NP_002421.2). Accordingly, utilities of GAM47 include diagnosis, prevention and treatment of diseases and clinical conditions associated with MN1.

Molybdenum cofactor synthesis 1 (MOCS1, Accession NP_620306.1) is another GAM47 target gene, herein designated TARGET GENE. MOCS1 BINDING SITE is a target binding site found in the 3' untranslated region of multiple transcripts of mRNA encoded by MOCS1, corresponding to a target binding site such as BINDING SITE I, BINDING SITE II or BINDING SITE III of FIG. 8. Table 4 illustrates the complementarity of the nucleotide sequences of MOCS1 BINDING SITE, designated SEQ ID:18692, to the nucleotide sequence of GAM47 RNA, herein designated GAM RNA, also designated SEQ ID:269.

Another function of GAM47 is therefore inhibition of Molybdenum cofactor synthesis 1 (MOCS1, Accession NP_620306.1). Accordingly, utilities of GAM47 include diagnosis, prevention and treatment of diseases and clinical conditions associated with MOCS1.

Molybdenum cofactor synthesis 1 (MOCS1, Accession NP_005933.1) is another GAM47 target gene, herein designated TARGET GENE. MOCS1 BINDING SITE is a target binding site found in the 3' untranslated region of multiple transcripts of mRNA encoded by MOCS1, corresponding to a target binding site such as BINDING SITE I, BINDING SITE II or BINDING SITE III of FIG. 8. Table 4 illustrates the complementarity of the nucleotide sequences of MOCS1 BINDING SITE, designated SEQ ID:18692, to the nucleotide sequence of GAM47 RNA, herein designated GAM RNA, also designated SEQ ID:269.

Another function of GAM47 is therefore inhibition of Molybdenum cofactor synthesis 1 (MOCS1, Accession NP_005933.1). Accordingly, utilities of GAM47 include diagnosis, prevention and treatment of diseases and clinical conditions associated with MOCS1.

Molybdenum cofactor synthesis 1 (MOCS1, Accession NP_005934.2) is another GAM47 target gene, herein designated TARGET GENE. MOCS1 BINDING SITE is a target binding site found in the 3' untranslated region of multiple transcripts of mRNA encoded by MOCS1, corresponding to a target binding site such as BINDING SITE I, BINDING SITE II or BINDING SITE III of FIG. 8. Table 4 illustrates the complementarity of the nucleotide sequences of MOCS1 BINDING SITE, designated SEQ ID:18692, to the nucleotide sequence of GAM47 RNA, herein designated GAM RNA, also designated SEQ ID:269.

Another function of GAM47 is therefore inhibition of Molybdenum cofactor synthesis 1 (MOCS1, Accession NP_005934.2). Accordingly, utilities of GAM47 include diagnosis, prevention and treatment of diseases and clinical conditions associated with MOCS1.

MOXD1 (Accession NP_056344.1) is another GAM47 target gene, herein designated TARGET GENE. MOXD1 BINDING SITE is a target binding site found in the 3' untranslated region of mRNA encoded by MOXD1, corresponding to a target binding site such as BINDING SITE I, BINDING SITE II or BINDING SITE III of FIG. 8. Table 4 illustrates the complementarity of the nucleotide sequences of MOXD1 BINDING SITE, designated SEQ ID:5314, to the nucleotide sequence of GAM47 RNA, herein designated GAM RNA, also designated SEQ ID:269.

Another function of GAM47 is therefore inhibition of MOXD1 (Accession NP_056344.1). Accordingly, utilities of GAM47 include diagnosis, prevention and treatment of diseases and clinical conditions associated with MOXD1.

MRF2 (Accession XP_084482.2) is another GAM47 target gene, herein designated TARGET GENE. MRF2 BINDING SITE is a target binding site found in the 3' untranslated region of mRNA encoded by MRF2, corresponding to a target binding site such as BINDING SITE I, BINDING SITE II or BINDING SITE III of FIG. 8. Table 4 illustrates the complementarity of the nucleotide sequences of MRF2 BINDING SITE, designated SEQ ID:16396, to the nucleotide sequence of GAM47 RNA, herein designated GAM RNA, also designated SEQ ID:269.

Another function of GAM47 is therefore inhibition of MRF2 (Accession XP_084482.2). Accordingly, utilities of GAM47 include diagnosis, prevention and treatment of diseases and clinical conditions associated with MRF2.

Mitochondrial ribosomal protein l10 (MRPL10, Accession NP_660298.2) is another GAM47 target gene, herein designated TARGET GENE. MRPL10 BINDING SITE is a target binding site found in the 3' untranslated region of multiple transcripts of mRNA encoded by MRPL10, corresponding to a target binding site such as BINDING SITE I, BINDING SITE II or BINDING SITE III of FIG. 8. Table 4 illustrates the complementarity of the nucleotide sequences of MRPL10 BINDING SITE, designated SEQ ID:9128, to the nucleotide sequence of GAM47 RNA, herein designated GAM RNA, also designated SEQ ID:269.

Another function of GAM47 is therefore inhibition of Mitochondrial ribosomal protein 110 (MRPL10, Accession NP_660298.2). Accordingly, utilities of GAM47 include diagnosis, prevention and treatment of diseases and clinical conditions associated with MRPL10.

Mitochondrial ribosomal protein l10 (MRPL10, Accession NP_683685.1) is another GAM47 target gene, herein designated TARGET GENE. MRPL10 BINDING SITE is a target binding site found in the 3' untranslated region of multiple transcripts of mRNA encoded by MRPL10, corresponding to a target binding site such as BINDING SITE I, BINDING SITE II or BINDING SITE III of FIG. 8. Table 4 illustrates the complementarity of the nucleotide sequences of MRPL10 BINDING SITE, designated SEQ ID:9128, to the nucleotide sequence of GAM47 RNA, herein designated GAM RNA, also designated SEQ ID:269.

Another function of GAM47 is therefore inhibition of Mitochondrial ribosomal protein 110 (MRPL10, Accession NP_683685.1). Accordingly, utilities of GAM47 include diagnosis, prevention and treatment of diseases and clinical conditions associated with MRPL10.

MTA3 (Accession XP_038567.5) is another GAM47 target gene, herein designated TARGET GENE. MTA3 BINDING SITE is a target binding site found in the 3' untranslated region of mRNA encoded by MTA3, corresponding to a target binding site such as BINDING SITE I, BINDING SITE II or BINDING SITE III of FIG. 8. Table 4 illustrates the complementarity of the nucleotide sequences of MTA3 BINDING SITE, designated SEQ ID:1271, to the nucleotide sequence of GAM47 RNA, herein designated GAM RNA, also designated SEQ ID:269.

Another function of GAM47 is therefore inhibition of MTA3 (Accession XP_038567.5). Accordingly, utilities of GAM47 include diagnosis, prevention and treatment of diseases and clinical conditions associated with MTA3.

Nucleosome assembly protein 1-like 2 (NAP1L2, Accession NP_068798.1) is another GAM47 target gene, herein designated TARGET GENE. NAP1L2 BINDING SITE is a target binding site found in the 5' untranslated region of mRNA encoded by NAP1L2, corresponding to a target binding site such as BINDING SITE I, BINDING SITE II or BINDING SITE III of FIG. 8. Table 4 illustrates the complementarity of the nucleotide sequences of NAP1L2 BINDING SITE, designated SEQ ID:9926, to the nucleotide sequence of GAM47 RNA, herein designated GAM RNA, also designated SEQ ID:269.

Another function of GAM47 is therefore inhibition of Nucleosome assembly protein 1-like 2 (NAP1L2, Accession NP_068798.1). Accordingly, utilities of GAM47 include diagnosis, prevention and treatment of diseases and clinical conditions associated with NAP1L2.

Nucleosome assembly protein 1-like 4 (NAP1L4, Accession NP_005960.1) is another GAM47 target gene, herein designated TARGET GENE. NAP1L4 BINDING SITE is a target binding site found in the 3' untranslated region of mRNA encoded by NAP1L4, corresponding to a target binding site such as BINDING SITE I, BINDING SITE II or BINDING SITE III of FIG. 8. Table 4 illustrates the complementarity of the nucleotide sequences of NAP1L4 BINDING SITE, designated SEQ ID:10186, to the nucleotide sequence of GAM47 RNA, herein designated GAM RNA, also designated SEQ ID:269.

Another function of GAM47 is therefore inhibition of Nucleosome assembly protein 1-like 4 (NAP1L4, Accession NP_005960.1), a gene which may have a role as a histone chaperone. Accordingly, utilities of GAM47 include diagnosis, prevention and treatment of diseases and clinical conditions associated with NAP1L4.

The function of NAP1L4 has been established by previous studies. Hu et al. (1996) used a positional cloning approach to isolate a gene which is located 100 kb centromeric to the proximal Beckwith-Wiedemann breakpoint cluster region (BWS; 130650) on chromosome 11p15. This gene is homologous to the yeast nucleosome assembly protein NAP1 (OMIM Ref. No. 164060). The authors designated the new gene NAP2. They demonstrated that this gene shows biallelic expression in all tissues tested and that it therefore diverges in its expression from IGF2 (OMIM Ref. No. 147470), H19 (OMIM Ref. No. 103280), and p57(KIP2) (OMIM Ref. No. 600856), which also map to 11p15.5 in the vicinity of the BWS gene. The NAP2 gene encodes a highly acidic protein of 375 amino acids. A 1,200-bp 3-prime untranslated region was present. Rodriguez et al. (1997) reported that the NAP1L4 gene consists of 14 exons and spans approximately 30.5 kb. Histones are thought to play a key role in regulating gene expression at the level of DNA packaging. The deduced amino acid sequence of NAP2 indicates that it is a protein with a potential nuclear localization motif and 2 clusters of highly acidic residues. By functional analysis of recombinant NAP2 protein purified from Escherichia coli, Rodriguez et al. (1997) found that this protein can interact with both core and linker histones (see OMIM Ref. No. 142709). They demonstrated that recombinant NAP2 can transfer histones onto naked DNA templates. Subcellular localization studies of NAP2 indicated that it can shuttle between the cytoplasm and nucleus, suggesting a role as a histone chaperone. NAP1L4 maps to a region implicated in Wilms tumor etiology (see OMIM Ref. No. 194071). Rodriguez et al. (1997) analyzed the gene encoding NAP2 for mutations and found no evidence of nonsense, frameshift, or deletion mutations. Their findings, coupled with tumor suppression assays in Wilms tumor cells, did not support a role for NAP2 in the etiology of that neoplasm.

Full details of the abovementioned studies are described in the following publications, the disclosure of which are hereby incorporated by reference:

Hu, R.-J.; Lee, M. P.; Johnson, L. A.; Feinberg, A. P.: A novel human homologue of yeast nucleosome assembly protein, 65 kb centromeric to the p57(KIP2) gene, is biallelically expressed in fetal and adult tissues. Hum. Molec. Genet. 5:1743-1748, 1996; and Rodriguez, P.; Munroe, D.; Prawitt, D.; Chu, L. L.; Bric, E.; Kim, J.; Reid, L. H.; Davies, C.; Nakagama, H.; Loebbert, R.; Winterpacht, A.; Petruzzi, M.-J.; Higgins, M. J.; Nowak, N.

Further studies establishing the function and utilities of NAP1L4 are found in John Hopkins OMIM database record ID 601651, and in cited publications listed in Table 5, which are hereby incorporated by reference. Neuroblastoma, suppression of tumorigenicity 1 (NBL1, Accession NP_005371.1) is another GAM47 target gene, herein designated TARGET GENE. NBL1 BINDING SITE is a target binding site found in the 3' untranslated region of mRNA encoded by NBL1, corresponding to a target binding site such as BINDING SITE I, BINDING SITE II or BINDING SITE III of FIG. 8. Table 4 illustrates the complementarity of the nucleotide sequences of NBL1 BINDING SITE, designated SEQ ID:10001, to the nucleotide sequence of GAM47 RNA, herein designated GAM RNA, also designated SEQ ID:269.

Another function of GAM47 is therefore inhibition of Neuroblastoma, suppression of tumorigenicity 1 (NBL1, Accession NP_005371.1). Accordingly, utilities of GAM47 include diagnosis, prevention and treatment of diseases and clinical conditions associated with NBL1.

N-myc downstream regulated gene 1 (NDRG1, Accession NP_006087.1) is another GAM47 target gene, herein designated TARGET GENE. NDRG1 BINDING SITE is a target binding site found in the 3' untranslated region of mRNA encoded by NDRG1, corresponding to a target binding site such as BINDING SITE I, BINDING SITE II or BINDING SITE III of FIG. 8. Table 4 illustrates the complementarity of the nucleotide sequences of NDRG1 BINDING SITE, designated SEQ ID:3602, to the nucleotide sequence of GAM47 RNA, herein designated GAM RNA, also designated SEQ ID:269.

Another function of GAM47 is therefore inhibition of N-myc downstream regulated gene 1 (NDRG1, Accession NP_006087.1), a gene which may have a growth inhibitory role. and therefore may be associated with Hereditary motor and sensory neuropathy, lom type. Accordingly, utilities of GAM47 include diagnosis, prevention and treatment of Hereditary motor and sensory neuropathy, lom type, and of other diseases and clinical conditions associated with NDRG1.

The function of NDRG1 has been established by previous studies. Using mRNA differential display analysis to compare expression in cells cultured in the presence of 1% or 20% oxygen, Park et al. (2000) determined that NDRG1, which they called PROXY1, is markedly upregulated in hypoxic cells. Northern and Western blot analyses showed that the 43-kD NDRG1 protein has a longer half-life than does the mRNA transcript and that the upregulation occurs through a heme protein-dependent pathway. Autosomal recessive peripheral neuropathies are relatively rare but are clinically more severe than autosomal dominant forms of Charcot-Marie-tooth disease (CMT). The Lom form of hereditary motor and sensory neuropathy (HMSNL; 601455), or CMT4D, is one such disorder. HMSNL shows features of Schwann cell dysfunction and a concomitant early axonal involvement, suggesting that impaired axon-glia interactions play a major role in its pathogenesis. Kalaydjieva et al. (1996) mapped the disease gene to 8q24.3, where closely related disease haplotypes and strong linkage disequilibrium suggested a single founder mutation. Kalaydjieva et al. (2000) reduced the HSMNL interval to 200 kb and characterized it by means of large-scale genomic sequencing. Sequence analysis of 2 genes located in the critical region, NDRG1 and WISP1 (OMIM Ref. No. 603398), identified the founder HMSNL mutation, a nonsense arg148- to - ter mutation (605262.0001) in the NDRG1 gene.

Full details of the abovementioned studies are described in the following publications, the disclosure of which are hereby incorporated by reference:

Kalaydjieva, L.; Gresham, D.; Gooding, R.; Heather, L.; Baas, F.; de Jonge, R.; Blechschmidt, K.; Angelicheva, D.; Chandler, D.; Worsley, P.; Rosenthal, A.; King, R. H. M.; Thomas, P. K.: N-myc downstream-regulated gene 1 is mutated in hereditary motor and sensory neuropathy-Lom. Am. J. Hum. Genet. 67:47-58, 2000; and Park, H,; Adams, M. A.; Lachat, P.; Bosman, F.; Pang, S. C.; Graham, C. H.: Hypoxia induces the expression of a 43-kDa protein (PROXY-1) in normal and malignant cells. Biochem. Bioph.

Further studies establishing the function and utilities of NDRG1 are found in John Hopkins OMIM database record ID 605262, and in cited publications listed in Table 5, which are hereby incorporated by reference. Nadh dehydrogenase (ubiquinone) 1 alpha subcomplex, 6, 14 kda (NDUFA6, Accession NP_002481.1) is another GAM47 target gene, herein designated TARGET GENE. NDUFA6 BINDING SITE is a target binding site found in the 3' untranslated region of mRNA encoded by NDUFA6, corresponding to a target binding site such as BINDING SITE I, BINDING SITE II or BINDING SITE III of FIG. 8. Table 4 illustrates the complementarity of the nucleotide sequences of NDUFA6 BINDING SITE, designated SEQ ID:13883, to the nucleotide sequence of GAM47 RNA, herein designated GAM RNA, also designated SEQ ID:269.

Another function of GAM47 is therefore inhibition of Nadh dehydrogenase (ubiquinone) 1 alpha subcomplex, 6, 14 kda (NDUFA6, Accession NP_002481.1), a gene which transfers electrons from nadh to the respiratory chain. Accordingly, utilities of GAM47 include diagnosis, prevention and treatment of diseases and clinical conditions associated with NDUFA6.

The function of NDUFA6 has been established by previous studies. See NDUFA2 (OMIM Ref. No. 602137). Dunbar et al. (1997) mapped the NDUFA6 gene to 21q22 by fluorescence in situ hybridization (FISH). However, by intron-based radiation hybrid mapping, Emahazion and Brookes (1998) assigned the NDUFA6 gene to 22q13.1. They stated that subsequent mapping studies with subfragments of the FISH-mapped recombinants of Dunbar et al. (1997) suggested chimerism and confirmed that the earlier FISH data were flawed. Ton et al. (1997) isolated human heart cDNAs encoding CI-B14 (OMIM Ref. No. NDUFA6) and 4 other complex I subunits.

Full details of the abovementioned studies are described in the following publications, the disclosure of which are hereby incorporated by reference:

Dunbar, D. R.; Shibasaki, Y.; Dobbie, L.; Andersson, B.; Brookes, A. J.: In situ hybridisation mapping of genomic clones for five human respiratory chain complex I genes. Cytogenet. Cell Genet. 78:21-24, 1997; and Emahazion, T.; Brookes, A. J.: Mapping of the NDUFA2, NDUFA6, NDUFA7, NDUFB8, and NDUFS8 electron transport chain genes by intron based radiation hybrid mapping. Cytogenet. Cell Genet.

Further studies establishing the function and utilities of NDUFA6 are found in John Hopkins OMIM database record ID 602138, and in cited publications listed in Table 5, which are hereby incorporated by reference. Nuclear factor of activated t-cells, cytoplasmic, calcineurin-dependent 4 (NFATC4, Accession NP_004545.2) is another GAM47 target gene, herein designated TARGET GENE. NFATC4 BINDING SITE is a target binding site found in the 3' untranslated region of mRNA encoded by NFATC4, corresponding to a target binding site such as BINDING SITE I, BINDING SITE II or BINDING SITE III of FIG. 8. Table 4 illustrates the complementarity of the nucleotide sequences of NFATC4 BINDING SITE, designated SEQ ID:11848, to the nucleotide sequence of GAM47 RNA, herein designated GAM RNA, also designated SEQ ID:269.

Another function of GAM47 is therefore inhibition of Nuclear factor of activated t-cells, cytoplasmic, calcineurin-dependent 4 (NFATC4, Accession NP_004545.2), a gene which plays a role in the inducible expression of cytokine genes in Tcells. Accordingly, utilities of GAM47 include diagnosis, prevention and treatment of diseases and clinical conditions associated with NFATC4.

The function of NFATC4 has been established by previous studies. The activation of NFAT proteins is controlled by calcineurin, the calmodulin-dependent phosphatase. Aramburu et al. (1998) identified a short conserved sequence in the NFATC4 protein (residues 105-117) that targets calcineurin to NFAT. Mutation of a single residue in this sequence impairs the calcineurin-mediated dephosphorylation and nuclear translocation of NFAT1. Peptides spanning the region inhibit the ability of calcineurin to bind to and dephosphorylate NFAT proteins, without affecting the phosphatase activity of calcineurin against other substrates. When expressed intracellularly, a corresponding peptide inhibits NFAT dephosphorylation, nuclear translocation, and NFAT-mediated expression in response to stimulation. Thus, disruption of the enzyme-substrate docking interaction that directs calcineurin to NFAT can effectively block NFAT-dependent functions Animal model experiments lend further support to the function of NFATC4. Graef et al. (2001) found that mice with disruptions of both the Nfatc4 and Nfatc3 genes died around embryonic day 11 (E11) with generalized defects in vessel assembly as well as excessive and disorganized growth of vessels into the neural tube and somites. Since calcineurin was thought to control nuclear localization of NFATC proteins, the authors introduced a mutation into the calcineurin B gene (OMIM Ref. No. 601302) that prevented phosphatase activation by calcium signals. These calcineurin B mutant mice exhibited vascular developmental abnormalities similar to those of the Nfatc3/Nfatc4 null mice. Graef et al. (2001) showed that calcineurin function was transiently required between E7.5 and E8.5. They concluded that early calcineurin/NFAT signaling initiates the later cross-talk between vessels and surrounding tissues that pattern the vasculature It is appreciated that the abovementioned animal model for NFATC4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Graef, I. A.; Chen, F.; Chen, L.; Kuo, A.; Crabtree, G. R.: Signals transduced by Ca(2+)/calcineurin and NFATc3/c4 pattern the developing vasculature. Cell 105:863-875, 2001; and Aramburu, J.; Garcia-Cozar, F.; Raghavan, A.; Okamura, H.; Rao, A.; Hogan, P. G.: Selective inhibition of NFAT activation by a peptide spanning the calcineurin targeting site of NFAT. Mol.

Further studies establishing the function and utilities of NFATC4 are found in John Hopkins OMIM database record ID 602699, and in cited publications listed in Table 5, which are hereby incorporated by reference. Nipsnap homolog 1 (c. elegans) (NIPSNAP1, Accession NP_003625.1) is another GAM47 target gene, herein designated TARGET GENE. NIPSNAP1 BINDING SITE1 and NIPSNAP1 BINDING SITE2 are target binding sites found in untranslated regions of mRNA encoded by NIPSNAP1, corresponding to target binding sites such as BINDING SITE I, BINDING SITE II or BINDING SITE III of FIG. 8. Table 4 illustrates the complementarity of the nucleotide sequences of NIPSNAP1 BINDING SITE1 and NIPSNAP1 BINDING SITE2, designated SEQ ID:15009 and SEQ ID:2560 respectively, to the nucleotide sequence of GAM47 RNA, herein designated GAM RNA, also designated SEQ ID:269.

Another function of GAM47 is therefore inhibition of Nipsnap homolog 1 (c. elegans) (NIPSNAP1, Accession NP_003625.1). Accordingly, utilities of GAM47 include diagnosis, prevention and treatment of diseases and clinical conditions associated with NIPSNAP1.

Neuroligin 4 (NLGN4, Accession NP_065793.1) is another GAM47 target gene, herein designated TARGET GENE. NLGN4 BINDING SITE is a target binding site found in the 5' untranslated region of multiple transcripts of mRNA encoded by NLGN4, corresponding to a target binding site such as BINDING SITE I, BINDING SITE II or BINDING SITE III of FIG. 8. Table 4 illustrates the complementarity of the nucleotide sequences of NLGN4 BINDING SITE, designated SEQ ID:11053, to the nucleotide sequence of GAM47 RNA, herein designated GAM RNA, also designated SEQ ID:269.

Another function of GAM47 is therefore inhibition of Neuroligin 4 (NLGN4, Accession NP_065793.1). Accordingly, utilities of GAM47 include diagnosis, prevention and treatment of diseases and clinical conditions associated with NLGN4.

Neuroligin 4 (NLGN4, Accession NP_851849.1) is another GAM47 target gene, herein designated TARGET GENE. NLGN4 BINDING SITE is a target binding site found in the 5' untranslated region of multiple transcripts of mRNA encoded by NLGN4, corresponding to a target binding site such as BINDING SITE I, BINDING SITE II or BINDING SITE III of FIG. 8. Table 4 illustrates the complementarity of the nucleotide sequences of NLGN4 BINDING SITE, designated SEQ ID:11053, to the nucleotide sequence of GAM47 RNA, herein designated GAM RNA, also designated SEQ ID:269.

Another function of GAM47 is therefore inhibition of Neuroligin 4 (NLGN4, Accession NP_851849.1). Accordingly, utilities of GAM47 include diagnosis, prevention and treatment of diseases and clinical conditions associated with NLGN4.

Nucleolar protein 3 (apoptosis repressor with card domain) (NOL3, Accession NP_003937.1) is another GAM47 target gene, herein designated TARGET GENE. NOL3 BINDING SITE is a target binding site found in the 3' untranslated region of mRNA encoded by NOL3, corresponding to a target binding site such as BINDING SITE I, BINDING SITE II or BINDING SITE III of FIG. 8. Table 4 illustrates the complementarity of the nucleotide sequences of NOL3 BINDING SITE, designated SEQ ID:4812, to the nucleotide sequence of GAM47 RNA, herein designated GAM RNA, also designated SEQ ID:269.

Another function of GAM47 is therefore inhibition of Nucleolar protein 3 (apoptosis repressor with card domain) (NOL3, Accession NP_003937.1), a gene which inhibits CASP2 and CASP8 and interacts with splicing factors. Accordingly, utilities of GAM47 include diagnosis, prevention and treatment of diseases and clinical conditions associated with NOL3.

The function of NOL3 has been established by previous studies. By searching an EST database for apoptosis-regulating proteins with homology to the caspase recruitment domain (CARD) of caspase-9 (CASP9; 602234), Koseki et al. (1998) identified a cDNA encoding ARC (apoptosis repressor with CARD). Sequence analysis predicted that the 208-amino acid ARC protein contains an N- terminal CARD and a C-terminal region rich in proline and glutamic acid. Northern blot analysis detected 5.5- and 1.0-kb ARC transcripts in skeletal muscle and heart, but no expression was detected in brain, placenta, lung, liver, kidney, pancreas, and lymphoid/hematopoietic tissues. To identify proteins involved in RNA processing, Stoss et al. (1999) used a yeast 2-hybrid screen with SRp30c (SFRS9; 601943) as bait on a HeLa library. They isolated a cDNA encoding a protein that they designated NOP30 (nucleolar protein of 30 kD) based on SDS-PAGE analysis. The authors also identified a cDNA encoding a smaller isoform that they termed MYC (muscle-enriched cytosolic protein), which is created by a frameshift and is identical to the ARC protein reported by Koseki et al. (1998). MYC did not interact with SFRS9. Sequence analysis of the 219-amino acid NOP30 protein predicted that it contains a highly acidic N terminus and a basic C terminus enriched with arginines, serines, and prolines and having multiple phosphorylation sites. Northern blot analysis detected 1.8- and 1.3-kb NOP30 transcripts, with highest expression in heart and skeletal muscle and weak expression in other tissues. In contrast, SFRS9 is relatively strongly and ubiquitously expressed as a 1.35-kb transcript. In situ hybridization analysis showed that NOP30 is expressed in the pia mater, a tissue surrounding the brain containing blood vessels lined with smooth muscle cells. Binding analysis indicated that NOP30 binds to itself and that the N and C termini of NOP30 interact with SFRS9 through its RS domain. Confocal microscopy demonstrated that NOP30, through its arginine-rich C terminus, colocalizes with B23 (NPM1; 164040) in the granular component of nucleoli; however, the majority of NOP30 was localized in the fibrillar component. NOP30 and SFRS9 colocalized in the nucleoplasm. In contrast, My, with its acidic N terminus, was predominantly localized in the cytoplasm.

Full details of the abovementioned studies are described in the following publications, the disclosure of which are hereby incorporated by reference:

Koseki, T.; Inohara, N.; Chen, S.; Nunez, G.: ARC, an inhibitor of apoptosis expressed in skeletal muscle and heart that interacts selectively with caspases. Proc. Nat. Acad. Sci. 95:5156-5160, 1998; and Stoss, O.; Schwaiger, F.-W.; Cooper, T. A.; Stamm, S.: Alternative splicing determines the intracellular localization of the novel nuclear protein Nop30 and its interaction with the sp.

Further studies establishing the function and utilities of NOL3 are found in John Hopkins OMIM database record ID 605235, and in cited publications listed in Table 5, which are hereby incorporated by reference. Notch homolog 2 (drosophila) (NOTCH2, Accession NP_077719.2) is another GAM47 target gene, herein designated TARGET GENE. NOTCH2 BINDING SITE is a target binding site found in the 3' untranslated region of mRNA encoded by NOTCH2, corresponding to a target binding site such as BINDING SITE I, BINDING SITE II or BINDING SITE III of FIG. 8. Table 4 illustrates the complementarity of the nucleotide sequences of NOTCH2 BINDING SITE, designated SEQ ID:4571, to the nucleotide sequence of GAM47 RNA, herein designated GAM RNA, also designated SEQ ID:269.

Another function of GAM47 is therefore inhibition of Notch homolog 2 (drosophila) (NOTCH2, Accession NP_077719.2), a gene which is moderately similar to a region of murine Notch1 and contains an ankyrin repeat. Accordingly, utilities of GAM47 include diagnosis, prevention and treatment of diseases and clinical conditions associated with NOTCH2.

The function of NOTCH2 has been established by previous studies. In Drosophila, the 'Notch' gene controls differentiation to various cell fates in many tissues. Three mammalian 'Notch' homologs have been identified. All 3 are very highly conserved relative to the Drosophila gene, which suggests that they are important for cell differentiation in mammals. This notion is supported by the previous finding of a truncated, translocated form of the human NOTCH1 (OMIM Ref. No. 190198) gene (formerly TAN1) in 3 cases of leukemia. Larsson et al. (1994) identified cosmid clones for all 3 human NOTCH genes. Using these clones as probes in fluorescence in situ hybridization to human metaphase chromosomes, they obtained results which, combined with data from somatic cell hybrid panels, demonstrated that NOTCH2 is located on 1p13-p11 and NOTCH3 on 19p13.2-p13.1, which are regions of neoplasia-associated translocation. As part of a study of a triplication of several Mb occurring on chromosomes 1, 6, and 9, Katsanis et al. (1996) confirmed the presence of a NOTCH locus on chromosome 1. Gao et al. (1998) mapped the mouse Notch2 gene to chromosome 3.

Full details of the abovementioned studies are described in the following publications, the disclosure of which are hereby incorporated by reference:

Katsanis, N.; Fitzgibbon, J.; Fisher, E. M. C.: Paralogy mapping: identification of a region in the human MHC triplicated onto human chromosomes 1 and 9 allows the prediction and isolation of novel PBX and NOTCH loci. Genomics 35:101-108, 1996; and Larsson, C.; Lardelli, M.; White, I.; Lendahl, U.: The human NOTCH1, 2, and 3 genes are located at chromosome positions 9q34, 1p13-p11, and 19p13.2-p13.1 in regions of neoplasia- associa.

Further studies establishing the function and utilities of NOTCH2 are found in John Hopkins OMIM database record ID 600275, and in cited publications listed in Table 5, which are hereby incorporated by reference. Nephronophthisis 4 (NPHP4, Accession NP_055917.1) is another GAM47 target gene, herein designated TARGET GENE. NPHP4 BINDING SITE is a target binding site found in the 3' untranslated region of mRNA encoded by NPHP4, corresponding to a target binding site such as BINDING SITE I, BINDING SITE II or BINDING SITE III of FIG. 8. Table 4 illustrates the complementarity of the nucleotide sequences of NPHP4 BINDING SITE, designated SEQ ID:5716, to the nucleotide sequence of GAM47 RNA, herein designated GAM RNA, also designated SEQ ID:269.

Another function of GAM47 is therefore inhibition of Nephronophthisis 4 (NPHP4, Accession NP_055917.1). Accordingly, utilities of GAM47 include diagnosis, prevention and treatment of diseases and clinical conditions associated with NPHP4.

Nuclear receptor subfamily 2, group f, member 6 (NR2F6, Accession NP_005225.2) is another GAM47 target gene, herein designated TARGET GENE. NR2F6 BINDING SITE is a target binding site found in the 3' untranslated region of mRNA encoded by NR2F6, corresponding to a target binding site such as BINDING SITE I, BINDING SITE II or BINDING SITE III of FIG. 8. Table 4 illustrates the complementarity of the nucleotide sequences of NR2F6 BINDING SITE, designated SEQ ID:3179, to the nucleotide sequence of GAM47 RNA, herein designated GAM RNA, also designated SEQ ID:269.

Another function of GAM47 is therefore inhibition of Nuclear receptor subfamily 2, group f, member 6 (NR2F6, Accession NP_005225.2), a gene which is similar to receptors for steroid hormones or thyroid hormone and contains a DNA binding domain. Accordingly, utilities of GAM47 include diagnosis, prevention and treatment of diseases and clinical conditions associated with NR2F6.

The function of NR2F6 has been established by previous studies. Miyajima et al. (1988) identified in the human genome 2 ERBA-related genes, named EAR2 and EAR3 (OMIM Ref. No. 132890), and characterized them by cDNA cloning. The genes are predicted to encode proteins very similar in primary structure to receptors for steroid hormones and thyroid hormone. In addition, the amino acid sequences of the 2 gene products are very similar to each other, especially in the DNA-binding domain (86% homology) and at the putative ligand-binding domain (76% homology). Northern hybridization using EAR DNA probes with RNAs from various tissues of the human fetus showed that the expression of EAR2 is high in the liver, whereas the expression of EAR3 is relatively ubiquitous. Hybridization analysis of DNAs from sorted chromosomes showed that the EAR2 gene is located on chromosome 19 and the EAR3 gene on chromosome 5. Bahler et al. (1997) performed cosmid contig mapping indicating that the NR2F6 gene was 100 kb proximal to MYO9B (OMIM Ref. No. 602129) on chromosome 19p13.1.

Full details of the abovementioned studies are described in the following publications, the disclosure of which are hereby incorporated by reference:

Bahler, M.; Kehrer, I.; Gordon, L.; Stoffler, H.-E.; Olsen, A. S.: Physical mapping of human myosin-IXB (MYO9B), the human orthologue of the rat myosin myr 5, to chromosome 19p13.1. Genomics 43:107-109, 1997; and Miyajima, N.; Kadowaki, Y.; Fukushige, S.; Shimizu, S.; Semba, K.; Yamanashi, Y.; Matsubara, K.; Toyoshima, K.; Yamamoto, T.: Identification of two novel members of erbA superfamily by.

Further studies establishing the function and utilities of NR2F6 are found in John Hopkins OMIM database record ID 132880, and in cited publications listed in Table 5, which are hereby incorporated by reference. Oxysterol binding protein-like 3 (OSBPL3, Accession NP_663163.1) is another GAM47 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:13242, to the nucleotide sequence of GAM47 RNA, herein designated GAM RNA, also designated SEQ ID:269.

Another function of GAM47 is therefore inhibition of Oxysterol binding protein-like 3 (OSBPL3, Accession NP_663163.1). Accordingly, utilities of GAM47 include diagnosis, prevention and treatment of diseases and clinical conditions associated with OSBPL3.

Oxysterol binding protein-like 3 (OSBPL3, Accession NP_663164.1) is another GAM47 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:13242, to the nucleotide sequence of GAM47 RNA, herein designated GAM RNA, also designated SEQ ID:269.

Another function of GAM47 is therefore inhibition of Oxysterol binding protein-like 3 (OSBPL3, Accession NP_663164.1). Accordingly, utilities of GAM47 include diagnosis, prevention and treatment of diseases and clinical conditions associated with OSBPL3.

OTOP3 (Accession XP_292588.2) is another GAM47 target gene, herein designated TARGET GENE. OTOP3 BINDING SITE is a target binding site found in the 5' untranslated region of mRNA encoded by OTOP3, corresponding to a target binding site such as BINDING SITE I, BINDING SITE II or BINDING SITE III of FIG. 8. Table 4 illustrates the complementarity of the nucleotide sequences of OTOP3 BINDING SITE, designated SEQ ID:1725, to the nucleotide sequence of GAM47 RNA, herein designated GAM RNA, also designated SEQ ID:269.

Another function of GAM47 is therefore inhibition of OTOP3 (Accession XP_292588.2). Accordingly, utilities of GAM47 include diagnosis, prevention and treatment of diseases and clinical conditions associated with OTOP3.

Phenylalanine hydroxylase (PAH, Accession NP_000268.1) is another GAM47 target gene, herein designated TARGET GENE. PAH BINDING SITE is a target binding site found in the 5' untranslated region of mRNA encoded by PAH, corresponding to a target binding site such as BINDING SITE I, BINDING SITE II or BINDING SITE III of FIG. 8. Table 4 illustrates the complementarity of the nucleotide sequences of PAH BINDING SITE, designated SEQ ID:1332, to the nucleotide sequence of GAM47 RNA, herein designated GAM RNA, also designated SEQ ID:269.

Another function of GAM47 is therefore inhibition of Phenylalanine hydroxylase (PAH, Accession NP_000268.1). Accordingly, utilities of GAM47 include diagnosis, prevention and treatment of diseases and clinical conditions associated with PAH.

Pantothenate kinase 4 (PANK4, Accession NP_060686.1) is another GAM47 target gene, herein designated TARGET GENE. PANK4 BINDING SITE is a target binding site found in the 3' untranslated region of mRNA encoded by PANK4, corresponding to a target binding site such as BINDING SITE I, BINDING SITE II or BINDING SITE III of FIG. 8. Table 4 illustrates the complementarity of the nucleotide sequences of PANK4 BINDING SITE, designated SEQ ID:18928, to the nucleotide sequence of GAM47 RNA, herein designated GAM RNA, also designated SEQ ID:269.

Another function of GAM47 is therefore inhibition of Pantothenate kinase 4 (PANK4, Accession NP_060686.1). Accordingly, utilities of GAM47 include diagnosis, prevention and treatment of diseases and clinical conditions associated with PANK4.

Poly(a) polymerase beta (testis specific) (PAPOLB, Accession NP_064529.2) is another GAM47 target gene, herein designated TARGET GENE. PAPOLB BINDING SITE is a target binding site found in the 3' untranslated region of mRNA encoded by PAPOLB, corresponding to a target binding site such as BINDING SITE I, BINDING SITE II or BINDING SITE III of FIG. 8. Table 4 illustrates the complementarity of the nucleotide sequences of PAPOLB BINDING SITE, designated SEQ ID:2967, to the nucleotide sequence of GAM47 RNA, herein designated GAM RNA, also designated SEQ ID:269.

Another function of GAM47 is therefore inhibition of Poly (a) polymerase beta (testis specific) (PAPOLB, Accession NP_064529.2). Accordingly, utilities of GAM47 include diagnosis, prevention and treatment of diseases and clinical conditions associated with PAPOLB.

Paired box gene 2 (PAX2, Accession NP_003980.1) is another GAM47 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:5547, to the nucleotide sequence of GAM47 RNA, herein designated GAM RNA, also designated SEQ ID:269.

Another function of GAM47 is therefore inhibition of Paired box gene 2 (PAX2, Accession NP_003980.1), a gene which involves in kidney cell differentiation and therefore is associated with Renal-coloboma syndrome. Accordingly, utilities of GAM47 include diagnosis, prevention and treatment of Renal-coloboma syndrome, and of other diseases and clinical conditions associated with PAX2.

The function of PAX2 has been established by previous studies. Sanyanusin et al. (1996) obtained the complete genomic structure of the human PAX2 gene. They described 5 genomic lambda clones containing human PAX2 gene sequences, 4 of which had previously been reported by them (Sanyanusin et al., 1995). The fifth clone, which included exons 7 and 8, was obtained by Sanyanusin et al. (1996) from a subgenomic lambda cDNA library of size- fractionated EcoRI fragments ranging in size from 6 to 8 kb. Sequencing and restriction mapping of these clones showed that the human PAX2 gene is composed of 12 exons spanning approximately 70 kb. They also found 2 alternatively spliced exons corresponding to exon 10 (Ward et al., 1994) and a 69-bp inserted sequence that they designated as exon 6. The 69-bp insert is homologous to a 69-bp insert reported in the murine Pax2 gene by Dressler et al. (1990). Sanyanusin et al. (1996) identified a (CA)n dinucleotide repeat polymorphism in PAX2 which they mapped immediately upstream of exon 9. The PAX2 gene is expressed in primitive cells of the kidney, ureter, ey, ear, and central nervous system. Based on the known expression pattern of PAX2, Sanyanusin et al. (1995) predicted that the phenotype caused by mutations of PAX2 would probably consist of autosomal dominant eye malformations, sensorineural hearing loss, and renal hypoplasia. Pursuing this suspicion, they found deletion of a single nucleotide in exon 5 of the PAX2 gene (167409.0001) in a father and 3 of his 5 sons who had optic nerve colobomas, renal hypoplasia, mild proteinuria, and vesicoureteral reflux. The nucleotide deletion caused a frameshift in the conserved octapeptide sequence. The phenotype was similar to that of Krd mutant mice which lack a portion of chromosome 19 that is homologous to human 10q24 and includes the Pax2 gene. These mice have reduced thickness of the renal cortex, a reduced number of glomeruli at birth, and reduced amplitudes on electroretinogram. In the Krd mouse, the deletion of chromosome 19 was transgene-induced (Keller et al., 1994). Coloboma of the optic nerve with renal disease (OMIM Ref. No. 120330) is a recognized syndrome. Renal dysplasia and retinal aplasia are combined in the Loken-Senior syndrome (OMIM Ref. No. 266900). Ocular abnormalities occur also with familial juvenile nephronophthisis (OMIM Ref. No. 256100), but that disorder maps to chromosome 2.

Animal model experiments lend further support to the function of PAX2. To determine the direct effects of PAX2 mutations on kidney development, fetal kidneys of mice carrying a Pax2(1Neu) mutation were examined. At embryonic day 15 (E15), heterozygous mutant kidneys were approximately 60% the size of those of wildtype littermates, and the number of nephrons was strikingly reduced. Heterozygous mutant mice showed increased apoptotic cell death during fetal kidney development, but the increased apoptosis was not associated with random stochastic inactivation of Pax2 expression in mutant kidneys; Pax2 was shown to be biallelically expressed during kidney development. The findings supported the conclusion that heterozygous mutations of the PAX2 gene are associated with increased apoptosis and reduced branching of the ureteric bud, due to reduced PAX2 dosage during a critical window in kidney development.

It is appreciated that the abovementioned animal model for PAX2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sanyanusin, P.; Schimmenti, L. A.; McNoe, L. A.; Ward, T. A.; Pierpont, M. E. M.; Sullivan, M. J.; Dobyns, W. B.; Eccles, M. R.: Mutation of the PAX2 gene in a family with optic nerve colobomas, renal anomalies and vesicoureteral reflux. Nature Genet. 9:358-364, 1995; and Porteous, S.; Torban, E.; Cho, N.-P.; Cunliffe, H.; Chua, L.; McNoe, L.; Ward, T.; Souza, C.; Gus, P.; Giugliani, R.; Sato, T.; Yun, K.; Favor, J.; Sicotte, M.; Goodyer, P.; Eccles, M.

Further studies establishing the function and utilities of PAX2 are found in John Hopkins OMIM database record ID 167409, and in cited publications listed in Table 5, which are hereby incorporated by reference. Paired box gene 2 (PAX2, Accession NP_003979.1) is another GAM47 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:5547, to the nucleotide sequence of GAM47 RNA, herein designated GAM RNA, also designated SEQ ID:269.

Another function of GAM47 is therefore inhibition of Paired box gene 2 (PAX2, Accession NP_003979.1), a gene which involves in kidney cell differentiation and therefore is associated with Renal-coloboma syndrome. Accordingly, utilities of GAM47 include diagnosis, prevention and treatment of Renal-coloboma syndrome, and of other diseases and clinical conditions associated with PAX2.

The function of PAX2 has been established by previous studies. Sanyanusin et al. (1996) obtained the complete genomic structure of the human PAX2 gene. They described 5 genomic lambda clones containing human PAX2 gene sequences, 4 of which had previously been reported by them (Sanyanusin et al., 1995). The fifth clone, which included exons 7 and 8, was obtained by Sanyanusin et al. (1996) from a subgenomic lambda cDNA library of size- fractionated EcoRI fragments ranging in size from 6 to 8 kb. Sequencing and restriction mapping of these clones showed that the human PAX2 gene is composed of 12 exons spanning approximately 70 kb. They also found 2 alternatively spliced exons corresponding to exon 10 (Ward et al., 1994) and a 69-bp inserted sequence that they designated as exon 6. The 69-bp insert is homologous to a 69-bp insert reported in the murine Pax2 gene by Dressler et al. (1990). Sanyanusin et al. (1996) identified a (CA)n dinucleotide repeat polymorphism in PAX2 which they mapped immediately upstream of exon 9. The PAX2 gene is expressed in primitive cells of the kidney, ureter, ey, ear, and central nervous system. Based on the known expression pattern of PAX2, Sanyanusin et al. (1995) predicted that the phenotype caused by mutations of PAX2 would probably consist of autosomal dominant eye malformations, sensorineural hearing loss, and renal hypoplasia. Pursuing this suspicion, they found deletion of a single nucleotide in exon 5 of the PAX2 gene (167409.0001) in a father and 3 of his 5 sons who had optic nerve colobomas, renal hypoplasia, mild proteinuria, and vesicoureteral reflux. The nucleotide deletion caused a frameshift in the conserved octapeptide sequence. The phenotype was similar to that of Krd mutant mice which lack a portion of chromosome 19 that is homologous to human 10q24 and includes the Pax2 gene. These mice have reduced thickness of the renal cortex, a reduced number of glomeruli at birth, and reduced amplitudes on electroretinogram. In the Krd mouse, the deletion of chromosome 19 was transgene-induced (Keller et al., 1994). Coloboma of the optic nerve with renal disease (OMIM Ref. No. 120330) is a recognized syndrome. Renal dysplasia and retinal aplasia are combined in the Loken-Senior syndrome (OMIM Ref. No. 266900). Ocular abnormalities occur also with familial juvenile nephronophthisis (OMIM Ref. No. 256100), but that disorder maps to chromosome 2.

Animal model experiments lend further support to the function of PAX2. To determine the direct effects of PAX2 mutations on kidney development, fetal kidneys of mice carrying a Pax2(1Neu) mutation were examined. At embryonic day 15 (E15), heterozygous mutant kidneys were approximately 60% the size of those of wildtype littermates, and the number of nephrons was strikingly reduced. Heterozygous mutant mice showed increased apoptotic cell death during fetal kidney development, but the increased apoptosis was not associated with random stochastic inactivation of Pax2 expression in mutant kidneys; Pax2 was shown to be biallelically expressed during kidney development. The findings supported the conclusion that heterozygous mutations of the PAX2 gene are associated with increased apoptosis and reduced branching of the ureteric bud, due to reduced PAX2 dosage during a critical window in kidney development.

It is appreciated that the abovementioned animal model for PAX2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sanyanusin, P.; Schimmenti, L. A.; McNoe, L. A.; Ward, T. A.; Pierpont, M. E. M.; Sullivan, M. J.; Dobyns, W. B.; Eccles, M. R.: Mutation of the PAX2 gene in a family with optic nerve colobomas, renal anomalies and vesicoureteral reflux. Nature Genet. 9:358-364, 1995; and Porteous, S.; Torban, E.; Cho, N.-P.; Cunliffe, H.; Chua, L.; McNoe, L.; Ward, T.; Souza, C.; Gus, P.; Giugliani, R.; Sato, T.; Yun, K.; Favor, J.; Sicotte, M.; Goodyer, P.; Eccles, M.

Further studies establishing the function and utilities of PAX2 are found in John Hopkins OMIM database record ID 167409, and in cited publications listed in Table 5, which are hereby incorporated by reference. Paired box gene 2 (PAX2, Accession NP_003981.1) is another GAM47 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:5547, to the nucleotide sequence of GAM47 RNA, herein designated GAM RNA, also designated SEQ ID:269.

Another function of GAM47 is therefore inhibition of Paired box gene 2 (PAX2, Accession NP_003981.1), a gene which involves in kidney cell differentiation and therefore is associated with Renal-coloboma syndrome. Accordingly, utilities of GAM47 include diagnosis, prevention and treatment of Renal-coloboma syndrome, and of other diseases and clinical conditions associated with PAX2.

The function of PAX2 has been established by previous studies. Sanyanusin et al. (1996) obtained the complete genomic structure of the human PAX2 gene. They described 5 genomic lambda clones containing human PAX2 gene sequences, 4 of which had previously been reported by them (Sanyanusin et al., 1995). The fifth clone, which included exons 7 and 8, was obtained by Sanyanusin et al. (1996) from a subgenomic lambda cDNA library of size- fractionated EcoRI fragments ranging in size from 6 to 8 kb. Sequencing and restriction mapping of these clones showed that the human PAX2 gene is composed of 12 exons spanning approximately 70 kb. They also found 2 alternatively spliced exons corresponding to exon 10 (Ward et al., 1994) and a 69-bp inserted sequence that they designated as exon 6. The 69-bp insert is homologous to a 69-bp insert reported in the murine Pax2 gene by Dressler et al. (1990). Sanyanusin et al. (1996) identified a (CA)n dinucleotide repeat polymorphism in PAX2 which they mapped immediately upstream of exon 9. The PAX2 gene is expressed in primitive cells of the kidney, ureter, ey, ear, and central nervous system. Based on the known expression pattern of PAX2, Sanyanusin et al. (1995) predicted that the phenotype caused by mutations of PAX2 would probably consist of autosomal dominant eye malformations, sensorineural hearing loss, and renal hypoplasia. Pursuing this suspicion, they found deletion of a single nucleotide in exon 5 of the PAX2 gene (167409.0001) in a father and 3 of his 5 sons who had optic nerve colobomas, renal hypoplasia, mild proteinuria, and vesicoureteral reflux. The nucleotide deletion caused a frameshift in the conserved octapeptide sequence. The phenotype was similar to that of Krd mutant mice which lack a portion of chromosome 19 that is homologous to human 10q24 and includes the Pax2 gene. These mice have reduced thickness of the renal cortex, a reduced number of glomeruli at birth, and reduced amplitudes on electroretinogram. In the Krd mouse, the deletion of chromosome 19 was transgene-induced (Keller et al., 1994). Coloboma of the optic nerve with renal disease (OMIM Ref. No. 120330) is a recognized syndrome. Renal dysplasia and retinal aplasia are combined in the Loken-Senior syndrome (OMIM Ref. No. 266900). Ocular abnormalities occur also with familial juvenile nephronophthisis (OMIM Ref. No. 256100), but that disorder maps to chromosome 2.

Animal model experiments lend further support to the function of PAX2. To determine the direct effects of PAX2 mutations on kidney development, fetal kidneys of mice carrying a Pax2(1Neu) mutation were examined. At embryonic day 15 (E15), heterozygous mutant kidneys were approximately 60% the size of those of wildtype littermates, and the number of nephrons was strikingly reduced. Heterozygous mutant mice showed increased apoptotic cell death during fetal kidney development, but the increased apoptosis was not associated with random stochastic inactivation of Pax2 expression in mutant kidneys; Pax2 was shown to be biallelically expressed during kidney development. The findings supported the conclusion that heterozygous mutations of the PAX2 gene are associated with increased apoptosis and reduced branching of the ureteric bud, due to reduced PAX2 dosage during a critical window in kidney development.

It is appreciated that the abovementioned animal model for PAX2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sanyanusin, P.; Schimmenti, L. A.; McNoe, L. A.; Ward, T. A.; Pierpont, M. E. M.; Sullivan, M. J.; Dobyns, W. B.; Eccles, M. R.: Mutation of the PAX2 gene in a family with optic nerve colobomas, renal anomalies and vesicoureteral reflux. Nature Genet. 9:358-364, 1995; and Porteous, S.; Torban, E.; Cho, N.-P.; Cunliffe, H.; Chua, L.; McNoe, L.; Ward, T.; Souza, C.; Gus, P.; Giugliani, R.; Sato, T.; Yun, K.; Favor, J.; Sicotte, M.; Goodyer, P.; Eccles, M.

Further studies establishing the function and utilities of PAX2 are found in John Hopkins OMIM database record ID 167409, and in cited publications listed in Table 5, which are hereby incorporated by reference. Paired box gene 2 (PAX2, Accession NP_003978.1) is another GAM47 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:5547, to the nucleotide sequence of GAM47 RNA, herein designated GAM RNA, also designated SEQ ID:269.

Another function of GAM47 is therefore inhibition of Paired box gene 2 (PAX2, Accession NP_003978.1), a gene which involves in kidney cell differentiation and therefore is associated with Renal-coloboma syndrome. Accordingly, utilities of GAM47 include diagnosis, prevention and treatment of Renal-coloboma syndrome, and of other diseases and clinical conditions associated with PAX2.

The function of PAX2 has been established by previous studies. Sanyanusin et al. (1996) obtained the complete genomic structure of the human PAX2 gene. They described 5 genomic lambda clones containing human PAX2 gene sequences, 4 of which had previously been reported by them (Sanyanusin et al., 1995). The fifth clone, which included exons 7 and 8, was obtained by Sanyanusin et al. (1996) from a subgenomic lambda cDNA library of size- fractionated EcoRI fragments ranging in size from 6 to 8 kb. Sequencing and restriction mapping of these clones showed that the human PAX2 gene is composed of 12 exons spanning approximately 70 kb. They also found 2 alternatively spliced exons corresponding to exon 10 (Ward et al., 1994) and a 69-bp inserted sequence that they designated as exon 6. The 69-bp insert is homologous to a 69-bp insert reported in the murine Pax2 gene by Dressler et al. (1990). Sanyanusin et al. (1996) identified a (CA)n dinucleotide repeat polymorphism in PAX2 which they mapped immediately upstream of exon 9. The PAX2 gene is expressed in primitive cells of the kidney, ureter, ey, ear, and central nervous system. Based on the known expression pattern of PAX2, Sanyanusin et al. (1995) predicted that the phenotype caused by mutations of PAX2 would probably consist of autosomal dominant eye malformations, sensorineural hearing loss, and renal hypoplasia. Pursuing this suspicion, they found deletion of a single nucleotide in exon 5 of the PAX2 gene (167409.0001) in a father and 3 of his 5 sons who had optic nerve colobomas, renal hypoplasia, mild proteinuria, and vesicoureteral reflux. The nucleotide deletion caused a frameshift in the conserved octapeptide sequence. The phenotype was similar to that of Krd mutant mice which lack a portion of chromosome 19 that is homologous to human 10q24 and includes the Pax2 gene. These mice have reduced thickness of the renal cortex, a reduced number of glomeruli at birth, and reduced amplitudes on electroretinogram. In the Krd mouse, the deletion of chromosome 19 was transgene-induced (Keller et al., 1994). Coloboma of the optic nerve with renal disease (OMIM Ref. No. 120330) is a recognized syndrome. Renal dysplasia and retinal aplasia are combined in the Loken-Senior syndrome (OMIM Ref. No. 266900). Ocular abnormalities occur also with familial juvenile nephronophthisis (OMIM Ref. No. 256100), but that disorder maps to chromosome 2.

Animal model experiments lend further support to the function of PAX2. To determine the direct effects of PAX2 mutations on kidney development, fetal kidneys of mice carrying a Pax2(1Neu) mutation were examined. At embryonic day 15 (E15), heterozygous mutant kidneys were approximately 60% the size of those of wildtype littermates, and the number of nephrons was strikingly reduced. Heterozygous mutant mice showed increased apoptotic cell death during fetal kidney development, but the increased apoptosis was not associated with random stochastic inactivation of Pax2 expression in mutant kidneys; Pax2 was shown to be biallelically expressed during kidney development. The findings supported the conclusion that heterozygous mutations of the PAX2 gene are associated with increased apoptosis and reduced branching of the ureteric bud, due to reduced PAX2 dosage during a critical window in kidney development.

It is appreciated that the abovementioned animal model for PAX2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sanyanusin, P.; Schimmenti, L. A.; McNoe, L. A.; Ward, T. A.; Pierpont, M. E. M.; Sullivan, M. J.; Dobyns, W. B.; Eccles, M. R.: Mutation of the PAX2 gene in a family with optic nerve colobomas, renal anomalies and vesicoureteral reflux. Nature Genet. 9:358-364, 1995; and Porteous, S.; Torban, E.; Cho, N.-P.; Cunliffe, H.; Chua, L.; McNoe, L.; Ward, T.; Souza, C.; Gus, P.; Giugliani, R.; Sato, T.; Yun, K.; Favor, J.; Sicotte, M.; Goodyer, P.; Eccles, M.

Further studies establishing the function and utilities of PAX2 are found in John Hopkins OMIM database record ID 167409, and in cited publications listed in Table 5, which are hereby incorporated by reference. Paired box gene 2 (PAX2, Accession NP_000269.1) is another GAM47 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:5547, to the nucleotide sequence of GAM47 RNA, herein designated GAM RNA, also designated SEQ ID:269.

Another function of GAM47 is therefore inhibition of Paired box gene 2 (PAX2, Accession NP_000269.1), a gene which involves in kidney cell differentiation and therefore is associated with Renal-coloboma syndrome. Accordingly, utilities of GAM47 include diagnosis, prevention and treatment of Renal-coloboma syndrome, and of other diseases and clinical conditions associated with PAX2.

The function of PAX2 has been established by previous studies. Sanyanusin et al. (1996) obtained the complete genomic structure of the human PAX2 gene. They described 5 genomic lambda clones containing human PAX2 gene sequences, 4 of which had previously been reported by them (Sanyanusin et al., 1995). The fifth clone, which included exons 7 and 8, was obtained by Sanyanusin et al. (1996) from a subgenomic lambda cDNA library of size- fractionated EcoRI fragments ranging in size from 6 to 8 kb. Sequencing and restriction mapping of these clones showed that the human PAX2 gene is composed of 12 exons spanning approximately 70 kb. They also found 2 alternatively spliced exons corresponding to exon 10 (Ward et al., 1994) and a 69-bp inserted sequence that they designated as exon 6. The 69-bp insert is homologous to a 69-bp insert reported in the murine Pax2 gene by Dressler et al. (1990). Sanyanusin et al. (1996) identified a (CA)n dinucleotide repeat polymorphism in PAX2 which they mapped immediately upstream of exon 9. The PAX2 gene is expressed in primitive cells of the kidney, ureter, ey, ear, and central nervous system. Based on the known expression pattern of PAX2, Sanyanusin et al. (1995) predicted that the phenotype caused by mutations of PAX2 would probably consist of autosomal dominant eye malformations, sensorineural hearing loss, and renal hypoplasia. Pursuing this suspicion, they found deletion of a single nucleotide in exon 5 of the PAX2 gene (167409.0001) in a father and 3 of his 5 sons who had optic nerve colobomas, renal hypoplasia, mild proteinuria, and vesicoureteral reflux. The nucleotide deletion caused a frameshift in the conserved octapeptide sequence. The phenotype was similar to that of Krd mutant mice which lack a portion of chromosome 19 that is homologous to human 10q24 and includes the Pax2 gene. These mice have reduced thickness of the renal cortex, a reduced number of glomeruli at birth, and reduced amplitudes on electroretinogram. In the Krd mouse, the deletion of chromosome 19 was transgene-induced (Keller et al., 1994). Coloboma of the optic nerve with renal disease (OMIM Ref. No. 120330) is a recognized syndrome. Renal dysplasia and retinal aplasia are combined in the Loken-Senior syndrome (OMIM Ref. No. 266900). Ocular abnormalities occur also with familial juvenile nephronophthisis (OMIM Ref. No. 256100), but that disorder maps to chromosome 2.

Animal model experiments lend further support to the function of PAX2. To determine the direct effects of PAX2 mutations on kidney development, fetal kidneys of mice carrying a Pax2(1Neu) mutation were examined. At embryonic day 15 (E15), heterozygous mutant kidneys were approximately 60% the size of those of wildtype littermates, and the number of nephrons was strikingly reduced. Heterozygous mutant mice showed increased apoptotic cell death during fetal kidney development, but the increased apoptosis was not associated with random stochastic inactivation of Pax2 expression in mutant kidneys; Pax2 was shown to be biallelically expressed during kidney development. The findings supported the conclusion that heterozygous mutations of the PAX2 gene are associated with increased apoptosis and reduced branching of the ureteric bud, due to reduced PAX2 dosage during a critical window in kidney development.

It is appreciated that the abovementioned animal model for PAX2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sanyanusin, P.; Schimmenti, L. A.; McNoe, L. A.; Ward, T. A.; Pierpont, M. E. M.; Sullivan, M. J.; Dobyns, W. B.; Eccles, M. R.: Mutation of the PAX2 gene in a family with optic nerve colobomas, renal anomalies and vesicoureteral reflux. Nature Genet. 9:358-364, 1995; and Porteous, S.; Torban, E.; Cho, N.-P.; Cunliffe, H.; Chua, L.; McNoe, L.; Ward, T.; Souza, C.; Gus, P.; Giugliani, R.; Sato, T.; Yun, K.; Favor, J.; Sicotte, M.; Goodyer, P.; Eccles, M.

Further studies establishing the function and utilities of PAX2 are found in John Hopkins OMIM database record ID 167409, and in cited publications listed in Table 5, which are hereby incorporated by reference. Pre-b-cell leukemia transcription factor 1 (PBX1, Accession NP_002576.1) is another GAM47 target gene, herein designated TARGET GENE. PBX1 BINDING SITE1 and PBX1 BINDING SITE2 are target binding sites found in untranslated regions of mRNA encoded by PBX1, corresponding to target binding sites such as BINDING SITE I, BINDING SITE II or BINDING SITE III of FIG. 8. Table 4 illustrates the complementarity of the nucleotide sequences of PBX1 BINDING SITE1 and PBX1 BINDING SITE2, designated SEQ ID:8409 and SEQ ID:18068 respectively, to the nucleotide sequence of GAM47 RNA, herein designated GAM RNA, also designated SEQ ID:269.

Another function of GAM47 is therefore inhibition of Pre-b-cell leukemia transcription factor 1 (PBX1, Accession NP_002576.1), a gene which involves in steroidogenesis and subsequently sexual development and differentiation and therefore is associated with Pre-b-cell acute lymphoblastic leukemias. Accordingly, utilities of GAM47 include diagnosis, prevention and treatment of Pre-b-cell acute lymphoblastic leukemias, and of other diseases and clinical conditions associated with PBX1.

The function of PBX1 has been established by previous studies. Kamps et al. (1991) discussed the chimeric genes created by the human t(1;19) translocation in pre-B-cell acute lymphoblastic leukemias. The authors cloned 2 different E2A-PBX1 fusion transcripts (which differed only in the PBX1 sequences they contained) and showed that NIH-3T3 cells transfected with cDNAs encoding the fusion proteins were able to cause malignant tumors in nude mice. They discussed subtle differences in the transforming ability of the 2 fusion proteins with respect to the regions of the PBX1 gene they contained.

Animal model experiments lend further support to the function of PBX1. In vitro studies have shown that PBX1 regulates the activity of IPF1, a Para-Hox homeodomain transcription factor required for the development and function of the pancreas in mice and humans. To investigate in vivo roles of PBX1 in pancreatic development and function, Kim et al. (2002) examined pancreatic Pbx1 expression, and morphogenesis, cell differentiation, and function in mice deficient for Pbx1. Pbx1 -/- embryos had pancreatic hypoplasia and marked defects in exocrine and endocrine cell differentiation prior to death at embryonic day 15 or 16. In these embryos, expression of Isl1 (OMIM Ref. No. 600366) and Atoh5 (OMIM Ref. No. 604882), essential regulators of pancreatic morphogenesis and differentiation, was severely reduced. Pbx1 +/- adults had pancreatic islet malformations, impaired glucose tolerance, and hypoinsulinemia. Thus, Kim et al. (2002) concluded that PBX1 is essential for normal pancreatic development and function. Analysis of trans-heterozygous Pbx1 +/- and Ipf1 +/- mice revealed in vivo genetic interactions between Pbx1 and Ipf1 that are essential for postnatal pancreatic function. Trans-heterozygous mice developed age-dependent overt diabetes mellitus, unlike Pbx1 +/- or Ipf1 +/- mice. Mutations affecting the Ipf1 protein promote diabetes mellitus in mice and humans. Kim et al. (2002) concluded that perturbation of PBX1 activity may also promote susceptibility to diabetes mellitus.

It is appreciated that the abovementioned animal model for PBX1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kamps, M. P.; Look, A. T.; Baltimore, D.: The human t(1:19) translocation in pre-B ALL produces multiple nuclear E2A-Pbx1 fusion proteins with differing transforming potentials. Genes Dev. 5:358-368, 1991; and Kim, S. K.; Selleri, L.; Lee, J. S.; Zhang, A. Y.; Gu, X.; Jacobs, Y.; Cleary, M. L.: Pbx1 inactivation disrupts pancreas development and in Ipf1- deficient mice promotes diabetes mellit.

Further studies establishing the function and utilities of PBX1 are found in John Hopkins OMIM database record ID 176310, and in cited publications listed in Table 5, which are hereby incorporated by reference. Bh-protocadherin (brain-heart) (PCDH7, Accession NP_115833.1) is another GAM47 target gene, herein designated TARGET GENE. PCDH7 BINDING SITE is a target binding site found in the 3' untranslated region of multiple transcripts of mRNA encoded by PCDH7, corresponding to a target binding site such as BINDING SITE I, BINDING SITE II or BINDING SITE III of FIG. 8. Table 4 illustrates the complementarity of the nucleotide sequences of PCDH7 BINDING SITE, designated SEQ ID:7631, to the nucleotide sequence of GAM47 RNA, herein designated GAM RNA, also designated SEQ ID:269.

Another function of GAM47 is therefore inhibition of Bh-protocadherin (brain-heart) (PCDH7, Accession NP_115833.1). Accordingly, utilities of GAM47 include diagnosis, prevention and treatment of diseases and clinical conditions associated with PCDH7.

Phosphodiesterase 4b, camp-specific (phosphodiesterase e4 dunce homolog, drosophila) (PDE4B, Accession NP_002591.1) is another GAM47 target gene, herein designated TARGET GENE. PDE4B BINDING SITE is a target binding site found in the 5' untranslated region of mRNA encoded by PDE4B, corresponding to a target binding site such as BINDING SITE I, BINDING SITE II or BINDING SITE III of FIG. 8. Table 4 illustrates the complementarity of the nucleotide sequences of PDE4B BINDING SITE, designated SEQ ID:19366, to the nucleotide sequence of GAM47 RNA, herein designated GAM RNA, also designated SEQ ID:269.

Another function of GAM47 is therefore inhibition of Phosphodiesterase 4b, camp-specific (phosphodiesterase e4 dunce homolog, drosophila) (PDE4B, Accession NP_002591.1), a gene which may be involved in mediating central nervous system effects of therapeutic agents ranging from antidepressants to antiasthmatic and anti-inflammatory agents. Accordingly, utilities of GAM47 include diagnosis, prevention and treatment of diseases and clinical conditions associated with PDE4B.

The function of PDE4B and its association with various diseases and clinical conditions, has been established by previous studies, as described hereinabove with reference to GAM31.1. Phosphodiesterase 4d interacting protein (myomegalin) (PDE4DIP, Accession NP_055459.1) is another GAM47 target gene, herein designated TARGET GENE. PDE4DIP BINDING SITE is a target binding site found in the 3' untranslated region of mRNA encoded by PDE4DIP, corresponding to a target binding site such as BINDING SITE I, BINDING SITE II or BINDING SITE III of FIG. 8. Table 4 illustrates the complementarity of the nucleotide sequences of PDE4DIP BINDING SITE, designated SEQ ID:18790, to the nucleotide sequence of GAM47 RNA, herein designated GAM RNA, also designated SEQ ID:269.

Another function of GAM47 is therefore inhibition of Phosphodiesterase 4d interacting protein (myomegalin) (PDE4DIP, Accession NP_055459.1). Accordingly, utilities of GAM47 include diagnosis, prevention and treatment of diseases and clinical conditions associated with PDE4DIP.

PDZK3 (Accession NP_055837.2) is another GAM47 target gene, herein designated TARGET GENE. PDZK3 BINDING SITE is a target binding site found in the 3' untranslated region of multiple transcripts of mRNA encoded by PDZK3, corresponding to a target binding site such as BINDING SITE I, BINDING SITE II or BINDING SITE III of FIG. 8. Table 4 illustrates the complementarity of the nucleotide sequences of PDZK3 BINDING SITE, designated SEQ ID:13259, to the nucleotide sequence of GAM47 RNA, herein designated GAM RNA, also designated SEQ ID:269.

Another function of GAM47 is therefore inhibition of PDZK3 (Accession NP_055837.2). Accordingly, utilities of GAM47 include diagnosis, prevention and treatment of diseases and clinical conditions associated with PDZK3.

PDZK3 (Accession NP_835260.1) is another GAM47 target gene, herein designated TARGET GENE. PDZK3 BINDING SITE is a target binding site found in the 3' untranslated region of multiple transcripts of mRNA encoded by PDZK3, corresponding to a target binding site such as BINDING SITE I, BINDING SITE II or BINDING SITE III of FIG. 8. Table 4 illustrates the complementarity of the nucleotide sequences of PDZK3 BINDING SITE, designated SEQ ID:13259, to the nucleotide sequence of GAM47 RNA, herein designated GAM RNA, also designated SEQ ID:269.

Another function of GAM47 is therefore inhibition of PDZK3 (Accession NP_835260.1). Accordingly, utilities of GAM47 include diagnosis, prevention and treatment of diseases and clinical conditions associated with PDZK3.

Phosphoprotein enriched in astrocytes 15 (PEA15, Accession NP_003759.1) is another GAM47 target gene, herein designated TARGET GENE. PEA15 BINDING SITE is a target binding site found in the 3' untranslated region of mRNA encoded by PEA15, corresponding to a target binding site such as BINDING SITE I, BINDING SITE II or BINDING SITE III of FIG. 8. Table 4 illustrates the complementarity of the nucleotide sequences of PEA15 BINDING SITE, designated SEQ ID:5427, to the nucleotide sequence of GAM47 RNA, herein designated GAM RNA, also designated SEQ ID:269.

Another function of GAM47 is therefore inhibition of Phosphoprotein enriched in astrocytes 15 (PEA15, Accession NP_003759.1), a gene which is a phosphoprotein and involved in glucose uptake. Accordingly, utilities of GAM47 include diagnosis, prevention and treatment of diseases and clinical conditions associated with PEA15.

The function of PEA15 has been established by previous studies. Astrocytes are involved in a variety of functions, including storage of glycogen and support for the migration and differentiation of neurons. They express membrane receptors which allow them to respond to extracellular signals. Activation of the receptors induces a cascade of events, such as the stimulation of protein kinases and the subsequent phosphorylation of target proteins. Araujo et al. (1993) identified a unique 15-kD protein in astrocytes that exists as a nonphosphorylated form and as 2 increasingly phosphorylated varieties. This protein, which they called PEA15, contains a consensus site for protein kinase C (PKC; e.g., 176960) and is an endogenous substrate for PKC. Using differential display to identify genes whose expressions are altered in tissues derived from type II diabetes mellitus (OMIM Ref. No. 125853) patients compared with nondiabetic individuals, Condorelli et al. (1998) cloned cDNAs encoding PEA15, which they named PED for 'phosphoprotein enriched in diabetes'. The ubiquitously expressed 2.8-kb PED mRNA was overexpressed in fibroblasts, skeletal muscle, and adipose tissue from type II diabetics. Levels of the 15-kD PED phosphoprotein were also elevated in type II diabetic tissues. The authors demonstrated that transfection of a PED cDNA into differentiating L6 skeletal muscle cells increases the content of glucose transporter-1 (GLUT1; 138140) on the plasma membrane and inhibits insulin-stimulated glucose transport and cell surface recruitment of glucose transporter-4 (GLUT4; 138190). These effects were reversed by blocking PKC activity.

Full details of the abovementioned studies are described in the following publications, the disclosure of which are hereby incorporated by reference:

Araujo, H.; Danziger, N.; Cordier, J.; Glowinski, J.; Chneiweiss, H.: Characterization of PEA-15, a major substrate for protein kinase C in astrocytes. J. Biol. Chem. 268:5911-5920, 1993; and Condorelli, G.; Vigliotta, G.; Iavarone, C.; Caruso, M.; Tocchetti, C. G.; Andreozzi, F.; Cafieri, A.; Tecce, M. F.; Formisano, P.; Beguinot, L.; Beguinot, F.: PED/PEA-15 gene controls.

Further studies establishing the function and utilities of PEA15 are found in John Hopkins OMIM database record ID 603434, and in cited publications listed in Table 5, which are hereby incorporated by reference. Peroxisome biogenesis factor 1 (PEX1, Accession NP_000457.1) is another GAM47 target gene, herein designated TARGET GENE. PEX1 BINDING SITE is a target binding site found in the 3' untranslated region of mRNA encoded by PEX1, corresponding to a target binding site such as BINDING SITE I, BINDING SITE II or BINDING SITE III of FIG. 8. Table 4 illustrates the complementarity of the nucleotide sequences of PEX1 BINDING SITE, designated SEQ ID:19226, to the nucleotide sequence of GAM47 RNA, herein designated GAM RNA, also designated SEQ ID:269.

Another function of GAM47 is therefore inhibition of Peroxisome biogenesis factor 1 (PEX1, Accession NP_000457.1). Accordingly, utilities of GAM47 include diagnosis, prevention and treatment of diseases and clinical conditions associated with PEX1.

6-phosphofructo -2-kinase/fructose-2,6-biphosphatase 3 (PFKFB3, Accession NP_004557.1) is another GAM47 target gene, herein designated TARGET GENE. PFKFB3 BINDING SITE is a target binding site found in the 3' untranslated region of mRNA encoded by PFKFB3, corresponding to a target binding site such as BINDING SITE I, BINDING SITE II or BINDING SITE III of FIG. 8. Table 4 illustrates the complementarity of the nucleotide sequences of PFKFB3 BINDING SITE, designated SEQ ID:12032, to the nucleotide sequence of GAM47 RNA, herein designated GAM RNA, also designated SEQ ID:269.

Another function of GAM47 is therefore inhibition of 6-phosphofructo -2-kinase/fructose-2,6-biphosphatase 3 (PFKFB3, Accession NP_004557.1), a gene which catalyzes synthesis and degradation of fructose 2,6-bisphosphate. Accordingly, utilities of GAM47 include diagnosis, prevention and treatment of diseases and clinical conditions associated with PFKFB3.

The function of PFKFB3 has been established by previous studies. The bifunctional 6-phosphofructo -2-kinase (EC 2.7.1.105)/fructose-2,6-bisphosphatase (EC 3.1.3.46) (PFKFB) regulates the steady-state concentration of fructose-2,6-bisphosphate, a potent activator of a key regulatory enzyme of glycolysis, phosphofructokinase. Cancer cells maintain a high glycolytic rate even in the presence of oxygen, a phenomenon known as the Warburg effect (Warburg, 1956). The glycolytic rate in the placenta, another fast-growing tissue, is accelerated by anoxia and by maternal diabetes By screening a placental cDNA library with human and frog liver PFKFB (PFKFB1; 311790) as probes, Sakai et al. (1996) obtained a cDNA encoding PFKFB3, which they termed HP (human placental PFKFB). The predicted PFKFB3 protein, which is 61% similar to human liver PFKFB, contains 529 amino acids and 7 potential phosphorylation sites. Northern blot analysis of first-trimester and term placentas detected a 4.5-kb PFKFB3 transcript Full details of the abovementioned studies are described in the following publications, the disclosure of which are hereby incorporated by reference:

Sakai, A.; Kato, M.; Fukasawa, M.; Ishiguro, M.; Furuy, E.; Sakakibara, R.: Cloning of cDNA encoding for a novel isozyme of fructose 6-phosphate,2-kinase/fructose 2,6-bisphosphatase from human placenta. J. Biochem. 119:506-511, 1996; and Warburg, O.: On the origin of cancer cells. Science 123: 309-314, 1956.

Further studies establishing the function and utilities of PFKFB3 are found in John Hopkins OMIM database record ID 605319, and in cited publications listed in Table 5, which are hereby incorporated by reference.6-phosphofructo -2-kinase/fructose-2,6-biphosphatase 4 (PFKFB4, Accession NP_004558.1) is another GAM47 target gene, herein designated TARGET GENE. PFKFB4 BINDING SITE is a target binding site found in the 3' untranslated region of mRNA encoded by PFKFB4, corresponding to a target binding site such as BINDING SITE I, BINDING SITE II or BINDING SITE III of FIG. 8. Table 4 illustrates the complementarity of the nucleotide sequences of PFKFB4 BINDING SITE, designated SEQ ID:14338, to the nucleotide sequence of GAM47 RNA, herein designated GAM RNA, also designated SEQ ID:269.

Another function of GAM47 is therefore inhibition of 6-phosphofructo -2-kinase/fructose-2,6-biphosphatase 4 (PFKFB4, Accession NP_004558.1), a gene which catalyzes synthesis and degradation of fructose 2,6-bisphosphate. Accordingly, utilities of GAM47 include diagnosis, prevention and treatment of diseases and clinical conditions associated with PFKFB4.

The function of PFKFB4 has been established by previous studies. The bifunctional 6-phosphofructo -2-kinase (EC 2.7.1.105)/fructose-2,6-bisphosphatase (EC 3.1.3.46) (PFKFB) regulates the steady-state concentration of fructose-2,6-bisphosphate, a potent activator of a key regulatory enzyme of glycolysis, phosphofructokinase. Isozymes of PFKFB differ in the regions surrounding the catalytic core, which are important for the differential response to allosteric effectors and hormonal signals in different tissues By screening a placental cDNA library with human and frog liver PFKFB (PFKFB1; 311790) as probes, Sakai et al. (1996) obtained a partial cDNA encoding PFKFB4, which they termed 2K-1. Manzano et al. (1999) isolated a cDNA encoding PFKFB4 by screening a human testis cDNA library with a rat liver Pfkfb probe, followed by RT-PCR. The predicted 469-amino acid PFKFB4 protein, which is 97% homologous to the rat sequence and approximately 70% identical to the human PFKFB isoforms, contains multiple phosphorylation sites. Northern blot analysis of rat brain, heart, liver, muscle, placenta, adipose tissue, ovary, fallopian tubes, and testis with the human PFKFB4 sequence as probe detected testis-specific expression of 2.4- and 3.3-kb transcripts. Western blot analysis showed expression of a 55-kD protein, close to the predicted value.

Full details of the abovementioned studies are described in the following publications, the disclosure of which are hereby incorporated by reference:

Sakai, A.; Kato, M.; Fukasawa, M.; Ishiguro, M.; Furuy, E.; Sakakibara, R.: Cloning of cDNA encoding for a novel isozyme of fructose 6-phosphate,2-kinase/fructose 2,6-bisphosphatase from human placenta. J. Biochem. 119:506-511, 1996; and Manzano, A.; Perez, J. X.; Nadal, M.; Estivill, X.; Lange, A.; Bartrons, R.: Cloning, expression and chromosomal localization of a human testis 6-phosphofructo -2-kinase/fructose-2,6-bis.

Further studies establishing the function and utilities of PFKFB4 are found in John Hopkins OMIM database record ID 605320, and in cited publications listed in Table 5, which are hereby incorporated by reference. Pftaire protein kinase 1 (PFTK1, Accession NP_036527.1) is another GAM47 target gene, herein designated TARGET GENE. PFTK1 BINDING SITE is a target binding site found in the 3' untranslated region of mRNA encoded by PFTK1, corresponding to a target binding site such as BINDING SITE I, BINDING SITE II or BINDING SITE III of FIG. 8. Table 4 illustrates the complementarity of the nucleotide sequences of PFTK1 BINDING SITE, designated SEQ ID:10701, to the nucleotide sequence of GAM47 RNA, herein designated GAM RNA, also designated SEQ ID:269.

Another function of GAM47 is therefore inhibition of Pftaire protein kinase 1 (PFTK1, Accession NP_036527.1). Accordingly, utilities of GAM47 include diagnosis, prevention and treatment of diseases and clinical conditions associated with PFTK1.

PHGDHL1 (Accession NP_808882.1) is another GAM47 target gene, herein designated TARGET GENE. PHGDHL1 BINDING SITE is a target binding site found in the 3' untranslated region of mRNA encoded by PHGDHL1, corresponding to a target binding site such as BINDING SITE I, BINDING SITE II or BINDING SITE III of FIG. 8. Table 4 illustrates the complementarity of the nucleotide sequences of PHGDHL1 BINDING SITE, designated SEQ ID:14585, to the nucleotide sequence of GAM47 RNA, herein designated GAM RNA, also designated SEQ ID:269.

Another function of GAM47 is therefore inhibition of PHGDHL1 (Accession NP_808882.1). Accordingly, utilities of GAM47 include diagnosis, prevention and treatment of diseases and clinical conditions associated with PHGDHL1.

Phosphatidylinositol glycan, class b (PIGB, Accession NP_004846.3) is another GAM47 target gene, herein designated TARGET GENE. PIGB BINDING SITE is a target binding site found in the 5' untranslated region of mRNA encoded by PIGB, corresponding to a target binding site such as BINDING SITE I, BINDING SITE II or BINDING SITE III of FIG. 8. Table 4 illustrates the complementarity of the nucleotide sequences of PIGB BINDING SITE, designated SEQ ID:10347, to the nucleotide sequence of GAM47 RNA, herein designated GAM RNA, also designated SEQ ID:269.

Another function of GAM47 is therefore inhibition of Phosphatidylinositol glycan, class b (PIGB, Accession NP_004846.3). Accordingly, utilities of GAM47 include diagnosis, prevention and treatment of diseases and clinical conditions associated with PIGB.

PIP5K2C (Accession NP_079055.2) is another GAM47 target gene, herein designated TARGET GENE. PIP5K2C BINDING SITE is a target binding site found in the 3' untranslated region of mRNA encoded by PIP5K2C, corresponding to a target binding site such as BINDING SITE I, BINDING SITE II or BINDING SITE III of FIG. 8. Table 4 illustrates the complementarity of the nucleotide sequences of PIP5K2C BINDING SITE, designated SEQ ID:10143, to the nucleotide sequence of GAM47 RNA, herein designated GAM RNA, also designated SEQ ID:269.

Another function of GAM47 is therefore inhibition of PIP5K2C (Accession NP_079055.2). Accordingly, utilities of GAM47 include diagnosis, prevention and treatment of diseases and clinical conditions associated with PIP5K2C.

Pleiomorphic adenoma gene 1 (PLAG1, Accession NP_002646.1) is another GAM47 target gene, herein designated TARGET GENE. PLAG1 BINDING SITE is a target binding site found in the 3' untranslated region of mRNA encoded by PLAG1, corresponding to a target binding site such as BINDING SITE I, BINDING SITE II or BINDING SITE III of FIG. 8. Table 4 illustrates the complementarity of the nucleotide sequences of PLAG1 BINDING SITE, designated SEQ ID:9631, to the nucleotide sequence of GAM47 RNA, herein designated GAM RNA, also designated SEQ ID:269.

Another function of GAM47 is therefore inhibition of Pleiomorphic adenoma gene 1 (PLAG1, Accession NP_002646.1), a gene which contains a zinc finger domain. Accordingly, utilities of GAM47 include diagnosis, prevention and treatment of diseases and clinical conditions associated with PLAG1.

The function of PLAG1 has been established by previous studies. Pleomorphic adenomas are benign epithelial tumors originating from the major and minor salivary glands (see OMIM Ref. No. 181030). They are characterized by recurrent chromosome translocations; the most common abnormalities involve chromosome 8, with consistent breakpoints at band q12. Kas et al. (1997) described the construction of 2 non-overlapping YAC contigs covering about 75% of human chromosome band 8q12, which spans approximately 9 Mb of genomic DNA and includes a number of known genes such as MOS (OMIM Ref. No. 190060) and LYN (OMIM Ref. No. 165120), as well as novel genes and expressed sequence tags (ESTs). By fluorescence in situ hybridization, the authors determined that the majority of pleomorphic adenoma 8q12 breakpoints clustered within a 2-Mb contig that was mapped to the centromeric region of 8q12 and that was covered by 34 overlapping YAC clones, and tagged by 31 markers with an average spacing of 65 kb. Nine of 11 primary adenomas with 8q12 abnormalities had breakpoints mapping within a 300-kb interval. By searching sequence databases with sequence tagged sites (STSs) located within the 300-kb region, Kas et al. (1997) identified an EST with sequence identity to one of the STSs. Northern blot analysis using this EST detected a 7.5-kb transcript representing pleomorphic adenoma gene-1 (PLAG1). The authors cloned human fetal kidney PLAG1 cDNAs and found that the PLAG1 gene contains 5 exons. Southern blot analysis of DNA from pleomorphic adenomas with t(3;8) detected rearrangements in the 5-prime noncoding region of the PLAG1 gene. Using 5-prime RACE or RT-PCR, the authors generated hybrid transcripts consisting of PLAG1 and beta-1-catenin (CTNNB1; 116806) from every primary tumor analyzed. Northern blot analysis of 3 pleomorphic adenomas with t(3;8) and 1 adenoma with a variant t(8;15) revealed that PLAG1 expression was activated by the translocations in all 4 tumors. Kas et al. (1997) detected the 7.5-kb PLAG1 transcript in normal human fetal lung, fetal liver, and fetal kidney, but not in the corresponding adult tissues, adult salivary gland, or fetal brain; CTNNB1 appeared to be ubiquitously expressed. The deduced PLAG1 protein has 2 potential nuclear localization signals in the N-terminal region, 7 zinc finger domains, and a serine-rich C terminus. Astrom et al. (1999) found overexpression of PLAG1 in 23 of 47 primary benign and malignant pleomorphic adenomas of the salivary glands. In 5 adenomas with a normal karyotype, fusion transcripts were found in 3; PLAG1 and CTNNB1 were fused in 1 case, and in 2 others PLAG1 was fused with the gene encoding transcription elongation factor SII (OMIM Ref. No. 601425). The fusions occurred in the 5-prime non-coding region of PLAG1, leading to exchange of regulatory control elements and, as a consequence, activation of PLAG1 gene expression. Because all of the cases had grossly normal karyotypes, the rearrangements must result from cryptic rearrangements.

Full details of the abovementioned studies are described in the following publications, the disclosure of which are hereby incorporated by reference:

Astrom, A.-K.; Voz, M. L.; Kas, K.; Roijer, E.; Wedell, B.; Mandahl, N.; Van de Ven, W.; Mark, J.; Stenman, G.: Conserved mechanism of PLAG1 activation in salivary gland tumors with and without chromosome 8q12 abnormalities: identification of SII as a new fusion partner gene. Cancer Res. 59:918- 923, 1999; and Kas, K.; Roijer, E.; Voz, M.; Meyen, E.; Stenman, G.; Van de Ven, W. J. M.: A 2-Mb YAC contig and physical map covering the chromosome 8q12 breakpoint cluster region in pleomorphic ad.

Further studies establishing the function and utilities of PLAG1 are found in John Hopkins OMIM database record ID 603026, and in cited publications listed in Table 5, which are hereby incorporated by reference. Phospholipase d1, phophatidylcholine-specific (PLD1, Accession NP_002653.1) is another GAM47 target gene, herein designated TARGET GENE. PLD1 BINDING SITE is a target binding site found in the 3' untranslated region of mRNA encoded by PLD1, corresponding to a target binding site such as BINDING SITE I, BINDING SITE II or BINDING SITE III of FIG. 8. Table 4 illustrates the complementarity of the nucleotide sequences of PLD1 BINDING SITE, designated SEQ ID:5891, to the nucleotide sequence of GAM47 RNA, herein designated GAM RNA, also designated SEQ ID:269.

Another function of GAM47 is therefore inhibition of Phospholipase d1, phophatidylcholine-specific (PLD1, Accession NP_002653.1), a gene which is ADP ribosylation factor-activated phosphatidylcholine-specific phospholipase D1. Accordingly, utilities of GAM47 include diagnosis, prevention and treatment of diseases and clinical conditions associated with PLD1.

The function of PLD1 has been established by previous studies. Phosphatidylcholine (PC)-specific phospholipases D (PLDs) catalyze the hydrolysis of PC to produce phosphatidic acid and choline. A range of agonists acting through G protein-coupled receptors and receptor tyrosine kinases stimulate this hydrolysis. PC- specific PLD activity has been implicated in numerous cellular pathway, including signal transduction, membrane trafficking, and the regulation of mitosis. Using primers specific for an EST that showed similarity to a yeast PC-specific PLD gene, Hammond et al. (1995) performed PCR on HeLa cDNA and then screened a HeLa cDNA library with the PCR product to clone a cDNA encoding PLD1. The 1,072-amino acid protein does not contain previously recognized domain structures and shows no similarity to PLC (see OMIM Ref. No. 600810) or PIGPLD (OMIM Ref. No. 602515). A database search identified homologs in numerous widely disparate organisms, demonstrating that PLD1 is a member of a novel but highly conserved gene family. Expression of PLD1 in insect cells produces a 120-kD protein, matching closely the theoretical size of 124 kD and suggesting that little if any posttranslational processing occurs. The authors showed that recombinant PLD1 activity is located both in the cytoplasm and in association with the membrane; they suggested that PLD1 can exist as a stable soluble protein and that controlled interaction with substrate-containing phospholipid surfaces may be a physiologically important mode of regulation. Hammond et al. (1995) demonstrated that PLD1 is stimulated by phosphatidylinositol 4,5-biphosphate and strongly inhibited by oleate in vitro. They found that ADP-ribosylation factor-1 (ARF1; 103180) activates PLD1, suggesting that PLD1 is involved in intravesicular membrane trafficking. Hammond et al. (1997) identified an evolutionarily conserved splice variant of PLD1 that arises from regulated splicing of a 38-amino acid alternate exon. They found that both forms of PLD1 have identical catalytic and regulatory properties. The authors demonstrated that PLD1 can be activated in vitro by PKCA (OMIM Ref. No. 176960) and the monomeric GTP-binding proteins RHO A, RAC1 (OMIM Ref. No. 602048), and CDC42 (OMIM Ref. No. 116952). They suggested that PLD1 may be involved in cell morphology alterations as well as intracellular protein trafficking. By Northern blot analysis, Colley et al. (1997) detected mouse Pld1 expression in all tissues examined, with highest levels in kidney and lung. The ratio of Pld1 and Pld2 (OMIM Ref. No. 602384) in each tissue varied. In situ hybridization of mouse embryo and adult brain showed that Pld1 is expressed in a restricted manner. By somatic cell hybrid analysis, Colley et al. (1997) mapped the human PLD1 gene to chromosome 3. By FISH, Park et al. (1998) refined the assignment to 3q26. By interspecific backcross analysis, Colley et al. (1997) mapped the mouse Pld1 gene to the proximal region of chromosome 3.

Full details of the abovementioned studies are described in the following publications, the disclosure of which are hereby incorporated by reference:

Hammond, S. M.; Altshuller, Y. M.; Sung, T.-C.; Rudge, S. A.; Rose, K.; Engebrecht, J.; Morris, A. J.; Frohman, M. A.: Human ADP-ribosylation factor-activated phosphatidylcholine-specific phospholipase D defines a new and highly conserved gene family. J. Biol. Chem. 270:29640-29643, 1995; and Hammond, S. M.; Jenco, J. M.; Nakashima, S.; Cadwallader, K.; Gu, Q.; Cook, S.; Nozawa, Y.; Prestwich, G. D.; Frohman, M. A.; Morris, A. J.: Characterization of two alternately spliced.

Further studies establishing the function and utilities of PLD1 are found in John Hopkins OMIM database record ID 602382, and in cited publications listed in Table 5, which are hereby incorporated by reference. Protein o-fucosyltransferase 1 (POFUT1, Accession NP_056167.1) is another GAM47 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:18732, to the nucleotide sequence of GAM47 RNA, herein designated GAM RNA, also designated SEQ ID:269.

Another function of GAM47 is therefore inhibition of Protein o-fucosyltransferase 1 (POFUT1, Accession NP_056167.1) . Accordingly, utilities of GAM47 include diagnosis, prevention and treatment of diseases and clinical conditions associated with POFUT1.

Pom121 membrane glycoprotein (rat) (POM121, Accession NP_742017.1) is another GAM47 target gene, herein designated TARGET GENE. POM121 BINDING SITE is a target binding site found in the 3' untranslated region of mRNA encoded by POM121, corresponding to a target binding site such as BINDING SITE I, BINDING SITE II or BINDING SITE III of FIG. 8. Table 4 illustrates the complementarity of the nucleotide sequences of POM121 BINDING SITE, designated SEQ ID:2631, to the nucleotide sequence of GAM47 RNA, herein designated GAM RNA, also designated SEQ ID:269.

Another function of GAM47 is therefore inhibition of Pom121 membrane glycoprotein (rat) (POM121, Accession NP_742017.1). Accordingly, utilities of GAM47 include diagnosis, prevention and treatment of diseases and clinical conditions associated with POM121.

Pou domain, class 4, transcription factor 2 (POU4F2, Accession NP_004566.1) is another GAM47 target gene, herein designated TARGET GENE. POU4F2 BINDING SITE is a target binding site found in the 3' untranslated region of mRNA encoded by POU4F2, corresponding to a target binding site such as BINDING SITE I, BINDING SITE II or BINDING SITE III of FIG. 8. Table 4 illustrates the complementarity of the nucleotide sequences of POU4F2 BINDING SITE, designated SEQ ID:12824, to the nucleotide sequence of GAM47 RNA, herein designated GAM RNA, also designated SEQ ID:269.

Another function of GAM47 is therefore inhibition of Pou domain, class 4, transcription factor 2 (POU4F2, Accession NP_004566.1). Accordingly, utilities of GAM47 include diagnosis, prevention and treatment of diseases and clinical conditions associated with POU4F2.

Peptidylprolyl isomerase (cyclophilin)-like 2 (PPIL2, Accession NP_680481.1) is another GAM47 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:15498, to the nucleotide sequence of GAM47 RNA, herein designated GAM RNA, also designated SEQ ID:269.

Another function of GAM47 is therefore inhibition of Peptidylprolyl isomerase (cyclophilin)-like 2 (PPIL2, Accession NP_680481.1). Accordingly, utilities of GAM47 include diagnosis, prevention and treatment of diseases and clinical conditions associated with PPIL2.

Peptidylprolyl isomerase (cyclophilin)-like 2 (PPIL2, Accession NP_680480.1) is another GAM47 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:15498, to the nucleotide sequence of GAM47 RNA, herein designated GAM RNA, also designated SEQ ID:269.

Another function of GAM47 is therefore inhibition of Peptidylprolyl isomerase (cyclophilin)-like 2 (PPIL2, Accession NP_680480.1). Accordingly, utilities of GAM47 include diagnosis, prevention and treatment of diseases and clinical conditions associated with PPIL2.

Protein phosphatase 1, regulatory (inhibitor) subunit 3b (PPP1R3B, Accession NP_078883.1) is another GAM47 target gene, herein designated TARGET GENE. PPP1R3B BINDING SITE is a target binding site found in the 3' untranslated region of mRNA encoded by PPP1R3B, corresponding to a target binding site such as BINDING SITE I, BINDING SITE II or BINDING SITE III of FIG. 8. Table 4 illustrates the complementarity of the nucleotide sequences of PPP1R3B BINDING SITE, designated SEQ ID:1614, to the nucleotide sequence of GAM47 RNA, herein designated GAM RNA, also designated SEQ ID:269.

Another function of GAM47 is therefore inhibition of Protein phosphatase 1, regulatory (inhibitor) subunit 3b (PPP1R3B, Accession NP_078883.1). Accordingly, utilities of GAM47 include diagnosis, prevention and treatment of diseases and clinical conditions associated with PPP1R3B.

Prolactin regulatory element binding (PREB, Accession NP_037520.1) is another GAM47 target gene, herein designated TARGET GENE. PREB BINDING SITE is a target binding site found in the 3' untranslated region of mRNA encoded by PREB, corresponding to a target binding site such as BINDING SITE I, BINDING SITE II or BINDING SITE III of FIG. 8. Table 4 illustrates the complementarity of the nucleotide sequences of PREB BINDING SITE, designated SEQ ID:9801, to the nucleotide sequence of GAM47 RNA, herein designated GAM RNA, also designated SEQ ID:269.

Another function of GAM47 is therefore inhibition of Prolactin regulatory element binding (PREB, Accession NP_037520.1), a gene which is a WD motif DNA-binding protein and involved in transcriptional regulation. Accordingly, utilities of GAM47 include diagnosis, prevention and treatment of diseases and clinical conditions associated with PREB.

The function of PREB has been established by previous studies. Fliss et al. (1999) isolated a rat cDNA encoding Preb, a WD motif DNA-binding protein with the capacity to regulate prolactin (PRL; 176760) promoter activity. Northern blot analysis of human tissues using a rat Preb cDNA probe showed expression of a 2.2-kb transcript in heart, brain, placenta, liver, skeletal muscle, kidney, and pancreas; a 1.9- kb transcript in brain, placenta, and lung; and a 1.5-kb transcript heart, skeletal muscle, and pancreas. By screening a fetal brain cDNA library with a rat Preb probe, followed by 5-prime primer walking, Taylor Clelland et al. (2000) isolated a cDNA encoding human PREB. The deduced 417-amino acid protein, which is 89% identical to the rat protein, has 3 conserved WD repeats and 2 conserved pro-gln-rich regions. RNA dot blot analysis detected variable expression of PREB in all adult and fetal tissues. They proposed that PREB is a DNA- binding factor during mammalian development and that abnormal dosage may play a role in some of the phenotypic abnormalities observed in the partial trisomy 2p syndrome, which is characterized by a number of congenital defects, including genital abnormalities.

Full details of the abovementioned studies are described in the following publications, the disclosure of which are hereby incorporated by reference:

Fliss, M. S.; Hinkle, P. M.; Bancroft, C.: Expression cloning and characterization of PREB (prolactin regulatory element binding), a novel WD motif DNA-binding protein with a capacity to regulate prolactin promoter activity. Molec. Endocr. 13:644-657, 1999; and Taylor Clelland, C. L.; Levy, B.; McKie, J. M.; Duncan, A. M. V.; Hirschhorn, K.; Bancroft, C.: Cloning and characterization of human PREB; a gene that maps to a genomic region associ.

Further studies establishing the function and utilities of PREB are found in John Hopkins OMIM database record ID 606395, and in cited publications listed in Table 5, which are hereby incorporated by reference. PRICKLE2 (Accession XP_093799.2) is another GAM47 target gene, herein designated TARGET GENE. PRICKLE2 BINDING SITE is a target binding site found in the 3' untranslated region of mRNA encoded by PRICKLE2, corresponding to a target binding site such as BINDING SITE I, BINDING SITE II or BINDING SITE III of FIG. 8. Table 4 illustrates the complementarity of the nucleotide sequences of PRICKLE2 BINDING SITE, designated SEQ ID:17660, to the nucleotide sequence of GAM47 RNA, herein designated GAM RNA, also designated SEQ ID:269.

Another function of GAM47 is therefore inhibition of PRICKLE2 (Accession XP_093799.2). Accordingly, utilities of GAM47 include diagnosis, prevention and treatment of diseases and clinical conditions associated with PRICKLE2.

Protein kinase, camp-dependent, catalytic, alpha (PRKACA, Accession NP_002721.1) is another GAM47 target gene, herein designated TARGET GENE. PRKACA BINDING SITE is a target binding site found in the 3' untranslated region of mRNA encoded by PRKACA, corresponding to a target binding site such as BINDING SITE I, BINDING SITE II or BINDING SITE III of FIG. 8. Table 4 illustrates the complementarity of the nucleotide sequences of PRKACA BINDING SITE, designated SEQ ID:2912, to the nucleotide sequence of GAM47 RNA, herein designated GAM RNA, also designated SEQ ID:269.

Another function of GAM47 is therefore inhibition of Protein kinase, camp-dependent, catalytic, alpha (PRKACA, Accession NP_002721.1), a gene which phosphorylates target proteins on serine or threonine residues. Accordingly, utilities of GAM47 include diagnosis, prevention and treatment of diseases and clinical conditions associated with PRKACA.

The function of PRKACA has been established by previous studies. Most of the effects of cAMP in the eukaryotic cell are mediated through the phosphorylation of target proteins on serine or threonine residues by the cAMP-dependent protein kinase (EC 2.7.1.37). The inactive cAMP-dependent protein kinase is a tetramer composed of 2 regulatory and 2 catalytic subunits. The cooperative binding of 4 molecules of cAMP dissociates the enzyme in a regulatory subunit dimer and 2 free active catalytic subunits. In the human, 4 different regulatory subunits (PRKAR1A, 188830; PRKAR1B, 176911; PRKAR2A, 176910; and PRKAR2B, 176912) and 3 catalytic subunits (PRKACA; PRKACB, 176892; and PRKACG 176893) have been identified. Using PCR and Southern blot analysis, Tasken et al. (1996) assigned the PRKACA gene to chromosome 19. By 2-color fluorescence in situ hybridization, they regionalized the assignment to 19p13.1.

Animal model experiments lend further support to the function of PRKACA. The intracellular second messenger cAMP affects cell physiology by directly interacting with effector molecules that include cyclic nucleotide-gated ion channels, cAMP-regulated G protein exchange factors, and cAMP-dependent protein kinases (PKA). Two catalytic subunits, C-alpha (OMIM Ref. No. PRKACA) and C-beta (OMIM Ref. No. PRKACB), are expressed in the mouse and mediate the effects of PKA. Skalhegg et al. (2002) generated a null mutation in the major catalytic subunit of PKA, C-alpha, and observed early postnatal lethality in the majority of C-alpha knockout mice. Surprisingly, a small percentage of C-alpha knockout mice, although runted, survived to adulthood. This growth retardation was not due to decreased GH (OMIM Ref. No. 139250) production but did correlate with a reduction in IGF1 (OMIM Ref. No. 147440) mRNA in the liver and diminished production of the major urinary proteins in kidney. In these animals, compensatory increases in C-beta levels occurred in brain whereas many tissues, including skeletal muscle, heart, and sperm, contained less than 10% of the normal PKA activity. Analysis of sperm in C-alpha knockout males revealed that spermatogenesis progressed normally but that mature sperm had defective forward motility It is appreciated that the abovementioned animal model for PRKACA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Skalhegg, B. S.; Huang, Y.; Su, T.; Idzerda, R. L.; McKnight, G. S.; Burton, K. A.: Mutation of the C-alpha subunit of PKA leads to growth retardation and sperm dysfunction. Molec. Endocr. 16:630-639, 2002; and Tasken, K.; Solberg, R.; Zhao, Y.; Hansson, V.; Jahnsen, T.; Siciliano, M. J.: The gene encoding the catalytic subunit C-alpha of cAMP-dependent protein kinase (locus PRKACA) localize.

Further studies establishing the function and utilities of PRKACA are found in John Hopkins OMIM database record ID 601639, and in cited publications listed in Table 5, which are hereby incorporated by reference. Protein kinase, camp-dependent, catalytic, gamma (PRKACG, Accession NP_002723.2) is another GAM47 target gene, herein designated TARGET GENE. PRKACG BINDING SITE is a target binding site found in the 3' untranslated region of mRNA encoded by PRKACG, corresponding to a target binding site such as BINDING SITE I, BINDING SITE II or BINDING SITE III of FIG. 8. Table 4 illustrates the complementarity of the nucleotide sequences of PRKACG BINDING SITE, designated SEQ ID:8827, to the nucleotide sequence of GAM47 RNA, herein designated GAM RNA, also designated SEQ ID:269.

Another function of GAM47 is therefore inhibition of Protein kinase, camp-dependent, catalytic, gamma (PRKACG, Accession NP_002723.2), a gene which is the catalytic subunit C gamma of cAMP-dependent protein kinase. Accordingly, utilities of GAM47 include diagnosis, prevention and treatment of diseases and clinical conditions associated with PRKACG.

The function of PRKACG has been established by previous studies. Beebe et al. (1990) reported the molecular cloning of a third isoform of the catalytic subunit of cAMP-dependent protein kinase (C-alpha (PRKACA; 601639) and C-beta (PRKACB; 176892) had previously been characterized). The third form, isolated from a human testis cDNA library and designated C-gamma, was clearly derived from a gene distinct from C-alpha and C-beta and showed tissue-specific expression. Whereas at the amino acid level C-alpha and C-beta showed 93% homology, C-gamma showed only about 80% homology to both C-alpha and C-beta. Reinton et al. (1998) isolated the entire human PRKACG genomic sequence. The PRKACG gene is intronless, contains remnants of a poly(A) tail, is flanked by direct repeats, and is colinear with the PRKACA gene. Thus, the authors concluded that the PRKACG gene is a PRKACA-derived retroposon. Northern blot analysis detected PRKACG expression in fractionated germ cells of human testes. Foss et al. (1991, 1992) mapped the gene for the subunit C-gamma to chromosome 9 by study of somatic cell hybrids. By in situ hybridization, they confirmed the assignment and regionalized the gene to 9q13.

Full details of the abovementioned studies are described in the following publications, the disclosure of which are hereby incorporated by reference:

Foss, K. B.; Simard, J.; Berube, D.; Beebe, S. J.; Sandberg, M.; Grzeschik, K.-H.; Gagne, R.; Hansson, V.; Jahnsen, T.: Localization of the catalytic subunit C-gamma of the cAMP-dependent protein kinase gene (PRKACG) to human chromosome region 9q13. Cytogenet. Cell Genet. 60:22-25, 1992; and Reinton, N.; Haugen, T. B.; Orstavik, S.; Skalhegg, B. S.; Hansson, V.; Jahnsen, T.; Tasken, K.: The gene encoding the C gamma catalytic subunit of cAMP-dependent protein kinase is a tr.

Further studies establishing the function and utilities of PRKACG are found in John Hopkins OMIM database record ID 176893, and in cited publications listed in Table 5, which are hereby incorporated by reference. Protein kinase, camp-dependent, regulatory, type i, alpha (tissue specific extinguisher 1) (PRKAR1A, Accession NP_002725.1) is another GAM47 target gene, herein designated TARGET GENE. PRKAR1A BINDING SITE is a target binding site found in the 3' untranslated region of mRNA encoded by PRKAR1A, corresponding to a target binding site such as BINDING SITE I, BINDING SITE II or BINDING SITE III of FIG. 8. Table 4 illustrates the complementarity of the nucleotide sequences of PRKAR1A BINDING SITE, designated SEQ ID:15538, to the nucleotide sequence of GAM47 RNA, herein designated GAM RNA, also designated SEQ ID:269.

Another function of GAM47 is therefore inhibition of Protein kinase, camp-dependent, regulatory, type i, alpha (tissue specific extinguisher 1) (PRKAR1A, Accession NP_002725.1). Accordingly, utilities of GAM47 include diagnosis, prevention and treatment of diseases and clinical conditions associated with PRKAR1A.

PRO2435 (Accession NP_060997.1) is another GAM47 target gene, herein designated TARGET GENE. PRO2435 BINDING SITE is a target binding site found in the 5' untranslated region of mRNA encoded by PRO2435, corresponding to a target binding site such as BINDING SITE I, BINDING SITE II or BINDING SITE III of FIG. 8. Table 4 illustrates the complementarity of the nucleotide sequences of PRO2435 BINDING SITE, designated SEQ ID:19591, to the nucleotide sequence of GAM47 RNA, herein designated GAM RNA, also designated SEQ ID:269.

Another function of GAM47 is therefore inhibition of PRO2435 (Accession NP_060997.1). Accordingly, utilities of GAM47 include diagnosis, prevention and treatment of diseases and clinical conditions associated with PRO2435.

Protease, serine, 21 (testisin) (PRSS21, Accession NP_659206.1) is another GAM47 target gene, herein designated TARGET GENE. PRSS21 BINDING SITE is a target binding site found in the 3' untranslated region of multiple transcripts of mRNA encoded by PRSS21, corresponding to a target binding site such as BINDING SITE I, BINDING SITE II or BINDING SITE III of FIG. 8. Table 4 illustrates the complementarity of the nucleotide sequences of PRSS21

BINDING SITE, designated SEQ ID:19855, to the nucleotide sequence of GAM47 RNA, herein designated GAM RNA, also designated SEQ ID:269.

Another function of GAM47 is therefore inhibition of Protease, serine, 21 (testisin) (PRSS21, Accession NP_659206.1). Accordingly, utilities of GAM47 include diagnosis, prevention and treatment of diseases and clinical conditions associated with PRSS21.

Protease, serine, 21 (testisin) (PRSS21, Accession NP_659205.1) is another GAM47 target gene, herein designated TARGET GENE. PRSS21 BINDING SITE is a target binding site found in the 3' untranslated region of multiple transcripts of mRNA encoded by PRSS21, corresponding to a target binding site such as BINDING SITE I, BINDING SITE II or BINDING SITE III of FIG. 8. Table 4 illustrates the complementarity of the nucleotide sequences of PRSS21 BINDING SITE, designated SEQ ID:19855, to the nucleotide sequence of GAM47 RNA, herein designated GAM RNA, also designated SEQ ID:269.

Another function of GAM47 is therefore inhibition of Protease, serine, 21 (testisin) (PRSS21, Accession NP_659205.1). Accordingly, utilities of GAM47 include diagnosis, prevention and treatment of diseases and clinical conditions associated with PRSS21.

Protease, serine, 21 (testisin) (PRSS21, Accession NP_006790.1) is another GAM47 target gene, herein designated TARGET GENE. PRSS21 BINDING SITE is a target binding site found in the 3' untranslated region of multiple transcripts of mRNA encoded by PRSS21, corresponding to a target binding site such as BINDING SITE I, BINDING SITE II or BINDING SITE III of FIG. 8. Table 4 illustrates the complementarity of the nucleotide sequences of PRSS21 BINDING SITE, designated SEQ ID:19855, to the nucleotide sequence of GAM47 RNA, herein designated GAM RNA, also designated SEQ ID:269.

Another function of GAM47 is therefore inhibition of Protease, serine, 21 (testisin) (PRSS21, Accession NP_006790.1). Accordingly, utilities of GAM47 include diagnosis, prevention and treatment of diseases and clinical conditions associated with PRSS21.

Pleckstrin homology, sec7 and coiled/coil domains 4 (PSCD4, Accession NP_037517.1) is another GAM47 target gene, herein designated TARGET GENE. PSCD4 BINDING SITE is a target binding site found in the 3' untranslated region of mRNA encoded by PSCD4, corresponding to a target binding site such as BINDING SITE I, BINDING SITE II or BINDING SITE III of FIG. 8. Table 4 illustrates the complementarity of the nucleotide sequences of PSCD4 BINDING SITE, designated SEQ ID:7145, to the nucleotide sequence of GAM47 RNA, herein designated GAM RNA, also designated SEQ ID:269.

Another function of GAM47 is therefore inhibition of Pleckstrin homology, sec7 and coiled/coil domains 4 (PSCD4, Accession NP_037517.1), a gene which promotes guanine-nucleotide exchange on arf1 and arf5. Accordingly, utilities of GAM47 include diagnosis, prevention and treatment of diseases and clinical conditions associated with PSCD4.

The function of PSCD4 has been established by previous studies. ADP-ribosylation factors, or ARFS (see OMIM Ref. No. ARF1; 103180), are small GTP-binding proteins within the Ras superfamily that regulate vesicle trafficking in eukaryotic cells. ARF1 recruits coat proteins (e.g., COPA; 601924) to membranes on the cytoplasmic face of the Golgi apparatus. The PSCD proteins (e.g., PSCD1; 182115), a family of proteins containing a C-terminal pleckstrin homology (PH) domain and a central 200-amino acid region similar to a domain within the yeast Sec7 protein, which is required for vesicular traffic of polypeptides through the Golgi, function as guanine-nucleotide exchange factors (GEFs) for ARFs. Klarlund et al. (1997) identified a cDNA encoding mouse Grp1 (general receptor for phosphoinositides-1) by screening mouse adipocyte and brain cDNA expression libraries with phosphoinositide probes. By searching an EST database for sequences similar to mouse brain Grp1, followed by PCR and screening of a human blood cDNA library, Venkateswarlu et al. (1998) obtained a cDNA encoding PSCD3, which they called GRP1. Sequence analysis showed that the predicted 399-amino acid PSCD3 protein contains a 39-amino acid coiled-coil domain, a 172-amino acid Sec7 domain, and a 118-amino acid PH domain. PSCD3 shares 82.7% and 79.5% amino acid identity with PSCD1 and PSCD2 (OMIM Ref. No. 602488), respectively, as well as 98.8% identity with mouse Grp1. By Scatchard and mutational analyses, Venkateswarlu et al. (1998) determined that PSCD3 binds via its PH domain to the inositol head group of phosphatidylinositol 3,4,5-triphosphate with high affinity. Confocal laser microscopy demonstrated that stimulation of cells with either epidermal growth factor (EGF; 131530) or nerve growth factor (NGF; 162030) results in PH domain-dependent translocation of PSCD3 from the cytosol to the plasma membrane. The translocation was rapid and transient with EGF, whereas NGF mediated a relatively longer translocation. By searching an EST database for Sec7 domain-related sequences and by screening a placenta cDNA library, Franco et al. (1998) isolated a cDNA encoding PSCD3, which they called ARNO3. Northern blot analysis revealed that PSCD3, in contrast to the ubiquitously expressed PSCD1 and PSCD2, is expressed as a 4.5-kb transcript that is almost absent from liver, thymus, and peripheral blood lymphocytes. Franco et al. (1998) found that PSCD3, like PSCD1 and PSCD2, shows GEF activity, mediated by the Sec7 domain, towards ARF1 but not ARF6 (OMIM Ref. No. 600464). Immunofluorescence microscopy indicated that overexpression of PSCD3 induces major morphologic alterations of the Golgi apparatus, including redistribution of Golgi resident proteins and the coat protein COPB (OMIM Ref. No. 600959). Lietzke et al. (2000) and Ferguson et al. (2000) determined the structure of the GRP1 PH domain in the unliganded form and bound to inositol 1,3,4,5-tetraphosphate. Lietzke et al. (2000) found that a novel mode of phosphoinositide recognition involving a 20-residue insertion within the beta-6/beta-7 loop explains the unusually high specificity of the GRP1 PH domain and the promiscuous 3-phosphoinositide binding typical of several other PH domains, including that of protein kinase B (AKT1; 164730). By comparing the GRP1 PH domain to other PH domains, general determinants of 3-phosphoinositide recognition and specificity could be deduced.

Full details of the abovementioned studies are described in the following publications, the disclosure of which are hereby incorporated by reference:

Ferguson, K. M.; Kavran, J. M.; Sankaran, V. G.; Fournier, E.; Isakoff, S. J.; Skolnik, E. Y.; Lemmon, M. A.: Structural basis for discrimination of 3-phosphoinositides by pleckstrin homology domains. Molec. Cell 6:373-384, 2000; and Franco, M.; Boretto, J.; Robineau, S.; Monier, S.; Goud, B.; Chardin, P.; Chavrier, P.: ARNO3, a Sec7-domain guanine nucleotide exchange factor for ADP ribosylation factor 1, is invol.

Further studies establishing the function and utilities of PSCD4 are found in John Hopkins OMIM database record ID 606514, and in cited publications listed in Table 5, which are hereby incorporated by reference. Presenilin 1 (alzheimer disease 3) (PSEN1, Accession NP_015557.1) is another GAM47 target gene, herein designated TARGET GENE. PSEN1 BINDING SITE is a target binding site found in the 3' untranslated region of multiple transcripts of mRNA encoded by PSEN1, corresponding to a target binding site such as BINDING SITE I, BINDING SITE II or BINDING SITE III of FIG. 8. Table 4 illustrates the complementarity of the nucleotide sequences of PSEN1 BINDING SITE, designated SEQ ID:10827, to the nucleotide sequence of GAM47 RNA, herein designated GAM RNA, also designated SEQ ID:269.

Another function of GAM47 is therefore inhibition of Presenilin 1 (alzheimer disease 3) (PSEN1, Accession NP_015557.1). Accordingly, utilities of GAM47 include diagnosis, prevention and treatment of diseases and clinical conditions associated with PSEN1.

Presenilin 1 (alzheimer disease 3) (PSEN1, Accession NP_000012.1) is another GAM47 target gene, herein designated TARGET GENE. PSEN1 BINDING SITE is a target binding site found in the 3' untranslated region of multiple transcripts of mRNA encoded by PSEN1, corresponding to a target binding site such as BINDING SITE I, BINDING SITE II or BINDING SITE III of FIG. 8. Table 4 illustrates the complementarity of the nucleotide sequences of PSEN1 BINDING SITE, designated SEQ ID:10827, to the nucleotide sequence of GAM47 RNA, herein designated GAM RNA, also designated SEQ ID:269.

Another function of GAM47 is therefore inhibition of Presenilin 1 (alzheimer disease 3) (PSEN1, Accession NP_000012.1). Accordingly, utilities of GAM47 include diagnosis, prevention and treatment of diseases and clinical conditions associated with PSEN1.

PTCRA (Accession NP_612153.1) is another GAM47 target gene, herein designated TARGET GENE. PTCRA BINDING SITE is a target binding site found in the 5' untranslated region of mRNA encoded by PTCRA, corresponding to a target binding site such as BINDING SITE I, BINDING SITE II or BINDING SITE III of FIG. 8. Table 4 illustrates the complementarity of the nucleotide sequences of PTCRA BINDING SITE, designated SEQ ID:10565, to the nucleotide sequence of GAM47 RNA, herein designated GAM RNA, also designated SEQ ID:269.

Another function of GAM47 is therefore inhibition of PTCRA (Accession NP_612153.1). Accordingly, utilities of GAM47 include diagnosis, prevention and treatment of diseases and clinical conditions associated with PTCRA.

Parathyroid hormone-like hormone (PTHLH, Accession NP_002811.1) is another GAM47 target gene, herein designated TARGET GENE. PTHLH BINDING SITE is a target binding site found in the 3' untranslated region of mRNA encoded by PTHLH, corresponding to a target binding site such as BINDING SITE I, BINDING SITE II or BINDING SITE III of FIG. 8. Table 4 illustrates the complementarity of the nucleotide sequences of PTHLH BINDING SITE, designated SEQ ID:2062, to the nucleotide sequence of GAM47 RNA, herein designated GAM RNA, also designated SEQ ID:269.

Another function of GAM47 is therefore inhibition of Parathyroid hormone-like hormone (PTHLH, Accession NP_002811.1), a gene which plays a physiological role in lactation, possibly as a hormone for the mobilization and/or transfer of calcium to the milk. and therefore is associated with Humoral hypercalcemia of malignancy. Accordingly, utilities of GAM47 include diagnosis, prevention and treatment of Humoral hypercalcemia of malignancy, and of other diseases and clinical conditions associated with PTHLH.

The function of PTHLH has been established by previous studies. PTHRP is responsible for most cases of humoral hypercalcemia of malignancy. It mimics the actions of PTH because of its structural homology with PTH and its ability to bind to and signal via the PTH/PTHRP receptor in bone and kidney. PTHRP-(1-36) appears to be one of several secretory forms of PTHRP. When this peptide was given intravenously (iv) to normal volunteers, it produced the same effects as PTH-(1-34). To determine whether PTHRP-(1-36) could be used subcutaneously (sc) in humans as a diagnostic reagent to study differences between HHM and hyperparathyroidism, Henry et al. (1997) examined whether sc PTHRP-(1-36) could affect mineral homeostasis. PTHRP-(1-36) given sc produced increases in circulating PTHRP- (1-36), reductions in serum phosphorus and the renal phosphorus threshold, increments in fractional calcium excretion and nephrogenous cAMP excretion, and increases in plasma 1,25-dihydroxyvitamin D. The authors concluded that it is feasible to use PTHRP-(1-36) in studies of HHM and hyperparathyroidism.

Animal model experiments lend further support to the function of PTHLH. Philbrick et al. (1998) found that whereas PTHRP knockout mice die at birth with a chondrodystrophic phenotype, replacement of PTHRP expression in the chondrocytes of these knockout mice using a procollagen II-driven transgene resulted in the correction of the lethal skeletal abnormalities and generated animals that were effectively PTHRP- null in all sites other than cartilage. These rescued PTHRP knockout mice survived to at least 6 months of age but were small in stature and displayed a number of developmental defects, including cranial chondrodystrophy and a failure of tooth eruption. Teeth appeared to develop normally but became trapped by the surrounding bone and underwent progressive impaction. Localization of PTHRP mRNA during normal tooth development by in situ hybridization showed increasing levels of expression in the enamel epithelium before the formation of the eruption pathway. The type 1 PTH/PTHRP receptor is expressed in both the adjacent dental mesenchyme and in alveolar bone. The replacement of PTHRP expression in the enamel epithelium with a keratin 14-driven transgene corrected the defect in bone resorption and restored the normal program of tooth eruption. PTHRP therefore represents an essential signal in the formation of the eruption pathway.

It is appreciated that the abovementioned animal model for PTHLH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Philbrick, W. M.; Dreyer, B. E.; Nakchbandi, I. A.; Karaplis, A. C.: Parathyroid hormone-related protein is required for tooth eruption. Proc. Nat. Acad. Sci. 95:11846-11851, 1998; and Strewler, G. J.: The physiology of parathyroid hormone-related protein. New Eng. J. Med. 342:177-185, 2000.

Further studies establishing the function and utilities of PTHLH are found in John Hopkins OMIM database record ID 168470, and in cited publications listed in Table 5, which are hereby incorporated by reference. Protein tyrosine phosphatase type iva, member 3 (PTP4A3, Accession NP_116000.1) is another GAM47 target gene, herein designated TARGET GENE. PTP4A3 BINDING SITE1 and PTP4A3 BINDING SITE2 are target binding sites found in untranslated regions of multiple transcripts of mRNA encoded by PTP4A3, corresponding to target binding sites such as BINDING SITE I, BINDING SITE II or BINDING SITE III of FIG. 8. Table 4 illustrates the complementarity of the nucleotide sequences of PTP4A3 BINDING SITE1 and PTP4A3 BINDING SITE2, designated SEQ ID:12368 and SEQ ID:16927 respectively, to the nucleotide sequence of GAM47 RNA, herein designated GAM RNA, also designated SEQ ID:269.

Another function of GAM47 is therefore inhibition of Protein tyrosine phosphatase type iva, member 3 (PTP4A3, Accession NP_116000.1). Accordingly, utilities of GAM47 include diagnosis, prevention and treatment of diseases and clinical conditions associated with PTP4A3.

Protein tyrosine phosphatase type iva, member 3 (PTP4A3, Accession NP_009010.2) is another GAM47 target gene, herein designated TARGET GENE. PTP4A3 BINDING SITE1 and PTP4A3 BINDING SITE2 are target binding sites found in untranslated regions of multiple transcripts of mRNA encoded by PTP4A3, corresponding to target binding sites such as BINDING SITE I, BINDING SITE II or BINDING SITE III of FIG. 8. Table 4 illustrates the complementarity of the nucleotide sequences of PTP4A3 BINDING SITE1 and PTP4A3 BINDING SITE2, designated SEQ ID:16927 and SEQ ID:12368 respectively, to the nucleotide sequence of GAM47 RNA, herein designated GAM RNA, also designated SEQ ID:269.

Another function of GAM47 is therefore inhibition of Protein tyrosine phosphatase type iva, member 3 (PTP4A3, Accession NP_009010.2). Accordingly, utilities of GAM47 include diagnosis, prevention and treatment of diseases and clinical conditions associated with PTP4A3.

Poliovirus receptor (PVR, Accession NP_006496.2) is another GAM47 target gene, herein designated TARGET GENE. PVR BINDING SITE is a target binding site found in the 3' untranslated region of mRNA encoded by PVR, corresponding to a target binding site such as BINDING SITE I, BINDING SITE II or BINDING SITE III of FIG. 8. Table 4 illustrates the complementarity of the nucleotide sequences of PVR BINDING SITE, designated SEQ ID:12007, to the nucleotide sequence of GAM47 RNA, herein designated GAM RNA, also designated SEQ ID:269.

Another function of GAM47 is therefore inhibition of Poliovirus receptor (PVR, Accession NP_006496.2), a gene which is a poliovirus receptor and therefore may be associated with Poliomyelitis. Accordingly, utilities of GAM47 include diagnosis, prevention and treatment of Poliomyelitis, and of other diseases and clinical conditions associated with PVR.

The function of PVR has been established by previous studies. Primates are susceptible to poliomyelitis infection, but rodents are not; furthermore, human cells but not rodent cells are killed by poliovirus in vitro. Susceptibility to poliovirus is a function of the presence or absence of a cellular receptor to which the virus binds as the first step in poliovirus replication. Mendelsohn et al. (1986) succeeded in transforming a human poliovirus receptor gene into mouse L cells which are ordinarily resistant to poliovirus infection because they do not bear a poliovirus receptor. Monoclonal antibody directed against the HeLa cell poliovirus receptor site was used in rosette assays to identify poliovirus-sensitive transformants. In a study of human-mouse hybrids, Miller et al. (1974) showed that chromosome 19 is correlated with susceptibility to poliovirus. Siddique et al. (1985) regionalized the PVS gene to 19q13-qter. By the study of rodent/human hybrid cell lines carrying 4 different regions of human chromosome 19, Siddique et al. (1988) demonstrated that the typical cytopathic effects of poliovirus infection were observed only when the region 19q12-q13.2 was contained as the smallest region of overlap. The same region contains the gene for myotonic dystrophy (OMIM Ref. No. 160900). The PVS gene is also of interest in connection with inherited motor neuron diseases because it encodes a cell-surface receptor expressed on motor neurons. Shepley et al. (1988) prepared a monoclonal antibody that identified a 100-kD membrane protein in HeLa cells and in human spinal cord involved in poliovirus attachment. They showed that the antigen identified by the monoclonal antibody was associated with the presence of human chromosome 19 in human-mouse hybrid cell lines. The monoclonal antibodies stained neurons in the reticular formation and clusters of brain stem neurons, consistent with the known pattern of damage caused by poliovirus infection in the brain stem. Furthermore, it reacted with human peripheral mononuclear cells, consistent with the known replication of poliovirus in Peyer patches and tonsils. Schonk et al. (1990) assigned the PVS gene to 19q13.2 by hybridization studies using a panel of somatic cell hybrids with subchromosomal segments of 19q. By fluorescence in situ hybridization, Trask et al. (1993) assigned the PVS gene to 19q13.2-q13.3. Seldin et al. (1991) mapped the homologous gene in the mouse to chromosome 9.

Full details of the abovementioned studies are described in the following publications, the disclosure of which are hereby incorporated by reference:

Mendelsohn, C.; Johnson, B.; Lionetti, K. A.; Nobis, P.; Wimmer, E.; Racaniello, V. R.: Transformation of a human poliovirus receptor gene into mouse cells. Proc. Nat. Acad. Sci. 83:7845-7849, 1986; and Seldin, M. F.; Saunders, A. M.; Rochelle, J. M.; Howard, T. A.: A proximal mouse chromosome 9 linkage map that further defines linkage groups homologous with segments of human chromosom.

Further studies establishing the function and utilities of PVR are found in John Hopkins OMIM database record ID 173850, and in cited publications listed in Table 5, which are hereby incorporated by reference. Paxillin (PXN, Accession NP_002850.1) is another GAM47 target gene, herein designated TARGET GENE. PXN BINDING SITE is a target binding site found in the 3' untranslated region of mRNA encoded by PXN, corresponding to a target binding site such as BINDING SITE I, BINDING SITE II or BINDING SITE III of FIG. 8. Table 4 illustrates the complementarity of the nucleotide sequences of PXN BINDING SITE, designated SEQ ID:11342, to the nucleotide sequence of GAM47 RNA, herein designated GAM RNA, also designated SEQ ID:269.

Another function of GAM47 is therefore inhibition of Paxillin (PXN, Accession NP_002850.1), a gene which may be involved in p53-dependent apoptosis and therefore may be associated with Cancer. Accordingly, utilities of GAM47 include diagnosis, prevention and treatment of Cancer, and of other diseases and clinical conditions associated with PXN.

The function of PXN has been established by previous studies. Drosophila peroxidasin is an extracellular matrix-associated peroxidase. It is expressed exclusively in hemocytes derived from head mesoderm at a very early stage of differentiation. Peroxidasin exists as a homotrimer with a unique hybrid structure that combines an enzymatically functional peroxidase domain with motifs that are typically found in extracellular matrix-associated proteins. It is a secreted protein that contains a secretory recognition sequence at its N terminus. Peroxidasin catalyzes hydrogen peroxide-driven radioiodination, oxidations, and the formation of dityrosine in vitro. It is also thought to function in extracellular matrix consolidation, phagocytosis, and defense. By sequencing random cDNAs corresponding to relatively long transcripts from the human immature myeloid cell line KG-1, Nagase et al. (1996) identified a cDNA, which they called KIAA0230, that encodes PRG2. The cDNA represents at least 90% of the full-length PRG2 transcript; however, since it lacks an inframe stop codon upstream of the first ATG, it may be missing 5-prime coding sequence. The 1,496-amino acid PRG2 protein deduced from the cDNA sequence contains predicted transmembrane domains. PRG2 shares 38% amino acid sequence identity with Drosophila peroxidasin across 1,412 amino acids. Northern blot analysis of human tissues showed PRG2 expression at higher levels in heart, lung, ovary, and placenta, and lower levels in liver, small intestine, colon, pancreas, spleen, kidney, thymus, skeletal muscle, testis, and prostate; PRG2 expression was not detected in brain or peripheral blood leukocytes.

Full details of the abovementioned studies are described in the following publications, the disclosure of which are hereby incorporated by reference:

Horikoshi, N.; Cong, J.; Kley, N.; Shenk, T.: Isolation of differentially expressed cDNAs from p53-dependent apoptotic cells: activation of the human homologue of the Drosophila peroxidasin gene. Biochem. Biophys. Res. Commun. 261:864- 869, 1999; and Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human g.

Further studies establishing the function and utilities of PXN are found in John Hopkins OMIM database record ID 602505, and in cited publications listed in Table 5, which are hereby incorporated by reference. RA-GEF-2 (Accession NP_057424.1) is another GAM47 target gene, herein designated TARGET GENE. RA-GEF-2 BINDING SITE is a target binding site found in the 3' untranslated region of mRNA encoded by RA-GEF-2, corresponding to a target binding site such as BINDING SITE I, BINDING SITE II or BINDING SITE III of FIG. 8. Table 4 illustrates the complementarity of the nucleotide sequences of RA-GEF-2 BINDING SITE, designated SEQ ID:16978, to the nucleotide sequence of GAM47 RNA, herein designated GAM RNA, also designated SEQ ID:269.

Another function of GAM47 is therefore inhibition of RA-GEF-2 (Accession NP_057424.1). Accordingly, utilities of GAM47 include diagnosis, prevention and treatment of diseases and clinical conditions associated with RA-GEF-2.

Ran binding protein 3 (RANBP3, Accession NP_015560.1) is another GAM47 target gene, herein designated TARGET GENE. RANBP3 BINDING SITE is a target binding site found in the 3' untranslated region of multiple transcripts of mRNA encoded by RANBP3, corresponding to a target binding site such as BINDING SITE I, BINDING SITE II or BINDING SITE III of FIG. 8. Table 4 illustrates the complementarity of the nucleotide sequences of RANBP3 BINDING SITE, designated SEQ ID:1057, to the nucleotide sequence of GAM47 RNA, herein designated GAM RNA, also designated SEQ ID:269.

Another function of GAM47 is therefore inhibition of Ran binding protein 3 (RANBP3, Accession NP_015560.1). Accordingly, utilities of GAM47 include diagnosis, prevention and treatment of diseases and clinical conditions associated with RANBP3.

Rna binding motif protein 8a (RBM8A, Accession NP_005096.1) is another GAM47 target gene, herein designated TARGET GENE. RBM8A BINDING SITE is a target binding site found in the 3' untranslated region of mRNA encoded by RBM8A, corresponding to a target binding site such as BINDING SITE I, BINDING SITE II or BINDING SITE III of FIG. 8. Table 4 illustrates the complementarity of the nucleotide sequences of RBM8A BINDING SITE, designated SEQ ID:6484, to the nucleotide sequence of GAM47 RNA, herein designated GAM RNA, also designated SEQ ID:269.

Another function of GAM47 is therefore inhibition of Rna binding motif protein 8a (RBM8A, Accession NP_005096.1), a gene which involves in the pathway of gene expression postsplicing nuclear preexport mRNPs, and newly exported cytoplasmic mRNPs. Accordingly, utilities of GAM47 include diagnosis, prevention and treatment of diseases and clinical conditions associated with RBM8A.

The function of RBM8A has been established by previous studies. Mago nashi (MAGOH; 602603), meaning grand-childless, is the homolog of a Drosophila protein required for normal germ plasm development in fly embryos. By performing a yeast 2-hybrid screen on a fetal brain cDNA library with MAGOH as the bait, Zhao et al. (2000) recovered a cDNA encoding RBM8. The 173-amino acid RBM8 protein is more than 93% identical to the mouse and zebrafish sequences, and the mouse differences are all accounted for by an 11-amino acid N-terminal insertion and another single-residue insertion in the mouse sequence. Exchange partner and GST pull-down assays confirmed the MAGOH-RBM8 interaction and showed that RBM8 is expressed as a 26-kD protein, slightly larger than the predicted mass of 23 kD. Northern blot analysis detected a major RBM8 transcript of less than 1.0 kb in all tissues tested, with weakest expression in pancreas and brain. By searching an EST database for homologs of the gonadotropin-releasing hormone receptor (GNRHR; 138850), followed by 5-prime RACE on a skeletal muscle cDNA library, Conklin et al. (2000) identified a cDNA encoding RBM8. Northern blot analysis detected a major 0.9-kb transcript in all tissues tested. Sequence analysis of the 174-amino acid protein predicted an RNA-binding domain, which is composed of 2 amphipathic alpha helices packed against a 4-stranded beta sheet, and a C-terminal arg-rich segment.

Full details of the abovementioned studies are described in the following publications, the disclosure of which are hereby incorporated by reference:

Conklin, D. C.; Rixon, M. W.; Kuestner, R. E.; Maurer, M. F.; Whitmore, T. E.; Millar, R. P.: Cloning and gene expression of a novel human ribonucleoprotein. Biochim. Biophys. Acta 1492:465-469, 2000; and Zhao, X.-F.; Nowak, N. J.; Shows, T. B.; Aplan, P. D.: MAGOH interacts with a novel RNA-binding protein. Genomics 63:145-148, 2000.

Further studies establishing the function and utilities of RBM8A are found in John Hopkins OMIM database record ID 605313, and in cited publications listed in Table 5, which are hereby incorporated by reference. Arginine-glutamic acid dipeptide (re) repeats (RERE, Accession NP_036234.2) is another GAM47 target gene, herein designated TARGET GENE. RERE BINDING SITE is a target binding site found in the 3' untranslated region of mRNA encoded by RERE, corresponding to a target binding site such as BINDING SITE I, BINDING SITE II or BINDING SITE III of FIG. 8. Table 4 illustrates the complementarity of the nucleotide sequences of RERE BINDING SITE, designated SEQ ID:12774, to the nucleotide sequence of GAM47 RNA, herein designated GAM RNA, also designated SEQ ID:269.

Another function of GAM47 is therefore inhibition of Arginine-glutamic acid dipeptide (re) repeats (RERE, Accession NP_036234.2), a gene which binds DRPLA and locates in the nucleus and therefore may be associated with Dentatorubral- pallidoluysian atrophy. Accordingly, utilities of GAM47 include diagnosis, prevention and treatment of Dentatorubral-pallidoluysian atrophy, and of other diseases and clinical conditions associated with RERE.

The function of RERE has been established by previous studies. Northern blot analysis detected 2 RERE transcripts: one of 9 kb, expressed exclusively in pancreas and testis; and one of 7 kb, expressed most strongly in skeletal muscle with weaker expression in other tissues tested, including brain. The RERE protein migrated at an apparent molecular weight of 212 kD in SDS-PAGE. An RERE fusion protein localized predominantly in the nucleus. Immunoprecipitation and in vitro binding assays demonstrated that the DRPLA and RERE proteins bind each other, which is facilitated by one of the RE repeats, and that extension of the DRPLA polyglutamine tract enhances the binding. Moreover, when RERE is overexpressed, the distribution of endogenous DRPLA protein alters from a diffuse to a speckled pattern in the nucleus so as to colocalize with RERE. More RERE protein is recruited into nuclear aggregates of the DRPLA protein with extended polyglutamine than into those of pure polyglutamine. The authors suggested a function for the DRPLA protein in the nucleus and the RE repeat in the protein-protein interaction. By study of a YAC spanning a translocation/duplication breakpoint within the minimally defined loss of heterozygosity region at 1p36.2-p36.1 in a neuroblastoma cell line, Amler et al. (2000) identified the RERE gene, which they designated DNB1/ARP (deleted in neuroblastoma-1/atrophin-related protein).

Full details of the abovementioned studies are described in the following publications, the disclosure of which are hereby incorporated by reference:

Amler, L. C.; Bauer, A.; Corvi, R.; Dihlmann, S.; Praml, C.; Cavenee, W. K.; Schwab, M.; Hampton, G. M.: Identification and characterization of novel genes located at the t(1;15)(p36.2;q24) translocation breakpoint in the neuroblastoma cell line NGP. Genomics 64:195-202, 2000; and Yanagisawa, H.; Bundo, M.; Miyashita, T.; Okamura-Oho, Y.; Tadokoro, K.; Tokunaga, K.; Yamada, M.: Protein binding of a DRPLA family through arginine-glutamic acid dipeptide repeats is.

Further studies establishing the function and utilities of RERE are found in John Hopkins OMIM database record ID 605226, and in cited publications listed in Table 5, which are hereby incorporated by reference. Re1-silencing transcription factor (REST, Accession NP_005603.2) is another GAM47 target gene, herein designated TARGET GENE. REST BINDING SITE is a target binding site found in the 5' untranslated region of mRNA encoded by REST, corresponding to a target binding site such as BINDING SITE I, BINDING SITE II or BINDING SITE III of FIG. 8. Table 4 illustrates the complementarity of the nucleotide sequences of REST BINDING SITE, designated SEQ ID:13891, to the nucleotide sequence of GAM47 RNA, herein designated GAM RNA, also designated SEQ ID:269.

Another function of GAM47 is therefore inhibition of Re1-silencing transcription factor (REST, Accession NP_005603.2), a gene which may function as a master negative-regulator of neurogenesis. Accordingly, utilities of GAM47 include diagnosis, prevention and treatment of diseases and clinical conditions associated with REST.

The function of REST has been established by previous studies. Palm et al. (1999) identified several REST variants that arise from alternative splicing of an exon that they designated exon N. The splice variants produce insertions that generate in-frame stop codons and encode truncated proteins with an N-terminal repressor domain and weakened DNA-binding activity. The expression levels of these variants differ in human neuroblastoma and glial cells.

Animal model experiments lend further support to the function of REST. Chen et al. (1998) disrupted the Rest gene in mice by gene targeting in mouse embryonic stem cells. As a result, derepression of neuron-specific tubulin (OMIM Ref. No. 602529) in a subset of nonneural tissues resulted and embryonic lethality ensued.

It is appreciated that the abovementioned animal model for REST is acknowledged by those skilled in the art as a scientifically valid animal model, as can be further appreciated from the publications sited hereinbelow.

Full details of the abovementioned studies are described in the following publications, the disclosure of which are hereby incorporated by reference:

Palm, K.; Metsis, M.; Timmusk, T.: Neuron-specific splicing of zinc finger transcription factor REST/NRSF/XBR is frequent in neuroblastomas and conserved in human, mouse and rat. Molec. Brain Res. 72:30-39, 1999; and Chen, Z.-F.; Paquette, A. J.; Anderson, D. J.: NRSF/REST is required in vivo for repression of multiple neuronal target genes during embryogenesis. Nature Genet. 20:136-142, 1998.

Further studies establishing the function and utilities of REST are found in John Hopkins OMIM database record ID 600571, and in cited publications listed in Table 5, which are hereby incorporated by reference. Ret proto - oncogene (multiple endocrine neoplasia and medullary thyroid carcinoma 1, hirschsprung disease) (RET, Accession NP_065681.1) is another GAM47 target gene, herein designated TARGET GENE. RET BINDING SITE is a target binding site found in the 3' untranslated region of multiple transcripts of mRNA encoded by RET, corresponding to a target binding site such as BINDING SITE I, BINDING SITE II or BINDING SITE III of FIG. 8. Table 4 illustrates the complementarity of the nucleotide sequences of RET BINDING SITE, designated SEQ ID:12696, to the nucleotide sequence of GAM47 RNA, herein designated GAM RNA, also designated SEQ ID:269.

Another function of GAM47 is therefore inhibition of Ret proto - oncogene (multiple endocrine neoplasia and medullary thyroid carcinoma 1, hirschsprung disease) (RET, Accession NP_065681.1), a gene which transduces signals for cell growth and differentiation. and therefore may be associated with Multiple endocrine neoplasia. Accordingly, utilities of GAM47 include diagnosis, prevention and treatment of Multiple endocrine neoplasia, and of other diseases and clinical conditions associated with RET.

The function of RET has been established by previous studies. Using the approach of SSCP analysis established for all 20 exons of the RET gene, Seri et al. (1997) identified 7 additional mutations among 39 sporadic and familial cases of Hirschsprung disease (detection rate 18%). They considered that the relatively low efficiency of detecting mutations of RET in Hirschsprung patients cannot be accounted for by genetic heterogeneity, which is not supported by the results of linkage analysis in pedigrees analyzed to date. Almost 74% of the point mutations in their series, as well as in other patient series, were identified among long-segment patients, who represented only 25% of the patient population. Seri et al. (1997) found a C620R substitution in a patient affected with total colonic aganglionosis; the same mutation had been found in medullary thyroid carcinoma. An R313Q mutation (164761.0026) was identified in homozygous state in a child born of consanguineous parents and was associated with the most severe Hirschsprung phenotype, namely, a total colonic aganglionosis with small bowel involvement. Eng (1996) reviewed the role of the RET protooncogene in multiple endocrine neoplasia type II and in Hirschsprung disease. Hoppener and Lips (1996) also reviewed RET gene mutations from the point of view of the molecular biology and the clinical aspects. Eng and Mulligan (1997) tabulated mutations of the RET gene in MEN2, the related sporadic tumors medullary thyroid carcinoma and pheochromocytoma, and familial and sporadic Hirschsprung disease. Germline mutations in 1 of 8 codons within RET cause the 3 subtypes of MEN2, namely, MEN2A, MEN2B, and familial medullary thyroid carcinoma. They stated that a somatic M918T mutation (164761.0013) accounts for the largest proportion of RET mutations detected in medullary thyroid carcinomas, most series showing a 30% to 50% range. It appeared that pheochromocytomas have a wider range of RET mutations. In contrast to MEN2, approximately 25% of patients with Hirschsprung disease have germline mutations scattered throughout the length of RET.

Full details of the abovementioned studies are described in the following publications, the disclosure of which are hereby incorporated by reference:

Seri, M.; Yin, L.; Barone, A.; Bolino, A.; Celli, I.; Bocciardi, R.; Pasini, B.; Ceccherini, I.; Lerone, M.; Kristoffersson, U.; Larsson, L. T.; Casasa, J. M.; Cass, D. T.; Abramowicz, M. J.; Vanderwinden, J.-M.; Kravcenkiene, I.; Baric, I.; Silengo, M.; Martucciello, G.; Romeo, G.: Frequency of RET mutations in long- and short-segment Hirschsprung disease. Hum. Mutat. 9:243-249, 1997; and Hoppener, J. W. M.; Lips, C. J. M.: RET receptor tyrosine kinase gene mutations: molecular biological, physiological and clinical aspects. Europ. J. Clin. Invest. 26:613-624, 1996.

Further studies establishing the function and utilities of RET are found in John Hopkins OMIM database record ID 164761, and in cited publications listed in Table 5, which are hereby incorporated by reference. Ret proto - oncogene (multiple endocrine neoplasia and medullary thyroid carcinoma 1, hirschsprung disease) (RET, Accession NP_000314.1) is another GAM47 target gene, herein designated TARGET GENE. RET BINDING SITE is a target binding site found in the 3' untranslated region of multiple transcripts of mRNA encoded by RET, corresponding to a target binding site such as BINDING SITE I, BINDING SITE II or BINDING SITE III of FIG. 8. Table 4 illustrates the complementarity of the nucleotide sequences of RET BINDING SITE, designated SEQ ID:12696, to the nucleotide sequence of GAM47 RNA, herein designated GAM RNA, also designated SEQ ID:269.

Another function of GAM47 is therefore inhibition of Ret proto - oncogene (multiple endocrine neoplasia and medullary thyroid carcinoma 1, hirschsprung disease) (RET, Accession NP_000314.1), a gene which transduces signals for cell growth and differentiation. and therefore may be associated with Multiple endocrine neoplasia. Accordingly, utilities of GAM47 include diagnosis, prevention and treatment of Multiple endocrine neoplasia, and of other diseases and clinical conditions associated with RET.

The function of RET has been established by previous studies. Using the approach of SSCP analysis established for all 20 exons of the RET gene, Seri et al. (1997) identified 7 additional mutations among 39 sporadic and familial cases of Hirschsprung disease (detection rate 18%). They considered that the relatively low efficiency of detecting mutations of RET in Hirschsprung patients cannot be accounted for by genetic heterogeneity, which is not supported by the results of linkage analysis in pedigrees analyzed to date. Almost 74% of the point mutations in their series, as well as in other patient series, were identified among long-segment patients, who represented only 25% of the patient population. Seri et al. (1997) found a C620R substitution in a patient affected with total colonic aganglionosis; the same mutation had been found in medullary thyroid carcinoma. An R313Q mutation (164761.0026) was identified in homozygous state in a child born of consanguineous parents and was associated with the most severe Hirschsprung phenotype, namely, a total colonic aganglionosis with small bowel involvement. Eng (1996) reviewed the role of the RET protooncogene in multiple endocrine neoplasia type II and in Hirschsprung disease. Hoppener and Lips (1996) also reviewed RET gene mutations from the point of view of the molecular biology and the clinical aspects. Eng and Mulligan (1997) tabulated mutations of the RET gene in MEN2, the related sporadic tumors medullary thyroid carcinoma and pheochromocytoma, and familial and sporadic Hirschsprung disease. Germline mutations in 1 of 8 codons within RET cause the 3 subtypes of MEN2, namely, MEN2A, MEN2B, and familial medullary thyroid carcinoma. They stated that a somatic M918T mutation (164761.0013) accounts for the largest proportion of RET mutations detected in medullary thyroid carcinomas, most series showing a 30% to 50% range. It appeared that pheochromocytomas have a wider range of RET mutations. In contrast to MEN2, approximately 25% of patients with Hirschsprung disease have germline mutations scattered throughout the length of RET.

Full details of the abovementioned studies are described in the following publications, the disclosure of which are hereby incorporated by reference:

Seri, M.; Yin, L.; Barone, A.; Bolino, A.; Celli, I.; Bocciardi, R.; Pasini, B.; Ceccherini, I.; Lerone, M.; Kristoffersson, U.; Larsson, L. T.; Casasa, J. M.; Cass, D. T.; Abramowicz, M. J.; Vanderwinden, J.-M.; Kravcenkiene, I.; Baric, I.; Silengo, M.; Martucciello, G.; Romeo, G.: Frequency of RET mutations in long- and short-segment Hirschsprung disease. Hum. Mutat. 9:243-249, 1997; and Hoppener, J. W. M.; Lips, C. J. M.: RET receptor tyrosine kinase gene mutations: molecular biological, physiological and clinical aspects. Europ. J. Clin. Invest. 26:613-624, 1996.

Further studies establishing the function and utilities of RET are found in John Hopkins OMIM database record ID 164761, and in cited publications listed in Table 5, which are hereby incorporated by reference. Ret proto - oncogene (multiple endocrine neoplasia and medullary thyroid carcinoma 1, hirschsprung disease) (RET, Accession NP_066124.1) is another GAM47 target gene, herein designated TARGET GENE. RET BINDING SITE is a target binding site found in the 3' untranslated region of multiple transcripts of mRNA encoded by RET, corresponding to a target binding site such as BINDING SITE I, BINDING SITE II or BINDING SITE III of FIG. 8. Table 4 illustrates the complementarity of the nucleotide sequences of RET BINDING SITE, designated SEQ ID:12696, to the nucleotide sequence of GAM47 RNA, herein designated GAM RNA, also designated SEQ ID:269.

Another function of GAM47 is therefore inhibition of Ret proto - oncogene (multiple endocrine neoplasia and medullary thyroid carcinoma 1, hirschsprung disease) (RET, Accession NP_066124.1), a gene which transduces signals for cell growth and differentiation. and therefore may be associated with Multiple endocrine neoplasia. Accordingly, utilities of GAM47 include diagnosis, prevention and treatment of Multiple endocrine neoplasia, and of other diseases and clinical conditions associated with RET.

The function of RET has been established by previous studies. Using the approach of SSCP analysis established for all 20 exons of the RET gene, Seri et al. (1997) identified 7 additional mutations among 39 sporadic and familial cases of Hirschsprung disease (detection rate 18%). They considered that the relatively low efficiency of detecting mutations of RET in Hirschsprung patients cannot be accounted for by genetic heterogeneity, which is not supported by the results of linkage analysis in pedigrees analyzed to date. Almost 74% of the point mutations in their series, as well as in other patient series, were identified among long-segment patients, who represented only 25% of the patient population. Seri et al. (1997) found a C620R substitution in a patient affected with total colonic aganglionosis; the same mutation had been found in medullary thyroid carcinoma. An R313Q mutation (164761.0026) was identified in homozygous state in a child born of consanguineous parents and was associated with the most severe Hirschsprung phenotype, namely, a total colonic aganglionosis with small bowel involvement. Eng (1996) reviewed the role of the RET protooncogene in multiple endocrine neoplasia type II and in Hirschsprung disease. Hoppener and Lips (1996) also reviewed RET gene mutations from the point of view of the molecular biology and the clinical aspects. Eng and Mulligan (1997) tabulated mutations of the RET gene in MEN2, the related sporadic tumors medullary thyroid carcinoma and pheochromocytoma, and familial and sporadic Hirschsprung disease. Germline mutations in 1 of 8 codons within RET cause the 3 subtypes of MEN2, namely, MEN2A, MEN2B, and familial medullary thyroid carcinoma. They stated that a somatic M918T mutation (164761.0013) accounts for the largest proportion of RET mutations detected in medullary thyroid carcinomas, most series showing a 30% to 50% range. It appeared that pheochromocytomas have a wider range of RET mutations. In contrast to MEN2, approximately 25% of patients with Hirschsprung disease have germline mutations scattered throughout the length of RET.

Full details of the abovementioned studies are described in the following publications, the disclosure of which are hereby incorporated by reference:

Seri, M.; Yin, L.; Barone, A.; Bolino, A.; Celli, I.; Bocciardi, R.; Pasini, B.; Ceccherini, I.; Lerone, M.; Kristoffersson, U.; Larsson, L. T.; Casasa, J. M.; Cass, D. T.; Abramowicz, M. J.; Vanderwinden, J.-M.; Kravcenkiene, I.; Baric, I.; Silengo, M.; Martucciello, G.; Romeo, G.: Frequency of RET mutations in long- and short-segment Hirschsprung disease. Hum. Mutat. 9:243-249, 1997; and Hoppener, J. W. M.; Lips, C. J. M.: RET receptor tyrosine kinase gene mutations: molecular biological, physiological and clinical aspects. Europ. J. Clin. Invest. 26:613-624, 1996.

Further studies establishing the function and utilities of RET are found in John Hopkins OMIM database record ID 164761, and in cited publications listed in Table 5, which are hereby incorporated by reference. SCRG1 (Accession NP_009212.1) is another GAM47 target gene, herein designated TARGET GENE. SCRG1 BINDING SITE is a target binding site found in the 5' untranslated region of mRNA encoded by SCRG1, corresponding to a target binding site such as BINDING SITE I, BINDING SITE II or BINDING SITE III of FIG. 8. Table 4 illustrates the complementarity of the nucleotide sequences of SCRG1 BINDING SITE, designated SEQ ID:18361, to the nucleotide sequence of GAM47 RNA, herein designated GAM RNA, also designated SEQ ID:269.

Another function of GAM47 is therefore inhibition of SCRG1 (Accession NP_009212.1). Accordingly, utilities of GAM47 include diagnosis, prevention and treatment of diseases and clinical conditions associated with SCRG1.

Syndecan 1 (SDC1, Accession NP_002988.3) is another GAM47 target gene, herein designated TARGET GENE. SDC1 BINDING SITE1 and SDC1 BINDING SITE2 are target binding sites found in untranslated regions of mRNA encoded by SDC1, corresponding to target binding sites such as BINDING SITE I, BINDING SITE II or BINDING SITE III of FIG. 8. Table 4 illustrates the complementarity of the nucleotide sequences of SDC1 BINDING SITE1 and SDC1 BINDING SITE2, designated SEQ ID:8422 and SEQ ID:6892 respectively, to the nucleotide sequence of GAM47 RNA, herein designated GAM RNA, also designated SEQ ID:269.

Another function of GAM47 is therefore inhibition of Syndecan 1 (SDC1, Accession NP_002988.3), a gene which mediates cell behaviors like cell adhesion, action of growth factors. Accordingly, utilities of GAM47 include diagnosis, prevention and treatment of diseases and clinical conditions associated with SDC1.

The function of SDC1 has been established by previous studies. Sanderson et al. (1989) showed that Sdc1 is expressed in mouse only when and where B lymphocytes associate with extracellular matrix, namely as B-cell precursors in bone marrow and as immobilized plasma cells in interstitial matrices. Expression is lost immediately before maturation and release of B lymphocytes into the circulation and is absent on circulating and mature peripheral B lymphocytes. SDC1 is reexpressed on differentiated plasma cells and is a marker for cells secreting immunoglobulin. By probing a breast epithelial cell line cDNA library with mouse syndecan probes, Mali et al. (1990) obtained a cDNA encoding human SDC1. Sequence analysis predicted that the 310-amino acid human protein is 77% identical to the mouse sequence. SDC1 has an ectodomain, a 25-residue transmembrane domain, and a 34-residue cytoplasmic domain, which are 70%, 96%, and 100% identical to those of the mouse protein, respectively. The ectodomain is preceded by an N-terminal signal peptide and contains 5 potential glycosaminoglycan- attachment sites, 1 potential N-glycosylation site, and a dibasic lys-arg cleavage site adjacent to the transmembrane domain. Northern blot analysis revealed expression of 2.6 - and 3.4-kb SDC1 transcripts in mammary epithelial and carcinoma cells and in fetal skin; a 4.5-kb transcript was detected in brain.

Animal model experiments lend further support to the function of SDC1. Reizes et al. (2001) found that transgenic expression in the hypothalamus of Sdc1 produced mice with hyperphagia and maturity-onset obesity resembling mice with reduced action of alpha-melanocyte-stimulating hormone (alpha-MSH; OMIM Ref. No. 155555). Via their heparan sulfate chains, syndecans potentiate the action of agouti-related protein (OMIM Ref. No. 602311) and agouti signaling protein (OMIM Ref. No. 600201), endogenous inhibitors of alpha-MSH. In wildtype mice, Sdc3 (OMIM Ref. No. 186357), the predominantly neural syndecan, was expressed in hypothalamic regions that control energy balance. Food deprivation increased hypothalamic Sdc3 levels several-fold. Sdc3 null mice, which otherwise appeared normal, responded to food deprivation with markedly reduced reflex hyperphagia. Reizes et al. (2001) proposed that oscillation of hypothalamic SDC3 levels physiologically modulates feeding behavior.

It is appreciated that the abovementioned animal model for SDC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Alexander, C. M.; Reichsman, F.; Hinkes, M. T.; Lincecum, J.; Becker, K. A.; Cumberledge, S.; Bernfield, M.: Syndecan-1 is required for Wnt-1- induced mammary tumorigenesis in mice. Nature Genet. 25:329-332, 2000; and Mali, M.; Jaakkola, P.; Arvilommi, A.-M.; Jalkanen, M.: Sequence of human syndecan indicates a novel gene family of integral membrane proteoglycans. J. Biol. Chem. 265:6884-6889, 199.

Further studies establishing the function and utilities of SDC1 are found in John Hopkins OMIM database record ID 186355, and in cited publications listed in Table 5, which are hereby incorporated by reference. SDS3 (Accession XP_045014.1) is another GAM47 target gene, herein designated TARGET GENE. SDS3 BINDING SITE is a target binding site found in the 3' untranslated region of mRNA encoded by SDS3, corresponding to a target binding site such as BINDING SITE I, BINDING SITE II or BINDING SITE III of FIG. 8. Table 4 illustrates the complementarity of the nucleotide sequences of SDS3 BINDING SITE, designated SEQ ID:5572, to the nucleotide sequence of GAM47 RNA, herein designated GAM RNA, also designated SEQ ID:269.

Another function of GAM47 is therefore inhibition of SDS3 (Accession XP_045014.1). Accordingly, utilities of GAM47 include diagnosis, prevention and treatment of diseases and clinical conditions associated with SDS3.

SEC15B (Accession XP_039570.3) is another GAM47 target gene, herein designated TARGET GENE. SEC15B BINDING SITE is a target binding site found in the 3' untranslated region of mRNA encoded by SEC15B, corresponding to a target binding site such as BINDING SITE I, BINDING SITE II or BINDING SITE III of FIG. 8. Table 4 illustrates the complementarity of the nucleotide sequences of SEC15B BINDING SITE, designated SEQ ID:6612, to the nucleotide sequence of GAM47 RNA, herein designated GAM RNA, also designated SEQ ID:269.

Another function of GAM47 is therefore inhibition of SEC15B (Accession XP_039570.3). Accordingly, utilities of GAM47 include diagnosis, prevention and treatment of diseases and clinical conditions associated with SEC15B.

SEC61A1 (Accession NP_037468.1) is another GAM47 target gene, herein designated TARGET GENE. SEC61A1 BINDING SITE is a target binding site found in the 3' untranslated region of mRNA encoded by SEC61A1, corresponding to a target binding site such as BINDING SITE I, BINDING SITE II or BINDING SITE III of FIG. 8. Table 4 illustrates the complementarity of the nucleotide sequences of SEC61A1 BINDING SITE, designated SEQ ID:13837, to the nucleotide sequence of GAM47 RNA, herein designated GAM RNA, also designated SEQ ID:269.

Another function of GAM47 is therefore inhibition of SEC61A1 (Accession NP_037468.1). Accordingly, utilities of GAM47 include diagnosis, prevention and treatment of diseases and clinical conditions associated with SEC61A1.

Sema domain, immunoglobulin domain (ig), and gpi membrane anchor, (semaphorin) 7a (SEMA7A, Accession NP_003603.1) is another GAM47 target gene, herein designated TARGET GENE. SEMA7A BINDING SITE is a target binding site found in the 3' untranslated region of mRNA encoded by SEMA7A, corresponding to a target binding site such as BINDING SITE I, BINDING SITE II or BINDING SITE III of FIG. 8. Table 4 illustrates the complementarity of the nucleotide sequences of SEMA7A BINDING SITE, designated SEQ ID:17524, to the nucleotide sequence of GAM47 RNA, herein designated GAM RNA, also designated SEQ ID:269.

Another function of GAM47 is therefore inhibition of Sema domain, immunoglobulin domain (ig), and gpi membrane anchor, (semaphorin) 7a (SEMA7A, Accession NP_003603.1). Accordingly, utilities of GAM47 include diagnosis, prevention and treatment of diseases and clinical conditions associated with SEMA7A.

Secreted frizzled-related protein 2 (SFRP2, Accession XP_050625.1) is another GAM47 target gene, herein designated TARGET GENE. SFRP2 BINDING SITE is a target binding site found in the 3' untranslated region of mRNA encoded by SFRP2, corresponding to a target binding site such as BINDING SITE I, BINDING SITE II or BINDING SITE III of FIG. 8. Table 4 illustrates the complementarity of the nucleotide sequences of SFRP2 BINDING SITE, designated SEQ ID:14061, to the nucleotide sequence of GAM47 RNA, herein designated GAM RNA, also designated SEQ ID:269.

Another function of GAM47 is therefore inhibition of Secreted frizzled-related protein 2 (SFRP2, Accession XP_050625.1), a gene which receptor for wnt proteins that may modulate Wnt protein function and retinal cell polarization. Accordingly, utilities of GAM47 include diagnosis, prevention and treatment of diseases and clinical conditions associated with SFRP2.

The function of SFRP2 has been established by previous studies. Melkonyan et al. (1997) isolated cDNAs encoding the related human proteins SARP1 (secreted apoptosis-related protein-1), SARP2 (SFRP1; 604156) and SARP3 (SFRP5; 604158). Each of these proteins contains a signal peptide followed by an N-terminal cysteine-rich region (CRD) homologous to the extracellular CRD of frizzled-like proteins. The partial human SARP1 cDNA encodes a polypeptide that is 95% identical to mouse Sarp1. When expressed in a breast adenocarcinoma cell line, mouse SARP1 and human SARP2 exhibited opposite effects on cell sensitivity to proapoptotic stimuli. Whereas cells with SARP1 had higher resistance, cells expressing SARP2 were sensitized to apoptosis induced by tumor necrosis factor (OMIM Ref. No. 191160) and ceramide. Expression of SARP1 or SARP2 modified the intracellular levels of beta-catenin (OMIM Ref. No. 116806), an indicator of Wnt-frizzled protein interaction and signal transduction, suggesting that SARPs interfere with the Wnt-frizzled signaling pathway. Northern blot analysis revealed that the SARP genes have distinct expression patterns. SARP1 is expressed as 2.2- and 1.3-kb transcripts in several human tissues, with the highest levels in colon and small intestine. Chang et al. (1999) reported that SARP1, or SFRP2, is highly and preferentially expressed in bovine retina throughout the inner nuclear layer. Within the retina, SARP3, or SFRP5, is specifically expressed in the retinal pigment epithelium (RPE), suggesting that photoreceptors are bathed by 2 complementary gradients of SFRP signaling molecules/modulators. The authors speculated that these putative inverse gradients of SFRP2 and SFRP5 might be involved in determining the polarity of photoreceptors and perhaps other cells in the retina.

Full details of the abovementioned studies are described in the following publications, the disclosure of which are hereby incorporated by reference:

Melkonyan, H. S.; Chang, W. C.; Shapiro, J. P.; Mahadevappa, M.; Fitzpatrick, P. A.; Kiefer, M. C.; Tomei, L. D.; Umansky, S. R.: SARPs: a family of secreted apoptosis-related proteins. Proc. Nat. Acad. Sci. 94:13636-13641, 1997; and Chang, J. T.; Esumi, N.; Moore, K.; Li, Y.; Zhang, S.; Chew, C.; Goodman, B.; Rattner, A.; Moody, S.; Stetten, G.; Campochiaro, P. A.; Zack, D. J.: Cloning and characterization of a secret.

Further studies establishing the function and utilities of SFRP2 are found in John Hopkins OMIM database record ID 604157, and in cited publications listed in Table 5, which are hereby incorporated by reference. Sideroflexin 1 (SFXN1, Accession NP_073591.2) is another GAM47 target gene, herein designated TARGET GENE. SFXN1 BINDING SITE is a target binding site found in the 3' untranslated region of mRNA encoded by SFXN1, corresponding to a target binding site such as BINDING SITE I, BINDING SITE II or BIND- ING SITE III of FIG. 8. Table 4 illustrates the complementarity of the nucleotide sequences of SFXN1 BINDING SITE, designated SEQ ID:7501, to the nucleotide sequence of GAM47 RNA, herein designated GAM RNA, also designated SEQ ID:269.

Another function of GAM47 is therefore inhibition of Sideroflexin 1 (SFXN1, Accession NP_073591.2). Accordingly, utilities of GAM47 include diagnosis, prevention and treatment of diseases and clinical conditions associated with SFXN1.

Sh3-domain binding protein 2 (SH3BP2, Accession NP_003014.2) is another GAM47 target gene, herein designated TARGET GENE. SH3BP2 BINDING SITE is a target binding site found in the 3' untranslated region of mRNA encoded by SH3BP2, corresponding to a target binding site such as BINDING SITE I, BINDING SITE II or BINDING SITE III of FIG. 8. Table 4 illustrates the complementarity of the nucleotide sequences of SH3BP2 BINDING SITE, designated SEQ ID:12033, to the nucleotide sequence of GAM47 RNA, herein designated GAM RNA, also designated SEQ ID:269.

Another function of GAM47 is therefore inhibition of Sh3-domain binding protein 2 (SH3BP2, Accession NP_003014.2). Accordingly, utilities of GAM47 include diagnosis, prevention and treatment of diseases and clinical conditions associated with SH3BP2.

Sh3-domain grb2-like endophilin b2 (SH3GLB2, Accession NP_064530.1) is another GAM47 target gene, herein designated TARGET GENE. SH3GLB2 BINDING SITE is a target binding site found in the 3' untranslated region of mRNA encoded by SH3GLB2, corresponding to a target binding site such as BINDING SITE I, BINDING SITE II or BINDING SITE III of FIG. 8. Table 4 illustrates the complementarity of the nucleotide sequences of SH3GLB2 BINDING SITE, designated SEQ ID:19409, to the nucleotide sequence of GAM47 RNA, herein designated GAM RNA, also designated SEQ ID:269.

Another function of GAM47 is therefore inhibition of Sh3-domain grb2-like endophilin b2 (SH3GLB2, Accession NP_064530.1). Accordingly, utilities of GAM47 include diagnosis, prevention and treatment of diseases and clinical conditions associated with SH3GLB2.

Split hand/foot malformation (ectrodactyly) type 3 (SHFM3, Accession NP_071322.1) is another GAM47 target gene, herein designated TARGET GENE. SHFM3 BINDING SITE is a target binding site found in the 3' untranslated region of mRNA encoded by SHFM3, corresponding to a target binding site such as BINDING SITE I, BINDING SITE II or BINDING SITE III of FIG. 8. Table 4 illustrates the complementarity of the nucleotide sequences of SHFM3 BINDING SITE, designated SEQ ID:18245, to the nucleotide sequence of GAM47 RNA, herein designated GAM RNA, also designated SEQ ID:269.

Another function of GAM47 is therefore inhibition of Split hand/foot malformation (ectrodactyly) type 3 (SHFM3, Accession NP_071322.1), a gene which probably binds to some phosphorylated proteins and promotes their degradation. and therefore may be associated with Split-hand/split-foot malformation. Accordingly, utilities of GAM47 include diagnosis, prevention and treatment of Split-hand/split-foot malformation, and of other diseases and clinical conditions associated with SHFM3.

The function of SHFM3 has been established by previous studies. By 2-point linkage analysis in a large Turkish family with isolated SHFM, Ozen et al. (1999) mapped the disorder to 10q24 and narrowed the SHFM3 region from 9 cM to an approximately 2-cM critical interval between genetic markers D10S1147 and D10S1240. In several instances they found a more severe phenotype in offspring of a mildly affected parent, suggesting anticipation. Data from this family, combined with those from 6 other pedigrees mapped to 10q24, demonstrated biased transmission of SHFM3 alleles from affected fathers to offspring. The degree of this segregation distortion was obvious in male offspring and was possibly of the same magnitude for female offspring.

Animal model experiments lend further support to the function of SHFM3. Early outgrowth of the vertebrate embryonic limb requires signaling by the apical ectodermal ridge (AER) to the progress zone (PZ), which in response proliferates and lays down the pattern of the presumptive limb in a proximal to distal progression. Signals from the PZ maintain the AER until the anlagen for the distal phalanges have been formed. The semidominant mouse mutant dactylaplasia (Dac) disrupts the maintenance of the AER, leading to truncation of distal structures of the developing footplate, or autopod. Adult Dac homozygotes thus lack hands and feet except for malformed single digits, whereas heterozygotes lack phalanges of the 3 middle digits. Dac resembles the human split-hand/foot malformation. The area of mapping of SHFM3 on 10q24 shows conservation of synteny with the Dac region on mouse chromosome 19; thus, SHFM3 may be due to disruption of the human homolog of Dac. Sidow et al. (1999) reported the positional cloning of Dac and showed that it belongs to the F-box/WD40 gene family, which encodes adaptors that target specific proteins for destruction by presenting them to the ubiquitination machinery. In connection with biochemical studies, this report demonstrated the importance of this gene family in vertebrate embryonic development. Sidow et al. (1999) designated the product of the large gene found to be disrupted by the Dac mutations dactylin. Two different alleles of Dac were found to be due to insertions, a common mechanism of mutation in the mouse.

It is appreciated that the abovementioned animal model for SHFM3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ozen, R. S.; Baysal, B. E.; Devlin, B.; Farr, J. E.; Gorry, M.; Ehrlich, G. D.; Richard, C. W., III : Fine mapping of the split-hand/split-foot locus (SHFM3) at 10q24: evidence for anticipation and segregation distortion. Am. J. Hum. Genet. 64:1646-1654, 1999; and Sidow, A.; Bulotsky, M. S.; Kerrebrock, A. W.; Birren, B. W.; Altshuler, D; Jaenisch, R.; Johnson, K. R.; Lander, E. S.: A novel member of the F-box/WD40 gene family, encoding dactylin.

Further studies establishing the function and utilities of SHFM3 are found in John Hopkins OMIM database record ID 600095, and in cited publications listed in Table 5, which are hereby incorporated by reference. S-phase kinase-associated protein 1a (p19a) (SKP1A, Accession NP_733779.1) is another GAM47 target gene, herein designated TARGET GENE. SKP1A BINDING SITE is a target binding site found in the 5' untranslated region of multiple transcripts of mRNA encoded by SKP1A, corresponding to a target binding site such as BINDING SITE I, BINDING SITE II or BINDING SITE III of FIG. 8. Table 4 illustrates the complementarity of the nucleotide sequences of SKP1A BINDING SITE, designated SEQ ID:7175, to the nucleotide sequence of GAM47 RNA, herein designated GAM RNA, also designated SEQ ID:269.

Another function of GAM47 is therefore inhibition of S-phase kinase-associated protein 1a (p19a) (SKP1A, Accession NP_733779.1). Accordingly, utilities of GAM47 include diagnosis, prevention and treatment of diseases and clinical conditions associated with SKP1A.

S-phase kinase-associated protein 1a (p19a) (SKP1A, Accession NP_008861.2) is another GAM47 target gene, herein designated TARGET GENE. SKP1A BINDING SITE is a target binding site found in the 5' untranslated region of multiple transcripts of mRNA encoded by SKP1A, corresponding to a target binding site such as BINDING SITE I, BINDING SITE II or BINDING SITE III of FIG. 8. Table 4 illustrates the complementarity of the nucleotide sequences of SKP1A BINDING SITE, designated SEQ ID:7175, to the nucleotide sequence of GAM47 RNA, herein designated GAM RNA, also designated SEQ ID:269.

Another function of GAM47 is therefore inhibition of S-phase kinase-associated protein 1a (p19a) (SKP1A, Accession NP_008861.2). Accordingly, utilities of GAM47 include diagnosis, prevention and treatment of diseases and clinical conditions associated with SKP1A.

SLC9A8 (Accession XP_030524.2) is another GAM47 target gene, herein designated TARGET GENE. SLC9A8 BINDING SITE1 and SLC9A8 BINDING SITE2 are target binding sites found in untranslated regions of mRNA encoded by SLC9A8, corresponding to target binding sites such as BINDING SITE I, BINDING SITE II or BINDING SITE III of FIG. 8. Table 4 illustrates the complementarity of the nucleotide sequences of SLC9A8 BINDING SITE1 and SLC9A8 BINDING SITE2, designated SEQ ID:9672 and SEQ ID:1205 respectively, to the nucleotide sequence of GAM47 RNA, herein designated GAM RNA, also designated SEQ ID:269.

Another function of GAM47 is therefore inhibition of SLC9A8 (Accession XP_030524.2). Accordingly, utilities of GAM47 include diagnosis, prevention and treatment of diseases and clinical conditions associated with SLC9A8.

SMOC1 (Accession NP_071420.1) is another GAM47 target gene, herein designated TARGET GENE. SMOC1 BINDING SITE is a target binding site found in the 3' untranslated region of mRNA encoded by SMOC1, corresponding to a target binding site such as BINDING SITE I, BINDING SITE II or BINDING SITE III of FIG. 8. Table 4 illustrates the complementarity of the nucleotide sequences of SMOC1 BINDING SITE, designated SEQ ID:5573, to the nucleotide sequence of GAM47 RNA, herein designated GAM RNA, also designated SEQ ID:269.

Another function of GAM47 is therefore inhibition of SMOC1 (Accession NP_071420.1). Accordingly, utilities of GAM47 include diagnosis, prevention and treatment of diseases and clinical conditions associated with SMOC1.

Superoxide dismutase 3, extracellular (SOD3, Accession NP_003093.1) is another GAM47 target gene, herein designated TARGET GENE. SOD3 BINDING SITE is a target binding site found in the 3' untranslated region of mRNA encoded by SOD3, corresponding to a target binding site such as BINDING SITE I, BINDING SITE II or BINDING SITE III of FIG. 8. Table 4 illustrates the complementarity of the nucleotide sequences of SOD3 BINDING SITE, designated SEQ ID:3673, to the nucleotide sequence of GAM47 RNA, herein designated GAM RNA, also designated SEQ ID:269.

Another function of GAM47 is therefore inhibition of Superoxide dismutase 3, extracellular (SOD3, Accession NP_003093.1), a gene which destroys radicals, but when he has a mutation, the extracellular SOD3 increases. Accordingly, utilities of GAM47 include diagnosis, prevention and treatment of diseases and clinical conditions associated with SOD3.

The function of SOD3 has been established by previous studies. Marklund (1984) demonstrated that in man the highest levels of SOD3 are found in lung, pancreas, thyroid, and uterus. By RNA gel blot analysis, Folz and Crapo (1994) determined that the highest levels of EC-SOD expression are in adult heart, placenta, pancreas, and lung, followed by moderate expression in kidney, skeletal muscle, and liver. Little EC-SOD mRNA was detected in brain or liver. This pattern of expression is in marked contrast to the relative protein concentration and activity of EC-SOD in these tissues as suggested by Marklund (1984). There may be a substantially higher ratio of enzyme activity to mRNA levels in the brain, pancreas, lung, and kidney, indicating that these tissues have enhanced affinity for circulating EC-SOD or translate the EC-SOD message more efficiently than other tissues. Folz and Crapo (1994) suggested that the EC-SOD gene contains unique transcriptional regulatory elements and that its expression may be regulated at the posttranscriptional or posttranslational level. In the vascular system, SOD3 appears to be located on the endothelial cell surface. The characteristic distinguishing SOD3 from SOD1 and SOD2 is the heparin-binding capacity. SOD3 binds on the surface of endothelial cells through the heparan sulfate proteoglycan and eliminates the oxygen radicals from the NADP-dependent oxidative system of neutrophils. Adachi et al. (1992) developed an immunoassay system for EC-SOD in order to measure EC-SOD levels in the serum of healthy subjects. They found that 6% of these persons had an SOD3 level that was 10- to 15-fold higher than the mean SOD3 level in all subjects. The familial nature of high serum level was established by Adachi et al. (1993). Sandstrom et al. (1994) reported that about 2% of the plasma donors in Sweden had an 8- to 10-fold higher EC-SOD level and that a single base substitution of C to G at position 760 of the cDNA (185490.0001) was responsible for the high level in plasma. Yamada et al. (1995) performed molecular analysis of the EC-SOD gene from Japanese individuals having a high serum SOD3 level and detected the same C- to - G mutation in healthy persons and hemodialysis patients.

Full details of the abovementioned studies are described in the following publications, the disclosure of which are hereby incorporated by reference:

Sandstrom, J.; Nilsson, P.; Karlsson, K.; Marklund, S. L.:.: 10-fold increase in human plasma extracellular superoxide dismutase content caused by a mutation in heparin-binding domain. J. Biol. Chem. 269:19163-19166, 1994; and Folz, R. J.; Crapo, J. D.: Extracellular superoxide dismutase (SOD3): tissue- specific expression, genomic characterization, and computer-assisted sequence analysis of the human EC SOD gene.

Further studies establishing the function and utilities of SOD3 are found in John Hopkins OMIM database record ID 185490, and in cited publications listed in Table 5, which are hereby incorporated by reference. Secreted protein, acidic, cysteine-rich (osteonectin) (SPARC, Accession NP_003109.1) is another GAM47 target gene, herein designated TARGET GENE. SPARC BINDING SITE is a target binding site found in the 3' untranslated region of mRNA encoded by SPARC, corresponding to a target binding site such as BINDING SITE I, BINDING SITE II or BINDING SITE III of FIG. 8. Table 4 illustrates the complementarity of the nucleotide sequences of SPARC BINDING SITE, designated SEQ ID:10553, to the nucleotide sequence of GAM47 RNA, herein designated GAM RNA, also designated SEQ ID:269.

Another function of GAM47 is therefore inhibition of Secreted protein, acidic, cysteine-rich (osteonectin) (SPARC, Accession NP_003109.1), a gene which . appears to regulate cell growth through interactions with the extracellular matrix and cytokines. binds calcium and copper, several types of collagen, albumin, thrombospondin, pdgf and cell membranes. Accordingly, utilities of GAM47 include diagnosis, prevention and treatment of diseases and clinical conditions associated with SPARC.

The function of SPARC has been established by previous studies. PARC is identical to osteonectin (from Latin verb nectere, to bind, bridge or link), a protein important to bone calcification which was identified by Termine et al. (1981). It is a 32,000-dalton, bone-specific phosphoprotein that binds selectively to hydroxyapatite and to collagen fibrils at distinct sites. Osteonectin accounts for the unique property of bone collagen to undergo calcification; type I collagen of bone is identical to that of skin and tendon. In bone, it is present in a concentration of 2.3 micrograms per 10 micrograms of protein. It is present also in dentin but absent from all other tissues. By comparison of protein sequences as well as investigation of the genes, Findlay et al. (1988) concluded that osteonectin is highly conserved between species. Naylor et al. (1989) demonstrated RFLPs of the ON gene which should be useful as markers on chromosome 5 and for investigating the possible role of osteonectin in bone diseases. SPARC, which can be selectively expressed by the endothelium in response to certain types of injury, induces rounding in adherent endothelial cells in vitro. From the results of studies on the influence of SPARC on endothelial permeability, Goldblum et al. (1994) concluded that SPARC regulates endothelial barrier function through F-actin-dependent changes in cell shape, coincident with the appearance of intercellular gaps, that provide a paracellular pathway for extravasation of macromolecules.

Animal model experiments lend further support to the function of SPARC. Gilmour et al. (1998) generated mice deficient for SPARC by targeted disruption. SPARC-deficient mice appeared normal and fertile until around 6 months of age, when they developed severe eye pathology characterized by cataract formation and rupture of the lens capsule. The first sign of lens pathology occurred in the equatorial bow region where vacuoles gradually formed within differentiating epithelial cells and fiber cells. The lens capsule, however, showed no qualitative changes in the major basal lamina proteins laminin, collagen IV, perlecan, or entactin.

It is appreciated that the abovementioned animal model for SPARC is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gilmour, D. T.; Lyon, G. J.; Carlton, M. B. L.; Sanes, J. R.; Cunningham, J. M.; Anderson, J. R.; Hogan, B. L. M.; Evans, M. J.; Colledge, W. H.: Mice deficient for the secreted glycoprotein SPARC/osteonectin/BM40 develop normally but show severe age-onset cataract formation and disruption of the lens. EMBO J. 17:1860-1870, 1998; and Le Beau et al. (1993) mapped the SPARC gene to 5q31.3-q32. SGoldblum, S. E.; Ding, X.; Funk, S. E.; Sage, E. H.: SPARC (secreted protein acidic and rich in cysteine) regulates endotheli.

Further studies establishing the function and utilities of SPARC are found in John Hopkins OMIM database record ID 182120, and in cited publications listed in Table 5, which are hereby incorporated by reference. Sparc/osteonectin, cwcv and kazal-like domains proteoglycan (testican) (SPOCK, Accession NP_004589.1) is another GAM47 target gene, herein designated TARGET GENE. SPOCK BINDING SITE is a target binding site found in the 3' untranslated region of mRNA encoded by SPOCK, corresponding to a target binding site such as BINDING SITE I, BINDING SITE II or BINDING SITE III of FIG. 8. Table 4 illustrates the complementarity of the nucleotide sequences of SPOCK BINDING SITE, designated SEQ ID:11060, to the nucleotide sequence of GAM47 RNA, herein designated GAM RNA, also designated SEQ ID:269.

Another function of GAM47 is therefore inhibition of Sparc/osteonectin, cwcv and kazal-like domains proteoglycan (testican) (SPOCK, Accession NP_004589.1). Accordingly, utilities of GAM47 include diagnosis, prevention and treatment of diseases and clinical conditions associated with SPOCK.

SPRR4 (Accession NP_775103.1) is another GAM47 target gene, herein designated TARGET GENE. SPRR4 BINDING SITE is a target binding site found in the 3' untranslated region of mRNA encoded by SPRR4, corresponding to a target binding site such as BINDING SITE I, BINDING SITE II or BINDING SITE III of FIG. 8. Table 4 illustrates the complementarity of the nucleotide sequences of SPRR4 BINDING SITE, designated SEQ ID:18654, to the nucleotide sequence of GAM47 RNA, herein designated GAM RNA, also designated SEQ ID:269.

Another function of GAM47 is therefore inhibition of SPRR4 (Accession NP_775103.1). Accordingly, utilities of GAM47 include diagnosis, prevention and treatment of diseases and clinical conditions associated with SPRR4.

Sequestosome 1 (SQSTM1, Accession NP_003891.1) is another GAM47 target gene, herein designated TARGET GENE. SQSTM1 BINDING SITE is a target binding site found in the 3' untranslated region of mRNA encoded by SQSTM1, corresponding to a target binding site such as BINDING SITE I, BINDING SITE II or BINDING SITE III of FIG. 8. Table 4 illustrates the complementarity of the nucleotide sequences of SQSTM1 BINDING SITE, designated SEQ ID:18350, to the nucleotide sequence of GAM47 RNA, herein designated GAM RNA, also designated SEQ ID:269.

Another function of GAM47 is therefore inhibition of Sequestosome 1 (SQSTM1, Accession NP_003891.1), a gene which binds SH2 domain of p56lck and ubiquitin, and it is associated with a serine/threonine kinase activity and therefore is associated with Paget disease of bone. Accordingly, utilities of GAM47 include diagnosis, prevention and treatment of Paget disease of bone, and of other diseases and clinical conditions associated with SQSTM1.

The function of SQSTM1 has been established by previous studies. Using 24 French Canadian families and 112 unrelated individuals with Paget disease of bone (OMIM Ref. No. 602080), Laurin et al. (2002) confined the PDB3 locus (OMIM Ref. No. 606262) on 5q35-qter to a region of approximately 300 kb. Within this interval, 2 disease-related haplotype signatures were observed in 11 families and 18 unrelated patients. This region encoded the SQSTM1 gene, which is a candidate gene for PDB because of its association with the RANK pathway (see OMIM Ref. No. 603499). Screening SQSTM1 for mutations led to the identification of a recurrent nonconservative change (P392L; 601530.0001) flanking the ubiquitin-associated domain (UBA; position 394-440) of the protein that was not present in 291 control individuals. The data demonstrated that 2 independent mutational events at the same position in SQSTM1 cause Paget disease of bone in a high proportion of French Canadian patients. The Src homology type 2 (SH2) domain is a highly conserved motif of about 100 amino acids which mediates protein-protein interactions by binding to phosphotyrosine. p56-lck (OMIM Ref. No. 153390), a T-cell-specific src family tyrosine kinase with an SH2 domain, is involved in T-cell signal transduction. A 62-kD protein (p62) was identified by Park et al. (1995) as a ligand of the p56-lck SH2 domain. Park et al. (1995) found that the p56-lck SH2 domain binds to p62 at the ser59 of p62 only when that serine is phosphorylated. Moreover, Park et al. (1995) found that p62 is associated with a serine/threonine kinase activity and also binds to ras GTPase-activating protein, a negative regulator of the ras signaling pathway.

Full details of the abovementioned studies are described in the following publications, the disclosure of which are hereby incorporated by reference:

Laurin, N.; Brown, J. P.; Morissette, J.; Raymond, V.: Recurrent mutation of the gene encoding sequestosome 1 (SQSTM1/p62) in Paget disease of bone. Am. J. Hum. Genet. 70:1582-1588, 2002; and Park, I.; Chung, J.; Walsh, C. T.; Yun, Y.; Strominger, J. L.; Shin, J.: Phosphotyrosine-independent binding of a 62-kDa protein to the src homology 2 (SH2) domain of p56-lck and its regu.

Further studies establishing the function and utilities of SQSTM1 are found in John Hopkins OMIM database record ID 601530, and in cited publications listed in Table 5, which are hereby incorporated by reference. Signal transducer and activator of transcription 3 (acute-phase response factor) (STAT3, Accession NP_003141.2) is another GAM47 target gene, herein designated TARGET GENE. STAT3 BINDING SITE is a target binding site found in the 3' untranslated region of multiple transcripts of mRNA encoded by STAT3, corresponding to a target binding site such as BINDING SITE I, BINDING SITE II or BINDING SITE III of FIG. 8. Table 4 illustrates the complementarity of the nucleotide sequences of STAT3 BINDING SITE, designated SEQ ID:19871, to the nucleotide sequence of GAM47 RNA, herein designated GAM RNA, also designated SEQ ID:269.

Another function of GAM47 is therefore inhibition of Signal transducer and activator of transcription 3 (acute-phase response factor) (STAT3, Accession NP_003141.2), a gene which carries out a dual function: signal transduction and activation of transcription. Accordingly, utilities of GAM47 include diagnosis, prevention and treatment of diseases and clinical conditions associated with STAT3.

The function of STAT3 has been established by previous studies. Akira et al. (1994) purified acute-phase response factor (APRF), also designated STAT3, and cloned the cDNA. At the amino acid level, APRF exhibited 52.5% overall homology with p91, a component of the interferon (IFN)-stimulated gene factor-3 complexes. Also see STAT1 (OMIM Ref. No. 600555). Caldenhoven et al. (1996) reported the cloning of a cDNA encoding a variant of the transcription factor STAT3, designated STAT3-beta, that was isolated by screening an eosinophil cDNA library. Compared to wildtype STAT3, STAT3- beta lacks an internal domain of 50 bp located near the C terminus. This splice product is a naturally occurring isoform of STAT3 and encodes an 80-kD protein.

Animal model experiments lend further support to the function of STAT3. Alternative splicing of the STAT3 gene produces 2 isoforms, STAT3-alpha and a dominant-negative variant, STAT3-beta. In STAT3-beta, the 55 C-terminal residues of STAT3-alpha, spanning the intrinsic transactivation domain, are replaced by 7 distinct residues. Yoo et al. (2002) generated Stat3-beta-deficient mice by gene targeting. Despite intact expression and phosphorylation of Stat3-alpha, overall Stat3 activity was impaired in Stat3-beta -/- cells. Global comparison of transcription in Stat3-beta +/+ and Stat3-beta -/- cells revealed stable differences. Stat3-beta-deficient mice exhibited diminished recovery from endotoxic shock and hyperresponsiveness of a subset of endotoxin-inducible genes in liver. The hepatic response to endotoxin in wildtype mice was accompanied by a transient increase in the ratio of Stat3-beta to Stat3-alpha. These findings indicated a critical role for Stat3-beta in the control of systemic inflammation.

It is appreciated that the abovementioned animal model for STAT3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Caldenhoven, E.; van Dijk, T. B.; Solari, R.; Armstrong, J.; Raaijmakers, J. A. M.; Lammers, J.-W. J.; Koenderman, L.; de Groot, R. P.: STAT3-beta, a splice variant of transcription factor STAT3, is a dominant negative regulator of transcription. J. Biol. Chem. 271:13221-13227, 1996; and Yoo, J.-Y.; Huso, D. L.; Nathans, D.; Desiderio, S.: Specific ablation of Stat3-beta distorts the pattern of Stat3-responsive gene expression and impairs recovery from endotoxic shock.

Further studies establishing the function and utilities of STAT3 are found in John Hopkins OMIM database record ID 102582, and in cited publications listed in Table 5, which are hereby incorporated by reference. Signal transducer and activator of transcription 3 (acute-phase response factor) (STAT3, Accession NP_644805.1) is another GAM47 target gene, herein designated TARGET GENE. STAT3 BINDING SITE is a target binding site found in the 3' untranslated region of multiple transcripts of mRNA encoded by STAT3, corresponding to a target binding site such as BINDING SITE I, BINDING SITE II or BINDING SITE III of FIG. 8. Table 4 illustrates the complementarity of the nucleotide sequences of STAT3 BINDING SITE, designated SEQ ID:19871, to the nucleotide sequence of GAM47 RNA, herein designated GAM RNA, also designated SEQ ID:269.

Another function of GAM47 is therefore inhibition of Signal transducer and activator of transcription 3 (acute-phase response factor) (STAT3, Accession NP_644805.1), a gene which carries out a dual function: signal transduction and activation of transcription. Accordingly, utilities of GAM47 include diagnosis, prevention and treatment of diseases and clinical conditions associated with STAT3.

The function of STAT3 has been established by previous studies. Akira et al. (1994) purified acute-phase response factor (APRF), also designated STAT3, and cloned the cDNA. At the amino acid level, APRF exhibited 52.5% overall homology with p91, a component of the interferon (IFN)-stimulated gene factor- 3 complexes. Also see STAT1 (OMIM Ref. No. 600555). Caldenhoven et al. (1996) reported the cloning of a cDNA encoding a variant of the transcription factor STAT3, designated STAT3-beta, that was isolated by screening an eosinophil cDNA library. Compared to wildtype STAT3, STAT3- beta lacks an internal domain of 50 bp located near the C terminus. This splice product is a naturally occurring isoform of STAT3 and encodes an 80-kD protein.

Animal model experiments lend further support to the function of STAT3. Alternative splicing of the STAT3 gene produces 2 isoforms, STAT3-alpha and a dominant-negative variant, STAT3-beta. In STAT3-beta, the 55 C-terminal residues of STAT3-alpha, spanning the intrinsic transactivation domain, are replaced by 7 distinct residues. Yoo et al. (2002) generated Stat3-beta-deficient mice by gene targeting. Despite intact expression and phosphorylation of Stat3-alpha, overall Stat3 activity was impaired in Stat3-beta -/- cells. Global comparison of transcription in Stat3-beta +/+ and Stat3-beta -/- cells revealed stable differences. Stat3-beta-deficient mice exhibited diminished recovery from endotoxic shock and hyperresponsiveness of a subset of endotoxin-inducible genes in liver. The hepatic response to endotoxin in wildtype mice was accompanied by a transient increase in the ratio of Stat3-beta to Stat3-alpha. These findings indicated a critical role for Stat3-beta in the control of systemic inflammation.

It is appreciated that the abovementioned animal model for STAT3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Caldenhoven, E.; van Dijk, T. B.; Solari, R.; Armstrong, J.; Raaijmakers, J. A. M.; Lammers, J.-W. J.; Koenderman, L.; de Groot, R. P.: STAT3-beta, a splice variant of transcription factor STAT3, is a dominant negative regulator of transcription. J. Biol. Chem. 271:13221-13227, 1996; and Yoo, J.-Y.; Huso, D. L.; Nathans, D.; Desiderio, S.: Specific ablation of Stat3-beta distorts the pattern of Stat3-responsive gene expression and impairs recovery from endotoxic shock.

Further studies establishing the function and utilities of STAT3 are found in John Hopkins OMIM database record ID 102582, and in cited publications listed in Table 5, which are hereby incorporated by reference. Serine/threonine kinase 16 (STK16, Accession NP_003682.1) is another GAM47 target gene, herein designated TARGET GENE. STK16 BINDING SITE is a target binding site found in the 3' untranslated region of mRNA encoded by STK16, corresponding to a target binding site such as BINDING SITE I, BINDING SITE II or BINDING SITE III of FIG. 8. Table 4 illustrates the complementarity of the nucleotide sequences of STK16 BINDING SITE, designated SEQ ID:5128, to the nucleotide sequence of GAM47 RNA, herein designated GAM RNA, also designated SEQ ID:269.

Another function of GAM47 is therefore inhibition of Serine/threonine kinase 16 (STK16, Accession NP_003682.1). Accordingly, utilities of GAM47 include diagnosis, prevention and treatment of diseases and clinical conditions associated with STK16.

Syntaxin 6 (STX6, Accession NP_005810.1) is another GAM47 target gene, herein designated TARGET GENE. STX6 BINDING SITE is a target binding site found in the 3' untranslated region of mRNA encoded by STX6, corresponding to a target binding site such as BINDING SITE I, BINDING SITE II or BINDING SITE III of FIG. 8. Table 4 illustrates the complementarity of the nucleotide sequences of STX6 BINDING SITE, designated SEQ ID:15081, to the nucleotide sequence of GAM47 RNA, herein designated GAM RNA, also designated SEQ ID:269.

Another function of GAM47 is therefore inhibition of Syntaxin 6 (STX6, Accession NP_005810.1). Accordingly, utilities of GAM47 include diagnosis, prevention and treatment of diseases and clinical conditions associated with STX6.

Sulfotransferase family, cytosolic, 1b, member 1 (SULT1B1, Accession NP_055280.2) is another GAM47 target gene, herein designated TARGET GENE. SULT1B1 BINDING SITE is a target binding site found in the 5' untranslated region of mRNA encoded by SULT1B1, corresponding to a target binding site such as BINDING SITE I, BINDING SITE II or BINDING SITE III of FIG. 8. Table 4 illustrates the complementarity of the nucleotide sequences of SULT1B1 BINDING SITE, designated SEQ ID:12908, to the nucleotide sequence of GAM47 RNA, herein designated GAM RNA, also designated SEQ ID:269.

Another function of GAM47 is therefore inhibition of Sulfotransferase family, cytosolic, 1b, member 1 (SULT1B1, Accession NP_055280.2). Accordingly, utilities of GAM47 include diagnosis, prevention and treatment of diseases and clinical conditions associated with SULT1B1.

Suppressor of variegation 3-9 homolog 1 (drosophila) (SUV39H1, Accession NP_003164.1) is another GAM47 target gene, herein designated TARGET GENE. SUV39H1 BINDING SITE is a target binding site found in the 3' untranslated region of mRNA encoded by SUV39H1, corresponding to a target binding site such as BINDING SITE I, BINDING SITE II or BINDING SITE III of FIG. 8. Table 4 illustrates the complementarity of the nucleotide sequences of SUV39H1 BINDING SITE, designated SEQ ID:11187, to the nucleotide sequence of GAM47 RNA, herein designated GAM RNA, also designated SEQ ID:269.

Another function of GAM47 is therefore inhibition of Suppressor of variegation 3-9 homolog 1 (drosophila) (SUV39H1, Accession NP_003164.1), a gene which is homolog of Drosophila suppressor of variegation 3-9 and modifies position effect variegation. Accordingly, utilities of GAM47 include diagnosis, prevention and treatment of diseases and clinical conditions associated with SUV39H1.

The function of SUV39H1 has been established by previous studies. By screening a human B-cell cDNA library with a sequence encoding the C-terminal portion of the Drosophila Su(var)3-9 gene product, which contains the SET domain, Aagaard et al. (1999) isolated a cDNA encoding SUV39H1. The predicted 412-amino acid SUV39H1 protein contains a chromodomain that is located close to the N terminus, a cysteine-rich region, an adjacent C-terminal SET domain that is followed at the very C-terminal tail by 3 conserved cysteine residues, and a putative nuclear localization signal. SUV39H1 shares 95% amino acid sequence identity with mouse Suv39h1, 42% identity with Drosophila Su(var)3-9, and 38% identity with S. pombe CLR4, another Su(var)3-9 ortholog. Immunoblot analysis of protein extracts from human cell lines detected an approximately 48-kD endogenous SUV39H1 protein, a mass that corresponds with the mass calculated from the SUV39H1 cDNA. Immunodetection of endogenous SUV39H1 protein revealed enriched distribution at heterochromatic foci during interphase and centromere-specific localization during metaphase. In addition, SUV39H1 protein associated with M31 (HP1-beta, or CBX1; 604511), an Su(var) homolog, indicating the existence of an Su(var) protein complex.

Animal model experiments lend further support to the function of SUV39H1. Peters et al. (2001) generated mice deficient for either Suv39h1 or Suv39h2 (OMIM Ref. No. 606503). These animals displayed normal viability and fertility and did not exhibit apparent phenotypes. The authors subsequently intercrossed Suv39h1 -/- and Suv39h2 -/- mice to generate compound Suv39h mutants that were then used to derive Suv39h double-null mice (Suv39h1 -/- and Suv39h2 -/-). These mice displayed severely impaired viability and chromosomal instabilities that were associated with an increased tumor risk and perturbed chromosome interactions during male meiosis. These data suggested a crucial role for pericentric H3 histone-lys9 methylation in protecting genome stability and defined the Suv39h HMTases as important epigenetic regulators for mammalian development.

It is appreciated that the abovementioned animal model for SUV39H1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aagaard, L.; Laible, G.; Selenko, P.; Schmid, M.; Dorn, R.; Schotta, G.; Kuhfittig, S.; Wolf, A.; Lebersorger, A.; Singh, P. B.; Reuter, G.; Jenuwein, T.: Functional mammalian homologues of the Drosophila PEV-modifier Su(var)3-9 encode centromere-associated proteins which complex with the heterochromatin component M31. EMBO J. 18:1923-1938, 1999; and Peters, A. H. F. M.; O'Carroll, D.; Scherthan, H.; Mechtler, K.; Sauer, S.; Schofer, C.; Weipoltshammer, K.; Pagani, M.; Lachner, M.; Kohlmaier, A.; Opravil, S.; Doyle, M.; Sibilia, M.

Further studies establishing the function and utilities of SUV39H1 are found in John Hopkins OMIM database record ID 300254, and in cited publications listed in Table 5, which are hereby incorporated by reference. Synaptotagmin ii (SYT2, Accession NP_796376.2) is another GAM47 target gene, herein designated TARGET GENE. SYT2 BINDING SITE is a target binding site found in the 3' untranslated region of mRNA encoded by SYT2, corresponding to a target binding site such as BINDING SITE I, BINDING SITE II or BINDING SITE III of FIG. 8. Table 4 illustrates the complementarity of the nucleotide sequences of SYT2 BINDING SITE, designated SEQ ID:3462, to the nucleotide sequence of GAM47 RNA, herein designated GAM RNA, also designated SEQ ID:269.

Another function of GAM47 is therefore inhibition of Synaptotagmin ii (SYT2, Accession NP_796376.2). Accordingly, utilities of GAM47 include diagnosis, prevention and treatment of diseases and clinical conditions associated with SYT2.

Synaptotagmin vi (SYT6, Accession XP_086135.1) is another GAM47 target gene, herein designated TARGET GENE. SYT6 BINDING SITE is a target binding site found in the 5' untranslated region of mRNA encoded by SYT6, corresponding to a target binding site such as BINDING SITE I, BINDING SITE II or BINDING SITE III of FIG. 8. Table 4 illustrates the complementarity of the nucleotide sequences of SYT6 BINDING SITE, designated SEQ ID:7804, to the nucleotide sequence of GAM47 RNA, herein designated GAM RNA, also designated SEQ ID:269.

Another function of GAM47 is therefore inhibition of Synaptotagmin vi (SYT6, Accession XP_086135.1). Accordingly, utilities of GAM47 include diagnosis, prevention and treatment of diseases and clinical conditions associated with SYT6.

Synaptotagmin-like 2 (SYTL2, Accession NP_115755.2) is another GAM47 target gene, herein designated TARGET GENE. SYTL2 BINDING SITE is a target binding site found in the 3' untranslated region of multiple transcripts of mRNA encoded by SYTL2, corresponding to a target binding site such as BINDING SITE I, BINDING SITE II or BINDING SITE III of FIG. 8. Table 4 illustrates the complementarity of the nucleotide sequences of SYTL2 BINDING SITE, designated SEQ ID:13084, to the nucleotide sequence of GAM47 RNA, herein designated GAM RNA, also designated SEQ ID:269.

Another function of GAM47 is therefore inhibition of Synaptotagmin-like 2 (SYTL2, Accession NP_115755.2). Accordingly, utilities of GAM47 include diagnosis, prevention and treatment of diseases and clinical conditions associated with SYTL2.

Synaptotagmin-like 2 (SYTL2, Accession NP_116561.1) is another GAM47 target gene, herein designated TARGET GENE. SYTL2 BINDING SITE is a target binding site found in the 3' untranslated region of multiple transcripts of mRNA encoded by SYTL2, corresponding to a target binding site such as BINDING SITE I, BINDING SITE II or BINDING SITE III of FIG. 8. Table 4 illustrates the complementarity of the nucleotide sequences of SYTL2 BINDING SITE, designated SEQ ID:13084, to the nucleotide sequence of GAM47 RNA, herein designated GAM RNA, also designated SEQ ID:269.

Another function of GAM47 is therefore inhibition of Synaptotagmin-like 2 (SYTL2, Accession NP_116561.1). Accordingly, utilities of GAM47 include diagnosis, prevention and treatment of diseases and clinical conditions associated with SYTL2.

Taf9-like rna polymerase ii, tata box binding protein (tbp)-associated factor, 31 kda (TAF9L, Accession NP_057059.2) is another GAM47 target gene, herein designated TARGET GENE. TAF9L BINDING SITE is a target binding site found in the 3' untranslated region of mRNA encoded by TAF9L, corresponding to a target binding site such as BINDING SITE I, BINDING SITE II or BINDING SITE III of FIG. 8. Table 4 illustrates the complementarity of the nucleotide sequences of TAF9L BINDING SITE, designated SEQ ID:18397, to the nucleotide sequence of GAM47 RNA, herein designated GAM RNA, also designated SEQ ID:269.

Another function of GAM47 is therefore inhibition of Taf9-like rna polymerase ii, tata box binding protein (tbp)-associated factor, 31 kda (TAF9L, Accession NP_057059.2). Accordingly, utilities of GAM47 include diagnosis, prevention and treatment of diseases and clinical conditions associated with TAF9L.

T-box 15 (TBX15, Accession NP_689593.1) is another GAM47 target gene, herein designated TARGET GENE. TBX15 BINDING SITE1 and TBX15 BINDING SITE2 are target binding sites found in untranslated regions of mRNA encoded by TBX15, corresponding to target binding sites such as BINDING SITE I, BINDING SITE II or BINDING SITE III of FIG. 8. Table 4 illustrates the complementarity of the nucleotide sequences of TBX15 BINDING SITE1 and TBX15 BINDING SITE2, designated SEQ ID:4394 and SEQ ID:5309 respectively, to the nucleotide sequence of GAM47 RNA, herein designated GAM RNA, also designated SEQ ID:269.

Another function of GAM47 is therefore inhibition of T-box 15 (TBX15, Accession NP_689593.1). Accordingly, utilities of GAM47 include diagnosis, prevention and treatment of diseases and clinical conditions associated with TBX15.

T-box 19 (TBX19, Accession NP_005140.1) is another GAM47 target gene, herein designated TARGET GENE. TBX19 BINDING SITE is a target binding site found in the 3' untranslated region of mRNA encoded by TBX19, corresponding to a target binding site such as BINDING SITE I, BINDING SITE II or BINDING SITE III of FIG. 8. Table 4 illustrates the complementarity of the nucleotide sequences of TBX19 BINDING SITE, designated SEQ ID:14889, to the nucleotide sequence of GAM47 RNA, herein designated GAM RNA, also designated SEQ ID:269.

Another function of GAM47 is therefore inhibition of T-box 19 (TBX19, Accession NP_005140.1). Accordingly, utilities of GAM47 include diagnosis, prevention and treatment of diseases and clinical conditions associated with TBX19.

Transcription factor-like 4 (TCFL4, Accession NP_037515.2) is another GAM47 target gene, herein designated TARGET GENE. TCFL4 BINDING SITE is a target binding site found in the 3' untranslated region of multiple transcripts of mRNA encoded by TCFL4, corresponding to a target binding site such as BINDING SITE I, BINDING SITE II or BINDING SITE III of FIG. 8. Table 4 illustrates the complementarity of the nucleotide sequences of TCFL4 BINDING SITE, designated SEQ ID:9522, to the nucleotide sequence of GAM47 RNA, herein designated GAM RNA, also designated SEQ ID:269.

Another function of GAM47 is therefore inhibition of Transcription factor-like 4 (TCFL4, Accession NP_037515.2), a gene which interacts with Mad and represses transcription by recruiting the Sin3A-histone deacetylase corepressor complex. Accordingly, utilities of GAM47 include diagnosis, prevention and treatment of diseases and clinical conditions associated with TCFL4.

The function of TCFL4 has been established by previous studies. Members of the basic helix-loop-helix leucine zipper (bHLH-Zip) family are transcription factors with roles in proliferation, determination, and differentiation (e.g., MAX; 154950). By searching sequence databases with a mouse Tcfl4 cDNA, Bjerknes and Cheng (1996) identified several TCFL4 expressed sequence tags derived from a variety of human tissues, and a 46-kb cosmid clone (GenBank U34879) containing the human TCFL4 gene. This cosmid, which maps to 17q21.1, also contains the HSD17B1 gene (OMIM Ref. No. 109684). The TCFL4 gene has 8 exons and spans more than 5 kb. The predicted TCFL4 protein contains a basic helix-loop-helix domain and a leucine zipper domain. RT-PCR detected mouse Tcfl4 expression in all tissues examined. In a 2-hybrid screen to identify Mad1 (OMIM Ref. No. 602686)-interacting proteins, Billin et al. (1999) identified TCFL4 as MLX, a bHLH-Zip protein that is structurally and functionally related to MAX. The predicted amino acid sequence of MLX is conserved at all positions that define the bHLH-Zip class of transcription factors and is most similar to that of MAX, sharing approximately 50% identity in the bHLH-Zip domains. The 244-amino acid human and mouse MLX proteins differ at only 4 amino acid positions. Billin et al. (1999) showed that transcriptional repression by Mad1: Mlx heterodimers is dependent on dimerization, DNA binding, and recruitment of the Sin3A-histone deacetylase (see OMIM Ref. No. 601241) corepressor complex. Their findings suggested that MLX may act to diversify Mad family function by its restricted association with a subset of the Mad family of transcriptional repressors.

Full details of the abovementioned studies are described in the following publications, the disclosure of which are hereby incorporated by reference:

Billin, A. N.; Eilers, A. L.; Queva, C.; Ayer, D. E.: Mlx, a novel Max-like BHLHZip protein that interacts with the Max network of transcription factors. J. Biol. Chem. 274:36344-36350, 1999; and Bjerknes, M.; Cheng, H.: TCFL4: a gene at 17q21.1 encoding a putative basic helix-loop-helix leucine-zipper transcription factor. Gene 181:7-11, 1996.

Further studies establishing the function and utilities of TCFL4 are found in John Hopkins OMIM database record ID 602976, and in cited publications listed in Table 5, which are hereby incorporated by reference. Transcription factor-like 4 (TCFL4, Accession NP_733753.1) is another GAM47 target gene, herein designated TARGET GENE. TCFL4 BINDING SITE is a target binding site found in the 3' untranslated region of multiple transcripts of mRNA encoded by TCFL4, corresponding to a target binding site such as BINDING SITE I, BINDING SITE II or BINDING SITE III of FIG. 8. Table 4 illustrates the complementarity of the nucleotide sequences of TCFL4 BINDING SITE, designated SEQ ID:9522, to the nucleotide sequence of GAM47 RNA, herein designated GAM RNA, also designated SEQ ID:269.

Another function of GAM47 is therefore inhibition of Transcription factor-like 4 (TCFL4, Accession NP_733753.1), a gene which interacts with Mad and represses transcription by recruiting the Sin3A-histone deacetylase corepressor complex. Accordingly, utilities of GAM47 include diagnosis, prevention and treatment of diseases and clinical conditions associated with TCFL4.

The function of TCFL4 has been established by previous studies. Members of the basic helix-loop-helix leucine zipper (bHLH-Zip) family are transcription factors with roles in proliferation, determination, and differentiation (e.g., MAX; 154950). By searching sequence databases with a mouse Tcfl4 cDNA, Bjerknes and Cheng (1996) identified several TCFL4 expressed sequence tags derived from a variety of human tissues, and a 46-kb cosmid clone (GenBank U34879) containing the human TCFL4 gene. This cosmid, which maps to 17q21.1, also contains the HSD17B1 gene (OMIM Ref. No. 109684). The TCFL4 gene has 8 exons and spans more than 5 kb. The predicted TCFL4 protein contains a basic helix-loop-helix domain and a leucine zipper domain. RT-PCR detected mouse Tcfl4 expression in all tissues examined. In a 2-hybrid screen to identify Mad1 (OMIM Ref. No. 602686)-interacting proteins, Billin et al. (1999) identified TCFL4 as MLX, a bHLH-Zip protein that is structurally and functionally related to MAX. The predicted amino acid sequence of MLX is conserved at all positions that define the bHLH-Zip class of transcription factors and is most similar to that of MAX, sharing approximately 50% identity in the bHLH-Zip domains. The 244-amino acid human and mouse MLX proteins differ at only 4 amino acid positions. Billin et al. (1999) showed that transcriptional repression by Mad1: Mlx heterodimers is dependent on dimerization, DNA binding, and recruitment of the Sin3A-histone deacetylase (see OMIM Ref. No. 601241) corepressor complex. Their findings suggested that MLX may act to diversify Mad family function by its restricted association with a subset of the Mad family of transcriptional repressors.

Full details of the abovementioned studies are described in the following publications, the disclosure of which are hereby incorporated by reference:

Billin, A. N.; Eilers, A. L.; Queva, C.; Ayer, D. E.: Mlx, a novel Max-like BHLHZip protein that interacts with the Max network of transcription factors. J. Biol. Chem. 274:36344-36350, 1999; and Bjerknes, M.; Cheng, H.: TCFL4: a gene at 17q21.1 encoding a putative basic helix-loop-helix leucine-zipper transcription factor. Gene 181:7-11, 1996.

Further studies establishing the function and utilities of TCFL4 are found in John Hopkins OMIM database record ID 602976, and in cited publications listed in Table 5, which are hereby incorporated by reference. Transcription factor-like 4 (TCFL4, Accession NP_733752.1) is another GAM47 target gene, herein designated TARGET GENE. TCFL4 BINDING SITE is a target binding site found in the 3' untranslated region of multiple transcripts of mRNA encoded by TCFL4, corresponding to a target binding site such as BINDING SITE I, BINDING SITE II or BINDING SITE III of FIG. 8. Table 4 illustrates the complementarity of the nucleotide sequences of TCFL4 BINDING SITE, designated SEQ ID:9522, to the nucleotide sequence of GAM47 RNA, herein designated GAM RNA, also designated SEQ ID:269.

Another function of GAM47 is therefore inhibition of Transcription factor-like 4 (TCFL4, Accession NP_733752.1), a gene which interacts with Mad and represses transcription by recruiting the Sin3A-histone deacetylase corepressor complex. Accordingly, utilities of GAM47 include diagnosis, prevention and treatment of diseases and clinical conditions associated with TCFL4.

The function of TCFL4 has been established by previous studies. Members of the basic helix-loop-helix leucine zipper (bHLH-Zip) family are transcription factors with roles in proliferation, determination, and differentiation (e.g., MAX; 154950). By searching sequence databases with a mouse Tcfl4 cDNA, Bjerknes and Cheng (1996) identified several TCFL4 expressed sequence tags derived from a variety of human tissues, and a 46-kb cosmid clone (GenBank U34879) containing the human TCFL4 gene. This cosmid, which maps to 17q21.1, also contains the HSD17B1 gene (OMIM Ref. No. 109684). The TCFL4 gene has 8 exons and spans more than 5 kb. The predicted TCFL4 protein contains a basic helix-loop-helix domain and a leucine zipper domain. RT-PCR detected mouse Tcfl4 expression in all tissues examined. In a 2-hybrid screen to identify Mad1 (OMIM Ref. No. 602686)-interacting proteins, Billin et al. (1999) identified TCFL4 as MLX, a bHLH-Zip protein that is structurally and functionally related to MAX. The predicted amino acid sequence of MLX is conserved at all positions that define the bHLH-Zip class of transcription factors and is most similar to that of MAX, sharing approximately 50% identity in the bHLH-Zip domains. The 244-amino acid human and mouse MLX proteins differ at only 4 amino acid positions. Billin et al. (1999) showed that transcriptional repression by Mad1:Mlx heterodimers is dependent on dimerization, DNA binding, and recruitment of the Sin3A-histone deacetylase (see OMIM Ref. No. 601241) corepressor complex. Their findings suggested that MLX may act to diversify Mad family function by its restricted association with a subset of the Mad family of transcriptional repressors.

Full details of the abovementioned studies are described in the following publications, the disclosure of which are hereby incorporated by reference:

Billin, A. N.; Eilers, A. L.; Queva, C.; Ayer, D. E.: Mlx, a novel Max-like BHLHZip protein that interacts with the Max network of transcription factors. J. Biol. Chem. 274:36344-36350, 1999; and Bjerknes, M.; Cheng, H.: TCFL4: a gene at 17q21.1 encoding a putative basic helix-loop-helix leucine-zipper transcription factor. Gene 181:7-11, 1996.

Further studies establishing the function and utilities of TCFL4 are found in John Hopkins OMIM database record ID 602976, and in cited publications listed in Table 5, which are hereby incorporated by reference. T-cell leukemia/lymphoma 1b (TCL1B, Accession NP_004909.1) is another GAM47 target gene, herein designated TARGET GENE. TCL1B BINDING SITE is a target binding site found in the 3' untranslated region of mRNA encoded by TCL1B, corresponding to a target binding site such as BINDING SITE I, BINDING SITE II or BINDING SITE III of FIG. 8. Table 4 illustrates the complementarity of the nucleotide sequences of TCL1B BINDING SITE, designated SEQ ID:19739, to the nucleotide sequence of GAM47 RNA, herein designated GAM RNA, also designated SEQ ID:269.

Another function of GAM47 is therefore inhibition of T-cell leukemia/lymphoma 1b (TCL1B, Accession NP_004909.1), a gene which is a a member of the TCL1 family that is activated in chronic t-cell leukemias (t-cll) and therefore may be associated with Chronic t-cell leukemias. Accordingly, utilities of GAM47 include diagnosis, prevention and treatment of Chronic t-cell leukemias, and of other diseases and clinical conditions associated with TCL1B.

The function of TCL1B has been established by previous studies. The TCL1A oncogene (OMIM Ref. No. 186960) on 14q32.1 is involved in the development of T-cell leukemia. Its expression in these leukemias is activated by chromosomal translocations and inversions at 14q32.1. By searching an EST database for sequences homologous to TCL1A and MTCP1 (OMIM Ref. No. 300116), a member of the TCL1 gene family that is located on Xq28 and is activated in rare cases of mature T-cell leukemia with a t(X;14) translocation, Pekarsky et al. (1999) isolated TCL1B, a novel member of the TCL1 gene family. The approximately 1.2-kb TCL1B cDNA encodes a 14-kD protein that contains 128 amino acids and shows 60% sequence similarity to the TCL1A protein. By PCR analysis of a radiation hybrid panel, they mapped the TCL1B gene to chromosome 14q32.1. Pulse-field analysis of a positive BAC clone revealed that the TCL1B gene is located approximately 16 kb centromeric of the TCL1A gene. Expression profiles of the 2 genes are very similar: both genes are expressed at very low levels in normal bone marrow and peripheral lymphocytes but are activated in T-cell leukemia by rearrangement of the 14q32.1 region. Thus, translocations and inversions at 14q32.1 in T-cell malignancies involve 2 oncogenes. Hallas et al. (1999) presented cloning, mapping, and expression analysis of the human and murine TCL1/Tcl1 locus. In addition to TCL1A and TCL1B, the human locus contains 2 additional genes, TNG1 (TCL1-neighboring gene-1; 604412) and TNG2 (OMIM Ref. No. 604413), encoding proteins of 141 and 110 amino acids, respectively. Both genes showed no homology to any known genes, but their expression profiles were very similar to those of TCL1A and TCL1B. TNG1 and TNG2 also were activated in T cell leukemias with rearrangements at 14q32.1. To aid in the development of the mouse model, Hallas et al. (1999) characterized the murine Tcl1a locus and found 5 genes homologous to human TCL1B. The 5 Tcl1b proteins ranged in size from 117 to 123 amino acids and were 65 to 80% similar, but they showed only a 30 to 40% similarity to human TCL1B. All murine Tcl1b and Tcl1a mRNAs were abundant in mouse oocytes and 2-cell embryos but rare in various adult tissues and lymphoid cell lines. These data suggested a similar or complementary function of these proteins in early embryogenesis.

Full details of the abovementioned studies are described in the following publications, the disclosure of which are hereby incorporated by reference:

Pekarsky, Y.; Hallas, C.; Isobe, M.; Russo, G.; Croce, C. M.: Abnormalities at 14q32.1 in T cell malignancies involve two oncogenes. Proc. Nat. Acad. Sci. 96:2949-2951, 1999; and Hallas, C.; Pekarsky, Y.; Itoyama, T.; Varnum, J.; Bichi, R.; Rothstein, J. L.; Croce, C. M.: Genomic analysis of human and mouse TCL1 loci reveals a complex of tightly clustered genes.

Further studies establishing the function and utilities of TCL1B are found in John Hopkins OMIM database record ID 603769, and in cited publications listed in Table 5, which are hereby incorporated by reference. Transcription factor dp-2 (e2f dimerization partner 2) (TFDP2, Accession NP_006277.1) is another GAM47 target gene, herein designated TARGET GENE. TFDP2 BINDING SITE is a target binding site found in the 3' untranslated region of mRNA encoded by TFDP2, corresponding to a target binding site such as BINDING SITE I, BINDING SITE II or BINDING SITE III of FIG. 8. Table 4 illustrates the complementarity of the nucleotide sequences of TFDP2 BINDING SITE, designated SEQ ID:17242, to the nucleotide sequence of GAM47 RNA, herein designated GAM RNA, also designated SEQ ID:269.

Another function of GAM47 is therefore inhibition of Transcription factor dp-2 (e2f dimerization partner 2) (TFDP2, Accession NP_006277.1), a gene which is required for the progression of S-phase during the cell cycle. Accordingly, utilities of GAM47 include diagnosis, prevention and treatment of diseases and clinical conditions associated with TFDP2.

The function of TFDP2 has been established by previous studies. Zhang and Chellappan (1995) cloned an E2F dimerization partner, transcription factor DP2, from a human kidney cDNA library. The TFDP2 gene encodes a predicted 386-amino acid protein that is 68% identical to TFDP1 (OMIM Ref. No. 189902). Northern blot analysis revealed 5 distinct transcript sizes ranging from 1.4 to 9.5 kb, with expression of at least one size observed in all cell lines tested. TFDP2 is able to form a functional heterodimer with E2F1 (OMIM Ref. No. 189971). Zhang et al. (1997) used fluorescence in situ hybridization to map the TFDP2 gene to human chromosome 3q23.

Full details of the abovementioned studies are described in the following publications, the disclosure of which are hereby incorporated by reference:

Zhang, Y.; Chellappan, S. P.: Cloning and characterization of human DP2, a novel dimerization partner of E2F. Oncogene 10:2085-2093, 1995; and Zhang, Y.; Venkatraj, V. S.; Fischer, S. G.; Warburton, D.; Chellappan, S. P.: Genomic cloning and chromosomal assignment of the E2F dimerization partner TFDP gene family. Genomics 39.

Further studies establishing the function and utilities of TFDP2 are found in John Hopkins OMIM database record ID 602160, and in cited publications listed in Table 5, which are hereby incorporated by reference. Transforming growth factor, beta receptor iii (betaglycan, 300 kda) (TGFBR3, Accession NP_003234.1) is another GAM47 target gene, herein designated TARGET GENE. TGFBR3 BINDING SITE is a target binding site found in the 3' untranslated region of mRNA encoded by TGFBR3, corresponding to a target binding site such as BINDING SITE I, BINDING SITE II or BINDING SITE III of FIG. 8. Table 4 illustrates the complementarity of the nucleotide sequences of TGFBR3 BINDING SITE, designated SEQ ID:17248, to the nucleotide sequence of GAM47 RNA, herein designated GAM RNA, also designated SEQ ID:269.

Another function of GAM47 is therefore inhibition of Transforming growth factor, beta receptor iii (betaglycan, 300 kda) (TGFBR3, Accession NP_003234.1), a gene which involves in capturing and retaining TGF-beta for presentation to the signaling receptors. Accordingly, utilities of GAM47 include diagnosis, prevention and treatment of diseases and clinical conditions associated with TGFBR3.

The function of TGFBR3 has been established by previous studies. In addition to type I TGF-beta receptor (TGFBR1; 190181) and type II (TFGBR2; 190182), type III (OMIM Ref. No. TGFBR3) has been identified. It is a glycoprotein that binds TGF-beta and exists in both a membrane-bound and a soluble form. It may serve as a receptor accessory molecule in both the TGF-beta and fibroblast growth factor systems. TGFBR3 lacks a recognizable signaling domain and has no clearly defined role in TGF-beta signaling. To investigate TGFBR3 function, Brown et al. (1999) studied cardiac endothelial cells in chick atrioventricular cushion explants. Endothelial cells undergoing epithelial-mesenchymal transformation expressed TGFBR3, and TGFBR3-specific antisera were found to inhibit mesenchyme formation and migration. Misexpression of TGFBR3 in nontransforming ventricular endothelial cells conferred transformation in response to TGFB2. These results supported a model where TGFBR3 localizes transformation in the heart and plays an essential, nonredundant role in TGF-beta signaling. Lewis et al. (2000) demonstrated that the type III TGF-beta receptor, or beta-glycan, can function as an inhibin (see OMIM Ref. No. 147380) coreceptor with ActRII (OMIM Ref. No. 102581). Beta-glycan binds inhibin with high affinity and enhances binding in cells coexpressing ActRII and beta-glycan. Inhibin also forms crosslinked complexes with both recombinant and endogenously expressed beta-glycan and ActRII. Lewis et al. (2000) demonstrated that beta-glycan confers inhibin sensitivity to cell lines that otherwise respond poorly to this hormone. The ability of beta-glycan to inhibit to facilitate inhibin antagonism of activin (see OMIM Ref. No. 147290) provided a variation on the emerging roles of proteoglycans as coreceptors modulating ligand-receptor sensitivity, selectivity, and function.

Full details of the abovementioned studies are described in the following publications, the disclosure of which are hereby incorporated by reference:

Brown, C. B.; Boyer, A. S.; Runyan, R. B.; Barnett, J. V.: Requirement of type III TGF-beta receptor for endocardial cell transformation in the heart. Science 283:2080-2082, 1999; and Lewis, K. A.; Gray, P. C.; Blount, A. L.; MacConell, L. A.; Wiater, E.; Bilezikjian, L. M.; Vale, W.: Betaglycan binds inhibin and can mediate functional antagonism of activin signalli.

Further studies establishing the function and utilities of TGFBR3 are found in John Hopkins OMIM database record ID 600742, and in cited publications listed in Table 5, which are hereby incorporated by reference. Translocase of inner mitochondrial membrane 22 homolog (yeast) (TIMM22, Accession NP_037469.1) is another GAM47 target gene, herein designated TARGET GENE. TIMM22 BINDING SITE is a target binding site found in the 3' untranslated region of mRNA encoded by TIMM22, corresponding to a target binding site such as BINDING SITE I, BINDING SITE II or BINDING SITE III of FIG. 8. Table 4 illustrates the complementarity of the nucleotide sequences of TIMM22 BINDING SITE, designated SEQ ID:19351, to the nucleotide sequence of GAM47 RNA, herein designated GAM RNA, also designated SEQ ID:269.

Another function of GAM47 is therefore inhibition of Translocase of inner mitochondrial membrane 22 homolog (yeast) (TIMM22, Accession NP_037469.1). Accordingly, utilities of GAM47 include diagnosis, prevention and treatment of diseases and clinical conditions associated with TIMM22.

Tissue inhibitor of metalloproteinase 3 (sorsby fundus dystrophy, pseudoinflammatory) (TIMP3, Accession NP_000353.1) is another GAM47 target gene, herein designated TARGET GENE. TIMP3 BINDING SITE is a target binding site found in the 3' untranslated region of mRNA encoded by TIMP3, corresponding to a target binding site such as BINDING SITE I, BINDING SITE II or BINDING SITE III of FIG. 8. Table 4 illustrates the complementarity of the nucleotide sequences of TIMP3 BINDING SITE, designated SEQ ID:11578, to the nucleotide sequence of GAM47 RNA, herein designated GAM RNA, also designated SEQ ID:269.

Another function of GAM47 is therefore inhibition of Tissue inhibitor of metalloproteinase 3 (sorsby fundus dystrophy, pseudoinflammatory) (TIMP3, Accession NP_000353.1). Accordingly, utilities of GAM47 include diagnosis, prevention and treatment of diseases and clinical conditions associated with TIMP3.

Transmembrane 6 superfamily member 2 (TM6SF2, Accession NP_075378.1) is another GAM47 target gene, herein designated TARGET GENE. TM6SF2 BINDING SITE is a target binding site found in the 3' untranslated region of multiple transcripts of mRNA encoded by TM6SF2, corresponding to a target binding site such as BINDING SITE I, BINDING SITE II or BINDING SITE III of FIG. 8. Table 4 illustrates the complementarity of the nucleotide sequences of TM6SF2 BINDING SITE, designated SEQ ID:6832, to the nucleotide sequence of GAM47 RNA, herein designated GAM RNA, also designated SEQ ID:269.

Another function of GAM47 is therefore inhibition of Transmembrane 6 superfamily member 2 (TM6SF2, Accession NP_075378.1), a gene which stabilizes the aggregates of proteoglycan monomers with hyaluronic acid in the extracellular cartilage matrix. Accordingly, utilities of GAM47 include diagnosis, prevention and treatment of diseases and clinical conditions associated with TM6SF2.

The function of TM6SF2 has been established by previous studies. By searching an EST database using TM6SF1 (OMIM Ref. No. 606562) as the probe, Carim-todd et al. (2000) obtained a cDNA encoding TM6SF2. The deduced 351-amino acid protein, which is 52% identical to TM6SF1, has 6 transmembrane domains. By screening for cDNAs with the potential to encode large proteins in brain, Nagase et al. (2001) identified a cDNA encoding TM6SF2, which they termed KIAA1926. KIAA1926 encodes a predicted 412-amino acid link protein, and the authors noted the existence of shorter isoforms. RT-PCR analysis detected high-level expression of KIAA1926 in adult and fetal brain, moderate expression in ovary, and low or undetectable expression in other tissues. Within brain, expression was highest in amygdala and thalamus, with high levels also detected in other brain regions.

Full details of the abovementioned studies are described in the following publications, the disclosure of which are hereby incorporated by reference:

Nagase, T.; Kikuno, R.; Ohara, O.: Prediction of the coding sequences of unidentified human genes. XXI. The complete sequences of 60 new cDNA clones from brain which code for large proteins. DNA Res. 8:179-187, 2001; and Carim-todd, L.; Escarceller, M.; Estivill, X.; Sumoy, L.: Cloning of the novel gene TM6SF1 reveals conservation of clusters of paralogous genes between human chromosomes 15q24-q26 and.

Further studies establishing the function and utilities of TM6SF2 are found in John Hopkins OMIM database record ID 606563, and in cited publications listed in Table 5, which are hereby incorporated by reference. Transmembrane protein 2 (TMEM2, Accession NP_037522.1) is another GAM47 target gene, herein designated TARGET GENE. TMEM2 BINDING SITE is a target binding site found in the 3' untranslated region of mRNA encoded by TMEM2, corresponding to a target binding site such as BINDING SITE I, BINDING SITE II or BINDING SITE III of FIG. 8. Table 4 illustrates the complementarity of the nucleotide sequences of TMEM2 BINDING SITE, designated SEQ ID:15379, to the nucleotide sequence of GAM47 RNA, herein designated GAM RNA, also designated SEQ ID:269.

Another function of GAM47 is therefore inhibition of Transmembrane protein 2 (TMEM2, Accession NP_037522.1). Accordingly, utilities of GAM47 include diagnosis, prevention and treatment of diseases and clinical conditions associated with TMEM2.

Transmembrane, prostate androgen induced rna (TMEPAI, Accession NP_064567.2) is another GAM47 target gene, herein designated TARGET GENE. TMEPAI BINDING SITE is a target binding site found in the 3' untranslated region of mRNA encoded by TMEPAI, corresponding to a target binding site such as BINDING SITE I, BINDING SITE II or BINDING SITE III of FIG. 8. Table 4 illustrates the complementarity of the nucleotide sequences of TMEPAI BINDING SITE, designated SEQ ID:3022, to the nucleotide sequence of GAM47 RNA, herein designated GAM RNA, also designated SEQ ID:269.

Another function of GAM47 is therefore inhibition of Transmembrane, prostate androgen induced rna (TMEPAI, Accession NP_064567.2). Accordingly, utilities of GAM47 include diagnosis, prevention and treatment of diseases and clinical conditions associated with TMEPAI.

TMIE (Accession NP_671729.1) is another GAM47 target gene, herein designated TARGET GENE. TMIE BINDING SITE is a target binding site found in the 3' untranslated region of mRNA encoded by TMIE, corresponding to a target binding site such as BINDING SITE I, BINDING SITE II or BINDING SITE III of FIG. 8. Table 4 illustrates the complementarity of the nucleotide sequences of TMIE BINDING SITE, designated SEQ ID:7061, to the nucleotide sequence of GAM47 RNA, herein designated GAM RNA, also designated SEQ ID:269.

Another function of GAM47 is therefore inhibition of TMIE (Accession NP_671729.1). Accordingly, utilities of GAM47 include diagnosis, prevention and treatment of diseases and clinical conditions associated with TMIE.

Tumor necrosis factor, alpha-induced protein 2 (TNFAIP2, Accession NP_006282.2) is another GAM47 target gene, herein designated TARGET GENE. TNFAIP2 BINDING SITE is a target binding site found in the 3' untranslated region of mRNA encoded by TNFAIP2, corresponding to a target binding site such as BINDING SITE I, BINDING SITE II or BINDING SITE III of FIG. 8. Table 4 illustrates the complementarity of the nucleotide sequences of TNFAIP2 BINDING SITE, designated SEQ ID:12369, to the nucleotide sequence of GAM47 RNA, herein designated GAM RNA, also designated SEQ ID:269.

Another function of GAM47 is therefore inhibition of Tumor necrosis factor, alpha-induced protein 2 (TNFAIP2, Accession NP_006282.2). Accordingly, utilities of GAM47 include diagnosis, prevention and treatment of diseases and clinical conditions associated with TNFAIP2.

TP53BPL (Accession NP_005793.1) is another GAM47 target gene, herein designated TARGET GENE. TP53BPL BINDING SITE is a target binding site found in the 3' untranslated region of mRNA encoded by TP53BPL, corresponding to a target binding site such as BINDING SITE I, BINDING SITE II or BINDING SITE III of FIG. 8. Table 4 illustrates the complementarity of the nucleotide sequences of TP53BPL BINDING SITE, designated SEQ ID:19807, to the nucleotide sequence of GAM47 RNA, herein designated GAM RNA, also designated SEQ ID:269.

Another function of GAM47 is therefore inhibition of TP53BPL (Accession NP_005793.1). Accordingly, utilities of GAM47 include diagnosis, prevention and treatment of diseases and clinical conditions associated with TP53BPL.

TPCN2 (Accession NP_620714.1) is another GAM47 target gene, herein designated TARGET GENE. TPCN2 BINDING SITE is a target binding site found in the 3' untranslated region of mRNA encoded by TPCN2, corresponding to a target binding site such as BINDING SITE I, BINDING SITE II or BINDING SITE III of FIG. 8. Table 4 illustrates the complementarity of the nucleotide sequences of TPCN2 BINDING SITE, designated SEQ ID:19148, to the nucleotide sequence of GAM47 RNA, herein designated GAM RNA, also designated SEQ ID:269.

Another function of GAM47 is therefore inhibition of TPCN2 (Accession NP_620714.1). Accordingly, utilities of GAM47 include diagnosis, prevention and treatment of diseases and clinical conditions associated with TPCN2.

Tripartite motif-containing 29 (TRIM29, Accession NP_036233.2) is another GAM47 target gene, herein designated TARGET GENE. TRIM29 BINDING SITE is a target binding site found in the 3' untranslated region of multiple transcripts of mRNA encoded by TRIM29, corresponding to a target binding site such as BINDING SITE I, BINDING SITE II or BINDING SITE III of FIG. 8. Table 4 illustrates the complementarity of the nucleotide sequences of TRIM29 BINDING SITE, designated SEQ ID:9558, to the nucleotide sequence of GAM47 RNA, herein designated GAM RNA, also designated SEQ ID:269.

Another function of GAM47 is therefore inhibition of Tripartite motif-containing 29 (TRIM29, Accession NP_036233.2). Accordingly, utilities of GAM47 include diagnosis, prevention and treatment of diseases and clinical conditions associated with TRIM29.

TRIP-Br2 (Accession NP_055570.1) is another GAM47 target gene, herein designated TARGET GENE. TRIP-Br2 BINDING SITE is a target binding site found in the 3' untranslated region of mRNA encoded by TRIP-Br2, corresponding to a target binding site such as BINDING SITE I, BINDING SITE II or BINDING SITE III of FIG. 8. Table 4 illustrates the complementarity of the nucleotide sequences of TRIP-Br2 BINDING SITE, designated SEQ ID:4744, to the nucleotide sequence of GAM47 RNA, herein designated GAM RNA, also designated SEQ ID:269.

Another function of GAM47 is therefore inhibition of TRIP-Br2 (Accession NP_055570.1). Accordingly, utilities of GAM47 include diagnosis, prevention and treatment of diseases and clinical conditions associated with TRIP-Br2.

Thyroid hormone receptor interactor 13 (TRIP13, Accession NP_004228.1) is another GAM47 target gene, herein designated TARGET GENE. TRIP13 BINDING SITE is a target binding site found in the 3' untranslated region of mRNA encoded by TRIP13, corresponding to a target binding site such as BINDING SITE I, BINDING SITE II or BINDING SITE III of FIG. 8. Table 4 illustrates the complementarity of the nucleotide sequences of TRIP13 BINDING SITE, designated SEQ ID:1424, to the nucleotide sequence of GAM47 RNA, herein designated GAM RNA, also designated SEQ ID:269.

Another function of GAM47 is therefore inhibition of Thyroid hormone receptor interactor 13 (TRIP13, Accession NP_004228.1). Accordingly, utilities of GAM47 include diagnosis, prevention and treatment of diseases and clinical conditions associated with TRIP13.

Tetratricopeptide repeat domain 7 (TTC7, Accession XP_031626.4) is another GAM47 target gene, herein designated TARGET GENE. TTC7 BINDING SITE is a target binding site found in the 3' untranslated region of mRNA encoded by TTC7, corresponding to a target binding site such as BINDING SITE I, BINDING SITE II or BINDING SITE III of FIG. 8. Table 4 illustrates the complementarity of the nucleotide sequences of TTC7 BINDING SITE, designated SEQ ID:14260, to the nucleotide sequence of GAM47 RNA, herein designated GAM RNA, also designated SEQ ID:269.

Another function of GAM47 is therefore inhibition of Tetratricopeptide repeat domain 7 (TTC7, Accession XP_031626.4). Accordingly, utilities of GAM47 include diagnosis, prevention and treatment of diseases and clinical conditions associated with TTC7.

TUBB5 (Accession NP_006078.2) is another GAM47 target gene, herein designated TARGET GENE. TUBB5 BINDING SITE is a target binding site found in the 3' untranslated region of mRNA encoded by TUBB5, corresponding to a target binding site such as BINDING SITE I, BINDING SITE II or BINDING SITE III of FIG. 8. Table 4 illustrates the complementarity of the nucleotide sequences of TUBB5 BINDING SITE, designated SEQ ID:15573, to the nucleotide sequence of GAM47 RNA, herein designated GAM RNA, also designated SEQ ID:269.

Another function of GAM47 is therefore inhibition of TUBB5 (Accession NP_006078.2). Accordingly, utilities of GAM47 include diagnosis, prevention and treatment of diseases and clinical conditions associated with TUBB5.

TXL-2 (Accession NP_835231.1) is another GAM47 target gene, herein designated TARGET GENE. TXL-2 BINDING SITE is a target binding site found in the 3' untranslated region of mRNA encoded by TXL-2, corresponding to a target binding site such as BINDING SITE I, BINDING SITE II or BINDING SITE III of FIG. 8. Table 4 illustrates the complementarity of the nucleotide sequences of TXL-2 BINDING SITE, designated SEQ ID:14725, to the nucleotide sequence of GAM47 RNA, herein designated GAM RNA, also designated SEQ ID:269.

Another function of GAM47 is therefore inhibition of TXL-2 (Accession NP_835231.1). Accordingly, utilities of GAM47 include diagnosis, prevention and treatment of diseases and clinical conditions associated with TXL-2.

U1SNRNPBP (Accession NP_851030.1) is another GAM47 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:19714, to the nucleotide sequence of GAM47 RNA, herein designated GAM RNA, also designated SEQ ID:269.

Another function of GAM47 is therefore inhibition of U1SNRNPBP (Accession NP_851030.1). Accordingly, utilities of GAM47 include diagnosis, prevention and treatment of diseases and clinical conditions associated with U1SNRNPBP.

U1SNRNPBP (Accession NP_851034.1) is another GAM47 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:19714, to the nucleotide sequence of GAM47 RNA, herein designated GAM RNA, also designated SEQ ID:269.

Another function of GAM47 is therefore inhibition of U1SNRNPBP (Accession NP_851034.1). Accordingly, utilities of GAM47 include diagnosis, prevention and treatment of diseases and clinical conditions associated with U1SNRNPBP.

U1SNRNPBP (Accession NP_073208.1) is another GAM47 target gene, herein designated TARGET GENE.

U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:19714, to the nucleotide sequence of GAM47 RNA, herein designated GAM RNA, also designated SEQ ID:269.

Another function of GAM47 is therefore inhibition of U1SNRNPBP (Accession NP_073208.1). Accordingly, utilities of GAM47 include diagnosis, prevention and treatment of diseases and clinical conditions associated with U1SNRNPBP.

U1SNRNPBP (Accession NP_008951.1) is another GAM47 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:19714, to the nucleotide sequence of GAM47 RNA, herein designated GAM RNA, also designated SEQ ID:269.

Another function of GAM47 is therefore inhibition of U1SNRNPBP (Accession NP_008951.1). Accordingly, utilities of GAM47 include diagnosis, prevention and treatment of diseases and clinical conditions associated with U1SNRNPBP.

Unc-51-like kinase 2 (c. elegans) (ULK2, Accession NP_055498.2) is another GAM47 target gene, herein designated TARGET GENE. ULK2 BINDING SITE is a target binding site found in the 3' untranslated region of mRNA encoded by ULK2, corresponding to a target binding site such as BINDING SITE I, BINDING SITE II or BINDING SITE III of FIG. 8. Table 4 illustrates the complementarity of the nucleotide sequences of ULK2 BINDING SITE, designated SEQ ID:2470, to the nucleotide sequence of GAM47 RNA, herein designated GAM RNA, also designated SEQ ID:269.

Another function of GAM47 is therefore inhibition of Unc-51-like kinase 2 (c. elegans) (ULK2, Accession NP_055498.2). Accordingly, utilities of GAM47 include diagnosis, prevention and treatment of diseases and clinical conditions associated with ULK2.

Ubiquitin specific protease 4 (proto - oncogene) (USP4, Accession NP_003354.1) is another GAM47 target gene, herein designated TARGET GENE. USP4 BINDING SITE is a target binding site found in the 3' untranslated region of mRNA encoded by USP4, corresponding to a target binding site such as BINDING SITE I, BINDING SITE II or BINDING SITE III of FIG. 8. Table 4 illustrates the complementarity of the nucleotide sequences of USP4 BINDING SITE, designated SEQ ID:10548, to the nucleotide sequence of GAM47 RNA, herein designated GAM RNA, also designated SEQ ID:269.

Another function of GAM47 is therefore inhibition of Ubiquitin specific protease 4 (proto - oncogene) (USP4, Accession NP_003354.1), a gene which is capable of removing ubiquitin from ubiquitinated proteins. Accordingly, utilities of GAM47 include diagnosis, prevention and treatment of diseases and clinical conditions associated with USP4.

The function of USP4 has been established by previous studies. The ubiquitin- specific proteases (UBPs) are a group of deubiquitinating enzymes that possess 2 signature motifs, the Cys box and the His box. By screening a human frontal cortex library with a Unp cDNA, Gray et al. (1995) isolated cDNAs encoding human UNP, or UNPH. The predicted protein contained both conserved UBP domains. Northern blot analysis of primary lung tumor samples indicated that levels of UNP mRNA were elevated in small cell carcinomas and adenocarcinomas relative to normal adult lung. Frederick et al. (1998) sequenced additional UNP cDNAs and found several differences from the sequence reported by Gray et al. (1995), including 2 single nucleotide insertions that increased the length of the predicted protein, UNPEL (UNP extended, long isoform), to 963 amino acids. They also recovered cDNAs encoding a shorter isoform designated UNPES. Both isoforms exhibited deubiquitinating activity. Antibodies against UNP detected 2 proteins of 105 to 110 kD on Western blots. Using immunocytochemistry of mammalian cells expressing epitope-tagged UNP and cell fractionation studies, Frederick et al. (1998) demonstrated that both isoforms of the human protein are localized primarily in the cytosol. Northern blot analysis revealed UNP expression as a closely-migrating cluster of mRNAs in all tissues tested. However, the authors found no evidence for overexpression of UNP transcripts in cell lines derived from small cell lung carcinomas.

Full details of the abovementioned studies are described in the following publications, the disclosure of which are hereby incorporated by reference:

Gray, D. A.; Inazawa, J.; Gupta, K.; Wong, A.; Ueda, R.; Takahashi, T.: Elevated expression of Unph, a proto - oncogene at 3p21.3, in human lung tumors. Oncogene 10:2179-2183, 1995; and Frederick, A.; Rolfe, M.; Chiu, M. I.: The human UNP locus at 3p21.31 encodes two tissue-selective, cytoplasmic isoforms with deubiquitinating activity that have reduced expression in s.

Further studies establishing the function and utilities of USP4 are found in John Hopkins OMIM database record ID 603486, and in cited publications listed in Table 5, which are hereby incorporated by reference. Vang-like 2 (van gogh, drosophila) (VANGL2, Accession XP_049695.4) is another GAM47 target gene, herein designated TARGET GENE. VANGL2 BINDING SITE1 and VANGL2 BINDING SITE2 are target binding sites found in untranslated regions of mRNA encoded by VANGL2, corresponding to target binding sites such as BINDING SITE I, BINDING SITE II or BINDING SITE III of FIG. 8. Table 4 illustrates the complementarity of the nucleotide sequences of VANGL2 BINDING SITE1 and VANGL2 BINDING SITE2, designated SEQ ID:2781 and SEQ ID:20059 respectively, to the nucleotide sequence of GAM47 RNA, herein designated GAM RNA, also designated SEQ ID:269.

Another function of GAM47 is therefore inhibition of Vang-like 2 (van gogh, drosophila) (VANGL2, Accession XP_049695.4), a gene which may take part in defining the lateral boundary of floorplate differentiation and therefore may be associated with Neural tube defects. Accordingly, utilities of GAM47 include diagnosis, prevention and treatment of Neural tube defects, and of other diseases and clinical conditions associated with VANGL2.

The function of VANGL2 has been established by previous studies. Murdoch et al. (2001) independently cloned the causative gene for craniorachischisis in Lp mice, which they named Lpp1. A single base transition, 1841G-A, resulted in a ser464- to - asn substitution. Lpp1 is expressed in the ventral part of the developing neural tube, but is excluded from the floorplate where Sonic hedgehog (Shh; 600725) is expressed. Embryos lacking Shh express Lpp1 throughout the ventral neural tube, suggesting negative regulation of Lpp1 by Shh. The authors suggested that the mutual interaction between Lpp1 and Shh may define the lateral boundary of floorplate differentiation. They hypothesized that loss of Lpp1 function may disrupt neurulation by permitting more extensive floorplate induction by Shh, thereby inhibiting midline bending of the neural plate during initiation of neurulation. The human ortholog of Lpp1, which maps to chromosome 1, shares 89% identity with the mouse gene at the nucleotide level and 99% identity at the amino acid level.

Animal model experiments lend further support to the function of VANGL2. 'Loop-tail' (Lp) is a semidominant mouse mutation that, in homozygous mutants, causes a severe form of neural tube defect called craniorachischisis. Heterozygous mice exhibit a characteristic looped tail, and homozygous embryos show a completely open neural tube in the hindbrain and spinal region. Kibar et al. (2001) used a positional cloning approach to identify the Lp gene. By an in silico search, the authors identified a mouse EST within the Lp interval homologous to a partial human cDNA clone KIAA1215. Based on its relationship to the mouse disorder, Kibar et al. (2001) used the temporary designation 'loop-tail-associated protein' (Ltap). The Ltap gene encodes a homolog of Drosophila 'strabismus/Van Gogh' (Stbm/Vang), a component of the frizzled-disheveled tissue polarity pathway. Ltap is expressed broadly in the neuroectoderm throughout early neurogenesis. This and the fact that the gene was altered in 2 independent Lp alleles identified it as the likely basis for loop-tail. The authors suggested that the human Ltap homolog is worthy of search for mutations that may be associated with sporadic or familial cases of neural tube defects in humans.

It is appreciated that the abovementioned animal model for VANGL2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Murdoch, J. N.; Doudney, K.; Paternotte, C.; Copp, A. J.; Stanier, P.: Severe neural tube defects in the loop-tail mouse result from mutation of Lpp1, a novel gene involved in floor plate specification. Hum. Molec. Genet. 10:2593-2601, 2001; and Kibar, Z.; Vogan, K. J.; Groulx, N.; Justice, M. J.; Underhill, D. A.; Gros, P.: Ltap, a mammalian homolog of Drosophila Strabismus/Van Gogh, is altered in the mouse neural tube mutant lo.

Further studies establishing the function and utilities of VANGL2 are found in John Hopkins OMIM database record ID 600533, and in cited publications listed in Table 5, which are hereby incorporated by reference. Vascular endothelial growth factor b (VEGFB, Accession NP_003368.1) is another GAM47 target gene, herein designated TARGET GENE. VEGFB BINDING SITE is a target binding site found in the 3' untranslated region of mRNA encoded by VEGFB, corresponding to a target binding site such as BINDING SITE I, BINDING SITE II or BINDING SITE III of FIG. 8. Table 4 illustrates the complementarity of the nucleotide sequences of VEGFB BINDING SITE, designated SEQ ID:1771, to the nucleotide sequence of GAM47 RNA, herein designated GAM RNA, also designated SEQ ID:269.

Another function of GAM47 is therefore inhibition of Vascular endothelial growth factor b (VEGFB, Accession NP_003368.1), a gene which is a growth factor for endothelial cells. Accordingly, utilities of GAM47 include diagnosis, prevention and treatment of diseases and clinical conditions associated with VEGFB.

The function of VEGFB has been established by previous studies. Grimmond et al. (1996) cloned and characterized a member of the vascular endothelial growth factor (VEGF; 192240) gene family, which they designated VRF for VEGF-related factor. By sequencing of cDNAs from a human fetal brain library and RT-PCR products from normal and tumor tissue cDNA pools, they identified 2 alternatively spliced messages with open reading frames of 621 and 564 bp, respectively. The predicted 186- and 167-amino acid polypeptides differ at their carboxyl ends, resulting from a shift in the open reading frame. Both isoforms show strong homology to VEGF at their amino termini, but only the shorter isoform maintained homology to VEGF at its carboxyl terminus and conserved all 16 cysteine residues of the 165-amino acid form of VEGF. VRF was predicted to contain a signal peptide, suggesting to Grimmond et al. (1996) that it may be a secreted factor. The protein coding region, spanning approximately 5 kb, is composed of 8 exons that range in size from 36 to 431 bp. Exons 6 and 7 are contiguous and the 2 isoforms of VRF arise through alternate splicing of exon 6. The investigators found that VRF is ubiquitously expressed as 2 transcripts of 2.0 and 5.5 kb and that the level of expression is similar among normal and malignant tissues.

Animal model experiments lend further support to the function of VEGFB. Bellomo et al. (2000) described the Vegfb -/-mouse. Unlike Vegfa-/- mice, which die during embryogenesis, Vegfb -/- mice are healthy and fertile. Although Vegfb -/-hearts appeared morphologically and functionally normal in unstressed mice, Bellomo et al. (2000) found that Vegfb -/-hearts were marginally smaller and displayed vascular dysfunction after coronary occlusion and impaired recovery from experimentally induced myocardial ischemia.

It is appreciated that the abovementioned animal model for VEGFB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Grimmond, S.; Lagercrantz, J.; Drinkwater, C.; Silins, G.; Townson, S.; Pollock, P.; Gotley, D.; Carson, E.; Rakar, S.; Nordenskjold, M.; Ward, L.; Hayward, N.; Weber, G. : Cloning and characterization of a novel human gene related to vascular endothelial growth factor. Genome Res. 6:124-131, 1996; and Bellomo, D.; Headrick, J. P.; Silins, G. U.; Paterson, C. A.; Thomas, P. S.; Gartside, M.; Mould, A.; Cahill, M. M.; Tonks, I. D.; Grimmond, S. M.; Townson, S.; Wells, C.; Little, M.; Cumm.

Further studies establishing the function and utilities of VEGFB are found in John Hopkins OMIM database record ID 601398, and in cited publications listed in Table 5, which are hereby incorporated by reference. Vasoactive intestinal peptide receptor 1 (VIPR1, Accession NP_004615.2) is another GAM47 target gene, herein designated TARGET GENE. VIPR1 BINDING SITE is a target binding site found in the 3' untranslated region of mRNA encoded by VIPR1, corresponding to a target binding site such as BINDING SITE I, BINDING SITE II or BINDING SITE III of FIG. 8. Table 4 illustrates the complementarity of the nucleotide sequences of VIPR1 BINDING SITE, designated SEQ ID:10605, to the nucleotide sequence of GAM47 RNA, herein designated GAM RNA, also designated SEQ ID:269.

Another function of GAM47 is therefore inhibition of Vasoactive intestinal peptide receptor 1 (VIPR1, Accession NP_004615.2), a gene which binds vip and is mediated by g proteins which activate adenylyl cyclase. Accordingly, utilities of GAM47 include diagnosis, prevention and treatment of diseases and clinical conditions associated with VIPR1.

The function of VIPR1 has been established by previous studies. Vasoactive intestinal peptide (VIP; 192320) is an octacosameric neuroendocrine mediator found predominantly in cholinergic presynaptic neurons of the central nervous system and in peripheral peptidergic neurons innervating diverse tissues. Of the many neuroendocrine peptides with immunologic functions, VIP is distinguished by its capacity to affect both B and T cells directly. Distinct subsets of neural, respiratory, gastrointestinal, and immune cells bear specific high-affinity receptors for VIP, which are associated with a guanine nucleotide-binding (G) protein capable of activating adenylate cyclase. Libert et al. (1991) obtained 4 new receptors of the G protein-coupled receptor family by selective amplification and cloning from thyroid cDNA. One of these, termed RDC1, was identified as the VIP receptor by Sreedharan et al. (1991). Libert et al. (1991) mapped the VIPR gene to 2q37 by in situ hybridization. Later information made it doubtful that the gene mapped to 2q37 was in fact the VIP receptor gene (Vassart, 1992). The sequence that was designated GPRN1 by Sreedharan et al. (1991) and mapped to 2q37 was found not to bind VIP by Wenger (1993). Sreedharan et al. (1995) isolated an authentic type I VIP receptor gene and by fluorescence in situ hybridization localized it to the 3p22 band in a region associated with small-cell lung cancer. By interspecific backcross analysis, Hashimoto et al. (1999) mapped the mouse Vipr1 gene to the distal region of chromosome 9, a region that shows homology of synteny with human chromosome 3p. Sreedharan et al. (1993) cloned a human intestinal VIP receptor gene; the deduced amino acid sequence shares 84% identity with the rat lung VIP receptor. Couvineau et al. (1994) isolated 2 VIPR cDNA clones from a human jejunal epithelial cell cDNA library. One encodes a VIP receptor consisting of 460 amino acids and having 7 putative transmembrane domains, as do other G protein-coupled receptors. The other encodes a 495-amino acid VIP receptor-related protein exhibiting 100% homology with the functional VIP receptor over the 428 amino acids at the C-terminal region, but containing a completely divergent 67-amino acid N-terminal domain. When expressed in COS-7 cells, the second protein did not bind radioiodinated VIP, although it was normally addressed at the plasma membrane as assessed by immunofluorescence studies.

Full details of the abovementioned studies are described in the following publications, the disclosure of which are hereby incorporated by reference:

Sreedharan, S. P.; Huang, J.-X.; Cheung, M.-C.; Goetzl, E. J.: Structure, expression, and chromosomal localization of the type I human vasoactive intestinal peptide receptor gene. Proc. Nat. Acad. Sci. 92:2939-2943, 1995; and Couvineau, A.; Rouyer-Fessard, C.; Darmoul, D.; Maoret, J.-J.; Carrero, I.; Ogier-Denis, E.; Laburthe, M.: Human intestinal VIP receptor: cloning and functional expression of two cDNA enc.

Further studies establishing the function and utilities of VIPR1 are found in John Hopkins OMIM database record ID 192321, and in cited publications listed in Table 5, which are hereby incorporated by reference. Vacuolar protein sorting 28 (yeast) (VPS28, Accession NP_057292.1) is another GAM47 target gene, herein designated TARGET GENE. VPS28 BINDING SITE is a target binding site found in the 3' untranslated region of mRNA encoded by VPS28, corresponding to a target binding site such as BINDING SITE I, BINDING SITE II or BINDING SITE III of FIG. 8. Table 4 illustrates the complementarity of the nucleotide sequences of VPS28 BINDING SITE, designated SEQ ID:1076, to the nucleotide sequence of GAM47 RNA, herein designated GAM RNA, also designated SEQ ID:269.

Another function of GAM47 is therefore inhibition of Vacuolar protein sorting 28 (yeast) (VPS28, Accession NP_057292.1). Accordingly, utilities of GAM47 include diagnosis, prevention and treatment of diseases and clinical conditions associated with VPS28.

Vacuolar protein sorting 4a (yeast) (VPS4A, Accession NP_037377.1) is another GAM47 target gene, herein designated TARGET GENE. VPS4A BINDING SITE is a target binding site found in the 3' untranslated region of mRNA encoded by VPS4A, corresponding to a target binding site such as BINDING SITE I, BINDING SITE II or BINDING SITE III of FIG. 8. Table 4 illustrates the complementarity of the nucleotide sequences of VPS4A BINDING SITE, designated SEQ ID:15139, to the nucleotide sequence of GAM47 RNA, herein designated GAM RNA, also designated SEQ ID:269.

Another function of GAM47 is therefore inhibition of Vacuolar protein sorting 4a (yeast) (VPS4A, Accession NP_037377.1). Accordingly, utilities of GAM47 include diagnosis, prevention and treatment of diseases and clinical conditions associated with VPS4A.

Williams-beuren syndrome chromosome region 1 (WBSCR1, Accession NP_114381.1) is another GAM47 target gene, herein designated TARGET GENE. WBSCR1 BINDING SITE is a target binding site found in the 3' untranslated region of multiple transcripts of mRNA encoded by WBSCR1, corresponding to a target binding site such as BINDING SITE I, BINDING SITE II or BINDING SITE III of FIG. 8. Table 4 illustrates the complementarity of the nucleotide sequences of WBSCR1 BINDING SITE, designated SEQ ID:9970, to the nucleotide sequence of GAM47 RNA, herein designated GAM RNA, also designated SEQ ID:269.

Another function of GAM47 is therefore inhibition of Williams-beuren syndrome chromosome region 1 (WBSCR1, Accession NP_114381.1), a gene which stimulates protein translation and therefore may be associated with Williams syndrome. Accordingly, utilities of GAM47 include diagnosis, prevention and treatment of Williams syndrome, and of other diseases and clinical conditions associated with WBSCR1.

The function of WBSCR1 has been established by previous studies. Williams- Beuren syndrome (WBS; 194050) is a multisystem developmental disorder caused by the deletion of contiguous genes at 7q11.23. Osborne et al. (1996) characterized a 500-kb region in 7q11.23 that was deleted in a collection of 30 WBS patients. They constructed a detailed physical map of the region consisting of cosmids, P1 artificial chromosomes, and yeast artificial chromosomes. They identified 9 transcription units from the area, including the previously characterized genes ELN (OMIM Ref. No. 130160), LIMK1 (OMIM Ref. No. 601329), and RFC2 (OMIM Ref. No. 600404), and the novel genes WSCR1 and WSCR4 (OMIM Ref. No. 603432). The WSCR1 gene has 6 exons which contain an open reading frame encoding 232 amino acids, including an RNA-binding domain consensus sequence. Northern blot analysis detected a 2.5-kb WBSCR1 transcript in all human cell lines analyzed. Richter-Cook et al. (1998) identified the eukaryotic initiation factor (EIF) 4H protein from rabbit reticulocyte lysate on the basis of its ability to stimulate translation in an in vitro globin synthesis assay deficient in EIF4B (OMIM Ref. No. 603928) and EIF4F. Amino acid sequence analysis of 3 EIF4H tryptic fragments revealed 100% sequence identity to the human WBSCR1 protein. The authors demonstrated that the 25-kD rabbit EIF4H protein stimulates the in vitro activities of EIF4B and EIF4F in globin synthesis, as well as the in vitro RNA-dependent ATPase activities of EIF4A (e.g., 601102), EIF4B, and EIF4F.

Full details of the abovementioned studies are described in the following publications, the disclosure of which are hereby incorporated by reference:

Osborne, L. R.; Martindale, D.; Scherer, S. W.; Shi, X.-M.; Huizenga, J.; Heng, H. H. Q.; Costa, T.; Pober, B.; Lew, L.; Brinkman, J.; Rommens, J.; Koop, B.; Tsui, L.- C.: Identification of genes from a 500-kb region at 7q11.23 that is commonly deleted in Williams syndrome patients. Genomics 36:328-336, 1996; and Richter-Cook, N. J.; Dever, T. E.; Hensold, J. O.; Merrick, W. C.: Purification and characterization of a new eukaryotic protein translation factor: eukaryotic initiation factor 4H. J.

Further studies establishing the function and utilities of WBSCR1 are found in John Hopkins OMIM database record ID 603431, and in cited publications listed in Table 5, which are hereby incorporated by reference. Williams-beuren syndrome chromosome region 1 (WBSCR1, Accession NP_071496.1) is another GAM47 target gene, herein designated TARGET GENE. WBSCR1 BINDING SITE is a target binding site found in the 3' untranslated region of multiple transcripts of mRNA encoded by WBSCR1, corresponding to a target binding site such as BINDING SITE I, BINDING SITE II or BINDING SITE III of FIG. 8. Table 4 illustrates the complementarity of the nucleotide sequences of WBSCR1 BINDING SITE, designated SEQ ID:9970, to the nucleotide sequence of GAM47 RNA, herein designated GAM RNA, also designated SEQ ID:269.

Another function of GAM47 is therefore inhibition of Williams-beuren syndrome chromosome region 1 (WBSCR1, Accession NP_071496.1), a gene which stimulates protein translation and therefore may be associated with Williams syndrome. Accordingly, utilities of GAM47 include diagnosis, prevention and treatment of Williams syndrome, and of other diseases and clinical conditions associated with WBSCR1.

The function of WBSCR1 has been established by previous studies. Williams- Beuren syndrome (WBS; 194050) is a multisystem developmental disorder caused by the deletion of contiguous genes at 7q11.23. Osborne et al. (1996) characterized a 500-kb region in 7q11.23 that was deleted in a collection of 30 WBS patients. They constructed a detailed physical map of the region consisting of cosmids, P1 artificial chromosomes, and yeast artificial chromosomes. They identified 9 transcription units from the area, including the previously characterized genes ELN (OMIM Ref. No. 130160), LIMK1 (OMIM Ref. No. 601329), and RFC2 (OMIM Ref. No. 600404), and the novel genes WSCR1 and WSCR4 (OMIM Ref. No. 603432). The WSCR1 gene has 6 exons which contain an open reading frame encoding 232 amino acids, including an RNA-binding domain consensus sequence. Northern blot analysis detected a 2.5-kb WBSCR1 transcript in all human cell lines analyzed. Richter-Cook et al. (1998) identified the eukaryotic initiation factor (EIF) 4H protein from rabbit reticulocyte lysate on the basis of its ability to stimulate translation in an in vitro globin synthesis assay deficient in EIF4B (OMIM Ref. No. 603928) and EIF4F. Amino acid sequence analysis of 3 EIF4H tryptic fragments revealed 100% sequence identity to the human WBSCR1 protein. The authors demonstrated that the 25-kD rabbit EIF4H protein stimulates the in vitro activities of EIF4B and EIF4F in globin synthesis, as well as the in vitro RNA-dependent ATPase activities of EIF4A (e.g., 601102), EIF4B, and EIF4F.

Full details of the abovementioned studies are described in the following publications, the disclosure of which are hereby incorporated by reference:

Osborne, L. R.; Martindale, D.; Scherer, S. W.; Shi, X.-M.; Huizenga, J.; Heng, H. H. Q.; Costa, T.; Pober, B.; Lew, L.; Brinkman, J.; Rommens, J.; Koop, B.; Tsui, L.- C.: Identification of genes from a 500-kb region at 7q11.23 that is commonly deleted in Williams syndrome patients. Genomics 36:328-336, 1996; and Richter-Cook, N. J.; Dever, T. E.; Hensold, J. O.; Merrick, W. C.: Purification and characterization of a new eukaryotic protein translation factor: eukaryotic initiation factor 4H. J.

Further studies establishing the function and utilities of WBSCR1 are found in John Hopkins OMIM database record ID 603431, and in cited publications listed in Table 5, which are hereby incorporated by reference. WDR22 (Accession XP_031102.1) is another GAM47 target gene, herein designated TARGET GENE. WDR22 BINDING SITE is a target binding site found in the 3' untranslated region of mRNA encoded by WDR22, corresponding to a target binding site such as BINDING SITE I, BINDING SITE II or BINDING SITE III of FIG. 8. Table 4 illustrates the complementarity of the nucleotide sequences of WDR22 BINDING SITE, designated SEQ ID:1630, to the nucleotide sequence of GAM47 RNA, herein designated GAM RNA, also designated SEQ ID:269.

Another function of GAM47 is therefore inhibition of WDR22 (Accession XP_031102.1). Accordingly, utilities of GAM47 include diagnosis, prevention and treatment of diseases and clinical conditions associated with WDR22.

WFDC13 (Accession NP_742002.1) is another GAM47 target gene, herein designated TARGET GENE. WFDC13 BINDING SITE is a target binding site found in the 5' untranslated region of mRNA encoded by WFDC13, corresponding to a target binding site such as BINDING SITE I, BINDING SITE II or BINDING SITE III of FIG. 8. Table 4 illustrates the complementarity of the nucleotide sequences of WFDC13 BINDING SITE, designated SEQ ID:15789, to the nucleotide sequence of GAM47 RNA, herein designated GAM RNA, also designated SEQ ID:269.

Another function of GAM47 is therefore inhibition of WFDC13 (Accession NP_742002.1). Accordingly, utilities of GAM47 include diagnosis, prevention and treatment of diseases and clinical conditions associated with WFDC13.

Xeroderma pigmentosum, complementation group c (XPC, Accession NP_004619.2) is another GAM47 target gene, herein designated TARGET GENE. XPC BINDING SITE is a target binding site found in the 3' untranslated region of mRNA encoded by XPC, corresponding to a target binding site such as BINDING SITE I, BINDING SITE II or BINDING SITE III of FIG. 8. Table 4 illustrates the complementarity of the nucleotide sequences of XPC BINDING SITE, designated SEQ ID:3193, to the nucleotide sequence of GAM47 RNA, herein designated GAM RNA, also designated SEQ ID:269.

Another function of GAM47 is therefore inhibition of Xeroderma pigmentosum, complementation group c (XPC, Accession NP_004619.2). Accordingly, utilities of GAM47 include diagnosis, prevention and treatment of diseases and clinical conditions associated with XPC.

ZAP (Accession NP_078901.3) is another GAM47 target gene, herein designated TARGET GENE. ZAP BINDING SITE is a target binding site found in the 5' untranslated region of multiple transcripts of mRNA encoded by ZAP, corresponding to a target binding site such as BINDING SITE I, BINDING SITE II or BINDING SITE III of FIG. 8. Table 4 illustrates the complementarity of the nucleotide sequences of ZAP BINDING SITE, designated SEQ ID:2097, to the nucleotide sequence of GAM47 RNA, herein designated GAM RNA, also designated SEQ ID:269.

Another function of GAM47 is therefore inhibition of ZAP (Accession NP_078901.3). Accordingly, utilities of GAM47 include diagnosis, prevention and treatment of diseases and clinical conditions associated with ZAP.

ZAP (Accession NP_064504.2) is another GAM47 target gene, herein designated TARGET GENE. ZAP BINDING SITE is a target binding site found in the 5' untranslated region of multiple transcripts of mRNA encoded by ZAP, corresponding to a target binding site such as BINDING SITE I, BINDING SITE II or BINDING SITE III of FIG. 8. Table 4 illustrates the complementarity of the nucleotide sequences of ZAP BINDING SITE, designated SEQ ID:2097, to the nucleotide sequence of GAM47 RNA, herein designated GAM RNA, also designated SEQ ID:269.

Another function of GAM47 is therefore inhibition of ZAP (Accession NP_064504.2). Accordingly, utilities of GAM47 include diagnosis, prevention and treatment of diseases and clinical conditions associated with ZAP.

Zinc finger, dhhc domain containing 5 (ZDHHC5, Accession XP_290511.1) is another GAM47 target gene, herein designated TARGET GENE. ZDHHC5 BINDING SITE is a target binding site found in the 5' untranslated region of mRNA encoded by ZDHHC5, corresponding to a target binding site such as BINDING SITE I, BINDING SITE II or BINDING SITE III of FIG. 8. Table 4 illustrates the complementarity of the nucleotide sequences of ZDHHC5 BINDING SITE, designated SEQ ID:17547, to the nucleotide sequence of GAM47 RNA, herein designated GAM RNA, also designated SEQ ID:269.

Another function of GAM47 is therefore inhibition of Zinc finger, dhhc domain containing 5 (ZDHHC5, Accession XP_290511.1). Accordingly, utilities of GAM47 include diagnosis, prevention and treatment of diseases and clinical conditions associated with ZDHHC5.

Zinc finger, dhhc domain containing 6 (ZDHHC6, Accession NP_071939.1) is another GAM47 target gene, herein designated TARGET GENE. ZDHHC6 BINDING SITE is a target binding site found in the 3' untranslated region of mRNA encoded by ZDHHC6, corresponding to a target binding site such as BINDING SITE I, BINDING SITE II or BINDING SITE III of FIG. 8. Table 4 illustrates the complementarity of the nucleotide sequences of ZDHHC6 BINDING SITE, designated SEQ ID:7010, to the nucleotide sequence of GAM47 RNA, herein designated GAM RNA, also designated SEQ ID:269.

Another function of GAM47 is therefore inhibition of Zinc finger, dhhc domain containing 6 (ZDHHC6, Accession NP_071939.1). Accordingly, utilities of GAM47 include diagnosis, prevention and treatment of diseases and clinical conditions associated with ZDHHC6.

ZFP1 (Accession NP_710155.1) is another GAM47 target gene, herein designated TARGET GENE. ZFP1 BINDING SITE is a target binding site found in the 5' untranslated region of mRNA encoded by ZFP1, corresponding to a target binding site such as BINDING SITE I, BINDING SITE II or BINDING SITE III of FIG. 8. Table 4 illustrates the complementarity of the nucleotide sequences of ZFP1 BINDING SITE, designated SEQ ID:2444, to the nucleotide sequence of GAM47 RNA, herein designated GAM RNA, also designated SEQ ID:269.

Another function of GAM47 is therefore inhibition of ZFP1 (Accession NP_710155.1). Accordingly, utilities of GAM47 include diagnosis, prevention and treatment of diseases and clinical conditions associated with ZFP1.

ZFP29 (Accession NP_060364.1) is another GAM47 target gene, herein designated TARGET GENE. ZFP29 BINDING SITE is a target binding site found in the 3' untranslated region of mRNA encoded by ZFP29, corresponding to a target binding site such as BINDING SITE I, BINDING SITE II or BINDING SITE III of FIG. 8. Table 4 illustrates the complementarity of the nucleotide sequences of ZFP29 BINDING SITE, designated SEQ ID:6538, to the nucleotide sequence of GAM47 RNA, herein designated GAM RNA, also designated SEQ ID:269.

Another function of GAM47 is therefore inhibition of ZFP29 (Accession NP_060364.1). Accordingly, utilities of GAM47 include diagnosis, prevention and treatment of diseases and clinical conditions associated with ZFP29.

Zinc finger protein 95 homolog (mouse) (ZFP95, Accession NP_055384.1) is another GAM47 target gene, herein designated TARGET GENE. ZFP95 BINDING SITE is a target binding site found in the 3' untranslated region of multiple transcripts of mRNA encoded by ZFP95, corresponding to a target binding site such as BINDING SITE I, BINDING SITE II or BINDING SITE III of FIG. 8. Table 4 illustrates the complementarity of the nucleotide sequences of ZFP95 BINDING SITE, designated SEQ ID:10540, to the nucleotide sequence of GAM47 RNA, herein designated GAM RNA, also designated SEQ ID:269.

Another function of GAM47 is therefore inhibition of Zinc finger protein 95 homolog (mouse) (ZFP95, Accession NP_055384.1). Accordingly, utilities of GAM47 include diagnosis, prevention and treatment of diseases and clinical conditions associated with ZFP95.

Zinc finger protein 95 homolog (mouse) (ZFP95, Accession NP_659570.1) is another GAM47 target gene, herein designated TARGET GENE. ZFP95 BINDING SITE is a target binding site found in the 3' untranslated region of multiple transcripts of mRNA encoded by ZFP95, corresponding to a target binding site such as BINDING SITE I, BINDING SITE II or BINDING SITE III of FIG. 8. Table 4 illustrates the complementarity of the nucleotide sequences of ZFP95 BINDING SITE, designated SEQ ID:10540, to the nucleotide sequence of GAM47 RNA, herein designated GAM RNA, also designated SEQ ID:269.

Another function of GAM47 is therefore inhibition of Zinc finger protein 95 homolog (mouse) (ZFP95, Accession NP_659570.1). Accordingly, utilities of GAM47 include diagnosis, prevention and treatment of diseases and clinical conditions associated with ZFP95.

ZHX2 (Accession NP_055758.1) is another GAM47 target gene, herein designated TARGET GENE. ZHX2 BINDING SITE is a target binding site found in the 3' untranslated region of mRNA encoded by ZHX2, corresponding to a target binding site such as BINDING SITE I, BINDING SITE II or BINDING SITE III of FIG. 8. Table 4 illustrates the complementarity of the nucleotide sequences of ZHX2 BINDING SITE, designated SEQ ID:3967, to the nucleotide sequence of GAM47 RNA, herein designated GAM RNA, also designated SEQ ID:269.

Another function of GAM47 is therefore inhibition of ZHX2 (Accession NP_055758.1). Accordingly, utilities of GAM47 include diagnosis, prevention and treatment of diseases and clinical conditions associated with ZHX2.

Zinc finger protein 137 (clone phz-30) (ZNF137, Accession NP_003429.1) is another GAM47 target gene, herein designated TARGET GENE. ZNF137 BINDING SITE is a target binding site found in the 3' untranslated region of mRNA encoded by ZNF137, corresponding to a target binding site such as BINDING SITE I, BINDING SITE II or BINDING SITE III of FIG. 8. Table 4 illustrates the complementarity of the nucleotide sequences of ZNF137 BINDING SITE, designated SEQ ID:18802, to the nucleotide sequence of GAM47 RNA, herein designated GAM RNA, also designated SEQ ID:269.

Another function of GAM47 is therefore inhibition of Zinc finger protein 137 (clone phz-30) (ZNF137, Accession NP_003429.1). Accordingly, utilities of GAM47 include diagnosis, prevention and treatment of diseases and clinical conditions associated with ZNF137.

Zinc finger protein 142 (clone phz-49) (ZNF142, Accession NP_005072.1) is another GAM47 target gene, herein designated TARGET GENE. ZNF142 BINDING SITE is a target binding site found in the 3' untranslated region of mRNA encoded by ZNF142, corresponding to a target binding site such as BINDING SITE I, BINDING SITE II or BINDING SITE III of FIG. 8. Table 4 illustrates the complementarity of the nucleotide sequences of ZNF142 BINDING SITE, designated SEQ ID:4359, to the nucleotide sequence of GAM47 RNA, herein designated GAM RNA, also designated SEQ ID:269.

Another function of GAM47 is therefore inhibition of Zinc finger protein 142 (clone phz-49) (ZNF142, Accession NP_005072.1), a gene which may be involved in transcriptional regulation. Accordingly, utilities of GAM47 include diagnosis, prevention and treatment of diseases and clinical conditions associated with ZNF142.

The function of ZNF142 has been established by previous studies. screening a human insulinoma cDNA library with a degenerate oligonucleotide corresponding to the H/C linker sequence, Tommerup et al. (1993) isolated cDNAs potentially encoding zinc finger proteins. Tommerup and Vissing (1995) performed sequence analysis on a number of these cDNAs and identified several novel zinc finger protein genes, including ZNF142. The ZNF142 cDNA predicts a protein belonging to the Kruppel family of zinc finger proteins. By sequencing random cDNAs corresponding to relatively long transcripts, Nagase et al. (1996) identified a cDNA encoding ZNF142, which they called KIAA0236. The deduced ZNF142 protein has 1,687 amino acids. Northern blot analysis detected ZNF142 expression in all 16 human tissues examined.

Full details of the abovementioned studies are described in the following publications, the disclosure of which are hereby incorporated by reference:

Tommerup, N.; Vissing, H.: Isolation and fine mapping of 16 novel human zinc finger-encoding cDNAs identify putative candidate genes for developmental and malignant disorders. Genomics 27:259-264, 1995; and Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes.

Further studies establishing the function and utilities of ZNF142 are found in John Hopkins OMIM database record ID 604083, and in cited publications listed in Table 5, which are hereby incorporated by reference. Zinc finger protein 336 (ZNF336, Accession NP_071927.1) is another GAM47 target gene, herein designated TARGET GENE. ZNF336 BINDING SITE is a target binding site found in the 3' untranslated region of mRNA encoded by ZNF336, corresponding to a target binding site such as BINDING SITE I, BINDING SITE II or BINDING SITE III of FIG. 8. Table 4 illustrates the complementarity of the nucleotide sequences of ZNF336 BINDING SITE, designated SEQ ID:11735, to the nucleotide sequence of GAM47 RNA, herein designated GAM RNA, also designated SEQ ID:269.

Another function of GAM47 is therefore inhibition of Zinc finger protein 336 (ZNF336, Accession NP_071927.1). Accordingly, utilities of GAM47 include diagnosis, prevention and treatment of diseases and clinical conditions associated with ZNF336.

ZNF431 (Accession XP_086098.2) is another GAM47 target gene, herein designated TARGET GENE. ZNF431 BINDING SITE is a target binding site found in the 3' untranslated region of mRNA encoded by ZNF431, corresponding to a target binding site such as BINDING SITE I, BINDING SITE II or BINDING SITE III of FIG. 8. Table 4 illustrates the complementarity of the nucleotide sequences of ZNF431 BINDING SITE, designated SEQ ID:4664, to the nucleotide sequence of GAM47 RNA, herein designated GAM RNA, also designated SEQ ID:269.

Another function of GAM47 is therefore inhibition of ZNF431 (Accession XP_086098.2). Accordingly, utilities of GAM47 include diagnosis, prevention and treatment of diseases and clinical conditions associated with ZNF431.

ZNF441 (Accession NP_689568.1) is another GAM47 target gene, herein designated TARGET GENE. ZNF441 BINDING SITE is a target binding site found in the 5' untranslated region of mRNA encoded by ZNF441, corresponding to a target binding site such as BINDING SITE I, BINDING SITE II or BINDING SITE III of FIG. 8. Table 4 illustrates the complementarity of the nucleotide sequences of ZNF441 BINDING SITE, designated SEQ ID:10390, to the nucleotide sequence of GAM47 RNA, herein designated GAM RNA, also designated SEQ ID:269.

Another function of GAM47 is therefore inhibition of ZNF441 (Accession NP_689568.1). Accordingly, utilities of GAM47 include diagnosis, prevention and treatment of diseases and clinical conditions associated with ZNF441.

Zinc finger protein 75a (ZNF75A, Accession NP_694573.1) is another GAM47 target gene, herein designated TARGET GENE. ZNF75A BINDING SITE is a target binding site found in the 3' untranslated region of mRNA encoded by ZNF75A, corresponding to a target binding site such as BINDING SITE I, BINDING SITE II or BINDING SITE III of FIG. 8. Table 4 illustrates the complementarity of the nucleotide sequences of ZNF75A BINDING SITE, designated SEQ ID:15281, to the nucleotide sequence of GAM47 RNA, herein designated GAM RNA, also designated SEQ ID:269.

Another function of GAM47 is therefore inhibition of Zinc finger protein 75a (ZNF75A, Accession NP_694573.1). Accordingly, utilities of GAM47 include diagnosis, prevention and treatment of diseases and clinical conditions associated with ZNF75A.

Zinc finger protein 80 (pt17) (ZNF80, Accession NP_009067.1) is another GAM47 target gene, herein designated TARGET GENE. ZNF80 BINDING SITE1 and ZNF80 BINDING SITE2 are target binding sites found in untranslated regions of mRNA encoded by ZNF80, corresponding to target binding sites such as BINDING SITE I, BINDING SITE II or BINDING SITE III of FIG. 8. Table 4 illustrates the complementarity of the nucleotide sequences of ZNF80 BINDING SITE1 and ZNF80 BINDING SITE2, designated SEQ ID:3538 and SEQ ID:7656 respectively, to the nucleotide sequence of GAM47 RNA, herein designated GAM RNA, also designated SEQ ID:269.

Another function of GAM47 is therefore inhibition of Zinc finger protein 80 (pt17) (ZNF80, Accession NP_009067.1).

Accordingly, utilities of GAM47 include diagnosis, prevention and treatment of diseases and clinical conditions associated with ZNF80.

FIG. 8 further provides a conceptual description of a novel bioinformatically detected of the present invention, referred to here as Genomic Address Messenger 49 (GAM49), which modulates expression of respective target genes thereof, the function and utility of which target genes is known in the art.

GAM49 is a novel bioinformatically detected regulatory, non protein coding, micro RNA (miRNA) gene. The method by which GAM49 was detected is described hereinabove with reference to FIGS. 8-15.

GAM49 gene, herein designated GAM GENE, and GAM49 target gene, herein designated TARGET GENE, are human genes contained in the human genome.

GAM49 gene encodes a GAM49 precursor RNA, herein designated GAM PRECURSOR RNA. Similar to other miRNA genes, and unlike most ordinary genes, GAM49 precursor RNA does not encode a protein. A nucleotide sequence identical or highly similar to the nucleotide sequence of GAM49 precursor RNA is designated SEQ ID:184, and is provided hereinbelow with reference to the sequence listing part.

GAM49 precursor RNA folds onto itself, forming GAM49 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM49 precursor RNA folds onto itself, forming GAM49 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM49 precursor RNA, designated SEQ-ID:184, and a schematic representation of a predicted secondary folding of GAM49 folded precursor RNA are further described with reference to Table 2, hereby incorporated by reference.

An enzyme complex designated DICER COMPLEX, 'dices' the GAM49 folded precursor RNA into GAM49 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM49 RNA is designated SEQ ID:338, and is provided hereinbelow with references to the sequence listing part and Table 3, hereby incorporated by reference.

GAM49 target gene, herein designated TARGET GENE, encodes a corresponding messenger RNA, GAM49 target RNA, herein designated GAM TARGET RNA. GAM49 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM49 RNA, herein designated GAM RNA, binds complementarily to one or more target binding sites located in untranslated regions of GAM49 target RNA, herein designated GAM TARGET RNA. This complementary binding is due to the fact that the nucleotide sequence of GAM49 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM49 RNA may have a different number of target binding sites in untranslated regions of a GAM49 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM49 RNA, herein designated GAM RNA, to target binding sites on GAM49 target RNA, herein designated GAM TARGET RNA, such as BINDING SITE I, BINDING SITE II and BINDING SITE III, inhibits translation of GAM49 target RNA into GAM49 target protein, herein designated GAM TARGET PROTEIN. GAM target protein is therefore outlined by a broken line.

It is appreciated that GAM49 target gene, herein designated TARGET GENE, in fact represents a plurality of GAM49 target genes. The mRNA of each one of this plurality of GAM49 target genes comprises one or more target binding sites, each having a nucleotide sequence which is at least partly complementary to GAM49 RNA, herein designated GAM RNA, and which when bound by GAM49 RNA causes inhibition of translation of respective one or more GAM49 target proteins.

It is further appreciated by one skilled in the art that the mode of translational inhibition illustrated by FIG. 8 with specific reference to translational inhibition exerted by GAM49 gene, herein designated GAM GENE, on one or more GAM49 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM49 correlate with, and may be deduced from, the identity of the target genes which GAM49 binds and inhibits, and the function of these target genes, as elaborated hereinbelow.

Fibroblast growth factor 18 (FGF18, Accession NM_003862.1) is a GAM49 target gene, herein designated TARGET GENE. FGF18 BINDING SITE is a target binding site found in the 5' untranslated region of multiple transcripts of mRNA encoded by FGF18, corresponding to a target binding site such as BINDING SITE I, BINDING SITE II or BINDING SITE III of FIG. 8. Table 4 illustrates the complementarity of the nucleotide sequences of FGF18 BINDING SITE, designated SEQ ID:6988, to the nucleotide sequence of GAM49 RNA, herein designated GAM RNA, also designated SEQ ID:338.

A function of GAM49 is therefore inhibition of Fibroblast growth factor 18 (FGF18, Accession NM_003862.1), a gene which stimulates hepatic and intestinal proliferation. Accordingly, utilities of GAM49 include diagnosis, prevention and treatment of diseases and clinical conditions associated with FGF18.

The function of FGF18 has been established by previous studies. The fibroblast growth factors (FGFs; e.g., FGF2; 134920) are a family of growth factors and oncogenes that contain a conserved, approximately 120-amino acid core. Individual FGFs play important roles in embryonic development, cell growth, morphogenesis, tissue repair, inflammation, angiogenesis, and tumor growth and invasion. Ohbayashi et al. (1998) isolated human, mouse, and rat cDNAs encoding a novel member of the FGF family, FGF18. The deduced 207-amino acid human and rat FGF18 proteins are 99% identical. FGF18 contains a typical hydrophobic signal sequence at its N terminus, and the authors demonstrated that recombinant rat Fgf18 can be efficiently secreted by High Five insect cells. Recombinant rat Fgf18 induced neurite outgrowth in PC12 cells. Northern blot analysis of rat adult tissues showed abundant expression of Fgf18 in lung but did not detect Fgf18 expression in other tissues. In rat 14.5- and 19.5-day embryos, in situ hybridization showed Fgf18 expression in several discrete regions. Independently, Hu et al. (1998) isolated human and mouse FGF18 cDNAs. Among known FGF family members, the FGF18 protein is most similar to FGF8 (OMIM Ref. No. 600483) and FGF17 (OMIM Ref. No. 603725), with human FGF18 showing 60% and 58% identity with human FGF8 and FGF17, respectively. The authors demonstrated that recombinant mouse Fgf18 is glycosylated and can stimulate proliferation of NIH 3T3 cells in vitro in a heparan sulfate-dependent manner. Northern blot analysis of mouse adult tissues showed highest Fgf18 expression in the lung and kidney, and in situ hybridization of mouse 15.5-day embryos detected Fgf18 transcripts primarily in the lung. However, injection of recombinant mouse Fgf18 into normal mice induced proliferation in a wide variety of tissues, with the liver and small intestine appearing to be the primary targets. Hu et al. (1998) showed that transgenic mice overexpressing Fgf18 in the liver exhibited an increase in liver weight and hepatocellular proliferation. By radiation hybrid analysis and FISH, Whitmore et al. (2000) mapped the FGF18 gene to chromosome 5q34.

Full details of the abovementioned studies are described in the following publications, the disclosure of which are hereby incorporated by reference:

Ohbayashi, N.; Hoshikawa, M.; Kimura, S.; Yamasaki, M.; Fukui, S.; Itoh, N.: Structure and expression of the mRNA encoding a novel fibroblast growth factor, FGF-18. J. Biol. Chem. 273:18161-18164, 1998; and Whitmore, T. E.; Maurer, M. F.; Sexson, S.; Raymond, F.; Conklin, D.; Deisher, T. A.: Assignment of fibroblast growth factor 18 (FGF18) to human chromosome 5q34 by use of radiation hyb.

Further studies establishing the function and utilities of FGF18 are found in John Hopkins OMIM database record ID 603726, and in cited publications listed in Table 5, which are hereby incorporated by reference. FLJ13855 (Accession NM_023079.2) is another GAM49 target gene, herein designated TARGET GENE. FLJ13855 BINDING SITE is a target binding site found in the 3' untranslated region of mRNA encoded by FLJ13855, corresponding to a target binding site such as BINDING SITE I, BINDING SITE II or BINDING SITE III of FIG. 8. Table 4 illustrates the complementarity of the nucleotide sequences of FLJ13855 BINDING SITE, designated SEQ ID:19352, to the nucleotide sequence of GAM49 RNA, herein designated GAM RNA, also designated SEQ ID:338.

Another function of GAM49 is therefore inhibition of FLJ13855 (Accession NM_023079.2). Accordingly, utilities of GAM49 include diagnosis, prevention and treatment of diseases and clinical conditions associated with FLJ13855.

Frequently rearranged in advanced t-cell lymphomas (FRAT1, Accession NM_005479.1) is another GAM49 target gene, herein designated TARGET GENE. FRAT1 BINDING SITE is a target binding site found in the 3' untranslated region of multiple transcripts of mRNA encoded by FRAT1, corresponding to a target binding site such as BINDING SITE I, BINDING SITE II or BINDING SITE III of FIG. 8. Table 4 illustrates the complementarity of the nucleotide sequences of FRAT1 BINDING SITE, designated SEQ ID:9462, to the nucleotide sequence of GAM49 RNA, herein designated GAM RNA, also designated SEQ ID:338.

Another function of GAM49 is therefore inhibition of Frequently rearranged in advanced t-cell lymphomas (FRAT1, Accession NM_005479.1). Accordingly, utilities of GAM49 include diagnosis, prevention and treatment of diseases and clinical conditions associated with FRAT1.

KIAA0087 (Accession NM_014769.1) is another GAM49 target gene, herein designated TARGET GENE. KIAA0087 BINDING SITE is a target binding site found in the 3' untranslated region of mRNA encoded by KIAA0087, corresponding to a target binding site such as BINDING SITE I, BINDING SITE II or BINDING SITE III of FIG. 8. Table 4 illustrates the complementarity of the nucleotide sequences of KIAA0087 BINDING SITE, designated SEQ ID:7226, to the nucleotide sequence of GAM49 RNA, herein designated GAM RNA, also designated SEQ ID:338.

Another function of GAM49 is therefore inhibition of KIAA0087 (Accession NM_014769.1). Accordingly, utilities of GAM49 include diagnosis, prevention and treatment of diseases and clinical conditions associated with KIAA0087.

KIAA1679 (Accession XM_046570.3) is another GAM49 target gene, herein designated TARGET GENE. KIAA1679 BINDING SITE is a target binding site found in the 3' untranslated region of mRNA encoded by KIAA1679, corresponding to a target binding site such as BINDING SITE I, BINDING SITE II or BINDING SITE III of FIG. 8. Table 4 illustrates the complementarity of the nucleotide sequences of KIAA1679 BINDING SITE, designated SEQ ID:16549, to the nucleotide sequence of GAM49 RNA, herein designated GAM RNA, also designated SEQ ID:338.

Another function of GAM49 is therefore inhibition of KIAA1679 (Accession XM_046570.3). Accordingly, utilities of GAM49 include diagnosis, prevention and treatment of diseases and clinical conditions associated with KIAA1679.

Ninjurin 2 (NINJ2, Accession NM_016533.3) is another GAM49 target gene, herein designated TARGET GENE. NINJ2 BINDING SITE is a target binding site found in the 5' untranslated region of mRNA encoded by NINJ2, corresponding to a target binding site such as BINDING SITE I, BINDING SITE II or BINDING SITE III of FIG. 8. Table 4 illustrates the complementarity of the nucleotide sequences of NINJ2 BINDING SITE, designated SEQ ID:18923, to the nucleotide sequence of GAM49 RNA, herein designated GAM RNA, also designated SEQ ID:338.

Another function of GAM49 is therefore inhibition of Ninjurin 2 (NINJ2, Accession NM_016533.3). Accordingly, utilities of GAM49 include diagnosis, prevention and treatment of diseases and clinical conditions associated with NINJ2.

S100 calcium binding protein, beta (neural) (S100B, Accession NM_006272.1) is another GAM49 target gene, herein designated TARGET GENE. S100B BINDING SITE is a target binding site found in the 3' untranslated region of mRNA encoded by S100B, corresponding to a target binding site such as BINDING SITE I, BINDING SITE II or BINDING SITE III of FIG. 8. Table 4 illustrates the complementarity of the nucleotide sequences of S100B BINDING SITE, designated SEQ ID:5375, to the nucleotide sequence of GAM49 RNA, herein designated GAM RNA, also designated SEQ ID:338.

Another function of GAM49 is therefore inhibition of S100 calcium binding protein, beta (neural) (S100B, Accession NM_006272.1), a gene which weakly binds calcium but binds zinc very tightly-distinct binding sites with different affinities exist for both ions on each monomer. Accordingly, utilities of GAM49 include diagnosis, prevention and treatment of diseases and clinical conditions associated with S100B.

The function of S100B has been established by previous studies. See 176940. The beta-subunit of S100 protein is expressed in glial cells at levels at least tenfold higher than in most other cell types. The brain also contains small amounts of the alpha subunits at levels approximately one-tenth that of the beta subunit. Allore et al. (1988) used genomic and cDNA probes in connection with a panel of rodent- human somatic cell hybrids to assign the S100B gene to 21q22. They suggested that this is a candidate gene for the neurologic disturbances in Down syndrome when present in trisomic state. By in situ hybridization, Duncan et al. (1989) localized the S100B gene to 21q22.2-q22.3. Allore et al. (1990) isolated overlapping genomic clones spanning the region coding for S100B and its flanking sequences. The intron/exon organization is similar to that of the genes coding for several other members of the S100 protein subfamily. The S100B gene is composed of 3 exons, the first of which specifies the 5-prime untranslated region. Morii et al. (1991) isolated the S100A (OMIM Ref. No. 176940) and S100B genes from a human genomic DNA library. Endonuclease mapping and DNA sequencing showed that both comprise 3 exons and 2 introns. Two Ca(2+)-binding domains were independently encoded by exons 2 and 3. By spot-blot hybridization analysis of flow-sorted chromosomes, Morii et al. (1991) showed that the S100A and S100B genes are located on chromosome 1 and chromosome 21, respectively. Using restriction endonuclease fragment length variations (RFLV) in multipoint backcrosses, Shimizu et al. (1992) mapped the S100b gene in relation to other genes on mouse chromosome 10. The S100B gene is expressed at high levels in brain primarily by astrocytes. Addition of the disulfide-bonded dimeric form of the protein to primary neuronal and glial cultures and established cell lines induces axonal extension and alterations in astrocyte proliferation and phenotype. Reeves et al. (1994) demonstrated that the same effects of the S100B protein are exerted in vivo. They found that both astrocytosis and neurite proliferation occurred in transgenic mice expressing elevated levels of S100b. They suggested that these transgenic mice represent a useful model for studies of the role of S100B in glial-neuronal interactions in normal development and function of the brain and for analyzing the significance of elevated levels of the protein in Down syndrome and Alzheimer disease.

Full details of the abovementioned studies are described in the following publications, the disclosure of which are hereby incorporated by reference:

Reeves, R. H.; Yao, J.; Crowley, M. R.; Buck, S.; Zhang, X.; Yarowsky, P.; Gearhart, J. D.; Hilt, D. C.: Astrocytosis and axonal proliferation in the hippocampus of S100b transgenic mice. Proc. Nat. Acad. Sci. 91:5359-5363, 1994; and Shimizu, A.; Sakai, Y.; Ohno, K.; Masaki, S.; Kuwano, R.; Takahashi, Y.; Miyashita, N.; Watanabe, T.: A molecular genetic linkage map of mouse chromosome 10, including the My, S100b, P.

Further studies establishing the function and utilities of S100B are found in John Hopkins OMIM database record ID 176990, and in cited publications listed in Table 5, which are hereby incorporated by reference. Sema domain, immunoglobulin domain (ig), transmembrane domain (tm) and short cytoplasmic domain, (semaphorin) 4b (SEMA4B, Accession XM_044533.9) is another GAM49 target gene, herein designated TARGET GENE. SEMA4B BINDING SITE is a target binding site found in the 3' untranslated region of multiple transcripts of mRNA encoded by SEMA4B, corresponding to a target binding site such as BINDING SITE I, BINDING SITE II or BINDING SITE III of FIG. 8. Table 4 illustrates the complementarity of the nucleotide sequences of SEMA4B BINDING SITE, designated SEQ ID:17188, to the nucleotide sequence of GAM49 RNA, herein designated GAM RNA, also designated SEQ ID:338.

Another function of GAM49 is therefore inhibition of Sema domain, immunoglobulin domain (ig), transmembrane domain (tm) and short cytoplasmic domain, (semaphorin) 4b (SEMA4B, Accession XM_044533.9). Accordingly, utilities of GAM49 include diagnosis, prevention and treatment of diseases and clinical conditions associated with SEMA4B.

Tumor necrosis factor receptor superfamily, member 6b, decoy (TNFRSF6B, Accession) is another GAM49 target gene, herein designated TARGET GENE. TNFRSF6B BINDING SITE is a target binding site found in the 3' untranslated region of multiple transcripts of mRNA encoded by TNFRSF6B, corresponding to a target binding site such as BINDING SITE I, BINDING SITE II or BINDING SITE III of FIG. 8. Table 4 illustrates the complementarity of the nucleotide sequences of TNFRSF6B BINDING SITE, designated SEQ ID:17121, to the nucleotide sequence of GAM49 RNA, herein designated GAM RNA, also designated SEQ ID:338.

Another function of GAM49 is therefore inhibition of Tumor necrosis factor receptor superfamily, member 6b, decoy (TNFRSF6B, Accession), a gene which is decoy receptor and protects against apoptosis. Accordingly, utilities of GAM49 include diagnosis, prevention and treatment of diseases and clinical conditions associated with TNFRSF6B.

The function of TNFRSF6B has been established by previous studies. Pitti et al. (1998) identified ESTs that showed homology to the tumor necrosis factor receptor (TNFR) superfamily. Using PCR with primers based on the region of EST consensus, they isolated a cDNA encoding a soluble decoy receptor, termed decoy receptor-3 (DCR3), from a human fetal lung cDNA library. The DCR3 protein contains 300 amino acids and has a molecular mass of 35 kD. By Northern blot analysis, Pitti et al. (1998) detected a 1.2-kb transcript in human fetal lung, brain, and liver, and in adult spleen, colon, and lung. Pitti et al. (1998) demonstrated that DCR3 binds to FASL and inhibits FASL-induced apoptosis. Like osteoprotegerin (OPG; 602643), another TNFR superfamily member, DCR3 lacks an apparent transmembrane sequence, indicating that DCR3 may be a secreted, rather than a membrane-associated, molecule. The DCR3 protein shares 31% sequence homology with OPG, and all of the cysteines in the 4 cysteine-rich domains of DCR3 and OPG are conserved. Pitti et al. (1998) stated that DCR3 and OPG define a subset of TNFR family members that function as secreted decoys to modulate ligands that induce apoptosis. Bai et al. (2000) independently identified the DCR3 gene, which they called M68. M68 genomic DNA, mRNA, and protein levels were examined in a series of human gastrointestinal tract tumors. Using M68 immunohistochemistry and a scoring system similar to that used for HER-2/neu (ERBB2; 164870), they found that M68 protein was overexpressed in 30 of 68 (44%) human adenocarcinomas of the esophagus, stomach, colon, and rectum. Tumors examined by Northern blot revealed M68 mRNA highly elevated in a similar fraction of primary tumors from the same gastrointestinal tract regions, as well as in 2 colon adenocarcinoma cell lines. They also found M68 protein to be overexpressed in a substantial number of tumors in which gene amplification could not be detected by fluorescence in situ hybridization or quantitative genomic PCR, suggesting that overexpression of M68 may precede amplification in tumors. They found that M68 lies within a 4-gene cluster that includes a novel helicase-like gene related to RAD3/ERCC2 (OMIM Ref. No. 126340), a plasma membrane Ras-related GTPase and a member of the stathmin family (OMIM Ref. No. 151442), amplification or overexpression of which may also contribute to cell growth and tumor progression.

Full details of the abovementioned studies are described in the following publications, the disclosure of which are hereby incorporated by reference:

Bai, C.; Connolly, B.; Metzker, M. L.; Hilliard, C. A.; Liu, X.; Sandig, V.; Soderman, A.; Galloway, S. M.; Liu, Q.; Austin, C. P.; Caskey, C. T.: Overexpression of M68/DCR3 in human gastrointestinal tract tumors independent of gene amplification and its location in a four-gene cluster. Proc. Nat. Acad. Sci. 97: 1230-1235, 2000; and Pitti, R. M.; Marsters, S. A.; Lawrence, D. A.; Roy, M.; Kischkel, F. C.; Dowd, P.; Huang, A.; Donahue, C. J.; Sherwood, S. W.; Baldwin, D. T.; Godowski, P. J.; Wood, W. I.; Gurney, A.

Further studies establishing the function and utilities of TNFRSF6B are found in John Hopkins OMIM database record ID 603361, and in cited publications listed in Table 5, which are hereby incorporated by reference.

FIG. 8 further provides a conceptual description of a novel bioinformatically detected of the present invention, referred to here as Genomic Address Messenger 50 (GAM50), which modulates expression of respective target genes thereof, the function and utility of which target genes is known in the art.

GAM50 is a novel bioinformatically detected regulatory, non protein coding, micro RNA (miRNA) gene. The method by which GAM50 was detected is described hereinabove with reference to FIGS. 8-15.

GAM50 gene, herein designated GAM GENE, and GAM50 target gene, herein designated TARGET GENE, are human genes contained in the human genome.

GAM50 gene encodes a GAM50 precursor RNA, herein designated GAM PRECURSOR RNA. Similar to other miRNA genes, and unlike most ordinary genes, GAM50 precursor RNA does not encode a protein. A nucleotide sequence identical or highly similar to the nucleotide sequence of GAM50 precursor RNA is designated SEQ ID:150, and is provided hereinbelow with reference to the sequence listing part.

GAM50 precursor RNA folds onto itself, forming GAM50 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM50 precursor RNA folds onto itself, forming GAM50 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM50 precursor RNA, designated SEQ-ID:150, and a schematic representation of a predicted secondary folding of GAM50 folded precursor RNA are further described with reference to Table 2, hereby incorporated by reference.

An enzyme complex designated DICER COMPLEX, 'dices' the GAM50 folded precursor RNA into GAM50 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM50 RNA is designated SEQ ID:368, and is provided hereinbelow with references to the sequence listing part and Table 3, hereby incorporated by reference.

GAM50 target gene, herein designated TARGET GENE, encodes a corresponding messenger RNA, GAM50 target RNA, herein designated GAM TARGET RNA. GAM50 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM50 RNA, herein designated GAM RNA, binds complementarily to one or more target binding sites located in untranslated regions of GAM50 target RNA, herein designated GAM TARGET RNA. This complementary binding is due to the fact that the nucleotide sequence of GAM50 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM50 RNA may have a different number of target binding sites in untranslated regions of a GAM50 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM50 RNA, herein designated GAM RNA, to target binding sites on GAM50 target RNA, herein designated GAM TARGET RNA, such as BINDING SITE I, BINDING SITE II and BINDING SITE III, inhibits translation of GAM50 target RNA into GAM50 target protein, herein designated GAM TARGET PROTEIN. GAM target protein is therefore outlined by a broken line.

It is appreciated that GAM50 target gene, herein designated TARGET GENE, in fact represents a plurality of GAM50 target genes. The mRNA of each one of this plurality of GAM50 target genes comprises one or more target binding sites, each having a nucleotide sequence which is at least partly complementary to GAM50 RNA, herein designated GAM RNA, and which when bound by GAM50 RNA causes inhibition of translation of respective one or more GAM50 target proteins.

It is further appreciated by one skilled in the art that the mode of translational inhibition illustrated by FIG. 8 with specific reference to translational inhibition exerted by GAM50 gene, herein designated GAM GENE, on one or more GAM50 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM50 correlate with, and may be deduced from, the identity of the target genes which GAM50 binds and inhibits, and the function of these target genes, as elaborated hereinbelow.

LOC85028 (Accession NM_053040.1) is a GAM50 target gene, herein designated TARGET GENE. LOC85028 BINDING SITE is a target binding site found in the 5' untranslated region of mRNA encoded by LOC85028, corresponding to a target binding site such as BINDING SITE I, BINDING SITE II or BINDING SITE III of FIG. 8. Table 4 illustrates the complementarity of the nucleotide sequences of LOC85028 BINDING SITE, designated SEQ ID:11482, to the nucleotide sequence of GAM50 RNA, herein designated GAM RNA, also designated SEQ ID:368.

A function of GAM50 is therefore inhibition of LOC85028 (Accession NM_053040.1). Accordingly, utilities of GAM50 include diagnosis, prevention and treatment of diseases and clinical conditions associated with LOC85028.

FIG. 8 further provides a conceptual description of a novel bioinformatically detected of the present invention, referred to here as Genomic Address Messenger 51 (GAM51), which modulates expression of respective target genes thereof, the function and utility of which target genes is known in the art.

GAM51 is a novel bioinformatically detected regulatory, non protein coding, micro RNA (miRNA) gene. The method by which GAM51 was detected is described hereinabove with reference to FIGS. 8-15.

GAM51 gene, herein designated GAM GENE, and GAM51 target gene, herein designated TARGET GENE, are human genes contained in the human genome.

GAM51 gene encodes a GAM51 precursor RNA, herein designated GAM PRECURSOR RNA. Similar to other miRNA genes, and unlike most ordinary genes, GAM51 precursor RNA does not encode a protein. A nucleotide sequence identical or highly similar to the nucleotide sequence of GAM51 precursor RNA is designated SEQ ID:49, and is provided hereinbelow with reference to the sequence listing part. Nucleotide sequence SEQ ID:49 is located at position 70576684 relative to chromosome 7.

GAM51 precursor RNA folds onto itself, forming GAM51 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM51 precursor RNA folds onto itself, forming GAM51 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM51 precursor RNA, designated SEQ-ID:49, and a schematic representation of a predicted secondary folding of GAM51 folded precursor RNA are further described with reference to Table 2, hereby incorporated by reference.

An enzyme complex designated DICER COMPLEX, 'dices' the GAM51 folded precursor RNA into GAM51 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM51 RNA is designated SEQ ID:201, and is provided hereinbelow with references to the sequence listing part and Table 3, hereby incorporated by reference.

GAM51 target gene, herein designated TARGET GENE, encodes a corresponding messenger RNA, GAM51 target RNA, herein designated GAM TARGET RNA. GAM51 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM51 RNA, herein designated GAM RNA, binds complementarily to one or more target binding sites located in untranslated regions of GAM51 target RNA, herein designated GAM TARGET RNA. This complementary binding is due to the fact that the nucleotide sequence of GAM51 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM51 RNA may have a different number of target binding sites in untranslated regions of a GAM51 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM51 RNA, herein designated GAM RNA, to target binding sites on GAM51 target RNA, herein designated GAM TARGET RNA, such as BINDING SITE I, BINDING SITE II and BINDING SITE III, inhibits translation of GAM51 target RNA into GAM51 target protein, herein designated GAM TARGET PROTEIN. GAM target protein is therefore outlined by a broken line.

It is appreciated that GAM51 target gene, herein designated TARGET GENE, in fact represents a plurality of GAM51 target genes. The mRNA of each one of this plurality of GAM51 target genes comprises one or more target binding sites, each having a nucleotide sequence which is at least partly complementary to GAM51 RNA, herein designated GAM RNA, and which when bound by GAM51 RNA causes inhibition of translation of respective one or more GAM51 target proteins.

It is further appreciated by one skilled in the art that the mode of translational inhibition illustrated by FIG. 8 with specific reference to translational inhibition exerted by GAM51 gene, herein designated GAM GENE, on one or more GAM51 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM51 correlate with, and may be deduced from, the identity of the target genes which GAM51 binds and inhibits, and the function of these target genes, as elaborated hereinbelow.

Atp-binding cassette, sub-family d (ald), member 4 (ABCD4, Accession NM_020323.1) is a GAM51 target gene, herein designated TARGET GENE. ABCD4 BINDING SITE is a target binding site found in the 3' untranslated region of multiple transcripts of mRNA encoded by ABCD4, corresponding to a target binding site such as BINDING SITE I, BINDING SITE II or BINDING SITE III of FIG. 8. Table 4 illustrates the complementarity of the nucleotide sequences of ABCD4 BINDING SITE, designated SEQ ID:1712, to the nucleotide sequence of GAM51 RNA, herein designated GAM RNA, also designated SEQ ID:201.

A function of GAM51 is therefore inhibition of Atp-binding cassette, sub-family d (ald), member 4 (ABCD4, Accession NM_020323.1), a gene which Putative peroxisomal ATP binding cassette transporter. Accordingly, utilities of GAM51 include diagnosis, prevention and treatment of diseases and clinical conditions associated with ABCD4.

The function of ABCD4 has been established by previous studies. The peroxisomal membrane contains several ATP-binding cassette (ABC) transporters, including PMP70 (PXMP1; 170995), ALDP (see OMIM Ref. No. 300100), and ALDR (ALDL1; 601081). All 3 proteins are ABC half-transporters, which dimerize to form an active transporter. See 603076. By searching an EST database for homologs of PMP70 and ALDP, Shani et al. (1997) and Holzinger et al. (1997) identified PXMP1L cDNAs. They respectively designated the gene P70R and PMP69. Shani et al. (1997) reported that the predicted 606-amino acid protein has the structure of an ABC half-transporter and shares 25 to 27% sequence identity with PMP70, ALDR, and ALDP. Antibodies against PXMP1L detected a 73-kD protein on Western blots. Immunofluorescence studies localized the protein to peroxisomes. Northern blot analysis revealed that PXMP1L was expressed as a 2.6-kb mRNA in all tissues examined. Holzinger et al. (1997) and Holzinger et al. (1998) found transcript variants resulting from alternative splicing and use of alternative polyadenylation sites. Holzinger et al. (1998) reported that the PXMP1L gene contains 19 exons and spans approximately 16 kb.

Full details of the abovementioned studies are described in the following publications, the disclosure of which are hereby incorporated by reference:

Holzinger, A.; Roscher, A. A.; Landgraf, P.; Lichtner, P.; Kammerer, S.: Genomic organization and chromosomal localization of the human peroxisomal membrane protein-1-like protein (PXMP1-L) gene encoding a peroxisomal ABC transporter. FEBS Lett. 426:238-242, 1998; and Shani, N.; Jimenez-Sanchez, G.; Steel, G.; Dean, M.; Valle, D.: Identification of a fourth half ABC transporter in the human peroxisomal membrane. Hum. Molec. Genet. 6:1925-1931, 1997.

Further studies establishing the function and utilities of ABCD4 are found in John Hopkins OMIM database record ID 603214, and in cited publications listed in Table 5, which are hereby incorporated by reference. Acyl-coenzyme a dehydrogenase family, member 8 (ACAD8, Accession NM_014384.1) is another GAM51 target gene, herein designated TARGET GENE. ACAD8 BINDING SITE is a target binding site found in the 3' untranslated region of mRNA encoded by ACAD8, corresponding to a target binding site such as BINDING SITE I, BINDING SITE II or BINDING SITE III of FIG. 8. Table 4 illustrates the complementarity of the nucleotide sequences of ACAD8 BINDING SITE, designated SEQ ID:1175, to the nucleotide sequence of GAM51 RNA, herein designated GAM RNA, also designated SEQ ID:201.

Another function of GAM51 is therefore inhibition of Acyl-coenzyme a dehydrogenase family, member 8 (ACAD8, Accession NM_014384.1), a gene which Member of the acyl-Coenzyme A dehydrogenase family; alpha,beta-dehydrogenates acyl-CoA esters. Accordingly, utilities of GAM51 include diagnosis, prevention and treatment of diseases and clinical conditions associated with ACAD8.

The function of ACAD8 has been established by previous studies. Acyl- coenzyme A (CoA) dehydrogenases (ACADs) are a family of mitochondrial enzymes that catalyze the first dehydrogenation step in the beta-oxidation of fatty acyl-CoA derivatives. Fatty acids provide important respiratory fuel for many tissues, including heart, skeletal muscle, brown adipose tissue, kidney, and liver, as is evident in individuals with defects in any 1 of the ACADs. The mitochondrial beta-oxidation pathway is a cycle of 4 sequential reactions in which the fatty acid substrate is shortened by 2 carbon atoms with each cycle, releasing an acetyl- CoA molecule that can then be used in the tricarboxylic acid cycle or for ketogenesis. Several human ACADs exist, including those involved in the initial step of mitochondrial beta-oxidation of straight chain fatty acids, such as short-chain ACAD (ACADS; 606885), medium-chain ACAD (ACADM; 607008), long-chain ACAD (ACADL; 201460), and very long-chain ACAD (ACADVL; 201475), and those involved in the degradation of amino acids, such as isovaleryl-CoA dehydrogenase (IVD; 243500), isobutyryl-CoA dehydrogenase, and glutaryl-CoA dehydrogenase (GCDH; 231670). All ACADs catalyze the same initial dehydrogenation of the substrate at the beta-carbon atom and require electron transfer flavoprotein as an electron acceptor. However, they differ distinctly from each other with regard to the length and configuration of the hydrocarbon chain of their respective substrates and have accordingly received appropriate names. ACADs are nuclear-encoded and are synthesized as precursor proteins in the cytosol with an N-terminal leader peptide, which is cleaved off on import to the mitochondria, producing a mature monomer. ACADs share sequence similarity. By constructing a transcript map of the HJCD (OMIM Ref. No. 602782) critical region in 11q25, together with searching the Unigene database, Telford et al. (1999) identified the ACAD8 gene. They isolated an ACAD8 cDNA containing a full-length coding sequence using RT-PCR on RNA from human adult brain and skin fibroblast. The predicted 415-amino acid ACAD8 protein contains many of the residues conserved in most other ACADs, including an active site glutamic acid residue and residues important for tetramer formation. Amino acid sequence identity between ACAD8 and other known ACADs range from 28% with GCDH to 38% with ACADS. Northern blot analysis detected an approximately 2.1-kb ACAD8 transcript in all tissues examined, namely heart, lung, brain, skeletal muscle, pancreas, placenta, liver, and kidney, although it was weakly expressed in the last 2 tissues. RT-PCR showed ACAD8 expression in human cochlea and the myeloid cell line KG-1. Andresen et al. (2000) showed that ACAD8 is an isobutyryl-CoA dehydrogenase and that both ACAD8 and ACADSB are imported in the mitochondria and form tetramers. ACAD8 is a mitochondrial enzyme that functions in valine catabolism.

Full details of the abovementioned studies are described in the following publications, the disclosure of which are hereby incorporated by reference:

Telford, E. A. R.; Moynihan, L. M.; Markham, A. F.; Lench, N. J.: Isolation and characterisation of a cDNA encoding the precursor for a novel member of the acyl-CoA dehydrogenase gene family. Biochim. Biophys. Acta 1446:371-376, 1999; and Andresen, B. S.; Christensen, E.; Corydon, T. J.; Bross, P.; Pilgaard, B.; Wanders, R. J. A.; Ruiter, J. P. N.; Simonsen, H.; Winter, V.; Knudsen, I.; Schroeder, L. D.; Gregersen, N.; S.

Further studies establishing the function and utilities of ACAD8 are found in John Hopkins OMIM database record ID 604773, and in cited publications listed in Table 5, which are hereby incorporated by reference. Acidic (leucine-rich) nuclear phosphoprotein 32 family, member a (ANP32A, Accession NM_006305.2) is another GAM51 target gene, herein designated TARGET GENE. ANP32A BINDING SITE is a target binding site found in the 3' untranslated region of mRNA encoded by ANP32A, corresponding to a target binding site such as BINDING SITE I, BINDING SITE II or BINDING SITE III of FIG. 8. Table 4 illustrates the complementarity of the nucleotide sequences of ANP32A BINDING SITE, designated SEQ ID:9401, to the nucleotide sequence of GAM51 RNA, herein designated GAM RNA, also designated SEQ ID:201.

Another function of GAM51 is therefore inhibition of Acidic (leucine-rich) nuclear phosphoprotein 32 family, member a (ANP32A, Accession NM_006305.2), a gene which may play a role in a signal transduction pathway that directs differentiation of cerebellar neurons. and therefore may be associated with Acute myeloid leukemia. Accordingly, utilities of GAM51 include diagnosis, prevention and treatment of Acute myeloid leukemia, and of other diseases and clinical conditions associated with ANP32A.

The function of ANP32A has been established by previous studies. Fink et al. (1995) mapped the PHAP1 gene to 15q22.3-q23 by fluorescence in situ hybridization. The similarities between PHAP I and SET suggested to the authors that the PHAP1 gene might also form a fusion protein with CAN. In the SET-CAN fusion gene, the breakpoint is located 3-prime of the SET gene, but the last exon of SET is removed in the fusion transcript. This exon encodes the last 7 amino acids (EDEGEDD) of SET that are identical with the end of PHAP I except that PHAP I carries an additional D (EDEGEDDD). The vast majority of cases in which CAN is involved in acute myeloid leukemia show a specificity for the t(6;9) translocation (Sandberg et al., 1983) that fuses the 3-prime part of the CAN gene on 9q34 (von Lindern et al., 1990) to almost the complete coding region of the DEK gene (OMIM Ref. No. 125264) on 6p23 (von Lindern et al., 1992). The translocation breakpoints always occur in intron icb- 9 of CAN. The PHAP1/CAN translocation would be expected to cause acute leukemia. Like DEK and SET, PHAP I contains an extended acidic region that could result in a transforming capacity. Mutation in ataxin-1 (ATX1; 601556) causes spinocerebellar ataxia (SCA1; 164400). Using a yeast 2-hybrid screen of a mouse brain cDNA library with mutant human ATX1 as bait, Matilla et al. (1997) isolated a mouse cDNA encoding Lanp, which is 89% identical to the human protein and is expressed in cerebellum and brainstem. Binding analysis indicated that the strongest interaction between the proteins is with the N-terminal 147 residues on Lanp, which contain 5 leucine-rich repeats, and a full-length ataxin-1 containing 82 glutamines. Immunohistochemical analysis demonstrated highest levels of Lanp, like Atx1, in the nuclei of cerebellar Purkinje cells Full details of the abovementioned studies are described in the following publications, the disclosure of which are hereby incorporated by reference:

Matilla, A.; Koshy, B. T.; Cummings, C. J.; Isobe, T.; Orr, H. T.; Zoghbi, H. Y.: The cerebellar leucine-rich acidic nuclear protein interacts with ataxin-1. Nature 389:974-978, 1997. Note: Erratum: Nature 391: 818 only, 1998; and Sandberg, A. A.; Morgan, R.; McCallister, J. A.; Kaiser-McCaw, B.; Hecht, F.: Acute myeloblastic leukemia (AML) with t(6;9)(p23;q34): a specific subgroup of AML? Cancer Genet. Cytogenet.

Further studies establishing the function and utilities of ANP32A are found in John Hopkins OMIM database record ID 600832, and in cited publications listed in Table 5, which are hereby incorporated by reference. Adaptor-related protein complex 4, sigma 1 subunit (AP4S1, Accession NM_007077.2) is another GAM51 target gene, herein designated TARGET GENE. AP4S1 BINDING SITE is a target binding site found in the 5' untranslated region of mRNA encoded by AP4S1, corresponding to a target binding site such as BINDING SITE I, BINDING SITE II or BINDING SITE III of FIG. 8. Table 4 illustrates the complementarity of the nucleotide sequences of AP4S1 BINDING SITE, designated SEQ ID:13777, to the nucleotide sequence of GAM51 RNA, herein designated GAM RNA, also designated SEQ ID:201.

Another function of GAM51 is therefore inhibition of Adaptor-related protein complex 4, sigma 1 subunit (AP4S1, Accession NM_007077.2). Accordingly, utilities of GAM51 include diagnosis, prevention and treatment of diseases and clinical conditions associated with AP4S1.

Aquaporin 6, kidney specific (AQP6, Accession NM_053286.1) is another GAM51 target gene, herein designated TARGET GENE. AQP6 BINDING SITE is a target binding site found in the 5' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:17661, to the nucleotide sequence of GAM51 RNA, herein designated GAM RNA, also designated SEQ ID:201.

Another function of GAM51 is therefore inhibition of Aquaporin 6, kidney specific (AQP6, Accession NM_053286.1), a gene which participates in distinct physiologic function such as glomerular filtration, tubular endocytosis, and acid-base-metabolism. Accordingly, utilities of GAM51 include diagnosis, prevention and treatment of diseases and clinical conditions associated with AQP6.

The function of AQP6 has been established by previous studies. Ma et al. (1997), who referred to this gene as aquaporin-6 (AQP6), demonstrated that, among the 7 human aquaporins cloned to that time (AQPs 0 to 6), the genes encoding the 4 most closely related aquaporins all mapped to 12q13: AQP0, AQP2, AQP5 (OMIM Ref. No. 600442), and AQP6. To construct a physical map and identify novel aquaporin gene members of this cluster, Ma et al. (1997) screened a human CEPH B YAC library by PCR using primers derived from exon 4 of the AQP2 and AQP0 genes. A YAC clone with 200 kb of human DNA was isolated an analyzed. Primary pulsed field gel electrophoresis and Southern blot analysis indicated the presence of AQP2, AQP5, and AQP6 genes, but not AQP0. Restriction mapping and PCR analysis yielded a precise physical map in which the 3 aquaporin genes spanned only approximately 27 kb with the order, transcription orientation, and spacer length as follows:5-prime-AQP2-5kb spacer-AQP5-7kb spacer-AQP6-3-prime. Yasui et al. (1999) showed that AQP6 is localized exclusively in intracellular membranes in renal epithelia. Sequential ultracentrifugation of rat kidney homogenates confirmed that AQP6 resides predominantly in vesicular fractions, and immunohistochemical and immunoelectron microscopic studies confirmed that more than 98% of AQP6 is located in intracellular membrane vesicles. In glomeruli, AQP6 is present in membrane vesicles within podocyte cell bodies and foot processes. In proximal tubules, AQP6 is also abundant in membrane vesicles within the subapical compartment of segment 2 and segment 3 cells, but was not detected in the brush border or basolateral membranes. In collecting duct, AQP6 resides in intracellular membrane vesicles in apical, mid, and basolateral cytoplasm of type A intercalated cells, but was not observed in the plasma membrane. Unlike other members of the AQP family, the unique distribution in intracellular membrane vesicles in multiple types of renal epithelia indicated that AQP6 is not simply involved in transcellular fluid absorption. These studies predicted that AQP6 participates in distinct physiologic function such as glomerular filtration, tubular endocytosis, and acid-base-metabolism.

Full details of the abovementioned studies are described in the following publications, the disclosure of which are hereby incorporated by reference:

Ma, T.; Yang, B.; Umenishi, F.; Verkman, A. S.: Closely spaced tandem arrangement of AQP2, AQP5, and AQP6 genes in a 27-kilobase segment at chromosome locus 12q13. Genomics 43:387-389, 1997; and Yasui, M.; Kwon, T.-H.; Knepper, M. A.; Nielsen, S.; Agre, P.: Aquaporin-6: an intracellular vesicle water channel protein in renal epithelia. Proc. Nat. Acad. Sci. 96:5808-5813, 1999.

Further studies establishing the function and utilities of AQP6 are found in John Hopkins OMIM database record ID 601383, and in cited publications listed in Table 5, which are hereby incorporated by reference. Atpase, na+/k+ transporting, alpha 2 (+) polypeptide (ATP1A2, Accession NM_000702.1) is another GAM51 target gene, herein designated TARGET GENE. ATP1A2 BINDING SITE is a target binding site found in the 3' untranslated region of mRNA encoded by ATP1A2, corresponding to a target binding site such as BINDING SITE I, BINDING SITE II or BINDING SITE III of FIG. 8. Table 4 illustrates the complementarity of the nucleotide sequences of ATP1A2 BINDING SITE, designated SEQ ID:15415, to the nucleotide sequence of GAM51 RNA, herein designated GAM RNA, also designated SEQ ID:201.

Another function of GAM51 is therefore inhibition of Atpase, na+/k+ transporting, alpha 2 (+) polypeptide (ATP1A2, Accession NM_000702.1). Accordingly, utilities of GAM51 include diagnosis, prevention and treatment of diseases and clinical conditions associated with ATP1A2.

Bone morphogenetic protein 1 (BMP1, Accession NM_006128.1) is another GAM51 target gene, herein designated TARGET GENE. BMP1 BINDING SITE is a target binding site found in the 3' untranslated region of multiple transcripts of mRNA encoded by BMP1, corresponding to a target binding site such as BINDING SITE I, BINDING SITE II or BINDING SITE III of FIG. 8. Table 4 illustrates the complementarity of the nucleotide sequences of BMP1 BINDING SITE, designated SEQ ID:4998, to the nucleotide sequence of GAM51 RNA, herein designated GAM RNA, also designated SEQ ID:201.

Another function of GAM51 is therefore inhibition of Bone morphogenetic protein 1 (BMP1, Accession NM_006128.1), a gene which cleaves procollagens leading to formation of extracellular matrix. Accordingly, utilities of GAM51 include diagnosis, prevention and treatment of diseases and clinical conditions associated with BMP1.

The function of BMP1 has been established by previous studies. The BMP1 locus encodes a protein that is capable of inducing formation of cartilage in vivo (Wozney et al., 1988). Although other bone morphogenetic proteins are members of the TGF-beta (OMIM Ref. No. 190180) superfamily, BMP1 encodes a novel protein that is not closely related to other known growth factors. Kessler et al. (1996) showed that recombinantly expressed BMP1 and purified procollagen C proteinase (PCP), a secreted metalloprotease requiring calcium and needed for cartilage and bone formation, are, in fact, identical. PCP cleaves the C-terminal propeptides of procollagen I (OMIM Ref. No. 120150), II (OMIM Ref. No. 120140), and III (OMIM Ref. No. 120180) and its activity is increased by the procollagen C- endopeptidase enhancer protein (OMIM Ref. No. 600270). Reddi (1996) discussed the significance of the finding that BMP1 is the same as procollagen C- proteinase.

Full details of the abovementioned studies are described in the following publications, the disclosure of which are hereby incorporated by reference:

Wozney, J. M.; Rosen, V.; Celeste, A. J.; Mitsock, L. M.; Whitters, M. J.; Kriz, R. W.; Hewick, R. M.; Wang, E. A.: Novel regulators of bone formation: molecular clones and activities. Science 242:1528-1534, 1988; and Kessler, E.; Takahara, K.; Biniaminov, L.; Brusel, M.; Greenspan, D.: Bone morphogenic protein-1: the type I procollagen C-proteinase. Science 271:360-362, 1996.

Further studies establishing the function and utilities of BMP1 are found in John Hopkins OMIM database record ID 112264, and in cited publications listed in Table 5, which are hereby incorporated by reference. Chromosome 14 open reading frame 1 (C14orf1, Accession NM_007176.1) is another GAM51 target gene, herein designated TARGET GENE. C14orf1 BINDING SITE is a target binding site found in the 3' untranslated region of mRNA encoded by C14orf1, corresponding to a target binding site such as BINDING SITE I, BINDING SITE II or BINDING SITE III of FIG. 8. Table 4 illustrates the complementarity of the nucleotide sequences of C14orf1 BINDING SITE, designated SEQ ID:19752, to the nucleotide sequence of GAM51 RNA, herein designated GAM RNA, also designated SEQ ID:201.

Another function of GAM51 is therefore inhibition of Chromosome 14 open reading frame 1 (C14orf1, Accession NM_007176.1). Accordingly, utilities of GAM51 include diagnosis, prevention and treatment of diseases and clinical conditions associated with C14orf1.

Chromosome 20 open reading frame 82 (C20orf82, Accession XM_097736.3) is another GAM51 target gene, herein designated TARGET GENE. C20orf82 BINDING SITE is a target binding site found in the 3' untranslated region of mRNA encoded by C20orf82, corresponding to a target binding site such as BINDING SITE I, BINDING SITE II or BINDING SITE III of FIG. 8. Table 4 illustrates the complementarity of the nucleotide sequences of C20orf82 BINDING SITE, designated SEQ ID:2115, to the nucleotide sequence of GAM51 RNA, herein designated GAM RNA, also designated SEQ ID:201.

Another function of GAM51 is therefore inhibition of Chromosome 20 open reading frame 82 (C20orf82, Accession XM_097736.3). Accordingly, utilities of GAM51 include diagnosis, prevention and treatment of diseases and clinical conditions associated with C20orf82.

Chemokine (c-c motif) receptor 5 (CCR5, Accession NM_000579.1) is another GAM51 target gene, herein designated TARGET GENE. CCR5 BINDING SITE is a target binding site found in the 3' untranslated region of mRNA encoded by CCR5, corresponding to a target binding site such as BINDING SITE I, BINDING SITE II or BINDING SITE III of FIG. 8. Table 4 illustrates the complementarity of the nucleotide sequences of CCR5 BINDING SITE, designated SEQ ID:15737, to the nucleotide sequence of GAM51 RNA, herein designated GAM RNA, also designated SEQ ID:201.

Another function of GAM51 is therefore inhibition of Chemokine (c-c motif) receptor 5 (CCR5, Accession NM_000579.1). Accordingly, utilities of GAM51 include diagnosis, prevention and treatment of diseases and clinical conditions associated with CCR5.

Centaurin, delta 2 (CENTD2, Accession NM_139181.1) is another GAM51 target gene, herein designated TARGET GENE. CENTD2 BINDING SITE is a target binding site found in the 3' untranslated region of multiple transcripts of mRNA encoded by CENTD2, corresponding to a target binding site such as BINDING SITE I, BINDING SITE II or BINDING SITE III of FIG. 8. Table 4 illustrates the complementarity of the nucleotide sequences of CENTD2 BINDING SITE, designated SEQ ID:11402, to the nucleotide sequence of GAM51 RNA, herein designated GAM RNA, also designated SEQ ID:201.

Another function of GAM51 is therefore inhibition of Centaurin, delta 2 (CENTD2, Accession NM_139181.1), a gene which involved in cell signaling/communication. Accordingly, utilities of GAM51 include diagnosis, prevention and treatment of diseases and clinical conditions associated with CENTD2.

The function of CENTD2 has been established by previous studies. Miura et al. (2002) examined ARAP1 as a possible link between phosphoinositide-, ARF-, and RHO-mediated cell signaling. In vitro, ARAP1 had RHO-GAP and phosphatidylinositol (3,4,5) trisphosphate (PIP3; OMIM Ref. No. 171834)-dependent ARF-GAP activity. ARAP1 associated with the Golgi. The RHO-GAP activity mediated cell rounding and loss of stress fibers when ARAP1 was overexpressed. The ARF-GAP activity mediated changes in the Golgi apparatus and the formation of filopodia, the latter a consequence of increased cellular activity of CDC42 (OMIM Ref. No. 116952). The ARF-GAP and RHO-GAP activities both contributed to inhibiting cell spreading. Thus, ARAP1 is a PIP3-dependent ARF-GAP that regulates ARF-, RHO-, and CDC42-dependent cell activities.

Full details of the abovementioned studies are described in the following publications, the disclosure of which are hereby incorporated by reference:

Miura, K.; Jacques, K. M.; Stauffer, S.; Kubosaki, A.; Zhu, K.; Hirsch, D. S.; Resau, J.; Zheng, Y.; Randazzo, P. A.: ARAP1: a point of convergence for Arf and Rho signaling. Molec. Cell 9:109-119, 2002; and Nagase, T.; Ishikawa, K.; Suyama, M.; Kikuno, R.; Miyajima, N.; Tanaka, A.; Kotani, H.; Nomura, N.; Ohara, O.: Prediction of the coding sequences of unidentified human genes. XI. The.

Further studies establishing the function and utilities of CENTD2 are found in John Hopkins OMIM database record ID 606646, and in cited publications listed in Table 5, which are hereby incorporated by reference. Corticotropin releasing hormone receptor 2 (CRHR2, Accession NM_001883.1) is another GAM51 target gene, herein designated TARGET GENE. CRHR2 BINDING SITE is a target binding site found in the 3' untranslated region of mRNA encoded by CRHR2, corresponding to a target binding site such as BINDING SITE I, BINDING SITE II or BINDING SITE III of FIG. 8. Table 4 illustrates the complementarity of the nucleotide sequences of CRHR2 BINDING SITE, designated SEQ ID:3504, to the nucleotide sequence of GAM51 RNA, herein designated GAM RNA, also designated SEQ ID:201.

Another function of GAM51 is therefore inhibition of Corticotropin releasing hormone receptor 2 (CRHR2, Accession NM_001883.1), a gene which is a corticotropin releasing factor receptor type II. and therefore may be associated with Anxiety. Accordingly, utilities of GAM51 include diagnosis, prevention and treatment of Anxiety, and of other diseases and clinical conditions associated with CRHR2.

The function of CRHR2 has been established by previous studies. Corticotropin-releasing hormone (CRH; 122560) is a 41-amino acid peptide synthesized in the hypothalamus. It is the principal neuroregulator of the hypothalamic- pituitary-adrenocortical axis and plays an important role in coordinating the endocrine, autonomic, and behavioral responses to stress and immune challenge. Liaw et al. (1996) stated that there are 2 G protein-coupled CRH receptors, CRHR1 (OMIM Ref. No. 122561) and CRHR2, which they termed the CRF2 receptor. The investigators used clones of the rat CRF2 receptor to isolate the human gene from brain and kidney genomic DNA libraries. The gene consists of 12 exons spanning approximately 30 kb. The predicted protein, which is 411 amino acids in length and 70% identical to the CRF1 receptor, contains a putative N-terminal secretory signal sequence and 7 putative transmembrane domains. Liaw et al. (1996) expressed the CRF2 receptor and found that transfected cells responded to the binding of CRH with an increase in intracellular cAMP. Although the rat receptor has 2 alternatively spliced variants, termed CRF2-alpha and CRF2-beta, Liaw et al. (1996) found no evidence for alternative splicing of the human receptor. Liaw et al. (1996) reported that the pharmacologic profile of this protein was similar to that of the rat CRF2-alpha protein but distinct from the human CRF1 receptor Kostich et al. (1998) reported a novel CRHR2 splice isoform, which they referred to as 'CRF2-gamma,' found in human brain. CRF2-gamma cDNA encodes a 397-amino acid receptor containing an amino terminus with no significant homology to the already reported alpha- and beta-termini. PCR and Southern blot analysis of CRF2-gamma RNA expression in human brain detected expression in the septum and hippocampus, with weaker but detectable expression in the amygdala, nucleus accumbens, midbrain, and frontal cortex.

Animal model experiments lend further support to the function of CRHR2. Kishimoto et al. (2000) generated mice deficient for Crhr2 by targeted disruption. They reported that male but not female Crhr2-deficient mice exhibited enhanced anxious behavior in several tests of anxiety in contrast to mice lacking Crhr1. The enhanced anxiety of Crhr2-deficient mice was not due to changes in hypothalamic-pituitary-adrenal axis activity, but rather reflected impaired responses in specific brain regions involved in emotional and autonomic functions, as monitored by a reduction in Creb phosphorylation in male, but not female, Crhr2 -/- mice. Kishimoto et al. (2000) proposed that CRHR1 predominantly mediates a central anxiolytic response, opposing the general anxiogenic effect of CRH mediated by CRHR1. Kishimoto et al. (2000) found that neither male nor female Crhr2-deficient mice showed alterations of baseline feeding behavior. Both responded with increased edema formation in response to thermal exposure, however, indicating that in contrast to its central role in anxiety, the peripheral role of CRHR2 in vascular permeability is independent of gender.

It is appreciated that the abovementioned animal model for CRHR2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kostich, W. A.; Chen, A.; Sperle, K.; Largent, B. L.: Molecular identification and analysis of a novel human corticotropin-releasing factor (CRF) receptor: the CRF2-gamma receptor. Molec. Endocr. 12:1077-1085, 1998; and Kishimoto, T.; Radulovic, J.; Radulovic, M.; Lin, C. R.; Schrick, C.; Hooshmand, F.; Hermanson, O.; Rosenfeld, M. G.; Spiess, J.: Deletion of Crhr2 reveals an anxiolytic role for cortic.

Further studies establishing the function and utilities of CRHR2 are found in John Hopkins OMIM database record ID 602034, and in cited publications listed in Table 5, which are hereby incorporated by reference. Cytochrome p450, subfamily ivf, polypeptide 2 (CYP4F2, Accession NM_001082.3) is another GAM51 target gene, herein designated TARGET GENE. CYP4F2 BINDING SITE is a target binding site found in the 3' untranslated region of mRNA encoded by CYP4F2, corresponding to a target binding site such as BINDING SITE I, BINDING SITE II or BINDING SITE III of FIG. 8. Table 4 illustrates the complementarity of the nucleotide sequences of CYP4F2 BINDING SITE, designated SEQ ID:7657, to the nucleotide sequence of GAM51 RNA, herein designated GAM RNA, also designated SEQ ID:201.

Another function of GAM51 is therefore inhibition of Cytochrome p450, subfamily ivf, polypeptide 2 (CYP4F2, Accession NM_001082.3). Accordingly, utilities of GAM51 include diagnosis, prevention and treatment of diseases and clinical conditions associated with CYP4F2.

DKFZp434M0331 (Accession NM_017600.1) is another GAM51 target gene, herein designated TARGET GENE. DKFZp434M0331 BINDING SITE is a target binding site found in the 3' untranslated region of mRNA encoded by DKFZp434M0331, corresponding to a target binding site such as BINDING SITE I, BINDING SITE II or BINDING SITE III of FIG. 8. Table 4 illustrates the complementarity of the nucleotide sequences of DKFZp434M0331 BINDING SITE, designated SEQ ID:2188, to the nucleotide sequence of GAM51 RNA, herein designated GAM RNA, also designated SEQ ID:201.

Another function of GAM51 is therefore inhibition of DKFZp434M0331 (Accession NM_017600.1). Accordingly, utilities of GAM51 include diagnosis, prevention and treatment of diseases and clinical conditions associated with DKFZp434M0331.

DKFZp761B0514 (Accession NM_032289.1) is another GAM51 target gene, herein designated TARGET GENE. DKFZp761B0514 BINDING SITE is a target binding site found in the 3' untranslated region of mRNA encoded by DKFZp761B0514, corresponding to a target binding site such as BINDING SITE I, BINDING SITE II or BINDING SITE III of FIG. 8. Table 4 illustrates the complementarity of the nucleotide sequences of DKFZp761B0514 BINDING SITE, designated SEQ ID:17559, to the nucleotide sequence of GAM51 RNA, herein designated GAM RNA, also designated SEQ ID:201.

Another function of GAM51 is therefore inhibition of DKFZp761B0514 (Accession NM_032289.1). Accordingly, utilities of GAM51 include diagnosis, prevention and treatment of diseases and clinical conditions associated with DKFZp761B0514.

Dentatorubral-pallidoluysian atrophy (atrophin-1) (DRPLA, Accession NM_001940.2) is another GAM51 target gene, herein designated TARGET GENE. DRPLA BINDING SITE is a target binding site found in the 3' untranslated region of mRNA encoded by DRPLA, corresponding to a target binding site such as BINDING SITE I, BINDING SITE II or BINDING SITE III of FIG. 8. Table 4 illustrates the complementarity of the nucleotide sequences of DRPLA BINDING SITE, designated SEQ ID:17538, to the nucleotide sequence of GAM51 RNA, herein designated GAM RNA, also designated SEQ ID:201.

Another function of GAM51 is therefore inhibition of Dentatorubral-pallidoluysian atrophy (atrophin-1) (DRPLA, Accession NM_001940.2). Accordingly, utilities of GAM51 include diagnosis, prevention and treatment of diseases and clinical conditions associated with DRPLA.

FLJ10450 (Accession NM_018095.2) is another GAM51 target gene, herein designated TARGET GENE. FLJ10450 BINDING SITE is a target binding site found in the 3' untranslated region of mRNA encoded by FLJ10450, corresponding to a target binding site such as BINDING SITE I, BINDING SITE II or BINDING SITE III of FIG. 8. Table 4 illustrates the complementarity of the nucleotide sequences of FLJ10450 BINDING SITE, designated SEQ ID:8966, to the nucleotide sequence of GAM51 RNA, herein designated GAM RNA, also designated SEQ ID:201.

Another function of GAM51 is therefore inhibition of FLJ10450 (Accession NM_018095.2). Accordingly, utilities of GAM51 include diagnosis, prevention and treatment of diseases and clinical conditions associated with FLJ10450.

FLJ13693 (Accession NM_024807.1) is another GAM51 target gene, herein designated TARGET GENE. FLJ13693 BINDING SITE is a target binding site found in the 3' untranslated region of mRNA encoded by FLJ13693, corresponding to a target binding site such as BINDING SITE I, BINDING SITE II or BINDING SITE III of FIG. 8. Table 4 illustrates the complementarity of the nucleotide sequences of FLJ13693 BINDING SITE, designated SEQ ID:8310, to the nucleotide sequence of GAM51 RNA, herein designated GAM RNA, also designated SEQ ID:201.

Another function of GAM51 is therefore inhibition of FLJ13693 (Accession NM_024807.1). Accordingly, utilities of GAM51 include diagnosis, prevention and treatment of diseases and clinical conditions associated with FLJ13693.

FLJ13940 (Accession) is another GAM51 target gene, herein designated TARGET GENE. FLJ13940 BINDING SITE is a target binding site found in the 3' untranslated region of mRNA encoded by FLJ13940, corresponding to a target binding site such as BINDING SITE I, BINDING SITE II or BINDING SITE III of FIG. 8. Table 4 illustrates the complementarity of the nucleotide sequences of FLJ13940 BINDING SITE, designated SEQ ID:4113, to the nucleotide sequence of GAM51 RNA, herein designated GAM RNA, also designated SEQ ID:201.

Another function of GAM51 is therefore inhibition of FLJ13940 (Accession). Accordingly, utilities of GAM51 include diagnosis, prevention and treatment of diseases and clinical conditions associated with FLJ13940.

FLJ14146 (Accession NM_024709.1) is another GAM51 target gene, herein designated TARGET GENE. FLJ14146 BINDING SITE is a target binding site found in the 3' untranslated region of mRNA encoded by FLJ14146, corresponding to a target binding site such as BINDING SITE I, BINDING SITE II or BINDING SITE III of FIG. 8. Table 4 illustrates the complementarity of the nucleotide sequences of FLJ14146 BINDING SITE, designated SEQ ID:14366, to the nucleotide sequence of GAM51 RNA, herein designated GAM RNA, also designated SEQ ID:201.

Another function of GAM51 is therefore inhibition of FLJ14146 (Accession NM_024709.1). Accordingly, utilities of GAM51 include diagnosis, prevention and treatment of diseases and clinical conditions associated with FLJ14146.

FLJ20508 (Accession NM_017850.1) is another GAM51 target gene, herein designated TARGET GENE. FLJ20508 BINDING SITE is a target binding site found in the 3' untranslated region of mRNA encoded by FLJ20508, corresponding to a target binding site such as BINDING SITE I, BINDING SITE II or BINDING SITE III of FIG. 8. Table 4 illustrates the complementarity of the nucleotide sequences of FLJ20508 BINDING SITE, designated SEQ ID:13954, to the nucleotide sequence of GAM51 RNA, herein designated GAM RNA, also designated SEQ ID:201.

Another function of GAM51 is therefore inhibition of FLJ20508 (Accession NM_017850.1). Accordingly, utilities of GAM51 include diagnosis, prevention and treatment of diseases and clinical conditions associated with FLJ20508.

FLJ25193 (Accession NM_144985.1) is another GAM51 target gene, herein designated TARGET GENE. FLJ25193 BINDING SITE is a target binding site found in the 3' untranslated region of mRNA encoded by FLJ25193, corresponding to a target binding site such as BINDING SITE I, BINDING SITE II or BINDING SITE III of FIG. 8. Table 4 illustrates the complementarity of the nucleotide sequences of FLJ25193 BINDING SITE, designated SEQ ID:11138, to the nucleotide sequence of GAM51 RNA, herein designated GAM RNA, also designated SEQ ID:201.

Another function of GAM51 is therefore inhibition of FLJ25193 (Accession NM_144985.1). Accordingly, utilities of GAM51 include diagnosis, prevention and treatment of diseases and clinical conditions associated with FLJ25193.

Gaba(a) receptor-associated protein like 1 (GABARAPL1, Accession NM_031412.1) is another GAM51 target gene, herein designated TARGET GENE. GABARAPL1 BINDING SITE is a target binding site found in the 3' untranslated region of mRNA encoded by GABARAPL1, corresponding to a target binding site such as BINDING SITE I, BINDING SITE II or BINDING SITE III of FIG. 8. Table 4 illustrates the complementarity of the nucleotide sequences of GABARAPL1 BINDING SITE, designated SEQ ID:11020, to the nucleotide sequence of GAM51 RNA, herein designated GAM RNA, also designated SEQ ID:201.

Another function of GAM51 is therefore inhibition of Gaba(a) receptor-associated protein like 1 (GABARAPL1, Accession NM_031412.1). Accordingly, utilities of GAM51 include diagnosis, prevention and treatment of diseases and clinical conditions associated with GABARAPL1.

Guanine nucleotide binding protein (g protein), beta polypeptide 2 (GNB2, Accession NM_005273.2) is another GAM51 target gene, herein designated TARGET GENE. GNB2 BINDING SITE is a target binding site found in the 3' untranslated region of mRNA encoded by GNB2, corresponding to a target binding site such as BINDING SITE I, BINDING SITE II or BINDING SITE III of FIG. 8. Table 4 illustrates the complementarity of the nucleotide sequences of GNB2 BINDING SITE, designated SEQ ID:818, to the nucleotide sequence of GAM51 RNA, herein designated GAM RNA, also designated SEQ ID:201.

Another function of GAM51 is therefore inhibition of Guanine nucleotide binding protein (g protein), beta polypeptide 2 (GNB2, Accession NM_005273.2). Accordingly, utilities of GAM51 include diagnosis, prevention and treatment of diseases and clinical conditions associated with GNB2.

HEMK (Accession NM_016173.1) is another GAM51 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:12563, to the nucleotide sequence of GAM51 RNA, herein designated GAM RNA, also designated SEQ ID:201.

Another function of GAM51 is therefore inhibition of HEMK (Accession NM_016173.1). Accordingly, utilities of GAM51 include diagnosis, prevention and treatment of diseases and clinical conditions associated with HEMK.

Human immunodeficiency virus type i enhancer binding protein 2 (HIVEP2, Accession NM_006734.2) is another GAM51 target gene, herein designated TARGET GENE. HIVEP2 BINDING SITE is a target binding site found in the 3' untranslated region of mRNA encoded by HIVEP2, corresponding to a target binding site such as BINDING SITE I, BINDING SITE II or BINDING SITE III of FIG. 8. Table 4 illustrates the complementarity of the nucleotide sequences of HIVEP2 BINDING SITE, designated SEQ ID:1152, to the nucleotide sequence of GAM51 RNA, herein designated GAM RNA, also designated SEQ ID:201.

Another function of GAM51 is therefore inhibition of Human immunodeficiency virus type i enhancer binding protein 2 (HIVEP2, Accession NM_006734.2). Accordingly, utilities of GAM51 include diagnosis, prevention and treatment of diseases and clinical conditions associated with HIVEP2.

HN1L (Accession NM_144570.1) is another GAM51 target gene, herein designated TARGET GENE. HN1L BINDING SITE is a target binding site found in the 3' untranslated region of mRNA encoded by HN1L, corresponding to a target binding site such as BINDING SITE I, BINDING SITE II or BINDING SITE III of FIG. 8. Table 4 illustrates the complementarity of the nucleotide sequences of HN1L BINDING SITE, designated SEQ ID:14161, to the nucleotide sequence of GAM51 RNA, herein designated GAM RNA, also designated SEQ ID:201.

Another function of GAM51 is therefore inhibition of HN1L (Accession NM_144570.1). Accordingly, utilities of GAM51 include diagnosis, prevention and treatment of diseases and clinical conditions associated with HN1L.

Heterogeneous nuclear ribonucleoprotein k (HNRPK, Accession NM_031262.1) is another GAM51 target gene, herein designated TARGET GENE. HNRPK BINDING SITE is a target binding site found in the 3' untranslated region of multiple transcripts of mRNA encoded by HNRPK, corresponding to a target binding site such as BINDING SITE I, BINDING SITE II or BINDING SITE III of FIG. 8. Table 4 illustrates the complementarity of the nucleotide sequences of HNRPK BINDING SITE, designated SEQ ID:19122, to the nucleotide sequence of GAM51 RNA, herein designated GAM RNA, also designated SEQ ID:201.

Another function of GAM51 is therefore inhibition of Heterogeneous nuclear ribonucleoprotein k (HNRPK, Accession NM_031262.1), a gene which play a role in the nuclear metabolism of hnrnas, particularly for pre-mrnas that contain cytidine-rich sequence. Accordingly, utilities of GAM51 include diagnosis, prevention and treatment of diseases and clinical conditions associated with HNRPK.

The function of HNRPK has been established by previous studies. The hnRNP-K family of acidic nuclear proteins have been identified using a monoclonal antibody that distinguishes between quiescent and proliferating human keratinocytes. The family, which is composed of at least 4 major proteins (e.g.:164017, 600124, 164020, and HNRPD) and their modified forms, is present in similar overall levels in quiescent and proliferating normal keratinocytes, although clear differences were observed in levels of some of the individual variants. Using a monoclonal antibody as a probe, Dejgaard et al. (1994) cloned a cDNA coding for type B hnRNP-K, and this was used to screen for additional family members. Sequencing of positive clones revealed 4 alternative splicing variants of a gene that mapped to chromosome 9 (by Southern blot analysis of human/rodent somatic cell hybrids). The hnRNP-K protein has been implicated in pre-mRNA metabolism of transcripts containing cytidine-rich sequences, and the results of Dejgaard et al. (1994) point toward a role in cell cycle progression. Tommerup and Leffers (1996) mapped HNRPNK to 9q21.32-q21.33 by fluorescence in situ hybridization.

Full details of the abovementioned studies are described in the following publications, the disclosure of which are hereby incorporated by reference:

Dejgaard, K.; Leffers, H.; Rasmussen, H. H.; Madsen, P.; Kruse, T. A.; Gesser, B.; Nielsen, H.; Celis, J. E.: Identification, molecular cloning, expression and chromosome mapping of a family of transformation upregulated hnRNP-K proteins derived by alternative splicing. J. Molec. Biol. 236: 33-48, 1994; and Tommerup, N.; Leffers, H.: Assignment of human KH-box-containing genes by in situ hybridization: HNRNPK maps to 9q21.32-q21.33, PCBP1 to 2p12-p13, and PCBP2 to 12q13.12-q13.13, distal to F.

Further studies establishing the function and utilities of HNRPK are found in John Hopkins OMIM database record ID 600712, and in cited publications listed in Table 5, which are hereby incorporated by reference. Homeo box d4 (HOXD4, Accession NM_014621.2) is another GAM51 target gene, herein designated TARGET GENE. HOXD4 BINDING SITE is a target binding site found in the 3' untranslated region of mRNA encoded by HOXD4, corresponding to a target binding site such as BINDING SITE I, BINDING SITE II or BINDING SITE III of FIG. 8. Table 4 illustrates the complementarity of the nucleotide sequences of HOXD4 BINDING SITE, designated SEQ ID:16160, to the nucleotide sequence of GAM51 RNA, herein designated GAM RNA, also designated SEQ ID:201.

Another function of GAM51 is therefore inhibition of Homeo box d4 (HOXD4, Accession NM_014621.2), a gene which is part of a developmental regulatory system. Accordingly, utilities of GAM51 include diagnosis, prevention and treatment of diseases and clinical conditions associated with HOXD4.

The function of HOXD4 has been established by previous studies. See HOXD3 (OMIM Ref. No. 142980). The homologous mouse gene was at first designated a Hox-5 gene. HOX4 genes, other than the one subsequently designated HOX4A, were initially considered to be members of a different cluster of genes called HOX5. Oliver et al. (1989) found by study of interspecific somatic cell hybrids that the cluster of so-called HOX5 genes map to human chromosome 2. By in situ hybridization, they found that the localization was 2q31-q32 with a peak of grains at 2q32.3. This gene is also called HOXD4, as a member of the HOXD gene cluster on 2q31. Mavilio et al. (1986) described the HOXD4 gene, but designated it homeo box X. Northern blot analysis detected multiple embryonic transcripts, which were differentially expressed in spinal cord, brain, backbone rudiments, limb buds, and heart in 5- to 9-week-old human embryos and fetuses in a striking organ- and stage-specific pattern. On the basis of these observations, Mavilio et al. (1986) suggested that in early mammalian development, homeo box genes may exert a wide spectrum of control functions in a variety of organs and body parts in addition to the spinal cord.

Full details of the abovementioned studies are described in the following publications, the disclosure of which are hereby incorporated by reference:

Mavilio, F.; Simeone, A.; Giampaolo, A.; Faiella, A.; Zappavigna, V.; Acampora, D.; Poiana, G.; Russo, G.; Peschle, C.; Boncinelli, E.: Differential and stage-related expression in embryonic tissues of a new human homoeobox gene. Nature 324:664-668, 1986; and Oliver, G.; Sidell, N.; Fiske, W.; Heinzmann, C.; Mohandas, T.; Sparkes, R. S.; De Robertis, E. M.: Complementary homeo protein gradients in developing limb buds. Genes Dev. 3:641-650.

Further studies establishing the function and utilities of HOXD4 are found in John Hopkins OMIM database record ID 142981, and in cited publications listed in Table 5, which are hereby incorporated by reference. HPIP (Accession NM_020524.2) is another GAM51 target gene, herein designated TARGET GENE. HPIP BINDING SITE is a target binding site found in the 3' untranslated region of mRNA encoded by HPIP, corresponding to a target binding site such as BINDING SITE I, BINDING SITE II or BINDING SITE III of FIG. 8. Table 4 illustrates the complementarity of the nucleotide sequences of HPIP BINDING SITE, designated SEQ ID:13420, to the nucleotide sequence of GAM51 RNA, herein designated GAM RNA, also designated SEQ ID:201.

Another function of GAM51 is therefore inhibition of HPIP (Accession NM_020524.2). Accordingly, utilities of GAM51 include diagnosis, prevention and treatment of diseases and clinical conditions associated with HPIP.

Integrin, alpha m (complement component receptor 3, alpha; also known as cd11b (p170), macrophage antigen alpha polypeptide) (ITGAM, Accession NM_000632.2) is another GAM51 target gene, herein designated TARGET GENE. ITGAM BINDING SITE is a target binding site found in the 3' untranslated region of mRNA encoded by ITGAM, corresponding to a target binding site such as BINDING SITE I, BINDING SITE II or BINDING SITE III of FIG. 8. Table 4 illustrates the complementarity of the nucleotide sequences of ITGAM BINDING SITE, designated SEQ ID:2813, to the nucleotide sequence of GAM51 RNA, herein designated GAM RNA, also designated SEQ ID:201.

Another function of GAM51 is therefore inhibition of Integrin, alpha m (complement component receptor 3, alpha; also known as cd11b (p170), macrophage antigen alpha polypeptide) (ITGAM, Accession NM_000632.2), a gene which is invovled in various adhesive interactions of monocytes, macrophages and granulocytes as well as in mediating the uptake of complement-coated particles. Accordingly, utilities of GAM51 include diagnosis, prevention and treatment of diseases and clinical conditions associated with ITGAM.

The function of ITGAM has been established by previous studies. A major surface antigen family on human leukocytes includes complement receptor type 3 (CR3A; also called integrin alpha-M, Mac1 or Mo1), lymphocyte function- associated antigen type 1 (LFA-1; 153370), and p150,95 (Leu M5; 151510). These antigens share a common beta chain (OMIM Ref. No. 116920) of 94 kD, linked noncovalently to 1 of 3 alpha chains distinctive to each. They promote adhesion of granulocytes to each other and to endothelial cell monolayers. The apparent molecular weight of the Mo1 alpha chain is 155 to 165 kD, that of the LFA1 alpha subunit is 180 kD, and that of the Leu M5 subunit is 130 to 150 kD. Pierce et al. (1986) purified human Mo1 to homogeneity from normal granulocytes by affinity chromatography and high performance liquid chromatography (HPLC) and determined the N-terminal amino acid sequence of its alpha subunit. The obtained sequence was identical, except for 2 conservative substitutions, to that of the alpha subunit of Mac1 antigen (Springer et al., 1985). Furthermore, Pierce et al. (1986) found that the N-terminal amino acid sequence of the alpha subunit of Mo1 was homologous to the alpha subunit of IIb/IIIa, a glycoprotein that serves similar adhesive functions on platelets and is deficient or defective in Glanzmann thrombasthenia (OMIM Ref. No. 273800). Patients with a history of recurrent bacterial infections and an inherited deficiency of all 3 leukocyte membrane surface antigens are thought to have reduced or absent synthesis of the common beta subunit of the antigen family; see 116920. By Southern analysis of DNA from hamster-human hybrids, Arnaout et al. (1988) localized the human MO1A gene to chromosome 16, which has been shown to contain the gene LFA1A (OMIM Ref. No. 153370). By in situ hybridization, Corbi et al. (1988) demonstrated that the alpha subunits of LFA-1, Mac1, and p150,95 constitute a cluster that might be called leukocyte adhesion, alpha, cluster (LAAC) located on 16p13.1-p11. Callen et al. (1991) narrowed the assignment to 16p11.2. Inflammation plays an essential role in the initiation and progression of atherosclerosis. Simon et al. (2000) presented evidence that it also has a role in vascular repair after mechanical arterial injury (i.e., percutaneous transluminal coronary angioplasty, or PTCA). In animal models of vascular injury, leukocytes are recruited as a precursor to intimal thickening. Markers of leukocyte activation, in particular, increased expression of Mac1, which is responsible for firm leukocyte adhesion to platelets and fibrinogen on denuded vessels, predict restenosis after PTCA. To determine whether Mac1-mediated leukocyte recruitment is causally related to neointimal formation, Simon et al. (2000) subjected Mac1 knockout mice to a mechanical carotid artery dilation and complete endothelial denudation. They found that the selective absence of Mac1 impaired transplatelet leukocyte migration into the vessel wall, reducing leukocyte accumulation. Diminished medial leukocyte accumulation was accompanied by markedly reduced neointimal thickening after vascular injury. These data established a role for inflammation in neointimal thickening and suggested that leukocyte recruitment to mechanically injured arteries may prevent restenosis Full details of the abovementioned studies are described in the following publications, the disclosure of which are hereby incorporated by reference:

Pierce, M. W.; Remold-O'Donnell, E.; Todd, R. F., III; Arnaout, M. A.: N-terminal sequence of human leukocyte glycoprotein Mo1: conservation across species and homology to platelet IIb/IIIa. Biochim. Biophys. Acta 874:368-371, 1986; and Arnaout, M. A.; Remold-O'Donnell, E.; Pierce, M. W.; Harris, P.; Tenen, D. G.: Molecular cloning of the alpha-subunit of human and guinea pig leukocyte adhesion glycoprotein Mo1: chromo.

Further studies establishing the function and utilities of ITGAM are found in John Hopkins OMIM database record ID 120980, and in cited publications listed in Table 5, which are hereby incorporated by reference. Jerky homolog-like (mouse) (JRKL, Accession NM_003772.2) is another GAM51 target gene, herein designated TARGET GENE. JRKL BINDING SITE is a target binding site found in the 3' untranslated region of mRNA encoded by JRKL, corresponding to a target binding site such as BINDING SITE I, BINDING SITE II or BINDING SITE III of FIG. 8. Table 4 illustrates the complementarity of the nucleotide sequences of JRKL BINDING SITE, designated SEQ ID:8555, to the nucleotide sequence of GAM51 RNA, herein designated GAM RNA, also designated SEQ ID:201.

Another function of GAM51 is therefore inhibition of Jerky homolog-like (mouse) (JRKL, Accession NM_003772.2), a gene which is a Jerky-related protein and similar to centromere binding protein-B and other nuclear regulators and therefore may be associated with Seizures. Accordingly, utilities of GAM51 include diagnosis, prevention and treatment of Seizures, and of other diseases and clinical conditions associated with JRKL.

The function of JRKL has been established by previous studies. Toth et al. (1995) found that inactivation of the mouse 'jerky' gene results in epileptic seizures. See 603210. Zeng et al. (1997) identified a human tonsil cDNA encoding a protein similar to jerky. They designated the predicted 442-amino acid protein HHMJG (human homolog of mouse jerky gene). The HHMJG and mouse jerky proteins are 35% identical. Northern blot analysis revealed that HHMJG is abundantly expressed as a 4-kb mRNA in various tissues. In testis, an additional 2-kb transcript is present. By fluorescence in situ hybridization, Zeng et al. (1997) mapped the HHMJG gene to 11q21.

Full details of the abovementioned studies are described in the following publications, the disclosure of which are hereby incorporated by reference:

Toth, M.; Grimsby, J.; Buzsaki, G.; Donovan, G. P.: Epileptic seizures caused by inactivation of a novel gene, jerky, related to centromere binding protein-B in transgenic mice. Nature Genet. 11:71-75, 1995. Note: Erratum: Nature Genet. 12:110 only, 1996; and Zeng, Z.; Kyaw, H.; Gakenheimer, K. R.; Augustus, M.; Fan, P.; Zhang, X.; Su, K.; Carter, K. C.; Li, Y.: Cloning, mapping, and tissue distribution of a human homologue of the mouse jerk.

Further studies establishing the function and utilities of JRKL are found in John Hopkins OMIM database record ID 603211, and in cited publications listed in Table 5, which are hereby incorporated by reference. KIAA0010 (Accession NM_014671.1) is another GAM51 target gene, herein designated TARGET GENE. KIAA0010 BINDING SITE is a target binding site found in the 3' untranslated region of mRNA encoded by KIAA0010, corresponding to a target binding site such as BINDING SITE I, BINDING SITE II or BINDING SITE III of FIG. 8. Table 4 illustrates the complementarity of the nucleotide sequences of KIAA0010 BINDING SITE, designated SEQ ID:10549, to the nucleotide sequence of GAM51 RNA, herein designated GAM RNA, also designated SEQ ID:201.

Another function of GAM51 is therefore inhibition of KIAA0010 (Accession NM_014671.1). Accordingly, utilities of GAM51 include diagnosis, prevention and treatment of diseases and clinical conditions associated with KIAA0010.

KIAA0427 (Accession NM_014772.1) is another GAM51 target gene, herein designated TARGET GENE. KIAA0427 BINDING SITE is a target binding site found in the 3' untranslated region of mRNA encoded by KIAA0427, corresponding to a target binding site such as BINDING SITE I, BINDING SITE II or BINDING SITE III of FIG. 8. Table 4 illustrates the complementarity of the nucleotide sequences of KIAA0427 BINDING SITE, designated SEQ ID:20045, to the nucleotide sequence of GAM51 RNA, herein designated GAM RNA, also designated SEQ ID:201.

Another function of GAM51 is therefore inhibition of KIAA0427 (Accession NM_014772.1). Accordingly, utilities of GAM51 include diagnosis, prevention and treatment of diseases and clinical conditions associated with KIAA0427.

KIAA0445 (Accession NM_014675.1) is another GAM51 target gene, herein designated TARGET GENE. KIAA0445 BINDING SITE is a target binding site found in the 3' untranslated region of mRNA encoded by KIAA0445, corresponding to a target binding site such as BINDING SITE I, BINDING SITE II or BINDING SITE III of FIG. 8. Table 4 illustrates the complementarity of the nucleotide sequences of KIAA0445 BINDING SITE, designated SEQ ID:15553, to the nucleotide sequence of GAM51 RNA, herein designated GAM RNA, also designated SEQ ID:201.

Another function of GAM51 is therefore inhibition of KIAA0445 (Accession NM_014675.1). Accordingly, utilities of GAM51 include diagnosis, prevention and treatment of diseases and clinical conditions associated with KIAA0445.

KIAA0775 (Accession) is another GAM51 target gene, herein designated TARGET GENE. KIAA0775 BINDING SITE is a target binding site found in the 5' untranslated region of mRNA encoded by KIAA0775, corresponding to a target binding site such as BINDING SITE I, BINDING SITE II or BINDING SITE III of FIG. 8. Table 4 illustrates the complementarity of the nucleotide sequences of KIAA0775 BINDING SITE, designated SEQ ID:17868, to the nucleotide sequence of GAM51 RNA, herein designated GAM RNA, also designated SEQ ID:201.

Another function of GAM51 is therefore inhibition of KIAA0775 (Accession). Accordingly, utilities of GAM51 include diagnosis, prevention and treatment of diseases and clinical conditions associated with KIAA0775.

KIAA1374 (Accession XM_028413.6) is another GAM51 target gene, herein designated TARGET GENE. KIAA1374 BINDING SITE is a target binding site found in the 3' untranslated region of mRNA encoded by KIAA1374, corresponding to a target binding site such as BINDING SITE I, BINDING SITE II or BINDING SITE III of FIG. 8. Table 4 illustrates the complementarity of the nucleotide sequences of KIAA1374 BINDING SITE, designated SEQ ID:15843, to the nucleotide sequence of GAM51 RNA, herein designated GAM RNA, also designated SEQ ID:201.

Another function of GAM51 is therefore inhibition of KIAA1374 (Accession XM_028413.6). Accordingly, utilities of GAM51 include diagnosis, prevention and treatment of diseases and clinical conditions associated with KIAA1374.

KIAA1500 (Accession) is another GAM51 target gene, herein designated TARGET GENE. KIAA1500 BINDING SITE is a target binding site found in the 3' untranslated region of mRNA encoded by KIAA1500, corresponding to a target binding site such as BINDING SITE I, BINDING SITE II or BINDING SITE III of FIG. 8. Table 4 illustrates the complementarity of the nucleotide sequences of KIAA1500 BINDING SITE, designated SEQ ID:16249, to the nucleotide sequence of GAM51 RNA, herein designated GAM RNA, also designated SEQ ID:201.

Another function of GAM51 is therefore inhibition of KIAA1500 (Accession). Accordingly, utilities of GAM51 include diagnosis, prevention and treatment of diseases and clinical conditions associated with KIAA1500.

KIAA1573 (Accession XM_031545.5) is another GAM51 target gene, herein designated TARGET GENE. KIAA1573 BINDING SITE is a target binding site found in the 3' untranslated region of mRNA encoded by KIAA1573, corresponding to a target binding site such as BINDING SITE I, BINDING SITE II or BINDING SITE III of FIG. 8. Table 4 illustrates the complementarity of the nucleotide sequences of KIAA1573 BINDING SITE, designated SEQ ID:4415, to the nucleotide sequence of GAM51 RNA, herein designated GAM RNA, also designated SEQ ID:201.

Another function of GAM51 is therefore inhibition of KIAA1573 (Accession XM_031545.5). Accordingly, utilities of GAM51 include diagnosis, prevention and treatment of diseases and clinical conditions associated with KIAA1573.

KIAA1649 (Accession) is another GAM51 target gene, herein designated TARGET GENE. KIAA1649 BINDING SITE is a target binding site found in the 5' untranslated region of mRNA encoded by KIAA1649, corresponding to a target binding site such as BINDING SITE I, BINDING SITE II or BINDING SITE III of FIG. 8. Table 4 illustrates the complementarity of the nucleotide sequences of KIAA1649 BINDING SITE, designated SEQ ID:819, to the nucleotide sequence of GAM51 RNA, herein designated GAM RNA, also designated SEQ ID:201.

Another function of GAM51 is therefore inhibition of KIAA1649 (Accession). Accordingly, utilities of GAM51 include diagnosis, prevention and treatment of diseases and clinical conditions associated with KIAA1649.

LOC131583 (Accession) is another GAM51 target gene, herein designated TARGET GENE. LOC131583 BINDING SITE is a target binding site found in the 3' untranslated region of mRNA encoded by LOC131583, corresponding to a target binding site such as BINDING SITE I, BINDING SITE II or BINDING SITE III of FIG. 8. Table 4 illustrates the complementarity of the nucleotide sequences of LOC131583 BINDING SITE, designated SEQ ID:4254, to the nucleotide sequence of GAM51 RNA, herein designated GAM RNA, also designated SEQ ID:201.

Another function of GAM51 is therefore inhibition of LOC131583 (Accession). Accordingly, utilities of GAM51 include diagnosis, prevention and treatment of diseases and clinical conditions associated with LOC131583.

LOC145951 (Accession) is another GAM51 target gene, herein designated TARGET GENE. LOC145951 BINDING SITE is a target binding site found in the 3' untranslated region of mRNA encoded by LOC145951, corresponding to a target binding site such as BINDING SITE I, BINDING SITE II or BINDING SITE III of FIG. 8. Table 4 illustrates the complementarity of the nucleotide sequences of LOC145951 BINDING SITE, designated SEQ ID:16078, to the nucleotide sequence of GAM51 RNA, herein designated GAM RNA, also designated SEQ ID:201.

Another function of GAM51 is therefore inhibition of LOC145951 (Accession). Accordingly, utilities of GAM51 include diagnosis, prevention and treatment of diseases and clinical conditions associated with LOC145951.

LOC145990 (Accession XM_085289.4) is another GAM51 target gene, herein designated TARGET GENE. LOC145990 BINDING SITE is a target binding site found in the 3' untranslated region of mRNA encoded by LOC145990, corresponding to a target binding site such as BINDING SITE I, BINDING SITE II or BINDING SITE III of FIG. 8. Table 4 illustrates the complementarity of the nucleotide sequences of LOC145990 BINDING SITE, designated SEQ ID:14131, to the nucleotide sequence of GAM51 RNA, herein designated GAM RNA, also designated SEQ ID:201.

Another function of GAM51 is therefore inhibition of LOC145990 (Accession XM_085289.4). Accordingly, utilities of GAM51 include diagnosis, prevention and treatment of diseases and clinical conditions associated with LOC145990.

LOC146108 (Accession) is another GAM51 target gene, herein designated TARGET GENE. LOC146108 BINDING SITE is a target binding site found in the 3' untranslated region of mRNA encoded by LOC146108, corresponding to a target binding site such as BINDING SITE I, BINDING SITE II or BINDING SITE III of FIG. 8. Table 4 illustrates the complementarity of the nucleotide sequences of LOC146108 BINDING SITE, designated SEQ ID:13023, to the nucleotide sequence of GAM51 RNA, herein designated GAM RNA, also designated SEQ ID:201.

Another function of GAM51 is therefore inhibition of LOC146108 (Accession). Accordingly, utilities of GAM51 include diagnosis, prevention and treatment of diseases and clinical conditions associated with LOC146108.

LOC147229 (Accession XM_085742.2) is another GAM51 target gene, herein designated TARGET GENE. LOC147229 BINDING SITE is a target binding site found in the 5' untranslated region of mRNA encoded by LOC147229, corresponding to a target binding site such as BINDING SITE I, BINDING SITE II or BINDING SITE III of FIG. 8. Table 4 illustrates the complementarity of the nucleotide sequences of LOC147229 BINDING SITE, designated SEQ ID:12528, to the nucleotide sequence of GAM51 RNA, herein designated GAM RNA, also designated SEQ ID:201.

Another function of GAM51 is therefore inhibition of LOC147229 (Accession XM_085742.2). Accordingly, utilities of GAM51 include diagnosis, prevention and treatment of diseases and clinical conditions associated with LOC147229.

LOC149386 (Accession XM_097631.1) is another GAM51 target gene, herein designated TARGET GENE. LOC149386 BINDING SITE is a target binding site found in the 5' untranslated region of mRNA encoded by LOC149386, corresponding to a target binding site such as BINDING SITE I, BINDING SITE II or BINDING SITE III of FIG. 8. Table 4 illustrates the complementarity of the nucleotide sequences of LOC149386 BINDING SITE, designated SEQ ID:4322, to the nucleotide sequence of GAM51 RNA, herein designated GAM RNA, also designated SEQ ID:201.

Another function of GAM51 is therefore inhibition of LOC149386 (Accession XM_097631.1). Accordingly, utilities of GAM51 include diagnosis, prevention and treatment of diseases and clinical conditions associated with LOC149386.

LOC151040 (Accession) is another GAM51 target gene, herein designated TARGET GENE. LOC151040 BINDING SITE is a target binding site found in the 3' untranslated region of mRNA encoded by LOC151040, corresponding to a target binding site such as BINDING SITE I, BINDING SITE II or BINDING SITE III of FIG. 8. Table 4 illustrates the complementarity of the nucleotide sequences of LOC151040 BINDING SITE, designated SEQ ID:16461, to the nucleotide sequence of GAM51 RNA, herein designated GAM RNA, also designated SEQ ID:201.

Another function of GAM51 is therefore inhibition of LOC151040 (Accession). Accordingly, utilities of GAM51 include diagnosis, prevention and treatment of diseases and clinical conditions associated with LOC151040.

LOC151438 (Accession XM_098060.1) is another GAM51 target gene, herein designated TARGET GENE. LOC151438 BINDING SITE is a target binding site found in the 5' untranslated region of mRNA encoded by LOC151438, corresponding to a target binding site such as BINDING SITE I, BINDING SITE II or BINDING SITE III of FIG. 8. Table 4 illustrates the complementarity of the nucleotide sequences of LOC151438 BINDING SITE, designated SEQ ID:5376, to the nucleotide sequence of GAM51 RNA, herein designated GAM RNA, also designated SEQ ID:201.

Another function of GAM51 is therefore inhibition of LOC151438 (Accession XM_098060.1). Accordingly, utilities of GAM51 include diagnosis, prevention and treatment of diseases and clinical conditions associated with LOC151438.

LOC158402 (Accession XM_098936.1) is another GAM51 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:10627, to the nucleotide sequence of GAM51 RNA, herein designated GAM RNA, also designated SEQ ID:201.

Another function of GAM51 is therefore inhibition of LOC158402 (Accession XM_098936.1). Accordingly, utilities of GAM51 include diagnosis, prevention and treatment of diseases and clinical conditions associated with LOC158402.

LOC162461 (Accession) is another GAM51 target gene, herein designated TARGET GENE. LOC162461 BINDING SITE is a target binding site found in the 3' untranslated region of mRNA encoded by LOC162461, corresponding to a target binding site such as BINDING SITE I, BINDING SITE II or BINDING SITE III of FIG. 8. Table 4 illustrates the complementarity of the nucleotide sequences of LOC162461 BINDING SITE, designated SEQ ID:4357, to the nucleotide sequence of GAM51 RNA, herein designated GAM RNA, also designated SEQ ID:201.

Another function of GAM51 is therefore inhibition of LOC162461 (Accession). Accordingly, utilities of GAM51 include diagnosis, prevention and treatment of diseases and clinical conditions associated with LOC162461.

LOC200220 (Accession XM_114157.1) is another GAM51 target gene, herein designated TARGET GENE. LOC200220 BINDING SITE is a target binding site found in the 3' untranslated region of mRNA encoded by LOC200220, corresponding to a target binding site such as BINDING SITE I, BINDING SITE II or BINDING SITE III of FIG. 8. Table 4 illustrates the complementarity of the nucleotide sequences of LOC200220 BINDING SITE, designated SEQ ID:14994, to the nucleotide sequence of GAM51 RNA, herein designated GAM RNA, also designated SEQ ID:201.

Another function of GAM51 is therefore inhibition of LOC200220 (Accession XM_114157.1). Accordingly, utilities of GAM51 include diagnosis, prevention and treatment of diseases and clinical conditions associated with LOC200220.

LOC220431 (Accession) is another GAM51 target gene, herein designated TARGET GENE. LOC220431 BINDING SITE is a target binding site found in the 5' untranslated region of mRNA encoded by LOC220431, corresponding to a target binding site such as BINDING SITE I, BINDING SITE II or BINDING SITE III of FIG. 8. Table 4 illustrates the complementarity of the nucleotide sequences of LOC220431 BINDING SITE, designated SEQ ID:7875, to the nucleotide sequence of GAM51 RNA, herein designated GAM RNA, also designated SEQ ID:201.

Another function of GAM51 is therefore inhibition of LOC220431 (Accession). Accordingly, utilities of GAM51 include diagnosis, prevention and treatment of diseases and clinical conditions associated with LOC220431.

LOC255189 (Accession XM_172929.2) is another GAM51 target gene, herein designated TARGET GENE. LOC255189 BINDING SITE is a target binding site found in the 5' untranslated region of mRNA encoded by LOC255189, corresponding to a target binding site such as BINDING SITE I, BINDING SITE II or BINDING SITE III of FIG. 8. Table 4 illustrates the complementarity of the nucleotide sequences of LOC255189 BINDING SITE, designated SEQ ID:6202, to the nucleotide sequence of GAM51 RNA, herein designated GAM RNA, also designated SEQ ID:201.

Another function of GAM51 is therefore inhibition of LOC255189 (Accession XM_172929.2). Accordingly, utilities of GAM51 include diagnosis, prevention and treatment of diseases and clinical conditions associated with LOC255189.

LOC255650 (Accession) is another GAM51 target gene, herein designated TARGET GENE. LOC255650 BINDING SITE is a target binding site found in the 3' untranslated region of mRNA encoded by LOC255650, corresponding to a target binding site such as BINDING SITE I, BINDING SITE II or BINDING SITE III of FIG. 8. Table 4 illustrates the complementarity of the nucleotide sequences of LOC255650 BINDING SITE, designated SEQ ID:16025, to the nucleotide sequence of GAM51 RNA, herein designated GAM RNA, also designated SEQ ID:201.

Another function of GAM51 is therefore inhibition of LOC255650 (Accession). Accordingly, utilities of GAM51 include diagnosis, prevention and treatment of diseases and clinical conditions associated with LOC255650.

LOC256158 (Accession) is another GAM51 target gene, herein designated TARGET GENE. LOC256158 BINDING SITE is a target binding site found in the 5' untranslated region of mRNA encoded by LOC256158, corresponding to a target binding site such as BINDING SITE I, BINDING SITE II or BINDING SITE III of FIG. 8. Table 4 illustrates the complementarity of the nucleotide sequences of LOC256158 BINDING SITE, designated SEQ ID:5147, to the nucleotide sequence of GAM51 RNA, herein designated GAM RNA, also designated SEQ ID:201.

Another function of GAM51 is therefore inhibition of LOC256158 (Accession). Accordingly, utilities of GAM51 include diagnosis, prevention and treatment of diseases and clinical conditions associated with LOC256158.

LOC256536 (Accession NM_174937.1) is another GAM51 target gene, herein designated TARGET GENE. LOC256536 BINDING SITE is a target binding site found in the 3' untranslated region of mRNA encoded by LOC256536, corresponding to a target binding site such as BINDING SITE I, BINDING SITE II or BINDING SITE III of FIG. 8. Table 4 illustrates the complementarity of the nucleotide sequences of LOC256536 BINDING SITE, designated SEQ ID:410, to the nucleotide sequence of GAM51 RNA, herein designated GAM RNA, also designated SEQ ID:201.

Another function of GAM51 is therefore inhibition of LOC256536 (Accession NM_174937.1). Accordingly, utilities of GAM51 include diagnosis, prevention and treatment of diseases and clinical conditions associated with LOC256536.

LOC256733 (Accession) is another GAM51 target gene, herein designated TARGET GENE. LOC256733 BINDING SITE is a target binding site found in the 5' untranslated region of mRNA encoded by LOC256733, corresponding to a target binding site such as BINDING SITE I, BINDING SITE II or BINDING SITE III of FIG. 8. Table 4 illustrates the complementarity of the nucleotide sequences of LOC256733 BINDING SITE, designated SEQ ID:18655, to the nucleotide sequence of GAM51 RNA, herein designated GAM RNA, also designated SEQ ID:201.

Another function of GAM51 is therefore inhibition of LOC256733 (Accession). Accordingly, utilities of GAM51 include diagnosis, prevention and treatment of diseases and clinical conditions associated with LOC256733.

LOC91133 (Accession) is another GAM51 target gene, herein designated TARGET GENE. LOC91133 BINDING SITE is a target binding site found in the 3' untranslated region of mRNA encoded by LOC91133, corresponding to a target binding site such as BINDING SITE I, BINDING SITE II or BINDING SITE III of FIG. 8. Table 4 illustrates the complementarity of the nucleotide sequences of LOC91133 BINDING SITE, designated SEQ ID:2831, to the nucleotide sequence of GAM51 RNA, herein designated GAM RNA, also designated SEQ ID:201.

Another function of GAM51 is therefore inhibition of LOC91133 (Accession). Accordingly, utilities of GAM51 include diagnosis, prevention and treatment of diseases and clinical conditions associated with LOC91133.

LOC91351 (Accession) is another GAM51 target gene, herein designated TARGET GENE. LOC91351 BINDING SITE is a target binding site found in the 3' untranslated region of mRNA encoded by LOC91351, corresponding to a target binding site such as BINDING SITE I, BINDING SITE II or BINDING SITE III of FIG. 8. Table 4 illustrates the complementarity of the nucleotide sequences of LOC91351 BINDING SITE, designated SEQ ID:9849, to the nucleotide sequence of GAM51 RNA, herein designated GAM RNA, also designated SEQ ID:201.

Another function of GAM51 is therefore inhibition of LOC91351 (Accession). Accordingly, utilities of GAM51 include diagnosis, prevention and treatment of diseases and clinical conditions associated with LOC91351.

Lymphotoxin alpha (tnf superfamily, member 1) (LTA, Accession NM_000595.2) is another GAM51 target gene, herein designated TARGET GENE. LTA BINDING SITE is a target binding site found in the 3' untranslated region of mRNA encoded by LTA, corresponding to a target binding site such as BINDING SITE I, BINDING SITE II or BINDING SITE III of FIG. 8. Table 4 illustrates the complementarity of the nucleotide sequences of LTA BINDING SITE, designated SEQ ID:19202, to the nucleotide sequence of GAM51 RNA, herein designated GAM RNA, also designated SEQ ID:201.

Another function of GAM51 is therefore inhibition of Lymphotoxin alpha (tnf superfamily, member 1) (LTA, Accession NM_000595.2), a gene which is a cytokine that in its homotrimeric form binds to tnfrsf1a/tnfr1, tnfrsf1b/tnfbr and tnfrsf14/hvem. Accordingly, utilities of GAM51 include diagnosis, prevention and treatment of diseases and clinical conditions associated with LTA.

The function of LTA and its association with various diseases and clinical conditions, has been established by previous studies, as described hereinabove with reference to GAM44.1. MGC10715 (Accession NM_024325.3) is another GAM51 target gene, herein designated TARGET GENE. MGC10715 BINDING SITE is a target binding site found in the 3' untranslated region of mRNA encoded by MGC10715, corresponding to a target binding site such as BINDING SITE I, BINDING SITE II or BINDING SITE III of FIG. 8. Table 4 illustrates the complementarity of the nucleotide sequences of MGC10715 BINDING SITE, designated SEQ ID:17807, to the nucleotide sequence of GAM51 RNA, herein designated GAM RNA, also designated SEQ ID:201.

Another function of GAM51 is therefore inhibition of MGC10715 (Accession NM_024325.3). Accordingly, utilities of GAM51 include diagnosis, prevention and treatment of diseases and clinical conditions associated with MGC10715.

MGC10986 (Accession NM_030576.2) is another GAM51 target gene, herein designated TARGET GENE. MGC10986 BINDING SITE is a target binding site found in the 3' untranslated region of mRNA encoded by MGC10986, corresponding to a target binding site such as BINDING SITE I, BINDING SITE II or BINDING SITE III of FIG. 8. Table 4 illustrates the complementarity of the nucleotide sequences of MGC10986 BINDING SITE, designated SEQ ID:13552, to the nucleotide sequence of GAM51 RNA, herein designated GAM RNA, also designated SEQ ID:201.

Another function of GAM51 is therefore inhibition of MGC10986 (Accession NM_030576.2). Accordingly, utilities of GAM51 include diagnosis, prevention and treatment of diseases and clinical conditions associated with MGC10986.

MGC15873 (Accession NM_032920.1) is another GAM51 target gene, herein designated TARGET GENE. MGC15873 BINDING SITE is a target binding site found in the 3' untranslated region of mRNA encoded by MGC15873, corresponding to a target binding site such as BINDING SITE I, BINDING SITE II or BINDING SITE III of FIG. 8. Table 4 illustrates the complementarity of the nucleotide sequences of MGC15873 BINDING SITE, designated SEQ ID:6309, to the nucleotide sequence of GAM51 RNA, herein designated GAM RNA, also designated SEQ ID:201.

Another function of GAM51 is therefore inhibition of MGC15873 (Accession NM_032920.1). Accordingly, utilities of GAM51 include diagnosis, prevention and treatment of diseases and clinical conditions associated with MGC15873.

MGC16142 (Accession NM_032763.1) is another GAM51 target gene, herein designated TARGET GENE. MGC16142 BINDING SITE is a target binding site found in the 5' untranslated region of mRNA encoded by MGC16142, corresponding to a target binding site such as BINDING SITE I, BINDING SITE II or BINDING SITE III of FIG. 8. Table 4 illustrates the complementarity of the nucleotide sequences of MGC16142 BINDING SITE, designated SEQ ID:15996, to the nucleotide sequence of GAM51 RNA, herein designated GAM RNA, also designated SEQ ID:201.

Another function of GAM51 is therefore inhibition of MGC16142 (Accession NM_032763.1). Accordingly, utilities of GAM51 include diagnosis, prevention and treatment of diseases and clinical conditions associated with MGC16142.

MGC5356 (Accession NM_024059.2) is another GAM51 target gene, herein designated TARGET GENE. MGC5356 BINDING SITE is a target binding site found in the 5' untranslated region of mRNA encoded by MGC5356, corresponding to a target binding site such as BINDING SITE I, BINDING SITE II or BINDING SITE III of FIG. 8. Table 4 illustrates the complementarity of the nucleotide sequences of MGC5356 BINDING SITE, designated SEQ ID:5507, to the nucleotide sequence of GAM51 RNA, herein designated GAM RNA, also designated SEQ ID:201.

Another function of GAM51 is therefore inhibition of MGC5356 (Accession NM_024059.2). Accordingly, utilities of GAM51 include diagnosis, prevention and treatment of diseases and clinical conditions associated with MGC5356.

Machado-joseph disease (spinocerebellar ataxia 3, olivopontocerebellar ataxia 3, autosomal dominant, ataxin 3) (MJD, Accession NM_030660.1) is another GAM51 target gene, herein designated TARGET GENE. MJD BINDING SITE is a target binding site found in the 3' untranslated region of multiple transcripts of mRNA encoded by MJD, corresponding to a target binding site such as BINDING SITE I, BINDING SITE II or BINDING SITE III of FIG. 8. Table 4 illustrates the complementarity of the nucleotide sequences of MJD BINDING SITE, designated SEQ ID:19294, to the nucleotide sequence of GAM51 RNA, herein designated GAM RNA, also designated SEQ ID:201.

Another function of GAM51 is therefore inhibition of Machado-joseph disease (spinocerebellar ataxia 3, olivopontocerebellar ataxia 3, autosomal dominant, ataxin 3) (MJD, Accession NM_030660.1). Accordingly, utilities of GAM51 include diagnosis, prevention and treatment of diseases and clinical conditions associated with MJD.

Otoferlin (OTOF, Accession NM_004802.1) is another GAM51 target gene, herein designated TARGET GENE. OTOF BINDING SITE is a target binding site found in the 3' untranslated region of mRNA encoded by OTOF, corresponding to a target binding site such as BINDING SITE I, BINDING SITE II or BINDING SITE III of FIG. 8. Table 4 illustrates the complementarity of the nucleotide sequences of OTOF BINDING SITE, designated SEQ ID:6635, to the nucleotide sequence of GAM51 RNA, herein designated GAM RNA, also designated SEQ ID:201.

Another function of GAM51 is therefore inhibition of Otoferlin (OTOF, Accession NM_004802.1), a gene which is involved in vesicle membrane fusion and required for inner ear function. and therefore may be associated with Deafness. Accordingly, utilities of GAM51 include diagnosis, prevention and treatment of Deafness, and of other diseases and clinical conditions associated with OTOF.

The function of OTOF has been established by previous studies. Using a candidate gene approach, Yasunaga et al. (1999) identified a novel human gene, which they called OTOF, mutation in which causes DFNB9 (OMIM Ref. No. 601071). DFNB9 had been linked to chromosome 2p23.1, between D2S2303 and D2S174. Yasunaga et al. (1999) refined the interval to a 1-cM interval between D2S158 and D2S174. A contig of YACs, BACs, and PACs was constructed, and 2 genes, HADHB and CENPA, and 4 ESTs were assigned to the interval. The genes were excluded as candidates for DFNB9 by function. The ESTs were submitted to rounds of 5-prime RACE-PCR and the deduced amino acids were compared with clones isolated from 2 subtracted mouse cochlear cDNA libraries. The human OTOF gene encodes a 4,954-bp transcript with a 3,690-bp open reading frame and a 1,038-bp 3-prime untranslated region with a polyadenylation signal at position 4934. The 1,230-amino acid protein has a calculated molecular mass of 140.5 kD. It has 3 C2 domains and a single carboxy-terminal transmembrane domain. The protein is homologous to the C. elegans spermatogenesis factor FER-1 and human dysferlin (OMIM Ref. No. 603009), prompting the authors to name it 'otoferlin.' The homology suggests the otoferlin is involved in vesicle membrane fusion. The OTOF gene extends over 21 kb and contains 28 coding exons and a 5-prime untranslated region exon. Otof expression was identified by RT-PCR in mouse cochlea, vestibule, and brain. By in situ hybridization, Otof labeling was seen in the inner hair cells, and faintly in the outer hair cells and spiral ganglion cells, at embryonic day 19.5, P0, and P2. Neuroepithelia of the utricle, saccule, and semicircular canals expressed Otof during the same days. Type I cells, but not type II cells or supporting cells, expressed Otof. By Northern blot analysis, Yasunaga et al. (2000) detected a 7-kb otoferlin mRNA in the human brain. They isolated a corresponding cDNA, which was predicted to encode a 1,977-long form of otoferlin with 6 C2 domains. They found that the human OTOF gene contains 48 coding exons and spans approximately 90 kb. Other alternatively spliced transcripts were detected, which predicted several long isoforms (with 6 C2 domains) in humans and mice and short isoforms (3 C2 domains) only in humans. Yasunaga et al. (2000) studied a consanguineous family originating from India in which 3 sibs suffered from severe to profound hearing loss. By segregation analysis with polymorphic markers of the DFNB9 chromosomal region, they concluded that an OTOF mutation was likely to underlie deafness in this family. By sequencing the 48 OTOF coding exons in members of this family, they identified a splice mutation in intron 8 (603681.0002). These studies demonstrated that the long otoferlin isoforms are By Northern blot analysis, Yasunaga et al. (2000) detected a 7-kb otoferlin mRNA in the human brain. They isolated a corresponding cDNA, which was predicted to encode a 1,977-long form of otoferlin with 6 C2 domains. They found that the human OTOF gene contains 48 coding exons and spans approximately 90 kb. Other alternatively spliced transcripts were detected, which predicted several long isoforms (with 6 C2 domains) in humans and mice and short isoforms (3 C2 domains) only in humans. Yasunaga et al. (2000) studied a consanguineous family originating from India in which 3 sibs suffered from severe to profound hearing loss. By segregation analysis with polymorphic markers of the DFNB9 chromosomal region, they concluded that an OTOF mutation was likely to underlie deafness in this family. By sequencing the 48 OTOF coding exons in members of this family, they identified a splice mutation in intron 8 (603681.0002). These studies demonstrated that the long otoferlin isoforms are required for inner ear function.

Full details of the abovementioned studies are described in the following publications, the disclosure of which are hereby incorporated by reference:

Yasunaga, S.; Grati, M.; Chardenoux, S.; Smith, T. N.; Friedman, T. B.; Lalwani, A. K.; Wilcox, E. R.; Petit, C.: OTOF encodes multiple long and short isoforms: genetic evidence that the long ones underlie recessive deafness DFNB9. Am. J. Hum. Genet. 67:591-600, 2000; and Yasunaga, S.; Grati, M.; Cohen-Salmon, M.; El-Amraoui, A.; Mustapha, M.; Salem, N.; El-Zir, E.; Loiselet, J.; Petit, C.: A mutation in OTOF, encoding otoferlin, a FER-1-like protein, c.

Further studies establishing the function and utilities of OTOF are found in John Hopkins OMIM database record ID 603681, and in cited publications listed in Table 5, which are hereby incorporated by reference. PAG (Accession NM_018440.2) is another GAM51 target gene, herein designated TARGET GENE. PAG BINDING SITE is a target binding site found in the 3' untranslated region of mRNA encoded by PAG, corresponding to a target binding site such as BINDING SITE I, BINDING SITE II or BINDING SITE III of FIG. 8. Table 4 illustrates the complementarity of the nucleotide sequences of PAG BINDING SITE, designated SEQ ID:8895, to the nucleotide sequence of GAM51 RNA, herein designated GAM RNA, also designated SEQ ID:201.

Another function of GAM51 is therefore inhibition of PAG (Accession NM_018440.2). Accordingly, utilities of GAM51 include diagnosis, prevention and treatment of diseases and clinical conditions associated with PAG.

PATE (Accession NM_138294.1) is another GAM51 target gene, herein designated TARGET GENE. PATE BINDING SITE is a target binding site found in the 3' untranslated region of mRNA encoded by PATE, corresponding to a target binding site such as BINDING SITE I, BINDING SITE II or BINDING SITE III of FIG. 8. Table 4 illustrates the complementarity of the nucleotide sequences of PATE BINDING SITE, designated SEQ ID:11458, to the nucleotide sequence of GAM51 RNA, herein designated GAM RNA, also designated SEQ ID:201.

Another function of GAM51 is therefore inhibition of PATE (Accession NM_138294.1). Accordingly, utilities of GAM51 include diagnosis, prevention and treatment of diseases and clinical conditions associated with PATE.

PP1057 (Accession NM_031285.1) is another GAM51 target gene, herein designated TARGET GENE. PP1057 BINDING SITE is a target binding site found in the 5' untranslated region of mRNA encoded by PP1057, corresponding to a target binding site such as BINDING SITE I, BINDING SITE II or BINDING SITE III of FIG. 8. Table 4 illustrates the complementarity of the nucleotide sequences of PP1057 BINDING SITE, designated SEQ ID:461, to the nucleotide sequence of GAM51 RNA, herein designated GAM RNA, also designated SEQ ID:201.

Another function of GAM51 is therefore inhibition of PP1057 (Accession NM_031285.1). Accordingly, utilities of GAM51 include diagnosis, prevention and treatment of diseases and clinical conditions associated with PP1057.

Protein phosphatase 1, regulatory (inhibitor) subunit 12b (PPP1R12B, Accession NM_032105.1) is another GAM51 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:7244, to the nucleotide sequence of GAM51 RNA, herein designated GAM RNA, also designated SEQ ID:201.

Another function of GAM51 is therefore inhibition of Protein phosphatase 1, regulatory (inhibitor) subunit 12b (PPP1R12B, Accession NM_032105.1). Accordingly, utilities of GAM51 include diagnosis, prevention and treatment of diseases and clinical conditions associated with PPP1R12B.

PRO0659 (Accession NM_014138.1) is another GAM51 target gene, herein designated TARGET GENE. PRO0659 BINDING SITE is a target binding site found in the 3' untranslated region of mRNA encoded by PRO0659, corresponding to a target binding site such as BINDING SITE I, BINDING SITE II or BINDING SITE III of FIG. 8. Table 4 illustrates the complementarity of the nucleotide sequences of PRO0659 BINDING SITE, designated SEQ ID:4863, to the nucleotide sequence of GAM51 RNA, herein designated GAM RNA, also designated SEQ ID:201.

Another function of GAM51 is therefore inhibition of PRO0659 (Accession NM_014138.1). Accordingly, utilities of GAM51 include diagnosis, prevention and treatment of diseases and clinical conditions associated with PRO0659.

Protein tyrosine phosphatase, receptor type, n polypeptide 2 (PTPRN2, Accession NM_130842.1) is another GAM51 target gene, herein designated TARGET GENE. PTPRN2 BINDING SITE is a target binding site found in the 3' untranslated region of multiple transcripts of mRNA encoded by PTPRN2, corresponding to a target binding site such as BINDING SITE I, BINDING SITE II or BINDING SITE III of FIG. 8. Table 4 illustrates the complementarity of the nucleotide sequences of PTPRN2 BINDING SITE, designated SEQ ID:19987, to the nucleotide sequence of GAM51 RNA, herein designated GAM RNA, also designated SEQ ID:201.

Another function of GAM51 is therefore inhibition of Protein tyrosine phosphatase, receptor type, n polypeptide 2 (PTPRN2, Accession NM_130842.1). Accordingly, utilities of GAM51 include diagnosis, prevention and treatment of diseases and clinical conditions associated with PTPRN2.

RGL (Accession NM_015149.2) is another GAM51 target gene, herein designated TARGET GENE. RGL BINDING SITE is a target binding site found in the 3' untranslated region of mRNA encoded by RGL, corresponding to a target binding site such as BINDING SITE I, BINDING SITE II or BINDING SITE III of FIG. 8. Table 4 illustrates the complementarity of the nucleotide sequences of RGL BINDING SITE, designated SEQ ID:20166, to the nucleotide sequence of GAM51 RNA, herein designated GAM RNA, also designated SEQ ID:201.

Another function of GAM51 is therefore inhibition of RGL (Accession NM_015149.2), a gene which is involved in nucleotide exchange factor. Accordingly, utilities of GAM51 include diagnosis, prevention and treatment of diseases and clinical conditions associated with RGL.

The function of RGL has been established by previous studies. Ral guanine nucleotide dissociation stimulator (RALGDS; 601619) and its family members are involved in Ras and Ral signaling pathways as downstream effector proteins. While transcript mapping the 1q25 region in an attempt to identify the HPC1 (OMIM Ref. No. 601518) gene, Sood et al. (2000) cloned a cDNA encoding RGL, which is 94% identical to the mouse Rgl protein, and a splice variant. The deduced 803-amino acid brain isoform, which is identical to the KIAA0959 protein isolated by Nagase et al. (1999), differs from the 768-amino acid liver isoform due to the substitution of 44 residues for the first 9 residues of the liver protein. The divergence results from the use of alternative first exons. Exon- trap and sequence analyses determined that the RGL gene contains 18 exons. The proteins both contain a CDC25 (OMIM Ref. No. 157680)-like domain and a Ras-interacting domain. Northern blot analysis revealed ubiquitous expression of a 5.0-kb transcript, with an additional 5.3-kb transcript in brain. Using RT-PCR analysis, Nagase et al. (1999) found strong expression in most tissues and all brain regions tested. By radiation hybrid analysis, Nagase et al. (1999) mapped the RGL gene to chromosome 1.

Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XIII. The complete sequences of 100 new cDNA clones from brain which code for large proteins in vitro. DNA Res. 6:63-70, 1999; and Sood, R.; Makalowska, I.; Carpten, J. D.; Robbins, C. M.; Stephan, D. A.; Connors, T. D.; Morgenbesser, S. D.; Su, K.; Pinkett, H. W.; Graham, C. L.; Quesenberry, M. I.; Baxevanis, A. D.

Further studies establishing the function and utilities of RGL are found in John Hopkins OMIM database record ID 605667, and in cited publications listed in Table 5, which are hereby incorporated by reference. RoXaN (Accession NM_017590.4) is another GAM51 target gene, herein designated TARGET GENE. RoXaN BINDING SITE is a target binding site found in the 3' untranslated region of mRNA encoded by RoXaN, corresponding to a target binding site such as BINDING SITE I, BINDING SITE II or BINDING SITE III of FIG. 8. Table 4 illustrates the complementarity of the nucleotide sequences of RoXaN BINDING SITE, designated SEQ ID:16809, to the nucleotide sequence of GAM51 RNA, herein designated GAM RNA, also designated SEQ ID:201.

Another function of GAM51 is therefore inhibition of RoXaN (Accession NM_017590.4). Accordingly, utilities of GAM51 include diagnosis, prevention and treatment of diseases and clinical conditions associated with RoXaN.

SCYD1 (Accession) is another GAM51 target gene, herein designated TARGET GENE. SCYD1 BINDING SITE is a target binding site found in the 3' untranslated region of mRNA encoded by SCYD1, corresponding to a target binding site such as BINDING SITE I, BINDING SITE II or BINDING SITE III of FIG. 8. Table 4 illustrates the complementarity of the nucleotide sequences of SCYD1 BINDING SITE, designated SEQ ID:18728, to the nucleotide sequence of GAM51 RNA, herein designated GAM RNA, also designated SEQ ID:201.

Another function of GAM51 is therefore inhibition of SCYD1 (Accession). Accordingly, utilities of GAM51 include diagnosis, prevention and treatment of diseases and clinical conditions associated with SCYD1.

Solute carrier family 2 (facilitated glucose transporter), member 1 (SLC2A1, Accession NM_006516.1) is another GAM51 target gene, herein designated TARGET GENE. SLC2A1 BINDING SITE is a target binding site found in the 3' untranslated region of mRNA encoded by SLC2A1, corresponding to a target binding site such as BINDING SITE I, BINDING SITE II or BINDING SITE III of FIG. 8. Table 4 illustrates the complementarity of the nucleotide sequences of SLC2A1 BINDING SITE, designated SEQ ID:17243, to the nucleotide sequence of GAM51 RNA, herein designated GAM RNA, also designated SEQ ID:201.

Another function of GAM51 is therefore inhibition of Solute carrier family 2 (facilitated glucose transporter), member 1 (SLC2A1, Accession NM_006516.1). Accordingly, utilities of GAM51 include diagnosis, prevention and treatment of diseases and clinical conditions associated with SLC2A1.

Stomatin (epb72)-like 1 (STOML1, Accession NM_004809.2) is another GAM51 target gene, herein designated TARGET GENE. STOML1 BINDING SITE is a target binding site found in the 3' untranslated region of mRNA encoded by STOML1, corresponding to a target binding site such as BINDING SITE I, BINDING SITE II or BINDING SITE III of FIG. 8. Table 4 illustrates the complementarity of the nucleotide sequences of STOML1 BINDING SITE, designated SEQ ID:17548, to the nucleotide sequence of GAM51 RNA, herein designated GAM RNA, also designated SEQ ID:201.

Another function of GAM51 is therefore inhibition of Stomatin (epb72)-like 1 (STOML1, Accession NM_004809.2). Accordingly, utilities of GAM51 include diagnosis, prevention and treatment of diseases and clinical conditions associated with STOML1.

TUSP (Accession NM_020245.2) is another GAM51 target gene, herein designated TARGET GENE. TUSP BINDING SITE is a target binding site found in the 3' untranslated region of mRNA encoded by TUSP, corresponding to a target binding site such as BINDING SITE I, BINDING SITE II or BINDING SITE III of FIG. 8. Table 4 illustrates the complementarity of the nucleotide sequences of TUSP BINDING SITE, designated SEQ ID:12909, to the nucleotide sequence of GAM51 RNA, herein designated GAM RNA, also designated SEQ ID:201.

Another function of GAM51 is therefore inhibition of TUSP (Accession NM_020245.2). Accordingly, utilities of GAM51 include diagnosis, prevention and treatment of diseases and clinical conditions associated with TUSP.

Ubiquitin-conjugating enzyme e2i (ubc9 homolog, yeast) (UBE2I, Accession NM_003345.1) is another GAM51 target gene, herein designated TARGET GENE. UBE2I BINDING SITE is a target binding site found in the 5' untranslated region of mRNA encoded by UBE2I, corresponding to a target binding site such as BINDING SITE I, BINDING SITE II or BINDING SITE III of FIG. 8. Table 4 illustrates the complementarity of the nucleotide sequences of UBE2I BINDING SITE, designated SEQ ID:17025, to the nucleotide sequence of GAM51 RNA, herein designated GAM RNA, also designated SEQ ID:201.

Another function of GAM51 is therefore inhibition of Ubiquitin-conjugating enzyme e2i (ubc9 homolog, yeast) (UBE2I, Accession NM_003345.1), a gene which catalyzes the covalent attachment of ubiquitin-like protein sumo-1 to other proteins. Accordingly, utilities of GAM51 include diagnosis, prevention and treatment of diseases and clinical conditions associated with UBE2I.

The function of UBE2I has been established by previous studies. The ubiquitin- conjugating enzymes (E2s) are a family of proteins involved in the ubiquitin- dependent protein degradation system. In yeast, at least 10 different E2s have been identified; they are involved in essential cellular processes such as DNA repair, cell cycle control, and stress responses. Using the yeast 2-hybrid system with the repressor domain of the Wilms tumor gene product (WT1; 607102) as bait, Wang et al. (1996) isolated a cDNA encoding a human homolog of the yeast ubiquitin-conjugating enzyme 9 (UBC9). Sequencing of human UBC9 revealed that it has 56% identity with yeast ubc9 and contains the active site cysteine residue necessary for the ubiquitin-conjugating activity of all E2 enzymes. Wang et al. (1996) found that human UBC9 could fully complement the mutant phenotype of a yeast ubc9 mutant strain. Northern blot analysis revealed human UBC9 transcripts of 4.4, 2.4, and 1.3 kb in all of the tissues examined. In yeast, ubc9 is involved in cell cycle progression via degradation of cyclins (see OMIM Ref. No. 123835). Wang et al. (1996) suggested that human UBC9 (also symbolized UBE2I) may play a similar role via interaction with WT1, which is able to impose a block to cell cycle progression in eukaryotic cells. Fragile histidine triad (FHIT; 601153), a candidate tumor suppressor gene located on 3p14.2, is deleted in many types of human cancer. Using a yeast 2-hybrid screen to search for proteins that interact with the FHIT protein in vivo, Shi et al. (2000) found that UBC9 is specifically associated with FHIT. The last 21 amino acids at the C terminus of UBC9 appear to be unimportant for its biologic activity, since a UBC9 mutant harboring a deletion of these amino acids could still restore normal growth of yeast containing a temperature-sensitive mutation in the homolog UBC9 gene. Mutational analysis indicated that UBC9 was associated with the C-terminal portion of FHIT. The interaction between FHIT and UBC9 appeared to be independent of the enzymatic activity of FHIT. Given that yeast UBC9 is involved in the degradation of S- and M-phase cyclins, Shi et al. (2000) concluded that FHIT may be involved in cell cycle control through its interaction with UBC9.

Full details of the abovementioned studies are described in the following publications, the disclosure of which are hereby incorporated by reference:

Wang, Z.-Y.; Qiu, Q.-Q.; Seufert, W.; Taguchi, T.; Testa, J. R.; Whitmore, S. A.; Callen, D. F.; Welsh, D.; Shenk, T.; Deuel, T. F.: Molecular cloning of the cDNA and chromosome localization of the gene for human ubiquitin-conjugating enzyme 9. J. Biol. Chem. 271:24811-24816, 1996; and Shi, Y.; Zou, M.; Farid, N. R.; Paterson, M. C.: Association of FHIT (fragile histidine triad), a candidate tumour suppressor gene, with the ubiquitin-conjugating enzyme hUBC9. Biochem.

Further studies establishing the function and utilities of UBE2I are found in John Hopkins OMIM database record ID 601661, and in cited publications listed in Table 5, which are hereby incorporated by reference.

FIG. 8 further provides a conceptual description of a novel bioinformatically detected of the present invention, referred to here as Genomic Address Messenger 52 (GAM52), which modulates expression of respective target genes thereof, the function and utility of which target genes is known in the art.

GAM52 is a novel bioinformatically detected regulatory, non protein coding, micro RNA (miRNA) gene. The method by which GAM52 was detected is described hereinabove with reference to FIGS. 8-15.

GAM52 gene, herein designated GAM GENE, and GAM52 target gene, herein designated TARGET GENE, are human genes contained in the human genome.

GAM52 gene encodes a GAM52 precursor RNA, herein designated GAM PRECURSOR RNA. Similar to other miRNA genes, and unlike most ordinary genes, GAM52 precursor RNA does not encode a protein. A nucleotide sequence identical or highly similar to the nucleotide sequence of GAM52 precursor RNA is designated SEQ ID:39, and is provided hereinbelow with reference to the sequence listing part. Nucleotide sequence SEQ ID:39 is located at position 2480402 relative to chromosome 6.

GAM52 precursor RNA folds onto itself, forming GAM52 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM52 precursor RNA folds onto itself, forming GAM52 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM52 precursor RNA, designated SEQ-ID:39, and a schematic representation of a predicted secondary folding of GAM52 folded precursor RNA are further described with reference to Table 2, hereby incorporated by reference.

An enzyme complex designated DICER COMPLEX, 'dices' the GAM52 folded precursor RNA into GAM52 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM52 RNA is designated SEQ ID:373, and is provided hereinbelow with references to the sequence listing part and Table 3, hereby incorporated by reference.

GAM52 target gene, herein designated TARGET GENE, encodes a corresponding messenger RNA, GAM52 target RNA, herein designated GAM TARGET RNA. GAM52 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM52 RNA, herein designated GAM RNA, binds complementarily to one or more target binding sites located in untranslated regions of GAM52 target RNA, herein designated GAM TARGET RNA. This complementary binding is due to the fact that the nucleotide sequence of GAM52 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM52 RNA may have a different number of target binding sites in untranslated regions of a GAM52 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM52 RNA, herein designated GAM RNA, to target binding sites on GAM52 target RNA, herein designated GAM TARGET RNA, such as BINDING SITE I, BINDING SITE II and BINDING SITE III, inhibits translation of GAM52 target RNA into GAM52 target protein, herein designated GAM TARGET PROTEIN. GAM target protein is therefore outlined by a broken line.

It is appreciated that GAM52 target gene, herein designated TARGET GENE, in fact represents a plurality of GAM52 target genes. The mRNA of each one of this plurality of GAM52 target genes comprises one or more target binding sites, each having a nucleotide sequence which is at least partly complementary to GAM52 RNA, herein designated GAM RNA, and which when bound by GAM52 RNA causes inhibition of translation of respective one or more GAM52 target proteins.

It is further appreciated by one skilled in the art that the mode of translational inhibition illustrated by FIG. 8 with specific reference to translational inhibition exerted by GAM52 gene, herein designated GAM GENE, on one or more GAM52 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM52 correlate with, and may be deduced from, the identity of the target genes which GAM52 binds and inhibits, and the function of these target genes, as elaborated hereinbelow.

Gap junction protein, alpha 5, 40 kda (connexin 40) (GJA5, Accession NM_005266.3) is a GAM52 target gene, herein designated TARGET GENE. GJA5 BINDING SITE is a target binding site found in the 3' untranslated region of mRNA encoded by GJA5, corresponding to a target binding site such as BINDING SITE I, BINDING SITE II or BINDING SITE III of FIG. 8. Table 4 illustrates the complementarity of the nucleotide sequences of GJA5 BINDING SITE, designated SEQ ID:15528, to the nucleotide sequence of GAM52 RNA, herein designated GAM RNA, also designated SEQ ID:373.

A function of GAM52 is therefore inhibition of Gap junction protein, alpha 5, 40 kda (connexin 40) (GJA5, Accession NM_005266.3), a gene which may facilitate cardiac impulse conduction. Accordingly, utilities of GAM52 include diagnosis, prevention and treatment of diseases and clinical conditions associated with GJA5.

The function of GJA5 has been established by previous studies. See 121011 for a general discussion of the connexin gene family. Kanter et al. (1992) demonstrated that canine ventricular myocytes express 3 distinct gap junction proteins, Cx40, Cx43 (GJA1; 121013), and Cx45. Kanter et al. (1994) used PCR with primers based on rat and dog Cx40 to clone human CX40. The CX40 gene has a 5-prime untranslated exon and 1 coding exon, and encodes a predicted 358-amino acid protein whose sequence is 82% identical to that of the rat and mouse CX40 protein. Northern blot analysis showed that CX40 mRNA is expressed as an approximately 3.3-kb transcript in ventricular myocardium. In immunofluorescence studies, CX40 localized to intercalated disc regions of the left ventricle, which join cardiac myocytes and contain gap junctions. The migration of lymphocytes from the circulation into tissues involves a number of adhesion molecules and the expression of new molecules. Gap junctions facilitate cell- to - cell adhesion and provide pathways for direct intercellular communication. Oviedo-Orta et al. (2000) noted that GJA1 is expressed in a number of lymphoid organs. By RT-PCR, Western blot, and flow cytometric analyses, they showed that lymphocytes express GJA1 and GJA5, but not GJB2 (OMIM Ref. No. 121011), GJB1 (OMIM Ref. No. 304040), GJA4 (OMIM Ref. No. 121012), or GJA7; GJA5 expression was restricted to tonsillar T and B lymphocytes. Flow cytometric analysis showed that GJA1 and GJA5 expression increases after mitogenic stimulation. Extracellular connexin mimetic peptide blocked dye transfer between lymphocyte subpopulations, and gap junction inhibitors decreased the production of IgM in cocultured T and B lymphocytes. The results identified gap junction proteins as important cell surface components that modulate immune responses.

Full details of the abovementioned studies are described in the following publications, the disclosure of which are hereby incorporated by reference:

Kanter, H. L.; Saffitz, J. E.; Beyer, E. C.: Cardiac myocytes express multiple gap junction proteins. Circ. Res. 70:438-444, 1992; and Oviedo-Orta, E.; Hoy, T.; Evans, W. H.: Intercellular communication in the immune system: differential expression of connexin40 and 43, and perturbation of gap junction channel function.

Further studies establishing the function and utilities of GJA5 are found in John Hopkins OMIM database record ID 121013, and in cited publications listed in Table 5, which are hereby incorporated by reference. Protein tyrosine phosphatase, non-receptor type substrate 1 (PTPNS1, Accession NM_080792.1) is another GAM52 target gene, herein designated TARGET GENE. PTPNS1 BINDING SITE is a target binding site found in the 3' untranslated region of mRNA encoded by PTPNS1, corresponding to a target binding site such as BINDING SITE I, BINDING SITE II or BINDING SITE III of FIG. 8. Table 4 illustrates the complementarity of the nucleotide sequences of PTPNS1 BINDING SITE, designated SEQ ID:15053, to the nucleotide sequence of GAM52 RNA, herein designated GAM RNA, also designated SEQ ID:373.

Another function of GAM52 is therefore inhibition of Protein tyrosine phosphatase, non-receptor type substrate 1 (PTPNS1, Accession NM_080792.1). Accordingly, utilities of GAM52 include diagnosis, prevention and treatment of diseases and clinical conditions associated with PTPNS1.

FIG. 8 further provides a conceptual description of a novel bioinformatically detected of the present invention, referred to here as Genomic Address Messenger 53 (GAM53), which modulates expression of respective target genes thereof, the function and utility of which target genes is known in the art.

GAM53 is a novel bioinformatically detected regulatory, non protein coding, micro RNA (miRNA) gene. The method by which GAM53 was detected is described hereinabove with reference to FIGS. 8-15.

GAM53 gene, herein designated GAM GENE, and GAM53 target gene, herein designated TARGET GENE, are human genes contained in the human genome.

GAM53 gene encodes a GAM53 precursor RNA, herein designated GAM PRECURSOR RNA. Similar to other miRNA genes, and unlike most ordinary genes, GAM53 precursor RNA does not encode a protein. A nucleotide sequence identical or highly similar to the nucleotide sequence of GAM53 precursor RNA is designated SEQ ID:136, and is provided hereinbelow with reference to the sequence listing part.

GAM53 precursor RNA folds onto itself, forming GAM53 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM53 precursor RNA folds onto itself, forming GAM53 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM53 precursor RNA, designated SEQ-ID:136, and a schematic representation of a predicted secondary folding of GAM53 folded precursor RNA are further described with reference to Table 2, hereby incorporated by reference.

An enzyme complex designated DICER COMPLEX, 'dices' the GAM53 folded precursor RNA into GAM53 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM53 RNA is designated SEQ ID:359, and is provided hereinbelow with references to the sequence listing part and Table 3, hereby incorporated by reference.

GAM53 target gene, herein designated TARGET GENE, encodes a corresponding messenger RNA, GAM53 target RNA, herein designated GAM TARGET RNA. GAM53 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM53 RNA, herein designated GAM RNA, binds complementarily to one or more target binding sites located in untranslated regions of GAM53 target RNA, herein designated GAM TARGET RNA. This complementary binding is due to the fact that the nucleotide sequence of GAM53 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM53 RNA may have a different number of target binding sites in untranslated regions of a GAM53 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM53 RNA, herein designated GAM RNA, to target binding sites on GAM53 target RNA, herein designated GAM TARGET RNA, such as BINDING SITE I, BINDING SITE II and BINDING SITE III, inhibits translation of GAM53 target RNA into GAM53 target protein, herein designated GAM TARGET PROTEIN. GAM target protein is therefore outlined by a broken line.

It is appreciated that GAM53 target gene, herein designated TARGET GENE, in fact represents a plurality of GAM53 target genes. The mRNA of each one of this plurality of GAM53 target genes comprises one or more target binding sites, each having a nucleotide sequence which is at least partly complementary to GAM53 RNA, herein designated GAM RNA, and which when bound by GAM53 RNA causes inhibition of translation of respective one or more GAM53 target proteins.

It is further appreciated by one skilled in the art that the mode of translational inhibition illustrated by FIG. 8 with specific reference to translational inhibition exerted by GAM53 gene, herein designated GAM GENE, on one or more GAM53 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM53 correlate with, and may be deduced from, the identity of the target genes which GAM53 binds and inhibits, and the function of these target genes, as elaborated hereinbelow.

Chromosome 20 open reading frame 39 (C20orf39, Accession NM_024893.1) is a GAM53 target gene, herein designated TARGET GENE. C20orf39 BINDING SITE is a target binding site found in the 3' untranslated region of mRNA encoded by C20orf39, corresponding to a target binding site such as BINDING SITE I, BINDING SITE II or BINDING SITE III of FIG. 8. Table 4 illustrates the complementarity of the nucleotide sequences of C20orf39 BINDING SITE, designated SEQ ID:14770, to the nucleotide sequence of GAM53 RNA, herein designated GAM RNA, also designated SEQ ID:359.

A function of GAM53 is therefore inhibition of Chromosome 20 open reading frame 39 (C20orf39, Accession NM_024893.1). Accordingly, utilities of GAM53 include diagnosis, prevention and treatment of diseases and clinical conditions associated with C20orf39.

FLJ10687 (Accession) is another GAM53 target gene, herein designated TARGET GENE. FLJ10687 BINDING SITE is a target binding site found in the 3' untranslated region of mRNA encoded by FLJ10687, corresponding to a target binding site such as BINDING SITE I, BINDING SITE II or BINDING SITE III of FIG. 8. Table 4 illustrates the complementarity of the nucleotide sequences of FLJ10687 BINDING SITE, designated SEQ ID:20126, to the nucleotide sequence of GAM53 RNA, herein designated GAM RNA, also designated SEQ ID:359.

Another function of GAM53 is therefore inhibition of FLJ10687 (Accession). Accordingly, utilities of GAM53 include diagnosis, prevention and treatment of diseases and clinical conditions associated with FLJ10687.

Fbj murine osteosarcoma viral oncogene homolog b (FOSB, Accession NM_006732.1) is another GAM53 target gene, herein designated TARGET GENE. FOSB BINDING SITE is a target binding site found in the 3' untranslated region of mRNA encoded by FOSB, corresponding to a target binding site such as BINDING SITE I, BINDING SITE II or BINDING SITE III of FIG. 8. Table 4 illustrates the complementarity of the nucleotide sequences of FOSB BINDING SITE, designated SEQ ID:7846, to the nucleotide sequence of GAM53 RNA, herein designated GAM RNA, also designated SEQ ID:359.

Another function of GAM53 is therefore inhibition of Fbj murine osteosarcoma viral oncogene homolog b (FOSB, Accession NM_006732.1), a gene which interacts with jun proteins enhancing their dna binding activity. and therefore may be associated with Cocaine addiction. Accordingly, utilities of GAM53 include diagnosis, prevention and treatment of Cocaine addiction, and of other diseases and clinical conditions associated with FOSB.

The function of FOSB has been established by previous studies. Cocaine enhances dopamine-mediated neurotransmission by blocking dopamine reuptake at axon terminals. Most dopamine-containing nerve terminals innervate medium spiny neurons in the striatum of the brain. Cocaine addiction is thought to stem, in part, from neural adaptations that act to maintain equilibrium by countering the effects of repeated drug administration. Chronic exposure to cocaine upregulates several transcription factors that alter gene expression and which could mediate such compensatory neural and behavioral changes. One such transcription factor is delta-FosB, a protein that persists in striatum long after the end of cocaine exposure. Using DNA array analysis of striatal material from inducible transgenic mice, Bibb et al. (2001) identified Cdk5 (OMIM Ref. No. 123831) as a downstream target of delta-FosB. Overexpression of delta-FosB, or chronic cocaine administration, raised levels of Cdk5 mRNA, protein, and activity in the striatum. Moreover, injection of Cdk5 inhibitors into the striatum potentiated behavioral effects of repeated cocaine administration. Bibb et al. (2001) concluded that changes in Cdk5 levels mediated by delta-FosB, and resulting alterations in signaling involving D1 dopamine receptors, contribute to adaptive changes in the brain related to cocaine addiction.

Animal model experiments lend further support to the function of FOSB. Brown et al. (1996) demonstrated that mice in whom the FOSB gene had been inactivated by homologous recombination displayed a profound defect in reproduction. The reproductive failure of fosB mutant mice was due to a specific behavioral defect that resulted in an inability to nurture young. This nurturing defect was seen not only in postpartum females but also in young females and males. Together, these findings provided evidence that nurturing behavior in mammals is genetically controlled and that an immediate early gene, FOSB, is critical for an adaptive neuronal response. Brown et al. (1996) speculated that the nurturing defect is likely due to the absence of FOSB in the preoptic area, a region of the hypothalamus that is critical for nurturing. They stated that this is an example of a transcription factor that controls a complex behavior by regulating a specific neuronal circuit.

It is appreciated that the abovementioned animal model for FOSB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bibb, J. A.; Chen, J.; Taylor, J. R.; Svenningsson, P.; Nishi, A.; Snyder, G. L.; Yan, Z.; Sagawa, Z. K.; Ouimet, C. C.; Nairn, A. C.; Nestler, E. J.; Greengard, P.: Effects of chronic exposure to cocaine are regulated by the neuronal protein Cdk5. Nature 410:376-380, 2001; and Brown, J. R.; y, H.; Bronson, R. T.; Dikkes, P.; Greenberg, M. E.: A defect in nurturing in mice lacking the immediate early gene fosB. Cell 86:297-309, 1996.

Further studies establishing the function and utilities of FOSB are found in John Hopkins OMIM database record ID 164772, and in cited publications listed in Table 5, which are hereby incorporated by reference. HBP17 (Accession NM_005130.1) is another GAM53 target gene, herein designated TARGET GENE. HBP17 BINDING SITE is a target binding site found in the 5' untranslated region of mRNA encoded by HBP17, corresponding to a target binding site such as BINDING SITE I, BINDING SITE II or BINDING SITE III of FIG. 8. Table 4 illustrates the complementarity of the nucleotide sequences of HBP17 BINDING SITE, designated SEQ ID:15114, to the nucleotide sequence of GAM53 RNA, herein designated GAM RNA, also designated SEQ ID:359.

Another function of GAM53 is therefore inhibition of HBP17 (Accession NM_005130.1). Accordingly, utilities of GAM53 include diagnosis, prevention and treatment of diseases and clinical conditions associated with HBP17.

Lactate dehydrogenase a (LDHA, Accession NM_005566.1) is another GAM53 target gene, herein designated TARGET GENE. LDHA BINDING SITE is a target binding site found in the 3' untranslated region of mRNA encoded by LDHA, corresponding to a target binding site such as BINDING SITE I, BINDING SITE II or BINDING SITE III of FIG. 8. Table 4 illustrates the complementarity of the nucleotide sequences of LDHA BINDING SITE, designated SEQ ID:6401, to the nucleotide sequence of GAM53 RNA, herein designated GAM RNA, also designated SEQ ID:359.

Another function of GAM53 is therefore inhibition of Lactate dehydrogenase a (LDHA, Accession NM_005566.1). Accordingly, utilities of GAM53 include diagnosis, prevention and treatment of diseases and clinical conditions associated with LDHA.

LOC125268 (Accession) is another GAM53 target gene, herein designated TARGET GENE. LOC125268 BINDING SITE is a target binding site found in the 3' untranslated region of mRNA encoded by LOC125268, corresponding to a target binding site such as BINDING SITE I, BINDING SITE II or BINDING SITE III of FIG. 8. Table 4 illustrates the complementarity of the nucleotide sequences of LOC125268 BINDING SITE, designated SEQ ID:6730, to the nucleotide sequence of GAM53 RNA, herein designated GAM RNA, also designated SEQ ID:359.

Another function of GAM53 is therefore inhibition of LOC125268 (Accession). Accordingly, utilities of GAM53 include diagnosis, prevention and treatment of diseases and clinical conditions associated with LOC125268.

Testis-specific transcript, y-linked 11 (TTTY11, Accession NM_031929.1) is another GAM53 target gene, herein designated TARGET GENE. TTTY11 BINDING SITE is a target binding site found in the 3' untranslated region of mRNA encoded by TTTY11, corresponding to a target binding site such as BINDING SITE I, BINDING SITE II or BINDING SITE III of FIG. 8. Table 4 illustrates the complementarity of the nucleotide sequences of TTTY11 BINDING SITE, designated SEQ ID:10980, to the nucleotide sequence of GAM53 RNA, herein designated GAM RNA, also designated SEQ ID:359.

Another function of GAM53 is therefore inhibition of Testis-specific transcript, y-linked 11 (TTTY11, Accession NM_031929.1). Accordingly, utilities of GAM53 include diagnosis, prevention and treatment of diseases and clinical conditions associated with TTTY11.

FIG. 8 further provides a conceptual description of a novel bioinformatically detected of the present invention, referred to here as Genomic Address Messenger 54 (GAM54), which modulates expression of respective target genes thereof, the function and utility of which target genes is known in the art.

GAM54 is a novel bioinformatically detected regulatory, non protein coding, micro RNA (miRNA) gene. The method by which GAM54 was detected is described hereinabove with reference to FIGS. 8-15.

GAM54 gene, herein designated GAM GENE, and GAM54 target gene, herein designated TARGET GENE, are human genes contained in the human genome.

GAM54 gene encodes a GAM54 precursor RNA, herein designated GAM PRECURSOR RNA. Similar to other miRNA genes, and unlike most ordinary genes, GAM54 precursor RNA does not encode a protein. A nucleotide sequence identical or highly similar to the nucleotide sequence of GAM54 precursor RNA is designated SEQ ID:167, and is provided hereinbelow with reference to the sequence listing part.

GAM54 precursor RNA folds onto itself, forming GAM54 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM54 precursor RNA folds onto itself, forming GAM54 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM54 precursor RNA, designated SEQ-ID:167, and a schematic representation of a predicted secondary folding of GAM54 folded precursor RNA are further described with reference to Table 2, hereby incorporated by reference.

An enzyme complex designated DICER COMPLEX, 'dices' the GAM54 folded precursor RNA into GAM54 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM54 RNA is designated SEQ ID:275, and is provided hereinbelow with references to the sequence listing part and Table 3, hereby incorporated by reference.

GAM54 target gene, herein designated TARGET GENE, encodes a corresponding messenger RNA, GAM54 target RNA, herein designated GAM TARGET RNA. GAM54 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM54 RNA, herein designated GAM RNA, binds complementarily to one or more target binding sites located in untranslated regions of GAM54 target RNA, herein designated GAM TARGET RNA. This complementary binding is due to the fact that the nucleotide sequence of GAM54 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM54 RNA may have a different number of target binding sites in untranslated regions of a GAM54 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM54 RNA, herein designated GAM RNA, to target binding sites on GAM54 target RNA, herein designated GAM TARGET RNA, such as BINDING SITE I, BINDING SITE II and BINDING SITE III, inhibits translation of GAM54 target RNA into GAM54 target protein, herein designated GAM TARGET PROTEIN. GAM target protein is therefore outlined by a broken line.

It is appreciated that GAM54 target gene, herein designated TARGET GENE, in fact represents a plurality of GAM54 target genes. The mRNA of each one of this plurality of GAM54 target genes comprises one or more target binding sites, each having a nucleotide sequence which is at least partly complementary to GAM54 RNA, herein designated GAM RNA, and which when bound by GAM54 RNA causes inhibition of translation of respective one or more GAM54 target proteins.

It is further appreciated by one skilled in the art that the mode of translational inhibition illustrated by FIG. 8 with specific reference to translational inhibition exerted by GAM54 gene, herein designated GAM GENE, on one or more GAM54 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM54 correlate with, and may be deduced from, the identity of the target genes which GAM54 binds and inhibits, and the function of these target genes, as elaborated hereinbelow.

A kinase (prka) anchor protein 13 (AKAP13, Accession NM_007200.2) is a GAM54 target gene, herein designated TARGET GENE. AKAP13 BINDING SITE is a target binding site found in the 3' untranslated region of multiple transcripts of mRNA encoded by AKAP13, corresponding to a target binding site such as BINDING SITE I, BINDING SITE II or BINDING SITE III of FIG. 8. Table 4 illustrates the complementarity of the nucleotide sequences of AKAP13 BINDING SITE, designated SEQ ID:18908, to the nucleotide sequence of GAM54 RNA, herein designated GAM RNA, also designated SEQ ID:275.

A function of GAM54 is therefore inhibition of A kinase (prka) anchor protein 13 (AKAP13, Accession NM_007200.2), a gene which regulates subcellular localization of type II cAMP-dependent PKA. Accordingly, utilities of GAM54 include diagnosis, prevention and treatment of diseases and clinical conditions associated with AKAP13.

The function of AKAP13 has been established by previous studies. Gene map locus 15q24-q25 A-kinase anchor proteins (AKAPs; OMIM Ref. No. 602449), such as AKAP13, direct the activity of protein kinase A (PKA; OMIM Ref. No. 176911) by tethering the enzyme near its physiologic substrates. AKAP13 is also known as LBC. Catalytic GDP-GTP exchange factors (GEFs), such as LBC, play an important role in regulating the Rho/Rac GTPase cycle. The Rho/Rac family of small GTPases mediates cytoskeletal reorganization, gene transcription, and cell cycle progression through unique signal transduction pathways. By probing a breast cancer expression library using an interaction cloning strategy for proteins that bind RXR (see OMIM Ref. No. 180245), Rubino et al. (1998) obtained a full-length cDNA encoding LBC, which they called BRX (breast cancer cDNA-encoded nuclear receptor-binding auxiliary protein). The deduced 1,428-amino acid BRX protein contains a region of identity to the LBC sequence identified by Toksoz and Williams (1994) that is preceded by 3 novel regions. A fifth, C-terminal region binds the estrogen receptor (ESR1; 133430). In addition to the tissues detected by Toksoz and Williams (1994), Northern blot analysis by Rubino et al. (1998) revealed BRX mRNA expression in reproductive tissues (ovary and placenta), and a 5.3-kb BRX transcript was detected in breast cancer cell lines, normal breast, and testis. Western blot and immunohistochemic analysis showed that BRX is expressed as a 170-kD protein in mammary epithelial cell lobules and terminal ducts. Binding analysis determined that BRX binds to ESR1, RXR, PPAR (OMIM Ref. No. 170998), and THR (see OMIM Ref. No. 190120). Regions 4 and 5 of BRX were shown to bind independently to the ligand-binding domain near the C terminus of ESR1 without the requirement of other bridging proteins. Overexpression of BRX in the presence of estrogen augmented the activity of an estrogen response element. ESR activation by BRX could be inhibited by a dominant-negative mutant of CDC42 (OMIM Ref. No. 116952). By genomic sequence and somatic cell hybrid analyses, Sterpetti et al. (1999) determined that proto - LBC and onco-LBC both contain N-terminal DH and PH domains; however, proto - LBC has a distinct C terminus absent in the oncoprotein. FISH with onco-LBC probes localized the LBC gene to 15q24-q25 and showed that onco-LBC represents a chimera derived from fusion with an unrelated sequence on 7q36. Northern blot analysis detected variably sized LBC transcripts and extended the known tissue distribution to spleen and a number of cancer cell lines. Immunoblot and thin-layer chromatography analysis showed that both proto - and onco-LBC can promote the formation of GTP-bound RHOA (ARHA; 165390). Mutation analysis indicated that the transforming activity of proto - LBC is increased by truncation of the C terminus, and that the DH and PH domains, but not the chromosome 7 sequence, are required for transformation. Immunoblot analysis determined that the proto - LBC form is in the membrane fraction, while the majority of the onco-LBC product is cytosolic, indicating that the C terminus may play a major role in the subcellular localization and regulation of LBC. Using FISH with onco-LBC probes, Sterpetti et al. (1999) localized the LBC gene to 15q24-q25 and showed that onco-LBC represents a chimera derived from fusion with an unrelated sequence on 7q36.

Full details of the abovementioned studies are described in the following publications, the disclosure of which are hereby incorporated by reference:

Rubino, D.; Driggers, P.; Arbit, D.; Kemp, L.; Miller, B.; Coso, O.; Pagliai, K.; Gray, K.; Gutkind, S.; Segars, J.: Characterization of Brx, a novel Dbl family member that modulates estrogen receptor action. Oncogene 16:2513-2526, 1998; and Sterpetti, P.; Hack, A. A.; Bashar, M. P.; Park, B.; Cheng, S.-D.; Knoll, J. H. M.; Urano, T.; Feig, L. A.; Toksoz, D.: Activation of the Lbc Rho exchange factor proto - oncogene by trunc.

Further studies establishing the function and utilities of AKAP13 are found in John Hopkins OMIM database record ID 604686, and in cited publications listed in Table 5, which are hereby incorporated by reference. Atpase, ca++ transporting, ubiquitous (ATP2A3, Accession NM_174957.1) is another GAM54 target gene, herein designated TARGET GENE. ATP2A3 BINDING SITE is a target binding site found in the 3' untranslated region of multiple transcripts of mRNA encoded by ATP2A3, corresponding to a target binding site such as BINDING SITE I, BINDING SITE II or BINDING SITE III of FIG. 8. Table 4 illustrates the complementarity of the nucleotide sequences of ATP2A3 BINDING SITE, designated SEQ ID:11692, to the nucleotide sequence of GAM54 RNA, herein designated GAM RNA, also designated SEQ ID:275.

Another function of GAM54 is therefore inhibition of Atpase, ca++ transporting, ubiquitous (ATP2A3, Accession NM_174957.1) . Accordingly, utilities of GAM54 include diagnosis, prevention and treatment of diseases and clinical conditions associated with ATP2A3.

Bn51 (bhk21) temperature sensitivity complementing (BN51T, Accession) is another GAM54 target gene, herein designated TARGET GENE. BN51T BINDING SITE is a target binding site found in the 3' untranslated region of mRNA encoded by BN51T, corresponding to a target binding site such as BINDING SITE I, BINDING SITE II or BINDING SITE III of FIG. 8. Table 4 illustrates the complementarity of the nucleotide sequences of BN51T BINDING SITE, designated SEQ ID:16770, to the nucleotide sequence of GAM54 RNA, herein designated GAM RNA, also designated SEQ ID:275.

Another function of GAM54 is therefore inhibition of Bn51 (bhk21) temperature sensitivity complementing (BN51T, Accession), a gene which complements a temperature-sensitive cell cycle mutation in BHK cells. Accordingly, utilities of GAM54 include diagnosis, prevention and treatment of diseases and clinical conditions associated with BN51T.

The function of BN51T has been established by previous studies. Two temperature-sensitive mutants have been isolated from the BHK-21 Syrian hamster cell line. Both of the human genes that complement these mutations, designated ts11 and tsBN51, lead to a block in progression through the G1 phase of the cell cycle at nonpermissive temperatures. Ts11 has been identified as asparagine synthetase; see 108370. The tsBN51 gene encodes a highly charged novel protein of 395 amino acids (Ittmann et al., 1987) whose biochemical function had not yet been determined when Greco et al. (1989) assigned the gene to 8q21 by study of rodent-human hybrid cells and by in situ hybridization using a tsBN51 probe. This is one of a considerable number of temperature-sensitive mutants which have been mapped to various autosomes and in several instances to the X chromosome.

Full details of the abovementioned studies are described in the following publications, the disclosure of which are hereby incorporated by reference:

Ittmann, M.; Greco, A.; Basilico, C.: Isolation of the human gene that complements a temperature-sensitive cell cycle mutation in BHK cells. Molec. Cell. Biol. 7:3386-3393, 1987; and Greco, A.; Ittmann, M.; Barletta, C.; Basilico, C.; Croce, C. M.; Cannizzaro, L. A.; Huebner, K.: Chromosomal localization of human genes required for G(1) progression in mammalian cell.

Further studies establishing the function and utilities of BN51T are found in John Hopkins OMIM database record ID 187280, and in cited publications listed in Table 5, which are hereby incorporated by reference. DKFZP727G051 (Accession XM_045308.6) is another GAM54 target gene, herein designated TARGET GENE. DKFZP727G051 BINDING SITE is a target binding site found in the 3' untranslated region of mRNA encoded by DKFZP727G051, corresponding to a target binding site such as BINDING SITE I, BINDING SITE II or BINDING SITE III of FIG. 8. Table 4 illustrates the complementarity of the nucleotide sequences of DKFZP727G051 BINDING SITE, designated SEQ ID:15727, to the nucleotide sequence of GAM54 RNA, herein designated GAM RNA, also designated SEQ ID:275.

Another function of GAM54 is therefore inhibition of DKFZP727G051 (Accession XM_045308.6). Accordingly, utilities of GAM54 include diagnosis, prevention and treatment of diseases and clinical conditions associated with DKFZP727G051.

Fc fragment of igg, receptor, transporter, alpha (FCGRT, Accession NM_004107.1) is another GAM54 target gene, herein designated TARGET GENE. FCGRT BINDING SITE is a target binding site found in the 3' untranslated region of mRNA encoded by FCGRT, corresponding to a target binding site such as BINDING SITE I, BINDING SITE II or BINDING SITE III of FIG. 8. Table 4 illustrates the complementarity of the nucleotide sequences of FCGRT BINDING SITE, designated SEQ ID:3505, to the nucleotide sequence of GAM54 RNA, herein designated GAM RNA, also designated SEQ ID:275.

Another function of GAM54 is therefore inhibition of Fc fragment of igg, receptor, transporter, alpha (FCGRT, Accession NM_004107.1), a gene which binds to the fc region of monomeric immunoglobulins gamma. Accordingly, utilities of GAM54 include diagnosis, prevention and treatment of diseases and clinical conditions associated with FCGRT.

The function of FCGRT has been established by previous studies. The intestinal epithelium of neonatal mice and rats expresses an Fc receptor (FcRn) that mediates the selective uptake of immunoglobulin G (IgG) in mothers' milk, thereby helping newborn animals to acquire passive immunity. Kandil et al. (1996) noted that the IgG in the milk is bound to FcRn at the apical surface of the intestinal epithelium, and the resultant FcRn-IgG complexes are transcytosed across the epithelium. At the basolateral surface of intestinal epithelial cells, IgG is released from FcRn into blood or tissue fluids. FcRn is structurally similar to the major histocompatibility complex class I molecule, which presents antigenic peptides to T cells. Like the MHC class I molecule, FcRn is made up of a heavy chain (approximately 48 kD) and beta-2-microglobulin (109700; approximately 12 kD). Its heavy chain shows approximately 35% amino acid sequence identity to that of a typical MHC class I molecule. Furthermore, the genomic organizations of the MHC class I and mouse FcRn heavy chain genes are similar in that the signal peptide, the 3 extracellular domains, the transmembrane region, and the cytoplasmic region are all encoded by separate exons. Story et al. (1994) cloned a cDNA encoding the human gene and symbolized it FcRn. Kandil et al. (1996) isolated human genomic clones for the gene (symbolized FCGRT by them) using 2 murine Fcgrt probes. The exonic sequences of the genomic clones are identical to the cDNA sequence described by Story et al. (1994).

Full details of the abovementioned studies are described in the following publications, the disclosure of which are hereby incorporated by reference:

Kandil, E.; Egashira, M.; Miyosi, O.; Niikawa, N.; Ishibashi, T.; Kasahara, M.: The human gene encoding the heavy chain of the major histocompatibility complex class I- like Fc receptor (FCGRT) maps to 19q13.3. Cytogenet. Cell Genet. 73:97-98, 1996; and Story, C. M.; Mikulska, J. E.; Simister, N. E.: A major histocompatibility complex class I-like Fc receptor cloned from human placenta: possible role in transfer of immunoglobulin G f.

Further studies establishing the function and utilities of FCGRT are found in John Hopkins OMIM database record ID 601437, and in cited publications listed in Table 5, which are hereby incorporated by reference. FLJ20422 (Accession NM_017814.1) is another GAM54 target gene, herein designated TARGET GENE. FLJ20422 BINDING SITE is a target binding site found in the 3' untranslated region of mRNA encoded by FLJ20422, corresponding to a target binding site such as BINDING SITE I, BINDING SITE II or BINDING SITE III of FIG. 8. Table 4 illustrates the complementarity of the nucleotide sequences of FLJ20422 BINDING SITE, designated SEQ ID:6197, to the nucleotide sequence of GAM54 RNA, herein designated GAM RNA, also designated SEQ ID:275.

Another function of GAM54 is therefore inhibition of FLJ20422 (Accession NM_017814.1). Accordingly, utilities of GAM54 include diagnosis, prevention and treatment of diseases and clinical conditions associated with FLJ20422.

KIAA0450 (Accession NM_014638.1) is another GAM54 target gene, herein designated TARGET GENE. KIAA0450 BINDING SITE is a target binding site found in the 5' untranslated region of mRNA encoded by KIAA0450, corresponding to a target binding site such as BINDING SITE I, BINDING SITE II or BINDING SITE III of FIG. 8. Table 4 illustrates the complementarity of the nucleotide sequences of KIAA0450 BINDING SITE, designated SEQ ID:1094, to the nucleotide sequence of GAM54 RNA, herein designated GAM RNA, also designated SEQ ID:275.

Another function of GAM54 is therefore inhibition of KIAA0450 (Accession NM_014638.1). Accordingly, utilities of GAM54 include diagnosis, prevention and treatment of diseases and clinical conditions associated with KIAA0450.

LOC145231 (Accession XM_096740.1) is another GAM54 target gene, herein designated TARGET GENE. LOC145231 BINDING SITE is a target binding site found in the 3' untranslated region of mRNA encoded by LOC145231, corresponding to a target binding site such as BINDING SITE I, BINDING SITE II or BINDING SITE III of FIG. 8. Table 4 illustrates the complementarity of the nucleotide sequences of LOC145231 BINDING SITE, designated SEQ ID:19216, to the nucleotide sequence of GAM54 RNA, herein designated GAM RNA, also designated SEQ ID:275.

Another function of GAM54 is therefore inhibition of LOC145231 (Accession XM_096740.1). Accordingly, utilities of GAM54 include diagnosis, prevention and treatment of diseases and clinical conditions associated with LOC145231.

LOC150005 (Accession XM_097795.1) is another GAM54 target gene, herein designated TARGET GENE. LOC150005 BINDING SITE is a target binding site found in the 3' untranslated region of mRNA encoded by LOC150005, corresponding to a target binding site such as BINDING SITE I, BINDING SITE II or BINDING SITE III of FIG. 8. Table 4 illustrates the complementarity of the nucleotide sequences of LOC150005 BINDING SITE, designated SEQ ID:6667, to the nucleotide sequence of GAM54 RNA, herein designated GAM RNA, also designated SEQ ID:275.

Another function of GAM54 is therefore inhibition of LOC150005 (Accession XM_097795.1). Accordingly, utilities of GAM54 include diagnosis, prevention and treatment of diseases and clinical conditions associated with LOC150005.

LOC152580 (Accession) is another GAM54 target gene, herein designated TARGET GENE. LOC152580 BINDING SITE is a target binding site found in the 5' untranslated region of mRNA encoded by LOC152580, corresponding to a target binding site such as BINDING SITE I, BINDING SITE II or BINDING SITE III of FIG. 8. Table 4 illustrates the complementarity of the nucleotide sequences of LOC152580 BINDING SITE, designated SEQ ID:738, to the nucleotide sequence of GAM54 RNA, herein designated GAM RNA, also designated SEQ ID:275.

Another function of GAM54 is therefore inhibition of LOC152580 (Accession). Accordingly, utilities of GAM54 include diagnosis, prevention and treatment of diseases and clinical conditions associated with LOC152580.

LOC253955 (Accession) is another GAM54 target gene, herein designated TARGET GENE. LOC253955 BINDING SITE is a target binding site found in the 3' untranslated region of mRNA encoded by LOC253955, corresponding to a target binding site such as BINDING SITE I, BINDING SITE II or BINDING SITE III of FIG. 8. Table 4 illustrates the complementarity of the nucleotide sequences of LOC253955 BINDING SITE, designated SEQ ID:16736, to the nucleotide sequence of GAM54 RNA, herein designated GAM RNA, also designated SEQ ID:275.

Another function of GAM54 is therefore inhibition of LOC253955 (Accession). Accordingly, utilities of GAM54 include diagnosis, prevention and treatment of diseases and clinical conditions associated with LOC253955.

Matrilin 1, cartilage matrix protein (MATN1, Accession NM_002379.2) is another GAM54 target gene, herein designated TARGET GENE. MATN1 BINDING SITE is a target binding site found in the 5' untranslated region of mRNA encoded by MATN1, corresponding to a target binding site such as BINDING SITE I, BINDING SITE II or BINDING SITE III of FIG. 8. Table 4 illustrates the complementarity of the nucleotide sequences of MATN1 BINDING SITE, designated SEQ ID:18773, to the nucleotide sequence of GAM54 RNA, herein designated GAM RNA, also designated SEQ ID:275.

Another function of GAM54 is therefore inhibition of Matrilin 1, cartilage matrix protein (MATN1, Accession NM_002379.2), a gene which a major component of the extracellular matrix of nonarticular cartilage. Accordingly, utilities of GAM54 include diagnosis, prevention and treatment of diseases and clinical conditions associated with MATN1.

The function of MATN1 has been established by previous studies. Cartilage matrix protein is a major component of the extracellular matrix of nonarticular cartilage. Jenkins et al. (1990) used a partial chicken CMP cDNA probe to isolate 3 overlapping human genomic clones. From one of these clones, a probe containing 2 human CMP exons was isolated and used to map the gene to 1p35 by a combination of Southern blot analysis of somatic cell hybrids and in situ chromosomal hybridization. The genomic probe was also used to screen a human retina cDNA library. The protein sequence predicted by the cDNA clones has 496 amino acids, including a 22-residue signal peptide. The structure of the CMP gene (also symbolized CRTM) and polypeptide were strikingly similar in the chicken and in the human. The human gene spans 12 kb and has 8 exons and 7 introns. By linkage studies, Loughlin et al. (1994) demonstrated that the CRTM gene segregated independently of several heritable chondrodysplasias: hypochondroplasia, achondroplasia, autosomal dominant SED tarda, and multiple epiphyseal dysplasia. CMP was alternatively named matrilin-1 by Deak et al. (1997) when they discovered matrilin-2 (OMIM Ref. No. 602108). Wagener et al. (1997) found that matrilin-1 is a trimer of identical ellipsoid subunits assembled via their C-terminal extension domains in a coiled-coil alpha-helix. The matrilins, including matrilin-2 and matrilin-3 (OMIM Ref. No. 602109), represent a subfamily of extracellular matrix proteins containing the von Willebrand factor type A (vWFA)-like domain. (The vWFA-like domain was first described in von Willebrand factor (OMIM Ref. No. 193400) where it plays a key role in promoting platelet adhesion to the subendothelin. Several vWFA-like domains have been implicated in interactions with collagen.) In some patients with rheumatoid arthritis (RA; 180300) and relapsing polychondritis (RP), an immune response against cartilage collagen II can be detected. However, study of responses against noncollagenous components of cartilage are limited. If an autoimmune response to cartilage proteins is involved in RA and RP, the different patterns of the affected tissues can best be explained if the respective targets are proteins with specific tissue distributions. Whereas RA preferentially affects diarthrodial joints, RP is characterized by inflammatory attacks on cartilage in different organs, and, preferentially, in the perichondrial layer of cartilage. The inflammatory infiltrates consist of neutrophils, lymphocytes, macrophages, and plasma cells. In early lesions, eosinophils can be observed close to the affected cartilage. A classic appearance of the patient with RP is 'saddle nose,' caused by erosive inflammation of the nasal septum. Another typical symptom is an inflamed external ear (89% of cases), which in some instances leads to ossified ear cartilages (OMIM Ref. No. 165670). Occasionally, joints are affected as a seronegative nonerosive arthritis. The most serious complication of RP is the involvement of the laryngotracheal cartilage, sometimes leading to lethal breathing difficulties. Early signs of airway involvement are cough, dysphonia, and tenderness over the thyroid cartilage. Remarkably, RP is associated with the same HLA haplotype (DR4) as RA, which carries with it approximately the same relative risk (Zeuner et al., 1997; Lang et al., 1993). To investigate whether the tissue distribution of relapsing polychondritis may be explained by a specific immune response, Hansson et al. (1999) immunized rats with matrilin-1, which is expressed predominantly in tracheal cartilage. After 2 to 3 weeks, some rats developed severe inspiratory stridor. They had swollen noses and/or epistaxis, but showed neither joint nor outer ear affection. The inflammatory lesions involved chronic active erosions of cartilage. Female rats were more susceptible than males. The disease susceptibility was controlled by MHC genes, some haplotypes being high responders and others resistant, and by non-MHC genes as well, as indicated by strain differences (the LEW strain was susceptible, and the DA strain resistant). All strains mounted a pronounced IgG response to matrilin-1. The findings suggested that different cartilage proteins are involved in pathogenic models of RP and RA.

Full details of the abovementioned studies are described in the following publications, the disclosure of which are hereby incorporated by reference:

Jenkins, R. N.; Osborne-Lawrence, S. L.; Sinclair, A. K.; Eddy, R. L., Jr.; Byers, M. G.; Shows, T. B.; Duby, A. D.: Structure and chromosomal location of the human gene encoding cartilage matrix protein. J. Biol. Chem. 265:19624-19631, 1990; and Deak, F.; Piecha, D.; Bachrati, C.; Paulsson, M.; Kiss, I.: Primary structure and expression of matrilin-2, the closest relative of cartilage matrix protein within the von Willebrand fa.

Further studies establishing the function and utilities of MATN1 are found in John Hopkins OMIM database record ID 115437, and in cited publications listed in Table 5, which are hereby incorporated by reference. Nadh dehydrogenase (ubiquinone) flavoprotein 3, 10 kda (NDUFV3, Accession NM_021075.2) is another GAM54 target gene, herein designated TARGET GENE. NDUFV3 BINDING SITE is a target binding site found in the 5' untranslated region of mRNA encoded by NDUFV3, corresponding to a target binding site such as BINDING SITE I, BINDING SITE II or BINDING SITE III of FIG. 8. Table 4 illustrates the complementarity of the nucleotide sequences of NDUFV3 BINDING SITE, designated SEQ ID:18615, to the nucleotide sequence of GAM54 RNA, herein designated GAM RNA, also designated SEQ ID:275.

Another function of GAM54 is therefore inhibition of Nadh dehydrogenase (ubiquinone) flavoprotein 3, 10 kda (NDUFV3, Accession NM_021075.2), a gene which transports electrons from NADH to ubiquinone. Accordingly, utilities of GAM54 include diagnosis, prevention and treatment of diseases and clinical conditions associated with NDUFV3.

The function of NDUFV3 has been established by previous studies. NADH:ubiquinone oxidoreductase (complex I; EC 1.6.5.3) is an inner mitochondrial membrane-bound multisubunit enzyme complex. Complex I consists of at least 41 subunits of which 7 are encoded by the mitochondrial genome. See MTND1 (OMIM Ref. No. 516000) through MTND6 (OMIM Ref. No. 516006). As one of the complexes of the mitochondrial respiratory chain, complex I functions in the catalysis of the rotenone-sensitive oxidation of NADH and the reduction of ubiquinone. By means of chaotropic agents, complex I can be resolved into 2 hydrophilic fractions, the flavoprotein fraction and the iron-protein fraction, and a hydrophobic fraction. The flavoprotein fraction comprises the 51-, 24-, and 10-kD subunits, all encoded by the nuclear genes NDUFV1 (OMIM Ref. No. 161015), NDUFV2 (OMIM Ref. No. 600532), and NDUFV3, respectively. This fraction plays a catalytic role in the oxidation of NADH as it is associated with flavoprotein and NAD binding. The 51-kD and 24-kD subunits are involved in electron transfer. The function of the 10-kD protein is unknown. The human gene for the 10-kD flavoprotein subunit was completely cloned and sequenced by de Coo et al. (1997). The NDUFV3 gene was found to contain 3 exons, spanning 20 kb. The open reading frame contains a 34-codon import sequence and a 74-codon mature protein sequence. Its homology to bovine and rat protein sequence was found but not to any other known protein. Northern blot analysis showed that the NDUFV3 gene is ubiquitously expressed. By fluorescence in situ hybridization, de Coo et al. (1997) assigned the NDUFV3 gene to 21q22.3, where it may play a dosage-dependent role in the phenotype of Down syndrome (OMIM Ref. No. 190685). Berry et al. (2000) found that NDUFV3 is located approximately 120 kb telomeric to PDE9A (OMIM Ref. No. 602973).

Full details of the abovementioned studies are described in the following publications, the disclosure of which are hereby incorporated by reference:

Berry, A.; Scott, H. S.; Kudoh, J.; Talior, I.; Korostishevsky, M.; Wattenhofer, M.; Guipponi, M.; Barras, C.; Rossier, C.; Shibuy, K.; Wang, J.; Kawasaki, K.; Asakawa, S.; Minoshima, S.; Shimizu, N.; Antonarakis, S.; Bonne-Tamir, B.: Refined localization of autosomal recessive nonsyndromic deafness DFNB10 locus using 34 novel microsatellite markers, genomic structure, and exclusion of six known genes in the region. Genomics 68:22-29, 2000; and de Coo, R. F. M.; Buddiger, P.; Smeets, H. J. M.; van Oost, B. A.: Molecular cloning and characterization of the human mitochondrial NADH:oxidoreductase 10-kDa gene (NDUFV3). Genomics.

Further studies establishing the function and utilities of NDUFV3 are found in John Hopkins OMIM database record ID 602184, and in cited publications listed in Table 5, which are hereby incorporated by reference. OS4 (Accession NM_005730.2) is another GAM54 target gene, herein designated TARGET GENE. OS4 BINDING SITE is a target binding site found in the 3' untranslated region of mRNA encoded by OS4, corresponding to a target binding site such as BINDING SITE I, BINDING SITE II or BINDING SITE III of FIG. 8. Table 4 illustrates the complementarity of the nucleotide sequences of OS4 BINDING SITE, designated SEQ ID:19362, to the nucleotide sequence of GAM54 RNA, herein designated GAM RNA, also designated SEQ ID:275.

Another function of GAM54 is therefore inhibition of OS4 (Accession NM_005730.2). Accordingly, utilities of GAM54 include diagnosis, prevention and treatment of diseases and clinical conditions associated with OS4.

Paired box gene 8 (PAX8, Accession NM_013992.1) is another GAM54 target gene, herein designated TARGET GENE. PAX8 BINDING SITE is a target binding site found in the 5' untranslated region of multiple transcripts of mRNA encoded by PAX8, corresponding to a target binding site such as BINDING SITE I, BINDING SITE II or BINDING SITE III of FIG. 8. Table 4 illustrates the complementarity of the nucleotide sequences of PAX8 BINDING SITE, designated SEQ ID:1852, to the nucleotide sequence of GAM54 RNA, herein designated GAM RNA, also designated SEQ ID:275.

Another function of GAM54 is therefore inhibition of Paired box gene 8 (PAX8, Accession NM_013992.1), a gene which maintaines the functional differentiation of thyroid cell type and therefore is associated with Thyroid dysgenesis.

Accordingly, utilities of GAM54 include diagnosis, prevention and treatment of Thyroid dysgenesis, and of other diseases and clinical conditions associated with PAX8.

The function of PAX8 has been established by previous studies. Pasca di Magliano et al. (2000) demonstrated that PAX8 is sufficient to activate expression of endogenous genes encoding thyroglobulin (TG; 188450), thyroperoxidase (TPO; 274500), and sodium/iodide symporter (SLC5A5; 601843), all thyroid-specific genes. The cell system they used provided direct evidence for the ability of PAX8 to activate transcription of thyroid-specific genes at their chromosomal locus and strongly suggested a fundamental role of this transcription factor in the maintenance of functional differentiation in thyroid cells. Moreover, they showed that PAX8 and thyroid transcription factor-1 (OMIM Ref. No. 600635) cooperate in the activation of the thyroglobulin promoter.

Animal model experiments lend further support to the function of PAX8. The thyroid gland develops from 2 distinct embryonic lineages: follicular cells, which produce thyroxine and are of endodermal origin, and parafollicular C-cells, which produce calcitonin and are of neural crest origin. Mice lacking thyroid transcription factor-1 (OMIM Ref. No. 600635) lack both cell types and thus are unable to develop a thyroid gland. By analysis of Pax8 knockout mice (Pax8 -/-), Mansouri et al. (1998) demonstrated that Pax8 is required for the formation of the follicular cells in the thyroid. They presented evidence that Pax8 is necessary for providing cues for the differentiation of component endoderm primordia into thyroxine-producing follicular cells.

It is appreciated that the abovementioned animal model for PAX8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pasca di Magliano, M.; Di Lauro, R.; Zannini, M.: Pax8 has a key role in thyroid cell differentiation. Proc. Nat. Acad. Sci. 97:13144-13149, 2000; and Mansouri, A.; Chowdhury, K.; Gruss, P.: Follicular cells of the thyroid gland require Pax8 gene function. Nature Genet. 19:87-90, 1998.

Further studies establishing the function and utilities of PAX8 are found in John Hopkins OMIM database record ID 167415, and in cited publications listed in Table 5, which are hereby incorporated by reference. Pdz domain containing 2 (PDZD2, Accession) is another GAM54 target gene, herein designated TARGET GENE. PDZD2 BINDING SITE is a target binding site found in the 5' untranslated region of mRNA encoded by PDZD2, corresponding to a target binding site such as BINDING SITE I, BINDING SITE II or BINDING SITE III of FIG. 8. Table 4 illustrates the complementarity of the nucleotide sequences of PDZD2 BINDING SITE, designated SEQ ID:16711, to the nucleotide sequence of GAM54 RNA, herein designated GAM RNA, also designated SEQ ID:275.

Another function of GAM54 is therefore inhibition of Pdz domain containing 2 (PDZD2, Accession). Accordingly, utilities of GAM54 include diagnosis, prevention and treatment of diseases and clinical conditions associated with PDZD2.

PI4KII (Accession NM_018425.2) is another GAM54 target gene, herein designated TARGET GENE. PI4KII BINDING SITE is a target binding site found in the 3' untranslated region of mRNA encoded by PI4KII, corresponding to a target binding site such as BINDING SITE I, BINDING SITE II or BINDING SITE III of FIG. 8. Table 4 illustrates the complementarity of the nucleotide sequences of PI4KII BINDING SITE, designated SEQ ID:4231, to the nucleotide sequence of GAM54 RNA, herein designated GAM RNA, also designated SEQ ID:275.

Another function of GAM54 is therefore inhibition of PI4KII (Accession NM_018425.2). Accordingly, utilities of GAM54 include diagnosis, prevention and treatment of diseases and clinical conditions associated with PI4KII.

RCD-8 (Accession NM_014329.2) is another GAM54 target gene, herein designated TARGET GENE. RCD-8 BINDING SITE is a target binding site found in the 3' untranslated region of mRNA encoded by RCD-8, corresponding to a target binding site such as BINDING SITE I, BINDING SITE II or BINDING SITE III of FIG. 8. Table 4 illustrates the complementarity of the nucleotide sequences of RCD-8 BINDING SITE, designated SEQ ID:7302, to the nucleotide sequence of GAM54 RNA, herein designated GAM RNA, also designated SEQ ID:275.

Another function of GAM54 is therefore inhibition of RCD-8 (Accession NM_014329.2). Accordingly, utilities of GAM54 include diagnosis, prevention and treatment of diseases and clinical conditions associated with RCD-8.

Regulator of g-protein signalling 11 (RGS11, Accession NM_003834.1) is another GAM54 target gene, herein designated TARGET GENE. RGS11 BINDING SITE is a target binding site found in the 3' untranslated region of mRNA encoded by RGS11, corresponding to a target binding site such as BINDING SITE I, BINDING SITE II or BINDING SITE III of FIG. 8. Table 4 illustrates the complementarity of the nucleotide sequences of RGS11 BINDING SITE, designated SEQ ID:3919, to the nucleotide sequence of GAM54 RNA, herein designated GAM RNA, also designated SEQ ID:275.

Another function of GAM54 is therefore inhibition of Regulator of g-protein signalling 11 (RGS11, Accession NM_003834.1). Accordingly, utilities of GAM54 include diagnosis, prevention and treatment of diseases and clinical conditions associated with RGS11.

XAP135 (Accession) is another GAM54 target gene, herein designated TARGET GENE. XAP135 BINDING SITE is a target binding site found in the 5' untranslated region of mRNA encoded by XAP135, corresponding to a target binding site such as BINDING SITE I, BINDING SITE II or BINDING SITE III of FIG. 8. Table 4 illustrates the complementarity of the nucleotide sequences of XAP135 BINDING SITE, designated SEQ ID:4269, to the nucleotide sequence of GAM54 RNA, herein designated GAM RNA, also designated SEQ ID:275.

Another function of GAM54 is therefore inhibition of XAP135 (Accession). Accordingly, utilities of GAM54 include diagnosis, prevention and treatment of diseases and clinical conditions associated with XAP135.

Zinc finger, dhhc domain containing 3 (ZDHHC3, Accession NM_016598.1) is another GAM54 target gene, herein designated TARGET GENE. ZDHHC3 BINDING SITE is a target binding site found in the 3' untranslated region of mRNA encoded by ZDHHC3, corresponding to a target binding site such as BINDING SITE I, BINDING SITE II or BINDING SITE III of FIG. 8. Table 4 illustrates the complementarity of the nucleotide sequences of ZDHHC3 BINDING SITE, designated SEQ ID:16992, to the nucleotide sequence of GAM54 RNA, herein designated GAM RNA, also designated SEQ ID:275.

Another function of GAM54 is therefore inhibition of Zinc finger, dhhc domain containing 3 (ZDHHC3, Accession NM_016598.1). Accordingly, utilities of GAM54 include diagnosis, prevention and treatment of diseases and clinical conditions associated with ZDHHC3.

FIG. 8 further provides a conceptual description of a novel bioinformatically detected of the present invention, referred to here as Genomic Address Messenger 55 (GAM55), which modulates expression of respective target genes thereof, the function and utility of which target genes is known in the art.

GAM55 is a novel bioinformatically detected regulatory, non protein coding, micro RNA (miRNA) gene. The method by which GAM55 was detected is described hereinabove with reference to FIGS. 8-15.

GAM55 gene, herein designated GAM GENE, and GAM55 target gene, herein designated TARGET GENE, are human genes contained in the human genome.

GAM55 gene encodes a GAM55 precursor RNA, herein designated GAM PRECURSOR RNA. Similar to other miRNA genes, and unlike most ordinary genes, GAM55 precursor RNA does not encode a protein. A nucleotide sequence identical or highly similar to the nucleotide sequence of GAM55 precursor RNA is designated SEQ ID:5, and is provided hereinbelow with reference to the sequence listing part. Nucleotide sequence SEQ ID:5 is located at position 69071145 relative to chromosome 16.

GAM55 precursor RNA folds onto itself, forming GAM55 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM55 precursor RNA folds onto itself, forming GAM55 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM55 precursor RNA, designated SEQ-ID:5, and a schematic representation of a predicted secondary folding of GAM55 folded precursor RNA are further described with reference to Table 2, hereby incorporated by reference.

An enzyme complex designated DICER COMPLEX, 'dices' the GAM55 folded precursor RNA into GAM55 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM55 RNA is designated SEQ ID:387, and is provided hereinbelow with references to the sequence listing part and Table 3, hereby incorporated by reference.

GAM55 target gene, herein designated TARGET GENE, encodes a corresponding messenger RNA, GAM55 target RNA, herein designated GAM TARGET RNA. GAM55 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM55 RNA, herein designated GAM RNA, binds complementarily to one or more target binding sites located in untranslated regions of GAM55 target RNA, herein designated GAM TARGET RNA. This complementary binding is due to the fact that the nucleotide sequence of GAM55 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM55 RNA may have a different number of target binding sites in untranslated regions of a GAM55 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM55 RNA, herein designated GAM RNA, to target binding sites on GAM55 target RNA, herein designated GAM TARGET RNA, such as BINDING SITE I, BINDING SITE II and BINDING SITE III, inhibits translation of GAM55 target RNA into GAM55 target protein, herein designated GAM TARGET PROTEIN. GAM target protein is therefore outlined by a broken line.

It is appreciated that GAM55 target gene, herein designated TARGET GENE, in fact represents a plurality of GAM55 target genes. The mRNA of each one of this plurality of GAM55 target genes comprises one or more target binding sites, each having a nucleotide sequence which is at least partly complementary to GAM55 RNA, herein designated GAM RNA, and which when bound by GAM55 RNA causes inhibition of translation of respective one or more GAM55 target proteins.

It is further appreciated by one skilled in the art that the mode of translational inhibition illustrated by FIG. 8 with specific reference to translational inhibition exerted by GAM55 gene, herein designated GAM GENE, on one or more GAM55 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM55 correlate with, and may be deduced from, the identity of the target genes which GAM55 binds and inhibits, and the function of these target genes, as elaborated hereinbelow.

Actin binding lim protein 1 (ABLIM1, Accession NP_006710.2) is a GAM55 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:18812, to the nucleotide sequence of GAM55 RNA, herein designated GAM RNA, also designated SEQ ID:387.

A function of GAM55 is therefore inhibition of Actin binding lim protein 1 (ABLIM1, Accession NP_006710.2).

Accordingly, utilities of GAM55 include diagnosis, prevention and treatment of diseases and clinical conditions associated with ABLIM1.

Actin binding lim protein 1 (ABLIM1, Accession NP_002304.2) is another GAM55 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:18812, to the nucleotide sequence of GAM55 RNA, herein designated GAM RNA, also designated SEQ ID:387.

Another function of GAM55 is therefore inhibition of Actin binding lim protein 1 (ABLIM1, Accession NP_002304.2). Accordingly, utilities of GAM55 include diagnosis, prevention and treatment of diseases and clinical conditions associated with ABLIM1.

Actin binding lim protein 1 (ABLIM1, Accession NP_006711.2) is another GAM55 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:18812, to the nucleotide sequence of GAM55 RNA, herein designated GAM RNA, also designated SEQ ID:387.

Another function of GAM55 is therefore inhibition of Actin binding lim protein 1 (ABLIM1, Accession NP_006711.2). Accordingly, utilities of GAM55 include diagnosis, prevention and treatment of diseases and clinical conditions associated with ABLIM1.

Activin a receptor, type ii (ACVR2, Accession NP_001607.1) is another GAM55 target gene, herein designated TARGET GENE. ACVR2 BINDING SITE is a target binding site found in the 3' untranslated region of mRNA encoded by ACVR2, corresponding to a target binding site such as BINDING SITE I, BINDING SITE II or BINDING SITE III of FIG. 8. Table 4 illustrates the complementarity of the nucleotide sequences of ACVR2 BINDING SITE, designated SEQ ID:11850, to the nucleotide sequence of GAM55 RNA, herein designated GAM RNA, also designated SEQ ID:387.

Another function of GAM55 is therefore inhibition of Activin a receptor, type ii (ACVR2, Accession NP_001607.1). Accordingly, utilities of GAM55 include diagnosis, prevention and treatment of diseases and clinical conditions associated with ACVR2.

Adaptor-related protein complex 2, beta 1 subunit (AP2B1, Accession NP_001273.1) is another GAM55 target gene, herein designated TARGET GENE. AP2B1 BINDING SITE is a target binding site found in the 3' untranslated region of mRNA encoded by AP2B1, corresponding to a target binding site such as BINDING SITE I, BINDING SITE II or BINDING SITE III of FIG. 8. Table 4 illustrates the complementarity of the nucleotide sequences of AP2B1 BINDING SITE, designated SEQ ID:7416, to the nucleotide sequence of GAM55 RNA, herein designated GAM RNA, also designated SEQ ID:387.

Another function of GAM55 is therefore inhibition of Adaptor-related protein complex 2, beta 1 subunit (AP2B1, Accession NP_001273.1), a gene which links clathrin to receptors in coated vesicles. Accordingly, utilities of GAM55 include diagnosis, prevention and treatment of diseases and clinical conditions associated with AP2B1.

The function of AP2B1 has been established by previous studies. The beta adaptin subunit of the clathrin coat assembly complex, also referred to as AP2-beta, was cloned from human, rat and bovine cDNA libraries by Ponnambalam et al. (1990) who found that the predicted 937-amino acid proteins are totally conserved between species. The protein is part of the AP2 coat assembly protein complex (see OMIM Ref. No. 601024) and links clathrin (OMIM Ref. No. 118960) to receptors in the coated vesicles. Druck et al. (1995) used a probe from the 3-prime UTR of the human cDNA to map the gene to chromosome 17. Hybrids with portions of chromosome 17 were then used to localize CLAPB1 to 17q11.2-q12.

Full details of the abovementioned studies are described in the following publications, the disclosure of which are hereby incorporated by reference:

Druck, T.; Gu, Y.; Prabhala. G.; Cannizzaro, L. A.; Park, S.-H.; Huebner, K.; Keen, J. H.: Chromosome localization of human genes for clathrin adaptor polypeptides AP2-beta and AP50 and the clathrin-binding protein, VCP. Genomics 30:94-97, 1995; and Ponnambalam, S.; Robinson, M. S.; Jackson, A. P.; Peiperl, L.; Parham, P.: Conservation and diversity in families of coated vesicle adaptins. J. Biol. Chem. 265:4814-4820, 1990.

Further studies establishing the function and utilities of AP2B1 are found in John Hopkins OMIM database record ID 601025, and in cited publications listed in Table 5, which are hereby incorporated by reference. APOARGC (Accession NP_663779.1) is another GAM55 target gene, herein designated TARGET GENE. APOARGC BINDING SITE is a target binding site found in the 3' untranslated region of multiple transcripts of mRNA encoded by APOARGC, corresponding to a target binding site such as BINDING SITE I, BINDING SITE II or BINDING SITE III of FIG. 8. Table 4 illustrates the complementarity of the nucleotide sequences of APOARGC BINDING SITE, designated SEQ ID:6057, to the nucleotide sequence of GAM55 RNA, herein designated GAM RNA, also designated SEQ ID:387.

Another function of GAM55 is therefore inhibition of APOARGC (Accession NP_663779.1). Accordingly, utilities of GAM55 include diagnosis, prevention and treatment of diseases and clinical conditions associated with APOARGC.

APOARGC (Accession NP_077818.1) is another GAM55 target gene, herein designated TARGET GENE. APOARGC BINDING SITE is a target binding site found in the 3' untranslated region of multiple transcripts of mRNA encoded by APOARGC, corresponding to a target binding site such as BINDING SITE I, BINDING SITE II or BINDING SITE III of FIG. 8. Table 4 illustrates the complementarity of the nucleotide sequences of APOARGC BINDING SITE, designated SEQ ID:6057, to the nucleotide sequence of GAM55 RNA, herein designated GAM RNA, also designated SEQ ID:387.

Another function of GAM55 is therefore inhibition of APOARGC (Accession NP_077818.1). Accordingly, utilities of GAM55 include diagnosis, prevention and treatment of diseases and clinical conditions associated with APOARGC.

Breast carcinoma amplified sequence 1 (BCAS1, Accession NP_003648.1) is another GAM55 target gene, herein designated TARGET GENE. BCAS1 BINDING SITE is a target binding site found in the 3' untranslated region of mRNA encoded by BCAS1, corresponding to a target binding site such as BINDING SITE I, BINDING SITE II or BINDING SITE III of FIG. 8. Table 4 illustrates the complementarity of the nucleotide sequences of BCAS1 BINDING SITE, designated SEQ ID:6939, to the nucleotide sequence of GAM55 RNA, herein designated GAM RNA, also designated SEQ ID:387.

Another function of GAM55 is therefore inhibition of Breast carcinoma amplified sequence 1 (BCAS1, Accession NP_003648.1). Accordingly, utilities of GAM55 include diagnosis, prevention and treatment of diseases and clinical conditions associated with BCAS1.

BOP (Accession XP_097915.2) is another GAM55 target gene, herein designated TARGET GENE. BOP BINDING SITE is a target binding site found in the 3' untranslated region of mRNA encoded by BOP, corresponding to a target binding site such as BINDING SITE I, BINDING SITE II or BINDING SITE III of FIG. 8. Table 4 illustrates the complementarity of the nucleotide sequences of BOP BINDING SITE, designated SEQ ID:18720, to the nucleotide sequence of GAM55 RNA, herein designated GAM RNA, also designated SEQ ID:387.

Another function of GAM55 is therefore inhibition of BOP (Accession XP_097915.2). Accordingly, utilities of GAM55 include diagnosis, prevention and treatment of diseases and clinical conditions associated with BOP.

Bromodomain containing 2 (BRD2, Accession NP_005095.1) is another GAM55 target gene, herein designated TARGET GENE. BRD2 BINDING SITE is a target binding site found in the 3' untranslated region of mRNA encoded by BRD2, corresponding to a target binding site such as BINDING SITE I, BINDING SITE II or BINDING SITE III of FIG. 8. Table 4 illustrates the complementarity of the nucleotide sequences of BRD2 BINDING SITE, designated SEQ ID:3080, to the nucleotide sequence of GAM55 RNA, herein designated GAM RNA, also designated SEQ ID:387.

Another function of GAM55 is therefore inhibition of Bromodomain containing 2 (BRD2, Accession NP_005095.1). Accordingly, utilities of GAM55 include diagnosis, prevention and treatment of diseases and clinical conditions associated with BRD2.

Chromosome 1 open reading frame 21 (C1orf21, Accession NP_110433.1) is another GAM55 target gene, herein designated TARGET GENE. C1orf21 BINDING SITE is a target binding site found in the 3' untranslated region of mRNA encoded by C1orf21, corresponding to a target binding site such as BINDING SITE I, BINDING SITE II or BINDING SITE III of FIG. 8. Table 4 illustrates the complementarity of the nucleotide sequences of C1orf21 BINDING SITE, designated SEQ ID:3784, to the nucleotide sequence of GAM55 RNA, herein designated GAM RNA, also designated SEQ ID:387.

Another function of GAM55 is therefore inhibition of Chromosome 1 open reading frame 21 (C1orf21, Accession NP_110433.1). Accordingly, utilities of GAM55 include diagnosis, prevention and treatment of diseases and clinical conditions associated with C1orf21.

Chromosome 21 open reading frame 45 (C21orf45, Accession NP_061817.1) is another GAM55 target gene, herein designated TARGET GENE. C21orf45 BINDING SITE is a target binding site found in the 5' untranslated region of mRNA encoded by C21orf45, corresponding to a target binding site such as BINDING SITE I, BINDING SITE II or BINDING SITE III of FIG. 8. Table 4 illustrates the complementarity of the nucleotide sequences of C21orf45 BINDING SITE, designated SEQ ID:3897, to the nucleotide sequence of GAM55 RNA, herein designated GAM RNA, also designated SEQ ID:387.

Another function of GAM55 is therefore inhibition of Chromosome 21 open reading frame 45 (C21orf45, Accession NP_061817.1). Accordingly, utilities of GAM55 include diagnosis, prevention and treatment of diseases and clinical conditions associated with C21orf45.

C6orf149 (Accession NP_065141.2) is another GAM55 target gene, herein designated TARGET GENE. C6orf149 BINDING SITE is a target binding site found in the 5' untranslated region of mRNA encoded by C6orf149, corresponding to a target binding site such as BINDING SITE I, BINDING SITE II or BINDING SITE III of FIG. 8. Table 4 illustrates the complementarity of the nucleotide sequences of C6orf149 BINDING SITE, designated SEQ ID:15036, to the nucleotide sequence of GAM55 RNA, herein designated GAM RNA, also designated SEQ ID:387.

Another function of GAM55 is therefore inhibition of C6orf149 (Accession NP_065141.2). Accordingly, utilities of GAM55 include diagnosis, prevention and treatment of diseases and clinical conditions associated with C6orf149.

Caveolin 2 (CAV2, Accession NP_001224.1) is another GAM55 target gene, herein designated TARGET GENE. CAV2 BINDING SITE is a target binding site found in the 3' untranslated region of mRNA encoded by CAV2, corresponding to a target binding site such as BINDING SITE I, BINDING SITE II or BINDING SITE III of FIG. 8. Table 4 illustrates the complementarity of the nucleotide sequences of CAV2 BINDING SITE, designated SEQ ID:3984, to the nucleotide sequence of GAM55 RNA, herein designated GAM RNA, also designated SEQ ID:387.

Another function of GAM55 is therefore inhibition of Caveolin 2 (CAV2, Accession NP_001224.1), a gene which may function as an accessory protein in conjunction with caveolin-1 and act as a scaffolding protein within caveolar membranes. Accordingly, utilities of GAM55 include diagnosis, prevention and treatment of diseases and clinical conditions associated with CAV2.

The function of CAV2 has been established by previous studies. Scherer et al. (1996) identified a protein related to caveolin-1 (CAV1; 601047) through microsequencing of adipocyte-derived caveolin-enriched membranes. They called the novel protein caveolin-2. They stated that caveolins-1 and -2 are similar in most respects. For both caveolin-1 and caveolin-2, mRNAs are most abundantly expressed in white adipose tissue and are induced during adipocyte differentiation. Caveolin-2 localizes with caveolin-1, indicating that caveolin-2 also localizes to caveolae. However, caveolin-1 and caveolin-2 differ in their functional interactions with heterotrimeric G proteins, possibly explaining why caveolins 1 and 2 are coexpressed within a single cell. Specifically, Scherer et al. (1996) found that whereas residues 82 to 101 of murine caveolin-1 functionally suppressed the basal GTPase activity of purified heterotrimeric G proteins, the corresponding region of caveolin-2 (which is 30% identical) had a stimulatory effect. Engelman et al. (1998) reviewed the molecular genetics of the caveolin gene family. They compared the genomic organization of the CAV1, CAV2, and CAV3 (OMIM Ref. No. 601253) genes. The CAV1 gene contains 3 exons, while the human CAV2 gene contains 2 exons. The boundary of the last exon of CAV1 and CAV2 are analogous, suggesting that they arose through gene duplication. The genes encoding murine caveolin-1 and -2 are colocalized within the A2 region of mouse chromosome 6 (Engelman et al., 1998). By FISH, Engelman et al. (1998) mapped CAV1 and CAV2 to 7q31.1-q31.2. (CA)n microsatellite repeat marker analysis of the CAV genomic clones indicated that they contain the marker D7S522, located at 7q31.1. Thus, the 2 genes map to 7q31 in a region of conserved synteny with murine 6-A2 (2,3:Engelman et al., 1998, 1998).

Full details of the abovementioned studies are described in the following publications, the disclosure of which are hereby incorporated by reference:

Engelman, J. A.; Zhang, X. L.; Galbiati, F.; Lisanti, M. P.: Chromosomal localization, genomic organization, and developmental expression of the murine caveolin gene family (Cav-1, -2, and -3): Cav-1 and Cav-2 genes map to a known tumor suppressor locus (6-A2/7q31). FEBS Lett. 429:330-336, 1998; and Scherer, P. E.; Okamoto, T.; Chun, M.; Nishimoto, I.; Lodish, H. F.; Lisanti, M. P.: Identification, sequence, and expression of caveolin-2 defines a caveolin gene family. Proc. Nat. Ac.

Further studies establishing the function and utilities of CAV2 are found in John Hopkins OMIM database record ID 601048, and in cited publications listed in Table 5, which are hereby incorporated by reference. Core-binding factor, runt domain, alpha subunit 2; translocated to, 2 (CBFA2T2, Accession NP_005084.1) is another GAM55 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:4255, to the nucleotide sequence of GAM55 RNA, herein designated GAM RNA, also designated SEQ ID:387.

Another function of GAM55 is therefore inhibition of Core-binding factor, runt domain, alpha subunit 2; translocated to, 2 (CBFA2T2, Accession NP_005084.1), a gene which is a putative transcription factor. Accordingly, utilities of GAM55 include diagnosis, prevention and treatment of diseases and clinical conditions associated with CBFA2T2.

The function of CBFA2T2 has been established by previous studies. To identify potential new genes homologous to ETO (OMIM Ref. No. 133435), Fracchiolla et al. (1998) screened the EST database using the entire ETO cDNA sequence as a probe. Among the ESTs identified, they selected 2 overlapping clones and sequenced them to completion. A putative translation initiation site was identified by the presence of a strong Kozak consensus sequence, followed by a 1,725-bp open reading frame coding for a putative protein of 575 amino acids. They named this gene EHT for 'ETO homolog on chromosome twenty.' The putative EHT protein is approximately 65% identical to ETO/MTG8 (OMIM Ref. No. 133435) and approximately 24% identical to an ETO Drosophila homolog, Nervy. Kitabayashi et al. (1998) reported the cloning of a similar cDNA, which they named MTGR1 (myeloid translocation gene-related protein-1). Their data suggested the presence of 2 alternative 5-prime ends of the MTGR1/EHT gene. Cytogenetic studies had shown that the 20q11 region is deleted in approximately 10% of cases of polycythemia vera, approximately 5% of cases of myelodysplastic syndromes, and approximately 3% of cases of acute myeloid leukemias. Kitabayashi et al. (1998) showed the direct interaction of MTGR1 in the AML1-MTG8 fusion protein, leading to an enhancement of cell proliferation mediated by granulocyte colony-stimulating factor (CSF3; 138970) in a murine myeloid model. This suggested that MTGR1 has an oncogenic rather than a tumor suppressor activity. Nevertheless, when MTGR1 was transfected alone into the same murine myeloid model cell line, the proliferative response to CSF was lower than that in the normal control, thus suggesting a possible negative growth control in normal cells.

Full details of the abovementioned studies are described in the following publications, the disclosure of which are hereby incorporated by reference:

Fracchiolla, N. S.; Colombo, G.; Finelli, P.; Maiolo, A. T.; Neri, A.: EHT, a new member of the MTG8/ETO gene family, maps on 20q11 region and is deleted in acute myeloid leukemias. (Letter) Blood 92:3481-3484, 1998; and Kitabayashi, I.; Ida, K.; Morohoshi, F.; Yokoyama, A.; Mitsuhashi, N.; Shimizu, K.; Nomura, N.; Hayashi, Y.; Ohki, M.: The AML1-MTG8 leukemic fusion protein forms a complex with a novel.

Further studies establishing the function and utilities of CBFA2T2 are found in John Hopkins OMIM database record ID 603672, and in cited publications listed in Table 5, which are hereby incorporated by reference. Core-binding factor, runt domain, alpha subunit 2; translocated to, 2 (CBFA2T2, Accession NP_787060.1) is another GAM55 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:4255, to the nucleotide sequence of GAM55 RNA, herein designated GAM RNA, also designated SEQ ID:387.

Another function of GAM55 is therefore inhibition of Core-binding factor, runt domain, alpha subunit 2; translocated to, 2 (CBFA2T2, Accession NP_787060.1), a gene which is a putative transcription factor. Accordingly, utilities of GAM55 include diagnosis, prevention and treatment of diseases and clinical conditions associated with CBFA2T2.

The function of CBFA2T2 has been established by previous studies. To identify potential new genes homologous to ETO (OMIM Ref. No. 133435), Fracchiolla et al. (1998) screened the EST database using the entire ETO cDNA sequence as a probe. Among the ESTs identified, they selected 2 overlapping clones and sequenced them to completion. A putative translation initiation site was identified by the presence of a strong Kozak consensus sequence, followed by a 1,725-bp open reading frame coding for a putative protein of 575 amino acids. They named this gene EHT for 'ETO homolog on chromosome twenty.' The putative EHT protein is approximately 65% identical to ETO/MTG8 (OMIM Ref. No. 133435) and approximately 24% identical to an ETO Drosophila homolog, Nervy. Kitabayashi et al. (1998) reported the cloning of a similar cDNA, which they named MTGR1 (myeloid translocation gene-related protein-1). Their data suggested the presence of 2 alternative 5-prime ends of the MTGR1/EHT gene. Cytogenetic studies had shown that the 20q11 region is deleted in approximately 10% of cases of polycythemia vera, approximately 5% of cases of myelodysplastic syndromes, and approximately 3% of cases of acute myeloid leukemias. Kitabayashi et al. (1998) showed the direct interaction of MTGR1 in the AML1-MTG8 fusion protein, leading to an enhancement of cell proliferation mediated by granulocyte colony-stimulating factor (CSF3; 138970) in a murine myeloid model. This suggested that MTGR1 has an oncogenic rather than a tumor suppressor activity. Nevertheless, when MTGR1 was transfected alone into the same murine myeloid model cell line, the proliferative response to CSF was lower than that in the normal control, thus suggesting a possible negative growth control in normal cells.

Full details of the abovementioned studies are described in the following publications, the disclosure of which are hereby incorporated by reference:

Fracchiolla, N. S.; Colombo, G.; Finelli, P.; Maiolo, A. T.; Neri, A.: EHT, a new member of the MTG8/ETO gene family, maps on 20q11 region and is deleted in acute myeloid leukemias. (Letter) Blood 92:3481-3484, 1998; and Kitabayashi, I.; Ida, K.; Morohoshi, F.; Yokoyama, A.; Mitsuhashi, N.; Shimizu, K.; Nomura, N.; Hayashi, Y.; Ohki, M.: The AML1-MTG8 leukemic fusion protein forms a complex with a novel.

Further studies establishing the function and utilities of CBFA2T2 are found in John Hopkins OMIM database record ID 603672, and in cited publications listed in Table 5, which are hereby incorporated by reference. CGI-01 (Accession NP_057019.2) is another GAM55 target gene, herein designated TARGET GENE. CGI-01 BINDING SITE is a target binding site found in the 3' untranslated region of mRNA encoded by CGI-01, corresponding to a target binding site such as BINDING SITE I, BINDING SITE II or BINDING SITE III of FIG. 8. Table 4 illustrates the complementarity of the nucleotide sequences of CGI-01 BINDING SITE, designated SEQ ID:19545, to the nucleotide sequence of GAM55 RNA, herein designated GAM RNA, also designated SEQ ID:387.

Another function of GAM55 is therefore inhibition of CGI-01 (Accession NP_057019.2). Accordingly, utilities of GAM55 include diagnosis, prevention and treatment of diseases and clinical conditions associated with CGI-01.

CPT1C (Accession NP_689572.1) is another GAM55 target gene, herein designated TARGET GENE. CPT1C BINDING SITE is a target binding site found in the 5' untranslated region of mRNA encoded by CPT1C, corresponding to a target binding site such as BINDING SITE I, BINDING SITE II or BINDING SITE III of FIG. 8. Table 4 illustrates the complementarity of the nucleotide sequences of CPT1C BINDING SITE, designated SEQ ID:13296, to the nucleotide sequence of GAM55 RNA, herein designated GAM RNA, also designated SEQ ID:387.

Another function of GAM55 is therefore inhibition of CPT1C (Accession NP_689572.1). Accordingly, utilities of GAM55 include diagnosis, prevention and treatment of diseases and clinical conditions associated with CPT1C.

Cellular repressor of e1a-stimulated genes (CREG, Accession NP_003842.1) is another GAM55 target gene, herein designated TARGET GENE. CREG BINDING SITE is a target binding site found in the 3' untranslated region of mRNA encoded by CREG, corresponding to a target binding site such as BINDING SITE I, BINDING SITE II or BINDING SITE III of FIG. 8. Table 4 illustrates the complementarity of the nucleotide sequences of CREG BINDING SITE, designated SEQ ID:7517, to the nucleotide sequence of GAM55 RNA, herein designated GAM RNA, also designated SEQ ID:387.

Another function of GAM55 is therefore inhibition of Cellular repressor of e1a-stimulated genes (CREG, Accession NP_003842.1). Accordingly, utilities of GAM55 include diagnosis, prevention and treatment of diseases and clinical conditions associated with CREG.

Collapsin response mediator protein 1 (CRMP1, Accession NP_001304.1) is another GAM55 target gene, herein designated TARGET GENE. CRMP1 BINDING SITE is a target binding site found in the 3' untranslated region of mRNA encoded by CRMP1, corresponding to a target binding site such as BINDING SITE I, BINDING SITE II or BINDING SITE III of FIG. 8. Table 4 illustrates the complementarity of the nucleotide sequences of CRMP1 BINDING SITE, designated SEQ ID:16155, to the nucleotide sequence of GAM55 RNA, herein designated GAM RNA, also designated SEQ ID:387.

Another function of GAM55 is therefore inhibition of Collapsin response mediator protein 1 (CRMP1, Accession NP_001304.1), a gene which is a member of dihydropyrimidinase family. Accordingly, utilities of GAM55 include diagnosis, prevention and treatment of diseases and clinical conditions associated with CRMP1.

The function of CRMP1 has been established by previous studies. Hamajima et al. (1996) isolated a human cDNA encoding collapsin response mediator protein-1 (CRMP1), which they called dihydropyrimidinase-related protein-1 (DRP1), from a fetal brain cDNA library (see OMIM Ref. No. 222748). The deduced CRMP1 protein has 572 amino acids. Northern blot analysis of adult human tissues showed that CRMP1 is abundantly expressed in brain as a major 2.9-kb transcript and a minor 4.9-kb transcript Ruiz-Perez et al. (2000) demonstrated overlap between the CRMP1 gene and the EVC gene (OMIM Ref. No. 604831), which maps to the same region of 4p and is mutated in the Ellis-van Creveld syndrome (OMIM Ref. No. 225500). The overlap was not confined to the 3-prime UTR but included coding sequence. Because CRMP1 is expressed in developing limb and ectoderm, the autors suggested that this 3-prime complementarity has functional significance Full details of the abovementioned studies are described in the following publications, the disclosure of which are hereby incorporated by reference:

Hamajima, N.; Matsuda, K.; Sakata, S.; Tamaki, N.; Sasaki, M.; Nonaka, M.: A novel gene family defined by human dihydropyrimidinase and three related proteins with differential tissue distribution. Gene 180:157-163, 1996; and Ruiz-Perez, V. L.; Ide, S. E.; Strom, T. M.; Lorenz, B.; Wilson, D.; Woods, K.; King, L.; Francomano, C.; Freisinger, P.; Spranger, S.; Marino, B.; Dallapiccola, B.; Wright, M.; Meitinge.

Further studies establishing the function and utilities of CRMP1 are found in John Hopkins OMIM database record ID 602462, and in cited publications listed in Table 5, which are hereby incorporated by reference. Cullin 3 (CUL3, Accession NP_003581.1) is another GAM55 target gene, herein designated TARGET GENE. CUL3 BINDING SITE is a target binding site found in the 3' untranslated region of mRNA encoded by CUL3, corresponding to a target binding site such as BINDING SITE I, BINDING SITE II or BINDING SITE III of FIG. 8. Table 4 illustrates the complementarity of the nucleotide sequences of CUL3 BINDING SITE, designated SEQ ID:7104, to the nucleotide sequence of GAM55 RNA, herein designated GAM RNA, also designated SEQ ID:387.

Another function of GAM55 is therefore inhibition of Cullin 3 (CUL3, Accession NP_003581.1), a gene which may target other proteins for ubiquitin-dependent proteolysis. Accordingly, utilities of GAM55 include diagnosis, prevention and treatment of diseases and clinical conditions associated with CUL3.

The function of CUL3 and its association with various diseases and clinical conditions, has been established by previous studies, as described hereinabove with reference to GAM32.1. Dynactin 4 (p62) (DCTN4, Accession NP_057305.1) is another GAM55 target gene, herein designated TARGET GENE. DCTN4 BINDING SITE is a target binding site found in the 3' untranslated region of mRNA encoded by DCTN4, corresponding to a target binding site such as BINDING SITE I, BINDING SITE II or BINDING SITE III of FIG. 8. Table 4 illustrates the complementarity of the nucleotide sequences of DCTN4 BINDING SITE, designated SEQ ID:4858, to the nucleotide sequence of GAM55 RNA, herein designated GAM RNA, also designated SEQ ID:387.

Another function of GAM55 is therefore inhibition of Dynactin 4 (p62) (DCTN4, Accession NP_057305.1). Accordingly, utilities of GAM55 include diagnosis, prevention and treatment of diseases and clinical conditions associated with DCTN4.

DKFZp761O17121 (Accession NP_115663.1) is another GAM55 target gene, herein designated TARGET GENE. DKFZp761O17121 BINDING SITE is a target binding site found in the 3' untranslated region of mRNA encoded by DKFZp761O17121, corresponding to a target binding site such as BINDING SITE I, BINDING SITE II or BINDING SITE III of FIG. 8. Table 4 illustrates the complementarity of the nucleotide sequences of DKFZp761O17121 BINDING SITE, designated SEQ ID:2906, to the nucleotide sequence of GAM55 RNA, herein designated GAM RNA, also designated SEQ ID:387.

Another function of GAM55 is therefore inhibition of DKFZp761O17121 (Accession NP_115663.1). Accordingly, utilities of GAM55 include diagnosis, prevention and treatment of diseases and clinical conditions associated with DKFZp761O17121.

Dynein, cytoplasmic, light polypeptide 2a (DNCL2A, Accession NP_054902.1) is another GAM55 target gene, herein designated TARGET GENE. DNCL2A BINDING SITE is a target binding site found in the 5' untranslated region of multiple transcripts of mRNA encoded by DNCL2A, corresponding to a target binding site such as BINDING SITE I, BINDING SITE II or BINDING SITE III of FIG. 8. Table 4 illustrates the complementarity of the nucleotide sequences of DNCL2A BINDING SITE, designated SEQ ID:3470, to the nucleotide sequence of GAM55 RNA, herein designated GAM RNA, also designated SEQ ID:387.

Another function of GAM55 is therefore inhibition of Dynein, cytoplasmic, light polypeptide 2a (DNCL2A, Accession NP_054902.1). Accordingly, utilities of GAM55 include diagnosis, prevention and treatment of diseases and clinical conditions associated with DNCL2A.

Dynein, cytoplasmic, light polypeptide 2a (DNCL2A, Accession NP_808853.1) is another GAM55 target gene, herein designated TARGET GENE. DNCL2A BINDING SITE is a target binding site found in the 5' untranslated region of multiple transcripts of mRNA encoded by DNCL2A, corresponding to a target binding site such as BINDING SITE I, BINDING SITE II or BINDING SITE III of FIG. 8. Table 4 illustrates the complementarity of the nucleotide sequences of DNCL2A BINDING SITE, designated SEQ ID:3470, to the nucleotide sequence of GAM55 RNA, herein designated GAM RNA, also designated SEQ ID:387.

Another function of GAM55 is therefore inhibition of Dynein, cytoplasmic, light polypeptide 2a (DNCL2A, Accession NP_808853.1). Accordingly, utilities of GAM55 include diagnosis, prevention and treatment of diseases and clinical conditions associated with DNCL2A.

DPF3 (Accession NP_036206.1) is another GAM55 target gene, herein designated TARGET GENE. DPF3 BINDING SITE is a target binding site found in the 3' untranslated region of mRNA encoded by DPF3, corresponding to a target binding site such as BINDING SITE I, BINDING SITE II or BINDING SITE III of FIG. 8. Table 4 illustrates the complementarity of the nucleotide sequences of DPF3 BINDING SITE, designated SEQ ID:7186, to the nucleotide sequence of GAM55 RNA, herein designated GAM RNA, also designated SEQ ID:387.

Another function of GAM55 is therefore inhibition of DPF3 (Accession NP_036206.1). Accordingly, utilities of GAM55 include diagnosis, prevention and treatment of diseases and clinical conditions associated with DPF3.

Endothelial differentiation, sphingolipid g-protein-coupled receptor, 3 (EDG3, Accession NP_005217.1) is another GAM55 target gene, herein designated TARGET GENE. EDG3 BINDING SITE is a target binding site found in the 3' untranslated region of mRNA encoded by EDG3, corresponding to a target binding site such as BINDING SITE I, BINDING SITE II or BINDING SITE III of FIG. 8. Table 4 illustrates the complementarity of the nucleotide sequences of EDG3 BINDING SITE, designated SEQ ID:10947, to the nucleotide sequence of GAM55 RNA, herein designated GAM RNA, also designated SEQ ID:387.

Another function of GAM55 is therefore inhibition of Endothelial differentiation, sphingolipid g-protein-coupled receptor, 3 (EDG3, Accession NP_005217.1). Accordingly, utilities of GAM55 include diagnosis, prevention and treatment of diseases and clinical conditions associated with EDG3.

Ephb6 (EPHB6, Accession NP_004436.1) is another GAM55 target gene, herein designated TARGET GENE. EPHB6 BINDING SITE is a target binding site found in the 5' untranslated region of mRNA encoded by EPHB6, corresponding to a target binding site such as BINDING SITE I, BINDING SITE II or BINDING SITE III of FIG. 8. Table 4 illustrates the complementarity of the nucleotide sequences of EPHB6 BINDING SITE, designated SEQ ID:4191, to the nucleotide sequence of GAM55 RNA, herein designated GAM RNA, also designated SEQ ID:387.

Another function of GAM55 is therefore inhibition of Ephb6 (EPHB6, Accession NP_004436.1), a gene which Putative Eph-related receptor tyrosine kinase B6. Accordingly, utilities of GAM55 include diagnosis, prevention and treatment of diseases and clinical conditions associated with EPHB6.

The function of EPHB6 has been established by previous studies. See 179610 for background on Eph receptors and their ligands, the ephrins. By screening human brain and hematopoietic cell cDNA libraries with the catalytic domain of EPHB4 (OMIM Ref. No. 600011), Matsuoka et al. (1997) cloned a cDNA encoding EPHB6. The predicted 1,006-amino acid EPHB6 protein has the primary structural features of Eph-family receptor tyrosine kinases, but it lacks several invariant residues that have been shown to be essential for tyrosine kinase activity. Expression of the catalytic domain of EPHB6 in mammalian cells resulted in no detectable tyrosine kinase activity in an in vitro assay. Northern blot analysis of normal human adult tissues showed that EPHB6 was expressed as a single 4.0-kb transcript in all tissues examined, with very strong expression in the brain and pancreas. EPHB6 is expressed in normal human brain as a 135-kD protein. By fluorescence in situ hybridization, Matsuoka et al. (1997) mapped the EPHB6 gene to 7q33-q35. Neuroblastoma (NB; 256700) is a common pediatric tumor that exhibits a wide range of biologic and clinical heterogeneity. EPH family receptor tyrosine kinases and ligand ephrins play pivotal roles in neural and cardiovascular development. High-level expression of transcripts encoding EPHB6 and its ligands ephrin-B2 (EFNB2; 600527) and ephrin-B3 (EFNB3; 602297) is associated with low-stage NB (stages 1, 2, and 4S) and high expression of TRKA (NTRK1; 191315). Tang et al. (2000) showed that EFNB2 and TRKA expressions were associated with both tumor stage and patient age, whereas EPHB6 and EFNB3 expressions were solely associated with tumor stage, suggesting that these genes were expressed in different subsets of NB. High-level expression of EPHB6, EFNB2, and EFNB3 predicted favorable NB outcome, and their expression combined with TRKA expression predicted the disease outcome more accurately than each variable alone. If any 1 of the 4 genes was expressed at high levels in NB, the patient survival was excellent (more than 90%). Tang et al. (2000) found that transfection of EPHB6 cDNA into neuroblastoma cell lines expressing little endogenous EPHB6 resulted in inhibition of their clonogenicity in culture. Furthermore, transfection of EPHB6 suppressed the tumorigenicity of a cell line in a mouse xenograft model, demonstrating that high-level expressions of favorable NB genes, such as EPHB6, can in fact suppress malignant phenotype of unfavorable NB.

Full details of the abovementioned studies are described in the following publications, the disclosure of which are hereby incorporated by reference:

Matsuoka, H.; Iwata, N.; Ito, M.; Shimoyama, M.; Nagata, A.; Chihara, K.; Takai, S.; Matsui, T.: Expression of a kinase-defective Eph-like receptor in the normal human brain. Biochem. Biophys. Res. Commun. 235:487-492, 1997; and Tang, X. X.; Zhao, H.; Robinson, M. E.; Cohen, B.; Cnaan, A.; London, W.; Cohn, S. L.; Cheung, N.-K. V.; Brodeur, G. M.; Evans, A. E.; Ikegaki, N.: Implications of EPHB6, EFNB2, and EFN.

Further studies establishing the function and utilities of EPHB6 are found in John Hopkins OMIM database record ID 602757, and in cited publications listed in Table 5, which are hereby incorporated by reference. Epsin 2 (EPN2, Accession NP_055779.1) is another GAM55 target gene, herein designated TARGET GENE. EPN2 BINDING SITE is a target binding site found in the 3' untranslated region of multiple transcripts of mRNA encoded by EPN2, corresponding to a target binding site such as BINDING SITE I, BINDING SITE II or BINDING SITE III of FIG. 8. Table 4 illustrates the complementarity of the nucleotide sequences of EPN2 BINDING SITE, designated SEQ ID:13330, to the nucleotide sequence of GAM55 RNA, herein designated GAM RNA, also designated SEQ ID:387.

Another function of GAM55 is therefore inhibition of Epsin 2 (EPN2, Accession NP_055779.1). Accordingly, utilities of GAM55 include diagnosis, prevention and treatment of diseases and clinical conditions associated with EPN2.

Epsin 2 (EPN2, Accession NP_683723.1) is another GAM55 target gene, herein designated TARGET GENE. EPN2 BINDING SITE is a target binding site found in the 3' untranslated region of multiple transcripts of mRNA encoded by EPN2, corresponding to a target binding site such as BINDING SITE I, BINDING SITE II or BINDING SITE III of FIG. 8. Table 4 illustrates the complementarity of the nucleotide sequences of EPN2 BINDING SITE, designated SEQ ID:13330, to the nucleotide sequence of GAM55 RNA, herein designated GAM RNA, also designated SEQ ID:387.

Another function of GAM55 is therefore inhibition of Epsin 2 (EPN2, Accession NP_683723.1). Accordingly, utilities of GAM55 include diagnosis, prevention and treatment of diseases and clinical conditions associated with EPN2.

F-box only protein 25 (FBXO25, Accession NP_036305.1) is another GAM55 target gene, herein designated TARGET GENE. FBXO25 BINDING SITE is a target binding site found in the 5' untranslated region of mRNA encoded by FBXO25, corresponding to a target binding site such as BINDING SITE I, BINDING SITE II or BINDING SITE III of FIG. 8. Table 4 illustrates the complementarity of the nucleotide sequences of FBXO25 BINDING SITE, designated SEQ ID:11736, to the nucleotide sequence of GAM55 RNA, herein designated GAM RNA, also designated SEQ ID:387.

Another function of GAM55 is therefore inhibition of F-box only protein 25 (FBXO25, Accession NP_036305.1). Accordingly, utilities of GAM55 include diagnosis, prevention and treatment of diseases and clinical conditions associated with FBXO25.

FLJ12770 (Accession NP_115550.2) is another GAM55 target gene, herein designated TARGET GENE. FLJ12770 BINDING SITE is a target binding site found in the 3' untranslated region of mRNA encoded by FLJ12770, corresponding to a target binding site such as BINDING SITE I, BINDING SITE II or BINDING SITE III of FIG. 8. Table 4 illustrates the complementarity of the nucleotide sequences of FLJ12770 BINDING SITE, designated SEQ ID:14361, to the nucleotide sequence of GAM55 RNA, herein designated GAM RNA, also designated SEQ ID:387.

Another function of GAM55 is therefore inhibition of FLJ12770 (Accession NP_115550.2). Accordingly, utilities of GAM55 include diagnosis, prevention and treatment of diseases and clinical conditions associated with FLJ12770.

FLJ20071 (Accession NP_060123.2) is another GAM55 target gene, herein designated TARGET GENE. FLJ20071 BINDING SITE is a target binding site found in the 5' untranslated region of mRNA encoded by FLJ20071, corresponding to a target binding site such as BINDING SITE I, BINDING SITE II or BINDING SITE III of FIG. 8. Table 4 illustrates the complementarity of the nucleotide sequences of FLJ20071 BINDING SITE, designated SEQ ID:9927, to the nucleotide sequence of GAM55 RNA, herein designated GAM RNA, also designated SEQ ID:387.

Another function of GAM55 is therefore inhibition of FLJ20071 (Accession NP_060123.2). Accordingly, utilities of GAM55 include diagnosis, prevention and treatment of diseases and clinical conditions associated with FLJ20071.

FLJ21156 (Accession NP_078878.1) is another GAM55 target gene, herein designated TARGET GENE. FLJ21156 BINDING SITE is a target binding site found in the 5' untranslated region of mRNA encoded by FLJ21156, corresponding to a target binding site such as BINDING SITE I, BINDING SITE II or BINDING SITE III of FIG. 8. Table 4 illustrates the complementarity of the nucleotide sequences of FLJ21156 BINDING SITE, designated SEQ ID:9244, to the nucleotide sequence of GAM55 RNA, herein designated GAM RNA, also designated SEQ ID:387.

Another function of GAM55 is therefore inhibition of FLJ21156 (Accession NP_078878.1). Accordingly, utilities of GAM55 include diagnosis, prevention and treatment of diseases and clinical conditions associated with FLJ21156.

FLJ21736 (Accession NP_079198.1) is another GAM55 target gene, herein designated TARGET GENE. FLJ21736 BINDING SITE is a target binding site found in the 5' untranslated region of mRNA encoded by FLJ21736, corresponding to a target binding site such as BINDING SITE I, BINDING SITE II or BINDING SITE III of FIG. 8. Table 4 illustrates the complementarity of the nucleotide sequences of FLJ21736 BINDING SITE, designated SEQ ID:4353, to the nucleotide sequence of GAM55 RNA, herein designated GAM RNA, also designated SEQ ID:387.

Another function of GAM55 is therefore inhibition of FLJ21736 (Accession NP_079198.1). Accordingly, utilities of GAM55 include diagnosis, prevention and treatment of diseases and clinical conditions associated with FLJ21736.

FLJ25461 (Accession NP_659403.1) is another GAM55 target gene, herein designated TARGET GENE. FLJ25461 BINDING SITE is a target binding site found in the 3' untranslated region of mRNA encoded by FLJ25461, corresponding to a target binding site such as BINDING SITE I, BINDING SITE II or BINDING SITE III of FIG. 8. Table 4 illustrates the complementarity of the nucleotide sequences of FLJ25461 BINDING SITE, designated SEQ ID:16876, to the nucleotide sequence of GAM55 RNA, herein designated GAM RNA, also designated SEQ ID:387.

Another function of GAM55 is therefore inhibition of FLJ25461 (Accession NP_659403.1). Accordingly, utilities of GAM55 include diagnosis, prevention and treatment of diseases and clinical conditions associated with FLJ25461.

FLJ32110 (Accession XP_294323.1) is another GAM55 target gene, herein designated TARGET GENE. FLJ32110 BINDING SITE is a target binding site found in the 5' untranslated region of mRNA encoded by FLJ32110, corresponding to a target binding site such as BINDING SITE I, BINDING SITE II or BINDING SITE III of FIG. 8. Table 4 illustrates the complementarity of the nucleotide sequences of FLJ32110 BINDING SITE, designated SEQ ID:9463, to the nucleotide sequence of GAM55 RNA, herein designated GAM RNA, also designated SEQ ID:387.

Another function of GAM55 is therefore inhibition of FLJ32110 (Accession XP_294323.1). Accordingly, utilities of GAM55 include diagnosis, prevention and treatment of diseases and clinical conditions associated with FLJ32110.

FLJ32934 (Accession NP_653223.1) is another GAM55 target gene, herein designated TARGET GENE. FLJ32934 BINDING SITE is a target binding site found in the 5' untranslated region of mRNA encoded by FLJ32934, corresponding to a target binding site such as BINDING SITE I, BINDING SITE II or BINDING SITE III of FIG. 8. Table 4 illustrates the complementarity of the nucleotide sequences of FLJ32934 BINDING SITE, designated SEQ ID:16951, to the nucleotide sequence of GAM55 RNA, herein designated GAM RNA, also designated SEQ ID:387.

Another function of GAM55 is therefore inhibition of FLJ32934 (Accession NP_653223.1). Accordingly, utilities of GAM55 include diagnosis, prevention and treatment of diseases and clinical conditions associated with FLJ32934.

FLJ35976 (Accession NP_775910.1) is another GAM55 target gene, herein designated TARGET GENE. FLJ35976 BINDING SITE is a target binding site found in the 3' untranslated region of mRNA encoded by FLJ35976, corresponding to a target binding site such as BINDING SITE I, BINDING SITE II or BINDING SITE III of FIG. 8. Table 4 illustrates the complementarity of the nucleotide sequences of FLJ35976 BINDING SITE, designated SEQ ID:16319, to the nucleotide sequence of GAM55 RNA, herein designated GAM RNA, also designated SEQ ID:387.

Another function of GAM55 is therefore inhibition of FLJ35976 (Accession NP_775910.1). Accordingly, utilities of GAM55 include diagnosis, prevention and treatment of diseases and clinical conditions associated with FLJ35976.

FLJ39267 (Accession NP_775821.1) is another GAM55 target gene, herein designated TARGET GENE. FLJ39267 BINDING SITE is a target binding site found in the 3' untranslated region of mRNA encoded by FLJ39267, corresponding to a target binding site such as BINDING SITE I, BINDING SITE II or BINDING SITE III of FIG. 8. Table 4 illustrates the complementarity of the nucleotide sequences of FLJ39267 BINDING SITE, designated SEQ ID:14964, to the nucleotide sequence of GAM55 RNA, herein designated GAM RNA, also designated SEQ ID:387.

Another function of GAM55 is therefore inhibition of FLJ39267 (Accession NP_775821.1). Accordingly, utilities of GAM55 include diagnosis, prevention and treatment of diseases and clinical conditions associated with FLJ39267.

FLJ39654 (Accession NP_787110.1) is another GAM55 target gene, herein designated TARGET GENE. FLJ39654 BINDING SITE is a target binding site found in the 3' untranslated region of mRNA encoded by FLJ39654, corresponding to a target binding site such as BINDING SITE I, BINDING SITE II or BINDING SITE III of FIG. 8. Table 4 illustrates the complementarity of the nucleotide sequences of FLJ39654 BINDING SITE, designated SEQ ID:8343, to the nucleotide sequence of GAM55 RNA, herein designated GAM RNA, also designated SEQ ID:387.

Another function of GAM55 is therefore inhibition of FLJ39654 (Accession NP_787110.1). Accordingly, utilities of GAM55 include diagnosis, prevention and treatment of diseases and clinical conditions associated with FLJ39654.

FLJ40201 (Accession NP_689820.1) is another GAM55 target gene, herein designated TARGET GENE. FLJ40201 BINDING SITE is a target binding site found in the 3' untranslated region of mRNA encoded by FLJ40201, corresponding to a target binding site such as BINDING SITE I, BINDING SITE II or BINDING SITE III of FIG. 8. Table 4 illustrates the complementarity of the nucleotide sequences of FLJ40201 BINDING SITE, designated SEQ ID:3723, to the nucleotide sequence of GAM55 RNA, herein designated GAM RNA, also designated SEQ ID:387.

Another function of GAM55 is therefore inhibition of FLJ40201 (Accession NP_689820.1). Accordingly, utilities of GAM55 include diagnosis, prevention and treatment of diseases and clinical conditions associated with FLJ40201.

Gaba(a) receptor-associated protein like 1 (GABARAPL1, Accession NP_113600.1) is another GAM55 target gene, herein designated TARGET GENE. GABARAPL1 BINDING SITE is a target binding site found in the 3' untranslated region of mRNA encoded by GABARAPL1, corresponding to a target binding site such as BINDING SITE I, BINDING SITE II or BINDING SITE III of FIG. 8. Table 4 illustrates the complementarity of the nucleotide sequences of GABARAPL1 BINDING SITE, designated SEQ ID:12594, to the nucleotide sequence of GAM55 RNA, herein designated GAM RNA, also designated SEQ ID:387.

Another function of GAM55 is therefore inhibition of Gaba(a) receptor-associated protein like 1 (GABARAPL1, Accession NP_113600.1). Accordingly, utilities of GAM55 include diagnosis, prevention and treatment of diseases and clinical conditions associated with GABARAPL1.

GENX-3414 (Accession NP_003934.1) is another GAM55 target gene, herein designated TARGET GENE. GENX-3414 BINDING SITE is a target binding site found in the 3' untranslated region of mRNA encoded by GENX-3414, corresponding to a target binding site such as BINDING SITE I, BINDING SITE II or BINDING SITE III of FIG. 8. Table 4 illustrates the complementarity of the nucleotide sequences of GENX-3414 BINDING SITE, designated SEQ ID:5371, to the nucleotide sequence of GAM55 RNA, herein designated GAM RNA, also designated SEQ ID:387.

Another function of GAM55 is therefore inhibition of GENX-3414 (Accession NP_003934.1). Accordingly, utilities of GAM55 include diagnosis, prevention and treatment of diseases and clinical conditions associated with GENX-3414.

Histone acetyltransferase 1 (HAT1, Accession NP_003633.1) is another GAM55 target gene, herein designated TARGET GENE. HAT1 BINDING SITE is a target binding site found in the 5' untranslated region of mRNA encoded by HAT1, corresponding to a target binding site such as BINDING SITE I, BINDING SITE II or BINDING SITE III of FIG. 8. Table 4 illustrates the complementarity of the nucleotide sequences of HAT1 BINDING SITE, designated SEQ ID:7198, to the nucleotide sequence of GAM55 RNA, herein designated GAM RNA, also designated SEQ ID:387.

Another function of GAM55 is therefore inhibition of Histone acetyltransferase 1 (HAT1, Accession NP_003633.1), a gene which acetylates soluble histones H2 and H4 and binds helix 1 of histone H4. Accordingly, utilities of GAM55 include diagnosis, prevention and treatment of diseases and clinical conditions associated with HAT1.

The function of HAT1 has been established by previous studies. The reversible acetylation of specific lysine residues within the N-terminal tails of the core histones is correlated with gene activity. Histone acetylation, particularly of histone H4, has also been proposed to play an important role in replication-dependent nucleosome assembly. The S. cerevisiae Hat1 gene was the first histone acetyltransferase gene to be identified, and its gene product was found to be tightly associated with an accessory protein. By searching an expressed sequence tag database with the S. cerevisiae Hat1 sequence, Verreault et al. (1998) isolated a cDNA (GenBank AF030424) encoding HAT1, the human ortholog of yeast Hat1. The sequences of the human and yeast HAT1 proteins are 29% identical and 55% similar. The deduced 419-amino acid human HAT1 contains D, A, and B motifs, which are present in many N-acetyltransferases, including those that acetylate substrates other than histones. HAT1 also contains a putative bipartite nuclear localization signal; however, deletion of this signal had no effect on the intranuclear localization of HAT1. The authors purified the HAT1 holoenzyme from human 293 cells and found that it consists of 2 subunits: the catalytic 46-kD HAT1 and the accessory p46 (RBBP7; 602922). The p46 subunit stimulated the activity of HAT1 and bound to core histones. The HAT1 holoenzyme acetylated newly synthesized but not nucleosomal histone H4 at lys5 and lys12, and, to a lesser extent, histone H2A at lys5. Verreault et al. (1998) showed that the HAT1 and p46 polypeptides are located in the nucleus of S-phase cells. In their GenBank submission, these authors indicated that the HAT1 gene maps to 2q31.2-q33.1.

Full details of the abovementioned studies are described in the following publications, the disclosure of which are hereby incorporated by reference:

Dutnall, R. N.; Tafrov, S. T.; Sternglanz, R.; Ramakrishnan, V.: Structure of the histone acetyltransferase Hat1: a paradigm for the GCN5-related N-acetyltransferase superfamily. Cell 94:427-438, 1998; and Verreault, A.; Kaufman, P. D.; Kobayashi, R.; Stillman, B.: Nucleosomal DNA regulates the core-histone-binding subunit of the human Hat1 acetyltransferase. Curr. Biol. 8:96-108, 1998.

Further studies establishing the function and utilities of HAT1 are found in John Hopkins OMIM database record ID 603053, and in cited publications listed in Table 5, which are hereby incorporated by reference. IPT (Accession NP_060116.1) is another GAM55 target gene, herein designated TARGET GENE. IPT BINDING SITE is a target binding site found in the 3' untranslated region of mRNA encoded by IPT, corresponding to a target binding site such as BINDING SITE I, BINDING SITE II or BINDING SITE III of FIG. 8. Table 4 illustrates the complementarity of the nucleotide sequences of IPT BINDING SITE, designated SEQ ID:10622, to the nucleotide sequence of GAM55 RNA, herein designated GAM RNA, also designated SEQ ID:387.

Another function of GAM55 is therefore inhibition of IPT (Accession NP_060116.1). Accordingly, utilities of GAM55 include diagnosis, prevention and treatment of diseases and clinical conditions associated with IPT.

Jagged 1 (alagille syndrome) (JAG1, Accession NP_000205.1) is another GAM55 target gene, herein designated TARGET GENE. JAG1 BINDING SITE is a target binding site found in the 3' untranslated region of mRNA encoded by JAG1, corresponding to a target binding site such as BINDING SITE I, BINDING SITE II or BINDING SITE III of FIG. 8. Table 4 illustrates the complementarity of the nucleotide sequences of JAG1 BINDING SITE, designated SEQ ID:10391, to the nucleotide sequence of GAM55 RNA, herein designated GAM RNA, also designated SEQ ID:387.

Another function of GAM55 is therefore inhibition of Jagged 1 (alagille syndrome) (JAG1, Accession NP_000205.1). Accordingly, utilities of GAM55 include diagnosis, prevention and treatment of diseases and clinical conditions associated with JAG1.

KIAA0089 (Accession NP_055956.1) is another GAM55 target gene, herein designated TARGET GENE. KIAA0089 BINDING SITE is a target binding site found in the 3' untranslated region of mRNA encoded by KIAA0089, corresponding to a target binding site such as BINDING SITE I, BINDING SITE II or BINDING SITE III of FIG. 8. Table 4 illustrates the complementarity of the nucleotide sequences of KIAA0089 BINDING SITE, designated SEQ ID:16156, to the nucleotide sequence of GAM55 RNA, herein designated GAM RNA, also designated SEQ ID:387.

Another function of GAM55 is therefore inhibition of KIAA0089 (Accession NP_055956.1). Accordingly, utilities of GAM55 include diagnosis, prevention and treatment of diseases and clinical conditions associated with KIAA0089.

KIAA0469 (Accession NP_055666.1) is another GAM55 target gene, herein designated TARGET GENE. KIAA0469 BINDING SITE is a target binding site found in the 3' untranslated region of mRNA encoded by KIAA0469, corresponding to a target binding site such as BINDING SITE I, BINDING SITE II or BINDING SITE III of FIG. 8. Table 4 illustrates the complementarity of the nucleotide sequences of KIAA0469 BINDING SITE, designated SEQ ID:3457, to the nucleotide sequence of GAM55 RNA, herein designated GAM RNA, also designated SEQ ID:387.

Another function of GAM55 is therefore inhibition of KIAA0469 (Accession NP_055666.1). Accordingly, utilities of GAM55 include diagnosis, prevention and treatment of diseases and clinical conditions associated with KIAA0469.

KIAA1045 (Accession XP_048592.1) is another GAM55 target gene, herein designated TARGET GENE. KIAA1045 BINDING SITE is a target binding site found in the 3' untranslated region of mRNA encoded by KIAA1045, corresponding to a target binding site such as BINDING SITE I, BINDING SITE II or BINDING SITE III of FIG. 8. Table 4 illustrates the complementarity of the nucleotide sequences of KIAA1045 BINDING SITE, designated SEQ ID:1089, to the nucleotide sequence of GAM55 RNA, herein designated GAM RNA, also designated SEQ ID:387.

Another function of GAM55 is therefore inhibition of KIAA1045 (Accession XP_048592.1). Accordingly, utilities of GAM55 include diagnosis, prevention and treatment of diseases and clinical conditions associated with KIAA1045.

KIAA1908 (Accession XP_055834.1) is another GAM55 target gene, herein designated TARGET GENE. KIAA1908 BINDING SITE is a target binding site found in the 3' untranslated region of mRNA encoded by KIAA1908, corresponding to a target binding site such as BINDING SITE I, BINDING SITE II or BINDING SITE III of FIG. 8. Table 4 illustrates the complementarity of the nucleotide sequences of KIAA1908 BINDING SITE, designated SEQ ID:15699, to the nucleotide sequence of GAM55 RNA, herein designated GAM RNA, also designated SEQ ID:387.

Another function of GAM55 is therefore inhibition of KIAA1908 (Accession XP_055834.1). Accordingly, utilities of GAM55 include diagnosis, prevention and treatment of diseases and clinical conditions associated with KIAA1908.

KIAA1937 (Accession XP_057107.3) is another GAM55 target gene, herein designated TARGET GENE. KIAA1937 BINDING SITE is a target binding site found in the 3' untranslated region of mRNA encoded by KIAA1937, corresponding to a target binding site such as BINDING SITE I, BINDING SITE II or BINDING SITE III of FIG. 8. Table 4 illustrates the complementarity of the nucleotide sequences of KIAA1937 BINDING SITE, designated SEQ ID:3380, to the nucleotide sequence of GAM55 RNA, herein designated GAM RNA, also designated SEQ ID:387.

Another function of GAM55 is therefore inhibition of KIAA1937 (Accession XP_057107.3). Accordingly, utilities of GAM55 include diagnosis, prevention and treatment of diseases and clinical conditions associated with KIAA1937.

Keratin 6a (KRT6A, Accession NP_005545.1) is another GAM55 target gene, herein designated TARGET GENE. KRT6A BINDING SITE is a target binding site found in the 5' untranslated region of mRNA encoded by KRT6A, corresponding to a target binding site such as BINDING SITE I, BINDING SITE II or BINDING SITE III of FIG. 8. Table 4 illustrates the complementarity of the nucleotide sequences of KRT6A BINDING SITE, designated SEQ ID:5931, to the nucleotide sequence of GAM55 RNA, herein designated GAM RNA, also designated SEQ ID:387.

Another function of GAM55 is therefore inhibition of Keratin 6a (KRT6A, Accession NP_005545.1), a gene which is required for filament assembly and therefore may be associated with Pachyonychia congenita, jadassohn-lewandowsky type. Accordingly, utilities of GAM55 include diagnosis, prevention and treatment of Pachyonychia congenita, jadassohn-lewandowsky type, and of other diseases and clinical conditions associated with KRT6A.

The function of KRT6A has been established by previous studies. Tyner et al. (1985) provided information on the structure of a type II keratin gene. A recent duplication in the basic keratin gene family gave rise to 2 copies of the human K6 gene. One of the copies is expressed at very low levels and may be at a still unextinguished step on the way to becoming a traditional pseudogene. Rosenberg et al. (1991) assigned the KRT6A gene to chromosome 12 by use of Southern blot analysis of somatic cell hybrids. By in situ hybridization of metaphase chromosomes, they demonstrated that the KRT6A gene is located in region 12q12-q14. Pachyonychia congenita (PC) is a rare autosomal dominant disorder characterized by multiple ectodermal abnormalities. Patients with type 1 PC, the Jadassohn- Lewandowsky syndrome (OMIM Ref. No. 167200), have onchyogryposis, palmoplantar hyperkeratosis, follicular hyperkeratosis, and oral leukokeratosis. Those with the rare type 2 PC, the Jackson-Lawler syndrome (OMIM Ref. No. 167210) lack oral involvement. Types 1 and 2 were related to mutations in keratin-16 (KRT16; 148067) and keratin-17 (KRT17; 148069), respectively. (Both KRT16 and KRT17 are type I keratins encoded by genes on chromosome 17.) Bowden et al. (1995) identified a mutation in a type II keratin, namely KRT6A, which is encoded by a gene on chromosome 12. The family was Slovenian and suffered from type 1 pachyonychia (OMIM Ref. No. 167200). K6A is the dominant K6 isoform. Takahashi et al. (1995) screened human genomic and skin cDNA libraries with probes derived from the K6B gene (OMIM Ref. No. 148042), and isolated clones containing the full-length gene and cDNA predicted to encode K6a. As many as 6 different human K6 protein isoforms that are highly related at the gene structure, nucleotide sequence, and predicted amino acid sequence levels were identified. Takahashi et al. (1995) proposed an evolutionary model in which the multiplicity of human K6 genes is explained by successive gene duplication events. Again, they demonstrated that K6A is clearly the dominant K6 isoform in skin tissue samples and cultured epithelial cell lines and that the various isoforms are differentially regulated within and between epithelial tissue types. Wong et al. (2000) found that K6-null mice have changes in the oral mucosa resembling those of pachyonychia congenita. They speculated on why the mice lacked obvious alterations in nail morphology, the conspicuous feature in pachyonychia congenita.

Full details of the abovementioned studies are described in the following publications, the disclosure of which are hereby incorporated by reference:

Wong, P.; Colucci-Guyon, E.; Takahashi, K.; Gu, C.; Babinet, C.; Coulombe, P. A.: Introducing a null mutation in the mouse K6-alpha and K6-beta genes reveals their essential structural role in the oral mucosa. J. Cell Biol. 150: 921-928, 2000; and Takahashi, K.; Paladini, R. D.; Coulombe, P. A.: Cloning and characterization of multiple human genes and cDNAs encoding highly related type II keratin 6 isoforms. J. Biol. Chem. 270.

Further studies establishing the function and utilities of KRT6A are found in John Hopkins OMIM database record ID 148041, and in cited publications listed in Table 5, which are hereby incorporated by reference. KRT6E (Accession NP_775109.1) is another GAM55 target gene, herein designated TARGET GENE. KRT6E BINDING SITE is a target binding site found in the 5' untranslated region of mRNA encoded by KRT6E, corresponding to a target binding site such as BINDING SITE I, BINDING SITE II or BINDING SITE III of FIG. 8. Table 4 illustrates the complementarity of the nucleotide sequences of KRT6E BINDING SITE, designated SEQ ID:16583, to the nucleotide sequence of GAM55 RNA, herein designated GAM RNA, also designated SEQ ID:387.

Another function of GAM55 is therefore inhibition of KRT6E (Accession NP_775109.1). Accordingly, utilities of GAM55 include diagnosis, prevention and treatment of diseases and clinical conditions associated with KRT6E.

LOC120935 (Accession XP_058518.3) is another GAM55 target gene, herein designated TARGET GENE. LOC120935 BINDING SITE is a target binding site found in the 5' untranslated region of mRNA encoded by LOC120935, corresponding to a target binding site such as BINDING SITE I, BINDING SITE II or BINDING SITE III of FIG. 8. Table 4 illustrates the complementarity of the nucleotide sequences of LOC120935 BINDING SITE, designated SEQ ID:8330, to the nucleotide sequence of GAM55 RNA, herein designated GAM RNA, also designated SEQ ID:387.

Another function of GAM55 is therefore inhibition of LOC120935 (Accession XP_058518.3). Accordingly, utilities of GAM55 include diagnosis, prevention and treatment of diseases and clinical conditions associated with LOC120935.

LOC131873 (Accession XP_067585.6) is another GAM55 target gene, herein designated TARGET GENE. LOC131873 BINDING SITE is a target binding site found in the 5' untranslated region of mRNA encoded by LOC131873, corresponding to a target binding site such as BINDING SITE I, BINDING SITE II or BINDING SITE III of FIG. 8. Table 4 illustrates the complementarity of the nucleotide sequences of LOC131873 BINDING SITE, designated SEQ ID:2874, to the nucleotide sequence of GAM55 RNA, herein designated GAM RNA, also designated SEQ ID:387.

Another function of GAM55 is therefore inhibition of LOC131873 (Accession XP_067585.6). Accordingly, utilities of GAM55 include diagnosis, prevention and treatment of diseases and clinical conditions associated with LOC131873.

LOC139201 (Accession XP_208439.1) is another GAM55 target gene, herein designated TARGET GENE. LOC139201 BINDING SITE is a target binding site found in the 3' untranslated region of mRNA encoded by LOC139201, corresponding to a target binding site such as BINDING SITE I, BINDING SITE II or BINDING SITE III of FIG. 8. Table 4 illustrates the complementarity of the nucleotide sequences of LOC139201 BINDING SITE, designated SEQ ID:716, to the nucleotide sequence of GAM55 RNA, herein designated GAM RNA, also designated SEQ ID:387.

Another function of GAM55 is therefore inhibition of LOC139201 (Accession XP_208439.1). Accordingly, utilities of GAM55 include diagnosis, prevention and treatment of diseases and clinical conditions associated with LOC139201.

LOC144202 (Accession XP_084770.5) is another GAM55 target gene, herein designated TARGET GENE. LOC144202 BINDING SITE is a target binding site found in the 3' untranslated region of mRNA encoded by LOC144202, corresponding to a target binding site such as BINDING SITE I, BINDING SITE II or BINDING SITE III of FIG. 8. Table 4 illustrates the complementarity of the nucleotide sequences of LOC144202 BINDING SITE, designated SEQ ID:2814, to the nucleotide sequence of GAM55 RNA, herein designated GAM RNA, also designated SEQ ID:387.

Another function of GAM55 is therefore inhibition of LOC144202 (Accession XP_084770.5). Accordingly, utilities of GAM55 include diagnosis, prevention and treatment of diseases and clinical conditions associated with LOC144202.

LOC144486 (Accession XP_096608.1) is another GAM55 target gene, herein designated TARGET GENE. LOC144486 BINDING SITE is a target binding site found in the 3' untranslated region of mRNA encoded by LOC144486, corresponding to a target binding site such as BINDING SITE I, BINDING SITE II or BINDING SITE III of FIG. 8. Table 4 illustrates the complementarity of the nucleotide sequences of LOC144486 BINDING SITE, designated SEQ ID:11985, to the nucleotide sequence of GAM55 RNA, herein designated GAM RNA, also designated SEQ ID:387.

Another function of GAM55 is therefore inhibition of LOC144486 (Accession XP_096608.1). Accordingly, utilities of GAM55 include diagnosis, prevention and treatment of diseases and clinical conditions associated with LOC144486.

LOC146429 (Accession XP_096998.2) is another GAM55 target gene, herein designated TARGET GENE. LOC146429 BINDING SITE is a target binding site found in the 5' untranslated region of mRNA encoded by LOC146429, corresponding to a target binding site such as BINDING SITE I, BINDING SITE II or BINDING SITE III of FIG. 8. Table 4 illustrates the complementarity of the nucleotide sequences of LOC146429 BINDING SITE, designated SEQ ID:6929, to the nucleotide sequence of GAM55 RNA, herein designated GAM RNA, also designated SEQ ID:387.

Another function of GAM55 is therefore inhibition of LOC146429 (Accession XP_096998.2). Accordingly, utilities of GAM55 include diagnosis, prevention and treatment of diseases and clinical conditions associated with LOC146429.

LOC151451 (Accession XP_087208.1) is another GAM55 target gene, herein designated TARGET GENE. LOC151451 BINDING SITE is a target binding site found in the 3' untranslated region of mRNA encoded by LOC151451, corresponding to a target binding site such as BINDING SITE I, BINDING SITE II or BINDING SITE III of FIG. 8. Table 4 illustrates the complementarity of the nucleotide sequences of LOC151451 BINDING SITE, designated SEQ ID:14420, to the nucleotide sequence of GAM55 RNA, herein designated GAM RNA, also designated SEQ ID:387.

Another function of GAM55 is therefore inhibition of LOC151451 (Accession XP_087208.1). Accordingly, utilities of GAM55 include diagnosis, prevention and treatment of diseases and clinical conditions associated with LOC151451.

LOC151534 (Accession NP_612491.1) is another GAM55 target gene, herein designated TARGET GENE. LOC151534 BINDING SITE is a target binding site found in the 5' untranslated region of mRNA encoded by LOC151534, corresponding to a target binding site such as BINDING SITE I, BINDING SITE II or BINDING SITE III of FIG. 8. Table 4 illustrates the complementarity of the nucleotide sequences of LOC151534 BINDING SITE, designated SEQ ID:3403, to the nucleotide sequence of GAM55 RNA, herein designated GAM RNA, also designated SEQ ID:387.

Another function of GAM55 is therefore inhibition of LOC151534 (Accession NP_612491.1). Accordingly, utilities of GAM55 include diagnosis, prevention and treatment of diseases and clinical conditions associated with LOC151534.

LOC152426 (Accession XP_098225.1) is another GAM55 target gene, herein designated TARGET GENE. LOC152426 BINDING SITE is a target binding site found in the 3' untranslated region of mRNA encoded by LOC152426, corresponding to a target binding site such as BINDING SITE I, BINDING SITE II or BINDING SITE III of FIG. 8. Table 4 illustrates the complementarity of the nucleotide sequences of LOC152426 BINDING SITE, designated SEQ ID:11108, to the nucleotide sequence of GAM55 RNA, herein designated GAM RNA, also designated SEQ ID:387.

Another function of GAM55 is therefore inhibition of LOC152426 (Accession XP_098225.1). Accordingly, utilities of GAM55 include diagnosis, prevention and treatment of diseases and clinical conditions associated with LOC152426.

LOC154062 (Accession XP_087842.1) is another GAM55 target gene, herein designated TARGET GENE. LOC154062 BINDING SITE is a target binding site found in the 3' untranslated region of mRNA encoded by LOC154062, corresponding to a target binding site such as BINDING SITE I, BINDING SITE II or BINDING SITE III of FIG. 8. Table 4 illustrates the complementarity of the nucleotide sequences of LOC154062 BINDING SITE, designated SEQ ID:13591, to the nucleotide sequence of GAM55 RNA, herein designated GAM RNA, also designated SEQ ID:387.

Another function of GAM55 is therefore inhibition of LOC154062 (Accession XP_087842.1). Accordingly, utilities of GAM55 include diagnosis, prevention and treatment of diseases and clinical conditions associated with LOC154062.

LOC200609 (Accession XP_117256.1) is another GAM55 target gene, herein designated TARGET GENE. LOC200609 BINDING SITE is a target binding site found in the 5' untranslated region of mRNA encoded by LOC200609, corresponding to a target binding site such as BINDING SITE I, BINDING SITE II or BINDING SITE III of FIG. 8. Table 4 illustrates the complementarity of the nucleotide sequences of LOC200609 BINDING SITE, designated SEQ ID:14431, to the nucleotide sequence of GAM55 RNA, herein designated GAM RNA, also designated SEQ ID:387.

Another function of GAM55 is therefore inhibition of LOC200609 (Accession XP_117256.1). Accordingly, utilities of GAM55 include diagnosis, prevention and treatment of diseases and clinical conditions associated with LOC200609.

LOC204275 (Accession XP_115290.2) is another GAM55 target gene, herein designated TARGET GENE. LOC204275 BINDING SITE is a target binding site found in the 3' untranslated region of mRNA encoded by LOC204275, corresponding to a target binding site such as BINDING SITE I, BINDING SITE II or BINDING SITE III of FIG. 8. Table 4 illustrates the complementarity of the nucleotide sequences of LOC204275 BINDING SITE, designated SEQ ID:5396, to the nucleotide sequence of GAM55 RNA, herein designated GAM RNA, also designated SEQ ID:387.

Another function of GAM55 is therefore inhibition of LOC204275 (Accession XP_115290.2). Accordingly, utilities of GAM55 include diagnosis, prevention and treatment of diseases and clinical conditions associated with LOC204275.

LOC254263 (Accession XP_170654.1) is another GAM55 target gene, herein designated TARGET GENE. LOC254263 BINDING SITE is a target binding site found in the 3' untranslated region of mRNA encoded by LOC254263, corresponding to a target binding site such as BINDING SITE I, BINDING SITE II or BINDING SITE III of FIG. 8. Table 4 illustrates the complementarity of the nucleotide sequences of LOC254263 BINDING SITE, designated SEQ ID:10172, to the nucleotide sequence of GAM55 RNA, herein designated GAM RNA, also designated SEQ ID:387.

Another function of GAM55 is therefore inhibition of LOC254263 (Accession XP_170654.1). Accordingly, utilities of GAM55 include diagnosis, prevention and treatment of diseases and clinical conditions associated with LOC254263.

LOC255328 (Accession XP_172920.1) is another GAM55 target gene, herein designated TARGET GENE. LOC255328 BINDING SITE is a target binding site found in the 5' untranslated region of mRNA encoded by LOC255328, corresponding to a target binding site such as BINDING SITE I, BINDING SITE II or BINDING SITE III of FIG. 8. Table 4 illustrates the complementarity of the nucleotide sequences of LOC255328 BINDING SITE, designated SEQ ID:16456, to the nucleotide sequence of GAM55 RNA, herein designated GAM RNA, also designated SEQ ID:387.

Another function of GAM55 is therefore inhibition of LOC255328 (Accession XP_172920.1). Accordingly, utilities of GAM55 include diagnosis, prevention and treatment of diseases and clinical conditions associated with LOC255328.

LOC282963 (Accession XP_210834.1) is another GAM55 target gene, herein designated TARGET GENE. LOC282963 BINDING SITE is a target binding site found in the 3' untranslated region of mRNA encoded by LOC282963, corresponding to a target binding site such as BINDING SITE I, BINDING SITE II or BINDING SITE III of FIG. 8. Table 4 illustrates the complementarity of the nucleotide sequences of LOC282963 BINDING SITE, designated SEQ ID:12044, to the nucleotide sequence of GAM55 RNA, herein designated GAM RNA, also designated SEQ ID:387.

Another function of GAM55 is therefore inhibition of LOC282963 (Accession XP_210834.1). Accordingly, utilities of GAM55 include diagnosis, prevention and treatment of diseases and clinical conditions associated with LOC282963.

LOC283140 (Accession XP_210911.1) is another GAM55 target gene, herein designated TARGET GENE. LOC283140 BINDING SITE is a target binding site found in the 3' untranslated region of mRNA encoded by LOC283140, corresponding to a target binding site such as BINDING SITE I, BINDING SITE II or BINDING SITE III of FIG. 8. Table 4 illustrates the complementarity of the nucleotide sequences of LOC283140 BINDING SITE, designated SEQ ID:1899, to the nucleotide sequence of GAM55 RNA, herein designated GAM RNA, also designated SEQ ID:387.

Another function of GAM55 is therefore inhibition of LOC283140 (Accession XP_210911.1). Accordingly, utilities of GAM55 include diagnosis, prevention and treatment of diseases and clinical conditions associated with LOC283140.

LOC284001 (Accession XP_208958.2) is another GAM55 target gene, herein designated TARGET GENE. LOC284001 BINDING SITE is a target binding site found in the 3' untranslated region of mRNA encoded by LOC284001, corresponding to a target binding site such as BINDING SITE I, BINDING SITE II or BINDING SITE III of FIG. 8. Table 4 illustrates the complementarity of the nucleotide sequences of LOC284001 BINDING SITE, designated SEQ ID:2281, to the nucleotide sequence of GAM55 RNA, herein designated GAM RNA, also designated SEQ ID:387.

Another function of GAM55 is therefore inhibition of LOC284001 (Accession XP_208958.2). Accordingly, utilities of GAM55 include diagnosis, prevention and treatment of diseases and clinical conditions associated with LOC284001.

LOC284281 (Accession XP_211415.1) is another GAM55 target gene, herein designated TARGET GENE. LOC284281 BINDING SITE is a target binding site found in the 5' untranslated region of mRNA encoded by LOC284281, corresponding to a target binding site such as BINDING SITE I, BINDING SITE II or BINDING SITE III of FIG. 8. Table 4 illustrates the complementarity of the nucleotide sequences of LOC284281 BINDING SITE, designated SEQ ID:7062, to the nucleotide sequence of GAM55 RNA, herein designated GAM RNA, also designated SEQ ID:387.

Another function of GAM55 is therefore inhibition of LOC284281 (Accession XP_211415.1). Accordingly, utilities of GAM55 include diagnosis, prevention and treatment of diseases and clinical conditions associated with LOC284281.

LOC284891 (Accession XP_211683.1) is another GAM55 target gene, herein designated TARGET GENE. LOC284891 BINDING SITE is a target binding site found in the 5' untranslated region of mRNA encoded by LOC284891, corresponding to a target binding site such as BINDING SITE I, BINDING SITE II or BINDING SITE III of FIG. 8. Table 4 illustrates the complementarity of the nucleotide sequences of LOC284891 BINDING SITE, designated SEQ ID:9719, to the nucleotide sequence of GAM55 RNA, herein designated GAM RNA, also designated SEQ ID:387.

Another function of GAM55 is therefore inhibition of LOC284891 (Accession XP_211683.1). Accordingly, utilities of GAM55 include diagnosis, prevention and treatment of diseases and clinical conditions associated with LOC284891.

LOC284925 (Accession XP_209414.1) is another GAM55 target gene, herein designated TARGET GENE. LOC284925 BINDING SITE is a target binding site found in the 3' untranslated region of mRNA encoded by LOC284925, corresponding to a target binding site such as BINDING SITE I, BINDING SITE II or BINDING SITE III of FIG. 8. Table 4 illustrates the complementarity of the nucleotide sequences of LOC284925 BINDING SITE, designated SEQ ID:2906, to the nucleotide sequence of GAM55 RNA, herein designated GAM RNA, also designated SEQ ID:387.

Another function of GAM55 is therefore inhibition of LOC284925 (Accession XP_209414.1). Accordingly, utilities of GAM55 include diagnosis, prevention and treatment of diseases and clinical conditions associated with LOC284925.

LOC284933 (Accession XP_211695.1) is another GAM55 target gene, herein designated TARGET GENE. LOC284933 BINDING SITE is a target binding site found in the 5' untranslated region of mRNA encoded by LOC284933, corresponding to a target binding site such as BINDING SITE I, BINDING SITE II or BINDING SITE III of FIG. 8. Table 4 illustrates the complementarity of the nucleotide sequences of LOC284933 BINDING SITE, designated SEQ ID:2110, to the nucleotide sequence of GAM55 RNA, herein designated GAM RNA, also designated SEQ ID:387.

Another function of GAM55 is therefore inhibition of LOC284933 (Accession XP_211695.1). Accordingly, utilities of GAM55 include diagnosis, prevention and treatment of diseases and clinical conditions associated with LOC284933.

LOC285174 (Accession XP_211798.1) is another GAM55 target gene, herein designated TARGET GENE. LOC285174 BINDING SITE is a target binding site found in the 5' untranslated region of mRNA encoded by LOC285174, corresponding to a target binding site such as BINDING SITE I, BINDING SITE II or BINDING SITE III of FIG. 8. Table 4 illustrates the complementarity of the nucleotide sequences of LOC285174 BINDING SITE, designated SEQ ID:17470, to the nucleotide sequence of GAM55 RNA, herein designated GAM RNA, also designated SEQ ID:387.

Another function of GAM55 is therefore inhibition of LOC285174 (Accession XP_211798.1). Accordingly, utilities of GAM55 include diagnosis, prevention and treatment of diseases and clinical conditions associated with LOC285174.

LOC285431 (Accession XP_211898.1) is another GAM55 target gene, herein designated TARGET GENE. LOC285431 BINDING SITE is a target binding site found in the 5' untranslated region of mRNA encoded by LOC285431, corresponding to a target binding site such as BINDING SITE I, BINDING SITE II or BINDING SITE III of FIG. 8. Table 4 illustrates the complementarity of the nucleotide sequences of LOC285431 BINDING SITE, designated SEQ ID:6402, to the nucleotide sequence of GAM55 RNA, herein designated GAM RNA, also designated SEQ ID:387.

Another function of GAM55 is therefore inhibition of LOC285431 (Accession XP_211898.1). Accordingly, utilities of GAM55 include diagnosis, prevention and treatment of diseases and clinical conditions associated with LOC285431.

LOC285602 (Accession XP_209676.1) is another GAM55 target gene, herein designated TARGET GENE. LOC285602 BINDING SITE is a target binding site found in the 5' untranslated region of mRNA encoded by LOC285602, corresponding to a target binding site such as BINDING SITE I, BINDING SITE II or BINDING SITE III of FIG. 8. Table 4 illustrates the complementarity of the nucleotide sequences of LOC285602 BINDING SITE, designated SEQ ID:4959, to the nucleotide sequence of GAM55 RNA, herein designated GAM RNA, also designated SEQ ID:387.

Another function of GAM55 is therefore inhibition of LOC285602 (Accession XP_209676.1). Accordingly, utilities of GAM55 include diagnosis, prevention and treatment of diseases and clinical conditions associated with LOC285602.

LOC286418 (Accession XP_210471.1) is another GAM55 target gene, herein designated TARGET GENE. LOC286418 BINDING SITE is a target binding site found in the 5' untranslated region of mRNA encoded by LOC286418, corresponding to a target binding site such as BINDING SITE I, BINDING SITE II or BINDING SITE III of FIG. 8. Table 4 illustrates the complementarity of the nucleotide sequences of LOC286418 BINDING SITE, designated SEQ ID:11434, to the nucleotide sequence of GAM55 RNA, herein designated GAM RNA, also designated SEQ ID:387.

Another function of GAM55 is therefore inhibition of LOC286418 (Accession XP_210471.1). Accordingly, utilities of GAM55 include diagnosis, prevention and treatment of diseases and clinical conditions associated with LOC286418.

LOC286527 (Accession XP_212336.1) is another GAM55 target gene, herein designated TARGET GENE. LOC286527 BINDING SITE is a target binding site found in the 3' untranslated region of mRNA encoded by LOC286527, corresponding to a target binding site such as BINDING SITE I, BINDING SITE II or BINDING SITE III of FIG. 8. Table 4 illustrates the complementarity of the nucleotide sequences of LOC286527 BINDING SITE, designated SEQ ID:8042, to the nucleotide sequence of GAM55 RNA, herein designated GAM RNA, also designated SEQ ID:387.

Another function of GAM55 is therefore inhibition of LOC286527 (Accession XP_212336.1). Accordingly, utilities of GAM55 include diagnosis, prevention and treatment of diseases and clinical conditions associated with LOC286527.

LOC348109 (Accession XP_302656.1) is another GAM55 target gene, herein designated TARGET GENE. LOC348109 BINDING SITE is a target binding site found in the 5' untranslated region of mRNA encoded by LOC348109, corresponding to a target binding site such as BINDING SITE I, BINDING SITE II or BINDING SITE III of FIG. 8. Table 4 illustrates the complementarity of the nucleotide sequences of LOC348109 BINDING SITE, designated SEQ ID:13521, to the nucleotide sequence of GAM55 RNA, herein designated GAM RNA, also designated SEQ ID:387.

Another function of GAM55 is therefore inhibition of LOC348109 (Accession XP_302656.1). Accordingly, utilities of GAM55 include diagnosis, prevention and treatment of diseases and clinical conditions associated with LOC348109.

LOC348454 (Accession XP_290909.1) is another GAM55 target gene, herein designated TARGET GENE. LOC348454 BINDING SITE is a target binding site found in the 3' untranslated region of mRNA encoded by LOC348454, corresponding to a target binding site such as BINDING SITE I, BINDING SITE II or BINDING SITE III of FIG. 8. Table 4 illustrates the complementarity of the nucleotide sequences of LOC348454 BINDING SITE, designated SEQ ID:15633, to the nucleotide sequence of GAM55 RNA, herein designated GAM RNA, also designated SEQ ID:387.

Another function of GAM55 is therefore inhibition of LOC348454 (Accession XP_290909.1). Accordingly, utilities of GAM55 include diagnosis, prevention and treatment of diseases and clinical conditions associated with LOC348454.

LOC348911 (Accession XP_302915.1) is another GAM55 target gene, herein designated TARGET GENE. LOC348911 BINDING SITE is a target binding site found in the 3' untranslated region of mRNA encoded by LOC348911, corresponding to a target binding site such as BINDING SITE I, BINDING SITE II or BINDING SITE III of FIG. 8. Table 4 illustrates the complementarity of the nucleotide sequences of LOC348911 BINDING SITE, designated SEQ ID:6953, to the nucleotide sequence of GAM55 RNA, herein designated GAM RNA, also designated SEQ ID:387.

Another function of GAM55 is therefore inhibition of LOC348911 (Accession XP_302915.1). Accordingly, utilities of GAM55 include diagnosis, prevention and treatment of diseases and clinical conditions associated with LOC348911.

LOC348938 (Accession XP_300883.1) is another GAM55 target gene, herein designated TARGET GENE. LOC348938 BINDING SITE is a target binding site found in the 3' untranslated region of mRNA encoded by LOC348938, corresponding to a target binding site such as BINDING SITE I, BINDING SITE II or BINDING SITE III of FIG. 8. Table 4 illustrates the complementarity of the nucleotide sequences of LOC348938 BINDING SITE, designated SEQ ID:1743, to the nucleotide sequence of GAM55 RNA, herein designated GAM RNA, also designated SEQ ID:387.

Another function of GAM55 is therefore inhibition of LOC348938 (Accession XP_300883.1). Accordingly, utilities of GAM55 include diagnosis, prevention and treatment of diseases and clinical conditions associated with LOC348938.

LOC349236 (Accession XP_300988.1) is another GAM55 target gene, herein designated TARGET GENE. LOC349236 BINDING SITE is a target binding site found in the 3' untranslated region of mRNA encoded by LOC349236, corresponding to a target binding site such as BINDING SITE I, BINDING SITE II or BINDING SITE III of FIG. 8. Table 4 illustrates the complementarity of the nucleotide sequences of LOC349236 BINDING SITE, designated SEQ ID:1579, to the nucleotide sequence of GAM55 RNA, herein designated GAM RNA, also designated SEQ ID:387.

Another function of GAM55 is therefore inhibition of LOC349236 (Accession XP_300988.1). Accordingly, utilities of GAM55 include diagnosis, prevention and treatment of diseases and clinical conditions associated with LOC349236.

LOC349395 (Accession XP_301067.1) is another GAM55 target gene, herein designated TARGET GENE. LOC349395 BINDING SITE is a target binding site found in the 3' untranslated region of mRNA encoded by LOC349395, corresponding to a target binding site such as BINDING SITE I, BINDING SITE II or BINDING SITE III of FIG. 8. Table 4 illustrates the complementarity of the nucleotide sequences of LOC349395 BINDING SITE, designated SEQ ID:5396, to the nucleotide sequence of GAM55 RNA, herein designated GAM RNA, also designated SEQ ID:387.

Another function of GAM55 is therefore inhibition of LOC349395 (Accession XP_301067.1). Accordingly, utilities of GAM55 include diagnosis, prevention and treatment of diseases and clinical conditions associated with LOC349395.

LOC90529 (Accession NP_835223.1) is another GAM55 target gene, herein designated TARGET GENE. LOC90529 BINDING SITE is a target binding site found in the 3' untranslated region of mRNA encoded by LOC90529, corresponding to a target binding site such as BINDING SITE I, BINDING SITE II or BINDING SITE III of FIG. 8. Table 4 illustrates the complementarity of the nucleotide sequences of LOC90529 BINDING SITE, designated SEQ ID:17696, to the nucleotide sequence of GAM55 RNA, herein designated GAM RNA, also designated SEQ ID:387.

Another function of GAM55 is therefore inhibition of LOC90529 (Accession NP_835223.1). Accordingly, utilities of GAM55 include diagnosis, prevention and treatment of diseases and clinical conditions associated with LOC90529.

LOC91661 (Accession NP_612381.1) is another GAM55 target gene, herein designated TARGET GENE. LOC91661 BINDING SITE is a target binding site found in the 3' untranslated region of mRNA encoded by LOC91661, corresponding to a target binding site such as BINDING SITE I, BINDING SITE II or BINDING SITE III of FIG. 8. Table 4 illustrates the complementarity of the nucleotide sequences of LOC91661 BINDING SITE, designated SEQ ID:19784, to the nucleotide sequence of GAM55 RNA, herein designated GAM RNA, also designated SEQ ID:387.

Another function of GAM55 is therefore inhibition of LOC91661 (Accession NP_612381.1). Accordingly, utilities of GAM55 include diagnosis, prevention and treatment of diseases and clinical conditions associated with LOC91661.

Mitogen-activated protein kinase kinase kinase 8 (MAP3K8, Accession NP_005195.2) is another GAM55 target gene, herein designated TARGET GENE. MAP3K8 BINDING SITE is a target binding site found in the 3' untranslated region of mRNA encoded by MAP3K8, corresponding to a target binding site such as BINDING SITE I, BINDING SITE II or BINDING SITE III of FIG. 8. Table 4 illustrates the complementarity of the nucleotide sequences of MAP3K8 BINDING SITE, designated SEQ ID:10457, to the nucleotide sequence of GAM55 RNA, herein designated GAM RNA, also designated SEQ ID:387.

Another function of GAM55 is therefore inhibition of Mitogen-activated protein kinase kinase kinase 8 (MAP3K8, Accession NP_005195.2), a gene which is able to activate nf-kappa-b 1 by stimulating proteasome-mediated p. Accordingly, utilities of GAM55 include diagnosis, prevention and treatment of diseases and clinical conditions associated with MAP3K8.

The function of MAP3K8 has been established by previous studies. By transfecting the hamster embryonic cell line SHOK with DNA extracted from a human thyroid carcinoma cell line, Miyoshi et al. (1991) identified the transforming oncogene 'cancer Osaka thyroid' (COT). Sequence analysis revealed that COT is a serine- threonine protein kinase. The authors compared genomic clones of COT from transformed SHOK cells and from human placenta cells and found that the COT oncogene had undergone a rearrangement within the last coding exon, an event which probably occurred during the initial transfection experiment. The COT protooncogene contains 8 exons. Aoki et al. (1993) reported that the predicted normal COT protein has 467 amino acids. In the COT oncoprotein, the C-terminal 70 amino acids of normal COT are replaced by 18 novel residues. Cell fractionation and immunoprecipitation studies demonstrated that the COT protooncogene encodes 58 - and 52-kD proteins that are located in the cytosol. Both proteins have serine/threonine kinase activity. The 2 COT isoforms appear to result from the use of alternative translation initiation sites. The 58-kD isoform had stronger transforming activity than the 52-kD protein, although this activity was much weaker than that of the oncoprotein. Aoki et al. (1993) suggested that the N-terminal domain of COT may be necessary for cellular transformation, whereas the C-terminal domain may negatively regulate the transforming activity. Chan et al. (1993) isolated a Ewing sarcoma cell line cDNA that transformed NIH3T3 cells. They designated the gene EST for 'Ewing sarcoma transformant' and identified it as COT. Since the EST cDNA encodes the normal form of the COT protein, the authors concluded that the COT gene can be activated as an oncogene by overexpression as well as by gene rearrangement. Northern blot analysis revealed that COT is expressed as a 3.2-kb mRNA in human fibroblasts and epithelial cells. Treatment of a lung fibroblast cell line with the tumor promoter okadaic acid induced COT expression Full details of the abovementioned studies are described in the following publications, the disclosure of which are hereby incorporated by reference:

Aoki, M.; Hamada, F.; Sugimoto, T.; Sumida, S.; Akiyama, T.; Toyoshima, K.: The human cot proto - oncogene encodes two protein serine/threonine kinases with different transforming activities by alternative initiation of translation. J. Biol. Chem. 268:22723-22732, 1993; and Chan, A. M.-L.; Chedid, M.; McGovern, E. S.; Popescu, N. C.; Miki, T.; Aaronson, S. A.: Expression cDNA cloning of a serine kinase transforming gene. Oncogene 8:1329-1333, 1993.

Further studies establishing the function and utilities of MAP3K8 are found in John Hopkins OMIM database record ID 603259, and in cited publications listed in Table 5, which are hereby incorporated by reference. MAWBP (Accession NP_071412.1) is another GAM55 target gene, herein designated TARGET GENE. MAWBP BINDING SITE is a target binding site found in the 3' untranslated region of mRNA encoded by MAWBP, corresponding to a target binding site such as BINDING SITE I, BINDING SITE II or BINDING SITE III of FIG. 8. Table 4 illustrates the complementarity of the nucleotide sequences of MAWBP BINDING SITE, designated SEQ ID:14451, to the nucleotide sequence of GAM55 RNA, herein designated GAM RNA, also designated SEQ ID:387.

Another function of GAM55 is therefore inhibition of MAWBP (Accession NP_071412.1). Accordingly, utilities of GAM55 include diagnosis, prevention and treatment of diseases and clinical conditions associated with MAWBP.

Methyl-cpg binding domain protein 2 (MBD2, Accession NP_056647.1) is another GAM55 target gene, herein designated TARGET GENE. MBD2 BINDING SITE is a target binding site found in the 3' untranslated region of multiple transcripts of mRNA encoded by MBD2, corresponding to a target binding site such as BINDING SITE I, BINDING SITE II or BINDING SITE III of FIG. 8. Table 4 illustrates the complementarity of the nucleotide sequences of MBD2 BINDING SITE, designated SEQ ID:12364, to the nucleotide sequence of GAM55 RNA, herein designated GAM RNA, also designated SEQ ID:387.

Another function of GAM55 is therefore inhibition of Methyl-cpg binding domain protein 2 (MBD2, Accession NP_056647.1). Accordingly, utilities of GAM55 include diagnosis, prevention and treatment of diseases and clinical conditions associated with MBD2.

Methyl-cpg binding domain protein 2 (MBD2, Accession NP_003918.1) is another GAM55 target gene, herein designated TARGET GENE. MBD2 BINDING SITE is a target binding site found in the 3' untranslated region of multiple transcripts of mRNA encoded by MBD2, corresponding to a target binding site such as BINDING SITE I, BINDING SITE II or BINDING SITE III of FIG. 8. Table 4 illustrates the complementarity of the nucleotide sequences of MBD2 BINDING SITE, designated SEQ ID:12364, to the nucleotide sequence of GAM55 RNA, herein designated GAM RNA, also designated SEQ ID:387.

Another function of GAM55 is therefore inhibition of Methyl-cpg binding domain protein 2 (MBD2, Accession NP_003918.1). Accordingly, utilities of GAM55 include diagnosis, prevention and treatment of diseases and clinical conditions associated with MBD2.

Mutated in colorectal cancers (MCC, Accession NP_002378.1) is another GAM55 target gene, herein designated TARGET GENE. MCC BINDING SITE is a target binding site found in the 3' untranslated region of mRNA encoded by MCC, corresponding to a target binding site such as BINDING SITE I, BINDING SITE II or BINDING SITE III of FIG. 8. Table 4 illustrates the complementarity of the nucleotide sequences of MCC BINDING SITE, designated SEQ ID:2297, to the nucleotide sequence of GAM55 RNA, herein designated GAM RNA, also designated SEQ ID:387.

Another function of GAM55 is therefore inhibition of Mutated in colorectal cancers (MCC, Accession NP_002378.1). Accordingly, utilities of GAM55 include diagnosis, prevention and treatment of diseases and clinical conditions associated with MCC.

Mitochondrial capsule selenoprotein (MCSP, Accession NP_109588.2) is another GAM55 target gene, herein designated TARGET GENE. MCSP BINDING SITE is a target binding site found in the 3' untranslated region of mRNA encoded by MCSP, corresponding to a target binding site such as BINDING SITE I, BINDING SITE II or BINDING SITE III of FIG. 8. Table 4 illustrates the complementarity of the nucleotide sequences of MCSP BINDING SITE, designated SEQ ID:11169, to the nucleotide sequence of GAM55 RNA, herein designated GAM RNA, also designated SEQ ID:387.

Another function of GAM55 is therefore inhibition of Mitochondrial capsule selenoprotein (MCSP, Accession NP_109588.2). Accordingly, utilities of GAM55 include diagnosis, prevention and treatment of diseases and clinical conditions associated with MCSP.

Mannosyl (alpha-1,3-)-glycoprotein beta-1,4-n-acetylglucosaminyltransferase, isoenzyme b (MGAT4B, Accession NP_463459.1) is another GAM55 target gene, herein designated TARGET GENE. MGAT4B BINDING SITE is a target binding site found in the 5' untranslated region of multiple transcripts of mRNA encoded by MGAT4B, corresponding to a target binding site such as BINDING SITE I, BINDING SITE II or BINDING SITE III of FIG. 8. Table 4 illustrates the complementarity of the nucleotide sequences of MGAT4B BINDING SITE, designated SEQ ID:15568, to the nucleotide sequence of GAM55 RNA, herein designated GAM RNA, also designated SEQ ID:387.

Another function of GAM55 is therefore inhibition of Mannosyl (alpha-1,3-)-glycoprotein beta-1,4-n-acetylglucosaminyltransferase, isoenzyme b (MGAT4B, Accession NP_463459.1). Accordingly, utilities of GAM55 include diagnosis, prevention and treatment of diseases and clinical conditions associated with MGAT4B.

MGC14386 (Accession NP_291022.1) is another GAM55 target gene, herein designated TARGET GENE. MGC14386 BINDING SITE is a target binding site found in the 5' untranslated region of mRNA encoded by MGC14386, corresponding to a target binding site such as BINDING SITE I, BINDING SITE II or BINDING SITE III of FIG. 8. Table 4 illustrates the complementarity of the nucleotide sequences of MGC14386 BINDING SITE, designated SEQ ID:18289, to the nucleotide sequence of GAM55 RNA, herein designated GAM RNA, also designated SEQ ID:387.

Another function of GAM55 is therefore inhibition of MGC14386 (Accession NP_291022.1). Accordingly, utilities of GAM55 include diagnosis, prevention and treatment of diseases and clinical conditions associated with MGC14386.

MGC23166 (Accession NP_689948.1) is another GAM55 target gene, herein designated TARGET GENE. MGC23166 BINDING SITE is a target binding site found in the 3' untranslated region of mRNA encoded by MGC23166, corresponding to a target binding site such as BINDING SITE I, BINDING SITE II or BINDING SITE III of FIG. 8. Table 4 illustrates the complementarity of the nucleotide sequences of MGC23166 BINDING SITE, designated SEQ ID:19091, to the nucleotide sequence of GAM55 RNA, herein designated GAM RNA, also designated SEQ ID:387.

Another function of GAM55 is therefore inhibition of MGC23166 (Accession NP_689948.1). Accordingly, utilities of GAM55 include diagnosis, prevention and treatment of diseases and clinical conditions associated with MGC23166.

NaGLT1 (Accession NP_699200.1) is another GAM55 target gene, herein designated TARGET GENE. NaGLT1 BINDING SITE is a target binding site found in the 5' untranslated region of mRNA encoded by NaGLT1, corresponding to a target binding site such as BINDING SITE I, BINDING SITE II or BINDING SITE III of FIG. 8. Table 4 illustrates the complementarity of the nucleotide sequences of NaGLT1 BINDING SITE, designated SEQ ID:14714, to the nucleotide sequence of GAM55 RNA, herein designated GAM RNA, also designated SEQ ID:387.

Another function of GAM55 is therefore inhibition of NaGLT1 (Accession NP_699200.1). Accordingly, utilities of GAM55 include diagnosis, prevention and treatment of diseases and clinical conditions associated with NaGLT1.

N-acetyltransferase 8 (camello like) (NAT8, Accession NP_003951.2) is another GAM55 target gene, herein designated TARGET GENE. NAT8 BINDING SITE is a target binding site found in the 5' untranslated region of mRNA encoded by NAT8, corresponding to a target binding site such as BINDING SITE I, BINDING SITE II or BINDING SITE III of FIG. 8. Table 4 illustrates the complementarity of the nucleotide sequences of NAT8 BINDING SITE, designated SEQ ID:12162, to the nucleotide sequence of GAM55 RNA, herein designated GAM RNA, also designated SEQ ID:387.

Another function of GAM55 is therefore inhibition of N-acetyltransferase 8 (camello like) (NAT8, Accession NP_003951.2). Accordingly, utilities of GAM55 include diagnosis, prevention and treatment of diseases and clinical conditions associated with NAT8.

Nk2 transcription factor related, locus 8 (drosophila) (NKX2-8, Accession NP_055175.2) is another GAM55 target gene, herein designated TARGET GENE. NKX2-8 BINDING SITE is a target binding site found in the 3' untranslated region of mRNA encoded by NKX2-8, corresponding to a target binding site such as BINDING SITE I, BINDING SITE II or BINDING SITE III of FIG. 8. Table 4 illustrates the complementarity of the nucleotide sequences of NKX2-8 BINDING SITE, designated SEQ ID:10500, to the nucleotide sequence of GAM55 RNA, herein designated GAM RNA, also designated SEQ ID:387.

Another function of GAM55 is therefore inhibition of Nk2 transcription factor related, locus 8 (drosophila) (NKX2-8, Accession NP_055175.2). Accordingly, utilities of GAM55 include diagnosis, prevention and treatment of diseases and clinical conditions associated with NKX2-8.

Nucleophosmin (nucleolar phosphoprotein b23, numatrin) (NPM1, Accession NP_002511.1) is another GAM55 target gene, herein designated TARGET GENE. NPM1 BINDING SITE is a target binding site found in the 3' untranslated region of mRNA encoded by NPM1, corresponding to a target binding site such as BINDING SITE I, BINDING SITE II or BINDING SITE III of FIG. 8. Table 4 illustrates the complementarity of the nucleotide sequences of NPM1 BINDING SITE, designated SEQ ID:5396, to the nucleotide sequence of GAM55 RNA, herein designated GAM RNA, also designated SEQ ID:387.

Another function of GAM55 is therefore inhibition of Nucleophosmin (nucleolar phosphoprotein b23, numatrin) (NPM1, Accession NP_002511.1), a gene which is associated with nucleolar ribonucleoprotein structures and binds single-stranded nucleic acids. Accordingly, utilities of GAM55 include diagnosis, prevention and treatment of diseases and clinical conditions associated with NPM1.

The function of NPM1 has been established by previous studies. Nucleophosmin is a nucleolar phosphoprotein that is more abundant in tumor cells than in normal resting cells. Stimulation of the growth of normal cells, e.g., mitogen activation of B lymphocytes, is accompanied by an increase in nucleophosmin protein level. Although the function of nucleophosmin has not been defined precisely, ample evidence suggests that it is involved in the assembly of ribosomal proteins into ribosomes. Electron microscopic study indicates that nucleophosmin is concentrated in the granular region of the nucleolus, where ribosome assembly occurs. Chan et al. (1989) reported the nucleotide sequence of a cDNA of human nucleophosmin. The cDNA has a coding sequence equivalent to a protein of 294 amino acids. When protein levels were compared with Western blot immunoassay, Novikoff hepatoma showed 20 times more nucleophosmin than normal, and hypertrophic rat liver showed about 5 times more nucleophosmin than unstimulated normal liver.

Animal model experiments lend further support to the function of NPM1. Cheng et al. (1999) generated transgenic mice with Plzf-Rara and Npm-Rara. Plzf-Rara transgenic animals developed chronic myeloid leukemia-like phenotypes at an early stage in life (within 3 months in 5 of 6 mice), whereas 3 Npm-Rara transgenic mice showed a spectrum of phenotypes from typical APL to chronic myeloid leukemia relatively late in life (from 12 to 15 months). In contrast to bone marrow cells from Plzf-Rara transgenic mice, those from Npm-Rara transgenic mice could be induced to differentiate by all-trans-retinoic acid (ATRA). Cheng et al. (1999) found that in interacting with nuclear coreceptors the 2 fusion proteins had different ligand sensitivities, which may be the underlying molecular mechanism for differential responses to ATRA. These data clearly established the leukemogenic role of PLZF-RARA and NPM-RARA and the importance of fusion receptor/corepressor interactions in the pathogenesis as well as in determining different clinical phenotypes of APL.

It is appreciated that the abovementioned animal model for NPM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chan, W.-Y.; Liu, Q.-R.; Borjigin, J.; Busch, H.; Rennert, O. M.; Tease, L. A.; Chan, P.-K.: Characterization of the cDNA encoding human nucleophosmin and studies of its role in normal and abnormal growth. Biochemistry 28:1033-1039, 1989; and Cheng, G.-X.; Zhu, X.-H.; Men, X.-Q.; Wang, L.; Huang, Q.-H.; Jin, X. L.; Xiong, S.-M.; Zhu, J.; Guo, W.-M.; Chen, J.-Q.; Xu, S.-F.; So, E.; Chan, L.-C.; Waxman, S.; Zelent, A.; Chen, G.

Further studies establishing the function and utilities of NPM1 are found in John Hopkins OMIM database record ID 164040, and in cited publications listed in Table 5, which are hereby incorporated by reference. PART1 (Accession NP_057674.1) is another GAM55 target gene, herein designated TARGET GENE. PART1 BINDING SITE is a target binding site found in the 3' untranslated region of mRNA encoded by PART1, corresponding to a target binding site such as BINDING SITE I, BINDING SITE II or BINDING SITE III of FIG. 8. Table 4 illustrates the complementarity of the nucleotide sequences of PART1 BINDING SITE, designated SEQ ID:6436, to the nucleotide sequence of GAM55 RNA, herein designated GAM RNA, also designated SEQ ID:387.

Another function of GAM55 is therefore inhibition of PART1 (Accession NP_057674.1). Accordingly, utilities of GAM55 include diagnosis, prevention and treatment of diseases and clinical conditions associated with PART1.

Pbx/knotted 1 homeobox 1 (PKNOX1, Accession NP_004562.2) is another GAM55 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:6249, to the nucleotide sequence of GAM55 RNA, herein designated GAM RNA, also designated SEQ ID:387.

Another function of GAM55 is therefore inhibition of Pbx/knotted 1 homeobox 1 (PKNOX1, Accession NP_004562.2), a gene which may regulate gene expression and control cell differentiation. Accordingly, utilities of GAM55 include diagnosis, prevention and treatment of diseases and clinical conditions associated with PKNOX1.

The function of PKNOX1 has been established by previous studies. As part of developing a transcript map of human chromosome 21, Chen et al. (1997) used exon trapping to identify portions of genes from chromosome 21-specific cosmids. They identified a trapped exon that is identical to a region of the human expressed sequence tag (EST) L12425. Using the exon and EST as probes, they screened human fetal brain and kidney cDNA libraries and cloned the corresponding gene, which encodes a homeodomain-containing polypeptide of 436 amino acids. Chen et al. (1997) used the EST as a probe for Northern analysis and detected transcripts of 2.5 and 5 kb in every human tissue examined, including heart, brain and brain subregions, placenta, lung, liver, muscle, and several fetal tissues. The gene, designated PBX/knotted-1 homeo box-1 (OMIM Ref. No. PKNOX1), has a homeodomain closely related to those of the mammalian PBX family (such as mouse Meis1) and the plant knotted-1 family (involved in plant development). Chen et al. (1997) used PCR amplification, hybridization, and genetic linkage analysis to map PKNOX1 to 21q22.3 between markers D21S212 and D21S25 on YAC350F7. By fluorescence in situ hybridization, Berthelsen et al. (1998) mapped the PKNOX1 gene to human chromosome 21q22.3 and mouse chromosome 17B/C.

Full details of the abovementioned studies are described in the following publications, the disclosure of which are hereby incorporated by reference:

Berthelsen, J.; Viggiano, L.; Schulz, H.; Ferretti, E.; Consalez, G. G.; Rocchi, M.; Blasi, F.: PKNOX1, a gene encoding PREP1, a new regulator of Pbx activity, maps on human chromosome 21q22.3 and murine chromosome 17B/C. Genomics 47:323-324, 1998; and Chen, H.; Rossier, C.; Nakamura, Y.; Lynn, A.; Chakravarti, A.; Antonarakis, S. E. : Cloning of a novel homeobox-containing gene, PKNOX1, and mapping to human chromosome 21q22.3. Genomi.

Further studies establishing the function and utilities of PKNOX1 are found in John Hopkins OMIM database record ID 602100, and in cited publications listed in Table 5, which are hereby incorporated by reference. Proteasome (prosome, macropain) subunit, alpha type, 1 (PSMA1, Accession NP_683877.1) is another GAM55 target gene, herein designated TARGET GENE. PSMA1 BINDING SITE is a target binding site found in the 5' untranslated region of multiple transcripts of mRNA encoded by PSMA1, corresponding to a target binding site such as BINDING SITE I, BINDING SITE II or BINDING SITE III of FIG. 8. Table 4 illustrates the complementarity of the nucleotide sequences of PSMA1 BINDING SITE, designated SEQ ID:4352, to the nucleotide sequence of GAM55 RNA, herein designated GAM RNA, also designated SEQ ID:387.

Another function of GAM55 is therefore inhibition of Proteasome (prosome, macropain) subunit, alpha type, 1 (PSMA1, Accession NP_683877.1), a gene which is responsible for the degradation of most cellular proteins. Accordingly, utilities of GAM55 include diagnosis, prevention and treatment of diseases and clinical conditions associated with PSMA1.

The function of PSMA1 has been established by previous studies. DeMartino et al. (1991) cloned the PSMA1 gene, termed 'subunit nu' by them. The cDNA encoded a 263-amino acid polypeptide. The calculated and observed molecular masses are 29.5 kD and 35 kD, respectively. Northern blot analysis revealed an 1.4-kb mRNA in human placenta and HeLa cells. Coux et al. (1996) noted that 2 proteins, HC2 (29.5 kD) and Pros30 (30.2 kD), are encoded by the PSMA1 gene. Coux et al. (1996) reviewed the structures and functions of the 20S proteasome subunits. The alpha subunits comprise the outer rings of the proteasome. Some alpha subunits contain a functional nuclear localization signal; proteasomes are found in both the nuclear and cytoplasmic compartments of the cell. Alpha subunits may constitute a physical barrier that limits access of cytosolic proteins into the inner proteolytic chamber. Bey et al. (1993) mapped the PSMA1 gene to chromosome 11p15.1 by fluorescence in situ hybridization Full details of the abovementioned studies are described in the following publications, the disclosure of which are hereby incorporated by reference:

Bey, F.; Silva Pereira, I.; Coux, O.; Viegas-Pequignot, E.; Recillas Targa, F.; Nothwang, H. G.; Dutrillaux, B.; Scherrer, K.: The prosomal RNA-binding protein p27K is a member of the alpha-type human prosomal gene family. Molec. Gen. Genet. 237:193-205, 1993; and Coux, O.; Tanaka, K.; Goldberg, A. L.: Structure and functions of the 20S and 26S proteasomes. Ann. Rev. Biochem. 65:801-847, 1996.

Further studies establishing the function and utilities of PSMA1 are found in John Hopkins OMIM database record ID 602854, and in cited publications listed in Table 5, which are hereby incorporated by reference. Phosphotriesterase related (PTER, Accession NP_109589.2) is another GAM55 target gene, herein designated TARGET GENE. PTER BINDING SITE is a target binding site found in the 3' untranslated region of mRNA encoded by PTER, corresponding to a target binding site such as BINDING SITE I, BINDING SITE II or BINDING SITE III of FIG. 8. Table 4 illustrates the complementarity of the nucleotide sequences of PTER BINDING SITE, designated SEQ ID:8150, to the nucleotide sequence of GAM55 RNA, herein designated GAM RNA, also designated SEQ ID:387.

Another function of GAM55 is therefore inhibition of Phosphotriesterase related (PTER, Accession NP_109589.2), a gene which is a phosphotriesterase homology protein. Accordingly, utilities of GAM55 include diagnosis, prevention and treatment of diseases and clinical conditions associated with PTER.

The function of PTER has been established by previous studies. Microbial phosphotriesterases are a group of zinc metalloenzymes that catalyze the hydrolysis of a range of phosphotriester compounds. Davies et al. (1997) isolated rat cDNAs encoding a phosphotriesterase homolog, which they named rpr1. Using a rat rpr1 cDNA as a hybridization probe, Alimova-Kost et al. (1998) isolated human genomic sequences of PTER, a homolog of phosphotriesterases. By FISH, Alimova-Kost et al. (1998) mapped the human PTER gene to 10p12

Full details of the abovementioned studies are described in the following publications, the disclosure of which are hereby incorporated by reference:

Alimova-Kost, M. V.; Imreh, S.; Buchman, V. L.; Ninkina, N. N.: Assignment of phosphotriesterase-related gene (PTER) to human chromosome band 10p12 by in situ hybridization. Cytogenet. Cell Genet. 83:16-17, 1998; and Davies, J. A.; Buchman, V. L.; Krylova, O.; Ninkina, N. N.: Molecular cloning and expression pattern of rpr-1, a resiniferatoxin-binding, phosphotriesterase-related protein, expressed.

Further studies establishing the function and utilities of PTER are found in John Hopkins OMIM database record ID 604446, and in cited publications listed in Table 5, which are hereby incorporated by reference. Retinoic acid induced 15 (RAI15, Accession XP_039548.2) is another GAM55 target gene, herein designated TARGET GENE. RAI15 BINDING SITE is a target binding site found in the 3' untranslated region of mRNA encoded by RAI15, corresponding to a target binding site such as BINDING SITE I, BINDING SITE II or BINDING SITE III of FIG. 8. Table 4 illustrates the complementarity of the nucleotide sequences of RAI15 BINDING SITE, designated SEQ ID:9537, to the nucleotide sequence of GAM55 RNA, herein designated GAM RNA, also designated SEQ ID:387.

Another function of GAM55 is therefore inhibition of Retinoic acid induced 15 (RAI15, Accession XP_039548.2). Accordingly, utilities of GAM55 include diagnosis, prevention and treatment of diseases and clinical conditions associated with RAI15.

Ras association (ralgds/af-6) domain family 2 (RASSF2, Accession NP_055552.1) is another GAM55 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:6459, to the nucleotide sequence of GAM55 RNA, herein designated GAM RNA, also designated SEQ ID:387.

Another function of GAM55 is therefore inhibition of Ras association (ralgds/af-6) domain family 2 (RASSF2, Accession NP_055552.1). Accordingly, utilities of GAM55 include diagnosis, prevention and treatment of diseases and clinical conditions associated with RASSF2.

Ras association (ralgds/af-6) domain family 2 (RASSF2, Accession NP_739579.1) is another GAM55 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:6459, to the nucleotide sequence of GAM55 RNA, herein designated GAM RNA, also designated SEQ ID:387.

Another function of GAM55 is therefore inhibition of Ras association (ralgds/af-6) domain family 2 (RASSF2, Accession NP_739579.1). Accordingly, utilities of GAM55 include diagnosis, prevention and treatment of diseases and clinical conditions associated with RASSF2.

Ras association (ralgds/af-6) domain family 2 (RASSF2, Accession NP_739580.1) is another GAM55 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:6459, to the nucleotide sequence of GAM55 RNA, herein designated GAM RNA, also designated SEQ ID:387.

Another function of GAM55 is therefore inhibition of Ras association (ralgds/af-6) domain family 2 (RASSF2, Accession NP_739580.1). Accordingly, utilities of GAM55 include diagnosis, prevention and treatment of diseases and clinical conditions associated with RASSF2.

Ribosomal protein l17 (RPL17, Accession NP_000976.1) is another GAM55 target gene, herein designated TARGET GENE. RPL17 BINDING SITE is a target binding site found in the 5' untranslated region of mRNA encoded by RPL17, corresponding to a target binding site such as BINDING SITE I, BINDING SITE II or BINDING SITE III of FIG. 8. Table 4 illustrates the complementarity of the nucleotide sequences of RPL17 BINDING SITE, designated SEQ ID:14681, to the nucleotide sequence of GAM55 RNA, herein designated GAM RNA, also designated SEQ ID:387.

Another function of GAM55 is therefore inhibition of Ribosomal protein l17 (RPL17, Accession NP_000976.1). Accordingly, utilities of GAM55 include diagnosis, prevention and treatment of diseases and clinical conditions associated with RPL17.

SEC22L3 (Accession NP_004197.1) is another GAM55 target gene, herein designated TARGET GENE. SEC22L3 BINDING SITE is a target binding site found in the 3' untranslated region of multiple transcripts of mRNA encoded by SEC22L3, corresponding to a target binding site such as BINDING SITE I, BINDING SITE II or BINDING SITE III of FIG. 8. Table 4 illustrates the complementarity of the nucleotide sequences of SEC22L3 BINDING SITE, designated SEQ ID:5454, to the nucleotide sequence of GAM55 RNA, herein designated GAM RNA, also designated SEQ ID:387.

Another function of GAM55 is therefore inhibition of SEC22L3 (Accession NP_004197.1). Accordingly, utilities of GAM55 include diagnosis, prevention and treatment of diseases and clinical conditions associated with SEC22L3.

Solute carrier family 25 (mitochondrial carrier; dicarboxylate transporter), member 10 (SLC25A10, Accession NP_036272.2) is another GAM55 target gene, herein designated TARGET GENE. SLC25A10 BINDING SITE is a target binding site found in the 5' untranslated region of mRNA encoded by SLC25A10, corresponding to a target binding site such as BINDING SITE I, BINDING SITE II or BINDING SITE III of FIG. 8. Table 4 illustrates the complementarity of the nucleotide sequences of SLC25A10 BINDING SITE, designated SEQ ID:15569, to the nucleotide sequence of GAM55 RNA, herein designated GAM RNA, also designated SEQ ID:387.

Another function of GAM55 is therefore inhibition of Solute carrier family 25 (mitochondrial carrier; dicarboxylate transporter), member 10 (SLC25A10, Accession NP_036272.2). Accordingly, utilities of GAM55 include diagnosis, prevention and treatment of diseases and clinical conditions associated with SLC25A10.

SYNE2 (Accession NP_055995.2) is another GAM55 target gene, herein designated TARGET GENE. SYNE2 BINDING SITE is a target binding site found in the 3' untranslated region of mRNA encoded by SYNE2, corresponding to a target binding site such as BINDING SITE I, BINDING SITE II or BINDING SITE III of FIG. 8. Table 4 illustrates the complementarity of the nucleotide sequences of SYNE2 BINDING SITE, designated SEQ ID:19149, to the nucleotide sequence of GAM55 RNA, herein designated GAM RNA, also designated SEQ ID:387.

Another function of GAM55 is therefore inhibition of SYNE2 (Accession NP_055995.2). Accordingly, utilities of GAM55 include diagnosis, prevention and treatment of diseases and clinical conditions associated with SYNE2.

TA-PP2C (Accession NP_644812.1) is another GAM55 target gene, herein designated TARGET GENE. TA-PP2C BINDING SITE is a target binding site found in the 3' untranslated region of mRNA encoded by TA-PP2C, corresponding to a target binding site such as BINDING SITE I, BINDING SITE II or BINDING SITE III of FIG. 8. Table 4 illustrates the complementarity of the nucleotide sequences of TA-PP2C BINDING SITE, designated SEQ ID:2661, to the nucleotide sequence of GAM55 RNA, herein designated GAM RNA, also designated SEQ ID:387.

Another function of GAM55 is therefore inhibition of TA-PP2C (Accession NP_644812.1). Accordingly, utilities of GAM55 include diagnosis, prevention and treatment of diseases and clinical conditions associated with TA-PP2C.

Tripartite motif-containing 10 (TRIM10, Accession NP_006769.1) is another GAM55 target gene, herein designated TARGET GENE. TRIM10 BINDING SITE is a target binding site found in the 3' untranslated region of multiple transcripts of mRNA encoded by TRIM10, corresponding to a target binding site such as BINDING SITE I, BINDING SITE II or BINDING SITE III of FIG. 8. Table 4 illustrates the complementarity of the nucleotide sequences of TRIM10 BINDING SITE, designated SEQ ID:7339, to the nucleotide sequence of GAM55 RNA, herein designated GAM RNA, also designated SEQ ID:387.

Another function of GAM55 is therefore inhibition of Tripartite motif-containing 10 (TRIM10, Accession NP_006769.1). Accordingly, utilities of GAM55 include diagnosis, prevention and treatment of diseases and clinical conditions associated with TRIM10.

Thioredoxin reductase 2 (TXNRD2, Accession NP_665690.1) is another GAM55 target gene, herein designated TARGET GENE. TXNRD2 BINDING SITE is a target binding site found in the 5' untranslated region of multiple transcripts of mRNA encoded by TXNRD2, corresponding to a target binding site such as BINDING SITE I, BINDING SITE II or BINDING SITE III of FIG. 8. Table 4 illustrates the complementarity of the nucleotide sequences of TXNRD2 BINDING SITE, designated SEQ ID:14503, to the nucleotide sequence of GAM55 RNA, herein designated GAM RNA, also designated SEQ ID:387.

Another function of GAM55 is therefore inhibition of Thioredoxin reductase 2 (TXNRD2, Accession NP_665690.1), a gene which is one mitochondrial thioredoxin reductase. Accordingly, utilities of GAM55 include diagnosis, prevention and treatment of diseases and clinical conditions associated with TXNRD2.

The function of TXNRD2 has been established by previous studies. By screening placenta, heart, and fetal heart cDNA libraries with a fragment of TXNRD1, or TR-alpha, as probe, Gasdaska et al. (1999) isolated a cDNA encoding TR-beta. The deduced 524-amino acid protein, which is 54% identical to TXNRD1, has a high content of positively charged residues in the N terminus and a conserved penultimate sec residue. Analysis of the 3-prime UTR revealed the presence of a region with the sequence and structure of a SECIS, although it is distinct from that of TXNRD1. Northern blot analysis detected ubiquitous expression of a 2.4-kb TR-beta transcript, with highest levels in prostate, testis, liver, uterus, and small intestine; this expression pattern is distinct from that of TXNRD1. Western blot analysis showed expression of a 54-kD cytosolic protein. Functional analysis confirmed the activity of TR-beta as a thioredoxin reductase that can directly reduce proteins such as insulin. By searching an EST database for sequences homologous to TXNRD1, Miranda-Vizuete et al. (1999) obtained a nearly complete cDNA encoding TR-beta, which they called TRXR2. The predicted protein contains an N-terminal mitochondrial localization sequence (MLS), conserved FAD- and NADPH-binding domains, and a conserved active site. Fluorescence microscopy and mutation analysis demonstrated a mitochondrial localization that requires the presence of the N-terminal MLS.

Full details of the abovementioned studies are described in the following publications, the disclosure of which are hereby incorporated by reference:

Gasdaska, P. Y.; Berggren, M. M.; Berry, M. J.; Powis, G.: Cloning, sequencing, and functional expression of a novel human thioredoxin reductase. FEBS Lett. 442:105-111, 1999; and Miranda-Vizuete, A.; Damdimopoulos, A. E.; Spyrou, G.: cDNA cloning, expression and chromosomal localization of the mouse mitochondrial thioredoxin reductase gene. Biochim. Biophys. Acta 1.

Further studies establishing the function and utilities of TXNRD2 are found in John Hopkins OMIM database record ID 606448, and in cited publications listed in Table 5, which are hereby incorporated by reference. VEZATIN (Accession NP_060069.2) is another GAM55 target gene, herein designated TARGET GENE. VEZATIN BINDING SITE1 and VEZATIN BINDING SITE2 are target binding sites found in untranslated regions of mRNA encoded by VEZATIN, corresponding to target binding sites such as BINDING SITE I, BINDING SITE II or BINDING SITE III of FIG. 8. Table 4 illustrates the complementarity of the nucleotide sequences of VEZATIN BINDING SITE1 and VEZATIN BINDING SITE2, designated SEQ ID:18752 and SEQ ID:14500 respectively, to the nucleotide sequence of GAM55 RNA, herein designated GAM RNA, also designated SEQ ID:387.

Another function of GAM55 is therefore inhibition of VEZATIN (Accession NP_060069.2). Accordingly, utilities of GAM55 include diagnosis, prevention and treatment of diseases and clinical conditions associated with VEZATIN.

VMP1 (Accession NP_112200.2) is another GAM55 target gene, herein designated TARGET GENE. VMP1 BINDING SITE is a target binding site found in the 5' untranslated region of mRNA encoded by VMP1, corresponding to a target binding site such as BINDING SITE I, BINDING SITE II or BINDING SITE III of FIG. 8. Table 4 illustrates the complementarity of the nucleotide sequences of VMP1 BINDING SITE, designated SEQ ID:8550, to the nucleotide sequence of GAM55 RNA, herein designated GAM RNA, also designated SEQ ID:387.

Another function of GAM55 is therefore inhibition of VMP1 (Accession NP_112200.2). Accordingly, utilities of GAM55 include diagnosis, prevention and treatment of diseases and clinical conditions associated with VMP1.

Zinc finger protein 41 (ZNF41, Accession NP_700359.1) is another GAM55 target gene, herein designated TARGET GENE. ZNF41 BINDING SITE is a target binding site found in the 3' untranslated region of multiple transcripts of mRNA encoded by ZNF41, corresponding to a target binding site such as BINDING SITE I, BINDING SITE II or BINDING SITE III of FIG. 8. Table 4 illustrates the complementarity of the nucleotide sequences of ZNF41 BINDING SITE, designated SEQ ID:10401, to the nucleotide sequence of GAM55 RNA, herein designated GAM RNA, also designated SEQ ID:387.

Another function of GAM55 is therefore inhibition of Zinc finger protein 41 (ZNF41, Accession NP_700359.1). Accordingly, utilities of GAM55 include diagnosis, prevention and treatment of diseases and clinical conditions associated with ZNF41.

Zinc finger protein 41 (ZNF41, Accession NP_009061.1) is another GAM55 target gene, herein designated TARGET GENE. ZNF41 BINDING SITE is a target binding site found in the 3' untranslated region of multiple transcripts of mRNA encoded by ZNF41, corresponding to a target binding site such as BINDING SITE I, BINDING SITE II or BINDING SITE III of FIG. 8. Table 4 illustrates the complementarity of the nucleotide sequences of ZNF41 BINDING SITE, designated SEQ ID:10401, to the nucleotide sequence of GAM55 RNA, herein designated GAM RNA, also designated SEQ ID:387.

Another function of GAM55 is therefore inhibition of Zinc finger protein 41 (ZNF41, Accession NP_009061.1). Accordingly, utilities of GAM55 include diagnosis, prevention and treatment of diseases and clinical conditions associated with ZNF41.

FIG. 8 further provides a conceptual description of a novel bioinformatically detected of the present invention, referred to here as Genomic Address Messenger 56 (GAM56), which modulates expression of respective target genes thereof, the function and utility of which target genes is known in the art.

GAM56 is a novel bioinformatically detected regulatory, non protein coding, micro RNA (miRNA) gene. The method by which GAM56 was detected is described hereinabove with reference to FIGS. 8-15.

GAM56 gene, herein designated GAM GENE, and GAM56 target gene, herein designated TARGET GENE, are human genes contained in the human genome.

GAM56 gene encodes a GAM56 precursor RNA, herein designated GAM PRECURSOR RNA. Similar to other miRNA genes, and unlike most ordinary genes, GAM56 precursor RNA does not encode a protein. A nucleotide sequence identical or highly similar to the nucleotide sequence of GAM56 precursor RNA is designated SEQ ID:23, and is provided hereinbelow with reference to the sequence listing part. Nucleotide sequence SEQ ID:23 is located at position 167913324 relative to chromosome 5.

GAM56 precursor RNA folds onto itself, forming GAM56 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM56 precursor RNA folds onto itself, forming GAM56 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM56 precursor RNA, designated SEQ-ID:23, and a schematic representation of a predicted secondary folding of GAM56 folded precursor RNA are further described with reference to Table 2, hereby incorporated by reference.

An enzyme complex designated DICER COMPLEX, 'dices' the GAM56 folded precursor RNA into GAM56 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM56 RNA is designated SEQ ID:315, and is provided hereinbelow with references to the sequence listing part and Table 3, hereby incorporated by reference.

GAM56 target gene, herein designated TARGET GENE, encodes a corresponding messenger RNA, GAM56 target RNA, herein designated GAM TARGET RNA. GAM56 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM56 RNA, herein designated GAM RNA, binds complementarily to one or more target binding sites located in untranslated regions of GAM56 target RNA, herein designated GAM TARGET RNA. This complementary binding is due to the fact that the nucleotide sequence of GAM56 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM56 RNA may have a different number of target binding sites in untranslated regions of a GAM56 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM56 RNA, herein designated GAM RNA, to target binding sites on GAM56 target RNA, herein designated GAM TARGET RNA, such as BINDING SITE I, BINDING SITE II and BINDING SITE III, inhibits translation of GAM56 target RNA into GAM56 target protein, herein designated GAM TARGET PROTEIN. GAM target protein is therefore outlined by a broken line.

It is appreciated that GAM56 target gene, herein designated TARGET GENE, in fact represents a plurality of GAM56 target genes. The mRNA of each one of this plurality of GAM56 target genes comprises one or more target binding sites, each having a nucleotide sequence which is at least partly complementary to GAM56 RNA, herein designated GAM RNA, and which when bound by GAM56 RNA causes inhibition of translation of respective one or more GAM56 target proteins.

It is further appreciated by one skilled in the art that the mode of translational inhibition illustrated by FIG. 8 with specific reference to translational inhibition exerted by GAM56 gene, herein designated GAM GENE, on one or more GAM56 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM56 correlate with, and may be deduced from, the identity of the target genes which GAM56 binds and inhibits, and the function of these target genes, as elaborated hereinbelow.

Egf-containing fibulin-like extracellular matrix protein 1 (EFEMP1, Accession NM_004105.2) is a GAM56 target gene, herein designated TARGET GENE. EFEMP1 BINDING SITE is a target binding site found in the 3' untranslated region of multiple transcripts of mRNA encoded by EFEMP1, corresponding to a target binding site such as BINDING SITE I, BINDING SITE II or BINDING SITE III of FIG. 8. Table 4 illustrates the complementarity of the nucleotide sequences of EFEMP1 BINDING SITE, designated SEQ ID:10550, to the nucleotide sequence of GAM56 RNA, herein designated GAM RNA, also designated SEQ ID:315.

A function of GAM56 is therefore inhibition of Egf-containing fibulin-like extracellular matrix protein 1 (EFEMP1, Accession NM_004105.2). Accordingly, utilities of GAM56 include diagnosis, prevention and treatment of diseases and clinical conditions associated with EFEMP1.

FIG. 8 further provides a conceptual description of a novel bioinformatically detected of the present invention, referred to here as Genomic Address Messenger 57 (GAM57), which modulates expression of respective target genes thereof, the function and utility of which target genes is known in the art.

GAM57 is a novel bioinformatically detected regulatory, non protein coding, micro RNA (miRNA) gene. The method by which GAM57 was detected is described hereinabove with reference to FIGS. 8-15.

GAM57 gene, herein designated GAM GENE, and GAM57 target gene, herein designated TARGET GENE, are human genes contained in the human genome.

GAM57 gene encodes a GAM57 precursor RNA, herein designated GAM PRECURSOR RNA. Similar to other miRNA genes, and unlike most ordinary genes, GAM57 precursor RNA does not encode a protein. A nucleotide sequence identical or highly similar to the nucleotide sequence of GAM57 precursor RNA is designated SEQ ID:157, and is provided hereinbelow with reference to the sequence listing part.

GAM57 precursor RNA folds onto itself, forming GAM57 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM57 precursor RNA folds onto itself, forming GAM57 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM57 precursor RNA, designated SEQ-ID:157, and a schematic representation of a predicted secondary folding of GAM57 folded precursor RNA are further described with reference to Table 2, hereby incorporated by reference.

An enzyme complex designated DICER COMPLEX, 'dices' the GAM57 folded precursor RNA into GAM57 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM57 RNA is designated SEQ ID:329, and is provided hereinbelow with references to the sequence listing part and Table 3, hereby incorporated by reference.

GAM57 target gene, herein designated TARGET GENE, encodes a corresponding messenger RNA, GAM57 target RNA, herein designated GAM TARGET RNA. GAM57 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM57 RNA, herein designated GAM RNA, binds complementarily to one or more target binding sites located in untranslated regions of GAM57 target RNA, herein designated GAM TARGET RNA. This complementary binding is due to the fact that the nucleotide sequence of GAM57 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM57 RNA may have a different number of target binding sites in untranslated regions of a GAM57 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM57 RNA, herein designated GAM RNA, to target binding sites on GAM57 target RNA, herein designated GAM TARGET RNA, such as BINDING SITE I, BINDING SITE II and BINDING SITE III, inhibits translation of GAM57 target RNA into GAM57 target protein, herein designated GAM TARGET PROTEIN. GAM target protein is therefore outlined by a broken line.

It is appreciated that GAM57 target gene, herein designated TARGET GENE, in fact represents a plurality of GAM57 target genes. The mRNA of each one of this plurality of GAM57 target genes comprises one or more target binding sites, each having a nucleotide sequence which is at least partly complementary to GAM57 RNA, herein designated GAM RNA, and which when bound by GAM57 RNA causes inhibition of translation of respective one or more GAM57 target proteins.

It is further appreciated by one skilled in the art that the mode of translational inhibition illustrated by FIG. 8 with specific reference to translational inhibition exerted by GAM57 gene, herein designated GAM GENE, on one or more GAM57 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM57 correlate with, and may be deduced from, the identity of the target genes which GAM57 binds and inhibits, and the function of these target genes, as elaborated hereinbelow.

LOC253150 (Accession) is a GAM57 target gene, herein designated TARGET GENE. LOC253150 BINDING SITE is a target binding site found in the 5' untranslated region of mRNA encoded by LOC253150, corresponding to a target binding site such as BINDING SITE I, BINDING SITE II or BINDING SITE III of FIG. 8. Table 4 illustrates the complementarity of the nucleotide sequences of LOC253150 BINDING SITE, designated SEQ ID:14514, to the nucleotide sequence of GAM57 RNA, herein designated GAM RNA, also designated SEQ ID:329.

A function of GAM57 is therefore inhibition of LOC253150 (Accession). Accordingly, utilities of GAM57 include diagnosis, prevention and treatment of diseases and clinical conditions associated with LOC253150.

FIG. 8 further provides a conceptual description of a novel bioinformatically detected of the present invention, referred to here as Genomic Address Messenger 58 (GAM58), which modulates expression of respective target genes thereof, the function and utility of which target genes is known in the art.

GAM58 is a novel bioinformatically detected regulatory, non protein coding, micro RNA (miRNA) gene. The method by which GAM58 was detected is described hereinabove with reference to FIGS. 8-15.

GAM58 gene, herein designated GAM GENE, and GAM58 target gene, herein designated TARGET GENE, are human genes contained in the human genome.

GAM58 gene encodes a GAM58 precursor RNA, herein designated GAM PRECURSOR RNA. Similar to other miRNA genes, and unlike most ordinary genes, GAM58 precursor RNA does not encode a protein. A nucleotide sequence identical or highly similar to the nucleotide sequence of GAM58 precursor RNA is designated SEQ ID:185, and is provided hereinbelow with reference to the sequence listing part. Nucleotide sequence SEQ ID:185 is located at position 47201318 relative to chromosome 6.

GAM58 precursor RNA folds onto itself, forming GAM58 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM58 precursor RNA folds onto itself, forming GAM58 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM58 precursor RNA, designated SEQ-ID:185, and a schematic representation of a predicted secondary folding of GAM58 folded precursor RNA are further described with reference to Table 2, hereby incorporated by reference.

An enzyme complex designated DICER COMPLEX, 'dices' the GAM58 folded precursor RNA into GAM58 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM58 RNA is designated SEQ ID:306, and is provided hereinbelow with references to the sequence listing part and Table 3, hereby incorporated by reference.

GAM58 target gene, herein designated TARGET GENE, encodes a corresponding messenger RNA, GAM58 target RNA, herein designated GAM TARGET RNA. GAM58 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM58 RNA, herein designated GAM RNA, binds complementarily to one or more target binding sites located in untranslated regions of GAM58 target RNA, herein designated GAM TARGET RNA. This complementary binding is due to the fact that the nucleotide sequence of GAM58 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM58 RNA may have a different number of target binding sites in untranslated regions of a GAM58 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM58 RNA, herein designated GAM RNA, to target binding sites on GAM58 target RNA, herein designated GAM TARGET RNA, such as BINDING SITE I, BINDING SITE II and BINDING SITE III, inhibits translation of GAM58 target RNA into GAM58 target protein, herein designated GAM TARGET PROTEIN. GAM target protein is therefore outlined by a broken line.

It is appreciated that GAM58 target gene, herein designated TARGET GENE, in fact represents a plurality of GAM58 target genes. The mRNA of each one of this plurality of GAM58 target genes comprises one or more target binding sites, each having a nucleotide sequence which is at least partly complementary to GAM58 RNA, herein designated GAM RNA, and which when bound by GAM58 RNA causes inhibition of translation of respective one or more GAM58 target proteins.

It is further appreciated by one skilled in the art that the mode of translational inhibition illustrated by FIG. 8 with specific reference to translational inhibition exerted by GAM58 gene, herein designated GAM GENE, on one or more GAM58 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM58 correlate with, and may be deduced from, the identity of the target genes which GAM58 binds and inhibits, and the function of these target genes, as elaborated hereinbelow.

Myosin, heavy polypeptide 10, non-muscle (MYH10, Accession XM_290747.2) is a GAM58 target gene, herein designated TARGET GENE. MYH10 BINDING SITE is a target binding site found in the 5' untranslated region of mRNA encoded by MYH10, corresponding to a target binding site such as BINDING SITE I, BINDING SITE II or BINDING SITE III of FIG. 8. Table 4 illustrates the complementarity of the nucleotide sequences of MYH10 BINDING SITE, designated SEQ ID:6588, to the nucleotide sequence of GAM58 RNA, herein designated GAM RNA, also designated SEQ ID:306.

A function of GAM58 is therefore inhibition of Myosin, heavy polypeptide 10, non-muscle (MYH10, Accession XM_290747.2). Accordingly, utilities of GAM58 include diagnosis, prevention and treatment of diseases and clinical conditions associated with MYH10.

Nuclear factor of activated t-cells 5, tonicity-responsive (NFAT5, Accession NM_138714.2) is another GAM58 target gene, herein designated TARGET GENE. NFAT5 BINDING SITE is a target binding site found in the 3' untranslated region of multiple transcripts of mRNA encoded by NFAT5, corresponding to a target binding site such as BINDING SITE I, BINDING SITE II or BINDING SITE III of FIG. 8. Table 4 illustrates the complementarity of the nucleotide sequences of NFAT5 BINDING SITE, designated SEQ ID:12511, to the nucleotide sequence of GAM58 RNA, herein designated GAM RNA, also designated SEQ ID:306.

Another function of GAM58 is therefore inhibition of Nuclear factor of activated t-cells 5, tonicity-responsive (NFAT5, Accession NM_138714.2). Accordingly, utilities of GAM58 include diagnosis, prevention and treatment of diseases and clinical conditions associated with NFAT5.

FIG. 8 further provides a conceptual description of a novel bioinformatically detected of the present invention, referred to here as Genomic Address Messenger 59 (GAM59), which modulates expression of respective target genes thereof, the function and utility of which target genes is known in the art.

GAM59 is a novel bioinformatically detected regulatory, non protein coding, micro RNA (miRNA) gene. The method by which GAM59 was detected is described hereinabove with reference to FIGS. 8-15.

GAM59 gene, herein designated GAM GENE, and GAM59 target gene, herein designated TARGET GENE, are human genes contained in the human genome.

GAM59 gene encodes a GAM59 precursor RNA, herein designated GAM PRECURSOR RNA. Similar to other miRNA genes, and unlike most ordinary genes, GAM59 precursor RNA does not encode a protein. A nucleotide sequence identical or highly similar to the nucleotide sequence of GAM59 precursor RNA is designated SEQ ID:30, and is provided hereinbelow with reference to the sequence listing part.

GAM59 precursor RNA folds onto itself, forming GAM59 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM59 precursor RNA folds onto itself, forming GAM59 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM59 precursor RNA, designated SEQ-ID:30, and a schematic representation of a predicted secondary folding of GAM59 folded precursor RNA are further described with reference to Table 2, hereby incorporated by reference.

An enzyme complex designated DICER COMPLEX, 'dices' the GAM59 folded precursor RNA into GAM59 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM59 RNA is designated SEQ ID:377, and is provided hereinbelow with references to the sequence listing part and Table 3, hereby incorporated by reference.

GAM59 target gene, herein designated TARGET GENE, encodes a corresponding messenger RNA, GAM59 target RNA, herein designated GAM TARGET RNA. GAM59 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM59 RNA, herein designated GAM RNA, binds complementarily to one or more target binding sites located in untranslated regions of GAM59 target RNA, herein designated GAM TARGET RNA. This complementary binding is due to the fact that the nucleotide sequence of GAM59 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM59 RNA may have a different number of target binding sites in untranslated regions of a GAM59 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM59 RNA, herein designated GAM RNA, to target binding sites on GAM59 target RNA, herein designated GAM TARGET RNA, such as BINDING SITE I, BINDING SITE II and BINDING SITE III, inhibits translation of GAM59 target RNA into GAM59 target protein, herein designated GAM TARGET PROTEIN. GAM target protein is therefore outlined by a broken line.

It is appreciated that GAM59 target gene, herein designated TARGET GENE, in fact represents a plurality of GAM59 target genes. The mRNA of each one of this plurality of GAM59 target genes comprises one or more target binding sites, each having a nucleotide sequence which is at least partly complementary to GAM59 RNA, herein designated GAM RNA, and which when bound by GAM59 RNA causes inhibition of translation of respective one or more GAM59 target proteins.

It is further appreciated by one skilled in the art that the mode of translational inhibition illustrated by FIG. 8 with specific reference to translational inhibition exerted by GAM59 gene, herein designated GAM GENE, on one or more GAM59 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM59 correlate with, and may be deduced from, the identity of the target genes which GAM59 binds and inhibits, and the function of these target genes, as elaborated hereinbelow.

Artemin (ARTN, Accession NM_057091.1) is a GAM59 target gene, herein designated TARGET GENE. ARTN BINDING SITE is a target binding site found in the 5' untranslated region of multiple transcripts of mRNA encoded by ARTN, corresponding to a target binding site such as BINDING SITE I, BINDING SITE II or BINDING SITE III of FIG. 8. Table 4 illustrates the complementarity of the nucleotide sequences of ARTN BINDING SITE, designated SEQ ID:13442, to the nucleotide sequence of GAM59 RNA, herein designated GAM RNA, also designated SEQ ID:377.

A function of GAM59 is therefore inhibition of Artemin (ARTN, Accession NM_057091.1). Accordingly, utilities of GAM59 include diagnosis, prevention and treatment of diseases and clinical conditions associated with ARTN.

Centaurin, alpha 1 (CENTA1, Accession NM_006869.1) is another GAM59 target gene, herein designated TARGET GENE. CENTA1 BINDING SITE is a target binding site found in the 5' untranslated region of mRNA encoded by CENTA1, corresponding to a target binding site such as BINDING SITE I, BINDING SITE II or BINDING SITE III of FIG. 8. Table 4 illustrates the complementarity of the nucleotide sequences of CENTA1 BINDING SITE, designated SEQ ID:7819, to the nucleotide sequence of GAM59 RNA, herein designated GAM RNA, also designated SEQ ID:377.

Another function of GAM59 is therefore inhibition of Centaurin, alpha 1 (CENTA1, Accession NM_006869.1). Accordingly, utilities of GAM59 include diagnosis, prevention and treatment of diseases and clinical conditions associated with CENTA1.

HYPH (Accession) is another GAM59 target gene, herein designated TARGET GENE. HYPH BINDING SITE is a target binding site found in the 5' untranslated region of mRNA encoded by HYPH, corresponding to a target binding site such as BINDING SITE I, BINDING SITE II or BINDING SITE III of FIG. 8. Table 4 illustrates the complementarity of the nucleotide sequences of HYPH BINDING SITE, designated SEQ ID:11217, to the nucleotide sequence of GAM59 RNA, herein designated GAM RNA, also designated SEQ ID:377.

Another function of GAM59 is therefore inhibition of HYPH (Accession). Accordingly, utilities of GAM59 include diagnosis, prevention and treatment of diseases and clinical conditions associated with HYPH.

Potassium channel, subfamily t, member 1 (KCNT1, Accession XM_029962.2) is another GAM59 target gene, herein designated TARGET GENE. KCNT1 BINDING SITE is a target binding site found in the 3' untranslated region of mRNA encoded by KCNT1, corresponding to a target binding site such as BINDING SITE I, BINDING SITE II or BINDING SITE III of FIG. 8. Table 4 illustrates the complementarity of the nucleotide sequences of KCNT1 BINDING SITE, designated SEQ ID:13367, to the nucleotide sequence of GAM59 RNA, herein designated GAM RNA, also designated SEQ ID:377.

Another function of GAM59 is therefore inhibition of Potassium channel, subfamily t, member 1 (KCNT1, Accession XM_029962.2). Accordingly, utilities of GAM59 include diagnosis, prevention and treatment of diseases and clinical conditions associated with KCNT1.

KIAA1130 (Accession XM_031104.5) is another GAM59 target gene, herein designated TARGET GENE. KIAA1130 BINDING SITE is a target binding site found in the 5' untranslated region of mRNA encoded by KIAA1130, corresponding to a target binding site such as BINDING SITE I, BINDING SITE II or BINDING SITE III of FIG. 8. Table 4 illustrates the complementarity of the nucleotide sequences of KIAA1130 BINDING SITE, designated SEQ ID:19640, to the nucleotide sequence of GAM59 RNA, herein designated GAM RNA, also designated SEQ ID:377.

Another function of GAM59 is therefore inhibition of KIAA1130 (Accession XM_031104.5). Accordingly, utilities of GAM59 include diagnosis, prevention and treatment of diseases and clinical conditions associated with KIAA1130.

LOC148479 (Accession) is another GAM59 target gene, herein designated TARGET GENE. LOC148479 BINDING SITE is a target binding site found in the 5' untranslated region of mRNA encoded by LOC148479, corresponding to a target binding site such as BINDING SITE I, BINDING SITE II or BINDING SITE III of FIG. 8. Table 4 illustrates the complementarity of the nucleotide sequences of LOC148479 BINDING SITE, designated SEQ ID:16524, to the nucleotide sequence of GAM59 RNA, herein designated GAM RNA, also designated SEQ ID:377.

Another function of GAM59 is therefore inhibition of LOC148479 (Accession). Accordingly, utilities of GAM59 include diagnosis, prevention and treatment of diseases and clinical conditions associated with LOC148479.

LOC220932 (Accession) is another GAM59 target gene, herein designated TARGET GENE. LOC220932 BINDING SITE is a target binding site found in the 3' untranslated region of mRNA encoded by LOC220932, corresponding to a target binding site such as BINDING SITE I, BINDING SITE II or BINDING SITE III of FIG. 8. Table 4 illustrates the complementarity of the nucleotide sequences of LOC220932 BINDING SITE, designated SEQ ID:18057, to the nucleotide sequence of GAM59 RNA, herein designated GAM RNA, also designated SEQ ID:377.

Another function of GAM59 is therefore inhibition of LOC220932 (Accession). Accordingly, utilities of GAM59 include diagnosis, prevention and treatment of diseases and clinical conditions associated with LOC220932.

LOC221583 (Accession) is another GAM59 target gene, herein designated TARGET GENE. LOC221583 BINDING SITE is a target binding site found in the 5' untranslated region of mRNA encoded by LOC221583, corresponding to a target binding site such as BINDING SITE I, BINDING SITE II or BINDING SITE III of FIG. 8. Table 4 illustrates the complementarity of the nucleotide sequences of LOC221583 BINDING SITE, designated SEQ ID:12315, to the nucleotide sequence of GAM59 RNA, herein designated GAM RNA, also designated SEQ ID:377.

Another function of GAM59 is therefore inhibition of LOC221583 (Accession). Accordingly, utilities of GAM59 include diagnosis, prevention and treatment of diseases and clinical conditions associated with LOC221583.

MGC29643 (Accession NM_144586.1) is another GAM59 target gene, herein designated TARGET GENE. MGC29643 BINDING SITE is a target binding site found in the 5' untranslated region of mRNA encoded by MGC29643, corresponding to a target binding site such as BINDING SITE I, BINDING SITE II or BINDING SITE III of FIG. 8. Table 4 illustrates the complementarity of the nucleotide sequences of MGC29643 BINDING SITE, designated SEQ ID:10131, to the nucleotide sequence of GAM59 RNA, herein designated GAM RNA, also designated SEQ ID:377.

Another function of GAM59 is therefore inhibition of MGC29643 (Accession NM_144586.1). Accordingly, utilities of GAM59 include diagnosis, prevention and treatment of diseases and clinical conditions associated with MGC29643.

Paired-like homeodomain transcription factor 1 (PITX1, Accession NM_002653.3) is another GAM59 target gene, herein designated TARGET GENE. PITX1 BINDING SITE is a target binding site found in the 5' untranslated region of mRNA encoded by PITX1, corresponding to a target binding site such as BINDING SITE I, BINDING SITE II or BINDING SITE III of FIG. 8. Table 4 illustrates the complementarity of the nucleotide sequences of PITX1 BINDING SITE, designated SEQ ID:20144, to the nucleotide sequence of GAM59 RNA, herein designated GAM RNA, also designated SEQ ID:377.

Another function of GAM59 is therefore inhibition of Paired-like homeodomain transcription factor 1 (PITX1, Accession NM_002653.3), a gene which may regulate gene expression and control cell differentiation. Accordingly, utilities of GAM59 include diagnosis, prevention and treatment of diseases and clinical conditions associated with PITX1.

The function of PITX1 has been established by previous studies. Pitx1 and Tbx4 (OMIM Ref. No. 601719) encode transcription factors that are expressed throughout the developing hindlimb, but not in forelimb buds. Logan and Tabin (1999) injected a retroviral vector carrying Pitx1 into the wing field of chicken embryos. Misexpression of Pitx1 in the chick wing bud induced distal expression of Tbx4, as well as HoxC10 and HoxC11, which are normally restricted to hindlimb expression domains. Wing buds in which Pitx1 was misexpressed developed into limbs with some morphologic characteristics of hindlimbs: the flexure was altered to that normally observed in legs, the digits were more toe-like in the relative size and shape, and the muscle pattern was transformed to that of a leg. Expression of Tbx5 (OMIM Ref. No. 601620), normally expressed only in the forelimb, was not altered by Pitx1 misexpression. Szeto et al. (1999) found that Pitx1-deleted mice exhibited striking abnormalities in morphogenesis and growth of the hindlimb, resulting in a limb that exhibited structural changes in tibia and fibula as well as patterning alterations in patella and proximal tarsus, causing the hindlimb to more closely resemble the corresponding forelimb structures. Deletion of the Pitx1 gene resulted in decreased distal expression of the hindlimb-specific marker Tbx4. Pitx1-deleted mice also exhibited reciprocal abnormalities of 2 ventral and 1 dorsal anterior pituitary cell types, presumably on the basis of its synergistic functions with other transcription factors, and defects in the derivatives in the first branchial arch, including cleft palate, suggesting a proliferative defect in these organs analogous to that observed in the hindlimb.

Full details of the abovementioned studies are described in the following publications, the disclosure of which are hereby incorporated by reference:

Skelly, R. H.; Korbonits, M.; Grossman, A.; Besser, G. M.; Monson, J. P.; Geddes, J. F.; Burrin, J. M.: Expression of the pituitary transcription factor Ptx-1, but not that of the transactivating factor Prop-1, is reduced in human corticotroph adenomas and is associated with decreased alpha-subunit secretion. J. Clin. Endocr. Metab. 85:2537-2542, 2000; and Szeto, D. P.; Rodriguez-Esteban, C.; Ryan, A. K.; O'Connell, S. M.; Liu, F.; Kioussi, C.; Gleiberman, A. S.; Izpisua-Belmonte, J. C.; Rosenfeld, M. G.: Role of the Bicoid-related home.

Further studies establishing the function and utilities of PITX1 are found in John Hopkins OMIM database record ID 602149, and in cited publications listed in Table 5, which are hereby incorporated by reference. T-box 6 (TBX6, Accession NM_004608.2) is another GAM59 target gene, herein designated TARGET GENE. TBX6 BINDING SITE is a target binding site found in the 5' untranslated region of multiple transcripts of mRNA encoded by TBX6, corresponding to a target binding site such as BINDING SITE I, BINDING SITE II or BINDING SITE III of FIG. 8. Table 4 illustrates the complementarity of the nucleotide sequences of TBX6 BINDING SITE, designated SEQ ID:19956, to the nucleotide sequence of GAM59 RNA, herein designated GAM RNA, also designated SEQ ID:377.

Another function of GAM59 is therefore inhibition of T-box 6 (TBX6, Accession NM_004608.2), a gene which is a probable transcriptional regulator involved in developmental processes. Accordingly, utilities of GAM59 include diagnosis, prevention and treatment of diseases and clinical conditions associated with TBX6.

The function of TBX6 has been established by previous studies. Somites, the segmented mesodermal units of the vertebrate embry, are the precursors of adult skeletal muscle, bone, and cartilage. During embryogenesis, somite progenitor cells ingress through the primitive streak, move laterally to a paraxial position (alongside the body axis), and segment into epithelial somites. Chapman et al. (1996) described a mouse T-box gene, Tbx6, which codes for a putative DNA-binding protein. The embryonic pattern of expression of Tbx6 in somite precursor cells suggested that this gene may be involved in the specification of paraxial mesoderm. Chapman and Papaioannou (1998) created a mutation in Tbx6 that profoundly affected the differentiation of paraxial mesoderm. Irregular somites formed in the neck region of mutant embryos, whereas more posterior paraxial tissue did not form somites but instead differentiated along a neural pathway, forming neural-tube-like structures that flanked the axial neural tube. These paraxial tubes showed dorsal/ventral patterning that is characteristic of the neural tube and had differentiated motor neurons. These results indicated that Tbx6 is needed for cells to choose between a mesodermal and a neuronal differentiation pathway during gastrulation; Tbx6 is essential for the specification of posterior paraxial mesoderm, and in its absence cells destined to form posterior somites differentiate along a neuronal pathway. By fluorescence in situ hybridization, Papapetrou et al. (1999) mapped the human TBX6 gene to 16p11.2. This region of chromosome 16 shows homology of synteny with mouse chromosome 7, cM position 61, the localization reported for the mouse Tbx6 gene (Chapman et al., 1996).

Full details of the abovementioned studies are described in the following publications, the disclosure of which are hereby incorporated by reference:

Chapman, D. L.; Agulnik, I.; Hancock, S.; Silver, L. M.; Papaioannou, V. E.: Tbx6, a mouse T-box gene implicated in paraxial mesoderm formation at gastrulation. Dev. Biol. 180: 534-542, 1996; and Papapetrou, C.; Putt, W.; Fox, M.; Edwards, Y. H.: The human TBX6 gene: cloning and assignment to chromosome 16p11.2. Genomics 55:238-241, 1999.

Further studies establishing the function and utilities of TBX6 are found in John Hopkins OMIM database record ID 602427, and in cited publications listed in Table 5, which are hereby incorporated by reference. Yes-associated protein 1, 65 kda (YAP1, Accession NM_006106.2) is another GAM59 target gene, herein designated TARGET GENE. YAP1 BINDING SITE is a target binding site found in the 5' untranslated region of mRNA encoded by YAP1, corresponding to a target binding site such as BINDING SITE I, BINDING SITE II or BINDING SITE III of FIG. 8. Table 4 illustrates the complementarity of the nucleotide sequences of YAP1 BINDING SITE, designated SEQ ID:7221, to the nucleotide sequence of GAM59 RNA, herein designated GAM RNA, also designated SEQ ID:377.

Another function of GAM59 is therefore inhibition of Yes-associated protein 1, 65 kda (YAP1, Accession NM_006106.2). Accordingly, utilities of GAM59 include diagnosis, prevention and treatment of diseases and clinical conditions associated with YAP1.

FIG. 8 further provides a conceptual description of a novel bioinformatically detected of the present invention, referred to here as Genomic Address Messenger 60 (GAM60), which modulates expression of respective target genes thereof, the function and utility of which target genes is known in the art.

GAM60 is a novel bioinformatically detected regulatory, non protein coding, micro RNA (miRNA) gene. The method by which GAM60 was detected is described hereinabove with reference to FIGS. 8-15.

GAM60 gene, herein designated GAM GENE, and GAM60 target gene, herein designated TARGET GENE, are human genes contained in the human genome.

GAM60 gene encodes a GAM60 precursor RNA, herein designated GAM PRECURSOR RNA. Similar to other miRNA genes, and unlike most ordinary genes, GAM60 precursor RNA does not encode a protein. A nucleotide sequence identical or highly similar to the nucleotide sequence of GAM60 precursor RNA is designated SEQ ID:80, and is provided hereinbelow with reference to the sequence listing part.

GAM60 precursor RNA folds onto itself, forming GAM60 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM60 precursor RNA folds onto itself, forming GAM60 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM60 precursor RNA, designated SEQ-ID:80, and a schematic representation of a predicted secondary folding of GAM60 folded precursor RNA are further described with reference to Table 2, hereby incorporated by reference.

An enzyme complex designated DICER COMPLEX, 'dices' the GAM60 folded precursor RNA into GAM60 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM60 RNA is designated SEQ ID:381, and is provided hereinbelow with references to the sequence listing part and Table 3, hereby incorporated by reference.

GAM60 target gene, herein designated TARGET GENE, encodes a corresponding messenger RNA, GAM60 target RNA, herein designated GAM TARGET RNA. GAM60 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM60 RNA, herein designated GAM RNA, binds complementarily to one or more target binding sites located in untranslated regions of GAM60 target RNA, herein designated GAM TARGET RNA. This complementary binding is due to the fact that the nucleotide sequence of GAM60 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM60 RNA may have a different number of target binding sites in untranslated regions of a GAM60 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM60 RNA, herein designated GAM RNA, to target binding sites on GAM60 target RNA, herein designated GAM TARGET RNA, such as BINDING SITE I, BINDING SITE II and BINDING SITE III, inhibits translation of GAM60 target RNA into GAM60 target protein, herein designated GAM TARGET PROTEIN. GAM target protein is therefore outlined by a broken line.

It is appreciated that GAM60 target gene, herein designated TARGET GENE, in fact represents a plurality of GAM60 target genes. The mRNA of each one of this plurality of GAM60 target genes comprises one or more target binding sites, each having a nucleotide sequence which is at least partly complementary to GAM60 RNA, herein designated GAM RNA, and which when bound by GAM60 RNA causes inhibition of translation of respective one or more GAM60 target proteins.

It is further appreciated by one skilled in the art that the mode of translational inhibition illustrated by FIG. 8 with specific reference to translational inhibition exerted by GAM60 gene, herein designated GAM GENE, on one or more GAM60 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM60 correlate with, and may be deduced from, the identity of the target genes which GAM60 binds and inhibits, and the function of these target genes, as elaborated hereinbelow.

Adaptor-related protein complex 1, gamma 2 subunit (AP1G2, Accession NM_080545.1) is a GAM60 target gene, herein designated TARGET GENE. AP1G2 BINDING SITE is a target binding site found in the 5' untranslated region of multiple transcripts of mRNA encoded by AP1G2, corresponding to a target binding site such as BINDING SITE I, BINDING SITE II or BINDING SITE III of FIG. 8. Table 4 illustrates the complementarity of the nucleotide sequences of AP1G2 BINDING SITE, designated SEQ ID:8669, to the nucleotide sequence of GAM60 RNA, herein designated GAM RNA, also designated SEQ ID:381.

A function of GAM60 is therefore inhibition of Adaptor-related protein complex 1, gamma 2 subunit (AP1G2, Accession NM_080545.1). Accordingly, utilities of GAM60 include diagnosis, prevention and treatment of diseases and clinical conditions associated with AP1G2.

Brca1 associated ring domain 1 (BARD1, Accession NM_000465.1) is another GAM60 target gene, herein designated TARGET GENE. BARD1 BINDING SITE is a target binding site found in the 5' untranslated region of mRNA encoded by BARD1, corresponding to a target binding site such as BINDING SITE I, BINDING SITE II or BINDING SITE III of FIG. 8. Table 4 illustrates the complementarity of the nucleotide sequences of BARD1 BINDING SITE, designated SEQ ID:16824, to the nucleotide sequence of GAM60 RNA, herein designated GAM RNA, also designated SEQ ID:381.

Another function of GAM60 is therefore inhibition of Brca1 associated ring domain 1 (BARD1, Accession NM_000465.1), a gene which involves in mediating tumour suppression by BRCA1 and therefore may be associated with Primary breast, ovarian and uterine cancers. Accordingly, utilities of GAM60 include diagnosis, prevention and treatment of Primary breast, ovarian and uterine cancers, and of other diseases and clinical conditions associated with BARD1.

The function of BARD1 has been established by previous studies. Kleiman and Manley (1999) demonstrated that the 50-kD subunit of cleavage stimulation factor (CSTF1; 600369) interacts in vitro and in intact cells with BARD1. The BARD1-CSTF1 interaction inhibited polyadenylation in vitro. BARD1, like CSTF1, interacts with RNA polymerase-2. BARD1, BRCA1, and CSTF1 were shown to associate in vivo. Kleiman and Manley (1999) demonstrated that BARD1 inhibits pre-mRNA 3-prime cleavage in vitro and that the same region of BARD1 required for binding of CSTF1 is necessary for inhibiting 3-prime pre-mRNA cleavage. Kleiman and Manley (1999) concluded that their results suggested a model in which BARD1, as part of the RNA polymerase-2 holoenzyme, senses sites of DNA damage and repair, and the inhibitory interaction with CSTF1 ensures that nascent RNAs are not erroneously polyadenylated at such sites. Irminger-Finger et al. (2001) suggested that BARD1 is a mediator of apoptosis because (1) cell death in vivo (ischemic stroke) and in vitro was accompanied by increased levels of BARD1 protein and mRNA; (2) overexpression of BARD1 induced cell death with all features of apoptosis; and (3) BARD1-repressed cells were defective for the apoptotic response to genotoxic stress. The proapoptotic activity of BARD1 involved binding to and elevation of p53 (OMIM Ref. No. 191170). BRCA1 was not required for induction of apoptosis by BARD1 but partially counteracted it. A tumor-associated mutation of BARD1 (glu564 to his) was defective in apoptosis induction, suggesting a role for BARD1 in tumor suppression by mediating the signaling from proapoptotic stress toward induction of apoptosis.

Full details of the abovementioned studies are described in the following publications, the disclosure of which are hereby incorporated by reference:

Kleiman, F. E.; Manley, J. L.: Functional interaction of BRCA1-associated BARD1 with polyadenylation factor CstF-50. Science 285:1576-1579, 1999; and Irminger-Finger, I.; Leung, W.-C.; Li, J.; Dubois-Dauphin, M.; Harb, J.; Feki, A.; Jefford, C. E.; Soriano, J. V.; Jaconi, M.; Montesano, R.; Krause, K.-H.: Identification of BARD1 as.

Further studies establishing the function and utilities of BARD1 are found in John Hopkins OMIM database record ID 601593, and in cited publications listed in Table 5, which are hereby incorporated by reference. HGC6.2 (Accession NM_014356.1) is another GAM60 target gene, herein designated TARGET GENE. HGC6.2 BINDING SITE is a target binding site found in the 5' untranslated region of mRNA encoded by HGC6.2, corresponding to a target binding site such as BINDING SITE I, BINDING SITE II or BINDING SITE III of FIG. 8. Table 4 illustrates the complementarity of the nucleotide sequences of HGC6.2 BINDING SITE, designated SEQ ID:19650, to the nucleotide sequence of GAM60 RNA, herein designated GAM RNA, also designated SEQ ID:381.

Another function of GAM60 is therefore inhibition of HGC6.2 (Accession NM_014356.1). Accordingly, utilities of GAM60 include diagnosis, prevention and treatment of diseases and clinical conditions associated with HGC6.2.

FIG. 8 further provides a conceptual description of a novel bioinformatically detected gene of the present invention, referred to here as Genomic Address Messenger 61 (GAM61), which modulates expression of respective target genes thereof, the function and utility of which target genes is known in the art.

GAM61 is a novel bioinformatically detected regulatory, non protein coding, micro RNA (miRNA) gene. The method by which GAM61 was detected is described hereinabove with reference to FIGS. 8-15.

GAM61 gene, herein designated GAM GENE, and GAM61 target gene, herein designated TARGET GENE, are human genes contained in the human genome.

GAM61 gene encodes a GAM61 precursor RNA, herein designated GAM PRECURSOR RNA. Similar to other miRNA genes, and unlike most ordinary genes, GAM61 precursor RNA does not encode a protein. A nucleotide sequence identical or highly similar to the nucleotide sequence of GAM61 precursor RNA is designated SEQ ID:63, and is provided hereinbelow with reference to the sequence listing part.

GAM61 precursor RNA folds onto itself, forming GAM61 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM61 precursor RNA folds onto itself, forming GAM61 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM61 precursor RNA, designated SEQ-ID:63, and a schematic representation of a predicted secondary folding of GAM61 folded precursor RNA are further described with reference to Table 2, hereby incorporated by reference.

An enzyme complex designated DICER COMPLEX, 'dices' the GAM61 folded precursor RNA into GAM61 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM61 RNA is designated SEQ ID:293, and is provided hereinbelow with references to the sequence listing part and Table 3, hereby incorporated by reference.

GAM61 target gene, herein designated TARGET GENE, encodes a corresponding messenger RNA, GAM61 target RNA, herein designated GAM TARGET RNA. GAM61 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM61 RNA, herein designated GAM RNA, binds complementarily to one or more target binding sites located in untranslated regions of GAM61 target RNA, herein designated GAM TARGET RNA. This complementary binding is due to the fact that the nucleotide sequence of GAM61 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM61 RNA may have a different number of target binding sites in untranslated regions of a GAM61 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM61 RNA, herein designated GAM RNA, to target binding sites on GAM61 target RNA, herein designated GAM TARGET RNA, such as BINDING SITE I, BINDING SITE II and BINDING SITE III, inhibits translation of GAM61 target RNA into GAM61 target protein, herein designated GAM TARGET PROTEIN. GAM target protein is therefore outlined by a broken line.

It is appreciated that GAM61 target gene, herein designated TARGET GENE, in fact represents a plurality of GAM61 target genes. The mRNA of each one of this plurality of GAM61 target genes comprises one or more target binding sites, each having a nucleotide sequence which is at least partly complementary to GAM61 RNA, herein designated GAM RNA, and which when bound by GAM61 RNA causes inhibition of translation of respective one or more GAM61 target proteins.

It is further appreciated by one skilled in the art that the mode of translational inhibition illustrated by FIG. 8 with specific reference to translational inhibition exerted by GAM61 gene, herein designated GAM GENE, on one or more GAM61 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM61 correlate with, and may be deduced from, the identity of the target genes which GAM61 binds and inhibits, and the function of these target genes, as elaborated hereinbelow.

Dihydropyrimidinase-like 4 (DPYSL4, Accession NM_006426.1) is a GAM61 target gene, herein designated TARGET GENE. DPYSL4 BINDING SITE is a target binding site found in the 3' untranslated region of mRNA encoded by DPYSL4, corresponding to a target binding site such as BINDING SITE I, BINDING SITE II or BINDING SITE III of FIG. 8. Table 4 illustrates the complementarity of the nucleotide sequences of DPYSL4 BINDING SITE, designated SEQ ID:9939, to the nucleotide sequence of GAM61 RNA, herein designated GAM RNA, also designated SEQ ID:293.

A function of GAM61 is therefore inhibition of Dihydropyrimidinase-like 4 (DPYSL4, Accession NM_006426.1). Accordingly, utilities of GAM61 include diagnosis, prevention and treatment of diseases and clinical conditions associated with DPYSL4.

LOC197285 (Accession) is another GAM61 target gene, herein designated TARGET GENE. LOC197285 BINDING SITE is a target binding site found in the 3' untranslated region of mRNA encoded by LOC197285, corresponding to a target binding site such as BINDING SITE I, BINDING SITE II or BINDING SITE III of FIG. 8. Table 4 illustrates the complementarity of the nucleotide sequences of LOC197285 BINDING SITE, designated SEQ ID:7360, to the nucleotide sequence of GAM61 RNA, herein designated GAM RNA, also designated SEQ ID:293.

Another function of GAM61 is therefore inhibition of LOC197285 (Accession). Accordingly, utilities of GAM61 include diagnosis, prevention and treatment of diseases and clinical conditions associated with LOC197285.

LOC257458 (Accession) is another GAM61 target gene, herein designated TARGET GENE. LOC257458 BINDING SITE is a target binding site found in the 5' untranslated region of mRNA encoded by LOC257458, corresponding to a target binding site such as BINDING SITE I, BINDING SITE II or BINDING SITE III of FIG. 8. Table 4 illustrates the complementarity of the nucleotide sequences of LOC257458 BINDING SITE, designated SEQ ID:15784, to the nucleotide sequence of GAM61 RNA, herein designated GAM RNA, also designated SEQ ID:293.

Another function of GAM61 is therefore inhibition of LOC257458 (Accession). Accordingly, utilities of GAM61 include diagnosis, prevention and treatment of diseases and clinical conditions associated with LOC257458.

FIG. 8 further provides a conceptual description of a novel bioinformatically detected of the present invention, referred to here as Genomic Address Messenger 62 (GAM62), which modulates expression of respective target genes thereof, the function and utility of which target genes is known in the art.

GAM62 is a novel bioinformatically detected regulatory, non protein coding, micro RNA (miRNA) gene. The method by which GAM62 was detected is described hereinabove with reference to FIGS. 8-15.

GAM62 gene, herein designated GAM GENE, and GAM62 target gene, herein designated TARGET GENE, are human genes contained in the human genome.

GAM62 gene encodes a GAM62 precursor RNA, herein designated GAM PRECURSOR RNA. Similar to other miRNA genes, and unlike most ordinary genes, GAM62 precursor RNA does not encode a protein. A nucleotide sequence identical or highly similar to the nucleotide sequence of GAM62 precursor RNA is designated SEQ ID:194, and is provided hereinbelow with reference to the sequence listing part.

GAM62 precursor RNA folds onto itself, forming GAM62 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM62 precursor RNA folds onto itself, forming GAM62 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM62 precursor RNA, designated SEQ-ID:194, and a schematic representation of a predicted secondary folding of GAM62 folded precursor RNA are further described with reference to Table 2, hereby incorporated by reference.

An enzyme complex designated DICER COMPLEX, 'dices' the GAM62 folded precursor RNA into GAM62 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM62 RNA is designated SEQ ID:220, and is provided hereinbelow with references to the sequence listing part and Table 3, hereby incorporated by reference.

GAM62 target gene, herein designated TARGET GENE, encodes a corresponding messenger RNA, GAM62 target RNA, herein designated GAM TARGET RNA. GAM62 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM62 RNA, herein designated GAM RNA, binds complementarily to one or more target binding sites located in untranslated regions of GAM62 target RNA, herein designated GAM TARGET RNA. This complementary binding is due to the fact that the nucleotide sequence of GAM62 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM62 RNA may have a different number of target binding sites in untranslated regions of a GAM62 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM62 RNA, herein designated GAM RNA, to target binding sites on GAM62 target RNA, herein designated GAM TARGET RNA, such as BINDING SITE I, BINDING SITE II and BINDING SITE III, inhibits translation of GAM62 target RNA into GAM62 target protein, herein designated GAM TARGET PROTEIN. GAM target protein is therefore outlined by a broken line.

It is appreciated that GAM62 target gene, herein designated TARGET GENE, in fact represents a plurality of GAM62 target genes. The mRNA of each one of this plurality of GAM62 target genes comprises one or more target binding sites, each having a nucleotide sequence which is at least partly complementary to GAM62 RNA, herein designated GAM RNA, and which when bound by GAM62 RNA causes inhibition of translation of respective one or more GAM62 target proteins.

It is further appreciated by one skilled in the art that the mode of translational inhibition illustrated by FIG. 8 with specific reference to translational inhibition exerted by GAM62 gene, herein designated GAM GENE, on one or more GAM62 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM62 correlate with, and may be deduced from, the identity of the target genes which GAM62 binds and inhibits, and the function of these target genes, as elaborated hereinbelow.

GBL (Accession NM_022372.2) is a GAM62 target gene, herein designated TARGET GENE. GBL BINDING SITE is a target binding site found in the 3' untranslated region of mRNA encoded by GBL, corresponding to a target binding site such as BINDING SITE I, BINDING SITE II or BINDING SITE III of FIG. 8. Table 4 illustrates the complementarity of the nucleotide sequences of GBL BINDING SITE, designated SEQ ID:11551, to the nucleotide sequence of GAM62 RNA, herein designated GAM RNA, also designated SEQ ID:220.

A function of GAM62 is therefore inhibition of GBL (Accession NM_022372.2). Accordingly, utilities of GAM62 include diagnosis, prevention and treatment of diseases and clinical conditions associated with GBL.

LOC144395 (Accession XM_084850.1) is another GAM62 target gene, herein designated TARGET GENE. LOC144395 BINDING SITE is a target binding site found in the 3' untranslated region of mRNA encoded by LOC144395, corresponding to a target binding site such as BINDING SITE I, BINDING SITE II or BINDING SITE III of FIG. 8. Table 4 illustrates the complementarity of the nucleotide sequences of LOC144395 BINDING SITE, designated SEQ ID:4572, to the nucleotide sequence of GAM62 RNA, herein designated GAM RNA, also designated SEQ ID:220.

Another function of GAM62 is therefore inhibition of LOC144395 (Accession XM_084850.1). Accordingly, utilities of GAM62 include diagnosis, prevention and treatment of diseases and clinical conditions associated with LOC144395.

Zinc finger protein 141 (clone phz-44) (ZNF141, Accession NM_003441.1) is another GAM62 target gene, herein designated TARGET GENE. ZNF141 BINDING SITE is a target binding site found in the 3' untranslated region of mRNA encoded by ZNF141, corresponding to a target binding site such as BINDING SITE I, BINDING SITE II or BINDING SITE III of FIG. 8. Table 4 illustrates the complementarity of the nucleotide sequences of ZNF141 BINDING SITE, designated SEQ ID:15865, to the nucleotide sequence of GAM62 RNA, herein designated GAM RNA, also designated SEQ ID:220.

Another function of GAM62 is therefore inhibition of Zinc finger protein 141 (clone phz-44) (ZNF141, Accession NM_003441.1). Accordingly, utilities of GAM62 include diagnosis, prevention and treatment of diseases and clinical conditions associated with ZNF141.

FIG. 8 further provides a conceptual description of a novel bioinformatically detected of the present invention, referred to here as Genomic Address Messenger 63 (GAM63), which modulates expression of respective target genes thereof, the function and utility of which target genes is known in the art.

GAM63 is a novel bioinformatically detected regulatory, non protein coding, micro RNA (miRNA) gene. The method by which GAM63 was detected is described hereinabove with reference to FIGS. 8-15.

GAM63 gene, herein designated GAM GENE, and GAM63 target gene, herein designated TARGET GENE, are human genes contained in the human genome.

GAM63 gene encodes a GAM63 precursor RNA, herein designated GAM PRECURSOR RNA. Similar to other miRNA genes, and unlike most ordinary genes, GAM63 precursor RNA does not encode a protein. A nucleotide sequence identical or highly similar to the nucleotide sequence of GAM63 precursor RNA is designated SEQ ID:155, and is provided hereinbelow with reference to the sequence listing part. Nucleotide sequence SEQ ID:155 is located at position 2 relative to chromosome 3.

GAM63 precursor RNA folds onto itself, forming GAM63 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM63 precursor RNA folds onto itself, forming GAM63 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM63 precursor RNA, designated SEQ-ID:155, and a schematic representation of a predicted secondary folding of GAM63 folded precursor RNA are further described with reference to Table 2, hereby incorporated by reference.

An enzyme complex designated DICER COMPLEX, 'dices' the GAM63 folded precursor RNA into GAM63 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM63 RNA is designated SEQ ID:348, and is provided hereinbelow with references to the sequence listing part and Table 3, hereby incorporated by reference.

GAM63 target gene, herein designated TARGET GENE, encodes a corresponding messenger RNA, GAM63 target RNA, herein designated GAM TARGET RNA. GAM63 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM63 RNA, herein designated GAM RNA, binds complementarily to one or more target binding sites located in untranslated regions of GAM63 target RNA, herein designated GAM TARGET RNA. This complementary binding is due to the fact that the nucleotide sequence of GAM63 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM63 RNA may have a different number of target binding sites in untranslated regions of a GAM63 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM63 RNA, herein designated GAM RNA, to target binding sites on GAM63 target RNA, herein designated GAM TARGET RNA, such as BINDING SITE I, BINDING SITE II and BINDING SITE III, inhibits translation of GAM63 target RNA into GAM63 target protein, herein designated GAM TARGET PROTEIN. GAM target protein is therefore outlined by a broken line.

It is appreciated that GAM63 target gene, herein designated TARGET GENE, in fact represents a plurality of GAM63 target genes. The mRNA of each one of this plurality of GAM63 target genes comprises one or more target binding sites, each having a nucleotide sequence which is at least partly complementary to GAM63 RNA, herein designated GAM RNA, and which when bound by GAM63 RNA causes inhibition of translation of respective one or more GAM63 target proteins.

It is further appreciated by one skilled in the art that the mode of translational inhibition illustrated by FIG. 8 with specific reference to translational inhibition exerted by GAM63 gene, herein designated GAM GENE, on one or more GAM63 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM63 correlate with, and may be deduced from, the identity of the target genes which GAM63 binds and inhibits, and the function of these target genes, as elaborated hereinbelow.

ABCA13 (Accession NP_689914.2) is a GAM63 target gene, herein designated TARGET GENE. ABCA13 BINDING SITE is a target binding site found in the 3' untranslated region of mRNA encoded by ABCA13, corresponding to a target binding site such as BINDING SITE I, BINDING SITE II or BINDING SITE III of FIG. 8. Table 4 illustrates the complementarity of the nucleotide sequences of ABCA13 BINDING SITE, designated SEQ ID:16335, to the nucleotide sequence of GAM63 RNA, herein designated GAM RNA, also designated SEQ ID:348.

A function of GAM63 is therefore inhibition of ABCA13 (Accession NP_689914.2). Accordingly, utilities of GAM63 include diagnosis, prevention and treatment of diseases and clinical conditions associated with ABCA13.

V-abl abelson murine leukemia viral oncogene homolog 1 (ABL1, Accession NP_005148.1) is another GAM63 target gene, herein designated TARGET GENE. ABL1 BINDING SITE is a target binding site found in the 3' untranslated region of multiple transcripts of mRNA encoded by ABL1, corresponding to a target binding site such as BINDING SITE I, BINDING SITE II or BINDING SITE III of FIG. 8. Table 4 illustrates the complementarity of the nucleotide sequences of ABL1 BINDING SITE, designated SEQ ID:820, to the nucleotide sequence of GAM63 RNA, herein designated GAM RNA, also designated SEQ ID:348.

Another function of GAM63 is therefore inhibition of V-abl abelson murine leukemia viral oncogene homolog 1 (ABL1, Accession NP_005148.1). Accordingly, utilities of GAM63 include diagnosis, prevention and treatment of diseases and clinical conditions associated with ABL1.

V-abl abelson murine leukemia viral oncogene homolog 1 (ABL1, Accession NP_009297.1) is another GAM63 target gene, herein designated TARGET GENE. ABL1 BINDING SITE is a target binding site found in the 3' untranslated region of multiple transcripts of mRNA encoded by ABL1, corresponding to a target binding site such as BINDING SITE I, BINDING SITE II or BINDING SITE III of FIG. 8. Table 4 illustrates the complementarity of the nucleotide sequences of ABL1 BINDING SITE, designated SEQ ID:820, to the nucleotide sequence of GAM63 RNA, herein designated GAM RNA, also designated SEQ ID:348.

Another function of GAM63 is therefore inhibition of V-abl abelson murine leukemia viral oncogene homolog 1 (ABL1, Accession NP_009297.1). Accordingly, utilities of GAM63 include diagnosis, prevention and treatment of diseases and clinical conditions associated with ABL1.

Acid phosphatase 1, soluble (ACP1, Accession NP_009030.1) is another GAM63 target gene, herein designated TARGET GENE. ACP1 BINDING SITE is a target binding site found in the 3' untranslated region of multiple transcripts of mRNA encoded by ACP1, corresponding to a target binding site such as BINDING SITE I, BINDING SITE II or BINDING SITE III of FIG. 8. Table 4 illustrates the complementarity of the nucleotide sequences of ACP1 BINDING SITE, designated SEQ ID:6377, to the nucleotide sequence of GAM63 RNA, herein designated GAM RNA, also designated SEQ ID:348.

Another function of GAM63 is therefore inhibition of Acid phosphatase 1, soluble (ACP1, Accession NP_009030.1), a gene which as demonstrated in starch-gel electrophoresis. and therefore may be associated with Acid phosphatase 1, soluble, a/b polymorphism of. Accordingly, utilities of GAM63 include diagnosis, prevention and treatment of Acid phosphatase 1, soluble, a/b polymorphism of, and of other diseases and clinical conditions associated with ACP1.

The function of ACP1 has been established by previous studies. Hopkinson et al. (1963) described a new human polymorphism involving erythrocyte acid phosphatase (EC 3.1.3.2) as demonstrated in starch-gel electrophoresis. Three alleles, P(a), P(b) and P(c), are thought to be involved, their frequency being estimated to be 0.35, 0.60 and 0.05, respectively. Another rare allele, P(r), was described by Giblett and Scott (1965). Mohrenweiser and Novotny (1982) described a low activity variant of ACP1 that is frequent (gene frequency of 0.132) in Guaymi Indians of Central America. Data on gene frequencies of allelic variants were tabulated by Roychoudhury and Nei (1988). Red cells of persons with the GUA-1 phenotype had increased basal levels of the flavoenzyme glutathione reductase and a larger fraction of the glutathione reductase protein in the form of the holoenzyme, indicating increased levels of flavin adenine dinucleotide in the red cells of these persons. The finding was consistent with the suggestion that ACP1 has a physiologic function as a flavin mononucleotide phosphatase. This function could regulate the intracellular concentrations of flavin coenzymes and, ultimately, of flavoenzymes, and could be the mechanism for the association between ACP1 type and certain disease states. Sensabaugh and Golden (1978) showed that ACP1 is inhibited by folic acid and various folates, and that the inhibition is phenotype dependent: ACP1(C) more than ACP1(A) more than ACP1(B). This explains elevation of ACP levels in red cells of patients with megaloblastic anemia and also variation in incidence and severity of favism in G6PD-deficient persons. Swallow et al. (1973) showed that 'red cell' acid phosphatase is not limited to erythrocytes but can be demonstrated in other tissues, including cultured fibroblasts and lymphoblastoid cells where there is no possibility of contamination by blood. Dissing et al. (1991) concluded that 2 electrophoretically distinct isozymes, f and s, which are produced in allele-specific ratios and are associated with each of the 3 major alleles, are generated by alternative splicing of the primary RNA transcript. 2. Junien et al. (1979) assigned the ACP1 locus to 2p25. Larson et al. (1982) studied 4 patients who had inherited an unbalanced form of a familial reciprocal translocation, t(2;10)(p24;q26), giving them partial duplication of 2p. Increased levels of acid phosphatase indicated that ACP1 is located in the 2p24-2pter region and that MDH is not. The previous inconsistency of the SRO (smallest region of overlap) is now resolved; ACP1 is at 2p25. Wo et al. (1992) cloned genes encoding 2 low molecular weight phosphotyrosyl protein phosphatases from a human placenta cDNA library. They were found to have identical nucleotide sequences, with the exception of a 108-bp segment in the middle of the open reading frame. From further studies they concluded that the 2 represent the fast and slow electrophoretic forms of red cell acid phosphatase and that this enzyme is not unique to the red cell but instead is expressed in all human tissues. They examined a human chromosome 2-specific library and demonstrated that the sequences they were studying are located on chromosome 2.

Full details of the abovementioned studies are described in the following publications, the disclosure of which are hereby incorporated by reference:

Dissing, J.; Johnsen, A. H.; Sensabaugh, G. F.: Human red cell acid phosphatase (ACP1): the amino acid sequence of the two isozymes Bf and Bs encoded by the ACP1*B allele. J. Biol. Chem. 266:20619-20625, 1991; and Wo, Y.-Y. P.; McCormack, A. L.; Shabanowitz, J.; Hunt, D. F.; Davis, J. P.; Mitchell, G. L.; Van Etten, R. L.: Sequencing, cloning, and expression of human red cell-type acid phosphata.

Further studies establishing the function and utilities of ACP1 are found in John Hopkins OMIM database record ID 171500, and in cited publications listed in Table 5, which are hereby incorporated by reference. Acid phosphatase 1, soluble (ACP1, Accession NP_004291.1) is another GAM63 target gene, herein designated TARGET GENE. ACP1 BINDING SITE is a target binding site found in the 3' untranslated region of multiple transcripts of mRNA encoded by ACP1, corresponding to a target binding site such as BINDING SITE I, BINDING SITE II or BINDING SITE III of FIG. 8. Table 4 illustrates the complementarity of the nucleotide sequences of ACP1 BINDING SITE, designated SEQ ID:6377, to the nucleotide sequence of GAM63 RNA, herein designated GAM RNA, also designated SEQ ID:348.

Another function of GAM63 is therefore inhibition of Acid phosphatase 1, soluble (ACP1, Accession NP_004291.1), a gene which as demonstrated in starch-gel electrophoresis. and therefore may be associated with Acid phosphatase 1, soluble, a/b polymorphism of. Accordingly, utilities of GAM63 include diagnosis, prevention and treatment of Acid phosphatase 1, soluble, a/b polymorphism of, and of other diseases and clinical conditions associated with ACP1.

The function of ACP1 has been established by previous studies. Hopkinson et al. (1963) described a new human polymorphism involving erythrocyte acid phosphatase (EC 3.1.3.2) as demonstrated in starch-gel electrophoresis. Three alleles, P(a), P(b) and P(c), are thought to be involved, their frequency being estimated to be 0.35, 0.60 and 0.05, respectively. Another rare allele, P(r), was described by Giblett and Scott (1965). Mohrenweiser and Novotny (1982) described a low activity variant of ACP1 that is frequent (gene frequency of 0.132) in Guaymi Indians of Central America. Data on gene frequencies of allelic variants were tabulated by Roychoudhury and Nei (1988). Red cells of persons with the GUA-1 phenotype had increased basal levels of the flavoenzyme glutathione reductase and a larger fraction of the glutathione reductase protein in the form of the holoenzyme, indicating increased levels of flavin adenine dinucleotide in the red cells of these persons. The finding was consistent with the suggestion that ACP1 has a physiologic function as a flavin mononucleotide phosphatase. This function could regulate the intracellular concentrations of flavin coenzymes and, ultimately, of flavoenzymes, and could be the mechanism for the association between ACP1 type and certain disease states. Sensabaugh and Golden (1978) showed that ACP1 is inhibited by folic acid and various folates, and that the inhibition is phenotype dependent: ACP1(C) more than ACP1(A) more than ACP1(B). This explains elevation of ACP levels in red cells of patients with megaloblastic anemia and also variation in incidence and severity of favism in G6PD-deficient persons. Swallow et al. (1973) showed that 'red cell' acid phosphatase is not limited to erythrocytes but can be demonstrated in other tissues, including cultured fibroblasts and lymphoblastoid cells where there is no possibility of contamination by blood. Dissing et al. (1991) concluded that 2 electrophoretically distinct isozymes, f and s, which are produced in allele-specific ratios and are associated with each of the 3 major alleles, are generated by alternative splicing of the primary RNA transcript. 2. Junien et al. (1979) assigned the ACP1 locus to 2p25. Larson et al. (1982) studied 4 patients who had inherited an unbalanced form of a familial reciprocal translocation, t(2;10)(p24;q26), giving them partial duplication of 2p. Increased levels of acid phosphatase indicated that ACP1 is located in the 2p24-2pter region and that MDH is not. The previous inconsistency of the SRO (smallest region of overlap) is now resolved; ACP1 is at 2p25. Wo et al. (1992) cloned genes encoding 2 low molecular weight phosphotyrosyl protein phosphatases from a human placenta cDNA library. They were found to have identical nucleotide sequences, with the exception of a 108-bp segment in the middle of the open reading frame. From further studies they concluded that the 2 represent the fast and slow electrophoretic forms of red cell acid phosphatase and that this enzyme is not unique to the red cell but instead is expressed in all human tissues. They examined a human chromosome 2-specific library and demonstrated that the sequences they were studying are located on chromosome 2.

Full details of the abovementioned studies are described in the following publications, the disclosure of which are hereby incorporated by reference:

Dissing, J.; Johnsen, A. H.; Sensabaugh, G. F.: Human red cell acid phosphatase (ACP1): the amino acid sequence of the two isozymes Bf and Bs encoded by the ACP1*B allele. J. Biol. Chem. 266:20619-20625, 1991; and Wo, Y.-Y. P.; McCormack, A. L.; Shabanowitz, J.; Hunt, D. F.; Davis, J. P.; Mitchell, G. L.; Van Etten, R. L.: Sequencing, cloning, and expression of human red cell-type acid phosphata.

Further studies establishing the function and utilities of ACP1 are found in John Hopkins OMIM database record ID 171500, and in cited publications listed in Table 5, which are hereby incorporated by reference. Acid phosphatase 1, soluble (ACP1, Accession NP_808222.1) is another GAM63 target gene, herein designated TARGET GENE. ACP1 BINDING SITE is a target binding site found in the 3' untranslated region of multiple transcripts of mRNA encoded by ACP1, corresponding to a target binding site such as BINDING SITE I, BINDING SITE II or BINDING SITE III of FIG. 8. Table 4 illustrates the complementarity of the nucleotide sequences of ACP1 BINDING SITE, designated SEQ ID:6377, to the nucleotide sequence of GAM63 RNA, herein designated GAM RNA, also designated SEQ ID:348.

Another function of GAM63 is therefore inhibition of Acid phosphatase 1, soluble (ACP1, Accession NP_808222.1), a gene which as demonstrated in starch-gel electrophoresis. and therefore may be associated with Acid phosphatase 1, soluble, a/b polymorphism of. Accordingly, utilities of GAM63 include diagnosis, prevention and treatment of Acid phosphatase 1, soluble, a/b polymorphism of, and of other diseases and clinical conditions associated with ACP1.

The function of ACP1 has been established by previous studies. Hopkinson et al. (1963) described a new human polymorphism involving erythrocyte acid phosphatase (EC 3.1.3.2) as demonstrated in starch-gel electrophoresis. Three alleles, P(a), P(b) and P(c), are thought to be involved, their frequency being estimated to be 0.35, 0.60 and 0.05, respectively. Another rare allele, P(r), was described by Giblett and Scott (1965). Mohrenweiser and Novotny (1982) described a low activity variant of ACP1 that is frequent (gene frequency of 0.132) in Guaymi Indians of Central America. Data on gene frequencies of allelic variants were tabulated by Roychoudhury and Nei (1988). Red cells of persons with the GUA-1 phenotype had increased basal levels of the flavoenzyme glutathione reductase and a larger fraction of the glutathione reductase protein in the form of the holoenzyme, indicating increased levels of flavin adenine dinucleotide in the red cells of these persons. The finding was consistent with the suggestion that ACP1 has a physiologic function as a flavin mononucleotide phosphatase. This function could regulate the intracellular concentrations of flavin coenzymes and, ultimately, of flavoenzymes, and could be the mechanism for the association between ACP1 type and certain disease states. Sensabaugh and Golden (1978) showed that ACP1 is inhibited by folic acid and various folates, and that the inhibition is phenotype dependent: ACP1(C) more than ACP1(A) more than ACP1(B). This explains elevation of ACP levels in red cells of patients with megaloblastic anemia and also variation in incidence and severity of favism in G6PD-deficient persons. Swallow et al. (1973) showed that 'red cell' acid phosphatase is not limited to erythrocytes but can be demonstrated in other tissues, including cultured fibroblasts and lymphoblastoid cells where there is no possibility of contamination by blood. Dissing et al. (1991) concluded that 2 electrophoretically distinct isozymes, f and s, which are produced in allele-specific ratios and are associated with each of the 3 major alleles, are generated by alternative splicing of the primary RNA transcript. 2. Junien et al. (1979) assigned the ACP1 locus to 2p25. Larson et al. (1982) studied 4 patients who had inherited an unbalanced form of a familial reciprocal translocation, t(2;10)(p24;q26), giving them partial duplication of 2p. Increased levels of acid phosphatase indicated that ACP1 is located in the 2p24-2pter region and that MDH is not. The previous inconsistency of the SRO (smallest region of overlap) is now resolved; ACP1 is at 2p25. Wo et al. (1992) cloned genes encoding 2 low molecular weight phosphotyrosyl protein phosphatases from a human placenta cDNA library. They were found to have identical nucleotide sequences, with the exception of a 108-bp segment in the middle of the open reading frame. From further studies they concluded that the 2 represent the fast and slow electrophoretic forms of red cell acid phosphatase and that this enzyme is not unique to the red cell but instead is expressed in all human tissues. They examined a human chromosome 2-specific library and demonstrated that the sequences they were studying are located on chromosome 2.

Full details of the abovementioned studies are described in the following publications, the disclosure of which are hereby incorporated by reference:

Dissing, J.; Johnsen, A. H.; Sensabaugh, G. F.: Human red cell acid phosphatase (ACP1): the amino acid sequence of the two isozymes Bf and Bs encoded by the ACP1*B allele. J. Biol. Chem. 266:20619-20625, 1991; and Wo, Y.-Y. P.; McCormack, A. L.; Shabanowitz, J.; Hunt, D. F.; Davis, J. P.; Mitchell, G. L.; Van Etten, R. L.: Sequencing, cloning, and expression of human red cell-type acid phosphata.

Further studies establishing the function and utilities of ACP1 are found in John Hopkins OMIM database record ID 171500, and in cited publications listed in Table 5, which are hereby incorporated by reference. AD031 (Accession NP_114410.1) is another GAM63 target gene, herein designated TARGET GENE. AD031 BINDING SITE is a target binding site found in the 3' untranslated region of mRNA encoded by AD031, corresponding to a target binding site such as BINDING SITE I, BINDING SITE II or BINDING SITE III of FIG. 8. Table 4 illustrates the complementarity of the nucleotide sequences of AD031 BINDING SITE, designated SEQ ID:7594, to the nucleotide sequence of GAM63 RNA, herein designated GAM RNA, also designated SEQ ID:348.

Another function of GAM63 is therefore inhibition of AD031 (Accession NP_114410.1). Accordingly, utilities of GAM63 include diagnosis, prevention and treatment of diseases and clinical conditions associated with AD031.

A disintegrin and metalloproteinase domain 10 (ADAM10, Accession NP_001101.1) is another GAM63 target gene, herein designated TARGET GENE. ADAM10 BINDING SITE is a target binding site found in the 5' untranslated region of mRNA encoded by ADAM10, corresponding to a target binding site such as BINDING SITE I, BINDING SITE II or BINDING SITE III of FIG. 8. Table 4 illustrates the complementarity of the nucleotide sequences of ADAM10 BINDING SITE, designated SEQ ID:10402, to the nucleotide sequence of GAM63 RNA, herein designated GAM RNA, also designated SEQ ID:348.

Another function of GAM63 is therefore inhibition of A disintegrin and metalloproteinase domain 10 (ADAM10, Accession NP_001101.1), a gene which Member of ADAM family of zinc metalloproteases. Accordingly, utilities of GAM63 include diagnosis, prevention and treatment of diseases and clinical conditions associated with ADAM10.

The function of ADAM10 and its association with various diseases and clinical conditions, has been established by previous studies, as described hereinabove with reference to GAM47.1. A disintegrin and metalloproteinase domain 33 (ADAM33, Accession NP_079496.1) is another GAM63 target gene, herein designated TARGET GENE. ADAM33 BINDING SITE is a target binding site found in the 3' untranslated region of multiple transcripts of mRNA encoded by ADAM33, corresponding to a target binding site such as BINDING SITE I, BINDING SITE II or BINDING SITE III of FIG. 8. Table 4 illustrates the complementarity of the nucleotide sequences of ADAM33 BINDING SITE, designated SEQ ID:15499, to the nucleotide sequence of GAM63 RNA, herein designated GAM RNA, also designated SEQ ID:348.

Another function of GAM63 is therefore inhibition of A disintegrin and metalloproteinase domain 33 (ADAM33, Accession NP_079496.1), a gene which may be involved in cell-surface proteolysis. Accordingly, utilities of GAM63 include diagnosis, prevention and treatment of diseases and clinical conditions associated with ADAM33.

The function of ADAM33 has been established by previous studies. ADAM33 is a member of the 'a disintegrin and metalloprotease domain' family of proteins. It is implicated in asthma and bronchial hyperresponsiveness (OMIM Ref. No. 600807). Yoshinaka et al. (2002) isolated mouse and human cDNAs encoding ADAM33. The 813-amino acid human protein shares 70% identity with the mouse protein. ADAM33 has a domain organization identical to that of previously reported members of the ADAM family, and contains the typical zinc-binding consensus sequence in the metalloprotease domain and a pattern of cysteine localization in the EGF-like domain that is typical of an EGF-like motif. The human protein shows 44% identity with Xenopus ADAM13, 40% with human ADAM19 (OMIM Ref. No. 603640), and 39% with human ADAM12 (OMIM Ref. No. 602714). Yoshinaka et al. (2002) mapped the human ADAM33 gene to chromosome 20p13. Van Eerdewegh et al. (2002) performed a genomewide scan of 460 Caucasian families and identified a locus on chromosome 20p13 that was linked to asthma (OMIM Ref. No. 600807) with a lod score of 2.94 and to bronchial hyperresponsiveness with a lod score of 3.93. A survey of 135 polymorphisms in 23 genes identified the ADAM33 gene as being significantly associated with asthma using case control, transmission disequilibrium, and haplotype analyses (P =0.04-0.000003).

Full details of the abovementioned studies are described in the following publications, the disclosure of which are hereby incorporated by reference:

Yoshinaka, T.; Nishii, K.; Yamada, K.; Sawada, H.; Nishiwaki, E.; Smith, K.; Yoshino, K.; Ishiguro, H.; Higashiyama, S.: Identification and characterization of novel mouse and human ADAM33s with potential metalloprotease activity. Gene 282:227-236, 2002; and Van Eerdewegh, P.; Little, R. D.; Dupuis, J.; Del Mastro, R. G.; Falls, K.; Simon, J.; Torrey, D.; Pandit, S.; McKenny, J.; Braunschweiger, K.; Walsh, A.; Liu, Z.; and 26 others: Assoc.

Further studies establishing the function and utilities of ADAM33 are found in John Hopkins OMIM database record ID 607114, and in cited publications listed in Table 5, which are hereby incorporated by reference. A disintegrin and metalloproteinase domain 33 (ADAM33, Accession NP_694882.1) is another GAM63 target gene, herein designated TARGET GENE. ADAM33 BINDING SITE is a target binding site found in the 3' untranslated region of multiple transcripts of mRNA encoded by ADAM33, corresponding to a target binding site such as BINDING SITE I, BINDING SITE II or BINDING SITE III of FIG. 8. Table 4 illustrates the complementarity of the nucleotide sequences of ADAM33 BINDING SITE, designated SEQ ID:15499, to the nucleotide sequence of GAM63 RNA, herein designated GAM RNA, also designated SEQ ID:348.

Another function of GAM63 is therefore inhibition of A disintegrin and metalloproteinase domain 33 (ADAM33, Accession NP_694882.1), a gene which may be involved in cell-surface proteolysis. Accordingly, utilities of GAM63 include diagnosis, prevention and treatment of diseases and clinical conditions associated with ADAM33.

The function of ADAM33 has been established by previous studies. ADAM33 is a member of the 'a disintegrin and metalloprotease domain' family of proteins. It is implicated in asthma and bronchial hyperresponsiveness (OMIM Ref. No. 600807). Yoshinaka et al. (2002) isolated mouse and human cDNAs encoding ADAM33. The 813-amino acid human protein shares 70% identity with the mouse protein. ADAM33 has a domain organization identical to that of previously reported members of the ADAM family, and contains the typical zinc-binding consensus sequence in the metalloprotease domain and a pattern of cysteine localization in the EGF-like domain that is typical of an EGF-like motif. The human protein shows 44% identity with Xenopus ADAM13, 40% with human ADAM19 (OMIM Ref. No. 603640), and 39% with human ADAM12 (OMIM Ref. No. 602714). Yoshinaka et al. (2002) mapped the human ADAM33 gene to chromosome 20p13. Van Eerdewegh et al. (2002) performed a genomewide scan of 460 Caucasian families and identified a locus on chromosome 20p13 that was linked to asthma (OMIM Ref. No. 600807) with a lod score of 2.94 and to bronchial hyperresponsiveness with a lod score of 3.93. A survey of 135 polymorphisms in 23 genes identified the ADAM33 gene as being significantly associated with asthma using case control, transmission disequilibrium, and haplotype analyses (P =0.04-0.000003).

Full details of the abovementioned studies are described in the following publications, the disclosure of which are hereby incorporated by reference:

Yoshinaka, T.; Nishii, K.; Yamada, K.; Sawada, H.; Nishiwaki, E.; Smith, K.; Yoshino, K.; Ishiguro, H.; Higashiyama, S.: Identification and characterization of novel mouse and human ADAM33s with potential metalloprotease activity. Gene 282:227-236, 2002; and Van Eerdewegh, P.; Little, R. D.; Dupuis, J.; Del Mastro, R. G.; Falls, K.; Simon, J.; Torrey, D.; Pandit, S.; McKenny, J.; Braunschweiger, K.; Walsh, A.; Liu, Z.; and 26 others: Assoc.

Further studies establishing the function and utilities of ADAM33 are found in John Hopkins OMIM database record ID 607114, and in cited publications listed in Table 5, which are hereby incorporated by reference. 1-acylglycerol-3-phosphate o-acyltransferase 1 (lysophosphatidic acid acyltransferase, alpha) (AGPAT1, Accession NP_006402.1) is another GAM63 target gene, herein designated TARGET GENE. AGPAT1 BINDING SITE is a target binding site found in the 3' untranslated region of multiple transcripts of mRNA encoded by AGPAT1, corresponding to a target binding site such as BINDING SITE I, BINDING SITE II or BINDING SITE III of FIG. 8. Table 4 illustrates the complementarity of the nucleotide sequences of AGPAT1 BINDING SITE, designated SEQ ID:3844, to the nucleotide sequence of GAM63 RNA, herein designated GAM RNA, also designated SEQ ID:348.

Another function of GAM63 is therefore inhibition of 1-acylglycerol-3-phosphate o-acyltransferase 1 (lysophosphatidic acid acyltransferase, alpha) (AGPAT1, Accession NP_006402.1). Accordingly, utilities of GAM63 include diagnosis, prevention and treatment of diseases and clinical conditions associated with AGPAT1.

1-acylglycerol-3-phosphate o-acyltransferase 1 (lysophosphatidic acid acyltransferase, alpha) (AGPAT1, Accession NP_116130.2) is another GAM63 target gene, herein designated TARGET GENE. AGPAT1 BINDING SITE is a target binding site found in the 3' untranslated region of multiple transcripts of mRNA encoded by AGPAT1, corresponding to a target binding site such as BINDING SITE I, BINDING SITE II or BINDING SITE III of FIG. 8. Table 4 illustrates the complementarity of the nucleotide sequences of AGPAT1 BINDING SITE, designated SEQ ID:3844, to the nucleotide sequence of GAM63 RNA, herein designated GAM RNA, also designated SEQ ID:348.

Another function of GAM63 is therefore inhibition of 1-acylglycerol-3-phosphate o-acyltransferase 1 (lysophosphatidic acid acyltransferase, alpha) (AGPAT1, Accession NP_116130.2). Accordingly, utilities of GAM63 include diagnosis, prevention and treatment of diseases and clinical conditions associated with AGPAT1.

AIP1 (Accession NP_036433.2) is another GAM63 target gene, herein designated TARGET GENE. AIP1 BINDING SITE is a target binding site found in the 3' untranslated region of mRNA encoded by AIP1, corresponding to a target binding site such as BINDING SITE I, BINDING SITE II or BINDING SITE III of FIG. 8. Table 4 illustrates the complementarity of the nucleotide sequences of AIP1 BINDING SITE, designated SEQ ID:1560, to the nucleotide sequence of GAM63 RNA, herein designated GAM RNA, also designated SEQ ID:348.

Another function of GAM63 is therefore inhibition of AIP1 (Accession NP_036433.2). Accordingly, utilities of GAM63 include diagnosis, prevention and treatment of diseases and clinical conditions associated with AIP1.

Aldehyde dehydrogenase 9 family, member a1 (ALDH9A1, Accession NP_000687.2) is another GAM63 target gene, herein designated TARGET GENE. ALDH9A1 BINDING SITE is a target binding site found in the 3' untranslated region of mRNA encoded by ALDH9A1, corresponding to a target binding site such as BINDING SITE I, BINDING SITE II or BINDING SITE III of FIG. 8. Table 4 illustrates the complementarity of the nucleotide sequences of ALDH9A1 BINDING SITE, designated SEQ ID:19851, to the nucleotide sequence of GAM63 RNA, herein designated GAM RNA, also designated SEQ ID:348.

Another function of GAM63 is therefore inhibition of Aldehyde dehydrogenase 9 family, member a1 (ALDH9A1, Accession NP_000687.2). Accordingly, utilities of GAM63 include diagnosis, prevention and treatment of diseases and clinical conditions associated with ALDH9A1.

Alkb, alkylation repair homolog (e. coli) (ALKBH, Accession NP_006011.1) is another GAM63 target gene, herein designated TARGET GENE. ALKBH BINDING SITE is a target binding site found in the 3' untranslated region of mRNA encoded by ALKBH, corresponding to a target binding site such as BINDING SITE I, BINDING SITE II or BINDING SITE III of FIG. 8. Table 4 illustrates the complementarity of the nucleotide sequences of ALKBH BINDING SITE, designated SEQ ID:14952, to the nucleotide sequence of GAM63 RNA, herein designated GAM RNA, also designated SEQ ID:348.

Another function of GAM63 is therefore inhibition of Alkb, alkylation repair homolog (e. coli) (ALKBH, Accession NP_006011.1). Accordingly, utilities of GAM63 include diagnosis, prevention and treatment of diseases and clinical conditions associated with ALKBH.

Arachidonate 12-lipoxygenase, 12r type (ALOX12B, Accession NP_001130.1) is another GAM63 target gene, herein designated TARGET GENE. ALOX12B BINDING SITE is a target binding site found in the 3' untranslated region of mRNA encoded by ALOX12B, corresponding to a target binding site such as BINDING SITE I, BINDING SITE II or BINDING SITE III of FIG. 8. Table 4 illustrates the complementarity of the nucleotide sequences of ALOX12B BINDING SITE, designated SEQ ID:14007, to the nucleotide sequence of GAM63 RNA, herein designated GAM RNA, also designated SEQ ID:348.

Another function of GAM63 is therefore inhibition of Arachidonate 12-lipoxygenase, 12r type (ALOX12B, Accession NP_001130.1), a gene which converts arachidonic acid to 12r-hydroperoxyeicosatetraenoic acid (12r-hpete). and therefore is associated with Ichthyosiform erythroderma. Accordingly, utilities of GAM63 include diagnosis, prevention and treatment of Ichthyosiform erythroderma, and of other diseases and clinical conditions associated with ALOX12B.

The function of ALOX12B and its association with various diseases and clinical conditions, has been established by previous studies, as described hereinabove with reference to GAM47.1. Amyotrophic lateral sclerosis 2 (juvenile) chromosome region, candidate 2 (ALS2CR2, Accession NP_061041.2) is another GAM63 target gene, herein designated TARGET GENE. ALS2CR2 BINDING SITE is a target binding site found in the 3' untranslated region of mRNA encoded by ALS2CR2, corresponding to a target binding site such as BINDING SITE I, BINDING SITE II or BINDING SITE III of FIG. 8. Table 4 illustrates the complementarity of the nucleotide sequences of ALS2CR2 BINDING SITE, designated SEQ ID:968, to the nucleotide sequence of GAM63 RNA, herein designated GAM RNA, also designated SEQ ID:348.

Another function of GAM63 is therefore inhibition of Amyotrophic lateral sclerosis 2 (juvenile) chromosome region, candidate 2 (ALS2CR2, Accession NP_061041.2). Accordingly, utilities of GAM63 include diagnosis, prevention and treatment of diseases and clinical conditions associated with ALS2CR2.

Autocrine motility factor receptor (AMFR, Accession NP_001135.3) is another GAM63 target gene, herein designated TARGET GENE. AMFR BINDING SITE is a target binding site found in the 3' untranslated region of multiple transcripts of mRNA encoded by AMFR, corresponding to a target binding site such as BINDING SITE I, BINDING SITE II or BINDING SITE III of FIG. 8. Table 4 illustrates the complementarity of the nucleotide sequences of AMFR BINDING SITE, designated SEQ ID:1001, to the nucleotide sequence of GAM63 RNA, herein designated GAM RNA, also designated SEQ ID:348.

Another function of GAM63 is therefore inhibition of Autocrine motility factor receptor (AMFR, Accession NP_001135.3), a gene which acts to stimulate migration of fibrosarcoma cells and therefore may be associated with Tumors. Accordingly, utilities of GAM63 include diagnosis, prevention and treatment of Tumors, and of other diseases and clinical conditions associated with AMFR.

The function of AMFR has been established by previous studies. Autocrine motility factor (AMF; 172400) is a protein secreted by tumor cells that stimulates tumor motility. Its receptor is a 78-kD glycoprotein (gp78). Watanabe et al. (1991) cloned the AMFR cDNA. The gene encodes a 323-amino acid polypeptide that has a single transmembrane domain and several putative glycosylation sites. The protein sequence has some homology to human tumor protein p53 (OMIM Ref. No. 191170). Hirono et al. (1996) used immunohistochemistry to examine the expression of AMFR in gastric cancer specimens. The level of expression was associated with the pathologic stage and grade of tumor penetration. Positive AMFR expression was significantly associated with poor prognosis.

Full details of the abovementioned studies are described in the following publications, the disclosure of which are hereby incorporated by reference:

Hirono, Y.; Fushida, S.; Yonemura, Y.; Yamamoto, H.; Watanabe, H.; Raz, A.: Expression of autocrine motility factor receptor correlates with disease progression in human gastric cancer. Brit. J. Cancer 74:2003-2007, 1996; and Watanabe, H.; Carmi, P.; Hogan, V.; Raz, T.; Silletti, S.; Nabi, I. R.; Raz, A.: Purification of human tumor cell autocrine motility factor and molecular cloning of its receptor. J. Bio.

Further studies establishing the function and utilities of AMFR are found in John Hopkins OMIM database record ID 603243, and in cited publications listed in Table 5, which are hereby incorporated by reference. Autocrine motility factor receptor (AMFR, Accession NP_620408.1) is another GAM63 target gene, herein designated TARGET GENE. AMFR BINDING SITE is a target binding site found in the 3' untranslated region of multiple transcripts of mRNA encoded by AMFR, corresponding to a target binding site such as BINDING SITE I, BINDING SITE II or BINDING SITE III of FIG. 8. Table 4 illustrates the complementarity of the nucleotide sequences of AMFR BINDING SITE, designated SEQ ID:1001, to the nucleotide sequence of GAM63 RNA, herein designated GAM RNA, also designated SEQ ID:348.

Another function of GAM63 is therefore inhibition of Autocrine motility factor receptor (AMFR, Accession NP_620408.1), a gene which acts to stimulate migration of fibrosarcoma cells and therefore may be associated with Tumors. Accordingly, utilities of GAM63 include diagnosis, prevention and treatment of Tumors, and of other diseases and clinical conditions associated with AMFR.

The function of AMFR has been established by previous studies. Autocrine motility factor (AMF; 172400) is a protein secreted by tumor cells that stimulates tumor motility. Its receptor is a 78-kD glycoprotein (gp78). Watanabe et al. (1991) cloned the AMFR cDNA. The gene encodes a 323-amino acid polypeptide that has a single transmembrane domain and several putative glycosylation sites. The protein sequence has some homology to human tumor protein p53 (OMIM Ref. No. 191170). Hirono et al. (1996) used immunohistochemistry to examine the expression of AMFR in gastric cancer specimens. The level of expression was associated with the pathologic stage and grade of tumor penetration. Positive AMFR expression was significantly associated with poor prognosis.

Full details of the abovementioned studies are described in the following publications, the disclosure of which are hereby incorporated by reference:

Hirono, Y.; Fushida, S.; Yonemura, Y.; Yamamoto, H.; Watanabe, H.; Raz, A.: Expression of autocrine motility factor receptor correlates with disease progression in human gastric cancer. Brit. J. Cancer 74:2003-2007, 1996; and Watanabe, H.; Carmi, P.; Hogan, V.; Raz, T.; Silletti, S.; Nabi, I. R.; Raz, A.: Purification of human tumor cell autocrine motility factor and molecular cloning of its receptor. J. Bio.

Further studies establishing the function and utilities of AMFR are found in John Hopkins OMIM database record ID 603243, and in cited publications listed in Table 5, which are hereby incorporated by reference. Adaptor-related protein complex 1, beta 1 subunit (AP1B1, Accession NP_663782.1) is another GAM63 target gene, herein designated TARGET GENE. AP1B1 BINDING SITE is a target binding site found in the 3' untranslated region of multiple transcripts of mRNA encoded by AP1B1, corresponding to a target binding site such as BINDING SITE I, BINDING SITE II or BINDING SITE III of FIG. 8. Table 4 illustrates the complementarity of the nucleotide sequences of AP1B1 BINDING SITE, designated SEQ ID:9898, to the nucleotide sequence of GAM63 RNA, herein designated GAM RNA, also designated SEQ ID:348.

Another function of GAM63 is therefore inhibition of Adaptor-related protein complex 1, beta 1 subunit (AP1B1, Accession NP_663782.1), a gene which plays a role in protein sorting in the late-golgi/trans- golgi network (tgn) and/or endosomes and therefore may be associated with Tumorigenesis of meningiomas. Accordingly, utilities of GAM63 include diagnosis, prevention and treatment of Tumorigenesis of meningiomas, and of other diseases and clinical conditions associated with AP1B1.

The function of AP1B1 and its association with various diseases and clinical conditions, has been established by previous studies, as described hereinabove with reference to GAM55.2. Adaptor-related protein complex 1, beta 1 subunit (AP1B1, Accession NP_001118.2) is another GAM63 target gene, herein designated TARGET GENE. AP1B1 BINDING SITE is a target binding site found in the 3' untranslated region of multiple transcripts of mRNA encoded by AP1B1, corresponding to a target binding site such as BINDING SITE I, BINDING SITE II or BINDING SITE III of FIG. 8. Table 4 illustrates the complementarity of the nucleotide sequences of AP1B1 BINDING SITE, designated SEQ ID:9898, to the nucleotide sequence of GAM63 RNA, herein designated GAM RNA, also designated SEQ ID:348.

Another function of GAM63 is therefore inhibition of Adaptor-related protein complex 1, beta 1 subunit (AP1B1, Accession NP_001118.2), a gene which plays a role in protein sorting in the late-golgi/trans- golgi network (tgn) and/or endosomes and therefore may be associated with Tumorigenesis of meningiomas. Accordingly, utilities of GAM63 include diagnosis, prevention and treatment of Tumorigenesis of meningiomas, and of other diseases and clinical conditions associated with AP1B1.

The function of AP1B1 and its association with various diseases and clinical conditions, has been established by previous studies, as described hereinabove with reference to GAM55.2. Ap1 gamma subunit binding protein 1 (AP1GBP1, Accession NP_542118.1) is another GAM63 target gene, herein designated TARGET GENE. AP1GBP1 BINDING SITE is a target binding site found in the 5' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:4092, to the nucleotide sequence of GAM63 RNA, herein designated GAM RNA, also designated SEQ ID:348.

Another function of GAM63 is therefore inhibition of Ap1 gamma subunit binding protein 1 (AP1GBP1, Accession NP_542118.1). Accordingly, utilities of GAM63 include diagnosis, prevention and treatment of diseases and clinical conditions associated with AP1GBP1.

Apolipoprotein l, 4 (APOL4, Accession NP_085146.2) is another GAM63 target gene, herein designated TARGET GENE. APOL4 BINDING SITE is a target binding site found in the 5' untranslated region of multiple transcripts of mRNA encoded by APOL4, corresponding to a target binding site such as BINDING SITE I, BINDING SITE II or BINDING SITE III of FIG. 8. Table 4 illustrates the complementarity of the nucleotide sequences of APOL4 BINDING SITE, designated SEQ ID:9016, to the nucleotide sequence of GAM63 RNA, herein designated GAM RNA, also designated SEQ ID:348.

Another function of GAM63 is therefore inhibition of Apolipoprotein l, 4 (APOL4, Accession NP_085146.2). Accordingly, utilities of GAM63 include diagnosis, prevention and treatment of diseases and clinical conditions associated with APOL4.

Apolipoprotein l, 4 (APOL4, Accession NP_663694.1) is another GAM63 target gene, herein designated TARGET GENE. APOL4 BINDING SITE is a target binding site found in the 5' untranslated region of multiple transcripts of mRNA encoded by APOL4, corresponding to a target binding site such as BINDING SITE I, BINDING SITE II or BINDING SITE III of FIG. 8. Table 4 illustrates the complementarity of the nucleotide sequences of APOL4 BINDING SITE, designated SEQ ID:9016, to the nucleotide sequence of GAM63 RNA, herein designated GAM RNA, also designated SEQ ID:348.

Another function of GAM63 is therefore inhibition of Apolipoprotein l, 4 (APOL4, Accession NP_663694.1). Accordingly, utilities of GAM63 include diagnosis, prevention and treatment of diseases and clinical conditions associated with APOL4.

Ash2 (absent, small, or homeotic)-like (drosophila) (ASH2L, Accession NP_004665.1) is another GAM63 target gene, herein designated TARGET GENE. ASH2L BINDING SITE is a target binding site found in the 3' untranslated region of mRNA encoded by ASH2L, corresponding to a target binding site such as BINDING SITE I, BINDING SITE II or BINDING SITE III of FIG. 8. Table 4 illustrates the complementarity of the nucleotide sequences of ASH2L BINDING SITE, designated SEQ ID:4049, to the nucleotide sequence of GAM63 RNA, herein designated GAM RNA, also designated SEQ ID:348.

Another function of GAM63 is therefore inhibition of Ash2 (absent, small, or homeotic)-like (drosophila) (ASH2L, Accession NP_004665.1). Accordingly, utilities of GAM63 include diagnosis, prevention and treatment of diseases and clinical conditions associated with ASH2L.

Atpase, h+/k+ transporting, nongastric, alpha polypeptide (ATP12A, Accession NP_001667.2) is another GAM63 target gene, herein designated TARGET GENE. ATP12A BINDING SITE is a target binding site found in the 3' untranslated region of mRNA encoded by ATP12A, corresponding to a target binding site such as BINDING SITE I, BINDING SITE II or BINDING SITE III of FIG. 8. Table 4 illustrates the complementarity of the nucleotide sequences of ATP12A BINDING SITE, designated SEQ ID:6304, to the nucleotide sequence of GAM63 RNA, herein designated GAM RNA, also designated SEQ ID:348.

Another function of GAM63 is therefore inhibition of Atpase, h+/k+ transporting, nongastric, alpha polypeptide (ATP12A, Accession NP_001667.2). Accordingly, utilities of GAM63 include diagnosis, prevention and treatment of diseases and clinical conditions associated with ATP12A.

Aut-like 2, cysteine endopeptidase (s. cerevisiae) (AUTL2, Accession NP_443168.2) is another GAM63 target gene, herein designated TARGET GENE. AUTL2 BINDING SITE is a target binding site found in the 3' untranslated region of multiple transcripts of mRNA encoded by AUTL2, corresponding to a target binding site such as BINDING SITE I, BINDING SITE II or BINDING SITE III of FIG. 8. Table 4 illustrates the complementarity of the nucleotide sequences of AUTL2 BINDING SITE, designated SEQ ID:914, to the nucleotide sequence of GAM63 RNA, herein designated GAM RNA, also designated SEQ ID:348.

Another function of GAM63 is therefore inhibition of Aut-like 2, cysteine endopeptidase (s. cerevisiae) (AUTL2, Accession NP_443168.2). Accordingly, utilities of GAM63 include diagnosis, prevention and treatment of diseases and clinical conditions associated with AUTL2.

Aut-like 2, cysteine endopeptidase (s. cerevisiae) (AUTL2, Accession NP_840055.1) is another GAM63 target gene, herein designated TARGET GENE. AUTL2 BINDING SITE is a target binding site found in the 3' untranslated region of multiple transcripts of mRNA encoded by AUTL2, corresponding to a target binding site such as BINDING SITE I, BINDING SITE II or BINDING SITE III of FIG. 8. Table 4 illustrates the complementarity of the nucleotide sequences of AUTL2 BINDING SITE, designated SEQ ID:914, to the nucleotide sequence of GAM63 RNA, herein designated GAM RNA, also designated SEQ ID:348.

Another function of GAM63 is therefore inhibition of Aut-like 2, cysteine endopeptidase (s. cerevisiae) (AUTL2, Accession NP_840055.1). Accordingly, utilities of GAM63 include diagnosis, prevention and treatment of diseases and clinical conditions associated with AUTL2.

Aut-like 2, cysteine endopeptidase (s. cerevisiae) (AUTL2, Accession NP_840054.1) is another GAM63 target gene, herein designated TARGET GENE. AUTL2 BINDING SITE is a target binding site found in the 3' untranslated region of multiple transcripts of mRNA encoded by AUTL2, corresponding to a target binding site such as BINDING SITE I, BINDING SITE II or BINDING SITE III of FIG. 8. Table 4 illustrates the complementarity of the nucleotide sequences of AUTL2 BINDING SITE, designated SEQ ID:914, to the nucleotide sequence of GAM63 RNA, herein designated GAM RNA, also designated SEQ ID:348.

Another function of GAM63 is therefore inhibition of Aut-like 2, cysteine endopeptidase (s. cerevisiae) (AUTL2, Accession NP_840054.1). Accordingly, utilities of GAM63 include diagnosis, prevention and treatment of diseases and clinical conditions associated with AUTL2.

Bagpipe homeobox homolog 1 (drosophila) (BAPX1, Accession NP_001180.1) is another GAM63 target gene, herein designated TARGET GENE. BAPX1 BINDING SITE is a target binding site found in the 3' untranslated region of mRNA encoded by BAPX1, corresponding to a target binding site such as BINDING SITE I, BINDING SITE II or BINDING SITE III of FIG. 8. Table 4 illustrates the complementarity of the nucleotide sequences of BAPX1 BINDING SITE, designated SEQ ID:17409, to the nucleotide sequence of GAM63 RNA, herein designated GAM RNA, also designated SEQ ID:348.

Another function of GAM63 is therefore inhibition of Bagpipe homeobox homolog 1 (drosophila) (BAPX1, Accession NP_001180.1), a gene which regulates gene expression, morphogenesis, and differentiation and therefore may be associated with Ellis-van creveld syndrome. Accordingly, utilities of GAM63 include diagnosis, prevention and treatment of Ellis-van creveld syndrome, and of other diseases and clinical conditions associated with BAPX1.

The function of BAPX1 has been established by previous studies. Yoshiura and Murray (1997) reported the sequence of the human homolog of BAPX1 and localized it to human 4p16.1 by linkage mapping on CEPH families with polymorphic markers identified from the genomic sequence near the gene. They suggested the human BAPX1 gene as a candidate gene for disorders of skeletal development that map to 4p16.1, such as Ellis-van Creveld syndrome (OMIM Ref. No. 225500). Tribioli and Lufkin (1997) cloned the BAPX1 gene by screening a human genomic placenta library with a genomic fragment of the mouse gene. The predicted 333-amino acid sequence of the human gene product had 85% overall identity to the product of the murine gene, with 100% identity in the homeodomain. By fluorescence in situ hybridization, they mapped the BAPX1 gene to 4p16.1 in a region of syntenic homology with mouse chromosome 5 where the mouse gene had been mapped. RT-PCR analysis demonstrated that BAPX1 is expressed in embryonic tissues, particularly the limb, and at a lower level in an embryonic lung cell line. RNA in situ hybridization showed that BAPX1 is predominantly expressed in mesenchymal condensations of the fetal limb and axial skeleton, and in lateral plate mesoderm giving rise to visceral muscle. Tribioli et al. (1997) showed that expression of Bapx1 is first detectable in embryos just before axis rotation in lateral plate mesoderm (splanchnic mesoderm) adjacent to the endodermal lining of the prospective gut, and in the most newly formed somites in the region corresponding to the presclerotome, the precursor of the vertebrae. Thus, Bapx1 is one of the earliest developmental markers for the sclerotome portion of the somite and the gut mesentery. Bapx1 continues to be expressed well into organogenesis in lateral plate mesoderm surrounding the mid- and hindgut, and in essentially all cartilaginous condensations that will subsequently undergo endochondral bone formation.

Full details of the abovementioned studies are described in the following publications, the disclosure of which are hereby incorporated by reference:

Yoshiura, K.-I.; Murray, J. C.: Sequence and chromosomal assignment of human BAPX1, a bagpipe-related gene, to 4p16.1: a candidate gene for skeletal dysplasia. Genomics 45:425-428, 1997; and Tribioli, C.; Frasch, M.; Lufkin, T.: Bapx1: an evolutionary conserved homologue of the Drosophila bagpipe homeobox gene is expressed in splanchnic mesoderm and the embryonic skeleton.

Further studies establishing the function and utilities of BAPX1 are found in John Hopkins OMIM database record ID 602183, and in cited publications listed in Table 5, which are hereby incorporated by reference. Hla-b associated transcript 8 (BAT8, Accession NP_006700.2) is another GAM63 target gene, herein designated TARGET GENE. BAT8 BINDING SITE1 and BAT8 BINDING SITE2 are target binding sites found in untranslated regions of multiple transcripts of mRNA encoded by BAT8, corresponding to target binding sites such as BINDING SITE I, BINDING SITE II or BINDING SITE III of FIG. 8. Table 4 illustrates the complementarity of the nucleotide sequences of BAT8 BINDING SITE1 and BAT8 BINDING SITE2, designated SEQ ID:16535 and SEQ ID:17987 respectively, to the nucleotide sequence of GAM63 RNA, herein designated GAM RNA, also designated SEQ ID:348.

Another function of GAM63 is therefore inhibition of Hla-b associated transcript 8 (BAT8, Accession NP_006700.2). Accordingly, utilities of GAM63 include diagnosis, prevention and treatment of diseases and clinical conditions associated with BAT8.

Hla-b associated transcript 8 (BAT8, Accession NP_006700.2) is another GAM63 target gene, herein designated TARGET GENE. BAT8 BINDING SITE1 and BAT8 BINDING SITE2 are target binding sites found in untranslated regions of multiple transcripts of mRNA encoded by BAT8, corresponding to target binding sites such as BINDING SITE I, BINDING SITE II or BINDING SITE III of FIG. 8. Table 4 illustrates the complementarity of the nucleotide sequences of BAT8 BINDING SITE1 and BAT8 BINDING SITE2, designated SEQ ID:17987 and SEQ ID:16535 respectively, to the nucleotide sequence of GAM63 RNA, herein designated GAM RNA, also designated SEQ ID:348.

Another function of GAM63 is therefore inhibition of Hla-b associated transcript 8 (BAT8, Accession NP_006700.2). Accordingly, utilities of GAM63 include diagnosis, prevention and treatment of diseases and clinical conditions associated with BAT8.

Bromodomain adjacent to zinc finger domain, 2a (BAZ2A, Accession NP_038477.1) is another GAM63 target gene, herein designated TARGET GENE. BAZ2A BINDING SITE is a target binding site found in the 3' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:2148, to the nucleotide sequence of GAM63 RNA, herein designated GAM RNA, also designated SEQ ID:348.

Another function of GAM63 is therefore inhibition of Bromodomain adjacent to zinc finger domain, 2a (BAZ2A, Accession NP_038477.1). Accordingly, utilities of GAM63 include diagnosis, prevention and treatment of diseases and clinical conditions associated with BAZ2A.

BLAME (Accession NP_064510.1) is another GAM63 target gene, herein designated TARGET GENE. BLAME BINDING SITE is a target binding site found in the 3' untranslated region of mRNA encoded by BLAME, corresponding to a target binding site such as BINDING SITE I, BINDING SITE II or BINDING SITE III of FIG. 8. Table 4 illustrates the complementarity of the nucleotide sequences of BLAME BINDING SITE, designated SEQ ID:10762, to the nucleotide sequence of GAM63 RNA, herein designated GAM RNA, also designated SEQ ID:348.

Another function of GAM63 is therefore inhibition of BLAME (Accession NP_064510.1). Accordingly, utilities of GAM63 include diagnosis, prevention and treatment of diseases and clinical conditions associated with BLAME.

BMF (Accession NP_277038.1) is another GAM63 target gene, herein designated TARGET GENE. BMF BINDING SITE is a target binding site found in the 3' untranslated region of mRNA encoded by BMF, corresponding to a target binding site such as BINDING SITE I, BINDING SITE II or BINDING SITE III of FIG. 8. Table 4 illustrates the complementarity of the nucleotide sequences of BMF BINDING SITE, designated SEQ ID:13024, to the nucleotide sequence of GAM63 RNA, herein designated GAM RNA, also designated SEQ ID:348.

Another function of GAM63 is therefore inhibition of BMF (Accession NP_277038.1). Accordingly, utilities of GAM63 include diagnosis, prevention and treatment of diseases and clinical conditions associated with BMF.

Bone morphogenetic protein 1 (BMP1, Accession NP_001190.1) is another GAM63 target gene, herein designated TARGET GENE. BMP1 BINDING SITE1 and BMP1 BINDING SITE2 are target binding sites found in untranslated regions of multiple transcripts of mRNA encoded by BMP1, corresponding to target binding sites such as BINDING SITE I, BINDING SITE II or BINDING SITE III of FIG. 8. Table 4 illustrates the complementarity of the nucleotide sequences of BMP1 BINDING SITE1 and BMP1 BINDING SITE2, designated SEQ ID:10746 and SEQ ID:10746 respectively, to the nucleotide sequence of GAM63 RNA, herein designated GAM RNA, also designated SEQ ID:348.

Another function of GAM63 is therefore inhibition of Bone morphogenetic protein 1 (BMP1, Accession NP_001190.1), a gene which cleaves procollagens leading to formation of extracellular matrix. Accordingly, utilities of GAM63 include diagnosis, prevention and treatment of diseases and clinical conditions associated with BMP1.

The function of BMP1 and its association with various diseases and clinical conditions, has been established by previous studies, as described hereinabove with reference to GAM51.1. Bone morphogenetic protein 1 (BMP1, Accession NP_006122.1) is another GAM63 target gene, herein designated TARGET GENE. BMP1 BINDING SITE1 and BMP1 BINDING SITE2 are target binding sites found in untranslated regions of multiple transcripts of mRNA encoded by BMP1, corresponding to target binding sites such as BINDING SITE I, BINDING SITE II or BINDING SITE III of FIG. 8. Table 4 illustrates the complementarity of the nucleotide sequences of BMP1 BINDING SITE1 and BMP1 BINDING SITE2, designated SEQ ID:16512 and SEQ ID:2992 respectively, to the nucleotide sequence of GAM63 RNA, herein designated GAM RNA, also designated SEQ ID:348.

Another function of GAM63 is therefore inhibition of Bone morphogenetic protein 1 (BMP1, Accession NP_006122.1), a gene which cleaves procollagens leading to formation of extracellular matrix. Accordingly, utilities of GAM63 include diagnosis, prevention and treatment of diseases and clinical conditions associated with BMP1.

The function of BMP1 and its association with various diseases and clinical conditions, has been established by previous studies, as described hereinabove with reference to GAM51.1. C10orf5 (Accession NP_848931.1) is another GAM63 target gene, herein designated TARGET GENE. C10orf5 BINDING SITE is a target binding site found in the 3' untranslated region of multiple transcripts of mRNA encoded by C10orf5, corresponding to a target binding site such as BINDING SITE I, BINDING SITE II or BINDING SITE III of FIG. 8. Table 4 illustrates the complementarity of the nucleotide sequences of C10orf5 BINDING SITE, designated SEQ ID:19283, to the nucleotide sequence of GAM63 RNA, herein designated GAM RNA, also designated SEQ ID:348.

Another function of GAM63 is therefore inhibition of C10orf5 (Accession NP_848931.1). Accordingly, utilities of GAM63 include diagnosis, prevention and treatment of diseases and clinical conditions associated with C10orf5.

Chromosome 14 open reading frame 1 (C14orf1, Accession NP_009107.1) is another GAM63 target gene, herein designated TARGET GENE. C14orf1 BINDING SITE is a target binding site found in the 3' untranslated region of mRNA encoded by C14orf1, corresponding to a target binding site such as BINDING SITE I, BINDING SITE II or BINDING SITE III of FIG. 8. Table 4 illustrates the complementarity of the nucleotide sequences of C14orf1 BINDING SITE, designated SEQ ID:8879, to the nucleotide sequence of GAM63 RNA, herein designated GAM RNA, also designated SEQ ID:348.

Another function of GAM63 is therefore inhibition of Chromosome 14 open reading frame 1 (C14orf1, Accession NP_009107.1). Accordingly, utilities of GAM63 include diagnosis, prevention and treatment of diseases and clinical conditions associated with C14orf1.

C14orf102 (Accession NP_060440.1) is another GAM63 target gene, herein designated TARGET GENE. C14orf102 BINDING SITE is a target binding site found in the 3' untranslated region of mRNA encoded by C14orf102, corresponding to a target binding site such as BINDING SITE I, BINDING SITE II or BINDING SITE III of FIG. 8. Table 4 illustrates the complementarity of the nucleotide sequences of C14orf102 BINDING SITE, designated SEQ ID:9576, to the nucleotide sequence of GAM63 RNA, herein designated GAM RNA, also designated SEQ ID:348.

Another function of GAM63 is therefore inhibition of C14orf102 (Accession NP_060440.1). Accordingly, utilities of GAM63 include diagnosis, prevention and treatment of diseases and clinical conditions associated with C14orf102.

C14orf132 (Accession NP_064600.1) is another GAM63 target gene, herein designated TARGET GENE. C14orf132 BINDING SITE is a target binding site found in the 3' untranslated region of mRNA encoded by C14orf132, corresponding to a target binding site such as BINDING SITE I, BINDING SITE II or BINDING SITE III of FIG. 8. Table 4 illustrates the complementarity of the nucleotide sequences of C14orf132 BINDING SITE, designated SEQ ID:8516, to the nucleotide sequence of GAM63 RNA, herein designated GAM RNA, also designated SEQ ID:348.

Another function of GAM63 is therefore inhibition of C14orf132 (Accession NP_064600.1). Accordingly, utilities of GAM63 include diagnosis, prevention and treatment of diseases and clinical conditions associated with C14orf132.

Chromosome 16 open reading frame 7 (C16orf7, Accession NP_004904.1) is another GAM63 target gene, herein designated TARGET GENE. C16orf7 BINDING SITE is a target binding site found in the 3' untranslated region of mRNA encoded by C16orf7, corresponding to a target binding site such as BINDING SITE I, BINDING SITE II or BINDING SITE III of FIG. 8. Table 4 illustrates the complementarity of the nucleotide sequences of C16orf7 BINDING SITE, designated SEQ ID:5690, to the nucleotide sequence of GAM63 RNA, herein designated GAM RNA, also designated SEQ ID:348.

Another function of GAM63 is therefore inhibition of Chromosome 16 open reading frame 7 (C16orf7, Accession NP_004904.1). Accordingly, utilities of GAM63 include diagnosis, prevention and treatment of diseases and clinical conditions associated with C16orf7.

Chromosome 1 open reading frame 21 (C1orf21, Accession NP_110433.1) is another GAM63 target gene, herein designated TARGET GENE. C1orf21 BINDING SITE is a target binding site found in the 3' untranslated region of mRNA encoded by C1orf21, corresponding to a target binding site such as BINDING SITE I, BINDING SITE II or BINDING SITE III of FIG. 8. Table 4 illustrates the complementarity of the nucleotide sequences of C1orf21 BINDING SITE, designated SEQ ID:13283, to the nucleotide sequence of GAM63 RNA, herein designated GAM RNA, also designated SEQ ID:348.

Another function of GAM63 is therefore inhibition of Chromosome 1 open reading frame 21 (C1orf21, Accession NP_110433.1). Accordingly, utilities of GAM63 include diagnosis, prevention and treatment of diseases and clinical conditions associated with C1orf21.

Chromosome 1 open reading frame 24 (C1orf24, Accession NP_443198.1) is another GAM63 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:17211, to the nucleotide sequence of GAM63 RNA, herein designated GAM RNA, also designated SEQ ID:348.

Another function of GAM63 is therefore inhibition of Chromosome 1 open reading frame 24 (C1orf24, Accession NP_443198.1). Accordingly, utilities of GAM63 include diagnosis, prevention and treatment of diseases and clinical conditions associated with C1orf24.

Chromosome 1 open reading frame 6 (C1orf6, Accession NP_064516.1) is another GAM63 target gene, herein designated TARGET GENE. C1orf6 BINDING SITE is a target binding site found in the 3' untranslated region of mRNA encoded by C1orf6, corresponding to a target binding site such as BINDING SITE I, BINDING SITE II or BINDING SITE III of FIG. 8. Table 4 illustrates the complementarity of the nucleotide sequences of C1orf6 BINDING SITE, designated SEQ ID:1257, to the nucleotide sequence of GAM63 RNA, herein designated GAM RNA, also designated SEQ ID:348.

Another function of GAM63 is therefore inhibition of Chromosome 1 open reading frame 6 (C1orf6, Accession NP_064516.1), a gene which may link ataxin-1 with the chaperone and ubiquitin/proteasome pathways. Accordingly, utilities of GAM63 include diagnosis, prevention and treatment of diseases and clinical conditions associated with C1orf6.

The function of C1orf6 and its association with various diseases and clinical conditions, has been established by previous studies, as described hereinabove with reference to GAM47.1. Complement component 1, q subcomponent, receptor 1 (C1QR1, Accession NP_036204.1) is another GAM63 target gene, herein designated TARGET GENE. C1QR1 BINDING SITE is a target binding site found in the 3' untranslated region of mRNA encoded by C1QR1, corresponding to a target binding site such as BINDING SITE I, BINDING SITE II or BINDING SITE III of FIG. 8. Table 4 illustrates the complementarity of the nucleotide sequences of C1QR1 BINDING SITE, designated SEQ ID:7246, to the nucleotide sequence of GAM63 RNA, herein designated GAM RNA, also designated SEQ ID:348.

Another function of GAM63 is therefore inhibition of Complement component 1, q subcomponent, receptor 1 (C1QR1, Accession NP_036204.1). Accordingly, utilities of GAM63 include diagnosis, prevention and treatment of diseases and clinical conditions associated with C1QR1.

Complement component 2 (C2, Accession NP_000054.2) is another GAM63 target gene, herein designated TARGET GENE. C2 BINDING SITE is a target binding site found in the 3' untranslated region of mRNA encoded by C2, corresponding to a target binding site such as BINDING SITE I, BINDING SITE II or BINDING SITE III of FIG. 8. Table 4 illustrates the complementarity of the nucleotide sequences of C2 BINDING SITE, designated SEQ ID:540, to the nucleotide sequence of GAM63 RNA, herein designated GAM RNA, also designated SEQ ID:348.

Another function of GAM63 is therefore inhibition of Complement component 2 (C2, Accession NP_000054.2). Accordingly, utilities of GAM63 include diagnosis, prevention and treatment of diseases and clinical conditions associated with C2.

Chromosome 20 open reading frame 116 (C20orf116, Accession NP_076424.1) is another GAM63 target gene, herein designated TARGET GENE. C20orf116 BINDING SITE is a target binding site found in the 3' untranslated region of mRNA encoded by C20orf116, corresponding to a target binding site such as BINDING SITE I, BINDING SITE II or BINDING SITE III of FIG. 8. Table 4 illustrates the complementarity of the nucleotide sequences of C20orf116 BINDING SITE, designated SEQ ID:13238, to the nucleotide sequence of GAM63 RNA, herein designated GAM RNA, also designated SEQ ID:348.

Another function of GAM63 is therefore inhibition of Chromosome 20 open reading frame 116 (C20orf116, Accession NP_076424.1). Accordingly, utilities of GAM63 include diagnosis, prevention and treatment of diseases and clinical conditions associated with C20orf116.

Chromosome 20 open reading frame 140 (C20orf140, Accession NP_653229.1) is another GAM63 target gene, herein designated TARGET GENE. C20orf140 BINDING SITE is a target binding site found in the 5' untranslated region of mRNA encoded by C20orf140, corresponding to a target binding site such as BINDING SITE I, BINDING SITE II or BINDING SITE III of FIG. 8. Table 4 illustrates the complementarity of the nucleotide sequences of C20orf140 BINDING SITE, designated SEQ ID:1272, to the nucleotide sequence of GAM63 RNA, herein designated GAM RNA, also designated SEQ ID:348.

Another function of GAM63 is therefore inhibition of Chromosome 20 open reading frame 140 (C20orf140, Accession NP_653229.1). Accordingly, utilities of GAM63 include diagnosis, prevention and treatment of diseases and clinical conditions associated with C20orf140.

Chromosome 20 open reading frame 169 (C20orf169, Accession NP_291020.1) is another GAM63 target gene, herein designated TARGET GENE. C20orf169 BINDING SITE is a target binding site found in the 3' untranslated region of mRNA encoded by C20orf169, corresponding to a target binding site such as BINDING SITE I, BINDING SITE II or BINDING SITE III of FIG. 8. Table 4 illustrates the complementarity of the nucleotide sequences of C20orf169 BINDING SITE, designated SEQ ID:15267, to the nucleotide sequence of GAM63 RNA, herein designated GAM RNA, also designated SEQ ID:348.

Another function of GAM63 is therefore inhibition of Chromosome 20 open reading frame 169 (C20orf169, Accession NP_291020.1). Accordingly, utilities of GAM63 include diagnosis, prevention and treatment of diseases and clinical conditions associated with C20orf169.

Chromosome 20 open reading frame 98 (C20orf98, Accession NP_079234.1) is another GAM63 target gene, herein designated TARGET GENE. C20orf98 BINDING SITE is a target binding site found in the 3' untranslated region of mRNA encoded by C20orf98, corresponding to a target binding site such as BINDING SITE I, BINDING SITE II or BINDING SITE III of FIG. 8. Table 4 illustrates the complementarity of the nucleotide sequences of C20orf98 BINDING SITE, designated SEQ ID:15768, to the nucleotide sequence of GAM63 RNA, herein designated GAM RNA, also designated SEQ ID:348.

Another function of GAM63 is therefore inhibition of Chromosome 20 open reading frame 98 (C20orf98, Accession NP_079234.1). Accordingly, utilities of GAM63 include diagnosis, prevention and treatment of diseases and clinical conditions associated with C20orf98.

Chromosome 21 open reading frame 93 (C21orf93, Accession NP_660162.1) is another GAM63 target gene, herein designated TARGET GENE. C21orf93 BINDING SITE is a target binding site found in the 3' untranslated region of mRNA encoded by C21orf93, corresponding to a target binding site such as BINDING SITE I, BINDING SITE II or BINDING SITE III of FIG. 8. Table 4 illustrates the complementarity of the nucleotide sequences of C21orf93 BINDING SITE, designated SEQ ID:20078, to the nucleotide sequence of GAM63 RNA, herein designated GAM RNA, also designated SEQ ID:348.

Another function of GAM63 is therefore inhibition of Chromosome 21 open reading frame 93 (C21orf93, Accession NP_660162.1). Accordingly, utilities of GAM63 include diagnosis, prevention and treatment of diseases and clinical conditions associated with C21orf93.

Chromosome 22 open reading frame 5 (C22orf5, Accession NP_036396.1) is another GAM63 target gene, herein designated TARGET GENE. C22orf5 BINDING SITE is a target binding site found in the 3' untranslated region of mRNA encoded by C22orf5, corresponding to a target binding site such as BINDING SITE I, BINDING SITE II or BINDING SITE III of FIG. 8. Table 4 illustrates the complementarity of the nucleotide sequences of C22orf5 BINDING SITE, designated SEQ ID:4323, to the nucleotide sequence of GAM63 RNA, herein designated GAM RNA, also designated SEQ ID:348.

Another function of GAM63 is therefore inhibition of Chromosome 22 open reading frame 5 (C22orf5, Accession NP_036396.1). Accordingly, utilities of GAM63 include diagnosis, prevention and treatment of diseases and clinical conditions associated with C22orf5.

Complement component 3 (C3, Accession NP_000055.1) is another GAM63 target gene, herein designated TARGET GENE. C3 BINDING SITE is a target binding site found in the 5' untranslated region of mRNA encoded by C3, corresponding to a target binding site such as BINDING SITE I, BINDING SITE II or BINDING SITE III of FIG. 8. Table 4 illustrates the complementarity of the nucleotide sequences of C3 BINDING SITE, designated SEQ ID:3699, to the nucleotide sequence of GAM63 RNA, herein designated GAM RNA, also designated SEQ ID:348.

Another function of GAM63 is therefore inhibition of Complement component 3 (C3, Accession NP_000055.1). Accordingly, utilities of GAM63 include diagnosis, prevention and treatment of diseases and clinical conditions associated with C3.

C3F (Accession NP_005759.2) is another GAM63 target gene, herein designated TARGET GENE. C3F BINDING SITE is a target binding site found in the 3' untranslated region of mRNA encoded by C3F, corresponding to a target binding site such as BINDING SITE I, BINDING SITE II or BINDING SITE III of FIG. 8. Table 4 illustrates the complementarity of the nucleotide sequences of C3F BINDING SITE, designated SEQ ID:15076, to the nucleotide sequence of GAM63 RNA, herein designated GAM RNA, also designated SEQ ID:348.

Another function of GAM63 is therefore inhibition of C3F (Accession NP_005759.2). Accordingly, utilities of GAM63 include diagnosis, prevention and treatment of diseases and clinical conditions associated with C3F.

C6orf136 (Accession NP_659466.1) is another GAM63 target gene, herein designated TARGET GENE. C6orf136 BINDING SITE is a target binding site found in the 5' untranslated region of mRNA encoded by C6orf136, corresponding to a target binding site such as BINDING SITE I, BINDING SITE II or BINDING SITE III of FIG. 8. Table 4 illustrates the complementarity of the nucleotide sequences of C6orf136 BINDING SITE, designated SEQ ID:7531, to the nucleotide sequence of GAM63 RNA, herein designated GAM RNA, also designated SEQ ID:348.

Another function of GAM63 is therefore inhibition of C6orf136 (Accession NP_659466.1). Accordingly, utilities of GAM63 include diagnosis, prevention and treatment of diseases and clinical conditions associated with C6orf136.

C6orf67 (Accession NP_060717.1) is another GAM63 target gene, herein designated TARGET GENE. C6orf67 BINDING SITE is a target binding site found in the 3' untranslated region of mRNA encoded by C6orf67, corresponding to a target binding site such as BINDING SITE I, BINDING SITE II or BINDING SITE III of FIG. 8. Table 4 illustrates the complementarity of the nucleotide sequences of C6orf67 BINDING SITE, designated SEQ ID:5174, to the nucleotide sequence of GAM63 RNA, herein designated GAM RNA, also designated SEQ ID:348.

Another function of GAM63 is therefore inhibition of C6orf67 (Accession NP_060717.1). Accordingly, utilities of GAM63 include diagnosis, prevention and treatment of diseases and clinical conditions associated with C6orf67.

CAB2 (Accession NP_219487.2) is another GAM63 target gene, herein designated TARGET GENE. CAB2 BINDING SITE is a target binding site found in the 3' untranslated region of mRNA encoded by CAB2, corresponding to a target binding site such as BINDING SITE I, BINDING SITE II or BINDING SITE III of FIG. 8. Table 4 illustrates the complementarity of the nucleotide sequences of CAB2 BINDING SITE, designated SEQ ID:12488, to the nucleotide sequence of GAM63 RNA, herein designated GAM RNA, also designated SEQ ID:348.

Another function of GAM63 is therefore inhibition of CAB2 (Accession NP_219487.2). Accordingly, utilities of GAM63 include diagnosis, prevention and treatment of diseases and clinical conditions associated with CAB2.

Calcium channel, voltage-dependent, gamma subunit 6 (CACNG6, Accession NP_665814.1) is another GAM63 target gene, herein designated TARGET GENE. CACNG6 BINDING SITE is a target binding site found in the 3' untranslated region of multiple transcripts of mRNA encoded by CACNG6, corresponding to a target binding site such as BINDING SITE I, BINDING SITE II or BINDING SITE III of FIG. 8. Table 4 illustrates the complementarity of the nucleotide sequences of CACNG6 BINDING SITE, designated SEQ ID:11907, to the nucleotide sequence of GAM63 RNA, herein designated GAM RNA, also designated SEQ ID:348.

Another function of GAM63 is therefore inhibition of Calcium channel, voltage-dependent, gamma subunit 6 (CACNG6, Accession NP_665814.1), a gene which plays a role in excitation-contraction coupling. Accordingly, utilities of GAM63 include diagnosis, prevention and treatment of diseases and clinical conditions associated with CACNG6.

The function of CACNG6 has been established by previous studies. Voltage- dependent calcium channels couple membrane depolarization in a number of cellular processes. These activities are regulated by distinct channels composed of the pore- forming alpha-1 (e.g., CACNA1D; 114206) subunit and the modulatory beta (e.g., CACNB1; 114207), alpha-2/delta (e.g., CACNA2D1; 114204), and gamma (e.g., CACNG1; 114209) subunits. By RT-PCR and genomic sequence analysis, Burgess et al. (2001) determined that the CACNG6 gene, like CACNG7 and CACNG8, contains 4 exons. A potential splice variant lacking exon 3 would eliminate 2 transmembrane domains.

Full details of the abovementioned studies are described in the following publications, the disclosure of which are hereby incorporated by reference:

Burgess, D. L.; Gefrides, L. A.; Foreman, P. J.; Noebels, J. L.: A cluster of three novel Ca(2+) channel gamma subunit genes on chromosome 19q13.4: evolution and expression profile of the gamma subunit gene family. Genomics 71: 339-350, 2001; and Chu, P.-J.; Robertson, H. M.; Best, P. M.: Calcium channel gamma subunits provide insights into the evolution of this gene family. Gene 280:37-48, 2001.

Further studies establishing the function and utilities of CACNG6 are found in John Hopkins OMIM database record ID 606898, and in cited publications listed in Table 5, which are hereby incorporated by reference. Calcium channel, voltage-dependent, gamma subunit 6 (CACNG6, Accession NP_665813.1) is another GAM63 target gene, herein designated TARGET GENE. CACNG6 BINDING SITE is a target binding site found in the 3' untranslated region of multiple transcripts of mRNA encoded by CACNG6, corresponding to a target binding site such as BINDING SITE I, BINDING SITE II or BINDING SITE III of FIG. 8. Table 4 illustrates the complementarity of the nucleotide sequences of CACNG6 BINDING SITE, designated SEQ ID:11907, to the nucleotide sequence of GAM63 RNA, herein designated GAM RNA, also designated SEQ ID:348.

Another function of GAM63 is therefore inhibition of Calcium channel, voltage-dependent, gamma subunit 6 (CACNG6, Accession NP_665813.1), a gene which plays a role in excitation-contraction coupling. Accordingly, utilities of GAM63 include diagnosis, prevention and treatment of diseases and clinical conditions associated with CACNG6.

The function of CACNG6 has been established by previous studies. Voltage- dependent calcium channels couple membrane depolarization in a number of cellular processes. These activities are regulated by distinct channels composed of the pore- forming alpha-1 (e.g., CACNA1D; 114206) subunit and the modulatory beta (e.g., CACNB1; 114207), alpha-2/delta (e.g., CACNA2D1; 114204), and gamma (e.g., CACNG1; 114209) subunits. By RT-PCR and genomic sequence analysis, Burgess et al. (2001) determined that the CACNG6 gene, like CACNG7 and CACNG8, contains 4 exons. A potential splice variant lacking exon 3 would eliminate 2 transmembrane domains.

Full details of the abovementioned studies are described in the following publications, the disclosure of which are hereby incorporated by reference:

Burgess, D. L.; Gefrides, L. A.; Foreman, P. J.; Noebels, J. L.: A cluster of three novel Ca(2+) channel gamma subunit genes on chromosome 19q13.4: evolution and expression profile of the gamma subunit gene family. Genomics 71: 339-350, 2001; and Chu, P.-J.; Robertson, H. M.; Best, P. M.: Calcium channel gamma subunits provide insights into the evolution of this gene family. Gene 280:37-48, 2001.

Further studies establishing the function and utilities of CACNG6 are found in John Hopkins OMIM database record ID 606898, and in cited publications listed in Table 5, which are hereby incorporated by reference. Calcium channel, voltage-dependent, gamma subunit 6 (CACNG6, Accession NP_114103.2) is another GAM63 target gene, herein designated TARGET GENE. CACNG6 BINDING SITE is a target binding site found in the 3' untranslated region of multiple transcripts of mRNA encoded by CACNG6, corresponding to a target binding site such as BINDING SITE I, BINDING SITE II or BINDING SITE III of FIG. 8. Table 4 illustrates the complementarity of the nucleotide sequences of CACNG6 BINDING SITE, designated SEQ ID:11907, to the nucleotide sequence of GAM63 RNA, herein designated GAM RNA, also designated SEQ ID:348.

Another function of GAM63 is therefore inhibition of Calcium channel, voltage-dependent, gamma subunit 6 (CACNG6, Accession NP_114103.2), a gene which plays a role in excitation-contraction coupling. Accordingly, utilities of GAM63 include diagnosis, prevention and treatment of diseases and clinical conditions associated with CACNG6.

The function of CACNG6 has been established by previous studies. Voltage- dependent calcium channels couple membrane depolarization in a number of cellular processes. These activities are regulated by distinct channels composed of the pore- forming alpha-1 (e.g., CACNA1D; 114206) subunit and the modulatory beta (e.g., CACNB1; 114207), alpha-2/delta (e.g., CACNA2D1; 114204), and gamma (e.g., CACNG1; 114209) subunits. By RT-PCR and genomic sequence analysis, Burgess et al. (2001) determined that the CACNG6 gene, like CACNG7 and CACNG8, contains 4 exons. A potential splice variant lacking exon 3 would eliminate 2 transmembrane domains.

Full details of the abovementioned studies are described in the following publications, the disclosure of which are hereby incorporated by reference:

Burgess, D. L.; Gefrides, L. A.; Foreman, P. J.; Noebels, J. L.: A cluster of three novel Ca(2+) channel gamma subunit genes on chromosome 19q13.4: evolution and expression profile of the gamma subunit gene family. Genomics 71: 339-350, 2001; and Chu, P.-J.; Robertson, H. M.; Best, P. M.: Calcium channel gamma subunits provide insights into the evolution of this gene family. Gene 280:37-48, 2001.

Further studies establishing the function and utilities of CACNG6 are found in John Hopkins OMIM database record ID 606898, and in cited publications listed in Table 5, which are hereby incorporated by reference. Calcium/calmodulin-dependent protein kinase kinase 1, alpha (CAMKK1, Accession NP_115670.1) is another GAM63 target gene, herein designated TARGET GENE. CAMKK1 BINDING SITE is a target binding site found in the 3' untranslated region of multiple transcripts of mRNA encoded by CAMKK1, corresponding to a target binding site such as BINDING SITE I, BINDING SITE II or BINDING SITE III of FIG. 8. Table 4 illustrates the complementarity of the nucleotide sequences of CAMKK1 BINDING SITE, designated SEQ ID:5691, to the nucleotide sequence of GAM63 RNA, herein designated GAM RNA, also designated SEQ ID:348.

Another function of GAM63 is therefore inhibition of Calcium/calmodulin-dependent protein kinase kinase 1, alpha (CAMKK1, Accession NP_115670.1). Accordingly, utilities of GAM63 include diagnosis, prevention and treatment of diseases and clinical conditions associated with CAMKK1.

Calcium/calmodulin-dependent protein kinase kinase 1, alpha (CAMKK1, Accession NP_757343.1) is another GAM63 target gene, herein designated TARGET GENE. CAMKK1 BINDING SITE is a target binding site found in the 3' untranslated region of multiple transcripts of mRNA encoded by CAMKK1, corresponding to a target binding site such as BINDING SITE I, BINDING SITE II or BINDING SITE III of FIG. 8. Table 4 illustrates the complementarity of the nucleotide sequences of CAMKK1 BINDING SITE, designated SEQ ID:5691, to the nucleotide sequence of GAM63 RNA, herein designated GAM RNA, also designated SEQ ID:348.

Another function of GAM63 is therefore inhibition of Calcium/calmodulin-dependent protein kinase kinase 1, alpha (CAMKK1, Accession NP_757343.1). Accordingly, utilities of GAM63 include diagnosis, prevention and treatment of diseases and clinical conditions associated with CAMKK1.

Calcium/calmodulin-dependent protein kinase kinase 2, beta (CAMKK2, Accession NP_757365.1) is another GAM63 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:14352, to the nucleotide sequence of GAM63 RNA, herein designated GAM RNA, also designated SEQ ID:348.

Another function of GAM63 is therefore inhibition of Calcium/calmodulin-dependent protein kinase kinase 2, beta (CAMKK2, Accession NP_757365.1). Accordingly, utilities of GAM63 include diagnosis, prevention and treatment of diseases and clinical conditions associated with CAMKK2.

Calcium/calmodulin-dependent protein kinase kinase 2, beta (CAMKK2, Accession NP_006540.3) is another GAM63 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:14352, to the nucleotide sequence of GAM63 RNA, herein designated GAM RNA, also designated SEQ ID:348.

Another function of GAM63 is therefore inhibition of Calcium/calmodulin-dependent protein kinase kinase 2, beta (CAMKK2, Accession NP_006540.3). Accordingly, utilities of GAM63 include diagnosis, prevention and treatment of diseases and clinical conditions associated with CAMKK2.

Calcium/calmodulin-dependent protein kinase kinase 2, beta (CAMKK2, Accession NP_757380.1) is another GAM63 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:14352, to the nucleotide sequence of GAM63 RNA, herein designated GAM RNA, also designated SEQ ID:348.

Another function of GAM63 is therefore inhibition of Calcium/calmodulin-dependent protein kinase kinase 2, beta (CAMKK2, Accession NP_757380.1). Accordingly, utilities of GAM63 include diagnosis, prevention and treatment of diseases and clinical conditions associated with CAMKK2.

Calcium/calmodulin-dependent protein kinase kinase 2, beta (CAMKK2, Accession NP_705719.2) is another GAM63 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:14352, to the nucleotide sequence of GAM63 RNA, herein designated GAM RNA, also designated SEQ ID:348.

Another function of GAM63 is therefore inhibition of Calcium/calmodulin-dependent protein kinase kinase 2, beta (CAMKK2, Accession NP_705719.2). Accordingly, utilities of GAM63 include diagnosis, prevention and treatment of diseases and clinical conditions associated with CAMKK2.

Calcium/calmodulin-dependent protein kinase kinase 2, beta (CAMKK2, Accession NP_705720.1) is another GAM63 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:14352, to the nucleotide sequence of GAM63 RNA, herein designated GAM RNA, also designated SEQ ID:348.

Another function of GAM63 is therefore inhibition of Calcium/calmodulin-dependent protein kinase kinase 2, beta (CAMKK2, Accession NP_705720.1). Accordingly, utilities of GAM63 include diagnosis, prevention and treatment of diseases and clinical conditions associated with CAMKK2.

CAP350 (Accession NP_055625.2) is another GAM63 target gene, herein designated TARGET GENE. CAP350 BINDING SITE is a target binding site found in the 3' untranslated region of mRNA encoded by CAP350, corresponding to a target binding site such as BINDING SITE I, BINDING SITE II or BINDING SITE III of FIG. 8. Table 4 illustrates the complementarity of the nucleotide sequences of CAP350 BINDING SITE, designated SEQ ID:19295, to the nucleotide sequence of GAM63 RNA, herein designated GAM RNA, also designated SEQ ID:348.

Another function of GAM63 is therefore inhibition of CAP350 (Accession NP_055625.2). Accordingly, utilities of GAM63 include diagnosis, prevention and treatment of diseases and clinical conditions associated with CAP350.

Core-binding factor, runt domain, alpha subunit 2; translocated to, 2 (CBFA2T2, Accession NP_787060.1) is another GAM63 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:9720, to the nucleotide sequence of GAM63 RNA, herein designated GAM RNA, also designated SEQ ID:348.

Another function of GAM63 is therefore inhibition of Core-binding factor, runt domain, alpha subunit 2; translocated to, 2 (CBFA2T2, Accession NP_787060.1), a gene which is a putative transcription factor. Accordingly, utilities of GAM63 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Core-binding factor, runt domain, alpha subunit 2; translocated to, 2 (CBFA2T2, Accession NP_005084.1) is another GAM63 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:9720, to the nucleotide sequence of GAM63 RNA, herein designated GAM RNA, also designated SEQ ID:348.

Another function of GAM63 is therefore inhibition of Core-binding factor, runt domain, alpha subunit 2; translocated to, 2 (CBFA2T2, Accession NP_005084.1), a gene which is a putative transcription factor. Accordingly, utilities of GAM63 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Chromobox homolog 7 (CBX7, Accession NP_783640.1) is another GAM63 target gene, herein designated TARGET GENE. CBX7 BINDING SITE is a target binding site found in the 3' untranslated region of mRNA encoded by CBX7, corresponding to a target binding site such as BINDING SITE I, BINDING SITE II or BINDING SITE III of FIG. 8. Table 4 illustrates the complementarity of the nucleotide sequences of CBX7 BINDING SITE, designated SEQ ID:8537, to the nucleotide sequence of GAM63 RNA, herein designated GAM RNA, also designated SEQ ID:348.

Another function of GAM63 is therefore inhibition of Chromobox homolog 7 (CBX7, Accession NP_783640.1). Accordingly, utilities of GAM63 include diagnosis, prevention and treatment of diseases and clinical conditions associated with CBX7.

Cyclin h (CCNH, Accession NP_001230.1) is another GAM63 target gene, herein designated TARGET GENE. CCNH BINDING SITE is a target binding site found in the 5' untranslated region of mRNA encoded by CCNH, corresponding to a target binding site such as BINDING SITE I, BINDING SITE II or BINDING SITE III of FIG. 8. Table 4 illustrates the complementarity of the nucleotide sequences of CCNH BINDING SITE, designated SEQ ID:13215, to the nucleotide sequence of GAM63 RNA, herein designated GAM RNA, also designated SEQ ID:348.

Another function of GAM63 is therefore inhibition of Cyclin h (CCNH, Accession NP_001230.1), a gene which phosphorylates and thus activates certain cyclin-dependent protein kinases in the regulation of cell cycle progression. Accordingly, utilities of GAM63 include diagnosis, prevention and treatment of diseases and clinical conditions associated with CCNH.

The function of CCNH has been established by previous studies. The cdk-activating kinase (CAK) is a multi-subunit protein which phosphorylates and thus activates certain cyclin-dependent protein kinases in the regulation of cell cycle progression. Fisher and Morgan (1994) purified mammalian CAK and found that it was composed of 2 major polypeptides, a 37-kD cyclin termed cyclin H and a 42-kD cyclin-dependent kinase (CDK7; 601955). Fisher and Morgan (1994) cloned the cyclin H gene encoding a 323-amino acid polypeptide homologous to STK1 (CDK7) and Xenopus MO15, a cell cycle-associated kinase. The authors reported that a reconstituted cyclin H/CDK7 complex was able to phosphorylate CDK2 (OMIM Ref. No. 116953) and CDC2 (OMIM Ref. No. 116940) in vitro. Mammalian CDK8 (OMIM Ref. No. 603184) and cyclin C (OMIM Ref. No. 123838) are components of the RNA polymerase II holoenzyme complex, where they function as a protein kinase that phosphorylates the C-terminal domain of the largest subunit of RNA polymerase II. The CDK8/cyclin C protein complex is also found in a number of mammalian 'Mediator'-like protein complexes, which repress activated transcription independently of the C-terminal domain in vitro. Akoulitchev et al. (2000) demonstrated that CDK8/cyclin C can regulate transcription by targeting the CDK7/cyclin H subunits of TFIIH. CDK8 phosphorylates mammalian cyclin H at serine 5 and serine 304 both in vitro and in vivo, in the vicinity of its functionally unique N- and C-terminal alpha-helical domains. This phosphorylation represses both the ability of TFIIH to activate transcription and its C-terminal kinase activity. In addition, mimicking CDK8 phosphorylation of cyclin H in vivo has a dominant-negative effect on cell growth. Akoulitchev et al. (2000) concluded that their results linked the Mediator complex and the basal transcription machinery by a regulatory pathway involving 2 cyclin-dependent kinases. This pathway appears to be unique to higher organisms.

Full details of the abovementioned studies are described in the following publications, the disclosure of which are hereby incorporated by reference:

Fisher, R. P.; Morgan, D. O.: A novel cyclin associates with MO15/CDK7 to form the CDK-activating kinase. Cell 78:713-724, 1994; and Akoulitchev, S.; Chuikov, S.; Reinberg, D.: TFIIH is negatively regulated by cdk8-containing mediator complexes. Nature 407:102-106, 2000.

Further studies establishing the function and utilities of CCNH are found in John Hopkins OMIM database record ID 601953, and in cited publications listed in Table 5, which are hereby incorporated by reference. Chemokine (c-c motif) receptor 7 (CCR7, Accession NP_001829.1) is another GAM63 target gene, herein designated TARGET GENE. CCR7 BINDING SITE is a target binding site found in the 3' untranslated region of mRNA encoded by CCR7, corresponding to a target binding site such as BINDING SITE I, BINDING SITE II or BINDING SITE III of FIG. 8. Table 4 illustrates the complementarity of the nucleotide sequences of CCR7 BINDING SITE, designated SEQ ID:19038, to the nucleotide sequence of GAM63 RNA, herein designated GAM RNA, also designated SEQ ID:348.

Another function of GAM63 is therefore inhibition of Chemokine (c-c motif) receptor 7 (CCR7, Accession NP_001829.1). Accordingly, utilities of GAM63 include diagnosis, prevention and treatment of diseases and clinical conditions associated with CCR7.

Cd2-associated protein (CD2AP, Accession NP_036252.1) is another GAM63 target gene, herein designated TARGET GENE. CD2AP BINDING SITE is a target binding site found in the 5' untranslated region of mRNA encoded by CD2AP, corresponding to a target binding site such as BINDING SITE I, BINDING SITE II or BINDING SITE III of FIG. 8. Table 4 illustrates the complementarity of the nucleotide sequences of CD2AP BINDING SITE, designated SEQ ID:12070, to the nucleotide sequence of GAM63 RNA, herein designated GAM RNA, also designated SEQ ID:348.

Another function of GAM63 is therefore inhibition of Cd2-associated protein (CD2AP, Accession NP_036252.1), a gene which binds CAS ligand and may therefor involves in its growth regulatory pathway. Accordingly, utilities of GAM63 include diagnosis, prevention and treatment of diseases and clinical conditions associated with CD2AP.

The function of CD2AP has been established by previous studies. P130(Cas) (OMIM Ref. No. 602941) is a docking protein that is tyrosine-phosphorylated in response to a variety of extracellular stimuli, such as growth factors, cell-cell interaction, and cell-matrix interaction, and appears to play a critical role in the integrin-linked formation of focal complexes. To understand the growth regulatory pathway of p130 (Cas), Kirsch et al. (1999) used the yeast 2-hybrid system to search for interacting molecules. They identified a human protein, which they called CMS for p130(Cas) ligand with multiple SH3 domains, as a direct binding protein of p130 (Cas). CMS is a multifunctional adapter-type molecule, which is localized in the cytoplasm, membrane ruffles, and leading edges of cells. Its structure and colocalization with F-actin (see OMIM Ref. No. 102610) and p130(Cas) suggested a function as a scaffolding protein involved in the dynamic regulation of the actin cytoskeleton. The cDNA corresponding to CMS encodes a protein of 639 amino acids with a deduced molecular mass of approximately 70 kD. Amino acid analysis revealed that CMS contains in its N terminus 3 SH3 domains followed by a proline-rich region containing binding sites for SH3 domains. Putative actin-binding sites and a coiled-coil domain are located at the C terminus of the protein, which also contains a putative leucine zipper motif. CMS mRNA is ubiquitously expressed in adult and fetal human tissues as an approximately 5.4-kb transcript, as detected by Northern blot analysis. CMS induces vesicle formation and colocalizes with p130(Cas) and F-actin to membrane ruffles. It also associates with and is phosphorylated by tyrosine kinases. Kirsch et al. (1999) demonstrated that CMS is able to homodimerize through the coiled-coil domain located in its C terminus. There was no evidence for intermolecular or intramolecular binding via the SH3 domains and PXXP binding.

Animal model experiments lend further support to the function of CD2AP. Shih et al. (1999) generated mice lacking CD2AP by targeted disruption. In CD2AP-deficient mice, immune function was compromised, but the mice died from renal failure at 6 to 7 weeks of age. In the kidney, CD2AP was expressed primarily in glomerular epithelial cells. Knockout mice exhibited defects in epithelial cell foot processes, accompanied by mesangial cell hyperplasia and extracellular matrix deposition. CD2AP associated with nephrin (OMIM Ref. No. 602716), which is the primary component of the slit diaphragm. This observation supports a role for CD2AP in this specialized cell junction.

It is appreciated that the abovementioned animal model for CD2AP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kirsch, K. H.; Georgescu, M.-M.; Ishimaru, S.; Hanafusa, H.: CMS: an adapter molecule involved in cytoskeletal rearrangements. Proc. Nat. Acad. Sci. 96:6211-6216, 1999; and Shih, N.-Y.; Li, J.; Karpitskii, V.; Nguyen, D.; Dustin, M. L.; Kanagawa, O.; Miner, J. H.; Shaw, A. S.: Congenital nephrotic syndrome in mice lacking CD2-associated protein. Science 2.

Further studies establishing the function and utilities of CD2AP are found in John Hopkins OMIM database record ID 604241, and in cited publications listed in Table 5, which are hereby incorporated by reference. Cd37 antigen (CD37, Accession NP_001765.1) is another GAM63 target gene, herein designated TARGET GENE. CD37 BINDING SITE is a target binding site found in the 3' untranslated region of mRNA encoded by CD37, corresponding to a target binding site such as BINDING SITE I, BINDING SITE II or BINDING SITE III of FIG. 8. Table 4 illustrates the complementarity of the nucleotide sequences of CD37 BINDING SITE, designated SEQ ID:19108, to the nucleotide sequence of GAM63 RNA, herein designated GAM RNA, also designated SEQ ID:348.

Another function of GAM63 is therefore inhibition of Cd37 antigen (CD37, Accession NP_001765.1), a gene which is expressed on leukocytes and has been implicated in signal transduction, cell-cell interactions, and cellular activation and development. Accordingly, utilities of GAM63 include diagnosis, prevention and treatment of diseases and clinical conditions associated with CD37.

The function of CD37 has been established by previous studies. CD37 is a membrane protein of the tetraspanin superfamily, which includes CD9 (OMIM Ref. No. 143030), CD53 (OMIM Ref. No. 151525), CD81 (OMIM Ref. No. 186845), and the R2 antigen (KAI1; 600623) among others. Many of these molecules are expressed on leukocytes and have been implicated in signal transduction, cell-cell interactions, and cellular activation and development. Virtaneva et al. (1993) found that the CD37, CD53, and KAI1 proteins have 4 hydrophobic membrane-spanning regions and a single major extracellular loop. Both N- and C-termini of the polypeptides are probably located in the cytoplasm. The 3 antigens appear to have a higher sequence similarity (33%) to each other than to other members of the family. The CD37 antigen is strongly expressed on the surface of B cells and only weakly on a subpopulation of T cells. The CD53 glycoprotein is a pan-leukocyte marker widely expressed on hemopoietic cells. The R2 antigen appears to be upregulated in activated T cells. By study of human/rodent somatic cell hybrids, Virtaneva et al. (1993) demonstrated that these 3 similar antigens are encoded by genes on distinct chromosomes; CD37 mapped to 19p13-q13.4, CD53 to 1p31-p12, and R2 to 11p12.

Full details of the abovementioned studies are described in the following publications, the disclosure of which are hereby incorporated by reference:

Knobeloch, K.-P.; Wright, M. D.; Ochsenbein, A. F.; Liesenfeld, O.; Lohler, J.; Zinkernagel, R. M.; Horak, I.; Orinska, Z.: Targeted inactivation of the tetraspanin CD37 impairs T-cell-dependent B-cell response under suboptimal costimulatory conditions. Molec. Cell. Biol. 20:5363-5369, 2000; and Virtaneva, K. I.; Angelisova, P.; Baumruker, T.; Horejsi, V.; Nevanlinna, H.; Schroder, J.: The genes for CD37, CD53, and R2, all members of a novel gene family, are located on differ.

Further studies establishing the function and utilities of CD37 are found in John Hopkins OMIM database record ID 151523, and in cited publications listed in Table 5, which are hereby incorporated by reference. Cd8 antigen, beta polypeptide 1 (p37) (CD8B1, Accession NP_742097.1) is another GAM63 target gene, herein designated TARGET GENE. CD8B1 BINDING SITE is a target binding site found in the 3' untranslated region of multiple transcripts of mRNA encoded by CD8B1, corresponding to a target binding site such as BINDING SITE I, BINDING SITE II or BINDING SITE III of FIG. 8. Table 4 illustrates the complementarity of the nucleotide sequences of CD8B1 BINDING SITE, designated SEQ ID:13025, to the nucleotide sequence of GAM63 RNA, herein designated GAM RNA, also designated SEQ ID:348.

Another function of GAM63 is therefore inhibition of Cd8 antigen, beta polypeptide 1 (p37) (CD8B1, Accession NP_742097.1). Accordingly, utilities of GAM63 include diagnosis, prevention and treatment of diseases and clinical conditions associated with CD8B1.

Cd8 antigen, beta polypeptide 1 (p37) (CD8B1, Accession NP_004922.1) is another GAM63 target gene, herein designated TARGET GENE. CD8B1 BINDING SITE is a target binding site found in the 3' untranslated region of multiple transcripts of mRNA encoded by CD8B1, corresponding to a target binding site such as BINDING SITE I, BINDING SITE II or BINDING SITE III of FIG. 8. Table 4 illustrates the complementarity of the nucleotide sequences of CD8B1 BINDING SITE, designated SEQ ID:13025, to the nucleotide sequence of GAM63 RNA, herein designated GAM RNA, also designated SEQ ID:348.

Another function of GAM63 is therefore inhibition of Cd8 antigen, beta polypeptide 1 (p37) (CD8B1, Accession NP_004922.1). Accordingly, utilities of GAM63 include diagnosis, prevention and treatment of diseases and clinical conditions associated with CD8B1.

Cell division cycle 42 (gtp binding protein, 25 kda) (CDC42, Accession NP_001782.1) is another GAM63 target gene, herein designated TARGET GENE. CDC42 BINDING SITE is a target binding site found in the 3' untranslated region of multiple transcripts of mRNA encoded by CDC42, corresponding to a target binding site such as BINDING SITE I, BINDING SITE II or BINDING SITE III of FIG. 8. Table 4 illustrates the complementarity of the nucleotide sequences of CDC42 BINDING SITE, designated SEQ ID:5028, to the nucleotide sequence of GAM63 RNA, herein designated GAM RNA, also designated SEQ ID:348.

Another function of GAM63 is therefore inhibition of Cell division cycle 42 (gtp binding protein, 25 kda) (CDC42, Accession NP_001782.1). Accordingly, utilities of GAM63 include diagnosis, prevention and treatment of diseases and clinical conditions associated with CDC42.

Cat eye syndrome chromosome region, candidate 1 (CECR1, Accession NP_803124.1) is another GAM63 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:8125 and SEQ ID:8928 respectively, to the nucleotide sequence of GAM63 RNA, herein designated GAM RNA, also designated SEQ ID:348.

Another function of GAM63 is therefore inhibition of Cat eye syndrome chromosome region, candidate 1 (CECR1, Accession NP_803124.1). Accordingly, utilities of GAM63 include diagnosis, prevention and treatment of diseases and clinical conditions associated with CECR1.

Cat eye syndrome chromosome region, candidate 1 (CECR1, Accession NP_059120.2) is another GAM63 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:8125 and SEQ ID:8928 respectively, to the nucleotide sequence of GAM63 RNA, herein designated GAM RNA, also designated SEQ ID:348.

Another function of GAM63 is therefore inhibition of Cat eye syndrome chromosome region, candidate 1 (CECR1, Accession NP_059120.2). Accordingly, utilities of GAM63 include diagnosis, prevention and treatment of diseases and clinical conditions associated with CECR1.

Cadherin, egf lag seven-pass g-type receptor 2 (flamingo homolog, drosophila) (CELSR2, Accession NP_001399.1) is another GAM63 target gene, herein designated TARGET GENE. CELSR2 BINDING SITE is a target binding site found in the 3' untranslated region of mRNA encoded by CELSR2, corresponding to a target binding site such as BINDING SITE I, BINDING SITE II or BINDING SITE III of FIG. 8. Table 4 illustrates the complementarity of the nucleotide sequences of CELSR2 BINDING SITE, designated SEQ ID:2706, to the nucleotide sequence of GAM63 RNA, herein designated GAM RNA, also designated SEQ ID:348.

Another function of GAM63 is therefore inhibition of Cadherin, egf lag seven-pass g-type receptor 2 (flamingo homolog, drosophila) (CELSR2, Accession NP_001399.1), a gene which is a calcium dependent cell adhesion protein. Accordingly, utilities of GAM63 include diagnosis, prevention and treatment of diseases and clinical conditions associated with CELSR2.

The function of CELSR2 has been established by previous studies. The domain that characterizes epidermal growth factor (EGF; 131530) consists of approximately 50 amino acids with 3 disulfide bonds. EGF-like domains are believed to play a critical role in a number of extracellular events, including cell adhesion and receptor-ligand interactions. Proteins with EGF-like domains often consist of more than 1,000 amino acids, have multiple copies of the EGF-like domain, and contain additional domains known to be involved in specific protein-protein interactions. To identify proteins containing EGF-like domains, Nakayama et al. (1998) searched a database of long cDNA sequences randomly selected from a human brain cDNA library for those that encode an EGF-like motif. They identified several partial cDNAs encoding novel proteins with EGF-like domains, such as EGFL2, which they named MEGF3. The predicted partial EGFL2 protein has at least 5 cadherin motifs, 6 EGF-like domains, 2 laminin G domains (see OMIM Ref. No. 601033), 7 transmembrane domains, and a cytoplasmic proline- rich sequence. Human EGFL2 appears to have a domain structure identical to that of rat Megf2 (OMIM Ref. No. 604264), whose complete coding sequence was also isolated by the authors. Northern blot analysis detected rat Megf3 expression in several regions of the brain.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996; and Nakayama, M.; Nakajima, D.; Nagase, T.; Nomura, N.; Seki, N.; Ohara, O.: Identification of high-molecular-weight proteins with multiple EGF-like motifs by motif-trap screening. Genomic.

Further studies establishing the function and utilities of CELSR2 are found in John Hopkins OMIM database record ID 604265, and in cited publications listed in Table 5, which are hereby incorporated by reference. Centromere protein b, 80 kda (CENPB, Accession NP_001801.1) is another GAM63 target gene, herein designated TARGET GENE. CENPB BINDING SITE is a target binding site found in the 3' untranslated region of mRNA encoded by CENPB, corresponding to a target binding site such as BINDING SITE I, BINDING SITE II or BINDING SITE III of FIG. 8. Table 4 illustrates the complementarity of the nucleotide sequences of CENPB BINDING SITE, designated SEQ ID:16636, to the nucleotide sequence of GAM63 RNA, herein designated GAM RNA, also designated SEQ ID:348.

Another function of GAM63 is therefore inhibition of Centromere protein b, 80 kda (CENPB, Accession NP_001801.1), a gene which is the major centromere antigen . Accordingly, utilities of GAM63 include diagnosis, prevention and treatment of diseases and clinical conditions associated with CENPB.

The function of CENPB has been established by previous studies. The structure and function of the centromere regions of mitotic chromosomes have been of interest to cell biologists, geneticists and rheumatologists. Cell biologists focus on the centromere as both the site of sister chromatid pairing and the site of mitotic spindle attachment. The latter site, the kinetochore, is a trilaminar plaque structure embedded in the chromatin at the surface of the chromosome, as visualized by electron microscopy. Geneticists have been interested in centromeric sequences involved in the control of chromosomal segregation. Rheumatologists became interested in centromere structure when it was observed that centromere compounds are the target of autoimmune responses. Earnshaw et al. (1987) isolated a series of overlapping DNA clones for about 95% of the mRNA that encodes the B centromeric protein. Anticentromere antibodies recognize 3 antigens: CENPA (17 kD; 117139), CENPB (80 kD), and CENPC (140 kD; 117141). CENPB is considered the major centromere antigen since antibody to it is consistently present at high titer in serum positive for anticentromere antibodies. The B protein is the product of a 2.9-kb mRNA that is encoded by a single locus. By optimizing the primer-annealing temperature in a rapid air cycling procedure, Sugimoto et al. (1993) specifically amplified human DNA sequences encoding CENPB and CENPC, without any detectable amplification of highly homologous rodent DNA sequences. Using a panel of rodent/human hybrid DNAs, the human CENPB and CENPC genes were mapped to chromosomes 20 and 12, respectively. By fluorescence in situ hybridization, Seki et al. (1994) assigned the CENPB gene to 20p13.

Full details of the abovementioned studies are described in the following publications, the disclosure of which are hereby incorporated by reference:

Earnshaw, W. C.; Sullivan, K. F.; Machlin, P. S.; Cooke, C. A.; Kaiser, D. A.; Pollard, T. D.; Rothfield, N. F.; Cleveland, D. W.: Molecular cloning of cDNA for CENP- B, the major human centromere autoantigen. J. Cell Biol. 104:817-829, 1987; and Seki, N.; Saito, T.; Kitagawa, K.; Masumoto, H.; Okazaki, T.; Hori, T.-A.: Mapping of the human centromere protein B gene (CENPB) to chromosome 20p13 by fluorescence in situ hybridizat.

Further studies establishing the function and utilities of CENPB are found in John Hopkins OMIM database record ID 117140, and in cited publications listed in Table 5, which are hereby incorporated by reference. Chromosome condensation 1 (CHC1, Accession NP_001260.1) is another GAM63 target gene, herein designated TARGET GENE. CHC1 BINDING SITE is a target binding site found in the 5' untranslated region of mRNA encoded by CHC1, corresponding to a target binding site such as BINDING SITE I, BINDING SITE II or BINDING SITE III of FIG. 8. Table 4 illustrates the complementarity of the nucleotide sequences of CHC1 BINDING SITE, designated SEQ ID:16629, to the nucleotide sequence of GAM63 RNA, herein designated GAM RNA, also designated SEQ ID:348.

Another function of GAM63 is therefore inhibition of Chromosome condensation 1 (CHC1, Accession NP_001260.1), a gene which is a regulator of chromosome condensation 1 and therefore may be associated with Crest syndrome. Accordingly, utilities of GAM63 include diagnosis, prevention and treatment of Crest syndrome, and of other diseases and clinical conditions associated with CHC1.

The function of CHC1 has been established by previous studies. Bischoff et al. (1990) demonstrated that RCC1 protein is homologous to a 47- kD nuclear protein recognized by antikinetochore autoimmune sera from patients with CREST syndrome (OMIM Ref. No. 181750). By hybridization to DNA from sorted chromosomes, Ohtsubo et al. (1987) concluded that the gene, which they symbolized RCC1, is located on chromosome 1. By fluorescence in situ hybridization (FISH) using a suppression FISH method for elimination of repetitive sequences in the genomic clone, Nishimoto et al. (1994) mapped the CHC1 gene to 1p36.1. They reported work of others indicating that the mouse counterpart maps to the distal region of chromosome 4.

Full details of the abovementioned studies are described in the following publications, the disclosure of which are hereby incorporated by reference:

Bischoff, F. R.; Maier, G.; Tilz, G.; Ponstingl, H.: A 47-kDa human nuclear protein recognized by antikinetochore autoimmune sera is homologous with the protein encoded by RCC1, a gene implicated in onset of chromosome condensation. Proc. Nat. Acad. Sci. 87:8617-8621, 1990; and Nemergut, M. E.; Mizzen, C. A.; Stukenberg, T.; Allis, C. D.; Macara, I. G.: Chromatin docking and exchange activity enhancement of RCC1 by histones H2A and H2B. Science 292:1540-1543.

Further studies establishing the function and utilities of CHC1 are found in John Hopkins OMIM database record ID 179710, and in cited publications listed in Table 5, which are hereby incorporated by reference. Chromodomain helicase dna binding protein 4 (CHD4, Accession NP_001264.1) is another GAM63 target gene, herein designated TARGET GENE. CHD4 BINDING SITE is a target binding site found in the 3' untranslated region of mRNA encoded by CHD4, corresponding to a target binding site such as BINDING SITE I, BINDING SITE II or BINDING SITE III of FIG. 8. Table 4 illustrates the complementarity of the nucleotide sequences of CHD4 BINDING SITE, designated SEQ ID:6002, to the nucleotide sequence of GAM63 RNA, herein designated GAM RNA, also designated SEQ ID:348.

Another function of GAM63 is therefore inhibition of Chromodomain helicase dna binding protein 4 (CHD4, Accession NP_001264.1), a gene which may regulate gene expression and chromatin structure and therefore may be associated with Dermatomyositis. Accordingly, utilities of GAM63 include diagnosis, prevention and treatment of Dermatomyositis, and of other diseases and clinical conditions associated with CHD4.

The function of CHD4 has been established by previous studies. Approximately 20% of patients with dermatomyositis develop antibodies against nuclear antigens that are termed Mi2. Sera containing anti-Mi2 antibodies precipitate several proteins, with 1 of the most abundant migrating as a 220- to 260-kD polypeptide on SDS-polyacrylamide gels. By immunoscreening a HeLa cell cDNA expression library with sera from a patient with dermatomyositis, Seelig et al. (1995) isolated a full-length cDNA encoding CHD4, which they called Mi2-beta. Northern blot analysis of Hep-2 cell RNA detected an approximately 6.8-kb Mi2-beta transcript. The deduced 1,912-amino acid protein has a calculated molecular mass of 218 kD. Native Mi2-beta from Hep- 2 cells has a molecular mass of 235 kD by SDS-PAGE. Searches of sequence databases indicated that Mi2-beta belongs to the SNF2/RAD54 family of nuclear helicases. The central portion of Mi2-beta contains the 7 motifs, including a DEAD/H box, that are characteristic of helicases. Mi2-beta also contains a putative chromatin-binding region and multiple potential nuclear targeting signals, N-glycosylation sites, N-myristoylation sites, and phosphorylation sites. Immunofluorescence studies localized the Mi2-beta protein to the nucleus. The authors concluded that Mi2-beta is a major antigen recognized by anti-Mi2 sera from patients with dermatomyositis. Studies with sera from dermatomyositis, systemic lupus erythematosus (OMIM Ref. No. 152700), and rheumatoid arthritis (OMIM Ref. No. 180300) patients showed that anti-Mi2-beta antibodies are predominantly found in dermatomyositis patients. Zhang et al. (1998) reported the isolation of a protein complex that contains both histone deacetylation and ATP-dependent nucleosome remodeling activities. The complex contained the histone deacetylases HDAC1/2, histone-binding proteins, the dermatomyositis-specific autoantigen Mi2-beta, a polypeptide related to the metastasis-associated protein-1, and a novel polypeptide of 32 kD. Patients with dermatomyositis have a high rate of malignancy. The finding that Mi2-beta exists in a complex containing histone deacetylase and nucleosome remodeling activities suggests a role for chromatin reorganization in cancer metastasis.

Full details of the abovementioned studies are described in the following publications, the disclosure of which are hereby incorporated by reference:

Seelig, H. P.; Moosbrugger, I.; Ehrfeld, H.; Fink, T.; Renz, M.; Genth, E.: The major dermatomyositis-specific Mi-2 autoantigen is a presumed helicase involved in transcriptional activation. Arthritis Rheum. 38:1389-1399, 1995; and Zhang, Y.; LeRoy, G.; Seelig, H.-P.; Lane, W. S.; Reinberg, D.: The dermatomyositis- specific autoantigen Mi2 is a component of a complex containing histone deacetylase and nucleosome re.

Further studies establishing the function and utilities of CHD4 are found in John Hopkins OMIM database record ID 603277, and in cited publications listed in Table 5, which are hereby incorporated by reference. Cholinergic receptor, nicotinic, beta polypeptide 2 (neuronal) (CHRNB2, Accession NP_000739.1) is another GAM63 target gene, herein designated TARGET GENE. CHRNB2 BINDING SITE is a target binding site found in the 3' untranslated region of mRNA encoded by CHRNB2, corresponding to a target binding site such as BINDING SITE I, BINDING SITE II or BINDING SITE III of FIG. 8. Table 4 illustrates the complementarity of the nucleotide sequences of CHRNB2 BINDING SITE, designated SEQ ID:14758, to the nucleotide sequence of GAM63 RNA, herein designated GAM RNA, also designated SEQ ID:348.

Another function of GAM63 is therefore inhibition of Cholinergic receptor, nicotinic, beta polypeptide 2 (neuronal) (CHRNB2, Accession NP_000739.1), a gene which mediates fast signal transmission at synapses. and therefore is associated with Epilepsy, nocturnal frontal lobe, type 3. Accordingly, utilities of GAM63 include diagnosis, prevention and treatment of Epilepsy, nocturnal frontal lobe, type 3, and of other diseases and clinical conditions associated with CHRNB2.

The function of CHRNB2 has been established by previous studies. The nicotinic acetylcholine receptors (OMIM Ref. No. nAChRs) are members of a superfamily of ligand-gated ion channels that mediate fast signal transmission at synapses. The nAChRs are thought to be (OMIM Ref. No. hetero)pentamers composed of homologous subunits. See 118508 for additional background information on nAChRs. In affected members of a Scottish family with type 3 nocturnal frontal lobe epilepsy (OMIM Ref. No. 605375), Phillips et al. (2001) identified a G- to - A transition at nucleotide 1025 in the CHRNB2 gene, resulting in a val287 - to - met (V287M) substitution within the M2 domain. Codon 287 was also involved in the family reported by De Fusco et al. (2000); see 118507.0001. The mutation is located in an evolutionarily conserved region of the gene. Functional receptors with the V287M mutation were highly expressed in Xenopus oocytes and characterized by an approximately 10-fold increase in acetylcholine sensitivity.

Animal model experiments lend further support to the function of CHRNB2. Picciotto et al. (1995) disrupted the CHRNB2 mouse homolog in embryonic stem (ES) cells to generate 'knockout' mice deficient in this subunit. Homozygous mice were viable, mated normally, and showed no obvious physical deficits. However, their brains showed absence of high-affinity binding sites for nicotine, and electrophysiologic recordings from brain slices showed that thalamic neurons did not respond to nicotine application. Furthermore, behavioral tests demonstrated that nicotine no longer augmented the performance of the deficient mice on passive avoidance, a test of associative memory. Paradoxically, mutant mice were able to perform better than their nonmutant sibs on this task.

It is appreciated that the abovementioned animal model for CHRNB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Phillips, H. A.; Favre, I.; Kirkpatrick, M.; Zuberi, S. M.; Goudie, D.; Heron, S. E.; Scheffer, I. E.; Sutherland, G. R.; Berkovic, S. F.; Bertrand, D.; Mulley, J. C. : CHRNB2 is the second acetylcholine receptor subunit associated with autosomal dominant nocturnal frontal lobe epilepsy. Am. J. Hum. Genet. 68:225-231, 2001; and De Fusco, M.; Becchetti, A.; Patrignani, A.; Annesi, G.; Gambardella, A.; Quattrone, A.; Ballabio, A.; Wanke, E.; Casari, G.: The nicotinic receptor beta-2 subunit is mutant in nocturn.

Further studies establishing the function and utilities of CHRNB2 are found in John Hopkins OMIM database record ID 118507, and in cited publications listed in Table 5, which are hereby incorporated by reference. Carbohydrate (keratan sulfate gal-6) sulfotransferase 1 (CHST1, Accession NP_003645.1) is another GAM63 target gene, herein designated TARGET GENE. CHST1 BINDING SITE is a target binding site found in the 3' untranslated region of mRNA encoded by CHST1, corresponding to a target binding site such as BINDING SITE I, BINDING SITE II or BINDING SITE III of FIG. 8. Table 4 illustrates the complementarity of the nucleotide sequences of CHST1 BINDING SITE, designated SEQ ID:19217, to the nucleotide sequence of GAM63 RNA, herein designated GAM RNA, also designated SEQ ID:348.

Another function of GAM63 is therefore inhibition of Carbohydrate (keratan sulfate gal-6) sulfotransferase 1 (CHST1, Accession NP_003645.1), a gene which may play a role in keratan sulfate biosynthesis in brain and cornea. Accordingly, utilities of GAM63 include diagnosis, prevention and treatment of diseases and clinical conditions associated with CHST1.

The function of CHST1 has been established by previous studies. The keratan sulfate proteoglycans lumican and keratocan are the major proteoglycans in the cornea and are thought to play an important role in corneal transparency. Sulfation appears to be important for the biologic function of keratan sulfate, because undersulfated keratan sulfate is synthesized in patients with macular corneal dystrophy (see OMIM Ref. No. 217800). Keratan sulfate bears sulfate groups on both N-acetylglucosamine (OMIM Ref. No. GlcNAc) and galactose residues. Fukuta et al. (1997) stated that C6ST (chondroitin 6-sulfotransferase; 603799) catalyzes sulfation of chondroitin and keratan sulfate. However, in developing cornea, keratan sulfate is actively synthesized while chondroitin 6-sulfate synthesis is minimal, suggesting that a different sulfotransferase is present in cornea with specificity towards keratan sulfate. By screening a human fetal brain library with a chick C6ST cDNA, Fukuta et al. (1997) isolated cDNAs encoding C6ST and keratan sulfate gal-6-sulfotransferase (KSGal6ST). Northern blot analysis revealed that the 2.8-kb KSGal6ST mRNA was expressed in human brain and in chick brain and cornea. A slightly larger and less abundant transcript was observed in human skeletal muscle. The predicted 411-amino acid KSGal6ST shares 37% sequence identity with chick C6ST. When the KSGal6ST cDNA was expressed in COS-7 cells, keratan sulfate sulfotransferase activity increased, but C6ST activity did not. In vitro, the partially purified KSGal6ST protein showed substrate specificity towards keratan sulfate; KSGal6ST could not utilize chondroitin as an acceptor. Fukuta et al. (1997) concluded that KSGal6ST may participate in the biosynthesis of keratan sulfate in the brain and cornea. Independently, Mazany et al. (1998) cloned genomic DNA and cDNAs corresponding to CHST1, which they called C6ST. These authors found that stable expression of the CHST1 cDNA in CHO cells increased both C6ST and keratan sulfate sulfotransferase activities. Mazany et al. (1998) suggested that the distinct pattern of CHST1 enzyme activity observed by Fukuta et al. (1997) may be due to differences between the mammalian cell lines used by the 2 groups to express the enzyme.

Full details of the abovementioned studies are described in the following publications, the disclosure of which are hereby incorporated by reference:

Iida, A.; Saito, S.; Sekine, A.; Mishima, C.; Kitamura, Y.; Kondo, K.; Harigae, S.; Osawa, S.; Nakamura, Y.: Catalog of 77 single-nucleotide polymorphisms (SNPs) in the carbohydrate sulfotransferase 1 (CHST1) and carbohydrate sulfotransferase 3 (CHST3) genes. J. Hum. Genet. 47:14-19, 2002; and Mazany, K. D.; Peng, T.; Watson, C. E.; Tabas, I.; Williams, K. J.: Human chondroitin 6-sulfotransferase: cloning, gene structure, and chromosomal localization. Biochim. Biophys. Acta.

Further studies establishing the function and utilities of CHST1 are found in John Hopkins OMIM database record ID 603797, and in cited publications listed in Table 5, which are hereby incorporated by reference. Chemokine-like factor super family 3 (CKLFSF3, Accession NP_653202.1) is another GAM63 target gene, herein designated TARGET GENE. CKLFSF3 BINDING SITE is a target binding site found in the 3' untranslated region of mRNA encoded by CKLFSF3, corresponding to a target binding site such as BINDING SITE I, BINDING SITE II or BINDING SITE III of FIG. 8. Table 4 illustrates the complementarity of the nucleotide sequences of CKLFSF3 BINDING SITE, designated SEQ ID:19997, to the nucleotide sequence of GAM63 RNA, herein designated GAM RNA, also designated SEQ ID:348.

Another function of GAM63 is therefore inhibition of Chemokine-like factor super family 3 (CKLFSF3, Accession NP_653202.1). Accordingly, utilities of GAM63 include diagnosis, prevention and treatment of diseases and clinical conditions associated with CKLFSF3.

Chemokine-like factor super family 5 (CKLFSF5, Accession NP_612469.1) is another GAM63 target gene, herein designated TARGET GENE. CKLFSF5 BINDING SITE is a target binding site found in the 5' untranslated region of mRNA encoded by CKLFSF5, corresponding to a target binding site such as BINDING SITE I, BINDING SITE II or BINDING SITE III of FIG. 8. Table 4 illustrates the complementarity of the nucleotide sequences of CKLFSF5 BINDING SITE, designated SEQ ID:10840, to the nucleotide sequence of GAM63 RNA, herein designated GAM RNA, also designated SEQ ID:348.

Another function of GAM63 is therefore inhibition of Chemokine-like factor super family 5 (CKLFSF5, Accession NP_612469.1). Accordingly, utilities of GAM63 include diagnosis, prevention and treatment of diseases and clinical conditions associated with CKLFSF5.

Creatine kinase, mitochondrial 1 (ubiquitous) (CKMT1, Accession NP_066270.1) is another GAM63 target gene, herein designated TARGET GENE. CKMT1 BINDING SITE is a target binding site found in the 3' untranslated region of mRNA encoded by CKMT1, corresponding to a target binding site such as BINDING SITE I, BINDING SITE II or BINDING SITE III of FIG. 8. Table 4 illustrates the complementarity of the nucleotide sequences of CKMT1 BINDING SITE, designated SEQ ID:12177, to the nucleotide sequence of GAM63 RNA, herein designated GAM RNA, also designated SEQ ID:348.

Another function of GAM63 is therefore inhibition of Creatine kinase, mitochondrial 1 (ubiquitous) (CKMT1, Accession NP_066270.1), a gene which play a central role in energy transduction in tissues with large, fluctuating energy demands. Accordingly, utilities of GAM63 include diagnosis, prevention and treatment of diseases and clinical conditions associated with CKMT1.

The function of CKMT1 has been established by previous studies. The expression of the 3 cytoplasmic (BB-CK, MB-CK, and MM-CK) and 2 mitochondrial (ubiquitous and sarcomeric) isoforms of creatine kinase (EC 2.7.3.2) is tissue specific and developmentally regulated. At least 4 functionally active genes, which encode the distinct CK subunits CKB (OMIM Ref. No. 123280), CKM (OMIM Ref. No. 123310), CKMT1, and CKMT2 (OMIM Ref. No. 123295), and a number of CKB pseudogenes have been identified. Bark (1980) observed appearance of mitochondrial creatine kinase in the serum of patients with profound shock, which in most of the patients was fatal.

Full details of the abovementioned studies are described in the following publications, the disclosure of which are hereby incorporated by reference:

Bark, C. J.: Mitochondrial creatine kinase: a poor prognostic sign. J. A. M. A. 243:2058-2060, 1980; and Stallings, R. L.; Olson, E.; Strauss, A. W.; Thompson, L. H.; Bachinski, L. L.; Siciliano, M. J.: Human creatine kinase genes on chromosomes 15 and 19, and proximity of the gene for th.

Further studies establishing the function and utilities of CKMT1 are found in John Hopkins OMIM database record ID 123290, and in cited publications listed in Table 5, which are hereby incorporated by reference. Chloride channel 6 (CLCN6, Accession NP_068505.1) is another GAM63 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:1912, to the nucleotide sequence of GAM63 RNA, herein designated GAM RNA, also designated SEQ ID:348.

Another function of GAM63 is therefore inhibition of Chloride channel 6 (CLCN6, Accession NP_068505.1), a gene which is a voltage- gated chloride channel. Accordingly, utilities of GAM63 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_068504.1) is another GAM63 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:1912, to the nucleotide sequence of GAM63 RNA, herein designated GAM RNA, also designated SEQ ID:348.

Another function of GAM63 is therefore inhibition of Chloride channel 6 (CLCN6, Accession NP_068504.1), a gene which is a voltage-gated chloride channel. Accordingly, utilities of GAM63 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_068503.1) is another GAM63 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:1912, to the nucleotide sequence of GAM63 RNA, herein designated GAM RNA, also designated SEQ ID:348.

Another function of GAM63 is therefore inhibition of Chloride channel 6 (CLCN6, Accession NP_068503.1), a gene which is a voltage-gated chloride channel. Accordingly, utilities of GAM63 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_001277.1) is another GAM63 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:1912, to the nucleotide sequence of GAM63 RNA, herein designated GAM RNA, also designated SEQ ID:348.

Another function of GAM63 is therefore inhibition of Chloride channel 6 (CLCN6, Accession NP_001277.1), a gene which is a voltage-gated chloride channel. Accordingly, utilities of GAM63 include diagnosis, prevention and treatment of diseases and clinical conditions associated with CLCN6.

The function of CLCN6 and its association with various diseases and clinical conditions, has been established by previous studies, as described hereinabove with reference to GAM40.1. Claudin 15 (CLDN15, Accession NP_055158.1) is another GAM63 target gene, herein designated TARGET GENE. CLDN15 BINDING SITE is a target binding site found in the 3' untranslated region of multiple transcripts of mRNA encoded by CLDN15, corresponding to a target binding site such as BINDING SITE I, BINDING SITE II or BINDING SITE III of FIG. 8. Table 4 illustrates the complementarity of the nucleotide sequences of CLDN15 BINDING SITE, designated SEQ ID:13079, to the nucleotide sequence of GAM63 RNA, herein designated GAM RNA, also designated SEQ ID:348.

Another function of GAM63 is therefore inhibition of Claudin 15 (CLDN15, Accession NP_055158.1). Accordingly, utilities of GAM63 include diagnosis, prevention and treatment of diseases and clinical conditions associated with CLDN15.

CLL-1 (Accession NP_612210.1) is another GAM63 target gene, herein designated TARGET GENE. CLL-1 BINDING SITE is a target binding site found in the 3' untranslated region of mRNA encoded by CLL-1, corresponding to a target binding site such as BINDING SITE I, BINDING SITE II or BINDING SITE III of FIG. 8. Table 4 illustrates the complementarity of the nucleotide sequences of CLL-1 BINDING SITE, designated SEQ ID:1380, to the nucleotide sequence of GAM63 RNA, herein designated GAM RNA, also designated SEQ ID:348.

Another function of GAM63 is therefore inhibition of CLL-1 (Accession NP_612210.1). Accordingly, utilities of GAM63 include diagnosis, prevention and treatment of diseases and clinical conditions associated with CLL-1.

Collagen, type i, alpha 2 (COL1A2, Accession NP_000080.1) is another GAM63 target gene, herein designated TARGET GENE. COL1A2 BINDING SITE is a target binding site found in the 3' untranslated region of mRNA encoded by COL1A2, corresponding to a target binding site such as BINDING SITE I, BINDING SITE II or BINDING SITE III of FIG. 8. Table 4 illustrates the complementarity of the nucleotide sequences of COL1A2 BINDING SITE, designated SEQ ID:5175, to the nucleotide sequence of GAM63 RNA, herein designated GAM RNA, also designated SEQ ID:348.

Another function of GAM63 is therefore inhibition of Collagen, type i, alpha 2 (COL1A2, Accession NP_000080.1). Accordingly, utilities of GAM63 include diagnosis, prevention and treatment of diseases and clinical conditions associated with COL1A2.

Collagen, type ix, alpha 2 (COL9A2, Accession NP_001843.1) is another GAM63 target gene, herein designated TARGET GENE. COL9A2 BINDING SITE is a target binding site found in the 3' untranslated region of mRNA encoded by COL9A2, corresponding to a target binding site such as BINDING SITE I, BINDING SITE II or BINDING SITE III of FIG. 8. Table 4 illustrates the complementarity of the nucleotide sequences of COL9A2 BINDING SITE, designated SEQ ID:13362, to the nucleotide sequence of GAM63 RNA, herein designated GAM RNA, also designated SEQ ID:348.

Another function of GAM63 is therefore inhibition of Collagen, type ix, alpha 2 (COL9A2, Accession NP_001843.1). Accordingly, utilities of GAM63 include diagnosis, prevention and treatment of diseases and clinical conditions associated with COL9A2.

Carboxypeptidase a5 (CPA5, Accession NP_525124.2) is another GAM63 target gene, herein designated TARGET GENE. CPA5 BINDING SITE is a target binding site found in the 3' untranslated region of mRNA encoded by CPA5, corresponding to a target binding site such as BINDING SITE I, BINDING SITE II or BINDING SITE III of FIG. 8. Table 4 illustrates the complementarity of the nucleotide sequences of CPA5 BINDING SITE, designated SEQ ID:5792, to the nucleotide sequence of GAM63 RNA, herein designated GAM RNA, also designated SEQ ID:348.

Another function of GAM63 is therefore inhibition of Carboxypeptidase a5 (CPA5, Accession NP_525124.2). Accordingly, utilities of GAM63 include diagnosis, prevention and treatment of diseases and clinical conditions associated with CPA5.

cPLA2delta (Accession NP_828848.1) is another GAM63 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:10856, to the nucleotide sequence of GAM63 RNA, herein designated GAM RNA, also designated SEQ ID:348.

Another function of GAM63 is therefore inhibition of cPLA2delta (Accession NP_828848.1). Accordingly, utilities of GAM63 include diagnosis, prevention and treatment of diseases and clinical conditions associated with cPLA2delta.

cPLA2delta (Accession XP_208820.2) is another GAM63 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:10856, to the nucleotide sequence of GAM63 RNA, herein designated GAM RNA, also designated SEQ ID:348.

Another function of GAM63 is therefore inhibition of cPLA2delta (Accession XP_208820.2). Accordingly, utilities of GAM63 include diagnosis, prevention and treatment of diseases and clinical conditions associated with cPLA2delta.

Complexin 2 (CPLX2, Accession NP_006641.1) is another GAM63 target gene, herein designated TARGET GENE. CPLX2 BINDING SITE is a target binding site found in the 5' untranslated region of mRNA encoded by CPLX2, corresponding to a target binding site such as BINDING SITE I, BINDING SITE II or BINDING SITE III of FIG. 8. Table 4 illustrates the complementarity of the nucleotide sequences of CPLX2 BINDING SITE, designated SEQ ID:6535, to the nucleotide sequence of GAM63 RNA, herein designated GAM RNA, also designated SEQ ID:348.

Another function of GAM63 is therefore inhibition of Complexin 2 (CPLX2, Accession NP_006641.1), a gene which functions in synaptic vesicle exocytosis. Accordingly, utilities of GAM63 include diagnosis, prevention and treatment of diseases and clinical conditions associated with CPLX2.

The function of CPLX2 has been established by previous studies. Reim et al. (2001) created deletion mutations in the murine Cplx1 and Cplx2 genes and homozygous single and double mutants with their respective controls. They found that mice lacking Cplx2 showed no obvious phenotypic changes. In contrast, homozygous Cplx1 deletion mutants developed a strong ataxia, suffered from sporadic seizures, were unable to reproduce, and died within 2 to 4 months after birth. Although loss of Cplx1 was ultimately fatal, the fact that mice lacking either Cplx1 or Cplx2 lived for at least 2 months after birth indicated that Cplx1 and Cplx2 are partially redundant. They therefore generated double mutants lacking both Cplx isoforms. Homozygous Cplx1/2 double mutants died within a few hours after birth. In order to detect possible developmental changes or alterations in brain structure due to Cplx deletion mutations, they analyzed morphologic characteristics of brains from homozygous adult Cplx1 and Cplx2 single mutants as well as newborn Cplx1/2 double mutants. They demonstrated that complexins are important regulators of transmitter release at a step immediately preceding vesicle fusion. Neurons lacking complexins showed a dramatically reduced transmitter release efficiency due to decreased calcium sensitivity of the synaptic secretion process. Analyses of mutant neurons demonstrated that complexins are acting at or following the calcium-triggering step of fast synchronous transmitter release by regulating the exocytotic calcium sensor, its interaction with the core complex fusion machinery, or the efficiency of the fusion apparatus itself Complexins, also called synaphins, are cytosolic proteins that preferentially bind to syntaxin within the SNARE complex. Studying squid and rat synaphin, Tokumaru et al. (2001) found that synaphin promotes SNAREs to form pre-complexes that oligomerize into higher-order structures. A peptide from the central, syntaxin-binding domain of synaphin competitively inhibited these 2 proteins from interacting and prevented SNARE complexes from oligomerizing. Injection of this peptide into squid giant presynaptic terminals inhibited neurotransmitter release at a late prefusion step of synaptic vesicle exocytosis. The authors proposed that oligomerization of SNARE complexes into a higher-order structure creates a SNARE scaffold for efficient, regulated fusion of synaptic vesicles.

Full details of the abovementioned studies are described in the following publications, the disclosure of which are hereby incorporated by reference:

Reim, K.; Mansour, M.; Varoqueaux, F.; McMahon, H. T.; Sudhof, T. C.; Brose, N.; Rosenmund, C.: Complexins regulate a late step in Ca(2+)-dependent neurotransmitter release. Cell 104:71-81, 2001; and Tokumaru, H.; Umayahara, K.; Pellegrini, L. L.; Ishizuka, T.; Saisu, H.; Betz, H.; Augustine, G. J.; Abe, T.: SNARE complex oligomerization by synaphin/complexin is essential for synap.

Further studies establishing the function and utilities of CPLX2 are found in John Hopkins OMIM database record ID 605033, and in cited publications listed in Table 5, which are hereby incorporated by reference. Cullin 3 (CUL3, Accession NP_003581.1) is another GAM63 target gene, herein designated TARGET GENE. CUL3 BINDING SITE is a target binding site found in the 3' untranslated region of mRNA encoded by CUL3, corresponding to a target binding site such as BINDING SITE I, BINDING SITE II or BINDING SITE III of FIG. 8. Table 4 illustrates the complementarity of the nucleotide sequences of CUL3 BINDING SITE, designated SEQ ID:7916, to the nucleotide sequence of GAM63 RNA, herein designated GAM RNA, also designated SEQ ID:348.

Another function of GAM63 is therefore inhibition of Cullin 3 (CUL3, Accession NP_003581.1), a gene which may target other proteins for ubiquitin-dependent proteolysis. Accordingly, utilities of GAM63 include diagnosis, prevention and treatment of diseases and clinical conditions associated with CUL3.

The function of CUL3 and its association with various diseases and clinical conditions, has been established by previous studies, as described hereinabove with reference to GAM32.1. Chemokine (c-x-c motif) ligand 12 (stromal cell-derived factor 1) (CXCL12, Accession NP_000600.1) is another GAM63 target gene, herein designated TARGET GENE. CXCL12 BINDING SITE is a target binding site found in the 3' untranslated region of mRNA encoded by CXCL12, corresponding to a target binding site such as BINDING SITE I, BINDING SITE II or BINDING SITE III of FIG. 8. Table 4 illustrates the complementarity of the nucleotide sequences of CXCL12 BINDING SITE, designated SEQ ID:785, to the nucleotide sequence of GAM63 RNA, herein designated GAM RNA, also designated SEQ ID:348.

Another function of GAM63 is therefore inhibition of Chemokine (c-x-c motif) ligand 12 (stromal cell-derived factor 1) (CXCL12, Accession NP_000600.1). Accordingly, utilities of GAM63 include diagnosis, prevention and treatment of diseases and clinical conditions associated with CXCL12.

Cytochrome p450, subfamily xxviib (25-hydroxyvitamin d-1-alpha-hydroxylase), polypeptide 1 (CYP27B1, Accession NP_000776.1) is another GAM63 target gene, herein designated TARGET GENE. CYP27B1 BINDING SITE is a target binding site found in the 3' untranslated region of mRNA encoded by CYP27B1, corresponding to a target binding site such as BINDING SITE I, BINDING SITE II or BINDING SITE III of FIG. 8. Table 4 illustrates the complementarity of the nucleotide sequences of CYP27B1 BINDING SITE, designated SEQ ID:18862, to the nucleotide sequence of GAM63 RNA, herein designated GAM RNA, also designated SEQ ID:348.

Another function of GAM63 is therefore inhibition of Cytochrome p450, subfamily xxviib (25-hydroxyvitamin d-1-alpha-hydroxylase), polypeptide 1 (CYP27B1, Accession NP_000776.1). Accordingly, utilities of GAM63 include diagnosis, prevention and treatment of diseases and clinical conditions associated with CYP27B1.

D21S2056E (Accession NP_003674.1) is another GAM63 target gene, herein designated TARGET GENE. D21S2056E BINDING SITE is a target binding site found in the 3' untranslated region of mRNA encoded by D21S2056E, corresponding to a target binding site such as BINDING SITE I, BINDING SITE II or BINDING SITE III of FIG. 8. Table 4 illustrates the complementarity of the nucleotide sequences of D21S2056E BINDING SITE, designated SEQ ID:6022, to the nucleotide sequence of GAM63 RNA, herein designated GAM RNA, also designated SEQ ID:348.

Another function of GAM63 is therefore inhibition of D21S2056E (Accession NP_003674.1). Accordingly, utilities of GAM63 include diagnosis, prevention and treatment of diseases and clinical conditions associated with D21S2056E.

Dystroglycan 1 (dystrophin-associated glycoprotein 1) (DAG1, Accession NP_004384.1) is another GAM63 target gene, herein designated TARGET GENE. DAG1 BINDING SITE is a target binding site found in the 3' untranslated region of mRNA encoded by DAG1, corresponding to a target binding site such as BINDING SITE I, BINDING SITE II or BINDING SITE III of FIG. 8. Table 4 illustrates the complementarity of the nucleotide sequences of DAG1 BINDING SITE, designated SEQ ID:15198, to the nucleotide sequence of GAM63 RNA, herein designated GAM RNA, also designated SEQ ID:348.

Another function of GAM63 is therefore inhibition of Dystroglycan 1 (dystrophin-associated glycoprotein 1) (DAG1, Accession NP_004384.1), a gene which may provide linkage between the sarcolemma and extracellular matrix (ECM) and therefore may be associated with Fukuyama-type congenital muscular dystrophy. Accordingly, utilities of GAM63 include diagnosis, prevention and treatment of Fukuyama-type congenital muscular dystrophy, and of other diseases and clinical conditions associated with DAG1.

The function of DAG1 has been established by previous studies. Ibraghimov-Beskrovnaya et al. (1992) demonstrated that the transmembrane 43-kD and extracellular 156-kD dystrophin (OMIM Ref. No. 300377)-associated glycoproteins are encoded by a single messenger RNA and that the extracellular 156-kD DAG binds laminin. Thus, the 156-kD DAG is a laminin-binding glycoprotein that may provide linkage between the sarcolemma and extracellular matrix (ECM). The dramatic reduction in the 156K DAG in Duchenne muscular dystrophy (OMIM Ref. No. 310200) led to a loss of linkage between the sarcolemma and extracellular matrix, rendering muscle fibers more susceptible to necrosis. Ibraghimov-Beskrovnaya et al. (1992, 1992, 1993) mapped the DAG gene to chromosome 3 by Southern blot analysis of human/Chinese hamster somatic cell hybrid DNAs. One hybrid cell line with an isochromosome 3q was negative, suggesting location of the gene on 3p. The regional assignment was confirmed and further refined by fluorescence in situ hybridization, the localization being 3p21. The coding sequence of the DAG1 gene is organized into 2 exons, separated by a large intron (Ibraghimov-Beskrovnaya et al., 1993). The predicted amino acid sequence of human and rabbit dystroglycan are 93% identical, with predicted glycosylation sites being conserved. Human dystroglycan is expressed in a variety of fetal and adult tissues. The muscle and nonmuscle isoforms of dystroglycan differ by carbohydrate moieties but not protein sequence. Using PCR, immunohistochemistry, and immunoblotting to analyze samples from patients with Fukuyama congenital muscular dystrophy (FCMD; 253800), Hayashi et al. (2001) confirmed a deficiency of fukutin and found marked deficiency of highly glycosylated DAG1 in skeletal and cardiac muscle and reduced amounts of DAG1 in brain tissue. Beta-dystroglycan was normal in all tissues examined. These findings supported the suggestion that fukutin deficiency affects the modification of glycosylation of DAG1, which then cannot localize or function properly and may be degraded or eluted from the extracellular surface membrane of the muscle fiber. Hayashi et al. (2001) concluded that this disruption underlies the developmental, structural, and functional damage to muscles in patients with FCMD.

Animal model experiments lend further support to the function of DAG1. Cohn et al. (2002) found that striated muscle-specific disruption of the Dag1 gene in mice resulted in loss of the dystrophin-glycoprotein complex in differentiated muscle and a remarkably mild muscular dystrophy with hypertrophy and without tissue fibrosis. They found that satellite cells, expressing dystroglycan, supported continued efficient regeneration of skeletal muscle along with transient expression of dystroglycan in regenerating muscle fibers. Cohn et al. (2002) demonstrated a similar phenomenon of reexpression of functional dystroglycan in regenerating muscle fibers in a mild form of human muscular dystrophy caused by disruption of posttranslational dystroglycan processing. They concluded that maintenance of regenerative capacity by satellite cells expressing dystroglycan is likely responsible for mild disease progression in mice and possibly humans. Cohn et al. (2002) suggested that inadequate repair of skeletal muscle by satellite cells represents an important mechanism affecting the pathogenesis of muscular dystrophy.

It is appreciated that the abovementioned animal model for DAG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ibraghimov-Beskrovnay, O.; Ervasti, J. M.; Leveille, C. J.; Slaughter, C. A.; Sernett, S. W.; Campbell, K. P.: Primary structure of dystrophin-associated glycoproteins linking dystrophin to the extracellular matrix. Nature 355:696-702, 1992; and Hayashi, Y. K.; Ogawa, M.; Tagawa, K.; Noguchi, S.; Ishihara, T.; Nonaka, I.; Arahata, K.: Selective deficiency of alpha-dystroglycan in Fukuyama-type congenital muscular dystrophy. N.

Further studies establishing the function and utilities of DAG1 are found in John Hopkins OMIM database record ID 128239, and in cited publications listed in Table 5, which are hereby incorporated by reference. Daz associated protein 2 (DAZAP2, Accession NP_055579.1) is another GAM63 target gene, herein designated TARGET GENE. DAZAP2 BINDING SITE is a target binding site found in the 3' untranslated region of mRNA encoded by DAZAP2, corresponding to a target binding site such as BINDING SITE I, BINDING SITE II or BINDING SITE III of FIG. 8. Table 4 illustrates the complementarity of the nucleotide sequences of DAZAP2 BINDING SITE, designated SEQ ID:757, to the nucleotide sequence of GAM63 RNA, herein designated GAM RNA, also designated SEQ ID:348.

Another function of GAM63 is therefore inhibition of Daz associated protein 2 (DAZAP2, Accession NP_055579.1). Accordingly, utilities of GAM63 include diagnosis, prevention and treatment of diseases and clinical conditions associated with DAZAP2.

Dead/h (asp-glu-ala-asp/his) box polypeptide 11 (chl1-like helicase homolog, s. cerevisiae) (DDX11, Accession NP_085911.1) is another GAM63 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:5910, to the nucleotide sequence of GAM63 RNA, herein designated GAM RNA, also designated SEQ ID:348.

Another function of GAM63 is therefore inhibition of Dead/h (asp-glu-ala-asp/his) box polypeptide 11 (chl1-like helicase homolog, s. cerevisiae) (DDX11, Accession NP_085911.1), a gene which could be an ATP-dependent DNA-binding helicase and may intervene in cell cycle regulation. Accordingly, utilities of GAM63 include diagnosis, prevention and treatment of diseases and clinical conditions associated with DDX11.

The function of DDX11 has been established by previous studies. Helicases are essential components of a number of multiprotein complexes, including those that regulate transcription, splicing, translation, and DNA repair. These enzymes assist in the unwinding of double-stranded DNA and RNA as an essential part of their function. DEAD box proteins are putative RNA helicases that have a characteristic Asp-Glu-Ala- Asp (DEAD) box as 1 of 8 highly conserved sequence motifs. See 600396. The yeast Chl1 gene encodes a putative helicase that appears to be essential for normal chromosome transmission. Amann et al. (1996) studied 2 human genes related to the Chl1 gene of Saccharomyces cerevisiae: CHLR1 and CHLR2 (OMIM Ref. No. 601151). The open reading frames (ORFs) of these genes encode proteins with a predicted molecular weight of 102 kD, and the in vitro transcribed and translated products bind efficiently to single-stranded DNA. The predicted ORFs of these 2 genes are more than 98% identical, suggesting that they may have redundant functions. The genes were localized to 12p11 and 12p13 by analysis of somatic cell hybrids and fluorescence in situ hybridization. Fluorescence in situ hybridization indicated that the 2 CHLR gene loci are physically distinct and separated by 8 to 12 Mb. Others had reported the duplication of this region of 12p involving a human expressed sequence tag (EST) and 2 previously uncharacterized cDNAs, which Amann et al. (1996) showed were, in fact, the CHLR genes. A comparison of the CHLR gene sequences with available databases indicated that a large proportion of these genes, including exons encoding 2 functional domains of the carboxyl-terminal region, had been duplicated as part of a large human telomeric repeat sequence found on many human chromosomes. The results suggested to the authors that duplication of a relatively large region of chromosome 12p containing this putative helicase gene has resulted in the creation of numerous pseudogenes as part of a subtelomeric repeat. Amann et al. (1996) stated that the presence of these helicase pseudogenes, as well as pseudogenes for other genes such as the interleukin-9 receptor (OMIM Ref. No. 300007), within many subtelomeric regions supported the possibility that the spread of this region is subject to exchange between different chromosomes and may have implications for elucidation of the mechanism of intra- and interchromosomal duplication events. Frank and Werner (1996) used differential display PCR to identify novel cDNAs in keratinocytes whose expression is regulated by keratinocyte growth factor (KGF; 148180). One such clone, termed KRG2 by the authors, was identified, and a full-length cDNA was cloned from a KGF-stimulated keratinocyte cDNA library. Southern blot analysis suggested that KRG2 is a member of a multigene family. Northern blot analysis revealed a single 4.3-kb mRNA whose expression is upregulated by KGF. The authors used RNase protection assays to determine that serum, EGF, and cytokine IL-1-beta (OMIM Ref. No. 147720) had no effect on KRG2 expression, while inhibitors of keratinocyte proliferation, such as TGF-beta-1 (OMIM Ref. No. 190180) and TNF-alpha (OMIM Ref. No. 191160), caused a slight reduction in KRG2 expression. Sequence analysis indicated that the KRG2 cDNA encodes an 856-amino acid protein that is 32% identical to the yeast gene CHL1. Frank and Werner (1996) hypothesized that KRG2 may be involved in cell cycle regulation.

Full details of the abovementioned studies are described in the following publications, the disclosure of which are hereby incorporated by reference:

Amann, J.; Kidd, V. J.; Lahti, J. M.: Characterization of putative human homologues of the yeast chromosome transmission fidelity gene, CHL1. J. Biol. Chem. 272:3823-3832, 1997; and Frank, S.; Werner, S.: The human homologue of the yeast CHL1 gene is a novel keratinocyte growth factor-regulated gene. J. Biol. Chem. 271:24337-24340, 1996.

Further studies establishing the function and utilities of DDX11 are found in John Hopkins OMIM database record ID 601150, and in cited publications listed in Table 5, which are hereby incorporated by reference. Dead/h (asp-glu-ala-asp/his) box polypeptide 11 (chl1-like helicase homolog, s. cerevisiae) (DDX11, Accession NP_004390.2) is another GAM63 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:5910, to the nucleotide sequence of GAM63 RNA, herein designated GAM RNA, also designated SEQ ID:348.

Another function of GAM63 is therefore inhibition of Dead/h (asp-glu-ala-asp/his) box polypeptide 11 (chl1-like helicase homolog, s. cerevisiae) (DDX11, Accession NP_004390.2), a gene which could be an ATP-dependent DNA-binding helicase and may intervene in cell cycle regulation. Accordingly, utilities of GAM63 include diagnosis, prevention and treatment of diseases and clinical conditions associated with DDX11.

The function of DDX11 has been established by previous studies. Helicases are essential components of a number of multiprotein complexes, including those that regulate transcription, splicing, translation, and DNA repair. These enzymes assist in the unwinding of double-stranded DNA and RNA as an essential part of their function. DEAD box proteins are putative RNA helicases that have a characteristic Asp-Glu-Ala- Asp (DEAD) box as 1 of 8 highly conserved sequence motifs. See 600396. The yeast Chl1 gene encodes a putative helicase that appears to be essential for normal chromosome transmission. Amann et al. (1996) studied 2 human genes related to the Chl1 gene of Saccharomyces cerevisiae: CHLR1 and CHLR2 (OMIM Ref. No. 601151). The open reading frames (ORFs) of these genes encode proteins with a predicted molecular weight of 102 kD, and the in vitro transcribed and translated products bind efficiently to single-stranded DNA. The predicted ORFs of these 2 genes are more than 98% identical, suggesting that they may have redundant functions. The genes were localized to 12p11 and 12p13 by analysis of somatic cell hybrids and fluorescence in situ hybridization. Fluorescence in situ hybridization indicated that the 2 CHLR gene loci are physically distinct and separated by 8 to 12 Mb. Others had reported the duplication of this region of 12p involving a human expressed sequence tag (EST) and 2 previously uncharacterized cDNAs, which Amann et al. (1996) showed were, in fact, the CHLR genes. A comparison of the CHLR gene sequences with available databases indicated that a large proportion of these genes, including exons encoding 2 functional domains of the carboxyl-terminal region, had been duplicated as part of a large human telomeric repeat sequence found on many human chromosomes. The results suggested to the authors that duplication of a relatively large region of chromosome 12p containing this putative helicase gene has resulted in the creation of numerous pseudogenes as part of a subtelomeric repeat. Amann et al. (1996) stated that the presence of these helicase pseudogenes, as well as pseudogenes for other genes such as the interleukin-9 receptor (OMIM Ref. No. 300007), within many subtelomeric regions supported the possibility that the spread of this region is subject to exchange between different chromosomes and may have implications for elucidation of the mechanism of intra- and interchromosomal duplication events. Frank and Werner (1996) used differential display PCR to identify novel cDNAs in keratinocytes whose expression is regulated by keratinocyte growth factor (KGF; 148180). One such clone, termed KRG2 by the authors, was identified, and a full-length cDNA was cloned from a KGF-stimulated keratinocyte cDNA library. Southern blot analysis suggested that KRG2 is a member of a multigene family. Northern blot analysis revealed a single 4.3-kb mRNA whose expression is upregulated by KGF. The authors used RNase protection assays to determine that serum, EGF, and cytokine IL-1-beta (OMIM Ref. No. 147720) had no effect on KRG2 expression, while inhibitors of keratinocyte proliferation, such as TGF-beta-1 (OMIM Ref. No. 190180) and TNF-alpha (OMIM Ref. No. 191160), caused a slight reduction in KRG2 expression. Sequence analysis indicated that the KRG2 cDNA encodes an 856-amino acid protein that is 32% identical to the yeast gene CHL1. Frank and Werner (1996) hypothesized that KRG2 may be involved in cell cycle regulation.

Full details of the abovementioned studies are described in the following publications, the disclosure of which are hereby incorporated by reference:

Amann, J.; Kidd, V. J.; Lahti, J. M.: Characterization of putative human homologues of the yeast chromosome transmission fidelity gene, CHL1. J. Biol. Chem. 272:3823-3832, 1997; and Frank, S.; Werner, S.: The human homologue of the yeast CHL1 gene is a novel keratinocyte growth factor-regulated gene. J. Biol. Chem. 271:24337-24340, 1996.

Further studies establishing the function and utilities of DDX11 are found in John Hopkins OMIM database record ID 601150, and in cited publications listed in Table 5, which are hereby incorporated by reference. Dead/h (asp-glu-ala-asp/his) box polypeptide 11 (chl1-like helicase homolog, s. cerevisiae) (DDX11, Accession NP_085913.1) is another GAM63 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:5910, to the nucleotide sequence of GAM63 RNA, herein designated GAM RNA, also designated SEQ ID:348.

Another function of GAM63 is therefore inhibition of Dead/h (asp-glu-ala-asp/his) box polypeptide 11 (chl1-like helicase homolog, s. cerevisiae) (DDX11, Accession NP_085913.1), a gene which could be an ATP-dependent DNA-binding helicase and may intervene in cell cycle regulation. Accordingly, utilities of GAM63 include diagnosis, prevention and treatment of diseases and clinical conditions associated with DDX11.

The function of DDX11 has been established by previous studies. Helicases are essential components of a number of multiprotein complexes, including those that regulate transcription, splicing, translation, and DNA repair. These enzymes assist in the unwinding of double-stranded DNA and RNA as an essential part of their function. DEAD box proteins are putative RNA helicases that have a characteristic Asp-Glu-Ala- Asp (DEAD) box as 1 of 8 highly conserved sequence motifs. See 600396. The yeast Chl1 gene encodes a putative helicase that appears to be essential for normal chromosome transmission. Amann et al. (1996) studied 2 human genes related to the Chl1 gene of Saccharomyces cerevisiae: CHLR1 and CHLR2 (OMIM Ref. No. 601151). The open reading frames (ORFs) of these genes encode proteins with a predicted molecular weight of 102 kD, and the in vitro transcribed and translated products bind efficiently to single-stranded DNA. The predicted ORFs of these 2 genes are more than 98% identical, suggesting that they may have redundant functions. The genes were localized to 12p11 and 12p13 by analysis of somatic cell hybrids and fluorescence in situ hybridization. Fluorescence in situ hybridization indicated that the 2 CHLR gene loci are physically distinct and separated by 8 to 12 Mb. Others had reported the duplication of this region of 12p involving a human expressed sequence tag (EST) and 2 previously uncharacterized cDNAs, which Amann et al. (1996) showed were, in fact, the CHLR genes. A comparison of the CHLR gene sequences with available databases indicated that a large proportion of these genes, including exons encoding 2 functional domains of the carboxyl-terminal region, had been duplicated as part of a large human telomeric repeat sequence found on many human chromosomes. The results suggested to the authors that duplication of a relatively large region of chromosome 12p containing this putative helicase gene has resulted in the creation of numerous pseudogenes as part of a subtelomeric repeat. Amann et al. (1996) stated that the presence of these helicase pseudogenes, as well as pseudogenes for other genes such as the interleukin-9 receptor (OMIM Ref. No. 300007), within many subtelomeric regions supported the possibility that the spread of this region is subject to exchange between different chromosomes and may have implications for elucidation of the mechanism of intra- and interchromosomal duplication events. Frank and Werner (1996) used differential display PCR to identify novel cDNAs in keratinocytes whose expression is regulated by keratinocyte growth factor (KGF; 148180). One such clone, termed KRG2 by the authors, was identified, and a full-length cDNA was cloned from a KGF-stimulated keratinocyte cDNA library. Southern blot analysis suggested that KRG2 is a member of a multigene family. Northern blot analysis revealed a single 4.3-kb mRNA whose expression is upregulated by KGF. The authors used RNase protection assays to determine that serum, EGF, and cytokine IL-1-beta (OMIM Ref. No. 147720) had no effect on KRG2 expression, while inhibitors of keratinocyte proliferation, such as TGF-beta-1 (OMIM Ref. No. 190180) and TNF-alpha (OMIM Ref. No. 191160), caused a slight reduction in KRG2 expression. Sequence analysis indicated that the KRG2 cDNA encodes an 856-amino acid protein that is 32% identical to the yeast gene CHL1. Frank and Werner (1996) hypothesized that KRG2 may be involved in cell cycle regulation.

Full details of the abovementioned studies are described in the following publications, the disclosure of which are hereby incorporated by reference:

Amann, J.; Kidd, V. J.; Lahti, J. M.: Characterization of putative human homologues of the yeast chromosome transmission fidelity gene, CHL1. J. Biol. Chem. 272:3823-3832, 1997; and Frank, S.; Werner, S.: The human homologue of the yeast CHL1 gene is a novel keratinocyte growth factor-regulated gene. J. Biol. Chem. 271:24337-24340, 1996.

Further studies establishing the function and utilities of DDX11 are found in John Hopkins OMIM database record ID 601150, and in cited publications listed in Table 5, which are hereby incorporated by reference. Dead/h (asp-glu-ala-asp/his) box polypeptide 34 (DDX34, Accession NP_055496.1) is another GAM63 target gene, herein designated TARGET GENE. DDX34 BINDING SITE is a target binding site found in the 3' untranslated region of mRNA encoded by DDX34, corresponding to a target binding site such as BINDING SITE I, BINDING SITE II or BINDING SITE III of FIG. 8. Table 4 illustrates the complementarity of the nucleotide sequences of DDX34 BINDING SITE, designated SEQ ID:1581, to the nucleotide sequence of GAM63 RNA, herein designated GAM RNA, also designated SEQ ID:348.

Another function of GAM63 is therefore inhibition of Dead/h (asp-glu-ala-asp/his) box polypeptide 34 (DDX34, Accession NP_055496.1). Accordingly, utilities of GAM63 include diagnosis, prevention and treatment of diseases and clinical conditions associated with DDX34.

Defensin, beta 127 (DEFB127, Accession NP_620713.1) is another GAM63 target gene, herein designated TARGET GENE. DEFB127 BINDING SITE is a target binding site found in the 3' untranslated region of mRNA encoded by DEFB127, corresponding to a target binding site such as BINDING SITE I, BINDING SITE II or BINDING SITE III of FIG. 8. Table 4 illustrates the complementarity of the nucleotide sequences of DEFB127 BINDING SITE, designated SEQ ID:11155, to the nucleotide sequence of GAM63 RNA, herein designated GAM RNA, also designated SEQ ID:348.

Another function of GAM63 is therefore inhibition of Defensin, beta 127 (DEFB127, Accession NP_620713.1). Accordingly, utilities of GAM63 include diagnosis, prevention and treatment of diseases and clinical conditions associated with DEFB127.

Digeorge syndrome critical region gene 6 (DGCR6, Accession NP_005666.2) is another GAM63 target gene, herein designated TARGET GENE. DGCR6 BINDING SITE is a target binding site found in the 3' untranslated region of mRNA encoded by DGCR6, corresponding to a target binding site such as BINDING SITE I, BINDING SITE II or BINDING SITE III of FIG. 8. Table 4 illustrates the complementarity of the nucleotide sequences of DGCR6 BINDING SITE, designated SEQ ID:4437, to the nucleotide sequence of GAM63 RNA, herein designated GAM RNA, also designated SEQ ID:348.

Another function of GAM63 is therefore inhibition of Digeorge syndrome critical region gene 6 (DGCR6, Accession NP_005666.2) . Accordingly, utilities of GAM63 include diagnosis, prevention and treatment of diseases and clinical conditions associated with DGCR6.

Digeorge syndrome critical region gene 6-like (DGCR6L, Accession NP_150282.1) is another GAM63 target gene, herein designated TARGET GENE. DGCR6L BINDING SITE is a target binding site found in the 3' untranslated region of mRNA encoded by DGCR6L, corresponding to a target binding site such as BINDING SITE I, BINDING SITE II or BINDING SITE III of FIG. 8. Table 4 illustrates the complementarity of the nucleotide sequences of DGCR6L BINDING SITE, designated SEQ ID:4437, to the nucleotide sequence of GAM63 RNA, herein designated GAM RNA, also designated SEQ ID:348.

Another function of GAM63 is therefore inhibition of Digeorge syndrome critical region gene 6-like (DGCR6L, Accession NP_150282.1). Accordingly, utilities of GAM63 include diagnosis, prevention and treatment of diseases and clinical conditions associated with DGCR6L.

DISPB (Accession NP_277045.1) is another GAM63 target gene, herein designated TARGET GENE. DISPB BINDING SITE is a target binding site found in the 3' untranslated region of mRNA encoded by DISPB, corresponding to a target binding site such as BINDING SITE I, BINDING SITE II or BINDING SITE III of FIG. 8. Table 4 illustrates the complementarity of the nucleotide sequences of DISPB BINDING SITE, designated SEQ ID:17539, to the nucleotide sequence of GAM63 RNA, herein designated GAM RNA, also designated SEQ ID:348.

Another function of GAM63 is therefore inhibition of DISPB (Accession NP_277045.1). Accordingly, utilities of GAM63 include diagnosis, prevention and treatment of diseases and clinical conditions associated with DISPB.

DKFZP434D193 (Accession XP_114297.2) is another GAM63 target gene, herein designated TARGET GENE. DKFZP434D193 BINDING SITE is a target binding site found in the 3' untranslated region of mRNA encoded by DKFZP434D193, corresponding to a target binding site such as BINDING SITE I, BINDING SITE II or BINDING SITE III of FIG. 8. Table 4 illustrates the complementarity of the nucleotide sequences of DKFZP434D193 BINDING SITE, designated SEQ ID:9123, to the nucleotide sequence of GAM63 RNA, herein designated GAM RNA, also designated SEQ ID:348.

Another function of GAM63 is therefore inhibition of DKFZP434D193 (Accession XP_114297.2). Accordingly, utilities of GAM63 include diagnosis, prevention and treatment of diseases and clinical conditions associated with DKFZP434D193.

DKFZP434F122 (Accession NP_056458.1) is another GAM63 target gene, herein designated TARGET GENE. DKFZP434F122 BINDING SITE is a target binding site found in the 3' untranslated region of mRNA encoded by DKFZP434F122, corresponding to a target binding site such as BINDING SITE I, BINDING SITE II or BINDING SITE III of FIG. 8. Table 4 illustrates the complementarity of the nucleotide sequences of DKFZP434F122 BINDING SITE, designated SEQ ID:15958, to the nucleotide sequence of GAM63 RNA, herein designated GAM RNA, also designated SEQ ID:348.

Another function of GAM63 is therefore inhibition of DKFZP434F122 (Accession NP_056458.1). Accordingly, utilities of GAM63 include diagnosis, prevention and treatment of diseases and clinical conditions associated with DKFZP434F122.

DKFZp434F142 (Accession NP_115630.1) is another GAM63 target gene, herein designated TARGET GENE. DKFZp434F142 BINDING SITE is a target binding site found in the 3' untranslated region of mRNA encoded by DKFZp434F142, corresponding to a target binding site such as BINDING SITE I, BINDING SITE II or BINDING SITE III of FIG. 8. Table 4 illustrates the complementarity of the nucleotide sequences of DKFZp434F142 BINDING SITE, designated SEQ ID:18569, to the nucleotide sequence of GAM63 RNA, herein designated GAM RNA, also designated SEQ ID:348.

Another function of GAM63 is therefore inhibition of DKFZp434F142 (Accession NP_115630.1). Accordingly, utilities of GAM63 include diagnosis, prevention and treatment of diseases and clinical conditions associated with DKFZp434F142.

DKFZp434H055 (Accession XP_064865.3) is another GAM63 target gene, herein designated TARGET GENE. DKFZp434H055 BINDING SITE is a target binding site found in the 3' untranslated region of mRNA encoded by DKFZp434H055, corresponding to a target binding site such as BINDING SITE I, BINDING SITE II or BINDING SITE III of FIG. 8. Table 4 illustrates the complementarity of the nucleotide sequences of DKFZp434H055 BINDING SITE, designated SEQ ID:15511, to the nucleotide sequence of GAM63 RNA, herein designated GAM RNA, also designated SEQ ID:348.

Another function of GAM63 is therefore inhibition of DKFZp434H055 (Accession XP_064865.3). Accordingly, utilities of GAM63 include diagnosis, prevention and treatment of diseases and clinical conditions associated with DKFZp434H055.

DKFZp434M1411 (Accession XP_088463.5) is another GAM63 target gene, herein designated TARGET GENE. DKFZp434M1411 BINDING SITE is a target binding site found in the 5' untranslated region of mRNA encoded by DKFZp434M1411, corresponding to a target binding site such as BINDING SITE I, BINDING SITE II or BINDING SITE III of FIG. 8. Table 4 illustrates the complementarity of the nucleotide sequences of DKFZp434M1411 BINDING SITE, designated SEQ ID:18924, to the nucleotide sequence of GAM63 RNA, herein designated GAM RNA, also designated SEQ ID:348.

Another function of GAM63 is therefore inhibition of DKFZp434M1411 (Accession XP_088463.5). Accordingly, utilities of GAM63 include diagnosis, prevention and treatment of diseases and clinical conditions associated with DKFZp434M1411.

DKFZP434P0111 (Accession XP_041116.1) is another GAM63 target gene, herein designated TARGET GENE. DKFZP434P0111 BINDING SITE is a target binding site found in the 3' untranslated region of mRNA encoded by DKFZP434P0111, corresponding to a target binding site such as BINDING SITE I, BINDING SITE II or BINDING SITE III of FIG. 8. Table 4 illustrates the complementarity of the nucleotide sequences of DKFZP434P0111 BINDING SITE, designated SEQ ID:12595, to the nucleotide sequence of GAM63 RNA, herein designated GAM RNA, also designated SEQ ID:348.

Another function of GAM63 is therefore inhibition of DKFZP434P0111 (Accession XP_041116.1). Accordingly, utilities of GAM63 include diagnosis, prevention and treatment of diseases and clinical conditions associated with DKFZP434P0111.

DKFZP564J0123 (Accession XP_300857.1) is another GAM63 target gene, herein designated TARGET GENE. DKFZP564J0123 BINDING SITE is a target binding site found in the 3' untranslated region of mRNA encoded by DKFZP564J0123, corresponding to a target binding site such as BINDING SITE I, BINDING SITE II or BINDING SITE III of FIG. 8. Table 4 illustrates the complementarity of the nucleotide sequences of DKFZP564J0123 BINDING SITE, designated SEQ ID:2440, to the nucleotide sequence of GAM63 RNA, herein designated GAM RNA, also designated SEQ ID:348.

Another function of GAM63 is therefore inhibition of DKFZP564J0123 (Accession XP_300857.1). Accordingly, utilities of GAM63 include diagnosis, prevention and treatment of diseases and clinical conditions associated with DKFZP564J0123.

DKFZP566K1924 (Accession NP_056278.1) is another GAM63 target gene, herein designated TARGET GENE. DKFZP566K1924 BINDING SITE is a target binding site found in the 3' untranslated region of mRNA encoded by DKFZP566K1924, corresponding to a target binding site such as BINDING SITE I, BINDING SITE II or BINDING SITE III of FIG. 8. Table 4 illustrates the complementarity of the nucleotide sequences of DKFZP566K1924 BINDING SITE, designated SEQ ID:20108, to the nucleotide sequence of GAM63 RNA, herein designated GAM RNA, also designated SEQ ID:348.

Another function of GAM63 is therefore inhibition of DKFZP566K1924 (Accession NP_056278.1). Accordingly, utilities of GAM63 include diagnosis, prevention and treatment of diseases and clinical conditions associated with DKFZP566K1924.

DKFZp667M2411 (Accession XP_290795.1) is another GAM63 target gene, herein designated TARGET GENE. DKFZp667M2411 BINDING SITE is a target binding site found in the 5' untranslated region of mRNA encoded by DKFZp667M2411, corresponding to a target binding site such as BINDING SITE I, BINDING SITE II or BINDING SITE III of FIG. 8. Table 4 illustrates the complementarity of the nucleotide sequences of DKFZp667M2411 BINDING SITE, designated SEQ ID:19396, to the nucleotide sequence of GAM63 RNA, herein designated GAM RNA, also designated SEQ ID:348.

Another function of GAM63 is therefore inhibition of DKFZp667M2411 (Accession XP_290795.1). Accordingly, utilities of GAM63 include diagnosis, prevention and treatment of diseases and clinical conditions associated with DKFZp667M2411.

DKFZp761B107 (Accession NP_775734.1) is another GAM63 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:8017, to the nucleotide sequence of GAM63 RNA, herein designated GAM RNA, also designated SEQ ID:348.

Another function of GAM63 is therefore inhibition of DKFZp761B107 (Accession NP_775734.1). Accordingly, utilities of GAM63 include diagnosis, prevention and treatment of diseases and clinical conditions associated with DKFZp761B107.

DKFZp761L1417 (Accession NP_690877.1) is another GAM63 target gene, herein designated TARGET GENE. DKFZp761L1417 BINDING SITE is a target binding site found in the 5' untranslated region of mRNA encoded by DKFZp761L1417, corresponding to a target binding site such as BINDING SITE I, BINDING SITE II or BINDING SITE III of FIG. 8. Table 4 illustrates the complementarity of the nucleotide sequences of DKFZp761L1417 BINDING SITE, designated SEQ ID:2815, to the nucleotide sequence of GAM63 RNA, herein designated GAM RNA, also designated SEQ ID:348.

Another function of GAM63 is therefore inhibition of DKFZp761L1417 (Accession NP_690877.1). Accordingly, utilities of GAM63 include diagnosis, prevention and treatment of diseases and clinical conditions associated with DKFZp761L1417.

DPCR1 (Accession NP_543146.1) is another GAM63 target gene, herein designated TARGET GENE. DPCR1 BINDING SITE is a target binding site found in the 3' untranslated region of mRNA encoded by DPCR1, corresponding to a target binding site such as BINDING SITE I, BINDING SITE II or BINDING SITE III of FIG. 8. Table 4 illustrates the complementarity of the nucleotide sequences of DPCR1 BINDING SITE, designated SEQ ID:6228, to the nucleotide sequence of GAM63 RNA, herein designated GAM RNA, also designated SEQ ID:348.

Another function of GAM63 is therefore inhibition of DPCR1 (Accession NP_543146.1). Accordingly, utilities of GAM63 include diagnosis, prevention and treatment of diseases and clinical conditions associated with DPCR1.

DPF3 (Accession NP_036206.1) is another GAM63 target gene, herein designated TARGET GENE. DPF3 BINDING SITE is a target binding site found in the 3' untranslated region of mRNA encoded by DPF3, corresponding to a target binding site such as BINDING SITE I, BINDING SITE II or BINDING SITE III of FIG. 8. Table 4 illustrates the complementarity of the nucleotide sequences of DPF3 BINDING SITE, designated SEQ ID:1393, to the nucleotide sequence of GAM63 RNA, herein designated GAM RNA, also designated SEQ ID:348.

Another function of GAM63 is therefore inhibition of DPF3 (Accession NP_036206.1). Accordingly, utilities of GAM63 include diagnosis, prevention and treatment of diseases and clinical conditions associated with DPF3.

Dishevelled, dsh homolog 3 (drosophila) (DVL3, Accession NP_004414.2) is another GAM63 target gene, herein designated TARGET GENE. DVL3 BINDING SITE is a target binding site found in the 3' untranslated region of mRNA encoded by DVL3, corresponding to a target binding site such as BINDING SITE I, BINDING SITE II or BINDING SITE III of FIG. 8. Table 4 illustrates the complementarity of the nucleotide sequences of DVL3 BINDING SITE, designated SEQ ID:19305, to the nucleotide sequence of GAM63 RNA, herein designated GAM RNA, also designated SEQ ID:348.

Another function of GAM63 is therefore inhibition of Dishevelled, dsh homolog 3 (drosophila) (DVL3, Accession NP_004414.2), a gene which regulates cell proliferation. Accordingly, utilities of GAM63 include diagnosis, prevention and treatment of diseases and clinical conditions associated with DVL3.

The function of DVL3 and its association with various diseases and clinical conditions, has been established by previous studies, as described hereinabove with reference to GAM47.1. Dual-specificity tyrosine-(y)-phosphorylation regulated kinase 1a (DYRK1A, Accession NP_567824.1) is another GAM63 target gene, herein designated TARGET GENE. DYRK1A BINDING SITE is a target binding site found in the 3' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:9660, to the nucleotide sequence of GAM63 RNA, herein designated GAM RNA, also designated SEQ ID:348.

Another function of GAM63 is therefore inhibition of Dual-specificity tyrosine-(y)-phosphorylation regulated kinase 1a (DYRK1A, Accession NP_567824.1), a gene which regulates cell proliferation and may be involved in brain development . and therefore may be associated with Down syndrome. Accordingly, utilities of GAM63 include diagnosis, prevention and treatment of Down syndrome, and of other diseases and clinical conditions associated with DYRK1A.

The function of DYRK1A has been established by previous studies. Shindoh et al. (1996) performed exon trapping to find exons within YAC clones spanning the 2-Mb 'Down syndrome critical region' (OMIM Ref. No. 190685) of human chromosome 21. Of more than 160 exons isolated, they found 6 that had significant identity at the amino acid level to the Drosophila 'minibrain' gene. Using 1 of these exons as a probe, they cloned the full-length human cDNA from a human fetal brain cDNA library. Sequence analysis of this cDNA revealed an open reading frame encoding a polypeptide of 754 amino acids. Shindoh et al. (1996) stated that this gene, termed MNB by them, represents the human homolog of the Drosophila mnb gene and of the rat Dyrk gene. The rat Dyrk gene differs from it by only 4 amino acids. Northern blot analysis of MNB revealed 2 transcripts of 6.0 and 7.5 kb. The 6.0-kb transcript was found to be present in all tissues examined, with highest levels of expression in skeletal muscle, testis, fetal lung, and fetal kidney. The 7.5-kb transcript was found to be expressed at a relatively lower level and was found only in adult heart, placenta, spleen, and testis. Shindoh et al. (1996) concluded that the human MNB protein may play a significant role in a signaling pathway regulating cell proliferation and may be involved in normal brain development and in the pathogenesis of Down syndrome.

Animal model experiments lend further support to the function of DYRK1A. Using Down syndrome as a model for complex trait analysis, Smith et al. (1997) sought to identify loci from 21q22.2 which, when present in an extra dose, contribute to learning abnormalities. They generated low-copy number transgenic mice, containing 4 different YACs that together cover approximately 2 Mb of contiguous DNA from 21q22.2. They subjected independent mouse lines derived from each of these YAC transgenes to a series of behavioral and learning assays. Two of the 4 YACs caused defects in learning and memory in the transgenic animals, while the other 2 YACs had no effect. The most severe defects were caused by a 570-kb YAC; the interval responsible for these defects was narrowed to a 180-kb critical region as a consequence of YAC fragmentation. This region was found to contain the human homolog of the Drosophila 'minibrain' gene, and strongly implicated it in learning defects associated with Down syndrome.

It is appreciated that the abovementioned animal model for DYRK1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shindoh, N.; Kudoh, J.; Maeda, H.; Yamaki, A.; Minoshima, S.; Shimizu, Y.; Shimizu, N.: Cloning of a human homolog of the Drosophila minibrain/rat Dyrk gene from 'the Down syndrome critical region' of chromosome 21. Biochem. Biophys. Res. Commun. 225:92-99, 1996; and Smith, D. J.; Stevens, M. E.; Sudanagunta, S. P.; Bronson, R. T.; Makhinson, M.; Watabe, A. M.; O'Dell, T. J.; Fung, J.; Weier, H.-U. G.; Cheng, J.-F.; Rubin, E. M.: Functional screeni.

Further studies establishing the function and utilities of DYRK1A are found in John Hopkins OMIM database record ID 600855, and in cited publications listed in Table 5, which are hereby incorporated by reference. Dual-specificity tyrosine-(y)-phosphorylation regulated kinase 1a (DYRK1A, Accession NP_569122.1) is another GAM63 target gene, herein designated TARGET GENE. DYRK1A BINDING SITE is a target binding site found in the 3' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:9660, to the nucleotide sequence of GAM63 RNA, herein designated GAM RNA, also designated SEQ ID:348.

Another function of GAM63 is therefore inhibition of Dual-specificity tyrosine-(y)-phosphorylation regulated kinase 1a (DYRK1A, Accession NP_569122.1), a gene which regulates cell proliferation and may be involved in brain development . and therefore may be associated with Down syndrome. Accordingly, utilities of GAM63 include diagnosis, prevention and treatment of Down syndrome, and of other diseases and clinical conditions associated with DYRK1A.

The function of DYRK1A has been established by previous studies. Shindoh et al. (1996) performed exon trapping to find exons within YAC clones spanning the 2-Mb 'Down syndrome critical region' (OMIM Ref. No. 190685) of human chromosome 21. Of more than 160 exons isolated, they found 6 that had significant identity at the amino acid level to the Drosophila 'minibrain' gene. Using 1 of these exons as a probe, they cloned the full-length human cDNA from a human fetal brain cDNA library. Sequence analysis of this cDNA revealed an open reading frame encoding a polypeptide of 754 amino acids. Shindoh et al. (1996) stated that this gene, termed MNB by them, represents the human homolog of the Drosophila mnb gene and of the rat Dyrk gene. The rat Dyrk gene differs from it by only 4 amino acids. Northern blot analysis of MNB revealed 2 transcripts of 6.0 and 7.5 kb. The 6.0-kb transcript was found to be present in all tissues examined, with highest levels of expression in skeletal muscle, testis, fetal lung, and fetal kidney. The 7.5-kb transcript was found to be expressed at a relatively lower level and was found only in adult heart, placenta, spleen, and testis. Shindoh et al. (1996) concluded that the human MNB protein may play a significant role in a signaling pathway regulating cell proliferation and may be involved in normal brain development and in the pathogenesis of Down syndrome.

Animal model experiments lend further support to the function of DYRK1A. Using Down syndrome as a model for complex trait analysis, Smith et al. (1997) sought to identify loci from 21q22.2 which, when present in an extra dose, contribute to learning abnormalities. They generated low-copy number transgenic mice, containing 4 different YACs that together cover approximately 2 Mb of contiguous DNA from 21q22.2. They subjected independent mouse lines derived from each of these YAC transgenes to a series of behavioral and learning assays. Two of the 4 YACs caused defects in learning and memory in the transgenic animals, while the other 2 YACs had no effect. The most severe defects were caused by a 570-kb YAC; the interval responsible for these defects was narrowed to a 180-kb critical region as a consequence of YAC fragmentation. This region was found to contain the human homolog of the Drosophila 'minibrain' gene, and strongly implicated it in learning defects associated with Down syndrome.

It is appreciated that the abovementioned animal model for DYRK1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shindoh, N.; Kudoh, J.; Maeda, H.; Yamaki, A.; Minoshima, S.; Shimizu, Y.; Shimizu, N.: Cloning of a human homolog of the Drosophila minibrain/rat Dyrk gene from 'the Down syndrome critical region' of chromosome 21. Biochem. Biophys. Res. Commun. 225:92-99, 1996; and Smith, D. J.; Stevens, M. E.; Sudanagunta, S. P.; Bronson, R. T.; Makhinson, M.; Watabe, A. M.; O'Dell, T. J.; Fung, J.; Weier, H.-U. G.; Cheng, J.-F.; Rubin, E. M.: Functional screeni.

Further studies establishing the function and utilities of DYRK1A are found in John Hopkins OMIM database record ID 600855, and in cited publications listed in Table 5, which are hereby incorporated by reference. Dual-specificity tyrosine-(y)-phosphorylation regulated kinase 1a (DYRK1A, Accession NP_569121.1) is another GAM63 target gene, herein designated TARGET GENE. DYRK1A BINDING SITE is a target binding site found in the 3' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:9660, to the nucleotide sequence of GAM63 RNA, herein designated GAM RNA, also designated SEQ ID:348.

Another function of GAM63 is therefore inhibition of Dual-specificity tyrosine-(y)-phosphorylation regulated kinase 1a (DYRK1A, Accession NP_569121.1), a gene which regulates cell proliferation and may be involved in brain development . and therefore may be associated with Down syndrome. Accordingly, utilities of GAM63 include diagnosis, prevention and treatment of Down syndrome, and of other diseases and clinical conditions associated with DYRK1A.

The function of DYRK1A has been established by previous studies. Shindoh et al. (1996) performed exon trapping to find exons within YAC clones spanning the 2-Mb 'Down syndrome critical region' (OMIM Ref. No. 190685) of human chromosome 21. Of more than 160 exons isolated, they found 6 that had significant identity at the amino acid level to the Drosophila 'minibrain' gene. Using 1 of these exons as a probe, they cloned the full-length human cDNA from a human fetal brain cDNA library. Sequence analysis of this cDNA revealed an open reading frame encoding a polypeptide of 754 amino acids. Shindoh et al. (1996) stated that this gene, termed MNB by them, represents the human homolog of the Drosophila mnb gene and of the rat Dyrk gene. The rat Dyrk gene differs from it by only 4 amino acids. Northern blot analysis of MNB revealed 2 transcripts of 6.0 and 7.5 kb. The 6.0-kb transcript was found to be present in all tissues examined, with highest levels of expression in skeletal muscle, testis, fetal lung, and fetal kidney. The 7.5-kb transcript was found to be expressed at a relatively lower level and was found only in adult heart, placenta, spleen, and testis. Shindoh et al. (1996) concluded that the human MNB protein may play a significant role in a signaling pathway regulating cell proliferation and may be involved in normal brain development and in the pathogenesis of Down syndrome.

Animal model experiments lend further support to the function of DYRK1A. Using Down syndrome as a model for complex trait analysis, Smith et al. (1997) sought to identify loci from 21q22.2 which, when present in an extra dose, contribute to learning abnormalities. They generated low-copy number transgenic mice, containing 4 different YACs that together cover approximately 2 Mb of contiguous DNA from 21q22.2. They subjected independent mouse lines derived from each of these YAC transgenes to a series of behavioral and learning assays. Two of the 4 YACs caused defects in learning and memory in the transgenic animals, while the other 2 YACs had no effect. The most severe defects were caused by a 570-kb YAC; the interval responsible for these defects was narrowed to a 180-kb critical region as a consequence of YAC fragmentation. This region was found to contain the human homolog of the Drosophila 'minibrain' gene, and strongly implicated it in learning defects associated with Down syndrome.

It is appreciated that the abovementioned animal model for DYRK1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shindoh, N.; Kudoh, J.; Maeda, H.; Yamaki, A.; Minoshima, S.; Shimizu, Y.; Shimizu, N.: Cloning of a human homolog of the Drosophila minibrain/rat Dyrk gene from 'the Down syndrome critical region' of chromosome 21. Biochem. Biophys. Res. Commun. 225:92-99, 1996; and Smith, D. J.; Stevens, M. E.; Sudanagunta, S. P.; Bronson, R. T.; Makhinson, M.; Watabe, A. M.; O'Dell, T. J.; Fung, J.; Weier, H.-U. G.; Cheng, J.-F.; Rubin, E. M.: Functional screeni.

Further studies establishing the function and utilities of DYRK1A are found in John Hopkins OMIM database record ID 600855, and in cited publications listed in Table 5, which are hereby incorporated by reference. Dual-specificity tyrosine-(y)-phosphorylation regulated kinase 1b (DYRK1B, Accession NP_004705.1) is another GAM63 target gene, herein designated TARGET GENE. DYRK1B BINDING SITE is a target binding site found in the 3' untranslated region of multiple transcripts of mRNA encoded by DYRK1B, corresponding to a target binding site such as BINDING SITE I, BINDING SITE II or BINDING SITE III of FIG. 8. Table 4 illustrates the complementarity of the nucleotide sequences of DYRK1B BINDING SITE, designated SEQ ID:3553, to the nucleotide sequence of GAM63 RNA, herein designated GAM RNA, also designated SEQ ID:348.

Another function of GAM63 is therefore inhibition of Dual-specificity tyrosine-(y)-phosphorylation regulated kinase 1b (DYRK1B, Accession NP_004705.1), a gene which is a mitogen-activated dual-specificity protein kinase substrate and therefore may be associated with Colon cancer. Accordingly, utilities of GAM63 include diagnosis, prevention and treatment of Colon cancer, and of other diseases and clinical conditions associated with DYRK1B.

The function of DYRK1B has been established by previous studies. The DYRK1A gene (OMIM Ref. No. 600855), located on human chromosome 21 and encoding a dual-specificity protein kinase, is the human homolog of the Drosophila 'minibrain' gene. The minibrain protein product, mnb, is involved in postembryonic neurogenesis. By performing RACE on human testis RNA using primers designed to the catalytic domain of DYRK1A, Leder et al. (1999) isolated a partial DYRK1B cDNA; they obtained the complete coding sequence of human DYRK1B by PCR cloning from human testis cDNA. The putative DYRK1B peptide has a domain structure similar to that of DYRK1A, with a kinase domain flanked by a 110-amino acid N-terminal domain and a 198-amino acid C-terminal domain. Human DYRK1A and DYRK1B proteins are 84% identical in the N-terminal and catalytic domains but show no extended similarity in the C-terminal region. Northern blot analysis detected a 2.4-kb DYRK1B transcript in testis and skeletal muscle. Expression of DYRK1B as a GFP fusion protein in COS-7 cells localized the protein to the nucleus. Human and mouse DYRK1B proteins share 97% sequence identity. Lee et al. (2000) cloned the same gene, which they designated MIRK for 'minibrain-related kinase.' They found that the encoded protein kinase enables colon carcinoma cells to survive under certain stress conditions. MIRK is a mitogen-activated protein kinase substrate but is downregulated by activated extracellular signal-regulated kinases (ERKs) in vivo. MIRK contains a PEST region characteristic of rapidly turned over proteins and is broken down to a 57-kD form only in the nucleus. MIRK mRNA levels were elevated in several types of carcinomas, and MIRK protein was detected in each of 7 colon carcinoma cell lines. Mirk was expressed at a higher protein level in Western blots from 3 of 8 colon cancers compared with paired normal colon tissue, suggesting that Mirk plays a role in the evolution of a subset of colon cancers. MIRK is not mutated in colon carcinomas.

Full details of the abovementioned studies are described in the following publications, the disclosure of which are hereby incorporated by reference:

Leder, S.; Weber, Y.; Altafaj, X.; Estivill, X.; Joost, H.-G.; Becker, W.: Cloning and characterization of DYRK1B, a novel member of the DYRK family of protein kinases. Biochem. Biophys. Res. Commun. 254:474-479, 1999; and Lee, K.; Deng, X.; Friedman, E.: Mirk protein kinase is a mitogen-activated protein kinase substrate that mediates survival of colon cancer cells. Cancer Res. 60: 3631-3637, 2000.

Further studies establishing the function and utilities of DYRK1B are found in John Hopkins OMIM database record ID 604556, and in cited publications listed in Table 5, which are hereby incorporated by reference. Dual-specificity tyrosine-(y)-phosphorylation regulated kinase 1b (DYRK1B, Accession NP_006475.1) is another GAM63 target gene, herein designated TARGET GENE. DYRK1B BINDING SITE is a target binding site found in the 3' untranslated region of multiple transcripts of mRNA encoded by DYRK1B, corresponding to a target binding site such as BINDING SITE I, BINDING SITE II or BINDING SITE III of FIG. 8. Table 4 illustrates the complementarity of the nucleotide sequences of DYRK1B BINDING SITE, designated SEQ ID:3553, to the nucleotide sequence of GAM63 RNA, herein designated GAM RNA, also designated SEQ ID:348.

Another function of GAM63 is therefore inhibition of Dual-specificity tyrosine-(y)-phosphorylation regulated kinase 1b (DYRK1B, Accession NP_006475.1), a gene which is a mitogen-activated dual-specificity protein kinase substrate and therefore may be associated with Colon cancer. Accordingly, utilities of GAM63 include diagnosis, prevention and treatment of Colon cancer, and of other diseases and clinical conditions associated with DYRK1B.

The function of DYRK1B has been established by previous studies. The DYRK1A gene (OMIM Ref. No. 600855), located on human chromosome 21 and encoding a dual-specificity protein kinase, is the human homolog of the Drosophila 'minibrain' gene. The minibrain protein product, mnb, is involved in postembryonic neurogenesis. By performing RACE on human testis RNA using primers designed to the catalytic domain of DYRK1A, Leder et al. (1999) isolated a partial DYRK1B cDNA; they obtained the complete coding sequence of human DYRK1B by PCR cloning from human testis cDNA. The putative DYRK1B peptide has a domain structure similar to that of DYRK1A, with a kinase domain flanked by a 110-amino acid N-terminal domain and a 198-amino acid C-terminal domain. Human DYRK1A and DYRK1B proteins are 84% identical in the N-terminal and catalytic domains but show no extended similarity in the C-terminal region. Northern blot analysis detected a 2.4-kb DYRK1B transcript in testis and skeletal muscle. Expression of DYRK1B as a GFP fusion protein in COS-7 cells localized the protein to the nucleus. Human and mouse DYRK1B proteins share 97% sequence identity. Lee et al. (2000) cloned the same gene, which they designated MIRK for 'minibrain-related kinase.' They found that the encoded protein kinase enables colon carcinoma cells to survive under certain stress conditions. MIRK is a mitogen-activated protein kinase substrate but is downregulated by activated extracellular signal-regulated kinases (ERKs) in vivo. MIRK contains a PEST region characteristic of rapidly turned over proteins and is broken down to a 57-kD form only in the nucleus. MIRK mRNA levels were elevated in several types of carcinomas, and MIRK protein was detected in each of 7 colon carcinoma cell lines. Mirk was expressed at a higher protein level in Western blots from 3 of 8 colon cancers compared with paired normal colon tissue, suggesting that Mirk plays a role in the evolution of a subset of colon cancers. MIRK is not mutated in colon carcinomas.

Full details of the abovementioned studies are described in the following publications, the disclosure of which are hereby incorporated by reference:

Leder, S.; Weber, Y.; Altafaj, X.; Estivill, X.; Joost, H.-G.; Becker, W.: Cloning and characterization of DYRK1B, a novel member of the DYRK family of protein kinases. Biochem. Biophys. Res. Commun. 254:474-479, 1999; and Lee, K.; Deng, X.; Friedman, E.: Mirk protein kinase is a mitogen-activated protein kinase substrate that mediates survival of colon cancer cells. Cancer Res. 60: 3631-3637, 2000.

Further studies establishing the function and utilities of DYRK1B are found in John Hopkins OMIM database record ID 604556, and in cited publications listed in Table 5, which are hereby incorporated by reference. Dual-specificity tyrosine-(y)-phosphorylation regulated kinase 1b (DYRK1B, Accession NP_006474.1) is another GAM63 target gene, herein designated TARGET GENE. DYRK1B BINDING SITE is a target binding site found in the 3' untranslated region of multiple transcripts of mRNA encoded by DYRK1B, corresponding to a target binding site such as BINDING SITE I, BINDING SITE II or BINDING SITE III of FIG. 8. Table 4 illustrates the complementarity of the nucleotide sequences of DYRK1B BINDING SITE, designated SEQ ID:3553, to the nucleotide sequence of GAM63 RNA, herein designated GAM RNA, also designated SEQ ID:348.

Another function of GAM63 is therefore inhibition of Dual-specificity tyrosine-(y)-phosphorylation regulated kinase 1b (DYRK1B, Accession NP_006474.1), a gene which is a mitogen-activated dual-specificity protein kinase substrate and therefore may be associated with Colon cancer. Accordingly, utilities of GAM63 include diagnosis, prevention and treatment of Colon cancer, and of other diseases and clinical conditions associated with DYRK1B.

The function of DYRK1B has been established by previous studies. The DYRK1A gene (OMIM Ref. No. 600855), located on human chromosome 21 and encoding a dual-specificity protein kinase, is the human homolog of the Drosophila 'minibrain' gene. The minibrain protein product, mnb, is involved in postembryonic neurogenesis. By performing RACE on human testis RNA using primers designed to the catalytic domain of DYRK1A, Leder et al. (1999) isolated a partial DYRK1B cDNA; they obtained the complete coding sequence of human DYRK1B by PCR cloning from human testis cDNA. The putative DYRK1B peptide has a domain structure similar to that of DYRK1A, with a kinase domain flanked by a 110-amino acid N-terminal domain and a 198-amino acid C-terminal domain. Human DYRK1A and DYRK1B proteins are 84% identical in the N-terminal and catalytic domains but show no extended similarity in the C-terminal region. Northern blot analysis detected a 2.4-kb DYRK1B transcript in testis and skeletal muscle. Expression of DYRK1B as a GFP fusion protein in COS-7 cells localized the protein to the nucleus. Human and mouse DYRK1B proteins share 97% sequence identity. Lee et al. (2000) cloned the same gene, which they designated MIRK for 'minibrain-related kinase.' They found that the encoded protein kinase enables colon carcinoma cells to survive under certain stress conditions. MIRK is a mitogen-activated protein kinase substrate but is downregulated by activated extracellular signal-regulated kinases (ERKs) in vivo. MIRK contains a PEST region characteristic of rapidly turned over proteins and is broken down to a 57-kD form only in the nucleus. MIRK mRNA levels were elevated in several types of carcinomas, and MIRK protein was detected in each of 7 colon carcinoma cell lines. Mirk was expressed at a higher protein level in Western blots from 3 of 8 colon cancers compared with paired normal colon tissue, suggesting that Mirk plays a role in the evolution of a subset of colon cancers. MIRK is not mutated in colon carcinomas.

Full details of the abovementioned studies are described in the following publications, the disclosure of which are hereby incorporated by reference:

Leder, S.; Weber, Y.; Altafaj, X.; Estivill, X.; Joost, H.-G.; Becker, W.: Cloning and characterization of DYRK1B, a novel member of the DYRK family of protein kinases. Biochem. Biophys. Res. Commun. 254:474-479, 1999. ; and Lee, K.; Deng, X.; Friedman, E.: Mirk protein kinase is a mitogen-activated protein kinase substrate that mediates survival of colon cancer cells. Cancer Res. 60: 3631-3637, 2000.

Further studies establishing the function and utilities of DYRK1B are found in John Hopkins OMIM database record ID 604556, and in cited publications listed in Table 5, which are hereby incorporated by reference. EAT2 (Accession NP_444512.1) is another GAM63 target gene, herein designated TARGET GENE. EAT2 BINDING SITE is a target binding site found in the 3' untranslated region of mRNA encoded by EAT2, corresponding to a target binding site such as BINDING SITE I, BINDING SITE II or BINDING SITE III of FIG. 8. Table 4 illustrates the complementarity of the nucleotide sequences of EAT2 BINDING SITE, designated SEQ ID:4918, to the nucleotide sequence of GAM63 RNA, herein designated GAM RNA, also designated SEQ ID:348.

Another function of GAM63 is therefore inhibition of EAT2 (Accession NP_444512.1). Accordingly, utilities of GAM63 include diagnosis, prevention and treatment of diseases and clinical conditions associated with EAT2.

EFS (Accession NP_115835.1) is another GAM63 target gene, herein designated TARGET GENE. EFS BINDING SITE is a target binding site found in the 3' untranslated region of multiple transcripts of mRNA encoded by EFS, corresponding to a target binding site such as BINDING SITE I, BINDING SITE II or BINDING SITE III of FIG. 8. Table 4 illustrates the complementarity of the nucleotide sequences of EFS BINDING SITE, designated SEQ ID:1802, to the nucleotide sequence of GAM63 RNA, herein designated GAM RNA, also designated SEQ ID:348.

Another function of GAM63 is therefore inhibition of EFS (Accession NP_115835.1). Accordingly, utilities of GAM63 include diagnosis, prevention and treatment of diseases and clinical conditions associated with EFS.

EFS (Accession NP_005855.1) is another GAM63 target gene, herein designated TARGET GENE. EFS BINDING SITE is a target binding site found in the 3' untranslated region of multiple transcripts of mRNA encoded by EFS, corresponding to a target binding site such as BINDING SITE I, BINDING SITE II or BINDING SITE III of FIG. 8. Table 4 illustrates the complementarity of the nucleotide sequences of EFS BINDING SITE, designated SEQ ID:1802, to the nucleotide sequence of GAM63 RNA, herein designated GAM RNA, also designated SEQ ID:348.

Another function of GAM63 is therefore inhibition of EFS (Accession NP_005855.1). Accordingly, utilities of GAM63 include diagnosis, prevention and treatment of diseases and clinical conditions associated with EFS.

Early growth response 3 (EGR3, Accession NP_004421.2) is another GAM63 target gene, herein designated TARGET GENE. EGR3 BINDING SITE is a target binding site found in the 3' untranslated region of mRNA encoded by EGR3, corresponding to a target binding site such as BINDING SITE I, BINDING SITE II or BINDING SITE III of FIG. 8. Table 4 illustrates the complementarity of the nucleotide sequences of EGR3 BINDING SITE, designated SEQ ID:4416, to the nucleotide sequence of GAM63 RNA, herein designated GAM RNA, also designated SEQ ID:348.

Another function of GAM63 is therefore inhibition of Early growth response 3 (EGR3, Accession NP_004421.2), a gene which is a putative transcription factor. Accordingly, utilities of GAM63 include diagnosis, prevention and treatment of diseases and clinical conditions associated with EGR3.

The function of EGR3 has been established by previous studies. The human EGR3 gene was described by Patwardhan et al. (1991) as predicting a 387-amino acid protein containing 3 C2H2 zinc fingers nearly identical to those of EGR1 and EGR2. The EGR3 gene has a single intron. The gene was known to be induced in various brain regions in response to stress or following focal brain injury. Morris et al. (1998) stated that, in the SCN, it probably participates in the transcriptional regulation of genes in response to retinal input, as had been proposed for FOS. Muscle spindles are skeletal muscle sensory organs that provide axial and limb position information (proprioception) to the central nervous system. Spindles consist of encapsulated muscle fibers (intrafusal fibers) that are innervated by specialized motor and sensory axons. Tourtellotte and Milbrandt (1998) found that mice rendered deficient in Egr3 by gene targeting had gait ataxia, increased frequency of perinatal mortality, scoliosis, resting tremors, and ptosis. Although extrafusal skeletal muscle fibers appeared normal, Egr3-deficient animals lacked muscle spindles, a finding that is consistent with their profound gait ataxia. Egr3 was highly expressed in developing muscle spindles, but not in IIa afferent neurons or their terminals during developmental periods that coincided with the induction of spindle morphogenesis by sensory afferent axons. These results indicated that type I myotubes are dependent upon Egr3-mediated transcription for proper spindle development.

Full details of the abovementioned studies are described in the following publications, the disclosure of which are hereby incorporated by reference:

Morris, M. E.; Viswanathan, N.; Kuhlman, S.; Davis, F. C.; Weitz, C. J.: A screen for genes induced in the suprachiasmatic nucleus by light. Science 279:1544-1547, 1998; and Tourtellotte, W. G.; Milbrandt, J.: Sensory ataxia and muscle spindle agenesis in mice lacking the transcription factor Egr3. Nature Genet. 20:87-91, 1998.

Further studies establishing the function and utilities of EGR3 are found in John Hopkins OMIM database record ID 602419, and in cited publications listed in Table 5, which are hereby incorporated by reference. Enolase 2, (gamma, neuronal) (ENO2, Accession NP_001966.1) is another GAM63 target gene, herein designated TARGET GENE. ENO2 BINDING SITE is a target binding site found in the 3' untranslated region of mRNA encoded by ENO2, corresponding to a target binding site such as BINDING SITE I, BINDING SITE II or BINDING SITE III of FIG. 8. Table 4 illustrates the complementarity of the nucleotide sequences of ENO2 BINDING SITE, designated SEQ ID:13106, to the nucleotide sequence of GAM63 RNA, herein designated GAM RNA, also designated SEQ ID:348.

Another function of GAM63 is therefore inhibition of Enolase 2, (gamma, neuronal) (ENO2, Accession NP_001966.1), a gene which converts 2-phospho-D-glycerate to phosphoenolpyruvate in glycolysis. Accordingly, utilities of GAM63 include diagnosis, prevention and treatment of diseases and clinical conditions associated with ENO2.

The function of ENO2 has been established by previous studies. The enolases (phosphopyruvate hydratase; EC 4.2.1.11) catalyze the interconversion of 2-phosphoglycerate to phosphoenolpyruvate in the glycolytic pathway. The functional enzyme is a dimer made up of subunits referred to as alpha, beta, and gamma. In mammals there are at least 3 isoforms of enolase characterized by different tissue distributions as well as by distinct biochemical and immunologic properties. The alpha-, or nonneuronal, enolase (ENO1; 172430) is a nearly ubiquitous form, found in almost all tissues, and its expression precedes that of the other isoforms in the early stage of embryonic development. The beta-, or muscle-specific, enolase (ENO3; 131370) is present in adult skeletal muscle, and the gamma-, or neuron- specific, enolase (ENO2) is the major form found in mature neurons and in cells of neuronal origin. Enolase-2 is determined by a gene on chromosome 12 (Grzeschik, 1976). Herbschleb-Voogt et al. (1978) confirmed assignment to chromosome 12 by showing synteny with LDHB and PEPB in man-mouse hybrids. Mattei et al. (1982) assigned ENO2 to 12p11-qter by study of cells trisomic for 12pter-p11. Law and Kao (1982) also assigned the gene to chromosome 12. By in situ hybridization, Craig et al. (1989, 1990) localized ENO2 to 12p13. Oliva et al. (1991) demonstrated that the ENO2 gene contains 12 exons distributed over 9,213 nucleotides. The putative promoter region lacks canonical TATA and CAAT boxes, is very G+C-rich, and contains several potential regulatory sequences.

Full details of the abovementioned studies are described in the following publications, the disclosure of which are hereby incorporated by reference:

Oliva, D.; Cali, L.; Feo, S.; Giallongo, A.: Complete structure of the human gene encoding neuron-specific enolase. Genomics 10:157-165, 1991; and Hinks, L. J.; Day, I. N. M.: Further studies of enolase loci. (Abstract) Cytogenet. Cell Genet. 58:1854 only, 1991.

Further studies establishing the function and utilities of ENO2 are found in John Hopkins OMIM database record ID 131360, and in cited publications listed in Table 5, which are hereby incorporated by reference. Era g-protein-like 1 (e. coli) (ERAL1, Accession NP_005693.1) is another GAM63 target gene, herein designated TARGET GENE. ERAL1 BINDING SITE is a target binding site found in the 3' untranslated region of mRNA encoded by ERAL1, corresponding to a target binding site such as BINDING SITE I, BINDING SITE II or BINDING SITE III of FIG. 8. Table 4 illustrates the complementarity of the nucleotide sequences of ERAL1 BINDING SITE, designated SEQ ID:5170, to the nucleotide sequence of GAM63 RNA, herein designated GAM RNA, also designated SEQ ID:348.

Another function of GAM63 is therefore inhibition of Era g-protein-like 1 (e. coli) (ERAL1, Accession NP_005693.1). Accordingly, utilities of GAM63 include diagnosis, prevention and treatment of diseases and clinical conditions associated with ERAL1.

V-erb-b2 erythroblastic leukemia viral oncogene homolog 3 (avian) (ERBB3, Accession NP_001973.1) is another GAM63 target gene, herein designated TARGET GENE. ERBB3 BINDING SITE is a target binding site found in the 3' untranslated region of mRNA encoded by ERBB3, corresponding to a target binding site such as BINDING SITE I, BINDING SITE II or BINDING SITE III of FIG. 8. Table 4 illustrates the complementarity of the nucleotide sequences of ERBB3 BINDING SITE, designated SEQ ID:12198, to the nucleotide sequence of GAM63 RNA, herein designated GAM RNA, also designated SEQ ID:348.

Another function of GAM63 is therefore inhibition of V-erb-b2 erythroblastic leukemia viral oncogene homolog 3 (avian) (ERBB3, Accession NP_001973.1), a gene which binds and is activated by neuregulins and ntak. Accordingly, utilities of GAM63 include diagnosis, prevention and treatment of diseases and clinical conditions associated with ERBB3.

The function of ERBB3 has been established by previous studies. Kraus et al. (1989) detected a DNA fragment related to but distinct from epidermal growth factor receptor (EGFR; 131550) and ERBB2 (OMIM Ref. No. 164870). cDNA cloning showed a predicted 148-kD transmembrane polypeptide with structural features identifying it as a member of the ERBB gene family, prompting the designation ERBB3. Markedly elevated ERBB3 mRNA levels were demonstrated in certain human mammary tumor cell lines, suggesting that it may play a role in some human malignancies just as does EGFR (also called ERBB1). Epidermal growth factor (OMIM Ref. No. 131530), transforming growth factor alpha (OMIM Ref. No. 190170), and amphiregulin (OMIM Ref. No. 104640) are structurally and functionally related growth regulatory proteins. They all are secreted polypeptides that bind to the 170-kD cell-surface EGF receptor, activating its intrinsic kinase activity. Plowman et al. (1990) speculated that these 3 proteins may differentially interact with a homolog of EGFR. They failed to show any interaction between these 3 secreted growth factors and ERBB2, a known EGFR-related protein. Searching for other members of this family of receptor tyrosine kinases, however, they cloned and studied the expression of ERBB3, which they referred to as HER3. The cDNA was isolated from a human carcinoma cell line, and its 6-kb transcript was identified in various human tissues. Carraway et al. (1994) demonstrated that ERBB3 is a receptor for heregulin (OMIM Ref. No. 142445) and is capable of mediating HGL-stimulated tyrosine phosphorylation of itself. By in situ hybridization, Kraus et al. (1989) mapped the ERBB3 gene to chromosome 12q13.

Full details of the abovementioned studies are described in the following publications, the disclosure of which are hereby incorporated by reference:

Kraus, M. H.; Issing, W.; Miki, T.; Popescu, N. C.; Aaronson, S. A.: Isolation and characterization of ERBB3, a third member of the ERBB/epidermal growth factor receptor family: evidence for overexpression in a subset of human mammary tumors. Proc. Nat. Acad. Sci. 86:9193-9197, 1989; and Plowman, G. D.; Whitney, G. S.; Neubauer, M. G.; Green, J. M.; McDonald, V. L.; Todaro, G. J.; Shoyab, M.: Molecular cloning and expression of an additional epidermal growth factor rece.

Further studies establishing the function and utilities of ERBB3 are found in John Hopkins OMIM database record ID 190151, and in cited publications listed in Table 5, which are hereby incorporated by reference. Extra spindle poles like 1 (s. cerevisiae) (ESPL1, Accession NP_036423.1) is another GAM63 target gene, herein designated TARGET GENE. ESPL1 BINDING SITE is a target binding site found in the 5' untranslated region of mRNA encoded by ESPL1, corresponding to a target binding site such as BINDING SITE I, BINDING SITE II or BINDING SITE III of FIG. 8. Table 4 illustrates the complementarity of the nucleotide sequences of ESPL1 BINDING SITE, designated SEQ ID:2372, to the nucleotide sequence of GAM63 RNA, herein designated GAM RNA, also designated SEQ ID:348.

Another function of GAM63 is therefore inhibition of Extra spindle poles like 1 (s. cerevisiae) (ESPL1, Accession NP_036423.1). Accordingly, utilities of GAM63 include diagnosis, prevention and treatment of diseases and clinical conditions associated with ESPL1.

F11R (Accession NP_058642.1) is another GAM63 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:15037, to the nucleotide sequence of GAM63 RNA, herein designated GAM RNA, also designated SEQ ID:348.

Another function of GAM63 is therefore inhibition of F11R (Accession NP_058642.1). Accordingly, utilities of GAM63 include diagnosis, prevention and treatment of diseases and clinical conditions associated with F11R.

F11R (Accession NP_653087.1) is another GAM63 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:15037, to the nucleotide sequence of GAM63 RNA, herein designated GAM RNA, also designated SEQ ID:348.

Another function of GAM63 is therefore inhibition of F11R (Accession NP_653087.1). Accordingly, utilities of GAM63 include diagnosis, prevention and treatment of diseases and clinical conditions associated with F11R.

F11R (Accession NP_653086.1) is another GAM63 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:15037, to the nucleotide sequence of GAM63 RNA, herein designated GAM RNA, also designated SEQ ID:348.

Another function of GAM63 is therefore inhibition of F11R (Accession NP_653086.1). Accordingly, utilities of GAM63 include diagnosis, prevention and treatment of diseases and clinical conditions associated with F11R.

F11R (Accession NP_653085.1) is another GAM63 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:15037, to the nucleotide sequence of GAM63 RNA, herein designated GAM RNA, also designated SEQ ID:348.

Another function of GAM63 is therefore inhibition of F11R (Accession NP_653085.1). Accordingly, utilities of GAM63 include diagnosis, prevention and treatment of diseases and clinical conditions associated with F11R.

Family with sequence similarity 3, member a (FAM3A, Accession NP_068578.1) is another GAM63 target gene, herein designated TARGET GENE. FAM3A BINDING SITE is a target binding site found in the 3' untranslated region of mRNA encoded by FAM3A, corresponding to a target binding site such as BINDING SITE I, BINDING SITE II or BINDING SITE III of FIG. 8. Table 4 illustrates the complementarity of the nucleotide sequences of FAM3A BINDING SITE, designated SEQ ID:11015, to the nucleotide sequence of GAM63 RNA, herein designated GAM RNA, also designated SEQ ID:348.

Another function of GAM63 is therefore inhibition of Family with sequence similarity 3, member a (FAM3A, Accession NP_068578.1). Accordingly, utilities of GAM63 include diagnosis, prevention and treatment of diseases and clinical conditions associated with FAM3A.

FBXW8 (Accession NP_036306.1) is another GAM63 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:15570, to the nucleotide sequence of GAM63 RNA, herein designated GAM RNA, also designated SEQ ID:348.

Another function of GAM63 is therefore inhibition of FBXW8 (Accession NP_036306.1). Accordingly, utilities of GAM63 include diagnosis, prevention and treatment of diseases and clinical conditions associated with FBXW8.

FBXW8 (Accession NP_699179.2) is another GAM63 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:15570, to the nucleotide sequence of GAM63 RNA, herein designated GAM RNA, also designated SEQ ID:348.

Another function of GAM63 is therefore inhibition of FBXW8 (Accession NP_699179.2). Accordingly, utilities of GAM63 include diagnosis, prevention and treatment of diseases and clinical conditions associated with FBXW8.

FLJ00001 (Accession XP_088525.2) is another GAM63 target gene, herein designated TARGET GENE. FLJ00001 BINDING SITE1 and FLJ00001 BINDING SITE2 are target binding sites found in untranslated regions of mRNA encoded by FLJ00001, corresponding to target binding sites such as BINDING SITE I, BINDING SITE II or BINDING SITE III of FIG. 8. Table 4 illustrates the complementarity of the nucleotide sequences of FLJ00001 BINDING SITE1 and FLJ00001 BINDING SITE2, designated SEQ ID:9347 and SEQ ID:3839 respectively, to the nucleotide sequence of GAM63 RNA, herein designated GAM RNA, also designated SEQ ID:348.

Another function of GAM63 is therefore inhibition of FLJ00001 (Accession XP_088525.2). Accordingly, utilities of GAM63 include diagnosis, prevention and treatment of diseases and clinical conditions associated with FLJ00001.

FLJ00024 (Accession XP_033361.2) is another GAM63 target gene, herein designated TARGET GENE. FLJ00024 BINDING SITE is a target binding site found in the 3' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:16819, to the nucleotide sequence of GAM63 RNA, herein designated GAM RNA, also designated SEQ ID:348.

Another function of GAM63 is therefore inhibition of FLJ00024 (Accession XP_033361.2). Accordingly, utilities of GAM63 include diagnosis, prevention and treatment of diseases and clinical conditions associated with FLJ00024.

FLJ00024 (Accession NP_203745.1) is another GAM63 target gene, herein designated TARGET GENE. FLJ00024 BINDING SITE is a target binding site found in the 3' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:16819, to the nucleotide sequence of GAM63 RNA, herein designated GAM RNA, also designated SEQ ID:348.

Another function of GAM63 is therefore inhibition of FLJ00024 (Accession NP_203745.1). Accordingly, utilities of GAM63 include diagnosis, prevention and treatment of diseases and clinical conditions associated with FLJ00024.

FLJ00103 (Accession XP_036104.5) is another GAM63 target gene, herein designated TARGET GENE. FLJ00103 BINDING SITE is a target binding site found in the 3' untranslated region of mRNA encoded by FLJ00103, corresponding to a target binding site such as BINDING SITE I, BINDING SITE II or BINDING SITE III of FIG. 8. Table 4 illustrates the complementarity of the nucleotide sequences of FLJ00103 BINDING SITE, designated SEQ ID:7642, to the nucleotide sequence of GAM63 RNA, herein designated GAM RNA, also designated SEQ ID:348.

Another function of GAM63 is therefore inhibition of FLJ00103 (Accession XP_036104.5). Accordingly, utilities of GAM63 include diagnosis, prevention and treatment of diseases and clinical conditions associated with FLJ00103.

FLJ10900 (Accession NP_060734.1) is another GAM63 target gene, herein designated TARGET GENE. FLJ10900 BINDING SITE is a target binding site found in the 3' untranslated region of mRNA encoded by FLJ10900, corresponding to a target binding site such as BINDING SITE I, BINDING SITE II or BINDING SITE III of FIG. 8. Table 4 illustrates the complementarity of the nucleotide sequences of FLJ10900 BINDING SITE, designated SEQ ID:16238, to the nucleotide sequence of GAM63 RNA, herein designated GAM RNA, also designated SEQ ID:348.

Another function of GAM63 is therefore inhibition of FLJ10900 (Accession NP_060734.1). Accordingly, utilities of GAM63 include diagnosis, prevention and treatment of diseases and clinical conditions associated with FLJ10900.

FLJ10922 (Accession NP_060743.1) is another GAM63 target gene, herein designated TARGET GENE. FLJ10922

BINDING SITE is a target binding site found in the 3' untranslated region of mRNA encoded by FLJ10922, corresponding to a target binding site such as BINDING SITE I, BINDING SITE II or BINDING SITE III of FIG. 8. Table 4 illustrates the complementarity of the nucleotide sequences of FLJ10922 BINDING SITE, designated SEQ ID:16820, to the nucleotide sequence of GAM63 RNA, herein designated GAM RNA, also designated SEQ ID:348.

Another function of GAM63 is therefore inhibition of FLJ10922 (Accession NP_060743.1). Accordingly, utilities of GAM63 include diagnosis, prevention and treatment of diseases and clinical conditions associated with FLJ10922.

FLJ11151 (Accession NP_060810.1) is another GAM63 target gene, herein designated TARGET GENE. FLJ11151 BINDING SITE is a target binding site found in the 3' untranslated region of mRNA encoded by FLJ11151, corresponding to a target binding site such as BINDING SITE I, BINDING SITE II or BINDING SITE III of FIG. 8. Table 4 illustrates the complementarity of the nucleotide sequences of FLJ11151 BINDING SITE, designated SEQ ID:11328, to the nucleotide sequence of GAM63 RNA, herein designated GAM RNA, also designated SEQ ID:348.

Another function of GAM63 is therefore inhibition of FLJ11151 (Accession NP_060810.1). Accordingly, utilities of GAM63 include diagnosis, prevention and treatment of diseases and clinical conditions associated with FLJ11151.

FLJ12660 (Accession NP_079428.1) is another GAM63 target gene, herein designated TARGET GENE. FLJ12660 BINDING SITE is a target binding site found in the 3' untranslated region of mRNA encoded by FLJ12660, corresponding to a target binding site such as BINDING SITE I, BINDING SITE II or BINDING SITE III of FIG. 8. Table 4 illustrates the complementarity of the nucleotide sequences of FLJ12660 BINDING SITE, designated SEQ ID:6133, to the nucleotide sequence of GAM63 RNA, herein designated GAM RNA, also designated SEQ ID:348.

Another function of GAM63 is therefore inhibition of FLJ12660 (Accession NP_079428.1). Accordingly, utilities of GAM63 include diagnosis, prevention and treatment of diseases and clinical conditions associated with FLJ12660.

FLJ13204 (Accession NP_079037.2) is another GAM63 target gene, herein designated TARGET GENE. FLJ13204 BINDING SITE is a target binding site found in the 3' untranslated region of mRNA encoded by FLJ13204, corresponding to a target binding site such as BINDING SITE I, BINDING SITE II or BINDING SITE III of FIG. 8. Table 4 illustrates the complementarity of the nucleotide sequences of FLJ13204 BINDING SITE, designated SEQ ID:3368, to the nucleotide sequence of GAM63 RNA, herein designated GAM RNA, also designated SEQ ID:348.

Another function of GAM63 is therefore inhibition of FLJ13204 (Accession NP_079037.2). Accordingly, utilities of GAM63 include diagnosis, prevention and treatment of diseases and clinical conditions associated with FLJ13204.

FLJ13215 (Accession NP_079280.1) is another GAM63 target gene, herein designated TARGET GENE. FLJ13215 BINDING SITE1 and FLJ13215 BINDING SITE2 are target binding sites found in untranslated regions of mRNA encoded by FLJ13215, corresponding to target binding sites such as BINDING SITE I, BINDING SITE II or BINDING SITE III of FIG. 8. Table 4 illustrates the complementarity of the nucleotide sequences of FLJ13215 BINDING SITE1 and FLJ13215 BINDING SITE2, designated SEQ ID:18857 and SEQ ID:5332 respectively, to the nucleotide sequence of GAM63 RNA, herein designated GAM RNA, also designated SEQ ID:348.

Another function of GAM63 is therefore inhibition of FLJ13215 (Accession NP_079280.1). Accordingly, utilities of GAM63 include diagnosis, prevention and treatment of diseases and clinical conditions associated with FLJ13215.

FLJ13639 (Accession NP_078981.1) is another GAM63 target gene, herein designated TARGET GENE. FLJ13639 BINDING SITE is a target binding site found in the 3' untranslated region of mRNA encoded by FLJ13639, corresponding to a target binding site such as BINDING SITE I, BINDING SITE II or BINDING SITE III of FIG. 8. Table 4 illustrates the complementarity of the nucleotide sequences of FLJ13639 BINDING SITE, designated SEQ ID:19873, to the nucleotide sequence of GAM63 RNA, herein designated GAM RNA, also designated SEQ ID:348.

Another function of GAM63 is therefore inhibition of FLJ13639 (Accession NP_078981.1). Accordingly, utilities of GAM63 include diagnosis, prevention and treatment of diseases and clinical conditions associated with FLJ13639.

FLJ14007 (Accession NP_078975.1) is another GAM63 target gene, herein designated TARGET GENE. FLJ14007 BINDING SITE is a target binding site found in the 3' untranslated region of mRNA encoded by FLJ14007, corresponding to a target binding site such as BINDING SITE I, BINDING SITE II or BINDING SITE III of FIG. 8. Table 4 illustrates the complementarity of the nucleotide sequences of FLJ14007 BINDING SITE, designated SEQ ID:11969, to the nucleotide sequence of GAM63 RNA, herein designated GAM RNA, also designated SEQ ID:348.

Another function of GAM63 is therefore inhibition of FLJ14007 (Accession NP_078975.1). Accordingly, utilities of GAM63 include diagnosis, prevention and treatment of diseases and clinical conditions associated with FLJ14007.

FLJ14050 (Accession NP_079145.1) is another GAM63 target gene, herein designated TARGET GENE. FLJ14050 BINDING SITE is a target binding site found in the 5' untranslated region of mRNA encoded by FLJ14050, corresponding to a target binding site such as BINDING SITE I, BINDING SITE II or BINDING SITE III of FIG. 8. Table 4 illustrates the complementarity of the nucleotide sequences of FLJ14050 BINDING SITE, designated SEQ ID:19808, to the nucleotide sequence of GAM63 RNA, herein designated GAM RNA, also designated SEQ ID:348.

Another function of GAM63 is therefore inhibition of FLJ14050 (Accession NP_079145.1). Accordingly, utilities of GAM63 include diagnosis, prevention and treatment of diseases and clinical conditions associated with FLJ14050.

FLJ20487 (Accession NP_060311.1) is another GAM63 target gene, herein designated TARGET GENE. FLJ20487 BINDING SITE is a target binding site found in the 3' untranslated region of mRNA encoded by FLJ20487, corresponding to a target binding site such as BINDING SITE I, BINDING SITE II or BINDING SITE III of FIG. 8. Table 4 illustrates the complementarity of the nucleotide sequences of FLJ20487 BINDING SITE, designated SEQ ID:14156, to the nucleotide sequence of GAM63 RNA, herein designated GAM RNA, also designated SEQ ID:348.

Another function of GAM63 is therefore inhibition of FLJ20487 (Accession NP_060311.1). Accordingly, utilities of GAM63 include diagnosis, prevention and treatment of diseases and clinical conditions associated with FLJ20487.

FLJ20619 (Accession NP_060374.1) is another GAM63 target gene, herein designated TARGET GENE. FLJ20619 BINDING SITE is a target binding site found in the 3' untranslated region of mRNA encoded by FLJ20619, corresponding to a target binding site such as BINDING SITE I, BINDING SITE II or BINDING SITE III of FIG. 8. Table 4 illustrates the complementarity of the nucleotide sequences of FLJ20619 BINDING SITE, designated SEQ ID:9038, to the nucleotide sequence of GAM63 RNA, herein designated GAM RNA, also designated SEQ ID:348.

Another function of GAM63 is therefore inhibition of FLJ20619 (Accession NP_060374.1). Accordingly, utilities of GAM63 include diagnosis, prevention and treatment of diseases and clinical conditions associated with FLJ20619.

FLJ20825 (Accession NP_060432.1) is another GAM63 target gene, herein designated TARGET GENE. FLJ20825 BINDING SITE is a target binding site found in the 3' untranslated region of mRNA encoded by FLJ20825, corresponding to a target binding site such as BINDING SITE I, BINDING SITE II or BINDING SITE III of FIG. 8. Table 4 illustrates the complementarity of the nucleotide sequences of FLJ20825 BINDING SITE, designated SEQ ID:1853, to the nucleotide sequence of GAM63 RNA, herein designated GAM RNA, also designated SEQ ID:348.

Another function of GAM63 is therefore inhibition of FLJ20825 (Accession NP_060432.1). Accordingly, utilities of GAM63 include diagnosis, prevention and treatment of diseases and clinical conditions associated with FLJ20825.

FLJ21977 (Accession NP_115589.2) is another GAM63 target gene, herein designated TARGET GENE. FLJ21977 BINDING SITE is a target binding site found in the 3' untranslated region of mRNA encoded by FLJ21977, corresponding to a target binding site such as BINDING SITE I, BINDING SITE II or BINDING SITE III of FIG. 8. Table 4 illustrates the complementarity of the nucleotide sequences of FLJ21977 BINDING SITE, designated SEQ ID:19347, to the nucleotide sequence of GAM63 RNA, herein designated GAM RNA, also designated SEQ ID:348.

Another function of GAM63 is therefore inhibition of FLJ21977 (Accession NP_115589.2). Accordingly, utilities of GAM63 include diagnosis, prevention and treatment of diseases and clinical conditions associated with FLJ21977.

FLJ22160 (Accession NP_078861.1) is another GAM63 target gene, herein designated TARGET GENE. FLJ22160 BINDING SITE is a target binding site found in the 3' untranslated region of mRNA encoded by FLJ22160, corresponding to a target binding site such as BINDING SITE I, BINDING SITE II or BINDING SITE III of FIG. 8. Table 4 illustrates the complementarity of the nucleotide sequences of FLJ22160 BINDING SITE, designated SEQ ID:4897, to the nucleotide sequence of GAM63 RNA, herein designated GAM RNA, also designated SEQ ID:348.

Another function of GAM63 is therefore inhibition of FLJ22160 (Accession NP_078861.1). Accordingly, utilities of GAM63 include diagnosis, prevention and treatment of diseases and clinical conditions associated with FLJ22160.

FLJ22169 (Accession NP_076990.1) is another GAM63 target gene, herein designated TARGET GENE. FLJ22169 BINDING SITE is a target binding site found in the 3' untranslated region of mRNA encoded by FLJ22169, corresponding to a target binding site such as BINDING SITE I, BINDING SITE II or BINDING SITE III of FIG. 8. Table 4 illustrates the complementarity of the nucleotide sequences of FLJ22169 BINDING SITE, designated SEQ ID:9940, to the nucleotide sequence of GAM63 RNA, herein designated GAM RNA, also designated SEQ ID:348.

Another function of GAM63 is therefore inhibition of FLJ22169 (Accession NP_076990.1). Accordingly, utilities of GAM63 include diagnosis, prevention and treatment of diseases and clinical conditions associated with FLJ22169.

FLJ22329 (Accession NP_078932.2) is another GAM63 target gene, herein designated TARGET GENE. FLJ22329 BINDING SITE is a target binding site found in the 3' untranslated region of mRNA encoded by FLJ22329, corresponding to a target binding site such as BINDING SITE I, BINDING SITE II or BINDING SITE III of FIG. 8. Table 4 illustrates the complementarity of the nucleotide sequences of FLJ22329 BINDING SITE, designated SEQ ID:2748, to the nucleotide sequence of GAM63 RNA, herein designated GAM RNA, also designated SEQ ID:348.

Another function of GAM63 is therefore inhibition of FLJ22329 (Accession NP_078932.2). Accordingly, utilities of GAM63 include diagnosis, prevention and treatment of diseases and clinical conditions associated with FLJ22329.

FLJ22678 (Accession NP_078812.2) is another GAM63 target gene, herein designated TARGET GENE. FLJ22678 BINDING SITE is a target binding site found in the 3' untranslated region of mRNA encoded by FLJ22678, corresponding to a target binding site such as BINDING SITE I, BINDING SITE II or BINDING SITE III of FIG. 8. Table 4 illustrates the complementarity of the nucleotide sequences of FLJ22678 BINDING SITE, designated SEQ ID:5171, to the nucleotide sequence of GAM63 RNA, herein designated GAM RNA, also designated SEQ ID:348.

Another function of GAM63 is therefore inhibition of FLJ22678 (Accession NP_078812.2). Accordingly, utilities of GAM63 include diagnosis, prevention and treatment of diseases and clinical conditions associated with FLJ22678.

FLJ23420 (Accession NP_079337.1) is another GAM63 target gene, herein designated TARGET GENE. FLJ23420 BINDING SITE is a target binding site found in the 5' untranslated region of mRNA encoded by FLJ23420, corresponding to a target binding site such as BINDING SITE I, BINDING SITE II or BINDING SITE III of FIG. 8. Table 4 illustrates the complementarity of the nucleotide sequences of FLJ23420 BINDING SITE, designated SEQ ID:20060, to the nucleotide sequence of GAM63 RNA, herein designated GAM RNA, also designated SEQ ID:348.

Another function of GAM63 is therefore inhibition of FLJ23420 (Accession NP_079337.1). Accordingly, utilities of GAM63 include diagnosis, prevention and treatment of diseases and clinical conditions associated with FLJ23420.

FLJ30317 (Accession NP_742148.1) is another GAM63 target gene, herein designated TARGET GENE. FLJ30317 BINDING SITE is a target binding site found in the 3' untranslated region of mRNA encoded by FLJ30317, corresponding to a target binding site such as BINDING SITE I, BINDING SITE II or BINDING SITE III of FIG. 8. Table 4 illustrates the complementarity of the nucleotide sequences of FLJ30317 BINDING SITE, designated SEQ ID:19586, to the nucleotide sequence of GAM63 RNA, herein designated GAM RNA, also designated SEQ ID:348.

Another function of GAM63 is therefore inhibition of FLJ30317 (Accession NP_742148.1). Accordingly, utilities of GAM63 include diagnosis, prevention and treatment of diseases and clinical conditions associated with FLJ30317.

FLJ30473 (Accession NP_653305.1) is another GAM63 target gene, herein designated TARGET GENE. FLJ30473 BINDING SITE is a target binding site found in the 3' untranslated region of mRNA encoded by FLJ30473, corresponding to a target binding site such as BINDING SITE I, BINDING SITE II or BINDING SITE III of FIG. 8. Table 4 illustrates the complementarity of the nucleotide sequences of FLJ30473 BINDING SITE, designated SEQ ID:18935, to the nucleotide sequence of GAM63 RNA, herein designated GAM RNA, also designated SEQ ID:348.

Another function of GAM63 is therefore inhibition of FLJ30473 (Accession NP_653305.1). Accordingly, utilities of GAM63 include diagnosis, prevention and treatment of diseases and clinical conditions associated with FLJ30473.

FLJ31131 (Accession NP_689748.1) is another GAM63 target gene, herein designated TARGET GENE. FLJ31131 BINDING SITE is a target binding site found in the 5' untranslated region of mRNA encoded by FLJ31131, corresponding to a target binding site such as BINDING SITE I, BINDING SITE II or BINDING SITE III of FIG. 8. Table 4 illustrates the complementarity of the nucleotide sequences of FLJ31131 BINDING SITE, designated SEQ ID:15810, to the nucleotide sequence of GAM63 RNA, herein designated GAM RNA, also designated SEQ ID:348.

Another function of GAM63 is therefore inhibition of FLJ31131 (Accession NP_689748.1). Accordingly, utilities of GAM63 include diagnosis, prevention and treatment of diseases and clinical conditions associated with FLJ31131.

FLJ31713 (Accession NP_689788.1) is another GAM63 target gene, herein designated TARGET GENE. FLJ31713 BINDING SITE is a target binding site found in the 3' untranslated region of mRNA encoded by FLJ31713, corresponding to a target binding site such as BINDING SITE I, BINDING SITE II or BINDING SITE III of FIG. 8. Table 4 illustrates the complementarity of the nucleotide sequences of FLJ31713 BINDING SITE, designated SEQ ID:19852, to the nucleotide sequence of GAM63 RNA, herein designated GAM RNA, also designated SEQ ID:348.

Another function of GAM63 is therefore inhibition of FLJ31713 (Accession NP_689788.1). Accordingly, utilities of GAM63 include diagnosis, prevention and treatment of diseases and clinical conditions associated with FLJ31713.

FLJ31819 (Accession NP_689742.2) is another GAM63 target gene, herein designated TARGET GENE. FLJ31819 BINDING SITE is a target binding site found in the 5' untranslated region of mRNA encoded by FLJ31819, corresponding to a target binding site such as BINDING SITE I, BINDING SITE II or BINDING SITE III of FIG. 8. Table 4 illustrates the complementarity of the nucleotide sequences of FLJ31819 BINDING SITE, designated SEQ ID:18693, to the nucleotide sequence of GAM63 RNA, herein designated GAM RNA, also designated SEQ ID:348.

Another function of GAM63 is therefore inhibition of FLJ31819 (Accession NP_689742.2). Accordingly, utilities of GAM63 include diagnosis, prevention and treatment of diseases and clinical conditions associated with FLJ31819.

FLJ31821 (Accession NP_694574.1) is another GAM63 target gene, herein designated TARGET GENE. FLJ31821 BINDING SITE is a target binding site found in the 5' untranslated region of mRNA encoded by FLJ31821, corresponding to a target binding site such as BINDING SITE I, BINDING SITE II or BINDING SITE III of FIG. 8. Table 4 illustrates the complementarity of the nucleotide sequences of FLJ31821 BINDING SITE, designated SEQ ID:855, to the nucleotide sequence of GAM63 RNA, herein designated GAM RNA, also designated SEQ ID:348.

Another function of GAM63 is therefore inhibition of FLJ31821 (Accession NP_694574.1). Accordingly, utilities of GAM63 include diagnosis, prevention and treatment of diseases and clinical conditions associated with FLJ31821.

FLJ32065 (Accession NP_694577.1) is another GAM63 target gene, herein designated TARGET GENE. FLJ32065 BINDING SITE is a target binding site found in the 3' untranslated region of mRNA encoded by FLJ32065, corresponding to a target binding site such as BINDING SITE I, BINDING SITE II or BINDING SITE III of FIG. 8. Table 4 illustrates the complementarity of the nucleotide sequences of FLJ32065 BINDING SITE, designated SEQ ID:15838, to the nucleotide sequence of GAM63 RNA, herein designated GAM RNA, also designated SEQ ID:348.

Another function of GAM63 is therefore inhibition of FLJ32065 (Accession NP_694577.1). Accordingly, utilities of GAM63 include diagnosis, prevention and treatment of diseases and clinical conditions associated with FLJ32065.

FLJ32069 (Accession NP_694578.1) is another GAM63 target gene, herein designated TARGET GENE. FLJ32069 BINDING SITE is a target binding site found in the 3' untranslated region of mRNA encoded by FLJ32069, corresponding to a target binding site such as BINDING SITE I, BINDING SITE II or BINDING SITE III of FIG. 8. Table 4 illustrates the complementarity of the nucleotide sequences of FLJ32069 BINDING SITE, designated SEQ ID:10747, to the nucleotide sequence of GAM63 RNA, herein designated GAM RNA, also designated SEQ ID:348.

Another function of GAM63 is therefore inhibition of FLJ32069 (Accession NP_694578.1). Accordingly, utilities of GAM63 include diagnosis, prevention and treatment of diseases and clinical conditions associated with FLJ32069.

FLJ32784 (Accession NP_653224.1) is another GAM63 target gene, herein designated TARGET GENE. FLJ32784 BINDING SITE is a target binding site found in the 3' untranslated region of mRNA encoded by FLJ32784, corresponding to a target binding site such as BINDING SITE I, BINDING SITE II or BINDING SITE III of FIG. 8. Table 4 illustrates the complementarity of the nucleotide sequences of FLJ32784 BINDING SITE, designated SEQ ID:7437, to the nucleotide sequence of GAM63 RNA, herein designated GAM RNA, also designated SEQ ID:348.

Another function of GAM63 is therefore inhibition of FLJ32784 (Accession NP_653224.1). Accordingly, utilities of GAM63 include diagnosis, prevention and treatment of diseases and clinical conditions associated with FLJ32784.

FLJ33610 (Accession NP_775968.1) is another GAM63 target gene, herein designated TARGET GENE. FLJ33610 BINDING SITE is a target binding site found in the 3' untranslated region of mRNA encoded by FLJ33610, corresponding to a target binding site such as BINDING SITE I, BINDING SITE II or BINDING SITE III of FIG. 8. Table 4 illustrates the complementarity of the nucleotide sequences of FLJ33610 BINDING SITE, designated SEQ ID:17301, to the nucleotide sequence of GAM63 RNA, herein designated GAM RNA, also designated SEQ ID:348.

Another function of GAM63 is therefore inhibition of FLJ33610 (Accession NP_775968.1). Accordingly, utilities of GAM63 include diagnosis, prevention and treatment of diseases and clinical conditions associated with FLJ33610.

FLJ33641 (Accession NP_689900.1) is another GAM63 target gene, herein designated TARGET GENE. FLJ33641 BINDING SITE is a target binding site found in the 3' untranslated region of mRNA encoded by FLJ33641, corresponding to a target binding site such as BINDING SITE I, BINDING SITE II or BINDING SITE III of FIG. 8. Table 4 illustrates the complementarity of the nucleotide sequences of FLJ33641 BINDING SITE, designated SEQ ID:15987, to the nucleotide sequence of GAM63 RNA, herein designated GAM RNA, also designated SEQ ID:348.

Another function of GAM63 is therefore inhibition of FLJ33641 (Accession NP_689900.1). Accordingly, utilities of GAM63 include diagnosis, prevention and treatment of diseases and clinical conditions associated with FLJ33641.

FLJ33817 (Accession NP_689561.1) is another GAM63 target gene, herein designated TARGET GENE. FLJ33817 BINDING SITE is a target binding site found in the 3' untranslated region of mRNA encoded by FLJ33817, corresponding to a target binding site such as BINDING SITE I, BINDING SITE II or BINDING SITE III of FIG. 8. Table 4 illustrates the complementarity of the nucleotide sequences of FLJ33817 BINDING SITE, designated SEQ ID:19519, to the nucleotide sequence of GAM63 RNA, herein designated GAM RNA, also designated SEQ ID:348.

Another function of GAM63 is therefore inhibition of FLJ33817 (Accession NP_689561.1). Accordingly, utilities of GAM63 include diagnosis, prevention and treatment of diseases and clinical conditions associated with FLJ33817.

FLJ35220 (Accession NP_775898.2) is another GAM63 target gene, herein designated TARGET GENE. FLJ35220 BINDING SITE is a target binding site found in the 3' untranslated region of mRNA encoded by FLJ35220, corresponding to a target binding site such as BINDING SITE I, BINDING SITE II or BINDING SITE III of FIG. 8. Table 4 illustrates the complementarity of the nucleotide sequences of FLJ35220 BINDING SITE, designated SEQ ID:7479, to the nucleotide sequence of GAM63 RNA, herein designated GAM RNA, also designated SEQ ID:348.

Another function of GAM63 is therefore inhibition of FLJ35220 (Accession NP_775898.2). Accordingly, utilities of GAM63 include diagnosis, prevention and treatment of diseases and clinical conditions associated with FLJ35220.

FLJ35283 (Accession NP_689915.1) is another GAM63 target gene, herein designated TARGET GENE. FLJ35283 BINDING SITE is a target binding site found in the 3' untranslated region of mRNA encoded by FLJ35283, corresponding to a target binding site such as BINDING SITE I, BINDING SITE II or BINDING SITE III of FIG. 8. Table 4 illustrates the complementarity of the nucleotide sequences of FLJ35283 BINDING SITE, designated SEQ ID:19021, to the nucleotide sequence of GAM63 RNA, herein designated GAM RNA, also designated SEQ ID:348.

Another function of GAM63 is therefore inhibition of FLJ35283 (Accession NP_689915.1). Accordingly, utilities of GAM63 include diagnosis, prevention and treatment of diseases and clinical conditions associated with FLJ35283.

FLJ35613 (Accession NP_775924.1) is another GAM63 target gene, herein designated TARGET GENE. FLJ35613 BINDING SITE is a target binding site found in the 3' untranslated region of mRNA encoded by FLJ35613, corresponding to a target binding site such as BINDING SITE I, BINDING SITE II or BINDING SITE III of FIG. 8. Table 4 illustrates the complementarity of the nucleotide sequences of FLJ35613 BINDING SITE, designated SEQ ID:6698, to the nucleotide sequence of GAM63 RNA, herein designated GAM RNA, also designated SEQ ID:348.

Another function of GAM63 is therefore inhibition of FLJ35613 (Accession NP_775924.1). Accordingly, utilities of GAM63 include diagnosis, prevention and treatment of diseases and clinical conditions associated with FLJ35613.

FLJ37478 (Accession NP_848652.1) is another GAM63 target gene, herein designated TARGET GENE. FLJ37478 BINDING SITE is a target binding site found in the 3' untranslated region of mRNA encoded by FLJ37478, corresponding to a target binding site such as BINDING SITE I, BINDING SITE II or BINDING SITE III of FIG. 8. Table 4 illustrates the complementarity of the nucleotide sequences of FLJ37478 BINDING SITE, designated SEQ ID:7911, to the nucleotide sequence of GAM63 RNA, herein designated GAM RNA, also designated SEQ ID:348.

Another function of GAM63 is therefore inhibition of FLJ37478 (Accession NP_848652.1). Accordingly, utilities of GAM63 include diagnosis, prevention and treatment of diseases and clinical conditions associated with FLJ37478.

FLJ38628 (Accession NP_689480.2) is another GAM63 target gene, herein designated TARGET GENE. FLJ38628 BINDING SITE is a target binding site found in the 3' untranslated region of mRNA encoded by FLJ38628, corresponding to a target binding site such as BINDING SITE I, BINDING SITE II or BINDING SITE III of FIG. 8. Table 4 illustrates the complementarity of the nucleotide sequences of FLJ38628 BINDING SITE, designated SEQ ID:3281, to the nucleotide sequence of GAM63 RNA, herein designated GAM RNA, also designated SEQ ID:348.

Another function of GAM63 is therefore inhibition of FLJ38628 (Accession NP_689480.2). Accordingly, utilities of GAM63 include diagnosis, prevention and treatment of diseases and clinical conditions associated with FLJ38628.

FLJ38792 (Accession NP_848615.1) is another GAM63 target gene, herein designated TARGET GENE. FLJ38792 BINDING SITE is a target binding site found in the 3' untranslated region of mRNA encoded by FLJ38792, corresponding to a target binding site such as BINDING SITE I, BINDING SITE II or BINDING SITE III of FIG. 8. Table 4 illustrates the complementarity of the nucleotide sequences of FLJ38792 BINDING SITE, designated SEQ ID:2686, to the nucleotide sequence of GAM63 RNA, herein designated GAM RNA, also designated SEQ ID:348.

Another function of GAM63 is therefore inhibition of FLJ38792 (Accession NP_848615.1). Accordingly, utilities of GAM63 include diagnosis, prevention and treatment of diseases and clinical conditions associated with FLJ38792.

FLJ39249 (Accession NP_775935.1) is another GAM63 target gene, herein designated TARGET GENE. FLJ39249 BINDING SITE is a target binding site found in the 3' untranslated region of mRNA encoded by FLJ39249, corresponding to a target binding site such as BINDING SITE I, BINDING SITE II or BINDING SITE III of FIG. 8. Table 4 illustrates the complementarity of the nucleotide sequences of FLJ39249 BINDING SITE, designated SEQ ID:16239, to the nucleotide sequence of GAM63 RNA, herein designated GAM RNA, also designated SEQ ID:348.

Another function of GAM63 is therefore inhibition of FLJ39249 (Accession NP_775935.1). Accordingly, utilities of GAM63 include diagnosis, prevention and treatment of diseases and clinical conditions associated with FLJ39249.

Flavin containing monooxygenase 4 (FMO4, Accession NP_002013.1) is another GAM63 target gene, herein designated TARGET GENE. FMO4 BINDING SITE is a target binding site found in the 3' untranslated region of mRNA encoded by FMO4, corresponding to a target binding site such as BINDING SITE I, BINDING SITE II or BINDING SITE III of FIG. 8. Table 4 illustrates the complementarity of the nucleotide sequences of FMO4 BINDING SITE, designated SEQ ID:13036, to the nucleotide sequence of GAM63 RNA, herein designated GAM RNA, also designated SEQ ID:348.

Another function of GAM63 is therefore inhibition of Flavin containing monooxygenase 4 (FMO4, Accession NP_002013.1). Accordingly, utilities of GAM63 include diagnosis, prevention and treatment of diseases and clinical conditions associated with FMO4.

Frequenin homolog (drosophila) (FREQ, Accession NP_055101.2) is another GAM63 target gene, herein designated TARGET GENE. FREQ BINDING SITE is a target binding site found in the 3' untranslated region of mRNA encoded by FREQ, corresponding to a target binding site such as BINDING SITE I, BINDING SITE II or BINDING SITE III of FIG. 8. Table 4 illustrates the complementarity of the nucleotide sequences of FREQ BINDING SITE, designated SEQ ID:12692, to the nucleotide sequence of GAM63 RNA, herein designated GAM RNA, also designated SEQ ID:348.

Another function of GAM63 is therefore inhibition of Frequenin homolog (drosophila) (FREQ, Accession NP_055101.2). Accordingly, utilities of GAM63 include diagnosis, prevention and treatment of diseases and clinical conditions associated with FREQ.

Ferritin, light polypeptide (FTL, Accession NP_000137.2) is another GAM63 target gene, herein designated TARGET GENE. FTL BINDING SITE is a target binding site found in the 5' untranslated region of mRNA encoded by FTL, corresponding to a target binding site such as BINDING SITE I, BINDING SITE II or BINDING SITE III of FIG. 8. Table 4 illustrates the complementarity of the nucleotide sequences of FTL BINDING SITE, designated SEQ ID:15882, to the nucleotide sequence of GAM63 RNA, herein designated GAM RNA, also designated SEQ ID:348.

Another function of GAM63 is therefore inhibition of Ferritin, light polypeptide (FTL, Accession NP_000137.2), a gene which stores iron in a soluble, nontoxic, readily available form. and therefore is associated with Hereditary hyperferritinemia-cataract syndrome. Accordingly, utilities of GAM63 include diagnosis, prevention and treatment of Hereditary hyperferritinemia-cataract syndrome, and of other diseases and clinical conditions associated with FTL.

The function of FTL has been established by previous studies. Beaumont et al. (1995) identified a mutation in the iron-responsive element (IRE) in the 5- prime noncoding region of the FTL gene (134790.0001) in the hyperferritinemia- cataract syndrome (OMIM Ref. No. 600886). Ferritin is the major intracellular iron storage protein in all organisms. It has the shape of a hollow sphere that permits entry of a variable amount of iron for storage as ferric hydroxide phosphate complexes. Mammalian liver and spleen ferritin (relative mass about 450,000) consists of 24 subunits of 2 species, the heavy subunit (relative mass =21,000) and the light subunit (relative mass =19,000). Brown et al. (1983) presented evidence that, in the rat, the 2 species of subunits are coded by separate mRNAs. Furthermore, a family of genes appear to encode the light subunit. Studies of ferritin synthesis in cell-free systems suggested that the H and L subunits have different mRNA molecules (Watanabe and Drysdale, 1981). By study of human/Chinese hamster hybrid cells and use of a radioimmunoassay specific for human ferritin, Caskey et al. (1983) showed that chromosome 19 encodes the structural gene for ferritin. Thus, mutation in the structural gene for ferritin is not responsible for hemochromatosis (OMIM Ref. No. 235200), since that disorder is coded by chromosome 6. By in situ hybridization, McGill et al. (1984) confirmed the assignment of the light chain gene to chromosome 19 but concluded that the heavy chain is encoded by 1p. By study of hamster-human and mouse-human hybrid cells, some with translocations involving chromosome 19, Worwood et al. (1985) concluded that light subunits of ferritin (rich in human spleen ferritin) are coded by a gene in segment 19q13.3-qter and that the gene for the heavy subunit (rich in human heart ferritin) is located on chromosome 11. By miniaturized restriction enzyme analysis of sorted chromosomes, Lebo et al. (1985) demonstrated ferritin light-chain genes on at least 3 chromosomes. Munro et al. (1988) reviewed information on the ferritin genes. They pointed out that in both the rat and the human, several ferritin pseudogenes can be recognized not only because they are flanked by 5-prime and 3-prime direct repeats representing the site of their retroinsertion into the chromatin, but also because they differ from functional genes by the absence of introns and by the presence of polyadenylic acid tails that have been inserted onto the 3-prime end of the messenger transcription of the functional gene. They cited the evidence of Santoro et al. (1986) and of Hentze et al. (1986) that there is only one expressed H and one expressed L gene in the human genome.

Full details of the abovementioned studies are described in the following publications, the disclosure of which are hereby incorporated by reference:

Beaumont, C.; Leneuve, P.; Devaux, I.; Scoazec, J.-Y.; Berthier, M.; Loiseau, M.- N.; Grandchamp, B.; Bonneau, D.: Mutation in the iron responsive element of the L ferritin mRNA in a family with dominant hyperferritinaemia and cataract. Nature Genet. 11:444-446, 1995; and Worwood, M.; Brook, J. D.; Cragg, S. J.; Hellkuhl, B.; Jones, B. M.; Perera, P.; Roberts, S. H.; Shaw, D. J.: Assignment of human ferritin genes to chromosomes 11 and 19q13.3-19qter. H.

Further studies establishing the function and utilities of FTL are found in John Hopkins OMIM database record ID 134790, and in cited publications listed in Table 5, which are hereby incorporated by reference. Fyve and coiled-coil domain containing 1 (FYCO1, Accession NP_078789.1) is another GAM63 target gene, herein designated TARGET GENE. FYCO1 BINDING SITE is a target binding site found in the 3' untranslated region of mRNA encoded by FYCO1, corresponding to a target binding site such as BINDING SITE I, BINDING SITE II or BINDING SITE III of FIG. 8. Table 4 illustrates the complementarity of the nucleotide sequences of FYCO1 BINDING SITE, designated SEQ ID:19663, to the nucleotide sequence of GAM63 RNA, herein designated GAM RNA, also designated SEQ ID:348.

Another function of GAM63 is therefore inhibition of Fyve and coiled-coil domain containing 1 (FYCO1, Accession NP_078789.1). Accordingly, utilities of GAM63 include diagnosis, prevention and treatment of diseases and clinical conditions associated with FYCO1.

Grb2-associated binding protein 2 (GAB2, Accession NP_036428.1) is another GAM63 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:7245, to the nucleotide sequence of GAM63 RNA, herein designated GAM RNA, also designated SEQ ID:348.

Another function of GAM63 is therefore inhibition of Grb2-associated binding protein 2 (GAB2, Accession NP_036428.1), a gene which act as adapters for transmitting various signals. Accordingly, utilities of GAM63 include diagnosis, prevention and treatment of diseases and clinical conditions associated with GAB2.

The function of GAB2 has been established by previous studies. The GAB2 gene encodes a 100-kd adapter molecule that is the principal activator of phosphatidylinositol-3 kinase (PIK3; OMIM Ref. No. 171833) in response to activation of the high affinity IgE receptor (see OMIM Ref. No. 147140). Zhao et al. (1999) demonstrated that upon tyrosine phosphorylation, GAB2 physically interacts with SHP2 tyrosine phosphatase and GRB2 adapter protein (OMIM Ref. No. 604330). GAB2 has an inhibitory effect on the activation of ELK1 (OMIM Ref. No. 311040)-dependent transcription triggered by a dominant active Ras (OMIM Ref. No. 190020) mutant or under growth factor stimulation, whereas GAB1 acts to potentiate slightly the ELK1 activity in the same system. In contrast to the reciprocal effects of GAB1 and GAB2 in mediating ELK1 induction, these 2 molecules have a similar function in extracellular signal-regulated kinase activation induced by either oncogenic Ras or growth factor stimulation. Zhao et al. (1999) concluded that GAB1 and GAB2 may have distinct roles in coupling cytoplasmic-nuclear signal transduction.

Animal model experiments lend further support to the function of GAB2. Gu et al. (2001) generated mice deficient in Gab2 by homologous recombination. Gab2 -/- mice were viable and generally healthy; however, the response of Gab2 -/-mast cells to stimulation of the high affinity IgE receptor Fc-epsilon-RI (see OMIM Ref. No. 147140) was defective. Accordingly, allergic reactions, such as passive cutaneous and systemic anaphylaxis, were markedly impaired in Gab -/- mice. Biochemical analyses revealed that signaling pathways dependent on phosphatidylinositol-3 hydroxykinase (PI3K), a critical component of the Fc-epsilon-RI signaling, were defective in Gab2 -/-mast cells. Gu et al. (2001) concluded that GAB2 is the principal activator of PI3K in response to Fc-epsilon-RI activation, thereby providing genetic evidence that Dos/Gab family scaffolds regulate the PI3K pathway in vivo.

It is appreciated that the abovementioned animal model for GAB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gu, H.; Saito, K.; Klaman, L. D.; Shen, J.; Fleming, T.; Wang, Y.-P.; Pratt, J. C.; Lin, G.; Lim, B.; Kinet, J.-P.; Neel, B. G.: Essential role for Gab2 in the allergic response. Nature 412:186-190, 2001; and Zhao, C.; y, D.-H.; Shen, R.; Feng, G.-S.: Gab2, a new pleckstrin homology domain-containing adapter protein, acts to uncouple signaling from ERK kinase to Elk- 1. J. Biol. Chem. 274.

Further studies establishing the function and utilities of GAB2 are found in John Hopkins OMIM database record ID 606203, and in cited publications listed in Table 5, which are hereby incorporated by reference. Grb2-associated binding protein 2 (GAB2, Accession NP_536739.1) is another GAM63 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:7245, to the nucleotide sequence of GAM63 RNA, herein designated GAM RNA, also designated SEQ ID:348.

Another function of GAM63 is therefore inhibition of Grb2-associated binding protein 2 (GAB2, Accession NP_536739.1), a gene which act as adapters for transmitting various signals. Accordingly, utilities of GAM63 include diagnosis, prevention and treatment of diseases and clinical conditions associated with GAB2.

The function of GAB2 has been established by previous studies. The GAB2 gene encodes a 100-kd adapter molecule that is the principal activator of phosphatidylinositol-3 kinase (PIK3; OMIM Ref. No. 171833) in response to activation of the high affinity IgE receptor (see OMIM Ref. No. 147140). Zhao et al. (1999) demonstrated that upon tyrosine phosphorylation, GAB2 physically interacts with SHP2 tyrosine phosphatase and GRB2 adapter protein (OMIM Ref. No. 604330). GAB2 has an inhibitory effect on the activation of ELK1 (OMIM Ref. No. 311040)-dependent transcription triggered by a dominant active Ras (OMIM Ref. No. 190020) mutant or under growth factor stimulation, whereas GAB1 acts to potentiate slightly the ELK1 activity in the same system. In contrast to the reciprocal effects of GAB1 and GAB2 in mediating ELK1 induction, these 2 molecules have a similar function in extracellular signal-regulated kinase activation induced by either oncogenic Ras or growth factor stimulation. Zhao et al. (1999) concluded that GAB1 and GAB2 may have distinct roles in coupling cytoplasmic-nuclear signal transduction.

Animal model experiments lend further support to the function of GAB2. Gu et al. (2001) generated mice deficient in Gab2 by homologous recombination. Gab2 -/- mice were viable and generally healthy; however, the response of Gab2 -/-mast cells to stimulation of the high affinity IgE receptor Fc-epsilon-RI (see OMIM Ref. No. 147140) was defective. Accordingly, allergic reactions, such as passive cutaneous and systemic anaphylaxis, were markedly impaired in Gab -/- mice. Biochemical analyses revealed that signaling pathways dependent on phosphatidylinositol-3 hydroxykinase (PI3K), a critical component of the Fc-epsilon-RI signaling, were defective in Gab2 -/-mast cells. Gu et al. (2001) concluded that GAB2 is the principal activator of PI3K in response to Fc-epsilon-RI activation, thereby providing genetic evidence that Dos/Gab family scaffolds regulate the PI3K pathway in vivo.

It is appreciated that the abovementioned animal model for GAB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gu, H.; Saito, K.; Klaman, L. D.; Shen, J.; Fleming, T.; Wang, Y.-P.; Pratt, J. C.; Lin, G.; Lim, B.; Kinet, J.-P.; Neel, B. G.: Essential role for Gab2 in the allergic response. Nature 412:186-190, 2001; and Zhao, C.; y, D.-H.; Shen, R.; Feng, G.-S.: Gab2, a new pleckstrin homology domain-containing adapter protein, acts to uncouple signaling from ERK kinase to Elk- 1. J. Biol. Chem. 274.

Further studies establishing the function and utilities of GAB2 are found in John Hopkins OMIM database record ID 606203, and in cited publications listed in Table 5, which are hereby incorporated by reference. Gamma-aminobutyric acid (gaba) b receptor, 1 (GABBR1, Accession NP_001461.1) is another GAM63 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:19441, to the nucleotide sequence of GAM63 RNA, herein designated GAM RNA, also designated SEQ ID:348.

Another function of GAM63 is therefore inhibition of Gamma-aminobutyric acid (gaba) b receptor, 1 (GABBR1, Accession NP_001461.1). Accordingly, utilities of GAM63 include diagnosis, prevention and treatment of diseases and clinical conditions associated with GABBR1.

Gamma-aminobutyric acid (gaba) b receptor, 1 (GABBR1, Accession NP_068704.1) is another GAM63 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:19441, to the nucleotide sequence of GAM63 RNA, herein designated GAM RNA, also designated SEQ ID:348.

Another function of GAM63 is therefore inhibition of Gamma-aminobutyric acid (gaba) b receptor, 1 (GABBR1, Accession NP_068704.1). Accordingly, utilities of GAM63 include diagnosis, prevention and treatment of diseases and clinical conditions associated with GABBR1.

Gamma-aminobutyric acid (gaba) b receptor, 1 (GABBR1, Accession NP_068705.1) is another GAM63 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:19441, to the nucleotide sequence of GAM63 RNA, herein designated GAM RNA, also designated SEQ ID:348.

Another function of GAM63 is therefore inhibition of Gamma-aminobutyric acid (gaba) b receptor, 1 (GABBR1, Accession NP_068705.1). Accordingly, utilities of GAM63 include diagnosis, prevention and treatment of diseases and clinical conditions associated with GABBR1.

Gamma-aminobutyric acid (gaba) b receptor, 1 (GABBR1, Accession NP_068703.1) is another GAM63 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:19441, to the nucleotide sequence of GAM63 RNA, herein designated GAM RNA, also designated SEQ ID:348.

Another function of GAM63 is therefore inhibition of Gamma-aminobutyric acid (gaba) b receptor, 1 (GABBR1, Accession NP_068703.1). Accordingly, utilities of GAM63 include diagnosis, prevention and treatment of diseases and clinical conditions associated with GABBR1.

Gata binding protein 4 (GATA4, Accession NP_002043.1) is another GAM63 target gene, herein designated TARGET GENE. GATA4 BINDING SITE is a target binding site found in the 3' untranslated region of mRNA encoded by GATA4, corresponding to a target binding site such as BINDING SITE I, BINDING SITE II or BINDING SITE III of FIG. 8. Table 4 illustrates the complementarity of the nucleotide sequences of GATA4 BINDING SITE, designated SEQ ID:980, to the nucleotide sequence of GAM63 RNA, herein designated GAM RNA, also designated SEQ ID:348.

Another function of GAM63 is therefore inhibition of Gata binding protein 4 (GATA4, Accession NP_002043.1), a gene which regulates genes critical for myocardial differentiation and function. and therefore may be associated with Cardiac hypertrophy and sex cord-derived ovarian tumors. Accordingly, utilities of GAM63 include diagnosis, prevention and treatment of Cardiac hypertrophy and sex cord-derived ovarian tumors, and of other diseases and clinical conditions associated with GATA4.

The function of GATA4 has been established by previous studies. Hasegawa et al. (1997) presented evidence implicating GATA4 as a mediator of changes in gene expression associated with cardiac hypertrophy. The authors injected a luciferase reporter construct driven by the cardiac beta-myosin heavy chain (MYH7; 160760) promoter region into rat myocardium in vivo. Cardiac hypertrophy was induced by surgical aortic constriction. Reporter gene expression in hypertrophic myocardium after 23 days was 3 times higher than that in sham controls (P less than 0.005); however, mutation of the GATA motif markedly reduced this response. Hasegawa et al. (1997) concluded that interaction between GATA4 and the GATA element plays a role in the transcriptional activation of MYH7 during pressure overload cardiac hypertrophy.

Animal model experiments lend further support to the function of GATA4. Crispino et al. (2001) created mice harboring a single amino acid replacement in Gata4 that impaired the ability of the protein to interact with Fog2. These mice died just after embryonic day 12.5 and exhibited features similar to Fog2-null embryos, most notably absence of coronary vasculature and reduced staining for Flk1 (OMIM Ref. No. 191306) and intracellular adhesion molecule-2 (ICAM2; 146630). However, the Gata4 mutant mice also showed semilunar cardiac valve defects and a double-outlet right ventricle not seen in Fog2-null mice. Crispino et al. (2001) concluded that GATA4 function is dependent on interaction with FOG2 and likely with an additional cardiac-specific FOG protein.

It is appreciated that the abovementioned animal model for GATA4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Crispino, J. D.; Lodish, M. B.; Thurberg, B. L.; Litovsky, S. H.; Collins, T.; Molkentin, J. D.; Orkin, S. H.: Proper coronary vascular development and heart morphogenesis depend on interaction of GATA-4 with FOG cofactors. Genes Dev. 15:839-844, 2001; and Hasegawa, K.; Lee, S. J.; Jobe, S. M.; Markham, B. E.; Kitsis, R. N.: cis-acting sequences that mediate induction of beta-myosin heavy chain gene expression during left ventricular hyp.

Further studies establishing the function and utilities of GATA4 are found in John Hopkins OMIM database record ID 600576, and in cited publications listed in Table 5, which are hereby incorporated by reference. Golgi-specific brefeldin a resistance factor 1 (GBF1, Accession NP_004184.1) is another GAM63 target gene, herein designated TARGET GENE. GBF1 BINDING SITE1 and GBF1 BINDING SITE2 are target binding sites found in untranslated regions of mRNA encoded by GBF1, corresponding to target binding sites such as BINDING SITE I, BINDING SITE II or BINDING SITE III of FIG. 8. Table 4 illustrates the complementarity of the nucleotide sequences of GBF1 BINDING SITE1 and GBF1 BINDING SITE2, designated SEQ ID:2843 and SEQ ID:12139 respectively, to the nucleotide sequence of GAM63 RNA, herein designated GAM RNA, also designated SEQ ID:348.

Another function of GAM63 is therefore inhibition of Golgi-specific brefeldin a resistance factor 1 (GBF1, Accession NP_004184.1), a gene which promotes guanine-nucleotide exchange on arf5. Accordingly, utilities of GAM63 include diagnosis, prevention and treatment of diseases and clinical conditions associated with GBF1.

The function of GBF1 has been established by previous studies. Members of the Sec7 domain family share a conserved region that forms a catalytic fold with guanine nucleotide exchange activity. In vitro, the Sec7 domain of several proteins catalyzes the activation of ADP-ribosylation factors (ARFs; OMIM Ref. No. 103180), suggesting that members of the Sec7 domain family represent specific guanine nucleotide exchange factors for the ARF GTPase family. Nagase et al. (1996) isolated KIAA0248, a partial cDNA from immature myeloid cells encoding a protein with homology to S. cerevisiae Sec7. Using 5-prime RACE, Mansour et al. (1998) isolated a cDNA corresponding to the remainder of the coding sequence. They designated the gene GBF1 (Golgi-specific brefeldin A resistance factor-1). The predicted 1,859-amino acid protein has a pI of 5.55 and contains a Sec7 domain and a proline-rich C terminus. A 7-kb GBF1 mRNA was expressed in all tissues tested by Northern blot analysis. By analysis of a somatic cell hybrid panel and by fluorescence in situ hybridization, Mansour et al. (1998) mapped the GBF1 gene to 10q24. Another Sec7 domain family member, PSD (OMIM Ref. No. 602327), maps to the same region.

Full details of the abovementioned studies are described in the following publications, the disclosure of which are hereby incorporated by reference:

Mansour, S. J.; Herbrick, J.-A.; Scherer, S. W.; Melancon, P.: Human GBF1 is a ubiquitously expressed gene of the Sec7 domain family mapping to 10q24. Genomics 54:323-327, 1998; and Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human g.

Further studies establishing the function and utilities of GBF1 are found in John Hopkins OMIM database record ID 603698, and in cited publications listed in Table 5, which are hereby incorporated by reference. GENX-3414 (Accession NP_003934.1) is another GAM63 target gene, herein designated TARGET GENE. GENX-3414 BINDING SITE is a target binding site found in the 3' untranslated region of mRNA encoded by GENX-3414, corresponding to a target binding site such as BINDING SITE I, BINDING SITE II or BINDING SITE III of FIG. 8. Table 4 illustrates the complementarity of the nucleotide sequences of GENX-3414 BINDING SITE, designated SEQ ID:3554, to the nucleotide sequence of GAM63 RNA, herein designated GAM RNA, also designated SEQ ID:348.

Another function of GAM63 is therefore inhibition of GENX-3414 (Accession NP_003934.1). Accordingly, utilities of GAM63 include diagnosis, prevention and treatment of diseases and clinical conditions associated with GENX-3414.

Gamma-glutamyltransferase-like activity 1 (GGTLA1, Accession NP_004112.1) is another GAM63 target gene, herein designated TARGET GENE. GGTLA1 BINDING SITE is a target binding site found in the 5' untranslated region of mRNA encoded by GGTLA1, corresponding to a target binding site such as BINDING SITE I, BINDING SITE II or BINDING SITE III of FIG. 8. Table 4 illustrates the complementarity of the nucleotide sequences of GGTLA1 BINDING SITE, designated SEQ ID:9172, to the nucleotide sequence of GAM63 RNA, herein designated GAM RNA, also designated SEQ ID:348.

Another function of GAM63 is therefore inhibition of Gamma-glutamyltransferase-like activity 1 (GGTLA1, Accession NP_004112.1). Accordingly, utilities of GAM63 include diagnosis, prevention and treatment of diseases and clinical conditions associated with GGTLA1.

G protein-coupled receptor 56 (GPR56, Accession NP_005673.2) is another GAM63 target gene, herein designated TARGET GENE. GPR56 BINDING SITE is a target binding site found in the 3' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:11435, to the nucleotide sequence of GAM63 RNA, herein designated GAM RNA, also designated SEQ ID:348.

Another function of GAM63 is therefore inhibition of G protein-coupled receptor 56 (GPR56, Accession NP_005673.2), a gene which transduces extracellular signals through heterotrimeric G proteins. Accordingly, utilities of GAM63 include diagnosis, prevention and treatment of diseases and clinical conditions associated with GPR56.

The function of GPR56 has been established by previous studies. G protein-coupled receptors (GPRs), which are characterized by the presence of 7 transmembrane domains, are divided into several classes based on sequence characteristics. Class B GPRs, or the secretin-like receptors, include the secretin receptor (OMIM Ref. No. 182098) and the calcitonin receptor (OMIM Ref. No. 114131). The orphan receptors HE6 (OMIM Ref. No. 602657), CD97 (OMIM Ref. No. 601211), EMR1 (OMIM Ref. No. 600493), and BAI1 (OMIM Ref. No. 602682) share significant homology with class B GPRs across the 7-transmembrane region, but have a distinct N-terminal region containing a characteristic cysteine box, which precedes the first membrane-spanning domain, and a mucin-like domain. By PCR of human cDNAs with degenerate primers based on conserved regions from secretin-like receptors, Liu et al. (1999) isolated a cDNA encoding a novel receptor, which they designated GPR56. The predicted 693-amino acid GPR56 protein shares 26 to 32% sequence identity with the 4 class B-like orphan receptors. Like these receptors, GPR56 contains 7 transmembrane domains as well as a mucin-like domain and cysteine box in the N-terminal region. Northern blot analysis revealed that the GPR56 gene was expressed as a 3-kb mRNA in a wide range of tissues, with the highest levels in thyroid. Using in situ hybridization, Liu et al. (1999) determined that the GPR56 gene was expressed selectively within the monolayer of cuboidal epithelial cells of the smaller, more actively secreting follicles of human thyroid. The GPR56 gene contains 13 exons and spans approximately 15 kb. Using differential display, Zendman et al. (1999) identified a GPR56 cDNA as a transcript that was differentially expressed in melanoma cell lines with different metastatic potential. They designated the gene TM7XN1 (7-transmembrane protein with no EGF-like N-terminal domains-1) because the protein lacks the EGF-like domains found in the related GPRs CD97 and EMR1. Zendman et al. (1999) reported that the TM7XN1 protein contains 687 amino acids. RT-PCR and Northern blot analyses indicated that TM7XN1 gene expression was inversely correlated with metastatic potential in melanoma cell lines.

Full details of the abovementioned studies are described in the following publications, the disclosure of which are hereby incorporated by reference:

Liu, M.; Parker, R. M. C.; Darby, K.; Eyre, H. J.; Copeland, N. G.; Crawford, J.; Gilbert, D. J.; Sutherland, G. R.; Jenkins, N. A.; Herzog, H.: GPR56, a novel secretin-like human G-protein-coupled receptor gene. Genomics 55:296-305, 1999; and Zendman, A. J. W.; Cornelissen, I. M. H. A.; Weidle, U. H.; Ruiter, D. J.; van Muijen, G. N. P.: TM7XN1, a novel human EGF-TM7-like cDNA, detected with mRNA differential display using.

Further studies establishing the function and utilities of GPR56 are found in John Hopkins OMIM database record ID 604110, and in cited publications listed in Table 5, which are hereby incorporated by reference. Glutamate receptor, ionotropic, delta 1 (GRID1, Accession XP_043613.8) is another GAM63 target gene, herein designated TARGET GENE. GRID1 BINDING SITE is a target binding site found in the 3' untranslated region of mRNA encoded by GRID1, corresponding to a target binding site such as BINDING SITE I, BINDING SITE II or BINDING SITE III of FIG. 8. Table 4 illustrates the complementarity of the nucleotide sequences of GRID1 BINDING SITE, designated SEQ ID:15134, to the nucleotide sequence of GAM63 RNA, herein designated GAM RNA, also designated SEQ ID:348.

Another function of GAM63 is therefore inhibition of Glutamate receptor, ionotropic, delta 1 (GRID1, Accession XP_043613.8). Accordingly, utilities of GAM63 include diagnosis, prevention and treatment of diseases and clinical conditions associated with GRID1.

Glutamate receptor, metabotropic 6 (GRM6, Accession NP_000834.1) is another GAM63 target gene, herein designated TARGET GENE. GRM6 BINDING SITE is a target binding site found in the 5' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:4232, to the nucleotide sequence of GAM63 RNA, herein designated GAM RNA, also designated SEQ ID:348.

Another function of GAM63 is therefore inhibition of Glutamate receptor, metabotropic 6 (GRM6, Accession NP_000834.1). Accordingly, utilities of GAM63 include diagnosis, prevention and treatment of diseases and clinical conditions associated with GRM6.

Glycogen synthase 1 (muscle) (GYS1, Accession NP_002094.2) is another GAM63 target gene, herein designated TARGET GENE. GYS1 BINDING SITE is a target binding site found in the 3' untranslated region of mRNA encoded by GYS1, corresponding to a target binding site such as BINDING SITE I, BINDING SITE II or BINDING SITE III of FIG. 8. Table 4 illustrates the complementarity of the nucleotide sequences of GYS1 BINDING SITE, designated SEQ ID:14495, to the nucleotide sequence of GAM63 RNA, herein designated GAM RNA, also designated SEQ ID:348.

Another function of GAM63 is therefore inhibition of Glycogen synthase 1 (muscle) (GYS1, Accession NP_002094.2), a gene which transfers the glycosyl residue from udp-glc to the nonreducing end of alpha-1,4-glucan. and therefore may be associated with Type 2 diabetes. Accordingly, utilities of GAM63 include diagnosis, prevention and treatment of Type 2 diabetes, and of other diseases and clinical conditions associated with GYS1.

The function of GYS1 has been established by previous studies. To examine whether defective muscle GYS1 expression is associated with impaired glycogen synthesis in type 2 diabetes and whether the defect is inherited or acquired, Huang et al. (2000) measured GYS1 gene expression and enzyme activity in muscle biopsies taken before and after an insulin clamp in 12 monozygotic twin pairs discordant for type 2 diabetes and in 12 matched control subjects. The effect of insulin on GYS1 fractional activity, when expressed as the increment over the basal values, was significantly impaired in diabetic (15.7 +/-3.3%; P less than 0.01), but not in nondiabetic (23.7 +/-1.8%; P=NS) twins compared with that in control subjects (28.1 +/-2.3%). Insulin increased GYS1 mRNA expression in control subjects (from 0.14 +/-0.02 to 1.74 +/-0.10 relative units; P less than 0.01) and in nondiabetic (from 0.24 +/- 0.05 to 1.81 +/-0.16 relative units; P less than 0.01) and diabetic (from 0.20 +/-0.07 to 1.08 +/-0.14 relative units; P less than 0.01) twins. The effect of insulin on GYS1 expression was, however, significantly reduced in the diabetic (P less than 0.003), but not in the nondiabetic, twins, compared with that in control subjects. The postclamp GYS1 mRNA levels correlated strongly with the hemoglobin A1c levels (r =-0.61; P less than 0.001). The authors concluded that insulin stimulates GYS1 mRNA expression and that impaired stimulation of GYS1 gene expression by insulin in patients with type 2 diabetes is acquired and most likely is secondary to chronic hyperglycemia. Inbred mouse strains fed on a diabetogenic diet (high in fat and sucrose) differ in their propensities to develop features analogous to type 2 diabetes mellitus. To define chromosomal locations that control these characteristics, Seldin et al. (1994) studied recombinant inbred strains from diabetes-prone C57BL/6J and diabetes-resistant A/J strains. Hyperglycemia correlated with the marker D7Mit25 on mouse chromosome 7. This putative susceptibility locus is consistent with that of the glycogen synthase gene, which was implicated by Groop et al. (1993) in the pathogenesis of type 2 diabetes in the human. Seldin et al. (1994) found that fractional glycogen synthase activity in isolated muscle was significantly lower in normal B/6J diabetes-prone mice than in normal diabetes-resistant A/J mice, a finding similar to that reported in relatives of human patients with type 2 diabetes.

Full details of the abovementioned studies are described in the following publications, the disclosure of which are hereby incorporated by reference:

Huang, X.; Vaag, A.; Hansson, M.; Weng, J.; Laurila, E.; Groop, L.: Impaired insulin- stimulated expression of the glycogen synthase gene in skeletal muscle of type 2 diabetic patients is acquired rather than inherited. J. Clin. Endocr. Metab. 85:1584-1590, 2000; and Seldin, M. F.; Mott, D.; Bhat, D.; Petro, A.; Kuhn, C. M.; Kingsmore, S. F.; Bogardus, C.; Opara, E.; Feinglos, M. N.; Surwit, R. S.: Glycogen synthase: a putative locus for diet-induc.

Further studies establishing the function and utilities of GYS1 are found in John Hopkins OMIM database record ID 138570, and in cited publications listed in Table 5, which are hereby incorporated by reference. Histone deacetylase 7a (HDAC7A, Accession NP_057680.2) is another GAM63 target gene, herein designated TARGET GENE. HDAC7A BINDING SITE is a target binding site found in the 3' untranslated region of multiple transcripts of mRNA encoded by HDAC7A, corresponding to a target binding site such as BINDING SITE I, BINDING SITE II or BINDING SITE III of FIG. 8. Table 4 illustrates the complementarity of the nucleotide sequences of HDAC7A BINDING SITE, designated SEQ ID:13926, to the nucleotide sequence of GAM63 RNA, herein designated GAM RNA, also designated SEQ ID:348.

Another function of GAM63 is therefore inhibition of Histone deacetylase 7a (HDAC7A, Accession NP_057680.2). Accordingly, utilities of GAM63 include diagnosis, prevention and treatment of diseases and clinical conditions associated with HDAC7A.

Histone deacetylase 7a (HDAC7A, Accession NP_056216.1) is another GAM63 target gene, herein designated TARGET GENE. HDAC7A BINDING SITE is a target binding site found in the 3' untranslated region of multiple transcripts of mRNA encoded by HDAC7A, corresponding to a target binding site such as BINDING SITE I, BINDING SITE II or BINDING SITE III of FIG. 8. Table 4 illustrates the complementarity of the nucleotide sequences of HDAC7A BINDING SITE, designated SEQ ID:13926, to the nucleotide sequence of GAM63 RNA, herein designated GAM RNA, also designated SEQ ID:348.

Another function of GAM63 is therefore inhibition of Histone deacetylase 7a (HDAC7A, Accession NP_056216.1). Accordingly, utilities of GAM63 include diagnosis, prevention and treatment of diseases and clinical conditions associated with HDAC7A.

HEMK (Accession NP_057257.1) is another GAM63 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:13927, to the nucleotide sequence of GAM63 RNA, herein designated GAM RNA, also designated SEQ ID:348.

Another function of GAM63 is therefore inhibition of HEMK (Accession NP_057257.1). Accordingly, utilities of GAM63 include diagnosis, prevention and treatment of diseases and clinical conditions associated with HEMK.

HH114 (Accession NP_115888.1) is another GAM63 target gene, herein designated TARGET GENE. HH114 BINDING SITE is a target binding site found in the 5' untranslated region of mRNA encoded by HH114, corresponding to a target binding site such as BINDING SITE I, BINDING SITE II or BINDING SITE III of FIG. 8. Table 4 illustrates the complementarity of the nucleotide sequences of HH114 BINDING SITE, designated SEQ ID:14866, to the nucleotide sequence of GAM63 RNA, herein designated GAM RNA, also designated SEQ ID:348.

Another function of GAM63 is therefore inhibition of HH114 (Accession NP_115888.1). Accordingly, utilities of GAM63 include diagnosis, prevention and treatment of diseases and clinical conditions associated with HH114.

Hypoxia inducible factor 3, alpha subunit (HIF3A, Accession NP_690007.1) is another GAM63 target gene, herein designated TARGET GENE. HIF3A BINDING SITE is a target binding site found in the 3' untranslated region of multiple transcripts of mRNA encoded by HIF3A, corresponding to a target binding site such as BINDING SITE I, BINDING SITE II or BINDING SITE III of FIG. 8. Table 4 illustrates the complementarity of the nucleotide sequences of HIF3A BINDING SITE, designated SEQ ID:11103, to the nucleotide sequence of GAM63 RNA, herein designated GAM RNA, also designated SEQ ID:348.

Another function of GAM63 is therefore inhibition of Hypoxia inducible factor 3, alpha subunit (HIF3A, Accession NP_690007.1). Accordingly, utilities of GAM63 include diagnosis, prevention and treatment of diseases and clinical conditions associated with HIF3A.

Human immunodeficiency virus type i enhancer binding protein 3 (HIVEP3, Accession NP_078779.1) is another GAM63 target gene, herein designated TARGET GENE. HIVEP3 BINDING SITE is a target binding site found in the 3' untranslated region of mRNA encoded by HIVEP3, corresponding to a target binding site such as BINDING SITE I, BINDING SITE II or BINDING SITE III of FIG. 8. Table 4 illustrates the complementarity of the nucleotide sequences of HIVEP3 BINDING SITE, designated SEQ ID:11510, to the nucleotide sequence of GAM63 RNA, herein designated GAM RNA, also designated SEQ ID:348.

Another function of GAM63 is therefore inhibition of Human immunodeficiency virus type i enhancer binding protein 3 (HIVEP3, Accession NP_078779.1), a gene which is required for transcriptional activation of glucose- repressible alcohol dehydrogenase (adh2). Accordingly, utilities of GAM63 include diagnosis, prevention and treatment of diseases and clinical conditions associated with HIVEP3.

The function of HIVEP3 has been established by previous studies. Hicar et al. (2001) cloned HIVEP3, a member of the HIVEP family (see OMIM Ref. No. HIVEP1; 194540). HIVEPs encode large zinc finger proteins and regulate transcription via the kappa-B enhancer motif. HIVEP3 is homologous to the mouse Krc (kappa-B-binding and recognition component of the V(D)J recombination signal sequence) protein. The largest open reading frame of HIVEP3 contains 2,406 amino acids and is 80% identical to Krc. RNA studies showed that multiple HIVEP3 transcripts are differentially expressed and regulated. Transcription termination occurs in the ultimate exon, exon 10, or in exon 6. Therefore, HIVEP3 may produce protein isoforms that contain or exclude the C-terminal DNA-binding domain and the leucine zipper by alternative RNA splicing and differential polyadenylation. GENE FUNCTION Oukka et al. (2002) described a function for the zinc finger transcription factor Krc in regulating patterns of gene activation in response to proinflammatory stimuli. Krc overexpression inhibited, while antisense or dominant-negative Krc enhanced, NF-kappa-B (OMIM Ref. No. 164011)-dependent transactivation and JNK (OMIM Ref. No. 601158) phosphorylation and consequently inhibited apoptosis and cytokine gene expression. The effect of Krc was mediated through its interaction with the adaptor protein TRAF2 (OMIM Ref. No. 601895). Oukka et al. (2002) concluded that Krc is a participant in the signal transduction pathway leading from the TNF receptor (see OMIM Ref. No. 602746) to gene activation and may play a critical role in inflammatory and apoptotic responses.

Full details of the abovementioned studies are described in the following publications, the disclosure of which are hereby incorporated by reference:

Hicar, M. D.; Liu, Y.; Allen, C. E.; Wu, L.-C.: Structure of the human zinc finger protein HIVEP3: molecular cloning, expression, exon-intron structure, and comparison with paralogous genes HIVEP1 and HIVEP2. Genomics 71: 89-100, 2001; and Oukka, M.; Kim, S. T.; Lugo, G.; Sun, J.; Wu, L.-C.; Glimcher, L. H.: A mammalian homolog of Drosophila schnurri, KRC, regulates TNF receptor-driven responses and interacts with TRAF2.

Further studies establishing the function and utilities of HIVEP3 are found in John Hopkins OMIM database record ID 606649, and in cited publications listed in Table 5, which are hereby incorporated by reference. Heterogeneous nuclear ribonucleoprotein d-like (HNRPDL, Accession NP_005454.1) is another GAM63 target gene, herein designated TARGET GENE. HNRPDL BINDING SITE is a target binding site found in the 3' untranslated region of multiple transcripts of mRNA encoded by HNRPDL, corresponding to a target binding site such as BINDING SITE I, BINDING SITE II or BINDING SITE III of FIG. 8. Table 4 illustrates the complementarity of the nucleotide sequences of HNRPDL BINDING SITE, designated SEQ ID:17189, to the nucleotide sequence of GAM63 RNA, herein designated GAM RNA, also designated SEQ ID:348.

Another function of GAM63 is therefore inhibition of Heterogeneous nuclear ribonucleoprotein d-like (HNRPDL, Accession NP_005454.1), a gene which binds to rna molecules that contain au-rich elements. Accordingly, utilities of GAM63 include diagnosis, prevention and treatment of diseases and clinical conditions associated with HNRPDL.

The function of HNRPDL has been established by previous studies. Kamei et al. (1999) identified 2 isoforms of HNR- PDL, which they called JKTBP1 and JKTBP2, corresponding to the 1.4- and 2.8-kb transcripts identified by Tsuchiya et al. (1998), respectively. The larger transcript predicts a 420-amino acid protein with a calculated molecular mass of approximately 46.4 kD. The JKTBP2 protein has a longer N terminus, and both proteins contain multiple potential sites for phosphorylation and arginine methylation. Northern blot analysis showed that both transcripts were expressed in all tissues examined, although the amounts and ratios of the transcripts varied in different tissues. Three JKTBP transcripts greater than 2.8 kb were expressed in pancreas, spleen, and thymus. Western blot analysis of myeloid leukemia cells showed proteins of 38 and 53 kD. Tsuchiya et al. (1998) determined that recombinant HNRPDL interacted with both the double- and single-stranded forms of JKT41, an oligodeoxynucleotide corresponding to the cis-acting element in intron 9 of the MPO gene. Recombinant HNRPDL also interacted with poly(G) and poly(A), but not with poly(U) or poly(C). Transient expression of HNRPDL repressed expression of reporter genes located downstream of the intron 9 element of JKT41 or the intron 7 element of FERE27, another oligodeoxynucleotide corresponding to MPO.

Full details of the abovementioned studies are described in the following publications, the disclosure of which are hereby incorporated by reference:

Kamei, D.; Tsuchiy, N.; Yamazaki, M.; Meguro, H.; Yamada, M.: Two forms of expression and genomic structure of the human heterogeneous nuclear ribonucleoprotein D-like JKTBP gene (HNRPDL). Gene 228:13-22, 1999; and Tsuchiy, N.; Kamei, D.; Takano, A.; Matsui, T.; Yamada, M.: Cloning and characterization of a cDNA encoding a novel heterogeneous nuclear ribonucleoprotein- like protein and its expressio.

Further studies establishing the function and utilities of HNRPDL are found in John Hopkins OMIM database record ID 607137, and in cited publications listed in Table 5, which are hereby incorporated by reference. Heterogeneous nuclear ribonucleoprotein d-like (HNRPDL, Accession NP_112740.1) is another GAM63 target gene, herein designated TARGET GENE. HNRPDL BINDING SITE is a target binding site found in the 3' untranslated region of multiple transcripts of mRNA encoded by HNRPDL, corresponding to a target binding site such as BINDING SITE I, BINDING SITE II or BINDING SITE III of FIG. 8. Table 4 illustrates the complementarity of the nucleotide sequences of HNRPDL BINDING SITE, designated SEQ ID:17189, to the nucleotide sequence of GAM63 RNA, herein designated GAM RNA, also designated SEQ ID:348.

Another function of GAM63 is therefore inhibition of Heterogeneous nuclear ribonucleoprotein d-like (HNRPDL, Accession NP_112740.1), a gene which binds to rna molecules that contain au-rich elements. Accordingly, utilities of GAM63 include diagnosis, prevention and treatment of diseases and clinical conditions associated with HNRPDL.

The function of HNRPDL has been established by previous studies. Kamei et al. (1999) identified 2 isoforms of HNRPDL, which they called JKTBP1 and JKTBP2, corresponding to the 1.4- and 2.8-kb transcripts identified by Tsuchiya et al. (1998), respectively. The larger transcript predicts a 420-amino acid protein with a calculated molecular mass of approximately 46.4 kD. The JKTBP2 protein has a longer N terminus, and both proteins contain multiple potential sites for phosphorylation and arginine methylation. Northern blot analysis showed that both transcripts were expressed in all tissues examined, although the amounts and ratios of the transcripts varied in different tissues. Three JKTBP transcripts greater than 2.8 kb were expressed in pancreas, spleen, and thymus. Western blot analysis of myeloid leukemia cells showed proteins of 38 and 53 kD. Tsuchiya et al. (1998) determined that recombinant HNRPDL interacted with both the double- and single-stranded forms of JKT41, an oligodeoxynucleotide corresponding to the cis-acting element in intron 9 of the MPO gene. Recombinant HNRPDL also interacted with poly(G) and poly(A), but not with poly(U) or poly(C). Transient expression of HNRPDL repressed expression of reporter genes located downstream of the intron 9 element of JKT41 or the intron 7 element of FERE27, another oligodeoxynucleotide corresponding to MPO.

Full details of the abovementioned studies are described in the following publications, the disclosure of which are hereby incorporated by reference:

Kamei, D.; Tsuchiy, N.; Yamazaki, M.; Meguro, H.; Yamada, M.: Two forms of expression and genomic structure of the human heterogeneous nuclear ribonucleoprotein D-like JKTBP gene (HNRPDL). Gene 228:13-22, 1999; and Tsuchiy, N.; Kamei, D.; Takano, A.; Matsui, T.; Yamada, M.: Cloning and characterization of a cDNA encoding a novel heterogeneous nuclear ribonucleoprotein- like protein and its expressio.

Further studies establishing the function and utilities of HNRPDL are found in John Hopkins OMIM database record ID 607137, and in cited publications listed in Table 5, which are hereby incorporated by reference. Homeo box a4 (HOXA4, Accession NP_002132.2) is another GAM63 target gene, herein designated TARGET GENE. HOXA4 BINDING SITE is a target binding site found in the 3' untranslated region of mRNA encoded by HOXA4, corresponding to a target binding site such as BINDING SITE I, BINDING SITE II or BINDING SITE III of FIG. 8. Table 4 illustrates the complementarity of the nucleotide sequences of HOXA4 BINDING SITE, designated SEQ ID:3176, to the nucleotide sequence of GAM63 RNA, herein designated GAM RNA, also designated SEQ ID:348.

Another function of GAM63 is therefore inhibition of Homeo box a4 (HOXA4, Accession NP_002132.2). Accordingly, utilities of GAM63 include diagnosis, prevention and treatment of diseases and clinical conditions associated with HOXA4.

HPS6 (Accession NP_079023.1) is another GAM63 target gene, herein designated TARGET GENE. HPS6 BINDING SITE is a target binding site found in the 5' untranslated region of mRNA encoded by HPS6, corresponding to a target binding site such as BINDING SITE I, BINDING SITE II or BINDING SITE III of FIG. 8. Table 4 illustrates the complementarity of the nucleotide sequences of HPS6 BINDING SITE, designated SEQ ID:15251, to the nucleotide sequence of GAM63 RNA, herein designated GAM RNA, also designated SEQ ID:348.

Another function of GAM63 is therefore inhibition of HPS6 (Accession NP_079023.1). Accordingly, utilities of GAM63 include diagnosis, prevention and treatment of diseases and clinical conditions associated with HPS6.

HSN44A4A (Accession NP_056187.1) is another GAM63 target gene, herein designated TARGET GENE. HSN44A4A BINDING SITE is a target binding site found in the 3' untranslated region of mRNA encoded by HSN44A4A, corresponding to a target binding site such as BINDING SITE I, BINDING SITE II or BINDING SITE III of FIG. 8. Table 4 illustrates the complementarity of the nucleotide sequences of HSN44A4A BINDING SITE, designated SEQ ID:15821, to the nucleotide sequence of GAM63 RNA, herein designated GAM RNA, also designated SEQ ID:348.

Another function of GAM63 is therefore inhibition of HSN44A4A (Accession NP_056187.1). Accordingly, utilities of GAM63 include diagnosis, prevention and treatment of diseases and clinical conditions associated with HSN44A4A.

HSPC065 (Accession NP_054876.2) is another GAM63 target gene, herein designated TARGET GENE. HSPC065 BINDING SITE is a target binding site found in the 3' untranslated region of mRNA encoded by HSPC065, corresponding to a target binding site such as BINDING SITE I, BINDING SITE II or BINDING SITE III of FIG. 8. Table 4 illustrates the complementarity of the nucleotide sequences of HSPC065 BINDING SITE, designated SEQ ID:4438, to the nucleotide sequence of GAM63 RNA, herein designated GAM RNA, also designated SEQ ID:348.

Another function of GAM63 is therefore inhibition of HSPC065 (Accession NP_054876.2). Accordingly, utilities of GAM63 include diagnosis, prevention and treatment of diseases and clinical conditions associated with HSPC065.

Immune associated nucleotide 4 like 1 (mouse) (IAN4L1, Accession NP_060854.2) is another GAM63 target gene, herein designated TARGET GENE. IAN4L1 BINDING SITE is a target binding site found in the 3' untranslated region of mRNA encoded by IAN4L1, corresponding to a target binding site such as BINDING SITE I, BINDING SITE II or BINDING SITE III of FIG. 8. Table 4 illustrates the complementarity of the nucleotide sequences of IAN4L1 BINDING SITE, designated SEQ ID:4785, to the nucleotide sequence of GAM63 RNA, herein designated GAM RNA, also designated SEQ ID:348.

Another function of GAM63 is therefore inhibition of Immune associated nucleotide 4 like 1 (mouse) (IAN4L1, Accession NP_060854.2). Accordingly, utilities of GAM63 include diagnosis, prevention and treatment of diseases and clinical conditions associated with IAN4L1.

Isocitrate dehydrogenase 3 (nad+) gamma (IDH3G, Accession NP_777358.1) is another GAM63 target gene, herein designated TARGET GENE. IDH3G BINDING SITE is a target binding site found in the 3' untranslated region of multiple transcripts of mRNA encoded by IDH3G, corresponding to a target binding site such as BINDING SITE I, BINDING SITE II or BINDING SITE III of FIG. 8. Table 4 illustrates the complementarity of the nucleotide sequences of IDH3G BINDING SITE, designated SEQ ID:7580, to the nucleotide sequence of GAM63 RNA, herein designated GAM RNA, also designated SEQ ID:348.

Another function of GAM63 is therefore inhibition of Isocitrate dehydrogenase 3 (nad+) gamma (IDH3G, Accession NP_777358.1), a gene which decarboxylates isocitrate into alpha-ketoglutarate and therefore may be associated with Bilateral periventricular nodular heterotopia. Accordingly, utilities of GAM63 include diagnosis, prevention and treatment of Bilateral periventricular nodular heterotopia, and of other diseases and clinical conditions associated with IDH3G.

The function of IDH3G has been established by previous studies. Brenner et al. (1997) presented the entire genomic sequence, as well as the cDNA sequence, of the human gene encoding the gamma subunit of the NAD(+)-dependent isocitrate dehydrogenase (IDH-gamma). The gene, symbolized IDH3G, is located in the region Xq28, approximately 70 kb telomeric to the adrenoleukodystrophy locus (ALD; 300100) and adjacent to the TRAP-delta gene (OMIM Ref. No. 300090), which they also cloned. The sequences of the transcripts of IDH-gamma and TRAP-delta were obtained by searching the EST database with genomic data. Identified ESTs were completely sequenced and assembled to cDNAs comprising the entire coding region. For IDH-gamma, several EST clones indicated differential splicing. The 2 genes are arranged in a compact head- to - head manner. The non-transcribed intergenic region comprises only 133 bp and is embedded in a CpG island. Brenner et al. (1997) concluded that the CpG island functions as a bidirectional promoter to initiate the transcription of both functionally unrelated genes with quite distinct expression patterns. Brenner et al. (1997) showed that in both rat and mouse, this region of the genome is similarly compact and comprises less than 249 bp in rat and not more than 164 bp in mouse. In both cases this intergenic region is embedded in a CpG island and is highly conserved, with nucleotide identity values ranging from 70.1% between human and rat to 92.6% between mouse and rat. In a male patient with periventricular heterotopia (OMIM Ref. No. 300049) and a large duplication of Xq28 reported by Fink et al. (1997), Fox et al. (1998) found that the centromeric boundary of the duplicated segment of Xq28 was base 3377 of the 3,395 bases of intron 1 of the IDH3G gene, approximately 600 kb distal to DXS15.

Full details of the abovementioned studies are described in the following publications, the disclosure of which are hereby incorporated by reference:

Fink, J. M.; Dobyns, W. B.; Guerrini, R.; Hirsch, B. A.: Identification of a duplication of Xq28 associated with bilateral periventricular nodular heterotopia. Am. J. Hum. Genet. 61:379-387, 1997; and Fox, J. W.; Lamperti, E. D.; Eksioglu, Y. Z.; Hong, S. E.; Feng, Y.; Graham, D. A.; Scheffer, I. E.; Dobyns, W. B.; Hirsch, B. A.; Radtke, R. A.; Berkovic, S. F.; Huttenlocher, P. R.; Wa.

Further studies establishing the function and utilities of IDH3G are found in John Hopkins OMIM database record ID 300089, and in cited publications listed in Table 5, which are hereby incorporated by reference. Immunoglobulin superfamily, member 9 (IGSF9, Accession NP_065840.1) is another GAM63 target gene, herein designated TARGET GENE. IGSF9 BINDING SITE is a target binding site found in the 5' untranslated region of mRNA encoded by IGSF9, corresponding to a target binding site such as BINDING SITE I, BINDING SITE II or BINDING SITE III of FIG. 8. Table 4 illustrates the complementarity of the nucleotide sequences of IGSF9 BINDING SITE, designated SEQ ID:2016, to the nucleotide sequence of GAM63 RNA, herein designated GAM RNA, also designated SEQ ID:348.

Another function of GAM63 is therefore inhibition of Immunoglobulin superfamily, member 9 (IGSF9, Accession NP_065840.1). Accordingly, utilities of GAM63 include diagnosis, prevention and treatment of diseases and clinical conditions associated with IGSF9.

Interleukin 17b (IL17B, Accession NP_055258.1) is another GAM63 target gene, herein designated TARGET GENE. IL17B BINDING SITE is a target binding site found in the 3' untranslated region of mRNA encoded by IL17B, corresponding to a target binding site such as BINDING SITE I, BINDING SITE II or BINDING SITE III of FIG. 8. Table 4 illustrates the complementarity of the nucleotide sequences of IL17B BINDING SITE, designated SEQ ID:5717, to the nucleotide sequence of GAM63 RNA, herein designated GAM RNA, also designated SEQ ID:348.

Another function of GAM63 is therefore inhibition of Interleukin 17b (IL17B, Accession NP_055258.1), a gene which may play an important role in the initiation or maintenance of the proinflammatory response. Accordingly, utilities of GAM63 include diagnosis, prevention and treatment of diseases and clinical conditions associated with IL17B.

The function of IL17B has been established by previous studies. Interleukin-17 (IL17; 603149) is a T cell-derived cytokine that may play an important role in the initiation or maintenance of the proinflammatory response. Whereas expression of IL17 is restricted to activated T cells, the IL17 receptor (IL17R; 605461) has been shown to be widely expressed, a finding consistent with the pleiotropic activities of IL17. Li et al. (2000) cloned and expressed 2 novel human cytokines, IL17B and IL17C (OMIM Ref. No. 604628), that are related to IL17 (approximately 27% amino acid identity). Northern blot analysis detected an 800-bp IL17B mRNA in adult pancreas, small intestine, and stomach, whereas IL17C mRNA was not detected in several adult tissues. No expression of IL17B or IL17C mRNA was found in activated T cells. The authors found that IL17B and IL17C differ from IL17 in their patterns of expression and biologic activities. These findings, coupled with the lack of interaction with the known IL17 receptor, suggested an expanded role for the IL17 family in the proinflammatory immune response Shi et al. (2000) cloned a cDNA encoding IL17B, which they initially designated IL20. The deduced 184-amino acid protein, 88% identical to the mouse sequence, has a 20-amino acid leader sequence, 1 potential N-glycosylation site, and 8 cysteine residues. Northern blot analysis detected a 1.0-kb transcript in spinal cord, testis, and small intestine, with less pronounced expression in prostate, colon mucosal lining, and ovary. SDS-PAGE analysis determined that IL17B is expressed as 23-, 22-, and 18-kD proteins under reducing conditions. Size-exclusion analysis suggested that IL17B is a nondisulfide-linked dimer. BIAcore, flow cytometric, and Western blot analyses determined that IL17B binds with high affinity to IL17BR (OMIM Ref. No. 605458) but only poorly to IL17R. Analysis of cultured cells showed that IL17B, in contrast to IL17, does not activate nuclear factor kappa-B (NFKB; OMIM Ref. No. 164011) or induce the production of cytokine message or protein Full details of the abovementioned studies are described in the following publications, the disclosure of which are hereby incorporated by reference:

Li, H.; Chen, J.; Huang, A.; Stinson, J.; Heldens, S.; Foster, J.; Dowd, P.; Gurney, A. L.; Wood, W. I.: Cloning and characterization of IL-17B and IL-17C, two new members of the IL-17 cytokine family. Proc. Nat. Acad. Sci. 97:773-778, 2000; and Shi, Y.; Ullrich, S. J.; Zhang, J.; Connolly, K.; Grzegorzewski, K. J.; Barber, M. C.; Wang, W.; Wathen, K.; Hodge, V.; Fisher, C. L.; Olsen, H.; Ruben, S. M.; Knyazev, I.; Cho, Y. H.

Further studies establishing the function and utilities of IL17B are found in John Hopkins OMIM database record ID 604627, and in cited publications listed in Table 5, which are hereby incorporated by reference. Interleukin 2 receptor, gamma (severe combined immunodeficiency) (IL2RG, Accession NP_000197.1) is another GAM63 target gene, herein designated TARGET GENE. IL2RG BINDING SITE is a target binding site found in the 3' untranslated region of mRNA encoded by IL2RG, corresponding to a target binding site such as BINDING SITE I, BINDING SITE II or BINDING SITE III of FIG. 8. Table 4 illustrates the complementarity of the nucleotide sequences of IL2RG BINDING SITE, designated SEQ ID:3947, to the nucleotide sequence of GAM63 RNA, herein designated GAM RNA, also designated SEQ ID:348.

Another function of GAM63 is therefore inhibition of Interleukin 2 receptor, gamma (severe combined immunodeficiency) (IL2RG, Accession NP_000197.1). Accordingly, utilities of GAM63 include diagnosis, prevention and treatment of diseases and clinical conditions associated with IL2RG.

Interleukin enhancer binding factor 3, 90 kda (ILF3, Accession NP_036350.2) is another GAM63 target gene, herein designated TARGET GENE. ILF3 BINDING SITE is a target binding site found in the 3' untranslated region of multiple transcripts of mRNA encoded by ILF3, corresponding to a target binding site such as BINDING SITE I, BINDING SITE II or BINDING SITE III of FIG. 8. Table 4 illustrates the complementarity of the nucleotide sequences of ILF3 BINDING SITE, designated SEQ ID:6170, to the nucleotide sequence of GAM63 RNA, herein designated GAM RNA, also designated SEQ ID:348.

Another function of GAM63 is therefore inhibition of Interleukin enhancer binding factor 3, 90 kda (ILF3, Accession NP_036350.2). Accordingly, utilities of GAM63 include diagnosis, prevention and treatment of diseases and clinical conditions associated with ILF3.

Interferon regulatory factor 2 (IRF2, Accession NP_002190.1) is another GAM63 target gene, herein designated TARGET GENE. IRF2 BINDING SITE is a target binding site found in the 5' untranslated region of mRNA encoded by IRF2, corresponding to a target binding site such as BINDING SITE I, BINDING SITE II or BINDING SITE III of FIG. 8. Table 4 illustrates the complementarity of the nucleotide sequences of IRF2 BINDING SITE, designated SEQ ID:17355, to the nucleotide sequence of GAM63 RNA, herein designated GAM RNA, also designated SEQ ID:348.

Another function of GAM63 is therefore inhibition of Interferon regulatory factor 2 (IRF2, Accession NP_002190.1), a gene which is a transcriptional activator of type I interferon and interferon-inducible genes. and therefore may be associated with Atopic dermatitis. Accordingly, utilities of GAM63 include diagnosis, prevention and treatment of Atopic dermatitis, and of other diseases and clinical conditions associated with IRF2.

The function of IRF2 has been established by previous studies. Interferon regulatory factor-1 (IRF1; 147575), a transcriptional activator, and IRF2, its antagonistic repressor, are regulators of type I interferon and interferon-inducible genes. The IRF1 gene is itself interferon-inducible and hence may be one of the target genes critical for interferon action. Harada et al. (1993) found that when the IRF2 gene was overexpressed in NIH 3T3 cells, the cells became transformed and displayed enhanced tumorigenicity in nude mice. This transformed phenotype was reversed by concomitant expression of the IRF1 gene. Thus, restrained cell growth depends on a balance between these 2 mutually antagonistic transcription factors Nishio et al. (2001) screened for mutations in the 5-prime flanking and coding regions of IRF2 in patients with atopic dermatitis (see OMIM Ref. No. 603165). They found 5 novel variants and conducted a transmission disequilibrium test in families identified through patients with atopic dermatitis. The data suggested that the IRF2 gene may play a role in the development of atopic dermatitis in Japanese Ko et al. (2002) noted that Irf1 -/- mice are deficient in Inos (OMIM Ref. No. 163730), Il12b (OMIM Ref. No. 161561), Cd8-positive T cells, and natural killer (NK) cells, whereas Irf2 -/- mice are deficient in NK cells and have dysregulated Il12b induction. Icsbp (OMIM Ref. No. 601565) -/- mice are deficient in Il12b, Irf2, and reactive oxygen intermediates (ROIs). All 3 are inducible by gamma-interferon (Ifng; 147570) and have varying susceptibility to different intracellular bacterial and protozoan pathogens. Ko et al. (2002) determined that Irf1 -/- mice are highly susceptible to fatal liver damage from Brucella abortus, the causative agent of brucellosis, which manifests as arthritis, endocarditis, and meningitis in humans. In contrast, Irf2 -/- mice are highly resistant to Brucella, whereas Icsbp -/- mice maintain a plateau of infection similar to that seen in Il12b -/- mice. The authors concluded that IL12, reactive nitrogen intermediates, and ROIs are probably crucial immune components in resistance to Brucella infection Animal model experiments lend further support to the function of IRF2. Hida et al. (2000) observed that Irf2 -/- mice exhibited progressive cutaneous inflammation accompanied by hair loss and ulcer formation. Histopathologic analysis demonstrated epidermal thickening with proliferating keratinocytes expressing Icam1/Cd54 (OMIM Ref. No. 147840), features similar to those found in psoriasis. In addition, however, there was a disorganized muscle layer and prominent fibrosis. In the basal dermis, infiltrating Cd8 (see OMIM Ref. No. 186910)-positive rather than Cd4 (OMIM Ref. No. 186940)-positive T cells were involved in the development of disease. In vitro analysis showed that the Cd8 T cells exhibited prolonged activation and proliferation with high expression of Cd44 (OMIM Ref. No. 107269) and Ly6c. RT-PCR and Northern blot analysis detected spontaneous expression of Ifna (OMIM Ref. No. 147660) and Ifnb (OMIM Ref. No. 147640), as well as overexpression of IFN-inducible genes, i.e., Oas (see OMIM Ref. No. 603351), Irf7 (OMIM Ref. No. 605047), Ip10 (SCYB10; 147310), and Mig (SCYB9; 601704), in the Irf2 -/- mice. Inactivation of the Ifna/Ifnb pathways by mutating Ifnar1 (OMIM Ref. No. 107450) or Irf9 resulted in the absence of skin disease in Irf2 -/- mice.

It is appreciated that the abovementioned animal model for IRF2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ko, J.; Gendron-Fitzpatrick, A.; Splitter, G. A.: Susceptibility of IFN regulatory factor-1 and IFN consensus sequence binding protein-deficient mice to brucellosis. J. Immun. 168: 2433-2440, 2002; and Nishio, Y.; Noguchi, E.; Ito, S.; Ichikawa, E.; Umebayashi, Y.; Otsuka, F.; Arinami, T.: Mutation and association analysis of the interferon regulatory factor 2 gene (IRF2) with atopic.

Further studies establishing the function and utilities of IRF2 are found in John Hopkins OMIM database record ID 147576, and in cited publications listed in Table 5, which are hereby incorporated by reference. Isl2 transcription factor, lim/homeodomain, (islet-2) (ISL2, Accession NP_665804.1) is another GAM63 target gene, herein designated TARGET GENE. ISL2 BINDING SITE is a target binding site found in the 3' untranslated region of mRNA encoded by ISL2, corresponding to a target binding site such as BINDING SITE I, BINDING SITE II or BINDING SITE III of FIG. 8. Table 4 illustrates the complementarity of the nucleotide sequences of ISL2 BINDING SITE, designated SEQ ID:3035, to the nucleotide sequence of GAM63 RNA, herein designated GAM RNA, also designated SEQ ID:348.

Another function of GAM63 is therefore inhibition of Isl2 transcription factor, lim/homeodomain, (islet-2) (ISL2, Accession NP_665804.1). Accordingly, utilities of GAM63 include diagnosis, prevention and treatment of diseases and clinical conditions associated with ISL2.

Inter-alpha (globulin) inhibitor, h1 polypeptide (ITIH1, Accession NP_002206.1) is another GAM63 target gene, herein designated TARGET GENE. ITIH1 BINDING SITE is a target binding site found in the 3' untranslated region of mRNA encoded by ITIH1, corresponding to a target binding site such as BINDING SITE I, BINDING SITE II or BINDING SITE III of FIG. 8. Table 4 illustrates the complementarity of the nucleotide sequences of ITIH1 BINDING SITE, designated SEQ ID:18461, to the nucleotide sequence of GAM63 RNA, herein designated GAM RNA, also designated SEQ ID:348.

Another function of GAM63 is therefore inhibition of Inter-alpha (globulin) inhibitor, h1 polypeptide (ITIH1, Accession NP_002206.1), a gene which may act as a carrier of hyaluronan in serum or as a binding protein between hyaluronan and other matrix protein. Accordingly, utilities of GAM63 include diagnosis, prevention and treatment of diseases and clinical conditions associated with ITIH1.

The function of ITIH1 has been established by previous studies. Inter-alpha- trypsin inhibitor (IATI) is a serine protease inhibitor with an overall molecular weight of 180,000 which is found in human plasma. Salier et al. (1987) reported that IATI is a multifunctional protein comprised of polypeptide chains that are synthesized in the liver by 2 distinct mRNA species: a heavy chain with a molecular weight of 95,000 and a light chain (ITIL; 176870) with a molecular weight of 40,000. Salier et al. (1987) characterized cDNAs for the H chain of IATI. Diarra-Mehrpour et al. (1989) showed that human poly(A)- rich RNAs hybrid-selected with various heavy-chain-encoding cDNA clones translate 3 different heavy chains, designated H1 (M(r) 92,000), H2 (ITIH2; 146640; M(r) 98,000), and H3 (ITIH3; 146650; M(r) 107,000). Two previously characterized heavy-chain cDNA clones were found to correspond to H1 and H2 chains. The deduced amino acid sequence of the H3 chain was found to be highly similar to those of the H1 (54%) and H2 (44%) chains. Diarra-Mehrpour et al. (1992) used a PCR-based cloning approach and cDNA library screening to isolate the full-length cDNA H1. Diarra-Mehrpour et al. (1994) demonstrated that the ITIH1 and ITIH3 genes are arranged in tandem, 2,721 bp apart. Diarra-Mehrpour et al. (1998) reported that the ITIH4 (OMIM Ref. No. 600564) gene is located just downstream of the last ITIH3 exon, and is transcribed in the opposite orientation. Bost et al. (1993) determined that the ITIH1 gene contains 22 exons and spans 14 kb. Northern blot analysis indicated that the 2.9-kb ITIH1 mRNA is expressed only in liver. The authors found evidence for alternative splicing of at least 1 exon of the ITIH1 gene. In situ hybridization by Diarra-Mehrpour et al. (1989) showed that the H1 and H3 genes are located in the 3p21.2-p21.1 region, whereas the H2 gene resides at 10p15

Full details of the abovementioned studies are described in the following publications, the disclosure of which are hereby incorporated by reference:

Diarra-Mehrpour, M.; Sarafan, N.; Bourguignon, J.; Bonnet, F.; Bost, F.; Martin, J.-P.: Human inter-alpha-trypsin inhibitor heavy chain H3 gene: genomic organization, promoter analysis, and gene linkage. J. Biol. Chem. 273:26809-26819, 1998; and Ding, M.; Umetsu, K.; Yuasa, I.; Sato, M.; Harada, A.; Suzuki, T.: Molecular basis of inter-alpha-trypsin inhibitor heavy chain H1 (ITIH1) polymorphism. Hum. Genet. 95:435-436, 1995.

Further studies establishing the function and utilities of ITIH1 are found in John Hopkins OMIM database record ID 147270, and in cited publications listed in Table 5, which are hereby incorporated by reference. Inositol 1,4,5-trisphosphate 3-kinase b (ITPKB, Accession NP_002212.1) is another GAM63 target gene, herein designated TARGET GENE. ITPKB BINDING SITE is a target binding site found in the 3' untranslated region of mRNA encoded by ITPKB, corresponding to a target binding site such as BINDING SITE I, BINDING SITE II or BINDING SITE III of FIG. 8. Table 4 illustrates the complementarity of the nucleotide sequences of ITPKB BINDING SITE, designated SEQ ID:14689, to the nucleotide sequence of GAM63 RNA, herein designated GAM RNA, also designated SEQ ID:348.

Another function of GAM63 is therefore inhibition of Inositol 1,4,5-trisphosphate 3-kinase b (ITPKB, Accession NP_002212.1), a gene which is a type B inositol 1,4,5-triphosphate 3 kinase. Accordingly, utilities of GAM63 include diagnosis, prevention and treatment of diseases and clinical conditions associated with ITPKB.

The function of ITPKB has been established by previous studies. Takazawa et al. (1991) isolated a second inositol 1,4,5-trisphosphate 3-kinase cDNA from a human hippocampus cDNA library. Sequencing yielded an open reading frame encoding a 472-amino acid protein with a calculated relative mass of 53,451. The C-terminal part of this enzyme, referred to as 3-kinase-B, namely, residues 187-462, was 68% identical to 3-kinase-A (OMIM Ref. No. 147521) in amino acid sequence. By in situ hybridization, Erneux et al. (1992) mapped the ITPKB gene to 1q41-q43.

Full details of the abovementioned studies are described in the following publications, the disclosure of which are hereby incorporated by reference:

Erneux, C.; Roeckel, N.; Takazawa, K.; Mailleux, P.; Vassart, G.; Mattei, M. G.: Localization of the genes for human inositol 1,4,5-trisphosphate 3-kinase A (ITPKA) and B (ITPKB) to chromosome regions 15q14-q21 and 1q41-q43, respectively, by in situ hybridization. Genomics 14: 546-547, 1992; and Takazawa, K.; Perret, J.; Dumont, J. E.; Erneux, C.: Molecular cloning and expression of a new putative inositol 1,4,5-trisphosphate 3-kinase isoenzyme. Biochem. J. 278: 883-886, 1991.

Further studies establishing the function and utilities of ITPKB are found in John Hopkins OMIM database record ID 147522, and in cited publications listed in Table 5, which are hereby incorporated by reference. Jumping translocation breakpoint (JTB, Accession NP_006685.1) is another GAM63 target gene, herein designated TARGET GENE. JTB BINDING SITE is a target binding site found in the 3' untranslated region of mRNA encoded by JTB, corresponding to a target binding site such as BINDING SITE I, BINDING SITE II or BINDING SITE III of FIG. 8. Table 4 illustrates the complementarity of the nucleotide sequences of JTB BINDING SITE, designated SEQ ID:4192, to the nucleotide sequence of GAM63 RNA, herein designated GAM RNA, also designated SEQ ID:348.

Another function of GAM63 is therefore inhibition of Jumping translocation breakpoint (JTB, Accession NP_006685.1). Accordingly, utilities of GAM63 include diagnosis, prevention and treatment of diseases and clinical conditions associated with JTB.

K5B (Accession NP_775487.1) is another GAM63 target gene, herein designated TARGET GENE. K5B BINDING SITE is a target binding site found in the 5' untranslated region of mRNA encoded by K5B, corresponding to a target binding site such as BINDING SITE I, BINDING SITE II or BINDING SITE III of FIG. 8. Table 4 illustrates the complementarity of the nucleotide sequences of K5B BINDING SITE, designated SEQ ID:9971, to the nucleotide sequence of GAM63 RNA, herein designated GAM RNA, also designated SEQ ID:348.

Another function of GAM63 is therefore inhibition of K5B (Accession NP_775487.1). Accordingly, utilities of GAM63 include diagnosis, prevention and treatment of diseases and clinical conditions associated with K5B.

Potassium voltage-gated channel, shaker-related subfamily, member 6 (KCNA6, Accession NP_002226.1) is another GAM63 target gene, herein designated TARGET GENE. KCNA6 BINDING SITE is a target binding site found in the 3' untranslated region of mRNA encoded by KCNA6, corresponding to a target binding site such as BINDING SITE I, BINDING SITE II or BINDING SITE III of FIG. 8. Table 4 illustrates the complementarity of the nucleotide sequences of KCNA6 BINDING SITE, designated SEQ ID:14965, to the nucleotide sequence of GAM63 RNA, herein designated GAM RNA, also designated SEQ ID:348.

Another function of GAM63 is therefore inhibition of Potassium voltage-gated channel, shaker-related subfamily, member 6 (KCNA6, Accession NP_002226.1), a gene which mediates the voltage-dependent potassium ion permeability of excitable membranes. Accordingly, utilities of GAM63 include diagnosis, prevention and treatment of diseases and clinical conditions associated with KCNA6.

The function of KCNA6 has been established by previous studies. By screening a human fetal cDNA library with a rat RCK3 potassium channel cDNA, Grupe et al. (1990) isolated cDNAs encoding a protein that they designated HBK2 (human brain potassium channel-2). The authors also cloned cDNAs corresponding to the rat homolog, RCK2. The predicted 529-amino acid HBK2 protein shares 94% identity with RCK2. HBK2 and RCK2 have the characteristic structure of voltage-gated ionic channels, with 6 potential membrane-spanning segments. When expressed in Xenopus oocytes, the HBK2/RCK2 channels exhibited the functional characteristics of a delayed-rectifier channel that acts especially in the more positive membrane voltage range. The functional and pharmacologic properties of HBK2/RCK2 potassium channels were distinct from those of previously characterized channels. Grupe et al. (1990) determined that the HBK2 gene did not contain introns. Using interspecific backcrosses between Mus musculus and Mus spretus, Klocke et al. (1993) mapped the mouse gene encoding the Kv1.6 potassium voltage-gated channel, Kcna6, to chromosome 6 in a cluster with Kcna1, Kcna5 (OMIM Ref. No. 176267), and the homolog of human TPI1 (OMIM Ref. No. 190450). Since human TPI1 is located on band 12p13, Klocke et al. (1993) predicted that the human KCNA6 gene is located on 12p near other genes of the Shaker-related subfamily, KCNA1 and KCNA5. Albrecht et al. (1995) determined that a 300-kb cluster on chromosome 12p13 contains the human KCNA6, KCNA1, and KCNA5 genes arranged in tandem Full details of the abovementioned studies are described in the following publications, the disclosure of which are hereby incorporated by reference:

Albrecht, B.; Weber, K.; Pongs, O.: Characterization of a voltage-activated K-channel gene cluster on human chromosome 12p13. Receptors Channels 3:213-220, 1995; and Grupe, A.; Schroter, K. H.; Ruppersberg, J. P.; Stocker, M.; Drewes, T.; Beckh, S.; Pongs, O.: Cloning and expression of a human voltage-gated potassium channel: a novel member of the R.

Further studies establishing the function and utilities of KCNA6 are found in John Hopkins OMIM database record ID 176257, and in cited publications listed in Table 5, which are hereby incorporated by reference. Potassium inwardly-rectifying channel, subfamily j, member 1 (KCNJ1, Accession NP_722450.1) is another GAM63 target gene, herein designated TARGET GENE. KCNJ1 BINDING SITE is a target binding site found in the 5' untranslated region of multiple transcripts of mRNA encoded by KCNJ1, corresponding to a target binding site such as BINDING SITE I, BINDING SITE II or BINDING SITE III of FIG. 8. Table 4 illustrates the complementarity of the nucleotide sequences of KCNJ1 BINDING SITE, designated SEQ ID:16832, to the nucleotide sequence of GAM63 RNA, herein designated GAM RNA, also designated SEQ ID:348.

Another function of GAM63 is therefore inhibition of Potassium inwardly-rectifying channel, subfamily j, member 1 (KCNJ1, Accession NP_722450.1). Accordingly, utilities of GAM63 include diagnosis, prevention and treatment of diseases and clinical conditions associated with KCNJ1.

Potassium inwardly-rectifying channel, subfamily j, member 1 (KCNJ1, Accession NP_722451.1) is another GAM63 target gene, herein designated TARGET GENE. KCNJ1 BINDING SITE is a target binding site found in the 5' untranslated region of multiple transcripts of mRNA encoded by KCNJ1, corresponding to a target binding site such as BINDING SITE I, BINDING SITE II or BINDING SITE III of FIG. 8. Table 4 illustrates the complementarity of the nucleotide sequences of KCNJ1 BINDING SITE, designated SEQ ID:16832, to the nucleotide sequence of GAM63 RNA, herein designated GAM RNA, also designated SEQ ID:348.

Another function of GAM63 is therefore inhibition of Potassium inwardly-rectifying channel, subfamily j, member 1 (KCNJ1, Accession NP_722451.1). Accordingly, utilities of GAM63 include diagnosis, prevention and treatment of diseases and clinical conditions associated with KCNJ1.

Potassium channel, subfamily t, member 1 (KCNT1, Accession XP_029962.2) is another GAM63 target gene, herein designated TARGET GENE. KCNT1 BINDING SITE is a target binding site found in the 3' untranslated region of mRNA encoded by KCNT1, corresponding to a target binding site such as BINDING SITE I, BINDING SITE II or BINDING SITE III of FIG. 8. Table 4 illustrates the complementarity of the nucleotide sequences of KCNT1 BINDING SITE, designated SEQ ID:10138, to the nucleotide sequence of GAM63 RNA, herein designated GAM RNA, also designated SEQ ID:348.

Another function of GAM63 is therefore inhibition of Potassium channel, subfamily t, member 1 (KCNT1, Accession XP_029962.2). Accordingly, utilities of GAM63 include diagnosis, prevention and treatment of diseases and clinical conditions associated with KCNT1.

KIAA0063 (Accession NP_055691.1) is another GAM63 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:17332, to the nucleotide sequence of GAM63 RNA, herein designated GAM RNA, also designated SEQ ID:348.

Another function of GAM63 is therefore inhibition of KIAA0063 (Accession NP_055691.1). Accordingly, utilities of GAM63 include diagnosis, prevention and treatment of diseases and clinical conditions associated with KIAA0063.

KIAA0217 (Accession XP_040265.4) is another GAM63 target gene, herein designated TARGET GENE. KIAA0217 BINDING SITE is a target binding site found in the 5' untranslated region of mRNA encoded by KIAA0217, corresponding to a target binding site such as BINDING SITE I, BINDING SITE II or BINDING SITE III of FIG. 8. Table 4 illustrates the complementarity of the nucleotide sequences of KIAA0217 BINDING SITE, designated SEQ ID:3254, to the nucleotide sequence of GAM63 RNA, herein designated GAM RNA, also designated SEQ ID:348.

Another function of GAM63 is therefore inhibition of KIAA0217 (Accession XP_040265.4). Accordingly, utilities of GAM63 include diagnosis, prevention and treatment of diseases and clinical conditions associated with KIAA0217.

KIAA0227 (Accession XP_027236.1) is another GAM63 target gene, herein designated TARGET GENE. KIAA0227 BINDING SITE is a target binding site found in the 3' untranslated region of mRNA encoded by KIAA0227, corresponding to a target binding site such as BINDING SITE I, BINDING SITE II or BINDING SITE III of FIG. 8. Table 4 illustrates the complementarity of the nucleotide sequences of KIAA0227 BINDING SITE, designated SEQ ID:16188, to the nucleotide sequence of GAM63 RNA, herein designated GAM RNA, also designated SEQ ID:348.

Another function of GAM63 is therefore inhibition of KIAA0227 (Accession XP_027236.1). Accordingly, utilities of GAM63 include diagnosis, prevention and treatment of diseases and clinical conditions associated with KIAA0227.

KIAA0232 (Accession XP_291106.1) is another GAM63 target gene, herein designated TARGET GENE. KIAA0232 BINDING SITE is a target binding site found in the 3' untranslated region of mRNA encoded by KIAA0232, corresponding to a target binding site such as BINDING SITE I, BINDING SITE II or BINDING SITE III of FIG. 8. Table 4 illustrates the complementarity of the nucleotide sequences of KIAA0232 BINDING SITE, designated SEQ ID:10118, to the nucleotide sequence of GAM63 RNA, herein designated GAM RNA, also designated SEQ ID:348.

Another function of GAM63 is therefore inhibition of KIAA0232 (Accession XP_291106.1). Accordingly, utilities of GAM63 include diagnosis, prevention and treatment of diseases and clinical conditions associated with KIAA0232.

KIAA0256 (Accession XP_034905.1) is another GAM63 target gene, herein designated TARGET GENE. KIAA0256 BINDING SITE is a target binding site found in the 3' untranslated region of mRNA encoded by KIAA0256, corresponding to a target binding site such as BINDING SITE I, BINDING SITE II or BINDING SITE III of FIG. 8. Table 4 illustrates the complementarity of the nucleotide sequences of KIAA0256 BINDING SITE, designated SEQ ID:16597, to the nucleotide sequence of GAM63 RNA, herein designated GAM RNA, also designated SEQ ID:348.

Another function of GAM63 is therefore inhibition of KIAA0256 (Accession XP_034905.1). Accordingly, utilities of GAM63 include diagnosis, prevention and treatment of diseases and clinical conditions associated with KIAA0256.

KIAA0258 (Accession NP_055600.1) is another GAM63 target gene, herein designated TARGET GENE. KIAA0258 BINDING SITE is a target binding site found in the 3' untranslated region of mRNA encoded by KIAA0258, corresponding to a target binding site such as BINDING SITE I, BINDING SITE II or BINDING SITE III of FIG. 8. Table 4 illustrates the complementarity of the nucleotide sequences of KIAA0258 BINDING SITE, designated SEQ ID:15208, to the nucleotide sequence of GAM63 RNA, herein designated GAM RNA, also designated SEQ ID:348.

Another function of GAM63 is therefore inhibition of KIAA0258 (Accession NP_055600.1). Accordingly, utilities of GAM63 include diagnosis, prevention and treatment of diseases and clinical conditions associated with KIAA0258.

KIAA0296 (Accession NP_055514.1) is another GAM63 target gene, herein designated TARGET GENE. KIAA0296 BINDING SITE is a target binding site found in the 3' untranslated region of mRNA encoded by KIAA0296, corresponding to a target binding site such as BINDING SITE I, BINDING SITE II or BINDING SITE III of FIG. 8. Table 4 illustrates the complementarity of the nucleotide sequences of KIAA0296 BINDING SITE, designated SEQ ID:14490, to the nucleotide sequence of GAM63 RNA, herein designated GAM RNA, also designated SEQ ID:348.

Another function of GAM63 is therefore inhibition of KIAA0296 (Accession NP_055514.1). Accordingly, utilities of GAM63 include diagnosis, prevention and treatment of diseases and clinical conditions associated with KIAA0296.

KIAA0415 (Accession XP_166527.2) is another GAM63 target gene, herein designated TARGET GENE. KIAA0415 BINDING SITE is a target binding site found in the 3' untranslated region of mRNA encoded by KIAA0415, corresponding to a target binding site such as BINDING SITE I, BINDING SITE II or BINDING SITE III of FIG. 8. Table 4 illustrates the complementarity of the nucleotide sequences of KIAA0415 BINDING SITE, designated SEQ ID:15657, to the nucleotide sequence of GAM63 RNA, herein designated GAM RNA, also designated SEQ ID:348.

Another function of GAM63 is therefore inhibition of KIAA0415 (Accession XP_166527.2). Accordingly, utilities of GAM63 include diagnosis, prevention and treatment of diseases and clinical conditions associated with KIAA0415.

KIAA0427 (Accession NP_055587.1) is another GAM63 target gene, herein designated TARGET GENE. KIAA0427 BINDING SITE is a target binding site found in the 3' untranslated region of mRNA encoded by KIAA0427, corresponding to a target binding site such as BINDING SITE I, BINDING SITE II or BINDING SITE III of FIG. 8. Table 4 illustrates the complementarity of the nucleotide sequences of KIAA0427 BINDING SITE, designated SEQ ID:15166, to the nucleotide sequence of GAM63 RNA, herein designated GAM RNA, also designated SEQ ID:348.

Another function of GAM63 is therefore inhibition of KIAA0427 (Accession NP_055587.1). Accordingly, utilities of GAM63 include diagnosis, prevention and treatment of diseases and clinical conditions associated with KIAA0427.

KIAA0450 (Accession NP_055453.1) is another GAM63 target gene, herein designated TARGET GENE. KIAA0450 BINDING SITE is a target binding site found in the 5' untranslated region of mRNA encoded by KIAA0450, corresponding to a target binding site such as BINDING SITE I, BINDING SITE II or BINDING SITE III of FIG. 8. Table 4 illustrates the complementarity of the nucleotide sequences of KIAA0450 BINDING SITE, designated SEQ ID:12861, to the nucleotide sequence of GAM63 RNA, herein designated GAM RNA, also designated SEQ ID:348.

Another function of GAM63 is therefore inhibition of KIAA0450 (Accession NP_055453.1). Accordingly, utilities of GAM63 include diagnosis, prevention and treatment of diseases and clinical conditions associated with KIAA0450.

KIAA0472 (Accession XP_290898.1) is another GAM63 target gene, herein designated TARGET GENE. KIAA0472 BINDING SITE is a target binding site found in the 5' untranslated region of mRNA encoded by KIAA0472, corresponding to a target binding site such as BINDING SITE I, BINDING SITE II or BINDING SITE III of FIG. 8. Table 4 illustrates the complementarity of the nucleotide sequences of KIAA0472 BINDING SITE, designated SEQ ID:3805, to the nucleotide sequence of GAM63 RNA, herein designated GAM RNA, also designated SEQ ID:348.

Another function of GAM63 is therefore inhibition of KIAA0472 (Accession XP_290898.1). Accordingly, utilities of GAM63 include diagnosis, prevention and treatment of diseases and clinical conditions associated with KIAA0472.

KIAA0475 (Accession NP_055679.1) is another GAM63 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:19144, to the nucleotide sequence of GAM63 RNA, herein designated GAM RNA, also designated SEQ ID:348.

Another function of GAM63 is therefore inhibition of KIAA0475 (Accession NP_055679.1). Accordingly, utilities of GAM63 include diagnosis, prevention and treatment of diseases and clinical conditions associated with KIAA0475.

KIAA0545 (Accession XP_032278.3) is another GAM63 target gene, herein designated TARGET GENE. KIAA0545 BINDING SITE is a target binding site found in the 3' untranslated region of mRNA encoded by KIAA0545, corresponding to a target binding site such as BINDING SITE I, BINDING SITE II or BINDING SITE III of FIG. 8. Table 4 illustrates the complementarity of the nucleotide sequences of KIAA0545 BINDING SITE, designated SEQ ID:6128, to the nucleotide sequence of GAM63 RNA, herein designated GAM RNA, also designated SEQ ID:348.

Another function of GAM63 is therefore inhibition of KIAA0545 (Accession XP_032278.3). Accordingly, utilities of GAM63 include diagnosis, prevention and treatment of diseases and clinical conditions associated with KIAA0545.

KIAA0599 (Accession XP_085127.6) is another GAM63 target gene, herein designated TARGET GENE. KIAA0599 BINDING SITE is a target binding site found in the 5' untranslated region of mRNA encoded by KIAA0599, corresponding to a target binding site such as BINDING SITE I, BINDING SITE II or BINDING SITE III of FIG. 8. Table 4 illustrates the complementarity of the nucleotide sequences of KIAA0599 BINDING SITE, designated SEQ ID:13331, to the nucleotide sequence of GAM63 RNA, herein designated GAM RNA, also designated SEQ ID:348.

Another function of GAM63 is therefore inhibition of KIAA0599 (Accession XP_085127.6). Accordingly, utilities of GAM63 include diagnosis, prevention and treatment of diseases and clinical conditions associated with KIAA0599.

KIAA0669 (Accession NP_055594.1) is another GAM63 target gene, herein designated TARGET GENE. KIAA0669 BINDING SITE is a target binding site found in the 5' untranslated region of mRNA encoded by KIAA0669, corresponding to a target binding site such as BINDING SITE I, BINDING SITE II or BINDING SITE III of FIG. 8. Table 4 illustrates the complementarity of the nucleotide sequences of KIAA0669 BINDING SITE, designated SEQ ID:16391, to the nucleotide sequence of GAM63 RNA, herein designated GAM RNA, also designated SEQ ID:348.

Another function of GAM63 is therefore inhibition of KIAA0669 (Accession NP_055594.1). Accordingly, utilities of GAM63 include diagnosis, prevention and treatment of diseases and clinical conditions associated with KIAA0669.

KIAA0676 (Accession NP_055858.1) is another GAM63 target gene, herein designated TARGET GENE. KIAA0676

BINDING SITE is a target binding site found in the 3' untranslated region of mRNA encoded by KIAA0676, corresponding to a target binding site such as BINDING SITE I, BINDING SITE II or BINDING SITE III of FIG. 8. Table 4 illustrates the complementarity of the nucleotide sequences of KIAA0676 BINDING SITE, designated SEQ ID:11139, to the nucleotide sequence of GAM63 RNA, herein designated GAM RNA, also designated SEQ ID:348.

Another function of GAM63 is therefore inhibition of KIAA0676 (Accession NP_055858.1). Accordingly, utilities of GAM63 include diagnosis, prevention and treatment of diseases and clinical conditions associated with KIAA0676.

KIAA0710 (Accession NP_055686.1) is another GAM63 target gene, herein designated TARGET GENE. KIAA0710 BINDING SITE is a target binding site found in the 3' untranslated region of mRNA encoded by KIAA0710, corresponding to a target binding site such as BINDING SITE I, BINDING SITE II or BINDING SITE III of FIG. 8. Table 4 illustrates the complementarity of the nucleotide sequences of KIAA0710 BINDING SITE, designated SEQ ID:12253, to the nucleotide sequence of GAM63 RNA, herein designated GAM RNA, also designated SEQ ID:348.

Another function of GAM63 is therefore inhibition of KIAA0710 (Accession NP_055686.1). Accordingly, utilities of GAM63 include diagnosis, prevention and treatment of diseases and clinical conditions associated with KIAA0710.

KIAA0767 (Accession XP_027105.2) is another GAM63 target gene, herein designated TARGET GENE. KIAA0767 BINDING SITE is a target binding site found in the 3' untranslated region of mRNA encoded by KIAA0767, corresponding to a target binding site such as BINDING SITE I, BINDING SITE II or BINDING SITE III of FIG. 8. Table 4 illustrates the complementarity of the nucleotide sequences of KIAA0767 BINDING SITE, designated SEQ ID:16026, to the nucleotide sequence of GAM63 RNA, herein designated GAM RNA, also designated SEQ ID:348.

Another function of GAM63 is therefore inhibition of KIAA0767 (Accession XP_027105.2). Accordingly, utilities of GAM63 include diagnosis, prevention and treatment of diseases and clinical conditions associated with KIAA0767.

KIAA0773 (Accession NP_055505.1) is another GAM63 target gene, herein designated TARGET GENE. KIAA0773 BINDING SITE is a target binding site found in the 3' untranslated region of mRNA encoded by KIAA0773, corresponding to a target binding site such as BINDING SITE I, BINDING SITE II or BINDING SITE III of FIG. 8. Table 4 illustrates the complementarity of the nucleotide sequences of KIAA0773 BINDING SITE, designated SEQ ID:13455, to the nucleotide sequence of GAM63 RNA, herein designated GAM RNA, also designated SEQ ID:348.

Another function of GAM63 is therefore inhibition of KIAA0773 (Accession NP_055505.1). Accordingly, utilities of GAM63 include diagnosis, prevention and treatment of diseases and clinical conditions associated with KIAA0773.

KIAA0825 (Accession XP_027906.5) is another GAM63 target gene, herein designated TARGET GENE. KIAA0825 BINDING SITE is a target binding site found in the 3' untranslated region of mRNA encoded by KIAA0825, corresponding to a target binding site such as BINDING SITE I, BINDING SITE II or BINDING SITE III of FIG. 8. Table 4 illustrates the complementarity of the nucleotide sequences of KIAA0825 BINDING SITE, designated SEQ ID:11299, to the nucleotide sequence of GAM63 RNA, herein designated GAM RNA, also designated SEQ ID:348.

Another function of GAM63 is therefore inhibition of KIAA0825 (Accession XP_027906.5). Accordingly, utilities of GAM63 include diagnosis, prevention and treatment of diseases and clinical conditions associated with KIAA0825.

KIAA0889 (Accession NP_689470.1) is another GAM63 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:1863, to the nucleotide sequence of GAM63 RNA, herein designated GAM RNA, also designated SEQ ID:348.

Another function of GAM63 is therefore inhibition of KIAA0889 (Accession NP_689470.1). Accordingly, utilities of GAM63 include diagnosis, prevention and treatment of diseases and clinical conditions associated with KIAA0889.

KIAA0889 (Accession NP_056192.1) is another GAM63 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:1863, to the nucleotide sequence of GAM63 RNA, herein designated GAM RNA, also designated SEQ ID:348.

Another function of GAM63 is therefore inhibition of KIAA0889 (Accession NP_056192.1). Accordingly, utilities of GAM63 include diagnosis, prevention and treatment of diseases and clinical conditions associated with KIAA0889.

KIAA1111 (Accession XP_171233.1) is another GAM63 target gene, herein designated TARGET GENE. KIAA1111 BINDING SITE is a target binding site found in the 3' untranslated region of mRNA encoded by KIAA1111, corresponding to a target binding site such as BINDING SITE I, BINDING SITE II or BINDING SITE III of FIG. 8. Table 4 illustrates the complementarity of the nucleotide sequences of KIAA1111 BINDING SITE, designated SEQ ID:6397, to the nucleotide sequence of GAM63 RNA, herein designated GAM RNA, also designated SEQ ID:348.

Another function of GAM63 is therefore inhibition of KIAA1111 (Accession XP_171233.1). Accordingly, utilities of GAM63 include diagnosis, prevention and treatment of diseases and clinical conditions associated with KIAA1111.

KIAA1115 (Accession NP_055746.1) is another GAM63 target gene, herein designated TARGET GENE. KIAA1115 BINDING SITE is a target binding site found in the 3' untranslated region of mRNA encoded by KIAA1115, corresponding to a target binding site such as BINDING SITE I, BINDING SITE II or BINDING SITE III of FIG. 8. Table 4 illustrates the complementarity of the nucleotide sequences of KIAA1115 BINDING SITE, designated SEQ ID:17435, to the nucleotide sequence of GAM63 RNA, herein designated GAM RNA, also designated SEQ ID:348.

Another function of GAM63 is therefore inhibition of KIAA1115 (Accession NP_055746.1). Accordingly, utilities of GAM63 include diagnosis, prevention and treatment of diseases and clinical conditions associated with KIAA1115.

KIAA1198 (Accession NP_065765.1) is another GAM63 target gene, herein designated TARGET GENE. KIAA1198 BINDING SITE is a target binding site found in the 3' untranslated region of mRNA encoded by KIAA1198, corresponding to a target binding site such as BINDING SITE I, BINDING SITE II or BINDING SITE III of FIG. 8. Table 4 illustrates the complementarity of the nucleotide sequences of KIAA1198 BINDING SITE, designated SEQ ID:19022, to the nucleotide sequence of GAM63 RNA, herein designated GAM RNA, also designated SEQ ID:348.

Another function of GAM63 is therefore inhibition of KIAA1198 (Accession NP_065765.1). Accordingly, utilities of GAM63 include diagnosis, prevention and treatment of diseases and clinical conditions associated with KIAA1198.

KIAA1203 (Accession XP_049683.4) is another GAM63 target gene, herein designated TARGET GENE. KIAA1203 BINDING SITE is a target binding site found in the 3' untranslated region of mRNA encoded by KIAA1203, corresponding to a target binding site such as BINDING SITE I, BINDING SITE II or BINDING SITE III of FIG. 8. Table 4 illustrates the complementarity of the nucleotide sequences of KIAA1203 BINDING SITE, designated SEQ ID:12583, to the nucleotide sequence of GAM63 RNA, herein designated GAM RNA, also designated SEQ ID:348.

Another function of GAM63 is therefore inhibition of KIAA1203 (Accession XP_049683.4). Accordingly, utilities of GAM63 include diagnosis, prevention and treatment of diseases and clinical conditions associated with KIAA1203.

KIAA1210 (Accession XP_172801.1) is another GAM63 target gene, herein designated TARGET GENE. KIAA1210 BINDING SITE is a target binding site found in the 3' untranslated region of mRNA encoded by KIAA1210, corresponding to a target binding site such as BINDING SITE I, BINDING SITE II or BINDING SITE III of FIG. 8. Table 4 illustrates the complementarity of the nucleotide sequences of KIAA1210 BINDING SITE, designated SEQ ID:6250, to the nucleotide sequence of GAM63 RNA, herein designated GAM RNA, also designated SEQ ID:348.

Another function of GAM63 is therefore inhibition of KIAA1210 (Accession XP_172801.1). Accordingly, utilities of GAM63 include diagnosis, prevention and treatment of diseases and clinical conditions associated with KIAA1210.

KIAA1318 (Accession NP_065820.1) is another GAM63 target gene, herein designated TARGET GENE. KIAA1318 BINDING SITE is a target binding site found in the 3' untranslated region of mRNA encoded by KIAA1318, corresponding to a target binding site such as BINDING SITE I, BINDING SITE II or BINDING SITE III of FIG. 8. Table 4 illustrates the complementarity of the nucleotide sequences of KIAA1318 BINDING SITE, designated SEQ ID:5129, to the nucleotide sequence of GAM63 RNA, herein designated GAM RNA, also designated SEQ ID:348.

Another function of GAM63 is therefore inhibition of KIAA1318 (Accession NP_065820.1). Accordingly, utilities of GAM63 include diagnosis, prevention and treatment of diseases and clinical conditions associated with KIAA1318.

KIAA1396 (Accession XP_032054.2) is another GAM63 target gene, herein designated TARGET GENE. KIAA1396 BINDING SITE is a target binding site found in the 3' untranslated region of mRNA encoded by KIAA1396, corresponding to a target binding site such as BINDING SITE I, BINDING SITE II or BINDING SITE III of FIG. 8. Table 4 illustrates the complementarity of the nucleotide sequences of KIAA1396 BINDING SITE, designated SEQ ID:5415, to the nucleotide sequence of GAM63 RNA, herein designated GAM RNA, also designated SEQ ID:348.

Another function of GAM63 is therefore inhibition of KIAA1396 (Accession XP_032054.2). Accordingly, utilities of GAM63 include diagnosis, prevention and treatment of diseases and clinical conditions associated with KIAA1396.

KIAA1416 (Accession XP_098762.3) is another GAM63 target gene, herein designated TARGET GENE. KIAA1416 BINDING SITE is a target binding site found in the 3' untranslated region of mRNA encoded by KIAA1416, corresponding to a target binding site such as BINDING SITE I, BINDING SITE II or BINDING SITE III of FIG. 8. Table 4 illustrates the complementarity of the nucleotide sequences of KIAA1416 BINDING SITE, designated SEQ ID:2332, to the nucleotide sequence of GAM63 RNA, herein designated GAM RNA, also designated SEQ ID:348.

Another function of GAM63 is therefore inhibition of KIAA1416 (Accession XP_098762.3). Accordingly, utilities of GAM63 include diagnosis, prevention and treatment of diseases and clinical conditions associated with KIAA1416.

KIAA1493 (Accession XP_034415.1) is another GAM63 target gene, herein designated TARGET GENE. KIAA1493 BINDING SITE is a target binding site found in the 3' untranslated region of mRNA encoded by KIAA1493, corresponding to a target binding site such as BINDING SITE I, BINDING SITE II or BINDING SITE III of FIG. 8. Table 4 illustrates the complementarity of the nucleotide sequences of KIAA1493 BINDING SITE, designated SEQ ID:18298, to the nucleotide sequence of GAM63 RNA, herein designated GAM RNA, also designated SEQ ID:348.

Another function of GAM63 is therefore inhibition of KIAA1493 (Accession XP_034415.1). Accordingly, utilities of GAM63 include diagnosis, prevention and treatment of diseases and clinical conditions associated with KIAA1493.

KIAA1511 (Accession XP_046581.5) is another GAM63 target gene, herein designated TARGET GENE. KIAA1511 BINDING SITE is a target binding site found in the 3' untranslated region of mRNA encoded by KIAA1511, corresponding to a target binding site such as BINDING SITE I, BINDING SITE II or BINDING SITE III of FIG. 8. Table 4 illustrates the complementarity of the nucleotide sequences of KIAA1511 BINDING SITE, designated SEQ ID:2587, to the nucleotide sequence of GAM63 RNA, herein designated GAM RNA, also designated SEQ ID:348.

Another function of GAM63 is therefore inhibition of KIAA1511 (Accession XP_046581.5). Accordingly, utilities of GAM63 include diagnosis, prevention and treatment of diseases and clinical conditions associated with KIAA1511.

KIAA1530 (Accession XP_042661.5) is another GAM63 target gene, herein designated TARGET GENE. KIAA1530 BINDING SITE is a target binding site found in the 3' untranslated region of mRNA encoded by KIAA1530, corresponding to a target binding site such as BINDING SITE I, BINDING SITE II or BINDING SITE III of FIG. 8. Table 4 illustrates the complementarity of the nucleotide sequences of KIAA1530 BINDING SITE, designated SEQ ID:8145, to the nucleotide sequence of GAM63 RNA, herein designated GAM RNA, also designated SEQ ID:348.

Another function of GAM63 is therefore inhibition of KIAA1530 (Accession XP_042661.5). Accordingly, utilities of GAM63 include diagnosis, prevention and treatment of diseases and clinical conditions associated with KIAA1530.

KIAA1656 (Accession XP_038022.1) is another GAM63 target gene, herein designated TARGET GENE. KIAA1656 BINDING SITE is a target binding site found in the 3' untranslated region of mRNA encoded by KIAA1656, corresponding to a target binding site such as BINDING SITE I, BINDING SITE II or BINDING SITE III of FIG. 8. Table 4 illustrates the complementarity of the nucleotide sequences of KIAA1656 BINDING SITE, designated SEQ ID:15785, to the nucleotide sequence of GAM63 RNA, herein designated GAM RNA, also designated SEQ ID:348.

Another function of GAM63 is therefore inhibition of KIAA1656 (Accession XP_038022.1). Accordingly, utilities of GAM63 include diagnosis, prevention and treatment of diseases and clinical conditions associated with KIAA1656.

KIAA1674 (Accession XP_290462.1) is another GAM63 target gene, herein designated TARGET GENE. KIAA1674 BINDING SITE is a target binding site found in the 3' untranslated region of mRNA encoded by KIAA1674, corresponding to a target binding site such as BINDING SITE I, BINDING SITE II or BINDING SITE III of FIG. 8. Table 4 illustrates the complementarity of the nucleotide sequences of KIAA1674 BINDING SITE, designated SEQ ID:8923, to the nucleotide sequence of GAM63 RNA, herein designated GAM RNA, also designated SEQ ID:348.

Another function of GAM63 is therefore inhibition of KIAA1674 (Accession XP_290462.1). Accordingly, utilities of GAM63 include diagnosis, prevention and treatment of diseases and clinical conditions associated with KIAA1674.

KIAA1753 (Accession XP_036115.3) is another GAM63 target gene, herein designated TARGET GENE. KIAA1753 BINDING SITE is a target binding site found in the 3' untranslated region of mRNA encoded by KIAA1753, corresponding to a target binding site such as BINDING SITE I, BINDING SITE II or BINDING SITE III of FIG. 8. Table 4 illustrates the complementarity of the nucleotide sequences of KIAA1753 BINDING SITE, designated SEQ ID:6431, to the nucleotide sequence of GAM63 RNA, herein designated GAM RNA, also designated SEQ ID:348.

Another function of GAM63 is therefore inhibition of KIAA1753 (Accession XP_036115.3). Accordingly, utilities of GAM63 include diagnosis, prevention and treatment of diseases and clinical conditions associated with KIAA1753.

KIAA1805 (Accession NP_115810.1) is another GAM63 target gene, herein designated TARGET GENE. KIAA1805 BINDING SITE is a target binding site found in the 3' untranslated region of mRNA encoded by KIAA1805, corresponding to a target binding site such as BINDING SITE I, BINDING SITE II or BINDING SITE III of FIG. 8. Table 4 illustrates the complementarity of the nucleotide sequences of KIAA1805 BINDING SITE, designated SEQ ID:17427, to the nucleotide sequence of GAM63 RNA, herein designated GAM RNA, also designated SEQ ID:348.

Another function of GAM63 is therefore inhibition of KIAA1805 (Accession NP_115810.1). Accordingly, utilities of GAM63 include diagnosis, prevention and treatment of diseases and clinical conditions associated with KIAA1805.

KIAA1920 (Accession XP_085210.1) is another GAM63 target gene, herein designated TARGET GENE. KIAA1920 BINDING SITE is a target binding site found in the 5' untranslated region of mRNA encoded by KIAA1920, corresponding to a target binding site such as BINDING SITE I, BINDING SITE II or BINDING SITE III of FIG. 8. Table 4 illustrates the complementarity of the nucleotide sequences of KIAA1920 BINDING SITE, designated SEQ ID:17296, to the nucleotide sequence of GAM63 RNA, herein designated GAM RNA, also designated SEQ ID:348.

Another function of GAM63 is therefore inhibition of KIAA1920 (Accession XP_085210.1). Accordingly, utilities of GAM63 include diagnosis, prevention and treatment of diseases and clinical conditions associated with KIAA1920.

KIAA2020 (Accession XP_290463.1) is another GAM63 target gene, herein designated TARGET GENE. KIAA2020 BINDING SITE is a target binding site found in the 3' untranslated region of mRNA encoded by KIAA2020, corresponding to a target binding site such as BINDING SITE I, BINDING SITE II or BINDING SITE III of FIG. 8. Table 4 illustrates the complementarity of the nucleotide sequences of KIAA2020 BINDING SITE, designated SEQ ID:16952, to the nucleotide sequence of GAM63 RNA, herein designated GAM RNA, also designated SEQ ID:348.

Another function of GAM63 is therefore inhibition of KIAA2020 (Accession XP_290463.1). Accordingly, utilities of GAM63 include diagnosis, prevention and treatment of diseases and clinical conditions associated with KIAA2020.

Kinesin family member 3c (KIF3C, Accession NP_002245.2) is another GAM63 target gene, herein designated TARGET GENE. KIF3C BINDING SITE is a target binding site found in the 3' untranslated region of mRNA encoded by KIF3C, corresponding to a target binding site such as BINDING SITE I, BINDING SITE II or BINDING SITE III of FIG. 8. Table 4 illustrates the complementarity of the nucleotide sequences of KIF3C BINDING SITE, designated SEQ ID:10471, to the nucleotide sequence of GAM63 RNA, herein designated GAM RNA, also designated SEQ ID:348.

Another function of GAM63 is therefore inhibition of Kinesin family member 3c (KIF3C, Accession NP_002245.2). Accordingly, utilities of GAM63 include diagnosis, prevention and treatment of diseases and clinical conditions associated with KIF3C.

Kin of irre like (drosophila) (KIRREL, Accession NP_060710.1) is another GAM63 target gene, herein designated TARGET GENE. KIRREL BINDING SITE is a target binding site found in the 3' untranslated region of mRNA encoded by KIRREL, corresponding to a target binding site such as BINDING SITE I, BINDING SITE II or BINDING SITE III of FIG. 8. Table 4 illustrates the complementarity of the nucleotide sequences of KIRREL BINDING SITE, designated SEQ ID:6373, to the nucleotide sequence of GAM63 RNA, herein designated GAM RNA, also designated SEQ ID:348.

Another function of GAM63 is therefore inhibition of Kin of irre like (drosophila) (KIRREL, Accession NP_060710.1). Accordingly, utilities of GAM63 include diagnosis, prevention and treatment of diseases and clinical conditions associated with KIRREL.

Kruppel-like factor 2 (lung) (KLF2, Accession NP_057354.1) is another GAM63 target gene, herein designated TARGET GENE. KLF2 BINDING SITE is a target binding site found in the 3' untranslated region of mRNA encoded by KLF2, corresponding to a target binding site such as BINDING SITE I, BINDING SITE II or BINDING SITE III of FIG. 8. Table 4 illustrates the complementarity of the nucleotide sequences of KLF2 BINDING SITE, designated SEQ ID:446, to the nucleotide sequence of GAM63 RNA, herein designated GAM RNA, also designated SEQ ID:348.

Another function of GAM63 is therefore inhibition of Kruppel-like factor 2 (lung) (KLF2, Accession NP_057354.1). Accordingly, utilities of GAM63 include diagnosis, prevention and treatment of diseases and clinical conditions associated with KLF2.

Karyopherin alpha 1 (importin alpha 5) (KPNA1, Accession NP_002255.1) is another GAM63 target gene, herein designated TARGET GENE. KPNA1 BINDING SITE is a target binding site found in the 3' untranslated region of mRNA encoded by KPNA1, corresponding to a target binding site such as BINDING SITE I, BINDING SITE II or BINDING SITE III of FIG. 8. Table 4 illustrates the complementarity of the nucleotide sequences of KPNA1 BINDING SITE, designated SEQ ID:8053, to the nucleotide sequence of GAM63 RNA, herein designated GAM RNA, also designated SEQ ID:348.

Another function of GAM63 is therefore inhibition of Karyopherin alpha 1 (importin alpha 5) (KPNA1, Accession NP_002255.1), a gene which promotes docking of import substrates to the nuclear pore complex. Accordingly, utilities of GAM63 include diagnosis, prevention and treatment of diseases and clinical conditions associated with KPNA1.

The function of KPNA1 has been established by previous studies. Cortes et al. (1994) used the 2-hybrid protein interaction systems to isolate a protein that specifically interacts with RAG1 (OMIM Ref. No. 179615). The genes RAG1 and RAG2 (OMIM Ref. No. 179616) are able to activate V(D)J recombination when transfected into fibroblasts. Further, knockout mice for these 2 loci lack B and T cells. Several other ubiquitously expressed proteins are thought to be recruited in the recombination process. Among these are the genes affected in severe combined immune deficiency (e.g., OMIM Ref. No. also 600899) and genes involved in ds-DNA break repair. The human cDNA identified by Cortes et al. (1994) encodes a 489-amino acid polypeptide that shows striking similarity to the yeast SRP1 protein, a mutant allele which can suppress a mutation of RNA polymerase I. The authors obtained human and mouse cDNA sequences which are 98% identical as proteins. When RAG1 and human SRP1 were cotransfected into 293T cells a stable complex of the 2 was observed. The authors speculated that because SRP1 appears to be bound to the nuclear envelope, the interaction with RAG1 may serve to localize that protein to the envelope as well. Conti et al. (1998) reported the crystal structure of a 50-kD fragment of the 60-kD yeast karyopherin alpha, in the absence and presence of a monopartite nuclear localization signal (NLS) peptide at 2.2-angstrom and 2.8-angstrom resolution, respectively. The structure showed a tandem array of 10 armadillo repeats, organized in a right-handed superhelix of helices. Binding of the NLS peptide occurred at 2 sites within a helical surface groove. The structure reveals the determinants of NLS specificity and suggested a model for the recognition of bipartite NLSs. By fluorescence in situ hybridization, Ayala-Madrigal et al. (2000) mapped the human KPNA1 gene to chromosome 3q21.

Full details of the abovementioned studies are described in the following publications, the disclosure of which are hereby incorporated by reference:

Ayala-Madrigal, M. L.; Doerr, S.; Ramirez-Duenas, M. L.; Hansmann, I.: Assignment of karyopherin alpha 1 (KPNA1) to human chromosome band 3q21 by in situ hybridization. Cytogenet. Cell Genet. 90:58-59, 2000; and Conti, E.; Uy, M.; Leighton, L.; Blobel, G.; Kuriyan, J.: Crystallographic analysis of the recognition of a nuclear localization signal by the nuclear import factor karyopherin alpha.

Further studies establishing the function and utilities of KPNA1 are found in John Hopkins OMIM database record ID 600686, and in cited publications listed in Table 5, which are hereby incorporated by reference. Karyopherin (importin) beta 2 (KPNB2, Accession NP_694858.1) is another GAM63 target gene, herein designated TARGET GENE. KPNB2 BINDING SITE is a target binding site found in the 3' untranslated region of multiple transcripts of mRNA encoded by KPNB2, corresponding to a target binding site such as BINDING SITE I, BINDING SITE II or BINDING SITE III of FIG. 8. Table 4 illustrates the complementarity of the nucleotide sequences of KPNB2 BINDING SITE, designated SEQ ID:10216, to the nucleotide sequence of GAM63 RNA, herein designated GAM RNA, also designated SEQ ID:348.

Another function of GAM63 is therefore inhibition of Karyopherin (importin) beta 2 (KPNB2, Accession NP_694858.1), a gene which is involved in nuclear import of m9-containing proteins. Accordingly, utilities of GAM63 include diagnosis, prevention and treatment of diseases and clinical conditions associated with KPNB2.

The function of KPNB2 has been established by previous studies. Targeting of most nuclear proteins to the cell nucleus is initiated by interaction between the protein's nuclear localization signal (NLS) and the importin, or karyopherin, receptor complex. An importin heterodimer recognizes the NLS protein in the cytoplasm via its alpha subunit and, via its beta subunit, docks the complex to a subset of peptide repeat-containing proteins known as nucleoporins. See importin beta-1 (KPNB1; 602738). Michael et al. (1995) determined that the C terminus of HNRPA1 (OMIM Ref. No. 164017) contains a 38-amino acid domain, termed M9, that confers bidirectional transport across the nuclear envelope. Pollard et al. (1996) found that M9-mediated nuclear import occurs by a novel pathway independent of the importin-mediated NLS pathway. Using a yeast 2-hybrid system, they identified a HeLa cell cDNA encoding a protein that interacts with an M9-containing sequence. The predicted 890-amino acid protein was designated M9-interacting protein (MIP1), or transportin. Transportin contains 2 leucine zipper motifs and a 19-amino acid highly acidic domain, and has an estimated pI of 4.6. Pollard et al. (1996) demonstrated that transportin mediated the nuclear import of M9-bearing proteins. Bonifaci et al. (1997) isolated cDNAs encoding transportin, which they designated karyopherin beta-2, or KPNB2. They reported that the predicted protein sequence is 34% identical to that of the yeast beta-karyopherin Kap104p. Using overlay blots, Bonifaci et al. (1997) demonstrated that KPNB2 also functions as a docking factor that binds to peptide repeat-containing nucleoporins. In an assay using permeabilized HeLa cells, KPNB2 inhibited KPNB1-mediated import of an NLS-containing substrate and KPNB1 inhibited KPNB2-mediated import of recombinant HNRPA1. These results led Bonifaci et al. (1997) to suggest that the distinct KPNB1- and KPNB2-mediated nuclear import pathways merge at least partially at the level of docking to nucleoporins. The International Radiation Hybrid Mapping Consortium mapped the KPNB2 gene to chromosome 5 (WI-13973).

Full details of the abovementioned studies are described in the following publications, the disclosure of which are hereby incorporated by reference:

Bonifaci, N.; Moroianu, J.; Radu, A.; Blobel, G.: Karyopherin beta-2 mediates nuclear import of a mRNA binding protein. Proc. Nat. Acad. Sci. 94:5055-5060, 1997; and Michael, W. M.; Choi, M.; Dreyfuss, G.: A nuclear export signal in hnRNP A1: a signal-mediated, temperature-dependent nuclear protein export pathway. Cell 83:415-422, 1995.

Further studies establishing the function and utilities of KPNB2 are found in John Hopkins OMIM database record ID 602901, and in cited publications listed in Table 5, which are hereby incorporated by reference. Karyopherin (importin) beta 2 (KPNB2, Accession NP_002261.2) is another GAM63 target gene, herein designated TARGET GENE. KPNB2 BINDING SITE is a target binding site found in the 3' untranslated region of multiple transcripts of mRNA encoded by KPNB2, corresponding to a target binding site such as BINDING SITE I, BINDING SITE II or BINDING SITE III of FIG. 8. Table 4 illustrates the complementarity of the nucleotide sequences of KPNB2 BINDING SITE, designated SEQ ID:10216, to the nucleotide sequence of GAM63 RNA, herein designated GAM RNA, also designated SEQ ID:348.

Another function of GAM63 is therefore inhibition of Karyopherin (importin) beta 2 (KPNB2, Accession NP_002261.2), a gene which is involved in nuclear import of m9-containing proteins. Accordingly, utilities of GAM63 include diagnosis, prevention and treatment of diseases and clinical conditions associated with KPNB2.

The function of KPNB2 has been established by previous studies. Targeting of most nuclear proteins to the cell nucleus is initiated by interaction between the protein's nuclear localization signal (NLS) and the importin, or karyopherin, receptor complex. An importin heterodimer recognizes the NLS protein in the cytoplasm via its alpha subunit and, via its beta subunit, docks the complex to a subset of peptide repeat-containing proteins known as nucleoporins. See importin beta-1 (KPNB1; 602738). Michael et al. (1995) determined that the C terminus of HNRPA1 (OMIM Ref. No. 164017) contains a 38-amino acid domain, termed M9, that confers bidirectional transport across the nuclear envelope. Pollard et al. (1996) found that M9-mediated nuclear import occurs by a novel pathway independent of the importin-mediated NLS pathway. Using a yeast 2-hybrid system, they identified a HeLa cell cDNA encoding a protein that interacts with an M9- containing sequence. The predicted 890-amino acid protein was designated M9-interacting protein (MIP1), or transportin. Transportin contains 2 leucine zipper motifs and a 19-amino acid highly acidic domain, and has an estimated pI of 4.6. Pollard et al. (1996) demonstrated that transportin mediated the nuclear import of M9-bearing proteins. Bonifaci et al. (1997) isolated cDNAs encoding transportin, which they designated karyopherin beta-2, or KPNB2. They reported that the predicted protein sequence is 34% identical to that of the yeast beta-karyopherin Kap104p. Using overlay blots, Bonifaci et al. (1997) demonstrated that KPNB2 also functions as a docking factor that binds to peptide repeat-containing nucleoporins. In an assay using permeabilized HeLa cells, KPNB2 inhibited KPNB1-mediated import of an NLS-containing substrate and KPNB1 inhibited KPNB2-mediated import of recombinant HNRPA1. These results led Bonifaci et al. (1997) to suggest that the distinct KPNB1- and KPNB2-mediated nuclear import pathways merge at least partially at the level of docking to nucleoporins. The International Radiation Hybrid Mapping Consortium mapped the KPNB2 gene to chromosome 5 (WI- 13973).

Full details of the abovementioned studies are described in the following publications, the disclosure of which are hereby incorporated by reference:

Bonifaci, N.; Moroianu, J.; Radu, A.; Blobel, G.: Karyopherin beta-2 mediates nuclear import of a mRNA binding protein. Proc. Nat. Acad. Sci. 94:5055-5060, 1997; and Michael, W. M.; Choi, M.; Dreyfuss, G.: A nuclear export signal in hnRNP A1: a signal-mediated, temperature-dependent nuclear protein export pathway. Cell 83:415-422, 1995.

Further studies establishing the function and utilities of KPNB2 are found in John Hopkins OMIM database record ID 602901, and in cited publications listed in Table 5, which are hereby incorporated by reference. Keratin associated protein 1-5 (KRTAP1-5, Accession NP_114163.1) is another GAM63 target gene, herein designated TARGET GENE. KRTAP1-5 BINDING SITE is a target binding site found in the 3' untranslated region of mRNA encoded by KRTAP1-5, corresponding to a target binding site such as BINDING SITE I, BINDING SITE II or BINDING SITE III of FIG. 8. Table 4 illustrates the complementarity of the nucleotide sequences of KRTAP1-5 BINDING SITE, designated SEQ ID:20046, to the nucleotide sequence of GAM63 RNA, herein designated GAM RNA, also designated SEQ ID:348.

Another function of GAM63 is therefore inhibition of Keratin associated protein 1-5 (KRTAP1-5, Accession NP_114163.1). Accordingly, utilities of GAM63 include diagnosis, prevention and treatment of diseases and clinical conditions associated with KRTAP1-5.

Keratin associated protein 3-1 (KRTAP3-1, Accession NP_114164.1) is another GAM63 target gene, herein designated TARGET GENE. KRTAP3-1 BINDING SITE is a target binding site found in the 3' untranslated region of mRNA encoded by KRTAP3-1, corresponding to a target binding site such as BINDING SITE I, BINDING SITE II or BINDING SITE III of FIG. 8. Table 4 illustrates the complementarity of the nucleotide sequences of KRTAP3-1 BINDING SITE, designated SEQ ID:6804, to the nucleotide sequence of GAM63 RNA, herein designated GAM RNA, also designated SEQ ID:348.

Another function of GAM63 is therefore inhibition of Keratin associated protein 3-1 (KRTAP3-1, Accession NP_114164.1). Accordingly, utilities of GAM63 include diagnosis, prevention and treatment of diseases and clinical conditions associated with KRTAP3-1.

Lactation elevated 1 (LACE1, Accession NP_660358.2) is another GAM63 target gene, herein designated TARGET GENE. LACE1 BINDING SITE is a target binding site found in the 3' untranslated region of mRNA encoded by LACE1, corresponding to a target binding site such as BINDING SITE I, BINDING SITE II or BINDING SITE III of FIG. 8. Table 4 illustrates the complementarity of the nucleotide sequences of LACE1 BINDING SITE, designated SEQ ID:5643, to the nucleotide sequence of GAM63 RNA, herein designated GAM RNA, also designated SEQ ID:348.

Another function of GAM63 is therefore inhibition of Lactation elevated 1 (LACE1, Accession NP_660358.2). Accordingly, utilities of GAM63 include diagnosis, prevention and treatment of diseases and clinical conditions associated with LACE1.

Laminin, beta 1 (LAMB1, Accession NP_002282.1) is another GAM63 target gene, herein designated TARGET GENE. LAMB1 BINDING SITE is a target binding site found in the 5' untranslated region of mRNA encoded by LAMB1, corresponding to a target binding site such as BINDING SITE I, BINDING SITE II or BINDING SITE III of FIG. 8. Table 4 illustrates the complementarity of the nucleotide sequences of LAMB1 BINDING SITE, designated SEQ ID:12728, to the nucleotide sequence of GAM63 RNA, herein designated GAM RNA, also designated SEQ ID:348.

Another function of GAM63 is therefore inhibition of Laminin, beta 1 (LAMB1, Accession NP_002282.1), a gene which mediates the attachment, migration, and organization of cells into tissues. and therefore may be associated with Marfan syndrome. Accordingly, utilities of GAM63 include diagnosis, prevention and treatment of Marfan syndrome, and of other diseases and clinical conditions associated with LAMB1.

The function of LAMB1 has been established by previous studies. The major components of basal laminae are the glycoproteins laminin and collagen IV, both of which are heterotrimers. Laminin is a cruciform protein trimer of chains that when originally isolated from the extracellular matrix of tumor cells, were named A, B1, and B2, but were renamed alpha-1, beta-1, and gamma-1, respectively (Burgeson et al., 1994). The laminin and collagen IV isoforms vary from one basal lamina to another and are members of multigene families. These gene families (like others, such as the globins and myosins) may provide a means of generating functional diversity within a common structural framework. Modi et al. (1987) mapped the LAMB1 locus to 7q31.1-q31.3 by Southern blot analysis of somatic cell hybrids and by in situ hybridization. On the other hand, by the same methods, Pikkarainen et al. (1987) placed LAMB1 in the 7q22 band. Jaye et al. (1987) regionalized LAMB1 to band 7q31 by somatic cell hybridization and in situ hybridization. Bonneau et al. (1991) described an infant with cutis laxa, emphysema, striking cardiac abnormalities and a diaphragmatic hernia leading to death at the age of 22 weeks. The infant had mild contractures at the elbows, hips, and knees, with bilateral hip dislocation. Arachnodactyly was striking. Chromosome studies showed a chromatid break at the junction of 7q31.3 and 7q32. Among 17 previously reported cases with the same syndrome, 1 was found to have a translocation involving 7q31 (Huret et al., 1991). Bonneau et al. (1991) called the condition neonatal cutis laxa with marfanoid phenotype. The clinical features and the location of the chromosomal change prompted Bonneau et al. (1991) to study laminin, which, by use of anti-human laminin antiserum, was found to be absent from the basement membranes of capillaries and the dermal-epidermal junction. Fibronectin was also not detected in the skin sample. Laminin B1 (OMIM Ref. No. 150240) maps to the same region of 7q. Bonneau et al. (1991) pointed to reports of some 12 cases of neonatal 'Marfan syndrome' which might represent this same syndrome. These included the cases of Neimann et al. (1968), Hohn and Webb (1971), Lababidi and Monzon (1981), Buchanan and Wyatt (1985), Day and Burke (1986), and Gross et al. (1989). In a note added in proof, Bonneau et al. (1991) stated that studies of the case published by Neimann et al. (1968) showed deficiency of laminin in the basement membranes. Burgeson et al. (1994), a group of 14 leading researchers in the field of connective tissue proteins, adopted a new nomenclature for the laminins. They were numbered with arabic numerals in the order discovered. The previous A, B1, and B2 chains, and their isoforms, are alpha, beta, and gamma, respectively, followed by an arabic numeral to identify the isoform. For example, the first laminin identified from the Engelbreth-Holm-Swarm tumor (EHS) was designated laminin-1 with the chain composition alpha-1/beta-1/gamma-1. The genes for these 3 chains are LAMA1 (OMIM Ref. No. 150320), LAMB1, and LAMC1 (OMIM Ref. No. 150290).

Full details of the abovementioned studies are described in the following publications, the disclosure of which are hereby incorporated by reference:

Burgeson, R. E.; Chiquet, M.; Deutzmann, R.; Ekblom, P.; Engel, J.; Kleinman, H.; Martin, G. R.; Meneguzzi, G.; Paulsson, M.; Sanes, J.; Timpl, R.; Tryggvason, K.; Yamada, Y.; Yurchenco, P. D.: A new nomenclature for the laminins. Matrix Biol. 14:209-211, 1994; and Bonneau, D.; Huret, J. L.; Godeau, G.; Couet, D.; Putterman, M.; Tanzer, J.; Babin, P.; Larregue, M.: Recurrent ctb (7)(q31.3) and possible laminin involvement in a neonatal cutis laxa w.

Further studies establishing the function and utilities of LAMB1 are found in John Hopkins OMIM database record ID 150240, and in cited publications listed in Table 5, which are hereby incorporated by reference. LCHN (Accession XP_098615.2) is another GAM63 target gene, herein designated TARGET GENE. LCHN BINDING SITE is a target binding site found in the 3' untranslated region of mRNA encoded by LCHN, corresponding to a target binding site such as BINDING SITE I, BINDING SITE II or BINDING SITE III of FIG. 8. Table 4 illustrates the complementarity of the nucleotide sequences of LCHN BINDING SITE, designated SEQ ID:447, to the nucleotide sequence of GAM63 RNA, herein designated GAM RNA, also designated SEQ ID:348.

Another function of GAM63 is therefore inhibition of LCHN (Accession XP_098615.2). Accordingly, utilities of GAM63 include diagnosis, prevention and treatment of diseases and clinical conditions associated with LCHN.

LEREPO4 (Accession NP_060941.1) is another GAM63 target gene, herein designated TARGET GENE. LEREPO4 BINDING SITE is a target binding site found in the 3' untranslated region of mRNA encoded by LEREPO4, corresponding to a target binding site such as BINDING SITE I, BINDING SITE II or BINDING SITE III of FIG. 8. Table 4 illustrates the complementarity of the nucleotide sequences of LEREPO4 BINDING SITE, designated SEQ ID:12248, to the nucleotide sequence of GAM63 RNA, herein designated GAM RNA, also designated SEQ ID:348.

Another function of GAM63 is therefore inhibition of LEREPO4 (Accession NP_060941.1). Accordingly, utilities of GAM63 include diagnosis, prevention and treatment of diseases and clinical conditions associated with LEREPO4.

LOC112476 (Accession NP_660282.1) is another GAM63 target gene, herein designated TARGET GENE. LOC112476 BINDING SITE is a target binding site found in the 5' untranslated region of mRNA encoded by LOC112476, corresponding to a target binding site such as BINDING SITE I, BINDING SITE II or BINDING SITE III of FIG. 8. Table 4 illustrates the complementarity of the nucleotide sequences of LOC112476 BINDING SITE, designated SEQ ID:13020, to the nucleotide sequence of GAM63 RNA, herein designated GAM RNA, also designated SEQ ID:348.

Another function of GAM63 is therefore inhibition of LOC112476 (Accession NP_660282.1). Accordingly, utilities of GAM63 include diagnosis, prevention and treatment of diseases and clinical conditions associated with LOC112476.

LOC112840 (Accession NP_542397.1) is another GAM63 target gene, herein designated TARGET GENE. LOC112840 BINDING SITE is a target binding site found in the 3' untranslated region of mRNA encoded by LOC112840, corresponding to a target binding site such as BINDING SITE I, BINDING SITE II or BINDING SITE III of FIG. 8. Table 4 illustrates the complementarity of the nucleotide sequences of LOC112840 BINDING SITE, designated SEQ ID:3419, to the nucleotide sequence of GAM63 RNA, herein designated GAM RNA, also designated SEQ ID:348.

Another function of GAM63 is therefore inhibition of LOC112840 (Accession NP_542397.1). Accordingly, utilities of GAM63 include diagnosis, prevention and treatment of diseases and clinical conditions associated with LOC112840.

LOC118709 (Accession XP_058338.2) is another GAM63 target gene, herein designated TARGET GENE. LOC118709 BINDING SITE is a target binding site found in the 3' untranslated region of mRNA encoded by LOC118709, corresponding to a target binding site such as BINDING SITE I, BINDING SITE II or BINDING SITE III of FIG. 8. Table 4 illustrates the complementarity of the nucleotide sequences of LOC118709 BINDING SITE, designated SEQ ID:10613, to the nucleotide sequence of GAM63 RNA, herein designated GAM RNA, also designated SEQ ID:348.

Another function of GAM63 is therefore inhibition of LOC118709 (Accession XP_058338.2). Accordingly, utilities of GAM63 include diagnosis, prevention and treatment of diseases and clinical conditions associated with LOC118709.

LOC120376 (Accession XP_071712.3) is another GAM63 target gene, herein designated TARGET GENE. LOC120376 BINDING SITE is a target binding site found in the 5' untranslated region of mRNA encoded by LOC120376, corresponding to a target binding site such as BINDING SITE I, BINDING SITE II or BINDING SITE III of FIG. 8. Table 4 illustrates the complementarity of the nucleotide sequences of LOC120376 BINDING SITE, designated SEQ ID:15763, to the nucleotide sequence of GAM63 RNA, herein designated GAM RNA, also designated SEQ ID:348.

Another function of GAM63 is therefore inhibition of LOC120376 (Accession XP_071712.3). Accordingly, utilities of GAM63 include diagnosis, prevention and treatment of diseases and clinical conditions associated with LOC120376.

LOC122258 (Accession NP_660291.1) is another GAM63 target gene, herein designated TARGET GENE. LOC122258 BINDING SITE is a target binding site found in the 5' untranslated region of mRNA encoded by LOC122258, corresponding to a target binding site such as BINDING SITE I, BINDING SITE II or BINDING SITE III of FIG. 8. Table 4 illustrates the complementarity of the nucleotide sequences of LOC122258 BINDING SITE, designated SEQ ID:14397, to the nucleotide sequence of GAM63 RNA, herein designated GAM RNA, also designated SEQ ID:348.

Another function of GAM63 is therefore inhibition of LOC122258 (Accession NP_660291.1). Accordingly, utilities of GAM63 include diagnosis, prevention and treatment of diseases and clinical conditions associated with LOC122258.

LOC123346 (Accession XP_063609.1) is another GAM63 target gene, herein designated TARGET GENE. LOC123346 BINDING SITE is a target binding site found in the 3' untranslated region of mRNA encoded by LOC123346, corresponding to a target binding site such as BINDING SITE I, BINDING SITE II or BINDING SITE III of FIG. 8. Table 4 illustrates the complementarity of the nucleotide sequences of LOC123346 BINDING SITE, designated SEQ ID:1872, to the nucleotide sequence of GAM63 RNA, herein designated GAM RNA, also designated SEQ ID:348.

Another function of GAM63 is therefore inhibition of LOC123346 (Accession XP_063609.1). Accordingly, utilities of GAM63 include diagnosis, prevention and treatment of diseases and clinical conditions associated with LOC123346.

LOC124245 (Accession NP_653205.2) is another GAM63 target gene, herein designated TARGET GENE. LOC124245 BINDING SITE is a target binding site found in the 5' untranslated region of mRNA encoded by LOC124245, corresponding to a target binding site such as BINDING SITE I, BINDING SITE II or BINDING SITE III of FIG. 8. Table 4 illustrates the complementarity of the nucleotide sequences of LOC124245 BINDING SITE, designated SEQ ID:3920, to the nucleotide sequence of GAM63 RNA, herein designated GAM RNA, also designated SEQ ID:348.

Another function of GAM63 is therefore inhibition of LOC124245 (Accession NP_653205.2). Accordingly, utilities of GAM63 include diagnosis, prevention and treatment of diseases and clinical conditions associated with LOC124245.

LOC130074 (Accession XP_072228.2) is another GAM63 target gene, herein designated TARGET GENE. LOC130074 BINDING SITE is a target binding site found in the 3' untranslated region of mRNA encoded by LOC130074, corresponding to a target binding site such as BINDING SITE I, BINDING SITE II or BINDING SITE III of FIG. 8. Table 4 illustrates the complementarity of the nucleotide sequences of LOC130074 BINDING SITE, designated SEQ ID:8538, to the nucleotide sequence of GAM63 RNA, herein designated GAM RNA, also designated SEQ ID:348.

Another function of GAM63 is therefore inhibition of LOC130074 (Accession XP_072228.2). Accordingly, utilities of GAM63 include diagnosis, prevention and treatment of diseases and clinical conditions associated with LOC130074.

LOC130644 (Accession XP_065813.2) is another GAM63 target gene, herein designated TARGET GENE. LOC130644 BINDING SITE is a target binding site found in the 3' untranslated region of mRNA encoded by LOC130644, corresponding to a target binding site such as BINDING SITE I, BINDING SITE II or BINDING SITE III of FIG. 8. Table 4 illustrates the complementarity of the nucleotide sequences of LOC130644 BINDING SITE, designated SEQ ID:11552, to the nucleotide sequence of GAM63 RNA, herein designated GAM RNA, also designated SEQ ID:348.

Another function of GAM63 is therefore inhibition of LOC130644 (Accession XP_065813.2). Accordingly, utilities of GAM63 include diagnosis, prevention and treatment of diseases and clinical conditions associated with LOC130644.

LOC130916 (Accession XP_059481.2) is another GAM63 target gene, herein designated TARGET GENE. LOC130916 BINDING SITE is a target binding site found in the 5' untranslated region of mRNA encoded by LOC130916, corresponding to a target binding site such as BINDING SITE I, BINDING SITE II or BINDING SITE III of FIG. 8. Table 4 illustrates the complementarity of the nucleotide sequences of LOC130916 BINDING SITE, designated SEQ ID:2189, to the nucleotide sequence of GAM63 RNA, herein designated GAM RNA, also designated SEQ ID:348.

Another function of GAM63 is therefore inhibition of LOC130916 (Accession XP_059481.2). Accordingly, utilities of GAM63 include diagnosis, prevention and treatment of diseases and clinical conditions associated with LOC130916.

LOC132235 (Accession XP_072302.1) is another GAM63 target gene, herein designated TARGET GENE. LOC132235 BINDING SITE is a target binding site found in the 5' untranslated region of mRNA encoded by LOC132235, corresponding to a target binding site such as BINDING SITE I, BINDING SITE II or BINDING SITE III of FIG. 8. Table 4 illustrates the complementarity of the nucleotide sequences of LOC132235 BINDING SITE, designated SEQ ID:19785, to the nucleotide sequence of GAM63 RNA, herein designated GAM RNA, also designated SEQ ID:348.

Another function of GAM63 is therefore inhibition of LOC132235 (Accession XP_072302.1). Accordingly, utilities of GAM63 include diagnosis, prevention and treatment of diseases and clinical conditions associated with LOC132235.

LOC132948 (Accession NP_660307.1) is another GAM63 target gene, herein designated TARGET GENE. LOC132948 BINDING SITE1 and LOC132948 BINDING SITE2 are target binding sites found in untranslated regions of mRNA encoded by LOC132948, corresponding to target binding sites such as BINDING SITE I, BINDING SITE II or BINDING SITE III of FIG. 8. Table 4 illustrates the complementarity of the nucleotide sequences of LOC132948 BINDING SITE1 and LOC132948 BINDING SITE2, designated SEQ ID:3612 and SEQ ID:7690 respectively, to the nucleotide sequence of GAM63 RNA, herein designated GAM RNA, also designated SEQ ID:348.

Another function of GAM63 is therefore inhibition of LOC132948 (Accession NP_660307.1). Accordingly, utilities of GAM63 include diagnosis, prevention and treatment of diseases and clinical conditions associated with LOC132948.

LOC139201 (Accession XP_208439.1) is another GAM63 target gene, herein designated TARGET GENE. LOC139201 BINDING SITE1 and LOC139201 BINDING SITE2 are target binding sites found in untranslated regions of mRNA encoded by LOC139201, corresponding to target binding sites such as BINDING SITE I, BINDING SITE II or BINDING SITE III of FIG. 8. Table 4 illustrates the complementarity of the nucleotide sequences of LOC139201 BINDING SITE1 and LOC139201 BINDING SITE2, designated SEQ ID:11945 and SEQ ID:1459 respectively, to the nucleotide sequence of GAM63 RNA, herein designated GAM RNA, also designated SEQ ID:348.

Another function of GAM63 is therefore inhibition of LOC139201 (Accession XP_208439.1). Accordingly, utilities of GAM63 include diagnosis, prevention and treatment of diseases and clinical conditions associated with LOC139201.

LOC144467 (Accession NP_612482.1) is another GAM63 target gene, herein designated TARGET GENE. LOC144467 BINDING SITE is a target binding site found in the 5' untranslated region of mRNA encoded by LOC144467, corresponding to a target binding site such as BINDING SITE I, BINDING SITE II or BINDING SITE III of FIG. 8. Table 4 illustrates the complementarity of the nucleotide sequences of LOC144467 BINDING SITE, designated SEQ ID:10729, to the nucleotide sequence of GAM63 RNA, herein designated GAM RNA, also designated SEQ ID:348.

Another function of GAM63 is therefore inhibition of LOC144467 (Accession NP_612482.1). Accordingly, utilities of GAM63 include diagnosis, prevention and treatment of diseases and clinical conditions associated with LOC144467.

LOC144667 (Accession XP_096648.1) is another GAM63 target gene, herein designated TARGET GENE. LOC144667 BINDING SITE is a target binding site found in the 3' untranslated region of mRNA encoded by LOC144667, corresponding to a target binding site such as BINDING SITE I, BINDING SITE II or BINDING SITE III of FIG. 8. Table 4 illustrates the complementarity of the nucleotide sequences of LOC144667 BINDING SITE, designated SEQ ID:19348, to the nucleotide sequence of GAM63 RNA, herein designated GAM RNA, also designated SEQ ID:348.

Another function of GAM63 is therefore inhibition of LOC144667 (Accession XP_096648.1). Accordingly, utilities of GAM63 include diagnosis, prevention and treatment of diseases and clinical conditions associated with LOC144667.

LOC144705 (Accession XP_096669.1) is another GAM63 target gene, herein designated TARGET GENE. LOC144705 BINDING SITE is a target binding site found in the 3' untranslated region of mRNA encoded by LOC144705, corresponding to a target binding site such as BINDING SITE I, BINDING SITE II or BINDING SITE III of FIG. 8. Table 4 illustrates the complementarity of the nucleotide sequences of LOC144705 BINDING SITE, designated SEQ ID:10034, to the nucleotide sequence of GAM63 RNA, herein designated GAM RNA, also designated SEQ ID:348.

Another function of GAM63 is therefore inhibition of LOC144705 (Accession XP_096669.1). Accordingly, utilities of GAM63 include diagnosis, prevention and treatment of diseases and clinical conditions associated with LOC144705.

LOC146562 (Accession NP_631909.1) is another GAM63 target gene, herein designated TARGET GENE. LOC146562 BINDING SITE is a target binding site found in the 3' untranslated region of mRNA encoded by LOC146562, corresponding to a target binding site such as BINDING SITE I, BINDING SITE II or BINDING SITE III of FIG. 8. Table 4 illustrates the complementarity of the nucleotide sequences of LOC146562 BINDING SITE, designated SEQ ID:2282, to the nucleotide sequence of GAM63 RNA, herein designated GAM RNA, also designated SEQ ID:348.

Another function of GAM63 is therefore inhibition of LOC146562 (Accession NP_631909.1). Accordingly, utilities of GAM63 include diagnosis, prevention and treatment of diseases and clinical conditions associated with LOC146562.

LOC147123 (Accession XP_085714.2) is another GAM63 target gene, herein designated TARGET GENE. LOC147123 BINDING SITE is a target binding site found in the 5' untranslated region of mRNA encoded by LOC147123, corresponding to a target binding site such as BINDING SITE I, BINDING SITE II or BINDING SITE III of FIG. 8. Table 4 illustrates the complementarity of the nucleotide sequences of LOC147123 BINDING SITE, designated SEQ ID:2993, to the nucleotide sequence of GAM63 RNA, herein designated GAM RNA, also designated SEQ ID:348.

Another function of GAM63 is therefore inhibition of LOC147123 (Accession XP_085714.2). Accordingly, utilities of GAM63 include diagnosis, prevention and treatment of diseases and clinical conditions associated with LOC147123.

LOC148056 (Accession XP_097380.1) is another GAM63 target gene, herein designated TARGET GENE. LOC148056 BINDING SITE is a target binding site found in the 3' untranslated region of mRNA encoded by LOC148056, corresponding to a target binding site such as BINDING SITE I, BINDING SITE II or BINDING SITE III of FIG. 8. Table 4 illustrates the complementarity of the nucleotide sequences of LOC148056 BINDING SITE, designated SEQ ID:4395, to the nucleotide sequence of GAM63 RNA, herein designated GAM RNA, also designated SEQ ID:348.

Another function of GAM63 is therefore inhibition of LOC148056 (Accession XP_097380.1). Accordingly, utilities of GAM63 include diagnosis, prevention and treatment of diseases and clinical conditions associated with LOC148056.

LOC149466 (Accession XP_086546.1) is another GAM63 target gene, herein designated TARGET GENE. LOC149466 BINDING SITE is a target binding site found in the 3' untranslated region of mRNA encoded by LOC149466, corresponding to a target binding site such as BINDING SITE I, BINDING SITE II or BINDING SITE III of FIG. 8. Table 4 illustrates the complementarity of the nucleotide sequences of LOC149466 BINDING SITE, designated SEQ ID:3852, to the nucleotide sequence of GAM63 RNA, herein designated GAM RNA, also designated SEQ ID:348.

Another function of GAM63 is therefore inhibition of LOC149466 (Accession XP_086546.1). Accordingly, utilities of GAM63 include diagnosis, prevention and treatment of diseases and clinical conditions associated with LOC149466.

LOC149478 (Accession XP_086536.1) is another GAM63 target gene, herein designated TARGET GENE. LOC149478 BINDING SITE is a target binding site found in the 5' untranslated region of mRNA encoded by LOC149478, corresponding to a target binding site such as BINDING SITE I, BINDING SITE II or BINDING SITE III of FIG. 8. Table 4 illustrates the complementarity of the nucleotide sequences of LOC149478 BINDING SITE, designated SEQ ID:8470, to the nucleotide sequence of GAM63 RNA, herein designated GAM RNA, also designated SEQ ID:348.

Another function of GAM63 is therefore inhibition of LOC149478 (Accession XP_086536.1). Accordingly, utilities of GAM63 include diagnosis, prevention and treatment of diseases and clinical conditions associated with LOC149478.

LOC150035 (Accession XP_097793.1) is another GAM63 target gene, herein designated TARGET GENE. LOC150035 BINDING SITE is a target binding site found in the 5' untranslated region of mRNA encoded by LOC150035, corresponding to a target binding site such as BINDING SITE I, BINDING SITE II or BINDING SITE III of FIG. 8. Table 4 illustrates the complementarity of the nucleotide sequences of LOC150035 BINDING SITE, designated SEQ ID:15062, to the nucleotide sequence of GAM63 RNA, herein designated GAM RNA, also designated SEQ ID:348.

Another function of GAM63 is therefore inhibition of LOC150035 (Accession XP_097793.1). Accordingly, utilities of GAM63 include diagnosis, prevention and treatment of diseases and clinical conditions associated with LOC150035.

LOC150054 (Accession XP_097797.1) is another GAM63 target gene, herein designated TARGET GENE. LOC150054 BINDING SITE is a target binding site found in the 5' untranslated region of mRNA encoded by LOC150054, corresponding to a target binding site such as BINDING SITE I, BINDING SITE II or BINDING SITE III of FIG. 8. Table 4 illustrates the complementarity of the nucleotide sequences of LOC150054 BINDING SITE, designated SEQ ID:10173, to the nucleotide sequence of GAM63 RNA, herein designated GAM RNA, also designated SEQ ID:348.

Another function of GAM63 is therefore inhibition of LOC150054 (Accession XP_097797.1). Accordingly, utilities of GAM63 include diagnosis, prevention and treatment of diseases and clinical conditions associated with LOC150054.

LOC150383 (Accession XP_086905.1) is another GAM63 target gene, herein designated TARGET GENE. LOC150383 BINDING SITE is a target binding site found in the 3' untranslated region of mRNA encoded by LOC150383, corresponding to a target binding site such as BINDING SITE I, BINDING SITE II or BINDING SITE III of FIG. 8. Table 4 illustrates the complementarity of the nucleotide sequences of LOC150383 BINDING SITE, designated SEQ ID:18710, to the nucleotide sequence of GAM63 RNA, herein designated GAM RNA, also designated SEQ ID:348.

Another function of GAM63 is therefore inhibition of LOC150383 (Accession XP_086905.1). Accordingly, utilities of GAM63 include diagnosis, prevention and treatment of diseases and clinical conditions associated with LOC150383.

LOC151475 (Accession XP_098063.1) is another GAM63 target gene, herein designated TARGET GENE. LOC151475 BINDING SITE is a target binding site found in the 3' untranslated region of mRNA encoded by LOC151475, corresponding to a target binding site such as BINDING SITE I, BINDING SITE II or BINDING SITE III of FIG. 8. Table 4 illustrates the complementarity of the nucleotide sequences of LOC151475 BINDING SITE, designated SEQ ID:8600, to the nucleotide sequence of GAM63 RNA, herein designated GAM RNA, also designated SEQ ID:348.

Another function of GAM63 is therefore inhibition of LOC151475 (Accession XP_098063.1). Accordingly, utilities of GAM63 include diagnosis, prevention and treatment of diseases and clinical conditions associated with LOC151475.

LOC151623 (Accession XP_098096.5) is another GAM63 target gene, herein designated TARGET GENE. LOC151623 BINDING SITE is a target binding site found in the 5' untranslated region of mRNA encoded by LOC151623, corresponding to a target binding site such as BINDING SITE I, BINDING SITE II or BINDING SITE III of FIG. 8. Table 4 illustrates the complementarity of the nucleotide sequences of LOC151623 BINDING SITE, designated SEQ ID:8648, to the nucleotide sequence of GAM63 RNA, herein designated GAM RNA, also designated SEQ ID:348.

Another function of GAM63 is therefore inhibition of LOC151623 (Accession XP_098096.5). Accordingly, utilities of GAM63 include diagnosis, prevention and treatment of diseases and clinical conditions associated with LOC151623.

LOC153711 (Accession XP_098419.1) is another GAM63 target gene, herein designated TARGET GENE. LOC153711 BINDING SITE is a target binding site found in the 5' untranslated region of mRNA encoded by LOC153711, corresponding to a target binding site such as BINDING SITE I, BINDING SITE II or BINDING SITE III of FIG. 8. Table 4 illustrates the complementarity of the nucleotide sequences of LOC153711 BINDING SITE, designated SEQ ID:14953, to the nucleotide sequence of GAM63 RNA, herein designated GAM RNA, also designated SEQ ID:348.

Another function of GAM63 is therefore inhibition of LOC153711 (Accession XP_098419.1). Accordingly, utilities of GAM63 include diagnosis, prevention and treatment of diseases and clinical conditions associated with LOC153711.

LOC153894 (Accession XP_087796.1) is another GAM63 target gene, herein designated TARGET GENE. LOC153894 BINDING SITE is a target binding site found in the 5' untranslated region of mRNA encoded by LOC153894, corresponding to a target binding site such as BINDING SITE I, BINDING SITE II or BINDING SITE III of FIG. 8. Table 4 illustrates the complementarity of the nucleotide sequences of LOC153894 BINDING SITE, designated SEQ ID:16220, to the nucleotide sequence of GAM63 RNA, herein designated GAM RNA, also designated SEQ ID:348.

Another function of GAM63 is therefore inhibition of LOC153894 (Accession XP_087796.1). Accordingly, utilities of GAM63 include diagnosis, prevention and treatment of diseases and clinical conditions associated with LOC153894.

LOC157278 (Accession XP_098741.2) is another GAM63 target gene, herein designated TARGET GENE.

LOC157278 BINDING SITE is a target binding site found in the 3' untranslated region of mRNA encoded by LOC157278, corresponding to a target binding site such as BINDING SITE I, BINDING SITE II or BINDING SITE III of FIG. 8. Table 4 illustrates the complementarity of the nucleotide sequences of LOC157278 BINDING SITE, designated SEQ ID:8648, to the nucleotide sequence of GAM63 RNA, herein designated GAM RNA, also designated SEQ ID:348.

Another function of GAM63 is therefore inhibition of LOC157278 (Accession XP_098741.2). Accordingly, utilities of GAM63 include diagnosis, prevention and treatment of diseases and clinical conditions associated with LOC157278.

LOC157931 (Accession XP_098845.1) is another GAM63 target gene, herein designated TARGET GENE. LOC157931 BINDING SITE is a target binding site found in the 5' untranslated region of mRNA encoded by LOC157931, corresponding to a target binding site such as BINDING SITE I, BINDING SITE II or BINDING SITE III of FIG. 8. Table 4 illustrates the complementarity of the nucleotide sequences of LOC157931 BINDING SITE, designated SEQ ID:3446, to the nucleotide sequence of GAM63 RNA, herein designated GAM RNA, also designated SEQ ID:348.

Another function of GAM63 is therefore inhibition of LOC157931 (Accession XP_098845.1). Accordingly, utilities of GAM63 include diagnosis, prevention and treatment of diseases and clinical conditions associated with LOC157931.

LOC158563 (Accession XP_088606.1) is another GAM63 target gene, herein designated TARGET GENE. LOC158563 BINDING SITE is a target binding site found in the 5' untranslated region of mRNA encoded by LOC158563, corresponding to a target binding site such as BINDING SITE I, BINDING SITE II or BINDING SITE III of FIG. 8. Table 4 illustrates the complementarity of the nucleotide sequences of LOC158563 BINDING SITE, designated SEQ ID:1153, to the nucleotide sequence of GAM63 RNA, herein designated GAM RNA, also designated SEQ ID:348.

Another function of GAM63 is therefore inhibition of LOC158563 (Accession XP_088606.1). Accordingly, utilities of GAM63 include diagnosis, prevention and treatment of diseases and clinical conditions associated with LOC158563.

LOC158709 (Accession XP_088648.1) is another GAM63 target gene, herein designated TARGET GENE. LOC158709 BINDING SITE is a target binding site found in the 5' untranslated region of mRNA encoded by LOC158709, corresponding to a target binding site such as BINDING SITE I, BINDING SITE II or BINDING SITE III of FIG. 8. Table 4 illustrates the complementarity of the nucleotide sequences of LOC158709 BINDING SITE, designated SEQ ID:17046, to the nucleotide sequence of GAM63 RNA, herein designated GAM RNA, also designated SEQ ID:348.

Another function of GAM63 is therefore inhibition of LOC158709 (Accession XP_088648.1). Accordingly, utilities of GAM63 include diagnosis, prevention and treatment of diseases and clinical conditions associated with LOC158709.

LOC159121 (Accession XP_099028.1) is another GAM63 target gene, herein designated TARGET GENE. LOC159121 BINDING SITE is a target binding site found in the 5' untranslated region of mRNA encoded by LOC159121, corresponding to a target binding site such as BINDING SITE I, BINDING SITE II or BINDING SITE III of FIG. 8. Table 4 illustrates the complementarity of the nucleotide sequences of LOC159121 BINDING SITE, designated SEQ ID:6485, to the nucleotide sequence of GAM63 RNA, herein designated GAM RNA, also designated SEQ ID:348.

Another function of GAM63 is therefore inhibition of LOC159121 (Accession XP_099028.1). Accordingly, utilities of GAM63 include diagnosis, prevention and treatment of diseases and clinical conditions associated with LOC159121.

LOC159963 (Accession XP_089960.6) is another GAM63 target gene, herein designated TARGET GENE. LOC159963 BINDING SITE is a target binding site found in the 5' untranslated region of mRNA encoded by LOC159963, corresponding to a target binding site such as BINDING SITE I, BINDING SITE II or BINDING SITE III of FIG. 8. Table 4 illustrates the complementarity of the nucleotide sequences of LOC159963 BINDING SITE, designated SEQ ID:5201, to the nucleotide sequence of GAM63 RNA, herein designated GAM RNA, also designated SEQ ID:348.

Another function of GAM63 is therefore inhibition of LOC159963 (Accession XP_089960.6). Accordingly, utilities of GAM63 include diagnosis, prevention and treatment of diseases and clinical conditions associated with LOC159963.

LOC160824 (Accession XP_090522.2) is another GAM63 target gene, herein designated TARGET GENE. LOC160824 BINDING SITE is a target binding site found in the 5' untranslated region of mRNA encoded by LOC160824, corresponding to a target binding site such as BINDING SITE I, BINDING SITE II or BINDING SITE III of FIG. 8. Table 4 illustrates the complementarity of the nucleotide sequences of LOC160824 BINDING SITE, designated SEQ ID:4898, to the nucleotide sequence of GAM63 RNA, herein designated GAM RNA, also designated SEQ ID:348.

Another function of GAM63 is therefore inhibition of LOC160824 (Accession XP_090522.2). Accordingly, utilities of GAM63 include diagnosis, prevention and treatment of diseases and clinical conditions associated with LOC160824.

LOC196446 (Accession XP_113722.2) is another GAM63 target gene, herein designated TARGET GENE. LOC196446 BINDING SITE is a target binding site found in the 5' untranslated region of mRNA encoded by LOC196446, corresponding to a target binding site such as BINDING SITE I, BINDING SITE II or BINDING SITE III of FIG. 8. Table 4 illustrates the complementarity of the nucleotide sequences of LOC196446 BINDING SITE, designated SEQ ID:19172, to the nucleotide sequence of GAM63 RNA, herein designated GAM RNA, also designated SEQ ID:348.

Another function of GAM63 is therefore inhibition of LOC196446 (Accession XP_113722.2). Accordingly, utilities of GAM63 include diagnosis, prevention and treatment of diseases and clinical conditions associated with LOC196446.

LOC196996 (Accession XP_113796.1) is another GAM63 target gene, herein designated TARGET GENE. LOC196996 BINDING SITE is a target binding site found in the 3' untranslated region of mRNA encoded by LOC196996, corresponding to a target binding site such as BINDING SITE I, BINDING SITE II or BINDING SITE III of FIG. 8. Table 4 illustrates the complementarity of the nucleotide sequences of LOC196996 BINDING SITE, designated SEQ ID:405, to the nucleotide sequence of GAM63 RNA, herein designated GAM RNA, also designated SEQ ID:348.

Another function of GAM63 is therefore inhibition of LOC196996 (Accession XP_113796.1). Accordingly, utilities of GAM63 include diagnosis, prevention and treatment of diseases and clinical conditions associated with LOC196996.

LOC199813 (Accession XP_114028.1) is another GAM63 target gene, herein designated TARGET GENE. LOC199813 BINDING SITE is a target binding site found in the 5' untranslated region of mRNA encoded by LOC199813, corresponding to a target binding site such as BINDING SITE I, BINDING SITE II or BINDING SITE III of FIG. 8. Table 4 illustrates the complementarity of the nucleotide sequences of LOC199813 BINDING SITE, designated SEQ ID:19093, to the nucleotide sequence of GAM63 RNA, herein designated GAM RNA, also designated SEQ ID:348.

Another function of GAM63 is therefore inhibition of LOC199813 (Accession XP_114028.1). Accordingly, utilities of GAM63 include diagnosis, prevention and treatment of diseases and clinical conditions associated with LOC199813.

LOC200010 (Accession XP_117174.2) is another GAM63 target gene, herein designated TARGET GENE. LOC200010 BINDING SITE is a target binding site found in the 5' untranslated region of mRNA encoded by LOC200010, corresponding to a target binding site such as BINDING SITE I, BINDING SITE II or BINDING SITE III of FIG. 8. Table 4 illustrates the complementarity of the nucleotide sequences of LOC200010 BINDING SITE, designated SEQ ID:19405, to the nucleotide sequence of GAM63 RNA, herein designated GAM RNA, also designated SEQ ID:348.

Another function of GAM63 is therefore inhibition of LOC200010 (Accession XP_117174.2). Accordingly, utilities of GAM63 include diagnosis, prevention and treatment of diseases and clinical conditions associated with LOC200010.

LOC200734 (Accession XP_114286.1) is another GAM63 target gene, herein designated TARGET GENE. LOC200734 BINDING SITE is a target binding site found in the 3' untranslated region of mRNA encoded by LOC200734, corresponding to a target binding site such as BINDING SITE I, BINDING SITE II or BINDING SITE III of FIG. 8. Table 4 illustrates the complementarity of the nucleotide sequences of LOC200734 BINDING SITE, designated SEQ ID:7136, to the nucleotide sequence of GAM63 RNA, herein designated GAM RNA, also designated SEQ ID:348.

Another function of GAM63 is therefore inhibition of LOC200734 (Accession XP_114286.1). Accordingly, utilities of GAM63 include diagnosis, prevention and treatment of diseases and clinical conditions associated with LOC200734.

LOC219918 (Accession XP_166197.1) is another GAM63 target gene, herein designated TARGET GENE. LOC219918 BINDING SITE is a target binding site found in the 3' untranslated region of mRNA encoded by LOC219918, corresponding to a target binding site such as BINDING SITE I, BINDING SITE II or BINDING SITE III of FIG. 8. Table 4 illustrates the complementarity of the nucleotide sequences of LOC219918 BINDING SITE, designated SEQ ID:13636, to the nucleotide sequence of GAM63 RNA, herein designated GAM RNA, also designated SEQ ID:348.

Another function of GAM63 is therefore inhibition of LOC219918 (Accession XP_166197.1). Accordingly, utilities of GAM63 include diagnosis, prevention and treatment of diseases and clinical conditions associated with LOC219918.

LOC220071 (Accession XP_167848.1) is another GAM63 target gene, herein designated TARGET GENE. LOC220071 BINDING SITE is a target binding site found in the 3' untranslated region of mRNA encoded by LOC220071, corresponding to a target binding site such as BINDING SITE I, BINDING SITE II or BINDING SITE III of FIG. 8. Table 4 illustrates the complementarity of the nucleotide sequences of LOC220071 BINDING SITE, designated SEQ ID:13636, to the nucleotide sequence of GAM63 RNA, herein designated GAM RNA, also designated SEQ ID:348.

Another function of GAM63 is therefore inhibition of LOC220071 (Accession XP_167848.1). Accordingly, utilities of GAM63 include diagnosis, prevention and treatment of diseases and clinical conditions associated with LOC220071.

LOC221002 (Accession NP_660356.1) is another GAM63 target gene, herein designated TARGET GENE. LOC221002 BINDING SITE is a target binding site found in the 5' untranslated region of mRNA encoded by LOC221002, corresponding to a target binding site such as BINDING SITE I, BINDING SITE II or BINDING SITE III of FIG. 8. Table 4 illustrates the complementarity of the nucleotide sequences of LOC221002 BINDING SITE, designated SEQ ID:560, to the nucleotide sequence of GAM63 RNA, herein designated GAM RNA, also designated SEQ ID:348.

Another function of GAM63 is therefore inhibition of LOC221002 (Accession NP_660356.1). Accordingly, utilities of GAM63 include diagnosis, prevention and treatment of diseases and clinical conditions associated with LOC221002.

LOC221495 (Accession XP_168136.1) is another GAM63 target gene, herein designated TARGET GENE. LOC221495 BINDING SITE is a target binding site found in the 3' untranslated region of mRNA encoded by LOC221495, corresponding to a target binding site such as BINDING SITE I, BINDING SITE II or BINDING SITE III of FIG. 8. Table 4 illustrates the complementarity of the nucleotide sequences of LOC221495 BINDING SITE, designated SEQ ID:2939, to the nucleotide sequence of GAM63 RNA, herein designated GAM RNA, also designated SEQ ID:348.

Another function of GAM63 is therefore inhibition of LOC221495 (Accession XP_168136.1). Accordingly, utilities of GAM63 include diagnosis, prevention and treatment of diseases and clinical conditions associated with LOC221495.

LOC221663 (Accession XP_168131.1) is another GAM63 target gene, herein designated TARGET GENE. LOC221663 BINDING SITE is a target binding site found in the 3' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:11468, to the nucleotide sequence of GAM63 RNA, herein designated GAM RNA, also designated SEQ ID:348.

Another function of GAM63 is therefore inhibition of LOC221663 (Accession XP_168131.1). Accordingly, utilities of GAM63 include diagnosis, prevention and treatment of diseases and clinical conditions associated with LOC221663.

LOC222031 (Accession XP_168371.1) is another GAM63 target gene, herein designated TARGET GENE. LOC222031 BINDING SITE is a target binding site found in the 3' untranslated region of mRNA encoded by LOC222031, corresponding to a target binding site such as BINDING SITE I, BINDING SITE II or BINDING SITE III of FIG. 8. Table 4 illustrates the complementarity of the nucleotide sequences of LOC222031 BINDING SITE, designated SEQ ID:11030, to the nucleotide sequence of GAM63 RNA, herein designated GAM RNA, also designated SEQ ID:348.

Another function of GAM63 is therefore inhibition of LOC222031 (Accession XP_168371.1). Accordingly, utilities of GAM63 include diagnosis, prevention and treatment of diseases and clinical conditions associated with LOC222031.

LOC222057 (Accession XP_166594.2) is another GAM63 target gene, herein designated TARGET GENE. LOC222057 BINDING SITE1 and LOC222057 BINDING SITE2 are target binding sites found in untranslated regions of mRNA encoded by LOC222057, corresponding to target binding sites such as BINDING SITE I, BINDING SITE II or BINDING SITE III of FIG. 8. Table 4 illustrates the complementarity of the nucleotide sequences of LOC222057 BINDING SITE1 and LOC222057 BINDING SITE2, designated SEQ ID:11430 and SEQ ID:12029 respectively, to the nucleotide sequence of GAM63 RNA, herein designated GAM RNA, also designated SEQ ID:348.

Another function of GAM63 is therefore inhibition of LOC222057 (Accession XP_166594.2). Accordingly, utilities of GAM63 include diagnosis, prevention and treatment of diseases and clinical conditions associated with LOC222057.

LOC222674 (Accession XP_167095.3) is another GAM63 target gene, herein designated TARGET GENE. LOC222674 BINDING SITE is a target binding site found in the 3' untranslated region of mRNA encoded by LOC222674, corresponding to a target binding site such as BINDING SITE I, BINDING SITE II or BINDING SITE III of FIG. 8. Table 4 illustrates the complementarity of the nucleotide sequences of LOC222674 BINDING SITE, designated SEQ ID:14980, to the nucleotide sequence of GAM63 RNA, herein designated GAM RNA, also designated SEQ ID:348.

Another function of GAM63 is therefore inhibition of LOC222674 (Accession XP_167095.3). Accordingly, utilities of GAM63 include diagnosis, prevention and treatment of diseases and clinical conditions associated with LOC222674.

LOC254559 (Accession XP_172931.2) is another GAM63 target gene, herein designated TARGET GENE. LOC254559 BINDING SITE is a target binding site found in the 3' untranslated region of mRNA encoded by LOC254559, corresponding to a target binding site such as BINDING SITE I, BINDING SITE II or BINDING SITE III of FIG. 8. Table 4 illustrates the complementarity of the nucleotide sequences of LOC254559 BINDING SITE, designated SEQ ID:19218, to the nucleotide sequence of GAM63 RNA, herein designated GAM RNA, also designated SEQ ID:348.

Another function of GAM63 is therefore inhibition of LOC254559 (Accession XP_172931.2). Accordingly, utilities of GAM63 include diagnosis, prevention and treatment of diseases and clinical conditions associated with LOC254559.

LOC255743 (Accession XP_171089.2) is another GAM63 target gene, herein designated TARGET GENE. LOC255743 BINDING SITE is a target binding site found in the 3' untranslated region of mRNA encoded by LOC255743, corresponding to a target binding site such as BINDING SITE I, BINDING SITE II or BINDING SITE III of FIG. 8. Table 4 illustrates the complementarity of the nucleotide sequences of LOC255743 BINDING SITE, designated SEQ ID:1120, to the nucleotide sequence of GAM63 RNA, herein designated GAM RNA, also designated SEQ ID:348.

Another function of GAM63 is therefore inhibition of LOC255743 (Accession XP_171089.2). Accordingly, utilities of GAM63 include diagnosis, prevention and treatment of diseases and clinical conditions associated with LOC255743.

LOC255975 (Accession XP_171083.2) is another GAM63 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:17165, to the nucleotide sequence of GAM63 RNA, herein designated GAM RNA, also designated SEQ ID:348.

Another function of GAM63 is therefore inhibition of LOC255975 (Accession XP_171083.2). Accordingly, utilities of GAM63 include diagnosis, prevention and treatment of diseases and clinical conditions associated with LOC255975.

LOC256106 (Accession XP_172187.1) is another GAM63 target gene, herein designated TARGET GENE. LOC256106 BINDING SITE is a target binding site found in the 3' untranslated region of mRNA encoded by LOC256106, corresponding to a target binding site such as BINDING SITE I, BINDING SITE II or BINDING SITE III of FIG. 8. Table 4 illustrates the complementarity of the nucleotide sequences of LOC256106 BINDING SITE, designated SEQ ID:11964, to the nucleotide sequence of GAM63 RNA, herein designated GAM RNA, also designated SEQ ID:348.

Another function of GAM63 is therefore inhibition of LOC256106 (Accession XP_172187.1). Accordingly, utilities of GAM63 include diagnosis, prevention and treatment of diseases and clinical conditions associated with LOC256106.

LOC282959 (Accession XP_212622.1) is another GAM63 target gene, herein designated TARGET GENE. LOC282959 BINDING SITE is a target binding site found in the 3' untranslated region of mRNA encoded by LOC282959, corresponding to a target binding site such as BINDING SITE I, BINDING SITE II or BINDING SITE III of FIG. 8. Table 4 illustrates the complementarity of the nucleotide sequences of LOC282959 BINDING SITE, designated SEQ ID:12554, to the nucleotide sequence of GAM63 RNA, herein designated GAM RNA, also designated SEQ ID:348.

Another function of GAM63 is therefore inhibition of LOC282959 (Accession XP_212622.1). Accordingly, utilities of GAM63 include diagnosis, prevention and treatment of diseases and clinical conditions associated with LOC282959.

LOC282966 (Accession XP_208460.1) is another GAM63 target gene, herein designated TARGET GENE. LOC282966 BINDING SITE is a target binding site found in the 3' untranslated region of mRNA encoded by LOC282966, corresponding to a target binding site such as BINDING SITE I, BINDING SITE II or BINDING SITE III of FIG. 8. Table 4 illustrates the complementarity of the nucleotide sequences of LOC282966 BINDING SITE, designated SEQ ID:9105, to the nucleotide sequence of GAM63 RNA, herein designated GAM RNA, also designated SEQ ID:348.

Another function of GAM63 is therefore inhibition of LOC282966 (Accession XP_208460.1). Accordingly, utilities of GAM63 include diagnosis, prevention and treatment of diseases and clinical conditions associated with LOC282966.

LOC283099 (Accession XP_210887.2) is another GAM63 target gene, herein designated TARGET GENE. LOC283099 BINDING SITE is a target binding site found in the 5' untranslated region of mRNA encoded by LOC283099, corresponding to a target binding site such as BINDING SITE I, BINDING SITE II or BINDING SITE III of FIG. 8. Table 4 illustrates the complementarity of the nucleotide sequences of LOC283099 BINDING SITE, designated SEQ ID:2411, to the nucleotide sequence of GAM63 RNA, herein designated GAM RNA, also designated SEQ ID:348.

Another function of GAM63 is therefore inhibition of LOC283099 (Accession XP_210887.2). Accordingly, utilities of GAM63 include diagnosis, prevention and treatment of diseases and clinical conditions associated with LOC283099.

LOC283158 (Accession XP_208530.1) is another GAM63 target gene, herein designated TARGET GENE. LOC283158 BINDING SITE is a target binding site found in the 3' untranslated region of mRNA encoded by LOC283158, corresponding to a target binding site such as BINDING SITE I, BINDING SITE II or BINDING SITE III of FIG. 8. Table 4 illustrates the complementarity of the nucleotide sequences of LOC283158 BINDING SITE, designated SEQ ID:13317, to the nucleotide sequence of GAM63 RNA, herein designated GAM RNA, also designated SEQ ID:348.

Another function of GAM63 is therefore inhibition of LOC283158 (Accession XP_208530.1). Accordingly, utilities of GAM63 include diagnosis, prevention and treatment of diseases and clinical conditions associated with LOC283158.

LOC283177 (Accession XP_210903.1) is another GAM63 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:1528, to the nucleotide sequence of GAM63 RNA, herein designated GAM RNA, also designated SEQ ID:348.

Another function of GAM63 is therefore inhibition of LOC283177 (Accession XP_210903.1). Accordingly, utilities of GAM63 include diagnosis, prevention and treatment of diseases and clinical conditions associated with LOC283177.

LOC283232 (Accession NP_777600.1) is another GAM63 target gene, herein designated TARGET GENE. LOC283232 BINDING SITE is a target binding site found in the 3' untranslated region of mRNA encoded by LOC283232, corresponding to a target binding site such as BINDING SITE I, BINDING SITE II or BINDING SITE III of FIG. 8. Table 4 illustrates the complementarity of the nucleotide sequences of LOC283232 BINDING SITE, designated SEQ ID:12802, to the nucleotide sequence of GAM63 RNA, herein designated GAM RNA, also designated SEQ ID:348.

Another function of GAM63 is therefore inhibition of LOC283232 (Accession NP_777600.1). Accordingly, utilities of GAM63 include diagnosis, prevention and treatment of diseases and clinical conditions associated with LOC283232.

LOC283243 (Accession XP_210947.2) is another GAM63 target gene, herein designated TARGET GENE. LOC283243 BINDING SITE is a target binding site found in the 5' untranslated region of mRNA encoded by LOC283243, corresponding to a target binding site such as BINDING SITE I, BINDING SITE II or BINDING SITE III of FIG. 8. Table 4 illustrates the complementarity of the nucleotide sequences of LOC283243 BINDING SITE, designated SEQ ID:8648, to the nucleotide sequence of GAM63 RNA, herein designated GAM RNA, also designated SEQ ID:348.

Another function of GAM63 is therefore inhibition of LOC283243 (Accession XP_210947.2). Accordingly, utilities of GAM63 include diagnosis, prevention and treatment of diseases and clinical conditions associated with LOC283243.

LOC283324 (Accession XP_208617.1) is another GAM63 target gene, herein designated TARGET GENE. LOC283324 BINDING SITE is a target binding site found in the 3' untranslated region of mRNA encoded by LOC283324, corresponding to a target binding site such as BINDING SITE I, BINDING SITE II or BINDING SITE III of FIG. 8. Table 4 illustrates the complementarity of the nucleotide sequences of LOC283324 BINDING SITE, designated SEQ ID:13636, to the nucleotide sequence of GAM63 RNA, herein designated GAM RNA, also designated SEQ ID:348.

Another function of GAM63 is therefore inhibition of LOC283324 (Accession XP_208617.1). Accordingly, utilities of GAM63 include diagnosis, prevention and treatment of diseases and clinical conditions associated with LOC283324.

LOC283325 (Accession XP_208618.1) is another GAM63 target gene, herein designated TARGET GENE. LOC283325 BINDING SITE is a target binding site found in the 3' untranslated region of mRNA encoded by LOC283325, corresponding to a target binding site such as BINDING SITE I, BINDING SITE II or BINDING SITE III of FIG. 8. Table 4 illustrates the complementarity of the nucleotide sequences of LOC283325 BINDING SITE, designated SEQ ID:10668, to the nucleotide sequence of GAM63 RNA, herein designated GAM RNA, also designated SEQ ID:348.

Another function of GAM63 is therefore inhibition of LOC283325 (Accession XP_208618.1). Accordingly, utilities of GAM63 include diagnosis, prevention and treatment of diseases and clinical conditions associated with LOC283325.

LOC283364 (Accession XP_211003.1) is another GAM63 target gene, herein designated TARGET GENE. LOC283364 BINDING SITE is a target binding site found in the 5' untranslated region of mRNA encoded by LOC283364, corresponding to a target binding site such as BINDING SITE I, BINDING SITE II or BINDING SITE III of FIG. 8. Table 4 illustrates the complementarity of the nucleotide sequences of LOC283364 BINDING SITE, designated SEQ ID:3471, to the nucleotide sequence of GAM63 RNA, herein designated GAM RNA, also designated SEQ ID:348.

Another function of GAM63 is therefore inhibition of LOC283364 (Accession XP_211003.1). Accordingly, utilities of GAM63 include diagnosis, prevention and treatment of diseases and clinical conditions associated with LOC283364.

LOC283389 (Accession XP_211009.1) is another GAM63 target gene, herein designated TARGET GENE. LOC283389 BINDING SITE is a target binding site found in the 5' untranslated region of mRNA encoded by LOC283389, corresponding to a target binding site such as BINDING SITE I, BINDING SITE II or BINDING SITE III of FIG. 8. Table 4 illustrates the complementarity of the nucleotide sequences of LOC283389 BINDING SITE, designated SEQ ID:10231, to the nucleotide sequence of GAM63 RNA, herein designated GAM RNA, also designated SEQ ID:348.

Another function of GAM63 is therefore inhibition of LOC283389 (Accession XP_211009.1). Accordingly, utilities of GAM63 include diagnosis, prevention and treatment of diseases and clinical conditions associated with LOC283389.

LOC283507 (Accession XP_211075.1) is another GAM63 target gene, herein designated TARGET GENE. LOC283507 BINDING SITE is a target binding site found in the 5' untranslated region of mRNA encoded by LOC283507, corresponding to a target binding site such as BINDING SITE I, BINDING SITE II or BINDING SITE III of FIG. 8. Table 4 illustrates the complementarity of the nucleotide sequences of LOC283507 BINDING SITE, designated SEQ ID:12549, to the nucleotide sequence of GAM63 RNA, herein designated GAM RNA, also designated SEQ ID:348.

Another function of GAM63 is therefore inhibition of LOC283507 (Accession XP_211075.1). Accordingly, utilities of GAM63 include diagnosis, prevention and treatment of diseases and clinical conditions associated with LOC283507.

LOC283514 (Accession XP_210264.2) is another GAM63 target gene, herein designated TARGET GENE. LOC283514 BINDING SITE is a target binding site found in the 3' untranslated region of mRNA encoded by LOC283514, corresponding to a target binding site such as BINDING SITE I, BINDING SITE II or BINDING SITE III of FIG. 8. Table 4 illustrates the complementarity of the nucleotide sequences of LOC283514 BINDING SITE, designated SEQ ID:12227, to the nucleotide sequence of GAM63 RNA, herein designated GAM RNA, also designated SEQ ID:348.

Another function of GAM63 is therefore inhibition of LOC283514 (Accession XP_210264.2). Accordingly, utilities of GAM63 include diagnosis, prevention and treatment of diseases and clinical conditions associated with LOC283514.

LOC283706 (Accession XP_208804.3) is another GAM63 target gene, herein designated TARGET GENE. LOC283706 BINDING SITE is a target binding site found in the 3' untranslated region of mRNA encoded by LOC283706, corresponding to a target binding site such as BINDING SITE I, BINDING SITE II or BINDING SITE III of FIG. 8. Table 4 illustrates the complementarity of the nucleotide sequences of LOC283706 BINDING SITE, designated SEQ ID:10969, to the nucleotide sequence of GAM63 RNA, herein designated GAM RNA, also designated SEQ ID:348.

Another function of GAM63 is therefore inhibition of LOC283706 (Accession XP_208804.3). Accordingly, utilities of GAM63 include diagnosis, prevention and treatment of diseases and clinical conditions associated with LOC283706.

LOC283868 (Accession XP_211243.1) is another GAM63 target gene, herein designated TARGET GENE. LOC283868 BINDING SITE is a target binding site found in the 3' untranslated region of mRNA encoded by LOC283868, corresponding to a target binding site such as BINDING SITE I, BINDING SITE II or BINDING SITE III of FIG. 8. Table 4 illustrates the complementarity of the nucleotide sequences of LOC283868 BINDING SITE, designated SEQ ID:6589, to the nucleotide sequence of GAM63 RNA, herein designated GAM RNA, also designated SEQ ID:348.

Another function of GAM63 is therefore inhibition of LOC283868 (Accession XP_211243.1). Accordingly, utilities of GAM63 include diagnosis, prevention and treatment of diseases and clinical conditions associated with LOC283868.

LOC283911 (Accession XP_211259.2) is another GAM63 target gene, herein designated TARGET GENE. LOC283911 BINDING SITE is a target binding site found in the 3' untranslated region of mRNA encoded by LOC283911, corresponding to a target binding site such as BINDING SITE I, BINDING SITE II or BINDING SITE III of FIG. 8. Table 4 illustrates the complementarity of the nucleotide sequences of LOC283911 BINDING SITE, designated SEQ ID:11030, to the nucleotide sequence of GAM63 RNA, herein designated GAM RNA, also designated SEQ ID:348.

Another function of GAM63 is therefore inhibition of LOC283911 (Accession XP_211259.2). Accordingly, utilities of GAM63 include diagnosis, prevention and treatment of diseases and clinical conditions associated with LOC283911.

LOC283950 (Accession XP_211273.1) is another GAM63 target gene, herein designated TARGET GENE. LOC283950 BINDING SITE is a target binding site found in the 5' untranslated region of mRNA encoded by LOC283950, corresponding to a target binding site such as BINDING SITE I, BINDING SITE II or BINDING SITE III of FIG. 8. Table 4 illustrates the complementarity of the nucleotide sequences of LOC283950 BINDING SITE, designated SEQ ID:2373, to the nucleotide sequence of GAM63 RNA, herein designated GAM RNA, also designated SEQ ID:348.

Another function of GAM63 is therefore inhibition of LOC283950 (Accession XP_211273.1). Accordingly, utilities of GAM63 include diagnosis, prevention and treatment of diseases and clinical conditions associated with LOC283950.

LOC284074 (Accession XP_211321.1) is another GAM63 target gene, herein designated TARGET GENE. LOC284074 BINDING SITE is a target binding site found in the 3' untranslated region of mRNA encoded by LOC284074, corresponding to a target binding site such as BINDING SITE I, BINDING SITE II or BINDING SITE III of FIG. 8. Table 4 illustrates the complementarity of the nucleotide sequences of LOC284074 BINDING SITE, designated SEQ ID:15991, to the nucleotide sequence of GAM63 RNA, herein designated GAM RNA, also designated SEQ ID:348.

Another function of GAM63 is therefore inhibition of LOC284074 (Accession XP_211321.1). Accordingly, utilities of GAM63 include diagnosis, prevention and treatment of diseases and clinical conditions associated with LOC284074.

LOC284134 (Accession XP_211345.1) is another GAM63 target gene, herein designated TARGET GENE. LOC284134 BINDING SITE is a target binding site found in the 3' untranslated region of mRNA encoded by LOC284134, corresponding to a target binding site such as BINDING SITE I, BINDING SITE II or BINDING SITE III of FIG. 8. Table 4 illustrates the complementarity of the nucleotide sequences of LOC284134 BINDING SITE, designated SEQ ID:12578, to the nucleotide sequence of GAM63 RNA, herein designated GAM RNA, also designated SEQ ID:348.

Another function of GAM63 is therefore inhibition of LOC284134 (Accession XP_211345.1). Accordingly, utilities of GAM63 include diagnosis, prevention and treatment of diseases and clinical conditions associated with LOC284134.

LOC284135 (Accession XP_209032.1) is another GAM63 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:15364, to the nucleotide sequence of GAM63 RNA, herein designated GAM RNA, also designated SEQ ID:348.

Another function of GAM63 is therefore inhibition of LOC284135 (Accession XP_209032.1). Accordingly, utilities of GAM63 include diagnosis, prevention and treatment of diseases and clinical conditions associated with LOC284135.

LOC284186 (Accession XP_209060.2) is another GAM63 target gene, herein designated TARGET GENE. LOC284186 BINDING SITE is a target binding site found in the 3' untranslated region of mRNA encoded by LOC284186, corresponding to a target binding site such as BINDING SITE I, BINDING SITE II or BINDING SITE III of FIG. 8. Table 4 illustrates the complementarity of the nucleotide sequences of LOC284186 BINDING SITE, designated SEQ ID:2686, to the nucleotide sequence of GAM63 RNA, herein designated GAM RNA, also designated SEQ ID:348.

Another function of GAM63 is therefore inhibition of LOC284186 (Accession XP_209060.2). Accordingly, utilities of GAM63 include diagnosis, prevention and treatment of diseases and clinical conditions associated with LOC284186.

LOC284187 (Accession XP_211366.2) is another GAM63 target gene, herein designated TARGET GENE. LOC284187 BINDING SITE is a target binding site found in the 3' untranslated region of mRNA encoded by LOC284187, corresponding to a target binding site such as BINDING SITE I, BINDING SITE II or BINDING SITE III of FIG. 8. Table 4 illustrates the complementarity of the nucleotide sequences of LOC284187 BINDING SITE, designated SEQ ID:11712, to the nucleotide sequence of GAM63 RNA, herein designated GAM RNA, also designated SEQ ID:348.

Another function of GAM63 is therefore inhibition of LOC284187 (Accession XP_211366.2). Accordingly, utilities of GAM63 include diagnosis, prevention and treatment of diseases and clinical conditions associated with LOC284187.

LOC284382 (Accession XP_209177.1) is another GAM63 target gene, herein designated TARGET GENE. LOC284382 BINDING SITE is a target binding site found in the 5' untranslated region of mRNA encoded by LOC284382, corresponding to a target binding site such as BINDING SITE I, BINDING SITE II or BINDING SITE III of FIG. 8. Table 4 illustrates the complementarity of the nucleotide sequences of LOC284382 BINDING SITE, designated SEQ ID:16203, to the nucleotide sequence of GAM63 RNA, herein designated GAM RNA, also designated SEQ ID:348.

Another function of GAM63 is therefore inhibition of LOC284382 (Accession XP_209177.1). Accordingly, utilities of GAM63 include diagnosis, prevention and treatment of diseases and clinical conditions associated with LOC284382.

LOC284394 (Accession XP_210786.1) is another GAM63 target gene, herein designated TARGET GENE. LOC284394 BINDING SITE1 and LOC284394 BINDING SITE2 are target binding sites found in untranslated regions of mRNA encoded by LOC284394, corresponding to target binding sites such as BINDING SITE I, BINDING SITE II or BINDING SITE III of FIG. 8. Table 4 illustrates the complementarity of the nucleotide sequences of LOC284394 BINDING SITE1 and LOC284394 BINDING SITE2, designated SEQ ID:2616 and SEQ ID:10139 respectively, to the nucleotide sequence of GAM63 RNA, herein designated GAM RNA, also designated SEQ ID:348.

Another function of GAM63 is therefore inhibition of LOC284394 (Accession XP_210786.1). Accordingly, utilities of GAM63 include diagnosis, prevention and treatment of diseases and clinical conditions associated with LOC284394.

LOC284456 (Accession XP_211470.1) is another GAM63 target gene, herein designated TARGET GENE. LOC284456 BINDING SITE is a target binding site found in the 5' untranslated region of mRNA encoded by LOC284456, corresponding to a target binding site such as BINDING SITE I, BINDING SITE II or BINDING SITE III of FIG. 8. Table 4 illustrates the complementarity of the nucleotide sequences of LOC284456 BINDING SITE, designated SEQ ID:8896, to the nucleotide sequence of GAM63 RNA, herein designated GAM RNA, also designated SEQ ID:348.

Another function of GAM63 is therefore inhibition of LOC284456 (Accession XP_211470.1). Accordingly, utilities of GAM63 include diagnosis, prevention and treatment of diseases and clinical conditions associated with LOC284456.

LOC284585 (Accession XP_209277.2) is another GAM63 target gene, herein designated TARGET GENE. LOC284585 BINDING SITE is a target binding site found in the 5' untranslated region of mRNA encoded by LOC284585, corresponding to a target binding site such as BINDING SITE I, BINDING SITE II or BINDING SITE III of FIG. 8. Table 4 illustrates the complementarity of the nucleotide sequences of LOC284585 BINDING SITE, designated SEQ ID:18870, to the nucleotide sequence of GAM63 RNA, herein designated GAM RNA, also designated SEQ ID:348.

Another function of GAM63 is therefore inhibition of LOC284585 (Accession XP_209277.2). Accordingly, utilities of GAM63 include diagnosis, prevention and treatment of diseases and clinical conditions associated with LOC284585.

LOC284673 (Accession XP_211591.1) is another GAM63 target gene, herein designated TARGET GENE. LOC284673 BINDING SITE is a target binding site found in the 3' untranslated region of mRNA encoded by LOC284673, corresponding to a target binding site such as BINDING SITE I, BINDING SITE II or BINDING SITE III of FIG. 8. Table 4 illustrates the complementarity of the nucleotide sequences of LOC284673 BINDING SITE, designated SEQ ID:4694, to the nucleotide sequence of GAM63 RNA, herein designated GAM RNA, also designated SEQ ID:348.

Another function of GAM63 is therefore inhibition of LOC284673 (Accession XP_211591.1). Accordingly, utilities of GAM63 include diagnosis, prevention and treatment of diseases and clinical conditions associated with LOC284673.

LOC284678 (Accession XP_209318.1) is another GAM63 target gene, herein designated TARGET GENE. LOC284678 BINDING SITE is a target binding site found in the 3' untranslated region of mRNA encoded by LOC284678, corresponding to a target binding site such as BINDING SITE I, BINDING SITE II or BINDING SITE III of FIG. 8. Table 4 illustrates the complementarity of the nucleotide sequences of LOC284678 BINDING SITE, designated SEQ ID:13363, to the nucleotide sequence of GAM63 RNA, herein designated GAM RNA, also designated SEQ ID:348.

Another function of GAM63 is therefore inhibition of LOC284678 (Accession XP_209318.1). Accordingly, utilities of GAM63 include diagnosis, prevention and treatment of diseases and clinical conditions associated with LOC284678.

LOC284701 (Accession XP_294994.1) is another GAM63 target gene, herein designated TARGET GENE. LOC284701 BINDING SITE is a target binding site found in the 5' untranslated region of mRNA encoded by LOC284701, corresponding to a target binding site such as BINDING SITE I, BINDING SITE II or BINDING SITE III of FIG. 8. Table 4 illustrates the complementarity of the nucleotide sequences of LOC284701 BINDING SITE, designated SEQ ID:11430, to the nucleotide sequence of GAM63 RNA, herein designated GAM RNA, also designated SEQ ID:348.

Another function of GAM63 is therefore inhibition of LOC284701 (Accession XP_294994.1). Accordingly, utilities of GAM63 include diagnosis, prevention and treatment of diseases and clinical conditions associated with LOC284701.

LOC284837 (Accession XP_211658.1) is another GAM63 target gene, herein designated TARGET GENE. LOC284837 BINDING SITE is a target binding site found in the 3' untranslated region of mRNA encoded by LOC284837, corresponding to a target binding site such as BINDING SITE I, BINDING SITE II or BINDING SITE III of FIG. 8. Table 4 illustrates the complementarity of the nucleotide sequences of LOC284837 BINDING SITE, designated SEQ ID:14432, to the nucleotide sequence of GAM63 RNA, herein designated GAM RNA, also designated SEQ ID:348.

Another function of GAM63 is therefore inhibition of LOC284837 (Accession XP_211658.1). Accordingly, utilities of GAM63 include diagnosis, prevention and treatment of diseases and clinical conditions associated with LOC284837.

LOC284891 (Accession XP_211683.1) is another GAM63 target gene, herein designated TARGET GENE. LOC284891 BINDING SITE is a target binding site found in the 5' untranslated region of mRNA encoded by LOC284891, corresponding to a target binding site such as BINDING SITE I, BINDING SITE II or BINDING SITE III of FIG. 8. Table 4 illustrates the complementarity of the nucleotide sequences of LOC284891 BINDING SITE, designated SEQ ID:17073, to the nucleotide sequence of GAM63 RNA, herein designated GAM RNA, also designated SEQ ID:348.

Another function of GAM63 is therefore inhibition of LOC284891 (Accession XP_211683.1). Accordingly, utilities of GAM63 include diagnosis, prevention and treatment of diseases and clinical conditions associated with LOC284891.

LOC284927 (Accession XP_211689.1) is another GAM63 target gene, herein designated TARGET GENE. LOC284927 BINDING SITE is a target binding site found in the 3' untranslated region of mRNA encoded by LOC284927, corresponding to a target binding site such as BINDING SITE I, BINDING SITE II or BINDING SITE III of FIG. 8. Table 4 illustrates the complementarity of the nucleotide sequences of LOC284927 BINDING SITE, designated SEQ ID:12266, to the nucleotide sequence of GAM63 RNA, herein designated GAM RNA, also designated SEQ ID:348.

Another function of GAM63 is therefore inhibition of LOC284927 (Accession XP_211689.1). Accordingly, utilities of GAM63 include diagnosis, prevention and treatment of diseases and clinical conditions associated with LOC284927.

LOC285043 (Accession XP_211742.1) is another GAM63 target gene, herein designated TARGET GENE. LOC285043 BINDING SITE is a target binding site found in the 3' untranslated region of mRNA encoded by LOC285043, corresponding to a target binding site such as BINDING SITE I, BINDING SITE II or BINDING SITE III of FIG. 8. Table 4 illustrates the complementarity of the nucleotide sequences of LOC285043 BINDING SITE, designated SEQ ID:5397, to the nucleotide sequence of GAM63 RNA, herein designated GAM RNA, also designated SEQ ID:348.

Another function of GAM63 is therefore inhibition of LOC285043 (Accession XP_211742.1). Accordingly, utilities of GAM63 include diagnosis, prevention and treatment of diseases and clinical conditions associated with LOC285043.

LOC285045 (Accession XP_211744.1) is another GAM63 target gene, herein designated TARGET GENE. LOC285045 BINDING SITE is a target binding site found in the 3' untranslated region of mRNA encoded by LOC285045, corresponding to a target binding site such as BINDING SITE I, BINDING SITE II or BINDING SITE III of FIG. 8. Table 4 illustrates the complementarity of the nucleotide sequences of LOC285045 BINDING SITE, designated SEQ ID:1894, to the nucleotide sequence of GAM63 RNA, herein designated GAM RNA, also designated SEQ ID:348.

Another function of GAM63 is therefore inhibition of LOC285045 (Accession XP_211744.1). Accordingly, utilities of GAM63 include diagnosis, prevention and treatment of diseases and clinical conditions associated with LOC285045.

LOC285182 (Accession XP_211800.1) is another GAM63 target gene, herein designated TARGET GENE. LOC285182 BINDING SITE is a target binding site found in the 3' untranslated region of mRNA encoded by LOC285182, corresponding to a target binding site such as BINDING SITE I, BINDING SITE II or BINDING SITE III of FIG. 8. Table 4 illustrates the complementarity of the nucleotide sequences of LOC285182 BINDING SITE, designated SEQ ID:7658, to the nucleotide sequence of GAM63 RNA, herein designated GAM RNA, also designated SEQ ID:348.

Another function of GAM63 is therefore inhibition of LOC285182 (Accession XP_211800.1). Accordingly, utilities of GAM63 include diagnosis, prevention and treatment of diseases and clinical conditions associated with LOC285182.

LOC285329 (Accession XP_209569.1) is another GAM63 target gene, herein designated TARGET GENE. LOC285329 BINDING SITE is a target binding site found in the 3' untranslated region of mRNA encoded by LOC285329, corresponding to a target binding site such as BINDING SITE I, BINDING SITE II or BINDING SITE III of FIG. 8. Table 4 illustrates the complementarity of the nucleotide sequences of LOC285329 BINDING SITE, designated SEQ ID:1257, to the nucleotide sequence of GAM63 RNA, herein designated GAM RNA, also designated SEQ ID:348.

Another function of GAM63 is therefore inhibition of LOC285329 (Accession XP_209569.1). Accordingly, utilities of GAM63 include diagnosis, prevention and treatment of diseases and clinical conditions associated with LOC285329.

LOC285337 (Accession XP_211847.1) is another GAM63 target gene, herein designated TARGET GENE. LOC285337 BINDING SITE is a target binding site found in the 5' untranslated region of mRNA encoded by LOC285337, corresponding to a target binding site such as BINDING SITE I, BINDING SITE II or BINDING SITE III of FIG. 8. Table 4 illustrates the complementarity of the nucleotide sequences of LOC285337 BINDING SITE, designated SEQ ID:18813, to the nucleotide sequence of GAM63 RNA, herein designated GAM RNA, also designated SEQ ID:348.

Another function of GAM63 is therefore inhibition of LOC285337 (Accession XP_211847.1). Accordingly, utilities of GAM63 include diagnosis, prevention and treatment of diseases and clinical conditions associated with LOC285337.

LOC285363 (Accession XP_211870.1) is another GAM63 target gene, herein designated TARGET GENE. LOC285363 BINDING SITE is a target binding site found in the 5' untranslated region of mRNA encoded by LOC285363, corresponding to a target binding site such as BINDING SITE I, BINDING SITE II or BINDING SITE III of FIG. 8. Table 4 illustrates the complementarity of the nucleotide sequences of LOC285363 BINDING SITE, designated SEQ ID:10101, to the nucleotide sequence of GAM63 RNA, herein designated GAM RNA, also designated SEQ ID:348.

Another function of GAM63 is therefore inhibition of LOC285363 (Accession XP_211870.1). Accordingly, utilities of GAM63 include diagnosis, prevention and treatment of diseases and clinical conditions associated with LOC285363.

LOC285408 (Accession XP_211886.3) is another GAM63 target gene, herein designated TARGET GENE. LOC285408 BINDING SITE is a target binding site found in the 5' untranslated region of mRNA encoded by LOC285408, corresponding to a target binding site such as BINDING SITE I, BINDING SITE II or BINDING SITE III of FIG. 8. Table 4 illustrates the complementarity of the nucleotide sequences of LOC285408 BINDING SITE, designated SEQ ID:8648, to the nucleotide sequence of GAM63 RNA, herein designated GAM RNA, also designated SEQ ID:348.

Another function of GAM63 is therefore inhibition of LOC285408 (Accession XP_211886.3). Accordingly, utilities of GAM63 include diagnosis, prevention and treatment of diseases and clinical conditions associated with LOC285408.

LOC285577 (Accession XP_211941.1) is another GAM63 target gene, herein designated TARGET GENE. LOC285577 BINDING SITE is a target binding site found in the 5' untranslated region of mRNA encoded by LOC285577, corresponding to a target binding site such as BINDING SITE I, BINDING SITE II or BINDING SITE III of FIG. 8. Table 4 illustrates the complementarity of the nucleotide sequences of LOC285577 BINDING SITE, designated SEQ ID:1035, to the nucleotide sequence of GAM63 RNA, herein designated GAM RNA, also designated SEQ ID:348.

Another function of GAM63 is therefore inhibition of LOC285577 (Accession XP_211941.1). Accordingly, utilities of GAM63 include diagnosis, prevention and treatment of diseases and clinical conditions associated with LOC285577.

LOC285634 (Accession XP_209691.1) is another GAM63 target gene, herein designated TARGET GENE. LOC285634 BINDING SITE is a target binding site found in the 3' untranslated region of mRNA encoded by LOC285634, corresponding to a target binding site such as BINDING SITE I, BINDING SITE II or BINDING SITE III of FIG. 8. Table 4 illustrates the complementarity of the nucleotide sequences of LOC285634 BINDING SITE, designated SEQ ID:15209, to the nucleotide sequence of GAM63 RNA, herein designated GAM RNA, also designated SEQ ID:348.

Another function of GAM63 is therefore inhibition of LOC285634 (Accession XP_209691.1). Accordingly, utilities of GAM63 include diagnosis, prevention and treatment of diseases and clinical conditions associated with LOC285634.

LOC285690 (Accession XP_209723.1) is another GAM63 target gene, herein designated TARGET GENE. LOC285690 BINDING SITE is a target binding site found in the 5' untranslated region of mRNA encoded by LOC285690, corresponding to a target binding site such as BINDING SITE I, BINDING SITE II or BINDING SITE III of FIG. 8. Table 4 illustrates the complementarity of the nucleotide sequences of LOC285690 BINDING SITE, designated SEQ ID:11929, to the nucleotide sequence of GAM63 RNA, herein designated GAM RNA, also designated SEQ ID:348.

Another function of GAM63 is therefore inhibition of LOC285690 (Accession XP_209723.1). Accordingly, utilities of GAM63 include diagnosis, prevention and treatment of diseases and clinical conditions associated with LOC285690.

LOC285714 (Accession XP_211994.1) is another GAM63 target gene, herein designated TARGET GENE. LOC285714 BINDING SITE is a target binding site found in the 3' untranslated region of mRNA encoded by LOC285714, corresponding to a target binding site such as BINDING SITE I, BINDING SITE II or BINDING SITE III of FIG. 8. Table 4 illustrates the complementarity of the nucleotide sequences of LOC285714 BINDING SITE, designated SEQ ID:12512, to the nucleotide sequence of GAM63 RNA, herein designated GAM RNA, also designated SEQ ID:348.

Another function of GAM63 is therefore inhibition of LOC285714 (Accession XP_211994.1). Accordingly, utilities of GAM63 include diagnosis, prevention and treatment of diseases and clinical conditions associated with LOC285714.

LOC285726 (Accession XP_211998.1) is another GAM63 target gene, herein designated TARGET GENE. LOC285726 BINDING SITE is a target binding site found in the 5' untranslated region of mRNA encoded by LOC285726, corresponding to a target binding site such as BINDING SITE I, BINDING SITE II or BINDING SITE III of FIG. 8. Table 4 illustrates the complementarity of the nucleotide sequences of LOC285726 BINDING SITE, designated SEQ ID:1407, to the nucleotide sequence of GAM63 RNA, herein designated GAM RNA, also designated SEQ ID:348.

Another function of GAM63 is therefore inhibition of LOC285726 (Accession XP_211998.1). Accordingly, utilities of GAM63 include diagnosis, prevention and treatment of diseases and clinical conditions associated with LOC285726.

LOC285747 (Accession XP_209742.1) is another GAM63 target gene, herein designated TARGET GENE. LOC285747 BINDING SITE is a target binding site found in the 5' untranslated region of mRNA encoded by LOC285747, corresponding to a target binding site such as BINDING SITE I, BINDING SITE II or BINDING SITE III of FIG. 8. Table 4 illustrates the complementarity of the nucleotide sequences of LOC285747 BINDING SITE, designated SEQ ID:18138, to the nucleotide sequence of GAM63 RNA, herein designated GAM RNA, also designated SEQ ID:348.

Another function of GAM63 is therefore inhibition of LOC285747 (Accession XP_209742.1). Accordingly, utilities of GAM63 include diagnosis, prevention and treatment of diseases and clinical conditions associated with LOC285747.

LOC285769 (Accession XP_209755.1) is another GAM63 target gene, herein designated TARGET GENE. LOC285769 BINDING SITE1 and LOC285769 BINDING SITE2 are target binding sites found in untranslated regions of mRNA encoded by LOC285769, corresponding to target binding sites such as BINDING SITE I, BINDING SITE II or BINDING SITE III of FIG. 8. Table 4 illustrates the complementarity of the nucleotide sequences of LOC285769 BINDING SITE1 and LOC285769 BINDING SITE2, designated SEQ ID:20180 and SEQ ID:11218 respectively, to the nucleotide sequence of GAM63 RNA, herein designated GAM RNA, also designated SEQ ID:348.

Another function of GAM63 is therefore inhibition of LOC285769 (Accession XP_209755.1). Accordingly, utilities of GAM63 include diagnosis, prevention and treatment of diseases and clinical conditions associated with LOC285769.

LOC285771 (Accession XP_212015.1) is another GAM63 target gene, herein designated TARGET GENE. LOC285771 BINDING SITE is a target binding site found in the 3' untranslated region of mRNA encoded by LOC285771, corresponding to a target binding site such as BINDING SITE I, BINDING SITE II or BINDING SITE III of FIG. 8. Table 4 illustrates the complementarity of the nucleotide sequences of LOC285771 BINDING SITE, designated SEQ ID:13902, to the nucleotide sequence of GAM63 RNA, herein designated GAM RNA, also designated SEQ ID:348.

Another function of GAM63 is therefore inhibition of LOC285771 (Accession XP_212015.1). Accordingly, utilities of GAM63 include diagnosis, prevention and treatment of diseases and clinical conditions associated with LOC285771.

LOC285831 (Accession XP_212577.1) is another GAM63 target gene, herein designated TARGET GENE. LOC285831 BINDING SITE is a target binding site found in the 5' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:15227, to the nucleotide sequence of GAM63 RNA, herein designated GAM RNA, also designated SEQ ID:348.

Another function of GAM63 is therefore inhibition of LOC285831 (Accession XP_212577.1). Accordingly, utilities of GAM63 include diagnosis, prevention and treatment of diseases and clinical conditions associated with LOC285831.

LOC285831 (Accession XP_209784.1) is another GAM63 target gene, herein designated TARGET GENE. LOC285831 BINDING SITE is a target binding site found in the 5' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:15227, to the nucleotide sequence of GAM63 RNA, herein designated GAM RNA, also designated SEQ ID:348.

Another function of GAM63 is therefore inhibition of LOC285831 (Accession XP_209784.1). Accordingly, utilities of GAM63 include diagnosis, prevention and treatment of diseases and clinical conditions associated with LOC285831.

LOC285831 (Accession XP_212625.1) is another GAM63 target gene, herein designated TARGET GENE. LOC285831 BINDING SITE is a target binding site found in the 5' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:15227, to the nucleotide sequence of GAM63 RNA, herein designated GAM RNA, also designated SEQ ID:348.

Another function of GAM63 is therefore inhibition of LOC285831 (Accession XP_212625.1). Accordingly, utilities of GAM63 include diagnosis, prevention and treatment of diseases and clinical conditions associated with LOC285831.

LOC285908 (Accession XP_209812.1) is another GAM63 target gene, herein designated TARGET GENE. LOC285908 BINDING SITE is a target binding site found in the 3' untranslated region of mRNA encoded by LOC285908, corresponding to a target binding site such as BINDING SITE I, BINDING SITE II or BINDING SITE III of FIG. 8. Table 4 illustrates the complementarity of the nucleotide sequences of LOC285908 BINDING SITE, designated SEQ ID:8743, to the nucleotide sequence of GAM63 RNA, herein designated GAM RNA, also designated SEQ ID:348.

Another function of GAM63 is therefore inhibition of LOC285908 (Accession XP_209812.1). Accordingly, utilities of GAM63 include diagnosis, prevention and treatment of diseases and clinical conditions associated with LOC285908.

LOC286008 (Accession XP_212134.1) is another GAM63 target gene, herein designated TARGET GENE. LOC286008 BINDING SITE is a target binding site found in the 3' untranslated region of mRNA encoded by LOC286008, corresponding to a target binding site such as BINDING SITE I, BINDING SITE II or BINDING SITE III of FIG. 8. Table 4 illustrates the complementarity of the nucleotide sequences of LOC286008 BINDING SITE, designated SEQ ID:17819, to the nucleotide sequence of GAM63 RNA, herein designated GAM RNA, also designated SEQ ID:348.

Another function of GAM63 is therefore inhibition of LOC286008 (Accession XP_212134.1). Accordingly, utilities of GAM63 include diagnosis, prevention and treatment of diseases and clinical conditions associated with LOC286008.

LOC286030 (Accession XP_209868.1) is another GAM63 target gene, herein designated TARGET GENE. LOC286030 BINDING SITE is a target binding site found in the 5' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:12513, to the nucleotide sequence of GAM63 RNA, herein designated GAM RNA, also designated SEQ ID:348.

Another function of GAM63 is therefore inhibition of LOC286030 (Accession XP_209868.1). Accordingly, utilities of GAM63 include diagnosis, prevention and treatment of diseases and clinical conditions associated with LOC286030.

LOC286032 (Accession XP_209867.2) is another GAM63 target gene, herein designated TARGET GENE. LOC286032 BINDING SITE is a target binding site found in the 5' untranslated region of mRNA encoded by LOC286032, corresponding to a target binding site such as BINDING SITE I, BINDING SITE II or BINDING SITE III of FIG. 8. Table 4 illustrates the complementarity of the nucleotide sequences of LOC286032 BINDING SITE, designated SEQ ID:11886, to the nucleotide sequence of GAM63 RNA, herein designated GAM RNA, also designated SEQ ID:348.

Another function of GAM63 is therefore inhibition of LOC286032 (Accession XP_209867.2). Accordingly, utilities of GAM63 include diagnosis, prevention and treatment of diseases and clinical conditions associated with LOC286032.

LOC286039 (Accession XP_209873.1) is another GAM63 target gene, herein designated TARGET GENE. LOC286039 BINDING SITE is a target binding site found in the 5' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:12513, to the nucleotide sequence of GAM63 RNA, herein designated GAM RNA, also designated SEQ ID:348.

Another function of GAM63 is therefore inhibition of LOC286039 (Accession XP_209873.1). Accordingly, utilities of GAM63 include diagnosis, prevention and treatment of diseases and clinical conditions associated with LOC286039.

LOC286059 (Accession XP_212156.1) is another GAM63 target gene, herein designated TARGET GENE. LOC286059 BINDING SITE is a target binding site found in the 3' untranslated region of mRNA encoded by LOC286059, corresponding to a target binding site such as BINDING SITE I, BINDING SITE II or BINDING SITE III of FIG. 8. Table 4 illustrates the complementarity of the nucleotide sequences of LOC286059 BINDING SITE, designated SEQ ID:14796, to the nucleotide sequence of GAM63 RNA, herein designated GAM RNA, also designated SEQ ID:348.

Another function of GAM63 is therefore inhibition of LOC286059 (Accession XP_212156.1). Accordingly, utilities of GAM63 include diagnosis, prevention and treatment of diseases and clinical conditions associated with LOC286059.

LOC286141 (Accession XP_212205.1) is another GAM63 target gene, herein designated TARGET GENE. LOC286141 BINDING SITE is a target binding site found in the 3' untranslated region of mRNA encoded by LOC286141, corresponding to a target binding site such as BINDING SITE I, BINDING SITE II or BINDING SITE III of FIG. 8. Table 4 illustrates the complementarity of the nucleotide sequences of LOC286141 BINDING SITE, designated SEQ ID:8298, to the nucleotide sequence of GAM63 RNA, herein designated GAM RNA, also designated SEQ ID:348.

Another function of GAM63 is therefore inhibition of LOC286141 (Accession XP_212205.1). Accordingly, utilities of GAM63 include diagnosis, prevention and treatment of diseases and clinical conditions associated with LOC286141.

LOC286163 (Accession XP_209922.1) is another GAM63 target gene, herein designated TARGET GENE. LOC286163 BINDING SITE is a target binding site found in the 3' untranslated region of mRNA encoded by LOC286163, corresponding to a target binding site such as BINDING SITE I, BINDING SITE II or BINDING SITE III of FIG. 8. Table 4 illustrates the complementarity of the nucleotide sequences of LOC286163 BINDING SITE, designated SEQ ID:10366, to the nucleotide sequence of GAM63 RNA, herein designated GAM RNA, also designated SEQ ID:348.

Another function of GAM63 is therefore inhibition of LOC286163 (Accession XP_209922.1). Accordingly, utilities of GAM63 include diagnosis, prevention and treatment of diseases and clinical conditions associated with LOC286163.

LOC286199 (Accession XP_212227.1) is another GAM63 target gene, herein designated TARGET GENE. LOC286199 BINDING SITE is a target binding site found in the 5' untranslated region of mRNA encoded by LOC286199, corresponding to a target binding site such as BINDING SITE I, BINDING SITE II or BINDING SITE III of FIG. 8. Table 4 illustrates the complementarity of the nucleotide sequences of LOC286199 BINDING SITE, designated SEQ ID:7887, to the nucleotide sequence of GAM63 RNA, herein designated GAM RNA, also designated SEQ ID:348.

Another function of GAM63 is therefore inhibition of LOC286199 (Accession XP_212227.1). Accordingly, utilities of GAM63 include diagnosis, prevention and treatment of diseases and clinical conditions associated with LOC286199.

LOC286215 (Accession XP_212228.1) is another GAM63 target gene, herein designated TARGET GENE. LOC286215 BINDING SITE is a target binding site found in the 3' untranslated region of mRNA encoded by LOC286215, corresponding to a target binding site such as BINDING SITE I, BINDING SITE II or BINDING SITE III of FIG. 8. Table 4 illustrates the complementarity of the nucleotide sequences of LOC286215 BINDING SITE, designated SEQ ID:19160, to the nucleotide sequence of GAM63 RNA, herein designated GAM RNA, also designated SEQ ID:348.

Another function of GAM63 is therefore inhibition of LOC286215 (Accession XP_212228.1). Accordingly, utilities of GAM63 include diagnosis, prevention and treatment of diseases and clinical conditions associated with LOC286215.

LOC286219 (Accession XP_212236.1) is another GAM63 target gene, herein designated TARGET GENE. LOC286219 BINDING SITE is a target binding site found in the 3' untranslated region of mRNA encoded by LOC286219, corresponding to a target binding site such as BINDING SITE I, BINDING SITE II or BINDING SITE III of FIG. 8. Table 4 illustrates the complementarity of the nucleotide sequences of LOC286219 BINDING SITE, designated SEQ ID:593, to the nucleotide sequence of GAM63 RNA, herein designated GAM RNA, also designated SEQ ID:348.

Another function of GAM63 is therefore inhibition of LOC286219 (Accession XP_212236.1). Accordingly, utilities of GAM63 include diagnosis, prevention and treatment of diseases and clinical conditions associated with LOC286219.

LOC286221 (Accession XP_212233.1) is another GAM63 target gene, herein designated TARGET GENE. LOC286221 BINDING SITE is a target binding site found in the 5' untranslated region of mRNA encoded by LOC286221, corresponding to a target binding site such as BINDING SITE I, BINDING SITE II or BINDING SITE III of FIG. 8. Table 4 illustrates the complementarity of the nucleotide sequences of LOC286221 BINDING SITE, designated SEQ ID:15764, to the nucleotide sequence of GAM63 RNA, herein designated GAM RNA, also designated SEQ ID:348.

Another function of GAM63 is therefore inhibition of LOC286221 (Accession XP_212233.1). Accordingly, utilities of GAM63 include diagnosis, prevention and treatment of diseases and clinical conditions associated with LOC286221.

LOC286256 (Accession XP_209970.2) is another GAM63 target gene, herein designated TARGET GENE. LOC286256 BINDING SITE is a target binding site found in the 3' untranslated region of mRNA encoded by LOC286256, corresponding to a target binding site such as BINDING SITE I, BINDING SITE II or BINDING SITE III of FIG. 8. Table 4 illustrates the complementarity of the nucleotide sequences of LOC286256 BINDING SITE, designated SEQ ID:16796, to the nucleotide sequence of GAM63 RNA, herein designated GAM RNA, also designated SEQ ID:348.

Another function of GAM63 is therefore inhibition of LOC286256 (Accession XP_209970.2). Accordingly, utilities of GAM63 include diagnosis, prevention and treatment of diseases and clinical conditions associated with LOC286256.

LOC286434 (Accession XP_301085.1) is another GAM63 target gene, herein designated TARGET GENE. LOC286434 BINDING SITE is a target binding site found in the 5' untranslated region of mRNA encoded by LOC286434, corresponding to a target binding site such as BINDING SITE I, BINDING SITE II or BINDING SITE III of FIG. 8. Table 4 illustrates the complementarity of the nucleotide sequences of LOC286434 BINDING SITE, designated SEQ ID:17046, to the nucleotide sequence of GAM63 RNA, herein designated GAM RNA, also designated SEQ ID:348.

Another function of GAM63 is therefore inhibition of LOC286434 (Accession XP_301085.1). Accordingly, utilities of GAM63 include diagnosis, prevention and treatment of diseases and clinical conditions associated with LOC286434.

LOC286501 (Accession XP_210079.1) is another GAM63 target gene, herein designated TARGET GENE.

LOC286501 BINDING SITE is a target binding site found in the 5' untranslated region of mRNA encoded by LOC286501, corresponding to a target binding site such as BINDING SITE I, BINDING SITE II or BINDING SITE III of FIG. 8. Table 4 illustrates the complementarity of the nucleotide sequences of LOC286501 BINDING SITE, designated SEQ ID:10562, to the nucleotide sequence of GAM63 RNA, herein designated GAM RNA, also designated SEQ ID:348.

Another function of GAM63 is therefore inhibition of LOC286501 (Accession XP_210079.1). Accordingly, utilities of GAM63 include diagnosis, prevention and treatment of diseases and clinical conditions associated with LOC286501.

LOC286567 (Accession XP_212343.1) is another GAM63 target gene, herein designated TARGET GENE. LOC286567 BINDING SITE is a target binding site found in the 5' untranslated region of mRNA encoded by LOC286567, corresponding to a target binding site such as BINDING SITE I, BINDING SITE II or BINDING SITE III of FIG. 8. Table 4 illustrates the complementarity of the nucleotide sequences of LOC286567 BINDING SITE, designated SEQ ID:12106, to the nucleotide sequence of GAM63 RNA, herein designated GAM RNA, also designated SEQ ID:348.

Another function of GAM63 is therefore inhibition of LOC286567 (Accession XP_212343.1). Accordingly, utilities of GAM63 include diagnosis, prevention and treatment of diseases and clinical conditions associated with LOC286567.

LOC286572 (Accession XP_212341.1) is another GAM63 target gene, herein designated TARGET GENE. LOC286572 BINDING SITE is a target binding site found in the 5' untranslated region of mRNA encoded by LOC286572, corresponding to a target binding site such as BINDING SITE I, BINDING SITE II or BINDING SITE III of FIG. 8. Table 4 illustrates the complementarity of the nucleotide sequences of LOC286572 BINDING SITE, designated SEQ ID:12106, to the nucleotide sequence of GAM63 RNA, herein designated GAM RNA, also designated SEQ ID:348.

Another function of GAM63 is therefore inhibition of LOC286572 (Accession XP_212341.1). Accordingly, utilities of GAM63 include diagnosis, prevention and treatment of diseases and clinical conditions associated with LOC286572.

LOC338709 (Accession XP_211595.2) is another GAM63 target gene, herein designated TARGET GENE. LOC338709 BINDING SITE is a target binding site found in the 5' untranslated region of mRNA encoded by LOC338709, corresponding to a target binding site such as BINDING SITE I, BINDING SITE II or BINDING SITE III of FIG. 8. Table 4 illustrates the complementarity of the nucleotide sequences of LOC338709 BINDING SITE, designated SEQ ID:11430, to the nucleotide sequence of GAM63 RNA, herein designated GAM RNA, also designated SEQ ID:348.

Another function of GAM63 is therefore inhibition of LOC338709 (Accession XP_211595.2). Accordingly, utilities of GAM63 include diagnosis, prevention and treatment of diseases and clinical conditions associated with LOC338709.

LOC338760 (Accession XP_290556.2) is another GAM63 target gene, herein designated TARGET GENE. LOC338760 BINDING SITE is a target binding site found in the 3' untranslated region of mRNA encoded by LOC338760, corresponding to a target binding site such as BINDING SITE I, BINDING SITE II or BINDING SITE III of FIG. 8. Table 4 illustrates the complementarity of the nucleotide sequences of LOC338760 BINDING SITE, designated SEQ ID:16183, to the nucleotide sequence of GAM63 RNA, herein designated GAM RNA, also designated SEQ ID:348.

Another function of GAM63 is therefore inhibition of LOC338760 (Accession XP_290556.2). Accordingly, utilities of GAM63 include diagnosis, prevention and treatment of diseases and clinical conditions associated with LOC338760.

LOC338812 (Accession XP_290587.2) is another GAM63 target gene, herein designated TARGET GENE. LOC338812 BINDING SITE is a target binding site found in the 3' untranslated region of mRNA encoded by LOC338812, corresponding to a target binding site such as BINDING SITE I, BINDING SITE II or BINDING SITE III of FIG. 8. Table 4 illustrates the complementarity of the nucleotide sequences of LOC338812 BINDING SITE, designated SEQ ID:5910, to the nucleotide sequence of GAM63 RNA, herein designated GAM RNA, also designated SEQ ID:348.

Another function of GAM63 is therefore inhibition of LOC338812 (Accession XP_290587.2). Accordingly, utilities of GAM63 include diagnosis, prevention and treatment of diseases and clinical conditions associated with LOC338812.

LOC338842 (Accession XP_294729.1) is another GAM63 target gene, herein designated TARGET GENE. LOC338842 BINDING SITE is a target binding site found in the 5' untranslated region of mRNA encoded by LOC338842, corresponding to a target binding site such as BINDING SITE I, BINDING SITE II or BINDING SITE III of FIG. 8. Table 4 illustrates the complementarity of the nucleotide sequences of LOC338842 BINDING SITE, designated SEQ ID:3177, to the nucleotide sequence of GAM63 RNA, herein designated GAM RNA, also designated SEQ ID:348.

Another function of GAM63 is therefore inhibition of LOC338842 (Accession XP_294729.1). Accordingly, utilities of GAM63 include diagnosis, prevention and treatment of diseases and clinical conditions associated with LOC338842.

LOC339178 (Accession XP_290742.1) is another GAM63 target gene, herein designated TARGET GENE. LOC339178 BINDING SITE is a target binding site found in the 3' untranslated region of mRNA encoded by LOC339178, corresponding to a target binding site such as BINDING SITE I, BINDING SITE II or BINDING SITE III of FIG. 8. Table 4 illustrates the complementarity of the nucleotide sequences of LOC339178 BINDING SITE, designated SEQ ID:9390, to the nucleotide sequence of GAM63 RNA, herein designated GAM RNA, also designated SEQ ID:348.

Another function of GAM63 is therefore inhibition of LOC339178 (Accession XP_290742.1). Accordingly, utilities of GAM63 include diagnosis, prevention and treatment of diseases and clinical conditions associated with LOC339178.

LOC339201 (Accession XP_290756.1) is another GAM63 target gene, herein designated TARGET GENE. LOC339201 BINDING SITE is a target binding site found in the 5' untranslated region of mRNA encoded by LOC339201, corresponding to a target binding site such as BINDING SITE I, BINDING SITE II or BINDING SITE III of FIG. 8. Table 4 illustrates the complementarity of the nucleotide sequences of LOC339201 BINDING SITE, designated SEQ ID:12179, to the nucleotide sequence of GAM63 RNA, herein designated GAM RNA, also designated SEQ ID:348.

Another function of GAM63 is therefore inhibition of LOC339201 (Accession XP_290756.1). Accordingly, utilities of GAM63 include diagnosis, prevention and treatment of diseases and clinical conditions associated with LOC339201.

LOC339238 (Accession XP_290784.1) is another GAM63 target gene, herein designated TARGET GENE. LOC339238 BINDING SITE1 and LOC339238 BINDING SITE2 are target binding sites found in untranslated regions of multiple transcripts of mRNA encoded by LOC339238, corresponding to target binding sites such as BINDING SITE I, BINDING SITE II or BINDING SITE III of FIG. 8. Table 4 illustrates the complementarity of the nucleotide sequences of LOC339238 BINDING SITE1 and LOC339238 BINDING SITE2, designated SEQ ID:14379 and SEQ ID:4093 respectively, to the nucleotide sequence of GAM63 RNA, herein designated GAM RNA, also designated SEQ ID:348.

Another function of GAM63 is therefore inhibition of LOC339238 (Accession XP_290784.1). Accordingly, utilities of GAM63 include diagnosis, prevention and treatment of diseases and clinical conditions associated with LOC339238.

LOC339290 (Accession XP_294901.1) is another GAM63 target gene, herein designated TARGET GENE. LOC339290 BINDING SITE is a target binding site found in the 5' untranslated region of mRNA encoded by LOC339290, corresponding to a target binding site such as BINDING SITE I, BINDING SITE II or BINDING SITE III of FIG. 8. Table 4 illustrates the complementarity of the nucleotide sequences of LOC339290 BINDING SITE, designated SEQ ID:14427, to the nucleotide sequence of GAM63 RNA, herein designated GAM RNA, also designated SEQ ID:348.

Another function of GAM63 is therefore inhibition of LOC339290 (Accession XP_294901.1). Accordingly, utilities of GAM63 include diagnosis, prevention and treatment of diseases and clinical conditions associated with LOC339290.

LOC339392 (Accession XP_294925.1) is another GAM63 target gene, herein designated TARGET GENE. LOC339392 BINDING SITE is a target binding site found in the 3' untranslated region of mRNA encoded by LOC339392, corresponding to a target binding site such as BINDING SITE I, BINDING SITE II or BINDING SITE III of FIG. 8. Table 4 illustrates the complementarity of the nucleotide sequences of LOC339392 BINDING SITE, designated SEQ ID:15380, to the nucleotide sequence of GAM63 RNA, herein designated GAM RNA, also designated SEQ ID:348.

Another function of GAM63 is therefore inhibition of LOC339392 (Accession XP_294925.1). Accordingly, utilities of GAM63 include diagnosis, prevention and treatment of diseases and clinical conditions associated with LOC339392.

LOC339778 (Accession XP_295061.1) is another GAM63 target gene, herein designated TARGET GENE. LOC339778 BINDING SITE is a target binding site found in the 5' untranslated region of mRNA encoded by LOC339778, corresponding to a target binding site such as BINDING SITE I, BINDING SITE II or BINDING SITE III of FIG. 8. Table 4 illustrates the complementarity of the nucleotide sequences of LOC339778 BINDING SITE, designated SEQ ID:12879, to the nucleotide sequence of GAM63 RNA, herein designated GAM RNA, also designated SEQ ID:348.

Another function of GAM63 is therefore inhibition of LOC339778 (Accession XP_295061.1). Accordingly, utilities of GAM63 include diagnosis, prevention and treatment of diseases and clinical conditions associated with LOC339778.

LOC339846 (Accession XP_295084.1) is another GAM63 target gene, herein designated TARGET GENE. LOC339846 BINDING SITE is a target binding site found in the 3' untranslated region of mRNA encoded by LOC339846, corresponding to a target binding site such as BINDING SITE I, BINDING SITE II or BINDING SITE III of FIG. 8. Table 4 illustrates the complementarity of the nucleotide sequences of LOC339846 BINDING SITE, designated SEQ ID:14168, to the nucleotide sequence of GAM63 RNA, herein designated GAM RNA, also designated SEQ ID:348.

Another function of GAM63 is therefore inhibition of LOC339846 (Accession XP_295084.1). Accordingly, utilities of GAM63 include diagnosis, prevention and treatment of diseases and clinical conditions associated with LOC339846.

LOC339862 (Accession XP_291044.1) is another GAM63 target gene, herein designated TARGET GENE. LOC339862 BINDING SITE is a target binding site found in the 3' untranslated region of mRNA encoded by LOC339862, corresponding to a target binding site such as BINDING SITE I, BINDING SITE II or BINDING SITE III of FIG. 8. Table 4 illustrates the complementarity of the nucleotide sequences of LOC339862 BINDING SITE, designated SEQ ID:17721, to the nucleotide sequence of GAM63 RNA, herein designated GAM RNA, also designated SEQ ID:348.

Another function of GAM63 is therefore inhibition of LOC339862 (Accession XP_291044.1). Accordingly, utilities of GAM63 include diagnosis, prevention and treatment of diseases and clinical conditions associated with LOC339862.

LOC339950 (Accession XP_294630.1) is another GAM63 target gene, herein designated TARGET GENE. LOC339950 BINDING SITE is a target binding site found in the 5' untranslated region of mRNA encoded by LOC339950, corresponding to a target binding site such as BINDING SITE I, BINDING SITE II or BINDING SITE III of FIG. 8. Table 4 illustrates the complementarity of the nucleotide sequences of LOC339950 BINDING SITE, designated SEQ ID:3281, to the nucleotide sequence of GAM63 RNA, herein designated GAM RNA, also designated SEQ ID:348.

Another function of GAM63 is therefore inhibition of LOC339950 (Accession XP_294630.1). Accordingly, utilities of GAM63 include diagnosis, prevention and treatment of diseases and clinical conditions associated with LOC339950.

LOC339983 (Accession XP_291101.1) is another GAM63 target gene, herein designated TARGET GENE. LOC339983 BINDING SITE is a target binding site found in the 3' untranslated region of mRNA encoded by LOC339983, corresponding to a target binding site such as BINDING SITE I, BINDING SITE II or BINDING SITE III of FIG. 8. Table 4 illustrates the complementarity of the nucleotide sequences of LOC339983 BINDING SITE, designated SEQ ID:7911, to the nucleotide sequence of GAM63 RNA, herein designated GAM RNA, also designated SEQ ID:348.

Another function of GAM63 is therefore inhibition of LOC339983 (Accession XP_291101.1). Accordingly, utilities of GAM63 include diagnosis, prevention and treatment of diseases and clinical conditions associated with LOC339983.

LOC340125 (Accession XP_291150.1) is another GAM63 target gene, herein designated TARGET GENE. LOC340125 BINDING SITE is a target binding site found in the 5' untranslated region of mRNA encoded by LOC340125, corresponding to a target binding site such as BINDING SITE I, BINDING SITE II or BINDING SITE III of FIG. 8. Table 4 illustrates the complementarity of the nucleotide sequences of LOC340125 BINDING SITE, designated SEQ ID:11430, to the nucleotide sequence of GAM63 RNA, herein designated GAM RNA, also designated SEQ ID:348.

Another function of GAM63 is therefore inhibition of LOC340125 (Accession XP_291150.1). Accordingly, utilities of GAM63 include diagnosis, prevention and treatment of diseases and clinical conditions associated with LOC340125.

LOC340227 (Accession XP_291203.1) is another GAM63 target gene, herein designated TARGET GENE. LOC340227 BINDING SITE is a target binding site found in the 5' untranslated region of mRNA encoded by LOC340227, corresponding to a target binding site such as BINDING SITE I, BINDING SITE II or BINDING SITE III of FIG. 8. Table 4 illustrates the complementarity of the nucleotide sequences of LOC340227 BINDING SITE, designated SEQ ID:11430, to the nucleotide sequence of GAM63 RNA, herein designated GAM RNA, also designated SEQ ID:348.

Another function of GAM63 is therefore inhibition of LOC340227 (Accession XP_291203.1). Accordingly, utilities of GAM63 include diagnosis, prevention and treatment of diseases and clinical conditions associated with LOC340227.

LOC340290 (Accession XP_291214.1) is another GAM63 target gene, herein designated TARGET GENE. LOC340290 BINDING SITE is a target binding site found in the 5' untranslated region of mRNA encoded by LOC340290, corresponding to a target binding site such as BINDING SITE I, BINDING SITE II or BINDING SITE III of FIG. 8. Table 4 illustrates the complementarity of the nucleotide sequences of LOC340290 BINDING SITE, designated SEQ ID:11430, to the nucleotide sequence of GAM63 RNA, herein designated GAM RNA, also designated SEQ ID:348.

Another function of GAM63 is therefore inhibition of LOC340290 (Accession XP_291214.1). Accordingly, utilities of GAM63 include diagnosis, prevention and treatment of diseases and clinical conditions associated with LOC340290.

LOC340340 (Accession XP_295215.1) is another GAM63 target gene, herein designated TARGET GENE. LOC340340 BINDING SITE is a target binding site found in the 3' untranslated region of mRNA encoded by LOC340340, corresponding to a target binding site such as BINDING SITE I, BINDING SITE II or BINDING SITE III of FIG. 8. Table 4 illustrates the complementarity of the nucleotide sequences of LOC340340 BINDING SITE, designated SEQ ID:14545, to the nucleotide sequence of GAM63 RNA, herein designated GAM RNA, also designated SEQ ID:348.

Another function of GAM63 is therefore inhibition of LOC340340 (Accession XP_295215.1). Accordingly, utilities of GAM63 include diagnosis, prevention and treatment of diseases and clinical conditions associated with LOC340340.

LOC340362 (Accession XP_295225.1) is another GAM63 target gene, herein designated TARGET GENE. LOC340362 BINDING SITE is a target binding site found in the 3' untranslated region of mRNA encoded by LOC340362, corresponding to a target binding site such as BINDING SITE I, BINDING SITE II or BINDING SITE III of FIG. 8. Table 4 illustrates the complementarity of the nucleotide sequences of LOC340362 BINDING SITE, designated SEQ ID:16910, to the nucleotide sequence of GAM63 RNA, herein designated GAM RNA, also designated SEQ ID:348.

Another function of GAM63 is therefore inhibition of LOC340362 (Accession XP_295225.1). Accordingly, utilities of GAM63 include diagnosis, prevention and treatment of diseases and clinical conditions associated with LOC340362.

LOC340408 (Accession XP_291274.1) is another GAM63 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:12513, to the nucleotide sequence of GAM63 RNA, herein designated GAM RNA, also designated SEQ ID:348.

Another function of GAM63 is therefore inhibition of LOC340408 (Accession XP_291274.1). Accordingly, utilities of GAM63 include diagnosis, prevention and treatment of diseases and clinical conditions associated with LOC340408.

LOC340528 (Accession XP_295268.1) is another GAM63 target gene, herein designated TARGET GENE. LOC340528 BINDING SITE is a target binding site found in the 3' untranslated region of mRNA encoded by LOC340528, corresponding to a target binding site such as BINDING SITE I, BINDING SITE II or BINDING SITE III of FIG. 8. Table 4 illustrates the complementarity of the nucleotide sequences of LOC340528 BINDING SITE, designated SEQ ID:12693, to the nucleotide sequence of GAM63 RNA, herein designated GAM RNA, also designated SEQ ID:348.

Another function of GAM63 is therefore inhibition of LOC340528 (Accession XP_295268.1). Accordingly, utilities of GAM63 include diagnosis, prevention and treatment of diseases and clinical conditions associated with LOC340528.

LOC341036 (Accession XP_295967.2) is another GAM63 target gene, herein designated TARGET GENE. LOC341036 BINDING SITE is a target binding site found in the 5' untranslated region of mRNA encoded by LOC341036, corresponding to a target binding site such as BINDING SITE I, BINDING SITE II or BINDING SITE III of FIG. 8. Table 4 illustrates the complementarity of the nucleotide sequences of LOC341036 BINDING SITE, designated SEQ ID:990, to the nucleotide sequence of GAM63 RNA, herein designated GAM RNA, also designated SEQ ID:348.

Another function of GAM63 is therefore inhibition of LOC341036 (Accession XP_295967.2). Accordingly, utilities of GAM63 include diagnosis, prevention and treatment of diseases and clinical conditions associated with LOC341036.

LOC342195 (Accession XP_292413.1) is another GAM63 target gene, herein designated TARGET GENE. LOC342195 BINDING SITE is a target binding site found in the 5' untranslated region of mRNA encoded by LOC342195, corresponding to a target binding site such as BINDING SITE I, BINDING SITE II or BINDING SITE III of FIG. 8. Table 4 illustrates the complementarity of the nucleotide sequences of LOC342195 BINDING SITE, designated SEQ ID:752, to the nucleotide sequence of GAM63 RNA, herein designated GAM RNA, also designated SEQ ID:348.

Another function of GAM63 is therefore inhibition of LOC342195 (Accession XP_292413.1). Accordingly, utilities of GAM63 include diagnosis, prevention and treatment of diseases and clinical conditions associated with LOC342195.

LOC343052 (Accession XP_295309.1) is another GAM63 target gene, herein designated TARGET GENE. LOC343052 BINDING SITE is a target binding site found in the 3' untranslated region of mRNA encoded by LOC343052, corresponding to a target binding site such as BINDING SITE I, BINDING SITE II or BINDING SITE III of FIG. 8. Table 4 illustrates the complementarity of the nucleotide sequences of LOC343052 BINDING SITE, designated SEQ ID:11315, to the nucleotide sequence of GAM63 RNA, herein designated GAM RNA, also designated SEQ ID:348.

Another function of GAM63 is therefore inhibition of LOC343052 (Accession XP_295309.1). Accordingly, utilities of GAM63 include diagnosis, prevention and treatment of diseases and clinical conditions associated with LOC343052.

LOC343127 (Accession XP_295364.1) is another GAM63 target gene, herein designated TARGET GENE. LOC343127 BINDING SITE is a target binding site found in the 5' untranslated region of mRNA encoded by LOC343127, corresponding to a target binding site such as BINDING SITE I, BINDING SITE II or BINDING SITE III of FIG. 8. Table 4 illustrates the complementarity of the nucleotide sequences of LOC343127 BINDING SITE, designated SEQ ID:15167, to the nucleotide sequence of GAM63 RNA, herein designated GAM RNA, also designated SEQ ID:348.

Another function of GAM63 is therefore inhibition of LOC343127 (Accession XP_295364.1). Accordingly, utilities of GAM63 include diagnosis, prevention and treatment of diseases and clinical conditions associated with LOC343127.

LOC344051 (Accession XP_297346.1) is another GAM63 target gene, herein designated TARGET GENE. LOC344051 BINDING SITE is a target binding site found in the 5' untranslated region of mRNA encoded by LOC344051, corresponding to a target binding site such as BINDING SITE I, BINDING SITE II or BINDING SITE III of FIG. 8. Table 4 illustrates the complementarity of the nucleotide sequences of LOC344051 BINDING SITE, designated SEQ ID:6198, to the nucleotide sequence of GAM63 RNA, herein designated GAM RNA, also designated SEQ ID:348.

Another function of GAM63 is therefore inhibition of LOC344051 (Accession XP_297346.1). Accordingly, utilities of GAM63 include diagnosis, prevention and treatment of diseases and clinical conditions associated with LOC344051.

LOC347804 (Accession XP_166630.4) is another GAM63 target gene, herein designated TARGET GENE. LOC347804 BINDING SITE is a target binding site found in the 3' untranslated region of mRNA encoded by LOC347804, corresponding to a target binding site such as BINDING SITE I, BINDING SITE II or BINDING SITE III of FIG. 8. Table 4 illustrates the complementarity of the nucleotide sequences of LOC347804 BINDING SITE, designated SEQ ID:16952, to the nucleotide sequence of GAM63 RNA, herein designated GAM RNA, also designated SEQ ID:348.

Another function of GAM63 is therefore inhibition of LOC347804 (Accession XP_166630.4). Accordingly, utilities of GAM63 include diagnosis, prevention and treatment of diseases and clinical conditions associated with LOC347804.

LOC348071 (Accession XP_300620.1) is another GAM63 target gene, herein designated TARGET GENE. LOC348071 BINDING SITE is a target binding site found in the 3' untranslated region of mRNA encoded by LOC348071, corresponding to a target binding site such as BINDING SITE I, BINDING SITE II or BINDING SITE III of FIG. 8. Table 4 illustrates the complementarity of the nucleotide sequences of LOC348071 BINDING SITE, designated SEQ ID:19753, to the nucleotide sequence of GAM63 RNA, herein designated GAM RNA, also designated SEQ ID:348.

Another function of GAM63 is therefore inhibition of LOC348071 (Accession XP_300620.1). Accordingly, utilities of GAM63 include diagnosis, prevention and treatment of diseases and clinical conditions associated with LOC348071.

LOC348146 (Accession XP_300640.1) is another GAM63 target gene, herein designated TARGET GENE. LOC348146 BINDING SITE is a target binding site found in the 3' untranslated region of mRNA encoded by LOC348146, corresponding to a target binding site such as BINDING SITE I, BINDING SITE II or BINDING SITE III of FIG. 8. Table 4 illustrates the complementarity of the nucleotide sequences of LOC348146 BINDING SITE, designated SEQ ID:2347, to the nucleotide sequence of GAM63 RNA, herein designated GAM RNA, also designated SEQ ID:348.

Another function of GAM63 is therefore inhibition of LOC348146 (Accession XP_300640.1). Accordingly, utilities of GAM63 include diagnosis, prevention and treatment of diseases and clinical conditions associated with LOC348146.

LOC348389 (Accession XP_302739.1) is another GAM63 target gene, herein designated TARGET GENE. LOC348389 BINDING SITE is a target binding site found in the 5' untranslated region of mRNA encoded by LOC348389, corresponding to a target binding site such as BINDING SITE I, BINDING SITE II or BINDING SITE III of FIG. 8. Table 4 illustrates the complementarity of the nucleotide sequences of LOC348389 BINDING SITE, designated SEQ ID:5103, to the nucleotide sequence of GAM63 RNA, herein designated GAM RNA, also designated SEQ ID:348.

Another function of GAM63 is therefore inhibition of LOC348389 (Accession XP_302739.1). Accordingly, utilities of GAM63 include diagnosis, prevention and treatment of diseases and clinical conditions associated with LOC348389.

LOC348416 (Accession XP_300733.1) is another GAM63 target gene, herein designated TARGET GENE. LOC348416 BINDING SITE is a target binding site found in the 5' untranslated region of mRNA encoded by LOC348416, corresponding to a target binding site such as BINDING SITE I, BINDING SITE II or BINDING SITE III of FIG. 8. Table 4 illustrates the complementarity of the nucleotide sequences of LOC348416 BINDING SITE, designated SEQ ID:6373, to the nucleotide sequence of GAM63 RNA, herein designated GAM RNA, also designated SEQ ID:348.

Another function of GAM63 is therefore inhibition of LOC348416 (Accession XP_300733.1). Accordingly, utilities of GAM63 include diagnosis, prevention and treatment of diseases and clinical conditions associated with LOC348416.

LOC348452 (Accession XP_300742.1) is another GAM63 target gene, herein designated TARGET GENE. LOC348452 BINDING SITE is a target binding site found in the 5' untranslated region of mRNA encoded by LOC348452, corresponding to a target binding site such as BINDING SITE I, BINDING SITE II or BINDING SITE III of FIG. 8. Table 4 illustrates the complementarity of the nucleotide sequences of LOC348452 BINDING SITE, designated SEQ ID:14880, to the nucleotide sequence of GAM63 RNA, herein designated GAM RNA, also designated SEQ ID:348.

Another function of GAM63 is therefore inhibition of LOC348452 (Accession XP_300742.1). Accordingly, utilities of GAM63 include diagnosis, prevention and treatment of diseases and clinical conditions associated with LOC348452.

LOC348488 (Accession XP_300352.1) is another GAM63 target gene, herein designated TARGET GENE. LOC348488 BINDING SITE is a target binding site found in the 3' untranslated region of mRNA encoded by LOC348488, corresponding to a target binding site such as BINDING SITE I, BINDING SITE II or BINDING SITE III of FIG. 8. Table 4 illustrates the complementarity of the nucleotide sequences of LOC348488 BINDING SITE, designated SEQ ID:14543, to the nucleotide sequence of GAM63 RNA, herein designated GAM RNA, also designated SEQ ID:348.

Another function of GAM63 is therefore inhibition of LOC348488 (Accession XP_300352.1). Accordingly, utilities of GAM63 include diagnosis, prevention and treatment of diseases and clinical conditions associated with LOC348488.

LOC348508 (Accession XP_302806.1) is another GAM63 target gene, herein designated TARGET GENE. LOC348508 BINDING SITE1 and LOC348508 BINDING SITE2 are target binding sites found in untranslated regions of mRNA encoded by LOC348508, corresponding to target binding sites such as BINDING SITE I, BINDING SITE II or BINDING SITE III of FIG. 8. Table 4 illustrates the complementarity of the nucleotide sequences of LOC348508 BINDING SITE1 and LOC348508 BINDING SITE2, designated SEQ ID:12029 and SEQ ID:11430 respectively, to the nucleotide sequence of GAM63 RNA, herein designated GAM RNA, also designated SEQ ID:348.

Another function of GAM63 is therefore inhibition of LOC348508 (Accession XP_302806.1). Accordingly, utilities of GAM63 include diagnosis, prevention and treatment of diseases and clinical conditions associated with LOC348508.

LOC348583 (Accession XP_302833.1) is another GAM63 target gene, herein designated TARGET GENE. LOC348583 BINDING SITE is a target binding site found in the 3' untranslated region of mRNA encoded by LOC348583, corresponding to a target binding site such as BINDING SITE I, BINDING SITE II or BINDING SITE III of FIG. 8. Table 4 illustrates the complementarity of the nucleotide sequences of LOC348583 BINDING SITE, designated SEQ ID:928, to the nucleotide sequence of GAM63 RNA, herein designated GAM RNA, also designated SEQ ID:348.

Another function of GAM63 is therefore inhibition of LOC348583 (Accession XP_302833.1). Accordingly, utilities of GAM63 include diagnosis, prevention and treatment of diseases and clinical conditions associated with LOC348583.

LOC348701 (Accession XP_300810.1) is another GAM63 target gene, herein designated TARGET GENE. LOC348701 BINDING SITE is a target binding site found in the 3' untranslated region of mRNA encoded by LOC348701, corresponding to a target binding site such as BINDING SITE I, BINDING SITE II or BINDING SITE III of FIG. 8. Table 4 illustrates the complementarity of the nucleotide sequences of LOC348701 BINDING SITE, designated SEQ ID:1681, to the nucleotide sequence of GAM63 RNA, herein designated GAM RNA, also designated SEQ ID:348.

Another function of GAM63 is therefore inhibition of LOC348701 (Accession XP_300810.1). Accordingly, utilities of GAM63 include diagnosis, prevention and treatment of diseases and clinical conditions associated with LOC348701.

LOC348780 (Accession XP_302884.1) is another GAM63 target gene, herein designated TARGET GENE. LOC348780 BINDING SITE is a target binding site found in the 5' untranslated region of mRNA encoded by LOC348780, corresponding to a target binding site such as BINDING SITE I, BINDING SITE II or BINDING SITE III of FIG. 8. Table 4 illustrates the complementarity of the nucleotide sequences of LOC348780 BINDING SITE, designated SEQ ID:17525, to the nucleotide sequence of GAM63 RNA, herein designated GAM RNA, also designated SEQ ID:348.

Another function of GAM63 is therefore inhibition of LOC348780 (Accession XP_302884.1). Accordingly, utilities of GAM63 include diagnosis, prevention and treatment of diseases and clinical conditions associated with LOC348780.

LOC349080 (Accession XP_302952.1) is another GAM63 target gene, herein designated TARGET GENE. LOC349080 BINDING SITE is a target binding site found in the 3' untranslated region of mRNA encoded by LOC349080, corresponding to a target binding site such as BINDING SITE I, BINDING SITE II or BINDING SITE III of FIG. 8. Table 4 illustrates the complementarity of the nucleotide sequences of LOC349080 BINDING SITE, designated SEQ ID:11232, to the nucleotide sequence of GAM63 RNA, herein designated GAM RNA, also designated SEQ ID:348.

Another function of GAM63 is therefore inhibition of LOC349080 (Accession XP_302952.1). Accordingly, utilities of GAM63 include diagnosis, prevention and treatment of diseases and clinical conditions associated with LOC349080.

LOC349161 (Accession XP_302970.1) is another GAM63 target gene, herein designated TARGET GENE. LOC349161 BINDING SITE is a target binding site found in the 3' untranslated region of mRNA encoded by LOC349161, corresponding to a target binding site such as BINDING SITE I, BINDING SITE II or BINDING SITE III of FIG. 8. Table 4 illustrates the complementarity of the nucleotide sequences of LOC349161 BINDING SITE, designated SEQ ID:18078, to the nucleotide sequence of GAM63 RNA, herein designated GAM RNA, also designated SEQ ID:348.

Another function of GAM63 is therefore inhibition of LOC349161 (Accession XP_302970.1). Accordingly, utilities of GAM63 include diagnosis, prevention and treatment of diseases and clinical conditions associated with LOC349161.

LOC349277 (Accession XP_303016.1) is another GAM63 target gene, herein designated TARGET GENE. LOC349277 BINDING SITE is a target binding site found in the 5' untranslated region of mRNA encoded by LOC349277, corresponding to a target binding site such as BINDING SITE I, BINDING SITE II or BINDING SITE III of FIG. 8. Table 4 illustrates the complementarity of the nucleotide sequences of LOC349277 BINDING SITE, designated SEQ ID:9154, to the nucleotide sequence of GAM63 RNA, herein designated GAM RNA, also designated SEQ ID:348.

Another function of GAM63 is therefore inhibition of LOC349277 (Accession XP_303016.1). Accordingly, utilities of GAM63 include diagnosis, prevention and treatment of diseases and clinical conditions associated with LOC349277.

LOC349299 (Accession XP_303021.1) is another GAM63 target gene, herein designated TARGET GENE. LOC349299 BINDING SITE is a target binding site found in the 5' untranslated region of mRNA encoded by LOC349299, corresponding to a target binding site such as BINDING SITE I, BINDING SITE II or BINDING SITE III of FIG. 8. Table 4 illustrates the complementarity of the nucleotide sequences of LOC349299 BINDING SITE, designated SEQ ID:9154, to the nucleotide sequence of GAM63 RNA, herein designated GAM RNA, also designated SEQ ID:348.

Another function of GAM63 is therefore inhibition of LOC349299 (Accession XP_303021.1). Accordingly, utilities of GAM63 include diagnosis, prevention and treatment of diseases and clinical conditions associated with LOC349299.

LOC349305 (Accession XP_301019.1) is another GAM63 target gene, herein designated TARGET GENE. LOC349305 BINDING SITE is a target binding site found in the 5' untranslated region of mRNA encoded by LOC349305, corresponding to a target binding site such as BINDING SITE I, BINDING SITE II or BINDING SITE III of FIG. 8. Table 4 illustrates the complementarity of the nucleotide sequences of LOC349305 BINDING SITE, designated SEQ ID:18870, to the nucleotide sequence of GAM63 RNA, herein designated GAM RNA, also designated SEQ ID:348.

Another function of GAM63 is therefore inhibition of LOC349305 (Accession XP_301019.1). Accordingly, utilities of GAM63 include diagnosis, prevention and treatment of diseases and clinical conditions associated with LOC349305.

LOC349307 (Accession XP_303024.1) is another GAM63 target gene, herein designated TARGET GENE. LOC349307 BINDING SITE is a target binding site found in the 3' untranslated region of mRNA encoded by LOC349307, corresponding to a target binding site such as BINDING SITE I, BINDING SITE II or BINDING SITE III of FIG. 8. Table 4 illustrates the complementarity of the nucleotide sequences of LOC349307 BINDING SITE, designated SEQ ID:10059, to the nucleotide sequence of GAM63 RNA, herein designated GAM RNA, also designated SEQ ID:348.

Another function of GAM63 is therefore inhibition of LOC349307 (Accession XP_303024.1). Accordingly, utilities of GAM63 include diagnosis, prevention and treatment of diseases and clinical conditions associated with LOC349307.

LOC349420 (Accession XP_301075.1) is another GAM63 target gene, herein designated TARGET GENE. LOC349420 BINDING SITE is a target binding site found in the 3' untranslated region of mRNA encoded by LOC349420, corresponding to a target binding site such as BINDING SITE I, BINDING SITE II or BINDING SITE III of FIG. 8. Table 4 illustrates the complementarity of the nucleotide sequences of LOC349420 BINDING SITE, designated SEQ ID:11964, to the nucleotide sequence of GAM63 RNA, herein designated GAM RNA, also designated SEQ ID:348.

Another function of GAM63 is therefore inhibition of LOC349420 (Accession XP_301075.1). Accordingly, utilities of GAM63 include diagnosis, prevention and treatment of diseases and clinical conditions associated with LOC349420.

LOC349429 (Accession XP_301083.1) is another GAM63 target gene, herein designated TARGET GENE. LOC349429 BINDING SITE is a target binding site found in the 5' untranslated region of mRNA encoded by LOC349429, corresponding to a target binding site such as BINDING SITE I, BINDING SITE II or BINDING SITE III of FIG. 8. Table 4 illustrates the complementarity of the nucleotide sequences of LOC349429 BINDING SITE, designated SEQ ID:17046, to the nucleotide sequence of GAM63 RNA, herein designated GAM RNA, also designated SEQ ID:348.

Another function of GAM63 is therefore inhibition of LOC349429 (Accession XP_301083.1). Accordingly, utilities of GAM63 include diagnosis, prevention and treatment of diseases and clinical conditions associated with LOC349429.

LOC350897 (Accession XP_303256.1) is another GAM63 target gene, herein designated TARGET GENE. LOC350897 BINDING SITE is a target binding site found in the 5' untranslated region of mRNA encoded by LOC350897, corresponding to a target binding site such as BINDING SITE I, BINDING SITE II or BINDING SITE III of FIG. 8. Table 4 illustrates the complementarity of the nucleotide sequences of LOC350897 BINDING SITE, designated SEQ ID:8471, to the nucleotide sequence of GAM63 RNA, herein designated GAM RNA, also designated SEQ ID:348.

Another function of GAM63 is therefore inhibition of LOC350897 (Accession XP_303256.1). Accordingly, utilities of GAM63 include diagnosis, prevention and treatment of diseases and clinical conditions associated with LOC350897.

LOC51236 (Accession NP_057542.2) is another GAM63 target gene, herein designated TARGET GENE. LOC51236 BINDING SITE is a target binding site found in the 3' untranslated region of mRNA encoded by LOC51236, corresponding to a target binding site such as BINDING SITE I, BINDING SITE II or BINDING SITE III of FIG. 8. Table 4 illustrates the complementarity of the nucleotide sequences of LOC51236 BINDING SITE, designated SEQ ID:6536, to the nucleotide sequence of GAM63 RNA, herein designated GAM RNA, also designated SEQ ID:348.

Another function of GAM63 is therefore inhibition of LOC51236 (Accession NP_057542.2). Accordingly, utilities of GAM63 include diagnosis, prevention and treatment of diseases and clinical conditions associated with LOC51236.

LOC90576 (Accession XP_032678.2) is another GAM63 target gene, herein designated TARGET GENE. LOC90576 BINDING SITE is a target binding site found in the 5' untranslated region of mRNA encoded by LOC90576, corresponding to a target binding site such as BINDING SITE I, BINDING SITE II or BINDING SITE III of FIG. 8. Table 4 illustrates the complementarity of the nucleotide sequences of LOC90576 BINDING SITE, designated SEQ ID:12424, to the nucleotide sequence of GAM63 RNA, herein designated GAM RNA, also designated SEQ ID:348.

Another function of GAM63 is therefore inhibition of LOC90576 (Accession XP_032678.2). Accordingly, utilities of GAM63 include diagnosis, prevention and treatment of diseases and clinical conditions associated with LOC90576.

LOC90906 (Accession XP_034809.1) is another GAM63 target gene, herein designated TARGET GENE. LOC90906 BINDING SITE is a target binding site found in the 3' untranslated region of mRNA encoded by LOC90906, corresponding to a target binding site such as BINDING SITE I, BINDING SITE II or BINDING SITE III of FIG. 8. Table 4 illustrates the complementarity of the nucleotide sequences of LOC90906 BINDING SITE, designated SEQ ID:10295, to the nucleotide sequence of GAM63 RNA, herein designated GAM RNA, also designated SEQ ID:348.

Another function of GAM63 is therefore inhibition of LOC90906 (Accession XP_034809.1). Accordingly, utilities of GAM63 include diagnosis, prevention and treatment of diseases and clinical conditions associated with LOC90906.

LOC91397 (Accession XP_038219.2) is another GAM63 target gene, herein designated TARGET GENE. LOC91397 BINDING SITE1 and LOC91397 BINDING SITE2 are target binding sites found in untranslated regions of mRNA encoded by LOC91397, corresponding to target binding sites such as BINDING SITE I, BINDING SITE II or BINDING SITE III of FIG. 8. Table 4 illustrates the complementarity of the nucleotide sequences of LOC91397 BINDING SITE1 and LOC91397 BINDING SITE2, designated SEQ ID:11988 and SEQ ID:12564 respectively, to the nucleotide sequence of GAM63 RNA, herein designated GAM RNA, also designated SEQ ID:348.

Another function of GAM63 is therefore inhibition of LOC91397 (Accession XP_038219.2). Accordingly, utilities of GAM63 include diagnosis, prevention and treatment of diseases and clinical conditions associated with LOC91397.

LOC91807 (Accession XP_040819.1) is another GAM63 target gene, herein designated TARGET GENE. LOC91807 BINDING SITE is a target binding site found in the 3' untranslated region of mRNA encoded by LOC91807, corresponding to a target binding site such as BINDING SITE I, BINDING SITE II or BINDING SITE III of FIG. 8. Table 4 illustrates the complementarity of the nucleotide sequences of LOC91807 BINDING SITE, designated SEQ ID:6003, to the nucleotide sequence of GAM63 RNA, herein designated GAM RNA, also designated SEQ ID:348.

Another function of GAM63 is therefore inhibition of LOC91807 (Accession XP_040819.1). Accordingly, utilities of GAM63 include diagnosis, prevention and treatment of diseases and clinical conditions associated with LOC91807.

LOC92973 (Accession XP_048529.2) is another GAM63 target gene, herein designated TARGET GENE. LOC92973 BINDING SITE is a target binding site found in the 5' untranslated region of mRNA encoded by LOC92973, corresponding to a target binding site such as BINDING SITE I, BINDING SITE II or BINDING SITE III of FIG. 8. Table 4 illustrates the complementarity of the nucleotide sequences of LOC92973 BINDING SITE, designated SEQ ID:17973, to the nucleotide sequence of GAM63 RNA, herein designated GAM RNA, also designated SEQ ID:348.

Another function of GAM63 is therefore inhibition of LOC92973 (Accession XP_048529.2). Accordingly, utilities of GAM63 include diagnosis, prevention and treatment of diseases and clinical conditions associated with LOC92973.

LOC93259 (Accession XP_050105.1) is another GAM63 target gene, herein designated TARGET GENE. LOC93259 BINDING SITE is a target binding site found in the 5' untranslated region of mRNA encoded by LOC93259, corresponding to a target binding site such as BINDING SITE I, BINDING SITE II or BINDING SITE III of FIG. 8. Table 4 illustrates the complementarity of the nucleotide sequences of LOC93259 BINDING SITE, designated SEQ ID:18965, to the nucleotide sequence of GAM63 RNA, herein designated GAM RNA, also designated SEQ ID:348.

Another function of GAM63 is therefore inhibition of LOC93259 (Accession XP_050105.1). Accordingly, utilities of GAM63 include diagnosis, prevention and treatment of diseases and clinical conditions associated with LOC93259.

Leupaxin (LPXN, Accession NP_004802.1) is another GAM63 target gene, herein designated TARGET GENE. LPXN BINDING SITE is a target binding site found in the 3' untranslated region of mRNA encoded by LPXN, corresponding to a target binding site such as BINDING SITE I, BINDING SITE II or BINDING SITE III of FIG. 8. Table 4 illustrates the complementarity of the nucleotide sequences of LPXN BINDING SITE, designated SEQ ID:14409, to the nucleotide sequence of GAM63 RNA, herein designated GAM RNA, also designated SEQ ID:348.

Another function of GAM63 is therefore inhibition of Leupaxin (LPXN, Accession NP_004802.1). Accordingly, utilities of GAM63 include diagnosis, prevention and treatment of diseases and clinical conditions associated with LPXN.

MAGED4 (Accession NP_803881.1) is another GAM63 target gene, herein designated TARGET GENE. MAGED4 BINDING SITE is a target binding site found in the 3' untranslated region of multiple transcripts of mRNA encoded by MAGED4, corresponding to a target binding site such as BINDING SITE I, BINDING SITE II or BINDING SITE III of FIG. 8. Table 4 illustrates the complementarity of the nucleotide sequences of MAGED4 BINDING SITE, designated SEQ ID:11993, to the nucleotide sequence of GAM63 RNA, herein designated GAM RNA, also designated SEQ ID:348.

Another function of GAM63 is therefore inhibition of MAGED4 (Accession NP_803881.1). Accordingly, utilities of GAM63 include diagnosis, prevention and treatment of diseases and clinical conditions associated with MAGED4.

Mam domain containing 1 (MAMDC1, Accession XP_090827.3) is another GAM63 target gene, herein designated TARGET GENE. MAMDC1 BINDING SITE is a target binding site found in the 3' untranslated region of mRNA encoded by MAMDC1, corresponding to a target binding site such as BINDING SITE I, BINDING SITE II or BINDING SITE III of FIG. 8. Table 4 illustrates the complementarity of the nucleotide sequences of MAMDC1 BINDING SITE, designated SEQ ID:11453, to the nucleotide sequence of GAM63 RNA, herein designated GAM RNA, also designated SEQ ID:348.

Another function of GAM63 is therefore inhibition of Mam domain containing 1 (MAMDC1, Accession XP_090827.3). Accordingly, utilities of GAM63 include diagnosis, prevention and treatment of diseases and clinical conditions associated with MAMDC1.

Mitogen-activated protein kinase kinase 4 (MAP2K4, Accession NP_003001.1) is another GAM63 target gene, herein designated TARGET GENE. MAP2K4 BINDING SITE1 and MAP2K4 BINDING SITE2 are target binding sites found in untranslated regions of mRNA encoded by MAP2K4, corresponding to target binding sites such as BINDING SITE I, BINDING SITE II or BINDING SITE III of FIG. 8. Table 4 illustrates the complementarity of the nucleotide sequences of MAP2K4 BINDING SITE1 and MAP2K4 BINDING SITE2, designated SEQ ID:17579 and SEQ ID:7023 respectively, to the nucleotide sequence of GAM63 RNA, herein designated GAM RNA, also designated SEQ ID:348.

Another function of GAM63 is therefore inhibition of Mitogen-activated protein kinase kinase 4 (MAP2K4, Accession NP_003001.1). Accordingly, utilities of GAM63 include diagnosis, prevention and treatment of diseases and clinical conditions associated with MAP2K4.

Map/microtubule affinity-regulating kinase 2 (MARK2, Accession NP_004945.2) is another GAM63 target gene, herein designated TARGET GENE. MARK2 BINDING SITE is a target binding site found in the 3' untranslated region of multiple transcripts of mRNA encoded by MARK2, corresponding to a target binding site such as BINDING SITE I, BINDING SITE II or BINDING SITE III of FIG. 8. Table 4 illustrates the complementarity of the nucleotide sequences of MARK2 BINDING SITE, designated SEQ ID:4411, to the nucleotide sequence of GAM63 RNA, herein designated GAM RNA, also designated SEQ ID:348.

Another function of GAM63 is therefore inhibition of Map/microtubule affinity-regulating kinase 2 (MARK2, Accession NP_004945.2). Accordingly, utilities of GAM63 include diagnosis, prevention and treatment of diseases and clinical conditions associated with MARK2.

Map/microtubule affinity-regulating kinase 2 (MARK2, Accession NP_059672.1) is another GAM63 target gene, herein designated TARGET GENE. MARK2 BINDING SITE is a target binding site found in the 3' untranslated region of multiple transcripts of mRNA encoded by MARK2, corresponding to a target binding site such as BINDING SITE I, BINDING SITE II or BINDING SITE III of FIG. 8. Table 4 illustrates the complementarity of the nucleotide sequences of MARK2 BINDING SITE, designated SEQ ID:4411, to the nucleotide sequence of GAM63 RNA, herein designated GAM RNA, also designated SEQ ID:348.

Another function of GAM63 is therefore inhibition of Map/microtubule affinity-regulating kinase 2 (MARK2, Accession NP_059672.1). Accordingly, utilities of GAM63 include diagnosis, prevention and treatment of diseases and clinical conditions associated with MARK2.

Membrane cofactor protein (cd46, trophoblast-lymphocyte cross-reactive antigen) (MCP, Accession NP_758870.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758870.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758869.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758869.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I-dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758865.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758865.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758861.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758861.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail.

Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758864.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758864.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758867.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758867.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins.

The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758863.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758863.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758860.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758860.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758871.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758871.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_722548.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_722548.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758866.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758866.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758862.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758862.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_002380.3) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_002380.3), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. Membrane cofactor protein (cd46, trophoblast-lymphocyte cross-reactive antigen) (MCP, Accession NP_758868.1) is another GAM63 target gene, herein designated TARGET GENE. MCP BINDING SITE is a target binding site found in the 5' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:3578, to the nucleotide sequence of GAM63 RNA, herein designated GAM RNA, also designated SEQ ID:348.

Another function of GAM63 is therefore inhibition of Membrane cofactor protein (cd46, trophoblast-lymphocyte cross-reactive antigen) (MCP, Accession NP_758868.1), a gene which may be involved in the regulation of complement activation. Accordingly, utilities of GAM63 include diagnosis, prevention and treatment of diseases and clinical conditions associated with MCP.

The function of MCP has been established by previous studies. MCP, a C3B/C4B-binding molecule of the complement system with cofactor activity for the I- dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes.

Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Sey, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in cited publications listed in Table 5, which are hereby incorporated by reference. MEP50 (Accession NP_077007.1) is another GAM63 target gene, herein designated TARGET GENE. MEP50 BINDING SITE is a target binding site found in the 3' untranslated region of mRNA encoded by MEP50, corresponding to a target binding site such as BINDING SITE I, BINDING SITE II or BINDING SITE III of FIG. 8. Table 4 illustrates the complementarity of the nucleotide sequences of MEP50 BINDING SITE, designated SEQ ID:18671, to the nucleotide sequence of GAM63 RNA, herein designated GAM RNA, also designated SEQ ID:348.

Another function of GAM63 is therefore inhibition of MEP50 (Accession NP_077007.1). Accordingly, utilities of GAM63 include diagnosis, prevention and treatment of diseases and clinical conditions associated with MEP50.

Mesoderm development candidate 2 (MESDC2, Accession XP_051854.1) is another GAM63 target gene, herein designated TARGET GENE. MESDC2 BINDING SITE is a target binding site found in the 3' untranslated region of mRNA encoded by MESDC2, corresponding to a target binding site such as BINDING SITE I, BINDING SITE II or BINDING SITE III of FIG. 8. Table 4 illustrates the complementarity of the nucleotide sequences of MESDC2 BINDING SITE, designated SEQ ID:20061, to the nucleotide sequence of GAM63 RNA, herein designated GAM RNA, also designated SEQ ID:348.

Another function of GAM63 is therefore inhibition of Mesoderm development candidate 2 (MESDC2, Accession XP_051854.1). Accordingly, utilities of GAM63 include diagnosis, prevention and treatment of diseases and clinical conditions associated with MESDC2.

MESP2 (Accession XP_085261.1) is another GAM63 target gene, herein designated TARGET GENE. MESP2 BINDING SITE is a target binding site found in the 3' untranslated region of mRNA encoded by MESP2, corresponding to a target binding site such as BINDING SITE I, BINDING SITE II or BINDING SITE III of FIG. 8. Table 4 illustrates the complementarity of the nucleotide sequences of MESP2 BINDING SITE, designated SEQ ID:12071, to the nucleotide sequence of GAM63 RNA, herein designated GAM RNA, also designated SEQ ID:348.

Another function of GAM63 is therefore inhibition of MESP2 (Accession XP_085261.1). Accordingly, utilities of GAM63 include diagnosis, prevention and treatment of diseases and clinical conditions associated with MESP2.

Max gene associated (MGA, Accession XP_031689.3) is another GAM63 target gene, herein designated TARGET GENE. MGA BINDING SITE is a target binding site found in the 3' untranslated region of mRNA encoded by MGA, corresponding to a target binding site such as BINDING SITE I, BINDING SITE II or BINDING SITE III of FIG. 8. Table 4 illustrates the complementarity of the nucleotide sequences of MGA BINDING SITE, designated SEQ ID:11668, to the nucleotide sequence of GAM63 RNA, herein designated GAM RNA, also designated SEQ ID:348.

Another function of GAM63 is therefore inhibition of Max gene associated (MGA, Accession XP_031689.3), a gene which plays a role in the final steps of digestion of starch. Accordingly, utilities of GAM63 include diagnosis, prevention and treatment of diseases and clinical conditions associated with MGA.

The function of MGA and its association with various diseases and clinical conditions, has been established by previous studies, as described hereinabove with reference to GAM47.1. Mannosyl (alpha-1,6-)-glycoprotein beta-1,6-n-acetyl-glucosaminyltransferase (MGAT5, Accession NP_002401.1) is another GAM63 target gene, herein designated TARGET GENE. MGAT5 BINDING SITE is a target binding site found in the 5' untranslated region of mRNA encoded by MGAT5, corresponding to a target binding site such as BINDING SITE I, BINDING SITE II or BINDING SITE III of FIG. 8. Table 4 illustrates the complementarity of the nucleotide sequences of MGAT5 BINDING SITE, designated SEQ ID:13161, to the nucleotide sequence of GAM63 RNA, herein designated GAM RNA, also designated SEQ ID:348.

Another function of GAM63 is therefore inhibition of Mannosyl (alpha-1,6-)-glycoprotein beta-1,6-n-acetyl-glucosaminyltransferase (MGAT5, Accession NP_002401.1). Accordingly, utilities of GAM63 include diagnosis, prevention and treatment of diseases and clinical conditions associated with MGAT5.

MGC10334 (Accession XP_300761.1) is another GAM63 target gene, herein designated TARGET GENE. MGC10334 BINDING SITE is a target binding site found in the 5' untranslated region of multiple transcripts of mRNA encoded by MGC10334, corresponding to a target binding site such as BINDING SITE I, BINDING SITE II or BINDING SITE III of FIG. 8. Table 4 illustrates the complementarity of the nucleotide sequences of MGC10334 BINDING SITE, designated SEQ ID:14880, to the nucleotide sequence of GAM63 RNA, herein designated GAM RNA, also designated SEQ ID:348.

Another function of GAM63 is therefore inhibition of MGC10334 (Accession XP_300761.1). Accordingly, utilities of GAM63 include diagnosis, prevention and treatment of diseases and clinical conditions associated with MGC10334.

MGC11115 (Accession NP_115686.2) is another GAM63 target gene, herein designated TARGET GENE. MGC11115 BINDING SITE is a target binding site found in the 3' untranslated region of mRNA encoded by MGC11115, corresponding to a target binding site such as BINDING SITE I, BINDING SITE II or BINDING SITE III of FIG. 8. Table 4 illustrates the complementarity of the nucleotide sequences of MGC11115 BINDING SITE, designated SEQ ID:13254, to the nucleotide sequence of GAM63 RNA, herein designated GAM RNA, also designated SEQ ID:348.

Another function of GAM63 is therefore inhibition of MGC11115 (Accession NP_115686.2). Accordingly, utilities of GAM63 include diagnosis, prevention and treatment of diseases and clinical conditions associated with MGC11115.

MGC12262 (Accession NP_116085.1) is another GAM63 target gene, herein designated TARGET GENE. MGC12262 BINDING SITE is a target binding site found in the 5' untranslated region of mRNA encoded by MGC12262, corresponding to a target binding site such as BINDING SITE I, BINDING SITE II or BINDING SITE III of FIG. 8. Table 4 illustrates the complementarity of the nucleotide sequences of MGC12262 BINDING SITE, designated SEQ ID:15149, to the nucleotide sequence of GAM63 RNA, herein designated GAM RNA, also designated SEQ ID:348.

Another function of GAM63 is therefore inhibition of MGC12262 (Accession NP_116085.1). Accordingly, utilities of GAM63 include diagnosis, prevention and treatment of diseases and clinical conditions associated with MGC12262.

MGC14839 (Accession NP_542390.1) is another GAM63 target gene, herein designated TARGET GENE. MGC14839 BINDING SITE is a target binding site found in the 3' untranslated region of mRNA encoded by MGC14839, corresponding to a target binding site such as BINDING SITE I, BINDING SITE II or BINDING SITE III of FIG. 8. Table 4 illustrates the complementarity of the nucleotide sequences of MGC14839 BINDING SITE, designated SEQ ID:19092, to the nucleotide sequence of GAM63 RNA, herein designated GAM RNA, also designated SEQ ID:348.

Another function of GAM63 is therefore inhibition of MGC14839 (Accession NP_542390.1). Accordingly, utilities of GAM63 include diagnosis, prevention and treatment of diseases and clinical conditions associated with MGC14839.

MGC16044 (Accession NP_612380.1) is another GAM63 target gene, herein designated TARGET GENE. MGC16044 BINDING SITE is a target binding site found in the 5' untranslated region of mRNA encoded by MGC16044, corresponding to a target binding site such as BINDING SITE I, BINDING SITE II or BINDING SITE III of FIG. 8. Table 4 illustrates the complementarity of the nucleotide sequences of MGC16044 BINDING SITE, designated SEQ ID:13269, to the nucleotide sequence of GAM63 RNA, herein designated GAM RNA, also designated SEQ ID:348.

Another function of GAM63 is therefore inhibition of MGC16044 (Accession NP_612380.1). Accordingly, utilities of GAM63 include diagnosis, prevention and treatment of diseases and clinical conditions associated with MGC16044.

MGC18216 (Accession NP_689665.1) is another GAM63 target gene, herein designated TARGET GENE. MGC18216 BINDING SITE is a target binding site found in the 3' untranslated region of mRNA encoded by MGC18216, corresponding to a target binding site such as BINDING SITE I, BINDING SITE II or BINDING SITE III of FIG. 8. Table 4 illustrates the complementarity of the nucleotide sequences of MGC18216 BINDING SITE, designated SEQ ID:10002, to the nucleotide sequence of GAM63 RNA, herein designated GAM RNA, also designated SEQ ID:348.

Another function of GAM63 is therefore inhibition of MGC18216 (Accession NP_689665.1). Accordingly, utilities of GAM63 include diagnosis, prevention and treatment of diseases and clinical conditions associated with MGC18216.

MGC20470 (Accession NP_659490.1) is another GAM63 target gene, herein designated TARGET GENE. MGC20470 BINDING SITE is a target binding site found in the 5' untranslated region of mRNA encoded by MGC20470, corresponding to a target binding site such as BINDING SITE I, BINDING SITE II or BINDING SITE III of FIG. 8. Table 4 illustrates the complementarity of the nucleotide sequences of MGC20470 BINDING SITE, designated SEQ ID:18986, to the nucleotide sequence of GAM63 RNA, herein designated GAM RNA, also designated SEQ ID:348.

Another function of GAM63 is therefore inhibition of MGC20470 (Accession NP_659490.1). Accordingly, utilities of GAM63 include diagnosis, prevention and treatment of diseases and clinical conditions associated with MGC20470.

MGC26598 (Accession NP_689851.1) is another GAM63 target gene, herein designated TARGET GENE. MGC26598 BINDING SITE is a target binding site found in the 5' untranslated region of mRNA encoded by MGC26598, corresponding to a target binding site such as BINDING SITE I, BINDING SITE II or BINDING SITE III of FIG. 8. Table 4 illustrates the complementarity of the nucleotide sequences of MGC26598 BINDING SITE, designated SEQ ID:3683, to the nucleotide sequence of GAM63 RNA, herein designated GAM RNA, also designated SEQ ID:348.

Another function of GAM63 is therefore inhibition of MGC26598 (Accession NP_689851.1). Accordingly, utilities of GAM63 include diagnosis, prevention and treatment of diseases and clinical conditions associated with MGC26598.

MGC3047 (Accession NP_115724.1) is another GAM63 target gene, herein designated TARGET GENE. MGC3047 BINDING SITE is a target binding site found in the 3' untranslated region of mRNA encoded by MGC3047, corresponding to a target binding site such as BINDING SITE I, BINDING SITE II or BINDING SITE III of FIG. 8. Table 4 illustrates the complementarity of the nucleotide sequences of MGC3047 BINDING SITE, designated SEQ ID:2308, to the nucleotide sequence of GAM63 RNA, herein designated GAM RNA, also designated SEQ ID:348.

Another function of GAM63 is therefore inhibition of MGC3047 (Accession NP_115724.1). Accordingly, utilities of GAM63 include diagnosis, prevention and treatment of diseases and clinical conditions associated with MGC3047.

MGC3101 (Accession NP_076948.1) is another GAM63 target gene, herein designated TARGET GENE. MGC3101 BINDING SITE is a target binding site found in the 3' untranslated region of mRNA encoded by MGC3101, corresponding to a target binding site such as BINDING SITE I, BINDING SITE II or BINDING SITE III of FIG. 8. Table 4 illustrates the complementarity of the nucleotide sequences of MGC3101 BINDING SITE, designated SEQ ID:12469, to the nucleotide sequence of GAM63 RNA, herein designated GAM RNA, also designated SEQ ID:348.

Another function of GAM63 is therefore inhibition of MGC3101 (Accession NP_076948.1). Accordingly, utilities of GAM63 include diagnosis, prevention and treatment of diseases and clinical conditions associated with MGC3101.

MGC32020 (Accession NP_689479.1) is another GAM63 target gene, herein designated TARGET GENE. MGC32020 BINDING SITE is a target binding site found in the 3' untranslated region of mRNA encoded by MGC32020, corresponding to a target binding site such as BINDING SITE I, BINDING SITE II or BINDING SITE III of FIG. 8. Table 4 illustrates the complementarity of the nucleotide sequences of MGC32020 BINDING SITE, designated SEQ ID:11644, to the nucleotide sequence of GAM63 RNA, herein designated GAM RNA, also designated SEQ ID:348.

Another function of GAM63 is therefore inhibition of MGC32020 (Accession NP_689479.1). Accordingly, utilities of GAM63 include diagnosis, prevention and treatment of diseases and clinical conditions associated with MGC32020.

MGC33407 (Accession NP_848620.1) is another GAM63 target gene, herein designated TARGET GENE. MGC33407 BINDING SITE is a target binding site found in the 5' untranslated region of mRNA encoded by MGC33407, corresponding to a target binding site such as BINDING SITE I, BINDING SITE II or BINDING SITE III of FIG. 8. Table 4 illustrates the complementarity of the nucleotide sequences of MGC33407 BINDING SITE, designated SEQ ID:16203, to the nucleotide sequence of GAM63 RNA, herein designated GAM RNA, also designated SEQ ID:348.

Another function of GAM63 is therefore inhibition of MGC33407 (Accession NP_848620.1). Accordingly, utilities of GAM63 include diagnosis, prevention and treatment of diseases and clinical conditions associated with MGC33407.

MGC33884 (Accession NP_699161.1) is another GAM63 target gene, herein designated TARGET GENE. MGC33884 BINDING SITE is a target binding site found in the 5' untranslated region of mRNA encoded by MGC33884, corresponding to a target binding site such as BINDING SITE I, BINDING SITE II or BINDING SITE III of FIG. 8. Table 4 illustrates the complementarity of the nucleotide sequences of MGC33884 BINDING SITE, designated SEQ ID:15982, to the nucleotide sequence of GAM63 RNA, herein designated GAM RNA, also designated SEQ ID:348.

Another function of GAM63 is therefore inhibition of MGC33884 (Accession NP_699161.1). Accordingly, utilities of GAM63 include diagnosis, prevention and treatment of diseases and clinical conditions associated with MGC33884.

MGC34837 (Accession NP_689590.1) is another GAM63 target gene, herein designated TARGET GENE. MGC34837 BINDING SITE is a target binding site found in the 3' untranslated region of mRNA encoded by MGC34837, corresponding to a target binding site such as BINDING SITE I, BINDING SITE II or BINDING SITE III of FIG. 8. Table 4 illustrates the complementarity of the nucleotide sequences of MGC34837 BINDING SITE, designated SEQ ID:10386, to the nucleotide sequence of GAM63 RNA, herein designated GAM RNA, also designated SEQ ID:348.

Another function of GAM63 is therefore inhibition of MGC34837 (Accession NP_689590.1). Accordingly, utilities of GAM63 include diagnosis, prevention and treatment of diseases and clinical conditions associated with MGC34837.

MGC35338 (Accession NP_689602.1) is another GAM63 target gene, herein designated TARGET GENE. MGC35338 BINDING SITE is a target binding site found in the 3' untranslated region of mRNA encoded by MGC35338, corresponding to a target binding site such as BINDING SITE I, BINDING SITE II or BINDING SITE III of FIG. 8. Table 4 illustrates the complementarity of the nucleotide sequences of MGC35338 BINDING SITE, designated SEQ ID:17534, to the nucleotide sequence of GAM63 RNA, herein designated GAM RNA, also designated SEQ ID:348.

Another function of GAM63 is therefore inhibition of MGC35338 (Accession NP_689602.1). Accordingly, utilities of GAM63 include diagnosis, prevention and treatment of diseases and clinical conditions associated with MGC35338.

MGC39518 (Accession NP_776183.1) is another GAM63 target gene, herein designated TARGET GENE. MGC39518 BINDING SITE is a target binding site found in the 3' untranslated region of mRNA encoded by MGC39518, corresponding to a target binding site such as BINDING SITE I, BINDING SITE II or BINDING SITE III of FIG. 8. Table 4 illustrates the complementarity of the nucleotide sequences of MGC39518 BINDING SITE, designated SEQ ID:7979, to the nucleotide sequence of GAM63 RNA, herein designated GAM RNA, also designated SEQ ID:348.

Another function of GAM63 is therefore inhibition of MGC39518 (Accession NP_776183.1). Accordingly, utilities of GAM63 include diagnosis, prevention and treatment of diseases and clinical conditions associated with MGC39518.

MGC48935 (Accession NP_848631.1) is another GAM63 target gene, herein designated TARGET GENE. MGC48935 BINDING SITE is a target binding site found in the 3' untranslated region of mRNA encoded by MGC48935, corresponding to a target binding site such as BINDING SITE I, BINDING SITE II or BINDING SITE III of FIG. 8. Table 4 illustrates the complementarity of the nucleotide sequences of MGC48935 BINDING SITE, designated SEQ ID:16796, to the nucleotide sequence of GAM63 RNA, herein designated GAM RNA, also designated SEQ ID:348.

Another function of GAM63 is therefore inhibition of MGC48935 (Accession NP_848631.1). Accordingly, utilities of GAM63 include diagnosis, prevention and treatment of diseases and clinical conditions associated with MGC48935.

MGC52019 (Accession NP_848593.1) is another GAM63 target gene, herein designated TARGET GENE. MGC52019 BINDING SITE is a target binding site found in the 5' untranslated region of mRNA encoded by MGC52019, corresponding to a target binding site such as BINDING SITE I, BINDING SITE II or BINDING SITE III of FIG. 8. Table 4 illustrates the complementarity of the nucleotide sequences of MGC52019 BINDING SITE, designated SEQ ID:5201, to the nucleotide sequence of GAM63 RNA, herein designated GAM RNA, also designated SEQ ID:348.

Another function of GAM63 is therefore inhibition of MGC52019 (Accession NP_848593.1). Accordingly, utilities of GAM63 include diagnosis, prevention and treatment of diseases and clinical conditions associated with MGC52019.

MIDORI (Accession NP_065829.1) is another GAM63 target gene, herein designated TARGET GENE. MIDORI BINDING SITE is a target binding site found in the 3' untranslated region of mRNA encoded by MIDORI, corresponding to a target binding site such as BINDING SITE I, BINDING SITE II or BINDING SITE III of FIG. 8. Table 4 illustrates the complementarity of the nucleotide sequences of MIDORI BINDING SITE, designated SEQ ID:8948, to the nucleotide sequence of GAM63 RNA, herein designated GAM RNA, also designated SEQ ID:348.

Another function of GAM63 is therefore inhibition of MIDORI (Accession NP_065829.1). Accordingly, utilities of GAM63 include diagnosis, prevention and treatment of diseases and clinical conditions associated with MIDORI.

Makorin, ring finger protein, 4 (MKRN4, Accession NP_110384.1) is another GAM63 target gene, herein designated TARGET GENE. MKRN4 BINDING SITE is a target binding site found in the 5' untranslated region of mRNA encoded by MKRN4, corresponding to a target binding site such as BINDING SITE I, BINDING SITE II or BINDING SITE III of FIG. 8. Table 4 illustrates the complementarity of the nucleotide sequences of MKRN4 BINDING SITE, designated SEQ ID:6983, to the nucleotide sequence of GAM63 RNA, herein designated GAM RNA, also designated SEQ ID:348.

Another function of GAM63 is therefore inhibition of Makorin, ring finger protein, 4 (MKRN4, Accession NP_110384.1). Accordingly, utilities of GAM63 include diagnosis, prevention and treatment of diseases and clinical conditions associated with MKRN4.

Membrane metallo-endopeptidase (neutral endopeptidase, enkephalinase, calla, cd10) (MME, Accession NP_009218.1) is another GAM63 target gene, herein designated TARGET GENE. MME BINDING SITE is a target binding site found in the 5' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:9503, to the nucleotide sequence of GAM63 RNA, herein designated GAM RNA, also designated SEQ ID:348.

Another function of GAM63 is therefore inhibition of Membrane metallo-endopeptidase (neutral endopeptidase, enkephalinase, calla, cd10) (MME, Accession NP__009218.1), a gene which is thermolysin-like specificity. and therefore is associated with Acute lymphocytic leukemia. Accordingly, utilities of GAM63 include diagnosis, prevention and treatment of Acute lymphocytic leukemia, and of other diseases and clinical conditions associated with MME.

The function of MME has been established by previous studies. Common acute lymphocytic leukemia antigen is an important cell surface marker in the diagnosis of human acute lymphocytic leukemia (ALL). It is present on leukemic cells of pre-B phenotype, which represent 85% of cases of ALL. CALLA is not restricted to leukemic cells, however, and is found on a variety of normal tissues. CALLA is a glycoprotein that is particularly abundant in kidney, where it is present on the brush border of proximal tubules and on glomerular epithelium. Letarte et al. (1988) cloned a cDNA coding for CALLA and showed that the amino acid sequence deduced from the cDNA sequence is identical to that of human membrane-associated neutral endopeptidase (NEP; EC 3.4.24.11), also known as enkephalinase. NEP cleaves peptides at the amino side of hydrophobic residues and inactivates several peptide hormones including glucagon, enkephalins, substance P, neurotensin, oxytocin, and bradykinin. By cDNA transfection analysis, Shipp et al. (1989) confirmed that CALLA is a functional neutral endopeptidase of the type that has previously been called enkephalinase. Barker et al. (1989) demonstrated that the CALLA gene, which encodes a 100-kD type II transmembrane glycoprotein, exists in a single copy of greater than 45 kb which is not rearranged in malignancies expressing cell surface CALLA. D'Adamio et al. (1989) demonstrated that the CALLA gene spans more than 80 kb and is composed of 24 exons.

Animal model experiments lend further support to the function of MME. Amyloid- beta peptide (OMIM Ref. No. 104760), the pathogenic agent of Alzheimer disease (OMIM Ref. No. 104300), is a physiologic metabolite in the brain. Iwata et al. (2001) examined the role of neprilysin, a candidate amyloid-beta degrading peptidase, in the metabolism using neprilysin gene-disrupted mice. Neprilysin deficiency resulted in defects both in the degradation of exogenously administered amyloid-beta and in the metabolic suppression of the endogenous amyloid-beta levels in a gene dose- dependent manner. The regional levels of amyloid-beta in the neprilysin-deficient mouse brain were in the distinct order of hippocampus, cortex, thalamus/striatum, and cerebellum, where hippocampus has the highest level and cerebellum the lowest, correlating with the vulnerability to amyloid-beta deposition in brains of humans with Alzheimer disease. Iwata et al. (2001) concluded that even partial downregulation of neprilysin activity, which could be caused by aging, can contribute to Alzheimer disease by promoting amyloid-beta accumulation.

It is appreciated that the abovementioned animal model for MME is acknowledged by those skilled in the art as a scientifically valid animal model, as can be further appreciated from the publications sited hereinbelow.

Full details of the abovementioned studies are described in the following publications, the disclosure of which are hereby incorporated by reference:

Iwata, N.; Tsubuki, S.; Takaki, Y.; Shirotani, K.; Lu, B.; Gerard, N. P.; Gerard, C.; Hama, E.; Lee, H.-J.; Saido, T. C.: Metabolic regulation of brain A-beta by neprilysin. Science 292:1550-1552, 2001; and Letarte, M.; Vera, S.; Tran, R.; Addis, J. B. L.; Onizuka, R. J.; Quackenbush, E. J.; Jongeneel, C. V.; McInnes, R. R.: Common acute lymphocytic leukemia antigen is identical to neutr.

Further studies establishing the function and utilities of MME are found in John Hopkins OMIM database record ID 120520, and in cited publications listed in Table 5, which are hereby incorporated by reference. Matrix metalloproteinase 28 (MMP28, Accession NP__116568.1) is another GAM63 target gene, herein designated TARGET GENE. MMP28 BINDING SITE is a target binding site found in the 3' untranslated region of multiple transcripts of mRNA encoded by MMP28, corresponding to a target binding site such as BINDING SITE I, BINDING SITE II or BINDING SITE III of FIG. 8. Table 4 illustrates the complementarity of the nucleotide sequences of MMP28 BINDING SITE, designated SEQ ID:13641, to the nucleotide sequence of GAM63 RNA, herein designated GAM RNA, also designated SEQ ID:348.

Another function of GAM63 is therefore inhibition of Matrix metalloproteinase 28 (MMP28, Accession NP__116568.1). Accordingly, utilities of GAM63 include diagnosis, prevention and treatment of diseases and clinical conditions associated with MMP28.

Mitochondrial ribosomal protein s27 (MRPS27, Accession NP_055899.1) is another GAM63 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:7135, to the nucleotide sequence of GAM63 RNA, herein designated GAM RNA, also designated SEQ ID:348.

Another function of GAM63 is therefore inhibition of Mitochondrial ribosomal protein s27 (MRPS27, Accession NP__055899.1). Accordingly, utilities of GAM63 include diagnosis, prevention and treatment of diseases and clinical conditions associated with MRPS27.

Membrane-spanning 4-domains, subfamily a, member 2 (fc fragment of ige, high affinity i, receptor for; beta polypeptide) (MS4A2, Accession NP__000130.1) is another GAM63 target gene, herein designated TARGET GENE. MS4A2 BINDING SITE is a target binding site found in the 3' untranslated region of mRNA encoded by MS4A2, corresponding to a target binding site such as BINDING SITE I, BINDING SITE II or BINDING SITE III of FIG. 8. Table 4 illustrates the complementarity of the nucleotide sequences of MS4A2 BINDING SITE, designated SEQ ID:18155, to the nucleotide sequence of GAM63 RNA, herein designated GAM RNA, also designated SEQ ID:348.

Another function of GAM63 is therefore inhibition of Membrane-spanning 4-domains, subfamily a, member 2 (fc fragment of ige, high affinity i, receptor for; beta polypeptide) (MS4A2, Accession NP__000130.1), a gene which binds to the fc region of immunoglobulins epsilon. and therefore may be associated with Atopic asthma, atopic dermatitis. Accordingly, utilities of GAM63 include diagnosis, prevention and treatment of Atopic asthma, atopic dermatitis, and of other diseases and clinical conditions associated with MS4A2.

The function of MS4A2 has been established by previous studies. Shirakawa et al. (1994) reported a significant association between atopy and substitution of a leucine for an isoleucine at position 181 of the FCER1B gene product. Hizawa et al. (1995) failed to find this leu181- to - ile substitution. Folster-Holst et al. (1998) presented evidence from linkage studies in 12 families with atopic dermatitis for linkage in close proximity to the marker D11S903. The method of analysis suggested an oligogenic mode of inheritance as well as heterogeneity in the genetic susceptibility to atopy and atopic dermatitis; only 2 of 12 families showed evidence for linkage using the oligogenic model.

Full details of the abovementioned studies are described in the following publications, the disclosure of which are hereby incorporated by reference:

Folster-Holst, R.; Moises, H. W.; Yang, L.; Fritsch, W.; Weissenbach, J.; Christophers, E.: Linkage between atopy and the IgE high-affinity receptor gene at 11q13 in atopic dermatitis families. Hum. Genet. 102:236- 239, 1998; and Shirakawa, T.; Li, A.; Dubowitz, M.; Dekker, J. W.; Shaw, A. E.; Faux, J. A.; Ra, C.; Cookson, W. O. C. M.; Hopkin, J. M.: Association between atopy and variants of the beta subunit of.

Further studies establishing the function and utilities of MS4A2 are found in John Hopkins OMIM database record ID 147138, and in cited publications listed in Table 5, which are hereby incorporated by reference. Myotubularin related protein 9 (MTMR9, Accession NP_056273.2) is another GAM63 target gene, herein designated TARGET GENE. MTMR9 BINDING SITE is a target binding site found in the 3' untranslated region of mRNA encoded by MTMR9, corresponding to a target binding site such as BINDING SITE I, BINDING SITE II or BINDING SITE III of FIG. 8. Table 4 illustrates the complementarity of the nucleotide sequences of MTMR9 BINDING SITE, designated SEQ ID:10289, to the nucleotide sequence of GAM63 RNA, herein designated GAM RNA, also designated SEQ ID:348.

Another function of GAM63 is therefore inhibition of Myotubularin related protein 9 (MTMR9, Accession NP_056273.2). Accordingly, utilities of GAM63 include diagnosis, prevention and treatment of diseases and clinical conditions associated with MTMR9.

Mucin 3b (MUC3B, Accession XP_168578.2) is another GAM63 target gene, herein designated TARGET GENE. MUC3B BINDING SITE is a target binding site found in the 3' untranslated region of mRNA encoded by MUC3B, corresponding to a target binding site such as BINDING SITE I, BINDING SITE II or BINDING SITE III of FIG. 8. Table 4 illustrates the complementarity of the nucleotide sequences of MUC3B BINDING SITE, designated SEQ ID:12658, to the nucleotide sequence of GAM63 RNA, herein designated GAM RNA, also designated SEQ ID:348.

Another function of GAM63 is therefore inhibition of Mucin 3b (MUC3B, Accession XP_168578.2), a gene which provides a protective, lubricating barrier against particles and infectious agents at mucosal surfaces. Accordingly, utilities of GAM63 include diagnosis, prevention and treatment of diseases and clinical conditions associated with MUC3B.

The function of MUC3B has been established by previous studies. The MUC3A gene (OMIM Ref. No. 158371), originally designated MUC3, encodes a transmembrane mucin-type glycoprotein. A number of consistent single nucleotide changes were observed in different MUC3 cDNAs from a single individual, suggesting the presence of at least 3 different transcripts. Pratt et al. (2000) presented evidence that this transcript heterogeneity is due to the existence of allelic changes and to tandem duplication of the MUC3 gene. Pratt et al. (2000) determined that the second gene, which they designated MUC3B, has the same C-terminal domain and intron-exon structure as that previously described for MUC3. The tandem repeat domain has the same amino acid consensus sequence but shows more substitutions. RT-PCR detected expression of MUC3B in fetal and adult small intestine, fetal and adult colon, and Caco-2 cells. Kyo et al. (2001) also determined that 'MUC3' consists of 2 genes, MUC3A and MUC3B, both of which encode membrane-bound mucins with 2 epidermal growth factor-like motifs and a putative transmembrane region. Fox et al. (1992) mapped the MUC3 gene (now MUC3A and MUC3B) to chromosome 7q22 by in situ hybridization.

Full details of the abovementioned studies are described in the following publications, the disclosure of which are hereby incorporated by reference:

Fox, M. F.; Lahbib, F.; Pratt, W.; Attwood, J.; Gum, J.; Kim, Y.; Swallow, D. M.: Regional localization of the intestinal mucin gene MUC3 to chromosome 7q22. Ann. Hum. Genet. 56:281-287, 1992; and Ky, K.; Muto, T.; Nagawa, H.; Lathrop, G. M.; Nakamura, Y.: Associations of distinct variants of the intestinal mucin gene MUC3A with ulcerative colitis and Crohn's disease. J. Hum. G.

Further studies establishing the function and utilities of MUC3B are found in John Hopkins OMIM database record ID 605633, and in cited publications listed in Table 5, which are hereby incorporated by reference. MYLC2PL (Accession NP_612412.1) is another GAM63 target gene, herein designated TARGET GENE. MYLC2PL BINDING SITE is a target binding site found in the 5' untranslated region of mRNA encoded by MYLC2PL, corresponding to a target binding site such as BINDING SITE I, BINDING SITE II or BINDING SITE III of FIG. 8. Table 4 illustrates the complementarity of the nucleotide sequences of MYLC2PL BINDING SITE, designated SEQ ID:17797, to the nucleotide sequence of GAM63 RNA, herein designated GAM RNA, also designated SEQ ID:348.

Another function of GAM63 is therefore inhibition of MYLC2PL (Accession NP_612412.1). Accordingly, utilities of GAM63 include diagnosis, prevention and treatment of diseases and clinical conditions associated with MYLC2PL.

Nima (never in mitosis gene a)-related kinase 6 (NEK6, Accession NP_055212.2) is another GAM63 target gene, herein designated TARGET GENE. NEK6 BINDING SITE is a target binding site found in the 3' untranslated region of mRNA encoded by NEK6, corresponding to a target binding site such as BINDING SITE I, BINDING SITE II or BINDING SITE III of FIG. 8. Table 4 illustrates the complementarity of the nucleotide sequences of NEK6 BINDING SITE, designated SEQ ID:13237, to the nucleotide sequence of GAM63 RNA, herein designated GAM RNA, also designated SEQ ID:348.

Another function of GAM63 is therefore inhibition of Nima (never in mitosis gene a)-related kinase 6 (NEK6, Accession NP_055212.2), a gene which regulates nuclear and cytoplasmic aspects of the mitotic cycle. Accordingly, utilities of GAM63 include diagnosis, prevention and treatment of diseases and clinical conditions associated with NEK6.

The function of NEK6 and its association with various diseases and clinical conditions, has been established by previous studies, as described hereinabove with reference to GAM44.1. Nuclear factor of kappa light polypeptide gene enhancer in b-cells inhibitor, epsilon (NFKBIE, Accession NP_004547.1) is another GAM63 target gene, herein designated TARGET GENE. NFKBIE BINDING SITE is a target binding site found in the 3' untranslated region of mRNA encoded by NFKBIE, corresponding to a target binding site such as BINDING SITE I, BINDING SITE II or BINDING SITE III of FIG. 8. Table 4 illustrates the complementarity of the nucleotide sequences of NFKBIE BINDING SITE, designated SEQ ID:16403, to the nucleotide sequence of GAM63 RNA, herein designated GAM RNA, also designated SEQ ID:348.

Another function of GAM63 is therefore inhibition of Nuclear factor of kappa light polypeptide gene enhancer in b-cells inhibitor, epsilon (NFKBIE, Accession NP_004547.1). Accordingly, utilities of GAM63 include diagnosis, prevention and treatment of diseases and clinical conditions associated with NFKBIE.

NIN283 (Accession NP_115644.1) is another GAM63 target gene, herein designated TARGET GENE. NIN283 BINDING SITE is a target binding site found in the 3' untranslated region of mRNA encoded by NIN283, corresponding to a target binding site such as BINDING SITE I, BINDING SITE II or BINDING SITE III of FIG. 8. Table 4 illustrates the complementarity of the nucleotide sequences of NIN283 BINDING SITE, designated SEQ ID:2207, to the nucleotide sequence of GAM63 RNA, herein designated GAM RNA, also designated SEQ ID:348.

Another function of GAM63 is therefore inhibition of NIN283 (Accession NP_115644.1). Accordingly, utilities of GAM63 include diagnosis, prevention and treatment of diseases and clinical conditions associated with NIN283.

Neuronatin (NNAT, Accession NP_005377.1) is another GAM63 target gene, herein designated TARGET GENE. NNAT BINDING SITE is a target binding site found in the 3' untranslated region of mRNA encoded by NNAT, corresponding to a target binding site such as BINDING SITE I, BINDING SITE II or BINDING SITE III of FIG. 8. Table 4 illustrates the complementarity of the nucleotide sequences of NNAT BINDING SITE, designated SEQ ID:9458, to the nucleotide sequence of GAM63 RNA, herein designated GAM RNA, also designated SEQ ID:348.

Another function of GAM63 is therefore inhibition of Neuronatin (NNAT, Accession NP_005377.1). Accordingly, utilities of GAM63 include diagnosis, prevention and treatment of diseases and clinical conditions associated with NNAT.

Nuclear receptor subfamily 3, group c, member 1 (glucocorticoid receptor) (NR3C1, Accession NP_000167.1) is another GAM63 target gene, herein designated TARGET GENE. NR3C1 BINDING SITE is a target binding site found in the 3' untranslated region of mRNA encoded by NR3C1, corresponding to a target binding site such as BINDING SITE I, BINDING SITE II or BINDING SITE III of FIG. 8. Table 4 illustrates the complementarity of the nucleotide sequences of NR3C1 BINDING SITE, designated SEQ ID:10686, to the nucleotide sequence of GAM63 RNA, herein designated GAM RNA, also designated SEQ ID:348.

Another function of GAM63 is therefore inhibition of Nuclear receptor subfamily 3, group c, member 1 (glucocorticoid receptor) (NR3C1, Accession NP_000167.1). Accordingly, utilities of GAM63 include diagnosis, prevention and treatment of diseases and clinical conditions associated with NR3C1.

Neurexin 1 (NRXN1, Accession NP_620072.1) is another GAM63 target gene, herein designated TARGET GENE. NRXN1 BINDING SITE is a target binding site found in the 5' untranslated region of multiple transcripts of mRNA encoded by NRXN1, corresponding to a target binding site such as BINDING SITE I, BINDING SITE II or BINDING SITE III of FIG. 8. Table 4 illustrates the complementarity of the nucleotide sequences of NRXN1 BINDING SITE, designated SEQ ID:8566, to the nucleotide sequence of GAM63 RNA, herein designated GAM RNA, also designated SEQ ID:348.

Another function of GAM63 is therefore inhibition of Neurexin 1 (NRXN1, Accession NP_620072.1), a gene which may be involved in cell recognition, cell adhesion, and mediate intracellular signaling. Accordingly, utilities of GAM63 include diagnosis, prevention and treatment of diseases and clinical conditions associated with NRXN1.

The function of NRXN1 has been established by previous studies. Neurexins are polymorphic cell surface proteins that are expressed in neurons. They were discovered by Ushkaryov et al. (1992) in the course of cloning the presynaptic receptor for alpha-latrotoxin. Three neurexin genes, designated 1 (NRXN1), 2 (NRXN2; 600566), and 3 (NRXN3; 600567), were identified in a rat brain cDNA library by Ushkaryov et al. (1992). Ichtchenko et al. (1995) observed that each neurexin gene has 2 independent promoters which generate 2 classes of mRNAs: the longer mRNAs encode alpha-neurexins and the shorter mRNAs encode beta-neurexins. Thus, 6 principal neurexin isoforms, called neurexins I-alpha to III-beta, result, of which neurexin I-alpha corresponds to the high molecular weight component of the alpha-latrotoxin receptor. Ushkaryov et al. (1992) showed that rat neurexins are expressed at significant levels only in brain. Ullrich et al. (1995) found that the 6 rat neurexin isoforms are coexpressed in neurons and are distributed differentially in various brain regions. Neurexins display a remarkable evolutionarily conserved pattern of extensive alternative splicing. As a result, the total number of neurexins in brain probably exceeds 2,000 (Ullrich et al., 1995). Neurexins contain epidermal growth factor-like sequences and domains homologous to the G domain repeats of laminin A (LAMA; 150320), indicating a function in cell-cell interactions.

Animal model experiments lend further support to the function of NRXN1. Alpha-latrotoxin is a potent neurotoxin from black widow spider venom that binds to presynaptic receptors and causes massive neurotransmitter release. In rat, 2 alpha-latrotoxin receptors have been identified: neurexin I-alpha, which binds the toxin in a calcium-dependent manner, and CIRL/latrophilin, which binds in a calcium- independent manner. Geppert et al. (1998) isolated the mouse neurexin I-alpha gene and found that it contains a large first exon of more than 1.5 kb that extends to the first site of alternative splicing in the coding region. To evaluate the importance of neurexin I-alpha in alpha-latrotoxin action, Geppert et al. (1998) generated mice carrying a deletion of the first exon of the neurexin I-alpha gene. Homozygous mutant mice lacked neurexin I-alpha, although the levels of neurexin I-beta were unaffected. The mutant mice were viable and fertile, and were indistinguishable in appearance from wild-type animals. The only abnormality observed was that female knockout mice were less able to attend to litters, leading to the death of more pups independent of pup genotype. Geppert et al. (1998) found that alpha-latrotoxin binding to brain membranes from mutant mice was decreased by almost 50% compared with wildtype membranes. In cultured hippocampal neurons from mutant mice, the toxin was still capable of activating neurotransmission. However, measurements of glutamate release from synaptosomes indicated a major decrease in the amount of release triggered by alpha-latrotoxin in the presence of calcium. The authors concluded that neurexin I-alpha is not essential for alpha-latrotoxin action but contributes to toxin action when calcium is present. They suggested that the action of alpha-latrotoxin may be mediated by independent parallel pathways.

It is appreciated that the abovementioned animal model for NRXN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Geppert, M.; Khvotchev, M.; Krasnoperov, V.; Goda, Y.; Missler, M.; Hammer, R. E.; Ichtchenko, K.; Petrenko, A. G.; Sudhof, T. C.: Neurexin I-alpha is a major alpha- latrotoxin receptor that cooperates in alpha-latrotoxin action. J. Biol. Chem. 273:1705-1710, 1998; and Ushkaryov, Y. A.; Petrenko, A. G.; Geppert, M.; Sudhof, T. C.: Neurexins: synaptic cell surface proteins related to the alpha-latrotoxin receptor and laminin. Science 257:50-56, 199.

Further studies establishing the function and utilities of NRXN1 are found in John Hopkins OMIM database record ID 600565, and in cited publications listed in Table 5, which are hereby incorporated by reference. NSE2 (Accession NP_777571.1) is another GAM63 target gene, herein designated TARGET GENE. NSE2 BINDING SITE is a target binding site found in the 3' untranslated region of mRNA encoded by NSE2, corresponding to a target binding site such as BINDING SITE I, BINDING SITE II or BINDING SITE III of FIG. 8. Table 4 illustrates the complementarity of the nucleotide sequences of NSE2 BINDING SITE, designated SEQ ID:5906, to the nucleotide sequence of GAM63 RNA, herein designated GAM RNA, also designated SEQ ID:348.

Another function of GAM63 is therefore inhibition of NSE2 (Accession NP_777571.1). Accordingly, utilities of GAM63 include diagnosis, prevention and treatment of diseases and clinical conditions associated with NSE2.

Netrin 4 (NTN4, Accession NP_067052.1) is another GAM63 target gene, herein designated TARGET GENE. NTN4 BINDING SITE is a target binding site found in the 3' untranslated region of mRNA encoded by NTN4, corresponding to a target binding site such as BINDING SITE I, BINDING SITE II or BINDING SITE III of FIG. 8. Table 4 illustrates the complementarity of the nucleotide sequences of NTN4 BINDING SITE, designated SEQ ID:14085, to the nucleotide sequence of GAM63 RNA, herein designated GAM RNA, also designated SEQ ID:348.

Another function of GAM63 is therefore inhibition of Netrin 4 (NTN4, Accession NP_067052.1). Accordingly, utilities of GAM63 include diagnosis, prevention and treatment of diseases and clinical conditions associated with NTN4.

Nucleoporin 54 kda (NUP54, Accession NP_059122.2) is another GAM63 target gene, herein designated TARGET GENE. NUP54 BINDING SITE is a target binding site found in the 3' untranslated region of mRNA encoded by NUP54, corresponding to a target binding site such as BINDING SITE I, BINDING SITE II or BINDING SITE III of FIG. 8. Table 4 illustrates the complementarity of the nucleotide sequences of NUP54 BINDING SITE, designated SEQ ID:6251, to the nucleotide sequence of GAM63 RNA, herein designated GAM RNA, also designated SEQ ID:348.

Another function of GAM63 is therefore inhibition of Nucleoporin 54 kda (NUP54, Accession NP_059122.2). Accordingly, utilities of GAM63 include diagnosis, prevention and treatment of diseases and clinical conditions associated with NUP54.

2'-5'-oligoadenylate synthetase 3, 100 kda (OAS3, Accession NP_006178.1) is another GAM63 target gene, herein designated TARGET GENE. OAS3 BINDING SITE is a target binding site found in the 3' untranslated region of mRNA encoded by OAS3, corresponding to a target binding site such as BINDING SITE I, BINDING SITE II or BINDING SITE III of FIG. 8. Table 4 illustrates the complementarity of the nucleotide sequences of OAS3 BINDING SITE, designated SEQ ID:6803, to the nucleotide sequence of GAM63 RNA, herein designated GAM RNA, also designated SEQ ID:348.

Another function of GAM63 is therefore inhibition of 2'-5'-oligoadenylate synthetase 3, 100 kda (OAS3, Accession NP_006178.1), a gene which may play a role in mediating resistance to virus infection, control of cell growth, differentiation, and apoptosis. Accordingly, utilities of GAM63 include diagnosis, prevention and treatment of diseases and clinical conditions associated with OAS3.

The function of OAS3 has been established by previous studies. The 2-prime, 5-prime oligoadenylate synthetases (OASs) are interferon-induced proteins characterized by their capacity to catalyze the synthesis of 2-prime, 5-prime oligomers of adenosine (2-5As). See OAS1 (OMIM Ref. No. 164350). Hovanessian et al. (1987) found that interferon-treated human cells contain several OASs corresponding to proteins of 40 (OAS1), 46 (OAS1), 69 (OAS2; 603350), and 100 kD. Hovnanian et al. (1998) reported that the predicted OAS3, or p100, protein contains 3 adjacent OAS1-like domains. The domains share 44 to 60% protein sequence similarity with each other and 42 to 60% sequence identity with the conserved domain of OAS1. The authors noted that OAS1, OAS2, and OAS3 contain 1, 2, and 3 conserved OAS domains or units, respectively. Northern blot analysis revealed that OAS3 is expressed as a 7-kb interferon-induced mRNA in HeLa cells. By fluorescence in situ hybridization and by inclusion within mapped clones, Hovnanian et al. (1998) determined that the OAS1, OAS2, and OAS3 genes are clustered with a 130-kb region on 12q24.2.

Full details of the abovementioned studies are described in the following publications, the disclosure of which are hereby incorporated by reference:

Hovanessian, A. G.; Laurent, A. G.; Chebath, J.; Galabru, J.; Robert, N.; Svab, J. : Identification of 69-kd and 100-kd forms of 2-5A synthetase in interferon-treated human cells by specific monoclonal antibodies. EMBO J. 6:1273-1280, 1987; and Hovnanian, A.; Rebouillat, D.; Mattei, M.-G.; Levy, E. R.; Marie, I.; Monaco, A. P.; Hovanessian, A. G.: The human 2-prime, 5-prime-oligoadenylate synthetase locus is composed of three.

Further studies establishing the function and utilities of OAS3 are found in John Hopkins OMIM database record ID 603351, and in cited publications listed in Table 5, which are hereby incorporated by reference.8-oxoguanine dna glycosylase (OGG1, Accession NP_058212.1) is another GAM63 target gene, herein designated TARGET GENE. OGG1 BINDING SITE is a target binding site found in the 3' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:19616, to the nucleotide sequence of GAM63 RNA, herein designated GAM RNA, also designated SEQ ID:348.

Another function of GAM63 is therefore inhibition of 8-oxoguanine dna glycosylase (OGG1, Accession NP_058212.1), a gene which is involved in base excision DNA repair and removal of 8-oxyguanine and therefore may be associated with Tumorigenesis. Accordingly, utilities of GAM63 include diagnosis, prevention and treatment of Tumorigenesis, and of other diseases and clinical conditions associated with OGG1.

The function of OGG1 has been established by previous studies. The major mutagenic base lesion in DNA caused by exposure to reactive oxygen species is 8-oxoguanine. This damaged base is excised by a DNA glycosylase with an associated lyase activity for chain cleavage. Lu et al. (1997), Aburatani et al. (1997), Bjoras et al. (1997), Rosenquist et al. (1997), Radicella et al. (1997), and Roldan-Arjona et al. (1997) cloned human cDNAs with partial sequence homology to the yeast 8-oxoguanine DNA glycosylase (OGG1) gene. Radicella et al. (1997) found that the predicted protein has 345 amino acids and a calculated molecular mass of 39 kD. Roldan-Arjona et al. (1997), who called the enzyme 8-hydroxyguanine DNA glycosylase, estimated their 424-amino acid predicted human enzyme to have a size of 47 kD. They showed that it releases free 8-hydroxyguanine from oxidized DNA and introduces a chain break in a double-stranded oligonucleotide specifically at an 8-hydroxyguanine residue base-paired with cytosine. Expression of the human protein in a DNA repair-deficient E. coli strain partly suppressed its spontaneous mutator phenotype. Radicella et al. (1997) showed that when the human coding sequence was expressed in a yeast strain mutant in Ogg1, it was able to complement the spontaneous mutator phenotype. Arai et al. (1997) also cloned the human OGG1 gene and, by Northern blotting, showed that the gene is ubiquitously expressed in a variety of human organs. By fluorescence in situ hybridization, Roldan-Arjona et al. (1997) and Radicella et al. (1997) mapped the human OGG1 gene to 3p25 (3p25.3-p25.2). By the same method, Arai et al. (1997) mapped the OGG1 gene to 3p26.2. By radiation hybrid analysis, Ishida et al. (1999) mapped the gene to 3p26, proximal to the VHL gene (OMIM Ref. No. 193300).

Full details of the abovementioned studies are described in the following publications, the disclosure of which are hereby incorporated by reference:

Radicella, J. P.; Dherin, C.; Desmaze, C.; Fox, M. S.; Boiteux, S.: Cloning and characterization of hOGG1, a human homolog of the OGG1 gene of Saccharomyces cerevisiae. Proc. Nat. Acad. Sci. 94:8010-8015, 1997; and Roldan-Arjona, T.; Wei, Y.-F.; Carter, K. C.; Klungland, A.; Anselmino, C.; Wang, R.-P.; Augustus, M.; Lindahl, T.: Molecular cloning and functional expression of a human cDNA encodin.

Further studies establishing the function and utilities of OGG1 are found in John Hopkins OMIM database record ID 601982, and in cited publications listed in Table 5, which are hereby incorporated by reference.8-oxoguanine dna glycosylase (OGG1, Accession NP_002533.1) is another GAM63 target gene, herein designated TARGET GENE. OGG1 BINDING SITE is a target binding site found in the 3' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:19616, to the nucleotide sequence of GAM63 RNA, herein designated GAM RNA, also designated SEQ ID:348.

Another function of GAM63 is therefore inhibition of 8-oxoguanine dna glycosylase (OGG1, Accession NP_002533.1), a gene which is involved in base excision DNA repair and removal of 8-oxyguanine and therefore may be associated with Tumorigenesis. Accordingly, utilities of GAM63 include diagnosis, prevention and treatment of Tumorigenesis, and of other diseases and clinical conditions associated with OGG1.

The function of OGG1 has been established by previous studies. The major mutagenic base lesion in DNA caused by exposure to reactive oxygen species is 8-oxoguanine. This damaged base is excised by a DNA glycosylase with an associated lyase activity for chain cleavage. Lu et al. (1997), Aburatani et al. (1997), Bjoras et al. (1997), Rosenquist et al. (1997), Radicella et al. (1997), and Roldan-Arjona et al. (1997) cloned human cDNAs with partial sequence homology to the yeast 8-oxoguanine DNA glycosylase (OGG1) gene. Radicella et al. (1997) found that the predicted protein has 345 amino acids and a calculated molecular mass of 39 kD. Roldan-Arjona et al. (1997), who called the enzyme 8-hydroxyguanine DNA glycosylase, estimated their 424-amino acid predicted human enzyme to have a size of 47 kD. They showed that it releases free 8-hydroxyguanine from oxidized DNA and introduces a chain break in a double-stranded oligonucleotide specifically at an 8-hydroxyguanine residue base-paired with cytosine. Expression of the human protein in a DNA repair-deficient E. coli strain partly suppressed its spontaneous mutator phenotype. Radicella et al. (1997) showed that when the human coding sequence was expressed in a yeast strain mutant in Ogg1, it was able to complement the spontaneous mutator phenotype. Arai et al. (1997) also cloned the human OGG1 gene and, by Northern blotting, showed that the gene is ubiquitously expressed in a variety of human organs. By fluorescence in situ hybridization, Roldan-Arjona et al. (1997) and Radicella et al. (1997) mapped the human OGG1 gene to 3p25 (3p25.3-p25.2). By the same method, Arai et al. (1997) mapped the OGG1 gene to 3p26.2. By radiation hybrid analysis, Ishida et al. (1999) mapped the gene to 3p26, proximal to the VHL gene (OMIM Ref. No. 193300).

Full details of the abovementioned studies are described in the following publications, the disclosure of which are hereby incorporated by reference:

Radicella, J. P.; Dherin, C.; Desmaze, C.; Fox, M. S.; Boiteux, S.: Cloning and characterization of hOGG1, a human homolog of the OGG1 gene of Saccharomyces cerevisiae. Proc. Nat. Acad. Sci. 94:8010-8015, 1997; and Roldan-Arjona, T.; Wei, Y.-F.; Carter, K. C.; Klungland, A.; Anselmino, C.; Wang, R.-P.; Augustus, M.; Lindahl, T.: Molecular cloning and functional expression of a human cDNA encodin.

Further studies establishing the function and utilities of OGG1 are found in John Hopkins OMIM database record ID 601982, and in cited publications listed in Table 5, which are hereby incorporated by reference. Optic atrophy 3 (autosomal recessive, with chorea and spastic paraplegia) (OPA3, Accession NP_079412.1) is another GAM63 target gene, herein designated TARGET GENE. OPA3 BINDING SITE is a target binding site found in the 3' untranslated region of mRNA encoded by OPA3, corresponding to a target binding site such as BINDING SITE I, BINDING SITE II or BINDING SITE III of FIG. 8. Table 4 illustrates the complementarity of the nucleotide sequences of OPA3 BINDING SITE, designated SEQ ID:16306, to the nucleotide sequence of GAM63 RNA, herein designated GAM RNA, also designated SEQ ID:348.

Another function of GAM63 is therefore inhibition of Optic atrophy 3 (autosomal recessive, with chorea and spastic paraplegia) (OPA3, Accession NP_079412.1). Accordingly, utilities of GAM63 include diagnosis, prevention and treatment of diseases and clinical conditions associated with OPA3.

Opticin (OPTC, Accession NP_055174.1) is another GAM63 target gene, herein designated TARGET GENE. OPTC BINDING SITE is a target binding site found in the 5' untranslated region of mRNA encoded by OPTC, corresponding to a target binding site such as BINDING SITE I, BINDING SITE II or BINDING SITE III of FIG. 8. Table 4 illustrates the complementarity of the nucleotide sequences of OPTC BINDING SITE, designated SEQ ID:3539, to the nucleotide sequence of GAM63 RNA, herein designated GAM RNA, also designated SEQ ID:348.

Another function of GAM63 is therefore inhibition of Opticin (OPTC, Accession NP_055174.1). Accordingly, utilities of GAM63 include diagnosis, prevention and treatment of diseases and clinical conditions associated with OPTC.

Oxysterol binding protein-like 7 (OSBPL7, Accession NP_060201.3) is another GAM63 target gene, herein designated TARGET GENE. OSBPL7 BINDING SITE is a target binding site found in the 3' untranslated region of multiple transcripts of mRNA encoded by OSBPL7, corresponding to a target binding site such as BINDING SITE I, BINDING SITE II or BINDING SITE III of FIG. 8. Table 4 illustrates the complementarity of the nucleotide sequences of OSBPL7 BINDING SITE, designated SEQ ID:16404, to the nucleotide sequence of GAM63 RNA, herein designated GAM RNA, also designated SEQ ID:348.

Another function of GAM63 is therefore inhibition of Oxysterol binding protein-like 7 (OSBPL7, Accession NP_060201.3). Accordingly, utilities of GAM63 include diagnosis, prevention and treatment of diseases and clinical conditions associated with OSBPL7.

p100 (Accession NP_055205.1) is another GAM63 target gene, herein designated TARGET GENE. p100 BINDING SITE is a target binding site found in the 3' untranslated region of mRNA encoded by p100, corresponding to a target binding site such as BINDING SITE I, BINDING SITE II or BINDING SITE III of FIG. 8. Table 4 illustrates the complementarity of the nucleotide sequences of p100 BINDING SITE, designated SEQ ID:16615, to the nucleotide sequence of GAM63 RNA, herein designated GAM RNA, also designated SEQ ID:348.

Another function of GAM63 is therefore inhibition of p100 (Accession NP_055205.1), a gene which coactivates gene expression regulated by the Epstein-Barr virus nuclear antigen 2. Accordingly, utilities of GAM63 include diagnosis, prevention and treatment of diseases and clinical conditions associated with p100.

The function of p100 has been established by previous studies. Epstein-Barr virus (EBV) nuclear antigen-2 (EBNA2) activates transcription of specific genes and is essential for EBV-mediated B-lymphocyte transformation. Tong et al. (1995) showed that EBNA2 binds to the nuclear protein p100 and that p100 coactivates gene expression mediated by the EBNA2 acidic domain. Using affinity cloning, Tong et al. (1995) cloned the human p100 gene and showed that it encodes an 885-amino acid polypeptide that contains 2 potential nuclear localization signals. By Northern blotting, p100 appeared to be ubiquitously expressed. The p100 protein also binds both the p56 and p34 subunits of transcription factor IIE (OMIM Ref. No. 189962). Callebaut and Mornon (1997) identified a novel domain within the p100 sequence that they named the 'tudor domain' because it is present in multiple copies in the Drosophila 'tudor' protein. By somatic cell hybrid analysis and FISH, Lienard et al. (2000) mapped the SND1 gene to human chromosome 7q31.3 and rat chromosome 4q23.

Full details of the abovementioned studies are described in the following publications, the disclosure of which are hereby incorporated by reference:

Tong, X.; Drapkin, R.; Yalamanchili, R.; Mosialos, G.; Kieff, E.: The Epstein-Barr virus nuclear protein 2 acidic domain forms a complex with a novel cellular coactivator that can interact with TFIIE. Molec. Cell. Biol. 15:4735-4744, 1995; and Callebaut, I.; Mornon, J. P.: The human EBNA-2 coactivator p100: multidomain organization and relationship to the staphylococcal nuclease fold and to the tudor protein involved in Dros.

Further studies establishing the function and utilities of p100 are found in John Hopkins OMIM database record ID 602181, and in cited publications listed in Table 5, which are hereby incorporated by reference. P114-RHO-GEF (Accession NP_056133.1) is another GAM63 target gene, herein designated TARGET GENE. P114-RHO-GEF BINDING SITE is a target binding site found in the 3' untranslated region of mRNA encoded by P114-RHO-GEF, corresponding to a target binding site such as BINDING SITE I, BINDING SITE II or BINDING SITE III of FIG. 8. Table 4 illustrates the complementarity of the nucleotide sequences of P114-RHO-GEF BINDING SITE, designated SEQ ID:14048, to the nucleotide sequence of GAM63 RNA, herein designated GAM RNA, also designated SEQ ID:348.

Another function of GAM63 is therefore inhibition of P114-RHO-GEF (Accession NP_056133.1). Accordingly, utilities of GAM63 include diagnosis, prevention and treatment of diseases and clinical conditions associated with P114-RHO-GEF.

P5-1 (Accession NP_006665.1) is another GAM63 target gene, herein designated TARGET GENE. P5-1 BINDING SITE is a target binding site found in the 3' untranslated region of mRNA encoded by P5-1, corresponding to a target binding site such as BINDING SITE I, BINDING SITE II or BINDING SITE III of FIG. 8. Table 4 illustrates the complementarity of the nucleotide sequences of P5-1 BINDING SITE, designated SEQ ID:14464, to the nucleotide sequence of GAM63 RNA, herein designated GAM RNA, also designated SEQ ID:348.

Another function of GAM63 is therefore inhibition of P5-1 (Accession NP_006665.1). Accordingly, utilities of GAM63 include diagnosis, prevention and treatment of diseases and clinical conditions associated with P5-1.

Paired basic amino acid cleaving system 4 (PACE4, Accession NP_612192.1) is another GAM63 target gene, herein designated TARGET GENE. PACE4 BINDING SITE is a target binding site found in the 3' untranslated region of multiple transcripts of mRNA encoded by PACE4, corresponding to a target binding site such as BINDING SITE I, BINDING SITE II or BINDING SITE III of FIG. 8. Table 4 illustrates the complementarity of the nucleotide sequences of PACE4 BINDING SITE, designated SEQ ID:10623, to the nucleotide sequence of GAM63 RNA, herein designated GAM RNA, also designated SEQ ID:348.

Another function of GAM63 is therefore inhibition of Paired basic amino acid cleaving system 4 (PACE4, Accession NP_612192.1), a gene which processes hormone precursors by cleaving paired basic amino acids. Accordingly, utilities of GAM63 include diagnosis, prevention and treatment of diseases and clinical conditions associated with PACE4.

The function of PACE4 and its association with various diseases and clinical conditions, has been established by previous studies, as described hereinabove with reference to GAM31.1. Paired basic amino acid cleaving system 4

(PACE4, Accession NP_002561.1) is another GAM63 target gene, herein designated TARGET GENE. PACE4 BINDING SITE is a target binding site found in the 3' untranslated region of multiple transcripts of mRNA encoded by PACE4, corresponding to a target binding site such as BINDING SITE I, BINDING SITE II or BINDING SITE III of FIG. 8. Table 4 illustrates the complementarity of the nucleotide sequences of PACE4 BINDING SITE, designated SEQ ID:10623, to the nucleotide sequence of GAM63 RNA, herein designated GAM RNA, also designated SEQ ID:348.

Another function of GAM63 is therefore inhibition of Paired basic amino acid cleaving system 4 (PACE4, Accession NP_002561.1), a gene which processes hormone precursors by cleaving paired basic amino acids. Accordingly, utilities of GAM63 include diagnosis, prevention and treatment of diseases and clinical conditions associated with PACE4.

The function of PACE4 and its association with various diseases and clinical conditions, has been established by previous studies, as described hereinabove with reference to GAM31.1. PAGE-5 (Accession NP_569734.2) is another GAM63 target gene, herein designated TARGET GENE. PAGE-5 BINDING SITE is a target binding site found in the 5' untranslated region of mRNA encoded by PAGE-5, corresponding to a target binding site such as BINDING SITE I, BINDING SITE II or BINDING SITE III of FIG. 8. Table 4 illustrates the complementarity of the nucleotide sequences of PAGE-5 BINDING SITE, designated SEQ ID:8319, to the nucleotide sequence of GAM63 RNA, herein designated GAM RNA, also designated SEQ ID:348.

Another function of GAM63 is therefore inhibition of PAGE-5 (Accession NP_569734.2). Accordingly, utilities of GAM63 include diagnosis, prevention and treatment of diseases and clinical conditions associated with PAGE-5.

Paralemmin (PALM, Accession NP_002570.1) is another GAM63 target gene, herein designated TARGET GENE. PALM BINDING SITE is a target binding site found in the 3' untranslated region of mRNA encoded by PALM, corresponding to a target binding site such as BINDING SITE I, BINDING SITE II or BINDING SITE III of FIG. 8. Table 4 illustrates the complementarity of the nucleotide sequences of PALM BINDING SITE, designated SEQ ID:5652, to the nucleotide sequence of GAM63 RNA, herein designated GAM RNA, also designated SEQ ID:348.

Another function of GAM63 is therefore inhibition of Paralemmin (PALM, Accession NP_002570.1). Accordingly, utilities of GAM63 include diagnosis, prevention and treatment of diseases and clinical conditions associated with PALM.

Poly(a) polymerase beta (testis specific) (PAPOLB, Accession NP_064529.2) is another GAM63 target gene, herein designated TARGET GENE. PAPOLB BINDING SITE is a target binding site found in the 3' untranslated region of mRNA encoded by PAPOLB, corresponding to a target binding site such as BINDING SITE I, BINDING SITE II or BINDING SITE III of FIG. 8. Table 4 illustrates the complementarity of the nucleotide sequences of PAPOLB BINDING SITE, designated SEQ ID:5455, to the nucleotide sequence of GAM63 RNA, herein designated GAM RNA, also designated SEQ ID:348.

Another function of GAM63 is therefore inhibition of Poly (a) polymerase beta (testis specific) (PAPOLB, Accession NP_064529.2). Accordingly, utilities of GAM63 include diagnosis, prevention and treatment of diseases and clinical conditions associated with PAPOLB.

Poly(rc) binding protein 3 (PCBP3, Accession NP_065389.1) is another GAM63 target gene, herein designated TARGET GENE. PCBP3 BINDING SITE is a target binding site found in the 5' untranslated region of mRNA encoded by PCBP3, corresponding to a target binding site such as BINDING SITE I, BINDING SITE II or BINDING SITE III of FIG. 8. Table 4 illustrates the complementarity of the nucleotide sequences of PCBP3 BINDING SITE, designated SEQ ID:4999, to the nucleotide sequence of GAM63 RNA, herein designated GAM RNA, also designated SEQ ID:348.

Another function of GAM63 is therefore inhibition of Poly (rc) binding protein 3 (PCBP3, Accession NP_065389.1). Accordingly, utilities of GAM63 include diagnosis, prevention and treatment of diseases and clinical conditions associated with PCBP3.

Poly(rc) binding protein 4 (PCBP4, Accession NP_127501.1) is another GAM63 target gene, herein designated TARGET GENE. PCBP4 BINDING SITE is a target binding site found in the 3' untranslated region of multiple transcripts of mRNA encoded by PCBP4, corresponding to a target binding site such as BINDING SITE I, BINDING SITE II or BINDING SITE III of FIG. 8. Table 4 illustrates the complementarity of the nucleotide sequences of PCBP4 BINDING SITE, designated SEQ ID:13884, to the nucleotide sequence of GAM63 RNA, herein designated GAM RNA, also designated SEQ ID:348.

Another function of GAM63 is therefore inhibition of Poly (rc) binding protein 4 (PCBP4, Accession NP_127501.1). Accordingly, utilities of GAM63 include diagnosis, prevention and treatment of diseases and clinical conditions associated with PCBP4.

Poly(rc) binding protein 4 (PCBP4, Accession NP_127503.1) is another GAM63 target gene, herein designated TARGET GENE. PCBP4 BINDING SITE is a target binding site found in the 3' untranslated region of multiple transcripts of mRNA encoded by PCBP4, corresponding to a target binding site such as BINDING SITE I, BINDING SITE II or BINDING SITE III of FIG. 8. Table 4 illustrates the complementarity of the nucleotide sequences of PCBP4 BINDING SITE, designated SEQ ID:13884, to the nucleotide sequence of GAM63 RNA, herein designated GAM RNA, also designated SEQ ID:348.

Another function of GAM63 is therefore inhibition of Poly (rc) binding protein 4 (PCBP4, Accession NP_127503.1). Accordingly, utilities of GAM63 include diagnosis, prevention and treatment of diseases and clinical conditions associated with PCBP4.

Poly(rc) binding protein 4 (PCBP4, Accession NP_065151.1) is another GAM63 target gene, herein designated TARGET GENE. PCBP4 BINDING SITE is a target binding site found in the 3' untranslated region of multiple transcripts of mRNA encoded by PCBP4, corresponding to a target binding site such as BINDING SITE I, BINDING SITE II or BINDING SITE III of FIG. 8. Table 4 illustrates the complementarity of the nucleotide sequences of PCBP4 BINDING SITE, designated SEQ ID:13884, to the nucleotide sequence of GAM63 RNA, herein designated GAM RNA, also designated SEQ ID:348.

Another function of GAM63 is therefore inhibition of Poly (rc) binding protein 4 (PCBP4, Accession NP_065151.1). Accordingly, utilities of GAM63 include diagnosis, prevention and treatment of diseases and clinical conditions associated with PCBP4.

Poly(rc) binding protein 4 (PCBP4, Accession NP_127502.1) is another GAM63 target gene, herein designated TARGET GENE. PCBP4 BINDING SITE is a target binding site found in the 3' untranslated region of multiple transcripts of mRNA encoded by PCBP4, corresponding to a target binding site such as BINDING SITE I, BINDING SITE II or BINDING SITE III of FIG. 8. Table 4 illustrates the complementarity of the nucleotide sequences of PCBP4 BINDING SITE, designated SEQ ID:13884, to the nucleotide sequence of GAM63 RNA, herein designated GAM RNA, also designated SEQ ID:348.

Another function of GAM63 is therefore inhibition of Poly (rc) binding protein 4 (PCBP4, Accession NP_127502.1). Accordingly, utilities of GAM63 include diagnosis, prevention and treatment of diseases and clinical conditions associated with PCBP4.

Protocadherin 1 (cadherin-like 1) (PCDH1, Accession NP_115796.2) is another GAM63 target gene, herein designated TARGET GENE. PCDH1 BINDING SITE is a target binding site found in the 3' untranslated region of multiple transcripts of mRNA encoded by PCDH1, corresponding to a target binding site such as BINDING SITE I, BINDING SITE II or BINDING SITE III of FIG. 8. Table 4 illustrates the complementarity of the nucleotide sequences of PCDH1 BINDING SITE, designated SEQ ID:8176, to the nucleotide sequence of GAM63 RNA, herein designated GAM RNA, also designated SEQ ID:348.

Another function of GAM63 is therefore inhibition of Protocadherin 1 (cadherin-like 1) (PCDH1, Accession NP_115796.2). Accordingly, utilities of GAM63 include diagnosis, prevention and treatment of diseases and clinical conditions associated with PCDH1.

Protocadherin 12 (PCDH12, Accession NP_057664.1) is another GAM63 target gene, herein designated TARGET GENE. PCDH12 BINDING SITE is a target binding site found in the 5' untranslated region of mRNA encoded by PCDH12, corresponding to a target binding site such as BINDING SITE I, BINDING SITE II or BINDING SITE III of FIG. 8. Table 4 illustrates the complementarity of the nucleotide sequences of PCDH12 BINDING SITE, designated SEQ ID:5173, to the nucleotide sequence of GAM63 RNA, herein designated GAM RNA, also designated SEQ ID:348.

Another function of GAM63 is therefore inhibition of Protocadherin 12 (PCDH12, Accession NP_057664.1), a gene which is a member of a family of nonclassical cadherins. Accordingly, utilities of GAM63 include diagnosis, prevention and treatment of diseases and clinical conditions associated with PCDH12.

The function of PCDH12 has been established by previous studies. Murine vascular endothelial cadherin-2 is a cellular adhesion molecule that is distinct from vascular endothelial cadherin-1 (CDH5; 601120) in that it does not interact with catenins and does not appear to affect cell migration or growth (Telo et al., 1998). By sequence database searching, Wu and Maniatis (2000) identified a human VE-cadherin-2 homolog, which they called protocadherin-12 (OMIM Ref. No. PCDH12), encoding a deduced 1,184-amino acid protein that shares 81% sequence identity with the mouse protein. PCDH12 contains 4 exons; a single large exon encodes the extracellular and transmembrane domains, and 3 small exons encode the cytoplasmic domain. Wu and Maniatis (2000) concluded that the presence of unusually large exons is a characteristic feature of protocadherin. Using the mouse Pcdh12 cDNA sequence and RACE-PCR reactions, Ludwig et al. (2000) cloned a full-length PCDH12 cDNA from a human fetal kidney cDNA library. Northern blot analysis detected expression of a 5-kb PCHD12 transcript chiefly in highly vascularized tissues including the heart and placenta, but most tissues contained a low level of expression. Prominent expression was also detected in the spleen. Some tissues, including skeletal muscle and peripheral blood leukocytes, possessed transcripts of a larger size.

Full details of the abovementioned studies are described in the following publications, the disclosure of which are hereby incorporated by reference:

Wu, Q.; Maniatis, T.: Large exons encoding multiple ectodomains are a characteristic feature of protocadherin genes. Proc. Nat. Acad. Sci. 97:3124-3129, 2000; and Ludwig, D.; Lorenz, J.; Dejana, E.; Bohlen, P.; Hicklin, D. J.; Witte, L.; Pytowski, B.: cDNA cloning, chromosomal mapping, and expression analysis of human VE-cadherin-2. Mammalian Ge.

Further studies establishing the function and utilities of PCDH12 are found in John Hopkins OMIM database record ID 605622, and in cited publications listed in Table 5, which are hereby incorporated by reference. PDIP38 (Accession NP_056399.1) is another GAM63 target gene, herein designated TARGET GENE. PDIP38 BINDING SITE is a target binding site found in the 3' untranslated region of mRNA encoded by PDIP38, corresponding to a target binding site such as BINDING SITE I, BINDING SITE II or BINDING SITE III of FIG. 8. Table 4 illustrates the complementarity of the nucleotide sequences of PDIP38 BINDING SITE, designated SEQ ID:19488, to the nucleotide sequence of GAM63 RNA, herein designated GAM RNA, also designated SEQ ID:348.

Another function of GAM63 is therefore inhibition of PDIP38 (Accession NP_056399.1). Accordingly, utilities of GAM63 include diagnosis, prevention and treatment of diseases and clinical conditions associated with PDIP38.

PDIP46 (Accession NP_835237.1) is another GAM63 target gene, herein designated TARGET GENE. PDIP46 BINDING SITE is a target binding site found in the 3' untranslated region of multiple transcripts of mRNA encoded by PDIP46, corresponding to a target binding site such as BINDING SITE I, BINDING SITE II or BINDING SITE III of FIG. 8. Table 4 illustrates the complementarity of the nucleotide sequences of PDIP46 BINDING SITE, designated SEQ ID:2149, to the nucleotide sequence of GAM63 RNA, herein designated GAM RNA, also designated SEQ ID:348.

Another function of GAM63 is therefore inhibition of PDIP46 (Accession NP_835237.1). Accordingly, utilities of GAM63 include diagnosis, prevention and treatment of diseases and clinical conditions associated with PDIP46.

PDIP46 (Accession NP_115687.2) is another GAM63 target gene, herein designated TARGET GENE. PDIP46 BINDING SITE is a target binding site found in the 3' untranslated region of multiple transcripts of mRNA encoded by PDIP46, corresponding to a target binding site such as BINDING SITE I, BINDING SITE II or BINDING SITE III of FIG. 8. Table 4 illustrates the complementarity of the nucleotide sequences of PDIP46 BINDING SITE, designated SEQ ID:2149, to the nucleotide sequence of GAM63 RNA, herein designated GAM RNA, also designated SEQ ID:348.

Another function of GAM63 is therefore inhibition of PDIP46 (Accession NP_115687.2). Accordingly, utilities of GAM63 include diagnosis, prevention and treatment of diseases and clinical conditions associated with PDIP46.

PDZGEF1 (Accession NP_055062.1) is another GAM63 target gene, herein designated TARGET GENE. PDZGEF1 BINDING SITE is a target binding site found in the 3' untranslated region of mRNA encoded by PDZGEF1, corresponding to a target binding site such as BINDING SITE I, BINDING SITE II or BINDING SITE III of FIG. 8. Table 4 illustrates the complementarity of the nucleotide sequences of PDZGEF1 BINDING SITE, designated SEQ ID:2782, to the nucleotide sequence of GAM63 RNA, herein designated GAM RNA, also designated SEQ ID:348.

Another function of GAM63 is therefore inhibition of PDZGEF1 (Accession NP_055062.1). Accordingly, utilities of GAM63 include diagnosis, prevention and treatment of diseases and clinical conditions associated with PDZGEF1.

Period homolog 1 (drosophila) (PER1, Accession NP_002607.1) is another GAM63 target gene, herein designated TARGET GENE. PER1 BINDING SITE is a target binding site found in the 3' untranslated region of mRNA encoded by PER1, corresponding to a target binding site such as BINDING SITE I, BINDING SITE II or BINDING SITE III of FIG. 8. Table 4 illustrates the complementarity of the nucleotide sequences of PER1 BINDING SITE, designated SEQ ID:10857, to the nucleotide sequence of GAM63 RNA, herein designated GAM RNA, also designated SEQ ID:348.

Another function of GAM63 is therefore inhibition of Period homolog 1 (drosophila) (PER1, Accession NP_002607.1). Accordingly, utilities of GAM63 include diagnosis, prevention and treatment of diseases and clinical conditions associated with PER1.

Phosphoribosylformylglycinamidine synthase (fgar amidotransferase) (PFAS, Accession NP_036525.1) is another GAM63 target gene, herein designated TARGET GENE. PFAS BINDING SITE is a target binding site found in the 3' untranslated region of mRNA encoded by PFAS, corresponding to a target binding site such as BINDING SITE I, BINDING SITE II or BINDING SITE III of FIG. 8. Table 4 illustrates the complementarity of the nucleotide sequences of PFAS BINDING SITE, designated SEQ ID:9390, to the nucleotide sequence of GAM63 RNA, herein designated GAM RNA, also designated SEQ ID:348.

Another function of GAM63 is therefore inhibition of Phosphoribosylformylglycinamidine synthase (fgar amidotransferase) (PFAS, Accession NP_036525.1). Accordingly, utilities of GAM63 include diagnosis, prevention and treatment of diseases and clinical conditions associated with PFAS.

Phosphofructokinase, liver (PFKL, Accession NP_002617.2) is another GAM63 target gene, herein designated TARGET GENE. PFKL BINDING SITE is a target binding site found in the 3' untranslated region of mRNA encoded by PFKL, corresponding to a target binding site such as BINDING SITE I, BINDING SITE II or BINDING SITE III of FIG. 8. Table 4 illustrates the complementarity of the nucleotide sequences of PFKL BINDING SITE, designated SEQ ID:975, to the nucleotide sequence of GAM63 RNA, herein designated GAM RNA, also designated SEQ ID:348.

Another function of GAM63 is therefore inhibition of Phosphofructokinase, liver (PFKL, Accession NP_002617.2), a gene which functions in glycolysis, phosphorylates fructose-6-phosphate to fructose-1,6- bisphosphate. Accordingly, utilities of GAM63 include diagnosis, prevention and treatment of diseases and clinical conditions associated with PFKL.

The function of PFKL has been established by previous studies. Phosphofructokinase (PFK; ATP:D-fructose-6-phosphate-1-phosphotransferase, EC 2.7.1.11) is a tetramer formed by the random association of the products of two separate gene loci to form the five possible tetramers. PFKs of muscle and liver are homotetramers of the M and L subunits, respectively. Red cells have all five isozymes: M4, M3L, M2L2, ML3, and L4 (Vora et al., 1980). The M locus is mutant in glycogen storage disease VII (OMIM Ref. No. 232800). Vora et al. (1980) speculated that the heterogeneous group of hemolytic syndromes associated with partial red cell PFK deficiency without myopathy (Boulard et al., 1974; Kahn et al., 1975) may represent total absence of L subunits or qualitative defects of M or L subunits. Vora and Francke (1981) stated that there are three structural loci controlling PFK: M (OMIM Ref. No. muscle), L (liver), and P (platelet) type subunits. Fibroblasts express all three genes. By somatic cell hybridization, the authors found that the liver type is determined by a gene on chromosome 21. The mean red cell PFK is elevated in persons with Down syndrome. Vora et al. (1983) described a completely asymptomatic man who was apparently heterozygous for a mutant unstable L subunit, which was found also in his asymptomatic son. Erythrocyte metabolism was normal and there was no evidence of hemolysis. Some 20 unrelated families with PFK deficiency had been previously reported. Vora et al. (1983) suggested that these can be divided into 5 major groups: I- -the classic syndrome of simultaneous myopathy and hemolysis (see OMIM Ref. No. 232800); II-isolated myopathy; III-hemolysis only; IV-asymptomatic partial deficiency of red cell PFK (e.g., Boulard et al., 1974); and V-progressive, fatal myopathy with other atypical features. Group II is of doubtful validity; it probably represents cases in which red cells were inadequately studied. Although some Group III cases have been found to belong in Group I, others (e.g., Etiemble et al., 1976; Miwa et al., 1972) may be genuine. An asymptomatic kindred of Etiemble et al. (1980) had an unstable M subunit. The nature of Group V is unclear. Several of the PFK cases have been of Russian-Jewish extraction, suggesting to Vora et al. (1983) an unusually high frequency. By study of dosage effects in cases of partial monosomy or partial trisomy of chromosome 21, Chadefaux et al. (1984) concluded that the liver-type PFK is located at 21q21-qter. This is consistent with the regional assignment to 21q22 by Cox et al. (1984). Using a human-specific monoclonal antibody for PFKL in the study of hamster-human hybrids, Van Keuren et al. (1986) located the gene on band 21q22.3. Levanon et al. (1986) confirmed the assignment of PFKL to chromosome 21 by demonstrating hybridization of genomic clones to the DNA from mouse-human hybrid cells containing chromosome 21 as the only human chromosome. By linkage studies with RFLPs, Petersen et al. (1991) confirmed the location of the gene in band 21q22.3 and determined its location relative to 15 other genes and DNA markers. Gehnrich et al. (1988) described the isolation and nucleotide sequencing of liver PFK cDNA and presented evidence of hormonal and nutritional regulation of PFKL mRNA. Elson et al. (1990) concluded that the PFKL gene is at least 28 kb long and is divided into 22 exons.

Full details of the abovementioned studies are described in the following publications, the disclosure of which are hereby incorporated by reference:

Petersen, M. B.; Slaugenhaupt, S. A.; Lewis, J. G.; Warren, A. C.; Chakravarti, A.; Antonarakis, S. E.: A genetic linkage map of 27 markers on human chromosome 21. Genomics 9:407-419, 1991; and Gehnrich, S. C.; Gekakis, N.; Sul, H. S.: Liver (B-type) phosphofructokinase mRNA: cloning, structure, and expression. J. Biol. Chem. 263:11755-11759, 1988.

Further studies establishing the function and utilities of PFKL are found in John Hopkins OMIM database record ID 171860, and in cited publications listed in Table 5, which are hereby incorporated by reference. Profilin 2 (PFN2, Accession NP_002619.1) is another GAM63 target gene, herein designated TARGET GENE. PFN2 BINDING SITE1 and PFN2 BINDING SITE2 are target binding sites found in untranslated regions of multiple transcripts of mRNA encoded by PFN2, corresponding to target binding sites such as BINDING SITE I, BINDING SITE II or BINDING SITE III of FIG. 8. Table 4 illustrates the complementarity of the nucleotide sequences of PFN2 BINDING SITE1 and PFN2 BINDING SITE2, designated SEQ ID:1957 and SEQ ID:15687 respectively, to the nucleotide sequence of GAM63 RNA, herein designated GAM RNA, also designated SEQ ID:348.

Another function of GAM63 is therefore inhibition of Profilin 2 (PFN2, Accession NP_002619.1). Accordingly, utilities of GAM63 include diagnosis, prevention and treatment of diseases and clinical conditions associated with PFN2.

Phosphorylase kinase, gamma 2 (testis) (PHKG2, Accession NP_000285.1) is another GAM63 target gene, herein designated TARGET GENE. PHKG2 BINDING SITE is a target binding site found in the 3' untranslated region of mRNA encoded by PHKG2, corresponding to a target binding site such as BINDING SITE I, BINDING SITE II or BINDING SITE III of FIG. 8. Table 4 illustrates the complementarity of the nucleotide sequences of PHKG2 BINDING SITE, designated SEQ ID:7564, to the nucleotide sequence of GAM63 RNA, herein designated GAM RNA, also designated SEQ ID:348.

Another function of GAM63 is therefore inhibition of Phosphorylase kinase, gamma 2 (testis) (PHKG2, Accession NP_000285.1). Accordingly, utilities of GAM63 include diagnosis, prevention and treatment of diseases and clinical conditions associated with PHKG2.

Phosphatidylinositol-4-phosphate 5-kinase, type ii, beta (PIP5K2B, Accession NP_003550.1) is another GAM63 target gene, herein designated TARGET GENE. PIP5K2B BINDING SITE is a target binding site found in the 3' untranslated region of multiple transcripts of mRNA encoded by PIP5K2B, corresponding to a target binding site such as BINDING SITE I, BINDING SITE II or BINDING SITE III of FIG. 8. Table 4 illustrates the complementarity of the nucleotide sequences of PIP5K2B BINDING SITE, designated SEQ ID:16136, to the nucleotide sequence of GAM63 RNA, herein designated GAM RNA, also designated SEQ ID:348.

Another function of GAM63 is therefore inhibition of Phosphatidylinositol-4-phosphate 5-kinase, type ii, beta (PIP5K2B, Accession NP_003550.1). Accordingly, utilities of GAM63 include diagnosis, prevention and treatment of diseases and clinical conditions associated with PIP5K2B.

Pleckstrin (PLEK, Accession NP_002655.1) is another GAM63 target gene, herein designated TARGET GENE. PLEK BINDING SITE is a target binding site found in the 3' untranslated region of mRNA encoded by PLEK, corresponding to a target binding site such as BINDING SITE I, BINDING SITE II or BINDING SITE III of FIG. 8. Table 4 illustrates the complementarity of the nucleotide sequences of PLEK BINDING SITE, designated SEQ ID:11928, to the nucleotide sequence of GAM63 RNA, herein designated GAM RNA, also designated SEQ ID:348.

Another function of GAM63 is therefore inhibition of Pleckstrin (PLEK, Accession NP_002655.1), a gene which is the major protein kinase c substrate of platelets. Accordingly, utilities of GAM63 include diagnosis, prevention and treatment of diseases and clinical conditions associated with PLEK.

The function of PLEK has been established by previous studies. In platelets, agonists that stimulate phosphoinositide turnover cause the rapid phosphorylation of a protein of apparent relative molecular mass 40,000-47,000, called P47, by protein kinase C. Tyers et al. (1988) isolated human P47 clones by immunologic screening of a lambda-gt11 cDNA library from a promyelocytic leukemia cell line. A 1,050 basepair open reading frame that could encode the protein in question was confirmed by comparison with peptide sequences from platelet P47 and by expression of the putative P47 in E. coli and in vitro. The P47 sequence appeared to have been conserved throughout vertebrate evolution and was not similar to any other known sequence, including lipocortin (OMIM Ref. No. 151690). Based on its specific expression in platelets and various differentiated white blood cells, Tyers et al. (1988) proposed the name pleckstrin for platelet and leukocyte C kinase substrate and for the KSTR string of amino acids in the sequence KFARKSTRRSIR, the probable phosphorylation site. Tyers et al. (1989) reported the pleckstrin sequence. They deduced a molecular weight of 40,087. By differential display comparison of murine epidermal promotion-sensitive and -resistant cell lines after exposure to a tumor promoter, phorbol ester TPA, Cmarik et al. (2000) observed preferential expression in promotion-resistant cells of a cDNA encoding Plek. Northern blot analysis detected a 3.6-kb Plek transcript in mouse heart, lung, and spleen. Mouse Plek shares 91% amino acid identity with human PLEK. Using an interspecific backcross panel, Cmarik et al. (2000) mapped the mouse Plek gene to the proximal part of chromosome 11 in a region showing homology of synteny to human 2p, where they stated the PLEK gene has been mapped.

Full details of the abovementioned studies are described in the following publications, the disclosure of which are hereby incorporated by reference:

Cmarik, J. L.; Hegamyer, G.; Gerrard, B.; Dean, M.; Colburn, N. H.: cDNA cloning and mapping of mouse pleckstrin (Plek), a gene upregulated in transformation-resistant cells. Genomics 66:204-212, 2000; and Tyers, M.; Haslam, R. J.; Rachubinski, R. A.; Harley, C. B.: Molecular analysis of pleckstrin: the major protein kinase C substrate of platelets. J. Cell. Biochem. 40:133-145, 1989.

Further studies establishing the function and utilities of PLEK are found in John Hopkins OMIM database record ID 173570, and in cited publications listed in Table 5, which are hereby incorporated by reference. Proteolipid protein 1 (pelizaeus-merzbacher disease, spastic paraplegia 2, uncomplicated) (PLP1, Accession NP_000524.2) is another GAM63 target gene, herein designated TARGET GENE. PLP1 BINDING SITE is a target binding site found in the 3' untranslated region of mRNA encoded by PLP1, corresponding to a target binding site such as BINDING SITE I, BINDING SITE II or BINDING SITE III of FIG. 8. Table 4 illustrates the complementarity of the nucleotide sequences of PLP1 BINDING SITE, designated SEQ ID:11746, to the nucleotide sequence of GAM63 RNA, herein designated GAM RNA, also designated SEQ ID:348.

Another function of GAM63 is therefore inhibition of Proteolipid protein 1 (pelizaeus-merzbacher disease, spastic paraplegia 2, uncomplicated) (PLP1, Accession NP_000524.2). Accordingly, utilities of GAM63 include diagnosis, prevention and treatment of diseases and clinical conditions associated with PLP1.

Peanut-like 1 (drosophila) (PNUTL1, Accession NP_002679.2) is another GAM63 target gene, herein designated TARGET GENE. PNUTL1 BINDING SITE is a target binding site found in the 3' untranslated region of mRNA encoded by PNUTL1, corresponding to a target binding site such as BINDING SITE I, BINDING SITE II or BINDING SITE III of FIG. 8. Table 4 illustrates the complementarity of the nucleotide sequences of PNUTL1 BINDING SITE, designated SEQ ID:3567, to the nucleotide sequence of GAM63 RNA, herein designated GAM RNA, also designated SEQ ID:348.

Another function of GAM63 is therefore inhibition of Peanut-like 1 (drosophila) (PNUTL1, Accession NP_002679.2). Accordingly, utilities of GAM63 include diagnosis, prevention and treatment of diseases and clinical conditions associated with PNUTL1.

POF1B (Accession NP_079197.2) is another GAM63 target gene, herein designated TARGET GENE. POF1B BINDING SITE is a target binding site found in the 3' untranslated region of mRNA encoded by POF1B, corresponding to a target binding site such as BINDING SITE I, BINDING SITE II or BINDING SITE III of FIG. 8. Table 4 illustrates the complementarity of the nucleotide sequences of POF1B BINDING SITE, designated SEQ ID:8710, to the nucleotide sequence of GAM63 RNA, herein designated GAM RNA, also designated SEQ ID:348.

Another function of GAM63 is therefore inhibition of POF1B (Accession NP_079197.2). Accordingly, utilities of GAM63 include diagnosis, prevention and treatment of diseases and clinical conditions associated with POF1B.

Protein phosphatase 1b (formerly 2c), magnesium-dependent, beta isoform (PPM1B, Accession NP_002697.1) is another GAM63 target gene, herein designated TARGET GENE. PPM1B BINDING SITE is a target binding site found in the 5' untranslated region of multiple transcripts of mRNA encoded by PPM1B, corresponding to a target binding site such as BINDING SITE I, BINDING SITE II or BINDING SITE III of FIG. 8. Table 4 illustrates the complementarity of the nucleotide sequences of PPM1B BINDING SITE, designated SEQ ID:1077, to the nucleotide sequence of GAM63 RNA, herein designated GAM RNA, also designated SEQ ID:348.

Another function of GAM63 is therefore inhibition of Protein phosphatase 1b (formerly 2c), magnesium-dependent, beta isoform (PPM1B, Accession NP_002697.1). Accordingly, utilities of GAM63 include diagnosis, prevention and treatment of diseases and clinical conditions associated with PPM1B.

Protein phosphatase 1b (formerly 2c), magnesium-dependent, beta isoform (PPM1B, Accession NP_808907.1) is another GAM63 target gene, herein designated TARGET GENE. PPM1B BINDING SITE is a target binding site found in the 5' untranslated region of multiple transcripts of mRNA encoded by PPM1B, corresponding to a target binding site such as BINDING SITE I, BINDING SITE II or BINDING SITE III of FIG. 8. Table 4 illustrates the complementarity of the nucleotide sequences of PPM1B BINDING SITE, designated SEQ ID:1077, to the nucleotide sequence of GAM63 RNA, herein designated GAM RNA, also designated SEQ ID:348.

Another function of GAM63 is therefore inhibition of Protein phosphatase 1b (formerly 2c), magnesium-dependent, beta isoform (PPM1B, Accession NP_808907.1). Accordingly, utilities of GAM63 include diagnosis, prevention and treatment of diseases and clinical conditions associated with PPM1B.

Palmitoyl-protein thioesterase 2 (PPT2, Accession NP_620312.1) is another GAM63 target gene, herein designated TARGET GENE. PPT2 BINDING SITE is a target binding site found in the 5' untranslated region of multiple transcripts of mRNA encoded by PPT2, corresponding to a target binding site such as BINDING SITE I, BINDING SITE II or BINDING SITE III of FIG. 8. Table 4 illustrates the complementarity of the nucleotide sequences of PPT2 BINDING SITE, designated SEQ ID:3705, to the nucleotide sequence of GAM63 RNA, herein designated GAM RNA, also designated SEQ ID:348.

Another function of GAM63 is therefore inhibition of Palmitoyl-protein thioesterase 2 (PPT2, Accession NP_620312.1), a gene which is a palmitoyl-protein thioesterase 2 which possesses a different substrate specificity than PPT1. Accordingly, utilities of GAM63 include diagnosis, prevention and treatment of diseases and clinical conditions associated with PPT2.

The function of PPT2 has been established by previous studies. Palmitoyl- protein thioesterase-1 (PPT1; 600722) is a lysosomal hydrolase that removes long-chain fatty acyl groups from modified cysteine residues in proteins. Mutations in PPT1 have been found to cause the infantile form of neuronal ceroid lipofuscinosis (INCL; 256730). By searching sequence databases for homologs of PPT1, Soyombo and Hofmann (1997) identified cDNAs encoding PPT2. The deduced PPT2 protein contains 302 amino acids, including a 27-amino acid leader peptide, a sequence motif characteristic of many thioesterases and lipases, and 5 potential N-linked glycosylation sites. PPT2 shares 18% amino acid identity with PPT1. Northern blot analysis detected a predominant 2.0-kb PPT2 transcript in the human tissues examined, with the highest expression in skeletal muscle; variable amounts of 2.8- and 7.0-kb transcripts were also observed. Immunoblot analysis of recombinant PPT2 expressed in mammalian cells showed 6 PPT2 proteins ranging in size from 31 to 42 kD. Treatment that removes asparagine-linked oligosaccharides resulted in a single major protein of 31 kD and a minor protein of 33 kD. The authors demonstrated that recombinant PPT2, like PPT1, possesses thioesterase activity and localizes to the lysosome. Since PPT2 could not substitute for PPT1 in correcting the metabolic defect in INCL cells and was unable to remove palmitate groups from palmitoylated proteins that are routinely used as substrates for PPT1, Soyombo and Hofmann (1997) suggested that PPT2 possesses a different substrate specificity than PPT1.

Animal model experiments lend further support to the function of PPT2. Gupta et al. (2001) engineered disruptions in the Ppt1 and Ppt2 genes to create knockout mice that were deficient in either enzyme. Both lines of mice were viable and fertile; however, both lines developed spasticity (a 'clasping' phenotype) at a median age of 21 weeks and 29 weeks, respectively. Motor abnormalities progressed in the Ppt1 knockout mice, leading to death by 10 months of age. In contrast, most Ppt2 mice were alive at 12 months. Myoclonic jerking and seizures were prominent in the Ppt1 mice. Autofluorescent storage material was striking throughout the brains of both strains of mice. Neuronal loss and apoptosis were particularly prominent in Ppt1-deficient brains. These studies provided a mouse model for infantile neuronal ceroid lipofuscinosis and further suggested that PPT2 serves a role in the brain that is not carried out by PPT1.

It is appreciated that the abovementioned animal model for PPT2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gupta, P.; Soyombo, A. A.; Atashband, A.; Wisniewski, K. E.; Shelton, J. M.; Richardson, J. A.; Hammer, R. E.; Hofmann, S. L.: Disruption of PPT1 or PPT2 causes neuronal ceroid lipofuscinosis in knockout mice. Proc. Nat. Acad. Sci. 98:13566-13571, 2001; and Soyombo, A. A.; Hofmann, S. L.: Molecular cloning and expression of palmitoyl- protein thioesterase 2 (PPT2), a homolog of lysosomal palmitoyl-protein thioesterase with a distinct subs.

Further studies establishing the function and utilities of PPT2 are found in John Hopkins OMIM database record ID 603298, and in cited publications listed in Table 5, which are hereby incorporated by reference. Palmitoyl-protein thioesterase 2 (PPT2, Accession NP_005146.3) is another GAM63 target gene, herein designated TARGET GENE. PPT2 BINDING SITE is a target binding site found in the 5' untranslated region of multiple transcripts of mRNA encoded by PPT2, corresponding to a target binding site such as BINDING SITE I, BINDING SITE II or BINDING SITE III of FIG. 8. Table 4 illustrates the complementarity of the nucleotide sequences of PPT2 BINDING SITE, designated SEQ ID:3705, to the nucleotide sequence of GAM63 RNA, herein designated GAM RNA, also designated SEQ ID:348.

Another function of GAM63 is therefore inhibition of Palmitoyl-protein thioesterase 2 (PPT2, Accession NP_005146.3), a gene which is a palmitoyl-protein thioesterase 2 which possesses a different substrate specificity than PPT1. Accordingly, utilities of GAM63 include diagnosis, prevention and treatment of diseases and clinical conditions associated with PPT2.

The function of PPT2 has been established by previous studies. Palmitoyl-protein thioesterase-1 (PPT1; 600722) is a lysosomal hydrolase that removes long-chain fatty acyl groups from modified cysteine residues in proteins. Mutations in PPT1 have been found to cause the infantile form of neuronal ceroid lipofuscinosis (INCL; 256730). By searching sequence databases for homologs of PPT1, Soyombo and Hofmann (1997) identified cDNAs encoding PPT2. The deduced PPT2 protein contains 302 amino acids, including a 27-amino acid leader peptide, a sequence motif characteristic of many thioesterases and lipases, and 5 potential N-linked glycosylation sites. PPT2 shares 18% amino acid identity with PPT1. Northern blot analysis detected a predominant 2.0-kb PPT2 transcript in the human tissues examined, with the highest expression in skeletal muscle; variable amounts of 2.8- and 7.0-kb transcripts were also observed. Immunoblot analysis of recombinant PPT2 expressed in mammalian cells showed 6 PPT2 proteins ranging in size from 31 to 42 kD. Treatment that removes asparagine-linked oligosaccharides resulted in a single major protein of 31 kD and a minor protein of 33 kD. The authors demonstrated that recombinant PPT2, like PPT1, possesses thioesterase activity and localizes to the lysosome. Since PPT2 could not substitute for PPT1 in correcting the metabolic defect in INCL cells and was unable to remove palmitate groups from palmitoylated proteins that are routinely used as substrates for PPT1, Soyombo and Hofmann (1997) suggested that PPT2 possesses a different substrate specificity than PPT1.

Animal model experiments lend further support to the function of PPT2. Gupta et al. (2001) engineered disruptions in the Ppt1 and Ppt2 genes to create knockout mice that were deficient in either enzyme. Both lines of mice were viable and fertile; however, both lines developed spasticity (a 'clasping' phenotype) at a median age of 21 weeks and 29 weeks, respectively. Motor abnormalities progressed in the Ppt1 knockout mice, leading to death by 10 months of age. In contrast, most Ppt2 mice were alive at 12 months. Myoclonic jerking and seizures were prominent in the Ppt1 mice. Autofluorescent storage material was striking throughout the brains of both strains of mice. Neuronal loss and apoptosis were particularly prominent in Ppt1-deficient brains. These studies provided a mouse model for infantile neuronal ceroid lipofuscinosis and further suggested that PPT2 serves a role in the brain that is not carried out by PPT1.

It is appreciated that the abovementioned animal model for PPT2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gupta, P.; Soyombo, A. A.; Atashband, A.; Wisniewski, K. E.; Shelton, J. M.; Richardson, J. A.; Hammer, R. E.; Hofmann, S. L.: Disruption of PPT1 or PPT2 causes neuronal ceroid lipofuscinosis in knockout mice. Proc. Nat. Acad. Sci. 98:13566-13571, 2001; and Soyombo, A. A.; Hofmann, S. L.: Molecular cloning and expression of palmitoyl-protein thioesterase 2 (PPT2), a homolog of lysosomal palmitoyl-protein thioesterase with a distinct subs.

Further studies establishing the function and utilities of PPT2 are found in John Hopkins OMIM database record ID 603298, and in cited publications listed in Table 5, which are hereby incorporated by reference. Prolactin receptor (PRLR, Accession NP_000940.1) is another GAM63 target gene, herein designated TARGET GENE. PRLR BINDING SITE is a target binding site found in the 5' untranslated region of mRNA encoded by PRLR, corresponding to a target binding site such as BINDING SITE I, BINDING SITE II or BINDING SITE III of FIG. 8. Table 4 illustrates the complementarity of the nucleotide sequences of PRLR BINDING SITE, designated SEQ ID:2391, to the nucleotide sequence of GAM63 RNA, herein designated GAM RNA, also designated SEQ ID:348.

Another function of GAM63 is therefore inhibition of Prolactin receptor (PRLR, Accession NP_000940.1), a gene which is a receptor for the anterior pituitary hormone prolactin. and therefore may be associated with Tumors. Accordingly, utilities of GAM63 include diagnosis, prevention and treatment of Tumors, and of other diseases and clinical conditions associated with PRLR.

The function of PRLR has been established by previous studies. Owerbach et al. (1981) did Southern blot analyses of DNA from human-mouse cell hybrids to show that the prolactin gene is located on chromosome 6 (Owerbach et al., 1981). It bears homology to the genes for growth hormone (OMIM Ref. No. 139250) and chorionic somatomammotropin (OMIM Ref. No. 150200), which are on chromosome 17, but not as close homology as these two bear to each other (Cooke et al., 1981). Only 16% sequence homology of the growth hormone and prolactin gene has been found (Shome and Parlow, 1977). The regional assignment of prolactin is of interest because of possible association between prolactin-secreting adenomas and specific HLA alleles (Farid et al., 1980). Larrea et al. (1987) presented the results of family studies suggesting that there is a familial factor determining the occurrence of the 'big-big' form as the predominant immunoreactive PRL species in blood. By somatic cell hybridization, Taggart et al. (1987) narrowed the assignment of the PRL gene to 6pter-p21.1. Evans et al. (1988, 1989) mapped the prolactin gene in a series of overlapping deletions of chromosome 6 produced by gamma-irradiation of a human lymphoblastoid cell line followed by selection for HLA antigen-loss mutants As pointed out by DiMattia (1998), the PRL gene possesses alternative tissue-specific promoters that are located 5,563 basepairs apart. The 5-prime promoter is specific for expression of prolactin in the decidualized human endometrium and in lymphoblastoid cells such as the human cell line IM-9-P3; the downstream promoter is specific for expression in the pituitary lactotrope and is under the control of the POU-homeodomain transcription factor PIT1 (OMIM Ref. No. 173110). Transcriptional control of the nonpituitary start site is linked to the differentiation of the endometrial stromal cell into the decidual cell during the secretory phase of the ovulatory cycle (DiMattia et al., 1990, Gellersen et al., 1994). By deletion analysis of the human PRL promoter in endometrial stromal cells decidualized in vitro, Watanabe et al. (2001) demonstrated a 536-bp enhancer located between nucleotides -2040 and -1505 in the 5-prime-flanking region. DNase I footprint analysis of decidualized endometrial stromal cells revealed 3 protected regions, FP1-FP3. Transfection of overlapping 100-bp fragments of the 536-bp enhancer indicated that FP1 and FP3 each conferred enhancer activity. Gel shift assays indicated that both FP1 and FP3 bind AP1 (OMIM Ref. No. 165160), and that JUND (OMIM Ref. No. 165162) and FOSL2 (OMIM Ref. No. 601575) are components of the AP1 complex in decidual fibroblasts. Mutation of the AP1 binding site in either FP1 or FP3 decreased enhancer activity by approximately 50%, while mutation of both sites almost completely abolished activity Full details of the abovementioned studies are described in the following publications, the disclosure of which are hereby incorporated by reference:

Watanabe, K.; Kessler, C. A.; Bachurski, C. J.; Kanda, Y.; Richardson, B. D.; Stanek, J.; Handwerger, S.; Brar, A. K.: Identification of a decidua-specific enhancer on the human prolactin gene with two critical activator protein 1 (AP-1) binding sites. Molec. Endocr. 15:638-653, 2001; and DiMattia, G. E.; Gellersen, B.; Duckworth, M. L.; Friesen, H. G.: Human prolactin gene expression: the use of an alternative noncoding exon in decidua and the IM-9-P3 lymphoblast cell.

Further studies establishing the function and utilities of PRLR are found in John Hopkins OMIM database record ID 176761, and in cited publications listed in Table 5, which are hereby incorporated by reference. PRO0159 (Accession NP_054837.1) is another GAM63 target gene, herein designated TARGET GENE. PRO0159 BINDING SITE is a target binding site found in the 5' untranslated region of mRNA encoded by PRO0159, corresponding to a target binding site such as BINDING SITE I, BINDING SITE II or BINDING SITE III of FIG. 8. Table 4 illustrates the complementarity of the nucleotide sequences of PRO0159 BINDING SITE, designated SEQ ID:17869, to the nucleotide sequence of GAM63 RNA, herein designated GAM RNA, also designated SEQ ID:348.

Another function of GAM63 is therefore inhibition of PRO0159 (Accession NP_054837.1). Accordingly, utilities of GAM63 include diagnosis, prevention and treatment of diseases and clinical conditions associated with PRO0159.

PRO0456 (Accession NP_054846.1) is another GAM63 target gene, herein designated TARGET GENE. PRO0456 BINDING SITE is a target binding site found in the 5' untranslated region of mRNA encoded by PRO0456, corresponding to a target binding site such as BINDING SITE I, BINDING SITE II or BINDING SITE III of FIG. 8. Table 4 illustrates the complementarity of the nucleotide sequences of PRO0456 BINDING SITE, designated SEQ ID:7771, to the nucleotide sequence of GAM63 RNA, herein designated GAM RNA, also designated SEQ ID:348.

Another function of GAM63 is therefore inhibition of PRO0456 (Accession NP_054846.1). Accordingly, utilities of GAM63 include diagnosis, prevention and treatment of diseases and clinical conditions associated with PRO0456.

Protein c receptor, endothelial (epcr) (PROCR, Accession NP_006395.1) is another GAM63 target gene, herein designated TARGET GENE. PROCR BINDING SITE is a target binding site found in the 3' untranslated region of mRNA encoded by PROCR, corresponding to a target binding site such as BINDING SITE I, BINDING SITE II or BINDING SITE III of FIG. 8. Table 4 illustrates the complementarity of the nucleotide sequences of PROCR BINDING SITE, designated SEQ ID:20145, to the nucleotide sequence of GAM63 RNA, herein designated GAM RNA, also designated SEQ ID:348.

Another function of GAM63 is therefore inhibition of Protein c receptor, endothelial (epcr) (PROCR, Accession NP_006395.1), a gene which binds protein C in a calcium-dependent manner. and therefore may be associated with Venous thromboembolism and myocardial infarction. Accordingly, utilities of GAM63 include diagnosis, prevention and treatment of Venous thromboembolism and myocardial infarction, and of other diseases and clinical conditions associated with PROCR.

The function of PROCR has been established by previous studies. Protein C (OMIM Ref. No. 176860), a vitamin K-dependent serine protease zymogen, plays a major role in blood coagulation and may also prevent the lethal effects of gram-negative sepsis. Deficiency of protein C leads to life-threatening thrombophilia. Protein C is activated when thrombin (F2; 176930), the terminal enzyme of the coagulation system, binds to an endothelial cell surface protein, thrombomodulin (THBD; 188040). Using immunohistochemical analysis, Ye et al. (1999) demonstrated that EPCR is expressed strongly in the endothelial cells of arteries and veins in heart and lung, less intensely in capillaries in the lung and skin, and not at all in the endothelium of small vessels of the liver and kidney. Immunoblot analysis showed that EPCR is expressed as a 49-kD protein that is reduced to the predicted 25 kD by deglycosylation. Antibodies to EPCR could inhibit binding of protein C and APC to cultured endothelial cells and inhibited the activation of protein C. Simmonds and Lane (1999) pointed out that THBD is uniformly expressed on endothelial cells, significantly reducing its effective concentration on large vessels, whereas EPCR, with its high affinity for protein C, is preferentially expressed on large vessels. Riewald et al. (2002) demonstrated that activated protein C (OMIM Ref. No. 176860) uses the endothelial cell protein C receptor (EPCR) as a coreceptor for cleavage of protease-activated receptor 1 (PAR1; 187930) on endothelial cells. Gene profiling demonstrated that PAR1 signaling could account for all activated protein C-induced protective genes, including the immunomodulatory monocyte chemoattractant protein-1 (MCP1; 158105), which was selectively induced by activation of PAR1, but not PAR2 (OMIM Ref. No. 600933). Thus, Riewald et al. (2002) concluded that the prototypical thrombin receptor is the target for EPCR-dependent APC signaling, suggesting a role for this receptor cascade in protection from sepsis.

Full details of the abovementioned studies are described in the following publications, the disclosure of which are hereby incorporated by reference:

Riewald, M.; Petrovan, R. J.; Donner, A.; Mueller, B. M.; Ruf, W.: Activation of endothelial cell protease activated receptor 1 by the protein C pathway. Science 296:1880-1882, 2002; and Simmonds, R. E.; Lane, D. A.: Structural and functional implications of the intron/exon organization of the human endothelial cell protein C/activated protein C receptor (EPCR) gene: c.

Further studies establishing the function and utilities of PROCR are found in John Hopkins OMIM database record ID 600646, and in cited publications listed in Table 5, which are hereby incorporated by reference. Pregnancy specific beta-1-glycoprotein 7 (PSG7, Accession NP_002774.1) is another GAM63 target gene, herein designated TARGET GENE. PSG7 BINDING SITE is a target binding site found in the 3' untranslated region of mRNA encoded by PSG7, corresponding to a target binding site such as BINDING SITE I, BINDING SITE II or BINDING SITE III of FIG. 8. Table 4 illustrates the complementarity of the nucleotide sequences of PSG7 BINDING SITE, designated SEQ ID:14910, to the nucleotide sequence of GAM63 RNA, herein designated GAM RNA, also designated SEQ ID:348.

Another function of GAM63 is therefore inhibition of Pregnancy specific beta-1-glycoprotein 7 (PSG7, Accession NP_002774.1), a gene which function still unknown. Accordingly, utilities of GAM63 include diagnosis, prevention and treatment of diseases and clinical conditions associated with PSG7.

The function of PSG7 has been established by previous studies. The human pregnancy-specific glycoproteins (PSGs) are a group of molecules that are mainly produced by the placental syncytiotrophoblasts during pregnancy. PSGs comprise a subgroup of the carcinoembryonic antigen (CEA) family, which belongs to the immunoglobulin superfamily. See PSG3 (OMIM Ref. No. 176392) for additional information about PSGs. Teglund et al. (1994) found that the PSG7 gene contains 6 exons. Studies by several groups resulted in the mapping of the CEA gene family to 19q13.1-q13.2 (Thompson et al., 1990; Thompson et al., 1992; Tynan et al., 1992; Trask et al., 1993). The PSG subgroup is located telomeric of the CEA subgroup, and together they span approximately 1.1 to 1.2 Mb (Brandriff et al., 1992; Tynan et al., 1992). Using a high-resolution restriction fragment fingerprinting technique, Olsen et al. (1994) assembled 256 cosmids spanning the PSG region on 19q13.2 into a single 700-kb contig. FISH to sperm pronuclei and cosmid walking experiments indicated that this PSG contig is telomeric of CGM8 at the telomeric end of the CEA subgroup gene cluster. Detailed restriction mapping and hybridization with gene-specific probes indicated that the order of the 11 PSG genes in the contig is cen-PSG3-PSG8 (OMIM Ref. No. 176397)-PSG12 (PSG10; 176399)-PSG1 (OMIM Ref. No. 176390)-PSG6 (OMIM Ref. No. 176395)-PSG7-PSG13 (PSG11; 176401)- PSG2 (OMIM Ref. No. 176391)-PSG5 (OMIM Ref. No. 176394)-PSG4 (OMIM Ref. No. 176393)-PSG11 (PSG9; 176398)-tel. The PSG genes are tandemly oriented in a 5-prime to 3-prime direction from telomere to centromere. The CEA subgroup gene CGM11 is located at the telomeric end of the PSG gene cluster, and 6 genes belonging to a third CEA family subgroup, namely CGM13 through CGM18 (later OMIM Ref. No. 109770), are interspersed among the PSG genes. Nomenclature: Beauchemin et al. (1999) provided a revised nomenclature for the CEA gene family. Based on this nomenclature, the CEA family is composed of the PSG subfamily, the CEACAM subfamily (see OMIM Ref. No. 109770), and the CEACAM pseudogene (CEACAMP) subfamily (see OMIM Ref. No. 109770). PSG11, PSG12, and PSG13 were renamed PSG9, PSG10, and PSG11, respectively.

Full details of the abovementioned studies are described in the following publications, the disclosure of which are hereby incorporated by reference:

Beauchemin, N.; Draber, P.; Dveksler, G.; Gold, P.; Gray-Owen, S.; Grunert, F.; Hammarstrom, S.; Holmes, K. V.; Karlsson, A.; Kuroki, M.; Lin, S.-H.; Lucka, L.; and 13 others: Redefined nomenclature for members of the carcinoembryonic antigen family. Exp. Cell Res. 252:243-249, 1999; and Brandriff, B. F.; Gordon, L. A.; Tynan, K. T.; Olsen, A. S.; Mohrenweiser, H. W.; Fertitta, A.; Carrano, A. V.; Trask, B. J.: Order and genomic distances among members of the carcinoem.

Further studies establishing the function and utilities of PSG7 are found in John Hopkins OMIM database record ID 176396, and in cited publications listed in Table 5, which are hereby incorporated by reference. Proteasome (prosome, macropain) 26s subunit, atpase, 3 (PSMC3, Accession NP_002795.2) is another GAM63 target gene, herein designated TARGET GENE. PSMC3 BINDING SITE is a target binding site found in the 5' untranslated region of mRNA encoded by PSMC3, corresponding to a target binding site such as BINDING SITE I, BINDING SITE II or BINDING SITE III of FIG. 8. Table 4 illustrates the complementarity of the nucleotide sequences of PSMC3 BINDING SITE, designated SEQ ID:16328, to the nucleotide sequence of GAM63 RNA, herein designated GAM RNA, also designated SEQ ID:348.

Another function of GAM63 is therefore inhibition of Proteasome (prosome, macropain) 26s subunit, atpase, 3 (PSMC3, Accession NP_002795.2), a gene which is the ATPase subunit of the 26S proteasome (prosome macropain). Accordingly, utilities of GAM63 include diagnosis, prevention and treatment of diseases and clinical conditions associated with PSMC3.

The function of PSMC3 has been established by previous studies. The human immunodeficiency virus-1 (HIV-1) protein Tat is a potent activator of virus gene expression and replication. Nelbock et al. (1990) used biotinylated Tat as a probe to screen a lambda-gt11 fusion protein library, thereby cloning a cDNA encoding a protein that interacts with Tat. Expression of this protein, designated Tat-binding protein-1, was observed in a variety of cell lines, with expression being highest in human cells. TBP1 was localized predominantly in the nucleus, which is consistent with the nuclear localization of Tat. In cotransfection experiments, expression of TBP1 was able to suppress Tat-mediated transactivation specifically. Nelbock et al. (1990) recommended their strategy for direct identification and cloning of genes encoding proteins that associate with other proteins to modulate their activity in a positive or negative fashion. Ohana et al. (1993) suggested that TBP1 is involved in Tat-mediated transcriptional activation. Ubiquitinated proteins are degraded by a 26S ATP-dependent protease. The protease is composed of a 20S catalytic proteasome and 2 PA700 regulatory modules (see OMIM Ref. No. PSMC1; 602706). DeMartino et al. (1996) identified a protein complex that enhances PA700 activation of the proteasome. They found that 2 proteins, p42 (PSMC6; 602708) and p50 (PSMC3), are components of both this complex and PA700. By protein sequence analysis, DeMartino et al. (1996) determined that p50 and TBP1 are identical.

Full details of the abovementioned studies are described in the following publications, the disclosure of which are hereby incorporated by reference:

Ohana, B.; Moore, P. A.; Ruben, S. M.; Southgate, C. D.; Green, M. R.; Rosen, C. A.: The type 1 human immunodeficiency virus Tat binding protein is a transcriptional activator belonging to an additional family of evolutionarily conserved genes. Proc. Nat. Acad. Sci. 90:138-142, 1993; and DeMartino, G. N.; Proske, R. J.; Moomaw, C. R.; Strong, A. A.; Song, X.; Hisamatsu, H.; Tanaka, K.; Slaughter, C. A.: Identification, purification, and characterization of a PA700-depen.

Further studies establishing the function and utilities of PSMC3 are found in John Hopkins OMIM database record ID 186852, and in cited publications listed in Table 5, which are hereby incorporated by reference. Phosphatidylserine synthase 1 (PTDSS1, Accession NP_055569.1) is another GAM63 target gene, herein designated TARGET GENE. PTDSS1 BINDING SITE is a target binding site found in the 3' untranslated region of mRNA encoded by PTDSS1, corresponding to a target binding site such as BINDING SITE I, BINDING SITE II or BINDING SITE III of FIG. 8. Table 4 illustrates the complementarity of the nucleotide sequences of PTDSS1 BINDING SITE, designated SEQ ID:12178, to the nucleotide sequence of GAM63 RNA, herein designated GAM RNA, also designated SEQ ID:348.

Another function of GAM63 is therefore inhibition of Phosphatidylserine synthase 1 (PTDSS1, Accession NP_055569.1). Accordingly, utilities of GAM63 include diagnosis, prevention and treatment of diseases and clinical conditions associated with PTDSS1.

Phosphatase and tensin homolog (mutated in multiple advanced cancers 1) (PTEN, Accession NP_000305.1) is another GAM63 target gene, herein designated TARGET GENE. PTEN BINDING SITE is a target binding site found in the 5' untranslated region of mRNA encoded by PTEN, corresponding to a target binding site such as BINDING SITE I, BINDING SITE II or BINDING SITE III of FIG. 8. Table 4 illustrates the complementarity of the nucleotide sequences of PTEN BINDING SITE, designated SEQ ID:6023, to the nucleotide sequence of GAM63 RNA, herein designated GAM RNA, also designated SEQ ID:348.

Another function of GAM63 is therefore inhibition of Phosphatase and tensin homolog (mutated in multiple advanced cancers 1) (PTEN, Accession NP_000305.1). Accordingly, utilities of GAM63 include diagnosis, prevention and treatment of diseases and clinical conditions associated with PTEN.

Rab1b, member ras oncogene family (RAB1B, Accession NP_112243.1) is another GAM63 target gene, herein designated TARGET GENE. RAB1B BINDING SITE is a target binding site found in the 3' untranslated region of mRNA encoded by RAB1B, corresponding to a target binding site such as BINDING SITE I, BINDING SITE II or BINDING SITE III of FIG. 8. Table 4 illustrates the complementarity of the nucleotide sequences of RAB1B BINDING SITE, designated SEQ ID:5292, to the nucleotide sequence of GAM63 RNA, herein designated GAM RNA, also designated SEQ ID:348.

Another function of GAM63 is therefore inhibition of Rab1b, member ras oncogene family (RAB1B, Accession NP_112243.1). Accordingly, utilities of GAM63 include diagnosis, prevention and treatment of diseases and clinical conditions associated with RAB1B.

Rab interacting factor (RABIF, Accession NP_002862.2) is another GAM63 target gene, herein designated TARGET GENE. RABIF BINDING SITE is a target binding site found in the 3' untranslated region of mRNA encoded by RABIF, corresponding to a target binding site such as BINDING SITE I, BINDING SITE II or BINDING SITE III of FIG. 8. Table 4 illustrates the complementarity of the nucleotide sequences of RABIF BINDING SITE, designated SEQ ID:10935, to the nucleotide sequence of GAM63 RNA, herein designated GAM RNA, also designated SEQ ID:348.

Another function of GAM63 is therefore inhibition of Rab interacting factor (RABIF, Accession NP_002862.2), a gene which is involved in the regulation of intracellular vesicular transport. Accordingly, utilities of GAM63 include diagnosis, prevention and treatment of diseases and clinical conditions associated with RABIF.

The function of RABIF has been established by previous studies. The Sec4/Rab- related small GTP-binding proteins are involved in the regulation of intracellular vesicular transport. Mss4 stimulates GTP-GDP exchange in Sec4 and Rab and binds to a subset of genetically related Rab proteins. Yu and Schreiber (1995) cloned a human MSS4 cDNA. The gene encodes a 123-amino acid polypeptide that requires zinc for stability. Muller-Pillasch et al. (1997) showed by Northern blot analysis that MSS4 is expressed as 3 differently sized mRNAs, probably due to alternative polyadenylation signals. The transcripts are present at barely detectable levels in healthy pancreas, but at much higher levels in pancreatic and other cancer tissues. Muller-Pillasch et al. (1997) used fluorescence in situ hybridization to map the MSS4 gene to human chromosome 1q32-q41.

Full details of the abovementioned studies are described in the following publications, the disclosure of which are hereby incorporated by reference:

Muller-Pillasch, F.; Zimmerhackl, F.; Lacher, U.; Schultz, N.; Hameister, H.; Varga, G.; Friess, H.; Buchler, M.; Adler, G.; Gress, T. M.: Cloning of novel transcripts of the human guanine-nucleotide-exchange factor Mss4: in situ chromosomal mapping and expression in pancreatic cancer. Genomics 46:389-396, 1997; and y, H.; Schreiber, S. L.: Cloning, Zn(2+) binding, and structural characterization of the guanine nucleotide exchange factor human Mss4. Biochemistry 34:9103-9110, 1995.

Further studies establishing the function and utilities of RABIF are found in John Hopkins OMIM database record ID 603417, and in cited publications listed in Table 5, which are hereby incorporated by reference. Retinoic acid induced 14 (RAI14, Accession NP_056392.1) is another GAM63 target gene, herein designated TARGET GENE. RAI14 BINDING SITE is a target binding site found in the 3' untranslated region of mRNA encoded by RAI14, corresponding to a target binding site such as BINDING SITE I, BINDING SITE II or BINDING SITE III of FIG. 8. Table 4 illustrates the complementarity of the nucleotide sequences of RAI14 BINDING SITE, designated SEQ ID:2934, to the nucleotide sequence of GAM63 RNA, herein designated GAM RNA, also designated SEQ ID:348.

Another function of GAM63 is therefore inhibition of Retinoic acid induced 14 (RAI14, Accession NP_056392.1), a gene which is required for protein transport from the er to the golgi complex. Accordingly, utilities of GAM63 include diagnosis, prevention and treatment of diseases and clinical conditions associated with RAI14.

The function of RAI14 has been established by previous studies. Nagase et al. (2000) isolated a cDNA encoding RAI14, which they called KIAA1334, from a size-fractionated fetal brain cDNA library. Kutty et al. (2001) characterized the RAI14 gene, which they called NORPEG, from human retinal pigment epithelial cells (ARPE-19), in which its expression is induced by all-trans-retinoic acid. The predicted human and mouse proteins contain 980 and 979 amino acids, respectively, and share 84% sequence identity. Human RAI14 has a predicted molecular mass of 110 kD, a pI of 5.83, 6 potential N-glycosylation sites, several ankyrin repeats, and several coiled- coil helical domains. Northern blot analysis of human tissues detected expression of 2 transcripts of approximately 5 and 3 kb. Like the ARPE- 19 cells, placenta showed an intense signal at 5 kb and a weak signal at 3 kb; the reverse was observed in testis, with an intense signal at 3 kb and a weak signal at 5 kb. RAI14 was also highly expressed in several human cancer cell lines. Expression studies showed that RAI14 localizes to the cytoplasm. Confocal microscopic analysis in ARPE-19 cells showed threadlike projections in the cytoplasm reminiscent of the cytoskeleton. The expression of Rai14 was detected in mouse embryo at embryonic day 9.5 by in situ hybridization, and the expression appeared to be developmentally regulated. In adult mouse, the highest level of expression was detected in the seminiferous tubules of testis.

Full details of the abovementioned studies are described in the following publications, the disclosure of which are hereby incorporated by reference:

Kutty, R. K.; Kutty, G.; Samuel, W.; Duncan, T.; Bridges, C. C.; El-Sherbeeny, A.; Nagineni, C. N.; Smith, S. B.; Wiggert, B.: Molecular characterization and developmental expression of NORPEG, a novel gene induced by retinoic acid. J. Biol. Chem. 276:2831-2840, 2001; and Nagase, T.; Kikuno, R.; Ishikawa, K.; Hirosawa, M.; Ohara, O.: Prediction of the coding sequences of unidentified human genes. XVI. The complete sequences of 150 new cDNA clones from.

Further studies establishing the function and utilities of RAI14 are found in John Hopkins OMIM database record ID 606586, and in cited publications listed in Table 5, which are hereby incorporated by reference. RDHL (Accession NP_005762.2) is another GAM63 target gene, herein designated TARGET GENE. RDHL BINDING SITE1 and RDHL BINDING SITE2 are target binding sites found in untranslated regions of mRNA encoded by RDHL, corresponding to target binding sites such as BINDING SITE I, BINDING SITE II or BINDING SITE III of FIG. 8. Table 4 illustrates the complementarity of the nucleotide sequences of RDHL BINDING SITE1 and RDHL BINDING SITE2, designated SEQ ID:19957 and SEQ ID:5428 respectively, to the nucleotide sequence of GAM63 RNA, herein designated GAM RNA, also designated SEQ ID:348.

Another function of GAM63 is therefore inhibition of RDHL (Accession NP_005762.2). Accordingly, utilities of GAM63 include diagnosis, prevention and treatment of diseases and clinical conditions associated with RDHL.

Regenerating islet-derived-like, pancreatic stone protein-like, pancreatic thread protein-like (rat) (REGL, Accession NP_006499.1) is another GAM63 target gene, herein designated TARGET GENE. REGL BINDING SITE is a target binding site found in the 3' untranslated region of mRNA encoded by REGL, corresponding to a target binding site such as BINDING SITE I, BINDING SITE II or BINDING SITE III of FIG. 8. Table 4 illustrates the complementarity of the nucleotide sequences of REGL BINDING SITE, designated SEQ ID:7886, to the nucleotide sequence of GAM63 RNA, herein designated GAM RNA, also designated SEQ ID:348.

Another function of GAM63 is therefore inhibition of Regenerating islet-derived-like, pancreatic stone protein-like, pancreatic thread protein-like (rat) (REGL, Accession NP_006499.1), a gene which is a member of REG family with unknown function. Accordingly, utilities of GAM63 include diagnosis, prevention and treatment of diseases and clinical conditions associated with REGL.

The function of REGL has been established by previous studies. The REG1A (OMIM Ref. No. 167770) and REG1B genes belong to the type I subclass of the REG family of genes, each of which encodes a 166-amino acid protein. Moriizumi et al. (1994) and Gharib et al. (1993) mapped the REG1A and REG1B genes to 2p12. Miyashita et al. (1995) demonstrated that 4 REG family genes are tandemly ordered in a 95-kb DNA region of 2p12. From analysis of YAC clones containing the 4 genes using 2-color fluorescence in situ hybridization, they demonstrated the following order: 2cen- -PAP-RS-REG1A-REG1B-ptel. (RS, so designated for REG-related sequence, shows a high degree of homology to the REG1 genes but has an in-frame stop codon in the protein coding region.)

Full details of the abovementioned studies are described in the following publications, the disclosure of which are hereby incorporated by reference:

Miyashita, H.; Nakagawara, K.; Mori, M.; Narushima, Y.; Noguchi, N.; Moriizumi, S.; Takasawa, S.; Yonekura, H.; Takeuchi, T.; Okamoto, H.: Human REG family genes are tandemly ordered in a 95-kilobase region of chromosome 2p12. FEBS Lett. 377:429-433, 1995; and Moriizumi, S.; Watanabe, T.; Unno, M.; Nakagawara, K.; Suzuki, Y.; Miyashita, H.; Yonekura, H.; Okamoto, H.: Isolation, structural determination and expression of a novel reg gene, hum.

Further studies establishing the function and utilities of REGL are found in John Hopkins OMIM database record ID 167771, and in cited publications listed in Table 5, which are hereby incorporated by reference. Regulatory factor x, 1 (influences hla class ii expression) (RFX1, Accession NP_002909.2) is another GAM63 target gene, herein designated TARGET GENE. RFX1 BINDING SITE is a target binding site found in the 3' untranslated region of mRNA encoded by RFX1, corresponding to a target binding site such as BINDING SITE I, BINDING SITE II or BINDING SITE III of FIG. 8. Table 4 illustrates the complementarity of the nucleotide sequences of RFX1 BINDING SITE, designated SEQ ID:8417, to the nucleotide sequence of GAM63 RNA, herein designated GAM RNA, also designated SEQ ID:348.

Another function of GAM63 is therefore inhibition of Regulatory factor x, 1 (influences hla class ii expression) (RFX1, Accession NP_002909.2), a gene which regulates mhc class ii gene expression and also binds to an inverted repeat (enh1) required for hepatitis b virus genes expression. Accordingly, utilities of GAM63 include diagnosis, prevention and treatment of diseases and clinical conditions associated with RFX1.

The function of RFX1 and its association with various diseases and clinical conditions, has been established by previous studies, as described hereinabove with reference to GAM55.2. RGL (Accession NP_055964.2) is another GAM63 target gene, herein designated TARGET GENE. RGL BINDING SITE is a target binding site found in the 3' untranslated region of mRNA encoded by RGL, corresponding to a target binding site such as BINDING SITE I, BINDING SITE II or BINDING SITE III of FIG. 8. Table 4 illustrates the complementarity of the nucleotide sequences of RGL BINDING SITE, designated SEQ ID:13116, to the nucleotide sequence of GAM63 RNA, herein designated GAM RNA, also designated SEQ ID:348.

Another function of GAM63 is therefore inhibition of RGL (Accession NP_055964.2), a gene which is involved in nucleotide exchange factor. Accordingly, utilities of GAM63 include diagnosis, prevention and treatment of diseases and clinical conditions associated with RGL.

The function of RGL and its association with various diseases and clinical conditions, has been established by previous studies, as described hereinabove with reference to GAM51.1. RGL3 (Accession XP_290867.1) is another GAM63 target gene, herein designated TARGET GENE. RGL3 BINDING SITE is a target binding site found in the 3' untranslated region of mRNA encoded by RGL3, corresponding to a target binding site such as BINDING SITE I, BINDING SITE II or BINDING SITE III of FIG. 8. Table 4 illustrates the complementarity of the nucleotide sequences of RGL3 BINDING SITE, designated SEQ ID:15226, to the nucleotide sequence of GAM63 RNA, herein designated GAM RNA, also designated SEQ ID:348.

Another function of GAM63 is therefore inhibition of RGL3 (Accession XP_290867.1). Accordingly, utilities of GAM63 include diagnosis, prevention and treatment of diseases and clinical conditions associated with RGL3.

RGNEF (Accession NP_071893.1) is another GAM63 target gene, herein designated TARGET GENE. RGNEF BINDING SITE is a target binding site found in the 3' untranslated region of mRNA encoded by RGNEF, corresponding to a target binding site such as BINDING SITE I, BINDING SITE II or BINDING SITE III of FIG. 8. Table 4 illustrates the complementarity of the nucleotide sequences of RGNEF BINDING SITE, designated SEQ ID:18858, to the nucleotide sequence of GAM63 RNA, herein designated GAM RNA, also designated SEQ ID:348.

Another function of GAM63 is therefore inhibition of RGNEF (Accession NP_071893.1). Accordingly, utilities of GAM63 include diagnosis, prevention and treatment of diseases and clinical conditions associated with RGNEF.

RNF110 (Accession NP_009075.1) is another GAM63 target gene, herein designated TARGET GENE. RNF110 BINDING SITE is a target binding site found in the 3' untranslated region of mRNA encoded by RNF110, corresponding to a target binding site such as BINDING SITE I, BINDING SITE II or BINDING SITE III of FIG. 8. Table 4 illustrates the complementarity of the nucleotide sequences of RNF110 BINDING SITE, designated SEQ ID:17598, to the nucleotide sequence of GAM63 RNA, herein designated GAM RNA, also designated SEQ ID:348.

Another function of GAM63 is therefore inhibition of RNF110 (Accession NP_009075.1). Accordingly, utilities of GAM63 include diagnosis, prevention and treatment of diseases and clinical conditions associated with RNF110.

Ring finger protein 3 (RNF3, Accession NP_006306.2) is another GAM63 target gene, herein designated TARGET GENE. RNF3 BINDING SITE is a target binding site found in the 3' untranslated region of multiple transcripts of mRNA encoded by RNF3, corresponding to a target binding site such as BINDING SITE I, BINDING SITE II or BINDING SITE III of FIG. 8. Table 4 illustrates the complementarity of the nucleotide sequences of RNF3 BINDING SITE, designated SEQ ID:6132, to the nucleotide sequence of GAM63 RNA, herein designated GAM RNA, also designated SEQ ID:348.

Another function of GAM63 is therefore inhibition of Ring finger protein 3 (RNF3, Accession NP_006306.2), a gene which is a mitogen-activated nuclear kinase involved in signal transduction. Accordingly, utilities of GAM63 include diagnosis, prevention and treatment of diseases and clinical conditions associated with RNF3.

The function of RNF3 has been established by previous studies. In a search for novel genes in the human major histocompatibility complex (MHC) class II region on chromosome 6p21.3, Okamoto et al. (1991) and Beck et al. (1992) identified a gene that they termed RING3 ('RING' is an acronym for 'really interesting new gene.'). Based on mapping and genomic sequencing, RING3 was located in the middle of the class II region between the genes HLA-DNA (OMIM Ref. No. 142930) and HLA-DMA (OMIM Ref. No. 142855). In contrast to all the other genes encoded in the class II region, RING3 appeared to have no obvious function associated with the immune system based on sequence comparisons. The striking sequence similarity to the female sterile homeotic (fsh) gene in Drosophila, however, suggested a conserved biologic function for RING3. Denis and Green (1996) discovered that the RING3 product is, in fact, a mitogen-activated nuclear kinase involved in signal transduction and that it is upregulated in certain types of leukemia. With the aim of learning more about the phylogeny of RING3, Thorpe et al. (1996) identified further homologs in different species and determined their gene structures. The functional analysis of RING3 had been further complicated by the finding of a second, non-MHC-linked copy of RING3 in humans by Nomura et al. (1994). This was referred to by them as ORFX (OMIM Ref. No. 601541). Using a PCR probe derived from the ORFX cDNA sequence, Thorpe et al. (1996) mapped ORFX to 9q34 by fluorescence in situ hybridization analysis. Several other MHC-related genes had been reported to map to the same region of 9q Full details of the abovementioned studies are described in the following publications, the disclosure of which are hereby incorporated by reference:

Denis, G. V.; Green, M. R.: A novel, mitogen-activated nuclear kinase is related to a Drosophila developmental regulator. Genes Dev. 10:261-271, 1996; and Nomura, N.; Nagase, T.; Miyajima, N.; Sazuka, T.; Tanaka, A.; Sato, S.; Seki, N.; Kawarabayasi, Y.; Ishikawa, K.; Tabata, S.: Prediction of the coding sequences of unidentified human genes.

Further studies establishing the function and utilities of RNF3 are found in John Hopkins OMIM database record ID 601540, and in cited publications listed in Table 5, which are hereby incorporated by reference. RNTRE (Accession NP_055503.1) is another GAM63 target gene, herein designated TARGET GENE. RNTRE BINDING SITE is a target binding site found in the 3' untranslated region of mRNA encoded by RNTRE, corresponding to a target binding site such as BINDING SITE I, BINDING SITE II or BINDING SITE III of FIG. 8. Table 4 illustrates the complementarity of the nucleotide sequences of RNTRE BINDING SITE, designated SEQ ID:17840, to the nucleotide sequence of GAM63 RNA, herein designated GAM RNA, also designated SEQ ID:348.

Another function of GAM63 is therefore inhibition of RNTRE (Accession NP_055503.1), a gene which may be involved in cell proliferation. Accordingly, utilities of GAM63 include diagnosis, prevention and treatment of diseases and clinical conditions associated with RNTRE.

The function of RNTRE has been established by previous studies. Matoskova et al. (1996) demonstrated that the product of the RNTRE gene is a 97- to 100- kD protein that stably associates in vivo and in vitro with EPS8 via the SH3 domain of the latter. In vitro, RNTRE displayed remarkable preference for binding to the SH3 domain of EPS8, compared with 8 other SH3s. A C-terminal truncated mutant of RNTRE was able to confer proliferative advantage and reduced serum requirement to NIH3T3 fibroblasts, suggesting a role for RNTRE in cell proliferation. Epidermal growth factor receptor (EGFR; 131550) signaling involves small GTPases of the Rho family, and EGFR trafficking involves small GTPases of the Rab family. Lanzetti et al. (2000) reported that the EPS8 protein connects these signaling pathways. EPS8 is a substrate of EGFR that is held in a complex with SOS1 (OMIM Ref. No. 182530) by the adaptor protein E3B1 (OMIM Ref. No. 603050), thereby mediating activation of RAC (OMIM Ref. No. 602048). Through its SH3 domain, EPS8 interacts with RNTRE. Lanzetti et al. (2000) showed that RNTRE is a RAB5 (OMIM Ref. No. 179512) GTPase-activating protein (GAP) whose activity is regulated by EGFR. By entering in a complex with EPS8, RNTRE acts on RAB5 and inhibits internalization of the EGFR. Furthermore, RNTRE diverts EPS8 from its RAC-activating function, resulting in the attenuation of RAC signaling. Thus, depending on its state of association with E3B1 or RNTRE, EPS8 participates in both EGFR signaling through RAC and EGFR trafficking through RAB5. Lanzetti et al. (2000) showed that 2 arginine residues (arg106 and arg150 of RNTRE) are highly conserved in TRH domains. In addition, an aspartate residue (asp147 of RNTRE) is invariant. Mutations of any of these residues to alanine resulted in proteins that were unable to display GAP activity on RAB5.

Full details of the abovementioned studies are described in the following publications, the disclosure of which are hereby incorporated by reference:

Lanzetti, L.; Rybin, V.; Malabarba, M. G.; Christoforidis, S.; Scita, G.; Zerial, M.; Di Fiore, P. P.: The Eps8 protein coordinates EGF receptor signalling through Rac and trafficking through Rab5. Nature 408:374-377, 2000; and Matoskova, B.; Wong, W. T.; Seki, N.; Nagase, T.; Nomura, N.; Robbins, K. C.; Di Fiore, P. P.: RN-tre identifies a family of tre-related proteins displaying a novel potential protein bind.

Further studies establishing the function and utilities of RNTRE are found in John Hopkins OMIM database record ID 605405, and in cited publications listed in Table 5, which are hereby incorporated by reference. RoXaN (Accession NP_060060.3) is another GAM63 target gene, herein designated TARGET GENE. RoXaN BINDING SITE is a target binding site found in the 3' untranslated region of mRNA encoded by RoXaN, corresponding to a target binding site such as BINDING SITE I, BINDING SITE II or BINDING SITE III of FIG. 8. Table 4 illustrates the complementarity of the nucleotide sequences of RoXaN BINDING SITE, designated SEQ ID:18964, to the nucleotide sequence of GAM63 RNA, herein designated GAM RNA, also designated SEQ ID:348.

Another function of GAM63 is therefore inhibition of RoXaN (Accession NP_060060.3). Accordingly, utilities of GAM63 include diagnosis, prevention and treatment of diseases and clinical conditions associated with RoXaN.

RPC2 (Accession NP_060552.2) is another GAM63 target gene, herein designated TARGET GENE. RPC2 BINDING SITE is a target binding site found in the 3' untranslated region of mRNA encoded by RPC2, corresponding to a target binding site such as BINDING SITE I, BINDING SITE II or BINDING SITE III of FIG. 8. Table 4 illustrates the complementarity of the nucleotide sequences of RPC2 BINDING SITE, designated SEQ ID:3735, to the nucleotide sequence of GAM63 RNA, herein designated GAM RNA, also designated SEQ ID:348.

Another function of GAM63 is therefore inhibition of RPC2 (Accession NP_060552.2). Accordingly, utilities of GAM63 include diagnosis, prevention and treatment of diseases and clinical conditions associated with RPC2.

Ribosomal protein s6 kinase, 52 kda, polypeptide 1 (RPS6KC1, Accession NP_036556.2) is another GAM63 target gene, herein designated TARGET GENE. RPS6KC1 BINDING SITE is a target binding site found in the 3' untranslated region of mRNA encoded by RPS6KC1, corresponding to a target binding site such as BINDING SITE I, BINDING SITE II or BINDING SITE III of FIG. 8. Table 4 illustrates the complementarity of the nucleotide sequences of RPS6KC1 BINDING SITE, designated SEQ ID:8683, to the nucleotide sequence of GAM63 RNA, herein designated GAM RNA, also designated SEQ ID:348.

Another function of GAM63 is therefore inhibition of Ribosomal protein s6 kinase, 52 kda, polypeptide 1 (RPS6KC1, Accession NP_036556.2). Accordingly, utilities of GAM63 include diagnosis, prevention and treatment of diseases and clinical conditions associated with RPS6KC1.

Related ras viral (r-ras) oncogene homolog 2 (RRAS2, Accession NP_036382.2) is another GAM63 target gene, herein designated TARGET GENE. RRAS2 BINDING SITE is a target binding site found in the 3' untranslated region of mRNA encoded by RRAS2, corresponding to a target binding site such as BINDING SITE I, BINDING SITE II or BINDING SITE III of FIG. 8. Table 4 illustrates the complementarity of the nucleotide sequences of RRAS2 BINDING SITE, designated SEQ ID:15394, to the nucleotide sequence of GAM63 RNA, herein designated GAM RNA, also designated SEQ ID:348.

Another function of GAM63 is therefore inhibition of Related ras viral (r-ras) oncogene homolog 2 (RRAS2, Accession NP_036382.2). Accordingly, utilities of GAM63 include diagnosis, prevention and treatment of diseases and clinical conditions associated with RRAS2.

S100Z (Accession NP_570128.1) is another GAM63 target gene, herein designated TARGET GENE. S100Z BINDING SITE is a target binding site found in the 5' untranslated region of mRNA encoded by S100Z, corresponding to a target binding site such as BINDING SITE I, BINDING SITE II or BINDING SITE III of FIG. 8. Table 4 illustrates the complementarity of the nucleotide sequences of S100Z BINDING SITE, designated SEQ ID:12017, to the nucleotide sequence of GAM63 RNA, herein designated GAM RNA, also designated SEQ ID:348.

Another function of GAM63 is therefore inhibition of S100Z (Accession NP_570128.1). Accordingly, utilities of GAM63 include diagnosis, prevention and treatment of diseases and clinical conditions associated with S100Z.

SAPAP3 (Accession XP_035601.2) is another GAM63 target gene, herein designated TARGET GENE. SAPAP3 BINDING SITE is a target binding site found in the 3' untranslated region of mRNA encoded by SAPAP3, corresponding to a target binding site such as BINDING SITE I, BINDING SITE II or BINDING SITE III of FIG. 8. Table 4 illustrates the complementarity of the nucleotide sequences of SAPAP3 BINDING SITE, designated SEQ ID:14421, to the nucleotide sequence of GAM63 RNA, herein designated GAM RNA, also designated SEQ ID:348.

Another function of GAM63 is therefore inhibition of SAPAP3 (Accession XP_035601.2). Accordingly, utilities of GAM63 include diagnosis, prevention and treatment of diseases and clinical conditions associated with SAPAP3.

SC65 (Accession NP_006446.1) is another GAM63 target gene, herein designated TARGET GENE. SC65 BINDING SITE is a target binding site found in the 3' untranslated region of mRNA encoded by SC65, corresponding to a target binding site such as BINDING SITE I, BINDING SITE II or BINDING SITE III of FIG. 8. Table 4 illustrates the complementarity of the nucleotide sequences of SC65 BINDING SITE, designated SEQ ID:5594, to the nucleotide sequence of GAM63 RNA, herein designated GAM RNA, also designated SEQ ID:348.

Another function of GAM63 is therefore inhibition of SC65 (Accession NP_006446.1). Accordingly, utilities of GAM63 include diagnosis, prevention and treatment of diseases and clinical conditions associated with SC65.

Sodium channel, voltage gated, type viii, alpha polypeptide (SCN8A, Accession NP_055006.1) is another GAM63 target gene, herein designated TARGET GENE. SCN8A BINDING SITE is a target binding site found in the 3' untranslated region of mRNA encoded by SCN8A, corresponding to a target binding site such as BINDING SITE I, BINDING SITE II or BINDING SITE III of FIG. 8. Table 4 illustrates the complementarity of the nucleotide sequences of SCN8A BINDING SITE, designated SEQ ID:1580, to the nucleotide sequence of GAM63 RNA, herein designated GAM RNA, also designated SEQ ID:348.

Another function of GAM63 is therefore inhibition of Sodium channel, voltage gated, type viii, alpha polypeptide (SCN8A, Accession NP_055006.1), a gene which is component of a brain voltage-gated sodium channel. Accordingly, utilities of GAM63 include diagnosis, prevention and treatment of diseases and clinical conditions associated with SCN8A.

The function of SCN8A has been established by previous studies. The dystonia demonstrated by Sprunger et al. (1999) in association with the Scn8a mutation was the first to be related to mutation in an ion channel. Furthermore, the med (J) mouse differed from other animal models with dystonia in that the condition persisted to adulthood and was not associated with neurodegeneration. Sprunger et al. (1999) suggested that the med(J) mutation should be classified as a hypomorphic allele because a low level of full-length Scn8a transcripts was demonstrated in homozygotes, indicating normal splicing at low efficiency. Homozygotes for null alleles of Scn8a could not survive even in the presence of 2 copies of the Scnm1(H) modifier allele. Thus, prevention of paralysis and survival to adulthood required both a low level of wildtype transcript and at least 1 copy of the dominant allele of Scnm1. C57BL/6J carries a recessive allele of Scnm1 that, in combination with a hypomorphic level of Scn8a, resulted in paralysis and lethality. DeRepentigny et al. (2001) described a spontaneous autosomal recessive mutation in the mouse, which they termed 'degenerating muscle' (dmu), that is characterized by skeletal and cardiac muscle degeneration. Dmu mice are weak and have great difficulty in moving due to muscle atrophy and wasting in the hindquarters. Histopathologic observations and ultrastructural analysis revealed muscle degeneration in both skeletal and cardiac muscle, but no abnormalities in sciatic nerves. Using linkage analysis, the authors mapped the dmu locus to the distal portion of mouse chromosome 15 in a region syntenic to human chromosome 12q13. The human disorder scapuloperoneal myopathy (SPM; 181430) has been linked to this region, and SPM patients with associated cardiomyopathy have been described. Intact transcripts for Scn8a were present in dmu mice, but their levels were dramatically reduced. Furthermore, genetic complementation crosses between dmu and med mice revealed that they are allelic. The authors concluded that at least a portion of the dmu phenotype may be caused by a downregulation of Scn8a, and that SCN8A is a candidate gene for human SPM.

Full details of the abovementioned studies are described in the following publications, the disclosure of which are hereby incorporated by reference:

Sprunger, L. K.; Escay, A.; Tallaksen-Greene, S.; Albin, R. L.; Meisler, M. H.: Dystonia associated with mutation of the neuronal sodium channel Scn8a and identification of the modifier locus Scnm1 on mouse chromosome 3. Hum. Molec. Genet. 8:471-479, 1999; and DeRepentigny, Y.; Cote, P. D.; Pool, M.; Bernier, G.; Girard, S.; Vidal, S. M.; Kothary, R.: Pathological and genetic analysis of the degenerating muscle (dmu) mouse: a new allele of Sc.

Further studies establishing the function and utilities of SCN8A are found in John Hopkins OMIM database record ID 600702, and in cited publications listed in Table 5, which are hereby incorporated by reference. Sidekick homolog 2 (chicken) (SDK2, Accession NP_061937.2) is another GAM63 target gene, herein designated TARGET GENE. SDK2 BINDING SITE is a target binding site found in the 3' untranslated region of mRNA encoded by SDK2, corresponding to a target binding site such as BINDING SITE I, BINDING SITE II or BINDING SITE III of FIG. 8. Table 4 illustrates the complementarity of the nucleotide sequences of SDK2 BINDING SITE, designated SEQ ID:16444, to the nucleotide sequence of GAM63 RNA, herein designated GAM RNA, also designated SEQ ID:348.

Another function of GAM63 is therefore inhibition of Sidekick homolog 2 (chicken) (SDK2, Accession NP_061937.2). Accordingly, utilities of GAM63 include diagnosis, prevention and treatment of diseases and clinical conditions associated with SDK2.

SEC31B-1 (Accession NP_056305.1) is another GAM63 target gene, herein designated TARGET GENE. SEC31B-1 BINDING SITE is a target binding site found in the 3' untranslated region of mRNA encoded by SEC31B-1, corresponding to a target binding site such as BINDING SITE I, BINDING SITE II or BINDING SITE III of FIG. 8. Table 4 illustrates the complementarity of the nucleotide sequences of SEC31B-1 BINDING SITE, designated SEQ ID:19442, to the nucleotide sequence of GAM63 RNA, herein designated GAM RNA, also designated SEQ ID:348.

Another function of GAM63 is therefore inhibition of SEC31B-1 (Accession NP_056305.1). Accordingly, utilities of GAM63 include diagnosis, prevention and treatment of diseases and clinical conditions associated with SEC31B-1.

SELB (Accession NP_068756.1) is another GAM63 target gene, herein designated TARGET GENE. SELB BINDING SITE is a target binding site found in the 3' untranslated region of mRNA encoded by SELB, corresponding to a target binding site such as BINDING SITE I, BINDING SITE II or BINDING SITE III of FIG. 8. Table 4 illustrates the complementarity of the nucleotide sequences of SELB BINDING SITE, designated SEQ ID:7377, to the nucleotide sequence of GAM63 RNA, herein designated GAM RNA, also designated SEQ ID:348.

Another function of GAM63 is therefore inhibition of SELB (Accession NP_068756.1). Accordingly, utilities of GAM63 include diagnosis, prevention and treatment of diseases and clinical conditions associated with SELB.

Serine (or cysteine) proteinase inhibitor, clade b (ovalbumin), member 5 (SERPINB5, Accession NP_002630.1) is another GAM63 target gene, herein designated TARGET GENE. SERPINB5 BINDING SITE is a target binding site found in the 3' untranslated region of mRNA encoded by SERPINB5, corresponding to a target binding site such as BINDING SITE I, BINDING SITE II or BINDING SITE III of FIG. 8. Table 4 illustrates the complementarity of the nucleotide sequences of SERPINB5 BINDING SITE, designated SEQ ID:8247, to the nucleotide sequence of GAM63 RNA, herein designated GAM RNA, also designated SEQ ID:348.

Another function of GAM63 is therefore inhibition of Serine (or cysteine) proteinase inhibitor, clade b (ovalbumin), member 5 (SERPINB5, Accession NP_002630.1), a gene which may be a serpin serine protease inhibitor and supresses tumor metastasis. Accordingly, utilities of GAM63 include diagnosis, prevention and treatment of diseases and clinical conditions associated with SERPINB5.

The function of SERPINB5 has been established by previous studies. The nucleotide 5-methylcytosine is involved in processes crucial to mammalian development, such as X-chromosome inactivation and gene imprinting. In addition, cytosine methylation may be involved in the establishment and maintenance of cell type- specific expression of developmentally regulated genes; however, it is difficult to identify clear examples of such genes, particularly in humans. Futscher et al. (2002) provided evidence that cytosine methylation of the maspin gene promoter controls, in part, normal cell type-specific SERPINB5 expression. In normal cells expressing SERPINB5, the SERPINB5 promoter is unmethylated and the promoter region has acetylated histones and an accessible chromatin structure. In contrast, normal cells that do not express SERPINB5 have a completely methylated SERPINB5 promoter with hypoacetylated histones, an inaccessible chromatin structure, and a transcriptional repression that is relieved by inhibition of DNA methylation. These findings indicated that cytosine methylation is important in the establishment and maintenance of cell type-restricted gene expression. Zou et al. (1994) used subtractive hybridization and the 'differential display' method to identify candidate tumor suppressor genes that are defective in human breast carcinoma cells. These genes were identified initially by searching for mRNAs whose expression is reduced or absent in tumor cells compared with normal cells grown under similar conditions. Zou et al. (1994) reported the characteristics of one of the more than 30 genes so identified, a member of the serpin family of protease inhibitors which they termed maspin. A single 3.0-kb maspin mRNA was expressed in normal mammary epithelial cell strains, but not in most mammary tumor cell lines examined. Southern blot analysis of XbaI-restricted DNA from normal and tumor cells with a maspin cDNA probe revealed no gross structural alterations of the maspin gene in the tumor cells. This result suggested that the maspin gene is downregulated but not mutated in cancer cells. Transfection of mammary carcinoma cells with the maspin gene did not alter the growth properties of the cells in vitro, but reduced their ability to induce tumors and metastasize in nude mice and to invade through a basement membrane matrix in vitro. Analysis of human breast cancer specimens demonstrated that loss of maspin expression occurred most frequently in advanced cancers. These results supported the hypothesis that maspin functions as a tumor suppressor.

Full details of the abovementioned studies are described in the following publications, the disclosure of which are hereby incorporated by reference:

Zou, Z.; Anisowicz, A.; Hendrix, M. J. C.; Thor, A.; Neveu, M.; Sheng, S.; Rafidi, K.; Seftor, E.; Sager, R.: Maspin, a serpin with tumor-suppressing activity in human mammary epithelial cells. Science 263:526-529, 1994; and Futscher, B. W.; Oshiro, M. M.; Wozniak, R. J.; Holtan, N.; Hanigan, C. L.; Duan, H.; Domann, F. E.: Role for DNA methylation in the control of cell type-specific maspin expression. Nat.

Further studies establishing the function and utilities of SERPINB5 are found in John Hopkins OMIM database record ID 154790, and in cited publications listed in Table 5, which are hereby incorporated by reference. Splicing factor 3b, subunit 3, 130 kda (SF3B3, Accession NP_036558.1) is another GAM63 target gene, herein designated TARGET GENE. SF3B3 BINDING SITE is a target binding site found in the 3' untranslated region of mRNA encoded by SF3B3, corresponding to a target binding site such as BINDING SITE I, BINDING SITE II or BINDING SITE III of FIG. 8. Table 4 illustrates the complementarity of the nucleotide sequences of SF3B3 BINDING SITE, designated SEQ ID:10702, to the nucleotide sequence of GAM63 RNA, herein designated GAM RNA, also designated SEQ ID:348.

Another function of GAM63 is therefore inhibition of Splicing factor 3b, subunit 3, 130 kda (SF3B3, Accession NP_036558.1). Accordingly, utilities of GAM63 include diagnosis, prevention and treatment of diseases and clinical conditions associated with SF3B3.

Short stature homeobox (SHOX, Accession NP_000442.1) is another GAM63 target gene, herein designated TARGET GENE. SHOX BINDING SITE is a target binding site found in the 3' untranslated region of multiple transcripts of mRNA encoded by SHOX, corresponding to a target binding site such as BINDING SITE I, BINDING SITE II or BINDING SITE III of FIG. 8. Table 4 illustrates the complementarity of the nucleotide sequences of SHOX BINDING SITE, designated SEQ ID:10815, to the nucleotide sequence of GAM63 RNA, herein designated GAM RNA, also designated SEQ ID:348.

Another function of GAM63 is therefore inhibition of Short stature homeobox (SHOX, Accession NP_000442.1). Accordingly, utilities of GAM63 include diagnosis, prevention and treatment of diseases and clinical conditions associated with SHOX.

Sialyltransferase 1 (beta-galactoside alpha-2,6-sialyltransferase) (SIAT1, Accession NP_775324.1) is another GAM63 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:17508, to the nucleotide sequence of GAM63 RNA, herein designated GAM RNA, also designated SEQ ID:348.

Another function of GAM63 is therefore inhibition of Sialyltransferase 1 (beta-galactoside alpha-2,6-sialyltransferase) (SIAT1, Accession NP_775324.1), a gene which transfers sialic acid from the donor of substrate cmp-sialic acid to galactose containing acceptor substrates. Accordingly, utilities of GAM63 include diagnosis, prevention and treatment of diseases and clinical conditions associated with SIAT1.

The function of SIAT1 and its association with various diseases and clinical conditions, has been established by previous studies, as described hereinabove with reference to GAM40.2. Sialyltransferase 1 (beta-galactoside alpha-2,6-sialytransferase) (SIAT1, Accession NP_775323.1) is another GAM63 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:17508, to the nucleotide sequence of GAM63 RNA, herein designated GAM RNA, also designated SEQ ID:348.

Another function of GAM63 is therefore inhibition of Sialyltransferase 1 (beta-galactoside alpha-2,6-sialyltransferase) (SIAT1, Accession NP_775323.1), a gene which transfers sialic acid from the donor of substrate cmp-sialic acid to galactose containing acceptor substrates. Accordingly, utilities of GAM63 include diagnosis, prevention and treatment of diseases and clinical conditions associated with SIAT1.

The function of SIAT1 and its association with various diseases and clinical conditions, has been established by previous studies, as described hereinabove with reference to GAM40.2. Sialyltransferase 1 (beta-galactoside alpha-2,6-sialytransferase) (SIAT1, Accession NP_003023.1) is another GAM63 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:17508, to the nucleotide sequence of GAM63 RNA, herein designated GAM RNA, also designated SEQ ID:348.

Another function of GAM63 is therefore inhibition of Sialyltransferase 1 (beta-galactoside alpha-2,6-sialyltransferase)

(SIAT1, Accession NP_003023.1), a gene which transfers sialic acid from the donor of substrate cmp-sialic acid to galactose containing acceptor substrates. Accordingly, utilities of GAM63 include diagnosis, prevention and treatment of diseases and clinical conditions associated with SIAT1.

The function of SIAT1 and its association with various diseases and clinical conditions, has been established by previous studies, as described hereinabove with reference to GAM40.2. Sialyltransferase 8e (alpha-2, 8-polysialyltransferase) (SIAT8E, Accession NP_037437.2) is another GAM63 target gene, herein designated TARGET GENE. SIAT8E BINDING SITE is a target binding site found in the 5' untranslated region of mRNA encoded by SIAT8E, corresponding to a target binding site such as BINDING SITE I, BINDING SITE II or BINDING SITE III of FIG. 8. Table 4 illustrates the complementarity of the nucleotide sequences of SIAT8E BINDING SITE, designated SEQ ID:20017, to the nucleotide sequence of GAM63 RNA, herein designated GAM RNA, also designated SEQ ID:348.

Another function of GAM63 is therefore inhibition of Sialyltransferase 8e (alpha-2, 8-polysialyltransferase) (SIAT8E, Accession NP_037437.2). Accordingly, utilities of GAM63 include diagnosis, prevention and treatment of diseases and clinical conditions associated with SIAT8E.

Sialic acid binding ig-like lectin 8 (SIGLEC8, Accession NP_055257.1) is another GAM63 target gene, herein designated TARGET GENE. SIGLEC8 BINDING SITE is a target binding site found in the 3' untranslated region of mRNA encoded by SIGLEC8, corresponding to a target binding site such as BINDING SITE I, BINDING SITE II or BINDING SITE III of FIG. 8. Table 4 illustrates the complementarity of the nucleotide sequences of SIGLEC8 BINDING SITE, designated SEQ ID:7604, to the nucleotide sequence of GAM63 RNA, herein designated GAM RNA, also designated SEQ ID:348.

Another function of GAM63 is therefore inhibition of Sialic acid binding ig-like lectin 8 (SIGLEC8, Accession NP_055257.1), a gene which is a cell adhesion molecule for postnatal neural development. Accordingly, utilities of GAM63 include diagnosis, prevention and treatment of diseases and clinical conditions associated with SIGLEC8.

The function of SIGLEC8 has been established by previous studies. By searching an EST database for sequences similar to CD33, Floyd et al. (2000) identified a cDNA from an eosinophil cDNA library encoding SIGLEC8. Sequence analysis predicted that like other SIGLECs, the 431-amino acid, type 1 transmembrane protein contains a signal peptide, an N-terminal V-set domain, and 2 C2-set domains, as well as 3 potential N-linked glycosylation sites and a transmembrane region; however, SIGLEC8 has a truncated 47- residue cytoplasmic tail lacking the conserved tyrosine-based motifs. Binding analysis confirmed that SIGLEC8 binds to red blood cell sialic acids with a preference for 3-prime over 6-prime sialyllactose-conjugated polyacrylamide. FACS and immunoprecipitation analyses demonstrated SIGLEC8 expression on eosinophils but not other leukocytes as a 45- and 89-kD dimer. Kikly et al. (2000) also cloned SIGLEC8, which they termed SAF2 (sialoadhesin (OMIM Ref. No. 600751) family member-2). Flow cytometric analysis detected strong expression on eosinophils and mast cells and weak but detectable expression on basophils.

Full details of the abovementioned studies are described in the following publications, the disclosure of which are hereby incorporated by reference:

Floy, H.; Ni, J.; Cornish, A. L.; Zeng, Z.; Liu, D.; Carter, K. C.; Steel, J.; Crocker, P. R.: Siglec-8: a novel eosinophil-specific member of the immunoglobulin superfamily. J. Biol. Chem. 275:861-866, 2000; and Kikly, K. K.; Bochner, B. S.; Freeman, S. D.; Tan, K. B.; Gallagher, K. T.; D'alessio, K. J.; Holmes, S. D.; Abrahamson, J. A.; Erickson-Miller, C. L.; Murdock, P. R.; Tachimoto, H.; Schl.

Further studies establishing the function and utilities of SIGLEC8 are found in John Hopkins OMIM database record ID 605639, and in cited publications listed in Table 5, which are hereby incorporated by reference. Src-like-adaptor (SLA, Accession NP_006739.1) is another GAM63 target gene, herein designated TARGET GENE. SLA BINDING SITE is a target binding site found in the 3' untranslated region of mRNA encoded by SLA, corresponding to a target binding site such as BINDING SITE I, BINDING SITE II or BINDING SITE III of FIG. 8. Table 4 illustrates the complementarity of the nucleotide sequences of SLA BINDING SITE, designated SEQ ID:8297, to the nucleotide sequence of GAM63 RNA, herein designated GAM RNA, also designated SEQ ID:348.

Another function of GAM63 is therefore inhibition of Src-like-adaptor (SLA, Accession NP_006739.1), a gene which is a negative regulator of T-cell receptor signaling. Accordingly, utilities of GAM63 include diagnosis, prevention and treatment of diseases and clinical conditions associated with SLA.

The function of SLA has been established by previous studies. Pandey et al. (1995) isolated a mouse cDNA using the 2-hybrid system to screen for molecules that interact with the cytoplasmic domain of Eck, a mouse receptor protein kinase (OMIM Ref. No. 176946). The predicted 281-amino acid protein has both SH3 and SH2 adaptor motifs similar to those in the Src family of nonreceptor tyrosine kinases but had no catalytic domain. The protein was named Slap (Src-like adaptor protein) by the authors. Recombinant Slap was shown to bind to activated Eck receptor tyrosine kinase. Angrist et al. (1995) cloned a cDNA for the putative human homolog of the gene, symbolized SLA. The predicted protein has 87% overall identity to the mouse sequence. Sosinowski et al. (2000) showed that SLA is a negative regulator of T-cell receptor signaling. Holland et al. (2001) demonstrated that SLA and SLA2 (OMIM Ref. No. 606577) are both involved in down-regulating T and B cell-mediated responses.

Full details of the abovementioned studies are described in the following publications, the disclosure of which are hereby incorporated by reference:

Angrist, M.; Wells, D. E.; Chakravarti, A.; Pandey, A.: Chromosomal localization of the mouse Src-like adapter protein (Slap) gene and its putative human homolog SLA. Genomics 30:623-625, 1995; and Sosinowski, T.; Pandey, A.; Dixit, V. M.; Weiss, A.: Src-like adaptor protein (SLAP) is a negative regulator of T cell receptor signaling. J. Exp. Med. 191:463-474, 2000.

Further studies establishing the function and utilities of SLA are found in John Hopkins OMIM database record ID 601099, and in cited publications listed in Table 5, which are hereby incorporated by reference. Solute carrier family 16 (monocarboxylic acid transporters), member 2 (putative transporter) (SLC16A2, Accession NP_006508.1) is another GAM63 target gene, herein designated TARGET GENE. SLC16A2 BINDING SITE is a target binding site found in the 3' untranslated region of mRNA encoded by SLC16A2, corresponding to a target binding site such as BINDING SITE I, BINDING SITE II or BINDING SITE III of FIG. 8. Table 4 illustrates the complementarity of the nucleotide sequences of SLC16A2 BINDING SITE, designated SEQ ID:12766, to the nucleotide sequence of GAM63 RNA, herein designated GAM RNA, also designated SEQ ID:348.

Another function of GAM63 is therefore inhibition of Solute carrier family 16 (monocarboxylic acid transporters), member 2 (putative transporter) (SLC16A2, Accession NP_006508.1). Accordingly, utilities of GAM63 include diagnosis, prevention and treatment of diseases and clinical conditions associated with SLC16A2.

Solute carrier family 21 (organic anion transporter), member 3 (SLC21A3, Accession NP_602307.1) is another GAM63 target gene, herein designated TARGET GENE. SLC21A3 BINDING SITE is a target binding site found in the 3' untranslated region of multiple transcripts of mRNA encoded by SLC21A3, corresponding to a target binding site such as BINDING SITE I, BINDING SITE II or BINDING SITE III of FIG. 8. Table 4 illustrates the complementarity of the nucleotide sequences of SLC21A3 BINDING SITE, designated SEQ ID:7376, to the nucleotide sequence of GAM63 RNA, herein designated GAM RNA, also designated SEQ ID:348.

Another function of GAM63 is therefore inhibition of Solute carrier family 21 (organic anion transporter), member 3 (SLC21A3, Accession NP_602307.1), a gene which mediates the na(+)-independent transport of organic anions such as bsp and conjugated (taurocholate) and unconjugated (cholate) bile acids. Accordingly, utilities of GAM63 include diagnosis, prevention and treatment of diseases and clinical conditions associated with SLC21A3.

The function of SLC21A3 has been established by previous studies. The organic anion transporter (OATP) of liver mediates the basolateral hepatocellular uptake of numerous cholephilic anions and steroidal compounds from sinusoidal blood. By screening a human liver cDNA library with a rat Oatp cDNA, Kullak-Ublick et al. (1995) cloned a cDNA encoding OATP. The deduced 670-amino acid OATP protein has 12 putative transmembrane domains and 8 potential N-linked glycosylation sites. The human and rat OATP proteins are 67% identical. In vitro translation produced unglycosylated and glycosylated human OATP proteins that migrated as 59-kD and 71-kD polypeptides, respectively, in SDS-polyacrylamide gels. Functional studies in Xenopus oocytes showed that OATP mediates sodium-independent transport of the xenobiotic bromosulfophthalein and of endogenous conjugated and unconjugated bile acids. Northern blot analysis detected an approximately 2.7-kb OATP transcript in human liver, brain, lung, kidney, and testis; additional transcripts were also observed. The authors stated that the extrahepatic expression of OATP suggests a general role for OATP in transepithelial organic anion transport Full details of the abovementioned studies are described in the following publications, the disclosure of which are hereby incorporated by reference:

Kullak-Ublick, G. A.; Hagenbuch, B.; Stieger, B.; Schteingart, C. D.; Hofmann, A. F.; Wolkoff, A. W.; Meier, P. J.: Molecular and functional characterization of an organic anion transporting polypeptide cloned from human liver.: Gastroenterology 109:1274-1282, 1995; and By somatic cell hybrid analysis, Kullak-Ublick et al. (1995) mapped the SLC21A3 gene to chromosome 12. Kullak-Ublick et al. (1996) regionally localized the SLC21A3 gene to 12p12 using fluor.

Further studies establishing the function and utilities of SLC21A3 are found in John Hopkins OMIM database record ID 602883, and in cited publications listed in Table 5, which are hereby incorporated by reference. Solute carrier family 21 (organic anion transporter), member 3 (SLC21A3, Accession NP_066580.1) is another GAM63 target gene, herein designated TARGET GENE. SLC21A3 BINDING SITE is a target binding site found in the 3' untranslated region of multiple transcripts of mRNA encoded by SLC21A3, corresponding to a target binding site such as BINDING SITE I, BINDING SITE II or BINDING SITE III of FIG. 8. Table 4 illustrates the complementarity of the nucleotide sequences of SLC21A3 BINDING SITE, designated SEQ ID:7376, to the nucleotide sequence of GAM63 RNA, herein designated GAM RNA, also designated SEQ ID:348.

Another function of GAM63 is therefore inhibition of Solute carrier family 21 (organic anion transporter), member 3 (SLC21A3, Accession NP_066580.1), a gene which mediates the na(+)-independent transport of organic anions such as bsp and conjugated (taurocholate) and unconjugated (cholate) bile acids. Accordingly, utilities of GAM63 include diagnosis, prevention and treatment of diseases and clinical conditions associated with SLC21A3.

The function of SLC21A3 has been established by previous studies. The organic anion transporter (OATP) of liver mediates the basolateral hepatocellular uptake of numerous cholephilic anions and steroidal compounds from sinusoidal blood. By screening a human liver cDNA library with a rat Oatp cDNA, Kullak-Ublick et al. (1995) cloned a cDNA encoding OATP. The deduced 670-amino acid OATP protein has 12 putative transmembrane domains and 8 potential N-linked glycosylation sites. The human and rat OATP proteins are 67% identical. In vitro translation produced unglycosylated and glycosylated human OATP proteins that migrated as 59-kD and 71-kD polypeptides, respectively, in SDS-polyacrylamide gels. Functional studies in Xenopus oocytes showed that OATP mediates sodium-independent transport of the xenobiotic bromosulfophthalein and of endogenous conjugated and unconjugated bile acids. Northern blot analysis detected an approximately 2.7-kb OATP transcript in human liver, brain, lung, kidney, and testis; additional transcripts were also observed. The authors stated that the extrahepatic expression of OATP suggests a general role for OATP in transepithelial organic anion transport Full details of the abovementioned studies are described in the following publications, the disclosure of which are hereby incorporated by reference:

Kullak-Ublick, G. A.; Hagenbuch, B.; Stieger, B.; Schteingart, C. D.; Hofmann, A. F.; Wolkoff, A. W.; Meier, P. J.: Molecular and functional characterization of an organic anion transporting polypeptide cloned from human liver.: Gastroenterology 109:1274-1282, 1995; and By somatic cell hybrid analysis, Kullak-Ublick et al. (1995) mapped the SLC21A3 gene to chromosome 12. Kullak-Ublick et al. (1996) regionally localized the SLC21A3 gene to 12p12 using fluor.

Further studies establishing the function and utilities of SLC21A3 are found in John Hopkins OMIM database record ID 602883, and in cited publications listed in Table 5, which are hereby incorporated by reference. Solute carrier family 24 (sodium/potassium/calcium exchanger), member 3 (SLC24A3, Accession XP_300245.1) is another GAM63 target gene, herein designated TARGET GENE. SLC24A3 BINDING SITE is a target binding site found in the 3' untranslated region of multiple transcripts of mRNA encoded by SLC24A3, corresponding to a target binding site such as BINDING SITE I, BINDING SITE II or BINDING SITE III of FIG. 8. Table 4 illustrates the complementarity of the nucleotide sequences of SLC24A3 BINDING SITE, designated SEQ ID:3098, to the nucleotide sequence of GAM63 RNA, herein designated GAM RNA, also designated SEQ ID:348.

Another function of GAM63 is therefore inhibition of Solute carrier family 24 (sodium/potassium/calcium exchanger), member 3 (SLC24A3, Accession XP_300245.1). Accordingly, utilities of GAM63 include diagnosis, prevention and treatment of diseases and clinical conditions associated with SLC24A3.

Solute carrier family 24 (sodium/potassium/calcium exchanger), member 3 (SLC24A3, Accession NP_065740.2) is another GAM63 target gene, herein designated TARGET GENE. SLC24A3 BINDING SITE is a target binding site found in the 3' untranslated region of multiple transcripts of mRNA encoded by SLC24A3, corresponding to a target binding site such as BINDING SITE I, BINDING SITE II or BINDING SITE III of FIG. 8. Table 4 illustrates the complementarity of the nucleotide sequences of SLC24A3 BINDING SITE, designated SEQ ID:3098, to the nucleotide sequence of GAM63 RNA, herein designated GAM RNA, also designated SEQ ID:348.

Another function of GAM63 is therefore inhibition of Solute carrier family 24 (sodium/potassium/calcium exchanger), member 3 (SLC24A3, Accession NP_065740.2). Accordingly, utilities of GAM63 include diagnosis, prevention and treatment of diseases and clinical conditions associated with SLC24A3.

Solute carrier family 25, member 13 (citrin) (SLC25A13, Accession NP_055066.1) is another GAM63 target gene, herein designated TARGET GENE. SLC25A13 BINDING SITE is a target binding site found in the 3' untranslated region of mRNA encoded by SLC25A13, corresponding to a target binding site such as BINDING SITE I, BINDING SITE II or BINDING SITE III of FIG. 8. Table 4 illustrates the complementarity of the nucleotide sequences of SLC25A13 BINDING SITE, designated SEQ ID:1680, to the nucleotide sequence of GAM63 RNA, herein designated GAM RNA, also designated SEQ ID:348.

Another function of GAM63 is therefore inhibition of Solute carrier family 25, member 13 (citrin) (SLC25A13, Accession NP_055066.1). Accordingly, utilities of GAM63 include diagnosis, prevention and treatment of diseases and clinical conditions associated with SLC25A13.

Solute carrier family 26, member 10 (SLC26A10, Accession NP_597996.1) is another GAM63 target gene, herein designated TARGET GENE. SLC26A10 BINDING SITE is a target binding site found in the 5' untranslated region of mRNA encoded by SLC26A10, corresponding to a target binding site such as BINDING SITE I, BINDING SITE II or BINDING SITE III of FIG. 8. Table 4 illustrates the complementarity of the nucleotide sequences of SLC26A10 BINDING SITE, designated SEQ ID:1293, to the nucleotide sequence of GAM63 RNA, herein designated GAM RNA, also designated SEQ ID:348.

Another function of GAM63 is therefore inhibition of Solute carrier family 26, member 10 (SLC26A10, Accession NP_597996.1). Accordingly, utilities of GAM63 include diagnosis, prevention and treatment of diseases and clinical conditions associated with SLC26A10.

Solute carrier family 39 (zinc transporter), member 4 (SLC39A4, Accession NP_060237.1) is another GAM63 target gene, herein designated TARGET GENE. SLC39A4 BINDING SITE is a target binding site found in the 5' untranslated region of multiple transcripts of mRNA encoded by SLC39A4, corresponding to a target binding site such as BINDING SITE I, BINDING SITE II or BINDING SITE III of FIG. 8. Table 4 illustrates the complementarity of the nucleotide sequences of SLC39A4 BINDING SITE, designated SEQ ID:9715, to the nucleotide sequence of GAM63 RNA, herein designated GAM RNA, also designated SEQ ID:348.

Another function of GAM63 is therefore inhibition of Solute carrier family 39 (zinc transporter), member 4 (SLC39A4, Accession NP_060237.1), a gene which is a zinc transporter and therefore may be associated with Acrodermatitis enteropathica. Accordingly, utilities of GAM63 include diagnosis, prevention and treatment of Acrodermatitis enteropathica, and of other diseases and clinical conditions associated with SLC39A4.

The function of SLC39A4 has been established by previous studies. The SLC39A4 gene encodes a protein with significant similarity to members of the zinc/iron-regulated transporter-like protein (ZIP) family, which are thought to be involved in zinc uptake in Arabidopsis thaliana and humans. Rogers et al. (2000) studied the Arabidopsis root membrane protein IRT1, which is likely to be responsible for uptake of iron from the soil. It also transports other cations, including the essential metals zinc and manganese. By heterologous expression in yeast, Rogers et al. (2000) showed that replacement of a glutamic acid residue at position 103 of wildtype IRT1 with alanine increased the substrate specificity of the transporter by selectively eliminating its ability to transport zinc. Other amino acid substitutions in this protein of the ZIP gene family caused other changes in specificity.

Full details of the abovementioned studies are described in the following publications, the disclosure of which are hereby incorporated by reference:

Rogers, E. E.; Eide, D. J.; Guerinot, M. L.: Altered selectivity in an Arabidopsis metal transporter. Proc. Nat. Acad. Sci. 97:12356-12360, 2000; and Wang, K.; Zhou, B.; Kuo, Y.-M.; Zemansky, J.; Gitschier, J.: A novel member of a zinc transporter family is defective in acrodermatitis enteropathica. Am. J. Hum. Genet. 71:66-73, 2002.

Further studies establishing the function and utilities of SLC39A4 are found in John Hopkins OMIM database record ID 607059, and in cited publications listed in Table 5, which are hereby incorporated by reference. Solute carrier family 6 (neurotransmitter transporter, gaba), member 13 (SLC6A13, Accession NP_057699.2) is another GAM63 target gene, herein designated TARGET GENE. SLC6A13 BINDING SITE is a target binding site found in the 5' untranslated region of mRNA encoded by SLC6A13, corresponding to a target binding site such as BINDING SITE I, BINDING SITE II or BINDING SITE III of FIG. 8. Table 4 illustrates the complementarity of the nucleotide sequences of SLC6A13 BINDING SITE, designated SEQ ID:4114, to the nucleotide sequence of GAM63 RNA, herein designated GAM RNA, also designated SEQ ID:348.

Another function of GAM63 is therefore inhibition of Solute carrier family 6 (neurotransmitter transporter, gaba), member 13 (SLC6A13, Accession NP_057699.2). Accordingly, utilities of GAM63 include diagnosis, prevention and treatment of diseases and clinical conditions associated with SLC6A13.

Solute carrier family 6 (neurotransmitter transporter, noradrenalin), member 2 (SLC6A2, Accession NP_001034.1) is another GAM63 target gene, herein designated TARGET GENE. SLC6A2 BINDING SITE is a target binding site found in the 3' untranslated region of mRNA encoded by SLC6A2, corresponding to a target binding site such as BINDING SITE I, BINDING SITE II or BINDING SITE III of FIG. 8. Table 4 illustrates the complementarity of the nucleotide sequences of SLC6A2 BINDING SITE, designated SEQ ID:6372, to the nucleotide sequence of GAM63 RNA, herein designated GAM RNA, also designated SEQ ID:348.

Another function of GAM63 is therefore inhibition of Solute carrier family 6 (neurotransmitter transporter, noradrenalin), member 2 (SLC6A2, Accession NP_001034.1), a gene which binds to gt and gc boxes promoters elements. Accordingly, utilities of GAM63 include diagnosis, prevention and treatment of diseases and clinical conditions associated with SLC6A2.

The function of SLC6A2 has been established by previous studies. identifying a new gene family for neurotransmitter transporter proteins. Pacholczyk et al. (1991) suggested that analysis of the structure and function of this transporter may aid structure-based drug design for the treatment of human depression and lead to a determination of whether transporter abnormalities underlie affective disorders. Long-term weight-restored patients with anorexia nervosa (OMIM Ref. No. 606788) have lower norepinephrine levels than controls (Kaye et al., 1985; Pirke et al., 1992). Since this may reflect altered reuptake by the norepinephrine transporter, Urwin et al. (2002) hypothesized that the NET gene may be involved in the genetic component of anorexia nervosa. PCR amplification of an AAGG repeat island (AAGG1) in the NET gene promoter region revealed a novel 343-bp sequence with 5 additional AAGG repeat islands (AAGG2-AAGG6). The sequence from AAGG1 to AAGG6, inclusive, was designated the NET gene promoter polymorphic region. A 4-bp deletion or insertion in AAGG4 resulted in the net loss or gain, respectively, of a putative Elk1 transcription factor site. The transmission disequilibrium test with 87 Australian trios (patient plus parents) demonstrated significant preferential transmission of the 4-bp insertion from parent to child with restricting anorexia nervosa (RAN), suggesting that this allele, or a DNA variant in linkage disequilibrium with it, doubles the risk for developing RAN.

Full details of the abovementioned studies are described in the following publications, the disclosure of which are hereby incorporated by reference:

Pacholczy, T.; Blakely, R. D.; Amara, S. G.: Expression cloning of a cocaine- and antidepressant-sensitive human noradrenaline transporter. Nature 350:350-354, 1991; and Urwin, R. E.; Bennetts, B.; Wilcken, B.; Lampropoulos, B.; Beumont, P.; Clarke, S.; Russell, J.; Tanner, S.; Nunn, K. P.: Anorexia nervosa (restrictive subtype) is associated with a poly.

Further studies establishing the function and utilities of SLC6A2 are found in John Hopkins OMIM database record ID 163970, and in cited publications listed in Table 5, which are hereby incorporated by reference. Solute carrier family 9 (sodium/hydrogen exchanger), isoform 1 (antiporter, na+/h+, amiloride sensitive) (SLC9A1, Accession NP_003038.2) is another GAM63 target gene, herein designated TARGET GENE. SLC9A1 BINDING SITE is a target binding site found in the 3' untranslated region of mRNA encoded by SLC9A1, corresponding to a target binding site such as BINDING SITE I, BINDING SITE II or BINDING SITE III of FIG. 8. Table 4 illustrates the complementarity of the nucleotide sequences of SLC9A1 BINDING SITE, designated SEQ ID:9899, to the nucleotide sequence of GAM63 RNA, herein designated GAM RNA, also designated SEQ ID:348.

Another function of GAM63 is therefore inhibition of Solute carrier family 9 (sodium/hydrogen exchanger), isoform 1 (antiporter, na+/h+, amiloride sensitive) (SLC9A1, Accession NP_003038.2), a gene which is involved in ph regulation to eliminate acids generated by active metabolism or to counter adverse environmental conditions. Accordingly, utilities of GAM63 include diagnosis, prevention and treatment of diseases and clinical conditions associated with SLC9A1.

The function of SLC9A1 has been established by previous studies. Denker et al. (2000) showed that the plasma membrane ion exchanger NHE1 acts as an anchor for actin filaments to control the integrity of the cortical cytoskeleton. This occurs through a previously unrecognized structural link between NHE1 and the actin-binding proteins ezrin (OMIM Ref. No. 123900), radixin (OMIM Ref. No. 179410), and moesin (OMIM Ref. No. 309845), which are collectively referred to as ERM proteins. NHE1 and ERM proteins were found to associate directly and colocalize in lamellipodia. Fibroblasts expressing NHE1 with mutations that disrupted binding with ERM proteins but not ion translocation had impaired organization of focal adhesions and actin stress fibers and an irregular cell shape. Denker et al. (2000) proposed a structural role for NHE1 in regulating the cortical cytoskeleton that is independent of its function as an ion exchanger. The genomic probe reported by Mattei et al. (1987) was used to map the APNH gene to 1p36.1-p35 by in situ hybridization (Mattei et al., 1988). Mattei et al. (1989) used in situ hybridization of the human cDNA probe to map the antiporter gene to the distal portion of mouse chromosome 4 and to the long arm of Chinese hamster chromosome 2, confirming the conserved homology between the distal part of human chromosome 1p, the mouse distal 4, and Chinese hamster distal 2q. By the analysis of fragment length variations in recombinant inbred strains, Morahan and Rakar (1993) likewise mapped the Nhe1 gene to mouse chromosome 4, between Lck and Akp2. Lifton et al. (1990) used genomic clones of the SLC9A1 gene to identify 2 polymorphisms. Using these RFLPs in 59 reference families, they found that the antiporter gene lies 3 cM proximal to the RH locus. Dudley et al. (1990) PCR-amplified a 376-bp fragment corresponding to the 5-prime end of SLC9A1 and detected a polymorphism within this fragment by denaturing gradient gel electrophoresis. By genetic linkage studies, they mapped SLC9A1 telomeric to D1S57 and close to RH (OMIM Ref. No. 111700) and ALPL (OMIM Ref. No. 171760). They pointed out that SLC9A1 is a plausible candidate gene for human essential hypertension.

Full details of the abovementioned studies are described in the following publications, the disclosure of which are hereby incorporated by reference:

Denker, S. P.; Huang, D. C.; Orlowski, J.; Furthmay, H.; Barber, D. L.: Direct binding of the Na-H exchanger NHE1 to ERM proteins regulates the cortical cytoskeleton and cell shape independently of H(+) translocation. Molec. Cell 6:1425-1436, 2000; and Dudley, C. R. K.; Giuffra, L. A.; Tippett, P.; Kidd, K. K.; Reeders, S. T.: The Na+/H+ antiporter: a 'melt' polymorphism allows regional mapping to the short arm of chromosome 1. Hum. G.

Further studies establishing the function and utilities of SLC9A1 are found in John Hopkins OMIM database record ID 107310, and in cited publications listed in Table 5, which are hereby incorporated by reference. Solute carrier family 9 (sodium/hydrogen exchanger), isoform 3 regulatory factor 1 (SLC9A3R1, Accession NP_004243.1) is another GAM63 target gene, herein designated TARGET GENE. SLC9A3R1 BINDING SITE is a target binding site found in the 5' untranslated region of mRNA encoded by SLC9A3R1, corresponding to a target binding site such as BINDING SITE I, BINDING SITE II or BINDING SITE III of FIG. 8. Table 4 illustrates the complementarity of the nucleotide sequences of SLC9A3R1 BINDING SITE, designated SEQ ID:10906, to the nucleotide sequence of GAM63 RNA, herein designated GAM RNA, also designated SEQ ID:348.

Another function of GAM63 is therefore inhibition of Solute carrier family 9 (sodium/hydrogen exchanger), isoform 3 regulatory factor 1 (SLC9A3R1, Accession NP_004243.1), a gene which is the regulatory cofactor of the NHE3 (SLC9A3) sodium/hydrogen antiporter. Accordingly, utilities of GAM63 include diagnosis, prevention and treatment of diseases and clinical conditions associated with SLC9A3R1.

The function of SLC9A3R1 has been established by previous studies. Murthy et al. (1998) isolated SLC9A3R1, which they termed NHERF, by screening a fetal frontal cortex cDNA library using a yeast 2- hybrid system with merlin as bait. Northern blot analysis revealed that SLC9A3R1 is ubiquitously expressed, with highest levels in kidney, liver, and pancreas. Deletion and mutation analyses showed that SLC9A3R1 associates with the N terminus but not with the C terminus of merlin. SLC9A3R1 was also shown to bind to moesin and radixin at the N terminus, the region with the most homology to merlin. Using immunocytochemistry, Murthy et al. (1998) demonstrated that SLC9A3R1 colocalizes with moesin at the ruffling membrane, microvilli, and filopodia in HeLa cells Animal model experiments lend further support to the function of SLC9A3R1. Shenolikar et al. (2002) found that targeted disruption of the mouse Nherf1 gene eliminated Nherf1 expression in kidney and other tissues of the mutant mice without altering Nherf2 levels in these tissues. Heterozygous and homozygous deficient male mice maintained normal blood electrolytes but showed increased urinary excretion of phosphate when compared with homozygous wildtype animals. Although the overall levels of renal Nherf1 targets, Slc9a3 and sodium-phosphate transport-2 (Npt2; 182309), were unchanged in the mutant mice, immunocytochemistry showed that the Npt2 protein was aberrantly localized at internal sites in the renal proximal tubule cells. The mislocalization of Npt2 paralleled a reduction in the transporter protein in renal brush-border membranes isolated from the mutant mice. In contrast, Slc9a3 was appropriately localized at the apical surface of proximal tubules in both wildtype and mutant mice. These data suggested that NHERF1 plays a unique role in the apical targeting and/or trafficking of NPT2 in the mammalian kidney, a function not shared by NHERF2 or other renal PDZ proteins. Phosphate wasting seen in the Nherf1 homozygous null mice provided a novel experimental system for defining the role of PDZ adaptors in the hormonal control of ion transport and renal disease It is appreciated that the abovementioned animal model for SLC9A3R1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shenolikar, S.; Voltz, J. W.; Minkoff, C. M.; Wade, J. B.; Weinman, E. J.: Targeted disruption of the mouse NHERF-1 gene promotes internalization of proximal tubule sodium-phosphate cotransporter type IIa and renal phosphate wasting. Proc. Nat. Acad. Sci. 99:11470-11475, 2002; and Murthy, A.; Gonzalez-Agosti, C.; Cordero, E.; Pinney, D.; Candia, C.; Solomon, F.; Gusella, J.; Ramesh, V.: NHE-RF, a regulatory cofactor for Na(+)-H(+) exchange, is a common interactor f.

Further studies establishing the function and utilities of SLC9A3R1 are found in John Hopkins OMIM database record ID 604990, and in cited publications listed in Table 5, which are hereby incorporated by reference. Swi/snf related, matrix associated, actin dependent regulator of chromatin, subfamily d, member 1 (SMARCD1, Accession NP_620710.1) is another GAM63 target gene, herein designated TARGET GENE. SMARCD1 BINDING SITE is a target binding site found in the 3' untranslated region of multiple transcripts of mRNA encoded by SMARCD1, corresponding to a target binding site such as BINDING SITE I, BINDING SITE II or BINDING SITE III of FIG. 8. Table 4 illustrates the complementarity of the nucleotide sequences of SMARCD1 BINDING SITE, designated SEQ ID:12120, to the nucleotide sequence of GAM63 RNA, herein designated GAM RNA, also designated SEQ ID:348.

Another function of GAM63 is therefore inhibition of Swi/snf related, matrix associated, actin dependent regulator of chromatin, subfamily d, member 1 (SMARCD1, Accession NP_620710.1), a gene which is involved in chromatin assembly and remodeling. Accordingly, utilities of GAM63 include diagnosis, prevention and treatment of diseases and clinical conditions associated with SMARCD1.

The function of SMARCD1 and its association with various diseases and clinical conditions, has been established by previous studies, as described hereinabove with reference to GAM42.1. Swi/snf related, matrix associated, actin dependent regulator of chromatin, subfamily d, member 1 (SMARCD1, Accession NP_003067.2) is another GAM63 target gene, herein designated TARGET GENE. SMARCD1 BINDING SITE is a target binding site found in the 3' untranslated region of multiple transcripts of mRNA encoded by SMARCD1, corresponding to a target binding site such as BINDING SITE I, BINDING SITE II or BINDING SITE III of FIG. 8. Table 4 illustrates the complementarity of the nucleotide sequences of SMARCD1 BINDING SITE, designated SEQ ID:12120, to the nucleotide sequence of GAM63 RNA, herein designated GAM RNA, also designated SEQ ID:348.

Another function of GAM63 is therefore inhibition of Swi/snf related, matrix associated, actin dependent regulator of chromatin, subfamily d, member 1 (SMARCD1, Accession NP_003067.2), a gene which is involved in chromatin assembly and remodeling. Accordingly, utilities of GAM63 include diagnosis, prevention and treatment of diseases and clinical conditions associated with SMARCD1.

The function of SMARCD1 and its association with various diseases and clinical conditions, has been established by previous studies, as described hereinabove with reference to GAM42.1. Smcx homolog, x chromosome (mouse) (SMCX, Accession NP_004178.1) is another GAM63 target gene, herein designated TARGET GENE. SMCX BINDING SITE is a target binding site found in the 3' untranslated region of mRNA encoded by SMCX, corresponding to a target binding site such as BINDING SITE I, BINDING SITE II or BINDING SITE III of FIG. 8. Table 4 illustrates the complementarity of the nucleotide sequences of SMCX BINDING SITE, designated SEQ ID:18708, to the nucleotide sequence of GAM63 RNA, herein designated GAM RNA, also designated SEQ ID:348.

Another function of GAM63 is therefore inhibition of Smcx homolog, x chromosome (mouse) (SMCX, Accession NP_004178.1), a gene which escapes X inactivation. Accordingly, utilities of GAM63 include diagnosis, prevention and treatment of diseases and clinical conditions associated with SMCX.

The function of SMCX has been established by previous studies. Agulnik et al. (1994) cloned a gene, designated Smcx, from the mouse X chromosome by its homology to the Y-located gene Smcy. Using direct in situ hybridization, Smcx was mapped to the distal end of the mouse X chromosome (XF2-XF4) and its human homolog, SMCX, was mapped to proximal Xp (Xp11.2-p11.1). Meiotic mapping in the mouse placed Smcx in the interval between Plp and Pdha1. Agulnik et al. (1994) showed that the Smcx gene escapes X inactivation; in hamster/human hybrids, it was expressed when either an active or an inactive human X chromosome was present. Furthermore, 2 alleles of Smcx were found to be expressed in t(16;X)16H female mice despite the intact X chromosome being inactive in all cells. Thus, Smcx is also not subject to X inactivation. Agulnik et al. (1994) stated that this was the first example in the mouse of a gene that escapes X inactivation. Brown et al. (1995) demonstrated that the DXS423E gene (OMIM Ref. No. 300040), which is also located on Xp11.22-p11.21, likewise escapes X chromosome inactivation. Thus, the DXS423E and XE169 genes define a new region in the proximal short arm of the X chromosome that is not subject to X chromosome inactivation. Lingenfelter et al. (1998) showed that Smcx is susceptible to complete X inactivation in a portion of mouse embryonic cells. Furthermore, Smcx inactivation persists in some cells at least until 13.5 days postcoitum. A highly variable Smcx expression found during mouse development progressively disappears in adult tissues where nearly equal expression between alleles is observed Full details of the abovementioned studies are described in the following publications, the disclosure of which are hereby incorporated by reference:

Agulnik, A. I.; Mitchell, M. J.; Mattei, M.-G.; Borsani, G.; Avner, P. A.; Lerner, J. L.; Bishop, C. E.: A novel X gene with a widely transcribed Y-linked homologue escapes X-inactivation in mouse and human. Hum. Molec. Genet. 3:879-884, 1994; and Lingenfelter, P. A.; Adler, D. A.; Poslinski, D.; Thomas, S.; Elliott, R. W.; Chapman, V. M.; Disteche, C. M.: Escape from X inactivation of Smcx is preceded by silencing during mouse deve.

Further studies establishing the function and utilities of SMCX are found in John Hopkins OMIM database record ID 314690, and in cited publications listed in Table 5, which are hereby incorporated by reference. SNRK (Accession NP_060189.2) is another GAM63 target gene, herein designated TARGET GENE. SNRK BINDING SITE is a target binding site found in the 3' untranslated region of mRNA encoded by SNRK, corresponding to a target binding site such as BINDING SITE I, BINDING SITE II or BINDING SITE III of FIG. 8. Table 4 illustrates the complementarity of the nucleotide sequences of SNRK BINDING SITE, designated SEQ ID:17487, to the nucleotide sequence of GAM63 RNA, herein designated GAM RNA, also designated SEQ ID:348.

Another function of GAM63 is therefore inhibition of SNRK (Accession NP_060189.2). Accordingly, utilities of GAM63 include diagnosis, prevention and treatment of diseases and clinical conditions associated with SNRK.

Sorting nexin 7 (SNX7, Accession NP_689424.1) is another GAM63 target gene, herein designated TARGET GENE. SNX7 BINDING SITE is a target binding site found in the 3' untranslated region of multiple transcripts of mRNA encoded by SNX7, corresponding to a target binding site such as BINDING SITE I, BINDING SITE II or BINDING SITE III of FIG. 8. Table 4 illustrates the complementarity of the nucleotide sequences of SNX7 BINDING SITE, designated SEQ ID:16240, to the nucleotide sequence of GAM63 RNA, herein designated GAM RNA, also designated SEQ ID:348.

Another function of GAM63 is therefore inhibition of Sorting nexin 7 (SNX7, Accession NP_689424.1). Accordingly, utilities of GAM63 include diagnosis, prevention and treatment of diseases and clinical conditions associated with SNX7.

Sorting nexin 7 (SNX7, Accession NP_057060.1) is another GAM63 target gene, herein designated TARGET GENE. SNX7 BINDING SITE is a target binding site found in the 3' untranslated region of multiple transcripts of mRNA encoded by SNX7, corresponding to a target binding site such as BINDING SITE I, BINDING SITE II or BINDING SITE III of FIG. 8. Table 4 illustrates the complementarity of the nucleotide sequences of SNX7 BINDING SITE, designated SEQ ID:16240, to the nucleotide sequence of GAM63 RNA, herein designated GAM RNA, also designated SEQ ID:348.

Another function of GAM63 is therefore inhibition of Sorting nexin 7 (SNX7, Accession NP_057060.1). Accordingly, utilities of GAM63 include diagnosis, prevention and treatment of diseases and clinical conditions associated with SNX7.

Sry (sex determining region y)-box 9 (campomelic dysplasia, autosomal sex-reversal) (SOX9, Accession NP_000337.1) is another GAM63 target gene, herein designated TARGET GENE. SOX9 BINDING SITE is a target binding site found in the 3' untranslated region of mRNA encoded by SOX9, corresponding to a target binding site such as BINDING SITE I, BINDING SITE II or BINDING SITE III of FIG. 8. Table 4 illustrates the complementarity of the nucleotide sequences of SOX9 BINDING SITE, designated SEQ ID:14587, to the nucleotide sequence of GAM63 RNA, herein designated GAM RNA, also designated SEQ ID:348.

Another function of GAM63 is therefore inhibition of Sry (sex determining region y)-box 9 (campomelic dysplasia, autosomal sex-reversal) (SOX9, Accession NP_000337.1), a gene which regulates the expression of other genes involved in chondrogenesis. Accordingly, utilities of GAM63 include diagnosis, prevention and treatment of diseases and clinical conditions associated with SOX9.

The function of SOX9 has been established by previous studies. Murakami et al. (2000) showed that expression of Sox9 is upregulated by fibroblast growth factors (FGFs; OMIM Ref. No. 601513) in primary chondrocytes and in Sox9-expressing mesenchymal cells. They further presented evidence that FGF stimulation of Sox9 expression is mediated by the mitogen-activated protein kinase (MAPK) cascade (see OMIM Ref. No. 176948) a signal transduction pathway that is activated by growth factors such as FGF. The data strongly suggested that FGF and the MAPK pathway play an important role in the regulation of Sox9 expression during chondrocyte differentiation, Bi et al. (2001) proposed that Sox9 also has a role in regulating the transition to hypertrophic chondrocytes in the growth plate. Despite the severe hypoplasia of cartilages, the overall organization and cellular composition of the growth plate were otherwise normal. The results suggested that 2 critical steps of the chondrocyte differentiation pathway are sensitive to Sox9 dosage: an early step presumably at the stage of mesenchymal condensation of cartilage primordia, and a later step preceding the transition of chondrocytes into hypertrophic chondrocytes.

Full details of the abovementioned studies are described in the following publications, the disclosure of which are hereby incorporated by reference:

Murakami, S.; Kan, M.; McKeehan, W. L.; de Crombrugghe, B.: Up-regulation of the chondrogenic Sox9 gene by fibroblast growth factors is mediated by the mitogen- activated protein kinase pathway. Proc. Nat. Acad. Sci. 97:1113-1118, 2000; and Bi, W.; Huang, W.; Whitworth, D. J.; Deng, J. M.; Zhang, Z.; Behringer, R. R.; de Crombrugghe, B.: Haploinsufficiency of Sox9 results in defective cartilage primordia and premature skelet.

Further studies establishing the function and utilities of SOX9 are found in John Hopkins OMIM database record ID 114290, and in cited publications listed in Table 5, which are hereby incorporated by reference. Synovial sarcoma, x breakpoint 1 (SSX1, Accession NP_005626.1) is another GAM63 target gene, herein designated TARGET GENE. SSX1 BINDING SITE is a target binding site found in the 3' untranslated region of mRNA encoded by SSX1, corresponding to a target binding site such as BINDING SITE I, BINDING SITE II or BINDING SITE III of FIG. 8. Table 4 illustrates the complementarity of the nucleotide sequences of SSX1 BINDING SITE, designated SEQ ID:2767, to the nucleotide sequence of GAM63 RNA, herein designated GAM RNA, also designated SEQ ID:348.

Another function of GAM63 is therefore inhibition of Synovial sarcoma, x breakpoint 1 (SSX1, Accession NP_005626.1), a gene which may act as a modulator of transcription. and therefore may be associated with Synovial sarcoma. Accordingly, utilities of GAM63 include diagnosis, prevention and treatment of Synovial sarcoma, and of other diseases and clinical conditions associated with SSX1.

The function of SSX1 has been established by previous studies. Synovial sarcoma, according to the experience of Enzinger and Weiss (1983), is the fourth most common type of soft tissue sarcoma. It usually develops in adolescents and young adults, is more common in males than in females, and has no racial predilection. Turc-Carel et al. (1987) found a translocation involving chromosome X (band p11.2) and chromosome 18 (band q11.2) in short-term cultures of cells from 5 synovial sarcomas and 1 malignant fibrous histiocytoma. In 4 of the tumors, the translocation t(X;18)(p11.2; q11.2) was reciprocal. The 2 other tumors had complex translocations, which, however, always involved chromosomes X and 18 at the 2 sites mentioned. The X;18 translocation was not detected in other histologic types of soft tissue sarcoma. This was the first description of a sex chromosome abnormality in a human solid tumor. Griffin and Emanuel (1987) confirmed the original findings of Turc-Carel et al. (1987). The karyotype of the tumor in their patient was 46,XX,t(X;18)(p11;q11). It may be significant that the ARAF1 oncogene (OMIM Ref. No. 311010) maps to the same region. Inactivation of the normal X chromosome in cells carrying the X/autosome translocation may result in loss of expression of the normal allele and allow expression of the altered gene at the breakpoint on the X chromosome. This phenomenon permitted localization of the gene for Duchenne muscular dystrophy (DMD; 300377) and a number of other autosomal recessive disorders that have been observed in females with X/autosome translocations. Smith et al. (1987) identified the translocation t(X;18)(p11.2;q11.2) in every cell analyzed from each of 3 synovial sarcomas. Karakousis et al. (1987) found a specific translocation between the X chromosome and chromosome 18 in 6 cases of synovial sarcoma. Wang-Wuu et al. (1987) likewise found t(X;18) in a case of synovial sarcoma. In a 13-year-old Japanese girl, Ueda et al. (1988) found t(X;18) in a synovial sarcoma, together with an insertion of chromosome 11q material into 15q. Knight et al. (1989) noted that the oncogene ARAF1 is not directly involved in the X;18 translocation. Miozzo et al. (1992) reported the instructive case of a patient with the Turner syndrome in whom the only X chromosome was involved in a translocation of typical form: t(X;18)(p11;q11). Knight et al. (1992) examined a hybrid cell line by Southern analysis using 13 additional markers located at Xp11.3-cen. The location of the breakpoint was further confirmed by fluorescence in situ hybridization. Two YAC probes of 300 kb and 450 kb, containing the OATL2 locus (OMIM Ref. No. 311241), hybridized to both derivative chromosomes, indicating that these YACs span the translocation breakpoint. Similar results were obtained with 2 independent cell lines carrying the translocation. Sinke et al. (1993) concluded that the translocation breakpoint in Xp11.2 that is associated with synovial sarcoma is different from the translocation breakpoint in Xp11.2 associated with renal adenocarcinoma (see OMIM Ref. No. 314310). By screening a synovial sarcoma cDNA library with a YAC spanning the X chromosome breakpoint, Clark et al. (1994) identified a hybrid transcript that contained 5-prime sequences (designated OMIM Ref. No. SSXT; 600192) mapping to chromosome 18 and 3-prime sequences (designated SSX by them) mapping to the X chromosome. An SYT probe detected genomic rearrangements in 10 of 13 synovial sarcomas. Sequencing of cDNA clones showed that the normal SYT gene encodes a protein rich in glutamine, proline, and glycine and that in synovial sarcoma, rearrangement of the SYT gene results in the formation of an SYT-SSX fusion protein. Both SYT and SSX failed to exhibit significant homology to known gene sequences.

Full details of the abovementioned studies are described in the following publications, the disclosure of which are hereby incorporated by reference:

Clark, J.; Rocques, P. J.; Crew, A. J.; Gill, S.; Shipley, J.; Chan, A. M.-L.; Gusterson, B. A.; Cooper, C. S.: Identification of novel genes, SYT and SSX, involved in the t(X;18)(p11.2;q11.2) translocation found in human synovial sarcoma. Nature Genet. 7:502-508, 1994; and Turc-Carel, C.; Dal Cin, P.; Limon, J.; Rao, U.; Li, F. P.; Corson, J. M.; Zimmerman, R.; Parry, D. M.; Cowan, J. M.; Sandberg, A. A.: Involvement of chromosome X in primary cytogenet.

Further studies establishing the function and utilities of SSX1 are found in John Hopkins OMIM database record ID 312820, and in cited publications listed in Table 5, which are hereby incorporated by reference. Synovial sarcoma, x breakpoint 8 (SSX8, Accession NP_777621.1) is another GAM63 target gene, herein designated TARGET GENE. SSX8 BINDING SITE is a target binding site found in the 3' untranslated region of mRNA encoded by SSX8, corresponding to a target binding site such as BINDING SITE I, BINDING SITE II or BINDING SITE III of FIG. 8. Table 4 illustrates the complementarity of the nucleotide sequences of SSX8 BINDING SITE, designated SEQ ID:2767, to the nucleotide sequence of GAM63 RNA, herein designated GAM RNA, also designated SEQ ID:348.

Another function of GAM63 is therefore inhibition of Synovial sarcoma, x breakpoint 8 (SSX8, Accession NP_777621.1). Accordingly, utilities of GAM63 include diagnosis, prevention and treatment of diseases and clinical conditions associated with SSX8.

ST6GALNAC6 (Accession NP_038471.2) is another GAM63 target gene, herein designated TARGET GENE. ST6GALNAC6 BINDING SITE is a target binding site found in the 3' untranslated region of mRNA encoded by ST6GALNAC6, corresponding to a target binding site such as BINDING SITE I, BINDING SITE II or BINDING SITE III of FIG. 8. Table 4 illustrates the complementarity of the nucleotide sequences of ST6GALNAC6 BINDING SITE, designated SEQ ID:1576, to the nucleotide sequence of GAM63 RNA, herein designated GAM RNA, also designated SEQ ID:348.

Another function of GAM63 is therefore inhibition of ST6GALNAC6 (Accession NP_038471.2). Accordingly, utilities of GAM63 include diagnosis, prevention and treatment of diseases and clinical conditions associated with ST6GALNAC6.

Sulfotransferase family 4a, member 1 (SULT4A1, Accession NP_795343.1) is another GAM63 target gene, herein designated TARGET GENE. SULT4A1 BINDING SITE is a target binding site found in the 3' untranslated region of multiple transcripts of mRNA encoded by SULT4A1, corresponding to a target binding site such as BINDING SITE I, BINDING SITE II or BINDING SITE III of FIG. 8. Table 4 illustrates the complementarity of the nucleotide sequences of SULT4A1 BINDING SITE, designated SEQ ID:12034, to the nucleotide sequence of GAM63 RNA, herein designated GAM RNA, also designated SEQ ID:348.

Another function of GAM63 is therefore inhibition of Sulfotransferase family 4a, member 1 (SULT4A1, Accession NP_795343.1). Accordingly, utilities of GAM63 include diagnosis, prevention and treatment of diseases and clinical conditions associated with SULT4A1.

Synaptogyrin 1 (SYNGR1, Accession NP_004702.2) is another GAM63 target gene, herein designated TARGET GENE. SYNGR1 BINDING SITE is a target binding site found in the 3' untranslated region of multiple transcripts of mRNA encoded by SYNGR1, corresponding to a target binding site such as BINDING SITE I, BINDING SITE II or BINDING SITE III of FIG. 8. Table 4 illustrates the complementarity of the nucleotide sequences of SYNGR1 BINDING SITE, designated SEQ ID:8617, to the nucleotide sequence of GAM63 RNA, herein designated GAM RNA, also designated SEQ ID:348.

Another function of GAM63 is therefore inhibition of Synaptogyrin 1 (SYNGR1, Accession NP_004702.2), a gene which belongs to transmembrane synaptic vesicle protein and may function in membrane recycling. Accordingly, utilities of GAM63 include diagnosis, prevention and treatment of diseases and clinical conditions associated with SYNGR1.

The function of SYNGR1 has been established by previous studies. Rat synaptogyrin, or RATSYNGR1, is an integral membrane protein associated with presynaptic vesicles in neuronal cells. See SYNGR2 (OMIM Ref. No. 603926). As part of an effort to sequence the long arm of human chromosome 22, Kedra et al. (1998) identified the human homolog of RATSYNGR1, synaptogyrin-1 (OMIM Ref. No. SYNGR1). By a combination of EST database searching and library screening, the authors isolated cDNAs corresponding to 3 alternatively spliced transcripts, which they designated SYNGR1a-c. The predicted 1a, 1b, and 1c proteins contain 234, 191, and 192 amino acids, respectively. Northern blot analysis revealed that the 4.5-kb SYNGR1a mRNA is expressed at high levels in brain. The other transcript forms are expressed at low levels in nonneuronal tissues. In situ hybridization to embryonic and adult mouse tissues confirmed that SYNGR1a, the most abundant transcript form, shows predominantly neuronal expression. Kedra et al. (1998) also identified cDNAs encoding the related human proteins SYNGR2 and SYNGR3 (OMIM Ref. No. 603927) and mouse Syngr1b. Like RATSYNGR1, the mouse and human synaptogyrin family members contain 4 membrane-spanning domains. The conserved central portion of SYNGR1a shares 54%, 61%, and 92% identity with that of SYNGR2, SYNGR3, and RATSYNGR1, respectively.

Animal model experiments lend further support to the function of SYNGR1. Using gene targeting, Janz et al. (1999) generated mice lacking Syngr1. They bred these Syngr1 knockout mice against Syp (OMIM Ref. No. 313475) knockout mice generated by McMahon et al. (1996) to create double knockout mice deficient in both Syp and Syngr1. Both single and double knockout mice were viable and fertile. Morphologic and biochemical analysis showed that the architecture and composition of synapses were unaltered in the brains of Syngr1 single knockout and Syngr1/Syp double knockout mutant mice. Electrophysiologic recordings in the hippocampal CA1 region revealed that short- and long-term synaptic plasticity was severely reduced in the Syngr1/Syp double knockout mice without changes in the fundamental release apparatus, vesicle cycling, or release probability. Janz et al. (1999) concluded that Syngr1 and Syp perform essential and redundant functions in synaptic plasticity without being required for synaptic transmission as such.

It is appreciated that the abovementioned animal model for SYNGR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Janz, R.; Sudhof, T. C.; Hammer, R. E.; Unni, V.; Siegelbaum, S. A.; Bolshakov, V. Y.: Essential roles in synaptic plasticity for synaptogyrin I and synaptophysin I. Neuron 24:687-700, 1999; and Kedra, D.; Pan, H.-Q.; Seroussi, E.; Fransson, I.; Guilbaud, C.; Collins, J. E.; Dunham, I.; Blennow, E.; Roe, B. A.; Piehl, F.; Dumanski, J. P.: Characterization of the human synapto.

Further studies establishing the function and utilities of SYNGR1 are found in John Hopkins OMIM database record ID 603925, and in cited publications listed in Table 5, which are hereby incorporated by reference. Transforming, acidic coiled-coil containing protein 1 (TACC1, Accession NP_006274.1) is another GAM63 target gene, herein designated TARGET GENE. TACC1 BINDING SITE is a target binding site found in the 3' untranslated region of mRNA encoded by TACC1, corresponding to a target binding site such as BINDING SITE I, BINDING SITE II or BINDING SITE III of FIG. 8. Table 4 illustrates the complementarity of the nucleotide sequences of TACC1 BINDING SITE, designated SEQ ID:3381, to the nucleotide sequence of GAM63 RNA, herein designated GAM RNA, also designated SEQ ID:348.

Another function of GAM63 is therefore inhibition of Transforming, acidic coiled-coil containing protein 1 (TACC1, Accession NP_006274.1). Accordingly, utilities of GAM63 include diagnosis, prevention and treatment of diseases and clinical conditions associated with TACC1.

Transcription elongation factor a (sii), 3 (TCEA3, Accession XP_114075.1) is another GAM63 target gene, herein designated TARGET GENE. TCEA3 BINDING SITE is a target binding site found in the 3' untranslated region of mRNA encoded by TCEA3, corresponding to a target binding site such as BINDING SITE I, BINDING SITE II or BINDING SITE III of FIG. 8. Table 4 illustrates the complementarity of the nucleotide sequences of TCEA3 BINDING SITE, designated SEQ ID:9591, to the nucleotide sequence of GAM63 RNA, herein designated GAM RNA, also designated SEQ ID:348.

Another function of GAM63 is therefore inhibition of Transcription elongation factor a (sii), 3 (TCEA3, Accession XP_114075.1). Accordingly, utilities of GAM63 include diagnosis, prevention and treatment of diseases and clinical conditions associated with TCEA3.

T-cell leukemia translocation altered gene (TCTA, Accession NP_071503.1) is another GAM63 target gene, herein designated TARGET GENE. TCTA BINDING SITE1 and TCTA BINDING SITE2 are target binding sites found in untranslated regions of mRNA encoded by TCTA, corresponding to target binding sites such as BINDING SITE I, BINDING SITE II or BINDING SITE III of FIG. 8. Table 4 illustrates the complementarity of the nucleotide sequences of TCTA BINDING SITE1 and TCTA BINDING SITE2, designated SEQ ID:9236 and SEQ ID:8960 respectively, to the nucleotide sequence of GAM63 RNA, herein designated GAM RNA, also designated SEQ ID:348.

Another function of GAM63 is therefore inhibition of T-cell leukemia translocation altered gene (TCTA, Accession NP_071503.1). Accordingly, utilities of GAM63 include diagnosis, prevention and treatment of diseases and clinical conditions associated with TCTA.

TEM7 (Accession NP_065138.2) is another GAM63 target gene, herein designated TARGET GENE. TEM7 BINDING SITE is a target binding site found in the 3' untranslated region of mRNA encoded by TEM7, corresponding to a target binding site such as BINDING SITE I, BINDING SITE II or BINDING SITE III of FIG. 8. Table 4 illustrates the complementarity of the nucleotide sequences of TEM7 BINDING SITE, designated SEQ ID:7488, to the nucleotide sequence of GAM63 RNA, herein designated GAM RNA, also designated SEQ ID:348.

Another function of GAM63 is therefore inhibition of TEM7 (Accession NP_065138.2), a gene which involves in angiogenesis and therefore may be associated with Colorectal cancer. Accordingly, utilities of GAM63 include diagnosis, prevention and treatment of Colorectal cancer, and of other diseases and clinical conditions associated with TEM7.

The function of TEM7 has been established by previous studies. Using Ser. analysis of gene expression (SAGE), St Croix et al. (2000) identified partial cDNAs corresponding to several tumor endothelial markers (TEMs) that displayed elevated expression during tumor angiogenesis. Among the genes they identified was TEM7. Using database searches and 5-prime RACE, Carson-Walter et al. (2001) derived sequences covering the entire TEM7 coding region, which encodes a 500-amino acid type I transmembrane protein containing a plexin-like domain. An alternate transcript of the TEM7 gene had been designated TEM3 by St Croix et al. (2000). TEM3 and TEM7 differ in the use of alternative polyadenylation sites but result in the same predicted protein. The mouse ortholog of TEM7 shares 81% amino acid identity with the human protein. In situ hybridization analysis of human colorectal cancer by Carson-Walter et al. (2001) demonstrated that TEM7 was expressed clearly in the endothelial cells of the tumor stroma but not in the endothelial cells of normal colonic tissue. Using in situ hybridization to assay expression in various normal adult mouse tissues, they observed that Tem7 was largely undetectable in mouse tissues or tumors, but was abundantly expressed in mouse brain. Carson-Walter et al. (2001) localized Tem7 expression to Purkinje cells of the cerebellum and some neuronal cells.

Full details of the abovementioned studies are described in the following publications, the disclosure of which are hereby incorporated by reference:

Carson-Walter, E. B.; Watkins, D. N.; Nanda, A.; Vogelstein, B.; Kinzler, K. W.; St. Croix, B.: Cell surface tumor endothelial markers are conserved in mice and humans. Cancer Res. 61:6649-6655, 2001; and St. Croix, B.; Rago, C.; Velculescu, V.; Traverso, G.; Romans, K. E.; Montgomery, E.; Lal, A.; Riggins, G. J.; Lengauer, C.; Vogelstein, B.; Kinzler, K. W.: Genes expressed in human tu.

Further studies establishing the function and utilities of TEM7 are found in John Hopkins OMIM database record ID 606826, and in cited publications listed in Table 5, which are hereby incorporated by reference. Tgfb-induced factor (tale family homeobox) (TGIF, Accession NP_775303.1) is another GAM63 target gene, herein designated TARGET GENE. TGIF BINDING SITE is a target binding site found in the 3' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14985, to the nucleotide sequence of GAM63 RNA, herein designated GAM RNA, also designated SEQ ID:348.

Another function of GAM63 is therefore inhibition of Tgfb-induced factor (tale family homeobox) (TGIF, Accession NP_775303.1). Accordingly, utilities of GAM63 include diagnosis, prevention and treatment of diseases and clinical conditions associated with TGIF.

Tgfb-induced factor (tale family homeobox) (TGIF, Accession NP_775299.1) is another GAM63 target gene, herein designated TARGET GENE. TGIF BINDING SITE is a target binding site found in the 3' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14985, to the nucleotide sequence of GAM63 RNA, herein designated GAM RNA, also designated SEQ ID:348.

Another function of GAM63 is therefore inhibition of Tgfb-induced factor (tale family homeobox) (TGIF, Accession NP_775299.1). Accordingly, utilities of GAM63 include diagnosis, prevention and treatment of diseases and clinical conditions associated with TGIF.

Tgfb-induced factor (tale family homeobox) (TGIF, Accession NP_775302.1) is another GAM63 target gene, herein designated TARGET GENE. TGIF BINDING SITE is a target binding site found in the 3' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14985, to the nucleotide sequence of GAM63 RNA, herein designated GAM RNA, also designated SEQ ID:348.

Another function of GAM63 is therefore inhibition of Tgfb-induced factor (tale family homeobox) (TGIF, Accession NP_775302.1). Accordingly, utilities of GAM63 include diagnosis, prevention and treatment of diseases and clinical conditions associated with TGIF.

Tgfb-induced factor (tale family homeobox) (TGIF, Accession NP_775300.1) is another GAM63 target gene, herein designated TARGET GENE. TGIF BINDING SITE is a target binding site found in the 3' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14985, to the nucleotide sequence of GAM63 RNA, herein designated GAM RNA, also designated SEQ ID:348.

Another function of GAM63 is therefore inhibition of Tgfb-induced factor (tale family homeobox) (TGIF, Accession NP_775300.1). Accordingly, utilities of GAM63 include diagnosis, prevention and treatment of diseases and clinical conditions associated with TGIF.

Tgfb-induced factor (tale family homeobox) (TGIF, Accession NP_733796.2) is another GAM63 target gene, herein designated TARGET GENE. TGIF BINDING SITE is a target binding site found in the 3' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14985, to the nucleotide sequence of GAM63 RNA, herein designated GAM RNA, also designated SEQ ID:348.

Another function of GAM63 is therefore inhibition of Tgfb-induced factor (tale family homeobox) (TGIF, Accession NP_733796.2). Accordingly, utilities of GAM63 include diagnosis, prevention and treatment of diseases and clinical conditions associated with TGIF.

Tgfb-induced factor (tale family homeobox) (TGIF, Accession NP_775301.1) is another GAM63 target gene, herein designated TARGET GENE. TGIF BINDING SITE is a target binding site found in the 3' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14985, to the nucleotide sequence of GAM63 RNA, herein designated GAM RNA, also designated SEQ ID:348.

Another function of GAM63 is therefore inhibition of Tgfb-induced factor (tale family homeobox) (TGIF, Accession NP_775301.1). Accordingly, utilities of GAM63 include diagnosis, prevention and treatment of diseases and clinical conditions associated with TGIF.

Tgfb-induced factor (tale family homeobox) (TGIF, Accession NP_003235.1) is another GAM63 target gene, herein designated TARGET GENE. TGIF BINDING SITE is a target binding site found in the 3' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14985, to the nucleotide sequence of GAM63 RNA, herein designated GAM RNA, also designated SEQ ID:348.

Another function of GAM63 is therefore inhibition of Tgfb-induced factor (tale family homeobox) (TGIF, Accession NP_003235.1). Accordingly, utilities of GAM63 include diagnosis, prevention and treatment of diseases and clinical conditions associated with TGIF.

Tgfb-induced factor (tale family homeobox) (TGIF, Accession NP_777480.1) is another GAM63 target gene, herein designated TARGET GENE. TGIF BINDING SITE is a target binding site found in the 3' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14985, to the nucleotide sequence of GAM63 RNA, herein designated GAM RNA, also designated SEQ ID:348.

Another function of GAM63 is therefore inhibition of Tgfb-induced factor (tale family homeobox) (TGIF, Accession NP_777480.1). Accordingly, utilities of GAM63 include diagnosis, prevention and treatment of diseases and clinical conditions associated with TGIF.

Thrombopoietin (myeloproliferative leukemia virus oncogene ligand, megakaryocyte growth and development factor) (THPO, Accession NP_000451.1) is another GAM63 target gene, herein designated TARGET GENE. THPO BINDING SITE is a target binding site found in the 5' untranslated region of mRNA encoded by THPO, corresponding to a target binding site such as BINDING SITE I, BINDING SITE II or BINDING SITE III of FIG. 8. Table 4 illustrates the complementarity of the nucleotide sequences of THPO BINDING SITE, designated SEQ ID:15986, to the nucleotide sequence of GAM63 RNA, herein designated GAM RNA, also designated SEQ ID:348.

Another function of GAM63 is therefore inhibition of Thrombopoietin (myeloproliferative leukemia virus oncogene ligand, megakaryocyte growth and development factor) (THPO, Accession NP_000451.1), a gene which binds to c-Mpl receptor and regulates megakaryocyte development and therefore may be associated with Essential thrombocythemia. Accordingly, utilities of GAM63 include diagnosis, prevention and treatment of Essential thrombocythemia, and of other diseases and clinical conditions associated with THPO.

The function of THPO has been established by previous studies. Bartley et al. (1994) reported the identification and cloning of a megakaryocyte growth and development factor (MGDF) from canine, murine, and human sources. Human, dog, and mouse cDNAs for MGDF are highly conserved and encode open reading frames for proteins of 353, 352, and 356 amino acids, respectively. Both canine and recombinant human MGDF support the development of megakaryocytes from human CD34(+) progenitor cell populations. MGDF binds to Mpl affinity columns, and its biologic effects are inhibited by the soluble extracellular domain of Mpl, suggesting that MGDF is a cytokine that regulates megakaryocyte development and is a ligand for the MPL receptor. Farese et al. (1996) reported that administration of a pegylated form of recombinant MGDF (PEG-MGDF) significantly induced bone marrow regeneration compared with rMGDF untreated with PEG. When combined with recombinant G-CSF, PEG-MGDF significantly enhanced multilineage hematopoietic recovery with no evidence of lineage competition. Ratajczak et al. (1997) found that in the presence of erythropoietin (OMIM Ref. No. 133170) and interleukin-3 (OMIM Ref. No. 147740), THPO was able to stimulate a small increase in erythroid colony formation in culture. Other studies suggested that THPO has little direct stimulatory effect on erythroid progenitor cells but may indirectly enhance erythropoiesis by preventing very early erythroid progenitor cells from undergoing apoptotic cell death. Essential thrombocythemia (OMIM Ref. No. 187950) is a chronic myeloproliferative syndrome due to sustained proliferation of megakaryocytes, which results in elevated numbers of circulating platelets, thrombotic or hemorrhagic episodes, and occasional leukemic transformation. Hereditary thrombocythemia with autosomal dominant transmission has been described with manifestations similar to those of sporadic essential thrombocythemia. As the THPO gene encodes a lineage-restricted growth factor with profound stimulatory effects on megakaryopoiesis and platelet production, Wiestner et al. (1998) tested the hypothesis that mutation in this gene might be responsible for the disorder in a Dutch family with 11 affected individuals. TPO protein concentrations in serum were consistently elevated in affected members of this family. Using an intragenic CA marker for the THPO gene, they demonstrated linkage to the disorder; lod score =3.5 at theta =0.0. Affected members were found to carry a splice donor mutation (600044.0001) that led to THPO mRNAs with shortened 5-prime untranslated regions that were more efficiently translated than the normal THPO transcripts.

Full details of the abovementioned studies are described in the following publications, the disclosure of which are hereby incorporated by reference:

Bartley, T. D.; Bogenberger, J.; Hunt, P.; Li, Y.-S.; Lu, H. S.; Martin, F.; Chang, M.-S.; Samal, B.; Nichol, J. L.; Swift, S.; Johnson, M. J.; Hsu, R.-Y.; and 41 others: Identification and cloning of a megakaryocyte growth and development factor that is a ligand for the cytokine receptor Mpl. Cell 77:1117-1124, 1994; and Wiestner, A.; Schlemper, R. J.; van der Maas, A. P. C.; Skoda, R. C.: An activating splice donor mutation in the thrombopoietin gene causes hereditary thrombocythaemia. Nature Genet.

Further studies establishing the function and utilities of THPO are found in John Hopkins OMIM database record ID 600044, and in cited publications listed in Table 5, which are hereby incorporated by reference. Translocase of inner mitochondrial membrane 9 homolog (yeast) (TIMM9, Accession NP_036592.1) is another GAM63 target gene, herein designated TARGET GENE. TIMM9 BINDING SITE is a target binding site found in the 5' untranslated region of mRNA encoded by TIMM9, corresponding to a target binding site such as BINDING SITE I, BINDING SITE II or BINDING SITE III of FIG. 8. Table 4 illustrates the complementarity of the nucleotide sequences of TIMM9 BINDING SITE, designated SEQ ID:8618, to the nucleotide sequence of GAM63 RNA, herein designated GAM RNA, also designated SEQ ID:348.

Another function of GAM63 is therefore inhibition of Translocase of inner mitochondrial membrane 9 homolog (yeast) (TIMM9, Accession NP_036592.1). Accordingly, utilities of GAM63 include diagnosis, prevention and treatment of diseases and clinical conditions associated with TIMM9.

TIP-1 (Accession NP_055419.1) is another GAM63 target gene, herein designated TARGET GENE. TIP-1 BINDING SITE is a target binding site found in the 3' untranslated region of mRNA encoded by TIP-1, corresponding to a target binding site such as BINDING SITE I, BINDING SITE II or BINDING SITE III of FIG. 8. Table 4 illustrates the complementarity of the nucleotide sequences of TIP-1 BINDING SITE, designated SEQ ID:10187, to the nucleotide sequence of GAM63 RNA, herein designated GAM RNA, also designated SEQ ID:348.

Another function of GAM63 is therefore inhibition of TIP-1 (Accession NP_055419.1). Accordingly, utilities of GAM63 include diagnosis, prevention and treatment of diseases and clinical conditions associated with TIP-1.

Triple homeobox 1 (TIX1, Accession NP_055850.1) is another GAM63 target gene, herein designated TARGET GENE. TIX1 BINDING SITE is a target binding site found in the 3' untranslated region of mRNA encoded by TIX1, corresponding to a target binding site such as BINDING SITE I, BINDING SITE II or BINDING SITE III of FIG. 8. Table 4 illustrates the complementarity of the nucleotide sequences of TIX1 BINDING SITE, designated SEQ ID:4786, to the nucleotide sequence of GAM63 RNA, herein designated GAM RNA, also designated SEQ ID:348.

Another function of GAM63 is therefore inhibition of Triple homeobox 1 (TIX1, Accession NP_055850.1). Accordingly, utilities of GAM63 include diagnosis, prevention and treatment of diseases and clinical conditions associated with TIX1.

Tropomodulin 2 (neuronal) (TMOD2, Accession NP_055363.1) is another GAM63 target gene, herein designated TARGET GENE. TMOD2 BINDING SITE is a target binding site found in the 3' untranslated region of mRNA encoded by TMOD2, corresponding to a target binding site such as BINDING SITE I, BINDING SITE II or BINDING SITE III of FIG. 8. Table 4 illustrates the complementarity of the nucleotide sequences of TMOD2 BINDING SITE, designated SEQ ID:5911, to the nucleotide sequence of GAM63 RNA, herein designated GAM RNA, also designated SEQ ID:348.

Another function of GAM63 is therefore inhibition of Tropomodulin 2 (neuronal) (TMOD2, Accession NP_055363.1), a gene which is an actin-capping protein for the slow-growing end of filamentous actin. Accordingly, utilities of GAM63 include diagnosis, prevention and treatment of diseases and clinical conditions associated with TMOD2.

The function of TMOD2 has been established by previous studies. Watakabe et al. (1996) identified and purified rat NTMOD as a protein that binds to the neuron-specific tropomyosin isoform, Tmbr3. Using degenerate oligonucleotides based on peptide sequences of NTMOD, they cloned an NTMOD cDNA from a rat brain cDNA library. Northern blot and RNase protection analyses detected NTMOD mRNA expression predominantly in brain. Immunofluorescence of primary frontal cortex cell cultures showed that NTMOD is specifically expressed in neurons. By screening a human cerebellar cDNA library with a portion of the rat NTMOD as probe, Cox and Zoghbi (2000) cloned a human NTMOD cDNA, designated TMOD2. TMOD2 encodes a deduced 351-amino acid protein. Northern blot analysis demonstrated restricted expression of TMOD2 in neuronal tissues; an approximately 9.5-kb transcript was seen in all brain regions. Cox and Zoghbi (2000) also cloned the mouse ortholog. Northern blot analysis showed that expression of mouse Tmod2 occurred as early as embryonic day 7 and progressively increased during development.

Full details of the abovementioned studies are described in the following publications, the disclosure of which are hereby incorporated by reference:

Watakabe, A.; Kobayashi, R.; Helfman, D. M.: N-tropomodulin: a novel isoform of tropomodulin identified as the major binding protein to brain tropomyosin. J. Cell Sci. 109: 2299-2310, 1996; and Cox, P. R.; Zoghbi, H. Y.: Sequencing, expression analysis, and mapping of three unique human tropomodulin genes and their mouse orthologs. Genomics 63:97-107, 2000.

Further studies establishing the function and utilities of TMOD2 are found in John Hopkins OMIM database record ID 602928, and in cited publications listed in Table 5, which are hereby incorporated by reference. TMSNB (Accession NP_068832.1) is another GAM63 target gene, herein designated TARGET GENE. TMSNB BINDING SITE is a target binding site found in the 3' untranslated region of mRNA encoded by TMSNB, corresponding to a target binding site such as BINDING SITE I, BINDING SITE II or BINDING SITE III of FIG. 8. Table 4 illustrates the complementarity of the nucleotide sequences of TMSNB BINDING SITE, designated SEQ ID:6359, to the nucleotide sequence of GAM63 RNA, herein designated GAM RNA, also designated SEQ ID:348.

Another function of GAM63 is therefore inhibition of TMSNB (Accession NP_068832.1). Accordingly, utilities of GAM63 include diagnosis, prevention and treatment of diseases and clinical conditions associated with TMSNB.

Tumor necrosis factor receptor superfamily, member 10b (TNFRSF10B, Accession NP_671716.1) is another GAM63 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:1812, to the nucleotide sequence of GAM63 RNA, herein designated GAM RNA, also designated SEQ ID:348.

Another function of GAM63 is therefore inhibition of Tumor necrosis factor receptor superfamily, member 10b (TNFRSF10B, Accession NP_671716.1), a gene which forms complex that induces apoptosis. and therefore may be associated with Squamous cell carcinoma. Accordingly, utilities of GAM63 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 10b (TNFRSF10B, Accession NP_003833.3) is another GAM63 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:1812, to the nucleotide sequence of GAM63 RNA, herein designated GAM RNA, also designated SEQ ID:348.

Another function of GAM63 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM63 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 8 (TNFRSF8, Accession NP_001234.1) is another GAM63 target gene, herein designated TARGET GENE. TNFRSF8 BINDING SITE is a target binding site found in the 3' untranslated region of multiple transcripts of mRNA encoded by TNFRSF8, corresponding to a target binding site such as BINDING SITE I, BINDING SITE II or BINDING SITE III of FIG. 8. Table 4 illustrates the complementarity of the nucleotide sequences of TNFRSF8 BINDING SITE, designated SEQ ID:10652, to the nucleotide sequence of GAM63 RNA, herein designated GAM RNA, also designated SEQ ID:348.

Another function of GAM63 is therefore inhibition of Tumor necrosis factor receptor superfamily, member 8 (TNFRSF8, Accession NP_001234.1), a gene which regulates gene expression through activation of nf-kappab. Accordingly, utilities of GAM63 include diagnosis, prevention and treatment of diseases and clinical conditions associated with TNFRSF8.

The function of TNFRSF8 has been established by previous studies. By in vitro binding, immunoprecipitation, immunoblot, and yeast 2-hybrid analyses, Aizawa et al. (1997) showed that TRAF2 (OMIM Ref. No. 601895) and TRAF5 (OMIM Ref. No. 602356) interact with overlapping but distinct sequences in the C-terminal region of CD30 and mediate the activation of nuclear factor kappa-B (see OMIM Ref. No. 164011). Kurts et al. (1999) identified a new mechanism that protects against autoimmunity mediated through CD30. CD30 is expressed by activated, but not by resting, B or T cells. Using a model system in which ovalbumin-specific CD8+ T cells from the OT-I transgenic line were adoptively transferred into unirradiated transgenic mice that expressed ovalbumin in the pancreatic beta cells and the proximal renal tubular cells, Kurts et al. (1999) found that wildtype OT-I cells caused diabetes only when adoptively transferred in large numbers (greater than 250,000), with lower doses being effectively tolerized. CD30-deficient islet-specific CD8+ T cells were roughly 6,000-fold more autoaggressive than wildtype cells, with the transfer of as few as 160 CD30-deficient T cells leading to the complete destruction of pancreatic islets and the rapid onset of diabetes (within 4 days). Kurts et al. (1999) showed that in the absence of CD30 signaling, cells activated but not yet deleted by the CD95 (OMIM Ref. No. 134637)-dependent cross- tolerance mechanism gain the ability to proliferate extensively upon secondary encounter with antigen on parenchymal tissues, such as the pancreatic islets. Thus, CD30 signaling limits the proliferative potential of autoreactive CD8 effector T cells, and protects the body against autoimmunity.

Full details of the abovementioned studies are described in the following publications, the disclosure of which are hereby incorporated by reference:

Aizawa, S.; Nakano, H.; Ishida, T.; Horie, R.; Nagai, M.; Ito, K.; Yagita, H.; Okumura, K.; Inoue, J.; Watanabe, T.: Tumor necrosis factor receptor-associated factor (TRAF) 5 and TRAF2 are involved in CD30-mediated NF-kappa-B activation. J. Biol. Chem. 272:2042-2045, 1997; and Kurts, C.; Carbone, F. R.; Krummel, M. F.; Koch, K. M.; Miller, J. F. A. P.; Heath, W. R.: Signalling through CD30 protects against autoimmune diabetes mediated by CD8 T cells. Nature 3.

Further studies establishing the function and utilities of TNFRSF8 are found in John Hopkins OMIM database record ID 153243, and in cited publications listed in Table 5, which are hereby incorporated by reference. Tumor necrosis factor receptor superfamily, member 8 (TNFRSF8, Accession NP_694421.1) is another GAM63 target gene, herein designated TARGET GENE. TNFRSF8 BINDING SITE is a target binding site found in the 3' untranslated region of multiple transcripts of mRNA encoded by TNFRSF8, corresponding to a target binding site such as BINDING SITE I, BINDING SITE II or BINDING SITE III of FIG. 8. Table 4 illustrates the complementarity of the nucleotide sequences of TNFRSF8 BINDING SITE, designated SEQ ID:10652, to the nucleotide sequence of GAM63 RNA, herein designated GAM RNA, also designated SEQ ID:348.

Another function of GAM63 is therefore inhibition of Tumor necrosis factor receptor superfamily, member 8 (TNFRSF8, Accession NP_694421.1), a gene which regulates gene expression through activation of nf-kappab. Accordingly, utilities of GAM63 include diagnosis, prevention and treatment of diseases and clinical conditions associated with TNFRSF8.

The function of TNFRSF8 has been established by previous studies. By in vitro binding, immunoprecipitation, immunoblot, and yeast 2-hybrid analyses, Aizawa et al. (1997) showed that TRAF2 (OMIM Ref. No. 601895) and TRAF5 (OMIM Ref. No. 602356) interact with overlapping but distinct sequences in the C-terminal region of CD30 and mediate the activation of nuclear factor kappa-B (see OMIM Ref. No. 164011). Kurts et al. (1999) identified a new mechanism that protects against autoimmunity mediated through CD30. CD30 is expressed by activated, but not by resting, B or T cells. Using a model system in which ovalbumin-specific CD8+ T cells from the OT-I transgenic line were adoptively transferred into unirradiated transgenic mice that expressed ovalbumin in the pancreatic beta cells and the proximal renal tubular cells, Kurts et al. (1999) found that wildtype OT-I cells caused diabetes only when adoptively transferred in large numbers (greater than 250,000), with lower doses being effectively tolerized. CD30-deficient islet-specific CD8+ T cells were roughly 6,000-fold more autoaggressive than wildtype cells, with the transfer of as few as 160 CD30-deficient T cells leading to the complete destruction of pancreatic islets and the rapid onset of diabetes (within 4 days). Kurts et al. (1999) showed that in the absence of CD30 signaling, cells activated but not yet deleted by the CD95 (OMIM Ref. No. 134637)-dependent cross- tolerance mechanism gain the ability to proliferate extensively upon secondary encounter with antigen on parenchymal tissues, such as the pancreatic islets. Thus, CD30 signaling limits the proliferative potential of autoreactive CD8 effector T cells, and protects the body against autoimmunity.

Full details of the abovementioned studies are described in the following publications, the disclosure of which are hereby incorporated by reference:

Aizawa, S.; Nakano, H.; Ishida, T.; Horie, R.; Nagai, M.; Ito, K.; Yagita, H.; Okumura, K.; Inoue, J.; Watanabe, T.: Tumor necrosis factor receptor-associated factor (TRAF) 5 and TRAF2 are involved in CD30-mediated NF-kappa- B activation. J. Biol. Chem. 272:2042-2045, 1997; and Kurts, C.; Carbone, F. R.; Krummel, M. F.; Koch, K. M.; Miller, J. F. A. P.; Heath, W. R.: Signalling through CD30 protects against autoimmune diabetes mediated by CD8 T cells. Nature 3.

Further studies establishing the function and utilities of TNFRSF8 are found in John Hopkins OMIM database record ID 153243, and in cited publications listed in Table 5, which are hereby incorporated by reference. Trinucleotide repeat containing 4 (TNRC4, Accession NP_009116.2) is another GAM63 target gene, herein designated TARGET GENE. TNRC4 BINDING SITE is a target binding site found in the 5' untranslated region of mRNA encoded by TNRC4, corresponding to a target binding site such as BINDING SITE I, BINDING SITE II or BINDING SITE III of FIG. 8. Table 4 illustrates the complementarity of the nucleotide sequences of TNRC4 BINDING SITE, designated SEQ ID:4212, to the nucleotide sequence of GAM63 RNA, herein designated GAM RNA, also designated SEQ ID:348.

Another function of GAM63 is therefore inhibition of Trinucleotide repeat containing 4 (TNRC4, Accession NP_009116.2). Accordingly, utilities of GAM63 include diagnosis, prevention and treatment of diseases and clinical conditions associated with TNRC4.

TOPBP1 (Accession NP_008958.1) is another GAM63 target gene, herein designated TARGET GENE. TOPBP1 BINDING SITE is a target binding site found in the 3' untranslated region of mRNA encoded by TOPBP1, corresponding to a target binding site such as BINDING SITE I, BINDING SITE II or BINDING SITE III of FIG. 8. Table 4 illustrates the complementarity of the nucleotide sequences of TOPBP1 BINDING SITE, designated SEQ ID:19773, to the nucleotide sequence of GAM63 RNA, herein designated GAM RNA, also designated SEQ ID:348.

Another function of GAM63 is therefore inhibition of TOPBP1 (Accession NP_008958.1). Accordingly, utilities of GAM63 include diagnosis, prevention and treatment of diseases and clinical conditions associated with TOPBP1.

TOSO (Accession NP_005440.1) is another GAM63 target gene, herein designated TARGET GENE. TOSO BINDING SITE is a target binding site found in the 3' untranslated region of mRNA encoded by TOSO, corresponding to a target binding site such as BINDING SITE I, BINDING SITE II or BINDING SITE III of FIG. 8. Table 4 illustrates the complementarity of the nucleotide sequences of TOSO BINDING SITE, designated SEQ ID:18553, to the nucleotide sequence of GAM63 RNA, herein designated GAM RNA, also designated SEQ ID:348.

Another function of GAM63 is therefore inhibition of TOSO (Accession NP_005440.1). Accordingly, utilities of GAM63 include diagnosis, prevention and treatment of diseases and clinical conditions associated with TOSO.

TP53I11 (Accession NP_006025.1) is another GAM63 target gene, herein designated TARGET GENE. TP53I11 BINDING SITE1 and TP53I11 BINDING SITE2 are target binding sites found in untranslated regions of multiple transcripts of mRNA encoded by TP53I11, corresponding to target binding sites such as BINDING SITE I, BINDING SITE II or BINDING SITE III of FIG. 8. Table 4 illustrates the complementarity of the nucleotide sequences of TP53I11 BINDING SITE1 and TP53I11 BINDING SITE2, designated SEQ ID:945 and SEQ ID:2826 respectively, to the nucleotide sequence of GAM63 RNA, herein designated GAM RNA, also designated SEQ ID:348.

Another function of GAM63 is therefore inhibition of TP53I11 (Accession NP_006025.1). Accordingly, utilities of GAM63 include diagnosis, prevention and treatment of diseases and clinical conditions associated with TP53I11.

Testis specific protein 1 (probe h4-1 p3-1) (TPX1, Accession NP_003287.1) is another GAM63 target gene, herein designated TARGET GENE. TPX1 BINDING SITE is a target binding site found in the 3' untranslated region of mRNA encoded by TPX1, corresponding to a target binding site such as BINDING SITE I, BINDING SITE II or BINDING SITE III of FIG. 8. Table 4 illustrates the complementarity of the nucleotide sequences of TPX1 BINDING SITE, designated SEQ ID:10561, to the nucleotide sequence of GAM63 RNA, herein designated GAM RNA, also designated SEQ ID:348.

Another function of GAM63 is therefore inhibition of Testis specific protein 1 (probe h4-1 p3-1) (TPX1, Accession NP_003287.1), a gene which Testis specific protein 1; member of the cysteine-rich secretory protein (CRISP) family. Accordingly, utilities of GAM63 include diagnosis, prevention and treatment of diseases and clinical conditions associated with TPX1.

The function of TPX1 has been established by previous studies. In the course of characterizing a large number of genomic clones isolated from mouse chromosome 17, Kasahara et al. (1987) found a cosmid clone containing a sequence transcribed specifically in the testis. Subsequent studies (Kasahara et al., 1989) demonstrated a map location between Pgk2 and Mep1 on mouse chromosome 17, making it unlikely that the gene is involved in t mutant phenotypes. Kasahara et al. (1989) described the cDNA sequences of the mouse gene, named Tpx1, and of its human counterpart TPX1. The 2 showed 77.8% nucleotide and 70% amino acid sequence similarity. The mouse gene showed 64.2% nucleotide and 55.1% amino acid sequence similarity to that of a rat sperm-coding glycoprotein gene, the protein product of which is secreted by the epidermis. By Southern blot analysis of somatic cell hybrid DNA, Kasahara et al. (1989) mapped the human TPX1 gene to 6p21-qter.

Full details of the abovementioned studies are described in the following publications, the disclosure of which are hereby incorporated by reference:

Kasahara, M.; Figueroa, F.; Klein, J.: Random cloning of genes from mouse chromosome 17. Proc. Nat. Acad. Sci. 84:3325-3328, 1987; and Kasahara, M.; Gutknecht, J.; Brew, K.; Spurr, N.; Goodfellow, P. N.: Cloning and mapping of a testis-specific gene with sequence similarity to a sperm-coating glycoprotein gene. Genomic.

Further studies establishing the function and utilities of TPX1 are found in John Hopkins OMIM database record ID 187430, and in cited publications listed in Table 5, which are hereby incorporated by reference. TRIP-Br2 (Accession NP_055570.1) is another GAM63 target gene, herein designated TARGET GENE. TRIP-Br2 BINDING SITE is a target binding site found in the 3' untranslated region of mRNA encoded by TRIP-Br2, corresponding to a target binding site such as BINDING SITE I, BINDING SITE II or BINDING SITE III of FIG. 8. Table 4 illustrates the complementarity of the nucleotide sequences of TRIP-Br2 BINDING SITE, designated SEQ ID:14867, to the nucleotide sequence of GAM63 RNA, herein designated GAM RNA, also designated SEQ ID:348.

Another function of GAM63 is therefore inhibition of TRIP-Br2 (Accession NP_055570.1). Accordingly, utilities of GAM63 include diagnosis, prevention and treatment of diseases and clinical conditions associated with TRIP-Br2.

Transient receptor potential cation channel, subfamily c, member 6 (TRPC6, Accession NP_004612.2) is another GAM63 target gene, herein designated TARGET GENE. TRPC6 BINDING SITE is a target binding site found in the 3' untranslated region of mRNA encoded by TRPC6, corresponding to a target binding site such as BINDING SITE I, BINDING SITE II or BINDING SITE III of FIG. 8. Table 4 illustrates the complementarity of the nucleotide sequences of TRPC6 BINDING SITE, designated SEQ ID:20179, to the nucleotide sequence of GAM63 RNA, herein designated GAM RNA, also designated SEQ ID:348.

Another function of GAM63 is therefore inhibition of Transient receptor potential cation channel, subfamily c, member 6 (TRPC6, Accession NP_004612.2), a gene which has calcium channel activity. Accordingly, utilities of GAM63 include diagnosis, prevention and treatment of diseases and clinical conditions associated with TRPC6.

The function of TRPC6 has been established by previous studies. TRPCs, mammalian homologs of the Drosophila transient receptor potential (trp) protein, are ion channels that are thought to mediate capacitative calcium entry into the cell. Using a PCR-based strategy, Hofmann et al. (1999) isolated cDNAs encoding TRPC6, a novel member of the TRPC family. The predicted 931-amino acid protein shares 93% identity with mouse Trpc6. The authors found that TRPC6 is a non-selective cation channel that is activated by diacylglycerol (DAG) in a membrane-delimited fashion, independently of protein kinase C. Although TRPC3 (OMIM Ref. No. 602345), the closest structural relative of TRPC6, is activated in the same manner, human TRPC1 and mouse Trpc4 (OMIM Ref. No. 603651) and Trpc5 (OMIM Ref. No. 300334) were unresponsive to DAG. The authors suggested that TRPC3 and TRPC6 represent the first members of a new functional family of second-messenger-operated cation channels that are activated by DAG. Northern blot analysis revealed that TRPC6 is expressed primarily in placenta, lung, spleen, ovary, and small intestine. By FISH, D'Esposito et al. (1998) mapped the TRPC6 gene to chromosome 11q21-q22.

Full details of the abovementioned studies are described in the following publications, the disclosure of which are hereby incorporated by reference:

Hofmann, T.; Obukhov, A. G.; Schaefer, M.; Harteneck, C.; Gudermann, T.; Schultz, G.: Direct activation of human TRPC6 and TRPC3 channels by diacylglycerol. Nature 397: 259-263, 1999; and D'Esposito, M.; Strazzullo, M.; Cuccurese, M.; Spalluto, C.; Rocchi, M.; D'Urso, M.; Ciccodicola, A.: Identification and assignment of the human transient receptor potential channel 6 gene.

Further studies establishing the function and utilities of TRPC6 are found in John Hopkins OMIM database record ID 603652, and in cited publications listed in Table 5, which are hereby incorporated by reference. U5-116KD (Accession NP_004238.1) is another GAM63 target gene, herein designated TARGET GENE. U5-116KD BINDING SITE is a target binding site found in the 3' untranslated region of mRNA encoded by U5-116KD, corresponding to a target binding site such as BINDING SITE I, BINDING SITE II or BINDING SITE III of FIG. 8. Table 4 illustrates the complementarity of the nucleotide sequences of U5-116KD BINDING SITE, designated SEQ ID:4615, to the nucleotide sequence of GAM63 RNA, herein designated GAM RNA, also designated SEQ ID:348.

Another function of GAM63 is therefore inhibition of U5-116KD (Accession NP_004238.1). Accordingly, utilities of GAM63 include diagnosis, prevention and treatment of diseases and clinical conditions associated with U5-116KD.

Ubiquitin-conjugating enzyme e2 variant 1 (UBE2V1, Accession NP_071887.1) is another GAM63 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:17471, to the nucleotide sequence of GAM63 RNA, herein designated GAM RNA, also designated SEQ ID:348.

Another function of GAM63 is therefore inhibition of Ubiquitin-conjugating enzyme e2 variant 1 (UBE2V1, Accession NP_071887.1), a gene which may play a role in signaling for DNA repair. Accordingly, utilities of GAM63 include diagnosis, prevention and treatment of diseases and clinical conditions associated with UBE2V1.

The function of UBE2V1 and its association with various diseases and clinical conditions, has been established by previous studies, as described hereinabove with reference to GAM44.1. Unc-119 homolog (c. elegans) (UNC119, Accession NP_473376.1) is another GAM63 target gene, herein designated TARGET GENE. UNC119 BINDING SITE1 and UNC119 BINDING SITE2 are target binding sites found in untranslated regions of multiple transcripts of mRNA encoded by UNC119, corresponding to target binding sites such as BINDING SITE I, BINDING SITE II or BINDING SITE III of FIG. 8. Table 4 illustrates the complementarity of the nucleotide sequences of UNC119 BINDING SITE1 and UNC119 BINDING SITE2, designated SEQ ID:4264 and SEQ ID:3155 respectively, to the nucleotide sequence of GAM63 RNA, herein designated GAM RNA, also designated SEQ ID:348.

Another function of GAM63 is therefore inhibition of Unc-119 homolog (c. elegans) (UNC119, Accession NP_473376.1), a gene which is expressed in the retina and may play a role in the mechanism of photoreceptor neurotransmitter release through the synaptic vesicle cycle. Accordingly, utilities of GAM63 include diagnosis, prevention and treatment of diseases and clinical conditions associated with UNC119.

The function of UNC119 has been established by previous studies. Using a subtractive hybridization strategy, Higashide et al. (1996) identified a retina-specific cDNA that they designated HRG4 (human retinal gene-4). Northern blot analysis revealed that the approximately 1.4-kb HRG4 mRNA is expressed specifically in human retina. The authors also cloned a cDNA encoding RRG4, the rat HRG4 homolog. The predicted 240-amino acid human and rat proteins both contain an N-terminal region rich in proline and glycine followed by a region with a mixture of alpha helices, beta sheets, and turns. Sequence comparisons indicated that the proline-glycine domains of RRG4 and HRG4 share only 67% homology, while the rest of the sequence is 100% identical. By in situ hybridization, Higashide et al. (1996) demonstrated that the HRG4 gene is expressed specifically in photoreceptors, both rods and cones, in human retina. In rat, the authors observed high levels of RRG4 expression in the outer retina beginning around postnatal day 5, when the photoreceptors begin to differentiate, and expression increased rapidly to reach the adult level by postnatal day 23. Mutations in the C. elegans unc119 gene lead to defects in locomotion, feeding behavior, and chemosensation. Both Swanson et al. (1998) and Higashide et al. (1998) observed that HRG4 shares strong homology with the C. elegans unc119 protein, leading Swanson et al. (1998) to designate the human protein UNC119. Swanson et al. (1998) stated that a human UNC119 cDNA functionally complemented the C. elegans unc119 mutation. Using immunofluorescence, Higashide et al. (1998) localized HRG4 to the outer plexiform layer of the retina in the synaptic termini of rod and cone photoreceptors. Electron microscopic immunolocalization showed that the protein is present in the cytoplasm and on the presynaptic membranes of the photoreceptor synapses. The authors suggested that HRG4 may play a role in the mechanism of photoreceptor neurotransmitter release through the synaptic vesicle cycle. They noted that the homology of HRG4 and unc119 is consistent with a possible role of HRG4 in the synaptic vesicle cycle, because the broad effects of unc119 on neuronal function are consistent with a defect in neurotransmission.

Full details of the abovementioned studies are described in the following publications, the disclosure of which are hereby incorporated by reference:

Higashide, T.; Murakami, A.; McLaren, M. J.; Inana, G.: Cloning of the cDNA for a novel photoreceptor protein. J. Biol. Chem. 271:1797-1804, 1996; and Swanson, D. A.; Chang, J. T.; Campochiaro, P. A.; Zack, D. J.; Valle, D.: Mammalian orthologs of C. elegans unc-119 highly expressed in photoreceptors. Invest. Ophthal. Vis. Sci. 39:20.

Further studies establishing the function and utilities of UNC119 are found in John Hopkins OMIM database record ID 604011, and in cited publications listed in Table 5, which are hereby incorporated by reference. Unc-119 homolog (c. elegans) (UNC119, Accession NP_473376.1) is another GAM63 target gene, herein designated TARGET GENE. UNC119 BINDING SITE1 and UNC119 BINDING SITE2 are target binding sites found in untranslated regions of multiple transcripts of mRNA encoded by UNC119, corresponding to target binding sites such as BINDING SITE I, BINDING SITE II or BINDING SITE III of FIG. 8. Table 4 illustrates the complementarity of the nucleotide sequences of UNC119 BINDING SITE1 and UNC119 BINDING SITE2, designated SEQ ID:3155 and SEQ ID:4050 respectively, to the nucleotide sequence of GAM63 RNA, herein designated GAM RNA, also designated SEQ ID:348.

Another function of GAM63 is therefore inhibition of Unc-119 homolog (c. elegans) (UNC119, Accession NP_473376.1), a gene which is expressed in the retina and may play a role in the mechanism of photoreceptor neurotransmitter release through the synaptic vesicle cycle. Accordingly, utilities of GAM63 include diagnosis, prevention and treatment of diseases and clinical conditions associated with UNC119.

The function of UNC119 has been established by previous studies. Using a subtractive hybridization strategy, Higashide et al. (1996) identified a retina-specific cDNA that they designated HRG4 (human retinal gene-4). Northern blot analysis revealed that the approximately 1.4-kb HRG4 mRNA is expressed specifically in human retina. The authors also cloned a cDNA encoding RRG4, the rat HRG4 homolog. The predicted 240-amino acid human and rat proteins both contain an N-terminal region rich in proline and glycine followed by a region with a mixture of alpha helices, beta sheets, and turns. Sequence comparisons indicated that the proline-glycine domains of RRG4 and HRG4 share only 67% homology, while the rest of the sequence is 100% identical. By in situ hybridization, Higashide et al. (1996) demonstrated that the HRG4 gene is expressed specifically in photoreceptors, both rods and cones, in human retina. In rat, the authors observed high levels of RRG4 expression in the outer retina beginning around postnatal day 5, when the photoreceptors begin to differentiate, and expression increased rapidly to reach the adult level by postnatal day 23. Mutations in the C. elegans unc119 gene lead to defects in locomotion, feeding behavior, and chemosensation. Both Swanson et al. (1998) and Higashide et al. (1998) observed that HRG4 shares strong homology with the C. elegans unc119 protein, leading Swanson et al. (1998) to designate the human protein UNC119. Swanson et al. (1998) stated that a human UNC119 cDNA functionally complemented the C. elegans unc119 mutation. Using immunofluorescence, Higashide et al. (1998) localized HRG4 to the outer plexiform layer of the retina in the synaptic termini of rod and cone photoreceptors. Electron microscopic immunolocalization showed that the protein is present in the cytoplasm and on the presynaptic membranes of the photoreceptor synapses. The authors suggested that HRG4 may play a role in the mechanism of photoreceptor neurotransmitter release through the synaptic vesicle cycle. They noted that the homology of HRG4 and unc119 is consistent with a possible role of HRG4 in the synaptic vesicle cycle, because the broad effects of unc119 on neuronal function are consistent with a defect in neurotransmission.

Full details of the abovementioned studies are described in the following publications, the disclosure of which are hereby incorporated by reference:

Higashide, T.; Murakami, A.; McLaren, M. J.; Inana, G.: Cloning of the cDNA for a novel photoreceptor protein. J. Biol. Chem. 271:1797-1804, 1996; and Swanson, D. A.; Chang, J. T.; Campochiaro, P. A.; Zack, D. J.; Valle, D.: Mammalian orthologs of C. elegans unc-119 highly expressed in photoreceptors. Invest. Ophthal. Vis. Sci. 39:20.

Further studies establishing the function and utilities of UNC119 are found in John Hopkins OMIM database record ID 604011, and in cited publications listed in Table 5, which are hereby incorporated by reference. Uv radiation resistance associated gene (UVRAG, Accession NP_003360.2) is another GAM63 target gene, herein designated TARGET GENE. UVRAG BINDING SITE is a target binding site found in the 3' untranslated region of mRNA encoded by UVRAG, corresponding to a target binding site such as BINDING SITE I, BINDING SITE II or BINDING SITE III of FIG. 8. Table 4 illustrates the complementarity of the nucleotide sequences of UVRAG BINDING SITE, designated SEQ ID:11078, to the nucleotide sequence of GAM63 RNA, herein designated GAM RNA, also designated SEQ ID:348.

Another function of GAM63 is therefore inhibition of Uv radiation resistance associated gene (UVRAG, Accession NP_003360.2). Accordingly, utilities of GAM63 include diagnosis, prevention and treatment of diseases and clinical conditions associated with UVRAG.

Vitamin d (1,25-dihydroxyvitamin d3) receptor (VDR, Accession NP_000367.1) is another GAM63 target gene, herein designated TARGET GENE. VDR BINDING SITE1 and VDR BINDING SITE2 are target binding sites found in untranslated regions of mRNA encoded by VDR, corresponding to target binding sites such as BINDING SITE I, BINDING SITE II or BINDING SITE III of FIG. 8. Table 4 illustrates the complementarity of the nucleotide sequences of VDR BINDING SITE1 and VDR BINDING SITE2, designated SEQ ID:637 and SEQ ID:4294 respectively, to the nucleotide sequence of GAM63 RNA, herein designated GAM RNA, also designated SEQ ID:348.

Another function of GAM63 is therefore inhibition of Vitamin d (1,25-dihydroxyvitamin d3) receptor (VDR, Accession NP_000367.1). Accordingly, utilities of GAM63 include diagnosis, prevention and treatment of diseases and clinical conditions associated with VDR.

VTS58635 (Accession NP_201572.1) is another GAM63 target gene, herein designated TARGET GENE. VTS58635 BINDING SITE is a target binding site found in the 3' untranslated region of mRNA encoded by VTS58635, corresponding to a target binding site such as BINDING SITE I, BINDING SITE II or BINDING SITE III of FIG. 8. Table 4 illustrates the complementarity of the nucleotide sequences of VTS58635 BINDING SITE, designated SEQ ID:9459, to the nucleotide sequence of GAM63 RNA, herein designated GAM RNA, also designated SEQ ID:348.

Another function of GAM63 is therefore inhibition of VTS58635 (Accession NP_201572.1). Accordingly, utilities of GAM63 include diagnosis, prevention and treatment of diseases and clinical conditions associated with VTS58635.

Williams-beuren syndrome chromosome region 17 (WBSCR17, Accession NP_071924.1) is another GAM63 target gene, herein designated TARGET GENE. WBSCR17 BINDING SITE is a target binding site found in the 3' untranslated region of mRNA encoded by WBSCR17, corresponding to a target binding site such as BINDING SITE I, BINDING SITE II or BINDING SITE III of FIG. 8. Table 4 illustrates the complementarity of the nucleotide sequences of WBSCR17 BINDING SITE, designated SEQ ID:3611, to the nucleotide sequence of GAM63 RNA, herein designated GAM RNA, also designated SEQ ID:348.

Another function of GAM63 is therefore inhibition of Williams-beuren syndrome chromosome region 17 (WBSCR17, Accession NP_071924.1). Accordingly, utilities of GAM63 include diagnosis, prevention and treatment of diseases and clinical conditions associated with WBSCR17.

ZFP385 (Accession NP_056296.1) is another GAM63 target gene, herein designated TARGET GENE. ZFP385 BINDING SITE is a target binding site found in the 3' untranslated region of mRNA encoded by ZFP385, corresponding to a target binding site such as BINDING SITE I, BINDING SITE II or BINDING SITE III of FIG. 8. Table 4 illustrates the complementarity of the nucleotide sequences of ZFP385 BINDING SITE, designated SEQ ID:16862, to the nucleotide sequence of GAM63 RNA, herein designated GAM RNA, also designated SEQ ID:348.

Another function of GAM63 is therefore inhibition of ZFP385 (Accession NP_056296.1). Accordingly, utilities of GAM63 include diagnosis, prevention and treatment of diseases and clinical conditions associated with ZFP385.

zizimin1 (Accession NP_056111.1) is another GAM63 target gene, herein designated TARGET GENE. zizimin1 BINDING SITE is a target binding site found in the 3' untranslated region of mRNA encoded by zizimin1, corresponding to a target binding site such as BINDING SITE I, BINDING SITE II or BINDING SITE III of FIG. 8. Table 4 illustrates the complementarity of the nucleotide sequences of zizimin1 BINDING SITE, designated SEQ ID:4665, to the nucleotide sequence of GAM63 RNA, herein designated GAM RNA, also designated SEQ ID:348.

Another function of GAM63 is therefore inhibition of zizimin1 (Accession NP_056111.1). Accordingly, utilities of GAM63 include diagnosis, prevention and treatment of diseases and clinical conditions associated with zizimin1.

Zinc finger protein 175 (ZNF175, Accession NP_009078.1) is another GAM63 target gene, herein designated TARGET GENE. ZNF175 BINDING SITE is a target binding site found in the 3' untranslated region of mRNA encoded by ZNF175, corresponding to a target binding site such as BINDING SITE I, BINDING SITE II or BINDING SITE III of FIG. 8. Table 4 illustrates the complementarity of the nucleotide sequences of ZNF175 BINDING SITE, designated SEQ ID:17154, to the nucleotide sequence of GAM63 RNA, herein designated GAM RNA, also designated SEQ ID:348.

Another function of GAM63 is therefore inhibition of Zinc finger protein 175 (ZNF175, Accession NP_009078.1). Accordingly, utilities of GAM63 include diagnosis, prevention and treatment of diseases and clinical conditions associated with ZNF175.

Zinc finger protein 179 (ZNF179, Accession NP_009079.1) is another GAM63 target gene, herein designated TARGET GENE. ZNF179 BINDING SITE is a target binding site found in the 3' untranslated region of mRNA encoded by ZNF179, corresponding to a target binding site such as BINDING SITE I, BINDING SITE II or BINDING SITE III of FIG. 8. Table 4 illustrates the complementarity of the nucleotide sequences of ZNF179 BINDING SITE, designated SEQ ID:3345, to the nucleotide sequence of GAM63 RNA, herein designated GAM RNA, also designated SEQ ID:348.

Another function of GAM63 is therefore inhibition of Zinc finger protein 179 (ZNF179, Accession NP_009079.1), a gene which has zink finger and a member of the RING finger protein family of transcription factors. and therefore may be associated with Smith-magenis syndrome. Accordingly, utilities of GAM63 include diagnosis, prevention and treatment of Smith-magenis syndrome, and of other diseases and clinical conditions associated with ZNF179.

The function of ZNF179 has been established by previous studies. Kimura et al. (1997) showed, by FISH analysis of metaphase or interphase chromosomes of 6 patients with Smith-Magenis syndrome (SMS; 182290), that ZNF179 was deleted in one of the homologs, indicating possible involvement of this gene in the pathogenesis of SMS. ZNF179 was sublocalized to a site proximal to LLGL (OMIM Ref. No. 600966), which is thought to be critical to SMS Full details of the abovementioned studies are described in the following publications, the disclosure of which are hereby incorporated by reference:

Kimura, T.; Arakawa, Y.; Inoue, S.; Fukushima, Y.; Kondo, I.; Koyama, K.; Hosoi, T.; Orimo, A.; Muramatsu, M.; Nakamura, Y.; Abe, T.; Inazawa, J.: The brain finger protein gene (ZNF179), a member of the RING finger family, maps within the Smith-Magenis syndrome region at 17p11.2. Am. J. Med. Genet. 69:320-324, 1997; and Matsuda, Y.; Inue, S.; Seki, N.; Hosoi, T.; Orimo, A.; Muramatsu, M.; Hori, T.: Chromosome mapping of human (ZNF179), mouse, and rat genes for brain finger protein (bfp), a member of the R.

Further studies establishing the function and utilities of ZNF179 are found in John Hopkins OMIM database record ID 601237, and in cited publications listed in Table 5, which are hereby incorporated by reference. Zinc finger protein 261 (ZNF261, Accession NP_005087.1) is another GAM63 target gene, herein designated TARGET GENE. ZNF261 BINDING SITE1 and ZNF261 BINDING SITE2 are target binding sites found in untranslated regions of mRNA encoded by ZNF261, corresponding to target binding sites such as BINDING SITE I, BINDING SITE II or BINDING SITE III of FIG. 8. Table 4 illustrates the complementarity of the nucleotide sequences of ZNF261 BINDING SITE1 and ZNF261 BINDING SITE2, designated SEQ ID:10852 and SEQ ID:12406 respectively, to the nucleotide sequence of GAM63 RNA, herein designated GAM RNA, also designated SEQ ID:348.

Another function of GAM63 is therefore inhibition of Zinc finger protein 261 (ZNF261, Accession NP_005087.1). Accordingly, utilities of GAM63 include diagnosis, prevention and treatment of diseases and clinical conditions associated with ZNF261.

Zinc finger protein 272 (ZNF272, Accession XP_030227.3) is another GAM63 target gene, herein designated TARGET GENE. ZNF272 BINDING SITE is a target binding site found in the 3' untranslated region of mRNA encoded by ZNF272, corresponding to a target binding site such as BINDING SITE I, BINDING SITE II or BINDING SITE III of FIG. 8. Table 4 illustrates the complementarity of the nucleotide sequences of ZNF272 BINDING SITE, designated SEQ ID:9716, to the nucleotide sequence of GAM63 RNA, herein designated GAM RNA, also designated SEQ ID:348.

Another function of GAM63 is therefore inhibition of Zinc finger protein 272 (ZNF272, Accession XP_030227.3). Accordingly, utilities of GAM63 include diagnosis, prevention and treatment of diseases and clinical conditions associated with ZNF272.

Zinc finger protein 323 (ZNF323, Accession NP_112161.2) is another GAM63 target gene, herein designated TARGET GENE. ZNF323 BINDING SITE is a target binding site found in the 3' untranslated region of mRNA encoded by ZNF323, corresponding to a target binding site such as BINDING SITE I, BINDING SITE II or BINDING SITE III of FIG. 8. Table 4 illustrates the complementarity of the nucleotide sequences of ZNF323 BINDING SITE, designated SEQ ID:13326, to the nucleotide sequence of GAM63 RNA, herein designated GAM RNA, also designated SEQ ID:348.

Another function of GAM63 is therefore inhibition of Zinc finger protein 323 (ZNF323, Accession NP_112161.2). Accordingly, utilities of GAM63 include diagnosis, prevention and treatment of diseases and clinical conditions associated with ZNF323.

ZNF435 (Accession NP_079507.1) is another GAM63 target gene, herein designated TARGET GENE. ZNF435 BINDING SITE is a target binding site found in the 3' untranslated region of mRNA encoded by ZNF435, corresponding to a target binding site such as BINDING SITE I, BINDING SITE II or BINDING SITE III of FIG. 8. Table 4 illustrates the complementarity of the nucleotide sequences of ZNF435 BINDING SITE, designated SEQ ID:19017, to the nucleotide sequence of GAM63 RNA, herein designated GAM RNA, also designated SEQ ID:348.

Another function of GAM63 is therefore inhibition of ZNF435 (Accession NP_079507.1). Accordingly, utilities of GAM63 include diagnosis, prevention and treatment of diseases and clinical conditions associated with ZNF435.

ZNF436 (Accession NP_085137.1) is another GAM63 target gene, herein designated TARGET GENE. ZNF436 BINDING SITE is a target binding site found in the 3' untranslated region of mRNA encoded by ZNF436, corresponding to a target binding site such as BINDING SITE I, BINDING SITE II or BINDING SITE III of FIG. 8. Table 4 illustrates the complementarity of the nucleotide sequences of ZNF436 BINDING SITE, designated SEQ ID:18528, to the nucleotide sequence of GAM63 RNA, herein designated GAM RNA, also designated SEQ ID:348.

Another function of GAM63 is therefore inhibition of ZNF436 (Accession NP_085137.1). Accordingly, utilities of GAM63 include diagnosis, prevention and treatment of diseases and clinical conditions associated with ZNF436.

FIG. 8 further provides a conceptual description of a novel bioinformatically detected of the present invention, referred to here as Genomic Address Messenger 64 (GAM64), which modulates expression of respective target genes thereof, the function and utility of which target genes is known in the art.

GAM64 is a novel bioinformatically detected regulatory, non protein coding, micro RNA (miRNA) gene. The method by which GAM64 was detected is described hereinabove with reference to FIGS. 8-15.

GAM64 gene, herein designated GAM GENE, and GAM64 target gene, herein designated TARGET GENE, are human genes contained in the human genome.

GAM64 gene encodes a GAM64 precursor RNA, herein designated GAM PRECURSOR RNA. Similar to other miRNA genes, and unlike most ordinary genes, GAM64 precursor RNA does not encode a protein. A nucleotide sequence identical or highly similar to the nucleotide sequence of GAM64 precursor RNA is designated SEQ ID:85, and is provided hereinbelow with reference to the sequence listing part.

GAM64 precursor RNA folds onto itself, forming GAM64 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM64 precursor RNA folds onto itself, forming GAM64 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM64 precursor RNA, designated SEQ-ID:85, and a schematic representation of a predicted secondary folding of GAM64 folded precursor RNA are further described with reference to Table 2, hereby incorporated by reference.

An enzyme complex designated DICER COMPLEX, 'dices' the GAM64 folded precursor RNA into GAM64 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM64 RNA is designated SEQ ID:239, and is provided hereinbelow with references to the sequence listing part and Table 3, hereby incorporated by reference.

GAM64 target gene, herein designated TARGET GENE, encodes a corresponding messenger RNA, GAM64 target RNA, herein designated GAM TARGET RNA. GAM64 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM64 RNA, herein designated GAM RNA, binds complementarily to one or more target binding sites located in untranslated regions of GAM64 target RNA, herein designated GAM TARGET RNA. This complementary binding is due to the fact that the nucleotide sequence of GAM64 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM64 RNA may have a different number of target binding sites in untranslated regions of a GAM64 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM64 RNA, herein designated GAM RNA, to target binding sites on GAM64 target RNA, herein designated GAM TARGET RNA, such as BINDING SITE I, BINDING SITE II and BINDING SITE III, inhibits translation of GAM64 target RNA into GAM64 target protein, herein designated GAM TARGET PROTEIN. GAM target protein is therefore outlined by a broken line.

It is appreciated that GAM64 target gene, herein designated TARGET GENE, in fact represents a plurality of GAM64 target genes. The mRNA of each one of this plurality of GAM64 target genes comprises one or more target binding sites, each having a nucleotide sequence which is at least partly complementary to GAM64 RNA, herein designated GAM RNA, and which when bound by GAM64 RNA causes inhibition of translation of respective one or more GAM64 target proteins.

It is further appreciated by one skilled in the art that the mode of translational inhibition illustrated by FIG. 8 with specific reference to translational inhibition exerted by GAM64 gene, herein designated GAM GENE, on one or more GAM64 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM64 correlate with, and may be deduced from, the identity of the target genes which GAM64 binds and inhibits, and the function of these target genes, as elaborated hereinbelow.

Bagpipe homeobox homolog 1 (drosophila) (BAPX1, Accession NM_001189.2) is a GAM64 target gene, herein designated TARGET GENE. BAPX1 BINDING SITE is a target binding site found in the 3' untranslated region of mRNA encoded by BAPX1, corresponding to a target binding site such as BINDING SITE I, BINDING SITE II or BINDING SITE III of FIG. 8. Table 4 illustrates the complementarity of the nucleotide sequences of BAPX1 BINDING SITE, designated SEQ ID:11199, to the nucleotide sequence of GAM64 RNA, herein designated GAM RNA, also designated SEQ ID:239.

A function of GAM64 is therefore inhibition of Bagpipe homeobox homolog 1 (drosophila) (BAPX1, Accession NM_001189.2), a gene which regulates gene expression, morphogenesis, and differentiation and therefore may be associated with Ellis-van creveld syndrome. Accordingly, utilities of GAM64 include diagnosis, prevention and treatment of Ellis-van creveld syndrome, and of other diseases and clinical conditions associated with BAPX1.

The function of BAPX1 and its association with various diseases and clinical conditions, has been established by previous studies, as described hereinabove with reference to GAM63.1. Dihydrofolate reductase (DHFR, Accession NM_000791.2) is another GAM64 target gene, herein designated TARGET GENE. DHFR BINDING SITE is a target binding site found in the 5' untranslated region of mRNA encoded by DHFR, corresponding to a target binding site such as BINDING SITE I, BINDING SITE II or BINDING SITE III of FIG. 8. Table 4 illustrates the complementarity of the nucleotide sequences of DHFR BINDING SITE, designated SEQ ID:3874, to the nucleotide sequence of GAM64 RNA, herein designated GAM RNA, also designated SEQ ID:239.

Another function of GAM64 is therefore inhibition of Dihydrofolate reductase (DHFR, Accession NM_000791.2), a gene which converts dihydrofolate into tetrahydrofolate. Accordingly, utilities of GAM64 include diagnosis, prevention and treatment of diseases and clinical conditions associated with DHFR.

The function of DHFR has been established by previous studies. Dihydrofolate reductase (EC 1.5.1.3) converts dihydrofolate into tetrahydrofolate, a methyl group shuttle required for the de novo synthesis of purines, thymidylic acid, and certain amino acids. DHFR is inhibited by methotrexate (MTX), a folate analog used as an antineoplastic and immunosuppressive agent. From comparisons of eukaryotic gene sequences and protein sequences of homologous enzymes from bacterial and mammalian organisms, Craik et al. (1983) noted that intron-exon junctions often coincide with variable surface loops of the protein structure. Proteins studied included DHFR, trypsin, and chymotrypsin. They pointed out that altered surface structures can account for functional differences among the members of a family, e.g., the serine proteases. 'Sliding' of the intron- exon junctions may constitute a mechanism for generating length polymorphisms and divergent sequences. Different function can thus be achieved without disrupting the stability of the protein core. DNA sequence amplification is one of the most frequent manifestations of genomic instability in human tumors. In most human tumor cells, amplified DNA sequences are borne on unstable, extrachromosomal double minutes (DMs). Singer et al. (2000) isolated a large number of independent methotrexate-resistant human cell lines, all of which contained DHFR-bearing DMs. All but one of these also had suffered partial or complete loss of one of the parental DHFR-bearing chromosomes. Cells in a few populations displayed what could be transient intermediates in the amplification process, including an initial homogeneously staining chromosome region (HSR), its subsequent breakage, the appearance of DHFR-containing fragments, and, finally, DMs. The studies suggested that both HSRs and DMs are initiated by chromosome breaks, but that cell types differ in how the extra sequences ultimately are processed and/or maintained.

Full details of the abovementioned studies are described in the following publications, the disclosure of which are hereby incorporated by reference:

Singer, M. J.; Mesner, L. D.; Friedman, C. L.; Trask, B. J.; Hamlin, J. L.: Amplification of the human dihydrofolate reductase gene via double minutes is initiated by chromosome breaks. Proc. Nat. Acad. Sci. 97:7921-7926, 2000; and Craik, C. S.; Rutter, W. J.; Fletterick, R.: Splice junctions: association with variation in protein structure. Science 220: 1125-1129, 1983.

Further studies establishing the function and utilities of DHFR are found in John Hopkins OMIM database record ID 126060, and in cited publications listed in Table 5, which are hereby incorporated by reference. Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NM_023031.1) is another GAM64 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:6486, to the nucleotide sequence of GAM64 RNA, herein designated GAM RNA, also designated SEQ ID:239.

Another function of GAM64 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NM_023031.1). Accordingly, utilities of GAM64 include diagnosis, prevention and treatment of diseases and clinical conditions associated with FGFR2.

Gdnf family receptor alpha 1 (GFRA1, Accession NM_145793.1) is another GAM64 target gene, herein designated TARGET GENE. GFRA1 BINDING SITE is a target binding site found in the 5' untranslated region of multiple transcripts of mRNA encoded by GFRA1, corresponding to a target binding site such as BINDING SITE I, BINDING SITE II or BINDING SITE III of FIG. 8. Table 4 illustrates the complementarity of the nucleotide sequences of GFRA1 BINDING SITE, designated SEQ ID:17656, to the nucleotide sequence of GAM64 RNA, herein designated GAM RNA, also designated SEQ ID:239.

Another function of GAM64 is therefore inhibition of Gdnf family receptor alpha 1 (GFRA1, Accession NM_145793.1), a gene which mediates the gdnf-induced autophosphorylation and activation of the ret receptor (by similarity). and therefore may be associated with Hirschsprung disease. Accordingly, utilities of GAM64 include diagnosis, prevention and treatment of Hirschsprung disease, and of other diseases and clinical conditions associated with GFRA1.

The function of GFRA1 has been established by previous studies. Glial cell line-derived neurotrophic factor (GDNF; 600837) is a potent neurotrophic factor that affects several types of neurons from both the central and peripheral nervous systems. Jing et al. (1996) reported the expression cloning and characterization of rat GDNFR-alpha, a glycosylphosphatidylinositol-linked cell surface receptor for GDNF. They used the rat cDNA to isolate cDNAs corresponding to the human gene, encoding a deduced 465-amino acid polypeptide that shares 93% sequence identity with the rat protein. The authors showed that recombinant GDNFR bound GDNF specifically and mediated activation of the RET protein-tyrosine kinase (RET; 164761). They noted that loss-of-function mutations in RET are involved in Hirschsprung disease (OMIM Ref. No. 142623), which is characterized by the congenital absence of parasympathetic innervation of the lower intestinal tract. Targeted disruption of the RET protooncogene in mice results in renal agenesis or severe dysgenesis and lack of enteric neurons throughout the digestive tract. This phenotype closely resembles that of GDNF knockout mice, suggesting that both RET and GDNF are involved in signal transduction pathways critical to the development of the kidney and the enteric nervous system. Jing et al. (1996) proposed a model for the stepwise formation of GDNF signal-transducing complex, including GDNF, GDNFR-alpha, and the RET protein-tyrosine kinase. Using fluorescence in situ hybridization, Gorodinsky et al. (1997) and Eng et al. (1998) mapped the GFRA1 gene to 10q26. Shefelbine et al. (1998) mapped GFRA1 to chromosome 10q25-q26 by radiation hybrid mapping. Puliti et al. (1997) mapped the Gfra1 gene to mouse chromosome 19 in a region with known homology to human 10q24-q26. Puliti et al. (1997) commented on the possibility that GFRA1 is a candidate gene for Hirschsprung disease.

Full details of the abovementioned studies are described in the following publications, the disclosure of which are hereby incorporated by reference:

Jing, S.; Wen, D.; y, Y.; Holst, P. L.; Luo, Y.; Fang, M.; Tamir, R.; Antonio, L.; Hu, Z.; Cupples, R.; Louis, J.-C.; Hu, S.; Altrock, B. W.; Fox, G. M.: GDNF-induced activation of the Ret protein tyrosine kinase is mediated by GDNFR-alpha, a novel receptor for GDNF. Cell 85:1113-1124, 1996; and Puliti, A.; Cinti, R.; Seri, M.; Ceccherini, I.; Romeo, G.: Assignment of mouse Gfra1, the homologue of a new human HSCR candidate gene, to the telomeric region of mouse chromosome 19.

Further studies establishing the function and utilities of GFRA1 are found in John Hopkins OMIM database record ID 601496, and in cited publications listed in Table 5, which are hereby incorporated by reference. KIAA1169 (Accession) is another GAM64 target gene, herein designated TARGET GENE. KIAA1169 BINDING SITE is a target binding site found in the 5' untranslated region of mRNA encoded by KIAA1169, corresponding to a target binding site such as BINDING SITE I, BINDING SITE II or BINDING SITE III of FIG. 8. Table 4 illustrates the complementarity of the nucleotide sequences of KIAA1169 BINDING SITE, designated SEQ ID:12904, to the nucleotide sequence of GAM64 RNA, herein designated GAM RNA, also designated SEQ ID:239.

Another function of GAM64 is therefore inhibition of KIAA1169 (Accession). Accordingly, utilities of GAM64 include diagnosis, prevention and treatment of diseases and clinical conditions associated with KIAA1169.

KIAA1396 (Accession XM_032054.2) is another GAM64 target gene, herein designated TARGET GENE. KIAA1396 BINDING SITE is a target binding site found in the 3' untranslated region of mRNA encoded by KIAA1396, corresponding to a target binding site such as BINDING SITE I, BINDING SITE II or BINDING SITE III of FIG. 8. Table 4 illustrates the complementarity of the nucleotide sequences of KIAA1396 BINDING SITE, designated SEQ ID:13496, to the nucleotide sequence of GAM64 RNA, herein designated GAM RNA, also designated SEQ ID:239.

Another function of GAM64 is therefore inhibition of KIAA1396 (Accession XM_032054.2). Accordingly, utilities of GAM64 include diagnosis, prevention and treatment of diseases and clinical conditions associated with KIAA1396.

KIAA1509 (Accession XM_029353.1) is another GAM64 target gene, herein designated TARGET GENE. KIAA1509 BINDING SITE is a target binding site found in the 3' untranslated region of mRNA encoded by KIAA1509, corresponding to a target binding site such as BINDING SITE I, BINDING SITE II or BINDING SITE III of FIG. 8. Table 4 illustrates the complementarity of the nucleotide sequences of KIAA1509 BINDING SITE, designated SEQ ID:10614, to the nucleotide sequence of GAM64 RNA, herein designated GAM RNA, also designated SEQ ID:239.

Another function of GAM64 is therefore inhibition of KIAA1509 (Accession XM_029353.1). Accordingly, utilities of GAM64 include diagnosis, prevention and treatment of diseases and clinical conditions associated with KIAA1509.

KIAA1691 (Accession XM_166523.1) is another GAM64 target gene, herein designated TARGET GENE. KIAA1691 BINDING SITE is a target binding site found in the 3' untranslated region of mRNA encoded by KIAA1691, corresponding to a target binding site such as BINDING SITE I, BINDING SITE II or BINDING SITE III of FIG. 8. Table 4 illustrates the complementarity of the nucleotide sequences of KIAA1691 BINDING SITE, designated SEQ ID:5765, to the nucleotide sequence of GAM64 RNA, herein designated GAM RNA, also designated SEQ ID:239.

Another function of GAM64 is therefore inhibition of KIAA1691 (Accession XM_166523.1). Accordingly, utilities of GAM64 include diagnosis, prevention and treatment of diseases and clinical conditions associated with KIAA1691.

LOC144667 (Accession XM_096648.1) is another GAM64 target gene, herein designated TARGET GENE. LOC144667 BINDING SITE is a target binding site found in the 5' untranslated region of mRNA encoded by LOC144667, corresponding to a target binding site such as BINDING SITE I, BINDING SITE II or BINDING SITE III of FIG. 8. Table 4 illustrates the complementarity of the nucleotide sequences of LOC144667 BINDING SITE, designated SEQ ID:10853, to the nucleotide sequence of GAM64 RNA, herein designated GAM RNA, also designated SEQ ID:239.

Another function of GAM64 is therefore inhibition of LOC144667 (Accession XM_096648.1). Accordingly, utilities of GAM64 include diagnosis, prevention and treatment of diseases and clinical conditions associated with LOC144667.

LOC197350 (Accession XM_113871.3) is another GAM64 target gene, herein designated TARGET GENE. LOC197350 BINDING SITE is a target binding site found in the 5' untranslated region of mRNA encoded by LOC197350, corresponding to a target binding site such as BINDING SITE I, BINDING SITE II or BINDING SITE III of FIG. 8. Table 4 illustrates the complementarity of the nucleotide sequences of LOC197350 BINDING SITE, designated SEQ ID:15432, to the nucleotide sequence of GAM64 RNA, herein designated GAM RNA, also designated SEQ ID:239.

Another function of GAM64 is therefore inhibition of LOC197350 (Accession XM_113871.3). Accordingly, utilities of GAM64 include diagnosis, prevention and treatment of diseases and clinical conditions associated with LOC197350.

LOC220549 (Accession) is another GAM64 target gene, herein designated TARGET GENE. LOC220549 BINDING SITE is a target binding site found in the 5' untranslated region of mRNA encoded by LOC220549, corresponding to a target binding site such as BINDING SITE I, BINDING SITE II or BINDING SITE III of FIG. 8. Table 4 illustrates the complementarity of the nucleotide sequences of LOC220549 BINDING SITE, designated SEQ ID:11757, to the nucleotide sequence of GAM64 RNA, herein designated GAM RNA, also designated SEQ ID:239.

Another function of GAM64 is therefore inhibition of LOC220549 (Accession). Accordingly, utilities of GAM64 include diagnosis, prevention and treatment of diseases and clinical conditions associated with LOC220549.

LOC54466 (Accession) is another GAM64 target gene, herein designated TARGET GENE. LOC54466 BINDING SITE is a target binding site found in the 5' untranslated region of mRNA encoded by LOC54466, corresponding to a target binding site such as BINDING SITE I, BINDING SITE II or BINDING SITE III of FIG. 8. Table 4 illustrates the complementarity of the nucleotide sequences of LOC54466 BINDING SITE, designated SEQ ID:9231, to the nucleotide sequence of GAM64 RNA, herein designated GAM RNA, also designated SEQ ID:239.

Another function of GAM64 is therefore inhibition of LOC54466 (Accession). Accordingly, utilities of GAM64 include diagnosis, prevention and treatment of diseases and clinical conditions associated with LOC54466.

MGC11115 (Accession NM_032310.2) is another GAM64 target gene, herein designated TARGET GENE. MGC11115 BINDING SITE is a target binding site found in the 3' untranslated region of mRNA encoded by MGC11115, corresponding to a target binding site such as BINDING SITE I, BINDING SITE II or BINDING SITE III of FIG. 8. Table 4 illustrates the complementarity of the nucleotide sequences of MGC11115 BINDING SITE, designated SEQ ID:4324, to the nucleotide sequence of GAM64 RNA, herein designated GAM RNA, also designated SEQ ID:239.

Another function of GAM64 is therefore inhibition of MGC11115 (Accession NM_032310.2). Accordingly, utilities of GAM64 include diagnosis, prevention and treatment of diseases and clinical conditions associated with MGC11115.

MGC1842 (Accession XM_037797.4) is another GAM64 target gene, herein designated TARGET GENE. MGC1842 BINDING SITE is a target binding site found in the 3' untranslated region of mRNA encoded by MGC1842, corresponding to a target binding site such as BINDING SITE I, BINDING SITE II or BINDING SITE III of FIG. 8. Table 4 illustrates the complementarity of the nucleotide sequences of MGC1842 BINDING SITE, designated SEQ ID:8701, to the nucleotide sequence of GAM64 RNA, herein designated GAM RNA, also designated SEQ ID:239.

Another function of GAM64 is therefore inhibition of MGC1842 (Accession XM_037797.4). Accordingly, utilities of GAM64 include diagnosis, prevention and treatment of diseases and clinical conditions associated with MGC1842.

Ndrg family member 4 (NDRG4, Accession NM_020465.1) is another GAM64 target gene, herein designated TARGET GENE. NDRG4 BINDING SITE is a target binding site found in the 3' untranslated region of multiple transcripts of mRNA encoded by NDRG4, corresponding to a target binding site such as BINDING SITE I, BINDING SITE II or BINDING SITE III of FIG. 8. Table 4 illustrates the complementarity of the nucleotide sequences of NDRG4 BINDING SITE, designated SEQ ID:19628, to the nucleotide sequence of GAM64 RNA, herein designated GAM RNA, also designated SEQ ID:239.

Another function of GAM64 is therefore inhibition of Ndrg family member 4 (NDRG4, Accession NM_020465.1). Accordingly, utilities of GAM64 include diagnosis, prevention and treatment of diseases and clinical conditions associated with NDRG4.

Pdz domain containing 2 (PDZD2, Accession) is another GAM64 target gene, herein designated TARGET GENE. PDZD2 BINDING SITE is a target binding site found in the 5' untranslated region of mRNA encoded by PDZD2, corresponding to a target binding site such as BINDING SITE I, BINDING SITE II or BINDING SITE III of FIG. 8. Table 4 illustrates the complementarity of the nucleotide sequences of PDZD2 BINDING SITE, designated SEQ ID:8880, to the nucleotide sequence of GAM64 RNA, herein designated GAM RNA, also designated SEQ ID:239.

Another function of GAM64 is therefore inhibition of Pdz domain containing 2 (PDZD2, Accession). Accordingly, utilities of GAM64 include diagnosis, prevention and treatment of diseases and clinical conditions associated with PDZD2.

Rad50 homolog (s. cerevisiae) (RAD50, Accession NM_005732.2) is another GAM64 target gene, herein designated TARGET GENE. RAD50 BINDING SITE is a target binding site found in the 5' untranslated region of multiple transcripts of mRNA encoded by RAD50, corresponding to a target binding site such as BINDING SITE I, BINDING SITE II or BINDING SITE III of FIG. 8. Table 4 illustrates the complementarity of the nucleotide sequences of RAD50 BINDING SITE, designated SEQ ID:12678, to the nucleotide sequence of GAM64 RNA, herein designated GAM RNA, also designated SEQ ID:239.

Another function of GAM64 is therefore inhibition of Rad50 homolog (s. cerevisiae) (RAD50, Accession NM_005732.2), a gene which is involved in dna double-strand break repair (dsbr). and therefore may be associated with Myeloid leukemia and breast cancer. Accordingly, utilities of GAM64 include diagnosis, prevention and treatment of Myeloid leukemia and breast cancer, and of other diseases and clinical conditions associated with RAD50.

The function of RAD50 and its association with various diseases and clinical conditions, has been established by previous studies, as described hereinabove with reference to GAM34.1. Ralbp1 associated eps domain containing 2 (REPS2, Accession NM_004726.1) is another GAM64 target gene, herein designated TARGET GENE. REPS2 BINDING SITE is a target binding site found in the 5' untranslated region of mRNA encoded by REPS2, corresponding to a target binding site such as BINDING SITE I, BINDING SITE II or BINDING SITE III of FIG. 8. Table 4 illustrates the complementarity of the nucleotide sequences of REPS2 BINDING SITE, designated SEQ ID:7876, to the nucleotide sequence of GAM64 RNA, herein designated GAM RNA, also designated SEQ ID:239.

Another function of GAM64 is therefore inhibition of Ralbp1 associated eps domain containing 2 (REPS2, Accession NM_004726.1), a gene which interacts with the active form of RAS with adaptor protein GRB2 and binds calcium. Accordingly, utilities of GAM64 include diagnosis, prevention and treatment of diseases and clinical conditions associated with REPS2.

The function of REPS2 has been established by previous studies. Small G proteins have GDP-bound inactive and GTP-bound active forms; RAL proteins (e.g., RALA; 179550) shift from the inactive to the active state through the actions of RALGDS (OMIM Ref. No. 601619). RALGDS interacts with the active form of RAS (see OMIM Ref. No. HRAS; 190020). Using RALA-binding protein-1 (RALBP1; 605801) as bait in a yeast 2-hybrid screen of a brain cDNA library, Ikeda et al. (1998) isolated cDNAs encoding REPS2, which they termed POB1. Sequence analysis predicted that the 521-amino acid protein has 2 potential initiator methionines in its N terminus, a central EPS15 (OMIM Ref. No. 600051)-like domain, and 2 proline-rich regions and a putative coiled-coil structure in its C terminus. Northern blot analysis revealed strong expression in rat cerebrum, cerebellum, lung, and testis, with weak expression in kidney and no expression in heart, thymus, liver, spleen, or adrenal gland. Immunoprecipitation and immunoblot analyses confirmed that the C-terminal 146 amino acids of REPS2 and the C-terminal 147 residues of RALBP1 interact in intact cells. RAL interacts with a distinct region of RALBP1, just N terminal of the REPS2-binding domain, and both proteins can interact simultaneously with RALBP1. Immunoblot analysis established that REPS2 is tyrosine phosphorylated in response to epidermal growth factor (EGF; 131530) and interacts with the EGF receptor (EGFR; 131550), possibly through the adaptor protein GRB2 (OMIM Ref. No. 108355), with which REPS2 interacts specifically. Using nuclear magnetic resonance spectroscopy, Koshiba et al. (1999) showed that the EPS15 homology domain of REPS2 consists of 2 EF-hand structures, the second of which binds calcium.

Full details of the abovementioned studies are described in the following publications, the disclosure of which are hereby incorporated by reference:

Ikeda, M.; Ishida, O.; Hinoi, T.; Kishida, S.; Kikuchi, A.: Identification and characterization of a novel protein interacting with Ral-binding protein 1, a putative effector protein of Ral. J. Biol. Chem. 273:814-821, 1998; and Koshiba, S.; Kigawa, T.; Iwahara, J.; Kikuchi, A.; Yokoyama, S.: Solution structure of the Eps15 homology domain of a human POB1 (partner of RalBP1). FEBS Lett. 442:138-142, 1999.

Further studies establishing the function and utilities of REPS2 are found in John Hopkins OMIM database record ID 300317, and in cited publications listed in Table 5, which are hereby incorporated by reference.

FIG. 8 further provides a conceptual description of a novel bioinformatically detected of the present invention, referred to here as Genomic Address Messenger 65 (GAM65), which modulates expression of respective target genes thereof, the function and utility of which target genes is known in the art.

GAM65 is a novel bioinformatically detected regulatory, non protein coding, micro RNA (miRNA) gene. The method by which GAM65 was detected is described hereinabove with reference to FIGS. 8-15.

GAM65 gene, herein designated GAM GENE, and GAM65 target gene, herein designated TARGET GENE, are human genes contained in the human genome.

GAM65 gene encodes a GAM65 precursor RNA, herein designated GAM PRECURSOR RNA. Similar to other miRNA genes, and unlike most ordinary genes, GAM65 precursor RNA does not encode a protein. A nucleotide sequence identical or highly similar to the nucleotide sequence of GAM65 precursor RNA is designated SEQ ID:33, and is provided hereinbelow with reference to the sequence listing part. Nucleotide sequence SEQ ID:33 is located at position 72936952 relative to chromosome 14.

GAM65 precursor RNA folds onto itself, forming GAM65 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM65 precursor RNA folds onto itself, forming GAM65 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM65 precursor RNA, designated SEQ-ID:33, and a schematic representation of a predicted secondary folding of GAM65 folded precursor RNA are further described with reference to Table 2, hereby incorporated by reference.

An enzyme complex designated DICER COMPLEX, 'dices' the GAM65 folded precursor RNA into GAM65 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM65 RNA is designated SEQ ID:272, and is provided hereinbelow with references to the sequence listing part and Table 3, hereby incorporated by reference.

GAM65 target gene, herein designated TARGET GENE, encodes a corresponding messenger RNA, GAM65 target RNA, herein designated GAM TARGET RNA. GAM65 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM65 RNA, herein designated GAM RNA, binds complementarily to one or more target binding sites located in untranslated regions of GAM65 target RNA, herein designated GAM TARGET RNA. This complementary binding is due to the fact that the nucleotide sequence of GAM65 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM65 RNA may have a different number of target binding sites in untranslated regions of a GAM65 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM65 RNA, herein designated GAM RNA, to target binding sites on GAM65 target RNA, herein designated GAM TARGET RNA, such as BINDING SITE I, BINDING SITE II and BINDING SITE III, inhibits translation of GAM65 target RNA into GAM65 target protein, herein designated GAM TARGET PROTEIN. GAM target protein is therefore outlined by a broken line.

It is appreciated that GAM65 target gene, herein designated TARGET GENE, in fact represents a plurality of GAM65 target genes. The mRNA of each one of this plurality of GAM65 target genes comprises one or more target binding sites, each having a nucleotide sequence which is at least partly complementary to GAM65 RNA, herein designated GAM RNA, and which when bound by GAM65 RNA causes inhibition of translation of respective one or more GAM65 target proteins.

It is further appreciated by one skilled in the art that the mode of translational inhibition illustrated by FIG. 8 with specific reference to translational inhibition exerted by GAM65 gene, herein designated GAM GENE, on one or more GAM65 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM65 correlate with, and may be deduced from, the identity of the target genes which GAM65 binds and inhibits, and the function of these target genes, as elaborated hereinbelow.

Activating transcription factor 3 (ATF3, Accession NP_001665.1) is a GAM65 target gene, herein designated TARGET GENE. ATF3 BINDING SITE is a target binding site found in the 3' untranslated region of multiple transcripts of mRNA encoded by ATF3, corresponding to a target binding site such as BINDING SITE I, BINDING SITE II or BINDING SITE III of FIG. 8. Table 4 illustrates the complementarity of the nucleotide sequences of ATF3 BINDING SITE, designated SEQ ID:7146, to the nucleotide sequence of GAM65 RNA, herein designated GAM RNA, also designated SEQ ID:272.

A function of GAM65 is therefore inhibition of Activating transcription factor 3 (ATF3, Accession NP_001665.1). Accordingly, utilities of GAM65 include diagnosis, prevention and treatment of diseases and clinical conditions associated with ATF3.

Activating transcription factor 3 (ATF3, Accession NP_004015.2) is another GAM65 target gene, herein designated TARGET GENE. ATF3 BINDING SITE is a target binding site found in the 3' untranslated region of multiple transcripts of mRNA encoded by ATF3, corresponding to a target binding site such as BINDING SITE I, BINDING SITE II or BINDING SITE III of FIG. 8. Table 4 illustrates the complementarity of the nucleotide sequences of ATF3 BINDING SITE, designated SEQ ID:7146, to the nucleotide sequence of GAM65 RNA, herein designated GAM RNA, also designated SEQ ID:272.

Another function of GAM65 is therefore inhibition of Activating transcription factor 3 (ATF3, Accession NP_004015.2). Accordingly, utilities of GAM65 include diagnosis, prevention and treatment of diseases and clinical conditions associated with ATF3.

Bystin-like (BYSL, Accession NP_004044.2) is another GAM65 target gene, herein designated TARGET GENE. BYSL BINDING SITE is a target binding site found in the 3' untranslated region of mRNA encoded by BYSL, corresponding to a target binding site such as BINDING SITE I, BINDING SITE II or BINDING SITE III of FIG. 8. Table 4 illustrates the complementarity of the nucleotide sequences of BYSL BINDING SITE, designated SEQ ID:7672, to the nucleotide sequence of GAM65 RNA, herein designated GAM RNA, also designated SEQ ID:272.

Another function of GAM65 is therefore inhibition of Bystin-like (BYSL, Accession NP_004044.2), a gene which could be involved with trophinin and tastin in a cell adhesion molecule complex. Accordingly, utilities of GAM65 include diagnosis, prevention and treatment of diseases and clinical conditions associated with BYSL.

The function of BYSL has been established by previous studies. Trophinin (OMIM Ref. No. 300132) and tastin (OMIM Ref. No. 603872) form a cell adhesion molecule complex that may be involved in mediating the initial attachment of the blastocyst to uterine epithelial cells at the time of implantation. However, Suzuki et al. (1998) found that trophinin and tastin do not bind to each other directly in vitro or in yeast 2-hybrid assays. By using an expression assay, these authors isolated a cDNA that allowed COS-1 cells expressing trophinin to adhere to the upper surfaces of SNG-M endometrial adenocarcinoma cells. The cDNA encoded a predicted 306-amino acid protein that they named 'bystin' because it is 53% identical to Drosophila bys (symbolizing 'by the ribosomal protein S6 gene'), or mrr (myosin rod-related), protein. Bystin has an apparent molecular weight of 35 kD. Northern blot analysis revealed that bystin is expressed as a 2-kb major transcript and a 3.6-kb minor transcript in SNG-M cells and in human trophoblastic teratocarcinoma HT-H cells. Using yeast 2- and 3-hybrid assays and in vitro protein binding assay, Suzuki et al. (1998) determined that bystin binds directly to trophinin and tastin, and that this binding is enhanced when cytokeratins 8 (OMIM Ref. No. 148060) and 18 (OMIM Ref. No. 148070) are present. Immunocytochemistry of HT-H cells showed that bystin colocalizes with trophinin, tastin, and the cytokeratins. The authors suggested that these molecules form a complex in trophectoderm cells at the time of implantation. Using immunohistochemistry, Suzuki et al. (1999) determined that trophinin and bystin are found in the placenta from the sixth week of pregnancy. Both proteins were localized in the cytoplasm of the syncytiotrophoblast in the chorionic villi and in endometrial decidual cells at the uteroplacental interface. After week 10, the levels of trophinin, tastin, and bystin decreased and then disappeared from placental villi.

Full details of the abovementioned studies are described in the following publications, the disclosure of which are hereby incorporated by reference:

Suzuki, N.; Nakayama, J.; Shih, I. M.; Aoki, D.; Nozawa, S.; Fukuda, M. N.: Expression of trophinin, tastin, and bystin by trophoblast and endometrial cells in human placenta. Biol. Reprod. 60:621-627, 1999; and Suzuki, N.; Zara, J.; Sato, T.; Ong, E.; Bakhiet, N.; Oshima, R. G.; Watson, K. L.; Fukuda, M. N.: A cytoplasmic protein, bystin, interacts with trophinin, tastin, and cytokeratin and.

Further studies establishing the function and utilities of BYSL are found in John Hopkins OMIM database record ID 603871, and in cited publications listed in Table 5, which are hereby incorporated by reference. Carbonic anhydrase iii, muscle specific (CA3, Accession NP_005172.1) is another GAM65 target gene, herein designated TARGET GENE. CA3 BINDING SITE is a target binding site found in the 3' untranslated region of mRNA encoded by CA3, corresponding to a target binding site such as BINDING SITE I, BINDING SITE II or BINDING SITE III of FIG. 8. Table 4 illustrates the complementarity of the nucleotide sequences of CA3 BINDING SITE, designated SEQ ID:9592, to the nucleotide sequence of GAM65 RNA, herein designated GAM RNA, also designated SEQ ID:272.

Another function of GAM65 is therefore inhibition of Carbonic anhydrase iii, muscle specific (CA3, Accession NP_005172.1), a gene which has a muscle-specific function of reversible hydratation of carbon dioxide. Accordingly, utilities of GAM65 include diagnosis, prevention and treatment of diseases and clinical conditions associated with CA3.

The function of CA3 has been established by previous studies. Carbonic anhydrases (CAs) are a family of zinc metalloenzymes. Carbonic anhydrase III is found in high concentration in muscle. It shows relatively poor hydratase and esterase activities compared to the red cell isozymes CA I (OMIM Ref. No. 114800) and CA II (OMIM Ref. No. 259730), but is similar in subunit structure (monomer) and molecular mass (28 kD). Heath et al. (1985) explored the use of CA III in conjunction with creatine kinase detection of the carrier state for Duchenne muscular dystrophy.

Full details of the abovementioned studies are described in the following publications, the disclosure of which are hereby incorporated by reference:

Heath, R.; Carter, N. D.; Jeffery, S.; Edwards, R. J.; Watts, D. C.; Watts, R. L. : Evaluation of carrier detection of Duchenne muscular dystrophy using carbonic anhydrase III and creatine kinase. Am. J. Med. Genet. 21:291-296, 1985; and Edwards, Y. H.; Lloy, J. C.; Parkar, M.; Povey, S.: The gene for human muscle specific carbonic anhydrase (CAIII) is assigned to chromosome 8. Ann. Hum. Genet. 50:41-47, 1986.

Further studies establishing the function and utilities of CA3 are found in John Hopkins OMIM database record ID 114750, and in cited publications listed in Table 5, which are hereby incorporated by reference. Core-binding factor, runt domain, alpha subunit 2; translocated to, 2 (CBFA2T2, Accession NP_005084.1) is another GAM65 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:14682, to the nucleotide sequence of GAM65 RNA, herein designated GAM RNA, also designated SEQ ID:272.

Another function of GAM65 is therefore inhibition of Core-binding factor, runt domain, alpha subunit 2; translocated to, 2 (CBFA2T2, Accession NP_005084.1), a gene which is a putative transcription factor. Accordingly, utilities of GAM65 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Core-binding factor, runt domain, alpha subunit 2; translocated to, 2 (CBFA2T2, Accession NP_787060.1) is another GAM65 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:14682, to the nucleotide sequence of GAM65 RNA, herein designated GAM RNA, also designated SEQ ID:272.

Another function of GAM65 is therefore inhibition of Core-binding factor, runt domain, alpha subunit 2; translocated to, 2 (CBFA2T2, Accession NP_787060.1), a gene which is a putative transcription factor. Accordingly, utilities of GAM65 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Cd8 antigen, alpha polypeptide (p32) (CD8A, Accession NP_741969.1) is another GAM65 target gene, herein designated TARGET GENE. CD8A BINDING SITE is a target binding site found in the 3' untranslated region of multiple transcripts of mRNA encoded by CD8A, corresponding to a target binding site such as BINDING SITE I, BINDING SITE II or BINDING SITE III of FIG. 8. Table 4 illustrates the complementarity of the nucleotide sequences of CD8A BINDING SITE, designated SEQ ID:11570, to the nucleotide sequence of GAM65 RNA, herein designated GAM RNA, also designated SEQ ID:272.

Another function of GAM65 is therefore inhibition of Cd8 antigen, alpha polypeptide (p32) (CD8A, Accession NP_741969.1), a gene which is thought to play a role in the process of t-cell mediated killing. Accordingly, utilities of GAM65 include diagnosis, prevention and treatment of diseases and clinical conditions associated with CD8A.

The function of CD8A has been established by previous studies. Comparative structural and functional studies of mouse and human T-cell antigens showed that human cytotoxic-suppressor T cells have a molecule homologous to the mouse Lyt-2,Lyt-3 molecule (Ledbetter et al., 1981). The human homolog of Lyt-2,Lyt-3 is termed LEU2. It is selectively expressed on a subset of T cells and in structure is a multimeric macromolecule composed of individual disulfide-bonded subunits. LEU2, or T8, is expressed by most T lymphocytes with cytotoxic or suppressor function. The molecule appears to be composed of multimers of a 32-kD and a 45-kD polypeptide in thymocytes and of a 32-kD polypeptide in peripheral blood lymphocytes. LEU2 (like its proposed murine homolog Lyt-2) may play a role in target-cell recognition. Kavathas et al. (1984) isolated genomic and cDNA clones for LEU2. Giblin et al. (1989) showed that through alternative splicing of mRNA, an exon encoding a transmembrane domain of CD8 is deleted. This gives rise to a 30-kD molecule that is secreted and exists as a monomer. The splicing pattern in man differs from that found in the mouse CD8 gene. This mRNA is also alternatively spliced, but an exon encoding a cytoplasmic region is deleted, giving rise to a cell surface molecule that differs in its cytoplasmic tail from the protein encoded by the longer mRNA. Neither protein is secreted. This is an example of the different splicing patterns of 2 homologous mouse and human genes giving rise to different proteins. This represents 1 mechanism of generating diversity during speciation Animal model experiments lend further support to the function of CD8A. Leishman et al. (2001) used tetramer analysis in a mouse model to show that thymus leukemia antigen (TL; 188850), which is expressed abundantly on intestinal epithelial cells, preferentially binds to the homotypic form of CD8A (CD8A-CD8A), in contrast to other major histocompatibility complex molecules that bind to CD8A-CD8B (OMIM Ref. No. 186730). Flow cytometric analysis demonstrated that most intestinal intraepithelial lymphocytes (IELs), but not splenocytes, react specifically to TL tetramers. Leishman et al. (2001) concluded that CD8A-CD8A on IELs acts semiautonomously, rather than as a T-cell receptor coreceptor. They suggested that expression of CD8A-CD8A on IELs could have important regulatory effects that influence homeostasis, activation, and survival of IELs under the high antigen load of the intestine It is appreciated that the abovementioned animal model for CD8A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kavathas, P.; Sukhatme, V. P.; Herzenberg, L. A.; Parnes, J. R.: Isolation of the gene encoding the human T-lymphocyte differentiation antigen Leu-2 (T8) by gene transfer and cDNA subtraction. Proc. Nat. Acad. Sci. 81:7688- 7692, 1984; and Leishman, A. J.; Naidenko, O. V.; Attinger, A.; Koning, F.; Lena, C. J.; Xiong, Y.; Chang, H.-C.; Reinherz, E.; Kronenberg, M.; Cheroutre, H.: T cell responses modulated through interac.

Further studies establishing the function and utilities of CD8A are found in John Hopkins OMIM database record ID 186910, and in cited publications listed in Table 5, which are hereby incorporated by reference. Cd8 antigen, alpha polypeptide (p32) (CD8A, Accession NP_001759.3) is another GAM65 target gene, herein designated TARGET GENE. CD8A BINDING SITE is a target binding site found in the 3' untranslated region of multiple transcripts of mRNA encoded by CD8A, corresponding to a target binding site such as BINDING SITE I, BINDING SITE II or BINDING SITE III of FIG. 8. Table 4 illustrates the complementarity of the nucleotide sequences of CD8A BINDING SITE, designated SEQ ID:11570, to the nucleotide sequence of GAM65 RNA, herein designated GAM RNA, also designated SEQ ID:272.

Another function of GAM65 is therefore inhibition of Cd8 antigen, alpha polypeptide (p32) (CD8A, Accession NP_001759.3), a gene which is thought to play a role in the process of t-cell mediated killing. Accordingly, utilities of GAM65 include diagnosis, prevention and treatment of diseases and clinical conditions associated with CD8A.

The function of CD8A has been established by previous studies. Comparative structural and functional studies of mouse and human T-cell antigens showed that human cytotoxic-suppressor T cells have a molecule homologous to the mouse Lyt-2,Lyt-3 molecule (Ledbetter et al., 1981). The human homolog of Lyt-2,Lyt-3 is termed LEU2. It is selectively expressed on a subset of T cells and in structure is a multimeric macromolecule composed of individual disulfide-bonded subunits. LEU2, or T8, is expressed by most T lymphocytes with cytotoxic or suppressor function. The molecule appears to be composed of multimers of a 32-kD and a 45-kD polypeptide in thymocytes and of a 32-kD polypeptide in peripheral blood lymphocytes. LEU2 (like its proposed murine homolog Lyt-2) may play a role in target-cell recognition. Kavathas et al. (1984) isolated genomic and cDNA clones for LEU2. Giblin et al. (1989) showed that through alternative splicing of mRNA, an exon encoding a transmembrane domain of CD8 is deleted. This gives rise to a 30-kD molecule that is secreted and exists as a monomer. The splicing pattern in man differs from that found in the mouse CD8 gene. This mRNA is also alternatively spliced, but an exon encoding a cytoplasmic region is deleted, giving rise to a cell surface molecule that differs in its cytoplasmic tail from the protein encoded by the longer mRNA. Neither protein is secreted. This is an example of the different splicing patterns of 2 homologous mouse and human genes giving rise to different proteins. This represents 1 mechanism of generating diversity during speciation Animal model experiments lend further support to the function of CD8A. Leishman et al. (2001) used tetramer analysis in a mouse model to show that thymus leukemia antigen (TL; 188850), which is expressed abundantly on intestinal epithelial cells, preferentially binds to the homotypic form of CD8A (CD8A-CD8A), in contrast to other major histocompatibility complex molecules that bind to CD8A-CD8B (OMIM Ref. No. 186730). Flow cytometric analysis demonstrated that most intestinal intraepithelial lymphocytes (IELs), but not splenocytes, react specifically to TL tetramers. Leishman et al. (2001) concluded that CD8A-CD8A on IELs acts semiautonomously, rather than as a T-cell receptor coreceptor. They suggested that expression of CD8A-CD8A on IELs could have important regulatory effects that influence homeostasis, activation, and survival of IELs under the high antigen load of the intestine It is appreciated that the abovementioned animal model for CD8A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kavathas, P.; Sukhatme, V. P.; Herzenberg, L. A.; Parnes, J. R.: Isolation of the gene encoding the human T-lymphocyte differentiation antigen Leu-2 (T8) by gene transfer and cDNA subtraction. Proc. Nat. Acad. Sci. 81:7688- 7692, 1984; and Leishman, A. J.; Naidenko, O. V.; Attinger, A.; Koning, F.; Lena, C. J.; Xiong, Y.; Chang, H.-C.; Reinherz, E.; Kronenberg, M.; Cheroutre, H.: T cell responses modulated through interac.

Further studies establishing the function and utilities of CD8A are found in John Hopkins OMIM database record ID 186910, and in cited publications listed in Table 5, which are hereby incorporated by reference. Carboxylesterase 1 (monocyte/macrophage serine esterase 1) (CES1, Accession NP__001257.3) is another GAM65 target gene, herein designated TARGET GENE. CES1 BINDING SITE is a target binding site found in the 3' untranslated region of mRNA encoded by CES1, corresponding to a target binding site such as BINDING SITE I, BINDING SITE II or BINDING SITE III of FIG. 8. Table 4 illustrates the complementarity of the nucleotide sequences of CES1 BINDING SITE, designated SEQ ID:12659, to the nucleotide sequence of GAM65 RNA, herein designated GAM RNA, also designated SEQ ID:272.

Another function of GAM65 is therefore inhibition of Carboxylesterase 1 (monocyte/macrophage serine esterase 1) (CES1, Accession NP__001257.3). Accordingly, utilities of GAM65 include diagnosis, prevention and treatment of diseases and clinical conditions associated with CES1.

Chromogranin b (secretogranin 1) (CHGB, Accession NP__001810.1) is another GAM65 target gene, herein designated TARGET GENE. CHGB BINDING SITE is a target binding site found in the 3' untranslated region of mRNA encoded by CHGB, corresponding to a target binding site such as BINDING SITE I, BINDING SITE II or BINDING SITE III of FIG. 8. Table 4 illustrates the complementarity of the nucleotide sequences of CHGB BINDING SITE, designated SEQ ID:7161, to the nucleotide sequence of GAM65 RNA, herein designated GAM RNA, also designated SEQ ID:272.

Another function of GAM65 is therefore inhibition of Chromogranin b (secretogranin 1) (CHGB, Accession NP__001810.1). Accordingly, utilities of GAM65 include diagnosis, prevention and treatment of diseases and clinical conditions associated with CHGB.

CML66 (Accession NP__116258.1) is another GAM65 target gene, herein designated TARGET GENE. CML66 BINDING SITE is a target binding site found in the 3' untranslated region of mRNA encoded by CML66, corresponding to a target binding site such as BINDING SITE I, BINDING SITE II or BINDING SITE III of FIG. 8. Table 4 illustrates the complementarity of the nucleotide sequences of CML66 BINDING SITE, designated SEQ ID:10642, to the nucleotide sequence of GAM65 RNA, herein designated GAM RNA, also designated SEQ ID:272.

Another function of GAM65 is therefore inhibition of CML66 (Accession NP__116258.1). Accordingly, utilities of GAM65 include diagnosis, prevention and treatment of diseases and clinical conditions associated with CML66.

Csrp2 binding protein (CSRP2BP, Accession NP__808779.1) is another GAM65 target gene, herein designated TARGET GENE. CSRP2BP BINDING SITE is a target binding site found in the 3' untranslated region of multiple transcripts of mRNA encoded by CSRP2BP, corresponding to a target binding site such as BINDING SITE I, BINDING SITE II or BINDING SITE III of FIG. 8. Table 4 illustrates the complementarity of the nucleotide sequences of CSRP2BP BINDING SITE, designated SEQ ID:19687, to the nucleotide sequence of GAM65 RNA, herein designated GAM RNA, also designated SEQ ID:272.

Another function of GAM65 is therefore inhibition of Csrp2 binding protein (CSRP2BP, Accession NP__808779.1). Accordingly, utilities of GAM65 include diagnosis, prevention and treatment of diseases and clinical conditions associated with CSRP2BP.

Csrp2 binding protein (CSRP2BP, Accession NP__065397.1) is another GAM65 target gene, herein designated TARGET GENE. CSRP2BP BINDING SITE is a target binding site found in the 3' untranslated region of multiple transcripts of mRNA encoded by CSRP2BP, corresponding to a target binding site such as BINDING SITE I, BINDING SITE II or BINDING SITE III of FIG. 8. Table 4 illustrates the complementarity of the nucleotide sequences of CSRP2BP BINDING SITE, designated SEQ ID:19687, to the nucleotide sequence of GAM65 RNA, herein designated GAM RNA, also designated SEQ ID:272.

Another function of GAM65 is therefore inhibition of Csrp2 binding protein (CSRP2BP, Accession NP__065397.1). Accordingly, utilities of GAM65 include diagnosis, prevention and treatment of diseases and clinical conditions associated with CSRP2BP.

Chemokine (c-x3-c motif) ligand 1 (CX3CL1, Accession NP__002987.1) is another GAM65 target gene, herein designated TARGET GENE. CX3CL1 BINDING SITE is a target binding site found in the 3' untranslated region of mRNA encoded by CX3CL1, corresponding to a target binding site such as BINDING SITE I, BINDING SITE II or BINDING SITE III of FIG. 8. Table 4 illustrates the complementarity of the nucleotide sequences of CX3CL1 BINDING SITE, designated SEQ ID:17574, to the nucleotide sequence of GAM65 RNA, herein designated GAM RNA, also designated SEQ ID:272.

Another function of GAM65 is therefore inhibition of Chemokine (c-x3-c motif) ligand 1 (CX3CL1, Accession NP__002987.1). Accordingly, utilities of GAM65 include diagnosis, prevention and treatment of diseases and clinical conditions associated with CX3CL1.

Dead/h (asp-glu-ala-asp/his) box polypeptide, y chromosome (DBY, Accession NP__004651.2) is another GAM65 target gene, herein designated TARGET GENE. DBY BINDING SITE is a target binding site found in the 3' untranslated region of mRNA encoded by DBY, corresponding to a target binding site such as BINDING SITE I, BINDING SITE II or BINDING SITE III of FIG. 8. Table 4 illustrates the complementarity of the nucleotide sequences of DBY BINDING SITE, designated SEQ ID:3439, to the nucleotide sequence of GAM65 RNA, herein designated GAM RNA, also designated SEQ ID:272.

Another function of GAM65 is therefore inhibition of Dead/h (asp-glu-ala-asp/his) box polypeptide, y chromosome (DBY, Accession NP_004651.2), a gene which plays a key role in the spermatogenic process. and therefore may be associated with Male infertility. Accordingly, utilities of GAM65 include diagnosis, prevention and treatment of Male infertility, and of other diseases and clinical conditions associated with DBY.

The function of DBY has been established by previous studies. Foresta et al. (2000) reported a complete sequence map of the AZFa region (see OMIM Ref. No. 415000), the genomic structure of AZFa genes, and their deletion analysis in 173 infertile men with well-defined spermatogenic alterations. Deletions were found in 9 patients: DBY alone was deleted in 6, USP9Y only in 1, and 1 each with USP9Y-DBY or DBY-UTY missing. No patients solely lacked UTY. Patients lacking DBY exhibited either Sertoli cell-only syndrome or severe hypospermatogenesis. Expression analysis of AZFa genes and their X homologs revealed ubiquitous expression for all of them except DBY; a shorter DBY transcript was expressed only in testis. The authors suggested that DBY plays a key role in the spermatogenic process. Using COS cells to express candidate Y chromosome genes and mouse dendritic cells for antigenic presentation, Scott et al. (2000) determined that Dby expresses 2 major histocompatibility complex (MHC) class II-restricted minor histocompatibility HY determinants. No stimulatory activity was found with these epitopes in cells transfected with Smcy (OMIM Ref. No. 426000) or Uty, both of which express MHC class I-restricted epitopes.

Full details of the abovementioned studies are described in the following publications, the disclosure of which are hereby incorporated by reference:

Foresta, C.; Ferlin, A.; Moro, E.: Deletion and expression analysis of AZFa genes on the human Y chromosome revealed a major role for DBY in male infertility. Hum. Molec. Genet. 9:1161-1169, 2000; and Scott, D.; Addey, C.; Ellis, P; James, E.; Mitchell, M. J.; Saut, N.; Jurcevic, S.; Simpson, E.: Dendritic cells permit identification of genes encoding MHC class II- restricted epitope.

Further studies establishing the function and utilities of DBY are found in John Hopkins OMIM database record ID 400010, and in cited publications listed in Table 5, which are hereby incorporated by reference. Eh-domain containing 1 (EHD1, Accession NP_006786.2) is another GAM65 target gene, herein designated TARGET GENE. EHD1 BINDING SITE is a target binding site found in the 3' untranslated region of mRNA encoded by EHD1, corresponding to a target binding site such as BINDING SITE I, BINDING SITE II or BINDING SITE III of FIG. 8. Table 4 illustrates the complementarity of the nucleotide sequences of EHD1 BINDING SITE, designated SEQ ID:2264, to the nucleotide sequence of GAM65 RNA, herein designated GAM RNA, also designated SEQ ID:272.

Another function of GAM65 is therefore inhibition of Eh-domain containing 1 (EHD1, Accession NP_006786.2), a gene which may be involved in ligand-initiated endocytosis. Accordingly, utilities of GAM65 include diagnosis, prevention and treatment of diseases and clinical conditions associated with EHD1.

The function of EHD1 has been established by previous studies. By screening a human cerebellar cDNA library with a mouse genomic fragment, Mintz et al. (1999) isolated a cDNA which was then used as a probe to screen a mouse brain cDNA library. The sequences of the deduced human and mouse proteins, designated EHD1, contain 534 amino acids and share approximately 94% homology. Both proteins have an EH domain, including an EF-Ca(2+)-binding motif, at their C terminus, a highly conserved ATP/GTP-binding domain, and a central coiled-coil structure. Cotransfection experiments indicated that the human EHD1 protein has a molecular mass of 62 kD. Northern blot analysis indicated the existence of 2 EHD1 RNA species in mouse and 3 in human (2.0, 3.2, 3.6 kb). In mouse, both transcripts are highly expressed in testis and are present in kidney, heart, intestine, and brain. In human, the smallest transcript is predominant in testis, while the largest transcript is present in other tissues as well. RT-PCR analysis indicated that the 3.2-kb mRNA results from skipping of exon 3. Subcellular localization experiments indicated that EHD1 colocalizes with transferrin-containing endocytic vesicles. EHD1 was also present in other cellular structures, including the Golgi apparatus. Immunohistochemical analyses in mice demonstrated EHD1 expression in male germ cells, in adipocytes, in several retinal layers, and, to a lesser extent, in uterus, skeletal muscle, and kidney. In situ hybridization and immunohistochemical analyses indicated that Ehd1 was expressed by day 9.5 in the limb buds and pharyngeal arches and at day 10.5 in sclerotomes, at various elements of the branchial apparatus, and in the occipital region. At day 15.5 Ehd1 expression peaked in cartilage, preceding hypertrophy and ossification, and at day 17.5 there was no expression in the bones. Rotem-Yehudar et al. (2001) found evidence for a role for EHD1 in the endocytosis of IGF1 receptors (IGF1R; 147370). Through immunoprecipitation of rat tissues, they found that EHD1 interacts directly with the synaptosomal-associated protein SNAP29 (OMIM Ref. No. 604202) and that both are present in complexes with IGF1R. They also found that IGF1 induction of EHD1-transfected CHO cells results in intracellular colocalization of EHD1 and IGF1R.

Full details of the abovementioned studies are described in the following publications, the disclosure of which are hereby incorporated by reference:

Mintz, L.; Galperin, E.; Pasmanik-Chor, M.; Tulzinsky, S.; Bromberg, Y.; Kozak, C. A.; Joyner, A.; Fein, A.; Horowitz, M.: EHD1-an EH-domain-containing protein with a specific expression pattern. Genomics 59:66-76, 1999; and Rotem-Yehudar, R.; Galperin, E.; Horowitz, M.: Association of insulin-like growth factor 1 receptor with EHD1 and SNAP29. J. Biol. Chem. 276:33054-33060, 2001.

Further studies establishing the function and utilities of EHD1 are found in John Hopkins OMIM database record ID 605888, and in cited publications listed in Table 5, which are hereby incorporated by reference. Er to nucleus signalling 1 (ERN1, Accession NP_001424.1) is another GAM65 target gene, herein designated TARGET GENE. ERN1 BINDING SITE is a target binding site found in the 3' untranslated region of mRNA encoded by ERN1, corresponding to a target binding site such as BINDING SITE I, BINDING SITE II or BINDING SITE III of FIG. 8. Table 4 illustrates the complementarity of the nucleotide sequences of ERN1 BINDING SITE, designated SEQ ID:17882, to the nucleotide sequence of GAM65 RNA, herein designated GAM RNA, also designated SEQ ID:272.

Another function of GAM65 is therefore inhibition of Er to nucleus signalling 1 (ERN1, Accession NP_001424.1).

Accordingly, utilities of GAM65 include diagnosis, prevention and treatment of diseases and clinical conditions associated with ERN1.

FLJ00024 (Accession XP_033361.2) is another GAM65 target gene, herein designated TARGET GENE. FLJ00024 BINDING SITE is a target binding site found in the 5' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:1895, to the nucleotide sequence of GAM65 RNA, herein designated GAM RNA, also designated SEQ ID:272.

Another function of GAM65 is therefore inhibition of FLJ00024 (Accession XP_033361.2). Accordingly, utilities of GAM65 include diagnosis, prevention and treatment of diseases and clinical conditions associated with FLJ00024.

FLJ00024 (Accession NP_203745.1) is another GAM65 target gene, herein designated TARGET GENE. FLJ00024 BINDING SITE is a target binding site found in the 5' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:1895, to the nucleotide sequence of GAM65 RNA, herein designated GAM RNA, also designated SEQ ID:272.

Another function of GAM65 is therefore inhibition of FLJ00024 (Accession NP_203745.1). Accordingly, utilities of GAM65 include diagnosis, prevention and treatment of diseases and clinical conditions associated with FLJ00024.

FLJ20400 (Accession NP_060274.1) is another GAM65 target gene, herein designated TARGET GENE. FLJ20400 BINDING SITE is a target binding site found in the 3' untranslated region of mRNA encoded by FLJ20400, corresponding to a target binding site such as BINDING SITE I, BINDING SITE II or BINDING SITE III of FIG. 8. Table 4 illustrates the complementarity of the nucleotide sequences of FLJ20400 BINDING SITE, designated SEQ ID:1121, to the nucleotide sequence of GAM65 RNA, herein designated GAM RNA, also designated SEQ ID:272.

Another function of GAM65 is therefore inhibition of FLJ20400 (Accession NP_060274.1). Accordingly, utilities of GAM65 include diagnosis, prevention and treatment of diseases and clinical conditions associated with FLJ20400.

FLJ20514 (Accession NP_060326.1) is another GAM65 target gene, herein designated TARGET GENE. FLJ20514 BINDING SITE is a target binding site found in the 5' untranslated region of mRNA encoded by FLJ20514, corresponding to a target binding site such as BINDING SITE I, BINDING SITE II or BINDING SITE III of FIG. 8. Table 4 illustrates the complementarity of the nucleotide sequences of FLJ20514 BINDING SITE, designated SEQ ID:7512, to the nucleotide sequence of GAM65 RNA, herein designated GAM RNA, also designated SEQ ID:272.

Another function of GAM65 is therefore inhibition of FLJ20514 (Accession NP_060326.1). Accordingly, utilities of GAM65 include diagnosis, prevention and treatment of diseases and clinical conditions associated with FLJ20514.

FLJ30634 (Accession NP_694559.1) is another GAM65 target gene, herein designated TARGET GENE. FLJ30634 BINDING SITE is a target binding site found in the 3' untranslated region of mRNA encoded by FLJ30634, corresponding to a target binding site such as BINDING SITE I, BINDING SITE II or BINDING SITE III of FIG. 8. Table 4 illustrates the complementarity of the nucleotide sequences of FLJ30634 BINDING SITE, designated SEQ ID:5870, to the nucleotide sequence of GAM65 RNA, herein designated GAM RNA, also designated SEQ ID:272.

Another function of GAM65 is therefore inhibition of FLJ30634 (Accession NP_694559.1). Accordingly, utilities of GAM65 include diagnosis, prevention and treatment of diseases and clinical conditions associated with FLJ30634.

FLJ35155 (Accession NP_689744.2) is another GAM65 target gene, herein designated TARGET GENE. FLJ35155 BINDING SITE is a target binding site found in the 3' untranslated region of mRNA encoded by FLJ35155, corresponding to a target binding site such as BINDING SITE I, BINDING SITE II or BINDING SITE III of FIG. 8. Table 4 illustrates the complementarity of the nucleotide sequences of FLJ35155 BINDING SITE, designated SEQ ID:13879, to the nucleotide sequence of GAM65 RNA, herein designated GAM RNA, also designated SEQ ID:272.

Another function of GAM65 is therefore inhibition of FLJ35155 (Accession NP_689744.2). Accordingly, utilities of GAM65 include diagnosis, prevention and treatment of diseases and clinical conditions associated with FLJ35155.

Gamma-aminobutyric acid (gaba) a receptor, epsilon (GABRE, Accession NP_068822.1) is another GAM65 target gene, herein designated TARGET GENE. GABRE BINDING SITE is a target binding site found in the 5' untranslated region of multiple transcripts of mRNA encoded by GABRE, corresponding to a target binding site such as BINDING SITE I, BINDING SITE II or BINDING SITE III of FIG. 8. Table 4 illustrates the complementarity of the nucleotide sequences of GABRE BINDING SITE, designated SEQ ID:12964, to the nucleotide sequence of GAM65 RNA, herein designated GAM RNA, also designated SEQ ID:272.

Another function of GAM65 is therefore inhibition of Gamma-aminobutyric acid (gaba) a receptor, epsilon (GABRE, Accession NP_068822.1), a gene which mediates neuronal inhibition by binding to the gaba/benzodiazepine receptor and opening an integral chloride channel. and therefore may be associated with Early-onset parkinsonism (or waisman syndrome), mrx3 (a form of x-linked mental retardation). Accordingly, utilities of GAM65 include diagnosis, prevention and treatment of Early-onset parkinsonism (or waisman syndrome), mrx3 (a form of x-linked mental retardation), and of other diseases and clinical conditions associated with GABRE.

The function of GABRE has been established by previous studies. Davies et al. (1997) described a member of a new class of human GABA(A) receptor subunit, the epsilon subunit. The subunit was detected in the brain and can assemble with alpha and beta subunits. Wilke et al. (1997) also identified a cDNA sequence of a gene coding for a 506-amino acid protein, representing a member of a putative new class (epsilon) of the GABA-A receptor. The gene, symbolized GABRE, encodes a polypeptide almost identical to the one reported by Davies et al. (1997). GABRE was transcribed in several different tissues, with the highest levels being detected in adult heart and placenta. Wilke et al. (1997) observed alternative splicing of GABRE transcripts isolated from different tissues at multiple positions of the gene, yielding an unusually complex variety of cDNA variants. The structure of the 5-prime region of most cDNAs is compatible with expression of GABRE in adult brain only, whereas in other tissues, most transcripts code for truncated protein sequences. The GABRE gene extends over 14 kb and is clustered together with the alpha-3 (OMIM Ref. No. 305660) and the putative beta-4 GABA-A receptor subunit genes in an interval of approximately 0.8 Mb in band Xq28. It is located in the candidate regions of 2 different neurologic diseases, early-onset parkinsonism, or Waisman syndrome (OMIM Ref. No. 311510), and MRX3 (OMIM Ref. No. 309541), a form of X-linked mental retardation. Sinkkonen et al. (2000) obtained cDNAs encoding rat Gabre and Gabrq (OMIM Ref. No. 300349), which are highly divergent from their human homologs. They noted that rat Gabre and Gabrq have expression patterns distinct from those reported in primates.

Full details of the abovementioned studies are described in the following publications, the disclosure of which are hereby incorporated by reference:

Davies, P. A.; Hanna, M. C.; Hales, T. G.; Kirkness, E. F.: Insensitivity to anaesthetic agents conferred by a class of GABA(A) receptor subunit. Nature 385:820-823, 1997; and Sinkkonen, S. T.; Hanna, M. C.; Kirkness, E. F.; Korpi, E. R.: GABA-A receptor epsilon and theta subunits display unusual structural variation between species and are enriched in the r.

Further studies establishing the function and utilities of GABRE are found in John Hopkins OMIM database record ID 300093, and in cited publications listed in Table 5, which are hereby incorporated by reference. Gamma-aminobutyric acid (gaba) a receptor, epsilon (GABRE, Accession NP_068819.1) is another GAM65 target gene, herein designated TARGET GENE. GABRE BINDING SITE is a target binding site found in the 5' untranslated region of multiple transcripts of mRNA encoded by GABRE, corresponding to a target binding site such as BINDING SITE I, BINDING SITE II or BINDING SITE III of FIG. 8. Table 4 illustrates the complementarity of the nucleotide sequences of GABRE BINDING SITE, designated SEQ ID:12964, to the nucleotide sequence of GAM65 RNA, herein designated GAM RNA, also designated SEQ ID:272.

Another function of GAM65 is therefore inhibition of Gamma-aminobutyric acid (gaba) a receptor, epsilon (GABRE, Accession NP_068819.1), a gene which mediates neuronal inhibition by binding to the gaba/benzodiazepine receptor and opening an integral chloride channel. and therefore may be associated with Early-onset parkinsonism (or waisman syndrome), mrx3 (a form of x-linked mental retardation). Accordingly, utilities of GAM65 include diagnosis, prevention and treatment of Early-onset parkinsonism (or waisman syndrome), mrx3 (a form of x-linked mental retardation), and of other diseases and clinical conditions associated with GABRE.

The function of GABRE has been established by previous studies. Davies et al. (1997) described a member of a new class of human GABA(A) receptor subunit, the epsilon subunit. The subunit was detected in the brain and can assemble with alpha and beta subunits. Wilke et al. (1997) also identified a cDNA sequence of a gene coding for a 506-amino acid protein, representing a member of a putative new class (epsilon) of the GABA-A receptor. The gene, symbolized GABRE, encodes a polypeptide almost identical to the one reported by Davies et al. (1997). GABRE was transcribed in several different tissues, with the highest levels being detected in adult heart and placenta. Wilke et al. (1997) observed alternative splicing of GABRE transcripts isolated from different tissues at multiple positions of the gene, yielding an unusually complex variety of cDNA variants. The structure of the 5-prime region of most cDNAs is compatible with expression of GABRE in adult brain only, whereas in other tissues, most transcripts code for truncated protein sequences. The GABRE gene extends over 14 kb and is clustered together with the alpha-3 (OMIM Ref. No. 305660) and the putative beta-4 GABA-A receptor subunit genes in an interval of approximately 0.8 Mb in band Xq28. It is located in the candidate regions of 2 different neurologic diseases, early-onset parkinsonism, or Waisman syndrome (OMIM Ref. No. 311510), and MRX3 (OMIM Ref. No. 309541), a form of X-linked mental retardation. Sinkkonen et al. (2000) obtained cDNAs encoding rat Gabre and Gabrq (OMIM Ref. No. 300349), which are highly divergent from their human homologs. They noted that rat Gabre and Gabrq have expression patterns distinct from those reported in primates.

Full details of the abovementioned studies are described in the following publications, the disclosure of which are hereby incorporated by reference:

Davies, P. A.; Hanna, M. C.; Hales, T. G.; Kirkness, E. F.: Insensitivity to anaesthetic agents conferred by a class of GABA(A) receptor subunit. Nature 385:820-823, 1997; and Sinkkonen, S. T.; Hanna, M. C.; Kirkness, E. F.; Korpi, E. R.: GABA-A receptor epsilon and theta subunits display unusual structural variation between species and are enriched in the r.

Further studies establishing the function and utilities of GABRE are found in John Hopkins OMIM database record ID 300093, and in cited publications listed in Table 5, which are hereby incorporated by reference. GREB1 (Accession NP_683701.1) is another GAM65 target gene, herein designated TARGET GENE. GREB1 BINDING SITE is a target binding site found in the 3' untranslated region of multiple transcripts of mRNA encoded by GREB1, corresponding to a target binding site such as BINDING SITE I, BINDING SITE II or BINDING SITE III of FIG. 8. Table 4 illustrates the complementarity of the nucleotide sequences of GREB1 BINDING SITE, designated SEQ ID:5081, to the nucleotide sequence of GAM65 RNA, herein designated GAM RNA, also designated SEQ ID:272.

Another function of GAM65 is therefore inhibition of GREB1 (Accession NP_683701.1). Accordingly, utilities of GAM65 include diagnosis, prevention and treatment of diseases and clinical conditions associated with GREB1.

HBP1 (Accession NP_036389.2) is another GAM65 target gene, herein designated TARGET GENE. HBP1 BINDING SITE is a target binding site found in the 3' untranslated region of mRNA encoded by HBP1, corresponding to a target binding site such as BINDING SITE I, BINDING SITE II or BINDING SITE III of FIG. 8. Table 4 illustrates the complementarity of the nucleotide sequences of HBP1 BINDING SITE, designated SEQ ID:19617, to the nucleotide sequence of GAM65 RNA, herein designated GAM RNA, also designated SEQ ID:272.

Another function of GAM65 is therefore inhibition of HBP1 (Accession NP_036389.2). Accordingly, utilities of GAM65 include diagnosis, prevention and treatment of diseases and clinical conditions associated with HBP1.

HEMK (Accession NP_057257.1) is another GAM65 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:6305, to the nucleotide sequence of GAM65 RNA, herein designated GAM RNA, also designated SEQ ID:272.

Another function of GAM65 is therefore inhibition of HEMK (Accession NP_057257.1). Accordingly, utilities of GAM65 include diagnosis, prevention and treatment of diseases and clinical conditions associated with HEMK.

Heterogeneous nuclear ribonucleoprotein d (au-rich element rna binding protein 1, 37 kda) (HNRPD, Accession NP_002129.2) is another GAM65 target gene, herein designated TARGET GENE. HNRPD BINDING SITE is a target binding site found in the 3' untranslated region of multiple transcripts of mRNA encoded by HNRPD, corresponding to a target binding site such as BINDING SITE I, BINDING SITE II or BINDING SITE III of FIG. 8. Table 4 illustrates the complementarity of the nucleotide sequences of HNRPD BINDING SITE, designated SEQ ID:14479, to the nucleotide sequence of GAM65 RNA, herein designated GAM RNA, also designated SEQ ID:272.

Another function of GAM65 is therefore inhibition of Heterogeneous nuclear ribonucleoprotein d (au-rich element rna binding protein 1, 37 kda) (HNRPD, Accession NP_002129.2). Accordingly, utilities of GAM65 include diagnosis, prevention and treatment of diseases and clinical conditions associated with HNRPD.

Heterogeneous nuclear ribonucleoprotein d (au-rich element rna binding protein 1, 37 kda) (HNRPD, Accession NP_112737.1) is another GAM65 target gene, herein designated TARGET GENE. HNRPD BINDING SITE is a target binding site found in the 3' untranslated region of multiple transcripts of mRNA encoded by HNRPD, corresponding to a target binding site such as BINDING SITE I, BINDING SITE II or BINDING SITE III of FIG. 8. Table 4 illustrates the complementarity of the nucleotide sequences of HNRPD BINDING SITE, designated SEQ ID:14479, to the nucleotide sequence of GAM65 RNA, herein designated GAM RNA, also designated SEQ ID:272.

Another function of GAM65 is therefore inhibition of Heterogeneous nuclear ribonucleoprotein d (au-rich element rna binding protein 1, 37 kda) (HNRPD, Accession NP_112737.1). Accordingly, utilities of GAM65 include diagnosis, prevention and treatment of diseases and clinical conditions associated with HNRPD.

Heterogeneous nuclear ribonucleoprotein d (au-rich element rna binding protein 1, 37 kda) (HNRPD, Accession NP_112738.1) is another GAM65 target gene, herein designated TARGET GENE. HNRPD BINDING SITE is a target binding site found in the 3' untranslated region of multiple transcripts of mRNA encoded by HNRPD, corresponding to a target binding site such as BINDING SITE I, BINDING SITE II or BINDING SITE III of FIG. 8. Table 4 illustrates the complementarity of the nucleotide sequences of HNRPD BINDING SITE, designated SEQ ID:14479, to the nucleotide sequence of GAM65 RNA, herein designated GAM RNA, also designated SEQ ID:272.

Another function of GAM65 is therefore inhibition of Heterogeneous nuclear ribonucleoprotein d (au-rich element rna binding protein 1, 37 kda) (HNRPD, Accession NP_112738.1). Accordingly, utilities of GAM65 include diagnosis, prevention and treatment of diseases and clinical conditions associated with HNRPD.

Heparan sulfate 2-o-sulfotransferase 1 (HS2ST1, Accession NP_036394.1) is another GAM65 target gene, herein designated TARGET GENE. HS2ST1 BINDING SITE is a target binding site found in the 3' untranslated region of mRNA encoded by HS2ST1, corresponding to a target binding site such as BINDING SITE I, BINDING SITE II or BINDING SITE III of FIG. 8. Table 4 illustrates the complementarity of the nucleotide sequences of HS2ST1 BINDING SITE, designated SEQ ID:19213, to the nucleotide sequence of GAM65 RNA, herein designated GAM RNA, also designated SEQ ID:272.

Another function of GAM65 is therefore inhibition of Heparan sulfate 2-o-sulfotransferase 1 (HS2ST1, Accession NP_036394.1). Accordingly, utilities of GAM65 include diagnosis, prevention and treatment of diseases and clinical conditions associated with HS2ST1.

HSPC056 (Accession NP_054873.1) is another GAM65 target gene, herein designated TARGET GENE. HSPC056 BINDING SITE is a target binding site found in the 3' untranslated region of mRNA encoded by HSPC056, corresponding to a target binding site such as BINDING SITE I, BINDING SITE II or BINDING SITE III of FIG. 8. Table 4 illustrates the complementarity of the nucleotide sequences of HSPC056 BINDING SITE, designated SEQ ID:8261, to the nucleotide sequence of GAM65 RNA, herein designated GAM RNA, also designated SEQ ID:272.

Another function of GAM65 is therefore inhibition of HSPC056 (Accession NP_054873.1). Accordingly, utilities of GAM65 include diagnosis, prevention and treatment of diseases and clinical conditions associated with HSPC056.

Integrin, alpha v (vitronectin receptor, alpha polypeptide, antigen cd51) (ITGAV, Accession NP_002201.1) is another GAM65 target gene, herein designated TARGET GENE. ITGAV BINDING SITE is a target binding site found in the 3' untranslated region of mRNA encoded by ITGAV, corresponding to a target binding site such as BINDING SITE I, BINDING SITE II or BINDING SITE III of FIG. 8. Table 4 illustrates the complementarity of the nucleotide sequences of ITGAV BINDING SITE, designated SEQ ID:15711, to the nucleotide sequence of GAM65 RNA, herein designated GAM RNA, also designated SEQ ID:272.

Another function of GAM65 is therefore inhibition of Integrin, alpha v (vitronectin receptor, alpha polypeptide, antigen cd51) (ITGAV, Accession NP_002201.1), a gene which is a member of the integrin family of cell-surface proteins. Accordingly, utilities of GAM65 include diagnosis, prevention and treatment of diseases and clinical conditions associated with ITGAV.

The function of ITGAV has been established by previous studies. A major surface antigen family on human leukocytes includes complement receptor type 3 (CR3A; also called integrin alpha-M, Mac1 or Mo1), lymphocyte function- associated antigen type 1 (LFA-1; 153370), and p150,95 (Leu M5; 151510). These antigens share a common beta chain (OMIM Ref. No. 116920) of 94 kD, linked noncovalently to 1 of 3 alpha chains distinctive to each. They promote adhesion of granulocytes to each other and to endothelial cell monolayers. The apparent molecular weight of the Mo1 alpha chain is 155 to 165 kD, that of the LFA1 alpha subunit is 180 kD, and that of the Leu M5 subunit is 130 to 150 kD. Pierce et al. (1986) purified human Mo1 to homogeneity from normal granulocytes by affinity chromatography and high performance liquid chromatography (HPLC) and determined the N-terminal amino acid sequence of its alpha subunit. The obtained sequence was identical, except for 2 conservative substitutions, to that of the alpha subunit of Mac1 antigen (Springer et al., 1985). Furthermore, Pierce et al. (1986) found that the N-terminal amino acid sequence of the alpha subunit of Mo1 was homologous to the alpha subunit of IIb/IIIa, a glycoprotein that serves similar adhesive functions on platelets and is deficient or defective in Glanzmann thrombasthenia (OMIM Ref. No. 273800). Patients with a history of recurrent bacterial infections and an inherited deficiency of all 3 leukocyte membrane surface antigens are thought to have reduced or absent synthesis of the common beta subunit of the antigen family; see 116920. Inflammation plays an essential role in the initiation and progression of atherosclerosis. Simon et al. (2000) presented evidence that it also has a role in vascular repair after mechanical arterial injury (i.e., percutaneous transluminal coronary angioplasty, or PTCA). In animal models of vascular injury, leukocytes are recruited as a precursor to intimal thickening. Markers of leukocyte activation, in particular, increased expression of Mac1, which is responsible for firm leukocyte adhesion to platelets and fibrinogen on denuded vessels, predict restenosis after PTCA. To determine whether Mac1-mediated leukocyte recruitment is causally related to neointimal formation, Simon et al. (2000) subjected Mac1 knockout mice to a mechanical carotid artery dilation and complete endothelial denudation. They found that the selective absence of Mac1 impaired transplatelet leukocyte migration into the vessel wall, reducing leukocyte accumulation. Diminished medial leukocyte accumulation was accompanied by markedly reduced neointimal thickening after vascular injury. These data established a role for inflammation in neointimal thickening and suggested that leukocyte recruitment to mechanically injured arteries may prevent restenosis Full details of the abovementioned studies are described in the following publications, the disclosure of which are hereby incorporated by reference:

Pierce, M. W.; Remold-O'Donnell, E.; Todd, R. F., III; Arnaout, M. A.: N-terminal sequence of human leukocyte glycoprotein Mo1: conservation across species and homology to platelet IIb/IIIa. Biochim. Biophys. Acta 874:368-371, 1986; and Simon, D. I.; Chen, Z.; Seifert, P.; Edelman, E. R.; Ballantyne, C. M.; Rogers, C. : Decreased neointimal formation in Mac-1 -/- mice reveals a role for inflammation in vascular repair a.

Further studies establishing the function and utilities of ITGAV are found in John Hopkins OMIM database record ID 193210, and in cited publications listed in Table 5, which are hereby incorporated by reference. Potassium channel, subfamily k, member 7 (KCNK7, Accession NP_005705.1) is another GAM65 target gene, herein designated TARGET GENE. KCNK7 BINDING SITE is a target binding site found in the 3' untranslated region of multiple transcripts of mRNA encoded by KCNK7, corresponding to a target binding site such as BINDING SITE I, BINDING SITE II or BINDING SITE III of FIG. 8. Table 4 illustrates the complementarity of the nucleotide sequences of KCNK7 BINDING SITE, designated SEQ ID:19349, to the nucleotide sequence of GAM65 RNA, herein designated GAM RNA, also designated SEQ ID:272.

Another function of GAM65 is therefore inhibition of Potassium channel, subfamily k, member 7 (KCNK7, Accession NP_005705.1). Accordingly, utilities of GAM65 include diagnosis, prevention and treatment of diseases and clinical conditions associated with KCNK7.

Potassium channel, subfamily k, member 7 (KCNK7, Accession NP_258416.1) is another GAM65 target gene, herein designated TARGET GENE. KCNK7 BINDING SITE is a target binding site found in the 3' untranslated region of multiple transcripts of mRNA encoded by KCNK7, corresponding to a target binding site such as BINDING SITE I, BINDING SITE II or BINDING SITE III of FIG. 8. Table 4 illustrates the complementarity of the nucleotide sequences of KCNK7 BINDING SITE, designated SEQ ID:19349, to the nucleotide sequence of GAM65 RNA, herein designated GAM RNA, also designated SEQ ID:272.

Another function of GAM65 is therefore inhibition of Potassium channel, subfamily k, member 7 (KCNK7, Accession NP_258416.1). Accordingly, utilities of GAM65 include diagnosis, prevention and treatment of diseases and clinical conditions associated with KCNK7.

KIAA0350 (Accession XP_290667.1) is another GAM65 target gene, herein designated TARGET GENE. KIAA0350 BINDING SITE is a target binding site found in the 3' untranslated region of mRNA encoded by KIAA0350, corresponding to a target binding site such as BINDING SITE I, BINDING SITE II or BINDING SITE III of FIG. 8. Table 4 illustrates the complementarity of the nucleotide sequences of KIAA0350 BINDING SITE, designated SEQ ID:594, to the nucleotide sequence of GAM65 RNA, herein designated GAM RNA, also designated SEQ ID:272.

Another function of GAM65 is therefore inhibition of KIAA0350 (Accession XP_290667.1). Accordingly, utilities of GAM65 include diagnosis, prevention and treatment of diseases and clinical conditions associated with KIAA0350.

KIAA0557 (Accession XP_085507.1) is another GAM65 target gene, herein designated TARGET GENE. KIAA0557 BINDING SITE is a target binding site found in the 3' untranslated region of mRNA encoded by KIAA0557, corresponding to a target binding site such as BINDING SITE I, BINDING SITE II or BINDING SITE III of FIG. 8. Table 4 illustrates the complementarity of the nucleotide sequences of KIAA0557 BINDING SITE, designated SEQ ID:18362, to the nucleotide sequence of GAM65 RNA, herein designated GAM RNA, also designated SEQ ID:272.

Another function of GAM65 is therefore inhibition of KIAA0557 (Accession XP_085507.1). Accordingly, utilities of GAM65 include diagnosis, prevention and treatment of diseases and clinical conditions associated with KIAA0557.

KIAA0562 (Accession NP_055519.1) is another GAM65 target gene, herein designated TARGET GENE. KIAA0562 BINDING SITE is a target binding site found in the 3' untranslated region of mRNA encoded by KIAA0562, corresponding to a target binding site such as BINDING SITE I, BINDING SITE II or BINDING SITE III of FIG. 8. Table 4 illustrates the complementarity of the nucleotide sequences of KIAA0562 BINDING SITE, designated SEQ ID:13255, to the nucleotide sequence of GAM65 RNA, herein designated GAM RNA, also designated SEQ ID:272.

Another function of GAM65 is therefore inhibition of KIAA0562 (Accession NP_055519.1). Accordingly, utilities of GAM65 include diagnosis, prevention and treatment of diseases and clinical conditions associated with KIAA0562.

KIAA0632 (Accession NP_056360.1) is another GAM65 target gene, herein designated TARGET GENE. KIAA0632 BINDING SITE is a target binding site found in the 5' untranslated region of mRNA encoded by KIAA0632, corresponding to a target binding site such as BINDING SITE I, BINDING SITE II or BINDING SITE III of FIG. 8. Table 4 illustrates the complementarity of the nucleotide sequences of KIAA0632 BINDING SITE, designated SEQ ID:14190, to the nucleotide sequence of GAM65 RNA, herein designated GAM RNA, also designated SEQ ID:272.

Another function of GAM65 is therefore inhibition of KIAA0632 (Accession NP_056360.1). Accordingly, utilities of GAM65 include diagnosis, prevention and treatment of diseases and clinical conditions associated with KIAA0632.

KIAA0804 (Accession XP_291080.1) is another GAM65 target gene, herein designated TARGET GENE. KIAA0804 BINDING SITE is a target binding site found in the 3' untranslated region of mRNA encoded by KIAA0804, corresponding to a target binding site such as BINDING SITE I, BINDING SITE II or BINDING SITE III of FIG. 8. Table 4 illustrates the complementarity of the nucleotide sequences of KIAA0804 BINDING SITE, designated SEQ ID:15077, to the nucleotide sequence of GAM65 RNA, herein designated GAM RNA, also designated SEQ ID:272.

Another function of GAM65 is therefore inhibition of KIAA0804 (Accession XP_291080.1). Accordingly, utilities of GAM65 include diagnosis, prevention and treatment of diseases and clinical conditions associated with KIAA0804.

KIAA1349 (Accession XP_047617.4) is another GAM65 target gene, herein designated TARGET GENE. KIAA1349 BINDING SITE is a target binding site found in the 3' untranslated region of mRNA encoded by KIAA1349, corresponding to a target binding site such as BINDING SITE I, BINDING SITE II or BINDING SITE III of FIG. 8. Table 4 illustrates the complementarity of the nucleotide sequences of KIAA1349 BINDING SITE, designated SEQ ID:4109, to the nucleotide sequence of GAM65 RNA, herein designated GAM RNA, also designated SEQ ID:272.

Another function of GAM65 is therefore inhibition of KIAA1349 (Accession XP_047617.4). Accordingly, utilities of GAM65 include diagnosis, prevention and treatment of diseases and clinical conditions associated with KIAA1349.

KIAA1423 (Accession XP_029703.1) is another GAM65 target gene, herein designated TARGET GENE. KIAA1423 BINDING SITE is a target binding site found in the 3' untranslated region of mRNA encoded by KIAA1423, corresponding to a target binding site such as BINDING SITE I, BINDING SITE II or BINDING SITE III of FIG. 8. Table 4 illustrates the complementarity of the nucleotide sequences of KIAA1423 BINDING SITE, designated SEQ ID:19203, to the nucleotide sequence of GAM65 RNA, herein designated GAM RNA, also designated SEQ ID:272.

Another function of GAM65 is therefore inhibition of KIAA1423 (Accession XP_029703.1). Accordingly, utilities of GAM65 include diagnosis, prevention and treatment of diseases and clinical conditions associated with KIAA1423.

KIAA2022 (Accession XP_291326.1) is another GAM65 target gene, herein designated TARGET GENE. KIAA2022 BINDING SITE is a target binding site found in the 3' untranslated region of mRNA encoded by KIAA2022, corresponding to a target binding site such as BINDING SITE I, BINDING SITE II or BINDING SITE III of FIG. 8. Table 4 illustrates the complementarity of the nucleotide sequences of KIAA2022 BINDING SITE, designated SEQ ID:18104, to the nucleotide sequence of GAM65 RNA, herein designated GAM RNA, also designated SEQ ID:272.

Another function of GAM65 is therefore inhibition of KIAA2022 (Accession XP_291326.1). Accordingly, utilities of GAM65 include diagnosis, prevention and treatment of diseases and clinical conditions associated with KIAA2022.

LNIR (Accession NP_112178.1) is another GAM65 target gene, herein designated TARGET GENE. LNIR BINDING SITE is a target binding site found in the 3' untranslated region of mRNA encoded by LNIR, corresponding to a target binding site such as BINDING SITE I, BINDING SITE II or BINDING SITE III of FIG. 8. Table 4 illustrates the complementarity of the nucleotide sequences of LNIR BINDING SITE, designated SEQ ID:18936, to the nucleotide sequence of GAM65 RNA, herein designated GAM RNA, also designated SEQ ID:272.

Another function of GAM65 is therefore inhibition of LNIR (Accession NP_112178.1). Accordingly, utilities of GAM65 include diagnosis, prevention and treatment of diseases and clinical conditions associated with LNIR.

LOC137829 (Accession XP_059923.2) is another GAM65 target gene, herein designated TARGET GENE. LOC137829 BINDING SITE is a target binding site found in the 3' untranslated region of mRNA encoded by LOC137829, corresponding to a target binding site such as BINDING SITE I, BINDING SITE II or BINDING SITE III of FIG. 8. Table 4 illustrates the complementarity of the nucleotide sequences of LOC137829 BINDING SITE, designated SEQ ID:6165, to the nucleotide sequence of GAM65 RNA, herein designated GAM RNA, also designated SEQ ID:272.

Another function of GAM65 is therefore inhibition of LOC137829 (Accession XP_059923.2). Accordingly, utilities of GAM65 include diagnosis, prevention and treatment of diseases and clinical conditions associated with LOC137829.

LOC152245 (Accession XP_098182.1) is another GAM65 target gene, herein designated TARGET GENE. LOC152245 BINDING SITE is a target binding site found in the 3' untranslated region of mRNA encoded by LOC152245, corresponding to a target binding site such as BINDING SITE I, BINDING SITE II or BINDING SITE III of FIG. 8. Table 4 illustrates the complementarity of the nucleotide sequences of LOC152245 BINDING SITE, designated SEQ ID:16959, to the nucleotide sequence of GAM65 RNA, herein designated GAM RNA, also designated SEQ ID:272.

Another function of GAM65 is therefore inhibition of LOC152245 (Accession XP_098182.1). Accordingly, utilities of GAM65 include diagnosis, prevention and treatment of diseases and clinical conditions associated with LOC152245.

LOC154877 (Accession XP_098626.1) is another GAM65 target gene, herein designated TARGET GENE. LOC154877 BINDING SITE is a target binding site found in the 3' untranslated region of mRNA encoded by LOC154877, corresponding to a target binding site such as BINDING SITE I, BINDING SITE II or BINDING SITE III of FIG. 8. Table 4 illustrates the complementarity of the nucleotide sequences of LOC154877 BINDING SITE, designated SEQ ID:18739, to the nucleotide sequence of GAM65 RNA, herein designated GAM RNA, also designated SEQ ID:272.

Another function of GAM65 is therefore inhibition of LOC154877 (Accession XP_098626.1). Accordingly, utilities of GAM65 include diagnosis, prevention and treatment of diseases and clinical conditions associated with LOC154877.

LOC220963 (Accession XP_166145.2) is another GAM65 target gene, herein designated TARGET GENE. LOC220963 BINDING SITE is a target binding site found in the 3' untranslated region of mRNA encoded by LOC220963, corresponding to a target binding site such as BINDING SITE I, BINDING SITE II or BINDING SITE III of FIG. 8. Table 4 illustrates the complementarity of the nucleotide sequences of LOC220963 BINDING SITE, designated SEQ ID:20127, to the nucleotide sequence of GAM65 RNA, herein designated GAM RNA, also designated SEQ ID:272.

Another function of GAM65 is therefore inhibition of LOC220963 (Accession XP_166145.2). Accordingly, utilities of GAM65 include diagnosis, prevention and treatment of diseases and clinical conditions associated with LOC220963.

LOC255967 (Accession NP_787050.1) is another GAM65 target gene, herein designated TARGET GENE. LOC255967 BINDING SITE is a target binding site found in the 3' untranslated region of mRNA encoded by LOC255967, corresponding to a target binding site such as BINDING SITE I, BINDING SITE II or BINDING SITE III of FIG. 8. Table 4 illustrates the complementarity of the nucleotide sequences of LOC255967 BINDING SITE, designated SEQ ID:10361, to the nucleotide sequence of GAM65 RNA, herein designated GAM RNA, also designated SEQ ID:272.

Another function of GAM65 is therefore inhibition of LOC255967 (Accession NP_787050.1). Accordingly, utilities of GAM65 include diagnosis, prevention and treatment of diseases and clinical conditions associated with LOC255967.

LOC283154 (Accession XP_210922.1) is another GAM65 target gene, herein designated TARGET GENE. LOC283154 BINDING SITE is a target binding site found in the 3' untranslated region of mRNA encoded by LOC283154, corresponding to a target binding site such as BINDING SITE I, BINDING SITE II or BINDING SITE III of FIG. 8. Table 4 illustrates the complementarity of the nucleotide sequences of LOC283154 BINDING SITE, designated SEQ ID:1913, to the nucleotide sequence of GAM65 RNA, herein designated GAM RNA, also designated SEQ ID:272.

Another function of GAM65 is therefore inhibition of LOC283154 (Accession XP_210922.1). Accordingly, utilities of GAM65 include diagnosis, prevention and treatment of diseases and clinical conditions associated with LOC283154.

LOC283170 (Accession XP_208535.1) is another GAM65 target gene, herein designated TARGET GENE. LOC283170 BINDING SITE is a target binding site found in the 3' untranslated region of mRNA encoded by LOC283170, corresponding to a target binding site such as BINDING SITE I, BINDING SITE II or BINDING SITE III of FIG. 8. Table 4 illustrates the complementarity of the nucleotide sequences of LOC283170 BINDING SITE, designated SEQ ID:19931, to the nucleotide sequence of GAM65 RNA, herein designated GAM RNA, also designated SEQ ID:272.

Another function of GAM65 is therefore inhibition of LOC283170 (Accession XP_208535.1). Accordingly, utilities of GAM65 include diagnosis, prevention and treatment of diseases and clinical conditions associated with LOC283170.

LOC283664 (Accession XP_208773.1) is another GAM65 target gene, herein designated TARGET GENE. LOC283664 BINDING SITE is a target binding site found in the 3' untranslated region of mRNA encoded by LOC283664, corresponding to a target binding site such as BINDING SITE I, BINDING SITE II or BINDING SITE III of FIG. 8. Table 4 illustrates the complementarity of the nucleotide sequences of LOC283664 BINDING SITE, designated SEQ ID:18325, to the nucleotide sequence of GAM65 RNA, herein designated GAM RNA, also designated SEQ ID:272.

Another function of GAM65 is therefore inhibition of LOC283664 (Accession XP_208773.1). Accordingly, utilities of GAM65 include diagnosis, prevention and treatment of diseases and clinical conditions associated with LOC283664.

LOC284555 (Accession XP_211518.1) is another GAM65 target gene, herein designated TARGET GENE. LOC284555 BINDING SITE is a target binding site found in the 3' untranslated region of mRNA encoded by LOC284555, corresponding to a target binding site such as BINDING SITE I, BINDING SITE II or BINDING SITE III of FIG. 8. Table 4 illustrates the complementarity of the nucleotide sequences of LOC284555 BINDING SITE, designated SEQ ID:11631, to the nucleotide sequence of GAM65 RNA, herein designated GAM RNA, also designated SEQ ID:272.

Another function of GAM65 is therefore inhibition of LOC284555 (Accession XP_211518.1). Accordingly, utilities of GAM65 include diagnosis, prevention and treatment of diseases and clinical conditions associated with LOC284555.

LOC284647 (Accession XP_211569.1) is another GAM65 target gene, herein designated TARGET GENE.

LOC284647 BINDING SITE is a target binding site found in the 3' untranslated region of mRNA encoded by LOC284647, corresponding to a target binding site such as BINDING SITE I, BINDING SITE II or BINDING SITE III of FIG. 8. Table 4 illustrates the complementarity of the nucleotide sequences of LOC284647 BINDING SITE, designated SEQ ID:18217, to the nucleotide sequence of GAM65 RNA, herein designated GAM RNA, also designated SEQ ID:272.

Another function of GAM65 is therefore inhibition of LOC284647 (Accession XP_211569.1). Accordingly, utilities of GAM65 include diagnosis, prevention and treatment of diseases and clinical conditions associated with LOC284647.

LOC285216 (Accession XP_209520.1) is another GAM65 target gene, herein designated TARGET GENE. LOC285216 BINDING SITE is a target binding site found in the 5' untranslated region of mRNA encoded by LOC285216, corresponding to a target binding site such as BINDING SITE I, BINDING SITE II or BINDING SITE III of FIG. 8. Table 4 illustrates the complementarity of the nucleotide sequences of LOC285216 BINDING SITE, designated SEQ ID:5907, to the nucleotide sequence of GAM65 RNA, herein designated GAM RNA, also designated SEQ ID:272.

Another function of GAM65 is therefore inhibition of LOC285216 (Accession XP_209520.1). Accordingly, utilities of GAM65 include diagnosis, prevention and treatment of diseases and clinical conditions associated with LOC285216.

LOC285806 (Accession XP_212028.1) is another GAM65 target gene, herein designated TARGET GENE. LOC285806 BINDING SITE is a target binding site found in the 3' untranslated region of mRNA encoded by LOC285806, corresponding to a target binding site such as BINDING SITE I, BINDING SITE II or BINDING SITE III of FIG. 8. Table 4 illustrates the complementarity of the nucleotide sequences of LOC285806 BINDING SITE, designated SEQ ID:12618, to the nucleotide sequence of GAM65 RNA, herein designated GAM RNA, also designated SEQ ID:272.

Another function of GAM65 is therefore inhibition of LOC285806 (Accession XP_212028.1). Accordingly, utilities of GAM65 include diagnosis, prevention and treatment of diseases and clinical conditions associated with LOC285806.

LOC286374 (Accession XP_212293.1) is another GAM65 target gene, herein designated TARGET GENE. LOC286374 BINDING SITE1 and LOC286374 BINDING SITE2 are target binding sites found in untranslated regions of mRNA encoded by LOC286374, corresponding to target binding sites such as BINDING SITE I, BINDING SITE II or BINDING SITE III of FIG. 8. Table 4 illustrates the complementarity of the nucleotide sequences of LOC286374 BINDING SITE1 and LOC286374 BINDING SITE2, designated SEQ ID:7390 and SEQ ID:19118 respectively, to the nucleotide sequence of GAM65 RNA, herein designated GAM RNA, also designated SEQ ID:272.

Another function of GAM65 is therefore inhibition of LOC286374 (Accession XP_212293.1). Accordingly, utilities of GAM65 include diagnosis, prevention and treatment of diseases and clinical conditions associated with LOC286374.

LOC339556 (Accession XP_290951.1) is another GAM65 target gene, herein designated TARGET GENE. LOC339556 BINDING SITE is a target binding site found in the 3' untranslated region of mRNA encoded by LOC339556, corresponding to a target binding site such as BINDING SITE I, BINDING SITE II or BINDING SITE III of FIG. 8. Table 4 illustrates the complementarity of the nucleotide sequences of LOC339556 BINDING SITE, designated SEQ ID:11280, to the nucleotide sequence of GAM65 RNA, herein designated GAM RNA, also designated SEQ ID:272.

Another function of GAM65 is therefore inhibition of LOC339556 (Accession XP_290951.1). Accordingly, utilities of GAM65 include diagnosis, prevention and treatment of diseases and clinical conditions associated with LOC339556.

LOC339929 (Accession XP_295105.1) is another GAM65 target gene, herein designated TARGET GENE. LOC339929 BINDING SITE is a target binding site found in the 3' untranslated region of mRNA encoded by LOC339929, corresponding to a target binding site such as BINDING SITE I, BINDING SITE II or BINDING SITE III of FIG. 8. Table 4 illustrates the complementarity of the nucleotide sequences of LOC339929 BINDING SITE, designated SEQ ID:18421, to the nucleotide sequence of GAM65 RNA, herein designated GAM RNA, also designated SEQ ID:272.

Another function of GAM65 is therefore inhibition of LOC339929 (Accession XP_295105.1). Accordingly, utilities of GAM65 include diagnosis, prevention and treatment of diseases and clinical conditions associated with LOC339929.

LOC349037 (Accession XP_302942.1) is another GAM65 target gene, herein designated TARGET GENE. LOC349037 BINDING SITE is a target binding site found in the 5' untranslated region of mRNA encoded by LOC349037, corresponding to a target binding site such as BINDING SITE I, BINDING SITE II or BINDING SITE III of FIG. 8. Table 4 illustrates the complementarity of the nucleotide sequences of LOC349037 BINDING SITE, designated SEQ ID:13327, to the nucleotide sequence of GAM65 RNA, herein designated GAM RNA, also designated SEQ ID:272.

Another function of GAM65 is therefore inhibition of LOC349037 (Accession XP_302942.1). Accordingly, utilities of GAM65 include diagnosis, prevention and treatment of diseases and clinical conditions associated with LOC349037.

LOC90670 (Accession XP_033352.1) is another GAM65 target gene, herein designated TARGET GENE. LOC90670 BINDING SITE1 and LOC90670 BINDING SITE2 are target binding sites found in untranslated regions of mRNA encoded by LOC90670, corresponding to target binding sites such as BINDING SITE I, BINDING SITE II or BINDING SITE III of FIG. 8. Table 4 illustrates the complementarity of the nucleotide sequences of LOC90670 BINDING SITE1 and LOC90670 BINDING SITE2, designated SEQ ID:18422 and SEQ ID:2098 respectively, to the nucleotide sequence of GAM65 RNA, herein designated GAM RNA, also designated SEQ ID:272.

Another function of GAM65 is therefore inhibition of LOC90670 (Accession XP_033352.1). Accordingly, utilities of GAM65 include diagnosis, prevention and treatment of diseases and clinical conditions associated with LOC90670.

Mastermind-like 1 (drosophila) (MAML1, Accession NP_055572.1) is another GAM65 target gene, herein designated TARGET GENE. MAML1 BINDING SITE is a target binding site found in the 3' untranslated region of mRNA encoded by MAML1, corresponding to a target binding site such as BINDING SITE I, BINDING SITE II or BINDING SITE III of FIG. 8. Table 4 illustrates the complementarity of the nucleotide sequences of MAML1 BINDING SITE, designated SEQ ID:4165, to the nucleotide sequence of GAM65 RNA, herein designated GAM RNA, also designated SEQ ID:272.

Another function of GAM65 is therefore inhibition of Mastermind-like 1 (drosophila) (MAML1, Accession NP_055572.1), a gene which MAML1 functions as a transcriptional coactivator for Notch signaling. Accordingly, utilities of GAM65 include diagnosis, prevention and treatment of diseases and clinical conditions associated with MAML1.

The function of MAML1 has been established by previous studies. Notch receptors (see OMIM Ref. No. NOTCH2; 600275) are involved in cell-fate determination in organisms as diverse as flies, frogs, and humans. The 'mastermind' gene has been identified in multiple genetic screens for modifiers of Notch mutations in Drosophila. Using a yeast 2-hybrid system on a HeLa cell cDNA library, Wu et al. (2000) isolated a cDNA encoding MAML1, a human homolog of Drosophila mastermind. The MAML1 gene encodes a 130-kD, 1,016-amino acid protein that localizes to nuclear bodies. MAML1 shares 24% amino acid identity and 27% amino acid similarity with Drosophila mastermind and is identical to the KIAA0200 protein reported by Nagase et al. (1996). Northern blot analysis detected a single 6-kb MAML1 transcript in all tissues tested, with an additional 1-kb transcript in placenta. MAML1 binds to the ankyrin repeat domain of all 4 mammalian Notch receptors and amplifies Notch- induced transcription of HES1 (OMIM Ref. No. 601659). These studies provided a molecular mechanism to explain the genetic links between mastermind and Notch in Drosophila and indicated that MAML1 functions as a transcriptional coactivator for Notch signaling Full details of the abovementioned studies are described in the following publications, the disclosure of which are hereby incorporated by reference:

Nagase, T.; Seki, N.; Ishikawa, K.; Tanaka, A.; Nomura, N.: Prediction of the coding sequences of unidentified human genes. V. The coding sequences of 40 new genes (KIAA0161-KIAA0200) deduced by analysis of cDNA clones from human cell line KG-1. DNA Res. 3:17-24, 1996; and Wu, L.; Aster, J. C.; Blacklow, S. C.; Lake, R.; Artavanis-Tsakonas, S.; Griffin, J. D.: MAML1, a human homologue of Drosophila mastermind, is a transcriptional co-activator for NOTCH r.

Further studies establishing the function and utilities of MAML1 are found in John Hopkins OMIM database record ID 605424, and in cited publications listed in Table 5, which are hereby incorporated by reference. Mitogen-activated protein kinase-activated protein kinase 3 (MAPKAPK3, Accession NP_004626.1) is another GAM65 target gene, herein designated TARGET GENE. MAPKAPK3 BINDING SITE is a target binding site found in the 3' untranslated region of mRNA encoded by MAPKAPK3, corresponding to a target binding site such as BINDING SITE I, BINDING SITE II or BINDING SITE III of FIG. 8. Table 4 illustrates the complementarity of the nucleotide sequences of MAPKAPK3 BINDING SITE, designated SEQ ID:16295, to the nucleotide sequence of GAM65 RNA, herein designated GAM RNA, also designated SEQ ID:272.

Another function of GAM65 is therefore inhibition of Mitogen-activated protein kinase-activated protein kinase 3 (MAPKAPK3, Accession NP_004626.1). Accordingly, utilities of GAM65 include diagnosis, prevention and treatment of diseases and clinical conditions associated with MAPKAPK3.

Myeloid cell leukemia sequence 1 (bcl2-related) (MCL1, Accession NP_068779.1) is another GAM65 target gene, herein designated TARGET GENE. MCL1 BINDING SITE is a target binding site found in the 3' untranslated region of mRNA encoded by MCL1, corresponding to a target binding site such as BINDING SITE I, BINDING SITE II or BINDING SITE III of FIG. 8. Table 4 illustrates the complementarity of the nucleotide sequences of MCL1 BINDING SITE, designated SEQ ID:13184, to the nucleotide sequence of GAM65 RNA, herein designated GAM RNA, also designated SEQ ID:272.

Another function of GAM65 is therefore inhibition of Myeloid cell leukemia sequence 1 (bcl2-related) (MCL1, Accession NP_068779.1), a gene which involved in programing of differentiation and concomitant maintenance of viability. Accordingly, utilities of GAM65 include diagnosis, prevention and treatment of diseases and clinical conditions associated with MCL1.

The function of MCL1 has been established by previous studies. Kozopas et al. (1993) isolated a gene, MCL1, from the ML-1 human myeloid leukemia cell line. Expression of MCL1 increased early in the induction, or programming, of differentiation in ML-1 (at 1-3 hr), before the appearance of differentiation markers and mature morphology (at 1-3 days). MCL1 showed sequence similarity, particularly in the carboxyl portion, to BCL2 (OMIM Ref. No. 151430), a gene involved in normal lymphoid development and in lymphomas with the t(14;18) chromosome translocation. Further, in contrast to proliferation-associated oncogenes, the expression of MCL1 and BCL2 relates to the programming of differentiation/development and cell viability/death. Kozopas et al. (1993) suggested that MCL1 and BCL2 are 2 members of a 'new' gene family. Bae et al. (2000) identified a short splicing variant of MCL1, which they termed MCL1S. Sequence analysis indicated that the 271-amino acid variant lacks BCL2 homology domains 1 and 2 and the transmembrane domain due to the splicing out of exon 2 during mRNA processing. Unlike the full-length 350-amino acid MCL1 protein (MCL1L), yeast 2-hybrid analysis showed that MCL1S does not interact with proapoptotic BCL2 family proteins but dimerizes with the antiapoptotic MCL1L. Overexpression of MCL1S induced apoptosis in transfected CHO cells that could be antagonized by a caspase inhibitor or specifically by MCL1L. Therefore, the authors concluded that the fate of MCL1-expressing cells may be regulated through alternative splicing mechanisms and the interactions of the resulting gene products. Using the methods of somatic cell hybrid analysis and fluorescence in situ hybridization, Craig et al. (1994) mapped MCL1 to 1q21. In the mouse, MCL1-related sequences were mapped to positions on 2 mouse chromosomes, 3 and 5, using haplotype analysis of an interspecific cross. The locus on mouse chromosome 3, Mcl1, was homologous to MCL1 on human chromosome 1; the second locus, Mcl- rs, on mouse chromosome 5, may represent a pseudogene. The proximal long arm of human chromosome 1, where MCL1 is located, is duplicated and/or rearranged in a variety of preneoplastic and neoplastic diseases, including hematologic and solid tumors. Thus, MCL1 is a candidate gene for involvement in cancer.

Animal model experiments lend further support to the function of MCL1. Rinkenberger et al. (2000) disrupted the Mcl1 locus in murine ES cells to determine the developmental roles of this Bcl2 family member. Deletion of Mcl1 resulted in periimplantation embryonic lethality. Homozygous Mcl1-deficient embryos did not implant in utero, but could be recovered at E3.5 to E4.0. Null blastocysts failed to hatch or attach in vitro, indicating a trophectoderm defect, although the inner cell mass could grow in culture. Of note, homozygous Mcl1-deficient blastocysts showed no evidence of increased apoptosis, but exhibited a delay in maturation beyond the precompaction stage. This model indicates that Mcl1 is essential for preimplantation development and implantation, and suggests that it has a function beyond regulating apoptosis.

It is appreciated that the abovementioned animal model for MCL1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kozopas, K. M.; Yang, T.; Buchan, H. L.; Zhou, P.; Craig, R. W.: MCL1, a gene expressed in programmed myeloid cell differentiation, has sequence similarity to BCL2. Proc. Nat. Acad. Sci. 90:3516-3520, 1993; and Bae, J.; Leo, C. P.; Hsu, S. Y.; Hsueh, A. J. W.: MCL-1S, a splicing variant of the antiapoptotic BCL-2 family member MCL-1, encodes a proapoptotic protein possessing only the BH3 domai.

Further studies establishing the function and utilities of MCL1 are found in John Hopkins OMIM database record ID 159552, and in cited publications listed in Table 5, which are hereby incorporated by reference. MGC15937 (Accession NP_542392.2) is another GAM65 target gene, herein designated TARGET GENE. MGC15937 BINDING SITE is a target binding site found in the 3' untranslated region of mRNA encoded by MGC15937, corresponding to a target binding site such as BINDING SITE I, BINDING SITE II or BINDING SITE III of FIG. 8. Table 4 illustrates the complementarity of the nucleotide sequences of MGC15937 BINDING SITE, designated SEQ ID:5372, to the nucleotide sequence of GAM65 RNA, herein designated GAM RNA, also designated SEQ ID:272.

Another function of GAM65 is therefore inhibition of MGC15937 (Accession NP_542392.2). Accordingly, utilities of GAM65 include diagnosis, prevention and treatment of diseases and clinical conditions associated with MGC15937.

MGC33602 (Accession NP_689604.1) is another GAM65 target gene, herein designated TARGET GENE. MGC33602 BINDING SITE is a target binding site found in the 3' untranslated region of mRNA encoded by MGC33602, corresponding to a target binding site such as BINDING SITE I, BINDING SITE II or BINDING SITE III of FIG. 8. Table 4 illustrates the complementarity of the nucleotide sequences of MGC33602 BINDING SITE, designated SEQ ID:13239, to the nucleotide sequence of GAM65 RNA, herein designated GAM RNA, also designated SEQ ID:272.

Another function of GAM65 is therefore inhibition of MGC33602 (Accession NP_689604.1). Accordingly, utilities of GAM65 include diagnosis, prevention and treatment of diseases and clinical conditions associated with MGC33602.

MGC39518 (Accession NP_776183.1) is another GAM65 target gene, herein designated TARGET GENE. MGC39518 BINDING SITE is a target binding site found in the 3' untranslated region of mRNA encoded by MGC39518, corresponding to a target binding site such as BINDING SITE I, BINDING SITE II or BINDING SITE III of FIG. 8. Table 4 illustrates the complementarity of the nucleotide sequences of MGC39518 BINDING SITE, designated SEQ ID:16267, to the nucleotide sequence of GAM65 RNA, herein designated GAM RNA, also designated SEQ ID:272.

Another function of GAM65 is therefore inhibition of MGC39518 (Accession NP_776183.1). Accordingly, utilities of GAM65 include diagnosis, prevention and treatment of diseases and clinical conditions associated with MGC39518.

MGC4248 (Accession NP_115709.2) is another GAM65 target gene, herein designated TARGET GENE. MGC4248 BINDING SITE is a target binding site found in the 3' untranslated region of mRNA encoded by MGC4248, corresponding to a target binding site such as BINDING SITE I, BINDING SITE II or BINDING SITE III of FIG. 8. Table 4 illustrates the complementarity of the nucleotide sequences of MGC4248 BINDING SITE, designated SEQ ID:12365, to the nucleotide sequence of GAM65 RNA, herein designated GAM RNA, also designated SEQ ID:272.

Another function of GAM65 is therefore inhibition of MGC4248 (Accession NP_115709.2). Accordingly, utilities of GAM65 include diagnosis, prevention and treatment of diseases and clinical conditions associated with MGC4248.

MGC955 (Accession NP_077002.1) is another GAM65 target gene, herein designated TARGET GENE. MGC955 BINDING SITE is a target binding site found in the 3' untranslated region of mRNA encoded by MGC955, corresponding to a target binding site such as BINDING SITE I, BINDING SITE II or BINDING SITE III of FIG. 8. Table 4 illustrates the complementarity of the nucleotide sequences of MGC955 BINDING SITE, designated SEQ ID:19343, to the nucleotide sequence of GAM65 RNA, herein designated GAM RNA, also designated SEQ ID:272.

Another function of GAM65 is therefore inhibition of MGC955 (Accession NP_077002.1). Accordingly, utilities of GAM65 include diagnosis, prevention and treatment of diseases and clinical conditions associated with MGC955.

Neuralized-like (drosophila) (NEURL, Accession NP_004201.2) is another GAM65 target gene, herein designated TARGET GENE. NEURL BINDING SITE is a target binding site found in the 3' untranslated region of mRNA encoded by NEURL, corresponding to a target binding site such as BINDING SITE I, BINDING SITE II or BINDING SITE III of FIG. 8. Table 4 illustrates the complementarity of the nucleotide sequences of NEURL BINDING SITE, designated SEQ ID:7940, to the nucleotide sequence of GAM65 RNA, herein designated GAM RNA, also designated SEQ ID:272.

Another function of GAM65 is therefore inhibition of Neuralized-like (drosophila) (NEURL, Accession NP_004201.2). Accordingly, utilities of GAM65 include diagnosis, prevention and treatment of diseases and clinical conditions associated with NEURL.

Phosphodiesterase 4c, camp-specific (phosphodiesterase e1 dunce homolog, drosophila) (PDE4C, Accession NP_000914.1) is another GAM65 target gene, herein designated TARGET GENE. PDE4C BINDING SITE is a target binding site found in the 3' untranslated region of mRNA encoded by PDE4C, corresponding to a target binding site such as BINDING SITE I, BINDING SITE II or BINDING SITE III of FIG. 8. Table 4 illustrates the complementarity of the nucleotide sequences of PDE4C BINDING SITE, designated SEQ ID:1136, to the nucleotide sequence of GAM65 RNA, herein designated GAM RNA, also designated SEQ ID:272.

Another function of GAM65 is therefore inhibition of Phosphodiesterase 4c, camp-specific (phosphodiesterase e1 dunce homolog, drosophila) (PDE4C, Accession NP_000914.1), a gene which is a cAMP-specific phosphodiesterase and may be a protein involved in learning and memory. Accordingly, utilities of GAM65 include diagnosis, prevention and treatment of diseases and clinical conditions associated with PDE4C.

The function of PDE4C has been established by previous studies. Milatovich et al. (1994) applied Southern analyses of somatic cell hybrid lines and of recombinant inbred mouse strains, as well as fluorescence chromosomal in situ hybridization (FISH), to map 4 'dunce-like' cAMP-specific nucleotide phosphodiesterase genes in human and mouse. DPDE1 (also symbolized PDE4C) was assigned to human chromosome 19 and mouse chromosome 8. DPDE2 (also symbolized PDE4A; 600126) was also assigned to human chromosome 19 but to mouse chromosome 9. DPDE3 (also symbolized PDE4D; 600129) was assigned to human 5q12 and mouse chromosome 13. DPDE4 (also symbolized PDE4B; 600127) was assigned to human 1p31 and mouse chromosome 4. By fluorescence in situ hybridization, Sullivan et al. (1999) localized the PDE4C gene to 19p13.1. They found that the PDE4C gene spans at least 38 kb, consists of at least 18 exons, and contains the marker D19S212 within an intron. Comparison of the published human PDE4C cDNA sequences with those of the genomic DNA identified 4 alternatively spliced exons and the possibility that the PDE4C locus contains at least 3 alternative promoters. The cosmids containing PDE4C also contained the genes for the growth regulatory transcription factor JUND (OMIM Ref. No. 165162), and the mini guanine nucleotide regulatory protein RAB3A (OMIM Ref. No. 179490). RAB3A was shown to consist of 5 exons spanning 7.9 kb, while the JUND gene was found to contain no introns. Analysis of cosmids containing PDE4C, JUND, and RAB3A showed that 27 kb separate JUND and PDE4C, while only 3.7 kb separate PDE4C and RAB3A. The 3 genes share the same orientation of transcription and are arranged in the 5-prime/3-prime order as follows: JUND-PDE4C-RAB3A-tel.

Full details of the abovementioned studies are described in the following publications, the disclosure of which are hereby incorporated by reference:

Milatovich, A.; Bolger, G.; Michaeli, T.; Francke, U.: Chromosome localizations of genes for five cAMP-specific phosphodiesterases in man and mouse. Somat. Cell Molec. Genet. 20:75-86, 1994; and Sullivan, M.; Olsen, A. S.; Houslay, M. D.: Genomic organisation of the human cyclic AMP-specific phosphodiesterase PDE4C gene and its chromosomal localisation to 19p13.1, between RAB3A.

Further studies establishing the function and utilities of PDE4C are found in John Hopkins OMIM database record ID 600128, and in cited publications listed in Table 5, which are hereby incorporated by reference. Piwi-like 2 (drosophila) (PIWIL2, Accession NP_060538.2) is another GAM65 target gene, herein designated TARGET GENE. PIWIL2 BINDING SITE is a target binding site found in the 3' untranslated region of mRNA encoded by PIWIL2, corresponding to a target binding site such as BINDING SITE I, BINDING SITE II or BINDING SITE III of FIG. 8. Table 4 illustrates the complementarity of the nucleotide sequences of PIWIL2 BINDING SITE, designated SEQ ID:15554, to the nucleotide sequence of GAM65 RNA, herein designated GAM RNA, also designated SEQ ID:272.

Another function of GAM65 is therefore inhibition of Piwi-like 2 (drosophila) (PIWIL2, Accession NP_060538.2). Accordingly, utilities of GAM65 include diagnosis, prevention and treatment of diseases and clinical conditions associated with PIWIL2.

Phospholipase c, gamma 1 (formerly subtype 148) (PLCG1, Accession NP_002651.1) is another GAM65 target gene, herein designated TARGET GENE. PLCG1 BINDING SITE is a target binding site found in the 3' untranslated region of mRNA encoded by PLCG1, corresponding to a target binding site such as BINDING SITE I, BINDING SITE II or BINDING SITE III of FIG. 8. Table 4 illustrates the complementarity of the nucleotide sequences of PLCG1 BINDING SITE, designated SEQ ID:17197, to the nucleotide sequence of GAM65 RNA, herein designated GAM RNA, also designated SEQ ID:272.

Another function of GAM65 is therefore inhibition of Phospholipase c, gamma 1 (formerly subtype 148) (PLCG1, Accession NP_002651.1), a gene which is a major substrate for heparin-binding growth factor 1 -activated tyrosine kinase. Accordingly, utilities of GAM65 include diagnosis, prevention and treatment of diseases and clinical conditions associated with PLCG1.

The function of PLCG1 and its association with various diseases and clinical conditions, has been established by previous studies, as described hereinabove with reference to GAM31.1. Plexin a2 (PLXNA2, Accession NP_079455.1) is another GAM65 target gene, herein designated TARGET GENE. PLXNA2 BINDING SITE is a target binding site found in the 3' untranslated region of mRNA encoded by PLXNA2, corresponding to a target binding site such as BINDING SITE I, BINDING SITE II or BINDING SITE III of FIG. 8. Table 4 illustrates the complementarity of the nucleotide sequences of PLXNA2 BINDING SITE, designated SEQ ID:1002, to the nucleotide sequence of GAM65 RNA, herein designated GAM RNA, also designated SEQ ID:272.

Another function of GAM65 is therefore inhibition of Plexin a2 (PLXNA2, Accession NP_079455.1), a gene which is a transmembrane protein. Accordingly, utilities of GAM65 include diagnosis, prevention and treatment of diseases and clinical conditions associated with PLXNA2.

The function of PLXNA2 has been established by previous studies. In the course of searching for previously unknown genes on the human X chromosome, Maestrini et al. (1996) identified a cDNA in Xq28 encoding a transmembrane protein that they termed SEX (OMIM Ref. No. 300022). They showed that SEX shares significant homology with the extracellular domain of the receptors encoded by MET and other members of the hepatocyte growth factor (HGF) receptor family. Three other sequences closely related to SEX were identified, 1 of which (designated OCT) was shown by analysis of a panel of human/hamster somatic cell hybrids to map to chromosome 1. The proteins encoded by all 4 genes contained large cytoplasmic domains characterized by a distinctive highly conserved sequence they called the SEX domain. See also 601053 and 601055. Nomenclature: Tamagnone et al. (1999) proposed a novel nomenclature for the genes of the plexin family, which they grouped into the A, B, C, and D subfamilies; the PLXN2 gene was renamed plexin A2 by them.

Full details of the abovementioned studies are described in the following publications, the disclosure of which are hereby incorporated by reference:

Maestrini, E.; Tamagnone, L.; Longati, P.; Cremona, O.; Gulisano, M.; Bione, S.; Tamanini, F.; Neel, B. G.; Toniolo, D.; Comoglio, P. M.: A family of transmembrane proteins with homology to the MET-hepatocyte growth factor receptor. Proc. Nat. Acad. Sci. 93:674-678, 1996; and Tamagnone, L.; Artigiani, S.; Chen, H.; He, Z.; Ming, G.; Song, H.; Chedotal, A.; Winberg, M. L.; Goodman, C. S.; Poo, M.; Tessier-Lavigne, M.; Comoglio, P. M.: Plexins are a large family.

Further studies establishing the function and utilities of PLXNA2 are found in John Hopkins OMIM database record ID 601054, and in cited publications listed in Table 5, which are hereby incorporated by reference. Rad21 homolog (s. pombe) (RAD21, Accession NP_006256.1) is another GAM65 target gene, herein designated TARGET GENE. RAD21 BINDING SITE is a target binding site found in the 5' untranslated region of mRNA encoded by RAD21, corresponding to a target binding site such as BINDING SITE I, BINDING SITE II or BINDING SITE III of FIG. 8. Table 4 illustrates the complementarity of the nucleotide sequences of RAD21 BINDING SITE, designated SEQ ID:14920, to the nucleotide sequence of GAM65 RNA, herein designated GAM RNA, also designated SEQ ID:272.

Another function of GAM65 is therefore inhibition of Rad21 homolog (s. pombe) (RAD21, Accession NP_006256.1), a gene which may act in double strand break repair. Accordingly, utilities of GAM65 include diagnosis, prevention and treatment of diseases and clinical conditions associated with RAD21.

The function of RAD21 has been established by previous studies. Eukaryotic sister chromatids remain connected from the time of synthesis until they are separated in anaphase. This cohesion depends on a complex of proteins known as cohesins. In vertebrates, unlike in yeast, the cohesins dissociate from chromosome arms earlier in M phase, during prophase. Small amounts of cohesin remain near the centromere until metaphase, with complete removal at the beginning of anaphase. Cohesin complexes contain SMC1 (OMIM Ref. No. 300040), SMC3 (CSPG6; 606062), SCC1 (RAD21), and either SA1 (STAG1; 604358) or SA2 (STAG2; 604359). The complexes, in turn, interact with PDS5, a protein implicated in chromosome cohesion, condensation, and recombination in yeast (Sumara et al., 2000). By sequencing cDNAs randomly selected from a cDNA library derived from a human immature myeloid cell line, Nomura et al. (1994) identified a cDNA encoding a homolog of S. pombe Rad21 that they termed KIAA0078. The deduced KIAA0078 protein has 631 amino acids. Northern blot analysis detected equivalent expression of KIAA0078 in all tissues tested.

Full details of the abovementioned studies are described in the following publications, the disclosure of which are hereby incorporated by reference:

Sumara, I.; Vorlaufer, E.; Gieffers, C.; Peters, B. H.; Peters, J.-M.: Characterization of vertebrate cohesin complexes and their regulation in prophase. J. Cell Biol. 151:749-761, 2000; and Nomura, N.; Nagase, T.; Miyajima, N.; Sazuka, T.; Tanaka, A.; Sato, S.; Seki, N.; Kawarabayasi, Y.; Ishikawa, K.; Tabata, S.: Prediction of the coding sequences of unidentified human g.

Further studies establishing the function and utilities of RAD21 are found in John Hopkins OMIM database record ID 606462, and in cited publications listed in Table 5, which are hereby incorporated by reference. Rna binding motif protein 7 (RBM7, Accession NP_057174.1) is another GAM65 target gene, herein designated TARGET GENE. RBM7 BINDING SITE is a target binding site found in the 3' untranslated region of mRNA encoded by RBM7, corresponding to a target binding site such as BINDING SITE I, BINDING SITE II or BINDING SITE III of FIG. 8. Table 4 illustrates the complementarity of the nucleotide sequences of RBM7 BINDING SITE, designated SEQ ID:8355, to the nucleotide sequence of GAM65 RNA, herein designated GAM RNA, also designated SEQ ID:272.

Another function of GAM65 is therefore inhibition of Rna binding motif protein 7 (RBM7, Accession NP_057174.1). Accordingly, utilities of GAM65 include diagnosis, prevention and treatment of diseases and clinical conditions associated with RBM7.

Src-like-adaptor (SLA, Accession NP_006739.1) is another GAM65 target gene, herein designated TARGET GENE. SLA BINDING SITE is a target binding site found in the 3' untranslated region of mRNA encoded by SLA, corresponding to a target binding site such as BINDING SITE I, BINDING SITE II or BINDING SITE III of FIG. 8. Table 4 illustrates the complementarity of the nucleotide sequences of SLA BINDING SITE, designated SEQ ID:16487, to the nucleotide sequence of GAM65 RNA, herein designated GAM RNA, also designated SEQ ID:272.

Another function of GAM65 is therefore inhibition of Src-like-adaptor (SLA, Accession NP_006739.1), a gene which is a negative regulator of T-cell receptor signaling. Accordingly, utilities of GAM65 include diagnosis, prevention and treatment of diseases and clinical conditions associated with SLA.

The function of SLA and its association with various diseases and clinical conditions, has been established by previous studies, as described hereinabove with reference to GAM63.1. Synaptotagmin-like 4 (granuphilin-a) (SYTL4, Accession NP_542775.1) is another GAM65 target gene, herein designated TARGET GENE. SYTL4 BINDING SITE is a target binding site found in the 3' untranslated region of mRNA encoded by SYTL4, corresponding to a target binding site such as BINDING SITE I, BINDING SITE II or BINDING SITE III of FIG. 8. Table 4 illustrates the complementarity of the nucleotide sequences of SYTL4 BINDING SITE, designated SEQ ID:8344, to the nucleotide sequence of GAM65 RNA, herein designated GAM RNA, also designated SEQ ID:272.

Another function of GAM65 is therefore inhibition of Synaptotagmin-like 4 (granuphilin-a) (SYTL4, Accession NP_542775.1). Accordingly, utilities of GAM65 include diagnosis, prevention and treatment of diseases and clinical conditions associated with SYTL4.

sytXIV (Accession NP_694994.1) is another GAM65 target gene, herein designated TARGET GENE. sytXIV BINDING SITE is a target binding site found in the 3' untranslated region of mRNA encoded by sytXIV, corresponding to a target binding site such as BINDING SITE I, BINDING SITE II or BINDING SITE III of FIG. 8. Table 4 illustrates the complementarity of the nucleotide sequences of sytXIV BINDING SITE, designated SEQ ID:12988, to the nucleotide sequence of GAM65 RNA, herein designated GAM RNA, also designated SEQ ID:272.

Another function of GAM65 is therefore inhibition of sytXIV (Accession NP_694994.1). Accordingly, utilities of GAM65 include diagnosis, prevention and treatment of diseases and clinical conditions associated with sytXIV.

SZF1 (Accession NP_057173.1) is another GAM65 target gene, herein designated TARGET GENE. SZF1 BINDING SITE is a target binding site found in the 3' untranslated region of mRNA encoded by SZF1, corresponding to a target binding site such as BINDING SITE I, BINDING SITE II or BINDING SITE III of FIG. 8. Table 4 illustrates the complementarity of the nucleotide sequences of SZF1 BINDING SITE, designated SEQ ID:18762, to the nucleotide sequence of GAM65 RNA, herein designated GAM RNA, also designated SEQ ID:272.

Another function of GAM65 is therefore inhibition of SZF1 (Accession NP_057173.1). Accordingly, utilities of GAM65 include diagnosis, prevention and treatment of diseases and clinical conditions associated with SZF1.

Tbc1 domain family, member 5 (TBC1D5, Accession NP_055559.1) is another GAM65 target gene, herein designated TARGET GENE. TBC1D5 BINDING SITE is a target binding site found in the 5' untranslated region of mRNA encoded by TBC1D5, corresponding to a target binding site such as BINDING SITE I, BINDING SITE II or BINDING SITE III of FIG. 8. Table 4 illustrates the complementarity of the nucleotide sequences of TBC1D5 BINDING SITE, designated SEQ ID:11874, to the nucleotide sequence of GAM65 RNA, herein designated GAM RNA, also designated SEQ ID:272.

Another function of GAM65 is therefore inhibition of Tbc1 domain family, member 5 (TBC1D5, Accession NP_055559.1). Accordingly, utilities of GAM65 include diagnosis, prevention and treatment of diseases and clinical conditions associated with TBC1D5.

Transient receptor potential cation channel, subfamily m, member 7 (TRPM7, Accession NP_060142.2) is another GAM65 target gene, herein designated TARGET GENE. TRPM7 BINDING SITE is a target binding site found in the 3' untranslated region of mRNA encoded by TRPM7, corresponding to a target binding site such as BINDING SITE I, BINDING SITE II or BINDING SITE III of FIG. 8. Table 4 illustrates the complementarity of the nucleotide sequences of TRPM7 BINDING SITE, designated SEQ ID:14667, to the nucleotide sequence of GAM65 RNA, herein designated GAM RNA, also designated SEQ ID:272.

Another function of GAM65 is therefore inhibition of Transient receptor potential cation channel, subfamily m, member 7 (TRPM7, Accession NP_060142.2), a gene which is a calcium channel and a protein kinase. Accordingly, utilities of GAM65 include diagnosis, prevention and treatment of diseases and clinical conditions associated with TRPM7.

The function of TRPM7 has been established by previous studies. Runnels et al. (2001) demonstrated that the TRP-PLIK protein is both an ion channel and a protein kinase. TRP-PLIK displayed autophosphorylation. When expressed in CHO-K1 cells, TRP-PLIK constitutes a nonselective, calcium-permeable, 105- picosiemen, steeply outwardly rectifying conductance. The zinc finger containing the alpha-kinase domain is functional. Inactivation of the kinase activity by site-directed mutagenesis and the channel's dependence on intracellular adenosine triphosphate (ATP) demonstrated that the channel's kinase activity is essential for channel function. Nadler et al. (2001) functionally characterized LTRPC7. Targeted deletion of LTRPC7 in DT-40 B cells was lethal, indicating that LTRPC7 has a fundamental and nonredundant role in cellular physiology. Electrophysiologic analysis of HEK293 cells overexpressing recombinant LTRPC7 showed large currents regulated by millimolar levels of intracellular magnesium-ATP and magnesium- GTP with the permeation properties of a voltage-independent divalent cation influx pathway. Analysis of several cultured cell types demonstrated small magnesium-nucleotide-regulated metal ion currents with regulation and permeation properties essentially identical to the large currents observed in cells expressing recombinant LTRPC7. Nadler et al. (2001) concluded that LTRPC7, by virtue of its sensitivity to physiologic magnesium-ATP levels, may be involved in a fundamental process that adjusts plasma membrane divalent cation fluxes according to the metabolic state of the cell.

Full details of the abovementioned studies are described in the following publications, the disclosure of which are hereby incorporated by reference:

Runnels, L. W.; Yue, L.; Clapham, D. E.: TRP-PLIK, a bifunctional protein with kinase and ion channel activities. Science 291:1043-1047, 2001; and Nadler, M. J. S.; Hermosura, M. C.; Inabe, K.; Perraud, A.-L.; Zhu, Q.; Stokes, A. J.; Kurosaki, T.; Kinet, J.-P.; Penner, R.; Scharenberg, A. M.; Fleig, A.: LTRPC7 is a Mg-ATP-regulated.

Further studies establishing the function and utilities of TRPM7 are found in John Hopkins OMIM database record ID 605692, and in cited publications listed in Table 5, which are hereby incorporated by reference. Ubinuclein 1 (UBN1, Accession NP_058632.1) is another GAM65 target gene, herein designated TARGET GENE. UBN1 BINDING SITE is a target binding site found in the 3' untranslated region of mRNA encoded by UBN1, corresponding to a target binding site such as BINDING SITE I, BINDING SITE II or BINDING SITE III of FIG. 8. Table 4 illustrates the complementarity of the nucleotide sequences of UBN1 BINDING SITE, designated SEQ ID:2743, to the nucleotide sequence of GAM65 RNA, herein designated GAM RNA, also designated SEQ ID:272.

Another function of GAM65 is therefore inhibition of Ubinuclein 1 (UBN1, Accession NP_058632.1). Accordingly, utilities of GAM65 include diagnosis, prevention and treatment of diseases and clinical conditions associated with UBN1.

Vanin 1 (VNN1, Accession NP_004657.1) is another GAM65 target gene, herein designated TARGET GENE. VNN1 BINDING SITE is a target binding site found in the 3' untranslated region of mRNA encoded by VNN1, corresponding to a target binding site such as BINDING SITE I, BINDING SITE II or BINDING SITE III of FIG. 8. Table 4 illustrates the complementarity of the nucleotide sequences of VNN1 BINDING SITE, designated SEQ ID:19406, to the nucleotide sequence of GAM65 RNA, herein designated GAM RNA, also designated SEQ ID:272.

Another function of GAM65 is therefore inhibition of Vanin 1 (VNN1, Accession NP_004657.1), a gene which may regulate steps in thymus homing and play a role in mammalian sexual development. Accordingly, utilities of GAM65 include diagnosis, prevention and treatment of diseases and clinical conditions associated with VNN1.

The function of VNN1 has been established by previous studies. Hematopoietic precursor cells migrate to the thymus, where they differentiate into mature T lymphocytes. Aurrand-Lions et al. (1996) reported the cDNA cloning and functional analysis of mouse vanin-1 (vascular noninflammatory molecule-1), a novel cell surface molecule that is involved in the thymus homing of bone marrow cells. Vanin-1 is a glycosylphosphatidylinositol (GPI)-anchored molecule expressed by perivascular thymic stromal cells. Antibody against vanin-1 blocked thymus colonization by hematopoietic progenitor cells in both short- and long-term assays and interfered with lymphostromal cell adhesion. The authors suggested that vanin-1 regulates late adhesion steps of thymus homing under physiologic, noninflammatory conditions. The mammalian sex-determining pathway is controlled by the presence or absence of SRY (OMIM Ref. No. 480000) expression in the embryonic gonad. To identify additional sex-determining or gonadal differentiation genes, Grimmond et al. (2000) screened for genes exhibiting sexually dimorphic patterns of expression in the mouse gonad at 12.5 and 13.5 days postcoitum, after overt gonad differentiation, by comparing complex cDNA probes derived from male and female gonadal tissue at these stages on microarrays constructed from a normalized urogenital ridge library. Using in situ hybridization analysis, they determined that mouse protease nexin-1 (OMIM Ref. No. 177010) and Vnn1 exhibit male-specific expression prior to overt gonadal differentiation and are detected in the somatic portion of the developing gonad, suggesting to the authors a possible direct link to the testis-determining pathway for both genes.

Full details of the abovementioned studies are described in the following publications, the disclosure of which are hereby incorporated by reference:

Aurrand-Lions, M.; Galland, F.; Bazin, H.; Zakharyev, V. M.; Imhof, B. A.; Naquet, P.: Vanin-1, a novel GPI-linked perivascular molecule involved in thymus homing. Immunity 5:391-405, 1996; and Grimmond, S.; Van Hateren, N.; Siggers, P.; Arkell, R.; Larder, R.; Soares, M. B.; de Fatima Bonaldo, M.; Smith, L.; Tymowska-Lalanne, Z.; Wells, C.; Greenfield, A.: Sexually dimorphic ex.

Further studies establishing the function and utilities of VNN1 are found in John Hopkins OMIM database record ID 603570, and in cited publications listed in Table 5, which are hereby incorporated by reference. Vacuolar protein sorting 45a (yeast) (VPS45A, Accession NP_009190.2) is another GAM65 target gene, herein designated TARGET GENE. VPS45A BINDING SITE is a target binding site found in the 3' untranslated region of mRNA encoded by VPS45A, corresponding to a target binding site such as BINDING SITE I, BINDING SITE II or BINDING SITE III of FIG. 8. Table 4 illustrates the complementarity of the nucleotide sequences of VPS45A BINDING SITE, designated SEQ ID:2588, to the nucleotide sequence of GAM65 RNA, herein designated GAM RNA, also designated SEQ ID:272.

Another function of GAM65 is therefore inhibition of Vacuolar protein sorting 45a (yeast) (VPS45A, Accession NP_009190.2). Accordingly, utilities of GAM65 include diagnosis, prevention and treatment of diseases and clinical conditions associated with VPS45A.

ZD52F10 (Accession NP_201574.1) is another GAM65 target gene, herein designated TARGET GENE. ZD52F10 BINDING SITE is a target binding site found in the 3' untranslated region of mRNA encoded by ZD52F10, corresponding to a target binding site such as BINDING SITE I, BINDING SITE II or BINDING SITE III of FIG. 8. Table 4 illustrates the complementarity of the nucleotide sequences of ZD52F10 BINDING SITE, designated SEQ ID:1210, to the nucleotide sequence of GAM65 RNA, herein designated GAM RNA, also designated SEQ ID:272.

Another function of GAM65 is therefore inhibition of ZD52F10 (Accession NP_201574.1). Accordingly, utilities of GAM65 include diagnosis, prevention and treatment of diseases and clinical conditions associated with ZD52F10.

ZFD25 (Accession NP_057304.1) is another GAM65 target gene, herein designated TARGET GENE. ZFD25 BINDING SITE is a target binding site found in the 3' untranslated region of mRNA encoded by ZFD25, corresponding to a target binding site such as BINDING SITE I, BINDING SITE II or BINDING SITE III of FIG. 8. Table 4 illustrates the complementarity of the nucleotide sequences of ZFD25 BINDING SITE, designated SEQ ID:6103, to the nucleotide sequence of GAM65 RNA, herein designated GAM RNA, also designated SEQ ID:272.

Another function of GAM65 is therefore inhibition of ZFD25 (Accession NP_057304.1). Accordingly, utilities of GAM65 include diagnosis, prevention and treatment of diseases and clinical conditions associated with ZFD25.

Zinc finger protein 177 (ZNF177, Accession NP_003442.1) is another GAM65 target gene, herein designated TARGET GENE. ZNF177 BINDING SITE is a target binding site found in the 3' untranslated region of mRNA encoded by ZNF177, corresponding to a target binding site such as BINDING SITE I, BINDING SITE II or BINDING SITE III of FIG. 8. Table 4 illustrates the complementarity of the nucleotide sequences of ZNF177 BINDING SITE, designated SEQ ID:16167, to the nucleotide sequence of GAM65 RNA, herein designated GAM RNA, also designated SEQ ID:272.

Another function of GAM65 is therefore inhibition of Zinc finger protein 177 (ZNF177, Accession NP_003442.1). Accordingly, utilities of GAM65 include diagnosis, prevention and treatment of diseases and clinical conditions associated with ZNF177.

Zinc finger protein 192 (ZNF192, Accession NP_006289.1) is another GAM65 target gene, herein designated TARGET GENE. ZNF192 BINDING SITE is a target binding site found in the 3' untranslated region of mRNA encoded by ZNF192, corresponding to a target binding site such as BINDING SITE I, BINDING SITE II or BINDING SITE III of FIG. 8. Table 4 illustrates the complementarity of the nucleotide sequences of ZNF192 BINDING SITE, designated SEQ ID:1148, to the nucleotide sequence of GAM65 RNA, herein designated GAM RNA, also designated SEQ ID:272.

Another function of GAM65 is therefore inhibition of Zinc finger protein 192 (ZNF192, Accession NP_006289.1). Accordingly, utilities of GAM65 include diagnosis, prevention and treatment of diseases and clinical conditions associated with ZNF192.

Zinc finger protein 211 (ZNF211, Accession XP_290823.1) is another GAM65 target gene, herein designated TARGET GENE. ZNF211 BINDING SITE is a target binding site found in the 3' untranslated region of multiple transcripts of mRNA encoded by ZNF211, corresponding to a target binding site such as BINDING SITE I, BINDING SITE II or BINDING SITE III of FIG. 8. Table 4 illustrates the complementarity of the nucleotide sequences of ZNF211 BINDING SITE, designated SEQ ID:11280, to the nucleotide sequence of GAM65 RNA, herein designated GAM RNA, also designated SEQ ID:272.

Another function of GAM65 is therefore inhibition of Zinc finger protein 211 (ZNF211, Accession XP_290823.1). Accordingly, utilities of GAM65 include diagnosis, prevention and treatment of diseases and clinical conditions associated with ZNF211.

Zinc finger protein 211 (ZNF211, Accession NP_006376.1) is another GAM65 target gene, herein designated TARGET GENE. ZNF211 BINDING SITE is a target binding site found in the 3' untranslated region of multiple transcripts of mRNA encoded by ZNF211, corresponding to a target binding site such as BINDING SITE I, BINDING SITE II or BINDING SITE III of FIG. 8. Table 4 illustrates the complementarity of the nucleotide sequences of ZNF211 BINDING SITE, designated SEQ ID:11280, to the nucleotide sequence of GAM65 RNA, herein designated GAM RNA, also designated SEQ ID:272.

Another function of GAM65 is therefore inhibition of Zinc finger protein 211 (ZNF211, Accession NP_006376.1). Accordingly, utilities of GAM65 include diagnosis, prevention and treatment of diseases and clinical conditions associated with ZNF211.

Zinc finger protein 397 (ZNF397, Accession NP_115723.1) is another GAM65 target gene, herein designated TARGET GENE. ZNF397 BINDING SITE is a target binding site found in the 3' untranslated region of mRNA encoded by ZNF397, corresponding to a target binding site such as BINDING SITE I, BINDING SITE II or BINDING SITE III of FIG. 8. Table 4 illustrates the complementarity of the nucleotide sequences of ZNF397 BINDING SITE, designated SEQ ID:2348, to the nucleotide sequence of GAM65 RNA, herein designated GAM RNA, also designated SEQ ID:272.

Another function of GAM65 is therefore inhibition of Zinc finger protein 397 (ZNF397, Accession NP_115723.1).

Accordingly, utilities of GAM65 include diagnosis, prevention and treatment of diseases and clinical conditions associated with ZNF397.

FIG. 8 further provides a conceptual description of a novel bioinformatically detected of the present invention, referred to here as Genomic Address Messenger 66 (GAM66), which modulates expression of respective target genes thereof, the function and utility of which target genes is known in the art.

GAM66 is a novel bioinformatically detected regulatory, non protein coding, micro RNA (miRNA) gene. The method by which GAM66 was detected is described hereinabove with reference to FIGS. 8-15.

GAM66 gene, herein designated GAM GENE, and GAM66 target gene, herein designated TARGET GENE, are human genes contained in the human genome.

GAM66 gene encodes a GAM66 precursor RNA, herein designated GAM PRECURSOR RNA. Similar to other miRNA genes, and unlike most ordinary genes, GAM66 precursor RNA does not encode a protein. A nucleotide sequence identical or highly similar to the nucleotide sequence of GAM66 precursor RNA is designated SEQ ID:62, and is provided hereinbelow with reference to the sequence listing part. Nucleotide sequence SEQ ID:62 is located at position 82042170 relative to chromosome 10.

GAM66 precursor RNA folds onto itself, forming GAM66 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM66 precursor RNA folds onto itself, forming GAM66 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM66 precursor RNA, designated SEQ-ID:62, and a schematic representation of a predicted secondary folding of GAM66 folded precursor RNA are further described with reference to Table 2, hereby incorporated by reference.

An enzyme complex designated DICER COMPLEX, 'dices' the GAM66 folded precursor RNA into GAM66 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM66 RNA is designated SEQ ID:238, and is provided hereinbelow with references to the sequence listing part and Table 3, hereby incorporated by reference.

GAM66 target gene, herein designated TARGET GENE, encodes a corresponding messenger RNA, GAM66 target RNA, herein designated GAM TARGET RNA. GAM66 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM66 RNA, herein designated GAM RNA, binds complementarily to one or more target binding sites located in untranslated regions of GAM66 target RNA, herein designated GAM TARGET RNA. This complementary binding is due to the fact that the nucleotide sequence of GAM66 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM66 RNA may have a different number of target binding sites in untranslated regions of a GAM66 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM66 RNA, herein designated GAM RNA, to target binding sites on GAM66 target RNA, herein designated GAM TARGET RNA, such as BINDING SITE I, BINDING SITE II and BINDING SITE III, inhibits translation of GAM66 target RNA into GAM66 target protein, herein designated GAM TARGET PROTEIN. GAM target protein is therefore outlined by a broken line.

It is appreciated that GAM66 target gene, herein designated TARGET GENE, in fact represents a plurality of GAM66 target genes. The mRNA of each one of this plurality of GAM66 target genes comprises one or more target binding sites, each having a nucleotide sequence which is at least partly complementary to GAM66 RNA, herein designated GAM RNA, and which when bound by GAM66 RNA causes inhibition of translation of respective one or more GAM66 target proteins.

It is further appreciated by one skilled in the art that the mode of translational inhibition illustrated by FIG. 8 with specific reference to translational inhibition exerted by GAM66 gene, herein designated GAM GENE, on one or more GAM66 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM66 correlate with, and may be deduced from, the identity of the target genes which GAM66 binds and inhibits, and the function of these target genes, as elaborated hereinbelow.

BOP (Accession XP_097915.2) is a GAM66 target gene, herein designated TARGET GENE. BOP BINDING SITE is a target binding site found in the 3' untranslated region of mRNA encoded by BOP, corresponding to a target binding site such as BINDING SITE I, BINDING SITE II or BINDING SITE III of FIG. 8. Table 4 illustrates the complementarity of the nucleotide sequences of BOP BINDING SITE, designated SEQ ID:4943, to the nucleotide sequence of GAM66 RNA, herein designated GAM RNA, also designated SEQ ID:238.

A function of GAM66 is therefore inhibition of BOP (Accession XP_097915.2). Accordingly, utilities of GAM66 include diagnosis, prevention and treatment of diseases and clinical conditions associated with BOP.

Chromosome 12 open reading frame 4 (C12orf4, Accession NP_065107.1) is another GAM66 target gene, herein designated TARGET GENE. C12orf4 BINDING SITE is a target binding site found in the 3' untranslated region of mRNA encoded by C12orf4, corresponding to a target binding site such as BINDING SITE I, BINDING SITE II or BINDING SITE III of FIG. 8. Table 4 illustrates the complementarity of the nucleotide sequences of C12orf4 BINDING SITE, designated SEQ ID:3404, to the nucleotide sequence of GAM66 RNA, herein designated GAM RNA, also designated SEQ ID:238.

Another function of GAM66 is therefore inhibition of Chromosome 12 open reading frame 4 (C12orf4, Accession NP_065107.1). Accordingly, utilities of GAM66 include diagnosis, prevention and treatment of diseases and clinical conditions associated with C12orf4.

Chromosome 5 open reading frame 8 (C5orf8, Accession NP_006807.1) is another GAM66 target gene, herein designated TARGET GENE. C5orf8 BINDING SITE is a target binding site found in the 3' untranslated region of mRNA encoded by C5orf8, corresponding to a target binding site such as BINDING SITE I, BINDING SITE II or BINDING SITE III of FIG. 8. Table 4 illustrates the complementarity of the nucleotide sequences of C5orf8 BINDING SITE, designated SEQ ID:18156, to the nucleotide sequence of GAM66 RNA, herein designated GAM RNA, also designated SEQ ID:238.

Another function of GAM66 is therefore inhibition of Chromosome 5 open reading frame 8 (C5orf8, Accession NP_006807.1). Accordingly, utilities of GAM66 include diagnosis, prevention and treatment of diseases and clinical conditions associated with C5orf8.

Complement component 5 receptor 1 (c5a ligand) (C5R1, Accession NP_001727.1) is another GAM66 target gene, herein designated TARGET GENE. C5R1 BINDING SITE is a target binding site found in the 3' untranslated region of mRNA encoded by C5R1, corresponding to a target binding site such as BINDING SITE I, BINDING SITE II or BINDING SITE III of FIG. 8. Table 4 illustrates the complementarity of the nucleotide sequences of C5R1 BINDING SITE, designated SEQ ID:4433, to the nucleotide sequence of GAM66 RNA, herein designated GAM RNA, also designated SEQ ID:238.

Another function of GAM66 is therefore inhibition of Complement component 5 receptor 1 (c5a ligand) (C5R1, Accession NP_001727.1), a gene which has a nonredundant function and is required for mucosal host cell defense in the lung and therefore may be associated with Asthma and pneumonia. Accordingly, utilities of GAM66 include diagnosis, prevention and treatment of Asthma and pneumonia, and of other diseases and clinical conditions associated with C5R1.

The function of C5R1 has been established by previous studies. Using a panel of somatic cell hybrids, Bao et al. (1992) mapped the receptor for the chemotactic ligand C5a to chromosome 19. This receptor, like those for the formyl peptides (136537, 136538) and interleukin-8 (OMIM Ref. No. 146929), is structurally related to rhodopsin (RHO; 180380) and transduces signals via intracellular GTP-binding proteins. Additionally, this receptor is similar to chemokine receptor-like 1 (OMIM Ref. No. 601531). Hopken et al. (1996) deleted the murine C5a receptor (C5ar) through homologous recombination. They reported that the C5ar-deficient mice showed no developmental or biologic defects in cells in which C5a is expressed (e.g., myeloid cell lineages, hepatocytes, and epithelial cells) apart from the ability to bind and signal to exogenous C5a. Hopken et al. (1996) reported that C5ar-deficient mice bred normally and displayed no gross defects when maintained under barrier conditions. When mice were challenged with intratracheal Pseudomonas aeruginosa, the C5ar-deficient mice, in contrast to their littermates, were unable to clear the bacteria and they succumbed to pneumonia. On the basis of these studies, Hopken et al. (1996) concluded that C5ar has a nonredundant function and is required for mucosal host cell defense in the lung.

Full details of the abovementioned studies are described in the following publications, the disclosure of which are hereby incorporated by reference:

Hopken, U. E.; Lu, D.; Gerard, N. P.; Gerard, C.: The C5a chemoattractant receptor mediates mucosal defense to infection. Nature 383:86-89, 1996; and Bao, L.; Gerard, N. P.; Eddy, R. L., Jr.; Shows, T. B.; Gerard, C.: Mapping of genes for the human C5a receptor (C5AR), human FMLP receptor (FPR), and two FMLP receptor homologue orphan.

Further studies establishing the function and utilities of C5R1 are found in John Hopkins OMIM database record ID 113995, and in cited publications listed in Table 5, which are hereby incorporated by reference. Cyclin d2 (CCND2, Accession NP_001750.1) is another GAM66 target gene, herein designated TARGET GENE. CCND2 BINDING SITE is a target binding site found in the 3' untranslated region of mRNA encoded by CCND2, corresponding to a target binding site such as BINDING SITE I, BINDING SITE II or BINDING SITE III of FIG. 8. Table 4 illustrates the complementarity of the nucleotide sequences of CCND2 BINDING SITE, designated SEQ ID:1190, to the nucleotide sequence of GAM66 RNA, herein designated GAM RNA, also designated SEQ ID:238.

Another function of GAM66 is therefore inhibition of Cyclin d2 (CCND2, Accession NP_001750.1), a gene which is essential for the control of the cell cycle at the g1/s (start) transition. Accordingly, utilities of GAM66 include diagnosis, prevention and treatment of diseases and clinical conditions associated with CCND2.

The function of CCND2 and its association with various diseases and clinical conditions, has been established by previous studies, as described hereinabove with reference to GAM47.1. Crystallin, zeta (quinone reductase) (CRy, Accession NP_001880.2) is another GAM66 target gene, herein designated TARGET GENE. CRYZ BINDING SITE is a target binding site found in the 3' untranslated region of mRNA encoded by CRy, corresponding to a target binding site such as BINDING SITE I, BINDING SITE II or BINDING SITE III of FIG. 8. Table 4 illustrates the complementarity of the nucleotide sequences of CRYZ BINDING SITE, designated SEQ ID:18125, to the nucleotide sequence of GAM66 RNA, herein designated GAM RNA, also designated SEQ ID:238.

Another function of GAM66 is therefore inhibition of Crystallin, zeta (quinone reductase) (CRy, Accession NP_001880.2), a gene which may act in the detoxification of xenobiotics. Accordingly, utilities of GAM66 include diagnosis, prevention and treatment of diseases and clinical conditions associated with CRYZ.

The function of CRYZ has been established by previous studies. In addition to the alpha, beta, and gamma crystallin families, which are present in the ocular lenses of all vertebrates, a number of other crystallins have been found to be present in high amounts in lenses from phylogenetically restricted groups. Most of these 'taxon- specific' crystallins are pyridine nucleotide-dependent oxidoreductases that are also present at enzymatic levels in nonlenticular tissues. The acquisition of this new function as a lens crystallin generally occurs without gene duplication and apparently without affecting the catalytic role of the enzyme. Zeta-crystallin/quinone reductase was initially described as a major protein in the lens of the guinea pig (Huang et al., 1987), in which a mutation in the gene is associated with hereditary cataracts (Rodriguez et al., 1992). It was later found to be also present in high amounts in the lens of camels (Garland et al., 1991) and at enzymatic levels in a number of nonlenticular tissues of various species. In the lens of guinea pigs and camels, it comprises about 10% of the total soluble protein. Gonzalez et al. (1994) isolated and characterized the human zeta-crystallin gene and its processed pseudogene. The functional gene is composed of 9 exons and spans about 20 kb. The 5-prime flanking region of the gene is rich in G and C (58%) and lacks TATA and CAAT boxes. Previous analysis of the guinea pig gene revealed the presence of 2 different promoters, one responsible for the high lens-specific expression and the other for expression at the enzymatic level in numerous tissues. A comparative analysis with the guinea pig gene showed that a region of approximately 2.5 kb that includes the promoter responsible for the high expression in the lens in the guinea pig is not present in the human gene By Southern analysis of human/mouse somatic cell hybrids, Heinzmann et al. (1994) assigned the CRYZ gene to human chromosome 1 and regionalized the assignment to 1p31-p22 by fluorescence in situ hybridization. They also identified 5 RFLPs Full details of the abovementioned studies are described in the following publications, the disclosure of which are hereby incorporated by reference:

Gonzalez, P.; Rao, P. V.; Zigler, J. S., Jr.: Organization of the human zeta- crystallin/quinone reductase gene (CRYZ). Genomics 21:317-324, 1994; and Heinzmann, C.; Kojis, T. L.; Gonzalez, P.; Rao, P. V.; Zigler, J. S., Jr.; Polymeropoulos, M. H.; Klisak, I.; Sparkes, R. S.; Mohandas, T.; Bateman, J. B.: Assignment of the zeta-crysta.

Further studies establishing the function and utilities of CRYZ are found in John Hopkins OMIM database record ID 123691, and in cited publications listed in Table 5, which are hereby incorporated by reference. Diaphanous homolog 2 (drosophila) (DIAPH2, Accession NP_006720.1) is another GAM66 target gene, herein designated TARGET GENE. DIAPH2 BINDING SITE is a target binding site found in the 3' untranslated region of multiple transcripts of mRNA encoded by DIAPH2, corresponding to a target binding site such as BINDING SITE I, BINDING SITE II or BINDING SITE III of FIG. 8. Table 4 illustrates the complementarity of the nucleotide sequences of DIAPH2 BINDING SITE, designated SEQ ID:9802, to the nucleotide sequence of GAM66 RNA, herein designated GAM RNA, also designated SEQ ID:238.

Another function of GAM66 is therefore inhibition of Diaphanous homolog 2 (drosophila) (DIAPH2, Accession NP_006720.1), a gene which may affect in oogenesis and therefore may be associated with Premature ovarian failure. Accordingly, utilities of GAM66 include diagnosis, prevention and treatment of Premature ovarian failure, and of other diseases and clinical conditions associated with DIAPH2.

The function of DIAPH2 has been established by previous studies. Mutant alleles of Drosophila dia affect spermatogenesis or oogenesis and lead to sterility. Bione et al. (1998) characterized a human homolog of 'diaphanous' and demonstrated that this gene, designated DIA, is interrupted by a breakpoint in a patient with familial premature ovarian failure (POF; 311360). A human EST, DRES25, which showed significant homology with the Drosophila gene, was mapped to Xq22 by fluorescence in situ hybridization. Bione et al. (1998) found that the human DIA open reading frame encodes a 1,101-amino acid protein approximately 39% identical to the Drosophila protein. Northern blot analysis of human adult and fetal tissues detected 4 transcripts, 3 of which are expressed ubiquitously and the fourth exclusively in adult testis. Bione et al. (1998) showed that the DIA gene is expressed in developing ovaries and testis of the mouse, as well as in all other tissues, from the E16 stage. Banfi et al. (1997) had indicated that a human homolog of 'diaphanous' maps to Xq22. Lynch et al. (1997) noted that a nonsyndromic form of X-linked deafness, DFN2 (OMIM Ref. No. 304500), also maps to Xq22, making this homologous gene a candidate for DFN2 hearing loss. In the family of patient BC studied by Sala et al. (1997), a balanced X;12 translocation, t(X;12)(q21; p1.3), was associated with premature ovarian failure (OMIM Ref. No. 311360). Patient BC had secondary amenorrhea, with no other associated features, at the age of 17 years. Her mother, who carried the same chromosomal rearrangement, was diagnosed with premature menopause at the age of 32 years. At diagnosis, both mother and daughter had high gonadotropin levels and inactivation of the normal X chromosome (Philippe et al., 1993). The breakpoint was mapped, by FISH, to a specific YAC. The translocation breakpoint was found to be in the last 200-kb intron of the gene.

Full details of the abovementioned studies are described in the following publications, the disclosure of which are hereby incorporated by reference:

Bione, S.; Sala, C.; Manzini, C.; Arrigo, G.; Zuffardi, O.; Banfi, S.; Borsani, G.; Jonveaux, P.; Philippe, C.; Zuccotti, M.; Ballabio, A.; Toniolo, D.: A human homologue of the Drosophila melanogaster diaphanous gene is disrupted in a patient with premature ovarian failure: evidence for conserved function in oogenesis and implications for human sterility. Am. J. Hum. Genet. 62:533-541, 1998; and Philippe, C.; Cremers, F. P. M.; Chery, M.; Bach, I.; Abbadi, N.; Ropers, H. H.; Gilgenkrantz, S.: Physical mapping of DNA markers in the q13-q22 region of the human X chromosome. Genom.

Further studies establishing the function and utilities of DIAPH2 are found in John Hopkins OMIM database record ID 300108, and in cited publications listed in Table 5, which are hereby incorporated by reference. DKFZp434F142 (Accession NP_115630.1) is another GAM66 target gene, herein designated TARGET GENE. DKFZp434F142 BINDING SITE is a target binding site found in the 3' untranslated region of mRNA encoded by DKFZp434F142, corresponding to a target binding site such as BINDING SITE I, BINDING SITE II or BINDING SITE III of FIG. 8. Table 4 illustrates the complementarity of the nucleotide sequences of DKFZp434F142 BINDING SITE, designated SEQ ID:7547, to the nucleotide sequence of GAM66 RNA, herein designated GAM RNA, also designated SEQ ID:238.

Another function of GAM66 is therefore inhibition of DKFZp434F142 (Accession NP_115630.1). Accordingly, utilities of GAM66 include diagnosis, prevention and treatment of diseases and clinical conditions associated with DKFZp434F142.

DKFZp434K1210 (Accession NP_060076.1) is another GAM66 target gene, herein designated TARGET GENE. DKFZp434K1210 BINDING SITE is a target binding site found in the 3' untranslated region of mRNA encoded by DKFZp434K1210, corresponding to a target binding site such as BINDING SITE I, BINDING SITE II or BINDING SITE III of FIG. 8. Table 4 illustrates the complementarity of the nucleotide sequences of DKFZp434K1210 BINDING SITE, designated SEQ ID:8684, to the nucleotide sequence of GAM66 RNA, herein designated GAM RNA, also designated SEQ ID:238.

Another function of GAM66 is therefore inhibition of DKFZp434K1210 (Accession NP_060076.1). Accordingly, utilities of GAM66 include diagnosis, prevention and treatment of diseases and clinical conditions associated with DKFZp434K1210.

FLJ31322 (Accession NP_689600.1) is another GAM66 target gene, herein designated TARGET GENE. FLJ31322 BINDING SITE is a target binding site found in the 3' untranslated region of mRNA encoded by FLJ31322, corresponding to a target binding site such as BINDING SITE I, BINDING SITE II or BINDING SITE III of FIG. 8. Table 4 illustrates the complementarity of the nucleotide sequences of FLJ31322 BINDING SITE, designated SEQ ID:16215, to the nucleotide sequence of GAM66 RNA, herein designated GAM RNA, also designated SEQ ID:238.

Another function of GAM66 is therefore inhibition of FLJ31322 (Accession NP_689600.1). Accordingly, utilities of GAM66 include diagnosis, prevention and treatment of diseases and clinical conditions associated with FLJ31322.

FLJ32938 (Accession XP_061055.4) is another GAM66 target gene, herein designated TARGET GENE. FLJ32938 BINDING SITE is a target binding site found in the 5' untranslated region of mRNA encoded by FLJ32938, corresponding to a target binding site such as BINDING SITE I, BINDING SITE II or BINDING SITE III of FIG. 8. Table 4 illustrates the complementarity of the nucleotide sequences of FLJ32938 BINDING SITE, designated SEQ ID:16646, to the nucleotide sequence of GAM66 RNA, herein designated GAM RNA, also designated SEQ ID:238.

Another function of GAM66 is therefore inhibition of FLJ32938 (Accession XP_061055.4). Accordingly, utilities of GAM66 include diagnosis, prevention and treatment of diseases and clinical conditions associated with FLJ32938.

FLJ34780 (Accession NP_775922.1) is another GAM66 target gene, herein designated TARGET GENE. FLJ34780 BINDING SITE is a target binding site found in the 3' untranslated region of mRNA encoded by FLJ34780, corresponding to a target binding site such as BINDING SITE I, BINDING SITE II or BINDING SITE III of FIG. 8. Table 4 illustrates the complementarity of the nucleotide sequences of FLJ34780 BINDING SITE, designated SEQ ID:6166, to the nucleotide sequence of GAM66 RNA, herein designated GAM RNA, also designated SEQ ID:238.

Another function of GAM66 is therefore inhibition of FLJ34780 (Accession NP_775922.1). Accordingly, utilities of GAM66 include diagnosis, prevention and treatment of diseases and clinical conditions associated with FLJ34780.

FLJ37306 (Accession NP_775768.1) is another GAM66 target gene, herein designated TARGET GENE. FLJ37306 BINDING SITE is a target binding site found in the 3' untranslated region of mRNA encoded by FLJ37306, corresponding to a target binding site such as BINDING SITE I, BINDING SITE II or BINDING SITE III of FIG. 8. Table 4 illustrates the complementarity of the nucleotide sequences of FLJ37306 BINDING SITE, designated SEQ ID:5263, to the nucleotide sequence of GAM66 RNA, herein designated GAM RNA, also designated SEQ ID:238.

Another function of GAM66 is therefore inhibition of FLJ37306 (Accession NP_775768.1). Accordingly, utilities of GAM66 include diagnosis, prevention and treatment of diseases and clinical conditions associated with FLJ37306.

FLJ40126 (Accession NP_775870.1) is another GAM66 target gene, herein designated TARGET GENE. FLJ40126 BINDING SITE is a target binding site found in the 3' untranslated region of mRNA encoded by FLJ40126, corresponding to a target binding site such as BINDING SITE I, BINDING SITE II or BINDING SITE III of FIG. 8. Table 4 illustrates the complementarity of the nucleotide sequences of FLJ40126 BINDING SITE, designated SEQ ID:18889, to the nucleotide sequence of GAM66 RNA, herein designated GAM RNA, also designated SEQ ID:238.

Another function of GAM66 is therefore inhibition of FLJ40126 (Accession NP_775870.1). Accordingly, utilities of GAM66 include diagnosis, prevention and treatment of diseases and clinical conditions associated with FLJ40126.

H63 (Accession NP_612432.2) is another GAM66 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:16055, to the nucleotide sequence of GAM66 RNA, herein designated GAM RNA, also designated SEQ ID:238.

Another function of GAM66 is therefore inhibition of H63 (Accession NP_612432.2). Accordingly, utilities of GAM66 include diagnosis, prevention and treatment of diseases and clinical conditions associated with H63.

H63 (Accession NP_816929.1) is another GAM66 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:16055, to the nucleotide sequence of GAM66 RNA, herein designated GAM RNA, also designated SEQ ID:238.

Another function of GAM66 is therefore inhibition of H63 (Accession NP_816929.1). Accordingly, utilities of GAM66 include diagnosis, prevention and treatment of diseases and clinical conditions associated with H63.

Interleukin 16 (lymphocyte chemoattractant factor) (IL16, Accession NP_004504.3) is another GAM66 target gene, herein designated TARGET GENE. IL16 BINDING SITE is a target binding site found in the 3' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:16054, to the nucleotide sequence of GAM66 RNA, herein designated GAM RNA, also designated SEQ ID:238.

Another function of GAM66 is therefore inhibition of Interleukin 16 (lymphocyte chemoattractant factor) (IL16, Accession NP_004504.3), a gene which modulates T-cell activation. Accordingly, utilities of GAM66 include diagnosis, prevention and treatment of diseases and clinical conditions associated with IL16.

The function of IL16 has been established by previous studies. Cruikshank and Center (1982) reported the functional and biochemical characterization of lymphocyte chemoattractant factor, which was subsequently renamed interleukin-16. This proinflammatory cytokine signals via CD4, inducing chemotactic and immunomodulatory responses of CD4+ lymphocytes, monocytes, and eosinophils. Cruikshank et al. (1994) cloned a 2.2-kb IL16 cDNA, encoding a 130-amino acid protein, from a mitogen-stimulated human peripheral blood mononuclear cell cDNA library. Bannert et al. (1996) found that the cDNA isolated by Cruikshank et al. (1994) is part of a much longer open reading frame and suggested that the encoded 130-amino acid IL16 protein is derived from a large precursor protein, pro-IL16. Baier et al. (1997) cloned additional IL16 cDNAs using 5-prime RACE and reported that the deduced pro-IL16 protein has 631 amino acids and a calculated molecular mass of 67 kD. Western blot analysis detected an approximately 80-kD pro-IL16 protein in cell lysates. The authors showed that recombinant pro-IL16 proteins are specifically cleaved in lysates of CD8+ cells, resulting in a protein that is smaller than the 130-amino acid polypeptide. By Northern blot analysis, they demonstrated the expression of a major 2.6-kb IL16 transcript in lymphatic tissues Full details of the abovementioned studies are described in the following publications, the disclosure of which are hereby incorporated by reference:

Bannert, N.; Baier, M.; Werner, A.; Kurth, R.: Interleukin-16 or not? Nature 381:30 only, 1996; and Baier, M.; Bannert, N.; Werner, A.; Lang, K.; Kurth, R.: Molecular cloning, sequence, expression, and processing of the interleukin 16 precursor. Proc. Nat. Acad. Sci. 94:5273-5277, 19.

Further studies establishing the function and utilities of IL16 are found in John Hopkins OMIM database record ID 603035, and in cited publications listed in Table 5, which are hereby incorporated by reference. Interleukin 16 (lymphocyte chemoattractant factor) (IL16, Accession NP_757366.1) is another GAM66 target gene, herein designated TARGET GENE. IL16 BINDING SITE is a target binding site found in the 3' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:16054, to the nucleotide sequence of GAM66 RNA, herein designated GAM RNA, also designated SEQ ID:238.

Another function of GAM66 is therefore inhibition of Interleukin 16 (lymphocyte chemoattractant factor) (IL16, Accession NP_757366.1), a gene which modulates T-cell activation. Accordingly, utilities of GAM66 include diagnosis, prevention and treatment of diseases and clinical conditions associated with IL16.

The function of IL16 has been established by previous studies. Cruikshank and Center (1982) reported the functional and biochemical characterization of lymphocyte chemoattractant factor, which was subsequently renamed interleukin-16. This proinflammatory cytokine signals via CD4, inducing chemotactic and immunomodulatory responses of CD4+ lymphocytes, monocytes, and eosinophils. Cruikshank et al. (1994) cloned a 2.2-kb IL16 cDNA, encoding a 130-amino acid protein, from a mitogen-stimulated human peripheral blood mononuclear cell cDNA library. Bannert et al. (1996) found that the cDNA isolated by Cruikshank et al. (1994) is part of a much longer open reading frame and suggested that the encoded 130-amino acid IL16 protein is derived from a large precursor protein, pro-IL16. Baier et al. (1997) cloned additional IL16 cDNAs using 5-prime RACE and reported that the deduced pro-IL16 protein has 631 amino acids and a calculated molecular mass of 67 kD. Western blot analysis detected an approximately 80-kD pro-IL16 protein in cell lysates. The authors showed that recombinant pro-IL16 proteins are specifically cleaved in lysates of CD8+ cells, resulting in a protein that is smaller than the 130-amino acid polypeptide. By Northern blot analysis, they demonstrated the expression of a major 2.6-kb IL16 transcript in lymphatic tissues Full details of the abovementioned studies are described in the following publications, the disclosure of which are hereby incorporated by reference:

Bannert, N.; Baier, M.; Werner, A.; Kurth, R.: Interleukin-16 or not? Nature 381:30 only, 1996; and Baier, M.; Bannert, N.; Werner, A.; Lang, K.; Kurth, R.: Molecular cloning, sequence, expression, and processing of the interleukin 16 precursor. Proc. Nat. Acad. Sci. 94:5273-5277, 19.

Further studies establishing the function and utilities of IL16 are found in John Hopkins OMIM database record ID 603035, and in cited publications listed in Table 5, which are hereby incorporated by reference. Internexin neuronal intermediate filament protein, alpha (INA, Accession NP_116116.1) is another GAM66 target gene, herein designated TARGET GENE. INA BINDING SITE is a target binding site found in the 3' untranslated region of mRNA encoded by INA, corresponding to a target binding site such as BINDING SITE I, BINDING SITE II or BINDING SITE III of FIG. 8. Table 4 illustrates the complementarity of the nucleotide sequences of INA BINDING SITE, designated SEQ ID:7210, to the nucleotide sequence of GAM66 RNA, herein designated GAM RNA, also designated SEQ ID:238.

Another function of GAM66 is therefore inhibition of Internexin neuronal intermediate filament protein, alpha (INA, Accession NP_116116.1). Accordingly, utilities of GAM66 include diagnosis, prevention and treatment of diseases and clinical conditions associated with INA.

Potassium channel, subfamily k, member 5 (KCNK5, Accession NP_003731.1) is another GAM66 target gene, herein designated TARGET GENE. KCNK5 BINDING SITE is a target binding site found in the 3' untranslated region of mRNA encoded by KCNK5, corresponding to a target binding site such as BINDING SITE I, BINDING SITE II or BINDING SITE III of FIG. 8. Table 4 illustrates the complementarity of the nucleotide sequences of KCNK5 BINDING SITE, designated SEQ ID:18276, to the nucleotide sequence of GAM66 RNA, herein designated GAM RNA, also designated SEQ ID:238.

Another function of GAM66 is therefore inhibition of Potassium channel, subfamily k, member 5 (KCNK5, Accession NP_003731.1). Accordingly, utilities of GAM66 include diagnosis, prevention and treatment of diseases and clinical conditions associated with KCNK5.

KIAA0252 (Accession NP_055953.1) is another GAM66 target gene, herein designated TARGET GENE. KIAA0252 BINDING SITE is a target binding site found in the 3' untranslated region of mRNA encoded by KIAA0252, corresponding to a target binding site such as BINDING SITE I, BINDING SITE II or BINDING SITE III of FIG. 8. Table 4 illustrates the complementarity of the nucleotide sequences of KIAA0252 BINDING SITE, designated SEQ ID:14205, to the nucleotide sequence of GAM66 RNA, herein designated GAM RNA, also designated SEQ ID:238.

Another function of GAM66 is therefore inhibition of KIAA0252 (Accession NP_055953.1). Accordingly, utilities of GAM66 include diagnosis, prevention and treatment of diseases and clinical conditions associated with KIAA0252.

KIAA0976 (Accession NP_055732.1) is another GAM66 target gene, herein designated TARGET GENE. KIAA0976 BINDING SITE is a target binding site found in the 3' untranslated region of mRNA encoded by KIAA0976, corresponding to a target binding site such as BINDING SITE I, BINDING SITE II or BINDING SITE III of FIG. 8. Table 4 illustrates the complementarity of the nucleotide sequences of KIAA0976 BINDING SITE, designated SEQ ID:19828, to the nucleotide sequence of GAM66 RNA, herein designated GAM RNA, also designated SEQ ID:238.

Another function of GAM66 is therefore inhibition of KIAA0976 (Accession NP_055732.1). Accordingly, utilities of GAM66 include diagnosis, prevention and treatment of diseases and clinical conditions associated with KIAA0976.

KIAA1128 (Accession NP_061872.1) is another GAM66 target gene, herein designated TARGET GENE. KIAA1128 BINDING SITE is a target binding site found in the 3' untranslated region of mRNA encoded by KIAA1128, corresponding to a target binding site such as BINDING SITE I, BINDING SITE II or BINDING SITE III of FIG. 8. Table 4 illustrates the complementarity of the nucleotide sequences of KIAA1128 BINDING SITE, designated SEQ ID:7548, to the nucleotide sequence of GAM66 RNA, herein designated GAM RNA, also designated SEQ ID:238.

Another function of GAM66 is therefore inhibition of KIAA1128 (Accession NP_061872.1). Accordingly, utilities of GAM66 include diagnosis, prevention and treatment of diseases and clinical conditions associated with KIAA1128.

KIAA1327 (Accession XP_051146.2) is another GAM66 target gene, herein designated TARGET GENE. KIAA1327 BINDING SITE is a target binding site found in the 3' untranslated region of mRNA encoded by KIAA1327, corresponding to a target binding site such as BINDING SITE I, BINDING SITE II or BINDING SITE III of FIG. 8. Table 4 illustrates the complementarity of the nucleotide sequences of KIAA1327 BINDING SITE, designated SEQ ID:7254, to the nucleotide sequence of GAM66 RNA, herein designated GAM RNA, also designated SEQ ID:238.

Another function of GAM66 is therefore inhibition of KIAA1327 (Accession XP_051146.2). Accordingly, utilities of GAM66 include diagnosis, prevention and treatment of diseases and clinical conditions associated with KIAA1327.

KIAA1577 (Accession XP_035299.1) is another GAM66 target gene, herein designated TARGET GENE. KIAA1577 BINDING SITE is a target binding site found in the 5' untranslated region of mRNA encoded by KIAA1577, corresponding to a target binding site such as BINDING SITE I, BINDING SITE II or BINDING SITE III of FIG. 8. Table 4 illustrates the complementarity of the nucleotide sequences of KIAA1577 BINDING SITE, designated SEQ ID:9184, to the nucleotide sequence of GAM66 RNA, herein designated GAM RNA, also designated SEQ ID:238.

Another function of GAM66 is therefore inhibition of KIAA1577 (Accession XP_035299.1). Accordingly, utilities of GAM66 include diagnosis, prevention and treatment of diseases and clinical conditions associated with KIAA1577.

KIAA1618 (Accession XP_290769.2) is another GAM66 target gene, herein designated TARGET GENE. KIAA1618 BINDING SITE is a target binding site found in the 3' untranslated region of mRNA encoded by KIAA1618, corresponding to a target binding site such as BINDING SITE I, BINDING SITE II or BINDING SITE III of FIG. 8. Table 4 illustrates the complementarity of the nucleotide sequences of KIAA1618 BINDING SITE, designated SEQ ID:6857, to the nucleotide sequence of GAM66 RNA, herein designated GAM RNA, also designated SEQ ID:238.

Another function of GAM66 is therefore inhibition of KIAA1618 (Accession XP_290769.2). Accordingly, utilities of GAM66 include diagnosis, prevention and treatment of diseases and clinical conditions associated with KIAA1618.

KIAA1872 (Accession NP_149053.1) is another GAM66 target gene, herein designated TARGET GENE. KIAA1872 BINDING SITE is a target binding site found in the 5' untranslated region of mRNA encoded by KIAA1872, corresponding to a target binding site such as BINDING SITE I, BINDING SITE II or BINDING SITE III of FIG. 8. Table 4 illustrates the complementarity of the nucleotide sequences of KIAA1872 BINDING SITE, designated SEQ ID:15500, to the nucleotide sequence of GAM66 RNA, herein designated GAM RNA, also designated SEQ ID:238.

Another function of GAM66 is therefore inhibition of KIAA1872 (Accession NP_149053.1). Accordingly, utilities of GAM66 include diagnosis, prevention and treatment of diseases and clinical conditions associated with KIAA1872.

Leukemia inhibitory factor (cholinergic differentiation factor) (LIF, Accession NP_002300.1) is another GAM66 target gene, herein designated TARGET GENE. LIF BINDING SITE is a target binding site found in the 3' untranslated region of mRNA encoded by LIF, corresponding to a target binding site such as BINDING SITE I, BINDING SITE II or BINDING SITE III of FIG. 8. Table 4 illustrates the complementarity of the nucleotide sequences of LIF BINDING SITE, designated SEQ ID:4319, to the nucleotide sequence of GAM66 RNA, herein designated GAM RNA, also designated SEQ ID:238.

Another function of GAM66 is therefore inhibition of Leukemia inhibitory factor (cholinergic differentiation factor) (LIF, Accession NP_002300.1). Accordingly, utilities of GAM66 include diagnosis, prevention and treatment of diseases and clinical conditions associated with LIF.

LOC114971 (Accession XP_054936.4) is another GAM66 target gene, herein designated TARGET GENE. LOC114971 BINDING SITE is a target binding site found in the 3' untranslated region of mRNA encoded by LOC114971, corresponding to a target binding site such as BINDING SITE I, BINDING SITE II or BINDING SITE III of FIG. 8. Table 4 illustrates the complementarity of the nucleotide sequences of LOC114971 BINDING SITE, designated SEQ ID:2099, to the nucleotide sequence of GAM66 RNA, herein designated GAM RNA, also designated SEQ ID:238.

Another function of GAM66 is therefore inhibition of LOC114971 (Accession XP_054936.4). Accordingly, utilities of GAM66 include diagnosis, prevention and treatment of diseases and clinical conditions associated with LOC114971.

LOC145231 (Accession XP_096740.1) is another GAM66 target gene, herein designated TARGET GENE. LOC145231 BINDING SITE is a target binding site found in the 3' untranslated region of mRNA encoded by LOC145231, corresponding to a target binding site such as BINDING SITE I, BINDING SITE II or BINDING SITE III of FIG. 8. Table 4 illustrates the complementarity of the nucleotide sequences of LOC145231 BINDING SITE, designated SEQ ID:10362, to the nucleotide sequence of GAM66 RNA, herein designated GAM RNA, also designated SEQ ID:238.

Another function of GAM66 is therefore inhibition of LOC145231 (Accession XP_096740.1). Accordingly, utilities of GAM66 include diagnosis, prevention and treatment of diseases and clinical conditions associated with LOC145231.

LOC146227 (Accession XP_085374.2) is another GAM66 target gene, herein designated TARGET GENE. LOC146227 BINDING SITE is a target binding site found in the 3' untranslated region of mRNA encoded by LOC146227, corresponding to a target binding site such as BINDING SITE I, BINDING SITE II or BINDING SITE III of FIG. 8. Table 4 illustrates the complementarity of the nucleotide sequences of LOC146227 BINDING SITE, designated SEQ ID:5104, to the nucleotide sequence of GAM66 RNA, herein designated GAM RNA, also designated SEQ ID:238.

Another function of GAM66 is therefore inhibition of LOC146227 (Accession XP_085374.2). Accordingly, utilities of GAM66 include diagnosis, prevention and treatment of diseases and clinical conditions associated with LOC146227.

LOC146481 (Accession XP_085484.2) is another GAM66 target gene, herein designated TARGET GENE. LOC146481 BINDING SITE is a target binding site found in the 3' untranslated region of mRNA encoded by LOC146481, corresponding to a target binding site such as BINDING SITE I, BINDING SITE II or BINDING SITE III of FIG. 8. Table 4 illustrates the complementarity of the nucleotide sequences of LOC146481 BINDING SITE, designated SEQ ID:9334, to the nucleotide sequence of GAM66 RNA, herein designated GAM RNA, also designated SEQ ID:238.

Another function of GAM66 is therefore inhibition of LOC146481 (Accession XP_085484.2). Accordingly, utilities of GAM66 include diagnosis, prevention and treatment of diseases and clinical conditions associated with LOC146481.

LOC150212 (Accession XP_086827.2) is another GAM66 target gene, herein designated TARGET GENE. LOC150212 BINDING SITE is a target binding site found in the 5' untranslated region of mRNA encoded by LOC150212, corresponding to a target binding site such as BINDING SITE I, BINDING SITE II or BINDING SITE III of FIG. 8. Table 4 illustrates the complementarity of the nucleotide sequences of LOC150212 BINDING SITE, designated SEQ ID:14049, to the nucleotide sequence of GAM66 RNA, herein designated GAM RNA, also designated SEQ ID:238.

Another function of GAM66 is therefore inhibition of LOC150212 (Accession XP_086827.2). Accordingly, utilities of GAM66 include diagnosis, prevention and treatment of diseases and clinical conditions associated with LOC150212.

LOC154860 (Accession XP_098623.1) is another GAM66 target gene, herein designated TARGET GENE. LOC154860 BINDING SITE is a target binding site found in the 5' untranslated region of mRNA encoded by LOC154860, corresponding to a target binding site such as BINDING SITE I, BINDING SITE II or BINDING SITE III of FIG. 8. Table 4 illustrates the complementarity of the nucleotide sequences of LOC154860 BINDING SITE, designated SEQ ID:9864, to the nucleotide sequence of GAM66 RNA, herein designated GAM RNA, also designated SEQ ID:238.

Another function of GAM66 is therefore inhibition of LOC154860 (Accession XP_098623.1). Accordingly, utilities of GAM66 include diagnosis, prevention and treatment of diseases and clinical conditions associated with LOC154860.

LOC154990 (Accession XP_088109.3) is another GAM66 target gene, herein designated TARGET GENE. LOC154990 BINDING SITE is a target binding site found in the 3' untranslated region of mRNA encoded by LOC154990, corresponding to a target binding site such as BINDING SITE I, BINDING SITE II or BINDING SITE III of FIG. 8. Table 4 illustrates the complementarity of the nucleotide sequences of LOC154990 BINDING SITE, designated SEQ ID:4166, to the nucleotide sequence of GAM66 RNA, herein designated GAM RNA, also designated SEQ ID:238.

Another function of GAM66 is therefore inhibition of LOC154990 (Accession XP_088109.3). Accordingly, utilities of GAM66 include diagnosis, prevention and treatment of diseases and clinical conditions associated with LOC154990.

LOC164714 (Accession XP_104657.1) is another GAM66 target gene, herein designated TARGET GENE. LOC164714 BINDING SITE is a target binding site found in the 5' untranslated region of mRNA encoded by LOC164714, corresponding to a target binding site such as BINDING SITE I, BINDING SITE II or BINDING SITE III of FIG. 8. Table 4 illustrates the complementarity of the nucleotide sequences of LOC164714 BINDING SITE, designated SEQ ID:13234, to the nucleotide sequence of GAM66 RNA, herein designated GAM RNA, also designated SEQ ID:238.

Another function of GAM66 is therefore inhibition of LOC164714 (Accession XP_104657.1). Accordingly, utilities of GAM66 include diagnosis, prevention and treatment of diseases and clinical conditions associated with LOC164714.

LOC222057 (Accession XP_166594.2) is another GAM66 target gene, herein designated TARGET GENE. LOC222057 BINDING SITE is a target binding site found in the 3' untranslated region of mRNA encoded by LOC222057, corresponding to a target binding site such as BINDING SITE I, BINDING SITE II or BINDING SITE III of FIG. 8. Table 4 illustrates the complementarity of the nucleotide sequences of LOC222057 BINDING SITE, designated SEQ ID:10021, to the nucleotide sequence of GAM66 RNA, herein designated GAM RNA, also designated SEQ ID:238.

Another function of GAM66 is therefore inhibition of LOC222057 (Accession XP_166594.2). Accordingly, utilities of GAM66 include diagnosis, prevention and treatment of diseases and clinical conditions associated with LOC222057.

LOC283048 (Accession XP_210867.1) is another GAM66 target gene, herein designated TARGET GENE. LOC283048 BINDING SITE is a target binding site found in the 5' untranslated region of mRNA encoded by LOC283048, corresponding to a target binding site such as BINDING SITE I, BINDING SITE II or BINDING SITE III of FIG. 8. Table 4 illustrates the complementarity of the nucleotide sequences of LOC283048 BINDING SITE, designated SEQ ID:15529, to the nucleotide sequence of GAM66 RNA, herein designated GAM RNA, also designated SEQ ID:238.

Another function of GAM66 is therefore inhibition of LOC283048 (Accession XP_210867.1). Accordingly, utilities of GAM66 include diagnosis, prevention and treatment of diseases and clinical conditions associated with LOC283048.

LOC283216 (Accession XP_210939.1) is another GAM66 target gene, herein designated TARGET GENE. LOC283216 BINDING SITE is a target binding site found in the 5' untranslated region of mRNA encoded by LOC283216, corresponding to a target binding site such as BINDING SITE I, BINDING SITE II or BINDING SITE III of FIG. 8. Table 4 illustrates the complementarity of the nucleotide sequences of LOC283216 BINDING SITE, designated SEQ ID:20167, to the nucleotide sequence of GAM66 RNA, herein designated GAM RNA, also designated SEQ ID:238.

Another function of GAM66 is therefore inhibition of LOC283216 (Accession XP_210939.1). Accordingly, utilities of GAM66 include diagnosis, prevention and treatment of diseases and clinical conditions associated with LOC283216.

LOC283323 (Accession XP_210973.1) is another GAM66 target gene, herein designated TARGET GENE. LOC283323 BINDING SITE is a target binding site found in the 5' untranslated region of mRNA encoded by LOC283323, corresponding to a target binding site such as BINDING SITE I, BINDING SITE II or BINDING SITE III of FIG. 8. Table 4 illustrates the complementarity of the nucleotide sequences of LOC283323 BINDING SITE, designated SEQ ID:1999, to the nucleotide sequence of GAM66 RNA, herein designated GAM RNA, also designated SEQ ID:238.

Another function of GAM66 is therefore inhibition of LOC283323 (Accession XP_210973.1). Accordingly, utilities of GAM66 include diagnosis, prevention and treatment of diseases and clinical conditions associated with LOC283323.

LOC283657 (Accession XP_211148.1) is another GAM66 target gene, herein designated TARGET GENE. LOC283657 BINDING SITE is a target binding site found in the 5' untranslated region of mRNA encoded by LOC283657, corresponding to a target binding site such as BINDING SITE I, BINDING SITE II or BINDING SITE III of FIG. 8. Table 4 illustrates the complementarity of the nucleotide sequences of LOC283657 BINDING SITE, designated SEQ ID:19902, to the nucleotide sequence of GAM66 RNA, herein designated GAM RNA, also designated SEQ ID:238.

Another function of GAM66 is therefore inhibition of LOC283657 (Accession XP_211148.1). Accordingly, utilities of GAM66 include diagnosis, prevention and treatment of diseases and clinical conditions associated with LOC283657.

LOC284080 (Accession XP_211322.1) is another GAM66 target gene, herein designated TARGET GENE. LOC284080 BINDING SITE is a target binding site found in the 3' untranslated region of mRNA encoded by LOC284080, corresponding to a target binding site such as BINDING SITE I, BINDING SITE II or BINDING SITE III of FIG. 8. Table 4 illustrates the complementarity of the nucleotide sequences of LOC284080 BINDING SITE, designated SEQ ID:6336, to the nucleotide sequence of GAM66 RNA, herein designated GAM RNA, also designated SEQ ID:238.

Another function of GAM66 is therefore inhibition of LOC284080 (Accession XP_211322.1). Accordingly, utilities of GAM66 include diagnosis, prevention and treatment of diseases and clinical conditions associated with LOC284080.

LOC284117 (Accession XP_209024.1) is another GAM66 target gene, herein designated TARGET GENE. LOC284117 BINDING SITE is a target binding site found in the 3' untranslated region of mRNA encoded by LOC284117, corresponding to a target binding site such as BINDING SITE I, BINDING SITE II or BINDING SITE III of FIG. 8. Table 4 illustrates the complementarity of the nucleotide sequences of LOC284117 BINDING SITE, designated SEQ ID:13823, to the nucleotide sequence of GAM66 RNA, herein designated GAM RNA, also designated SEQ ID:238.

Another function of GAM66 is therefore inhibition of LOC284117 (Accession XP_209024.1). Accordingly, utilities of GAM66 include diagnosis, prevention and treatment of diseases and clinical conditions associated with LOC284117.

LOC285136 (Accession XP_211777.1) is another GAM66 target gene, herein designated TARGET GENE. LOC285136 BINDING SITE is a target binding site found in the 5' untranslated region of mRNA encoded by LOC285136, corresponding to a target binding site such as BINDING SITE I, BINDING SITE II or BINDING SITE III of FIG. 8. Table 4 illustrates the complementarity of the nucleotide sequences of LOC285136 BINDING SITE, designated SEQ ID:3059, to the nucleotide sequence of GAM66 RNA, herein designated GAM RNA, also designated SEQ ID:238.

Another function of GAM66 is therefore inhibition of LOC285136 (Accession XP_211777.1). Accordingly, utilities of GAM66 include diagnosis, prevention and treatment of diseases and clinical conditions associated with LOC285136.

LOC285369 (Accession XP_211861.3) is another GAM66 target gene, herein designated TARGET GENE. LOC285369 BINDING SITE is a target binding site found in the 3' untranslated region of mRNA encoded by LOC285369, corresponding to a target binding site such as BINDING SITE I, BINDING SITE II or BINDING SITE III of FIG. 8. Table 4 illustrates the complementarity of the nucleotide sequences of LOC285369 BINDING SITE, designated SEQ ID:11869, to the nucleotide sequence of GAM66 RNA, herein designated GAM RNA, also designated SEQ ID:238.

Another function of GAM66 is therefore inhibition of LOC285369 (Accession XP_211861.3). Accordingly, utilities of GAM66 include diagnosis, prevention and treatment of diseases and clinical conditions associated with LOC285369.

LOC285387 (Accession XP_209588.1) is another GAM66 target gene, herein designated TARGET GENE. LOC285387 BINDING SITE is a target binding site found in the 3' untranslated region of mRNA encoded by LOC285387, corresponding to a target binding site such as BINDING SITE I, BINDING SITE II or BINDING SITE III of FIG. 8. Table 4 illustrates the complementarity of the nucleotide sequences of LOC285387 BINDING SITE, designated SEQ ID:18757, to the nucleotide sequence of GAM66 RNA, herein designated GAM RNA, also designated SEQ ID:238.

Another function of GAM66 is therefore inhibition of LOC285387 (Accession XP_209588.1). Accordingly, utilities of GAM66 include diagnosis, prevention and treatment of diseases and clinical conditions associated with LOC285387.

LOC286058 (Accession XP_212158.1) is another GAM66 target gene, herein designated TARGET GENE. LOC286058 BINDING SITE is a target binding site found in the 3' untranslated region of mRNA encoded by LOC286058, corresponding to a target binding site such as BINDING SITE I, BINDING SITE II or BINDING SITE III of FIG. 8. Table 4 illustrates the complementarity of the nucleotide sequences of LOC286058 BINDING SITE, designated SEQ ID:16079, to the nucleotide sequence of GAM66 RNA, herein designated GAM RNA, also designated SEQ ID:238.

Another function of GAM66 is therefore inhibition of LOC286058 (Accession XP_212158.1). Accordingly, utilities of GAM66 include diagnosis, prevention and treatment of diseases and clinical conditions associated with LOC286058.

LOC286149 (Accession XP_212202.1) is another GAM66 target gene, herein designated TARGET GENE. LOC286149 BINDING SITE is a target binding site found in the 5' untranslated region of mRNA encoded by LOC286149, corresponding to a target binding site such as BINDING SITE I, BINDING SITE II or BINDING SITE III of FIG. 8. Table 4 illustrates the complementarity of the nucleotide sequences of LOC286149 BINDING SITE, designated SEQ ID:18656, to the nucleotide sequence of GAM66 RNA, herein designated GAM RNA, also designated SEQ ID:238.

Another function of GAM66 is therefore inhibition of LOC286149 (Accession XP_212202.1). Accordingly, utilities of GAM66 include diagnosis, prevention and treatment of diseases and clinical conditions associated with LOC286149.

LOC339439 (Accession XP_294952.2) is another GAM66 target gene, herein designated TARGET GENE.

LOC339439 BINDING SITE is a target binding site found in the 3' untranslated region of mRNA encoded by LOC339439, corresponding to a target binding site such as BINDING SITE I, BINDING SITE II or BINDING SITE III of FIG. 8. Table 4 illustrates the complementarity of the nucleotide sequences of LOC339439 BINDING SITE, designated SEQ ID:10021, to the nucleotide sequence of GAM66 RNA, herein designated GAM RNA, also designated SEQ ID:238.

Another function of GAM66 is therefore inhibition of LOC339439 (Accession XP_294952.2). Accordingly, utilities of GAM66 include diagnosis, prevention and treatment of diseases and clinical conditions associated with LOC339439.

LOC340128 (Accession XP_295164.2) is another GAM66 target gene, herein designated TARGET GENE. LOC340128 BINDING SITE is a target binding site found in the 5' untranslated region of mRNA encoded by LOC340128, corresponding to a target binding site such as BINDING SITE I, BINDING SITE II or BINDING SITE III of FIG. 8. Table 4 illustrates the complementarity of the nucleotide sequences of LOC340128 BINDING SITE, designated SEQ ID:10021, to the nucleotide sequence of GAM66 RNA, herein designated GAM RNA, also designated SEQ ID:238.

Another function of GAM66 is therefore inhibition of LOC340128 (Accession XP_295164.2). Accordingly, utilities of GAM66 include diagnosis, prevention and treatment of diseases and clinical conditions associated with LOC340128.

LOC340346 (Accession XP_295213.2) is another GAM66 target gene, herein designated TARGET GENE. LOC340346 BINDING SITE is a target binding site found in the 3' untranslated region of mRNA encoded by LOC340346, corresponding to a target binding site such as BINDING SITE I, BINDING SITE II or BINDING SITE III of FIG. 8. Table 4 illustrates the complementarity of the nucleotide sequences of LOC340346 BINDING SITE, designated SEQ ID:10021, to the nucleotide sequence of GAM66 RNA, herein designated GAM RNA, also designated SEQ ID:238.

Another function of GAM66 is therefore inhibition of LOC340346 (Accession XP_295213.2). Accordingly, utilities of GAM66 include diagnosis, prevention and treatment of diseases and clinical conditions associated with LOC340346.

LOC347648 (Accession XP_300226.1) is another GAM66 target gene, herein designated TARGET GENE. LOC347648 BINDING SITE is a target binding site found in the 3' untranslated region of mRNA encoded by LOC347648, corresponding to a target binding site such as BINDING SITE I, BINDING SITE II or BINDING SITE III of FIG. 8. Table 4 illustrates the complementarity of the nucleotide sequences of LOC347648 BINDING SITE, designated SEQ ID:5082, to the nucleotide sequence of GAM66 RNA, herein designated GAM RNA, also designated SEQ ID:238.

Another function of GAM66 is therefore inhibition of LOC347648 (Accession XP_300226.1). Accordingly, utilities of GAM66 include diagnosis, prevention and treatment of diseases and clinical conditions associated with LOC347648.

LOC348301 (Accession XP_302717.1) is another GAM66 target gene, herein designated TARGET GENE. LOC348301 BINDING SITE is a target binding site found in the 3' untranslated region of mRNA encoded by LOC348301, corresponding to a target binding site such as BINDING SITE I, BINDING SITE II or BINDING SITE III of FIG. 8. Table 4 illustrates the complementarity of the nucleotide sequences of LOC348301 BINDING SITE, designated SEQ ID:866, to the nucleotide sequence of GAM66 RNA, herein designated GAM RNA, also designated SEQ ID:238.

Another function of GAM66 is therefore inhibition of LOC348301 (Accession XP_302717.1). Accordingly, utilities of GAM66 include diagnosis, prevention and treatment of diseases and clinical conditions associated with LOC348301.

LOC348450 (Accession XP_302758.1) is another GAM66 target gene, herein designated TARGET GENE. LOC348450 BINDING SITE is a target binding site found in the 3' untranslated region of mRNA encoded by LOC348450, corresponding to a target binding site such as BINDING SITE I, BINDING SITE II or BINDING SITE III of FIG. 8. Table 4 illustrates the complementarity of the nucleotide sequences of LOC348450 BINDING SITE, designated SEQ ID:4166, to the nucleotide sequence of GAM66 RNA, herein designated GAM RNA, also designated SEQ ID:238.

Another function of GAM66 is therefore inhibition of LOC348450 (Accession XP_302758.1). Accordingly, utilities of GAM66 include diagnosis, prevention and treatment of diseases and clinical conditions associated with LOC348450.

LOC348508 (Accession XP_302806.1) is another GAM66 target gene, herein designated TARGET GENE. LOC348508 BINDING SITE is a target binding site found in the 3' untranslated region of mRNA encoded by LOC348508, corresponding to a target binding site such as BINDING SITE I, BINDING SITE II or BINDING SITE III of FIG. 8. Table 4 illustrates the complementarity of the nucleotide sequences of LOC348508 BINDING SITE, designated SEQ ID:10021, to the nucleotide sequence of GAM66 RNA, herein designated GAM RNA, also designated SEQ ID:238.

Another function of GAM66 is therefore inhibition of LOC348508 (Accession XP_302806.1). Accordingly, utilities of GAM66 include diagnosis, prevention and treatment of diseases and clinical conditions associated with LOC348508.

LOC348529 (Accession XP_302813.1) is another GAM66 target gene, herein designated TARGET GENE. LOC348529 BINDING SITE is a target binding site found in the 5' untranslated region of mRNA encoded by LOC348529, corresponding to a target binding site such as BINDING SITE I, BINDING SITE II or BINDING SITE III of FIG. 8. Table 4 illustrates the complementarity of the nucleotide sequences of LOC348529 BINDING SITE, designated SEQ ID:6460, to the nucleotide sequence of GAM66 RNA, herein designated GAM RNA, also designated SEQ ID:238.

Another function of GAM66 is therefore inhibition of LOC348529 (Accession XP_302813.1). Accordingly, utilities of GAM66 include diagnosis, prevention and treatment of diseases and clinical conditions associated with LOC348529.

LOC348842 (Accession XP_300861.1) is another GAM66 target gene, herein designated TARGET GENE. LOC348842 BINDING SITE is a target binding site found in the 3' untranslated region of mRNA encoded by LOC348842, corresponding to a target binding site such as BINDING SITE I, BINDING SITE II or BINDING SITE III of FIG. 8. Table 4 illustrates the complementarity of the nucleotide sequences of LOC348842 BINDING SITE, designated SEQ ID:4166, to the nucleotide sequence of GAM66 RNA, herein designated GAM RNA, also designated SEQ ID:238.

Another function of GAM66 is therefore inhibition of LOC348842 (Accession XP_300861.1). Accordingly, utilities of GAM66 include diagnosis, prevention and treatment of diseases and clinical conditions associated with LOC348842.

LOC349071 (Accession XP_300933.1) is another GAM66 target gene, herein designated TARGET GENE. LOC349071 BINDING SITE is a target binding site found in the 5' untranslated region of mRNA encoded by LOC349071, corresponding to a target binding site such as BINDING SITE I, BINDING SITE II or BINDING SITE III of FIG. 8. Table 4 illustrates the complementarity of the nucleotide sequences of LOC349071 BINDING SITE, designated SEQ ID:10021, to the nucleotide sequence of GAM66 RNA, herein designated GAM RNA, also designated SEQ ID:238.

Another function of GAM66 is therefore inhibition of LOC349071 (Accession XP_300933.1). Accordingly, utilities of GAM66 include diagnosis, prevention and treatment of diseases and clinical conditions associated with LOC349071.

LOC349275 (Accession XP_302588.1) is another GAM66 target gene, herein designated TARGET GENE. LOC349275 BINDING SITE is a target binding site found in the 5' untranslated region of mRNA encoded by LOC349275, corresponding to a target binding site such as BINDING SITE I, BINDING SITE II or BINDING SITE III of FIG. 8. Table 4 illustrates the complementarity of the nucleotide sequences of LOC349275 BINDING SITE, designated SEQ ID:7680, to the nucleotide sequence of GAM66 RNA, herein designated GAM RNA, also designated SEQ ID:238.

Another function of GAM66 is therefore inhibition of LOC349275 (Accession XP_302588.1). Accordingly, utilities of GAM66 include diagnosis, prevention and treatment of diseases and clinical conditions associated with LOC349275.

LOC349297 (Accession XP_302589.1) is another GAM66 target gene, herein designated TARGET GENE. LOC349297 BINDING SITE is a target binding site found in the 5' untranslated region of mRNA encoded by LOC349297, corresponding to a target binding site such as BINDING SITE I, BINDING SITE II or BINDING SITE III of FIG. 8. Table 4 illustrates the complementarity of the nucleotide sequences of LOC349297 BINDING SITE, designated SEQ ID:7680, to the nucleotide sequence of GAM66 RNA, herein designated GAM RNA, also designated SEQ ID:238.

Another function of GAM66 is therefore inhibition of LOC349297 (Accession XP_302589.1). Accordingly, utilities of GAM66 include diagnosis, prevention and treatment of diseases and clinical conditions associated with LOC349297.

LOC349419 (Accession XP_291356.1) is another GAM66 target gene, herein designated TARGET GENE. LOC349419 BINDING SITE is a target binding site found in the 5' untranslated region of mRNA encoded by LOC349419, corresponding to a target binding site such as BINDING SITE I, BINDING SITE II or BINDING SITE III of FIG. 8. Table 4 illustrates the complementarity of the nucleotide sequences of LOC349419 BINDING SITE, designated SEQ ID:17974, to the nucleotide sequence of GAM66 RNA, herein designated GAM RNA, also designated SEQ ID:238.

Another function of GAM66 is therefore inhibition of LOC349419 (Accession XP_291356.1). Accordingly, utilities of GAM66 include diagnosis, prevention and treatment of diseases and clinical conditions associated with LOC349419.

LOC90520 (Accession XP_032277.1) is another GAM66 target gene, herein designated TARGET GENE. LOC90520 BINDING SITE is a target binding site found in the 3' untranslated region of mRNA encoded by LOC90520, corresponding to a target binding site such as BINDING SITE I, BINDING SITE II or BINDING SITE III of FIG. 8. Table 4 illustrates the complementarity of the nucleotide sequences of LOC90520 BINDING SITE, designated SEQ ID:19060, to the nucleotide sequence of GAM66 RNA, herein designated GAM RNA, also designated SEQ ID:238.

Another function of GAM66 is therefore inhibition of LOC90520 (Accession XP_032277.1). Accordingly, utilities of GAM66 include diagnosis, prevention and treatment of diseases and clinical conditions associated with LOC90520.

LOC92597 (Accession NP_775739.1) is another GAM66 target gene, herein designated TARGET GENE. LOC92597 BINDING SITE is a target binding site found in the 3' untranslated region of mRNA encoded by LOC92597, corresponding to a target binding site such as BINDING SITE I, BINDING SITE II or BINDING SITE III of FIG. 8. Table 4 illustrates the complementarity of the nucleotide sequences of LOC92597 BINDING SITE, designated SEQ ID:14239, to the nucleotide sequence of GAM66 RNA, herein designated GAM RNA, also designated SEQ ID:238.

Another function of GAM66 is therefore inhibition of LOC92597 (Accession NP_775739.1). Accordingly, utilities of GAM66 include diagnosis, prevention and treatment of diseases and clinical conditions associated with LOC92597.

MGC16664 (Accession NP_775780.1) is another GAM66 target gene, herein designated TARGET GENE. MGC16664 BINDING SITE is a target binding site found in the 5' untranslated region of mRNA encoded by MGC16664, corresponding to a target binding site such as BINDING SITE I, BINDING SITE II or BINDING SITE III of FIG. 8. Table 4 illustrates the complementarity of the nucleotide sequences of MGC16664 BINDING SITE, designated SEQ ID:3795, to the nucleotide sequence of GAM66 RNA, herein designated GAM RNA, also designated SEQ ID:238.

Another function of GAM66 is therefore inhibition of MGC16664 (Accession NP_775780.1). Accordingly, utilities of GAM66 include diagnosis, prevention and treatment of diseases and clinical conditions associated with MGC16664.

MGC20255 (Accession NP_443080.1) is another GAM66 target gene, herein designated TARGET GENE. MGC20255 BINDING SITE is a target binding site found in the 3' untranslated region of mRNA encoded by MGC20255, corresponding to a target binding site such as BINDING SITE I, BINDING SITE II or BINDING SITE III of FIG. 8. Table 4 illustrates the complementarity of the nucleotide sequences of MGC20255 BINDING SITE, designated SEQ ID:8679, to the nucleotide sequence of GAM66 RNA, herein designated GAM RNA, also designated SEQ ID:238.

Another function of GAM66 is therefore inhibition of MGC20255 (Accession NP_443080.1). Accordingly, utilities of GAM66 include diagnosis, prevention and treatment of diseases and clinical conditions associated with MGC20255.

MGC4643 (Accession NP_116104.1) is another GAM66 target gene, herein designated TARGET GENE. MGC4643 BINDING SITE is a target binding site found in the 3' untranslated region of mRNA encoded by MGC4643, corresponding to a target binding site such as BINDING SITE I, BINDING SITE II or BINDING SITE III of FIG. 8. Table 4 illustrates the complementarity of the nucleotide sequences of MGC4643 BINDING SITE, designated SEQ ID:3909, to the nucleotide sequence of GAM66 RNA, herein designated GAM RNA, also designated SEQ ID:238.

Another function of GAM66 is therefore inhibition of MGC4643 (Accession NP_116104.1). Accordingly, utilities of GAM66 include diagnosis, prevention and treatment of diseases and clinical conditions associated with MGC4643.

Phosphatidylinositol glycan, class s (PIGS, Accession NP_149975.1) is another GAM66 target gene, herein designated TARGET GENE. PIGS BINDING SITE is a target binding site found in the 3' untranslated region of mRNA encoded by PIGS, corresponding to a target binding site such as BINDING SITE I, BINDING SITE II or BINDING SITE III of FIG. 8. Table 4 illustrates the complementarity of the nucleotide sequences of PIGS BINDING SITE, designated SEQ ID:3985, to the nucleotide sequence of GAM66 RNA, herein designated GAM RNA, also designated SEQ ID:238.

Another function of GAM66 is therefore inhibition of Phosphatidylinositol glycan, class s (PIGS, Accession NP_149975.1). Accordingly, utilities of GAM66 include diagnosis, prevention and treatment of diseases and clinical conditions associated with PIGS.

PRO1853 (Accession NP_061077.1) is another GAM66 target gene, herein designated TARGET GENE. PRO1853 BINDING SITE is a target binding site found in the 3' untranslated region of multiple transcripts of mRNA encoded by PRO1853, corresponding to a target binding site such as BINDING SITE I, BINDING SITE II or BINDING SITE III of FIG. 8. Table 4 illustrates the complementarity of the nucleotide sequences of PRO1853 BINDING SITE, designated SEQ ID:15239, to the nucleotide sequence of GAM66 RNA, herein designated GAM RNA, also designated SEQ ID:238.

Another function of GAM66 is therefore inhibition of PRO1853 (Accession NP_061077.1). Accordingly, utilities of GAM66 include diagnosis, prevention and treatment of diseases and clinical conditions associated with PRO1853.

Rad50 homolog (s. cerevisiae) (RAD50, Accession NP_005723.2) is another GAM66 target gene, herein designated TARGET GENE. RAD50 BINDING SITE is a target binding site found in the 3' untranslated region of multiple transcripts of mRNA encoded by RAD50, corresponding to a target binding site such as BINDING SITE I, BINDING SITE II or BINDING SITE III of FIG. 8. Table 4 illustrates the complementarity of the nucleotide sequences of RAD50 BINDING SITE, designated SEQ ID:11752, to the nucleotide sequence of GAM66 RNA, herein designated GAM RNA, also designated SEQ ID:238.

Another function of GAM66 is therefore inhibition of Rad50 homolog (s. cerevisiae) (RAD50, Accession NP_005723.2), a gene which is involved in dna double-strand break repair (dsbr). and therefore may be associated with Myeloid leukemia and breast cancer. Accordingly, utilities of GAM66 include diagnosis, prevention and treatment of Myeloid leukemia and breast cancer, and of other diseases and clinical conditions associated with RAD50.

The function of RAD50 and its association with various diseases and clinical conditions, has been established by previous studies, as described hereinabove with reference to GAM34.1. Rad50 homolog (s. cerevisiae) (RAD50, Accession NP_597816.1) is another GAM66 target gene, herein designated TARGET GENE. RAD50 BINDING SITE is a target binding site found in the 3' untranslated region of multiple transcripts of mRNA encoded by RAD50, corresponding to a target binding site such as BINDING SITE I, BINDING SITE II or BINDING SITE III of FIG. 8. Table 4 illustrates the complementarity of the nucleotide sequences of RAD50 BINDING SITE, designated SEQ ID:11752, to the nucleotide sequence of GAM66 RNA, herein designated GAM RNA, also designated SEQ ID:238.

Another function of GAM66 is therefore inhibition of Rad50 homolog (s. cerevisiae) (RAD50, Accession NP_597816.1), a gene which is involved in dna double-strand break repair (dsbr). and therefore may be associated with Myeloid leukemia and breast cancer. Accordingly, utilities of GAM66 include diagnosis, prevention and treatment of Myeloid leukemia and breast cancer, and of other diseases and clinical conditions associated with RAD50.

The function of RAD50 and its association with various diseases and clinical conditions, has been established by previous studies, as described hereinabove with reference to GAM34.1. Ryanodine receptor 2 (cardiac) (RYR2, Accession NP_001026.1) is another GAM66 target gene, herein designated TARGET GENE. RYR2 BINDING SITE is a target binding site found in the 3' untranslated region of mRNA encoded by RYR2, corresponding to a target binding site such as BINDING SITE I, BINDING SITE II or BINDING SITE III of FIG. 8. Table 4 illustrates the complementarity of the nucleotide sequences of RYR2 BINDING SITE, designated SEQ ID:12550, to the nucleotide sequence of GAM66 RNA, herein designated GAM RNA, also designated SEQ ID:238.

Another function of GAM66 is therefore inhibition of Ryanodine receptor 2 (cardiac) (RYR2, Accession NP_001026.1). Accordingly, utilities of GAM66 include diagnosis, prevention and treatment of diseases and clinical conditions associated with RYR2.

SETDB2 (Accession NP_114121.1) is another GAM66 target gene, herein designated TARGET GENE. SETDB2 BINDING SITE is a target binding site found in the 5' untranslated region of mRNA encoded by SETDB2, corresponding to a target binding site such as BINDING SITE I, BINDING SITE II or BINDING SITE III of FIG. 8. Table 4 illustrates the complementarity of the nucleotide sequences of SETDB2 BINDING SITE, designated SEQ ID:10049, to the nucleotide sequence of GAM66 RNA, herein designated GAM RNA, also designated SEQ ID:238.

Another function of GAM66 is therefore inhibition of SETDB2 (Accession NP_114121.1). Accordingly, utilities of GAM66 include diagnosis, prevention and treatment of diseases and clinical conditions associated with SETDB2.

Solute carrier family 19 (folate transporter), member 1 (SLC19A1, Accession NP_003047.1) is another GAM66 target gene, herein designated TARGET GENE. SLC19A1 BINDING SITE is a target binding site found in the 3' untranslated region of mRNA encoded by SLC19A1, corresponding to a target binding site such as BINDING SITE I, BINDING SITE II or BINDING SITE III of FIG. 8. Table 4 illustrates the complementarity of the nucleotide sequences of SLC19A1 BINDING SITE, designated SEQ ID:3271, to the nucleotide sequence of GAM66 RNA, herein designated GAM RNA, also designated SEQ ID:238.

Another function of GAM66 is therefore inhibition of Solute carrier family 19 (folate transporter), member 1 (SLC19A1, Accession NP_003047.1). Accordingly, utilities of GAM66 include diagnosis, prevention and treatment of diseases and clinical conditions associated with SLC19A1.

Smcy homolog, y chromosome (mouse) (SMCY, Accession NP_004644.1) is another GAM66 target gene, herein designated TARGET GENE. SMCY BINDING SITE is a target binding site found in the 5' untranslated region of mRNA encoded by SMCY, corresponding to a target binding site such as BINDING SITE I, BINDING SITE II or BINDING SITE III of FIG. 8. Table 4 illustrates the complementarity of the nucleotide sequences of SMCY BINDING SITE, designated SEQ ID:10886, to the nucleotide sequence of GAM66 RNA, herein designated GAM RNA, also designated SEQ ID:238.

Another function of GAM66 is therefore inhibition of Smcy homolog, y chromosome (mouse) (SMCY, Accession NP_004644.1), a gene which plays a role in spermatogenesis. Accordingly, utilities of GAM66 include diagnosis, prevention and treatment of diseases and clinical conditions associated with SMCY.

The function of SMCY has been established by previous studies. Burgoyne et al. (1986) suggested that the H-Y antigen gene or a gene closely linked to it plays a role in spermatogenesis. Simpson et al. (1993) found that of 9 azoospermic or severely oligospermic patients 7 could be tested for HYA expression; of these, 6 were H-Y positive. Of 3 patients showing Yq structural abnormalities, 2 could be tested for H-Y expression; 1 was negative, the other positive. These results showed no correlation between spermatogenic failure and the absence of Hy, thus separating the AZF locus (OMIM Ref. No. 415000) from HYA. Agulnik et al. (1994) described the isolation of a gene that mapped to the short arm of the mouse Y chromosome. They called the gene Smcy for 'selected mouse cDNA on Y.' It was clustered with the Ube1y (OMIM Ref. No. 489000) and the Zfy1 genes (OMIM Ref. No. 490000) in a segment of approximately 250 kb. A homologous gene, Smcx (OMIM Ref. No. 314690), was found on the X chromosome. Expression of Smcy was detected in all male tissues and expression of Smcx in all male and female tissues tested. Remarkably, the expression of both genes was detected in pools of mouse preimplantation embryos as early as the 2-cell stage. They found that Smcy, like Sry (OMIM Ref. No. 480000) and Ube1y, has been conserved on the Y chromosome since the divergence of metatherian and eutherian mammals some 120 million years ago. Agulnik et al. (1994) isolated homologous genes from the human and horse and showed that they have similar exon/intron organizations and are more than 93% similar to each other and to Smcx at the amino acid level. Using a set of overlapping YAC clones provided by David Page, Agulnik et al. (1994) determined that the human SMCY gene maps to deletion interval 5O/5P on Yq between STS markers DYS214 and DYS215. The HYA locus maps to the same interval on the human Y chromosome. In an accompanying paper, Agulnik et al. (1994) also showed that the X chromosome gene (SMCX) escapes X-inactivation in both mouse and human.

Full details of the abovementioned studies are described in the following publications, the disclosure of which are hereby incorporated by reference:

Simpson, E.; Chandler, P.; Goulmy, E.; Ma, K.; Hargreave, T. B.; Chandley, A. C.: Loss of the 'azoospermia factor' (AZF) on Yq in man is not associated with loss of HYA. Hum. Molec. Genet. 2:469-471, 1993; and Agulnik, A. I.; Mitchell, M. J.; Lerner, J. L.; Woods, D. R.; Bishop, C. E.: A mouse Y chromosome gene encoded by a region essential for spermatogenesis and expression of male-specific min.

Further studies establishing the function and utilities of SMCY are found in John Hopkins OMIM database record ID 426000, and in cited publications listed in Table 5, which are hereby incorporated by reference. Suppression of tumorigenicity 5 (ST5, Accession NP_005409.2) is another GAM66 target gene, herein designated TARGET GENE. ST5 BINDING SITE is a target binding site found in the 3' untranslated region of multiple transcripts of mRNA encoded by ST5, corresponding to a target binding site such as BINDING SITE I, BINDING SITE II or BINDING SITE III of FIG. 8. Table 4 illustrates the complementarity of the nucleotide sequences of ST5 BINDING SITE, designated SEQ ID:18268, to the nucleotide sequence of GAM66 RNA, herein designated GAM RNA, also designated SEQ ID:238.

Another function of GAM66 is therefore inhibition of Suppression of tumorigenicity 5 (ST5, Accession NP_005409.2), a gene which preferentially binds to the SH3 domain of c-Abl kinase, and acts as a regulator of MAPK1/ERK2 kinase. Accordingly, utilities of GAM66 include diagnosis, prevention and treatment of diseases and clinical conditions associated with ST5.

The function of ST5 has been established by previous studies. The tumorigenicity of HeLa cells in nude mice can be suppressed by the addition of a normal human chromosome 11 in somatic cell hybrids (Stanbridge, 1976; Klinger, 1980); see 191181 for description of a tumor-suppressor gene located on 11q. Lichy et al. (1992) isolated a HeLa cell line that displayed morphologic features of the nontumorigenic hybrids, demonstrated reduced tumorigenicity in nude mice, and showed an 85% reduction in alkaline phosphatase, a consistent marker of the tumorigenic phenotype in these cells. This cell line, designated F2, contained a single exogenous cDNA, which was recovered by polymerase chain reaction (PCR) and designated HTS1 because of its probable association with 'HeLa tumor suppression.' In nontumorigenic hybrids, RNA species of 2.8, 3.1, and 4.6 kb were identified. In 2 tumorigenic hybrid lines, the 2.8-kb species was markedly reduced or absent. Whereas 3 nontumorigenic human keratinocyte lines expressed all 3 RNA species, several tumorigenic cervical carcinoma cell lines lacked the 2.8-kb species. The HTS1 gene was localized to 11p15 by in situ hybridization, confirming the assignment to chromosome 11 by somatic cell hybrid analysis. Lichy et al. (1992) reviewed previous evidence indicating the presence of a tumor suppressor gene in the 11p15 region; see 194071 and 185440.

Full details of the abovementioned studies are described in the following publications, the disclosure of which are hereby incorporated by reference:

Lichy, J. H.; Modi, W. S.; Seuanez, H. N.; Howley, P. M.: Identification of a human chromosome 11 gene which is differentially regulated in tumorigenic and nontumorigenic somatic cell hybrids of HeLa cells. Cell Growth Differ. 3:541-548, 1992; and Stanbridge, E. J.: Suppression of malignancy in human cells. Nature 260:17-20, 1976.

Further studies establishing the function and utilities of ST5 are found in John Hopkins OMIM database record ID 140750, and in cited publications listed in Table 5, which are hereby incorporated by reference. Suppression of tumorigenicity 5 (ST5, Accession NP_631896.1) is another GAM66 target gene, herein designated TARGET GENE. ST5 BINDING SITE is a target binding site found in the 3' untranslated region of multiple transcripts of mRNA encoded by ST5, corresponding to a target binding site such as BINDING SITE I, BINDING SITE II or BINDING SITE III of FIG. 8. Table 4 illustrates the complementarity of the nucleotide sequences of ST5 BINDING SITE, designated SEQ ID:18268, to the nucleotide sequence of GAM66 RNA, herein designated GAM RNA, also designated SEQ ID:238.

Another function of GAM66 is therefore inhibition of Suppression of tumorigenicity 5 (ST5, Accession NP_631896.1), a gene which preferentially binds to the SH3 domain of c-Abl kinase, and acts as a regulator of MAPK1/ERK2 kinase. Accordingly, utilities of GAM66 include diagnosis, prevention and treatment of diseases and clinical conditions associated with ST5.

The function of ST5 has been established by previous studies. The tumorigenicity of HeLa cells in nude mice can be suppressed by the addition of a normal human chromosome 11 in somatic cell hybrids (Stanbridge, 1976; Klinger, 1980); see 191181 for description of a tumor-suppressor gene located on 11q. Lichy et al. (1992) isolated a HeLa cell line that displayed morphologic features of the nontumorigenic hybrids, demonstrated reduced tumorigenicity in nude mice, and showed an 85% reduction in alkaline phosphatase, a consistent marker of the tumorigenic phenotype in these cells. This cell line, designated F2, contained a single exogenous cDNA, which was recovered by polymerase chain reaction (PCR) and designated HTS1 because of its probable association with 'HeLa tumor suppression.' In nontumorigenic hybrids, RNA species of 2.8, 3.1, and 4.6 kb were identified. In 2 tumorigenic hybrid lines, the 2.8-kb species was markedly reduced or absent. Whereas 3 nontumorigenic human keratinocyte lines expressed all 3 RNA species, several tumorigenic cervical carcinoma cell lines lacked the 2.8-kb species. The HTS1 gene was localized to 11p15 by in situ hybridization, confirming the assignment to chromosome 11 by somatic cell hybrid analysis. Lichy et al. (1992) reviewed previous evidence indicating the presence of a tumor suppressor gene in the 11p15 region; see 194071 and 185440.

Full details of the abovementioned studies are described in the following publications, the disclosure of which are hereby incorporated by reference:

Lichy, J. H.; Modi, W. S.; Seuanez, H. N.; Howley, P. M.: Identification of a human chromosome 11 gene which is differentially regulated in tumorigenic and nontumorigenic somatic cell hybrids of HeLa cells. Cell Growth Differ. 3:541-548, 1992; and Stanbridge, E. J.: Suppression of malignancy in human cells. Nature 260:17-20, 1976.

Further studies establishing the function and utilities of ST5 are found in John Hopkins OMIM database record ID 140750, and in cited publications listed in Table 5, which are hereby incorporated by reference. Stromal antigen 2 (STAG2, Accession NP_006594.3) is another GAM66 target gene, herein designated TARGET GENE. STAG2 BINDING SITE is a target binding site found in the 3' untranslated region of mRNA encoded by STAG2, corresponding to a target binding site such as BINDING SITE I, BINDING SITE II or BINDING SITE III of FIG. 8. Table 4 illustrates the complementarity of the nucleotide sequences of STAG2 BINDING SITE, designated SEQ ID:11828, to the nucleotide sequence of GAM66 RNA, herein designated GAM RNA, also designated SEQ ID:238.

Another function of GAM66 is therefore inhibition of Stromal antigen 2 (STAG2, Accession NP_006594.3). Accordingly, utilities of GAM66 include diagnosis, prevention and treatment of diseases and clinical conditions associated with STAG2.

Striatin, calmodulin binding protein 3 (STRN3, Accession NP_055389.1) is another GAM66 target gene, herein designated TARGET GENE. STRN3 BINDING SITE is a target binding site found in the 3' untranslated region of mRNA encoded by STRN3, corresponding to a target binding site such as BINDING SITE I, BINDING SITE II or BINDING SITE III of FIG. 8. Table 4 illustrates the complementarity of the nucleotide sequences of STRN3 BINDING SITE, designated SEQ ID:14812, to the nucleotide sequence of GAM66 RNA, herein designated GAM RNA, also designated SEQ ID:238.

Another function of GAM66 is therefore inhibition of Striatin, calmodulin binding protein 3 (STRN3, Accession NP_055389.1). Accordingly, utilities of GAM66 include diagnosis, prevention and treatment of diseases and clinical conditions associated with STRN3.

Tyrosinase-related protein 1 (TYRP1, Accession NP_000541.1) is another GAM66 target gene, herein designated TARGET GENE. TYRP1 BINDING SITE is a target binding site found in the 3' untranslated region of mRNA encoded by TYRP1, corresponding to a target binding site such as BINDING SITE I, BINDING SITE II or BINDING SITE III of FIG. 8. Table 4 illustrates the complementarity of the nucleotide sequences of TYRP1 BINDING SITE, designated SEQ ID:14058, to the nucleotide sequence of GAM66 RNA, herein designated GAM RNA, also designated SEQ ID:238.

Another function of GAM66 is therefore inhibition of Tyrosinase-related protein 1 (TYRP1, Accession NP_000541.1). Accordingly, utilities of GAM66 include diagnosis, prevention and treatment of diseases and clinical conditions associated with TYRP1.

Ubiquitin associated protein 1 (UBAP1, Accession NP_057609.2) is another GAM66 target gene, herein designated TARGET GENE. UBAP1 BINDING SITE is a target binding site found in the 3' untranslated region of mRNA encoded by UBAP1, corresponding to a target binding site such as BINDING SITE I, BINDING SITE II or BINDING SITE III of FIG. 8. Table 4 illustrates the complementarity of the nucleotide sequences of UBAP1 BINDING SITE, designated SEQ ID:14677, to the nucleotide sequence of GAM66 RNA, herein designated GAM RNA, also designated SEQ ID:238.

Another function of GAM66 is therefore inhibition of Ubiquitin associated protein 1 (UBAP1, Accession NP_057609.2). Accordingly, utilities of GAM66 include diagnosis, prevention and treatment of diseases and clinical conditions associated with UBAP1.

XT3 (Accession NP_071800.1) is another GAM66 target gene, herein designated TARGET GENE. XT3 BINDING SITE is a target binding site found in the 3' untranslated region of multiple transcripts of mRNA encoded by XT3, corresponding to a target binding site such as BINDING SITE I, BINDING SITE II or BINDING SITE III of FIG. 8. Table 4 illustrates the complementarity of the nucleotide sequences of XT3 BINDING SITE, designated SEQ ID:9880, to the nucleotide sequence of GAM66 RNA, herein designated GAM RNA, also designated SEQ ID:238.

Another function of GAM66 is therefore inhibition of XT3 (Accession NP_071800.1), a gene which is a Kidney-specific orphan transporter. Accordingly, utilities of GAM66 include diagnosis, prevention and treatment of diseases and clinical conditions associated with XT3.

The function of XT3 has been established by previous studies. Na(+) and Cl(-)-coupled transporter proteins mediate transit of structurally related small hydrophilic substances across plasma membranes. These transporters are structurally related to a small subgroup of proteins with no known substrates. By screening a mouse kidney cDNA library, Nash et al. (1998) obtained cDNAs encoding 2 members of this subgroup, Xt2 and Xt3. Using mouse Xt3 to screen a human kidney cDNA library, they obtained a partial sequence encoding human XT3. Sequence analysis predicted that the mouse sequence, approximately 88% identical to human XT3 and rat B21a, contains 12 potential transmembrane domains. Northern blot analysis detected 3.2- and 4.0-kb XT3 transcripts in human kidney and small intestine, with no expression detected in other tissues. Expression was slightly higher in kidney, where an 8.5-kb transcript was also detected. Immunofluorescence microscopy demonstrated expression on the plasma membrane of transfected cells. Nash et al. (1998) tested numerous substrates but failed to identify a compound transported by Xt3. Nash et al. (1998) mapped the mouse Xt3 gene to chromosome 9, near the telomere. Scott (2001) mapped the human XT3 gene to chromosome 3 based on sequence similarity between the XT3 sequence (GenBank AF075260) and a chromosome 3 clone (GenBank AC005669).

Full details of the abovementioned studies are described in the following publications, the disclosure of which are hereby incorporated by reference:

Nash, S. R.; Giros, B.; Kingsmore, S. F.; Kim, K. M.; El-Mestikawy, S.; Dong, Q.; Fumagalli, F.; Seldin, M. F.; Caron, M. G.: Cloning, gene structure and genomic localization of an orphan transporter from mouse kidney with six alternatively-spliced isoforms. Receptors Channels 6:113-128, 1998; and Scott, A. F.: Personal Communication. Baltimore, Md., 2/5/2001.

Further studies establishing the function and utilities of XT3 are found in John Hopkins OMIM database record ID 605616, and in cited publications listed in Table 5, which are hereby incorporated by reference. XT3 (Accession NP_064593.1) is another GAM66 target gene, herein designated TARGET GENE. XT3 BINDING SITE is a target binding site found in the 3' untranslated region of multiple transcripts of mRNA encoded by XT3, corresponding to a target binding site such as BINDING SITE I, BINDING SITE II or BINDING SITE III of FIG. 8. Table 4 illustrates the complementarity of the nucleotide sequences of XT3 BINDING SITE, designated SEQ ID:9880, to the nucleotide sequence of GAM66 RNA, herein designated GAM RNA, also designated SEQ ID:238.

Another function of GAM66 is therefore inhibition of XT3 (Accession NP_064593.1), a gene which is a Kidney-specific orphan transporter. Accordingly, utilities of GAM66 include diagnosis, prevention and treatment of diseases and clinical conditions associated with XT3.

The function of XT3 has been established by previous studies. Na(+) and Cl(-)-coupled transporter proteins mediate transit of structurally related small hydrophilic substances across plasma membranes. These transporters are structurally related to a small subgroup of proteins with no known substrates. By screening a mouse kidney cDNA library, Nash et al. (1998) obtained cDNAs encoding 2 members of this subgroup, Xt2 and Xt3. Using mouse Xt3 to screen a human kidney cDNA library, they obtained a partial sequence encoding human XT3. Sequence analysis predicted that the mouse sequence, approximately 88% identical to human XT3 and rat B21a, contains 12 potential transmembrane domains. Northern blot analysis detected 3.2- and 4.0-kb XT3 transcripts in human kidney and small intestine, with no expression detected in other tissues. Expression was slightly higher in kidney, where an 8.5-kb transcript was also detected. Immunofluorescence microscopy demonstrated expression on the plasma membrane of transfected cells. Nash et al. (1998) tested numerous substrates but failed to identify a compound transported by Xt3. Nash et al. (1998) mapped the mouse Xt3 gene to chromosome 9, near the telomere. Scott (2001) mapped the human XT3 gene to chromosome 3 based on sequence similarity between the XT3 sequence (GenBank AF075260) and a chromosome 3 clone (GenBank AC005669).

Full details of the abovementioned studies are described in the following publications, the disclosure of which are hereby incorporated by reference:

Nash, S. R.; Giros, B.; Kingsmore, S. F.; Kim, K. M.; El-Mestikawy, S.; Dong, Q.; Fumagalli, F.; Seldin, M. F.; Caron, M. G.: Cloning, gene structure and genomic localization of an orphan transporter from mouse kidney with six alternatively-spliced isoforms. Receptors Channels 6:113-128, 1998; and Scott, A. F.: Personal Communication. Baltimore, Md., 2/5/2001.

Further studies establishing the function and utilities of XT3 are found in John Hopkins OMIM database record ID 605616, and in cited publications listed in Table 5, which are hereby incorporated by reference. Zinc finger protein 313 (ZNF313, Accession NP_061153.1) is another GAM66 target gene, herein designated TARGET GENE. ZNF313 BINDING SITE is a target binding site found in the 3' untranslated region of mRNA encoded by ZNF313, corresponding to a target binding site such as BINDING SITE I, BINDING SITE II or BINDING SITE III of FIG. 8. Table 4 illustrates the complementarity of the nucleotide sequences of ZNF313 BINDING SITE, designated SEQ ID:8054, to the nucleotide sequence of GAM66 RNA, herein designated GAM RNA, also designated SEQ ID:238.

Another function of GAM66 is therefore inhibition of Zinc finger protein 313 (ZNF313, Accession NP_061153.1). Accordingly, utilities of GAM66 include diagnosis, prevention and treatment of diseases and clinical conditions associated with ZNF313.

FIG. 8 further provides a conceptual description of a novel bioinformatically detected of the present invention, referred to here as Genomic Address Messenger 67 (GAM67), which modulates expression of respective target genes thereof, the function and utility of which target genes is known in the art.

GAM67 is a novel bioinformatically detected regulatory, non protein coding, micro RNA (miRNA) gene. The method by which GAM67 was detected is described hereinabove with reference to FIGS. 8-15.

GAM67 gene, herein designated GAM GENE, and GAM67 target gene, herein designated TARGET GENE, are human genes contained in the human genome.

GAM67 gene encodes a GAM67 precursor RNA, herein designated GAM PRECURSOR RNA. Similar to other miRNA genes, and unlike most ordinary genes, GAM67 precursor RNA does not encode a protein. A nucleotide sequence identical or highly similar to the nucleotide sequence of GAM67 precursor RNA is designated SEQ ID:37, and is provided hereinbelow with reference to the sequence listing part. Nucleotide sequence SEQ ID:37 is located at position 38369449 relative to chromosome 17.

GAM67 precursor RNA folds onto itself, forming GAM67 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM67 precursor RNA folds onto itself, forming GAM67 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM67 precursor RNA, designated SEQ-ID:37, and a schematic representation of a predicted secondary folding of GAM67 folded precursor RNA are further described with reference to Table 2, hereby incorporated by reference.

An enzyme complex designated DICER COMPLEX, 'dices' the GAM67 folded precursor RNA into GAM67 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM67 RNA is designated SEQ ID:282, and is provided hereinbelow with references to the sequence listing part and Table 3, hereby incorporated by reference.

GAM67 target gene, herein designated TARGET GENE, encodes a corresponding messenger RNA, GAM67 target RNA, herein designated GAM TARGET RNA. GAM67 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM67 RNA, herein designated GAM RNA, binds complementarily to one or more target binding sites located in untranslated regions of GAM67 target RNA, herein designated GAM TARGET RNA. This complementary binding is due to the fact that the nucleotide sequence of GAM67 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM67 RNA may have a different number of target binding sites in untranslated regions of a GAM67 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM67 RNA, herein designated GAM RNA, to target binding sites on GAM67 target RNA, herein designated GAM TARGET RNA, such as BINDING SITE I, BINDING SITE II and BINDING SITE III, inhibits translation of GAM67 target RNA into GAM67 target protein, herein designated GAM TARGET PROTEIN. GAM target protein is therefore outlined by a broken line.

It is appreciated that GAM67 target gene, herein designated TARGET GENE, in fact represents a plurality of GAM67 target genes. The mRNA of each one of this plurality of GAM67 target genes comprises one or more target binding sites, each having a nucleotide sequence which is at least partly complementary to GAM67 RNA, herein designated GAM RNA, and which when bound by GAM67 RNA causes inhibition of translation of respective one or more GAM67 target proteins.

It is further appreciated by one skilled in the art that the mode of translational inhibition illustrated by FIG. 8 with specific reference to translational inhibition exerted by GAM67 gene, herein designated GAM GENE, on one or more GAM67 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM67 correlate with, and may be deduced from, the identity of the target genes which GAM67 binds and inhibits, and the function of these target genes, as elaborated hereinbelow.

Amyotrophic lateral sclerosis 2 (juvenile) (ALS2, Accession NP_065970.1) is a GAM67 target gene, herein designated TARGET GENE. ALS2 BINDING SITE is a target binding site found in the 3' untranslated region of mRNA encoded by ALS2, corresponding to a target binding site such as BINDING SITE I, BINDING SITE II or BINDING SITE III of FIG. 8. Table 4 illustrates the complementarity of the nucleotide sequences of ALS2 BINDING SITE, designated SEQ ID:12702, to the nucleotide sequence of GAM67 RNA, herein designated GAM RNA, also designated SEQ ID:282.

A function of GAM67 is therefore inhibition of Amyotrophic lateral sclerosis 2 (juvenile) (ALS2, Accession NP_065970.1). Accordingly, utilities of GAM67 include diagnosis, prevention and treatment of diseases and clinical conditions associated with ALS2.

Adenomatosis polyposis coli (APC, Accession NP_000029.1) is another GAM67 target gene, herein designated TARGET GENE. APC BINDING SITE is a target binding site found in the 3' untranslated region of mRNA encoded by APC, corresponding to a target binding site such as BINDING SITE I, BINDING SITE II or BINDING SITE III of FIG. 8. Table 4 illustrates the complementarity of the nucleotide sequences of APC BINDING SITE, designated SEQ ID:10697, to the nucleotide sequence of GAM67 RNA, herein designated GAM RNA, also designated SEQ ID:282.

Another function of GAM67 is therefore inhibition of Adenomatosis polyposis coli (APC, Accession NP_000029.1). Accordingly, utilities of GAM67 include diagnosis, prevention and treatment of diseases and clinical conditions associated with APC.

Rho gtpase activating protein 8 (ARHGAP8, Accession NP_060171.2) is another GAM67 target gene, herein designated TARGET GENE. ARHGAP8 BINDING SITE is a target binding site found in the 5' untranslated region of multiple transcripts of mRNA encoded by ARHGAP8, corresponding to a target binding site such as BINDING SITE I, BINDING SITE II or BINDING SITE III of FIG. 8. Table 4 illustrates the complementarity of the nucleotide sequences of ARHGAP8 BINDING SITE, designated SEQ ID:12147, to the nucleotide sequence of GAM67 RNA, herein designated GAM RNA, also designated SEQ ID:282.

Another function of GAM67 is therefore inhibition of Rho gtpase activating protein 8 (ARHGAP8, Accession NP_060171.2). Accordingly, utilities of GAM67 include diagnosis, prevention and treatment of diseases and clinical conditions associated with ARHGAP8.

Aryl-hydrocarbon receptor nuclear translocator 2 (ARNT2, Accession NP_055677.1) is another GAM67 target gene, herein designated TARGET GENE. ARNT2 BINDING SITE is a target binding site found in the 3' untranslated region of mRNA encoded by ARNT2, corresponding to a target binding site such as BINDING SITE I, BINDING SITE II or BINDING SITE III of FIG. 8. Table 4 illustrates the complementarity of the nucleotide sequences of ARNT2 BINDING SITE, designated SEQ ID:19883, to the nucleotide sequence of GAM67 RNA, herein designated GAM RNA, also designated SEQ ID:282.

Another function of GAM67 is therefore inhibition of Aryl-hydrocarbon receptor nuclear translocator 2 (ARNT2, Accession NP_055677.1), a gene which specifically recognizes the xenobiotic response element (xre). Accordingly, utilities of GAM67 include diagnosis, prevention and treatment of diseases and clinical conditions associated with ARNT2.

The function of ARNT2 has been established by previous studies. Hirose et al. (1996) determined that Arnt2 interacts with mouse AhR and Sim as efficiently as Arnt and that the Arnt2-AhR complex recognizes and specifically binds the xenobiotic responsive element (XRE) sequence. In DNA transfection experiments, Arnt2 rescued XRE-driven reporter gene activity in Arnt mutant cells. RNA blot analysis detected restricted expression of Arnt2 in the brains and kidneys of adult mice, in contrast to the ubiquitous expression of Arnt. In situ hybridization experiments demonstrated expression of Arnt2 exclusively in the dorsal region of the spinal cord and branchial arch-1, whereas Arnt expression was broadly distributed in the ventral portion of the mesodermal and endodermal tissues.

Animal model experiments lend further support to the function of ARNT2. To assess the role of ARNT2 in development and determine functional overlap with ARNT, Keith et al. (2001) generated a targeted null mutation of the murine Arnt2 locus. Arnt2 -/- embryos died perinatally and exhibited impaired hypothalamic development, phenotypes previously observed for a targeted mutation in the murine Sim1 gene and consistent with the proposal by Michaud et al. (2000) that Arnt2 and Sim1 form an essential heterodimer in vivo. In addition, cultured Arnt2 -/-neurons displayed decreased hypoxic induction of HIF1A target genes, demonstrating formally that ARNT2/HIF1A complexes regulate oxygen-responsive genes. Finally, a strong genetic interaction between Arnt and Arnt2 mutations was observed, indicating that either gene can fulfill essential functions in a dose-dependent manner before embryonic day 8.5. These results demonstrated that Arnt and Arnt2 have both unique and overlapping essential functions in embryonic development.

It is appreciated that the abovementioned animal model for ARNT2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hirose, K.; Morita, M.; Ema, M.; Mimura, J.; Hamada, H.; Fujii, H.; Saijo, Y.; Gotoh, O.; Sogawa, K.; Fujii-Kuriyama, Y.: cDNA cloning and tissue-specific expression of a novel basic helix-loop-helix/PAS factor (Arnt2) with close sequence similarity to the aryl hydrocarbon receptor nuclear translocator (Arnt). Molec. Cell. Biol. 16:1706-1713, 1996; and Keith, B.; Adelman, D. M.; Simon, M. C.: Targeted mutation of the murine arylhydrocarbon receptor nuclear translocator 2 (Arnt2) gene reveals partial redundancy with Arnt. Proc. Nat. Ac.

Further studies establishing the function and utilities of ARNT2 are found in John Hopkins OMIM database record ID 606036, and in cited publications listed in Table 5, which are hereby incorporated by reference. BRD8 (Accession NP_006687.2) is another GAM67 target gene, herein designated TARGET GENE. BRD8 BINDING SITE is a target binding site found in the 5' untranslated region of mRNA encoded by BRD8, corresponding to a target binding site such as BINDING SITE I, BINDING SITE II or BINDING SITE III of FIG. 8. Table 4 illustrates the complementarity of the nucleotide sequences of BRD8 BINDING SITE, designated SEQ ID:5029, to the nucleotide sequence of GAM67 RNA, herein designated GAM RNA, also designated SEQ ID:282.

Another function of GAM67 is therefore inhibition of BRD8 (Accession NP_006687.2). Accordingly, utilities of GAM67 include diagnosis, prevention and treatment of diseases and clinical conditions associated with BRD8.

C14orf137 (Accession NP_075601.1) is another GAM67 target gene, herein designated TARGET GENE. C14orf137 BINDING SITE is a target binding site found in the 3' untranslated region of mRNA encoded by C14orf137, corresponding to a target binding site such as BINDING SITE I, BINDING SITE II or BINDING SITE III of FIG. 8. Table 4 illustrates the complementarity of the nucleotide sequences of C14orf137 BINDING SITE, designated SEQ ID:9342, to the nucleotide sequence of GAM67 RNA, herein designated GAM RNA, also designated SEQ ID:282.

Another function of GAM67 is therefore inhibition of C14orf137 (Accession NP_075601.1). Accordingly, utilities of GAM67 include diagnosis, prevention and treatment of diseases and clinical conditions associated with C14orf137.

Chromosome 20 open reading frame 108 (C20orf108, Accession NP_543011.1) is another GAM67 target gene, herein designated TARGET GENE. C20orf108 BINDING SITE is a target binding site found in the 3' untranslated region of mRNA encoded by C20orf108, corresponding to a target binding site such as BINDING SITE I, BINDING SITE II or BINDING SITE III of FIG. 8. Table 4 illustrates the complementarity of the nucleotide sequences of C20orf108 BINDING SITE, designated SEQ ID:4739, to the nucleotide sequence of GAM67 RNA, herein designated GAM RNA, also designated SEQ ID:282.

Another function of GAM67 is therefore inhibition of Chromosome 20 open reading frame 108 (C20orf108, Accession NP_543011.1). Accordingly, utilities of GAM67 include diagnosis, prevention and treatment of diseases and clinical conditions associated with C20orf108.

Cell division cycle 25a (CDC25A, Accession NP_001780.1) is another GAM67 target gene, herein designated TARGET GENE. CDC25A BINDING SITE is a target binding site found in the 5' untranslated region of mRNA encoded by CDC25A, corresponding to a target binding site such as BINDING SITE I, BINDING SITE II or BINDING SITE III of FIG. 8. Table 4 illustrates the complementarity of the nucleotide sequences of CDC25A BINDING SITE, designated SEQ ID:19913, to the nucleotide sequence of GAM67 RNA, herein designated GAM RNA, also designated SEQ ID:282.

Another function of GAM67 is therefore inhibition of Cell division cycle 25a (CDC25A, Accession NP_001780.1), a gene which is a tyrosine protein phosphatase required for progression of the cell cycle. and therefore may be associated with Oncogenesis. Accordingly, utilities of GAM67 include diagnosis, prevention and treatment of Oncogenesis, and of other diseases and clinical conditions associated with CDC25A.

The function of CDC25A has been established by previous studies. When exposed to ionizing radiation, eukaryotic cells activate checkpoint pathways to delay the progression of the cell cycle. Defects in the ionizing radiation-induced S-phase checkpoint cause 'radioresistant DNA synthesis,' a phenomenon that has been identified in cancer-prone patients suffering from ataxia-telangiectasia. The CDC25A phosphatase activates CDK2, needed for DNA synthesis, but becomes degraded in response to DNA damage or stalled replication. Falck et al. (2001) reported a functional link between ATM (OMIM Ref. No. 208900), checkpoint signaling kinase CHK2 (OMIM Ref. No. 604373), and CDC25A, and implicated this mechanism in controlling the S-phase checkpoint. Falck et al. (2001) showed that ionizing radiation-induced destruction of CDC25A requires both ATM and the CHK2-mediated phosphorylation of CDC25A on serine-123. An ionizing radiation-induced loss of CDC25A protein prevents dephosphorylation of CDK2 and leads to a transient blockade of DNA replication. Falck et al. (2001) also showed that tumor-associated CHK2 alleles cannot bind or phosphorylate CDC25A, and that cells expressing these CHK2 alleles, elevated CDC25A, or a CDK2 mutant unable to undergo inhibitory phosphorylation (OMIM Ref. No. CDK2AF) fail to inhibit DNA synthesis when irradiated. Falck et al. (2001) concluded that their results support CHK2 as a candidate tumor suppressor, and identify the ATM-CHK2-CDC25A-CDK2 pathway as a genomic integrity checkpoint that prevents radioresistant DNA synthesis. Falck et al. (2002) demonstrated that experimental blockade of either the NBS1 (OMIM Ref. No. 602667)-MRE11 (OMIM Ref. No. 600814) function or the CHK2-triggered events leads to a partial radioresistant DNA synthesis phenotype in human cells. In contrast, concomitant interference with NBS1-MRE11 and the CHK2-CDC25A-CDK2 pathways entirely abolishes inhibition of DNA synthesis induced by ionizing radiation, resulting in complete radioresistant DNA synthesis analogous to that caused by defective ATM. In addition, CDK2-dependent loading of CDC45 (OMIM Ref. No. 603465) onto replication origins, a prerequisite for recruitment of DNA polymerase, was prevented upon irradiation of normal or NBS1/MRE11-defective cells but not cells with defective ATM. Falck et al. (2002) concluded that in response to ionizing radiation, phosphorylation of NBS1 and CHK2 by ATM triggers 2 parallel branches of the DNA damage-dependent S-phase checkpoint that cooperate by inhibiting distinct steps of DNA replication. To protect genome integrity and ensure survival, eukaryotic cells exposed to genotoxic stress cease proliferating to provide time for DNA repair. Mailand et al. (2000) demonstrated that human cells respond to ultraviolet light or ionizing radiation by rapid, ubiquitin- and proteosome-dependent protein degradation of CDC25A, a phosphatase that is required for progression from G1 to S phase of the cell cycle. This response involved activated CHK1 protein kinase (OMIM Ref. No. 603078) but not the p53 (OMIM Ref. No. 191170) pathway, and the persisting inhibitory tyrosine phosphorylation of CDK2 (OMIM Ref. No. 116953) blocked entry into S phase and DNA replication. CDC25A- dependent cell cycle arrest occurs 1 to 2 hours after ultraviolet radiation, whereas the p53-p21 axis affects the cell cycle only several hours after ultraviolet treatment. Mailand et al. (2000) thus concluded that the checkpoint response to DNA damage occurs in 2 waves. Overexpression of CDC25A bypassed the mechanism of cell cycle arrest, leading to enhanced DNA damage and decreased cell survival. Mailand et al. (2000) concluded that the results identified specific degradation of CDC25A as part of the DNA damage checkpoint mechanism and suggested how CDC25A overexpression in human cancers might contribute to tumorigenesis.

Full details of the abovementioned studies are described in the following publications, the disclosure of which are hereby incorporated by reference:

Mailand, N.; Falck, J.; Lukas, C.; Syljuasen, R. G.; Welcker, M.; Bartek, J.; Lukas, J.: Rapid destruction of human Cdc25A in response to DNA damage. Science 288:1425-1429, 2000; and Falck, J.; Mailand, N.; Syljuasen, R. G.; Bartek, J.; Lukas, J.: The ATM-Chk2-Cdc25A checkpoint pathway guards against radioresistant DNA synthesis. Nature 410:842-847, 2001.

Further studies establishing the function and utilities of CDC25A are found in John Hopkins OMIM database record ID 116947, and in cited publications listed in Table 5, which are hereby incorporated by reference. Cadherin 12, type 2 (n-cadherin 2) (CDH12, Accession NP_004052.2) is another GAM67 target gene, herein designated TARGET GENE. CDH12 BINDING SITE is a target binding site found in the 5' untranslated region of mRNA encoded by CDH12, corresponding to a target binding site such as BINDING SITE I, BINDING SITE II or BINDING SITE III of FIG. 8. Table 4 illustrates the complementarity of the nucleotide sequences of CDH12 BINDING SITE, designated SEQ ID:4140, to the nucleotide sequence of GAM67 RNA, herein designated GAM RNA, also designated SEQ ID:282.

Another function of GAM67 is therefore inhibition of Cadherin 12, type 2 (n-cadherin 2) (CDH12, Accession NP_004052.2) . Accordingly, utilities of GAM67 include diagnosis, prevention and treatment of diseases and clinical conditions associated with CDH12.

COE2 (Accession XP_034639.1) is another GAM67 target gene, herein designated TARGET GENE. COE2 BINDING SITE is a target binding site found in the 3' untranslated region of mRNA encoded by COE2, corresponding to a target binding site such as BINDING SITE I, BINDING SITE II or BINDING SITE III of FIG. 8. Table 4 illustrates the complementarity of the nucleotide sequences of COE2 BINDING SITE, designated SEQ ID:5083, to the nucleotide sequence of GAM67 RNA, herein designated GAM RNA, also designated SEQ ID:282.

Another function of GAM67 is therefore inhibition of COE2 (Accession XP_034639.1). Accordingly, utilities of GAM67 include diagnosis, prevention and treatment of diseases and clinical conditions associated with COE2.

Collagen, type iv, alpha 2 (COL4A2, Accession NP_001837.1) is another GAM67 target gene, herein designated TARGET GENE. COL4A2 BINDING SITE is a target binding site found in the 3' untranslated region of mRNA encoded by COL4A2, corresponding to a target binding site such as BINDING SITE I, BINDING SITE II or BINDING SITE III of FIG. 8. Table 4 illustrates the complementarity of the nucleotide sequences of COL4A2 BINDING SITE, designated SEQ ID:1689, to the nucleotide sequence of GAM67 RNA, herein designated GAM RNA, also designated SEQ ID:282.

Another function of GAM67 is therefore inhibition of Collagen, type iv, alpha 2 (COL4A2, Accession NP_001837.1), a gene which is a member of a subfamily of collagen extracellular matrix proteins. and therefore may be associated with Alport disease,goodpasture antigen. Accordingly, utilities of GAM67 include diagnosis, prevention and treatment of Alport disease,goodpasture antigen, and of other diseases and clinical conditions associated with COL4A2.

The function of COL4A2 has been established by previous studies. See COL4A1 (OMIM Ref. No. 120130). Type IV collagen is associated with laminin, entactin, and heparan sulfate proteoglycans to form the sheetlike basement membranes that separate epithelium from connective tissue. The dispersion of the other collagen genes helps to avoid unequal crossing-over. Because the alpha-1 and alpha-2 chains of type IV collagen are highly divergent, close proximity on chromosome 13 carries less hazard of a disruptive event than might otherwise be the case. On the other hand, their coordinate regulation may be enhanced by the close situation. Brazel et al. (1988) determined sequences of cDNA and protein of the N-terminal 60% of the COL4A2 chain. Aligning the 2-alpha chains of type IV collagen from the N-terminus, they concluded that the alpha-2 chain has 43 more amino acids than the alpha-1 chain. Twenty-one of these additional residues form a disulfide-bridged loop within the triple helix, which is unique among all known collagens. The Goodpasture antigen appears to be part of the type IV collagen molecule. Abnormalities in or absence of the Goodpasture antigen has been claimed in Alport disease The 2 subunit genes COL4A1

(OMIM Ref. No. 120130) and COL4A2 are transcribed divergently from a common promoter. They both contain activating elements which are indispensable for efficient transcription. Moreover, Haniel et al. (1995) demonstrated a novel silencer element within the human COL4A2 gene and localized it by deletion mapping to a 24-bp region within the third intron of the gene. The element is able to inhibit the promoters of both COL4A genes, as well as the unrelated herpes simplex virus thymidine kinase promoter, largely independent of its position and orientation relative to the transcription start site of the promoter. The silencer element is specifically recognized by a nuclear protein called SILBF. Mutation studies and deletion analysis by Haniel et al. (1995) demonstrated that binding of SILBF is not only necessary but also sufficient for the silencing function Full details of the abovementioned studies are described in the following publications, the disclosure of which are hereby incorporated by reference:

Brazel, D.; Pollner, R.; Oberbaumer, I.; Kuhn, K.: Human basement membrane collagen (type IV): the amino acid sequence of the alpha-2(IV) chain and its comparison with the alpha-1(IV) chain reveals deletions in the alpha-1(IV) chain. Europ. J. Biochem. 172:35-42, 1988; and Haniel, A.; Welge-Lussen, U.; Kuhn, K.; Poschl, E.: Identification and characterization of a novel transcriptional silencer in the human collagen type IV gene COL4A2. J. Biol. Chem. 270.

Further studies establishing the function and utilities of COL4A2 are found in John Hopkins OMIM database record ID 120090, and in cited publications listed in Table 5, which are hereby incorporated by reference. Cartilage acidic protein 1 (CRTAC1, Accession NP_060528.1) is another GAM67 target gene, herein designated TARGET GENE. CRTAC1 BINDING SITE is a target binding site found in the 5' untranslated region of mRNA encoded by CRTAC1, corresponding to a target binding site such as BINDING SITE I, BINDING SITE II or BINDING SITE III of FIG. 8. Table 4 illustrates the complementarity of the nucleotide sequences of CRTAC1 BINDING SITE, designated SEQ ID:15719, to the nucleotide sequence of GAM67 RNA, herein designated GAM RNA, also designated SEQ ID:282.

Another function of GAM67 is therefore inhibition of Cartilage acidic protein 1 (CRTAC1, Accession NP_060528.1). Accordingly, utilities of GAM67 include diagnosis, prevention and treatment of diseases and clinical conditions associated with CRTAC1.

Cullin 3 (CUL3, Accession NP_003581.1) is another GAM67 target gene, herein designated TARGET GENE. CUL3 BINDING SITE is a target binding site found in the 3' untranslated region of mRNA encoded by CUL3, corresponding to a target binding site such as BINDING SITE I, BINDING SITE II or BINDING SITE III of FIG. 8. Table 4 illustrates the complementarity of the nucleotide sequences of CUL3 BINDING SITE, designated SEQ ID:15180, to the nucleotide sequence of GAM67 RNA, herein designated GAM RNA, also designated SEQ ID:282.

Another function of GAM67 is therefore inhibition of Cullin 3 (CUL3, Accession NP_003581.1), a gene which may target other proteins for ubiquitin-dependent proteolysis. Accordingly, utilities of GAM67 include diagnosis, prevention and treatment of diseases and clinical conditions associated with CUL3.

The function of CUL3 and its association with various diseases and clinical conditions, has been established by previous studies, as described hereinabove with reference to GAM32.1. Cytochrome p450, subfamily ivf, polypeptide 3 (leukotriene b4 omega hydroxylase) (CYP4F3, Accession NP_000887.1) is another GAM67 target gene, herein designated TARGET GENE. CYP4F3 BINDING SITE is a target binding site found in the 3' untranslated region of mRNA encoded by CYP4F3, corresponding to a target binding site such as BINDING SITE I, BINDING SITE II or BINDING SITE III of FIG. 8. Table 4 illustrates the complementarity of the nucleotide sequences of CYP4F3 BINDING SITE, designated SEQ ID:5739, to the nucleotide sequence of GAM67 RNA, herein designated GAM RNA, also designated SEQ ID:282.

Another function of GAM67 is therefore inhibition of Cytochrome p450, subfamily ivf, polypeptide 3 (leukotriene b4 omega hydroxylase) (CYP4F3, Accession NP_000887.1), a gene which converts leukotriene B4 into the less active 20-hydroxy-leukotriene B4. Accordingly, utilities of GAM67 include diagnosis, prevention and treatment of diseases and clinical conditions associated with CYP4F3.

The function of CYP4F3 has been established by previous studies. Leukotrienes are a group of bioactive compounds that play important roles in such processes as inflammation. Kikuta et al. (1993) isolated a cDNA for the human leukotriene B4 omega-hydroxylase (LTB4H), an enzyme which catalyzes the omega-hydroxylation of leukotriene B4. Their cDNA encoded a 520-amino acid protein with a predicted molecular weight of 59,805 Da. The deduced amino acid sequence contains a cysteine in the conserved heme-binding domain near the C-terminus, which is a characteristic feature of the cytochrome P450 superfamily; the protein shares 31 to 44% similarity with CYP4A, CYP4B (OMIM Ref. No. 124075), and CYP4C. Kikuta et al. (1993) detected transcript from the LTB4H gene in polymorphonuclear leukocytes and leukocytes.

Full details of the abovementioned studies are described in the following publications, the disclosure of which are hereby incorporated by reference:

Kikuta, Y.; Kato, M.; Yamashita, Y.; Miyauchi, Y.; Tanaka, K.; Kamada, N.; Kusunose, M.: Human leukotriene B4 omega-hydroxylase (CYP4F3) gene: molecular cloning and chromosomal localization. DNA Cell Biol. 17:221-230, 1998; and Kikuta, Y.; Kusunose, E.; Endo, K.; Yamamoto, S.; Sogawa, K.; Fujii-Kuriyama, Y.; Kusunose, M.: A novel form of cytochrome P-450 family 4 in human polymorphonuclear leukocytes: cDNA cl.

Further studies establishing the function and utilities of CYP4F3 are found in John Hopkins OMIM database record ID 601270, and in cited publications listed in Table 5, which are hereby incorporated by reference. E2f transcription factor 3 (E2F3, Accession NP_001940.1) is another GAM67 target gene, herein designated TARGET GENE. E2F3 BINDING SITE is a target binding site found in the 3' untranslated region of mRNA encoded by E2F3, corresponding to a target binding site such as BINDING SITE I, BINDING SITE II or BINDING SITE III of FIG. 8. Table 4 illustrates the complementarity of the nucleotide sequences of E2F3 BINDING SITE, designated SEQ ID:15738, to the nucleotide sequence of GAM67 RNA, herein designated GAM RNA, also designated SEQ ID:282.

Another function of GAM67 is therefore inhibition of E2f transcription factor 3 (E2F3, Accession NP_001940.1), a gene which binds dna and controls cell-cycle progression from g1 to s phase. and therefore may be associated with Hereditary autosomal dominant myoclonus dystonia. Accordingly, utilities of GAM67 include diagnosis, prevention and treatment of Hereditary autosomal dominant myoclonus dystonia, and of other diseases and clinical conditions associated with E2F3.

The function of E2F3 and its association with various diseases and clinical conditions, has been established by previous studies, as described hereinabove with reference to GAM44.1. FLJ22031 (Accession NP_079350.1) is another GAM67 target gene, herein designated TARGET GENE. FLJ22031 BINDING SITE is a target binding site found in the 3' untranslated region of mRNA encoded by FLJ22031, corresponding to a target binding site such as BINDING SITE I, BINDING SITE II or BINDING SITE III of FIG. 8. Table 4 illustrates the complementarity of the nucleotide sequences of FLJ22031 BINDING SITE, designated SEQ ID:19766, to the nucleotide sequence of GAM67 RNA, herein designated GAM RNA, also designated SEQ ID:282.

Another function of GAM67 is therefore inhibition of FLJ22031 (Accession NP_079350.1). Accordingly, utilities of GAM67 include diagnosis, prevention and treatment of diseases and clinical conditions associated with FLJ22031.

FLJ23168 (Accession NP_079331.2) is another GAM67 target gene, herein designated TARGET GENE. FLJ23168 BINDING SITE is a target binding site found in the 3' untranslated region of mRNA encoded by FLJ23168, corresponding to a target binding site such as BINDING SITE I, BINDING SITE II or BINDING SITE III of FIG. 8. Table 4 illustrates the complementarity of the nucleotide sequences of FLJ23168 BINDING SITE, designated SEQ ID:16056, to the nucleotide sequence of GAM67 RNA, herein designated GAM RNA, also designated SEQ ID:282.

Another function of GAM67 is therefore inhibition of FLJ23168 (Accession NP_079331.2). Accordingly, utilities of GAM67 include diagnosis, prevention and treatment of diseases and clinical conditions associated with FLJ23168.

FLJ32065 (Accession NP_694577.1) is another GAM67 target gene, herein designated TARGET GENE. FLJ32065 BINDING SITE is a target binding site found in the 3' untranslated region of mRNA encoded by FLJ32065, corresponding to a target binding site such as BINDING SITE I, BINDING SITE II or BINDING SITE III of FIG. 8. Table 4 illustrates the complementarity of the nucleotide sequences of FLJ32065 BINDING SITE, designated SEQ ID:5508, to the nucleotide sequence of GAM67 RNA, herein designated GAM RNA, also designated SEQ ID:282.

Another function of GAM67 is therefore inhibition of FLJ32065 (Accession NP_694577.1). Accordingly, utilities of GAM67 include diagnosis, prevention and treatment of diseases and clinical conditions associated with FLJ32065.

FLJ34766 (Accession NP_848597.1) is another GAM67 target gene, herein designated TARGET GENE. FLJ34766 BINDING SITE is a target binding site found in the 3' untranslated region of mRNA encoded by FLJ34766, corresponding to a target binding site such as BINDING SITE I, BINDING SITE II or BINDING SITE III of FIG. 8. Table 4 illustrates the complementarity of the nucleotide sequences of FLJ34766 BINDING SITE, designated SEQ ID:6306, to the nucleotide sequence of GAM67 RNA, herein designated GAM RNA, also designated SEQ ID:282.

Another function of GAM67 is therefore inhibition of FLJ34766 (Accession NP_848597.1). Accordingly, utilities of GAM67 include diagnosis, prevention and treatment of diseases and clinical conditions associated with FLJ34766.

FLJ40201 (Accession NP_689820.1) is another GAM67 target gene, herein designated TARGET GENE. FLJ40201 BINDING SITE is a target binding site found in the 3' untranslated region of mRNA encoded by FLJ40201, corresponding to a target binding site such as BINDING SITE I, BINDING SITE II or BINDING SITE III of FIG. 8. Table 4 illustrates the complementarity of the nucleotide sequences of FLJ40201 BINDING SITE, designated SEQ ID:9705, to the nucleotide sequence of GAM67 RNA, herein designated GAM RNA, also designated SEQ ID:282.

Another function of GAM67 is therefore inhibition of FLJ40201 (Accession NP_689820.1). Accordingly, utilities of GAM67 include diagnosis, prevention and treatment of diseases and clinical conditions associated with FLJ40201.

Frizzled homolog 4 (drosophila) (FZD4, Accession NP_036325.2) is another GAM67 target gene, herein designated TARGET GENE. FZD4 BINDING SITE is a target binding site found in the 3' untranslated region of mRNA encoded by FZD4, corresponding to a target binding site such as BINDING SITE I, BINDING SITE II or BINDING SITE III of FIG. 8. Table 4 illustrates the complementarity of the nucleotide sequences of FZD4 BINDING SITE, designated SEQ ID:2889, to the nucleotide sequence of GAM67 RNA, herein designated GAM RNA, also designated SEQ ID:282.

Another function of GAM67 is therefore inhibition of Frizzled homolog 4 (drosophila) (FZD4, Accession NP_036325.2), a gene which may function in cell polarity, cell fate specification and cancer; similar to frizzled receptor family, has seven transmembrane domains and therefore may be associated with Familial exudative vitreoretinopathy. Accordingly, utilities of GAM67 include diagnosis, prevention and treatment of Familial exudative vitreoretinopathy, and of other diseases and clinical conditions associated with FZD4.

The function of FZD4 has been established by previous studies. Members of the 'frizzled' (FZ) gene family (see OMIM Ref. No. 601766) encode 7-transmembrane domain proteins that are receptors for Wnt (see OMIM Ref. No. 164975) signaling proteins. By screening a human fetal lung cDNA library with an FZD4 cDNA fragment isolated from a human gastric cancer cDNA pool, Kirikoshi et al. (1999) obtained a full-length cDNA of FZD4. FZD4 encodes a deduced 537-amino acid protein that has a cysteine-rich domain in the N-terminal extracellular region, 2 cysteine residues in the second and third extracellular loops, 2 N-linked glycosylation extracellular sites, and the S/T-X-V motif in the C terminus. Amino acid sequence identity with other FZD proteins ranged from 39 to 52% in the N terminus to 42 to 69% in the transmembrane domains. Northern blot analysis revealed expression of a 7.7-kb transcript in large amounts in adult heart, skeletal muscle, ovary, and fetal kidney, in moderate amounts in adult liver, kidney, pancreas, spleen, and fetal lung, and in small amounts in placenta, adult lung, prostate, testis, colon, fetal brain, and liver. Expression was also strong in HeLa cells but not in several cancer cell lines. Familial exudative vitreoretinopathy (FEVR) is a hereditary ocular disorder characterized by a failure of peripheral retinal vascularization. Loci associated with FEVR map to 11q13-q23 (EVR1; 133780), Xp11.4 (EVR2; 305390), and 11p13-p12 (EVR3; 605750). In a large Canadian family of British descent, Robitaille et al. (2002) demonstrated linkage to 11q13-q23 for autosomal dominant FEVR and refined the disease locus to a genomic region spanning 1.55 Mb. The region contained the FZD4 gene, which they subjected to mutation search and identified in affected individuals a deletion of 6 nucleotides, 1479-1484, resulting in deletion of 2 highly conserved amino acids, met493 and trp494. In a second small family they found a deletion of 2 nucleotides, 1501-1502, that resulted in a frameshift at leu501, creating a stop codon at residue 533. Both mutations were located in exon 2 and altered the seventh transmembrane domain and the intracellular carboxy-terminal tail, respectively. No mutations in FZD4 were detected in 3 other small families with FEVR. Robitaille et al. (2002)

presented data indicating that the changes in FZD4 in these families with autosomal dominant FEVR represented loss of function mutations.

Full details of the abovementioned studies are described in the following publications, the disclosure of which are hereby incorporated by reference:

Kirikoshi, H.; Sagara, N.; Koike, J.; Tanaka, K.; Sekihara, H.; Hirai, M.; Katoh, M.: Molecular cloning and characterization of human frizzled-4 on chromosome 11q14-q21. Biochem. Biophys. Res. Commun. 264:955-961, 1999; and Robitaille, J.; MacDonald, M. L. E.; Kaykas, A.; Sheldahl, L. C.; Zeisler, J.; Dube, M.-P.; Zhang, L.-H.; Singaraja, R. R.; Guernsey, D. L.; Zhang, B.; Siebert, L. F.; Hoskin-Mott, A.

Further studies establishing the function and utilities of FZD4 are found in John Hopkins OMIM database record ID 604579, and in cited publications listed in Table 5, which are hereby incorporated by reference. Hydroxyacyl-coenzyme a dehydrogenase/3-ketoacyl-coenzyme a thiolase/enoyl-coenzyme a hydratase (trifunctional protein), alpha subunit (HADHA, Accession NP_000173.2) is another GAM67 target gene, herein designated TARGET GENE. HADHA BINDING SITE is a target binding site found in the 3' untranslated region of mRNA encoded by HADHA, corresponding to a target binding site such as BINDING SITE I, BINDING SITE II or BINDING SITE III of FIG. 8. Table 4 illustrates the complementarity of the nucleotide sequences of HADHA BINDING SITE, designated SEQ ID:6337, to the nucleotide sequence of GAM67 RNA, herein designated GAM RNA, also designated SEQ ID:282.

Another function of GAM67 is therefore inhibition of Hydroxyacyl-coenzyme a dehydrogenase/3-ketoacyl-coenzyme a thiolase/enoyl-coenzyme a hydratase (trifunctional protein), alpha subunit (HADHA, Accession NP_000173.2). Accordingly, utilities of GAM67 include diagnosis, prevention and treatment of diseases and clinical conditions associated with HADHA.

Potassium voltage-gated channel, delayed-rectifier, subfamily s, member 2 (KCNS2, Accession XP_043106.1) is another GAM67 target gene, herein designated TARGET GENE. KCNS2 BINDING SITE is a target binding site found in the 3' untranslated region of mRNA encoded by KCNS2, corresponding to a target binding site such as BINDING SITE I, BINDING SITE II or BINDING SITE III of FIG. 8. Table 4 illustrates the complementarity of the nucleotide sequences of KCNS2 BINDING SITE, designated SEQ ID:16743, to the nucleotide sequence of GAM67 RNA, herein designated GAM RNA, also designated SEQ ID:282.

Another function of GAM67 is therefore inhibition of Potassium voltage-gated channel, delayed-rectifier, subfamily s, member 2 (KCNS2, Accession XP_043106.1), a gene which mediates the voltage-dependent potassium ion permeability of excitable membranes. Accordingly, utilities of GAM67 include diagnosis, prevention and treatment of diseases and clinical conditions associated with KCNS2.

The function of KCNS2 has been established by previous studies. See KCNS1 (OMIM Ref. No. 602905). By searching an expressed sequence tag (EST) database with the peptide sequence of the silent Kv8.1 alpha subunit, Salinas et al. (1997) identified human cDNAs encoding KCNS2, which they called Kv9.2. Using these ESTs, the authors isolated a mouse Kcns2 cDNA from a brain cDNA library. The predicted 477-amino acid Kcns2 protein has all of the structural characteristics of an outward rectifier Kv alpha subunit, namely 6 transmembrane domains, a transmembrane region with 5 positively charged amino acids, and a conserved pore-forming region. Several putative phosphorylation sites are located in the cytoplasmic regions. Northern blot analysis showed that Kcns2 is expressed only in the brain. In situ hybridization detected high levels of Kcns2 mRNA in the olfactory bulb, cerebral cortex, hippocampal formation, habenula, basolateral amygdaloid nuclei, and cerebellum; expression was also found in the retina and spinal cord. Salinas et al. (1997) demonstrated that Kcns2 does not have potassium channel activity by itself but can modulate the activities of the Kv2.1 (see OMIM Ref. No. KCNB1; 600397) and Kv2.2 alpha subunits. By fluorescence in situ hybridization and radiation hybrid mapping, Banfi et al. (1996) mapped an EST (GenBank R19352) corresponding to the human KCNS2 gene (Salinas et al., 1997) to 8q22.

Full details of the abovementioned studies are described in the following publications, the disclosure of which are hereby incorporated by reference:

Banfi, S.; Borsani, G.; Rossi, E.; Bernard, L.; Guffanti, A.; Rubboli, F.; Marchitiello, A.; Giglio, S.; Coluccia, E.; Zollo, M.; Zuffardi, O.; Ballabio, A.: Identification and mapping of human cDNAs homologous to Drosophila mutant genes through EST database searching. Nature Genet. 13:167-174, 1996; and Salinas, M.; Duprat, F.; Heurteaux, C.; Hugnot, J.-P.; Lazdunski, M.: New modulatory alpha subunits for mammalian Shab K(+) channels. J. Biol. Chem. 272:24371-24379, 1997.

Further studies establishing the function and utilities of KCNS2 are found in John Hopkins OMIM database record ID 602906, and in cited publications listed in Table 5, which are hereby incorporated by reference. KIAA0182 (Accession XP_050495.4) is another GAM67 target gene, herein designated TARGET GENE. KIAA0182 BINDING SITE is a target binding site found in the 3' untranslated region of mRNA encoded by KIAA0182, corresponding to a target binding site such as BINDING SITE I, BINDING SITE II or BINDING SITE III of FIG. 8. Table 4 illustrates the complementarity of the nucleotide sequences of KIAA0182 BINDING SITE, designated SEQ ID:16445, to the nucleotide sequence of GAM67 RNA, herein designated GAM RNA, also designated SEQ ID:282.

Another function of GAM67 is therefore inhibition of KIAA0182 (Accession XP_050495.4). Accordingly, utilities of GAM67 include diagnosis, prevention and treatment of diseases and clinical conditions associated with KIAA0182.

KIAA0298 (Accession XP_084529.6) is another GAM67 target gene, herein designated TARGET GENE. KIAA0298 BINDING SITE is a target binding site found in the 3' untranslated region of mRNA encoded by KIAA0298, corresponding to a target binding site such as BINDING SITE I, BINDING SITE II or BINDING SITE III of FIG. 8. Table 4 illustrates the complementarity of the nucleotide sequences of KIAA0298 BINDING SITE, designated SEQ ID:2259, to the nucleotide sequence of GAM67 RNA, herein designated GAM RNA, also designated SEQ ID:282.

Another function of GAM67 is therefore inhibition of KIAA0298 (Accession XP_084529.6). Accordingly, utilities of GAM67 include diagnosis, prevention and treatment of diseases and clinical conditions associated with KIAA0298.

KIAA0368 (Accession XP_036708.6) is another GAM67 target gene, herein designated TARGET GENE. KIAA0368 BINDING SITE is a target binding site found in the 3' untranslated region of mRNA encoded by KIAA0368, corresponding to a target binding site such as BINDING SITE I, BINDING SITE II or BINDING SITE III of FIG. 8. Table 4 illustrates the complementarity of the nucleotide sequences of KIAA0368 BINDING SITE, designated SEQ ID:19247, to the nucleotide sequence of GAM67 RNA, herein designated GAM RNA, also designated SEQ ID:282.

Another function of GAM67 is therefore inhibition of KIAA0368 (Accession XP_036708.6). Accordingly, utilities of GAM67 include diagnosis, prevention and treatment of diseases and clinical conditions associated with KIAA0368.

KIAA0514 (Accession NP_055511.1) is another GAM67 target gene, herein designated TARGET GENE. KIAA0514 BINDING SITE is a target binding site found in the 3' untranslated region of mRNA encoded by KIAA0514, corresponding to a target binding site such as BINDING SITE I, BINDING SITE II or BINDING SITE III of FIG. 8. Table 4 illustrates the complementarity of the nucleotide sequences of KIAA0514 BINDING SITE, designated SEQ ID:16457, to the nucleotide sequence of GAM67 RNA, herein designated GAM RNA, also designated SEQ ID:282.

Another function of GAM67 is therefore inhibition of KIAA0514 (Accession NP_055511.1). Accordingly, utilities of GAM67 include diagnosis, prevention and treatment of diseases and clinical conditions associated with KIAA0514.

KIAA0774 (Accession XP_166270.1) is another GAM67 target gene, herein designated TARGET GENE. KIAA0774 BINDING SITE is a target binding site found in the 3' untranslated region of mRNA encoded by KIAA0774, corresponding to a target binding site such as BINDING SITE I, BINDING SITE II or BINDING SITE III of FIG. 8. Table 4 illustrates the complementarity of the nucleotide sequences of KIAA0774 BINDING SITE, designated SEQ ID:19740, to the nucleotide sequence of GAM67 RNA, herein designated GAM RNA, also designated SEQ ID:282.

Another function of GAM67 is therefore inhibition of KIAA0774 (Accession XP_166270.1). Accordingly, utilities of GAM67 include diagnosis, prevention and treatment of diseases and clinical conditions associated with KIAA0774.

KIAA1359 (Accession XP_116034.2) is another GAM67 target gene, herein designated TARGET GENE. KIAA1359 BINDING SITE is a target binding site found in the 3' untranslated region of mRNA encoded by KIAA1359, corresponding to a target binding site such as BINDING SITE I, BINDING SITE II or BINDING SITE III of FIG. 8. Table 4 illustrates the complementarity of the nucleotide sequences of KIAA1359 BINDING SITE, designated SEQ ID:2094, to the nucleotide sequence of GAM67 RNA, herein designated GAM RNA, also designated SEQ ID:282.

Another function of GAM67 is therefore inhibition of KIAA1359 (Accession XP_116034.2). Accordingly, utilities of GAM67 include diagnosis, prevention and treatment of diseases and clinical conditions associated with KIAA1359.

KIAA1443 (Accession NP_065885.1) is another GAM67 target gene, herein designated TARGET GENE. KIAA1443 BINDING SITE is a target binding site found in the 3' untranslated region of mRNA encoded by KIAA1443, corresponding to a target binding site such as BINDING SITE I, BINDING SITE II or BINDING SITE III of FIG. 8. Table 4 illustrates the complementarity of the nucleotide sequences of KIAA1443 BINDING SITE, designated SEQ ID:15959, to the nucleotide sequence of GAM67 RNA, herein designated GAM RNA, also designated SEQ ID:282.

Another function of GAM67 is therefore inhibition of KIAA1443 (Accession NP_065885.1). Accordingly, utilities of GAM67 include diagnosis, prevention and treatment of diseases and clinical conditions associated with KIAA1443.

KIAA1724 (Accession XP_040280.2) is another GAM67 target gene, herein designated TARGET GENE. KIAA1724 BINDING SITE is a target binding site found in the 3' untranslated region of mRNA encoded by KIAA1724, corresponding to a target binding site such as BINDING SITE I, BINDING SITE II or BINDING SITE III of FIG. 8. Table 4 illustrates the complementarity of the nucleotide sequences of KIAA1724 BINDING SITE, designated SEQ ID:5509, to the nucleotide sequence of GAM67 RNA, herein designated GAM RNA, also designated SEQ ID:282.

Another function of GAM67 is therefore inhibition of KIAA1724 (Accession XP_040280.2). Accordingly, utilities of GAM67 include diagnosis, prevention and treatment of diseases and clinical conditions associated with KIAA1724.

KIAA1853 (Accession XP_045184.1) is another GAM67 target gene, herein designated TARGET GENE. KIAA1853 BINDING SITE is a target binding site found in the 5' untranslated region of mRNA encoded by KIAA1853, corresponding to a target binding site such as BINDING SITE I, BINDING SITE II or BINDING SITE III of FIG. 8. Table 4 illustrates the complementarity of the nucleotide sequences of KIAA1853 BINDING SITE, designated SEQ ID:16006, to the nucleotide sequence of GAM67 RNA, herein designated GAM RNA, also designated SEQ ID:282.

Another function of GAM67 is therefore inhibition of KIAA1853 (Accession XP_045184.1). Accordingly, utilities of GAM67 include diagnosis, prevention and treatment of diseases and clinical conditions associated with KIAA1853.

KIAA1946 (Accession NP_803237.1) is another GAM67 target gene, herein designated TARGET GENE. KIAA1946 BINDING SITE is a target binding site found in the 3' untranslated region of mRNA encoded by KIAA1946, corresponding to a target binding site such as BINDING SITE I, BINDING SITE II or BINDING SITE III of FIG. 8. Table 4 illustrates the complementarity of the nucleotide sequences of KIAA1946 BINDING SITE, designated SEQ ID:10647, to the nucleotide sequence of GAM67 RNA, herein designated GAM RNA, also designated SEQ ID:282.

Another function of GAM67 is therefore inhibition of KIAA1946 (Accession NP_803237.1). Accordingly, utilities of GAM67 include diagnosis, prevention and treatment of diseases and clinical conditions associated with KIAA1946.

Karyopherin alpha 3 (importin alpha 4) (KPNA3, Accession NP_002258.1) is another GAM67 target gene, herein designated TARGET GENE. KPNA3 BINDING SITE is a target binding site found in the 3' untranslated region of mRNA encoded by KPNA3, corresponding to a target binding site such as BINDING SITE I, BINDING SITE II or BINDING SITE III of FIG. 8. Table 4 illustrates the complementarity of the nucleotide sequences of KPNA3 BINDING SITE, designated SEQ ID:15262, to the nucleotide sequence of GAM67 RNA, herein designated GAM RNA, also designated SEQ ID:282.

Another function of GAM67 is therefore inhibition of Karyopherin alpha 3 (importin alpha 4) (KPNA3, Accession NP_002258.1), a gene which seems to act as a cytosolic receptor for both simple and bipartite nls motifs. Accordingly, utilities of GAM67 include diagnosis, prevention and treatment of diseases and clinical conditions associated with KPNA3.

The function of KPNA3 has been established by previous studies. The transport of molecules between the nucleus and the cytoplasm in eukaryotic cells is mediated by the nuclear pore complex (NPC), which consists of 60 to 100 proteins and is probably 120 million daltons in molecular size. Small molecules (up to 70 kD) can pass through the nuclear pore by nonselective diffusion; larger molecules are transported by an active process. Most nuclear proteins contain short basic amino acid sequences known as nuclear localization signals (NLSs). The import of nuclear proteins from cytoplasm to nucleus occurs in 2 steps. First, nuclear proteins are recognized by cytoplasmic NLS receptors and bind to the cytoplasmic face of the NPC. Second, the NLS substrates are transported to the interior of the nucleus through the NPC; this step requires ATP hydrolysis. In extracts from Xenopus oocytes, Moore and Blobel (1992) identified 2 fractions, A and B, that contribute respectively to the first and second steps of nuclear import. See karyopherin alpha-1 (KPNA1; 600686) and alpha-2 (KPNA2; 600685). From a human fetal brain cDNA library, Takeda et al. (1997) isolated and characterized a novel gene, designated KPNA3, encoding a protein highly homologous to certain nuclear transport proteins of Xenopus and human. The complete cDNA clone contained an open reading frame of 1,563 bp encoding 521 amino acids. The predicted amino acid sequence shows 48%, 45%, and 48% identity with Xenopus importin, yeast SRP1, and human RCH1 (KPNA2), respectively. The similarities among these proteins suggested that karyopherin alpha-3 may be involved in the nuclear transport system. Kohler et al. (1997) isolated a human KPNA3 cDNA. The predicted KPNA3 protein contains an N-terminal importin-beta-binding (IBB) domain, 8 armadillo repeats, and a C-terminal acidic region, all of which are characteristics of importin-alphas. Of the known human importin-alphas, KPNA3 shares the highest sequence identity with KPNA4 (OMIM Ref. No. 602970). Northern blot analysis detected a 4.6-kb KPNA3 transcript in all tissues tested. However, expression levels varied considerably among tissues, with the highest expression in testis and colon and the lowest expression in liver, kidney, and peripheral blood leukocytes Full details of the abovementioned studies are described in the following publications, the disclosure of which are hereby incorporated by reference:

Kohler, M.; Ansieau, S.; Prehn, S.; Leutz, A.; Haller, H.; Hartmann, E.: Cloning of two novel human importin-alpha subunits and analysis of the expression pattern of the importin-alpha protein family. FEBS Lett. 417:104-108, 1997; and Moore, M. S.; Blobel, G.: The two steps of nuclear import, targeting to the nuclear envelope and translocation through the nuclear pore, require different cytosolic factors. Cell 69:93.

Further studies establishing the function and utilities of KPNA3 are found in John Hopkins OMIM database record ID 601892, and in cited publications listed in Table 5, which are hereby incorporated by reference. LOC133418 (Accession XP_059649.4) is another GAM67 target gene, herein designated TARGET GENE. LOC133418 BINDING SITE is a target binding site found in the 3' untranslated region of mRNA encoded by LOC133418, corresponding to a target binding site such as BINDING SITE I, BINDING SITE II or BINDING SITE III of FIG. 8. Table 4 illustrates the complementarity of the nucleotide sequences of LOC133418 BINDING SITE, designated SEQ ID:5908, to the nucleotide sequence of GAM67 RNA, herein designated GAM RNA, also designated SEQ ID:282.

Another function of GAM67 is therefore inhibition of LOC133418 (Accession XP_059649.4). Accordingly, utilities of GAM67 include diagnosis, prevention and treatment of diseases and clinical conditions associated with LOC133418.

LOC149050 (Accession XP_017261.1) is another GAM67 target gene, herein designated TARGET GENE. LOC149050 BINDING SITE is a target binding site found in the 3' untranslated region of mRNA encoded by LOC149050, corresponding to a target binding site such as BINDING SITE I, BINDING SITE II or BINDING SITE III of FIG. 8. Table 4 illustrates the complementarity of the nucleotide sequences of LOC149050 BINDING SITE, designated SEQ ID:13860, to the nucleotide sequence of GAM67 RNA, herein designated GAM RNA, also designated SEQ ID:282.

Another function of GAM67 is therefore inhibition of LOC149050 (Accession XP_017261.1). Accordingly, utilities of GAM67 include diagnosis, prevention and treatment of diseases and clinical conditions associated with LOC149050.

LOC196403 (Accession XP_116915.2) is another GAM67 target gene, herein designated TARGET GENE. LOC196403 BINDING SITE is a target binding site found in the 3' untranslated region of mRNA encoded by LOC196403, corresponding to a target binding site such as BINDING SITE I, BINDING SITE II or BINDING SITE III of FIG. 8. Table 4 illustrates the complementarity of the nucleotide sequences of LOC196403 BINDING SITE, designated SEQ ID:6306, to the nucleotide sequence of GAM67 RNA, herein designated GAM RNA, also designated SEQ ID:282.

Another function of GAM67 is therefore inhibition of LOC196403 (Accession XP_116915.2). Accordingly, utilities of GAM67 include diagnosis, prevention and treatment of diseases and clinical conditions associated with LOC196403.

LOC221042 (Accession XP_167669.2) is another GAM67 target gene, herein designated TARGET GENE. LOC221042 BINDING SITE is a target binding site found in the 3' untranslated region of mRNA encoded by LOC221042, corresponding to a target binding site such as BINDING SITE I, BINDING SITE II or BINDING SITE III of FIG. 8. Table 4 illustrates the complementarity of the nucleotide sequences of LOC221042 BINDING SITE, designated SEQ ID:9749, to the nucleotide sequence of GAM67 RNA, herein designated GAM RNA, also designated SEQ ID:282.

Another function of GAM67 is therefore inhibition of LOC221042 (Accession XP_167669.2). Accordingly, utilities of GAM67 include diagnosis, prevention and treatment of diseases and clinical conditions associated with LOC221042.

LOC223075 (Accession XP_167336.2) is another GAM67 target gene, herein designated TARGET GENE. LOC223075 BINDING SITE is a target binding site found in the 3' untranslated region of mRNA encoded by LOC223075, corresponding to a target binding site such as BINDING SITE I, BINDING SITE II or BINDING SITE III of FIG. 8. Table 4 illustrates the complementarity of the nucleotide sequences of LOC223075 BINDING SITE, designated SEQ ID:2240, to the nucleotide sequence of GAM67 RNA, herein designated GAM RNA, also designated SEQ ID:282.

Another function of GAM67 is therefore inhibition of LOC223075 (Accession XP_167336.2). Accordingly, utilities of GAM67 include diagnosis, prevention and treatment of diseases and clinical conditions associated with LOC223075.

LOC253842 (Accession XP_173230.1) is another GAM67 target gene, herein designated TARGET GENE. LOC253842 BINDING SITE is a target binding site found in the 3' untranslated region of mRNA encoded by LOC253842, corresponding to a target binding site such as BINDING SITE I, BINDING SITE II or BINDING SITE III of FIG. 8. Table 4 illustrates the complementarity of the nucleotide sequences of LOC253842 BINDING SITE, designated SEQ ID:5240, to the nucleotide sequence of GAM67 RNA, herein designated GAM RNA, also designated SEQ ID:282.

Another function of GAM67 is therefore inhibition of LOC253842 (Accession XP_173230.1). Accordingly, utilities of GAM67 include diagnosis, prevention and treatment of diseases and clinical conditions associated with LOC253842.

LOC283658 (Accession XP_211150.1) is another GAM67 target gene, herein designated TARGET GENE. LOC283658 BINDING SITE is a target binding site found in the 3' untranslated region of mRNA encoded by LOC283658, corresponding to a target binding site such as BINDING SITE I, BINDING SITE II or BINDING SITE III of FIG. 8. Table 4 illustrates the complementarity of the nucleotide sequences of LOC283658 BINDING SITE, designated SEQ ID:16123, to the nucleotide sequence of GAM67 RNA, herein designated GAM RNA, also designated SEQ ID:282.

Another function of GAM67 is therefore inhibition of LOC283658 (Accession XP_211150.1). Accordingly, utilities of GAM67 include diagnosis, prevention and treatment of diseases and clinical conditions associated with LOC283658.

LOC284355 (Accession XP_209160.1) is another GAM67 target gene, herein designated TARGET GENE. LOC284355 BINDING SITE is a target binding site found in the 3' untranslated region of mRNA encoded by LOC284355, corresponding to a target binding site such as BINDING SITE I, BINDING SITE II or BINDING SITE III of FIG. 8. Table 4 illustrates the complementarity of the nucleotide sequences of LOC284355 BINDING SITE, designated SEQ ID:13410, to the nucleotide sequence of GAM67 RNA, herein designated GAM RNA, also designated SEQ ID:282.

Another function of GAM67 is therefore inhibition of LOC284355 (Accession XP_209160.1). Accordingly, utilities of GAM67 include diagnosis, prevention and treatment of diseases and clinical conditions associated with LOC284355.

LOC284678 (Accession XP_209318.1) is another GAM67 target gene, herein designated TARGET GENE. LOC284678 BINDING SITE is a target binding site found in the 5' untranslated region of mRNA encoded by LOC284678, corresponding to a target binding site such as BINDING SITE I, BINDING SITE II or BINDING SITE III of FIG. 8. Table 4 illustrates the complementarity of the nucleotide sequences of LOC284678 BINDING SITE, designated SEQ ID:17988, to the nucleotide sequence of GAM67 RNA, herein designated GAM RNA, also designated SEQ ID:282.

Another function of GAM67 is therefore inhibition of LOC284678 (Accession XP_209318.1). Accordingly, utilities of GAM67 include diagnosis, prevention and treatment of diseases and clinical conditions associated with LOC284678.

LOC284988 (Accession XP_209429.2) is another GAM67 target gene, herein designated TARGET GENE. LOC284988 BINDING SITE is a target binding site found in the 3' untranslated region of mRNA encoded by LOC284988, corresponding to a target binding site such as BINDING SITE I, BINDING SITE II or BINDING SITE III of FIG. 8. Table 4 illustrates the complementarity of the nucleotide sequences of LOC284988 BINDING SITE, designated SEQ ID:11370, to the nucleotide sequence of GAM67 RNA, herein designated GAM RNA, also designated SEQ ID:282.

Another function of GAM67 is therefore inhibition of LOC284988 (Accession XP_209429.2). Accordingly, utilities of GAM67 include diagnosis, prevention and treatment of diseases and clinical conditions associated with LOC284988.

LOC286209 (Accession XP_209946.1) is another GAM67 target gene, herein designated TARGET GENE. LOC286209 BINDING SITE is a target binding site found in the 3' untranslated region of mRNA encoded by LOC286209, corresponding to a target binding site such as BINDING SITE I, BINDING SITE II or BINDING SITE III of FIG. 8. Table 4 illustrates the complementarity of the nucleotide sequences of LOC286209 BINDING SITE, designated SEQ ID:19868, to the nucleotide sequence of GAM67 RNA, herein designated GAM RNA, also designated SEQ ID:282.

Another function of GAM67 is therefore inhibition of LOC286209 (Accession XP_209946.1). Accordingly, utilities of GAM67 include diagnosis, prevention and treatment of diseases and clinical conditions associated with LOC286209.

LOC286562 (Accession XP_210107.1) is another GAM67 target gene, herein designated TARGET GENE. LOC286562 BINDING SITE is a target binding site found in the 3' untranslated region of mRNA encoded by LOC286562, corresponding to a target binding site such as BINDING SITE I, BINDING SITE II or BINDING SITE III of FIG. 8. Table 4 illustrates the complementarity of the nucleotide sequences of LOC286562 BINDING SITE, designated SEQ ID:6979, to the nucleotide sequence of GAM67 RNA, herein designated GAM RNA, also designated SEQ ID:282.

Another function of GAM67 is therefore inhibition of LOC286562 (Accession XP_210107.1). Accordingly, utilities of GAM67 include diagnosis, prevention and treatment of diseases and clinical conditions associated with LOC286562.

LOC339600 (Accession XP_295014.1) is another GAM67 target gene, herein designated TARGET GENE. LOC339600 BINDING SITE is a target binding site found in the 3' untranslated region of mRNA encoded by LOC339600, corresponding to a target binding site such as BINDING SITE I, BINDING SITE II or BINDING SITE III of FIG. 8. Table 4 illustrates the complementarity of the nucleotide sequences of LOC339600 BINDING SITE, designated SEQ ID:15712, to the nucleotide sequence of GAM67 RNA, herein designated GAM RNA, also designated SEQ ID:282.

Another function of GAM67 is therefore inhibition of LOC339600 (Accession XP_295014.1). Accordingly, utilities of GAM67 include diagnosis, prevention and treatment of diseases and clinical conditions associated with LOC339600.

LOC93097 (Accession XP_049221.1) is another GAM67 target gene, herein designated TARGET GENE. LOC93097 BINDING SITE is a target binding site found in the 3' untranslated region of mRNA encoded by LOC93097, corresponding to a target binding site such as BINDING SITE I, BINDING SITE II or BINDING SITE III of FIG. 8. Table 4 illustrates the complementarity of the nucleotide sequences of LOC93097 BINDING SITE, designated SEQ ID:1803, to the nucleotide sequence of GAM67 RNA, herein designated GAM RNA, also designated SEQ ID:282.

Another function of GAM67 is therefore inhibition of LOC93097 (Accession XP_049221.1). Accordingly, utilities of GAM67 include diagnosis, prevention and treatment of diseases and clinical conditions associated with LOC93097.

MGC10715 (Accession NP_077301.4) is another GAM67 target gene, herein designated TARGET GENE. MGC10715 BINDING SITE is a target binding site found in the 3' untranslated region of mRNA encoded by MGC10715, corresponding to a target binding site such as BINDING SITE I, BINDING SITE II or BINDING SITE III of FIG. 8. Table 4 illustrates the complementarity of the nucleotide sequences of MGC10715 BINDING SITE, designated SEQ ID:13051, to the nucleotide sequence of GAM67 RNA, herein designated GAM RNA, also designated SEQ ID:282.

Another function of GAM67 is therefore inhibition of MGC10715 (Accession NP_077301.4). Accordingly, utilities of GAM67 include diagnosis, prevention and treatment of diseases and clinical conditions associated with MGC10715.

Opsin 1 (cone pigments), long-wave-sensitive (color blindness, protan) (OPN1LW, Accession XP_301073.1) is another GAM67 target gene, herein designated TARGET GENE. OPN1LW BINDING SITE is a target binding site found in the 3' untranslated region of mRNA encoded by OPN1LW, corresponding to a target binding site such as BINDING SITE I, BINDING SITE II or BINDING SITE III of FIG. 8. Table 4 illustrates the complementarity of the nucleotide sequences of OPN1LW BINDING SITE, designated SEQ ID:11329, to the nucleotide sequence of GAM67 RNA, herein designated GAM RNA, also designated SEQ ID:282.

Another function of GAM67 is therefore inhibition of Opsin 1 (cone pigments), long-wave-sensitive (color blindness, protan) (OPN1LW, Accession XP_301073.1). Accordingly, utilities of GAM67 include diagnosis, prevention and treatment of diseases and clinical conditions associated with OPN1LW.

Oxysterol binding protein-like 3 (OSBPL3, Accession NP_663164.1) is another GAM67 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:1991, to the nucleotide sequence of GAM67 RNA, herein designated GAM RNA, also designated SEQ ID:282.

Another function of GAM67 is therefore inhibition of Oxysterol binding protein-like 3 (OSBPL3, Accession NP_663164.1). Accordingly, utilities of GAM67 include diagnosis, prevention and treatment of diseases and clinical conditions associated with OSBPL3.

Oxysterol binding protein-like 3 (OSBPL3, Accession NP_663163.1) is another GAM67 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:1991, to the nucleotide sequence of GAM67 RNA, herein designated GAM RNA, also designated SEQ ID:282.

Another function of GAM67 is therefore inhibition of Oxysterol binding protein-like 3 (OSBPL3, Accession NP_663163.1). Accordingly, utilities of GAM67 include diagnosis, prevention and treatment of diseases and clinical conditions associated with OSBPL3.

Protein phosphatase 1, regulatory subunit 10 (PPP1R10, Accession NP_002705.2) is another GAM67 target gene, herein designated TARGET GENE. PPP1R10 BINDING SITE is a target binding site found in the 3' untranslated region of mRNA encoded by PPP1R10, corresponding to a target binding site such as BINDING SITE I, BINDING SITE II or BINDING SITE III of FIG. 8. Table 4 illustrates the complementarity of the nucleotide sequences of PPP1R10 BINDING SITE, designated SEQ ID:14628, to the nucleotide sequence of GAM67 RNA, herein designated GAM RNA, also designated SEQ ID:282.

Another function of GAM67 is therefore inhibition of Protein phosphatase 1, regulatory subunit 10 (PPP1R10, Accession NP_002705.2). Accordingly, utilities of GAM67 include diagnosis, prevention and treatment of diseases and clinical conditions associated with PPP1R10.

Rab interacting factor (RABIF, Accession NP_002862.2) is another GAM67 target gene, herein designated TARGET GENE. RABIF BINDING SITE is a target binding site found in the 3' untranslated region of mRNA encoded by RABIF, corresponding to a target binding site such as BINDING SITE I, BINDING SITE II or BINDING SITE III of FIG. 8. Table 4 illustrates the complementarity of the nucleotide sequences of RABIF BINDING SITE, designated SEQ ID:19664, to the nucleotide sequence of GAM67 RNA, herein designated GAM RNA, also designated SEQ ID:282.

Another function of GAM67 is therefore inhibition of Rab interacting factor (RABIF, Accession NP_002862.2), a gene which is involved in the regulation of intracellular vesicular transport. Accordingly, utilities of GAM67 include diagnosis, prevention and treatment of diseases and clinical conditions associated with RABIF.

The function of RABIF and its association with various diseases and clinical conditions, has been established by previous studies, as described hereinabove with reference to GAM63.1. RNPC4 (Accession NP_060577.2) is another GAM67 target gene, herein designated TARGET GENE. RNPC4 BINDING SITE is a target binding site found in the 3' untranslated region of mRNA encoded by RNPC4, corresponding to a target binding site such as BINDING SITE I, BINDING SITE II or BINDING SITE III of FIG. 8. Table 4 illustrates the complementarity of the nucleotide sequences of RNPC4 BINDING SITE, designated SEQ ID:1626, to the nucleotide sequence of GAM67 RNA, herein designated GAM RNA, also designated SEQ ID:282.

Another function of GAM67 is therefore inhibition of RNPC4 (Accession NP_060577.2). Accordingly, utilities of GAM67 include diagnosis, prevention and treatment of diseases and clinical conditions associated with RNPC4.

Sterol regulatory element binding transcription factor 1 (SREBF1, Accession NP_004167.3) is another GAM67 target gene, herein designated TARGET GENE. SREBF1 BINDING SITE is a target binding site found in the 3' untranslated region of mRNA encoded by SREBF1, corresponding to a target binding site such as BINDING SITE I, BINDING SITE II or BINDING SITE III of FIG. 8. Table 4 illustrates the complementarity of the nucleotide sequences of SREBF1 BINDING SITE, designated SEQ ID:9185, to the nucleotide sequence of GAM67 RNA, herein designated GAM RNA, also designated SEQ ID:282.

Another function of GAM67 is therefore inhibition of Sterol regulatory element binding transcription factor 1 (SREBF1, Accession NP_004167.3), a gene which is a transcriptional activator that binds to the sterol regulatory element 1. Accordingly, utilities of GAM67 include diagnosis, prevention and treatment of diseases and clinical conditions associated with SREBF1.

The function of SREBF1 has been established by previous studies. SREBP1 is synthesized as a 125-kD precursor that is attached to the nuclear membrane and endoplasmic reticulum (ER). Wang et al. (1994) found that in sterol-depleted cells, the membrane-bound precursor is cleaved to generate a soluble N-terminal fragment (apparent molecular mass, 68 kD) that translocates to the nucleus. This fragment, which includes the bHLH-Zip domain, activates transcription of the genes for the LDL receptor and HMG-CoA synthase (OMIM Ref. No. 142940). Sterols inhibit the cleavage of SREBP1, and the 68-kD nuclear form is rapidly catabolized, thereby reducing transcription. N-acetyl-leucyl-leucyl-norleucinal (ALLN), an inhibitor of neutral cysteine proteases, blocked the breakdown of the 68-kD form and superinduced sterol-regulated genes. Sterol-regulated proteolysis of a membrane-bound transcription factor is a novel mechanism by which transcription can be regulated by membrane lipids Animal model experiments lend further support to the function of SREBF1. Shimomura et al. (1998) produced transgenic mice that overexpressed nuclear SREBP1C in adipose tissue under the control of the adipocyte-specific aP2 (OMIM Ref. No. 600434) enhancer/promoter. These mice exhibited many of the features of congenital generalized lipodystrophy (BSCL; 269700). White fat failed to differentiate fully, and the size of the white fat deposits was markedly decreased. Brown fat was hypertrophic and contained fat-laden cells resembling immature white fat. Levels of mRNA encoding adipocyte differentiation markers, including leptin (OMIM Ref. No. 164160), were reduced, but levels of PREF1 (OMIM Ref. No. 176290) and TNF-alpha (OMIM Ref. No. 191160) were increased. Marked insulin resistance with 60-fold elevation in plasma insulin was observed. Diabetes mellitus with elevated blood glucose of greater than 300 mg/dl that failed to decline when insulin was injected was also seen. The transgenic mice had fatty liver from birth and developed elevated plasma triglyceride levels later in life.

It is appreciated that the abovementioned animal model for SREBF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shimomura, I.; Hammer, R. E.; Richardson, J. A.; Ikemoto, S.; Bashmakov, Y.; Goldstein, J. L.; Brown, M. S.: Insulin resistance and diabetes mellitus in transgenic mice expressing nuclear SREBP-1c in adipose tissue: model for congenital generalized lipodystrophy. Genes Dev. 12:3182-3194, 1998; and Wang, X.; Sato, R.; Brown, M. S.; Hua, X.; Goldstein, J. L.: SREBP-1, a membrane-bound transcription factor released by sterol-regulated proteolysis. Cell 77:53-62, 1994.

Further studies establishing the function and utilities of SREBF1 are found in John Hopkins OMIM database record ID 184756, and in cited publications listed in Table 5, which are hereby incorporated by reference. Synaptopodin 2 (SYNPO2, Accession XP_050219.2) is another GAM67 target gene, herein designated TARGET GENE. SYNPO2 BINDING SITE is a target binding site found in the 3' untranslated region of mRNA encoded by SYNPO2, corresponding to a target binding site such as BINDING SITE I, BINDING SITE II or BINDING SITE III of FIG. 8. Table 4 illustrates the complementarity of the nucleotide sequences of SYNPO2 BINDING SITE, designated SEQ ID:12148, to the nucleotide sequence of GAM67 RNA, herein designated GAM RNA, also designated SEQ ID:282.

Another function of GAM67 is therefore inhibition of Synaptopodin 2 (SYNPO2, Accession XP_050219.2). Accordingly, utilities of GAM67 include diagnosis, prevention and treatment of diseases and clinical conditions associated with SYNPO2.

Synaptotagmin xi (SYT11, Accession NP_689493.2) is another GAM67 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:2632, to the nucleotide sequence of GAM67 RNA, herein designated GAM RNA, also designated SEQ ID:282.

Another function of GAM67 is therefore inhibition of Synaptotagmin xi (SYT11, Accession NP_689493.2). Accordingly, utilities of GAM67 include diagnosis, prevention and treatment of diseases and clinical conditions associated with SYT11.

Taf4 rna polymerase ii, tata box binding protein (tbp)-associated factor, 135 kda (TAF4, Accession NP_003176.1) is another GAM67 target gene, herein designated TARGET GENE. TAF4 BINDING SITE is a target binding site found in the 3' untranslated region of mRNA encoded by TAF4, corresponding to a target binding site such as BINDING SITE I, BINDING SITE II or BINDING SITE III of FIG. 8. Table 4 illustrates the complementarity of the nucleotide sequences of TAF4 BINDING SITE, designated SEQ ID:9232, to the nucleotide sequence of GAM67 RNA, herein designated GAM RNA, also designated SEQ ID:282.

Another function of GAM67 is therefore inhibition of Taf4 rna polymerase ii, tata box binding protein (tbp)-associated factor, 135 kda (TAF4, Accession NP_003176.1), a gene which plays a central role in mediating promoter responses to various activators and repressors. Accordingly, utilities of GAM67 include diagnosis, prevention and treatment of diseases and clinical conditions associated with TAF4.

The function of TAF4 has been established by previous studies. Transcription factor TFIID is a multiprotein complex composed of the TATA box-binding protein (TBP; 600075) and multiple TBP-associated factors (TAFs; OMIM Ref. No. 313650). Tanese et al. (1996) cloned cDNAs encoding 2 subunits of the human TFIID complex: TAFII130 (also symbolized TAF2C1) and TAFII100 (TAF2D; 601787). The longest partial cDNA representing human TAFII130 encodes the predicted C-terminal 947 amino acids of the protein and 1.4 kb of 3-prime untranslated sequence; this cDNA appeared to be missing approximately 100 N-terminal amino acids of TAFII130. Tanese et al. (1996) showed that recombinant TAFII100 and TAFII130 associated with endogenous TAFs and TBP to form a TFIID complex in transfected 293 cells. Their experiments also suggested a role for TAFII130 as a direct coactivator target for Sp1 (OMIM Ref. No. 189906). See also TAF2C2 (OMIM Ref. No. 601689). By biochemical purification and genomic screening, Mengus et al. (1997) obtained a full-length cDNA encoding TAF2C1. Sequence analysis predicted that the 1,083-amino acid protein contains a C-terminal domain and a central region highly homologous to those of TAF2C2. TAF2C1 expression was found to enhance transactivation by the class II nuclear receptors RAR (see OMIM Ref. No. 180240), THRA (see OMIM Ref. No. 190120), and VDR (OMIM Ref. No. 601769) through activation function-2 in the C-terminal ligand-binding domain.

Full details of the abovementioned studies are described in the following publications, the disclosure of which are hereby incorporated by reference:

Mengus, G.; May, M.; Carre, L.; Chambon, P.; Davidson, I.: Human TAF(II)135 potentiates transcriptional activation by the AF-2s of the retinoic acid, vitamin D3, and thyroid hormone receptors in mammalian cells. Genes Dev. 11:1381-1395, 1997; and Tanese, N.; Saluja, D.; Vassallo, M. F.; Chen, J.-L.; Admon, A.: Molecular cloning and analysis of two subunits of the human TFIID complex: hTAFII130 and hTAFII100. Proc. Nat. Acad. S.

Further studies establishing the function and utilities of TAF4 are found in John Hopkins OMIM database record ID 601796, and in cited publications listed in Table 5, which are hereby incorporated by reference. Transmembrane 4 superfamily member 2 (TM4SF2, Accession NP_004606.2) is another GAM67 target gene, herein designated TARGET GENE. TM4SF2 BINDING SITE is a target binding site found in the 3' untranslated region of mRNA encoded by TM4SF2, corresponding to a target binding site such as BINDING SITE I, BINDING SITE II or BINDING SITE III of FIG. 8. Table 4 illustrates the complementarity of the nucleotide sequences of TM4SF2 BINDING SITE, designated SEQ ID:1003, to the nucleotide sequence of GAM67 RNA, herein designated GAM RNA, also designated SEQ ID:282.

Another function of GAM67 is therefore inhibition of Transmembrane 4 superfamily member 2 (TM4SF2, Accession NP_004606.2). Accordingly, utilities of GAM67 include diagnosis, prevention and treatment of diseases and clinical conditions associated with TM4SF2.

Ubiquitin-conjugating enzyme e2, j1 (ubc6 homolog, yeast) (UBE2J1, Accession NP_057105.1) is another GAM67 target gene, herein designated TARGET GENE. UBE2J1 BINDING SITE is a target binding site found in the 3' untranslated region of multiple transcripts of mRNA encoded by UBE2J1, corresponding to a target binding site such as BINDING SITE I, BINDING SITE II or BINDING SITE III of FIG. 8. Table 4 illustrates the complementarity of the nucleotide sequences of UBE2J1 BINDING SITE, designated SEQ ID:4859, to the nucleotide sequence of GAM67 RNA, herein designated GAM RNA, also designated SEQ ID:282.

Another function of GAM67 is therefore inhibition of Ubiquitin-conjugating enzyme e2, j1 (ubc6 homolog, yeast) (UBE2J1, Accession NP_057105.1). Accordingly, utilities of GAM67 include diagnosis, prevention and treatment of diseases and clinical conditions associated with UBE2J1.

UPF3B (Accession NP_075386.1) is another GAM67 target gene, herein designated TARGET GENE. UPF3B BINDING SITE is a target binding site found in the 3' untranslated region of multiple transcripts of mRNA encoded by UPF3B, corresponding to a target binding site such as BINDING SITE I, BINDING SITE II or BINDING SITE III of FIG. 8. Table 4 illustrates the complementarity of the nucleotide sequences of UPF3B BINDING SITE, designated SEQ ID:4390, to the nucleotide sequence of GAM67 RNA, herein designated GAM RNA, also designated SEQ ID:282.

Another function of GAM67 is therefore inhibition of UPF3B (Accession NP_075386.1), a gene which facilitates the export of spliced mRNAs and may function as a positive regulator for mannosylphosphate transferase. Accordingly, utilities of GAM67 include diagnosis, prevention and treatment of diseases and clinical conditions associated with UPF3B.

The function of UPF3B has been established by previous studies. Lykke-andersen et al. (2000) found that UPF2, UPF3A, and UPF3B were complexed with UPF1 (RENT1; 601430) while in HeLa cell extracts. In intact cells, UPF3A and UPF3B were found to be nucleocytoplasmic shuttling proteins, while UPF2 was perinuclear, and UPF1 was cytoplasmic. UPF3A and UPF3B associated selectively with spliced beta-globin (OMIM Ref. No. 141900) mRNA in vivo, and tethering of any UPF protein to the 3-prime untranslated region of beta-globin mRNA elicited NMD. These data suggested that assembly of a dynamic human UPF complex initiates in the nucleus at mRNA exon-exon junctions and triggers NMD in the cytoplasm when recognized downstream of a translation termination site. By immunoprecipitation and immunoblot analyses of nucleoplasmic fractions, Kim et al. (2001) showed that UPF3A and UPF3B are associated in an RNase-resistant manner with Y14 (RBM8A; 605313), as well as with the mRNA export factors ALY (OMIM Ref. No. 604171) and TAP (NXF1; 602647), in mRNA-protein complexes. UPF3 proteins appeared to bind immediately upstream of exon-exon junctions. Kim et al. (2001) concluded that UPF3 proteins facilitate the export of spliced mRNAs by recruiting mRNA export proteins. They proposed that UPF3 functions in NMD and travels with the mRNA to the cytoplasm, where a leading translating ribosome displaces the UPF3-Y14 complexes from the mRNA.

Full details of the abovementioned studies are described in the following publications, the disclosure of which are hereby incorporated by reference:

Lykke-andersen, J.; Shu, M.-D.; Steitz, J. A.: Human Upf proteins target an mRNA for nonsense-mediated decay when bound downstream of a termination codon. Cell 103:1121-1131, 2000; and Kim, V. N.; Kataoka, N.; Dreyfuss, G.: Role of the nonsense-mediated decay factor hUpf3 in the splicing-dependent exon-exon junction complex. Science 293:1832-1836, 2001.

Further studies establishing the function and utilities of UPF3B are found in John Hopkins OMIM database record ID 300298, and in cited publications listed in Table 5, which are hereby incorporated by reference. UPF3B (Accession NP_542199.1) is another GAM67 target gene, herein designated TARGET GENE. UPF3B BINDING SITE is a target binding site found in the 3' untranslated region of multiple transcripts of mRNA encoded by UPF3B, corresponding to a target binding site such as BINDING SITE I, BINDING SITE II or BINDING SITE III of FIG. 8. Table 4 illustrates the complementarity of the nucleotide sequences of UPF3B BINDING SITE, designated SEQ ID:4390, to the nucleotide sequence of GAM67 RNA, herein designated GAM RNA, also designated SEQ ID:282.

Another function of GAM67 is therefore inhibition of UPF3B (Accession NP_542199.1), a gene which facilitates the export of spliced mRNAs and may function as a positive regulator for mannosylphosphate transferase. Accordingly, utilities of GAM67 include diagnosis, prevention and treatment of diseases and clinical conditions associated with UPF3B.

The function of UPF3B has been established by previous studies. Lykke-andersen et al. (2000) found that UPF2, UPF3A, and UPF3B were complexed with UPF1 (RENT1; 601430) while in HeLa cell extracts. In intact cells, UPF3A and UPF3B were found to be nucleocytoplasmic shuttling proteins, while UPF2 was perinuclear, and UPF1 was cytoplasmic. UPF3A and UPF3B associated selectively with spliced beta-globin (OMIM Ref. No. 141900) mRNA in vivo, and tethering of any UPF protein to the 3-prime untranslated region of beta-globin mRNA elicited NMD. These data suggested that assembly of a dynamic human UPF complex initiates in the nucleus at mRNA exon-exon junctions and triggers NMD in the cytoplasm when recognized downstream of a translation termination site. By immunoprecipitation and immunoblot analyses of nucleoplasmic fractions, Kim et al. (2001) showed that UPF3A and UPF3B are associated in an RNase-resistant manner with Y14 (RBM8A; 605313), as well as with the mRNA export factors ALY (OMIM Ref. No. 604171) and TAP (NXF1; 602647), in mRNA-protein complexes. UPF3 proteins appeared to bind immediately upstream of exon-exon junctions. Kim et al. (2001) concluded that UPF3 proteins facilitate the export of spliced mRNAs by recruiting mRNA export proteins. They proposed that UPF3 functions in NMD and travels with the mRNA to the cytoplasm, where a leading translating ribosome displaces the UPF3-Y14 complexes from the mRNA.

Full details of the abovementioned studies are described in the following publications, the disclosure of which are hereby incorporated by reference:

Lykke- andersen, J.; Shu, M.-D.; Steitz, J. A.: Human Upf proteins target an mRNA for nonsense-mediated decay when bound downstream of a termination codon. Cell 103:1121-1131, 2000; and Kim, V. N.; Kataoka, N.; Dreyfuss, G.: Role of the nonsense-mediated decay factor hUpf3 in the splicing-dependent exon-exon junction complex. Science 293:1832-1836, 2001.

Further studies establishing the function and utilities of UPF3B are found in John Hopkins OMIM database record ID 300298, and in cited publications listed in Table 5, which are hereby incorporated by reference. Zinc finger protein 323 (ZNF323, Accession NP_112161.2) is another GAM67 target gene, herein designated TARGET GENE. ZNF323 BINDING SITE is a target binding site found in the 3' untranslated region of mRNA encoded by ZNF323, corresponding to a target binding site such as BINDING SITE I, BINDING SITE II or BINDING SITE III of FIG. 8. Table 4 illustrates the complementarity of the nucleotide sequences of ZNF323 BINDING SITE, designated SEQ ID:12107, to the nucleotide sequence of GAM67 RNA, herein designated GAM RNA, also designated SEQ ID:282.

Another function of GAM67 is therefore inhibition of Zinc finger protein 323 (ZNF323, Accession NP_112161.2). Accordingly, utilities of GAM67 include diagnosis, prevention and treatment of diseases and clinical conditions associated with ZNF323.

FIG. 8 further provides a conceptual description of a novel bioinformatically detected of the present invention, referred to here as Genomic Address Messenger 68 (GAM68), which modulates expression of respective target genes thereof, the function and utility of which target genes is known in the art.

GAM68 is a novel bioinformatically detected regulatory, non protein coding, micro RNA (miRNA) gene. The method by which GAM68 was detected is described hereinabove with reference to FIGS. 8-15.

GAM68 gene, herein designated GAM GENE, and GAM68 target gene, herein designated TARGET GENE, are human genes contained in the human genome.

GAM68 gene encodes a GAM68 precursor RNA, herein designated GAM PRECURSOR RNA. Similar to other miRNA genes, and unlike most ordinary genes, GAM68 precursor RNA does not encode a protein. A nucleotide sequence identical or highly similar to the nucleotide sequence of GAM68 precursor RNA is designated SEQ ID:128, and is provided hereinbelow with reference to the sequence listing part.

GAM68 precursor RNA folds onto itself, forming GAM68 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM68 precursor RNA folds onto itself, forming GAM68 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM68 precursor RNA, designated SEQ-ID:128, and a schematic representation of a predicted secondary folding of GAM68 folded precursor RNA are further described with reference to Table 2, hereby incorporated by reference.

An enzyme complex designated DICER COMPLEX, 'dices' the GAM68 folded precursor RNA into GAM68 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM68 RNA is designated SEQ ID:251, and is provided hereinbelow with references to the sequence listing part and Table 3, hereby incorporated by reference.

GAM68 target gene, herein designated TARGET GENE, encodes a corresponding messenger RNA, GAM68 target RNA, herein designated GAM TARGET RNA. GAM68 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM68 RNA, herein designated GAM RNA, binds complementarily to one or more target binding sites located in untranslated regions of GAM68 target RNA, herein designated GAM TARGET RNA. This complementary binding is due to the fact that the nucleotide sequence of GAM68 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM68 RNA may have a different number of target binding sites in untranslated regions of a GAM68 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM68 RNA, herein designated GAM RNA, to target binding sites on GAM68 target RNA, herein designated GAM TARGET RNA, such as BINDING SITE I, BINDING SITE II and BINDING SITE III, inhibits translation of GAM68 target RNA into GAM68 target protein, herein designated GAM TARGET PROTEIN. GAM target protein is therefore outlined by a broken line.

It is appreciated that GAM68 target gene, herein designated TARGET GENE, in fact represents a plurality of GAM68 target genes. The mRNA of each one of this plurality of GAM68 target genes comprises one or more target binding sites, each having a nucleotide sequence which is at least partly complementary to GAM68 RNA, herein designated GAM RNA, and which when bound by GAM68 RNA causes inhibition of translation of respective one or more GAM68 target proteins.

It is further appreciated by one skilled in the art that the mode of translational inhibition illustrated by FIG. 8 with specific reference to translational inhibition exerted by GAM68 gene, herein designated GAM GENE, on one or more GAM68 target genes, herein collectively designated TARGET GENE, is common to other known miRNA genes.

As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM68 correlate with, and may be deduced from, the identity of the target genes which GAM68 binds and inhibits, and the function of these target genes, as elaborated hereinbelow.

Cadherin 13, h-cadherin (heart) (CDH13, Accession NM_001257.2) is a GAM68 target gene, herein designated TARGET GENE. CDH13 BINDING SITE is a target binding site found in the 3' untranslated region of mRNA encoded by CDH13, corresponding to a target binding site such as BINDING SITE I, BINDING SITE II or BINDING SITE III of FIG. 8. Table 4 illustrates the complementarity of the nucleotide sequences of CDH13 BINDING SITE, designated SEQ ID:8595, to the nucleotide sequence of GAM68 RNA, herein designated GAM RNA, also designated SEQ ID:251.

A function of GAM68 is therefore inhibition of Cadherin 13, h-cadherin (heart) (CDH13, Accession NM_001257.2). Accordingly, utilities of GAM68 include diagnosis, prevention and treatment of diseases and clinical conditions associated with CDH13.

Dnaj (hsp40) homolog, subfamily c, member 5 (DNAJC5, Accession XM_028966.6) is another GAM68 target gene, herein designated TARGET GENE. DNAJC5 BINDING SITE is a target binding site found in the 3' untranslated region of mRNA encoded by DNAJC5, corresponding to a target binding site such as BINDING SITE I, BINDING SITE II or BINDING SITE III of FIG. 8. Table 4 illustrates the complementarity of the nucleotide sequences of DNAJC5 BINDING SITE, designated SEQ ID:15877, to the nucleotide sequence of GAM68 RNA, herein designated GAM RNA, also designated SEQ ID:251.

Another function of GAM68 is therefore inhibition of Dnaj (hsp40) homolog, subfamily c, member 5 (DNAJC5, Accession XM_028966.6). Accordingly, utilities of GAM68 include diagnosis, prevention and treatment of diseases and clinical conditions associated with DNAJC5.

FENS-1 (Accession) is another GAM68 target gene, herein designated TARGET GENE. FENS-1 BINDING SITE is a target binding site found in the 3' untranslated region of mRNA encoded by FENS-1, corresponding to a target binding site such as BINDING SITE I, BINDING SITE II or BINDING SITE III of FIG. 8. Table 4 illustrates the complementarity of the nucleotide sequences of FENS-1 BINDING SITE, designated SEQ ID:6852, to the nucleotide sequence of GAM68 RNA, herein designated GAM RNA, also designated SEQ ID:251.

Another function of GAM68 is therefore inhibition of FENS-1 (Accession). Accordingly, utilities of GAM68 include diagnosis, prevention and treatment of diseases and clinical conditions associated with FENS-1.

Glucocorticoid receptor dna binding factor 1 (GRLF1, Accession NM_024342.1) is another GAM68 target gene, herein designated TARGET GENE. GRLF1 BINDING SITE is a target binding site found in the 3' untranslated region of multiple transcripts of mRNA encoded by GRLF1, corresponding to a target binding site such as BINDING SITE I, BINDING SITE II or BINDING SITE III of FIG. 8. Table 4 illustrates the complementarity of the nucleotide sequences of GRLF1 BINDING SITE, designated SEQ ID:486, to the nucleotide sequence of GAM68 RNA, herein designated GAM RNA, also designated SEQ ID:251.

Another function of GAM68 is therefore inhibition of Glucocorticoid receptor dna binding factor 1 (GRLF1, Accession NM_024342.1), a gene which inhibits transcription of the glucocorticoid receptor gene. Accordingly, utilities of GAM68 include diagnosis, prevention and treatment of diseases and clinical conditions associated with GRLF1.

The function of GRLF1 has been established by previous studies. Using polyclonal antibodies against purified GRLF1, LeClerc et al. (1991) isolated a partial GRLF1 cDNA encoding a deduced 835-amino acid protein. The protein contains 3 possible zinc finger structures and a leucine zipper motif that contains 1 cysteine. Western blot analysis detected expression of a 94-kD GRLF1 protein. By sequence comparisons with rat p190A, database searching, and RT-PCR analysis, Tikoo et al. (2000) obtained a full-length cDNA sequence encoding GRLF1, the human homolog of p190A. The deduced 1,514-amino acid protein is 97% identical to the rat sequence. The first 1,287 residues, including the GTPase and middle domains, are encoded by the 3.7-kb exon 1, similar to the structure observed in p190B (ARHGAP5; 602680).

Full details of the abovementioned studies are described in the following publications, the disclosure of which are hereby incorporated by reference:

LeClerc, S.; Palaniswami, R.; Xie, B.; Govdan, M. V.: Molecular cloning and characterization of a factor that binds the human glucocorticoid receptor gene and represses its expression. J. Biol. Chem. 266:17333-17340, 1991; and Tikoo, A.; Czekay, S.; Viars, C.; White, S.; Heath, J. K.; Arden, K.; Maruta, H.: p190-A, a human tumor suppressor gene, maps to the chromosomal region 19q13.3 that is reportedly delet.

Further studies establishing the function and utilities of GRLF1 are found in John Hopkins OMIM database record ID 605277, and in cited publications listed in Table 5, which are hereby incorporated by reference. SORCS2 (Accession NM_020777.1) is another GAM68 target gene, herein designated TARGET GENE. SORCS2 BINDING SITE is a target binding site found in the 3' untranslated region of mRNA encoded by SORCS2, corresponding to a target binding site such as BINDING SITE I, BINDING SITE II or BINDING SITE III of FIG. 8. Table 4 illustrates the complementarity of the nucleotide sequences of SORCS2 BINDING SITE, designated SEQ ID:7018, to the nucleotide sequence of GAM68 RNA, herein designated GAM RNA, also designated SEQ ID:251.

Another function of GAM68 is therefore inhibition of SORCS2 (Accession NM_020777.1). Accordingly, utilities of GAM68 include diagnosis, prevention and treatment of diseases and clinical conditions associated with SORCS2.

FIG. 8 further provides a conceptual description of a novel bioinformatically detected of the present invention, referred to here as Genomic Address Messenger 69 (GAM69), which modulates expression of respective target genes thereof, the function and utility of which target genes is known in the art.

GAM69 is a novel bioinformatically detected regulatory, non protein coding, micro RNA (miRNA) gene. The method by which GAM69 was detected is described hereinabove with reference to FIGS. 8-15.

GAM69 gene, herein designated GAM GENE, and GAM69 target gene, herein designated TARGET GENE, are human genes contained in the human genome.

GAM69 gene encodes a GAM69 precursor RNA, herein designated GAM PRECURSOR RNA. Similar to other miRNA genes, and unlike most ordinary genes, GAM69 precursor RNA does not encode a protein. A nucleotide sequence identical or highly similar to the nucleotide sequence of GAM69 precursor RNA is designated SEQ ID:96, and is provided hereinbelow with reference to the sequence listing part.

GAM69 precursor RNA folds onto itself, forming GAM69 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM69 precursor RNA folds onto itself, forming GAM69 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM69 precursor RNA, designated SEQ-ID:96, and a schematic representation of a predicted secondary folding of GAM69 folded precursor RNA are further described with reference to Table 2, hereby incorporated by reference.

An enzyme complex designated DICER COMPLEX, 'dices' the GAM69 folded precursor RNA into GAM69 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM69 RNA is designated SEQ ID:258, and is provided hereinbelow with references to the sequence listing part and Table 3, hereby incorporated by reference.

GAM69 target gene, herein designated TARGET GENE, encodes a corresponding messenger RNA, GAM69 target RNA, herein designated GAM TARGET RNA. GAM69 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM69 RNA, herein designated GAM RNA, binds complementarily to one or more target binding sites located in untranslated regions of GAM69 target RNA, herein designated GAM TARGET RNA. This complementary binding is due to the fact that the nucleotide sequence of GAM69 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM69 RNA may have a different number of target binding sites in untranslated regions of a GAM69 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM69 RNA, herein designated GAM RNA, to target binding sites on GAM69 target RNA, herein designated GAM TARGET RNA, such as BINDING SITE I, BINDING SITE II and BINDING SITE III, inhibits translation of GAM69 target RNA into GAM69 target protein, herein designated GAM TARGET PROTEIN. GAM target protein is therefore outlined by a broken line.

It is appreciated that GAM69 target gene, herein designated TARGET GENE, in fact represents a plurality of GAM69 target genes. The mRNA of each one of this plurality of GAM69 target genes comprises one or more target binding sites, each having a nucleotide sequence which is at least partly complementary to GAM69 RNA, herein designated GAM RNA, and which when bound by GAM69 RNA causes inhibition of translation of respective one or more GAM69 target proteins.

It is further appreciated by one skilled in the art that the mode of translational inhibition illustrated by FIG. 8 with specific reference to translational inhibition exerted by GAM69 gene, herein designated GAM GENE, on one or more GAM69 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM69 correlate with, and may be deduced from, the identity of the target genes which GAM69 binds and inhibits, and the function of these target genes, as elaborated hereinbelow.

Atp-binding cassette, sub-family b (mdr/tap), member 5 (ABCB5, Accession XP_291215.1) is a GAM69 target gene, herein designated TARGET GENE. ABCB5 BINDING SITE is a target binding site found in the 3' untranslated region of mRNA encoded by ABCB5, corresponding to a target binding site such as BINDING SITE I, BINDING SITE II or BINDING SITE III of FIG. 8. Table 4 illustrates the complementarity of the nucleotide sequences of ABCB5 BINDING SITE, designated SEQ ID:12174, to the nucleotide sequence of GAM69 RNA, herein designated GAM RNA, also designated SEQ ID:258.

A function of GAM69 is therefore inhibition of Atp-binding cassette, sub-family b (mdr/tap), member 5 (ABCB5, Accession XP_291215.1). Accordingly, utilities of GAM69 include diagnosis, prevention and treatment of diseases and clinical conditions associated with ABCB5.

Adenylate cyclase 5 (ADCY5, Accession XP_171048.2) is another GAM69 target gene, herein designated TARGET GENE. ADCY5 BINDING SITE is a target binding site found in the 5' untranslated region of mRNA encoded by ADCY5, corresponding to a target binding site such as BINDING SITE I, BINDING SITE II or BINDING SITE III of FIG. 8. Table 4 illustrates the complementarity of the nucleotide sequences of ADCY5 BINDING SITE, designated SEQ ID:17269, to the nucleotide sequence of GAM69 RNA, herein designated GAM RNA, also designated SEQ ID:258.

Another function of GAM69 is therefore inhibition of Adenylate cyclase 5 (ADCY5, Accession XP_171048.2).

Accordingly, utilities of GAM69 include diagnosis, prevention and treatment of diseases and clinical conditions associated with ADCY5.

Adenylate cyclase 8 (brain) (ADCY8, Accession NP_001106.1) is another GAM69 target gene, herein designated TARGET GENE. ADCY8 BINDING SITE is a target binding site found in the 5' untranslated region of mRNA encoded by ADCY8, corresponding to a target binding site such as BINDING SITE I, BINDING SITE II or BINDING SITE III of FIG. 8. Table 4 illustrates the complementarity of the nucleotide sequences of ADCY8 BINDING SITE, designated SEQ ID:16440, to the nucleotide sequence of GAM69 RNA, herein designated GAM RNA, also designated SEQ ID:258.

Another function of GAM69 is therefore inhibition of Adenylate cyclase 8 (brain) (ADCY8, Accession NP_001106.1), a gene which this a membrane-bound, ca(2+)-inhibitable adenylyl cyclase. Accordingly, utilities of GAM69 include diagnosis, prevention and treatment of diseases and clinical conditions associated with ADCY8.

The function of ADCY8 has been established by previous studies. Adenylyl cyclase (EC 4.6.1.1) catalyzes the transformation of ATP into cyclic AMP. The enzymatic activity is under the control of several hormones, and different polypeptides participate in the transduction of the signal from the receptor to the catalytic moiety. Stimulatory or inhibitory receptors (Rs and Ri) interact with G proteins (Gs and Gi) that exhibit GTPase activity and they modulate the activity of the catalytic subunit of the adenylyl cyclase. Parma et al. (1991) cloned a cDNA corresponding to human brain adenylyl cyclase, symbolized by them as HBAC1. By in situ hybridization to metaphase chromosomal spreads using the human brain cDNA probe, Stengel et al. (1992) showed that the gene is located on 8q24.2. A highly homologous gene, ADCY2 (OMIM Ref. No. 103071), was assigned to 5p15.3 by the same method.

Full details of the abovementioned studies are described in the following publications, the disclosure of which are hereby incorporated by reference:

Parma, J.; Stengel, D.; Gannage, M.-H.; Poyard, M.; Barouki, R.; Hanoune, J.: Sequence of a human brain adenylyl cyclase partial cDNA: evidence for a consensus cyclase domain. Biochem. Biophys. Res. Commun. 179:455-462, 1991; and Stengel, D.; Parma, J.; Gannage, M.-H.; Roeckel, N.; Mattei, M.-G.; Barouki, R.; Hanoune, J.: Different chromosomal localization of two adenylyl cyclase genes expressed in human brain.

Further studies establishing the function and utilities of ADCY8 are found in John Hopkins OMIM database record ID 103070, and in cited publications listed in Table 5, which are hereby incorporated by reference. Adducin 2 (beta) (ADD2, Accession NP_059522.1) is another GAM69 target gene, herein designated TARGET GENE. ADD2 BINDING SITE is a target binding site found in the 3' untranslated region of multiple transcripts of mRNA encoded by ADD2, corresponding to a target binding site such as BINDING SITE I, BINDING SITE II or BINDING SITE III of FIG. 8. Table 4 illustrates the complementarity of the nucleotide sequences of ADD2 BINDING SITE, designated SEQ ID:12249, to the nucleotide sequence of GAM69 RNA, herein designated GAM RNA, also designated SEQ ID:258.

Another function of GAM69 is therefore inhibition of Adducin 2 (beta) (ADD2, Accession NP_059522.1), a gene which membrane-cytoskeleton-protein that promotes the assembly of the spectrin-actin network. Accordingly, utilities of GAM69 include diagnosis, prevention and treatment of diseases and clinical conditions associated with ADD2.

The function of ADD2 has been established by previous studies. See alpha-adducin (ADD1; 102680). Adducin is a heterodimeric calmodulin (OMIM Ref. No. 114180)-binding protein of the cell-membrane skeleton, which is thought to play a role in assembly of the spectrin-actin lattice that underlies the plasma membrane (see OMIM Ref. No. also 182860 and 102560). Missense mutations in both the alpha- and beta-adducin genes that alter amino acids that are normally phosphorylated have been associated with the regulation of blood pressure in the Milan hypertensive strain (MHS) of rats (Bianchi et al., 1994). Muro et al. (2000) showed that in Add2 -/- mice, targeted disruption of the beta-adducin gene resulted in an 80% decrease of alpha-adducin and a 4-fold upregulation of gamma-adducin in erythrocytes. Elliptocytes, ovalocytes, and occasionally spherocytes were found in the blood smears of -/- mice. Mild hematologic findings were thought to be related to the amount of adducin remaining in the mutant animals (presumably alpha-gamma adducin).

Full details of the abovementioned studies are described in the following publications, the disclosure of which are hereby incorporated by reference:

Bianchi, G.; Tripodi, G.; Casari, G.; Salardi, S.; Barber, B. R.; Garcia, R.; Leoni, P.; Torielli, L.; Cusi, D.; Ferrandi, M.; Pinna, L. A.; Baralle, F. E.; Ferrari, P.: Two point mutations within the adducin genes are involved in blood pressure variation. Proc. Nat. Acad. Sci. 91:3999-4003, 1994; and Muro, A. F.; Marro, M. L.; Gajovic, S.; Porro, F.; Luzzatto, L.; Baralle, F. E.: Mild spherocytic hereditary elliptocytosis and altered levels of alpha- and gamma-adducins in beta-adduc.

Further studies establishing the function and utilities of ADD2 are found in John Hopkins OMIM database record ID 102681, and in cited publications listed in Table 5, which are hereby incorporated by reference. Adducin 2 (beta) (ADD2, Accession NP_059520.1) is another GAM69 target gene, herein designated TARGET GENE. ADD2 BINDING SITE is a target binding site found in the 3' untranslated region of multiple transcripts of mRNA encoded by ADD2, corresponding to a target binding site such as BINDING SITE I, BINDING SITE II or BINDING SITE III of FIG. 8. Table 4 illustrates the complementarity of the nucleotide sequences of ADD2 BINDING SITE, designated SEQ ID:12249, to the nucleotide sequence of GAM69 RNA, herein designated GAM RNA, also designated SEQ ID:258.

Another function of GAM69 is therefore inhibition of Adducin 2 (beta) (ADD2, Accession NP_059520.1), a gene which membrane-cytoskeleton-protein that promotes the assembly of the spectrin-actin network. Accordingly, utilities of GAM69 include diagnosis, prevention and treatment of diseases and clinical conditions associated with ADD2.

The function of ADD2 has been established by previous studies. See alpha-adducin (ADD1; 102680). Adducin is a heterodimeric calmodulin (OMIM Ref. No. 114180)-binding protein of the cell-membrane skeleton, which is thought to play a role in assembly of the spectrin-actin lattice that underlies the plasma membrane (see OMIM Ref. No. also 182860 and 102560). Missense mutations in both the alpha- and beta-adducin genes that alter amino acids that are normally phosphorylated have been associated with the regulation of blood pressure in the Milan hypertensive strain (MHS) of rats (Bianchi et al., 1994). Muro et al. (2000) showed that in Add2 -/- mice, targeted disruption of the beta-adducin gene resulted in an 80% decrease of alpha-adducin and a 4-fold upregulation of gamma-adducin in erythrocytes. Elliptocytes, ovalocytes, and occasionally spherocytes were found in the blood smears of -/- mice. Mild hematologic findings were thought to be related to the amount of adducin remaining in the mutant animals (presumably alpha-gamma adducin).

Full details of the abovementioned studies are described in the following publications, the disclosure of which are hereby incorporated by reference:

Bianchi, G.; Tripodi, G.; Casari, G.; Salardi, S.; Barber, B. R.; Garcia, R.; Leoni, P.; Torielli, L.; Cusi, D.; Ferrandi, M.; Pinna, L. A.; Baralle, F. E.; Ferrari, P.: Two point mutations within the adducin genes are involved in blood pressure variation. Proc. Nat. Acad. Sci. 91:3999-4003, 1994; and Muro, A. F.; Marro, M. L.; Gajovic, S.; Porro, F.; Luzzatto, L.; Baralle, F. E.: Mild spherocytic hereditary elliptocytosis and altered levels of alpha- and gamma-adducins in beta-adduc.

Further studies establishing the function and utilities of ADD2 are found in John Hopkins OMIM database record ID 102681, and in cited publications listed in Table 5, which are hereby incorporated by reference. Adducin 2 (beta) (ADD2, Accession NP_001608.1) is another GAM69 target gene, herein designated TARGET GENE. ADD2 BINDING SITE is a target binding site found in the 3' untranslated region of multiple transcripts of mRNA encoded by ADD2, corresponding to a target binding site such as BINDING SITE I, BINDING SITE II or BINDING SITE III of FIG. 8. Table 4 illustrates the complementarity of the nucleotide sequences of ADD2 BINDING SITE, designated SEQ ID:12249, to the nucleotide sequence of GAM69 RNA, herein designated GAM RNA, also designated SEQ ID:258.

Another function of GAM69 is therefore inhibition of Adducin 2 (beta) (ADD2, Accession NP_001608.1), a gene which membrane-cytoskeleton-protein that promotes the assembly of the spectrin-actin network. Accordingly, utilities of GAM69 include diagnosis, prevention and treatment of diseases and clinical conditions associated with ADD2.

The function of ADD2 has been established by previous studies. See alpha-adducin (ADD1; 102680). Adducin is a heterodimeric calmodulin (OMIM Ref. No. 114180)-binding protein of the cell-membrane skeleton, which is thought to play a role in assembly of the spectrin-actin lattice that underlies the plasma membrane (see OMIM Ref. No. also 182860 and 102560). Missense mutations in both the alpha- and beta-adducin genes that alter amino acids that are normally phosphorylated have been associated with the regulation of blood pressure in the Milan hypertensive strain (MHS) of rats (Bianchi et al., 1994). Muro et al. (2000) showed that in Add2 -/- mice, targeted disruption of the beta-adducin gene resulted in an 80% decrease of alpha-adducin and a 4-fold upregulation of gamma-adducin in erythrocytes. Elliptocytes, ovalocytes, and occasionally spherocytes were found in the blood smears of -/- mice. Mild hematologic findings were thought to be related to the amount of adducin remaining in the mutant animals (presumably alpha-gamma adducin).

Full details of the abovementioned studies are described in the following publications, the disclosure of which are hereby incorporated by reference:

Bianchi, G.; Tripodi, G.; Casari, G.; Salardi, S.; Barber, B. R.; Garcia, R.; Leoni, P.; Torielli, L.; Cusi, D.; Ferrandi, M.; Pinna, L. A.; Baralle, F. E.; Ferrari, P.: Two point mutations within the adducin genes are involved in blood pressure variation. Proc. Nat. Acad. Sci. 91:3999-4003, 1994; and Muro, A. F.; Marro, M. L.; Gajovic, S.; Porro, F.; Luzzatto, L.; Baralle, F. E.: Mild spherocytic hereditary elliptocytosis and altered levels of alpha- and gamma-adducins in beta-adduc.

Further studies establishing the function and utilities of ADD2 are found in John Hopkins OMIM database record ID 102681, and in cited publications listed in Table 5, which are hereby incorporated by reference. Adducin 2 (beta) (ADD2, Accession NP_059517.1) is another GAM69 target gene, herein designated TARGET GENE. ADD2 BINDING SITE is a target binding site found in the 3' untranslated region of multiple transcripts of mRNA encoded by ADD2, corresponding to a target binding site such as BINDING SITE I, BINDING SITE II or BINDING SITE III of FIG. 8. Table 4 illustrates the complementarity of the nucleotide sequences of ADD2 BINDING SITE, designated SEQ ID:12249, to the nucleotide sequence of GAM69 RNA, herein designated GAM RNA, also designated SEQ ID:258.

Another function of GAM69 is therefore inhibition of Adducin 2 (beta) (ADD2, Accession NP_059517.1), a gene which membrane-cytoskeleton-protein that promotes the assembly of the spectrin-actin network. Accordingly, utilities of GAM69 include diagnosis, prevention and treatment of diseases and clinical conditions associated with ADD2.

The function of ADD2 has been established by previous studies. See alpha-adducin (ADD1; 102680). Adducin is a heterodimeric calmodulin (OMIM Ref. No. 114180)-binding protein of the cell-membrane skeleton, which is thought to play a role in assembly of the spectrin-actin lattice that underlies the plasma membrane (see OMIM Ref. No. also 182860 and 102560). Missense mutations in both the alpha- and beta-adducin genes that alter amino acids that are normally phosphorylated have been associated with the regulation of blood pressure in the Milan hypertensive strain (MHS) of rats (Bianchi et al., 1994). Muro et al. (2000) showed that in Add2 -/- mice, targeted disruption of the beta-adducin gene resulted in an 80% decrease of alpha-adducin and a 4-fold upregulation of gamma-adducin in erythrocytes. Elliptocytes, ovalocytes, and occasionally spherocytes were found in the blood smears of -/- mice. Mild hematologic findings were thought to be related to the amount of adducin remaining in the mutant animals (presumably alpha-gamma adducin).

Full details of the abovementioned studies are described in the following publications, the disclosure of which are hereby incorporated by reference:

Bianchi, G.; Tripodi, G.; Casari, G.; Salardi, S.; Barber, B. R.; Garcia, R.; Leoni, P.; Torielli, L.; Cusi, D.; Ferrandi, M.; Pinna, L. A.; Baralle, F. E.; Ferrari, P.: Two point mutations within the adducin genes are involved in blood pressure variation. Proc. Nat. Acad. Sci. 91:3999-4003, 1994; and Muro, A. F.; Marro, M. L.; Gajovic, S.; Porro, F.; Luzzatto, L.; Baralle, F. E.: Mild spherocytic hereditary elliptocytosis and altered levels of alpha- and gamma-adducins in beta-adduc.

Further studies establishing the function and utilities of ADD2 are found in John Hopkins OMIM database record ID 102681, and in cited publications listed in Table 5, which are hereby incorporated by reference. Adducin 2 (beta) (ADD2, Accession NP_059519.1) is another GAM69 target gene, herein designated TARGET GENE. ADD2 BINDING SITE is a target binding site found in the 3' untranslated region of multiple transcripts of mRNA encoded by ADD2, corresponding to a target binding site such as BINDING SITE I, BINDING SITE II or BINDING SITE III of FIG. 8. Table 4 illustrates the complementarity of the nucleotide sequences of ADD2 BINDING SITE, designated SEQ ID:12249, to the nucleotide sequence of GAM69 RNA, herein designated GAM RNA, also designated SEQ ID:258.

Another function of GAM69 is therefore inhibition of Adducin 2 (beta) (ADD2, Accession NP_059519.1), a gene which membrane-cytoskeleton-protein that promotes the assembly of the spectrin-actin network. Accordingly, utilities of GAM69 include diagnosis, prevention and treatment of diseases and clinical conditions associated with ADD2.

The function of ADD2 has been established by previous studies. See alpha-adducin (ADD1; 102680). Adducin is a heterodimeric calmodulin (OMIM Ref. No. 114180)-binding protein of the cell-membrane skeleton, which is thought to play a role in assembly of the spectrin-actin lattice that underlies the plasma membrane (see OMIM Ref. No. also 182860 and 102560). Missense mutations in both the alpha- and beta-adducin genes that alter amino acids that are normally phosphorylated have been associated with the regulation of blood pressure in the Milan hypertensive strain (MHS) of rats (Bianchi et al., 1994). Muro et al. (2000) showed that in Add2 -/- mice, targeted disruption of the beta-adducin gene resulted in an 80% decrease of alpha-adducin and a 4-fold upregulation of gamma-adducin in erythrocytes. Elliptocytes, ovalocytes, and occasionally spherocytes were found in the blood smears of -/- mice. Mild hematologic findings were thought to be related to the amount of adducin remaining in the mutant animals (presumably alpha-gamma adducin).

Full details of the abovementioned studies are described in the following publications, the disclosure of which are hereby incorporated by reference:

Bianchi, G.; Tripodi, G.; Casari, G.; Salardi, S.; Barber, B. R.; Garcia, R.; Leoni, P.; Torielli, L.; Cusi, D.; Ferrandi, M.; Pinna, L. A.; Baralle, F. E.; Ferrari, P.: Two point mutations within the adducin genes are involved in blood pressure variation. Proc. Nat. Acad. Sci. 91:3999-4003, 1994; and Muro, A. F.; Marro, M. L.; Gajovic, S.; Porro, F.; Luzzatto, L.; Baralle, F. E.: Mild spherocytic hereditary elliptocytosis and altered levels of alpha- and gamma-adducins in beta-adduc.

Further studies establishing the function and utilities of ADD2 are found in John Hopkins OMIM database record ID 102681, and in cited publications listed in Table 5, which are hereby incorporated by reference. Aquaporin 6, kidney specific (AQP6, Accession NP_445738.1) is another GAM69 target gene, herein designated TARGET GENE. AQP6 BINDING SITE is a target binding site found in the 5' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:5241, to the nucleotide sequence of GAM69 RNA, herein designated GAM RNA, also designated SEQ ID:258.

Another function of GAM69 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM69 include diagnosis, prevention and treatment of diseases and clinical conditions associated with AQP6.

The function of AQP6 and its association with various diseases and clinical conditions, has been established by previous studies, as described hereinabove with reference to GAM51.1. C10orf5 (Accession NP_848931.1) is another GAM69 target gene, herein designated TARGET GENE. C10orf5 BINDING SITE is a target binding site found in the 3' untranslated region of multiple transcripts of mRNA encoded by C10orf5, corresponding to a target binding site such as BINDING SITE I, BINDING SITE II or BINDING SITE III of FIG. 8. Table 4 illustrates the complementarity of the nucleotide sequences of C10orf5 BINDING SITE, designated SEQ ID:12344, to the nucleotide sequence of GAM69 RNA, herein designated GAM RNA, also designated SEQ ID:258.

Another function of GAM69 is therefore inhibition of C10orf5 (Accession NP_848931.1). Accordingly, utilities of GAM69 include diagnosis, prevention and treatment of diseases and clinical conditions associated with C10orf5.

C1orf38 (Accession NP_004839.1) is another GAM69 target gene, herein designated TARGET GENE. C1orf38 BINDING SITE is a target binding site found in the 3' untranslated region of mRNA encoded by C1orf38, corresponding to a target binding site such as BINDING SITE I, BINDING SITE II or BINDING SITE III of FIG. 8. Table 4 illustrates the complementarity of the nucleotide sequences of C1orf38 BINDING SITE, designated SEQ ID:17232, to the nucleotide sequence of GAM69 RNA, herein designated GAM RNA, also designated SEQ ID:258.

Another function of GAM69 is therefore inhibition of C1orf38 (Accession NP_004839.1). Accordingly, utilities of GAM69 include diagnosis, prevention and treatment of diseases and clinical conditions associated with C1orf38.

C1q and tumor necrosis factor related protein 7 (C1QTNF7, Accession NP_114117.1) is another GAM69 target gene, herein designated TARGET GENE. C1QTNF7 BINDING SITE is a target binding site found in the 3' untranslated region of mRNA encoded by C1QTNF7, corresponding to a target binding site such as BINDING SITE I, BINDING SITE II or BINDING SITE III of FIG. 8. Table 4 illustrates the complementarity of the nucleotide sequences of C1QTNF7 BINDING SITE, designated SEQ ID:6301, to the nucleotide sequence of GAM69 RNA, herein designated GAM RNA, also designated SEQ ID:258.

Another function of GAM69 is therefore inhibition of C1q and tumor necrosis factor related protein 7 (C1QTNF7, Accession NP_114117.1). Accordingly, utilities of GAM69 include diagnosis, prevention and treatment of diseases and clinical conditions associated with C1QTNF7.

Cyclin b1 (CCNB1, Accession NP_114172.1) is another GAM69 target gene, herein designated TARGET GENE. CCNB1 BINDING SITE is a target binding site found in the 5' untranslated region of mRNA encoded by CCNB1, corresponding to a target binding site such as BINDING SITE I, BINDING SITE II or BINDING SITE III of FIG. 8. Table 4 illustrates the complementarity of the nucleotide sequences of CCNB1 BINDING SITE, designated SEQ ID:4167, to the nucleotide sequence of GAM69 RNA, herein designated GAM RNA, also designated SEQ ID:258.

Another function of GAM69 is therefore inhibition of Cyclin b1 (CCNB1, Accession NP_114172.1), a gene which essential for the control of the cell cycle at the g2/m (mitosis) transition and may have developmental- and/or cell-type-specific functions. Accordingly, utilities of GAM69 include diagnosis, prevention and treatment of diseases and clinical conditions associated with CCNB1.

The function of CCNB1 has been established by previous studies. Pines and Hunter (1989) reported the nucleotide and predicted amino acid sequence of a human B-type cyclin. The gene is expressed predominantly in the G2/M phase of cell division. The gene product complexes with p34(cdc2) to form the mitosis-promoting factor (MPF). By genetic mapping in the mouse using human cyclin B1 probes, Lock et al. (1992) identified 10 cyclin B1-related sequences located on chromosomes 4, 5, 7, 8, 13, 14, 15, and 17. In Northern analysis, 3 cyclin B1-related transcripts of 1.7, 2.1, and 2.7 kb were detected in embryonic stem cells and postimplantation embryos from day 9.5 to 15.5 of development. The multiple cyclin B1-related sequences in the mouse genome and the multiple cyclin B1 mRNAs raised the possibility that the seemingly redundant cyclin B genes may have developmental- and/or cell-type-specific functions.

Animal model experiments lend further support to the function of CCNB1. Two B-type cyclins, B1 and B2 (OMIM Ref. No. 602755), have been identified in mammals. Proliferating cells express both cyclins, which bind to and activate p34 (CDC2). To test whether the 2 B-type cyclins have distinct roles, Brandeis et al. (1998) generated lines of transgenic mice, one lacking cyclin B1 and the other lacking B2. Cyclin B1 proved to be an essential gene; no homozygous B1-null pups were born. In contrast, nullizygous B2 mice developed normally and did not display any obvious abnormalities. Both male and female cyclin B2-null mice were fertile, which was unexpected in view of the high levels and distinct patterns of expression of cyclin B2 during spermatogenesis. Brandeis et al. (1998) showed that the expression of cyclin B1 overlaps the expression of cyclin B2 in the mature testis, but not vice versa. Cyclin B1 can be found both on intracellular membranes and free in the cytoplasm, in contrast to cyclin B2, which is membrane-associated. These observations suggested that cyclin B1 may compensate for the loss of cyclin B2 in the mutant mice, and implies that cyclin B1 is capable of targeting the p34(CDC2) kinase to the essential substrates of cyclin B2.

It is appreciated that the abovementioned animal model for CCNB1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lock, L. F.; Pines, J.; Hunter, T.; Gilbert, D. J.; Gopalan, G.; Jenkins, N. A.; Copeland, N. G.; Donovan, P. J.: A single cyclin A gene and multiple cyclin B1-related sequences are dispersed in the mouse genome. Genomics 13:415-424, 1992; and Brandeis, M.; Rosewell, I.; Carrington, M.; Crompton, T.; Jacobs, M. A.; Kirk, J.; Gannon, J.; Hunt, T.: Cyclin B2-null mice develop normally and are fertile whereas cyclin B1-null mice.

Further studies establishing the function and utilities of CCNB1 are found in John Hopkins OMIM database record ID 123836, and in cited publications listed in Table 5, which are hereby incorporated by reference. Calponin 1, basic, smooth muscle (CNN1, Accession NP_001290.2) is another GAM69 target gene, herein designated TARGET GENE. CNN1 BINDING SITE is a target binding site found in the 5' untranslated region of mRNA encoded by CNN1, corresponding to a target binding site such as BINDING SITE I, BINDING SITE II or BINDING SITE III of FIG. 8. Table 4 illustrates the complementarity of the nucleotide sequences of CNN1 BINDING SITE, designated SEQ ID:462, to the nucleotide sequence of GAM69 RNA, herein designated GAM RNA, also designated SEQ ID:258.

Another function of GAM69 is therefore inhibition of Calponin 1, basic, smooth muscle (CNN1, Accession NP_001290.2), a gene which is able to inhibit the ATPase activity of myosin and may play a role in smooth muscle contraction. Accordingly, utilities of GAM69 include diagnosis, prevention and treatment of diseases and clinical conditions associated with CNN1.

The function of CNN1 has been established by previous studies. Calponin is a basic 34-kD protein first isolated from chicken gizzard and bovine aorta. It is specifically expressed in smooth muscle and binds calmodulin, actin, and tropomyosin. It is able to inhibit the ATPase activity of myosin and is thought to play a role in smooth muscle contraction. Strasser et al. (1993) isolated 2 similar calponins (h1 and h2) from both mouse and pig. These are the products of separate loci. Northern blots of mouse uterus RNA indicated that h1 transcripts are about 10-fold higher than those of the h2 gene Maguchi et al. (1995) isolated a human cDNA encoding calponin h1 (CNN1) by screening an aorta cDNA library with a rat h1 cDNA. The 297-amino acid CNN1 contains a motif that is tandemly repeated 3 times. The N terminus of CNN1 is markedly basic and highly homologous to that of CNN3 (OMIM Ref. No. 602374). CNN1 has a predicted pI of 9.4. Northern blot analysis of RNA from human tissues showed that CNN1 is specifically expressed in smooth muscle Full details of the abovementioned studies are described in the following publications, the disclosure of which are hereby incorporated by reference:

Strasser, P.; Gimona, M.; Moessler, H.; Herzog, M.; Small, J. V.: Mammalian calponin: identification and expression of genetic variants. FEBS Lett. 330:13-18, 1993; and Maguchi, M.; Nishida, W.; Kohara, K.; Kuwano, A.; Kondo, I.; Hiwada, K.: Molecular cloning and gene mapping of human basic and acidic calponins. Biochem. Biophys. Res. Commun. 217:238.

Further studies establishing the function and utilities of CNN1 are found in John Hopkins OMIM database record ID 600806, and in cited publications listed in Table 5, which are hereby incorporated by reference. Collagen, type xi, alpha 2 (COL11A2, Accession NP_542412.1) is another GAM69 target gene, herein designated TARGET GENE. COL11A2 BINDING SITE is a target binding site found in the 5' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:1273, to the nucleotide sequence of GAM69 RNA, herein designated GAM RNA, also designated SEQ ID:258.

Another function of GAM69 is therefore inhibition of Collagen, type xi, alpha 2 (COL11A2, Accession NP_542412.1). Accordingly, utilities of GAM69 include diagnosis, prevention and treatment of diseases and clinical conditions associated with COL11A2.

Collagen, type xi, alpha 2 (COL11A2, Accession NP_542410.1) is another GAM69 target gene, herein designated TARGET GENE. COL11A2 BINDING SITE is a target binding site found in the 5' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:1273, to the nucleotide sequence of GAM69 RNA, herein designated GAM RNA, also designated SEQ ID:258.

Another function of GAM69 is therefore inhibition of Collagen, type xi, alpha 2 (COL11A2, Accession NP_542410.1). Accordingly, utilities of GAM69 include diagnosis, prevention and treatment of diseases and clinical conditions associated with COL11A2.

Collagen, type xi, alpha 2 (COL11A2, Accession NP_542411.1) is another GAM69 target gene, herein designated TARGET GENE. COL11A2 BINDING SITE is a target binding site found in the 5' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:1273, to the nucleotide sequence of GAM69 RNA, herein designated GAM RNA, also designated SEQ ID:258.

Another function of GAM69 is therefore inhibition of Collagen, type xi, alpha 2 (COL11A2, Accession NP_542411.1). Accordingly, utilities of GAM69 include diagnosis, prevention and treatment of diseases and clinical conditions associated with COL11A2.

Cathepsin e (CTSE, Accession NP_001901.1) is another GAM69 target gene, herein designated TARGET GENE. CTSE BINDING SITE is a target binding site found in the 3' untranslated region of multiple transcripts of mRNA encoded by CTSE, corresponding to a target binding site such as BINDING SITE I, BINDING SITE II or BINDING SITE III of FIG. 8. Table 4 illustrates the complementarity of the nucleotide sequences of CTSE BINDING SITE, designated SEQ ID:11615, to the nucleotide sequence of GAM69 RNA, herein designated GAM RNA, also designated SEQ ID:258.

Another function of GAM69 is therefore inhibition of Cathepsin e (CTSE, Accession NP_001901.1). Accordingly, utilities of GAM69 include diagnosis, prevention and treatment of diseases and clinical conditions associated with CTSE.

Cytochrome p450, subfamily xxia (steroid 21-hydroxylase, congenital adrenal hyperplasia), polypeptide 2 (CYP21A2, Accession NP_000491.2) is another GAM69 target gene, herein designated TARGET GENE. CYP21A2 BINDING SITE is a target binding site found in the 5' untranslated region of mRNA encoded by CYP21A2, corresponding to a target binding site such as BINDING SITE I, BINDING SITE II or BINDING SITE III of FIG. 8. Table 4 illustrates the complementarity of the nucleotide sequences of CYP21A2 BINDING SITE, designated SEQ ID:4412, to the nucleotide sequence of GAM69 RNA, herein designated GAM RNA, also designated SEQ ID:258.

Another function of GAM69 is therefore inhibition of Cytochrome p450, subfamily xxia (steroid 21-hydroxylase, congenital adrenal hyperplasia), polypeptide 2 (CYP21A2, Accession NP_000491.2), a gene which mediates in cortisol biosynthesis. and therefore is associated with Congenital adrenal hyperplasia (cah). Accordingly, utilities of GAM69 include diagnosis, prevention and treatment of Congenital adrenal hyperplasia (cah), and of other diseases and clinical conditions associated with CYP21A2.

The function of CYP21A2 has been established by previous studies. Slominski et al. (1996) presented evidence that the CYP21A2, CYP11A1 (OMIM Ref. No. 118485), CYP17 (OMIM Ref. No. 202110), and ACTHR (OMIM Ref. No. 202200) genes are expressed in skin (see OMIM Ref. No. 202200). The authors suggested that expression of these genes may play a role in skin physiology and pathology and that cutaneous proopiomelanocortin activity may be autoregulated by a feedback mechanism involving glucocorticoids synthesized locally. Thilen and Larsson (1990) performed a retrospective study of all Swedish patients with CAH born between 1969 and 1986, to determine possible benefits of neonatal screening. Information was obtained concerning 67 males and 83 females. Of these, 143 were regarded as classic and 7 as nonclassic (symptoms after 5 years of age or cryptic). All but 2 (a girl with 11-hydroxylase deficiency and a boy with beta-hydroxysteroid dehydrogenase deficiency) had 21-hydroxylase deficiency. The prevalence was 1 in 11,500. Salt loss was displayed by 93 patients (48 male, 45 female), all before the age of 3 months. The median age at diagnosis for boys in this group was 21 days. Gender assignment was a major problem in 38 of 57 girls, with ambiguous genitalia noticed at birth. Of these girls, 15 were considered to be male before the diagnosis of CAH was made. In a similar study in Kuwait, Lubani et al. (1990) found 60 children with CAH diagnosed between 1978 and 1988, giving an estimated prevalence of 1 in 9,000 live births. In addition, there was presumptive evidence of CAH resulting in the death of 20 other children, giving a prevalence figure of 1 in 7,000. In 54 patients (90%), 21-hydroxylase deficiency was diagnosed; in 3 patients each, the diagnosis was 3- beta-hydroxysteroid dehydrogenase deficiency and 11-beta-hydroxylase deficiency.

Animal model experiments lend further support to the function of CYP21A2. In the mouse, Chaplin et al. (1986) showed that only one of the two 21-hydroxylase genes is expressed. The authors presented the complete primary structure of both 21-hydroxylase encoding genes. The active gene in the mouse is referred to as A, whereas in man it is referred to as B. In the mouse, Chaplin et al. (1986) found a deletion of 215 nucleotides spanning the second exon in the 21-hydroxylase B gene; other nucleotide changes introduced frameshifts and premature termination codons. A hybrid gene composed of the 21-hydroxylase B promoter placed 5-prime of the 21-hydroxylase A structural sequences was efficiently transcribed following transfection into adrenocortical tumor cells. These findings demonstrated that the lack of expression was due to mutations within the 21-hydroxylase B structural gene and not due to a defect of the promoter. In the human, the CA21HA gene is a pseudogene (OMIM Ref. No. 184754) and the nature of the gene deletions that prevent expression is different from that in the mouse. Specifically, the 21-hydroxylase A gene has an 8-base deletion within the third exon, introducing a premature termination codon (White et al., 1986; Higashi et al., 1986). See review by White et al. (1987).

It is appreciated that the abovementioned animal model for CYP21A2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Slominski, A.; Ermak, G.; Mihm, M.: ACTH receptor, CYP11A1, CYP17 and CYP21A2 genes are expressed in skin. J. Clin. Endocr. Metab. 81:2746-2749, 1996; and Thilen, A.; Larsson, A.: Congenital adrenal hyperplasia in Sweden 1969-1986: prevalence, symptoms and age at diagnosis. Acta Paediat. Scand. 79:168-175, 1990.

Further studies establishing the function and utilities of CYP21A2 are found in John Hopkins OMIM database record ID 201910, and in cited publications listed in Table 5, which are hereby incorporated by reference. D13S106E (Accession NP_005791.2) is another GAM69 target gene, herein designated TARGET GENE. D13S106E BINDING SITE is a target binding site found in the 5' untranslated region of mRNA encoded by D13S106E, corresponding to a target binding site such as BINDING SITE I, BINDING SITE II or BINDING SITE III of FIG. 8. Table 4 illustrates the complementarity of the nucleotide sequences of D13S106E BINDING SITE, designated SEQ ID:16482, to the nucleotide sequence of GAM69 RNA, herein designated GAM RNA, also designated SEQ ID:258.

Another function of GAM69 is therefore inhibition of D13S106E (Accession NP_005791.2). Accordingly, utilities of GAM69 include diagnosis, prevention and treatment of diseases and clinical conditions associated with D13S106E.

DKFZp547A023 (Accession NP_061174.1) is another GAM69 target gene, herein designated TARGET GENE. DKFZp547A023 BINDING SITE is a target binding site found in the 3' untranslated region of mRNA encoded by DKFZp547A023, corresponding to a target binding site such as BINDING SITE I, BINDING SITE II or BINDING SITE III of FIG. 8. Table 4 illustrates the complementarity of the nucleotide sequences of DKFZp547A023 BINDING SITE, designated SEQ ID:12565, to the nucleotide sequence of GAM69 RNA, herein designated GAM RNA, also designated SEQ ID:258.

Another function of GAM69 is therefore inhibition of DKFZp547A023 (Accession NP_061174.1). Accordingly, utilities of GAM69 include diagnosis, prevention and treatment of diseases and clinical conditions associated with DKFZp547A023.

DKFZp761K1423 (Accession NP_060892.1) is another GAM69 target gene, herein designated TARGET GENE. DKFZp761K1423 BINDING SITE is a target binding site found in the 5' untranslated region of mRNA encoded by DKFZp761K1423, corresponding to a target binding site such as BINDING SITE I, BINDING SITE II or BINDING SITE III of FIG. 8. Table 4 illustrates the complementarity of the nucleotide sequences of DKFZp761K1423 BINDING SITE, designated SEQ ID:9816, to the nucleotide sequence of GAM69 RNA, herein designated GAM RNA, also designated SEQ ID:258.

Another function of GAM69 is therefore inhibition of DKFZp761K1423 (Accession NP_060892.1). Accordingly, utilities of GAM69 include diagnosis, prevention and treatment of diseases and clinical conditions associated with DKFZp761K1423.

DMN (Accession NP_663780.1) is another GAM69 target gene, herein designated TARGET GENE. DMN BINDING SITE is a target binding site found in the 5' untranslated region of multiple transcripts of mRNA encoded by DMN, corresponding to a target binding site such as BINDING SITE I, BINDING SITE II or BINDING SITE III of FIG. 8. Table 4 illustrates the complementarity of the nucleotide sequences of DMN BINDING SITE, designated SEQ ID:12222, to the nucleotide sequence of GAM69 RNA, herein designated GAM RNA, also designated SEQ ID:258.

Another function of GAM69 is therefore inhibition of DMN (Accession NP_663780.1), a gene which may participate in maintaining muscle cell integrity. Accordingly, utilities of GAM69 include diagnosis, prevention and treatment of diseases and clinical conditions associated with DMN.

The function of DMN and its association with various diseases and clinical conditions, has been established by previous studies, as described hereinabove with reference to GAM66.2. DMN (Accession NP_056101.4) is another GAM69 target gene, herein designated TARGET GENE. DMN BINDING SITE is a target binding site found in the 5' untranslated region of multiple transcripts of mRNA encoded by DMN, corresponding to a target binding site such as BINDING SITE I, BINDING SITE II or BINDING SITE III of FIG. 8. Table 4 illustrates the complementarity of the nucleotide sequences of DMN BINDING SITE, designated SEQ ID:12222, to the nucleotide sequence of GAM69 RNA, herein designated GAM RNA, also designated SEQ ID:258.

Another function of GAM69 is therefore inhibition of DMN (Accession NP_056101.4), a gene which may participate in maintaining muscle cell integrity. Accordingly, utilities of GAM69 include diagnosis, prevention and treatment of diseases and clinical conditions associated with DMN.

The function of DMN and its association with various diseases and clinical conditions, has been established by previous studies, as described hereinabove with reference to GAM66.2. Docking protein 4 (DOK4, Accession NP_060580.2) is another GAM69 target gene, herein designated TARGET GENE. DOK4 BINDING SITE is a target binding site found in the 3' untranslated region of mRNA encoded by DOK4, corresponding to a target binding site such as BINDING SITE I, BINDING SITE II or BINDING SITE III of FIG. 8. Table 4 illustrates the complementarity of the nucleotide sequences of DOK4 BINDING SITE, designated SEQ ID:2501, to the nucleotide sequence of GAM69 RNA, herein designated GAM RNA, also designated SEQ ID:258.

Another function of GAM69 is therefore inhibition of Docking protein 4 (DOK4, Accession NP_060580.2). Accordingly, utilities of GAM69 include diagnosis, prevention and treatment of diseases and clinical conditions associated with DOK4.

Fibroblast growth factor 18 (FGF18, Accession NP_003853.1) is another GAM69 target gene, herein designated TARGET GENE. FGF18 BINDING SITE is a target binding site found in the 5' untranslated region of multiple transcripts of mRNA encoded by FGF18, corresponding to a target binding site such as BINDING SITE I, BINDING SITE II or BINDING SITE III of FIG. 8. Table 4 illustrates the complementarity of the nucleotide sequences of FGF18 BINDING SITE, designated SEQ ID:14981, to the nucleotide sequence of GAM69 RNA, herein designated GAM RNA, also designated SEQ ID:258.

Another function of GAM69 is therefore inhibition of Fibroblast growth factor 18 (FGF18, Accession NP_003853.1), a gene which stimulates hepatic and intestinal proliferation. Accordingly, utilities of GAM69 include diagnosis, prevention and treatment of diseases and clinical conditions associated with FGF18.

The function of FGF18 and its association with various diseases and clinical conditions, has been established by previous studies, as described hereinabove with reference to GAM49.1. Fibroblast growth factor 18 (FGF18, Accession NP_387498.1) is another GAM69 target gene, herein designated TARGET GENE. FGF18 BINDING SITE is a target binding site found in the 5' untranslated region of multiple transcripts of mRNA encoded by FGF18, corresponding to a target binding site such as BINDING SITE I, BINDING SITE II or BINDING SITE III of FIG. 8. Table 4 illustrates the complementarity of the nucleotide sequences of FGF18 BINDING SITE, designated SEQ ID:14981, to the nucleotide sequence of GAM69 RNA, herein designated GAM RNA, also designated SEQ ID:258.

Another function of GAM69 is therefore inhibition of Fibroblast growth factor 18 (FGF18, Accession NP_387498.1), a gene which stimulates hepatic and intestinal proliferation. Accordingly, utilities of GAM69 include diagnosis, prevention and treatment of diseases and clinical conditions associated with FGF18.

The function of FGF18 and its association with various diseases and clinical conditions, has been established by previous studies, as described hereinabove with reference to GAM49.1. FLJ10420 (Accession NP_060560.1) is another GAM69 target gene, herein designated TARGET GENE. FLJ10420 BINDING SITE is a target binding site found in the 3' untranslated region of mRNA encoded by FLJ10420, corresponding to a target binding site such as BINDING SITE I, BINDING SITE II or BINDING SITE III of FIG. 8. Table 4 illustrates the complementarity of the nucleotide sequences of FLJ10420 BINDING SITE, designated SEQ ID:6374, to the nucleotide sequence of GAM69 RNA, herein designated GAM RNA, also designated SEQ ID:258.

Another function of GAM69 is therefore inhibition of FLJ10420 (Accession NP_060560.1). Accordingly, utilities of GAM69 include diagnosis, prevention and treatment of diseases and clinical conditions associated with FLJ10420.

FLJ13189 (Accession NP_079158.1) is another GAM69 target gene, herein designated TARGET GENE. FLJ13189 BINDING SITE1 and FLJ13189 BINDING SITE2 are target binding sites found in untranslated regions of mRNA encoded by FLJ13189, corresponding to target binding sites such as BINDING SITE I, BINDING SITE II or BINDING SITE III of FIG. 8. Table 4 illustrates the complementarity of the nucleotide sequences of FLJ13189 BINDING SITE1 and FLJ13189 BINDING SITE2, designated SEQ ID:5952 and SEQ ID:7088 respectively, to the nucleotide sequence of GAM69 RNA, herein designated GAM RNA, also designated SEQ ID:258.

Another function of GAM69 is therefore inhibition of FLJ13189 (Accession NP_079158.1). Accordingly, utilities of GAM69 include diagnosis, prevention and treatment of diseases and clinical conditions associated with FLJ13189.

FLJ21369 (Accession NP_079078.1) is another GAM69 target gene, herein designated TARGET GENE. FLJ21369 BINDING SITE is a target binding site found in the 3' untranslated region of mRNA encoded by FLJ21369, corresponding to a target binding site such as BINDING SITE I, BINDING SITE II or BINDING SITE III of FIG. 8. Table 4 illustrates the complementarity of the nucleotide sequences of FLJ21369 BINDING SITE, designated SEQ ID:15599, to the nucleotide sequence of GAM69 RNA, herein designated GAM RNA, also designated SEQ ID:258.

Another function of GAM69 is therefore inhibition of FLJ21369 (Accession NP_079078.1). Accordingly, utilities of GAM69 include diagnosis, prevention and treatment of diseases and clinical conditions associated with FLJ21369.

FLJ22843 (Accession NP_079460.2) is another GAM69 target gene, herein designated TARGET GENE. FLJ22843 BINDING SITE is a target binding site found in the 5' untranslated region of mRNA encoded by FLJ22843, corresponding to a target binding site such as BINDING SITE I, BINDING SITE II or BINDING SITE III of FIG. 8. Table 4 illustrates the complementarity of the nucleotide sequences of FLJ22843 BINDING SITE, designated SEQ ID:1721, to the nucleotide sequence of GAM69 RNA, herein designated GAM RNA, also designated SEQ ID:258.

Another function of GAM69 is therefore inhibition of FLJ22843 (Accession NP_079460.2). Accordingly, utilities of GAM69 include diagnosis, prevention and treatment of diseases and clinical conditions associated with FLJ22843.

FLJ23462 (Accession NP_079119.2) is another GAM69 target gene, herein designated TARGET GENE. FLJ23462 BINDING SITE is a target binding site found in the 3' untranslated region of mRNA encoded by FLJ23462, corresponding to a target binding site such as BINDING SITE I, BINDING SITE II or BINDING SITE III of FIG. 8. Table 4 illustrates the complementarity of the nucleotide sequences of FLJ23462 BINDING SITE, designated SEQ ID:10577, to the nucleotide sequence of GAM69 RNA, herein designated GAM RNA, also designated SEQ ID:258.

Another function of GAM69 is therefore inhibition of FLJ23462 (Accession NP_079119.2). Accordingly, utilities of GAM69 include diagnosis, prevention and treatment of diseases and clinical conditions associated with FLJ23462.

FLJ32214 (Accession NP_689686.1) is another GAM69 target gene, herein designated TARGET GENE. FLJ32214 BINDING SITE is a target binding site found in the 5' untranslated region of mRNA encoded by FLJ32214, corresponding to a target binding site such as BINDING SITE I, BINDING SITE II or BINDING SITE III of FIG. 8. Table 4 illustrates the complementarity of the nucleotide sequences of FLJ32214 BINDING SITE, designated SEQ ID:9977, to the nucleotide sequence of GAM69 RNA, herein designated GAM RNA, also designated SEQ ID:258.

Another function of GAM69 is therefore inhibition of FLJ32214 (Accession NP_689686.1). Accordingly, utilities of GAM69 include diagnosis, prevention and treatment of diseases and clinical conditions associated with FLJ32214.

FLJ32915 (Accession NP_659451.1) is another GAM69 target gene, herein designated TARGET GENE. FLJ32915 BINDING SITE is a target binding site found in the 5' untranslated region of mRNA encoded by FLJ32915, corresponding to a target binding site such as BINDING SITE I, BINDING SITE II or BINDING SITE III of FIG. 8. Table 4 illustrates the complementarity of the nucleotide sequences of FLJ32915 BINDING SITE, designated SEQ ID:18785, to the nucleotide sequence of GAM69 RNA, herein designated GAM RNA, also designated SEQ ID:258.

Another function of GAM69 is therefore inhibition of FLJ32915 (Accession NP_659451.1). Accordingly, utilities of GAM69 include diagnosis, prevention and treatment of diseases and clinical conditions associated with FLJ32915.

FLJ35989 (Accession NP_689810.2) is another GAM69 target gene, herein designated TARGET GENE. FLJ35989 BINDING SITE is a target binding site found in the 5' untranslated region of mRNA encoded by FLJ35989, corresponding to a target binding site such as BINDING SITE I, BINDING SITE II or BINDING SITE III of FIG. 8. Table 4 illustrates the complementarity of the nucleotide sequences of FLJ35989 BINDING SITE, designated SEQ ID:8320, to the nucleotide sequence of GAM69 RNA, herein designated GAM RNA, also designated SEQ ID:258.

Another function of GAM69 is therefore inhibition of FLJ35989 (Accession NP_689810.2). Accordingly, utilities of GAM69 include diagnosis, prevention and treatment of diseases and clinical conditions associated with FLJ35989.

FLJ90231 (Accession NP_775852.1) is another GAM69 target gene, herein designated TARGET GENE. FLJ90231 BINDING SITE1 and FLJ90231 BINDING SITE2 are target binding sites found in untranslated regions of mRNA encoded by FLJ90231, corresponding to target binding sites such as BINDING SITE I, BINDING SITE II or BINDING SITE III of FIG. 8. Table 4 illustrates the complementarity of the nucleotide sequences of FLJ90231 BINDING SITE1 and FLJ90231 BINDING SITE2, designated SEQ ID:14227 and SEQ ID:8670 respectively, to the nucleotide sequence of GAM69 RNA, herein designated GAM RNA, also designated SEQ ID:258.

Another function of GAM69 is therefore inhibition of FLJ90231 (Accession NP_775852.1). Accordingly, utilities of GAM69 include diagnosis, prevention and treatment of diseases and clinical conditions associated with FLJ90231.

Gamma-aminobutyric acid (gaba) b receptor, 1 (GABBR1, Accession NP_068705.1) is another GAM69 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:3948, to the nucleotide sequence of GAM69 RNA, herein designated GAM RNA, also designated SEQ ID:258.

Another function of GAM69 is therefore inhibition of Gamma-aminobutyric acid (gaba) b receptor, 1 (GABBR1, Accession NP_068705.1). Accordingly, utilities of GAM69 include diagnosis, prevention and treatment of diseases and clinical conditions associated with GABBR1.

Growth arrest-specific 2 like 1 (GAS2L1, Accession NP_689423.1) is another GAM69 target gene, herein designated TARGET GENE. GAS2L1 BINDING SITE is a target binding site found in the 3' untranslated region of multiple transcripts of mRNA encoded by GAS2L1, corresponding to a target binding site such as BINDING SITE I, BINDING SITE II or BINDING SITE III of FIG. 8. Table 4 illustrates the complementarity of the nucleotide sequences of GAS2L1 BINDING SITE, designated SEQ ID:14222, to the nucleotide sequence of GAM69 RNA, herein designated GAM RNA, also designated SEQ ID:258.

Another function of GAM69 is therefore inhibition of Growth arrest-specific 2 like 1 (GAS2L1, Accession NP_689423.1). Accordingly, utilities of GAM69 include diagnosis, prevention and treatment of diseases and clinical conditions associated with GAS2L1.

HAK (Accession NP_443179.1) is another GAM69 target gene, herein designated TARGET GENE. HAK BINDING SITE is a target binding site found in the 5' untranslated region of mRNA encoded by HAK, corresponding to a target binding site such as BINDING SITE I, BINDING SITE II or BINDING SITE III of FIG. 8. Table 4 illustrates the complementarity of the nucleotide sequences of HAK BINDING SITE, designated SEQ ID:10217, to the nucleotide sequence of GAM69 RNA, herein designated GAM RNA, also designated SEQ ID:258.

Another function of GAM69 is therefore inhibition of HAK (Accession NP_443179.1). Accordingly, utilities of GAM69 include diagnosis, prevention and treatment of diseases and clinical conditions associated with HAK.

Heart and neural crest derivatives expressed 1 (HAND1, Accession NP_004812.1) is another GAM69 target gene, herein designated TARGET GENE. HAND1 BINDING SITE is a target binding site found in the 3' untranslated region of mRNA encoded by HAND1, corresponding to a target binding site such as BINDING SITE I, BINDING SITE II or BINDING SITE III of FIG. 8. Table 4 illustrates the complementarity of the nucleotide sequences of HAND1 BINDING SITE, designated SEQ ID:12355, to the nucleotide sequence of GAM69 RNA, herein designated GAM RNA, also designated SEQ ID:258.

Another function of GAM69 is therefore inhibition of Heart and neural crest derivatives expressed 1 (HAND1, Accession NP_004812.1). Accordingly, utilities of GAM69 include diagnosis, prevention and treatment of diseases and clinical conditions associated with HAND1.

Hepatocyte nuclear factor 4, alpha (HNF4A, Accession NP_849180.1) is another GAM69 target gene, herein designated TARGET GENE. HNF4A BINDING SITE is a target binding site found in the 3' untranslated region of multiple transcripts of mRNA encoded by HNF4A, corresponding to a target binding site such as BINDING SITE I, BINDING SITE II or BINDING SITE III of FIG. 8. Table 4 illustrates the complementarity of the nucleotide sequences of HNF4A BINDING SITE, designated SEQ ID:15282, to the nucleotide sequence of GAM69 RNA, herein designated GAM RNA, also designated SEQ ID:258.

Another function of GAM69 is therefore inhibition of Hepatocyte nuclear factor 4, alpha (HNF4A, Accession NP_849180.1), a gene which may be essential for development of the liver, kidney, pancreas and intestine. and therefore may be associated with Type i maturity-onset diabetes of the young. Accordingly, utilities of GAM69 include diagnosis, prevention and treatment of Type i maturity-onset diabetes of the young, and of other diseases and clinical conditions associated with HNF4A.

The function of HNF4A has been established by previous studies. Stoffel and Duncan (1997) investigated the molecular mechanism by which the Q268X mutation, which deletes 187 C-terminal amino acids of the HNF4-alpha protein, causes diabetes. They showed that the mutant gene product had lost its transcriptional transactivation activity and failed to dimerize and bind DNA, implying that the MODY1 phenotype is due to a loss of HFN4-alpha function. The effect of loss of function on expression of HNF4-alpha target genes was investigated further in embryonic stem cells, which are amenable to genetic manipulation and can be induced to form visceral endoderm. Because the visceral endoderm shares many properties with the liver and pancreatic beta-cells, including expression of genes for glucose transport and metabolism, it offers an ideal system to investigate HNF4-dependent gene regulation in glucose homeostasis. With this approach, Stoffel and Duncan (1997) identified several genes encoding components of the glucose-dependent insulin secretion pathway whose expression is dependent upon HNF4-alpha. These included glucose transporter 2 (OMIM Ref. No. 138160), and the glycolytic enzymes aldolase B (OMIM Ref. No. 229600) and glyceraldehyde-3-phosphate dehydrogenase (OMIM Ref. No. 138400), and liver pyruvate kinase (OMIM Ref. No. 266200). In addition, they found that expression of the fatty acid binding proteins and cellular retinol binding protein also are downregulated in the absence of HNF4-alpha. These data provided direct evidence that HNF4-alpha is critical for regulating glucose transport and glycolysis and in doing so is critical for maintaining glucose homeostasis.

Animal model experiments lend further support to the function of HNF4A. To study the contribution of HNF4A to hepatic development and differentiation, Li et al. (2000) used a technique in which Hnf4a -/-mouse embryos were complemented with wildtype visceral endoderm to counteract early embryonic lethality. By histologic analyses, the authors found that specification and early development of the liver and liver morphology did not require Hnf4a. In addition, the expression of many liver genes was unaffected in these mice. However, RT-PCR analysis showed that Hnf4a -/-fetal livers failed to express a large array of genes whose expression in differentiated hepatocytes is essential for a functional hepatic parenchyma, including apolipoproteins (e.g., APOA1; 107680), metabolic proteins (e.g., aldolase B; 229600), transferrin (OMIM Ref. No. 190000), retinol-binding protein (e.g., RBP4; 180250), and erythropoietin (OMIM Ref. No. 133170). The lack of Hnf4a did not affect the expression of most transcription factors but did significantly reduce the levels of Hnf1a (TCF1; 142410) and the pregnane X receptor (NR1I2; 603065), suggesting that HNF4A acts upstream of at least these 2 transcription factors, which are also important in hepatocyte gene expression.

It is appreciated that the abovementioned animal model for HNF4A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, J.; Ning, G.; Duncan, S. A.: Mammalian hepatocyte differentiation requires the transcription factor HNF-4-alpha. Genes Dev. 14:464-474, 2000; and Stoffel, M.; Duncan, S. A.: The maturity-onset diabetes of the young (MODY1) transcription factor HNF4-alpha regulates expression of genes required for glucose transport and metabolism. P.

Further studies establishing the function and utilities of HNF4A are found in John Hopkins OMIM database record ID 600281, and in cited publications listed in Table 5, which are hereby incorporated by reference. Hepatocyte nuclear factor 4, alpha (HNF4A, Accession NP_000448.3) is another GAM69 target gene, herein designated TARGET GENE.

HNF4A BINDING SITE is a target binding site found in the 3' untranslated region of multiple transcripts of mRNA encoded by HNF4A, corresponding to a target binding site such as BINDING SITE I, BINDING SITE II or BINDING SITE III of FIG. 8. Table 4 illustrates the complementarity of the nucleotide sequences of HNF4A BINDING SITE, designated SEQ ID:15282, to the nucleotide sequence of GAM69 RNA, herein designated GAM RNA, also designated SEQ ID:258.

Another function of GAM69 is therefore inhibition of Hepatocyte nuclear factor 4, alpha (HNF4A, Accession NP_000448.3), a gene which may be essential for development of the liver, kidney, pancreas and intestine. and therefore may be associated with Type i maturity-onset diabetes of the young. Accordingly, utilities of GAM69 include diagnosis, prevention and treatment of Type i maturity-onset diabetes of the young, and of other diseases and clinical conditions associated with HNF4A.

The function of HNF4A has been established by previous studies. Stoffel and Duncan (1997) investigated the molecular mechanism by which the Q268X mutation, which deletes 187 C-terminal amino acids of the HNF4-alpha protein, causes diabetes. They showed that the mutant gene product had lost its transcriptional transactivation activity and failed to dimerize and bind DNA, implying that the MODY1 phenotype is due to a loss of HFN4-alpha function. The effect of loss of function on expression of HNF4-alpha target genes was investigated further in embryonic stem cells, which are amenable to genetic manipulation and can be induced to form visceral endoderm. Because the visceral endoderm shares many properties with the liver and pancreatic beta-cells, including expression of genes for glucose transport and metabolism, it offers an ideal system to investigate HNF4-dependent gene regulation in glucose homeostasis. With this approach, Stoffel and Duncan (1997) identified several genes encoding components of the glucose-dependent insulin secretion pathway whose expression is dependent upon HNF4-alpha. These included glucose transporter 2 (OMIM Ref. No. 138160), and the glycolytic enzymes aldolase B (OMIM Ref. No. 229600) and glyceraldehyde-3-phosphate dehydrogenase (OMIM Ref. No. 138400), and liver pyruvate kinase (OMIM Ref. No. 266200). In addition, they found that expression of the fatty acid binding proteins and cellular retinol binding protein also are downregulated in the absence of HNF4-alpha. These data provided direct evidence that HNF4-alpha is critical for regulating glucose transport and glycolysis and in doing so is critical for maintaining glucose homeostasis.

Animal model experiments lend further support to the function of HNF4A. To study the contribution of HNF4A to hepatic development and differentiation, Li et al. (2000) used a technique in which Hnf4a -/-mouse embryos were complemented with wildtype visceral endoderm to counteract early embryonic lethality. By histologic analyses, the authors found that specification and early development of the liver and liver morphology did not require Hnf4a. In addition, the expression of many liver genes was unaffected in these mice. However, RT-PCR analysis showed that Hnf4a -/-fetal livers failed to express a large array of genes whose expression in differentiated hepatocytes is essential for a functional hepatic parenchyma, including apolipoproteins (e.g., APOA1; 107680), metabolic proteins (e.g., aldolase B; 229600), transferrin (OMIM Ref. No. 190000), retinol-binding protein (e.g., RBP4; 180250), and erythropoietin (OMIM Ref. No. 133170). The lack of Hnf4a did not affect the expression of most transcription factors but did significantly reduce the levels of Hnf1a (TCF1; 142410) and the pregnane X receptor (NR1I2; 603065), suggesting that HNF4A acts upstream of at least these 2 transcription factors, which are also important in hepatocyte gene expression.

It is appreciated that the abovementioned animal model for HNF4A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, J.; Ning, G.; Duncan, S. A.: Mammalian hepatocyte differentiation requires the transcription factor HNF-4-alpha. Genes Dev. 14:464-474, 2000; and Stoffel, M.; Duncan, S. A.: The maturity-onset diabetes of the young (MODY1) transcription factor HNF4-alpha regulates expression of genes required for glucose transport and metabolism. P.

Further studies establishing the function and utilities of HNF4A are found in John Hopkins OMIM database record ID 600281, and in cited publications listed in Table 5, which are hereby incorporated by reference. Homeo box b6 (HOXB6, Accession NP_724778.1) is another GAM69 target gene, herein designated TARGET GENE. HOXB6 BINDING SITE is a target binding site found in the 3' untranslated region of multiple transcripts of mRNA encoded by HOXB6, corresponding to a target binding site such as BINDING SITE I, BINDING SITE II or BINDING SITE III of FIG. 8. Table 4 illustrates the complementarity of the nucleotide sequences of HOXB6 BINDING SITE, designated SEQ ID:8188, to the nucleotide sequence of GAM69 RNA, herein designated GAM RNA, also designated SEQ ID:258.

Another function of GAM69 is therefore inhibition of Homeo box b6 (HOXB6, Accession NP_724778.1), a gene which participates in establishing segmentation patterns and in determining segment identities. Accordingly, utilities of GAM69 include diagnosis, prevention and treatment of diseases and clinical conditions associated with HOXB6.

The function of HOXB6 and its association with various diseases and clinical conditions, has been established by previous studies, as described hereinabove with reference to GAM48.2 . HRD1 (Accession NP_115807.1) is another GAM69 target gene, herein designated TARGET GENE. HRD1 BINDING SITE is a target binding site found in the 3' untranslated region of multiple transcripts of mRNA encoded by HRD1, corresponding to a target binding site such as BINDING SITE I, BINDING SITE II or BINDING SITE III of FIG. 8. Table 4 illustrates the complementarity of the nucleotide sequences of HRD1 BINDING SITE, designated SEQ ID:1224, to the nucleotide sequence of GAM69 RNA, herein designated GAM RNA, also designated SEQ ID:258.

Another function of GAM69 is therefore inhibition of HRD1 (Accession NP_115807.1). Accordingly, utilities of GAM69 include diagnosis, prevention and treatment of diseases and clinical conditions associated with HRD1.

HRD1 (Accession NP_757385.1) is another GAM69 target gene, herein designated TARGET GENE. HRD1 BINDING SITE is a target binding site found in the 3' untranslated region of multiple transcripts of mRNA encoded by HRD1, corresponding to a target binding site such as BINDING SITE I, BINDING SITE II or BINDING SITE III of FIG. 8. Table 4 illustrates the complementarity of the nucleotide sequences of HRD1 BINDING SITE, designated SEQ ID:1224, to the nucleotide sequence of GAM69 RNA, herein designated GAM RNA, also designated SEQ ID:258.

Another function of GAM69 is therefore inhibition of HRD1 (Accession NP_757385.1). Accordingly, utilities of GAM69 include diagnosis, prevention and treatment of diseases and clinical conditions associated with HRD1.

Insulin-like growth factor 1 (somatomedin c) (IGF1, Accession NP__000609.1) is another GAM69 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:11594, to the nucleotide sequence of GAM69 RNA, herein designated GAM RNA, also designated SEQ ID:258.

Another function of GAM69 is therefore inhibition of Insulin-like growth factor 1 (somatomedin c) (IGF1, Accession NP__000609.1), a gene which are structurally and functionally related to insulin but have a much higher growth-promoting activity and therefore may be associated with Growth retardation with sensorineural deafness and mental retardation. Accordingly, utilities of GAM69 include diagnosis, prevention and treatment of Growth retardation with sensorineural deafness and mental retardation, and of other diseases and clinical conditions associated with IGF1.

The function of IGF1 and its association with various diseases and clinical conditions, has been established by previous studies, as described hereinabove with reference to GAM66.2. Potassium voltage-gated channel, shaker-related subfamily, member 3 (KCNA3, Accession NP__002223.2) is another GAM69 target gene, herein designated TARGET GENE. KCNA3 BINDING SITE is a target binding site found in the 5' untranslated region of mRNA encoded by KCNA3, corresponding to a target binding site such as BINDING SITE I, BINDING SITE II or BINDING SITE III of FIG. 8. Table 4 illustrates the complementarity of the nucleotide sequences of KCNA3 BINDING SITE, designated SEQ ID:11200, to the nucleotide sequence of GAM69 RNA, herein designated GAM RNA, also designated SEQ ID:258.

Another function of GAM69 is therefore inhibition of Potassium voltage-gated channel, shaker-related subfamily, member 3 (KCNA3, Accession NP__002223.2). Accordingly, utilities of GAM69 include diagnosis, prevention and treatment of diseases and clinical conditions associated with KCNA3.

Potassium voltage-gated channel, isk-related family, member 2 (KCNE2, Accession NP__751951.1) is another GAM69 target gene, herein designated TARGET GENE. KCNE2 BINDING SITE is a target binding site found in the 5' untranslated region of mRNA encoded by KCNE2, corresponding to a target binding site such as BINDING SITE I, BINDING SITE II or BINDING SITE III of FIG. 8. Table 4 illustrates the complementarity of the nucleotide sequences of KCNE2 BINDING SITE, designated SEQ ID:9124, to the nucleotide sequence of GAM69 RNA, herein designated GAM RNA, also designated SEQ ID:258.

Another function of GAM69 is therefore inhibition of Potassium voltage-gated channel, isk-related family, member 2 (KCNE2, Accession NP__751951.1). Accordingly, utilities of GAM69 include diagnosis, prevention and treatment of diseases and clinical conditions associated with KCNE2.

KIAA0082 (Accession NP__055865.1) is another GAM69 target gene, herein designated TARGET GENE. KIAA0082 BINDING SITE is a target binding site found in the 3' untranslated region of mRNA encoded by KIAA0082, corresponding to a target binding site such as BINDING SITE I, BINDING SITE II or BINDING SITE III of FIG. 8. Table 4 illustrates the complementarity of the nucleotide sequences of KIAA0082 BINDING SITE, designated SEQ ID:6751, to the nucleotide sequence of GAM69 RNA, herein designated GAM RNA, also designated SEQ ID:258.

Another function of GAM69 is therefore inhibition of KIAA0082 (Accession NP__055865.1). Accordingly, utilities of GAM69 include diagnosis, prevention and treatment of diseases and clinical conditions associated with KIAA0082.

KIAA0084 (Accession XP__042841.3) is another GAM69 target gene, herein designated TARGET GENE. KIAA0084 BINDING SITE is a target binding site found in the 5' untranslated region of mRNA encoded by KIAA0084, corresponding to a target binding site such as BINDING SITE I, BINDING SITE II or BINDING SITE III of FIG. 8. Table 4 illustrates the complementarity of the nucleotide sequences of KIAA0084 BINDING SITE, designated SEQ ID:16667, to the nucleotide sequence of GAM69 RNA, herein designated GAM RNA, also designated SEQ ID:258.

Another function of GAM69 is therefore inhibition of KIAA0084 (Accession XP__042841.3). Accordingly, utilities of GAM69 include diagnosis, prevention and treatment of diseases and clinical conditions associated with KIAA0084.

KIAA0872 (Accession NP__055755.1) is another GAM69 target gene, herein designated TARGET GENE. KIAA0872 BINDING SITE is a target binding site found in the 3' untranslated region of mRNA encoded by KIAA0872, corresponding to a target binding site such as BINDING SITE I, BINDING SITE II or BINDING SITE III of FIG. 8. Table 4 illustrates the complementarity of the nucleotide sequences of KIAA0872 BINDING SITE, designated SEQ ID:17704, to the nucleotide sequence of GAM69 RNA, herein designated GAM RNA, also designated SEQ ID:258.

Another function of GAM69 is therefore inhibition of KIAA0872 (Accession NP__055755.1). Accordingly, utilities of GAM69 include diagnosis, prevention and treatment of diseases and clinical conditions associated with KIAA0872.

KIAA1018 (Accession NP__055782.1) is another GAM69 target gene, herein designated TARGET GENE. KIAA1018 BINDING SITE is a target binding site found in the 3' untranslated region of mRNA encoded by KIAA1018, corresponding to a target binding site such as BINDING SITE I, BINDING SITE II or BINDING SITE III of FIG. 8. Table 4 illustrates the complementarity of the nucleotide sequences of KIAA1018 BINDING SITE, designated SEQ ID:7543, to the nucleotide sequence of GAM69 RNA, herein designated GAM RNA, also designated SEQ ID:258.

Another function of GAM69 is therefore inhibition of KIAA1018 (Accession NP__055782.1). Accordingly, utilities of GAM69 include diagnosis, prevention and treatment of diseases and clinical conditions associated with KIAA1018.

Kallikrein 14 (KLK14, Accession NP__071329.1) is another GAM69 target gene, herein designated TARGET GENE. KLK14 BINDING SITE is a target binding site found in the 5' untranslated region of mRNA encoded by KLK14, corresponding to a target binding site such as BINDING SITE I, BINDING SITE II or BINDING SITE III of FIG. 8. Table 4 illustrates the complementarity of the nucleotide sequences of KLK14 BINDING SITE, designated SEQ ID:19306, to the nucleotide sequence of GAM69 RNA, herein designated GAM RNA, also designated SEQ ID:258.

Another function of GAM69 is therefore inhibition of Kallikrein 14 (KLK14, Accession NP__071329.1). Accordingly, utilities of GAM69 include diagnosis, prevention and treatment of diseases and clinical conditions associated with KLK14.

L(3)mbt-like (drosophila) (L3MBTL, Accession NP_115479.2) is another GAM69 target gene, herein designated TARGET GENE. L3MBTL BINDING SITE is a target binding site found in the 3' untranslated region of multiple transcripts of mRNA encoded by L3MBTL, corresponding to a target binding site such as BINDING SITE I, BINDING SITE II or BINDING SITE III of FIG. 8. Table 4 illustrates the complementarity of the nucleotide sequences of L3MBTL BINDING SITE, designated SEQ ID:3613, to the nucleotide sequence of GAM69 RNA, herein designated GAM RNA, also designated SEQ ID:258.

Another function of GAM69 is therefore inhibition of L(3) mbt-like (drosophila) (L3MBTL, Accession NP_115479.2). Accordingly, utilities of GAM69 include diagnosis, prevention and treatment of diseases and clinical conditions associated with L3MBTL.

LOC116238 (Accession NP_612472.1) is another GAM69 target gene, herein designated TARGET GENE. LOC116238 BINDING SITE is a target binding site found in the 5' untranslated region of mRNA encoded by LOC116238, corresponding to a target binding site such as BINDING SITE I, BINDING SITE II or BINDING SITE III of FIG. 8. Table 4 illustrates the complementarity of the nucleotide sequences of LOC116238 BINDING SITE, designated SEQ ID:7565, to the nucleotide sequence of GAM69 RNA, herein designated GAM RNA, also designated SEQ ID:258.

Another function of GAM69 is therefore inhibition of LOC116238 (Accession NP_612472.1). Accordingly, utilities of GAM69 include diagnosis, prevention and treatment of diseases and clinical conditions associated with LOC116238.

LOC133491 (Accession XP_059655.2) is another GAM69 target gene, herein designated TARGET GENE. LOC133491 BINDING SITE is a target binding site found in the 3' untranslated region of mRNA encoded by LOC133491, corresponding to a target binding site such as BINDING SITE I, BINDING SITE II or BINDING SITE III of FIG. 8. Table 4 illustrates the complementarity of the nucleotide sequences of LOC133491 BINDING SITE, designated SEQ ID:19039, to the nucleotide sequence of GAM69 RNA, herein designated GAM RNA, also designated SEQ ID:258.

Another function of GAM69 is therefore inhibition of LOC133491 (Accession XP_059655.2). Accordingly, utilities of GAM69 include diagnosis, prevention and treatment of diseases and clinical conditions associated with LOC133491.

LOC143308 (Accession XP_096411.1) is another GAM69 target gene, herein designated TARGET GENE. LOC143308 BINDING SITE is a target binding site found in the 5' untranslated region of mRNA encoded by LOC143308, corresponding to a target binding site such as BINDING SITE I, BINDING SITE II or BINDING SITE III of FIG. 8. Table 4 illustrates the complementarity of the nucleotide sequences of LOC143308 BINDING SITE, designated SEQ ID:7544, to the nucleotide sequence of GAM69 RNA, herein designated GAM RNA, also designated SEQ ID:258.

Another function of GAM69 is therefore inhibition of LOC143308 (Accession XP_096411.1). Accordingly, utilities of GAM69 include diagnosis, prevention and treatment of diseases and clinical conditions associated with LOC143308.

LOC148490 (Accession XP_086210.2) is another GAM69 target gene, herein designated TARGET GENE. LOC148490 BINDING SITE is a target binding site found in the 3' untranslated region of mRNA encoded by LOC148490, corresponding to a target binding site such as BINDING SITE I, BINDING SITE II or BINDING SITE III of FIG. 8. Table 4 illustrates the complementarity of the nucleotide sequences of LOC148490 BINDING SITE, designated SEQ ID:14446, to the nucleotide sequence of GAM69 RNA, herein designated GAM RNA, also designated SEQ ID:258.

Another function of GAM69 is therefore inhibition of LOC148490 (Accession XP_086210.2). Accordingly, utilities of GAM69 include diagnosis, prevention and treatment of diseases and clinical conditions associated with LOC148490.

LOC150935 (Accession XP_087049.1) is another GAM69 target gene, herein designated TARGET GENE. LOC150935 BINDING SITE is a target binding site found in the 3' untranslated region of mRNA encoded by LOC150935, corresponding to a target binding site such as BINDING SITE I, BINDING SITE II or BINDING SITE III of FIG. 8. Table 4 illustrates the complementarity of the nucleotide sequences of LOC150935 BINDING SITE, designated SEQ ID:5653, to the nucleotide sequence of GAM69 RNA, herein designated GAM RNA, also designated SEQ ID:258.

Another function of GAM69 is therefore inhibition of LOC150935 (Accession XP_087049.1). Accordingly, utilities of GAM69 include diagnosis, prevention and treatment of diseases and clinical conditions associated with LOC150935.

LOC196993 (Accession XP_116971.3) is another GAM69 target gene, herein designated TARGET GENE. LOC196993 BINDING SITE is a target binding site found in the 5' untranslated region of mRNA encoded by LOC196993, corresponding to a target binding site such as BINDING SITE I, BINDING SITE II or BINDING SITE III of FIG. 8. Table 4 illustrates the complementarity of the nucleotide sequences of LOC196993 BINDING SITE, designated SEQ ID:12012, to the nucleotide sequence of GAM69 RNA, herein designated GAM RNA, also designated SEQ ID:258.

Another function of GAM69 is therefore inhibition of LOC196993 (Accession XP_116971.3). Accordingly, utilities of GAM69 include diagnosis, prevention and treatment of diseases and clinical conditions associated with LOC196993.

LOC201175 (Accession NP_777579.1) is another GAM69 target gene, herein designated TARGET GENE. LOC201175 BINDING SITE is a target binding site found in the 5' untranslated region of mRNA encoded by LOC201175, corresponding to a target binding site such as BINDING SITE I, BINDING SITE II or BINDING SITE III of FIG. 8. Table 4 illustrates the complementarity of the nucleotide sequences of LOC201175 BINDING SITE, designated SEQ ID:5222, to the nucleotide sequence of GAM69 RNA, herein designated GAM RNA, also designated SEQ ID:258.

Another function of GAM69 is therefore inhibition of LOC201175 (Accession NP_777579.1). Accordingly, utilities of GAM69 include diagnosis, prevention and treatment of diseases and clinical conditions associated with LOC201175.

LOC201292 (Accession NP_775818.1) is another GAM69 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:4960, to the nucleotide sequence of GAM69 RNA, herein designated GAM RNA, also designated SEQ ID:258.

Another function of GAM69 is therefore inhibition of LOC201292 (Accession NP_775818.1). Accordingly, utilities of GAM69 include diagnosis, prevention and treatment of diseases and clinical conditions associated with LOC201292.

LOC283259 (Accession XP_208061.3) is another GAM69 target gene, herein designated TARGET GENE. LOC283259 BINDING SITE is a target binding site found in the 3' untranslated region of mRNA encoded by LOC283259, corresponding to a target binding site such as BINDING SITE I, BINDING SITE II or BINDING SITE III of FIG. 8. Table 4 illustrates the complementarity of the nucleotide sequences of LOC283259 BINDING SITE, designated SEQ ID:14650, to the nucleotide sequence of GAM69 RNA, herein designated GAM RNA, also designated SEQ ID:258.

Another function of GAM69 is therefore inhibition of LOC283259 (Accession XP_208061.3). Accordingly, utilities of GAM69 include diagnosis, prevention and treatment of diseases and clinical conditions associated with LOC283259.

LOC283487 (Accession XP_211062.1) is another GAM69 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:10763, to the nucleotide sequence of GAM69 RNA, herein designated GAM RNA, also designated SEQ ID:258.

Another function of GAM69 is therefore inhibition of LOC283487 (Accession XP_211062.1). Accordingly, utilities of GAM69 include diagnosis, prevention and treatment of diseases and clinical conditions associated with LOC283487.

LOC283778 (Accession XP_211199.1) is another GAM69 target gene, herein designated TARGET GENE. LOC283778 BINDING SITE is a target binding site found in the 3' untranslated region of mRNA encoded by LOC283778, corresponding to a target binding site such as BINDING SITE I, BINDING SITE II or BINDING SITE III of FIG. 8. Table 4 illustrates the complementarity of the nucleotide sequences of LOC283778 BINDING SITE, designated SEQ ID:7820, to the nucleotide sequence of GAM69 RNA, herein designated GAM RNA, also designated SEQ ID:258.

Another function of GAM69 is therefore inhibition of LOC283778 (Accession XP_211199.1). Accordingly, utilities of GAM69 include diagnosis, prevention and treatment of diseases and clinical conditions associated with LOC283778.

LOC283888 (Accession XP_211249.1) is another GAM69 target gene, herein designated TARGET GENE. LOC283888 BINDING SITE1 and LOC283888 BINDING SITE2 are target binding sites found in untranslated regions of mRNA encoded by LOC283888, corresponding to target binding sites such as BINDING SITE I, BINDING SITE II or BINDING SITE III of FIG. 8. Table 4 illustrates the complementarity of the nucleotide sequences of LOC283888 BINDING SITE1 and LOC283888 BINDING SITE2, designated SEQ ID:19540 and SEQ ID:4070 respectively, to the nucleotide sequence of GAM69 RNA, herein designated GAM RNA, also designated SEQ ID:258.

Another function of GAM69 is therefore inhibition of LOC283888 (Accession XP_211249.1). Accordingly, utilities of GAM69 include diagnosis, prevention and treatment of diseases and clinical conditions associated with LOC283888.

LOC284191 (Accession XP_211377.1) is another GAM69 target gene, herein designated TARGET GENE. LOC284191 BINDING SITE is a target binding site found in the 3' untranslated region of mRNA encoded by LOC284191, corresponding to a target binding site such as BINDING SITE I, BINDING SITE II or BINDING SITE III of FIG. 8. Table 4 illustrates the complementarity of the nucleotide sequences of LOC284191 BINDING SITE, designated SEQ ID:6369, to the nucleotide sequence of GAM69 RNA, herein designated GAM RNA, also designated SEQ ID:258.

Another function of GAM69 is therefore inhibition of LOC284191 (Accession XP_211377.1). Accordingly, utilities of GAM69 include diagnosis, prevention and treatment of diseases and clinical conditions associated with LOC284191.

LOC284352 (Accession XP_113978.1) is another GAM69 target gene, herein designated TARGET GENE. LOC284352 BINDING SITE is a target binding site found in the 5' untranslated region of mRNA encoded by LOC284352, corresponding to a target binding site such as BINDING SITE I, BINDING SITE II or BINDING SITE III of FIG. 8. Table 4 illustrates the complementarity of the nucleotide sequences of LOC284352 BINDING SITE, designated SEQ ID:13773, to the nucleotide sequence of GAM69 RNA, herein designated GAM RNA, also designated SEQ ID:258.

Another function of GAM69 is therefore inhibition of LOC284352 (Accession XP_113978.1). Accordingly, utilities of GAM69 include diagnosis, prevention and treatment of diseases and clinical conditions associated with LOC284352.

LOC284748 (Accession XP_211629.1) is another GAM69 target gene, herein designated TARGET GENE. LOC284748 BINDING SITE is a target binding site found in the 3' untranslated region of mRNA encoded by LOC284748, corresponding to a target binding site such as BINDING SITE I, BINDING SITE II or BINDING SITE III of FIG. 8. Table 4 illustrates the complementarity of the nucleotide sequences of LOC284748 BINDING SITE, designated SEQ ID:6746, to the nucleotide sequence of GAM69 RNA, herein designated GAM RNA, also designated SEQ ID:258.

Another function of GAM69 is therefore inhibition of LOC284748 (Accession XP_211629.1). Accordingly, utilities of GAM69 include diagnosis, prevention and treatment of diseases and clinical conditions associated with LOC284748.

LOC284907 (Accession XP_209397.1) is another GAM69 target gene, herein designated TARGET GENE. LOC284907 BINDING SITE is a target binding site found in the 3' untranslated region of mRNA encoded by LOC284907, corresponding to a target binding site such as BINDING SITE I, BINDING SITE II or BINDING SITE III of FIG. 8. Table 4 illustrates the complementarity of the nucleotide sequences of LOC284907 BINDING SITE, designated SEQ ID:20140, to the nucleotide sequence of GAM69 RNA, herein designated GAM RNA, also designated SEQ ID:258.

Another function of GAM69 is therefore inhibition of LOC284907 (Accession XP_209397.1). Accordingly, utilities of GAM69 include diagnosis, prevention and treatment of diseases and clinical conditions associated with LOC284907.

LOC284960 (Accession XP_211715.1) is another GAM69 target gene, herein designated TARGET GENE. LOC284960 BINDING SITE1 and LOC284960 BINDING SITE2 are target binding sites found in untranslated regions of mRNA encoded by LOC284960, corresponding to target binding sites such as BINDING SITE I, BINDING SITE II or BINDING SITE III of FIG. 8. Table 4 illustrates the complementarity of the nucleotide sequences of LOC284960 BINDING SITE1 and LOC284960 BINDING SITE2, designated SEQ ID:13185 and SEQ ID:6769 respectively, to the nucleotide sequence of GAM69 RNA, herein designated GAM RNA, also designated SEQ ID:258.

Another function of GAM69 is therefore inhibition of LOC284960 (Accession XP_211715.1). Accordingly, utilities of GAM69 include diagnosis, prevention and treatment of diseases and clinical conditions associated with LOC284960.

LOC285014 (Accession XP_211734.1) is another GAM69 target gene, herein designated TARGET GENE. LOC285014 BINDING SITE1 and LOC285014 BINDING SITE2 are target binding sites found in untranslated regions of mRNA encoded by LOC285014, corresponding to target binding sites such as BINDING SITE I, BINDING SITE II or BINDING SITE III of FIG. 8. Table 4 illustrates the complementarity of the nucleotide sequences of LOC285014 BINDING SITE1 and LOC285014 BINDING SITE2, designated SEQ ID:13185 and SEQ ID:6769 respectively, to the nucleotide sequence of GAM69 RNA, herein designated GAM RNA, also designated SEQ ID:258.

Another function of GAM69 is therefore inhibition of LOC285014 (Accession XP_211734.1). Accordingly, utilities of GAM69 include diagnosis, prevention and treatment of diseases and clinical conditions associated with LOC285014.

LOC285032 (Accession XP_211740.1) is another GAM69 target gene, herein designated TARGET GENE. LOC285032 BINDING SITE1 and LOC285032 BINDING SITE2 are target binding sites found in untranslated regions of mRNA encoded by LOC285032, corresponding to target binding sites such as BINDING SITE I, BINDING SITE II or BINDING SITE III of FIG. 8. Table 4 illustrates the complementarity of the nucleotide sequences of LOC285032 BINDING SITE1 and LOC285032 BINDING SITE2, designated SEQ ID:13185 and SEQ ID:6769 respectively, to the nucleotide sequence of GAM69 RNA, herein designated GAM RNA, also designated SEQ ID:258.

Another function of GAM69 is therefore inhibition of LOC285032 (Accession XP_211740.1). Accordingly, utilities of GAM69 include diagnosis, prevention and treatment of diseases and clinical conditions associated with LOC285032.

LOC285045 (Accession XP_211744.1) is another GAM69 target gene, herein designated TARGET GENE. LOC285045 BINDING SITE is a target binding site found in the 3' untranslated region of mRNA encoded by LOC285045, corresponding to a target binding site such as BINDING SITE I, BINDING SITE II or BINDING SITE III of FIG. 8. Table 4 illustrates the complementarity of the nucleotide sequences of LOC285045 BINDING SITE, designated SEQ ID:5718, to the nucleotide sequence of GAM69 RNA, herein designated GAM RNA, also designated SEQ ID:258.

Another function of GAM69 is therefore inhibition of LOC285045 (Accession XP_211744.1). Accordingly, utilities of GAM69 include diagnosis, prevention and treatment of diseases and clinical conditions associated with LOC285045.

LOC285594 (Accession XP_211946.2) is another GAM69 target gene, herein designated TARGET GENE. LOC285594 BINDING SITE is a target binding site found in the 3' untranslated region of mRNA encoded by LOC285594, corresponding to a target binding site such as BINDING SITE I, BINDING SITE II or BINDING SITE III of FIG. 8. Table 4 illustrates the complementarity of the nucleotide sequences of LOC285594 BINDING SITE, designated SEQ ID:8400, to the nucleotide sequence of GAM69 RNA, herein designated GAM RNA, also designated SEQ ID:258.

Another function of GAM69 is therefore inhibition of LOC285594 (Accession XP_211946.2). Accordingly, utilities of GAM69 include diagnosis, prevention and treatment of diseases and clinical conditions associated with LOC285594.

LOC285767 (Accession XP_212019.1) is another GAM69 target gene, herein designated TARGET GENE. LOC285767 BINDING SITE is a target binding site found in the 5' untranslated region of mRNA encoded by LOC285767, corresponding to a target binding site such as BINDING SITE I, BINDING SITE II or BINDING SITE III of FIG. 8. Table 4 illustrates the complementarity of the nucleotide sequences of LOC285767 BINDING SITE, designated SEQ ID:18052, to the nucleotide sequence of GAM69 RNA, herein designated GAM RNA, also designated SEQ ID:258.

Another function of GAM69 is therefore inhibition of LOC285767 (Accession XP_212019.1). Accordingly, utilities of GAM69 include diagnosis, prevention and treatment of diseases and clinical conditions associated with LOC285767.

LOC285846 (Accession XP_209776.1) is another GAM69 target gene, herein designated TARGET GENE. LOC285846 BINDING SITE is a target binding site found in the 3' untranslated region of mRNA encoded by LOC285846, corresponding to a target binding site such as BINDING SITE I, BINDING SITE II or BINDING SITE III of FIG. 8. Table 4 illustrates the complementarity of the nucleotide sequences of LOC285846 BINDING SITE, designated SEQ ID:6565, to the nucleotide sequence of GAM69 RNA, herein designated GAM RNA, also designated SEQ ID:258.

Another function of GAM69 is therefore inhibition of LOC285846 (Accession XP_209776.1). Accordingly, utilities of GAM69 include diagnosis, prevention and treatment of diseases and clinical conditions associated with LOC285846.

LOC286008 (Accession XP_212134.1) is another GAM69 target gene, herein designated TARGET GENE. LOC286008 BINDING SITE is a target binding site found in the 3' untranslated region of mRNA encoded by LOC286008, corresponding to a target binding site such as BINDING SITE I, BINDING SITE II or BINDING SITE III of FIG. 8. Table 4 illustrates the complementarity of the nucleotide sequences of LOC286008 BINDING SITE, designated SEQ ID:18326, to the nucleotide sequence of GAM69 RNA, herein designated GAM RNA, also designated SEQ ID:258.

Another function of GAM69 is therefore inhibition of LOC286008 (Accession XP_212134.1). Accordingly, utilities of GAM69 include diagnosis, prevention and treatment of diseases and clinical conditions associated with LOC286008.

LOC339505 (Accession XP_294985.1) is another GAM69 target gene, herein designated TARGET GENE. LOC339505 BINDING SITE is a target binding site found in the 3' untranslated region of mRNA encoded by LOC339505, corresponding to a target binding site such as BINDING SITE I, BINDING SITE II or BINDING SITE III of FIG. 8. Table 4 illustrates the complementarity of the nucleotide sequences of LOC339505 BINDING SITE, designated SEQ ID:3748, to the nucleotide sequence of GAM69 RNA, herein designated GAM RNA, also designated SEQ ID:258.

Another function of GAM69 is therefore inhibition of LOC339505 (Accession XP_294985.1). Accordingly, utilities of GAM69 include diagnosis, prevention and treatment of diseases and clinical conditions associated with LOC339505.

LOC339685 (Accession XP_295032.1) is another GAM69 target gene, herein designated TARGET GENE. LOC339685 BINDING SITE is a target binding site found in the 5' untranslated region of mRNA encoded by LOC339685, corresponding to a target binding site such as BINDING SITE I, BINDING SITE II or BINDING SITE III of FIG. 8. Table 4 illustrates the complementarity of the nucleotide sequences of LOC339685 BINDING SITE, designated SEQ ID:7222, to the nucleotide sequence of GAM69 RNA, herein designated GAM RNA, also designated SEQ ID:258.

Another function of GAM69 is therefore inhibition of LOC339685 (Accession XP_295032.1). Accordingly, utilities of GAM69 include diagnosis, prevention and treatment of diseases and clinical conditions associated with LOC339685.

LOC340561 (Accession XP_291337.1) is another GAM69 target gene, herein designated TARGET GENE. LOC340561 BINDING SITE is a target binding site found in the 3' untranslated region of mRNA encoded by LOC340561, corresponding to a target binding site such as BINDING SITE I, BINDING SITE II or BINDING SITE III of FIG. 8. Table 4 illustrates the complementarity of the nucleotide sequences of LOC340561 BINDING SITE, designated SEQ ID:7740, to the nucleotide sequence of GAM69 RNA, herein designated GAM RNA, also designated SEQ ID:258.

Another function of GAM69 is therefore inhibition of LOC340561 (Accession XP_291337.1). Accordingly, utilities of GAM69 include diagnosis, prevention and treatment of diseases and clinical conditions associated with LOC340561.

LOC347867 (Accession XP_300269.1) is another GAM69 target gene, herein designated TARGET GENE. LOC347867 BINDING SITE is a target binding site found in the 3' untranslated region of mRNA encoded by LOC347867, corresponding to a target binding site such as BINDING SITE I, BINDING SITE II or BINDING SITE III of FIG. 8. Table 4 illustrates the complementarity of the nucleotide sequences of LOC347867 BINDING SITE, designated SEQ ID:14650, to the nucleotide sequence of GAM69 RNA, herein designated GAM RNA, also designated SEQ ID:258.

Another function of GAM69 is therefore inhibition of LOC347867 (Accession XP_300269.1). Accordingly, utilities of GAM69 include diagnosis, prevention and treatment of diseases and clinical conditions associated with LOC347867.

LOC347929 (Accession XP_302565.1) is another GAM69 target gene, herein designated TARGET GENE. LOC347929 BINDING SITE is a target binding site found in the 5' untranslated region of mRNA encoded by LOC347929, corresponding to a target binding site such as BINDING SITE I, BINDING SITE II or BINDING SITE III of FIG. 8. Table 4 illustrates the complementarity of the nucleotide sequences of LOC347929 BINDING SITE, designated SEQ ID:8274, to the nucleotide sequence of GAM69 RNA, herein designated GAM RNA, also designated SEQ ID:258.

Another function of GAM69 is therefore inhibition of LOC347929 (Accession XP_302565.1). Accordingly, utilities of GAM69 include diagnosis, prevention and treatment of diseases and clinical conditions associated with LOC347929.

LOC348483 (Accession XP_290913.2) is another GAM69 target gene, herein designated TARGET GENE. LOC348483 BINDING SITE is a target binding site found in the 5' untranslated region of mRNA encoded by LOC348483, corresponding to a target binding site such as BINDING SITE I, BINDING SITE II or BINDING SITE III of FIG. 8. Table 4 illustrates the complementarity of the nucleotide sequences of LOC348483 BINDING SITE, designated SEQ ID:6566, to the nucleotide sequence of GAM69 RNA, herein designated GAM RNA, also designated SEQ ID:258.

Another function of GAM69 is therefore inhibition of LOC348483 (Accession XP_290913.2). Accordingly, utilities of GAM69 include diagnosis, prevention and treatment of diseases and clinical conditions associated with LOC348483.

LOC348808 (Accession XP_302893.1) is another GAM69 target gene, herein designated TARGET GENE. LOC348808 BINDING SITE is a target binding site found in the 3' untranslated region of mRNA encoded by LOC348808, corresponding to a target binding site such as BINDING SITE I, BINDING SITE II or BINDING SITE III of FIG. 8. Table 4 illustrates the complementarity of the nucleotide sequences of LOC348808 BINDING SITE, designated SEQ ID:1722, to the nucleotide sequence of GAM69 RNA, herein designated GAM RNA, also designated SEQ ID:258.

Another function of GAM69 is therefore inhibition of LOC348808 (Accession XP_302893.1). Accordingly, utilities of GAM69 include diagnosis, prevention and treatment of diseases and clinical conditions associated with LOC348808.

LOC349092 (Accession XP_302959.1) is another GAM69 target gene, herein designated TARGET GENE. LOC349092 BINDING SITE is a target binding site found in the 5' untranslated region of mRNA encoded by LOC349092, corresponding to a target binding site such as BINDING SITE I, BINDING SITE II or BINDING SITE III of FIG. 8. Table 4 illustrates the complementarity of the nucleotide sequences of LOC349092 BINDING SITE, designated SEQ ID:9734, to the nucleotide sequence of GAM69 RNA, herein designated GAM RNA, also designated SEQ ID:258.

Another function of GAM69 is therefore inhibition of LOC349092 (Accession XP_302959.1). Accordingly, utilities of GAM69 include diagnosis, prevention and treatment of diseases and clinical conditions associated with LOC349092.

LOC349272 (Accession XP_303013.1) is another GAM69 target gene, herein designated TARGET GENE. LOC349272 BINDING SITE1 and LOC349272 BINDING SITE2 are target binding sites found in untranslated regions of mRNA encoded by LOC349272, corresponding to target binding sites such as BINDING SITE I, BINDING SITE II or BINDING SITE III of FIG. 8. Table 4 illustrates the complementarity of the nucleotide sequences of LOC349272 BINDING SITE1 and LOC349272 BINDING SITE2, designated SEQ ID:11989 and SEQ ID:4719 respectively, to the nucleotide sequence of GAM69 RNA, herein designated GAM RNA, also designated SEQ ID:258.

Another function of GAM69 is therefore inhibition of LOC349272 (Accession XP_303013.1). Accordingly, utilities of GAM69 include diagnosis, prevention and treatment of diseases and clinical conditions associated with LOC349272.

LOC349279 (Accession XP_303015.1) is another GAM69 target gene, herein designated TARGET GENE. LOC349279 BINDING SITE1 and LOC349279 BINDING SITE2 are target binding sites found in untranslated regions of mRNA encoded by LOC349279, corresponding to target binding sites such as BINDING SITE I, BINDING SITE II or BINDING SITE III of FIG. 8. Table 4 illustrates the complementarity of the nucleotide sequences of LOC349279 BINDING SITE1 and LOC349279 BINDING SITE2, designated SEQ ID:7545 and SEQ ID:4719 respectively, to the nucleotide sequence of GAM69 RNA, herein designated GAM RNA, also designated SEQ ID:258.

Another function of GAM69 is therefore inhibition of LOC349279 (Accession XP_303015.1). Accordingly, utilities of GAM69 include diagnosis, prevention and treatment of diseases and clinical conditions associated with LOC349279.

LOC349301 (Accession XP_303022.1) is another GAM69 target gene, herein designated TARGET GENE. LOC349301 BINDING SITE1 and LOC349301 BINDING SITE2 are target binding sites found in untranslated regions of mRNA encoded by LOC349301, corresponding to target binding sites such as BINDING SITE I, BINDING SITE II or BINDING SITE III of FIG. 8. Table 4 illustrates the complementarity of the nucleotide sequences of LOC349301 BINDING SITE1 and LOC349301 BINDING SITE2, designated SEQ ID:11989 and SEQ ID:4719 respectively, to the nucleotide sequence of GAM69 RNA, herein designated GAM RNA, also designated SEQ ID:258.

Another function of GAM69 is therefore inhibition of LOC349301 (Accession XP_303022.1). Accordingly, utilities of GAM69 include diagnosis, prevention and treatment of diseases and clinical conditions associated with LOC349301.

LOC349306 (Accession XP_303023.1) is another GAM69 target gene, herein designated TARGET GENE. LOC349306 BINDING SITE1 and LOC349306 BINDING SITE2 are target binding sites found in untranslated regions of mRNA encoded by LOC349306, corresponding to target binding sites such as BINDING SITE I, BINDING SITE II or BINDING SITE III of FIG. 8. Table 4 illustrates the complementarity of the nucleotide sequences of LOC349306 BINDING SITE1 and LOC349306 BINDING SITE2, designated SEQ ID:11989 and SEQ ID:4719 respectively, to the nucleotide sequence of GAM69 RNA, herein designated GAM RNA, also designated SEQ ID:258.

Another function of GAM69 is therefore inhibition of LOC349306 (Accession XP_303023.1). Accordingly, utilities of GAM69 include diagnosis, prevention and treatment of diseases and clinical conditions associated with LOC349306.

LOC92568 (Accession XP_045852.1) is another GAM69 target gene, herein designated TARGET GENE. LOC92568 BINDING SITE is a target binding site found in the 3' untranslated region of mRNA encoded by LOC92568, corresponding to a target binding site such as BINDING SITE I, BINDING SITE II or BINDING SITE III of FIG. 8. Table 4 illustrates the complementarity of the nucleotide sequences of LOC92568 BINDING SITE, designated SEQ ID:6853, to the nucleotide sequence of GAM69 RNA, herein designated GAM RNA, also designated SEQ ID:258.

Another function of GAM69 is therefore inhibition of LOC92568 (Accession XP_045852.1). Accordingly, utilities of GAM69 include diagnosis, prevention and treatment of diseases and clinical conditions associated with LOC92568.

LSM1 (Accession NP_055277.1) is another GAM69 target gene, herein designated TARGET GENE. LSM1 BINDING SITE is a target binding site found in the 5' untranslated region of mRNA encoded by LSM1, corresponding to a target binding site such as BINDING SITE I, BINDING SITE II or BINDING SITE III of FIG. 8. Table 4 illustrates the complementarity of the nucleotide sequences of LSM1 BINDING SITE, designated SEQ ID:11524, to the nucleotide sequence of GAM69 RNA, herein designated GAM RNA, also designated SEQ ID:258.

Another function of GAM69 is therefore inhibition of LSM1 (Accession NP_055277.1). Accordingly, utilities of GAM69 include diagnosis, prevention and treatment of diseases and clinical conditions associated with LSM1.

Methyl cpg binding protein 2 (rett syndrome) (MECP2, Accession NP_004983.1) is another GAM69 target gene, herein designated TARGET GENE. MECP2 BINDING SITE is a target binding site found in the 3' untranslated region of mRNA encoded by MECP2, corresponding to a target binding site such as BINDING SITE I, BINDING SITE II or BINDING SITE III of FIG. 8. Table 4 illustrates the complementarity of the nucleotide sequences of MECP2 BINDING SITE, designated SEQ ID:15395, to the nucleotide sequence of GAM69 RNA, herein designated GAM RNA, also designated SEQ ID:258.

Another function of GAM69 is therefore inhibition of Methyl cpg binding protein 2 (rett syndrome) (MECP2, Accession NP_004983.1). Accordingly, utilities of GAM69 include diagnosis, prevention and treatment of diseases and clinical conditions associated with MECP2.

MGC11332 (Accession NP_116107.2) is another GAM69 target gene, herein designated TARGET GENE. MGC11332 BINDING SITE is a target binding site found in the 3' untranslated region of mRNA encoded by MGC11332, corresponding to a target binding site such as BINDING SITE I, BINDING SITE II or BINDING SITE III of FIG. 8. Table 4 illustrates the complementarity of the nucleotide sequences of MGC11332 BINDING SITE, designated SEQ ID:3597, to the nucleotide sequence of GAM69 RNA, herein designated GAM RNA, also designated SEQ ID:258.

Another function of GAM69 is therefore inhibition of MGC11332 (Accession NP_116107.2). Accordingly, utilities of GAM69 include diagnosis, prevention and treatment of diseases and clinical conditions associated with MGC11332.

MGC12335 (Accession NP_116133.1) is another GAM69 target gene, herein designated TARGET GENE. MGC12335 BINDING SITE is a target binding site found in the 3' untranslated region of mRNA encoded by MGC12335, corresponding to a target binding site such as BINDING SITE I, BINDING SITE II or BINDING SITE III of FIG. 8. Table 4 illustrates the complementarity of the nucleotide sequences of MGC12335 BINDING SITE, designated SEQ ID:12974, to the nucleotide sequence of GAM69 RNA, herein designated GAM RNA, also designated SEQ ID:258.

Another function of GAM69 is therefore inhibition of MGC12335 (Accession NP_116133.1). Accordingly, utilities of GAM69 include diagnosis, prevention and treatment of diseases and clinical conditions associated with MGC12335.

MGC42638 (Accession NP_848662.1) is another GAM69 target gene, herein designated TARGET GENE. MGC42638 BINDING SITE is a target binding site found in the 3' untranslated region of mRNA encoded by MGC42638, corresponding to a target binding site such as BINDING SITE I, BINDING SITE II or BINDING SITE III of FIG. 8. Table 4 illustrates the complementarity of the nucleotide sequences of MGC42638 BINDING SITE, designated SEQ ID:7740, to the nucleotide sequence of GAM69 RNA, herein designated GAM RNA, also designated SEQ ID:258.

Another function of GAM69 is therefore inhibition of MGC42638 (Accession NP_848662.1). Accordingly, utilities of GAM69 include diagnosis, prevention and treatment of diseases and clinical conditions associated with MGC42638.

Muscle ras oncogene homolog (MRAS, Accession NP_036351.1) is another GAM69 target gene, herein designated TARGET GENE. MRAS BINDING SITE is a target binding site found in the 5' untranslated region of mRNA encoded by MRAS, corresponding to a target binding site such as BINDING SITE I, BINDING SITE II or BINDING SITE III of FIG. 8. Table 4 illustrates the complementarity of the nucleotide sequences of MRAS BINDING SITE, designated SEQ ID:17599, to the nucleotide sequence of GAM69 RNA, herein designated GAM RNA, also designated SEQ ID:258.

Another function of GAM69 is therefore inhibition of Muscle ras oncogene homolog (MRAS, Accession NP_036351.1). Accordingly, utilities of GAM69 include diagnosis, prevention and treatment of diseases and clinical conditions associated with MRAS.

Nad(p)h dehydrogenase, quinone 2 (NQO2, Accession NP_000895.1) is another GAM69 target gene, herein designated TARGET GENE. NQO2 BINDING SITE is a target binding site found in the 3' untranslated region of mRNA encoded by NQO2, corresponding to a target binding site such as BINDING SITE I, BINDING SITE II or BINDING SITE III of FIG. 8. Table 4 illustrates the complementarity of the nucleotide sequences of NQO2 BINDING SITE, designated SEQ ID:17356, to the nucleotide sequence of GAM69 RNA, herein designated GAM RNA, also designated SEQ ID:258.

Another function of GAM69 is therefore inhibition of Nad(p)h dehydrogenase, quinone 2 (NQO2, Accession NP_000895.1), a gene which oxidizes NADH or NADPH by quinones and oxidation-reduction dyes. Accordingly, utilities of GAM69 include diagnosis, prevention and treatment of diseases and clinical conditions associated with NQO2.

The function of NQO2 has been established by previous studies. NAD(P)H:quinone oxidoreductases (NQOs) are flavoproteins that catalyze the oxidation of NADH or NADPH by various quinones and oxidation-reduction dyes. Jaiswal et al. (1988) described a cDNA that encodes a dioxin-inducible cytosolic form of human NAD(P)H:quinone oxidoreductase (NQO1; 125860). Jaiswal et al. (1990) described the nucleotide sequence and deduced amino acid sequence for a cDNA clone that encodes a second form of this oxidoreductase, NQO2. It was isolated by screening a human liver cDNA library by hybridization with an NQO1 cDNA probe. The NQO2 cDNA was 976 nucleotides long and encoded a protein of 231 amino acids with a molecular mass of 25,956. The human NQO2 cDNA and protein were 54% and 49% similar to human liver cytosolic NQO1 cDNA and protein, respectively. Southern blot analysis suggested the presence of a single human gene approximately 14 to 17 kb long. The NQO2 gene showed extensive polymorphism. By study of rodent/human somatic cell hybrids, Jaiswal et al. (1990) mapped the NQO2 gene to 6pter-q12. By fluorescence in situ hybridization, Jaiswal et al. (1999) narrowed the mapping of NQO2 to 6p25.

Full details of the abovementioned studies are described in the following publications, the disclosure of which are hereby incorporated by reference:

Jaiswal, A. K.; Bell, D. W.; Radjendirane, V.; Testa, J. R.: Localization of human NQO1 gene to chromosome 16q22 and NQO2-6p25 and associated polymorphisms. Pharmacogenetics 9:413-418, 1999; and Jaiswal, A. K.; Burnett, P.; Adesnik, M.; McBride, O. W.: Nucleotide and deduced amino acid sequence of a human cDNA (NQO2) corresponding to a second member of the NAD(P)H:quinone oxi.

Further studies establishing the function and utilities of NQO2 are found in John Hopkins OMIM database record ID 160998, and in cited publications listed in Table 5, which are hereby incorporated by reference. Nuclear receptor subfamily 3, group c, member 2 (NR3C2, Accession NP_000892.1) is another GAM69 target gene, herein designated TARGET GENE. NR3C2 BINDING SITE is a target binding site found in the 3' untranslated region of mRNA encoded by NR3C2, corresponding to a target binding site such as BINDING SITE I, BINDING SITE II or BINDING SITE III of FIG. 8. Table 4 illustrates the complementarity of the nucleotide sequences of NR3C2 BINDING SITE, designated SEQ ID:18170, to the nucleotide sequence of GAM69 RNA, herein designated GAM RNA, also designated SEQ ID:258.

Another function of GAM69 is therefore inhibition of Nuclear receptor subfamily 3, group c, member 2 (NR3C2, Accession NP_000892.1), a gene which is to increase ion and water transport and thus raise extracellular fluid volume and blood pressure and lower potassium levels. Accordingly, utilities of GAM69 include diagnosis, prevention and treatment of diseases and clinical conditions associated with NR3C2.

The function of NR3C2 and its association with various diseases and clinical conditions, has been established by previous studies, as described hereinabove with reference to GAM40.1. P100 (Accession NP_055205.1) is another GAM69 target gene, herein designated TARGET GENE. p100 BINDING SITE is a target binding site found in the 3' untranslated region of mRNA encoded by p100, corresponding to a target binding site such as BINDING SITE I, BINDING SITE II or BINDING SITE III of FIG. 8. Table 4 illustrates the complementarity of the nucleotide sequences of p100 BINDING SITE, designated SEQ ID:7791, to the nucleotide sequence of GAM69 RNA, herein designated GAM RNA, also designated SEQ ID:258.

Another function of GAM69 is therefore inhibition of p100 (Accession NP_055205.1), a gene which coactivates gene expression regulated by the Epstein-Barr virus nuclear antigen 2. Accordingly, utilities of GAM69 include diagnosis, prevention and treatment of diseases and clinical conditions associated with p100.

The function of p100 and its association with various diseases and clinical conditions, has been established by previous studies, as described hereinabove with reference to GAM63.1. P21/cdc42/rac1-activated kinase 1 (ste20 homolog, yeast) (PAK1, Accession NP_002567.2) is another GAM69 target gene, herein designated TARGET GENE. PAK1 BINDING SITE is a target binding site found in the 5' untranslated region of mRNA encoded by PAK1, corresponding to a target binding site such as BINDING SITE I, BINDING SITE II or BINDING SITE III of FIG. 8. Table 4 illustrates the complementarity of the nucleotide sequences of PAK1 BINDING SITE, designated SEQ ID:4638, to the nucleotide sequence of GAM69 RNA, herein designated GAM RNA, also designated SEQ ID:258.

Another function of GAM69 is therefore inhibition of P21/cdc42/rac1-activated kinase 1 (ste20 homolog, yeast) (PAK1, Accession NP_002567.2), a gene which activates the Jun N-terminal kinase MAP kinase pathway. Accordingly, utilities of GAM69 include diagnosis, prevention and treatment of diseases and clinical conditions associated with PAK1.

The function of PAK1 has been established by previous studies. PAK1 protein promotes the disassembly of stress fibers and focal adhesions. Sanders et al. (1999) demonstrated that, in baby hamster kidney-21 and HeLa cells expressing constitutively active PAK1, MLCK (OMIM Ref. No. 600922) activity and myosin light-chain phosphorylation were decreased, and cell spreading was inhibited. These results indicated that MLCK is a target for PAK1, and that PAKs may regulate cytoskeletal dynamics by decreasing MLCK activity and myosin light-chain phosphorylation. Parrini et al. (2002) showed that PAK1 forms homodimers in vivo and that its dimerization is regulated by the intracellular level of GTP-CDC42 (OMIM Ref. No. 116952) or GTP-RAC1 (OMIM Ref. No. 602048). The dimerized PAK1 adopts a trans-inhibited conformation: the N-terminal inhibitory portion of one PAK1 molecule in the dimer binds and inhibits the catalytic domain of the other. One GTPase interaction can result in activation of both partners. Another ligand, beta-PIX (OMIM Ref. No. 605477), can stably associate with dimerized PAK1. Dimerization does not facilitate PAK1 trans- phosphorylation. The authors concluded that the functional significance of dimerization is to allow trans-inhibition. Vadlamudi et al. (2002) identified filamin A (FLNA; 300017) as a binding partner of PAK1 in a yeast 2-hybrid screen of a mammary gland cDNA library. By mutation analysis, they localized the PAK1- binding region in FLNA to tandem repeat 23 in the C terminus, and the FLNA-binding region in PAK1 between amino acids 52 and 132 in the conserved CDC42 (OMIM Ref. No. 116952)/RAC (OMIM Ref. No. 602048)-interacting domain. Endogenous FLNA was phosphorylated by PAK1 on ser2152 following stimulation with physiologic signaling molecules. Following stimulation, FLNA colocalized with PAK1 in membrane ruffles. The ruffle-forming activity of PAK1 was found in FLNA-expressing cells, but not in cells deficient in FLNA.

Full details of the abovementioned studies are described in the following publications, the disclosure of which are hereby incorporated by reference:

Sanders, L. C.; Matsumura, F.; Bokoch, G. M.; de Lanerolle, P.: Inhibition of myosin light chain kinase by p21-activated kinase. Science 283:2083-2085, 1999; and Vadlamudi, R. K.; Li, F.; Adam, L.; Nguyen, D.; Ohta, Y.; Stossel, T. P.; Kumar, R. : Filamin is essential in actin cytoskeletal assembly mediated by p21-activated kinase 1. Nature Cell.

Further studies establishing the function and utilities of PAK1 are found in John Hopkins OMIM database record ID 601032, and in cited publications listed in Table 5, which are hereby incorporated by reference. Platelet-derived growth factor beta polypeptide (simian sarcoma viral (v-sis) oncogene homolog) (PDGFB, Accession NP_148937.1) is another GAM69 target gene, herein designated TARGET GENE. PDGFB BINDING SITE is a target binding site found in the 3' untranslated region of multiple transcripts of mRNA encoded by PDGFB, corresponding to a target binding site such as BINDING SITE I, BINDING SITE II or BINDING SITE III of FIG. 8. Table 4 illustrates the complementarity of the nucleotide sequences of PDGFB BINDING SITE, designated SEQ ID:6199, to the nucleotide sequence of GAM69 RNA, herein designated GAM RNA, also designated SEQ ID:258.

Another function of GAM69 is therefore inhibition of Platelet-derived growth factor beta polypeptide (simian sarcoma viral (v-sis) oncogene homolog) (PDGFB, Accession NP_148937.1), a gene which plays an important role in stimulating adjacent cells to grow and thereby heal the wound. and therefore may be associated with Dermatofibrosarcoma protuberans (dp). Accordingly, utilities of GAM69 include diagnosis, prevention and treatment of Dermatofibrosarcoma protuberans (dp), and of other diseases and clinical conditions associated with PDGFB.

The function of PDGFB has been established by previous studies. Most proliferating cells are programmed to undergo apoptosis unless specific survival signals are provided. Platelet-derived growth factor promotes cellular proliferation and inhibits apoptosis. Romashkova and Makarov (1999) showed that PDGF activates the RAS/PIK3/AKT1/IKK/NFKB1 pathway. In this pathway, NFKB1 (OMIM Ref. No. 164011) does not induce c-myc and apoptosis, but instead induces putative antiapoptotic genes. In response to PDGF, AKT1 (OMIM Ref. No. 164730) transiently associates with IKK (see OMIM Ref. No. 600664) and induces IKK activation. The authors suggested that under certain conditions PIK3 (see OMIM Ref. No. 171834) may activate NFKB1 without the involvement of NFKBIA (OMIM Ref. No. 164008) or NFKBIB (OMIM Ref. No. 604495) degradation. Dermatofibrosarcoma protuberans (DFSP), an infiltrative skin tumor of intermediate malignancy, presents specific cytogenetic features such as reciprocal translocations t(17;22)(q22;q13) and supernumerary ring chromosomes derived from t(17;22). Simon et al. (1997) characterized the breakpoints from translocations and rings in dermatofibrosarcoma protuberans and its juvenile form, giant cell fibroblastoma, on the genomic and RNA levels. They found that these rearrangements fuse the PDGFB gene and the COL1A1 gene (OMIM Ref. No. 120150). Simon et al. (1997) commented that PDGFB has transforming activity and is a potent mitogen for a number of cell types, but its role in oncogenic processes was not fully understood. They noted that neither COL1A1 nor PDGFB had hitherto been implicated in tumor translocations. The gene fusions deleted exon 1 of PDGFB and released this growth factor from its normal regulation; see 190040.0002.

Full details of the abovementioned studies are described in the following publications, the disclosure of which are hereby incorporated by reference:

Simon, M.-P.; Pedeutour, F.; Sirvent, N.; Grosgeorge, J.; Minoletti, F.; Coindre, J.-M.; Terrier-Lacombe, M.-J.; Mandahl, N.; Craver, R. D.; Blin, N.; Sozzi, G.; Turc-Carel, C.; O'Brien, K. P.; Kedra, D.; Fransson, I.; Guilbaud, C.; Dumanski, J. P.: Deregulation of the platelet-derived growth factor B-chain gene via fusion with collagen gene COL1A1 in dermatofibrosarcoma protuberans and giant-cell fibroblastoma. Nature Genet. 15:95-98, 1997; and Josephs, S. F.; Guo, C.; Ratner, L.; Wong-Staal, F.: Human proto - oncogene nucleotide sequences corresponding to the transforming region of simian sarcoma virus. Science 223: 487-491, 1.

Further studies establishing the function and utilities of PDGFB are found in John Hopkins OMIM database record ID 190040, and in cited publications listed in Table 5, which are hereby incorporated by reference. Platelet-derived growth factor beta polypeptide (simian sarcoma viral (v-sis) oncogene homolog) (PDGFB, Accession NP_002599.1) is another GAM69 target gene, herein designated TARGET GENE. PDGFB BINDING SITE is a target binding site found in the 3' untranslated region of multiple transcripts of mRNA encoded by PDGFB, corresponding to a target binding site such as BINDING SITE I, BINDING SITE II or BINDING SITE III of FIG. 8. Table 4 illustrates the complementarity of the nucleotide sequences of PDGFB BINDING SITE, designated SEQ ID:6199, to the nucleotide sequence of GAM69 RNA, herein designated GAM RNA, also designated SEQ ID:258.

Another function of GAM69 is therefore inhibition of Platelet-derived growth factor beta polypeptide (simian sarcoma viral (v-sis) oncogene homolog) (PDGFB, Accession NP_002599.1), a gene which plays an important role in stimulating adjacent cells to grow and thereby heal the wound. and therefore may be associated with Dermatofibrosarcoma protuberans (dp). Accordingly, utilities of GAM69 include diagnosis, prevention and treatment of Dermatofibrosarcoma protuberans (dp), and of other diseases and clinical conditions associated with PDGFB.

The function of PDGFB has been established by previous studies. Most proliferating cells are programmed to undergo apoptosis unless specific survival signals are provided. Platelet-derived growth factor promotes cellular proliferation and inhibits apoptosis. Romashkova and Makarov (1999) showed that PDGF activates the RAS/PIK3/AKT1/IKK/NFKB1 pathway. In this pathway, NFKB1 (OMIM Ref. No. 164011) does not induce c-myc and apoptosis, but instead induces putative antiapoptotic genes. In response to PDGF, AKT1 (OMIM Ref. No. 164730) transiently associates with IKK (see OMIM Ref. No. 600664) and induces IKK activation. The authors suggested that under certain conditions PIK3 (see OMIM Ref. No. 171834) may activate NFKB1 without the involvement of NFKBIA (OMIM Ref. No. 164008) or NFKBIB (OMIM Ref. No. 604495) degradation. Dermatofibrosarcoma protuberans (DFSP), an infiltrative skin tumor of intermediate malignancy, presents specific cytogenetic features such as reciprocal translocations t(17;22)(q22;q13) and supernumerary ring chromosomes derived from t(17;22). Simon et al. (1997) characterized the breakpoints from translocations and rings in dermatofibrosarcoma protuberans and its juvenile form, giant cell fibroblastoma, on the genomic and RNA levels. They found that these rearrangements fuse the PDGFB gene and the COL1A1 gene (OMIM Ref. No. 120150). Simon et al. (1997) commented that PDGFB has transforming activity and is a potent mitogen for a number of cell types, but its role in oncogenic processes was not fully understood. They noted that neither COL1A1 nor PDGFB had hitherto been implicated in tumor translocations. The gene fusions deleted exon 1 of PDGFB and released this growth factor from its normal regulation; see 190040.0002.

Full details of the abovementioned studies are described in the following publications, the disclosure of which are hereby incorporated by reference:

Simon, M.-P.; Pedeutour, F.; Sirvent, N.; Grosgeorge, J.; Minoletti, F.; Coindre, J.-M.; Terrier-Lacombe, M.-J.; Mandahl, N.; Craver, R. D.; Blin, N.; Sozzi, G.; Turc-Carel, C.; O'Brien, K. P.; Kedra, D.; Fransson, I.; Guilbaud, C.; Dumanski, J. P.: Deregulation of the platelet-derived growth factor B-chain gene via fusion with collagen gene COL1A1 in dermatofibrosarcoma protuberans and giant-cell fibroblastoma. Nature Genet. 15:95-98, 1997; and Josephs, S. F.; Guo, C.; Ratner, L.; Wong-Staal, F.: Human proto-oncogene nucleotide sequences corresponding to the transforming region of simian sarcoma virus. Science 223: 487-491, 1.

Further studies establishing the function and utilities of PDGFB are found in John Hopkins OMIM database record ID 190040, and in cited publications listed in Table 5, which are hereby incorporated by reference. PRO2015 (Accession NP_060982.1) is another GAM69 target gene, herein designated TARGET GENE. PRO2015 BINDING SITE is a target binding site found in the 3' untranslated region of mRNA encoded by PRO2015, corresponding to a target binding site such as BINDING SITE I, BINDING SITE II or BINDING SITE III of FIG. 8. Table 4 illustrates the complementarity of the nucleotide sequences of PRO2015 BINDING SITE, designated SEQ ID:18651, to the nucleotide sequence of GAM69 RNA, herein designated GAM RNA, also designated SEQ ID:258.

Another function of GAM69 is therefore inhibition of PRO2015 (Accession NP_060982.1). Accordingly, utilities of GAM69 include diagnosis, prevention and treatment of diseases and clinical conditions associated with PRO2015.

Protein z, vitamin k-dependent plasma glycoprotein (PROZ, Accession NP_003882.1) is another GAM69 target gene, herein designated TARGET GENE. PROZ BINDING SITE is a target binding site found in the 3' untranslated region of mRNA encoded by PROZ, corresponding to a target binding site such as BINDING SITE I, BINDING SITE II or BINDING SITE III of FIG. 8. Table 4 illustrates the complementarity of the nucleotide sequences of PROZ BINDING SITE, designated SEQ ID:10472, to the nucleotide sequence of GAM69 RNA, herein designated GAM RNA, also designated SEQ ID:258.

Another function of GAM69 is therefore inhibition of Protein z, vitamin k-dependent plasma glycoprotein (PROZ, Accession NP_003882.1). Accordingly, utilities of GAM69 include diagnosis, prevention and treatment of diseases and clinical conditions associated with PROZ.

Ptk7 protein tyrosine kinase 7 (PTK7, Accession NP_690622.1) is another GAM69 target gene, herein designated TARGET GENE. PTK7 BINDING SITE is a target binding site found in the 3' untranslated region of multiple transcripts of mRNA encoded by PTK7, corresponding to a target binding site such as BINDING SITE I, BINDING SITE II or BINDING SITE III of FIG. 8. Table 4 illustrates the complementarity of the nucleotide sequences of PTK7 BINDING SITE, designated SEQ ID:14002, to the nucleotide sequence of GAM69 RNA, herein designated GAM RNA, also designated SEQ ID:258.

Another function of GAM69 is therefore inhibition of Ptk7 protein tyrosine kinase 7 (PTK7, Accession NP_690622.1), a gene which is a glycosylated receptor protein tyrosine kinase and may function as a cell adhesion molecule. Accordingly, utilities of GAM69 include diagnosis, prevention and treatment of diseases and clinical conditions associated with PTK7.

The function of PTK7 has been established by previous studies. protein-tyrosine kinases (PTKs) play important roles in regulating cell proliferation and differentiation during development. Lee et al. (1993) isolated a 220-bp fragment of PTK7 cDNA through a screen designed to identify tyrosine kinase mRNAs expressed in normal human melanocytes. This fragment was mapped to chromosome 6 by Southern blotting using a panel of human-hamster somatic cell hybrids. Park et al. (1996) isolated a full-length PTK7 cDNA and found that it encodes a receptor protein-tyrosine kinase-like molecule closely related to a chick kinase-like gene whose function was unknown. Mossie et al. (1995) independently isolated the PTK7 gene from colon carcinoma and designated it colon carcinoma kinase-4. Banga et al. (1997) sublocalized the PTK7 gene to 6p21.1-p12.2 by fluorescence in situ hybridization.

Full details of the abovementioned studies are described in the following publications, the disclosure of which are hereby incorporated by reference:

Lee, S.-T.; Strunk, K. M.; Spritz, R. A.: A survey of protein tyrosine kinase mRNAs expressed in normal human melanocytes. Oncogene 8:3403-3410, 1993; and Park, S.-K.; Lee, H.-S.; Lee, S.-T.: Characterization of the human full-length PTK7 cDNA encoding a receptor protein tyrosine kinase-like molecule closely related to chick KLG. J. Bioch.

Further studies establishing the function and utilities of PTK7 are found in John Hopkins OMIM database record ID 601890, and in cited publications listed in Table 5, which are hereby incorporated by reference. Protein tyrosine phosphatase, non-receptor type 7 (PTPN7, Accession NP_542156.1) is another GAM69 target gene, herein designated TARGET GENE. PTPN7 BINDING SITE is a target binding site found in the 3' untranslated region of multiple transcripts of mRNA encoded by PTPN7, corresponding to a target binding site such as BINDING SITE I, BINDING SITE II or BINDING SITE III of FIG. 8. Table 4 illustrates the complementarity of the nucleotide sequences of PTPN7

BINDING SITE, designated SEQ ID:17270, to the nucleotide sequence of GAM69 RNA, herein designated GAM RNA, also designated SEQ ID:258.

Another function of GAM69 is therefore inhibition of Protein tyrosine phosphatase, non-receptor type 7 (PTPN7, Accession NP_542156.1). Accordingly, utilities of GAM69 include diagnosis, prevention and treatment of diseases and clinical conditions associated with PTPN7.

Protein tyrosine phosphatase, non-receptor type 7 (PTPN7, Accession NP_002823.2) is another GAM69 target gene, herein designated TARGET GENE. PTPN7 BINDING SITE is a target binding site found in the 3' untranslated region of multiple transcripts of mRNA encoded by PTPN7, corresponding to a target binding site such as BINDING SITE I, BINDING SITE II or BINDING SITE III of FIG. 8. Table 4 illustrates the complementarity of the nucleotide sequences of PTPN7 BINDING SITE, designated SEQ ID:17270, to the nucleotide sequence of GAM69 RNA, herein designated GAM RNA, also designated SEQ ID:258.

Another function of GAM69 is therefore inhibition of Protein tyrosine phosphatase, non-receptor type 7 (PTPN7, Accession NP_002823.2). Accordingly, utilities of GAM69 include diagnosis, prevention and treatment of diseases and clinical conditions associated with PTPN7.

Protein tyrosine phosphatase, non-receptor type 7 (PTPN7, Accession NP_542155.1) is another GAM69 target gene, herein designated TARGET GENE. PTPN7 BINDING SITE is a target binding site found in the 3' untranslated region of multiple transcripts of mRNA encoded by PTPN7, corresponding to a target binding site such as BINDING SITE I, BINDING SITE II or BINDING SITE III of FIG. 8. Table 4 illustrates the complementarity of the nucleotide sequences of PTPN7 BINDING SITE, designated SEQ ID:17270, to the nucleotide sequence of GAM69 RNA, herein designated GAM RNA, also designated SEQ ID:258.

Another function of GAM69 is therefore inhibition of Protein tyrosine phosphatase, non-receptor type 7 (PTPN7, Accession NP_542155.1). Accordingly, utilities of GAM69 include diagnosis, prevention and treatment of diseases and clinical conditions associated with PTPN7.

Ring finger protein 3 (RNF3, Accession NP_006306.2) is another GAM69 target gene, herein designated TARGET GENE. RNF3 BINDING SITE is a target binding site found in the 3' untranslated region of multiple transcripts of mRNA encoded by RNF3, corresponding to a target binding site such as BINDING SITE I, BINDING SITE II or BINDING SITE III of FIG. 8. Table 4 illustrates the complementarity of the nucleotide sequences of RNF3 BINDING SITE, designated SEQ ID:11664, to the nucleotide sequence of GAM69 RNA, herein designated GAM RNA, also designated SEQ ID:258.

Another function of GAM69 is therefore inhibition of Ring finger protein 3 (RNF3, Accession NP_006306.2), a gene which is a mitogen-activated nuclear kinase involved in signal transduction. Accordingly, utilities of GAM69 include diagnosis, prevention and treatment of diseases and clinical conditions associated with RNF3.

The function of RNF3 and its association with various diseases and clinical conditions, has been established by previous studies, as described hereinabove with reference to GAM63.1. Splicing factor 3a, subunit 3, 60 kda (SF3A3, Accession NP_006793.1) is another GAM69 target gene, herein designated TARGET GENE. SF3A3 BINDING SITE is a target binding site found in the 3' untranslated region of mRNA encoded by SF3A3, corresponding to a target binding site such as BINDING SITE I, BINDING SITE II or BINDING SITE III of FIG. 8. Table 4 illustrates the complementarity of the nucleotide sequences of SF3A3 BINDING SITE, designated SEQ ID:12715, to the nucleotide sequence of GAM69 RNA, herein designated GAM RNA, also designated SEQ ID:258.

Another function of GAM69 is therefore inhibition of Splicing factor 3a, subunit 3, 60 kda (SF3A3, Accession NP_006793.1). Accordingly, utilities of GAM69 include diagnosis, prevention and treatment of diseases and clinical conditions associated with SF3A3.

Spermatogenesis associated 2 (SPATA2, Accession NP_006029.1) is another GAM69 target gene, herein designated TARGET GENE. SPATA2 BINDING SITE is a target binding site found in the 3' untranslated region of mRNA encoded by SPATA2, corresponding to a target binding site such as BINDING SITE I, BINDING SITE II or BINDING SITE III of FIG. 8. Table 4 illustrates the complementarity of the nucleotide sequences of SPATA2 BINDING SITE, designated SEQ ID:8049, to the nucleotide sequence of GAM69 RNA, herein designated GAM RNA, also designated SEQ ID:258.

Another function of GAM69 is therefore inhibition of Spermatogenesis associated 2 (SPATA2, Accession NP_006029.1). Accordingly, utilities of GAM69 include diagnosis, prevention and treatment of diseases and clinical conditions associated with SPATA2.

Suppressor of fused homolog (drosophila) (SUFU, Accession NP_057253.2) is another GAM69 target gene, herein designated TARGET GENE. SUFU BINDING SITE is a target binding site found in the 3' untranslated region of mRNA encoded by SUFU, corresponding to a target binding site such as BINDING SITE I, BINDING SITE II or BINDING SITE III of FIG. 8. Table 4 illustrates the complementarity of the nucleotide sequences of SUFU BINDING SITE, designated SEQ ID:5078, to the nucleotide sequence of GAM69 RNA, herein designated GAM RNA, also designated SEQ ID:258.

Another function of GAM69 is therefore inhibition of Suppressor of fused homolog (drosophila) (SUFU, Accession NP_057253.2). Accordingly, utilities of GAM69 include diagnosis, prevention and treatment of diseases and clinical conditions associated with SUFU.

TUBB-5 (Accession NP_115914.1) is another GAM69 target gene, herein designated TARGET GENE. TUBB-5 BINDING SITE is a target binding site found in the 3' untranslated region of mRNA encoded by TUBB-5, corresponding to a target binding site such as BINDING SITE I, BINDING SITE II or BINDING SITE III of FIG. 8. Table 4 illustrates the complementarity of the nucleotide sequences of TUBB-5 BINDING SITE, designated SEQ ID:18195, to the nucleotide sequence of GAM69 RNA, herein designated GAM RNA, also designated SEQ ID:258.

Another function of GAM69 is therefore inhibition of TUBB-5 (Accession NP_115914.1). Accordingly, utilities of GAM69 include diagnosis, prevention and treatment of diseases and clinical conditions associated with TUBB-5.

Ubiquitin specific protease 9, y chromosome (fat facets-like drosophila) (USP9Y, Accession NP_004645.1) is another GAM69 target gene, herein designated TARGET GENE. USP9Y BINDING SITE is a target binding site found in the 5' untranslated region of mRNA encoded by USP9Y, corresponding to a target binding site such as BINDING SITE I, BINDING SITE II or BINDING SITE III of FIG. 8. Table 4 illustrates the complementarity of the nucleotide sequences of USP9Y BINDING SITE, designated SEQ ID:4718, to the nucleotide sequence of GAM69 RNA, herein designated GAM RNA, also designated SEQ ID:258.

Another function of GAM69 is therefore inhibition of Ubiquitin specific protease 9, y chromosome (fat facets-like drosophila) (USP9Y, Accession NP_004645.1), a gene which removes ubiquitin from ubiquitin-conjugated proteins and has a role in spermatogenesis and therefore may be associated with Azoospermia. Accordingly, utilities of GAM69 include diagnosis, prevention and treatment of Azoospermia, and of other diseases and clinical conditions associated with USP9Y.

The function of USP9Y has been established by previous studies. Sun et al. (1999) were the first to trace spermatogenic failure to a point mutation in a Y-linked gene or to a deletion of a single Y-linked gene. They sequenced the AZFa (see OMIM Ref. No. 415000) region of the Y chromosome and identified 2 functional genes previously described: USP9Y and DBY (OMIM Ref. No. 400010). Screening of the 2 genes in 576 infertile and 96 fertile men revealed several sequence variants, most of which appeared to be heritable and of little functional consequence. They found 1 de novo mutation in USP9Y: a 4-bp deletion in the splice donor site, causing an exon to be skipped and protein truncation. This mutation was present in a man with nonobstructive azoospermia, but was absent in his fertile brother, suggesting that the USP9Y mutation caused spermatogenic failure. Sun et al. (1999) also identified a single gene deletion associated with spermatogenic failure, again involving USP9Y, by reanalyzing a published study. The coding regions of the DFFRY and DFFRX genes show 89% identity at the nucleotide level. In common with DFFRX, the potential amino acid sequence of DFFRY contains the conserved cys and his domains characteristic of ubiquitin C-terminal hydrolases. The human DFFRY mRNA is expressed in a wide range of adult and embryonic tissues, including testis, whereas the homologous mouse Dffry gene is expressed specifically in the testis. Brown et al. (1998) found that 3 azoospermic male patients had deletion of DFFRY from the Y chromosome. Two patients had a testicular phenotype that resembled Sertoli cell-only syndrome (see OMIM Ref. No. 305700), and the third had diminished spermatogenesis. In all 3 patients, the deletions extended from close to the 3-prime end into the gene, removing the entire coding sequence of DFFRY. Brown et al. (1998) showed that the mouse Dffry gene maps to the Sxr-b deletion interval on the shorter arm of the mouse Y chromosome and that its expression in mouse testis can first be detected between 7.5 and 10.5 days after birth when type A and B spermatogonia and preleptotene and leptotene spermatocytes are present.

Full details of the abovementioned studies are described in the following publications, the disclosure of which are hereby incorporated by reference:

Sun, C.; Skaletsky, H.; Birren, B.; Devon, K.; Tang, Z.; Silber, S.; Oates, R.; Page, D. C.: An azoospermic man with a de novo point mutation in the Y-chromosomal gene USP9Y. Nature Genet. 23:429-432, 1999; and Brown, G. M.; Furlong, R. A.; Sargent, C. A.; Erickson, R. P.; Longepied, G.; Mitchell, M.; Jones, M. H.; Hargreave, T. B.; Cooke, H. J.; Affara, N. A.: Characterisation of the coding.

Further studies establishing the function and utilities of USP9Y are found in John Hopkins OMIM database record ID 400005, and in cited publications listed in Table 5, which are hereby incorporated by reference. Udp-glucuronate decarboxylase 1 (UXS1, Accession NP_079352.1) is another GAM69 target gene, herein designated TARGET GENE. UXS1 BINDING SITE is a target binding site found in the 5' untranslated region of mRNA encoded by UXS1, corresponding to a target binding site such as BINDING SITE I, BINDING SITE II or BINDING SITE III of FIG. 8. Table 4 illustrates the complementarity of the nucleotide sequences of UXS1 BINDING SITE, designated SEQ ID:7888, to the nucleotide sequence of GAM69 RNA, herein designated GAM RNA, also designated SEQ ID:258.

Another function of GAM69 is therefore inhibition of Udp-glucuronate decarboxylase 1 (UXS1, Accession NP_079352.1). Accordingly, utilities of GAM69 include diagnosis, prevention and treatment of diseases and clinical conditions associated with UXS1.

FIG. 8 further provides a conceptual description of a novel bioinformatically detected of the present invention, referred to here as Genomic Address Messenger 70 (GAM70), which modulates expression of respective target genes thereof, the function and utility of which target genes is known in the art.

GAM70 is a novel bioinformatically detected regulatory, non protein coding, micro RNA (miRNA) gene. The method by which GAM70 was detected is described hereinabove with reference to FIGS. 8-15.

GAM70 gene, herein designated GAM GENE, and GAM70 target gene, herein designated TARGET GENE, are human genes contained in the human genome.

GAM70 gene encodes a GAM70 precursor RNA, herein designated GAM PRECURSOR RNA. Similar to other miRNA genes, and unlike most ordinary genes, GAM70 precursor RNA does not encode a protein. A nucleotide sequence identical or highly similar to the nucleotide sequence of GAM70 precursor RNA is designated SEQ ID:158, and is provided hereinbelow with reference to the sequence listing part. Nucleotide sequence SEQ ID:158 is located at position 38540894 relative to chromosome 17.

GAM70 precursor RNA folds onto itself, forming GAM70 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM70 precursor RNA folds onto itself, forming GAM70 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM70 precursor RNA, designated SEQ-ID:158, and a schematic representation of a predicted secondary folding of GAM70 folded precursor RNA are further described with reference to Table 2, hereby incorporated by reference.

An enzyme complex designated DICER COMPLEX, 'dices' the GAM70 folded precursor RNA into GAM70 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM70 RNA is designated SEQ ID:358, and is provided hereinbelow with references to the sequence listing part and Table 3, hereby incorporated by reference.

GAM70 target gene, herein designated TARGET GENE, encodes a corresponding messenger RNA, GAM70 target RNA, herein designated GAM TARGET RNA. GAM70 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM70 RNA, herein designated GAM RNA, binds complementarily to one or more target binding sites located in untranslated regions of GAM70 target RNA, herein designated GAM TARGET RNA. This complementary binding is due to the fact that the nucleotide sequence of GAM70 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM70 RNA may have a different number of target binding sites in untranslated regions of a GAM70 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM70 RNA, herein designated GAM RNA, to target binding sites on GAM70 target RNA, herein designated GAM TARGET RNA, such as BINDING SITE I, BINDING SITE II and BINDING SITE III, inhibits translation of GAM70 target RNA into GAM70 target protein, herein designated GAM TARGET PROTEIN. GAM target protein is therefore outlined by a broken line.

It is appreciated that GAM70 target gene, herein designated TARGET GENE, in fact represents a plurality of GAM70 target genes. The mRNA of each one of this plurality of GAM70 target genes comprises one or more target binding sites, each having a nucleotide sequence which is at least partly complementary to GAM70 RNA, herein designated GAM RNA, and which when bound by GAM70 RNA causes inhibition of translation of respective one or more GAM70 target proteins.

It is further appreciated by one skilled in the art that the mode of translational inhibition illustrated by FIG. 8 with specific reference to translational inhibition exerted by GAM70 gene, herein designated GAM GENE, on one or more GAM70 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM70 correlate with, and may be deduced from, the identity of the target genes which GAM70 binds and inhibits, and the function of these target genes, as elaborated hereinbelow.

C1q and tumor necrosis factor related protein 6 (C1QTNF6, Accession NM_031910.2) is a GAM70 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:561, to the nucleotide sequence of GAM70 RNA, herein designated GAM RNA, also designated SEQ ID:358.

A function of GAM70 is therefore inhibition of C1q and tumor necrosis factor related protein 6 (C1QTNF6, Accession NM_031910.2). Accordingly, utilities of GAM70 include diagnosis, prevention and treatment of diseases and clinical conditions associated with C1QTNF6.

DKFZP434P211 (Accession NM_014549.1) is another GAM70 target gene, herein designated TARGET GENE. DKFZP434P211 BINDING SITE is a target binding site found in the 3' untranslated region of mRNA encoded by DKFZP434P211, corresponding to a target binding site such as BINDING SITE I, BINDING SITE II or BINDING SITE III of FIG. 8. Table 4 illustrates the complementarity of the nucleotide sequences of DKFZP434P211 BINDING SITE, designated SEQ ID:10873, to the nucleotide sequence of GAM70 RNA, herein designated GAM RNA, also designated SEQ ID:358.

Another function of GAM70 is therefore inhibition of DKFZP434P211 (Accession NM_014549.1). Accordingly, utilities of GAM70 include diagnosis, prevention and treatment of diseases and clinical conditions associated with DKFZP434P211.

FLJ13291 (Accession NM_032178.1) is another GAM70 target gene, herein designated TARGET GENE. FLJ13291 BINDING SITE is a target binding site found in the 3' untranslated region of mRNA encoded by FLJ13291, corresponding to a target binding site such as BINDING SITE I, BINDING SITE II or BINDING SITE III of FIG. 8. Table 4 illustrates the complementarity of the nucleotide sequences of FLJ13291 BINDING SITE, designated SEQ ID:16725, to the nucleotide sequence of GAM70 RNA, herein designated GAM RNA, also designated SEQ ID:358.

Another function of GAM70 is therefore inhibition of FLJ13291 (Accession NM_032178.1). Accordingly, utilities of GAM70 include diagnosis, prevention and treatment of diseases and clinical conditions associated with FLJ13291.

FLJ14950 (Accession) is another GAM70 target gene, herein designated TARGET GENE. FLJ14950 BINDING SITE is a target binding site found in the 3' untranslated region of mRNA encoded by FLJ14950, corresponding to a target binding site such as BINDING SITE I, BINDING SITE II or BINDING SITE III of FIG. 8. Table 4 illustrates the complementarity of the nucleotide sequences of FLJ14950 BINDING SITE, designated SEQ ID:1848, to the nucleotide sequence of GAM70 RNA, herein designated GAM RNA, also designated SEQ ID:358.

Another function of GAM70 is therefore inhibition of FLJ14950 (Accession). Accordingly, utilities of GAM70 include diagnosis, prevention and treatment of diseases and clinical conditions associated with FLJ14950.

LOC254956 (Accession XM_171204.2) is another GAM70 target gene, herein designated TARGET GENE. LOC254956 BINDING SITE is a target binding site found in the 3' untranslated region of mRNA encoded by LOC254956, corresponding to a target binding site such as BINDING SITE I, BINDING SITE II or BINDING SITE III of FIG. 8. Table 4 illustrates the complementarity of the nucleotide sequences of LOC254956 BINDING SITE, designated SEQ ID:10060, to the nucleotide sequence of GAM70 RNA, herein designated GAM RNA, also designated SEQ ID:358.

Another function of GAM70 is therefore inhibition of LOC254956 (Accession XM_171204.2). Accordingly, utilities of GAM70 include diagnosis, prevention and treatment of diseases and clinical conditions associated with LOC254956.

LOC91149 (Accession XM_036480.1) is another GAM70 target gene, herein designated TARGET GENE. LOC91149 BINDING SITE is a target binding site found in the 3' untranslated region of mRNA encoded by LOC91149, corresponding to a target binding site such as BINDING SITE I, BINDING SITE II or BINDING SITE III of FIG. 8. Table 4 illustrates the complementarity of the nucleotide sequences of LOC91149 BINDING SITE, designated SEQ ID:503, to the nucleotide sequence of GAM70 RNA, herein designated GAM RNA, also designated SEQ ID:358.

Another function of GAM70 is therefore inhibition of LOC91149 (Accession XM_036480.1). Accordingly, utilities of GAM70 include diagnosis, prevention and treatment of diseases and clinical conditions associated with LOC91149.

Serine protease inhibitor, kunitz type 1 (SPINT1, Accession NM_003710.1) is another GAM70 target gene, herein designated TARGET GENE. SPINT1 BINDING SITE is a target binding site found in the 3' untranslated region of mRNA encoded by SPINT1, corresponding to a target binding site such as BINDING SITE I, BINDING SITE II or BINDING SITE III of FIG. 8. Table 4 illustrates the complementarity of the nucleotide sequences of SPINT1 BINDING SITE, designated SEQ ID:1381, to the nucleotide sequence of GAM70 RNA, herein designated GAM RNA, also designated SEQ ID:358.

Another function of GAM70 is therefore inhibition of Serine protease inhibitor, kunitz type 1 (SPINT1, Accession NM_003710.1). Accordingly, utilities of GAM70 include diagnosis, prevention and treatment of diseases and clinical conditions associated with SPINT1.

FIG. 8 further provides a conceptual description of a novel bioinformatically detected of the present invention, referred to here as Genomic Address Messenger 71 (GAM71), which modulates expression of respective target genes thereof, the function and utility of which target genes is known in the art.

GAM71 is a novel bioinformatically detected regulatory, non protein coding, micro RNA (miRNA) gene. The method by which GAM71 was detected is described hereinabove with reference to FIGS. 8-15.

GAM71 gene, herein designated GAM GENE, and GAM71 target gene, herein designated TARGET GENE, are human genes contained in the human genome.

GAM71 gene encodes a GAM71 precursor RNA, herein designated GAM PRECURSOR RNA. Similar to other miRNA genes, and unlike most ordinary genes, GAM71 precursor RNA does not encode a protein. A nucleotide sequence identical or highly similar to the nucleotide sequence of GAM71 precursor RNA is designated SEQ ID:163, and is provided hereinbelow with reference to the sequence listing part. Nucleotide sequence SEQ ID:163 is located at position 56709260 relative to chromosome 12.

GAM71 precursor RNA folds onto itself, forming GAM71 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM71 precursor RNA folds onto itself, forming GAM71 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM71 precursor RNA, designated SEQ-ID:163, and a schematic representation of a predicted secondary folding of GAM71 folded precursor RNA are further described with reference to Table 2, hereby incorporated by reference.

An enzyme complex designated DICER COMPLEX, 'dices' the GAM71 folded precursor RNA into GAM71 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM71 RNA is designated SEQ ID:257, and is provided hereinbelow with references to the sequence listing part and Table 3, hereby incorporated by reference.

GAM71 target gene, herein designated TARGET GENE, encodes a corresponding messenger RNA, GAM71 target RNA, herein designated GAM TARGET RNA. GAM71 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM71 RNA, herein designated GAM RNA, binds complementarily to one or more target binding sites located in untranslated regions of GAM71 target RNA, herein designated GAM TARGET RNA. This complementary binding is due to the fact that the nucleotide sequence of GAM71 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM71 RNA may have a different number of target binding sites in untranslated regions of a GAM71 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM71 RNA, herein designated GAM RNA, to target binding sites on GAM71 target RNA, herein designated GAM TARGET RNA, such as BINDING SITE I, BINDING SITE II and BINDING SITE III, inhibits translation of GAM71 target RNA into GAM71 target protein, herein designated GAM TARGET PROTEIN. GAM target protein is therefore outlined by a broken line.

It is appreciated that GAM71 target gene, herein designated TARGET GENE, in fact represents a plurality of GAM71 target genes. The mRNA of each one of this plurality of GAM71 target genes comprises one or more target binding sites, each having a nucleotide sequence which is at least partly complementary to GAM71 RNA, herein designated GAM RNA, and which when bound by GAM71 RNA causes inhibition of translation of respective one or more GAM71 target proteins.

It is further appreciated by one skilled in the art that the mode of translational inhibition illustrated by FIG. 8 with specific reference to translational inhibition exerted by GAM71 gene, herein designated GAM GENE, on one or more GAM71 target genes, herein collectively designated TARGET GENE, is common to other known miRNA genes.

As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM71 correlate with, and may be deduced from, the identity of the target genes which GAM71 binds and inhibits, and the function of these target genes, as elaborated hereinbelow.

Atp-binding cassette, sub-family d (ald), member 4 (ABCD4, Accession NM_020323.1) is a GAM71 target gene, herein designated TARGET GENE. ABCD4 BINDING SITE is a target binding site found in the 3' untranslated region of multiple transcripts of mRNA encoded by ABCD4, corresponding to a target binding site such as BINDING SITE I, BINDING SITE II or BINDING SITE III of FIG. 8. Table 4 illustrates the complementarity of the nucleotide sequences of ABCD4 BINDING SITE, designated SEQ ID:8201, to the nucleotide sequence of GAM71 RNA, herein designated GAM RNA, also designated SEQ ID:257.

A function of GAM71 is therefore inhibition of Atp-binding cassette, sub-family d (ald), member 4 (ABCD4, Accession NM_020323.1), a gene which Putative peroxisomal ATP binding cassette transporter. Accordingly, utilities of GAM71 include diagnosis, prevention and treatment of diseases and clinical conditions associated with ABCD4.

The function of ABCD4 and its association with various diseases and clinical conditions, has been established by previous studies, as described hereinabove with reference to GAM51.1. Ankyrin repeat and btb (poz) domain containing 1 (ABTB1, Accession NM_032548.2) is another GAM71 target gene, herein designated TARGET GENE. ABTB1 BINDING SITE is a target binding site found in the 5' untranslated region of multiple transcripts of mRNA encoded by ABTB1, corresponding to a target binding site such as BINDING SITE I, BINDING SITE II or BINDING SITE III of FIG. 8. Table 4 illustrates the complementarity of the nucleotide sequences of ABTB1 BINDING SITE, designated SEQ ID:7271, to the nucleotide sequence of GAM71 RNA, herein designated GAM RNA, also designated SEQ ID:257.

Another function of GAM71 is therefore inhibition of Ankyrin repeat and btb (poz) domain containing 1 (ABTB1, Accession NM_032548.2). Accordingly, utilities of GAM71 include diagnosis, prevention and treatment of diseases and clinical conditions associated with ABTB1.

A disintegrin-like and metalloprotease (reprolysin type) with thrombospondin type 1 motif, 1 (ADAMTS1, Accession NM_006988.2) is another GAM71 target gene, herein designated TARGET GENE. ADAMTS1 BINDING SITE is a target binding site found in the 3' untranslated region of mRNA encoded by ADAMTS1, corresponding to a target binding site such as BINDING SITE I, BINDING SITE II or BINDING SITE III of FIG. 8. Table 4 illustrates the complementarity of the nucleotide sequences of ADAMTS1 BINDING SITE, designated SEQ ID:16850, to the nucleotide sequence of GAM71 RNA, herein designated GAM RNA, also designated SEQ ID:257.

Another function of GAM71 is therefore inhibition of A disintegrin-like and metalloprotease (reprolysin type) with thrombospondin type 1 motif, 1 (ADAMTS1, Accession NM_006988.2). Accordingly, utilities of GAM71 include diagnosis, prevention and treatment of diseases and clinical conditions associated with ADAMTS1.

A disintegrin-like and metalloprotease (reprolysin type) with thrombospondin type 1 motif, 13 (ADAMTS13, Accession NM_139025.1) is another GAM71 target gene, herein designated TARGET GENE. ADAMTS13 BINDING SITE is a target binding site found in the 5' untranslated region of multiple transcripts of mRNA encoded by ADAMTS13, corresponding to a target binding site such as BINDING SITE I, BINDING SITE II or BINDING SITE III of FIG. 8. Table 4 illustrates the complementarity of the nucleotide sequences of ADAMTS13 BINDING SITE, designated SEQ ID:7432, to the nucleotide sequence of GAM71 RNA, herein designated GAM RNA, also designated SEQ ID:257.

Another function of GAM71 is therefore inhibition of A disintegrin-like and metalloprotease (reprolysin type) with thrombospondin type 1 motif, 13 (ADAMTS13, Accession NM_139025.1), a gene which cleaves aggrecan, a cartilage proteoglycan, and may be involved in its turnover. Accordingly, utilities of GAM71 include diagnosis, prevention and treatment of diseases and clinical conditions associated with ADAMTS13.

The function of ADAMTS13 has been established by previous studies. Furlan et al. (1996) and Tsai (1996) independently reported that a metal-containing proteolytic enzyme (metalloprotease) in normal plasma cleaves the peptide bond between tyrosine at position 842 and methionine at position 843 in monomeric subunits of von Willebrand factor (VWF; 193400), thereby degrading the large multimers. This von Willebrand factor-cleaving protease was found by Furlan et al. (1997) to be deficient in 4 patients with chronic relapsing thrombotic thrombocytopenic purpura (OMIM Ref. No. 274150), 2 of whom were brothers. Because no inhibitor of the enzyme was detected in plasma, the deficiency was ascribed to an abnormality in the production, survival, or function of the protease. Furlan et al. (1998) studied plasma samples from 30 patients with thrombotic thrombocytopenic purpura and 23 patients with the hemolytic-uremic syndrome (HUS; 235400). Of 24 patients with nonfamilial thrombocytopenic purpura, 20 had severe and 4 had moderate protease deficiency during an acute event. An inhibitor of VWF found in 20 of the 24 patients (in all 5 plasma samples tested) was shown to be IgG, i.e., an antibody. Furlan et al. (1998) found that 6 patients with familial thrombocytopenic purpura lacked von Willebrand factor-cleaving protease activity but had no inhibitor, whereas all 10 patients with familial hemolytic-uremic syndrome had normal protease activity. In vitro proteolytic degradation of von Willebrand factor by the protease was studied in 5 patients with familial and 7 patients with nonfamilial hemolytic-uremic syndrome and was found to function normally in all 12 patients. In 2 Japanese families with Upshaw-Schulman syndrome (OMIM Ref. No. 276850), characterized by congenital TTP with neonatal onset and frequent relapses, Kokame et al. (2002) reported 4 novel mutations, 3 missense and 1 nonsense. Comparison of individual ADAMTS13 genotypes and plasma VWFCP activities indicated that 3 of the mutations, arg268 to pro (R268P; 604134.0014), gln449 to ter (Q449X; 604134.0013), and cys508 to tyr (C508Y; 604134.0015), abrogated activity of the enzyme, whereas the fourth, pro475 to ser (P475S; 604134.0016), retained low but significant activity. The effects of these mutations were further confirmed by expression analysis in HeLa cells. Recombinant VWFCP containing either of the mutations R268P or C508Y was not secreted from cells; in contrast, VWFCP containing either Q449X or P475S was normally secreted but demonstrated minimal activity. Genotype analysis of 364 Japanese subjects revealed that the P475S mutation was heterozygous in 9.6% of individuals, suggesting that approximately 10% of the Japanese population possesses reduced VWFCP activity. Thus, the mutation represents an SNP associated with alterations in VWFCP activity that may be a risk factor for thrombotic disorders.

Full details of the abovementioned studies are described in the following publications, the disclosure of which are hereby incorporated by reference:

Furlan, M.; Robles, R.; Galbusera, M.; Remuzzi, G.; Kyrle, P. A.; Brenner, B.; Krause, M.; Scharrer, I.; Aumann, V.; Mittler, U.; Solenthaler, M.; Lammle, B.: Von Willebrand factor-cleaving protease in thrombotic thrombocytopenic purpura and the hemolytic- uremic syndrome. New Eng. J. Med. 339:1578-1584, 1998; and Kokame, K.; Matsumoto, M.; Soejima, K.; Yagi, H.; Ishizashi, H.; Funato, M.; Tamai, H.; Konno, M.; Kamide, K.; Kawano, Y.; Miyata, T.; Fujimura, Y.: Mutations and common polymorphisms i.

Further studies establishing the function and utilities of ADAMTS13 are found in John Hopkins OMIM database record ID 604134, and in cited publications listed in Table 5, which are hereby incorporated by reference. AFAP (Accession NM_021638.2) is another GAM71 target gene, herein designated TARGET GENE. AFAP BINDING SITE is a target binding site found in the 3' untranslated region of mRNA encoded by AFAP, corresponding to a target binding site such as BINDING SITE I, BINDING SITE II or BINDING SITE III of FIG. 8. Table 4 illustrates the complementarity of the nucleotide sequences of AFAP BINDING SITE, designated SEQ ID:5293, to the nucleotide sequence of GAM71 RNA, herein designated GAM RNA, also designated SEQ ID:257.

Another function of GAM71 is therefore inhibition of AFAP (Accession NM_021638.2). Accordingly, utilities of GAM71 include diagnosis, prevention and treatment of diseases and clinical conditions associated with AFAP.

Ankyrin repeat and socs box-containing 16 (ASB16, Accession NM_080863.4) is another GAM71 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:1294, to the nucleotide sequence of GAM71 RNA, herein designated GAM RNA, also designated SEQ ID:257.

Another function of GAM71 is therefore inhibition of Ankyrin repeat and socs box-containing 16 (ASB16, Accession NM_080863.4). Accordingly, utilities of GAM71 include diagnosis, prevention and treatment of diseases and clinical conditions associated with ASB16.

Atpase, class i, type 8b, member 2 (ATP8B2, Accession XM_290875.1) is another GAM71 target gene, herein designated TARGET GENE. ATP8B2 BINDING SITE is a target binding site found in the 3' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:18449, to the nucleotide sequence of GAM71 RNA, herein designated GAM RNA, also designated SEQ ID:257.

Another function of GAM71 is therefore inhibition of Atpase, class i, type 8b, member 2 (ATP8B2, Accession XM_290875.1). Accordingly, utilities of GAM71 include diagnosis, prevention and treatment of diseases and clinical conditions associated with ATP8B2.

Axl receptor tyrosine kinase (AXL, Accession NM_021913.2) is another GAM71 target gene, herein designated TARGET GENE. AXL BINDING SITE is a target binding site found in the 5' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:3749, to the nucleotide sequence of GAM71 RNA, herein designated GAM RNA, also designated SEQ ID:257.

Another function of GAM71 is therefore inhibition of Axl receptor tyrosine kinase (AXL, Accession NM_021913.2). Accordingly, utilities of GAM71 include diagnosis, prevention and treatment of diseases and clinical conditions associated with AXL.

Beta-site app-cleaving enzyme (BACE, Accession NM_138973.1) is another GAM71 target gene, herein designated TARGET GENE. BACE BINDING SITE1 and BACE BINDING SITE2 are target binding sites found in untranslated regions of multiple transcripts of mRNA encoded by BACE, corresponding to target binding sites such as BINDING SITE I, BINDING SITE II or BINDING SITE III of FIG. 8. Table 4 illustrates the complementarity of the nucleotide sequences of BACE BINDING SITE1 and BACE BINDING SITE2, designated SEQ ID:12874 and SEQ ID:1238 respectively, to the nucleotide sequence of GAM71 RNA, herein designated GAM RNA, also designated SEQ ID:257.

Another function of GAM71 is therefore inhibition of Beta-site app-cleaving enzyme (BACE, Accession NM_138973.1), a gene which is responsible for the proteolytic processing of the amyloid precursor protein and therefore may be associated with Alzheimer disease. Accordingly, utilities of GAM71 include diagnosis, prevention and treatment of Alzheimer disease, and of other diseases and clinical conditions associated with BACE.

The function of BACE has been established by previous studies. Cerebral deposition of amyloid beta peptide is an early and critical feature of Alzheimer disease (AD; 104300). Amyloid beta generation depends on proteolytic cleavage of amyloid precursor protein (APP; 104760) by 2 proteases, beta-secretase and gamma-secretase. Vassar et al. (1999) reported the cloning of a human transmembrane aspartic protease that had all the known characteristics of the beta-secretase. Using an expression cloning strategy, they identified a clone that shared significant sequence similarity with members of the pepsin subfamily of aspartic proteases. This clone encoded a novel protein, designated BACE for 'beta-site APP-cleaving enzyme.' The BACE open reading frame encodes a protein of 501 amino acids containing a 21-amino acid signal peptide followed by a proprotein domain spanning amino acids 22 to 45. The lumenal domain of the mature protein is followed by 1 predicted transmembrane domain and a short cytosolic C-terminal tail of 24 amino acids. BACE was predicted to be a type 1 transmembrane protein with the active site on the lumenal side of the membrane, where beta-secretase cleaves APP. The BACE protein shares greatest amino acid identity (30%) with cathepsin E (OMIM Ref. No. 116890). Rat and mouse BACE orthologs have 96% amino acid sequence identity with the human BACE protein. Northern blot analysis of human BACE mRNA in adult peripheral tissues and various subregions of the brain detected 3 transcripts of approximately 7.0, 4.4, and 2.6 kb. By in situ hybridization, expression of BACE mRNA in rat brain was observed at higher levels in neurons than in glia, supporting the idea that neurons are the primary source of the extracellular A-beta deposited in amyloid plaques. Vassar et al. (1999) ascribed the difference between the apparent and calculated molecular weight (approximately 70 and 51 kD, respectively) of the BACE protein to N-linked glycosylation. Immunostaining demonstrated intracellular localization of BACE to the Golgi and endosomes. Transient overexpression of BACE did not affect APP expression, but decreased alpha-secretase cleavage and increased beta-secretase activity in cells expressing wildtype or Swedish mutant (104760.0008) APP. BACE overexpression induced cleavage only at the known beta-secretase positions, asp1 and glu11. Vassar et al. (1999) concluded that their data provided strong evidence that the BACE aspartic protease is the long-sought beta-secretase.

Animal model experiments lend further support to the function of BACE. Luo et al. (2001) found that mice deficient in BACE1 are healthy, fertile, and appear normal in gross anatomy, tissue histology, hematology, and clinical chemistry. Bace1 -/- mice who are also hemizygous for an amyloid precursor protein transgene lack brain beta-amyloid and beta-secretase-cleaved APP C-terminal fragments. These results provided validation of BACE1 as the major beta-secretase in vivo and suggested that therapeutic inhibition of BACE1 for the treatment of Alzheimer disease may be free of mechanism-based toxicity.

It is appreciated that the abovementioned animal model for BACE is acknowledged by those skilled in the art as a scientifically valid animal model, as can be further appreciated from the publications sited hereinbelow.

Full details of the abovementioned studies are described in the following publications, the disclosure of which are hereby incorporated by reference:

Vassar, R.; Bennett, B. D.; Babu-Khan, S.; Kahn, S.; Mendiaz, E. A.; Dents, P.; Taplow, D. B.; Ross, S.; Amaranta, P.; Loeloff, R.; Luo, Y.; Fisher, S.; and 12 others: Beta-secretase cleavage of Alzheimer's amyloid precursor protein by the transmembrane aspartic protease BACE. Science 286:735-741, 1999; and Luo, Y.; Bolon, B.; Kahn, S.; Bennett, B. D.; Babu-Khan, S.; Denis, P.; Fan, W.; Kha, H.; Zhang, J.; Gong, Y.; Martin, L.; Louis, J.-C.; Yan, Q.; Richards, W. G.; Citron, M.; Vassar, R.

Further studies establishing the function and utilities of BACE are found in John Hopkins OMIM database record ID 604252, and in cited publications listed in Table 5, which are hereby incorporated by reference. B-cell cll/lymphoma 2 (BCL2, Accession NM_000633.1) is another GAM71 target gene, herein designated TARGET GENE. BCL2 BINDING SITE is a target binding site found in the 3' untranslated region of multiple transcripts of mRNA encoded by BCL2, corresponding to a target binding site such as BINDING SITE I, BINDING SITE II or BINDING SITE III of FIG. 8. Table 4 illustrates the complementarity of the nucleotide sequences of BCL2 BINDING SITE, designated SEQ ID:8286, to the nucleotide sequence of GAM71 RNA, herein designated GAM RNA, also designated SEQ ID:257.

Another function of GAM71 is therefore inhibition of B-cell cll/lymphoma 2 (BCL2, Accession NM_000633.1). Accordingly, utilities of GAM71 include diagnosis, prevention and treatment of diseases and clinical conditions associated with BCL2.

Chromosome 14 open reading frame 1 (C14orf1, Accession NM_007176.1) is another GAM71 target gene, herein designated TARGET GENE. C14orf1 BINDING SITE is a target binding site found in the 3' untranslated region of mRNA encoded by C14orf1, corresponding to a target binding site such as BINDING SITE I, BINDING SITE II or BINDING SITE III of FIG. 8. Table 4 illustrates the complementarity of the nucleotide sequences of C14orf1 BINDING SITE, designated SEQ ID:18564, to the nucleotide sequence of GAM71 RNA, herein designated GAM RNA, also designated SEQ ID:257.

Another function of GAM71 is therefore inhibition of Chromosome 14 open reading frame 1 (C14orf1, Accession NM_007176.1). Accordingly, utilities of GAM71 include diagnosis, prevention and treatment of diseases and clinical conditions associated with C14orf1.

CGR11 (Accession NM_006569.1) is another GAM71 target gene, herein designated TARGET GENE. CGR11 BINDING SITE is a target binding site found in the 3' untranslated region of mRNA encoded by CGR11, corresponding to a target binding site such as BINDING SITE I, BINDING SITE II or BINDING SITE III of FIG. 8. Table 4 illustrates the complementarity of the nucleotide sequences of CGR11 BINDING SITE, designated SEQ ID:13993, to the nucleotide sequence of GAM71 RNA, herein designated GAM RNA, also designated SEQ ID:257.

Another function of GAM71 is therefore inhibition of CGR11 (Accession NM_006569.1). Accordingly, utilities of GAM71 include diagnosis, prevention and treatment of diseases and clinical conditions associated with CGR11.

Collagen, type iv, alpha 6 (COL4A6, Accession NM_001847.1) is another GAM71 target gene, herein designated TARGET GENE. COL4A6 BINDING SITE is a target binding site found in the 3' untranslated region of multiple transcripts of mRNA encoded by COL4A6, corresponding to a target binding site such as BINDING SITE I, BINDING SITE II or BINDING SITE III of FIG. 8. Table 4 illustrates the complementarity of the nucleotide sequences of COL4A6 BINDING SITE, designated SEQ ID:11540, to the nucleotide sequence of GAM71 RNA, herein designated GAM RNA, also designated SEQ ID:257.

Another function of GAM71 is therefore inhibition of Collagen, type iv, alpha 6 (COL4A6, Accession NM_001847.1). Accordingly, utilities of GAM71 include diagnosis, prevention and treatment of diseases and clinical conditions associated with COL4A6.

Cysteine and glycine-rich protein 1 (CSRP1, Accession NM_004078.1) is another GAM71 target gene, herein designated TARGET GENE. CSRP1 BINDING SITE is a target binding site found in the 3' untranslated region of mRNA encoded by CSRP1, corresponding to a target binding site such as BINDING SITE I, BINDING SITE II or BINDING SITE III of FIG. 8. Table 4 illustrates the complementarity of the nucleotide sequences of CSRP1 BINDING SITE, designated SEQ ID:14791, to the nucleotide sequence of GAM71 RNA, herein designated GAM RNA, also designated SEQ ID:257.

Another function of GAM71 is therefore inhibition of Cysteine and glycine-rich protein 1 (CSRP1, Accession NM_004078.1), a gene which could play a role in neuronal development. Accordingly, utilities of GAM71 include diagnosis, prevention and treatment of diseases and clinical conditions associated with CSRP1.

The function of CSRP1 has been established by previous studies. The human gene encoding cysteine-rich protein (CSRP) is a highly conserved, cell cycle-regulated gene that is induced in the immediate early response to serum repletion in serum-starved, noncycling cells. The LIM/double zinc finger motif found in cysteine-rich protein is found in an expanding group of proteins with critical functions in gene regulation, cell growth, and somatic differentiation (Wang et al., 1992). Other members of the group include cysteine-rich intestinal protein (CRIP; 123875), CSRP2 (OMIM Ref. No. 601871), CSRP3 (OMIM Ref. No. 600824), and the rhombotin genes RBTN1 (OMIM Ref. No. 186921), RBTN2 (OMIM Ref. No. 180385), and RBTN3 (OMIM Ref. No. 180386). Weiskirchen et al. (1995) described the CRP family of LIM domain proteins Wang et al. (1992) cloned the human CRP genomic sequence. The CRP gene spans approximately 23.2 kb from the cap site to the polyadenylation site. It contains 6 exons, with a 10.4-kb first intron. The authors showed that CRP is a primary response gene in both human fibroblasts and mouse Balb/c 3T3 cells; in the mouse cells, the kinetic profile of its induction closely paralleled that of c-myc (190080

Full details of the abovementioned studies are described in the following publications, the disclosure of which are hereby incorporated by reference:

Wang, X.; Ray, K.; Szpirer, J.; Levan, G.; Liebhaber, S. A.; Cooke, N. E.: Analysis of the human cysteine-rich protein gene (CSRP), assignment to chromosome 1q24-1q32, and identification of an associated MspI polymorphism. Genomics 14:391-397, 1992; and Liebhaber, S. A.; Emery, J. G.; Urbanek, M.; Wang, X.; Cooke, N. E.: Characterization of a human cDNA encoding a widely expressed and highly conserved cysteine-rich protein with an unus.

Further studies establishing the function and utilities of CSRP1 are found in John Hopkins OMIM database record ID 123876, and in cited publications listed in Table 5, which are hereby incorporated by reference. Dystroglycan 1 (dystrophin-associated glycoprotein 1) (DAG1, Accession NM_004393.1) is another GAM71 target gene, herein designated TARGET GENE. DAG1 BINDING SITE is a target binding site found in the 3' untranslated region of mRNA encoded by DAG1, corresponding to a target binding site such as BINDING SITE I, BINDING SITE II or BINDING SITE III of FIG. 8. Table 4 illustrates the complementarity of the nucleotide sequences of DAG1 BINDING SITE, designated SEQ ID:11861, to the nucleotide sequence of GAM71 RNA, herein designated GAM RNA, also designated SEQ ID:257.

Another function of GAM71 is therefore inhibition of Dystroglycan 1 (dystrophin-associated glycoprotein 1) (DAG1, Accession NM_004393.1), a gene which may provide linkage between the sarcolemma and extracellular matrix (ECM) and therefore may be associated with Fukuyama-type congenital muscular dystrophy. Accordingly, utilities of GAM71 include diagnosis, prevention and treatment of Fukuyama-type congenital muscular dystrophy, and of other diseases and clinical conditions associated with DAG1.

The function of DAG1 and its association with various diseases and clinical conditions, has been established by previous studies, as described hereinabove with reference to GAM63.1. Dodecenoyl-coenzyme a delta isomerase (3,2 trans-enoyl-coenzyme a isomerase) (DCI, Accession NM_001919.1) is another GAM71 target gene, herein designated TARGET GENE. DCI BINDING SITE is a target binding site found in the 3' untranslated region of mRNA encoded by DCI, corresponding to a target binding site such as BINDING SITE I, BINDING SITE II or BINDING SITE III of FIG. 8. Table 4 illustrates the complementarity of the nucleotide sequences of DCI BINDING SITE, designated SEQ ID:1497, to the nucleotide sequence of GAM71 RNA, herein designated GAM RNA, also designated SEQ ID:257.

Another function of GAM71 is therefore inhibition of Dodecenoyl-coenzyme a delta isomerase (3,2 trans-enoyl-coenzyme a isomerase) (DCI, Accession NM_001919.1). Accordingly, utilities of GAM71 include diagnosis, prevention and treatment of diseases and clinical conditions associated with DCI.

DKFZP434B103 (Accession NM_015644.1) is another GAM71 target gene, herein designated TARGET GENE. DKFZP434B103 BINDING SITE is a target binding site found in the 3' untranslated region of mRNA encoded by DKFZP434B103, corresponding to a target binding site such as BINDING SITE I, BINDING SITE II or BINDING SITE III of FIG. 8. Table 4 illustrates the complementarity of the nucleotide sequences of DKFZP434B103 BINDING SITE, designated SEQ ID:11454, to the nucleotide sequence of GAM71 RNA, herein designated GAM RNA, also designated SEQ ID:257.

Another function of GAM71 is therefore inhibition of DKFZP434B103 (Accession NM_015644.1). Accordingly, utilities of GAM71 include diagnosis, prevention and treatment of diseases and clinical conditions associated with DKFZP434B103.

DKFZp434G0920 (Accession) is another GAM71 target gene, herein designated TARGET GENE. DKFZp434G0920 BINDING SITE is a target binding site found in the 3' untranslated region of mRNA encoded by DKFZp434G0920, corresponding to a target binding site such as BINDING SITE I, BINDING SITE II or BINDING SITE III of FIG. 8. Table 4 illustrates the complementarity of the nucleotide sequences of DKFZp434G0920 BINDING SITE, designated SEQ ID:15728, to the nucleotide sequence of GAM71 RNA, herein designated GAM RNA, also designated SEQ ID:257.

Another function of GAM71 is therefore inhibition of DKFZp434G0920 (Accession). Accordingly, utilities of GAM71 include diagnosis, prevention and treatment of diseases and clinical conditions associated with DKFZp434G0920.

DKFZp434L0850 (Accession NM_017558.1) is another GAM71 target gene, herein designated TARGET GENE. DKFZp434L0850 BINDING SITE is a target binding site found in the 3' untranslated region of mRNA encoded by DKFZp434L0850, corresponding to a target binding site such as BINDING SITE I, BINDING SITE II or BINDING SITE III of FIG. 8. Table 4 illustrates the complementarity of the nucleotide sequences of DKFZp434L0850 BINDING SITE, designated SEQ ID:14410, to the nucleotide sequence of GAM71 RNA, herein designated GAM RNA, also designated SEQ ID:257.

Another function of GAM71 is therefore inhibition of DKFZp434L0850 (Accession NM_017558.1). Accordingly, utilities of GAM71 include diagnosis, prevention and treatment of diseases and clinical conditions associated with DKFZp434L0850.

DKFZp547H236 (Accession) is another GAM71 target gene, herein designated TARGET GENE. DKFZp547H236 BINDING SITE is a target binding site found in the 5' untranslated region of mRNA encoded by DKFZp547H236, corresponding to a target binding site such as BINDING SITE I, BINDING SITE II or BINDING SITE III of FIG. 8. Table 4 illustrates the complementarity of the nucleotide sequences of DKFZp547H236 BINDING SITE, designated SEQ ID:18786, to the nucleotide sequence of GAM71 RNA, herein designated GAM RNA, also designated SEQ ID:257.

Another function of GAM71 is therefore inhibition of DKFZp547H236 (Accession). Accordingly, utilities of GAM71 include diagnosis, prevention and treatment of diseases and clinical conditions associated with DKFZp547H236.

DKFZp547M072 (Accession) is another GAM71 target gene, herein designated TARGET GENE. DKFZp547M072

BINDING SITE is a target binding site found in the 3' untranslated region of mRNA encoded by DKFZp547M072, corresponding to a target binding site such as BINDING SITE I, BINDING SITE II or BINDING SITE III of FIG. 8. Table 4 illustrates the complementarity of the nucleotide sequences of DKFZp547M072 BINDING SITE, designated SEQ ID:15410, to the nucleotide sequence of GAM71 RNA, herein designated GAM RNA, also designated SEQ ID:257.

Another function of GAM71 is therefore inhibition of DKFZp547M072 (Accession). Accordingly, utilities of GAM71 include diagnosis, prevention and treatment of diseases and clinical conditions associated with DKFZp547M072.

DKFZP586I2223 (Accession NM_080730.1) is another GAM71 target gene, herein designated TARGET GENE. DKFZP586I2223 BINDING SITE is a target binding site found in the 3' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:457, to the nucleotide sequence of GAM71 RNA, herein designated GAM RNA, also designated SEQ ID:257.

Another function of GAM71 is therefore inhibition of DKFZP586I2223 (Accession NM_080730.1). Accordingly, utilities of GAM71 include diagnosis, prevention and treatment of diseases and clinical conditions associated with DKFZP586I2223.

DKFZP586M1120 (Accession NM_031294.1) is another GAM71 target gene, herein designated TARGET GENE. DKFZP586M1120 BINDING SITE is a target binding site found in the 3' untranslated region of mRNA encoded by DKFZP586M1120, corresponding to a target binding site such as BINDING SITE I, BINDING SITE II or BINDING SITE III of FIG. 8. Table 4 illustrates the complementarity of the nucleotide sequences of DKFZP586M1120 BINDING SITE, designated SEQ ID:7051, to the nucleotide sequence of GAM71 RNA, herein designated GAM RNA, also designated SEQ ID:257.

Another function of GAM71 is therefore inhibition of DKFZP586M1120 (Accession NM_031294.1). Accordingly, utilities of GAM71 include diagnosis, prevention and treatment of diseases and clinical conditions associated with DKFZP586M1120.

Dual specificity phosphatase 7 (DUSP7, Accession XM_037430.5) is another GAM71 target gene, herein designated TARGET GENE. DUSP7 BINDING SITE is a target binding site found in the 3' untranslated region of mRNA encoded by DUSP7, corresponding to a target binding site such as BINDING SITE I, BINDING SITE II or BINDING SITE III of FIG. 8. Table 4 illustrates the complementarity of the nucleotide sequences of DUSP7 BINDING SITE, designated SEQ ID:19651, to the nucleotide sequence of GAM71 RNA, herein designated GAM RNA, also designated SEQ ID:257.

Another function of GAM71 is therefore inhibition of Dual specificity phosphatase 7 (DUSP7, Accession XM_037430.5), a gene which is a member of the dual specificity protein phosphatase family. Accordingly, utilities of GAM71 include diagnosis, prevention and treatment of diseases and clinical conditions associated with DUSP7.

The function of DUSP7 has been established by previous studies. Members of the mitogen-activated protein (MAP) kinase family play a pivotal role in cellular signal transduction. The dual-specificity phosphatases can reverse MAP kinase activation by dephosphorylating critical phosphotyrosine and phosphothreonine residues. Muda et al. (1996) identified rat superior cervical ganglion cDNAs encoding 2 dual- specificity phosphatases that they designated MKP3 (OMIM Ref. No. 602748) and MKPX. The predicted 280-amino acid sequence of the partial MKPX cDNA was 76% identical to that of MKP3. Groom et al. (1996) identified cDNAs encoding the human MKP3 and MKPX homologs, which they called PYST1 and PYST2, respectively. The predicted amino acid sequence of the partial PYST2 cDNA was 73% identical to that of PYST1. Northern analysis revealed that the 3.5-kb PYST2 mRNA was expressed at low levels in several tissues. In liver, Groom et al. (1996) observed strong expression of a 2.5-kb transcript and much weaker expression of a 5-kb transcript.

Full details of the abovementioned studies are described in the following publications, the disclosure of which are hereby incorporated by reference:

Groom, L. A.; Sneddon, A. A.; Alessi, D. R.; Dowd, S.; Keyse, S. M.: Differential regulation of the MAP, SAP and Rk/p38 kinases by Pyst1, a novel cytosolic dual-specificity phosphatase. EMBO J. 15:3621-3632, 1996. ; and Muda, M.; Boschert, U.; Dickinson, R.; Martinou, J.-C.; Martinou, I.; Camps, M.; Schlegel, W.; Arkinstall, S.: MKP-3, a novel cytosolic protein-tyrosine phosphatase that exemplifies a.

Further studies establishing the function and utilities of DUSP7 are found in John Hopkins OMIM database record ID 602749, and in cited publications listed in Table 5, which are hereby incorporated by reference. Egl nine homolog 2 (c. elegans) (EGLN2, Accession NM_080732.1) is another GAM71 target gene, herein designated TARGET GENE. EGLN2 BINDING SITE is a target binding site found in the 3' untranslated region of multiple transcripts of mRNA encoded by EGLN2, corresponding to a target binding site such as BINDING SITE I, BINDING SITE II or BINDING SITE III of FIG. 8. Table 4 illustrates the complementarity of the nucleotide sequences of EGLN2 BINDING SITE, designated SEQ ID:16027, to the nucleotide sequence of GAM71 RNA, herein designated GAM RNA, also designated SEQ ID:257.

Another function of GAM71 is therefore inhibition of Egl nine homolog 2 (c. elegans) (EGLN2, Accession NM_080732.1), a gene which is an essential component of the pathway. Accordingly, utilities of GAM71 include diagnosis, prevention and treatment of diseases and clinical conditions associated with EGLN2.

The function of EGLN2 has been established by previous studies. In cultured mammalian cells, Bruick and McKnight (2001) found that the inappropriate accumulation of HIF caused by forced expression of the HIF1-alpha subunit under normoxic conditions was attenuated by coexpression of HPH. Suppression of HPH in cultured Drosophila melanogaster cells by RNA interference resulted in elevated expression of the hypoxia-inducible gene LDH (see OMIM Ref. No. 150000) under normoxic conditions. Bruick and McKnight (2001) concluded that HPH is an essential component of the pathway through which cells sense oxygen. HIF is a transcriptional complex that plays a central role in mammalian oxygen homeostasis. Posttranslational modification by prolyl hydroxylation is a key regulatory event that targets HIF-alpha (HIF1; 603348) subunits for proteasomal destruction via the von Hippel-Lindau (VHL; 193300) ubiquitylation complex. Epstein et al. (2001) defined a conserved HIF-VHL-prolyl hydroxylase pathway in C. elegans and identified Egl9 as a dioxygenase that regulates HIF by prolyl hydroxylation. In mammalian cells, they showed that the HIF-prolyl hydroxylases are represented by 3 proteins with a conserved 2-histidine-1-carboxylate iron coordination motif at the catalytic site. The genes encoding these proteins were cloned and termed PHD1, PHD2 (OMIM Ref. No. 606425), and PHD3 (OMIM Ref. No. 606426) by the authors. Direct modulation of recombinant enzyme activity by graded hypoxia, iron chelation, and cobaltous ions mirrored the characteristics of HIF induction in vivo, fulfilling requirements for these enzymes being oxygen sensors that regulate HIF.

Full details of the abovementioned studies are described in the following publications, the disclosure of which are hereby incorporated by reference:

Bruick, R. K.; McKnight, S. L.: A conserved family of prolyl-4-hydroxylases that modify HIF. Science 294:1337-1340, 2001; and Epstein, A. C. R.; Gleadle, J. M.; McNeill, L. A.; Hewitson, K. S.; O'Rourke, J.; Mole, D. R.; Mukherji, M.; Metzen, E.; Wilson, M. I.; Dhanda, A.; Tian, Y.-M.; Masson, N.; Hamilton, D.

Further studies establishing the function and utilities of EGLN2 are found in John Hopkins OMIM database record ID 606424, and in cited publications listed in Table 5, which are hereby incorporated by reference. Epithelial membrane protein 1 (EMP1, Accession NM_001423.1) is another GAM71 target gene, herein designated TARGET GENE. EMP1 BINDING SITE is a target binding site found in the 3' untranslated region of mRNA encoded by EMP1, corresponding to a target binding site such as BINDING SITE I, BINDING SITE II or BINDING SITE III of FIG. 8. Table 4 illustrates the complementarity of the nucleotide sequences of EMP1 BINDING SITE, designated SEQ ID:13208, to the nucleotide sequence of GAM71 RNA, herein designated GAM RNA, also designated SEQ ID:257.

Another function of GAM71 is therefore inhibition of Epithelial membrane protein 1 (EMP1, Accession NM_001423.1), a gene which plays a role in squamous cell differentiation; member of the PMP22/EMP/MP20 family of membrane glycoproteins. Accordingly, utilities of GAM71 include diagnosis, prevention and treatment of diseases and clinical conditions associated with EMP1.

The function of EMP1 and its association with various diseases and clinical conditions, has been established by previous studies, as described hereinabove with reference to GAM40.1. Fc fragment of ige, low affinity ii, receptor for (cd23a) (FCER2, Accession NM_002002.2) is another GAM71 target gene, herein designated TARGET GENE. FCER2 BINDING SITE is a target binding site found in the 3' untranslated region of mRNA encoded by FCER2, corresponding to a target binding site such as BINDING SITE I, BINDING SITE II or BINDING SITE III of FIG. 8. Table 4 illustrates the complementarity of the nucleotide sequences of FCER2 BINDING SITE, designated SEQ ID:9196, to the nucleotide sequence of GAM71 RNA, herein designated GAM RNA, also designated SEQ ID:257.

Another function of GAM71 is therefore inhibition of Fc fragment of ige, low affinity ii, receptor for (cd23a) (FCER2, Accession NM_002002.2), a gene which regulates the synthesis of IgE; contains an inverse RGD motif that binds to IgE. and therefore may be associated with Allergic diseases. Accordingly, utilities of GAM71 include diagnosis, prevention and treatment of Allergic diseases, and of other diseases and clinical conditions associated with FCER2.

The function of FCER2 has been established by previous studies. Ludin et al. (1987) cloned the cDNA coding for a human lymphocyte IgE receptor. Low- affinity receptors and secretor factors, which bind to immunoglobulins of the IgE isotype, play a key role in the regulation of human IgE synthesis. The nucleotide sequence of the cDNA predicted a polypeptide with 321 amino acids and a molecular weight of 36,281 daltons. The role of the IgE receptor in allergic diseases will be of interest. Furthermore, the receptor may be involved in determining the basic level of IgE in serum (OMIM Ref. No. 147050). The human leukocyte differentiation antigen CD23 (FCE2) is a key molecule for B-cell activation and growth. It is the low-affinity receptor for IgE. Furthermore, the truncated molecule can be secreted, then functioning as a potent mitogenic growth factor. Wendel-Hansen et al. (1990) showed by Southern analysis of DNAs from human/rodent cell hybrids that the CD23 gene is located on human chromosome 19. As part of a mapping of multiple probes to specific bands on chromosome 19 by fluorescence in situ hybridization, Trask et al. (1993) assigned the FCE2 gene to 19p13.3. Delespesse et al. (1989) studied the influence of IL4 and interferon on the production of CD23.

Full details of the abovementioned studies are described in the following publications, the disclosure of which are hereby incorporated by reference:

Ludin, C.; Hofstetter, H.; Sarfati, M.; Levy, C. A.; Suter, U.; Alaimo, D.; Kilchherr, E.; Frost, H.; Delespesse, G.: Cloning and expression of the cDNA coding for a human lymphocyte IgE receptor. EMBO J. 6:109-114, 1987; and Wendel-Hansen, V.; Riviere, M.; Uno, M.; Jansson, I.; Szpirer, J.; Islam, M. Q.; Levan, G.; Klein, G.; Yodoi, J.; Rosen, A.; Szpirer, C.: The gene encoding CD23 leukocyte antigen (FCE2).

Further studies establishing the function and utilities of FCER2 are found in John Hopkins OMIM database record ID 151445, and in cited publications listed in Table 5, which are hereby incorporated by reference. FLJ00001 (Accession XM_088525.2) is another GAM71 target gene, herein designated TARGET GENE. FLJ00001 BINDING SITE is a target binding site found in the 3' untranslated region of mRNA encoded by FLJ00001, corresponding to a target binding site such as BINDING SITE I, BINDING SITE II or BINDING SITE III of FIG. 8. Table 4 illustrates the complementarity of the nucleotide sequences of FLJ00001 BINDING SITE, designated SEQ ID:6511, to the nucleotide sequence of GAM71 RNA, herein designated GAM RNA, also designated SEQ ID:257.

Another function of GAM71 is therefore inhibition of FLJ00001 (Accession XM_088525.2). Accordingly, utilities of GAM71 include diagnosis, prevention and treatment of diseases and clinical conditions associated with FLJ00001.

FLJ10193 (Accession NM_018019.2) is another GAM71 target gene, herein designated TARGET GENE. FLJ10193 BINDING SITE is a target binding site found in the 3' untranslated region of mRNA encoded by FLJ10193, corresponding to a target binding site such as BINDING SITE I, BINDING SITE II or BINDING SITE III of FIG. 8. Table 4 illustrates the complementarity of the nucleotide sequences of FLJ10193 BINDING SITE, designated SEQ ID:6887, to the nucleotide sequence of GAM71 RNA, herein designated GAM RNA, also designated SEQ ID:257.

Another function of GAM71 is therefore inhibition of FLJ10193 (Accession NM_018019.2). Accordingly, utilities of GAM71 include diagnosis, prevention and treatment of diseases and clinical conditions associated with FLJ10193.

FLJ10604 (Accession) is another GAM71 target gene, herein designated TARGET GENE. FLJ10604 BINDING SITE is a target binding site found in the 5' untranslated region of mRNA encoded by FLJ10604, corresponding to a target binding site such as BINDING SITE I, BINDING SITE II or BINDING SITE III of FIG. 8. Table 4 illustrates the complementarity of the nucleotide sequences of FLJ10604

BINDING SITE, designated SEQ ID:753, to the nucleotide sequence of GAM71 RNA, herein designated GAM RNA, also designated SEQ ID:257.

Another function of GAM71 is therefore inhibition of FLJ10604 (Accession). Accordingly, utilities of GAM71 include diagnosis, prevention and treatment of diseases and clinical conditions associated with FLJ10604.

FLJ10743 (Accession NM_018201.2) is another GAM71 target gene, herein designated TARGET GENE. FLJ10743 BINDING SITE is a target binding site found in the 3' untranslated region of mRNA encoded by FLJ10743, corresponding to a target binding site such as BINDING SITE I, BINDING SITE II or BINDING SITE III of FIG. 8. Table 4 illustrates the complementarity of the nucleotide sequences of FLJ10743 BINDING SITE, designated SEQ ID:10397, to the nucleotide sequence of GAM71 RNA, herein designated GAM RNA, also designated SEQ ID:257.

Another function of GAM71 is therefore inhibition of FLJ10743 (Accession NM_018201.2). Accordingly, utilities of GAM71 include diagnosis, prevention and treatment of diseases and clinical conditions associated with FLJ10743.

FLJ11193 (Accession NM_018356.1) is another GAM71 target gene, herein designated TARGET GENE. FLJ11193 BINDING SITE is a target binding site found in the 3' untranslated region of mRNA encoded by FLJ11193, corresponding to a target binding site such as BINDING SITE I, BINDING SITE II or BINDING SITE III of FIG. 8. Table 4 illustrates the complementarity of the nucleotide sequences of FLJ11193 BINDING SITE, designated SEQ ID:9608, to the nucleotide sequence of GAM71 RNA, herein designated GAM RNA, also designated SEQ ID:257.

Another function of GAM71 is therefore inhibition of FLJ11193 (Accession NM_018356.1). Accordingly, utilities of GAM71 include diagnosis, prevention and treatment of diseases and clinical conditions associated with FLJ11193.

FLJ12122 (Accession) is another GAM71 target gene, herein designated TARGET GENE. FLJ12122 BINDING SITE is a target binding site found in the 5' untranslated region of mRNA encoded by FLJ12122, corresponding to a target binding site such as BINDING SITE I, BINDING SITE II or BINDING SITE III of FIG. 8. Table 4 illustrates the complementarity of the nucleotide sequences of FLJ12122 BINDING SITE, designated SEQ ID:10593, to the nucleotide sequence of GAM71 RNA, herein designated GAM RNA, also designated SEQ ID:257.

Another function of GAM71 is therefore inhibition of FLJ12122 (Accession). Accordingly, utilities of GAM71 include diagnosis, prevention and treatment of diseases and clinical conditions associated with FLJ12122.

FLJ13153 (Accession) is another GAM71 target gene, herein designated TARGET GENE. FLJ13153 BINDING SITE is a target binding site found in the 3' untranslated region of mRNA encoded by FLJ13153, corresponding to a target binding site such as BINDING SITE I, BINDING SITE II or BINDING SITE III of FIG. 8. Table 4 illustrates the complementarity of the nucleotide sequences of FLJ13153 BINDING SITE, designated SEQ ID:4589, to the nucleotide sequence of GAM71 RNA, herein designated GAM RNA, also designated SEQ ID:257.

Another function of GAM71 is therefore inhibition of FLJ13153 (Accession). Accordingly, utilities of GAM71 include diagnosis, prevention and treatment of diseases and clinical conditions associated with FLJ13153.

FLJ14100 (Accession NM_025025.1) is another GAM71 target gene, herein designated TARGET GENE. FLJ14100 BINDING SITE is a target binding site found in the 3' untranslated region of mRNA encoded by FLJ14100, corresponding to a target binding site such as BINDING SITE I, BINDING SITE II or BINDING SITE III of FIG. 8. Table 4 illustrates the complementarity of the nucleotide sequences of FLJ14100 BINDING SITE, designated SEQ ID:12679, to the nucleotide sequence of GAM71 RNA, herein designated GAM RNA, also designated SEQ ID:257.

Another function of GAM71 is therefore inhibition of FLJ14100 (Accession NM_025025.1). Accordingly, utilities of GAM71 include diagnosis, prevention and treatment of diseases and clinical conditions associated with FLJ14100.

FLJ20207 (Accession NM_017711.2) is another GAM71 target gene, herein designated TARGET GENE. FLJ20207 BINDING SITE is a target binding site found in the 3' untranslated region of mRNA encoded by FLJ20207, corresponding to a target binding site such as BINDING SITE I, BINDING SITE II or BINDING SITE III of FIG. 8. Table 4 illustrates the complementarity of the nucleotide sequences of FLJ20207 BINDING SITE, designated SEQ ID:4760, to the nucleotide sequence of GAM71 RNA, herein designated GAM RNA, also designated SEQ ID:257.

Another function of GAM71 is therefore inhibition of FLJ20207 (Accession NM_017711.2). Accordingly, utilities of GAM71 include diagnosis, prevention and treatment of diseases and clinical conditions associated with FLJ20207.

FLJ21596 (Accession NM_024823.1) is another GAM71 target gene, herein designated TARGET GENE. FLJ21596 BINDING SITE is a target binding site found in the 3' untranslated region of mRNA encoded by FLJ21596, corresponding to a target binding site such as BINDING SITE I, BINDING SITE II or BINDING SITE III of FIG. 8. Table 4 illustrates the complementarity of the nucleotide sequences of FLJ21596 BINDING SITE, designated SEQ ID:827, to the nucleotide sequence of GAM71 RNA, herein designated GAM RNA, also designated SEQ ID:257.

Another function of GAM71 is therefore inhibition of FLJ21596 (Accession NM_024823.1). Accordingly, utilities of GAM71 include diagnosis, prevention and treatment of diseases and clinical conditions associated with FLJ21596.

FLJ22378 (Accession NM_025078.1) is another GAM71 target gene, herein designated TARGET GENE. FLJ22378 BINDING SITE is a target binding site found in the 3' untranslated region of mRNA encoded by FLJ22378, corresponding to a target binding site such as BINDING SITE I, BINDING SITE II or BINDING SITE III of FIG. 8. Table 4 illustrates the complementarity of the nucleotide sequences of FLJ22378 BINDING SITE, designated SEQ ID:5148, to the nucleotide sequence of GAM71 RNA, herein designated GAM RNA, also designated SEQ ID:257.

Another function of GAM71 is therefore inhibition of FLJ22378 (Accession NM_025078.1). Accordingly, utilities of GAM71 include diagnosis, prevention and treatment of diseases and clinical conditions associated with FLJ22378.

FLJ32865 (Accession NM_144613.1) is another GAM71 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:14411, to the nucleotide sequence of GAM71 RNA, herein designated GAM RNA, also designated SEQ ID:257.

Another function of GAM71 is therefore inhibition of FLJ32865 (Accession NM_144613.1). Accordingly, utilities of GAM71 include diagnosis, prevention and treatment of diseases and clinical conditions associated with FLJ32865.

G protein-coupled receptor kinase-interactor 2 (GIT2, Accession NM_014776.2) is another GAM71 target gene, herein designated TARGET GENE. GIT2 BINDING SITE is a target binding site found in the 3' untranslated region of multiple transcripts of mRNA encoded by GIT2, corresponding to a target binding site such as BINDING SITE I, BINDING SITE II or BINDING SITE III of FIG. 8. Table 4 illustrates the complementarity of the nucleotide sequences of GIT2 BINDING SITE, designated SEQ ID:16979, to the nucleotide sequence of GAM71 RNA, herein designated GAM RNA, also designated SEQ ID:257.

Another function of GAM71 is therefore inhibition of G protein-coupled receptor kinase-interactor 2 (GIT2, Accession NM_014776.2). Accordingly, utilities of GAM71 include diagnosis, prevention and treatment of diseases and clinical conditions associated with GIT2.

Guanine nucleotide binding protein (g protein), alpha inhibiting activity polypeptide 2 (GNAI2, Accession NM_002070.1) is another GAM71 target gene, herein designated TARGET GENE. GNAI2 BINDING SITE is a target binding site found in the 3' untranslated region of mRNA encoded by GNAI2, corresponding to a target binding site such as BINDING SITE I, BINDING SITE II or BINDING SITE III of FIG. 8. Table 4 illustrates the complementarity of the nucleotide sequences of GNAI2 BINDING SITE, designated SEQ ID:5504, to the nucleotide sequence of GAM71 RNA, herein designated GAM RNA, also designated SEQ ID:257.

Another function of GAM71 is therefore inhibition of Guanine nucleotide binding protein (g protein), alpha inhibiting activity polypeptide 2 (GNAI2, Accession NM_002070.1), a gene which is a human G-alpha inhibitory protein and therefore may be associated with Adrenal cortical tumor. Accordingly, utilities of GAM71 include diagnosis, prevention and treatment of Adrenal cortical tumor, and of other diseases and clinical conditions associated with GNAI2.

The function of GNAI2 has been established by previous studies. Sparkes et al. (1987) and Blatt et al. (1988) used a cDNA probe with a mouse/human somatic cell hybrid panel to assign the alpha-2 inhibitory polypeptide to chromosome 3 in man and chromosome 9 in mouse. Blatt et al. (1988) also assigned the GNAI2 gene to chromosome 3 by hybridization of cDNA clones with DNA from human-mouse somatic cell hybrids. Itoh et al. (1988) demonstrated 3 distinct human G-alpha inhibitory proteins. Southern blot analysis indicated that a single copy of each gene is present in the haploid human genome. The alpha-2 and alpha-3 genes were found to be composed of 8 coding exons and 7 introns and to possess identical exon-intron organization. Magovcevic et al. (1992) isolated a cDNA for the GNAI2 gene from a human T-cell library and mapped it by chromosomal in situ hybridization to 3p21. A related sequence, GNAI2L (OMIM Ref. No. 139180), was mapped by the same method to 12p13-p12. The assignment to chromosome 3 was supported by PCR amplification of GNAI2-specific sequences in a human/rodent somatic cell hybrid containing only human chromosome 3. Hermouet et al. (1991) demonstrated that activating and inactivating mutations of the GNAI2 gene have opposite effects on proliferation of NIH 3T3 cells. Wilkie et al. (1992) assigned the corresponding gene to mouse chromosome 9. Since somatic mutations in some growth hormone-secreting pituitary tumors convert the gene for the alpha polypeptide chain of G(s) into a putative oncogene, referred to as GSP (OMIM Ref. No. 139320), Lyons et al. (1990) considered the likelihood that similar mutations would activate other G proteins. They found mutations of the GNAI2 gene that replaced arginine-179 with either cysteine or histidine in tumors of the adrenal cortex and endocrine tumors of the ovary. They referred to this mutant GNAI2 gene as the GIP2 oncogene. Williamson et al. (1995) studied 32 adrenocorticotrophin hormone-secreting pituitary adenomas for the presence of GSP and GIP mutations. GSP mutations were demonstrated in 2 tumors at codon 227 (139320.0012) and a GIP mutation was identified in 1 tumor at codon 179 (139360.0003).

Full details of the abovementioned studies are described in the following publications, the disclosure of which are hereby incorporated by reference:

Lyons, J.; Landis, C. A.; Harsh, G.; Vallar, L.; Grunewald, K.; Feichtinger, H.; Duh, Q.-Y.; Clark, O. H.; Kawasaki, E.; Bourne, H. R.; McCormick, F.: Two G protein oncogenes in human endocrine tumors. Science 249:655-659, 1990; and Magovcevic, I.; Ang, S.-L.; Seidman, J. G.; Tolman, C. J.; Neer, E. J.; Morton, C. C.: Regional localization of the human G protein alpha(i2) (GNAI2) gene: assignment to 3p21 and a rel.

Further studies establishing the function and utilities of GNAI2 are found in John Hopkins OMIM database record ID 139360, and in cited publications listed in Table 5, which are hereby incorporated by reference. GREB1 (Accession NM_014668.2) is another GAM71 target gene, herein designated TARGET GENE. GREB1 BINDING SITE is a target binding site found in the 3' untranslated region of multiple transcripts of mRNA encoded by GREB1, corresponding to a target binding site such as BINDING SITE I, BINDING SITE II or BINDING SITE III of FIG. 8. Table 4 illustrates the complementarity of the nucleotide sequences of GREB1 BINDING SITE, designated SEQ ID:2037, to the nucleotide sequence of GAM71 RNA, herein designated GAM RNA, also designated SEQ ID:257.

Another function of GAM71 is therefore inhibition of GREB1 (Accession NM_014668.2). Accordingly, utilities of GAM71 include diagnosis, prevention and treatment of diseases and clinical conditions associated with GREB1.

H-plk (Accession NM_015852.1) is another GAM71 target gene, herein designated TARGET GENE. H-plk BINDING SITE is a target binding site found in the 5' untranslated region of mRNA encoded by H-plk, corresponding to a target binding site such as BINDING SITE I, BINDING SITE II or BINDING SITE III of FIG. 8. Table 4 illustrates the complementarity of the nucleotide sequences of H-plk BINDING SITE, designated SEQ ID:11965, to the nucleotide sequence of GAM71 RNA, herein designated GAM RNA, also designated SEQ ID:257.

Another function of GAM71 is therefore inhibition of H-plk (Accession NM_015852.1). Accordingly, utilities of GAM71 include diagnosis, prevention and treatment of diseases and clinical conditions associated with H-plk.

HEMK (Accession NM_016173.1) is another GAM71 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:14603, to the nucleotide sequence of GAM71 RNA, herein designated GAM RNA, also designated SEQ ID:257.

Another function of GAM71 is therefore inhibition of HEMK (Accession NM_016173.1). Accordingly, utilities of GAM71 include diagnosis, prevention and treatment of diseases and clinical conditions associated with HEMK.

Hir histone cell cycle regulation defective homolog a (s. cerevisiae) (HIRA, Accession NM_003325.3) is another GAM71 target gene, herein designated TARGET GENE.

HIRA BINDING SITE is a target binding site found in the 3' untranslated region of mRNA encoded by HIRA, corresponding to a target binding site such as BINDING SITE I, BINDING SITE II or BINDING SITE III of FIG. 8. Table 4 illustrates the complementarity of the nucleotide sequences of HIRA BINDING SITE, designated SEQ ID:1388, to the nucleotide sequence of GAM71 RNA, herein designated GAM RNA, also designated SEQ ID:257.

Another function of GAM71 is therefore inhibition of Hir histone cell cycle regulation defective homolog a (s. cerevisiae) (HIRA, Accession NM_003325.3), a gene which could have a part in mechanisms of transcriptional regulation similar to that played by yeast hir1 and hir2 together. and therefore may be associated with Digeorge syndrome. Accordingly, utilities of GAM71 include diagnosis, prevention and treatment of Digeorge syndrome, and of other diseases and clinical conditions associated with HIRA.

The function of HIRA has been established by previous studies. The human TUPLE1 gene encodes a putative transcription regulator with a sequence similar to that of the yeast TUP1 gene (Halford et al., 1993). The protein product of the TUPLE1 gene contains WD40 domains, motifs thought to be involved in protein-protein interactions. Halford et al. (1993) demonstrated that the TUPLE1 gene maps to chromosome 22 and to the shortest region of deletion overlap in a series of over 100 patients with the DiGeorge syndrome (DGS; 188400), velocardiofacial syndrome (VCFS; 192430), or a related disorder. It is expressed in a range of fetal tissues. Halford et al. (1993) cloned the murine Tuple1 gene and showed that it has strong sequence similarity to the human gene. Since TUPLE1 is a candidate gene for DGS through the mechanism of haploinsufficiency and it might be possible to produce models of this disorder by creating mutations in the mouse gene, Mattei et al. (1994) mapped the gene to mouse chromosome 16 by isotopic in situ hybridization. The experiments were carried out using metaphase spreads from a WMP male mouse in which all of the autosomes, except 19, were in the form of metacentric Robertsonian translocations. In the human, TUPLE1 is centromeric to COMT (OMIM Ref. No. 116790), which in turn is centromeric to IGLC1 (OMIM Ref. No. 147220); all of these expressed sequences map to mouse chromosome 16. Magnaghi et al. (1998) reported an interaction between HIRA and the transcription factor PAX3 (OMIM Ref. No. 606597). PAX3 haploinsufficiency results in the mouse 'splotch' and human Waardenburg syndrome (see OMIM Ref. No. 193500) phenotypes. Mice homozygous for PAX3 mutations die in utero with a phenocopy of DiGeorge syndrome, or neonatally with neural tube defects. HIRA was also found to interact with core histones. Thus, altered stoichiometry of complexes containing HIRA may be important for the development of structures affected in Waardenburg syndrome and DiGeorge syndrome.

Full details of the abovementioned studies are described in the following publications, the disclosure of which are hereby incorporated by reference:

Halford, S.; Wilson, D. I.; Daw, S. C. M.; Roberts, C.; Wadey, R.; Kamath, S.; Wickremasinghe, A.; Burn, J.; Goodship, J.; Mattei, M.-G.; Moorman, A. F. M.; Scambler, P. J.: Isolation of a gene expressed during early embryogenesis from the region of 22q11 commonly deleted in DiGeorge syndrome. Hum. Molec. Genet. 2: 1577-1582, 1993; and Magnaghi, P.; Roberts, C.; Lorain, S.; Lipinski, M.; Scambler, P. J.: HIRA, a mammalian homologue of Saccharomyces cerevisiae transcriptional co-repressors, interacts with Pax3. Natur.

Further studies establishing the function and utilities of HIRA are found in John Hopkins OMIM database record ID 600237, and in cited publications listed in Table 5, which are hereby incorporated by reference. Inhibitor of dna binding 4, dominant negative helix-loop-helix protein (ID4, Accession NM_001546.2) is another GAM71 target gene, herein designated TARGET GENE. ID4 BINDING SITE is a target binding site found in the 3' untranslated region of mRNA encoded by ID4, corresponding to a target binding site such as BINDING SITE I, BINDING SITE II or BINDING SITE III of FIG. 8. Table 4 illustrates the complementarity of the nucleotide sequences of ID4 BINDING SITE, designated SEQ ID:19992, to the nucleotide sequence of GAM71 RNA, herein designated GAM RNA, also designated SEQ ID:257.

Another function of GAM71 is therefore inhibition of Inhibitor of dna binding 4, dominant negative helix-loop-helix protein (ID4, Accession NM_001546.2), a gene which negatively regulates cell differentiation. Accordingly, utilities of GAM71 include diagnosis, prevention and treatment of diseases and clinical conditions associated with ID4.

The function of ID4 has been established by previous studies. Transcription factors containing a basic helix-loop-helix (bHLH) motif regulate the expression of tissue-specific genes in a number of mammalian and insect systems (Pagliuca et al., 1995). DNA-binding activity of the bHLH proteins is dependent on formation of homo- and/or heterodimers. Dominant-negative HLH proteins (encoded by Id-related genes) also contain the HLH-dimerization domain but lack the DNA-binding basic domain. Consequently, Id proteins inhibit binding to DNA and transcriptional transactivation by heterodimerization with bHLH proteins. Pagliuca et al. (1995) reported the cDNA sequence of a novel human HLH gene, to which the symbol ID4 was assigned, which lacks the basic domain. ID4 is differentially expressed in adult organs as 4 mRNA molecules that are presumably the result of differential splicing and/or alternative polyadenylation sites. Transfection experiments indicated that enforced expression of the ID4 protein inhibits the transactivation of the muscle creatine kinase (CKM; 123310) E-box enhancer by MyoD (MYOD1; 159970). By fluorescence in situ hybridization (FISH), Pagliuca et al. (1995) mapped the ID4 gene to 6p22-p21.3. By the same method, Rigolet et al. (1998) mapped the gene to 6p23-p22.3. For other dominant- negative inhibitors of DNA binding, see ID1 (OMIM Ref. No. 600349), ID2 (OMIM Ref. No. 600386), and ID3 (600277

Full details of the abovementioned studies are described in the following publications, the disclosure of which are hereby incorporated by reference:

Pagliuca, A.; Bartoli, P. C.; Saccone, S.; Valle, G. D.; Lania, L.: Molecular cloning of ID4, a novel dominant negative helix-loop-helix human gene on chromosome 6p21.3-p22. Genomics 27:200-203, 1995; and Rigolet, M.; Rich, T.; Gross-Morand, M.-S.; Molina-Gomes, D.; Viegas-Pequignot, E.; Junien, C.: cDNA cloning, tissue distribution and chromosomal localization of the human ID4 gene. DNA.

Further studies establishing the function and utilities of ID4 are found in John Hopkins OMIM database record ID 600581, and in cited publications listed in Table 5, which are hereby incorporated by reference. IL27 (Accession) is another GAM71 target gene, herein designated TARGET GENE. IL27 BINDING SITE is a target binding site found in the 5' untranslated region of mRNA encoded by IL27, corresponding to a target binding site such as BINDING SITE I, BINDING SITE II or BINDING SITE III of FIG. 8. Table 4 illustrates the complementarity of the nucleotide sequences of IL27 BINDING SITE, designated SEQ ID:2935, to the nucleotide sequence of GAM71 RNA, herein designated GAM RNA, also designated SEQ ID:257.

Another function of GAM71 is therefore inhibition of IL27 (Accession). Accordingly, utilities of GAM71 include diagnosis, prevention and treatment of diseases and clinical conditions associated with IL27.

Inositol 1,3,4-triphosphate 5/6 kinase (ITPK1, Accession NM_014216.2) is another GAM71 target gene, herein designated TARGET GENE. ITPK1 BINDING SITE is a target binding site found in the 3' untranslated region of mRNA encoded by ITPK1, corresponding to a target binding site such as BINDING SITE I, BINDING SITE II or BINDING SITE III of FIG. 8. Table 4 illustrates the complementarity of the nucleotide sequences of ITPK1 BINDING SITE, designated SEQ ID:18327, to the nucleotide sequence of GAM71 RNA, herein designated GAM RNA, also designated SEQ ID:257.

Another function of GAM71 is therefore inhibition of Inositol 1,3,4-triphosphate 5/6 kinase (ITPK1, Accession NM_014216.2). Accordingly, utilities of GAM71 include diagnosis, prevention and treatment of diseases and clinical conditions associated with ITPK1.

KIAA0368 (Accession XM_036708.9) is another GAM71 target gene, herein designated TARGET GENE. KIAA0368 BINDING SITE is a target binding site found in the 3' untranslated region of mRNA encoded by KIAA0368, corresponding to a target binding site such as BINDING SITE I, BINDING SITE II or BINDING SITE III of FIG. 8. Table 4 illustrates the complementarity of the nucleotide sequences of KIAA0368 BINDING SITE, designated SEQ ID:10473, to the nucleotide sequence of GAM71 RNA, herein designated GAM RNA, also designated SEQ ID:257.

Another function of GAM71 is therefore inhibition of KIAA0368 (Accession XM_036708.9). Accordingly, utilities of GAM71 include diagnosis, prevention and treatment of diseases and clinical conditions associated with KIAA0368.

KIAA0450 (Accession NM_014638.1) is another GAM71 target gene, herein designated TARGET GENE. KIAA0450 BINDING SITE is a target binding site found in the 5' untranslated region of mRNA encoded by KIAA0450, corresponding to a target binding site such as BINDING SITE I, BINDING SITE II or BINDING SITE III of FIG. 8. Table 4 illustrates the complementarity of the nucleotide sequences of KIAA0450 BINDING SITE, designated SEQ ID:14799, to the nucleotide sequence of GAM71 RNA, herein designated GAM RNA, also designated SEQ ID:257.

Another function of GAM71 is therefore inhibition of KIAA0450 (Accession NM_014638.1). Accordingly, utilities of GAM71 include diagnosis, prevention and treatment of diseases and clinical conditions associated with KIAA0450.

KIAA0469 (Accession NM_014851.1) is another GAM71 target gene, herein designated TARGET GENE. KIAA0469 BINDING SITE is a target binding site found in the 3' untranslated region of mRNA encoded by KIAA0469, corresponding to a target binding site such as BINDING SITE I, BINDING SITE II or BINDING SITE III of FIG. 8. Table 4 illustrates the complementarity of the nucleotide sequences of KIAA0469 BINDING SITE, designated SEQ ID:15128, to the nucleotide sequence of GAM71 RNA, herein designated GAM RNA, also designated SEQ ID:257.

Another function of GAM71 is therefore inhibition of KIAA0469 (Accession NM_014851.1). Accordingly, utilities of GAM71 include diagnosis, prevention and treatment of diseases and clinical conditions associated with KIAA0469.

KIAA0767 (Accession XM_027105.3) is another GAM71 target gene, herein designated TARGET GENE. KIAA0767 BINDING SITE is a target binding site found in the 3' untranslated region of mRNA encoded by KIAA0767, corresponding to a target binding site such as BINDING SITE I, BINDING SITE II or BINDING SITE III of FIG. 8. Table 4 illustrates the complementarity of the nucleotide sequences of KIAA0767 BINDING SITE, designated SEQ ID:10304, to the nucleotide sequence of GAM71 RNA, herein designated GAM RNA, also designated SEQ ID:257.

Another function of GAM71 is therefore inhibition of KIAA0767 (Accession XM_027105.3). Accordingly, utilities of GAM71 include diagnosis, prevention and treatment of diseases and clinical conditions associated with KIAA0767.

KIAA0775 (Accession) is another GAM71 target gene, herein designated TARGET GENE. KIAA0775 BINDING SITE is a target binding site found in the 3' untranslated region of mRNA encoded by KIAA0775, corresponding to a target binding site such as BINDING SITE I, BINDING SITE II or BINDING SITE III of FIG. 8. Table 4 illustrates the complementarity of the nucleotide sequences of KIAA0775 BINDING SITE, designated SEQ ID:15906, to the nucleotide sequence of GAM71 RNA, herein designated GAM RNA, also designated SEQ ID:257.

Another function of GAM71 is therefore inhibition of KIAA0775 (Accession). Accordingly, utilities of GAM71 include diagnosis, prevention and treatment of diseases and clinical conditions associated with KIAA0775.

KIAA1010 (Accession XM_050742.5) is another GAM71 target gene, herein designated TARGET GENE. KIAA1010 BINDING SITE is a target binding site found in the 3' untranslated region of mRNA encoded by KIAA1010, corresponding to a target binding site such as BINDING SITE I, BINDING SITE II or BINDING SITE III of FIG. 8. Table 4 illustrates the complementarity of the nucleotide sequences of KIAA1010 BINDING SITE, designated SEQ ID:17733, to the nucleotide sequence of GAM71 RNA, herein designated GAM RNA, also designated SEQ ID:257.

Another function of GAM71 is therefore inhibition of KIAA1010 (Accession XM_050742.5). Accordingly, utilities of GAM71 include diagnosis, prevention and treatment of diseases and clinical conditions associated with KIAA1010.

KIAA1879 (Accession XM_056635.4) is another GAM71 target gene, herein designated TARGET GENE. KIAA1879 BINDING SITE is a target binding site found in the 3' untranslated region of mRNA encoded by KIAA1879, corresponding to a target binding site such as BINDING SITE I, BINDING SITE II or BINDING SITE III of FIG. 8. Table 4 illustrates the complementarity of the nucleotide sequences of KIAA1879 BINDING SITE, designated SEQ ID:15615, to the nucleotide sequence of GAM71 RNA, herein designated GAM RNA, also designated SEQ ID:257.

Another function of GAM71 is therefore inhibition of KIAA1879 (Accession XM_056635.4). Accordingly, utilities of GAM71 include diagnosis, prevention and treatment of diseases and clinical conditions associated with KIAA1879.

Lipoma hmgic fusion partner (LHFP, Accession NM_005780.1) is another GAM71 target gene, herein designated TARGET GENE. LHFP BINDING SITE is a target binding site found in the 5' untranslated region of mRNA encoded by LHFP, corresponding to a target binding site such as BINDING SITE I, BINDING SITE II or BINDING SITE III of FIG. 8. Table 4 illustrates the complementarity of the nucleotide sequences of LHFP BINDING SITE, designated SEQ ID:5024, to the nucleotide sequence of GAM71 RNA, herein designated GAM RNA, also designated SEQ ID:257.

Another function of GAM71 is therefore inhibition of Lipoma hmgic fusion partner (LHFP, Accession NM_005780.1). Accordingly, utilities of GAM71 include diagnosis, prevention and treatment of diseases and clinical conditions associated with LHFP.

LOC113763 (Accession) is another GAM71 target gene, herein designated TARGET GENE. LOC113763 BINDING SITE is a target binding site found in the 3' untranslated region of mRNA encoded by LOC113763, corresponding to a target binding site such as BINDING SITE I, BINDING SITE II or BINDING SITE III of FIG. 8. Table 4 illustrates the complementarity of the nucleotide sequences of LOC113763 BINDING SITE, designated SEQ ID:14333, to the nucleotide sequence of GAM71 RNA, herein designated GAM RNA, also designated SEQ ID:257.

Another function of GAM71 is therefore inhibition of LOC113763 (Accession). Accordingly, utilities of GAM71 include diagnosis, prevention and treatment of diseases and clinical conditions associated with LOC113763.

LOC118471 (Accession NM_145202.1) is another GAM71 target gene, herein designated TARGET GENE. LOC118471 BINDING SITE is a target binding site found in the 3' untranslated region of mRNA encoded by LOC118471, corresponding to a target binding site such as BINDING SITE I, BINDING SITE II or BINDING SITE III of FIG. 8. Table 4 illustrates the complementarity of the nucleotide sequences of LOC118471 BINDING SITE, designated SEQ ID:10854, to the nucleotide sequence of GAM71 RNA, herein designated GAM RNA, also designated SEQ ID:257.

Another function of GAM71 is therefore inhibition of LOC118471 (Accession NM_145202.1). Accordingly, utilities of GAM71 include diagnosis, prevention and treatment of diseases and clinical conditions associated with LOC118471.

LOC126364 (Accession) is another GAM71 target gene, herein designated TARGET GENE. LOC126364 BINDING SITE is a target binding site found in the 5' untranslated region of mRNA encoded by LOC126364, corresponding to a target binding site such as BINDING SITE I, BINDING SITE II or BINDING SITE III of FIG. 8. Table 4 illustrates the complementarity of the nucleotide sequences of LOC126364 BINDING SITE, designated SEQ ID:19761, to the nucleotide sequence of GAM71 RNA, herein designated GAM RNA, also designated SEQ ID:257.

Another function of GAM71 is therefore inhibition of LOC126364 (Accession). Accordingly, utilities of GAM71 include diagnosis, prevention and treatment of diseases and clinical conditions associated with LOC126364.

LOC144017 (Accession XM_096520.3) is another GAM71 target gene, herein designated TARGET GENE. LOC144017 BINDING SITE is a target binding site found in the 5' untranslated region of mRNA encoded by LOC144017, corresponding to a target binding site such as BINDING SITE I, BINDING SITE II or BINDING SITE III of FIG. 8. Table 4 illustrates the complementarity of the nucleotide sequences of LOC144017 BINDING SITE, designated SEQ ID:9661, to the nucleotide sequence of GAM71 RNA, herein designated GAM RNA, also designated SEQ ID:257.

Another function of GAM71 is therefore inhibition of LOC144017 (Accession XM_096520.3). Accordingly, utilities of GAM71 include diagnosis, prevention and treatment of diseases and clinical conditions associated with LOC144017.

LOC145836 (Accession XM_096881.6) is another GAM71 target gene, herein designated TARGET GENE. LOC145836 BINDING SITE is a target binding site found in the 5' untranslated region of mRNA encoded by LOC145836, corresponding to a target binding site such as BINDING SITE I, BINDING SITE II or BINDING SITE III of FIG. 8. Table 4 illustrates the complementarity of the nucleotide sequences of LOC145836 BINDING SITE, designated SEQ ID:18672, to the nucleotide sequence of GAM71 RNA, herein designated GAM RNA, also designated SEQ ID:257.

Another function of GAM71 is therefore inhibition of LOC145836 (Accession XM_096881.6). Accordingly, utilities of GAM71 include diagnosis, prevention and treatment of diseases and clinical conditions associated with LOC145836.

LOC146237 (Accession) is another GAM71 target gene, herein designated TARGET GENE. LOC146237 BINDING SITE is a target binding site found in the 3' untranslated region of mRNA encoded by LOC146237, corresponding to a target binding site such as BINDING SITE I, BINDING SITE II or BINDING SITE III of FIG. 8. Table 4 illustrates the complementarity of the nucleotide sequences of LOC146237 BINDING SITE, designated SEQ ID:12330, to the nucleotide sequence of GAM71 RNA, herein designated GAM RNA, also designated SEQ ID:257.

Another function of GAM71 is therefore inhibition of LOC146237 (Accession). Accordingly, utilities of GAM71 include diagnosis, prevention and treatment of diseases and clinical conditions associated with LOC146237.

LOC149461 (Accession) is another GAM71 target gene, herein designated TARGET GENE. LOC149461 BINDING SITE is a target binding site found in the 3' untranslated region of mRNA encoded by LOC149461, corresponding to a target binding site such as BINDING SITE I, BINDING SITE II or BINDING SITE III of FIG. 8. Table 4 illustrates the complementarity of the nucleotide sequences of LOC149461 BINDING SITE, designated SEQ ID:10468, to the nucleotide sequence of GAM71 RNA, herein designated GAM RNA, also designated SEQ ID:257.

Another function of GAM71 is therefore inhibition of LOC149461 (Accession). Accordingly, utilities of GAM71 include diagnosis, prevention and treatment of diseases and clinical conditions associated with LOC149461.

LOC150378 (Accession) is another GAM71 target gene, herein designated TARGET GENE. LOC150378 BINDING SITE is a target binding site found in the 5' untranslated region of mRNA encoded by LOC150378, corresponding to a target binding site such as BINDING SITE I, BINDING SITE II or BINDING SITE III of FIG. 8. Table 4 illustrates the complementarity of the nucleotide sequences of LOC150378 BINDING SITE, designated SEQ ID:7786, to the nucleotide sequence of GAM71 RNA, herein designated GAM RNA, also designated SEQ ID:257.

Another function of GAM71 is therefore inhibition of LOC150378 (Accession). Accordingly, utilities of GAM71 include diagnosis, prevention and treatment of diseases and clinical conditions associated with LOC150378.

LOC152286 (Accession XM_098188.1) is another GAM71 target gene, herein designated TARGET GENE. LOC152286 BINDING SITE is a target binding site found in the 5' untranslated region of mRNA encoded by LOC152286, corresponding to a target binding site such as BINDING SITE I, BINDING SITE II or BINDING SITE III of FIG. 8. Table 4 illustrates the complementarity of the nucleotide sequences of LOC152286 BINDING SITE, designated SEQ ID:10326, to the nucleotide sequence of GAM71 RNA, herein designated GAM RNA, also designated SEQ ID:257.

Another function of GAM71 is therefore inhibition of LOC152286 (Accession XM_098188.1). Accordingly, utilities of GAM71 include diagnosis, prevention and treatment of diseases and clinical conditions associated with LOC152286.

LOC157349 (Accession) is another GAM71 target gene, herein designated TARGET GENE. LOC157349 BINDING SITE is a target binding site found in the 3' untranslated region of mRNA encoded by LOC157349, corresponding to a target binding site such as BINDING SITE I, BINDING SITE II or BINDING SITE III of FIG. 8. Table 4 illustrates the complementarity of the nucleotide sequences of LOC157349 BINDING SITE, designated SEQ ID:15688, to the nucleotide sequence of GAM71 RNA, herein designated GAM RNA, also designated SEQ ID:257.

Another function of GAM71 is therefore inhibition of LOC157349 (Accession). Accordingly, utilities of GAM71 include diagnosis, prevention and treatment of diseases and clinical conditions associated with LOC157349.

LOC159110 (Accession XM_088753.1) is another GAM71 target gene, herein designated TARGET GENE. LOC159110 BINDING SITE is a target binding site found in the 5' untranslated region of mRNA encoded by LOC159110, corresponding to a target binding site such as BINDING SITE I, BINDING SITE II or BINDING SITE III of FIG. 8. Table 4 illustrates the complementarity of the nucleotide sequences of LOC159110 BINDING SITE, designated SEQ ID:9850, to the nucleotide sequence of GAM71 RNA, herein designated GAM RNA, also designated SEQ ID:257.

Another function of GAM71 is therefore inhibition of LOC159110 (Accession XM_088753.1). Accordingly, utilities of GAM71 include diagnosis, prevention and treatment of diseases and clinical conditions associated with LOC159110.

LOC161038 (Accession) is another GAM71 target gene, herein designated TARGET GENE. LOC161038 BINDING SITE is a target binding site found in the 5' untranslated region of mRNA encoded by LOC161038, corresponding to a target binding site such as BINDING SITE I, BINDING SITE II or BINDING SITE III of FIG. 8. Table 4 illustrates the complementarity of the nucleotide sequences of LOC161038 BINDING SITE, designated SEQ ID:7787, to the nucleotide sequence of GAM71 RNA, herein designated GAM RNA, also designated SEQ ID:257.

Another function of GAM71 is therefore inhibition of LOC161038 (Accession). Accordingly, utilities of GAM71 include diagnosis, prevention and treatment of diseases and clinical conditions associated with LOC161038.

LOC165246 (Accession) is another GAM71 target gene, herein designated TARGET GENE. LOC165246 BINDING SITE is a target binding site found in the 3' untranslated region of mRNA encoded by LOC165246, corresponding to a target binding site such as BINDING SITE I, BINDING SITE II or BINDING SITE III of FIG. 8. Table 4 illustrates the complementarity of the nucleotide sequences of LOC165246 BINDING SITE, designated SEQ ID:16928, to the nucleotide sequence of GAM71 RNA, herein designated GAM RNA, also designated SEQ ID:257.

Another function of GAM71 is therefore inhibition of LOC165246 (Accession). Accordingly, utilities of GAM71 include diagnosis, prevention and treatment of diseases and clinical conditions associated with LOC165246.

LOC196761 (Accession XM_116865.1) is another GAM71 target gene, herein designated TARGET GENE. LOC196761 BINDING SITE is a target binding site found in the 3' untranslated region of mRNA encoded by LOC196761, corresponding to a target binding site such as BINDING SITE I, BINDING SITE II or BINDING SITE III of FIG. 8. Table 4 illustrates the complementarity of the nucleotide sequences of LOC196761 BINDING SITE, designated SEQ ID:19133, to the nucleotide sequence of GAM71 RNA, herein designated GAM RNA, also designated SEQ ID:257.

Another function of GAM71 is therefore inhibition of LOC196761 (Accession XM_116865.1). Accordingly, utilities of GAM71 include diagnosis, prevention and treatment of diseases and clinical conditions associated with LOC196761.

LOC197342 (Accession XM_113869.2) is another GAM71 target gene, herein designated TARGET GENE. LOC197342 BINDING SITE is a target binding site found in the 3' untranslated region of mRNA encoded by LOC197342, corresponding to a target binding site such as BINDING SITE I, BINDING SITE II or BINDING SITE III of FIG. 8. Table 4 illustrates the complementarity of the nucleotide sequences of LOC197342 BINDING SITE, designated SEQ ID:772, to the nucleotide sequence of GAM71 RNA, herein designated GAM RNA, also designated SEQ ID:257.

Another function of GAM71 is therefore inhibition of LOC197342 (Accession XM_113869.2). Accordingly, utilities of GAM71 include diagnosis, prevention and treatment of diseases and clinical conditions associated with LOC197342.

LOC203636 (Accession) is another GAM71 target gene, herein designated TARGET GENE. LOC203636 BINDING SITE is a target binding site found in the 3' untranslated region of mRNA encoded by LOC203636, corresponding to a target binding site such as BINDING SITE I, BINDING SITE II or BINDING SITE III of FIG. 8. Table 4 illustrates the complementarity of the nucleotide sequences of LOC203636 BINDING SITE, designated SEQ ID:16235, to the nucleotide sequence of GAM71 RNA, herein designated GAM RNA, also designated SEQ ID:257.

Another function of GAM71 is therefore inhibition of LOC203636 (Accession). Accordingly, utilities of GAM71 include diagnosis, prevention and treatment of diseases and clinical conditions associated with LOC203636.

LOC219654 (Accession) is another GAM71 target gene, herein designated TARGET GENE. LOC219654 BINDING SITE is a target binding site found in the 3' untranslated region of mRNA encoded by LOC219654, corresponding to a target binding site such as BINDING SITE I, BINDING SITE II or BINDING SITE III of FIG. 8. Table 4 illustrates the complementarity of the nucleotide sequences of LOC219654 BINDING SITE, designated SEQ ID:2165, to the nucleotide sequence of GAM71 RNA, herein designated GAM RNA, also designated SEQ ID:257.

Another function of GAM71 is therefore inhibition of LOC219654 (Accession). Accordingly, utilities of GAM71 include diagnosis, prevention and treatment of diseases and clinical conditions associated with LOC219654.

LOC221060 (Accession) is another GAM71 target gene, herein designated TARGET GENE. LOC221060 BINDING SITE is a target binding site found in the 3' untranslated region of mRNA encoded by LOC221060, corresponding to a target binding site such as BINDING SITE I, BINDING SITE II or BINDING SITE III of FIG. 8. Table 4 illustrates the complementarity of the nucleotide sequences of LOC221060 BINDING SITE, designated SEQ ID:18299, to the nucleotide sequence of GAM71 RNA, herein designated GAM RNA, also designated SEQ ID:257.

Another function of GAM71 is therefore inhibition of LOC221060 (Accession). Accordingly, utilities of GAM71 include diagnosis, prevention and treatment of diseases and clinical conditions associated with LOC221060.

LOC253461 (Accession) is another GAM71 target gene, herein designated TARGET GENE. LOC253461 BINDING SITE is a target binding site found in the 5' untranslated region of mRNA encoded by LOC253461, corresponding to a target binding site such as BINDING SITE I, BINDING SITE II or BINDING SITE III of FIG. 8. Table 4 illustrates the complementarity of the nucleotide sequences of LOC253461 BINDING SITE, designated SEQ ID:14098, to the nucleotide sequence of GAM71 RNA, herein designated GAM RNA, also designated SEQ ID:257.

Another function of GAM71 is therefore inhibition of LOC253461 (Accession). Accordingly, utilities of GAM71 include diagnosis, prevention and treatment of diseases and clinical conditions associated with LOC253461.

LOC254182 (Accession) is another GAM71 target gene, herein designated TARGET GENE. LOC254182 BINDING SITE is a target binding site found in the 5' untranslated region of mRNA encoded by LOC254182, corresponding to a target binding site such as BINDING SITE I, BINDING SITE II or BINDING SITE III of FIG. 8. Table 4 illustrates the complementarity of the nucleotide sequences of LOC254182 BINDING SITE, designated SEQ ID:18053, to the nucleotide sequence of GAM71 RNA, herein designated GAM RNA, also designated SEQ ID:257.

Another function of GAM71 is therefore inhibition of LOC254182 (Accession). Accordingly, utilities of GAM71 include diagnosis, prevention and treatment of diseases and clinical conditions associated with LOC254182.

LOC254427 (Accession) is another GAM71 target gene, herein designated TARGET GENE. LOC254427 BINDING SITE is a target binding site found in the 3' untranslated region of mRNA encoded by LOC254427, corresponding to a target binding site such as BINDING SITE I, BINDING SITE II or BINDING SITE III of FIG. 8. Table 4 illustrates the complementarity of the nucleotide sequences of LOC254427 BINDING SITE, designated SEQ ID:19884, to the nucleotide sequence of GAM71 RNA, herein designated GAM RNA, also designated SEQ ID:257.

Another function of GAM71 is therefore inhibition of LOC254427 (Accession). Accordingly, utilities of GAM71 include diagnosis, prevention and treatment of diseases and clinical conditions associated with LOC254427.

LOC255285 (Accession) is another GAM71 target gene, herein designated TARGET GENE. LOC255285 BINDING SITE is a target binding site found in the 3' untranslated region of mRNA encoded by LOC255285, corresponding to a target binding site such as BINDING SITE I, BINDING SITE II or BINDING SITE III of FIG. 8. Table 4 illustrates the complementarity of the nucleotide sequences of LOC255285 BINDING SITE, designated SEQ ID:3832, to the nucleotide sequence of GAM71 RNA, herein designated GAM RNA, also designated SEQ ID:257.

Another function of GAM71 is therefore inhibition of LOC255285 (Accession). Accordingly, utilities of GAM71 include diagnosis, prevention and treatment of diseases and clinical conditions associated with LOC255285.

LOC255481 (Accession) is another GAM71 target gene, herein designated TARGET GENE. LOC255481 BINDING SITE is a target binding site found in the 3' untranslated region of mRNA encoded by LOC255481, corresponding to a target binding site such as BINDING SITE I, BINDING SITE II or BINDING SITE III of FIG. 8. Table 4 illustrates the complementarity of the nucleotide sequences of LOC255481 BINDING SITE, designated SEQ ID:8843, to the nucleotide sequence of GAM71 RNA, herein designated GAM RNA, also designated SEQ ID:257.

Another function of GAM71 is therefore inhibition of LOC255481 (Accession). Accordingly, utilities of GAM71 include diagnosis, prevention and treatment of diseases and clinical conditions associated with LOC255481.

LOC255650 (Accession) is another GAM71 target gene, herein designated TARGET GENE. LOC255650 BINDING SITE is a target binding site found in the 3' untranslated region of mRNA encoded by LOC255650, corresponding to a target binding site such as BINDING SITE I, BINDING SITE II or BINDING SITE III of FIG. 8. Table 4 illustrates the complementarity of the nucleotide sequences of LOC255650 BINDING SITE, designated SEQ ID:9039, to the nucleotide sequence of GAM71 RNA, herein designated GAM RNA, also designated SEQ ID:257.

Another function of GAM71 is therefore inhibition of LOC255650 (Accession). Accordingly, utilities of GAM71 include diagnosis, prevention and treatment of diseases and clinical conditions associated with LOC255650.

LOC256158 (Accession) is another GAM71 target gene, herein designated TARGET GENE. LOC256158 BINDING SITE is a target binding site found in the 5' untranslated region of mRNA encoded by LOC256158, corresponding to a target binding site such as BINDING SITE I, BINDING SITE II or BINDING SITE III of FIG. 8. Table 4 illustrates the complementarity of the nucleotide sequences of LOC256158 BINDING SITE, designated SEQ ID:7930, to the nucleotide sequence of GAM71 RNA, herein designated GAM RNA, also designated SEQ ID:257.

Another function of GAM71 is therefore inhibition of LOC256158 (Accession). Accordingly, utilities of GAM71 include diagnosis, prevention and treatment of diseases and clinical conditions associated with LOC256158.

LOC257494 (Accession) is another GAM71 target gene, herein designated TARGET GENE. LOC257494 BINDING SITE is a target binding site found in the 3' untranslated region of mRNA encoded by LOC257494, corresponding to a target binding site such as BINDING SITE I, BINDING SITE II or BINDING SITE III of FIG. 8. Table 4 illustrates the complementarity of the nucleotide sequences of LOC257494 BINDING SITE, designated SEQ ID:3853, to the nucleotide sequence of GAM71 RNA, herein designated GAM RNA, also designated SEQ ID:257.

Another function of GAM71 is therefore inhibition of LOC257494 (Accession). Accordingly, utilities of GAM71 include diagnosis, prevention and treatment of diseases and clinical conditions associated with LOC257494.

LOC57333 (Accession) is another GAM71 target gene, herein designated TARGET GENE. LOC57333 BINDING SITE is a target binding site found in the 3' untranslated region of mRNA encoded by LOC57333, corresponding to a target binding site such as BINDING SITE I, BINDING SITE II or BINDING SITE III of FIG. 8. Table 4 illustrates the complementarity of the nucleotide sequences of LOC57333 BINDING SITE, designated SEQ ID:882, to the nucleotide sequence of GAM71 RNA, herein designated GAM RNA, also designated SEQ ID:257.

Another function of GAM71 is therefore inhibition of LOC57333 (Accession). Accordingly, utilities of GAM71 include diagnosis, prevention and treatment of diseases and clinical conditions associated with LOC57333.

LOC91759 (Accession XM_040467.1) is another GAM71 target gene, herein designated TARGET GENE. LOC91759 BINDING SITE is a target binding site found in the 5' untranslated region of mRNA encoded by LOC91759, corresponding to a target binding site such as BINDING SITE I, BINDING SITE II or BINDING SITE III of FIG. 8. Table 4 illustrates the complementarity of the nucleotide sequences of LOC91759 BINDING SITE, designated SEQ ID:13656, to the nucleotide sequence of GAM71 RNA, herein designated GAM RNA, also designated SEQ ID:257.

Another function of GAM71 is therefore inhibition of LOC91759 (Accession XM_040467.1). Accordingly, utilities of GAM71 include diagnosis, prevention and treatment of diseases and clinical conditions associated with LOC91759.

Lysyl oxidase-like 2 (LOXL2, Accession NM_002318.1) is another GAM71 target gene, herein designated TARGET GENE. LOXL2 BINDING SITE is a target binding site found in the 3' untranslated region of mRNA encoded by LOXL2, corresponding to a target binding site such as BINDING SITE I, BINDING SITE II or BINDING SITE III of FIG. 8. Table 4 illustrates the complementarity of the nucleotide sequences of LOXL2 BINDING SITE, designated SEQ ID:9639, to the nucleotide sequence of GAM71 RNA, herein designated GAM RNA, also designated SEQ ID:257.

Another function of GAM71 is therefore inhibition of Lysyl oxidase-like 2 (LOXL2, Accession NM_002318.1), a gene which may have roles in senescence and cell adhesion. Accordingly, utilities of GAM71 include diagnosis, prevention and treatment of diseases and clinical conditions associated with LOXL2.

The function of LOXL2 has been established by previous studies. LOXL2 is a member of the lysyl oxidase (LO; 153455) gene family. LO is an extracellular, copper-dependent enzyme that initiates the cross-linking of collagens and elastin by catalyzing the oxidative deamination of peptidyl lysine to alpha- aminoadipic-delta-semialdehyde. Members of the LO family have diverse functions, including tumor suppression and cell adhesion and senescence Saito et al. (1997) used PCR and 5-prime RACE to obtain a full-length cDNA encoding LOXL2. The predicted 774-amino acid LOXL2 protein contains 3 potential N-linked glycosylation sites and 4 scavenger receptor cysteine-rich (SRCR) domains, which are involved in binding to other cell surface or extracellular molecules. LOXL2 also contains residues conserved among copper-binding proteins. In vitro translation produced an 87-kD LOXL2 protein. Northern blot analysis detected a 3.65-kb LOXL2 transcript in adherent tumor cell lines but not in suspension cell lines. Using cultured fibroblasts, Saito et al. (1997) demonstrated that LOXL2 expression is upregulated in senescent fibroblasts, induced by transforming growth factor beta-1 (OMIM Ref. No. 190180) and indomethacin, and inhibited by phorbol ester and retinoic acid. They concluded that LOXL2 is an extracellular matrix component that may be specifically involved in cell adhesion and senescence Full details of the abovementioned studies are described in the following publications, the disclosure of which are hereby incorporated by reference:

Saito, H.; Papaconstantinou, J.; Sato, H.; Goldstein, S.: Regulation of a novel gene encoding a lysyl oxidase-related protein in cellular adhesion and senescence. J. Biol. Chem. 272:8157-8160, 1997; and Saito, H.; Papaconstantinou, J.; Sato, H.; Goldstein, S.: Regulation of a novel gene encoding a lysyl oxidase-related protein in cellular adhesion and senescence. J. Biol. Chem. 272:8157.

Further studies establishing the function and utilities of LOXL2 are found in John Hopkins OMIM database record ID 606663, and in cited publications listed in Table 5, which are hereby incorporated by reference. LR8 (Accession NM_014020.2) is another GAM71 target gene, herein designated TARGET GENE. LR8 BINDING SITE is a target binding site found in the 5' untranslated region of mRNA encoded by LR8, corresponding to a target binding site such as BINDING SITE I, BINDING SITE II or BINDING SITE III of FIG. 8. Table 4 illustrates the complementarity of the nucleotide sequences of LR8 BINDING SITE, designated SEQ ID:15399, to the nucleotide sequence of GAM71 RNA, herein designated GAM RNA, also designated SEQ ID:257.

Another function of GAM71 is therefore inhibition of LR8 (Accession NM_014020.2). Accordingly, utilities of GAM71 include diagnosis, prevention and treatment of diseases and clinical conditions associated with LR8.

Lymphocyte antigen 6 complex, locus e (LY6E, Accession NM_002346.1) is another GAM71 target gene, herein designated TARGET GENE. LY6E BINDING SITE is a target binding site found in the 3' untranslated region of mRNA encoded by LY6E, corresponding to a target binding site such as BINDING SITE I, BINDING SITE II or BINDING SITE III of FIG. 8. Table 4 illustrates the complementarity of the nucleotide sequences of LY6E BINDING SITE, designated SEQ ID:5766, to the nucleotide sequence of GAM71 RNA, herein designated GAM RNA, also designated SEQ ID:257.

Another function of GAM71 is therefore inhibition of Lymphocyte antigen 6 complex, locus e (LY6E, Accession NM_002346.1). Accordingly, utilities of GAM71 include diagnosis, prevention and treatment of diseases and clinical conditions associated with LY6E.

MARKL1 (Accession) is another GAM71 target gene, herein designated TARGET GENE. MARKL1 BINDING SITE is a target binding site found in the 5' untranslated region of mRNA encoded by MARKL1, corresponding to a target binding site such as BINDING SITE I, BINDING SITE II or BINDING SITE III of FIG. 8. Table 4 illustrates the complementarity of the nucleotide sequences of MARKL1 BINDING SITE, designated SEQ ID:3863, to the nucleotide sequence of GAM71 RNA, herein designated GAM RNA, also designated SEQ ID:257.

Another function of GAM71 is therefore inhibition of MARKL1 (Accession). Accordingly, utilities of GAM71 include diagnosis, prevention and treatment of diseases and clinical conditions associated with MARKL1.

MGC15416 (Accession NM_032371.1) is another GAM71 target gene, herein designated TARGET GENE. MGC15416 BINDING SITE is a target binding site found in the 5' untranslated region of mRNA encoded by MGC15416, corresponding to a target binding site such as BINDING SITE I, BINDING SITE II or BINDING SITE III of FIG. 8. Table 4 illustrates the complementarity of the nucleotide sequences of MGC15416 BINDING SITE, designated SEQ ID:18601, to the nucleotide sequence of GAM71 RNA, herein designated GAM RNA, also designated SEQ ID:257.

Another function of GAM71 is therefore inhibition of MGC15416 (Accession NM_032371.1). Accordingly, utilities of GAM71 include diagnosis, prevention and treatment of diseases and clinical conditions associated with MGC15416.

MGC16025 (Accession NM_032923.1) is another GAM71 target gene, herein designated TARGET GENE. MGC16025 BINDING SITE is a target binding site found in the 3' untranslated region of mRNA encoded by MGC16025, corresponding to a target binding site such as BINDING SITE I, BINDING SITE II or BINDING SITE III of FIG. 8. Table 4 illustrates the complementarity of the nucleotide sequences of MGC16025 BINDING SITE, designated SEQ ID:14504, to the nucleotide sequence of GAM71 RNA, herein designated GAM RNA, also designated SEQ ID:257.

Another function of GAM71 is therefore inhibition of MGC16025 (Accession NM_032923.1). Accordingly, utilities of GAM71 include diagnosis, prevention and treatment of diseases and clinical conditions associated with MGC16025.

Makorin, ring finger protein, 1 (MKRN1, Accession NM_013446.2) is another GAM71 target gene, herein designated TARGET GENE. MKRN1 BINDING SITE is a target binding site found in the 3' untranslated region of mRNA encoded by MKRN1, corresponding to a target binding site such as BINDING SITE I, BINDING SITE II or BINDING SITE III of FIG. 8. Table 4 illustrates the complementarity of the nucleotide sequences of MKRN1 BINDING SITE, designated SEQ ID:17691, to the nucleotide sequence of GAM71 RNA, herein designated GAM RNA, also designated SEQ ID:257.

Another function of GAM71 is therefore inhibition of Makorin, ring finger protein, 1 (MKRN1, Accession NM_013446.2). Accordingly, utilities of GAM71 include diagnosis, prevention and treatment of diseases and clinical conditions associated with MKRN1.

Motilin (MLN, Accession NM_002418.1) is another GAM71 target gene, herein designated TARGET GENE. MLN BINDING SITE is a target binding site found in the 3' untranslated region of mRNA encoded by MLN, corresponding to a target binding site such as BINDING SITE I, BINDING SITE II or BINDING SITE III of FIG. 8. Table 4 illustrates the complementarity of the nucleotide sequences of MLN BINDING SITE, designated SEQ ID:13955, to the nucleotide sequence of GAM71 RNA, herein designated GAM RNA, also designated SEQ ID:257.

Another function of GAM71 is therefore inhibition of Motilin (MLN, Accession NM_002418.1), a gene which plays an important role in the regulation of interdigestive gastrointestinal motility. Accordingly, utilities of GAM71 include diagnosis, prevention and treatment of diseases and clinical conditions associated with MLN.

The function of MLN has been established by previous studies. Motilin, a 22-amino acid hormone synthesized by cells of the small intestine, regulates interdigestive gastrointestinal contraction. The characterization of cDNA clones encoding human motilin showed that it is derived by proteolytic processing of a 115-amino acid precursor. By a combination of Southern analysis of somatic cell hybrids and in situ hybridization, Fan et al. (1989) assigned the MLN gene to 6p21.2. Daikh et al. (1989) showed that the motilin gene consists of 5 exons spanning approximately 9 kb of genomic DNA. Exon 1 encodes the 5-prime untranslated portion of the motilin mRNA. Exons 2 and 3 encode the signal peptide and the 22-amino acid motilin peptide. Gasparini et al. (1994) showed that MLN is tightly linked to the HLA-DQ-alpha locus (HLA-DQA1; 146880). The chromosomal localization of MNL and its expression in bronchoepithelial cells suggested that this gene may be involved in the immotile cilia syndrome (ICS; 242650) which had previously been assigned to 6p. Sequence and segregation analyses of the MLN gene, carried out in 2 families in which mapping to 6p21.3 had been demonstrated, excluded MLN as a candidate gene for the HLA-associated form of ICS.

Full details of the abovementioned studies are described in the following publications, the disclosure of which are hereby incorporated by reference:

Daikh, D. I.; Douglass, J. O.; Adelman, J. P.: Structure and expression of the human motilin gene. DNA 8:615-621, 1989; and Gasparini, P.; Grifa, A.; Savasta, S.; Merlo, I.; Bisceglia, L.; Totaro, A.; Zelante, L.: The motilin gene: subregional localisation, tissue expression, DNA polymorphisms and exclusion.

Further studies establishing the function and utilities of MLN are found in John Hopkins OMIM database record ID 158270, and in cited publications listed in Table 5, which are hereby incorporated by reference. Mll septin-like fusion (MSF, Accession NM_006640.2) is another GAM71 target gene, herein designated TARGET GENE. MSF BINDING SITE is a target binding site found in the 3' untranslated region of mRNA encoded by MSF, corresponding to a target binding site such as BINDING SITE I, BINDING SITE II or BINDING SITE III of FIG. 8. Table 4 illustrates the complementarity of the nucleotide sequences of MSF BINDING SITE, designated SEQ ID:16611, to the nucleotide sequence of GAM71 RNA, herein designated GAM RNA, also designated SEQ ID:257.

Another function of GAM71 is therefore inhibition of Mll septin-like fusion (MSF, Accession NM_006640.2), a gene which plays a role in the cell cycle. and therefore may be associated with Therapy-related acute myeloid leukemia, ovarian tumors. Accordingly, utilities of GAM71 include diagnosis, prevention and treatment of Therapy-related acute myeloid leukemia, ovarian tumors, and of other diseases and clinical conditions associated with MSF.

The function of MSF has been established by previous studies. MLL (OMIM Ref. No. 159555), which is located on 11q23, is frequently rearranged in patients with therapy-related acute myeloid leukemia who previously were treated with DNA topoisomerase II inhibitors. Osaka et al. (1999) identified a fusion partner of MLL in a 10-year-old female who developed therapy-related acute myeloid leukemia 17 months after treatment for Hodgkin disease (OMIM Ref. No. 236000). Leukemia cells of this patient had a t(11;17)(q23; q25), which involved MLL. The partner gene was cloned from cDNA of the leukemia cells by use of a combination of adaptor reverse transcriptase-PCR, rapid amplification of 5-prime cDNA ends (RACE), and BLAST database analysis to identify ESTs. The full-length cDNA of 2.8 kb was found to be a member of the septin family, and Osaka et al. (1999) therefore designated the gene MSF for 'MLL septin-like fusion gene.' Members of the septin family conserve the GTP-binding domain, localize in the cytoplasm, and interact with cytoskeletal filaments. MSF encodes a putative protein of 568 amino acids, with a predicted molecular mass of about 63 kD. Northern blot analysis revealed a major 4-kb transcript that was expressed ubiquitously, a 1.7-kb transcript that was found in most tissues, and a 3-kb transcript that was found only in hematopoietic tissues. MSF is highly homologous to CDCREL (OMIM Ref. No. 602724), which is a partner gene of MLL in leukemias with a t(11;22)(q23;q11.2). Russell et al. (2000) isolated the same gene, which they designated Ovarian/Breast (Ov/Br) septin, as a candidate for the ovarian tumor suppressor gene that had been indirectly identified by up to 70% loss of heterozygosity (LOH) for a marker at chromosome 17q25 in a bank of malignant ovarian tumors. Two splice variants were demonstrated within the 200- kb contig, which differed only at exon 1. The septins are a family of genes involved in cytokinesis and cell cycle control, whose known functions are consistent with the hypothesis that the human 17q25 septin gene is a candidate for the ovarian tumor suppressor gene.

Full details of the abovementioned studies are described in the following publications, the disclosure of which are hereby incorporated by reference:

Osaka, M.; Rowley, J. D.; Zeleznik-Le, N. J.: MSF (MLL septin-like fusion), a fusion partner gene of MLL, in a therapy-related acute myeloid leukemia with a t(11;17)(q23; q25). Proc. Nat. Acad. Sci. 96:6428-6433, 1999; and Russell, S. E. H.; McIlhatton, M. A.; Burrows, J. F.; Donaghy, P. G.; Chanduloy, S.; Petty, E. M.; Kalikin, L. M.; Church, S. W.; McIlroy, S.; Harkin, D. P.; Keilty, G. W.; Cranston, A.

Further studies establishing the function and utilities of MSF are found in John Hopkins OMIM database record ID 604061, and in cited publications listed in Table 5, which are hereby incorporated by reference. N-acetylgalactosaminidase, alpha- (NAGA, Accession NM_000262.1) is another GAM71 target gene, herein designated TARGET GENE. NAGA BINDING SITE is a target binding site found in the 3' untranslated region of mRNA encoded by NAGA, corresponding to a target binding site such as BINDING SITE I, BINDING SITE II or BINDING SITE III of FIG. 8. Table 4 illustrates the complementarity of the nucleotide sequences of NAGA BINDING SITE, designated SEQ ID:8596, to the nucleotide sequence of GAM71 RNA, herein designated GAM RNA, also designated SEQ ID:257.

Another function of GAM71 is therefore inhibition of N-acetylgalactosaminidase, alpha-(NAGA, Accession NM_000262.1). Accordingly, utilities of GAM71 include diagnosis, prevention and treatment of diseases and clinical conditions associated with NAGA.

Procollagen-proline, 2-oxoglutarate 4-dioxygenase (proline 4-hydroxylase), alpha polypeptide ii (P4HA2, Accession NM_004199.1) is another GAM71 target gene, herein designated TARGET GENE. P4HA2 BINDING SITE is a target binding site found in the 5' untranslated region of mRNA encoded by P4HA2, corresponding to a target binding site such as BINDING SITE I, BINDING SITE II or BINDING SITE III of FIG. 8. Table 4 illustrates the complementarity of the nucleotide sequences of P4HA2 BINDING SITE, designated SEQ ID:2032, to the nucleotide sequence of GAM71 RNA, herein designated GAM RNA, also designated SEQ ID:257.

Another function of GAM71 is therefore inhibition of Procollagen-proline, 2-oxoglutarate 4-dioxygenase (proline 4-hydroxylase), alpha polypeptide ii (P4HA2, Accession NM_004199.1). Accordingly, utilities of GAM71 include diagnosis, prevention and treatment of diseases and clinical conditions associated with P4HA2.

Pre-b-cell leukemia transcription factor 2 (PBX2, Accession NM_002586.3) is another GAM71 target gene, herein designated TARGET GENE. PBX2 BINDING SITE is a target binding site found in the 3' untranslated region of mRNA encoded by PBX2, corresponding to a target binding site such as BINDING SITE I, BINDING SITE II or BINDING SITE III of FIG. 8. Table 4 illustrates the complementarity of the nucleotide sequences of PBX2 BINDING SITE, designated SEQ ID:11494, to the nucleotide sequence of GAM71 RNA, herein designated GAM RNA, also designated SEQ ID:257.

Another function of GAM71 is therefore inhibition of Pre-b-cell leukemia transcription factor 2 (PBX2, Accession NM_002586.3), a gene which binds the sequence 5'-atcaatcaa-3'. Accordingly, utilities of GAM71 include diagnosis, prevention and treatment of diseases and clinical conditions associated with PBX2.

The function of PBX2 has been established by previous studies. Monica et al. (1991) isolated 2 new homeo box genes, PBX2 and PBX3, on the basis of their extensive homology to PBX1 (OMIM Ref. No. 176310), which is involved in t(1;19) translocation in acute pre-B-cell leukemias. The predicted PBX2 and PBX3 proteins were 92 and 94% identical to PBX1 over a large region of 266 amino acids within and flanking their homeodomains, but all 3 proteins diverged significantly near their amino and carboxy termini. Chromosome in situ hybridization demonstrated that the PBX genes map to separate loci: PBX1, 1q23; PBX2, 3q22-q23; PBX3, 9q33-q34. It was subsequently determined that the PBX gene mapped to chromosome 3 was in fact a pseudogene (PBXP1; OMIM Ref. No. 176310). As noted later, PBX2 maps to chromosome 6. Unlike PBX1, which is not expressed in lymphoid cell lines, expression of PBX2 and PBX3 was not restricted to particular states of differentiation or development, as mRNA transcripts of these genes were detected in most fetal and adult tissues and all cell lines. Like PBX1 RNA, PBX3 RNA is alternatively spliced to yield 2 translation products with different carboxy termini, a feature not observed for PBX2. Their extensive sequence similarity and widespread expression suggest a generalized, overlapping role for PBX proteins in most cell types. Differences in their amino and carboxy termini may modulate their activities, mediated in part by differential splicing and, for PBX1, protein fusion following t(1;19) chromosomal translocation. Aguado and Campbell (1995) characterized the genomic structure of the PBX2 gene on chromosome 6 and showed that it is split into 9 exons. Further, they confirmed that homologous genes map to chromosomes 1 and 3. The chromosome 1 copy may also be a pseudogene.

Full details of the abovementioned studies are described in the following publications, the disclosure of which are hereby incorporated by reference:

Monica, K.; Galili, N.; Nourse, J.; Saltman, D.; Cleary, M. L.: PBX2 and PBX3, new homeobox genes with extensive homology to the human proto - oncogene PBX1. Molec. Cell. Biol. 11:6149-6157, 1991; and Aguado, B.; Campbell, R. D.: The novel gene G17, located in the human major histocompatibility complex, encodes PBX2, a homeodomain-containing protein. Genomics 25:650-659, 1995.

Further studies establishing the function and utilities of PBX2 are found in John Hopkins OMIM database record ID 176311, and in cited publications listed in Table 5, which are hereby incorporated by reference. Protocadherin 16 dachsous-like (drosophila) (PCDH16, Accession NM_003737.1) is another GAM71 target gene, herein designated TARGET GENE. PCDH16 BINDING SITE1 and PCDH16 BINDING SITE2 are target binding sites found in untranslated regions of mRNA encoded by PCDH16, corresponding to target binding sites such as BINDING SITE I, BINDING SITE II or BINDING SITE III of FIG. 8. Table 4 illustrates the complementarity of the nucleotide sequences of PCDH16 BINDING SITE1 and PCDH16 BINDING SITE2, designated SEQ ID:16682 and SEQ ID:6276 respectively, to the nucleotide sequence of GAM71 RNA, herein designated GAM RNA, also designated SEQ ID:257.

Another function of GAM71 is therefore inhibition of Protocadherin 16 dachsous-like (drosophila) (PCDH16, Accession NM_003737.1) . Accordingly, utilities of GAM71 include diagnosis, prevention and treatment of diseases and clinical conditions associated with PCDH16.

Phosphatidylinositol-4-phosphate 5-kinase, type i, gamma (PIP5K1C, Accession XM_047620.3) is another GAM71 target gene, herein designated TARGET GENE. PIP5K1C BINDING SITE1 and PIP5K1C BINDING SITE2 are target binding sites found in untranslated regions of multiple transcripts of mRNA encoded by PIP5K1C, corresponding to target binding sites such as BINDING SITE I, BINDING SITE II or BINDING SITE III of FIG. 8. Table 4 illustrates the complementarity of the nucleotide sequences of PIP5K1C BINDING SITE1 and PIP5K1C BINDING SITE2, designated SEQ ID:11489 and SEQ ID:16584 respectively, to the nucleotide sequence of GAM71 RNA, herein designated GAM RNA, also designated SEQ ID:257.

Another function of GAM71 is therefore inhibition of Phosphatidylinositol-4-phosphate 5-kinase, type i, gamma (PIP5K1C, Accession XM_047620.3). Accordingly, utilities of GAM71 include diagnosis, prevention and treatment of diseases and clinical conditions associated with PIP5K1C.

Protein kinase, lysine deficient 2 (PRKWNK2, Accession) is another GAM71 target gene, herein designated TARGET GENE. PRKWNK2 BINDING SITE is a target binding site found in the 3' untranslated region of mRNA encoded by PRKWNK2, corresponding to a target binding site such as BINDING SITE I, BINDING SITE II or BINDING SITE III of FIG. 8. Table 4 illustrates the complementarity of the nucleotide sequences of PRKWNK2 BINDING SITE, designated SEQ ID:19227, to the nucleotide sequence of GAM71 RNA, herein designated GAM RNA, also designated SEQ ID:257.

Another function of GAM71 is therefore inhibition of Protein kinase, lysine deficient 2 (PRKWNK2, Accession). Accordingly, utilities of GAM71 include diagnosis, prevention and treatment of diseases and clinical conditions associated with PRKWNK2.

PRO2730 (Accession NM_025222.2) is another GAM71 target gene, herein designated TARGET GENE. PRO2730 BINDING SITE is a target binding site found in the 3' untranslated region of mRNA encoded by PRO2730, corresponding to a target binding site such as BINDING SITE I, BINDING SITE II or BINDING SITE III of FIG. 8. Table 4 illustrates the complementarity of the nucleotide sequences of PRO2730 BINDING SITE, designated SEQ ID:5236, to the nucleotide sequence of GAM71 RNA, herein designated GAM RNA, also designated SEQ ID:257.

Another function of GAM71 is therefore inhibition of PRO2730 (Accession NM_025222.2). Accordingly, utilities of GAM71 include diagnosis, prevention and treatment of diseases and clinical conditions associated with PRO2730.

Protein serine kinase h1 (PSKH1, Accession NM_006742.1) is another GAM71 target gene, herein designated TARGET GENE. PSKH1 BINDING SITE is a target binding site found in the 3' untranslated region of mRNA encoded by PSKH1, corresponding to a target binding site such as BINDING SITE I, BINDING SITE II or BINDING SITE III of FIG. 8. Table 4 illustrates the complementarity of the nucleotide sequences of PSKH1 BINDING SITE, designated SEQ ID:8943, to the nucleotide sequence of GAM71 RNA, herein designated GAM RNA, also designated SEQ ID:257.

Another function of GAM71 is therefore inhibition of Protein serine kinase h1 (PSKH1, Accession NM_006742.1). Accordingly, utilities of GAM71 include diagnosis, prevention and treatment of diseases and clinical conditions associated with PSKH1.

Protein tyrosine phosphatase, non-receptor type 1 (PTPN1, Accession NM_002827.2) is another GAM71 target gene, herein designated TARGET GENE. PTPN1 BINDING SITE is a target binding site found in the 3' untranslated region of mRNA encoded by PTPN1, corresponding to a target binding site such as BINDING SITE I, BINDING SITE II or BINDING SITE III of FIG. 8. Table 4 illustrates the complementarity of the nucleotide sequences of PTPN1 BINDING SITE, designated SEQ ID:487, to the nucleotide sequence of GAM71 RNA, herein designated GAM RNA, also designated SEQ ID:257.

Another function of GAM71 is therefore inhibition of Protein tyrosine phosphatase, non-receptor type 1 (PTPN1, Accession NM_002827.2), a gene which is a non-receptor type 1 protein tyrosine phosphatase and inhibits insulin signaling. Accordingly, utilities of GAM71 include diagnosis, prevention and treatment of diseases and clinical conditions associated with PTPN1.

The function of PTPN1 has been established by previous studies. PTP1B inhibits insulin signaling and, when overexpressed, plays a role in insulin resistance (Ahmad et al., 1997). In the 3-prime untranslated region of the PTP1B gene, Di Paola et al. (2002) identified a 1484insG variation (176885.0001) that, in 2 different populations, was associated with several features of insulin resistance. Similar data were obtained in a family-based association study by use of sib pairs discordant for genotype (Gu et al., 2000). Subjects carrying the 1484insG variant showed PTP1B mRNA overexpression in skeletal muscle. PTP1B mRNA stability was significantly higher in human embryonic kidney cells transfected with 1484insG PTP1B as compared with those transfected with wildtype PTP1B. The data indicated that the 1484insG allele causes PTP1B overexpression and plays a role in insulin resistance. Therefore, individuals carrying the 1484insG variant might particularly benefit from PTP1B inhibitors in the treatment of insulin resistance (Kennedy and Ramachandran, 2000).

Animal model experiments lend further support to the function of PTPN1. Elchebly et al. (1999) generated PTP1B-deficient mice by targeted disruption of the mouse homolog of the PTP1B gene. Mice were phenotypically and pathologically normal and had normal life span. In the fed state, homozygous mutant mice had slightly lower blood glucose concentrations, and half the circulating insulin concentrations, of wildtype littermates. The enhanced insulin sensitivity of PTP1B-deficient mice was also evident in glucose- and insulin- tolerance tests. After insulin injection, deficient mice showed increased phosphorylation of the insulin receptor in liver and muscle tissue compared to wildtype mice. On a high-fat diet, PTP1B-deficient mice were resistant to weight gain and remained insulin sensitive, while wildtype mice rapidly gained weight and became insulin resistant. These results suggested a major role for PTP1B in modulation of insulin sensitivity and fuel metabolism. The authors proposed PTP1B as a potential therapeutic target for the treatment of type 2 diabetes and obesity.

It is appreciated that the abovementioned animal model for PTPN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Elchebly, M.; Payette, P.; Michaliszy, E.; Cromlish, W.; Collins, S.; Loy, A. L.; Normandin, D.; Cheng, A.; Himms-Hagen, J.; Chan, C.-C.; Ramachandran, C.; Gresser, M. J.; Tremblay, M. L.; Kennedy, B. P.: Increased insulin sensitivity and obesity resistance in mice lacking the protein tyrosine phosphatase-1B gene. Science 283:1544-1548, 1999; and Di Paola, R.; Frittitta, L.; Miscio, G.; Bozzali, M.; Baratta, R.; Centra, M.; Spampinato, D.; Santagati, M. G.; Ercolino, T.; Cisternino, C.; Soccio, T. Mastroianno, S.; Tassi, V.; Alm.

Further studies establishing the function and utilities of PTPN1 are found in John Hopkins OMIM database record ID 176885, and in cited publications listed in Table 5, which are hereby incorporated by reference. Retinoic acid receptor, alpha (RARA, Accession NM_000964.1) is another GAM71 target gene, herein designated TARGET GENE. RARA BINDING SITE is a target binding site found in the 3' untranslated region of mRNA encoded by RARA, corresponding to a target binding site such as BINDING SITE I, BINDING SITE II or BINDING SITE III of FIG. 8. Table 4 illustrates the complementarity of the nucleotide sequences of RARA BINDING SITE, designated SEQ ID:3568, to the nucleotide sequence of GAM71 RNA, herein designated GAM RNA, also designated SEQ ID:257.

Another function of GAM71 is therefore inhibition of Retinoic acid receptor, alpha (RARA, Accession NM_000964.1). Accordingly, utilities of GAM71 include diagnosis, prevention and treatment of diseases and clinical conditions associated with RARA.

Arginyl aminopeptidase (aminopeptidase b) (RNPEP, Accession NM_020216.2) is another GAM71 target gene, herein designated TARGET GENE. RNPEP BINDING SITE is a target binding site found in the 3' untranslated region of mRNA encoded by RNPEP, corresponding to a target binding site such as BINDING SITE I, BINDING SITE II or BINDING SITE III of FIG. 8. Table 4 illustrates the complementarity of the nucleotide sequences of RNPEP BINDING SITE, designated SEQ ID:8256, to the nucleotide sequence of GAM71 RNA, herein designated GAM RNA, also designated SEQ ID:257.

Another function of GAM71 is therefore inhibition of Arginyl aminopeptidase (aminopeptidase b) (RNPEP, Accession NM_020216.2), a gene which is an exopeptidase which selectively removes arginine and/or lysine residues from the n-terminus of several peptide substrates. Accordingly, utilities of GAM71 include diagnosis, prevention and treatment of diseases and clinical conditions associated with RNPEP.

The function of RNPEP has been established by previous studies. Aminopeptidase B (EC 3.4.11.6) was originally defined as an exopeptidase capable of trimming basic amino acid residues from the NH2 terminus of peptide substrates (Hopsu et al., 1964). Cadel et al. (1995) demonstrated that it is a Zn(2+)-dependent exopeptidase that selectively removes arginine and/or lysine residues from the N terminus of several peptide substrates. Structurally it is related to leukotriene A4 hydrolase (OMIM Ref. No. 151570), an important enzyme of the arachidonic acid pathway. The structural relationship has its functional counterpart in the capacity of aminopeptidase B to hydrolyze leukotriene A4 (Cadel et al., 1997). Antibodies raised against the isolated peptidase show that it is widely distributed in a number of tissues, including endocrine and nonendocrine cell types. It is secreted by rat PC12 pheochromocytoma cells and associated with the external face of their plasma membrane. Together these data strongly argue in favor of participation of this ubiquitous and in vitro bifunctional enzyme in the final stages of precursor processing mechanisms occurring either during the intracellular transport along the secretory pathway or at the plasma membrane level, or both (Aurich-Costa et al., 1997

Full details of the abovementioned studies are described in the following publications, the disclosure of which are hereby incorporated by reference:

Cadel, S.; Foulon, T.; Viron, A.; Balogh, A.; Midol-Monnet, S.; Noel, N.; Cohen, P.: Aminopeptidase B from the rat testis is a bifunctional enzyme structurally related to leukotriene-A4 hydrolase. Proc. Nat. Acad. Sci. 94:2963-2968, 1997; and Cadel, S.; Pierotti, A. R.; Foulton, T.; Creminon, C.; Barre, N.; Segretain, D.; Cohen, P.: Aminopeptidase-B in the rat testes: isolation, functional properties and cellular localizatio.

Further studies establishing the function and utilities of RNPEP are found in John Hopkins OMIM database record ID 602675, and in cited publications listed in Table 5, which are hereby incorporated by reference. Solute carrier family 15 (oligopeptide transporter), member 1 (SLC15A1, Accession NM_005073.1) is another GAM71 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:19682, to the nucleotide sequence of GAM71 RNA, herein designated GAM RNA, also designated SEQ ID:257.

Another function of GAM71 is therefore inhibition of Solute carrier family 15 (oligopeptide transporter), member 1 (SLC15A1, Accession NM_005073.1), a gene which is a H(+)-coupled peptide transporter. Accordingly, utilities of GAM71 include diagnosis, prevention and treatment of diseases and clinical conditions associated with SLC15A1.

The function of SLC15A1 and its association with various diseases and clinical conditions, has been established by previous studies, as described hereinabove with reference to GAM30.1. Solute carrier family 21 (organic anion transporter), member 9 (SLC21A9, Accession NM_007256.1) is another GAM71 target gene, herein designated TARGET GENE. SLC21A9 BINDING SITE is a target binding site found in the 3' untranslated region of mRNA encoded by SLC21A9, corresponding to a target binding site such as BINDING SITE I, BINDING SITE II or BINDING SITE III of FIG. 8. Table 4 illustrates the complementarity of the nucleotide sequences of SLC21A9 BINDING SITE, designated SEQ ID:5348, to the nucleotide sequence of GAM71 RNA, herein designated GAM RNA, also designated SEQ ID:257.

Another function of GAM71 is therefore inhibition of Solute carrier family 21 (organic anion transporter), member 9 (SLC21A9, Accession NM_007256.1), a gene which is Moderately similar to SLC21A2 prostaglandin transporter. Accordingly, utilities of GAM71 include diagnosis, prevention and treatment of diseases and clinical conditions associated with SLC21A9.

The function of SLC21A9 has been established by previous studies. By screening human brain cDNAs for the potential to encode proteins that are at least 50 kD, Nagase et al. (1998) isolated an SLC21A9 cDNA, which they called KIAA0880, that contains a complete coding sequence. The predicted 709-amino acid SLC21A9 protein contains 8 membrane-spanning regions. SLC21A9 shares 42.8% amino acid sequence identity with a rat prostaglandin transporter across 678 residues. RT-PCR followed by ELISA detected SLC21A9 expression in all human tissues examined, with the highest expression in liver, lower expression in lung, ovary, brain, heart, kidney, pancreas, spleen, and testis, and lowest expression in skeletal muscle Organic anion-transporting polypeptides (OATPs) are a family of multispecific carriers that mediate the sodium-independent transport of steroid hormone and conjugates, drugs, and numerous anionic endogenous substrates. St-Pierre et al. (2002) investigated whether members of the OATP gene family could mediate fetal-maternal transfer of anionic steroid conjugates in the human placenta. They isolated OATPB (SLC21A9) from a placenta cDNA library. An antiserum to OATPB detected an 85-kD protein in basal but not apical syncytiotrophoblast membranes. Immunohistochemistry of first-, second-, and third-trimester placenta showed staining in the cytotrophoblast membranes and at the basal surface of the syncytiotrophoblast. Trophoblasts that reacted with an antibody to Ki-67, a proliferation-associated antigen, expressed lower levels of OATPB. OATPB mRNA levels were measured in isolated trophoblasts under culture conditions that promoted syncytia formation. Real-time quantitative PCR estimated an 8-fold increase in OATPB expression on differentiation to syncytia. Pregnenolone sulfate partially inhibited OATPB-mediated transport of estrone-3-sulfate in an oocyte expression system. The authors concluded that these findings suggested a physiologic role for OATPB in the placental uptake of fetal-derived sulfated steroids Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XII. The complete sequences of 100 new cDNA clones from brain which code for large proteins in vitro. DNA Res. 5:355-364, 1998; and St-Pierre, M. V.; Hagenbuch, B.; Ugele, B.; Meier, P. J.; Stallmach, T.: Characterization of an organic anion-transporting polypeptide (OATP-B) in human placenta. J. Clin. Endocr. Metab.

Further studies establishing the function and utilities of SLC21A9 are found in John Hopkins OMIM database record ID 604988, and in cited publications listed in Table 5, which are hereby incorporated by reference. Solute carrier family 2 (facilitated glucose transporter), member 10 (SLC2A10, Accession NM_030777.2) is another GAM71 target gene, herein designated TARGET GENE. SLC2A10 BINDING SITE is a target binding site found in the 3' untranslated region of mRNA encoded by SLC2A10, corresponding to a target binding site such as BINDING SITE I, BINDING SITE II or BINDING SITE III of FIG. 8. Table 4 illustrates the complementarity of the nucleotide sequences of SLC2A10 BINDING SITE, designated SEQ ID:1738, to the nucleotide sequence of GAM71 RNA, herein designated GAM RNA, also designated SEQ ID:257.

Another function of GAM71 is therefore inhibition of Solute carrier family 2 (facilitated glucose transporter), member 10 (SLC2A10, Accession NM_030777.2). Accordingly, utilities of GAM71 include diagnosis, prevention and treatment of diseases and clinical conditions associated with SLC2A10.

Solute carrier family 5 (sodium-dependent vitamin transporter), member 6 (SLC5A6, Accession NM_021095.1) is another GAM71 target gene, herein designated TARGET GENE. SLC5A6 BINDING SITE is a target binding site found in the 5' untranslated region of mRNA encoded by SLC5A6, corresponding to a target binding site such as BINDING SITE I, BINDING SITE II or BINDING SITE III of FIG. 8. Table 4 illustrates the complementarity of the nucleotide sequences of SLC5A6 BINDING SITE, designated SEQ ID:19138, to the nucleotide sequence of GAM71 RNA, herein designated GAM RNA, also designated SEQ ID:257.

Another function of GAM71 is therefore inhibition of Solute carrier family 5 (sodium-dependent vitamin transporter), member 6 (SLC5A6, Accession NM_021095.1). Accordingly, utilities of GAM71 include diagnosis, prevention and treatment of diseases and clinical conditions associated with SLC5A6.

Solute carrier family 6 (neurotransmitter transporter, noradrenalin), member 2 (SLC6A2, Accession NM_001043.1) is another GAM71 target gene, herein designated TARGET GENE. SLC6A2 BINDING SITE is a target binding site found in the 3' untranslated region of mRNA encoded by SLC6A2, corresponding to a target binding site such as BINDING SITE I, BINDING SITE II or BINDING SITE III of FIG. 8. Table 4 illustrates the complementarity of the nucleotide sequences of SLC6A2 BINDING SITE, designated SEQ ID:3434, to the nucleotide sequence of GAM71 RNA, herein designated GAM RNA, also designated SEQ ID:257.

Another function of GAM71 is therefore inhibition of Solute carrier family 6 (neurotransmitter transporter, noradrenalin), member 2 (SLC6A2, Accession NM_001043.1), a gene which binds to gt and gc boxes promoters elements. Accordingly, utilities of GAM71 include diagnosis, prevention and treatment of diseases and clinical conditions associated with SLC6A2.

The function of SLC6A2 and its association with various diseases and clinical conditions, has been established by previous studies, as described hereinabove with reference to GAM63.1. Solute carrier family 9 (sodium/hydrogen exchanger), isoform 3 regulatory factor 2 (SLC9A3R2, Accession NM_004785.1) is another GAM71 target gene, herein designated TARGET GENE. SLC9A3R2 BINDING SITE is a target binding site found in the 3' untranslated region of mRNA encoded by SLC9A3R2, corresponding to a target binding site such as BINDING SITE I, BINDING SITE II or BINDING SITE III of FIG. 8. Table 4 illustrates the complementarity of the nucleotide sequences of SLC9A3R2 BINDING SITE, designated SEQ ID:16392, to the nucleotide sequence of GAM71 RNA, herein designated GAM RNA, also designated SEQ ID:257.

Another function of GAM71 is therefore inhibition of Solute carrier family 9 (sodium/hydrogen exchanger), isoform 3 regulatory factor 2 (SLC9A3R2, Accession NM_004785.1), a gene which interacts with the sodium/hydrogen exchanger (SLC9A3), the cytoskeletal protein ezrin (VIL2) and the testis determining factor (SRY). Accordingly, utilities of GAM71 include diagnosis, prevention and treatment of diseases and clinical conditions associated with SLC9A3R2.

The function of SLC9A3R2 has been established by previous studies. Mahon et al. (2002) demonstrated that parathyroid hormone receptor-1 (PTHR1; 168468) binds to the sodium/hydrogen exchanger regulatory factors NHERF1 (OMIM Ref. No. 604990) and NHERF2 through a PDZ-domain interaction in vitro and in PTH target cells. NHERF2 simultaneously binds phospholipase C-beta-1 and an atypical, carboxyl-terminal PDZ consensus motif, ETVM, of the PTHR1 through PDZ1 and PDZ2, respectively. PTH treatment of cells that express the NHERF2-PTH1R complex markedly activated phospholipase C-beta and inhibits adenylylcyclase through stimulation of inhibitory G proteins (see OMIM Ref. No. 139310). NHERF-mediated assembly of PTHR1 and phospholipase C-beta is a unique mechanism to regulate PTH signaling in cells and membranes of polarized cells that express NHERF, which may account for many tissue- and cell-specific actions of PTH/PTH-related protein (OMIM Ref. No. 168470) and may also be relevant to signaling by many G protein-coupled receptors Yun et al. (1998) showed that a central domain of NHE3, not a C-terminal domain, interacts with NHERF2 through its second PDZ domain plus its C terminus. Confocal microscopy demonstrated predominantly cytosolic expression of NHERF2 in the absence of NHE3, with more plasma membrane expression in the presence of NHE3. Gel overlay analysis showed that, as seen with NHERF, the N terminus of ezrin (VIL2; 123900) interacts with the C-terminal residues of NHERF2.

Full details of the abovementioned studies are described in the following publications, the disclosure of which are hereby incorporated by reference:

Mahon, M. J.; Donowitz, M.; Yun, C. C.; Segre, G. V.: Na+/H+ exchanger regulatory factor 2 directs parathyroid hormone 1 receptor signalling. Nature 417:858-861, 2002; and Yun, C.-H. C.; Lamprecht, G.; Forster, D. V.; Sidor, A.: NHE3 kinase A regulatory protein E3KARP binds the epithelial brush border Na(+)/H(+) exchanger NHE3 and the cytoskeletal protein.

Further studies establishing the function and utilities of SLC9A3R2 are found in John Hopkins OMIM database record ID 606553, and in cited publications listed in Table 5, which are hereby incorporated by reference. SSB-4 (Accession) is another GAM71 target gene, herein designated TARGET GENE. SSB-4 BINDING SITE is a target binding site found in the 5' untranslated region of mRNA encoded by SSB-4, corresponding to a target binding site such as BINDING SITE I, BINDING SITE II or BINDING SITE III of FIG. 8. Table 4 illustrates the complementarity of the nucleotide sequences of SSB-4 BINDING SITE, designated SEQ ID:7581, to the nucleotide sequence of GAM71 RNA, herein designated GAM RNA, also designated SEQ ID:257.

Another function of GAM71 is therefore inhibition of SSB-4 (Accession). Accordingly, utilities of GAM71 include diagnosis, prevention and treatment of diseases and clinical conditions associated with SSB-4.

Serine/threonine kinase 10 (STK10, Accession NM_005990.1) is another GAM71 target gene, herein designated TARGET GENE. STK10 BINDING SITE is a target binding site found in the 3' untranslated region of mRNA encoded by STK10, corresponding to a target binding site such as BINDING SITE I, BINDING SITE II or BINDING SITE III of FIG. 8. Table 4 illustrates the complementarity of the nucleotide sequences of STK10 BINDING SITE, designated SEQ ID:13156, to the nucleotide sequence of GAM71 RNA, herein designated GAM RNA, also designated SEQ ID:257.

Another function of GAM71 is therefore inhibition of Serine/threonine kinase 10 (STK10, Accession NM_005990.1), a gene which can act on substrates such as myelin basic protein and histone iia on serine and threonine residues. Accordingly, utilities of GAM71 include diagnosis, prevention and treatment of diseases and clinical conditions associated with STK10.

The function of STK10 has been established by previous studies. Kuramochi et al. (1997) cloned the mouse gene Stk10, coding for a new serine/threonine kinase, designated LOK. Kuramochi et al. (1999) described the cloning of a cDNA encoding the human homolog and the detection of LOK proteins in human lymphoid cells. They deposited the sequence of a human LOK cDNA in GenBank (AB015718). They also determined the chromosomal location of the gene by fluorescence in situ hybridization: 5q35.1 in human, 11A4 in mouse, and 10q12.3 in rat. By means of polymorphic CA repeats found in the 3-prime untranslated region of the mouse Stk10 gene and an intersubspecific backcross mapping panel, they mapped the Stk10 locus to a restricted region on chromosome 11 between D11Mit53 and D11Mit84. These results established STK10 as a new marker of human chromosome 5 to define the syntenic boundary of human chromosomes 5 and 16 on mouse chromosome 11.

Full details of the abovementioned studies are described in the following publications, the disclosure of which are hereby incorporated by reference:

Kuramochi, S.; Matsuda, Y.; Okamoto, M.; Kitamura, F.; Yonekawa, H.; Karasuyama, H.: Molecular cloning of the human gene STK10 encoding lymphocyte-oriented kinase, and comparative chromosomal mapping of the human, mouse, and rat homologues. Immunogenetics 49:369-375, 1999; and Kuramochi, S.; Moriguchi, T.; Kuida, K.; Endo, J.; Semba, K.; Nishida, E.; Karasuyama, H.: LOK is a novel mouse STE20-like protein kinase that is expressed predominantly in lymphocyte.

Further studies establishing the function and utilities of STK10 are found in John Hopkins OMIM database record ID 603919, and in cited publications listed in Table 5, which are hereby incorporated by reference. Synaptogyrin 1 (SYNGR1, Accession NM_004711.2) is another GAM71 target gene, herein designated TARGET GENE. SYNGR1 BINDING SITE1 and SYNGR1 BINDING SITE2 are target binding sites found in untranslated regions of multiple transcripts of mRNA encoded by SYNGR1, corresponding to target binding sites such as BINDING SITE I, BINDING SITE II or BINDING SITE III of FIG. 8. Table 4 illustrates the complementarity of the nucleotide sequences of SYNGR1 BINDING SITE1 and SYNGR1 BINDING SITE2, designated SEQ ID:13235 and SEQ ID:11048 respectively, to the nucleotide sequence of GAM71 RNA, herein designated GAM RNA, also designated SEQ ID:257.

Another function of GAM71 is therefore inhibition of Synaptogyrin 1 (SYNGR1, Accession NM_004711.2), a gene which belongs to transmembrane synaptic vesicle protein and may function in membrane recycling. Accordingly, utilities of GAM71 include diagnosis, prevention and treatment of diseases and clinical conditions associated with SYNGR1.

The function of SYNGR1 and its association with various diseases and clinical conditions, has been established by previous studies, as described hereinabove with reference to GAM63.1. Transcription factor ap-4 (activating enhancer binding protein 4) (TFAP4, Accession NM_003223.1) is another GAM71 target gene, herein designated TARGET GENE. TFAP4 BINDING SITE is a target binding site found in the 3' untranslated region of mRNA encoded by TFAP4, corresponding to a target binding site such as BINDING SITE I, BINDING SITE II or BINDING SITE III of FIG. 8. Table 4 illustrates the complementarity of the nucleotide sequences of TFAP4 BINDING SITE, designated SEQ ID:18694, to the nucleotide sequence of GAM71 RNA, herein designated GAM RNA, also designated SEQ ID:257.

Another function of GAM71 is therefore inhibition of Transcription factor ap-4 (activating enhancer binding protein 4) (TFAP4, Accession NM_003223.1), a gene which activates both viral and cellular genes by binding to the symmetrical dna sequence 5'-cagctg-3'. Accordingly, utilities of GAM71 include diagnosis, prevention and treatment of diseases and clinical conditions associated with TFAP4.

The function of TFAP4 has been established by previous studies. Transcription factors of the basic helix-loop-helix-zipper (bHLH-Zip) family contain a basic domain, which is used for DNA binding, and HLH and Zip domains, which are used for oligomerization. Transcription factor AP4 activates both viral and cellular genes by binding to the symmetrical DNA sequence CAGCTG (Mermod et al., 1988; Hu et al., 1990). By interspecific backcross analysis, Steingrimsson et al. (1995) mapped the Tfap4 gene to mouse chromosome 16, close to the gene for sperm protamine P1 (PRM1; 182880). Since the PRM1 is located on chromosome 16p13.3 in the human, they suggested that TFAP4 is probably on human chromosome 16. The International Radiation Hybrid Mapping Consortium mapped the TFAP4 gene to chromosome 16p13 (sts-S73885).

Full details of the abovementioned studies are described in the following publications, the disclosure of which are hereby incorporated by reference:

Hu, Y.-F.; Luscher, B.; Admon, A.; Mermod, N.; Tjian, R.: Transcription factor AP- 4 contains multiple dimerization domains that regulate dimer specificity. Genes Dev. 4:1741-1752, 1990; and Steingrimsson, E.; Sawadogo, M.; Gilbert, D. J.; Zervos, A. S.; Brent, R.; Blanar, M. A.; Fisher, D. E.; Copeland, N. G.; Jenkins, N. A.: Murine chromosomal location of five bHLH-Zip tr.

Further studies establishing the function and utilities of TFAP4 are found in John Hopkins OMIM database record ID 600743, and in cited publications listed in Table 5, which are hereby incorporated by reference. Tgfb-induced factor 2 (tale family homeobox) (TGIF2, Accession NM_021809.2) is another GAM71 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:6058, to the nucleotide sequence of GAM71 RNA, herein designated GAM RNA, also designated SEQ ID:257.

Another function of GAM71 is therefore inhibition of Tgfb-induced factor 2 (tale family homeobox) (TGIF2, Accession NM_021809.2). Accordingly, utilities of GAM71 include diagnosis, prevention and treatment of diseases and clinical conditions associated with TGIF2.

Uncoupling protein 3 (mitochondrial, proton carrier) (UCP3, Accession NM_003356.2) is another GAM71 target gene, herein designated TARGET GENE. UCP3 BINDING SITE is a target binding site found in the 5' untranslated region of multiple transcripts of mRNA encoded by UCP3, corresponding to a target binding site such as BINDING SITE I, BINDING SITE II or BINDING SITE III of FIG. 8. Table 4 illustrates the complementarity of the nucleotide sequences of UCP3 BINDING SITE, designated SEQ ID:4639, to the nucleotide sequence of GAM71 RNA, herein designated GAM RNA, also designated SEQ ID:257.

Another function of GAM71 is therefore inhibition of Uncoupling protein 3 (mitochondrial, proton carrier) (UCP3, Accession NM_003356.2), a gene which is a mitochondrial transporter protein that creates proton leaks across the inner mitochondrial membrane, thus uncoupling oxidative phosphorylation. and therefore may be associated with Obesity. Accordingly, utilities of GAM71 include diagnosis, prevention and treatment of Obesity, and of other diseases and clinical conditions associated with UCP3.

The function of UCP3 has been established by previous studies. With the capacity to participate in thermogenesis and energy balance, UCP3 is an important obesity candidate gene. Bouchard et al. (1997) demonstrated linkage between markers at the UCP2/UCP3 region with resting metabolic rate. This region is syntenic to a region of mouse chromosome 7 that has been linked to hyperinsulinemia and obesity (Fleury et al., 1997).

Animal model experiments lend further support to the function of UCP3. Clapham et al. (2000) created transgenic mice that overexpress human UCP3 in skeletal muscle. UCP3 expression was driven by the human alpha-skeletal actin (OMIM Ref. No. 102610) promoter, limiting expression to skeletal muscle. Clapham et al. (2000) bred 3 independent lines to homozygosity and selected a line of mice that had a 66-fold increase in UCP3 expression. These mice were hyperphagic but weighed less than their wildtype littermates. Magnetic resonance imaging (MRI) showed a striking reduction in adipose tissue mass. The mice also exhibited lower fasting plasma glucose and insulin levels and an increased glucose clearance rate. Clapham et al. (2000) concluded that their data provided evidence that skeletal muscle UCP3 has the potential to influence metabolic rates and glucose homeostasis in the whole animal.

It is appreciated that the abovementioned animal model for UCP3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Clapham, J. C.; Arch, J. R. S.; Chapman, H.; Haynes, A.; Lister, C.; Moore, G. B. T.; Piercy, V.; Carter, S. A.; Lehner, I.; Smith, S. A.; Beeley, L. J.; Godden, R. J.; and 15 others: Mice overexpressing human uncoupling protein-3 in skeletal muscle are hyperphagic and lean. Nature 406:415-418, 2000; and Fleury, C.; Neverova, M.; Collins, S.; Raimbault, S.; Champigny, O.; Levi-Meyrueis, C.; Bouillaud, F.; Seldin, M. F.; Surwit, R. S.; Ricquier, D.; Warden, C. H.: Uncoupling protein-2.

Further studies establishing the function and utilities of UCP3 are found in John Hopkins OMIM database record ID 602044, and in cited publications listed in Table 5, which are hereby incorporated by reference. UREB1 (Accession NM_031407.2) is another GAM71 target gene, herein designated TARGET GENE. UREB1 BINDING SITE is a target binding site found in the 5' untranslated region of mRNA encoded by UREB1, corresponding to a target binding site such as BINDING SITE I, BINDING SITE II or BINDING SITE III of FIG. 8. Table 4 illustrates the complementarity of the nucleotide sequences of UREB1 BINDING SITE, designated SEQ ID:5654, to the nucleotide sequence of GAM71 RNA, herein designated GAM RNA, also designated SEQ ID:257.

Another function of GAM71 is therefore inhibition of UREB1 (Accession NM_031407.2). Accordingly, utilities of GAM71 include diagnosis, prevention and treatment of diseases and clinical conditions associated with UREB1.

Ubiquitin specific protease 21 (USP21, Accession NM_012475.2) is another GAM71 target gene, herein designated TARGET GENE. USP21 BINDING SITE is a target binding site found in the 3' untranslated region of multiple transcripts of mRNA encoded by USP21, corresponding to a target binding site such as BINDING SITE I, BINDING SITE II or BINDING SITE III of FIG. 8. Table 4 illustrates the complementarity of the nucleotide sequences of USP21 BINDING SITE, designated SEQ ID:3093, to the nucleotide sequence of GAM71 RNA, herein designated GAM RNA, also designated SEQ ID:257.

Another function of GAM71 is therefore inhibition of Ubiquitin specific protease 21 (USP21, Accession NM_012475.2). Accordingly, utilities of GAM71 include diagnosis, prevention and treatment of diseases and clinical conditions associated with USP21.

FIG. 8 further provides a conceptual description of a novel bioinformatically detected of the present invention, referred to here as Genomic Address Messenger 72 (GAM72), which modulates expression of respective target genes thereof, the function and utility of which target genes is known in the art.

GAM72 is a novel bioinformatically detected regulatory, non protein coding, micro RNA (miRNA) gene. The method by which GAM72 was detected is described hereinabove with reference to FIGS. 8-15.

GAM72 gene, herein designated GAM GENE, and GAM72 target gene, herein designated TARGET GENE, are human genes contained in the human genome.

GAM72 gene encodes a GAM72 precursor RNA, herein designated GAM PRECURSOR RNA. Similar to other miRNA genes, and unlike most ordinary genes, GAM72 precursor RNA does not encode a protein. A nucleotide sequence identical or highly similar to the nucleotide sequence of GAM72 precursor RNA is designated SEQ ID:198, and is provided hereinbelow with reference to the sequence listing part.

GAM72 precursor RNA folds onto itself, forming GAM72 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM72 precursor RNA folds onto itself, forming GAM72 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM72 precursor RNA, designated SEQ-ID:198, and a schematic representation of a predicted secondary folding of GAM72 folded precursor RNA are further described with reference to Table 2, hereby incorporated by reference.

An enzyme complex designated DICER COMPLEX, 'dices' the GAM72 folded precursor RNA into GAM72 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM72 RNA is designated SEQ ID:342, and is provided hereinbelow with references to the sequence listing part and Table 3, hereby incorporated by reference.

GAM72 target gene, herein designated TARGET GENE, encodes a corresponding messenger RNA, GAM72 target RNA, herein designated GAM TARGET RNA. GAM72 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM72 RNA, herein designated GAM RNA, binds complementarily to one or more target binding sites located in untranslated regions of GAM72 target RNA, herein designated GAM TARGET RNA. This complementary binding is due to the fact that the nucleotide sequence of GAM72 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM72 RNA may have a different number of target binding sites in untranslated regions of a GAM72 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM72 RNA, herein designated GAM RNA, to target binding sites on GAM72 target RNA, herein designated GAM TARGET RNA, such as BINDING SITE I, BINDING SITE II and BINDING SITE III, inhibits translation of GAM72 target RNA into GAM72 target protein, herein designated GAM TARGET PROTEIN. GAM target protein is therefore outlined by a broken line.

It is appreciated that GAM72 target gene, herein designated TARGET GENE, in fact represents a plurality of GAM72 target genes. The mRNA of each one of this plurality of GAM72 target genes comprises one or more target binding sites, each having a nucleotide sequence which is at least partly complementary to GAM72 RNA, herein designated GAM RNA, and which when bound by GAM72 RNA causes inhibition of translation of respective one or more GAM72 target proteins.

It is further appreciated by one skilled in the art that the mode of translational inhibition illustrated by FIG. 8 with specific reference to translational inhibition exerted by GAM72 gene, herein designated GAM GENE, on one or more GAM72 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM72 correlate with, and may be deduced from, the identity of the target genes which GAM72 binds and inhibits, and the function of these target genes, as elaborated hereinbelow.

A kinase (prka) anchor protein 11 (AKAP11, Accession NM_016248.2) is a GAM72 target gene, herein designated TARGET GENE. AKAP11 BINDING SITE is a target binding site found in the 3' untranslated region of multiple transcripts of mRNA encoded by AKAP11, corresponding to a target binding site such as BINDING SITE I, BINDING SITE II or BINDING SITE III of FIG. 8. Table 4 illustrates the complementarity of the nucleotide sequences of AKAP11 BINDING SITE, designated SEQ ID:10091, to the nucleotide sequence of GAM72 RNA, herein designated GAM RNA, also designated SEQ ID:342.

A function of GAM72 is therefore inhibition of A kinase (prka) anchor protein 11 (AKAP11, Accession NM_016248.2). Accordingly, utilities of GAM72 include diagnosis, prevention and treatment of diseases and clinical conditions associated with AKAP11.

Arachidonate 15-lipoxygenase, second type (ALOX15B, Accession NM_001141.1) is another GAM72 target gene, herein designated TARGET GENE. ALOX15B BINDING SITE is a target binding site found in the 3' untranslated region of mRNA encoded by ALOX15B, corresponding to a target binding site such as BINDING SITE I, BINDING SITE II or BINDING SITE III of FIG. 8. Table 4 illustrates the complementarity of the nucleotide sequences of ALOX15B BINDING SITE, designated SEQ ID:407, to the nucleotide sequence of GAM72 RNA, herein designated GAM RNA, also designated SEQ ID:342.

Another function of GAM72 is therefore inhibition of Arachidonate 15-lipoxygenase, second type (ALOX15B, Accession NM_001141.1). Accordingly, utilities of GAM72 include diagnosis, prevention and treatment of diseases and clinical conditions associated with ALOX15B.

Ap1 gamma subunit binding protein 1 (AP1GBP1, Accession NM_080550.1) is another GAM72 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:8213, to the nucleotide sequence of GAM72 RNA, herein designated GAM RNA, also designated SEQ ID:342.

Another function of GAM72 is therefore inhibition of Ap1 gamma subunit binding protein 1 (AP1GBP1, Accession NM_080550.1). Accordingly, utilities of GAM72 include diagnosis, prevention and treatment of diseases and clinical conditions associated with AP1GBP1.

Apolipoprotein l, 1 (APOL1, Accession NM_145343.1) is another GAM72 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:11403, to the nucleotide sequence of GAM72 RNA, herein designated GAM RNA, also designated SEQ ID:342.

Another function of GAM72 is therefore inhibition of Apolipoprotein l, 1 (APOL1, Accession NM_145343.1), a gene which may participate in reverse cholesterol transport from peripheral cells to the liver. and therefore may be associated with Schizophrenia. Accordingly, utilities of GAM72 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Arylsulfatase d (ARSD, Accession NM_001669.1) is another GAM72 target gene, herein designated TARGET GENE. ARSD BINDING SITE is a target binding site found in the 3' untranslated region of multiple transcripts of mRNA encoded by ARSD, corresponding to a target binding site such as BINDING SITE I, BINDING SITE II or BINDING SITE III of FIG. 8. Table 4 illustrates the complementarity of the nucleotide sequences of ARSD BINDING SITE, designated SEQ ID:14037, to the nucleotide sequence of GAM72 RNA, herein designated GAM RNA, also designated SEQ ID:342.

Another function of GAM72 is therefore inhibition of Arylsulfatase d (ARSD, Accession NM_001669.1), a gene which hydrolyzes sulfate groups from sugar residues in complex glycoconjugates. and therefore may be associated with X-linked chondrodysplasia punctata. Accordingly, utilities of GAM72 include diagnosis, prevention and treatment of X-linked chondrodysplasia punctata, and of other diseases and clinical conditions associated with ARSD.

The function of ARSD has been established by previous studies. In the course of positional cloning of the gene mutant in X-linked chondrodysplasia punctata (OMIM Ref. No. 302950), Franco et al. (1995) identified a cluster of 3 sulfatase genes located in the region Xp22.3. The genes were arylsulfatases and were designated ARSD, ARSE (OMIM Ref. No. 300180), and ARSF (OMIM Ref. No. 300003), in that order, proceeding from the telomere of Xp toward the centromere. Mutations in ARSE were identified in males with chondrodysplasia punctata. Franco et al. (1995) showed that both ARSD and ARSE have 11 exons and are transcribed toward the telomere. Their natural substrate was not determined. Meroni et al. (1996) reported that ARSD and ARSE have several typical features of genes that map in the pseudoautosomal region of the X chromosome, i.e., they escape X inactivation, have homologs on the Y chromosome, and are not conserved in mouse. Meroni et al. (1996) noted that ARSD, ARSE, and STS have a conserved gene structure; alignment of the genomic structures revealed perfect conservation of the intron-exon junctions. Sequence analysis of the Y-linked homologs of ARSD and ARSE indicated that they represent truncated pseudogenes.

Full details of the abovementioned studies are described in the following publications, the disclosure of which are hereby incorporated by reference:

Franco, B.; Meroni, G.; Parenti, G.; Levilliers, J.; Bernard, L.; Gebbia, M.; Cox, L.; Maroteaux, P.; Sheffield, L.; Rappold, G. A.; Andria, G.; Petit, C.; Ballabio, A.: A cluster of sulfatase genes on Xp22.3: mutations in chondrodysplasia punctata (CDPX) and implications for warfarin embryopathy. Cell 81:1-20, 1995; and Meroni, G.; Franco, B.; Archidiacono, N.; Messali, S.; Andolfi, G.; Rocchi, M.; Ballabio, A.: Characterization of a cluster of sulfatase genes on Xp22.3 suggests gene duplications in a.

Further studies establishing the function and utilities of ARSD are found in John Hopkins OMIM database record ID 300002, and in cited publications listed in Table 5, which are hereby incorporated by reference. Biphenyl hydrolase-like (serine hydrolase; breast epithelial mucin-associated antigen) (BPHL, Accession NM_004332.1) is another GAM72 target gene, herein designated TARGET GENE. BPHL BINDING SITE is a target binding site found in the 3' untranslated region of mRNA encoded by BPHL, corresponding to a target binding site such as BINDING SITE I, BINDING SITE II or BINDING SITE III of FIG. 8. Table 4 illustrates the complementarity of the nucleotide sequences of BPHL BINDING SITE, designated SEQ ID:16204, to the nucleotide sequence of GAM72 RNA, herein designated GAM RNA, also designated SEQ ID:342.

Another function of GAM72 is therefore inhibition of Biphenyl hydrolase-like (serine hydrolase; breast epithelial mucin-associated antigen) (BPHL, Accession NM_004332.1), a gene which involves in detoxification processes. Accordingly, utilities of GAM72 include diagnosis, prevention and treatment of diseases and clinical conditions associated with BPHL.

The function of BPHL has been established by previous studies. The serine hydrolases are defined as a functional class of hydrolytic enzymes that contain a serine residue in their active site. They can be grouped into subfamilies that contain closely related members in terms of substrate specificity or amino acid sequence similarity. Puente and Lopez-Otin (1995) isolated a full-length human breast carcinoma cDNA encoding a novel serine hydrolase, BPHL. The deduced 274-amino acid protein shows significant sequence similarity to prokaryotic enzymes involved in the degradation of aromatic compounds; the highest identities, about 25%, are to 4 serine hydrolases encoded by the bphD genes of different strains of Pseudomonas, all of which degrade biphenyl derivatives. Recombinant BPHL protein demonstrated serine hydrolase activity that was abolished by a covalent inhibitor of serine hydrolases. By Northern blot analysis of human tissues, the authors detected a major 1.8-kb BPHL transcript, with highest levels in liver and kidney, and a minor 2.4-kb transcript. They showed that BPHL is expressed as an approximately 30-kD protein in human liver using Western blot analysis. Puente et al. (1998) determined that the BPHL gene spans approximately 30 kb and contains 8 exons. By fluorescence in situ hybridization, they localized the BPHL gene to 6p25.

Full details of the abovementioned studies are described in the following publications, the disclosure of which are hereby incorporated by reference:

Puente, X. S.; Lopez-Otin, C.: Cloning and expression analysis of a novel human serine hydrolase with sequence similarity to prokaryotic enzymes involved in the degradation of aromatic compounds. J. Biol. Chem. 270:12926-12932, 1995; and Puente, X. S.; Pendas, A. M.; Lopez-Otin, C.: Structural characterization and chromosomal localization of the gene encoding human biphenyl hydrolase-related protein (BPHL). Genomics 5.

Further studies establishing the function and utilities of BPHL are found in John Hopkins OMIM database record ID 603156, and in cited publications listed in Table 5, which are hereby incorporated by reference. Breast cancer 2, early onset (BRCA2, Accession NM_000059.1) is another GAM72 target gene, herein designated TARGET GENE. BRCA2 BINDING SITE is a target binding site found in the 5' untranslated region of mRNA encoded by BRCA2, corresponding to a target binding site such as BINDING SITE I, BINDING SITE II or BINDING SITE III of FIG. 8. Table 4 illustrates the complementarity of the nucleotide sequences of BRCA2 BINDING SITE, designated SEQ ID:2407, to the nucleotide sequence of GAM72 RNA, herein designated GAM RNA, also designated SEQ ID:342.

Another function of GAM72 is therefore inhibition of Breast cancer 2, early onset (BRCA2, Accession NM_000059.1). Accordingly, utilities of GAM72 include diagnosis, prevention and treatment of diseases and clinical conditions associated with BRCA2.

Chromosome 1 open reading frame 24 (C1orf24, Accession NM_052966.1) is another GAM72 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:12135, to the nucleotide sequence of GAM72 RNA, herein designated GAM RNA, also designated SEQ ID:342.

Another function of GAM72 is therefore inhibition of Chromosome 1 open reading frame 24 (C1orf24, Accession NM_052966.1). Accordingly, utilities of GAM72 include diagnosis, prevention and treatment of diseases and clinical conditions associated with C1orf24.

Chromosome 1 open reading frame 33 (C1orf33, Accession NM_016183.2) is another GAM72 target gene, herein designated TARGET GENE. C1orf33 BINDING SITE is a target binding site found in the 3' untranslated region of mRNA encoded by C1orf33, corresponding to a target binding site such as BINDING SITE I, BINDING SITE II or BINDING SITE III of FIG. 8. Table 4 illustrates the complementarity of the nucleotide sequences of C1orf33 BINDING SITE, designated SEQ ID:13080, to the nucleotide sequence of GAM72 RNA, herein designated GAM RNA, also designated SEQ ID:342.

Another function of GAM72 is therefore inhibition of Chromosome 1 open reading frame 33 (C1orf33, Accession NM_016183.2). Accordingly, utilities of GAM72 include diagnosis, prevention and treatment of diseases and clinical conditions associated with C1orf33.

C1q and tumor necrosis factor related protein 2 (C1QTNF2, Accession NM_031908.2) is another GAM72 target gene, herein designated TARGET GENE. C1QTNF2 BINDING SITE is a target binding site found in the 3' untranslated region of mRNA encoded by C1QTNF2, corresponding to a target binding site such as BINDING SITE I, BINDING SITE II or BINDING SITE III of FIG. 8. Table 4 illustrates the complementarity of the nucleotide sequences of C1QTNF2 BINDING SITE, designated SEQ ID:9609, to the nucleotide sequence of GAM72 RNA, herein designated GAM RNA, also designated SEQ ID:342.

Another function of GAM72 is therefore inhibition of C1q and tumor necrosis factor related protein 2 (C1QTNF2, Accession NM_031908.2). Accordingly, utilities of GAM72 include diagnosis, prevention and treatment of diseases and clinical conditions associated with C1QTNF2.

Chromosome 20 open reading frame 106 (C20orf106, Accession) is another GAM72 target gene, herein designated TARGET GENE. C20orf106 BINDING SITE1 and C20orf106 BINDING SITE2 are target binding sites found in untranslated regions of mRNA encoded by C20orf106, corresponding to target binding sites such as BINDING SITE I, BINDING SITE II or BINDING SITE III of FIG. 8. Table 4 illustrates the complementarity of the nucleotide sequences of C20orf106 BINDING SITE1 and C20orf106 BINDING SITE2, designated SEQ ID:11104 and SEQ ID:16007 respectively, to the nucleotide sequence of GAM72 RNA, herein designated GAM RNA, also designated SEQ ID:342.

Another function of GAM72 is therefore inhibition of Chromosome 20 open reading frame 106 (C20orf106, Accession). Accordingly, utilities of GAM72 include diagnosis, prevention and treatment of diseases and clinical conditions associated with C20orf106.

Chromosome 20 open reading frame 142 (C20orf142, Accession XM_300782.1) is another GAM72 target gene, herein designated TARGET GENE. C20orf142 BINDING SITE is a target binding site found in the 3' untranslated region of mRNA encoded by C20orf142, corresponding to a target binding site such as BINDING SITE I, BINDING SITE II or BINDING SITE III of FIG. 8. Table 4 illustrates the complementarity of the nucleotide sequences of C20orf142 BINDING SITE, designated SEQ ID:19248, to the nucleotide sequence of GAM72 RNA, herein designated GAM RNA, also designated SEQ ID:342.

Another function of GAM72 is therefore inhibition of Chromosome 20 open reading frame 142 (C20orf142, Accession XM_300782.1). Accordingly, utilities of GAM72 include diagnosis, prevention and treatment of diseases and clinical conditions associated with C20orf142.

Chromosome 21 open reading frame 5 (C21orf5, Accession NM_005128.1) is another GAM72 target gene, herein designated TARGET GENE. C21orf5 BINDING SITE is a target binding site found in the 5' untranslated region of mRNA encoded by C21orf5, corresponding to a target binding site such as BINDING SITE I, BINDING SITE II or BINDING SITE III of FIG. 8. Table 4 illustrates the complementarity of the nucleotide sequences of C21orf5 BINDING SITE, designated SEQ ID:17560, to the nucleotide sequence of GAM72 RNA, herein designated GAM RNA, also designated SEQ ID:342.

Another function of GAM72 is therefore inhibition of Chromosome 21 open reading frame 5 (C21orf5, Accession NM_005128.1). Accordingly, utilities of GAM72 include diagnosis, prevention and treatment of diseases and clinical conditions associated with C21orf5.

Chromosome 22 open reading frame 20 (C22orf20, Accession NM_025225.2) is another GAM72 target gene, herein designated TARGET GENE. C22orf20 BINDING SITE is a target binding site found in the 3' untranslated region of mRNA encoded by C22orf20, corresponding to a target binding site such as BINDING SITE I, BINDING SITE II or BINDING SITE III of FIG. 8. Table 4 illustrates the complementarity of the nucleotide sequences of C22orf20 BINDING SITE, designated SEQ ID:15306, to the nucleotide sequence of GAM72 RNA, herein designated GAM RNA, also designated SEQ ID:342.

Another function of GAM72 is therefore inhibition of Chromosome 22 open reading frame 20 (C22orf20, Accession NM_025225.2). Accordingly, utilities of GAM72 include diagnosis, prevention and treatment of diseases and clinical conditions associated with C22orf20.

C4S-2 (Accession NM_018641.2) is another GAM72 target gene, herein designated TARGET GENE. C4S-2 BINDING SITE is a target binding site found in the 3' untranslated region of mRNA encoded by C4S-2, corresponding to a target binding site such as BINDING SITE I, BINDING SITE II or BINDING SITE III of FIG. 8. Table 4 illustrates the complementarity of the nucleotide sequences of C4S-2 BINDING SITE, designated SEQ ID:10076, to the nucleotide sequence of GAM72 RNA, herein designated GAM RNA, also designated SEQ ID:342.

Another function of GAM72 is therefore inhibition of C4S-2 (Accession NM_018641.2). Accordingly, utilities of GAM72 include diagnosis, prevention and treatment of diseases and clinical conditions associated with C4S-2.

Chromosome 6 open reading frame 10 (C6orf10, Accession NM_006781.1) is another GAM72 target gene, herein designated TARGET GENE. C6orf10 BINDING SITE is a target binding site found in the 5' untranslated region of mRNA encoded by C6orf10, corresponding to a target binding site such as BINDING SITE I, BINDING SITE II or BINDING SITE III of FIG. 8. Table 4 illustrates the complementarity of the nucleotide sequences of C6orf10 BINDING SITE, designated SEQ ID:2589, to the nucleotide sequence of GAM72 RNA, herein designated GAM RNA, also designated SEQ ID:342.

Another function of GAM72 is therefore inhibition of Chromosome 6 open reading frame 10 (C6orf10, Accession NM_006781.1). Accordingly, utilities of GAM72 include diagnosis, prevention and treatment of diseases and clinical conditions associated with C6orf10.

Chromosome 6 open reading frame 29 (C6orf29, Accession NM_032794.1) is another GAM72 target gene, herein designated TARGET GENE. C6orf29 BINDING SITE is a target binding site found in the 3' untranslated region of multiple transcripts of mRNA encoded by C6orf29, corresponding to a target binding site such as BINDING SITE I, BINDING SITE II or BINDING SITE III of FIG. 8. Table 4 illustrates the complementarity of the nucleotide sequences of C6orf29 BINDING SITE, designated SEQ ID:9517, to the nucleotide sequence of GAM72 RNA, herein designated GAM RNA, also designated SEQ ID:342.

Another function of GAM72 is therefore inhibition of Chromosome 6 open reading frame 29 (C6orf29, Accession NM_032794.1). Accordingly, utilities of GAM72 include diagnosis, prevention and treatment of diseases and clinical conditions associated with C6orf29.

Caspase 10, apoptosis-related cysteine protease (CASP10, Accession NM_032974.1) is another GAM72 target gene, herein designated TARGET GENE. CASP10 BINDING SITE is a target binding site found in the 3' untranslated region of multiple transcripts of mRNA encoded by CASP10, corresponding to a target binding site such as BINDING SITE I, BINDING SITE II or BINDING SITE III of FIG. 8. Table 4 illustrates the complementarity of the nucleotide sequences of CASP10 BINDING SITE, designated SEQ ID:13216, to the nucleotide sequence of GAM72 RNA, herein designated GAM RNA, also designated SEQ ID:342.

Another function of GAM72 is therefore inhibition of Caspase 10, apoptosis-related cysteine protease (CASP10, Accession NM_032974.1), a gene which is one aspartate-specific cysteine protease and important in death receptor signaling or other cellular processes and therefore may be associated with Gastric cancers. Accordingly, utilities of GAM72 include diagnosis, prevention and treatment of Gastric cancers, and of other diseases and clinical conditions associated with CASP10.

The function of CASP10 and its association with various diseases and clinical conditions, has been established by previous studies, as described hereinabove with reference to GAM44.1. Caspase 8, apoptosis-related cysteine protease (CASP8, Accession NM_001228.2) is another GAM72 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:10165, to the nucleotide sequence of GAM72 RNA, herein designated GAM RNA, also designated SEQ ID:342.

Another function of GAM72 is therefore inhibition of Caspase 8, apoptosis-related cysteine protease (CASP8, Accession NM_001228.2), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM72 include diagnosis, prevention and treatment of Huntington-related neurodegenerative diseases, and of other diseases and clinical conditions associated with CASP8.

The function of CASP8 has been established by previous studies. Expression of cDNAs that encode truncated polypeptides containing mostly expanded polyglutamine repeats, but not of those that encode the corresponding full-length proteins, has been shown to induce cell death by apoptosis. Such truncated proteins have been shown to form aggregates or inclusions (Ikeda et al., 1996). Sanchez et al. (1999) studied the role of caspases in polyglutamine-induced cell death in established cultures of primary cortical, striatal, and cerebellar neurons from embryonic day 17 rat embryos, transfected with an expression construct encoding truncated ataxin-3 that contained 79 glutamine (Q79) residues. The authors showed that the apoptosis inhibitors Bcl2, CrmA, and a truncated Fas/APO1-associated death domain protein (FADD DN) inhibited polyglutamine repeat-induced neuronal cell death. A mutant Jurkat cell line specifically lacking caspase-8 was resistant to polyglutamine-induced cell death. Cells transfected with Q79 showed insoluble inclusions. Caspase-8 was recruited and activated by these Q79 inclusions. Western blot analysis revealed the presence of activated caspase-8 in the insoluble fraction of affected brain regions from Huntington disease (OMIM Ref. No. 143100) patients but not in those from controls. The authors suggested that caspase-8 has an essential role in Huntington-related neurodegenerative diseases.

Animal model experiments lend further support to the function of CASP8. Varfolomeev et al. (1998) generated mice deficient in Casp8 by disrupting exons 1 and 2, which encode the N-terminal death effector domains (DEDs) that interact with MORT1/FADD (OMIM Ref. No. 602457). Whereas wildtype and heterozygous mice appeared normal, no homozygous mutant mice survived beyond approximately embryonic day 13.5. Histopathologic analysis revealed marked abdominal hyperemia with erythrocytosis in the liver, major blood vessels, capillaries, and other organs. Cardiac ventricular musculature was thin and similar to early mesenchyme. Colony forming assays showed that hemopoietic precursor cells were markedly reduced in the mutant mice. Immunoprecipitation and Western blot analysis indicated that fibroblasts from mutant mice responded normally to the noncytocidal effects of tumor necrosis factor receptor (TNFR; 191190) and death receptor-3 (DR3, or TNFRSF12; 603366) stimulation, whereas wildtype fibroblasts were killed by TNF (OMIM Ref. No. 191160) treatment or FAS (TNFRSF6; 134637) cross-linking. Agents such as ultraviolet irradiation and protein kinase inhibitors were lethal for mutant and normal fibroblasts. Varfolomeev et al. (1998) concluded that CASP8 is necessary for death induction by receptors of the TNF/nerve growth factor (see OMIM Ref. No. NGFR; 162010) family and is vital in embryonal development.

It is appreciated that the abovementioned animal model for CASP8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sanchez, I.; Xu, C.-J.; Juo, P.; Kakizaka, A.; Blenis, J.; Yuan, J.: Caspase-8 is required for cell death induced by expanded polyglutamine repeats. Neuron 22:623-633, 1999; and Varfolomeev, E. E.; Schuchmann, M.; Luria, V.; Chiannilkulchai, N.; Beckmann, J. S.; Mett, I. L.; Rebrikov, D.; Brodianski, V. M.; Kemper, O. C.; Kollet, O.; Lapidot, T.; Soffer, D.; So.

Further studies establishing the function and utilities of CASP8 are found in John Hopkins OMIM database record ID 601763, and in cited publications listed in Table 5, which are hereby incorporated by reference. Centaurin, alpha 2 (CENTA2, Accession NM_018404.1) is another GAM72 target gene, herein designated TARGET GENE. CENTA2 BINDING SITE is a target binding site found in the 3' untranslated region of mRNA encoded by CENTA2, corresponding to a target binding site such as BINDING SITE I, BINDING SITE II or BINDING SITE III of FIG. 8. Table 4 illustrates the complementarity of the nucleotide sequences of CENTA2 BINDING SITE, designated SEQ ID:10588, to the nucleotide sequence of GAM72 RNA, herein designated GAM RNA, also designated SEQ ID:342.

Another function of GAM72 is therefore inhibition of Centaurin, alpha 2 (CENTA2, Accession NM_018404.1). Accordingly, utilities of GAM72 include diagnosis, prevention and treatment of diseases and clinical conditions associated with CENTA2.

Carbohydrate (chondroitin 6) sulfotransferase 3 (CHST3, Accession NM_004273.2) is another GAM72 target gene, herein designated TARGET GENE. CHST3 BINDING SITE is a target binding site found in the 3' untranslated region of mRNA encoded by CHST3, corresponding to a target binding site such as BINDING SITE I, BINDING SITE II or BINDING SITE III of FIG. 8. Table 4 illustrates the complementarity of the nucleotide sequences of CHST3 BINDING SITE, designated SEQ ID:8037, to the nucleotide sequence of GAM72 RNA, herein designated GAM RNA, also designated SEQ ID:342.

Another function of GAM72 is therefore inhibition of Carbohydrate (chondroitin 6) sulfotransferase 3 (CHST3, Accession NM_004273.2). Accordingly, utilities of GAM72 include diagnosis, prevention and treatment of diseases and clinical conditions associated with CHST3.

Cyclic nucleotide gated channel beta 1 (CNGB1, Accession NM_001297.1) is another GAM72 target gene, herein designated TARGET GENE. CNGB1 BINDING SITE is a target binding site found in the 3' untranslated region of mRNA encoded by CNGB1, corresponding to a target binding site such as BINDING SITE I, BINDING SITE II or BINDING SITE III of FIG. 8. Table 4 illustrates the complementarity of the nucleotide sequences of CNGB1 BINDING SITE, designated SEQ ID:8665, to the nucleotide sequence of GAM72 RNA, herein designated GAM RNA, also designated SEQ ID:342.

Another function of GAM72 is therefore inhibition of Cyclic nucleotide gated channel beta 1 (CNGB1, Accession NM_001297.1), a gene which has probable role in photoreception. and therefore may be associated with Retinitis pigmentosa. Accordingly, utilities of GAM72 include diagnosis, prevention and treatment of Retinitis pigmentosa, and of other diseases and clinical conditions associated with CNGB1.

The function of CNGB1 has been established by previous studies. See CNCG1 (OMIM Ref. No. 123825). The human and bovine rod photoreceptor cGMP-gated cation channel consists of 2 subunits: alpha (63 kD; 123825) and beta (OMIM Ref. No. 240 kD). Ardell et al. (1996) provided evidence that the human GAR1 protein is encoded by the N-terminal region of the gene encoding the beta subunit of the cGMP-gated photoreceptor channel Bareil et al. (2001) studied a consanguineous French family with autosomal recessive retinitis pigmentosa (RP; 268000). Autosomal recessive RP accounts for 5 to 20% of all RP, whereas sporadic RP, presumed to be recessive in most cases, accounts for a further 40 to 50% (Bird, 1995). Bareil et al. (2001) excluded linkage to known loci involved in RP and by homozygosity mapping localized the disease gene in this family to 16q13-q21. They noted 2 candidate genes, KIFC3 (OMIM Ref. No. 604535) and CNGB1. Mutation analysis demonstrated that CNGB1 was mutated in this family Full details of the abovementioned studies are described in the following publications, the disclosure of which are hereby incorporated by reference:

Ardell, M. D.; Aragon, I.; Oliveira, L.; Porche, G. E.; Burke, E.; Pittler, S. J.: The beta subunit of human rod photoreceptor cGMP-gated cation channel is generated from a complex transcription unit. FEBS Lett. 389:213-218, 1996; and Bareil, C.; Hamel, C. P.; Delague, V.; Arnaud, B.; Demaille, J.; Claustres, M.: Segregation of a mutation in CNGB1 encoding the beta-subunit of the rod cGMP-gated channel in a family wi.

Further studies establishing the function and utilities of CNGB1 are found in John Hopkins OMIM database record ID 600724, and in cited publications listed in Table 5, which are hereby incorporated by reference. Cyclin m1 (CNNM1, Accession NM_020348.1) is another GAM72 target gene, herein designated TARGET GENE. CNNM1 BINDING SITE is a target binding site found in the 3' untranslated region of mRNA encoded by CNNM1, corresponding to a target binding site such as BINDING SITE I, BINDING SITE II or BINDING SITE III of FIG. 8. Table 4 illustrates the complementarity of the nucleotide sequences of CNNM1 BINDING SITE, designated SEQ ID:14071, to the nucleotide sequence of GAM72 RNA, herein designated GAM RNA, also designated SEQ ID:342.

Another function of GAM72 is therefore inhibition of Cyclin m1 (CNNM1, Accession NM_020348.1). Accordingly, utilities of GAM72 include diagnosis, prevention and treatment of diseases and clinical conditions associated with CNNM1.

Carboxypeptidase m (CPM, Accession NM_001874.1) is another GAM72 target gene, herein designated TARGET GENE. CPM BINDING SITE is a target binding site found in the 3' untranslated region of mRNA encoded by CPM, corresponding to a target binding site such as BINDING SITE I, BINDING SITE II or BINDING SITE III of FIG. 8. Table 4 illustrates the complementarity of the nucleotide sequences of CPM BINDING SITE, designated SEQ ID:2111, to the nucleotide sequence of GAM72 RNA, herein designated GAM RNA, also designated SEQ ID:342.

Another function of GAM72 is therefore inhibition of Carboxypeptidase m (CPM, Accession NM_001874.1), a gene which specifically removes COOH-terminal basic amino acids (arginine or lysine). Accordingly, utilities of GAM72 include diagnosis, prevention and treatment of diseases and clinical conditions associated with CPM.

The function of CPM has been established by previous studies. Carboxypeptidases specifically remove COOH-terminal basic amino acids (arginine or lysine). They have important functions in many biologic processes, including activation, inactivation, or modulation of peptide hormone activity and alteration of physical properties of proteins and enzymes. Carboxypeptidase M is a membrane-bound arginine/lysine carboxypeptidase found in many tissues and cultured cells. Rehli et al. (1995) found that its expression associated with monocyte to macrophage differentiation. Tan et al. (1989) described the molecular cloning and sequencing of the cDNA for human carboxypeptidase M from a human placental cDNA library. The 2-kb cDNA contained an open reading frame of 1,317 basepairs, encoding a 439-amino acid protein. Sequence analysis revealed hydrophobic regions at the NH(2) and carboxy termini. There are 6 potential asparagine-linked glycosylation sites. Observed sequence homologies with other carboxypeptidases were as follows: human plasma carboxypeptidase N (OMIM Ref. No. 212070), 41%; bovine carboxypeptidase H (OMIM Ref. No. 114855), 41%; and bovine pancreatic carboxypeptidases A and B, 15%. The active site residues of carboxypeptidases A and B are conserved in carboxypeptidase M Full details of the abovementioned studies are described in the following publications, the disclosure of which are hereby incorporated by reference:

Rehli, M.; Krause, S. W.; Kreutz, M.; Andreesen, R.: Carboxypeptidase M is identical to the MAX.1 antigen and its expression is associated with monocyte to macrophage differentiation. J. Biol. Chem. 270:15644-15649, 1995; and Tan, F.; Chan, S. J.; Steiner, D. F.; Schilling, J. W.; Skidgel, R. A.: Molecular cloning and sequencing of the cDNA for human membrane-bound carboxypeptidase M: comparison with carboxy.

Further studies establishing the function and utilities of CPM are found in John Hopkins OMIM database record ID 114860, and in cited publications listed in Table 5, which are hereby incorporated by reference. CPR2 (Accession NM_030900.1) is another GAM72 target gene, herein designated TARGET GENE. CPR2 BINDING SITE is a target binding site found in the 3' untranslated region of multiple transcripts of mRNA encoded by CPR2, corresponding to a target binding site such as BINDING SITE I, BINDING SITE II or BINDING SITE III of FIG. 8. Table 4 illustrates the complementarity of the nucleotide sequences of CPR2 BINDING SITE, designated SEQ ID:14297, to the nucleotide sequence of GAM72 RNA, herein designated GAM RNA, also designated SEQ ID:342.

Another function of GAM72 is therefore inhibition of CPR2 (Accession NM_030900.1). Accordingly, utilities of GAM72 include diagnosis, prevention and treatment of diseases and clinical conditions associated with CPR2.

Carnitine o-octanoyltransferase (CROT, Accession NM_021151.1) is another GAM72 target gene, herein designated TARGET GENE. CROT BINDING SITE is a target binding site found in the 3' untranslated region of mRNA encoded by CROT, corresponding to a target binding site such as BINDING SITE I, BINDING SITE II or BINDING SITE III of FIG. 8. Table 4 illustrates the complementarity of the nucleotide sequences of CROT BINDING SITE, designated SEQ ID:14662, to the nucleotide sequence of GAM72 RNA, herein designated GAM RNA, also designated SEQ ID:342.

Another function of GAM72 is therefore inhibition of Carnitine o-octanoyltransferase (CROT, Accession NM_021151.1), a gene which CROT plays a crucial role in the beta-oxidation of branched-chain fatty acids including pristanic acid. Accordingly, utilities of GAM72 include diagnosis, prevention and treatment of diseases and clinical conditions associated with CROT.

The function of CROT has been established by previous studies. Carnitine octanoyltransferase (EC 2.3.1.137) is a carnitine acyltransferase that catalyzes the reversible transfer of fatty acyl groups between CoA and carnitine. This provides a crucial step in the transport of medium- and long-chain acyl-CoA out of the mammalian peroxisome to the cytosol and mitochondria. See also CRAT (OMIM Ref. No. 600184). Van der Leij et al. (2000) reviewed the function, structural features, and phylogenetics of human carnitine acyltransferase genes, including CROT Using enzyme activity measurements of CROT expressed in a carnitine acetyltransferase-deficient yeast strain, Ferdinandusse et al. (1999) demonstrated that CROT efficiently converts a branched-chain fatty acyl-CoA (4,8-dimethylnonanoyl-CoA) to its corresponding carnitine ester. They hypothesized that CROT plays a crucial role in the beta-oxidation of branched-chain fatty acids including pristanic acid Full details of the abovementioned studies are described in the following publications, the disclosure of which are hereby incorporated by reference:

Ferdinandusse, S.; Mulders, J.; IJlst, L.; Denis, S.; Dacremont, G.; Waterham, H. R.; Wanders, R. J. A.: Molecular cloning and expression of human carnitine octanoyltransferase: evidence for its role in the peroxisomal beta-oxidation of branched-chain fatty acids. Biochem. Biophys. Res. Commun. 263:213-218, 1999; and van der Leij, F. R.; Huijkman, N. C. A.; Boomsma, C.; Kuipers, J. R. G.; Bartelds, B.: Genomics of the human carnitine acyltransferase genes. Molec. Genet. Metab. 71:139-153, 2000.

Further studies establishing the function and utilities of CROT are found in John Hopkins OMIM database record ID 606090, and in cited publications listed in Table 5, which are hereby incorporated by reference. CSL4 (Accession NM_016046.2) is another GAM72 target gene, herein designated TARGET GENE. CSL4 BINDING SITE is a target binding site found in the 3' untranslated region of mRNA encoded by CSL4, corresponding to a target binding site such as BINDING SITE I, BINDING SITE II or BINDING SITE III of FIG. 8. Table 4 illustrates the complementarity of the nucleotide sequences of CSL4 BINDING SITE, designated SEQ ID:16124, to the nucleotide sequence of GAM72 RNA, herein designated GAM RNA, also designated SEQ ID:342.

Another function of GAM72 is therefore inhibition of CSL4 (Accession NM_016046.2). Accordingly, utilities of GAM72 include diagnosis, prevention and treatment of diseases and clinical conditions associated with CSL4.

Cathepsin s (CTSS, Accession NM_004079.3) is another GAM72 target gene, herein designated TARGET GENE. CTSS BINDING SITE is a target binding site found in the 3' untranslated region of mRNA encoded by CTSS, corresponding to a target binding site such as BINDING SITE I, BINDING SITE II or BINDING SITE III of FIG. 8. Table 4 illustrates the complementarity of the nucleotide sequences of CTSS BINDING SITE, designated SEQ ID:2354, to the nucleotide sequence of GAM72 RNA, herein designated GAM RNA, also designated SEQ ID:342.

Another function of GAM72 is therefore inhibition of Cathepsin s (CTSS, Accession NM_004079.3), a gene which is a lysosomal cysteine (thiol) protease that cleaves elastin. Accordingly, utilities of GAM72 include diagnosis, prevention and treatment of diseases and clinical conditions associated with CTSS.

The function of CTSS has been established by previous studies. Alveolar macrophages express an elastase activity of acidic pH optimum inhibitable by cysteine protease inhibitors. It had been shown that the only previously known eukaryotic elastinolytic cysteine protease, cathepsin L (OMIM Ref. No. 116880), could not completely account for this activity. In a search for additional cysteine proteases with elastinolytic activity, Shi et al. (1992) used low-degeneracy oligonucleotide primers based on regions of strong amino acid homology among the known cysteine proteases to screen reverse-transcribed human alveolar macrophage RNA for cysteine proteases by PCR. The screening turned up a cDNA sequence highly homologous to bovine cathepsin S. The recombinant enzyme was found to be elastinolytic. The relatively broad pH range of human cathepsin S activity suggested that it plays a significant role in the contact-dependent elastase activity of alveolar macrophages Northern blot analysis by Shi et al. (1994) showed that cathepsin S shows a restricted tissue distribution, with highest levels in spleen, heart, and lung. Immunostaining of lung tissue demonstrated detectable cathepsin S only in lung macrophages. The high level of expression in the spleen and in phagocytes suggested to Shi et al. (1994) that cathepsin S may have a specific function in immunity, perhaps related to antigen processing.

Animal model experiments lend further support to the function of CTSS. Cathepsins S and L play prominent roles in the degradation of the invariant chain (Ii, or CD74; 142790). In I-A(b) class II mice lacking the Ctss gene, failure to degrade Ii resulted in the accumulation of a class II-associated, 10-kD Ii fragment within endosomes, disrupting class II trafficking, peptide complex formation, and class II-restricted antigen presentation (Driessen et al., 1999). Riese et al. (2001) showed that I-A(b) class II haplotype mice lacking the Ctss gene had impaired NK1.1-positive T-cell selection and function. There were no overt defects in Cd4 (OMIM Ref. No. 186940)-positive and Cd8 (see OMIM Ref. No. 186910)-positive T-cell populations. In Ctss -/- mice, thymic dendritic cells had defective presentation of the Cd1d (OMIM Ref. No. 188410)-restricted antigen, the marine sponge glycosphingolipid alpha-galactosylceramide. Cd1d colocalized with Ii fragments and accumulated within endocytic dendritic cell compartments, impairing Cd1d trafficking. This dysfunction did not occur, however, in Ctss -/- mice of the I-A(k) class II haplotype. Riese et al. (2001) concluded that Cd1d function is critically linked to the processing of Ii, revealing that MHC class II haplotype and Ctss activity are regulators of NK T cells.

It is appreciated that the abovementioned animal model for CTSS is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shi, G.-P.; Webb, A. C.; Foster, K. E.; Knoll, J. H. M.; Lemere, C. A.; Munger, J. S.; Chapman, H. A.: Human cathepsin S: chromosomal localization, gene structure, and tissue distribution. J. Biol. Chem. 269:11530-11536, 1994. ; and Riese, R. J.; Shi, G.-P.; Villadangos, J.; Stetson, D.; Driessen, C.; Lennon-Dumenil, A.-M.; Chu, C.-L.; Naumov, Y.; Behar, S. M.; Ploegh, H.; Locksley, R.; Chapman, H. A.: Regulation o.

Further studies establishing the function and utilities of CTSS are found in John Hopkins OMIM database record ID 116845, and in cited publications listed in Table 5, which are hereby incorporated by reference. Chromosome y open reading frame 14 (CYorf14, Accession NM_018542.1) is another GAM72 target gene, herein designated TARGET GENE. CYorf14 BINDING SITE is a target binding site found in the 3' untranslated region of mRNA encoded by CYorf14, corresponding to a target binding site such as BINDING SITE I, BINDING SITE II or BINDING SITE III of FIG. 8. Table 4 illustrates the complementarity of the nucleotide sequences of CYorf14 BINDING SITE, designated SEQ ID:4714, to the nucleotide sequence of GAM72 RNA, herein designated GAM RNA, also designated SEQ ID:342.

Another function of GAM72 is therefore inhibition of Chromosome y open reading frame 14 (CYorf14, Accession NM_018542.1). Accordingly, utilities of GAM72 include diagnosis, prevention and treatment of diseases and clinical conditions associated with CYorf14.

Cytochrome p450, subfamily iiia (niphedipine oxidase), polypeptide 4 (CYP3A4, Accession NM_017460.3) is another GAM72 target gene, herein designated TARGET GENE. CYP3A4 BINDING SITE is a target binding site found in the 3' untranslated region of mRNA encoded by CYP3A4, corresponding to a target binding site such as BINDING SITE I, BINDING SITE II or BINDING SITE III of FIG. 8. Table 4 illustrates the complementarity of the nucleotide sequences of CYP3A4 BINDING SITE, designated SEQ ID:15095, to the nucleotide sequence of GAM72 RNA, herein designated GAM RNA, also designated SEQ ID:342.

Another function of GAM72 is therefore inhibition of Cytochrome p450, subfamily iiia (niphedipine oxidase), polypeptide 4 (CYP3A4, Accession NM_017460.3), a gene which may be involved in an nadph- dependent electron transport pathway. Accordingly, utilities of GAM72 include diagnosis, prevention and treatment of diseases and clinical conditions associated with CYP3A4.

The function of CYP3A4 has been established by previous studies. Watkins et al. (1985) identified a glucocorticoid-inducible cytochrome P450 in human liver. Molowa et al. (1986) reported the complete cDNA sequence of this P450. Wrighton and Vandenbranden (1989) isolated a CYP3-type cytochrome P450 from human fetal liver. By somatic cell hybridization and in situ hybridization, Riddell et al. (1987) assigned to chromosome 7 the gene for a cytochrome P450 that encodes the enzyme nifedipine oxidase (CYP3). The assignment to chromosome 7 was corroborated by Gonzalez et al. (1988) by use of somatic cell hybrids. These authors also provided additional evidence supporting the identity of P450PCN1 and nifedipine oxidase. By multipoint linkage analysis using DNA markers known to be located on chromosome 7, Brooks et al. (1988) concluded that the most likely location of CYP3 is 7q21-q22.1. No recombination with a COL1A2 (OMIM Ref. No. 120160) marker was found. Spurr et al. (1989) assigned CYP3 to 7q22-qter by study of a panel of human-rodent somatic cell hybrids. Inoue et al. (1992) mapped CYP3A4 to 7q22.1 by fluorescence in situ hybridization. The induction of CYP3A enzymes is species-specific and believed to involve 1 or more cellular factors, or receptor-like xenosensors. Xie et al. (2000) identified PXR/SXR as one such factor. They showed that targeted disruption of the mouse Pxr gene abolished induction of CYP3A by prototypic inducers such as dexamethasone or pregnenolone-16-alpha-carbonitrile. In Pxr- null mice carrying a transgene for an activated form of human SXR, there was constitutive upregulation of CYP3A gene expression and enhanced protection against toxic xenobiotic compounds. Xie et al. (2000) demonstrated that species origin of the receptor, rather than the promoter structure of the CYP3A genes, dictates the species-specific pattern of CYP3A inducibility. Thus, they could generate 'humanized' transgenic mice that were responsive to human-specific inducers such as the antibiotic rifampicin. Xie et al. (2000) concluded that the SXR/PXR genes encode the primary species-specific xenosensors that mediate the adaptive hepatic response, and may represent the critical biochemical mechanism of human xenoprotection.

Full details of the abovementioned studies are described in the following publications, the disclosure of which are hereby incorporated by reference:

Inoue, K.; Inazawa, J.; Nakagawa, H.; Shimada, T.; Yamazaki, H.; Guengerich, F. P.; Abe, T.: Assignment of the human cytochrome P-450 nifedipine oxidase gene (CYP3A4) to chromosome 7 at band q22.1 by fluorescence in situ hybridization. Jpn. J. Hum. Genet. 37:133-138, 1992; and Xie, W.; Barwick, J. L.; Downes, M.; Blumberg, B.; Simon, C. M.; Nelson, M. C.; Neuschwander-Tetri, B. A.; Brunt, E. M.; Guzelian, P. S.; Evans, R. M.: Humanized xenobiotic response.

Further studies establishing the function and utilities of CYP3A4 are found in John Hopkins OMIM database record ID 124010, and in cited publications listed in Table 5, which are hereby incorporated by reference. Dual adaptor of phosphotyrosine and 3-phosphoinositides (DAPP1, Accession NM_014395.1) is another GAM72 target gene, herein designated TARGET GENE. DAPP1 BINDING SITE is a target binding site found in the 3' untranslated region of mRNA encoded by DAPP1, corresponding to a target binding site such as BINDING SITE I, BINDING SITE II or BINDING SITE III of FIG. 8. Table 4 illustrates the complementarity of the nucleotide sequences of DAPP1 BINDING SITE, designated SEQ ID:8299, to the nucleotide sequence of GAM72 RNA, herein designated GAM RNA, also designated SEQ ID:342.

Another function of GAM72 is therefore inhibition of Dual adaptor of phosphotyrosine and 3-phosphoinositides (DAPP1, Accession NM_014395.1), a gene which regulates the ras-cyclic amp pathway. Accordingly, utilities of GAM72 include diagnosis, prevention and treatment of diseases and clinical conditions associated with DAPP1.

The function of DAPP1 has been established by previous studies. By EST database searching for pleckstrin homology (PH) domain-containing proteins, followed by screening a universal cDNA library, Dowler et al. (1999) isolated a cDNA encoding DAPP1. Sequence analysis predicted that the 280-amino acid protein contains a potential myristoylation site (a glycine after the N-terminal methionine), an N-terminal SH2 domain, and a C-terminal PH domain with a PtdIns- interacting motif. The authors noted that APS (OMIM Ref. No. 605300) also has an SH2 domain and a PH domain but at opposite termini of the protein. PCR of cDNA libraries and Northern blot analysis revealed ubiquitous expression of 2.7-kb transcripts, with highest levels in placenta and lung. A protein-lipid overlay analysis indicated that the PH domain of DAPP1 interacts with physiologic enantiomers of PtdIns. Using suppression subtractive hybridization with follicular dendritic cell tester cDNA, Marshall et al. (2000) cloned BAM32 and a splice variant identical to DAPP1. In addition to the SH2 and PH domains noted by Dowler et al. (1999), Marshall et al. (2000) predicted the presence of a potential tyrosine phosphorylation site in BAM32. Northern blot analysis detected an abundant 2.9-kb transcript and a minor 4.4-kb transcript in all hemopoietic tissues, as well as in trachea and placenta. RT-PCR analysis revealed expression in all B-cell lines, but not in T-cell, epithelial cell, fibroblast, or myelocytic leukemia cell lines. Activation of B cells was found to increase BAM32 expression. Immunoblot analysis showed that stimulation also induces BAM32 association with PLCG2 (OMIM Ref. No. 600220) and tyrosine phosphorylation of a 36-kD protein. Confocal microscopy demonstrated a PI3K-dependent membrane localization of BAM32 after B-cell receptor (BCR) activation. Luciferase reporter analysis showed that expression of the PH domain of BAM32 inhibits BCR-induced activation of NFATC (see OMIM Ref. No. 600489).

Full details of the abovementioned studies are described in the following publications, the disclosure of which are hereby incorporated by reference:

Dowler, S.; Currie, R. A.; Downes, C. P.; Alessi, D. R.: DAPP1: a dual adaptor for phosphotyrosine and 3-phosphoinositides. Biochem. J. 342:7-12, 1999; and Marshall, A. J.; Niiro, H.; Lerner, C. G.; Yun, T. J.; Thomas, S.; Disteche, C. M.; Clark, E. A.: A novel B lymphocyte-associated adaptor protein, Bam32, regulates antigen receptor si.

Further studies establishing the function and utilities of DAPP1 are found in John Hopkins OMIM database record ID 605768, and in cited publications listed in Table 5, which are hereby incorporated by reference. Dna cross-link repair 1c (pso2 homolog, s. cerevisiae) (DCLRE1C, Accession NM_022487.1) is another GAM72 target gene, herein designated TARGET GENE. DCLRE1C BINDING SITE is a target binding site found in the 3' untranslated region of mRNA encoded by DCLRE1C, corresponding to a target binding site such as BINDING SITE I, BINDING SITE II or BINDING SITE III of FIG. 8. Table 4 illustrates the complementarity of the nucleotide sequences of DCLRE1C BINDING SITE, designated SEQ ID:10284, to the nucleotide sequence of GAM72 RNA, herein designated GAM RNA, also designated SEQ ID:342.

Another function of GAM72 is therefore inhibition of Dna cross-link repair 1c (pso2 homolog, s. cerevisiae) (DCLRE1C, Accession NM_022487.1), a gene which intervenes in V(D)J recombination/DNA repair. and therefore may be associated with Severe combined immunodeficiency with sensitivity to ionizing radiation . Accordingly, utilities of GAM72 include diagnosis, prevention and treatment of Severe combined immunodeficiency with sensitivity to ionizing radiation ., and of other diseases and clinical conditions associated with DCLRE1C.

The function of DCLRE1C has been established by previous studies. The V(D)J recombination process insures the somatic diversification of immunoglobulin-encoding and antigen T-cell receptor-encoding genes. This reaction is initiated by a DNA double- strand break, which is resolved by the ubiquitously expressed DNA repair machinery. Human T-B severe combined immunodeficiency associated with increased cellular radiosensitivity (RS-SCID; 602450) is characterized by a defect in V(D)J recombination leading to an early arrest of both B- and T-cell maturation. The RS-SCID locus maps to the short arm of chromosome 10. By analyzing chromosome 10 BAC contigs, searching sequence databases, and RT-PCR, Moshous et al. (2001) isolated a cDNA encoding Artemis, a protein involved in V(D)J recombination/DNA repair. The predicted 685-amino acid Artemis protein has a molecular mass of 77.6 kD and is 78% identical to the murine protein. Protein sequence analysis suggested that Artemis belongs to the metallo-beta-lactamase superfamily. Northern blot and RT-PCR analyses detected ubiquitous expression of Artemis. Ma et al. (2002) reported that Artemis forms a complex with the 469-kD DNA-dependent protein kinase (PRKDS; 600899) in the absence of DNA. The purified Artemis protein alone possesses single- strand-specific 5-prime-to -3-prime exonuclease activity. Upon complex formation, PRKDS phosphorylates Artemis, and Artemis acquires endonucleolytic activity on 5-prime and 3-prime overhangs, as well as hairpins. The Artemis-PRKDS complex can open hairpins generated by the RAG (see OMIM Ref. No. 179615) complex. Thus, PRKDC regulates Artemis by both phosphorylation and complex formation to permit enzymatic activities that are critical for the hairpin-opening step of V(D)J recombination and for the 5-prime and 3-prime overhang processing in nonhomologous DNA end joining.

Full details of the abovementioned studies are described in the following publications, the disclosure of which are hereby incorporated by reference:

Ma, Y.; Pannicke, U.; Schwarz, K.; Lieber, M. R.: Hairpin opening and overhang processing by an Artemis/DNA-dependent protein kinase complex in nonhomologous end joining and V(D)J recombination. Cell 108:781-794, 2002; and Moshous, D.; Callebaut, I.; de Chasseval, R.; Corneo, B.; Cavazzana-Calvo, M.; Le Deist, F.; Tezcan, I.; Sanal, O.; Bertrand, Y.; Philippe, N.; Fischer, A.; de Villartay, J.-P.: Artem.

Further studies establishing the function and utilities of DCLRE1C are found in John Hopkins OMIM database record ID 605988, and in cited publications listed in Table 5, which are hereby incorporated by reference. DCOHM (Accession NM_032151.2) is another GAM72 target gene, herein designated TARGET GENE. DCOHM BINDING SITE is a target binding site found in the 3' untranslated region of mRNA encoded by DCOHM, corresponding to a target binding site such as BINDING SITE I, BINDING SITE II or BINDING SITE III of FIG. 8. Table 4 illustrates the complementarity of the nucleotide sequences of DCOHM BINDING SITE, designated SEQ ID:7474, to the nucleotide sequence of GAM72 RNA, herein designated GAM RNA, also designated SEQ ID:342.

Another function of GAM72 is therefore inhibition of DCOHM (Accession NM_032151.2). Accordingly, utilities of GAM72 include diagnosis, prevention and treatment of diseases and clinical conditions associated with DCOHM.

Dihydrofolate reductase (DHFR, Accession NM_000791.2) is another GAM72 target gene, herein designated TARGET GENE. DHFR BINDING SITE is a target binding site found in the 3' untranslated region of mRNA encoded by DHFR, corresponding to a target binding site such as BINDING SITE I, BINDING SITE II or BINDING SITE III of FIG. 8. Table 4 illustrates the complementarity of the nucleotide sequences of DHFR BINDING SITE, designated SEQ ID:3036, to the nucleotide sequence of GAM72 RNA, herein designated GAM RNA, also designated SEQ ID:342.

Another function of GAM72 is therefore inhibition of Dihydrofolate reductase (DHFR, Accession NM_000791.2), a gene which converts dihydrofolate into tetrahydrofolate. Accordingly, utilities of GAM72 include diagnosis, prevention and treatment of diseases and clinical conditions associated with DHFR.

The function of DHFR and its association with various diseases and clinical conditions, has been established by previous studies, as described hereinabove with reference to GAM64.1. DIS3 (Accession NM_014953.2) is another GAM72 target gene, herein designated TARGET GENE. DIS3 BINDING SITE is a target binding site found in the 3' untranslated region of mRNA encoded by DIS3, corresponding to a target binding site such as BINDING SITE I, BINDING SITE II or BINDING SITE III of FIG. 8. Table 4 illustrates the complementarity of the nucleotide sequences of DIS3 BINDING SITE, designated SEQ ID:17479, to the nucleotide sequence of GAM72 RNA, herein designated GAM RNA, also designated SEQ ID:342.

Another function of GAM72 is therefore inhibition of DIS3 (Accession NM_014953.2). Accordingly, utilities of GAM72 include diagnosis, prevention and treatment of diseases and clinical conditions associated with DIS3.

DJ122O8.2 (Accession NM_020466.3) is another GAM72 target gene, herein designated TARGET GENE. DJ122O8.2 BINDING SITE is a target binding site found in the 3' untranslated region of mRNA encoded by DJ122O8.2, corresponding to a target binding site such as BINDING SITE I, BINDING SITE II or BINDING SITE III of FIG. 8. Table 4 illustrates the complementarity of the nucleotide sequences of DJ122O8.2 BINDING SITE, designated SEQ ID:4695, to the nucleotide sequence of GAM72 RNA, herein designated GAM RNA, also designated SEQ ID:342.

Another function of GAM72 is therefore inhibition of DJ122O8.2 (Accession NM_020466.3). Accordingly, utilities of GAM72 include diagnosis, prevention and treatment of diseases and clinical conditions associated with DJ122O8.2.

DKFZp434E0519 (Accession) is another GAM72 target gene, herein designated TARGET GENE. DKFZp434E0519 BINDING SITE1 and DKFZp434E0519 BINDING SITE2 are target binding sites found in untranslated regions of mRNA encoded by DKFZp434E0519, corresponding to target binding sites such as BINDING SITE I, BINDING SITE II or BINDING SITE III of FIG. 8. Table 4 illustrates the complementarity of the nucleotide sequences of DKFZp434E0519 BINDING SITE1 and DKFZp434E0519 BINDING SITE2, designated SEQ ID:18481 and SEQ ID:9845 respectively, to the nucleotide sequence of GAM72 RNA, herein designated GAM RNA, also designated SEQ ID:342.

Another function of GAM72 is therefore inhibition of DKFZp434E0519 (Accession). Accordingly, utilities of GAM72 include diagnosis, prevention and treatment of diseases and clinical conditions associated with DKFZp434E0519.

DKFZP434F1735 (Accession NM_015590.1) is another GAM72 target gene, herein designated TARGET GENE. DKFZP434F1735 BINDING SITE is a target binding site found in the 3' untranslated region of mRNA encoded by DKFZP434F1735, corresponding to a target binding site such as BINDING SITE I, BINDING SITE II or BINDING SITE III of FIG. 8. Table 4 illustrates the complementarity of the nucleotide sequences of DKFZP434F1735 BINDING SITE, designated SEQ ID:1252, to the nucleotide sequence of GAM72 RNA, herein designated GAM RNA, also designated SEQ ID:342.

Another function of GAM72 is therefore inhibition of DKFZP434F1735 (Accession NM_015590.1). Accordingly, utilities of GAM72 include diagnosis, prevention and treatment of diseases and clinical conditions associated with DKFZP434F1735.

DKFZP434I1735 (Accession XM_113763.3) is another GAM72 target gene, herein designated TARGET GENE. DKFZP434I1735 BINDING SITE is a target binding site found in the 3' untranslated region of mRNA encoded by DKFZP434I1735, corresponding to a target binding site such as BINDING SITE I, BINDING SITE II or BINDING SITE III of FIG. 8. Table 4 illustrates the complementarity of the nucleotide sequences of DKFZP434I1735 BINDING SITE, designated SEQ ID:16090, to the nucleotide sequence of GAM72 RNA, herein designated GAM RNA, also designated SEQ ID:342.

Another function of GAM72 is therefore inhibition of DKFZP434I1735 (Accession XM_113763.3). Accordingly, utilities of GAM72 include diagnosis, prevention and treatment of diseases and clinical conditions associated with DKFZP434I1735.

DKFZP434N161 (Accession) is another GAM72 target gene, herein designated TARGET GENE. DKFZP434N161 BINDING SITE is a target binding site found in the 5' untranslated region of mRNA encoded by DKFZP434N161, corresponding to a target binding site such as BINDING SITE I, BINDING SITE II or BINDING SITE III of FIG. 8. Table 4 illustrates the complementarity of the nucleotide sequences of DKFZP434N161 BINDING SITE, designated SEQ ID:8281, to the nucleotide sequence of GAM72 RNA, herein designated GAM RNA, also designated SEQ ID:342.

Another function of GAM72 is therefore inhibition of DKFZP434N161 (Accession). Accordingly, utilities of GAM72 include diagnosis, prevention and treatment of diseases and clinical conditions associated with DKFZP434N161.

DKFZp547A023 (Accession NM_018704.1) is another GAM72 target gene, herein designated TARGET GENE. DKFZp547A023 BINDING SITE is a target binding site found in the 3' untranslated region of mRNA encoded by DKFZp547A023, corresponding to a target binding site such as BINDING SITE I, BINDING SITE II or BINDING SITE III of FIG. 8. Table 4 illustrates the complementarity of the nucleotide sequences of DKFZp547A023 BINDING SITE, designated SEQ ID:6974, to the nucleotide sequence of GAM72 RNA, herein designated GAM RNA, also designated SEQ ID:342.

Another function of GAM72 is therefore inhibition of DKFZp547A023 (Accession NM_018704.1). Accordingly, utilities of GAM72 include diagnosis, prevention and treatment of diseases and clinical conditions associated with DKFZp547A023.

DKFZp547G183 (Accession NM_018705.1) is another GAM72 target gene, herein designated TARGET GENE. DKFZp547G183 BINDING SITE is a target binding site found in the 3' untranslated region of mRNA encoded by DKFZp547G183, corresponding to a target binding site such as BINDING SITE I, BINDING SITE II or BINDING SITE III of FIG. 8. Table 4 illustrates the complementarity of the nucleotide sequences of DKFZp547G183 BINDING SITE, designated SEQ ID:12489, to the nucleotide sequence of GAM72 RNA, herein designated GAM RNA, also designated SEQ ID:342.

Another function of GAM72 is therefore inhibition of DKFZp547G183 (Accession NM_018705.1). Accordingly, utilities of GAM72 include diagnosis, prevention and treatment of diseases and clinical conditions associated with DKFZp547G183.

DKFZP564A022 (Accession NM_030954.2) is another GAM72 target gene, herein designated TARGET GENE. DKFZP564A022 BINDING SITE is a target binding site found in the 3' untranslated region of mRNA encoded by DKFZP564A022, corresponding to a target binding site such as BINDING SITE I, BINDING SITE II or BINDING SITE III of FIG. 8. Table 4 illustrates the complementarity of the nucleotide sequences of DKFZP564A022 BINDING SITE, designated SEQ ID:8696, to the nucleotide sequence of GAM72 RNA, herein designated GAM RNA, also designated SEQ ID:342.

Another function of GAM72 is therefore inhibition of DKFZP564A022 (Accession NM_030954.2). Accordingly, utilities of GAM72 include diagnosis, prevention and treatment of diseases and clinical conditions associated with DKFZP564A022.

DKFZp564K142 (Accession NM_032121.1) is another GAM72 target gene, herein designated TARGET GENE. DKFZp564K142 BINDING SITE is a target binding site found in the 3' untranslated region of mRNA encoded by DKFZp564K142, corresponding to a target binding site such as BINDING SITE I, BINDING SITE II or BINDING SITE III of FIG. 8. Table 4 illustrates the complementarity of the nucleotide sequences of DKFZp564K142 BINDING SITE, designated SEQ ID:8472, to the nucleotide sequence of GAM72 RNA, herein designated GAM RNA, also designated SEQ ID:342.

Another function of GAM72 is therefore inhibition of DKFZp564K142 (Accession NM_032121.1). Accordingly, utilities of GAM72 include diagnosis, prevention and treatment of diseases and clinical conditions associated with DKFZp564K142.

DKFZP566J2046 (Accession NM_031208.1) is another GAM72 target gene, herein designated TARGET GENE. DKFZP566J2046 BINDING SITE is a target binding site found in the 3' untranslated region of mRNA encoded by DKFZP566J2046, corresponding to a target binding site such as BINDING SITE I, BINDING SITE II or BINDING SITE III of FIG. 8. Table 4 illustrates the complementarity of the nucleotide sequences of DKFZP566J2046 BINDING SITE, designated SEQ ID:2862, to the nucleotide sequence of GAM72 RNA, herein designated GAM RNA, also designated SEQ ID:342.

Another function of GAM72 is therefore inhibition of DKFZP566J2046 (Accession NM_031208.1). Accordingly, utilities of GAM72 include diagnosis, prevention and treatment of diseases and clinical conditions associated with DKFZP566J2046.

DKFZP586D2223 (Accession) is another GAM72 target gene, herein designated TARGET GENE. DKFZP586D2223 BINDING SITE1 and DKFZP586D2223 BINDING SITE2 are target binding sites found in untranslated regions of mRNA encoded by DKFZP586D2223, corresponding to target binding sites such as BINDING SITE I, BINDING SITE II or BINDING SITE III of FIG. 8. Table 4 illustrates the complementarity of the nucleotide sequences of DKFZP586D2223 BINDING SITE1 and DKFZP586D2223 BINDING SITE2, designated SEQ ID:19726 and SEQ ID:5423 respectively, to the nucleotide sequence of GAM72 RNA, herein designated GAM RNA, also designated SEQ ID:342.

Another function of GAM72 is therefore inhibition of DKFZP586D2223 (Accession). Accordingly, utilities of GAM72 include diagnosis, prevention and treatment of diseases and clinical conditions associated with DKFZP586D2223.

DKFZP667O116 (Accession) is another GAM72 target gene, herein designated TARGET GENE. DKFZP667O116 BINDING SITE is a target binding site found in the 3' untranslated region of mRNA encoded by DKFZP667O116, corresponding to a target binding site such as BINDING SITE I, BINDING SITE II or BINDING SITE III of FIG. 8. Table 4 illustrates the complementarity of the nucleotide sequences of DKFZP667O116 BINDING SITE, designated SEQ ID:1610, to the nucleotide sequence of GAM72 RNA, herein designated GAM RNA, also designated SEQ ID:342.

Another function of GAM72 is therefore inhibition of DKFZP667O116 (Accession). Accordingly, utilities of GAM72 include diagnosis, prevention and treatment of diseases and clinical conditions associated with DKFZP667O116.

DKFZP761G1913 (Accession NM_031474.1) is another GAM72 target gene, herein designated TARGET GENE. DKFZP761G1913 BINDING SITE is a target binding site found in the 5' untranslated region of mRNA encoded by DKFZP761G1913, corresponding to a target binding site such as BINDING SITE I, BINDING SITE II or BINDING SITE III of FIG. 8. Table 4 illustrates the complementarity of the nucleotide sequences of DKFZP761G1913 BINDING SITE, designated SEQ ID:1611, to the nucleotide sequence of GAM72 RNA, herein designated GAM RNA, also designated SEQ ID:342.

Another function of GAM72 is therefore inhibition of DKFZP761G1913 (Accession NM_031474.1). Accordingly, utilities of GAM72 include diagnosis, prevention and treatment of diseases and clinical conditions associated with DKFZP761G1913.

Deoxyribonuclease ii, lysosomal (DNASE2, Accession NM_001375.1) is another GAM72 target gene, herein designated TARGET GENE. DNASE2 BINDING SITE1 and DNASE2 BINDING SITE2 are target binding sites found in untranslated regions of mRNA encoded by DNASE2, corresponding to target binding sites such as BINDING SITE I, BINDING SITE II or BINDING SITE III of FIG. 8. Table 4 illustrates the complementarity of the nucleotide sequences of DNASE2 BINDING SITE1 and DNASE2 BINDING SITE2, designated SEQ ID:14261 and SEQ ID:1193 respectively, to the nucleotide sequence of GAM72 RNA, herein designated GAM RNA, also designated SEQ ID:342.

Another function of GAM72 is therefore inhibition of Deoxyribonuclease ii, lysosomal (DNASE2, Accession NM_001375.1), a gene which has a possible role in apoptosis. Accordingly, utilities of GAM72 include diagnosis, prevention and treatment of diseases and clinical conditions associated with DNASE2.

The function of DNASE2 has been established by previous studies. Yasuda et al. (1992) described a specific and highly sensitive assay for urinary and leukocytic DNASE2. In both urine and leukocytes, the enzyme showed clear-cut bimodality, and the Japanese study population could be classified into 2 distinct types, namely low-activity (DNASE2 L) and high-activity (DNASE2 H), which indicated the existence of a genetic polymorphism. Close correlations between the leukocytic and urinary enzyme activity levels from the same individuals were observed, and the types in the leukocyte samples agreed with the types found in the corresponding urine samples. In a group of 528 unrelated Japanese individuals, the gene frequencies of the low-activity allele (DNASE2*L) and the high-activity allele (DNASE2*H) were calculated to be 0.632 and 0.368, respectively. Sex and age did not affect the distribution of the DNASE2 activity levels. Family studies indicated that the low-activity type is autosomal recessive. Using RACE with primers based on the sequence of purified DNase II protein to amplify thyroid RNA, Yasuda et al. (1998) cloned the DNase II gene. The predicted 360-amino acid protein has 3 parts: a 16-amino acid signal peptide, a 91-amino acid propeptide, and a 253-amino acid mature protein region. Yasuda et al. (1998) suggested that, like other lysosomal enzymes, DNase II is processed by release of a signal peptide followed by proteolytic processing that generates a 2-chain enzyme. Purified DNase II migrates as 2 bands (32 and 12 kD) on SDS-PAGE. Using RT-PCR, Yasuda et al. (1998) found that DNase II is expressed ubiquitously.

Animal model experiments lend further support to the function of DNASE2. Mature erythrocytes in mammals have no nuclei, although they differentiate from nucleated precursor cells. Kawane et al. (2001) demonstrated that DNase II is indispensable for definitive erythropoiesis in mouse fetal liver. No live DNase II-null mice were born, owing to severe anemia. When mutant fetal liver cells were transferred into lethally irradiated wildtype mice, mature red blood cells were generated from the mutant cells, suggesting that DNase II functions in a non-cell-autonomous manner. Histochemical analyses indicated that the critical cellular sources of DNase II are macrophages present at the site of definitive erythropoiesis in the fetal liver. Thus, Kawane et al. (2001) concluded that DNase II in macrophages appears to be responsible for destroying the nuclear DNA expelled from erythroid precursor cells.

It is appreciated that the abovementioned animal model for DNASE2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Yasuda, T.; Nadano, D.; Sawazaki, K.; Kishi, K.: Genetic polymorphism of human deoxyribonuclease II (DNase II): low activity levels in urine and leukocytes are due to an autosomal recessive allele. Ann. Hum. Genet. 56:1-10, 1992; and Yasuda, T.; Takeshita, H.; Iida, R.; Nakajima, T.; Hosomi, O.; Nakashima, Y.; Kishi, K.: Molecular cloning of the cDNA encoding human deoxyribonuclease II. J. Biol. Chem. 273: 2610-261.

Further studies establishing the function and utilities of DNASE2 are found in John Hopkins OMIM database record ID 126350, and in cited publications listed in Table 5, which are hereby incorporated by reference. Eukaryotic translation initiation factor 2, subunit 1 alpha, 35 kda (EIF2S1, Accession NM_004094.2) is another GAM72 target gene, herein designated TARGET GENE. EIF2S1 BINDING SITE is a target binding site found in the 3' untranslated region of mRNA encoded by EIF2S1, corresponding to a target binding site such as BINDING SITE I, BINDING SITE II or BINDING SITE III of FIG. 8. Table 4 illustrates the complementarity of the nucleotide sequences of EIF2S1 BINDING SITE, designated SEQ ID:3165, to the nucleotide sequence of GAM72 RNA, herein designated GAM RNA, also designated SEQ ID:342.

Another function of GAM72 is therefore inhibition of Eukaryotic translation initiation factor 2, subunit 1 alpha, 35 kda (EIF2S1, Accession NM_004094.2). Accordingly, utilities of GAM72 include diagnosis, prevention and treatment of diseases and clinical conditions associated with EIF2S1.

ET (Accession NM_024311.1) is another GAM72 target gene, herein designated TARGET GENE. ET BINDING SITE is a target binding site found in the 3' untranslated region of mRNA encoded by ET, corresponding to a target binding site such as BINDING SITE I, BINDING SITE II or BINDING SITE III of FIG. 8. Table 4 illustrates the complementarity of the nucleotide sequences of ET BINDING SITE, designated SEQ ID:15878, to the nucleotide sequence of GAM72 RNA, herein designated GAM RNA, also designated SEQ ID:342.

Another function of GAM72 is therefore inhibition of ET (Accession NM_024311.1). Accordingly, utilities of GAM72 include diagnosis, prevention and treatment of diseases and clinical conditions associated with ET.

Coagulation factor ii (thrombin) receptor-like 3 (F2RL3, Accession NM_003950.1) is another GAM72 target gene, herein designated TARGET GENE. F2RL3 BINDING SITE1 and F2RL3 BINDING SITE2 are target binding sites found in untranslated regions of mRNA encoded by F2RL3, corresponding to target binding sites such as BINDING SITE I, BINDING SITE II or BINDING SITE III of FIG. 8. Table 4 illustrates the complementarity of the nucleotide sequences of F2RL3 BINDING SITE1 and F2RL3 BINDING SITE2, designated SEQ ID:16469 and SEQ ID:17466 respectively, to the nucleotide sequence of GAM72 RNA, herein designated GAM RNA, also designated SEQ ID:342.

Another function of GAM72 is therefore inhibition of Coagulation factor ii (thrombin) receptor-like 3 (F2RL3, Accession NM_003950.1), a gene which Protease-activated receptor 4; G protein-coupled receptor that increases phosphoinositide hydrolysis. Accordingly, utilities of GAM72 include diagnosis, prevention and treatment of diseases and clinical conditions associated with F2RL3.

The function of F2RL3 has been established by previous studies. Protease-activated receptors 1 (PAR1; 187930), 2 (PAR2; 600933), and 3 (PAR3; 601919) are members of a unique G protein-coupled receptor family. They are characterized by a tethered peptide ligand at the extracellular amino terminus that is generated by minor proteolysis. Xu et al. (1998) identified a partial cDNA sequence of a fourth member of this family, PAR4, in an expressed sequence tag (EST) database, and a full-length cDNA clone was isolated from a lymphoma Daudi cell cDNA library. The open reading frame coded for a 7-transmembrane domain protein of 385 amino acids with 33% amino acid sequence identity with PAR1-3. A putative protease cleavage site was identified within the extracellular amino terminus. Northern blot analysis showed that PAR4 mRNA is expressed in a number of human tissues, with high levels being present in lung, pancreas, thyroid, testis, and small intestine. By fluorescence in situ hybridization, Xu et al. (1998) mapped the PAR4 gene to 19p12.

Animal model experiments lend further support to the function of F2RL3. Sambrano et al. (2001) demonstrated that platelets from Par4-deficient mice failed to change shape, mobilize calcium, secrete ATP, or aggregate in response to thrombin.

It is appreciated that the abovementioned animal model for F2RL3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Xu, W.-F.; Andersen, H.; Whitmore, T. E.; Presnell, S. R.; Yee, D. P.; Ching, A.; Gilbert, T.; Davie, E. W.; Foster, D. C.: Cloning and characterization of human protease-activated receptor 4. Proc. Nat. Acad. Sci. 95:6642-6646, 1998; and Sambrano, G. R.; Weiss, E. J.; Zheng, Y.-W.; Huang, W.; Coughlin, S. R.: Role of thrombin signalling in platelets in haemostasis and thrombosis. Nature 413:74-78, 2001.

Further studies establishing the function and utilities of F2RL3 are found in John Hopkins OMIM database record ID 602779, and in cited publications listed in Table 5, which are hereby incorporated by reference. Fanconi anemia, complementation group d2 (FANCD2, Accession NM_033084.2) is another GAM72 target gene, herein designated TARGET GENE. FANCD2 BINDING SITE is a target binding site found in the 3' untranslated region of mRNA encoded by FANCD2, corresponding to a target binding site such as BINDING SITE I, BINDING SITE II or BINDING SITE III of FIG. 8. Table 4 illustrates the complementarity of the nucleotide sequences of FANCD2 BINDING SITE, designated SEQ ID:5050, to the nucleotide sequence of GAM72 RNA, herein designated GAM RNA, also designated SEQ ID:342.

Another function of GAM72 is therefore inhibition of Fanconi anemia, complementation group d2 (FANCD2, Accession NM_033084.2). Accordingly, utilities of GAM72 include diagnosis, prevention and treatment of diseases and clinical conditions associated with FANCD2.

F-box only protein 26 (FBXO26, Accession NM_024907.5) is another GAM72 target gene, herein designated TARGET GENE. FBXO26 BINDING SITE is a target binding site found in the 3' untranslated region of multiple transcripts of mRNA encoded by FBXO26, corresponding to a target binding site such as BINDING SITE I, BINDING SITE II or BINDING SITE III of FIG. 8. Table 4 illustrates the complementarity of the nucleotide sequences of FBXO26 BINDING SITE, designated SEQ ID:1376, to the nucleotide sequence of GAM72 RNA, herein designated GAM RNA, also designated SEQ ID:342.

Another function of GAM72 is therefore inhibition of F-box only protein 26 (FBXO26, Accession NM_024907.5). Accordingly, utilities of GAM72 include diagnosis, prevention and treatment of diseases and clinical conditions associated with FBXO26.

F-box only protein 27 (FBXO27, Accession XM_059045.1) is another GAM72 target gene, herein designated TARGET GENE. FBXO27 BINDING SITE is a target binding site found in the 3' untranslated region of multiple transcripts of mRNA encoded by FBXO27, corresponding to a target binding site such as BINDING SITE I, BINDING SITE II or BINDING SITE III of FIG. 8. Table 4 illustrates the complementarity of the nucleotide sequences of FBXO27 BINDING SITE, designated SEQ ID:4320, to the nucleotide sequence of GAM72 RNA, herein designated GAM RNA, also designated SEQ ID:342.

Another function of GAM72 is therefore inhibition of F-box only protein 27 (FBXO27, Accession XM_059045.1). Accordingly, utilities of GAM72 include diagnosis, prevention and treatment of diseases and clinical conditions associated with FBXO27.

F-box only protein 9 (FBXO9, Accession NM_033481.1) is another GAM72 target gene, herein designated TARGET GENE. FBXO9 BINDING SITE is a target binding site found in the 3' untranslated region of multiple transcripts of mRNA encoded by FBXO9, corresponding to a target binding site such as BINDING SITE I, BINDING SITE II or BINDING SITE III of FIG. 8. Table 4 illustrates the complementarity of the nucleotide sequences of FBXO9 BINDING SITE, designated SEQ ID:14249, to the nucleotide sequence of GAM72 RNA, herein designated GAM RNA, also designated SEQ ID:342.

Another function of GAM72 is therefore inhibition of F-box only protein 9 (FBXO9, Accession NM_033481.1). Accordingly, utilities of GAM72 include diagnosis, prevention and treatment of diseases and clinical conditions associated with FBXO9.

Fukuyama type congenital muscular dystrophy (fukutin) (FCMD, Accession NM_006731.1) is another GAM72 target gene, herein designated TARGET GENE. FCMD BINDING SITE is a target binding site found in the 3' untranslated region of mRNA encoded by FCMD, corresponding to a target binding site such as BINDING SITE I, BINDING SITE II or BINDING SITE III of FIG. 8. Table 4 illustrates the complementarity of the nucleotide sequences of FCMD BINDING SITE, designated SEQ ID:3598, to the nucleotide sequence of GAM72 RNA, herein designated GAM RNA, also designated SEQ ID:342.

Another function of GAM72 is therefore inhibition of Fukuyama type congenital muscular dystrophy (fukutin) (FCMD, Accession NM_006731.1). Accordingly, utilities of GAM72 include diagnosis, prevention and treatment of diseases and clinical conditions associated with FCMD.

Fibroblast growth factor 2 (basic) (FGF2, Accession NM_002006.2) is another GAM72 target gene, herein designated TARGET GENE. FGF2 BINDING SITE is a target binding site found in the 3' untranslated region of mRNA encoded by FGF2, corresponding to a target binding site such as BINDING SITE I, BINDING SITE II or BINDING SITE III of FIG. 8. Table 4 illustrates the complementarity of the nucleotide sequences of FGF2 BINDING SITE, designated SEQ ID:11990, to the nucleotide sequence of GAM72 RNA, herein designated GAM RNA, also designated SEQ ID:342.

Another function of GAM72 is therefore inhibition of Fibroblast growth factor 2 (basic) (FGF2, Accession NM_002006.2), a gene which the Basic fibroblast growth factor 2; is mitogenic, angiogenic, and neurotrophic factor. Accordingly, utilities of GAM72 include diagnosis, prevention and treatment of diseases and clinical conditions associated with FGF2.

The function of FGF2 and its association with various diseases and clinical conditions, has been established by previous studies, as described hereinabove with reference to GAM36.1. FKSG17 (Accession NM_032031.1) is another GAM72 target gene, herein designated TARGET GENE. FKSG17 BINDING SITE is a target binding site found in the 3' untranslated region of mRNA encoded by FKSG17, corresponding to a target binding site such as BINDING SITE I, BINDING SITE II or BINDING SITE III of FIG. 8. Table 4 illustrates the complementarity of the nucleotide sequences of FKSG17 BINDING SITE, designated SEQ ID:9662, to the nucleotide sequence of GAM72 RNA, herein designated GAM RNA, also designated SEQ ID:342.

Another function of GAM72 is therefore inhibition of FKSG17 (Accession NM_032031.1). Accordingly, utilities of GAM72 include diagnosis, prevention and treatment of diseases and clinical conditions associated with FKSG17.

FLJ00060 (Accession XM_028154.2) is another GAM72 target gene, herein designated TARGET GENE. FLJ00060 BINDING SITE is a target binding site found in the 3' untranslated region of mRNA encoded by FLJ00060, corresponding to a target binding site such as BINDING SITE I, BINDING SITE II or BINDING SITE III of FIG. 8. Table 4 illustrates the complementarity of the nucleotide sequences of FLJ00060 BINDING SITE, designated SEQ ID:11930, to the nucleotide sequence of GAM72 RNA, herein designated GAM RNA, also designated SEQ ID:342.

Another function of GAM72 is therefore inhibition of FLJ00060 (Accession XM_028154.2). Accordingly, utilities of GAM72 include diagnosis, prevention and treatment of diseases and clinical conditions associated with FLJ00060.

FLJ10139 (Accession NM_018005.1) is another GAM72 target gene, herein designated TARGET GENE. FLJ10139 BINDING SITE is a target binding site found in the 3' untranslated region of mRNA encoded by FLJ10139, corresponding to a target binding site such as BINDING SITE I, BINDING SITE II or BINDING SITE III of FIG. 8. Table 4 illustrates the complementarity of the nucleotide sequences of FLJ10139 BINDING SITE, designated SEQ ID:17526, to the nucleotide sequence of GAM72 RNA, herein designated GAM RNA, also designated SEQ ID:342.

Another function of GAM72 is therefore inhibition of FLJ10139 (Accession NM_018005.1). Accordingly, utilities of GAM72 include diagnosis, prevention and treatment of diseases and clinical conditions associated with FLJ10139.

FLJ10460 (Accession NM_018097.1) is another GAM72 target gene, herein designated TARGET GENE. FLJ10460 BINDING SITE is a target binding site found in the 3' untranslated region of mRNA encoded by FLJ10460, corresponding to a target binding site such as BINDING SITE I, BINDING SITE II or BINDING SITE III of FIG. 8. Table 4 illustrates the complementarity of the nucleotide sequences of FLJ10460 BINDING SITE, designated SEQ ID:2166, to the nucleotide sequence of GAM72 RNA, herein designated GAM RNA, also designated SEQ ID:342.

Another function of GAM72 is therefore inhibition of FLJ10460 (Accession NM_018097.1). Accordingly, utilities of GAM72 include diagnosis, prevention and treatment of diseases and clinical conditions associated with FLJ10460.

FLJ10803 (Accession NM_018224.1) is another GAM72 target gene, herein designated TARGET GENE. FLJ10803 BINDING SITE is a target binding site found in the 3' untranslated region of mRNA encoded by FLJ10803, corresponding to a target binding site such as BINDING SITE I, BINDING SITE II or BINDING SITE III of FIG. 8. Table 4 illustrates the complementarity of the nucleotide sequences of FLJ10803 BINDING SITE, designated SEQ ID:9700, to the nucleotide sequence of GAM72 RNA, herein designated GAM RNA, also designated SEQ ID:342.

Another function of GAM72 is therefore inhibition of FLJ10803 (Accession NM_018224.1). Accordingly, utilities of GAM72 include diagnosis, prevention and treatment of diseases and clinical conditions associated with FLJ10803.

FLJ10830 (Accession) is another GAM72 target gene, herein designated TARGET GENE. FLJ10830 BINDING SITE is a target binding site found in the 3' untranslated region of mRNA encoded by FLJ10830, corresponding to a target binding site such as BINDING SITE I, BINDING SITE II or BINDING SITE III of FIG. 8. Table 4 illustrates the complementarity of the nucleotide sequences of FLJ10830 BINDING SITE, designated SEQ ID:18345, to the nucleotide sequence of GAM72 RNA, herein designated GAM RNA, also designated SEQ ID:342.

Another function of GAM72 is therefore inhibition of FLJ10830 (Accession). Accordingly, utilities of GAM72 include diagnosis, prevention and treatment of diseases and clinical conditions associated with FLJ10830.

FLJ10891 (Accession NM_018260.1) is another GAM72 target gene, herein designated TARGET GENE. FLJ10891 BINDING SITE is a target binding site found in the 3' untranslated region of mRNA encoded by FLJ10891, corresponding to a target binding site such as BINDING SITE I, BINDING SITE II or BINDING SITE III of FIG. 8. Table 4 illustrates the complementarity of the nucleotide sequences of FLJ10891 BINDING SITE, designated SEQ ID:2260, to the nucleotide sequence of GAM72 RNA, herein designated GAM RNA, also designated SEQ ID:342.

Another function of GAM72 is therefore inhibition of FLJ10891 (Accession NM_018260.1). Accordingly, utilities of GAM72 include diagnosis, prevention and treatment of diseases and clinical conditions associated with FLJ10891.

FLJ11016 (Accession NM_018301.1) is another GAM72 target gene, herein designated TARGET GENE. FLJ11016 BINDING SITE is a target binding site found in the 3' untranslated region of mRNA encoded by FLJ11016, corresponding to a target binding site such as BINDING SITE I, BINDING SITE II or BINDING SITE III of FIG. 8. Table 4 illustrates the complementarity of the nucleotide sequences of FLJ11016 BINDING SITE, designated SEQ ID:6799, to the nucleotide sequence of GAM72 RNA, herein designated GAM RNA, also designated SEQ ID:342.

Another function of GAM72 is therefore inhibition of FLJ11016 (Accession NM_018301.1). Accordingly, utilities of GAM72 include diagnosis, prevention and treatment of diseases and clinical conditions associated with FLJ11016.

FLJ11259 (Accession NM_018370.1) is another GAM72 target gene, herein designated TARGET GENE. FLJ11259 BINDING SITE is a target binding site found in the 3' untranslated region of mRNA encoded by FLJ11259, corresponding to a target binding site such as BINDING SITE I, BINDING SITE II or BINDING SITE III of FIG. 8. Table 4 illustrates the complementarity of the nucleotide sequences of FLJ11259 BINDING SITE, designated SEQ ID:1365, to the nucleotide sequence of GAM72 RNA, herein designated GAM RNA, also designated SEQ ID:342.

Another function of GAM72 is therefore inhibition of FLJ11259 (Accession NM_018370.1). Accordingly, utilities of GAM72 include diagnosis, prevention and treatment of diseases and clinical conditions associated with FLJ11259.

FLJ11370 (Accession NM_024961.1) is another GAM72 target gene, herein designated TARGET GENE. FLJ11370 BINDING SITE is a target binding site found in the 3' untranslated region of mRNA encoded by FLJ11370, corresponding to a target binding site such as BINDING SITE I, BINDING SITE II or BINDING SITE III of FIG. 8. Table 4 illustrates the complementarity of the nucleotide sequences of FLJ11370 BINDING SITE, designated SEQ ID:20041, to the nucleotide sequence of GAM72 RNA, herein designated GAM RNA, also designated SEQ ID:342.

Another function of GAM72 is therefore inhibition of FLJ11370 (Accession NM_024961.1). Accordingly, utilities of GAM72 include diagnosis, prevention and treatment of diseases and clinical conditions associated with FLJ11370.

FLJ11467 (Accession NM_024963.2) is another GAM72 target gene, herein designated TARGET GENE. FLJ11467 BINDING SITE is a target binding site found in the 3' untranslated region of mRNA encoded by FLJ11467, corresponding to a target binding site such as BINDING SITE I, BINDING SITE II or BINDING SITE III of FIG. 8. Table 4 illustrates the complementarity of the nucleotide sequences of FLJ11467 BINDING SITE, designated SEQ ID:7995, to the nucleotide sequence of GAM72 RNA, herein designated GAM RNA, also designated SEQ ID:342.

Another function of GAM72 is therefore inhibition of FLJ11467 (Accession NM_024963.2). Accordingly, utilities of GAM72 include diagnosis, prevention and treatment of diseases and clinical conditions associated with FLJ11467.

FLJ11577 (Accession NM_025159.1) is another GAM72 target gene, herein designated TARGET GENE. FLJ11577 BINDING SITE is a target binding site found in the 3' untranslated region of mRNA encoded by FLJ11577, corresponding to a target binding site such as BINDING SITE I, BINDING SITE II or BINDING SITE III of FIG. 8. Table 4 illustrates the complementarity of the nucleotide sequences of FLJ11577 BINDING SITE, designated SEQ ID:13792, to the nucleotide sequence of GAM72 RNA, herein designated GAM RNA, also designated SEQ ID:342.

Another function of GAM72 is therefore inhibition of FLJ11577 (Accession NM_025159.1). Accordingly, utilities of GAM72 include diagnosis, prevention and treatment of diseases and clinical conditions associated with FLJ11577.

FLJ11715 (Accession NM_024564.1) is another GAM72 target gene, herein designated TARGET GENE. FLJ11715 BINDING SITE is a target binding site found in the 3' untranslated region of mRNA encoded by FLJ11715, corresponding to a target binding site such as BINDING SITE I, BINDING SITE II or BINDING SITE III of FIG. 8. Table 4 illustrates the complementarity of the nucleotide sequences of FLJ11715 BINDING SITE, designated SEQ ID:6725, to the nucleotide sequence of GAM72 RNA, herein designated GAM RNA, also designated SEQ ID:342.

Another function of GAM72 is therefore inhibition of FLJ11715 (Accession NM_024564.1). Accordingly, utilities of GAM72 include diagnosis, prevention and treatment of diseases and clinical conditions associated with FLJ11715.

FLJ12132 (Accession NM_024980.2) is another GAM72 target gene, herein designated TARGET GENE. FLJ12132 BINDING SITE is a target binding site found in the 3' untranslated region of mRNA encoded by FLJ12132, corresponding to a target binding site such as BINDING SITE I, BINDING SITE II or BINDING SITE III of FIG. 8. Table 4 illustrates the complementarity of the nucleotide sequences of FLJ12132 BINDING SITE, designated SEQ ID:1822, to the nucleotide sequence of GAM72 RNA, herein designated GAM RNA, also designated SEQ ID:342.

Another function of GAM72 is therefore inhibition of FLJ12132 (Accession NM_024980.2). Accordingly, utilities of GAM72 include diagnosis, prevention and treatment of diseases and clinical conditions associated with FLJ12132.

FLJ12190 (Accession NM_025071.1) is another GAM72 target gene, herein designated TARGET GENE. FLJ12190 BINDING SITE is a target binding site found in the 3' untranslated region of mRNA encoded by FLJ12190, corresponding to a target binding site such as BINDING SITE I, BINDING SITE II or BINDING SITE III of FIG. 8. Table 4 illustrates the complementarity of the nucleotide sequences of FLJ12190 BINDING SITE, designated SEQ ID:15565, to the nucleotide sequence of GAM72 RNA, herein designated GAM RNA, also designated SEQ ID:342.

Another function of GAM72 is therefore inhibition of FLJ12190 (Accession NM_025071.1). Accordingly, utilities of GAM72 include diagnosis, prevention and treatment of diseases and clinical conditions associated with FLJ12190.

FLJ12294 (Accession NM_025100.1) is another GAM72 target gene, herein designated TARGET GENE. FLJ12294 BINDING SITE is a target binding site found in the 5' untranslated region of mRNA encoded by FLJ12294, corresponding to a target binding site such as BINDING SITE I, BINDING SITE II or BINDING SITE III of FIG. 8. Table 4 illustrates the complementarity of the nucleotide sequences of FLJ12294 BINDING SITE, designated SEQ ID:18537, to the nucleotide sequence of GAM72 RNA, herein designated GAM RNA, also designated SEQ ID:342.

Another function of GAM72 is therefore inhibition of FLJ12294 (Accession NM_025100.1). Accordingly, utilities of GAM72 include diagnosis, prevention and treatment of diseases and clinical conditions associated with FLJ12294.

FLJ12409 (Accession NM_025105.1) is another GAM72 target gene, herein designated TARGET GENE. FLJ12409 BINDING SITE is a target binding site found in the 3' untranslated region of mRNA encoded by FLJ12409, corresponding to a target binding site such as BINDING SITE I, BINDING SITE II or BINDING SITE III of FIG. 8. Table 4 illustrates the complementarity of the nucleotide sequences of FLJ12409 BINDING SITE, designated SEQ ID:19647, to the nucleotide sequence of GAM72 RNA, herein designated GAM RNA, also designated SEQ ID:342.

Another function of GAM72 is therefore inhibition of FLJ12409 (Accession NM_025105.1). Accordingly, utilities of GAM72 include diagnosis, prevention and treatment of diseases and clinical conditions associated with FLJ12409.

FLJ12448 (Accession NM_022895.1) is another GAM72 target gene, herein designated TARGET GENE. FLJ12448 BINDING SITE is a target binding site found in the 3' untranslated region of mRNA encoded by FLJ12448, corresponding to a target binding site such as BINDING SITE I, BINDING SITE II or BINDING SITE III of FIG. 8. Table 4 illustrates the complementarity of the nucleotide sequences of FLJ12448 BINDING SITE, designated SEQ ID:1090, to the nucleotide sequence of GAM72 RNA, herein designated GAM RNA, also designated SEQ ID:342.

Another function of GAM72 is therefore inhibition of FLJ12448 (Accession NM_022895.1). Accordingly, utilities of GAM72 include diagnosis, prevention and treatment of diseases and clinical conditions associated with FLJ12448.

FLJ12671 (Accession NM_030980.1) is another GAM72 target gene, herein designated TARGET GENE. FLJ12671 BINDING SITE is a target binding site found in the 3' untranslated region of mRNA encoded by FLJ12671, corresponding to a target binding site such as BINDING SITE I, BINDING SITE II or BINDING SITE III of FIG. 8. Table 4 illustrates the complementarity of the nucleotide sequences of FLJ12671 BINDING SITE, designated SEQ ID:8146, to the nucleotide sequence of GAM72 RNA, herein designated GAM RNA, also designated SEQ ID:342.

Another function of GAM72 is therefore inhibition of FLJ12671 (Accession NM_030980.1). Accordingly, utilities of GAM72 include diagnosis, prevention and treatment of diseases and clinical conditions associated with FLJ12671.

FLJ12921 (Accession NM_024875.1) is another GAM72 target gene, herein designated TARGET GENE. FLJ12921 BINDING SITE is a target binding site found in the 3' untranslated region of mRNA encoded by FLJ12921, corresponding to a target binding site such as BINDING SITE I, BINDING SITE II or BINDING SITE III of FIG. 8. Table 4 illustrates the complementarity of the nucleotide sequences of FLJ12921 BINDING SITE, designated SEQ ID:17641, to the nucleotide sequence of GAM72 RNA, herein designated GAM RNA, also designated SEQ ID:342.

Another function of GAM72 is therefore inhibition of FLJ12921 (Accession NM_024875.1). Accordingly, utilities of GAM72 include diagnosis, prevention and treatment of diseases and clinical conditions associated with FLJ12921.

FLJ13193 (Accession) is another GAM72 target gene, herein designated TARGET GENE. FLJ13193 BINDING SITE1 and FLJ13193 BINDING SITE2 are target binding sites found in untranslated regions of mRNA encoded by FLJ13193, corresponding to target binding sites such as BINDING SITE I, BINDING SITE II or BINDING SITE III of FIG. 8. Table 4 illustrates the complementarity of the nucleotide sequences of FLJ13193 BINDING SITE1 and FLJ13193 BINDING SITE2, designated SEQ ID:19618 and SEQ ID:6059 respectively, to the nucleotide sequence of GAM72 RNA, herein designated GAM RNA, also designated SEQ ID:342.

Another function of GAM72 is therefore inhibition of FLJ13193 (Accession). Accordingly, utilities of GAM72 include diagnosis, prevention and treatment of diseases and clinical conditions associated with FLJ13193.

FLJ13330 (Accession NM_025091.2) is another GAM72 target gene, herein designated TARGET GENE. FLJ13330 BINDING SITE is a target binding site found in the 3' untranslated region of mRNA encoded by FLJ13330, corresponding to a target binding site such as BINDING SITE I, BINDING SITE II or BINDING SITE III of FIG. 8. Table 4 illustrates the complementarity of the nucleotide sequences of FLJ13330 BINDING SITE, designated SEQ ID:15073, to the nucleotide sequence of GAM72 RNA, herein designated GAM RNA, also designated SEQ ID:342.

Another function of GAM72 is therefore inhibition of FLJ13330 (Accession NM_025091.2). Accordingly, utilities of GAM72 include diagnosis, prevention and treatment of diseases and clinical conditions associated with FLJ13330.

FLJ13352 (Accession NM_024592.1) is another GAM72 target gene, herein designated TARGET GENE. FLJ13352 BINDING SITE is a target binding site found in the 3' untranslated region of mRNA encoded by FLJ13352, corresponding to a target binding site such as BINDING SITE I, BINDING SITE II or BINDING SITE III of FIG. 8. Table 4 illustrates the complementarity of the nucleotide sequences of FLJ13352 BINDING SITE, designated SEQ ID:9233, to the nucleotide sequence of GAM72 RNA, herein designated GAM RNA, also designated SEQ ID:342.

Another function of GAM72 is therefore inhibition of FLJ13352 (Accession NM_024592.1). Accordingly, utilities of GAM72 include diagnosis, prevention and treatment of diseases and clinical conditions associated with FLJ13352.

FLJ13390 (Accession) is another GAM72 target gene, herein designated TARGET GENE. FLJ13390 BINDING SITE is a target binding site found in the 3' untranslated region of mRNA encoded by FLJ13390, corresponding to a target binding site such as BINDING SITE I, BINDING SITE II or BINDING SITE III of FIG. 8. Table 4 illustrates the complementarity of the nucleotide sequences of FLJ13390 BINDING SITE, designated SEQ ID:19961, to the nucleotide sequence of GAM72 RNA, herein designated GAM RNA, also designated SEQ ID:342.

Another function of GAM72 is therefore inhibition of FLJ13390 (Accession). Accordingly, utilities of GAM72 include diagnosis, prevention and treatment of diseases and clinical conditions associated with FLJ13390.

FLJ13456 (Accession XM_038291.5) is another GAM72 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:13553, to the nucleotide sequence of GAM72 RNA, herein designated GAM RNA, also designated SEQ ID:342.

Another function of GAM72 is therefore inhibition of FLJ13456 (Accession XM_038291.5). Accordingly, utilities of GAM72 include diagnosis, prevention and treatment of diseases and clinical conditions associated with FLJ13456.

FLJ13544 (Accession NM_025008.1) is another GAM72 target gene, herein designated TARGET GENE. FLJ13544 BINDING SITE is a target binding site found in the 3' untranslated region of mRNA encoded by FLJ13544, corresponding to a target binding site such as BINDING SITE I, BINDING SITE II or BINDING SITE III of FIG. 8. Table 4 illustrates the complementarity of the nucleotide sequences of FLJ13544 BINDING SITE, designated SEQ ID:17984, to the nucleotide sequence of GAM72 RNA, herein designated GAM RNA, also designated SEQ ID:342.

Another function of GAM72 is therefore inhibition of FLJ13544 (Accession NM_025008.1). Accordingly, utilities of GAM72 include diagnosis, prevention and treatment of diseases and clinical conditions associated with FLJ13544.

FLJ13621 (Accession NM_025009.1) is another GAM72 target gene, herein designated TARGET GENE. FLJ13621 BINDING SITE is a target binding site found in the 3' untranslated region of mRNA encoded by FLJ13621, corresponding to a target binding site such as BINDING SITE I, BINDING SITE II or BINDING SITE III of FIG. 8. Table 4 illustrates the complementarity of the nucleotide sequences of FLJ13621 BINDING SITE, designated SEQ ID:1377, to the nucleotide sequence of GAM72 RNA, herein designated GAM RNA, also designated SEQ ID:342.

Another function of GAM72 is therefore inhibition of FLJ13621 (Accession NM_025009.1). Accordingly, utilities of GAM72 include diagnosis, prevention and treatment of diseases and clinical conditions associated with FLJ13621.

FLJ13848 (Accession NM_024771.1) is another GAM72 target gene, herein designated TARGET GENE. FLJ13848 BINDING SITE is a target binding site found in the 5' untranslated region of mRNA encoded by FLJ13848, corresponding to a target binding site such as BINDING SITE I, BINDING SITE II or BINDING SITE III of FIG. 8. Table 4 illustrates the complementarity of the nucleotide sequences of FLJ13848 BINDING SITE, designated SEQ ID:3884, to the nucleotide sequence of GAM72 RNA, herein designated GAM RNA, also designated SEQ ID:342.

Another function of GAM72 is therefore inhibition of FLJ13848 (Accession NM_024771.1). Accordingly, utilities of GAM72 include diagnosis, prevention and treatment of diseases and clinical conditions associated with FLJ13848.

FLJ13984 (Accession NM_024770.1) is another GAM72 target gene, herein designated TARGET GENE. FLJ13984 BINDING SITE is a target binding site found in the 3' untranslated region of mRNA encoded by FLJ13984, corresponding to a target binding site such as BINDING SITE I, BINDING SITE II or BINDING SITE III of FIG. 8. Table 4 illustrates the complementarity of the nucleotide sequences of FLJ13984 BINDING SITE, designated SEQ ID:11483, to the nucleotide sequence of GAM72 RNA, herein designated GAM RNA, also designated SEQ ID:342.

Another function of GAM72 is therefore inhibition of FLJ13984 (Accession NM_024770.1). Accordingly, utilities of GAM72 include diagnosis, prevention and treatment of diseases and clinical conditions associated with FLJ13984.

FLJ14011 (Accession NM_022103.1) is another GAM72 target gene, herein designated TARGET GENE. FLJ14011 BINDING SITE is a target binding site found in the 3' untranslated region of mRNA encoded by FLJ14011, corresponding to a target binding site such as BINDING SITE I, BINDING SITE II or BINDING SITE III of FIG. 8. Table 4 illustrates the complementarity of the nucleotide sequences of FLJ14011 BINDING SITE, designated SEQ ID:9324, to the nucleotide sequence of GAM72 RNA, herein designated GAM RNA, also designated SEQ ID:342.

Another function of GAM72 is therefore inhibition of FLJ14011 (Accession NM_022103.1). Accordingly, utilities of GAM72 include diagnosis, prevention and treatment of diseases and clinical conditions associated with FLJ14011.

FLJ14082 (Accession NM_025024.1) is another GAM72 target gene, herein designated TARGET GENE. FLJ14082 BINDING SITE is a target binding site found in the 3' untranslated region of mRNA encoded by FLJ14082, corresponding to a target binding site such as BINDING SITE I, BINDING SITE II or BINDING SITE III of FIG. 8. Table 4 illustrates the complementarity of the nucleotide sequences of FLJ14082 BINDING SITE, designated SEQ ID:6567, to the nucleotide sequence of GAM72 RNA, herein designated GAM RNA, also designated SEQ ID:342.

Another function of GAM72 is therefore inhibition of FLJ14082 (Accession NM_025024.1). Accordingly, utilities of GAM72 include diagnosis, prevention and treatment of diseases and clinical conditions associated with FLJ14082.

FLJ14251 (Accession) is another GAM72 target gene, herein designated TARGET GENE. FLJ14251 BINDING SITE is a target binding site found in the 5' untranslated region of mRNA encoded by FLJ14251, corresponding to a target binding site such as BINDING SITE I, BINDING SITE II or BINDING SITE III of FIG. 8. Table 4 illustrates the complementarity of the nucleotide sequences of FLJ14251 BINDING SITE, designated SEQ ID:2884, to the nucleotide sequence of GAM72 RNA, herein designated GAM RNA, also designated SEQ ID:342.

Another function of GAM72 is therefore inhibition of FLJ14251 (Accession). Accordingly, utilities of GAM72 include diagnosis, prevention and treatment of diseases and clinical conditions associated with FLJ14251.

FLJ14280 (Accession NM_024886.1) is another GAM72 target gene, herein designated TARGET GENE. FLJ14280 BINDING SITE is a target binding site found in the 3' untranslated region of mRNA encoded by FLJ14280, corresponding to a target binding site such as BINDING SITE I, BINDING SITE II or BINDING SITE III of FIG. 8. Table 4 illustrates the complementarity of the nucleotide sequences of FLJ14280 BINDING SITE, designated SEQ ID:15839, to the nucleotide sequence of GAM72 RNA, herein designated GAM RNA, also designated SEQ ID:342.

Another function of GAM72 is therefore inhibition of FLJ14280 (Accession NM_024886.1). Accordingly, utilities of GAM72 include diagnosis, prevention and treatment of diseases and clinical conditions associated with FLJ14280.

FLJ14326 (Accession) is another GAM72 target gene, herein designated TARGET GENE. FLJ14326 BINDING SITE is a target binding site found in the 3' untranslated region of mRNA encoded by FLJ14326, corresponding to a target binding site such as BINDING SITE I, BINDING SITE II or BINDING SITE III of FIG. 8. Table 4 illustrates the complementarity of the nucleotide sequences of FLJ14326 BINDING SITE, designated SEQ ID:18652, to the nucleotide sequence of GAM72 RNA, herein designated GAM RNA, also designated SEQ ID:342.

Another function of GAM72 is therefore inhibition of FLJ14326 (Accession). Accordingly, utilities of GAM72 include diagnosis, prevention and treatment of diseases and clinical conditions associated with FLJ14326.

FLJ14327 (Accession NM_024912.1) is another GAM72 target gene, herein designated TARGET GENE. FLJ14327 BINDING SITE is a target binding site found in the 3' untranslated region of mRNA encoded by FLJ14327, corresponding to a target binding site such as BINDING SITE I, BINDING SITE II or BINDING SITE III of FIG. 8. Table 4 illustrates the complementarity of the nucleotide sequences of FLJ14327 BINDING SITE, designated SEQ ID:1971, to the nucleotide sequence of GAM72 RNA, herein designated GAM RNA, also designated SEQ ID:342.

Another function of GAM72 is therefore inhibition of FLJ14327 (Accession NM_024912.1). Accordingly, utilities of GAM72 include diagnosis, prevention and treatment of diseases and clinical conditions associated with FLJ14327.

FLJ14397 (Accession NM_032779.1) is another GAM72 target gene, herein designated TARGET GENE. FLJ14397 BINDING SITE is a target binding site found in the 3' untranslated region of mRNA encoded by FLJ14397, corresponding to a target binding site such as BINDING SITE I, BINDING SITE II or BINDING SITE III of FIG. 8. Table 4 illustrates the complementarity of the nucleotide sequences of FLJ14397 BINDING SITE, designated SEQ ID:16157, to the nucleotide sequence of GAM72 RNA, herein designated GAM RNA, also designated SEQ ID:342.

Another function of GAM72 is therefore inhibition of FLJ14397 (Accession NM_032779.1). Accordingly, utilities of GAM72 include diagnosis, prevention and treatment of diseases and clinical conditions associated with FLJ14397.

FLJ14399 (Accession NM_032780.1) is another GAM72 target gene, herein designated TARGET GENE. FLJ14399 BINDING SITE is a target binding site found in the 3' untranslated region of mRNA encoded by FLJ14399, corresponding to a target binding site such as BINDING SITE I, BINDING SITE II or BINDING SITE III of FIG. 8. Table 4 illustrates the complementarity of the nucleotide sequences of FLJ14399 BINDING SITE, designated SEQ ID:2000, to the nucleotide sequence of GAM72 RNA, herein designated GAM RNA, also designated SEQ ID:342.

Another function of GAM72 is therefore inhibition of FLJ14399 (Accession NM_032780.1). Accordingly, utilities of GAM72 include diagnosis, prevention and treatment of diseases and clinical conditions associated with FLJ14399.

FLJ14457 (Accession NM_032788.1) is another GAM72 target gene, herein designated TARGET GENE. FLJ14457 BINDING SITE is a target binding site found in the 3' untranslated region of mRNA encoded by FLJ14457, corresponding to a target binding site such as BINDING SITE I, BINDING SITE II or BINDING SITE III of FIG. 8. Table 4 illustrates the complementarity of the nucleotide sequences of FLJ14457 BINDING SITE, designated SEQ ID:6993, to the nucleotide sequence of GAM72 RNA, herein designated GAM RNA, also designated SEQ ID:342.

Another function of GAM72 is therefore inhibition of FLJ14457 (Accession NM_032788.1). Accordingly, utilities of GAM72 include diagnosis, prevention and treatment of diseases and clinical conditions associated with FLJ14457.

FLJ14466 (Accession NM_032790.1) is another GAM72 target gene, herein designated TARGET GENE. FLJ14466 BINDING SITE is a target binding site found in the 3' untranslated region of mRNA encoded by FLJ14466, corresponding to a target binding site such as BINDING SITE I, BINDING SITE II or BINDING SITE III of FIG. 8. Table 4 illustrates the complementarity of the nucleotide sequences of FLJ14466 BINDING SITE, designated SEQ ID:12835, to the nucleotide sequence of GAM72 RNA, herein designated GAM RNA, also designated SEQ ID:342.

Another function of GAM72 is therefore inhibition of FLJ14466 (Accession NM_032790.1). Accordingly, utilities of GAM72 include diagnosis, prevention and treatment of diseases and clinical conditions associated with FLJ14466.

FLJ20004 (Accession) is another GAM72 target gene, herein designated TARGET GENE. FLJ20004 BINDING SITE1 and FLJ20004 BINDING SITE2 are target binding sites found in untranslated regions of mRNA encoded by FLJ20004, corresponding to target binding sites such as BINDING SITE I, BINDING SITE II or BINDING SITE III of FIG. 8. Table 4 illustrates the complementarity of the nucleotide sequences of FLJ20004 BINDING SITE1 and FLJ20004 BINDING SITE2, designated SEQ ID:16023 and SEQ ID:19735 respectively, to the nucleotide sequence of GAM72 RNA, herein designated GAM RNA, also designated SEQ ID:342.

Another function of GAM72 is therefore inhibition of FLJ20004 (Accession). Accordingly, utilities of GAM72 include diagnosis, prevention and treatment of diseases and clinical conditions associated with FLJ20004.

FLJ20006 (Accession NM_017618.1) is another GAM72 target gene, herein designated TARGET GENE. FLJ20006 BINDING SITE is a target binding site found in the 3' untranslated region of mRNA encoded by FLJ20006, corresponding to a target binding site such as BINDING SITE I, BINDING SITE II or BINDING SITE III of FIG. 8. Table 4 illustrates the complementarity of the nucleotide sequences of FLJ20006 BINDING SITE, designated SEQ ID:9107, to the nucleotide sequence of GAM72 RNA, herein designated GAM RNA, also designated SEQ ID:342.

Another function of GAM72 is therefore inhibition of FLJ20006 (Accession NM_017618.1). Accordingly, utilities of GAM72 include diagnosis, prevention and treatment of diseases and clinical conditions associated with FLJ20006.

FLJ20013 (Accession NM_017621.2) is another GAM72 target gene, herein designated TARGET GENE. FLJ20013 BINDING SITE1 and FLJ20013 BINDING SITE2 are target binding sites found in untranslated regions of mRNA encoded by FLJ20013, corresponding to target binding sites such as BINDING SITE I, BINDING SITE II or BINDING SITE III of FIG. 8. Table 4 illustrates the complementarity of the nucleotide sequences of FLJ20013 BINDING SITE1 and FLJ20013 BINDING SITE2, designated SEQ ID:3892 and SEQ ID:4741 respectively, to the nucleotide sequence of GAM72 RNA, herein designated GAM RNA, also designated SEQ ID:342.

Another function of GAM72 is therefore inhibition of FLJ20013 (Accession NM_017621.2). Accordingly, utilities of GAM72 include diagnosis, prevention and treatment of diseases and clinical conditions associated with FLJ20013.

FLJ20045 (Accession NM_017638.1) is another GAM72 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:10035, to the nucleotide sequence of GAM72 RNA, herein designated GAM RNA, also designated SEQ ID:342.

Another function of GAM72 is therefore inhibition of FLJ20045 (Accession NM_017638.1). Accordingly, utilities of GAM72 include diagnosis, prevention and treatment of diseases and clinical conditions associated with FLJ20045.

FLJ20059 (Accession NM_017644.1) is another GAM72 target gene, herein designated TARGET GENE. FLJ20059 BINDING SITE is a target binding site found in the 3' untranslated region of mRNA encoded by FLJ20059, corresponding to a target binding site such as BINDING SITE I, BINDING SITE II or BINDING SITE III of FIG. 8. Table 4 illustrates the complementarity of the nucleotide sequences of FLJ20059 BINDING SITE, designated SEQ ID:9258, to the nucleotide sequence of GAM72 RNA, herein designated GAM RNA, also designated SEQ ID:342.

Another function of GAM72 is therefore inhibition of FLJ20059 (Accession NM_017644.1). Accordingly, utilities of GAM72 include diagnosis, prevention and treatment of diseases and clinical conditions associated with FLJ20059.

FLJ20069 (Accession NM_017651.2) is another GAM72 target gene, herein designated TARGET GENE. FLJ20069 BINDING SITE is a target binding site found in the 3' untranslated region of mRNA encoded by FLJ20069, corresponding to a target binding site such as BINDING SITE I, BINDING SITE II or BINDING SITE III of FIG. 8. Table 4 illustrates the complementarity of the nucleotide sequences of FLJ20069 BINDING SITE, designated SEQ ID:11616, to the nucleotide sequence of GAM72 RNA, herein designated GAM RNA, also designated SEQ ID:342.

Another function of GAM72 is therefore inhibition of FLJ20069 (Accession NM_017651.2). Accordingly, utilities of GAM72 include diagnosis, prevention and treatment of diseases and clinical conditions associated with FLJ20069.

FLJ20139 (Accession) is another GAM72 target gene, herein designated TARGET GENE. FLJ20139 BINDING SITE is a target binding site found in the 3' untranslated region of mRNA encoded by FLJ20139, corresponding to a target binding site such as BINDING SITE I, BINDING SITE II or BINDING SITE III of FIG. 8. Table 4 illustrates the complementarity of the nucleotide sequences of FLJ20139 BINDING SITE, designated SEQ ID:12730, to the nucleotide sequence of GAM72 RNA, herein designated GAM RNA, also designated SEQ ID:342.

Another function of GAM72 is therefore inhibition of FLJ20139 (Accession). Accordingly, utilities of GAM72 include diagnosis, prevention and treatment of diseases and clinical conditions associated with FLJ20139.

FLJ20174 (Accession NM_017699.1) is another GAM72 target gene, herein designated TARGET GENE. FLJ20174 BINDING SITE is a target binding site found in the 3' untranslated region of mRNA encoded by FLJ20174, corresponding to a target binding site such as BINDING SITE I, BINDING SITE II or BINDING SITE III of FIG. 8. Table 4 illustrates the complementarity of the nucleotide sequences of FLJ20174 BINDING SITE, designated SEQ ID:14813, to the nucleotide sequence of GAM72 RNA, herein designated GAM RNA, also designated SEQ ID:342.

Another function of GAM72 is therefore inhibition of FLJ20174 (Accession NM_017699.1). Accordingly, utilities of GAM72 include diagnosis, prevention and treatment of diseases and clinical conditions associated with FLJ20174.

FLJ20200 (Accession NM_017708.1) is another GAM72 target gene, herein designated TARGET GENE. FLJ20200 BINDING SITE is a target binding site found in the 3' untranslated region of mRNA encoded by FLJ20200, corresponding to a target binding site such as BINDING SITE I, BINDING SITE II or BINDING SITE III of FIG. 8. Table 4 illustrates the complementarity of the nucleotide sequences of FLJ20200 BINDING SITE, designated SEQ ID:2707, to the nucleotide sequence of GAM72 RNA, herein designated GAM RNA, also designated SEQ ID:342.

Another function of GAM72 is therefore inhibition of FLJ20200 (Accession NM_017708.1). Accordingly, utilities of GAM72 include diagnosis, prevention and treatment of diseases and clinical conditions associated with FLJ20200.

FLJ20340 (Accession) is another GAM72 target gene, herein designated TARGET GENE. FLJ20340 BINDING SITE is a target binding site found in the 3' untranslated region of mRNA encoded by FLJ20340, corresponding to a target binding site such as BINDING SITE I, BINDING SITE II or BINDING SITE III of FIG. 8. Table 4 illustrates the complementarity of the nucleotide sequences of FLJ20340 BINDING SITE, designated SEQ ID:19249, to the nucleotide sequence of GAM72 RNA, herein designated GAM RNA, also designated SEQ ID:342.

Another function of GAM72 is therefore inhibition of FLJ20340 (Accession). Accordingly, utilities of GAM72 include diagnosis, prevention and treatment of diseases and clinical conditions associated with FLJ20340.

FLJ20413 (Accession NM_017808.1) is another GAM72 target gene, herein designated TARGET GENE. FLJ20413 BINDING SITE is a target binding site found in the 3' untranslated region of mRNA encoded by FLJ20413, corresponding to a target binding site such as BINDING SITE I, BINDING SITE II or BINDING SITE III of FIG. 8. Table 4 illustrates the complementarity of the nucleotide sequences of FLJ20413 BINDING SITE, designated SEQ ID:16863, to the nucleotide sequence of GAM72 RNA, herein designated GAM RNA, also designated SEQ ID:342.

Another function of GAM72 is therefore inhibition of FLJ20413 (Accession NM_017808.1). Accordingly, utilities of GAM72 include diagnosis, prevention and treatment of diseases and clinical conditions associated with FLJ20413.

FLJ20464 (Accession NM_017834.1) is another GAM72 target gene, herein designated TARGET GENE. FLJ20464 BINDING SITE is a target binding site found in the 5' untranslated region of mRNA encoded by FLJ20464, corresponding to a target binding site such as BINDING SITE I, BINDING SITE II or BINDING SITE III of FIG. 8. Table 4 illustrates the complementarity of the nucleotide sequences of FLJ20464 BINDING SITE, designated SEQ ID:402, to the nucleotide sequence of GAM72 RNA, herein designated GAM RNA, also designated SEQ ID:342.

Another function of GAM72 is therefore inhibition of FLJ20464 (Accession NM_017834.1). Accordingly, utilities of GAM72 include diagnosis, prevention and treatment of diseases and clinical conditions associated with FLJ20464.

FLJ20546 (Accession NM_017872.2) is another GAM72 target gene, herein designated TARGET GENE. FLJ20546 BINDING SITE is a target binding site found in the 3' untranslated region of mRNA encoded by FLJ20546, corresponding to a target binding site such as BINDING SITE I, BINDING SITE II or BINDING SITE III of FIG. 8. Table 4 illustrates the complementarity of the nucleotide sequences of FLJ20546 BINDING SITE, designated SEQ ID:17595, to the nucleotide sequence of GAM72 RNA, herein designated GAM RNA, also designated SEQ ID:342.

Another function of GAM72 is therefore inhibition of FLJ20546 (Accession NM_017872.2). Accordingly, utilities of GAM72 include diagnosis, prevention and treatment of diseases and clinical conditions associated with FLJ20546.

FLJ20694 (Accession NM_017928.1) is another GAM72 target gene, herein designated TARGET GENE. FLJ20694 BINDING SITE is a target binding site found in the 3' untranslated region of mRNA encoded by FLJ20694, corresponding to a target binding site such as BINDING SITE I, BINDING SITE II or BINDING SITE III of FIG. 8. Table 4 illustrates the complementarity of the nucleotide sequences of FLJ20694 BINDING SITE, designated SEQ ID:16458, to the nucleotide sequence of GAM72 RNA, herein designated GAM RNA, also designated SEQ ID:342.

Another function of GAM72 is therefore inhibition of FLJ20694 (Accession NM_017928.1). Accordingly, utilities of GAM72 include diagnosis, prevention and treatment of diseases and clinical conditions associated with FLJ20694.

FLJ20700 (Accession NM_017932.1) is another GAM72 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:13236, to the nucleotide sequence of GAM72 RNA, herein designated GAM RNA, also designated SEQ ID:342.

Another function of GAM72 is therefore inhibition of FLJ20700 (Accession NM_017932.1). Accordingly, utilities of GAM72 include diagnosis, prevention and treatment of diseases and clinical conditions associated with FLJ20700.

FLJ20783 (Accession) is another GAM72 target gene, herein designated TARGET GENE. FLJ20783 BINDING SITE is a target binding site found in the 5' untranslated region of mRNA encoded by FLJ20783, corresponding to a target binding site such as BINDING SITE I, BINDING SITE II or BINDING SITE III of FIG. 8. Table 4 illustrates the complementarity of the nucleotide sequences of FLJ20783 BINDING SITE, designated SEQ ID:13950, to the nucleotide sequence of GAM72 RNA, herein designated GAM RNA, also designated SEQ ID:342.

Another function of GAM72 is therefore inhibition of FLJ20783 (Accession). Accordingly, utilities of GAM72 include diagnosis, prevention and treatment of diseases and clinical conditions associated with FLJ20783.

FLJ20808 (Accession NM_017960.1) is another GAM72 target gene, herein designated TARGET GENE. FLJ20808 BINDING SITE is a target binding site found in the 3' untranslated region of mRNA encoded by FLJ20808, corresponding to a target binding site such as BINDING SITE I, BINDING SITE II or BINDING SITE III of FIG. 8. Table 4 illustrates the complementarity of the nucleotide sequences of FLJ20808 BINDING SITE, designated SEQ ID:991, to the nucleotide sequence of GAM72 RNA, herein designated GAM RNA, also designated SEQ ID:342.

Another function of GAM72 is therefore inhibition of FLJ20808 (Accession NM_017960.1). Accordingly, utilities of GAM72 include diagnosis, prevention and treatment of diseases and clinical conditions associated with FLJ20808.

FLJ20825 (Accession NM_017962.1) is another GAM72 target gene, herein designated TARGET GENE. FLJ20825 BINDING SITE is a target binding site found in the 3' untranslated region of mRNA encoded by FLJ20825, corresponding to a target binding site such as BINDING SITE I, BINDING SITE II or BINDING SITE III of FIG. 8. Table 4 illustrates the complementarity of the nucleotide sequences of FLJ20825 BINDING SITE, designated SEQ ID:14966, to the nucleotide sequence of GAM72 RNA, herein designated GAM RNA, also designated SEQ ID:342.

Another function of GAM72 is therefore inhibition of FLJ20825 (Accession NM_017962.1). Accordingly, utilities of GAM72 include diagnosis, prevention and treatment of diseases and clinical conditions associated with FLJ20825.

FLJ21106 (Accession NM_025097.1) is another GAM72 target gene, herein designated TARGET GENE. FLJ21106 BINDING SITE is a target binding site found in the 5' untranslated region of mRNA encoded by FLJ21106, corresponding to a target binding site such as BINDING SITE I, BINDING SITE II or BINDING SITE III of FIG. 8. Table 4 illustrates the complementarity of the nucleotide sequences of FLJ21106 BINDING SITE, designated SEQ ID:7533, to the nucleotide sequence of GAM72 RNA, herein designated GAM RNA, also designated SEQ ID:342.

Another function of GAM72 is therefore inhibition of FLJ21106 (Accession NM_025097.1). Accordingly, utilities of GAM72 include diagnosis, prevention and treatment of diseases and clinical conditions associated with FLJ21106.

FLJ21162 (Accession) is another GAM72 target gene, herein designated TARGET GENE. FLJ21162 BINDING SITE is a target binding site found in the 5' untranslated region of mRNA encoded by FLJ21162, corresponding to a target binding site such as BINDING SITE I, BINDING SITE II or BINDING SITE III of FIG. 8. Table 4 illustrates the complementarity of the nucleotide sequences of FLJ21162 BINDING SITE, designated SEQ ID:9315, to the nucleotide sequence of GAM72 RNA, herein designated GAM RNA, also designated SEQ ID:342.

Another function of GAM72 is therefore inhibition of FLJ21162 (Accession). Accordingly, utilities of GAM72 include diagnosis, prevention and treatment of diseases and clinical conditions associated with FLJ21162.

FLJ21272 (Accession NM_025032.1) is another GAM72 target gene, herein designated TARGET GENE. FLJ21272 BINDING SITE is a target binding site found in the 3' untranslated region of mRNA encoded by FLJ21272, corresponding to a target binding site such as BINDING SITE I, BINDING SITE II or BINDING SITE III of FIG. 8. Table 4 illustrates the complementarity of the nucleotide sequences of FLJ21272 BINDING SITE, designated SEQ ID:2503, to the nucleotide sequence of GAM72 RNA, herein designated GAM RNA, also designated SEQ ID:342.

Another function of GAM72 is therefore inhibition of FLJ21272 (Accession NM_025032.1). Accordingly, utilities of GAM72 include diagnosis, prevention and treatment of diseases and clinical conditions associated with FLJ21272.

FLJ21369 (Accession NM_024802.1) is another GAM72 target gene, herein designated TARGET GENE. FLJ21369 BINDING SITE is a target binding site found in the 3' untranslated region of mRNA encoded by FLJ21369, corresponding to a target binding site such as BINDING SITE I, BINDING SITE II or BINDING SITE III of FIG. 8. Table 4 illustrates the complementarity of the nucleotide sequences of FLJ21369 BINDING SITE, designated SEQ ID:18241, to the nucleotide sequence of GAM72 RNA, herein designated GAM RNA, also designated SEQ ID:342.

Another function of GAM72 is therefore inhibition of FLJ21369 (Accession NM_024802.1). Accordingly, utilities of GAM72 include diagnosis, prevention and treatment of diseases and clinical conditions associated with FLJ21369.

FLJ21551 (Accession NM_024801.1) is another GAM72 target gene, herein designated TARGET GENE. FLJ21551 BINDING SITE is a target binding site found in the 3' untranslated region of mRNA encoded by FLJ21551, corresponding to a target binding site such as BINDING SITE I, BINDING SITE II or BINDING SITE III of FIG. 8. Table 4 illustrates the complementarity of the nucleotide sequences of FLJ21551 BINDING SITE, designated SEQ ID:6940, to the nucleotide sequence of GAM72 RNA, herein designated GAM RNA, also designated SEQ ID:342.

Another function of GAM72 is therefore inhibition of FLJ21551 (Accession NM_024801.1). Accordingly, utilities of GAM72 include diagnosis, prevention and treatment of diseases and clinical conditions associated with FLJ21551.

FLJ22009 (Accession) is another GAM72 target gene, herein designated TARGET GENE. FLJ22009 BINDING SITE is a target binding site found in the 3' untranslated region of mRNA encoded by FLJ22009, corresponding to a target binding site such as BINDING SITE I, BINDING SITE II or BINDING SITE III of FIG. 8. Table 4 illustrates the complementarity of the nucleotide sequences of FLJ22009 BINDING SITE, designated SEQ ID:1350, to the nucleotide sequence of GAM72 RNA, herein designated GAM RNA, also designated SEQ ID:342.

Another function of GAM72 is therefore inhibition of FLJ22009 (Accession). Accordingly, utilities of GAM72 include diagnosis, prevention and treatment of diseases and clinical conditions associated with FLJ22009.

FLJ22474 (Accession) is another GAM72 target gene, herein designated TARGET GENE. FLJ22474 BINDING SITE is a target binding site found in the 3' untranslated region of mRNA encoded by FLJ22474, corresponding to a target binding site such as BINDING SITE I, BINDING SITE II or BINDING SITE III of FIG. 8. Table 4 illustrates the complementarity of the nucleotide sequences of FLJ22474 BINDING SITE, designated SEQ ID:17883, to the nucleotide sequence of GAM72 RNA, herein designated GAM RNA, also designated SEQ ID:342.

Another function of GAM72 is therefore inhibition of FLJ22474 (Accession). Accordingly, utilities of GAM72 include diagnosis, prevention and treatment of diseases and clinical conditions associated with FLJ22474.

FLJ22692 (Accession NM_025049.1) is another GAM72 target gene, herein designated TARGET GENE. FLJ22692 BINDING SITE is a target binding site found in the 3' untranslated region of mRNA encoded by FLJ22692, corresponding to a target binding site such as BINDING SITE I, BINDING SITE II or BINDING SITE III of FIG. 8. Table 4 illustrates the complementarity of the nucleotide sequences of FLJ22692 BINDING SITE, designated SEQ ID:16683, to the nucleotide sequence of GAM72 RNA, herein designated GAM RNA, also designated SEQ ID:342.

Another function of GAM72 is therefore inhibition of FLJ22692 (Accession NM_025049.1). Accordingly, utilities of GAM72 include diagnosis, prevention and treatment of diseases and clinical conditions associated with FLJ22692.

FLJ22814 (Accession NM_024916.1) is another GAM72 target gene, herein designated TARGET GENE. FLJ22814 BINDING SITE is a target binding site found in the 3' untranslated region of mRNA encoded by FLJ22814, corresponding to a target binding site such as BINDING SITE I, BINDING SITE II or BINDING SITE III of FIG. 8. Table 4 illustrates the complementarity of the nucleotide sequences of FLJ22814 BINDING SITE, designated SEQ ID:458, to the nucleotide sequence of GAM72 RNA, herein designated GAM RNA, also designated SEQ ID:342.

Another function of GAM72 is therefore inhibition of FLJ22814 (Accession NM_024916.1). Accordingly, utilities of GAM72 include diagnosis, prevention and treatment of diseases and clinical conditions associated with FLJ22814.

FLJ23040 (Accession NM_025174.1) is another GAM72 target gene, herein designated TARGET GENE. FLJ23040 BINDING SITE is a target binding site found in the 3' untranslated region of mRNA encoded by FLJ23040, corresponding to a target binding site such as BINDING SITE I, BINDING SITE II or BINDING SITE III of FIG. 8. Table 4 illustrates the complementarity of the nucleotide sequences of FLJ23040 BINDING SITE, designated SEQ ID:15539, to the nucleotide sequence of GAM72 RNA, herein designated GAM RNA, also designated SEQ ID:342.

Another function of GAM72 is therefore inhibition of FLJ23040 (Accession NM_025174.1). Accordingly, utilities of GAM72 include diagnosis, prevention and treatment of diseases and clinical conditions associated with FLJ23040.

FLJ23042 (Accession) is another GAM72 target gene, herein designated TARGET GENE. FLJ23042 BINDING SITE is a target binding site found in the 3' untranslated region of mRNA encoded by FLJ23042, corresponding to a target binding site such as BINDING SITE I, BINDING SITE II or BINDING SITE III of FIG. 8. Table 4 illustrates the complementarity of the nucleotide sequences of FLJ23042 BINDING SITE, designated SEQ ID:1823, to the nucleotide sequence of GAM72 RNA, herein designated GAM RNA, also designated SEQ ID:342.

Another function of GAM72 is therefore inhibition of FLJ23042 (Accession). Accordingly, utilities of GAM72 include diagnosis, prevention and treatment of diseases and clinical conditions associated with FLJ23042.

FLJ23112 (Accession NM_024929.1) is another GAM72 target gene, herein designated TARGET GENE. FLJ23112 BINDING SITE is a target binding site found in the 3' untranslated region of mRNA encoded by FLJ23112, corresponding to a target binding site such as BINDING SITE I, BINDING SITE II or BINDING SITE III of FIG. 8. Table 4 illustrates the complementarity of the nucleotide sequences of FLJ23112 BINDING SITE, designated SEQ ID:11044, to the nucleotide sequence of GAM72 RNA, herein designated GAM RNA, also designated SEQ ID:342.

Another function of GAM72 is therefore inhibition of FLJ23112 (Accession NM_024929.1). Accordingly, utilities of GAM72 include diagnosis, prevention and treatment of diseases and clinical conditions associated with FLJ23112.

FLJ23120 (Accession) is another GAM72 target gene, herein designated TARGET GENE. FLJ23120 BINDING SITE is a target binding site found in the 3' untranslated region of mRNA encoded by FLJ23120, corresponding to a target binding site such as BINDING SITE I, BINDING SITE II or BINDING SITE III of FIG. 8. Table 4 illustrates the complementarity of the nucleotide sequences of FLJ23120 BINDING SITE, designated SEQ ID:18218, to the nucleotide sequence of GAM72 RNA, herein designated GAM RNA, also designated SEQ ID:342.

Another function of GAM72 is therefore inhibition of FLJ23120 (Accession). Accordingly, utilities of GAM72 include diagnosis, prevention and treatment of diseases and clinical conditions associated with FLJ23120.

FLJ23476 (Accession NM_024640.1) is another GAM72 target gene, herein designated TARGET GENE. FLJ23476 BINDING SITE is a target binding site found in the 3' untranslated region of mRNA encoded by FLJ23476, corresponding to a target binding site such as BINDING SITE I, BINDING SITE II or BINDING SITE III of FIG. 8. Table 4 illustrates the complementarity of the nucleotide sequences of FLJ23476 BINDING SITE, designated SEQ ID:8812, to the nucleotide sequence of GAM72 RNA, herein designated GAM RNA, also designated SEQ ID:342.

Another function of GAM72 is therefore inhibition of FLJ23476 (Accession NM_024640.1). Accordingly, utilities of GAM72 include diagnosis, prevention and treatment of diseases and clinical conditions associated with FLJ23476.

FLJ23499 (Accession NM_022761.1) is another GAM72 target gene, herein designated TARGET GENE. FLJ23499 BINDING SITE1 and FLJ23499 BINDING SITE2 are target binding sites found in untranslated regions of mRNA encoded by FLJ23499, corresponding to target binding sites such as BINDING SITE I, BINDING SITE II or BINDING SITE III of FIG. 8. Table 4 illustrates the complementarity of the nucleotide sequences of FLJ23499 BINDING SITE1 and FLJ23499 BINDING SITE2, designated SEQ ID:10255 and SEQ ID:10849 respectively, to the nucleotide sequence of GAM72 RNA, herein designated GAM RNA, also designated SEQ ID:342.

Another function of GAM72 is therefore inhibition of FLJ23499 (Accession NM_022761.1). Accordingly, utilities of GAM72 include diagnosis, prevention and treatment of diseases and clinical conditions associated with FLJ23499.

FLJ23537 (Accession NM_024889.1) is another GAM72 target gene, herein designated TARGET GENE. FLJ23537 BINDING SITE is a target binding site found in the 3' untranslated region of mRNA encoded by FLJ23537, corresponding to a target binding site such as BINDING SITE I, BINDING SITE II or BINDING SITE III of FIG. 8. Table 4 illustrates the complementarity of the nucleotide sequences of FLJ23537 BINDING SITE, designated SEQ ID:6332, to the nucleotide sequence of GAM72 RNA, herein designated GAM RNA, also designated SEQ ID:342.

Another function of GAM72 is therefore inhibition of FLJ23537 (Accession NM_024889.1). Accordingly, utilities of GAM72 include diagnosis, prevention and treatment of diseases and clinical conditions associated with FLJ23537.

FLJ25012 (Accession) is another GAM72 target gene, herein designated TARGET GENE. FLJ25012 BINDING SITE is a target binding site found in the 3' untranslated region of mRNA encoded by FLJ25012, corresponding to a target binding site such as BINDING SITE I, BINDING SITE II or BINDING SITE III of FIG. 8. Table 4 illustrates the complementarity of the nucleotide sequences of FLJ25012 BINDING SITE, designated SEQ ID:19167, to the nucleotide sequence of GAM72 RNA, herein designated GAM RNA, also designated SEQ ID:342.

Another function of GAM72 is therefore inhibition of FLJ25012 (Accession). Accordingly, utilities of GAM72 include diagnosis, prevention and treatment of diseases and clinical conditions associated with FLJ25012.

FLJ30681 (Accession XM_166291.2) is another GAM72 target gene, herein designated TARGET GENE. FLJ30681 BINDING SITE is a target binding site found in the 3' untranslated region of mRNA encoded by FLJ30681, corresponding to a target binding site such as BINDING SITE I, BINDING SITE II or BINDING SITE III of FIG. 8. Table 4 illustrates the complementarity of the nucleotide sequences of FLJ30681 BINDING SITE, designated SEQ ID:6277, to the nucleotide sequence of GAM72 RNA, herein designated GAM RNA, also designated SEQ ID:342.

Another function of GAM72 is therefore inhibition of FLJ30681 (Accession XM_166291.2). Accordingly, utilities of GAM72 include diagnosis, prevention and treatment of diseases and clinical conditions associated with FLJ30681.

FLJ31168 (Accession) is another GAM72 target gene, herein designated TARGET GENE. FLJ31168 BINDING SITE is a target binding site found in the 3' untranslated region of mRNA encoded by FLJ31168, corresponding to a target binding site such as BINDING SITE I, BINDING SITE II or BINDING SITE III of FIG. 8. Table 4 illustrates the complementarity of the nucleotide sequences of FLJ31168 BINDING SITE, designated SEQ ID:12604, to the nucleotide sequence of GAM72 RNA, herein designated GAM RNA, also designated SEQ ID:342.

Another function of GAM72 is therefore inhibition of FLJ31168 (Accession). Accordingly, utilities of GAM72 include diagnosis, prevention and treatment of diseases and clinical conditions associated with FLJ31168.

Fibronectin leucine rich transmembrane protein 2 (FLRT2, Accession NM_013231.2) is another GAM72 target gene, herein designated TARGET GENE. FLRT2 BINDING SITE is a target binding site found in the 5' untranslated region of mRNA encoded by FLRT2, corresponding to a target binding site such as BINDING SITE I, BINDING SITE II or BINDING SITE III of FIG. 8. Table 4 illustrates the complementarity of the nucleotide sequences of FLRT2 BINDING SITE, designated SEQ ID:10151, to the nucleotide sequence of GAM72 RNA, herein designated GAM RNA, also designated SEQ ID:342.

Another function of GAM72 is therefore inhibition of Fibronectin leucine rich transmembrane protein 2 (FLRT2, Accession NM_013231.2), a gene which may have a function in cell adhesion and/or receptor signaling. Accordingly, utilities of GAM72 include diagnosis, prevention and treatment of diseases and clinical conditions associated with FLRT2.

The function of FLRT2 has been established by previous studies. The FLRT family of proteins structurally resembles small leucine-rich proteoglycans found in the extracellular matrix. By screening human brain cDNAs for the potential to encode proteins that are at least 50 kD, Ishikawa et al. (1997) isolated a FLRT2 cDNA, which they called KIAA0405. The deduced 660-amino acid full-length FLRT2 protein shares 25% amino acid sequence identity with the precursor of the alpha chain of human platelet glycoprotein Ib (GP1BA; OMIM Ref. No. 231200) across 180 residues. By SDS-PAGE, in vitro transcribed/translated FLRT2 had an apparent molecular mass of approximately 75 kD. RT-PCR detected FLRT2 expression in a number of human tissues, with highest expression in ovary and relatively high expression in brain and pancreas. By searching a human EST database with portions of the FLRT1 protein (OMIM Ref. No. 604806) sequence, Lacy et al. (1999) identified ESTs encoding FLRT2. The full-length FLRT2 coding sequence encodes a predicted 660- amino acid protein containing a putative N-terminal signal sequence, 10 leucine-rich repeats (LRRs) flanked by N- and C-terminal cysteine-rich regions, a fibronectin-/collagen-like domain, a transmembrane domain, and an intracellular C-terminal tail. FLRT2 has 5 potential N-glycosylation sites in its extracellular region. FLRT2 shares 44% amino acid sequence identity with FLRT3 (OMIM Ref. No. 604808) and 41% identity with FLRT1. Recombinant FLRT2 expressed in SF9 insect cells and monkey COS-1 cells migrated as an 85-kD protein on SDS-polyacrylamide gels. The authors demonstrated that FLRT2 is glycosylated. Northern blot analysis of a variety of human adult tissues detected a 7.5-kb FLRT2 transcript that was expressed abundantly in pancreas and less abundantly in skeletal muscle, brain, and heart. Lacy et al. (1999) suggested that FLRT2 functions in cell adhesion and/or receptor signaling. By analysis of a radiation hybrid mapping panel, Ishikawa et al. (1997) mapped the FLRT2 gene to chromosome 14. Lacy et al. (1999) noted that a UniGene cluster corresponding to the FLRT2 gene has been mapped to 14q24-q32.

Full details of the abovementioned studies are described in the following publications, the disclosure of which are hereby incorporated by reference:

Ishikawa, K.; Nagase, T.; Nakajima, D.; Seki, N.; Ohira, M.; Miyajima, N.; Tanaka, A.; Kotani, H.; Nomura, N.; Ohara, O.: Prediction of the coding sequences of unidentified human genes. VIII. 78 new cDNA clones from brain which code for large proteins in vitro. DNA Res. 4:307-313, 1997; and Lacy, S. E.; Bonnemann, C. G.; Buzney, E. A.; Kunkel, L. M.: Identification of FLRT1, FLRT2, and FLRT3: a novel family of transmembrane leucine-rich repeat proteins. Genomics 62:417-4.

Further studies establishing the function and utilities of FLRT2 are found in John Hopkins OMIM database record ID 604807, and in cited publications listed in Table 5, which are hereby incorporated by reference. Udp-n-acetyl-alpha-d-galactosamine:polypeptide n-acetylgalactosaminyltransferase 3 (galnac-t3) (GALNT3, Accession NM_004482.2) is another GAM72 target gene, herein designated TARGET GENE. GALNT3 BINDING SITE is a target binding site found in the 3' untranslated region of mRNA encoded by GALNT3, corresponding to a target binding site such as BINDING SITE I, BINDING SITE II or BINDING SITE III of FIG. 8. Table 4 illustrates the complementarity of the nucleotide sequences of GALNT3 BINDING SITE, designated SEQ ID:2190, to the nucleotide sequence of GAM72 RNA, herein designated GAM RNA, also designated SEQ ID:342.

Another function of GAM72 is therefore inhibition of Udp-n-acetyl-alpha-d-galactosamine:polypeptide n-acetyl-galactosaminyltransferase 3 (galnac-t3) (GALNT3, Accession NM_004482.2), a gene which initiates O-glycosylation of serine and threonine residues. Accordingly, utilities of GAM72 include diagnosis, prevention and treatment of diseases and clinical conditions associated with GALNT3.

The function of GALNT3 has been established by previous studies. GALNT3 (EC 2.4.1.41) is one of several enzymes that catalyze the reaction UDP- GalNAc + polypeptide-(Ser/Thr)-OH to GalNAc-alpha-O-Ser/Thr-polypeptide + UDP, thereby initiating O-glycosylation of serine and threonine residues on an array of glycoproteins. Bennett et al. (1996) used degenerate PCR to clone human GALNT3 using primers based on the sequences of GALNT1 (OMIM Ref. No. 602273) and GALNT2 (OMIM Ref. No. 602274). GALNT3 encodes a 633-amino acid protein which has a single membrane-spanning region and is highly homologous to GALNT1 and GALNT2. Northern blot analysis showed that GALNT3 is expressed as a 3.6-kb transcript, with highest levels in human pancreas and testis. Bennett et al. (1996) expressed the gene in insect Sf9 cells and showed that GALNT3 does have GalNAc-transferase activity, but with different substrate specificity than GALNT1 or GALNT2. The mouse ortholog of GalNAc-T3 was cloned by Zara et al. (1996). Bennett et al. (1998) found that the GALNT1, GALNT2, and GALNT3 genes contain 11, 16, and 10 exons, respectively. Several intron/exon boundaries are conserved within the 3 genes. By FISH, Bennett et al. (1998) mapped the GALNT3 gene to human chromosome 2q24-q31.

Full details of the abovementioned studies are described in the following publications, the disclosure of which are hereby incorporated by reference:

Bennett, E. P.; Hassan, H.; Clausen, H.: cDNA cloning and expression of a novel human UDP-N-acetyl-alpha-D-galactosamine. J. Biol. Chem. 271:17006-17012, 1996; and Bennett, E. P.; Weghuis, D. O.; Merkx, G.; Geurts van Kessel, A.; Eiberg, H.; Clausen, H.: Genomic organization and chromosomal localization of three members of the UDP-N-acetylgalacto.

Further studies establishing the function and utilities of GALNT3 are found in John Hopkins OMIM database record ID 601756, and in cited publications listed in Table 5, which are hereby incorporated by reference. Udp-n-acetyl-alpha-d-galactosamine:polypeptide n-acetylgalactosaminyltransferase 6 (galnac-t6) (GALNT6, Accession NM_007210.2) is another GAM72 target gene, herein designated TARGET GENE. GALNT6 BINDING SITE is a target binding site found in the 3' untranslated region of mRNA encoded by GALNT6, corresponding to a target binding site such as BINDING SITE I, BINDING SITE II or BINDING SITE III of FIG. 8. Table 4 illustrates the complementarity of the nucleotide sequences of GALNT6 BINDING SITE, designated SEQ ID:14948, to the nucleotide sequence of GAM72 RNA, herein designated GAM RNA, also designated SEQ ID:342.

Another function of GAM72 is therefore inhibition of Udp-n-acetyl-alpha-d-galactosamine:polypeptide n-acetyl-galactosaminyltransferase 6 (galnac-t6) (GALNT6, Accession NM_007210.2). Accordingly, utilities of GAM72 include diagnosis, prevention and treatment of diseases and clinical conditions associated with GALNT6.

Growth arrest-specific 7 (GAS7, Accession NM_005890.1) is another GAM72 target gene, herein designated TARGET GENE. GAS7 BINDING SITE is a target binding site found in the 3' untranslated region of multiple transcripts of mRNA encoded by GAS7, corresponding to a target binding site such as BINDING SITE I, BINDING SITE II or BINDING SITE III of FIG. 8. Table 4 illustrates the complementarity of the nucleotide sequences of GAS7 BINDING SITE, designated SEQ ID:17657, to the nucleotide sequence of GAM72 RNA, herein designated GAM RNA, also designated SEQ ID:342.

Another function of GAM72 is therefore inhibition of Growth arrest-specific 7 (GAS7, Accession NM_005890.1), a gene which may play a role in promoting maturation and morphological differentiation of cerebellar neurons. and therefore may be associated with Leukemias with myeloid/lymphoid (mll). Accordingly, utilities of GAM72 include diagnosis, prevention and treatment of Leukemias with myeloid/lymphoid (mll), and of other diseases and clinical conditions associated with GAS7.

The function of GAS7 has been established by previous studies. Growth arrest- specific (GAS) genes are expressed preferentially in cells that enter a quiescent state. Ju et al. (1998) described the isolation and characterization of a GAS gene (GAS7) that is expressed primarily in vivo in terminally differentiated brain cells and particularly prominently in mature cerebellar Purkinje neurons. The gene had originally been identified in serum-starved murine fibroblasts. GAS7 transcripts encode a 48-kD protein containing a structural domain that resembles sequences of OCT-T2 (OMIM Ref. No. 602608), a POU transcription factor implicated in neuronal development, and synapsins, e.g., synapsin I (SYN1; 313440), which have a role in modulating neurotransmitter release. Using in situ hybridization and immunocytochemical analysis, Ju et al. (1998) showed that inhibition of production of GAS7 in terminally differentiating cultures of embryonic murine cerebellum impedes neurite outgrowth from maturing Purkinje cells. Conversely, GAS7 overexpression in undifferentiated neuroblastoma cell cultures dramatically promotes neurite-like outgrowth. Collectively, the results provided evidence for an association between expression of GAS7 and neuronal development. By analysis of cell hybrid DNAs prepared from a panel of 21 Chinese hamster/mouse hybrid cell lines, Ju et al. (1998) mapped the mouse Gas7 gene to chromosome 11. They reported that a human DNA fragment (GenBank G13706) having 85% sequence identity with Gas7 mapped to 17p, which is largely syngeneic with mouse chromosome 11 (Kurtz and Zimmer, 1995).

Full details of the abovementioned studies are described in the following publications, the disclosure of which are hereby incorporated by reference:

Ju, Y.-T.; Chang, A. C. Y.; She, B.-R.; Tsaur, M.-L.; Hwang, H.-M.; Chao, C. C.- K.; Cohen, S. N.; Lin-Chao, S.: Gas7: a gene expressed preferentially in growth- arrested fibroblasts and terminally differentiated Purkinje neurons affects neurite formation. Proc. Nat. Acad. Sci. 95:11423-11428, 1998; and Kurtz, A.; Zimmer, A.: Interspecies fluorescence in situ hybridization further defines synteny homology between mouse chromosome 11 and human chromosome 17. Mammalian Genome 6:379-380.

Further studies establishing the function and utilities of GAS7 are found in John Hopkins OMIM database record ID 603127, and in cited publications listed in Table 5, which are hereby incorporated by reference. GCN2 (Accession) is another GAM72 target gene, herein designated TARGET GENE. GCN2 BINDING SITE is a target binding site found in the 3' untranslated region of mRNA encoded by GCN2, corresponding to a target binding site such as BINDING SITE I, BINDING SITE II or BINDING SITE III of FIG. 8. Table 4 illustrates the complementarity of the nucleotide sequences of GCN2 BINDING SITE, designated SEQ ID:11455, to the nucleotide sequence of GAM72 RNA, herein designated GAM RNA, also designated SEQ ID:342.

Another function of GAM72 is therefore inhibition of GCN2 (Accession). Accordingly, utilities of GAM72 include diagnosis, prevention and treatment of diseases and clinical conditions associated with GCN2.

Golgi associated, gamma adaptin ear containing, arf binding protein 2 (GGA2, Accession NM_015044.2) is another GAM72 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:16227, to the nucleotide sequence of GAM72 RNA, herein designated GAM RNA, also designated SEQ ID:342.

Another function of GAM72 is therefore inhibition of Golgi associated, gamma adaptin ear containing, arf binding protein 2 (GGA2, Accession NM_015044.2). Accordingly, utilities of GAM72 include diagnosis, prevention and treatment of diseases and clinical conditions associated with GGA2.

G protein-coupled receptor kinase 7 (GPRK7, Accession NM_139209.1) is another GAM72 target gene, herein designated TARGET GENE. GPRK7 BINDING SITE is a target binding site found in the 3' untranslated region of mRNA encoded by GPRK7, corresponding to a target binding site such as BINDING SITE I, BINDING SITE II or BINDING SITE III of FIG. 8. Table 4 illustrates the complementarity of the nucleotide sequences of GPRK7 BINDING SITE, designated SEQ ID:5505, to the nucleotide sequence of GAM72 RNA, herein designated GAM RNA, also designated SEQ ID:342.

Another function of GAM72 is therefore inhibition of G protein-coupled receptor kinase 7 (GPRK7, Accession NM_139209.1), a gene which regulates the G protein-coupled receptors. Accordingly, utilities of GAM72 include diagnosis, prevention and treatment of diseases and clinical conditions associated with GPRK7.

The function of GPRK7 has been established by previous studies. By PCR on neutrophil cDNA using primers based on sequences of known receptor kinases, Haribabu and Snyderman (1993) identified sequences for GPRK5 (OMIM Ref. No. 600870), GPRK6 (OMIM Ref. No. 600869), and what they believed to be GPRK7. The sequence designated GPRK7 showed the least homology to known receptor kinases and was later determined to match the sequence of mitogen-activated protein kinase-interacting serine/threonine kinase-2 (MKNK2). MKNK2 contains conserved DLG (asp-leu-gly) and ENIL (glu-asn-ile-leu) motifs. Using a 2-hybrid screen for Erk2 (MAPK1; 176948)-binding proteins, Waskiewicz et al. (1997) identified mouse Mnk2 and isolated a full-length cDNA clone from a mouse embryo cDNA library. Mnk2 has a conserved C-terminal Erk-interacting domain, a catalytic domain with homology to the calcium/calmodulin-dependent family of kinases, and putative MAP kinase phosphorylation sites located within the T loop of the kinase domain. Northern blot analysis detected Mnk2 expression in all adult mouse tissues tested except brain, where levels were greatly reduced. Expression was especially abundant in skeletal muscle.

Full details of the abovementioned studies are described in the following publications, the disclosure of which are hereby incorporated by reference:

Haribabu, B.; Snyderman, R.: Identification of additional members of human G- protein-coupled receptor kinase multigene family. Proc. Nat. Acad. Sci. 90:9398-9402, 1993; and Waskiewicz, A. J.; Flynn, A.; Proud, C. G.; Cooper, J. A.: Mitogen-activated protein kinases activate the serine/threonine kinases Mnk1 and Mnk2. EMBO J. 16:1909-1920, 1997.

Further studies establishing the function and utilities of GPRK7 are found in John Hopkins OMIM database record ID 605069, and in cited publications listed in Table 5, which are hereby incorporated by reference. Huntingtin interacting protein 1 (HIP1, Accession NM_005338.3) is another GAM72 target gene, herein designated TARGET GENE. HIP1 BINDING SITE1 and HIP1 BINDING SITE2 are target binding sites found in untranslated regions of mRNA encoded by HIP1, corresponding to target binding sites such as BINDING SITE I, BINDING SITE II or BINDING SITE III of FIG. 8. Table 4 illustrates the complementarity of the nucleotide sequences of HIP1 BINDING SITE1 and HIP1 BINDING SITE2, designated SEQ ID:17600 and SEQ ID:14256 respectively, to the nucleotide sequence of GAM72 RNA, herein designated GAM RNA, also designated SEQ ID:342.

Another function of GAM72 is therefore inhibition of Huntingtin interacting protein 1 (HIP1, Accession NM_005338.3), a gene which is a membrane protein and interacts with huntingtin. and therefore may be associated with Huntington disease. Accordingly, utilities of GAM72 include diagnosis, prevention and treatment of Huntington disease, and of other diseases and clinical conditions associated with HIP1.

The function of HIP1 has been established by previous studies. Huntington disease (HD; 143100) may be due to a toxic gain-of-function caused by abnormal protein-protein interactions related to the elongated polyglutamine sequence of huntingtin. Thus, the binding of distinct proteins to the polyglutamine region could either confer a new property on huntingtin or alter its normal interactions with other proteins. Wanker et al. (1997) hypothesized that the specific binding of a protein with a restricted pattern of expression to the elongated polyglutamine stretch of the huntingtin protein could cause selective vulnerability to particular cells. The potential huntingtin-interacting proteins that have been identified include huntingtin-associated protein-1 (OMIM Ref. No. 600947), the glycolytic enzyme GAPD (OMIM Ref. No. 138400), and the ubiquitin-conjugating enzyme E2-25K, also named HIP2 (OMIM Ref. No. 602846), which binds selectively to the N terminus of huntingtin. Wanker et al. (1997) demonstrated the specific binding of a protein to the N terminus of huntingtin, both in the yeast 2-hybrid screen and in in vitro binding experiments. A protein region downstream of the polyglutamine stretch in huntingtin was essential for the interaction in vitro. Thus, the authors designated the new protein 'huntingtin-interacting protein-1' (HIP1). The HIP1 cDNA isolated by the 2-hybrid screen encodes a 55-kD fragment of the novel protein. Using an affinity-purified polyclonal antibody raised against recombinant HIP1, a protein of 116 kD was detected in brain extracts by Western blot analysis. The predicted amino acid sequence of the HIP1 fragment exhibited significant similarity to cytoskeleton proteins, suggesting to Wanker et al. (1997) that HIP1 and huntingtin play a functional role in the cell filament network. The HIP1 gene was found to be ubiquitously expressed at low levels in different brain regions. HIP1 is enriched in human brain but can also be detected in other human tissues, as well as in mouse brain. The authors noted that HIP1 and huntingtin behave almost identically during subcellular fractionation and both proteins are enriched in the membrane-containing fractions.

Animal model experiments lend further support to the function of HIP1. Kalchman et al. (1997) showed that HIP1 is a membrane-associated protein that colocalizes with huntingtin and shares sequence homology and biochemical characteristics with Sla2p, a protein essential for function of the cytoskeleton in S. cerevisiae. The huntingtin-HIP1 interaction was restricted to the brain and correlated inversely with the polyglutamine length in huntingtin. Their results provided a molecular link between huntingtin and the neuronal cytoskeleton and suggested that, in Huntington disease, loss of normal huntingtin-HIP1 interaction may contribute to a defect in membrane-cytoskeletal integrity in the brain.

It is appreciated that the abovementioned animal model for HIP1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kalchman, M. A.; Koide, H. B.; McCutcheon, K.; Graham, R. K.; Nichol, K.; Nishiyama, K.; Kazemi-Esfarjani, P.; Lynn, F. C.; Wellington, C.; Metzler, M.; Goldberg, Y. P.; Kanazawa, I.; Gietz, R. D.; Hayden, M. R.: HIP1, a human homologue of S. cerevisiae Slap2, interacts with membrane-associated huntingtin in the brain. Nature Genet. 16:44-53, 1997; and Wanker, E. E.; Rovira, C.; Scherzinger, E.; Hasenbank, R.; Walter, S.; Tait, D.; Colicelli, J.; Lehrach, H.: HIP-I: a huntingtin interacting protein isolated by the yeast two-hybrid sys.

Further studies establishing the function and utilities of HIP1 are found in John Hopkins OMIM database record ID 601767, and in cited publications listed in Table 5, which are hereby incorporated by reference. Major histocompatibility complex, class i, e (HLA-E, Accession NM_005516.3) is another GAM72 target gene, herein designated TARGET GENE. HLA-E BINDING SITE is a target binding site found in the 5' untranslated region of mRNA encoded by HLA-E, corresponding to a target binding site such as BINDING SITE I, BINDING SITE II or BINDING SITE III of FIG. 8. Table 4 illustrates the complementarity of the nucleotide sequences of HLA-E BINDING SITE, designated SEQ ID:1460, to the nucleotide sequence of GAM72 RNA, herein designated GAM RNA, also designated SEQ ID:342.

Another function of GAM72 is therefore inhibition of Major histocompatibility complex, class i, e (HLA-E, Accession NM_005516.3), a gene which involves in NK cell-mediated lysis. Accordingly, utilities of GAM72 include diagnosis, prevention and treatment of diseases and clinical conditions associated with HLA-E.

The function of HLA-E has been established by previous studies. O'Callaghan et al. (1998) determined the crystal structure of human HLA-E in complex with a prototypic ligand, the nonamer peptide (VMAPRTVLL), derived from the highly conserved residues 3-11 of the human MHC class Ia leader sequence. The mode of peptide binding retained some of the standard features observed in MHC class Ia complexes, but novel features implied that HLA-E has evolved to mediate specific binding to a tightly defined set of almost identical hydrophobic peptides from the highly conserved class I leader sequences. These molecular adaptations make HLA-E a rigorous checkpoint at the cell surface, reporting on the integrity of the antigen processing pathway to CD94/NKG2 receptor-bearing natural killer cells. The protein HLA-E is a nonclassical MHC molecule of limited sequence variability. Its expression on the cell surface is regulated by the binding of peptides derived from the signal sequence of some other MHC class I molecules. Braud et al. (1998) reported the identification of ligands for HLA-E. Braud et al. (1998) constructed tetramers in which recombinant HLA-E and beta-2 microglobulin were refolded with an MHC leader-sequence peptide, biotinylated, and conjugated to Extravidin. This HLA-E tetramer bound to natural killer (NK) cells and a small subset of T cells from peripheral blood. On transfectants, the tetramer bound to the CD94/NKG2A (OMIM Ref. No. 161555), CD94/NKG2B, and CD94/NKG2C (OMIM Ref. No. 602891) NK cell receptors, but did not bind to the immunoglobulin family of NK cell receptors (KIRs; OMIM Ref. No. 604936). Surface expression of HLA-E was enough to protect target cells from lysis by CD94/NKG2A+ NK cell clones. A subset of HLA class I alleles had been shown to inhibit killing by CD94/NKG2A+ NK cell clones. Only the HLA alleles that possess a leader peptide capable of upregulating HLA-E surface expression confer resistance to NK cell-mediated lysis, implying that their action is mediated by HLA-E, the predominant ligand for the NK cell inhibitory receptor CD94/NKG2A.

Full details of the abovementioned studies are described in the following publications, the disclosure of which are hereby incorporated by reference:

O'Callaghan, C. A.; Tormo, J.; Willcox, B. E.; Braud, V. M.; Jakobsen, B. K.; Stuart, D. I.; McMichael, A. J.; Bell, J. I.; Jones, E. Y.: Structural features impose tight peptide binding specificity in the nonclassical MHC molecule HLA-E. Molec. Cell 1:531-541, 1998; and Braud, V. M.; Allan, D. S. J.; O'Callaghan, C. A.; Soderstrom, K.; D'Andrea, A.; Ogg, G. S.; Lazetic, S.; Young, N. T.; Bell, J. I.; Phillips, J. H.; Lanier, L. L.; McMichael, A. J.: HL.

Further studies establishing the function and utilities of HLA-E are found in John Hopkins OMIM database record ID 143010, and in cited publications listed in Table 5, which are hereby incorporated by reference. HSC3 (Accession NM_145174.1) is another GAM72 target gene, herein designated TARGET GENE. HSC3 BINDING SITE is a target binding site found in the 3' untranslated region of mRNA encoded by HSC3, corresponding to a target binding site such as BINDING SITE I, BINDING SITE II or BINDING SITE III of FIG. 8. Table 4 illustrates the complementarity of the nucleotide sequences of HSC3 BINDING SITE, designated SEQ ID:2408, to the nucleotide sequence of GAM72 RNA, herein designated GAM RNA, also designated SEQ ID:342.

Another function of GAM72 is therefore inhibition of HSC3 (Accession NM_145174.1). Accordingly, utilities of GAM72 include diagnosis, prevention and treatment of diseases and clinical conditions associated with HSC3.

HSH2 (Accession NM_032855.1) is another GAM72 target gene, herein designated TARGET GENE. HSH2 BINDING SITE is a target binding site found in the 3' untranslated region of mRNA encoded by HSH2, corresponding to a target binding site such as BINDING SITE I, BINDING SITE II or BINDING SITE III of FIG. 8. Table 4 illustrates the complementarity of the nucleotide sequences of HSH2 BINDING SITE, designated SEQ ID:5998, to the nucleotide sequence of GAM72 RNA, herein designated GAM RNA, also designated SEQ ID:342.

Another function of GAM72 is therefore inhibition of HSH2 (Accession NM_032855.1). Accordingly, utilities of GAM72 include diagnosis, prevention and treatment of diseases and clinical conditions associated with HSH2.

HSMPP8 (Accession XM_167894.2) is another GAM72 target gene, herein designated TARGET GENE. HSMPP8 BINDING SITE is a target binding site found in the 3' untranslated region of mRNA encoded by HSMPP8, corresponding to a target binding site such as BINDING SITE I, BINDING SITE II or BINDING SITE III of FIG. 8. Table 4 illustrates the complementarity of the nucleotide sequences of HSMPP8 BINDING SITE, designated SEQ ID:11227, to the nucleotide sequence of GAM72 RNA, herein designated GAM RNA, also designated SEQ ID:342.

Another function of GAM72 is therefore inhibition of HSMPP8 (Accession XM_167894.2). Accordingly, utilities of GAM72 include diagnosis, prevention and treatment of diseases and clinical conditions associated with HSMPP8.

Heat shock 70 kda protein 5 (glucose-regulated protein, 78 kda) (HSPA5, Accession NM_005347.2) is another GAM72 target gene, herein designated TARGET GENE. HSPA5 BINDING SITE is a target binding site found in the 3' untranslated region of mRNA encoded by HSPA5, corresponding to a target binding site such as BINDING SITE I, BINDING SITE II or BINDING SITE III of FIG. 8. Table 4 illustrates the complementarity of the nucleotide sequences of HSPA5 BINDING SITE, designated SEQ ID:3420, to the nucleotide sequence of GAM72 RNA, herein designated GAM RNA, also designated SEQ ID:342.

Another function of GAM72 is therefore inhibition of Heat shock 70 kda protein 5 (glucose-regulated protein, 78 kda) (HSPA5, Accession NM_005347.2), a gene which is involved in the folding and assembly of proteins in the endoplasmic reticulum (ER). Accordingly, utilities of GAM72 include diagnosis, prevention and treatment of diseases and clinical conditions associated with HSPA5.

The function of HSPA5 has been established by previous studies. Hendershot et al. (1994) pointed out that GRP78, also referred to as 'immunoglobulin heavy chain-binding protein' (BiP), is a member of the heat-shock protein-70 (HSP70) family and is involved in the folding and assembly of proteins in the endoplasmic reticulum (ER). Because so many ER proteins interact with GRP78 transiently, it may play a key role in monitoring protein transport through the cell. To examine how the binding of BiP influences the conformational maturation of thyroglobulin (TG; 188450), Muresan and Arvan (1998) expressed TG in Chinese hamster ovary (CHO) cells genetically manipulated for selectively increased BiP expression (CHO-B cells). The TG expressed in CHO-B cells did not contain any mutations that induce misfolding (i.e., no unfolded protein response), so that levels of all other ER chaperones were normal. Increased availability of BiP did not accelerate TG secretion; rather, the export of newly synthesized TG was delayed. TG that was detained intracullularly was concentrated in the ER. Muresan and Arvan (1998) concluded that increased binding of BiP to TG leads to its delayed conformational maturation in the ER.

Full details of the abovementioned studies are described in the following publications, the disclosure of which are hereby incorporated by reference:

Hendershot, L. M.; Valentine, V. A.; Lee, A. S.; Morris, S. W.; Shapiro, D. N.: Localization of the gene encoding human BiP/GRP78, the endoplasmic reticulum cognate of the HSP70 family, to chromosome 9q34. Genomics 20:281-284, 1994; and Muresan, Z.; Arvan, P.: Enhanced binding to the molecular chaperone BiP slows thyroglobulin export from the endoplasmic reticulum. Molec. Endocr. 12:458-467, 1998.

Further studies establishing the function and utilities of HSPA5 are found in John Hopkins OMIM database record ID 138120, and in cited publications listed in Table 5, which are hereby incorporated by reference. HSPC031 (Accession NM_016101.1) is another GAM72 target gene, herein designated TARGET GENE. HSPC031 BINDING SITE is a target binding site found in the 3' untranslated region of mRNA encoded by HSPC031, corresponding to a target binding site such as BINDING SITE I, BINDING SITE II or BINDING SITE III of FIG. 8. Table 4 illustrates the complementarity of the nucleotide sequences of HSPC031 BINDING SITE, designated SEQ ID:3773, to the nucleotide sequence of GAM72 RNA, herein designated GAM RNA, also designated SEQ ID:342.

Another function of GAM72 is therefore inhibition of HSPC031 (Accession NM_016101.1). Accordingly, utilities of GAM72 include diagnosis, prevention and treatment of diseases and clinical conditions associated with HSPC031.

HYPK (Accession NM_016400.2) is another GAM72 target gene, herein designated TARGET GENE. HYPK BINDING SITE is a target binding site found in the 3' untranslated region of mRNA encoded by HYPK, corresponding to a target binding site such as BINDING SITE I, BINDING SITE II or BINDING SITE III of FIG. 8. Table 4 illustrates the complementarity of the nucleotide sequences of HYPK BINDING SITE, designated SEQ ID:17104, to the nucleotide sequence of GAM72 RNA, herein designated GAM RNA, also designated SEQ ID:342.

Another function of GAM72 is therefore inhibition of HYPK (Accession NM_016400.2). Accordingly, utilities of GAM72 include diagnosis, prevention and treatment of diseases and clinical conditions associated with HYPK.

Interferon-related developmental regulator 1 (IFRD1, Accession NM_001550.1) is another GAM72 target gene, herein designated TARGET GENE. IFRD1 BINDING SITE is a target binding site found in the 3' untranslated region of mRNA encoded by IFRD1, corresponding to a target binding site such as BINDING SITE I, BINDING SITE II or BINDING SITE III of FIG. 8. Table 4 illustrates the complementarity of the nucleotide sequences of IFRD1 BINDING SITE, designated SEQ ID:6054, to the nucleotide sequence of GAM72 RNA, herein designated GAM RNA, also designated SEQ ID:342.

Another function of GAM72 is therefore inhibition of Interferon-related developmental regulator 1 (IFRD1, Accession NM_001550.1). Accordingly, utilities of GAM72 include diagnosis, prevention and treatment of diseases and clinical conditions associated with IFRD1.

Interleukin 10 receptor, beta (IL10RB, Accession NM_000628.3) is another GAM72 target gene, herein designated TARGET GENE. IL10RB BINDING SITE is a target binding site found in the 3' untranslated region of mRNA encoded by IL10RB, corresponding to a target binding site such as BINDING SITE I, BINDING SITE II or BINDING SITE III of FIG. 8. Table 4 illustrates the complementarity of the nucleotide sequences of IL10RB BINDING SITE, designated SEQ ID:8908, to the nucleotide sequence of GAM72 RNA, herein designated GAM RNA, also designated SEQ ID:342.

Another function of GAM72 is therefore inhibition of Interleukin 10 receptor, beta (IL10RB, Accession NM_000628.3). Accordingly, utilities of GAM72 include diagnosis, prevention and treatment of diseases and clinical conditions associated with IL10RB.

Interleukin 11 (IL11, Accession NM_000641.2) is another GAM72 target gene, herein designated TARGET GENE. IL11 BINDING SITE is a target binding site found in the 3' untranslated region of mRNA encoded by IL11, corresponding to a target binding site such as BINDING SITE I, BINDING SITE II or BINDING SITE III of FIG. 8. Table 4 illustrates the complementarity of the nucleotide sequences of IL11 BINDING SITE, designated SEQ ID:11693, to the nucleotide sequence of GAM72 RNA, herein designated GAM RNA, also designated SEQ ID:342.

Another function of GAM72 is therefore inhibition of Interleukin 11 (IL11, Accession NM_000641.2), a gene which stimulates the proliferation of hematopoietic stem cells and megakaryocyte progenitor cells and induces megakaryocyte maturation. Accordingly, utilities of GAM72 include diagnosis, prevention and treatment of diseases and clinical conditions associated with IL11.

The function of IL11 and its association with various diseases and clinical conditions, has been established by previous studies, as described hereinabove with reference to GAM41.1. Interleukin 13 receptor, alpha 1 (IL13RA1, Accession NM_001560.2) is another GAM72 target gene, herein designated TARGET GENE. IL13RA1 BINDING SITE is a target binding site found in the 3' untranslated region of mRNA encoded by IL13RA1, corresponding to a target binding site such as BINDING SITE I, BINDING SITE II or BINDING SITE III of FIG. 8. Table 4 illustrates the complementarity of the nucleotide sequences of IL13RA1 BINDING SITE, designated SEQ ID:1465, to the nucleotide sequence of GAM72 RNA, herein designated GAM RNA, also designated SEQ ID:342.

Another function of GAM72 is therefore inhibition of Interleukin 13 receptor, alpha 1 (IL13RA1, Accession NM_001560.2), a gene which binds il-13 with a low affinity. together with il-4r- alpha can form a functional receptor for il-13 and therefore may be associated with Asthma and athopy. Accordingly, utilities of GAM72 include diagnosis, prevention and treatment of Asthma and athopy, and of other diseases and clinical conditions associated with IL13RA1.

The function of IL13RA1 has been established by previous studies. Interleukin-4 (IL4; 147780) and interleukin-13 (IL13; 147683) are 2 cytokines that are secreted by activated T cells and have similar effects on monocytes and B cells. Zurawski et al. (1993) demonstrated that the IL4 receptor (OMIM Ref. No. 147781) is a complex of at least 2 components. They described a mutant form of human IL4 that competitively antagonizes both human IL4 and human IL13. The amino acid sequences of IL4 and IL13 are approximately 30% homologous, and circular dichroism spectroscopy demonstrates that both proteins have a highly alpha- helical structure. IL13 competitively inhibited binding of IL4 to functional human IL4 receptors expressed on a cell line that responds to both IL4 and IL13. The binding of IL4 to an IL4-responsive cell line that does not respond to IL13, and the binding of IL4 to cloned IL4R ligand binding protein expressed on heterologous cells, were not inhibited by IL13. The results demonstrated that IL4 and IL13 share a receptor component that is important for signal transduction. Hilton et al. (1996) reviewed these and other data suggesting a model of IL4 and IL13 receptor composition and function Heinzmann et al. (2000) determined that a variant of human IL13 (OMIM Ref. No. 147683), arg110 to gln (OMIM Ref. No. A4464G), associated with asthma in case-control populations from Britain and Japan (peak odds ratio (OR) =2.31, 95% confidence interval, 1.33-4.00); the variant also predicted asthma and higher serum IL13 levels in a general, Japanese pediatric population. The authors referred to this variant as gln110 to arg. Immunohistochemistry demonstrated that both subunits of IL13R are prominently expressed in bronchial epithelium and smooth muscle from asthmatic subjects. Detailed molecular modeling analyses indicated that residue 110 of IL13 is important in the internal constitution of the ligand and crucial in ligand-receptor interaction. A noncoding variant of IL13R-alpha 1, 1398A-G, associated primarily with high IgE levels (OR =3.38 in males, 1.10 in females) rather than asthma Full details of the abovementioned studies are described in the following publications, the disclosure of which are hereby incorporated by reference:

Hilton, D. J.; Zhang, J.-G.; Metcalf, D.; Alexander, W. S.; Nicola, N. A.; Willson, T. A.: Cloning and characterization of a binding subunit of the interleukin 13 receptor that is also a component of the interleukin 4 receptor. Proc. Nat. Acad. Sci. 93:497-501, 1996; and Heinzmann, H.; Mao, X.-Q.; Akaiwa, M.; Kreomer, R. T.; Gao, P.-S.; Ohshima, K.; Umeshita, R.; Abe, Y.; Braun, S.; Yamashita, T.; Roberts, M. H.; Sugimoto, R.; and 20 others: Genetic var.

Further studies establishing the function and utilities of IL13RA1 are found in John Hopkins OMIM database record ID 300119, and in cited publications listed in Table 5, which are hereby incorporated by reference. Interleukin 18 (interferon-gamma-inducing factor) (IL18, Accession NM_001562.2) is another GAM72 target gene, herein designated TARGET GENE. IL18 BINDING SITE is a target binding site found in the 3' untranslated region of mRNA encoded by IL18, corresponding to a target binding site such as BINDING SITE I, BINDING SITE II or BINDING SITE III of FIG. 8. Table 4 illustrates the complementarity of the nucleotide sequences of IL18 BINDING SITE, designated SEQ ID:19198, to the nucleotide sequence of GAM72 RNA, herein designated GAM RNA, also designated SEQ ID:342.

Another function of GAM72 is therefore inhibition of Interleukin 18 (interferon-gamma-inducing factor) (IL18, Accession NM_001562.2), a gene which augments natural killer cell activity in spleen cells and stimulates interferon gamma production in t helper type i cells. and therefore may be associated with Crohn disease. Accordingly, utilities of GAM72 include diagnosis, prevention and treatment of Crohn disease, and of other diseases and clinical conditions associated with IL18.

The function of IL18 has been established by previous studies. Okamura et al. (1995) cloned an interferon-gamma (IFNG; 147570)-inducing factor that augments natural killer (NK) cell activity in spleen cells. The gene encodes a precursor protein of 192 amino acids and a mature protein of 157 amino acids. Messenger RNAs for the gene, designated IGIF by them, and for interleukin-12 (IL12; OMIM Ref. No. 161560) were readily detected in Kupffer cells and activated macrophages. Recombinant IGIF induced IFNG more potently than did IL12, which is also a NK-cell stimulatory factor. Administration of anti-IGIF antibodies prevented liver damage in mice inoculated with Propionibacterium acnes and challenged with lipopolysaccharide that induces toxic shock. Okamura et al. (1995) speculated that IGIF may be involved in the development of Th1 cells and also in mechanisms of tissue injury in inflammatory reactions. The mechanism underlying the differentiation of CD4+ T cells into functionally distinct Th1 and Th2 subsets had been incompletely understood. The interferon-gamma-inducing factor is also known as interleukin-18 (Sarvetnick, 1997). Rothe et al. (1997) concluded that IGIF expression is normally regulated in autoimmune NOD mice and is closely associated with diabetes development. They showed that the Igif gene maps to mouse chromosome 9 within the Idd2 interval and is therefore a candidate for the Idd2 diabetes susceptibility gene, a non-MHC gene associated with the acceleration of diabetes development Animal model experiments lend further support to the function of IL18. In transgenic mice, Konishi et al. (2002) showed that IL18 contributes to the spontaneous development of atopic dermatitis-like inflammatory skin lesions independently of IgE/Stat6 (OMIM Ref. No. 601512) under specific pathogen- free conditions. Overrelease of IL18 initiated atopic dermatitis-like inflammation, which was accelerated by interleukin 1-alpha (IL1A; 147760).

It is appreciated that the abovementioned animal model for IL18 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okamura, H.; Tsutsui, H.; Komatsu, T.; Yutsudo, M.; Hakura, A.; Tanimoto, T.; Torigoe, K.; Okura, T.; Nukada, Y.; Hattori, K.; Akita, K.; Namba, M.; Tanabe, F.; Konishi, K.; Fukuda, S.; Kurimoto, M.: Cloning of a new cytokine that induces IFN-gamma production by T cells. Nature 378:88-91, 1995; and Konishi, H.; Tsutsui, H.; Murakami, T.; Yumikura-Futatsugi, S.; Yamanaka, K.; Tanaka, M.; Iwakura, Y.; Suzuki, N.; Takeda, K.; Akira, S.; Nakanishi, K.; Mizutani, H: IL-18 contributes.

Further studies establishing the function and utilities of IL18 are found in John Hopkins OMIM database record ID 600953, and in cited publications listed in Table 5, which are hereby incorporated by reference. Intracisternal a particle-promoted polypeptide (IPP, Accession NM_005897.1) is another GAM72 target gene, herein designated TARGET GENE. IPP BINDING SITE is a target binding site found in the 3' untranslated region of mRNA encoded by IPP, corresponding to a target binding site such as BINDING SITE I, BINDING SITE II or BINDING SITE III of FIG. 8. Table 4 illustrates the complementarity of the nucleotide sequences of IPP BINDING SITE, designated SEQ ID:19290, to the nucleotide sequence of GAM72 RNA, herein designated GAM RNA, also designated SEQ ID:342.

Another function of GAM72 is therefore inhibition of Intracisternal a particle-promoted polypeptide (IPP, Accession NM_005897.1), a gene which may play a role in organizing the actin cytoskeleton. Accordingly, utilities of GAM72 include diagnosis, prevention and treatment of diseases and clinical conditions associated with IPP.

The function of IPP has been established by previous studies. Chang-Yeh et al. (1991) cloned and characterized a novel cellular gene that is promoted by an intracisternal A-particle (IAP) LTR and expressed in the mouse placenta. They referred to it as mouse IAP-promoted placental gene (MIPP). From an 8-day-old mouse embryo cDNA library, they isolated a 1,067-bp cDNA clone containing an IAP LTR U5 region duplicated in its 5-prime terminus and an open reading frame coding for a potential 202-amino acid protein. Sequence of the 5-prime region of a genomic clone revealed the presence of a solo IAP LTR with the same U5 duplication, and primer extension analysis confirmed that transcription of the MIPP gene is under the control of the IAP LTR. Expression of the MIPP gene paralleled that of IAP genes in normal mouse tissues with abundant transcripts present in the placenta. By examining the expression of the MIPP gene in other tissues of the mid-gestation mouse conceptus by Northern analysis, Mold et al. (1991) found that expression is confined to tissues derived from 2 distinct cell lineages, the trophectoderm and primitive endoderm. The MIPP-encoded protein is composed of four 48-amino acid units and shares homology with a vaccinia virus gene product. MIPP-related sequences were also found in several mammals, including the human genome. If the same placental-specific pattern of expression is seen in humans, an examination of the human IPP promoter could lead to important insights into the role of retroviruses in evolution. By study of restriction fragment length variations (RFLV) in recombinant inbred (RI) mice, Chang-Yeh et al. (1993) mapped the Ipp gene to distal mouse chromosome 4. Chang-Yeh et al. (1993) mapped the human gene to 1p32-p22 by PCR analysis of DNAs from somatic cell hybrid panels.

Full details of the abovementioned studies are described in the following publications, the disclosure of which are hereby incorporated by reference:

Chang-Yeh, A.; Jabs, E. W.; Li, X.; Dracopoli, N. C.; Huang, R. C. C.: The IPP gene is assigned to human chromosome 1p32-1p22. Genomics 15:239-241, 1993; and Chang-Yeh, A.; Mold, D. E.; Brilliant, M. H.; Huang, R. C. C.: The mouse intracisternal A particle-promoted placental gene retrotransposition is mouse-strain- specific. Proc. Nat. Acad.

Further studies establishing the function and utilities of IPP are found in John Hopkins OMIM database record ID 147485, and in cited publications listed in Table 5, which are hereby incorporated by reference. Interleukin-1 receptor-associated kinase 4 (IRAK4, Accession NM_016123.1) is another GAM72 target gene, herein designated TARGET GENE. IRAK4 BINDING SITE is a target binding site found in the 3' untranslated region of mRNA encoded by IRAK4, corresponding to a target binding site such as BINDING SITE I, BINDING SITE II or BINDING SITE III of FIG. 8. Table 4 illustrates the complementarity of the nucleotide sequences of IRAK4 BINDING SITE, designated SEQ ID:13012, to the nucleotide sequence of GAM72 RNA, herein designated GAM RNA, also designated SEQ ID:342.

Another function of GAM72 is therefore inhibition of Interleukin-1 receptor-associated kinase 4 (IRAK4, Accession NM_016123.1), a gene which may function as an IRAK1 kinase, triggering a cascade of phosphorylation events. and therefore may be associated with Renal tumors. Accordingly, utilities of GAM72 include diagnosis, prevention and treatment of Renal tumors, and of other diseases and clinical conditions associated with IRAK4.

The function of IRAK4 has been established by previous studies. By SEREX (serologic analysis of recombinant cDNA expression libraries) screening of renal tumors, Scanlan et al. (1999) identified multiple antigens, including REN64. The deduced 460-amino acid protein is strongly expressed in kidney, as determined by immunohistochemistry. RT-PCR analysis detected expression in all 6 tissues tested (lung, testis, small intestine, breast, liver, and placenta). By database searching for IRAK-like sequences and PCR of a universal cDNA library, Li et al. (2002) obtained a cDNA encoding IRAK4, which is 98% identical to REN64. The predicted protein is 84% identical to the mouse protein and, like IRAK1, IRAK2 (OMIM Ref. No. 603304), IRAKM (OMIM Ref. No. 604459), and the Drosophila Pelle protein, it has an N-terminal death domain and a central kinase domain. Unlike the other IRAK proteins, however, but similar to Pelle, IRAK4 has a short C-terminal domain. Northern blot analysis revealed expression of 3.0- and 4.4-kb transcripts, with strongest expression in kidney and liver. RT-PCR analysis detected wide, low-level expression of IRAK4. Functional analysis by Li et al. (2002) determined that IRAK4, like IRAK1 and Pelle, has auto - and cross-phosphorylation kinase activity. Precipitation and binding analyses showed weak interaction between IRAK4 and IRAK1, but IRAK4 did not interact with other IRAK family members. Overexpressed IRAK4 interacted with MYD88 (OMIM Ref. No. 602170) and TRAF6 (OMIM Ref. No. 602355) and activated mitogen-activated protein kinase (MAPK) and nuclear factor kappa-B (NFKB; 164011) pathways. Endogenous IRAK4 associated in a transient IL1 (see OMIM Ref. No. 147720)-dependent manner with unmodified IRAK1 and TRAF6. Luciferase reporter analysis showed that IRAK4 lacking the kinase domain inhibited IL1-but not tumor necrosis factor (TNF; 191160)-induced NFKB and IRAK1 activation. SDS-PAGE and autoradiographic analysis indicated that IRAK4 phosphorylates and activates IRAK1 at thr387, but not vice versa. Li et al. (2002) proposed that IRAK4 acts upstream of other IRAKs and may function as an IRAK1 kinase, triggering a cascade of phosphorylation events By gene targeting, Suzuki et al. (2002) generated mice deficient in Irak4. Mutant mice and macrophages or embryonic fibroblasts (MEFs) from these mice were unable to respond to Il1 by production of Il6 (OMIM Ref. No. 147620), Tnf, or nitric oxide, or by activation of Nfkb or Jnk (OMIM Ref. No. 601158). Responses to Tnf, however, were intact, suggesting that the defect was specific for Il1. Analysis of responses to lipopolysaccharide (LPS), bacterial DNA (unmethylated CpG), peptidoglycan, or viral RNA extended the importance of Irak4 to Tlr4, Tlr9 (OMIM Ref. No. 605474), Tlr2 (OMIM Ref. No. 603028), and Tlr3 (OMIM Ref. No. 603029), respectively, which use signaling mechanisms similar to IL1R. Challenge of Irak4 -/- mice with lymphocytic choriomeningitis virus showed reduced production of gamma-interferon (IFNG; 147570) by natural killer cells, but no loss of cytolytic function of these cells. Challenge with Staphylococcus aureus was lethal in all mutant mice but not in most wildtype mice. Luciferase reporter analysis suggested that Irak4 acts upstream of Myd88 and Mal (OMIM Ref. No. 606252) and downstream of Traf6.

Animal model experiments lend further support to the function of IRAK4. By gene targeting, Suzuki et al. (2002) generated mice deficient in Irak4. Mutant mice and macrophages or embryonic fibroblasts (MEFs) from these mice were unable to respond to Il1 by production of Il6 (OMIM Ref. No. 147620), Tnf, or nitric oxide, or by activation of Nfkb or Jnk (OMIM Ref. No. 601158). Responses to Tnf, however, were intact, suggesting that the defect was specific for Il1. Analysis of responses to lipopolysaccharide (LPS), bacterial DNA (unmethylated CpG), peptidoglycan, or viral RNA extended the importance of Irak4 to Tlr4, Tlr9 (OMIM Ref. No. 605474), Tlr2 (OMIM Ref. No. 603028), and Tlr3 (OMIM Ref. No. 603029), respectively, which use signaling mechanisms similar to IL1R. Challenge of Irak4 -/- mice with lymphocytic choriomeningitis virus showed reduced production of gamma-interferon (IFNG; 147570) by natural killer cells, but no loss of cytolytic function of these cells. Challenge with Staphylococcus aureus was lethal in all mutant mice but not in most wildtype mice. Luciferase reporter analysis suggested that Irak4 acts upstream of Myd88 and Mal (OMIM Ref. No. 606252) and downstream of Traf6

It is appreciated that the abovementioned animal model for IRAK4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, S.; Strelow, A.; Fontana, E. J.; Wesche, H.: IRAK-4: a novel member of the IRAK family with the properties of an IRAK-kinase. Proc. Nat. Acad. Sci. 99:5567-5572, 2002; and Scanlan, M. J.; Gordon, J. D.; Williamson, B.; Stockert, E.; Bander, N. H.; Jongeneel, V.; Gure, A. O.; Jager, D.; Jager, E.; Knuth, A.; Chen, Y.-T.; Old, L. J.: Antigens recognized b.

Further studies establishing the function and utilities of IRAK4 are found in John Hopkins OMIM database record ID 606883, and in cited publications listed in Table 5, which are hereby incorporated by reference. Itchy homolog e3 ubiquitin protein ligase (mouse) (ITCH, Accession NM_031483.3) is another GAM72 target gene, herein designated TARGET GENE. ITCH BINDING SITE is a target binding site found in the 3' untranslated region of mRNA encoded by ITCH, corresponding to a target binding site such as BINDING SITE I, BINDING SITE II or BINDING SITE III of FIG. 8. Table 4 illustrates the complementarity of the nucleotide sequences of ITCH BINDING SITE, designated SEQ ID:13485, to the nucleotide sequence of GAM72 RNA, herein designated GAM RNA, also designated SEQ ID:342.

Another function of GAM72 is therefore inhibition of Itchy homolog e3 ubiquitin protein ligase (mouse) (ITCH, Accession NM_031483.3), a gene which accepts ubiquitin from an e2 ubiquitin-conjugating enzyme in the form of a thioester and then directly transfers the ubiquitin to targeted substrates. Accordingly, utilities of GAM72 include diagnosis, prevention and treatment of diseases and clinical conditions associated with ITCH.

The function of ITCH has been established by previous studies. Using GST pull-down and coimmunoprecipitation experiments, Winberg et al. (2000) demonstrated that ITCH and KIAA0439 (OMIM Ref. No. 606384) form physiologic complexes with the Epstein-Barr virus (EBV) latent membrane protein 2a (LMP2A) in EBV- positive cells. They concluded that the ability of LMP2A to recognize the WW domains of ITCH or KIAA0439 is dependent on the LMP2A PPPPY motifs. Using chimeric protein analysis, they determined that the N-terminal region of LMP2A is necessary and sufficient for binding to ITCH and that this interaction is not dependent on tyrosine phosphorylation. The authors hypothesized that LMP2A promotes ITCH-mediated ubiquitination of Lyn (OMIM Ref. No. 165120) and Syk (OMIM Ref. No. 600085). With GST pull-down assays and immunoprecipitation assay, Qiu et al. (2000) demonstrated that Itch binds to the N-terminal portion of the Notch (see OMIM Ref. No. 190198) intracellular domain via its WW domains and promotes ubiquitination of Notch through its HECT ubiquitin ligase domain. They hypothesized that Itch may participate in the regulation of immune responses by modifying Notch-mediated signaling. Using transfection experiments, Chen et al. (2001) concluded that ITCH can act as a transcriptional corepressor of p45/NFE2. The interaction between these 2 proteins is modulated through the WW1 domain of ITCH and requires the PY motif of p45/NFE2. In cotransfection assay, they observed that ITCH suppressed transcriptional activation by p45/NFE2. They hypothesized that the erythroid hyperplasia observed in a18H mice (see OMIM Ref. No. Animal Model section) is likely due to the loss of NFE2/ITCH interaction.

Animal model experiments lend further support to the function of ITCH. By analyzing genomic clones from wildtype and mutant mice, Perry et al. (1998) determined that the phenotype of the non-agouti-lethal 18H (a18H) or Itchy mice results from a small inversion that disrupts both the agouti and the Itch genes. The mice develop a spectrum of immunologic diseases not seen in other mice with mutations in agouti. The phenotype includes inflammation of the lung and stomach, hyperplasia of lymphoid and hematopoietic cells, and constant itching in the skin, suggesting that Itch is involved in the regulation of immune response. The inversion in a18H mice appears to produce a null allele of Itch by removing the promoter from the coding region of the Itch gene. Perry et al. (1998) concluded that the a18H mutation provides a link between ubiquitin-dependent proteolysis and normal immune function in vivo in addition to identifying a molecule important for the regulation of epithelial and hematopoietic cell growth. D'Andrea and Serhan (1998) presented models of how the disruption of the Itch locus may cause the immune reaction seen in a18H mice and discussed the implications for possible functions of Itch It is appreciated that the abovementioned animal model for ITCH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Perry, W. L.; Hustad, C. M.; Swing, D. A.; O'Sullivan, T. N.; Jenkins, N. A.; Copeland, N. G.: The itchy locus encodes a novel ubiquitin protein ligase that is disrupted in a18H mice. Nature Genet. 18:143-146, 1998; and Chen, X.; Wen, S.; Fukuda, M. N.; Gavva, N. R.; Hsu, D.; Akama, T. O.; Yang-Feng, T.; Shen, C. K. J.: Human ITCH is a coregulator of the hematopoietic transcription factor NF-E2. Genomi.

Further studies establishing the function and utilities of ITCH are found in John Hopkins OMIM database record ID 606409, and in cited publications listed in Table 5, which are hereby incorporated by reference. KBRAS2 (Accession NM_017595.2) is another GAM72 target gene, herein designated TARGET GENE. KBRAS2 BINDING SITE is a target binding site found in the 5' untranslated region of mRNA encoded by KBRAS2, corresponding to a target binding site such as BINDING SITE I, BINDING SITE II or BINDING SITE III of FIG. 8. Table 4 illustrates the complementarity of the nucleotide sequences of KBRAS2 BINDING SITE, designated SEQ ID:16138, to the nucleotide sequence of GAM72 RNA, herein designated GAM RNA, also designated SEQ ID:342.

Another function of GAM72 is therefore inhibition of KBRAS2 (Accession NM_017595.2). Accordingly, utilities of GAM72 include diagnosis, prevention and treatment of diseases and clinical conditions associated with KBRAS2.

Potassium voltage-gated channel, shaker-related subfamily, member 7 (KCNA7, Accession NM_031886.2) is another GAM72 target gene, herein designated TARGET GENE. KCNA7 BINDING SITE1 and KCNA7 BINDING SITE2 are target binding sites found in untranslated regions of mRNA encoded by KCNA7, corresponding to target binding sites such as BINDING SITE I, BINDING SITE II or BINDING SITE III of FIG. 8. Table 4 illustrates the complementarity of the nucleotide sequences of KCNA7 BINDING SITE1 and KCNA7 BINDING SITE2, designated SEQ ID:13270 and SEQ ID:15078 respectively, to the nucleotide sequence of GAM72 RNA, herein designated GAM RNA, also designated SEQ ID:342.

Another function of GAM72 is therefore inhibition of Potassium voltage-gated channel, shaker-related subfamily, member 7 (KCNA7, Accession NM_031886.2), a gene which allows nerve cells to efficiently repolarize following an action potential. Accordingly, utilities of GAM72 include diagnosis, prevention and treatment of diseases and clinical conditions associated with KCNA7.

The function of KCNA7 has been established by previous studies. See 176260 for a general discussion of potassium voltage-gated ion channels. Using a probe from the mouse in the study of somatic cell hybrids, McPherson et al. (1991) found that a seventh member of the Shaker-related potassium voltage-gated channel is encoded by a gene on chromosome 19. Kalman et al. (1998) reported the isolation of the mouse voltage-gated Shaker-related potassium channel gene, Kv1.7 (Kcna7). Unlike other known Kv1 family genes that have intronless coding regions, the protein-coding region of Kv1.7 was interrupted by a 1.9-kb intron. The gene was mapped to mouse chromosome 7 and human chromosome 19q13.3. The mouse Kv1.7 channel was voltage-dependent and exhibited cumulative inactivation. Northern blot analysis revealed transcripts of approximately 3 kb in mouse heart and skeletal muscle. Bardien-Kruger et al. (2002) deduced the coding region of KCNA7 by aligning the mouse cDNA sequence with a human BAC clone and mouse EST sequences. The region encodes a protein of 456 amino acid residues containing cytoplasmic N- and C-termini, a central core domain composed of 6 transmembrane segments and the characteristic pore- loop. The human intron was 1153 bp in length and smaller than that of mouse (1929 bp). Using the deduced amino acid sequences, the potassium-channels of the 2 species were highly conserved (greater than 95%). The expression of KCNA7 in human adult heart was confirmed by RT-PCR studies. Bardien-Kruger et al. (2002) refined the location of the KCNA7 gene within chromosome 19q13.3 by bioinformatic in silico mapping and implicated it as a positional candidate gene for progressive familial heart block type I (OMIM Ref. No. 604559), an autosomal dominant cardiac conduction disorder mapped to 19q13.3. In affected individuals, Bardien-Kruger et al. (2002) screened the coding region of KCNA7 by PCR-SSCP analysis and direct DNA sequencing, which did not reveal any pathogenic sequence changes Full details of the abovementioned studies are described in the following publications, the disclosure of which are hereby incorporated by reference:

Bardien-Kruger, S.; Wulff, H.; Arieff, Z.; Brink, P.; Chandy, K. G.; Corfield, V. : Characterisation of the human voltage-gated potassium channel gene, KCNA7, a candidate gene for inherited cardiac disorders, and its exclusion as cause of progressive familial heart block I (PFHBI). Europ. J. Hum. Genet. 10:36-43, 2002; and Kalman, K.; Nguyen, A.; Tseng-Crank, J.; Dukes, I. D.; Chandy, G.; Hustad, C. M.; Copeland, N. G.; Jenkins, N. A.; Mohrenweiser, H.; Brandriff, B.; Cahalan, M.; Gutman, G. A.; Chandy, K.

Further studies establishing the function and utilities of KCNA7 are found in John Hopkins OMIM database record ID 176268, and in cited publications listed in Table 5, which are hereby incorporated by reference. Potassium inwardly-rectifying channel, subfamily j, member 5 (KCNJ5, Accession NM_000890.3) is another GAM72 target gene, herein designated TARGET GENE. KCNJ5 BINDING SITE is a target binding site found in the 3' untranslated region of mRNA encoded by KCNJ5, corresponding to a target binding site such as BINDING SITE I, BINDING SITE II or BINDING SITE III of FIG. 8. Table 4 illustrates the complementarity of the nucleotide sequences of KCNJ5 BINDING SITE, designated SEQ ID:12729, to the nucleotide sequence of GAM72 RNA, herein designated GAM RNA, also designated SEQ ID:342.

Another function of GAM72 is therefore inhibition of Potassium inwardly-rectifying channel, subfamily j, member 5 (KCNJ5, Accession NM_000890.3), a gene which is a potassium inwardly-rectifying channel. Accordingly, utilities of GAM72 include diagnosis, prevention and treatment of diseases and clinical conditions associated with KCNJ5.

The function of KCNJ5 has been established by previous studies. Potassium channels inhibited by cytosolic ATP are found in a wide variety of tissues. Tucker et al. (1995) noted that in the pancreatic beta-cell, potassium channels play a critical role in the regulation of insulin secretion, and in smooth muscle they are responsible for hypoxic vasodilatation. Moreover, these channels are the targets for several important classes of therapeutic drugs, including the antidiabetic sulfonamides and the antihypertensive potassium channel openers. In the heart, as in other tissues, K(ATP) channels are thought to couple the membrane potential to the metabolic status of the cell, and these normally quiescent channels are activated during transient ischemic and hypoxic periods when they contribute to shortening of the cardiac action potential duration. Ashford et al. (1994) cloned the rat heart K(ATP) channel, thus enabling the isolation of the human homolog. The primary structure of KATP1 placed it in the J subfamily of inwardly rectifying potassium channels (Bond et al., 1994), such as KCNJ2 (OMIM Ref. No. 600681) and KCNJ4 (OMIM Ref. No. 600504); thus, the human homolog was designated KCNJ5. Wickman et al. (1997) reported a partial sequence of human GIRK4. They used human/rodent somatic cell hybrids to localize the human gene to chromosome 11, consistent with previous studies that localized the gene to 11q23-ter. Wickman et al. (1997) cloned the mouse Girk4 gene. They showed that the gene is expressed almost exclusively in the mouse heart. Using interspecific backcross analysis, Wickman et al. (1997) mapped the mouse Girk4 gene to chromosome 9, consistent with the mapping to human chromosome 11.

Full details of the abovementioned studies are described in the following publications, the disclosure of which are hereby incorporated by reference:

Ashford, M. L. J.; Bond, C. T.; Blair, T. A.; Adelman, J. P.: Cloning and functional expression of a rat heart KATP channel. Nature 370:456-459, 1994; and Bond, C. T.; Pessia, M.; Xia, X.-M.; Lagrutta, A.; Kavanaugh, M. P.; Adelman, J. P.: Cloning and expression of a family of inward rectifier potassium channels. Receptors Channels 2:183.

Further studies establishing the function and utilities of KCNJ5 are found in John Hopkins OMIM database record ID 600734, and in cited publications listed in Table 5, which are hereby incorporated by reference. Potassium channel, subfamily k, member 6 (KCNK6, Accession NM_004823.1) is another GAM72 target gene, herein designated TARGET GENE. KCNK6 BINDING SITE is a target binding site found in the 3' untranslated region of mRNA encoded by KCNK6, corresponding to a target binding site such as BINDING SITE I, BINDING SITE II or BINDING SITE III of FIG. 8. Table 4 illustrates the complementarity of the nucleotide sequences of KCNK6 BINDING SITE, designated SEQ ID:4740, to the nucleotide sequence of GAM72 RNA, herein designated GAM RNA, also designated SEQ ID:342.

Another function of GAM72 is therefore inhibition of Potassium channel, subfamily k, member 6 (KCNK6, Accession NM_004823.1), a gene which is an inward rectifying potassium channel protein. Accordingly, utilities of GAM72 include diagnosis, prevention and treatment of diseases and clinical conditions associated with KCNK6.

The function of KCNK6 has been established by previous studies. Potassium channels perform many distinct functions in both excitable and nonexcitable cells. Members of the tandem pore domain potassium (K2P) channel family, such as TWIK1 (OMIM Ref. No. 601745) and TREK (OMIM Ref. No. 603219), contain 4 transmembrane domains and 2 pore-forming (P) domains. The K2P channels all produce quasi-instantaneous and noninactivating currents but exhibit different types of regulation, indicating that these potassium channels are probably involved in a great diversity of physiologic and pathophysiologic roles (Salinas et al., 1999). Both Chavez et al. (1999) and Pountney et al. (1999) identified cDNAs encoding human KCNK6, which they referred to as TWIK2 and TOSS (TWIK-originated similarity sequence), respectively. Chavez et al. (1999) reported that the predicted 313-amino acid TWIK2 protein shares 54% sequence similarity with TWIK1. Pountney et al. (1999) stated that since TOSS lacks a signal sequence, the N terminus is predicted to be intracellular. They noted that the P2 domain of TOSS contains an unusual GLG motif in a position corresponding to that found in TWIK1. While Chavez et al. (1999) found by Northern blot analysis that the 6.8-, 2.6-, and 1.35-kb TWIK2 mRNAs were expressed in many human tissues, Pountney et al. (1999) reported a more restricted expression pattern. In Xenopus oocytes expressing TWIK2, Chavez et al. (1999) detected noninactivating, weak inward rectification, while Pountney et al. (1999) failed to detect any currents above background. By radiation hybrid analysis, Gray et al. (1999) mapped the KCNK6 gene to chromosome 19q13.1.

Full details of the abovementioned studies are described in the following publications, the disclosure of which are hereby incorporated by reference:

Chavez, R. A.; Gray, A. T.; Zhao, B. B.; Kindler, C. H.; Mazurek, M. J.; Mehta, Y.; Forsayeth, J. R.; Yost, C. S.: TWIK-2, a new weak inward rectifying member of the tandem pore domain potassium channel family. J. Biol. Chem. 274:7887-7892, 1999; and Gray, A. T.; Kindler, C. H.; Sampson, E. R.; Yost, C. S.: Assignment of KCNK6 encoding the human weak inward rectifier potassium channel TWIK-2 to chromosome band 19q13.1 by radiation.

Further studies establishing the function and utilities of KCNK6 are found in John Hopkins OMIM database record ID 603939, and in cited publications listed in Table 5, which are hereby incorporated by reference. KIAA0057 (Accession) is another GAM72 target gene, herein designated TARGET GENE. KIAA0057 BINDING SITE is a target binding site found in the 3' untranslated region of mRNA encoded by KIAA0057, corresponding to a target binding site such as BINDING SITE I, BINDING SITE II or BINDING SITE III of FIG. 8. Table 4 illustrates the complementarity of the nucleotide sequences of KIAA0057 BINDING SITE, designated SEQ ID:8437, to the nucleotide sequence of GAM72 RNA, herein designated GAM RNA, also designated SEQ ID:342.

Another function of GAM72 is therefore inhibition of KIAA0057 (Accession). Accordingly, utilities of GAM72 include diagnosis, prevention and treatment of diseases and clinical conditions associated with KIAA0057.

KIAA0090 (Accession NM_015047.1) is another GAM72 target gene, herein designated TARGET GENE. KIAA0090 BINDING SITE is a target binding site found in the 3' untranslated region of mRNA encoded by KIAA0090, corresponding to a target binding site such as BINDING SITE I, BINDING SITE II or BINDING SITE III of FIG. 8. Table 4 illustrates the complementarity of the nucleotide sequences of KIAA0090 BINDING SITE, designated SEQ ID:5892, to the nucleotide sequence of GAM72 RNA, herein designated GAM RNA, also designated SEQ ID:342.

Another function of GAM72 is therefore inhibition of KIAA0090 (Accession NM_015047.1). Accordingly, utilities of GAM72 include diagnosis, prevention and treatment of diseases and clinical conditions associated with KIAA0090.

KIAA0391 (Accession NM_014672.1) is another GAM72 target gene, herein designated TARGET GENE. KIAA0391 BINDING SITE is a target binding site found in the 3' untranslated region of mRNA encoded by KIAA0391, corresponding to a target binding site such as BINDING SITE I, BINDING SITE II or BINDING SITE III of FIG. 8. Table 4 illustrates the complementarity of the nucleotide sequences of KIAA0391 BINDING SITE, designated SEQ ID:19903, to the nucleotide sequence of GAM72 RNA, herein designated GAM RNA, also designated SEQ ID:342.

Another function of GAM72 is therefore inhibition of KIAA0391 (Accession NM_014672.1). Accordingly, utilities of GAM72 include diagnosis, prevention and treatment of diseases and clinical conditions associated with KIAA0391.

KIAA0419 (Accession NM_014711.1) is another GAM72 target gene, herein designated TARGET GENE. KIAA0419 BINDING SITE is a target binding site found in the 3' untranslated region of mRNA encoded by KIAA0419, corresponding to a target binding site such as BINDING SITE I, BINDING SITE II or BINDING SITE III of FIG. 8. Table 4 illustrates the complementarity of the nucleotide sequences of KIAA0419 BINDING SITE, designated SEQ ID:11980, to the nucleotide sequence of GAM72 RNA, herein designated GAM RNA, also designated SEQ ID:342.

Another function of GAM72 is therefore inhibition of KIAA0419 (Accession NM_014711.1). Accordingly, utilities of GAM72 include diagnosis, prevention and treatment of diseases and clinical conditions associated with KIAA0419.

KIAA0447 (Accession) is another GAM72 target gene, herein designated TARGET GENE. KIAA0447 BINDING SITE is a target binding site found in the 3' untranslated region of mRNA encoded by KIAA0447, corresponding to a target binding site such as BINDING SITE I, BINDING SITE II or BINDING SITE III of FIG. 8. Table 4 illustrates the complementarity of the nucleotide sequences of KIAA0447 BINDING SITE, designated SEQ ID:7417, to the nucleotide sequence of GAM72 RNA, herein designated GAM RNA, also designated SEQ ID:342.

Another function of GAM72 is therefore inhibition of KIAA0447 (Accession). Accordingly, utilities of GAM72 include diagnosis, prevention and treatment of diseases and clinical conditions associated with KIAA0447.

KIAA0451 (Accession) is another GAM72 target gene, herein designated TARGET GENE. KIAA0451 BINDING SITE is a target binding site found in the 5' untranslated region of mRNA encoded by KIAA0451, corresponding to a target binding site such as BINDING SITE I, BINDING SITE II or BINDING SITE III of FIG. 8. Table 4 illustrates the complementarity of the nucleotide sequences of KIAA0451 BINDING SITE, designated SEQ ID:3255, to the nucleotide sequence of GAM72 RNA, herein designated GAM RNA, also designated SEQ ID:342.

Another function of GAM72 is therefore inhibition of KIAA0451 (Accession). Accordingly, utilities of GAM72 include diagnosis, prevention and treatment of diseases and clinical conditions associated with KIAA0451.

KIAA0475 (Accession XM_301133.1) is another GAM72 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:587, to the nucleotide sequence of GAM72 RNA, herein designated GAM RNA, also designated SEQ ID:342.

Another function of GAM72 is therefore inhibition of KIAA0475 (Accession XM_301133.1). Accordingly, utilities of GAM72 include diagnosis, prevention and treatment of diseases and clinical conditions associated with KIAA0475.

KIAA0547 (Accession) is another GAM72 target gene, herein designated TARGET GENE. KIAA0547 BINDING SITE is a target binding site found in the 3' untranslated region of mRNA encoded by KIAA0547, corresponding to a target binding site such as BINDING SITE I, BINDING SITE II or BINDING SITE III of FIG. 8. Table 4 illustrates the complementarity of the nucleotide sequences of KIAA0547 BINDING SITE, designated SEQ ID:1327, to the nucleotide sequence of GAM72 RNA, herein designated GAM RNA, also designated SEQ ID:342.

Another function of GAM72 is therefore inhibition of KIAA0547 (Accession). Accordingly, utilities of GAM72 include diagnosis, prevention and treatment of diseases and clinical conditions associated with KIAA0547.

KIAA0565 (Accession XM_039912.4) is another GAM72 target gene, herein designated TARGET GENE. KIAA0565 BINDING SITE is a target binding site found in the 3' untranslated region of mRNA encoded by KIAA0565, corresponding to a target binding site such as BINDING SITE I, BINDING SITE II or BINDING SITE III of FIG. 8. Table 4 illustrates the complementarity of the nucleotide sequences of KIAA0565 BINDING SITE, designated SEQ ID:16513, to the nucleotide sequence of GAM72 RNA, herein designated GAM RNA, also designated SEQ ID:342.

Another function of GAM72 is therefore inhibition of KIAA0565 (Accession XM_039912.4). Accordingly, utilities of GAM72 include diagnosis, prevention and treatment of diseases and clinical conditions associated with KIAA0565.

KIAA0596 (Accession) is another GAM72 target gene, herein designated TARGET GENE. KIAA0596 BINDING SITE is a target binding site found in the 5' untranslated region of mRNA encoded by KIAA0596, corresponding to a target binding site such as BINDING SITE I, BINDING SITE II or BINDING SITE III of FIG. 8. Table 4 illustrates the complementarity of the nucleotide sequences of KIAA0596 BINDING SITE, designated SEQ ID:19199, to the nucleotide sequence of GAM72 RNA, herein designated GAM RNA, also designated SEQ ID:342.

Another function of GAM72 is therefore inhibition of KIAA0596 (Accession). Accordingly, utilities of GAM72 include diagnosis, prevention and treatment of diseases and clinical conditions associated with KIAA0596.

KIAA0628 (Accession NM_014789.1) is another GAM72 target gene, herein designated TARGET GENE. KIAA0628 BINDING SITE is a target binding site found in the 3' untranslated region of mRNA encoded by KIAA0628, corresponding to a target binding site such as BINDING SITE I, BINDING SITE II or BINDING SITE III of FIG. 8. Table 4 illustrates the complementarity of the nucleotide sequences of KIAA0628 BINDING SITE, designated SEQ ID:8071, to the nucleotide sequence of GAM72 RNA, herein designated GAM RNA, also designated SEQ ID:342.

Another function of GAM72 is therefore inhibition of KIAA0628 (Accession NM_014789.1). Accordingly, utilities of GAM72 include diagnosis, prevention and treatment of diseases and clinical conditions associated with KIAA0628.

KIAA0694 (Accession XM_051970.3) is another GAM72 target gene, herein designated TARGET GENE. KIAA0694 BINDING SITE is a target binding site found in the 3' untranslated region of mRNA encoded by KIAA0694, corresponding to a target binding site such as BINDING SITE I, BINDING SITE II or BINDING SITE III of FIG. 8. Table 4 illustrates the complementarity of the nucleotide sequences of KIAA0694 BINDING SITE, designated SEQ ID:13722, to the nucleotide sequence of GAM72 RNA, herein designated GAM RNA, also designated SEQ ID:342.

Another function of GAM72 is therefore inhibition of KIAA0694 (Accession XM_051970.3). Accordingly, utilities of GAM72 include diagnosis, prevention and treatment of diseases and clinical conditions associated with KIAA0694.

KIAA0831 (Accession NM_014924.1) is another GAM72 target gene, herein designated TARGET GENE. KIAA0831 BINDING SITE1 and KIAA0831 BINDING SITE2 are target binding sites found in untranslated regions of mRNA encoded by KIAA0831, corresponding to target binding sites such as BINDING SITE I, BINDING SITE II or BINDING SITE III of FIG. 8. Table 4 illustrates the complementarity of the nucleotide sequences of KIAA0831 BINDING SITE1 and KIAA0831 BINDING SITE2, designated SEQ ID:19089 and SEQ ID:6562 respectively, to the nucleotide sequence of GAM72 RNA, herein designated GAM RNA, also designated SEQ ID:342.

Another function of GAM72 is therefore inhibition of KIAA0831 (Accession NM_014924.1). Accordingly, utilities of GAM72 include diagnosis, prevention and treatment of diseases and clinical conditions associated with KIAA0831.

KIAA0884 (Accession XM_046660.4) is another GAM72 target gene, herein designated TARGET GENE. KIAA0884 BINDING SITE is a target binding site found in the 5' untranslated region of mRNA encoded by KIAA0884, corresponding to a target binding site such as BINDING SITE I, BINDING SITE II or BINDING SITE III of FIG. 8. Table 4 illustrates the complementarity of the nucleotide sequences of KIAA0884 BINDING SITE, designated SEQ ID:7518, to the nucleotide sequence of GAM72 RNA, herein designated GAM RNA, also designated SEQ ID:342.

Another function of GAM72 is therefore inhibition of KIAA0884 (Accession XM_046660.4). Accordingly, utilities of GAM72 include diagnosis, prevention and treatment of diseases and clinical conditions associated with KIAA0884.

KIAA0889 (Accession NM_152257.1) is another GAM72 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:17820, to the nucleotide sequence of GAM72 RNA, herein designated GAM RNA, also designated SEQ ID:342.

Another function of GAM72 is therefore inhibition of KIAA0889 (Accession NM_152257.1). Accordingly, utilities of GAM72 include diagnosis, prevention and treatment of diseases and clinical conditions associated with KIAA0889.

KIAA0953 (Accession XM_039733.2) is another GAM72 target gene, herein designated TARGET GENE. KIAA0953 BINDING SITE is a target binding site found in the 3' untranslated region of mRNA encoded by KIAA0953, corresponding to a target binding site such as BINDING SITE I, BINDING SITE II or BINDING SITE III of FIG. 8. Table 4 illustrates the complementarity of the nucleotide sequences of KIAA0953 BINDING SITE, designated SEQ ID:7972, to the nucleotide sequence of GAM72 RNA, herein designated GAM RNA, also designated SEQ ID:342.

Another function of GAM72 is therefore inhibition of KIAA0953 (Accession XM_039733.2). Accordingly, utilities of GAM72 include diagnosis, prevention and treatment of diseases and clinical conditions associated with KIAA0953.

KIAA0981 (Accession XM_028867.2) is another GAM72 target gene, herein designated TARGET GENE. KIAA0981 BINDING SITE is a target binding site found in the 3' untranslated region of mRNA encoded by KIAA0981, corresponding to a target binding site such as BINDING SITE I, BINDING SITE II or BINDING SITE III of FIG. 8. Table 4 illustrates the complementarity of the nucleotide sequences of KIAA0981 BINDING SITE, designated SEQ ID:18398, to the nucleotide sequence of GAM72 RNA, herein designated GAM RNA, also designated SEQ ID:342.

Another function of GAM72 is therefore inhibition of KIAA0981 (Accession XM_028867.2). Accordingly, utilities of GAM72 include diagnosis, prevention and treatment of diseases and clinical conditions associated with KIAA0981.

KIAA1001 (Accession NM_014960.1) is another GAM72 target gene, herein designated TARGET GENE. KIAA1001 BINDING SITE is a target binding site found in the 3' untranslated region of mRNA encoded by KIAA1001, corresponding to a target binding site such as BINDING SITE I, BINDING SITE II or BINDING SITE III of FIG. 8. Table 4 illustrates the complementarity of the nucleotide sequences of KIAA1001 BINDING SITE, designated SEQ ID:3031, to the nucleotide sequence of GAM72 RNA, herein designated GAM RNA, also designated SEQ ID:342.

Another function of GAM72 is therefore inhibition of KIAA1001 (Accession NM_014960.1). Accordingly, utilities of GAM72 include diagnosis, prevention and treatment of diseases and clinical conditions associated with KIAA1001.

KIAA1086 (Accession XM_047610.1) is another GAM72 target gene, herein designated TARGET GENE. KIAA1086 BINDING SITE is a target binding site found in the 3' untranslated region of mRNA encoded by KIAA1086, corresponding to a target binding site such as BINDING SITE I, BINDING SITE II or BINDING SITE III of FIG. 8. Table 4 illustrates the complementarity of the nucleotide sequences of KIAA1086 BINDING SITE, designated SEQ ID:10445, to the nucleotide sequence of GAM72 RNA, herein designated GAM RNA, also designated SEQ ID:342.

Another function of GAM72 is therefore inhibition of KIAA1086 (Accession XM_047610.1). Accordingly, utilities of GAM72 include diagnosis, prevention and treatment of diseases and clinical conditions associated with KIAA1086.

KIAA1143 (Accession XM_044014.3) is another GAM72 target gene, herein designated TARGET GENE. KIAA1143 BINDING SITE is a target binding site found in the 3' untranslated region of mRNA encoded by KIAA1143, corresponding to a target binding site such as BINDING SITE I, BINDING SITE II or BINDING SITE III of FIG. 8. Table 4 illustrates the complementarity of the nucleotide sequences of KIAA1143 BINDING SITE, designated SEQ ID:3668, to the nucleotide sequence of GAM72 RNA, herein designated GAM RNA, also designated SEQ ID:342.

Another function of GAM72 is therefore inhibition of KIAA1143 (Accession XM_044014.3). Accordingly, utilities of GAM72 include diagnosis, prevention and treatment of diseases and clinical conditions associated with KIAA1143.

KIAA1164 (Accession XM_045358.2) is another GAM72 target gene, herein designated TARGET GENE. KIAA1164 BINDING SITE is a target binding site found in the 3' untranslated region of mRNA encoded by KIAA1164, corresponding to a target binding site such as BINDING SITE I, BINDING SITE II or BINDING SITE III of FIG. 8. Table 4 illustrates the complementarity of the nucleotide sequences of KIAA1164 BINDING SITE, designated SEQ ID:16893, to the nucleotide sequence of GAM72 RNA, herein designated GAM RNA, also designated SEQ ID:342.

Another function of GAM72 is therefore inhibition of KIAA1164 (Accession XM_045358.2). Accordingly, utilities of GAM72 include diagnosis, prevention and treatment of diseases and clinical conditions associated with KIAA1164.

KIAA1202 (Accession XM_050478.2) is another GAM72 target gene, herein designated TARGET GENE. KIAA1202 BINDING SITE is a target binding site found in the 3' untranslated region of mRNA encoded by KIAA1202, corresponding to a target binding site such as BINDING SITE I, BINDING SITE II or BINDING SITE III of FIG. 8. Table 4 illustrates the complementarity of the nucleotide sequences of KIAA1202 BINDING SITE, designated SEQ ID:1103, to the nucleotide sequence of GAM72 RNA, herein designated GAM RNA, also designated SEQ ID:342.

Another function of GAM72 is therefore inhibition of KIAA1202 (Accession XM_050478.2). Accordingly, utilities of GAM72 include diagnosis, prevention and treatment of diseases and clinical conditions associated with KIAA1202.

KIAA1204 (Accession) is another GAM72 target gene, herein designated TARGET GENE. KIAA1204 BINDING SITE is a target binding site found in the 3' untranslated region of mRNA encoded by KIAA1204, corresponding to a target binding site such as BINDING SITE I, BINDING SITE II or BINDING SITE III of FIG. 8. Table 4 illustrates the complementarity of the nucleotide sequences of KIAA1204 BINDING SITE, designated SEQ ID:19727, to the nucleotide sequence of GAM72 RNA, herein designated GAM RNA, also designated SEQ ID:342.

Another function of GAM72 is therefore inhibition of KIAA1204 (Accession). Accordingly, utilities of GAM72 include diagnosis, prevention and treatment of diseases and clinical conditions associated with KIAA1204.

KIAA1253 (Accession) is another GAM72 target gene, herein designated TARGET GENE. KIAA1253 BINDING SITE is a target binding site found in the 3' untranslated region of mRNA encoded by KIAA1253, corresponding to a target binding site such as BINDING SITE I, BINDING SITE II or BINDING SITE III of FIG. 8. Table 4 illustrates the complementarity of the nucleotide sequences of KIAA1253 BINDING SITE, designated SEQ ID:16508, to the nucleotide sequence of GAM72 RNA, herein designated GAM RNA, also designated SEQ ID:342.

Another function of GAM72 is therefore inhibition of KIAA1253 (Accession). Accordingly, utilities of GAM72 include diagnosis, prevention and treatment of diseases and clinical conditions associated with KIAA1253.

KIAA1257 (Accession XM_031577.3) is another GAM72 target gene, herein designated TARGET GENE. KIAA1257 BINDING SITE is a target binding site found in the 3' untranslated region of mRNA encoded by KIAA1257, corresponding to a target binding site such as BINDING SITE I, BINDING SITE II or BINDING SITE III of FIG. 8. Table 4 illustrates the complementarity of the nucleotide sequences of KIAA1257 BINDING SITE, designated SEQ ID:8495, to the nucleotide sequence of GAM72 RNA, herein designated GAM RNA, also designated SEQ ID:342.

Another function of GAM72 is therefore inhibition of KIAA1257 (Accession XM_031577.3). Accordingly, utilities of GAM72 include diagnosis, prevention and treatment of diseases and clinical conditions associated with KIAA1257.

KIAA1276 (Accession XM_039169.1) is another GAM72 target gene, herein designated TARGET GENE. KIAA1276 BINDING SITE is a target binding site found in the 3' untranslated region of mRNA encoded by KIAA1276, corresponding to a target binding site such as BINDING SITE I, BINDING SITE II or BINDING SITE III of FIG. 8. Table 4 illustrates the complementarity of the nucleotide sequences of KIAA1276 BINDING SITE, designated SEQ ID:13081, to the nucleotide sequence of GAM72 RNA, herein designated GAM RNA, also designated SEQ ID:342.

Another function of GAM72 is therefore inhibition of KIAA1276 (Accession XM_039169.1). Accordingly, utilities of GAM72 include diagnosis, prevention and treatment of diseases and clinical conditions associated with KIAA1276.

KIAA1348 (Accession XM_043826.5) is another GAM72 target gene, herein designated TARGET GENE. KIAA1348 BINDING SITE is a target binding site found in the 3' untranslated region of mRNA encoded by KIAA1348, corresponding to a target binding site such as BINDING SITE I, BINDING SITE II or BINDING SITE III of FIG. 8. Table 4 illustrates the complementarity of the nucleotide sequences of KIAA1348 BINDING SITE, designated SEQ ID:8164, to the nucleotide sequence of GAM72 RNA, herein designated GAM RNA, also designated SEQ ID:342.

Another function of GAM72 is therefore inhibition of KIAA1348 (Accession XM_043826.5). Accordingly, utilities of GAM72 include diagnosis, prevention and treatment of diseases and clinical conditions associated with KIAA1348.

KIAA1423 (Accession XM_029703.1) is another GAM72 target gene, herein designated TARGET GENE. KIAA1423 BINDING SITE is a target binding site found in the 3' untranslated region of mRNA encoded by KIAA1423, corresponding to a target binding site such as BINDING SITE I, BINDING SITE II or BINDING SITE III of FIG. 8. Table 4 illustrates the complementarity of the nucleotide sequences of KIAA1423 BINDING SITE, designated SEQ ID:2123, to the nucleotide sequence of GAM72 RNA, herein designated GAM RNA, also designated SEQ ID:342.

Another function of GAM72 is therefore inhibition of KIAA1423 (Accession XM_029703.1). Accordingly, utilities of GAM72 include diagnosis, prevention and treatment of diseases and clinical conditions associated with KIAA1423.

KIAA1456 (Accession XM_040100.4) is another GAM72 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:767, to the nucleotide sequence of GAM72 RNA, herein designated GAM RNA, also designated SEQ ID:342.

Another function of GAM72 is therefore inhibition of KIAA1456 (Accession XM_040100.4). Accordingly, utilities of GAM72 include diagnosis, prevention and treatment of diseases and clinical conditions associated with KIAA1456.

KIAA1486 (Accession XM_041126.5) is another GAM72 target gene, herein designated TARGET GENE. KIAA1486 BINDING SITE is a target binding site found in the 3' untranslated region of mRNA encoded by KIAA1486, corresponding to a target binding site such as BINDING SITE I, BINDING SITE II or BINDING SITE III of FIG. 8. Table 4 illustrates the complementarity of the nucleotide sequences of KIAA1486 BINDING SITE, designated SEQ ID:1131, to the nucleotide sequence of GAM72 RNA, herein designated GAM RNA, also designated SEQ ID:342.

Another function of GAM72 is therefore inhibition of KIAA1486 (Accession XM_041126.5). Accordingly, utilities of GAM72 include diagnosis, prevention and treatment of diseases and clinical conditions associated with KIAA1486.

KIAA1508 (Accession XM_290952.1) is another GAM72 target gene, herein designated TARGET GENE. KIAA1508 BINDING SITE is a target binding site found in the 3' untranslated region of mRNA encoded by KIAA1508, corresponding to a target binding site such as BINDING SITE I, BINDING SITE II or BINDING SITE III of FIG. 8. Table 4 illustrates the complementarity of the nucleotide sequences of KIAA1508 BINDING SITE, designated SEQ ID:6930, to the nucleotide sequence of GAM72 RNA, herein designated GAM RNA, also designated SEQ ID:342.

Another function of GAM72 is therefore inhibition of KIAA1508 (Accession XM_290952.1). Accordingly, utilities of GAM72 include diagnosis, prevention and treatment of diseases and clinical conditions associated with KIAA1508.

KIAA1614 (Accession XM_046531.1) is another GAM72 target gene, herein designated TARGET GENE. KIAA1614 BINDING SITE is a target binding site found in the 5' untranslated region of mRNA encoded by KIAA1614, corresponding to a target binding site such as BINDING SITE I, BINDING SITE II or BINDING SITE III of FIG. 8. Table 4 illustrates the complementarity of the nucleotide sequences of KIAA1614 BINDING SITE, designated SEQ ID:18444, to the nucleotide sequence of GAM72 RNA, herein designated GAM RNA, also designated SEQ ID:342.

Another function of GAM72 is therefore inhibition of KIAA1614 (Accession XM_046531.1). Accordingly, utilities of GAM72 include diagnosis, prevention and treatment of diseases and clinical conditions associated with KIAA1614.

KIAA1641 (Accession XM_087167.3) is another GAM72 target gene, herein designated TARGET GENE. KIAA1641 BINDING SITE is a target binding site found in the 3' untranslated region of multiple transcripts of mRNA encoded by KIAA1641, corresponding to a target binding site such as BINDING SITE I, BINDING SITE II or BINDING SITE III of FIG. 8. Table 4 illustrates the complementarity of the nucleotide sequences of KIAA1641 BINDING SITE, designated SEQ ID:1772, to the nucleotide sequence of GAM72 RNA, herein designated GAM RNA, also designated SEQ ID:342.

Another function of GAM72 is therefore inhibition of KIAA1641 (Accession XM_087167.3). Accordingly, utilities of GAM72 include diagnosis, prevention and treatment of diseases and clinical conditions associated with KIAA1641.

KIAA1649 (Accession) is another GAM72 target gene, herein designated TARGET GENE. KIAA1649 BINDING SITE1 and KIAA1649 BINDING SITE2 are target binding sites found in untranslated regions of mRNA encoded by KIAA1649, corresponding to target binding sites such as BINDING SITE I, BINDING SITE II or BINDING SITE III of FIG. 8. Table 4 illustrates the complementarity of the nucleotide sequences of KIAA1649 BINDING SITE1 and KIAA1649 BINDING SITE2, designated SEQ ID:6163 and SEQ ID:12470 respectively, to the nucleotide sequence of GAM72 RNA, herein designated GAM RNA, also designated SEQ ID:342.

Another function of GAM72 is therefore inhibition of KIAA1649 (Accession). Accordingly, utilities of GAM72 include diagnosis, prevention and treatment of diseases and clinical conditions associated with KIAA1649.

KIAA1715 (Accession XM_042834.2) is another GAM72 target gene, herein designated TARGET GENE. KIAA1715 BINDING SITE is a target binding site found in the 3' untranslated region of mRNA encoded by KIAA1715, corresponding to a target binding site such as BINDING SITE I, BINDING SITE II or BINDING SITE III of FIG. 8. Table 4 illustrates the complementarity of the nucleotide sequences of KIAA1715 BINDING SITE, designated SEQ ID:11201, to the nucleotide sequence of GAM72 RNA, herein designated GAM RNA, also designated SEQ ID:342.

Another function of GAM72 is therefore inhibition of KIAA1715 (Accession XM_042834.2). Accordingly, utilities of GAM72 include diagnosis, prevention and treatment of diseases and clinical conditions associated with KIAA1715.

KIAA1727 (Accession XM_034262.6) is another GAM72 target gene, herein designated TARGET GENE. KIAA1727 BINDING SITE is a target binding site found in the 3' untranslated region of mRNA encoded by KIAA1727, corresponding to a target binding site such as BINDING SITE I, BINDING SITE II or BINDING SITE III of FIG. 8. Table 4 illustrates the complementarity of the nucleotide sequences of KIAA1727 BINDING SITE, designated SEQ ID:17480, to the nucleotide sequence of GAM72 RNA, herein designated GAM RNA, also designated SEQ ID:342.

Another function of GAM72 is therefore inhibition of KIAA1727 (Accession XM_034262.6). Accordingly, utilities of GAM72 include diagnosis, prevention and treatment of diseases and clinical conditions associated with KIAA1727.

KIAA1821 (Accession) is another GAM72 target gene, herein designated TARGET GENE. KIAA1821 BINDING SITE is a target binding site found in the 3' untranslated region of mRNA encoded by KIAA1821, corresponding to a target binding site such as BINDING SITE I, BINDING SITE II or BINDING SITE III of FIG. 8. Table 4 illustrates the complementarity of the nucleotide sequences of KIAA1821 BINDING SITE, designated SEQ ID:13832, to the nucleotide sequence of GAM72 RNA, herein designated GAM RNA, also designated SEQ ID:342.

Another function of GAM72 is therefore inhibition of KIAA1821 (Accession). Accordingly, utilities of GAM72 include diagnosis, prevention and treatment of diseases and clinical conditions associated with KIAA1821.

KIAA1829 (Accession XM_030378.2) is another GAM72 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:1448, to the nucleotide sequence of GAM72 RNA, herein designated GAM RNA, also designated SEQ ID:342.

Another function of GAM72 is therefore inhibition of KIAA1829 (Accession XM_030378.2). Accordingly, utilities of GAM72 include diagnosis, prevention and treatment of diseases and clinical conditions associated with KIAA1829.

KIAA1841 (Accession XM_087056.4) is another GAM72 target gene, herein designated TARGET GENE. KIAA1841 BINDING SITE is a target binding site found in the 3' untranslated region of mRNA encoded by KIAA1841, corresponding to a target binding site such as BINDING SITE I, BINDING SITE II or BINDING SITE III of FIG. 8. Table 4 illustrates the complementarity of the nucleotide sequences of KIAA1841 BINDING SITE, designated SEQ ID:17999, to the nucleotide sequence of GAM72 RNA, herein designated GAM RNA, also designated SEQ ID:342.

Another function of GAM72 is therefore inhibition of KIAA1841 (Accession XM_087056.4). Accordingly, utilities of GAM72 include diagnosis, prevention and treatment of diseases and clinical conditions associated with KIAA1841.

KIAA1871 (Accession XM_290737.1) is another GAM72 target gene, herein designated TARGET GENE. KIAA1871 BINDING SITE is a target binding site found in the 3' untranslated region of mRNA encoded by KIAA1871, corresponding to a target binding site such as BINDING SITE I, BINDING SITE II or BINDING SITE III of FIG. 8. Table 4 illustrates the complementarity of the nucleotide sequences of KIAA1871 BINDING SITE, designated SEQ ID:3023, to the nucleotide sequence of GAM72 RNA, herein designated GAM RNA, also designated SEQ ID:342.

Another function of GAM72 is therefore inhibition of KIAA1871 (Accession XM_290737.1). Accordingly, utilities of GAM72 include diagnosis, prevention and treatment of diseases and clinical conditions associated with KIAA1871.

KIAA1872 (Accession NM_033064.1) is another GAM72 target gene, herein designated TARGET GENE. KIAA1872 BINDING SITE is a target binding site found in the 3' untranslated region of mRNA encoded by KIAA1872, corresponding to a target binding site such as BINDING SITE I, BINDING SITE II or BINDING SITE III of FIG. 8. Table 4 illustrates the complementarity of the nucleotide sequences of KIAA1872 BINDING SITE, designated SEQ ID:19477, to the nucleotide sequence of GAM72 RNA, herein designated GAM RNA, also designated SEQ ID:342.

Another function of GAM72 is therefore inhibition of KIAA1872 (Accession NM_033064.1). Accordingly, utilities of GAM72 include diagnosis, prevention and treatment of diseases and clinical conditions associated with KIAA1872.

KIAA1948 (Accession) is another GAM72 target gene, herein designated TARGET GENE. KIAA1948 BINDING SITE is a target binding site found in the 3' untranslated region of mRNA encoded by KIAA1948, corresponding to a target binding site such as BINDING SITE I, BINDING SITE II or BINDING SITE III of FIG. 8. Table 4 illustrates the complementarity of the nucleotide sequences of KIAA1948 BINDING SITE, designated SEQ ID:10715, to the nucleotide sequence of GAM72 RNA, herein designated GAM RNA, also designated SEQ ID:342.

Another function of GAM72 is therefore inhibition of KIAA1948 (Accession). Accordingly, utilities of GAM72 include diagnosis, prevention and treatment of diseases and clinical conditions associated with KIAA1948.

Kinesin family member 1b (KIF1B, Accession NM_015074.1) is another GAM72 target gene, herein designated TARGET GENE. KIF1B BINDING SITE is a target binding site found in the 3' untranslated region of mRNA encoded by KIF1B, corresponding to a target binding site such as BINDING SITE I, BINDING SITE II or BINDING SITE III of FIG. 8. Table 4 illustrates the complementarity of the nucleotide sequences of KIF1B BINDING SITE, designated SEQ ID:17155, to the nucleotide sequence of GAM72 RNA, herein designated GAM RNA, also designated SEQ ID:342.

Another function of GAM72 is therefore inhibition of Kinesin family member 1b (KIF1B, Accession NM_015074.1), a gene which motor for anterograde transport of mitochondria. has a microtubule plus end-directed motility. and therefore is associated with Charcot-marie-tooth disease, neuronal type, a. Accordingly, utilities of GAM72 include diagnosis, prevention and treatment of Charcot-marie- tooth disease, neuronal type, a, and of other diseases and clinical conditions associated with KIF1B.

The function of KIF1B has been established by previous studies. Nangaku et al. (1994) cloned a member of the mouse kinesin superfamily, Kif1b, which encodes an N-terminal-type motor protein. Kif1b was expressed in all tissues tested. In situ hybridization revealed that Kif1b is expressed abundantly in differentiated nerve cells. The authors found that Kif1b works as a monomer, having a microtubule plus-end-directed motility. Rotary shadowing electron microscopy revealed mostly single globular structures. Immunocytochemically, Kif1b was colocalized with mitochondria in vivo. A subcellular fractionation study showed that Kif1b is concentrated in the mitochondrial fraction, and purified Kif1b could transport mitochondria along microtubules in vitro. These data suggested that Kif1b works as a monomeric motor for anterograde transport of mitochondria. Zhao et al. (2001) identified an isoform of mouse Kif1b, which they called Kif1b-beta, that is distinct from Kif1b-alpha (Nangaku et al., 1994) in its cargo-binding domain. Yang et al. (2001) identified the KIF1B gene in a homozygously deleted region of chromosome 1p36.2 in a neuroblastoma cell line. They reported results suggesting that the gene is not a candidate for tumor suppressor gene of neuroblastoma. Northern blot analysis demonstrated that human KIF1B has at least 2 isoforms. The long isoform (KIF1B-beta) was expressed in a wide variety of tissues, while the short isoform (KIF1B-alpha) was detected only in adult testis.

Full details of the abovementioned studies are described in the following publications, the disclosure of which are hereby incorporated by reference:

Yang, H. W.; Chen, Y. Z.; Takita, J.; Soeda, E.; Piao, H. Y.; Hayashi, Y.: Genomic structure and mutational analysis of the human KIF1B gene which is homozygously deleted in neuroblastoma at chromosome 1p36.2. Oncogene 20:5075-5083, 2001; and Nangaku, M.; Sato - Yoshitake, R.; Okada, Y.; Noda, Y.; Takemura, R.; Yamazaki, H.; Hirokawa, N.: KIF1B, a novel microtubule plus end-directed monomeric motor protein for transport of mi.

Further studies establishing the function and utilities of KIF1B are found in John Hopkins OMIM database record ID 605995, and in cited publications listed in Table 5, which are hereby incorporated by reference. Kinesin family member 3b (KIF3B, Accession NM_004798.1) is another GAM72 target gene, herein designated TARGET GENE. KIF3B BINDING SITE is a target binding site found in the 3' untranslated region of mRNA encoded by KIF3B, corresponding to a target binding site such as BINDING SITE I, BINDING SITE II or BINDING SITE III of FIG. 8. Table 4 illustrates the complementarity of the nucleotide sequences of KIF3B BINDING SITE, designated SEQ ID:406, to the nucleotide sequence of GAM72 RNA, herein designated GAM RNA, also designated SEQ ID:342.

Another function of GAM72 is therefore inhibition of Kinesin family member 3b (KIF3B, Accession NM_004798.1), a gene which is a microtubule-based anterograde translocator for membranous organelles. Accordingly, utilities of GAM72 include diagnosis, prevention and treatment of diseases and clinical conditions associated with KIF3B.

The function of KIF3B has been established by previous studies. In eukaryotic cells, proteins and lipids are sorted and transported to their correct destinations at distinct velocities by each organelle or protein complex. Kinesin superfamily proteins are a molecular motor superfamily involved in these processes, conveying their own cargoes along microtubules. Nagase et al. (1997) cloned the KIF3B gene, which they referred to as KIAA0359, the human homolog of the mouse kinase superfamily 3B gene (Yamazaki et al., 1995). The human KIF3B gene encodes a 747-amino acid protein that shares 98% identity with the mouse Kif3b protein. RT-PCR analysis revealed that the KIF3B gene was ubiquitously expressed in all human tissues tested. By analysis of radiation hybrid panels, Nagase et al. (1997) mapped the KIF3B gene to chromosome 20

Animal model experiments lend further support to the function of KIF3B. By gene targeting, Nonaka et al. (1998) disrupted the murine Kif3b gene. The null mutants did not survive beyond midgestation, exhibiting growth retardation, pericardial sac ballooning, and neural tube disorganization. Prominently, the left-right asymmetry was randomized in the heart loop and the direction of embryonic turning. Lefty- 2 (OMIM Ref. No. 603037) expression was either bilateral or absent. Furthermore, the node lacked monocilia while the basal bodies were present. Immunocytochemistry revealed Kif3b localization in wildtype nodal cilia. Video microscopy showed that these cilia were motile and generated a leftward flow. These data suggested that KIF3B is essential for the left-right determination through intraciliary transportation of materials for ciliogenesis of motile primary cilia that could produce a gradient of putative morphogen along the left-right axis in the node It is appreciated that the abovementioned animal model for KIF3B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4:141-150, 1997; and Nonaka, S.; Tanaka, Y.; Okada, Y.; Takeda, S.; Harada, A.; Kanai, Y.; Kido, M.; Hirokawa, N.: Randomization of left-right asymmetry due to loss of nodal cilia generating leftward flow.

Further studies establishing the function and utilities of KIF3B are found in John Hopkins OMIM database record ID 603754, and in cited publications listed in Table 5, which are hereby incorporated by reference. Kelch-like 6 (drosophila) (KLHL6, Accession NM_130446.1) is another GAM72 target gene, herein designated TARGET GENE. KLHL6 BINDING SITE is a target binding site found in the 3' untranslated region of mRNA encoded by KLHL6, corresponding to a target binding site such as BINDING SITE I, BINDING SITE II or BINDING SITE III of FIG. 8. Table 4 illustrates the complementarity of the nucleotide sequences of KLHL6 BINDING SITE, designated SEQ ID:7713, to the nucleotide sequence of GAM72 RNA, herein designated GAM RNA, also designated SEQ ID:342.

Another function of GAM72 is therefore inhibition of Kelch-like 6 (drosophila) (KLHL6, Accession NM_130446.1). Accordingly, utilities of GAM72 include diagnosis, prevention and treatment of diseases and clinical conditions associated with KLHL6.

KR18 (Accession NM_033288.1) is another GAM72 target gene, herein designated TARGET GENE. KR18 BINDING SITE is a target binding site found in the 3' untranslated region of mRNA encoded by KR18, corresponding to a target binding site such as BINDING SITE I, BINDING SITE II or BINDING SITE III of FIG. 8. Table 4 illustrates the complementarity of the nucleotide sequences of KR18 BINDING SITE, designated SEQ ID:11484, to the nucleotide sequence of GAM72 RNA, herein designated GAM RNA, also designated SEQ ID:342.

Another function of GAM72 is therefore inhibition of KR18 (Accession NM_033288.1). Accordingly, utilities of GAM72 include diagnosis, prevention and treatment of diseases and clinical conditions associated with KR18.

LOC113523 (Accession) is another GAM72 target gene, herein designated TARGET GENE. LOC113523 BINDING SITE is a target binding site found in the 3' untranslated region of mRNA encoded by LOC113523, corresponding to a target binding site such as BINDING SITE I, BINDING SITE II or BINDING SITE III of FIG. 8. Table 4 illustrates the complementarity of the nucleotide sequences of LOC113523 BINDING SITE, designated SEQ ID:11541, to the nucleotide sequence of GAM72 RNA, herein designated GAM RNA, also designated SEQ ID:342.

Another function of GAM72 is therefore inhibition of LOC113523 (Accession). Accordingly, utilities of GAM72 include diagnosis, prevention and treatment of diseases and clinical conditions associated with LOC113523.

LOC115129 (Accession XM_055292.1) is another GAM72 target gene, herein designated TARGET GENE. LOC115129 BINDING SITE is a target binding site found in the 3' untranslated region of mRNA encoded by LOC115129, corresponding to a target binding site such as BINDING SITE I, BINDING SITE II or BINDING SITE III of FIG. 8. Table 4 illustrates the complementarity of the nucleotide sequences of LOC115129 BINDING SITE, designated SEQ ID:16505, to the nucleotide sequence of GAM72 RNA, herein designated GAM RNA, also designated SEQ ID:342.

Another function of GAM72 is therefore inhibition of LOC115129 (Accession XM_055292.1). Accordingly, utilities of GAM72 include diagnosis, prevention and treatment of diseases and clinical conditions associated with LOC115129.

LOC115196 (Accession) is another GAM72 target gene, herein designated TARGET GENE. LOC115196 BINDING SITE is a target binding site found in the 3' untranslated region of mRNA encoded by LOC115196, corresponding to a target binding site such as BINDING SITE I, BINDING SITE II or BINDING SITE III of FIG. 8. Table 4 illustrates the complementarity of the nucleotide sequences of LOC115196 BINDING SITE, designated SEQ ID:16754, to the nucleotide sequence of GAM72 RNA, herein designated GAM RNA, also designated SEQ ID:342.

Another function of GAM72 is therefore inhibition of LOC115196 (Accession). Accordingly, utilities of GAM72 include diagnosis, prevention and treatment of diseases and clinical conditions associated with LOC115196.

LOC115273 (Accession) is another GAM72 target gene, herein designated TARGET GENE. LOC115273 BINDING SITE is a target binding site found in the 3' untranslated region of mRNA encoded by LOC115273, corresponding to a target binding site such as BINDING SITE I, BINDING SITE II or BINDING SITE III of FIG. 8. Table 4 illustrates the complementarity of the nucleotide sequences of LOC115273 BINDING SITE, designated SEQ ID:8356, to the nucleotide sequence of GAM72 RNA, herein designated GAM RNA, also designated SEQ ID:342.

Another function of GAM72 is therefore inhibition of LOC115273 (Accession). Accordingly, utilities of GAM72 include diagnosis, prevention and treatment of diseases and clinical conditions associated with LOC115273.

LOC115757 (Accession) is another GAM72 target gene, herein designated TARGET GENE. LOC115757 BINDING SITE is a target binding site found in the 3' untranslated region of mRNA encoded by LOC115757, corresponding to a target binding site such as BINDING SITE I, BINDING SITE II or BINDING SITE III of FIG. 8. Table 4 illustrates the complementarity of the nucleotide sequences of LOC115757 BINDING SITE, designated SEQ ID:3024, to the nucleotide sequence of GAM72 RNA, herein designated GAM RNA, also designated SEQ ID:342.

Another function of GAM72 is therefore inhibition of LOC115757 (Accession). Accordingly, utilities of GAM72 include diagnosis, prevention and treatment of diseases and clinical conditions associated with LOC115757.

LOC115861 (Accession NM_138454.1) is another GAM72 target gene, herein designated TARGET GENE. LOC115861 BINDING SITE is a target binding site found in the 3' untranslated region of mRNA encoded by LOC115861, corresponding to a target binding site such as BINDING SITE I, BINDING SITE II or BINDING SITE III of FIG. 8. Table 4 illustrates the complementarity of the nucleotide sequences of LOC115861 BINDING SITE, designated SEQ ID:8383, to the nucleotide sequence of GAM72 RNA, herein designated GAM RNA, also designated SEQ ID:342.

Another function of GAM72 is therefore inhibition of LOC115861 (Accession NM_138454.1). Accordingly, utilities of GAM72 include diagnosis, prevention and treatment of diseases and clinical conditions associated with LOC115861.

LOC116143 (Accession NM_138458.1) is another GAM72 target gene, herein designated TARGET GENE. LOC116143 BINDING SITE is a target binding site found in the 3' untranslated region of mRNA encoded by LOC116143, corresponding to a target binding site such as BINDING SITE I, BINDING SITE II or BINDING SITE III of FIG. 8. Table 4 illustrates the complementarity of the nucleotide sequences of LOC116143 BINDING SITE, designated SEQ ID:8282, to the nucleotide sequence of GAM72 RNA, herein designated GAM RNA, also designated SEQ ID:342.

Another function of GAM72 is therefore inhibition of LOC116143 (Accession NM_138458.1). Accordingly, utilities of GAM72 include diagnosis, prevention and treatment of diseases and clinical conditions associated with LOC116143.

LOC116236 (Accession XM_057674.5) is another GAM72 target gene, herein designated TARGET GENE. LOC116236 BINDING SITE is a target binding site found in the 3' untranslated region of mRNA encoded by LOC116236, corresponding to a target binding site such as BINDING SITE I, BINDING SITE II or BINDING SITE III of FIG. 8. Table 4 illustrates the complementarity of the nucleotide sequences of LOC116236 BINDING SITE, designated SEQ ID:10907, to the nucleotide sequence of GAM72 RNA, herein designated GAM RNA, also designated SEQ ID:342.

Another function of GAM72 is therefore inhibition of LOC116236 (Accession XM_057674.5). Accordingly, utilities of GAM72 include diagnosis, prevention and treatment of diseases and clinical conditions associated with LOC116236.

LOC118471 (Accession NM_145202.1) is another GAM72 target gene, herein designated TARGET GENE. LOC118471 BINDING SITE is a target binding site found in the 3' untranslated region of mRNA encoded by LOC118471, corresponding to a target binding site such as BINDING SITE I, BINDING SITE II or BINDING SITE III of FIG. 8. Table 4 illustrates the complementarity of the nucleotide sequences of LOC118471 BINDING SITE, designated SEQ ID:14292, to the nucleotide sequence of GAM72 RNA, herein designated GAM RNA, also designated SEQ ID:342.

Another function of GAM72 is therefore inhibition of LOC118471 (Accession NM_145202.1). Accordingly, utilities of GAM72 include diagnosis, prevention and treatment of diseases and clinical conditions associated with LOC118471.

LOC122970 (Accession) is another GAM72 target gene, herein designated TARGET GENE. LOC122970 BINDING SITE is a target binding site found in the 3' untranslated region of mRNA encoded by LOC122970, corresponding to a target binding site such as BINDING SITE I, BINDING SITE II or BINDING SITE III of FIG. 8. Table 4 illustrates the complementarity of the nucleotide sequences of LOC122970 BINDING SITE, designated SEQ ID:17020, to the nucleotide sequence of GAM72 RNA, herein designated GAM RNA, also designated SEQ ID:342.

Another function of GAM72 is therefore inhibition of LOC122970 (Accession). Accordingly, utilities of GAM72 include diagnosis, prevention and treatment of diseases and clinical conditions associated with LOC122970.

LOC126282 (Accession) is another GAM72 target gene, herein designated TARGET GENE. LOC126282 BINDING SITE is a target binding site found in the 3' untranslated region of mRNA encoded by LOC126282, corresponding to a target binding site such as BINDING SITE I, BINDING SITE II or BINDING SITE III of FIG. 8. Table 4 illustrates the complementarity of the nucleotide sequences of LOC126282 BINDING SITE, designated SEQ ID:18753, to the nucleotide sequence of GAM72 RNA, herein designated GAM RNA, also designated SEQ ID:342.

Another function of GAM72 is therefore inhibition of LOC126282 (Accession). Accordingly, utilities of GAM72 include diagnosis, prevention and treatment of diseases and clinical conditions associated with LOC126282.

LOC126432 (Accession XM_059046.7) is another GAM72 target gene, herein designated TARGET GENE. LOC126432 BINDING SITE is a target binding site found in the 3' untranslated region of mRNA encoded by LOC126432, corresponding to a target binding site such as BINDING SITE I, BINDING SITE II or BINDING SITE III of FIG. 8. Table 4 illustrates the complementarity of the nucleotide sequences of LOC126432 BINDING SITE, designated SEQ ID:3331, to the nucleotide sequence of GAM72 RNA, herein designated GAM RNA, also designated SEQ ID:342.

Another function of GAM72 is therefore inhibition of LOC126432 (Accession XM_059046.7). Accordingly, utilities of GAM72 include diagnosis, prevention and treatment of diseases and clinical conditions associated with LOC126432.

LOC127262 (Accession XM_072073.6) is another GAM72 target gene, herein designated TARGET GENE. LOC127262 BINDING SITE is a target binding site found in the 3' untranslated region of mRNA encoded by LOC127262, corresponding to a target binding site such as BINDING SITE I, BINDING SITE II or BINDING SITE III of FIG. 8. Table 4 illustrates the complementarity of the nucleotide sequences of LOC127262 BINDING SITE, designated SEQ ID:13265, to the nucleotide sequence of GAM72 RNA, herein designated GAM RNA, also designated SEQ ID:342.

Another function of GAM72 is therefore inhibition of LOC127262 (Accession XM_072073.6). Accordingly, utilities of GAM72 include diagnosis, prevention and treatment of diseases and clinical conditions associated with LOC127262.

LOC127294 (Accession) is another GAM72 target gene, herein designated TARGET GENE. LOC127294 BINDING SITE is a target binding site found in the 3' untranslated region of mRNA encoded by LOC127294, corresponding to a target binding site such as BINDING SITE I, BINDING SITE II or BINDING SITE III of FIG. 8. Table 4 illustrates the complementarity of the nucleotide sequences of LOC127294 BINDING SITE, designated SEQ ID:14191, to the nucleotide sequence of GAM72 RNA, herein designated GAM RNA, also designated SEQ ID:342.

Another function of GAM72 is therefore inhibition of LOC127294 (Accession). Accordingly, utilities of GAM72 include diagnosis, prevention and treatment of diseases and clinical conditions associated with LOC127294.

LOC127428 (Accession) is another GAM72 target gene, herein designated TARGET GENE. LOC127428 BINDING SITE is a target binding site found in the 3' untranslated region of mRNA encoded by LOC127428, corresponding to a target binding site such as BINDING SITE I, BINDING SITE II or BINDING SITE III of FIG. 8. Table 4 illustrates the complementarity of the nucleotide sequences of LOC127428 BINDING SITE, designated SEQ ID:14475, to the nucleotide sequence of GAM72 RNA, herein designated GAM RNA, also designated SEQ ID:342.

Another function of GAM72 is therefore inhibition of LOC127428 (Accession). Accordingly, utilities of GAM72 include diagnosis, prevention and treatment of diseases and clinical conditions associated with LOC127428.

LOC130535 (Accession) is another GAM72 target gene, herein designated TARGET GENE. LOC130535 BINDING SITE is a target binding site found in the 3' untranslated region of mRNA encoded by LOC130535, corresponding to a target binding site such as BINDING SITE I, BINDING SITE II or BINDING SITE III of FIG. 8. Table 4 illustrates the complementarity of the nucleotide sequences of LOC130535 BINDING SITE, designated SEQ ID:6355, to the nucleotide sequence of GAM72 RNA, herein designated GAM RNA, also designated SEQ ID:342.

Another function of GAM72 is therefore inhibition of LOC130535 (Accession). Accordingly, utilities of GAM72 include diagnosis, prevention and treatment of diseases and clinical conditions associated with LOC130535.

LOC131965 (Accession) is another GAM72 target gene, herein designated TARGET GENE. LOC131965 BINDING SITE is a target binding site found in the 3' untranslated region of mRNA encoded by LOC131965, corresponding to a target binding site such as BINDING SITE I, BINDING SITE II or BINDING SITE III of FIG. 8. Table 4 illustrates the complementarity of the nucleotide sequences of LOC131965 BINDING SITE, designated SEQ ID:3563, to the nucleotide sequence of GAM72 RNA, herein designated GAM RNA, also designated SEQ ID:342.

Another function of GAM72 is therefore inhibition of LOC131965 (Accession). Accordingly, utilities of GAM72 include diagnosis, prevention and treatment of diseases and clinical conditions associated with LOC131965.

LOC132625 (Accession) is another GAM72 target gene, herein designated TARGET GENE. LOC132625 BINDING SITE is a target binding site found in the 3' untranslated region of mRNA encoded by LOC132625, corresponding to a target binding site such as BINDING SITE I, BINDING SITE II or BINDING SITE III of FIG. 8. Table 4 illustrates the complementarity of the nucleotide sequences of LOC132625 BINDING SITE, designated SEQ ID:8924, to the nucleotide sequence of GAM72 RNA, herein designated GAM RNA, also designated SEQ ID:342.

Another function of GAM72 is therefore inhibition of LOC132625 (Accession). Accordingly, utilities of GAM72 include diagnosis, prevention and treatment of diseases and clinical conditions associated with LOC132625.

LOC133926 (Accession XM_059674.5) is another GAM72 target gene, herein designated TARGET GENE. LOC133926 BINDING SITE is a target binding site found in the 3' untranslated region of mRNA encoded by LOC133926, corresponding to a target binding site such as BINDING SITE I, BINDING SITE II or BINDING SITE III of FIG. 8. Table 4 illustrates the complementarity of the nucleotide sequences of LOC133926 BINDING SITE, designated SEQ ID:6976, to the nucleotide sequence of GAM72 RNA, herein designated GAM RNA, also designated SEQ ID:342.

Another function of GAM72 is therefore inhibition of LOC133926 (Accession XM_059674.5). Accordingly, utilities of GAM72 include diagnosis, prevention and treatment of diseases and clinical conditions associated with LOC133926.

LOC138389 (Accession) is another GAM72 target gene, herein designated TARGET GENE. LOC138389 BINDING SITE is a target binding site found in the 3' untranslated region of mRNA encoded by LOC138389, corresponding to a target binding site such as BINDING SITE I, BINDING SITE II or BINDING SITE III of FIG. 8. Table 4 illustrates the complementarity of the nucleotide sequences of LOC138389 BINDING SITE, designated SEQ ID:11357, to the nucleotide sequence of GAM72 RNA, herein designated GAM RNA, also designated SEQ ID:342.

Another function of GAM72 is therefore inhibition of LOC138389 (Accession). Accordingly, utilities of GAM72 include diagnosis, prevention and treatment of diseases and clinical conditions associated with LOC138389.

LOC139422 (Accession XM_066687.3) is another GAM72 target gene, herein designated TARGET GENE. LOC139422 BINDING SITE is a target binding site found in the 3' untranslated region of mRNA encoded by LOC139422, corresponding to a target binding site such as BINDING SITE I, BINDING SITE II or BINDING SITE III of FIG. 8. Table 4 illustrates the complementarity of the nucleotide sequences of LOC139422 BINDING SITE, designated SEQ ID:19244, to the nucleotide sequence of GAM72 RNA, herein designated GAM RNA, also designated SEQ ID:342.

Another function of GAM72 is therefore inhibition of LOC139422 (Accession XM_066687.3). Accordingly, utilities of GAM72 include diagnosis, prevention and treatment of diseases and clinical conditions associated with LOC139422.

LOC142948 (Accession XM_096364.1) is another GAM72 target gene, herein designated TARGET GENE. LOC142948 BINDING SITE is a target binding site found in the 3' untranslated region of mRNA encoded by LOC142948, corresponding to a target binding site such as BINDING SITE I, BINDING SITE II or BINDING SITE III of FIG. 8. Table 4 illustrates the complementarity of the nucleotide sequences of LOC142948 BINDING SITE, designated SEQ ID:8177, to the nucleotide sequence of GAM72 RNA, herein designated GAM RNA, also designated SEQ ID:342.

Another function of GAM72 is therefore inhibition of LOC142948 (Accession XM_096364.1). Accordingly, utilities of GAM72 include diagnosis, prevention and treatment of diseases and clinical conditions associated with LOC142948.

LOC144465 (Accession) is another GAM72 target gene, herein designated TARGET GENE. LOC144465 BINDING SITE is a target binding site found in the 3' untranslated region of mRNA encoded by LOC144465, corresponding to a target binding site such as BINDING SITE I, BINDING SITE II or BINDING SITE III of FIG. 8. Table 4 illustrates the complementarity of the nucleotide sequences of LOC144465 BINDING SITE, designated SEQ ID:16349, to the nucleotide sequence of GAM72 RNA, herein designated GAM RNA, also designated SEQ ID:342.

Another function of GAM72 is therefore inhibition of LOC144465 (Accession). Accordingly, utilities of GAM72 include diagnosis, prevention and treatment of diseases and clinical conditions associated with LOC144465.

LOC144524 (Accession) is another GAM72 target gene, herein designated TARGET GENE. LOC144524 BINDING SITE is a target binding site found in the 5' untranslated region of mRNA encoded by LOC144524, corresponding to a target binding site such as BINDING SITE I, BINDING SITE II or BINDING SITE III of FIG. 8. Table 4 illustrates the complementarity of the nucleotide sequences of LOC144524 BINDING SITE, designated SEQ ID:20141, to the nucleotide sequence of GAM72 RNA, herein designated GAM RNA, also designated SEQ ID:342.

Another function of GAM72 is therefore inhibition of LOC144524 (Accession). Accordingly, utilities of GAM72 include diagnosis, prevention and treatment of diseases and clinical conditions associated with LOC144524.

LOC145387 (Accession XM_096791.1) is another GAM72 target gene, herein designated TARGET GENE. LOC145387 BINDING SITE is a target binding site found in the 3' untranslated region of mRNA encoded by LOC145387, corresponding to a target binding site such as BINDING SITE I, BINDING SITE II or BINDING SITE III of FIG. 8. Table 4 illustrates the complementarity of the nucleotide sequences of LOC145387 BINDING SITE, designated SEQ ID:11469, to the nucleotide sequence of GAM72 RNA, herein designated GAM RNA, also designated SEQ ID:342.

Another function of GAM72 is therefore inhibition of LOC145387 (Accession XM_096791.1). Accordingly, utilities of GAM72 include diagnosis, prevention and treatment of diseases and clinical conditions associated with LOC145387.

LOC145988 (Accession XM_085290.7) is another GAM72 target gene, herein designated TARGET GENE. LOC145988 BINDING SITE is a target binding site found in the 5' untranslated region of mRNA encoded by LOC145988, corresponding to a target binding site such as BINDING SITE I, BINDING SITE II or BINDING SITE III of FIG. 8. Table 4 illustrates the complementarity of the nucleotide sequences of LOC145988 BINDING SITE, designated SEQ ID:7470, to the nucleotide sequence of GAM72 RNA, herein designated GAM RNA, also designated SEQ ID:342.

Another function of GAM72 is therefore inhibition of LOC145988 (Accession XM_085290.7). Accordingly, utilities of GAM72 include diagnosis, prevention and treatment of diseases and clinical conditions associated with LOC145988.

LOC146159 (Accession) is another GAM72 target gene, herein designated TARGET GENE. LOC146159 BINDING SITE is a target binding site found in the 3' untranslated region of mRNA encoded by LOC146159, corresponding to a target binding site such as BINDING SITE I, BINDING SITE II or BINDING SITE III of FIG. 8. Table 4 illustrates the complementarity of the nucleotide sequences of LOC146159 BINDING SITE, designated SEQ ID:3209, to the nucleotide sequence of GAM72 RNA, herein designated GAM RNA, also designated SEQ ID:342.

Another function of GAM72 is therefore inhibition of LOC146159 (Accession). Accordingly, utilities of GAM72 include diagnosis, prevention and treatment of diseases and clinical conditions associated with LOC146159.

LOC146540 (Accession) is another GAM72 target gene, herein designated TARGET GENE. LOC146540 BINDING SITE is a target binding site found in the 3' untranslated region of mRNA encoded by LOC146540, corresponding to a target binding site such as BINDING SITE I, BINDING SITE II or BINDING SITE III of FIG. 8. Table 4 illustrates the complementarity of the nucleotide sequences of LOC146540 BINDING SITE, designated SEQ ID:16974, to the nucleotide sequence of GAM72 RNA, herein designated GAM RNA, also designated SEQ ID:342.

Another function of GAM72 is therefore inhibition of LOC146540 (Accession). Accordingly, utilities of GAM72 include diagnosis, prevention and treatment of diseases and clinical conditions associated with LOC146540.

LOC146656 (Accession XM_085536.1) is another GAM72 target gene, herein designated TARGET GENE. LOC146656 BINDING SITE is a target binding site found in the 3' untranslated region of mRNA encoded by LOC146656, corresponding to a target binding site such as BINDING SITE I, BINDING SITE II or BINDING SITE III of FIG. 8. Table 4 illustrates the complementarity of the nucleotide sequences of LOC146656 BINDING SITE, designated SEQ ID:4213, to the nucleotide sequence of GAM72 RNA, herein designated GAM RNA, also designated SEQ ID:342.

Another function of GAM72 is therefore inhibition of LOC146656 (Accession XM_085536.1). Accordingly, utilities of GAM72 include diagnosis, prevention and treatment of diseases and clinical conditions associated with LOC146656.

LOC146669 (Accession) is another GAM72 target gene, herein designated TARGET GENE. LOC146669 BINDING SITE is a target binding site found in the 3' untranslated region of mRNA encoded by LOC146669, corresponding to a target binding site such as BINDING SITE I, BINDING SITE II or BINDING SITE III of FIG. 8. Table 4 illustrates the complementarity of the nucleotide sequences of LOC146669 BINDING SITE, designated SEQ ID:8777, to the nucleotide sequence of GAM72 RNA, herein designated GAM RNA, also designated SEQ ID:342.

Another function of GAM72 is therefore inhibition of LOC146669 (Accession). Accordingly, utilities of GAM72 include diagnosis, prevention and treatment of diseases and clinical conditions associated with LOC146669.

LOC146728 (Accession XM_097074.1) is another GAM72 target gene, herein designated TARGET GENE. LOC146728 BINDING SITE is a target binding site found in the 3' untranslated region of mRNA encoded by LOC146728, corresponding to a target binding site such as BINDING SITE I, BINDING SITE II or BINDING SITE III of FIG. 8. Table 4 illustrates the complementarity of the nucleotide sequences of LOC146728 BINDING SITE, designated SEQ ID:3515, to the nucleotide sequence of GAM72 RNA, herein designated GAM RNA, also designated SEQ ID:342.

Another function of GAM72 is therefore inhibition of LOC146728 (Accession XM_097074.1). Accordingly, utilities of GAM72 include diagnosis, prevention and treatment of diseases and clinical conditions associated with LOC146728.

LOC146780 (Accession) is another GAM72 target gene, herein designated TARGET GENE. LOC146780 BINDING SITE is a target binding site found in the 3' untranslated region of mRNA encoded by LOC146780, corresponding to a target binding site such as BINDING SITE I, BINDING SITE II or BINDING SITE III of FIG. 8. Table 4 illustrates the complementarity of the nucleotide sequences of LOC146780 BINDING SITE, designated SEQ ID:10771, to the nucleotide sequence of GAM72 RNA, herein designated GAM RNA, also designated SEQ ID:342.

Another function of GAM72 is therefore inhibition of LOC146780 (Accession). Accordingly, utilities of GAM72 include diagnosis, prevention and treatment of diseases and clinical conditions associated with LOC146780.

LOC146901 (Accession XM_097121.1) is another GAM72 target gene, herein designated TARGET GENE. LOC146901 BINDING SITE is a target binding site found in the 3' untranslated region of mRNA encoded by LOC146901, corresponding to a target binding site such as BINDING SITE I, BINDING SITE II or BINDING SITE III of FIG. 8. Table 4 illustrates the complementarity of the nucleotide sequences of LOC146901 BINDING SITE, designated SEQ ID:18219, to the nucleotide sequence of GAM72 RNA, herein designated GAM RNA, also designated SEQ ID:342.

Another function of GAM72 is therefore inhibition of LOC146901 (Accession XM_097121.1). Accordingly, utilities of GAM72 include diagnosis, prevention and treatment of diseases and clinical conditions associated with LOC146901.

LOC146958 (Accession XM_097142.1) is another GAM72 target gene, herein designated TARGET GENE. LOC146958 BINDING SITE is a target binding site found in the 3' untranslated region of mRNA encoded by LOC146958, corresponding to a target binding site such as BINDING SITE I, BINDING SITE II or BINDING SITE III of FIG. 8. Table 4 illustrates the complementarity of the nucleotide sequences of LOC146958 BINDING SITE, designated SEQ ID:8050, to the nucleotide sequence of GAM72 RNA, herein designated GAM RNA, also designated SEQ ID:342.

Another function of GAM72 is therefore inhibition of LOC146958 (Accession XM_097142.1). Accordingly, utilities of GAM72 include diagnosis, prevention and treatment of diseases and clinical conditions associated with LOC146958.

LOC146975 (Accession) is another GAM72 target gene, herein designated TARGET GENE. LOC146975 BINDING SITE is a target binding site found in the 5' untranslated region of mRNA encoded by LOC146975, corresponding to a target binding site such as BINDING SITE I, BINDING SITE II or BINDING SITE III of FIG. 8. Table 4 illustrates the complementarity of the nucleotide sequences of LOC146975 BINDING SITE, designated SEQ ID:8141, to the nucleotide sequence of GAM72 RNA, herein designated GAM RNA, also designated SEQ ID:342.

Another function of GAM72 is therefore inhibition of LOC146975 (Accession). Accordingly, utilities of GAM72 include diagnosis, prevention and treatment of diseases and clinical conditions associated with LOC146975.

LOC147080 (Accession XM_097182.1) is another GAM72 target gene, herein designated TARGET GENE. LOC147080 BINDING SITE is a target binding site found in the 3' untranslated region of mRNA encoded by LOC147080, corresponding to a target binding site such as BINDING SITE I, BINDING SITE II or BINDING SITE III of FIG. 8. Table 4 illustrates the complementarity of the nucleotide sequences of LOC147080 BINDING SITE, designated SEQ ID:4511, to the nucleotide sequence of GAM72 RNA, herein designated GAM RNA, also designated SEQ ID:342.

Another function of GAM72 is therefore inhibition of LOC147080 (Accession XM_097182.1). Accordingly, utilities of GAM72 include diagnosis, prevention and treatment of diseases and clinical conditions associated with LOC147080.

LOC147669 (Accession XM_097262.1) is another GAM72 target gene, herein designated TARGET GENE. LOC147669 BINDING SITE is a target binding site found in the 3' untranslated region of mRNA encoded by LOC147669, corresponding to a target binding site such as BINDING SITE I, BINDING SITE II or BINDING SITE III of FIG. 8. Table 4 illustrates the complementarity of the nucleotide sequences of LOC147669 BINDING SITE, designated SEQ ID:2584, to the nucleotide sequence of GAM72 RNA, herein designated GAM RNA, also designated SEQ ID:342.

Another function of GAM72 is therefore inhibition of LOC147669 (Accession XM_097262.1). Accordingly, utilities of GAM72 include diagnosis, prevention and treatment of diseases and clinical conditions associated with LOC147669.

LOC147727 (Accession XM_085862.6) is another GAM72 target gene, herein designated TARGET GENE. LOC147727 BINDING SITE is a target binding site found in the 5' untranslated region of mRNA encoded by LOC147727, corresponding to a target binding site such as BINDING SITE I, BINDING SITE II or BINDING SITE III of FIG. 8. Table 4 illustrates the complementarity of the nucleotide sequences of LOC147727 BINDING SITE, designated SEQ ID:18394, to the nucleotide sequence of GAM72 RNA, herein designated GAM RNA, also designated SEQ ID:342.

Another function of GAM72 is therefore inhibition of LOC147727 (Accession XM_085862.6). Accordingly, utilities of GAM72 include diagnosis, prevention and treatment of diseases and clinical conditions associated with LOC147727.

LOC148267 (Accession) is another GAM72 target gene, herein designated TARGET GENE. LOC148267 BINDING SITE is a target binding site found in the 3' untranslated region of mRNA encoded by LOC148267, corresponding to a target binding site such as BINDING SITE I, BINDING SITE II or BINDING SITE III of FIG. 8. Table 4 illustrates the complementarity of the nucleotide sequences of LOC148267 BINDING SITE, designated SEQ ID:17321, to the nucleotide sequence of GAM72 RNA, herein designated GAM RNA, also designated SEQ ID:342.

Another function of GAM72 is therefore inhibition of LOC148267 (Accession). Accordingly, utilities of GAM72 include diagnosis, prevention and treatment of diseases and clinical conditions associated with LOC148267.

LOC148293 (Accession) is another GAM72 target gene, herein designated TARGET GENE. LOC148293 BINDING SITE is a target binding site found in the 3' untranslated region of mRNA encoded by LOC148293, corresponding to a target binding site such as BINDING SITE I, BINDING SITE II or BINDING SITE III of FIG. 8. Table 4 illustrates the complementarity of the nucleotide sequences of LOC148293 BINDING SITE, designated SEQ ID:15074, to the nucleotide sequence of GAM72 RNA, herein designated GAM RNA, also designated SEQ ID:342.

Another function of GAM72 is therefore inhibition of LOC148293 (Accession). Accordingly, utilities of GAM72 include diagnosis, prevention and treatment of diseases and clinical conditions associated with LOC148293.

LOC148343 (Accession) is another GAM72 target gene, herein designated TARGET GENE. LOC148343 BINDING SITE is a target binding site found in the 3' untranslated region of mRNA encoded by LOC148343, corresponding to a target binding site such as BINDING SITE I, BINDING SITE II or BINDING SITE III of FIG. 8. Table 4 illustrates the complementarity of the nucleotide sequences of LOC148343 BINDING SITE, designated SEQ ID:5999, to the nucleotide sequence of GAM72 RNA, herein designated GAM RNA, also designated SEQ ID:342.

Another function of GAM72 is therefore inhibition of LOC148343 (Accession). Accordingly, utilities of GAM72 include diagnosis, prevention and treatment of diseases and clinical conditions associated with LOC148343.

LOC148397 (Accession) is another GAM72 target gene, herein designated TARGET GENE. LOC148397 BINDING SITE is a target binding site found in the 3' untranslated region of mRNA encoded by LOC148397, corresponding to a target binding site such as BINDING SITE I, BINDING SITE II or BINDING SITE III of FIG. 8. Table 4 illustrates the complementarity of the nucleotide sequences of LOC148397 BINDING SITE, designated SEQ ID:7273, to the nucleotide sequence of GAM72 RNA, herein designated GAM RNA, also designated SEQ ID:342.

Another function of GAM72 is therefore inhibition of LOC148397 (Accession). Accordingly, utilities of GAM72 include diagnosis, prevention and treatment of diseases and clinical conditions associated with LOC148397.

LOC148918 (Accession XM_086361.5) is another GAM72 target gene, herein designated TARGET GENE. LOC148918 BINDING SITE is a target binding site found in the 5' untranslated region of mRNA encoded by LOC148918, corresponding to a target binding site such as BINDING SITE I, BINDING SITE II or BINDING SITE III of FIG. 8. Table 4 illustrates the complementarity of the nucleotide sequences of LOC148918 BINDING SITE, designated SEQ ID:18844, to the nucleotide sequence of GAM72 RNA, herein designated GAM RNA, also designated SEQ ID:342.

Another function of GAM72 is therefore inhibition of LOC148918 (Accession XM_086361.5). Accordingly, utilities of GAM72 include diagnosis, prevention and treatment of diseases and clinical conditions associated with LOC148918.

LOC149464 (Accession XM_097645.4) is another GAM72 target gene, herein designated TARGET GENE. LOC149464 BINDING SITE is a target binding site found in the 3' untranslated region of mRNA encoded by LOC149464, corresponding to a target binding site such as BINDING SITE I, BINDING SITE II or BINDING SITE III of FIG. 8. Table 4 illustrates the complementarity of the nucleotide sequences of LOC149464 BINDING SITE, designated SEQ ID:4860, to the nucleotide sequence of GAM72 RNA, herein designated GAM RNA, also designated SEQ ID:342.

Another function of GAM72 is therefore inhibition of LOC149464 (Accession XM_097645.4). Accordingly, utilities of GAM72 include diagnosis, prevention and treatment of diseases and clinical conditions associated with LOC149464.

LOC149711 (Accession) is another GAM72 target gene, herein designated TARGET GENE. LOC149711 BINDING SITE is a target binding site found in the 5' untranslated region of mRNA encoded by LOC149711, corresponding to a target binding site such as BINDING SITE I, BINDING SITE II or BINDING SITE III of FIG. 8. Table 4 illustrates the complementarity of the nucleotide sequences of LOC149711 BINDING SITE, designated SEQ ID:19797, to the nucleotide sequence of GAM72 RNA, herein designated GAM RNA, also designated SEQ ID:342.

Another function of GAM72 is therefore inhibition of LOC149711 (Accession). Accordingly, utilities of GAM72 include diagnosis, prevention and treatment of diseases and clinical conditions associated with LOC149711.

LOC150139 (Accession) is another GAM72 target gene, herein designated TARGET GENE. LOC150139 BINDING SITE is a target binding site found in the 3' untranslated region of mRNA encoded by LOC150139, corresponding to a target binding site such as BINDING SITE I, BINDING SITE II or BINDING SITE III of FIG. 8. Table 4 illustrates the complementarity of the nucleotide sequences of LOC150139 BINDING SITE, designated SEQ ID:6506, to the nucleotide sequence of GAM72 RNA, herein designated GAM RNA, also designated SEQ ID:342.

Another function of GAM72 is therefore inhibition of LOC150139 (Accession). Accordingly, utilities of GAM72 include diagnosis, prevention and treatment of diseases and clinical conditions associated with LOC150139.

LOC150142 (Accession XM_086791.3) is another GAM72 target gene, herein designated TARGET GENE. LOC150142 BINDING SITE is a target binding site found in the 5' untranslated region of mRNA encoded by LOC150142, corresponding to a target binding site such as BINDING SITE I, BINDING SITE II or BINDING SITE III of FIG. 8. Table 4 illustrates the complementarity of the nucleotide sequences of LOC150142 BINDING SITE, designated SEQ ID:9701, to the nucleotide sequence of GAM72 RNA, herein designated GAM RNA, also designated SEQ ID:342.

Another function of GAM72 is therefore inhibition of LOC150142 (Accession XM_086791.3). Accordingly, utilities of GAM72 include diagnosis, prevention and treatment of diseases and clinical conditions associated with LOC150142.

LOC150225 (Accession XM_097870.1) is another GAM72 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:16037, to the nucleotide sequence of GAM72 RNA, herein designated GAM RNA, also designated SEQ ID:342.

Another function of GAM72 is therefore inhibition of LOC150225 (Accession XM_097870.1). Accordingly, utilities of GAM72 include diagnosis, prevention and treatment of diseases and clinical conditions associated with LOC150225.

LOC150245 (Accession) is another GAM72 target gene, herein designated TARGET GENE. LOC150245 BINDING SITE is a target binding site found in the 3' untranslated region of mRNA encoded by LOC150245, corresponding to a target binding site such as BINDING SITE I, BINDING SITE II or BINDING SITE III of FIG. 8. Table 4 illustrates the complementarity of the nucleotide sequences of LOC150245 BINDING SITE, designated SEQ ID:7735, to the nucleotide sequence of GAM72 RNA, herein designated GAM RNA, also designated SEQ ID:342.

Another function of GAM72 is therefore inhibition of LOC150245 (Accession). Accordingly, utilities of GAM72 include diagnosis, prevention and treatment of diseases and clinical conditions associated with LOC150245.

LOC150299 (Accession XM_097869.2) is another GAM72 target gene, herein designated TARGET GENE. LOC150299 BINDING SITE is a target binding site found in the 3' untranslated region of mRNA encoded by LOC150299, corresponding to a target binding site such as BINDING SITE I, BINDING SITE II or BINDING SITE III of FIG. 8. Table 4 illustrates the complementarity of the nucleotide sequences of LOC150299 BINDING SITE, designated SEQ ID:20103, to the nucleotide sequence of GAM72 RNA, herein designated GAM RNA, also designated SEQ ID:342.

Another function of GAM72 is therefore inhibition of LOC150299 (Accession XM_097869.2). Accordingly, utilities of GAM72 include diagnosis, prevention and treatment of diseases and clinical conditions associated with LOC150299.

LOC150630 (Accession XM_097931.1) is another GAM72 target gene, herein designated TARGET GENE. LOC150630 BINDING SITE is a target binding site found in the 5' untranslated region of mRNA encoded by LOC150630, corresponding to a target binding site such as BINDING SITE I, BINDING SITE II or BINDING SITE III of FIG. 8. Table 4 illustrates the complementarity of the nucleotide sequences of LOC150630 BINDING SITE, designated SEQ ID:7681, to the nucleotide sequence of GAM72 RNA, herein designated GAM RNA, also designated SEQ ID:342.

Another function of GAM72 is therefore inhibition of LOC150630 (Accession XM_097931.1). Accordingly, utilities of GAM72 include diagnosis, prevention and treatment of diseases and clinical conditions associated with LOC150630.

LOC150960 (Accession) is another GAM72 target gene, herein designated TARGET GENE. LOC150960 BINDING SITE is a target binding site found in the 3' untranslated region of mRNA encoded by LOC150960, corresponding to a target binding site such as BINDING SITE I, BINDING SITE II or BINDING SITE III of FIG. 8. Table 4 illustrates the complementarity of the nucleotide sequences of LOC150960 BINDING SITE, designated SEQ ID:7643, to the nucleotide sequence of GAM72 RNA, herein designated GAM RNA, also designated SEQ ID:342.

Another function of GAM72 is therefore inhibition of LOC150960 (Accession). Accordingly, utilities of GAM72 include diagnosis, prevention and treatment of diseases and clinical conditions associated with LOC150960.

LOC150998 (Accession) is another GAM72 target gene, herein designated TARGET GENE. LOC150998 BINDING SITE is a target binding site found in the 3' untranslated region of mRNA encoded by LOC150998, corresponding to a target binding site such as BINDING SITE I, BINDING SITE II or BINDING SITE III of FIG. 8. Table 4 illustrates the complementarity of the nucleotide sequences of LOC150998 BINDING SITE, designated SEQ ID:14192, to the nucleotide sequence of GAM72 RNA, herein designated GAM RNA, also designated SEQ ID:342.

Another function of GAM72 is therefore inhibition of LOC150998 (Accession). Accordingly, utilities of GAM72 include diagnosis, prevention and treatment of diseases and clinical conditions associated with LOC150998.

LOC151248 (Accession) is another GAM72 target gene, herein designated TARGET GENE. LOC151248 BINDING SITE is a target binding site found in the 3' untranslated region of mRNA encoded by LOC151248, corresponding to a target binding site such as BINDING SITE I, BINDING SITE II or BINDING SITE III of FIG. 8. Table 4 illustrates the complementarity of the nucleotide sequences of LOC151248 BINDING SITE, designated SEQ ID:3564, to the nucleotide sequence of GAM72 RNA, herein designated GAM RNA, also designated SEQ ID:342.

Another function of GAM72 is therefore inhibition of LOC151248 (Accession). Accordingly, utilities of GAM72 include diagnosis, prevention and treatment of diseases and clinical conditions associated with LOC151248.

LOC151429 (Accession) is another GAM72 target gene, herein designated TARGET GENE. LOC151429 BINDING SITE is a target binding site found in the 3' untranslated region of mRNA encoded by LOC151429, corresponding to a target binding site such as BINDING SITE I, BINDING SITE II or BINDING SITE III of FIG. 8. Table 4 illustrates the complementarity of the nucleotide sequences of LOC151429 BINDING SITE, designated SEQ ID:17658, to the nucleotide sequence of GAM72 RNA, herein designated GAM RNA, also designated SEQ ID:342.

Another function of GAM72 is therefore inhibition of LOC151429 (Accession). Accordingly, utilities of GAM72 include diagnosis, prevention and treatment of diseases and clinical conditions associated with LOC151429.

LOC151438 (Accession XM_098060.1) is another GAM72 target gene, herein designated TARGET GENE. LOC151438 BINDING SITE is a target binding site found in the 3' untranslated region of mRNA encoded by LOC151438, corresponding to a target binding site such as BINDING SITE I, BINDING SITE II or BINDING SITE III of FIG. 8. Table 4 illustrates the complementarity of the nucleotide sequences of LOC151438 BINDING SITE, designated SEQ ID:729, to the nucleotide sequence of GAM72 RNA, herein designated GAM RNA, also designated SEQ ID:342.

Another function of GAM72 is therefore inhibition of LOC151438 (Accession XM_098060.1). Accordingly, utilities of GAM72 include diagnosis, prevention and treatment of diseases and clinical conditions associated with LOC151438.

LOC152002 (Accession) is another GAM72 target gene, herein designated TARGET GENE. LOC152002 BINDING SITE is a target binding site found in the 3' untranslated region of mRNA encoded by LOC152002, corresponding to a target binding site such as BINDING SITE I, BINDING SITE II or BINDING SITE III of FIG. 8. Table 4 illustrates the complementarity of the nucleotide sequences of LOC152002 BINDING SITE, designated SEQ ID:5871, to the nucleotide sequence of GAM72 RNA, herein designated GAM RNA, also designated SEQ ID:342.

Another function of GAM72 is therefore inhibition of LOC152002 (Accession). Accordingly, utilities of GAM72 include diagnosis, prevention and treatment of diseases and clinical conditions associated with LOC152002.

LOC152106 (Accession) is another GAM72 target gene, herein designated TARGET GENE. LOC152106 BINDING SITE is a target binding site found in the 3' untranslated region of mRNA encoded by LOC152106, corresponding to a target binding site such as BINDING SITE I, BINDING SITE II or BINDING SITE III of FIG. 8. Table 4 illustrates the complementarity of the nucleotide sequences of LOC152106 BINDING SITE, designated SEQ ID:14066, to the nucleotide sequence of GAM72 RNA, herein designated GAM RNA, also designated SEQ ID:342.

Another function of GAM72 is therefore inhibition of LOC152106 (Accession). Accordingly, utilities of GAM72 include diagnosis, prevention and treatment of diseases and clinical conditions associated with LOC152106.

LOC152283 (Accession) is another GAM72 target gene, herein designated TARGET GENE. LOC152283 BINDING SITE is a target binding site found in the 3' untranslated region of mRNA encoded by LOC152283, corresponding to a target binding site such as BINDING SITE I, BINDING SITE II or BINDING SITE III of FIG. 8. Table 4 illustrates the complementarity of the nucleotide sequences of LOC152283 BINDING SITE, designated SEQ ID:18445, to the nucleotide sequence of GAM72 RNA, herein designated GAM RNA, also designated SEQ ID:342.

Another function of GAM72 is therefore inhibition of LOC152283 (Accession). Accordingly, utilities of GAM72 include diagnosis, prevention and treatment of diseases and clinical conditions associated with LOC152283.

LOC152441 (Accession) is another GAM72 target gene, herein designated TARGET GENE. LOC152441 BINDING SITE is a target binding site found in the 3' untranslated region of mRNA encoded by LOC152441, corresponding to a target binding site such as BINDING SITE I, BINDING SITE II or BINDING SITE III of FIG. 8. Table 4 illustrates the complementarity of the nucleotide sequences of LOC152441 BINDING SITE, designated SEQ ID:10381, to the nucleotide sequence of GAM72 RNA, herein designated GAM RNA, also designated SEQ ID:342.

Another function of GAM72 is therefore inhibition of LOC152441 (Accession). Accordingly, utilities of GAM72 include diagnosis, prevention and treatment of diseases and clinical conditions associated with LOC152441.

LOC152445 (Accession XM_098231.1) is another GAM72 target gene, herein designated TARGET GENE. LOC152445 BINDING SITE is a target binding site found in the 3' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:733, to the nucleotide sequence of GAM72 RNA, herein designated GAM RNA, also designated SEQ ID:342.

Another function of GAM72 is therefore inhibition of LOC152445 (Accession XM_098231.1). Accordingly, utilities of GAM72 include diagnosis, prevention and treatment of diseases and clinical conditions associated with LOC152445.

LOC152453 (Accession) is another GAM72 target gene, herein designated TARGET GENE. LOC152453 BINDING SITE1 and LOC152453 BINDING SITE2 are target binding sites found in untranslated regions of mRNA encoded by LOC152453, corresponding to target binding sites such as BINDING SITE I, BINDING SITE II or BINDING SITE III of FIG. 8. Table 4 illustrates the complementarity of the nucleotide sequences of LOC152453 BINDING SITE1 and LOC152453 BINDING SITE2, designated SEQ ID:6507 and SEQ ID:7673 respectively, to the nucleotide sequence of GAM72 RNA, herein designated GAM RNA, also designated SEQ ID:342.

Another function of GAM72 is therefore inhibition of LOC152453 (Accession). Accordingly, utilities of GAM72 include diagnosis, prevention and treatment of diseases and clinical conditions associated with LOC152453.

LOC152627 (Accession XM_087495.1) is another GAM72 target gene, herein designated TARGET GENE. LOC152627 BINDING SITE is a target binding site found in the 5' untranslated region of mRNA encoded by LOC152627, corresponding to a target binding site such as BINDING SITE I, BINDING SITE II or BINDING SITE III of FIG. 8. Table 4 illustrates the complementarity of the nucleotide sequences of LOC152627 BINDING SITE, designated SEQ ID:16737, to the nucleotide sequence of GAM72 RNA, herein designated GAM RNA, also designated SEQ ID:342.

Another function of GAM72 is therefore inhibition of LOC152627 (Accession XM_087495.1). Accordingly, utilities of GAM72 include diagnosis, prevention and treatment of diseases and clinical conditions associated with LOC152627.

LOC152804 (Accession XM_098266.5) is another GAM72 target gene, herein designated TARGET GENE. LOC152804 BINDING SITE is a target binding site found in the 3' untranslated region of mRNA encoded by LOC152804, corresponding to a target binding site such as BINDING SITE I, BINDING SITE II or BINDING SITE III of FIG. 8. Table 4 illustrates the complementarity of the nucleotide sequences of LOC152804 BINDING SITE, designated SEQ ID:11713, to the nucleotide sequence of GAM72 RNA, herein designated GAM RNA, also designated SEQ ID:342.

Another function of GAM72 is therefore inhibition of LOC152804 (Accession XM_098266.5). Accordingly, utilities of GAM72 include diagnosis, prevention and treatment of diseases and clinical conditions associated with LOC152804.

LOC153077 (Accession XM_098307.1) is another GAM72 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:4690, to the nucleotide sequence of GAM72 RNA, herein designated GAM RNA, also designated SEQ ID:342.

Another function of GAM72 is therefore inhibition of LOC153077 (Accession XM_098307.1). Accordingly, utilities of GAM72 include diagnosis, prevention and treatment of diseases and clinical conditions associated with LOC153077.

LOC153561 (Accession XM_087708.6) is another GAM72 target gene, herein designated TARGET GENE. LOC153561 BINDING SITE is a target binding site found in the 3' untranslated region of mRNA encoded by LOC153561, corresponding to a target binding site such as BINDING SITE I, BINDING SITE II or BINDING SITE III of FIG. 8. Table 4 illustrates the complementarity of the nucleotide sequences of LOC153561 BINDING SITE, designated SEQ ID:8086, to the nucleotide sequence of GAM72 RNA, herein designated GAM RNA, also designated SEQ ID:342.

Another function of GAM72 is therefore inhibition of LOC153561 (Accession XM_087708.6). Accordingly, utilities of GAM72 include diagnosis, prevention and treatment of diseases and clinical conditions associated with LOC153561.

LOC153642 (Accession) is another GAM72 target gene, herein designated TARGET GENE. LOC153642 BINDING SITE is a target binding site found in the 3' untranslated region of mRNA encoded by LOC153642, corresponding to a target binding site such as BINDING SITE I, BINDING SITE II or BINDING SITE III of FIG. 8. Table 4 illustrates the complementarity of the nucleotide sequences of LOC153642 BINDING SITE, designated SEQ ID:1185, to the nucleotide sequence of GAM72 RNA, herein designated GAM RNA, also designated SEQ ID:342.

Another function of GAM72 is therefore inhibition of LOC153642 (Accession). Accordingly, utilities of GAM72 include diagnosis, prevention and treatment of diseases and clinical conditions associated with LOC153642.

LOC153684 (Accession XM_098412.1) is another GAM72 target gene, herein designated TARGET GENE. LOC153684 BINDING SITE is a target binding site found in the 3' untranslated region of mRNA encoded by LOC153684, corresponding to a target binding site such as BINDING SITE I, BINDING SITE II or BINDING SITE III of FIG. 8. Table 4 illustrates the complementarity of the nucleotide sequences of LOC153684 BINDING SITE, designated SEQ ID:6747, to the nucleotide sequence of GAM72 RNA, herein designated GAM RNA, also designated SEQ ID:342.

Another function of GAM72 is therefore inhibition of LOC153684 (Accession XM_098412.1). Accordingly, utilities of GAM72 include diagnosis, prevention and treatment of diseases and clinical conditions associated with LOC153684.

LOC153727 (Accession XM_098422.1) is another GAM72 target gene, herein designated TARGET GENE. LOC153727 BINDING SITE1 and LOC153727 BINDING SITE2 are target binding sites found in untranslated regions of mRNA encoded by LOC153727, corresponding to target binding sites such as BINDING SITE I, BINDING SITE II or BINDING SITE III of FIG. 8. Table 4 illustrates the complementarity of the nucleotide sequences of LOC153727 BINDING SITE1 and LOC153727 BINDING SITE2, designated SEQ ID:18363 and SEQ ID:5172 respectively, to the nucleotide sequence of GAM72 RNA, herein designated GAM RNA, also designated SEQ ID:342.

Another function of GAM72 is therefore inhibition of LOC153727 (Accession XM_098422.1). Accordingly, utilities of GAM72 include diagnosis, prevention and treatment of diseases and clinical conditions associated with LOC153727.

LOC153733 (Accession) is another GAM72 target gene, herein designated TARGET GENE. LOC153733 BINDING SITE is a target binding site found in the 3' untranslated region of mRNA encoded by LOC153733, corresponding to a target binding site such as BINDING SITE I, BINDING SITE II or BINDING SITE III of FIG. 8. Table 4 illustrates the complementarity of the nucleotide sequences of LOC153733 BINDING SITE, designated SEQ ID:5167, to the nucleotide sequence of GAM72 RNA, herein designated GAM RNA, also designated SEQ ID:342.

Another function of GAM72 is therefore inhibition of LOC153733 (Accession). Accordingly, utilities of GAM72 include diagnosis, prevention and treatment of diseases and clinical conditions associated with LOC153733.

LOC154089 (Accession) is another GAM72 target gene, herein designated TARGET GENE. LOC154089 BINDING SITE is a target binding site found in the 3' untranslated region of mRNA encoded by LOC154089, corresponding to a target binding site such as BINDING SITE I, BINDING SITE II or BINDING SITE III of FIG. 8. Table 4 illustrates the complementarity of the nucleotide sequences of LOC154089 BINDING SITE, designated SEQ ID:8087, to the nucleotide sequence of GAM72 RNA, herein designated GAM RNA, also designated SEQ ID:342.

Another function of GAM72 is therefore inhibition of LOC154089 (Accession). Accordingly, utilities of GAM72 include diagnosis, prevention and treatment of diseases and clinical conditions associated with LOC154089.

LOC154092 (Accession XM_098466.1) is another GAM72 target gene, herein designated TARGET GENE. LOC154092 BINDING SITE is a target binding site found in the 3' untranslated region of mRNA encoded by LOC154092, corresponding to a target binding site such as BINDING SITE I, BINDING SITE II or BINDING SITE III of FIG. 8. Table 4 illustrates the complementarity of the nucleotide sequences of LOC154092 BINDING SITE, designated SEQ ID:8225, to the nucleotide sequence of GAM72 RNA, herein designated GAM RNA, also designated SEQ ID:342.

Another function of GAM72 is therefore inhibition of LOC154092 (Accession XM_098466.1). Accordingly, utilities of GAM72 include diagnosis, prevention and treatment of diseases and clinical conditions associated with LOC154092.

LOC154403 (Accession) is another GAM72 target gene, herein designated TARGET GENE. LOC154403 BINDING SITE is a target binding site found in the 3' untranslated region of mRNA encoded by LOC154403, corresponding to a target binding site such as BINDING SITE I, BINDING SITE II or BINDING SITE III of FIG. 8. Table 4 illustrates the complementarity of the nucleotide sequences of LOC154403 BINDING SITE, designated SEQ ID:7519, to the nucleotide sequence of GAM72 RNA, herein designated GAM RNA, also designated SEQ ID:342.

Another function of GAM72 is therefore inhibition of LOC154403 (Accession). Accordingly, utilities of GAM72 include diagnosis, prevention and treatment of diseases and clinical conditions associated with LOC154403.

LOC154739 (Accession XM_098602.1) is another GAM72 target gene, herein designated TARGET GENE. LOC154739 BINDING SITE is a target binding site found in the 5' untranslated region of mRNA encoded by LOC154739, corresponding to a target binding site such as BINDING SITE I, BINDING SITE II or BINDING SITE III of FIG. 8. Table 4 illustrates the complementarity of the nucleotide sequences of LOC154739 BINDING SITE, designated SEQ ID:9325, to the nucleotide sequence of GAM72 RNA, herein designated GAM RNA, also designated SEQ ID:342.

Another function of GAM72 is therefore inhibition of LOC154739 (Accession XM_098602.1). Accordingly, utilities of GAM72 include diagnosis, prevention and treatment of diseases and clinical conditions associated with LOC154739.

LOC154992 (Accession) is another GAM72 target gene, herein designated TARGET GENE. LOC154992 BINDING SITE is a target binding site found in the 3' untranslated region of mRNA encoded by LOC154992, corresponding to a target binding site such as BINDING SITE I, BINDING SITE II or BINDING SITE III of FIG. 8. Table 4 illustrates the complementarity of the nucleotide sequences of LOC154992 BINDING SITE, designated SEQ ID:16364, to the nucleotide sequence of GAM72 RNA, herein designated GAM RNA, also designated SEQ ID:342.

Another function of GAM72 is therefore inhibition of LOC154992 (Accession). Accordingly, utilities of GAM72 include diagnosis, prevention and treatment of diseases and clinical conditions associated with LOC154992.

LOC155376 (Accession) is another GAM72 target gene, herein designated TARGET GENE. LOC155376 BINDING SITE is a target binding site found in the 3' untranslated region of mRNA encoded by LOC155376, corresponding to a target binding site such as BINDING SITE I, BINDING SITE II or BINDING SITE III of FIG. 8. Table 4 illustrates the complementarity of the nucleotide sequences of LOC155376 BINDING SITE, designated SEQ ID:17561, to the nucleotide sequence of GAM72 RNA, herein designated GAM RNA, also designated SEQ ID:342.

Another function of GAM72 is therefore inhibition of LOC155376 (Accession). Accordingly, utilities of GAM72 include diagnosis, prevention and treatment of diseases and clinical conditions associated with LOC155376.

LOC155438 (Accession XM_098722.1) is another GAM72 target gene, herein designated TARGET GENE. LOC155438 BINDING SITE is a target binding site found in the 3' untranslated region of mRNA encoded by LOC155438, corresponding to a target binding site such as BINDING SITE I, BINDING SITE II or BINDING SITE III of FIG. 8. Table 4 illustrates the complementarity of the nucleotide sequences of LOC155438 BINDING SITE, designated SEQ ID:5623, to the nucleotide sequence of GAM72 RNA, herein designated GAM RNA, also designated SEQ ID:342.

Another function of GAM72 is therefore inhibition of LOC155438 (Accession XM_098722.1). Accordingly, utilities of GAM72 include diagnosis, prevention and treatment of diseases and clinical conditions associated with LOC155438.

LOC157247 (Accession) is another GAM72 target gene, herein designated TARGET GENE. LOC157247 BINDING SITE is a target binding site found in the 5' untranslated region of mRNA encoded by LOC157247, corresponding to a target binding site such as BINDING SITE I, BINDING SITE II or BINDING SITE III of FIG. 8. Table 4 illustrates the complementarity of the nucleotide sequences of LOC157247 BINDING SITE, designated SEQ ID:5887, to the nucleotide sequence of GAM72 RNA, herein designated GAM RNA, also designated SEQ ID:342.

Another function of GAM72 is therefore inhibition of LOC157247 (Accession). Accordingly, utilities of GAM72 include diagnosis, prevention and treatment of diseases and clinical conditions associated with LOC157247.

LOC157562 (Accession XM_098779.1) is another GAM72 target gene, herein designated TARGET GENE. LOC157562 BINDING SITE is a target binding site found in the 5' untranslated region of mRNA encoded by LOC157562, corresponding to a target binding site such as BINDING SITE I, BINDING SITE II or BINDING SITE III of FIG. 8. Table 4 illustrates the complementarity of the nucleotide sequences of LOC157562 BINDING SITE, designated SEQ ID:12425, to the nucleotide sequence of GAM72 RNA, herein designated GAM RNA, also designated SEQ ID:342.

Another function of GAM72 is therefore inhibition of LOC157562 (Accession XM_098779.1). Accordingly, utilities of GAM72 include diagnosis, prevention and treatment of diseases and clinical conditions associated with LOC157562.

LOC158160 (Accession XM_054490.2) is another GAM72 target gene, herein designated TARGET GENE. LOC158160 BINDING SITE is a target binding site found in the 5' untranslated region of mRNA encoded by LOC158160, corresponding to a target binding site such as BINDING SITE I, BINDING SITE II or BINDING SITE III of FIG. 8. Table 4 illustrates the complementarity of the nucleotide sequences of LOC158160 BINDING SITE, designated SEQ ID:10160, to the nucleotide sequence of GAM72 RNA, herein designated GAM RNA, also designated SEQ ID:342.

Another function of GAM72 is therefore inhibition of LOC158160 (Accession XM_054490.2). Accordingly, utilities of GAM72 include diagnosis, prevention and treatment of diseases and clinical conditions associated with LOC158160.

LOC158235 (Accession) is another GAM72 target gene, herein designated TARGET GENE. LOC158235 BINDING SITE is a target binding site found in the 3' untranslated region of mRNA encoded by LOC158235, corresponding to a target binding site such as BINDING SITE I, BINDING SITE II or BINDING SITE III of FIG. 8. Table 4 illustrates the complementarity of the nucleotide sequences of LOC158235 BINDING SITE, designated SEQ ID:13710, to the nucleotide sequence of GAM72 RNA, herein designated GAM RNA, also designated SEQ ID:342.

Another function of GAM72 is therefore inhibition of LOC158235 (Accession). Accordingly, utilities of GAM72 include diagnosis, prevention and treatment of diseases and clinical conditions associated with LOC158235.

LOC158288 (Accession XM_098912.2) is another GAM72 target gene, herein designated TARGET GENE. LOC158288 BINDING SITE is a target binding site found in the 3' untranslated region of mRNA encoded by LOC158288, corresponding to a target binding site such as BINDING SITE I, BINDING SITE II or BINDING SITE III of FIG. 8. Table 4 illustrates the complementarity of the nucleotide sequences of LOC158288 BINDING SITE, designated SEQ ID:15611, to the nucleotide sequence of GAM72 RNA, herein designated GAM RNA, also designated SEQ ID:342.

Another function of GAM72 is therefore inhibition of LOC158288 (Accession XM_098912.2). Accordingly, utilities of GAM72 include diagnosis, prevention and treatment of diseases and clinical conditions associated with LOC158288.

LOC158382 (Accession XM_098931.4) is another GAM72 target gene, herein designated TARGET GENE. LOC158382 BINDING SITE is a target binding site found in the 5' untranslated region of mRNA encoded by LOC158382, corresponding to a target binding site such as BINDING SITE I, BINDING SITE II or BINDING SITE III of FIG. 8. Table 4 illustrates the complementarity of the nucleotide sequences of LOC158382 BINDING SITE, designated SEQ ID:427, to the nucleotide sequence of GAM72 RNA, herein designated GAM RNA, also designated SEQ ID:342.

Another function of GAM72 is therefore inhibition of LOC158382 (Accession XM_098931.4). Accordingly, utilities of GAM72 include diagnosis, prevention and treatment of diseases and clinical conditions associated with LOC158382.

LOC158434 (Accession XM_098939.1) is another GAM72 target gene, herein designated TARGET GENE. LOC158434 BINDING SITE is a target binding site found in the 3' untranslated region of mRNA encoded by LOC158434, corresponding to a target binding site such as BINDING SITE I, BINDING SITE II or BINDING SITE III of FIG. 8. Table 4 illustrates the complementarity of the nucleotide sequences of LOC158434 BINDING SITE, designated SEQ ID:5974, to the nucleotide sequence of GAM72 RNA, herein designated GAM RNA, also designated SEQ ID:342.

Another function of GAM72 is therefore inhibition of LOC158434 (Accession XM_098939.1). Accordingly, utilities of GAM72 include diagnosis, prevention and treatment of diseases and clinical conditions associated with LOC158434.

LOC158677 (Accession) is another GAM72 target gene, herein designated TARGET GENE. LOC158677 BINDING SITE is a target binding site found in the 5' untranslated region of mRNA encoded by LOC158677, corresponding to a target binding site such as BINDING SITE I, BINDING SITE II or BINDING SITE III of FIG. 8. Table 4 illustrates the complementarity of the nucleotide sequences of LOC158677 BINDING SITE, designated SEQ ID:9473, to the nucleotide sequence of GAM72 RNA, herein designated GAM RNA, also designated SEQ ID:342.

Another function of GAM72 is therefore inhibition of LOC158677 (Accession). Accordingly, utilities of GAM72 include diagnosis, prevention and treatment of diseases and clinical conditions associated with LOC158677.

LOC158863 (Accession XM_098999.2) is another GAM72 target gene, herein designated TARGET GENE. LOC158863 BINDING SITE is a target binding site found in the 3' untranslated region of mRNA encoded by LOC158863, corresponding to a target binding site such as BINDING SITE I, BINDING SITE II or BINDING SITE III of FIG. 8. Table 4 illustrates the complementarity of the nucleotide sequences of LOC158863 BINDING SITE, designated SEQ ID:4611, to the nucleotide sequence of GAM72 RNA, herein designated GAM RNA, also designated SEQ ID:342.

Another function of GAM72 is therefore inhibition of LOC158863 (Accession XM_098999.2). Accordingly, utilities of GAM72 include diagnosis, prevention and treatment of diseases and clinical conditions associated with LOC158863.

LOC158987 (Accession) is another GAM72 target gene, herein designated TARGET GENE. LOC158987 BINDING SITE is a target binding site found in the 3' untranslated region of mRNA encoded by LOC158987, corresponding to a target binding site such as BINDING SITE I, BINDING SITE II or BINDING SITE III of FIG. 8. Table 4 illustrates the complementarity of the nucleotide sequences of LOC158987 BINDING SITE, designated SEQ ID:10126, to the nucleotide sequence of GAM72 RNA, herein designated GAM RNA, also designated SEQ ID:342.

Another function of GAM72 is therefore inhibition of LOC158987 (Accession). Accordingly, utilities of GAM72 include diagnosis, prevention and treatment of diseases and clinical conditions associated with LOC158987.

LOC159053 (Accession XM_099021.1) is another GAM72 target gene, herein designated TARGET GENE. LOC159053 BINDING SITE is a target binding site found in the 3' untranslated region of mRNA encoded by LOC159053, corresponding to a target binding site such as BINDING SITE I, BINDING SITE II or BINDING SITE III of FIG. 8. Table 4 illustrates the complementarity of the nucleotide sequences of LOC159053 BINDING SITE, designated SEQ ID:14881, to the nucleotide sequence of GAM72 RNA, herein designated GAM RNA, also designated SEQ ID:342.

Another function of GAM72 is therefore inhibition of LOC159053 (Accession XM_099021.1). Accordingly, utilities of GAM72 include diagnosis, prevention and treatment of diseases and clinical conditions associated with LOC159053.

LOC159116 (Accession) is another GAM72 target gene, herein designated TARGET GENE. LOC159116 BINDING SITE is a target binding site found in the 3' untranslated region of mRNA encoded by LOC159116, corresponding to a target binding site such as BINDING SITE I, BINDING SITE II or BINDING SITE III of FIG. 8. Table 4 illustrates the complementarity of the nucleotide sequences of LOC159116 BINDING SITE, designated SEQ ID:16091, to the nucleotide sequence of GAM72 RNA, herein designated GAM RNA, also designated SEQ ID:342.

Another function of GAM72 is therefore inhibition of LOC159116 (Accession). Accordingly, utilities of GAM72 include diagnosis, prevention and treatment of diseases and clinical conditions associated with LOC159116.

LOC160646 (Accession) is another GAM72 target gene, herein designated TARGET GENE. LOC160646 BINDING SITE is a target binding site found in the 3' untranslated region of mRNA encoded by LOC160646, corresponding to a target binding site such as BINDING SITE I, BINDING SITE II or BINDING SITE III of FIG. 8. Table 4 illustrates the complementarity of the nucleotide sequences of LOC160646 BINDING SITE, designated SEQ ID:15754, to the nucleotide sequence of GAM72 RNA, herein designated GAM RNA, also designated SEQ ID:342.

Another function of GAM72 is therefore inhibition of LOC160646 (Accession). Accordingly, utilities of GAM72 include diagnosis, prevention and treatment of diseases and clinical conditions associated with LOC160646.

LOC166219 (Accession) is another GAM72 target gene, herein designated TARGET GENE. LOC166219 BINDING SITE is a target binding site found in the 3' untranslated region of mRNA encoded by LOC166219, corresponding to a target binding site such as BINDING SITE I, BINDING SITE II or BINDING SITE III of FIG. 8. Table 4 illustrates the complementarity of the nucleotide sequences of LOC166219 BINDING SITE, designated SEQ ID:9359, to the nucleotide sequence of GAM72 RNA, herein designated GAM RNA, also designated SEQ ID:342.

Another function of GAM72 is therefore inhibition of LOC166219 (Accession). Accordingly, utilities of GAM72 include diagnosis, prevention and treatment of diseases and clinical conditions associated with LOC166219.

LOC196027 (Accession) is another GAM72 target gene, herein designated TARGET GENE. LOC196027 BINDING SITE is a target binding site found in the 3' untranslated region of mRNA encoded by LOC196027, corresponding to a target binding site such as BINDING SITE I, BINDING SITE II or BINDING SITE III of FIG. 8. Table 4 illustrates the complementarity of the nucleotide sequences of LOC196027 BINDING SITE, designated SEQ ID:13986, to the nucleotide sequence of GAM72 RNA, herein designated GAM RNA, also designated SEQ ID:342.

Another function of GAM72 is therefore inhibition of LOC196027 (Accession). Accordingly, utilities of GAM72 include diagnosis, prevention and treatment of diseases and clinical conditions associated with LOC196027.

LOC196761 (Accession XM_116865.1) is another GAM72 target gene, herein designated TARGET GENE. LOC196761 BINDING SITE is a target binding site found in the 3' untranslated region of mRNA encoded by LOC196761, corresponding to a target binding site such as BINDING SITE I, BINDING SITE II or BINDING SITE III of FIG. 8. Table 4 illustrates the complementarity of the nucleotide sequences of LOC196761 BINDING SITE, designated SEQ ID:17150, to the nucleotide sequence of GAM72 RNA, herein designated GAM RNA, also designated SEQ ID:342.

Another function of GAM72 is therefore inhibition of LOC196761 (Accession XM_116865.1). Accordingly, utilities of GAM72 include diagnosis, prevention and treatment of diseases and clinical conditions associated with LOC196761.

LOC197196 (Accession) is another GAM72 target gene, herein designated TARGET GENE. LOC197196 BINDING SITE is a target binding site found in the 3' untranslated region of mRNA encoded by LOC197196, corresponding to a target binding site such as BINDING SITE I, BINDING SITE II or BINDING SITE III of FIG. 8. Table 4 illustrates the complementarity of the nucleotide sequences of LOC197196 BINDING SITE, designated SEQ ID:8418, to the nucleotide sequence of GAM72 RNA, herein designated GAM RNA, also designated SEQ ID:342.

Another function of GAM72 is therefore inhibition of LOC197196 (Accession). Accordingly, utilities of GAM72 include diagnosis, prevention and treatment of diseases and clinical conditions associated with LOC197196.

LOC197319 (Accession) is another GAM72 target gene, herein designated TARGET GENE. LOC197319 BINDING SITE is a target binding site found in the 3' untranslated region of mRNA encoded by LOC197319, corresponding to a target binding site such as BINDING SITE I, BINDING SITE II or BINDING SITE III of FIG. 8. Table 4 illustrates the complementarity of the nucleotide sequences of LOC197319 BINDING SITE, designated SEQ ID:19926, to the nucleotide sequence of GAM72 RNA, herein designated GAM RNA, also designated SEQ ID:342.

Another function of GAM72 is therefore inhibition of LOC197319 (Accession). Accordingly, utilities of GAM72 include diagnosis, prevention and treatment of diseases and clinical conditions associated with LOC197319.

LOC197335 (Accession) is another GAM72 target gene, herein designated TARGET GENE. LOC197335 BINDING SITE is a target binding site found in the 3' untranslated region of mRNA encoded by LOC197335, corresponding to a target binding site such as BINDING SITE I, BINDING SITE II or BINDING SITE III of FIG. 8. Table 4 illustrates the complementarity of the nucleotide sequences of LOC197335 BINDING SITE, designated SEQ ID:12694, to the nucleotide sequence of GAM72 RNA, herein designated GAM RNA, also designated SEQ ID:342.

Another function of GAM72 is therefore inhibition of LOC197335 (Accession). Accordingly, utilities of GAM72 include diagnosis, prevention and treatment of diseases and clinical conditions associated with LOC197335.

LOC197408 (Accession) is another GAM72 target gene, herein designated TARGET GENE. LOC197408 BINDING SITE is a target binding site found in the 5' untranslated region of mRNA encoded by LOC197408, corresponding to a target binding site such as BINDING SITE I, BINDING SITE II or BINDING SITE III of FIG. 8. Table 4 illustrates the complementarity of the nucleotide sequences of LOC197408 BINDING SITE, designated SEQ ID:13833, to the nucleotide sequence of GAM72 RNA, herein designated GAM RNA, also designated SEQ ID:342.

Another function of GAM72 is therefore inhibition of LOC197408 (Accession). Accordingly, utilities of GAM72 include diagnosis, prevention and treatment of diseases and clinical conditions associated with LOC197408.

LOC200014 (Accession) is another GAM72 target gene, herein designated TARGET GENE. LOC200014 BINDING SITE is a target binding site found in the 3' untranslated region of mRNA encoded by LOC200014, corresponding to a target binding site such as BINDING SITE I, BINDING SITE II or BINDING SITE III of FIG. 8. Table 4 illustrates the complementarity of the nucleotide sequences of LOC200014 BINDING SITE, designated SEQ ID:19993, to the nucleotide sequence of GAM72 RNA, herein designated GAM RNA, also designated SEQ ID:342.

Another function of GAM72 is therefore inhibition of LOC200014 (Accession). Accordingly, utilities of GAM72 include diagnosis, prevention and treatment of diseases and clinical conditions associated with LOC200014.

LOC200282 (Accession) is another GAM72 target gene, herein designated TARGET GENE. LOC200282 BINDING SITE is a target binding site found in the 3' untranslated region of mRNA encoded by LOC200282, corresponding to a target binding site such as BINDING SITE I, BINDING SITE II or BINDING SITE III of FIG. 8. Table 4 illustrates the complementarity of the nucleotide sequences of LOC200282 BINDING SITE, designated SEQ ID:13981, to the nucleotide sequence of GAM72 RNA, herein designated GAM RNA, also designated SEQ ID:342.

Another function of GAM72 is therefore inhibition of LOC200282 (Accession). Accordingly, utilities of GAM72 include diagnosis, prevention and treatment of diseases and clinical conditions associated with LOC200282.

LOC200731 (Accession XM_117268.1) is another GAM72 target gene, herein designated TARGET GENE. LOC200731 BINDING SITE is a target binding site found in the 3' untranslated region of mRNA encoded by LOC200731, corresponding to a target binding site such as BINDING SITE I, BINDING SITE II or BINDING SITE III of FIG. 8. Table 4 illustrates the complementarity of the nucleotide sequences of LOC200731 BINDING SITE, designated SEQ ID:10206, to the nucleotide sequence of GAM72 RNA, herein designated GAM RNA, also designated SEQ ID:342.

Another function of GAM72 is therefore inhibition of LOC200731 (Accession XM_117268.1). Accordingly, utilities of GAM72 include diagnosis, prevention and treatment of diseases and clinical conditions associated with LOC200731.

LOC200803 (Accession) is another GAM72 target gene, herein designated TARGET GENE. LOC200803 BINDING SITE is a target binding site found in the 3' untranslated region of mRNA encoded by LOC200803, corresponding to a target binding site such as BINDING SITE I, BINDING SITE II or BINDING SITE III of FIG. 8. Table 4 illustrates the complementarity of the nucleotide sequences of LOC200803 BINDING SITE, designated SEQ ID:7883, to the nucleotide sequence of GAM72 RNA, herein designated GAM RNA, also designated SEQ ID:342.

Another function of GAM72 is therefore inhibition of LOC200803 (Accession). Accordingly, utilities of GAM72 include diagnosis, prevention and treatment of diseases and clinical conditions associated with LOC200803.

LOC201868 (Accession XM_114393.2) is another GAM72 target gene, herein designated TARGET GENE. LOC201868 BINDING SITE is a target binding site found in the 3' untranslated region of mRNA encoded by LOC201868, corresponding to a target binding site such as BINDING SITE I, BINDING SITE II or BINDING SITE III of FIG. 8. Table 4 illustrates the complementarity of the nucleotide sequences of LOC201868 BINDING SITE, designated SEQ ID:6971, to the nucleotide sequence of GAM72 RNA, herein designated GAM RNA, also designated SEQ ID:342.

Another function of GAM72 is therefore inhibition of LOC201868 (Accession XM_114393.2). Accordingly, utilities of GAM72 include diagnosis, prevention and treatment of diseases and clinical conditions associated with LOC201868.

LOC201931 (Accession) is another GAM72 target gene, herein designated TARGET GENE. LOC201931 BINDING SITE is a target binding site found in the 3' untranslated region of mRNA encoded by LOC201931, corresponding to a target binding site such as BINDING SITE I, BINDING SITE II or BINDING SITE III of FIG. 8. Table 4 illustrates the complementarity of the nucleotide sequences of LOC201931 BINDING SITE, designated SEQ ID:19292, to the nucleotide sequence of GAM72 RNA, herein designated GAM RNA, also designated SEQ ID:342.

Another function of GAM72 is therefore inhibition of LOC201931 (Accession). Accordingly, utilities of GAM72 include diagnosis, prevention and treatment of diseases and clinical conditions associated with LOC201931.

LOC202134 (Accession XM_117365.5) is another GAM72 target gene, herein designated TARGET GENE. LOC202134 BINDING SITE is a target binding site found in the 5' untranslated region of mRNA encoded by LOC202134, corresponding to a target binding site such as BINDING SITE I, BINDING SITE II or BINDING SITE III of FIG. 8. Table 4 illustrates the complementarity of the nucleotide sequences of LOC202134 BINDING SITE, designated SEQ ID:8165, to the nucleotide sequence of GAM72 RNA, herein designated GAM RNA, also designated SEQ ID:342.

Another function of GAM72 is therefore inhibition of LOC202134 (Accession XM_117365.5). Accordingly, utilities of GAM72 include diagnosis, prevention and treatment of diseases and clinical conditions associated with LOC202134.

LOC202781 (Accession XM_117455.3) is another GAM72 target gene, herein designated TARGET GENE. LOC202781 BINDING SITE is a target binding site found in the 3' untranslated region of mRNA encoded by LOC202781, corresponding to a target binding site such as BINDING SITE I, BINDING SITE II or BINDING SITE III of FIG. 8. Table 4 illustrates the complementarity of the nucleotide sequences of LOC202781 BINDING SITE, designated SEQ ID:15090, to the nucleotide sequence of GAM72 RNA, herein designated GAM RNA, also designated SEQ ID:342.

Another function of GAM72 is therefore inhibition of LOC202781 (Accession XM_117455.3). Accordingly, utilities of GAM72 include diagnosis, prevention and treatment of diseases and clinical conditions associated with LOC202781.

LOC203350 (Accession) is another GAM72 target gene, herein designated TARGET GENE. LOC203350 BINDING SITE is a target binding site found in the 3' untranslated region of mRNA encoded by LOC203350, corresponding to a target binding site such as BINDING SITE I, BINDING SITE II or BINDING SITE III of FIG. 8. Table 4 illustrates the complementarity of the nucleotide sequences of LOC203350 BINDING SITE, designated SEQ ID:12836, to the nucleotide sequence of GAM72 RNA, herein designated GAM RNA, also designated SEQ ID:342.

Another function of GAM72 is therefore inhibition of LOC203350 (Accession). Accordingly, utilities of GAM72 include diagnosis, prevention and treatment of diseases and clinical conditions associated with LOC203350.

LOC203378 (Accession) is another GAM72 target gene, herein designated TARGET GENE. LOC203378 BINDING SITE1 and LOC203378 BINDING SITE2 are target binding sites found in untranslated regions of mRNA encoded by LOC203378, corresponding to target binding sites such as BINDING SITE I, BINDING SITE II or BINDING SITE III of FIG. 8. Table 4 illustrates the complementarity of the nucleotide sequences of LOC203378 BINDING SITE1 and LOC203378 BINDING SITE2, designated SEQ ID:19699 and SEQ ID:8136 respectively, to the nucleotide sequence of GAM72 RNA, herein designated GAM RNA, also designated SEQ ID:342.

Another function of GAM72 is therefore inhibition of LOC203378 (Accession). Accordingly, utilities of GAM72 include diagnosis, prevention and treatment of diseases and clinical conditions associated with LOC203378.

LOC203397 (Accession) is another GAM72 target gene, herein designated TARGET GENE. LOC203397 BINDING SITE is a target binding site found in the 3' untranslated region of mRNA encoded by LOC203397, corresponding to a target binding site such as BINDING SITE I, BINDING SITE II or BINDING SITE III of FIG. 8. Table 4 illustrates the complementarity of the nucleotide sequences of LOC203397 BINDING SITE, designated SEQ ID:2611, to the nucleotide sequence of GAM72 RNA, herein designated GAM RNA, also designated SEQ ID:342.

Another function of GAM72 is therefore inhibition of LOC203397 (Accession). Accordingly, utilities of GAM72 include diagnosis, prevention and treatment of diseases and clinical conditions associated with LOC203397.

LOC219649 (Accession XM_167562.1) is another GAM72 target gene, herein designated TARGET GENE. LOC219649 BINDING SITE is a target binding site found in the 3' untranslated region of mRNA encoded by LOC219649, corresponding to a target binding site such as BINDING SITE I, BINDING SITE II or BINDING SITE III of FIG. 8. Table 4 illustrates the complementarity of the nucleotide sequences of LOC219649 BINDING SITE, designated SEQ ID:17944, to the nucleotide sequence of GAM72 RNA, herein designated GAM RNA, also designated SEQ ID:342.

Another function of GAM72 is therefore inhibition of LOC219649 (Accession XM_167562.1). Accordingly, utilities of GAM72 include diagnosis, prevention and treatment of diseases and clinical conditions associated with LOC219649.

LOC220370 (Accession) is another GAM72 target gene, herein designated TARGET GENE. LOC220370 BINDING SITE is a target binding site found in the 3' untranslated region of mRNA encoded by LOC220370, corresponding to a target binding site such as BINDING SITE I, BINDING SITE II or BINDING SITE III of FIG. 8. Table 4 illustrates the complementarity of the nucleotide sequences of LOC220370 BINDING SITE, designated SEQ ID:10212, to the nucleotide sequence of GAM72 RNA, herein designated GAM RNA, also designated SEQ ID:342.

Another function of GAM72 is therefore inhibition of LOC220370 (Accession). Accordingly, utilities of GAM72 include diagnosis, prevention and treatment of diseases and clinical conditions associated with LOC220370.

LOC220662 (Accession) is another GAM72 target gene, herein designated TARGET GENE. LOC220662 BINDING SITE is a target binding site found in the 3' untranslated region of mRNA encoded by LOC220662, corresponding to a target binding site such as BINDING SITE I, BINDING SITE II or BINDING SITE III of FIG. 8. Table 4 illustrates the complementarity of the nucleotide sequences of LOC220662 BINDING SITE, designated SEQ ID:14876, to the nucleotide sequence of GAM72 RNA, herein designated GAM RNA, also designated SEQ ID:342.

Another function of GAM72 is therefore inhibition of LOC220662 (Accession). Accordingly, utilities of GAM72 include diagnosis, prevention and treatment of diseases and clinical conditions associated with LOC220662.

LOC221069 (Accession) is another GAM72 target gene, herein designated TARGET GENE. LOC221069 BINDING SITE is a target binding site found in the 3' untranslated region of mRNA encoded by LOC221069, corresponding to a target binding site such as BINDING SITE I, BINDING SITE II or BINDING SITE III of FIG. 8. Table 4 illustrates the complementarity of the nucleotide sequences of LOC221069 BINDING SITE, designated SEQ ID:877, to the nucleotide sequence of GAM72 RNA, herein designated GAM RNA, also designated SEQ ID:342.

Another function of GAM72 is therefore inhibition of LOC221069 (Accession). Accordingly, utilities of GAM72 include diagnosis, prevention and treatment of diseases and clinical conditions associated with LOC221069.

LOC221271 (Accession) is another GAM72 target gene, herein designated TARGET GENE. LOC221271 BINDING SITE is a target binding site found in the 3' untranslated region of mRNA encoded by LOC221271, corresponding to a target binding site such as BINDING SITE I, BINDING SITE II or BINDING SITE III of FIG. 8. Table 4 illustrates the complementarity of the nucleotide sequences of LOC221271 BINDING SITE, designated SEQ ID:18966, to the nucleotide sequence of GAM72 RNA, herein designated GAM RNA, also designated SEQ ID:342.

Another function of GAM72 is therefore inhibition of LOC221271 (Accession). Accordingly, utilities of GAM72 include diagnosis, prevention and treatment of diseases and clinical conditions associated with LOC221271.

LOC221641 (Accession) is another GAM72 target gene, herein designated TARGET GENE. LOC221641 BINDING SITE is a target binding site found in the 3' untranslated region of mRNA encoded by LOC221641, corresponding to a target binding site such as BINDING SITE I, BINDING SITE II or BINDING SITE III of FIG. 8. Table 4 illustrates the complementarity of the nucleotide sequences of LOC221641

BINDING SITE, designated SEQ ID:4135, to the nucleotide sequence of GAM72 RNA, herein designated GAM RNA, also designated SEQ ID:342.

Another function of GAM72 is therefore inhibition of LOC221641 (Accession). Accordingly, utilities of GAM72 include diagnosis, prevention and treatment of diseases and clinical conditions associated with LOC221641.

LOC221943 (Accession XM_168343.1) is another GAM72 target gene, herein designated TARGET GENE. LOC221943 BINDING SITE is a target binding site found in the 5' untranslated region of mRNA encoded by LOC221943, corresponding to a target binding site such as BINDING SITE I, BINDING SITE II or BINDING SITE III of FIG. 8. Table 4 illustrates the complementarity of the nucleotide sequences of LOC221943 BINDING SITE, designated SEQ ID:17821, to the nucleotide sequence of GAM72 RNA, herein designated GAM RNA, also designated SEQ ID:342.

Another function of GAM72 is therefore inhibition of LOC221943 (Accession XM_168343.1). Accordingly, utilities of GAM72 include diagnosis, prevention and treatment of diseases and clinical conditions associated with LOC221943.

LOC221946 (Accession XM_168340.2) is another GAM72 target gene, herein designated TARGET GENE. LOC221946 BINDING SITE is a target binding site found in the 3' untranslated region of mRNA encoded by LOC221946, corresponding to a target binding site such as BINDING SITE I, BINDING SITE II or BINDING SITE III of FIG. 8. Table 4 illustrates the complementarity of the nucleotide sequences of LOC221946 BINDING SITE, designated SEQ ID:18979, to the nucleotide sequence of GAM72 RNA, herein designated GAM RNA, also designated SEQ ID:342.

Another function of GAM72 is therefore inhibition of LOC221946 (Accession XM_168340.2). Accordingly, utilities of GAM72 include diagnosis, prevention and treatment of diseases and clinical conditions associated with LOC221946.

LOC222060 (Accession XM_168427.2) is another GAM72 target gene, herein designated TARGET GENE. LOC222060 BINDING SITE is a target binding site found in the 5' untranslated region of mRNA encoded by LOC222060, corresponding to a target binding site such as BINDING SITE I, BINDING SITE II or BINDING SITE III of FIG. 8. Table 4 illustrates the complementarity of the nucleotide sequences of LOC222060 BINDING SITE, designated SEQ ID:8977, to the nucleotide sequence of GAM72 RNA, herein designated GAM RNA, also designated SEQ ID:342.

Another function of GAM72 is therefore inhibition of LOC222060 (Accession XM_168427.2). Accordingly, utilities of GAM72 include diagnosis, prevention and treatment of diseases and clinical conditions associated with LOC222060.

LOC222066 (Accession) is another GAM72 target gene, herein designated TARGET GENE. LOC222066 BINDING SITE1 and LOC222066 BINDING SITE2 are target binding sites found in untranslated regions of mRNA encoded by LOC222066, corresponding to target binding sites such as BINDING SITE I, BINDING SITE II or BINDING SITE III of FIG. 8. Table 4 illustrates the complementarity of the nucleotide sequences of LOC222066 BINDING SITE1 and LOC222066 BINDING SITE2, designated SEQ ID:14380 and SEQ ID:11966 respectively, to the nucleotide sequence of GAM72 RNA, herein designated GAM RNA, also designated SEQ ID:342.

Another function of GAM72 is therefore inhibition of LOC222066 (Accession). Accordingly, utilities of GAM72 include diagnosis, prevention and treatment of diseases and clinical conditions associated with LOC222066.

LOC222160 (Accession XM_168431.1) is another GAM72 target gene, herein designated TARGET GENE. LOC222160 BINDING SITE1 and LOC222160 BINDING SITE2 are target binding sites found in untranslated regions of mRNA encoded by LOC222160, corresponding to target binding sites such as BINDING SITE I, BINDING SITE II or BINDING SITE III of FIG. 8. Table 4 illustrates the complementarity of the nucleotide sequences of LOC222160 BINDING SITE1 and LOC222160 BINDING SITE2, designated SEQ ID:6925 and SEQ ID:4691 respectively, to the nucleotide sequence of GAM72 RNA, herein designated GAM RNA, also designated SEQ ID:342.

Another function of GAM72 is therefore inhibition of LOC222160 (Accession XM_168431.1). Accordingly, utilities of GAM72 include diagnosis, prevention and treatment of diseases and clinical conditions associated with LOC222160.

LOC222237 (Accession) is another GAM72 target gene, herein designated TARGET GENE. LOC222237 BINDING SITE is a target binding site found in the 3' untranslated region of mRNA encoded by LOC222237, corresponding to a target binding site such as BINDING SITE I, BINDING SITE II or BINDING SITE III of FIG. 8. Table 4 illustrates the complementarity of the nucleotide sequences of LOC222237 BINDING SITE, designated SEQ ID:10341, to the nucleotide sequence of GAM72 RNA, herein designated GAM RNA, also designated SEQ ID:342.

Another function of GAM72 is therefore inhibition of LOC222237 (Accession). Accordingly, utilities of GAM72 include diagnosis, prevention and treatment of diseases and clinical conditions associated with LOC222237.

LOC222256 (Accession) is another GAM72 target gene, herein designated TARGET GENE. LOC222256 BINDING SITE is a target binding site found in the 3' untranslated region of mRNA encoded by LOC222256, corresponding to a target binding site such as BINDING SITE I, BINDING SITE II or BINDING SITE III of FIG. 8. Table 4 illustrates the complementarity of the nucleotide sequences of LOC222256 BINDING SITE, designated SEQ ID:15689, to the nucleotide sequence of GAM72 RNA, herein designated GAM RNA, also designated SEQ ID:342.

Another function of GAM72 is therefore inhibition of LOC222256 (Accession). Accordingly, utilities of GAM72 include diagnosis, prevention and treatment of diseases and clinical conditions associated with LOC222256.

LOC253840 (Accession) is another GAM72 target gene, herein designated TARGET GENE. LOC253840 BINDING SITE is a target binding site found in the 3' untranslated region of mRNA encoded by LOC253840, corresponding to a target binding site such as BINDING SITE I, BINDING SITE II or BINDING SITE III of FIG. 8. Table 4 illustrates the complementarity of the nucleotide sequences of LOC253840 BINDING SITE, designated SEQ ID:10077, to the nucleotide sequence of GAM72 RNA, herein designated GAM RNA, also designated SEQ ID:342.

Another function of GAM72 is therefore inhibition of LOC253840 (Accession). Accordingly, utilities of GAM72 include diagnosis, prevention and treatment of diseases and clinical conditions associated with LOC253840.

LOC254045 (Accession) is another GAM72 target gene, herein designated TARGET GENE. LOC254045 BINDING SITE is a target binding site found in the 3' untranslated region of mRNA encoded by LOC254045, corresponding to a target binding site such as BINDING SITE I, BINDING SITE II or BINDING SITE III of FIG. 8. Table 4 illustrates the complementarity of the nucleotide sequences of LOC254045 BINDING SITE, designated SEQ ID:7566, to the nucleotide sequence of GAM72 RNA, herein designated GAM RNA, also designated SEQ ID:342.

Another function of GAM72 is therefore inhibition of LOC254045 (Accession). Accordingly, utilities of GAM72 include diagnosis, prevention and treatment of diseases and clinical conditions associated with LOC254045.

LOC254100 (Accession XM_172851.1) is another GAM72 target gene, herein designated TARGET GENE. LOC254100 BINDING SITE is a target binding site found in the 3' untranslated region of mRNA encoded by LOC254100, corresponding to a target binding site such as BINDING SITE I, BINDING SITE II or BINDING SITE III of FIG. 8. Table 4 illustrates the complementarity of the nucleotide sequences of LOC254100 BINDING SITE, designated SEQ ID:1555, to the nucleotide sequence of GAM72 RNA, herein designated GAM RNA, also designated SEQ ID:342.

Another function of GAM72 is therefore inhibition of LOC254100 (Accession XM_172851.1). Accordingly, utilities of GAM72 include diagnosis, prevention and treatment of diseases and clinical conditions associated with LOC254100.

LOC255031 (Accession XM_173187.2) is another GAM72 target gene, herein designated TARGET GENE. LOC255031 BINDING SITE is a target binding site found in the 3' untranslated region of mRNA encoded by LOC255031, corresponding to a target binding site such as BINDING SITE I, BINDING SITE II or BINDING SITE III of FIG. 8. Table 4 illustrates the complementarity of the nucleotide sequences of LOC255031 BINDING SITE, designated SEQ ID:4612, to the nucleotide sequence of GAM72 RNA, herein designated GAM RNA, also designated SEQ ID:342.

Another function of GAM72 is therefore inhibition of LOC255031 (Accession XM_173187.2). Accordingly, utilities of GAM72 include diagnosis, prevention and treatment of diseases and clinical conditions associated with LOC255031.

LOC255042 (Accession) is another GAM72 target gene, herein designated TARGET GENE. LOC255042 BINDING SITE is a target binding site found in the 3' untranslated region of mRNA encoded by LOC255042, corresponding to a target binding site such as BINDING SITE I, BINDING SITE II or BINDING SITE III of FIG. 8. Table 4 illustrates the complementarity of the nucleotide sequences of LOC255042 BINDING SITE, designated SEQ ID:18961, to the nucleotide sequence of GAM72 RNA, herein designated GAM RNA, also designated SEQ ID:342.

Another function of GAM72 is therefore inhibition of LOC255042 (Accession). Accordingly, utilities of GAM72 include diagnosis, prevention and treatment of diseases and clinical conditions associated with LOC255042.

LOC255326 (Accession) is another GAM72 target gene, herein designated TARGET GENE. LOC255326 BINDING SITE is a target binding site found in the 3' untranslated region of mRNA encoded by LOC255326, corresponding to a target binding site such as BINDING SITE I, BINDING SITE II or BINDING SITE III of FIG. 8. Table 4 illustrates the complementarity of the nucleotide sequences of LOC255326 BINDING SITE, designated SEQ ID:16738, to the nucleotide sequence of GAM72 RNA, herein designated GAM RNA, also designated SEQ ID:342.

Another function of GAM72 is therefore inhibition of LOC255326 (Accession). Accordingly, utilities of GAM72 include diagnosis, prevention and treatment of diseases and clinical conditions associated with LOC255326.

LOC255328 (Accession XM_172920.1) is another GAM72 target gene, herein designated TARGET GENE. LOC255328 BINDING SITE is a target binding site found in the 3' untranslated region of mRNA encoded by LOC255328, corresponding to a target binding site such as BINDING SITE I, BINDING SITE II or BINDING SITE III of FIG. 8. Table 4 illustrates the complementarity of the nucleotide sequences of LOC255328 BINDING SITE, designated SEQ ID:4607, to the nucleotide sequence of GAM72 RNA, herein designated GAM RNA, also designated SEQ ID:342.

Another function of GAM72 is therefore inhibition of LOC255328 (Accession XM_172920.1). Accordingly, utilities of GAM72 include diagnosis, prevention and treatment of diseases and clinical conditions associated with LOC255328.

LOC255463 (Accession) is another GAM72 target gene, herein designated TARGET GENE. LOC255463 BINDING SITE is a target binding site found in the 3' untranslated region of mRNA encoded by LOC255463, corresponding to a target binding site such as BINDING SITE I, BINDING SITE II or BINDING SITE III of FIG. 8. Table 4 illustrates the complementarity of the nucleotide sequences of LOC255463 BINDING SITE, designated SEQ ID:11708, to the nucleotide sequence of GAM72 RNA, herein designated GAM RNA, also designated SEQ ID:342.

Another function of GAM72 is therefore inhibition of LOC255463 (Accession). Accordingly, utilities of GAM72 include diagnosis, prevention and treatment of diseases and clinical conditions associated with LOC255463.

LOC255798 (Accession XM_173087.2) is another GAM72 target gene, herein designated TARGET GENE. LOC255798 BINDING SITE is a target binding site found in the 3' untranslated region of mRNA encoded by LOC255798, corresponding to a target binding site such as BINDING SITE I, BINDING SITE II or BINDING SITE III of FIG. 8. Table 4 illustrates the complementarity of the nucleotide sequences of LOC255798 BINDING SITE, designated SEQ ID:18840, to the nucleotide sequence of GAM72 RNA, herein designated GAM RNA, also designated SEQ ID:342.

Another function of GAM72 is therefore inhibition of LOC255798 (Accession XM_173087.2). Accordingly, utilities of GAM72 include diagnosis, prevention and treatment of diseases and clinical conditions associated with LOC255798.

LOC255937 (Accession) is another GAM72 target gene, herein designated TARGET GENE. LOC255937 BINDING SITE is a target binding site found in the 3' untranslated region of mRNA encoded by LOC255937, corresponding to a target binding site such as BINDING SITE I, BINDING SITE II or BINDING SITE III of FIG. 8. Table 4 illustrates the complementarity of the nucleotide sequences of LOC255937 BINDING SITE, designated SEQ ID:1366, to the nucleotide sequence of GAM72 RNA, herein designated GAM RNA, also designated SEQ ID:342.

Another function of GAM72 is therefore inhibition of LOC255937 (Accession). Accordingly, utilities of GAM72 include diagnosis, prevention and treatment of diseases and clinical conditions associated with LOC255937.

LOC255971 (Accession XM_172907.1) is another GAM72 target gene, herein designated TARGET GENE. LOC255971 BINDING SITE is a target binding site found in the 3' untranslated region of mRNA encoded by LOC255971, corresponding to a target binding site such as BINDING SITE I, BINDING SITE II or BINDING SITE III of FIG. 8. Table 4 illustrates the complementarity of the nucleotide sequences of LOC255971 BINDING SITE, designated SEQ ID:15032, to the nucleotide sequence of GAM72 RNA, herein designated GAM RNA, also designated SEQ ID:342.

Another function of GAM72 is therefore inhibition of LOC255971 (Accession XM_172907.1). Accordingly, utilities of GAM72 include diagnosis, prevention and treatment of diseases and clinical conditions associated with LOC255971.

LOC256515 (Accession XM_172866.1) is another GAM72 target gene, herein designated TARGET GENE. LOC256515 BINDING SITE is a target binding site found in the 3' untranslated region of mRNA encoded by LOC256515, corresponding to a target binding site such as BINDING SITE I, BINDING SITE II or BINDING SITE III of FIG. 8. Table 4 illustrates the complementarity of the nucleotide sequences of LOC256515 BINDING SITE, designated SEQ ID:16314, to the nucleotide sequence of GAM72 RNA, herein designated GAM RNA, also designated SEQ ID:342.

Another function of GAM72 is therefore inhibition of LOC256515 (Accession XM_172866.1). Accordingly, utilities of GAM72 include diagnosis, prevention and treatment of diseases and clinical conditions associated with LOC256515.

LOC256520 (Accession) is another GAM72 target gene, herein designated TARGET GENE. LOC256520 BINDING SITE is a target binding site found in the 3' untranslated region of mRNA encoded by LOC256520, corresponding to a target binding site such as BINDING SITE I, BINDING SITE II or BINDING SITE III of FIG. 8. Table 4 illustrates the complementarity of the nucleotide sequences of LOC256520 BINDING SITE, designated SEQ ID:15534, to the nucleotide sequence of GAM72 RNA, herein designated GAM RNA, also designated SEQ ID:342.

Another function of GAM72 is therefore inhibition of LOC256520 (Accession). Accordingly, utilities of GAM72 include diagnosis, prevention and treatment of diseases and clinical conditions associated with LOC256520.

LOC256544 (Accession) is another GAM72 target gene, herein designated TARGET GENE. LOC256544 BINDING SITE is a target binding site found in the 3' untranslated region of mRNA encoded by LOC256544, corresponding to a target binding site such as BINDING SITE I, BINDING SITE II or BINDING SITE III of FIG. 8. Table 4 illustrates the complementarity of the nucleotide sequences of LOC256544 BINDING SITE, designated SEQ ID:3768, to the nucleotide sequence of GAM72 RNA, herein designated GAM RNA, also designated SEQ ID:342.

Another function of GAM72 is therefore inhibition of LOC256544 (Accession). Accordingly, utilities of GAM72 include diagnosis, prevention and treatment of diseases and clinical conditions associated with LOC256544.

LOC257354 (Accession) is another GAM72 target gene, herein designated TARGET GENE. LOC257354 BINDING SITE is a target binding site found in the 5' untranslated region of mRNA encoded by LOC257354, corresponding to a target binding site such as BINDING SITE I, BINDING SITE II or BINDING SITE III of FIG. 8. Table 4 illustrates the complementarity of the nucleotide sequences of LOC257354 BINDING SITE, designated SEQ ID:14050, to the nucleotide sequence of GAM72 RNA, herein designated GAM RNA, also designated SEQ ID:342.

Another function of GAM72 is therefore inhibition of LOC257354 (Accession). Accordingly, utilities of GAM72 include diagnosis, prevention and treatment of diseases and clinical conditions associated with LOC257354.

LOC257448 (Accession) is another GAM72 target gene, herein designated TARGET GENE. LOC257448 BINDING SITE is a target binding site found in the 3' untranslated region of mRNA encoded by LOC257448, corresponding to a target binding site such as BINDING SITE I, BINDING SITE II or BINDING SITE III of FIG. 8. Table 4 illustrates the complementarity of the nucleotide sequences of LOC257448 BINDING SITE, designated SEQ ID:14619, to the nucleotide sequence of GAM72 RNA, herein designated GAM RNA, also designated SEQ ID:342.

Another function of GAM72 is therefore inhibition of LOC257448 (Accession). Accordingly, utilities of GAM72 include diagnosis, prevention and treatment of diseases and clinical conditions associated with LOC257448.

LOC257596 (Accession) is another GAM72 target gene, herein designated TARGET GENE. LOC257596 BINDING SITE is a target binding site found in the 5' untranslated region of mRNA encoded by LOC257596, corresponding to a target binding site such as BINDING SITE I, BINDING SITE II or BINDING SITE III of FIG. 8. Table 4 illustrates the complementarity of the nucleotide sequences of LOC257596 BINDING SITE, designated SEQ ID:10276, to the nucleotide sequence of GAM72 RNA, herein designated GAM RNA, also designated SEQ ID:342.

Another function of GAM72 is therefore inhibition of LOC257596 (Accession). Accordingly, utilities of GAM72 include diagnosis, prevention and treatment of diseases and clinical conditions associated with LOC257596.

LOC51122 (Accession NM_016094.1) is another GAM72 target gene, herein designated TARGET GENE. LOC51122 BINDING SITE is a target binding site found in the 3' untranslated region of mRNA encoded by LOC51122, corresponding to a target binding site such as BINDING SITE I, BINDING SITE II or BINDING SITE III of FIG. 8. Table 4 illustrates the complementarity of the nucleotide sequences of LOC51122 BINDING SITE, designated SEQ ID:15769, to the nucleotide sequence of GAM72 RNA, herein designated GAM RNA, also designated SEQ ID:342.

Another function of GAM72 is therefore inhibition of LOC51122 (Accession NM_016094.1). Accordingly, utilities of GAM72 include diagnosis, prevention and treatment of diseases and clinical conditions associated with LOC51122.

LOC51145 (Accession NM_016158.1) is another GAM72 target gene, herein designated TARGET GENE. LOC51145 BINDING SITE is a target binding site found in the 3' untranslated region of mRNA encoded by LOC51145, corresponding to a target binding site such as BINDING SITE I, BINDING SITE II or BINDING SITE III of FIG. 8. Table 4 illustrates the complementarity of the nucleotide sequences of LOC51145 BINDING SITE, designated SEQ ID:19694, to the nucleotide sequence of GAM72 RNA, herein designated GAM RNA, also designated SEQ ID:342.

Another function of GAM72 is therefore inhibition of LOC51145 (Accession NM_016158.1). Accordingly, utilities of GAM72 include diagnosis, prevention and treatment of diseases and clinical conditions associated with LOC51145.

LOC51212 (Accession NM_016380.1) is another GAM72 target gene, herein designated TARGET GENE. LOC51212 BINDING SITE is a target binding site found in the 3' untranslated region of mRNA encoded by LOC51212, corresponding to a target binding site such as BINDING SITE I, BINDING SITE II or BINDING SITE III of FIG. 8. Table 4 illustrates the complementarity of the nucleotide sequences of LOC51212 BINDING SITE, designated SEQ ID:3156, to the nucleotide sequence of GAM72 RNA, herein designated GAM RNA, also designated SEQ ID:342.

Another function of GAM72 is therefore inhibition of LOC51212 (Accession NM_016380.1). Accordingly, utilities of GAM72 include diagnosis, prevention and treatment of diseases and clinical conditions associated with LOC51212.

LOC51279 (Accession NM_016546.1) is another GAM72 target gene, herein designated TARGET GENE. LOC51279 BINDING SITE is a target binding site found in the 3' untranslated region of mRNA encoded by LOC51279, corresponding to a target binding site such as BINDING SITE I, BINDING SITE II or BINDING SITE III of FIG. 8. Table 4 illustrates the complementarity of the nucleotide sequences of LOC51279 BINDING SITE, designated SEQ ID:16733, to the nucleotide sequence of GAM72 RNA, herein designated GAM RNA, also designated SEQ ID:342.

Another function of GAM72 is therefore inhibition of LOC51279 (Accession NM_016546.1). Accordingly, utilities of GAM72 include diagnosis, prevention and treatment of diseases and clinical conditions associated with LOC51279.

LOC51333 (Accession NM_016643.1) is another GAM72 target gene, herein designated TARGET GENE. LOC51333 BINDING SITE is a target binding site found in the 3' untranslated region of mRNA encoded by LOC51333, corresponding to a target binding site such as BINDING SITE I, BINDING SITE II or BINDING SITE III of FIG. 8. Table 4 illustrates the complementarity of the nucleotide sequences of LOC51333 BINDING SITE, designated SEQ ID:8944, to the nucleotide sequence of GAM72 RNA, herein designated GAM RNA, also designated SEQ ID:342.

Another function of GAM72 is therefore inhibition of LOC51333 (Accession NM_016643.1). Accordingly, utilities of GAM72 include diagnosis, prevention and treatment of diseases and clinical conditions associated with LOC51333.

LOC51716 (Accession) is another GAM72 target gene, herein designated TARGET GENE. LOC51716 BINDING SITE is a target binding site found in the 3' untranslated region of mRNA encoded by LOC51716, corresponding to a target binding site such as BINDING SITE I, BINDING SITE II or BINDING SITE III of FIG. 8. Table 4 illustrates the complementarity of the nucleotide sequences of LOC51716 BINDING SITE, designated SEQ ID:8066, to the nucleotide sequence of GAM72 RNA, herein designated GAM RNA, also designated SEQ ID:342.

Another function of GAM72 is therefore inhibition of LOC51716 (Accession). Accordingly, utilities of GAM72 include diagnosis, prevention and treatment of diseases and clinical conditions associated with LOC51716.

LOC89958 (Accession XM_027627.4) is another GAM72 target gene, herein designated TARGET GENE. LOC89958 BINDING SITE is a target binding site found in the 3' untranslated region of mRNA encoded by LOC89958, corresponding to a target binding site such as BINDING SITE I, BINDING SITE II or BINDING SITE III of FIG. 8. Table 4 illustrates the complementarity of the nucleotide sequences of LOC89958 BINDING SITE, designated SEQ ID:4295, to the nucleotide sequence of GAM72 RNA, herein designated GAM RNA, also designated SEQ ID:342.

Another function of GAM72 is therefore inhibition of LOC89958 (Accession XM_027627.4). Accordingly, utilities of GAM72 include diagnosis, prevention and treatment of diseases and clinical conditions associated with LOC89958.

LOC90092 (Accession) is another GAM72 target gene, herein designated TARGET GENE. LOC90092 BINDING SITE is a target binding site found in the 3' untranslated region of mRNA encoded by LOC90092, corresponding to a target binding site such as BINDING SITE I, BINDING SITE II or BINDING SITE III of FIG. 8. Table 4 illustrates the complementarity of the nucleotide sequences of LOC90092 BINDING SITE, designated SEQ ID:5975, to the nucleotide sequence of GAM72 RNA, herein designated GAM RNA, also designated SEQ ID:342.

Another function of GAM72 is therefore inhibition of LOC90092 (Accession). Accordingly, utilities of GAM72 include diagnosis, prevention and treatment of diseases and clinical conditions associated with LOC90092.

LOC90141 (Accession) is another GAM72 target gene, herein designated TARGET GENE. LOC90141 BINDING SITE is a target binding site found in the 3' untranslated region of mRNA encoded by LOC90141, corresponding to a target binding site such as BINDING SITE I, BINDING SITE II or BINDING SITE III of FIG. 8. Table 4 illustrates the complementarity of the nucleotide sequences of LOC90141 BINDING SITE, designated SEQ ID:3769, to the nucleotide sequence of GAM72 RNA, herein designated GAM RNA, also designated SEQ ID:342.

Another function of GAM72 is therefore inhibition of LOC90141 (Accession). Accordingly, utilities of GAM72 include diagnosis, prevention and treatment of diseases and clinical conditions associated with LOC90141.

LOC90333 (Accession XM_030958.6) is another GAM72 target gene, herein designated TARGET GENE. LOC90333 BINDING SITE is a target binding site found in the 3' untranslated region of mRNA encoded by LOC90333, corresponding to a target binding site such as BINDING SITE I, BINDING SITE II or BINDING SITE III of FIG. 8. Table 4 illustrates the complementarity of the nucleotide sequences of LOC90333 BINDING SITE, designated SEQ ID:4608, to the nucleotide sequence of GAM72 RNA, herein designated GAM RNA, also designated SEQ ID:342.

Another function of GAM72 is therefore inhibition of LOC90333 (Accession XM_030958.6). Accordingly, utilities of GAM72 include diagnosis, prevention and treatment of diseases and clinical conditions associated with LOC90333.

LOC90573 (Accession XM_032669.1) is another GAM72 target gene, herein designated TARGET GENE. LOC90573 BINDING SITE is a target binding site found in the 3' untranslated region of mRNA encoded by LOC90573, corresponding to a target binding site such as BINDING SITE I, BINDING SITE II or BINDING SITE III of FIG. 8. Table 4 illustrates the complementarity of the nucleotide sequences of LOC90573 BINDING SITE, designated SEQ ID:8294, to the nucleotide sequence of GAM72 RNA, herein designated GAM RNA, also designated SEQ ID:342.

Another function of GAM72 is therefore inhibition of LOC90573 (Accession XM_032669.1). Accordingly, utilities of GAM72 include diagnosis, prevention and treatment of diseases and clinical conditions associated with LOC90573.

LOC90589 (Accession NM_145233.1) is another GAM72 target gene, herein designated TARGET GENE. LOC90589 BINDING SITE is a target binding site found in the 3' untranslated region of mRNA encoded by LOC90589, corresponding to a target binding site such as BINDING SITE I, BINDING SITE II or BINDING SITE III of FIG. 8. Table 4 illustrates the complementarity of the nucleotide sequences of LOC90589 BINDING SITE, designated SEQ ID:8082, to the nucleotide sequence of GAM72 RNA, herein designated GAM RNA, also designated SEQ ID:342.

Another function of GAM72 is therefore inhibition of LOC90589 (Accession NM_145233.1). Accordingly, utilities of GAM72 include diagnosis, prevention and treatment of diseases and clinical conditions associated with LOC90589.

LOC90624 (Accession XM_033003.4) is another GAM72 target gene, herein designated TARGET GENE. LOC90624 BINDING SITE is a target binding site found in the 3' untranslated region of mRNA encoded by LOC90624, corresponding to a target binding site such as BINDING SITE I, BINDING SITE II or BINDING SITE III of FIG. 8. Table 4 illustrates the complementarity of the nucleotide sequences of LOC90624 BINDING SITE, designated SEQ ID:4899, to the nucleotide sequence of GAM72 RNA, herein designated GAM RNA, also designated SEQ ID:342.

Another function of GAM72 is therefore inhibition of LOC90624 (Accession XM_033003.4). Accordingly, utilities of GAM72 include diagnosis, prevention and treatment of diseases and clinical conditions associated with LOC90624.

LOC90777 (Accession) is another GAM72 target gene, herein designated TARGET GENE. LOC90777 BINDING SITE is a target binding site found in the 3' untranslated region of mRNA encoded by LOC90777, corresponding to a target binding site such as BINDING SITE I, BINDING SITE II or BINDING SITE III of FIG. 8. Table 4 illustrates the complementarity of the nucleotide sequences of LOC90777 BINDING SITE, designated SEQ ID:18233, to the nucleotide sequence of GAM72 RNA, herein designated GAM RNA, also designated SEQ ID:342.

Another function of GAM72 is therefore inhibition of LOC90777 (Accession). Accordingly, utilities of GAM72 include diagnosis, prevention and treatment of diseases and clinical conditions associated with LOC90777.

LOC90784 (Accession XM_034109.2) is another GAM72 target gene, herein designated TARGET GENE. LOC90784 BINDING SITE is a target binding site found in the 5' untranslated region of mRNA encoded by LOC90784, corresponding to a target binding site such as BINDING SITE I, BINDING SITE II or BINDING SITE III of FIG. 8. Table 4 illustrates the complementarity of the nucleotide sequences of LOC90784 BINDING SITE, designated SEQ ID:8897, to the nucleotide sequence of GAM72 RNA, herein designated GAM RNA, also designated SEQ ID:342.

Another function of GAM72 is therefore inhibition of LOC90784 (Accession XM_034109.2). Accordingly, utilities of GAM72 include diagnosis, prevention and treatment of diseases and clinical conditions associated with LOC90784.

LOC91380 (Accession) is another GAM72 target gene, herein designated TARGET GENE. LOC91380 BINDING SITE is a target binding site found in the 3' untranslated region of mRNA encoded by LOC91380, corresponding to a target binding site such as BINDING SITE I, BINDING SITE II or BINDING SITE III of FIG. 8. Table 4 illustrates the complementarity of the nucleotide sequences of LOC91380 BINDING SITE, designated SEQ ID:15283, to the nucleotide sequence of GAM72 RNA, herein designated GAM RNA, also designated SEQ ID:342.

Another function of GAM72 is therefore inhibition of LOC91380 (Accession). Accordingly, utilities of GAM72 include diagnosis, prevention and treatment of diseases and clinical conditions associated with LOC91380.

LOC91397 (Accession XM_038219.2) is another GAM72 target gene, herein designated TARGET GENE. LOC91397 BINDING SITE is a target binding site found in the 3' untranslated region of mRNA encoded by LOC91397, corresponding to a target binding site such as BINDING SITE I, BINDING SITE II or BINDING SITE III of FIG. 8. Table 4 illustrates the complementarity of the nucleotide sequences of LOC91397 BINDING SITE, designated SEQ ID:18139, to the nucleotide sequence of GAM72 RNA, herein designated GAM RNA, also designated SEQ ID:342.

Another function of GAM72 is therefore inhibition of LOC91397 (Accession XM_038219.2). Accordingly, utilities of GAM72 include diagnosis, prevention and treatment of diseases and clinical conditions associated with LOC91397.

LOC91442 (Accession) is another GAM72 target gene, herein designated TARGET GENE. LOC91442 BINDING SITE is a target binding site found in the 3' untranslated region of mRNA encoded by LOC91442, corresponding to a target binding site such as BINDING SITE I, BINDING SITE II or BINDING SITE III of FIG. 8. Table 4 illustrates the complementarity of the nucleotide sequences of LOC91442 BINDING SITE, designated SEQ ID:4045, to the nucleotide sequence of GAM72 RNA, herein designated GAM RNA, also designated SEQ ID:342.

Another function of GAM72 is therefore inhibition of LOC91442 (Accession). Accordingly, utilities of GAM72 include diagnosis, prevention and treatment of diseases and clinical conditions associated with LOC91442.

LOC91565 (Accession XM_039231.1) is another GAM72 target gene, herein designated TARGET GENE. LOC91565 BINDING SITE is a target binding site found in the 5' untranslated region of mRNA encoded by LOC91565, corresponding to a target binding site such as BINDING SITE I, BINDING SITE II or BINDING SITE III of FIG. 8. Table 4 illustrates the complementarity of the nucleotide sequences of LOC91565 BINDING SITE, designated SEQ ID:19839, to the nucleotide sequence of GAM72 RNA, herein designated GAM RNA, also designated SEQ ID:342.

Another function of GAM72 is therefore inhibition of LOC91565 (Accession XM_039231.1). Accordingly, utilities of GAM72 include diagnosis, prevention and treatment of diseases and clinical conditions associated with LOC91565.

LOC91862 (Accession NM_052858.1) is another GAM72 target gene, herein designated TARGET GENE. LOC91862 BINDING SITE is a target binding site found in the 3' untranslated region of mRNA encoded by LOC91862, corresponding to a target binding site such as BINDING SITE I, BINDING SITE II or BINDING SITE III of FIG. 8. Table 4 illustrates the complementarity of the nucleotide sequences of LOC91862 BINDING SITE, designated SEQ ID:14448, to the nucleotide sequence of GAM72 RNA, herein designated GAM RNA, also designated SEQ ID:342.

Another function of GAM72 is therefore inhibition of LOC91862 (Accession NM_052858.1). Accordingly, utilities of GAM72 include diagnosis, prevention and treatment of diseases and clinical conditions associated with LOC91862.

LOC91948 (Accession XM_041723.1) is another GAM72 target gene, herein designated TARGET GENE. LOC91948 BINDING SITE is a target binding site found in the 3' untranslated region of mRNA encoded by LOC91948, corresponding to a target binding site such as BINDING SITE I, BINDING SITE II or BINDING SITE III of FIG. 8. Table 4 illustrates the complementarity of the nucleotide sequences of LOC91948 BINDING SITE, designated SEQ ID:17556, to the nucleotide sequence of GAM72 RNA, herein designated GAM RNA, also designated SEQ ID:342.

Another function of GAM72 is therefore inhibition of LOC91948 (Accession XM_041723.1). Accordingly, utilities of GAM72 include diagnosis, prevention and treatment of diseases and clinical conditions associated with LOC91948.

LOC92223 (Accession) is another GAM72 target gene, herein designated TARGET GENE. LOC92223 BINDING SITE is a target binding site found in the 3' untranslated region of mRNA encoded by LOC92223, corresponding to a target binding site such as BINDING SITE I, BINDING SITE II or BINDING SITE III of FIG. 8. Table 4 illustrates the complementarity of the nucleotide sequences of LOC92223 BINDING SITE, designated SEQ ID:10868, to the nucleotide sequence of GAM72 RNA, herein designated GAM RNA, also designated SEQ ID:342.

Another function of GAM72 is therefore inhibition of LOC92223 (Accession). Accordingly, utilities of GAM72 include diagnosis, prevention and treatment of diseases and clinical conditions associated with LOC92223.

LOC92465 (Accession) is another GAM72 target gene, herein designated TARGET GENE. LOC92465 BINDING SITE is a target binding site found in the 5' untranslated region of mRNA encoded by LOC92465, corresponding to a target binding site such as BINDING SITE I, BINDING SITE II or BINDING SITE III of FIG. 8. Table 4 illustrates the complementarity of the nucleotide sequences of LOC92465 BINDING SITE, designated SEQ ID:16877, to the nucleotide sequence of GAM72 RNA, herein designated GAM RNA, also designated SEQ ID:342.

Another function of GAM72 is therefore inhibition of LOC92465 (Accession). Accordingly, utilities of GAM72 include diagnosis, prevention and treatment of diseases and clinical conditions associated with LOC92465.

LOC92568 (Accession XM_045852.1) is another GAM72 target gene, herein designated TARGET GENE. LOC92568 BINDING SITE is a target binding site found in the 3' untranslated region of mRNA encoded by LOC92568, corresponding to a target binding site such as BINDING SITE I, BINDING SITE II or BINDING SITE III of FIG. 8. Table 4 illustrates the complementarity of the nucleotide sequences of LOC92568 BINDING SITE, designated SEQ ID:12413, to the nucleotide sequence of GAM72 RNA, herein designated GAM RNA, also designated SEQ ID:342.

Another function of GAM72 is therefore inhibition of LOC92568 (Accession XM_045852.1). Accordingly, utilities of GAM72 include diagnosis, prevention and treatment of diseases and clinical conditions associated with LOC92568.

LOC92661 (Accession) is another GAM72 target gene, herein designated TARGET GENE. LOC92661 BINDING SITE is a target binding site found in the 5' untranslated region of mRNA encoded by LOC92661, corresponding to a target binding site such as BINDING SITE I, BINDING SITE II or BINDING SITE III of FIG. 8. Table 4 illustrates the complementarity of the nucleotide sequences of LOC92661 BINDING SITE, designated SEQ ID:16307, to the nucleotide sequence of GAM72 RNA, herein designated GAM RNA, also designated SEQ ID:342.

Another function of GAM72 is therefore inhibition of LOC92661 (Accession). Accordingly, utilities of GAM72 include diagnosis, prevention and treatment of diseases and clinical conditions associated with LOC92661.

LOC92771 (Accession) is another GAM72 target gene, herein designated TARGET GENE. LOC92771 BINDING SITE is a target binding site found in the 3' untranslated region of mRNA encoded by LOC92771, corresponding to a target binding site such as BINDING SITE I, BINDING SITE II or BINDING SITE III of FIG. 8. Table 4 illustrates the complementarity of the nucleotide sequences of LOC92771 BINDING SITE, designated SEQ ID:8166, to the nucleotide sequence of GAM72 RNA, herein designated GAM RNA, also designated SEQ ID:342.

Another function of GAM72 is therefore inhibition of LOC92771 (Accession). Accordingly, utilities of GAM72 include diagnosis, prevention and treatment of diseases and clinical conditions associated with LOC92771.

LOC93132 (Accession XM_049396.2) is another GAM72 target gene, herein designated TARGET GENE. LOC93132 BINDING SITE is a target binding site found in the 3' untranslated region of mRNA encoded by LOC93132, corresponding to a target binding site such as BINDING SITE I, BINDING SITE II or BINDING SITE III of FIG. 8. Table 4 illustrates the complementarity of the nucleotide sequences of LOC93132 BINDING SITE, designated SEQ ID:2241, to the nucleotide sequence of GAM72 RNA, herein designated GAM RNA, also designated SEQ ID:342.

Another function of GAM72 is therefore inhibition of LOC93132 (Accession XM_049396.2). Accordingly, utilities of GAM72 include diagnosis, prevention and treatment of diseases and clinical conditions associated with LOC93132.

LOC96597 (Accession XM_039922.2) is another GAM72 target gene, herein designated TARGET GENE. LOC96597 BINDING SITE is a target binding site found in the 5' untranslated region of mRNA encoded by LOC96597, corresponding to a target binding site such as BINDING SITE I, BINDING SITE II or BINDING SITE III of FIG. 8. Table 4 illustrates the complementarity of the nucleotide sequences of LOC96597 BINDING SITE, designated SEQ ID:18099, to the nucleotide sequence of GAM72 RNA, herein designated GAM RNA, also designated SEQ ID:342.

Another function of GAM72 is therefore inhibition of LOC96597 (Accession XM_039922.2). Accordingly, utilities of GAM72 include diagnosis, prevention and treatment of diseases and clinical conditions associated with LOC96597.

Leucine rich repeat (in flii) interacting protein 1 (LRRFIP1, Accession NM_004735.1) is another GAM72 target gene, herein designated TARGET GENE. LRRFIP1 BINDING SITE is a target binding site found in the 3' untranslated region of mRNA encoded by LRRFIP1, corresponding to a target binding site such as BINDING SITE I, BINDING SITE II or BINDING SITE III of FIG. 8. Table 4 illustrates the complementarity of the nucleotide sequences of LRRFIP1 BINDING SITE, designated SEQ ID:15700, to the nucleotide sequence of GAM72 RNA, herein designated GAM RNA, also designated SEQ ID:342.

Another function of GAM72 is therefore inhibition of Leucine rich repeat (in flii) interacting protein 1 (LRRFIP1, Accession NM_004735.1). Accordingly, utilities of GAM72 include diagnosis, prevention and treatment of diseases and clinical conditions associated with LRRFIP1.

LSR68 (Accession) is another GAM72 target gene, herein designated TARGET GENE. LSR68 BINDING SITE is a target binding site found in the 3' untranslated region of mRNA encoded by LSR68, corresponding to a target binding site such as BINDING SITE I, BINDING SITE II or BINDING SITE III of FIG. 8. Table 4 illustrates the complementarity of the nucleotide sequences of LSR68 BINDING SITE, designated SEQ ID:4233, to the nucleotide sequence of GAM72 RNA, herein designated GAM RNA, also designated SEQ ID:342.

Another function of GAM72 is therefore inhibition of LSR68 (Accession). Accordingly, utilities of GAM72 include diagnosis, prevention and treatment of diseases and clinical conditions associated with LSR68.

Mannan-binding lectin serine protease 1 (c4/c2 activating component of ra-reactive factor) (MASP1, Accession NM_001879.3) is another GAM72 target gene, herein designated TARGET GENE. MASP1 BINDING SITE is a target binding site found in the 3' untranslated region of multiple transcripts of mRNA encoded by MASP1, corresponding to a target binding site such as BINDING SITE I, BINDING SITE II or BINDING SITE III of FIG. 8. Table 4 illustrates the complementarity of the nucleotide sequences of MASP1 BINDING SITE, designated SEQ ID:9106, to the nucleotide sequence of GAM72 RNA, herein designated GAM RNA, also designated SEQ ID:342.

Another function of GAM72 is therefore inhibition of Mannan-binding lectin serine protease 1 (c4/c2 activating component of ra-reactive factor) (MASP1, Accession NM_001879.3), a gene which a complement- dependent bactericidal factor. Accordingly, utilities of GAM72 include diagnosis, prevention and treatment of diseases and clinical conditions associated with MASP1.

The function of MASP1 and its association with various diseases and clinical conditions, has been established by previous studies, as described hereinabove with reference to GAM40.1. MAWBP (Accession NM_022129.1) is another GAM72 target gene, herein designated TARGET GENE. MAWBP BINDING SITE is a target binding site found in the 3' untranslated region of mRNA encoded by MAWBP, corresponding to a target binding site such as BINDING SITE I, BINDING SITE II or BINDING SITE III of FIG. 8. Table 4 illustrates the complementarity of the nucleotide sequences of MAWBP BINDING SITE, designated SEQ ID:1896, to the nucleotide sequence of GAM72 RNA, herein designated GAM RNA, also designated SEQ ID:342.

Another function of GAM72 is therefore inhibition of MAWBP (Accession NM_022129.1). Accordingly, utilities of GAM72 include diagnosis, prevention and treatment of diseases and clinical conditions associated with MAWBP.

MED6 (Accession NM_005466.1) is another GAM72 target gene, herein designated TARGET GENE. MED6 BINDING SITE is a target binding site found in the 3' untranslated region of mRNA encoded by MED6, corresponding to a target binding site such as BINDING SITE I, BINDING SITE II or BINDING SITE III of FIG. 8. Table 4 illustrates the complementarity of the nucleotide sequences of MED6 BINDING SITE, designated SEQ ID:14033, to the nucleotide sequence of GAM72 RNA, herein designated GAM RNA, also designated SEQ ID:342.

Another function of GAM72 is therefore inhibition of MED6 (Accession NM_005466.1). Accordingly, utilities of GAM72 include diagnosis, prevention and treatment of diseases and clinical conditions associated with MED6.

Mesoderm development candidate 2 (MESDC2, Accession XM_051854.3) is another GAM72 target gene, herein designated TARGET GENE. MESDC2 BINDING SITE is a target binding site found in the 5' untranslated region of mRNA encoded by MESDC2, corresponding to a target binding site such as BINDING SITE I, BINDING SITE II or BINDING SITE III of FIG. 8. Table 4 illustrates the complementarity of the nucleotide sequences of MESDC2 BINDING SITE, designated SEQ ID:5973, to the nucleotide sequence of GAM72 RNA, herein designated GAM RNA, also designated SEQ ID:342.

Another function of GAM72 is therefore inhibition of Mesoderm development candidate 2 (MESDC2, Accession XM_051854.3). Accordingly, utilities of GAM72 include diagnosis, prevention and treatment of diseases and clinical conditions associated with MESDC2.

MGC10999 (Accession NM_032307.1) is another GAM72 target gene, herein designated TARGET GENE. MGC10999 BINDING SITE is a target binding site found in the 3' untranslated region of mRNA encoded by MGC10999, corresponding to a target binding site such as BINDING SITE I, BINDING SITE II or BINDING SITE III of FIG. 8. Table 4 illustrates the complementarity of the nucleotide sequences of MGC10999 BINDING SITE, designated SEQ ID:15448, to the nucleotide sequence of GAM72 RNA, herein designated GAM RNA, also designated SEQ ID:342.

Another function of GAM72 is therefore inhibition of MGC10999 (Accession NM_032307.1). Accordingly, utilities of GAM72 include diagnosis, prevention and treatment of diseases and clinical conditions associated with MGC10999.

MGC11287 (Accession) is another GAM72 target gene, herein designated TARGET GENE. MGC11287 BINDING SITE is a target binding site found in the 5' untranslated region of mRNA encoded by MGC11287, corresponding to a target binding site such as BINDING SITE I, BINDING SITE II or BINDING SITE III of FIG. 8. Table 4 illustrates the complementarity of the nucleotide sequences of MGC11287 BINDING SITE, designated SEQ ID:4413, to the nucleotide sequence of GAM72 RNA, herein designated GAM RNA, also designated SEQ ID:342.

Another function of GAM72 is therefore inhibition of MGC11287 (Accession). Accordingly, utilities of GAM72 include diagnosis, prevention and treatment of diseases and clinical conditions associated with MGC11287.

MGC15631 (Accession NM_032753.2) is another GAM72 target gene, herein designated TARGET GENE. MGC15631 BINDING SITE is a target binding site found in the 3' untranslated region of mRNA encoded by MGC15631, corresponding to a target binding site such as BINDING SITE I, BINDING SITE II or BINDING SITE III of FIG. 8. Table 4 illustrates the complementarity of the nucleotide sequences of MGC15631 BINDING SITE, designated SEQ ID:2277, to the nucleotide sequence of GAM72 RNA, herein designated GAM RNA, also designated SEQ ID:342.

Another function of GAM72 is therefore inhibition of MGC15631 (Accession NM_032753.2). Accordingly, utilities of GAM72 include diagnosis, prevention and treatment of diseases and clinical conditions associated with MGC15631.

MGC16037 (Accession NM_032887.1) is another GAM72 target gene, herein designated TARGET GENE. MGC16037 BINDING SITE is a target binding site found in the 3' untranslated region of mRNA encoded by MGC16037, corresponding to a target binding site such as BINDING SITE I, BINDING SITE II or BINDING SITE III of FIG. 8. Table 4 illustrates the complementarity of the nucleotide sequences of MGC16037 BINDING SITE, designated SEQ ID:11316, to the nucleotide sequence of GAM72 RNA, herein designated GAM RNA, also designated SEQ ID:342.

Another function of GAM72 is therefore inhibition of MGC16037 (Accession NM_032887.1). Accordingly, utilities of GAM72 include diagnosis, prevention and treatment of diseases and clinical conditions associated with MGC16037.

MGC20235 (Accession NM_145041.1) is another GAM72 target gene, herein designated TARGET GENE. MGC20235 BINDING SITE is a target binding site found in the 3' untranslated region of mRNA encoded by MGC20235, corresponding to a target binding site such as BINDING SITE I, BINDING SITE II or BINDING SITE III of FIG. 8. Table 4 illustrates the complementarity of the nucleotide sequences of MGC20235 BINDING SITE, designated SEQ ID:8637, to the nucleotide sequence of GAM72 RNA, herein designated GAM RNA, also designated SEQ ID:342.

Another function of GAM72 is therefore inhibition of MGC20235 (Accession NM_145041.1). Accordingly, utilities of GAM72 include diagnosis, prevention and treatment of diseases and clinical conditions associated with MGC20235.

MGC26641 (Accession NM_144971.1) is another GAM72 target gene, herein designated TARGET GENE. MGC26641 BINDING SITE is a target binding site found in the 3' untranslated region of mRNA encoded by MGC26641, corresponding to a target binding site such as BINDING SITE I, BINDING SITE II or BINDING SITE III of FIG. 8. Table 4 illustrates the complementarity of the nucleotide sequences of MGC26641 BINDING SITE, designated SEQ ID:14080, to the nucleotide sequence of GAM72 RNA, herein designated GAM RNA, also designated SEQ ID:342.

Another function of GAM72 is therefore inhibition of MGC26641 (Accession NM_144971.1). Accordingly, utilities of GAM72 include diagnosis, prevention and treatment of diseases and clinical conditions associated with MGC26641.

MGC29891 (Accession NM_144618.1) is another GAM72 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:20056, to the nucleotide sequence of GAM72 RNA, herein designated GAM RNA, also designated SEQ ID:342.

Another function of GAM72 is therefore inhibition of MGC29891 (Accession NM_144618.1). Accordingly, utilities of GAM72 include diagnosis, prevention and treatment of diseases and clinical conditions associated with MGC29891.

MGC3169 (Accession NM_024074.1) is another GAM72 target gene, herein designated TARGET GENE. MGC3169 BINDING SITE is a target binding site found in the 3' untranslated region of mRNA encoded by MGC3169, corresponding to a target binding site such as BINDING SITE I, BINDING SITE II or BINDING SITE III of FIG. 8. Table 4 illustrates the complementarity of the nucleotide sequences of MGC3169 BINDING SITE, designated SEQ ID:403, to the nucleotide sequence of GAM72 RNA, herein designated GAM RNA, also designated SEQ ID:342.

Another function of GAM72 is therefore inhibition of MGC3169 (Accession NM_024074.1). Accordingly, utilities of GAM72 include diagnosis, prevention and treatment of diseases and clinical conditions associated with MGC3169.

MGC39350 (Accession NM_144970.1) is another GAM72 target gene, herein designated TARGET GENE. MGC39350 BINDING SITE is a target binding site found in the 3' untranslated region of mRNA encoded by MGC39350, corresponding to a target binding site such as BINDING SITE I, BINDING SITE II or BINDING SITE III of FIG. 8. Table 4 illustrates the complementarity of the nucleotide sequences of MGC39350 BINDING SITE, designated SEQ ID:16509, to the nucleotide sequence of GAM72 RNA, herein designated GAM RNA, also designated SEQ ID:342.

Another function of GAM72 is therefore inhibition of MGC39350 (Accession NM_144970.1). Accordingly, utilities of GAM72 include diagnosis, prevention and treatment of diseases and clinical conditions associated with MGC39350.

MGC4368 (Accession NM_024510.2) is another GAM72 target gene, herein designated TARGET GENE. MGC4368 BINDING SITE is a target binding site found in the 3' untranslated region of mRNA encoded by MGC4368, corresponding to a target binding site such as BINDING SITE I, BINDING SITE II or BINDING SITE III of FIG. 8. Table 4 illustrates the complementarity of the nucleotide sequences of MGC4368 BINDING SITE, designated SEQ ID:8406, to the nucleotide sequence of GAM72 RNA, herein designated GAM RNA, also designated SEQ ID:342.

Another function of GAM72 is therefore inhibition of MGC4368 (Accession NM_024510.2). Accordingly, utilities of GAM72 include diagnosis, prevention and treatment of diseases and clinical conditions associated with MGC4368.

MGC4562 (Accession NM_133375.1) is another GAM72 target gene, herein designated TARGET GENE. MGC4562 BINDING SITE is a target binding site found in the 3' untranslated region of mRNA encoded by MGC4562, corresponding to a target binding site such as BINDING SITE I, BINDING SITE II or BINDING SITE III of FIG. 8. Table 4 illustrates the complementarity of the nucleotide sequences of MGC4562 BINDING SITE, designated SEQ ID:12121, to the nucleotide sequence of GAM72 RNA, herein designated GAM RNA, also designated SEQ ID:342.

Another function of GAM72 is therefore inhibition of MGC4562 (Accession NM_133375.1). Accordingly, utilities of GAM72 include diagnosis, prevention and treatment of diseases and clinical conditions associated with MGC4562.

MGC4771 (Accession NM_032668.1) is another GAM72 target gene, herein designated TARGET GENE. MGC4771 BINDING SITE is a target binding site found in the 3' untranslated region of mRNA encoded by MGC4771, corresponding to a target binding site such as BINDING SITE I, BINDING SITE II or BINDING SITE III of FIG. 8. Table 4 illustrates the complementarity of the nucleotide sequences of MGC4771 BINDING SITE, designated SEQ ID:18399, to the nucleotide sequence of GAM72 RNA, herein designated GAM RNA, also designated SEQ ID:342.

Another function of GAM72 is therefore inhibition of MGC4771 (Accession NM_032668.1). Accordingly, utilities of GAM72 include diagnosis, prevention and treatment of diseases and clinical conditions associated with MGC4771.

MGC4840 (Accession NM_031490.1) is another GAM72 target gene, herein designated TARGET GENE. MGC4840 BINDING SITE is a target binding site found in the 3' untranslated region of mRNA encoded by MGC4840, corresponding to a target binding site such as BINDING SITE I, BINDING SITE II or BINDING SITE III of FIG. 8. Table 4 illustrates the complementarity of the nucleotide sequences of MGC4840 BINDING SITE, designated SEQ ID:18803, to the nucleotide sequence of GAM72 RNA, herein designated GAM RNA, also designated SEQ ID:342.

Another function of GAM72 is therefore inhibition of MGC4840 (Accession NM_031490.1). Accordingly, utilities of GAM72 include diagnosis, prevention and treatment of diseases and clinical conditions associated with MGC4840.

MGC5457 (Accession NM_032633.1) is another GAM72 target gene, herein designated TARGET GENE. MGC5457 BINDING SITE is a target binding site found in the 3' untranslated region of mRNA encoded by MGC5457, corresponding to a target binding site such as BINDING SITE I, BINDING SITE II or BINDING SITE III of FIG. 8. Table 4 illustrates the complementarity of the nucleotide sequences of MGC5457 BINDING SITE, designated SEQ ID:17297, to the nucleotide sequence of GAM72 RNA, herein designated GAM RNA, also designated SEQ ID:342.

Another function of GAM72 is therefore inhibition of MGC5457 (Accession NM_032633.1). Accordingly, utilities of GAM72 include diagnosis, prevention and treatment of diseases and clinical conditions associated with MGC5457.

MIR16 (Accession NM_016641.2) is another GAM72 target gene, herein designated TARGET GENE. MIR16 BINDING SITE is a target binding site found in the 3' untranslated region of mRNA encoded by MIR16, corresponding to a target binding site such as BINDING SITE I, BINDING SITE II or BINDING SITE III of FIG. 8. Table 4 illustrates the complementarity of the nucleotide sequences of MIR16 BINDING SITE, designated SEQ ID:10113, to the nucleotide sequence of GAM72 RNA, herein designated GAM RNA, also designated SEQ ID:342.

Another function of GAM72 is therefore inhibition of MIR16 (Accession NM_016641.2), a gene which is a membrane interacting protein. Accordingly, utilities of GAM72 include diagnosis, prevention and treatment of diseases and clinical conditions associated with MIR16.

The function of MIR16 has been established by previous studies. Using a yeast 2-hybrid screen to identify proteins that interact with RGS16 (OMIM Ref. No. 602514), Zheng et al. (2000) isolated a cDNA encoding rat Mir16. By searching sequence databases with rat Mir16 as the probe, they identified a cDNA encoding human MIR16 that had been reported by Loftus et al. (1999) as part of a large-scale chromosome 16 sequencing effort. The human MIR16 protein shares 94% amino acid similarity with rat MIR16 and also shares strong homology with bacterial glycerophosphodiester phosphodiesterases. Northern blot analysis detected widespread expression of a 1.8-kb Mir16 transcript in rat tissues, with highest levels in heart, brain, liver, kidney, and testis. Similar expression was observed for human and mouse MIR16. Using yeast 2-hybrid and GST pull-down assay, Zheng et al. (2000) demonstrated that MIR16 interacts with the RGS domain of RGS16 and weakly with other RGS proteins, including RGS2 (OMIM Ref. No. 600861). Membrane association assays and endoglycosidase H digestion showed that MIR16 is an integral membrane glycoprotein. Immunofluorescence and immunoelectron microscopy localized Mir16 in the intracellular membranes in rat pituitary and on the plasma membrane in rat liver and kidney. By genomic sequence analysis, Loftus et al. (1999) mapped the MIR16 gene to chromosome 16p.

Full details of the abovementioned studies are described in the following publications, the disclosure of which are hereby incorporated by reference:

Loftus, B. J.; Kim, U.-J.; Sneddon, V. P.; Kalush, F.; Brandon, R.; Fuhrmann, J.; Mason, T.; Crosby, M. L.; Barnstead, M.; Cronin, L.; May, A. D.; Cao, Y.; Xu, R. X.; Kang, H.-L.; Mitchell, S.; Eichler, E. E.; Harris, P. C.; Venter, J. C.; Adams, M. D. : Genome duplications and other features in 12 Mb of DNA sequence from human chromosome 16p and 16q. Genomics 60:295-308, 1999; and Zheng, B.; Chen, D.; Farquhar, M. G.: MIR16, a putative membrane glycerophosphodiester phosphodiesterase, interacts with RGS16. Proc. Nat. Acad. Sci. 97:3999-4004, 2000.

Further studies establishing the function and utilities of MIR16 are found in John Hopkins OMIM database record ID 605943, and in cited publications listed in Table 5, which are hereby incorporated by reference. Myeloid/lymphoid or mixed-lineage leukemia (trithorax homolog, drosophila); translocated to, 4 (MLLT4, Accession NM_005936.1) is another GAM72 target gene, herein designated TARGET GENE. MLLT4 BINDING SITE is a target binding site found in the 3' untranslated region of mRNA encoded by MLLT4, corresponding to a target binding site such as BINDING SITE I, BINDING SITE II or BINDING SITE III of FIG. 8. Table 4 illustrates the complementarity of the nucleotide sequences of MLLT4 BINDING SITE, designated SEQ ID:14447, to the nucleotide sequence of GAM72 RNA, herein designated GAM RNA, also designated SEQ ID:342.

Another function of GAM72 is therefore inhibition of Myeloid/lymphoid or mixed-lineage leukemia (trithorax homolog, drosophila); translocated to, 4 (MLLT4, Accession NM_005936.1), a gene which may act as an intracellular signaling component and therefore is associated with Acute leukemias. Accordingly, utilities of GAM72 include diagnosis, prevention and treatment of Acute leukemias, and of other diseases and clinical conditions associated with MLLT4.

The function of MLLT4 has been established by previous studies. Most acute leukemias in infancy and at least 5% of acute lymphoblastic leukemias and acute myeloid leukemias of older children and adults show abnormalities of chromosome band 11q23. In these cases, translocation results in fusion of a gene at 11q23, variously called ALL1, MLL, and the human homolog of Drosophila 'trithorax' (OMIM Ref. No. 159555), with part of a gene on chromosome 4 (OMIM Ref. No. 159557), chromosome 9 (OMIM Ref. No. 159558), or chromosome 19 (OMIM Ref. No. 159556). Prasad et al. (1993) described the cloning and characterization of the 'partner gene' involved in a fourth common translocation involving 11q23, t(6;11)(q27;q23). The gene, designated AF6 by them, was found to be expressed in a variety of cell types and to encode a protein of 1,612 amino acids. The protein contains short stretches rich in proline, charged amino acids, serines, or glutamines. In addition, the AF6 protein contains the GLGF motif shared with several proteins of vertebrates and invertebrates thought to be involved in signal transduction at special cell-cell junctions. Using rapid amplification of cDNA ends (RACE) by PCR, Saha et al. (1995) confirmed the breakpoint in AF6 and identified a cDNA clone that was used as a probe to screen a chromosome 6 cosmid library. By fluorescence in situ hybridization, the single clone that was isolated was found to map distal to the critically deleted region associated with ovarian malignancies (OMIM Ref. No. 167000). AF6 is therefore distinct from and lies telomeric to that region. This gene is also symbolized MLLT4.

Full details of the abovementioned studies are described in the following publications, the disclosure of which are hereby incorporated by reference:

Prasad, R.; Gu, Y.; Alder, H.; Nakamura, T.; Canaani, O.; Saito, H.; Huebner, K.; Gale, R. P.; Nowell, P. C.; Kuriyama, K.; Miyazaki, Y.; Croce, C. M.; Canaani, E.: Cloning of the ALL-1 fusion partner, the AF-6 gene, involved in acute myeloid leukemias with the t(6;11) chromosome translocation. Cancer Res. 53:5624-5628, 1993; and Saha, V.; Lillington, D. M.; Shelling, A. N.; Chaplin, T.; Yaspo, M.-L.; Ganesan, T. S.; Young, B. D.: AF6 gene on chromosome band 6q27 maps distal to the minimal region of deletion in.

Further studies establishing the function and utilities of MLLT4 are found in John Hopkins OMIM database record ID 159559, and in cited publications listed in Table 5, which are hereby incorporated by reference. MRPL56 (Accession) is another GAM72 target gene, herein designated TARGET GENE. MRPL56 BINDING SITE is a target binding site found in the 3' untranslated region of mRNA encoded by MRPL56, corresponding to a target binding site such as BINDING SITE I, BINDING SITE II or BINDING SITE III of FIG. 8. Table 4 illustrates the complementarity of the nucleotide sequences of MRPL56 BINDING SITE, designated SEQ ID:9134, to the nucleotide sequence of GAM72 RNA, herein designated GAM RNA, also designated SEQ ID:342.

Another function of GAM72 is therefore inhibition of MRPL56 (Accession). Accordingly, utilities of GAM72 include diagnosis, prevention and treatment of diseases and clinical conditions associated with MRPL56.

Mitochondrial ribosomal protein s18b (MRPS18B, Accession NM_014046.2) is another GAM72 target gene, herein designated TARGET GENE. MRPS18B BINDING SITE is a target binding site found in the 3' untranslated region of mRNA encoded by MRPS18B, corresponding to a target binding site such as BINDING SITE I, BINDING SITE II or BINDING SITE III of FIG. 8. Table 4 illustrates the complementarity of the nucleotide sequences of MRPS18B BINDING SITE, designated SEQ ID:18538, to the nucleotide sequence of GAM72 RNA, herein designated GAM RNA, also designated SEQ ID:342.

Another function of GAM72 is therefore inhibition of Mitochondrial ribosomal protein s18b (MRPS18B, Accession NM_014046.2). Accordingly, utilities of GAM72 include diagnosis, prevention and treatment of diseases and clinical conditions associated with MRPS18B.

Myosin ib (MYO1B, Accession XM_290989.1) is another GAM72 target gene, herein designated TARGET GENE. MYO1B BINDING SITE is a target binding site found in the 3' untranslated region of mRNA encoded by MYO1B, corresponding to a target binding site such as BINDING SITE I, BINDING SITE II or BINDING SITE III of FIG. 8. Table 4 illustrates the complementarity of the nucleotide sequences of MYO1B BINDING SITE, designated SEQ ID:9604, to the nucleotide sequence of GAM72 RNA, herein designated GAM RNA, also designated SEQ ID:342.

Another function of GAM72 is therefore inhibition of Myosin ib (MYO1B, Accession XM_290989.1). Accordingly, utilities of GAM72 include diagnosis, prevention and treatment of diseases and clinical conditions associated with MYO1B.

NBR2 (Accession NM_005821.2) is another GAM72 target gene, herein designated TARGET GENE. NBR2 BINDING SITE is a target binding site found in the 3' untranslated region of mRNA encoded by NBR2, corresponding to a target binding site such as BINDING SITE I, BINDING SITE II or BINDING SITE III of FIG. 8. Table 4 illustrates the complementarity of the nucleotide sequences of NBR2 BINDING SITE, designated SEQ ID:6975, to the nucleotide sequence of GAM72 RNA, herein designated GAM RNA, also designated SEQ ID:342.

Another function of GAM72 is therefore inhibition of NBR2 (Accession NM_005821.2). Accordingly, utilities of GAM72 include diagnosis, prevention and treatment of diseases and clinical conditions associated with NBR2.

Nephrosis 1, congenital, finnish type (nephrin) (NPHS1, Accession NM_004646.1) is another GAM72 target gene, herein designated TARGET GENE. NPHS1 BINDING SITE is a target binding site found in the 5' untranslated region of mRNA encoded by NPHS1, corresponding to a target binding site such as BINDING SITE I, BINDING SITE II or BINDING SITE III of FIG. 8. Table 4 illustrates the complementarity of the nucleotide sequences of NPHS1 BINDING SITE, designated SEQ ID:19090, to the nucleotide sequence of GAM72 RNA, herein designated GAM RNA, also designated SEQ ID:342.

Another function of GAM72 is therefore inhibition of Nephrosis 1, congenital, finnish type (nephrin) (NPHS1, Accession NM_004646.1). Accordingly, utilities of GAM72 include diagnosis, prevention and treatment of diseases and clinical conditions associated with NPHS1.

Nebulin-related anchoring protein (Nrap, Accession NM_006175.2) is another GAM72 target gene, herein designated TARGET GENE. Nrap BINDING SITE is a target binding site found in the 3' untranslated region of mRNA encoded by Nrap, corresponding to a target binding site such as BINDING SITE I, BINDING SITE II or BINDING SITE III of FIG. 8. Table 4 illustrates the complementarity of the nucleotide sequences of Nrap BINDING SITE, designated SEQ ID:915, to the nucleotide sequence of GAM72 RNA, herein designated GAM RNA, also designated SEQ ID:342.

Another function of GAM72 is therefore inhibition of Nebulin-related anchoring protein (Nrap, Accession NM_006175.2), a gene which performs an anchoring function to link the terminal actin filaments of myofibrils to protein complexes located beneath the sarcolemma. Accordingly, utilities of GAM72 include diagnosis, prevention and treatment of diseases and clinical conditions associated with Nrap.

The function of Nrap has been established by previous studies. Nebulin is a family of giant myofibrillar proteins found within the sarcomeres of skeletal muscle. See (OMIM Ref. No. 161650). Over 95% of the nebulin protein consists of 185 copies of a 35- to 40-amino acid module. Most of the modules are arranged into a higher order repeating sequence termed a 'nebulin super repeat.' By screening a mouse skeletal muscle library with a human nebulin cDNA, Luo et al. (1997) isolated cDNAs encoding a protein that they called 'nebulin-related anchoring protein,' or NRAP. Sequence analysis predicted that NRAP is a 1,175-amino acid protein with a pI of 9.26. The C-terminal half of NRAP includes an actin- binding domain with homology to the nebulin super repeats. The N-terminal region contains a LIM domain, thought to mediate protein-protein interactions. Northern blot analysis of various mouse tissues revealed that NRAP is expressed as a 6-kb mRNA only in skeletal muscle and heart. Antibodies against NRAP recognized a 185-kD band on Western blots of skeletal and cardiac muscle proteins. Using immunofluorescence, Luo et al. (1997) found that NRAP is localized at the myotendinous junction in skeletal muscle and the intercalated disc in cardiac muscle. The authors suggested that NRAP performs an anchoring function, linking the terminal actin filaments of myofibrils to protein complexes located beneath the sarcolemma. By searching the GenBank database, Luo et al. (1997) identified ESTs encoding the human NRAP homolog. Luo et al. (1997) mapped the human NRAP gene to 10q24-q26 using PCR of a radiation hybrid panel. By analysis of an interspecific backcross, they found that the mouse NRAP gene is located on chromosome 19 in a region showing homology of synteny with the human 10q23-q26 region.

Full details of the abovementioned studies are described in the following publications, the disclosure of which are hereby incorporated by reference:

Luo, G.; Leroy, E.; Kozak, C. A.; Polymeropoulos, M. H.; Horowits, R.: Mapping of the gene (NRAP) encoding N-RAP in the mouse and human genomes. Genomics 45:229-232, 1997; and Luo, G.; Zhang, J. Q.; Nguyen, T.-P.; Herrera, A. H.; Paterson, B.; Horowits, R. : Complete cDNA sequence and tissue localization of N-RAP, a novel nebulin-related protein of striated m.

Further studies establishing the function and utilities of Nrap are found in John Hopkins OMIM database record ID 602873, and in cited publications listed in Table 5, which are hereby incorporated by reference. Nucleoporin 62 kda (NUP62, Accession NM_012346.2) is another GAM72 target gene, herein designated TARGET GENE. NUP62 BINDING SITE is a target binding site found in the 3' untranslated region of multiple transcripts of mRNA encoded by NUP62, corresponding to a target binding site such as BINDING SITE I, BINDING SITE II or BINDING SITE III of FIG. 8. Table 4 illustrates the complementarity of the nucleotide sequences of NUP62 BINDING SITE, designated SEQ ID:16510, to the nucleotide sequence of GAM72 RNA, herein designated GAM RNA, also designated SEQ ID:342.

Another function of GAM72 is therefore inhibition of Nucleoporin 62 kda (NUP62, Accession NM_012346.2). Accordingly, utilities of GAM72 include diagnosis, prevention and treatment of diseases and clinical conditions associated with NUP62.

2'-5'-oligoadenylate synthetase-like (OASL, Accession NM_003733.1) is another GAM72 target gene, herein designated TARGET GENE. OASL BINDING SITE is a target binding site found in the 3' untranslated region of mRNA encoded by OASL, corresponding to a target binding site such as BINDING SITE I, BINDING SITE II or BINDING SITE III of FIG. 8. Table 4 illustrates the complementarity of the nucleotide sequences of OASL BINDING SITE, designated SEQ ID:17989, to the nucleotide sequence of GAM72 RNA, herein designated GAM RNA, also designated SEQ ID:342.

Another function of GAM72 is therefore inhibition of 2'-5'-oligoadenylate synthetase-like (OASL, Accession NM_003733.1), a gene which does not have 2'-5'-oas activity, but binds double-stranded rna and dna. Accordingly, utilities of GAM72 include diagnosis, prevention and treatment of diseases and clinical conditions associated with OASL.

The function of OASL has been established by previous studies. 2-prime,5-prime oligoadenylates (2-5As) bind to and activate RNase L (OMIM Ref. No. 180435), resulting in general RNA degradation and consequent inhibition of protein synthesis. 2-5As are produced by a well-conserved family of interferon-induced enzymes, the 2-5A synthetases or OASs. By searching an EST database for sequences related to the human OASs OAS1 (OMIM Ref. No. 164350) and p69OAS, Hartmann et al. (1998) identified a cDNA encoding a protein that they called p59OASL (59-kD 2-5A synthetase-like protein). The predicted 514-amino acid p59OASL shares a highly conserved N-terminal domain with other OASs. The C-terminal portion of p59OASL contains 2 ubiquitin-like domains. Northern blot analysis revealed that p59OASL is expressed in most tissues, with the highest levels in primary blood leukocytes and other hematopoietic system tissues, colon, and stomach. p59OASL transcription is induced by interferon. The p59OASL gene contains 6 exons. Exons 1-5 are similar in structure to exons 3-7 of OAS1, suggesting that the 2 genes arose from a duplication of an ancestral gene. The thyroid hormone receptors (TRs) are hormone-dependent transcription factors that regulate expression of a variety of specific target genes. In a screen for TR- interacting proteins (TRIPs; OMIM Ref. No. 602933), Lee et al. (1995) identified an OASL cDNA and designated it TRIP14.

Full details of the abovementioned studies are described in the following publications, the disclosure of which are hereby incorporated by reference:

Hartmann, R.; Olsen, H. S.; Widder, S.; Jorgensen, R.; Justesen, J.: p59OASL, a 2-prime-5-prime oligoadenylate synthetase like protein: a novel human gene related to the 2-prime-5-prime oligoadenylate synthetase family. Nucleic Acids Res. 26:4121-4127, 1998; and Lee, J. W.; Choi, H.-S.; Gyuris, J.; Brent, R.; Moore, D. D.: Two classes of proteins dependent on either the presence or absence of thyroid hormone for interaction with the thyroid ho.

Further studies establishing the function and utilities of OASL are found in John Hopkins OMIM database record ID 603281, and in cited publications listed in Table 5, which are hereby incorporated by reference. Optic atrophy 3 (autosomal recessive, with chorea and spastic paraplegia) (OPA3, Accession NM_025136.1) is another GAM72 target gene, herein designated TARGET GENE. OPA3 BINDING SITE is a target binding site found in the 3' untranslated region of mRNA encoded by OPA3, corresponding to a target binding site such as BINDING SITE I, BINDING SITE II or BINDING SITE III of FIG. 8. Table 4 illustrates the complementarity of the nucleotide sequences of OPA3 BINDING SITE, designated SEQ ID:2498, to the nucleotide sequence of GAM72 RNA, herein designated GAM RNA, also designated SEQ ID:342.

Another function of GAM72 is therefore inhibition of Optic atrophy 3 (autosomal recessive, with chorea and spastic paraplegia) (OPA3, Accession NM_025136.1). Accordingly, utilities of GAM72 include diagnosis, prevention and treatment of diseases and clinical conditions associated with OPA3.

Purinergic receptor p2x, ligand-gated ion channel, 7 (P2RX7, Accession NM_002562.3) is another GAM72 target gene, herein designated TARGET GENE. P2RX7 BINDING SITE is a target binding site found in the 3' untranslated region of multiple transcripts of mRNA encoded by P2RX7, corresponding to a target binding site such as BINDING SITE I, BINDING SITE II or BINDING SITE III of FIG. 8. Table 4 illustrates the complementarity of the nucleotide sequences of P2RX7 BINDING SITE, designated SEQ ID:17467, to the nucleotide sequence of GAM72 RNA, herein designated GAM RNA, also designated SEQ ID:342.

Another function of GAM72 is therefore inhibition of Purinergic receptor p2x, ligand-gated ion channel, 7 (P2RX7, Accession NM_002562.3), a gene which responsible for atp-dependent lysis of macrophages and therefore may be associated with Chronic lymphatic leukemia. Accordingly, utilities of GAM72 include diagnosis, prevention and treatment of Chronic lymphatic leukemia, and of other diseases and clinical conditions associated with P2RX7.

The function of P2RX7 has been established by previous studies. Wiley et al. (2002) did a study to ascertain whether or not a glu496- to - ala (E496A; 1513A-C) single-nucleotide polymorphism that results in loss of function of P2X7 in healthy individuals, was present in leukemic B lymphocytes of patients with chronic lymphatic leukemia (CLL; 151400). They studied genomic DNA from the peripheral blood leukocytes of 36 unrelated individuals with CLL, 4 individuals with familial CLL, and 46 age-matched controls. The prevalence of the polymorphic mutation and the frequency of the mutant allele were 3-fold greater in individuals with CLL than in white, elderly controls. Individuals homozygous for the polymorphic allele had no P2X7 receptor function and heterozygotes had half the normal function of that seen in individuals homozygous for the wildtype allele; amounts of ATP-induced apoptosis varied accordingly. In 2 families in which Wiley et al. (2002) studied a father-son pair and a sister- sister pair with CLL, loss of P2X7 function arose because of inheritance of 1 or 2 1513A-C alleles for P2X7. They concluded that activation of the P2X7 receptor leads to apoptosis of lymphocytes in individuals with CLL, and reduced function of this receptor has an antiapoptotic effect, resulting in an increase in B-cell numbers. Thus, inheritance of a loss-of-function polymorphic mutation at position 1513 in the P2X7 gene would contribute to the pathogenesis of CLL.

Animal model experiments lend further support to the function of P2RX7. Solle et al. (2001) generated P2rx7-deficient mice by homologous recombination. Macrophages from the mutant mice were unable to respond to extracellular ATP as measured by fluorescent dye accumulation. In addition, ATP or lipopolysaccharide (LPS) stimulation of macrophages resulted in the accumulation of 35-kD pro-Il1b (OMIM Ref. No. 147720) in amounts comparable to wildtype, but only wildtype macrophages secreted the 17-kD Il1b. Both wildtype and mutant macrophages produced and released the 17-kD form in response to the potassium ionophore nigericin. Likewise, in vivo, mutant mice primed with LPS and challenged with ATP failed to generate significant levels of Il1b. Il6 (OMIM Ref. No. 147620), on the other hand, was produced by the mutant mice in response to LPS but without additional production after ATP challenge, suggesting that ATP affects IL6 production via both P2RX7-dependent and -independent mechanisms.

It is appreciated that the abovementioned animal model for P2RX7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Wiley, J. S.; Dao-Ung, L. P.; Gu, B. J.; Sluyter, R.; Shemon, A. N.; Li, C.; Taper, J.; Gallo, J.; Manoharan, A.: A loss-of-function polymorphic mutation in the cytolytic P2X7 receptor gene and chronic lymphocyte leukaemia: a molecular study. Lancet 359:1114-1119, 2002; and Solle, M.; Labasi, J.; Perregaux, D. G.; Stam, E.; Petrushova, N.; Koller, B. H.; Griffiths, R. J.; Gabel, C. A.: Altered cytokine production in mice lacking P2X7 receptors. J. Biol. C.

Further studies establishing the function and utilities of P2RX7 are found in John Hopkins OMIM database record ID 602566, and in cited publications listed in Table 5, which are hereby incorporated by reference. Pyrimidinergic receptor p2y, g-protein coupled, 6 (P2RY6, Accession NM_176796.1) is another GAM72 target gene, herein designated TARGET GENE. P2RY6 BINDING SITE is a target binding site found in the 3' untranslated region of multiple transcripts of mRNA encoded by P2RY6, corresponding to a target binding site such as BINDING SITE I, BINDING SITE II or BINDING SITE III of FIG. 8. Table 4 illustrates the complementarity of the nucleotide sequences of P2RY6 BINDING SITE, designated SEQ ID:2502, to the nucleotide sequence of GAM72 RNA, herein designated GAM RNA, also designated SEQ ID:342.

Another function of GAM72 is therefore inhibition of Pyrimidinergic receptor p2y, g-protein coupled, 6 (P2RY6, Accession NM_176796.1), a gene which mediates cellular responses to nucleotides. Accordingly, utilities of GAM72 include diagnosis, prevention and treatment of diseases and clinical conditions associated with P2RY6.

The function of P2RY6 has been established by previous studies. Chang et al. (1995) discovered the first receptor of the P2Y6 type in rat. The human ortholog was identified by Communi et al. (1996). Maier et al. (1997) identified 3 isoforms of P2Y6 cDNA. Two contained the same contiguous open reading frames, but differed in their 5-prime untranslated regions and may, therefore, originate by alternative splicing; the third represented a pseudogene. Analysis of P2Y receptor subtype expression in human bone and 2 osteoblastic cell lines by RT-PCR showed that all known human P2Y receptor subtypes were expressed: P2Y1 (P2RY1; 601167), P2Y2, P2Y4, P2Y6, and P2Y7 (OMIM Ref. No. 601531). In contrast, analysis of brain-derived cell lines suggested that a selective expression of P2Y receptor subtypes occurs in brain tissue. By somatic cell hybridization, Pidlaoan et al. (1997) mapped the P2RY6 gene to 11q13.3-q13.5. By fluorescence in situ hybridization and by sequence tagged site (STS) mapping using the National Center for Biotechnology Information (NCBI) database, Somers et al. (1997) mapped the P2RY6 gene to 11q13.5, between polymorphic markers D11S1314 and D11S916. Further NCBI database analysis of the P2Y purinoceptor genes revealed that P2RY2 (OMIM Ref. No. 600041) maps within less than 4 cM of P2RY6. This was the first chromosomal clustering of this gene family to be described. By phylogenetic analysis of the P2Y purinoceptor family, Somers et al. (1997) demonstrated the presence of 5 evolutionary branches and suggested the occurrence of an ancient gene duplication event.

Full details of the abovementioned studies are described in the following publications, the disclosure of which are hereby incorporated by reference:

Communi, D.; Parmentier, M.; Boeynaems, J.-M.: Cloning, functional expression and tissue distribution of the human P2Y6 receptor. Biochem. Biophys. Res. Commun. 222:303-308, 1996; and Maier, R.; Glatz, A.; Mosbacher, J.; Bilbe, G.: Cloning of P2Y6 cDNAs and identification of a pseudogene: comparison of P2Y receptor subtype expression in bone and brain tissues. Bioch.

Further studies establishing the function and utilities of P2RY6 are found in John Hopkins OMIM database record ID 602451, and in cited publications listed in Table 5, which are hereby incorporated by reference. PB1 (Accession NM_018165.1) is another GAM72 target gene, herein designated TARGET GENE. PB1 BINDING SITE is a target binding site found in the 3' untranslated region of multiple transcripts of mRNA encoded by PB1, corresponding to a target binding site such as BINDING SITE I, BINDING SITE II or BINDING SITE III of FIG. 8. Table 4 illustrates the complementarity of the nucleotide sequences of PB1 BINDING SITE, designated SEQ ID:12116, to the nucleotide sequence of GAM72 RNA, herein designated GAM RNA, also designated SEQ ID:342.

Another function of GAM72 is therefore inhibition of PB1 (Accession NM_018165.1). Accordingly, utilities of GAM72 include diagnosis, prevention and treatment of diseases and clinical conditions associated with PB1.

Protocadherin 11 y-linked (PCDH11Y, Accession NM_032972.1) is another GAM72 target gene, herein designated TARGET GENE. PCDH11Y BINDING SITE is a target binding site found in the 3' untranslated region of multiple transcripts of mRNA encoded by PCDH11Y, corresponding to a target binding site such as BINDING SITE I, BINDING SITE II or BINDING SITE III of FIG. 8. Table 4 illustrates the complementarity of the nucleotide sequences of PCDH11Y BINDING SITE, designated SEQ ID:12339, to the nucleotide sequence of GAM72 RNA, herein designated GAM RNA, also designated SEQ ID:342.

Another function of GAM72 is therefore inhibition of Protocadherin 11 y-linked (PCDH11Y, Accession NM_032972.1). Accordingly, utilities of GAM72 include diagnosis, prevention and treatment of diseases and clinical conditions associated with PCDH11Y.

Protocadherin beta 9 (PCDHB9, Accession NM_019119.3) is another GAM72 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:8982, to the nucleotide sequence of GAM72 RNA, herein designated GAM RNA, also designated SEQ ID:342.

Another function of GAM72 is therefore inhibition of Protocadherin beta 9 (PCDHB9, Accession NM_019119.3), a gene which is a potential calcium-dependent cell-adhesion protein. Accordingly, utilities of GAM72 include diagnosis, prevention and treatment of diseases and clinical conditions associated with PCDHB9.

The function of PCDHB9 has been established by previous studies. Cadherins are calcium-dependent cell-cell adhesion molecules that mediate neural cell-cell interactions. Protocadherins constitute a subfamily of nonclassic cadherins. PCDHB9 is a member of the beta cluster of protocadherin genes on 5q31. For specific information on the PCDHB genes, see 604967. Vanhalst et al. (2001) determined that unlike most PCDHB proteins, PCDHB9 has not 1 but 2 PXXP motifs, putative SH3 protein-binding sites, at the end of the conserved region of its cytoplasmic domain.

Full details of the abovementioned studies are described in the following publications, the disclosure of which are hereby incorporated by reference:

Vanhalst, K.; Kools, P.; Eynde, E. V.; van Roy, F.: The human and murine protocadherin-beta one-exon gene families show high evolutionary conservation, despite the difference in gene number. FEBS Lett. 495:120-125, 2001; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse a.

Further studies establishing the function and utilities of PCDHB9 are found in John Hopkins OMIM database record ID 606335, and in cited publications listed in Table 5, which are hereby incorporated by reference. Phosphodiesterase 4c, camp-specific (phosphodiesterase e1 dunce homolog, drosophila) (PDE4C, Accession NM_000923.1) is another GAM72 target gene, herein designated TARGET GENE. PDE4C BINDING SITE is a target binding site found in the 3' untranslated region of mRNA encoded by PDE4C, corresponding to a target binding site such as BINDING SITE I, BINDING SITE II or BINDING SITE III of FIG. 8. Table 4 illustrates the complementarity of the nucleotide sequences of PDE4C BINDING SITE, designated SEQ ID:16348, to the nucleotide sequence of GAM72 RNA, herein designated GAM RNA, also designated SEQ ID:342.

Another function of GAM72 is therefore inhibition of Phosphodiesterase 4c, camp-specific (phosphodiesterase e1 dunce homolog, drosophila) (PDE4C, Accession NM_000923.1), a gene which is a cAMP-specific phosphodiesterase and may be a protein involved in learning and memory. Accordingly, utilities of GAM72 include diagnosis, prevention and treatment of diseases and clinical conditions associated with PDE4C.

The function of PDE4C and its association with various diseases and clinical conditions, has been established by previous studies, as described hereinabove with reference to GAM65.1. Piwi-like 2 (drosophila) (PIWIL2, Accession NM_018068.2) is another GAM72 target gene, herein designated TARGET GENE. PIWIL2 BINDING SITE is a target binding site found in the 3' untranslated region of mRNA encoded by PIWIL2, corresponding to a target binding site such as BINDING SITE I, BINDING SITE II or BINDING SITE III of FIG. 8. Table 4 illustrates the complementarity of the nucleotide sequences of PIWIL2 BINDING SITE, designated SEQ ID:6875, to the nucleotide sequence of GAM72 RNA, herein designated GAM RNA, also designated SEQ ID:342.

Another function of GAM72 is therefore inhibition of Piwi-like 2 (drosophila) (PIWIL2, Accession NM_018068.2). Accordingly, utilities of GAM72 include diagnosis, prevention and treatment of diseases and clinical conditions associated with PIWIL2.

Phospholipase a2, group iid (PLA2G2D, Accession NM_012400.2) is another GAM72 target gene, herein designated TARGET GENE. PLA2G2D BINDING SITE is a target binding site found in the 3' untranslated region of mRNA encoded by PLA2G2D, corresponding to a target binding site such as BINDING SITE I, BINDING SITE II or BINDING SITE III of FIG. 8. Table 4 illustrates the complementarity of the nucleotide sequences of PLA2G2D BINDING SITE, designated SEQ ID:4938, to the nucleotide sequence of GAM72 RNA, herein designated GAM RNA, also designated SEQ ID:342.

Another function of GAM72 is therefore inhibition of Phospholipase a2, group iid (PLA2G2D, Accession NM_012400.2), a gene which is involved in phospholipid digestion, remodeling of cell membranes, and host defense, as well as pathophysiologic processes. Accordingly, utilities of GAM72 include diagnosis, prevention and treatment of diseases and clinical conditions associated with PLA2G2D.

The function of PLA2G2D has been established by previous studies. Phospholipase A2 (PLA2) family members (e.g., PLA2G2A; 172411) are lipolytic enzymes that hydrolyze the sn-2 fatty acid ester bond of glycerophospholipids to produce free fatty acid and lysophospholipids. PLA2s are involved in phospholipid digestion, remodeling of cell membranes, and host defense, as well as pathophysiologic processes involving the production prostaglandins, leukotrienes, thromboxanes, and platelet-activating factor. By searching an EST database using the catalytically essential residues of secretory PLA2s as the probe, followed by PCR of mouse and human spleen cDNA, Ishizaki et al. (1999) obtained cDNAs encoding mouse and human PLA2G2D. Sequence analysis predicted that the 145-amino acid human secretory protein, 48% identical PLA2G2A, contains a 20-residue signal peptide, a potential N-linked glycosylation site, 14 cys residues, and conserved his48 and asp49 sites. Analysis of enzymatic activity detected most activity in culture supernatant and determined that PLA2G2D preferentially hydrolyzes phosphatidylglycerol and phosphatidylethanolamine, followed by phosphatidylcholine, but does not hydrolyze phosphatidylserine or phosphatidic acid. Northern blot analysis revealed variable expression of 2.0- and 1.0-kb transcripts, with highest expression in pancreas and spleen. In a rat model, expression in thymus increased dramatically after lipopolysaccharide injection. By subtractive cDNA cloning using spleens from wildtype and tumor necrosis factor (Tnf; 191160)/lymphotoxin-alpha (Lta; 153440) double-knockout mice, followed by probing a spleen cDNA library, Shakhov et al. (2000) isolated a cDNA encoding mouse Pla2g2d, which they designated Splash (secretory-type PLA, stroma-associated homolog). Splash was expressed 6-fold less in mutant than wildtype mice. By screening a human cDNA library, they isolated cDNAs encoding human PLA2G2D. Shakhov et al. (2000) noted that the human and mouse protein sequences are 73% identical and 81% homologous. Northern blot analysis detected mouse Pla2g2d expression in adult but not embryonic spleen. By radiation hybrid mapping, Ishizaki et al. (1999) mapped the PLA2G2D gene to 1p36.12. Also using radiation hybrid analysis, Shakhov et al. (2000) mapped the PLA2G2D gene to 1p36.1-p35, near the PLA2G2A gene and a region known for frequent loss of heterozygosity in human tumors. Shakhov et al. (2000) mapped the mouse gene to chromosome 4.

Full details of the abovementioned studies are described in the following publications, the disclosure of which are hereby incorporated by reference:

Ishizaki, J.; Suzuki, N.; Higashino, K.; Yokota, Y.; Ono, T.; Kawamoto, K.; Fujii, N.; Arita, H.; Hanasaki, K.: Cloning and characterization of novel mouse and human secretory phospholipase A(2)s. J. Biol. Chem. 274:24973-24979, 1999; and Shakhov, A. N.; Rubtsov, A. V.; Lyakhov, I. G.; Tumanov, A. V.; Nedospasov, S. A.: SPLASH (PLA(2)IID), a novel member of phospholipase A2 family, is associated with lymphotoxin-defici.

Further studies establishing the function and utilities of PLA2G2D are found in John Hopkins OMIM database record ID 605630, and in cited publications listed in Table 5, which are hereby incorporated by reference. Polymerase (dna directed), eta (POLH, Accession NM_006502.1) is another GAM72 target gene, herein designated TARGET GENE. POLH BINDING SITE1 and POLH BINDING SITE2 are target binding sites found in untranslated regions of mRNA encoded by POLH, corresponding to target binding sites such as BINDING SITE I, BINDING SITE II or BINDING SITE III of FIG. 8. Table 4 illustrates the complementarity of the nucleotide sequences of POLH BINDING SITE1 and POLH BINDING SITE2, designated SEQ ID:19397 and SEQ ID:12030 respectively, to the nucleotide sequence of GAM72 RNA, herein designated GAM RNA, also designated SEQ ID:342.

Another function of GAM72 is therefore inhibition of Polymerase (dna directed), eta (POLH, Accession NM_006502.1). Accordingly, utilities of GAM72 include diagnosis, prevention and treatment of diseases and clinical conditions associated with POLH.

Polymerase (dna directed) kappa (POLK, Accession NM_016218.1) is another GAM72 target gene, herein designated TARGET GENE. POLK BINDING SITE is a target binding site found in the 3' untranslated region of mRNA encoded by POLK, corresponding to a target binding site such as BINDING SITE I, BINDING SITE II or BINDING SITE III of FIG. 8. Table 4 illustrates the complementarity of the nucleotide sequences of POLK BINDING SITE, designated SEQ ID:6167, to the nucleotide sequence of GAM72 RNA, herein designated GAM RNA, also designated SEQ ID:342.

Another function of GAM72 is therefore inhibition of Polymerase (dna directed) kappa (POLK, Accession NM_016218.1), a gene which is necessary for chromosome segregation. Accordingly, utilities of GAM72 include diagnosis, prevention and treatment of diseases and clinical conditions associated with POLK.

The function of POLK has been established by previous studies. Wang et al. (2000) found that yeast TRF4, an evolutionarily conserved gene necessary for chromosome segregation, encodes a DNA polymerase with beta-polymerase-like properties. A double mutant in the redundant homologs TRF4 and TRF5 is unable to complete S phase, whereas a TRF4 single mutant completes a presumably defective S phase that results in the failure of cohesion between the replicated sister chromatids. This suggested that TRFs are a key link in the coordination between DNA replication and sister chromatid cohesion. Walowsky et al. (1999) noted that a region of the human TRF4-1 gene is identical to an STS (OMIM Ref. No. G06245) mapping to 5p15. This region of chromosome 5p is among the most common regions amplified in small cell lung tumor cell lines and in primary small cell tumors. In addition, amplifications in this region are frequently found in high-grade ovarian tumors.

Full details of the abovementioned studies are described in the following publications, the disclosure of which are hereby incorporated by reference:

Wang, Z.; Castano, I. B.; De Las Penas, A.; Adams, C.; Christman, M. F.: Pol kappa: a DNA polymerase required for sister chromatid cohesion. Science 289:774-779, 2000; and Walowsky, C.; Fitzhugh, D. J.; Castano, I. B.; Ju, J. Y.; Levin, N. A.; Christman, M. F.: The topoisomerase-related function gene TRF4 affects cellular sensitivity to the antitumor agent.

Further studies establishing the function and utilities of POLK are found in John Hopkins OMIM database record ID 605198, and in cited publications listed in Table 5, which are hereby incorporated by reference. PP591 (Accession NM_025207.2) is another GAM72 target gene, herein designated TARGET GENE. PP591 BINDING SITE is a target binding site found in the 5' untranslated region of mRNA encoded by PP591, corresponding to a target binding site such as BINDING SITE I, BINDING SITE II or BINDING SITE III of FIG. 8. Table 4 illustrates the complementarity of the nucleotide sequences of PP591 BINDING SITE, designated SEQ ID:5542, to the nucleotide sequence of GAM72 RNA, herein designated GAM RNA, also designated SEQ ID:342.

Another function of GAM72 is therefore inhibition of PP591 (Accession NM_025207.2). Accordingly, utilities of GAM72 include diagnosis, prevention and treatment of diseases and clinical conditions associated with PP591.

Protein phosphatase 1, regulatory (inhibitor) subunit 3b (PPP1R3B, Accession NM_024607.1) is another GAM72 target gene, herein designated TARGET GENE. PPP1R3B BINDING SITE1 and PPP1R3B BINDING SITE2 are target binding sites found in untranslated regions of mRNA encoded by PPP1R3B, corresponding to target binding sites such as BINDING SITE I, BINDING SITE II or BINDING SITE III of FIG. 8. Table 4 illustrates the complementarity of the nucleotide sequences of PPP1R3B BINDING SITE1 and PPP1R3B BINDING SITE2, designated SEQ ID:12619 and SEQ ID:9817 respectively, to the nucleotide sequence of GAM72 RNA, herein designated GAM RNA, also designated SEQ ID:342.

Another function of GAM72 is therefore inhibition of Protein phosphatase 1, regulatory (inhibitor) subunit 3b (PPP1R3B, Accession NM_024607.1). Accordingly, utilities of GAM72 include diagnosis, prevention and treatment of diseases and clinical conditions associated with PPP1R3B.

PRIC285 (Accession NM_033405.1) is another GAM72 target gene, herein designated TARGET GENE. PRIC285 BINDING SITE is a target binding site found in the 3' untranslated region of mRNA encoded by PRIC285, corresponding to a target binding site such as BINDING SITE I, BINDING SITE II or BINDING SITE III of FIG. 8. Table 4 illustrates the complementarity of the nucleotide sequences of PRIC285 BINDING SITE, designated SEQ ID:17244, to the nucleotide sequence of GAM72 RNA, herein designated GAM RNA, also designated SEQ ID:342.

Another function of GAM72 is therefore inhibition of PRIC285 (Accession NM_033405.1). Accordingly, utilities of GAM72 include diagnosis, prevention and treatment of diseases and clinical conditions associated with PRIC285.

Protein kinase, y-linked (PRKY, Accession NM_002760.1) is another GAM72 target gene, herein designated TARGET GENE. PRKY BINDING SITE is a target binding site found in the 3' untranslated region of mRNA encoded by PRKY, corresponding to a target binding site such as BINDING SITE I, BINDING SITE II or BINDING SITE III of FIG. 8. Table 4 illustrates the complementarity of the nucleotide sequences of PRKY BINDING SITE, designated SEQ ID:4590, to the nucleotide sequence of GAM72 RNA, herein designated GAM RNA, also designated SEQ ID:342.

Another function of GAM72 is therefore inhibition of Protein kinase, y-linked (PRKY, Accession NM_002760.1), a gene which is a putative protein kinase. Accordingly, utilities of GAM72 include diagnosis, prevention and treatment of diseases and clinical conditions associated with PRKY.

The function of PRKY has been established by previous studies. PRKX (OMIM Ref. No. 300083) is a novel serine/threonine subtype of protein kinase that appears to encode a protein related to the catalytic subunit of the cAMP-dependent protein kinases, which are key players in the cellular responses to the second messenger cAMP. Klink et al. (1995) found that somatic cell hybrid analysis of PRKX under high stringency conditions revealed at least 3 further loci closely related to this gene in the human, constituting a small subfamily. Schiebel et al. (1997) isolated and characterized the PRKY gene, which is highly homologous to the PRKX gene on Xp22.3 and represents a member of the cAMP-dependent serine/threonine protein kinase gene family. Abnormal interchange can occur anywhere between Xp and Yp proximal to SRY (OMIM Ref. No. 480000). Schiebel et al. (1997) demonstrated that abnormal interchange in XX males (OMIM Ref. No. 278850) and XY females (OMIM Ref. No. 306100) happens particularly frequently between PRKX and PRKY. In a collection of 26 XX males and 4 XY females, between 27 and 35% of the interchanges took place between PRK homologs, but at different sites within the gene. PRKY and PRKX are located far from the pseudoautosomal region, where XY exchange normally takes place. Schiebel et al. (1997) stated that the unprecedented high sequence identity and identical orientation of PRKY to its homologous partner on the X chromosome, PRKX, explains the high frequency of abnormal pairing and the subsequent ectopic recombination, leading to XX males and XY females and to the highest rate of recombination outside the pseudoautosomal region. Schiebel et al. (1997) used FISH analysis to map the PRKY gene to Yp11.2 in close proximity to AMELY (OMIM Ref. No. 410000); the autosomal copy, a pseudogene (OMIM Ref. No. PRKXP1), to 15q26; and a further X-linked pseudogene (OMIM Ref. No. PRKXP2) to Xq12-q13.

Full details of the abovementioned studies are described in the following publications, the disclosure of which are hereby incorporated by reference:

Schiebel, K.; Mertz, A.; Winkelmann, B.; Glaser, B.; Schempp, W.; Rappold, G.: FISH localization of the human Y-homolog of protein kinase PRKX (PRKY) to Yp11.2 and two pseudogenes to 15q26 and Xq12-q13. Cytogenet. Cell Genet. 76:49-52, 1997; and Schiebel, K.; Winkelmann, M.; Mertz, A.; Xu, X.; Page, D. C.; Weil, D.; Petit, C.; Rappold, G. A.: Abnormal XY interchange between a novel isolated protein kinase gene, PRKY, and its h.

Further studies establishing the function and utilities of PRKY are found in John Hopkins OMIM database record ID 400008, and in cited publications listed in Table 5, which are hereby incorporated by reference. PRO0038 (Accession NM_014113.1) is another GAM72 target gene, herein designated TARGET GENE. PRO0038 BINDING SITE is a target binding site found in the 3' untranslated region of mRNA encoded by PRO0038, corresponding to a target binding site such as BINDING SITE I, BINDING SITE II or BINDING SITE III of FIG. 8. Table 4 illustrates the complementarity of the nucleotide sequences of PRO0038 BINDING SITE, designated SEQ ID:3005, to the nucleotide sequence of GAM72 RNA, herein designated GAM RNA, also designated SEQ ID:342.

Another function of GAM72 is therefore inhibition of PRO0038 (Accession NM_014113.1). Accordingly, utilities of GAM72 include diagnosis, prevention and treatment of diseases and clinical conditions associated with PRO0038.

PRO0255 (Accession NM_014124.1) is another GAM72 target gene, herein designated TARGET GENE. PRO0255 BINDING SITE is a target binding site found in the 3' untranslated region of mRNA encoded by PRO0255, corresponding to a target binding site such as BINDING SITE I, BINDING SITE II or BINDING SITE III of FIG. 8. Table 4 illustrates the complementarity of the nucleotide sequences of PRO0255 BINDING SITE, designated SEQ ID:7528, to the nucleotide sequence of GAM72 RNA, herein designated GAM RNA, also designated SEQ ID:342.

Another function of GAM72 is therefore inhibition of PRO0255 (Accession NM_014124.1). Accordingly, utilities of GAM72 include diagnosis, prevention and treatment of diseases and clinical conditions associated with PRO0255.

PRO0456 (Accession NM_014127.1) is another GAM72 target gene, herein designated TARGET GENE. PRO0456 BINDING SITE is a target binding site found in the 3' untranslated region of mRNA encoded by PRO0456, corresponding to a target binding site such as BINDING SITE I, BINDING SITE II or BINDING SITE III of FIG. 8. Table 4 illustrates the complementarity of the nucleotide sequences of PRO0456 BINDING SITE, designated SEQ ID:19460, to the nucleotide sequence of GAM72 RNA, herein designated GAM RNA, also designated SEQ ID:342.

Another function of GAM72 is therefore inhibition of PRO0456 (Accession NM_014127.1). Accordingly, utilities of GAM72 include diagnosis, prevention and treatment of diseases and clinical conditions associated with PRO0456.

PRO0478 (Accession NM_014129.1) is another GAM72 target gene, herein designated TARGET GENE. PRO0478 BINDING SITE is a target binding site found in the 3' untranslated region of mRNA encoded by PRO0478, corresponding to a target binding site such as BINDING SITE I, BINDING SITE II or BINDING SITE III of FIG. 8. Table 4 illustrates the complementarity of the nucleotide sequences of PRO0478 BINDING SITE, designated SEQ ID:16168, to the nucleotide sequence of GAM72 RNA, herein designated GAM RNA, also designated SEQ ID:342.

Another function of GAM72 is therefore inhibition of PRO0478 (Accession NM_014129.1). Accordingly, utilities of GAM72 include diagnosis, prevention and treatment of diseases and clinical conditions associated with PRO0478.

PRO0628 (Accession NM_014134.1) is another GAM72 target gene, herein designated TARGET GENE. PRO0628 BINDING SITE is a target binding site found in the 3' untranslated region of mRNA encoded by PRO0628, corresponding to a target binding site such as BINDING SITE I, BINDING SITE II or BINDING SITE III of FIG. 8. Table 4 illustrates the complementarity of the nucleotide sequences of PRO0628 BINDING SITE, designated SEQ ID:15616, to the nucleotide sequence of GAM72 RNA, herein designated GAM RNA, also designated SEQ ID:342.

Another function of GAM72 is therefore inhibition of PRO0628 (Accession NM_014134.1). Accordingly, utilities of GAM72 include diagnosis, prevention and treatment of diseases and clinical conditions associated with PRO0628.

PRO1048 (Accession NM_018497.1) is another GAM72 target gene, herein designated TARGET GENE. PRO1048

BINDING SITE is a target binding site found in the 5' untranslated region of mRNA encoded by PRO1048, corresponding to a target binding site such as BINDING SITE I, BINDING SITE II or BINDING SITE III of FIG. 8. Table 4 illustrates the complementarity of the nucleotide sequences of PRO1048 BINDING SITE, designated SEQ ID:18804, to the nucleotide sequence of GAM72 RNA, herein designated GAM RNA, also designated SEQ ID:342.

Another function of GAM72 is therefore inhibition of PRO1048 (Accession NM_018497.1). Accordingly, utilities of GAM72 include diagnosis, prevention and treatment of diseases and clinical conditions associated with PRO1048.

PRO1777 (Accession) is another GAM72 target gene, herein designated TARGET GENE. PRO1777 BINDING SITE is a target binding site found in the 3' untranslated region of mRNA encoded by PRO1777, corresponding to a target binding site such as BINDING SITE I, BINDING SITE II or BINDING SITE III of FIG. 8. Table 4 illustrates the complementarity of the nucleotide sequences of PRO1777 BINDING SITE, designated SEQ ID:16858, to the nucleotide sequence of GAM72 RNA, herein designated GAM RNA, also designated SEQ ID:342.

Another function of GAM72 is therefore inhibition of PRO1777 (Accession). Accordingly, utilities of GAM72 include diagnosis, prevention and treatment of diseases and clinical conditions associated with PRO1777.

PRO2015 (Accession NM_018512.1) is another GAM72 target gene, herein designated TARGET GENE. PRO2015 BINDING SITE is a target binding site found in the 5' untranslated region of mRNA encoded by PRO2015, corresponding to a target binding site such as BINDING SITE I, BINDING SITE II or BINDING SITE III of FIG. 8. Table 4 illustrates the complementarity of the nucleotide sequences of PRO2015 BINDING SITE, designated SEQ ID:11837, to the nucleotide sequence of GAM72 RNA, herein designated GAM RNA, also designated SEQ ID:342.

Another function of GAM72 is therefore inhibition of PRO2015 (Accession NM_018512.1). Accordingly, utilities of GAM72 include diagnosis, prevention and treatment of diseases and clinical conditions associated with PRO2015.

PRO2893 (Accession) is another GAM72 target gene, herein designated TARGET GENE. PRO2893 BINDING SITE is a target binding site found in the 3' untranslated region of mRNA encoded by PRO2893, corresponding to a target binding site such as BINDING SITE I, BINDING SITE II or BINDING SITE III of FIG. 8. Table 4 illustrates the complementarity of the nucleotide sequences of PRO2893 BINDING SITE, designated SEQ ID:4610, to the nucleotide sequence of GAM72 RNA, herein designated GAM RNA, also designated SEQ ID:342.

Another function of GAM72 is therefore inhibition of PRO2893 (Accession). Accordingly, utilities of GAM72 include diagnosis, prevention and treatment of diseases and clinical conditions associated with PRO2893.

Pleckstrin and sec7 domain protein (PSD, Accession NM_002779.2) is another GAM72 target gene, herein designated TARGET GENE. PSD BINDING SITE is a target binding site found in the 5' untranslated region of mRNA encoded by PSD, corresponding to a target binding site such as BINDING SITE I, BINDING SITE II or BINDING SITE III of FIG. 8. Table 4 illustrates the complementarity of the nucleotide sequences of PSD BINDING SITE, designated SEQ ID:14038, to the nucleotide sequence of GAM72 RNA, herein designated GAM RNA, also designated SEQ ID:342.

Another function of GAM72 is therefore inhibition of Pleckstrin and sec7 domain protein (PSD, Accession NM_002779.2), a gene which promotes guanine-nucleotide exchange on arf6. Accordingly, utilities of GAM72 include diagnosis, prevention and treatment of diseases and clinical conditions associated with PSD.

The function of PSD has been established by previous studies. Perletti et al. (1997) identified a novel human gene on 10q24, contiguous to the 3-prime end of the NFKB2 gene (OMIM Ref. No. 164012) in a tail- to - tail arrangement. They described a cDNA of 4,307 bp, isolated from an adult human brain cDNA library, which contains an open reading frame encoding a putative protein of 645 amino acids with a predicted molecular weight of 71 kD. Database homology searches indicated that the novel gene codes for a putative protein containing 2 discrete domains with significant homology to the Sec7 and pleckstrin-homology (PH) domains, respectively. They used the gene symbol PSD for 'pleckstrin-Sec7 domains.' Northern blot analysis of a panel of RNAs from normal human tissues using the PSD cDNA as probe revealed the presence of 3 different tissue-specific transcripts of approximately 4.3, 2.3, and 1.8 kb, the longest of which was expressed only in brain. The data suggested that the PSD gene may encode a protein related to the protein family containing both the Sec7 in the PH domains and thought to be involved in signaling transduction processes. Other human proteins in the same family include cytohesin-1 (Kolanus et al., 1996) and ARNO (OMIM Ref. No. 602488) (Chardin et al., 1996).

Full details of the abovementioned studies are described in the following publications, the disclosure of which are hereby incorporated by reference:

Kolanus, W.; Nagel, W.; Schiller, B.; Zeitlmann, L.; Godar, S.; Stockinger, H.; Seed, B.: Alpha-L-beta-2 integrin/LFA-1 binding to ICAM-1 induced by cytohesin-1, a cytoplasmic regulatory molecule. Cell 86:233-242, 1996; and Perletti, L.; Talarico, D.; Trecca, D.; Ronchetti, D.; Fracchiolla, N. S.; Maiolo, A. T.; Neri, A.: Identification of a novel gene, PSD, adjacent to NFKB2/lyt-10, which contains Sec7 an.

Further studies establishing the function and utilities of PSD are found in John Hopkins OMIM database record ID 602327, and in cited publications listed in Table 5, which are hereby incorporated by reference. Polymerase i and transcript release factor (PTRF, Accession NM_012232.1) is another GAM72 target gene, herein designated TARGET GENE. PTRF BINDING SITE is a target binding site found in the 3' untranslated region of mRNA encoded by PTRF, corresponding to a target binding site such as BINDING SITE I, BINDING SITE II or BINDING SITE III of FIG. 8. Table 4 illustrates the complementarity of the nucleotide sequences of PTRF BINDING SITE, designated SEQ ID:12748, to the nucleotide sequence of GAM72 RNA, herein designated GAM RNA, also designated SEQ ID:342.

Another function of GAM72 is therefore inhibition of Polymerase i and transcript release factor (PTRF, Accession NM_012232.1). Accordingly, utilities of GAM72 include diagnosis, prevention and treatment of diseases and clinical conditions associated with PTRF.

RAD18 (Accession NM_020165.2) is another GAM72 target gene, herein designated TARGET GENE. RAD18 BINDING SITE is a target binding site found in the 3' untranslated region of mRNA encoded by RAD18, corresponding to a target binding site such as BINDING SITE I, BINDING SITE II or BINDING SITE III of FIG. 8. Table 4 illustrates the complementarity of the nucleotide sequences of RAD18 BINDING SITE, designated SEQ ID:923, to the nucleotide sequence of GAM72 RNA, herein designated GAM RNA, also designated SEQ ID:342.

Another function of GAM72 is therefore inhibition of RAD18 (Accession NM_020165.2), a gene which functions with dna repair protein rad5 in error-free postreplication dna repair and therefore may be associated with Cancer. Accordingly, utilities of GAM72 include diagnosis, prevention and treatment of Cancer, and of other diseases and clinical conditions associated with RAD18.

The function of RAD18 and its association with various diseases and clinical conditions, has been established by previous studies, as described hereinabove with reference to GAM55.2. Rad51 homolog (reca homolog, e. coli) (s. cerevisiae) (RAD51, Accession NM_002875.2) is another GAM72 target gene, herein designated TARGET GENE. RAD51 BINDING SITE is a target binding site found in the 3' untranslated region of multiple transcripts of mRNA encoded by RAD51, corresponding to a target binding site such as BINDING SITE I, BINDING SITE II or BINDING SITE III of FIG. 8. Table 4 illustrates the complementarity of the nucleotide sequences of RAD51 BINDING SITE, designated SEQ ID:11450, to the nucleotide sequence of GAM72 RNA, herein designated GAM RNA, also designated SEQ ID:342.

Another function of GAM72 is therefore inhibition of Rad51 homolog (reca homolog, e. coli) (s. cerevisiae) (RAD51, Accession NM_002875.2). Accordingly, utilities of GAM72 include diagnosis, prevention and treatment of diseases and clinical conditions associated with RAD51.

Rad51-like 1 (s. cerevisiae) (RAD51L1, Accession NM_133509.1) is another GAM72 target gene, herein designated TARGET GENE. RAD51L1 BINDING SITE is a target binding site found in the 5' untranslated region of multiple transcripts of mRNA encoded by RAD51L1, corresponding to a target binding site such as BINDING SITE I, BINDING SITE II or BINDING SITE III of FIG. 8. Table 4 illustrates the complementarity of the nucleotide sequences of RAD51L1 BINDING SITE, designated SEQ ID:19291, to the nucleotide sequence of GAM72 RNA, herein designated GAM RNA, also designated SEQ ID:342.

Another function of GAM72 is therefore inhibition of Rad51-like 1 (s. cerevisiae) (RAD51L1, Accession NM_133509.1), a gene which is a member of the RAD51 family of strand-transfer proteins. Accordingly, utilities of GAM72 include diagnosis, prevention and treatment of diseases and clinical conditions associated with RAD51L1.

The function of RAD51L1 and its association with various diseases and clinical conditions, has been established by previous studies, as described hereinabove with reference to GAM40.2. Retinoblastoma binding protein 9 (RBBP9, Accession NM_006606.2) is another GAM72 target gene, herein designated TARGET GENE. RBBP9 BINDING SITE is a target binding site found in the 3' untranslated region of multiple transcripts of mRNA encoded by RBBP9, corresponding to a target binding site such as BINDING SITE I, BINDING SITE II or BINDING SITE III of FIG. 8. Table 4 illustrates the complementarity of the nucleotide sequences of RBBP9 BINDING SITE, designated SEQ ID:12889, to the nucleotide sequence of GAM72 RNA, herein designated GAM RNA, also designated SEQ ID:342.

Another function of GAM72 is therefore inhibition of Retinoblastoma binding protein 9 (RBBP9, Accession NM_006606.2). Accordingly, utilities of GAM72 include diagnosis, prevention and treatment of diseases and clinical conditions associated with RBBP9.

Retinoblastoma-like 1 (p107) (RBL1, Accession NM_002895.1) is another GAM72 target gene, herein designated TARGET GENE. RBL1 BINDING SITE is a target binding site found in the 3' untranslated region of mRNA encoded by RBL1, corresponding to a target binding site such as BINDING SITE I, BINDING SITE II or BINDING SITE III of FIG. 8. Table 4 illustrates the complementarity of the nucleotide sequences of RBL1 BINDING SITE, designated SEQ ID:3943, to the nucleotide sequence of GAM72 RNA, herein designated GAM RNA, also designated SEQ ID:342.

Another function of GAM72 is therefore inhibition of Retinoblastoma-like 1 (p107) (RBL1, Accession NM_002895.1), a gene which has an important role in negatively regulating the rate of progression of the cell cycle. Accordingly, utilities of GAM72 include diagnosis, prevention and treatment of diseases and clinical conditions associated with RBL1.

The function of RBL1 has been established by previous studies. The cellular protein p107, like the retinoblastoma gene product (OMIM Ref. No. 180200), has been shown to form a specific complex with adenovirus E1A and SV40 large T antigen (T). The binding characteristics implied that RB1 and p107 share a common biochemical function. Ewen et al. (1991) used a partial cDNA for human p107 to map the gene to 20q11.2 by fluorescence in situ hybridization. The cDNA encoded a 936-residue protein. Comparison with RB1 showed a major region of homology extending over 564 residues. This region in RB1 is essential to its growth-controlling function. Sequences outside of this region are largely unique to each protein.

Animal model experiments lend further support to the function of RBL1. LeCouter et al. (1998) introduced a null mutation in p107 into the germ line of mice and bred into a BALB/cJ genetic background. Mice lacking p107 were viable and fertile but displayed impaired growth, reaching about 50% of normal weight by 21 days of age. Mutant mice exhibited a myeloproliferative disorder characterized by ectopic myeloid hyperplasia in the spleen and liver. Embryonic p107 -/- fibroblasts and primary myoblasts isolated from adult p107 -/- mice displayed a striking 2-fold acceleration in doubling time. However, cell sort analysis indicated that the fraction of cells in G1, S, and G2 was unaltered, suggesting that the different phases of the cell cycle in p107 -/-cells was uniformly reduced by a factor of 2. Western analysis of cyclin expression in synchronized p107 -/- fibroblasts revealed that expression of cyclins E and A preceded that of D1. Mutant embryos expressed approximately twice the normal levels of Rb, whereas p130 levels were unaltered. Finally, mutant mice reverted to a wildtype phenotype following a single backcross with C57BL/6J mice, suggesting the existence of modifier genes that have potentially epistatic relationships with p107. LeCouter et al. (1998) concluded that p107 has an important role in negatively regulating the rate of progression of the cell cycle, but in a strain-dependent manner.

It is appreciated that the abovementioned animal model for RBL1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ewen, M. E.; Xing, Y.; Lawrence, J. B.; Livingston, D. M.: Molecular cloning, chromosomal mapping, and expression of the cDNA for p107, a retinoblastoma gene product-related protein. Cell 66:1155-1164, 1991; and LeCouter, J. E.; Kablar, B.; Hardy, W. R.; Ying, C.; Megeney, L. A.; May, L. L.; Rudnicki, M. A.: Strain-dependent myeloid hyperplasia, growth deficiency, and accelerated cell cycle in.

Further studies establishing the function and utilities of RBL1 are found in John Hopkins OMIM database record ID 116957, and in cited publications listed in Table 5, which are hereby incorporated by reference. Recq protein-like 5 (RECQL5, Accession NM_004259.2) is another GAM72 target gene, herein designated TARGET GENE. RECQL5 BINDING SITE is a target binding site found in the 3' untranslated region of mRNA encoded by RECQL5, corresponding to a target binding site such as BINDING SITE I, BINDING SITE II or BINDING SITE III of FIG. 8. Table 4 illustrates the complementarity of the nucleotide sequences of RECQL5 BINDING SITE, designated SEQ ID:16624, to the nucleotide sequence of GAM72 RNA, herein designated GAM RNA, also designated SEQ ID:342.

Another function of GAM72 is therefore inhibition of Recq protein-like 5 (RECQL5, Accession NM_004259.2). Accordingly, utilities of GAM72 include diagnosis, prevention and treatment of diseases and clinical conditions associated with RECQL5.

Rho-related btb domain containing 3 (RHOBTB3, Accession NM_014899.1) is another GAM72 target gene, herein designated TARGET GENE. RHOBTB3 BINDING SITE is a target binding site found in the 3' untranslated region of mRNA encoded by RHOBTB3, corresponding to a target binding site such as BINDING SITE I, BINDING SITE II or BINDING SITE III of FIG. 8. Table 4 illustrates the complementarity of the nucleotide sequences of RHOBTB3 BINDING SITE, designated SEQ ID:14678, to the nucleotide sequence of GAM72 RNA, herein designated GAM RNA, also designated SEQ ID:342.

Another function of GAM72 is therefore inhibition of Rho-related btb domain containing 3 (RHOBTB3, Accession NM_014899.1). Accordingly, utilities of GAM72 include diagnosis, prevention and treatment of diseases and clinical conditions associated with RHOBTB3.

RNO2 (Accession) is another GAM72 target gene, herein designated TARGET GENE. RNO2 BINDING SITE is a target binding site found in the 3' untranslated region of mRNA encoded by RNO2, corresponding to a target binding site such as BINDING SITE I, BINDING SITE II or BINDING SITE III of FIG. 8. Table 4 illustrates the complementarity of the nucleotide sequences of RNO2 BINDING SITE, designated SEQ ID:8096, to the nucleotide sequence of GAM72 RNA, herein designated GAM RNA, also designated SEQ ID:342.

Another function of GAM72 is therefore inhibition of RNO2 (Accession). Accordingly, utilities of GAM72 include diagnosis, prevention and treatment of diseases and clinical conditions associated with RNO2.

RoXaN (Accession NM_017590.4) is another GAM72 target gene, herein designated TARGET GENE. RoXaN BINDING SITE1 and RoXaN BINDING SITE2 are target binding sites found in untranslated regions of mRNA encoded by RoXaN, corresponding to target binding sites such as BINDING SITE I, BINDING SITE II or BINDING SITE III of FIG. 8. Table 4 illustrates the complementarity of the nucleotide sequences of RoXaN BINDING SITE1 and RoXaN BINDING SITE2, designated SEQ ID:7925 and SEQ ID:1449 respectively, to the nucleotide sequence of GAM72 RNA, herein designated GAM RNA, also designated SEQ ID:342.

Another function of GAM72 is therefore inhibition of RoXaN (Accession NM_017590.4). Accordingly, utilities of GAM72 include diagnosis, prevention and treatment of diseases and clinical conditions associated with RoXaN.

Ribosomal protein 113 (RPL13, Accession NM_000977.2) is another GAM72 target gene, herein designated TARGET GENE. RPL13 BINDING SITE is a target binding site found in the 3' untranslated region of multiple transcripts of mRNA encoded by RPL13, corresponding to a target binding site such as BINDING SITE I, BINDING SITE II or BINDING SITE III of FIG. 8. Table 4 illustrates the complementarity of the nucleotide sequences of RPL13 BINDING SITE, designated SEQ ID:7469, to the nucleotide sequence of GAM72 RNA, herein designated GAM RNA, also designated SEQ ID:342.

Another function of GAM72 is therefore inhibition of Ribosomal protein 113 (RPL13, Accession NM_000977.2). Accordingly, utilities of GAM72 include diagnosis, prevention and treatment of diseases and clinical conditions associated with RPL13.

Rpo1-2 (Accession) is another GAM72 target gene, herein designated TARGET GENE. Rpo1-2 BINDING SITE1 and Rpo1-2 BINDING SITE2 are target binding sites found in untranslated regions of mRNA encoded by Rpo1-2, corresponding to target binding sites such as BINDING SITE I, BINDING SITE II or BINDING SITE III of FIG. 8. Table 4 illustrates the complementarity of the nucleotide sequences of Rpo1-2 BINDING SITE1 and Rpo1-2 BINDING SITE2, designated SEQ ID:1849 and SEQ ID:1072 respectively, to the nucleotide sequence of GAM72 RNA, herein designated GAM RNA, also designated SEQ ID:342.

Another function of GAM72 is therefore inhibition of Rpo1-2 (Accession). Accordingly, utilities of GAM72 include diagnosis, prevention and treatment of diseases and clinical conditions associated with Rpo1-2.

RRP4 (Accession NM_014285.3) is another GAM72 target gene, herein designated TARGET GENE. RRP4 BINDING SITE is a target binding site found in the 3' untranslated region of mRNA encoded by RRP4, corresponding to a target binding site such as BINDING SITE I, BINDING SITE II or BINDING SITE III of FIG. 8. Table 4 illustrates the complementarity of the nucleotide sequences of RRP4 BINDING SITE, designated SEQ ID:15765, to the nucleotide sequence of GAM72 RNA, herein designated GAM RNA, also designated SEQ ID:342.

Another function of GAM72 is therefore inhibition of RRP4 (Accession NM_014285.3). Accordingly, utilities of GAM72 include diagnosis, prevention and treatment of diseases and clinical conditions associated with RRP4.

S164 (Accession XM_027330.10) is another GAM72 target gene, herein designated TARGET GENE. S164 BINDING SITE is a target binding site found in the 5' untranslated region of mRNA encoded by S164, corresponding to a target binding site such as BINDING SITE I, BINDING SITE II or BINDING SITE III of FIG. 8. Table 4 illustrates the complementarity of the nucleotide sequences of S164 BINDING SITE, designated SEQ ID:19587, to the nucleotide sequence of GAM72 RNA, herein designated GAM RNA, also designated SEQ ID:342.

Another function of GAM72 is therefore inhibition of S164 (Accession XM_027330.10). Accordingly, utilities of GAM72 include diagnosis, prevention and treatment of diseases and clinical conditions associated with S164.

SAC2 (Accession NM_014937.1) is another GAM72 target gene, herein designated TARGET GENE. SAC2 BINDING SITE is a target binding site found in the 3' untranslated region of mRNA encoded by SAC2, corresponding to a target binding site such as BINDING SITE I, BINDING SITE II or BINDING SITE III of FIG. 8. Table 4 illustrates the complementarity of the nucleotide sequences of SAC2 BINDING SITE, designated SEQ ID:9886, to the nucleotide sequence of GAM72 RNA, herein designated GAM RNA, also designated SEQ ID:342.

Another function of GAM72 is therefore inhibition of SAC2 (Accession NM_014937.1). Accordingly, utilities of GAM72 include diagnosis, prevention and treatment of diseases and clinical conditions associated with SAC2.

SCYA5 (Accession) is another GAM72 target gene, herein designated TARGET GENE. SCYA5 BINDING SITE1 and SCYA5 BINDING SITE2 are target binding sites found in untranslated regions of mRNA encoded by SCYA5, corresponding to target binding sites such as BINDING SITE I, BINDING SITE II or BINDING SITE III of FIG. 8. Table 4 illustrates the complementarity of the nucleotide sequences of SCYA5 BINDING SITE1 and SCYA5 BINDING SITE2, designated SEQ ID:9538 and SEQ ID:19472 respectively, to the nucleotide sequence of GAM72 RNA, herein designated GAM RNA, also designated SEQ ID:342.

Another function of GAM72 is therefore inhibition of SCYA5 (Accession). Accordingly, utilities of GAM72 include diagnosis, prevention and treatment of diseases and clinical conditions associated with SCYA5.

Small edrk-rich factor 1b (centromeric) (SERF1B, Accession NM_022978.1) is another GAM72 target gene, herein designated TARGET GENE. SERF1B BINDING SITE is a target binding site found in the 3' untranslated region of mRNA encoded by SERF1B, corresponding to a target binding site such as BINDING SITE I, BINDING SITE II or BINDING SITE III of FIG. 8. Table 4 illustrates the complementarity of the nucleotide sequences of SERF1B BINDING SITE, designated SEQ ID:12529, to the nucleotide sequence of GAM72 RNA, herein designated GAM RNA, also designated SEQ ID:342.

Another function of GAM72 is therefore inhibition of Small edrk-rich factor 1b (centromeric) (SERF1B, Accession NM_022978.1). Accordingly, utilities of GAM72 include diagnosis, prevention and treatment of diseases and clinical conditions associated with SERF1B.

Splicing factor, arginine/serine-rich 2, interacting protein (SFRS2IP, Accession NM_004719.1) is another GAM72 target gene, herein designated TARGET GENE. SFRS2IP BINDING SITE is a target binding site found in the 5' untranslated region of mRNA encoded by SFRS2IP, corresponding to a target binding site such as BINDING SITE I, BINDING SITE II or BINDING SITE III of FIG. 8. Table 4 illustrates the complementarity of the nucleotide sequences of SFRS2IP BINDING SITE, designated SEQ ID:6699, to the nucleotide sequence of GAM72 RNA, herein designated GAM RNA, also designated SEQ ID:342.

Another function of GAM72 is therefore inhibition of Splicing factor, arginine/serine-rich 2, interacting protein (SFRS2IP, Accession NM_004719.1), a gene which plays an essential role in pre-mRNA splicing. Accordingly, utilities of GAM72 include diagnosis, prevention and treatment of diseases and clinical conditions associated with SFRS2IP.

The function of SFRS2IP and its association with various diseases and clinical conditions, has been established by previous studies, as described hereinabove with reference to GAM44.1. Serum/glucocorticoid regulated kinase-like (SGKL, Accession NM_013257.3) is another GAM72 target gene, herein designated TARGET GENE. SGKL BINDING SITE is a target binding site found in the 3' untranslated region of multiple transcripts of mRNA encoded by SGKL, corresponding to a target binding site such as BINDING SITE I, BINDING SITE II or BINDING SITE III of FIG. 8. Table 4 illustrates the complementarity of the nucleotide sequences of SGKL BINDING SITE, designated SEQ ID:5761, to the nucleotide sequence of GAM72 RNA, herein designated GAM RNA, also designated SEQ ID:342.

Another function of GAM72 is therefore inhibition of Serum/glucocorticoid regulated kinase-like (SGKL, Accession NM_013257.3). Accordingly, utilities of GAM72 include diagnosis, prevention and treatment of diseases and clinical conditions associated with SGKL.

Sh2 domain containing 3a (SH2D3A, Accession NM_005490.1) is another GAM72 target gene, herein designated TARGET GENE. SH2D3A BINDING SITE is a target binding site found in the 3' untranslated region of mRNA encoded by SH2D3A, corresponding to a target binding site such as BINDING SITE I, BINDING SITE II or BINDING SITE III of FIG. 8. Table 4 illustrates the complementarity of the nucleotide sequences of SH2D3A BINDING SITE, designated SEQ ID:15487, to the nucleotide sequence of GAM72 RNA, herein designated GAM RNA, also designated SEQ ID:342.

Another function of GAM72 is therefore inhibition of Sh2 domain containing 3a (SH2D3A, Accession NM_005490.1). Accordingly, utilities of GAM72 include diagnosis, prevention and treatment of diseases and clinical conditions associated with SH2D3A.

Sialyltransferase 4a (beta-galactoside alpha-2,3-sialytransferase) (SIAT4A, Accession NM_173344.1) is another GAM72 target gene, herein designated TARGET GENE. SIAT4A BINDING SITE is a target binding site found in the 3' untranslated region of multiple transcripts of mRNA encoded by SIAT4A, corresponding to a target binding site such as BINDING SITE I, BINDING SITE II or BINDING SITE III of FIG. 8. Table 4 illustrates the complementarity of the nucleotide sequences of SIAT4A BINDING SITE, designated SEQ ID:9442, to the nucleotide sequence of GAM72 RNA, herein designated GAM RNA, also designated SEQ ID:342.

Another function of GAM72 is therefore inhibition of Sialyltransferase 4a (beta-galactoside alpha-2,3-sialytransferase) (SIAT4A, Accession NM_173344.1). Accordingly, utilities of GAM72 include diagnosis, prevention and treatment of diseases and clinical conditions associated with SIAT4A.

Sialic acid binding ig-like lectin 11 (SIGLEC11, Accession NM_052884.1) is another GAM72 target gene, herein designated TARGET GENE. SIGLEC11 BINDING SITE is a target binding site found in the 3' untranslated region of mRNA encoded by SIGLEC11, corresponding to a target binding site such as BINDING SITE I, BINDING SITE II or BINDING SITE III of FIG. 8. Table 4 illustrates the complementarity of the nucleotide sequences of SIGLEC11 BINDING SITE, designated SEQ ID:5392, to the nucleotide sequence of GAM72 RNA, herein designated GAM RNA, also designated SEQ ID:342.

Another function of GAM72 is therefore inhibition of Sialic acid binding ig-like lectin 11 (SIGLEC11, Accession NM_052884.1). Accordingly, utilities of GAM72 include diagnosis, prevention and treatment of diseases and clinical conditions associated with SIGLEC11.

Solute carrier family 2 (facilitated glucose transporter), member 11 (SLC2A11, Accession NM_030807.2) is another GAM72 target gene, herein designated TARGET GENE. SLC2A11 BINDING SITE is a target binding site found in the 3' untranslated region of mRNA encoded by SLC2A11, corresponding to a target binding site such as BINDING SITE I, BINDING SITE II or BINDING SITE III of FIG. 8. Table 4 illustrates the complementarity of the nucleotide sequences of SLC2A11 BINDING SITE, designated SEQ ID:14546, to the nucleotide sequence of GAM72 RNA, herein designated GAM RNA, also designated SEQ ID:342.

Another function of GAM72 is therefore inhibition of Solute carrier family 2 (facilitated glucose transporter), member 11 (SLC2A11, Accession NM_030807.2). Accordingly, utilities of GAM72 include diagnosis, prevention and treatment of diseases and clinical conditions associated with SLC2A11.

SMA3 (Accession NM_006780.1) is another GAM72 target gene, herein designated TARGET GENE. SMA3 BINDING SITE is a target binding site found in the 3' untranslated region of mRNA encoded by SMA3, corresponding to a target binding site such as BINDING SITE I, BINDING SITE II or BINDING SITE III of FIG. 8. Table 4 illustrates the complementarity of the nucleotide sequences of SMA3 BINDING SITE, designated SEQ ID:5456, to the nucleotide sequence of GAM72 RNA, herein designated GAM RNA, also designated SEQ ID:342.

Another function of GAM72 is therefore inhibition of SMA3 (Accession NM_006780.1). Accordingly, utilities of GAM72 include diagnosis, prevention and treatment of diseases and clinical conditions associated with SMA3.

Smith-magenis syndrome chromosome region, candidate 5 (SMCR5, Accession NM_144774.1) is another GAM72 target gene, herein designated TARGET GENE. SMCR5 BINDING SITE is a target binding site found in the 3' untranslated region of mRNA encoded by SMCR5, corresponding to a target binding site such as BINDING SITE I, BINDING SITE II or BINDING SITE III of FIG. 8. Table 4 illustrates the complementarity of the nucleotide sequences of SMCR5 BINDING SITE, designated SEQ ID:10816, to the nucleotide sequence of GAM72 RNA, herein designated GAM RNA, also designated SEQ ID:342.

Another function of GAM72 is therefore inhibition of Smith-magenis syndrome chromosome region, candidate 5 (SMCR5, Accession NM_144774.1). Accordingly, utilities of GAM72 include diagnosis, prevention and treatment of diseases and clinical conditions associated with SMCR5.

Small nuclear rna activating complex, polypeptide 1, 43 kda (SNAPC1, Accession NM_003082.2) is another GAM72 target gene, herein designated TARGET GENE. SNAPC1 BINDING SITE is a target binding site found in the 3' untranslated region of mRNA encoded by SNAPC1, corresponding to a target binding site such as BINDING SITE I, BINDING SITE II or BINDING SITE III of FIG. 8. Table 4 illustrates the complementarity of the nucleotide sequences of SNAPC1 BINDING SITE, designated SEQ ID:6354, to the nucleotide sequence of GAM72 RNA, herein designated GAM RNA, also designated SEQ ID:342.

Another function of GAM72 is therefore inhibition of Small nuclear rna activating complex, polypeptide 1, 43 kda (SNAPC1, Accession NM_003082.2). Accordingly, utilities of GAM72 include diagnosis, prevention and treatment of diseases and clinical conditions associated with SNAPC1.

Sprouty homolog 4 (drosophila) (SPRY4, Accession NM_030964.2) is another GAM72 target gene, herein designated TARGET GENE. SPRY4 BINDING SITE is a target binding site found in the 3' untranslated region of mRNA encoded by SPRY4, corresponding to a target binding site such as BINDING SITE I, BINDING SITE II or BINDING SITE III of FIG. 8. Table 4 illustrates the complementarity of the nucleotide sequences of SPRY4 BINDING SITE, designated SEQ ID:10205, to the nucleotide sequence of GAM72 RNA, herein designated GAM RNA, also designated SEQ ID:342.

Another function of GAM72 is therefore inhibition of Sprouty homolog 4 (drosophila) (SPRY4, Accession NM_030964.2). Accordingly, utilities of GAM72 include diagnosis, prevention and treatment of diseases and clinical conditions associated with SPRY4.

SRGAP1 (Accession XM_051143.3) is another GAM72 target gene, herein designated TARGET GENE. SRGAP1 BINDING SITE is a target binding site found in the 5' untranslated region of mRNA encoded by SRGAP1, corresponding to a target binding site such as BINDING SITE I, BINDING SITE II or BINDING SITE III of FIG. 8. Table 4 illustrates the complementarity of the nucleotide sequences of SRGAP1 BINDING SITE, designated SEQ ID:18079, to the nucleotide sequence of GAM72 RNA, herein designated GAM RNA, also designated SEQ ID:342.

Another function of GAM72 is therefore inhibition of SRGAP1 (Accession XM_051143.3). Accordingly, utilities of GAM72 include diagnosis, prevention and treatment of diseases and clinical conditions associated with SRGAP1.

Syntaxin 12 (STX12, Accession NM_177424.1) is another GAM72 target gene, herein designated TARGET GENE. STX12 BINDING SITE is a target binding site found in the 3' untranslated region of mRNA encoded by STX12, corresponding to a target binding site such as BINDING SITE I, BINDING SITE II or BINDING SITE III of FIG. 8. Table 4 illustrates the complementarity of the nucleotide sequences of STX12 BINDING SITE, designated SEQ ID:2278, to the nucleotide sequence of GAM72 RNA, herein designated GAM RNA, also designated SEQ ID:342.

Another function of GAM72 is therefore inhibition of Syntaxin 12 (STX12, Accession NM_177424.1). Accordingly, utilities of GAM72 include diagnosis, prevention and treatment of diseases and clinical conditions associated with STX12.

Sudd suppressor of bimd6 homolog (a. nidulans) (SUDD, Accession NM_145906.1) is another GAM72 target gene, herein designated TARGET GENE. SUDD BINDING SITE is a target binding site found in the 3' untranslated region of multiple transcripts of mRNA encoded by SUDD, corresponding to a target binding site such as BINDING SITE I, BINDING SITE II or BINDING SITE III of FIG. 8. Table 4 illustrates the complementarity of the nucleotide sequences of SUDD BINDING SITE, designated SEQ ID:13818, to the nucleotide sequence of GAM72 RNA, herein designated GAM RNA, also designated SEQ ID:342.

Another function of GAM72 is therefore inhibition of Sudd suppressor of bimd6 homolog (a. nidulans) (SUDD, Accession NM_145906.1). Accordingly, utilities of GAM72 include diagnosis, prevention and treatment of diseases and clinical conditions associated with SUDD.

Reserved (SYAP1, Accession NM_032796.2) is another GAM72 target gene, herein designated TARGET GENE. SYAP1 BINDING SITE is a target binding site found in the 3' untranslated region of mRNA encoded by SYAP1, corresponding to a target binding site such as BINDING SITE I, BINDING SITE II or BINDING SITE III of FIG. 8. Table 4 illustrates the complementarity of the nucleotide sequences of SYAP1 BINDING SITE, designated SEQ ID:19134, to the nucleotide sequence of GAM72 RNA, herein designated GAM RNA, also designated SEQ ID:342.

Another function of GAM72 is therefore inhibition of Reserved (SYAP1, Accession NM_032796.2). Accordingly, utilities of GAM72 include diagnosis, prevention and treatment of diseases and clinical conditions associated with SYAP1.

Synaptojanin 2 binding protein (SYNJ2BP, Accession NM_018373.1) is another GAM72 target gene, herein designated TARGET GENE. SYNJ2BP BINDING SITE is a target binding site found in the 3' untranslated region of mRNA encoded by SYNJ2BP, corresponding to a target binding site such as BINDING SITE I, BINDING SITE II or BINDING SITE III of FIG. 8. Table 4 illustrates the complementarity of the nucleotide sequences of SYNJ2BP BIND- ING SITE, designated SEQ ID:7272, to the nucleotide sequence of GAM72 RNA, herein designated GAM RNA, also designated SEQ ID:342.

Another function of GAM72 is therefore inhibition of Synaptojanin 2 binding protein (SYNJ2BP, Accession NM_018373.1). Accordingly, utilities of GAM72 include diagnosis, prevention and treatment of diseases and clinical conditions associated with SYNJ2BP.

Synaptopodin 2 (SYNPO2, Accession XM_050219.6) is another GAM72 target gene, herein designated TARGET GENE. SYNPO2 BINDING SITE is a target binding site found in the 3' untranslated region of mRNA encoded by SYNPO2, corresponding to a target binding site such as BINDING SITE I, BINDING SITE II or BINDING SITE III of FIG. 8. Table 4 illustrates the complementarity of the nucleotide sequences of SYNPO2 BINDING SITE, designated SEQ ID:9657, to the nucleotide sequence of GAM72 RNA, herein designated GAM RNA, also designated SEQ ID:342.

Another function of GAM72 is therefore inhibition of Synaptopodin 2 (SYNPO2, Accession XM_050219.6). Accordingly, utilities of GAM72 include diagnosis, prevention and treatment of diseases and clinical conditions associated with SYNPO2.

T-box 6 (TBX6, Accession NM_004608.2) is another GAM72 target gene, herein designated TARGET GENE. TBX6 BINDING SITE is a target binding site found in the 3' untranslated region of multiple transcripts of mRNA encoded by TBX6, corresponding to a target binding site such as BINDING SITE I, BINDING SITE II or BINDING SITE III of FIG. 8. Table 4 illustrates the complementarity of the nucleotide sequences of TBX6 BINDING SITE, designated SEQ ID:7788, to the nucleotide sequence of GAM72 RNA, herein designated GAM RNA, also designated SEQ ID:342.

Another function of GAM72 is therefore inhibition of T-box 6 (TBX6, Accession NM_004608.2), a gene which is a probable transcriptional regulator involved in developmental processes. Accordingly, utilities of GAM72 include diagnosis, prevention and treatment of diseases and clinical conditions associated with TBX6.

The function of TBX6 and its association with various diseases and clinical conditions, has been established by previous studies, as described hereinabove with reference to GAM59.1. Thymine-dna glycosylase (TDG, Accession NM_003211.1) is another GAM72 target gene, herein designated TARGET GENE. TDG BINDING SITE is a target binding site found in the 5' untranslated region of mRNA encoded by TDG, corresponding to a target binding site such as BINDING SITE I, BINDING SITE II or BINDING SITE III of FIG. 8. Table 4 illustrates the complementarity of the nucleotide sequences of TDG BINDING SITE, designated SEQ ID:16585, to the nucleotide sequence of GAM72 RNA, herein designated GAM RNA, also designated SEQ ID:342.

Another function of GAM72 is therefore inhibition of Thymine-dna glycosylase (TDG, Accession NM_003211.1), a gene which excises uracil and thymine from mispairs with guanidine. Accordingly, utilities of GAM72 include diagnosis, prevention and treatment of diseases and clinical conditions associated with TDG.

The function of TDG has been established by previous studies. The process of spontaneous hydrolytic deamination affects all DNA bases with exocyclic amino groups (Lindahl, 1982). Hydrolytic deamination of 5-methylcytosine leads to the formation of G/T mismatches. These G/T mismatches are corrected to G/C basepairs by a mismatch-specific DNA-binding glycosylase, TDG. TDG initiates repair of G/T and G/U mismatches, commonly associated with CpG islands, by removing thymine and uracil moieties. Tini et al. (2002) reported that TDG associates with transcriptional coactivators CBP (OMIM Ref. No. 600140) and p300 (OMIM Ref. No. 602700) and that the resulting complexes are competent for both the excision step of repair and histone acetylation. TDG stimulated CBP transcriptional activity in transfected cells and reciprocally served as a substrate for CBP/p300 acetylation. This acetylation triggered release of CBP from DNA ternary complexes and also regulated recruitment of repair endonuclease APE (OMIM Ref. No. 107748). These observations revealed a potential regulatory role for protein acetylation in base mismatch repair and a role for CBP/p300 in maintaining genomic stability.

Full details of the abovementioned studies are described in the following publications, the disclosure of which are hereby incorporated by reference:

Tini, M.; Benecke, A.; Um, S.-J.; Torchia, J.; Evans, R. M.; Chambon, P.: Association of CBP/p300 acetylase and thymine DNA glycosylase links DNA repair and transcription. Molec. Cell 9:265-277, 2002; and Neddermann, P.; Gallinari, P.; Lettieri, T.; Schmid, D.; Truong, O.; Hsuan, J. J.; Wiebauer, K.; Jiricny, J.: Cloning and expression of human G/T mismatch-specific thymine-DNA glycosyl.

Further studies establishing the function and utilities of TDG are found in John Hopkins OMIM database record ID 601423, and in cited publications listed in Table 5, which are hereby incorporated by reference. Tyrosyl-dna phosphodiesterase 1 (TDP1, Accession NM_018319.2) is another GAM72 target gene, herein designated TARGET GENE. TDP1 BINDING SITE is a target binding site found in the 5' untranslated region of mRNA encoded by TDP1, corresponding to a target binding site such as BINDING SITE I, BINDING SITE II or BINDING SITE III of FIG. 8. Table 4 illustrates the complementarity of the nucleotide sequences of TDP1 BINDING SITE, designated SEQ ID:3718, to the nucleotide sequence of GAM72 RNA, herein designated GAM RNA, also designated SEQ ID:342.

Another function of GAM72 is therefore inhibition of Tyrosyl-dna phosphodiesterase 1 (TDP1, Accession NM_018319.2). Accordingly, utilities of GAM72 include diagnosis, prevention and treatment of diseases and clinical conditions associated with TDP1.

Telomerase-associated protein 1 (TEP1, Accession NM_007110.3) is another GAM72 target gene, herein designated TARGET GENE. TEP1 BINDING SITE is a target binding site found in the 5' untranslated region of mRNA encoded by TEP1, corresponding to a target binding site such as BINDING SITE I, BINDING SITE II or BINDING SITE III of FIG. 8. Table 4 illustrates the complementarity of the nucleotide sequences of TEP1 BINDING SITE, designated SEQ ID:7532, to the nucleotide sequence of GAM72 RNA, herein designated GAM RNA, also designated SEQ ID:342.

Another function of GAM72 is therefore inhibition of Telomerase-associated protein 1 (TEP1, Accession NM_007110.3), a gene which interacts with active telomerase RNA. Accordingly, utilities of GAM72 include diagnosis, prevention and treatment of diseases and clinical conditions associated with TEP1.

The function of TEP1 has been established by previous studies. The telomerase ribonucleoprotein (OMIM Ref. No. 187270) catalyzes the addition of new telomeres on the chromosome ends. Harrington et al. (1997) noted that in humans, the telomeric repeat is 5-prime-TTAGGG-3-prime and the telomerase RNA contains a sequence complementary to this telomeric repeat. The telomerase RNA template is required for telomere repeat synthesis in vitro and in vivo. The ribonucleoprotein complex responsible for telomerase activity had been purified only in ciliates. Purified tetrahymena telomerase contains an RNA and 2 protein components, p80 and p95. The p80 component can be specifically cross linked to telomerase RNA, whereas the p95 component binds and cross links to single-stranded, telomeric DNA. Harrington et al. (1997) identified a cDNA encoding a tetrahymena p80 homolog from a murine colonic crypt expressed sequence tag (EST) database. The mouse sequence was used as a probe to identify contiguous human cDNA clones from a library prepared from a human colon carcinoma cell line. The mouse and human open reading frames were found to be 75% identical at the amino acid level. The predicted human polypeptide contains 2,627 amino acids, 2 fewer than the predicted mouse polypeptide. Northern blot analysis of both mouse and human tissues showed widespread expression of the gene, which they symbolized TP1. The studies indicated that telomerase-associated proteins are conserved from ciliates to humans. Saito et al. (1997) mapped the human TEP1 gene and mouse Tep1 gene by fluorescence in situ hybridization to human chromosome 14q11.2 and to the C2-D1 band of mouse chromosome 14, respectively. By means of genetic linkage mapping, the mouse gene was further localized to a position 2.7 cM distal to D14Mit18 and D14Mit134, and 2.0 cM proximal to D14Mit5 on mouse chromosome 14, where conserved linkage homology with human chromosome 14q11-q12 had been identified.

Full details of the abovementioned studies are described in the following publications, the disclosure of which are hereby incorporated by reference:

Harrington, L.; McPhail, T.; Mar, V.; Zhou, W.; Oulton, R.; Bass, M. B.; Arruda, I.; Robinson, M. O.: A mammalian telomerase-associated protein. Science 275:973-976, 1997; and Saito, T.; Matsuda, Y.; Suzuki, T.; Hayashi, A.; Yuan, X.; Saito, M.; Nakayama, J.; Hori, T.; Ishikawa, F.: Comparative gene mapping of the human and mouse TEP1 genes, which encode one.

Further studies establishing the function and utilities of TEP1 are found in John Hopkins OMIM database record ID 601686, and in cited publications listed in Table 5, which are hereby incorporated by reference. Testis derived transcript (3 lim domains) (TES, Accession NM_015641.2) is another GAM72 target gene, herein designated TARGET GENE. TES BINDING SITE is a target binding site found in the 3' untranslated region of multiple transcripts of mRNA encoded by TES, corresponding to a target binding site such as BINDING SITE I, BINDING SITE II or BINDING SITE III of FIG. 8. Table 4 illustrates the complementarity of the nucleotide sequences of TES BINDING SITE, designated SEQ ID:12134, to the nucleotide sequence of GAM72 RNA, herein designated GAM RNA, also designated SEQ ID:342.

Another function of GAM72 is therefore inhibition of Testis derived transcript (3 lim domains) (TES, Accession NM_015641.2), a gene which acts as a tumor suppressor and therefore may be associated with Ovarian carcinomas, breast cancer. Accordingly, utilities of GAM72 include diagnosis, prevention and treatment of Ovarian carcinomas, breast cancer, and of other diseases and clinical conditions associated with TES.

The function of TES has been established by previous studies. By construction and sequencing of a BAC contig within the FRA7G region at 7q31.2, Tatarelli et al. (2000) identified a novel gene which they called TESTIN because of its homology to mouse testin. They isolated 3 human isoforms. Isoforms 1 and 2, which use exon 1a and differ in their 3-prime UTR, contain 7 exons and encode a deduced 421-amino acid protein with a calculated molecular mass of 48 kD. Isoform 3, which uses exon 1b, encodes a deduced 412-amino acid protein with a calculated molecular mass of 47 kD. Each of the isoforms contains 3 LIM domains in the C terminus and shows 89% and 35% sequence identity with the mouse and C. elegans homologs, respectively. Human TESTIN contains 7 putative functional sites:4 phosphorylation sites, a glycosylation site, a myristylation site, and a cytochrome C heme-binding site. Northern blot analysis of normal human tissues demonstrated ubiquitous expression of an approximately 2.8-kb TESTIN transcript, which apparently corresponded to isoforms 2 and 3. An approximately 1.5-kb transcript, corresponding to isoform 1, was expressed at significantly higher levels in testis than in other tissues. FRA7G is a common aphidicolin-inducible fragile site at 7q31.2 showing loss of heterozygosity in human malignancies. Tatarelli et al. (2000) noted that a relationship between LIM proteins and cancer had been observed in several studies. By RT-PCR analysis, they found lack of TESTIN expression in 22% of cancer cell lines and 44% of the cell lines derived from hematologic malignancies. They determined that in most of these cases the inactivation of TESTIN expression was due to methylation of a CpG island. Analysis of the TESTIN coding region in 26 tumor cell lines revealed 3 missense mutations. The authors thus suggested that TESTIN may represent a tumor suppressor gene. Tobias et al. (2001) also cloned and characterized human TESTIN, which they called TES. Mutation analysis of the coding TES exons in 21 human-derived cell lines revealed the presence of a frameshift mutation in 1 allele in a breast cancer cell line. Methylation of the CpG island at the 5-prime end of TES appeared to be a remarkably frequent finding, occurring in 7 of 10 ovarian carcinomas and in each of 30 tumor-derived cell lines tested. Moreover, forced expression of TES in HeLa or OVCAR5 cells resulted in a profound reduction in growth potential, as determined by the colony formation assay. Tobias et al. (2001) suggested that TES is a tumor suppressor gene that is inactivated primarily by transcriptional silencing resulting from CpG island methylation.

Full details of the abovementioned studies are described in the following publications, the disclosure of which are hereby incorporated by reference:

Tatarelli, C.; Linnenbach, A.; Mimori, K.; Croce, C. M.: Characterization of the human TESTIN gene localized in the FRA7G region at 7q31.2. Genomics 68:1-12, 2000; and Tobias, E. S.; Hurlstone, A. F. L.; MacKenzie, E.; McFarlane, R.; Black, D. M.: The TES gene at 7q31.1 is methylated in tumours and encodes a novel growth- suppressing LIM domain prote.

Further studies establishing the function and utilities of TES are found in John Hopkins OMIM database record ID 606085, and in cited publications listed in Table 5, which are hereby incorporated by reference. TM7SF3 (Accession NM_016551.1) is another GAM72 target gene, herein designated TARGET GENE. TM7SF3 BINDING SITE is a target binding site found in the 3' untranslated region of mRNA encoded by TM7SF3, corresponding to a target binding site such as BINDING SITE I, BINDING SITE II or BINDING SITE III of FIG. 8. Table 4 illustrates the complementarity of the nucleotide sequences of TM7SF3 BINDING SITE, designated SEQ ID:572, to the nucleotide sequence of GAM72 RNA, herein designated GAM RNA, also designated SEQ ID:342.

Another function of GAM72 is therefore inhibition of TM7SF3 (Accession NM_016551.1). Accordingly, utilities of GAM72 include diagnosis, prevention and treatment of diseases and clinical conditions associated with TM7SF3.

Tumor necrosis factor receptor superfamily, member 1b (TNFRSF1B, Accession NM_001066.2) is another GAM72 target gene, herein designated TARGET GENE. TNFRSF1B BINDING SITE is a target binding site found in the 3' untranslated region of mRNA encoded by TNFRSF1B, corresponding to a target binding site such as BINDING SITE I, BINDING SITE II or BINDING SITE III of FIG. 8. Table 4 illustrates the complementarity of the nucleotide sequences of TNFRSF1B BINDING SITE, designated SEQ ID:6162, to the nucleotide sequence of GAM72 RNA, herein designated GAM RNA, also designated SEQ ID:342.

Another function of GAM72 is therefore inhibition of Tumor necrosis factor receptor superfamily, member 1b (TNFRSF1B, Accession NM_001066.2), a gene which mediates proinflammatory cellular responses. and therefore may be associated with Familial combined hyperlipidemia. Accordingly, utilities of GAM72 include diagnosis, prevention and treatment of Familial combined hyperlipidemia, and of other diseases and clinical conditions associated with TNFRSF1B.

The function of TNFRSF1B has been established by previous studies. Preassembly or self-association of cytokine receptor dimers (e.g., OMIM Ref. No. 147810; IL2R, 147730; and EPOR, 133171) occurs via the same amino acid contacts that are critical for ligand binding. Chan et al. (2000) found that, in contrast, the p60 (TNFRSF1A; 191190) and p80 (TNFRSF1B) TNFA receptors self-assemble through a distinct functional domain in the TNFR extracellular domain, termed the pre-ligand assembly domain (PLAD), in the absence of ligand. Deletion of the PLAD results in monomeric presentation of p60 or p80. Flow cytometric analysis showed that efficient TNFA binding depends on receptor self-assembly. They also found that other members of the TNF receptor superfamily, including the extracellular domains of TRAIL (TNFRSF10A; 603611), CD40 (TNFRSF5; 109535), and FAS (TNFRSF6; 134637), all self-associate but do not interact with heterologous receptors. Using Jurkat T cells, which express TNFR1 but little TNFR2, and Jurkat cells stably transfected with TNFR2, Li et al. (2002) confirmed that TNF stimulation, or stimulation with a TNFR2, but not TNFR1, agonist, causes a loss of TRAF2 (OMIM Ref. No. 601895) in the TNFR2-expressing cells, but not the parental cell line, through a ubiquitination- and proteasome-dependent process. Binding analysis indicated that TRAF2 interacts with CIAP1 (OMIM Ref. No. 601712) and CIAP2 (OMIM Ref. No. 601721), which possess E3 ubiquitin ligase (e.g. UBE3A, 601623) activity. Ubiquitination assays and SDS-PAGE analysis showed that in the presence of an E2-conjugating enzyme (e.g., UBCH7, 603721), CIAP1, but not CIAP2, induces TRAF2 ubiquitination outside of its RING domain. Both CIAPs bind but neither ubiquitinates TRAF1 (OMIM Ref. No. 601711). CIAP1 expression fails to protect TNFR2-expressing cells from TNF-induced apoptosis, whereas an E3-inactive CIAP1 mutant and wildtype CIAP2 do protect cells from TRAF2 downregulation and cause a delay in cell death. Li et al. (2002) concluded that TNFR2 stimulation causes the ubiquitination of TRAF2 by CIAP1, which can play a proapoptotic role in TNF signaling.

Animal model experiments lend further support to the function of TNFRSF1B. Bruce et al. (1996) used targeted gene disruption to generate mice lacking either the p55 (TNFR1) or the p75 (TNFR2) TNF receptor; mice lacking both p55 and p75 were generated from crosses of the singly deficient mice. The TNFR-deficient (TNFR-KO) mice exhibited no overt phenotype under unchallenged conditions. Bruce et al. (1996) reported that damage to neurons caused by focal cerebral ischemia and epileptic seizures was exacerbated in the TNFR-KO mice, indicating that TNF serves a neuroprotective function. Their studies indicated that TNF protects neurons by stimulating antioxidative pathways. Injury-induced microglial activation was suppressed in TNFR-KO mice. They concluded that drugs which target TNF signaling pathways may prove beneficial in treating stroke or traumatic brain injury.

It is appreciated that the abovementioned animal model for TNFRSF1B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chan, F. K.-M.; Chun, H. J.; Zheng, L.; Siegel, R. M.; Bui, K. L.; Lenardo, M. J. : A domain in TNF receptors that mediates ligand-independent receptor assembly and signaling. Science 288:2351-2354, 2000; and Li, X.; Yang, Y.; Ashwell, J. D.: TNF-RII and c-IAP1 mediate ubiquitination and degradation of TRAF2. Nature 416: 345-349, 2002.

Further studies establishing the function and utilities of TNFRSF1B are found in John Hopkins OMIM database record ID 191191, and in cited publications listed in Table 5, which are hereby incorporated by reference. Tumor necrosis factor (ligand) superfamily, member 10 (TNFSF10, Accession NM_003810.2) is another GAM72 target gene, herein designated TARGET GENE. TNFSF10 BINDING SITE is a target binding site found in the 3' untranslated region of mRNA encoded by TNFSF10, corresponding to a target binding site such as BINDING SITE I, BINDING SITE II or BINDING SITE III of FIG. 8. Table 4 illustrates the complementarity of the nucleotide sequences of TNFSF10 BINDING SITE, designated SEQ ID:15311, to the nucleotide sequence of GAM72 RNA, herein designated GAM RNA, also designated SEQ ID:342.

Another function of GAM72 is therefore inhibition of Tumor necrosis factor (ligand) superfamily, member 10 (TNFSF10, Accession NM_003810.2), a gene which mediates cell death. Accordingly, utilities of GAM72 include diagnosis, prevention and treatment of diseases and clinical conditions associated with TNFSF10.

The function of TNFSF10 has been established by previous studies. Degli- Esposti et al. (1997) noted that TRAIL can induce apoptosis in a wide variety of transformed cell lines of diverse lineage, but does not appear to kill normal cells even though TRAIL mRNA is expressed at significant levels in most normal tissues. They suggested that the regulation of TRAIL function takes place at the level of receptor expression. The TRAIL receptors TRAILR1, also called DR4 (OMIM Ref. No. 603611), and TRAILR2, also called DR5 (OMIM Ref. No. 603612), are capable of mediating apoptosis. Two other receptors, TRAILR3 (OMIM Ref. No. 603613) and TRAILR4 (OMIM Ref. No. 603614), do not signal apoptosis and are potential decoy receptors for TRAIL. Cell death induced by TRAIL had been believed to occur exclusively in tumor cells, suggesting that this drug was safe to use as an antitumor therapy. Nitsch et al. (2000) reported that TRAIL induced apoptosis in the human brain, which argues against the use of TRAIL for therapy of human brain tumors. However, neuroinflammatory T cells that express TRAIL might induce apoptosis of brain tissue, indicating a potential target for treatment of multiple sclerosis.

Animal model experiments lend further support to the function of TNFSF10. Cretney et al. (2002) generated healthy, fertile Trail-deficient mice by homologous recombination. Functional analysis confirmed the importance of Trail in mediating natural killer (NK) cytotoxicity to some tumor target cells. The authors found that Trail contributes to NK cell suppression of metastases to liver by a renal adenocarcinoma and to multiple tissues by breast carcinoma cells. Trail -/- mice were also more susceptible than wildtype mice to early onset of fibrosarcomas from lower doses of methylcholanthrene.

It is appreciated that the abovementioned animal model for TNFSF10 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Degli-Esposti, M. A.; Dougall, W. C.; Smolak, P. J.; Waugh, J. Y.; Smith, C. A.; Goodwin, R. G.: The novel receptor TRAIL-R4 induces NF-kappa-B and protects against TRAIL-mediated apoptosis, yet retains an incomplete death domain. Immunity 7:813-820, 1997; and Nitsch, R.; Bechmann, I.; Deisz, R. A.; Haas, D.; Lehmann, T. N.; Wendling, U.; Zipp, F.: Human brain-cell death induced by tumour-necrosis-factor-related apoptosis- inducing ligand (TRA.

Further studies establishing the function and utilities of TNFSF10 are found in John Hopkins OMIM database record ID 603598, and in cited publications listed in Table 5, which are hereby incorporated by reference. Tropomyosin 4 (TPM4, Accession NM_003290.1) is another GAM72 target gene, herein designated TARGET GENE. TPM4 BINDING SITE is a target binding site found in the 3' untranslated region of mRNA encoded by TPM4, corresponding to a target binding site such as BINDING SITE I, BINDING SITE II or BINDING SITE III of FIG. 8. Table 4 illustrates the complementarity of the nucleotide sequences of TPM4 BINDING SITE, designated SEQ ID:11140, to the nucleotide sequence of GAM72 RNA, herein designated GAM RNA, also designated SEQ ID:342.

Another function of GAM72 is therefore inhibition of Tropomyosin 4 (TPM4, Accession NM_003290.1), a gene which plays a central role, in association with the troponin complex, in the calcium dependent regulation of vertebrate striated muscle contraction. Accordingly, utilities of GAM72 include diagnosis, prevention and treatment of diseases and clinical conditions associated with TPM4.

The function of TPM4 has been established by previous studies. Vertebrates have at least 4 different tropomyosin genes; in humans, they are named TPM1 (OMIM Ref. No. 191010), TPM2 (OMIM Ref. No. 190990), TPM3 (OMIM Ref. No. 191030), and TPM4. Both the muscle and non-muscle isoforms of the tropomyosins are expressed through alternative splicing of each of the 4 genes. Laing et al. (1995) referred to unpublished observations indicating that the TPM4 gene maps to human chromosome 19. Wilton et al. (1996) developed sequence tagged sites (STS) for the TPM4 gene. One STS was used to amplify DNA from somatic cell hybrids to localize TPM4 to chromosome 19. The other, a product from a long-range PCR, was used directly as a probe to refine the localization of TPM4 to 19p13.1 by fluorescence in situ hybridization to metaphase chromosome spreads.

Full details of the abovementioned studies are described in the following publications, the disclosure of which are hereby incorporated by reference:

Laing, N. G.; Wilton, S. D.; Akkari, P. A.; Dorosz, S.; Boundy, K.; Kneebone, C.; Blumbergs, P.; White, S.; Watkins, H.; Love, D. R.; Haan, E.: A mutation in the alpha tropomyosin gene TPM3 associated with autosomal dominant nemaline myopathy. Nature Genet. 9:75-79, 1995; and Wilton, S. D.; Lim, L.; Dorosz, S. D.; Gunn, H. C.; Eyre, H. J.; Callen, D. F.; Laing, N. G.: Assignment of the human alpha-tropomyosin gene TPM4 to band 19p13.1 by fluorescence in situ hy.

Further studies establishing the function and utilities of TPM4 are found in John Hopkins OMIM database record ID 600317, and in cited publications listed in Table 5, which are hereby incorporated by reference. Tripartite motif-containing 9 (TRIM9, Accession NM_015163.3) is another GAM72 target gene, herein designated TARGET GENE. TRIM9 BINDING SITE is a target binding site found in the 5' untranslated region of multiple transcripts of mRNA encoded by TRIM9, corresponding to a target binding site such as BINDING SITE I, BINDING SITE II or BINDING SITE III of FIG. 8. Table 4 illustrates the complementarity of the nucleotide sequences of TRIM9 BINDING SITE, designated SEQ ID:12950, to the nucleotide sequence of GAM72 RNA, herein designated GAM RNA, also designated SEQ ID:342.

Another function of GAM72 is therefore inhibition of Tripartite motif-containing 9 (TRIM9, Accession NM_015163.3), a gene which may function as a positive regulator for mannosylphosphate transferase and is required to mediate mannosylphosphate transfer in both the core and outer chain portions of n-linked. oligosaccharides. Accordingly, utilities of GAM72 include diagnosis, prevention and treatment of diseases and clinical conditions associated with TRIM9.

The function of TRIM9 has been established by previous studies. TRIM proteins are composed of 3 zinc-binding domains, a RING, a B-box type 1, and a B-box type 2, followed by a coiled-coil region. They are involved in development and cell growth. By EST database searching for B-box-containing proteins, Reymond et al. (2001) identified 37 TRIM members, including 3 isoforms of TRIM9. Northern blot analysis revealed high expression of a 4.4-kb TRIM9 transcript in brain. Fluorescence microscopy demonstrated expression of TRIM9 in cytoplasmic speckles. Interaction mating analysis indicated that TRIM9 can form a homodimer.

Full details of the abovementioned studies are described in the following publications, the disclosure of which are hereby incorporated by reference:

Li, Y.; Chin, L.-S.; Weigel, C.; Li, L.: Spring, a novel RING finger protein that regulates synaptic vesicle exocytosis. J. Biol. Chem. 276:40824-40833, 2001; and Reymond, A.; Meroni, G.; Fantozzi, A.; Merla, G.; Cairo, S.; Luzi, L.; Riganelli, D.; Zanaria, E.; Messali, S.; Cainarca, S.; Guffanti, A.; Minucci, S.; Pelicci, P. G.; Ballabio, A..

Further studies establishing the function and utilities of TRIM9 are found in John Hopkins OMIM database record ID 606555, and in cited publications listed in Table 5, which are hereby incorporated by reference. Translin (TSN, Accession NM_004622.2) is another GAM72 target gene, herein designated TARGET GENE. TSN BINDING SITE is a target binding site found in the 3' untranslated region of mRNA encoded by TSN, corresponding to a target binding site such as BINDING SITE I, BINDING SITE II or BINDING SITE III of FIG. 8. Table 4 illustrates the complementarity of the nucleotide sequences of TSN BINDING SITE, designated SEQ ID:11699, to the nucleotide sequence of GAM72 RNA, herein designated GAM RNA, also designated SEQ ID:342.

Another function of GAM72 is therefore inhibition of Translin (TSN, Accession NM_004622.2), a gene which is a DNA binding protein and involved in DNA repair, replication, or recombination. Accordingly, utilities of GAM72 include diagnosis, prevention and treatment of diseases and clinical conditions associated with TSN.

The function of TSN has been established by previous studies. Kasai et al. (1994) identified a protein they termed recombination hotspot-associated factor (RcHF1), which specifically binds to the signal-like sequences at the breakpoint junction of 8q24 and 1p32 in acute lymphoblastic leukemia (ALL) patients carrying t(8;14)(q24;q11) and t(1;14)(p32;q11) translocations involving the TCR delta-chain locus (TCRD; 186810). Aoki et al. (1994) showed that an analogous protein, which they designated BCLF1, specifically binds to a target sequence within the clustered breakpoint region of the BCL2 oncogene (OMIM Ref. No. 151430) in follicular lymphoma patients carrying t(14;18)(q32;q21) translocations. It was proposed that these binding activities at recombination hotspot regions may play a crucial role in chromosomal translocations in lymphoid neoplasms. Aoki et al. (1995) purified the BCLF1 protein to homogeneity and determined that it is identical to RcHF1. Molecular gene cloning experiments revealed that the purified protein, which they named translin (TSN), is a previously undescribed DNA-binding protein with no significant similarity to known proteins. (The designation 'translin' came from selected letters in 'translocation.') In addition, Aoki et al. (1995) found that nuclear localization of translin was limited to lymphoid cell lines with rearranged Ig and processes such as DNA repair, replication, or recombination. In their native form, translin polypeptides form a multimeric structure that is responsible for its DNA binding activity. Aoki et al. (1997) found that the human and mouse translin genes have identical genomic structures consisting of 6 exons, 5 introns, and a GC-rich upstream region. By in situ hybridization and analysis of somatic cell hybrids, Aoki et al. (1997) mapped the human TSN gene to 2q21.1. Badge et al. (2000) studied a subtelomeric region at 16p13.3 that displays a 300-fold increase in crossovers compared to the genomic average rate. Segregation analysis of CEPH and other pedigrees yielded 6 paternal crossover breakpoints in the approximately 85-kb interval between the minisatellite loci D16S309 (MS205) and D16S83 (OMIM Ref. No. EKMDA2). Three crossovers were mapped to within the same small (less than 3 kb) interval, which did not colocalize with any tandem repeat array or expressed sequence. Sequence analysis revealed the presence of recombination-associated motifs and binding sites for translin. The authors concluded that this locus represents an intense male-specific recombination hotspot. Hosaka et al. (2000) demonstrated that the presence of the translin binding motif may be one of the important determinants for the location of breakpoints in the TLS (OMIM Ref. No. 137070) and CHOP (OMIM Ref. No. 126337) genes which are fused by translocation t(12;16) in liposarcomas.

Full details of the abovementioned studies are described in the following publications, the disclosure of which are hereby incorporated by reference:

Badge, R. M.; Yardley, J.; Jeffrey, A. J.; Armour, J. A. L.: Crossover breakpoint mapping identifies a subtelomeric hotspot for male meiotic recombination. Hum. Molec. Genet. 9:1239-1244, 2000; and Hosaka, T.; Kanoe, H.; Nakayama, T.; Murakami, H.; Yamamoto, H.; Nakamata, T.; Tsuboyama, T.; Oka, M.; Kasai, M.; Sasaki, M. S.; Nakamura, T.; Toguchida, J.: Translin binds to the sequ.

Further studies establishing the function and utilities of TSN are found in John Hopkins OMIM database record ID 600575, and in cited publications listed in Table 5, which are hereby incorporated by reference. UBCE7IP5 (Accession NM_014948.1) is another GAM72 target gene, herein designated TARGET GENE. UBCE7IP5 BINDING SITE is a target binding site found in the 3' untranslated region of mRNA encoded by UBCE7IP5, corresponding to a target binding site such as BINDING SITE I, BINDING SITE II or BINDING SITE III of FIG. 8. Table 4 illustrates the complementarity of the nucleotide sequences of UBCE7IP5 BINDING SITE, designated SEQ ID:504, to the nucleotide sequence of GAM72 RNA, herein designated GAM RNA, also designated SEQ ID:342.

Another function of GAM72 is therefore inhibition of UBCE7IP5 (Accession NM_014948.1). Accordingly, utilities of GAM72 include diagnosis, prevention and treatment of diseases and clinical conditions associated with UBCE7IP5.

Ubiquitin-conjugating enzyme e2b (rad6 homolog) (UBE2B, Accession NM_003337.1) is another GAM72 target gene, herein designated TARGET GENE. UBE2B BINDING SITE is a target binding site found in the 3' untranslated region of mRNA encoded by UBE2B, corresponding to a target binding site such as BINDING SITE I, BINDING SITE II or BINDING SITE III of FIG. 8. Table 4 illustrates the complementarity of the nucleotide sequences of UBE2B BINDING SITE, designated SEQ ID:19646, to the nucleotide sequence of GAM72 RNA, herein designated GAM RNA, also designated SEQ ID:342.

Another function of GAM72 is therefore inhibition of Ubiquitin-conjugating enzyme e2b (rad6 homolog) (UBE2B, Accession NM_003337.1), a gene which catalyzes the covalent attachment of ubiquitin to other proteins and is required for postreplication repair of uv-damaged dna. Accordingly, utilities of GAM72 include diagnosis, prevention and treatment of diseases and clinical conditions associated with UBE2B.

The function of UBE2B has been established by previous studies. The RAD6 pathway is central to postreplicative DNA repair in eukaryotic cells. Two principal elements of this pathway are the ubiquitin-conjugating enzymes RAD6 and the MMS2 (OMIM Ref. No. 603001)-UBC13 (OMIM Ref. No. 603679) heterodimer, which are recruited to chromatin by the RING-finger proteins RAD18 (OMIM Ref. No. 605256) and RAD5 (OMIM Ref. No. 607266), respectively. Hoege et al. (2002) showed that UBC9 (OMIM Ref. No. 601661), a small ubiquitin-related modifier (SUMO)-conjugating enzyme, is also affiliated with this pathway and that proliferating cell nuclear antigen (PCNA; 176740), a DNA polymerase sliding clamp involved in DNA synthesis and repair, is a substrate. PCNA is monoubiquitinated through RAD6 and RAD18, modified by lys63-linked multiubiquitination, which additionally requires MMS2, UBC13, and RAD5, and is conjugated to SUMO by UBC9. All 3 modifications affect the same lysine residue of PCNA, K164, suggesting that they label PCNA for alternative functions. Hoege et al. (2002) demonstrated that these modifications differentially affect resistance to DNA damage, and that damage-induced PCNA ubiquitination is elementary for DNA repair and occurs at the same conserved residue in yeast and humans.

Animal model experiments lend further support to the function of UBE2B. Roest et al. (1996) reported the phenotype of the first animal mutant in the ubiquitin pathway. Experimental inactivation of the RAD6B gene in mice caused male infertility. Derailment of spermatogenesis became overt during the postmeiotic condensation of chromatin in spermatids. In yeast the gene is not only implicated in postreplication repair and damage-induced mutagenesis but is also required for sporulation and may modulate chromatin structure via histone ubiquitination. The authors stated that the findings in the 'knock-out' mice provided a parallel between yeast sporulation and mammalian spermatogenesis and strongly implicated RAD6-dependent ubiquitination in chromatin remodeling in the human. Since heterozygous male mice and even knockout female mice are completely normal and fertile and thus able to transmit the defect, similar RAD6B mutations may cause male infertility in man. The fact that the RAD6B mice are viable and phenotypically normal is presumably due to functional redundancy with RAD6A (OMIM Ref. No. 312180).

It is appreciated that the abovementioned animal model for UBE2B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hoege, C.; Pfander, B.; Moldovan, G.-L.; Pyrowolakis, G.; Jentsch, S.: RAD6-dependent DNA repair is linked to modification of PCNA by ubiquitin and SUMO. Nature 419:135-141, 2002; and Roest, H. P.; van Klaveren, J.; de Wit, J.; van Gurp, C. G.; Koken, M. H. M.; Vermey, M.; van Roijen, J. H.; Hoogerbrugge, J. W.; Vreeburg, J. T. M.; Baarends, W. M.; Bootsma, D.; Grootego.

Further studies establishing the function and utilities of UBE2B are found in John Hopkins OMIM database record ID 179095, and in cited publications listed in Table 5, which are hereby incorporated by reference. Ubiquitin-conjugating enzyme e2g 2 (ubc7 homolog, yeast) (UBE2G2, Accession NM_003343.2) is another GAM72 target gene, herein designated TARGET GENE. UBE2G2 BINDING SITE is a target binding site found in the 3' untranslated region of mRNA encoded by UBE2G2, corresponding to a target binding site such as BINDING SITE I, BINDING SITE II or BINDING SITE III of FIG. 8. Table 4 illustrates the complementarity of the nucleotide sequences of UBE2G2 BINDING SITE, designated SEQ ID:7019, to the nucleotide sequence of GAM72 RNA, herein designated GAM RNA, also designated SEQ ID:342.

Another function of GAM72 is therefore inhibition of Ubiquitin-conjugating enzyme e2g 2 (ubc7 homolog, yeast) (UBE2G2, Accession NM_003343.2), a gene which catalyzes the covalent attachment of ubiquitin to other proteins. Accordingly, utilities of GAM72 include diagnosis, prevention and treatment of diseases and clinical conditions associated with UBE2G2.

The function of UBE2G2 has been established by previous studies. In eukaryotes, conjugation of target proteins to ubiquitin is an essential step in the proteasome-dependent degradation process and is mediated by a family of ubiquitin-conjugating (UBC) enzymes. See 600012. Katsanis and Fisher (1998) stated that S. cerevisiae Ubc7 is an endoplasmic reticulum-bound molecule whose active site faces the cytosol. Ubc7 has been shown to confer resistance to cadmium and to participate in the degradation of specific yeast proteins. As part of an effort to generate a transcriptional map of human chromosome 21, Katsanis and Fisher (1998) identified UBE2G2 cDNAs. The predicted 165-amino acid protein shares 60% sequence identity with yeast Ubc7. The nucleotide sequence of UBE2G2 is 57% similar to that of UBE2G (OMIM Ref. No. 601569), another human Ubc7 homolog. Northern blot analysis revealed that UBE2G2 is expressed ubiquitously as 2.9- and 7-kb mRNAs. The highest level of expression was seen in skeletal muscle. By inclusion within mapped clones and by analysis of somatic cell hybrid panels, Katsanis and Fisher (1998) mapped the UBE2G2 gene to 21q22.3. Rose et al. (1998) confirmed the localization to 21q22.3 by FISH.

Full details of the abovementioned studies are described in the following publications, the disclosure of which are hereby incorporated by reference:

Katsanis, N.; Fisher, E. M. C.: Identification, expression, and chromosomal localization of ubiquitin conjugating enzyme 7 (UBE2G2), a human homologue of the Saccharomyces cerevisiae Ubc7 gene. Genomics 51:128-131, 1998; and Rose, S. A.; Leek, J. P.; Moynihan, T. P.; Ardley, H. C.; Markham, A. F.; Robinson, P. A.: Assignment of the ubiquitin conjugating enzyme gene, UBE2G2, to human chromosome band 21q22.3.

Further studies establishing the function and utilities of UBE2G2 are found in John Hopkins OMIM database record ID 603124, and in cited publications listed in Table 5, which are hereby incorporated by reference. Vitamin d (1,25-dihydroxyvitamin d3) receptor (VDR, Accession NM_000376.1) is another GAM72 target gene, herein designated TARGET GENE. VDR BINDING SITE is a target binding site found in the 3' untranslated region of mRNA encoded by VDR, corresponding to a target binding site such as BINDING SITE I, BINDING SITE II or BINDING SITE III of FIG. 8. Table 4 illustrates the complementarity of the nucleotide sequences of VDR BINDING SITE, designated SEQ ID:16133, to the nucleotide sequence of GAM72 RNA, herein designated GAM RNA, also designated SEQ ID:342.

Another function of GAM72 is therefore inhibition of Vitamin d (1,25-dihydroxyvitamin d3) receptor (VDR, Accession NM_000376.1). Accordingly, utilities of GAM72 include diagnosis, prevention and treatment of diseases and clinical conditions associated with VDR.

Von hippel-lindau syndrome (VHL, Accession NM_000551.1) is another GAM72 target gene, herein designated TARGET GENE. VHL BINDING SITE is a target binding site found in the 3' untranslated region of mRNA encoded by VHL, corresponding to a target binding site such as BINDING SITE I, BINDING SITE II or BINDING SITE III of FIG. 8. Table 4 illustrates the complementarity of the nucleotide sequences of VHL BINDING SITE, designated SEQ ID:11294, to the nucleotide sequence of GAM72 RNA, herein designated GAM RNA, also designated SEQ ID:342.

Another function of GAM72 is therefore inhibition of Von hippel-lindau syndrome (VHL, Accession NM_000551.1), a gene which may control rna stability through the selective degradation of rna-bound proteins. and therefore is associated with Von hippel-lindau disease. Accordingly, utilities of GAM72 include diagnosis, prevention and treatment of Von hippel-lindau disease, and of other diseases and clinical conditions associated with VHL.

The function of VHL has been established by previous studies. Interfamilial differences in predisposition to pheochromocytoma in VHL reflect allelic heterogeneity such that there is a strong association between missense mutations and risk of pheochromocytoma. Prowse et al. (1997) investigated the mechanism of tumorigenesis in VHL tumors to determine whether there were differences between tumor types or classes of germline mutations. They studied 53 tumors (30 renal cell carcinomas, 15 hemangioblastomas, 5 pheochromocytomas, and 3 pancreatic tumors) from 33 patients (27 kindreds) with VHL. Overall, 51% of 45 informative tumors showed LOH at the VHL locus. In 11 cases, it was possible to distinguish between loss of the wildtype and mutant alleles, and in each case the wildtype allele was lost. LOH was detected in all tumor types and occurred in the presence of both germline missense mutations and other types of germline mutation associated with a low risk of pheochromocytoma. Intragenic somatic mutations were detected in 3 tumors (all hemangioblastomas) and in 2 of these could be shown to occur in the wildtype allele. Their study provided the first example of homozygous inactivation of the VHL gene by small intragenic mutations in this type of tumor. Hypermethylation of the VHL gene was detected in 33% (6 of 18) of tumors without LOH, including 2 renal cell carcinomas and 4 hemangioblastomas. Prowse et al. (1997) stated that, although hypermethylation of the VHL gene had been reported previously in nonfamilial RCC and although methylation of tumor-suppressor genes had been implicated in the pathogenesis of other sporadic cancers, this was the first report of somatic methylation in a familial cancer syndrome. Herman et al. (1994) observed hypermethylation of the VHL gene in 19% of sporadic RCCs. Versteeg (1997) provided a general discussion of aberrant methylation in cancer.

Animal model experiments lend further support to the function of VHL. Gemmill et al. (2002) isolated the Drosophila homolog of TRC8 (OMIM Ref. No. 603046) and studied its function by genetic manipulations and a yeast 2-hybrid screen. Human and Drosophila TRC8 proteins localize to the endoplasmic reticulum. Loss of either Drosophila Trc8 or Vhl resulted in an identical ventral midline defect. Direct interaction between Trc8 and Vhl in drosophila was confirmed by GST-pulldown and coimmunoprecipitation experiments. Gemmill et al. (2002) found that in Drosophila, overexpression of Trc8 inhibited growth consistent with its presumed role as a tumor suppressor gene. Human JAB1 (OMIM Ref. No. 604850) localization was dependent on VHL mutant status. Thus, the VHL, TRC8, and JAB1 proteins appear to be linked both physically and functionally, and all 3 may participate in the development of kidney cancer.

It is appreciated that the abovementioned animal model for VHL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Herman, J. G.; Latif, F.; Weng, Y.; Lerman, M. I.; Zbar, B.; Liu, S.; Samid, D.; Duan, D.-S. R.; Guarra, J. R.; Linehan, W. M.; Baylin, S. B.: Silencing of the VHL tumor-suppressor gene by DNA methylation in renal carcinomas. Proc. Nat. Acad. Sci. 91:9700-9704, 1994; and Gemmill, R. M.; Bemis, L. T.; Lee, J. P.; Sozen, M. A.; Baron, A.; Zeng, C.; Erickson, P. F.; Hooper, J. E.; Drabkin, H. A.: The TRC8 hereditary kidney cancer gene suppresses growth and fu.

Further studies establishing the function and utilities of VHL are found in John Hopkins OMIM database record ID 193300, and in cited publications listed in Table 5, which are hereby incorporated by reference. Vacuolar protein sorting 41 (yeast) (VPS41, Accession NM_014396.2) is another GAM72 target gene, herein designated TARGET GENE. VPS41 BINDING SITE is a target binding site found in the 3' untranslated region of multiple transcripts of mRNA encoded by VPS41, corresponding to a target binding site such as BINDING SITE I, BINDING SITE II or BINDING SITE III of FIG. 8. Table 4 illustrates the complementarity of the nucleotide sequences of VPS41 BINDING SITE, designated SEQ ID:16653, to the nucleotide sequence of GAM72 RNA, herein designated GAM RNA, also designated SEQ ID:342.

Another function of GAM72 is therefore inhibition of Vacuolar protein sorting 41 (yeast) (VPS41, Accession NM_014396.2). Accordingly, utilities of GAM72 include diagnosis, prevention and treatment of diseases and clinical conditions associated with VPS41.

WW45 (Accession) is another GAM72 target gene, herein designated TARGET GENE. WW45 BINDING SITE is a target binding site found in the 3' untranslated region of mRNA encoded by WW45, corresponding to a target binding site such as BINDING SITE I, BINDING SITE II or BINDING SITE III of FIG. 8. Table 4 illustrates the complementarity of the nucleotide sequences of WW45 BINDING SITE, designated SEQ ID:16137, to the nucleotide sequence of GAM72 RNA, herein designated GAM RNA, also designated SEQ ID:342.

Another function of GAM72 is therefore inhibition of WW45 (Accession), a gene which is required for ubiquitination and therefore degradation of several cell surface proteins like gap1, fur4, mal61 and ste2. also acts on rbp1. Accordingly, utilities of GAM72 include diagnosis, prevention and treatment of diseases and clinical conditions associated with WW45.

The function of WW45 has been established by previous studies. By searching an EST database using C. elegans and Drosophila WW domain-containing protein sequences as bait, followed by 5-prime and 3-prime RACE using a human heart cDNA library, Valverde (2000) obtained a full-length cDNA encoding WW45. The deduced 383-amino acid protein has a predicted molecular mass of approximately 45 kD. It contains 2 WW domains, a region rich in prolines and glutamines, and a coiled-coil region, as well as a nuclear localization signal and 2 endoplasmic reticulum retention signals. The mouse Ww45 cDNA has a different 3-prime untranslated region and encodes a protein that shares 93% identity with human WW45. Northern blot and RT-PCR analyses demonstrated that both human and mouse WW45 transcripts (1.2 and 2.7 kb, respectively) are ubiquitously expressed in adult tissues. In human, highest expression was in pancreas, while in mouse, highest expression was in testis. Northern blot analysis of whole mouse embryos showed that embryonic expression of Ww45 first occurred at 7 days postcoitum. Expression levels markedly decreased at day 11 and remained low at days 15 and 17, suggesting that WW45 expression is developmentally regulated. Accordingly, expression of human WW45 was found to be higher in fetal heart than in adult heart. By radiation hybrid analysis, Valverde (2000) mapped the WW45 gene to chromosome 14q13-q23. In a screen for Drosophila mutations that result in tissue overgrowth, Tapon et al. (2002) identified salvador (sav), a gene that promotes both cell cycle exit and cell death. Elevated cyclin E (OMIM Ref. No. 123837) and inhibitor of apoptosis-1 (Diap1) levels were found in mutant cells, resulting in delayed cell cycle exit and impaired apoptosis. Salvador contains 2 WW domains and binds to the Warts (or OMIM Ref. No. 603473) protein kinase. Because WW45 is the human ortholog of salvador, Tapon et al. (2002) sequenced the entire WW45 coding region in a panel of 52 tumor-derived cell lines, representing a broad range of tissue types. One colon cancer cell line, HCT15, had a heterozygous C- to - A mutation at nucleotide 554, resulting in an asp185- to - ala substitution. This mutation was not present in 185 population-based controls (370 chromosomes), indicating that it is not a common polymorphism. The authors noted that HCT15 carries a mutation in the mismatch repair gene MSH6 (OMIM Ref. No. 600678), which appears to enhance the frequency of point mutations in other genes. Two renal cancer cell lines, ACHN and 786-O, had deletions involving WW45. The normal allele was not present in either cell line, indicating that these cell lines were either homozygous or hemizygous for the deletion. The WW45 transcript was undetectable by RT-PCR in both cell lines, and a Southern blot using a probe derived from the 3-prime portion of the gene demonstrated that this part of the gene was absent in both cell lines. In cell line 786-O, PCR analysis of genomic DNA indicated that there was a deletion of approximately 157 kb, with the 5-prime breakpoint between exons 2 and 3 of WW45. The deletion in ACHN of approximately 138 kb encompassed the entire gene. The common region of overlap between these 2 deletions was only 21 kb, containing exons 3 to 5 of WW45. No other transcription units were identified within this 21 kb interval.

Full details of the abovementioned studies are described in the following publications, the disclosure of which are hereby incorporated by reference:

Tapon, N.; Harvey, K. F.; Bell, D. W.; Wahrer, D. C. R.; Schiripo, T. A.; Haber, D. A.; Hariharan, I. K.: salvador promotes both cell cycle exit and apoptosis in Drosophila and is mutated in human cancer cell lines. Cell 110:467-478, 2002; and Valverde, P.: Cloning, expression, and mapping of hWW45, a novel human WW domain-containing gene. Biochem. Biophys. Res. Commun. 276:990-998, 2000.

Further studies establishing the function and utilities of WW45 are found in John Hopkins OMIM database record ID 607203, and in cited publications listed in Table 5, which are hereby incorporated by reference. X-ray repair complementing defective repair in chinese hamster cells 2 (XRCC2, Accession NM_005431.1) is another GAM72 target gene, herein designated TARGET GENE. XRCC2 BINDING SITE is a target binding site found in the 3' untranslated region of mRNA encoded by XRCC2, corresponding to a target binding site such as BINDING SITE I, BINDING SITE II or BINDING SITE III of FIG. 8. Table 4 illustrates the complementarity of the nucleotide sequences of XRCC2 BINDING SITE, designated SEQ ID:12295, to the nucleotide sequence of GAM72 RNA, herein designated GAM RNA, also designated SEQ ID:342.

Another function of GAM72 is therefore inhibition of X-ray repair complementing defective repair in chinese hamster cells 2 (XRCC2, Accession NM_005431.1), a gene which involves in the homologous recombination repair (hrr) pathway of double-stranded dna. Accordingly, utilities of GAM72 include diagnosis, prevention and treatment of diseases and clinical conditions associated with XRCC2.

The function of XRCC2 has been established by previous studies. Johnson et al. (1999) demonstrated that XRCC2 is essential for the efficient repair of DNA double-strand breaks by homologous recombination between sister chromatids. Hamster cells deficient in XRCC2 showed a more than 100-fold decrease in homologous recombination induced by double-strand breaks compared with the parental cell line. This defect was corrected to almost wildtype levels by transient transfection with a plasmid expressing XRCC2. The repair defect in XRCC2 mutant cells appeared to be restricted to recombinational repair because nonhomologous end joining was normal. Johnson et al. (1999) concluded that XRCC2 is involved in the repair of DNA double-strand breaks by homologous recombination. Using a yeast 2-hybrid assay, Braybrooke et al. (2000) identified a direct interaction between XRCC2 and RAD51L3 (OMIM Ref. No. 602954), and they confirmed the interaction by pull-down assays between recombinant XRCC2 and endogenous RAD51L3 in HeLa cell extracts. Size-exclusion chromatography followed by Western blot analysis suggested that the 2 proteins exist as a heterodimer of about 70 kD.

Full details of the abovementioned studies are described in the following publications, the disclosure of which are hereby incorporated by reference:

Johnson, R. D.; Liu, N.; Jasin, M.: Mammalian XRCC2 promotes the repair of DNA double-strand breaks by homologous recombination. Nature 401:397-399, 1999; and Braybrooke, J. P.; Spink, K. G.; Thacker, J.; Hickson, I. D.: The RAD51 family member, RAD51L3, is a DNA-stimulated ATPase that forms a complex with XRCC2. J. Biol. Chem. 275:29100-29.

Further studies establishing the function and utilities of XRCC2 are found in John Hopkins OMIM database record ID 600375, and in cited publications listed in Table 5, which are hereby incorporated by reference. ZFD25 (Accession NM_016220.1) is another GAM72 target gene, herein designated TARGET GENE. ZFD25 BINDING SITE is a target binding site found in the 3' untranslated region of mRNA encoded by ZFD25, corresponding to a target binding site such as BINDING SITE I, BINDING SITE II or BINDING SITE III of FIG. 8. Table 4 illustrates the complementarity of the nucleotide sequences of ZFD25 BINDING SITE, designated SEQ ID:2054, to the nucleotide sequence of GAM72 RNA, herein designated GAM RNA, also designated SEQ ID:342.

Another function of GAM72 is therefore inhibition of ZFD25 (Accession NM_016220.1). Accordingly, utilities of GAM72 include diagnosis, prevention and treatment of diseases and clinical conditions associated with ZFD25.

Zinc finger, imprinted 3 (ZIM3, Accession NM_052882.1) is another GAM72 target gene, herein designated TARGET GENE. ZIM3 BINDING SITE is a target binding site found in the 3' untranslated region of mRNA encoded by ZIM3, corresponding to a target binding site such as BINDING SITE I, BINDING SITE II or BINDING SITE III of FIG. 8. Table 4 illustrates the complementarity of the nucleotide sequences of ZIM3 BINDING SITE, designated SEQ ID:14398, to the nucleotide sequence of GAM72 RNA, herein designated GAM RNA, also designated SEQ ID:342.

Another function of GAM72 is therefore inhibition of Zinc finger, imprinted 3 (ZIM3, Accession NM_052882.1). Accordingly, utilities of GAM72 include diagnosis, prevention and treatment of diseases and clinical conditions associated with ZIM3.

Zinc finger protein 14 (kox 6) (ZNF14, Accession NM_021030.1) is another GAM72 target gene, herein designated TARGET GENE. ZNF14 BINDING SITE is a target binding site found in the 3' untranslated region of mRNA encoded by ZNF14, corresponding to a target binding site such as BINDING SITE I, BINDING SITE II or BINDING SITE III of FIG. 8. Table 4 illustrates the complementarity of the nucleotide sequences of ZNF14 BINDING SITE, designated SEQ ID:14474, to the nucleotide sequence of GAM72 RNA, herein designated GAM RNA, also designated SEQ ID:342.

Another function of GAM72 is therefore inhibition of Zinc finger protein 14 (kox 6) (ZNF14, Accession NM_021030.1). Accordingly, utilities of GAM72 include diagnosis, prevention and treatment of diseases and clinical conditions associated with ZNF14.

FIG. 8 further provides a conceptual description of a novel bioinformatically detected of the present invention, referred to here as Genomic Address Messenger 73 (GAM73), which modulates expression of respective target genes thereof, the function and utility of which target genes is known in the art.

GAM73 is a novel bioinformatically detected regulatory, non protein coding, micro RNA (miRNA) gene. The method by which GAM73 was detected is described hereinabove with reference to FIGS. 8-15.

GAM73 gene, herein designated GAM GENE, and GAM73 target gene, herein designated TARGET GENE, are human genes contained in the human genome.

GAM73 gene encodes a GAM73 precursor RNA, herein designated GAM PRECURSOR RNA. Similar to other miRNA genes, and unlike most ordinary genes, GAM73 precursor RNA does not encode a protein. A nucleotide sequence identical or highly similar to the nucleotide sequence of GAM73 precursor RNA is designated SEQ ID:18, and is provided hereinbelow with reference to the sequence listing part.

GAM73 precursor RNA folds onto itself, forming GAM73 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM73 precursor RNA folds onto itself, forming GAM73 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM73 precursor RNA, designated SEQ-ID:18, and a schematic representation of a predicted secondary folding of GAM73 folded precursor RNA are further described with reference to Table 2, hereby incorporated by reference.

An enzyme complex designated DICER COMPLEX, 'dices' the GAM73 folded precursor RNA into GAM73 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM73 RNA is designated SEQ ID:264, and is provided hereinbelow with references to the sequence listing part and Table 3, hereby incorporated by reference.

GAM73 target gene, herein designated TARGET GENE, encodes a corresponding messenger RNA, GAM73 target RNA, herein designated GAM TARGET RNA. GAM73 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM73 RNA, herein designated GAM RNA, binds complementarily to one or more target binding sites located in untranslated regions of GAM73 target RNA, herein designated GAM TARGET RNA. This complementary binding is due to the fact that the nucleotide sequence of GAM73 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM73 RNA may have a different number of target binding sites in untranslated regions of a GAM73 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM73 RNA, herein designated GAM RNA, to target binding sites on GAM73 target RNA, herein designated GAM TARGET RNA, such as BINDING SITE I, BINDING SITE II and BINDING SITE III, inhibits translation of GAM73 target RNA into GAM73 target protein, herein designated GAM TARGET PROTEIN. GAM target protein is therefore outlined by a broken line.

It is appreciated that GAM73 target gene, herein designated TARGET GENE, in fact represents a plurality of GAM73 target genes. The mRNA of each one of this plurality of GAM73 target genes comprises one or more target binding sites, each having a nucleotide sequence which is at least partly complementary to GAM73 RNA, herein designated GAM RNA, and which when bound by GAM73 RNA causes inhibition of translation of respective one or more GAM73 target proteins.

It is further appreciated by one skilled in the art that the mode of translational inhibition illustrated by FIG. 8 with specific reference to translational inhibition exerted by GAM73 gene, herein designated GAM GENE, on one or more GAM73 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM73 correlate with, and may be deduced from, the identity of the target genes which GAM73 binds and inhibits, and the function of these target genes, as elaborated hereinbelow.

Chromosome 17 open reading frame 26 (C17orf26, Accession NM_139177.1) is a GAM73 target gene, herein designated TARGET GENE. C17orf26 BINDING SITE is a target binding site found in the 3' untranslated region of mRNA encoded by C17orf26, corresponding to a target binding site such as BINDING SITE I, BINDING SITE II or BINDING SITE III of FIG. 8. Table 4 illustrates the complementarity of the nucleotide sequences of C17orf26 BINDING SITE, designated SEQ ID:3694, to the nucleotide sequence of GAM73 RNA, herein designated GAM RNA, also designated SEQ ID:264.

A function of GAM73 is therefore inhibition of Chromosome 17 open reading frame 26 (C17orf26, Accession NM_139177.1). Accordingly, utilities of GAM73 include diagnosis, prevention and treatment of diseases and clinical conditions associated with C17orf26.

Grb2-associated binding protein 2 (GAB2, Accession NM_080491.1) is another GAM73 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:18529, to the nucleotide sequence of GAM73 RNA, herein designated GAM RNA, also designated SEQ ID:264.

Another function of GAM73 is therefore inhibition of Grb2-associated binding protein 2 (GAB2, Accession NM_080491.1), a gene which act as adapters for transmitting various signals. Accordingly, utilities of GAM73 include diagnosis, prevention and treatment of diseases and clinical conditions associated with GAB2.

The function of GAB2 and its association with various diseases and clinical conditions, has been established by previous studies, as described hereinabove with reference to GAM63.1. LOC144248 (Accession XM_084786.1) is another GAM73 target gene, herein designated TARGET GENE. LOC144248 BINDING SITE is a target binding site found in the 5' untranslated region of mRNA encoded by LOC144248, corresponding to a target binding site such as BINDING SITE I, BINDING SITE II or BINDING SITE III of FIG. 8. Table 4 illustrates the complementarity of the nucleotide sequences of LOC144248 BINDING SITE, designated SEQ ID:10663, to the nucleotide sequence of GAM73 RNA, herein designated GAM RNA, also designated SEQ ID:264.

Another function of GAM73 is therefore inhibition of LOC144248 (Accession XM_084786.1). Accordingly, utilities of GAM73 include diagnosis, prevention and treatment of diseases and clinical conditions associated with LOC144248.

LOC197003 (Accession) is another GAM73 target gene, herein designated TARGET GENE. LOC197003 BINDING SITE is a target binding site found in the 3' untranslated region of mRNA encoded by LOC197003, corresponding to a target binding site such as BINDING SITE I, BINDING SITE II or BINDING SITE III of FIG. 8. Table 4 illustrates the complementarity of the nucleotide sequences of LOC197003 BINDING SITE, designated SEQ ID:7418, to the nucleotide sequence of GAM73 RNA, herein designated GAM RNA, also designated SEQ ID:264.

Another function of GAM73 is therefore inhibition of LOC197003 (Accession). Accordingly, utilities of GAM73 include diagnosis, prevention and treatment of diseases and clinical conditions associated with LOC197003.

Moesin (MSN, Accession NM_002444.1) is another GAM73 target gene, herein designated TARGET GENE. MSN BINDING SITE is a target binding site found in the 3' untranslated region of mRNA encoded by MSN, corresponding to a target binding site such as BINDING SITE I, BINDING SITE II or BINDING SITE III of FIG. 8. Table 4 illustrates the complementarity of the nucleotide sequences of MSN BINDING SITE, designated SEQ ID:8419, to the nucleotide sequence of GAM73 RNA, herein designated GAM RNA, also designated SEQ ID:264.

Another function of GAM73 is therefore inhibition of Moesin (MSN, Accession NM_002444.1), a gene which may have a role linking the cytoskeleton to the plasma membrane and therefore may be associated with Wiskott-aldrich syndrome. Accordingly, utilities of GAM73 include diagnosis, prevention and treatment of Wiskott-aldrich syndrome., and of other diseases and clinical conditions associated with MSN.

The function of MSN has been established by previous studies. Shcherbina et al. (1999) demonstrated a decrease in platelet moesin in patients with Wiskott-Aldrich syndrome (OMIM Ref. No. 301000). This appeared to be a secondary defect to the primary defect in the WASP gene. The WASP and MSN genes are both located on the X chromosome, on the short and the long arm, respectively. Using mouse helper T cell lines and confocal microscopy, Allenspach et al. (2001) determined that the cytoplasmic tail of CD43 is necessary and sufficient for CD43 removal from the immunologic synapse. In at least some cells, CD43 is located at the distal pole of the T cell together with ezrin and moesin. No differences in the behavior of ezrin and moesin were noted throughout the study. Using cells from Cd43 -/- mice, Allenspach et al. (2001) observed that ezrin-radixin-moesin (ERM) family proteins move independently of the large CD43 mucin. Overexpression of a dominant- negative ERM mutant containing the N-terminal 320 amino acids of ezrin inhibited the activation-induced movement of CD43 without affecting conjugate formation. The dominant-negative mutant reduced cytokine production but not the expression of T-cell activation markers.

Full details of the abovementioned studies are described in the following publications, the disclosure of which are hereby incorporated by reference:

Lankes, W.; Griesmacher, A.; Grunwald, J.; Schwartz-Albiez, R.; Keller, R.: A heparin-binding protein involved in inhibition of smooth-muscle cell proliferation. Biochem. J. 251:831-842, 1988; and Lankes, W. T.; Furthmay, H.: Moesin: a member of the protein 4.1-talin-ezrin family of proteins. Proc. Nat. Acad. Sci. 88:8297-8301, 1991.

Further studies establishing the function and utilities of MSN are found in John Hopkins OMIM database record ID 309845, and in cited publications listed in Table 5, which are hereby incorporated by reference. RPH3A (Accession NM_014954.1) is another GAM73 target gene, herein designated TARGET GENE. RPH3A BINDING SITE is a target binding site found in the 3' untranslated region of mRNA encoded by RPH3A, corresponding to a target binding site such as BINDING SITE I, BINDING SITE II or BINDING SITE III of FIG. 8. Table 4 illustrates the complementarity of the nucleotide sequences of RPH3A BINDING SITE, designated SEQ ID:13411, to the nucleotide sequence of GAM73 RNA, herein designated GAM RNA, also designated SEQ ID:264.

Another function of GAM73 is therefore inhibition of RPH3A (Accession NM_014954.1). Accordingly, utilities of GAM73 include diagnosis, prevention and treatment of diseases and clinical conditions associated with RPH3A.

Serine/threonine kinase 29 (STK29, Accession NM_003957.1) is another GAM73 target gene, herein designated TARGET GENE. STK29 BINDING SITE is a target binding site found in the 3' untranslated region of mRNA encoded by STK29, corresponding to a target binding site such as BINDING SITE I, BINDING SITE II or BINDING SITE III of FIG. 8. Table 4 illustrates the complementarity of the nucleotide sequences of STK29 BINDING SITE, designated SEQ ID:15075, to the nucleotide sequence of GAM73 RNA, herein designated GAM RNA, also designated SEQ ID:264.

Another function of GAM73 is therefore inhibition of Serine/threonine kinase 29 (STK29, Accession NM_003957.1). Accordingly, utilities of GAM73 include diagnosis, prevention and treatment of diseases and clinical conditions associated with STK29.

Transient receptor potential cation channel, subfamily c, member 5 (TRPC5, Accession NM_012471.1) is another GAM73 target gene, herein designated TARGET GENE. TRPC5 BINDING SITE is a target binding site found in the 3' untranslated region of mRNA encoded by TRPC5, corresponding to a target binding site such as BINDING SITE I, BINDING SITE II or BINDING SITE III of FIG. 8. Table 4 illustrates the complementarity of the nucleotide sequences of TRPC5 BINDING SITE, designated SEQ ID:6129, to the nucleotide sequence of GAM73 RNA, herein designated GAM RNA, also designated SEQ ID:264.

Another function of GAM73 is therefore inhibition of Transient receptor potential cation channel, subfamily c, member 5 (TRPC5, Accession NM_012471.1). Accordingly, utilities of GAM73 include diagnosis, prevention and treatment of diseases and clinical conditions associated with TRPC5.

FIG. 8 further provides a conceptual description of a novel bioinformatically detected of the present invention, referred to here as Genomic Address Messenger 74 (GAM74), which modulates expression of respective target genes thereof, the function and utility of which target genes is known in the art.

GAM74 is a novel bioinformatically detected regulatory, non protein coding, micro RNA (miRNA) gene. The method by which GAM74 was detected is described hereinabove with reference to FIGS. 8-15.

GAM74 gene, herein designated GAM GENE, and GAM74 target gene, herein designated TARGET GENE, are human genes contained in the human genome.

GAM74 gene encodes a GAM74 precursor RNA, herein designated GAM PRECURSOR RNA. Similar to other miRNA genes, and unlike most ordinary genes, GAM74 precursor RNA does not encode a protein. A nucleotide sequence identical or highly similar to the nucleotide sequence of GAM74 precursor RNA is designated SEQ ID:87, and is provided hereinbelow with reference to the sequence listing part. Nucleotide sequence SEQ ID:87 is located at position 60841960 relative to chromosome 18.

GAM74 precursor RNA folds onto itself, forming GAM74 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM74 precursor RNA folds onto itself, forming GAM74 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM74 precursor RNA, designated SEQ-ID:87, and a schematic representation of a predicted secondary folding of GAM74 folded precursor RNA are further described with reference to Table 2, hereby incorporated by reference.

An enzyme complex designated DICER COMPLEX, 'dices' the GAM74 folded precursor RNA into GAM74 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM74 RNA is designated SEQ ID:254, and is provided hereinbelow with references to the sequence listing part and Table 3, hereby incorporated by reference.

GAM74 target gene, herein designated TARGET GENE, encodes a corresponding messenger RNA, GAM74 target RNA, herein designated GAM TARGET RNA. GAM74 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM74 RNA, herein designated GAM RNA, binds complementarily to one or more target binding sites located in untranslated regions of GAM74 target RNA, herein designated GAM TARGET RNA. This complementary binding is due to the fact that the nucleotide sequence of GAM74 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM74 RNA may have a different number of target binding sites in untranslated regions of a GAM74 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM74 RNA, herein designated GAM RNA, to target binding sites on GAM74 target RNA, herein designated GAM TARGET RNA, such as BINDING SITE I, BINDING SITE II and BINDING SITE III, inhibits translation of GAM74 target RNA into GAM74 target protein, herein designated GAM TARGET PROTEIN. GAM target protein is therefore outlined by a broken line.

It is appreciated that GAM74 target gene, herein designated TARGET GENE, in fact represents a plurality of GAM74 target genes. The mRNA of each one of this plurality of GAM74 target genes comprises one or more target binding sites, each having a nucleotide sequence which is at least partly complementary to GAM74 RNA, herein designated GAM RNA, and which when bound by GAM74 RNA causes inhibition of translation of respective one or more GAM74 target proteins.

It is further appreciated by one skilled in the art that the mode of translational inhibition illustrated by FIG. 8 with specific reference to translational inhibition exerted by GAM74 gene, herein designated GAM GENE, on one or more GAM74 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM74 correlate with, and may be deduced from, the identity of the target genes which GAM74 binds and inhibits, and the function of these target genes, as elaborated hereinbelow.

DKFZp434G171 (Accession) is a GAM74 target gene, herein designated TARGET GENE. DKFZp434G171 BINDING SITE is a target binding site found in the 3' untranslated region of mRNA encoded by DKFZp434G171, corresponding to a target binding site such as BINDING SITE I, BINDING SITE II or BINDING SITE III of FIG. 8. Table 4 illustrates the complementarity of the nucleotide sequences of DKFZp434G171 BINDING SITE, designated SEQ ID:3282, to the nucleotide sequence of GAM74 RNA, herein designated GAM RNA, also designated SEQ ID:254.

A function of GAM74 is therefore inhibition of DKFZp434G171 (Accession). Accordingly, utilities of GAM74 include diagnosis, prevention and treatment of diseases and clinical conditions associated with DKFZp434G171.

F-box only protein 9 (FBXO9, Accession NM_033481.1) is another GAM74 target gene, herein designated TARGET GENE. FBXO9 BINDING SITE is a target binding site found in the 3' untranslated region of multiple transcripts of mRNA encoded by FBXO9, corresponding to a target binding site such as BINDING SITE I, BINDING SITE II or BINDING SITE III of FIG. 8. Table 4 illustrates the complementarity of the nucleotide sequences of FBXO9 BINDING SITE, designated SEQ ID:12849, to the nucleotide sequence of GAM74 RNA, herein designated GAM RNA, also designated SEQ ID:254.

Another function of GAM74 is therefore inhibition of F-box only protein 9 (FBXO9, Accession NM_033481.1). Accordingly, utilities of GAM74 include diagnosis, prevention and treatment of diseases and clinical conditions associated with FBXO9.

Fibroblast growth factor receptor-like 1 (FGFRL1, Accession NM_021923.2) is another GAM74 target gene, herein designated TARGET GENE. FGFRL1 BINDING SITE is a target binding site found in the 3' untranslated region of mRNA encoded by FGFRL1, corresponding to a target binding site such as BINDING SITE I, BINDING SITE II or BINDING SITE III of FIG. 8. Table 4 illustrates the complementarity of the nucleotide sequences of FGFRL1 BINDING SITE, designated SEQ ID:2185, to the nucleotide sequence of GAM74 RNA, herein designated GAM RNA, also designated SEQ ID:254.

Another function of GAM74 is therefore inhibition of Fibroblast growth factor receptor-like 1 (FGFRL1, Accession NM_021923.2). Accordingly, utilities of GAM74 include diagnosis, prevention and treatment of diseases and clinical conditions associated with FGFRL1.

FLJ00024 (Accession XM_033361.2) is another GAM74 target gene, herein designated TARGET GENE. FLJ00024 BINDING SITE is a target binding site found in the 3' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:16152, to the nucleotide sequence of GAM74 RNA, herein designated GAM RNA, also designated SEQ ID:254.

Another function of GAM74 is therefore inhibition of FLJ00024 (Accession XM_033361.2). Accordingly, utilities of GAM74 include diagnosis, prevention and treatment of diseases and clinical conditions associated with FLJ00024.

FLJ11136 (Accession) is another GAM74 target gene, herein designated TARGET GENE. FLJ11136 BINDING SITE is a target binding site found in the 3' untranslated region of mRNA encoded by FLJ11136, corresponding to a target binding site such as BINDING SITE I, BINDING SITE II or BINDING SITE III of FIG. 8. Table 4 illustrates the complementarity of the nucleotide sequences of FLJ11136 BINDING SITE, designated SEQ ID:3962, to the nucleotide sequence of GAM74 RNA, herein designated GAM RNA, also designated SEQ ID:254.

Another function of GAM74 is therefore inhibition of FLJ11136 (Accession). Accordingly, utilities of GAM74 include diagnosis, prevention and treatment of diseases and clinical conditions associated with FLJ11136.

FLJ12891 (Accession NM_024950.1) is another GAM74 target gene, herein designated TARGET GENE. FLJ12891 BINDING SITE is a target binding site found in the 5' untranslated region of mRNA encoded by FLJ12891, corresponding to a target binding site such as BINDING SITE I, BINDING SITE II or BINDING SITE III of FIG. 8. Table 4 illustrates the complementarity of the nucleotide sequences of FLJ12891 BINDING SITE, designated SEQ ID:1091, to the nucleotide sequence of GAM74 RNA, herein designated GAM RNA, also designated SEQ ID:254.

Another function of GAM74 is therefore inhibition of FLJ12891 (Accession NM_024950.1). Accordingly, utilities of GAM74 include diagnosis, prevention and treatment of diseases and clinical conditions associated with FLJ12891.

FLJ13195 (Accession NM_022906.1) is another GAM74 target gene, herein designated TARGET GENE. FLJ13195 BINDING SITE is a target binding site found in the 3' untranslated region of mRNA encoded by FLJ13195, corresponding to a target binding site such as BINDING SITE I, BINDING SITE II or BINDING SITE III of FIG. 8. Table 4 illustrates the complementarity of the nucleotide sequences of FLJ13195 BINDING SITE, designated SEQ ID:12499, to the nucleotide sequence of GAM74 RNA, herein designated GAM RNA, also designated SEQ ID:254.

Another function of GAM74 is therefore inhibition of FLJ13195 (Accession NM_022906.1). Accordingly, utilities of GAM74 include diagnosis, prevention and treatment of diseases and clinical conditions associated with FLJ13195.

FLJ14146 (Accession NM_024709.1) is another GAM74 target gene, herein designated TARGET GENE. FLJ14146 BINDING SITE is a target binding site found in the 3' untranslated region of mRNA encoded by FLJ14146, corresponding to a target binding site such as BINDING SITE I, BINDING SITE II or BINDING SITE III of FIG. 8. Table 4 illustrates the complementarity of the nucleotide sequences of FLJ14146 BINDING SITE, designated SEQ ID:11084, to the nucleotide sequence of GAM74 RNA, herein designated GAM RNA, also designated SEQ ID:254.

Another function of GAM74 is therefore inhibition of FLJ14146 (Accession NM_024709.1). Accordingly, utilities of GAM74 include diagnosis, prevention and treatment of diseases and clinical conditions associated with FLJ14146.

FLJ20211 (Accession NM_017713.1) is another GAM74 target gene, herein designated TARGET GENE. FLJ20211 BINDING SITE is a target binding site found in the 3' untranslated region of mRNA encoded by FLJ20211, corresponding to a target binding site such as BINDING SITE I, BINDING SITE II or BINDING SITE III of FIG. 8. Table 4 illustrates the complementarity of the nucleotide sequences of FLJ20211 BINDING SITE, designated SEQ ID:2327, to the nucleotide sequence of GAM74 RNA, herein designated GAM RNA, also designated SEQ ID:254.

Another function of GAM74 is therefore inhibition of FLJ20211 (Accession NM_017713.1). Accordingly, utilities of GAM74 include diagnosis, prevention and treatment of diseases and clinical conditions associated with FLJ20211.

Holocarboxylase synthetase (biotin-[proprionyl-coenzyme a-carboxylase (atp-hydrolysing)] ligase) (HLCS, Accession NM_000411.3) is another GAM74 target gene, herein designated TARGET GENE. HLCS BINDING SITE is a target binding site found in the 3' untranslated region of mRNA encoded by HLCS, corresponding to a target binding site such as BINDING SITE I, BINDING SITE II or BINDING SITE III of FIG. 8. Table 4 illustrates the complementarity of the nucleotide sequences of HLCS BINDING SITE, designated SEQ ID:10828, to the nucleotide sequence of GAM74 RNA, herein designated GAM RNA, also designated SEQ ID:254.

Another function of GAM74 is therefore inhibition of Holocarboxylase synthetase (biotin-[proprionyl-coenzyme a-carboxylase (atp-hydrolysing)] ligase) (HLCS, Accession NM_000411.3). Accordingly, utilities of GAM74 include diagnosis, prevention and treatment of diseases and clinical conditions associated with HLCS.

KIAA0971 (Accession NM_014929.1) is another GAM74 target gene, herein designated TARGET GENE. KIAA0971 BINDING SITE is a target binding site found in the 3' untranslated region of mRNA encoded by KIAA0971, corresponding to a target binding site such as BINDING SITE I, BINDING SITE II or BINDING SITE III of FIG. 8. Table 4 illustrates the complementarity of the nucleotide sequences of KIAA0971 BINDING SITE, designated SEQ ID:1934, to the nucleotide sequence of GAM74 RNA, herein designated GAM RNA, also designated SEQ ID:254.

Another function of GAM74 is therefore inhibition of KIAA0971 (Accession NM_014929.1). Accordingly, utilities of GAM74 include diagnosis, prevention and treatment of diseases and clinical conditions associated with KIAA0971.

LOC147920 (Accession XM_085932.5) is another GAM74 target gene, herein designated TARGET GENE. LOC147920 BINDING SITE is a target binding site found in the 5' untranslated region of mRNA encoded by LOC147920, corresponding to a target binding site such as BINDING SITE I, BINDING SITE II or BINDING SITE III of FIG. 8. Table 4 illustrates the complementarity of the nucleotide sequences of LOC147920 BINDING SITE, designated SEQ ID:11680, to the nucleotide sequence of GAM74 RNA, herein designated GAM RNA, also designated SEQ ID:254.

Another function of GAM74 is therefore inhibition of LOC147920 (Accession XM_085932.5). Accordingly, utilities of GAM74 include diagnosis, prevention and treatment of diseases and clinical conditions associated with LOC147920.

LOC158230 (Accession XM_088517.1) is another GAM74 target gene, herein designated TARGET GENE. LOC158230 BINDING SITE is a target binding site found in the 3' untranslated region of mRNA encoded by LOC158230, corresponding to a target binding site such as BINDING SITE I, BINDING SITE II or BINDING SITE III of FIG. 8. Table 4 illustrates the complementarity of the nucleotide sequences of LOC158230 BINDING SITE, designated SEQ ID:7124, to the nucleotide sequence of GAM74 RNA, herein designated GAM RNA, also designated SEQ ID:254.

Another function of GAM74 is therefore inhibition of LOC158230 (Accession XM_088517.1). Accordingly, utilities of GAM74 include diagnosis, prevention and treatment of diseases and clinical conditions associated with LOC158230.

LOC164955 (Accession XM_092265.4) is another GAM74 target gene, herein designated TARGET GENE. LOC164955 BINDING SITE is a target binding site found in the 5' untranslated region of mRNA encoded by LOC164955, corresponding to a target binding site such as BINDING SITE I, BINDING SITE II or BINDING SITE III of FIG. 8. Table 4 illustrates the complementarity of the nucleotide sequences of LOC164955 BINDING SITE, designated SEQ ID:7799, to the nucleotide sequence of GAM74 RNA, herein designated GAM RNA, also designated SEQ ID:254.

Another function of GAM74 is therefore inhibition of LOC164955 (Accession XM_092265.4). Accordingly, utilities of GAM74 include diagnosis, prevention and treatment of diseases and clinical conditions associated with LOC164955.

LOC195977 (Accession XM_113625.3) is another GAM74 target gene, herein designated TARGET GENE. LOC195977 BINDING SITE is a target binding site found in the 3' untranslated region of mRNA encoded by LOC195977, corresponding to a target binding site such as BINDING SITE I, BINDING SITE II or BINDING SITE III of FIG. 8. Table 4 illustrates the complementarity of the nucleotide sequences of LOC195977 BINDING SITE, designated SEQ ID:12998, to the nucleotide sequence of GAM74 RNA, herein designated GAM RNA, also designated SEQ ID:254.

Another function of GAM74 is therefore inhibition of LOC195977 (Accession XM_113625.3). Accordingly, utilities of GAM74 include diagnosis, prevention and treatment of diseases and clinical conditions associated with LOC195977.

LOC220776 (Accession) is another GAM74 target gene, herein designated TARGET GENE. LOC220776 BINDING SITE is a target binding site found in the 3' untranslated region of mRNA encoded by LOC220776, corresponding to a target binding site such as BINDING SITE I, BINDING SITE II or BINDING SITE III of FIG. 8. Table 4 illustrates the complementarity of the nucleotide sequences of LOC220776 BINDING SITE, designated SEQ ID:1233, to the nucleotide sequence of GAM74 RNA, herein designated GAM RNA, also designated SEQ ID:254.

Another function of GAM74 is therefore inhibition of LOC220776 (Accession). Accordingly, utilities of GAM74 include diagnosis, prevention and treatment of diseases and clinical conditions associated with LOC220776.

LOC257576 (Accession) is another GAM74 target gene, herein designated TARGET GENE. LOC257576 BINDING SITE is a target binding site found in the 5' untranslated region of mRNA encoded by LOC257576, corresponding to a target binding site such as BINDING SITE I, BINDING SITE II or BINDING SITE III of FIG. 8. Table 4 illustrates the complementarity of the nucleotide sequences of LOC257576 BINDING SITE, designated SEQ ID:18100, to the nucleotide sequence of GAM74 RNA, herein designated GAM RNA, also designated SEQ ID:254.

Another function of GAM74 is therefore inhibition of LOC257576 (Accession). Accordingly, utilities of GAM74 include diagnosis, prevention and treatment of diseases and clinical conditions associated with LOC257576.

LOC92840 (Accession NM_138393.1) is another GAM74 target gene, herein designated TARGET GENE. LOC92840 BINDING SITE is a target binding site found in the 3' untranslated region of mRNA encoded by LOC92840, corresponding to a target binding site such as BINDING SITE I, BINDING SITE II or BINDING SITE III of FIG. 8. Table 4 illustrates the complementarity of the nucleotide sequences of LOC92840 BINDING SITE, designated SEQ ID:13076, to the nucleotide sequence of GAM74 RNA, herein designated GAM RNA, also designated SEQ ID:254.

Another function of GAM74 is therefore inhibition of LOC92840 (Accession NM_138393.1). Accordingly, utilities of GAM74 include diagnosis, prevention and treatment of diseases and clinical conditions associated with LOC92840.

Lymphotoxin beta receptor (tnfr superfamily, member 3) (LTBR, Accession NM_002342.1) is another GAM74 target gene, herein designated TARGET GENE. LTBR BINDING SITE is a target binding site found in the 3' untranslated region of mRNA encoded by LTBR, corresponding to a target binding site such as BINDING SITE I, BINDING SITE II or BINDING SITE III of FIG. 8. Table 4 illustrates the complementarity of the nucleotide sequences of LTBR BINDING SITE, designated SEQ ID:2499, to the nucleotide sequence of GAM74 RNA, herein designated GAM RNA, also designated SEQ ID:254.

Another function of GAM74 is therefore inhibition of Lymphotoxin beta receptor (tnfr superfamily, member 3) (LTBR, Accession NM_002342.1), a gene which is a receptor for the heterotrimeric lymphotoxin containing lta and ltb, and for tnfs14/light. promotes apoptosis via traf3 and traf5. may play a role in the development of lymphoid organs. Accordingly, utilities of GAM74 include diagnosis, prevention and treatment of diseases and clinical conditions associated with LTBR.

The function of LTBR has been established by previous studies. Crowe et al. (1994) demonstrated that the tumor necrosis factor receptor related protein is the human receptor for the heterotrimer of lymphotoxin-alpha (OMIM Ref. No. 153440) and lymphotoxin-beta (OMIM Ref. No. 600978). This LT-alpha/LT-beta heterotrimer is assumed to take part in immunologic reactions by cell-cell contact, but does not bind to either TNFR1 (OMIM Ref. No. 191190) or TNFR2 (OMIM Ref. No. 191191). Nakamura et al. (1995) isolated the LT-beta receptor cDNA from a cDNA library of murine embryonic heart mRNA, using the signal sequence trap (SST) method, a newly developed strategy for cloning secreted proteins and type I membrane proteins (Tashiro et al., 1993). This method, which does not require specific functional assay, takes advantage of the fact that their precursors carry amino-terminal signal sequences. The deduced amino acid sequence of the mouse LT-beta receptor is 66% identical to that of the human protein. Northern analysis of various organs in adult mice have showed that expression levels of LTBR mRNA were strong in lung, liver, and kidney, moderate in heart and testes, but weak in brain, thymus, spleen, and lymph nodes. Nakamura et al. (1995) speculated that, since the mouse receptor was already expressed in 7 day-postcoitus embryos, the LT-alpha/LT-beta receptor system may have some function in early embryogenesis. By linkage analysis with recombinant inbred mouse strains, Nakamura et al. (1995) demonstrated that the locus, designated Tnfcr, is very close to the Tnfr1 gene on mouse chromosome 6. Presumably, the human homolog is located on 12p13

Full details of the abovementioned studies are described in the following publications, the disclosure of which are hereby incorporated by reference:

Crowe, P. D.; VanArsdale, T. L.; Walter, B. N.; Ware, C. F.; Hession, C.; Ehrenfels, B.; Browning, J. L.; Din, W. S.; Goodwin, R. G; Smith, C. A.: A lymphotoxin-beta- specific receptor. Science 264:707-710, 1994; and Nakamura, T.; Tashiro, K.; Nazarea, M.; Nakano, T.; Sasayama, S.; Honjo, T.: The murine lymphotoxin-beta receptor cDNA: isolation by the signal sequence trap and chromosomal mapping. Gen.

Further studies establishing the function and utilities of LTBR are found in John Hopkins OMIM database record ID 600979, and in cited publications listed in Table 5, which are hereby incorporated by reference. MGC14425 (Accession NM_032903.1) is another GAM74 target gene, herein designated TARGET GENE. MGC14425 BINDING SITE is a target binding site found in the 3' untranslated region of mRNA encoded by MGC14425, corresponding to a target binding site such as BINDING SITE I, BINDING SITE II or BINDING SITE III of FIG. 8. Table 4 illustrates the complementarity of the nucleotide sequences of MGC14425 BINDING SITE, designated SEQ ID:9928, to the nucleotide sequence of GAM74 RNA, herein designated GAM RNA, also designated SEQ ID:254.

Another function of GAM74 is therefore inhibition of MGC14425 (Accession NM_032903.1). Accordingly, utilities of GAM74 include diagnosis, prevention and treatment of diseases and clinical conditions associated with MGC14425.

MGC16037 (Accession NM_032887.1) is another GAM74 target gene, herein designated TARGET GENE. MGC16037 BINDING SITE is a target binding site found in the 3' untranslated region of mRNA encoded by MGC16037, corresponding to a target binding site such as BINDING SITE I, BINDING SITE II or BINDING SITE III of FIG. 8. Table 4 illustrates the complementarity of the nucleotide sequences of MGC16037 BINDING SITE, designated SEQ ID:6563, to the nucleotide sequence of GAM74 RNA, herein designated GAM RNA, also designated SEQ ID:254.

Another function of GAM74 is therefore inhibition of MGC16037 (Accession NM_032887.1). Accordingly, utilities of GAM74 include diagnosis, prevention and treatment of diseases and clinical conditions associated with MGC16037.

P53AIP1 (Accession NM_022112.1) is another GAM74 target gene, herein designated TARGET GENE. P53AIP1 BINDING SITE is a target binding site found in the 3' untranslated region of mRNA encoded by P53AIP1, corresponding to a target binding site such as BINDING SITE I, BINDING SITE II or BINDING SITE III of FIG. 8. Table 4 illustrates the complementarity of the nucleotide sequences of P53AIP1 BINDING SITE, designated SEQ ID:13522, to the nucleotide sequence of GAM74 RNA, herein designated GAM RNA, also designated SEQ ID:254.

Another function of GAM74 is therefore inhibition of P53AIP1 (Accession NM_022112.1). Accordingly, utilities of GAM74 include diagnosis, prevention and treatment of diseases and clinical conditions associated with P53AIP1.

Protein regulator of cytokinesis 1 (PRC1, Accession NM_003981.1) is another GAM74 target gene, herein designated TARGET GENE. PRC1 BINDING SITE is a target binding site found in the 3' untranslated region of mRNA encoded by PRC1, corresponding to a target binding site such as BINDING SITE I, BINDING SITE II or BINDING SITE III of FIG. 8. Table 4 illustrates the complementarity of the nucleotide sequences of PRC1 BINDING SITE, designated SEQ ID:14663, to the nucleotide sequence of GAM74 RNA, herein designated GAM RNA, also designated SEQ ID:254.

Another function of GAM74 is therefore inhibition of Protein regulator of cytokinesis 1 (PRC1, Accession NM_003981.1). Accordingly, utilities of GAM74 include diagnosis, prevention and treatment of diseases and clinical conditions associated with PRC1.

Ring1 and yy1 binding protein (RYBP, Accession NM_012234.3) is another GAM74 target gene, herein designated TARGET GENE. RYBP BINDING SITE is a target binding site found in the 5' untranslated region of mRNA encoded by RYBP, corresponding to a target binding site such as BINDING SITE I, BINDING SITE II or BINDING SITE III of FIG. 8. Table 4 illustrates the complementarity of the nucleotide sequences of RYBP BINDING SITE, designated SEQ ID:15729, to the nucleotide sequence of GAM74 RNA, herein designated GAM RNA, also designated SEQ ID:254.

Another function of GAM74 is therefore inhibition of Ring1 and yy1 binding protein (RYBP, Accession NM_012234.3). Accordingly, utilities of GAM74 include diagnosis, prevention and treatment of diseases and clinical conditions associated with RYBP.

Solute carrier family 37 (glycerol-3-phosphate transporter), member 1 (SLC37A1, Accession NM_018964.2) is another GAM74 target gene, herein designated TARGET GENE. SLC37A1 BINDING SITE is a target binding site found in the 3' untranslated region of mRNA encoded by SLC37A1, corresponding to a target binding site such as BINDING SITE I, BINDING SITE II or BINDING SITE III of FIG. 8. Table 4 illustrates the complementarity of the nucleotide sequences of SLC37A1 BINDING SITE, designated SEQ ID:6854, to the nucleotide sequence of GAM74 RNA, herein designated GAM RNA, also designated SEQ ID:254.

Another function of GAM74 is therefore inhibition of Solute carrier family 37 (glycerol-3-phosphate transporter), member 1 (SLC37A1, Accession NM_018964.2). Accordingly, utilities of GAM74 include diagnosis, prevention and treatment of diseases and clinical conditions associated with SLC37A1.

Solute carrier family 38, member 5 (SLC38A5, Accession NM_033518.1) is another GAM74 target gene, herein designated TARGET GENE. SLC38A5 BINDING SITE is a target binding site found in the 5' untranslated region of mRNA encoded by SLC38A5, corresponding to a target binding site such as BINDING SITE I, BINDING SITE II or BINDING SITE III of FIG. 8. Table 4 illustrates the complementarity of the nucleotide sequences of SLC38A5 BINDING SITE, designated SEQ ID:1536, to the nucleotide sequence of GAM74 RNA, herein designated GAM RNA, also designated SEQ ID:254.

Another function of GAM74 is therefore inhibition of Solute carrier family 38, member 5 (SLC38A5, Accession NM_033518.1). Accordingly, utilities of GAM74 include diagnosis, prevention and treatment of diseases and clinical conditions associated with SLC38A5.

Solute carrier family 7 (cationic amino acid transporter, y+ system), member 6 (SLC7A6, Accession NM_003983.1) is another GAM74 target gene, herein designated TARGET GENE. SLC7A6 BINDING SITE is a target binding site found in the 3' untranslated region of mRNA encoded by SLC7A6, corresponding to a target binding site such as BINDING SITE I, BINDING SITE II or BINDING SITE III of FIG. 8. Table 4 illustrates the complementarity of the nucleotide sequences of SLC7A6 BINDING SITE, designated SEQ ID:11061, to the nucleotide sequence of GAM74 RNA, herein designated GAM RNA, also designated SEQ ID:254.

Another function of GAM74 is therefore inhibition of Solute carrier family 7 (cationic amino acid transporter, y+ system), member 6 (SLC7A6, Accession NM_003983.1), a gene which is involved in mediating amino acid transport. Accordingly, utilities of GAM74 include diagnosis, prevention and treatment of diseases and clinical conditions associated with SLC7A6.

The function of SLC7A6 has been established by previous studies. Using RT-PCR with degenerate primers to screen for amino acid transporters in opossum kidney, followed by searching EST databases, Torrents et al. (1998) obtained a cDNA encoding SLC7A6, which they called y(+)LAT2. SLC7A6 is identical to the KIAA0245 gene reported by Nagase et al. (1996). Sequence analysis predicted that SLC7A6 is a 515-amino acid, typical organic solute transporter protein with 12 transmembrane domains, 3 potential phosphorylation sites, and N- and C-terminal cytoplasmic segments. SLC7A6 shares 75% amino acid identity with the opossum sequence and y(+)LAT1 (SLC7A7; 603593). By RT-PCR analysis, Nagase et al. (1996) detected SLC7A6 expression in all tissues tested except liver; expression was weak in pancreas and highest in thymus.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996; and Torrents, D.; Estevez, R.; Pineda, M.; Fernandez, E.; Lloberas, J.; Shi, Y.-B.; Zorzano, A.; Palacin, M.: Identification and characterization of a membrane protein (y(+)L amino acid tr.

Further studies establishing the function and utilities of SLC7A6 are found in John Hopkins OMIM database record ID 605641, and in cited publications listed in Table 5, which are hereby incorporated by reference. SMA3 (Accession NM_006780.1) is another GAM74 target gene, herein designated TARGET GENE. SMA3 BINDING SITE is a target binding site found in the 3' untranslated region of mRNA encoded by SMA3, corresponding to a target binding site such as BINDING SITE I, BINDING SITE II or BINDING SITE III of FIG. 8. Table 4 illustrates the complementarity of the nucleotide sequences of SMA3 BINDING SITE, designated SEQ ID:6849, to the nucleotide sequence of GAM74 RNA, herein designated GAM RNA, also designated SEQ ID:254.

Another function of GAM74 is therefore inhibition of SMA3 (Accession NM_006780.1). Accordingly, utilities of GAM74 include diagnosis, prevention and treatment of diseases and clinical conditions associated with SMA3.

Sparc/osteonectin, cwcv and kazal-like domains proteoglycan (testican) (SPOCK, Accession NM_004598.2) is another GAM74 target gene, herein designated TARGET GENE. SPOCK BINDING SITE is a target binding site found in the 3' untranslated region of mRNA encoded by SPOCK, corresponding to a target binding site such as BINDING SITE I, BINDING SITE II or BINDING SITE III of FIG. 8. Table 4 illustrates the complementarity of the nucleotide sequences of SPOCK BINDING SITE, designated SEQ ID:10327, to the nucleotide sequence of GAM74 RNA, herein designated GAM RNA, also designated SEQ ID:254.

Another function of GAM74 is therefore inhibition of Sparc/osteonectin, cwcv and kazal-like domains proteoglycan (testican) (SPOCK, Accession NM_004598.2). Accordingly, utilities of GAM74 include diagnosis, prevention and treatment of diseases and clinical conditions associated with SPOCK.

Thy-1 cell surface antigen (THY1, Accession NM_006288.2) is another GAM74 target gene, herein designated TARGET GENE. THY1 BINDING SITE is a target binding site found in the 3' untranslated region of mRNA encoded by THY1, corresponding to a target binding site such as BINDING SITE I, BINDING SITE II or BINDING SITE III of FIG. 8. Table 4 illustrates the complementarity of the nucleotide sequences of THY1 BINDING SITE, designated SEQ ID:7884, to the nucleotide sequence of GAM74 RNA, herein designated GAM RNA, also designated SEQ ID:254.

Another function of GAM74 is therefore inhibition of Thy-1 cell surface antigen (THY1, Accession NM_006288.2), a gene which plays a role in cell-cell or cell-ligand interactions during synaptogenesis. Accordingly, utilities of GAM74 include diagnosis, prevention and treatment of diseases and clinical conditions associated with THY1.

The function of THY1 has been established by previous studies. Thy-1 is the designation for a major cell surface glycoprotein characteristic to T cells, as first defined in the mouse and rat (Raff, 1971; Letarte-Muirhead et al., 1975). The Thy-1 glycoproteins are constituents of thymocytes and neurons and probably are involved in cell-cell interactions. The putative human homolog of Thy-1 of the mouse is called K117. The human homolog of the rodent antigen was studied by Ades et al. (1980). Using a monoclonal antibody, McKenzie and Fabre (1981) studied the tissue distribution of the antigen. By use of a gene clone in somatic cell hybrids, Seki et al. (1985) assigned the THY1 gene to chromosome 11. Van den Elsen et al. (1985) predicted that the human Thy-1 homolog maps to chromosome 11 because that is where they found T3D (OMIM Ref. No. 186790) to map and in the mouse T3D and Thy-1 map to chromosome 9 along with certain other loci that are on human 11q. A multigene family is a group of homologous genes with similar function. A supergene family is a set of multigene families and single genes related by sequence (implying common ancestry) but not necessarily related in function. Hood et al. (1985) refer to the immunoglobulin supergene family which includes Thy-1, poly-Ig receptor, heavy, kappa and lambda immunoglobulins, Lyt-2 (T8), alpha and beta chains of T-cell antigen receptor and the closely homologous gamma chain, class I MHC antigen, beta-2-microglobulin, and the alpha and beta chains of class II MHC antigens. Thy-1 is structurally the simplest of these, consisting of a single immunoglobulin homology unit that is either intermediate between V and C or somewhat more similar to a V homology unit (Williams and Gagnon, 1982). The Thy-1 glycoprotein is also exceptional in that it is on the cell surface as a free homology unit and apparently does not associate either with itself or with other polypeptides. Its role in immune response is unclear. It is expressed on fibroblasts and brain cells in addition to some T cells. The significant role of Thy-1 in developing nervous tissue (Morris, 1985) may be of relevance to disorders such as ataxia- telangiectasia (OMIM Ref. No. 208900) that combine neurologic and immunologic defects. By somatic cell and in situ hybridization, van Rijs et al. (1985) localized the gene to 11q23-11q24. Rettig et al. (1985) assigned the gene to 11q13-qter, by Southern analysis of DNA from hybrid cells containing rearranged chromosomes 11. HGM7 gave the regional assignment as 11q22.3. Tunnacliffe and McGuire (1990) constructed a physical map of 11q23 by pulsed field gel electrophoresis and showed that THY1 lies in 11q23.3 as the most telomeric of a group of 6 genes: cen-CD3E-CD3D-CD3G-PBGD-CBL2-THY1-qter. Greenspan and O'Brien (1989) showed in the mouse that a factor secreted by nonneuronal accessory cells of dorsal root ganglion cultures stimulates neurite outgrowth in neonatal sympathetic ganglion neurons. They presented evidence that this is identical to Thy-1. It is this function in separate tissues that might explain pleiotropic manifestations of some syndromes such as ataxia-telangiectasia (OMIM Ref. No. 208900) or cartilage-hair hypoplasia (OMIM Ref. No. 250250).

Full details of the abovementioned studies are described in the following publications, the disclosure of which are hereby incorporated by reference:

Morris, R.: Thy-1 in developing nervous tissue. Dev. Neurosci. 7: 133-160, 1985; and Greenspan, R. J.; O'Brien, M. C.: Genetic evidence for the role of Thy-1 in neurite outgrowth in the mouse. J. Neurogenet. 5:25-36, 1989.

Further studies establishing the function and utilities of THY1 are found in John Hopkins OMIM database record ID 188230, and in cited publications listed in Table 5, which are hereby incorporated by reference. Upstream binding transcription factor, rna polymerase i (UBTF, Accession NM_014233.1) is another GAM74 target gene, herein designated TARGET GENE. UBTF BINDING SITE is a target binding site found in the 3' untranslated region of mRNA encoded by UBTF, corresponding to a target binding site such as BINDING SITE I, BINDING SITE II or BINDING SITE III of FIG. 8. Table 4 illustrates the complementarity of the nucleotide sequences of UBTF BINDING SITE, designated SEQ ID:14273, to the nucleotide sequence of GAM74 RNA, herein designated GAM RNA, also designated SEQ ID:254.

Another function of GAM74 is therefore inhibition of Upstream binding transcription factor, rna polymerase i (UBTF, Accession NM_014233.1), a gene which recognizes the ribosomal rna gene promoter and activates transcription. Accordingly, utilities of GAM74 include diagnosis, prevention and treatment of diseases and clinical conditions associated with UBTF.

The function of UBTF has been established by previous studies. Upstream binding factor (UBF) is a transcription factor required for expression of the 18S, 5.8S, and 28S ribosomal RNAs, along with SL1 (a complex of TBP (OMIM Ref. No. 600075) and multiple TBP-associated factors or 'TAFs'). Two UBF polypeptides, of 94 and 97 kD, exist in the human (Bell et al., 1988). UBF is a nucleolar phosphoprotein with both DNA binding and transactivation domains. Sequence-specific DNA binding to the core and upstream control elements of the human rRNA promoter is mediated through several HMG boxes (Jantzen et al., 1990). Jantzen et al. (1990) cloned human UBF by screening a HeLa cell cDNA library with DNA probes based on tryptic peptides of the protein. They found an open reading frame encoding the 764-amino acid UBF. The authors also characterized DNA binding characteristics of UBF. Chan et al. (1991) cloned the human cDNA by screening an expression library with a specific autoantibody that recognizes nucleolar organizing regions. Jones et al. (1995) mapped the gene, symbolized UBTF, to the BRCA1 region of 17q21 by analyzing genomic clones from that region. They found the gene order to be cen-PPY(OMIM Ref. No. 167780)-UBTF-EPB3(OMIM Ref. No. 109270)-GP2B(OMIM Ref. No. 273800)-tel.

Full details of the abovementioned studies are described in the following publications, the disclosure of which are hereby incorporated by reference:

Jantzen, H.-M.; Admon, A.; Bell, S. P.; Tjian, R.: Nucleolar transcription factor hUBF contains a DNA-binding motif with homology to HMG proteins. Nature 344:830-836, 1990; and Chan, E. K. L.; Imai, H.; Hamel, J. C.; Tan, E. M.: Human autoantibody to RNA polymerase I transcription factor hUBF: molecular identity of nucleolus organizer region autoantigen NOR-9.

Further studies establishing the function and utilities of UBTF are found in John Hopkins OMIM database record ID 600673, and in cited publications listed in Table 5, which are hereby incorporated by reference.

FIG. 8 further provides a conceptual description of a novel bioinformatically detected of the present invention, referred to here as Genomic Address Messenger 75 (GAM75), which modulates expression of respective target genes thereof, the function and utility of which target genes is known in the art.

GAM75 is a novel bioinformatically detected regulatory, non protein coding, micro RNA (miRNA) gene. The method by which GAM75 was detected is described hereinabove with reference to FIGS. 8-15.

GAM75 gene, herein designated GAM GENE, and GAM75 target gene, herein designated TARGET GENE, are human genes contained in the human genome.

GAM75 gene encodes a GAM75 precursor RNA, herein designated GAM PRECURSOR RNA. Similar to other miRNA genes, and unlike most ordinary genes, GAM75 precursor RNA does not encode a protein. A nucleotide sequence identical or highly similar to the nucleotide sequence of GAM75 precursor RNA is designated SEQ ID:177, and is provided hereinbelow with reference to the sequence listing part.

GAM75 precursor RNA folds onto itself, forming GAM75 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM75 precursor RNA folds onto itself, forming GAM75 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM75 precursor RNA, designated SEQ-ID:177, and a schematic representation of a predicted secondary folding of GAM75 folded precursor RNA are further described with reference to Table 2, hereby incorporated by reference.

An enzyme complex designated DICER COMPLEX, 'dices' the GAM75 folded precursor RNA into GAM75 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM75 RNA is designated SEQ ID:210, and is provided hereinbelow with references to the sequence listing part and Table 3, hereby incorporated by reference.

GAM75 target gene, herein designated TARGET GENE, encodes a corresponding messenger RNA, GAM75 target RNA, herein designated GAM TARGET RNA. GAM75 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM75 RNA, herein designated GAM RNA, binds complementarily to one or more target binding sites located in untranslated regions of GAM75 target RNA, herein designated GAM TARGET RNA. This complementary binding is due to the fact that the nucleotide sequence of GAM75 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM75 RNA may have a different number of target binding sites in untranslated regions of a GAM75 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM75 RNA, herein designated GAM RNA, to target binding sites on GAM75 target RNA, herein designated GAM TARGET RNA, such as BINDING SITE I, BINDING SITE II and BINDING SITE III, inhibits translation of GAM75 target RNA into GAM75 target protein, herein designated GAM TARGET PROTEIN. GAM target protein is therefore outlined by a broken line.

It is appreciated that GAM75 target gene, herein designated TARGET GENE, in fact represents a plurality of GAM75 target genes. The mRNA of each one of this plurality of GAM75 target genes comprises one or more target binding sites, each having a nucleotide sequence which is at least partly complementary to GAM75 RNA, herein designated GAM RNA, and which when bound by GAM75 RNA causes inhibition of translation of respective one or more GAM75 target proteins.

It is further appreciated by one skilled in the art that the mode of translational inhibition illustrated by FIG. 8 with specific reference to translational inhibition exerted by GAM75 gene, herein designated GAM GENE, on one or more GAM75 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM75 correlate with, and may be deduced from, the identity of the target genes which GAM75 binds and inhibits, and the function of these target genes, as elaborated hereinbelow.

Adenylate cyclase 7 (ADCY7, Accession NM_001114.1) is a GAM75 target gene, herein designated TARGET GENE. ADCY7 BINDING SITE is a target binding site found in the 3' untranslated region of mRNA encoded by ADCY7, corresponding to a target binding site such as BINDING SITE I, BINDING SITE II or BINDING SITE III of FIG. 8. Table 4 illustrates the complementarity of the nucleotide sequences of ADCY7 BINDING SITE, designated SEQ ID:15427, to the nucleotide sequence of GAM75 RNA, herein designated GAM RNA, also designated SEQ ID:210.

A function of GAM75 is therefore inhibition of Adenylate cyclase 7 (ADCY7, Accession NM_001114.1), a gene which this a membrane- bound, ca(2+)-inhibitable adenylyl cyclase. Accordingly, utilities of GAM75 include diagnosis, prevention and treatment of diseases and clinical conditions associated with ADCY7.

The function of ADCY7 has been established by previous studies. Hellevuo et al. (1993) identified a novel form of human adenylyl cyclase (ADCY7) in the human erythroleukemia cell line HEL. It appeared that ADCY7 is the major form of adenylyl cyclase in human platelets. Hellevuo et al. (1995) used PCR techniques in the study of human/rodent somatic hybrid panels and a YAC library to demonstrate that the ADCY7 gene is located on 16q12-q13. The adenylyl cyclase enzyme family is characterized by the presence of 12 membrane-spanning domains in its sequences, and this region of the genome is known to contain other genes encoding proteins characterized by 12 membrane-spanning domains: norepinephrine transporter protein-1 (NET1; 163970), located at 16q12.2, and renal sodium-glucose transporter-2 (SGLT2; 182381), located at 16p11.2.

Full details of the abovementioned studies are described in the following publications, the disclosure of which are hereby incorporated by reference:

Hellevuo, K.; Berry, R.; Sikela, J. M.; Tabakoff, B.: Localization of the gene for a novel human adenylyl cyclase (ADCY7) to chromosome 16. Hum. Genet. 95:197-200, 1995; and Hellevuo, K.; Yoshimura, M.; Kao, M.; Hoffman, P. L.; Cooper, D. M. F.; Tabakoff, B.: A novel adenylyl cyclase sequence cloned from the human erythroleukemia cell line. Biochem. Biophy.

Further studies establishing the function and utilities of ADCY7 are found in John Hopkins OMIM database record ID 600385, and in cited publications listed in Table 5, which are hereby incorporated by reference. Blepharophimosis, epicanthus inversus and ptosis, candidate 1 (BPESC1, Accession NM_021812.1) is another GAM75 target gene, herein designated TARGET GENE. BPESC1 BINDING SITE is a target binding site found in the 3' untranslated region of mRNA encoded by BPESC1, corresponding to a target binding site such as BINDING SITE I, BINDING SITE II or BINDING SITE III of FIG. 8. Table 4 illustrates the complementarity of the nucleotide sequences of BPESC1 BINDING SITE, designated SEQ ID:12031, to the nucleotide sequence of GAM75 RNA, herein designated GAM RNA, also designated SEQ ID:210.

Another function of GAM75 is therefore inhibition of Blepharophimosis, epicanthus inversus and ptosis, candidate 1 (BPESC1, Accession NM_021812.1). Accordingly, utilities of GAM75 include diagnosis, prevention and treatment of diseases and clinical conditions associated with BPESC1.

Chromosome 22 open reading frame 3 (C22orf3, Accession NM_012265.1) is another GAM75 target gene, herein designated TARGET GENE. C22orf3 BINDING SITE is a target binding site found in the 3' untranslated region of mRNA encoded by C22orf3, corresponding to a target binding site such as BINDING SITE I, BINDING SITE II or BINDING SITE III of FIG. 8. Table 4 illustrates the complementarity of the nucleotide sequences of C22orf3 BINDING SITE, designated SEQ ID:12551, to the nucleotide sequence of GAM75 RNA, herein designated GAM RNA, also designated SEQ ID:210.

Another function of GAM75 is therefore inhibition of Chromosome 22 open reading frame 3 (C22orf3, Accession NM_012265.1). Accordingly, utilities of GAM75 include diagnosis, prevention and treatment of diseases and clinical conditions associated with C22orf3.

CMRF-35H (Accession XM_046925.4) is another GAM75 target gene, herein designated TARGET GENE. CMRF-35H BINDING SITE is a target binding site found in the 3' untranslated region of mRNA encoded by CMRF-35H, corresponding to a target binding site such as BINDING SITE I, BINDING SITE II or BINDING SITE III of FIG. 8. Table 4 illustrates the complementarity of the nucleotide sequences of CMRF-35H BINDING SITE, designated SEQ ID:5740, to the nucleotide sequence of GAM75 RNA, herein designated GAM RNA, also designated SEQ ID:210.

Another function of GAM75 is therefore inhibition of CMRF-35H (Accession XM_046925.4). Accordingly, utilities of GAM75 include diagnosis, prevention and treatment of diseases and clinical conditions associated with CMRF-35H.

Camp responsive element binding protein-like 2 (CREBL2, Accession NM_001310.2) is another GAM75 target gene, herein designated TARGET GENE. CREBL2 BINDING SITE is a target binding site found in the 3' untranslated region of mRNA encoded by CREBL2, corresponding to a target binding site such as BINDING SITE I, BINDING SITE II or BINDING SITE III of FIG. 8. Table 4 illustrates the complementarity of the nucleotide sequences of CREBL2 BINDING SITE, designated SEQ ID:4609, to the nucleotide sequence of GAM75 RNA, herein designated GAM RNA, also designated SEQ ID:210.

Another function of GAM75 is therefore inhibition of Camp responsive element binding protein-like 2 (CREBL2, Accession NM_001310.2) . Accordingly, utilities of GAM75 include diagnosis, prevention and treatment of diseases and clinical conditions associated with CREBL2.

D123 (Accession) is another GAM75 target gene, herein designated TARGET GENE. D123 BINDING SITE is a target binding site found in the 5' untranslated region of mRNA encoded by D123, corresponding to a target binding site such as BINDING SITE I, BINDING SITE II or BINDING SITE III of FIG. 8. Table 4 illustrates the complementarity of the nucleotide sequences of D123 BINDING SITE, designated SEQ ID:17716, to the nucleotide sequence of GAM75 RNA, herein designated GAM RNA, also designated SEQ ID:210.

Another function of GAM75 is therefore inhibition of D123 (Accession). Accordingly, utilities of GAM75 include diagnosis, prevention and treatment of diseases and clinical conditions associated with D123.

Endoglin (osler-rendu-weber syndrome 1) (ENG, Accession NM_000118.1) is another GAM75 target gene, herein designated TARGET GENE. ENG BINDING SITE is a target binding site found in the 3' untranslated region of mRNA encoded by ENG, corresponding to a target binding site such as BINDING SITE I, BINDING SITE II or BINDING SITE III of FIG. 8. Table 4 illustrates the complementarity of the nucleotide sequences of ENG BINDING SITE, designated SEQ ID:2762, to the nucleotide sequence of GAM75 RNA, herein designated GAM RNA, also designated SEQ ID:210.

Another function of GAM75 is therefore inhibition of Endoglin (osler-rendu-weber syndrome 1) (ENG, Accession NM_000118.1). Accordingly, utilities of GAM75 include diagnosis, prevention and treatment of diseases and clinical conditions associated with ENG.

FLJ14936 (Accession NM_032864.2) is another GAM75 target gene, herein designated TARGET GENE. FLJ14936 BINDING SITE is a target binding site found in the 3' untranslated region of multiple transcripts of mRNA encoded by FLJ14936, corresponding to a target binding site such as BINDING SITE I, BINDING SITE II or BINDING SITE III of FIG. 8. Table 4 illustrates the complementarity of the nucleotide sequences of FLJ14936 BINDING SITE, designated SEQ ID:2656, to the nucleotide sequence of GAM75 RNA, herein designated GAM RNA, also designated SEQ ID:210.

Another function of GAM75 is therefore inhibition of FLJ14936 (Accession NM_032864.2). Accordingly, utilities of GAM75 include diagnosis, prevention and treatment of diseases and clinical conditions associated with FLJ14936.

FLJ32332 (Accession NM_144641.1) is another GAM75 target gene, herein designated TARGET GENE. FLJ32332 BINDING SITE is a target binding site found in the 3' untranslated region of mRNA encoded by FLJ32332, corresponding to a target binding site such as BINDING SITE I, BINDING SITE II or BINDING SITE III of FIG. 8. Table 4 illustrates the complementarity of the nucleotide sequences of FLJ32332 BINDING SITE, designated SEQ ID:16169, to the nucleotide sequence of GAM75 RNA, herein designated GAM RNA, also designated SEQ ID:210.

Another function of GAM75 is therefore inhibition of FLJ32332 (Accession NM_144641.1). Accordingly, utilities of GAM75 include diagnosis, prevention and treatment of diseases and clinical conditions associated with FLJ32332.

Glucokinase (hexokinase 4, maturity onset diabetes of the young 2) (GCK, Accession NM_000162.2) is another GAM75 target gene, herein designated TARGET GENE. GCK BINDING SITE is a target binding site found in the 3' untranslated region of multiple transcripts of mRNA encoded by GCK, corresponding to a target binding site such as BINDING SITE I, BINDING SITE II or BINDING SITE III of FIG. 8. Table 4 illustrates the complementarity of the nucleotide sequences of GCK BINDING SITE, designated SEQ ID:4463, to the nucleotide sequence of GAM75 RNA, herein designated GAM RNA, also designated SEQ ID:210.

Another function of GAM75 is therefore inhibition of Glucokinase (hexokinase 4, maturity onset diabetes of the young 2) (GCK, Accession NM_000162.2), a gene which catalyzes the initial step in utilization of glucose by the beta-cell and liver at physiological glucose concentration. Accordingly, utilities of GAM75 include diagnosis, prevention and treatment of diseases and clinical conditions associated with GCK.

The function of GCK has been established by previous studies. B lymphocytes that reside in the germinal center of lymphoid follicles are functionally and phenotypically distinct from those residing in the surrounding mantle zone. Various regulatory and structural genes control a complex series of differentiation and selection steps through which B cells that exit the germinal center of lymphoid follicles must pass. In differential hybridization studies to identify some of these genes, Katz et al. (1994) isolated a novel gene based on its preferential expression in tonsillar germinal center B lymphocytes. The complete nucleotide sequence predicted a 819-amino acid protein, named GC (for 'germinal center') kinase, with homology to serine-threonine protein kinases. Its catalytic domain was 39% and 37% identical to those of S. cerevisiae STE20 and Drosophila NinaC proteins, respectively. Northern blot analysis revealed expression of a 2.9-kb mRNA in several human tissues, including brain, lung, and placenta. In situ hybridization of tonsil tissue demonstrated preferential hybridization to the germinal center region. The expressed protein phosphorylated casein and myelin basic protein in in vitro kinase assays. Pombo et al. (1995) showed that GC kinase, or GCK, specifically activates the SAPK (OMIM Ref. No. 601335) pathway. They also showed that GCK is activated in situ by TNF-alpha (OMIM Ref. No. 191160), a potent SAPK agonist. The authors suggested that the SAPK pathway may be active in the differentiation and selection of B cells in the germinal center Full details of the abovementioned studies are described in the following publications, the disclosure of which are hereby incorporated by reference:

Katz, P.; Whalen, G.; Kehrl, J. H.: Differential expression of a novel protein kinase in human B lymphocytes: preferential localization in the germinal center. J. Biol. Chem. 269: 16802-16809, 1994; and Ren, M.; Zeng, J.; De Lemos-Chiarandini, C.; Rosenfeld, M.; Adesnik, M.; Sabatini, D. D.: In its active form, the GTP-binding protein rab8 interacts with a stress-activated protein kina.

Further studies establishing the function and utilities of GCK are found in John Hopkins OMIM database record ID 603166, and in cited publications listed in Table 5, which are hereby incorporated by reference. Golgi reassembly stacking protein 1, 65 kda (GORASP1, Accession NM_031899.2) is another GAM75 target gene, herein designated TARGET GENE. GORASP1 BINDING SITE is a target binding site found in the 3' untranslated region of mRNA encoded by GORASP1, corresponding to a target binding site such as BINDING SITE I, BINDING SITE II or BINDING SITE III of FIG. 8. Table 4 illustrates the complementarity of the nucleotide sequences of GORASP1 BINDING SITE, designated SEQ ID:17619, to the nucleotide sequence of GAM75 RNA, herein designated GAM RNA, also designated SEQ ID:210.

Another function of GAM75 is therefore inhibition of Golgi reassembly stacking protein 1, 65 kda (GORASP1, Accession NM_031899.2), a gene which has some funtion with the Golgi apparatus. Accordingly, utilities of GAM75 include diagnosis, prevention and treatment of diseases and clinical conditions associated with GORASP1.

The function of GORASP1 has been established by previous studies. Barr et al. (1998) determined that GOLPH5 interacts with GM130 (OMIM Ref. No. 602580), a Golgi matrix protein, in detergent extracts of rat liver Golgi membranes. They further determined that this complex can bind to the vesicle docking protein p115 (OMIM Ref. No. 603344). Using in vitro translation and site-directed mutagenesis in conjunction with immunoprecipitation, Barr et al. (1998) localized the critical interacting domains to the C terminus of GM130 and the PDZ-like domain of GOLPH5. Interaction was also found to be critical for the correct targeting of both proteins to the Golgi apparatus. Sutterlin et al. (2002) found that addition of an antibody to the Golgi-associated protein GRASP65 inhibited Golgi fragmentation by mitotic cytosol in permeabilized cells. Microinjecting this antibody or a C-terminal fragment of GRASP65 containing the antibody-binding site into normal rat kidney cells prevented entry into mitosis. Under these conditions the cells had completed S phase but were not in the prophase stage of mitosis. Fragmentation of the Golgi apparatus by nocodazole or brefeldin A treatment prior to or after microinjection of the anti-GRASP65 antibody alleviated the block in mitotic entry. These data suggested that pericentriolar Golgi organization is a sensor for controlling entry into mitosis in mammalian cells.

Full details of the abovementioned studies are described in the following publications, the disclosure of which are hereby incorporated by reference:

Barr, F. A.; Nakamura, N.; Warren, G.: Mapping the interaction between GRASP65 and GM130, components of a protein complex involved in the stacking of Golgi cisternae. EMBO J. 17:3258-3268, 1998; and Sutterlin, C.; Hsu, P.; Mallabiabarrena, A.; Malhotra, V.: Fragmentation and dispersal of the pericentriolar Golgi complex is required for entry into mitosis in mammalian cells. Cell 1.

Further studies establishing the function and utilities of GORASP1 are found in John Hopkins OMIM database record ID 606867, and in cited publications listed in Table 5, which are hereby incorporated by reference. LANP-L (Accession) is another GAM75 target gene, herein designated TARGET GENE. LANP-L BINDING SITE is a target binding site found in the 5' untranslated region of mRNA encoded by LANP-L, corresponding to a target binding site such as BINDING SITE I, BINDING SITE II or BINDING SITE III of FIG. 8. Table 4 illustrates the complementarity of the nucleotide sequences of LANP-L BINDING SITE, designated SEQ ID:11358, to the nucleotide sequence of GAM75 RNA, herein designated GAM RNA, also designated SEQ ID:210.

Another function of GAM75 is therefore inhibition of LANP-L (Accession) . Accordingly, utilities of GAM75 include diagnosis, prevention and treatment of diseases and clinical conditions associated with LANP-L.

LOC143098 (Accession) is another GAM75 target gene, herein designated TARGET GENE. LOC143098 BINDING SITE is a target binding site found in the 5' untranslated region of mRNA encoded by LOC143098, corresponding to a target binding site such as BINDING SITE I, BINDING SITE II or BINDING SITE III of FIG. 8. Table 4 illustrates the complementarity of the nucleotide sequences of LOC143098 BINDING SITE, designated SEQ ID:1402, to the nucleotide sequence of GAM75 RNA, herein designated GAM RNA, also designated SEQ ID:210.

Another function of GAM75 is therefore inhibition of LOC143098 (Accession). Accordingly, utilities of GAM75 include diagnosis, prevention and treatment of diseases and clinical conditions associated with LOC143098.

LOC145988 (Accession XM_085290.7) is another GAM75 target gene, herein designated TARGET GENE. LOC145988 BINDING SITE is a target binding site found in the 5' untranslated region of mRNA encoded by LOC145988, corresponding to a target binding site such as BINDING SITE I, BINDING SITE II or BINDING SITE III of FIG. 8. Table 4 illustrates the complementarity of the nucleotide sequences of LOC145988 BINDING SITE, designated SEQ ID:14081, to the nucleotide sequence of GAM75 RNA, herein designated GAM RNA, also designated SEQ ID:210.

Another function of GAM75 is therefore inhibition of LOC145988 (Accession XM_085290.7). Accordingly, utilities of GAM75 include diagnosis, prevention and treatment of diseases and clinical conditions associated with LOC145988.

LOC199936 (Accession) is another GAM75 target gene, herein designated TARGET GENE. LOC199936 BINDING SITE is a target binding site found in the 3' untranslated region of mRNA encoded by LOC199936, corresponding to a target binding site such as BINDING SITE I, BINDING SITE II or BINDING SITE III of FIG. 8. Table 4 illustrates the complementarity of the nucleotide sequences of LOC199936 BINDING SITE, designated SEQ ID:13578, to the nucleotide sequence of GAM75 RNA, herein designated GAM RNA, also designated SEQ ID:210.

Another function of GAM75 is therefore inhibition of LOC199936 (Accession). Accordingly, utilities of GAM75 include diagnosis, prevention and treatment of diseases and clinical conditions associated with LOC199936.

LOC221583 (Accession) is another GAM75 target gene, herein designated TARGET GENE. LOC221583 BINDING SITE is a target binding site found in the 5' untranslated region of mRNA encoded by LOC221583, corresponding to a target binding site such as BINDING SITE I, BINDING SITE II or BINDING SITE III of FIG. 8. Table 4 illustrates the complementarity of the nucleotide sequences of LOC221583 BINDING SITE, designated SEQ ID:3621, to the nucleotide sequence of GAM75 RNA, herein designated GAM RNA, also designated SEQ ID:210.

Another function of GAM75 is therefore inhibition of LOC221583 (Accession). Accordingly, utilities of GAM75 include diagnosis, prevention and treatment of diseases and clinical conditions associated with LOC221583.

LOC256310 (Accession) is another GAM75 target gene, herein designated TARGET GENE. LOC256310 BINDING SITE is a target binding site found in the 3' untranslated region of mRNA encoded by LOC256310, corresponding to a target binding site such as BINDING SITE I, BINDING SITE II or BINDING SITE III of FIG. 8. Table 4 illustrates the complementarity of the nucleotide sequences of LOC256310 BINDING SITE, designated SEQ ID:5809, to the nucleotide sequence of GAM75 RNA, herein designated GAM RNA, also designated SEQ ID:210.

Another function of GAM75 is therefore inhibition of LOC256310 (Accession). Accordingly, utilities of GAM75 include diagnosis, prevention and treatment of diseases and clinical conditions associated with LOC256310.

LOC93349 (Accession NM_138402.2) is another GAM75 target gene, herein designated TARGET GENE. LOC93349 BINDING SITE is a target binding site found in the 3' untranslated region of mRNA encoded by LOC93349, corresponding to a target binding site such as BINDING SITE I, BINDING SITE II or BINDING SITE III of FIG. 8. Table 4 illustrates the complementarity of the nucleotide sequences of LOC93349 BINDING SITE, designated SEQ ID:4761, to the nucleotide sequence of GAM75 RNA, herein designated GAM RNA, also designated SEQ ID:210.

Another function of GAM75 is therefore inhibition of LOC93349 (Accession NM_138402.2). Accordingly, utilities of GAM75 include diagnosis, prevention and treatment of diseases and clinical conditions associated with LOC93349.

Matrix metalloproteinase 13 (collagenase 3) (MMP13, Accession NM_002427.2) is another GAM75 target gene, herein designated TARGET GENE. MMP13 BINDING SITE is a target binding site found in the 3' untranslated region of mRNA encoded by MMP13, corresponding to a target binding site such as BINDING SITE I, BINDING SITE II or BINDING SITE III of FIG. 8. Table 4 illustrates the complementarity of the nucleotide sequences of MMP13 BINDING SITE, designated SEQ ID:15931, to the nucleotide sequence of GAM75 RNA, herein designated GAM RNA, also designated SEQ ID:210.

Another function of GAM75 is therefore inhibition of Matrix metalloproteinase 13 (collagenase 3) (MMP13, Accession NM_002427.2). Accordingly, utilities of GAM75 include diagnosis, prevention and treatment of diseases and clinical conditions associated with MMP13.

Oxysterol binding protein-like 5 (OSBPL5, Accession NM_145638.1) is another GAM75 target gene, herein designated TARGET GENE. OSBPL5 BINDING SITE is a target binding site found in the 3' untranslated region of multiple transcripts of mRNA encoded by OSBPL5, corresponding to a target binding site such as BINDING SITE I, BINDING SITE II or BINDING SITE III of FIG. 8. Table 4 illustrates the complementarity of the nucleotide sequences of OSBPL5 BINDING SITE, designated SEQ ID:10114, to the nucleotide sequence of GAM75 RNA, herein designated GAM RNA, also designated SEQ ID:210.

Another function of GAM75 is therefore inhibition of Oxysterol binding protein-like 5 (OSBPL5, Accession NM_145638.1). Accordingly, utilities of GAM75 include diagnosis, prevention and treatment of diseases and clinical conditions associated with OSBPL5.

Rad52 homolog (s. cerevisiae) (RAD52, Accession NM_002879.2) is another GAM75 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52 BINDING SITE, designated SEQ ID:8804, to the nucleotide sequence of GAM75 RNA, herein GAM RNA, also designated SEQ ID:210.

Another function of GAM75 is therefore inhibition of Rad52 homolog (s. cerevisiae) (RAD52, Accession NM_002879.2). Accordingly, utilities of GAM75 include diagnosis, prevention and treatment of diseases and clinical conditions associated with RAD52.

FIG. 8 further provides a conceptual description of a novel bioinformatically detected of the present invention, referred to here as Genomic Address Messenger 76 (GAM76), which modulates expression of respective target genes thereof, the function and utility of which target genes is known in the art.

GAM76 is a novel bioinformatically detected regulatory, non protein coding, micro RNA (miRNA) gene. The method by which GAM76 was detected is described hereinabove with reference to FIGS. 8-15.

GAM76 gene, herein designated GAM GENE, and GAM76 target gene, herein designated TARGET GENE, are human genes contained in the human genome.

GAM76 gene encodes a GAM76 precursor RNA, herein designated GAM PRECURSOR RNA. Similar to other miRNA genes, and unlike most ordinary genes, GAM76 precursor RNA does not encode a protein. A nucleotide sequence identical or highly similar to the nucleotide sequence of GAM76 precursor RNA is designated SEQ ID:129, and is provided hereinbelow with reference to the sequence listing part.

GAM76 precursor RNA folds onto itself, forming GAM76 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM76 precursor RNA folds onto itself, forming GAM76 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM76 precursor RNA, designated SEQ-ID:129, and a schematic representation of a predicted secondary folding of GAM76 folded precursor RNA are further described with reference to Table 2, hereby incorporated by reference.

An enzyme complex designated DICER COMPLEX, 'dices' the GAM76 folded precursor RNA into GAM76 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM76 RNA is designated SEQ ID:292, and is provided hereinbelow with references to the sequence listing part and Table 3, hereby incorporated by reference.

GAM76 target gene, herein designated TARGET GENE, encodes a corresponding messenger RNA, GAM76 target RNA, herein designated GAM TARGET RNA. GAM76 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM76 RNA, herein designated GAM RNA, binds complementarily to one or more target binding sites located in untranslated regions of GAM76 target RNA, herein designated GAM TARGET RNA. This complementary binding is due to the fact that the nucleotide sequence of GAM76 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM76 RNA may have a different number of target binding sites in untranslated regions of a GAM76 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM76 RNA, herein designated GAM RNA, to target binding sites on GAM76 target RNA, herein designated GAM TARGET RNA, such as BINDING SITE I, BINDING SITE II and BINDING SITE III, inhibits translation of GAM76 target RNA into GAM76 target protein, herein designated GAM TARGET PROTEIN. GAM target protein is therefore outlined by a broken line.

It is appreciated that GAM76 target gene, herein designated TARGET GENE, in fact represents a plurality of GAM76 target genes. The mRNA of each one of this plurality of GAM76 target genes comprises one or more target binding sites, each having a nucleotide sequence which is at least partly complementary to GAM76 RNA, herein designated GAM RNA, and which when bound by GAM76 RNA causes inhibition of translation of respective one or more GAM76 target proteins.

It is further appreciated by one skilled in the art that the mode of translational inhibition illustrated by FIG. 8 with specific reference to translational inhibition exerted by GAM76 gene, herein designated GAM GENE, on one or more GAM76 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM76 correlate with, and may be deduced from, the identity of the target genes which GAM76 binds and inhibits, and the function of these target genes, as elaborated hereinbelow.

Rho guanine nucleotide exchange factor (gef) 5 (ARHGEF5, Accession NM_005435.2) is a GAM76 target gene, herein designated TARGET GENE. ARHGEF5 BINDING SITE is a target binding site found in the 3' untranslated region of mRNA encoded by ARHGEF5, corresponding to a target binding site such as BINDING SITE I, BINDING SITE II or BINDING SITE III of FIG. 8. Table 4 illustrates the complementarity of the nucleotide sequences of ARHGEF5 BINDING SITE, designated SEQ ID:1425, to the nucleotide sequence of GAM76 RNA, herein designated GAM RNA, also designated SEQ ID:292.

A function of GAM76 is therefore inhibition of Rho guanine nucleotide exchange factor (gef) 5 (ARHGEF5, Accession NM_005435.2), a gene which may form complex with G proteins and stimulate Rho-dependent signals. Accordingly, utilities of GAM76 include diagnosis, prevention and treatment of diseases and clinical conditions associated with ARHGEF5.

The function of ARHGEF5 has been established by previous studies. Chan et al. (1994) isolated the TIM oncogene by an expression cloning strategy (Miki et al., 1991) as a cDNA clone with transforming activity in NIH/3T3 fibroblasts. The 2.3-kb TIM cDNA encodes a predicted protein of 60-kD containing a Dbl-homology (DH) domain. The DH motif is shared by several signal transducing molecules that are implicated as regulators of small GTP-binding proteins. Therefore, the TIM oncogene is also thought to be involved in the control of cytoskeletal organization through regulation of small GTP-binding proteins. Using human/hamster somatic cell hybrids, Chan et al. (1994) mapped the TIM gene to chromosome 7. By fluorescence in situ hybridization, Takai et al. (1995) localized the gene to 7q33-q35.

Full details of the abovementioned studies are described in the following publications, the disclosure of which are hereby incorporated by reference:

Chan, A. M-L.; McGovern, E. S.; Catalano, G.; Fleming, T. P.; Miki, T.: Expression cDNA cloning of a novel oncogene with sequence similarity to regulators of small GTP- binding proteins. Oncogene 9:1057-1063, 1994; and Miki, T.; Fleming, T. P.; Crescenzi, M.; Molloy, C. J.; Blam, S. B.; Reynolds, S. H.; Aaronson, S. A.: Development of a highly efficient expression cDNA cloning system: application to.

Further studies establishing the function and utilities of ARHGEF5 are found in John Hopkins OMIM database record ID 600888, and in cited publications listed in Table 5, which are hereby incorporated by reference. Cholinergic receptor, nicotinic, beta polypeptide 4 (CHRNB4, Accession NM_000750.1) is another GAM76 target gene, herein designated TARGET GENE. CHRNB4 BINDING SITE is a target binding site found in the 5' untranslated region of mRNA encoded by CHRNB4, corresponding to a target binding site such as BINDING SITE I, BINDING SITE II or BINDING SITE III of FIG. 8. Table 4 illustrates the complementarity of the nucleotide sequences of CHRNB4 BINDING SITE, designated SEQ ID:13256, to the nucleotide sequence of GAM76 RNA, herein designated GAM RNA, also designated SEQ ID:292.

Another function of GAM76 is therefore inhibition of Cholinergic receptor, nicotinic, beta polypeptide 4 (CHRNB4, Accession NM_000750.1), a gene which mediates fast signal transmission at synapses. Accordingly, utilities of GAM76 include diagnosis, prevention and treatment of diseases and clinical conditions associated with CHRNB4.

The function of CHRNB4 has been established by previous studies. Transmitter- gated cation channels are detectors of excitatory chemical signals at synapses in the nervous system. Khakh et al. (2000) showed that structurally distinct alpha-3-beta-4 nicotinic and P2X(2) (OMIM Ref. No. 600844) channels influence each other when coactivated. The activation of one channel type affects distinct kinetic and conductance states of the other, and coactivation results in nonadditive responses owing to inhibition of both channel types. State-dependent inhibition of nicotinic channels was revealed most clearly with mutant P2X(2) channels, and inhibition was decreased at lower densities of channel expression. In synaptically coupled myenteric neurons, nicotinic fast excitatory postsynaptic currents were occluded during activation of endogenously coexpressed P2X channels. Khakh et al. (2000) concluded that their data provide a molecular basis and a synaptic context for cross-inhibition between transmitter-gated channels. Transmitter-gated cation channels are detectors of excitatory chemical signals at synapses in the nervous system. Khakh et al. (2000) showed that structurally distinct alpha-3-beta-4 nicotinic and P2X(2) (OMIM Ref. No. 600844) channels influence each other when coactivated. The activation of one channel type affects distinct kinetic and conductance states of the other, and coactivation results in nonadditive responses owing to inhibition of both channel types. State-dependent inhibition of nicotinic channels was revealed most clearly with mutant P2X(2) channels, and inhibition was decreased at lower densities of channel expression. In synaptically coupled myenteric neurons, nicotinic fast excitatory postsynaptic currents were occluded during activation of endogenously coexpressed P2X channels. Khakh et al. (2000) concluded that their data provide a molecular basis and a synaptic context for cross-inhibition between transmitter-gated channels Full details of the abovementioned studies are described in the following publications, the disclosure of which are hereby incorporated by reference:

Khakh, B. S.; Zhou, X.; Sydes, J.; Galligan, J. J.; Lester, H. A.: State-dependent cross-inhibition between transmitter-gated cation channels. Nature 406:405-410, 2000; and Tarroni, P.; Rubboli, F.; Chini, B.; Zwart, R.; Oortgiesen, M.; Sher, E.; Clementi, F.: Neuronal-type nicotinic receptors in human neuroblastoma and small-cell lung carcinoma cell line.

Further studies establishing the function and utilities of CHRNB4 are found in John Hopkins OMIM database record ID 118509, and in cited publications listed in Table 5, which are hereby incorporated by reference. FLJ10450 (Accession NM_018095.2) is another GAM76 target gene, herein designated TARGET GENE. FLJ10450 BINDING SITE is a target binding site found in the 5' untranslated region of mRNA encoded by FLJ10450, corresponding to a target binding site such as BINDING SITE I, BINDING SITE II or BINDING SITE III of FIG. 8. Table 4 illustrates the complementarity of the nucleotide sequences of FLJ10450 BINDING SITE, designated SEQ ID:15495, to the nucleotide sequence of GAM76 RNA, herein designated GAM RNA, also designated SEQ ID:292.

Another function of GAM76 is therefore inhibition of FLJ10450 (Accession NM_018095.2). Accordingly, utilities of GAM76 include diagnosis, prevention and treatment of diseases and clinical conditions associated with FLJ10450.

FLJ21977 (Accession NM_032213.2) is another GAM76 target gene, herein designated TARGET GENE. FLJ21977 BINDING SITE is a target binding site found in the 3' untranslated region of mRNA encoded by FLJ21977, corresponding to a target binding site such as BINDING SITE I, BINDING SITE II or BINDING SITE III of FIG. 8. Table 4 illustrates the complementarity of the nucleotide sequences of FLJ21977 BINDING SITE, designated SEQ ID:15840, to the nucleotide sequence of GAM76 RNA, herein designated GAM RNA, also designated SEQ ID:292.

Another function of GAM76 is therefore inhibition of FLJ21977 (Accession NM_032213.2). Accordingly, utilities of GAM76 include diagnosis, prevention and treatment of diseases and clinical conditions associated with FLJ21977.

Huntingtin (huntington disease) (HD, Accession NM_002111.3) is another GAM76 target gene, herein designated TARGET GENE. HD BINDING SITE is a target binding site found in the 5' untranslated region of mRNA encoded by HD, corresponding to a target binding site such as BINDING SITE I, BINDING SITE II or BINDING SITE III of FIG. 8. Table 4 illustrates the complementarity of the nucleotide sequences of HD BINDING SITE, designated SEQ ID:4994, to the nucleotide sequence of GAM76 RNA, herein designated GAM RNA, also designated SEQ ID:292.

Another function of GAM76 is therefore inhibition of Huntingtin (huntington disease) (HD, Accession NM_002111.3). Accordingly, utilities of GAM76 include diagnosis, prevention and treatment of diseases and clinical conditions associated with HD.

KIAA0513 (Accession NM_014732.1) is another GAM76 target gene, herein designated TARGET GENE. KIAA0513 BINDING SITE is a target binding site found in the 3' untranslated region of mRNA encoded by KIAA0513, corresponding to a target binding site such as BINDING SITE I, BINDING SITE II or BINDING SITE III of FIG. 8. Table 4 illustrates the complementarity of the nucleotide sequences of KIAA0513 BINDING SITE, designated SEQ ID:7751, to the nucleotide sequence of GAM76 RNA, herein designated GAM RNA, also designated SEQ ID:292.

Another function of GAM76 is therefore inhibition of KIAA0513 (Accession NM_014732.1). Accordingly, utilities of GAM76 include diagnosis, prevention and treatment of diseases and clinical conditions associated with KIAA0513.

KIAA1328 (Accession XM_029429.5) is another GAM76 target gene, herein designated TARGET GENE. KIAA1328 BINDING SITE is a target binding site found in the 3' untranslated region of mRNA encoded by KIAA1328, corresponding to a target binding site such as BINDING SITE I, BINDING SITE II or BINDING SITE III of FIG. 8. Table 4 illustrates the complementarity of the nucleotide sequences of KIAA1328 BINDING SITE, designated SEQ ID:9539, to the nucleotide sequence of GAM76 RNA, herein designated GAM RNA, also designated SEQ ID:292.

Another function of GAM76 is therefore inhibition of KIAA1328 (Accession XM_029429.5). Accordingly, utilities of GAM76 include diagnosis, prevention and treatment of diseases and clinical conditions associated with KIAA1328.

LOC144305 (Accession) is another GAM76 target gene, herein designated TARGET GENE. LOC144305 BINDING SITE is a target binding site found in the 3' untranslated region of mRNA encoded by LOC144305, corresponding to a target binding site such as BINDING SITE I, BINDING SITE II or BINDING SITE III of FIG. 8. Table 4 illustrates the complementarity of the nucleotide sequences of LOC144305 BINDING SITE, designated SEQ ID:17369, to the nucleotide sequence of GAM76 RNA, herein designated GAM RNA, also designated SEQ ID:292.

Another function of GAM76 is therefore inhibition of LOC144305 (Accession). Accordingly, utilities of GAM76 include diagnosis, prevention and treatment of diseases and clinical conditions associated with LOC144305.

LOC146310 (Accession NM_174903.1) is another GAM76 target gene, herein designated TARGET GENE. LOC146310 BINDING SITE is a target binding site found in the 5' untranslated region of mRNA encoded by LOC146310, corresponding to a target binding site such as BINDING SITE I, BINDING SITE II or BINDING SITE III of FIG. 8. Table 4 illustrates the complementarity of the nucleotide sequences of LOC146310 BINDING SITE, designated SEQ ID:16285, to the nucleotide sequence of GAM76 RNA, herein designated GAM RNA, also designated SEQ ID:292.

Another function of GAM76 is therefore inhibition of LOC146310 (Accession NM_174903.1). Accordingly, utilities of GAM76 include diagnosis, prevention and treatment of diseases and clinical conditions associated with LOC146310.

LOC148223 (Accession) is another GAM76 target gene, herein designated TARGET GENE. LOC148223 BINDING SITE is a target binding site found in the 3' untranslated region of mRNA encoded by LOC148223, corresponding to a target binding site such as BINDING SITE I, BINDING SITE II or BINDING SITE III of FIG. 8. Table 4 illustrates the complementarity of the nucleotide sequences of LOC148223 BINDING SITE, designated SEQ ID:12443, to the nucleotide sequence of GAM76 RNA, herein designated GAM RNA, also designated SEQ ID:292.

Another function of GAM76 is therefore inhibition of LOC148223 (Accession). Accordingly, utilities of GAM76 include diagnosis, prevention and treatment of diseases and clinical conditions associated with LOC148223.

LOC162417 (Accession) is another GAM76 target gene, herein designated TARGET GENE. LOC162417 BINDING SITE is a target binding site found in the 3' untranslated region of mRNA encoded by LOC162417, corresponding to a target binding site such as BINDING SITE I, BINDING SITE II or BINDING SITE III of FIG. 8. Table 4 illustrates the complementarity of the nucleotide sequences of LOC162417 BINDING SITE, designated SEQ ID:9518, to the nucleotide sequence of GAM76 RNA, herein designated GAM RNA, also designated SEQ ID:292.

Another function of GAM76 is therefore inhibition of LOC162417 (Accession). Accordingly, utilities of GAM76 include diagnosis, prevention and treatment of diseases and clinical conditions associated with LOC162417.

LOC220565 (Accession) is another GAM76 target gene, herein designated TARGET GENE. LOC220565 BINDING SITE is a target binding site found in the 5' untranslated region of mRNA encoded by LOC220565, corresponding to a target binding site such as BINDING SITE I, BINDING SITE II or BINDING SITE III of FIG. 8. Table 4 illustrates the complementarity of the nucleotide sequences of LOC220565 BINDING SITE, designated SEQ ID:18814, to the nucleotide sequence of GAM76 RNA, herein designated GAM RNA, also designated SEQ ID:292.

Another function of GAM76 is therefore inhibition of LOC220565 (Accession). Accordingly, utilities of GAM76 include diagnosis, prevention and treatment of diseases and clinical conditions associated with LOC220565.

LOC254778 (Accession) is another GAM76 target gene, herein designated TARGET GENE. LOC254778 BINDING SITE is a target binding site found in the 3' untranslated region of mRNA encoded by LOC254778, corresponding to a target binding site such as BINDING SITE I, BINDING SITE II or BINDING SITE III of FIG. 8. Table 4 illustrates the complementarity of the nucleotide sequences of LOC254778 BINDING SITE, designated SEQ ID:18587, to the nucleotide sequence of GAM76 RNA, herein designated GAM RNA, also designated SEQ ID:292.

Another function of GAM76 is therefore inhibition of LOC254778 (Accession). Accordingly, utilities of GAM76 include diagnosis, prevention and treatment of diseases and clinical conditions associated with LOC254778.

Lysophospholipase ii (LYPLA2, Accession NM_007260.2) is another GAM76 target gene, herein designated TARGET GENE. LYPLA2 BINDING SITE is a target binding site found in the 3' untranslated region of mRNA encoded by LYPLA2, corresponding to a target binding site such as BINDING SITE I, BINDING SITE II or BINDING SITE III of FIG. 8. Table 4 illustrates the complementarity of the nucleotide sequences of LYPLA2 BINDING SITE, designated SEQ ID:2075, to the nucleotide sequence of GAM76 RNA, herein designated GAM RNA, also designated SEQ ID:292.

Another function of GAM76 is therefore inhibition of Lysophospholipase ii (LYPLA2, Accession NM_007260.2). Accordingly, utilities of GAM76 include diagnosis, prevention and treatment of diseases and clinical conditions associated with LYPLA2.

Proteinase 3 (serine proteinase, neutrophil, wegener granulomatosis autoantigen) (PRTN3, Accession NM_002777.2) is another GAM76 target gene, herein designated TARGET GENE. PRTN3 BINDING SITE is a target binding site found in the 5' untranslated region of mRNA encoded by PRTN3, corresponding to a target binding site such as BINDING SITE I, BINDING SITE II or BINDING SITE III of FIG. 8. Table 4 illustrates the complementarity of the nucleotide sequences of PRTN3 BINDING SITE, designated SEQ ID:15181, to the nucleotide sequence of GAM76 RNA, herein designated GAM RNA, also designated SEQ ID:292.

Another function of GAM76 is therefore inhibition of Proteinase 3 (serine proteinase, neutrophil, wegener granulomatosis autoantigen) (PRTN3, Accession NM_002777.2), a gene which is a neutrophil serine protease. and therefore may be associated with Wegener granulomatosis. Accordingly, utilities of GAM76 include diagnosis, prevention and treatment of Wegener granulomatosis, and of other diseases and clinical conditions associated with PRTN3.

The function of PRTN3 has been established by previous studies. Wegener granulomatosis is a disease of unknown cause and pathogenesis. Its major features are necrotizing granulomatous lesions, which most often affect the upper and lower airways and are associated with vasculitis, necrotizing glomerulonephritis, and pulmonary capillaritis. It is a devastating illness; without immunosuppressive therapy, over 80% of patients die within 1 year, often because of rapid loss of renal function or massive pulmonary hemorrhage. Definitive diagnosis hitherto depended on demonstration of characteristic histologic findings. Beginning with the report of Davies et al. (1982), detection of antineutrophil antibodies provided an immunologic diagnosis. Niles et al. (1989) demonstrated that the circulating IgG autoantibodies that produced a cytoplasmic pattern of staining in neutrophils from 10 patients with Wegener granulomatosis reacted, in Western blot analysis, with a 29-kD neutrophil protein (P29), which has the characteristics of a distinctive serine proteinase. Ludemann et al. (1990) showed further that the antigen is a neutral serine protease that is able to cleave elastin and that it is identical to proteinase-3. The neutral serine protease called proteinase-3 (PR3) was isolated, identified, and characterized from polymorphonuclear leukocytes by Kao et al. (1988). They showed that PR3 has an ability to induce emphysema in hamsters commensurate with that of leukocyte elastase. Lutz et al. (2000) showed that myeloblastin is expressed specifically in immature myeloid cells, that myeloblastin is a granulocyte colony-stimulating factor (G-CSF)-responsive gene, and that its constitutive overexpression confers factor-independent growth to Ba/F3 cells expressing the G-CFS receptor. Lutz et al. (2000) suggested that their results point to myeloblastin as a G-CSF-responsive gene critical to factor-independent growth and indicate that the expression of the G-CSF receptor is a prerequisite to this process. A 91-bp myeloblastin promoter region containing binding sites for PU.1 (OMIM Ref. No. 165170), C/EBP (OMIM Ref. No. 116897), and c-Myb (OMIM Ref. No. 189990) is responsive to G-CSF treatment. Although PU.1, C/EBP, and c-Myb transcription factors all were critical for expression of myeloblastin, its upregulation by G-CSF was associated mainly with PU.1. Lutz et al. (2000) concluded that myeloblastin is an important target of PU.1 and a key protease for factor-independent growth of hematopoietic cells. Using RT-PCR, immunoblot, and immunofluorescence microscopy analyses, Sugawara et al. (2001) demonstrated that oral epithelial cells express IL18 (OMIM Ref. No. 600953) mRNA and the 24-kD IL18 precursor protein. ELISA analysis showed that stimulation of the cells with PRTN3 and lipopolysaccharide (LPS) after gamma-interferon (IFNG; 147570) priming leads to intracellular production and secretion of the 18-kD bioactive form of IL18 in a caspase-1 (CASP1; 147678)-independent fashion. Cell fractionation and immunoblot analyses indicated that PRTN3 acts on the cell surface after the IFNG priming, not intracellularly. Sugawara et al. (2001) proposed that PRTN3 together with LPS and IFNG may be involved in mucosal inflammation, such as periodontitis.

Full details of the abovementioned studies are described in the following publications, the disclosure of which are hereby incorporated by reference:

Sugawara, S.; Uehara, A.; Nochi, T.; Yamaguchi, T.; Ueda, H.; Sugiyama, A.; Hanzawa, K.; Kumagai, K.; Okamura, H.; Takada, H.: Neutrophil proteinase 3-mediated induction of bioactive IL-18 secretion by human oral epithelial cells. J. Immun. 167:6568-6575, 2001; and Sturrock, A. B.; Espinosa, R., III; Hoidal, J. R.; Le Beau, M. M.: Localization of the gene encoding proteinase-3 (the Wegener's granulomatosis autoantigen) to human chromosome band 1.

Further studies establishing the function and utilities of PRTN3 are found in John Hopkins OMIM database record ID 177020, and in cited publications listed in Table 5, which are hereby incorporated by reference. SC65 (Accession NM_006455.1) is another GAM76 target gene, herein designated TARGET GENE. SC65 BINDING SITE is a target binding site found in the 3' untranslated region of mRNA encoded by SC65, corresponding to a target binding site such as BINDING SITE I, BINDING SITE II or BINDING SITE III of FIG. 8. Table 4 illustrates the complementarity of the nucleotide sequences of SC65 BINDING SITE, designated SEQ ID:6668, to the nucleotide sequence of GAM76 RNA, herein designated GAM RNA, also designated SEQ ID:292.

Another function of GAM76 is therefore inhibition of SC65 (Accession NM_006455.1). Accordingly, utilities of GAM76 include diagnosis, prevention and treatment of diseases and clinical conditions associated with SC65.

Smoothelin (SMTN, Accession NM_134269.1) is another GAM76 target gene, herein designated TARGET GENE. SMTN BINDING SITE is a target binding site found in the 3' untranslated region of multiple transcripts of mRNA encoded by SMTN, corresponding to a target binding site such as BINDING SITE I, BINDING SITE II or BINDING SITE III of FIG. 8. Table 4 illustrates the complementarity of the nucleotide sequences of SMTN BINDING SITE, designated SEQ ID:16350, to the nucleotide sequence of GAM76 RNA, herein designated GAM RNA, also designated SEQ ID:292.

Another function of GAM76 is therefore inhibition of Smoothelin (SMTN, Accession NM_134269.1), a gene which is a structural protein. Accordingly, utilities of GAM76 include diagnosis, prevention and treatment of diseases and clinical conditions associated with SMTN.

The function of SMTN has been established by previous studies. Van der Loop et al. (1996) used expression cloning to isolate a novel gene whose expression is restricted to smooth muscle cells. This gene, termed smoothelin (SMTN), encodes a 371-amino acid polypeptide. Sequence analysis revealed that the protein contains a 56-amino acid domain with significant homology to a sequence that flanks the actin-binding domains of dystrophin, utrophin, beta-spectrin, and alpha-actinin. Cell fractionation studies suggested to the authors that smoothelin is a part of the cytoskeleton. By Northern blot analysis, van der Loop et al. (1996) showed that the gene is expressed as a 1.5-kb mRNA in several tissues containing smooth muscle, but not in brain, adipose tissue, cardiac muscle, or skeletal muscle. Transfection of the human cDNA into smooth muscle cells or COS-7 cells produced a 59-kD protein that assembled into a filamentous network. Subcellular localization showed that smoothelin is associated with stress fibers. Van der Loop et al. (1996) found that smoothelin is not detected in primary or long-term smooth muscle cell cultures. They also found that transcription of smoothelin is halted in smooth muscle explants.

Full details of the abovementioned studies are described in the following publications, the disclosure of which are hereby incorporated by reference:

van der Loop, F. T. L.; Schaart, G.; Timmer, E. D. J.; Ramaekers, F. C. S.; van Ey, G. J. J. M.: Smoothelin, a novel cytoskeletal protein specific for smooth muscle cells. J. Cell Biol. 134:401-411, 1996; and Engelen, J. J. M.; Esterling, L. E.; Albrechts, J. C. M.; Detera-Wadleigh, S. D.; van Ey, G. J. J. M.: Assignment of the human gene for smoothelin (SMTN) to chromosome 22q12 by fluores.

Further studies establishing the function and utilities of SMTN are found in John Hopkins OMIM database record ID 602127, and in cited publications listed in Table 5, which are hereby incorporated by reference.

FIG. 8 further provides a conceptual description of a novel bioinformatically detected of the present invention, referred to here as Genomic Address Messenger 77 (GAM77), which modulates expression of respective target genes thereof, the function and utility of which target genes is known in the art.

GAM77 is a novel bioinformatically detected regulatory, non protein coding, micro RNA (miRNA) gene. The method by which GAM77 was detected is described hereinabove with reference to FIGS. 8-15.

GAM77 gene, herein designated GAM GENE, and GAM77 target gene, herein designated TARGET GENE, are human genes contained in the human genome.

GAM77 gene encodes a GAM77 precursor RNA, herein designated GAM PRECURSOR RNA. Similar to other miRNA genes, and unlike most ordinary genes, GAM77 precursor RNA does not encode a protein. A nucleotide sequence identical or highly similar to the nucleotide sequence of GAM77 precursor RNA is designated SEQ ID:123, and is provided hereinbelow with reference to the sequence listing part.

GAM77 precursor RNA folds onto itself, forming GAM77 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM77 precursor RNA folds onto itself, forming GAM77 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM77 precursor RNA, designated SEQ-ID:123, and a schematic representation of a predicted secondary folding of GAM77 folded precursor RNA are further described with reference to Table 2, hereby incorporated by reference.

An enzyme complex designated DICER COMPLEX, 'dices' the GAM77 folded precursor RNA into GAM77 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM77 RNA is designated SEQ ID:390, and is provided hereinbelow with references to the sequence listing part and Table 3, hereby incorporated by reference.

GAM77 target gene, herein designated TARGET GENE, encodes a corresponding messenger RNA, GAM77 target RNA, herein designated GAM TARGET RNA. GAM77 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM77 RNA, herein designated GAM RNA, binds complementarily to one or more target binding sites located in untranslated regions of GAM77 target RNA, herein designated GAM TARGET RNA. This complementary binding is due to the fact that the nucleotide sequence of GAM77 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM77 RNA may have a different number of target binding sites in untranslated regions of a GAM77 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM77 RNA, herein designated GAM RNA, to target binding sites on GAM77 target RNA, herein designated GAM TARGET RNA, such as BINDING SITE I, BINDING SITE II and BINDING SITE III, inhibits translation of GAM77 target RNA into GAM77 target protein, herein designated GAM TARGET PROTEIN. GAM target protein is therefore outlined by a broken line.

It is appreciated that GAM77 target gene, herein designated TARGET GENE, in fact represents a plurality of GAM77 target genes. The mRNA of each one of this plurality of GAM77 target genes comprises one or more target binding sites, each having a nucleotide sequence which is at least partly complementary to GAM77 RNA, herein designated GAM RNA, and which when bound by GAM77 RNA causes inhibition of translation of respective one or more GAM77 target proteins.

It is further appreciated by one skilled in the art that the mode of translational inhibition illustrated by FIG. 8 with specific reference to translational inhibition exerted by GAM77 gene, herein designated GAM GENE, on one or more GAM77 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM77 correlate with, and may be deduced from, the identity of the target genes which GAM77 binds and inhibits, and the function of these target genes, as elaborated hereinbelow.

FLJ12595 (Accession NM_024994.1) is a GAM77 target gene, herein designated TARGET GENE. FLJ12595 BINDING SITE is a target binding site found in the 3' untranslated region of mRNA encoded by FLJ12595, corresponding to a target binding site such as BINDING SITE I, BINDING SITE II or BINDING SITE III of FIG. 8. Table 4 illustrates the complementarity of the nucleotide sequences of FLJ12595 BINDING SITE, designated SEQ ID:16765, to the nucleotide sequence of GAM77 RNA, herein designated GAM RNA, also designated SEQ ID:390.

A function of GAM77 is therefore inhibition of FLJ12595 (Accession NM_024994.1). Accordingly, utilities of GAM77 include diagnosis, prevention and treatment of diseases and clinical conditions associated with FLJ12595.

LOC149711 (Accession) is another GAM77 target gene, herein designated TARGET GENE. LOC149711 BINDING SITE is a target binding site found in the 5' untranslated region of mRNA encoded by LOC149711, corresponding to a target binding site such as BINDING SITE I, BINDING SITE II or BINDING SITE III of FIG. 8. Table 4 illustrates the complementarity of the nucleotide sequences of LOC149711 BINDING SITE, designated SEQ ID:17357, to the nucleotide sequence of GAM77 RNA, herein designated GAM RNA, also designated SEQ ID:390.

Another function of GAM77 is therefore inhibition of LOC149711 (Accession). Accordingly, utilities of GAM77 include diagnosis, prevention and treatment of diseases and clinical conditions associated with LOC149711.

Related ras viral (r-ras) oncogene homolog (RRAS, Accession NM_006270.2) is another GAM77 target gene, herein designated TARGET GENE. RRAS BINDING SITE is a target binding site found in the 3' untranslated region of mRNA encoded by RRAS, corresponding to a target binding site such as BINDING SITE I, BINDING SITE II or BINDING SITE III of FIG. 8. Table 4 illustrates the complementarity of the nucleotide sequences of RRAS BINDING SITE, designated SEQ ID:7350, to the nucleotide sequence of GAM77 RNA, herein designated GAM RNA, also designated SEQ ID:390.

Another function of GAM77 is therefore inhibition of Related ras viral (r-ras) oncogene homolog (RRAS, Accession NM_006270.2). Accordingly, utilities of GAM77 include diagnosis, prevention and treatment of diseases and clinical conditions associated with RRAS.

Solute carrier family 26, member 7 (SLC26A7, Accession NM_052832.2) is another GAM77 target gene, herein designated TARGET GENE. SLC26A7 BINDING SITE is a target binding site found in the 3' untranslated region of multiple transcripts of mRNA encoded by SLC26A7, corresponding to a target binding site such as BINDING SITE I, BINDING SITE II or BINDING SITE III of FIG. 8. Table 4 illustrates the complementarity of the nucleotide sequences of SLC26A7 BINDING SITE, designated SEQ ID:8226, to the nucleotide sequence of GAM77 RNA, herein designated GAM RNA, also designated SEQ ID:390.

Another function of GAM77 is therefore inhibition of Solute carrier family 26, member 7 (SLC26A7, Accession NM_052832.2). Accordingly, utilities of GAM77 include diagnosis, prevention and treatment of diseases and clinical conditions associated with SLC26A7.

FIG. 8 further provides a conceptual description of a novel bioinformatically detected of the present invention, referred to here as Genomic Address Messenger 78 (GAM78), which modulates expression of respective target genes thereof, the function and utility of which target genes is known in the art.

GAM78 is a novel bioinformatically detected regulatory, non protein coding, micro RNA (miRNA) gene. The method by which GAM78 was detected is described hereinabove with reference to FIGS. 8-15.

GAM78 gene, herein designated GAM GENE, and GAM78 target gene, herein designated TARGET GENE, are human genes contained in the human genome.

GAM78 gene encodes a GAM78 precursor RNA, herein designated GAM PRECURSOR RNA. Similar to other miRNA genes, and unlike most ordinary genes, GAM78 precursor RNA does not encode a protein. A nucleotide sequence identical or highly similar to the nucleotide sequence of GAM78 precursor RNA is designated SEQ ID:119, and is provided hereinbelow with reference to the sequence listing part.

GAM78 precursor RNA folds onto itself, forming GAM78 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM78 precursor RNA folds onto itself, forming GAM78 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM78 precursor RNA, designated SEQ-ID:119, and a schematic representation of a predicted secondary folding of GAM78 folded precursor RNA are further described with reference to Table 2, hereby incorporated by reference.

An enzyme complex designated DICER COMPLEX, 'dices' the GAM78 folded precursor RNA into GAM78 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM78 RNA is designated SEQ ID:277, and is provided hereinbelow with references to the sequence listing part and Table 3, hereby incorporated by reference.

GAM78 target gene, herein designated TARGET GENE, encodes a corresponding messenger RNA, GAM78 target RNA, herein designated GAM TARGET RNA. GAM78 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM78 RNA, herein designated GAM RNA, binds complementarily to one or more target binding sites located in untranslated regions of GAM78 target RNA, herein designated GAM TARGET RNA. This complementary binding is due to the fact that the nucleotide sequence of GAM78 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM78 RNA may have a different number of target binding sites in untranslated regions of a GAM78 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM78 RNA, herein designated GAM RNA, to target binding sites on GAM78 target RNA, herein designated GAM TARGET RNA, such as BINDING SITE I, BINDING SITE II and BINDING SITE III, inhibits translation of GAM78 target RNA into GAM78 target protein, herein designated GAM TARGET PROTEIN. GAM target protein is therefore outlined by a broken line.

It is appreciated that GAM78 target gene, herein designated TARGET GENE, in fact represents a plurality of GAM78 target genes. The mRNA of each one of this plurality of GAM78 target genes comprises one or more target binding sites, each having a nucleotide sequence which is at least partly complementary to GAM78 RNA, herein designated GAM RNA, and which when bound by GAM78 RNA causes inhibition of translation of respective one or more GAM78 target proteins.

It is further appreciated by one skilled in the art that the mode of translational inhibition illustrated by FIG. 8 with specific reference to translational inhibition exerted by GAM78 gene, herein designated GAM GENE, on one or more GAM78 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM78 correlate with, and may be deduced from, the identity of the target genes which GAM78 binds and inhibits, and the function of these target genes, as elaborated hereinbelow.

Golgi snap receptor complex member 2 (GOSR2, Accession NM_054022.1) is a GAM78 target gene, herein designated TARGET GENE. GOSR2 BINDING SITE is a target binding site found in the 3' untranslated region of multiple transcripts of mRNA encoded by GOSR2, corresponding to a target binding site such as BINDING SITE I, BINDING SITE II or BINDING SITE III of FIG. 8. Table 4 illustrates the complementarity of the nucleotide sequences of GOSR2 BINDING SITE, designated SEQ ID:5872, to the nucleotide sequence of GAM78 RNA, herein designated GAM RNA, also designated SEQ ID:277.

A function of GAM78 is therefore inhibition of Golgi snap receptor complex member 2 (GOSR2, Accession NM_054022.1), a gene which involves in transport of proteins from the cis/medial-golgi to the trans-golgi network. Accordingly, utilities of GAM78 include diagnosis, prevention and treatment of diseases and clinical conditions associated with GOSR2.

The function of GOSR2 has been established by previous studies. In eukaryotic cells, the Golgi apparatus receives newly synthesized proteins from the endoplasmic reticulum (ER) and delivers them, after covalent modification, to their destination in the cell. These proteins move from the inside (cis) face of the Golgi to the plasma-membrane (trans) side, through a stack of cisternae, towards the trans-Golgi network (TGN). The specificity of membrane transport reactions is thought to be determined by correct pairing of vesicle-associated SNAREs (v-SNAREs) with those on the target membrane (t-SNAREs). This complex then recruits soluble NSF attachment proteins (SNAPs) and N-ethylmaleimide-sensitive factor (NSF; 601633) to form a 20S SNARE complex. See SNAPA (OMIM Ref. No. 603215). Hay et al. (1997) isolated a rat liver protein complex representing an intermediate in ER- to - Golgi transfer reactions. The complex contained the proposed cis-Golgi vesicle receptor syntaxin-5 (OMIM Ref. No. 603189), a 28-kD Golgi-associated SNARE (GOS28 or GS28; 604026), rat homologs of the yeast Bet1 (OMIM Ref. No. 605456) and Sly1 proteins, and 2 novel proteins, sec22b (OMIM Ref. No. 604029) and a 25-kD protein. The authors called the 25-kD protein 'membrin' to show its membership in a large complex of related proteins and to emphasize its probable importance to the trafficking of intracellular membranes. Like GOS28, syntaxin-5, sec22b, and rat bet1, membrin is a C terminal-anchored, cytoplasmically oriented integral membrane protein. By immunofluorescence of mammalian cells expressing epitope-tagged membrin, Hay et al. (1997) found that the expressed protein accumulated primarily at the ER in half the cells, and primarily in the Golgi in the remaining cells. Other members of the complex localized to Golgi membranes, so that the complex appeared to recapitulate vesicle docking interactions of proteins originating from distinct compartments. Lowe et al. (1997) identified cDNAs encoding human, mouse, and rat membrin, which they named GS27 (Golgi SNARE of 27 kD). Immunofluorescence of mammalian cells revealed that endogenous GS27 was associated with the Golgi apparatus and its surrounding vesicular structures. Using an in vitro transport assay, the authors demonstrated that GS27 participated in protein movement from the medial- to trans-Golgi and the trans-Golgi network, but unlike GS28, GS27 had no effect on transport from the ER to the cis/medial-Golgi. They concluded that protein movement through the Golgi apparatus depends on SNARE-mediated vesicular transport.

Full details of the abovementioned studies are described in the following publications, the disclosure of which are hereby incorporated by reference:

Hay, J. C.; Chao, D. S.; Kuo, C. S.; Scheller, R. H.: Protein interactions regulating vesicle transport between the endoplasmic reticulum and Golgi apparatus in mammalian cells. Cell 89:149-158, 1997; and Lowe, S. L.; Peter, F.; Subramaniam, V. N.; Wong, S. H.; Hong, W.: A SNARE involved in protein transport through the Golgi apparatus. Nature 389:881-884, 1997.

Further studies establishing the function and utilities of GOSR2 are found in John Hopkins OMIM database record ID 604027, and in cited publications listed in Table 5, which are hereby incorporated by reference. Mitochondrial ribosomal protein 113 (MRPL13, Accession NM_014078.3) is another GAM78 target gene, herein designated TARGET GENE. MRPL13 BINDING SITE is a target binding site found in the 3' untranslated region of mRNA encoded by MRPL13, corresponding to a target binding site such as BINDING SITE I, BINDING SITE II or BINDING SITE III of FIG. 8. Table 4 illustrates the complementarity of the nucleotide sequences of MRPL13 BINDING SITE, designated SEQ ID:11681, to the nucleotide sequence of GAM78 RNA, herein designated GAM RNA, also designated SEQ ID:277.

Another function of GAM78 is therefore inhibition of Mitochondrial ribosomal protein 113 (MRPL13, Accession NM_014078.3). Accordingly, utilities of GAM78 include diagnosis, prevention and treatment of diseases and clinical conditions associated with MRPL13.

FIG. 8 further provides a conceptual description of a novel bioinformatically detected of the present invention, referred to here as Genomic Address Messenger 79 (GAM79), which modulates expression of respective target genes thereof, the function and utility of which target genes is known in the art.

GAM79 is a novel bioinformatically detected regulatory, non protein coding, micro RNA (miRNA) gene. The method by which GAM79 was detected is described hereinabove with reference to FIGS. 8-15.

GAM79 gene, herein designated GAM GENE, and GAM79 target gene, herein designated TARGET GENE, are human genes contained in the human genome.

GAM79 gene encodes a GAM79 precursor RNA, herein designated GAM PRECURSOR RNA. Similar to other miRNA genes, and unlike most ordinary genes, GAM79 precursor RNA does not encode a protein. A nucleotide sequence identical or highly similar to the nucleotide sequence of GAM79 precursor RNA is designated SEQ ID:200, and is provided hereinbelow with reference to the sequence listing part.

GAM79 precursor RNA folds onto itself, forming GAM79 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM79 precursor RNA folds onto itself, forming GAM79 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM79 precursor RNA, designated SEQ-ID:200, and a schematic representation of a predicted secondary folding of GAM79 folded precursor RNA are further described with reference to Table 2, hereby incorporated by reference.

An enzyme complex designated DICER COMPLEX, 'dices' the GAM79 folded precursor RNA into GAM79 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM79 RNA is designated SEQ ID:352, and is provided hereinbelow with references to the sequence listing part and Table 3, hereby incorporated by reference.

GAM79 target gene, herein designated TARGET GENE, encodes a corresponding messenger RNA, GAM79 target RNA, herein designated GAM TARGET RNA. GAM79 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM79 RNA, herein designated GAM RNA, binds complementarily to one or more target binding sites located in untranslated regions of GAM79 target RNA, herein designated GAM TARGET RNA. This complementary binding is due to the fact that the nucleotide sequence of GAM79 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM79 RNA may have a different number of target binding sites in untranslated regions of a GAM79 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM79 RNA, herein designated GAM RNA, to target binding sites on GAM79 target RNA, herein designated GAM TARGET RNA, such as BINDING SITE I, BINDING SITE II and BINDING SITE III, inhibits translation of GAM79 target RNA into GAM79 target protein, herein designated GAM TARGET PROTEIN. GAM target protein is therefore outlined by a broken line.

It is appreciated that GAM79 target gene, herein designated TARGET GENE, in fact represents a plurality of GAM79 target genes. The mRNA of each one of this plurality of GAM79 target genes comprises one or more target binding sites, each having a nucleotide sequence which is at least partly complementary to GAM79 RNA, herein designated GAM RNA, and which when bound by GAM79 RNA causes inhibition of translation of respective one or more GAM79 target proteins.

It is further appreciated by one skilled in the art that the mode of translational inhibition illustrated by FIG. 8 with specific reference to translational inhibition exerted by GAM79 gene, herein designated GAM GENE, on one or more GAM79 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM79 correlate with, and may be deduced from, the identity of the target genes which GAM79 binds and inhibits, and the function of these target genes, as elaborated hereinbelow.

FLJ11370 (Accession NM_024961.1) is a GAM79 target gene, herein designated TARGET GENE. FLJ11370 BINDING SITE is a target binding site found in the 3' untranslated region of mRNA encoded by FLJ11370, corresponding to a target binding site such as BINDING SITE I, BINDING SITE II or BINDING SITE III of FIG. 8. Table 4 illustrates the complementarity of the nucleotide sequences of FLJ11370 BINDING SITE, designated SEQ ID:18758, to the nucleotide sequence of GAM79 RNA, herein designated GAM RNA, also designated SEQ ID:352.

A function of GAM79 is therefore inhibition of FLJ11370 (Accession NM_024961.1). Accordingly, utilities of GAM79 include diagnosis, prevention and treatment of diseases and clinical conditions associated with FLJ11370.

Neuronal pentraxin receptor (NPTXR, Accession NM_058178.1) is another GAM79 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:16236, to the nucleotide sequence of GAM79 RNA, herein designated GAM RNA, also designated SEQ ID:352.

Another function of GAM79 is therefore inhibition of Neuronal pentraxin receptor (NPTXR, Accession NM_058178.1). Accordingly, utilities of GAM79 include diagnosis, prevention and treatment of diseases and clinical conditions associated with NPTXR.

FIG. 8 further provides a conceptual description of a novel bioinformatically detected of the present invention, referred to here as Genomic Address Messenger 80 (GAM80), which modulates expression of respective target genes thereof, the function and utility of which target genes is known in the art.

GAM80 is a novel bioinformatically detected regulatory, non protein coding, micro RNA (miRNA) gene. The method by which GAM80 was detected is described hereinabove with reference to FIGS. 8-15.

GAM80 gene, herein designated GAM GENE, and GAM80 target gene, herein designated TARGET GENE, are human genes contained in the human genome.

GAM80 gene encodes a GAM80 precursor RNA, herein designated GAM PRECURSOR RNA. Similar to other miRNA genes, and unlike most ordinary genes, GAM80 precursor RNA does not encode a protein. A nucleotide sequence identical or highly similar to the nucleotide sequence of GAM80 precursor RNA is designated SEQ ID:116, and is provided hereinbelow with reference to the sequence listing part.

GAM80 precursor RNA folds onto itself, forming GAM80 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM80 precursor RNA folds onto itself, forming GAM80 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM80 precursor RNA, designated SEQ-ID:116, and a schematic representation of a predicted secondary folding of GAM80 folded precursor RNA are further described with reference to Table 2, hereby incorporated by reference.

An enzyme complex designated DICER COMPLEX, 'dices' the GAM80 folded precursor RNA into GAM80 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM80 RNA is designated SEQ ID:362, and is provided hereinbelow with references to the sequence listing part and Table 3, hereby incorporated by reference.

GAM80 target gene, herein designated TARGET GENE, encodes a corresponding messenger RNA, GAM80 target RNA, herein designated GAM TARGET RNA. GAM80 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM80 RNA, herein designated GAM RNA, binds complementarily to one or more target binding sites located in untranslated regions of GAM80 target RNA, herein designated GAM TARGET RNA. This complementary binding is due to the fact that the nucleotide sequence of GAM80 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM80 RNA may have a different number of target binding sites in untranslated regions of a GAM80 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM80 RNA, herein designated GAM RNA, to target binding sites on GAM80 target RNA, herein designated GAM TARGET RNA, such as BINDING SITE I, BINDING SITE II and BINDING SITE III, inhibits translation of GAM80 target RNA into GAM80 target protein, herein designated GAM TARGET PROTEIN. GAM target protein is therefore outlined by a broken line.

It is appreciated that GAM80 target gene, herein designated TARGET GENE, in fact represents a plurality of GAM80 target genes. The mRNA of each one of this plurality of GAM80 target genes comprises one or more target binding sites, each having a nucleotide sequence which is at least partly complementary to GAM80 RNA, herein designated GAM RNA, and which when bound by GAM80 RNA causes inhibition of translation of respective one or more GAM80 target proteins.

It is further appreciated by one skilled in the art that the mode of translational inhibition illustrated by FIG. 8 with specific reference to translational inhibition exerted by GAM80 gene, herein designated GAM GENE, on one or more GAM80 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM80 correlate with, and may be deduced from, the identity of the target genes which GAM80 binds and inhibits, and the function of these target genes, as elaborated hereinbelow.

LOC132241 (Accession XM_059583.7) is a GAM80 target gene, herein designated TARGET GENE. LOC132241 BINDING SITE is a target binding site found in the 5' untranslated region of mRNA encoded by LOC132241, corresponding to a target binding site such as BINDING SITE I, BINDING SITE II or BINDING SITE III of FIG. 8. Table 4 illustrates the complementarity of the nucleotide sequences of LOC132241 BINDING SITE, designated SEQ ID:15123, to the nucleotide sequence of GAM80 RNA, herein designated GAM RNA, also designated SEQ ID:362.

A function of GAM80 is therefore inhibition of LOC132241 (Accession XM_059583.7). Accordingly, utilities of GAM80 include diagnosis, prevention and treatment of diseases and clinical conditions associated with LOC132241.

Spleen tyrosine kinase (Sy, Accession NM_003177.2) is another GAM80 target gene, herein designated TARGET GENE. SYK BINDING SITE is a target binding site found in the 3' untranslated region of mRNA encoded by Sy, corresponding to a target binding site such as BINDING SITE I, BINDING SITE II or BINDING SITE III of FIG. 8. Table 4 illustrates the complementarity of the nucleotide sequences of SYK BINDING SITE, designated SEQ ID:7456, to the nucleotide sequence of GAM80 RNA, herein designated GAM RNA, also designated SEQ ID:362.

Another function of GAM80 is therefore inhibition of Spleen tyrosine kinase (Sy, Accession NM_003177.2), a gene which may participate in signaling pathways and play a role in lymphocyte activation. Accordingly, utilities of GAM80 include diagnosis, prevention and treatment of diseases and clinical conditions associated with SYK.

The function of SYK has been established by previous studies. The pig protein-tyrosine kinase Sy, with a relative molecular mass of 72,000, was first described as a protein predominantly expressed in the spleen and thymus (Zioncheck et al., 1988). The nucleotide and deduced amino acid sequence indicated that SYK is a member of the family of nonreceptor type kinases (Taniguchi et al., 1991). Muller et al. (1994) cloned the human homolog. They found an open reading frame of 1,890 bp encoding a protein of 630 amino acids, in comparison with the pig SYK of 628 amino acids. In the human protein, the N-terminal SH2 domain spans amino acids 10-102, the C-terminal SH2 domain spans amino acids 163-254, and the kinase domain includes amino acids 366-621. On the amino acid level, the overall similarity between human and pig SYK is 93%. The similarity was highest in the kinase domain.

Animal model experiments lend further support to the function of SYK. Colucci et al. (2002) noted that humans with mutations in ZAP70 have T-cell immunodeficiency, that mice lacking Zap70 have blocked T-cell development, and that mice lacking Syk have a failure of B-cell development. NK cells express both molecules, which associate with immunoreceptor tyrosine-based activation motifs (ITAMs). Using mice deficient in both Zap70 and Sy, Colucci et al. (2002) observed NK cell activity comparable to that in wildtype mice. The mutant cells expressed Nkg2d (OMIM Ref. No. 602893) and were able to lyse targets with and without Nkg2d ligands in vitro and in vivo. However, wildtype cells, but not the double- deficient cells, responded to CD16 (OMIM Ref. No. 146740) and Ly49d (see OMIM Ref. No. 604274) crosslinking with increased cytotoxicity, suggesting that these 2 ITAM-bearing receptors are unable to signal in the mutant cells. Inhibitors of PI3K (see OMIM Ref. No. 601232) or Src kinases blocked and, in combination, abrogated cytotoxic activity in the mutant cells, whereas inhibition of both kinases was required to reduce wildtype NK activity. Colucci et al. (2002) concluded that intracellular signaling in the adaptive immune system, i.e., in B and T cells, is fundamentally different from that in the NK cells of the innate immune system.

It is appreciated that the abovementioned animal model for SYK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Colucci, F.; Schweighoffer, E.; Tomasello, E.; Turner, M.; Ortaldo, J. R.; Vivier, E.; Tybulewicz, V. L. J.; Di Santo, J. P.: Natural cytotoxicity uncoupled from the Syk and ZAP-70 intracellular kinases. Nature Immun. 3:288-294, 2002; and Muller, B.; Cooper, L.; Terhorst, C.: Molecular cloning of the human homologue to the pig protein-tyrosine kinase syk. Immunogenetics 39:359-362, 1994.

Further studies establishing the function and utilities of SYK are found in John Hopkins OMIM database record ID 600085, and in cited publications listed in Table 5, which are hereby incorporated by reference.

FIG. 8 further provides a conceptual description of a novel bioinformatically detected of the present invention, referred to here as Genomic Address Messenger 81 (GAM81), which modulates expression of respective target genes thereof, the function and utility of which target genes is known in the art.

GAM81 is a novel bioinformatically detected regulatory, non protein coding, micro RNA (miRNA) gene. The method by which GAM81 was detected is described hereinabove with reference to FIGS. 8-15.

GAM81 gene, herein designated GAM GENE, and GAM81 target gene, herein designated TARGET GENE, are human genes contained in the human genome.

GAM81 gene encodes a GAM81 precursor RNA, herein designated GAM PRECURSOR RNA. Similar to other miRNA genes, and unlike most ordinary genes, GAM81 precursor RNA does not encode a protein. A nucleotide sequence identical or highly similar to the nucleotide sequence of GAM81 precursor RNA is designated SEQ ID:192, and is provided hereinbelow with reference to the sequence listing part.

GAM81 precursor RNA folds onto itself, forming GAM81 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM81 precursor RNA folds onto itself, forming GAM81 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM81 precursor RNA, designated SEQ-ID:192, and a schematic representation of a predicted secondary folding of GAM81 folded precursor RNA are further described with reference to Table 2, hereby incorporated by reference.

An enzyme complex designated DICER COMPLEX, 'dices' the GAM81 folded precursor RNA into GAM81 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM81 RNA is designated SEQ ID:256, and is provided hereinbelow with references to the sequence listing part and Table 3, hereby incorporated by reference.

GAM81 target gene, herein designated TARGET GENE, encodes a corresponding messenger RNA, GAM81 target RNA, herein designated GAM TARGET RNA. GAM81 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM81 RNA, herein designated GAM RNA, binds complementarily to one or more target binding sites located in untranslated regions of GAM81 target RNA, herein designated GAM TARGET RNA. This complementary binding is due to the fact that the nucleotide sequence of GAM81 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM81 RNA may have a different number of target binding sites in untranslated regions of a GAM81 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM81 RNA, herein designated GAM RNA, to target binding sites on GAM81 target RNA, herein designated GAM TARGET RNA, such as BINDING SITE I, BINDING SITE II and BINDING SITE III, inhibits translation of GAM81 target RNA into GAM81 target protein, herein designated GAM TARGET PROTEIN. GAM target protein is therefore outlined by a broken line.

It is appreciated that GAM81 target gene, herein designated TARGET GENE, in fact represents a plurality of GAM81 target genes. The mRNA of each one of this plurality of GAM81 target genes comprises one or more target binding sites, each having a nucleotide sequence which is at least partly complementary to GAM81 RNA, herein designated GAM RNA, and which when bound by GAM81 RNA causes inhibition of translation of respective one or more GAM81 target proteins.

It is further appreciated by one skilled in the art that the mode of translational inhibition illustrated by FIG. 8 with specific reference to translational inhibition exerted by GAM81 gene, herein designated GAM GENE, on one or more GAM81 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM81 correlate with, and may be deduced from, the identity of the target genes which GAM81 binds and inhibits, and the function of these target genes, as elaborated hereinbelow.

Ciliary neurotrophic factor receptor (CNTFR, Accession NM_001842.3) is a GAM81 target gene, herein designated TARGET GENE. CNTFR BINDING SITE is a target binding site found in the 3' untranslated region of multiple transcripts of mRNA encoded by CNTFR, corresponding to a target binding site such as BINDING SITE I, BINDING SITE II or BINDING SITE III of FIG. 8. Table 4 illustrates the complementarity of the nucleotide sequences of CNTFR BINDING SITE, designated SEQ ID:13128, to the nucleotide sequence of GAM81 RNA, herein designated GAM RNA, also designated SEQ ID:256.

A function of GAM81 is therefore inhibition of Ciliary neurotrophic factor receptor (CNTFR, Accession NM_001842.3), a gene which is critical for the developing nervous system. and therefore may be associated with Motor neuron deficits. Accordingly, utilities of GAM81 include diagnosis, prevention and treatment of Motor neuron deficits, and of other diseases and clinical conditions associated with CNTFR.

The function of CNTFR has been established by previous studies. Davis et al. (1991) used the 'tagged-ligand panning' procedure to clone a receptor for ciliary neurotrophic factor (OMIM Ref. No. 118945). This receptor is expressed exclusively in the nervous system and skeletal muscle. The CNTF receptor was found to have a structure unrelated to the receptors utilized by the nerve growth factor family of neurotrophic molecules, but instead is most homologous to the receptor for a cytokine, interleukin-6 (IL6; 147620). This similarity suggested that the CNTF receptor, like the IL6 receptor, requires a second, signal-transducing component. In contrast to all known receptors, the CNTF receptor is anchored to cell membranes by a glycosyl-phosphatidylinositol linkage. Donaldson et al. (1993) mapped the CNTFR gene to chromosome 9 by PCR on a panel of human/CHO somatic cell hybrids and regionalized the assignment to 9p13 by PCR on a panel of radiation hybrids By interspecific backcross linkage analysis, Pilz et al. (1995) mapped the Cntfr gene to mouse chromosome 4. By fluorescence in situ hybridization, Valenzuela et al. (1995) mapped the CNTFR gene to 9p13, and by interspecific backcross linkage analysis, they mapped the gene to mouse chromosome 4 in a region of known homology of synteny to 9p. Valenzuela et al. (1995) found that the human and mouse genes have an identical intron/exon structure that correlates well with the domain structure of the protein. The signal peptide and the immunoglobulin-like domain are each encoded by a single exon, the cytokine receptor-like domain is distributed among 4 exons, and the C-terminal glycosylphosphatidylinositol recognition domain is encoded by the final coding exon. The position of the introns within the cytokine receptor-like domain corresponds to that found in other members of the cytokine receptor superfamily Full details of the abovementioned studies are described in the following publications, the disclosure of which are hereby incorporated by reference:

Davis, S.; Aldrich, T. H.; Valenzuela, D. M.; Wong, V.; Furth, M. E.; Squinto, S. P.; Yancopoulos, G. D.: The receptor for ciliary neurotrophic factor. Science 253:59-63, 1991; and Pilz, A.; Woodward, K.; Povey, S.; Abbott, C.: Comparative mapping of 50 human chromosome 9 loci in the laboratory mouse. Genomics 25:139-149, 1995.

Further studies establishing the function and utilities of CNTFR are found in John Hopkins OMIM database record ID 118946, and in cited publications listed in Table 5, which are hereby incorporated by reference. LOC221191 (Accession) is another GAM81 target gene, herein designated TARGET GENE. LOC221191 BINDING SITE is a target binding site found in the 5' untranslated region of mRNA encoded by LOC221191, corresponding to a target binding site such as BINDING SITE I, BINDING SITE II or BINDING SITE III of FIG. 8. Table 4 illustrates the complementarity of the nucleotide sequences of LOC221191 BINDING SITE, designated SEQ ID:17596, to the nucleotide sequence of GAM81 RNA, herein designated GAM RNA, also designated SEQ ID:256.

Another function of GAM81 is therefore inhibition of LOC221191 (Accession). Accordingly, utilities of GAM81 include diagnosis, prevention and treatment of diseases and clinical conditions associated with LOC221191.

LOC221535 (Accession) is another GAM81 target gene, herein designated TARGET GENE. LOC221535 BINDING SITE is a target binding site found in the 5' untranslated region of mRNA encoded by LOC221535, corresponding to a target binding site such as BINDING SITE I, BINDING SITE II or BINDING SITE III of FIG. 8. Table 4 illustrates the complementarity of the nucleotide sequences of LOC221535 BINDING SITE, designated SEQ ID:7033, to the nucleotide sequence of GAM81 RNA, herein designated GAM RNA, also designated SEQ ID:256.

Another function of GAM81 is therefore inhibition of LOC221535 (Accession). Accordingly, utilities of GAM81 include diagnosis, prevention and treatment of diseases and clinical conditions associated with LOC221535.

Solute carrier family 25 (mitochondrial carrier; oxoglutarate carrier), member 11 (SLC25A11, Accession NM_003562.2) is another GAM81 target gene, herein designated TARGET GENE. SLC25A11 BINDING SITE is a target binding site found in the 3' untranslated region of mRNA encoded by SLC25A11, corresponding to a target binding site such as BINDING SITE I, BINDING SITE II or BINDING SITE III of FIG. 8. Table 4 illustrates the complementarity of the nucleotide sequences of SLC25A11 BINDING SITE, designated SEQ ID:13421, to the nucleotide sequence of GAM81 RNA, herein designated GAM RNA, also designated SEQ ID:256.

Another function of GAM81 is therefore inhibition of Solute carrier family 25 (mitochondrial carrier; oxoglutarate carrier), member 11 (SLC25A11, Accession NM_003562.2), a gene which catalyzes transport across the mitochondrial membrane plays an important role in several metabolic processes, including the malate-aspartate shuttle, and others. Accordingly, utilities of GAM81 include diagnosis, prevention and treatment of diseases and clinical conditions associated with SLC25A11.

The function of SLC25A11 has been established by previous studies. The inner membranes of mitochondria contain a number of proteins to transport various metabolites across the mitochondrial membrane. The oxoglutarate/malate carrier transports 2-oxoglutarate across the inner membranes of mitochondria in an electroneutral exchange for malate or other dicarboxylic acids. Iacobazzi et al. (1992) determined the sequences of the human and bovine mitochondrial 2-oxoglutarate carrier genes from overlapping genomic clones generated by PCR. The coding and protein sequences of the human and bovine genes are 93% and 96.6% identical, respectively. The human gene has 8 exons and 7 introns and spans 2.5 kb. Its protein product has 314 amino acids and does not appear to have a processed presequence to target it into mitochondria By fluorescence in situ hybridization, Piccininni et al. (1998) mapped the SLC25A11 gene to 17p13.3

Full details of the abovementioned studies are described in the following publications, the disclosure of which are hereby incorporated by reference:

Iacobazzi, V.; Palmieri, F.; Runswick, M. J.; Walker, J. E.: Sequences of the human and bovine genes for the mitochondrial 2-oxoglutarate carrier. DNA Seq. 3:79-88, 1992; and Piccininni, S.; Iacobazzi, V.; Lauria, G.; Rocchi, M.; Palmieri, F.: Assignment of the oxoglutarate carrier gene (SLC20A4) to human chromosome 17p13.3. Cytogenet. Cell Genet. 83:256-257.

Further studies establishing the function and utilities of SLC25A11 are found in John Hopkins OMIM database record ID 604165, and in cited publications listed in Table 5, which are hereby incorporated by reference.

FIG. 8 further provides a conceptual description of a novel bioinformatically detected of the present invention, referred to here as Genomic Address Messenger 82 (GAM82), which modulates expression of respective target genes thereof, the function and utility of which target genes is known in the art.

GAM82 is a novel bioinformatically detected regulatory, non protein coding, micro RNA (miRNA) gene. The method by which GAM82 was detected is described hereinabove with reference to FIGS. 8-15.

GAM82 gene, herein designated GAM GENE, and GAM82 target gene, herein designated TARGET GENE, are human genes contained in the human genome.

GAM82 gene encodes a GAM82 precursor RNA, herein designated GAM PRECURSOR RNA. Similar to other miRNA genes, and unlike most ordinary genes, GAM82 precursor RNA does not encode a protein. A nucleotide sequence identical or highly similar to the nucleotide sequence of GAM82 precursor RNA is designated SEQ ID:64, and is provided hereinbelow with reference to the sequence listing part. Nucleotide sequence SEQ ID:64 is located at position 5198759 relative to chromosome 17.

GAM82 precursor RNA folds onto itself, forming GAM82 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM82 precursor RNA folds onto itself, forming GAM82 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM82 precursor RNA, designated SEQ-ID:64, and a schematic representation of a predicted secondary folding of GAM82 folded precursor RNA are further described with reference to Table 2, hereby incorporated by reference.

An enzyme complex designated DICER COMPLEX, 'dices' the GAM82 folded precursor RNA into GAM82 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM82 RNA is designated SEQ ID:333, and is provided hereinbelow with references to the sequence listing part and Table 3, hereby incorporated by reference.

GAM82 target gene, herein designated TARGET GENE, encodes a corresponding messenger RNA, GAM82 target RNA, herein designated GAM TARGET RNA. GAM82 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM82 RNA, herein designated GAM RNA, binds complementarily to one or more target binding sites located in untranslated regions of GAM82 target RNA, herein designated GAM TARGET RNA. This complementary binding is due to the fact that the nucleotide sequence of GAM82 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM82 RNA may have a different number of target binding sites in untranslated regions of a GAM82 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM82 RNA, herein designated GAM RNA, to target binding sites on GAM82 target RNA, herein designated GAM TARGET RNA, such as BINDING SITE I, BINDING SITE II and BINDING SITE III, inhibits translation of GAM82 target RNA into GAM82 target protein, herein designated GAM TARGET PROTEIN. GAM target protein is therefore outlined by a broken line.

It is appreciated that GAM82 target gene, herein designated TARGET GENE, in fact represents a plurality of GAM82 target genes. The mRNA of each one of this plurality of GAM82 target genes comprises one or more target binding sites, each having a nucleotide sequence which is at least partly complementary to GAM82 RNA, herein designated GAM RNA, and which when bound by GAM82 RNA causes inhibition of translation of respective one or more GAM82 target proteins.

It is further appreciated by one skilled in the art that the mode of translational inhibition illustrated by FIG. 8 with specific reference to translational inhibition exerted by GAM82 gene, herein designated GAM GENE, on one or more GAM82 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM82 correlate with, and may be deduced from, the identity of the target genes which GAM82 binds and inhibits, and the function of these target genes, as elaborated hereinbelow.

A disintegrin-like and metalloprotease (reprolysin type) with thrombospondin type 1 motif, 5 (aggrecanase-2) (ADAMTS5, Accession NM_007038.1) is a GAM82 target gene, herein designated TARGET GENE. ADAMTS5 BINDING SITE is a target binding site found in the 3' untranslated region of mRNA encoded by ADAMTS5, corresponding to a target binding site such as BINDING SITE I, BINDING SITE II or BINDING SITE III of FIG. 8. Table 4 illustrates the complementarity of the nucleotide sequences of ADAMTS5 BINDING SITE, designated SEQ ID:9498, to the nucleotide sequence of GAM82 RNA, herein designated GAM RNA, also designated SEQ ID:333.

A function of GAM82 is therefore inhibition of A disintegrin-like and metalloprotease (reprolysin type) with thrombospondin type 1 motif, 5 (aggrecanase-2) (ADAMTS5, Accession NM_007038.1), a gene which cleaves aggrecan, a cartilage proteoglycan, and may be involved in its turnover. and therefore is associated with Arthritic diseases. Accordingly, utilities of GAM82 include diagnosis, prevention and treatment of Arthritic diseases, and of other diseases and clinical conditions associated with ADAMTS5.

The function of ADAMTS5 and its association with various diseases and clinical conditions, has been established by previous studies, as described hereinabove with reference to GAM47.1. Casein kinase 2, alpha 1 polypeptide (CSNK2A1, Accession NM_177560.1) is another GAM82 target gene, herein designated TARGET GENE. CSNK2A1 BINDING SITE is a target binding site found in the 3' untranslated region of multiple transcripts of mRNA encoded by CSNK2A1, corresponding to a target binding site such as BINDING SITE I, BINDING SITE II or BINDING SITE III of FIG. 8. Table 4 illustrates the complementarity of the nucleotide sequences of CSNK2A1 BINDING SITE, designated SEQ ID:8339, to the nucleotide sequence of GAM82 RNA, herein designated GAM RNA, also designated SEQ ID:333.

Another function of GAM82 is therefore inhibition of Casein kinase 2, alpha 1 polypeptide (CSNK2A1, Accession NM_177560.1), a gene which cphosphorylates acidic protein such as casein. Accordingly, utilities of GAM82 include diagnosis, prevention and treatment of diseases and clinical conditions associated with CSNK2A1.

The function of CSNK2A1 has been established by previous studies. Phosphorylation of the human p53 protein (OMIM Ref. No. 191170) at ser392 is responsive to ultraviolet (UV) but not gamma irradiation. Keller et al. (2001) identified and purified a mammalian UV-activated protein kinase complex that phosphorylates ser392 in vitro. This kinase complex contains CK2 and the chromatin transcriptional elongation factor FACT, a heterodimer of SPT16 (OMIM Ref. No. 605012) and SSRP1 (OMIM Ref. No. 604328). In vitro studies showed that FACT alters the specificity of CK2 in the complex such that it selectively phosphorylates p53 over other substrates, including casein. In addition, phosphorylation by the kinase complex was found to enhance p53 activity. These results provided a potential mechanism for p53 activation by UV irradiation Doray et al. (2002) demonstrated that the Golgi-localized, gamma-ear-containing adenosine diphosphate ribosylation factor-binding proteins (GGA1, 606004 and GGA3, 606006) and the coat protein adaptor protein-1 (AP-1) complex (see OMIM Ref. No. AP1G2, 603534) colocalize in clathrin-coated buds of the trans-Golgi networks of mouse L cells and human HeLa cells. Binding studies revealed a direct interaction between the hinge domains of the GGAs and the gamma-ear domain of AP-1. Further, AP-1 contained bound casein kinase-2 that phosphorylated GGA1 and GGA3, thereby causing autoinhibition. Doray et al. (2002) demonstrated that this autoinhibition could induce the directed transfer of mannose 6-phosphate receptors (see OMIM Ref. No. 154540) from the GGAs to AP-1. Mannose 6-phosphate receptors that were defective in binding to GGAs were poorly incorporated into adaptor protein complex containing clathrin coated vesicles. Thus, Doray et al. (2002) concluded that GGAs and the AP-1 complex interact to package mannose 6-phosphate receptors into AP-1-containing coated vesicles Full details of the abovementioned studies are described in the following publications, the disclosure of which are hereby incorporated by reference:

Keller, D. M.; Zeng, X.; Wang, Y.; Zhang, Q. H.; Kapoor, M.; Shu, H.; Goodman, R.; Lozano, G.; Zhao, Y.; Lu, H.: A DNA damage-induced p53 serine 392 kinase complex contains CK2, hSpt16, and SSRP1. Molec. Cell 283-292, 2001; and Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002.

Further studies establishing the function and utilities of CSNK2A1 are found in John Hopkins OMIM database record ID 115440, and in cited publications listed in Table 5, which are hereby incorporated by reference. Kelch-like 4 (drosophila) (KLHL4, Accession NM_019117.3) is another GAM82 target gene, herein designated TARGET GENE. KLHL4 BINDING SITE is a target binding site found in the 3' untranslated region of multiple transcripts of mRNA encoded by KLHL4, corresponding to a target binding site such as BINDING SITE I, BINDING SITE II or BINDING SITE III of FIG. 8. Table 4 illustrates the complementarity of the nucleotide sequences of KLHL4 BINDING SITE, designated SEQ ID:11049, to the nucleotide sequence of GAM82 RNA, herein designated GAM RNA, also designated SEQ ID:333.

Another function of GAM82 is therefore inhibition of Kelch-like 4 (drosophila) (KLHL4, Accession NM_019117.3). Accordingly, utilities of GAM82 include diagnosis, prevention and treatment of diseases and clinical conditions associated with KLHL4.

LOC138639 (Accession) is another GAM82 target gene, herein designated TARGET GENE. LOC138639 BINDING SITE is a target binding site found in the 5' untranslated region of mRNA encoded by LOC138639, corresponding to a target binding site such as BINDING SITE I, BINDING SITE II or BINDING SITE III of FIG. 8. Table 4 illustrates the complementarity of the nucleotide sequences of LOC138639 BINDING SITE, designated SEQ ID:8881, to the nucleotide sequence of GAM82 RNA, herein designated GAM RNA, also designated SEQ ID:333.

Another function of GAM82 is therefore inhibition of LOC138639 (Accession). Accordingly, utilities of GAM82 include diagnosis, prevention and treatment of diseases and clinical conditions associated with LOC138639.

FIG. 8 further provides a conceptual description of a novel bioinformatically detected of the present invention, referred to here as Genomic Address Messenger 83 (GAM83), which modulates expression of respective target genes thereof, the function and utility of which target genes is known in the art.

GAM83 is a novel bioinformatically detected regulatory, non protein coding, micro RNA (miRNA) gene. The method by which GAM83 was detected is described hereinabove with reference to FIGS. 8-15.

GAM83 gene, herein designated GAM GENE, and GAM83 target gene, herein designated TARGET GENE, are human genes contained in the human genome.

GAM83 gene encodes a GAM83 precursor RNA, herein designated GAM PRECURSOR RNA. Similar to other miRNA genes, and unlike most ordinary genes, GAM83 precursor RNA does not encode a protein. A nucleotide sequence identical or highly similar to the nucleotide sequence of GAM83 precursor RNA is designated SEQ ID:172, and is provided hereinbelow with reference to the sequence listing part. Nucleotide sequence SEQ ID:172 is located at position 48222374 relative to chromosome 11.

GAM83 precursor RNA folds onto itself, forming GAM83 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM83 precursor RNA folds onto itself, forming GAM83 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM83 precursor RNA, designated SEQ-ID:172, and a schematic representation of a predicted secondary folding of GAM83 folded precursor RNA are further described with reference to Table 2, hereby incorporated by reference.

An enzyme complex designated DICER COMPLEX, 'dices' the GAM83 folded precursor RNA into GAM83 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM83 RNA is designated SEQ ID:287, and is provided hereinbelow with references to the sequence listing part and Table 3, hereby incorporated by reference.

GAM83 target gene, herein designated TARGET GENE, encodes a corresponding messenger RNA, GAM83 target RNA, herein designated GAM TARGET RNA. GAM83 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM83 RNA, herein designated GAM RNA, binds complementarily to one or more target binding sites located in untranslated regions of GAM83 target RNA, herein designated GAM TARGET RNA. This complementary binding is due to the fact that the nucleotide sequence of GAM83 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM83 RNA may have a different number of target binding sites in untranslated regions of a GAM83 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM83 RNA, herein designated GAM RNA, to target binding sites on GAM83 target RNA, herein designated GAM TARGET RNA, such as BINDING SITE I, BINDING SITE II and BINDING SITE III, inhibits translation of GAM83 target RNA into GAM83 target protein, herein designated GAM TARGET PROTEIN. GAM target protein is therefore outlined by a broken line.

It is appreciated that GAM83 target gene, herein designated TARGET GENE, in fact represents a plurality of GAM83 target genes. The mRNA of each one of this plurality of GAM83 target genes comprises one or more target binding sites, each having a nucleotide sequence which is at least partly complementary to GAM83 RNA, herein designated GAM RNA, and which when bound by GAM83 RNA causes inhibition of translation of respective one or more GAM83 target proteins.

It is further appreciated by one skilled in the art that the mode of translational inhibition illustrated by FIG. 8 with specific reference to translational inhibition exerted by GAM83 gene, herein designated GAM GENE, on one or more GAM83 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM83 correlate with, and may be deduced from, the identity of the target genes which GAM83 binds and inhibits, and the function of these target genes, as elaborated hereinbelow.

Angiotensin i converting enzyme (peptidyl-dipeptidase a) 1 (ACE, Accession NP_690044.1) is a GAM83 target gene, herein designated TARGET GENE. ACE BINDING SITE is a target binding site found in the 3' untranslated region of multiple transcripts of mRNA encoded by ACE, corresponding to a target binding site such as BINDING SITE I, BINDING SITE II or BINDING SITE III of FIG. 8. Table 4 illustrates the complementarity of the nucleotide sequences of ACE BINDING SITE, designated SEQ ID:2830, to the nucleotide sequence of GAM83 RNA, herein designated GAM RNA, also designated SEQ ID:287.

A function of GAM83 is therefore inhibition of Angiotensin i converting enzyme (peptidyl-dipeptidase a) 1 (ACE, Accession NP_690044.1), a gene which Angiotensin I-converting enzyme (dipeptidyl carboxypeptidase 1). Accordingly, utilities of GAM83 include diagnosis, prevention and treatment of diseases and clinical conditions associated with ACE.

The function of ACE and its association with various diseases and clinical conditions, has been established by previous studies, as described hereinabove with reference to GAM44.1. ANP32E (Accession NP_112182.1) is another GAM83 target gene, herein designated TARGET GENE. ANP32E BINDING SITE1 and ANP32E BINDING SITE2 are target binding sites found in untranslated regions of mRNA encoded by ANP32E, corresponding to target binding sites such as BINDING SITE I, BINDING SITE II or BINDING SITE III of FIG. 8. Table 4 illustrates the complementarity of the nucleotide sequences of ANP32E BINDING SITE1 and ANP32E BINDING SITE2, designated SEQ ID:11390 and SEQ ID:16172 respectively, to the nucleotide sequence of GAM83 RNA, herein designated GAM RNA, also designated SEQ ID:287.

Another function of GAM83 is therefore inhibition of ANP32E (Accession NP_112182.1). Accordingly, utilities of GAM83 include diagnosis, prevention and treatment of diseases and clinical conditions associated with ANP32E.

Adaptor-related protein complex 3, mu 2 subunit (AP3M2, Accession NP_006794.1) is another GAM83 target gene, herein designated TARGET GENE. AP3M2 BINDING SITE is a target binding site found in the 3' untranslated region of mRNA encoded by AP3M2, corresponding to a target binding site such as BINDING SITE I, BINDING SITE II or BINDING SITE III of FIG. 8. Table 4 illustrates the complementarity of the nucleotide sequences of AP3M2 BINDING SITE, designated SEQ ID:17766, to the nucleotide sequence of GAM83 RNA, herein designated GAM RNA, also designated SEQ ID:287.

Another function of GAM83 is therefore inhibition of Adaptor-related protein complex 3, mu 2 subunit (AP3M2, Accession NP_006794.1). Accordingly, utilities of GAM83 include diagnosis, prevention and treatment of diseases and clinical conditions associated with AP3M2.

Rho guanine nucleotide exchange factor (gef) 12 (ARHGEF12, Accession NP_056128.1) is another GAM83 target gene, herein designated TARGET GENE. ARHGEF12 BINDING SITE is a target binding site found in the 3' untranslated region of mRNA encoded by ARHGEF12, corresponding to a target binding site such as BINDING SITE I, BINDING SITE II or BINDING SITE III of FIG. 8. Table 4 illustrates the complementarity of the nucleotide sequences of ARHGEF12 BINDING SITE, designated SEQ ID:6308, to the nucleotide sequence of GAM83 RNA, herein designated GAM RNA, also designated SEQ ID:287.

Another function of GAM83 is therefore inhibition of Rho guanine nucleotide exchange factor (gef) 12 (ARHGEF12, Accession NP_056128.1). Accordingly, utilities of GAM83 include diagnosis, prevention and treatment of diseases and clinical conditions associated with ARHGEF12.

Aspartate beta-hydroxylase (ASPH, Accession NP_115856.1) is another GAM83 target gene, herein designated TARGET GENE. ASPH BINDING SITE is a target binding site found in the 3' untranslated region of multiple transcripts of mRNA encoded by ASPH, corresponding to a target binding site such as BINDING SITE I, BINDING SITE II or BINDING SITE III of FIG. 8. Table 4 illustrates the complementarity of the nucleotide sequences of ASPH BINDING SITE, designated SEQ ID:11418, to the nucleotide sequence of GAM83 RNA, herein designated GAM RNA, also designated SEQ ID:287.

Another function of GAM83 is therefore inhibition of Aspartate beta-hydroxylase (ASPH, Accession NP_115856.1), a gene which specifically hydroxylates the beta carbon of aspartic acid or asparagine residues in certain epidermal growth factor (EGF)-like domains of a number of proteins. Accordingly, utilities of GAM83 include diagnosis, prevention and treatment of diseases and clinical conditions associated with ASPH.

The function of ASPH and its association with various diseases and clinical conditions, has been established by previous studies, as described hereinabove with reference to GAM44.1. Aspartate beta-hydroxylase (ASPH, Accession NP_064549.1) is another GAM83 target gene, herein designated TARGET GENE. ASPH BINDING SITE is a target binding site found in the 3' untranslated region of multiple transcripts of mRNA encoded by ASPH, corresponding to a target binding site such as BINDING SITE I, BINDING SITE II or BINDING SITE III of FIG. 8. Table 4 illustrates the complementarity of the nucleotide sequences of ASPH BINDING SITE, designated SEQ ID:11418, to the nucleotide sequence of GAM83 RNA, herein designated GAM RNA, also designated SEQ ID:287.

Another function of GAM83 is therefore inhibition of Aspartate beta-hydroxylase (ASPH, Accession NP_064549.1), a gene which specifically hydroxylates the beta carbon of aspartic acid or asparagine residues in certain epidermal growth factor (EGF)-like domains of a number of proteins. Accordingly, utilities of GAM83 include diagnosis, prevention and treatment of diseases and clinical conditions associated with ASPH.

The function of ASPH and its association with various diseases and clinical conditions, has been established by previous studies, as described hereinabove with reference to GAM44.1. Atpase, na+/k+ transporting, beta 3 polypeptide (ATP1B3, Accession NP_001670.1) is another GAM83 target gene, herein designated TARGET GENE. ATP1B3 BINDING SITE is a target binding site found in the 3' untranslated region of mRNA encoded by ATP1B3, corresponding to a target binding site such as BINDING SITE I, BINDING SITE II or BINDING SITE III of FIG. 8. Table 4 illustrates the complementarity of the nucleotide sequences of ATP1B3 BINDING SITE, designated SEQ ID:9521, to the nucleotide sequence of GAM83 RNA, herein designated GAM RNA, also designated SEQ ID:287.

Another function of GAM83 is therefore inhibition of Atpase, na+/k+ transporting, beta 3 polypeptide (ATP1B3, Accession NP_001670.1). Accordingly, utilities of GAM83 include diagnosis, prevention and treatment of diseases and clinical conditions associated with ATP1B3.

Atpase, ca++ transporting, type 2c, member 1 (ATP2C1, Accession NP_055197.1) is another GAM83 target gene, herein designated TARGET GENE. ATP2C1 BINDING SITE is a target binding site found in the 3' untranslated region of mRNA encoded by ATP2C1, corresponding to a target binding site such as BINDING SITE I, BINDING SITE II or BINDING SITE III of FIG. 8. Table 4 illustrates the complementarity of the nucleotide sequences of ATP2C1 BINDING SITE, designated SEQ ID:9108, to the nucleotide sequence of GAM83 RNA, herein designated GAM RNA, also designated SEQ ID:287.

Another function of GAM83 is therefore inhibition of Atpase, ca++ transporting, type 2c, member 1 (ATP2C1, Accession NP_055197.1). Accordingly, utilities of GAM83 include diagnosis, prevention and treatment of diseases and clinical conditions associated with ATP2C1.

Btb and cnc homology 1, basic leucine zipper transcription factor 2 (BACH2, Accession NP_068585.1) is another GAM83 target gene, herein designated TARGET GENE. BACH2 BINDING SITE is a target binding site found in the 3' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:13836, to the nucleotide sequence of GAM83 RNA, herein designated GAM RNA, also designated SEQ ID:287.

Another function of GAM83 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM83 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. BHC80 (Accession NP_057705.2) is another GAM83 target gene, herein designated TARGET GENE. BHC80 BINDING SITE is a target binding site found in the 5' untranslated region of mRNA encoded by BHC80, corresponding to a target binding site such as BINDING SITE I, BINDING SITE II or BINDING SITE III of FIG. 8. Table 4 illustrates the complementarity of the nucleotide sequences of BHC80 BINDING SITE, designated SEQ ID:7380, to the nucleotide sequence of GAM83 RNA, herein designated GAM RNA, also designated SEQ ID:287.

Another function of GAM83 is therefore inhibition of BHC80 (Accession NP_057705.2). Accordingly, utilities of GAM83 include diagnosis, prevention and treatment of diseases and clinical conditions associated with BHC80.

C14orf24 (Accession NP_775878.1) is another GAM83 target gene, herein designated TARGET GENE. C14orf24 BINDING SITE is a target binding site found in the 3' untranslated region of mRNA encoded by C14orf24, corresponding to a target binding site such as BINDING SITE I, BINDING SITE II or BINDING SITE III of FIG. 8. Table 4 illustrates the complementarity of the nucleotide sequences of C14orf24 BINDING SITE, designated SEQ ID:831, to the nucleotide sequence of GAM83 RNA, herein designated GAM RNA, also designated SEQ ID:287.

Another function of GAM83 is therefore inhibition of C14orf24 (Accession NP_775878.1). Accordingly, utilities of GAM83 include diagnosis, prevention and treatment of diseases and clinical conditions associated with C14orf24.

C14orf39 (Accession NP_777638.1) is another GAM83 target gene, herein designated TARGET GENE. C14orf39 BINDING SITE is a target binding site found in the 3' untranslated region of mRNA encoded by C14orf39, corresponding to a target binding site such as BINDING SITE I, BINDING SITE II or BINDING SITE III of FIG. 8. Table 4 illustrates the complementarity of the nucleotide sequences of C14orf39 BINDING SITE, designated SEQ ID:10766, to the nucleotide sequence of GAM83 RNA, herein designated GAM RNA, also designated SEQ ID:287.

Another function of GAM83 is therefore inhibition of C14orf39 (Accession NP_777638.1). Accordingly, utilities of GAM83 include diagnosis, prevention and treatment of diseases and clinical conditions associated with C14orf39.

C14orf78 (Accession XP_290629.1) is another GAM83 target gene, herein designated TARGET GENE. C14orf78 BINDING SITE is a target binding site found in the 3' untranslated region of mRNA encoded by C14orf78, corresponding to a target binding site such as BINDING SITE I, BINDING SITE II or BINDING SITE III of FIG. 8. Table 4 illustrates the complementarity of the nucleotide sequences of C14orf78 BINDING SITE, designated SEQ ID:11042, to the nucleotide sequence of GAM83 RNA, herein designated GAM RNA, also designated SEQ ID:287.

Another function of GAM83 is therefore inhibition of C14orf78 (Accession XP_290629.1). Accordingly, utilities of GAM83 include diagnosis, prevention and treatment of diseases and clinical conditions associated with C14orf78.

Chromosome 21 open reading frame 55 (C21orf55, Accession NP_060303.1) is another GAM83 target gene, herein designated TARGET GENE. C21orf55 BINDING SITE is a target binding site found in the 5' untranslated region of mRNA encoded by C21orf55, corresponding to a target binding site such as BINDING SITE I, BINDING SITE II or BINDING SITE III of FIG. 8. Table 4 illustrates the complementarity of the nucleotide sequences of C21orf55 BINDING SITE, designated SEQ ID:15819, to the nucleotide sequence of GAM83 RNA, herein designated GAM RNA, also designated SEQ ID:287.

Another function of GAM83 is therefore inhibition of Chromosome 21 open reading frame 55 (C21orf55, Accession NP_060303.1). Accordingly, utilities of GAM83 include diagnosis, prevention and treatment of diseases and clinical conditions associated with C21orf55.

Chromosome 5 open reading frame 4 (C5orf4, Accession NP_115761.1) is another GAM83 target gene, herein designated TARGET GENE. C5orf4 BINDING SITE1 and C5orf4 BINDING SITE2 are target binding sites found in untranslated regions of multiple transcripts of mRNA encoded by C5orf4, corresponding to target binding sites such as BINDING SITE I, BINDING SITE II or BINDING SITE III of FIG. 8. Table 4 illustrates the complementarity of the nucleotide sequences of C5orf4 BINDING SITE1 and C5orf4 BINDING SITE2, designated SEQ ID:2131 and SEQ ID:16902 respectively, to the nucleotide sequence of GAM83 RNA, herein designated GAM RNA, also designated SEQ ID:287.

Another function of GAM83 is therefore inhibition of Chromosome 5 open reading frame 4 (C5orf4, Accession NP_115761.1). Accordingly, utilities of GAM83 include diagnosis, prevention and treatment of diseases and clinical conditions associated with C5orf4.

Chromosome 5 open reading frame 4 (C5orf4, Accession NP_057432.1) is another GAM83 target gene, herein designated TARGET GENE. C5orf4 BINDING SITE1 and C5orf4 BINDING SITE2 are target binding sites found in untranslated regions of multiple transcripts of mRNA encoded by C5orf4, corresponding to target binding sites such as BINDING SITE I, BINDING SITE II or BINDING SITE III of FIG. 8. Table 4 illustrates the complementarity of the nucleotide sequences of C5orf4 BINDING SITE1 and C5orf4 BINDING SITE2, designated SEQ ID:16902 and SEQ ID:18232 respectively, to the nucleotide sequence of GAM83 RNA, herein designated GAM RNA, also designated SEQ ID:287.

Another function of GAM83 is therefore inhibition of Chromosome 5 open reading frame 4 (C5orf4, Accession NP_057432.1). Accordingly, utilities of GAM83 include diagnosis, prevention and treatment of diseases and clinical conditions associated with C5orf4.

Cholecystokinin b receptor (CCKBR, Accession NP_795344.1) is another GAM83 target gene, herein designated TARGET GENE. CCKBR BINDING SITE is a target binding site found in the 3' untranslated region of multiple transcripts of mRNA encoded by CCKBR, corresponding to a target binding site such as BINDING SITE I, BINDING SITE II or BINDING SITE III of FIG. 8. Table 4 illustrates the complementarity of the nucleotide sequences of CCKBR BINDING SITE, designated SEQ ID:6458, to the nucleotide sequence of GAM83 RNA, herein designated GAM RNA, also designated SEQ ID:287.

Another function of GAM83 is therefore inhibition of Cholecystokinin b receptor (CCKBR, Accession NP_795344.1), a gene which bonds cholecystokinin, regulates emotion and gastric acid secretion. Accordingly, utilities of GAM83 include diagnosis, prevention and treatment of diseases and clinical conditions associated with CCKBR.

The function of CCKBR and its association with various diseases and clinical conditions, has been established by previous studies, as described hereinabove with reference to GAM44.1. Cholecystokinin b receptor (CCKBR, Accession NP_000722.2) is another GAM83 target gene, herein designated TARGET GENE. CCKBR BINDING SITE is a target binding site found in the 3' untranslated region of multiple transcripts of mRNA encoded by CCKBR, corresponding to a target binding site such as BINDING SITE I, BINDING SITE II or BINDING SITE III of FIG. 8. Table 4 illustrates the complementarity of the nucleotide sequences of CCKBR BINDING SITE, designated SEQ ID:6458, to the nucleotide sequence of GAM83 RNA, herein designated GAM RNA, also designated SEQ ID:287.

Another function of GAM83 is therefore inhibition of Cholecystokinin b receptor (CCKBR, Accession NP_000722.2), a gene which bonds cholecystokinin, regulates emotion and gastric acid secretion. Accordingly, utilities of GAM83 include diagnosis, prevention and treatment of diseases and clinical conditions associated with CCKBR.

The function of CCKBR and its association with various diseases and clinical conditions, has been established by previous studies, as described hereinabove with reference to GAM44.1. Collagen-like tail subunit (single strand of homotrimer) of asymmetric acetylcholinesterase (COLQ, Accession NP_536803.1) is another GAM83 target gene, herein designated TARGET GENE. COLQ BINDING SITE is a target binding site found in the 3' untranslated region of multiple transcripts of mRNA encoded by COLQ, corresponding to a target binding site such as BINDING SITE I, BINDING SITE II or BINDING SITE III of FIG. 8. Table 4 illustrates the complementarity of the nucleotide sequences of COLQ BINDING SITE, designated SEQ ID:9718, to the nucleotide sequence of GAM83 RNA, herein designated GAM RNA, also designated SEQ ID:287.

Another function of GAM83 is therefore inhibition of Collagen-like tail subunit (single strand of homotrimer) of asymmetric acetylcholinesterase (COLQ, Accession NP_536803.1). Accordingly, utilities of GAM83 include diagnosis, prevention and treatment of diseases and clinical conditions associated with COLQ.

Collagen-like tail subunit (single strand of homotrimer) of asymmetric acetylcholinesterase (COLQ, Accession NP_536804.1) is another GAM83 target gene, herein designated TARGET GENE. COLQ BINDING SITE is a target binding site found in the 3' untranslated region of multiple transcripts of mRNA encoded by COLQ, corresponding to a target binding site such as BINDING SITE I, BINDING SITE II or BINDING SITE III of FIG. 8. Table 4 illustrates the complementarity of the nucleotide sequences of COLQ BINDING SITE, designated SEQ ID:9718, to the nucleotide sequence of GAM83 RNA, herein designated GAM RNA, also designated SEQ ID:287.

Another function of GAM83 is therefore inhibition of Collagen-like tail subunit (single strand of homotrimer) of asymmetric acetylcholinesterase (COLQ, Accession NP_536804.1). Accordingly, utilities of GAM83 include diagnosis, prevention and treatment of diseases and clinical conditions associated with COLQ.

Complement component (3b/4b) receptor 1, including knops blood group system (CR1, Accession NP_000564.1) is another GAM83 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:10491, to the nucleotide sequence of GAM83 RNA, herein designated GAM RNA, also designated SEQ ID:287.

Another function of GAM83 is therefore inhibition of Complement component (3b/4b) receptor 1, including knops blood group system (CR1, Accession NP_000564.1). Accordingly, utilities of GAM83 include diagnosis, prevention and treatment of diseases and clinical conditions associated with CR1.

Chemokine (c-x3-c motif) receptor 1 (CX3CR1, Accession NP_001328.1) is another GAM83 target gene, herein designated TARGET GENE. CX3CR1 BINDING SITE is a target binding site found in the 3' untranslated region of mRNA encoded by CX3CR1, corresponding to a target binding site such as BINDING SITE I, BINDING SITE II or BINDING SITE III of FIG. 8. Table 4 illustrates the complementarity of the nucleotide sequences of CX3CR1 BINDING SITE, designated SEQ ID:10405, to the nucleotide sequence of GAM83 RNA, herein designated GAM RNA, also designated SEQ ID:287.

Another function of GAM83 is therefore inhibition of Chemokine (c-x3-c motif) receptor 1 (CX3CR1, Accession NP_001328.1), a gene which mediates both the adhesive and migratory functions of fractalkine and therefore may be associated with Human immunodeficiency virus type 1. Accordingly, utilities of GAM83 include diagnosis, prevention and treatment of Human immunodeficiency virus type 1., and of other diseases and clinical conditions associated with CX3CR1.

The function of CX3CR1 and its association with various diseases and clinical conditions, has been established by previous studies, as described hereinabove with reference to GAM44.1. Cylindromatosis (turban tumor syndrome) (CYLD, Accession NP_056062.1) is another GAM83 target gene, herein designated TARGET GENE. CYLD BINDING SITE is a target binding site found in the 5' untranslated region of mRNA encoded by CYLD, corresponding to a target binding site such as BINDING SITE I, BINDING SITE II or BINDING SITE III of FIG. 8. Table 4 illustrates the complementarity of the nucleotide sequences of CYLD BINDING SITE, designated SEQ ID:11043, to the nucleotide sequence of GAM83 RNA, herein designated GAM RNA, also designated SEQ ID:287.

Another function of GAM83 is therefore inhibition of Cylindromatosis (turban tumor syndrome) (CYLD, Accession NP_056062.1). Accordingly, utilities of GAM83 include diagnosis, prevention and treatment of diseases and clinical conditions associated with CYLD.

24-dehydrocholesterol reductase (DHCR24, Accession NP_055577.1) is another GAM83 target gene, herein designated TARGET GENE. DHCR24 BINDING SITE is a target binding site found in the 3' untranslated region of mRNA encoded by DHCR24, corresponding to a target binding site such as BINDING SITE I, BINDING SITE II or BINDING SITE III of FIG. 8. Table 4 illustrates the complementarity of the nucleotide sequences of DHCR24 BINDING SITE, designated SEQ ID:14070, to the nucleotide sequence of GAM83 RNA, herein designated GAM RNA, also designated SEQ ID:287.

Another function of GAM83 is therefore inhibition of 24-dehydrocholesterol reductase (DHCR24, Accession NP_055577.1), a gene which catalyzes the reduction of sterol intermediates. and therefore is associated with Desmosterolosis. Accordingly, utilities of GAM83 include diagnosis, prevention and treatment of Desmosterolosis, and of other diseases and clinical conditions associated with DHCR24.

The function of DHCR24 and its association with various diseases and clinical conditions, has been established by previous studies, as described hereinabove with reference to GAM44.1. DIRAS2 (Accession NP_060064.2) is another GAM83 target gene, herein designated TARGET GENE. DIRAS2 BINDING SITE1 and DIRAS2 BINDING SITE2 are target binding sites found in untranslated regions of mRNA encoded by DIRAS2, corresponding to target binding sites such as BINDING SITE I, BINDING SITE II or BINDING SITE III of FIG. 8. Table 4 illustrates the complementarity of the nucleotide sequences of DIRAS2 BINDING SITE1 and DIRAS2 BINDING SITE2, designated SEQ ID:16186 and SEQ ID:14097 respectively, to the nucleotide sequence of GAM83 RNA, herein designated GAM RNA, also designated SEQ ID:287.

Another function of GAM83 is therefore inhibition of DIRAS2 (Accession NP_060064.2). Accordingly, utilities of GAM83 include diagnosis, prevention and treatment of diseases and clinical conditions associated with DIRAS2.

DKFZp547I094 (Accession NP_115531.1) is another GAM83 target gene, herein designated TARGET GENE. DKFZp547I094 BINDING SITE is a target binding site found in the 5' untranslated region of mRNA encoded by DKFZp547I094, corresponding to a target binding site such as BINDING SITE I, BINDING SITE II or BINDING SITE III of FIG. 8. Table 4 illustrates the complementarity of the nucleotide sequences of DKFZp547I094 BINDING SITE, designated SEQ ID:2790, to the nucleotide sequence of GAM83 RNA, herein designated GAM RNA, also designated SEQ ID:287.

Another function of GAM83 is therefore inhibition of DKFZp547I094 (Accession NP_115531.1). Accordingly, utilities of GAM83 include diagnosis, prevention and treatment of diseases and clinical conditions associated with DKFZp547I094.

DKFZP564O0423 (Accession XP_166254.2) is another GAM83 target gene, herein designated TARGET GENE. DKFZP564O0423 BINDING SITE is a target binding site found in the 3' untranslated region of mRNA encoded by DKFZP564O0423, corresponding to a target binding site such as BINDING SITE I, BINDING SITE II or BINDING SITE III of FIG. 8. Table 4 illustrates the complementarity of the nucleotide sequences of DKFZP564O0423 BINDING SITE, designated SEQ ID:1156, to the nucleotide sequence of GAM83 RNA, herein designated GAM RNA, also designated SEQ ID:287.

Another function of GAM83 is therefore inhibition of DKFZP564O0423 (Accession XP_166254.2). Accordingly, utilities of GAM83 include diagnosis, prevention and treatment of diseases and clinical conditions associated with DKFZP564O0423.

DKFZP586F2423 (Accession XP_291242.1) is another GAM83 target gene, herein designated TARGET GENE. DKFZP586F2423 BINDING SITE is a target binding site found in the 3' untranslated region of mRNA encoded by DKFZP586F2423, corresponding to a target binding site such as BINDING SITE I, BINDING SITE II or BINDING SITE III of FIG. 8. Table 4 illustrates the complementarity of the nucleotide sequences of DKFZP586F2423 BINDING SITE, designated SEQ ID:12701, to the nucleotide sequence of GAM83 RNA, herein designated GAM RNA, also designated SEQ ID:287.

Another function of GAM83 is therefore inhibition of DKFZP586F2423 (Accession XP_291242.1). Accordingly, utilities of GAM83 include diagnosis, prevention and treatment of diseases and clinical conditions associated with DKFZP586F2423.

DKFZp761B107 (Accession NP_775734.1) is another GAM83 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:19365, to the nucleotide sequence of GAM83 RNA, herein designated GAM RNA, also designated SEQ ID:287.

Another function of GAM83 is therefore inhibition of DKFZp761B107 (Accession NP_775734.1). Accordingly, utilities of GAM83 include diagnosis, prevention and treatment of diseases and clinical conditions associated with DKFZp761B107.

E2f transcription factor 3 (E2F3, Accession NP_001940.1) is another GAM83 target gene, herein designated TARGET GENE. E2F3 BINDING SITE is a target binding site found in the 3' untranslated region of mRNA encoded by E2F3, corresponding to a target binding site such as BINDING SITE I, BINDING SITE II or BINDING SITE III of FIG. 8. Table 4 illustrates the complementarity of the nucleotide sequences of E2F3 BINDING SITE, designated SEQ ID:13295, to the nucleotide sequence of GAM83 RNA, herein designated GAM RNA, also designated SEQ ID:287.

Another function of GAM83 is therefore inhibition of E2f transcription factor 3 (E2F3, Accession NP_001940.1), a gene which binds dna and controls cell-cycle progression from g1 to s phase. and therefore may be associated with Hereditary autosomal dominant myoclonus dystonia. Accordingly, utilities of GAM83 include diagnosis, prevention and treatment of Hereditary autosomal dominant myoclonus dystonia, and of other diseases and clinical conditions associated with E2F3.

The function of E2F3 and its association with various diseases and clinical conditions, has been established by previous studies, as described hereinabove with reference to GAM44.1. Endothelial differentiation, lysophosphatidic acid g-protein-coupled receptor, 2 (EDG2, Accession NP_476500.1) is another GAM83 target gene, herein designated TARGET GENE. EDG2 BINDING SITE is a target binding site found in the 3' untranslated region of multiple transcripts of mRNA encoded by EDG2, corresponding to a target binding site such as BINDING SITE I, BINDING SITE II or BINDING SITE III of FIG. 8. Table 4 illustrates the complementarity of the nucleotide sequences of EDG2 BINDING SITE, designated SEQ ID:10299, to the nucleotide sequence of GAM83 RNA, herein designated GAM RNA, also designated SEQ ID:287.

Another function of GAM83 is therefore inhibition of Endothelial differentiation, lysophosphatidic acid g-protein-coupled receptor, 2 (EDG2, Accession NP_476500.1). Accordingly, utilities of GAM83 include diagnosis, prevention and treatment of diseases and clinical conditions associated with EDG2.

Endothelial differentiation, lysophosphatidic acid g-protein-coupled receptor, 2 (EDG2, Accession NP_001392.2) is another GAM83 target gene, herein designated TARGET GENE. EDG2 BINDING SITE is a target binding site found in the 3' untranslated region of multiple transcripts of mRNA encoded by EDG2, corresponding to a target binding site such as BINDING SITE I, BINDING SITE II or BINDING SITE III of FIG. 8. Table 4 illustrates the complementarity of the nucleotide sequences of EDG2 BINDING SITE, designated SEQ ID:10299, to the nucleotide sequence of GAM83 RNA, herein designated GAM RNA, also designated SEQ ID:287.

Another function of GAM83 is therefore inhibition of Endothelial differentiation, lysophosphatidic acid g-protein-coupled receptor, 2 (EDG2, Accession NP_001392.2). Accordingly, utilities of GAM83 include diagnosis, prevention and treatment of diseases and clinical conditions associated with EDG2.

Fk506 binding protein 2, 13 kda (FKBP2, Accession NP_004461.2) is another GAM83 target gene, herein designated TARGET GENE. FKBP2 BINDING SITE is a target binding site found in the 3' untranslated region of multiple transcripts of mRNA encoded by FKBP2, corresponding to a target binding site such as BINDING SITE I, BINDING SITE II or BINDING SITE III of FIG. 8. Table 4 illustrates the complementarity of the nucleotide sequences of FKBP2 BINDING SITE, designated SEQ ID:11911, to the nucleotide sequence of GAM83 RNA, herein designated GAM RNA, also designated SEQ ID:287.

Another function of GAM83 is therefore inhibition of Fk506 binding protein 2, 13 kda (FKBP2, Accession NP_004461.2), a gene which ppiases accelerate the folding of proteins. Accordingly, utilities of GAM83 include diagnosis, prevention and treatment of diseases and clinical conditions associated with FKBP2.

The function of FKBP2 and its association with various diseases and clinical conditions, has been established by previous studies, as described hereinabove with reference to GAM44.1. Fk506 binding protein 2, 13 kda (FKBP2, Accession NP_476433.1) is another GAM83 target gene, herein designated TARGET GENE. FKBP2 BINDING SITE is a target binding site found in the 3' untranslated region of multiple transcripts of mRNA encoded by FKBP2, corresponding to a target binding site such as BINDING SITE I, BINDING SITE II or BINDING SITE III of FIG. 8. Table 4 illustrates the complementarity of the nucleotide sequences of FKBP2 BINDING SITE, designated SEQ ID:11911, to the nucleotide sequence of GAM83 RNA, herein designated GAM RNA, also designated SEQ ID:287.

Another function of GAM83 is therefore inhibition of Fk506 binding protein 2, 13 kda (FKBP2, Accession NP_476433.1), a gene which ppiases accelerate the folding of proteins. Accordingly, utilities of GAM83 include diagnosis, prevention and treatment of diseases and clinical conditions associated with FKBP2.

The function of FKBP2 and its association with various diseases and clinical conditions, has been established by previous studies, as described hereinabove with reference to GAM44.1. FLJ10945 (Accession NP_060750.1) is another GAM83 target gene, herein designated TARGET GENE. FLJ10945 BINDING SITE is a target binding site found in the 3' untranslated region of mRNA encoded by FLJ10945, corresponding to a target binding site such as BINDING SITE I, BINDING SITE II or BINDING SITE III of FIG. 8. Table 4 illustrates the complementarity of the nucleotide sequences of FLJ10945 BINDING SITE, designated SEQ ID:3221, to the nucleotide sequence of GAM83 RNA, herein designated GAM RNA, also designated SEQ ID:287.

Another function of GAM83 is therefore inhibition of FLJ10945 (Accession NP_060750.1). Accordingly, utilities of GAM83 include diagnosis, prevention and treatment of diseases and clinical conditions associated with FLJ10945.

FLJ11730 (Accession NP_073593.1) is another GAM83 target gene, herein designated TARGET GENE. FLJ11730 BINDING SITE is a target binding site found in the 3' untranslated region of mRNA encoded by FLJ11730, corresponding to a target binding site such as BINDING SITE I, BINDING SITE II or BINDING SITE III of FIG. 8. Table 4 illustrates the complementarity of the nucleotide sequences of FLJ11730 BINDING SITE, designated SEQ ID:13471, to the nucleotide sequence of GAM83 RNA, herein designated GAM RNA, also designated SEQ ID:287.

Another function of GAM83 is therefore inhibition of FLJ11730 (Accession NP_073593.1). Accordingly, utilities of GAM83 include diagnosis, prevention and treatment of diseases and clinical conditions associated with FLJ11730.

FLJ11871 (Accession NP_079393.1) is another GAM83 target gene, herein designated TARGET GENE. FLJ11871 BINDING SITE is a target binding site found in the 3' untranslated region of mRNA encoded by FLJ11871, corresponding to a target binding site such as BINDING SITE I, BINDING SITE II or BINDING SITE III of FIG. 8. Table 4 illustrates the complementarity of the nucleotide sequences of FLJ11871 BINDING SITE, designated SEQ ID:18221, to the nucleotide sequence of GAM83 RNA, herein designated GAM RNA, also designated SEQ ID:287.

Another function of GAM83 is therefore inhibition of FLJ11871 (Accession NP_079393.1). Accordingly, utilities of GAM83 include diagnosis, prevention and treatment of diseases and clinical conditions associated with FLJ11871.

FLJ12425 (Accession XP_098290.1) is another GAM83 target gene, herein designated TARGET GENE. FLJ12425 BINDING SITE is a target binding site found in the 3' untranslated region of mRNA encoded by FLJ12425, corresponding to a target binding site such as BINDING SITE I, BINDING SITE II or BINDING SITE III of FIG. 8. Table 4 illustrates the complementarity of the nucleotide sequences of FLJ12425 BINDING SITE, designated SEQ ID:7079, to the nucleotide sequence of GAM83 RNA, herein designated GAM RNA, also designated SEQ ID:287.

Another function of GAM83 is therefore inhibition of FLJ12425 (Accession XP_098290.1). Accordingly, utilities of GAM83 include diagnosis, prevention and treatment of diseases and clinical conditions associated with FLJ12425.

FLJ12529 (Accession NP_079087.2) is another GAM83 target gene, herein designated TARGET GENE. FLJ12529 BINDING SITE is a target binding site found in the 3' untranslated region of mRNA encoded by FLJ12529, corresponding to a target binding site such as BINDING SITE I, BINDING SITE II or BINDING SITE III of FIG. 8. Table 4 illustrates the complementarity of the nucleotide sequences of FLJ12529 BINDING SITE, designated SEQ ID:17806, to the nucleotide sequence of GAM83 RNA, herein designated GAM RNA, also designated SEQ ID:287.

Another function of GAM83 is therefore inhibition of FLJ12529 (Accession NP_079087.2). Accordingly, utilities of GAM83 include diagnosis, prevention and treatment of diseases and clinical conditions associated with FLJ12529.

FLJ13089 (Accession NP_079229.1) is another GAM83 target gene, herein designated TARGET GENE. FLJ13089 BINDING SITE is a target binding site found in the 3' untranslated region of mRNA encoded by FLJ13089, corresponding to a target binding site such as BINDING SITE I, BINDING SITE II or BINDING SITE III of FIG. 8. Table 4 illustrates the complementarity of the nucleotide sequences of FLJ13089 BINDING SITE, designated SEQ ID:10552, to the nucleotide sequence of GAM83 RNA, herein designated GAM RNA, also designated SEQ ID:287.

Another function of GAM83 is therefore inhibition of FLJ13089 (Accession NP_079229.1). Accordingly, utilities of GAM83 include diagnosis, prevention and treatment of diseases and clinical conditions associated with FLJ13089.

FLJ13848 (Accession NP_079047.1) is another GAM83 target gene, herein designated TARGET GENE. FLJ13848 BINDING SITE is a target binding site found in the 3' untranslated region of mRNA encoded by FLJ13848, corresponding to a target binding site such as BINDING SITE I, BINDING SITE II or BINDING SITE III of FIG. 8. Table 4 illustrates the complementarity of the nucleotide sequences of FLJ13848 BINDING SITE, designated SEQ ID:19252, to the nucleotide sequence of GAM83 RNA, herein designated GAM RNA, also designated SEQ ID:287.

Another function of GAM83 is therefore inhibition of FLJ13848 (Accession NP_079047.1). Accordingly, utilities of GAM83 include diagnosis, prevention and treatment of diseases and clinical conditions associated with FLJ13848.

FLJ14721 (Accession NP_116218.1) is another GAM83 target gene, herein designated TARGET GENE. FLJ14721 BINDING SITE is a target binding site found in the 3' untranslated region of mRNA encoded by FLJ14721, corresponding to a target binding site such as BINDING SITE I, BINDING SITE II or BINDING SITE III of FIG. 8. Table 4 illustrates the complementarity of the nucleotide sequences of FLJ14721 BINDING SITE, designated SEQ ID:14879, to the nucleotide sequence of GAM83 RNA, herein designated GAM RNA, also designated SEQ ID:287.

Another function of GAM83 is therefore inhibition of FLJ14721 (Accession NP_116218.1). Accordingly, utilities of GAM83 include diagnosis, prevention and treatment of diseases and clinical conditions associated with FLJ14721.

FLJ20856 (Accession NP_079419.1) is another GAM83 target gene, herein designated TARGET GENE. FLJ20856 BINDING SITE is a target binding site found in the 5' untranslated region of mRNA encoded by FLJ20856, corresponding to a target binding site such as BINDING SITE I, BINDING SITE II or BINDING SITE III of FIG. 8. Table 4 illustrates the complementarity of the nucleotide sequences of FLJ20856 BINDING SITE, designated SEQ ID:3537, to the nucleotide sequence of GAM83 RNA, herein designated GAM RNA, also designated SEQ ID:287.

Another function of GAM83 is therefore inhibition of FLJ20856 (Accession NP_079419.1). Accordingly, utilities of GAM83 include diagnosis, prevention and treatment of diseases and clinical conditions associated with FLJ20856.

FLJ21156 (Accession NP_078878.1) is another GAM83 target gene, herein designated TARGET GENE. FLJ21156 BINDING SITE is a target binding site found in the 3' untranslated region of mRNA encoded by FLJ21156, corresponding to a target binding site such as BINDING SITE I, BINDING SITE II or BINDING SITE III of FIG. 8. Table 4 illustrates the complementarity of the nucleotide sequences of FLJ21156 BINDING SITE, designated SEQ ID:485, to the nucleotide sequence of GAM83 RNA, herein designated GAM RNA, also designated SEQ ID:287.

Another function of GAM83 is therefore inhibition of FLJ21156 (Accession NP_078878.1). Accordingly, utilities of GAM83 include diagnosis, prevention and treatment of diseases and clinical conditions associated with FLJ21156.

FLJ23518 (Accession NP_079001.2) is another GAM83 target gene, herein designated TARGET GENE. FLJ23518 BINDING SITE is a target binding site found in the 3' untranslated region of mRNA encoded by FLJ23518, corresponding to a target binding site such as BINDING SITE I, BINDING SITE II or BINDING SITE III of FIG. 8. Table 4 illustrates the complementarity of the nucleotide sequences of FLJ23518 BINDING SITE, designated SEQ ID:11473, to the nucleotide sequence of GAM83 RNA, herein designated GAM RNA, also designated SEQ ID:287.

Another function of GAM83 is therefore inhibition of FLJ23518 (Accession NP_079001.2). Accordingly, utilities of GAM83 include diagnosis, prevention and treatment of diseases and clinical conditions associated with FLJ23518.

FLJ25534 (Accession NP_694966.2) is another GAM83 target gene, herein designated TARGET GENE. FLJ25534 BINDING SITE is a target binding site found in the 3' untranslated region of mRNA encoded by FLJ25534, corresponding to a target binding site such as BINDING SITE I, BINDING SITE II or BINDING SITE III of FIG. 8. Table 4 illustrates the complementarity of the nucleotide sequences of FLJ25534 BINDING SITE, designated SEQ ID:1034, to the nucleotide sequence of GAM83 RNA, herein designated GAM RNA, also designated SEQ ID:287.

Another function of GAM83 is therefore inhibition of FLJ25534 (Accession NP_694966.2). Accordingly, utilities of GAM83 include diagnosis, prevention and treatment of diseases and clinical conditions associated with FLJ25534.

FLJ30532 (Accession NP_653325.1) is another GAM83 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:1559, to the nucleotide sequence of GAM83 RNA, herein designated GAM RNA, also designated SEQ ID:287.

Another function of GAM83 is therefore inhibition of FLJ30532 (Accession NP_653325.1). Accordingly, utilities of GAM83 include diagnosis, prevention and treatment of diseases and clinical conditions associated with FLJ30532.

FLJ32069 (Accession NP_694578.1) is another GAM83 target gene, herein designated TARGET GENE. FLJ32069 BINDING SITE is a target binding site found in the 3' untranslated region of mRNA encoded by FLJ32069, corresponding to a target binding site such as BINDING SITE I, BINDING SITE II or BINDING SITE III of FIG. 8. Table 4 illustrates the complementarity of the nucleotide sequences of FLJ32069 BINDING SITE, designated SEQ ID:19969, to the nucleotide sequence of GAM83 RNA, herein designated GAM RNA, also designated SEQ ID:287.

Another function of GAM83 is therefore inhibition of FLJ32069 (Accession NP_694578.1). Accordingly, utilities of GAM83 include diagnosis, prevention and treatment of diseases and clinical conditions associated with FLJ32069.

FLJ32312 (Accession NP_653310.1) is another GAM83 target gene, herein designated TARGET GENE. FLJ32312 BINDING SITE is a target binding site found in the 3' untranslated region of mRNA encoded by FLJ32312, corresponding to a target binding site such as BINDING SITE I, BINDING SITE II or BINDING SITE III of FIG. 8. Table 4 illustrates the complementarity of the nucleotide sequences of FLJ32312 BINDING SITE, designated SEQ ID:6992, to the nucleotide sequence of GAM83 RNA, herein designated GAM RNA, also designated SEQ ID:287.

Another function of GAM83 is therefore inhibition of FLJ32312 (Accession NP_653310.1). Accordingly, utilities of GAM83 include diagnosis, prevention and treatment of diseases and clinical conditions associated with FLJ32312.

FLJ34047 (Accession NP_775940.1) is another GAM83 target gene, herein designated TARGET GENE. FLJ34047 BINDING SITE is a target binding site found in the 3' untranslated region of mRNA encoded by FLJ34047, corresponding to a target binding site such as BINDING SITE I, BINDING SITE II or BINDING SITE III of FIG. 8. Table 4 illustrates the complementarity of the nucleotide sequences of FLJ34047 BINDING SITE, designated SEQ ID:5426, to the nucleotide sequence of GAM83 RNA, herein designated GAM RNA, also designated SEQ ID:287.

Another function of GAM83 is therefore inhibition of FLJ34047 (Accession NP_775940.1). Accordingly, utilities of GAM83 include diagnosis, prevention and treatment of diseases and clinical conditions associated with FLJ34047.

FLJ39639 (Accession XP_290687.1) is another GAM83 target gene, herein designated TARGET GENE. FLJ39639 BINDING SITE is a target binding site found in the 3' untranslated region of mRNA encoded by FLJ39639, corresponding to a target binding site such as BINDING SITE I, BINDING SITE II or BINDING SITE III of FIG. 8. Table 4 illustrates the complementarity of the nucleotide sequences of FLJ39639 BINDING SITE, designated SEQ ID:7460, to the nucleotide sequence of GAM83 RNA, herein designated GAM RNA, also designated SEQ ID:287.

Another function of GAM83 is therefore inhibition of FLJ39639 (Accession XP_290687.1). Accordingly, utilities of GAM83 include diagnosis, prevention and treatment of diseases and clinical conditions associated with FLJ39639.

FLJ40288 (Accession NP_775953.1) is another GAM83 target gene, herein designated TARGET GENE. FLJ40288 BINDING SITE is a target binding site found in the 3' untranslated region of mRNA encoded by FLJ40288, corresponding to a target binding site such as BINDING SITE I, BINDING SITE II or BINDING SITE III of FIG. 8. Table 4 illustrates the complementarity of the nucleotide sequences of FLJ40288 BINDING SITE, designated SEQ ID:15256, to the nucleotide sequence of GAM83 RNA, herein designated GAM RNA, also designated SEQ ID:287.

Another function of GAM83 is therefore inhibition of FLJ40288 (Accession NP_775953.1). Accordingly, utilities of GAM83 include diagnosis, prevention and treatment of diseases and clinical conditions associated with FLJ40288.

Formin binding protein 4 (FNBP4, Accession NP_056123.1) is another GAM83 target gene, herein designated TARGET GENE. FNBP4 BINDING SITE is a target binding site found in the 3' untranslated region of mRNA encoded by FNBP4, corresponding to a target binding site such as BINDING SITE I, BINDING SITE II or BINDING SITE III of FIG. 8. Table 4 illustrates the complementarity of the nucleotide sequences of FNBP4 BINDING SITE, designated SEQ ID:13556, to the nucleotide sequence of GAM83 RNA, herein designated GAM RNA, also designated SEQ ID:287.

Another function of GAM83 is therefore inhibition of Formin binding protein 4 (FNBP4, Accession NP_056123.1). Accordingly, utilities of GAM83 include diagnosis, prevention and treatment of diseases and clinical conditions associated with FNBP4.

GAS8 (Accession NP_001472.1) is another GAM83 target gene, herein designated TARGET GENE. GAS8 BINDING SITE is a target binding site found in the 3' untranslated region of mRNA encoded by GAS8, corresponding to a target binding site such as BINDING SITE I, BINDING SITE II or BINDING SITE III of FIG. 8. Table 4 illustrates the complementarity of the nucleotide sequences of GAS8 BINDING SITE, designated SEQ ID:6978, to the nucleotide sequence of GAM83 RNA, herein designated GAM RNA, also designated SEQ ID:287.

Another function of GAM83 is therefore inhibition of GAS8 (Accession NP_001472.1). Accordingly, utilities of GAM83 include diagnosis, prevention and treatment of diseases and clinical conditions associated with GAS8.

Gata binding protein 2 (GATA2, Accession NP_116027.2) is another GAM83 target gene, herein designated TARGET GENE. GATA2 BINDING SITE is a target binding site found in the 3' untranslated region of mRNA encoded by GATA2, corresponding to a target binding site such as BINDING SITE I, BINDING SITE II or BINDING SITE III of FIG. 8. Table 4 illustrates the complementarity of the nucleotide sequences of GATA2 BINDING SITE, designated SEQ ID:2059, to the nucleotide sequence of GAM83 RNA, herein designated GAM RNA, also designated SEQ ID:287.

Another function of GAM83 is therefore inhibition of Gata binding protein 2 (GATA2, Accession NP_116027.2). Accordingly, utilities of GAM83 include diagnosis, prevention and treatment of diseases and clinical conditions associated with GATA2.

Glycosylphosphatidylinositol specific phospholipase d1 (GPLD1, Accession NP_001494.2) is another GAM83 target gene, herein designated TARGET GENE. GPLD1 BINDING SITE is a target binding site found in the 3' untranslated region of multiple transcripts of mRNA encoded by GPLD1, corresponding to a target binding site such as BINDING SITE I, BINDING SITE II or BINDING SITE III of FIG. 8. Table 4 illustrates the complementarity of the nucleotide sequences of GPLD1 BINDING SITE, designated SEQ ID:17577, to the nucleotide sequence of GAM83 RNA, herein designated GAM RNA, also designated SEQ ID:287.

Another function of GAM83 is therefore inhibition of Glycosylphosphatidylinositol specific phospholipase d1 (GPLD1, Accession NP_001494.2), a gene which hydrolyses the inositol phosphate linkage in proteins anchored by phosphatidylinositol glycans to release these proteins from the membrane. Accordingly, utilities of GAM83 include diagnosis, prevention and treatment of diseases and clinical conditions associated with GPLD1.

The function of GPLD1 and its association with various diseases and clinical conditions, has been established by previous studies, as described hereinabove with reference to GAM44.1. G protein-coupled receptor 68 (GPR68, Accession NP_003476.1) is another GAM83 target gene, herein designated TARGET GENE. GPR68 BINDING SITE is a target binding site found in the 5' untranslated region of mRNA encoded by GPR68, corresponding to a target binding site such as BINDING SITE I, BINDING SITE II or BINDING SITE III of FIG. 8. Table 4 illustrates the complementarity of the nucleotide sequences of GPR68 BINDING SITE, designated SEQ ID:4765, to the nucleotide sequence of GAM83 RNA, herein designated GAM RNA, also designated SEQ ID:287.

Another function of GAM83 is therefore inhibition of G protein-coupled receptor 68 (GPR68, Accession NP_003476.1). Accordingly, utilities of GAM83 include diagnosis, prevention and treatment of diseases and clinical conditions associated with GPR68.

G protein-coupled receptor 77 (GPR77, Accession NP_060955.1) is another GAM83 target gene, herein designated TARGET GENE. GPR77 BINDING SITE is a target binding site found in the 5' untranslated region of mRNA encoded by GPR77, corresponding to a target binding site such as BINDING SITE I, BINDING SITE II or BINDING SITE III of FIG. 8. Table 4 illustrates the complementarity of the nucleotide sequences of GPR77 BINDING SITE, designated SEQ ID:2326, to the nucleotide sequence of GAM83 RNA, herein designated GAM RNA, also designated SEQ ID:287.

Another function of GAM83 is therefore inhibition of G protein-coupled receptor 77 (GPR77, Accession NP_060955.1). Accordingly, utilities of GAM83 include diagnosis, prevention and treatment of diseases and clinical conditions associated with GPR77.

GW112 (Accession NP_006409.2) is another GAM83 target gene, herein designated TARGET GENE. GW112 BINDING SITE is a target binding site found in the 5' untranslated region of mRNA encoded by GW112, corresponding to a target binding site such as BINDING SITE I, BINDING SITE II or BINDING SITE III of FIG. 8. Table 4 illustrates the complementarity of the nucleotide sequences of GW112 BINDING SITE, designated SEQ ID:17202, to the nucleotide sequence of GAM83 RNA, herein designated GAM RNA, also designated SEQ ID:287.

Another function of GAM83 is therefore inhibition of GW112 (Accession NP_006409.2). Accordingly, utilities of GAM83 include diagnosis, prevention and treatment of diseases and clinical conditions associated with GW112.

Hepatitis a virus cellular receptor 1 (HAVCR1, Accession NP_036338.1) is another GAM83 target gene, herein designated TARGET GENE. HAVCR1 BINDING SITE is a target binding site found in the 3' untranslated region of mRNA encoded by HAVCR1, corresponding to a target binding site such as BINDING SITE I, BINDING SITE II or BINDING SITE III of FIG. 8. Table 4 illustrates the complementarity of the nucleotide sequences of HAVCR1 BINDING SITE, designated SEQ ID:1838, to the nucleotide sequence of GAM83 RNA, herein designated GAM RNA, also designated SEQ ID:287.

Another function of GAM83 is therefore inhibition of Hepatitis a virus cellular receptor 1 (HAVCR1, Accession NP_036338.1). Accordingly, utilities of GAM83 include diagnosis, prevention and treatment of diseases and clinical conditions associated with HAVCR1.

Homeo box b7 (HOXB7, Accession NP_004493.2) is another GAM83 target gene, herein designated TARGET GENE. HOXB7 BINDING SITE is a target binding site found in the 3' untranslated region of mRNA encoded by HOXB7, corresponding to a target binding site such as BINDING SITE I, BINDING SITE II or BINDING SITE III of FIG. 8. Table 4 illustrates the complementarity of the nucleotide sequences of HOXB7 BINDING SITE, designated SEQ ID:14802, to the nucleotide sequence of GAM83 RNA, herein designated GAM RNA, also designated SEQ ID:287.

Another function of GAM83 is therefore inhibition of Homeo box b7 (HOXB7, Accession NP_004493.2), a gene which is a member of homeodomain family of DNA binding proteins; may regulate gene expression, morphogenesis, and differentiation. Accordingly, utilities of GAM83 include diagnosis, prevention and treatment of diseases and clinical conditions associated with HOXB7.

The function of HOXB7 and its association with various diseases and clinical conditions, has been established by previous studies, as described hereinabove with reference to GAM44.1. Hermansky-pudlak syndrome 3 (HPS3, Accession NP_115759.2) is another GAM83 target gene, herein designated TARGET GENE. HPS3 BINDING SITE is a target binding site found in the 3' untranslated region of mRNA encoded by HPS3, corresponding to a target binding site such as BINDING SITE I, BINDING SITE II or BINDING SITE III of FIG. 8. Table 4 illustrates the complementarity of the nucleotide sequences of HPS3 BINDING SITE, designated SEQ ID:10776, to the nucleotide sequence of GAM83 RNA, herein designated GAM RNA, also designated SEQ ID:287.

Another function of GAM83 is therefore inhibition of Hermansky-pudlak syndrome 3 (HPS3, Accession NP_115759.2). Accordingly, utilities of GAM83 include diagnosis, prevention and treatment of diseases and clinical conditions associated with HPS3.

HSPC133 (Accession NP_054887.1) is another GAM83 target gene, herein designated TARGET GENE. HSPC133 BINDING SITE is a target binding site found in the 3' untranslated region of mRNA encoded by HSPC133, corresponding to a target binding site such as BINDING SITE I, BINDING SITE II or BINDING SITE III of FIG. 8. Table 4 illustrates the complementarity of the nucleotide sequences of HSPC133 BINDING SITE, designated SEQ ID:19037, to the nucleotide sequence of GAM83 RNA, herein designated GAM RNA, also designated SEQ ID:287.

Another function of GAM83 is therefore inhibition of HSPC133 (Accession NP_054887.1). Accordingly, utilities of GAM83 include diagnosis, prevention and treatment of diseases and clinical conditions associated with HSPC133.

HT001 (Accession NP_054784.1) is another GAM83 target gene, herein designated TARGET GENE. HT001 BINDING SITE is a target binding site found in the 5' untranslated region of mRNA encoded by HT001, corresponding to a target binding site such as BINDING SITE I, BINDING SITE II or BINDING SITE III of FIG. 8. Table 4 illustrates the complementarity of the nucleotide sequences of HT001 BINDING SITE, designated SEQ ID:2559, to the nucleotide sequence of GAM83 RNA, herein designated GAM RNA, also designated SEQ ID:287.

Another function of GAM83 is therefore inhibition of HT001 (Accession NP_054784.1). Accordingly, utilities of GAM83 include diagnosis, prevention and treatment of diseases and clinical conditions associated with HT001.

ICK (Accession NP_057597.2) is another GAM83 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:4546, to the nucleotide sequence of GAM83 RNA, herein designated GAM RNA, also designated SEQ ID:287.

Another function of GAM83 is therefore inhibition of ICK (Accession NP_057597.2). Accordingly, utilities of GAM83 include diagnosis, prevention and treatment of diseases and clinical conditions associated with ICK.

ICK (Accession NP_055735.1) is another GAM83 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:4546, to the nucleotide sequence of GAM83 RNA, herein designated GAM RNA, also designated SEQ ID:287.

Another function of GAM83 is therefore inhibition of ICK (Accession NP_055735.1). Accordingly, utilities of GAM83 include diagnosis, prevention and treatment of diseases and clinical conditions associated with ICK.

Insulin-like growth factor 2 receptor (IGF2R, Accession NP_000867.1) is another GAM83 target gene, herein designated TARGET GENE. IGF2R BINDING SITE is a target binding site found in the 3' untranslated region of mRNA encoded by IGF2R, corresponding to a target binding site such as BINDING SITE I, BINDING SITE II or BINDING SITE III of FIG. 8. Table 4 illustrates the complementarity of the nucleotide sequences of IGF2R BINDING SITE, designated SEQ ID:11950, to the nucleotide sequence of GAM83 RNA, herein designated GAM RNA, also designated SEQ ID:287.

Another function of GAM83 is therefore inhibition of Insulin-like growth factor 2 receptor (IGF2R, Accession NP_000867.1), a gene which transport of phosphorylated lysosomal enzymes from the golgi complex and the cell surface to lysosomes. lysosomal enzymes bearing phosphomannosyl residues bind specifically to mannose-6-phosphate receptors in the golgi apparatus and the resulting receptor-ligand complex is transported to an acidic prelyosomal compartment where the low ph mediates the dissociation of the complex. this receptor also binds insulin growth factor ii. and therefore may be associated with Hepatocellular carcinoma, somatic. Accordingly, utilities of GAM83 include diagnosis, prevention and treatment of Hepatocellular carcinoma, somatic, and of other diseases and clinical conditions associated with IGF2R.

The function of IGF2R and its association with various diseases and clinical conditions, has been established by previous studies, as described hereinabove with reference to GAM44.1. Interleukin 28 receptor, alpha (IL28RA, Accession NP_775088.1) is another GAM83 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:3043, to the nucleotide sequence of GAM83 RNA, herein designated GAM RNA, also designated SEQ ID:287.

Another function of GAM83 is therefore inhibition of Interleukin 28 receptor, alpha (IL28RA, Accession NP_775088.1). Accordingly, utilities of GAM83 include diagnosis, prevention and treatment of diseases and clinical conditions associated with IL28RA.

IMMP2L (Accession NP_115938.1) is another GAM83 target gene, herein designated TARGET GENE. IMMP2L BINDING SITE is a target binding site found in the 3' untranslated region of mRNA encoded by IMMP2L, corresponding to a target binding site such as BINDING SITE I, BINDING SITE II or BINDING SITE III of FIG. 8. Table 4 illustrates the complementarity of the nucleotide sequences of IMMP2L BINDING SITE, designated SEQ ID:2346, to the nucleotide sequence of GAM83 RNA, herein designated GAM RNA, also designated SEQ ID:287.

Another function of GAM83 is therefore inhibition of IMMP2L (Accession NP_115938.1), a gene which is a HOMOLOG of YEAST INNER MITOCHONDRIAL MEMBRANE PEPTIDASE. and therefore may be associated with Tourette syndrome. Accordingly, utilities of GAM83 include diagnosis, prevention and treatment of Tourette syndrome, and of other diseases and clinical conditions associated with IMMP2L.

The function of IMMP2L and its association with various diseases and clinical conditions, has been established by previous studies, as described hereinabove with reference to GAM44.1. Inositol polyphosphate-5-phosphatase, 72 kda (INPP5E, Accession NP_063945.1) is another GAM83 target gene, herein designated TARGET GENE. INPP5E BINDING SITE is a target binding site found in the 3' untranslated region of mRNA encoded by INPP5E, corresponding to a target binding site such as BINDING SITE I, BINDING SITE II or BINDING SITE III of FIG. 8. Table 4 illustrates the complementarity of the nucleotide sequences of INPP5E BINDING SITE, designated SEQ ID:17360, to the nucleotide sequence of GAM83 RNA, herein designated GAM RNA, also designated SEQ ID:287.

Another function of GAM83 is therefore inhibition of Inositol polyphosphate-5-phosphatase, 72 kda (INPP5E, Accession NP_063945.1). Accordingly, utilities of GAM83 include diagnosis, prevention and treatment of diseases and clinical conditions associated with INPP5E.

Il2-inducible t-cell kinase (ITK, Accession NP_005537.3) is another GAM83 target gene, herein designated TARGET GENE. ITK BINDING SITE is a target binding site found in the 5' untranslated region of mRNA encoded by ITK, corresponding to a target binding site such as BINDING SITE I, BINDING SITE II or BINDING SITE III of FIG. 8. Table 4 illustrates the complementarity of the nucleotide sequences of ITK BINDING SITE, designated SEQ ID:1134, to the nucleotide sequence of GAM83 RNA, herein designated GAM RNA, also designated SEQ ID:287.

Another function of GAM83 is therefore inhibition of Il2-inducible t-cell kinase (ITK, Accession NP_005537.3), a gene which plays a role in t cell proliferation and differentiation. and therefore may be associated with Myelodysplastic syndrome. Accordingly, utilities of GAM83 include diagnosis, prevention and treatment of Myelodysplastic syndrome, and of other diseases and clinical conditions associated with ITK.

The function of ITK and its association with various diseases and clinical conditions, has been established by previous studies, as described hereinabove with reference to GAM44.1. KIAA0391 (Accession NP_055487.1) is another GAM83 target gene, herein designated TARGET GENE. KIAA0391 BINDING SITE is a target binding site found in the 5' untranslated region of mRNA encoded by KIAA0391, corresponding to a target binding site such as BINDING SITE I, BINDING SITE II or BINDING SITE III of FIG. 8. Table 4 illustrates the complementarity of the nucleotide sequences of KIAA0391 BINDING SITE, designated SEQ ID:728, to the nucleotide sequence of GAM83 RNA, herein designated GAM RNA, also designated SEQ ID:287.

Another function of GAM83 is therefore inhibition of KIAA0391 (Accession NP_055487.1). Accordingly, utilities of GAM83 include diagnosis, prevention and treatment of diseases and clinical conditions associated with KIAA0391.

KIAA0523 (Accession XP_041964.5) is another GAM83 target gene, herein designated TARGET GENE. KIAA0523 BINDING SITE is a target binding site found in the 3' untranslated region of mRNA encoded by KIAA0523, corresponding to a target binding site such as BINDING SITE I, BINDING SITE II or BINDING SITE III of FIG. 8. Table 4 illustrates the complementarity of the nucleotide sequences of KIAA0523 BINDING SITE, designated SEQ ID:2007, to the nucleotide sequence of GAM83 RNA, herein designated GAM RNA, also designated SEQ ID:287.

Another function of GAM83 is therefore inhibition of KIAA0523 (Accession XP_041964.5). Accordingly, utilities of GAM83 include diagnosis, prevention and treatment of diseases and clinical conditions associated with KIAA0523.

KIAA0789 (Accession XP_033113.1) is another GAM83 target gene, herein designated TARGET GENE. KIAA0789 BINDING SITE is a target binding site found in the 3' untranslated region of mRNA encoded by KIAA0789, corresponding to a target binding site such as BINDING SITE I, BINDING SITE II or BINDING SITE III of FIG. 8. Table 4 illustrates the complementarity of the nucleotide sequences of KIAA0789 BINDING SITE, designated SEQ ID:1640, to the nucleotide sequence of GAM83 RNA, herein designated GAM RNA, also designated SEQ ID:287.

Another function of GAM83 is therefore inhibition of KIAA0789 (Accession XP_033113.1). Accordingly, utilities of GAM83 include diagnosis, prevention and treatment of diseases and clinical conditions associated with KIAA0789.

KIAA0984 (Accession XP_037557.2) is another GAM83 target gene, herein designated TARGET GENE. KIAA0984 BINDING SITE is a target binding site found in the 3' untranslated region of mRNA encoded by KIAA0984, corresponding to a target binding site such as BINDING SITE I, BINDING SITE II or BINDING SITE III of FIG. 8. Table 4 illustrates the complementarity of the nucleotide sequences of KIAA0984 BINDING SITE, designated SEQ ID:12474, to the nucleotide sequence of GAM83 RNA, herein designated GAM RNA, also designated SEQ ID:287.

Another function of GAM83 is therefore inhibition of KIAA0984 (Accession XP_037557.2). Accordingly, utilities of GAM83 include diagnosis, prevention and treatment of diseases and clinical conditions associated with KIAA0984.

KIAA1332 (Accession XP_048774.2) is another GAM83 target gene, herein designated TARGET GENE. KIAA1332 BINDING SITE is a target binding site found in the 3' untranslated region of mRNA encoded by KIAA1332, corresponding to a target binding site such as BINDING SITE I, BINDING SITE II or BINDING SITE III of FIG. 8. Table 4 illustrates the complementarity of the nucleotide sequences of KIAA1332 BINDING SITE, designated SEQ ID:12318, to the nucleotide sequence of GAM83 RNA, herein designated GAM RNA, also designated SEQ ID:287.

Another function of GAM83 is therefore inhibition of KIAA1332 (Accession XP_048774.2). Accordingly, utilities of GAM83 include diagnosis, prevention and treatment of diseases and clinical conditions associated with KIAA1332.

KIAA1684 (Accession XP_290806.1) is another GAM83 target gene, herein designated TARGET GENE. KIAA1684 BINDING SITE is a target binding site found in the 3' untranslated region of mRNA encoded by KIAA1684, corresponding to a target binding site such as BINDING SITE I, BINDING SITE II or BINDING SITE III of FIG. 8. Table 4 illustrates the complementarity of the nucleotide sequences of KIAA1684 BINDING SITE, designated SEQ ID:12907, to the nucleotide sequence of GAM83 RNA, herein designated GAM RNA, also designated SEQ ID:287.

Another function of GAM83 is therefore inhibition of KIAA1684 (Accession XP_290806.1). Accordingly, utilities of GAM83 include diagnosis, prevention and treatment of diseases and clinical conditions associated with KIAA1684.

KIAA1720 (Accession NP_085148.1) is another GAM83 target gene, herein designated TARGET GENE. KIAA1720 BINDING SITE is a target binding site found in the 3' untranslated region of mRNA encoded by KIAA1720, corresponding to a target binding site such as BINDING SITE I, BINDING SITE II or BINDING SITE III of FIG. 8. Table 4 illustrates the complementarity of the nucleotide sequences of KIAA1720 BINDING SITE, designated SEQ ID:15787, to the nucleotide sequence of GAM83 RNA, herein designated GAM RNA, also designated SEQ ID:287.

Another function of GAM83 is therefore inhibition of KIAA1720 (Accession NP_085148.1). Accordingly, utilities of GAM83 include diagnosis, prevention and treatment of diseases and clinical conditions associated with KIAA1720.

KIAA1920 (Accession XP_085210.1) is another GAM83 target gene, herein designated TARGET GENE. KIAA1920 BINDING SITE is a target binding site found in the 5' untranslated region of mRNA encoded by KIAA1920, corresponding to a target binding site such as BINDING SITE I, BINDING SITE II or BINDING SITE III of FIG. 8. Table 4 illustrates the complementarity of the nucleotide sequences of KIAA1920 BINDING SITE, designated SEQ ID:8388, to the nucleotide sequence of GAM83 RNA, herein designated GAM RNA, also designated SEQ ID:287.

Another function of GAM83 is therefore inhibition of KIAA1920 (Accession XP_085210.1). Accordingly, utilities of GAM83 include diagnosis, prevention and treatment of diseases and clinical conditions associated with KIAA1920.

KIAA1946 (Accession NP_803237.1) is another GAM83 target gene, herein designated TARGET GENE. KIAA1946 BINDING SITE is a target binding site found in the 3' untranslated region of mRNA encoded by KIAA1946, corresponding to a target binding site such as BINDING SITE I, BINDING SITE II or BINDING SITE III of FIG. 8. Table 4 illustrates the complementarity of the nucleotide sequences of KIAA1946 BINDING SITE, designated SEQ ID:8568, to the nucleotide sequence of GAM83 RNA, herein designated GAM RNA, also designated SEQ ID:287.

Another function of GAM83 is therefore inhibition of KIAA1946 (Accession NP_803237.1). Accordingly, utilities of GAM83 include diagnosis, prevention and treatment of diseases and clinical conditions associated with KIAA1946.

Karyopherin alpha 6 (importin alpha 7) (KPNA6, Accession NP_036448.1) is another GAM83 target gene, herein designated TARGET GENE. KPNA6 BINDING SITE is a target binding site found in the 3' untranslated region of mRNA encoded by KPNA6, corresponding to a target binding site such as BINDING SITE I, BINDING SITE II or BINDING SITE III of FIG. 8. Table 4 illustrates the complementarity of the nucleotide sequences of KPNA6 BINDING SITE, designated SEQ ID:16094, to the nucleotide sequence of GAM83 RNA, herein designated GAM RNA, also designated SEQ ID:287.

Another function of GAM83 is therefore inhibition of Karyopherin alpha 6 (importin alpha 7) (KPNA6, Accession NP_036448.1). Accordingly, utilities of GAM83 include diagnosis, prevention and treatment of diseases and clinical conditions associated with KPNA6.

Like-glycosyltransferase (LARGE, Accession NP_004728.1) is another GAM83 target gene, herein designated TARGET GENE. LARGE BINDING SITE is a target binding site found in the 3' untranslated region of multiple transcripts of mRNA encoded by LARGE, corresponding to a target binding site such as BINDING SITE I, BINDING SITE II or BINDING SITE III of FIG. 8. Table 4 illustrates the complementarity of the nucleotide sequences of LARGE BINDING SITE, designated SEQ ID:14179, to the nucleotide sequence of GAM83 RNA, herein designated GAM RNA, also designated SEQ ID:287.

Another function of GAM83 is therefore inhibition of Like-glycosyltransferase (LARGE, Accession NP_004728.1), a gene which is a member of the N-acetylglucosaminyltransferase family. Accordingly, utilities of GAM83 include diagnosis, prevention and treatment of diseases and clinical conditions associated with LARGE.

The function of LARGE and its association with various diseases and clinical conditions, has been established by previous studies, as described hereinabove with reference to GAM44.1. Like-glycosyltransferase (LARGE, Accession NP_598397.1) is another GAM83 target gene, herein designated TARGET GENE. LARGE BINDING SITE is a target binding site found in the 3' untranslated region of multiple transcripts of mRNA encoded by LARGE, corresponding to a target binding site such as BINDING SITE I, BINDING SITE II or BINDING SITE III of FIG. 8. Table 4 illustrates the complementarity of the nucleotide sequences of LARGE BINDING SITE, designated SEQ ID:14179, to the nucleotide sequence of GAM83 RNA, herein designated GAM RNA, also designated SEQ ID:287.

Another function of GAM83 is therefore inhibition of Like-glycosyltransferase (LARGE, Accession NP_598397.1), a gene which is a member of the N-acetylglucosaminyltransferase family. Accordingly, utilities of GAM83 include diagnosis, prevention and treatment of diseases and clinical conditions associated with LARGE.

The function of LARGE and its association with various diseases and clinical conditions, has been established by previous studies, as described hereinabove with reference to GAM44.1. LAX (Accession NP_060243.1) is another GAM83 target gene, herein designated TARGET GENE. LAX BINDING SITE is a target binding site found in the 3' untranslated region of mRNA encoded by LAX, corresponding to a target binding site such as BINDING SITE I, BINDING SITE II or BINDING SITE III of FIG. 8. Table 4 illustrates the complementarity of the nucleotide sequences of LAX BINDING SITE, designated SEQ ID:9263, to the nucleotide sequence of GAM83 RNA, herein designated GAM RNA, also designated SEQ ID:287.

Another function of GAM83 is therefore inhibition of LAX (Accession NP_060243.1). Accordingly, utilities of GAM83 include diagnosis, prevention and treatment of diseases and clinical conditions associated with LAX.

Leucine zipper, down-regulated in cancer 1 (LDOC1, Accession NP_036449.1) is another GAM83 target gene, herein designated TARGET GENE. LDOC1 BINDING SITE is a target binding site found in the 3' untranslated region of mRNA encoded by LDOC1, corresponding to a target binding site such as BINDING SITE I, BINDING SITE II or BINDING SITE III of FIG. 8. Table 4 illustrates the complementarity of the nucleotide sequences of LDOC1 BINDING SITE, designated SEQ ID:2933, to the nucleotide sequence of GAM83 RNA, herein designated GAM RNA, also designated SEQ ID:287.

Another function of GAM83 is therefore inhibition of Leucine zipper, down-regulated in cancer 1 (LDOC1, Accession NP_036449.1). Accordingly, utilities of GAM83 include diagnosis, prevention and treatment of diseases and clinical conditions associated with LDOC1.

Lipoma hmgic fusion partner (LHFP, Accession NP_005771.1) is another GAM83 target gene, herein designated TARGET GENE. LHFP BINDING SITE is a target binding site found in the 3' untranslated region of mRNA encoded by LHFP, corresponding to a target binding site such as BINDING SITE I, BINDING SITE II or BINDING SITE III of FIG. 8. Table 4 illustrates the complementarity of the nucleotide sequences of LHFP BINDING SITE, designated SEQ ID:12839, to the nucleotide sequence of GAM83 RNA, herein designated GAM RNA, also designated SEQ ID:287.

Another function of GAM83 is therefore inhibition of Lipoma hmgic fusion partner (LHFP, Accession NP_005771.1). Accordingly, utilities of GAM83 include diagnosis, prevention and treatment of diseases and clinical conditions associated with LHFP.

Lin-7 homolog a (c. elegans) (LIN7A, Accession NP_004655.1) is another GAM83 target gene, herein designated TARGET GENE. LIN7A BINDING SITE is a target binding site found in the 5' untranslated region of mRNA encoded by LIN7A, corresponding to a target binding site such as BINDING SITE I, BINDING SITE II or BINDING SITE III of FIG. 8. Table 4 illustrates the complementarity of the nucleotide sequences of LIN7A BINDING SITE, designated SEQ ID:3012, to the nucleotide sequence of GAM83 RNA, herein designated GAM RNA, also designated SEQ ID:287.

Another function of GAM83 is therefore inhibition of Lin-7 homolog a (c. elegans) (LIN7A, Accession NP_004655.1). Accordingly, utilities of GAM83 include diagnosis, prevention and treatment of diseases and clinical conditions associated with LIN7A.

LOC118987 (Accession NP_776152.1) is another GAM83 target gene, herein designated TARGET GENE. LOC118987 BINDING SITE is a target binding site found in the 3' untranslated region of mRNA encoded by LOC118987, corresponding to a target binding site such as BINDING SITE I, BINDING SITE II or BINDING SITE III of FIG. 8. Table 4 illustrates the complementarity of the nucleotide sequences of LOC118987 BINDING SITE, designated SEQ ID:9092, to the nucleotide sequence of GAM83 RNA, herein designated GAM RNA, also designated SEQ ID:287.

Another function of GAM83 is therefore inhibition of LOC118987 (Accession NP_776152.1). Accordingly, utilities of GAM83 include diagnosis, prevention and treatment of diseases and clinical conditions associated with LOC118987.

LOC126017 (Accession XP_064903.7) is another GAM83 target gene, herein designated TARGET GENE. LOC126017 BINDING SITE is a target binding site found in the 3' untranslated region of mRNA encoded by LOC126017, corresponding to a target binding site such as BINDING SITE I, BINDING SITE II or BINDING SITE III of FIG. 8. Table 4 illustrates the complementarity of the nucleotide sequences of LOC126017 BINDING SITE, designated SEQ ID:19476, to the nucleotide sequence of GAM83 RNA, herein designated GAM RNA, also designated SEQ ID:287.

Another function of GAM83 is therefore inhibition of LOC126017 (Accession XP_064903.7). Accordingly, utilities of GAM83 include diagnosis, prevention and treatment of diseases and clinical conditions associated with LOC126017.

LOC126731 (Accession NP_660300.1) is another GAM83 target gene, herein designated TARGET GENE. LOC126731 BINDING SITE is a target binding site found in the 3' untranslated region of mRNA encoded by LOC126731, corresponding to a target binding site such as BINDING SITE I, BINDING SITE II or BINDING SITE III of FIG. 8. Table 4 illustrates the complementarity of the nucleotide sequences of LOC126731 BINDING SITE, designated SEQ ID:18542, to the nucleotide sequence of GAM83 RNA, herein designated GAM RNA, also designated SEQ ID:287.

Another function of GAM83 is therefore inhibition of LOC126731 (Accession NP_660300.1). Accordingly, utilities of GAM83 include diagnosis, prevention and treatment of diseases and clinical conditions associated with LOC126731.

LOC130752 (Accession XP_059468.3) is another GAM83 target gene, herein designated TARGET GENE. LOC130752 BINDING SITE is a target binding site found in the 3' untranslated region of mRNA encoded by LOC130752, corresponding to a target binding site such as BINDING SITE I, BINDING SITE II or BINDING SITE III of FIG. 8. Table 4 illustrates the complementarity of the nucleotide sequences of LOC130752 BINDING SITE, designated SEQ ID:10734, to the nucleotide sequence of GAM83 RNA, herein designated GAM RNA, also designated SEQ ID:287.

Another function of GAM83 is therefore inhibition of LOC130752 (Accession XP_059468.3). Accordingly, utilities of GAM83 include diagnosis, prevention and treatment of diseases and clinical conditions associated with LOC130752.

LOC144486 (Accession XP_096608.1) is another GAM83 target gene, herein designated TARGET GENE. LOC144486 BINDING SITE is a target binding site found in the 3' untranslated region of mRNA encoded by LOC144486, corresponding to a target binding site such as BINDING SITE I, BINDING SITE II or BINDING SITE III of FIG. 8. Table 4 illustrates the complementarity of the nucleotide sequences of LOC144486 BINDING SITE, designated SEQ ID:16849, to the nucleotide sequence of GAM83 RNA, herein designated GAM RNA, also designated SEQ ID:287.

Another function of GAM83 is therefore inhibition of LOC144486 (Accession XP_096608.1). Accordingly, utilities of GAM83 include diagnosis, prevention and treatment of diseases and clinical conditions associated with LOC144486.

LOC145053 (Accession XP_096714.1) is another GAM83 target gene, herein designated TARGET GENE. LOC145053 BINDING SITE is a target binding site found in the 3' untranslated region of mRNA encoded by LOC145053, corresponding to a target binding site such as BINDING SITE I, BINDING SITE II or BINDING SITE III of FIG. 8. Table 4 illustrates the complementarity of the nucleotide sequences of LOC145053 BINDING SITE, designated SEQ ID:16596, to the nucleotide sequence of GAM83 RNA, herein designated GAM RNA, also designated SEQ ID:287.

Another function of GAM83 is therefore inhibition of LOC145053 (Accession XP_096714.1). Accordingly, utilities of GAM83 include diagnosis, prevention and treatment of diseases and clinical conditions associated with LOC145053.

LOC145216 (Accession XP_096730.1) is another GAM83 target gene, herein designated TARGET GENE. LOC145216 BINDING SITE is a target binding site found in the 3' untranslated region of mRNA encoded by LOC145216, corresponding to a target binding site such as BINDING SITE I, BINDING SITE II or BINDING SITE III of FIG. 8. Table 4 illustrates the complementarity of the nucleotide sequences of LOC145216 BINDING SITE, designated SEQ ID:18659, to the nucleotide sequence of GAM83 RNA, herein designated GAM RNA, also designated SEQ ID:287.

Another function of GAM83 is therefore inhibition of LOC145216 (Accession XP_096730.1). Accordingly, utilities of GAM83 include diagnosis, prevention and treatment of diseases and clinical conditions associated with LOC145216.

LOC146227 (Accession XP_085374.2) is another GAM83 target gene, herein designated TARGET GENE. LOC146227 BINDING SITE is a target binding site found in the 3' untranslated region of mRNA encoded by LOC146227, corresponding to a target binding site such as BINDING SITE I, BINDING SITE II or BINDING SITE III of FIG. 8. Table 4 illustrates the complementarity of the nucleotide sequences of LOC146227 BINDING SITE, designated SEQ ID:1810, to the nucleotide sequence of GAM83 RNA, herein designated GAM RNA, also designated SEQ ID:287.

Another function of GAM83 is therefore inhibition of LOC146227 (Accession XP_085374.2). Accordingly, utilities of GAM83 include diagnosis, prevention and treatment of diseases and clinical conditions associated with LOC146227.

LOC146443 (Accession XP_085461.6) is another GAM83 target gene, herein designated TARGET GENE. LOC146443 BINDING SITE is a target binding site found in the 3' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:15013, to the nucleotide sequence of GAM83 RNA, herein designated GAM RNA, also designated SEQ ID:287.

Another function of GAM83 is therefore inhibition of LOC146443 (Accession XP_085461.6). Accordingly, utilities of GAM83 include diagnosis, prevention and treatment of diseases and clinical conditions associated with LOC146443.

LOC146728 (Accession XP_097074.1) is another GAM83 target gene, herein designated TARGET GENE. LOC146728 BINDING SITE is a target binding site found in the 5' untranslated region of mRNA encoded by LOC146728, corresponding to a target binding site such as BINDING SITE I, BINDING SITE II or BINDING SITE III of FIG. 8. Table 4 illustrates the complementarity of the nucleotide sequences of LOC146728 BINDING SITE, designated SEQ ID:16534, to the nucleotide sequence of GAM83 RNA, herein designated GAM RNA, also designated SEQ ID:287.

Another function of GAM83 is therefore inhibition of LOC146728 (Accession XP_097074.1). Accordingly, utilities of GAM83 include diagnosis, prevention and treatment of diseases and clinical conditions associated with LOC146728.

LOC146856 (Accession XP_096086.1) is another GAM83 target gene, herein designated TARGET GENE. LOC146856 BINDING SITE is a target binding site found in the 3' untranslated region of mRNA encoded by LOC146856, corresponding to a target binding site such as BINDING SITE I, BINDING SITE II or BINDING SITE III of FIG. 8. Table 4 illustrates the complementarity of the nucleotide sequences of LOC146856 BINDING SITE, designated SEQ ID:17740, to the nucleotide sequence of GAM83 RNA, herein designated GAM RNA, also designated SEQ ID:287.

Another function of GAM83 is therefore inhibition of LOC146856 (Accession XP_096086.1). Accordingly, utilities of GAM83 include diagnosis, prevention and treatment of diseases and clinical conditions associated with LOC146856.

LOC147947 (Accession XP_085974.1) is another GAM83 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:6702, to the nucleotide sequence of GAM83 RNA, herein designated GAM RNA, also designated SEQ ID:287.

Another function of GAM83 is therefore inhibition of LOC147947 (Accession XP_085974.1). Accordingly, utilities of GAM83 include diagnosis, prevention and treatment of diseases and clinical conditions associated with LOC147947.

LOC148490 (Accession XP_086210.2) is another GAM83 target gene, herein designated TARGET GENE. LOC148490 BINDING SITE is a target binding site found in the 5' untranslated region of mRNA encoded by LOC148490, corresponding to a target binding site such as BINDING SITE I, BINDING SITE II or BINDING SITE III of FIG. 8. Table 4 illustrates the complementarity of the nucleotide sequences of LOC148490 BINDING SITE, designated SEQ ID:18524, to the nucleotide sequence of GAM83 RNA, herein designated GAM RNA, also designated SEQ ID:287.

Another function of GAM83 is therefore inhibition of LOC148490 (Accession XP_086210.2). Accordingly, utilities of GAM83 include diagnosis, prevention and treatment of diseases and clinical conditions associated with LOC148490.

LOC149420 (Accession NP_690048.1) is another GAM83 target gene, herein designated TARGET GENE. LOC149420 BINDING SITE is a target binding site found in the 5' untranslated region of mRNA encoded by LOC149420, corresponding to a target binding site such as BINDING SITE I, BINDING SITE II or BINDING SITE III of FIG. 8. Table 4 illustrates the complementarity of the nucleotide sequences of LOC149420 BINDING SITE, designated SEQ ID:19107, to the nucleotide sequence of GAM83 RNA, herein designated GAM RNA, also designated SEQ ID:287.

Another function of GAM83 is therefore inhibition of LOC149420 (Accession NP_690048.1). Accordingly, utilities of GAM83 include diagnosis, prevention and treatment of diseases and clinical conditions associated with LOC149420.

LOC151242 (Accession XP_087137.2) is another GAM83 target gene, herein designated TARGET GENE. LOC151242 BINDING SITE is a target binding site found in the 3' untranslated region of mRNA encoded by LOC151242, corresponding to a target binding site such as BINDING SITE I, BINDING SITE II or BINDING SITE III of FIG. 8. Table 4 illustrates the complementarity of the nucleotide sequences of LOC151242 BINDING SITE, designated SEQ ID:1944, to the nucleotide sequence of GAM83 RNA, herein designated GAM RNA, also designated SEQ ID:287.

Another function of GAM83 is therefore inhibition of LOC151242 (Accession XP_087137.2). Accordingly, utilities of GAM83 include diagnosis, prevention and treatment of diseases and clinical conditions associated with LOC151242.

LOC151610 (Accession XP_087245.1) is another GAM83 target gene, herein designated TARGET GENE. LOC151610 BINDING SITE is a target binding site found in the 5' untranslated region of mRNA encoded by LOC151610, corresponding to a target binding site such as BINDING SITE I, BINDING SITE II or BINDING SITE III of FIG. 8. Table 4 illustrates the complementarity of the nucleotide sequences of LOC151610 BINDING SITE, designated SEQ ID:12037, to the nucleotide sequence of GAM83 RNA, herein designated GAM RNA, also designated SEQ ID:287.

Another function of GAM83 is therefore inhibition of LOC151610 (Accession XP_087245.1). Accordingly, utilities of GAM83 include diagnosis, prevention and treatment of diseases and clinical conditions associated with LOC151610.

LOC152519 (Accession XP_087483.3) is another GAM83 target gene, herein designated TARGET GENE. LOC152519 BINDING SITE is a target binding site found in the 3' untranslated region of mRNA encoded by LOC152519, corresponding to a target binding site such as BINDING SITE I, BINDING SITE II or BINDING SITE III of FIG. 8. Table 4 illustrates the complementarity of the nucleotide sequences of LOC152519 BINDING SITE, designated SEQ ID:12979, to the nucleotide sequence of GAM83 RNA, herein designated GAM RNA, also designated SEQ ID:287.

Another function of GAM83 is therefore inhibition of LOC152519 (Accession XP_087483.3). Accordingly, utilities of GAM83 include diagnosis, prevention and treatment of diseases and clinical conditions associated with LOC152519.

LOC153077 (Accession XP_098307.1) is another GAM83 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:16808, to the nucleotide sequence of GAM83 RNA, herein designated GAM RNA, also designated SEQ ID:287.

Another function of GAM83 is therefore inhibition of LOC153077 (Accession XP_098307.1). Accordingly, utilities of GAM83 include diagnosis, prevention and treatment of diseases and clinical conditions associated with LOC153077.

LOC157531 (Accession XP_098772.1) is another GAM83 target gene, herein designated TARGET GENE. LOC157531 BINDING SITE is a target binding site found in the 3' untranslated region of multiple transcripts of mRNA encoded by LOC157531, corresponding to a target binding site such as BINDING SITE I, BINDING SITE II or BINDING SITE III of FIG. 8. Table 4 illustrates the complementarity of the nucleotide sequences of LOC157531 BINDING SITE, designated SEQ ID:3461, to the nucleotide sequence of GAM83 RNA, herein designated GAM RNA, also designated SEQ ID:287.

Another function of GAM83 is therefore inhibition of LOC157531 (Accession XP_098772.1). Accordingly, utilities of GAM83 include diagnosis, prevention and treatment of diseases and clinical conditions associated with LOC157531.

LOC158125 (Accession XP_088492.2) is another GAM83 target gene, herein designated TARGET GENE. LOC158125 BINDING SITE is a target binding site found in the 3' untranslated region of mRNA encoded by LOC158125, corresponding to a target binding site such as BINDING SITE I, BINDING SITE II or BINDING SITE III of FIG. 8. Table 4 illustrates the complementarity of the nucleotide sequences of LOC158125 BINDING SITE, designated SEQ ID:8554, to the nucleotide sequence of GAM83 RNA, herein designated GAM RNA, also designated SEQ ID:287.

Another function of GAM83 is therefore inhibition of LOC158125 (Accession XP_088492.2). Accordingly, utilities of GAM83 include diagnosis, prevention and treatment of diseases and clinical conditions associated with LOC158125.

LOC202781 (Accession XP_117455.1) is another GAM83 target gene, herein designated TARGET GENE. LOC202781 BINDING SITE is a target binding site found in the 3' untranslated region of mRNA encoded by LOC202781, corresponding to a target binding site such as BINDING SITE I, BINDING SITE II or BINDING SITE III of FIG. 8. Table 4 illustrates the complementarity of the nucleotide sequences of LOC202781 BINDING SITE, designated SEQ ID:9377, to the nucleotide sequence of GAM83 RNA, herein designated GAM RNA, also designated SEQ ID:287.

Another function of GAM83 is therefore inhibition of LOC202781 (Accession XP_117455.1). Accordingly, utilities of GAM83 include diagnosis, prevention and treatment of diseases and clinical conditions associated with LOC202781.

LOC219612 (Accession XP_168585.2) is another GAM83 target gene, herein designated TARGET GENE. LOC219612 BINDING SITE is a target binding site found in the 5' untranslated region of mRNA encoded by LOC219612, corresponding to a target binding site such as BINDING SITE I, BINDING SITE II or BINDING SITE III of FIG. 8. Table 4 illustrates the complementarity of the nucleotide sequences of LOC219612 BINDING SITE, designated SEQ ID:690, to the nucleotide sequence of GAM83 RNA, herein designated GAM RNA, also designated SEQ ID:287.

Another function of GAM83 is therefore inhibition of LOC219612 (Accession XP_168585.2). Accordingly, utilities of GAM83 include diagnosis, prevention and treatment of diseases and clinical conditions associated with LOC219612.

LOC219731 (Accession XP_167596.1) is another GAM83 target gene, herein designated TARGET GENE. LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:5054, to the nucleotide sequence of GAM83 RNA, herein designated GAM RNA, also designated SEQ ID:287.

Another function of GAM83 is therefore inhibition of LOC219731 (Accession XP_167596.1). Accordingly, utilities of GAM83 include diagnosis, prevention and treatment of diseases and clinical conditions associated with LOC219731.

LOC219914 (Accession XP_167788.1) is another GAM83 target gene, herein designated TARGET GENE. LOC219914 BINDING SITE is a target binding site found in the 3' untranslated region of mRNA encoded by LOC219914, corresponding to a target binding site such as BINDING SITE I, BINDING SITE II or BINDING SITE III of FIG. 8. Table 4 illustrates the complementarity of the nucleotide sequences of LOC219914 BINDING SITE, designated SEQ ID:15995, to the nucleotide sequence of GAM83 RNA, herein designated GAM RNA, also designated SEQ ID:287.

Another function of GAM83 is therefore inhibition of LOC219914 (Accession XP_167788.1). Accordingly, utilities of GAM83 include diagnosis, prevention and treatment of diseases and clinical conditions associated with LOC219914.

LOC219942 (Accession XP_167790.1) is another GAM83 target gene, herein designated TARGET GENE. LOC219942 BINDING SITE is a target binding site found in the 3' untranslated region of mRNA encoded by LOC219942, corresponding to a target binding site such as BINDING SITE I, BINDING SITE II or BINDING SITE III of FIG. 8. Table 4 illustrates the complementarity of the nucleotide sequences of LOC219942 BINDING SITE, designated SEQ ID:10767, to the nucleotide sequence of GAM83 RNA, herein designated GAM RNA, also designated SEQ ID:287.

Another function of GAM83 is therefore inhibition of LOC219942 (Accession XP_167790.1). Accordingly, utilities of GAM83 include diagnosis, prevention and treatment of diseases and clinical conditions associated with LOC219942.

LOC282976 (Accession XP_210838.1) is another GAM83 target gene, herein designated TARGET GENE.

LOC282976 BINDING SITE is a target binding site found in the 3' untranslated region of mRNA encoded by LOC282976, corresponding to a target binding site such as BINDING SITE I, BINDING SITE II or BINDING SITE III of FIG. 8. Table 4 illustrates the complementarity of the nucleotide sequences of LOC282976 BINDING SITE, designated SEQ ID:2531, to the nucleotide sequence of GAM83 RNA, herein designated GAM RNA, also designated SEQ ID:287.

Another function of GAM83 is therefore inhibition of LOC282976 (Accession XP_210838.1). Accordingly, utilities of GAM83 include diagnosis, prevention and treatment of diseases and clinical conditions associated with LOC282976.

LOC283314 (Accession XP_210969.1) is another GAM83 target gene, herein designated TARGET GENE. LOC283314 BINDING SITE is a target binding site found in the 3' untranslated region of mRNA encoded by LOC283314, corresponding to a target binding site such as BINDING SITE I, BINDING SITE II or BINDING SITE III of FIG. 8. Table 4 illustrates the complementarity of the nucleotide sequences of LOC283314 BINDING SITE, designated SEQ ID:19120, to the nucleotide sequence of GAM83 RNA, herein designated GAM RNA, also designated SEQ ID:287.

Another function of GAM83 is therefore inhibition of LOC283314 (Accession XP_210969.1). Accordingly, utilities of GAM83 include diagnosis, prevention and treatment of diseases and clinical conditions associated with LOC283314.

LOC283337 (Accession XP_300560.1) is another GAM83 target gene, herein designated TARGET GENE. LOC283337 BINDING SITE is a target binding site found in the 3' untranslated region of mRNA encoded by LOC283337, corresponding to a target binding site such as BINDING SITE I, BINDING SITE II or BINDING SITE III of FIG. 8. Table 4 illustrates the complementarity of the nucleotide sequences of LOC283337 BINDING SITE, designated SEQ ID:7249, to the nucleotide sequence of GAM83 RNA, herein designated GAM RNA, also designated SEQ ID:287.

Another function of GAM83 is therefore inhibition of LOC283337 (Accession XP_300560.1). Accordingly, utilities of GAM83 include diagnosis, prevention and treatment of diseases and clinical conditions associated with LOC283337.

LOC283484 (Accession XP_211053.1) is another GAM83 target gene, herein designated TARGET GENE. LOC283484 BINDING SITE is a target binding site found in the 3' untranslated region of mRNA encoded by LOC283484, corresponding to a target binding site such as BINDING SITE I, BINDING SITE II or BINDING SITE III of FIG. 8. Table 4 illustrates the complementarity of the nucleotide sequences of LOC283484 BINDING SITE, designated SEQ ID:17012, to the nucleotide sequence of GAM83 RNA, herein designated GAM RNA, also designated SEQ ID:287.

Another function of GAM83 is therefore inhibition of LOC283484 (Accession XP_211053.1). Accordingly, utilities of GAM83 include diagnosis, prevention and treatment of diseases and clinical conditions associated with LOC283484.

LOC283767 (Accession XP_208835.1) is another GAM83 target gene, herein designated TARGET GENE. LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:1502, to the nucleotide sequence of GAM83 RNA, herein designated GAM RNA, also designated SEQ ID:287.

Another function of GAM83 is therefore inhibition of LOC283767 (Accession XP_208835.1). Accordingly, utilities of GAM83 include diagnosis, prevention and treatment of diseases and clinical conditions associated with LOC283767.

LOC283776 (Accession XP_211196.1) is another GAM83 target gene, herein designated TARGET GENE. LOC283776 BINDING SITE is a target binding site found in the 5' untranslated region of mRNA encoded by LOC283776, corresponding to a target binding site such as BINDING SITE I, BINDING SITE II or BINDING SITE III of FIG. 8. Table 4 illustrates the complementarity of the nucleotide sequences of LOC283776 BINDING SITE, designated SEQ ID:14021, to the nucleotide sequence of GAM83 RNA, herein designated GAM RNA, also designated SEQ ID:287.

Another function of GAM83 is therefore inhibition of LOC283776 (Accession XP_211196.1). Accordingly, utilities of GAM83 include diagnosis, prevention and treatment of diseases and clinical conditions associated with LOC283776.

LOC283818 (Accession XP_211218.1) is another GAM83 target gene, herein designated TARGET GENE. LOC283818 BINDING SITE is a target binding site found in the 5' untranslated region of mRNA encoded by LOC283818, corresponding to a target binding site such as BINDING SITE I, BINDING SITE II or BINDING SITE III of FIG. 8. Table 4 illustrates the complementarity of the nucleotide sequences of LOC283818 BINDING SITE, designated SEQ ID:3222, to the nucleotide sequence of GAM83 RNA, herein designated GAM RNA, also designated SEQ ID:287.

Another function of GAM83 is therefore inhibition of LOC283818 (Accession XP_211218.1). Accordingly, utilities of GAM83 include diagnosis, prevention and treatment of diseases and clinical conditions associated with LOC283818.

LOC283906 (Accession XP_211254.1) is another GAM83 target gene, herein designated TARGET GENE. LOC283906 BINDING SITE is a target binding site found in the 5' untranslated region of mRNA encoded by LOC283906, corresponding to a target binding site such as BINDING SITE I, BINDING SITE II or BINDING SITE III of FIG. 8. Table 4 illustrates the complementarity of the nucleotide sequences of LOC283906 BINDING SITE, designated SEQ ID:19383, to the nucleotide sequence of GAM83 RNA, herein designated GAM RNA, also designated SEQ ID:287.

Another function of GAM83 is therefore inhibition of LOC283906 (Accession XP_211254.1). Accordingly, utilities of GAM83 include diagnosis, prevention and treatment of diseases and clinical conditions associated with LOC283906.

LOC284031 (Accession XP_208982.1) is another GAM83 target gene, herein designated TARGET GENE. LOC284031 BINDING SITE is a target binding site found in the 3' untranslated region of mRNA encoded by LOC284031, corresponding to a target binding site such as BINDING SITE I, BINDING SITE II or BINDING SITE III of FIG. 8. Table 4 illustrates the complementarity of the nucleotide sequences of LOC284031 BINDING SITE, designated SEQ ID:1826, to the nucleotide sequence of GAM83 RNA, herein designated GAM RNA, also designated SEQ ID:287.

Another function of GAM83 is therefore inhibition of LOC284031 (Accession XP_208982.1). Accordingly, utilities of GAM83 include diagnosis, prevention and treatment of diseases and clinical conditions associated with LOC284031.

LOC284462 (Accession XP_211475.1) is another GAM83 target gene, herein designated TARGET GENE. LOC284462 BINDING SITE is a target binding site found in the 3' untranslated region of mRNA encoded by LOC284462, corresponding to a target binding site such as BINDING SITE I, BINDING SITE II or BINDING SITE III of FIG. 8. Table 4 illustrates the complementarity of the nucleotide sequences of LOC284462 BINDING SITE, designated SEQ ID:17281, to the nucleotide sequence of GAM83 RNA, herein designated GAM RNA, also designated SEQ ID:287.

Another function of GAM83 is therefore inhibition of LOC284462 (Accession XP_211475.1). Accordingly, utilities of GAM83 include diagnosis, prevention and treatment of diseases and clinical conditions associated with LOC284462.

LOC284473 (Accession XP_211474.1) is another GAM83 target gene, herein designated TARGET GENE. LOC284473 BINDING SITE is a target binding site found in the 3' untranslated region of mRNA encoded by LOC284473, corresponding to a target binding site such as BINDING SITE I, BINDING SITE II or BINDING SITE III of FIG. 8. Table 4 illustrates the complementarity of the nucleotide sequences of LOC284473 BINDING SITE, designated SEQ ID:7971, to the nucleotide sequence of GAM83 RNA, herein designated GAM RNA, also designated SEQ ID:287.

Another function of GAM83 is therefore inhibition of LOC284473 (Accession XP_211474.1). Accordingly, utilities of GAM83 include diagnosis, prevention and treatment of diseases and clinical conditions associated with LOC284473.

LOC284578 (Accession XP_211526.1) is another GAM83 target gene, herein designated TARGET GENE. LOC284578 BINDING SITE is a target binding site found in the 5' untranslated region of mRNA encoded by LOC284578, corresponding to a target binding site such as BINDING SITE I, BINDING SITE II or BINDING SITE III of FIG. 8. Table 4 illustrates the complementarity of the nucleotide sequences of LOC284578 BINDING SITE, designated SEQ ID:13654, to the nucleotide sequence of GAM83 RNA, herein designated GAM RNA, also designated SEQ ID:287.

Another function of GAM83 is therefore inhibition of LOC284578 (Accession XP_211526.1). Accordingly, utilities of GAM83 include diagnosis, prevention and treatment of diseases and clinical conditions associated with LOC284578.

LOC284671 (Accession XP_209313.2) is another GAM83 target gene, herein designated TARGET GENE. LOC284671 BINDING SITE is a target binding site found in the 3' untranslated region of mRNA encoded by LOC284671, corresponding to a target binding site such as BINDING SITE I, BINDING SITE II or BINDING SITE III of FIG. 8. Table 4 illustrates the complementarity of the nucleotide sequences of LOC284671 BINDING SITE, designated SEQ ID:1698, to the nucleotide sequence of GAM83 RNA, herein designated GAM RNA, also designated SEQ ID:287.

Another function of GAM83 is therefore inhibition of LOC284671 (Accession XP_209313.2). Accordingly, utilities of GAM83 include diagnosis, prevention and treatment of diseases and clinical conditions associated with LOC284671.

LOC284684 (Accession XP_209316.1) is another GAM83 target gene, herein designated TARGET GENE. LOC284684 BINDING SITE is a target binding site found in the 3' untranslated region of mRNA encoded by LOC284684, corresponding to a target binding site such as BINDING SITE I, BINDING SITE II or BINDING SITE III of FIG. 8. Table 4 illustrates the complementarity of the nucleotide sequences of LOC284684 BINDING SITE, designated SEQ ID:2205, to the nucleotide sequence of GAM83 RNA, herein designated GAM RNA, also designated SEQ ID:287.

Another function of GAM83 is therefore inhibition of LOC284684 (Accession XP_209316.1). Accordingly, utilities of GAM83 include diagnosis, prevention and treatment of diseases and clinical conditions associated with LOC284684.

LOC284775 (Accession XP_211635.1) is another GAM83 target gene, herein designated TARGET GENE. LOC284775 BINDING SITE is a target binding site found in the 3' untranslated region of mRNA encoded by LOC284775, corresponding to a target binding site such as BINDING SITE I, BINDING SITE II or BINDING SITE III of FIG. 8. Table 4 illustrates the complementarity of the nucleotide sequences of LOC284775 BINDING SITE, designated SEQ ID:19513, to the nucleotide sequence of GAM83 RNA, herein designated GAM RNA, also designated SEQ ID:287.

Another function of GAM83 is therefore inhibition of LOC284775 (Accession XP_211635.1). Accordingly, utilities of GAM83 include diagnosis, prevention and treatment of diseases and clinical conditions associated with LOC284775.

LOC284798 (Accession XP_211639.1) is another GAM83 target gene, herein designated TARGET GENE. LOC284798 BINDING SITE is a target binding site found in the 3' untranslated region of mRNA encoded by LOC284798, corresponding to a target binding site such as BINDING SITE I, BINDING SITE II or BINDING SITE III of FIG. 8. Table 4 illustrates the complementarity of the nucleotide sequences of LOC284798 BINDING SITE, designated SEQ ID:18378, to the nucleotide sequence of GAM83 RNA, herein designated GAM RNA, also designated SEQ ID:287.

Another function of GAM83 is therefore inhibition of LOC284798 (Accession XP_211639.1). Accordingly, utilities of GAM83 include diagnosis, prevention and treatment of diseases and clinical conditions associated with LOC284798.

LOC285351 (Accession XP_211856.1) is another GAM83 target gene, herein designated TARGET GENE. LOC285351 BINDING SITE is a target binding site found in the 5' untranslated region of mRNA encoded by LOC285351, corresponding to a target binding site such as BINDING SITE I, BINDING SITE II or BINDING SITE III of FIG. 8. Table 4 illustrates the complementarity of the nucleotide sequences of LOC285351 BINDING SITE, designated SEQ ID:7404, to the nucleotide sequence of GAM83 RNA, herein designated GAM RNA, also designated SEQ ID:287.

Another function of GAM83 is therefore inhibition of LOC285351 (Accession XP_211856.1). Accordingly, utilities of GAM83 include diagnosis, prevention and treatment of diseases and clinical conditions associated with LOC285351.

LOC285404 (Accession XP_211885.1) is another GAM83 target gene, herein designated TARGET GENE. LOC285404 BINDING SITE is a target binding site found in the 3' untranslated region of mRNA encoded by LOC285404, corresponding to a target binding site such as BINDING SITE I, BINDING SITE II or BINDING SITE III of FIG. 8. Table 4 illustrates the complementarity of the nucleotide sequences of LOC285404 BINDING SITE, designated SEQ ID:2002, to the nucleotide sequence of GAM83 RNA, herein designated GAM RNA, also designated SEQ ID:287.

Another function of GAM83 is therefore inhibition of LOC285404 (Accession XP_211885.1). Accordingly, utilities of GAM83 include diagnosis, prevention and treatment of diseases and clinical conditions associated with LOC285404.

LOC285422 (Accession XP_211894.1) is another GAM83 target gene, herein designated TARGET GENE. LOC285422 BINDING SITE is a target binding site found in the 3' untranslated region of mRNA encoded by LOC285422, corresponding to a target binding site such as BINDING SITE I, BINDING SITE II or BINDING SITE III of FIG. 8. Table 4 illustrates the complementarity of the nucleotide sequences of LOC285422 BINDING SITE, designated SEQ ID:5221, to the nucleotide sequence of GAM83 RNA, herein designated GAM RNA, also designated SEQ ID:287.

Another function of GAM83 is therefore inhibition of LOC285422 (Accession XP_211894.1). Accordingly, utilities of GAM83 include diagnosis, prevention and treatment of diseases and clinical conditions associated with LOC285422.

LOC285441 (Accession XP_211897.1) is another GAM83 target gene, herein designated TARGET GENE. LOC285441 BINDING SITE is a target binding site found in the 3' untranslated region of mRNA encoded by LOC285441, corresponding to a target binding site such as BINDING SITE I, BINDING SITE II or BINDING SITE III of FIG. 8. Table 4 illustrates the complementarity of the nucleotide sequences of LOC285441 BINDING SITE, designated SEQ ID:18486, to the nucleotide sequence of GAM83 RNA, herein designated GAM RNA, also designated SEQ ID:287.

Another function of GAM83 is therefore inhibition of LOC285441 (Accession XP_211897.1). Accordingly, utilities of GAM83 include diagnosis, prevention and treatment of diseases and clinical conditions associated with LOC285441.

LOC285548 (Accession XP_211936.1) is another GAM83 target gene, herein designated TARGET GENE. LOC285548 BINDING SITE is a target binding site found in the 3' untranslated region of mRNA encoded by LOC285548, corresponding to a target binding site such as BINDING SITE I, BINDING SITE II or BINDING SITE III of FIG. 8. Table 4 illustrates the complementarity of the nucleotide sequences of LOC285548 BINDING SITE, designated SEQ ID:3710, to the nucleotide sequence of GAM83 RNA, herein designated GAM RNA, also designated SEQ ID:287.

Another function of GAM83 is therefore inhibition of LOC285548 (Accession XP_211936.1). Accordingly, utilities of GAM83 include diagnosis, prevention and treatment of diseases and clinical conditions associated with LOC285548.

LOC285623 (Accession XP_211958.1) is another GAM83 target gene, herein designated TARGET GENE. LOC285623 BINDING SITE is a target binding site found in the 3' untranslated region of mRNA encoded by LOC285623, corresponding to a target binding site such as BINDING SITE I, BINDING SITE II or BINDING SITE III of FIG. 8. Table 4 illustrates the complementarity of the nucleotide sequences of LOC285623 BINDING SITE, designated SEQ ID:1605, to the nucleotide sequence of GAM83 RNA, herein designated GAM RNA, also designated SEQ ID:287.

Another function of GAM83 is therefore inhibition of LOC285623 (Accession XP_211958.1). Accordingly, utilities of GAM83 include diagnosis, prevention and treatment of diseases and clinical conditions associated with LOC285623.

LOC285747 (Accession XP_209742.1) is another GAM83 target gene, herein designated TARGET GENE. LOC285747 BINDING SITE is a target binding site found in the 3' untranslated region of mRNA encoded by LOC285747, corresponding to a target binding site such as BINDING SITE I, BINDING SITE II or BINDING SITE III of FIG. 8. Table 4 illustrates the complementarity of the nucleotide sequences of LOC285747 BINDING SITE, designated SEQ ID:16029, to the nucleotide sequence of GAM83 RNA, herein designated GAM RNA, also designated SEQ ID:287.

Another function of GAM83 is therefore inhibition of LOC285747 (Accession XP_209742.1). Accordingly, utilities of GAM83 include diagnosis, prevention and treatment of diseases and clinical conditions associated with LOC285747.

LOC285946 (Accession XP_212103.1) is another GAM83 target gene, herein designated TARGET GENE. LOC285946 BINDING SITE is a target binding site found in the 3' untranslated region of mRNA encoded by LOC285946, corresponding to a target binding site such as BINDING SITE I, BINDING SITE II or BINDING SITE III of FIG. 8. Table 4 illustrates the complementarity of the nucleotide sequences of LOC285946 BINDING SITE, designated SEQ ID:19964, to the nucleotide sequence of GAM83 RNA, herein designated GAM RNA, also designated SEQ ID:287.

Another function of GAM83 is therefore inhibition of LOC285946 (Accession XP_212103.1). Accordingly, utilities of GAM83 include diagnosis, prevention and treatment of diseases and clinical conditions associated with LOC285946.

LOC286345 (Accession XP_210021.1) is another GAM83 target gene, herein designated TARGET GENE. LOC286345 BINDING SITE is a target binding site found in the 5' untranslated region of mRNA encoded by LOC286345, corresponding to a target binding site such as BINDING SITE I, BINDING SITE II or BINDING SITE III of FIG. 8. Table 4 illustrates the complementarity of the nucleotide sequences of LOC286345 BINDING SITE, designated SEQ ID:1540, to the nucleotide sequence of GAM83 RNA, herein designated GAM RNA, also designated SEQ ID:287.

Another function of GAM83 is therefore inhibition of LOC286345 (Accession XP_210021.1). Accordingly, utilities of GAM83 include diagnosis, prevention and treatment of diseases and clinical conditions associated with LOC286345.

LOC286452 (Accession XP_212323.1) is another GAM83 target gene, herein designated TARGET GENE. LOC286452 BINDING SITE is a target binding site found in the 5' untranslated region of mRNA encoded by LOC286452, corresponding to a target binding site such as BINDING SITE I, BINDING SITE II or BINDING SITE III of FIG. 8. Table 4 illustrates the complementarity of the nucleotide sequences of LOC286452 BINDING SITE, designated SEQ ID:17170, to the nucleotide sequence of GAM83 RNA, herein designated GAM RNA, also designated SEQ ID:287.

Another function of GAM83 is therefore inhibition of LOC286452 (Accession XP_212323.1). Accordingly, utilities of GAM83 include diagnosis, prevention and treatment of diseases and clinical conditions associated with LOC286452.

LOC286484 (Accession XP_208434.1) is another GAM83 target gene, herein designated TARGET GENE. LOC286484 BINDING SITE is a target binding site found in the 5' untranslated region of mRNA encoded by LOC286484, corresponding to a target binding site such as BINDING SITE I, BINDING SITE II or BINDING SITE III of FIG. 8. Table 4 illustrates the complementarity of the nucleotide sequences of LOC286484 BINDING SITE, designated SEQ ID:14618, to the nucleotide sequence of GAM83 RNA, herein designated GAM RNA, also designated SEQ ID:287.

Another function of GAM83 is therefore inhibition of LOC286484 (Accession XP_208434.1). Accordingly, utilities of GAM83 include diagnosis, prevention and treatment of diseases and clinical conditions associated with LOC286484.

LOC338588 (Accession XP_294659.1) is another GAM83 target gene, herein designated TARGET GENE. LOC338588 BINDING SITE is a target binding site found in the 5' untranslated region of mRNA encoded by LOC338588, corresponding to a target binding site such as BINDING SITE I, BINDING SITE II or BINDING SITE III of FIG. 8. Table 4 illustrates the complementarity of the nucleotide sequences of LOC338588 BINDING SITE, designated SEQ ID:10340, to the nucleotide sequence of GAM83 RNA, herein designated GAM RNA, also designated SEQ ID:287.

Another function of GAM83 is therefore inhibition of LOC338588 (Accession XP_294659.1). Accordingly, utilities of GAM83 include diagnosis, prevention and treatment of diseases and clinical conditions associated with LOC338588.

LOC338991 (Accession XP_290663.1) is another GAM83 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:1502, to the nucleotide sequence of GAM83 RNA, herein designated GAM RNA, also designated SEQ ID:287.

Another function of GAM83 is therefore inhibition of LOC338991 (Accession XP_290663.1). Accordingly, utilities of GAM83 include diagnosis, prevention and treatment of diseases and clinical conditions associated with LOC338991.

LOC338999 (Accession XP_290659.1) is another GAM83 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:1502, to the nucleotide sequence of GAM83 RNA, herein designated GAM RNA, also designated SEQ ID:287.

Another function of GAM83 is therefore inhibition of LOC338999 (Accession XP_290659.1). Accordingly, utilities of GAM83 include diagnosis, prevention and treatment of diseases and clinical conditions associated with LOC338999.

LOC339161 (Accession XP_294835.1) is another GAM83 target gene, herein designated TARGET GENE. LOC339161 BINDING SITE is a target binding site found in the 5' untranslated region of mRNA encoded by LOC339161, corresponding to a target binding site such as BINDING SITE I, BINDING SITE II or BINDING SITE III of FIG. 8. Table 4 illustrates the complementarity of the nucleotide sequences of LOC339161 BINDING SITE, designated SEQ ID:7871, to the nucleotide sequence of GAM83 RNA, herein designated GAM RNA, also designated SEQ ID:287.

Another function of GAM83 is therefore inhibition of LOC339161 (Accession XP_294835.1). Accordingly, utilities of GAM83 include diagnosis, prevention and treatment of diseases and clinical conditions associated with LOC339161.

LOC339184 (Accession XP_290743.1) is another GAM83 target gene, herein designated TARGET GENE. LOC339184 BINDING SITE is a target binding site found in the 3' untranslated region of mRNA encoded by LOC339184, corresponding to a target binding site such as BINDING SITE I, BINDING SITE II or BINDING SITE III of FIG. 8. Table 4 illustrates the complementarity of the nucleotide sequences of LOC339184 BINDING SITE, designated SEQ ID:5261, to the nucleotide sequence of GAM83 RNA, herein designated GAM RNA, also designated SEQ ID:287.

Another function of GAM83 is therefore inhibition of LOC339184 (Accession XP_290743.1). Accordingly, utilities of GAM83 include diagnosis, prevention and treatment of diseases and clinical conditions associated with LOC339184.

LOC339437 (Accession XP_290899.1) is another GAM83 target gene, herein designated TARGET GENE. LOC339437 BINDING SITE is a target binding site found in the 5' untranslated region of mRNA encoded by LOC339437, corresponding to a target binding site such as BINDING SITE I, BINDING SITE II or BINDING SITE III of FIG. 8. Table 4 illustrates the complementarity of the nucleotide sequences of LOC339437 BINDING SITE, designated SEQ ID:19567, to the nucleotide sequence of GAM83 RNA, herein designated GAM RNA, also designated SEQ ID:287.

Another function of GAM83 is therefore inhibition of LOC339437 (Accession XP_290899.1). Accordingly, utilities of GAM83 include diagnosis, prevention and treatment of diseases and clinical conditions associated with LOC339437.

LOC340478 (Accession XP_295258.1) is another GAM83 target gene, herein designated TARGET GENE. LOC340478 BINDING SITE is a target binding site found in the 5' untranslated region of mRNA encoded by LOC340478, corresponding to a target binding site such as BINDING SITE I, BINDING SITE II or BINDING SITE III of FIG. 8. Table 4 illustrates the complementarity of the nucleotide sequences of LOC340478 BINDING SITE, designated SEQ ID:2003, to the nucleotide sequence of GAM83 RNA, herein designated GAM RNA, also designated SEQ ID:287.

Another function of GAM83 is therefore inhibition of LOC340478 (Accession XP_295258.1). Accordingly, utilities of GAM83 include diagnosis, prevention and treatment of diseases and clinical conditions associated with LOC340478.

LOC341744 (Accession XP_296409.1) is another GAM83 target gene, herein designated TARGET GENE. LOC341744 BINDING SITE is a target binding site found in the 3' untranslated region of mRNA encoded by LOC341744, corresponding to a target binding site such as BINDING SITE I, BINDING SITE II or BINDING SITE III of FIG. 8. Table 4 illustrates the complementarity of the nucleotide sequences of LOC341744 BINDING SITE, designated SEQ ID:11667, to the nucleotide sequence of GAM83 RNA, herein designated GAM RNA, also designated SEQ ID:287.

Another function of GAM83 is therefore inhibition of LOC341744 (Accession XP_296409.1). Accordingly, utilities of GAM83 include diagnosis, prevention and treatment of diseases and clinical conditions associated with LOC341744.

LOC348113 (Accession XP_300623.1) is another GAM83 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:1502, to the nucleotide sequence of GAM83 RNA, herein designated GAM RNA, also designated SEQ ID:287.

Another function of GAM83 is therefore inhibition of LOC348113 (Accession XP_300623.1). Accordingly, utilities of GAM83 include diagnosis, prevention and treatment of diseases and clinical conditions associated with LOC348113.

LOC348137 (Accession XP_300635.1) is another GAM83 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:10142, to the nucleotide sequence of GAM83 RNA, herein designated GAM RNA, also designated SEQ ID:287.

Another function of GAM83 is therefore inhibition of LOC348137 (Accession XP_300635.1). Accordingly, utilities of GAM83 include diagnosis, prevention and treatment of diseases and clinical conditions associated with LOC348137.

LOC348142 (Accession XP_300636.1) is another GAM83 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:1502, to the nucleotide sequence of GAM83 RNA, herein designated GAM RNA, also designated SEQ ID:287.

Another function of GAM83 is therefore inhibition of LOC348142 (Accession XP_300636.1). Accordingly, utilities of GAM83 include diagnosis, prevention and treatment of diseases and clinical conditions associated with LOC348142.

LOC348144 (Accession XP_300638.1) is another GAM83 target gene, herein designated TARGET GENE. LOC348144 BINDING SITE is a target binding site found in the 3' untranslated region of mRNA encoded by LOC348144, corresponding to a target binding site such as BINDING SITE I, BINDING SITE II or BINDING SITE III of FIG. 8. Table 4 illustrates the complementarity of the nucleotide sequences of LOC348144 BINDING SITE, designated SEQ ID:18221, to the nucleotide sequence of GAM83 RNA, herein designated GAM RNA, also designated SEQ ID:287.

Another function of GAM83 is therefore inhibition of LOC348144 (Accession XP_300638.1). Accordingly, utilities of GAM83 include diagnosis, prevention and treatment of diseases and clinical conditions associated with LOC348144.

LOC348182 (Accession XP_302676.1) is another GAM83 target gene, herein designated TARGET GENE. LOC348182 BINDING SITE is a target binding site found in the 5' untranslated region of mRNA encoded by LOC348182, corresponding to a target binding site such as BINDING SITE I, BINDING SITE II or BINDING SITE III of FIG. 8. Table 4 illustrates the complementarity of the nucleotide sequences of LOC348182 BINDING SITE, designated SEQ ID:11592, to the nucleotide sequence of GAM83 RNA, herein designated GAM RNA, also designated SEQ ID:287.

Another function of GAM83 is therefore inhibition of LOC348182 (Accession XP_302676.1). Accordingly, utilities of GAM83 include diagnosis, prevention and treatment of diseases and clinical conditions associated with LOC348182.

LOC348768 (Accession XP_302883.1) is another GAM83 target gene, herein designated TARGET GENE. LOC348768 BINDING SITE is a target binding site found in the 3' untranslated region of mRNA encoded by LOC348768, corresponding to a target binding site such as BINDING SITE I, BINDING SITE II or BINDING SITE III of FIG. 8. Table 4 illustrates the complementarity of the nucleotide sequences of LOC348768 BINDING SITE, designated SEQ ID:14195, to the nucleotide sequence of GAM83 RNA, herein designated GAM RNA, also designated SEQ ID:287.

Another function of GAM83 is therefore inhibition of LOC348768 (Accession XP_302883.1). Accordingly, utilities of GAM83 include diagnosis, prevention and treatment of diseases and clinical conditions associated with LOC348768.

LOC350132 (Accession XP_303867.1) is another GAM83 target gene, herein designated TARGET GENE. LOC350132 BINDING SITE is a target binding site found in the 5' untranslated region of mRNA encoded by LOC350132, corresponding to a target binding site such as BINDING SITE I, BINDING SITE II or BINDING SITE III of FIG. 8. Table 4 illustrates the complementarity of the nucleotide sequences of LOC350132 BINDING SITE, designated SEQ ID:3208, to the nucleotide sequence of GAM83 RNA, herein designated GAM RNA, also designated SEQ ID:287.

Another function of GAM83 is therefore inhibition of LOC350132 (Accession XP_303867.1). Accordingly, utilities of GAM83 include diagnosis, prevention and treatment of diseases and clinical conditions associated with LOC350132.

LOC350147 (Accession XP_303825.1) is another GAM83 target gene, herein designated TARGET GENE. LOC350147 BINDING SITE is a target binding site found in the 5' untranslated region of mRNA encoded by LOC350147, corresponding to a target binding site such as BINDING SITE I, BINDING SITE II or BINDING SITE III of FIG. 8. Table 4 illustrates the complementarity of the nucleotide sequences of LOC350147 BINDING SITE, designated SEQ ID:15430, to the nucleotide sequence of GAM83 RNA, herein designated GAM RNA, also designated SEQ ID:287.

Another function of GAM83 is therefore inhibition of LOC350147 (Accession XP_303825.1). Accordingly, utilities of GAM83 include diagnosis, prevention and treatment of diseases and clinical conditions associated with LOC350147.

LOC351042 (Accession XP_304632.1) is another GAM83 target gene, herein designated TARGET GENE. LOC351042 BINDING SITE is a target binding site found in the 5' untranslated region of mRNA encoded by LOC351042, corresponding to a target binding site such as BINDING SITE I, BINDING SITE II or BINDING SITE III of FIG. 8. Table 4 illustrates the complementarity of the nucleotide sequences of LOC351042 BINDING SITE, designated SEQ ID:8285, to the nucleotide sequence of GAM83 RNA, herein designated GAM RNA, also designated SEQ ID:287.

Another function of GAM83 is therefore inhibition of LOC351042 (Accession XP_304632.1). Accordingly, utilities of GAM83 include diagnosis, prevention and treatment of diseases and clinical conditions associated with LOC351042.

LOC57107 (Accession NP_065114.2) is another GAM83 target gene, herein designated TARGET GENE. LOC57107 BINDING SITE is a target binding site found in the 3' untranslated region of mRNA encoded by LOC57107, corresponding to a target binding site such as BINDING SITE I, BINDING SITE II or BINDING SITE III of FIG. 8. Table 4 illustrates the complementarity of the nucleotide sequences of LOC57107 BINDING SITE, designated SEQ ID:5002, to the nucleotide sequence of GAM83 RNA, herein designated GAM RNA, also designated SEQ ID:287.

Another function of GAM83 is therefore inhibition of LOC57107 (Accession NP_065114.2). Accordingly, utilities of GAM83 include diagnosis, prevention and treatment of diseases and clinical conditions associated with LOC57107.

LOC90148 (Accession XP_029430.1) is another GAM83 target gene, herein designated TARGET GENE. LOC90148 BINDING SITE is a target binding site found in the 3' untranslated region of mRNA encoded by LOC90148, corresponding to a target binding site such as BINDING SITE I, BINDING SITE II or BINDING SITE III of FIG. 8. Table 4 illustrates the complementarity of the nucleotide sequences of LOC90148 BINDING SITE, designated SEQ ID:4641, to the nucleotide sequence of GAM83 RNA, herein designated GAM RNA, also designated SEQ ID:287.

Another function of GAM83 is therefore inhibition of LOC90148 (Accession XP_029430.1). Accordingly, utilities of GAM83 include diagnosis, prevention and treatment of diseases and clinical conditions associated with LOC90148.

LOC92973 (Accession XP_048529.2) is another GAM83 target gene, herein designated TARGET GENE. LOC92973 BINDING SITE is a target binding site found in the 5' untranslated region of mRNA encoded by LOC92973, corresponding to a target binding site such as BINDING SITE I, BINDING SITE II or BINDING SITE III of FIG. 8. Table 4 illustrates the complementarity of the nucleotide sequences of LOC92973 BINDING SITE, designated SEQ ID:14969, to the nucleotide sequence of GAM83 RNA, herein designated GAM RNA, also designated SEQ ID:287.

Another function of GAM83 is therefore inhibition of LOC92973 (Accession XP_048529.2). Accordingly, utilities of GAM83 include diagnosis, prevention and treatment of diseases and clinical conditions associated with LOC92973.

LOC93349 (Accession NP_612411.2) is another GAM83 target gene, herein designated TARGET GENE. LOC93349 BINDING SITE is a target binding site found in the 3' untranslated region of mRNA encoded by LOC93349, corresponding to a target binding site such as BINDING SITE I, BINDING SITE II or BINDING SITE III of FIG. 8. Table 4 illustrates the complementarity of the nucleotide sequences of LOC93349 BINDING SITE, designated SEQ ID:17460, to the nucleotide sequence of GAM83 RNA, herein designated GAM RNA, also designated SEQ ID:287.

Another function of GAM83 is therefore inhibition of LOC93349 (Accession NP_612411.2). Accordingly, utilities of GAM83 include diagnosis, prevention and treatment of diseases and clinical conditions associated with LOC93349.

LSM10 (Accession NP_116270.1) is another GAM83 target gene, herein designated TARGET GENE. LSM10 BINDING SITE is a target binding site found in the 3' untranslated region of mRNA encoded by LSM10, corresponding to a target binding site such as BINDING SITE I, BINDING SITE II or BINDING SITE III of FIG. 8. Table 4 illustrates the complementarity of the nucleotide sequences of LSM10 BINDING SITE, designated SEQ ID:918, to the nucleotide sequence of GAM83 RNA, herein designated GAM RNA, also designated SEQ ID:287.

Another function of GAM83 is therefore inhibition of LSM10 (Accession NP_116270.1). Accordingly, utilities of GAM83 include diagnosis, prevention and treatment of diseases and clinical conditions associated with LSM10.

Lymphotoxin alpha (tnf superfamily, member 1) (LTA, Accession NP_000586.2) is another GAM83 target gene, herein designated TARGET GENE. LTA BINDING SITE is a target binding site found in the 5' untranslated region of mRNA encoded by LTA, corresponding to a target binding site such as BINDING SITE I, BINDING SITE II or BINDING SITE III of FIG. 8. Table 4 illustrates the complementarity of the nucleotide sequences of LTA BINDING SITE, designated SEQ ID:3286, to the nucleotide sequence of GAM83 RNA, herein designated GAM RNA, also designated SEQ ID:287.

Another function of GAM83 is therefore inhibition of Lymphotoxin alpha (tnf superfamily, member 1) (LTA, Accession NP_000586.2), a gene which is a cytokine that in its homotrimeric form binds to tnfrsf1a/tnfr1, tnfrsf1b/tnfbr and tnfrsf14/hvem. Accordingly, utilities of GAM83 include diagnosis, prevention and treatment of diseases and clinical conditions associated with LTA.

The function of LTA and its association with various diseases and clinical conditions, has been established by previous studies, as described hereinabove with reference to GAM44.1. Methyl cpg binding protein 2 (rett syndrome) (MECP2, Accession NP_004983.1) is another GAM83 target gene, herein designated TARGET GENE. MECP2 BINDING SITE is a target binding site found in the 3' untranslated region of mRNA encoded by MECP2, corresponding to a target binding site such as BINDING SITE I, BINDING SITE II or BINDING SITE III of FIG. 8. Table 4 illustrates the complementarity of the nucleotide sequences of MECP2 BINDING SITE, designated SEQ ID:689, to the nucleotide sequence of GAM83 RNA, herein designated GAM RNA, also designated SEQ ID:287.

Another function of GAM83 is therefore inhibition of Methyl cpg binding protein 2 (rett syndrome) (MECP2, Accession NP_004983.1). Accordingly, utilities of GAM83 include diagnosis, prevention and treatment of diseases and clinical conditions associated with MECP2.

Meis1, myeloid ecotropic viral integration site 1 homolog (mouse) (MEIS1, Accession NP_002389.1) is another GAM83 target gene, herein designated TARGET GENE. MEIS1 BINDING SITE is a target binding site found in the 3' untranslated region of mRNA encoded by MEIS1, corresponding to a target binding site such as BINDING SITE I, BINDING SITE II or BINDING SITE III of FIG. 8. Table 4 illustrates the complementarity of the nucleotide sequences of MEIS1 BINDING SITE, designated SEQ ID:12764, to the nucleotide sequence of GAM83 RNA, herein designated GAM RNA, also designated SEQ ID:287.

Another function of GAM83 is therefore inhibition of Meis1, myeloid ecotropic viral integration site 1 homolog (mouse) (MEIS1, Accession NP_002389.1), a gene which may regulate gene expression and control cell differentiation. Accordingly, utilities of GAM83 include diagnosis, prevention and treatment of diseases and clinical conditions associated with MEIS1.

The function of MEIS1 and its association with various diseases and clinical conditions, has been established by previous studies, as described hereinabove with reference to GAM44.1. Microfibrillar-associated protein 2 (MFAP2, Accession NP_059453.1) is another GAM83 target gene, herein designated TARGET GENE. MFAP2 BINDING SITE is a target binding site found in the 3' untranslated region of multiple transcripts of mRNA encoded by MFAP2, corresponding to a target binding site such as BINDING SITE I, BINDING SITE II or BINDING SITE III of FIG. 8. Table 4 illustrates the complementarity of the nucleotide sequences of MFAP2 BINDING SITE, designated SEQ ID:2746, to the nucleotide sequence of GAM83 RNA, herein designated GAM RNA, also designated SEQ ID:287.

Another function of GAM83 is therefore inhibition of Microfibrillar-associated protein 2 (MFAP2, Accession NP_059453.1), a gene which is a component of the elastin-associated microfibrils. Accordingly, utilities of GAM83 include diagnosis, prevention and treatment of diseases and clinical conditions associated with MFAP2.

The function of MFAP2 and its association with various diseases and clinical conditions, has been established by previous studies, as described hereinabove with reference to GAM44.1. Microfibrillar-associated protein 2 (MFAP2, Accession NP_002394.1) is another GAM83 target gene, herein designated TARGET GENE. MFAP2 BINDING SITE is a target binding site found in the 3' untranslated region of multiple transcripts of mRNA encoded by MFAP2, corresponding to a target binding site such as BINDING SITE I, BINDING SITE II or BINDING SITE III of FIG. 8. Table 4 illustrates the complementarity of the nucleotide sequences of MFAP2 BINDING SITE, designated SEQ ID:2746, to the nucleotide sequence of GAM83 RNA, herein designated GAM RNA, also designated SEQ ID:287.

Another function of GAM83 is therefore inhibition of Microfibrillar-associated protein 2 (MFAP2, Accession NP_002394.1), a gene which is a component of the elastin-associated microfibrils. Accordingly, utilities of GAM83 include diagnosis, prevention and treatment of diseases and clinical conditions associated with MFAP2.

The function of MFAP2 and its association with various diseases and clinical conditions, has been established by previous studies, as described hereinabove with reference to GAM44.1. MGC10646 (Accession NP_116082.1) is another GAM83 target gene, herein designated TARGET GENE. MGC10646 BINDING SITE is a target binding site found in the 3' untranslated region of mRNA encoded by MGC10646, corresponding to a target binding site such as BINDING SITE I, BINDING SITE II or BINDING SITE III of FIG. 8. Table 4 illustrates the complementarity of the nucleotide sequences of MGC10646 BINDING SITE, designated SEQ ID:5646, to the nucleotide sequence of GAM83 RNA, herein designated GAM RNA, also designated SEQ ID:287.

Another function of GAM83 is therefore inhibition of MGC10646 (Accession NP_116082.1). Accordingly, utilities of GAM83 include diagnosis, prevention and treatment of diseases and clinical conditions associated with MGC10646.

MGC12435 (Accession NP_113615.1) is another GAM83 target gene, herein designated TARGET GENE. MGC12435 BINDING SITE is a target binding site found in the 3' untranslated region of mRNA encoded by MGC12435, corresponding to a target binding site such as BINDING SITE I, BINDING SITE II or BINDING SITE III of FIG. 8. Table 4 illustrates the complementarity of the nucleotide sequences of MGC12435 BINDING SITE, designated SEQ ID:7109, to the nucleotide sequence of GAM83 RNA, herein designated GAM RNA, also designated SEQ ID:287.

Another function of GAM83 is therefore inhibition of MGC12435 (Accession NP_113615.1). Accordingly, utilities of GAM83 include diagnosis, prevention and treatment of diseases and clinical conditions associated with MGC12435.

MGC13071 (Accession NP_116078.2) is another GAM83 target gene, herein designated TARGET GENE. MGC13071 BINDING SITE is a target binding site found in the 3' untranslated region of mRNA encoded by MGC13071, corresponding to a target binding site such as BINDING SITE I, BINDING SITE II or BINDING SITE III of FIG. 8. Table 4 illustrates the complementarity of the nucleotide sequences of MGC13071 BINDING SITE, designated SEQ ID:8673, to the nucleotide sequence of GAM83 RNA, herein designated GAM RNA, also designated SEQ ID:287.

Another function of GAM83 is therefore inhibition of MGC13071 (Accession NP_116078.2). Accordingly, utilities of GAM83 include diagnosis, prevention and treatment of diseases and clinical conditions associated with MGC13071.

MGC17515 (Accession NP_689684.1) is another GAM83 target gene, herein designated TARGET GENE. MGC17515 BINDING SITE is a target binding site found in the 5' untranslated region of mRNA encoded by MGC17515, corresponding to a target binding site such as BINDING SITE I, BINDING SITE II or BINDING SITE III of FIG. 8. Table 4 illustrates the complementarity of the nucleotide sequences of MGC17515 BINDING SITE, designated SEQ ID:16554, to the nucleotide sequence of GAM83 RNA, herein designated GAM RNA, also designated SEQ ID:287.

Another function of GAM83 is therefore inhibition of MGC17515 (Accession NP_689684.1). Accordingly, utilities of GAM83 include diagnosis, prevention and treatment of diseases and clinical conditions associated with MGC17515.

MGC2306 (Accession NP_002041.2) is another GAM83 target gene, herein designated TARGET GENE. MGC2306 BINDING SITE is a target binding site found in the 3' untranslated region of mRNA encoded by MGC2306, corresponding to a target binding site such as BINDING SITE I, BINDING SITE II or BINDING SITE III of FIG. 8. Table 4 illustrates the complementarity of the nucleotide sequences of MGC2306 BINDING SITE, designated SEQ ID:2059, to the nucleotide sequence of GAM83 RNA, herein designated GAM RNA, also designated SEQ ID:287.

Another function of GAM83 is therefore inhibition of MGC2306 (Accession NP_002041.2). Accordingly, utilities of GAM83 include diagnosis, prevention and treatment of diseases and clinical conditions associated with MGC2306.

MGC3101 (Accession NP_076948.1) is another GAM83 target gene, herein designated TARGET GENE. MGC3101 BINDING SITE is a target binding site found in the 3' untranslated region of mRNA encoded by MGC3101, corresponding to a target binding site such as BINDING SITE I, BINDING SITE II or BINDING SITE III of FIG. 8. Table 4 illustrates the complementarity of the nucleotide sequences of MGC3101 BINDING SITE, designated SEQ ID:6021, to the nucleotide sequence of GAM83 RNA, herein designated GAM RNA, also designated SEQ ID:287.

Another function of GAM83 is therefore inhibition of MGC3101 (Accession NP_076948.1). Accordingly, utilities of GAM83 include diagnosis, prevention and treatment of diseases and clinical conditions associated with MGC3101.

MGC33215 (Accession NP_722517.1) is another GAM83 target gene, herein designated TARGET GENE. MGC33215 BINDING SITE is a target binding site found in the 3' untranslated region of mRNA encoded by MGC33215, corresponding to a target binding site such as BINDING SITE I, BINDING SITE II or BINDING SITE III of FIG. 8. Table 4 illustrates the complementarity of the nucleotide sequences of MGC33215 BINDING SITE, designated SEQ ID:9985, to the nucleotide sequence of GAM83 RNA, herein designated GAM RNA, also designated SEQ ID:287.

Another function of GAM83 is therefore inhibition of MGC33215 (Accession NP_722517.1). Accordingly, utilities of GAM83 include diagnosis, prevention and treatment of diseases and clinical conditions associated with MGC33215.

MGC33974 (Accession NP_699181.1) is another GAM83 target gene, herein designated TARGET GENE. MGC33974 BINDING SITE is a target binding site found in the 3' untranslated region of mRNA encoded by MGC33974, corresponding to a target binding site such as BINDING SITE I, BINDING SITE II or BINDING SITE III of FIG. 8. Table 4 illustrates the complementarity of the nucleotide sequences of MGC33974 BINDING SITE, designated SEQ ID:19531, to the nucleotide sequence of GAM83 RNA, herein designated GAM RNA, also designated SEQ ID:287.

Another function of GAM83 is therefore inhibition of MGC33974 (Accession NP_699181.1). Accordingly, utilities of GAM83 include diagnosis, prevention and treatment of diseases and clinical conditions associated with MGC33974.

MGC35440 (Accession NP_694952.1) is another GAM83 target gene, herein designated TARGET GENE. MGC35440 BINDING SITE is a target binding site found in the 3' untranslated region of mRNA encoded by MGC35440, corresponding to a target binding site such as BINDING SITE I, BINDING SITE II or BINDING SITE III of FIG. 8. Table 4 illustrates the complementarity of the nucleotide sequences of MGC35440 BINDING SITE, designated SEQ ID:1776, to the nucleotide sequence of GAM83 RNA, herein designated GAM RNA, also designated SEQ ID:287.

Another function of GAM83 is therefore inhibition of MGC35440 (Accession NP_694952.1). Accordingly, utilities of GAM83 include diagnosis, prevention and treatment of diseases and clinical conditions associated with MGC35440.

Molybdenum cofactor synthesis 3 (MOCS3, Accession NP_055299.1) is another GAM83 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:4326, to the nucleotide sequence of GAM83 RNA, herein designated GAM RNA, also designated SEQ ID:287.

Another function of GAM83 is therefore inhibition of Molybdenum cofactor synthesis 3 (MOCS3, Accession NP_055299.1). Accordingly, utilities of GAM83 include diagnosis, prevention and treatment of diseases and clinical conditions associated with MOCS3.

Mitochondrial ribosomal protein l21 (MRPL21, Accession NP_852616.1) is another GAM83 target gene, herein designated TARGET GENE. MRPL21 BINDING SITE is a target binding site found in the 5' untranslated region of multiple transcripts of mRNA encoded by MRPL21, corresponding to a target binding site such as BINDING SITE I, BINDING SITE II or BINDING SITE III of FIG. 8. Table 4 illustrates the complementarity of the nucleotide sequences of MRPL21 BINDING SITE, designated SEQ ID:1724, to the nucleotide sequence of GAM83 RNA, herein designated GAM RNA, also designated SEQ ID:287.

Another function of GAM83 is therefore inhibition of Mitochondrial ribosomal protein l21 (MRPL21, Accession NP_852616.1). Accordingly, utilities of GAM83 include diagnosis, prevention and treatment of diseases and clinical conditions associated with MRPL21.

Mitochondrial ribosomal protein l30 (MRPL30, Accession NP_660213.1) is another GAM83 target gene, herein designated TARGET GENE. MRPL30 BINDING SITE is a target binding site found in the 3' untranslated region of multiple transcripts of mRNA encoded by MRPL30, corresponding to a target binding site such as BINDING SITE I, BINDING SITE II or BINDING SITE III of FIG. 8. Table 4 illustrates the complementarity of the nucleotide sequences of MRPL30 BINDING SITE, designated SEQ ID:8553, to the nucleotide sequence of GAM83 RNA, herein designated GAM RNA, also designated SEQ ID:287.

Another function of GAM83 is therefore inhibition of Mitochondrial ribosomal protein l30 (MRPL30, Accession NP_660213.1). Accordingly, utilities of GAM83 include diagnosis, prevention and treatment of diseases and clinical conditions associated with MRPL30.

Myosin, light polypeptide 9, regulatory (MYL9, Accession NP_852667.1) is another GAM83 target gene, herein designated TARGET GENE. MYL9 BINDING SITE is a target binding site found in the 3' untranslated region of multiple transcripts of mRNA encoded by MYL9, corresponding to a target binding site such as BINDING SITE I, BINDING SITE II or BINDING SITE III of FIG. 8. Table 4 illustrates the complementarity of the nucleotide sequences of MYL9 BINDING SITE, designated SEQ ID:1500, to the nucleotide sequence of GAM83 RNA, herein designated GAM RNA, also designated SEQ ID:287.

Another function of GAM83 is therefore inhibition of Myosin, light polypeptide 9, regulatory (MYL9, Accession NP_852667.1). Accordingly, utilities of GAM83 include diagnosis, prevention and treatment of diseases and clinical conditions associated with MYL9.

Myosin, light polypeptide 9, regulatory (MYL9, Accession NP_006088.2) is another GAM83 target gene, herein designated TARGET GENE. MYL9 BINDING SITE is a target binding site found in the 3' untranslated region of multiple transcripts of mRNA encoded by MYL9, corresponding to a target binding site such as BINDING SITE I, BINDING SITE II or BINDING SITE III of FIG. 8. Table 4 illustrates the complementarity of the nucleotide sequences of MYL9 BINDING SITE, designated SEQ ID:1500, to the nucleotide sequence of GAM83 RNA, herein designated GAM RNA, also designated SEQ ID:287.

Another function of GAM83 is therefore inhibition of Myosin, light polypeptide 9, regulatory (MYL9, Accession NP_006088.2). Accordingly, utilities of GAM83 include diagnosis, prevention and treatment of diseases and clinical conditions associated with MYL9.

Neural cell adhesion molecule 2 (NCAM2, Accession NP_004531.1) is another GAM83 target gene, herein designated TARGET GENE. NCAM2 BINDING SITE is a target binding site found in the 3' untranslated region of mRNA encoded by NCAM2, corresponding to a target binding site such as BINDING SITE I, BINDING SITE II or BINDING SITE III of FIG. 8. Table 4 illustrates the complementarity of the nucleotide sequences of NCAM2 BINDING SITE, designated SEQ ID:15637, to the nucleotide sequence of GAM83 RNA, herein designated GAM RNA, also designated SEQ ID:287.

Another function of GAM83 is therefore inhibition of Neural cell adhesion molecule 2 (NCAM2, Accession NP_004531.1). Accordingly, utilities of GAM83 include diagnosis, prevention and treatment of diseases and clinical conditions associated with NCAM2.

Nima (never in mitosis gene a)-related kinase 6 (NEK6, Accession NP_055212.2) is another GAM83 target gene, herein designated TARGET GENE. NEK6 BINDING SITE is a target binding site found in the 3' untranslated region of mRNA encoded by NEK6, corresponding to a target binding site such as BINDING SITE I, BINDING SITE II or BINDING SITE III of FIG. 8. Table 4 illustrates the complementarity of the nucleotide sequences of NEK6 BINDING SITE, designated SEQ ID:1469, to the nucleotide sequence of GAM83 RNA, herein designated GAM RNA, also designated SEQ ID:287.

Another function of GAM83 is therefore inhibition of Nima (never in mitosis gene a)-related kinase 6 (NEK6, Accession NP_055212.2), a gene which regulates nuclear and cytoplasmic aspects of the mitotic cycle. Accordingly, utilities of GAM83 include diagnosis, prevention and treatment of diseases and clinical conditions associated with NEK6.

The function of NEK6 and its association with various diseases and clinical conditions, has been established by previous studies, as described hereinabove with reference to GAM44.1. NFASC (Accession XP_046808.8) is another GAM83 target gene, herein designated TARGET GENE. NFASC BINDING SITE is a target binding site found in the 3' untranslated region of mRNA encoded by NFASC, corresponding to a target binding site such as BINDING SITE I, BINDING SITE II or BINDING SITE III of FIG. 8. Table 4 illustrates the complementarity of the nucleotide sequences of NFASC BINDING SITE, designated SEQ ID:8725, to the nucleotide sequence of GAM83 RNA, herein designated GAM RNA, also designated SEQ ID:287.

Another function of GAM83 is therefore inhibition of NFASC (Accession XP_046808.8). Accordingly, utilities of GAM83 include diagnosis, prevention and treatment of diseases and clinical conditions associated with NFASC.

NK4 (Accession NP_004212.3) is another GAM83 target gene, herein designated TARGET GENE. NK4 BINDING SITE is a target binding site found in the 3' untranslated region of mRNA encoded by NK4, corresponding to a target binding site such as BINDING SITE I, BINDING SITE II or BINDING SITE III of FIG. 8. Table 4 illustrates the complementarity of the nucleotide sequences of NK4 BINDING SITE, designated SEQ ID:19318, to the nucleotide sequence of GAM83 RNA, herein designated GAM RNA, also designated SEQ ID:287.

Another function of GAM83 is therefore inhibition of NK4 (Accession NP_004212.3). Accordingly, utilities of GAM83 include diagnosis, prevention and treatment of diseases and clinical conditions associated with NK4.

NP220 (Accession NP_055312.2) is another GAM83 target gene, herein designated TARGET GENE. NP220 BINDING SITE is a target binding site found in the 5' untranslated region of mRNA encoded by NP220, corresponding to a target binding site such as BINDING SITE I, BINDING SITE II or BINDING SITE III of FIG. 8. Table 4 illustrates the complementarity of the nucleotide sequences of NP220 BINDING SITE, designated SEQ ID:9969, to the nucleotide sequence of GAM83 RNA, herein designated GAM RNA, also designated SEQ ID:287.

Another function of GAM83 is therefore inhibition of NP220 (Accession NP_055312.2). Accordingly, utilities of GAM83 include diagnosis, prevention and treatment of diseases and clinical conditions associated with NP220.

Neuronal pentraxin receptor (NPTXR, Accession NP_055108.2) is another GAM83 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:3192, to the nucleotide sequence of GAM83 RNA, herein designated GAM RNA, also designated SEQ ID:287.

Another function of GAM83 is therefore inhibition of Neuronal pentraxin receptor (NPTXR, Accession NP_055108.2). Accordingly, utilities of GAM83 include diagnosis, prevention and treatment of diseases and clinical conditions associated with NPTXR.

Neuronal pentraxin receptor (NPTXR, Accession NP_478058.1) is another GAM83 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:3192, to the nucleotide sequence of GAM83 RNA, herein designated GAM RNA, also designated SEQ ID:287.

Another function of GAM83 is therefore inhibition of Neuronal pentraxin receptor (NPTXR, Accession NP_478058.1). Accordingly, utilities of GAM83 include diagnosis, prevention and treatment of diseases and clinical conditions associated with NPTXR.

Purinergic receptor p2x, ligand-gated ion channel, 5 (P2RX5, Accession NP_778255.1) is another GAM83 target gene, herein designated TARGET GENE. P2RX5 BINDING SITE is a target binding site found in the 3' untranslated region of multiple transcripts of mRNA encoded by P2RX5, corresponding to a target binding site such as BINDING SITE I, BINDING SITE II or BINDING SITE III of FIG. 8. Table 4 illustrates the complementarity of the nucleotide sequences of P2RX5 BINDING SITE, designated SEQ ID:4268, to the nucleotide sequence of GAM83 RNA, herein designated GAM RNA, also designated SEQ ID:287.

Another function of GAM83 is therefore inhibition of Purinergic receptor p2x, ligand-gated ion channel, 5 (P2RX5, Accession NP_778255.1). Accordingly, utilities of GAM83 include diagnosis, prevention and treatment of diseases and clinical conditions associated with P2RX5.

Purinergic receptor p2x, ligand-gated ion channel, 5 (P2RX5, Accession NP_002552.2) is another GAM83 target gene, herein designated TARGET GENE. P2RX5 BINDING SITE is a target binding site found in the 3' untranslated region of multiple transcripts of mRNA encoded by P2RX5, corresponding to a target binding site such as BINDING SITE I, BINDING SITE II or BINDING SITE III of FIG. 8. Table 4 illustrates the complementarity of the nucleotide sequences of P2RX5 BINDING SITE, designated SEQ ID:4268, to the nucleotide sequence of GAM83 RNA, herein designated GAM RNA, also designated SEQ ID:287.

Another function of GAM83 is therefore inhibition of Purinergic receptor p2x, ligand-gated ion channel, 5 (P2RX5, Accession NP_002552.2). Accordingly, utilities of GAM83 include diagnosis, prevention and treatment of diseases and clinical conditions associated with P2RX5.

Phosphodiesterase 5a, cgmp-specific (PDE5A, Accession NP_246273.1) is another GAM83 target gene, herein designated TARGET GENE. PDE5A BINDING SITE is a target binding site found in the 5' untranslated region of multiple transcripts of mRNA encoded by PDE5A, corresponding to a target binding site such as BINDING SITE I, BINDING SITE II or BINDING SITE III of FIG. 8. Table 4 illustrates the complementarity of the nucleotide sequences of PDE5A BINDING SITE, designated SEQ ID:19020, to the nucleotide sequence of GAM83 RNA, herein designated GAM RNA, also designated SEQ ID:287.

Another function of GAM83 is therefore inhibition of Phosphodiesterase 5a, cgmp-specific (PDE5A, Accession NP_246273.1), a gene which plays a role in signal transduction by regulating the intracellular concentration of cyclic nucleotides. Accordingly, utilities of GAM83 include diagnosis, prevention and treatment of diseases and clinical conditions associated with PDE5A.

The function of PDE5A and its association with various diseases and clinical conditions, has been established by previous studies, as described hereinabove with reference to GAM44.1. Pellino homolog 2 (drosophila) (PELI2, Accession NP_067078.1) is another GAM83 target gene, herein designated TARGET GENE. PELI2 BINDING SITE is a target binding site found in the 3' untranslated region of mRNA encoded by PELI2, corresponding to a target binding site such as BINDING SITE I, BINDING SITE II or BINDING SITE III of FIG. 8. Table 4 illustrates the complementarity of the nucleotide sequences of PELI2 BINDING SITE, designated SEQ ID:7435, to the nucleotide sequence of GAM83 RNA, herein designated GAM RNA, also designated SEQ ID:287.

Another function of GAM83 is therefore inhibition of Pellino homolog 2 (drosophila) (PELI2, Accession NP_067078.1). Accordingly, utilities of GAM83 include diagnosis, prevention and treatment of diseases and clinical conditions associated with PELI2.

Peptidase d (PEPD, Accession NP_000276.1) is another GAM83 target gene, herein designated TARGET GENE. PEPD BINDING SITE is a target binding site found in the 3' untranslated region of mRNA encoded by PEPD, corresponding to a target binding site such as BINDING SITE I, BINDING SITE II or BINDING SITE III of FIG. 8. Table 4 illustrates the complementarity of the nucleotide sequences of PEPD BINDING SITE, designated SEQ ID:4327, to the nucleotide sequence of GAM83 RNA, herein designated GAM RNA, also designated SEQ ID:287.

Another function of GAM83 is therefore inhibition of Peptidase d (PEPD, Accession NP_000276.1). Accordingly, utilities of GAM83 include diagnosis, prevention and treatment of diseases and clinical conditions associated with PEPD.

PILRB (Accession NP_778212.2) is another GAM83 target gene, herein designated TARGET GENE. PILRB BINDING SITE is a target binding site found in the 5' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:5459, to the nucleotide sequence of GAM83 RNA, herein designated GAM RNA, also designated SEQ ID:287.

Another function of GAM83 is therefore inhibition of PILRB (Accession NP_778212.2). Accordingly, utilities of GAM83 include diagnosis, prevention and treatment of diseases and clinical conditions associated with PILRB.

PILRB (Accession NP_038468.3) is another GAM83 target gene, herein designated TARGET GENE. PILRB BINDING SITE is a target binding site found in the 5' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:5459, to the nucleotide sequence of GAM83 RNA, herein designated GAM RNA, also designated SEQ ID:287.

Another function of GAM83 is therefore inhibition of PILRB (Accession NP_038468.3). Accordingly, utilities of GAM83 include diagnosis, prevention and treatment of diseases and clinical conditions associated with PILRB.

Pogo transposable element with znf domain (POGZ, Accession NP_055915.1) is another GAM83 target gene, herein designated TARGET GENE. POGZ BINDING SITE is a target binding site found in the 3' untranslated region of multiple transcripts of mRNA encoded by POGZ, corresponding to a target binding site such as BINDING SITE I, BINDING SITE II or BINDING SITE III of FIG. 8. Table 4 illustrates the complementarity of the nucleotide sequences of POGZ BINDING SITE, designated SEQ ID:11143, to the nucleotide sequence of GAM83 RNA, herein designated GAM RNA, also designated SEQ ID:287.

Another function of GAM83 is therefore inhibition of Pogo transposable element with znf domain (POGZ, Accession NP_055915.1). Accordingly, utilities of GAM83 include diagnosis, prevention and treatment of diseases and clinical conditions associated with POGZ.

Polymerase (rna) ii (dna directed) polypeptide d (POLR2D, Accession NP_004796.1) is another GAM83 target gene, herein designated TARGET GENE. POLR2D BINDING SITE is a target binding site found in the 3' untranslated region of mRNA encoded by POLR2D, corresponding to a target binding site such as BINDING SITE I, BINDING SITE II or BINDING SITE III of FIG. 8. Table 4 illustrates the complementarity of the nucleotide sequences of POLR2D BINDING SITE, designated SEQ ID:4052, to the nucleotide sequence of GAM83 RNA, herein designated GAM RNA, also designated SEQ ID:287.

Another function of GAM83 is therefore inhibition of Polymerase (rna) ii (dna directed) polypeptide d (POLR2D, Accession NP_004796.1). Accordingly, utilities of GAM83 include diagnosis, prevention and treatment of diseases and clinical conditions associated with POLR2D.

Pou domain, class 2, associating factor 1 (POU2AF1, Accession NP_006226.1) is another GAM83 target gene, herein designated TARGET GENE. POU2AF1 BINDING SITE is a target binding site found in the 5' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:16639, to the nucleotide sequence of GAM83 RNA, herein designated GAM RNA, also designated SEQ ID:287.

Another function of GAM83 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM83 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. Protein phosphatase 1, regulatory (inhibitor) subunit 3a (glycogen and sarcoplasmic reticulum binding subunit, skeletal muscle) (PPP1R3A, Accession NP_002702.1) is another GAM83 target gene, herein designated TARGET GENE. PPP1R3A BINDING SITE is a target binding site found in the 3' untranslated region of mRNA encoded by PPP1R3A, corresponding to a target binding site such as BINDING SITE I, BINDING SITE II or BINDING SITE III of FIG. 8. Table 4 illustrates the complementarity of the nucleotide sequences of PPP1R3A BINDING SITE, designated SEQ ID:20165, to the nucleotide sequence of GAM83 RNA, herein designated GAM RNA, also designated SEQ ID:287.

Another function of GAM83 is therefore inhibition of Protein phosphatase 1, regulatory (inhibitor) subunit 3a (glycogen and sarcoplasmic reticulum binding subunit, skeletal muscle) (PPP1R3A, Accession NP_002702.1), a gene which regulates phosphatase activity towards glycogen synthase, active in skeletal muscle and therefore may be associated with Insulin resistance and glycemia variation. Accordingly, utilities of GAM83 include diagnosis, prevention and treatment of Insulin resistance and glycemia variation, and of other diseases and clinical conditions associated with PPP1R3A.

The function of PPP1R3A and its association with various diseases and clinical conditions, has been established by previous studies, as described hereinabove with reference to GAM44.1. Pr domain containing 2, with znf domain (PRDM2, Accession NP_056950.2) is another GAM83 target gene, herein designated TARGET GENE. PRDM2 BINDING SITE is a target binding site found in the 3' untranslated region of multiple transcripts of mRNA encoded by PRDM2, corresponding to a target binding site such as BINDING SITE I, BINDING SITE II or BINDING SITE III of FIG. 8. Table 4 illustrates the complementarity of the nucleotide sequences of PRDM2 BINDING SITE, designated SEQ ID:12854, to the nucleotide sequence of GAM83 RNA, herein designated GAM RNA, also designated SEQ ID:287.

Another function of GAM83 is therefore inhibition of Pr domain containing 2, with znf domain (PRDM2, Accession NP_056950.2), a gene which plays a role in transcriptional regulation during neuronal differentiation and pathogenesis of retinoblastoma. and therefore may be associated with Tumor. Accordingly, utilities of GAM83 include diagnosis, prevention and treatment of Tumor, and of other diseases and clinical conditions associated with PRDM2.

The function of PRDM2 and its association with various diseases and clinical conditions, has been established by previous studies, as described hereinabove with reference to GAM44.1. Protein kinase c, nu (PRKCN, Accession NP_005804.1) is another GAM83 target gene, herein designated TARGET GENE. PRKCN BINDING SITE is a target binding site found in the 3' untranslated region of mRNA encoded by PRKCN, corresponding to a target binding site such as BINDING SITE I, BINDING SITE II or BINDING SITE III of FIG. 8. Table 4 illustrates the complementarity of the nucleotide sequences of PRKCN BINDING SITE, designated SEQ ID:19159, to the nucleotide sequence of GAM83 RNA, herein designated GAM RNA, also designated SEQ ID:287.

Another function of GAM83 is therefore inhibition of Protein kinase c, nu (PRKCN, Accession NP_005804.1). Accordingly, utilities of GAM83 include diagnosis, prevention and treatment of diseases and clinical conditions associated with PRKCN.

PRO0461 (Accession NP_112558.1) is another GAM83 target gene, herein designated TARGET GENE. PRO0461 BINDING SITE is a target binding site found in the 5' untranslated region of mRNA encoded by PRO0461, corresponding to a target binding site such as BINDING SITE I, BINDING SITE II or BINDING SITE III of FIG. 8. Table 4 illustrates the complementarity of the nucleotide sequences of PRO0461 BINDING SITE, designated SEQ ID:19001, to the nucleotide sequence of GAM83 RNA, herein designated GAM RNA, also designated SEQ ID:287.

Another function of GAM83 is therefore inhibition of PRO0461 (Accession NP_112558.1). Accordingly, utilities of GAM83 include diagnosis, prevention and treatment of diseases and clinical conditions associated with PRO0461.

Pyrroline-5-carboxylate reductase 1 (PYCR1, Accession NP_008838.2) is another GAM83 target gene, herein designated TARGET GENE. PYCR1 BINDING SITE1 and PYCR1 BINDING SITE2 are target binding sites found in untranslated regions of multiple transcripts of mRNA encoded by PYCR1, corresponding to target binding sites such as BINDING SITE I, BINDING SITE II or BINDING SITE III of FIG. 8. Table 4 illustrates the complementarity of the nucleotide sequences of PYCR1 BINDING SITE1 and PYCR1 BINDING SITE2, designated SEQ ID:17062 and SEQ ID:7092 respectively, to the nucleotide sequence of GAM83 RNA, herein designated GAM RNA, also designated SEQ ID:287.

Another function of GAM83 is therefore inhibition of Pyrroline-5-carboxylate reductase 1 (PYCR1, Accession NP_008838.2), a gene which catalyzes the NAD(P)H-dependent conversion of pyrroline-5-carboxylate to proline. Accordingly, utilities of GAM83 include diagnosis, prevention and treatment of diseases and clinical conditions associated with PYCR1.

The function of PYCR1 and its association with various diseases and clinical conditions, has been established by previous studies, as described hereinabove with reference to GAM44.1. Rab11-FIP2 (Accession NP_055719.1) is another GAM83 target gene, herein designated TARGET GENE. Rab11-FIP2 BINDING SITE is a target binding site found in the 3' untranslated region of mRNA encoded by Rab11-FIP2, corresponding to a target binding site such as BINDING SITE I, BINDING SITE II or BINDING SITE III of FIG. 8. Table 4 illustrates the complementarity of the nucleotide sequences of Rab11-FIP2 BINDING SITE, designated SEQ ID:7165, to the nucleotide sequence of GAM83 RNA, herein designated GAM RNA, also designated SEQ ID:287.

Another function of GAM83 is therefore inhibition of Rab11-FIP2 (Accession NP_055719.1). Accordingly, utilities of GAM83 include diagnosis, prevention and treatment of diseases and clinical conditions associated with Rab11-FIP2.

Rab39b, member ras oncogene family (RAB39B, Accession NP_741995.1) is another GAM83 target gene, herein designated TARGET GENE. RAB39B BINDING SITE is a target binding site found in the 3' untranslated region of mRNA encoded by RAB39B, corresponding to a target binding site such as BINDING SITE I, BINDING SITE II or BINDING SITE III of FIG. 8. Table 4 illustrates the complementarity of the nucleotide sequences of RAB39B BINDING SITE, designated SEQ ID:14419, to the nucleotide sequence of GAM83 RNA, herein designated GAM RNA, also designated SEQ ID:287.

Another function of GAM83 is therefore inhibition of Rab39b, member ras oncogene family (RAB39B, Accession NP_741995.1). Accordingly, utilities of GAM83 include diagnosis, prevention and treatment of diseases and clinical conditions associated with RAB39B.

Rap1b, member of ras oncogene family (RAP1B, Accession NP_056461.1) is another GAM83 target gene, herein designated TARGET GENE. RAP1B BINDING SITE is a target binding site found in the 3' untranslated region of mRNA encoded by RAP1B, corresponding to a target binding site such as BINDING SITE I, BINDING SITE II or BINDING SITE III of FIG. 8. Table 4 illustrates the complementarity of the nucleotide sequences of RAP1B BINDING SITE, designated SEQ ID:7459, to the nucleotide sequence of GAM83 RNA, herein designated GAM RNA, also designated SEQ ID:287.

Another function of GAM83 is therefore inhibition of Rap1b, member of ras oncogene family (RAP1B, Accession NP_056461.1), a gene which induces morphological reversion of a cell line transformed by a ras oncogene. Accordingly, utilities of GAM83 include diagnosis, prevention and treatment of diseases and clinical conditions associated with RAP1B.

The function of RAP1B and its association with various diseases and clinical conditions, has been established by previous studies, as described hereinabove with reference to GAM44.1. Rap2a, member of ras oncogene family (RAP2A, Accession NP_066361.1) is another GAM83 target gene, herein designated TARGET GENE. RAP2A BINDING SITE is a target binding site found in the 3' untranslated region of mRNA encoded by RAP2A, corresponding to a target binding site such as BINDING SITE I, BINDING SITE II or BINDING SITE III of FIG. 8. Table 4 illustrates the complementarity of the nucleotide sequences of RAP2A BINDING SITE, designated SEQ ID:12939, to the nucleotide sequence of GAM83 RNA, herein designated GAM RNA, also designated SEQ ID:287.

Another function of GAM83 is therefore inhibition of Rap2a, member of ras oncogene family (RAP2A, Accession NP_066361.1). Accordingly, utilities of GAM83 include diagnosis, prevention and treatment of diseases and clinical conditions associated with RAP2A.

Ras guanyl releasing protein 2 (calcium and dag-regulated) (RASGRP2, Accession NP_722541.1) is another GAM83 target gene, herein designated TARGET GENE. RASGRP2 BINDING SITE is a target binding site found in the 5' untranslated region of multiple transcripts of mRNA encoded by RASGRP2, corresponding to a target binding site such as BINDING SITE I, BINDING SITE II or BINDING SITE III of FIG. 8. Table 4 illustrates the complementarity of the nucleotide sequences of RASGRP2 BINDING SITE, designated SEQ ID:18244, to the nucleotide sequence of GAM83 RNA, herein designated GAM RNA, also designated SEQ ID:287.

Another function of GAM83 is therefore inhibition of Ras guanyl releasing protein 2 (calcium and dag-regulated) (RASGRP2, Accession NP_722541.1), a gene which promotes the exchange of ras-bound gdp by gtp. Accordingly, utilities of GAM83 include diagnosis, prevention and treatment of diseases and clinical conditions associated with RASGRP2.

The function of RASGRP2 and its association with various diseases and clinical conditions, has been established by previous studies, as described hereinabove with reference to GAM44.1. Ras guanyl releasing protein 2 (calcium and dag-regulated) (RASGRP2, Accession NP_005816.2) is another GAM83 target gene, herein designated TARGET GENE. RASGRP2 BINDING SITE is a target binding site found in the 5' untranslated region of multiple transcripts of mRNA encoded by RASGRP2, corresponding to a target binding site such as BINDING SITE I, BINDING SITE II or BINDING SITE III of FIG. 8. Table 4 illustrates the complementarity of the nucleotide sequences of RASGRP2 BINDING SITE, designated SEQ ID:18244, to the nucleotide sequence of GAM83 RNA, herein designated GAM RNA, also designated SEQ ID:287.

Another function of GAM83 is therefore inhibition of Ras guanyl releasing protein 2 (calcium and dag-regulated) (RASGRP2, Accession NP_005816.2), a gene which promotes the exchange of ras-bound gdp by gtp. Accordingly, utilities of GAM83 include diagnosis, prevention and treatment of diseases and clinical conditions associated with RASGRP2.

The function of RASGRP2 and its association with various diseases and clinical conditions, has been established by previous studies, as described hereinabove with reference to GAM44.1. Ring finger protein 1 (RING1, Accession NP_002922.1) is another GAM83 target gene, herein designated TARGET GENE. RING1 BINDING SITE is a target binding site found in the 5' untranslated region of mRNA encoded by RING1, corresponding to a target binding site such as BINDING SITE I, BINDING SITE II or BINDING SITE III of FIG. 8. Table 4 illustrates the complementarity of the nucleotide sequences of RING1 BINDING SITE, designated SEQ ID:11106, to the nucleotide sequence of GAM83 RNA, herein designated GAM RNA, also designated SEQ ID:287.

Another function of GAM83 is therefore inhibition of Ring finger protein 1 (RING1, Accession NP_002922.1), a gene which involves in transcriptional regulation. Accordingly, utilities of GAM83 include diagnosis, prevention and treatment of diseases and clinical conditions associated with RING1.

The function of RING1 and its association with various diseases and clinical conditions, has been established by previous studies, as described hereinabove with reference to GAM44.1. RNF39 (Accession NP_079512.1) is another GAM83 target gene, herein designated TARGET GENE. RNF39 BINDING SITE is a target binding site found in the 3' untranslated region of multiple transcripts of mRNA encoded by RNF39, corresponding to a target binding site such as BINDING SITE I, BINDING SITE II or BINDING SITE III of FIG. 8. Table 4 illustrates the complementarity of the nucleotide sequences of RNF39 BINDING SITE, designated SEQ ID:5743, to the nucleotide sequence of GAM83 RNA, herein designated GAM RNA, also designated SEQ ID:287.

Another function of GAM83 is therefore inhibition of RNF39 (Accession NP_079512.1). Accordingly, utilities of GAM83 include diagnosis, prevention and treatment of diseases and clinical conditions associated with RNF39.

RNF39 (Accession NP_739575.1) is another GAM83 target gene, herein designated TARGET GENE. RNF39 BINDING SITE is a target binding site found in the 3' untranslated region of multiple transcripts of mRNA encoded by RNF39, corresponding to a target binding site such as BINDING SITE I, BINDING SITE II or BINDING SITE III of FIG. 8. Table 4 illustrates the complementarity of the nucleotide sequences of RNF39 BINDING SITE, designated SEQ ID:5743, to the nucleotide sequence of GAM83 RNA, herein designated GAM RNA, also designated SEQ ID:287.

Another function of GAM83 is therefore inhibition of RNF39 (Accession NP_739575.1). Accordingly, utilities of GAM83 include diagnosis, prevention and treatment of diseases and clinical conditions associated with RNF39.

SALPR (Accession NP_057652.1) is another GAM83 target gene, herein designated TARGET GENE. SALPR BINDING SITE is a target binding site found in the 5' untranslated region of mRNA encoded by SALPR, corresponding to a target binding site such as BINDING SITE I, BINDING SITE II or BINDING SITE III of FIG. 8. Table 4 illustrates the complementarity of the nucleotide sequences of SALPR BINDING SITE, designated SEQ ID:1044, to the nucleotide sequence of GAM83 RNA, herein designated GAM RNA, also designated SEQ ID:287.

Another function of GAM83 is therefore inhibition of SALPR (Accession NP_057652.1). Accordingly, utilities of GAM83 include diagnosis, prevention and treatment of diseases and clinical conditions associated with SALPR.

Spinocerebellar ataxia 1 (olivopontocerebellar ataxia 1, autosomal dominant, ataxin 1) (SCA1, Accession NP_000323.1) is another GAM83 target gene, herein designated TARGET GENE. SCA1 BINDING SITE is a target binding site found in the 3' untranslated region of mRNA encoded by SCA1, corresponding to a target binding site such as BINDING SITE I, BINDING SITE II or BINDING SITE III of FIG. 8. Table 4 illustrates the complementarity of the nucleotide sequences of SCA1 BINDING SITE, designated SEQ ID:17933, to the nucleotide sequence of GAM83 RNA, herein designated GAM RNA, also designated SEQ ID:287.

Another function of GAM83 is therefore inhibition of Spinocerebellar ataxia 1 (olivopontocerebellar ataxia 1, autosomal dominant, ataxin 1) (SCA1, Accession NP_000323.1). Accordingly, utilities of GAM83 include diagnosis, prevention and treatment of diseases and clinical conditions associated with SCA1.

Sodium channel, nonvoltage-gated 1 alpha (SCNN1A, Accession NP_001029.1) is another GAM83 target gene, herein designated TARGET GENE. SCNN1A BINDING SITE is a target binding site found in the 3' untranslated region of mRNA encoded by SCNN1A, corresponding to a target binding site such as BINDING SITE I, BINDING SITE II or BINDING SITE III of FIG. 8. Table 4 illustrates the complementarity of the nucleotide sequences of SCNN1A BINDING SITE, designated SEQ ID:16640, to the nucleotide sequence of GAM83 RNA, herein designated GAM RNA, also designated SEQ ID:287.

Another function of GAM83 is therefore inhibition of Sodium channel, nonvoltage-gated 1 alpha (SCNN1A, Accession NP_001029.1). Accordingly, utilities of GAM83 include diagnosis, prevention and treatment of diseases and clinical conditions associated with SCNN1A.

Sema domain, immunoglobulin domain (ig), transmembrane domain (tm) and short cytoplasmic domain, (semaphorin) 4c (SEMA4C, Accession NP_060259.2) is another GAM83 target gene, herein designated TARGET GENE. SEMA4C BINDING SITE is a target binding site found in the 5' untranslated region of mRNA encoded by SEMA4C, corresponding to a target binding site such as BINDING SITE I, BINDING SITE II or BINDING SITE III of FIG. 8. Table 4 illustrates the complementarity of the nucleotide sequences of SEMA4C BINDING SITE, designated SEQ ID:13121, to the nucleotide sequence of GAM83 RNA, herein designated GAM RNA, also designated SEQ ID:287.

Another function of GAM83 is therefore inhibition of Sema domain, immunoglobulin domain (ig), transmembrane domain (tm) and short cytoplasmic domain, (semaphorin) 4c (SEMA4C, Accession NP_060259.2). Accordingly, utilities of GAM83 include diagnosis, prevention and treatment of diseases and clinical conditions associated with SEMA4C.

Splicing factor, arginine/serine-rich 2, interacting protein (SFRS2IP, Accession NP_004710.1) is another GAM83 target gene, herein designated TARGET GENE. SFRS2IP BINDING SITE is a target binding site found in the 3' untranslated region of mRNA encoded by SFRS2IP, corresponding to a target binding site such as BINDING SITE I, BINDING SITE II or BINDING SITE III of FIG. 8. Table 4 illustrates the complementarity of the nucleotide sequences of SFRS2IP BINDING SITE, designated SEQ ID:13515, to the nucleotide sequence of GAM83 RNA, herein designated GAM RNA, also designated SEQ ID:287.

Another function of GAM83 is therefore inhibition of Splicing factor, arginine/serine-rich 2, interacting protein (SFRS2IP, Accession NP_004710.1), a gene which plays an essential role in pre-mRNA splicing. Accordingly, utilities of GAM83 include diagnosis, prevention and treatment of diseases and clinical conditions associated with SFRS2IP.

The function of SFRS2IP and its association with various diseases and clinical conditions, has been established by previous studies, as described hereinabove with reference to GAM44.1. Sialyltransferase 6 (n-acetyllacosaminide alpha 2,3-sialyltransferase) (SIAT6, Accession NP_006270.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_006270.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777627.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777627.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777628.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777628.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777624.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777624.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777629.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777629.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777631.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777631.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777623.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777623.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777626.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777626.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777630.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777630.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777632.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777632.1). Accordingly, utilities of GAM83 include diagnosis, prevention and treatment of diseases and clinical conditions associated with SIAT6.

Sialyltransferase 6 (n-acetyllacosaminide alpha 2,3-sialyltransferase) (SIAT6, Accession NP_777625.1) is another GAM83 target gene, herein designated TARGET GENE. SIAT6 BINDING SITE is a target binding site found in the 3' untranslated region of multiple transcripts of mRNA encoded by SIAT6, corresponding to a target binding site such as BINDING SITE I, BINDING SITE II or BINDING SITE III of FIG. 8. Table 4 illustrates the complementarity of the nucleotide sequences of SIAT6 BINDING SITE, designated SEQ ID:8130, to the nucleotide sequence of GAM83 RNA, herein designated GAM RNA, also designated SEQ ID:287.

Another function of GAM83 is therefore inhibition of Sialyltransferase 6 (n-acetyllacosaminide alpha 2,3-sialyltransferase) (SIAT6, Accession NP_777625.1). Accordingly, utilities of GAM83 include diagnosis, prevention and treatment of diseases and clinical conditions associated with SIAT6.

SLC30A7 (Accession NP_598003.1) is another GAM83 target gene, herein designated TARGET GENE. SLC30A7 BINDING SITE is a target binding site found in the 3' untranslated region of mRNA encoded by SLC30A7, corresponding to a target binding site such as BINDING SITE I, BINDING SITE II or BINDING SITE III of FIG. 8. Table 4 illustrates the complementarity of the nucleotide sequences of SLC30A7 BINDING SITE, designated SEQ ID:7436, to the nucleotide sequence of GAM83 RNA, herein designated GAM RNA, also designated SEQ ID:287.

Another function of GAM83 is therefore inhibition of SLC30A7 (Accession NP_598003.1). Accordingly, utilities of GAM83 include diagnosis, prevention and treatment of diseases and clinical conditions associated with SLC30A7.

Syntrophin, gamma 2 (SNTG2, Accession NP_061841.1) is another GAM83 target gene, herein designated TARGET GENE. SNTG2 BINDING SITE is a target binding site found in the 3' untranslated region of multiple transcripts of mRNA encoded by SNTG2, corresponding to a target binding site such as BINDING SITE I, BINDING SITE II or BINDING SITE III of FIG. 8. Table 4 illustrates the complementarity of the nucleotide sequences of SNTG2 BINDING SITE, designated SEQ ID:9285, to the nucleotide sequence of GAM83 RNA, herein designated GAM RNA, also designated SEQ ID:287.

Another function of GAM83 is therefore inhibition of Syntrophin, gamma 2 (SNTG2, Accession NP_061841.1). Accordingly, utilities of GAM83 include diagnosis, prevention and treatment of diseases and clinical conditions associated with SNTG2.

Sry (sex determining region y)-box 4 (SOX4, Accession NP_003098.1) is another GAM83 target gene, herein designated TARGET GENE. SOX4 BINDING SITE is a target binding site found in the 3' untranslated region of mRNA encoded by SOX4, corresponding to a target binding site such as BINDING SITE I, BINDING SITE II or BINDING SITE III of FIG. 8. Table 4 illustrates the complementarity of the nucleotide sequences of SOX4 BINDING SITE, designated SEQ ID:9249, to the nucleotide sequence of GAM83 RNA, herein designated GAM RNA, also designated SEQ ID:287.

Another function of GAM83 is therefore inhibition of Sry (sex determining region y)-box 4 (SOX4, Accession NP_003098.1), a gene which binds with high affinity to the t-cell enhancer motif 5'-aacaaag-3' motif. Accordingly, utilities of GAM83 include diagnosis, prevention and treatment of diseases and clinical conditions associated with SOX4.

The function of SOX4 and its association with various diseases and clinical conditions, has been established by previous studies, as described hereinabove with reference to GAM44.1. Sry (sex determining region y)-box 7 (SOX7, Accession NP_113627.1) is another GAM83 target gene, herein designated TARGET GENE. SOX7 BINDING SITE is a target binding site found in the 3' untranslated region of mRNA encoded by SOX7, corresponding to a target binding site such as BINDING SITE I, BINDING SITE II or BINDING SITE III of FIG. 8. Table 4 illustrates the complementarity of the nucleotide sequences of SOX7 BINDING SITE, designated SEQ ID:4922, to the nucleotide sequence of GAM83 RNA, herein designated GAM RNA, also designated SEQ ID:287.

Another function of GAM83 is therefore inhibition of Sry (sex determining region y)-box 7 (SOX7, Accession NP_113627.1). Accordingly, utilities of GAM83 include diagnosis, prevention and treatment of diseases and clinical conditions associated with SOX7.

SPRR4 (Accession NP_775103.1) is another GAM83 target gene, herein designated TARGET GENE. SPRR4 BINDING SITE is a target binding site found in the 3' untranslated region of mRNA encoded by SPRR4, corresponding to a target binding site such as BINDING SITE I, BINDING SITE II or BINDING SITE III of FIG. 8. Table 4 illustrates the complementarity of the nucleotide sequences of SPRR4 BINDING SITE, designated SEQ ID:1276, to the nucleotide sequence of GAM83 RNA, herein designated GAM RNA, also designated SEQ ID:287.

Another function of GAM83 is therefore inhibition of SPRR4 (Accession NP_775103.1). Accordingly, utilities of GAM83 include diagnosis, prevention and treatment of diseases and clinical conditions associated with SPRR4.

Signal recognition particle receptor ('docking protein') (SRPR, Accession NP_003130.2) is another GAM83 target gene, herein designated TARGET GENE. SRPR BINDING SITE is a target binding site found in the 3' untranslated region of mRNA encoded by SRPR, corresponding to a target binding site such as BINDING SITE I, BINDING SITE II or BINDING SITE III of FIG. 8. Table 4 illustrates the complementarity of the nucleotide sequences of SRPR BINDING SITE, designated SEQ ID:14130, to the nucleotide sequence of GAM83 RNA, herein designated GAM RNA, also designated SEQ ID:287.

Another function of GAM83 is therefore inhibition of Signal recognition particle receptor ('docking protein') (SRPR, Accession NP_003130.2). Accordingly, utilities of GAM83 include diagnosis, prevention and treatment of diseases and clinical conditions associated with SRPR.

Sjogren syndrome antigen a1 (52 kda, ribonucleoprotein autoantigen ss-a/ro) (SSA1, Accession NP_003132.2) is another GAM83 target gene, herein designated TARGET GENE. SSA1 BINDING SITE is a target binding site found in the 3' untranslated region of mRNA encoded by SSA1, corresponding to a target binding site such as BINDING SITE I, BINDING SITE II or BINDING SITE III of FIG. 8. Table 4 illustrates the complementarity of the nucleotide sequences of SSA1 BINDING SITE, designated SEQ ID:18743, to the nucleotide sequence of GAM83 RNA, herein designated GAM RNA, also designated SEQ ID:287.

Another function of GAM83 is therefore inhibition of Sjogren syndrome antigen a1 (52 kda, ribonucleoprotein autoantigen ss-a/ro) (SSA1, Accession NP_003132.2), a gene which is a Minor component of Ro/SSA ribonucleoprotein complexes, recognized by autoantibodies and therefore may be associated with Systemic lupus erythematosus and sjogren syndrome. Accordingly, utilities of GAM83 include diagnosis, prevention and treatment of Systemic lupus erythematosus and sjogren syndrome., and of other diseases and clinical conditions associated with SSA1.

The function of SSA1 and its association with various diseases and clinical conditions, has been established by previous studies, as described hereinabove with reference to GAM44.1. Signal transducer and activator of transcription 1, 91 kda (STAT1, Accession NP_644671.1) is another GAM83 target gene, herein designated TARGET GENE. STAT1 BINDING SITE is a target binding site found in the 3' untranslated region of multiple transcripts of mRNA encoded by STAT1, corresponding to a target binding site such as BINDING SITE I, BINDING SITE II or BINDING SITE III of FIG. 8. Table 4 illustrates the complementarity of the nucleotide sequences of STAT1 BINDING SITE, designated SEQ ID:15202, to the nucleotide sequence of GAM83 RNA, herein designated GAM RNA, also designated SEQ ID:287.

Another function of GAM83 is therefore inhibition of Signal transducer and activator of transcription 1, 91 kda (STAT1, Accession NP_644671.1), a gene which is involved in transcriptional regulation. Accordingly, utilities of GAM83 include diagnosis, prevention and treatment of diseases and clinical conditions associated with STAT1.

The function of STAT1 and its association with various diseases and clinical conditions, has been established by previous studies, as described hereinabove with reference to GAM44.1. STHM (Accession NP_006447.1) is another GAM83 target gene, herein designated TARGET GENE. STHM BINDING SITE is a target binding site found in the 3' untranslated region of mRNA encoded by STHM, corresponding to a target binding site such as BINDING SITE I, BINDING SITE II or BINDING SITE III of FIG. 8. Table 4 illustrates the complementarity of the nucleotide sequences of STHM BINDING SITE, designated SEQ ID:1189, to the nucleotide sequence of GAM83 RNA, herein designated GAM RNA, also designated SEQ ID:287.

Another function of GAM83 is therefore inhibition of STHM (Accession NP_006447.1). Accordingly, utilities of GAM83 include diagnosis, prevention and treatment of diseases and clinical conditions associated with STHM.

Suppressor of ty 4 homolog 1 (s. cerevisiae) (SUPT4H1, Accession NP_003159.1) is another GAM83 target gene, herein designated TARGET GENE. SUPT4H1 BINDING SITE is a target binding site found in the 3' untranslated region of mRNA encoded by SUPT4H1, corresponding to a target binding site such as BINDING SITE I, BINDING SITE II or BINDING SITE III of FIG. 8. Table 4 illustrates the complementarity of the nucleotide sequences of SUPT4H1 BINDING SITE, designated SEQ ID:16861, to the nucleotide sequence of GAM83 RNA, herein designated GAM RNA, also designated SEQ ID:287.

Another function of GAM83 is therefore inhibition of Suppressor of ty 4 homolog 1 (s. cerevisiae) (SUPT4H1, Accession NP_003159.1). Accordingly, utilities of GAM83 include diagnosis, prevention and treatment of diseases and clinical conditions associated with SUPT4H1.

Supervillin (SVIL, Accession NP_003165.1) is another GAM83 target gene, herein designated TARGET GENE. SVIL BINDING SITE is a target binding site found in the 3' untranslated region of multiple transcripts of mRNA encoded by SVIL, corresponding to a target binding site such as BINDING SITE I, BINDING SITE II or BINDING SITE III of FIG. 8. Table 4 illustrates the complementarity of the nucleotide sequences of SVIL BINDING SITE, designated SEQ ID:2228, to the nucleotide sequence of GAM83 RNA, herein designated GAM RNA, also designated SEQ ID:287.

Another function of GAM83 is therefore inhibition of Supervillin (SVIL, Accession NP_003165.1), a gene which binds actin, links filamentous actin with the plasma membrane; and contains putative nuclear localization signals. Accordingly, utilities of GAM83 include diagnosis, prevention and treatment of diseases and clinical conditions associated with SVIL.

The function of SVIL and its association with various diseases and clinical conditions, has been established by previous studies, as described hereinabove with reference to GAM44.1. Supervillin (SVIL, Accession NP_068506.1) is another GAM83 target gene, herein designated TARGET GENE. SVIL BINDING SITE is a target binding site found in the 3' untranslated region of multiple transcripts of mRNA encoded by SVIL, corresponding to a target binding site such as BINDING SITE I, BINDING SITE II or BINDING SITE III of FIG. 8. Table 4 illustrates the complementarity of the nucleotide sequences of SVIL BINDING SITE, designated SEQ ID:2228, to the nucleotide sequence of GAM83 RNA, herein designated GAM RNA, also designated SEQ ID:287.

Another function of GAM83 is therefore inhibition of Supervillin (SVIL, Accession NP_068506.1), a gene which binds actin, links filamentous actin with the plasma membrane; and contains putative nuclear localization signals. Accordingly, utilities of GAM83 include diagnosis, prevention and treatment of diseases and clinical conditions associated with SVIL.

The function of SVIL and its association with various diseases and clinical conditions, has been established by previous studies, as described hereinabove with reference to GAM44.1. TARSH (Accession NP_079077.1) is another GAM83 target gene, herein designated TARGET GENE. TARSH BINDING SITE is a target binding site found in the 3' untranslated region of multiple transcripts of mRNA encoded by TARSH, corresponding to a target binding site such as BINDING SITE I, BINDING SITE II or BINDING SITE III of FIG. 8. Table 4 illustrates the complementarity of the nucleotide sequences of TARSH BINDING SITE, designated SEQ ID:14655, to the nucleotide sequence of GAM83 RNA, herein designated GAM RNA, also designated SEQ ID:287.

Another function of GAM83 is therefore inhibition of TARSH (Accession NP_079077.1). Accordingly, utilities of GAM83 include diagnosis, prevention and treatment of diseases and clinical conditions associated with TARSH.

Treacher collins-franceschetti syndrome 1 (TCOF1, Accession NP_000347.1) is another GAM83 target gene, herein designated TARGET GENE. TCOF1 BINDING SITE is a target binding site found in the 3' untranslated region of mRNA encoded by TCOF1, corresponding to a target binding site such as BINDING SITE I, BINDING SITE II or BINDING SITE III of FIG. 8. Table 4 illustrates the complementarity of the nucleotide sequences of TCOF1 BINDING SITE, designated SEQ ID:12765, to the nucleotide sequence of GAM83 RNA, herein designated GAM RNA, also designated SEQ ID:287.

Another function of GAM83 is therefore inhibition of Treacher collins-franceschetti syndrome 1 (TCOF1, Accession NP_000347.1). Accordingly, utilities of GAM83 include diagnosis, prevention and treatment of diseases and clinical conditions associated with TCOF1.

TD-60 (Accession NP_061185.1) is another GAM83 target gene, herein designated TARGET GENE. TD-60 BINDING SITE is a target binding site found in the 3' untranslated region of mRNA encoded by TD-60, corresponding to a target binding site such as BINDING SITE I, BINDING SITE II or BINDING SITE III of FIG. 8. Table 4 illustrates the complementarity of the nucleotide sequences of TD-60 BINDING SITE, designated SEQ ID:17170, to the nucleotide sequence of GAM83 RNA, herein designated GAM RNA, also designated SEQ ID:287.

Another function of GAM83 is therefore inhibition of TD-60 (Accession NP_061185.1). Accordingly, utilities of GAM83 include diagnosis, prevention and treatment of diseases and clinical conditions associated with TD-60.

Trinucleotide repeat containing 6 (TNRC6, Accession NP_065898.1) is another GAM83 target gene, herein designated TARGET GENE. TNRC6 BINDING SITE is a target binding site found in the 3' untranslated region of multiple transcripts of mRNA encoded by TNRC6, corresponding to a target binding site such as BINDING SITE I, BINDING SITE II or BINDING SITE III of FIG. 8. Table 4 illustrates the complementarity of the nucleotide sequences of TNRC6 BINDING SITE, designated SEQ ID:3142, to the nucleotide sequence of GAM83 RNA, herein designated GAM RNA, also designated SEQ ID:287.

Another function of GAM83 is therefore inhibition of Trinucleotide repeat containing 6 (TNRC6, Accession NP_065898.1). Accordingly, utilities of GAM83 include diagnosis, prevention and treatment of diseases and clinical conditions associated with TNRC6.

Trinucleotide repeat containing 6 (TNRC6, Accession NP_055309.1) is another GAM83 target gene, herein designated TARGET GENE. TNRC6 BINDING SITE is a target binding site found in the 3' untranslated region of multiple transcripts of mRNA encoded by TNRC6, corresponding to a target binding site such as BINDING SITE I, BINDING SITE II or BINDING SITE III of FIG. 8. Table 4 illustrates the complementarity of the nucleotide sequences of TNRC6 BINDING SITE, designated SEQ ID:3142, to the nucleotide sequence of GAM83 RNA, herein designated GAM RNA, also designated SEQ ID:287.

Another function of GAM83 is therefore inhibition of Trinucleotide repeat containing 6 (TNRC6, Accession NP_055309.1). Accordingly, utilities of GAM83 include diagnosis, prevention and treatment of diseases and clinical conditions associated with TNRC6.

TP53I11 (Accession NP_006025.1) is another GAM83 target gene, herein designated TARGET GENE. TP53I11 BINDING SITE is a target binding site found in the 3' untranslated region of multiple transcripts of mRNA encoded by TP53I11, corresponding to a target binding site such as BINDING SITE I, BINDING SITE II or BINDING SITE III of FIG. 8. Table 4 illustrates the complementarity of the nucleotide sequences of TP53I11 BINDING SITE, designated SEQ ID:10684, to the nucleotide sequence of GAM83 RNA, herein designated GAM RNA, also designated SEQ ID:287.

Another function of GAM83 is therefore inhibition of TP53I11 (Accession NP_006025.1). Accordingly, utilities of GAM83 include diagnosis, prevention and treatment of diseases and clinical conditions associated with TP53I11.

Tripartite motif-containing 37 (TRIM37, Accession NP_056109.1) is another GAM83 target gene, herein designated TARGET GENE. TRIM37 BINDING SITE is a target binding site found in the 3' untranslated region of mRNA encoded by TRIM37, corresponding to a target binding site such as BINDING SITE I, BINDING SITE II or BINDING SITE III of FIG. 8. Table 4 illustrates the complementarity of the nucleotide sequences of TRIM37 BINDING SITE, designated SEQ ID:19079, to the nucleotide sequence of GAM83 RNA, herein designated GAM RNA, also designated SEQ ID:287.

Another function of GAM83 is therefore inhibition of Tripartite motif-containing 37 (TRIM37, Accession NP_056109.1). Accordingly, utilities of GAM83 include diagnosis, prevention and treatment of diseases and clinical conditions associated with TRIM37.

TRIP-Br2 (Accession NP_055570.1) is another GAM83 target gene, herein designated TARGET GENE. TRIP-Br2 BINDING SITE1 and TRIP-Br2 BINDING SITE2 are target binding sites found in untranslated regions of mRNA encoded by TRIP-Br2, corresponding to target binding sites such as BINDING SITE I, BINDING SITE II or BINDING SITE III of FIG. 8. Table 4 illustrates the complementarity of the nucleotide sequences of TRIP-Br2 BINDING SITE1 and TRIP-Br2 BINDING SITE2, designated SEQ ID:1237 and SEQ ID:18572 respectively, to the nucleotide sequence of GAM83 RNA, herein designated GAM RNA, also designated SEQ ID:287.

Another function of GAM83 is therefore inhibition of TRIP-Br2 (Accession NP_055570.1). Accordingly, utilities of GAM83 include diagnosis, prevention and treatment of diseases and clinical conditions associated with TRIP-Br2.

TUBA3 (Accession NP_006000.2) is another GAM83 target gene, herein designated TARGET GENE. TUBA3 BINDING SITE is a target binding site found in the 3' untranslated region of mRNA encoded by TUBA3, corresponding to a target binding site such as BINDING SITE I, BINDING SITE II or BINDING SITE III of FIG. 8. Table 4 illustrates the complementarity of the nucleotide sequences of TUBA3 BINDING SITE, designated SEQ ID:7845, to the nucleotide sequence of GAM83 RNA, herein designated GAM RNA, also designated SEQ ID:287.

Another function of GAM83 is therefore inhibition of TUBA3 (Accession NP_006000.2), a gene which is the major constituent of microtubules. Accordingly, utilities of GAM83 include diagnosis, prevention and treatment of diseases and clinical conditions associated with TUBA3.

The function of TUBA3 and its association with various diseases and clinical conditions, has been established by previous studies, as described hereinabove with reference to GAM44.1. TWISTNB (Accession XP_166508.1) is another GAM83 target gene, herein designated TARGET GENE. TWISTNB BINDING SITE is a target binding site found in the 3' untranslated region of mRNA encoded by TWISTNB, corresponding to a target binding site such as BINDING SITE I, BINDING SITE II or BINDING SITE III of FIG. 8. Table 4 illustrates the complementarity of the nucleotide sequences of TWISTNB BINDING SITE, designated SEQ ID:8569, to the nucleotide sequence of GAM83 RNA, herein designated GAM RNA, also designated SEQ ID:287.

Another function of GAM83 is therefore inhibition of TWISTNB (Accession XP_166508.1). Accordingly, utilities of GAM83 include diagnosis, prevention and treatment of diseases and clinical conditions associated with TWISTNB.

Ubiquitin-conjugating enzyme e2 variant 1 (UBE2V1, Accession NP_068823.1) is another GAM83 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8971, to the nucleotide sequence of GAM83 RNA, herein designated GAM RNA, also designated SEQ ID:287.

Another function of GAM83 is therefore inhibition of Ubiquitin-conjugating enzyme e2 variant 1 (UBE2V1, Accession NP_068823.1), a gene which may play a role in signaling for DNA repair. Accordingly, utilities of GAM83 include diagnosis, prevention and treatment of diseases and clinical conditions associated with UBE2V1.

The function of UBE2V1 and its association with various diseases and clinical conditions, has been established by previous studies, as described hereinabove with reference to GAM44.1. Ubiquitin-conjugating enzyme e2 variant 1 (UBE2V1, Accession NP_071887.1) is another GAM83 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8971, to the nucleotide sequence of GAM83 RNA, herein designated GAM RNA, also designated SEQ ID:287.

Another function of GAM83 is therefore inhibition of Ubiquitin-conjugating enzyme e2 variant 1 (UBE2V1, Accession NP_071887.1), a gene which may play a role in signaling for DNA repair. Accordingly, utilities of GAM83 include diagnosis, prevention and treatment of diseases and clinical conditions associated with UBE2V1.

The function of UBE2V1 and its association with various diseases and clinical conditions, has been established by previous studies, as described hereinabove with reference to GAM44.1. Ubiquitin-conjugating enzyme e2 variant 1 (UBE2V1, Accession NP_003340.1) is another GAM83target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8971, to the nucleotide sequence of GAM83 RNA, herein designated GAM RNA, also designated SEQ ID:287.

Another function of GAM83 is therefore inhibition of Ubiquitin-conjugating enzyme e2 variant 1 (UBE2V1, Accession NP_003340.1), a gene which may play a role in signaling for DNA repair. Accordingly, utilities of GAM83 include diagnosis, prevention and treatment of diseases and clinical conditions associated with UBE2V1.

The function of UBE2V1 and its association with various diseases and clinical conditions, has been established by previous studies, as described hereinabove with reference to GAM44.1. Ubinuclein 1 (UBN1, Accession NP_058632.1) is another GAM83 target gene, herein designated TARGET GENE. UBN1 BINDING SITE is a target binding site found in the 3' untranslated region of mRNA encoded by UBN1, corresponding to a target binding site such as BINDING SITE I, BINDING SITE II or BINDING SITE III of FIG. 8. Table 4 illustrates the complementarity of the nucleotide sequences of UBN1 BINDING SITE, designated SEQ ID:17578, to the nucleotide sequence of GAM83 RNA, herein designated GAM RNA, also designated SEQ ID:287.

Another function of GAM83 is therefore inhibition of Ubinuclein 1 (UBN1, Accession NP_058632.1). Accordingly, utilities of GAM83 include diagnosis, prevention and treatment of diseases and clinical conditions associated with UBN1.

WBP3 (Accession NP_783863.2) is another GAM83 target gene, herein designated TARGET GENE. WBP3 BINDING SITE is a target binding site found in the 3' untranslated region of mRNA encoded by WBP3, corresponding to a target binding site such as BINDING SITE I, BINDING SITE II or BINDING SITE III of FIG. 8. Table 4 illustrates the complementarity of the nucleotide sequences of WBP3 BINDING SITE, designated SEQ ID:1501, to the nucleotide sequence of GAM83 RNA, herein designated GAM RNA, also designated SEQ ID:287.

Another function of GAM83 is therefore inhibition of WBP3 (Accession NP_783863.2). Accordingly, utilities of GAM83 include diagnosis, prevention and treatment of diseases and clinical conditions associated with WBP3.

Tyrosine 3-monooxygenase/tryptophan 5-monooxygenase activation protein, gamma polypeptide (YWHAG, Accession NP_036611.2) is another GAM83 target gene, herein designated TARGET GENE. YWHAG BINDING SITE is a target binding site found in the 3' untranslated region of mRNA encoded by YWHAG, corresponding to a target binding site such as BINDING SITE I, BINDING SITE II or BINDING SITE III of FIG. 8. Table 4 illustrates the complementarity of the nucleotide sequences of YWHAG BINDING SITE, designated SEQ ID:15404, to the nucleotide sequence of GAM83 RNA, herein designated GAM RNA, also designated SEQ ID:287.

Another function of GAM83 is therefore inhibition of Tyrosine 3-monooxygenase/tryptophan 5-monooxygenase activation protein, gamma polypeptide (YWHAG, Accession NP_036611.2), a gene which mediates mitogenic signals of PDGF in vascular smooth muscle cells. Accordingly, utilities of GAM83 include diagnosis, prevention and treatment of diseases and clinical conditions associated with YWHAG.

The function of YWHAG and its association with various diseases and clinical conditions, has been established by previous studies, as described hereinabove with reference to GAM40.1. ZFYVE26 (Accession XP_031077.1) is another GAM83 target gene, herein designated TARGET GENE. ZFYVE26 BINDING SITE is a target binding site found in the 3' untranslated region of mRNA encoded by ZFYVE26, corresponding to a target binding site such as BINDING SITE I, BINDING SITE II or BINDING SITE III of FIG. 8. Table 4 illustrates the complementarity of the nucleotide sequences of ZFYVE26 BINDING SITE, designated SEQ ID:7546, to the nucleotide sequence of GAM83 RNA, herein designated GAM RNA, also designated SEQ ID:287.

Another function of GAM83 is therefore inhibition of ZFYVE26 (Accession XP_031077.1). Accordingly, utilities of GAM83 include diagnosis, prevention and treatment of diseases and clinical conditions associated with ZFYVE26.

FIG. 8 further provides a conceptual description of a novel bioinformatically detected of the present invention, referred to here as Genomic Address Messenger 84 (GAM84), which modulates expression of respective target genes thereof, the function and utility of which target genes is known in the art.

GAM84 is a novel bioinformatically detected regulatory, non protein coding, micro RNA (miRNA) gene. The method by which GAM84 was detected is described hereinabove with reference to FIGS. 8-15.

GAM84 gene, herein designated GAM GENE, and GAM84 target gene, herein designated TARGET GENE, are human genes contained in the human genome.

GAM84 gene encodes a GAM84 precursor RNA, herein designated GAM PRECURSOR RNA. Similar to other miRNA genes, and unlike most ordinary genes, GAM84 precursor RNA does not encode a protein. A nucleotide sequence identical or highly similar to the nucleotide sequence of GAM84 precursor RNA is designated SEQ ID:98, and is provided hereinbelow with reference to the sequence listing part.

GAM84 precursor RNA folds onto itself, forming GAM84 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM84 precursor RNA folds onto itself, forming GAM84 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM84 precursor RNA, designated SEQ-ID:98, and a schematic representation of a predicted secondary folding of GAM84 folded precursor RNA are further described with reference to Table 2, hereby incorporated by reference.

An enzyme complex designated DICER COMPLEX, 'dices' the GAM84 folded precursor RNA into GAM84 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM84 RNA is designated SEQ ID:204, and is provided hereinbelow with references to the sequence listing part and Table 3, hereby incorporated by reference.

GAM84 target gene, herein designated TARGET GENE, encodes a corresponding messenger RNA, GAM84 target RNA, herein designated GAM TARGET RNA. GAM84 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM84 RNA, herein designated GAM RNA, binds complementarily to one or more target binding sites located in untranslated regions of GAM84 target RNA, herein designated GAM TARGET RNA. This complementary binding is due to the fact that the nucleotide sequence of GAM84 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM84 RNA may have a different number of target binding sites in untranslated regions of a GAM84 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM84 RNA, herein designated GAM RNA, to target binding sites on GAM84 target RNA, herein designated GAM TARGET RNA, such as BINDING SITE I, BINDING SITE II and BINDING SITE III, inhibits translation of GAM84 target RNA into GAM84 target protein, herein designated GAM TARGET PROTEIN. GAM target protein is therefore outlined by a broken line.

It is appreciated that GAM84 target gene, herein designated TARGET GENE, in fact represents a plurality of GAM84 target genes. The mRNA of each one of this plurality of GAM84 target genes comprises one or more target binding sites, each having a nucleotide sequence which is at least partly complementary to GAM84 RNA, herein designated GAM RNA, and which when bound by GAM84 RNA causes inhibition of translation of respective one or more GAM84 target proteins.

It is further appreciated by one skilled in the art that the mode of translational inhibition illustrated by FIG. 8 with specific reference to translational inhibition exerted by GAM84 gene, herein designated GAM GENE, on one or more GAM84 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM84 correlate with, and may be deduced from, the identity of the target genes which GAM84 binds and inhibits, and the function of these target genes, as elaborated hereinbelow.

APPD (Accession) is a GAM84 target gene, herein designated TARGET GENE. APPD BINDING SITE is a target binding site found in the 3' untranslated region of mRNA encoded by APPD, corresponding to a target binding site such as BINDING SITE I, BINDING SITE II or BINDING SITE III of FIG. 8. Table 4 illustrates the complementarity of the nucleotide sequences of APPD BINDING SITE, designated SEQ ID:10016, to the nucleotide sequence of GAM84 RNA, herein designated GAM RNA, also designated SEQ ID:204.

A function of GAM84 is therefore inhibition of APPD (Accession). Accordingly, utilities of GAM84 include diagnosis, prevention and treatment of diseases and clinical conditions associated with APPD.

Digeorge syndrome critical region gene 2 (DGCR2, Accession NM_005137.1) is another GAM84 target gene, herein designated TARGET GENE. DGCR2 BINDING SITE is a target binding site found in the 3' untranslated region of mRNA encoded by DGCR2, corresponding to a target binding site such as BINDING SITE I, BINDING SITE II or BINDING SITE III of FIG. 8. Table 4 illustrates the complementarity of the nucleotide sequences of DGCR2 BINDING SITE, designated SEQ ID:6302, to the nucleotide sequence of GAM84 RNA, herein designated GAM RNA, also designated SEQ ID:204.

Another function of GAM84 is therefore inhibition of Digeorge syndrome critical region gene 2 (DGCR2, Accession NM_005137.1), a gene which is putative adhesion receptor and intervenes in cell-cell or cell-matrix interactions and therefore may be associated with Digeorge syndrome. Accordingly, utilities of GAM84 include diagnosis, prevention and treatment of Digeorge syndrome, and of other diseases and clinical conditions associated with DGCR2.

The function of DGCR2 has been established by previous studies. Demczuk et al. (1995) cloned 1 breakpoint in a balanced t(2;22)(q14.1;q11.1) translocation found in a daughter and her mother with DiGeorge syndrome/velocardiofacial syndrome phenotypes (see OMIM Ref. No. 188400; Augusseau et al., 1986). They reported the isolation of a gene encoding a potential adhesion receptor protein. The gene did not encompass the breakpoint, but its 3-prime end mapped only 10 kb telomeric to the balanced translocation. They proposed to designate this gene as DGCR2; the TUPLE1 (OMIM Ref. No. 600237) gene isolated from the same region would then be DGCR1. Analysis of the DGCR2 sequence led Demczuk et al. (1995) to propose a mechanism by which the protein could be etiologic in CATCH22 (see OMIM Ref. No. 188400). The cephalic neural crest cells have been shown to contribute to the aorticopulmonary septation and to the morphogenesis of the thymus and parathyroids. Therefore, DiGeorge syndrome has been classified as a neurocristopathy. Altered levels of adhesion receptors due to haploinsufficiency for the DGCR2 protein might interfere with migration of neural crest cells. ADU were the initials of a patient with DiGeorge syndrome (OMIM Ref. No. 188400) in whom was found a balanced translocation with a breakpoint within 22q11, the shortest region of deletion overlap for this disorder. Wadey et al. (1995) isolated a P1 clone that spanned this breakpoint (also called the ADU breakpoint) and used it to isolate a cDNA encoding a transmembrane protein expressed in a wide variety of tissues. This gene, called IDD (integral membrane protein, deleted in DGS), was not disrupted by the translocation but mapped within 10 kb of the breakpoint. Mutation analysis in 5 cases of DiGeorge syndrome with no previously identified chromosome 22 deletion yielded negative results, but a possible protein polymorphism was discovered. No deletions or rearrangements were detected in these patients following analysis with markers closely flanking the breakpoint, data that emphasized the large (over 1 Mb) interstitial deletions that are the rule in DGS. Wadey et al. (1995) speculated that, although the mutation analysis was negative, the proximity of IDD to the balanced translocation breakpoint and its position within the shortest region of deletion overlap indicated that the gene may have a role, along with other genes, in the CATCH22 haploinsufficiency syndromes. The sequences of the genes cloned by Demczuk et al. (1995) and Wadey et al. (1995) are identical.

Full details of the abovementioned studies are described in the following publications, the disclosure of which are hereby incorporated by reference:

Augusseau, S.; Jouk, S.; Jalbert, P.; Prieur, M.: DiGeorge syndrome and 22q11 rearrangements. (Letter) Hum. Genet. 74:206 only, 1986; and Demczuk, S.; Aledo, R.; Zucman, J.; Delattre, O.; Desmaze, C.; Dauphinot, L.; Jalbert, P.; Rouleau, G. A.; Thomas, G.; Aurias, A.: Cloning of a balanced translocation breakpoint in the.

Further studies establishing the function and utilities of DGCR2 are found in John Hopkins OMIM database record ID 600594, and in cited publications listed in Table 5, which are hereby incorporated by reference. Fc fragment of igg, low affinity iib, receptor for (cd32) (FCGR2B, Accession NM_004001.2) is another GAM84 target gene, herein designated TARGET GENE. FCGR2B BINDING SITE1 and FCGR2B BINDING SITE2 are target binding sites found in untranslated regions of mRNA encoded by FCGR2B, corresponding to target binding sites such as BINDING SITE I, BINDING SITE II or BINDING SITE III of FIG. 8. Table 4 illustrates the complementarity of the nucleotide sequences of FCGR2B BINDING SITE1 and FCGR2B BINDING SITE2, designated SEQ ID:19509 and SEQ ID:7555 respectively, to the nucleotide sequence of GAM84 RNA, herein designated GAM RNA, also designated SEQ ID:204.

Another function of GAM84 is therefore inhibition of Fc fragment of igg, low affinity iib, receptor for (cd32) (FCGR2B, Accession NM_004001.2). Accordingly, utilities of GAM84 include diagnosis, prevention and treatment of diseases and clinical conditions associated with FCGR2B.

FLJ11117 (Accession NM_018329.1) is another GAM84 target gene, herein designated TARGET GENE. FLJ11117 BINDING SITE is a target binding site found in the 3' untranslated region of mRNA encoded by FLJ11117, corresponding to a target binding site such as BINDING SITE I, BINDING SITE II or BINDING SITE III of FIG. 8. Table 4 illustrates the complementarity of the nucleotide sequences of FLJ11117 BINDING SITE, designated SEQ ID:6333, to the nucleotide sequence of GAM84 RNA, herein designated GAM RNA, also designated SEQ ID:204.

Another function of GAM84 is therefore inhibition of FLJ11117 (Accession NM_018329.1). Accordingly, utilities of GAM84 include diagnosis, prevention and treatment of diseases and clinical conditions associated with FLJ11117.

FLJ20276 (Accession NM_017738.1) is another GAM84 target gene, herein designated TARGET GENE. FLJ20276 BINDING SITE is a target binding site found in the 3' untranslated region of mRNA encoded by FLJ20276, corresponding to a target binding site such as BINDING SITE I, BINDING SITE II or BINDING SITE III of FIG. 8. Table 4 illustrates the complementarity of the nucleotide sequences of FLJ20276 BINDING SITE, designated SEQ ID:11122, to the nucleotide sequence of GAM84 RNA, herein designated GAM RNA, also designated SEQ ID:204.

Another function of GAM84 is therefore inhibition of FLJ20276 (Accession NM_017738.1). Accordingly, utilities of GAM84 include diagnosis, prevention and treatment of diseases and clinical conditions associated with FLJ20276.

FLJ30655 (Accession NM_144643.1) is another GAM84 target gene, herein designated TARGET GENE. FLJ30655 BINDING SITE1 and FLJ30655 BINDING SITE2 are target binding sites found in untranslated regions of mRNA encoded by FLJ30655, corresponding to target binding sites such as BINDING SITE I, BINDING SITE II or BINDING SITE III of FIG. 8. Table 4 illustrates the complementarity of the nucleotide sequences of FLJ30655 BINDING SITE1 and FLJ30655 BINDING SITE2, designated SEQ ID:6164 and SEQ ID:6278 respectively, to the nucleotide sequence of GAM84 RNA, herein designated GAM RNA, also designated SEQ ID:204.

Another function of GAM84 is therefore inhibition of FLJ30655 (Accession NM_144643.1). Accordingly, utilities of GAM84 include diagnosis, prevention and treatment of diseases and clinical conditions associated with FLJ30655.

HTRA3 (Accession NM_053044.2) is another GAM84 target gene, herein designated TARGET GENE. HTRA3 BINDING SITE is a target binding site found in the 3' untranslated region of mRNA encoded by HTRA3, corresponding to a target binding site such as BINDING SITE I, BINDING SITE II or BINDING SITE III of FIG. 8. Table 4 illustrates the complementarity of the nucleotide sequences of HTRA3 BINDING SITE, designated SEQ ID:1600, to the nucleotide sequence of GAM84 RNA, herein designated GAM RNA, also designated SEQ ID:204.

Another function of GAM84 is therefore inhibition of HTRA3 (Accession NM_053044.2). Accordingly, utilities of GAM84 include diagnosis, prevention and treatment of diseases and clinical conditions associated with HTRA3.

KIAA0982 (Accession NM_014023.1) is another GAM84 target gene, herein designated TARGET GENE. KIAA0982 BINDING SITE is a target binding site found in the 3' untranslated region of mRNA encoded by KIAA0982, corresponding to a target binding site such as BINDING SITE I, BINDING SITE II or BINDING SITE III of FIG. 8. Table 4 illustrates the complementarity of the nucleotide sequences of KIAA0982 BINDING SITE, designated SEQ ID:6334, to the nucleotide sequence of GAM84 RNA, herein designated GAM RNA, also designated SEQ ID:204.

Another function of GAM84 is therefore inhibition of KIAA0982 (Accession NM_014023.1). Accordingly, utilities of GAM84 include diagnosis, prevention and treatment of diseases and clinical conditions associated with KIAA0982.

LOC127294 (Accession) is another GAM84 target gene, herein designated TARGET GENE. LOC127294 BINDING SITE is a target binding site found in the 3' untranslated region of mRNA encoded by LOC127294, corresponding to a target binding site such as BINDING SITE I, BINDING SITE II or BINDING SITE III of FIG. 8. Table 4 illustrates the complementarity of the nucleotide sequences of LOC127294 BINDING SITE, designated SEQ ID:19840, to the nucleotide sequence of GAM84 RNA, herein designated GAM RNA, also designated SEQ ID:204.

Another function of GAM84 is therefore inhibition of LOC127294 (Accession). Accordingly, utilities of GAM84 include diagnosis, prevention and treatment of diseases and clinical conditions associated with LOC127294.

LOC133728 (Accession XM_068500.1) is another GAM84 target gene, herein designated TARGET GENE. LOC133728 BINDING SITE is a target binding site found in the 5' untranslated region of mRNA encoded by LOC133728, corresponding to a target binding site such as BINDING SITE I, BINDING SITE II or BINDING SITE III of FIG. 8. Table 4 illustrates the complementarity of the nucleotide sequences of LOC133728 BINDING SITE, designated SEQ ID:8467, to the nucleotide sequence of GAM84 RNA, herein designated GAM RNA, also designated SEQ ID:204.

Another function of GAM84 is therefore inhibition of LOC133728 (Accession XM_068500.1). Accordingly, utilities of GAM84 include diagnosis, prevention and treatment of diseases and clinical conditions associated with LOC133728.

LOC148918 (Accession XM_086361.5) is another GAM84 target gene, herein designated TARGET GENE. LOC148918 BINDING SITE is a target binding site found in the 5' untranslated region of mRNA encoded by LOC148918, corresponding to a target binding site such as BINDING SITE I, BINDING SITE II or BINDING SITE III of FIG. 8. Table 4 illustrates the complementarity of the nucleotide sequences of LOC148918 BINDING SITE, designated SEQ ID:10115, to the nucleotide sequence of GAM84 RNA, herein designated GAM RNA, also designated SEQ ID:204.

Another function of GAM84 is therefore inhibition of LOC148918 (Accession XM_086361.5). Accordingly, utilities of GAM84 include diagnosis, prevention and treatment of diseases and clinical conditions associated with LOC148918.

LOC151124 (Accession XM_098006.2) is another GAM84 target gene, herein designated TARGET GENE. LOC151124 BINDING SITE is a target binding site found in the 5' untranslated region of mRNA encoded by LOC151124, corresponding to a target binding site such as BINDING SITE I, BINDING SITE II or BINDING SITE III of FIG. 8. Table 4 illustrates the complementarity of the nucleotide sequences of LOC151124 BINDING SITE, designated SEQ ID:2757, to the nucleotide sequence of GAM84 RNA, herein designated GAM RNA, also designated SEQ ID:204.

Another function of GAM84 is therefore inhibition of LOC151124 (Accession XM_098006.2). Accordingly, utilities of GAM84 include diagnosis, prevention and treatment of diseases and clinical conditions associated with LOC151124.

Olfactory receptor, family 2, subfamily c, member 3 (OR2C3, Accession XM_060575.2) is another GAM84 target gene, herein designated TARGET GENE. OR2C3 BINDING SITE is a target binding site found in the 3' untranslated region of mRNA encoded by OR2C3, corresponding to a target binding site such as BINDING SITE I, BINDING SITE II or BINDING SITE III of FIG. 8. Table 4 illustrates the complementarity of the nucleotide sequences of OR2C3 BINDING SITE, designated SEQ ID:15199, to the nucleotide sequence of GAM84 RNA, herein designated GAM RNA, also designated SEQ ID:204.

Another function of GAM84 is therefore inhibition of Olfactory receptor, family 2, subfamily c, member 3 (OR2C3, Accession XM_060575.2). Accordingly, utilities of GAM84 include diagnosis, prevention and treatment of diseases and clinical conditions associated with OR2C3.

3-oxoacid coa transferase 2 (OXCT2, Accession NM_022120.1) is another GAM84 target gene, herein designated TARGET GENE. OXCT2 BINDING SITE is a target binding site found in the 3' untranslated region of mRNA encoded by OXCT2, corresponding to a target binding site such as BINDING SITE I, BINDING SITE II or BINDING SITE III of FIG. 8. Table 4 illustrates the complementarity of the nucleotide sequences of OXCT2 BINDING SITE, designated SEQ ID:5349, to the nucleotide sequence of GAM84 RNA, herein designated GAM RNA, also designated SEQ ID:204.

Another function of GAM84 is therefore inhibition of 3-oxoacid coa transferase 2 (OXCT2, Accession NM_022120.1). Accordingly, utilities of GAM84 include diagnosis, prevention and treatment of diseases and clinical conditions associated with OXCT2.

Ribosomal protein l13a (RPL13A, Accession NM_012423.2) is another GAM84 target gene, herein designated TARGET GENE. RPL13A BINDING SITE is a target binding site found in the 3' untranslated region of mRNA encoded by RPL13A, corresponding to a target binding site such as BINDING SITE I, BINDING SITE II or BINDING SITE III of FIG. 8. Table 4 illustrates the complementarity of the nucleotide sequences of RPL13A BINDING SITE, designated SEQ ID:3006, to the nucleotide sequence of GAM84 RNA, herein designated GAM RNA, also designated SEQ ID:204.

Another function of GAM84 is therefore inhibition of Ribosomal protein l13a (RPL13A, Accession NM_012423.2). Accordingly, utilities of GAM84 include diagnosis, prevention and treatment of diseases and clinical conditions associated with RPL13A.

Thioredoxin 2 (TXN2, Accession NM_012473.3) is another GAM84 target gene, herein designated TARGET GENE. TXN2 BINDING SITE is a target binding site found in the 3' untranslated region of mRNA encoded by TXN2, corresponding to a target binding site such as BINDING SITE I, BINDING SITE II or BINDING SITE III of FIG. 8. Table 4 illustrates the complementarity of the nucleotide sequences of TXN2 BINDING SITE, designated SEQ ID:12500, to the nucleotide sequence of GAM84 RNA, herein designated GAM RNA, also designated SEQ ID:204.

Another function of GAM84 is therefore inhibition of Thioredoxin 2 (TXN2, Accession NM_012473.3). Accordingly, utilities of GAM84 include diagnosis, prevention and treatment of diseases and clinical conditions associated with TXN2.

FIG. 8 further provides a conceptual description of a novel bioinformatically detected of the present invention, referred to here as Genomic Address Messenger 85 (GAM85), which modulates expression of respective target genes thereof, the function and utility of which target genes is known in the art.

GAM85 is a novel bioinformatically detected regulatory, non protein coding, micro RNA (miRNA) gene. The method by which GAM85 was detected is described hereinabove with reference to FIGS. 8-15.

GAM85 gene, herein designated GAM GENE, and GAM85 target gene, herein designated TARGET GENE, are human genes contained in the human genome.

GAM85 gene encodes a GAM85 precursor RNA, herein designated GAM PRECURSOR RNA. Similar to other miRNA genes, and unlike most ordinary genes, GAM85 precursor RNA does not encode a protein. A nucleotide sequence identical or highly similar to the nucleotide sequence of GAM85 precursor RNA is designated SEQ ID:182, and is provided hereinbelow with reference to the sequence listing part.

GAM85 precursor RNA folds onto itself, forming GAM85 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM85 precursor RNA folds onto itself, forming GAM85 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM85 precursor RNA, designated SEQ-ID:182, and a schematic representation of a predicted secondary folding of GAM85 folded precursor RNA are further described with reference to Table 2, hereby incorporated by reference.

An enzyme complex designated DICER COMPLEX, 'dices' the GAM85 folded precursor RNA into GAM85 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM85 RNA is designated SEQ ID:227, and is provided hereinbelow with references to the sequence listing part and Table 3, hereby incorporated by reference.

GAM85 target gene, herein designated TARGET GENE, encodes a corresponding messenger RNA, GAM85 target RNA, herein designated GAM TARGET RNA. GAM85 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM85 RNA, herein designated GAM RNA, binds complementarily to one or more target binding sites located in untranslated regions of GAM85 target RNA, herein designated GAM TARGET RNA. This complementary binding is due to the fact that the nucleotide sequence of GAM85 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM85 RNA may have a different number of target binding sites in untranslated regions of a GAM85 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM85 RNA, herein designated GAM RNA, to target binding sites on GAM85 target RNA, herein designated GAM TARGET RNA, such as BINDING SITE I, BINDING SITE II and BINDING SITE III, inhibits translation of GAM85 target RNA into GAM85 target protein, herein designated GAM TARGET PROTEIN. GAM target protein is therefore outlined by a broken line.

It is appreciated that GAM85 target gene, herein designated TARGET GENE, in fact represents a plurality of GAM85 target genes. The mRNA of each one of this plurality of GAM85 target genes comprises one or more target binding sites, each having a nucleotide sequence which is at least partly complementary to GAM85 RNA, herein designated GAM RNA, and which when bound by GAM85 RNA causes inhibition of translation of respective one or more GAM85 target proteins.

It is further appreciated by one skilled in the art that the mode of translational inhibition illustrated by FIG. 8 with specific reference to translational inhibition exerted by GAM85 gene, herein designated GAM GENE, on one or more GAM85 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM85 correlate with, and may be deduced from, the identity of the target genes which GAM85 binds and inhibits, and the function of these target genes, as elaborated hereinbelow.

DKFZP434B044 (Accession NM_031476.1) is a GAM85 target gene, herein designated TARGET GENE. DKFZP434B044 BINDING SITE is a target binding site found in the 3' untranslated region of mRNA encoded by DKFZP434B044, corresponding to a target binding site such as BINDING SITE I, BINDING SITE II or BINDING SITE III of FIG. 8. Table 4 illustrates the complementarity of the nucleotide sequences of DKFZP434B044 BINDING SITE, designated SEQ ID:7457, to the nucleotide sequence of GAM85 RNA, herein designated GAM RNA, also designated SEQ ID:227.

A function of GAM85 is therefore inhibition of DKFZP434B044 (Accession NM_031476.1). Accordingly, utilities of GAM85 include diagnosis, prevention and treatment of diseases and clinical conditions associated with DKFZP434B044.

Protocadherin gamma subfamily a, 6 (PCDHGA6, Accession NM_018919.2) is another GAM85 target gene, herein designated TARGET GENE. PCDHGA6 BINDING SITE is a target binding site found in the 3' untranslated region of mRNA encoded by PCDHGA6, corresponding to a target binding site such as BINDING SITE I, BINDING SITE II or BINDING SITE III of FIG. 8. Table 4 illustrates the complementarity of the nucleotide sequences of PCDHGA6 BINDING SITE, designated SEQ ID:13203, to the nucleotide sequence of GAM85 RNA, herein designated GAM RNA, also designated SEQ ID:227.

Another function of GAM85 is therefore inhibition of Protocadherin gamma subfamily a, 6 (PCDHGA6, Accession NM_018919.2). Accordingly, utilities of GAM85 include diagnosis, prevention and treatment of diseases and clinical conditions associated with PCDHGA6.

Protein serine kinase h1 (PSKH1, Accession NM_006742.1) is another GAM85 target gene, herein designated TARGET GENE. PSKH1 BINDING SITE is a target binding site found in the 3' untranslated region of mRNA encoded by PSKH1, corresponding to a target binding site such as BINDING SITE I, BINDING SITE II or BINDING SITE III of FIG. 8. Table 4 illustrates the complementarity of the nucleotide sequences of PSKH1 BINDING SITE, designated SEQ ID:9017, to the nucleotide sequence of GAM85 RNA, herein designated GAM RNA, also designated SEQ ID:227.

Another function of GAM85 is therefore inhibition of Protein serine kinase h1 (PSKH1, Accession NM_006742.1). Accordingly, utilities of GAM85 include diagnosis, prevention and treatment of diseases and clinical conditions associated with PSKH1.

FIG. 8 further provides a conceptual description of a novel bioinformatically detected of the present invention, referred to here as Genomic Address Messenger 86 (GAM86), which modulates expression of respective target genes thereof, the function and utility of which target genes is known in the art.

GAM86 is a novel bioinformatically detected regulatory, non protein coding, micro RNA (miRNA) gene. The method by which GAM86 was detected is described hereinabove with reference to FIGS. 8-15.

GAM86 gene, herein designated GAM GENE, and GAM86 target gene, herein designated TARGET GENE, are human genes contained in the human genome.

GAM86 gene encodes a GAM86 precursor RNA, herein designated GAM PRECURSOR RNA. Similar to other miRNA genes, and unlike most ordinary genes, GAM86 precursor RNA does not encode a protein. A nucleotide sequence identical or highly similar to the nucleotide sequence of GAM86 precursor RNA is designated SEQ ID:56, and is provided hereinbelow with reference to the sequence listing part.

GAM86 precursor RNA folds onto itself, forming GAM86 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM86 precursor RNA folds onto itself, forming GAM86 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM86 precursor RNA, designated SEQ-ID:56, and a schematic representation of a predicted secondary folding of GAM86 folded precursor RNA are further described with reference to Table 2, hereby incorporated by reference.

An enzyme complex designated DICER COMPLEX, 'dices' the GAM86 folded precursor RNA into GAM86 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM86 RNA is designated SEQ ID:382, and is provided hereinbelow with references to the sequence listing part and Table 3, hereby incorporated by reference.

GAM86 target gene, herein designated TARGET GENE, encodes a corresponding messenger RNA, GAM86 target RNA, herein designated GAM TARGET RNA. GAM86 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM86 RNA, herein designated GAM RNA, binds complementarily to one or more target binding sites located in untranslated regions of GAM86 target RNA, herein designated GAM TARGET RNA. This complementary binding is due to the fact that the nucleotide sequence of GAM86 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM86 RNA may have a different number of target binding sites in untranslated regions of a GAM86 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM86 RNA, herein designated GAM RNA, to target binding sites on GAM86 target RNA, herein designated GAM TARGET RNA, such as BINDING SITE I, BINDING SITE II and BINDING SITE III, inhibits translation of GAM86 target RNA into GAM86 target protein, herein designated GAM TARGET PROTEIN. GAM target protein is therefore outlined by a broken line.

It is appreciated that GAM86 target gene, herein designated TARGET GENE, in fact represents a plurality of GAM86 target genes. The mRNA of each one of this plurality of GAM86 target genes comprises one or more target binding sites, each having a nucleotide sequence which is at least partly complementary to GAM86 RNA, herein designated GAM RNA, and which when bound by GAM86 RNA causes inhibition of translation of respective one or more GAM86 target proteins.

It is further appreciated by one skilled in the art that the mode of translational inhibition illustrated by FIG. 8 with specific reference to translational inhibition exerted by GAM86 gene, herein designated GAM GENE, on one or more GAM86 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM86 correlate with, and may be deduced from, the identity of the target genes which GAM86 binds and inhibits, and the function of these target genes, as elaborated hereinbelow.

FLJ20340 (Accession) is a GAM86 target gene, herein designated TARGET GENE. FLJ20340 BINDING SITE is a target binding site found in the 3' untranslated region of mRNA encoded by FLJ20340, corresponding to a target binding site such as BINDING SITE I, BINDING SITE II or BINDING SITE III of FIG. 8. Table 4 illustrates the complementarity of the nucleotide sequences of FLJ20340 BINDING SITE, designated SEQ ID:15070, to the nucleotide sequence of GAM86 RNA, herein designated GAM RNA, also designated SEQ ID:382.

A function of GAM86 is therefore inhibition of FLJ20340 (Accession). Accordingly, utilities of GAM86 include diagnosis, prevention and treatment of diseases and clinical conditions associated with FLJ20340.

FIG. 8 further provides a conceptual description of a novel bioinformatically detected of the present invention, referred to here as Genomic Address Messenger 87 (GAM87), which modulates expression of respective target genes thereof, the function and utility of which target genes is known in the art.

GAM87 is a novel bioinformatically detected regulatory, non protein coding, micro RNA (miRNA) gene. The method by which GAM87 was detected is described hereinabove with reference to FIGS. 8-15.

GAM87 gene, herein designated GAM GENE, and GAM87 target gene, herein designated TARGET GENE, are human genes contained in the human genome.

GAM87 gene encodes a GAM87 precursor RNA, herein designated GAM PRECURSOR RNA. Similar to other miRNA genes, and unlike most ordinary genes, GAM87 precursor RNA does not encode a protein. A nucleotide sequence identical or highly similar to the nucleotide sequence of GAM87 precursor RNA is designated SEQ ID:120, and is provided hereinbelow with reference to the sequence listing part.

GAM87 precursor RNA folds onto itself, forming GAM87 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM87 precursor RNA folds onto itself, forming GAM87 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM87 precursor RNA, designated SEQ-ID:120, and a schematic representation of a predicted secondary folding of GAM87 folded precursor RNA are further described with reference to Table 2, hereby incorporated by reference.

An enzyme complex designated DICER COMPLEX, 'dices' the GAM87 folded precursor RNA into GAM87 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM87 RNA is designated SEQ ID:366, and is provided hereinbelow with references to the sequence listing part and Table 3, hereby incorporated by reference.

GAM87 target gene, herein designated TARGET GENE, encodes a corresponding messenger RNA, GAM87 target RNA, herein designated GAM TARGET RNA. GAM87 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM87 RNA, herein designated GAM RNA, binds complementarily to one or more target binding sites located in untranslated regions of GAM87 target RNA, herein designated GAM TARGET RNA. This complementary binding is due to the fact that the nucleotide sequence of GAM87 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM87 RNA may have a different number of target binding sites in untranslated regions of a GAM87 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM87 RNA, herein designated GAM RNA, to target binding sites on GAM87 target RNA, herein designated GAM TARGET RNA, such as BINDING SITE I, BINDING SITE II and BINDING SITE III, inhibits translation of GAM87 target RNA into GAM87 target protein, herein designated GAM TARGET PROTEIN. GAM target protein is therefore outlined by a broken line.

It is appreciated that GAM87 target gene, herein designated TARGET GENE, in fact represents a plurality of GAM87 target genes. The mRNA of each one of this plurality of GAM87 target genes comprises one or more target binding sites, each having a nucleotide sequence which is at least partly complementary to GAM87 RNA, herein designated GAM RNA, and which when bound by GAM87 RNA causes inhibition of translation of respective one or more GAM87 target proteins.

It is further appreciated by one skilled in the art that the mode of translational inhibition illustrated by FIG. 8 with specific reference to translational inhibition exerted by GAM87 gene, herein designated GAM GENE, on one or more GAM87 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM87 correlate with, and may be deduced from, the identity of the target genes which GAM87 binds and inhibits, and the function of these target genes, as elaborated hereinbelow.

Adam-like, decysin 1 (ADAMDEC1, Accession NM_014479.2) is a GAM87 target gene, herein designated TARGET GENE. ADAMDEC1 BINDING SITE is a target binding site found in the 3' untranslated region of mRNA encoded by ADAMDEC1, corresponding to a target binding site such as BINDING SITE I, BINDING SITE II or BINDING SITE III of FIG. 8. Table 4 illustrates the complementarity of the nucleotide sequences of ADAMDEC1 BINDING SITE, designated SEQ ID:3369, to the nucleotide sequence of GAM87 RNA, herein designated GAM RNA, also designated SEQ ID:366.

A function of GAM87 is therefore inhibition of Adam-like, decysin 1 (ADAMDEC1, Accession NM_014479.2).

Accordingly, utilities of GAM87 include diagnosis, prevention and treatment of diseases and clinical conditions associated with ADAMDEC1.

KIAA0663 (Accession NM_014827.1) is another GAM87 target gene, herein designated TARGET GENE. KIAA0663 BINDING SITE is a target binding site found in the 3' untranslated region of mRNA encoded by KIAA0663, corresponding to a target binding site such as BINDING SITE I, BINDING SITE II or BINDING SITE III of FIG. 8. Table 4 illustrates the complementarity of the nucleotide sequences of KIAA0663 BINDING SITE, designated SEQ ID:2132, to the nucleotide sequence of GAM87 RNA, herein designated GAM RNA, also designated SEQ ID:366.

Another function of GAM87 is therefore inhibition of KIAA0663 (Accession NM_014827.1). Accordingly, utilities of GAM87 include diagnosis, prevention and treatment of diseases and clinical conditions associated with KIAA0663.

KIAA1571 (Accession XM_027744.1) is another GAM87 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:15798, to the nucleotide sequence of GAM87 RNA, herein designated GAM RNA, also designated SEQ ID:366.

Another function of GAM87 is therefore inhibition of KIAA1571 (Accession XM_027744.1). Accordingly, utilities of GAM87 include diagnosis, prevention and treatment of diseases and clinical conditions associated with KIAA1571.

KIAA1677 (Accession XM_040383.5) is another GAM87 target gene, herein designated TARGET GENE. KIAA1677 BINDING SITE is a target binding site found in the 3' untranslated region of mRNA encoded by KIAA1677, corresponding to a target binding site such as BINDING SITE I, BINDING SITE II or BINDING SITE III of FIG. 8. Table 4 illustrates the complementarity of the nucleotide sequences of KIAA1677 BINDING SITE, designated SEQ ID:10201, to the nucleotide sequence of GAM87 RNA, herein designated GAM RNA, also designated SEQ ID:366.

Another function of GAM87 is therefore inhibition of KIAA1677 (Accession XM_040383.5). Accordingly, utilities of GAM87 include diagnosis, prevention and treatment of diseases and clinical conditions associated with KIAA1677.

LOC91050 (Accession) is another GAM87 target gene, herein designated TARGET GENE. LOC91050 BINDING SITE is a target binding site found in the 3' untranslated region of mRNA encoded by LOC91050, corresponding to a target binding site such as BINDING SITE I, BINDING SITE II or BINDING SITE III of FIG. 8. Table 4 illustrates the complementarity of the nucleotide sequences of LOC91050 BINDING SITE, designated SEQ ID:7289, to the nucleotide sequence of GAM87 RNA, herein designated GAM RNA, also designated SEQ ID:366.

Another function of GAM87 is therefore inhibition of LOC91050 (Accession). Accordingly, utilities of GAM87 include diagnosis, prevention and treatment of diseases and clinical conditions associated with LOC91050.

Platelet derived growth factor c (PDGFC, Accession NM_016205.1) is another GAM87 target gene, herein designated TARGET GENE. PDGFC BINDING SITE is a target binding site found in the 3' untranslated region of mRNA encoded by PDGFC, corresponding to a target binding site such as BINDING SITE I, BINDING SITE II or BINDING SITE III of FIG. 8. Table 4 illustrates the complementarity of the nucleotide sequences of PDGFC BINDING SITE, designated SEQ ID:2292, to the nucleotide sequence of GAM87 RNA, herein designated GAM RNA, also designated SEQ ID:366.

Another function of GAM87 is therefore inhibition of Platelet derived growth factor c (PDGFC, Accession NM_016205.1). Accordingly, utilities of GAM87 include diagnosis, prevention and treatment of diseases and clinical conditions associated with PDGFC.

FIG. 8 further provides a conceptual description of a novel bioinformatically detected of the present invention, referred to here as Genomic Address Messenger 88 (GAM88), which modulates expression of respective target genes thereof, the function and utility of which target genes is known in the art.

GAM88 is a novel bioinformatically detected regulatory, non protein coding, micro RNA (miRNA) gene. The method by which GAM88 was detected is described hereinabove with reference to FIGS. 8-15.

GAM88 gene, herein designated GAM GENE, and GAM88 target gene, herein designated TARGET GENE, are human genes contained in the human genome.

GAM88 gene encodes a GAM88 precursor RNA, herein designated GAM PRECURSOR RNA. Similar to other miRNA genes, and unlike most ordinary genes, GAM88 precursor RNA does not encode a protein. A nucleotide sequence identical or highly similar to the nucleotide sequence of GAM88 precursor RNA is designated SEQ ID:178, and is provided hereinbelow with reference to the sequence listing part. Nucleotide sequence SEQ ID:178 is located at position 26570785 relative to chromosome 13.

GAM88 precursor RNA folds onto itself, forming GAM88 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM88 precursor RNA folds onto itself, forming GAM88 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM88 precursor RNA, designated SEQ-ID:178, and a schematic representation of a predicted secondary folding of GAM88 folded precursor RNA are further described with reference to Table 2, hereby incorporated by reference.

An enzyme complex designated DICER COMPLEX, 'dices' the GAM88 folded precursor RNA into GAM88 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM88 RNA is designated SEQ ID:310, and is provided hereinbelow with references to the sequence listing part and Table 3, hereby incorporated by reference.

GAM88 target gene, herein designated TARGET GENE, encodes a corresponding messenger RNA, GAM88 target RNA, herein designated GAM TARGET RNA. GAM88 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM88 RNA, herein designated GAM RNA, binds complementarily to one or more target binding sites located in untranslated regions of GAM88 target RNA, herein designated GAM TARGET RNA. This complementary binding is due to the fact that the nucleotide sequence of GAM88 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM88 RNA may have a different number of target binding sites in untranslated regions of a GAM88 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM88 RNA, herein designated GAM RNA, to target binding sites on GAM88 target RNA, herein designated GAM TARGET RNA, such as BINDING SITE I, BINDING SITE II and BINDING SITE III, inhibits translation of GAM88 target RNA into GAM88 target protein, herein designated GAM TARGET PROTEIN. GAM target protein is therefore outlined by a broken line.

It is appreciated that GAM88 target gene, herein designated TARGET GENE, in fact represents a plurality of GAM88 target genes. The mRNA of each one of this plurality of GAM88 target genes comprises one or more target binding sites, each having a nucleotide sequence which is at least partly complementary to GAM88 RNA, herein designated GAM RNA, and which when bound by GAM88 RNA causes inhibition of translation of respective one or more GAM88 target proteins.

It is further appreciated by one skilled in the art that the mode of translational inhibition illustrated by FIG. 8 with specific reference to translational inhibition exerted by GAM88 gene, herein designated GAM GENE, on one or more GAM88 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM88 correlate with, and may be deduced from, the identity of the target genes which GAM88 binds and inhibits, and the function of these target genes, as elaborated hereinbelow.

AIP1 (Accession NP_036433.2) is a GAM88 target gene, herein designated TARGET GENE. AIP1 BINDING SITE is a target binding site found in the 3' untranslated region of mRNA encoded by AIP1, corresponding to a target binding site such as BINDING SITE I, BINDING SITE II or BINDING SITE III of FIG. 8. Table 4 illustrates the complementarity of the nucleotide sequences of AIP1 BINDING SITE, designated SEQ ID:19267, to the nucleotide sequence of GAM88 RNA, herein designated GAM RNA, also designated SEQ ID:310.

A function of GAM88 is therefore inhibition of AIP1 (Accession NP_036433.2). Accordingly, utilities of GAM88 include diagnosis, prevention and treatment of diseases and clinical conditions associated with AIP1.

Bcl2-like 12 (proline rich) (BCL2L12, Accession NP_443074.2) is another GAM88 target gene, herein designated TARGET GENE. BCL2L12 BINDING SITE is a target binding site found in the 5' untranslated region of multiple transcripts of mRNA encoded by BCL2L12, corresponding to a target binding site such as BINDING SITE I, BINDING SITE II or BINDING SITE III of FIG. 8. Table 4 illustrates the complementarity of the nucleotide sequences of BCL2L12 BINDING SITE, designated SEQ ID:2744, to the nucleotide sequence of GAM88 RNA, herein designated GAM RNA, also designated SEQ ID:310.

Another function of GAM88 is therefore inhibition of Bcl2-like 12 (proline rich) (BCL2L12, Accession NP_443074.2). Accordingly, utilities of GAM88 include diagnosis, prevention and treatment of diseases and clinical conditions associated with BCL2L12.

Bcl2-like 12 (proline rich) (BCL2L12, Accession NP_619580.1) is another GAM88 target gene, herein designated TARGET GENE. BCL2L12 BINDING SITE is a target binding site found in the 5' untranslated region of multiple transcripts of mRNA encoded by BCL2L12, corresponding to a target binding site such as BINDING SITE I, BINDING SITE II or BINDING SITE III of FIG. 8. Table 4 illustrates the complementarity of the nucleotide sequences of BCL2L12 BINDING SITE, designated SEQ ID:2744, to the nucleotide sequence of GAM88 RNA, herein designated GAM RNA, also designated SEQ ID:310.

Another function of GAM88 is therefore inhibition of Bcl2-like 12 (proline rich) (BCL2L12, Accession NP_619580.1). Accordingly, utilities of GAM88 include diagnosis, prevention and treatment of diseases and clinical conditions associated with BCL2L12.

Chromosome 18 open reading frame 1 (C18orf1, Accession NP_004329.1) is another GAM88 target gene, herein designated TARGET GENE. C18orf1 BINDING SITE is a target binding site found in the 3' untranslated region of mRNA encoded by C18orf1, corresponding to a target binding site such as BINDING SITE I, BINDING SITE II or BINDING SITE III of FIG. 8. Table 4 illustrates the complementarity of the nucleotide sequences of C18orf1 BINDING SITE, designated SEQ ID:1225, to the nucleotide sequence of GAM88 RNA, herein designated GAM RNA, also designated SEQ ID:310.

Another function of GAM88 is therefore inhibition of Chromosome 18 open reading frame 1 (C18orf1, Accession NP_004329.1), a gene which displays selective expression, regulated spatially and temporally. Accordingly, utilities of GAM88 include diagnosis, prevention and treatment of diseases and clinical conditions associated with C18orf1.

The function of C18orf1 has been established by previous studies. By cDNA selection, Yoshikawa et al. (1997) isolated several brain-derived transcripts on chromosome 18, including C18ORF1, which maps to 18p11.2. Yoshikawa et al. (1998) further characterized C18ORF1 and identified 2 major classes of transcripts distinguished by their unique upstream regions, with the beta variants representing N-terminal-truncated versions of the alpha isoforms. The alpha-specific exons 1 to 3 are missing in beta; instead, the downstream sequence of intron C is present in the mature mRNA (exon 4a), which combines with exon 4b to create the upstream exon for beta. The differential splicing of exon 5 leads to the expression of 2 alpha and 2 beta subclasses. Alpha-1 and beta-1 share identical sequences with alpha-2 and beta-2, respectively, except for the loss of exon 5 in alpha-2 and beta-2. The differences between the alpha and the beta classes of transcripts predict 2 potentially distinct promoters for the C18ORF1 gene. Yoshikawa et al. (1998) also presented evidence of RNA editing in the 5-prime untranslated region of the beta-2 variant. Yoshikawa et al. (1998) demonstrated that the C18ORF1 transcripts display selective expression, regulated spatially and temporally. The cortical and subcortical structures of brain appear to express high levels of alpha, in both fetal and adult stages. The major 9-kb transcript of C18ORF1, detectable in early development in kidney, liver, and lung, is indiscernible in these tissues in the adult. The expression profile displayed by beta is more complex. Northern blots generated from adult tissues are devoid of hybridization signals with beta but fetal tissues exhibit a 4-kb transcript. In contrast, all subcortical areas of adult brain show relatively intense signals at 6.8 kb, implying a different mechanism of transcript processing in adult brain structures. Northern blot analysis also detected several minor bands in the alpha and beta isoforms.

Full details of the abovementioned studies are described in the following publications, the disclosure of which are hereby incorporated by reference:

Yoshikawa, T.; Sanders, A. R.; Esterling, L. E.; Detera-Wadleigh, S. D.: Multiple transcriptional variants and RNA editing in C18orf1, a novel gene with LDLRA and transmembrane domains on 18p11.2. Genomics 47:246-257, 1998; and Yoshikawa, T.; Sanders, A. R.; Esterling, L. E.; Overharser, J.; Garnes, J. A.; Lennon, G.; Grewal, R.; Detera-Wadleigh, S. D.: Isolation of chromosome 18- specific brain transcripts as.

Further studies establishing the function and utilities of C18orf1 are found in John Hopkins OMIM database record ID 606571, and in cited publications listed in Table 5, which are hereby incorporated by reference. Calcium channel, voltage-dependent, 1 type, alpha 1s subunit (CACNA1S, Accession NP_000060.1) is another GAM88 target gene, herein designated TARGET GENE. CACNA1S BINDING SITE is a target binding site found in the 5' untranslated region of mRNA encoded by CACNA1S, corresponding to a target binding site such as BINDING SITE I, BINDING SITE II or BINDING SITE III of FIG. 8. Table 4 illustrates the complementarity of the nucleotide sequences of CACNA1S BINDING SITE, designated SEQ ID:476, to the nucleotide sequence of GAM88 RNA, herein designated GAM RNA, also designated SEQ ID:310.

Another function of GAM88 is therefore inhibition of Calcium channel, voltage-dependent, 1 type, alpha 1s subunit (CACNA1S, Accession NP_000060.1). Accordingly, utilities of GAM88 include diagnosis, prevention and treatment of diseases and clinical conditions associated with CACNA1S.

D15Wsu75e (Accession XP_039495.1) is another GAM88 target gene, herein designated TARGET GENE. D15Wsu75e BINDING SITE is a target binding site found in the 3' untranslated region of mRNA encoded by D15Wsu75e, corresponding to a target binding site such as BINDING SITE I, BINDING SITE II or BINDING SITE III of FIG. 8. Table 4 illustrates the complementarity of the nucleotide sequences of D15Wsu75e BINDING SITE, designated SEQ ID:15739, to the nucleotide sequence of GAM88 RNA, herein designated GAM RNA, also designated SEQ ID:310.

Another function of GAM88 is therefore inhibition of D15Wsu75e (Accession XP_039495.1). Accordingly, utilities of GAM88 include diagnosis, prevention and treatment of diseases and clinical conditions associated with D15Wsu75e.

DKFZP434P211 (Accession NP_055364.1) is another GAM88 target gene, herein designated TARGET GENE. DKFZP434P211 BINDING SITE is a target binding site found in the 3' untranslated region of mRNA encoded by DKFZP434P211, corresponding to a target binding site such as BINDING SITE I, BINDING SITE II or BINDING SITE III of FIG. 8. Table 4 illustrates the complementarity of the nucleotide sequences of DKFZP434P211 BINDING SITE, designated SEQ ID:13554, to the nucleotide sequence of GAM88 RNA, herein designated GAM RNA, also designated SEQ ID:310.

Another function of GAM88 is therefore inhibition of DKFZP434P211 (Accession NP_055364.1). Accordingly, utilities of GAM88 include diagnosis, prevention and treatment of diseases and clinical conditions associated with DKFZP434P211.

DKFZP762N2316 (Accession XP_040560.4) is another GAM88 target gene, herein designated TARGET GENE. DKFZP762N2316 BINDING SITE is a target binding site found in the 3' untranslated region of multiple transcripts of mRNA encoded by DKFZP762N2316, corresponding to a target binding site such as BINDING SITE I, BINDING SITE II or BINDING SITE III of FIG. 8. Table 4 illustrates the complementarity of the nucleotide sequences of DKFZP762N2316 BINDING SITE, designated SEQ ID:18171, to the nucleotide sequence of GAM88 RNA, herein designated GAM RNA, also designated SEQ ID:310.

Another function of GAM88 is therefore inhibition of DKFZP762N2316 (Accession XP_040560.4). Accordingly, utilities of GAM88 include diagnosis, prevention and treatment of diseases and clinical conditions associated with DKFZP762N2316.

FLJ13105 (Accession XP_291109.1) is another GAM88 target gene, herein designated TARGET GENE. FLJ13105 BINDING SITE is a target binding site found in the 5' untranslated region of mRNA encoded by FLJ13105, corresponding to a target binding site such as BINDING SITE I, BINDING SITE II or BINDING SITE III of FIG. 8. Table 4 illustrates the complementarity of the nucleotide sequences of FLJ13105 BINDING SITE, designated SEQ ID:5327, to the nucleotide sequence of GAM88 RNA, herein designated GAM RNA, also designated SEQ ID:310.

Another function of GAM88 is therefore inhibition of FLJ13105 (Accession XP_291109.1). Accordingly, utilities of GAM88 include diagnosis, prevention and treatment of diseases and clinical conditions associated with FLJ13105.

FLJ21458 (Accession NP_079126.1) is another GAM88 target gene, herein designated TARGET GENE. FLJ21458 BINDING SITE is a target binding site found in the 3' untranslated region of mRNA encoded by FLJ21458, corresponding to a target binding site such as BINDING SITE I, BINDING SITE II or BINDING SITE III of FIG. 8. Table 4 illustrates the complementarity of the nucleotide sequences of FLJ21458 BINDING SITE, designated SEQ ID:2930, to the nucleotide sequence of GAM88 RNA, herein designated GAM RNA, also designated SEQ ID:310.

Another function of GAM88 is therefore inhibition of FLJ21458 (Accession NP_079126.1). Accordingly, utilities of GAM88 include diagnosis, prevention and treatment of diseases and clinical conditions associated with FLJ21458.

FLJ22578 (Accession NP_079140.1) is another GAM88 target gene, herein designated TARGET GENE. FLJ22578

BINDING SITE1 and FLJ22578 BINDING SITE2 are target binding sites found in untranslated regions of mRNA encoded by FLJ22578, corresponding to target binding sites such as BINDING SITE I, BINDING SITE II or BINDING SITE III of FIG. 8. Table 4 illustrates the complementarity of the nucleotide sequences of FLJ22578 BINDING SITE1 and FLJ22578 BINDING SITE2, designated SEQ ID:12117 and SEQ ID:16393 respectively, to the nucleotide sequence of GAM88 RNA, herein designated GAM RNA, also designated SEQ ID:310.

Another function of GAM88 is therefore inhibition of FLJ22578 (Accession NP_079140.1). Accordingly, utilities of GAM88 include diagnosis, prevention and treatment of diseases and clinical conditions associated with FLJ22578.

FLJ30794 (Accession NP_689740.1) is another GAM88 target gene, herein designated TARGET GENE. FLJ30794 BINDING SITE is a target binding site found in the 3' untranslated region of mRNA encoded by FLJ30794, corresponding to a target binding site such as BINDING SITE I, BINDING SITE II or BINDING SITE III of FIG. 8. Table 4 illustrates the complementarity of the nucleotide sequences of FLJ30794 BINDING SITE, designated SEQ ID:885, to the nucleotide sequence of GAM88 RNA, herein designated GAM RNA, also designated SEQ ID:310.

Another function of GAM88 is therefore inhibition of FLJ30794 (Accession NP_689740.1). Accordingly, utilities of GAM88 include diagnosis, prevention and treatment of diseases and clinical conditions associated with FLJ30794.

FLJ34233 (Accession NP_775965.1) is another GAM88 target gene, herein designated TARGET GENE. FLJ34233 BINDING SITE is a target binding site found in the 3' untranslated region of mRNA encoded by FLJ34233, corresponding to a target binding site such as BINDING SITE I, BINDING SITE II or BINDING SITE III of FIG. 8. Table 4 illustrates the complementarity of the nucleotide sequences of FLJ34233 BINDING SITE, designated SEQ ID:2585, to the nucleotide sequence of GAM88 RNA, herein designated GAM RNA, also designated SEQ ID:310.

Another function of GAM88 is therefore inhibition of FLJ34233 (Accession NP_775965.1). Accordingly, utilities of GAM88 include diagnosis, prevention and treatment of diseases and clinical conditions associated with FLJ34233.

Glucocorticoid induced transcript 1 (GLCCI1, Accession XP_166529.2) is another GAM88 target gene, herein designated TARGET GENE. GLCCI1 BINDING SITE is a target binding site found in the 3' untranslated region of mRNA encoded by GLCCI1, corresponding to a target binding site such as BINDING SITE I, BINDING SITE II or BINDING SITE III of FIG. 8. Table 4 illustrates the complementarity of the nucleotide sequences of GLCCI1 BINDING SITE, designated SEQ ID:10955, to the nucleotide sequence of GAM88 RNA, herein designated GAM RNA, also designated SEQ ID:310.

Another function of GAM88 is therefore inhibition of Glucocorticoid induced transcript 1 (GLCCI1, Accession XP_166529.2). Accordingly, utilities of GAM88 include diagnosis, prevention and treatment of diseases and clinical conditions associated with GLCCI1.

Hydroxymethylbilane synthase (HMBS, Accession NP_000181.2) is another GAM88 target gene, herein designated TARGET GENE. HMBS BINDING SITE is a target binding site found in the 5' untranslated region of mRNA encoded by HMBS, corresponding to a target binding site such as BINDING SITE I, BINDING SITE II or BINDING SITE III of FIG. 8. Table 4 illustrates the complementarity of the nucleotide sequences of HMBS BINDING SITE, designated SEQ ID:12118, to the nucleotide sequence of GAM88 RNA, herein designated GAM RNA, also designated SEQ ID:310.

Another function of GAM88 is therefore inhibition of Hydroxymethylbilane synthase (HMBS, Accession NP_000181.2). Accordingly, utilities of GAM88 include diagnosis, prevention and treatment of diseases and clinical conditions associated with HMBS.

Janus kinase 3 (a protein tyrosine kinase, leukocyte) (JAK3, Accession NP_000206.1) is another GAM88 target gene, herein designated TARGET GENE. JAK3 BINDING SITE is a target binding site found in the 3' untranslated region of mRNA encoded by JAK3, corresponding to a target binding site such as BINDING SITE I, BINDING SITE II or BINDING SITE III of FIG. 8. Table 4 illustrates the complementarity of the nucleotide sequences of JAK3 BINDING SITE, designated SEQ ID:10674, to the nucleotide sequence of GAM88 RNA, herein designated GAM RNA, also designated SEQ ID:310.

Another function of GAM88 is therefore inhibition of Janus kinase 3 (a protein tyrosine kinase, leukocyte) (JAK3, Accession NP_000206.1). Accordingly, utilities of GAM88 include diagnosis, prevention and treatment of diseases and clinical conditions associated with JAK3.

Potassium large conductance calcium-activated channel, subfamily m, beta member 2 (KCNMB2, Accession NP_852006.1) is another GAM88 target gene, herein designated TARGET GENE. KCNMB2 BINDING SITE is a target binding site found in the 3' untranslated region of multiple transcripts of mRNA encoded by KCNMB2, corresponding to a target binding site such as BINDING SITE I, BINDING SITE II or BINDING SITE III of FIG. 8. Table 4 illustrates the complementarity of the nucleotide sequences of KCNMB2 BINDING SITE, designated SEQ ID:6564, to the nucleotide sequence of GAM88 RNA, herein designated GAM RNA, also designated SEQ ID:310.

Another function of GAM88 is therefore inhibition of Potassium large conductance calcium-activated channel, subfamily m, beta member 2 (KCNMB2, Accession NP_852006.1). Accordingly, utilities of GAM88 include diagnosis, prevention and treatment of diseases and clinical conditions associated with KCNMB2.

Potassium large conductance calcium-activated channel, subfamily m, beta member 2 (KCNMB2, Accession NP_005823.1) is another GAM88 target gene, herein designated TARGET GENE. KCNMB2 BINDING SITE is a target binding site found in the 3' untranslated region of multiple transcripts of mRNA encoded by KCNMB2, corresponding to a target binding site such as BINDING SITE I, BINDING SITE II or BINDING SITE III of FIG. 8. Table 4 illustrates the complementarity of the nucleotide sequences of KCNMB2 BINDING SITE, designated SEQ ID:6564, to the nucleotide sequence of GAM88 RNA, herein designated GAM RNA, also designated SEQ ID:310.

Another function of GAM88 is therefore inhibition of Potassium large conductance calcium-activated channel, subfamily m, beta member 2 (KCNMB2, Accession NP_005823.1). Accordingly, utilities of GAM88 include diagnosis, prevention and treatment of diseases and clinical conditions associated with KCNMB2.

LOC123722 (Accession XP_058721.2) is another GAM88 target gene, herein designated TARGET GENE. LOC123722 BINDING SITE is a target binding site found in the 3' untranslated region of mRNA encoded by LOC123722, corresponding to a target binding site such as BINDING SITE I, BINDING SITE II or BINDING SITE III of FIG. 8. Table 4 illustrates the complementarity of the nucleotide sequences of LOC123722 BINDING SITE, designated SEQ ID:10477, to the nucleotide sequence of GAM88 RNA, herein designated GAM RNA, also designated SEQ ID:310.

Another function of GAM88 is therefore inhibition of LOC123722 (Accession XP_058721.2). Accordingly, utilities of GAM88 include diagnosis, prevention and treatment of diseases and clinical conditions associated with LOC123722.

LOC149073 (Accession XP_097577.1) is another GAM88 target gene, herein designated TARGET GENE. LOC149073 BINDING SITE is a target binding site found in the 5' untranslated region of mRNA encoded by LOC149073, corresponding to a target binding site such as BINDING SITE I, BINDING SITE II or BINDING SITE III of FIG. 8. Table 4 illustrates the complementarity of the nucleotide sequences of LOC149073 BINDING SITE, designated SEQ ID:11398, to the nucleotide sequence of GAM88 RNA, herein designated GAM RNA, also designated SEQ ID:310.

Another function of GAM88 is therefore inhibition of LOC149073 (Accession XP_097577.1). Accordingly, utilities of GAM88 include diagnosis, prevention and treatment of diseases and clinical conditions associated with LOC149073.

LOC150174 (Accession XP_086802.2) is another GAM88 target gene, herein designated TARGET GENE. LOC150174 BINDING SITE is a target binding site found in the 3' untranslated region of mRNA encoded by LOC150174, corresponding to a target binding site such as BINDING SITE I, BINDING SITE II or BINDING SITE III of FIG. 8. Table 4 illustrates the complementarity of the nucleotide sequences of LOC150174 BINDING SITE, designated SEQ ID:13554, to the nucleotide sequence of GAM88 RNA, herein designated GAM RNA, also designated SEQ ID:310.

Another function of GAM88 is therefore inhibition of LOC150174 (Accession XP_086802.2). Accordingly, utilities of GAM88 include diagnosis, prevention and treatment of diseases and clinical conditions associated with LOC150174.

LOC150213 (Accession XP_059324.1) is another GAM88 target gene, herein designated TARGET GENE. LOC150213 BINDING SITE is a target binding site found in the 3' untranslated region of mRNA encoded by LOC150213, corresponding to a target binding site such as BINDING SITE I, BINDING SITE II or BINDING SITE III of FIG. 8. Table 4 illustrates the complementarity of the nucleotide sequences of LOC150213 BINDING SITE, designated SEQ ID:13554, to the nucleotide sequence of GAM88 RNA, herein designated GAM RNA, also designated SEQ ID:310.

Another function of GAM88 is therefore inhibition of LOC150213 (Accession XP_059324.1). Accordingly, utilities of GAM88 include diagnosis, prevention and treatment of diseases and clinical conditions associated with LOC150213.

LOC153387 (Accession XP_098369.1) is another GAM88 target gene, herein designated TARGET GENE. LOC153387 BINDING SITE is a target binding site found in the 5' untranslated region of mRNA encoded by LOC153387, corresponding to a target binding site such as BINDING SITE I, BINDING SITE II or BINDING SITE III of FIG. 8. Table 4 illustrates the complementarity of the nucleotide sequences of LOC153387 BINDING SITE, designated SEQ ID:17717, to the nucleotide sequence of GAM88 RNA, herein designated GAM RNA, also designated SEQ ID:310.

Another function of GAM88 is therefore inhibition of LOC153387 (Accession XP_098369.1). Accordingly, utilities of GAM88 include diagnosis, prevention and treatment of diseases and clinical conditions associated with LOC153387.

LOC154222 (Accession XP_098497.1) is another GAM88 target gene, herein designated TARGET GENE. LOC154222 BINDING SITE is a target binding site found in the 3' untranslated region of mRNA encoded by LOC154222, corresponding to a target binding site such as BINDING SITE I, BINDING SITE II or BINDING SITE III of FIG. 8. Table 4 illustrates the complementarity of the nucleotide sequences of LOC154222 BINDING SITE, designated SEQ ID:18214, to the nucleotide sequence of GAM88 RNA, herein designated GAM RNA, also designated SEQ ID:310.

Another function of GAM88 is therefore inhibition of LOC154222 (Accession XP_098497.1). Accordingly, utilities of GAM88 include diagnosis, prevention and treatment of diseases and clinical conditions associated with LOC154222.

LOC157627 (Accession XP_088347.2) is another GAM88 target gene, herein designated TARGET GENE. LOC157627 BINDING SITE is a target binding site found in the 3' untranslated region of mRNA encoded by LOC157627, corresponding to a target binding site such as BINDING SITE I, BINDING SITE II or BINDING SITE III of FIG. 8. Table 4 illustrates the complementarity of the nucleotide sequences of LOC157627 BINDING SITE, designated SEQ ID:10850, to the nucleotide sequence of GAM88 RNA, herein designated GAM RNA, also designated SEQ ID:310.

Another function of GAM88 is therefore inhibition of LOC157627 (Accession XP_088347.2). Accordingly, utilities of GAM88 include diagnosis, prevention and treatment of diseases and clinical conditions associated with LOC157627.

LOC201173 (Accession XP_113312.3) is another GAM88 target gene, herein designated TARGET GENE. LOC201173 BINDING SITE is a target binding site found in the 3' untranslated region of mRNA encoded by LOC201173, corresponding to a target binding site such as BINDING SITE I, BINDING SITE II or BINDING SITE III of FIG. 8. Table 4 illustrates the complementarity of the nucleotide sequences of LOC201173 BINDING SITE, designated SEQ ID:18000, to the nucleotide sequence of GAM88 RNA, herein designated GAM RNA, also designated SEQ ID:310.

Another function of GAM88 is therefore inhibition of LOC201173 (Accession XP_113312.3). Accordingly, utilities of GAM88 include diagnosis, prevention and treatment of diseases and clinical conditions associated with LOC201173.

LOC254826 (Accession XP_173188.1) is another GAM88 target gene, herein designated TARGET GENE. LOC254826 BINDING SITE1 and LOC254826 BINDING SITE2 are target binding sites found in untranslated regions of mRNA encoded by LOC254826, corresponding to target binding sites such as BINDING SITE I, BINDING SITE II or BINDING SITE III of FIG. 8. Table 4 illustrates the complementarity of the nucleotide sequences of LOC254826 BINDING SITE1 and LOC254826 BINDING SITE2, designated SEQ ID:14223 and SEQ ID:15375 respectively, to the nucleotide sequence of GAM88 RNA, herein designated GAM RNA, also designated SEQ ID:310.

Another function of GAM88 is therefore inhibition of LOC254826 (Accession XP_173188.1). Accordingly, utilities of GAM88 include diagnosis, prevention and treatment of diseases and clinical conditions associated with LOC254826.

LOC256447 (Accession XP_170877.1) is another GAM88 target gene, herein designated TARGET GENE.

LOC256447 BINDING SITE is a target binding site found in the 5' untranslated region of mRNA encoded by LOC256447, corresponding to a target binding site such as BINDING SITE I, BINDING SITE II or BINDING SITE III of FIG. 8. Table 4 illustrates the complementarity of the nucleotide sequences of LOC256447 BINDING SITE, designated SEQ ID:12508, to the nucleotide sequence of GAM88 RNA, herein designated GAM RNA, also designated SEQ ID:310.

Another function of GAM88 is therefore inhibition of LOC256447 (Accession XP_170877.1). Accordingly, utilities of GAM88 include diagnosis, prevention and treatment of diseases and clinical conditions associated with LOC256447.

LOC283244 (Accession XP_208583.2) is another GAM88 target gene, herein designated TARGET GENE. LOC283244 BINDING SITE is a target binding site found in the 5' untranslated region of mRNA encoded by LOC283244, corresponding to a target binding site such as BINDING SITE I, BINDING SITE II or BINDING SITE III of FIG. 8. Table 4 illustrates the complementarity of the nucleotide sequences of LOC283244 BINDING SITE, designated SEQ ID:9088, to the nucleotide sequence of GAM88 RNA, herein designated GAM RNA, also designated SEQ ID:310.

Another function of GAM88 is therefore inhibition of LOC283244 (Accession XP_208583.2). Accordingly, utilities of GAM88 include diagnosis, prevention and treatment of diseases and clinical conditions associated with LOC283244.

LOC283911 (Accession XP_211259.2) is another GAM88 target gene, herein designated TARGET GENE. LOC283911 BINDING SITE is a target binding site found in the 5' untranslated region of mRNA encoded by LOC283911, corresponding to a target binding site such as BINDING SITE I, BINDING SITE II or BINDING SITE III of FIG. 8. Table 4 illustrates the complementarity of the nucleotide sequences of LOC283911 BINDING SITE, designated SEQ ID:11156, to the nucleotide sequence of GAM88 RNA, herein designated GAM RNA, also designated SEQ ID:310.

Another function of GAM88 is therefore inhibition of LOC283911 (Accession XP_211259.2). Accordingly, utilities of GAM88 include diagnosis, prevention and treatment of diseases and clinical conditions associated with LOC283911.

LOC284277 (Accession XP_209102.1) is another GAM88 target gene, herein designated TARGET GENE. LOC284277 BINDING SITE is a target binding site found in the 3' untranslated region of mRNA encoded by LOC284277, corresponding to a target binding site such as BINDING SITE I, BINDING SITE II or BINDING SITE III of FIG. 8. Table 4 illustrates the complementarity of the nucleotide sequences of LOC284277 BINDING SITE, designated SEQ ID:17038, to the nucleotide sequence of GAM88 RNA, herein designated GAM RNA, also designated SEQ ID:310.

Another function of GAM88 is therefore inhibition of LOC284277 (Accession XP_209102.1). Accordingly, utilities of GAM88 include diagnosis, prevention and treatment of diseases and clinical conditions associated with LOC284277.

LOC284906 (Accession XP_209402.1) is another GAM88 target gene, herein designated TARGET GENE. LOC284906 BINDING SITE is a target binding site found in the 3' untranslated region of mRNA encoded by LOC284906, corresponding to a target binding site such as BINDING SITE I, BINDING SITE II or BINDING SITE III of FIG. 8. Table 4 illustrates the complementarity of the nucleotide sequences of LOC284906 BINDING SITE, designated SEQ ID:16684, to the nucleotide sequence of GAM88 RNA, herein designated GAM RNA, also designated SEQ ID:310.

Another function of GAM88 is therefore inhibition of LOC284906 (Accession XP_209402.1). Accordingly, utilities of GAM88 include diagnosis, prevention and treatment of diseases and clinical conditions associated with LOC284906.

LOC285321 (Accession XP_208313.1) is another GAM88 target gene, herein designated TARGET GENE. LOC285321 BINDING SITE is a target binding site found in the 3' untranslated region of mRNA encoded by LOC285321, corresponding to a target binding site such as BINDING SITE I, BINDING SITE II or BINDING SITE III of FIG. 8. Table 4 illustrates the complementarity of the nucleotide sequences of LOC285321 BINDING SITE, designated SEQ ID:5638, to the nucleotide sequence of GAM88 RNA, herein designated GAM RNA, also designated SEQ ID:310.

Another function of GAM88 is therefore inhibition of LOC285321 (Accession XP_208313.1). Accordingly, utilities of GAM88 include diagnosis, prevention and treatment of diseases and clinical conditions associated with LOC285321.

LOC285387 (Accession XP_209588.1) is another GAM88 target gene, herein designated TARGET GENE. LOC285387 BINDING SITE is a target binding site found in the 3' untranslated region of mRNA encoded by LOC285387, corresponding to a target binding site such as BINDING SITE I, BINDING SITE II or BINDING SITE III of FIG. 8. Table 4 illustrates the complementarity of the nucleotide sequences of LOC285387 BINDING SITE, designated SEQ ID:13211, to the nucleotide sequence of GAM88 RNA, herein designated GAM RNA, also designated SEQ ID:310.

Another function of GAM88 is therefore inhibition of LOC285387 (Accession XP_209588.1). Accordingly, utilities of GAM88 include diagnosis, prevention and treatment of diseases and clinical conditions associated with LOC285387.

LOC285992 (Accession XP_212126.1) is another GAM88 target gene, herein designated TARGET GENE. LOC285992 BINDING SITE is a target binding site found in the 5' untranslated region of mRNA encoded by LOC285992, corresponding to a target binding site such as BINDING SITE I, BINDING SITE II or BINDING SITE III of FIG. 8. Table 4 illustrates the complementarity of the nucleotide sequences of LOC285992 BINDING SITE, designated SEQ ID:16051, to the nucleotide sequence of GAM88 RNA, herein designated GAM RNA, also designated SEQ ID:310.

Another function of GAM88 is therefore inhibition of LOC285992 (Accession XP_212126.1). Accordingly, utilities of GAM88 include diagnosis, prevention and treatment of diseases and clinical conditions associated with LOC285992.

LOC286047 (Accession XP_209872.1) is another GAM88 target gene, herein designated TARGET GENE. LOC286047 BINDING SITE is a target binding site found in the 5' untranslated region of mRNA encoded by LOC286047, corresponding to a target binding site such as BINDING SITE I, BINDING SITE II or BINDING SITE III of FIG. 8. Table 4 illustrates the complementarity of the nucleotide sequences of LOC286047 BINDING SITE, designated SEQ ID:9088, to the nucleotide sequence of GAM88 RNA, herein designated GAM RNA, also designated SEQ ID:310.

Another function of GAM88 is therefore inhibition of LOC286047 (Accession XP_209872.1). Accordingly, utilities of GAM88 include diagnosis, prevention and treatment of diseases and clinical conditions associated with LOC286047.

LOC286332 (Accession XP_212273.1) is another GAM88 target gene, herein designated TARGET GENE. LOC286332 BINDING SITE is a target binding site found in the 5' untranslated region of mRNA encoded by LOC286332, corresponding to a target binding site such as BINDING SITE I, BINDING SITE II or BINDING SITE III of FIG. 8. Table 4 illustrates the complementarity of the nucleotide sequences of LOC286332 BINDING SITE, designated SEQ ID:6130, to the nucleotide sequence of GAM88 RNA, herein designated GAM RNA, also designated SEQ ID:310.

Another function of GAM88 is therefore inhibition of LOC286332 (Accession XP_212273.1). Accordingly, utilities of GAM88 include diagnosis, prevention and treatment of diseases and clinical conditions associated with LOC286332.

LOC286333 (Accession XP_212271.1) is another GAM88 target gene, herein designated TARGET GENE. LOC286333 BINDING SITE is a target binding site found in the 5' untranslated region of mRNA encoded by LOC286333, corresponding to a target binding site such as BINDING SITE I, BINDING SITE II or BINDING SITE III of FIG. 8. Table 4 illustrates the complementarity of the nucleotide sequences of LOC286333 BINDING SITE, designated SEQ ID:6130, to the nucleotide sequence of GAM88 RNA, herein designated GAM RNA, also designated SEQ ID:310.

Another function of GAM88 is therefore inhibition of LOC286333 (Accession XP_212271.1). Accordingly, utilities of GAM88 include diagnosis, prevention and treatment of diseases and clinical conditions associated with LOC286333.

LOC338769 (Accession XP_294696.2) is another GAM88 target gene, herein designated TARGET GENE. LOC338769 BINDING SITE is a target binding site found in the 3' untranslated region of mRNA encoded by LOC338769, corresponding to a target binding site such as BINDING SITE I, BINDING SITE II or BINDING SITE III of FIG. 8. Table 4 illustrates the complementarity of the nucleotide sequences of LOC338769 BINDING SITE, designated SEQ ID:6075, to the nucleotide sequence of GAM88 RNA, herein designated GAM RNA, also designated SEQ ID:310.

Another function of GAM88 is therefore inhibition of LOC338769 (Accession XP_294696.2). Accordingly, utilities of GAM88 include diagnosis, prevention and treatment of diseases and clinical conditions associated with LOC338769.

LOC339556 (Accession XP_290951.1) is another GAM88 target gene, herein designated TARGET GENE. LOC339556 BINDING SITE is a target binding site found in the 3' untranslated region of mRNA encoded by LOC339556, corresponding to a target binding site such as BINDING SITE I, BINDING SITE II or BINDING SITE III of FIG. 8. Table 4 illustrates the complementarity of the nucleotide sequences of LOC339556 BINDING SITE, designated SEQ ID:8415, to the nucleotide sequence of GAM88 RNA, herein designated GAM RNA, also designated SEQ ID:310.

Another function of GAM88 is therefore inhibition of LOC339556 (Accession XP_290951.1). Accordingly, utilities of GAM88 include diagnosis, prevention and treatment of diseases and clinical conditions associated with LOC339556.

LOC339832 (Accession XP_295079.1) is another GAM88 target gene, herein designated TARGET GENE. LOC339832 BINDING SITE is a target binding site found in the 3' untranslated region of mRNA encoded by LOC339832, corresponding to a target binding site such as BINDING SITE I, BINDING SITE II or BINDING SITE III of FIG. 8. Table 4 illustrates the complementarity of the nucleotide sequences of LOC339832 BINDING SITE, designated SEQ ID:3921, to the nucleotide sequence of GAM88 RNA, herein designated GAM RNA, also designated SEQ ID:310.

Another function of GAM88 is therefore inhibition of LOC339832 (Accession XP_295079.1). Accordingly, utilities of GAM88 include diagnosis, prevention and treatment of diseases and clinical conditions associated with LOC339832.

LOC340269 (Accession XP_295199.1) is another GAM88 target gene, herein designated TARGET GENE. LOC340269 BINDING SITE is a target binding site found in the 5' untranslated region of mRNA encoded by LOC340269, corresponding to a target binding site such as BINDING SITE I, BINDING SITE II or BINDING SITE III of FIG. 8. Table 4 illustrates the complementarity of the nucleotide sequences of LOC340269 BINDING SITE, designated SEQ ID:4434, to the nucleotide sequence of GAM88 RNA, herein designated GAM RNA, also designated SEQ ID:310.

Another function of GAM88 is therefore inhibition of LOC340269 (Accession XP_295199.1). Accordingly, utilities of GAM88 include diagnosis, prevention and treatment of diseases and clinical conditions associated with LOC340269.

LOC341625 (Accession XP_296347.1) is another GAM88 target gene, herein designated TARGET GENE. LOC341625 BINDING SITE is a target binding site found in the 5' untranslated region of mRNA encoded by LOC341625, corresponding to a target binding site such as BINDING SITE I, BINDING SITE II or BINDING SITE III of FIG. 8. Table 4 illustrates the complementarity of the nucleotide sequences of LOC341625 BINDING SITE, designated SEQ ID:10681, to the nucleotide sequence of GAM88 RNA, herein designated GAM RNA, also designated SEQ ID:310.

Another function of GAM88 is therefore inhibition of LOC341625 (Accession XP_296347.1). Accordingly, utilities of GAM88 include diagnosis, prevention and treatment of diseases and clinical conditions associated with LOC341625.

LOC345484 (Accession XP_298816.1) is another GAM88 target gene, herein designated TARGET GENE. LOC345484 BINDING SITE is a target binding site found in the 5' untranslated region of mRNA encoded by LOC345484, corresponding to a target binding site such as BINDING SITE I, BINDING SITE II or BINDING SITE III of FIG. 8. Table 4 illustrates the complementarity of the nucleotide sequences of LOC345484 BINDING SITE, designated SEQ ID:6432, to the nucleotide sequence of GAM88 RNA, herein designated GAM RNA, also designated SEQ ID:310.

Another function of GAM88 is therefore inhibition of LOC345484 (Accession XP_298816.1). Accordingly, utilities of GAM88 include diagnosis, prevention and treatment of diseases and clinical conditions associated with LOC345484.

LOC347939 (Accession XP_029423.1) is another GAM88 target gene, herein designated TARGET GENE. LOC347939 BINDING SITE is a target binding site found in the 5' untranslated region of mRNA encoded by LOC347939, corresponding to a target binding site such as BINDING SITE I, BINDING SITE II or BINDING SITE III of FIG. 8. Table 4 illustrates the complementarity of the nucleotide sequences of LOC347939 BINDING SITE, designated SEQ ID:14547, to the nucleotide sequence of GAM88 RNA, herein designated GAM RNA, also designated SEQ ID:310.

Another function of GAM88 is therefore inhibition of LOC347939 (Accession XP_029423.1). Accordingly, utilities of GAM88 include diagnosis, prevention and treatment of diseases and clinical conditions associated with LOC347939.

LOC348474 (Accession XP_209299.2) is another GAM88 target gene, herein designated TARGET GENE. LOC348474 BINDING SITE is a target binding site found in the 3' untranslated region of mRNA encoded by LOC348474, corresponding to a target binding site such as BINDING SITE I, BINDING SITE II or BINDING SITE III of FIG. 8. Table 4 illustrates the complementarity of the nucleotide sequences of LOC348474 BINDING SITE, designated SEQ ID:7632, to the nucleotide sequence of GAM88 RNA, herein designated GAM RNA, also designated SEQ ID:310.

Another function of GAM88 is therefore inhibition of LOC348474 (Accession XP_209299.2). Accordingly, utilities of GAM88 include diagnosis, prevention and treatment of diseases and clinical conditions associated with LOC348474.

LOC349059 (Accession XP_302946.1) is another GAM88 target gene, herein designated TARGET GENE. LOC349059 BINDING SITE is a target binding site found in the 3' untranslated region of mRNA encoded by LOC349059, corresponding to a target binding site such as BINDING SITE I, BINDING SITE II or BINDING SITE III of FIG. 8. Table 4 illustrates the complementarity of the nucleotide sequences of LOC349059 BINDING SITE, designated SEQ ID:18214, to the nucleotide sequence of GAM88 RNA, herein designated GAM RNA, also designated SEQ ID:310.

Another function of GAM88 is therefore inhibition of LOC349059 (Accession XP_302946.1). Accordingly, utilities of GAM88 include diagnosis, prevention and treatment of diseases and clinical conditions associated with LOC349059.

LOC349160 (Accession XP_302972.1) is another GAM88 target gene, herein designated TARGET GENE. LOC349160 BINDING SITE1 and LOC349160 BINDING SITE2 are target binding sites found in untranslated regions of mRNA encoded by LOC349160, corresponding to target binding sites such as BINDING SITE I, BINDING SITE II or BINDING SITE III of FIG. 8. Table 4 illustrates the complementarity of the nucleotide sequences of LOC349160 BINDING SITE1 and LOC349160 BINDING SITE2, designated SEQ ID:1659 and SEQ ID:18539 respectively, to the nucleotide sequence of GAM88 RNA, herein designated GAM RNA, also designated SEQ ID:310.

Another function of GAM88 is therefore inhibition of LOC349160 (Accession XP_302972.1). Accordingly, utilities of GAM88 include diagnosis, prevention and treatment of diseases and clinical conditions associated with LOC349160.

LOC90233 (Accession NP_612356.1) is another GAM88 target gene, herein designated TARGET GENE. LOC90233 BINDING SITE is a target binding site found in the 3' untranslated region of mRNA encoded by LOC90233, corresponding to a target binding site such as BINDING SITE I, BINDING SITE II or BINDING SITE III of FIG. 8. Table 4 illustrates the complementarity of the nucleotide sequences of LOC90233 BINDING SITE, designated SEQ ID:11676, to the nucleotide sequence of GAM88 RNA, herein designated GAM RNA, also designated SEQ ID:310.

Another function of GAM88 is therefore inhibition of LOC90233 (Accession NP_612356.1). Accordingly, utilities of GAM88 include diagnosis, prevention and treatment of diseases and clinical conditions associated with LOC90233.

LOC91663 (Accession NP_612382.1) is another GAM88 target gene, herein designated TARGET GENE. LOC91663 BINDING SITE is a target binding site found in the 3' untranslated region of mRNA encoded by LOC91663, corresponding to a target binding site such as BINDING SITE I, BINDING SITE II or BINDING SITE III of FIG. 8. Table 4 illustrates the complementarity of the nucleotide sequences of LOC91663 BINDING SITE, designated SEQ ID:3125, to the nucleotide sequence of GAM88 RNA, herein designated GAM RNA, also designated SEQ ID:310.

Another function of GAM88 is therefore inhibition of LOC91663 (Accession NP_612382.1). Accordingly, utilities of GAM88 include diagnosis, prevention and treatment of diseases and clinical conditions associated with LOC91663.

Mesoderm development candidate 2 (MESDC2, Accession XP_051854.1) is another GAM88 target gene, herein designated TARGET GENE. MESDC2 BINDING SITE is a target binding site found in the 3' untranslated region of mRNA encoded by MESDC2, corresponding to a target binding site such as BINDING SITE I, BINDING SITE II or BINDING SITE III of FIG. 8. Table 4 illustrates the complementarity of the nucleotide sequences of MESDC2 BINDING SITE, designated SEQ ID:10030, to the nucleotide sequence of GAM88 RNA, herein designated GAM RNA, also designated SEQ ID:310.

Another function of GAM88 is therefore inhibition of Mesoderm development candidate 2 (MESDC2, Accession XP_051854.1). Accordingly, utilities of GAM88 include diagnosis, prevention and treatment of diseases and clinical conditions associated with MESDC2.

MGC40579 (Accession NP_689989.1) is another GAM88 target gene, herein designated TARGET GENE. MGC40579 BINDING SITE is a target binding site found in the 3' untranslated region of mRNA encoded by MGC40579, corresponding to a target binding site such as BINDING SITE I, BINDING SITE II or BINDING SITE III of FIG. 8. Table 4 illustrates the complementarity of the nucleotide sequences of MGC40579 BINDING SITE, designated SEQ ID:17677, to the nucleotide sequence of GAM88 RNA, herein designated GAM RNA, also designated SEQ ID:310.

Another function of GAM88 is therefore inhibition of MGC40579 (Accession NP_689989.1). Accordingly, utilities of GAM88 include diagnosis, prevention and treatment of diseases and clinical conditions associated with MGC40579.

MGC47799 (Accession NP_775816.1) is another GAM88 target gene, herein designated TARGET GENE. MGC47799 BINDING SITE is a target binding site found in the 3' untranslated region of mRNA encoded by MGC47799, corresponding to a target binding site such as BINDING SITE I, BINDING SITE II or BINDING SITE III of FIG. 8. Table 4 illustrates the complementarity of the nucleotide sequences of MGC47799 BINDING SITE, designated SEQ ID:1116, to the nucleotide sequence of GAM88 RNA, herein designated GAM RNA, also designated SEQ ID:310.

Another function of GAM88 is therefore inhibition of MGC47799 (Accession NP_775816.1). Accordingly, utilities of GAM88 include diagnosis, prevention and treatment of diseases and clinical conditions associated with MGC47799.

NCYM (Accession NP_006307.1) is another GAM88 target gene, herein designated TARGET GENE. NCYM BINDING SITE is a target binding site found in the 5' untranslated region of mRNA encoded by NCy, corresponding to a target binding site such as BINDING SITE I, BINDING SITE II or BINDING SITE III of FIG. 8. Table 4 illustrates the complementarity of the nucleotide sequences of NCYM BINDING SITE, designated SEQ ID:3893, to the nucleotide sequence of GAM88 RNA, herein designated GAM RNA, also designated SEQ ID:310.

Another function of GAM88 is therefore inhibition of NCYM (Accession NP_006307.1), a gene which may have a functional role during normal fetal development. Accordingly, utilities of GAM88 include diagnosis, prevention and treatment of diseases and clinical conditions associated with NCYM.

The function of NCYM has been established by previous studies. Krystal et al. (1990) demonstrated that antisense primary transcription of the MYCN oncogene (OMIM Ref. No. 164840) gives rise to stable polyadenylated transcripts. The antisense transcription unit, designated NCy, has significant overlap with MYCN, but is expressed from the opposite DNA strand. After RNase protection and restriction mapping, Armstrong and Krystal (1992) identified a probe containing sequence unique to the MYCN locus antisense transcript and isolated an NCYM cDNA from a neuroblastoma cell line cDNA library. The deduced 109-amino acid, 12-kD NCYM protein is encoded by 3 exons. Armstrong and Krystal (1992) used RACE to identify 2 polyadenylation sites and multiple 5-prime ends, consistent with the results of RNase protection experiments. The predicted sequence contains a helix-loop-helix motif and a basic region, suggesting that NCYM may function as a DNA-binding protein. By RT- PCR, Armstrong and Krystal (1992) detected NCYM expression at varying low levels in fetal tissues including brain, lung, liver, and kidney, suggesting a functional role during development. By Northern blot analysis, they detected NCYM expression at high levels in 2 neuroblastoma cell lines and in a small cell lung cancer cell line. All 3 of these cell lines also contained amplified MYCN. The expression of MYCN and NCYM also appeared to be coregulated in response to retinoic acid, leading Armstrong and Krystal (1992) to suggest that NCYM should invariably be amplified in tumors containing MYCN amplification.

Full details of the abovementioned studies are described in the following publications, the disclosure of which are hereby incorporated by reference:

Armstrong, B. C.; Krystal, G. W.: Isolation and characterization of complementary DNA for N-cy, a gene encoded by the DNA strand opposite to N-myc. Cell Growth Differ. 3:385-390, 1992; and Krystal, G. W.; Armstrong, B. C.; Battey, J. F.: N-myc mRNA forms an RNA-RNA duplex with endogenous antisense transcripts. Molec. Cell. Biol. 10:4180-4191, 1990.

Further studies establishing the function and utilities of NCYM are found in John Hopkins OMIM database record ID 605374, and in cited publications listed in Table 5, which are hereby incorporated by reference. Nudix (nucleoside diphosphate linked moiety x)-type motif 4 (NUDT4, Accession NP_061967.2) is another GAM88 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:13312, to the nucleotide sequence of GAM88 RNA, herein designated GAM RNA, also designated SEQ ID:310.

Another function of GAM88 is therefore inhibition of Nudix (nucleoside diphosphate linked moiety x)-type motif 4 (NUDT4, Accession NP_061967.2). Accordingly, utilities of GAM88 include diagnosis, prevention and treatment of diseases and clinical conditions associated with NUDT4.

Protocadherin 10 (PCDH10, Accession NP_065866.1) is another GAM88 target gene, herein designated TARGET GENE. PCDH10 BINDING SITE is a target binding site found in the 5' untranslated region of multiple transcripts of mRNA encoded by PCDH10, corresponding to a target binding site such as BINDING SITE I, BINDING SITE II or BINDING SITE III of FIG. 8. Table 4 illustrates the complementarity of the nucleotide sequences of PCDH10 BINDING SITE, designated SEQ ID:17410, to the nucleotide sequence of GAM88 RNA, herein designated GAM RNA, also designated SEQ ID:310.

Another function of GAM88 is therefore inhibition of Protocadherin 10 (PCDH10, Accession NP_065866.1). Accordingly, utilities of GAM88 include diagnosis, prevention and treatment of diseases and clinical conditions associated with PCDH10.

Protocadherin 10 (PCDH10, Accession NP_116586.1) is another GAM88 target gene, herein designated TARGET GENE. PCDH10 BINDING SITE is a target binding site found in the 5' untranslated region of multiple transcripts of mRNA encoded by PCDH10, corresponding to a target binding site such as BINDING SITE I, BINDING SITE II or BINDING SITE III of FIG. 8. Table 4 illustrates the complementarity of the nucleotide sequences of PCDH10 BINDING SITE, designated SEQ ID:17410, to the nucleotide sequence of GAM88 RNA, herein designated GAM RNA, also designated SEQ ID:310.

Another function of GAM88 is therefore inhibition of Protocadherin 10 (PCDH10, Accession NP_116586.1). Accordingly, utilities of GAM88 include diagnosis, prevention and treatment of diseases and clinical conditions associated with PCDH10.

Protein o-fucosyltransferase 1 (POFUT1, Accession NP_056167.1) is another GAM88 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:1461, to the nucleotide sequence of GAM88 RNA, herein designated GAM RNA, also designated SEQ ID:310.

Another function of GAM88 is therefore inhibition of Protein o-fucosyltransferase 1 (POFUT1, Accession NP_056167.1) . Accordingly, utilities of GAM88 include diagnosis, prevention and treatment of diseases and clinical conditions associated with POFUT1.

PRO1768 (Accession NP_054818.1) is another GAM88 target gene, herein designated TARGET GENE. PRO1768 BINDING SITE is a target binding site found in the 3' untranslated region of mRNA encoded by PRO1768, corresponding to a target binding site such as BINDING SITE I, BINDING SITE II or BINDING SITE III of FIG. 8. Table 4 illustrates the complementarity of the nucleotide sequences of PRO1768 BINDING SITE, designated SEQ ID:3744, to the nucleotide sequence of GAM88 RNA, herein designated GAM RNA, also designated SEQ ID:310.

Another function of GAM88 is therefore inhibition of PRO1768 (Accession NP_054818.1). Accordingly, utilities of GAM88 include diagnosis, prevention and treatment of diseases and clinical conditions associated with PRO1768.

Rab11a, member ras oncogene family (RAB11A, Accession NP_004654.1) is another GAM88 target gene, herein designated TARGET GENE. RAB11A BINDING SITE is a target binding site found in the 3' untranslated region of mRNA encoded by RAB11A, corresponding to a target binding site such as BINDING SITE I, BINDING SITE II or BINDING SITE III of FIG. 8. Table 4 illustrates the complementarity of the nucleotide sequences of RAB11A BINDING SITE, designated SEQ ID:6694, to the nucleotide sequence of GAM88 RNA, herein designated GAM RNA, also designated SEQ ID:310.

Another function of GAM88 is therefore inhibition of Rab11a, member ras oncogene family (RAB11A, Accession NP_004654.1). Accordingly, utilities of GAM88 include diagnosis, prevention and treatment of diseases and clinical conditions associated with RAB11A.

Rna binding motif protein 3 (RBM3, Accession NP_006734.1) is another GAM88 target gene, herein designated TARGET GENE. RBM3 BINDING SITE is a target binding site found in the 5' untranslated region of mRNA encoded by RBM3, corresponding to a target binding site such as BINDING SITE I, BINDING SITE II or BINDING SITE III of FIG. 8. Table 4 illustrates the complementarity of the nucleotide sequences of RBM3 BINDING SITE, designated SEQ ID:8083, to the nucleotide sequence of GAM88 RNA, herein designated GAM RNA, also designated SEQ ID:310.

Another function of GAM88 is therefore inhibition of Rna binding motif protein 3 (RBM3, Accession NP_006734.1). Accordingly, utilities of GAM88 include diagnosis, prevention and treatment of diseases and clinical conditions associated with RBM3.

Sarcoma amplified sequence (SAS, Accession NP_005972.1) is another GAM88 target gene, herein designated TARGET GENE. SAS BINDING SITE is a target binding site found in the 5' untranslated region of mRNA encoded by SAS, corresponding to a target binding site such as BINDING SITE I, BINDING SITE II or BINDING SITE III of FIG. 8. Table 4 illustrates the complementarity of the nucleotide sequences of SAS BINDING SITE, designated SEQ ID:15612, to the nucleotide sequence of GAM88 RNA, herein designated GAM RNA, also designated SEQ ID:310.

Another function of GAM88 is therefore inhibition of Sarcoma amplified sequence (SAS, Accession NP_005972.1), a gene which is a member of the transmembrane 4 superfamily (TM4SF) and may be involved in growth-related cellular processes T. Accordingly, utilities of GAM88 include diagnosis, prevention and treatment of diseases and clinical conditions associated with SAS.

The function of SAS has been established by previous studies. SAS is a member of the transmembrane 4 superfamily, all members of which have 4 hydrophobic domains. This family includes various tumor-associated antigens such as CO-029 (OMIM Ref. No. 600769), L6 (M3S1; 191155), and ME491 (CD63; 155740), hematopoietic cell antigens such as CD9 (OMIM Ref. No. 143030), CD53 (OMIM Ref. No. 151525), CD37 (OMIM Ref. No. 151523),and TAPA1 (OMIM Ref. No. 186845), as well as the parasitic trematode surface proteins Sm23 and Sj23. Meltzer et al. (1991) identified and partially cloned a gene that is amplified in human malignant fibrous histiocytoma. They demonstrated that the gene, designated sarcoma amplified sequence, is located on chromosome 12 by hybridization to a rodent/human somatic cell hybrid mapping panel. They further regionalized the assignment to 12q13-q14 by fluorescence in situ hybridization. This chromosomal region is commonly involved in rearrangements in myxoid liposarcoma, benign lipoma, and uterine leiomyoma. Meltzer et al. (1991) identified SAS amplification in 5 of 29 malignant fibrous histiocytoma biopsies, 4 of 12 liposarcoma biopsies, and 1 osteogenic sarcoma cell line. Since amplification of cellular oncogenes occurs frequently in human cancers, identification of amplified genes in tumor cells is a useful approach for understanding genetic alterations. Jankowski et al. (1995) characterized the genomic structure of SAS and showed that it has 6 exons spanning approximately 3.2 kb.

Full details of the abovementioned studies are described in the following publications, the disclosure of which are hereby incorporated by reference:

Jankowski, S. A.; De Jong, P.; Meltzer, P. S.: Genomic structure of SAS, a member of the transmembrane 4 superfamily amplified in human sarcomas. Genomics 25:501-506, 1995; and Meltzer, P. S.; Jankowski, S. A.; Dal Cin, P.; Sandberg, A. A.; Paz, I. B.; Coccia, M. A.; Smith, S. H.: Identification and cloning of a novel amplified DNA sequence in human malignant.

Further studies establishing the function and utilities of SAS are found in John Hopkins OMIM database record ID 181035, and in cited publications listed in Table 5, which are hereby incorporated by reference. Sry (sex determining region y)-box 9 (campomelic dysplasia, autosomal sex-reversal) (SOX9, Accession NP_000337.1) is another GAM88 target gene, herein designated TARGET GENE. SOX9 BINDING SITE is a target binding site found in the 3' untranslated region of mRNA encoded by SOX9, corresponding to a target binding site such as BINDING SITE I, BINDING SITE II or BINDING SITE III of FIG. 8. Table 4 illustrates the complementarity of the nucleotide sequences of SOX9 BINDING SITE, designated SEQ ID:9040, to the nucleotide sequence of GAM88 RNA, herein designated GAM RNA, also designated SEQ ID:310.

Another function of GAM88 is therefore inhibition of Sry (sex determining region y)-box 9 (campomelic dysplasia, autosomal sex-reversal) (SOX9, Accession NP_000337.1), a gene which regulates the expression of other genes involved in chondrogenesis. Accordingly, utilities of GAM88 include diagnosis, prevention and treatment of diseases and clinical conditions associated with SOX9.

The function of SOX9 and its association with various diseases and clinical conditions, has been established by previous studies, as described hereinabove with reference to GAM63.1. Taf1-like rna polymerase ii, tata box binding protein (tbp)-associated factor, 210 kda (TAF1L, Accession NP_722516.1) is another GAM88 target gene, herein designated TARGET GENE. TAF1L BINDING SITE is a target binding site found in the 3' untranslated region of mRNA encoded by TAF1L, corresponding to a target binding site such as BINDING SITE I, BINDING SITE II or BINDING SITE III of FIG. 8. Table 4 illustrates the complementarity of the nucleotide sequences of TAF1L BINDING SITE, designated SEQ ID:5793, to the nucleotide sequence of GAM88 RNA, herein designated GAM RNA, also designated SEQ ID:310.

Another function of GAM88 is therefore inhibition of Taf1-like rna polymerase ii, tata box binding protein (tbp)-associated factor, 210 kda (TAF1L, Accession NP_722516.1). Accordingly, utilities of GAM88 include diagnosis, prevention and treatment of diseases and clinical conditions associated with TAF1L.

TU12B1-TY (Accession NP_057659.1) is another GAM88 target gene, herein designated TARGET GENE. TU12B1-TY BINDING SITE is a target binding site found in the 3' untranslated region of mRNA encoded by TU12B1-TY, corresponding to a target binding site such as BINDING SITE I, BINDING SITE II or BINDING SITE III of FIG. 8. Table 4 illustrates the complementarity of the nucleotide sequences of TU12B1-TY BINDING SITE, designated SEQ ID:16898, to the nucleotide sequence of GAM88 RNA, herein designated GAM RNA, also designated SEQ ID:310.

Another function of GAM88 is therefore inhibition of TU12B1-TY (Accession NP_057659.1). Accordingly, utilities of GAM88 include diagnosis, prevention and treatment of diseases and clinical conditions associated with TU12B1-TY.

Ubiquitin specific protease 13 (isopeptidase t-3) (USP13, Accession NP_003931.1) is another GAM88 target gene, herein designated TARGET GENE. USP13 BINDING SITE is a target binding site found in the 3' untranslated region of mRNA encoded by USP13, corresponding to a target binding site such as BINDING SITE I, BINDING SITE II or BINDING SITE III of FIG. 8. Table 4 illustrates the complementarity of the nucleotide sequences of USP13 BINDING SITE, designated SEQ ID:8813, to the nucleotide sequence of GAM88 RNA, herein designated GAM RNA, also designated SEQ ID:310.

Another function of GAM88 is therefore inhibition of Ubiquitin specific protease 13 (isopeptidase t-3) (USP13, Accession NP_003931.1). Accordingly, utilities of GAM88 include diagnosis, prevention and treatment of diseases and clinical conditions associated with USP13.

Zinc finger protein 211 (ZNF211, Accession XP_290823.1) is another GAM88 target gene, herein designated TARGET GENE. ZNF211 BINDING SITE is a target binding site found in the 3' untranslated region of multiple transcripts of mRNA encoded by ZNF211, corresponding to a target binding site such as BINDING SITE I, BINDING SITE II or BINDING SITE III of FIG. 8. Table 4 illustrates the complementarity of the nucleotide sequences of ZNF211 BINDING SITE, designated SEQ ID:8415, to the nucleotide sequence of GAM88 RNA, herein designated GAM RNA, also designated SEQ ID:310.

Another function of GAM88 is therefore inhibition of Zinc finger protein 211 (ZNF211, Accession XP_290823.1). Accordingly, utilities of GAM88 include diagnosis, prevention and treatment of diseases and clinical conditions associated with ZNF211.

Zinc finger protein 211 (ZNF211, Accession NP_006376.1) is another GAM88 target gene, herein designated TARGET GENE. ZNF211 BINDING SITE is a target binding site found in the 3' untranslated region of multiple transcripts of mRNA encoded by ZNF211, corresponding to a target binding site such as BINDING SITE I, BINDING SITE II or BINDING SITE III of FIG. 8. Table 4 illustrates the complementarity of the nucleotide sequences of ZNF211 BINDING SITE, designated SEQ ID:8415, to the nucleotide sequence of GAM88 RNA, herein designated GAM RNA, also designated SEQ ID:310.

Another function of GAM88 is therefore inhibition of Zinc finger protein 211 (ZNF211, Accession NP_006376.1). Accordingly, utilities of GAM88 include diagnosis, prevention and treatment of diseases and clinical conditions associated with ZNF211.

FIG. 8 further provides a conceptual description of a novel bioinformatically detected of the present invention, referred to here as Genomic Address Messenger 89 (GAM89), which modulates expression of respective target genes thereof, the function and utility of which target genes is known in the art.

GAM89 is a novel bioinformatically detected regulatory, non protein coding, micro RNA (miRNA) gene. The method by which GAM89 was detected is described hereinabove with reference to FIGS. 8-15.

GAM89 gene, herein designated GAM GENE, and GAM89 target gene, herein designated TARGET GENE, are human genes contained in the human genome.

GAM89 gene encodes a GAM89 precursor RNA, herein designated GAM PRECURSOR RNA. Similar to other miRNA genes, and unlike most ordinary genes, GAM89 precursor RNA does not encode a protein. A nucleotide sequence identical or highly similar to the nucleotide sequence of GAM89 precursor RNA is designated SEQ ID:106, and is provided hereinbelow with reference to the sequence listing part.

GAM89 precursor RNA folds onto itself, forming GAM89 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM89 precursor RNA folds onto itself, forming GAM89 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM89 precursor RNA, designated SEQ-ID:106, and a schematic representation of a predicted secondary folding of GAM89 folded precursor RNA are further described with reference to Table 2, hereby incorporated by reference.

An enzyme complex designated DICER COMPLEX, 'dices' the GAM89 folded precursor RNA into GAM89 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM89 RNA is designated SEQ ID:235, and is provided hereinbelow with references to the sequence listing part and Table 3, hereby incorporated by reference.

GAM89 target gene, herein designated TARGET GENE, encodes a corresponding messenger RNA, GAM89 target RNA, herein designated GAM TARGET RNA. GAM89 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM89 RNA, herein designated GAM RNA, binds complementarily to one or more target binding sites located in untranslated regions of GAM89 target RNA, herein designated GAM TARGET RNA. This complementary binding is due to the fact that the nucleotide sequence of GAM89 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM89 RNA may have a different number of target binding sites in untranslated regions of a GAM89 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM89 RNA, herein designated GAM RNA, to target binding sites on GAM89 target RNA, herein designated GAM TARGET RNA, such as BINDING SITE I, BINDING SITE II and BINDING SITE III, inhibits translation of GAM89 target RNA into GAM89 target protein, herein designated GAM TARGET PROTEIN. GAM target protein is therefore outlined by a broken line.

It is appreciated that GAM89 target gene, herein designated TARGET GENE, in fact represents a plurality of GAM89 target genes. The mRNA of each one of this plurality of GAM89 target genes comprises one or more target binding sites, each having a nucleotide sequence which is at least partly complementary to GAM89 RNA, herein designated GAM RNA, and which when bound by GAM89 RNA causes inhibition of translation of respective one or more GAM89 target proteins.

It is further appreciated by one skilled in the art that the mode of translational inhibition illustrated by FIG. 8 with specific reference to translational inhibition exerted by GAM89 gene, herein designated GAM GENE, on one or more GAM89 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM89 correlate with, and may be deduced from, the identity of the target genes which GAM89 binds and inhibits, and the function of these target genes, as elaborated hereinbelow.

Ap1 gamma subunit binding protein 1 (AP1GBP1, Accession NM_080550.1) is a GAM89 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:17343, to the nucleotide sequence of GAM89 RNA, herein designated GAM RNA, also designated SEQ ID:235.

A function of GAM89 is therefore inhibition of Ap1 gamma subunit binding protein 1 (AP1GBP1, Accession NM_080550.1). Accordingly, utilities of GAM89 include diagnosis, prevention and treatment of diseases and clinical conditions associated with AP1GBP1.

KIAA1244 (Accession NM_020340.1) is another GAM89 target gene, herein designated TARGET GENE. KIAA1244 BINDING SITE is a target binding site found in the 3' untranslated region of mRNA encoded by KIAA1244, corresponding to a target binding site such as BINDING SITE I, BINDING SITE II or BINDING SITE III of FIG. 8. Table 4 illustrates the complementarity of the nucleotide sequences of KIAA1244 BINDING SITE, designated SEQ ID:5953, to the nucleotide sequence of GAM89 RNA, herein designated GAM RNA, also designated SEQ ID:235.

Another function of GAM89 is therefore inhibition of KIAA1244 (Accession NM_020340.1). Accordingly, utilities of GAM89 include diagnosis, prevention and treatment of diseases and clinical conditions associated with KIAA1244.

LOC153218 (Accession XM_087628.1) is another GAM89 target gene, herein designated TARGET GENE. LOC153218 BINDING SITE is a target binding site found in the 3' untranslated region of mRNA encoded by LOC153218, corresponding to a target binding site such as BINDING SITE I, BINDING SITE II or BINDING SITE III of FIG. 8. Table 4 illustrates the complementarity of the nucleotide sequences of LOC153218 BINDING SITE, designated SEQ ID:1873, to the nucleotide sequence of GAM89 RNA, herein designated GAM RNA, also designated SEQ ID:235.

Another function of GAM89 is therefore inhibition of LOC153218 (Accession XM_087628.1). Accordingly, utilities of GAM89 include diagnosis, prevention and treatment of diseases and clinical conditions associated with LOC153218.

LOC256691 (Accession) is another GAM89 target gene, herein designated TARGET GENE. LOC256691 BINDING SITE is a target binding site found in the 3' untranslated region of mRNA encoded by LOC256691, corresponding to a target binding site such as BINDING SITE I, BINDING SITE II or BINDING SITE III of FIG. 8. Table 4 illustrates the complementarity of the nucleotide sequences of LOC256691 BINDING SITE, designated SEQ ID:16637, to the nucleotide sequence of GAM89 RNA, herein designated GAM RNA, also designated SEQ ID:235.

Another function of GAM89 is therefore inhibition of LOC256691 (Accession). Accordingly, utilities of GAM89 include diagnosis, prevention and treatment of diseases and clinical conditions associated with LOC256691.

FIG. 8 further provides a conceptual description of a novel bioinformatically detected of the present invention, referred to here as Genomic Address Messenger 90 (GAM90), which modulates expression of respective target genes thereof, the function and utility of which target genes is known in the art.

GAM90 is a novel bioinformatically detected regulatory, non protein coding, micro RNA (miRNA) gene. The method by which GAM90 was detected is described hereinabove with reference to FIGS. 8-15.

GAM90 gene, herein designated GAM GENE, and GAM90 target gene, herein designated TARGET GENE, are human genes contained in the human genome.

GAM90 gene encodes a GAM90 precursor RNA, herein designated GAM PRECURSOR RNA. Similar to other miRNA genes, and unlike most ordinary genes, GAM90 precursor RNA does not encode a protein. A nucleotide sequence identical or highly similar to the nucleotide sequence of GAM90 precursor RNA is designated SEQ ID:131, and is provided hereinbelow with reference to the sequence listing part.

GAM90 precursor RNA folds onto itself, forming GAM90 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM90 precursor RNA folds onto itself, forming GAM90 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM90 precursor RNA, designated SEQ-ID:131, and a schematic representation of a predicted secondary folding of GAM90 folded precursor RNA are further described with reference to Table 2, hereby incorporated by reference.

An enzyme complex designated DICER COMPLEX, 'dices' the GAM90 folded precursor RNA into GAM90 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM90 RNA is designated SEQ ID:374, and is provided hereinbelow with references to the sequence listing part and Table 3, hereby incorporated by reference.

GAM90 target gene, herein designated TARGET GENE, encodes a corresponding messenger RNA, GAM90 target RNA, herein designated GAM TARGET RNA. GAM90 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM90 RNA, herein designated GAM RNA, binds complementarily to one or more target binding sites located in untranslated regions of GAM90 target RNA, herein designated GAM TARGET RNA. This complementary binding is due to the fact that the nucleotide sequence of GAM90 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM90 RNA may have a different number of target binding sites in untranslated regions of a GAM90 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM90 RNA, herein designated GAM RNA, to target binding sites on GAM90 target RNA, herein designated GAM TARGET RNA, such as BINDING SITE I, BINDING SITE II and BINDING SITE III, inhibits translation of GAM90 target RNA into GAM90 target protein, herein designated GAM TARGET PROTEIN. GAM target protein is therefore outlined by a broken line.

It is appreciated that GAM90 target gene, herein designated TARGET GENE, in fact represents a plurality of GAM90 target genes. The mRNA of each one of this plurality of GAM90 target genes comprises one or more target binding sites, each having a nucleotide sequence which is at least partly complementary to GAM90 RNA, herein designated GAM RNA, and which when bound by GAM90 RNA causes inhibition of translation of respective one or more GAM90 target proteins.

It is further appreciated by one skilled in the art that the mode of translational inhibition illustrated by FIG. 8 with specific reference to translational inhibition exerted by GAM90 gene, herein designated GAM GENE, on one or more GAM90 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM90 correlate with, and may be deduced from, the identity of the target genes which GAM90 binds and inhibits, and the function of these target genes, as elaborated hereinbelow.

AF020591 (Accession NM_014480.1) is a GAM90 target gene, herein designated TARGET GENE. AF020591 BINDING SITE is a target binding site found in the 5' untranslated region of mRNA encoded by AF020591, corresponding to a target binding site such as BINDING SITE I, BINDING SITE II or BINDING SITE III of FIG. 8. Table 4 illustrates the complementarity of the nucleotide sequences of AF020591 BINDING SITE, designated SEQ ID:16052, to the nucleotide sequence of GAM90 RNA, herein designated GAM RNA, also designated SEQ ID:374.

A function of GAM90 is therefore inhibition of AF020591 (Accession NM_014480.1). Accordingly, utilities of GAM90 include diagnosis, prevention and treatment of diseases and clinical conditions associated with AF020591.

BANP (Accession NM_017869.2) is another GAM90 target gene, herein designated TARGET GENE. BANP BINDING SITE is a target binding site found in the 5' untranslated region of multiple transcripts of mRNA encoded by BANP, corresponding to a target binding site such as BINDING SITE I, BINDING SITE II or BINDING SITE III of FIG. 8. Table 4 illustrates the complementarity of the nucleotide sequences of BANP BINDING SITE, designated SEQ ID:18199, to the nucleotide sequence of GAM90 RNA, herein designated GAM RNA, also designated SEQ ID:374.

Another function of GAM90 is therefore inhibition of BANP (Accession NM_017869.2). Accordingly, utilities of GAM90 include diagnosis, prevention and treatment of diseases and clinical conditions associated with BANP.

B-cell cll/lymphoma 6 (zinc finger protein 51) (BCL6, Accession NM_001706.2) is another GAM90 target gene, herein designated TARGET GENE. BCL6 BINDING SITE is a target binding site found in the 3' untranslated region of multiple transcripts of mRNA encoded by BCL6, corresponding to a target binding site such as BINDING SITE I, BINDING SITE II or BINDING SITE III of FIG. 8. Table 4 illustrates the complementarity of the nucleotide sequences of BCL6 BINDING SITE, designated SEQ ID:9018, to the nucleotide sequence of GAM90 RNA, herein designated GAM RNA, also designated SEQ ID:374.

Another function of GAM90 is therefore inhibition of B-cell cll/lymphoma 6 (zinc finger protein 51) (BCL6, Accession NM_001706.2), a gene which is involved in the generation and maintenance of both T and B cells during immune responses and therefore may be associated with B-cell non-hodgkin lymphoma, diffuse large cell lymphomas and follicular lymphomas. Accordingly, utilities of GAM90 include diagnosis, prevention and treatment of B-cell non-hodgkin lymphoma, diffuse large cell lymphomas and follicular lymphomas, and of other diseases and clinical conditions associated with BCL6.

The function of BCL6 has been established by previous studies. Chromosomal translocations involving chromosome 3q27 and immunoglobulin gene regions are among the most common rearrangements in B-cell non-Hodgkin lymphoma. Using a probe from the immunoglobulin heavy chain joining region locus (OMIM Ref. No. 147010), Baron et al. (1993) isolated genomic clones from a bacteriophage lambda library prepared from a lymphoma characterized by a translocation t(3;14)(q27;q32). Normal chromosome 3 sequences and the reciprocal breakpoint junction were isolated. DNA probes on each side of the chromosome 3 breakpoint hybridized at high stringency to the DNA of various mammalian species, demonstrating evolutionary conservation. A probe made from partial cDNA clones isolated from a T-cell line hybridized the genomic DNA from both sides of the chromosome 3 breakpoint, indicating that the t(3;14) is associated with a break within the gene on chromosome 3. In situ chromosomal hybridization revealed that the same gene is involved in the t(3;22)(q27;q11). Preliminary nucleotide sequencing showed no identity of the cDNA to gene sequences in available data banks. Baron et al. (1993) proposed the name B-cell lymphoma-6 (BCL6) for this gene, which they presumed plays a role in the pathogenesis of certain B-cell lymphomas. Ye et al. (1993) cloned the BCL6 gene.

Animal model experiments lend further support to the function of BCL6. Ichii et al. (2002) observed that the percentage of CD8 (see OMIM Ref. No. 186910)-positive T cells with a memory phenotype was lower in Bcl6 -/- mice than in wildtype mice, while the percentage of activated T cells was the same. Transgenic mice and 'rescued' Bcl6 -/- mice expressing the Bcl6 transgene specifically in T cells had levels of memory CD8 cells like those of wildtype mice. After antigenic stimulation, memory CD8 cells, which express CD44 (OMIM Ref. No. 107269), Ly6C (see OMIM Ref. No. LY6D; 606204), CD122 (OMIM Ref. No. 146710), and Bcl2 (OMIM Ref. No. 151430), differentiated into effector cells more rapidly than nonmemory CD8 cells in wildtype mice. Analysis of CD8-positive T-cell proliferation indicated that memory-type CD8 cells proliferated through a homeostatic mechanism in a Bcl6-dependent manner in the lymphopenic environment of very young mouse spleens. Ichii et al. (2002) concluded that BCL6 is involved in the generation and maintenance of both T and B cells during immune responses.

It is appreciated that the abovementioned animal model for BCL6 is acknowledged by those skilled in the art as a scientifically valid animal model, as can be further appreciated from the publications sited hereinbelow.

Full details of the abovementioned studies are described in the following publications, the disclosure of which are hereby incorporated by reference:

y, B. H.; Rao, P. H.; Chaganti, R. S. K.; Dalla-Favera, R.: Cloning of bcl-6, the locus involved in chromosome translocations affecting band 3q27 in B-cell lymphoma. Cancer Res. 53:2732-2735, 1993; and Ichii, H.; Sakamoto, A.; Hatano, M.; Okada, S.; Toyama, H.; Taki, S.; Arima, M.; Kuroda, Y.; Tokuhisa, T.: Role of Bcl-6 in the generation and maintenance of memory CD8+ T cells. Natu.

Further studies establishing the function and utilities of BCL6 are found in John Hopkins OMIM database record ID 109565, and in cited publications listed in Table 5, which are hereby incorporated by reference. Cold autoinflammatory syndrome 1 (CIAS1, Accession NM_004895.2) is another GAM90 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:19841, to the nucleotide sequence of GAM90 RNA, herein designated GAM RNA, also designated SEQ ID:374.

Another function of GAM90 is therefore inhibition of Cold autoinflammatory syndrome 1 (CIAS1, Accession NM_004895.2), a gene which may mediate protein-protein interactions; contains a leucine rich repeat and therefore may be associated with Familial cold autoinflammatory syndrome, muckle-wells syndrome. Accordingly, utilities of GAM90 include diagnosis, prevention and treatment of Familial cold autoinflammatory syndrome, muckle-wells syndrome, and of other diseases and clinical conditions associated with CIAS1.

The function of CIAS1 has been established by previous studies. In a positional cloning effort to identify the gene mutated in familial cold autoinflammatory syndrome and Muckle-Wells syndrome, both of which map to 1q44, Hoffman et al. (2001) cloned and characterized the CIAS1 gene, so named for 'cold- induced autoinflammatory syndrome.' The full-length cDNA corresponds to a 9-exon gene encoding an open reading frame of 3,105 basepairs with 2 potential start codons in exon 1, with the second start codon meeting more Kozak criteria, and a stop codon at exon 9. Northern blot analysis identified a broad mRNA band of approximately 4 kb expressed at a low level in peripheral blood leukocytes; little or no expression was detectable in other tissues. Further analysis revealed extensive alternative splicing of exons 4 through 8 that resulted in mRNAs ranging from 3,315 to 4,170 bp, consistent with the Northern blot analysis. The predicted protein encoded by the first splice form of CIAS1 (exons 1-3, 5, and 7-9), called cryopyrin, consists of 920 amino acids with a size of 105.7 kD and a PI of 6.16. The protein sequence contains several distinct motifs including a pyrin domain in the amino terminus (amino acids 13 through 83), a central nucleotide- binding site (NACHT subfamily) domain in exon 3 (amino acids 217 to 533), and a C-terminal leucine-rich repeat domain containing 7 leucine- rich repeats (amino acids 697 through 920). No nuclear localization signals were identified and no clear transmembrane regions were found. The largest protein potentially encoded by the 9 exons of CIAS1 consists of 1,034 amino acids with a size of 117.9 kD and 11 C-terminal leucine-rich repeats. Hoffman et al. (2001) suggested that cryopyrin is a signaling protein involved in the regulation of apoptosis. Dode et al. (2002) identified CIAS1 mutations, all located in exon 3, in 9 unrelated families with MWS and in 3 unrelated families with familial cold urticaria (FCU), originating from France, England, and Algeria. Five mutations were novel. The R260W mutation (606416.0005) was identified in 2 families with MWS and in 2 families with FCU, of different ethnic origins, thereby demonstrating that a single CIAS1 mutation may cause both syndromes. This result indicated that modifier genes are involved in determining either an MWS or an FCU phenotype. The finding of the G569R mutation (606416.0006) in asymptomatic individuals further emphasized the importance of a modifier gene (or genes) in determining disease phenotype. The authors suggested that identification of modifiers was likely to have significant therapeutic implications for these severe diseases.

Full details of the abovementioned studies are described in the following publications, the disclosure of which are hereby incorporated by reference:

Dode, C.; Le Du, N.; Cuisset, L.; Letourneur, F.; Berthelot, J.-M.; Vaudour, G.; Meyrier, A.; Watts, R. A.; Scott, D. G. I.; Nicholls, A.; Granel, B.; Frances, C.; Garcier, F.; Edery, P.;

Boulinguez, S.; Domergues, J.-P.; Delpech, M.; Grateau, G.: New mutations of CIAS1 that are responsible for Muckle-Wells syndrome and familial cold urticaria: a novel mutation underlies both syndromes. Am. J. Hum. Genet. 70:1498-1506, 2002; and Hoffman, H. M.; Mueller, J. L.; Broide, D. H.; Wanderer, A. A.; Kolodner, R. D.: Mutation of a new gene encoding a putative pyrin-like protein causes familial cold autoinflammatory syn.

Further studies establishing the function and utilities of CIAS1 are found in John Hopkins OMIM database record ID 606416, and in cited publications listed in Table 5, which are hereby incorporated by reference. Ccctc-binding factor (zinc finger protein)-like (CTCFL, Accession NM_080618.2) is another GAM90 target gene, herein designated TARGET GENE. CTCFL BINDING SITE is a target binding site found in the 3' untranslated region of mRNA encoded by CTCFL, corresponding to a target binding site such as BINDING SITE I, BINDING SITE II or BINDING SITE III of FIG. 8. Table 4 illustrates the complementarity of the nucleotide sequences of CTCFL BINDING SITE, designated SEQ ID:16845, to the nucleotide sequence of GAM90 RNA, herein designated GAM RNA, also designated SEQ ID:374.

Another function of GAM90 is therefore inhibition of Ccctc-binding factor (zinc finger protein)-like (CTCFL, Accession NM_080618.2). Accordingly, utilities of GAM90 include diagnosis, prevention and treatment of diseases and clinical conditions associated with CTCFL.

DKFZp434O0515 (Accession NM_178123.1) is another GAM90 target gene, herein designated TARGET GENE. DKFZp434O0515 BINDING SITE is a target binding site found in the 5' untranslated region of mRNA encoded by DKFZp434O0515, corresponding to a target binding site such as BINDING SITE I, BINDING SITE II or BINDING SITE III of FIG. 8. Table 4 illustrates the complementarity of the nucleotide sequences of DKFZp434O0515 BINDING SITE, designated SEQ ID:12460, to the nucleotide sequence of GAM90 RNA, herein designated GAM RNA, also designated SEQ ID:374.

Another function of GAM90 is therefore inhibition of DKFZp434O0515 (Accession NM_178123.1). Accordingly, utilities of GAM90 include diagnosis, prevention and treatment of diseases and clinical conditions associated with DKFZp434O0515.

E2IG4 (Accession NM_015516.1) is another GAM90 target gene, herein designated TARGET GENE. E2IG4 BINDING SITE is a target binding site found in the 3' untranslated region of mRNA encoded by E2IG4, corresponding to a target binding site such as BINDING SITE I, BINDING SITE II or BINDING SITE III of FIG. 8. Table 4 illustrates the complementarity of the nucleotide sequences of E2IG4 BINDING SITE, designated SEQ ID:10835, to the nucleotide sequence of GAM90 RNA, herein designated GAM RNA, also designated SEQ ID:374.

Another function of GAM90 is therefore inhibition of E2IG4 (Accession NM_015516.1). Accordingly, utilities of GAM90 include diagnosis, prevention and treatment of diseases and clinical conditions associated with E2IG4.

Estrogen receptor binding site associated, antigen, 9 (EBAG9, Accession NM_004215.2) is another GAM90 target gene, herein designated TARGET GENE. EBAG9 BINDING SITE is a target binding site found in the 5' untranslated region of mRNA encoded by EBAG9, corresponding to a target binding site such as BINDING SITE I, BINDING SITE II or BINDING SITE III of FIG. 8. Table 4 illustrates the complementarity of the nucleotide sequences of EBAG9 BINDING SITE, designated SEQ ID:768, to the nucleotide sequence of GAM90 RNA, herein designated GAM RNA, also designated SEQ ID:374.

Another function of GAM90 is therefore inhibition of Estrogen receptor binding site associated, antigen, 9 (EBAG9, Accession NM_004215.2), a gene which suppresses cell proliferation and induces apoptotic cell death and therefore may be associated with Cancer and tumor invasiveness. Accordingly, utilities of GAM90 include diagnosis, prevention and treatment of Cancer and tumor invasiveness, and of other diseases and clinical conditions associated with EBAG9.

The function of EBAG9 has been established by previous studies. Watanabe et al. (1998) used the CpG-GBS (genomic binding site) method to isolate novel estrogen-responsive genes. By screening a breast cancer cDNA library with the ESR-binding fragments isolated from the CpG island library, they isolated cDNAs encoding EBAG9, GRIN2D (OMIM Ref. No. 602717), and COX7A2L (OMIM Ref. No. 605771), which the authors termed EB9, EB11, and EB1 (or COX7RP), respectively. EBAG9 encodes a deduced 214-amino acid protein. Northern blot analysis revealed expression of a 1.8-kb transcript in endometrial carcinoma and breast cancer cell lines and, to a lesser extent, in an osteosarcoma cell line. Gel mobility shift analysis confirmed that the ERE of EBAG9 binds to ESR. Northern blot analysis detected an upregulation of EBAG9 after estrogen treatment of a breast cancer cell line. Ikeda et al. (2000) noted that EBAG9 is identical with RCAS1, a human cancer cell surface antigen isolated by Nakashima et al. (1999). Ikeda et al. (2000) determined that the 5-prime flanking region of EBAG9 is 65% GC-rich, lacks a TATA motif, and contains a perfect palindromic ERE element at -60 to -48 upstream of the transcription initiation site. Promoter analysis revealed that the ERE-containing region can respond to estrogen in a breast cancer cell line. Electrophoretic mobility shift and supershift analysis demonstrated that ESR1 (OMIM Ref. No. 133430) is involved in binding to the ERE element.

Full details of the abovementioned studies are described in the following publications, the disclosure of which are hereby incorporated by reference:

Watanabe, T.; Inoue, S.; Hiroi, H.; Orimo, A.; Kawashima, H.; Muramatsu, M.: Isolation of estrogen-responsive genes with a CpG island library. Molec. Cell. Biol. 18:442-449, 1998; and Ikeda, K.; Sato, M.; Tsutsumi, O.; Tsuchiy, F.; Tsuneizumi, M.; Emi, M.; Imoto, I.; Inazawa, J.; Muramatsu, M.; Inoue, S.: Promoter analysis and chromosomal mapping of human EBAG9 gene.

Further studies establishing the function and utilities of EBAG9 are found in John Hopkins OMIM database record ID 605772, and in cited publications listed in Table 5, which are hereby incorporated by reference. FLJ13964 (Accession) is another GAM90 target gene, herein designated TARGET GENE. FLJ13964 BINDING SITE is a target binding site found in the 3' untranslated region of mRNA encoded by FLJ13964, corresponding to a target binding site such as BINDING SITE I, BINDING SITE II or BINDING SITE III of FIG. 8. Table 4 illustrates the complementarity of the nucleotide sequences of FLJ13964 BINDING SITE, designated SEQ ID:10501, to the nucleotide sequence of GAM90 RNA, herein designated GAM RNA, also designated SEQ ID:374.

Another function of GAM90 is therefore inhibition of FLJ13964 (Accession). Accordingly, utilities of GAM90 include diagnosis, prevention and treatment of diseases and clinical conditions associated with FLJ13964.

FLJ21916 (Accession) is another GAM90 target gene, herein designated TARGET GENE. FLJ21916 BINDING SITE is a target binding site found in the 3' untranslated region of mRNA encoded by FLJ21916, corresponding to a target binding site such as BINDING SITE I, BINDING SITE II or BINDING SITE III of FIG. 8. Table 4 illustrates the complementarity of the nucleotide sequences of FLJ21916 BINDING SITE, designated SEQ ID:6125, to the nucleotide sequence of GAM90 RNA, herein designated GAM RNA, also designated SEQ ID:374.

Another function of GAM90 is therefore inhibition of FLJ21916 (Accession). Accordingly, utilities of GAM90 include diagnosis, prevention and treatment of diseases and clinical conditions associated with FLJ21916.

Grb2-associated binding protein 2 (GAB2, Accession NM_080491.1) is another GAM90 target gene, herein designated TARGET GENE. GAB2 BINDING SITE is a target binding site found in the 5' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:12509, to the nucleotide sequence of GAM90 RNA, herein designated GAM RNA, also designated SEQ ID:374.

Another function of GAM90 is therefore inhibition of Grb2-associated binding protein 2 (GAB2, Accession NM_080491.1), a gene which act as adapters for transmitting various signals. Accordingly, utilities of GAM90 include diagnosis, prevention and treatment of diseases and clinical conditions associated with GAB2.

The function of GAB2 and its association with various diseases and clinical conditions, has been established by previous studies, as described hereinabove with reference to GAM63.1. Glycoprotein a repetitions predominant (GARP, Accession NM_005512.1) is another GAM90 target gene, herein designated TARGET GENE. GARP BINDING SITE is a target binding site found in the 3' untranslated region of mRNA encoded by GARP, corresponding to a target binding site such as BINDING SITE I, BINDING SITE II or BINDING SITE III of FIG. 8. Table 4 illustrates the complementarity of the nucleotide sequences of GARP BINDING SITE, designated SEQ ID:10589, to the nucleotide sequence of GAM90 RNA, herein designated GAM RNA, also designated SEQ ID:374.

Another function of GAM90 is therefore inhibition of Glycoprotein a repetitions predominant (GARP, Accession NM_005512.1). Accordingly, utilities of GAM90 include diagnosis, prevention and treatment of diseases and clinical conditions associated with GARP.

HCC8 (Accession NM_016516.1) is another GAM90 target gene, herein designated TARGET GENE. HCC8 BINDING SITE is a target binding site found in the 3' untranslated region of mRNA encoded by HCC8, corresponding to a target binding site such as BINDING SITE I, BINDING SITE II or BINDING SITE III of FIG. 8. Table 4 illustrates the complementarity of the nucleotide sequences of HCC8 BINDING SITE, designated SEQ ID:19979, to the nucleotide sequence of GAM90 RNA, herein designated GAM RNA, also designated SEQ ID:374.

Another function of GAM90 is therefore inhibition of HCC8 (Accession NM_016516.1). Accordingly, utilities of GAM90 include diagnosis, prevention and treatment of diseases and clinical conditions associated with HCC8.

HMP19 (Accession NM_015980.1) is another GAM90 target gene, herein designated TARGET GENE. HMP19 BINDING SITE is a target binding site found in the 3' untranslated region of mRNA encoded by HMP19, corresponding to a target binding site such as BINDING SITE I, BINDING SITE II or BINDING SITE III of FIG. 8. Table 4 illustrates the complementarity of the nucleotide sequences of HMP19 BINDING SITE, designated SEQ ID:1334, to the nucleotide sequence of GAM90 RNA, herein designated GAM RNA, also designated SEQ ID:374.

Another function of GAM90 is therefore inhibition of HMP19 (Accession NM_015980.1). Accordingly, utilities of GAM90 include diagnosis, prevention and treatment of diseases and clinical conditions associated with HMP19.

Interferon regulatory factor 1 (IRF1, Accession NM_002198.1) is another GAM90 target gene, herein designated TARGET GENE. IRF1 BINDING SITE is a target binding site found in the 3' untranslated region of mRNA encoded by IRF1, corresponding to a target binding site such as BINDING SITE I, BINDING SITE II or BINDING SITE III of FIG. 8. Table 4 illustrates the complementarity of the nucleotide sequences of IRF1 BINDING SITE, designated SEQ ID:622, to the nucleotide sequence of GAM90 RNA, herein designated GAM RNA, also designated SEQ ID:374.

Another function of GAM90 is therefore inhibition of Interferon regulatory factor 1 (IRF1, Accession NM_002198.1), a gene which specifically binds to the upstream regulatory region of type i ifn and ifn-inducible mhc class i genes and therefore may be associated with Gastric cancer. Accordingly, utilities of GAM90 include diagnosis, prevention and treatment of Gastric cancer, and of other diseases and clinical conditions associated with IRF1.

The function of IRF1 has been established by previous studies. In the course of studies of the regulation of type I interferon gene expression (147660, 147640), Miyamoto et al. (1988) identified a nuclear factor, termed interferon regulatory factor-1 (IRF1), that binds to the upstream cis elements of both the interferon-alpha and the interferon-beta genes. It was found that IRF1 functions as a transcriptional activator for the type I IFN genes (Harada et al., 1990). Harada et al. (1989) found that another factor, IRF2 (OMIM Ref. No. 147576), apparently antagonizes the IRF1 effect by competing for the same cis elements. By linkage studies using RFLPs, the IRF1 gene was assigned to 5q23-q31. To assess the possible role of IRF1 in the regulation of cell growth and differentiation, Yamada et al. (1991) generated transgenic mice carrying the human IRF1 gene, the constitutive expression of which was driven at a high level by the juxtaposed human immunoglobulin heavy-chain enhancer. They found that these transgenic mice showed a dramatic reduction in the number of B lymphocytes. Itoh et al. (1991) also mapped IRF1 to chromosome 5 by analysis of mouse-human somatic cell hybrids. Loss of heterozygosity (LOH) at the IRF1 locus occurs frequently in human gastric cancer (OMIM Ref. No. 137215) (Tamura et al., 1996). Nozawa et al. (1998) identified a point mutation in a human gastric cancer cell line (147575.0001) that changed methionine at codon 8 to leucine and produced an IRF1 protein with reduced transcriptional activity, but unaltered DNA-binding activity. In addition, Harada et al. (1994) had observed alternative splicing of IRF1 mRNA, producing nonfunctional IRF1 protein at high frequencies in patients with myelodysplastic syndrome and acute myelogenous leukemia Animal model experiments lend further support to the function of IRF1. Ko et al. (2002) noted that Irf1 -/- mice are deficient in Inos (OMIM Ref. No. 163730), Il12b (OMIM Ref. No. 161561), Cd8 (see OMIM Ref. No. 186910)-positive T cells, and natural killer (NK) cells, whereas Irf2 -/- mice are deficient in NK cells and have dysregulated Il12b induction. Icsbp (OMIM Ref. No. 601565) -/- mice are deficient in Il12b, Irf2, and reactive oxygen intermediates (ROIs). The Irf1, Irf2, and Icsbp genes are all inducible by gamma-interferon (Ifng; 147570). Irf1-, Irf2-, and Icsbp-deficient mouse strains have varying susceptibility to different intracellular bacterial and protozoan pathogens. Ko et al. (2002) determined that Irf1 -/- mice are highly susceptible to fatal liver damage from Brucella abortus, the causative agent of brucellosis, which manifests as arthritis, endocarditis, and meningitis in humans. In contrast, Irf2 -/- mice are highly resistant to Brucella, whereas Icsbp -/- mice maintain a plateau of infection similar to that seen in Il12b -/- mice. The authors concluded that IL12, reactive nitrogen intermediates, and ROIs are probably crucial immune components in resistance to Brucella infection.

It is appreciated that the abovementioned animal model for IRF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Yamada, G.; Ogawa, M.; Akagi, K.; Miyamoto, H.; Nakano, N.; Itoh, S.; Miyazaki, J.; Nishikawa, S.; Yamamura, K.; Taniguchi, T.: Specific depletion of the B-cell population induced by aberrant expression of human interferon regulatory factor 1 gene in transgenic mice. Proc. Nat. Acad. Sci. 88:532-536, 1991.; and Ko, J.; Gendron-Fitzpatrick, A.; Splitter, G. A.: Susceptibility of IFN regulatory factor-1 and IFN consensus sequence binding protein-deficient mice to brucellosis. J. Immun. 168: 2433.

Further studies establishing the function and utilities of IRF1 are found in John Hopkins OMIM database record ID 147575, and in cited publications listed in Table 5, which are hereby incorporated by reference. KIAA0280 (Accession XM_166238.1) is another GAM90 target gene, herein designated TARGET GENE. KIAA0280 BINDING SITE is a target binding site found in the 3' untranslated region of mRNA encoded by KIAA0280, corresponding to a target binding site such as BINDING SITE I, BINDING SITE II or BINDING SITE III of FIG. 8. Table 4 illustrates the complementarity of the nucleotide sequences of KIAA0280 BINDING SITE, designated SEQ ID:5713, to the nucleotide sequence of GAM90 RNA, herein designated GAM RNA, also designated SEQ ID:374.

Another function of GAM90 is therefore inhibition of KIAA0280 (Accession XM_166238.1). Accordingly, utilities of GAM90 include diagnosis, prevention and treatment of diseases and clinical conditions associated with KIAA0280.

KIAA1219 (Accession XM_028835.7) is another GAM90 target gene, herein designated TARGET GENE. KIAA1219 BINDING SITE is a target binding site found in the 3' untranslated region of mRNA encoded by KIAA1219, corresponding to a target binding site such as BINDING SITE I, BINDING SITE II or BINDING SITE III of FIG. 8. Table 4 illustrates the complementarity of the nucleotide sequences of KIAA1219 BINDING SITE, designated SEQ ID:9549, to the nucleotide sequence of GAM90 RNA, herein designated GAM RNA, also designated SEQ ID:374.

Another function of GAM90 is therefore inhibition of KIAA1219 (Accession XM_028835.7). Accordingly, utilities of GAM90 include diagnosis, prevention and treatment of diseases and clinical conditions associated with KIAA1219.

KIAA1340 (Accession XM_044836.7) is another GAM90 target gene, herein designated TARGET GENE. KIAA1340 BINDING SITE is a target binding site found in the 3' untranslated region of mRNA encoded by KIAA1340, corresponding to a target binding site such as BINDING SITE I, BINDING SITE II or BINDING SITE III of FIG. 8. Table 4 illustrates the complementarity of the nucleotide sequences of KIAA1340 BINDING SITE, designated SEQ ID:17198, to the nucleotide sequence of GAM90 RNA, herein designated GAM RNA, also designated SEQ ID:374.

Another function of GAM90 is therefore inhibition of KIAA1340 (Accession XM_044836.7). Accordingly, utilities of GAM90 include diagnosis, prevention and treatment of diseases and clinical conditions associated with KIAA1340.

KIAA1715 (Accession XM_042834.2) is another GAM90 target gene, herein designated TARGET GENE. KIAA1715 BINDING SITE is a target binding site found in the 3' untranslated region of mRNA encoded by KIAA1715, corresponding to a target binding site such as BINDING SITE I, BINDING SITE II or BINDING SITE III of FIG. 8. Table 4 illustrates the complementarity of the nucleotide sequences of KIAA1715 BINDING SITE, designated SEQ ID:2627, to the nucleotide sequence of GAM90 RNA, herein designated GAM RNA, also designated SEQ ID:374.

Another function of GAM90 is therefore inhibition of KIAA1715 (Accession XM_042834.2). Accordingly, utilities of GAM90 include diagnosis, prevention and treatment of diseases and clinical conditions associated with KIAA1715.

LOC124446 (Accession XM_058805.5) is another GAM90 target gene, herein designated TARGET GENE. LOC124446 BINDING SITE is a target binding site found in the 5' untranslated region of mRNA encoded by LOC124446, corresponding to a target binding site such as BINDING SITE I, BINDING SITE II or BINDING SITE III of FIG. 8. Table 4 illustrates the complementarity of the nucleotide sequences of LOC124446 BINDING SITE, designated SEQ ID:14538, to the nucleotide sequence of GAM90 RNA, herein designated GAM RNA, also designated SEQ ID:374.

Another function of GAM90 is therefore inhibition of LOC124446 (Accession XM_058805.5). Accordingly, utilities of GAM90 include diagnosis, prevention and treatment of diseases and clinical conditions associated with LOC124446.

LOC147685 (Accession) is another GAM90 target gene, herein designated TARGET GENE. LOC147685 BINDING SITE is a target binding site found in the 3' untranslated region of mRNA encoded by LOC147685, corresponding to a target binding site such as BINDING SITE I, BINDING SITE II or BINDING SITE III of FIG. 8. Table 4 illustrates the complementarity of the nucleotide sequences of LOC147685 BINDING SITE, designated SEQ ID:15549, to the nucleotide sequence of GAM90 RNA, herein designated GAM RNA, also designated SEQ ID:374.

Another function of GAM90 is therefore inhibition of LOC147685 (Accession). Accordingly, utilities of GAM90 include diagnosis, prevention and treatment of diseases and clinical conditions associated with LOC147685.

LOC148508 (Accession) is another GAM90 target gene, herein designated TARGET GENE. LOC148508 BINDING SITE is a target binding site found in the 3' untranslated region of mRNA encoded by LOC148508, corresponding to a target binding site such as BINDING SITE I, BINDING SITE II or BINDING SITE III of FIG. 8. Table 4 illustrates the complementarity of the nucleotide sequences of LOC148508 BINDING SITE, designated SEQ ID:16878, to the nucleotide sequence of GAM90 RNA, herein designated GAM RNA, also designated SEQ ID:374.

Another function of GAM90 is therefore inhibition of LOC148508 (Accession). Accordingly, utilities of GAM90 include diagnosis, prevention and treatment of diseases and clinical conditions associated with LOC148508.

LOC150998 (Accession) is another GAM90 target gene, herein designated TARGET GENE. LOC150998 BINDING SITE is a target binding site found in the 3' untranslated region of mRNA encoded by LOC150998, corresponding to a target binding site such as BINDING SITE I, BINDING SITE II or BINDING SITE III of FIG. 8. Table 4 illustrates the complementarity of the nucleotide sequences of LOC150998 BINDING SITE, designated SEQ ID:18871, to the nucleotide sequence of GAM90 RNA, herein designated GAM RNA, also designated SEQ ID:374.

Another function of GAM90 is therefore inhibition of LOC150998 (Accession). Accordingly, utilities of GAM90 include diagnosis, prevention and treatment of diseases and clinical conditions associated with LOC150998.

LOC159199 (Accession) is another GAM90 target gene, herein designated TARGET GENE. LOC159199 BINDING SITE is a target binding site found in the 5' untranslated region of mRNA encoded by LOC159199, corresponding to a target binding site such as BINDING SITE I, BINDING SITE II or BINDING SITE III of FIG. 8. Table 4 illustrates the complementarity of the nucleotide sequences of LOC159199 BINDING SITE, designated SEQ ID:16647, to the nucleotide sequence of GAM90 RNA, herein designated GAM RNA, also designated SEQ ID:374.

Another function of GAM90 is therefore inhibition of LOC159199 (Accession). Accordingly, utilities of GAM90 include diagnosis, prevention and treatment of diseases and clinical conditions associated with LOC159199.

LOC199786 (Accession) is another GAM90 target gene, herein designated TARGET GENE. LOC199786 BINDING SITE is a target binding site found in the 3' untranslated region of mRNA encoded by LOC199786, corresponding to a target binding site such as BINDING SITE I, BINDING SITE II or BINDING SITE III of FIG. 8. Table 4 illustrates the complementarity of the nucleotide sequences of LOC199786 BINDING SITE, designated SEQ ID:5506, to the nucleotide sequence of GAM90 RNA, herein designated GAM RNA, also designated SEQ ID:374.

Another function of GAM90 is therefore inhibition of LOC199786 (Accession). Accordingly, utilities of GAM90 include diagnosis, prevention and treatment of diseases and clinical conditions associated with LOC199786.

LOC200205 (Accession XM_114152.1) is another GAM90 target gene, herein designated TARGET GENE. LOC200205 BINDING SITE is a target binding site found in the 3' untranslated region of mRNA encoded by LOC200205, corresponding to a target binding site such as BINDING SITE I, BINDING SITE II or BINDING SITE III of FIG. 8. Table 4 illustrates the complementarity of the nucleotide sequences of LOC200205 BINDING SITE, designated SEQ ID:13733, to the nucleotide sequence of GAM90 RNA, herein designated GAM RNA, also designated SEQ ID:374.

Another function of GAM90 is therefore inhibition of LOC200205 (Accession XM_114152.1). Accordingly, utilities of GAM90 include diagnosis, prevention and treatment of diseases and clinical conditions associated with LOC200205.

LOC220522 (Accession XM_018306.6) is another GAM90 target gene, herein designated TARGET GENE. LOC220522 BINDING SITE is a target binding site found in the 3' untranslated region of mRNA encoded by LOC220522, corresponding to a target binding site such as BINDING SITE I, BINDING SITE II or BINDING SITE III of FIG. 8. Table 4 illustrates the complementarity of the nucleotide sequences of LOC220522 BINDING SITE, designated SEQ ID:10285, to the nucleotide sequence of GAM90 RNA, herein designated GAM RNA, also designated SEQ ID:374.

Another function of GAM90 is therefore inhibition of LOC220522 (Accession XM_018306.6). Accordingly, utilities of GAM90 include diagnosis, prevention and treatment of diseases and clinical conditions associated with LOC220522.

LOC222803 (Accession) is another GAM90 target gene, herein designated TARGET GENE. LOC222803 BINDING SITE is a target binding site found in the 5' untranslated region of mRNA encoded by LOC222803, corresponding to a target binding site such as BINDING SITE I, BINDING SITE II or BINDING SITE III of FIG. 8. Table 4 illustrates the complementarity of the nucleotide sequences of LOC222803 BINDING SITE, designated SEQ ID:2424, to the nucleotide sequence of GAM90 RNA, herein designated GAM RNA, also designated SEQ ID:374.

Another function of GAM90 is therefore inhibition of LOC222803 (Accession). Accordingly, utilities of GAM90 include diagnosis, prevention and treatment of diseases and clinical conditions associated with LOC222803.

LOC254132 (Accession) is another GAM90 target gene, herein designated TARGET GENE. LOC254132 BINDING SITE is a target binding site found in the 5' untranslated region of mRNA encoded by LOC254132, corresponding to a target binding site such as BINDING SITE I, BINDING SITE II or BINDING SITE III of FIG. 8. Table 4 illustrates the complementarity of the nucleotide sequences of LOC254132 BINDING SITE, designated SEQ ID:16296, to the nucleotide sequence of GAM90 RNA, herein designated GAM RNA, also designated SEQ ID:374.

Another function of GAM90 is therefore inhibition of LOC254132 (Accession). Accordingly, utilities of GAM90 include diagnosis, prevention and treatment of diseases and clinical conditions associated with LOC254132.

LOC257554 (Accession) is another GAM90 target gene, herein designated TARGET GENE. LOC257554 BINDING SITE is a target binding site found in the 3' untranslated region of mRNA encoded by LOC257554, corresponding to a target binding site such as BINDING SITE I, BINDING SITE II or BINDING SITE III of FIG. 8. Table 4 illustrates the complementarity of the nucleotide sequences of LOC257554 BINDING SITE, designated SEQ ID:13098, to the nucleotide sequence of GAM90 RNA, herein designated GAM RNA, also designated SEQ ID:374.

Another function of GAM90 is therefore inhibition of LOC257554 (Accession). Accordingly, utilities of GAM90 include diagnosis, prevention and treatment of diseases and clinical conditions associated with LOC257554.

LOC51279 (Accession NM_016546.1) is another GAM90 target gene, herein designated TARGET GENE. LOC51279 BINDING SITE is a target binding site found in the 3' untranslated region of mRNA encoded by LOC51279, corresponding to a target binding site such as BINDING SITE I, BINDING SITE II or BINDING SITE III of FIG. 8. Table 4 illustrates the complementarity of the nucleotide sequences of LOC51279 BINDING SITE, designated SEQ ID:954, to the nucleotide sequence of GAM90 RNA, herein designated GAM RNA, also designated SEQ ID:374.

Another function of GAM90 is therefore inhibition of LOC51279 (Accession NM_016546.1). Accordingly, utilities of GAM90 include diagnosis, prevention and treatment of diseases and clinical conditions associated with LOC51279.

LOC80298 (Accession NM_025198.2) is another GAM90 target gene, herein designated TARGET GENE. LOC80298 BINDING SITE is a target binding site found in the 5' untranslated region of mRNA encoded by LOC80298, corresponding to a target binding site such as BINDING SITE I, BINDING SITE II or BINDING SITE III of FIG. 8. Table 4 illustrates the complementarity of the nucleotide sequences of LOC80298 BINDING SITE, designated SEQ ID:18667, to the nucleotide sequence of GAM90 RNA, herein designated GAM RNA, also designated SEQ ID:374.

Another function of GAM90 is therefore inhibition of LOC80298 (Accession NM_025198.2). Accordingly, utilities of GAM90 include diagnosis, prevention and treatment of diseases and clinical conditions associated with LOC80298.

LOC91660 (Accession) is another GAM90 target gene, herein designated TARGET GENE. LOC91660 BINDING SITE is a target binding site found in the 5' untranslated region of mRNA encoded by LOC91660, corresponding to a target binding site such as BINDING SITE I, BINDING SITE II or BINDING SITE III of FIG. 8. Table 4 illustrates the complementarity of the nucleotide sequences of LOC91660 BINDING SITE, designated SEQ ID:10541, to the nucleotide sequence of GAM90 RNA, herein designated GAM RNA, also designated SEQ ID:374.

Another function of GAM90 is therefore inhibition of LOC91660 (Accession). Accordingly, utilities of GAM90 include diagnosis, prevention and treatment of diseases and clinical conditions associated with LOC91660.

MGC1203 (Accession NM_024296.1) is another GAM90 target gene, herein designated TARGET GENE. MGC1203 BINDING SITE is a target binding site found in the 3' untranslated region of mRNA encoded by MGC1203, corresponding to a target binding site such as BINDING SITE I, BINDING SITE II or BINDING SITE III of FIG. 8. Table 4 illustrates the complementarity of the nucleotide sequences of MGC1203 BINDING SITE, designated SEQ ID:6223, to the nucleotide sequence of GAM90 RNA, herein designated GAM RNA, also designated SEQ ID:374.

Another function of GAM90 is therefore inhibition of MGC1203 (Accession NM_024296.1). Accordingly, utilities of GAM90 include diagnosis, prevention and treatment of diseases and clinical conditions associated with MGC1203.

MGC3035 (Accession NM_024293.1) is another GAM90 target gene, herein designated TARGET GENE. MGC3035 BINDING SITE is a target binding site found in the 5' untranslated region of mRNA encoded by MGC3035, corresponding to a target binding site such as BINDING SITE I, BINDING SITE II or BINDING SITE III of FIG. 8. Table 4 illustrates the complementarity of the nucleotide sequences of MGC3035 BINDING SITE, designated SEQ ID:11606, to the nucleotide sequence of GAM90 RNA, herein designated GAM RNA, also designated SEQ ID:374.

Another function of GAM90 is therefore inhibition of MGC3035 (Accession NM_024293.1). Accordingly, utilities of GAM90 include diagnosis, prevention and treatment of diseases and clinical conditions associated with MGC3035.

MIR16 (Accession NM_016641.2) is another GAM90 target gene, herein designated TARGET GENE. MIR16 BINDING SITE is a target binding site found in the 3' untranslated region of mRNA encoded by MIR16, corresponding to a target binding site such as BINDING SITE I, BINDING SITE II or BINDING SITE III of FIG. 8. Table 4 illustrates the complementarity of the nucleotide sequences of MIR16 BINDING SITE, designated SEQ ID:3695, to the nucleotide sequence of GAM90 RNA, herein designated GAM RNA, also designated SEQ ID:374.

Another function of GAM90 is therefore inhibition of MIR16 (Accession NM_016641.2), a gene which is a membrane interacting protein. Accordingly, utilities of GAM90 include diagnosis, prevention and treatment of diseases and clinical conditions associated with MIR16.

The function of MIR16 and its association with various diseases and clinical conditions, has been established by previous studies, as described hereinabove with reference to GAM72.1. Nuclear factor (erythroid-derived 2)-like 1 (NFE2L1, Accession NM_003204.1) is another GAM90 target gene, herein designated TARGET GENE. NFE2L1 BINDING SITE is a target binding site found in the 5' untranslated region of mRNA encoded by NFE2L1, corresponding to a target binding site such as BINDING SITE I, BINDING SITE II or BINDING SITE III of FIG. 8. Table 4 illustrates the complementarity of the nucleotide sequences of NFE2L1 BINDING SITE, designated SEQ ID:19520, to the nucleotide sequence of GAM90 RNA, herein designated GAM RNA, also designated SEQ ID:374.

Another function of GAM90 is therefore inhibition of Nuclear factor (erythroid-derived 2)-like 1 (NFE2L1, Accession NM_003204.1), a gene which may regulate expression of ferritin genes. Accordingly, utilities of GAM90 include diagnosis, prevention and treatment of diseases and clinical conditions associated with NFE2L1.

The function of NFE2L1 has been established by previous studies. Chan et al. (1993) devised a complementation assay in yeast to clone mammalian transcription activators and used it to identify a distinct human bZIP transcription factor, NFE2L1, which they designated NRF1 (NFE2-related factor-1) because of its similarities to NFE2 (OMIM Ref. No. 601490). Chan et al. (1995) showed that the NFE2L1 gene encodes a 742-amino acid protein with a different molecular weight than either the p45 subunit (NFE2) or the Maf protein subunit (MafF, MafG (OMIM Ref. No. 602020), or MafK (OMIM Ref. No. 600197)) of nuclear factor erythroid-2. Chan et al. (1993) found that NFE2L1 activates transcription via NFE2-binding sites in yeast cells. The ubiquitous expression pattern of NFE2L1 and the range of promoters containing the NFE2-binding motif suggested that this gene may play a role in the regulation of heme synthesis and ferritin genes Animal model experiments lend further support to the function of NFE2L1. To determine the function of Nrf1, Chan et al. (1998) disrupted the mouse gene by homologous recombination. Heterozygous Nfr1 mutant mice developed normally, were fertile, and showed no obvious abnormalities. Mice homozygous for the Nrf1 mutation suffered from anemia as a result of abnormal fetal liver erythropoiesis and died in utero at mid-late gestation. The authors did not detect defects in globin gene expression. Abnormal red cell production appeared to result from a defect in the fetal liver microenvironment specific for erythroid cells. Chan et al. (1998) suggested that target genes regulated by Nrf1 play an essential role during fetal liver hematopoiesis.

It is appreciated that the abovementioned animal model for NFE2L1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chan, J. Y.; Kwong, M.; Lu, R.; Chang, J.; Wang, B.; Yen, T. S. B.; Kan, Y. W.: Targeted disruption of the ubiquitous CNC-bZIP transcription factor, Nrf-1, results in anemia and embryonic lethality in mice. EMBO J. 17:1779-1787, 1998; and Chan, J. Y.; Han, X.-L.; Kan, Y. W.: Cloning of Nrf1, an NF-E2-related transcription factor, by genetic selection in yeast. Proc. Nat. Acad. Sci. 90: 11371-11375, 1993.

Further studies establishing the function and utilities of NFE2L1 are found in John Hopkins OMIM database record ID 163260, and in cited publications listed in Table 5, which are hereby incorporated by reference. Neuroligin 1 (NLGN1, Accession NM_014932.1) is another GAM90 target gene, herein designated TARGET GENE. NLGN1 BINDING SITE is a target binding site found in the 5' untranslated region of mRNA encoded by NLGN1, corresponding to a target binding site such as BINDING SITE I, BINDING SITE II or BINDING SITE III of FIG. 8. Table 4 illustrates the complementarity of the nucleotide sequences of NLGN1 BINDING SITE, designated SEQ ID:8799, to the nucleotide sequence of GAM90 RNA, herein designated GAM RNA, also designated SEQ ID:374.

Another function of GAM90 is therefore inhibition of Neuroligin 1 (NLGN1, Accession NM_014932.1), a gene which may trigger the de novo formation of presynaptic structure. Accordingly, utilities of GAM90 include diagnosis, prevention and treatment of diseases and clinical conditions associated with NLGN1.

The function of NLGN1 has been established by previous studies. Neurexins (see OMIM Ref. No. NRXN1; 600565) are neuronal cell surface proteins first identified in rat brain with hundreds of isoforms generated by alternative splicing. Ichtchenko et al. (1995) described neuroligin I, a neuronal cell surface protein that is enriched in rat synaptic plasma membranes and acts as a splice site-specific ligand for beta-neurexins. (Each of 3 genes encoding neurexins-NRXN1, NRXN2, and NRXN3-has 2 independent promoters and generates 2 classes of mRNAs. The longer mRNAs encode alpha-neurexins and the shorter mRNAs beta-neurexins.) Neuroligin I binds to beta-neurexins only if they lack an insert in the alternatively spliced sequence of the G domain, and not if they contain an insert. The extracellular sequence of rat neuroligin I is composed of a catalytically inactive esterase domain homologous to acetylcholinesterase. Ichtchenko et al. (1995) used in situ hybridization to demonstrate that alternative splicing of neurexins at the binding site recognized by neuroligin I is highly regulated. These findings support a model whereby alternative splicing of neurexins creates a family of cell surface receptors that confer interactive specificity on their resident neurons. Using an in vitro system, Scheiffele et al. (2000) demonstrated that mouse neuroligin-1 and -2, postsynaptically localized proteins, can trigger the de novo formation of presynaptic structure. Nonneuronal cells engineered to express neuroligins induced morphologic and functional presynaptic differentiation in contacting axons. This activity could be inhibited by addition of a soluble version of beta-neurexin. Furthermore, addition of soluble beta-neurexin to a coculture of defined pre- and postsynaptic central nervous system (CNS) neurons inhibited synaptic vesicle clustering in axons contacting target neurons. These results suggested that neuroligins are part of the machinery employed during the formation and remodeling of CNS synapses.

Full details of the abovementioned studies are described in the following publications, the disclosure of which are hereby incorporated by reference:

Ichtchenko, K.; Hata, Y.; Nguyen, T.; Ullrich, B.; Missler, M.; Moomaw, C.; Sudhof, T. C.: Neuroligin 1: a splice site-specific ligand for beta-neurexins. Cell 81:435-443, 1995; and Scheiffele, P.; Fan, J.; Choih, J.; Fetter, R.; Serafini, T.: Neuroligin expressed in nonneuronal cells triggers presynaptic development in contacting axons. Cell 101:657-669, 2000.

Further studies establishing the function and utilities of NLGN1 are found in John Hopkins OMIM database record ID 600568, and in cited publications listed in Table 5, which are hereby incorporated by reference. Neurexin 2 (NRXN2, Accession NM_138732.1) is another GAM90 target gene, herein designated TARGET GENE. NRXN2 BINDING SITE is a target binding site found in the 3' untranslated region of multiple transcripts of mRNA encoded by NRXN2, corresponding to a target binding site such as BINDING SITE I, BINDING SITE II or BINDING SITE III of FIG. 8. Table 4 illustrates the complementarity of the nucleotide sequences of NRXN2 BINDING SITE, designated SEQ ID:10578, to the nucleotide sequence of GAM90 RNA, herein designated GAM RNA, also designated SEQ ID:374.

Another function of GAM90 is therefore inhibition of Neurexin 2 (NRXN2, Accession NM_138732.1), a gene which may be involved in cell recognition, cell adhesion, and may mediate intracellular signaling. Accordingly, utilities of GAM90 include diagnosis, prevention and treatment of diseases and clinical conditions associated with NRXN2.

The function of NRXN2 has been established by previous studies. Neurexins are polymorphic cell surface proteins that are expressed in neurons. Neurexin II is 1 of 3 rat neurexin genes identified by Ushkaryov et al. (1992). Each gene contains 2 promoters that direct synthesis of alpha- and beta-neurexins. By analysis of a 1.2-Mb region flanking the MEN1 (OMIM Ref. No. 131100) locus on 11q13, Bergman et al. (1999) identified MCG36, a human gene similar to rat neurexin II-alpha. By genomic sequence analysis, Tabuchi and Sudhof (2002) determined that the NRXN2 gene contains 23 exons, has very large introns, and spans 106 kb, making it a relatively small gene compared to NRXN1 (OMIM Ref. No. 600565) and NRXN3. Exon 1 is more than 2 kb and encodes the first LNS domain and the first EGF-like repeat of alpha-neurexins. Other exons are average in size, with the remaining LNS domains interrupted by at least 1 intron, whereas all EGF-like repeats are encoded in single exons. The last exon, also relatively large, encodes the transmembrane region and cytoplasmic tail. Tabuchi and Sudhof (2002) also described a number of neurexin splice sites.

Full details of the abovementioned studies are described in the following publications, the disclosure of which are hereby incorporated by reference:

Bergman, L.; Silins, G.; Grimmond, S.; Hummerich, H.; Stewart, C.; Little, P.; Hayward, N.: A 500-kb sequence-ready cosmid contig and transcript map of the MEN1 region on 11q13. Genomics 55:49-56, 1999; and Tabuchi, K.; Sudhof, T. C.: Structure and evolution of neurexin genes: insight into the mechanism of alternative splicing. Genomics 79:849-859, 2002.

Further studies establishing the function and utilities of NRXN2 are found in John Hopkins OMIM database record ID 600566, and in cited publications listed in Table 5, which are hereby incorporated by reference. Numb homolog (drosophila) (NUMB, Accession NM_003744.3) is another GAM90 target gene, herein designated TARGET GENE. NUMB BINDING SITE is a target binding site found in the 5' untranslated region of mRNA encoded by NUMB, corresponding to a target binding site such as BINDING SITE I, BINDING SITE II or BINDING SITE III of FIG. 8. Table 4 illustrates the complementarity of the nucleotide sequences of NUMB BINDING SITE, designated SEQ ID:13662, to the nucleotide sequence of GAM90 RNA, herein designated GAM RNA, also designated SEQ ID:374.

Another function of GAM90 is therefore inhibition of Numb homolog (drosophila) (NUMB, Accession NM_003744.3), a gene which may act in generating asymmetric cell division during neurogenesisand is strongly similar to murine Numb. Accordingly, utilities of GAM90 include diagnosis, prevention and treatment of diseases and clinical conditions associated with NUMB.

The function of NUMB has been established by previous studies. During Drosophila neurogenesis, differential partitioning of the 'Numb' (dNumb) gene product is necessary for daughter cells to adopt distinct fates. Numb is thought to act by causing a bias in the cell-cell interaction mediated by Notch (see OMIM Ref. No. JAG2; 602570). Zhong et al. (1996) isolated cDNAs encoding mouse Numb (mNumb). The N-terminal region of the deduced 593-amino acid mouse protein contains a predicted phosphotyrosine-binding domain and shares 63% identity with dNumb. The C-terminal half shows little similarity with dNumb and includes a proline-rich segment with potential SH3-binding sites. Immunofluorescence experiments revealed that mNumb is asymmetrically localized to the apical membrane of dividing ventricular neural progenitors during mouse cortical neurogenesis. However, unlike dNumb, there was no correlation between cleavage planes and mNumb localization at the apical cell membrane in anaphase ventricular cells. Zhong et al. (1996) expressed mNumb in Drosophila embryos and found that it localized asymmetrically in dividing neural precursors and rescued the Numb mutant phenotype. Yeast 2-hybrid assays and in vitro binding experiments demonstrated that mNumb can physically interact with the intracellular domain of mouse Notch1 (OMIM Ref. No. 190198). The authors concluded that shared molecular mechanisms generate asymmetric cell divisions during neurogenesis of vertebrates and invertebrates. Salcini et al. (1997) reported that both the NUMB and NUMB-like (NUMBL; 604018) proteins bind to the EH protein-protein interaction domain found in EPS15 (OMIM Ref. No. 600051) and other proteins. Coimmunoprecipitation studies demonstrated that NUMB and EPS15 are associated in vivo. This association appears to be mediated by an interaction between the EH domain of EPS15 and an asn-pro-phe (NPF) motif located near the C terminus of NUMB.

Full details of the abovementioned studies are described in the following publications, the disclosure of which are hereby incorporated by reference:

Salcini, A. E.; Confalonieri, S.; Doria, M.; Santolini, E.; Tassi, E.; Minenkova, O.; Cesareni, G.; Pelicci, P. G.; Di Fiore, P. P.: Binding specificity and in vivo targets of the EH domain, a novel protein-protein interaction module. Genes Dev. 11:2239-2249, 1997; and Zhong, W.; Feder, J. N.; Jiang, M.-M.; Jan, L. Y.; Jan, Y. N.: Asymmetric localization of a mammalian Numb homolog during mouse cortical neurogenesis. Neuron 17:43-53, 1996.

Further studies establishing the function and utilities of NUMB are found in John Hopkins OMIM database record ID 603728, and in cited publications listed in Table 5, which are hereby incorporated by reference. Parvin, alpha (PARVA, Accession NM_018222.2) is another GAM90 target gene, herein designated TARGET GENE. PARVA BINDING SITE is a target binding site found in the 3' untranslated region of mRNA encoded by PARVA, corresponding to a target binding site such as BINDING SITE I, BINDING SITE II or BINDING SITE III of FIG. 8. Table 4 illustrates the complementarity of the nucleotide sequences of PARVA BINDING SITE, designated SEQ ID:14808, to the nucleotide sequence of GAM90 RNA, herein designated GAM RNA, also designated SEQ ID:374.

Another function of GAM90 is therefore inhibition of Parvin, alpha (PARVA, Accession NM_018222.2). Accordingly, utilities of GAM90 include diagnosis, prevention and treatment of diseases and clinical conditions associated with PARVA.

PRO1496 (Accession NM_018603.1) is another GAM90 target gene, herein designated TARGET GENE. PRO1496 BINDING SITE is a target binding site found in the 3' untranslated region of mRNA encoded by PRO1496, corresponding to a target binding site such as BINDING SITE I, BINDING SITE II or BINDING SITE III of FIG. 8. Table 4 illustrates the complementarity of the nucleotide sequences of PRO1496 BINDING SITE, designated SEQ ID:1444, to the nucleotide sequence of GAM90 RNA, herein designated GAM RNA, also designated SEQ ID:374.

Another function of GAM90 is therefore inhibition of PRO1496 (Accession NM_018603.1). Accordingly, utilities of GAM90 include diagnosis, prevention and treatment of diseases and clinical conditions associated with PRO1496.

Protein tyrosine phosphatase, receptor type, t (PTPRT, Accession NM_007050.3) is another GAM90 target gene, herein designated TARGET GENE. PTPRT BINDING SITE is a target binding site found in the 3' untranslated region of multiple transcripts of mRNA encoded by PTPRT, corresponding to a target binding site such as BINDING SITE I, BINDING SITE II or BINDING SITE III of FIG. 8. Table 4 illustrates the complementarity of the nucleotide sequences of PTPRT BINDING SITE, designated SEQ ID:2885, to the nucleotide sequence of GAM90 RNA, herein designated GAM RNA, also designated SEQ ID:374.

Another function of GAM90 is therefore inhibition of Protein tyrosine phosphatase, receptor type, t (PTPRT, Accession NM_007050.3). Accordingly, utilities of GAM90 include diagnosis, prevention and treatment of diseases and clinical conditions associated with PTPRT.

V-rel reticuloendotheliosis viral oncogene homolog b, nuclear factor of kappa light polypeptide gene enhancer in b-cells 3 (avian) (RELB, Accession NM_006509.1) is another GAM90 target gene, herein designated TARGET GENE. RELB BINDING SITE is a target binding site found in the 3' untranslated region of mRNA encoded by RELB, corresponding to a target binding site such as BINDING SITE I, BINDING SITE II or BINDING SITE III of FIG. 8. Table 4 illustrates the complementarity of the nucleotide sequences of RELB BINDING SITE, designated SEQ ID:9956, to the nucleotide sequence of GAM90 RNA, herein designated GAM RNA, also designated SEQ ID:374.

Another function of GAM90 is therefore inhibition of V-rel reticuloendotheliosis viral oncogene homolog b, nuclear factor of kappa light polypeptide gene enhancer in b-cells 3 (avian) (RELB, Accession NM_006509.1). Accordingly, utilities of GAM90 include diagnosis, prevention and treatment of diseases and clinical conditions associated with RELB.

Rho-associated, coiled-coil containing protein kinase 2 (ROCK2, Accession NM_004850.2) is another GAM90 target gene, herein designated TARGET GENE. ROCK2 BINDING SITE is a target binding site found in the 3' untranslated region of mRNA encoded by ROCK2, corresponding to a target binding site such as BINDING SITE I, BINDING SITE II or BINDING SITE III of FIG. 8. Table 4 illustrates the complementarity of the nucleotide sequences of ROCK2

BINDING SITE, designated SEQ ID:4807, to the nucleotide sequence of GAM90 RNA, herein designated GAM RNA, also designated SEQ ID:374.

Another function of GAM90 is therefore inhibition of Rho-associated, coiled-coil containing protein kinase 2 (ROCK2, Accession NM_004850.2), a gene which regulates cytokinesis, smooth muscle contraction, the formation of actin stress fibers and focal adhesions. Accordingly, utilities of GAM90 include diagnosis, prevention and treatment of diseases and clinical conditions associated with ROCK2.

The function of ROCK2 has been established by previous studies. ROCK2 is a serine/threonine kinase that regulates cytokinesis, smooth muscle contraction, the formation of actin stress fibers and focal adhesions, and the activation of the c-fos (OMIM Ref. No. 164810) serum response element. ROCK2, which is an isozyme of ROCK1 (OMIM Ref. No. 601702), is a target for the small GTPase Rho (e.g., 165390). Nakamura et al. (2001) studied the role of Rho in the migration of corneal epithelial cells in rabbit. They detected both ROCK1 (OMIM Ref. No. 601702) and ROCK2 in the corneal epithelium at protein and mRNA levels. They found that exoenzyme C3, a Rho inhibitor, inhibits corneal epithelial migration in a dose-dependent manner and prevents the stimulatory effect of the Rho activator lysophosphatidic acid (LPA). Both cytochalasin B, an inhibitor of actin filament assembly, and ML7, an inhibitor of myosin light chain kinase, also prevent LPA stimulation of epithelial migration. The authors suggested that Rho mediates corneal epithelial migration in response to external stimuli by regulating the organization of the actin cytoskeleton. Rao et al. (2001) investigated the role of Rho kinase in the modulation of aqueous humor outflow facility. The treatment of human trabecular meshwork and canal of Schlemm cells with a Rho kinase-specific inhibitor led to significant but reversible changes in cell shape and decreased actin stress fibers, focal adhesions, and protein phosphotyrosine staining. Based on the Rho kinase inhibitor-induced changes in myosin light chain phosphorylation and actomyosin organization, the authors suggested that cellular relaxation and loss of cell-substratum adhesions in the human trabecular meshwork and canal of Schlemm cells could result in either increased paracellular fluid flow across the canal of Schlemm or altered flow pathway through the juxtacanalicular tissue, thereby lowering resistance to outflow. They suggested Rho kinase as a potential target for the development of drugs to modulate intraocular pressure in glaucoma patients.

Full details of the abovementioned studies are described in the following publications, the disclosure of which are hereby incorporated by reference:

Nakamura, M.; Nagano, T.; Chikama, T.; Nishida, T.: Role of the small GTP-binding protein Rho in epithelial cell migration in the rabbit cornea. Invest. Ophthal. Vis. Sci. 42:941-947, 2001; and Rao, P. V.; Deng, P.-F.; Kumar, J.; Epstein, D. L.: Modulation of aqueous humor outflow facility by the Rho kinase-specific inhibitor Y-27632. Invest. Ophthal. Vis. Sci. 42:1029-1037.

Further studies establishing the function and utilities of ROCK2 are found in John Hopkins OMIM database record ID 604002, and in cited publications listed in Table 5, which are hereby incorporated by reference. Wingless-type mmtv integration site family, member 10b (WNT10B, Accession NM_003394.2) is another GAM90 target gene, herein designated TARGET GENE. WNT10B BINDING SITE is a target binding site found in the 3' untranslated region of mRNA encoded by WNT10B, corresponding to a target binding site such as BINDING SITE I, BINDING SITE II or BINDING SITE III of FIG. 8. Table 4 illustrates the complementarity of the nucleotide sequences of WNT10B BINDING SITE, designated SEQ ID:5168, to the nucleotide sequence of GAM90 RNA, herein designated GAM RNA, also designated SEQ ID:374.

Another function of GAM90 is therefore inhibition of Wingless-type mmtv integration site family, member 10b (WNT10B, Accession NM_003394.2), a gene which is a ligand for members of the frizzled family of seven transmembrane receptors and may be a signaling molecule. Accordingly, utilities of GAM90 include diagnosis, prevention and treatment of diseases and clinical conditions associated with WNT10B.

The function of WNT10B has been established by previous studies. Several members of the Wnt gene family have been shown to cause mammary tumors in mice. Using degenerate primer PCR on human genomic DNA and specific PCR of cDNA libraries, Bui et al. (1997) isolated a Wnt gene that had not previously been described in human. It is the human homolog of mouse Wnt10b, which had been shown to be one of the oncogenes cooperating with FGF3 (OMIM Ref. No. 164950) in the development of mouse mammary tumor virus (MMTV)-induced mammary carcinomas in mice. The human WNT10B sequence is 88 and 95% identical to the murine gene at nucleotide and amino acid levels, respectively. By YAC and fluorescence in situ hybridization (FISH) mapping, Bui et al. (1997) localized the gene to 12q13, a chromosomal region frequently rearranged in human tumors and also containing the WNT1 gene (OMIM Ref. No. 164820). WNT10B expression was not observed in normal and benign proliferations of human breast tissue but was found to be elevated in 3 of 50 primary breast carcinomas. Southern blot analysis of the carcinoma expressing the highest level of WNT10B showed no amplification or rearrangement of the gene. Hardiman et al. (1997) demonstrated that the WNT10B gene encodes a 389-amino acid protein with 96.6% sequence identity to mouse Wnt10b. The expression pattern showed that it is synthesized in many adult tissues with the highest levels found in heart and skeletal muscle. Ross et al. (2000) showed that WNT signaling, likely mediated by WNT10B, is a molecular switch that governs adipogenesis. WNT signaling maintains preadipocytes in an undifferentiated state through inhibition of the adipogenic transcription factors CEBPA (OMIM Ref. No. 116897) and PPAR-gamma (OMIM Ref. No. 601487). When WNT signaling in preadipocytes is prevented by overexpression of axin (OMIM Ref. No. 603816) or dominant-negative TCF4 (OMIM Ref. No. 602272), these cells differentiate into adipocytes. Disruption of WNT signaling also causes transdifferentiation of myoblasts into adipocytes in vitro, highlighting the importance of this pathway not only in adipocyte differentiation but also in mesodermal cell fate determination. By PCR typing of a human/rodent monochromosomal panel and FISH, Hardiman et al. (1997) mapped the WNT10B gene to chromosome 12q13.1. By analyzing human genome draft sequence, Kirikoshi et al. (2001) determined that WNT10B is encoded by 5 exons and is clustered with WNT1 (OMIM Ref. No. 164820) in a head- to - head manner with an interval of less than 7 kb. They hypothesized that the WNT1-WNT10B gene cluster and the WNT6 (OMIM Ref. No. 604663)-WNT10A (OMIM Ref. No. 606268) gene cluster on chromosome 2 might be due to duplication of an ancestral WNT gene cluster.

Full details of the abovementioned publications are described in the following publications, the disclosure of which are hereby incorporated by reference:

Kirikoshi, H.; Sekihara, H.; Katoh, M.: WNT10A and WNT6, clustered in human chromosome 2q35 region with head- to - tail manner, are strongly coexpressed in SW480 cells. Biochem. Biophys. Res. Commun. 283:798-805, 2001; and Ross, S. E.; Hemati, N.; Longo, K. A.; Bennett, C. N.; Lucas, P. C.; Erickson, R. L.; MacDougald, O. A.: Inhibition of adipogenesis by Wnt signaling. Science 289:950-953, 2000.

Further studies establishing the function and utilities of WNT10B are found in John Hopkins OMIM database record ID 601906, and in cited publications listed in Table 5, which are hereby incorporated by reference.

FIG. 8 further provides a conceptual description of a novel bioinformatically detected of the present invention, referred to here as Genomic Address Messenger 91 (GAM91), which modulates expression of respective target genes thereof, the function and utility of which target genes is known in the art.

GAM91 is a novel bioinformatically detected regulatory, non protein coding, micro RNA (miRNA) gene. The method by which GAM91 was detected is described hereinabove with reference to FIGS. 8-15.

GAM91 gene, herein designated GAM GENE, and GAM91 target gene, herein designated TARGET GENE, are human genes contained in the human genome.

GAM91 gene encodes a GAM91 precursor RNA, herein designated GAM PRECURSOR RNA. Similar to other miRNA genes, and unlike most ordinary genes, GAM91 precursor RNA does not encode a protein. A nucleotide sequence identical or highly similar to the nucleotide sequence of GAM91 precursor RNA is designated SEQ ID:130, and is provided hereinbelow with reference to the sequence listing part. Nucleotide sequence SEQ ID:130 is located at position 50784242 relative to chromosome 1.

GAM91 precursor RNA folds onto itself, forming GAM91 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM91 precursor RNA folds onto itself, forming GAM91 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM91 precursor RNA, designated SEQ-ID:130, and a schematic representation of a predicted secondary folding of GAM91 folded precursor RNA are further described with reference to Table 2, hereby incorporated by reference.

An enzyme complex designated DICER COMPLEX, 'dices' the GAM91 folded precursor RNA into GAM91 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM91 RNA is designated SEQ ID:336, and is provided hereinbelow with references to the sequence listing part and Table 3, hereby incorporated by reference.

GAM91 target gene, herein designated TARGET GENE, encodes a corresponding messenger RNA, GAM91 target RNA, herein designated GAM TARGET RNA. GAM91 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM91 RNA, herein designated GAM RNA, binds complementarily to one or more target binding sites located in untranslated regions of GAM91 target RNA, herein designated GAM TARGET RNA. This complementary binding is due to the fact that the nucleotide sequence of GAM91 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM91 RNA may have a different number of target binding sites in untranslated regions of a GAM91 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM91 RNA, herein designated GAM RNA, to target binding sites on GAM91 target RNA, herein designated GAM TARGET RNA, such as BINDING SITE I, BINDING SITE II and BINDING SITE III, inhibits translation of GAM91 target RNA into GAM91 target protein, herein designated GAM TARGET PROTEIN. GAM target protein is therefore outlined by a broken line.

It is appreciated that GAM91 target gene, herein designated TARGET GENE, in fact represents a plurality of GAM91 target genes. The mRNA of each one of this plurality of GAM91 target genes comprises one or more target binding sites, each having a nucleotide sequence which is at least partly complementary to GAM91 RNA, herein designated GAM RNA, and which when bound by GAM91 RNA causes inhibition of translation of respective one or more GAM91 target proteins.

It is further appreciated by one skilled in the art that the mode of translational inhibition illustrated by FIG. 8 with specific reference to translational inhibition exerted by GAM91 gene, herein designated GAM GENE, on one or more GAM91 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM91 correlate with, and may be deduced from, the identity of the target genes which GAM91 binds and inhibits, and the function of these target genes, as elaborated hereinbelow.

Aquaporin 6, kidney specific (AQP6, Accession NM_053286.1) is a GAM91 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:14082, to the nucleotide sequence of GAM91 RNA, herein designated GAM RNA, also designated SEQ ID:336.

A function of GAM91 is therefore inhibition of Aquaporin 6, kidney specific (AQP6, Accession NM_053286.1), a gene which participates in distinct physiologic function such as glomerular filtration, tubular endocytosis, and acid-base-metabolism. Accordingly, utilities of GAM91 include diagnosis, prevention and treatment of diseases and clinical conditions associated with AQP6.

The function of AQP6 and its association with various diseases and clinical conditions, has been established by previous studies, as described hereinabove with reference to GAM51.1. Chromosome 20 open reading frame 70 (C20orf70, Accession XM_114180.1) is another GAM91 target gene, herein designated TARGET GENE. C20orf70 BINDING SITE is a target binding site found in the 3' untranslated region of mRNA encoded by C20orf70, corresponding to a target binding site such as BINDING SITE I, BINDING SITE II or BINDING SITE III of FIG. 8. Table 4 illustrates the complementarity of the nucleotide sequences of C20orf70 BINDING SITE, designated SEQ ID:17422, to the nucleotide sequence of GAM91 RNA, herein designated GAM RNA, also designated SEQ ID:336.

Another function of GAM91 is therefore inhibition of Chromosome 20 open reading frame 70 (C20orf70, Accession XM_114180.1). Accordingly, utilities of GAM91 include diagnosis, prevention and treatment of diseases and clinical conditions associated with C20orf70.

Fas (tnfrsf6) associated factor 1 (FAF1, Accession NM_131917.1) is another GAM91 target gene, herein designated TARGET GENE. FAF1 BINDING SITE is a target binding site found in the 5' untranslated region of multiple transcripts of mRNA encoded by FAF1, corresponding to a target binding site such as BINDING SITE I, BINDING SITE II or BINDING SITE III of FIG. 8. Table 4 illustrates the complementarity of the nucleotide sequences of FAF1 BINDING SITE, designated SEQ ID:899, to the nucleotide sequence of GAM91 RNA, herein designated GAM RNA, also designated SEQ ID:336.

Another function of GAM91 is therefore inhibition of Fas (tnfrsf6) associated factor 1 (FAF1, Accession NM_131917.1). Accordingly, utilities of GAM91 include diagnosis, prevention and treatment of diseases and clinical conditions associated with FAF1.

FLJ20207 (Accession NM_017711.2) is another GAM91 target gene, herein designated TARGET GENE. FLJ20207 BINDING SITE is a target binding site found in the 5' untranslated region of mRNA encoded by FLJ20207, corresponding to a target binding site such as BINDING SITE I, BINDING SITE II or BINDING SITE III of FIG. 8. Table 4 illustrates the complementarity of the nucleotide sequences of FLJ20207 BINDING SITE, designated SEQ ID:3833, to the nucleotide sequence of GAM91 RNA, herein designated GAM RNA, also designated SEQ ID:336.

Another function of GAM91 is therefore inhibition of FLJ20207 (Accession NM_017711.2). Accordingly, utilities of GAM91 include diagnosis, prevention and treatment of diseases and clinical conditions associated with FLJ20207.

FLJ22408 (Accession NM_024794.1) is another GAM91 target gene, herein designated TARGET GENE. FLJ22408 BINDING SITE is a target binding site found in the 3' untranslated region of mRNA encoded by FLJ22408, corresponding to a target binding site such as BINDING SITE I, BINDING SITE II or BINDING SITE III of FIG. 8. Table 4 illustrates the complementarity of the nucleotide sequences of FLJ22408 BINDING SITE, designated SEQ ID:18346, to the nucleotide sequence of GAM91 RNA, herein designated GAM RNA, also designated SEQ ID:336.

Another function of GAM91 is therefore inhibition of FLJ22408 (Accession NM_024794.1). Accordingly, utilities of GAM91 include diagnosis, prevention and treatment of diseases and clinical conditions associated with FLJ22408.

Hippocalcin-like 1 (HPCAL1, Accession NM_002149.2) is another GAM91 target gene, herein designated TARGET GENE. HPCAL1 BINDING SITE is a target binding site found in the 3' untranslated region of multiple transcripts of mRNA encoded by HPCAL1, corresponding to a target binding site such as BINDING SITE I, BINDING SITE II or BINDING SITE III of FIG. 8. Table 4 illustrates the complementarity of the nucleotide sequences of HPCAL1 BINDING SITE, designated SEQ ID:4354, to the nucleotide sequence of GAM91 RNA, herein designated GAM RNA, also designated SEQ ID:336.

Another function of GAM91 is therefore inhibition of Hippocalcin-like 1 (HPCAL1, Accession NM_002149.2). Accordingly, utilities of GAM91 include diagnosis, prevention and treatment of diseases and clinical conditions associated with HPCAL1.

Lim domains containing 1 (LIMD1, Accession NM_014240.1) is another GAM91 target gene, herein designated TARGET GENE. LIMD1 BINDING SITE is a target binding site found in the 3' untranslated region of mRNA encoded by LIMD1, corresponding to a target binding site such as BINDING SITE I, BINDING SITE II or BINDING SITE III of FIG. 8. Table 4 illustrates the complementarity of the nucleotide sequences of LIMD1 BINDING SITE, designated SEQ ID:19473, to the nucleotide sequence of GAM91 RNA, herein designated GAM RNA, also designated SEQ ID:336.

Another function of GAM91 is therefore inhibition of Lim domains containing 1 (LIMD1, Accession NM_014240.1). Accordingly, utilities of GAM91 include diagnosis, prevention and treatment of diseases and clinical conditions associated with LIMD1.

FIG. 8 further provides a conceptual description of a novel bioinformatically detected of the present invention, referred to here as Genomic Address Messenger 92 (GAM92), which modulates expression of respective target genes thereof, the function and utility of which target genes is known in the art.

GAM92 is a novel bioinformatically detected regulatory, non protein coding, micro RNA (miRNA) gene. The method by which GAM92 was detected is described hereinabove with reference to FIGS. 8-15.

GAM92 gene, herein designated GAM GENE, and GAM92 target gene, herein designated TARGET GENE, are human genes contained in the human genome.

GAM92 gene encodes a GAM92 precursor RNA, herein designated GAM PRECURSOR RNA. Similar to other miRNA genes, and unlike most ordinary genes, GAM92 precursor RNA does not encode a protein. A nucleotide sequence identical or highly similar to the nucleotide sequence of GAM92 precursor RNA is designated SEQ ID:60, and is provided hereinbelow with reference to the sequence listing part.

GAM92 precursor RNA folds onto itself, forming GAM92 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM92 precursor RNA folds onto itself, forming GAM92 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM92 precursor RNA, designated SEQ-ID:60, and a schematic representation of a predicted secondary folding of GAM92 folded precursor RNA are further described with reference to Table 2, hereby incorporated by reference.

An enzyme complex designated DICER COMPLEX, 'dices' the GAM92 folded precursor RNA into GAM92 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM92 RNA is designated SEQ ID:308, and is provided hereinbelow with references to the sequence listing part and Table 3, hereby incorporated by reference.

GAM92 target gene, herein designated TARGET GENE, encodes a corresponding messenger RNA, GAM92 target RNA, herein designated GAM TARGET RNA. GAM92 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM92 RNA, herein designated GAM RNA, binds complementarily to one or more target binding sites located in untranslated regions of GAM92 target RNA, herein designated GAM TARGET RNA. This complementary binding is due to the fact that the nucleotide sequence of GAM92 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM92 RNA may have a different number of target binding sites in untranslated regions of a GAM92 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM92 RNA, herein designated GAM RNA, to target binding sites on GAM92 target RNA, herein designated GAM TARGET RNA, such as BINDING SITE I, BINDING SITE II and BINDING SITE III, inhibits translation of GAM92 target RNA into GAM92 target protein, herein designated GAM TARGET PROTEIN. GAM target protein is therefore outlined by a broken line.

It is appreciated that GAM92 target gene, herein designated TARGET GENE, in fact represents a plurality of GAM92 target genes. The mRNA of each one of this plurality of GAM92 target genes comprises one or more target binding sites, each having a nucleotide sequence which is at least partly complementary to GAM92 RNA, herein designated GAM RNA, and which when bound by GAM92 RNA causes inhibition of translation of respective one or more GAM92 target proteins.

It is further appreciated by one skilled in the art that the mode of translational inhibition illustrated by FIG. 8 with specific reference to translational inhibition exerted by GAM92 gene, herein designated GAM GENE, on one or more GAM92 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM92 correlate with, and may be deduced from, the identity of the target genes which GAM92 binds and inhibits, and the function of these target genes, as elaborated hereinbelow.

LOC158156 (Accession) is a GAM92 target gene, herein designated TARGET GENE. LOC158156 BINDING SITE is a target binding site found in the 3' untranslated region of mRNA encoded by LOC158156, corresponding to a target binding site such as BINDING SITE I, BINDING SITE II or BINDING SITE III of FIG. 8. Table 4 illustrates the complementarity of the nucleotide sequences of LOC158156 BINDING SITE, designated SEQ ID:16734, to the nucleotide sequence of GAM92 RNA, herein designated GAM RNA, also designated SEQ ID:308.

A function of GAM92 is therefore inhibition of LOC158156 (Accession). Accordingly, utilities of GAM92 include diagnosis, prevention and treatment of diseases and clinical conditions associated with LOC158156.

FIG. 8 further provides a conceptual description of a novel bioinformatically detected of the present invention, referred to here as Genomic Address Messenger 93 (GAM93), which modulates expression of respective target genes thereof, the function and utility of which target genes is known in the art.

GAM93 is a novel bioinformatically detected regulatory, non protein coding, micro RNA (miRNA) gene. The method by which GAM93 was detected is described hereinabove with reference to FIGS. 8-15.

GAM93 gene, herein designated GAM GENE, and GAM93 target gene, herein designated TARGET GENE, are human genes contained in the human genome.

GAM93 gene encodes a GAM93 precursor RNA, herein designated GAM PRECURSOR RNA. Similar to other miRNA genes, and unlike most ordinary genes, GAM93 precursor RNA does not encode a protein. A nucleotide sequence identical or highly similar to the nucleotide sequence of GAM93 precursor RNA is designated SEQ ID:14, and is provided hereinbelow with reference to the sequence listing part. Nucleotide sequence SEQ ID:14 is located at position 32921767 relative to chromosome 21.

GAM93 precursor RNA folds onto itself, forming GAM93 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM93 precursor RNA folds onto itself, forming GAM93 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM93 precursor RNA, designated SEQ-ID:14, and a schematic representation of a predicted secondary folding of GAM93 folded precursor RNA are further described with reference to Table 2, hereby incorporated by reference.

An enzyme complex designated DICER COMPLEX, 'dices' the GAM93 folded precursor RNA into GAM93 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM93 RNA is designated SEQ ID:397, and is provided hereinbelow with references to the sequence listing part and Table 3, hereby incorporated by reference.

GAM93 target gene, herein designated TARGET GENE, encodes a corresponding messenger RNA, GAM93 target RNA, herein designated GAM TARGET RNA. GAM93 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM93 RNA, herein designated GAM RNA, binds complementarily to one or more target binding sites located in untranslated regions of GAM93 target RNA, herein designated GAM TARGET RNA. This complementary binding is due to the fact that the nucleotide sequence of GAM93 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM93 RNA may have a different number of target binding sites in untranslated regions of a GAM93 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM93 RNA, herein designated GAM RNA, to target binding sites on GAM93 target RNA, herein designated GAM TARGET RNA, such as BINDING SITE I, BINDING SITE II and BINDING SITE III, inhibits translation of GAM93 target RNA into GAM93 target protein, herein designated GAM TARGET PROTEIN. GAM target protein is therefore outlined by a broken line.

It is appreciated that GAM93 target gene, herein designated TARGET GENE, in fact represents a plurality of GAM93 target genes. The mRNA of each one of this plurality of GAM93 target genes comprises one or more target binding sites, each having a nucleotide sequence which is at least partly complementary to GAM93 RNA, herein designated GAM RNA, and which when bound by GAM93 RNA causes inhibition of translation of respective one or more GAM93 target proteins.

It is further appreciated by one skilled in the art that the mode of translational inhibition illustrated by FIG. 8 with specific reference to translational inhibition exerted by GAM93 gene, herein designated GAM GENE, on one or more GAM93 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM93 correlate with, and may be deduced from, the identity of the target genes which GAM93 binds and inhibits, and the function of these target genes, as elaborated hereinbelow.

FLJ32334 (Accession NM_144565.1) is a GAM93 target gene, herein designated TARGET GENE. FLJ32334 BINDING SITE is a target binding site found in the 3' untranslated region of mRNA encoded by FLJ32334, corresponding to a target binding site such as BINDING SITE I, BINDING SITE II or BINDING SITE III of FIG. 8. Table 4 illustrates the complementarity of the nucleotide sequences of FLJ32334 BINDING SITE, designated SEQ ID:19780, to the nucleotide sequence of GAM93 RNA, herein designated GAM RNA, also designated SEQ ID:397.

A function of GAM93 is therefore inhibition of FLJ32334 (Accession NM_144565.1). Accordingly, utilities of GAM93 include diagnosis, prevention and treatment of diseases and clinical conditions associated with FLJ32334.

Plakophilin 2 (PKP2, Accession NM_004572.1) is another GAM93 target gene, herein designated TARGET GENE. PKP2 BINDING SITE is a target binding site found in the 3' untranslated region of mRNA encoded by PKP2, corresponding to a target binding site such as BINDING SITE I, BINDING SITE II or BINDING SITE III of FIG. 8. Table 4 illustrates the complementarity of the nucleotide sequences of PKP2 BINDING SITE, designated SEQ ID:7334, to the nucleotide sequence of GAM93 RNA, herein designated GAM RNA, also designated SEQ ID:397.

Another function of GAM93 is therefore inhibition of Plakophilin 2 (PKP2, Accession NM_004572.1), a gene which may play a role in junctional plaques. Accordingly, utilities of GAM93 include diagnosis, prevention and treatment of diseases and clinical conditions associated with PKP2.

The function of PKP2 has been established by previous studies. Plakophilins are armadillo repeat-containing proteins that are localized in the desmosomal plaque and cell nucleus. Desmosomal plakophilins, like plakophilin 2, form part of the link between the cytoplasmic tail of cadherins and the intermediate filament cytoskeleton (Bonne et al., 2000). Mertens et al. (1996) isolated cDNAs encoding 2 forms of plakophilin-2 (PKP2), which they named PKP2a and PKP2b, from human colon carcinoma and heart cDNA libraries. The predicted 837-amino acid PKP2a protein contains 9 complete copies of the armadillo motif, which is an approximately 42-amino acid domain first defined in the Drosophila 'armadillo' gene product. Compared with PKP2a, the predicted 881-amino acid PKP2b protein contains an insertion of 44 amino acids between the second and third armadillo motifs. The authors suggested that PKP2a and PKP2b are derived from alternatively spliced PKP2 transcripts. The PKP2 and PKP1 (OMIM Ref. No. 601975) proteins are 42% identical in the armadillo repeats. Immunoblot analysis of a wide range of human cell lines and tissues using antibodies against PKP2 detected an approximately 100-kD protein, which sometimes appeared as a twin band. Immunolocalization studies showed that PKP2 is a constituent of the desmosomal plaque in simple epithelia, some stratified epithelia, and some nonepithelial cells. PKP2 is also enriched in the karyoplasm of cells of various types, including those lacking desmosomes. Northern blot analysis detected approximately 5.3-kb PKP2 transcripts in diverse human cell lines and tissues representing both epithelial and nonepithelial cells. By fluorescence in situ hybridization and analysis of a somatic cell hybrid mapping panel, Bonne et al. (1998) mapped the PKP2 gene to 12p13. Schmidt et al. (1999) used FISH to map the PKP2 gene to 12p11. Further analysis by Bonne et al. (2000) of a human 12p13-specific PAC clone showed that 12p13 was the location of a processed plakophilin-2 pseudogene, PKP2P1. By fluorescence in situ hybridization, Bonne et al. (2000) confirmed the localization of PKP2 to 12p11.

Full details of the abovementioned studies are described in the following publications, the disclosure of which are hereby incorporated by reference:

Bonne, S.; van Hengel, J; van Roy, F.: Assignment of the plakophilin-2 gene (PKP2) and a plakophilin-2 pseudogene (PKP2P1) to human chromosome bands 12p11 and 12p13, respectively, by in situ hybridization. Cytogenet. Cell Genet. 88:286-287, 2000; and Bonne, S.; van Hengel, J.; van Roy, F.: Chromosomal mapping of human armadillo genes belonging to the p120(ctn)/plakophilin subfamily. Genomics 51:452-454, 1998.

Further studies establishing the function and utilities of PKP2 are found in John Hopkins OMIM database record ID 602861, and in cited publications listed in Table 5, which are hereby incorporated by reference. Proline rich 1 (PROL1, Accession NM_021225.1) is another GAM93 target gene, herein designated TARGET GENE. PROL1 BINDING SITE is a target binding site found in the 3' untranslated region of mRNA encoded by PROL1, corresponding to a target binding site such as BINDING SITE I, BINDING SITE II or BINDING SITE III of FIG. 8. Table 4 illustrates the complementarity of the nucleotide sequences of PROL1 BINDING SITE, designated SEQ ID:11105, to the nucleotide sequence of GAM93 RNA, herein designated GAM RNA, also designated SEQ ID:397.

Another function of GAM93 is therefore inhibition of Proline rich 1 (PROL1, Accession NM_021225.1). Accordingly, utilities of GAM93 include diagnosis, prevention and treatment of diseases and clinical conditions associated with PROL1.

FIG. 8 further provides a conceptual description of a novel bioinformatically detected of the present invention, referred to here as Genomic Address Messenger 94 (GAM94), which modulates expression of respective target genes thereof, the function and utility of which target genes is known in the art.

GAM94 is a novel bioinformatically detected regulatory, non protein coding, micro RNA (miRNA) gene. The method by which GAM94 was detected is described hereinabove with reference to FIGS. 8-15.

GAM94 gene, herein designated GAM GENE, and GAM94 target gene, herein designated TARGET GENE, are human genes contained in the human genome.

GAM94 gene encodes a GAM94 precursor RNA, herein designated GAM PRECURSOR RNA. Similar to other miRNA genes, and unlike most ordinary genes, GAM94 precursor RNA does not encode a protein. A nucleotide sequence identical or highly similar to the nucleotide sequence of GAM94 precursor RNA is designated SEQ ID:2, and is provided hereinbelow with reference to the sequence listing part.

GAM94 precursor RNA folds onto itself, forming GAM94 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM94 precursor RNA folds onto itself, forming GAM94 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM94 precursor RNA, designated SEQ-ID:2, and a schematic representation of a predicted secondary folding of GAM94 folded precursor RNA are further described with reference to Table 2, hereby incorporated by reference.

An enzyme complex designated DICER COMPLEX, 'dices' the GAM94 folded precursor RNA into GAM94 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM94 RNA is designated SEQ ID:332, and is provided hereinbelow with references to the sequence listing part and Table 3, hereby incorporated by reference.

GAM94 target gene, herein designated TARGET GENE, encodes a corresponding messenger RNA, GAM94 target RNA, herein designated GAM TARGET RNA. GAM94 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM94 RNA, herein designated GAM RNA, binds complementarily to one or more target binding sites located in untranslated regions of GAM94 target RNA, herein designated GAM TARGET RNA. This complementary binding is due to the fact that the nucleotide sequence of GAM94 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM94 RNA may have a different number of target binding sites in untranslated regions of a GAM94 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM94 RNA, herein designated GAM RNA, to target binding sites on GAM94 target RNA, herein designated GAM TARGET RNA, such as BINDING SITE I, BINDING SITE II and BINDING SITE III, inhibits translation of GAM94 target RNA into GAM94 target protein, herein designated GAM TARGET PROTEIN. GAM target protein is therefore outlined by a broken line.

It is appreciated that GAM94 target gene, herein designated TARGET GENE, in fact represents a plurality of GAM94 target genes. The mRNA of each one of this plurality of GAM94 target genes comprises one or more target binding sites, each having a nucleotide sequence which is at least partly complementary to GAM94 RNA, herein designated GAM RNA, and which when bound by GAM94 RNA causes inhibition of translation of respective one or more GAM94 target proteins.

It is further appreciated by one skilled in the art that the mode of translational inhibition illustrated by FIG. 8 with specific reference to translational inhibition exerted by GAM94 gene, herein designated GAM GENE, on one or more GAM94 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM94 correlate with, and may be deduced from, the identity of the target genes which GAM94 binds and inhibits, and the function of these target genes, as elaborated hereinbelow.

Atp-binding cassette, sub-family a (abc1), member 1 (ABCA1, Accession NP_005493.2) is a GAM94 target gene, herein designated TARGET GENE. ABCA1 BINDING SITE is a target binding site found in the 5' untranslated region of mRNA encoded by ABCA1, corresponding to a target binding site such as BINDING SITE I, BINDING SITE II or BINDING SITE III of FIG. 8. Table 4 illustrates the complementarity of the nucleotide sequences of ABCA1 BINDING SITE, designated SEQ ID:8991, to the nucleotide sequence of GAM94 RNA, herein designated GAM RNA, also designated SEQ ID:332.

A function of GAM94 is therefore inhibition of Atp-binding cassette, sub-family a (abc1), member 1 (ABCA1, Accession NP_005493.2), a gene which camp-dependent and sulfonylurea-sensitive anion transporter. and therefore is associated with Tangier disease (high density lipoprotein deficiency type i). Accordingly, utilities of GAM94 include diagnosis, prevention and treatment of Tangier disease (high density lipoprotein deficiency type i), and of other diseases and clinical conditions associated with ABCA1.

The function of ABCA1 has been established by previous studies. By a PCR- based approach, Luciani et al. (1994) identified 2 novel mammalian members of the family of ATP-binding cassette (ABC) transporters designated ABC1 and ABC2 (OMIM Ref. No. 600047). They belong to a group of traffic ATPases encoded as a single multifunctional protein, such as CFTR (OMIM Ref. No. 602421) and P-glycoproteins (see OMIM Ref. No. 171050). Both ABC1 and ABC2 are large, internally symmetrical molecules that contain complete information for a functional 'channel-like' structure, a feature typical of the mammalian transporters at the plasma membrane. In both ABC1 and ABC2, the 2 halves of the molecules do not share extensive sequence similarity, apart from the nucleotide binding domains. This feature, shared with CFTR and with MRP1 (OMIM Ref. No. 158343), is in contrast with the high similarity shown by the 2 halves of P-glycoproteins. The finding argues against internal gene duplication as the event giving rise to the symmetric structure and favors the alternative hypothesis of the fusion of 2 independently evolved genes encoding the 2 halves. Santamarina-Fojo et al. (2000) found that the ABCA1 gene spans 149 kb and contains 50 exons. They identified 62 repetitive Alu sequences in the 49 introns. Comparative analysis of the mouse and human ABCA1 promoter sequences identified specific regulatory elements that are evolutionarily conserved. Pullinger et al. (2000) analyzed the promoter region of ABCA1. They identified 7 putative SP1 (OMIM Ref. No. 189906)-binding sites, 4 sterol regulatory elements (SREs) similar to the SRE of the low density lipoprotein receptor (LDLR; 606945) promoter region, a CpG island, a possible weak TATA box, 2 distal CCAAT sequences, and binding sites for several other transcription factors.

Full details of the abovementioned studies are described in the following publications, the disclosure of which are hereby incorporated by reference:

Luciani, M. F.; Denizot, F.; Savary, S.; Mattei, M. G.; Chimini, G.: Cloning of two novel ABC transporters mapping on human chromosome 9. Genomics 21:150-159, 1994; and Santamarina-Fojo, S.; Peterson, K.; Knapper, C.; Qiu, Y.; Freeman, L.; Cheng, J.-F.; Osorio, J.; Remaley, A.; Yang, X.-P.; Haudenschild, C.; Prades, C.; Chimini, G.; Blackmon, E.; Franc.

Further studies establishing the function and utilities of ABCA1 are found in John Hopkins OMIM database record ID 600046, and in cited publications listed in Table 5, which are hereby incorporated by reference. Active bcr-related gene (ABR, Accession NP_001083.1) is another GAM94 target gene, herein designated TARGET GENE. ABR BINDING SITE is a target binding site found in the 5' untranslated region of multiple transcripts of mRNA encoded by ABR, corresponding to a target binding site such as BINDING SITE I, BINDING SITE II or BINDING SITE III of FIG. 8. Table 4 illustrates the complementarity of the nucleotide sequences of ABR BINDING SITE, designated SEQ ID:18596, to the nucleotide sequence of GAM94 RNA, herein designated GAM RNA, also designated SEQ ID:332.

Another function of GAM94 is therefore inhibition of Active bcr-related gene (ABR, Accession NP_001083.1), a gene which gtpase-activating protein for rac and cdc42. and therefore may be associated with Medulloblastoma. Accordingly, utilities of GAM94 include diagnosis, prevention and treatment of Medulloblastoma, and of other diseases and clinical conditions associated with ABR.

The function of ABR has been established by previous studies. Heisterkamp et al. (1989) described an active BCR-related gene (ABR) that they identified based on its homology with the BCR gene (OMIM Ref. No. 151410) located on chromosome 22. BCR is involved in reciprocal translocations with the ABL oncogene (OMIM Ref. No. 189980) on chromosome 9 in Philadelphia chromosome-positive chronic myelogenous leukemia. Heisterkamp et al. (1993) mapped the ABR gene to 17p13.3 by in situ hybridization techniques. McDonald et al. (1994) found that the ABR locus was deleted in 7 of 8 informative cases of medulloblastoma. Using pulsed field gel electrophoresis, they localized a polymorphic marker of the ABR gene to within 220 kb of D17S34. A cosmid contig constructed in this region was used to demonstrate by fluorescence in situ hybridization that the 5-prime to 3-prime transcriptional orientation of the ABR gene is toward the telomere.

Full details of the abovementioned studies are described in the following publications, the disclosure of which are hereby incorporated by reference:

Heisterkamp, N.; Kaartinen, V.; van Soest, S.; Bokoch, G. M.; Groffen, J.: Human ABR encodes a protein with GAP-rac activity and homology to the DBL nucleotide exchange factor domain. J. Biol. Chem. 268:16903-16906, 1993; and McDonald, J. D.; Daneshvar, L.; Willert, J. R.; Matsumura, K.; Waldman, F.; Cogen, P. H.: Physical mapping of chromosome 17p13.3 in the region of a putative tumor suppressor gene import.

Further studies establishing the function and utilities of ABR are found in John Hopkins OMIM database record ID 600365, and in cited publications listed in Table 5, which are hereby incorporated by reference. Angiotensin i converting enzyme (peptidyl-dipeptidase a) 1 (ACE, Accession NP_690044.1) is another GAM94 target gene, herein designated TARGET GENE. ACE BINDING SITE is a target binding site found in the 3' untranslated region of multiple transcripts of mRNA encoded by ACE, corresponding to a target binding site such as BINDING SITE I, BINDING SITE II or BINDING SITE III of FIG. 8. Table 4 illustrates the complementarity of the nucleotide sequences of ACE BINDING SITE, designated SEQ ID:10322, to the nucleotide sequence of GAM94 RNA, herein designated GAM RNA, also designated SEQ ID:332.

Another function of GAM94 is therefore inhibition of Angiotensin i converting enzyme (peptidyl-dipeptidase a) 1 (ACE, Accession NP_690044.1), a gene which Angiotensin I-converting enzyme (dipeptidyl carboxypeptidase 1). Accordingly, utilities of GAM94 include diagnosis, prevention and treatment of diseases and clinical conditions associated with ACE.

The function of ACE and its association with various diseases and clinical conditions, has been established by previous studies, as described hereinabove with reference to GAM44.1. ACTR6 (Accession NP_071941.1) is another GAM94 target gene, herein designated TARGET GENE. ACTR6 BINDING SITE is a target binding site found in the 5' untranslated region of mRNA encoded by ACTR6, corresponding to a target binding site such as BINDING SITE I, BINDING SITE II or BINDING SITE III of FIG. 8. Table 4 illustrates the complementarity of the nucleotide sequences of ACTR6 BINDING SITE, designated SEQ ID:17448, to the nucleotide sequence of GAM94 RNA, herein designated GAM RNA, also designated SEQ ID:332.

Another function of GAM94 is therefore inhibition of ACTR6 (Accession NP_071941.1). Accordingly, utilities of GAM94 include diagnosis, prevention and treatment of diseases and clinical conditions associated with ACTR6.

Arp8 actin-related protein 8 homolog (yeast) (ACTR8, Accession NP_075050.1) is another GAM94 target gene, herein designated TARGET GENE. ACTR8 BINDING SITE is a target binding site found in the 3' untranslated region of mRNA encoded by ACTR8, corresponding to a target binding site such as BINDING SITE I, BINDING SITE II or BINDING SITE III of FIG. 8. Table 4 illustrates the complementarity of the nucleotide sequences of ACTR8 BINDING SITE, designated SEQ ID:7335, to the nucleotide sequence of GAM94 RNA, herein designated GAM RNA, also designated SEQ ID:332.

Another function of GAM94 is therefore inhibition of Arp8 actin-related protein 8 homolog (yeast) (ACTR8, Accession NP_075050.1). Accordingly, utilities of GAM94 include diagnosis, prevention and treatment of diseases and clinical conditions associated with ACTR8.

A disintegrin and metalloproteinase domain 10 (ADAM10, Accession NP_001101.1) is another GAM94 target gene, herein designated TARGET GENE. ADAM10 BINDING SITE is a target binding site found in the 5' untranslated region of mRNA encoded by ADAM10, corresponding to a target binding site such as BINDING SITE I, BINDING SITE II or BINDING SITE III of FIG. 8. Table 4 illustrates the complementarity of the nucleotide sequences of ADAM10 BINDING SITE, designated SEQ ID:19754, to the nucleotide sequence of GAM94 RNA, herein designated GAM RNA, also designated SEQ ID:332.

Another function of GAM94 is therefore inhibition of A disintegrin and metalloproteinase domain 10 (ADAM10, Accession NP_001101.1), a gene which Member of ADAM family of zinc metalloproteases. Accordingly, utilities of GAM94 include diagnosis, prevention and treatment of diseases and clinical conditions associated with ADAM10.

The function of ADAM10 and its association with various diseases and clinical conditions, has been established by previous studies, as described hereinabove with reference to GAM47.1. A disintegrin-like and metalloprotease (reprolysin type) with thrombospondin type 1 motif, 8 (ADAMTS8, Accession NP_008968.2) is another GAM94 target gene, herein designated TARGET GENE. ADAMTS8 BINDING SITE is a target binding site found in the 3' untranslated region of mRNA encoded by ADAMTS8, corresponding to a target binding site such as BINDING SITE I, BINDING SITE II or BINDING SITE III of FIG. 8. Table 4 illustrates the complementarity of the nucleotide sequences of ADAMTS8 BINDING SITE, designated SEQ ID:19214, to the nucleotide sequence of GAM94 RNA, herein designated GAM RNA, also designated SEQ ID:332.

Another function of GAM94 is therefore inhibition of A disintegrin-like and metalloprotease (reprolysin type) with thrombospondin type 1 motif, 8 (ADAMTS8, Accession NP_008968.2), a gene which has anti-angiogenic properties. Accordingly, utilities of GAM94 include diagnosis, prevention and treatment of diseases and clinical conditions associated with ADAMTS8.

The function of ADAMTS8 has been established by previous studies. Thrombospondin-1 (THBS1; 188060) associates with the extracellular matrix and inhibits angiogenesis in vivo. In vitro, THBS1 blocks capillary-like tube formation and endothelial cell proliferation. The antiangiogenic activity is mediated by a region that contains 3 type 1 (properdin or thrombospondin) repeats. By searching an EST database for sequences containing the antiangiogenic motif of THBS1, Vazquez et al. (1999) identified heart and lung cDNAs encoding ADAMTS1 (OMIM Ref. No. 605174) and ADAMTS8, which they called METH1 and METH2, respectively. Sequence analysis predicted that the 890-amino acid ADAMTS8 protein shares 52% amino acid identity with ADAMTS1. ADAMTS8 is a secreted protein that has an N-terminal signal peptide, a zinc metalloprotease domain containing a zinc-binding site, and a cysteine-rich region containing 2 putative disintegrin loops. The C terminus of ADAMTS8 has 2 heparin-binding thrombospondin repeats with 6 cys and 3 trp residues. Southern blot analysis showed that ADAMTS8 is a single-copy gene distinct from that encoding ADAMTS1. Northern blot analysis detected highest expression of a 3.7-kb ADAMTS8 transcript in adult and fetal lung, with lower expression in brain, placenta, heart, and stomach, as well as fetal brain and kidney. Expression was also detected in a colon carcinoma cell line. SDS-PAGE analysis demonstrated that ADAMTS8 is expressed as a 98-kD protein, a 79-kD protein after cleavage at the subtilisin site, or as a 64-kD protein, which is most abundant, generated by an additional processing event. Functional analysis determined that ADAMTS8 disrupts angiogenesis in vivo and in vitro more efficiently than THBS1 or endostatin (OMIM Ref. No. 120328) but somewhat less efficiently than ADAMTS1. By interspecific backcross analysis, Georgiadis et al. (1999) mapped the mouse Adamts8 gene to chromosome 9 in a region showing homology of synteny with human 11q23-qter. They mapped the human ADAMTS8 gene to 11q25 by PCR analysis of a radiation hybrid mapping panel. The authors noted that a number of disorders have been mapped in the vicinity of the ADAMTS8 gene in mice and humans, most notably, given the expression and functional analyses, lung neoplasms.

Full details of the abovementioned studies are described in the following publications, the disclosure of which are hereby incorporated by reference:

Georgiadis, K. E.; Hirohata, S.; Seldin, M. F.; Apte, S. S.: ADAM-TS8, a novel metalloprotease of the ADAM-TS family located on mouse chromosome 9 and human chromosome 11. Genomics 62:312-315, 1999; and Vazquez, F.; Hastings, G.; Ortega, M.-A.; Lane, T. F.; Oikemus, S.; Lombardo, M.; Iruela-Arispe, M. L.: METH-1, a human ortholog of ADAMTS-1, and METH-2 are members of a new family of.

Further studies establishing the function and utilities of ADAMTS8 are found in John Hopkins OMIM database record ID 605175, and in cited publications listed in Table 5, which are hereby incorporated by reference. Afg3 atpase family gene 3-like 1 (yeast) (AFG3L1, Accession NP_001123.1) is another GAM94 target gene, herein designated TARGET GENE. AFG3L1 BINDING SITE is a target binding site found in the 5' untranslated region of mRNA encoded by AFG3L1, corresponding to a target binding site such as BINDING SITE I, BINDING SITE II or BINDING SITE III of FIG. 8. Table 4 illustrates the complementarity of the nucleotide sequences of AFG3L1 BINDING SITE, designated SEQ ID:13711, to the nucleotide sequence of GAM94 RNA, herein designated GAM RNA, also designated SEQ ID:332.

Another function of GAM94 is therefore inhibition of Afg3 atpase family gene 3-like 1 (yeast) (AFG3L1, Accession NP_001123.1). Accordingly, utilities of GAM94 include diagnosis, prevention and treatment of diseases and clinical conditions associated with AFG3L1.

A kinase (prka) anchor protein 2 (AKAP2, Accession NP_009134.1) is another GAM94 target gene, herein designated TARGET GENE. AKAP2 BINDING SITE is a target binding site found in the 3' untranslated region of multiple transcripts of mRNA encoded by AKAP2, corresponding to a target binding site such as BINDING SITE I, BINDING SITE II or BINDING SITE III of FIG. 8. Table 4 illustrates the complementarity of the nucleotide sequences of AKAP2 BINDING SITE, designated SEQ ID:6726, to the nucleotide sequence of GAM94 RNA, herein designated GAM RNA, also designated SEQ ID:332.

Another function of GAM94 is therefore inhibition of A kinase (prka) anchor protein 2 (AKAP2, Accession NP_009134.1), a gene which binds to regulatory subunit (rii) of protein kinase a. Accordingly, utilities of GAM94 include diagnosis, prevention and treatment of diseases and clinical conditions associated with AKAP2.

The function of AKAP2 has been established by previous studies. Gene map locus Chr.9 Protein kinase A (PKA; OMIM Ref. No. 176911) mediates actions of hormones and neurotransmitters that activate adenylate cyclase (see OMIM Ref. No. 103070). Signals carried by cAMP are often directed at discrete intracellular sites. A nonuniform distribution of PKA type II molecules occurs when they are attached to the cytoskeleton by 'A-kinase anchor proteins' (see OMIM Ref. No. AKAP1, 602449). Such anchored molecules may be essential for dissemination of cAMP signals in highly polarized epithelium such as lung and kidney. Using yeast 2-hybrid screening, Dong et al. (1998) isolated cDNAs encoding 6 isoforms of a full-length 885-kD mouse protein which they termed AKAP-KL because of its expression in epithelial cells of kidney and lung. Sequence analysis showed that the isoforms are generated by alternative splicing and by utilization of either of 2 translation start codons. Using affinity chromatography and Western blot analysis, the authors showed that AKAP-KL binds PKA type II in intact cells. By immunoblot analysis of tissue fractions, Dong et al. (1998) found that AKAP-KL is abundantly expressed in lung, moderately expressed in thymus and cerebellum, but absent in heart, cerebral cortex, and liver. Confocal immunofluorescence microscopy revealed that AKAP-KL accumulates in regions of the cortical cytoskeleton in association with F-actin (see OMIM Ref. No. 102610) in human embryonic kidney cells. By radiation hybrid analysis, Nagase et al. (1999) mapped the human AKAP gene, which they called KIAA0920, to chromosome 9.

Full details of the abovementioned studies are described in the following publications, the disclosure of which are hereby incorporated by reference:

Dong, F.; Feldmesser, M.; Casadevall, A.; Rubin, C. S.: Molecular characterization of a cDNA that encodes six isoforms of a novel murine A kinase anchor protein. J. Biol. Chem. 273:6533-6541, 1998; and Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human ge.

Further studies establishing the function and utilities of AKAP2 are found in John Hopkins OMIM database record ID 604582, and in cited publications listed in Table 5, which are hereby incorporated by reference. A kinase (prka) anchor protein 2 (AKAP2, Accession NP_671492.1) is another GAM94 target gene, herein designated TARGET GENE. AKAP2 BINDING SITE is a target binding site found in the 3' untranslated region of multiple transcripts of mRNA encoded by AKAP2, corresponding to a target binding site such as BINDING SITE I, BINDING SITE II or BINDING SITE III of FIG. 8. Table 4 illustrates the complementarity of the nucleotide sequences of AKAP2 BINDING SITE, designated SEQ ID:6726, to the nucleotide sequence of GAM94 RNA, herein designated GAM RNA, also designated SEQ ID:332.

Another function of GAM94 is therefore inhibition of A kinase (prka) anchor protein 2 (AKAP2, Accession NP_671492.1), a gene which binds to regulatory subunit (rii) of protein kinase a. Accordingly, utilities of GAM94 include diagnosis, prevention and treatment of diseases and clinical conditions associated with AKAP2.

The function of AKAP2 has been established by previous studies. Gene map locus Chr.9 Protein kinase A (PKA; OMIM Ref. No. 176911) mediates actions of hormones and neurotransmitters that activate adenylate cyclase (see OMIM Ref. No. 103070). Signals carried by cAMP are often directed at discrete intracellular sites. A nonuniform distribution of PKA type II molecules occurs when they are attached to the cytoskeleton by 'A-kinase anchor proteins' (see OMIM Ref. No. AKAP1, 602449). Such anchored molecules may be essential for dissemination of cAMP signals in highly polarized epithelium such as lung and kidney. Using yeast 2-hybrid screening, Dong et al. (1998) isolated cDNAs encoding 6 isoforms of a full-length 885-kD mouse protein which they termed AKAP-KL because of its expression in epithelial cells of kidney and lung. Sequence analysis showed that the isoforms are generated by alternative splicing and by utilization of either of 2 translation start codons. Using affinity chromatography and Western blot analysis, the authors showed that AKAP-KL binds PKA type II in intact cells. By immunoblot analysis of tissue fractions, Dong et al. (1998) found that AKAP-KL is abundantly expressed in lung, moderately expressed in thymus and cerebellum, but absent in heart, cerebral cortex, and liver. Confocal immunofluorescence microscopy revealed that AKAP- KL accumulates in regions of the cortical cytoskeleton in association with F-actin (see OMIM Ref. No. 102610) in human embryonic kidney cells. By radiation hybrid analysis, Nagase et al. (1999) mapped the human AKAP gene, which they called KIAA0920, to chromosome 9.

Full details of the abovementioned studies are described in the following publications, the disclosure of which are hereby incorporated by reference:

Dong, F.; Feldmesser, M.; Casadevall, A.; Rubin, C. S.: Molecular characterization of a cDNA that encodes six isoforms of a novel murine A kinase anchor protein. J. Biol. Chem. 273:6533-6541, 1998; and Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human ge.

Further studies establishing the function and utilities of AKAP2 are found in John Hopkins OMIM database record ID 604582, and in cited publications listed in Table 5, which are hereby incorporated by reference. ALEX3 (Accession NP_057691.1) is another GAM94 target gene, herein designated TARGET GENE. ALEX3 BINDING SITE is a target binding site found in the 5' untranslated region of multiple transcripts of mRNA encoded by ALEX3, corresponding to a target binding site such as BINDING SITE I, BINDING SITE II or BINDING SITE III of FIG. 8. Table 4 illustrates the complementarity of the nucleotide sequences of ALEX3 BINDING SITE, designated SEQ ID:15945, to the nucleotide sequence of GAM94 RNA, herein designated GAM RNA, also designated SEQ ID:332.

Another function of GAM94 is therefore inhibition of ALEX3 (Accession NP_057691.1). Accordingly, utilities of GAM94 include diagnosis, prevention and treatment of diseases and clinical conditions associated with ALEX3.

ALEX3 (Accession NP_808816.1) is another GAM94 target gene, herein designated TARGET GENE. ALEX3 BINDING SITE is a target binding site found in the 5' untranslated region of multiple transcripts of mRNA encoded by ALEX3, corresponding to a target binding site such as BINDING SITE I, BINDING SITE II or BINDING SITE III of FIG. 8. Table 4 illustrates the complementarity of the nucleotide sequences of ALEX3 BINDING SITE, designated SEQ ID:15945, to the nucleotide sequence of GAM94 RNA, herein designated GAM RNA, also designated SEQ ID:332.

Another function of GAM94 is therefore inhibition of ALEX3 (Accession NP_808816.1). Accordingly, utilities of GAM94 include diagnosis, prevention and treatment of diseases and clinical conditions associated with ALEX3.

ALEX3 (Accession NP_808817.1) is another GAM94 target gene, herein designated TARGET GENE. ALEX3 BINDING SITE is a target binding site found in the 5' untranslated region of multiple transcripts of mRNA encoded by ALEX3, corresponding to a target binding site such as BINDING SITE I, BINDING SITE II or BINDING SITE III of FIG. 8. Table 4 illustrates the complementarity of the nucleotide sequences of ALEX3 BINDING SITE, designated SEQ ID:15945, to the nucleotide sequence of GAM94 RNA, herein designated GAM RNA, also designated SEQ ID:332.

Another function of GAM94 is therefore inhibition of ALEX3 (Accession NP_808817.1). Accordingly, utilities of GAM94 include diagnosis, prevention and treatment of diseases and clinical conditions associated with ALEX3.

ALK7 (Accession NP_660302.1) is another GAM94 target gene, herein designated TARGET GENE. ALK7 BINDING SITE is a target binding site found in the 3' untranslated region of mRNA encoded by ALK7, corresponding to a target binding site such as BINDING SITE I, BINDING SITE II or BINDING SITE III of FIG. 8. Table 4 illustrates the complementarity of the nucleotide sequences of ALK7 BINDING SITE, designated SEQ ID:1036, to the nucleotide sequence of GAM94 RNA, herein designated GAM RNA, also designated SEQ ID:332.

Another function of GAM94 is therefore inhibition of ALK7 (Accession NP_660302.1). Accordingly, utilities of GAM94 include diagnosis, prevention and treatment of diseases and clinical conditions associated with ALK7.

Ankyrin 1, erythrocytic (ANK1, Accession NP_065208.1) is another GAM94 target gene, herein designated TARGET GENE. ANK1 BINDING SITE is a target binding site found in the 3' untranslated region of multiple transcripts of mRNA encoded by ANK1, corresponding to a target binding site such as BINDING SITE I, BINDING SITE II or BINDING SITE III of FIG. 8. Table 4 illustrates the complementarity of the nucleotide sequences of ANK1 BINDING SITE, designated SEQ ID:1839, to the nucleotide sequence of GAM94 RNA, herein designated GAM RNA, also designated SEQ ID:332.

Another function of GAM94 is therefore inhibition of Ankyrin 1, erythrocytic (ANK1, Accession NP_065208.1). Accordingly, utilities of GAM94 include diagnosis, prevention and treatment of diseases and clinical conditions associated with ANK1.

Ankyrin 1, erythrocytic (ANK1, Accession NP_065214.1) is another GAM94 target gene, herein designated TARGET GENE. ANK1 BINDING SITE is a target binding site found in the 3' untranslated region of multiple transcripts of mRNA encoded by ANK1, corresponding to a target binding site such as BINDING SITE I, BINDING SITE II or BINDING SITE III of FIG. 8. Table 4 illustrates the complementarity of the nucleotide sequences of ANK1 BINDING SITE, designated SEQ ID:1839, to the nucleotide sequence of GAM94 RNA, herein designated GAM RNA, also designated SEQ ID:332.

Another function of GAM94 is therefore inhibition of Ankyrin 1, erythrocytic (ANK1, Accession NP_065214.1). Accordingly, utilities of GAM94 include diagnosis, prevention and treatment of diseases and clinical conditions associated with ANK1.

Ankyrin 1, erythrocytic (ANK1, Accession NP_065210.1) is another GAM94 target gene, herein designated TARGET GENE. ANK1 BINDING SITE is a target binding site found in the 3' untranslated region of multiple transcripts of mRNA encoded by ANK1, corresponding to a target binding site such as BINDING SITE I, BINDING SITE II or BINDING SITE III of FIG. 8. Table 4 illustrates the complementarity of the nucleotide sequences of ANK1 BINDING SITE, designated SEQ ID:1839, to the nucleotide sequence of GAM94 RNA, herein designated GAM RNA, also designated SEQ ID:332.

Another function of GAM94 is therefore inhibition of Ankyrin 1, erythrocytic (ANK1, Accession NP_065210.1). Accordingly, utilities of GAM94 include diagnosis, prevention and treatment of diseases and clinical conditions associated with ANK1.

Ankyrin 1, erythrocytic (ANK1, Accession NP_065211.1) is another GAM94 target gene, herein designated TARGET GENE. ANK1 BINDING SITE is a target binding site found in the 3' untranslated region of multiple transcripts of mRNA encoded by ANK1, corresponding to a target binding site such as BINDING SITE I, BINDING SITE II or BINDING SITE III of FIG. 8. Table 4 illustrates the complementarity of the nucleotide sequences of ANK1 BINDING SITE, designated SEQ ID:1839, to the nucleotide sequence of GAM94 RNA, herein designated GAM RNA, also designated SEQ ID:332.

Another function of GAM94 is therefore inhibition of Ankyrin 1, erythrocytic (ANK1, Accession NP_065211.1). Accordingly, utilities of GAM94 include diagnosis, prevention and treatment of diseases and clinical conditions associated with ANK1.

Ankyrin 1, erythrocytic (ANK1, Accession NP_000028.2) is another GAM94 target gene, herein designated TARGET GENE. ANK1 BINDING SITE is a target binding site found in the 3' untranslated region of multiple transcripts of mRNA encoded by ANK1, corresponding to a target binding site such as BINDING SITE I, BINDING SITE II or BINDING SITE III of FIG. 8. Table 4 illustrates the complementarity of the nucleotide sequences of ANK1 BINDING SITE, designated SEQ ID:1839, to the nucleotide sequence of GAM94 RNA, herein designated GAM RNA, also designated SEQ ID:332.

Another function of GAM94 is therefore inhibition of Ankyrin 1, erythrocytic (ANK1, Accession NP_000028.2). Accordingly, utilities of GAM94 include diagnosis, prevention and treatment of diseases and clinical conditions associated with ANK1.

Ankyrin 1, erythrocytic (ANK1, Accession NP_065213.1) is another GAM94 target gene, herein designated TARGET GENE. ANK1 BINDING SITE is a target binding site found in the 3' untranslated region of multiple transcripts of mRNA encoded by ANK1, corresponding to a target binding site such as BINDING SITE I, BINDING SITE II or BINDING SITE III of FIG. 8. Table 4 illustrates the complementarity of the nucleotide sequences of ANK1 BINDING SITE, designated SEQ ID:1839, to the nucleotide sequence of GAM94 RNA, herein designated GAM RNA, also designated SEQ ID:332.

Another function of GAM94 is therefore inhibition of Ankyrin 1, erythrocytic (ANK1, Accession NP_065213.1). Accordingly, utilities of GAM94 include diagnosis, prevention and treatment of diseases and clinical conditions associated with ANK1.

Ankyrin 1, erythrocytic (ANK1, Accession NP_065212.1) is another GAM94 target gene, herein designated TARGET GENE. ANK1 BINDING SITE is a target binding site found in the 3' untranslated region of multiple transcripts of mRNA encoded by ANK1, corresponding to a target binding site such as BINDING SITE I, BINDING SITE II or BINDING SITE III of FIG. 8. Table 4 illustrates the complementarity of the nucleotide sequences of ANK1 BINDING SITE, designated SEQ ID:1839, to the nucleotide sequence of GAM94 RNA, herein designated GAM RNA, also designated SEQ ID:332.

Another function of GAM94 is therefore inhibition of Ankyrin 1, erythrocytic (ANK1, Accession NP_065212.1). Accordingly, utilities of GAM94 include diagnosis, prevention and treatment of diseases and clinical conditions associated with ANK1.

Ankyrin 1, erythrocytic (ANK1, Accession NP_065209.1) is another GAM94 target gene, herein designated TARGET GENE. ANK1 BINDING SITE is a target binding site found in the 3' untranslated region of multiple transcripts of mRNA encoded by ANK1, corresponding to a target binding site such as BINDING SITE I, BINDING SITE II or BINDING SITE III of FIG. 8. Table 4 illustrates the complementarity of the nucleotide sequences of ANK1 BINDING SITE, designated SEQ ID:1839, to the nucleotide sequence of GAM94 RNA, herein designated GAM RNA, also designated SEQ ID:332.

Another function of GAM94 is therefore inhibition of Ankyrin 1, erythrocytic (ANK1, Accession NP_065209.1). Accordingly, utilities of GAM94 include diagnosis, prevention and treatment of diseases and clinical conditions associated with ANK1.

AP1S3 (Accession XP_291023.1) is another GAM94 target gene, herein designated TARGET GENE. AP1S3 BINDING SITE is a target binding site found in the 5' untranslated region of multiple transcripts of mRNA encoded by AP1S3, corresponding to a target binding site such as BINDING SITE I, BINDING SITE II or BINDING SITE III of FIG. 8. Table 4 illustrates the complementarity of the nucleotide sequences of AP1S3 BINDING SITE, designated SEQ ID:6748, to the nucleotide sequence of GAM94 RNA, herein designated GAM RNA, also designated SEQ ID:332.

Another function of GAM94 is therefore inhibition of AP1S3 (Accession XP_291023.1). Accordingly, utilities of GAM94 include diagnosis, prevention and treatment of diseases and clinical conditions associated with AP1S3.

APLN (Accession NP_059109.2) is another GAM94 target gene, herein designated TARGET GENE. APLN BINDING SITE is a target binding site found in the 3' untranslated region of mRNA encoded by APLN, corresponding to a target binding site such as BINDING SITE I, BINDING SITE II or BINDING SITE III of FIG. 8. Table 4 illustrates the complementarity of the nucleotide sequences of APLN BINDING SITE, designated SEQ ID:3649, to the nucleotide sequence of GAM94 RNA, herein designated GAM RNA, also designated SEQ ID:332.

Another function of GAM94 is therefore inhibition of APLN (Accession NP_059109.2). Accordingly, utilities of GAM94 include diagnosis, prevention and treatment of diseases and clinical conditions associated with APLN.

Apolipoprotein a-v (APOA5, Accession NP_443200.1) is another GAM94 target gene, herein designated TARGET GENE. APOA5 BINDING SITE is a target binding site found in the 3' untranslated region of mRNA encoded by APOA5, corresponding to a target binding site such as BINDING SITE I, BINDING SITE II or BINDING SITE III of FIG. 8. Table 4 illustrates the complementarity of the nucleotide sequences of APOA5 BINDING SITE, designated SEQ ID:14854, to the nucleotide sequence of GAM94 RNA, herein designated GAM RNA, also designated SEQ ID:332.

Another function of GAM94 is therefore inhibition of Apolipoprotein a-v (APOA5, Accession NP_443200.1). Accordingly, utilities of GAM94 include diagnosis, prevention and treatment of diseases and clinical conditions associated with APOA5.

Aquaporin 1 (channel-forming integral protein, 28 kda) (AQP1, Accession NP_000376.1) is another GAM94 target gene, herein designated TARGET GENE. AQP1 BINDING SITE is a target binding site found in the 3' untranslated region of mRNA encoded by AQP1, corresponding to a target binding site such as BINDING SITE I, BINDING SITE II or BINDING SITE III of FIG. 8. Table 4 illustrates the complementarity of the nucleotide sequences of AQP1 BINDING SITE, designated SEQ ID:19824, to the nucleotide sequence of GAM94 RNA, herein designated GAM RNA, also designated SEQ ID:332.

Another function of GAM94 is therefore inhibition of Aquaporin 1 (channel-forming integral protein, 28 kda) (AQP1, Accession NP_000376.1). Accordingly, utilities of GAM94 include diagnosis, prevention and treatment of diseases and clinical conditions associated with AQP1.

Archain 1 (ARCN1, Accession NP_001646.2) is another GAM94 target gene, herein designated TARGET GENE. ARCN1 BINDING SITE is a target binding site found in the 3' untranslated region of mRNA encoded by ARCN1, corresponding to a target binding site such as BINDING SITE I, BINDING SITE II or BINDING SITE III of FIG. 8. Table 4 illustrates the complementarity of the nucleotide sequences of ARCN1 BINDING SITE, designated SEQ ID:10942, to the nucleotide sequence of GAM94 RNA, herein designated GAM RNA, also designated SEQ ID:332.

Another function of GAM94 is therefore inhibition of Archain 1 (ARCN1, Accession NP_001646.2), a gene which plays a fundamental role in eukaryotic cell biology. Accordingly, utilities of GAM94 include diagnosis, prevention and treatment of diseases and clinical conditions associated with ARCN1.

The function of ARCN1 and its association with various diseases and clinical conditions, has been established by previous studies, as described hereinabove with reference to GAM30.1. Rho guanine nucleotide exchange factor (gef) 12 (ARHGEF12, Accession NP_056128.1) is another GAM94 target gene, herein designated TARGET GENE. ARHGEF12 BINDING SITE is a target binding site found in the 3' untranslated region of mRNA encoded by ARHGEF12, corresponding to a target binding site such as BINDING SITE I, BINDING SITE II or BINDING SITE III of FIG. 8. Table 4 illustrates the complementarity of the nucleotide sequences of ARHGEF12 BINDING SITE, designated SEQ ID:3599, to the nucleotide sequence of GAM94 RNA, herein designated GAM RNA, also designated SEQ ID:332.

Another function of GAM94 is therefore inhibition of Rho guanine nucleotide exchange factor (gef) 12 (ARHGEF12, Accession NP_056128.1). Accordingly, utilities of GAM94 include diagnosis, prevention and treatment of diseases and clinical conditions associated with ARHGEF12.

Cdc42 guanine nucleotide exchange factor (gef) 9 (ARHGEF9, Accession NP_056000.1) is another GAM94 target gene, herein designated TARGET GENE. ARHGEF9 BINDING SITE is a target binding site found in the 5' untranslated region of mRNA encoded by ARHGEF9, corresponding to a target binding site such as BINDING SITE I, BINDING SITE II or BINDING SITE III of FIG. 8. Table 4 illustrates the complementarity of the nucleotide sequences of ARHGEF9 BINDING SITE, designated SEQ ID:14362, to the nucleotide sequence of GAM94 RNA, herein designated GAM RNA, also designated SEQ ID:332.

Another function of GAM94 is therefore inhibition of Cdc42 guanine nucleotide exchange factor (gef) 9 (ARHGEF9, Accession NP_056000.1). Accordingly, utilities of GAM94 include diagnosis, prevention and treatment of diseases and clinical conditions associated with ARHGEF9.

Astrotactin (ASTN, Accession XP_045113.1) is another GAM94 target gene, herein designated TARGET GENE. ASTN BINDING SITE is a target binding site found in the 3' untranslated region of mRNA encoded by ASTN, corresponding to a target binding site such as BINDING SITE I, BINDING SITE II or BINDING SITE III of FIG. 8. Table 4 illustrates the complementarity of the nucleotide sequences of ASTN BINDING SITE, designated SEQ ID:14476, to the nucleotide sequence of GAM94 RNA, herein designated GAM RNA, also designated SEQ ID:332.

Another function of GAM94 is therefore inhibition of Astrotactin (ASTN, Accession XP_045113.1). Accordingly, utilities of GAM94 include diagnosis, prevention and treatment of diseases and clinical conditions associated with ASTN.

Atpase, h+ transporting, lysosomal 13 kda, v1 subunit g isoform 2 (ATP6V1G2, Accession NP_569730.1) is another GAM94 target gene, herein designated TARGET GENE. ATP6V1G2 BINDING SITE is a target binding site found in the 5' untranslated region of multiple transcripts of mRNA encoded by ATP6V1G2, corresponding to a target binding site such as BINDING SITE I, BINDING SITE II or BINDING SITE III of FIG. 8. Table 4 illustrates the complementarity of the nucleotide sequences of ATP6V1G2 BINDING SITE, designated SEQ ID:2763, to the nucleotide sequence of GAM94 RNA, herein designated GAM RNA, also designated SEQ ID:332.

Another function of GAM94 is therefore inhibition of Atpase, h+ transporting, lysosomal 13 kda, v1 subunit g isoform 2 (ATP6V1G2, Accession NP_569730.1). Accordingly, utilities of GAM94 include diagnosis, prevention and treatment of diseases and clinical conditions associated with ATP6V1G2.

Beta-site app-cleaving enzyme (BACE, Accession NP_620428.1) is another GAM94 target gene, herein designated TARGET GENE. BACE BINDING SITE is a target binding site found in the 3' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:19344, to the nucleotide sequence of GAM94 RNA, herein designated GAM RNA, also designated SEQ ID:332.

Another function of GAM94 is therefore inhibition of Beta-site app-cleaving enzyme (BACE, Accession NP_620428.1), a gene which is responsible for the proteolytic processing of the amyloid precursor protein and therefore may be associated with Alzheimer disease. Accordingly, utilities of GAM94 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_036236.1) is another GAM94 target gene, herein designated TARGET GENE. BACE BINDING SITE is a target binding site found in the 3' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:19344, to the nucleotide sequence of GAM94 RNA, herein designated GAM RNA, also designated SEQ ID:332.

Another function of GAM94 is therefore inhibition of Beta-site app-cleaving enzyme (BACE, Accession NP_036236.1), a gene which is responsible for the proteolytic processing of the amyloid precursor protein and therefore may be associated with Alzheimer disease. Accordingly, utilities of GAM94 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_620429.1) is another GAM94 target gene, herein designated TARGET GENE. BACE BINDING SITE is a target binding site found in the 3' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:19344, to the nucleotide sequence of GAM94 RNA, herein designated GAM RNA, also designated SEQ ID:332.

Another function of GAM94 is therefore inhibition of Beta-site app-cleaving enzyme (BACE, Accession NP_620429.1), a gene which is responsible for the proteolytic processing of the amyloid precursor protein and therefore may be associated with Alzheimer disease. Accordingly, utilities of GAM94 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_620427.1) is another GAM94 target gene, herein designated TARGET GENE. BACE BINDING SITE is a target binding site found in the 3' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:19344, to the nucleotide sequence of GAM94 RNA, herein designated GAM RNA, also designated SEQ ID:332.

Another function of GAM94 is therefore inhibition of Beta-site app-cleaving enzyme (BACE, Accession NP_620427.1), a gene which is responsible for the proteolytic processing of the amyloid precursor protein and therefore may be associated with Alzheimer disease. Accordingly, utilities of GAM94 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Btb and cnc homology 1, basic leucine zipper transcription factor 2 (BACH2, Accession NP_068585.1) is another GAM94 target gene, herein designated TARGET GENE. BACH2 BINDING SITE is a target binding site found in the 5' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:17333, to the nucleotide sequence of GAM94 RNA, herein designated GAM RNA, also designated SEQ ID:332.

Another function of GAM94 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM94 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. Bromodomain adjacent to zinc finger domain, 2a (BAZ2A, Accession NP_038477.1) is another GAM94 target gene, herein designated TARGET GENE. BAZ2A BINDING SITE is a target binding site found in the 5' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:16323, to the nucleotide sequence of GAM94 RNA, herein designated GAM RNA, also designated SEQ ID:332.

Another function of GAM94 is therefore inhibition of Bromodomain adjacent to zinc finger domain, 2a (BAZ2A, Accession NP_038477.1). Accordingly, utilities of GAM94 include diagnosis, prevention and treatment of diseases and clinical conditions associated with BAZ2A.

B-cell cll/lymphoma 11b (zinc finger protein) (BCL11B, Accession NP_075049.1) is another GAM94 target gene, herein designated TARGET GENE. BCL11B BINDING SITE1 and BCL11B BINDING SITE2 are target binding sites found in untranslated regions of multiple transcripts of mRNA encoded by BCL11B, corresponding to target binding sites such as BINDING SITE I, BINDING SITE II or BINDING SITE III of FIG. 8. Table 4 illustrates the complementarity of the nucleotide sequences of BCL11B BINDING SITE1 and BCL11B BINDING SITE2, designated SEQ ID:17597 and SEQ ID:17597 respectively, to the nucleotide sequence of GAM94 RNA, herein designated GAM RNA, also designated SEQ ID:332.

Another function of GAM94 is therefore inhibition of B-cell cll/lymphoma 11b (zinc finger protein) (BCL11B, Accession NP_075049.1). Accordingly, utilities of GAM94 include diagnosis, prevention and treatment of diseases and clinical conditions associated with BCL11B.

B-cell cll/lymphoma 11b (zinc finger protein) (BCL11B, Accession NP_075049.1) is another GAM94 target gene, herein designated TARGET GENE. BCL11B BINDING SITE1 and BCL11B BINDING SITE2 are target binding sites found in untranslated regions of multiple transcripts of mRNA encoded by BCL11B, corresponding to target binding sites such as BINDING SITE I, BINDING SITE II or BINDING SITE III of FIG. 8. Table 4 illustrates the complementarity of the nucleotide sequences of BCL11B BINDING SITE1 and BCL11B BINDING SITE2, designated SEQ ID:3630 and SEQ ID:14045 respectively, to the nucleotide sequence of GAM94 RNA, herein designated GAM RNA, also designated SEQ ID:332.

Another function of GAM94 is therefore inhibition of B-cell cll/lymphoma 11b (zinc finger protein) (BCL11B, Accession NP_075049.1). Accordingly, utilities of GAM94 include diagnosis, prevention and treatment of diseases and clinical conditions associated with BCL11B.

BM-002 (Accession NP_057701.1) is another GAM94 target gene, herein designated TARGET GENE. BM-002 BINDING SITE is a target binding site found in the 3' untranslated region of mRNA encoded by BM-002, corresponding to a target binding site such as BINDING SITE I, BINDING SITE II or BINDING SITE III of FIG. 8. Table 4 illustrates the complementarity of the nucleotide sequences of BM-002 BINDING SITE, designated SEQ ID:19641, to the nucleotide sequence of GAM94 RNA, herein designated GAM RNA, also designated SEQ ID:332.

Another function of GAM94 is therefore inhibition of BM-002 (Accession NP_057701.1). Accordingly, utilities of GAM94 include diagnosis, prevention and treatment of diseases and clinical conditions associated with BM-002.

Bone morphogenetic protein 4 (BMP4, Accession NP_570911.1) is another GAM94 target gene, herein designated TARGET GENE. BMP4 BINDING SITE1 through BMP4 BINDING SITE4 are target binding sites found in untranslated regions of multiple transcripts of mRNA encoded by BMP4, corresponding to target binding sites such as BINDING SITE I, BINDING SITE II or BINDING SITE III of FIG. 8. Table 4 illustrates the complementarity of the nucleotide sequences of BMP4 BINDING SITE1 through BMP4 BINDING SITE4, designated SEQ ID:17767, SEQ ID:11479, SEQ ID:16063 and SEQ ID:17767 respectively, to the nucleotide sequence of GAM94 RNA, herein designated GAM RNA, also designated SEQ ID:332.

Another function of GAM94 is therefore inhibition of Bone morphogenetic protein 4 (BMP4, Accession NP_570911.1), a gene which acts in mesoderm induction, tooth development, limb formation and fracture repair and therefore may be associated with Fibrodysplasia ossificans progressiva. Accordingly, utilities of GAM94 include diagnosis, prevention and treatment of Fibrodysplasia ossificans progressiva, and of other diseases and clinical conditions associated with BMP4.

The function of BMP4 and its association with various diseases and clinical conditions, has been established by previous studies, as described hereinabove with reference to GAM47.1. Bone morphogenetic protein 4 (BMP4, Accession NP_570911.1) is another GAM94 target gene, herein designated TARGET GENE. BMP4 BINDING SITE1 through BMP4 BINDING SITE4 are target binding sites found in untranslated regions of multiple transcripts of mRNA encoded by BMP4, corresponding to target binding sites such as BINDING SITE I, BINDING SITE II or BINDING SITE III of FIG. 8. Table 4 illustrates the complementarity of the nucleotide sequences of BMP4 BINDING SITE1 through BMP4 BINDING SITE4, designated SEQ ID:11479, SEQ ID:15443, SEQ ID:15443 and SEQ ID:16063 respectively, to the nucleotide sequence of GAM94 RNA, herein designated GAM RNA, also designated SEQ ID:332.

Another function of GAM94 is therefore inhibition of Bone morphogenetic protein 4 (BMP4, Accession NP_570911.1), a gene which acts in mesoderm induction, tooth development, limb formation and fracture repair and therefore may be associated with Fibrodysplasia ossificans progressiva. Accordingly, utilities of GAM94 include diagnosis, prevention and treatment of Fibrodysplasia ossificans progressiva, and of other diseases and clinical conditions associated with BMP4.

The function of BMP4 and its association with various diseases and clinical conditions, has been established by previous studies, as described hereinabove with reference to GAM47.1. Basic transcription element binding protein 1 (BTEB1, Accession NP_001197.1) is another GAM94 target gene, herein designated TARGET GENE. BTEB1 BINDING SITE1 and BTEB1 BINDING SITE2 are target binding sites found in untranslated regions of mRNA encoded by BTEB1, corresponding to target binding sites such as BINDING SITE I, BINDING SITE II or BINDING SITE III of FIG. 8. Table 4 illustrates the complementarity of the nucleotide sequences of BTEB1 BINDING SITE1 and BTEB1 BINDING SITE2, designated SEQ ID:6904 and SEQ ID:12461 respectively, to the nucleotide sequence of GAM94 RNA, herein designated GAM RNA, also designated SEQ ID:332.

Another function of GAM94 is therefore inhibition of Basic transcription element binding protein 1 (BTEB1, Accession NP_001197.1). Accordingly, utilities of GAM94 include diagnosis, prevention and treatment of diseases and clinical conditions associated with BTEB1.

Butyrophilin, subfamily 2, member a1 (BTN2A1, Accession NP_008980.1) is another GAM94 target gene, herein designated TARGET GENE. BTN2A1 BINDING SITE is a target binding site found in the 5' untranslated region of multiple transcripts of mRNA encoded by BTN2A1, corresponding to a target binding site such as BINDING SITE I, BINDING SITE II or BINDING SITE III of FIG. 8. Table 4 illustrates the complementarity of the nucleotide sequences of BTN2A1 BINDING SITE, designated SEQ ID:2586, to the nucleotide sequence of GAM94 RNA, herein designated GAM RNA, also designated SEQ ID:332.

Another function of GAM94 is therefore inhibition of Butyrophilin, subfamily 2, member a1 (BTN2A1, Accession NP_008980.1). Accordingly, utilities of GAM94 include diagnosis, prevention and treatment of diseases and clinical conditions associated with BTN2A1.

Butyrophilin, subfamily 2, member a1 (BTN2A1, Accession NP_510961.1) is another GAM94 target gene, herein designated TARGET GENE. BTN2A1 BINDING SITE is a target binding site found in the 5' untranslated region of multiple transcripts of mRNA encoded by BTN2A1, corresponding to a target binding site such as BINDING SITE I, BINDING SITE II or BINDING SITE III of FIG. 8. Table 4 illustrates the complementarity of the nucleotide sequences of BTN2A1 BINDING SITE, designated SEQ ID:2586, to the nucleotide sequence of GAM94 RNA, herein designated GAM RNA, also designated SEQ ID:332.

Another function of GAM94 is therefore inhibition of Butyrophilin, subfamily 2, member a1 (BTN2A1, Accession NP_510961.1). Accordingly, utilities of GAM94 include diagnosis, prevention and treatment of diseases and clinical conditions associated with BTN2A1.

BY55 (Accession NP_008984.1) is another GAM94 target gene, herein designated TARGET GENE. BY55 BINDING SITE is a target binding site found in the 3' untranslated region of mRNA encoded by BY55, corresponding to a target binding site such as BINDING SITE I, BINDING SITE II or BINDING SITE III of FIG. 8. Table 4 illustrates the complementarity of the nucleotide sequences of BY55 BINDING SITE, designated SEQ ID:11183, to the nucleotide sequence of GAM94 RNA, herein designated GAM RNA, also designated SEQ ID:332.

Another function of GAM94 is therefore inhibition of BY55 (Accession NP_008984.1). Accordingly, utilities of GAM94 include diagnosis, prevention and treatment of diseases and clinical conditions associated with BY55.

C10orf5 (Accession XP_172843.1) is another GAM94 target gene, herein designated TARGET GENE. C10orf5 BINDING SITE is a target binding site found in the 3' untranslated region of multiple transcripts of mRNA encoded by C10orf5, corresponding to a target binding site such as BINDING SITE I, BINDING SITE II or BINDING SITE III of FIG. 8. Table 4 illustrates the complementarity of the nucleotide sequences of C10orf5 BINDING SITE, designated SEQ ID:12775, to the nucleotide sequence of GAM94 RNA, herein designated GAM RNA, also designated SEQ ID:332.

Another function of GAM94 is therefore inhibition of C10orf5 (Accession XP_172843.1). Accordingly, utilities of GAM94 include diagnosis, prevention and treatment of diseases and clinical conditions associated with C10orf5.

C14orf72 (Accession XP_096733.1) is another GAM94 target gene, herein designated TARGET GENE. C14orf72 BINDING SITE is a target binding site found in the 5' untranslated region of mRNA encoded by C14orf72, corresponding to a target binding site such as BINDING SITE I, BINDING SITE II or BINDING SITE III of FIG. 8. Table 4 illustrates the complementarity of the nucleotide sequences of C14orf72 BINDING SITE, designated SEQ ID:7433, to the nucleotide sequence of GAM94 RNA, herein designated GAM RNA, also designated SEQ ID:332.

Another function of GAM94 is therefore inhibition of C14orf72 (Accession XP_096733.1). Accordingly, utilities of GAM94 include diagnosis, prevention and treatment of diseases and clinical conditions associated with C14orf72.

Chromosome 1 open reading frame 16 (C1orf16, Accession NP_055652.2) is another GAM94 target gene, herein designated TARGET GENE. C1orf16 BINDING SITE1 and C1orf16 BINDING SITE2 are target binding sites found in untranslated regions of mRNA encoded by C1orf16, corresponding to target binding sites such as BINDING SITE I, BINDING SITE II or BINDING SITE III of FIG. 8. Table 4 illustrates the complementarity of the nucleotide sequences of C1orf16 BINDING SITE1 and C1orf16 BINDING SITE2, designated SEQ ID:7627 and SEQ ID:4187 respectively, to the nucleotide sequence of GAM94 RNA, herein designated GAM RNA, also designated SEQ ID:332.

Another function of GAM94 is therefore inhibition of Chromosome 1 open reading frame 16 (C1orf16, Accession NP_055652.2). Accordingly, utilities of GAM94 include diagnosis, prevention and treatment of diseases and clinical conditions associated with C1orf16.

Chromosome 1 open reading frame 2 (C1orf2, Accession NP_006580.1) is another GAM94 target gene, herein designated TARGET GENE. C1orf2 BINDING SITE is a target binding site found in the 3' untranslated region of mRNA encoded by C1orf2, corresponding to a target binding site such as BINDING SITE I, BINDING SITE II or BINDING SITE III of FIG. 8. Table 4 illustrates the complementarity of the nucleotide sequences of C1orf2 BINDING SITE, designated SEQ ID:1834, to the nucleotide sequence of GAM94 RNA, herein designated GAM RNA, also designated SEQ ID:332.

Another function of GAM94 is therefore inhibition of Chromosome 1 open reading frame 2 (C1orf2, Accession NP_006580.1). Accordingly, utilities of GAM94 include diagnosis, prevention and treatment of diseases and clinical conditions associated with C1orf2.

Chromosome 1 open reading frame 21 (C1orf21, Accession NP_110433.1) is another GAM94 target gene, herein designated TARGET GENE. C1orf21 BINDING SITE is a target binding site found in the 3' untranslated region of mRNA encoded by C1orf21, corresponding to a target binding site such as BINDING SITE I, BINDING SITE II or BINDING SITE III of FIG. 8. Table 4 illustrates the complementarity of the nucleotide sequences of C1orf21 BINDING SITE, designated SEQ ID:15376, to the nucleotide sequence of GAM94 RNA, herein designated GAM RNA, also designated SEQ ID:332.

Another function of GAM94 is therefore inhibition of Chromosome 1 open reading frame 21 (C1orf21, Accession NP_110433.1). Accordingly, utilities of GAM94 include diagnosis, prevention and treatment of diseases and clinical conditions associated with C1orf21.

Chromosome 1 open reading frame 9 (C1orf9, Accession NP_055098.1) is another GAM94 target gene, herein designated TARGET GENE. C1orf9 BINDING SITE is a target binding site found in the 5' untranslated region of multiple transcripts of mRNA encoded by C1orf9, corresponding to a target binding site such as BINDING SITE I, BINDING SITE II or BINDING SITE III of FIG. 8. Table 4 illustrates the complementarity of the nucleotide sequences of C1orf9 BINDING SITE, designated SEQ ID:19770, to the nucleotide sequence of GAM94 RNA, herein designated GAM RNA, also designated SEQ ID:332.

Another function of GAM94 is therefore inhibition of Chromosome 1 open reading frame 9 (C1orf9, Accession NP_055098.1). Accordingly, utilities of GAM94 include diagnosis, prevention and treatment of diseases and clinical conditions associated with C1orf9.

Chromosome 20 open reading frame 158 (C20orf158, Accession NP_689515.1) is another GAM94 target gene, herein designated TARGET GENE. C20orf158 BINDING SITE1 and C20orf158 BINDING SITE2 are target binding sites found in untranslated regions of mRNA encoded by C20orf158, corresponding to target binding sites such as BINDING SITE I, BINDING SITE II or BINDING SITE III of FIG. 8. Table 4 illustrates the complementarity of the nucleotide sequences of C20orf158 BINDING SITE1 and C20orf158 BINDING SITE2, designated SEQ ID:14515 and SEQ ID:14428 respectively, to the nucleotide sequence of GAM94 RNA, herein designated GAM RNA, also designated SEQ ID:332.

Another function of GAM94 is therefore inhibition of Chromosome 20 open reading frame 158 (C20orf158, Accession NP_689515.1). Accordingly, utilities of GAM94 include diagnosis, prevention and treatment of diseases and clinical conditions associated with C20orf158.

Chromosome 20 open reading frame 174 (C20orf174, Accession XP_066058.2) is another GAM94 target gene, herein designated TARGET GENE. C20orf174 BINDING SITE is a target binding site found in the 3' untranslated region of mRNA encoded by C20orf174, corresponding to a target binding site such as BINDING SITE I, BINDING SITE II or BINDING SITE III of FIG. 8. Table 4 illustrates the complementarity of the nucleotide sequences of C20orf174 BINDING SITE, designated SEQ ID:14077, to the nucleotide sequence of GAM94 RNA, herein designated GAM RNA, also designated SEQ ID:332.

Another function of GAM94 is therefore inhibition of Chromosome 20 open reading frame 174 (C20orf174, Accession XP_066058.2). Accordingly, utilities of GAM94 include diagnosis, prevention and treatment of diseases and clinical conditions associated with C20orf174.

Chromosome 3 open reading frame 4 (C3orf4, Accession NP_063948.1) is another GAM94 target gene, herein designated TARGET GENE. C3orf4 BINDING SITE is a target binding site found in the 3' untranslated region of mRNA encoded by C3orf4, corresponding to a target binding site such as BINDING SITE I, BINDING SITE II or BINDING SITE III of FIG. 8. Table 4 illustrates the complementarity of the nucleotide sequences of C3orf4 BINDING SITE, designated SEQ ID:12175, to the nucleotide sequence of GAM94 RNA, herein designated GAM RNA, also designated SEQ ID:332.

Another function of GAM94 is therefore inhibition of Chromosome 3 open reading frame 4 (C3orf4, Accession NP_063948.1). Accordingly, utilities of GAM94 include diagnosis, prevention and treatment of diseases and clinical conditions associated with C3orf4.

Chromosome 5 open reading frame 4 (C5orf4, Accession NP_115761.1) is another GAM94 target gene, herein designated TARGET GENE. C5orf4 BINDING SITE is a target binding site found in the 3' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:1351, to the nucleotide sequence of GAM94 RNA, herein designated GAM RNA, also designated SEQ ID:332.

Another function of GAM94 is therefore inhibition of Chromosome 5 open reading frame 4 (C5orf4, Accession NP_115761.1). Accordingly, utilities of GAM94 include diagnosis, prevention and treatment of diseases and clinical conditions associated with C5orf4.

Chromosome 5 open reading frame 4 (C5orf4, Accession NP_057432.1) is another GAM94 target gene, herein designated TARGET GENE. C5orf4 BINDING SITE is a target binding site found in the 3' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:1351, to the nucleotide sequence of GAM94 RNA, herein designated GAM RNA, also designated SEQ ID:332.

Another function of GAM94 is therefore inhibition of Chromosome 5 open reading frame 4 (C5orf4, Accession NP_057432.1). Accordingly, utilities of GAM94 include diagnosis, prevention and treatment of diseases and clinical conditions associated with C5orf4.

C6orf49 (Accession NP_060071.1) is another GAM94 target gene, herein designated TARGET GENE. C6orf49 BINDING SITE is a target binding site found in the 5' untranslated region of multiple transcripts of mRNA encoded by C6orf49, corresponding to a target binding site such as BINDING SITE I, BINDING SITE II or BINDING SITE III of FIG. 8. Table 4 illustrates the complementarity of the nucleotide sequences of C6orf49 BINDING SITE, designated SEQ ID:5100, to the nucleotide sequence of GAM94 RNA, herein designated GAM RNA, also designated SEQ ID:332.

Another function of GAM94 is therefore inhibition of C6orf49 (Accession NP_060071.1). Accordingly, utilities of GAM94 include diagnosis, prevention and treatment of diseases and clinical conditions associated with C6orf49.

C6orf84 (Accession NP_055710.1) is another GAM94 target gene, herein designated TARGET GENE. C6orf84 BINDING SITE1 and C6orf84 BINDING SITE2 are target binding sites found in untranslated regions of mRNA encoded by C6orf84, corresponding to target binding sites such as BINDING SITE I, BINDING SITE II or BINDING SITE III of FIG. 8. Table 4 illustrates the complementarity of the nucleotide sequences of C6orf84 BINDING SITE1 and C6orf84 BINDING SITE2, designated SEQ ID:5543 and SEQ ID:16947 respectively, to the nucleotide sequence of GAM94 RNA, herein designated GAM RNA, also designated SEQ ID:332.

Another function of GAM94 is therefore inhibition of C6orf84 (Accession NP_055710.1). Accordingly, utilities of GAM94 include diagnosis, prevention and treatment of diseases and clinical conditions associated with C6orf84.

Chromosome 8 open reading frame 17 (C8orf17, Accession NP_064622.1) is another GAM94 target gene, herein designated TARGET GENE. C8orf17 BINDING SITE is a target binding site found in the 5' untranslated region of mRNA encoded by C8orf17, corresponding to a target binding site such as BINDING SITE I, BINDING SITE II or BINDING SITE III of FIG. 8. Table 4 illustrates the complementarity of the nucleotide sequences of C8orf17 BINDING SITE, designated SEQ ID:4088, to the nucleotide sequence of GAM94 RNA, herein designated GAM RNA, also designated SEQ ID:332.

Another function of GAM94 is therefore inhibition of Chromosome 8 open reading frame 17 (C8orf17, Accession NP_064622.1). Accordingly, utilities of GAM94 include diagnosis, prevention and treatment of diseases and clinical conditions associated with C8orf17.

Carbonic anhydrase x (CA10, Accession NP_064563.1) is another GAM94 target gene, herein designated TARGET GENE. CA10 BINDING SITE is a target binding site found in the 3' untranslated region of mRNA encoded by CA10, corresponding to a target binding site such as BINDING SITE I, BINDING SITE II or BINDING SITE III of FIG. 8. Table 4 illustrates the complementarity of the nucleotide sequences of CA10 BINDING SITE, designated SEQ ID:3311, to the nucleotide sequence of GAM94 RNA, herein designated GAM RNA, also designated SEQ ID:332.

Another function of GAM94 is therefore inhibition of Carbonic anhydrase x (CA10, Accession NP_064563.1). Accordingly, utilities of GAM94 include diagnosis, prevention and treatment of diseases and clinical conditions associated with CA10.

Calcitonin receptor (CALCR, Accession NP_001733.1) is another GAM94 target gene, herein designated TARGET GENE. CALCR BINDING SITE is a target binding site found in the 3' untranslated region of mRNA encoded by CALCR, corresponding to a target binding site such as BINDING SITE I, BINDING SITE II or BINDING SITE III of FIG. 8. Table 4 illustrates the complementarity of the nucleotide sequences of CALCR BINDING SITE, designated SEQ ID:16744, to the nucleotide sequence of GAM94 RNA, herein designated GAM RNA, also designated SEQ ID:332.

Another function of GAM94 is therefore inhibition of Calcitonin receptor (CALCR, Accession NP_001733.1), a gene which is a receptor for calcitonin, is mediated by g proteins which activate adenylyl cyclase, and thought to couple to the heterotrimeric guanosine triphosphate-binding protein that is sensitive to cholera toxin. Accordingly, utilities of GAM94 include diagnosis, prevention and treatment of diseases and clinical conditions associated with CALCR.

The function of CALCR has been established by previous studies. Taboulet et al. (1996) had reported the point mutation polymorphism (OMIM Ref. No. T to C) in the 3-prime region of the CALCR gene which induced a pro447- to - leu amino acid change in the third intracellular domain of the protein. This was the same mutation as that subsequently identified by Nakamura et al. (1997) and Masi et al. (1998) and referred to as pro463 to leu; the difference in numbering depended on whether isoform 1 or isoform 2 of the calcitonin receptor, with or without the 16-amino acid insert, was referred to (de Vernejoul, 1999). Taboulet et al. (1998) studied the distribution of these alleles in a cohort of 123 women with no osteoporotic fractures and 92 women who presented with one or more osteoporotic fractures of wrist or vertebrae. They found that bone mineral density of the femoral neck was significantly higher in heterozygous subjects compared with the homozygous leucine and homozygous proline genotypes. Also, a decreased fracture risk was observed in heterozygote subjects. In conclusion, they suggested that polymorphism of CALCR is associated with osteoporotic factors and bone mineral density in a population of postmenopausal women. The heterozygous advantage of the pro/leu subjects could explain their protection against osteoporosis. The distribution of the CALCR alleles in the French population studied by Taboulet et al. (1998) was quite different from that observed by Nakamura et al. (1997) in the Japanese population. In Japan, the proline homozygote was the most frequent genotype (70%), Gorn et al. (1992) cloned a human calcitonin receptor cDNA from a eukaryotic expression library prepared from an ovarian small cell carcinoma cell line. A cell line had been shown to respond to calcitonin (CT, or CALCA; 114130) with increases in content of cellular cAMP. Transfection of this cDNA into COS cells resulted in expression of receptors with high affinity for salmon and human calcitonin. The expressed CALCR was coupled to adenylate cyclase. Northern analysis indicated a single transcript of about 4.2 kb. The cloned cDNA encoded a putative peptide of 490 amino acids with 7 potential transmembrane domains. The amino acid sequence was 73% identical to porcine CALCR, although the human CALCR contained an inset of 16 amino acids between transmembrane domains I and II. CALCR is closely related to the parathyroid hormone receptor (OMIM Ref. No. 168468) and the secretin receptor (OMIM Ref. No. 182098); these receptors comprise a distinct family of G protein-coupled 7-transmembrane domain receptors. A comparison of the human CALCR sequence to protein sequences in databases suggested that the receptor for calcitonin is evolutionarily related to the chemoattractant receptor of the primitive eukaryote Dictyostelium discoideum.

Full details of the abovementioned studies are described in the following publications, the disclosure of which are hereby incorporated by reference:

Gorn, A. H.; Lin, H. Y.; Yamin, M.; Auron, P. E.; Flannery, M. R.; Tapp, D. R.; Manning, C. A.; Lodish, H. F.; Krane, S. M.; Goldring, S. R.: Cloning, characterization, and expression of a human calcitonin receptor from an ovarian carcinoma cell line. J. Clin. Invest. 90:1726-1735, 1992; and Taboulet, J.; Frenkian, M.; Frendo, J. L.; Feingold, N.; Jullienne, A.; de Vernejoul, M. C.: Calcitonin receptor polymorphism is associated with a decreased fracture risk in postmenop.

Further studies establishing the function and utilities of CALCR are found in John Hopkins OMIM database record ID 114131, and in cited publications listed in Table 5, which are hereby incorporated by reference. Calcium/calmodulin-dependent serine protein kinase (maguk family) (CASK, Accession NP_003679.1) is another GAM94 target gene, herein designated TARGET GENE. CASK BINDING SITE is a target binding site found in the 3' untranslated region of mRNA encoded by CASK, corresponding to a target binding site such as BINDING SITE I, BINDING SITE II or BINDING SITE III of FIG. 8. Table 4 illustrates the complementarity of the nucleotide sequences of CASK BINDING SITE, designated SEQ ID:11580, to the nucleotide sequence of GAM94 RNA, herein designated GAM RNA, also designated SEQ ID:332.

Another function of GAM94 is therefore inhibition of Calcium/calmodulin-dependent serine protein kinase (maguk family) (CASK, Accession NP_003679.1), a gene which is a membrane-associated guanylate kinase and binds to actin-binding protein 4.1 and syndecan-2. Accordingly, utilities of GAM94 include diagnosis, prevention and treatment of diseases and clinical conditions associated with CASK.

The function of CASK has been established by previous studies. Cohen et al. (1998) determined that CASK interacts with both syndecan-2 (SDC2; 142460) and the actin-binding band 4.1 protein (OMIM Ref. No. 130500). They suggested that CASK may function as a cytoskeletal membrane scaffold that coordinates signal transduction pathways within the cortical cytoskeleton. To identify binding partners for the guanylate kinase domain of CASK, Hsueh et al. (2000) carried out a yeast 2-hybrid screen of brain complementary DNA libraries, from which TBR1 (OMIM Ref. No. 604616) was isolated. By deletion analysis, the C-terminal region of TBR1 (residues 342 to 681) was found to be necessary and sufficient for association with the guanylate kinase domain of CASK. When coexpressed in COS-7 cells, TBR1 and CASK were readily coprecipitated by antibodies directed against either individual protein. Hsueh et al. (2000) demonstrated that CASK enters the nucleus and binds to a specific DNA sequence (the T element) in a complex with TBR1. CASK acts as a coactivator of TBR1 to induce transcription of T element-containing genes, including reelin, a gene that is essential for cerebrocortical development. On the basis of their findings, Hsueh et al. (2000) concluded that a membrane-associated guanylate kinase, which is usually associated with cell junctions, has a transcription regulation function.

Full details of the abovementioned studies are described in the following publications, the disclosure of which are hereby incorporated by reference:

Cohen, A. R.; Wood, D. F.; Marfatia, S. M.; Walther, Z.; Chishti, A. H.; Anderson, J. M.: Human CASK/LIN-2 binds syndecan-2 and protein 4.1 and localizes to the basolateral membrane of epithelial cells. J. Cell Biol. 142:129-138, 1998; and Hsueh, Y.-P.; Wang, T.-F.; Yang, F.-C.; Sheng, M.: Nuclear transcription and transcription regulation by the membrane-associated guanylate kinase CASK/LIN-2. Nature 404:298-302, 2000.

Further studies establishing the function and utilities of CASK are found in John Hopkins OMIM database record ID 300172, and in cited publications listed in Table 5, which are hereby incorporated by reference. Cyclin i (CCNI, Accession NP_006826.1) is another GAM94 target gene, herein designated TARGET GENE. CCNI BINDING SITE is a target binding site found in the 5' untranslated region of mRNA encoded by CCNI, corresponding to a target binding site such as BINDING SITE I, BINDING SITE II or BINDING SITE III of FIG. 8. Table 4 illustrates the complementarity of the nucleotide sequences of CCNI BINDING SITE, designated SEQ ID:1699, to the nucleotide sequence of GAM94 RNA, herein designated GAM RNA, also designated SEQ ID:332.

Another function of GAM94 is therefore inhibition of Cyclin i (CCNI, Accession NP_006826.1). Accordingly, utilities of GAM94 include diagnosis, prevention and treatment of diseases and clinical conditions associated with CCNI.

CCNL2 (Accession NP_112199.1) is another GAM94 target gene, herein designated TARGET GENE. CCNL2 BINDING SITE is a target binding site found in the 5' untranslated region of mRNA encoded by CCNL2, corresponding to a target binding site such as BINDING SITE I, BINDING SITE II or BINDING SITE III of FIG. 8. Table 4 illustrates the complementarity of the nucleotide sequences of CCNL2 BINDING SITE, designated SEQ ID:9923, to the nucleotide sequence of GAM94 RNA, herein designated GAM RNA, also designated SEQ ID:332.

Another function of GAM94 is therefore inhibition of CCNL2 (Accession NP_112199.1). Accordingly, utilities of GAM94 include diagnosis, prevention and treatment of diseases and clinical conditions associated with CCNL2.

Chemokine (c-c motif) receptor-like 1 (CCRL1, Accession NP_057641.1) is another GAM94 target gene, herein designated TARGET GENE. CCRL1 BINDING SITE is a target binding site found in the 3' untranslated region of multiple transcripts of mRNA encoded by CCRL1, corresponding to a target binding site such as BINDING SITE I, BINDING SITE II or BINDING SITE III of FIG. 8. Table 4 illustrates the complementarity of the nucleotide sequences of CCRL1 BINDING SITE, designated SEQ ID:19245, to the nucleotide sequence of GAM94 RNA, herein designated GAM RNA, also designated SEQ ID:332.

Another function of GAM94 is therefore inhibition of Chemokine (c-c motif) receptor-like 1 (CCRL1, Accession NP_057641.1), a gene which is a G protein-coupled receptor that binds chemokines of the CC subfamily, especially MCP-4, ELC (SCYA19) and TECK (SCYA25). Accordingly, utilities of GAM94 include diagnosis, prevention and treatment of diseases and clinical conditions associated with CCRL1.

The function of CCRL1 has been established by previous studies. Chemokine receptors are members of the 7-transmembrane-spanning, G protein-coupled receptor family that recognize small proteins responsible for the directed migration of specific cell types. Depending on the number of amino acids between the first 2 cysteines of their ligands (they may have more than 1 ligand), chemokine receptors are designated CCR (adjacent cysteines), CXCR (1 amino acid between the cysteines), or CX3CR (3 amino acids between the cysteines). The 'R' designation refers to proteins that not only bind, but also have a signaling function after binding. By searching an EST database for PPR1 homologs, Schweickart et al. (2000) obtained a cDNA encoding CCRL1, which they called CCR11. They initially reported that CCRL1 shares functional similarity to CCR2 (OMIM Ref. No. 601267) because it has a chemotactic response to MCP family chemokines (e.g., MCP2; 602283). However, in an erratum, Schweickart et al. (2000) corrected their functional data and stated that cells expressing CCRL1 do not have a chemotactic response to MCP family chemokines. They confirmed that CCRL1 binds ELC, SLC, and TECK, as reported by Gosling et al. (2000).

Full details of the abovementioned studies are described in the following publications, the disclosure of which are hereby incorporated by reference:

Schweickart, V. L.; Epp, A.; Raport, C. J.; Gray, P. W.: CCR11 is a functional receptor for the monocyte chemoattractant protein family of chemokines. J. Biol. Chem. 275: 9550-9556, 2000. Note: Erratum: J. Biol. Chem. 276:856 only, 2001; and Gosling, J.; Dairaghi, D. J.; Wang, Y.; Hanley, M.; Talbot, D.; Miao, Z.; Schall, T. J.: Cutting edge: identification of a novel chemokine receptor that binds dendritic cell- and T cel.

Further studies establishing the function and utilities of CCRL1 are found in John Hopkins OMIM database record ID 606065, and in cited publications listed in Table 5, which are hereby incorporated by reference. Chemokine (c-c motif) receptor-like 1 (CCRL1, Accession NP_848540.1) is another GAM94 target gene, herein designated TARGET GENE. CCRL1 BINDING SITE is a target binding site found in the 3' untranslated region of multiple transcripts of mRNA encoded by CCRL1, corresponding to a target binding site such as BINDING SITE I, BINDING SITE II or BINDING SITE III of FIG. 8. Table 4 illustrates the complementarity of the nucleotide sequences of CCRL1 BINDING SITE, designated SEQ ID:19245, to the nucleotide sequence of GAM94 RNA, herein designated GAM RNA, also designated SEQ ID:332.

Another function of GAM94 is therefore inhibition of Chemokine (c-c motif) receptor-like 1 (CCRL1, Accession NP_848540.1), a gene which is a G protein-coupled receptor that binds chemokines of the CC subfamily, especially MCP-4, ELC (SCYA19) and TECK (SCYA25). Accordingly, utilities of GAM94 include diagnosis, prevention and treatment of diseases and clinical conditions associated with CCRL1.

The function of CCRL1 has been established by previous studies. Chemokine receptors are members of the 7-transmembrane-spanning, G protein-coupled receptor family that recognize small proteins responsible for the directed migration of specific cell types. Depending on the number of amino acids between the first 2 cysteines of their ligands (they may have more than 1 ligand), chemokine receptors are designated CCR (adjacent cysteines), CXCR (1 amino acid between the cysteines), or CX3CR (3 amino acids between the cysteines). The 'R' designation refers to proteins that not only bind, but also have a signaling function after binding. By searching an EST database for PPR1 homologs, Schweickart et al. (2000) obtained a cDNA encoding CCRL1, which they called CCR11. They initially reported that CCRL1 shares functional similarity to CCR2 (OMIM Ref. No. 601267) because it has a chemotactic response to MCP family chemokines (e.g., MCP2; 602283). However, in an erratum, Schweickart et al. (2000) corrected their functional data and stated that cells expressing CCRL1 do not have a chemotactic response to MCP family chemokines. They confirmed that CCRL1 binds ELC, SLC, and TECK, as reported by Gosling et al. (2000).

Full details of the abovementioned studies are described in the following publications, the disclosure of which are hereby incorporated by reference:

Schweickart, V. L.; Epp, A.; Raport, C. J.; Gray, P. W.: CCR11 is a functional receptor for the monocyte chemoattractant protein family of chemokines. J. Biol. Chem. 275: 9550-9556, 2000. Note: Erratum: J. Biol. Chem. 276:856 only, 2001; and Gosling, J.; Dairaghi, D. J.; Wang, Y.; Hanley, M.; Talbot, D.; Miao, Z.; Schall, T. J.: Cutting edge: identification of a novel chemokine receptor that binds dendritic cell- and T cel.

Further studies establishing the function and utilities of CCRL1 are found in John Hopkins OMIM database record ID 606065, and in cited publications listed in Table 5, which are hereby incorporated by reference. Cd28 antigen (tp44) (CD28, Accession NP_006130.1) is another GAM94 target gene, herein designated TARGET GENE. CD28 BINDING SITE is a target binding site found in the 3' untranslated region of mRNA encoded by CD28, corresponding to a target binding site such as BINDING SITE I, BINDING SITE II or BINDING SITE III of FIG. 8. Table 4 illustrates the complementarity of the nucleotide sequences of CD28 BINDING SITE, designated SEQ ID:5373, to the nucleotide sequence of GAM94 RNA, herein designated GAM RNA, also designated SEQ ID:332.

Another function of GAM94 is therefore inhibition of Cd28 antigen (tp44) (CD28, Accession NP_006130.1), a gene which possibly involved in t-cell activation. Accordingly, utilities of GAM94 include diagnosis, prevention and treatment of diseases and clinical conditions associated with CD28.

The function of CD28 has been established by previous studies. Monoclonal antibodies recognize 3 antigens, CD3 (OMIM Ref. No. 186790), CD2 (OMIM Ref. No. 186990), and CD28 (Tp44), that cause human T cells to proliferate in the presence of phorbol esters. Whereas CD3 appeared to be involved in transduction of the signal generated by antigen binding to the T-cell receptor, the role of the CD2 and CD28 antigens in physiologic proliferation was not understood. Aruffo and Seed (1987) isolated a cDNA clone encoding CD28 by a simple and highly efficient cloning strategy based on transient expression. In COS cells the CD28 encodes a highly glycosylated membrane protein with homology to the immunoglobulin superfamily.

Animal model experiments lend further support to the function of CD28. CD28 undergoes tyrosine phosphorylation after interacting with its ligand, B7 (CD80; 112203). Phosphorylation of tyr173 (tyr170 in mouse) in the cytoplasmic domain of CD28 allows the recruitment of signaling proteins such as phosphatidylinositol 3-kinase (see OMIM Ref. No. PIK3R1; 171833), GRB2 (OMIM Ref. No. 108355), and GADS (GRAP2; 604518) via their SH2 domains. Okkenhaug et al. (2001) reconstituted CD28 knockout mice with transgenes encoding wildtype Cd28 or Cd28 carrying a tyr170- to - phe mutation. Mutant Cd28 did not bind to the SH2 domain of PIK3R1, resulting in diminished protein kinase B (OMIM Ref. No. 164730) activation. Mutant Cd28 was able to prevent the induction of anergy, to promote T-cell proliferation and interleukin-2 (IL2; 147680) secretion, and to provide B-cell help, but was unable to upregulate expression of the prosurvival protein BCLXL (OMIM Ref. No. 600039). The defect in BCLXL upregulation was correlated with increased susceptibility of the T cells to gamma radiation. Okkenhaug et al. (2001) suggested that other tyrosine residues or asn172 may be critical to functions not affected by the tyr170- to - phe mutation.

It is appreciated that the abovementioned animal model for CD28 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aruffo, A.; Seed, B.: Molecular cloning of a CD28 cDNA by a high-efficiency COS cell expression system. Proc. Nat. Acad. Sci. 84:8573-8577, 1987; and Okkenhaug, K.; Wu, L.; Garza, K. M.; La Rose, J.; Khoo, W.; Odermatt, B.; Mak, T. W.; Ohashi, P. S.; Rottapel, R.: A point mutation in CD28 distinguishes proliferative signals from sur.

Further studies establishing the function and utilities of CD28 are found in John Hopkins OMIM database record ID 186760, and in cited publications listed in Table 5, which are hereby incorporated by reference. Cdc14 cell division cycle 14 homolog a (s. cerevisiae) (CDC14A, Accession NP_201570.1) is another GAM94 target gene, herein designated TARGET GENE. CDC14A BINDING SITE is a target binding site found in the 3' untranslated region of multiple transcripts of mRNA encoded by CDC14A, corresponding to a target binding site such as BINDING SITE I, BINDING SITE II or BINDING SITE III of FIG. 8. Table 4 illustrates the complementarity of the nucleotide sequences of CDC14A BINDING SITE, designated SEQ ID:15163, to the nucleotide sequence of GAM94 RNA, herein designated GAM RNA, also designated SEQ ID:332.

Another function of GAM94 is therefore inhibition of Cdc14 cell division cycle 14 homolog a (s. cerevisiae) (CDC14A, Accession NP_201570.1). Accordingly, utilities of GAM94 include diagnosis, prevention and treatment of diseases and clinical conditions associated with CDC14A.

Cell division cycle 25a (CDC25A, Accession NP_001780.1) is another GAM94 target gene, herein designated TARGET GENE. CDC25A BINDING SITE is a target binding site found in the 3' untranslated region of mRNA encoded by CDC25A, corresponding to a target binding site such as BINDING SITE I, BINDING SITE II or BINDING SITE III of FIG. 8. Table 4 illustrates the complementarity of the nucleotide sequences of CDC25A BINDING SITE, designated SEQ ID:910, to the nucleotide sequence of GAM94 RNA, herein designated GAM RNA, also designated SEQ ID:332.

Another function of GAM94 is therefore inhibition of Cell division cycle 25a (CDC25A, Accession NP_001780.1), a gene which is a tyrosine protein phosphatase required for progression of the cell cycle. and therefore may be associated with Oncogenesis. Accordingly, utilities of GAM94 include diagnosis, prevention and treatment of Oncogenesis, and of other diseases and clinical conditions associated with CDC25A.

The function of CDC25A and its association with various diseases and clinical conditions, has been established by previous studies, as described hereinabove with reference to GAM67.1. Cell division cycle 2-like 1 (pitslre proteins) (CDC2L1, Accession NP_277025.1) is another GAM94 target gene, herein designated TARGET GENE. CDC2L1 BINDING SITE1 and CDC2L1 BINDING SITE2 are target binding sites found in untranslated regions of multiple transcripts of mRNA encoded by CDC2L1, corresponding to target binding sites such as BINDING SITE I, BINDING SITE II or BINDING SITE III of FIG. 8. Table 4 illustrates the complementarity of the nucleotide sequences of CDC2L1 BINDING SITE1 and CDC2L1 BINDING SITE2, designated SEQ ID:11887 and SEQ ID:11887 respectively, to the nucleotide sequence of GAM94 RNA, herein designated GAM RNA, also designated SEQ ID:332.

Another function of GAM94 is therefore inhibition of Cell division cycle 2-like 1 (pitslre proteins) (CDC2L1, Accession NP_277025.1), a gene which is a negative regulator of normal cell cycle progression. Accordingly, utilities of GAM94 include diagnosis, prevention and treatment of diseases and clinical conditions associated with CDC2L1.

The function of CDC2L1 has been established by previous studies. Bunnell et al. (1990) identified a human cell division control (CDC)-related protein kinase, p58, that is structurally and functionally related to p34(cdc2) (CDC2; 116940). Abnormal expression of the p58 protein kinase in eukaryotic cells had effects suggesting that it is a negative regulator of normal cell cycle progression. The gene is well conserved evolutionarily. Its expression is regulated during murine embryogenesis, and its activity is coordinately regulated with that of p34(cdc2) during the cell cycle. Eipers et al. (1991) assigned the expressed p58 gene to 1p36 by somatic cell hybrid analysis, in situ hybridization, and nested PCR amplification of microdissected chromosomes. The authors stated that this gene, tentatively symbolized PK58, may be implicated in the pathogenesis of tumors that have deletion in the region of 1p36. Eipers et al. (1992) detailed the complete structure of the CDC2L1 gene including its putative promoter region, transcriptional start sites, exonic sequences, and intron/exon boundary sequences. The gene is 10 kb in size and contains 12 exons and 11 introns.

Full details of the abovementioned studies are described in the following publications, the disclosure of which are hereby incorporated by reference:

Bunnell, B.; Heath, L. S.; Adams, D. E.; Lahti, J. M.; Kidd, V. J.: Elevated expression of a p58 protein kinase leads to changes in the CHO cell cycle. Proc. Nat. Acad. Sci. 87:7467-7471, 1990; and Cornelis, S.; Bruynooghe, Y.; Denecker, G.; Van Huffel, S.; Tinton, S.; Beyaert, R. : Identification and characterization of a novel cell cycle-regulated internal ribosome entry site. Mo.

Further studies establishing the function and utilities of CDC2L1 are found in John Hopkins OMIM database record ID 176873, and in cited publications listed in Table 5, which are hereby incorporated by reference. Cell division cycle 2-like 1 (pitslre proteins) (CDC2L1, Accession NP_277022.1) is another GAM94 target gene, herein designated TARGET GENE. CDC2L1 BINDING SITE1 and CDC2L1 BINDING SITE2 are target binding sites found in untranslated regions of multiple transcripts of mRNA encoded by CDC2L1, corresponding to target binding sites such as BINDING SITE I, BINDING SITE II or BINDING SITE III of FIG. 8. Table 4 illustrates the complementarity of the nucleotide sequences of CDC2L1 BINDING SITE1 and CDC2L1 BINDING SITE2, designated SEQ ID:9626 and SEQ ID:9626 respectively, to the nucleotide sequence of GAM94 RNA, herein designated GAM RNA, also designated SEQ ID:332.

Another function of GAM94 is therefore inhibition of Cell division cycle 2-like 1 (pitslre proteins) (CDC2L1, Accession NP_277022.1), a gene which is a negative regulator of normal cell cycle progression. Accordingly, utilities of GAM94 include diagnosis, prevention and treatment of diseases and clinical conditions associated with CDC2L1.

The function of CDC2L1 has been established by previous studies. Bunnell et al. (1990) identified a human cell division control (CDC)-related protein kinase, p58, that is structurally and functionally related to p34(cdc2) (CDC2; 116940). Abnormal expression of the p58 protein kinase in eukaryotic cells had effects suggesting that it is a negative regulator of normal cell cycle progression. The gene is well conserved evolutionarily. Its expression is regulated during murine embryogenesis, and its activity is coordinately regulated with that of p34(cdc2) during the cell cycle. Eipers et al. (1991) assigned the expressed p58 gene to 1p36 by somatic cell hybrid analysis, in situ hybridization, and nested PCR amplification of microdissected chromosomes. The authors stated that this gene, tentatively symbolized PK58, may be implicated in the pathogenesis of tumors that have deletion in the region of 1p36. Eipers et al. (1992) detailed the complete structure of the CDC2L1 gene including its putative promoter region, transcriptional start sites, exonic sequences, and intron/exon boundary sequences. The gene is 10 kb in size and contains 12 exons and 11 introns.

Full details of the abovementioned studies are described in the following publications, the disclosure of which are hereby incorporated by reference:

Bunnell, B.; Heath, L. S.; Adams, D. E.; Lahti, J. M.; Kidd, V. J.: Elevated expression of a p58 protein kinase leads to changes in the CHO cell cycle. Proc. Nat. Acad. Sci. 87:7467-7471, 1990; and Cornelis, S.; Bruynooghe, Y.; Denecker, G.; Van Huffel, S.; Tinton, S.; Beyaert, R. : Identification and characterization of a novel cell cycle-regulated internal ribosome entry site. Mo.

Further studies establishing the function and utilities of CDC2L1 are found in John Hopkins OMIM database record ID 176873, and in cited publications listed in Table 5, which are hereby incorporated by reference. Cell division cycle 2-like 1 (pitslre proteins) (CDC2L1, Accession NP_277022.1) is another GAM94 target gene, herein designated TARGET GENE. CDC2L1 BINDING SITE1 and CDC2L1 BINDING SITE2 are target binding sites found in untranslated regions of multiple transcripts of mRNA encoded by CDC2L1, corresponding to target binding sites such as BINDING SITE I, BINDING SITE II or BINDING SITE III of FIG. 8. Table 4 illustrates the complementarity of the nucleotide sequences of CDC2L1 BINDING SITE1 and CDC2L1 BINDING SITE2, designated SEQ ID:11887 and SEQ ID:11887 respectively, to the nucleotide sequence of GAM94 RNA, herein designated GAM RNA, also designated SEQ ID:332.

Another function of GAM94 is therefore inhibition of Cell division cycle 2-like 1 (pitslre proteins) (CDC2L1, Accession NP_277022.1), a gene which is a negative regulator of normal cell cycle progression. Accordingly, utilities of GAM94 include diagnosis, prevention and treatment of diseases and clinical conditions associated with CDC2L1.

The function of CDC2L1 has been established by previous studies. Bunnell et al. (1990) identified a human cell division control (CDC)-related protein kinase, p58, that is structurally and functionally related to p34(cdc2) (CDC2; 116940). Abnormal expression of the p58 protein kinase in eukaryotic cells had effects suggesting that it is a negative regulator of normal cell cycle progression. The gene is well conserved evolutionarily. Its expression is regulated during murine embryogenesis, and its activity is coordinately regulated with that of p34(cdc2) during the cell cycle. Eipers et al. (1991) assigned the expressed p58 gene to 1p36 by somatic cell hybrid analysis, in situ hybridization, and nested PCR amplification of microdissected chromosomes. The authors stated that this gene, tentatively symbolized PK58, may be implicated in the pathogenesis of tumors that have deletion in the region of 1p36. Eipers et al. (1992) detailed the complete structure of the CDC2L1 gene including its putative promoter region, transcriptional start sites, exonic sequences, and intron/exon boundary sequences. The gene is 10 kb in size and contains 12 exons and 11 introns.

Full details of the abovementioned studies are described in the following publications, the disclosure of which are hereby incorporated by reference:

Bunnell, B.; Heath, L. S.; Adams, D. E.; Lahti, J. M.; Kidd, V. J.: Elevated expression of a p58 protein kinase leads to changes in the CHO cell cycle. Proc. Nat. Acad. Sci. 87:7467-7471, 1990; and Cornelis, S.; Bruynooghe, Y.; Denecker, G.; Van Huffel, S.; Tinton, S.; Beyaert, R. : Identification and characterization of a novel cell cycle-regulated internal ribosome entry site. Mo.

Further studies establishing the function and utilities of CDC2L1 are found in John Hopkins OMIM database record ID 176873, and in cited publications listed in Table 5, which are hereby incorporated by reference. Cell division cycle 2-like 2 (CDC2L2, Accession NP_277069.1) is another GAM94 target gene, herein designated TARGET GENE. CDC2L2 BINDING SITE1 through CDC2L2 BINDING SITE5 are target binding sites found in untranslated regions of multiple transcripts of mRNA encoded by CDC2L2, corresponding to target binding sites such as BINDING SITE I, BINDING SITE II or BINDING SITE III of FIG. 8. Table 4 illustrates the complementarity of the nucleotide sequences of CDC2L2 BINDING SITE1 through CDC2L2 BINDING SITE5, designated SEQ ID:14067, SEQ ID:2681, SEQ ID:17841, SEQ ID:17841 and SEQ ID:11887 respectively, to the nucleotide sequence of GAM94 RNA, herein designated GAM RNA, also designated SEQ ID:332.

Another function of GAM94 is therefore inhibition of Cell division cycle 2-like 2 (CDC2L2, Accession NP_277069.1). Accordingly, utilities of GAM94 include diagnosis, prevention and treatment of diseases and clinical conditions associated with CDC2L2.

Cell division cycle 2-like 2 (CDC2L2, Accession NP_277074.1) is another GAM94 target gene, herein designated TARGET GENE. CDC2L2 BINDING SITE1 through CDC2L2 BINDING SITE5 are target binding sites found in untranslated regions of multiple transcripts of mRNA encoded by CDC2L2, corresponding to target binding sites such as BINDING SITE I, BINDING SITE II or BINDING SITE III of FIG. 8. Table 4 illustrates the complementarity of the nucleotide sequences of CDC2L2 BINDING SITE1 through CDC2L2 BINDING SITE5, designated SEQ ID:9626, SEQ ID:9626, SEQ ID:2681, SEQ ID:11887 and SEQ ID:14067 respectively, to the nucleotide sequence of GAM94 RNA, herein designated GAM RNA, also designated SEQ ID:332.

Another function of GAM94 is therefore inhibition of Cell division cycle 2-like 2 (CDC2L2, Accession NP_277074.1).

Accordingly, utilities of GAM94 include diagnosis, prevention and treatment of diseases and clinical conditions associated with CDC2L2.

CDGAP (Accession XP_291085.1) is another GAM94 target gene, herein designated TARGET GENE. CDGAP BINDING SITE is a target binding site found in the 3' untranslated region of mRNA encoded by CDGAP, corresponding to a target binding site such as BINDING SITE I, BINDING SITE II or BINDING SITE III of FIG. 8. Table 4 illustrates the complementarity of the nucleotide sequences of CDGAP BINDING SITE, designated SEQ ID:657, to the nucleotide sequence of GAM94 RNA, herein designated GAM RNA, also designated SEQ ID:332.

Another function of GAM94 is therefore inhibition of CDGAP (Accession XP_291085.1). Accordingly, utilities of GAM94 include diagnosis, prevention and treatment of diseases and clinical conditions associated with CDGAP.

Cadherin 1, type 1, e-cadherin (epithelial) (CDH1, Accession NP_004351.1) is another GAM94 target gene, herein designated TARGET GENE. CDH1 BINDING SITE is a target binding site found in the 3' untranslated region of mRNA encoded by CDH1, corresponding to a target binding site such as BINDING SITE I, BINDING SITE II or BINDING SITE III of FIG. 8. Table 4 illustrates the complementarity of the nucleotide sequences of CDH1 BINDING SITE, designated SEQ ID:15908, to the nucleotide sequence of GAM94 RNA, herein designated GAM RNA, also designated SEQ ID:332.

Another function of GAM94 is therefore inhibition of Cadherin 1, type 1, e-cadherin (epithelial) (CDH1, Accession NP_004351.1) . Accordingly, utilities of GAM94 include diagnosis, prevention and treatment of diseases and clinical conditions associated with CDH1.

Cadherin 18, type 2 (CDH18, Accession NP_004925.1) is another GAM94 target gene, herein designated TARGET GENE. CDH18 BINDING SITE is a target binding site found in the 5' untranslated region of mRNA encoded by CDH18, corresponding to a target binding site such as BINDING SITE I, BINDING SITE II or BINDING SITE III of FIG. 8. Table 4 illustrates the complementarity of the nucleotide sequences of CDH18 BINDING SITE, designated SEQ ID:14157, to the nucleotide sequence of GAM94 RNA, herein designated GAM RNA, also designated SEQ ID:332.

Another function of GAM94 is therefore inhibition of Cadherin 18, type 2 (CDH18, Accession NP_004925.1), a gene which mediates neural cell-cell interactions and may play an important role in neural development. Accordingly, utilities of GAM94 include diagnosis, prevention and treatment of diseases and clinical conditions associated with CDH18.

The function of CDH18 has been established by previous studies. To isolate cDNAs encoding proteins that interact with beta-catenin, Shibata et al. (1997) screened a human adult brain cDNA expression library with recombinant beta-catenin protein. They identified a cDNA with high sequence homology to cadherin molecules and designated it cadherin-14 (CDH14), which has been renamed cadherin-18 (CDH18). Comparison of the deduced 790-amino acid CDH18 sequence with the sequences of other cadherins revealed that CDH18 is more closely related to type 2 cadherins than to type 1 cadherins, with the N-terminal regions of CDH18 and CDH12 (OMIM Ref. No. 600562) showing particularly high amino acid similarity. Northern blot analysis of human tissues detected 9.7-, 5.5-, and 3.9-kb CDH18 transcripts specifically in the central nervous system; CDH18 expression was also found in small-cell lung carcinoma cell lines, which have neuroectodermal cell phenotypes Full details of the abovementioned studies are described in the following publications, the disclosure of which are hereby incorporated by reference:

Chalmers, I. J.; Hofler, H.; Atkinson, M. J.: Mapping of a cadherin gene cluster to a region of chromosome 5 subject to frequent allelic loss in carcinoma. Genomics 57:160-163, 1999; and Shibata, T.; Shimoyama, Y.; Gotoh, M.; Hirohashi, S.: Identification of human cadherin-14, a novel neurally specific type II cadherin, by protein interaction cloning. J. Biol. Chem. 2.

Further studies establishing the function and utilities of CDH18 are found in John Hopkins OMIM database record ID 603019, and in cited publications listed in Table 5, which are hereby incorporated by reference. Cyclin-dependent kinase inhibitor 2c (p18, inhibits cdk4) (CDKN2C, Accession NP_523240.1) is another GAM94 target gene, herein designated TARGET GENE. CDKN2C BINDING SITE is a target binding site found in the 5' untranslated region of multiple transcripts of mRNA encoded by CDKN2C, corresponding to a target binding site such as BINDING SITE I, BINDING SITE II or BINDING SITE III of FIG. 8. Table 4 illustrates the complementarity of the nucleotide sequences of CDKN2C BINDING SITE, designated SEQ ID:5149, to the nucleotide sequence of GAM94 RNA, herein designated GAM RNA, also designated SEQ ID:332.

Another function of GAM94 is therefore inhibition of Cyclin-dependent kinase inhibitor 2c (p18, inhibits cdk4) (CDKN2C, Accession NP_523240.1), a gene which associate with cyclin-CDK complexes or CDKs alone and inhibit their activity and therefore may be associated with Breast tumors. Accordingly, utilities of GAM94 include diagnosis, prevention and treatment of Breast tumors, and of other diseases and clinical conditions associated with CDKN2C.

The function of CDKN2C has been established by previous studies. Cyclin- dependent kinase inhibitors (CKIs) are a group of low molecular weight proteins that associate with cyclin-CDK complexes or CDKs alone and inhibit their activity. Members of the INK4 family of CKIs specifically bind and inhibit CDK4 (OMIM Ref. No. 123829) and CDK6 (OMIM Ref. No. 603368), thereby preventing cyclin D-dependent phosphorylation of RB1 (OMIM Ref. No. 180200). See INK4D (OMIM Ref. No. 600927). By using a yeast 2-hybrid screen to search for CDK6-interacting proteins, Guan et al. (1994) isolated a partial cDNA encoding a protein that they designated p18 based on its molecular mass of 18 kD. They used the partial cDNA to screen a HeLa cell library and recovered additional cDNAs corresponding to the entire p18 coding region. Sequence analysis revealed that the predicted 168-amino acid p18 protein shares 38% and 42% sequence identity with p16/INK4A (OMIM Ref. No. 600160) and p14/INK4B (OMIM Ref. No. 600431), respectively. Like p14 and p16, p18 contains an ankyrin repeat domain. Both in vivo and in vitro, p18 interacted strongly with CDK6 and weakly with CDK4, but not with the other CDKs tested. Recombinant p18 inhibited the kinase activity of cyclin D-CDK6 in vitro. Ectopic expression of either p16 or p18 suppressed the growth of human cells in a manner that appears to correlate with the presence of a wildtype RB1 function. Using Northern blot analysis, Guan et al. (1994) found that p18 is expressed as multiple transcripts in various human tissues, with the strongest expression in skeletal muscle. Blais et al. (1998) determined that the p18, or INK4C, gene contains 3 exons and spans more than 7.5 kb. Lapointe et al. (1996) identified a single amino acid substitution (ala72 to pro; A72P) in BT- 20 human breast cancer cells that abrogated the ability of p18 to interact with CDK6 and to suppress cell growth. These authors suggested that p18 inactivation by point mutations may contribute to deregulated growth control in certain cell lines and/or tumors. Blais et al. (1998) found this p18 variant in 3 of 35 breast tumors examined, and suggested that it may be a polymorphism.

Full details of the abovementioned studies are described in the following publications, the disclosure of which are hereby incorporated by reference:

Blais, A.; Labrie, Y.; Pouliot, F.; Lachance, Y.; Labrie, C.: Structure of the gene encoding the human cyclin-dependent kinase inhibitor p18 and mutational analysis in breast cancer. Biochem. Biophys. Res. Commun. 247:146-153, 1998; and Lapointe, J.; Lachance, Y.; Labrie, Y.; Labrie, C.: A p18 mutant defective in CDK6 binding in human breast cancer cells. Cancer Res. 56:4586-4589, 1996.

Further studies establishing the function and utilities of CDKN2C are found in John Hopkins OMIM database record ID 603369, and in cited publications listed in Table 5, which are hereby incorporated by reference. CDT6 (Accession NP_066969.1) is another GAM94 target gene, herein designated TARGET GENE. CDT6 BINDING SITE is a target binding site found in the 5' untranslated region of mRNA encoded by CDT6, corresponding to a target binding site such as BINDING SITE I, BINDING SITE II or BINDING SITE III of FIG. 8. Table 4 illustrates the complementarity of the nucleotide sequences of CDT6 BINDING SITE, designated SEQ ID:7162, to the nucleotide sequence of GAM94 RNA, herein designated GAM RNA, also designated SEQ ID:332.

Another function of GAM94 is therefore inhibition of CDT6 (Accession NP_066969.1). Accordingly, utilities of GAM94 include diagnosis, prevention and treatment of diseases and clinical conditions associated with CDT6.

CGI-104 (Accession NP_057230.1) is another GAM94 target gene, herein designated TARGET GENE. CGI-104 BINDING SITE is a target binding site found in the 5' untranslated region of mRNA encoded by CGI-104, corresponding to a target binding site such as BINDING SITE I, BINDING SITE II or BINDING SITE III of FIG. 8. Table 4 illustrates the complementarity of the nucleotide sequences of CGI-104 BINDING SITE, designated SEQ ID:18497, to the nucleotide sequence of GAM94 RNA, herein designated GAM RNA, also designated SEQ ID:332.

Another function of GAM94 is therefore inhibition of CGI-104 (Accession NP_057230.1). Accordingly, utilities of GAM94 include diagnosis, prevention and treatment of diseases and clinical conditions associated with CGI-104.

CGI-85 (Accession NP_057112.2) is another GAM94 target gene, herein designated TARGET GENE. CGI-85 BINDING SITE is a target binding site found in the 3' untranslated region of multiple transcripts of mRNA encoded by CGI-85, corresponding to a target binding site such as BINDING SITE I, BINDING SITE II or BINDING SITE III of FIG. 8. Table 4 illustrates the complementarity of the nucleotide sequences of CGI-85 BINDING SITE, designated SEQ ID:5217, to the nucleotide sequence of GAM94 RNA, herein designated GAM RNA, also designated SEQ ID:332.

Another function of GAM94 is therefore inhibition of CGI-85 (Accession NP_057112.2). Accordingly, utilities of GAM94 include diagnosis, prevention and treatment of diseases and clinical conditions associated with CGI-85.

Chromodomain helicase dna binding protein 1-like (CHD1L, Accession NP_078844.1) is another GAM94 target gene, herein designated TARGET GENE. CHD1L BINDING SITE is a target binding site found in the 3' untranslated region of mRNA encoded by CHD1L, corresponding to a target binding site such as BINDING SITE I, BINDING SITE II or BINDING SITE III of FIG. 8. Table 4 illustrates the complementarity of the nucleotide sequences of CHD1L BINDING SITE, designated SEQ ID:18799, to the nucleotide sequence of GAM94 RNA, herein designated GAM RNA, also designated SEQ ID:332.

Another function of GAM94 is therefore inhibition of Chromodomain helicase dna binding protein 1-like (CHD1L, Accession NP_078844.1). Accordingly, utilities of GAM94 include diagnosis, prevention and treatment of diseases and clinical conditions associated with CHD1L.

Cholinergic receptor, muscarinic 5 (CHRM5, Accession NP_036257.1) is another GAM94 target gene, herein designated TARGET GENE. CHRM5 BINDING SITE is a target binding site found in the 5' untranslated region of mRNA encoded by CHRM5, corresponding to a target binding site such as BINDING SITE I, BINDING SITE II or BINDING SITE III of FIG. 8. Table 4 illustrates the complementarity of the nucleotide sequences of CHRM5 BINDING SITE, designated SEQ ID:18498, to the nucleotide sequence of GAM94 RNA, herein designated GAM RNA, also designated SEQ ID:332.

Another function of GAM94 is therefore inhibition of Cholinergic receptor, muscarinic 5 (CHRM5, Accession NP_036257.1). Accordingly, utilities of GAM94 include diagnosis, prevention and treatment of diseases and clinical conditions associated with CHRM5.

Cholinergic receptor, nicotinic, beta polypeptide 2 (neuronal) (CHRNB2, Accession NP_000739.1) is another GAM94 target gene, herein designated TARGET GENE. CHRNB2 BINDING SITE is a target binding site found in the 3' untranslated region of mRNA encoded by CHRNB2, corresponding to a target binding site such as BINDING SITE I, BINDING SITE II or BINDING SITE III of FIG. 8. Table 4 illustrates the complementarity of the nucleotide sequences of CHRNB2 BINDING SITE, designated SEQ ID:17099, to the nucleotide sequence of GAM94 RNA, herein designated GAM RNA, also designated SEQ ID:332.

Another function of GAM94 is therefore inhibition of Cholinergic receptor, nicotinic, beta polypeptide 2 (neuronal) (CHRNB2, Accession NP_000739.1), a gene which mediates fast signal transmission at synapses. and therefore is associated with Epilepsy, nocturnal frontal lobe, type 3. Accordingly, utilities of GAM94 include diagnosis, prevention and treatment of Epilepsy, nocturnal frontal lobe, type 3, and of other diseases and clinical conditions associated with CHRNB2.

The function of CHRNB2 and its association with various diseases and clinical conditions, has been established by previous studies, as described hereinabove with reference to GAM63.1. Carbohydrate (keratan sulfate gal-6) sulfotransferase 1 (CHST1, Accession NP_003645.1) is another GAM94 target gene, herein designated TARGET GENE. CHST1 BINDING SITE is a target binding site found in the 5' untranslated region of mRNA encoded by CHST1, corresponding to a target binding site such as BINDING SITE I, BINDING SITE II or BINDING SITE III of FIG. 8. Table 4 illustrates the complementarity of the nucleotide sequences of CHST1 BINDING SITE, designated SEQ ID:11016, to the nucleotide sequence of GAM94 RNA, herein designated GAM RNA, also designated SEQ ID:332.

Another function of GAM94 is therefore inhibition of Carbohydrate (keratan sulfate gal-6) sulfotransferase 1 (CHST1, Accession NP_003645.1), a gene which may play a role in keratan sulfate biosynthesis in brain and cornea. Accordingly, utilities of GAM94 include diagnosis, prevention and treatment of diseases and clinical conditions associated with CHST1.

The function of CHST1 and its association with various diseases and clinical conditions, has been established by previous studies, as described hereinabove with reference to GAM63.1. Chemokine-like factor super family 6 (CKLFSF6, Accession NP_060271.1) is another GAM94 target gene, herein designated TARGET GENE. CKLFSF6 BINDING SITE1 and CKLFSF6 BINDING SITE2 are target binding sites found in untranslated regions of mRNA encoded by CKLFSF6, corresponding to target binding sites such as BINDING SITE I, BINDING SITE II or BINDING SITE III of FIG. 8. Table 4 illustrates the complementarity of the nucleotide sequences of CKLFSF6 BINDING SITE1 and CKLFSF6 BINDING SITE2, designated SEQ ID:1874 and SEQ ID:14312 respectively, to the nucleotide sequence of GAM94 RNA, herein designated GAM RNA, also designated SEQ ID:332.

Another function of GAM94 is therefore inhibition of Chemokine-like factor super family 6 (CKLFSF6, Accession NP_060271.1). Accordingly, utilities of GAM94 include diagnosis, prevention and treatment of diseases and clinical conditions associated with CKLFSF6.

Chloride channel 4 (CLCN4, Accession NP_001821.1) is another GAM94 target gene, herein designated TARGET GENE. CLCN4 BINDING SITE is a target binding site found in the 3' untranslated region of mRNA encoded by CLCN4, corresponding to a target binding site such as BINDING SITE I, BINDING SITE II or BINDING SITE III of FIG. 8. Table 4 illustrates the complementarity of the nucleotide sequences of CLCN4 BINDING SITE, designated SEQ ID:12401, to the nucleotide sequence of GAM94 RNA, herein designated GAM RNA, also designated SEQ ID:332.

Another function of GAM94 is therefore inhibition of Chloride channel 4 (CLCN4, Accession NP_001821.1), a gene which is regulation of cell volume; membrane potential stabilization, signal transduction and transepithelial transport. Accordingly, utilities of GAM94 include diagnosis, prevention and treatment of diseases and clinical conditions associated with CLCN4.

The function of CLCN4 has been established by previous studies. In the course of constructing a comprehensive transcript map of the Xp22.3 region, van Slegtenhorst et al. (1994) identified an evolutionarily conserved CpG island and cloned the corresponding gene. The predicted 760-amino acid protein contained 12 hydrophobic domains and shared sequence and structural similarities with all the previously isolated members of the family of voltage-gated chloride channels. The gene, termed CLCN4, for chloride channel 4, contained at least 10 exons spanning 60 to 80 kb. In contrast with most genes isolated from the Xp22.3 region, CLCN4 did not share homology with the Y chromosome, but was conserved in mouse and hamster. Expression studies demonstrated a 7.5-kb transcript that is particularly abundant in skeletal muscle and also detectable in brain and heart. Thus, this gene encodes a newly identified voltage-gated chloride channel. Rugarli et al. (1995) found that in the wild Mediterranean mouse Mus spretus, the Cln4 gene maps to the X chromosome as it does in the human; however, in the inbred strain of laboratory mouse C57BL/6J, they found that it maps to chromosome 7. Findings indicated that a recent evolutionary rearrangement occurred in the mouse sex chromosomes very close to the pseudoautosomal region (PAR). The data were considered molecular evidence for a major divergence near the pseudoautosomal region consistent with the hypothesis that hybrid sterility in these species results from abnormal pairing of sex chromosomes during male meiosis. They found that Cln is the closest cloned gene to the M. spretus pseudoautosomal region and the most distal locus displaying a conserved position between the human and this mouse locus. The X-inactivation status of the locus in M. spretus was demonstrated by the finding that in F1 females from a cross between M. spretus and an inbred- derived mouse carrying the t(X;16)16H balanced translocation, it was always the normal M. spretus X chromosome that was inactive in adult tissues. This completely skewed X inactivation provided a system for assaying expression of genes from the inactive X chromosome once the parental alleles could be distinguished. Palmer et al. (1995) likewise found what they referred to as 'contravention of Ohno's law' in the course of mapping a cDNA mouse Cln4 in an interspecific backcross. This was the first example of a gene unique to the X chromosome in 1 eutherian species but autosomal in another. The consequence of this chromosomal rearrangement was that the gene was lost by mendelian segregation in a subset of the male progeny of a (C57BL/6 x Mus spretus) x Mus spretus backcross.

Full details of the abovementioned studies are described in the following publications, the disclosure of which are hereby incorporated by reference:

Rugarli, E. I.; Adler, D. A.; Borsani, G.; Tsuchiy, K.; Franco, B.; Hauge, X.; Disteche, C.; Chapman, V.; Ballabio, A.: Different chromosomal localization of the Clcn4 gene in Mus spretus and C57BL/6J mice. Nature Genet. 10:466-471, 1995; and van Slegtenhorst, M. A.; Bassi, M. T.; Borsani, G.; Wapenaar, M. C.; Ferrero, G. B.; de Conciliis, L.; Rugarli, E. I.; Grillo, A.; Franco, B.; Zoghbi, H. Y.; Ballabio, A.: A gene from.

Further studies establishing the function and utilities of CLCN4 are found in John Hopkins OMIM database record ID 302910, and in cited publications listed in Table 5, which are hereby incorporated by reference. Claudin 14 (CLDN14, Accession NP_652763.1) is another GAM94 target gene, herein designated TARGET GENE. CLDN14 BINDING SITE is a target binding site found in the 5' untranslated region of multiple transcripts of mRNA encoded by CLDN14, corresponding to a target binding site such as BINDING SITE I, BINDING SITE II or BINDING SITE III of FIG. 8. Table 4 illustrates the complementarity of the nucleotide sequences of CLDN14 BINDING SITE, designated SEQ ID:5051, to the nucleotide sequence of GAM94 RNA, herein designated GAM RNA, also designated SEQ ID:332.

Another function of GAM94 is therefore inhibition of Claudin 14 (CLDN14, Accession NP_652763.1), a gene which provides structural support for the auditory neuroepithelium. and therefore is associated with Deafness. Accordingly, utilities of GAM94 include diagnosis, prevention and treatment of Deafness, and of other diseases and clinical conditions associated with CLDN14.

The function of CLDN14 has been established by previous studies. By sequencing the long arm of chromosome 21, Hattori et al. (2000) identified the CLDN14 gene. Using RACE, Wilcox et al. (2001) amplified a cDNA encoding CLDN14 from human liver cDNA. Comparison of the genomic chromosome 21 sequence with the cDNA sequence indicated that the CLDN14 gene contains 3 exons, and the authors identified 2 splice isoforms, one with and the other without exon 2. Northern blot analysis detected CLDN14 expression in liver and kidney. In situ hybridization and immunofluorescence studies revealed mouse Cldn14 expression in the sensory epithelium of the organ of Corti. By sequence analysis of chromosome 21q, Hattori et al. (2000) mapped the CLDN14 gene to 21q22.3. Wilcox et al. (2001) showed that the profound, congenital, recessive deafness segregating in 2 Pakistani families, PKSN6 and PKSR9a, defines a novel locus, DFNB29, on 21q22.1. These families supported maximum 2-point lod scores of 6.7 at theta of zero for the marker D21S1252 and 6.1 at theta of zero for marker D21S2079, respectively. Critical recombinants and homozygosity for polymorphic markers defined a DFNB29 linkage interval of 228,600 bp on 21q22.1. Since the CLDN14 gene maps within the critical interval and was considered a good candidate, Wilcox et al. (2001) examined the sequence of its single protein-coding exon. In affected individuals of family PKSN6, they identified a homozygous 1-bp deletion (398delT; 605608.0001), while in family PKSR9a they identified a val85- to - asp missense mutation (605608.0002). Val85 is conserved among 12 of the 20 claudins, while isoleucine is present among 5 claudins, and the remaining 3 claudins have either a cysteine or a proline at this position of the consensus molecule. Aspartic acid at position 85 was predicted to affect hydrophobicity and disrupt the predicted secondary structures in transmembrane domain 2.

Full details of the abovementioned studies are described in the following publications, the disclosure of which are hereby incorporated by reference:

Hattori, M.; Fujiyama, A.; Taylor, T. D.; Watanabe, H.; Yada, T.; Park, H.-S.; Toyoda, A.; Ishii, K.; Totoki, Y.; Choi, D.-K.; Groner, Y.; Soeda, E.; and 52 others: The DNA sequence of human chromosome 21. Nature 405:311-319, 2000. Note: Erratum: Nature:407:110 only, 2000; and Wilcox, E. R.; Burton, Q. L.; Naz, S.; Riazuddin, S.; Smith, T. N.; Ploplis, B.; Belyatseva, I.; Ben-Yosef, T.; Liburd, N. A.; Morell, R. J.; Kachar, B.; Wu, D. K.; Griffith, A. J.; Ri.

Further studies establishing the function and utilities of CLDN14 are found in John Hopkins OMIM database record ID 605608, and in cited publications listed in Table 5, which are hereby incorporated by reference. Cdc-like kinase 3 (CLK3, Accession NP_001283.1) is another GAM94 target gene, herein designated TARGET GENE. CLK3 BINDING SITE is a target binding site found in the 3' untranslated region of multiple transcripts of mRNA encoded by CLK3, corresponding to a target binding site such as BINDING SITE I, BINDING SITE II or BINDING SITE III of FIG. 8. Table 4 illustrates the complementarity of the nucleotide sequences of CLK3 BINDING SITE, designated SEQ ID:18588, to the nucleotide sequence of GAM94 RNA, herein designated GAM RNA, also designated SEQ ID:332.

Another function of GAM94 is therefore inhibition of Cdc-like kinase 3 (CLK3, Accession NP_001283.1). Accordingly, utilities of GAM94 include diagnosis, prevention and treatment of diseases and clinical conditions associated with CLK3.

Cyclin m1 (CNNM1, Accession NP_065081.1) is another GAM94 target gene, herein designated TARGET GENE. CNNM1 BINDING SITE1 and CNNM1 BINDING SITE2 are target binding sites found in untranslated regions of mRNA encoded by CNNM1, corresponding to target binding sites such as BINDING SITE I, BINDING SITE II or BINDING SITE III of FIG. 8. Table 4 illustrates the complementarity of the nucleotide sequences of CNNM1 BINDING SITE1 and CNNM1 BINDING SITE2, designated SEQ ID:1194 and SEQ ID:7736 respectively, to the nucleotide sequence of GAM94 RNA, herein designated GAM RNA, also designated SEQ ID:332.

Another function of GAM94 is therefore inhibition of Cyclin m1 (CNNM1, Accession NP_065081.1). Accordingly, utilities of GAM94 include diagnosis, prevention and treatment of diseases and clinical conditions associated with CNNM1.

Ccr4-not transcription complex, subunit 4 (CNOT4, Accession NP_037448.1) is another GAM94 target gene, herein designated TARGET GENE. CNOT4 BINDING SITE is a target binding site found in the 3' untranslated region of mRNA encoded by CNOT4, corresponding to a target binding site such as BINDING SITE I, BINDING SITE II or BINDING SITE III of FIG. 8. Table 4 illustrates the complementarity of the nucleotide sequences of CNOT4 BINDING SITE, designated SEQ ID:9013, to the nucleotide sequence of GAM94 RNA, herein designated GAM RNA, also designated SEQ ID:332.

Another function of GAM94 is therefore inhibition of Ccr4-not transcription complex, subunit 4 (CNOT4, Accession NP_037448.1). Accordingly, utilities of GAM94 include diagnosis, prevention and treatment of diseases and clinical conditions associated with CNOT4.

Cannabinoid receptor 2 (macrophage) (CNR2, Accession NP_001832.1) is another GAM94 target gene, herein designated TARGET GENE. CNR2 BINDING SITE is a target binding site found in the 5' untranslated region of mRNA encoded by CNR2, corresponding to a target binding site such as BINDING SITE I, BINDING SITE II or BINDING SITE III of FIG. 8. Table 4 illustrates the complementarity of the nucleotide sequences of CNR2 BINDING SITE, designated SEQ ID:15470, to the nucleotide sequence of GAM94 RNA, herein designated GAM RNA, also designated SEQ ID:332.

Another function of GAM94 is therefore inhibition of Cannabinoid receptor 2 (macrophage) (CNR2, Accession NP_001832.1). Accordingly, utilities of GAM94 include diagnosis, prevention and treatment of diseases and clinical conditions associated with CNR2.

Collagen, type xvii, alpha 1 (COL17A1, Accession NP_570134.1) is another GAM94 target gene, herein designated TARGET GENE. COL17A1 BINDING SITE is a target binding site found in the 3' untranslated region of multiple transcripts of mRNA encoded by COL17A1, corresponding to a target binding site such as BINDING SITE I, BINDING SITE II or BINDING SITE III of FIG. 8. Table 4 illustrates the complementarity of the nucleotide sequences of COL17A1 BINDING SITE, designated SEQ ID:4162, to the nucleotide sequence of GAM94 RNA, herein designated GAM RNA, also designated SEQ ID:332.

Another function of GAM94 is therefore inhibition of Collagen, type xvii, alpha 1 (COL17A1, Accession NP_570134.1). Accordingly, utilities of GAM94 include diagnosis, prevention and treatment of diseases and clinical conditions associated with COL17A1.

Collagen, type xvii, alpha 1 (COL17A1, Accession NP_000485.2) is another GAM94 target gene, herein designated TARGET GENE. COL17A1 BINDING SITE is a target binding site found in the 3' untranslated region of multiple transcripts of mRNA encoded by COL17A1, corresponding to a target binding site such as BINDING SITE I, BINDING SITE II or BINDING SITE III of FIG. 8. Table 4 illustrates the complementarity of the nucleotide sequences of COL17A1 BINDING SITE, designated SEQ ID:4162, to the nucleotide sequence of GAM94 RNA, herein designated GAM RNA, also designated SEQ ID:332.

Another function of GAM94 is therefore inhibition of Collagen, type xvii, alpha 1 (COL17A1, Accession NP_000485.2). Accordingly, utilities of GAM94 include diagnosis, prevention and treatment of diseases and clinical conditions associated with COL17A1.

Collagen, type xix, alpha 1 (COL19A1, Accession NP_001849.1) is another GAM94 target gene, herein designated TARGET GENE. COL19A1 BINDING SITE is a target binding site found in the 3' untranslated region of mRNA encoded by COL19A1, corresponding to a target binding site such as BINDING SITE I, BINDING SITE II or BINDING SITE III of FIG. 8. Table 4 illustrates the complementarity of the nucleotide sequences of COL19A1 BINDING SITE, designated SEQ ID:19736, to the nucleotide sequence of GAM94 RNA, herein designated GAM RNA, also designated SEQ ID:332.

Another function of GAM94 is therefore inhibition of Collagen, type xix, alpha 1 (COL19A1, Accession NP_001849.1), a gene which may act as a cross-bridge between fibrils and other extracellular matrix molecules. Accordingly, utilities of GAM94 include diagnosis, prevention and treatment of diseases and clinical conditions associated with COL19A1.

The function of COL19A1 has been established by previous studies. The collagens are a large superfamily of genes that include a number of subgroups. One such group is composed of fibrillar associated collagens with interrupted triple helices (FACIT) and includes collagen types IX (e.g., 120210), XII (e.g., 120320), XIV (e.g., 120324), and XVI (e.g., 120326). Members of this group have common structural features, including short stretches of collagenous domains interrupted by non-collagenous regions. These, in turn, form functional units that serve to produce adhesion to the fibrils, provide a rigid arm that projects from the fibril and provide a point of interaction with other matrix components Yoshioka et al. (1992) mapped the COL19A1 gene to 6q12-q14, where the COL9A1 gene (OMIM Ref. No. 120210) has been mapped. Myers et al. (1993) mapped the COL19A1 gene to chromosome 6 by analysis of a panel of somatic cell hybrids. By FISH, Gerecke et al. (1997) mapped the COL19A1 gene to 6q12-q13. Khaleduzzaman et al. (1997) showed that the mouse Col19a1 gene is located on chromosome 1A3, where Col9a1 had also been mapped. They suggested that COL19A1 and COL9A1, and their murine counterparts, were duplicated from the same ancestral gene of the FACIT family Full details of the abovementioned studies are described in the following publications, the disclosure of which are hereby incorporated by reference:

Yoshioka, H.; Zhang, H.; Ramirez, F.; Mattei, M.-G.; Moradi-Ameli, M.; van der Rest, M.; Gordon, M. K.: Synteny between the loci for a novel FACIT-like collagen (D6S228E) and alpha 1(IX) collagen (COL9A1) on 6q12-q14 in humans. Genomics 13:884-886, 1992; and Yoshioka, H.; Zhang, H.; Ramirez, F.; Mattei, M.-G.; Moradi-Ameli, M.; van der Rest, M.; Gordon, M. K.: Synteny between the loci for a novel FACIT-like collagen (D6S228E) and alpha 1(IX.

Further studies establishing the function and utilities of COL19A1 are found in John Hopkins OMIM database record ID 120165, and in cited publications listed in Table 5, which are hereby incorporated by reference. COL22A1 (Accession XP_291257.2) is another GAM94 target gene, herein designated TARGET GENE. COL22A1 BINDING SITE is a target binding site found in the 3' untranslated region of mRNA encoded by COL22A1, corresponding to a target binding site such as BINDING SITE I, BINDING SITE II or BINDING SITE III of FIG. 8. Table 4 illustrates the complementarity of the nucleotide sequences of COL22A1 BINDING SITE, designated SEQ ID:17151, to the nucleotide sequence of GAM94 RNA, herein designated GAM RNA, also designated SEQ ID:332.

Another function of GAM94 is therefore inhibition of COL22A1 (Accession XP_291257.2). Accordingly, utilities of GAM94 include diagnosis, prevention and treatment of diseases and clinical conditions associated with COL22A1.

Crm, cramped-like (drosophila) (CRAMP1L, Accession XP_034570.4) is another GAM94 target gene, herein designated TARGET GENE. CRAMP1L BINDING SITE is a target binding site found in the 3' untranslated region of mRNA encoded by CRAMP1L, corresponding to a target binding site such as BINDING SITE I, BINDING SITE II or BINDING SITE III of FIG. 8. Table 4 illustrates the complementarity of the nucleotide sequences of CRAMP1L BINDING SITE, designated SEQ ID:17653, to the nucleotide sequence of GAM94 RNA, herein designated GAM RNA, also designated SEQ ID:332.

Another function of GAM94 is therefore inhibition of Crm, cramped-like (drosophila) (CRAMP1L, Accession XP_034570.4). Accordingly, utilities of GAM94 include diagnosis, prevention and treatment of diseases and clinical conditions associated with CRAMP1L.

CREG2 (Accession NP_722578.1) is another GAM94 target gene, herein designated TARGET GENE. CREG2 BINDING SITE is a target binding site found in the 3' untranslated region of mRNA encoded by CREG2, corresponding to a target binding site such as BINDING SITE I, BINDING SITE II or BINDING SITE III of FIG. 8. Table 4 illustrates the complementarity of the nucleotide sequences of CREG2 BINDING SITE, designated SEQ ID:5574, to the nucleotide sequence of GAM94 RNA, herein designated GAM RNA, also designated SEQ ID:332.

Another function of GAM94 is therefore inhibition of CREG2 (Accession NP_722578.1). Accordingly, utilities of GAM94 include diagnosis, prevention and treatment of diseases and clinical conditions associated with CREG2.

Cysteine-rich motor neuron 1 (CRIM1, Accession NP_057525.1) is another GAM94 target gene, herein designated TARGET GENE. CRIM1 BINDING SITE is a target binding site found in the 3' untranslated region of mRNA encoded by CRIM1, corresponding to a target binding site such as BINDING SITE I, BINDING SITE II or BINDING SITE III of FIG. 8. Table 4 illustrates the complementarity of the nucleotide sequences of CRIM1 BINDING SITE, designated SEQ ID:18711, to the nucleotide sequence of GAM94 RNA, herein designated GAM RNA, also designated SEQ ID:332.

Another function of GAM94 is therefore inhibition of Cysteine-rich motor neuron 1 (CRIM1, Accession NP_057525.1). Accordingly, utilities of GAM94 include diagnosis, prevention and treatment of diseases and clinical conditions associated with CRIM1.

CRK7 (Accession NP_057591.1) is another GAM94 target gene, herein designated TARGET GENE. CRK7 BINDING SITE is a target binding site found in the 3' untranslated region of mRNA encoded by CRK7, corresponding to a target binding site such as BINDING SITE I, BINDING SITE II or BINDING SITE III of FIG. 8. Table 4 illustrates the complementarity of the nucleotide sequences of CRK7 BINDING SITE, designated SEQ ID:16784, to the nucleotide sequence of GAM94 RNA, herein designated GAM RNA, also designated SEQ ID:332.

Another function of GAM94 is therefore inhibition of CRK7 (Accession NP_057591.1). Accordingly, utilities of GAM94 include diagnosis, prevention and treatment of diseases and clinical conditions associated with CRK7.

CRN (Accession NP_006578.2) is another GAM94 target gene, herein designated TARGET GENE. CRN BINDING SITE is a target binding site found in the 5' untranslated region of mRNA encoded by CRN, corresponding to a target binding site such as BINDING SITE I, BINDING SITE II or BINDING SITE III of FIG. 8. Table 4 illustrates the complementarity of the nucleotide sequences of CRN BINDING SITE, designated SEQ ID:19629, to the nucleotide sequence of GAM94 RNA, herein designated GAM RNA, also designated SEQ ID:332.

Another function of GAM94 is therefore inhibition of CRN (Accession NP_006578.2). Accordingly, utilities of GAM94 include diagnosis, prevention and treatment of diseases and clinical conditions associated with CRN.

Colony stimulating factor 1 receptor, formerly mcdonough feline sarcoma viral (v-fms) oncogene homolog (CSF1R, Accession NP_005202.2) is another GAM94 target gene, herein designated TARGET GENE. CSF1R BINDING SITE1 through CSF1R BINDING SITE5 are target binding sites found in untranslated regions of mRNA encoded by CSF1R, corresponding to target binding sites such as BINDING SITE I, BINDING SITE II or BINDING SITE III of FIG. 8. Table 4 illustrates the complementarity of the nucleotide sequences of CSF1R BINDING SITE1 through CSF1R BINDING SITE5, designated SEQ ID:15322, SEQ ID:6055, SEQ ID:1086, SEQ ID:9658 and SEQ ID:2612 respectively, to the nucleotide sequence of GAM94 RNA, herein designated GAM RNA, also designated SEQ ID:332.

Another function of GAM94 is therefore inhibition of Colony stimulating factor 1 receptor, formerly mcdonough feline sarcoma viral (v-fms) oncogene homolog (CSF1R, Accession NP_005202.2), a gene which is involved in regulation of growth and differentiation of myeloid cells and therefore may be associated with Myeloid malignancy, predisposition to. Accordingly, utilities of GAM94 include diagnosis, prevention and treatment of Myeloid malignancy, predisposition to, and of other diseases and clinical conditions associated with CSF1R.

The function of CSF1R has been established by previous studies. The FMS oncogene was assigned to chromosome 5 by study of mouse-man somatic cell hybrids. The location was narrowed to 5q34 by the study of hamster-human cell hybrids with well-defined deletions of 5q (Groffen et al., 1984). The order on the long arm was found to be centromere-leuS-HEXB-EMTB-CFMS-CHR. By in situ hybridization, Le Beau et al. (1986) assigned FMS to 5q33 and GMCSF (OMIM Ref. No. 138960) to 5q23-q31. Both genes were deleted in the 5q-chromosome from bone marrow cells of 2 patients with refractory anemia and del(5)(q15q33.3). From study of other cases they concluded that FMS is located in band 5q33.2 or 5q33.3 rather than 5q34-q35 as reported earlier. The FMS oncogene is the same as the receptor for colony-stimulating factor-1, otherwise known as macrophage colony-stimulating factor (OMIM Ref. No. 120420). Kondo et al. (2000) showed that a clonogenic common lymphoid progenitor, a bone marrow-resident cell that gives rise exclusively to lymphocytes (T, B, and natural killer cells), can be redirected to the myeloid lineage by stimulation through exogenously expressed interleukin-2 receptor (OMIM Ref. No. 146710) and GMCSF receptor (138981, 306250). Analysis of mutants of the beta-chain of the IL2 receptor revealed that the granulocyte and monocyte differentiation signals are triggered by different cytoplasmic domains, showing that the signaling pathways responsible for these unique developmental outcomes are separable. Finally, Kondo et al. (2000) showed that the endogenous myelomonocytic cytokine receptors for GM-CSF and macrophage colony-stimulating factor (CSF1R) are expressed at low to moderate levels on the more primitive hematopoietic stem cells, are absent on common lymphoid progenitors, and are upregulated after myeloid lineage induction by IL2 (OMIM Ref. No. 147680). Kondo et al. (2000) concluded that cytokine signaling can regulate cell fate decisions and proposed that a critical step in lymphoid commitment is downregulation of cytokine receptors that drive myeloid cell development Full details of the abovementioned studies are described in the following publications, the disclosure of which are hereby incorporated by reference:

Le Beau, M. M.; Westbrook, C. A.; Diaz, M. O.; Larson, R. A.; Rowley, J. D.; Gasson, J. C.; Golde, D. W.; Sherr, C. J.: Evidence for the involvement of GM-CSF and FMS in the deletion (5q) in myeloid disorders. Science 231:984-987, 1986; and Kondo, M.; Scherer, D. C.; Miyamoto, T.; King, A. G.; Akashi, K.; Sugamura, K.; Weissman, I. L.: Cell-fate conversion of lymphoid-committed progenitors by instructive actions of cytoki.

Further studies establishing the function and utilities of CSF1R are found in John Hopkins OMIM database record ID 164770, and in cited publications listed in Table 5, which are hereby incorporated by reference. Chondroitin sulfate proteoglycan 3 (neurocan) (CSPG3, Accession NP_004377.1) is another GAM94 target gene, herein designated TARGET GENE. CSPG3 BINDING SITE is a target binding site found in the 3' untranslated region of mRNA encoded by CSPG3, corresponding to a target binding site such as BINDING SITE I, BINDING SITE II or BINDING SITE III of FIG. 8. Table 4 illustrates the complementarity of the nucleotide sequences of CSPG3 BINDING SITE, designated SEQ ID:5105, to the nucleotide sequence of GAM94 RNA, herein designated GAM RNA, also designated SEQ ID:332.

Another function of GAM94 is therefore inhibition of Chondroitin sulfate proteoglycan 3 (neurocan) (CSPG3, Accession NP_004377.1), a gene which may play a role in modulating cell adhesion and migrationn. Accordingly, utilities of GAM94 include diagnosis, prevention and treatment of diseases and clinical conditions associated with CSPG3.

The function of CSPG3 has been established by previous studies. Neurocan was first described in the early postnatal rat brain where it accounts for 20 to 30% of the total chondroitin sulfate proteoglycan. Rauch et al. (1992) cloned the rat cDNA using degenerate primers based on partial amino acid sequence of immunoaffinity-purified protein. The mouse neurocan cDNA encodes a deduced 1,257-amino acid protein with a predicted molecular mass of 136 kD. The large protein is processed into a smaller form in the adult brain. The predicted protein has a 22-amino acid signal peptide followed by an immunoglobin-like domain and repeating motifs characteristic of the hyaluronic acid-binding region of aggregating proteoglycans. The C terminus shows approximately 60% identity to the fibroblast and cartilage proteoglycans versican (OMIM Ref. No. 118661) and aggrecan (OMIM Ref. No. 155760). Northern blots detected a 7.5-kb transcript from 4-day and adult rat brains Prange et al. (1998) cloned human neurocan cDNAs from infant and adult brain cDNA libraries. The deduced 1,321-amino acid protein shares 63% sequence identity with both mouse and rat neurocan proteins. Like other known proteoglycans, its N terminus contains an immunoglobulin domain and a series of hyaluronic acid-binding tandem repeats, and its C terminus contains an EGF-like domain, a lectin-like domain, and a complement regulatory-like domain. Northern blot analysis detected expression of a 7.5-kb transcript in fetal and adult tissues from all brain regions tested Full details of the abovementioned studies are described in the following publications, the disclosure of which are hereby incorporated by reference:

Rauch, U.; Grimpe, B.; Kulbe, G.; Arnold-Ammer, I.; Beier, D. R.; Fassler, R.: Structure and chromosomal localization of the mouse neurocan gene. Genomics 28: 405-410, 1995; and Prange, C. K.; Pennacchio, L. A.; Lieuallen, K.; Fan, W.; Lennon, G. G.: Characterization of the human neurocan gene, CSPG3. Gene 221:199- 205, 1998.

Further studies establishing the function and utilities of CSPG3 are found in John Hopkins OMIM database record ID 600826, and in cited publications listed in Table 5, which are hereby incorporated by reference. Chemokine (c-x-c motif) ligand 1 (melanoma growth stimulating activity, alpha) (CXCL1, Accession NP_001502.1) is another GAM94 target gene, herein designated TARGET GENE. CXCL1 BINDING SITE is a target binding site found in the 3' untranslated region of mRNA encoded by CXCL1, corresponding to a target binding site such as BINDING SITE I, BINDING SITE II or BINDING SITE III of FIG. 8. Table 4 illustrates the complementarity of the nucleotide sequences of CXCL1 BINDING SITE, designated SEQ ID:10919, to the nucleotide sequence of GAM94 RNA, herein designated GAM RNA, also designated SEQ ID:332.

Another function of GAM94 is therefore inhibition of Chemokine (c-x-c motif) ligand 1 (melanoma growth stimulating activity, alpha) (CXCL1, Accession NP_001502.1), a gene which has chemotactic activity for neutrophils and may play a role in inflammation. Accordingly, utilities of GAM94 include diagnosis, prevention and treatment of diseases and clinical conditions associated with CXCL1.

The function of CXCL1 has been established by previous studies. Melanoma growth stimulatory activity (MGSA) is a mitogenic polypeptide secreted by human melanoma cells. The mature form is maximally 73 amino acids long. MGSA is structurally related to the platelet-derived beta-thromboglobulin. It is the product of the gene GRO isolated by Anisowicz et al. (1987). Horuk et al. (1993) indicated that structurally MGSA belongs to a superfamily of proteins that includes interleukin-8 (IL8, or CXCR2; 146928) and platelet factor-4 (PF4; 173460). These proteins are involved in inflammatory processes. Tsai et al. (2002) demonstrated a role for rodent Cxcl1 and Cxcr2 in patterning the developing spinal cord. Signaling through Cxcr2, Cxcl1 inhibited oligodendrocyte precursor migration. The migrational arrest was rapid, reversible, and concentration dependent, and it reflected enhanced cell/substrate interactions. White matter expression of Cxcl1 was temporospatially regulated. Developing Cxcr2 null spinal cords contained reduced oligodendrocytes abnormally concentrated at the periphery. In mouse and rat slice preparations, Cxcl1 inhibited embryonic oligodendrocyte precursor migration, and widespread dispersal of postnatal precursors occurred in the absence of Cxcr2 signaling. The data suggested that a population of presumptive white matter by oligodendrocyte precursors is dependent on localized expression of CXCL1.

Full details of the abovementioned studies are described in the following publications, the disclosure of which are hereby incorporated by reference:

Horuk, R.; Yansura, D. G.; Reilly, D.; Spencer, S.; Bourell, J.; Henzel, W.; Rice, G.; Unemori, E.: Purification, receptor binding analysis, and biological characterization of human melanoma growth stimulating activity (MGSA): evidence for a novel MGSA receptor. J. Biol. Chem. 268:541-546, 1993; and Tsai, H.-H.; Frost, E.; To, V.; Robinson, S.; ffrench-Constant, C.; Geertman, R.; Ransohoff, R. M.; Miller, R. H.: The chemokine receptor CXCR2 controls positioning of oligodendrocyte p.

Further studies establishing the function and utilities of CXCL1 are found in John Hopkins OMIM database record ID 155730, and in cited publications listed in Table 5, which are hereby incorporated by reference. Chemokine (c-x-c motif) ligand 2 (CXCL2, Accession NP_002080.1) is another GAM94 target gene, herein designated TARGET GENE. CXCL2 BINDING SITE is a target binding site found in the 3' untranslated region of mRNA encoded by CXCL2, corresponding to a target binding site such as BINDING SITE I, BINDING SITE II or BINDING SITE III of FIG. 8. Table 4 illustrates the complementarity of the nucleotide sequences of CXCL2 BINDING SITE, designated SEQ ID:10919, to the nucleotide sequence of GAM94 RNA, herein designated GAM RNA, also designated SEQ ID:332.

Another function of GAM94 is therefore inhibition of Chemokine (c-x-c motif) ligand 2 (CXCL2, Accession NP_002080.1). Accordingly, utilities of GAM94 include diagnosis, prevention and treatment of diseases and clinical conditions associated with CXCL2.

Chromosome y open reading frame 14 (CYorf14, Accession NP_061012.1) is another GAM94 target gene, herein designated TARGET GENE. CYorf14 BINDING SITE is a target binding site found in the 3' untranslated region of mRNA encoded by CYorf14, corresponding to a target binding site such as BINDING SITE I, BINDING SITE II or BINDING SITE III of FIG. 8. Table 4 illustrates the complementarity of the nucleotide sequences of CYorf14 BINDING SITE, designated SEQ ID:8844, to the nucleotide sequence of GAM94 RNA, herein designated GAM RNA, also designated SEQ ID:332.

Another function of GAM94 is therefore inhibition of Chromosome y open reading frame 14 (CYorf14, Accession NP_061012.1). Accordingly, utilities of GAM94 include diagnosis, prevention and treatment of diseases and clinical conditions associated with CYorf14.

Cytochrome p450, subfamily iiia, polypeptide 7 (CYP3A7, Accession NP_000756.1) is another GAM94 target gene, herein designated TARGET GENE. CYP3A7 BINDING SITE is a target binding site found in the 5' untranslated region of mRNA encoded by CYP3A7, corresponding to a target binding site such as BINDING SITE I, BINDING SITE II or BINDING SITE III of FIG. 8. Table 4 illustrates the complementarity of the nucleotide sequences of CYP3A7 BINDING SITE, designated SEQ ID:13918, to the nucleotide sequence of GAM94 RNA, herein designated GAM RNA, also designated SEQ ID:332.

Another function of GAM94 is therefore inhibition of Cytochrome p450, subfamily iiia, polypeptide 7 (CYP3A7, Accession NP_000756.1). Accordingly, utilities of GAM94 include diagnosis, prevention and treatment of diseases and clinical conditions associated with CYP3A7.

Cytochrome p450, subfamily ivf, polypeptide 3 (leukotriene b4 omega hydroxylase) (CYP4F3, Accession NP_000887.1) is another GAM94 target gene, herein designated TARGET GENE. CYP4F3 BINDING SITE1 and CYP4F3 BINDING SITE2 are target binding sites found in untranslated regions of mRNA encoded by CYP4F3, corresponding to target binding sites such as BINDING SITE I, BINDING SITE II or BINDING SITE III of FIG. 8. Table 4 illustrates the complementarity of the nucleotide sequences of CYP4F3 BINDING SITE1 and CYP4F3 BINDING SITE2, designated SEQ ID:17402 and SEQ ID:18277 respectively, to the nucleotide sequence of GAM94 RNA, herein designated GAM RNA, also designated SEQ ID:332.

Another function of GAM94 is therefore inhibition of Cytochrome p450, subfamily ivf, polypeptide 3 (leukotriene b4 omega hydroxylase) (CYP4F3, Accession NP_000887.1), a gene which converts leukotriene B4 into the less active 20-hydroxy-leukotriene B4. Accordingly, utilities of GAM94 include diagnosis, prevention and treatment of diseases and clinical conditions associated with CYP4F3.

The function of CYP4F3 and its association with various diseases and clinical conditions, has been established by previous studies, as described hereinabove with reference to GAM67.1. Cytochrome p450, subfamily viib (oxysterol 7 alpha-hydroxylase), polypeptide 1 (CYP7B1, Accession NP_004811.1) is another GAM94 target gene, herein designated TARGET GENE. CYP7B1 BINDING SITE is a target binding site found in the 3' untranslated region of mRNA encoded by CYP7B1, corresponding to a target binding site such as BINDING SITE I, BINDING SITE II or BINDING SITE III of FIG. 8. Table 4 illustrates the complementarity of the nucleotide sequences of CYP7B1 BINDING SITE, designated SEQ ID:4296, to the nucleotide sequence of GAM94 RNA, herein designated GAM RNA, also designated SEQ ID:332.

Another function of GAM94 is therefore inhibition of Cytochrome p450, subfamily viib (oxysterol 7 alpha-hydroxylase), polypeptide 1 (CYP7B1, Accession NP_004811.1), a gene which functions in the acidic pathway of bile acid biosynthesis. and therefore is associated with Neonatal giant cell hepatitis. Accordingly, utilities of GAM94 include diagnosis, prevention and treatment of Neonatal giant cell hepatitis, and of other diseases and clinical conditions associated with CYP7B1.

The function of CYP7B1 has been established by previous studies. Setchell et al. (1998) determined that the CYP7B1 gene contains 6 exons. The positions of the 5 introns are identical to those of the CYP7A1 gene. By radiation hybrid analysis, Setchell et al. (1998) mapped the CYP7A1 gene to 8q21.13 and the CYP7B1 gene to 8q21.3. The close linkage of the genes and their shared exon-intron structures suggested that they arose via an ancient duplication event. Setchell et al. (1998) described a metabolic defect in bile acid synthesis involving a deficiency in 7-alpha-hydroxylation due to a mutation in the gene for the microsomal oxysterol 7-alpha-hydroxylase enzyme, active in the acidic pathway for bile acid synthesis. The defect, identified in a 10-week-old boy presenting with severe cholestasis, cirrhosis, and liver synthetic failure, was established by fast atom bombardment ionization-mass spectrometry, which revealed elevated urinary bile acid excretion, a mass spectrum with intense ions at m/z 453 and m/z 510 corresponding to sulfate and glycosulfate conjugates of unsaturated monohydroxycholenoic acids, and an absence of primary bile acids. Levels of 27-hydroxycholesterol were more than 4,500 times normal. Hepatic microsomal oxysterol 7-alpha-hydroxylase activity was undetectable. It was thought that an accumulation of hepatotoxic unsaturated monohydroxy bile acids accounted for the pathology. Gene analysis demonstrated a C- to - T transition in exon 5 of the CYP7A1 gene, resulting in the conversion of an arginine codon at position 388 to a stop codon. The truncated protein was inactive when expressed in 293 cells. These findings indicated the quantitative importance of the acidic pathway in early life in humans and defined a further inborn error of bile acid synthesis as a metabolic cause of severe cholestatic liver disease.

Animal model experiments lend further support to the function of CYP7B1. Using immunoblotting, Li-Hawkins et al. (2000) detected higher levels of Cyp7b1 protein in the liver and kidney of male mice compared with female mice. Li-Hawkins et al. (2000) produced mice carrying a targeted disruption in Cyp7b1. The knockout mice had elevated levels of 2 different oxysterols, 25-hydroxycholesterol and 27-hydroxycholesterol, in serum and tissue. De novo cholesterol synthesis was decreased by approximately 40% in the kidneys of male knockout mice. Li-Hawkins et al. (2000) concluded that the major physiologic role of Cyp7b1 is to inactivate oxysterols and that loss of this enzyme in the liver of mice is compensated for by an increase in the synthesis of bile acids by other pathways (see OMIM Ref. No. CYP39A1, 605994).

It is appreciated that the abovementioned animal model for CYP7B1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li-Hawkins, J.; Lund, E. G.; Turley, S. D.; Russell, D. W.: Disruption of the oxysterol 7-alpha-hydroxylase gene in mice. J. Biol. Chem. 275:16536-16542, 2000; and Setchell, K. D. R.; Schwarz, M.; O'Connell, N. C.; Lund, E. G.; Davis, D. L.; Lathe, R.; Thompson, H. R.; Tyson, R. W.; Sokol, R. J.; Russell, D. W.: Identification of a new inborn er.

Further studies establishing the function and utilities of CYP7B1 are found in John Hopkins OMIM database record ID 603711, and in cited publications listed in Table 5, which are hereby incorporated by reference. Dna cross-link repair 1a (pso2 homolog, s. cerevisiae) (DCLRE1A, Accession NP_055696.1) is another GAM94 target gene, herein designated TARGET GENE. DCLRE1A BINDING SITE is a target binding site found in the 3' untranslated region of mRNA encoded by DCLRE1A, corresponding to a target binding site such as BINDING SITE I, BINDING SITE II or BINDING SITE III of FIG. 8. Table 4 illustrates the complementarity of the nucleotide sequences of DCLRE1A BINDING SITE, designated SEQ ID:13586, to the nucleotide sequence of GAM94 RNA, herein designated GAM RNA, also designated SEQ ID:332.

Another function of GAM94 is therefore inhibition of Dna cross-link repair 1a (pso2 homolog, s. cerevisiae) (DCLRE1A, Accession NP_055696.1). Accordingly, utilities of GAM94 include diagnosis, prevention and treatment of diseases and clinical conditions associated with DCLRE1A.

Dopachrome tautomerase (dopachrome delta-isomerase, tyrosine-related protein 2) (DCT, Accession NP_001913.2) is another GAM94 target gene, herein designated TARGET GENE. DCT BINDING SITE is a target binding site found in the 5' untranslated region of mRNA encoded by DCT, corresponding to a target binding site such as BINDING SITE I, BINDING SITE II or BINDING SITE III of FIG. 8. Table 4 illustrates the complementarity of the nucleotide sequences of DCT BINDING SITE, designated SEQ ID:12756, to the nucleotide sequence of GAM94 RNA, herein designated GAM RNA, also designated SEQ ID:332.

Another function of GAM94 is therefore inhibition of Dopachrome tautomerase (dopachrome delta-isomerase, tyrosine-related protein 2) (DCT, Accession NP_001913.2), a gene which regulates eumelanin and phaeomelanin levels. and therefore may be associated with Melanoma. Accordingly, utilities of GAM94 include diagnosis, prevention and treatment of Melanoma, and of other diseases and clinical conditions associated with DCT.

The function of DCT has been established by previous studies. Sturm et al. (1995) showed that the TYRP1 protein is encoded in 7 exons spread over 24 kb of genomic DNA. By contrast, the TYRP2 protein is encoded by 8 exons. TYRP1, TYRP2, and the tyrosinase gene share a common C-terminal membrane spanning exon. The position of intron junctions suggested that TYRP1 was derived from a TYR duplication and then was itself duplicated to give rise to the TYRP2 gene. The comparisons also suggested that at least some of the introns within the Ty, TYRP1, and TYRP2 coding regions were gained after duplication and that intron slippage was unlikely to have occurred. NYESO1 (CTAG; 300156) is expressed on tumor cells of many different types, including melanoma. TRP2 is a melanoma-differentiation antigen. In a melanoma vaccine trial in patients with metastatic disease, Khong and Rosenberg (2002) identified tumor-infiltrating lymphocytes (TILs) that recognized NYESO1, TRP2, and a TRP2 splice variant from a patient who experienced dramatic tumor regression. The TILs expressed immunologic reactivity against these antigens before vaccination with antigens, none of which she had been vaccinated against. Khong and Rosenberg (2002) proposed that NYESO1 and TRP2 may be useful in the active immunotherapy of patients with melanoma.

Full details of the abovementioned studies are described in the following publications, the disclosure of which are hereby incorporated by reference:

Khong, H. T.; Rosenberg, S. A.: Pre-existing immunity to tyrosinase-related protein (TRP)-2, a new TRP-2 isoform, and the NY-ESO-1 melanoma antigen in a patient with a dramatic response to immunotherapy. J. Immun. 168: 951-956, 2002; and Sturm, R. A.; O'Sullivan B. J.; Box, N. F.; Smith, A. G.; Smit, S. E.; Puttick, E. R. J.; Parsons, P. G.; Dunn, I. S.: Chromosomal structure of the human TYRP1 and TYRP2 loci and compa.

Further studies establishing the function and utilities of DCT are found in John Hopkins OMIM database record ID 191275, and in cited publications listed in Table 5, which are hereby incorporated by reference. Dead/h (asp-glu-ala-asp/his) box polypeptide 11 (chl1-like helicase homolog, s. cerevisiae) (DDX11, Accession NP_085913.1) is another GAM94 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:14293, to the nucleotide sequence of GAM94 RNA, herein designated GAM RNA, also designated SEQ ID:332.

Another function of GAM94 is therefore inhibition of Dead/h (asp-glu-ala-asp/his) box polypeptide 11 (chl1-like helicase homolog, s. cerevisiae) (DDX11, Accession NP_085913.1), a gene which could be an ATP-dependent DNA-binding helicase and may intervene in cell cycle regulation. Accordingly, utilities of GAM94 include diagnosis, prevention and treatment of diseases and clinical conditions associated with DDX11.

The function of DDX11 and its association with various diseases and clinical conditions, has been established by previous studies, as described hereinabove with reference to GAM63.1. DEPP (Accession NP_008952.1) is another GAM94 target gene, herein designated TARGET GENE. DEPP BINDING SITE is a target binding site found in the 3' untranslated region of mRNA encoded by DEPP, corresponding to a target binding site such as BINDING SITE I, BINDING SITE II or BINDING SITE III of FIG. 8. Table 4 illustrates the complementarity of the nucleotide sequences of DEPP BINDING SITE, designated SEQ ID:12438, to the nucleotide sequence of GAM94 RNA, herein designated GAM RNA, also designated SEQ ID:332.

Another function of GAM94 is therefore inhibition of DEPP (Accession NP_008952.1). Accordingly, utilities of GAM94 include diagnosis, prevention and treatment of diseases and clinical conditions associated with DEPP.

Desmin (DES, Accession NP_001918.2) is another GAM94 target gene, herein designated TARGET GENE. DES BINDING SITE1 and DES BINDING SITE2 are target binding sites found in untranslated regions of mRNA encoded by DES, corresponding to target binding sites such as BINDING SITE I, BINDING SITE II or BINDING SITE III of FIG. 8. Table 4 illustrates the complementarity of the nucleotide sequences of DES BINDING SITE1 and DES BINDING SITE2, designated SEQ ID:5424 and SEQ ID:9797 respectively, to the nucleotide sequence of GAM94 RNA, herein designated GAM RNA, also designated SEQ ID:332.

Another function of GAM94 is therefore inhibition of Desmin (DES, Accession NP_001918.2). Accordingly, utilities of GAM94 include diagnosis, prevention and treatment of diseases and clinical conditions associated with DES.

Deiodinase, iodothyronine, type i (DIO1, Accession NP_000783.2) is another GAM94 target gene, herein designated TARGET GENE. DIO1 BINDING SITE is a target binding site found in the 3' untranslated region of mRNA encoded by DIO1, corresponding to a target binding site such as BINDING SITE I, BINDING SITE II or BINDING SITE III of FIG. 8. Table 4 illustrates the complementarity of the nucleotide sequences of DIO1 BINDING SITE, designated SEQ ID:5841, to the nucleotide sequence of GAM94 RNA, herein designated GAM RNA, also designated SEQ ID:332.

Another function of GAM94 is therefore inhibition of Deiodinase, iodothyronine, type i (DIO1, Accession NP_000783.2). Accordingly, utilities of GAM94 include diagnosis, prevention and treatment of diseases and clinical conditions associated with DIO1.

DJ102H19.4 (Accession NP_071367.1) is another GAM94 target gene, herein designated TARGET GENE. DJ102H19.4 BINDING SITE is a target binding site found in the 3' untranslated region of mRNA encoded by DJ102H19.4, corresponding to a target binding site such as BINDING SITE I, BINDING SITE II or BINDING SITE III of FIG. 8. Table 4 illustrates the complementarity of the nucleotide sequences of DJ102H19.4 BINDING SITE, designated SEQ ID:13535, to the nucleotide sequence of GAM94 RNA, herein designated GAM RNA, also designated SEQ ID:332.

Another function of GAM94 is therefore inhibition of DJ102H19.4 (Accession NP_071367.1). Accordingly, utilities of GAM94 include diagnosis, prevention and treatment of diseases and clinical conditions associated with DJ102H19.4.

DKFZP434A0225 (Accession XP_168185.1) is another GAM94 target gene, herein designated TARGET GENE. DKFZP434A0225 BINDING SITE is a target binding site found in the 3' untranslated region of mRNA encoded by DKFZP434A0225, corresponding to a target binding site such as BINDING SITE I, BINDING SITE II or BINDING SITE III of FIG. 8. Table 4 illustrates the complementarity of the nucleotide sequences of DKFZP434A0225 BINDING SITE, designated SEQ ID:14982, to the nucleotide sequence of GAM94 RNA, herein designated GAM RNA, also designated SEQ ID:332.

Another function of GAM94 is therefore inhibition of DKFZP434A0225 (Accession XP_168185.1). Accordingly, utilities of GAM94 include diagnosis, prevention and treatment of diseases and clinical conditions associated with DKFZP434A0225.

DKFZP434L187 (Accession XP_044070.6) is another GAM94 target gene, herein designated TARGET GENE.

DKFZP434L187 BINDING SITE1 and DKFZP434L187 BINDING SITE2 are target binding sites found in untranslated regions of mRNA encoded by DKFZP434L187, corresponding to target binding sites such as BINDING SITE I, BINDING SITE II or BINDING SITE III of FIG. 8. Table 4 illustrates the complementarity of the nucleotide sequences of DKFZP434L187 BINDING SITE1 and DKFZP434L187 BINDING SITE2, designated SEQ ID:8955 and SEQ ID:4715 respectively, to the nucleotide sequence of GAM94 RNA, herein designated GAM RNA, also designated SEQ ID:332.

Another function of GAM94 is therefore inhibition of DKFZP434L187 (Accession XP_044070.6). Accordingly, utilities of GAM94 include diagnosis, prevention and treatment of diseases and clinical conditions associated with DKFZP434L187.

DKFZp451A175 (Accession NP_694967.1) is another GAM94 target gene, herein designated TARGET GENE. DKFZp451A175 BINDING SITE is a target binding site found in the 3' untranslated region of mRNA encoded by DKFZp451A175, corresponding to a target binding site such as BINDING SITE I, BINDING SITE II or BINDING SITE III of FIG. 8. Table 4 illustrates the complementarity of the nucleotide sequences of DKFZp451A175 BINDING SITE, designated SEQ ID:18054, to the nucleotide sequence of GAM94 RNA, herein designated GAM RNA, also designated SEQ ID:332.

Another function of GAM94 is therefore inhibition of DKFZp451A175 (Accession NP_694967.1). Accordingly, utilities of GAM94 include diagnosis, prevention and treatment of diseases and clinical conditions associated with DKFZp451A175.

DKFZp547G183 (Accession NP_061175.1) is another GAM94 target gene, herein designated TARGET GENE. DKFZp547G183 BINDING SITE is a target binding site found in the 3' untranslated region of mRNA encoded by DKFZp547G183, corresponding to a target binding site such as BINDING SITE I, BINDING SITE II or BINDING SITE III of FIG. 8. Table 4 illustrates the complementarity of the nucleotide sequences of DKFZp547G183 BINDING SITE, designated SEQ ID:1986, to the nucleotide sequence of GAM94 RNA, herein designated GAM RNA, also designated SEQ ID:332.

Another function of GAM94 is therefore inhibition of DKFZp547G183 (Accession NP_061175.1). Accordingly, utilities of GAM94 include diagnosis, prevention and treatment of diseases and clinical conditions associated with DKFZp547G183.

DKFZp564I1922 (Accession NP_056234.1) is another GAM94 target gene, herein designated TARGET GENE. DKFZp564I1922 BINDING SITE is a target binding site found in the 3' untranslated region of mRNA encoded by DKFZp564I1922, corresponding to a target binding site such as BINDING SITE I, BINDING SITE II or BINDING SITE III of FIG. 8. Table 4 illustrates the complementarity of the nucleotide sequences of DKFZp564I1922 BINDING SITE, designated SEQ ID:18835, to the nucleotide sequence of GAM94 RNA, herein designated GAM RNA, also designated SEQ ID:332.

Another function of GAM94 is therefore inhibition of DKFZp564I1922 (Accession NP_056234.1). Accordingly, utilities of GAM94 include diagnosis, prevention and treatment of diseases and clinical conditions associated with DKFZp564I1922.

DKFZp761O17121 (Accession NP_115663.1) is another GAM94 target gene, herein designated TARGET GENE. DKFZp761O17121 BINDING SITE is a target binding site found in the 3' untranslated region of mRNA encoded by DKFZp761O17121, corresponding to a target binding site such as BINDING SITE I, BINDING SITE II or BINDING SITE III of FIG. 8. Table 4 illustrates the complementarity of the nucleotide sequences of DKFZp761O17121 BINDING SITE, designated SEQ ID:14715, to the nucleotide sequence of GAM94 RNA, herein designated GAM RNA, also designated SEQ ID:332.

Another function of GAM94 is therefore inhibition of DKFZp761O17121 (Accession NP_115663.1). Accordingly, utilities of GAM94 include diagnosis, prevention and treatment of diseases and clinical conditions associated with DKFZp761O17121.

Dickkopf homolog 2 (xenopus laevis) (DKK2, Accession NP_055236.1) is another GAM94 target gene, herein designated TARGET GENE. DKK2 BINDING SITE is a target binding site found in the 5' untranslated region of mRNA encoded by DKK2, corresponding to a target binding site such as BINDING SITE I, BINDING SITE II or BINDING SITE III of FIG. 8. Table 4 illustrates the complementarity of the nucleotide sequences of DKK2 BINDING SITE, designated SEQ ID:8609, to the nucleotide sequence of GAM94 RNA, herein designated GAM RNA, also designated SEQ ID:332.

Another function of GAM94 is therefore inhibition of Dickkopf homolog 2 (xenopus laevis) (DKK2, Accession NP_055236.1). Accordingly, utilities of GAM94 include diagnosis, prevention and treatment of diseases and clinical conditions associated with DKK2.

Distal-less homeo box 1 (DLX1, Accession NP_835221.1) is another GAM94 target gene, herein designated TARGET GENE. DLX1 BINDING SITE is a target binding site found in the 3' untranslated region of mRNA encoded by DLX1, corresponding to a target binding site such as BINDING SITE I, BINDING SITE II or BINDING SITE III of FIG. 8. Table 4 illustrates the complementarity of the nucleotide sequences of DLX1 BINDING SITE, designated SEQ ID:12176, to the nucleotide sequence of GAM94 RNA, herein designated GAM RNA, also designated SEQ ID:332.

Another function of GAM94 is therefore inhibition of Distal-less homeo box 1 (DLX1, Accession NP_835221.1). Accordingly, utilities of GAM94 include diagnosis, prevention and treatment of diseases and clinical conditions associated with DLX1.

Dystrophin (muscular dystrophy, duchenne and becker types) (DMD, Accession NP_004006.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004006.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004012.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004012.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004009.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004009.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004011.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004011.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004008.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004008.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004000.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004000.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004001.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004001.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004007.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004007.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004005.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004005.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004004.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004004.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_000100.2) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_000100.2), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_003997.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_003997.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004002.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types)

(DMD, Accession NP_004002.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004003.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004003.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_003998.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_003998.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004014.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004014.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dystrophin (muscular dystrophy, duchenne and becker types) (DMD, Accession NP_004013.1) is another GAM94 target gene, herein designated TARGET GENE. DMD BINDING SITE is a target binding site found in the 3' untranslated region of multiple transcripts of mRNA encoded by DMD, corresponding to a target binding site such as BINDING SITE I, BINDING SITE II or BINDING SITE III of FIG. 8. Table 4 illustrates the complementarity of the nucleotide sequences of DMD BINDING SITE, designated SEQ ID:10078, to the nucleotide sequence of GAM94 RNA, herein designated GAM RNA, also designated SEQ ID:332.

Another function of GAM94 is therefore inhibition of Dystrophin (muscular dystrophy, duchenne and becker types) (DMD, Accession NP_004013.1), a gene which muscular dystrophy.and therefore is associated with Duchenne muscular dystrophy (dmd) and becker muscular dystrophy. Accordingly, utilities of GAM94 include diagnosis, prevention and treatment of Duchenne muscular dystrophy (dmd) and becker muscular dystrophy, and of other diseases and clinical conditions associated with DMD.

The function of DMD and its association with various diseases and clinical conditions, has been established by previous studies, as described hereinabove with reference to GAM40.1. Dnaj (hsp40) homolog, subfamily a, member 1 (DNAJA1, Accession NP_001530.1) is another GAM94 target gene, herein designated TARGET GENE. DNAJA1 BINDING SITE is a target binding site found in the 5' untranslated region of mRNA encoded by DNAJA1, corresponding to a target binding site such as BINDING SITE I, BINDING SITE II or BINDING SITE III of FIG. 8. Table 4 illustrates the complementarity of the nucleotide sequences of DNAJA1 BINDING SITE, designated SEQ ID:9846, to the nucleotide sequence of GAM94 RNA, herein designated GAM RNA, also designated SEQ ID:332.

Another function of GAM94 is therefore inhibition of Dnaj (hsp40) homolog, subfamily a, member 1 (DNAJA1, Accession NP_001530.1). Accordingly, utilities of GAM94 include diagnosis, prevention and treatment of diseases and clinical conditions associated with DNAJA1.

Dnaj (hsp40) homolog, subfamily b, member 5 (DNAJB5, Accession NP_036398.2) is another GAM94 target gene, herein designated TARGET GENE. DNAJB5 BINDING SITE is a target binding site found in the 3' untranslated region of mRNA encoded by DNAJB5, corresponding to a target binding site such as BINDING SITE I, BINDING SITE II or BINDING SITE III of FIG. 8. Table 4 illustrates the complementarity of the nucleotide sequences of DNAJB5 BINDING SITE, designated SEQ ID:17549, to the nucleotide sequence of GAM94 RNA, herein designated GAM RNA, also designated SEQ ID:332.

Another function of GAM94 is therefore inhibition of Dnaj (hsp40) homolog, subfamily b, member 5 (DNAJB5, Accession NP_036398.2). Accordingly, utilities of GAM94 include diagnosis, prevention and treatment of diseases and clinical conditions associated with DNAJB5.

DNAM-1 (Accession NP_006557.1) is another GAM94 target gene, herein designated TARGET GENE. DNAM-1 BINDING SITE is a target binding site found in the 3' untranslated region of mRNA encoded by DNAM-1, corresponding to a target binding site such as BINDING SITE I, BINDING SITE II or BINDING SITE III of FIG. 8. Table 4 illustrates the complementarity of the nucleotide sequences of DNAM-1 BINDING SITE, designated SEQ ID:2229, to the nucleotide sequence of GAM94 RNA, herein designated GAM RNA, also designated SEQ ID:332.

Another function of GAM94 is therefore inhibition of DNAM-1 (Accession NP_006557.1). Accordingly, utilities of GAM94 include diagnosis, prevention and treatment of diseases and clinical conditions associated with DNAM-1.

DPF3 (Accession NP_036206.1) is another GAM94 target gene, herein designated TARGET GENE. DPF3 BINDING SITE is a target binding site found in the 3' untranslated region of mRNA encoded by DPF3, corresponding to a target binding site such as BINDING SITE I, BINDING SITE II or BINDING SITE III of FIG. 8. Table 4 illustrates the complementarity of the nucleotide sequences of DPF3 BINDING SITE, designated SEQ ID:16598, to the nucleotide sequence of GAM94 RNA, herein designated GAM RNA, also designated SEQ ID:332.

Another function of GAM94 is therefore inhibition of DPF3 (Accession NP_036206.1). Accordingly, utilities of GAM94 include diagnosis, prevention and treatment of diseases and clinical conditions associated with DPF3.

Dihydropyrimidinase-like 3 (DPYSL3, Accession NP_001378.1) is another GAM94 target gene, herein designated TARGET GENE. DPYSL3 BINDING SITE is a target binding site found in the 3' untranslated region of mRNA encoded by DPYSL3, corresponding to a target binding site such as BINDING SITE I, BINDING SITE II or BINDING SITE III of FIG. 8. Table 4 illustrates the complementarity of the nucleotide sequences of DPYSL3 BINDING SITE, designated SEQ ID:13744, to the nucleotide sequence of GAM94 RNA, herein designated GAM RNA, also designated SEQ ID:332.

Another function of GAM94 is therefore inhibition of Dihydropyrimidinase-like 3 (DPYSL3, Accession NP_001378.1), a gene which is a member of the dihydropyrimidinase family. Accordingly, utilities of GAM94 include diagnosis, prevention and treatment of diseases and clinical conditions associated with DPYSL3.

The function of DPYSL3 has been established by previous studies. Hamajima et al. (1996) isolated a cDNA encoding dihydropyrimidinase-like 3 (OMIM Ref. No. DPYSL3), called DRP3 by them, from a fetal brain cDNA library (see OMIM Ref. No. 222748). By Northern blot analysis of adult human tissues, they detected a 5.8-kb DPYSL3 transcript at high levels in heart and skeletal muscle and at low levels in brain and lung. Gaetano et al. (1997) isolated a human ULIP cDNA from retinoic acid-differentiated neuroblastoma cells. In contrast to Hamajima et al. (1996), they found that the gene is expressed strongly in human fetal brain and spinal cord but is not detectably expressed in adult brain and nonneuronal tissues. The 5.5-kb full-length cDNA contains a 1,710-bp open reading frame predicting a 570-amino acid protein. The human gene shares 98% identity with mouse Ulip. The authors speculated that the human ULIP gene mediates signals involved in axonal growth.

Full details of the abovementioned studies are described in the following publications, the disclosure of which are hereby incorporated by reference:

Hamajima, N.; Matsuda, K.; Sakata, S.; Tamaki, N.; Sasaki, M.; Nonaka, M.: A novel gene family defined by human dihydropyrimidinase and three related proteins with differential tissue distribution. Gene 180:157-163, 1996; and Gaetano, C; Matsuo, T.; Thiele, C. J.: Identification and characterization of a retinoic acid-regulated human homologue of the unc-33-like phosphoprotein gene (hUlip) from neuroblastom.

Further studies establishing the function and utilities of DPYSL3 are found in John Hopkins OMIM database record ID 601168, and in cited publications listed in Table 5, which are hereby incorporated by reference. Dopamine receptor d3 (DRD3, Accession NP_387507.1) is another GAM94 target gene, herein designated TARGET GENE. DRD3 BINDING SITE is a target binding site found in the 3' untranslated region of multiple transcripts of mRNA encoded by DRD3, corresponding to a target binding site such as BINDING SITE I, BINDING SITE II or BINDING SITE III of FIG. 8. Table 4 illustrates the complementarity of the nucleotide sequences of DRD3 BINDING SITE, designated SEQ ID:11135, to the nucleotide sequence of GAM94 RNA, herein designated GAM RNA, also designated SEQ ID:332.

Another function of GAM94 is therefore inhibition of Dopamine receptor d3 (DRD3, Accession NP_387507.1), a gene which is mediated by g proteins which inhibit adenylyl cyclase. Accordingly, utilities of GAM94 include diagnosis, prevention and treatment of diseases and clinical conditions associated with DRD3.

The function of DRD3 has been established by previous studies. Sokoloff et al. (1990) characterized a dopamine receptor that differs in its pharmacology and signaling system from the D1 (OMIM Ref. No. 126449) and D2 (OMIM Ref. No. 126450) receptors and represents both an autoreceptor and a postsynaptic receptor. Designated the dopamine receptor D3, it is localized to limbic areas of the brain, which are associated with cognitive, emotional, and endocrine functions. It appeared to mediate some of the effects of antipsychotic drugs and drugs used in the treatment of Parkinson disease (OMIM Ref. No. 168600), which were previously thought to interact only with D2 receptors. By screening cDNA and genomic libraries using a combination of reverse transcription and PCR, Sokoloff et al. (1990) cloned the DRD3 gene. Like the DRD2 gene, but unlike most other members of this superfamily, the DRD3 gene contains introns, 5 in number. The position of 2 of the introns corresponds to that of introns in DRD2. Le Coniat et al. (1991) assigned the DRD3 gene to chromosome 3 by hybridization of a genomic probe to flow-sorted chromosomes and localized it to band 3q13.3 by in situ hybridization.

Animal model experiments lend further support to the function of DRD3. The role of the D3 receptor is difficult to study because of its low abundance (approximately 1% of D2 receptors) and the absence of selective ligands. Using a strategy of gene targeting in mouse embryonic stem cells, Accili et al. (1996) generated DRD3-deficient mice carrying a premature chain-termination mutation after residue arginine 148. Binding of the dopamine antagonist iodosulpride to D3 receptors was absent in mice homozygous for the mutation and greatly reduced in heterozygous mice. Behavioral analysis of mutant mice showed that this mutation is associated with hyperactivity. Homozygous mice lacking D3 receptors displayed increased locomotor activity and rearing behavior. Mice heterozygous for the mutation showed similar, although less pronounced, behavioral alterations.

It is appreciated that the abovementioned animal model for DRD3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Accili, D.; Fishburn, C. S.; Drago, J.; Steiner, H.; Lachowicz, J. E.; Park, B.-H.; Gauda, E. B.; Lee, E. J.; Cool, M. H.; Sibley, D. R.; Gerfen, C. R.; Westphal, H.; Fuchs, S.: A targeted mutation of the D3 dopamine receptor gene is associated with hyperactivity in mice. Proc. Nat. Acad. Sci. 93:1945-1949, 1996; and Sokoloff, P.; Giros, B.; Martres, M.-P.; Bouthenet, M.-L.; Schwartz, J.-C.: Molecular cloning and characterization of a novel dopamine receptor (D-3) as a target for neuroleptics. Nat.

Further studies establishing the function and utilities of DRD3 are found in John Hopkins OMIM database record ID 126451, and in cited publications listed in Table 5, which are hereby incorporated by reference. Dual specificity phosphatase 16 (DUSP16, Accession XP_039106.1) is another GAM94 target gene, herein designated TARGET GENE. DUSP16 BINDING SITE is a target binding site found in the 5' untranslated region of mRNA encoded by DUSP16, corresponding to a target binding site such as BINDING SITE I, BINDING SITE II or BINDING SITE III of FIG. 8. Table 4 illustrates the complementarity of the nucleotide sequences of DUSP16 BINDING SITE, designated SEQ ID:7912, to the nucleotide sequence of GAM94 RNA, herein designated GAM RNA, also designated SEQ ID:332.

Another function of GAM94 is therefore inhibition of Dual specificity phosphatase 16 (DUSP16, Accession XP_039106.1). Accordingly, utilities of GAM94 include diagnosis, prevention and treatment of diseases and clinical conditions associated with DUSP16.

Early growth response 1 (EGR1, Accession NP_001955.1) is another GAM94 target gene, herein designated TARGET GENE. EGR1 BINDING SITE is a target binding site found in the 3' untranslated region of mRNA encoded by EGR1, corresponding to a target binding site such as BINDING SITE I, BINDING SITE II or BINDING SITE III of FIG. 8. Table 4 illustrates the complementarity of the nucleotide sequences of EGR1 BINDING SITE, designated SEQ ID:2968, to the nucleotide sequence of GAM94 RNA, herein designated GAM RNA, also designated SEQ ID:332.

Another function of GAM94 is therefore inhibition of Early growth response 1 (EGR1, Accession NP_001955.1). Accordingly, utilities of GAM94 include diagnosis, prevention and treatment of diseases and clinical conditions associated with EGR1.

Eukaryotic translation initiation factor 4 gamma, 3 (EIF4G3, Accession NP_003751.2) is another GAM94 target gene, herein designated TARGET GENE. EIF4G3 BINDING SITE is a target binding site found in the 3' untranslated region of mRNA encoded by EIF4G3, corresponding to a target binding site such as BINDING SITE I, BINDING SITE II or BINDING SITE III of FIG. 8. Table 4 illustrates the complementarity of the nucleotide sequences of EIF4G3 BINDING SITE, designated SEQ ID:12862, to the nucleotide sequence of GAM94 RNA, herein designated GAM RNA, also designated SEQ ID:332.

Another function of GAM94 is therefore inhibition of Eukaryotic translation initiation factor 4 gamma, 3 (EIF4G3, Accession NP_003751.2). Accordingly, utilities of GAM94 include diagnosis, prevention and treatment of diseases and clinical conditions associated with EIF4G3.

Eukaryotic translation initiation factor 5a (EIF5A, Accession NP_001961.1) is another GAM94 target gene, herein designated TARGET GENE. EIF5A BINDING SITE is a target binding site found in the 3' untranslated region of mRNA encoded by EIF5A, corresponding to a target binding site such as BINDING SITE I, BINDING SITE II or BINDING SITE III of FIG. 8. Table 4 illustrates the complementarity of the nucleotide sequences of EIF5A BINDING SITE, designated SEQ ID:3210, to the nucleotide sequence of GAM94 RNA, herein designated GAM RNA, also designated SEQ ID:332.

Another function of GAM94 is therefore inhibition of Eukaryotic translation initiation factor 5a (EIF5A, Accession NP_001961.1), a gene which is an initiation factor. Accordingly, utilities of GAM94 include diagnosis, prevention and treatment of diseases and clinical conditions associated with EIF5A.

The function of EIF5A has been established by previous studies. The eukaryotic initiation factor 5A is an 18-kD protein composed of 154 amino acids. It contains a unique amino acid residue, hypusine, that is formed posttranslationally via the transfer and hydroxylation of the butylamino-group from the polyamine spermidine to a lys50 within the EIF5A protein. Koettnitz et al. (1994) isolated and characterized the human EIF5A pseudogene. Subsequently, Koettnitz et al. (1995) identified a genomic clone with an EIF5A containing 3 introns and spanning about 4.8 kb. The authors showed that this sequence would successfully complement yeast carrying the HYP2 mutation (the homolog of EIF5A), whereas the pseudogenes could not. Steinkasserer et al. (1995) mapped the EIF5A gene to 17p13-p12 by fluorescence in situ hybridization. Three pseudogenes were mapped to 10q23.3, 17q25, and 19q13.2.

Full details of the abovementioned studies are described in the following publications, the disclosure of which are hereby incorporated by reference:

Koettnitz, K.; Wohl, T.; Kappel, B.; Lottspeich, F.; Hauber, J.; Bevec, D.: Identification of a new member of the human eIF-5A gene family. Gene 159:283-284, 1995; and Steinkasserer, A.; Jones, T.; Sheer, D.; Koettnitz, K.; Hauber, J.; Bevec, D.: The eukaryotic cofactor for the human immunodeficiency virus type 1 (HIV-1) rev protein, eIF-5A, maps to.

Further studies establishing the function and utilities of EIF5A are found in John Hopkins OMIM database record ID 600187, and in cited publications listed in Table 5, which are hereby incorporated by reference. Eukaryotic translation initiation factor 5a pseudogene 1 (EIF5AP1, Accession XP_290186.1) is another GAM94 target gene, herein designated TARGET GENE. EIF5AP1 BINDING SITE is a target binding site found in the 3' untranslated region of mRNA encoded by EIF5AP1, corresponding to a target binding site such as BINDING SITE I, BINDING SITE II or BINDING SITE III of FIG. 8. Table 4 illustrates the complementarity of the nucleotide sequences of EIF5AP1 BINDING SITE, designated SEQ ID:6926, to the nucleotide sequence of GAM94 RNA, herein designated GAM RNA, also designated SEQ ID:332.

Another function of GAM94 is therefore inhibition of Eukaryotic translation initiation factor 5a pseudogene 1 (EIF5AP1, Accession XP_290186.1). Accordingly, utilities of GAM94 include diagnosis, prevention and treatment of diseases and clinical conditions associated with EIF5AP1.

Egf-like module containing, mucin-like, hormone receptor-like sequence 2 (EMR2, Accession NP_038475.2) is another GAM94 target gene, herein designated TARGET GENE. EMR2 BINDING SITE is a target binding site found in the 3' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:9659, to the nucleotide sequence of GAM94 RNA, herein designated GAM RNA, also designated SEQ ID:332.

Another function of GAM94 is therefore inhibition of Egf-like module containing, mucin-like, hormone receptor-like sequence 2 (EMR2, Accession NP_038475.2). Accordingly, utilities of GAM94 include diagnosis, prevention and treatment of diseases and clinical conditions associated with EMR2.

Egf-like module containing, mucin-like, hormone receptor-like sequence 2 (EMR2, Accession NP_690884.1) is another GAM94 target gene, herein designated TARGET GENE. EMR2 BINDING SITE is a target binding site found in the 3' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:9659, to the nucleotide sequence of GAM94 RNA, herein designated GAM RNA, also designated SEQ ID:332.

Another function of GAM94 is therefore inhibition of Egf-like module containing, mucin-like, hormone receptor-like sequence 2 (EMR2, Accession NP_690884.1). Accordingly, utilities of GAM94 include diagnosis, prevention and treatment of diseases and clinical conditions associated with EMR2.

Egf-like module containing, mucin-like, hormone receptor-like sequence 2 (EMR2, Accession NP_690880.1) is another GAM94 target gene, herein designated TARGET GENE. EMR2 BINDING SITE is a target binding site found in the 3' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:9659, to the nucleotide sequence of GAM94 RNA, herein designated GAM RNA, also designated SEQ ID:332.

Another function of GAM94 is therefore inhibition of Egf-like module containing, mucin-like, hormone receptor-like sequence 2 (EMR2, Accession NP_690880.1). Accordingly, utilities of GAM94 include diagnosis, prevention and treatment of diseases and clinical conditions associated with EMR2.

Egf-like module containing, mucin-like, hormone receptor-like sequence 2 (EMR2, Accession NP_690882.1) is another GAM94 target gene, herein designated TARGET GENE. EMR2 BINDING SITE is a target binding site found in the 3' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:9659, to the nucleotide sequence of GAM94 RNA, herein designated GAM RNA, also designated SEQ ID:332.

Another function of GAM94 is therefore inhibition of Egf-like module containing, mucin-like, hormone receptor-like sequence 2 (EMR2, Accession NP_690882.1). Accordingly, utilities of GAM94 include diagnosis, prevention and treatment of diseases and clinical conditions associated with EMR2.

Egf-like module containing, mucin-like, hormone receptor-like sequence 2 (EMR2, Accession NP_690883.1) is another GAM94 target gene, herein designated TARGET GENE. EMR2 BINDING SITE is a target binding site found in the 3' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:9659, to the nucleotide sequence of GAM94 RNA, herein designated GAM RNA, also designated SEQ ID:332.

Another function of GAM94 is therefore inhibition of Egf-like module containing, mucin-like, hormone receptor-like sequence 2 (EMR2, Accession NP_690883.1). Accordingly, utilities of GAM94 include diagnosis, prevention and treatment of diseases and clinical conditions associated with EMR2.

Egf-like module containing, mucin-like, hormone receptor-like sequence 2 (EMR2, Accession NP_690885.1) is another GAM94 target gene, herein designated TARGET GENE. EMR2 BINDING SITE is a target binding site found in the 3' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:9659, to the nucleotide sequence of GAM94 RNA, herein designated GAM RNA, also designated SEQ ID:332.

Another function of GAM94 is therefore inhibition of Egf-like module containing, mucin-like, hormone receptor-like sequence 2 (EMR2, Accession NP_690885.1). Accordingly, utilities of GAM94 include diagnosis, prevention and treatment of diseases and clinical conditions associated with EMR2.

Egf-like module containing, mucin-like, hormone receptor-like sequence 2 (EMR2, Accession NP_690881.1) is another GAM94 target gene, herein designated TARGET GENE. EMR2 BINDING SITE is a target binding site found in the 3' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:9659, to the nucleotide sequence of GAM94 RNA, herein designated GAM RNA, also designated SEQ ID:332.

Another function of GAM94 is therefore inhibition of Egf-like module containing, mucin-like, hormone receptor-like sequence 2 (EMR2, Accession NP_690881.1). Accordingly, utilities of GAM94 include diagnosis, prevention and treatment of diseases and clinical conditions associated with EMR2.

Erythrocyte membrane protein band 4.1-like 1 (EPB41L1, Accession NP_818932.1) is another GAM94 target gene, herein designated TARGET GENE. EPB41L1 BINDING SITE is a target binding site found in the 5' untranslated region of multiple transcripts of mRNA encoded by EPB41L1, corresponding to a target binding site such as BINDING SITE I, BINDING SITE II or BINDING SITE III of FIG. 8. Table 4 illustrates the complementarity of the nucleotide sequences of EPB41L1 BINDING SITE, designated SEQ ID:16125, to the nucleotide sequence of GAM94 RNA, herein designated GAM RNA, also designated SEQ ID:332.

Another function of GAM94 is therefore inhibition of Erythrocyte membrane protein band 4.1-like 1 (EPB41L1, Accession NP_818932.1). Accordingly, utilities of GAM94 include diagnosis, prevention and treatment of diseases and clinical conditions associated with EPB41L1.

ESDN (Accession NP_563615.2) is another GAM94 target gene, herein designated TARGET GENE. ESDN BINDING SITE is a target binding site found in the 3' untranslated region of mRNA encoded by ESDN, corresponding to a target binding site such as BINDING SITE I, BINDING SITE II or BINDING SITE III of FIG. 8. Table 4 illustrates the complementarity of the nucleotide sequences of ESDN BINDING SITE, designated SEQ ID:551, to the nucleotide sequence of GAM94 RNA, herein designated GAM RNA, also designated SEQ ID:332.

Another function of GAM94 is therefore inhibition of ESDN (Accession NP_563615.2). Accordingly, utilities of GAM94 include diagnosis, prevention and treatment of diseases and clinical conditions associated with ESDN.

Ecotropic viral integration site 5 (EVI5, Accession NP_005656.2) is another GAM94 target gene, herein designated TARGET GENE. EVI5 BINDING SITE is a target binding site found in the 3' untranslated region of mRNA encoded by EVI5, corresponding to a target binding site such as BINDING SITE I, BINDING SITE II or BINDING SITE III of FIG. 8. Table 4 illustrates the complementarity of the nucleotide sequences of EVI5 BINDING SITE, designated SEQ ID:9673, to the nucleotide sequence of GAM94 RNA, herein designated GAM RNA, also designated SEQ ID:332.

Another function of GAM94 is therefore inhibition of Ecotropic viral integration site 5 (EVI5, Accession NP_005656.2). Accordingly, utilities of GAM94 include diagnosis, prevention and treatment of diseases and clinical conditions associated with EVI5.

Exostoses (multiple) 1 (EXT1, Accession NP_000118.1) is another GAM94 target gene, herein designated TARGET GENE. EXT1 BINDING SITE is a target binding site found in the 5' untranslated region of mRNA encoded by EXT1, corresponding to a target binding site such as BINDING SITE I, BINDING SITE II or BINDING SITE III of FIG. 8. Table 4 illustrates the complementarity of the nucleotide sequences of EXT1 BINDING SITE, designated SEQ ID:16470, to the nucleotide sequence of GAM94 RNA, herein designated GAM RNA, also designated SEQ ID:332.

Another function of GAM94 is therefore inhibition of Exostoses (multiple) 1 (EXT1, Accession NP_000118.1). Accordingly, utilities of GAM94 include diagnosis, prevention and treatment of diseases and clinical conditions associated with EXT1.

Fatty-acid-coenzyme a ligase, long-chain 4 (FACL4, Accession NP_075266.1) is another GAM94 target gene, herein designated TARGET GENE. FACL4 BINDING SITE is a target binding site found in the 3' untranslated region of multiple transcripts of mRNA encoded by FACL4, corresponding to a target binding site such as BINDING SITE I, BINDING SITE II or BINDING SITE III of FIG. 8. Table 4 illustrates the complementarity of the nucleotide sequences of FACL4 BINDING SITE, designated SEQ ID:4716, to the nucleotide sequence of GAM94 RNA, herein designated GAM RNA, also designated SEQ ID:332.

Another function of GAM94 is therefore inhibition of Fatty-acid-coenzyme a ligase, long-chain 4 (FACL4, Accession NP_075266.1) . Accordingly, utilities of GAM94 include diagnosis, prevention and treatment of diseases and clinical conditions associated with FACL4.

Fatty-acid-coenzyme a ligase, long-chain 4 (FACL4, Accession NP_004449.1) is another GAM94 target gene, herein designated TARGET GENE. FACL4 BINDING SITE is a target binding site found in the 3' untranslated region of multiple transcripts of mRNA encoded by FACL4, corresponding to a target binding site such as BINDING SITE I, BINDING SITE II or BINDING SITE III of FIG. 8. Table 4 illustrates the complementarity of the nucleotide sequences of FACL4 BINDING SITE, designated SEQ ID:4716, to the nucleotide sequence of GAM94 RNA, herein designated GAM RNA, also designated SEQ ID:332.

Another function of GAM94 is therefore inhibition of Fatty-acid-coenzyme a ligase, long-chain 4 (FACL4, Accession NP_004449.1) . Accordingly, utilities of GAM94 include diagnosis, prevention and treatment of diseases and clinical conditions associated with FACL4.

Fibroblast growth factor 13 (FGF13, Accession NP_004105.1) is another GAM94 target gene, herein designated TARGET GENE. FGF13 BINDING SITE is a target binding site found in the 5' untranslated region of multiple transcripts of mRNA encoded by FGF13, corresponding to a target binding site such as BINDING SITE I, BINDING SITE II or BINDING SITE III of FIG. 8. Table 4 illustrates the complementarity of the nucleotide sequences of FGF13 BINDING SITE, designated SEQ ID:4855, to the nucleotide sequence of GAM94 RNA, herein designated GAM RNA, also designated SEQ ID:332.

Another function of GAM94 is therefore inhibition of Fibroblast growth factor 13 (FGF13, Accession NP_004105.1), a gene which probably involved in nervous system development and function. Accordingly, utilities of GAM94 include diagnosis, prevention and treatment of diseases and clinical conditions associated with FGF13.

The function of FGF13 has been established by previous studies. See fibroblast growth factor-12 (FGF12; 601513). By Southern blot hybridization of genomic DNA from rodent/human hybrid cell lines carrying individual human chromosomes, Smallwood et al. (1996) mapped the FHF2 gene (also symbolized FGF13) to the X chromosome. By using an interspecific backcross mapping panel, they demonstrated that the mouse gene, Fhf2, shows no recombination with the gene for CD40 antigen ligand (OMIM Ref. No. 300386). Thus the human gene is probably located at Xq26. By use of isotopic in situ hybridization, Lovec et al. (1997) assigned the FHF2 gene to Xq21. Gecz et al. (1999), however, provided evidence that the FHF2 gene is located in Xq26.3. They identified a male patient with features of Borjeson-Forssman-Lehmann syndrome (BFLS; 301900) and a duplication of the Xq26-q28 region. By FISH using YAC clones from Xq26, they localized the duplication breakpoint to an interval of approximately 400 kb in the Xq26.3 region between DXS155 and DXS294/DXS730. Database searches and an analysis of available genomic sequence from the region showed that the FHF2 gene is located within the duplication breakpoint interval. Gecz et al. (1999) determined the structure of the FHF2 gene and identified 2 new exons, including a new 5-prime end exon, designated 1B. FHF2 is a large gene, extending over approximately 200 kb in Xq26.3, and contains at least 7 exons. It shows tissue-specific alternative splicing and alternative transcription starts. Northern blot hybridization showed highest expression in brain and skeletal muscle. The localization and tissue-specific expression pattern of FHF2 made it a possible candidate gene for familial cases of BFLS and for other syndromal and nonspecific forms of X-linked mental retardation mapping to that region.

Full details of the abovementioned studies are described in the following publications, the disclosure of which are hereby incorporated by reference:

Gecz, J.; Baker, E.; Donnelly, A.; Ming, J. E.; McDonald-McGinn, D. M.; Spinner, N. B.; Zackai, E. H.; Sutherland, G. R.; Mulley, J. C.: Fibroblast growth factor homologous factor 2 (FHF2): gene structure, expression and mapping to the Borjeson-Forssman-Lehmann syndrome region in Xq26 delineated by a duplication breakpoint in a BFLS-like patient. Hum. Genet. 104:56-63, 1999; and Lovec, H.; Hartung, H.; Verdier, A.-S.; Mattei, M.-G.; Birnbaum, D.; Goldfarb, M.; Coulier, F.: Assignment of FGF13 to human chromosome band Xq21 by in situ hybridization. Cytogenet.

Further studies establishing the function and utilities of FGF13 are found in John Hopkins OMIM database record ID 300070, and in cited publications listed in Table 5, which are hereby incorporated by reference. Fk506 binding protein 10, 65 kda (FKBP10, Accession NP_068758.2) is another GAM94 target gene, herein designated TARGET GENE. FKBP10 BINDING SITE1 and FKBP10 BINDING SITE2 are target binding sites found in untranslated regions of mRNA encoded by FKBP10, corresponding to target binding sites such as BINDING SITE I, BINDING SITE II or BINDING SITE III of FIG. 8. Table 4 illustrates the complementarity of the nucleotide sequences of FKBP10 BINDING SITE1 and FKBP10 BINDING SITE2, designated SEQ ID:13573 and SEQ ID:4046 respectively, to the nucleotide sequence of GAM94 RNA, herein designated GAM RNA, also designated SEQ ID:332.

Another function of GAM94 is therefore inhibition of Fk506 binding protein 10, 65 kda (FKBP10, Accession NP_068758.2), a gene which ppiases accelerate the folding of proteins during protein synthesis. Accordingly, utilities of GAM94 include diagnosis, prevention and treatment of diseases and clinical conditions associated with FKBP10.

The function of FKBP10 has been established by previous studies. The FK506-binding proteins (FKBPs) were first identified as receptors for the immunosuppressants FK506 and rapamycin. All FKBPs display peptidyl-prolyl cis/trans isomerase (OMIM Ref. No. PPIase) activity and act as molecular chaperones. Patterson et al. (2000) found that mouse Fkbp10 is contained within the lumen of the endoplasmic reticulum. Western blot analysis detected expression in 12-day-old mouse aorta, brain, kidney, and lung; no or barely detectable expression was found in adult tissues. Immunolocalization of Fkbp10 in developing lung revealed staining of vascular and airway smooth muscle cells. Patterson et al. (2002) stated that the human and mouse protein sequences are identical with the exception of a valine-24 addition within the signal sequence of the human protein. Both contain 4 consecutive PPIase domains. Patterson et al. (2002) determined that both the human and mouse FKBP10 genes contain 10 exons. The International Radiation Hybrid Mapping Consortium mapped the FKBP10 gene to chromosome 17 (stSG35365).

Full details of the abovementioned studies are described in the following publications, the disclosure of which are hereby incorporated by reference:

Patterson, C. E.; Gao, J.; Rooney, A. P.; Davis, E. C.: Genomic organization of mouse and human 65 kDa FK506-binding protein genes and evolution of the FKBP multigene family. Genomics 79:881-889, 2002; and Patterson, C. E.; Schaub, T.; Coleman, E. J.; Davis, E. C.: Developmental regulation of FKBP65: an ER localized extracellular matrix-binding protein. Molec. Biol. Cell 11:3925-3935.

Further studies establishing the function and utilities of FKBP10 are found in John Hopkins OMIM database record ID 607063, and in cited publications listed in Table 5, which are hereby incorporated by reference. Fk506 binding protein 8, 38 kda (FKBP8, Accession NP_036313.2) is another GAM94 target gene, herein designated TARGET GENE. FKBP8 BINDING SITE1 and FKBP8 BINDING SITE2 are target binding sites found in untranslated regions of mRNA encoded by FKBP8, corresponding to target binding sites such as BINDING SITE I, BINDING SITE II or BINDING SITE III of FIG. 8. Table 4 illustrates the complementarity of the nucleotide sequences of FKBP8 BINDING SITE1 and FKBP8 BINDING SITE2, designated SEQ ID:10546 and SEQ ID:10823 respectively, to the nucleotide sequence of GAM94 RNA, herein designated GAM RNA, also designated SEQ ID:332.

Another function of GAM94 is therefore inhibition of Fk506 binding protein 8, 38 kda (FKBP8, Accession NP_036313.2). Accordingly, utilities of GAM94 include diagnosis, prevention and treatment of diseases and clinical conditions associated with FKBP8.

FLJ10300 (Accession NP_060521.2) is another GAM94 target gene, herein designated TARGET GENE. FLJ10300 BINDING SITE is a target binding site found in the 5' untranslated region of mRNA encoded by FLJ10300, corresponding to a target binding site such as BINDING SITE I, BINDING SITE II or BINDING SITE III of FIG. 8. Table 4 illustrates the complementarity of the nucleotide sequences of FLJ10300 BINDING SITE, designated SEQ ID:18087, to the nucleotide sequence of GAM94 RNA, herein designated GAM RNA, also designated SEQ ID:332.

Another function of GAM94 is therefore inhibition of FLJ10300 (Accession NP_060521.2). Accordingly, utilities of GAM94 include diagnosis, prevention and treatment of diseases and clinical conditions associated with FLJ10300.

FLJ10415 (Accession NP_060559.1) is another GAM94 target gene, herein designated TARGET GENE. FLJ10415 BINDING SITE is a target binding site found in the 3' untranslated region of mRNA encoded by FLJ10415, corresponding to a target binding site such as BINDING SITE I, BINDING SITE II or BINDING SITE III of FIG. 8. Table 4 illustrates the complementarity of the nucleotide sequences of FLJ10415 BINDING SITE, designated SEQ ID:15496, to the nucleotide sequence of GAM94 RNA, herein designated GAM RNA, also designated SEQ ID:332.

Another function of GAM94 is therefore inhibition of FLJ10415 (Accession NP_060559.1). Accordingly, utilities of GAM94 include diagnosis, prevention and treatment of diseases and clinical conditions associated with FLJ10415.

FLJ10891 (Accession NP_060730.1) is another GAM94 target gene, herein designated TARGET GENE. FLJ10891 BINDING SITE1 and FLJ10891 BINDING SITE2 are target binding sites found in untranslated regions of mRNA encoded by FLJ10891, corresponding to target binding sites such as BINDING SITE I, BINDING SITE II or BINDING SITE III of FIG. 8. Table 4 illustrates the complementarity of the nucleotide sequences of FLJ10891 BINDING SITE1 and FLJ10891 BINDING SITE2, designated SEQ ID:18909 and SEQ ID:10943 respectively, to the nucleotide sequence of GAM94 RNA, herein designated GAM RNA, also designated SEQ ID:332.

Another function of GAM94 is therefore inhibition of FLJ10891 (Accession NP_060730.1). Accordingly, utilities of GAM94 include diagnosis, prevention and treatment of diseases and clinical conditions associated with FLJ10891.

FLJ10997 (Accession NP_060763.1) is another GAM94 target gene, herein designated TARGET GENE. FLJ10997 BINDING SITE is a target binding site found in the 3' untranslated region of mRNA encoded by FLJ10997, corresponding to a target binding site such as BINDING SITE I, BINDING SITE II or BINDING SITE III of FIG. 8. Table 4 illustrates the complementarity of the nucleotide sequences of FLJ10997 BINDING SITE, designated SEQ ID:14334, to the nucleotide sequence of GAM94 RNA, herein designated GAM RNA, also designated SEQ ID:332.

Another function of GAM94 is therefore inhibition of FLJ10997 (Accession NP_060763.1). Accordingly, utilities of GAM94 include diagnosis, prevention and treatment of diseases and clinical conditions associated with FLJ10997.

FLJ11016 (Accession NP_060771.1) is another GAM94 target gene, herein designated TARGET GENE. FLJ11016 BINDING SITE is a target binding site found in the 3' untranslated region of mRNA encoded by FLJ11016, corresponding to a target binding site such as BINDING SITE I, BINDING SITE II or BINDING SITE III of FIG. 8. Table 4 illustrates the complementarity of the nucleotide sequences of FLJ11016 BINDING SITE, designated SEQ ID:15194, to the nucleotide sequence of GAM94 RNA, herein designated GAM RNA, also designated SEQ ID:332.

Another function of GAM94 is therefore inhibition of FLJ11016 (Accession NP_060771.1). Accordingly, utilities of GAM94 include diagnosis, prevention and treatment of diseases and clinical conditions associated with FLJ11016.

FLJ11021 (Accession NP_075388.1) is another GAM94 target gene, herein designated TARGET GENE. FLJ11021 BINDING SITE1 and FLJ11021 BINDING SITE2 are target binding sites found in untranslated regions of mRNA encoded by FLJ11021, corresponding to target binding sites such as BINDING SITE I, BINDING SITE II or BINDING SITE III of FIG. 8. Table 4 illustrates the complementarity of the nucleotide sequences of FLJ11021 BINDING SITE1 and FLJ11021 BINDING SITE2, designated SEQ ID:11805 and SEQ ID:19145 respectively, to the nucleotide sequence of GAM94 RNA, herein designated GAM RNA, also designated SEQ ID:332.

Another function of GAM94 is therefore inhibition of FLJ11021 (Accession NP_075388.1). Accordingly, utilities of GAM94 include diagnosis, prevention and treatment of diseases and clinical conditions associated with FLJ11021.

FLJ11191 (Accession NP_060825.1) is another GAM94 target gene, herein designated TARGET GENE. FLJ11191 BINDING SITE is a target binding site found in the 5' untranslated region of mRNA encoded by FLJ11191, corresponding to a target binding site such as BINDING SITE I, BINDING SITE II or BINDING SITE III of FIG. 8. Table 4 illustrates the complementarity of the nucleotide sequences of FLJ11191 BINDING SITE, designated SEQ ID:19798, to the nucleotide sequence of GAM94 RNA, herein designated GAM RNA, also designated SEQ ID:332.

Another function of GAM94 is therefore inhibition of FLJ11191 (Accession NP_060825.1). Accordingly, utilities of GAM94 include diagnosis, prevention and treatment of diseases and clinical conditions associated with FLJ11191.

FLJ11700 (Accession NP_079168.1) is another GAM94 target gene, herein designated TARGET GENE. FLJ11700 BINDING SITE is a target binding site found in the 3' untranslated region of mRNA encoded by FLJ11700, corresponding to a target binding site such as BINDING SITE I, BINDING SITE II or BINDING SITE III of FIG. 8. Table 4 illustrates the complementarity of the nucleotide sequences of FLJ11700 BINDING SITE, designated SEQ ID:15002, to the nucleotide sequence of GAM94 RNA, herein designated GAM RNA, also designated SEQ ID:332.

Another function of GAM94 is therefore inhibition of FLJ11700 (Accession NP_079168.1). Accordingly, utilities of GAM94 include diagnosis, prevention and treatment of diseases and clinical conditions associated with FLJ11700.

FLJ11756 (Accession NP_078882.2) is another GAM94 target gene, herein designated TARGET GENE. FLJ11756 BINDING SITE is a target binding site found in the 5' untranslated region of mRNA encoded by FLJ11756, corresponding to a target binding site such as BINDING SITE I, BINDING SITE II or BINDING SITE III of FIG. 8. Table 4 illustrates the complementarity of the nucleotide sequences of FLJ11756 BINDING SITE, designated SEQ ID:6613, to the nucleotide sequence of GAM94 RNA, herein designated GAM RNA, also designated SEQ ID:332.

Another function of GAM94 is therefore inhibition of FLJ11756 (Accession NP_078882.2). Accordingly, utilities of GAM94 include diagnosis, prevention and treatment of diseases and clinical conditions associated with FLJ11756.

FLJ12528 (Accession NP_079426.2) is another GAM94 target gene, herein designated TARGET GENE. FLJ12528 BINDING SITE is a target binding site found in the 3' untranslated region of mRNA encoded by FLJ12528, corresponding to a target binding site such as BINDING SITE I, BINDING SITE II or BINDING SITE III of FIG. 8. Table 4 illustrates the complementarity of the nucleotide sequences of FLJ12528 BINDING SITE, designated SEQ ID:3405, to the nucleotide sequence of GAM94 RNA, herein designated GAM RNA, also designated SEQ ID:332.

Another function of GAM94 is therefore inhibition of FLJ12528 (Accession NP_079426.2). Accordingly, utilities of GAM94 include diagnosis, prevention and treatment of diseases and clinical conditions associated with FLJ12528.

FLJ12700 (Accession NP_079186.1) is another GAM94 target gene, herein designated TARGET GENE. FLJ12700 BINDING SITE is a target binding site found in the 3' untranslated region of mRNA encoded by FLJ12700, corresponding to a target binding site such as BINDING SITE I, BINDING SITE II or BINDING SITE III of FIG. 8. Table 4 illustrates the complementarity of the nucleotide sequences of FLJ12700 BINDING SITE, designated SEQ ID:4392, to the nucleotide sequence of GAM94 RNA, herein designated GAM RNA, also designated SEQ ID:332.

Another function of GAM94 is therefore inhibition of FLJ12700 (Accession NP_079186.1). Accordingly, utilities of GAM94 include diagnosis, prevention and treatment of diseases and clinical conditions associated with FLJ12700.

FLJ12704 (Accession NP_079274.1) is another GAM94 target gene, herein designated TARGET GENE. FLJ12704 BINDING SITE is a target binding site found in the 5' untranslated region of mRNA encoded by FLJ12704, corresponding to a target binding site such as BINDING SITE I, BINDING SITE II or BINDING SITE III of FIG. 8. Table 4 illustrates the complementarity of the nucleotide sequences of FLJ12704 BINDING SITE, designated SEQ ID:13847, to the nucleotide sequence of GAM94 RNA, herein designated GAM RNA, also designated SEQ ID:332.

Another function of GAM94 is therefore inhibition of FLJ12704 (Accession NP_079274.1). Accordingly, utilities of GAM94 include diagnosis, prevention and treatment of diseases and clinical conditions associated with FLJ12704.

FLJ13111 (Accession NP_079358.1) is another GAM94 target gene, herein designated TARGET GENE. FLJ13111 BINDING SITE is a target binding site found in the 3' untranslated region of mRNA encoded by FLJ13111, corresponding to a target binding site such as BINDING SITE I, BINDING SITE II or BINDING SITE III of FIG. 8. Table 4 illustrates the complementarity of the nucleotide sequences of FLJ13111 BINDING SITE, designated SEQ ID:2017, to the nucleotide sequence of GAM94 RNA, herein designated GAM RNA, also designated SEQ ID:332.

Another function of GAM94 is therefore inhibition of FLJ13111 (Accession NP_079358.1). Accordingly, utilities of GAM94 include diagnosis, prevention and treatment of diseases and clinical conditions associated with FLJ13111.

FLJ13769 (Accession NP_079288.1) is another GAM94 target gene, herein designated TARGET GENE. FLJ13769 BINDING SITE is a target binding site found in the 3' untranslated region of mRNA encoded by FLJ13769, corresponding to a target binding site such as BINDING SITE I, BINDING SITE II or BINDING SITE III of FIG. 8. Table 4 illustrates the complementarity of the nucleotide sequences of FLJ13769 BINDING SITE, designated SEQ ID:5258, to the nucleotide sequence of GAM94 RNA, herein designated GAM RNA, also designated SEQ ID:332.

Another function of GAM94 is therefore inhibition of FLJ13769 (Accession NP_079288.1). Accordingly, utilities of GAM94 include diagnosis, prevention and treatment of diseases and clinical conditions associated with FLJ13769.

FLJ13841 (Accession NP_078978.1) is another GAM94 target gene, herein designated TARGET GENE. FLJ13841 BINDING SITE is a target binding site found in the 5' untranslated region of mRNA encoded by FLJ13841, corresponding to a target binding site such as BINDING SITE I, BINDING SITE II or BINDING SITE III of FIG. 8. Table 4 illustrates the complementarity of the nucleotide sequences of FLJ13841 BINDING SITE, designated SEQ ID:15346, to the nucleotide sequence of GAM94 RNA, herein designated GAM RNA, also designated SEQ ID:332.

Another function of GAM94 is therefore inhibition of FLJ13841 (Accession NP_078978.1). Accordingly, utilities of GAM94 include diagnosis, prevention and treatment of diseases and clinical conditions associated with FLJ13841.

FLJ14566 (Accession NP_116195.2) is another GAM94 target gene, herein designated TARGET GENE. FLJ14566 BINDING SITE is a target binding site found in the 3' untranslated region of mRNA encoded by FLJ14566, corresponding to a target binding site such as BINDING SITE I, BINDING SITE II or BINDING SITE III of FIG. 8. Table 4 illustrates the complementarity of the nucleotide sequences of FLJ14566 BINDING SITE, designated SEQ ID:5288, to the nucleotide sequence of GAM94 RNA, herein designated GAM RNA, also designated SEQ ID:332.

Another function of GAM94 is therefore inhibition of FLJ14566 (Accession NP_116195.2). Accordingly, utilities of GAM94 include diagnosis, prevention and treatment of diseases and clinical conditions associated with FLJ14566.

FLJ14957 (Accession NP_116255.1) is another GAM94 target gene, herein designated TARGET GENE. FLJ14957 BINDING SITE is a target binding site found in the 3' untranslated region of mRNA encoded by FLJ14957, corresponding to a target binding site such as BINDING SITE I, BINDING SITE II or BINDING SITE III of FIG. 8. Table 4 illustrates the complementarity of the nucleotide sequences of FLJ14957 BINDING SITE, designated SEQ ID:4961, to the nucleotide sequence of GAM94 RNA, herein designated GAM RNA, also designated SEQ ID:332.

Another function of GAM94 is therefore inhibition of FLJ14957 (Accession NP_116255.1). Accordingly, utilities of GAM94 include diagnosis, prevention and treatment of diseases and clinical conditions associated with FLJ14957.

FLJ20232 (Accession NP_061881.2) is another GAM94 target gene, herein designated TARGET GENE. FLJ20232 BINDING SITE is a target binding site found in the 3' untranslated region of mRNA encoded by FLJ20232, corresponding to a target binding site such as BINDING SITE I, BINDING SITE II or BINDING SITE III of FIG. 8. Table 4 illustrates the complementarity of the nucleotide sequences of FLJ20232 BINDING SITE, designated SEQ ID:17592, to the nucleotide sequence of GAM94 RNA, herein designated GAM RNA, also designated SEQ ID:332.

Another function of GAM94 is therefore inhibition of FLJ20232 (Accession NP_061881.2). Accordingly, utilities of GAM94 include diagnosis, prevention and treatment of diseases and clinical conditions associated with FLJ20232.

FLJ20273 (Accession NP_061900.1) is another GAM94 target gene, herein designated TARGET GENE. FLJ20273 BINDING SITE1 and FLJ20273 BINDING SITE2 are target binding sites found in untranslated regions of mRNA encoded by FLJ20273, corresponding to target binding sites such as BINDING SITE I, BINDING SITE II or BINDING SITE III of FIG. 8. Table 4 illustrates the complementarity of the nucleotide sequences of FLJ20273 BINDING SITE1 and FLJ20273 BINDING SITE2, designated SEQ ID:17100 and SEQ ID:10073 respectively, to the nucleotide sequence of GAM94 RNA, herein designated GAM RNA, also designated SEQ ID:332.

Another function of GAM94 is therefore inhibition of FLJ20273 (Accession NP_061900.1). Accordingly, utilities of GAM94 include diagnosis, prevention and treatment of diseases and clinical conditions associated with FLJ20273.

FLJ20668 (Accession NP_060393.1) is another GAM94 target gene, herein designated TARGET GENE. FLJ20668 BINDING SITE is a target binding site found in the 3' untranslated region of mRNA encoded by FLJ20668, corresponding to a target binding site such as BINDING SITE I, BINDING SITE II or BINDING SITE III of FIG. 8. Table 4 illustrates the complementarity of the nucleotide sequences of FLJ20668 BINDING SITE, designated SEQ ID:10920, to the nucleotide sequence of GAM94 RNA, herein designated GAM RNA, also designated SEQ ID:332.

Another function of GAM94 is therefore inhibition of FLJ20668 (Accession NP_060393.1). Accordingly, utilities of GAM94 include diagnosis, prevention and treatment of diseases and clinical conditions associated with FLJ20668.

FLJ21159 (Accession NP_079102.1) is another GAM94 target gene, herein designated TARGET GENE. FLJ21159 BINDING SITE is a target binding site found in the 3' untranslated region of mRNA encoded by FLJ21159, corresponding to a target binding site such as BINDING SITE I, BINDING SITE II or BINDING SITE III of FIG. 8. Table 4 illustrates the complementarity of the nucleotide sequences of FLJ21159 BINDING SITE, designated SEQ ID:19392, to the nucleotide sequence of GAM94 RNA, herein designated GAM RNA, also designated SEQ ID:332.

Another function of GAM94 is therefore inhibition of FLJ21159 (Accession NP_079102.1). Accordingly, utilities of GAM94 include diagnosis, prevention and treatment of diseases and clinical conditions associated with FLJ21159.

FLJ21940 (Accession NP_073739.1) is another GAM94 target gene, herein designated TARGET GENE. FLJ21940 BINDING SITE is a target binding site found in the 3' untranslated region of mRNA encoded by FLJ21940, corresponding to a target binding site such as BINDING SITE I, BINDING SITE II or BINDING SITE III of FIG. 8. Table 4 illustrates the complementarity of the nucleotide sequences of FLJ21940 BINDING SITE, designated SEQ ID:2403, to the nucleotide sequence of GAM94 RNA, herein designated GAM RNA, also designated SEQ ID:332.

Another function of GAM94 is therefore inhibition of FLJ21940 (Accession NP_073739.1). Accordingly, utilities of GAM94 include diagnosis, prevention and treatment of diseases and clinical conditions associated with FLJ21940.

FLJ21986 (Accession NP_079189.3) is another GAM94 target gene, herein designated TARGET GENE. FLJ21986 BINDING SITE is a target binding site found in the 5' untranslated region of mRNA encoded by FLJ21986, corresponding to a target binding site such as BINDING SITE I, BINDING SITE II or BINDING SITE III of FIG. 8. Table 4 illustrates the complementarity of the nucleotide sequences of FLJ21986 BINDING SITE, designated SEQ ID:6727, to the nucleotide sequence of GAM94 RNA, herein designated GAM RNA, also designated SEQ ID:332.

Another function of GAM94 is therefore inhibition of FLJ21986 (Accession NP_079189.3). Accordingly, utilities of GAM94 include diagnosis, prevention and treatment of diseases and clinical conditions associated with FLJ21986.

FLJ22037 (Accession XP_168215.1) is another GAM94 target gene, herein designated TARGET GENE. FLJ22037 BINDING SITE is a target binding site found in the 5' untranslated region of mRNA encoded by FLJ22037, corresponding to a target binding site such as BINDING SITE I, BINDING SITE II or BINDING SITE III of FIG. 8. Table 4 illustrates the complementarity of the nucleotide sequences of FLJ22037 BINDING SITE, designated SEQ ID:10902, to the nucleotide sequence of GAM94 RNA, herein designated GAM RNA, also designated SEQ ID:332.

Another function of GAM94 is therefore inhibition of FLJ22037 (Accession XP_168215.1). Accordingly, utilities of GAM94 include diagnosis, prevention and treatment of diseases and clinical conditions associated with FLJ22037.

FLJ22774 (Accession NP_115605.1) is another GAM94 target gene, herein designated TARGET GENE. FLJ22774 BINDING SITE is a target binding site found in the 3' untranslated region of mRNA encoded by FLJ22774, corresponding to a target binding site such as BINDING SITE I, BINDING SITE II or BINDING SITE III of FIG. 8. Table 4 illustrates the complementarity of the nucleotide sequences of FLJ22774 BINDING SITE, designated SEQ ID:10317, to the nucleotide sequence of GAM94 RNA, herein designated GAM RNA, also designated SEQ ID:332.

Another function of GAM94 is therefore inhibition of FLJ22774 (Accession NP_115605.1). Accordingly, utilities of GAM94 include diagnosis, prevention and treatment of diseases and clinical conditions associated with FLJ22774.

FLJ25369 (Accession NP_689883.1) is another GAM94 target gene, herein designated TARGET GENE. FLJ25369 BINDING SITE is a target binding site found in the 3' untranslated region of mRNA encoded by FLJ25369, corresponding to a target binding site such as BINDING SITE I, BINDING SITE II or BINDING SITE III of FIG. 8. Table 4 illustrates the complementarity of the nucleotide sequences of FLJ25369 BINDING SITE, designated SEQ ID:14188, to the nucleotide sequence of GAM94 RNA, herein designated GAM RNA, also designated SEQ ID:332.

Another function of GAM94 is therefore inhibition of FLJ25369 (Accession NP_689883.1). Accordingly, utilities of GAM94 include diagnosis, prevention and treatment of diseases and clinical conditions associated with FLJ25369.

FLJ25438 (Accession NP_653297.1) is another GAM94 target gene, herein designated TARGET GENE. FLJ25438 BINDING SITE is a target binding site found in the 3' untranslated region of mRNA encoded by FLJ25438, corresponding to a target binding site such as BINDING SITE I, BINDING SITE II or BINDING SITE III of FIG. 8. Table 4 illustrates the complementarity of the nucleotide sequences of FLJ25438 BINDING SITE, designated SEQ ID:12072, to the nucleotide sequence of GAM94 RNA, herein designated GAM RNA, also designated SEQ ID:332.

Another function of GAM94 is therefore inhibition of FLJ25438 (Accession NP_653297.1). Accordingly, utilities of GAM94 include diagnosis, prevention and treatment of diseases and clinical conditions associated with FLJ25438.

FLJ31131 (Accession NP_689748.1) is another GAM94 target gene, herein designated TARGET GENE. FLJ31131 BINDING SITE is a target binding site found in the 3' untranslated region of mRNA encoded by FLJ31131, corresponding to a target binding site such as BINDING SITE I, BINDING SITE II or BINDING SITE III of FIG. 8. Table 4 illustrates the complementarity of the nucleotide sequences of FLJ31131 BINDING SITE, designated SEQ ID:13536, to the nucleotide sequence of GAM94 RNA, herein designated GAM RNA, also designated SEQ ID:332.

Another function of GAM94 is therefore inhibition of FLJ31131 (Accession NP_689748.1). Accordingly, utilities of GAM94 include diagnosis, prevention and treatment of diseases and clinical conditions associated with FLJ31131.

FLJ31659 (Accession NP_694572.1) is another GAM94 target gene, herein designated TARGET GENE. FLJ31659 BINDING SITE is a target binding site found in the 3' untranslated region of mRNA encoded by FLJ31659, corresponding to a target binding site such as BINDING SITE I, BINDING SITE II or BINDING SITE III of FIG. 8. Table 4 illustrates the complementarity of the nucleotide sequences of FLJ31659 BINDING SITE, designated SEQ ID:2343, to the nucleotide sequence of GAM94 RNA, herein designated GAM RNA, also designated SEQ ID:332.

Another function of GAM94 is therefore inhibition of FLJ31659 (Accession NP_694572.1). Accordingly, utilities of GAM94 include diagnosis, prevention and treatment of diseases and clinical conditions associated with FLJ31659.

FLJ32063 (Accession NP_694576.1) is another GAM94 target gene, herein designated TARGET GENE. FLJ32063 BINDING SITE is a target binding site found in the 3' untranslated region of mRNA encoded by FLJ32063, corresponding to a target binding site such as BINDING SITE I, BINDING SITE II or BINDING SITE III of FIG. 8. Table 4 illustrates the complementarity of the nucleotide sequences of FLJ32063 BINDING SITE, designated SEQ ID:8368, to the nucleotide sequence of GAM94 RNA, herein designated GAM RNA, also designated SEQ ID:332.

Another function of GAM94 is therefore inhibition of FLJ32063 (Accession NP_694576.1). Accordingly, utilities of GAM94 include diagnosis, prevention and treatment of diseases and clinical conditions associated with FLJ32063.

FLJ32203 (Accession NP_653232.2) is another GAM94 target gene, herein designated TARGET GENE. FLJ32203 BINDING SITE is a target binding site found in the 5' untranslated region of mRNA encoded by FLJ32203, corresponding to a target binding site such as BINDING SITE I, BINDING SITE II or BINDING SITE III of FIG. 8. Table 4 illustrates the complementarity of the nucleotide sequences of FLJ32203 BINDING SITE, designated SEQ ID:17014, to the nucleotide sequence of GAM94 RNA, herein designated GAM RNA, also designated SEQ ID:332.

Another function of GAM94 is therefore inhibition of FLJ32203 (Accession NP_653232.2). Accordingly, utilities of GAM94 include diagnosis, prevention and treatment of diseases and clinical conditions associated with FLJ32203.

FLJ32894 (Accession NP_653268.1) is another GAM94 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:6669, to the nucleotide sequence of GAM94 RNA, herein designated GAM RNA, also designated SEQ ID:332.

Another function of GAM94 is therefore inhibition of FLJ32894 (Accession NP_653268.1). Accordingly, utilities of GAM94 include diagnosis, prevention and treatment of diseases and clinical conditions associated with FLJ32894.

FLJ33610 (Accession NP_775968.1) is another GAM94 target gene, herein designated TARGET GENE. FLJ33610 BINDING SITE is a target binding site found in the 3' untranslated region of mRNA encoded by FLJ33610, corresponding to a target binding site such as BINDING SITE I, BINDING SITE II or BINDING SITE III of FIG. 8. Table 4 illustrates the complementarity of the nucleotide sequences of FLJ33610 BINDING SITE, designated SEQ ID:18380, to the nucleotide sequence of GAM94 RNA, herein designated GAM RNA, also designated SEQ ID:332.

Another function of GAM94 is therefore inhibition of FLJ33610 (Accession NP_775968.1). Accordingly, utilities of GAM94 include diagnosis, prevention and treatment of diseases and clinical conditions associated with FLJ33610.

FLJ33887 (Accession NP_775756.1) is another GAM94 target gene, herein designated TARGET GENE. FLJ33887 BINDING SITE is a target binding site found in the 5' untranslated region of mRNA encoded by FLJ33887, corresponding to a target binding site such as BINDING SITE I, BINDING SITE II or BINDING SITE III of FIG. 8. Table 4 illustrates the complementarity of the nucleotide sequences of FLJ33887 BINDING SITE, designated SEQ ID:8829, to the nucleotide sequence of GAM94 RNA, herein designated GAM RNA, also designated SEQ ID:332.

Another function of GAM94 is therefore inhibition of FLJ33887 (Accession NP_775756.1). Accordingly, utilities of GAM94 include diagnosis, prevention and treatment of diseases and clinical conditions associated with FLJ33887.

FLJ34278 (Accession NP_775873.1) is another GAM94 target gene, herein designated TARGET GENE. FLJ34278 BINDING SITE is a target binding site found in the 3' untranslated region of mRNA encoded by FLJ34278, corresponding to a target binding site such as BINDING SITE I, BINDING SITE II or BINDING SITE III of FIG. 8. Table 4 illustrates the complementarity of the nucleotide sequences of FLJ34278 BINDING SITE, designated SEQ ID:8967, to the nucleotide sequence of GAM94 RNA, herein designated GAM RNA, also designated SEQ ID:332.

Another function of GAM94 is therefore inhibition of FLJ34278 (Accession NP_775873.1). Accordingly, utilities of GAM94 include diagnosis, prevention and treatment of diseases and clinical conditions associated with FLJ34278.

FLJ35721 (Accession NP_775955.1) is another GAM94 target gene, herein designated TARGET GENE. FLJ35721 BINDING SITE is a target binding site found in the 5' untranslated region of mRNA encoded by FLJ35721, corresponding to a target binding site such as BINDING SITE I, BINDING SITE II or BINDING SITE III of FIG. 8. Table 4 illustrates the complementarity of the nucleotide sequences of FLJ35721 BINDING SITE, designated SEQ ID:7540, to the nucleotide sequence of GAM94 RNA, herein designated GAM RNA, also designated SEQ ID:332.

Another function of GAM94 is therefore inhibition of FLJ35721 (Accession NP_775955.1). Accordingly, utilities of GAM94 include diagnosis, prevention and treatment of diseases and clinical conditions associated with FLJ35721.

FLJ35785 (Accession NP_775884.1) is another GAM94 target gene, herein designated TARGET GENE. FLJ35785 BINDING SITE is a target binding site found in the 5' untranslated region of mRNA encoded by FLJ35785, corresponding to a target binding site such as BINDING SITE I, BINDING SITE II or BINDING SITE III of FIG. 8. Table 4 illustrates the complementarity of the nucleotide sequences of FLJ35785 BINDING SITE, designated SEQ ID:6827, to the nucleotide sequence of GAM94 RNA, herein designated GAM RNA, also designated SEQ ID:332.

Another function of GAM94 is therefore inhibition of FLJ35785 (Accession NP_775884.1). Accordingly, utilities of GAM94 include diagnosis, prevention and treatment of diseases and clinical conditions associated with FLJ35785.

FLJ35866 (Accession XP_300990.1) is another GAM94 target gene, herein designated TARGET GENE. FLJ35866 BINDING SITE1 and FLJ35866 BINDING SITE2 are target binding sites found in untranslated regions of multiple transcripts of mRNA encoded by FLJ35866, corresponding to target binding sites such as BINDING SITE I, BINDING SITE II or BINDING SITE III of FIG. 8. Table 4 illustrates the complementarity of the nucleotide sequences of FLJ35866 BINDING SITE1 and FLJ35866 BINDING SITE2, designated SEQ ID:4640 and SEQ ID:6770 respectively, to the nucleotide sequence of GAM94 RNA, herein designated GAM RNA, also designated SEQ ID:332.

Another function of GAM94 is therefore inhibition of FLJ35866 (Accession XP_300990.1). Accordingly, utilities of GAM94 include diagnosis, prevention and treatment of diseases and clinical conditions associated with FLJ35866.

FLJ36006 (Accession NP_689858.1) is another GAM94 target gene, herein designated TARGET GENE. FLJ36006 BINDING SITE is a target binding site found in the 5' untranslated region of mRNA encoded by FLJ36006, corresponding to a target binding site such as BINDING SITE I, BINDING SITE II or BINDING SITE III of FIG. 8. Table 4 illustrates the complementarity of the nucleotide sequences of FLJ36006 BINDING SITE, designated SEQ ID:18215, to the nucleotide sequence of GAM94 RNA, herein designated GAM RNA, also designated SEQ ID:332.

Another function of GAM94 is therefore inhibition of FLJ36006 (Accession NP_689858.1). Accordingly, utilities of GAM94 include diagnosis, prevention and treatment of diseases and clinical conditions associated with FLJ36006.

FLJ36870 (Accession NP_775929.1) is another GAM94 target gene, herein designated TARGET GENE. FLJ36870 BINDING SITE is a target binding site found in the 5' untranslated region of mRNA encoded by FLJ36870, corresponding to a target binding site such as BINDING SITE I, BINDING SITE II or BINDING SITE III of FIG. 8. Table 4 illustrates the complementarity of the nucleotide sequences of FLJ36870 BINDING SITE, designated SEQ ID:15135, to the nucleotide sequence of GAM94 RNA, herein designated GAM RNA, also designated SEQ ID:332.

Another function of GAM94 is therefore inhibition of FLJ36870 (Accession NP_775929.1). Accordingly, utilities of GAM94 include diagnosis, prevention and treatment of diseases and clinical conditions associated with FLJ36870.

FLJ37045 (Accession NP_787085.1) is another GAM94 target gene, herein designated TARGET GENE. FLJ37045 BINDING SITE is a target binding site found in the 3' untranslated region of mRNA encoded by FLJ37045, corresponding to a target binding site such as BINDING SITE I, BINDING SITE II or BINDING SITE III of FIG. 8. Table 4 illustrates the complementarity of the nucleotide sequences of FLJ37045 BINDING SITE, designated SEQ ID:3394, to the nucleotide sequence of GAM94 RNA, herein designated GAM RNA, also designated SEQ ID:332.

Another function of GAM94 is therefore inhibition of FLJ37045 (Accession NP_787085.1). Accordingly, utilities of GAM94 include diagnosis, prevention and treatment of diseases and clinical conditions associated with FLJ37045.

FLJ37306 (Accession NP_775768.1) is another GAM94 target gene, herein designated TARGET GENE. FLJ37306 BINDING SITE is a target binding site found in the 3' untranslated region of mRNA encoded by FLJ37306, corresponding to a target binding site such as BINDING SITE I, BINDING SITE II or BINDING SITE III of FIG. 8. Table 4 illustrates the complementarity of the nucleotide sequences of FLJ37306 BINDING SITE, designated SEQ ID:17101, to the nucleotide sequence of GAM94 RNA, herein designated GAM RNA, also designated SEQ ID:332.

Another function of GAM94 is therefore inhibition of FLJ37306 (Accession NP_775768.1). Accordingly, utilities of GAM94 include diagnosis, prevention and treatment of diseases and clinical conditions associated with FLJ37306.

FLJ38568 (Accession NP_694984.1) is another GAM94 target gene, herein designated TARGET GENE. FLJ38568 BINDING SITE is a target binding site found in the 3' untranslated region of mRNA encoded by FLJ38568, corresponding to a target binding site such as BINDING SITE I, BINDING SITE II or BINDING SITE III of FIG. 8. Table 4 illustrates the complementarity of the nucleotide sequences of FLJ38568 BINDING SITE, designated SEQ ID:18616, to the nucleotide sequence of GAM94 RNA, herein designated GAM RNA, also designated SEQ ID:332.

Another function of GAM94 is therefore inhibition of FLJ38568 (Accession NP_694984.1). Accordingly, utilities of GAM94 include diagnosis, prevention and treatment of diseases and clinical conditions associated with FLJ38568.

FLJ39005 (Accession NP_848616.1) is another GAM94 target gene, herein designated TARGET GENE. FLJ39005 BINDING SITE is a target binding site found in the 5' untranslated region of mRNA encoded by FLJ39005, corresponding to a target binding site such as BINDING SITE I, BINDING SITE II or BINDING SITE III of FIG. 8. Table 4 illustrates the complementarity of the nucleotide sequences of FLJ39005 BINDING SITE, designated SEQ ID:911, to the nucleotide sequence of GAM94 RNA, herein designated GAM RNA, also designated SEQ ID:332.

Another function of GAM94 is therefore inhibition of FLJ39005 (Accession NP_848616.1). Accordingly, utilities of GAM94 include diagnosis, prevention and treatment of diseases and clinical conditions associated with FLJ39005.

FLJ39061 (Accession XP_092342.3) is another GAM94 target gene, herein designated TARGET GENE. FLJ39061 BINDING SITE is a target binding site found in the 5' untranslated region of mRNA encoded by FLJ39061, corresponding to a target binding site such as BINDING SITE I, BINDING SITE II or BINDING SITE III of FIG. 8. Table 4 illustrates the complementarity of the nucleotide sequences of FLJ39061 BINDING SITE, designated SEQ ID:17919, to the nucleotide sequence of GAM94 RNA, herein designated GAM RNA, also designated SEQ ID:332.

Another function of GAM94 is therefore inhibition of FLJ39061 (Accession XP_092342.3). Accordingly, utilities of GAM94 include diagnosis, prevention and treatment of diseases and clinical conditions associated with FLJ39061.

FLJ39421 (Accession NP_848614.1) is another GAM94 target gene, herein designated TARGET GENE. FLJ39421 BINDING SITE is a target binding site found in the 5' untranslated region of mRNA encoded by FLJ39421, corresponding to a target binding site such as BINDING SITE I, BINDING SITE II or BINDING SITE III of FIG. 8. Table 4 illustrates the complementarity of the nucleotide sequences of FLJ39421 BINDING SITE, designated SEQ ID:11838, to the nucleotide sequence of GAM94 RNA, herein designated GAM RNA, also designated SEQ ID:332.

Another function of GAM94 is therefore inhibition of FLJ39421 (Accession NP_848614.1). Accordingly, utilities of GAM94 include diagnosis, prevention and treatment of diseases and clinical conditions associated with FLJ39421.

FLJ40473 (Accession NP_848626.1) is another GAM94 target gene, herein designated TARGET GENE. FLJ40473 BINDING SITE is a target binding site found in the 3' untranslated region of mRNA encoded by FLJ40473, corresponding to a target binding site such as BINDING SITE I, BINDING SITE II or BINDING SITE III of FIG. 8. Table 4 illustrates the complementarity of the nucleotide sequences of FLJ40473 BINDING SITE, designated SEQ ID:4047, to the nucleotide sequence of GAM94 RNA, herein designated GAM RNA, also designated SEQ ID:332.

Another function of GAM94 is therefore inhibition of FLJ40473 (Accession NP_848626.1). Accordingly, utilities of GAM94 include diagnosis, prevention and treatment of diseases and clinical conditions associated with FLJ40473.

Fms-related tyrosine kinase 4 (FLT4, Accession NP_002011.1) is another GAM94 target gene, herein designated TARGET GENE. FLT4 BINDING SITE is a target binding site found in the 3' untranslated region of mRNA encoded by FLT4, corresponding to a target binding site such as BINDING SITE I, BINDING SITE II or BINDING SITE III of FIG. 8. Table 4 illustrates the complementarity of the nucleotide sequences of FLT4 BINDING SITE, designated SEQ ID:15512, to the nucleotide sequence of GAM94 RNA, herein designated GAM RNA, also designated SEQ ID:332.

Another function of GAM94 is therefore inhibition of Fms-related tyrosine kinase 4 (FLT4, Accession NP_002011.1), a gene which receptor for vegf-c. has a tyrosine-protein kinase activity. and therefore is associated with Lymphedema. Accordingly, utilities of GAM94 include diagnosis, prevention and treatment of Lymphedema, and of other diseases and clinical conditions associated with FLT4.

The function of FLT4 has been established by previous studies. By screening a placental cDNA library with a mouse Flt3 probe, Galland et al. (1992) isolated a human gene encoding a putative receptor-type tyrosine kinase. The deduced amino acid sequence of the intracellular portion of the molecule showed that it was strongly related to FLT1 (OMIM Ref. No. 165070) and KDR (OMIM Ref. No. 191306) and to a lesser degree to members of the class III receptor-type tyrosine kinases: FMS (OMIM Ref. No. 164770), PDGFR (173490, 173410), KIT (OMIM Ref. No. 164920), and FLT3 (OMIM Ref. No. 136351). Galland et al. (1992) mapped FLT4 to 5q34-q35, telomeric to the FMS and PDGFRB genes, by in situ hybridization. They assigned the mouse homolog to chromosome 11 by the same method. In the process of creating a radiation hybrid map of 18 genes, Warrington et al. (1992) demonstrated that the FLT4 gene is located on distal 5q between GABRA1 (OMIM Ref. No. 137160) at 5q34-q35 and DRD1 (OMIM Ref. No. 126449) at 5q35.1. Aprelikova et al. (1992) also mapped the FLT4 gene to 5q33-qter. Hereditary or primary lymphedema (OMIM Ref. No. 153100), first described by Milroy (1892), is a developmental disorder of the lymphatic system that leads to disabling, disfiguring swelling of the extremities, frequently of the legs. The disorder generally shows an autosomal dominant pattern of inheritance with reduced penetrance, variable expression, and variable age of onset. Swelling may appear in one or all limbs. Swelling varies in degree and in distribution, and, if untreated, worsens over time. In rare instances, angiosarcoma may develop in affected tissues (Offori et al., 1993). Ferrell et al. (1998) confirmed the mapping of the gene for hereditary lymphedema type I (OMIM Ref. No. 153100) to 5q34-q35 and identified a specific mutation in the FLT4 gene in affected members of 1 family. Evans et al. (1999) mapped hereditary lymphedema type I to the most telomeric part of 5q35.3. Assuming that the families they studied had mutations in the FLT4 gene, the mapping of the gene is refined. Karkkainen et al. (2000) identified mutations at the FLT4 locus in several families. They found that all disease-associated alleles analyzed had missense mutations and encoded proteins with an inactive tyrosine kinase, preventing downstream gene activation. These studies established that vascular endothelial growth factor receptor-3 is important for normal lymphatic vascular function. In a family with hereditary lymphedema, Irrthum et al. (2000) demonstrated linkage of the disorder with markers on 5q34-q35, including a FLT4 intragenic polymorphism. They also identified an A- to - G transition that cosegregated with the disease, predicting a histidine- to - arginine substitution in the catalytic loop of the FLT4 protein (136352.0006). In addition, they showed by in vitro expression that this mutation inhibited the autophosphorylation of the receptor. They Chy mouse mutant, characterized by accumulation of chylous ascites and swelling of the limbs, was obtained by ethylnitrosourea-induced mutagenesis (11,12:Lyon and Glenister, 1984, 1986). The phenotype is linked to mouse chromosome 11. Karkkainen et al. (2001) sequenced the Vegfr3 candidate gene on chromosome 11 in the Chy mice and found a heterozygous 3157A-T mutation resulting in an ile1053- to - phe (OMIM Ref. No. I1053F) amino acid substitution in the tyrosine kinase domain. This mutation was located in a highly conserved catalytic domain of the receptor, in close proximity to the VEGFR3 mutations in human primary lymphedema. The I1053F mutant receptor was tyrosine kinase inactive. Although lymphedema patients with heterozygous missense mutations of VEGFR3 retain some receptor activity because of the presence of the wildtype allele (Karkkainen et al., 2000), the mutant VEGFR3 can be classified as a dominant-negative receptor similar to certain mutant KIT receptors in piebaldism (OMIM Ref. No. 172800) and RET receptors (OMIM Ref. No. 164761) in Hirschsprung disease (OMIM Ref. No. 142623). Karkkainen et al. (2001) found that neuropilin-2 (NRP2; 602070) bound VEGFC and was expressed in the visceral, but not in the cutaneous, lymphatic endothelia. This may explain why hypoplastic cutaneous, but not visceral, lymphatic vessels were found in the Chy mice. Using virus-mediated VEGFC gene therapy, Karkkainen et al. (2001) were able to generate functional lymphatic vessels in the lymphedema mice. The results suggested that growth factor gene therapy is applicable to human lymphedema as well and provided a paradigm for other diseases associated with mutant receptors, i.e., ligand therapy.

Full details of the abovementioned studies are described in the following publications, the disclosure of which are hereby incorporated by reference:

Irrthum, A.; Karkkainen, M. J.; Devriendt, K.; Alitalo, K.; Vikkula, M.: Congenital hereditary lymphedema caused by a mutation that inactivates VEGFR3 tyrosine kinase. Am. J. Hum. Genet. 67:295-301, 2000; and Karkkainen, M. J.; Saaristo, A.; Jussila, L.; Karila, K. A.; Lawrence, E. C.; Pajusola, K.; Bueler, H.; Eichmann, A.; Kauppinen, R.; Kettunen, M. I.; Yla-Herttuala, S.; Finegold, D. N.

Further studies establishing the function and utilities of FLT4 are found in John Hopkins OMIM database record ID 136352, and in cited publications listed in Table 5, which are hereby incorporated by reference. Fbj murine osteosarcoma viral oncogene homolog b (FOSB, Accession NP_006723.1) is another GAM94 target gene, herein designated TARGET GENE. FOSB BINDING SITE1 and FOSB BINDING SITE2 are target binding sites found in untranslated regions of mRNA encoded by FOSB, corresponding to target binding sites such as BINDING SITE I, BINDING SITE II or BINDING SITE III of FIG. 8. Table 4 illustrates the complementarity of the nucleotide sequences of FOSB BINDING SITE1 and FOSB BINDING SITE2, designated SEQ ID:18954 and SEQ ID:2063 respectively, to the nucleotide sequence of GAM94 RNA, herein designated GAM RNA, also designated SEQ ID:332.

Another function of GAM94 is therefore inhibition of Fbj murine osteosarcoma viral oncogene homolog b (FOSB, Accession NP_006723.1), a gene which interacts with jun proteins enhancing their dna binding activity. and therefore may be associated with Cocaine addiction. Accordingly, utilities of GAM94 include diagnosis, prevention and treatment of Cocaine addiction, and of other diseases and clinical conditions associated with FOSB.

The function of FOSB and its association with various diseases and clinical conditions, has been established by previous studies, as described hereinabove with reference to GAM53.1. Frizzled homolog 1 (drosophila) (FZD1, Accession NP_003496.1) is another GAM94 target gene, herein designated TARGET GENE. FZD1 BINDING SITE is a target binding site found in the 3' untranslated region of mRNA encoded by FZD1, corresponding to a target binding site such as BINDING SITE I, BINDING SITE II or BINDING SITE III of FIG. 8. Table 4 illustrates the complementarity of the nucleotide sequences of FZD1 BINDING SITE, designated SEQ ID:9605, to the nucleotide sequence of GAM94 RNA, herein designated GAM RNA, also designated SEQ ID:332.

Another function of GAM94 is therefore inhibition of Frizzled homolog 1 (drosophila) (FZD1, Accession NP_003496.1), a gene which may be involved in bone resorption; strongly similar to rat Fzd. Accordingly, utilities of GAM94 include diagnosis, prevention and treatment of diseases and clinical conditions associated with FZD1.

The function of FZD1 has been established by previous studies. Members of the 'frizzled' (Fz) gene family encode 7-transmembrane domain proteins that are receptors for Wnt (see OMIM Ref. No. 164975) signaling proteins. See 601766. Liu et al. (2001) constructed a chimeric receptor with the ligand-binding and transmembrane segments from the beta-2-adrenergic receptor (OMIM Ref. No. 109690) and the cytoplasmic domains from rat frizzled-1. Stimulation of mouse F9 clones expressing the chimera with the beta-adrenergic agonist isoproterenol stimulated stabilization of beta-catenin (OMIM Ref. No. 116806), activation of a beta-catenin-sensitive promoter, and formation of primitive endoderm. The response was blocked by inactivation of pertussis toxin-sensitive, heterotrimeric G proteins, and by depletion of G-alpha-q (OMIM Ref. No. 600998) and G-alpha-o (OMIM Ref. No. 139311). Thus, Liu et al. (2001) concluded that G proteins are elements of Wnt/frizzled-1 signaling to the beta-catenin- lymphoid-enhancer factor (LEF)-T-cell factor (Tcf) pathway.

Full details of the abovementioned studies are described in the following publications, the disclosure of which are hereby incorporated by reference:

Liu, T.; DeCostanzo, A. J.; Liu, X.; Wang, H.; Hallagan, S.; Moon, R. T.; Malbon, C. C.: G protein signaling from activated rat frizzled-1 to the beta-catenin-Lef-Tcf pathway. Science 292:1718-1722, 2001; and Sagara, N.; Toda, G.; Hirai, M.; Terada, M.; Katoh, M.: Molecular cloning, differential expression, and chromosomal localization of human frizzled-1, frizzled-2, and frizzled-7. Bioch.

Further studies establishing the function and utilities of FZD1 are found in John Hopkins OMIM database record ID 603408, and in cited publications listed in Table 5, which are hereby incorporated by reference. Grb2-associated binding protein 2 (GAB2, Accession NP_536739.1) is another GAM94 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:10497, to the nucleotide sequence of GAM94 RNA, herein designated GAM RNA, also designated SEQ ID:332.

Another function of GAM94 is therefore inhibition of Grb2-associated binding protein 2 (GAB2, Accession NP_536739.1), a gene which act as adapters for transmitting various signals. Accordingly, utilities of GAM94 include diagnosis, prevention and treatment of diseases and clinical conditions associated with GAB2.

The function of GAB2 and its association with various diseases and clinical conditions, has been established by previous studies, as described hereinabove with reference to GAM63.1. Grb2-associated binding protein 2 (GAB2, Accession NP_036428.1) is another GAM94 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:10497, to the nucleotide sequence of GAM94 RNA, herein designated GAM RNA, also designated SEQ ID:332.

Another function of GAM94 is therefore inhibition of Grb2-associated binding protein 2 (GAB2, Accession NP_036428.1), a gene which act as adapters for transmitting various signals. Accordingly, utilities of GAM94 include diagnosis, prevention and treatment of diseases and clinical conditions associated with GAB2.

The function of GAB2 and its association with various diseases and clinical conditions, has been established by previous studies, as described hereinabove with reference to GAM63.1. Gamma-aminobutyric acid (gaba) b receptor, 1 (GABBR1, Accession NP_068705.1) is another GAM94 target gene, herein designated TARGET GENE. GABBR1 BINDING SITE is a target binding site found in the 5' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:9593, to the nucleotide sequence of GAM94 RNA, herein designated GAM RNA, also designated SEQ ID:332.

Another function of GAM94 is therefore inhibition of Gamma-aminobutyric acid (gaba) b receptor, 1 (GABBR1, Accession NP_068705.1). Accordingly, utilities of GAM94 include diagnosis, prevention and treatment of diseases and clinical conditions associated with GABBR1.

Gamma-aminobutyric acid (gaba) b receptor, 1 (GABBR1, Accession NP_001461.1) is another GAM94 target gene, herein designated TARGET GENE. GABBR1 BINDING SITE is a target binding site found in the 5' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:9593, to the nucleotide sequence of GAM94 RNA, herein designated GAM RNA, also designated SEQ ID:332.

Another function of GAM94 is therefore inhibition of Gamma-aminobutyric acid (gaba) b receptor, 1 (GABBR1, Accession NP_001461.1). Accordingly, utilities of GAM94 include diagnosis, prevention and treatment of diseases and clinical conditions associated with GABBR1.

Gamma-aminobutyric acid (gaba) b receptor, 1 (GABBR1, Accession NP_068704.1) is another GAM94 target gene, herein designated TARGET GENE. GABBR1 BINDING SITE is a target binding site found in the 5' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:9593, to the nucleotide sequence of GAM94 RNA, herein designated GAM RNA, also designated SEQ ID:332.

Another function of GAM94 is therefore inhibition of Gamma-aminobutyric acid (gaba) b receptor, 1 (GABBR1, Accession NP_068704.1). Accordingly, utilities of GAM94 include diagnosis, prevention and treatment of diseases and clinical conditions associated with GABBR1.

GAPCENA (Accession NP_036329.2) is another GAM94 target gene, herein designated TARGET GENE. GAPCENA BINDING SITE is a target binding site found in the 5' untranslated region of mRNA encoded by GAPCENA, corresponding to a target binding site such as BINDING SITE I, BINDING SITE II or BINDING SITE III of FIG. 8. Table 4 illustrates the complementarity of the nucleotide sequences of GAPCENA BINDING SITE, designated SEQ ID:18769, to the nucleotide sequence of GAM94 RNA, herein designated GAM RNA, also designated SEQ ID:332.

Another function of GAM94 is therefore inhibition of GAPCENA (Accession NP_036329.2). Accordingly, utilities of GAM94 include diagnosis, prevention and treatment of diseases and clinical conditions associated with GAPCENA.

GATS (Accession NP_849153.1) is another GAM94 target gene, herein designated TARGET GENE. GATS BINDING SITE1 and GATS BINDING SITE2 are target binding sites found in untranslated regions of mRNA encoded by GATS, corresponding to target binding sites such as BINDING SITE I, BINDING SITE II or BINDING SITE III of FIG. 8. Table 4 illustrates the complementarity of the nucleotide sequences of GATS BINDING SITE1 and GATS BINDING SITE2, designated SEQ ID:11136 and SEQ ID:4488 respectively, to the nucleotide sequence of GAM94 RNA, herein designated GAM RNA, also designated SEQ ID:332.

Another function of GAM94 is therefore inhibition of GATS (Accession NP_849153.1). Accordingly, utilities of GAM94 include diagnosis, prevention and treatment of diseases and clinical conditions associated with GATS.

GDEP (Accession NP_477516.1) is another GAM94 target gene, herein designated TARGET GENE. GDEP BINDING SITE is a target binding site found in the 5' untranslated region of mRNA encoded by GDEP, corresponding to a target binding site such as BINDING SITE I, BINDING SITE II or BINDING SITE III of FIG. 8. Table 4 illustrates the complementarity of the nucleotide sequences of GDEP BINDING SITE, designated SEQ ID:4567, to the nucleotide sequence of GAM94 RNA, herein designated GAM RNA, also designated SEQ ID:332.

Another function of GAM94 is therefore inhibition of GDEP (Accession NP_477516.1). Accordingly, utilities of GAM94 include diagnosis, prevention and treatment of diseases and clinical conditions associated with GDEP.

Guanine nucleotide binding protein (g protein), gamma transducing activity polypeptide 2 (GNGT2, Accession NP_113686.1) is another GAM94 target gene, herein designated TARGET GENE. GNGT2 BINDING SITE is a target binding site found in the 5' untranslated region of mRNA encoded by GNGT2, corresponding to a target binding site such as BINDING SITE I, BINDING SITE II or BINDING SITE III of FIG. 8. Table 4 illustrates the complementarity of the nucleotide sequences of GNGT2 BINDING SITE, designated SEQ ID:10664, to the nucleotide sequence of GAM94 RNA, herein designated GAM RNA, also designated SEQ ID:332.

Another function of GAM94 is therefore inhibition of Guanine nucleotide binding protein (g protein), gamma transducing activity polypeptide 2 (GNGT2, Accession NP_113686.1), a gene which is involved as a modulator or transducer in various transmembrane signaling systems. Accordingly, utilities of GAM94 include diagnosis, prevention and treatment of diseases and clinical conditions associated with GNGT2.

The function of GNGT2 has been established by previous studies. Phototransduction in the vertebrate rod and cone photoreceptors is regulated by structurally homologous but distinct groups of signaling proteins. Ong et al. (1995) identified in bovine retinas a cone-specific G protein gamma subunit, G-gamma-c (previously named G-gamma-8), which may play a key role in coupling the cone visual pigment to phosphodiesterase. Ong et al. (1997) characterized the human homolog, which was found to share a high degree of sequence identity with the corresponding bovine isoform (85%) and human rod G-gamma-1 (63%). The protein is specifically localized in cones, as indicated by immunohistochemical staining. Nucleotide sequence analysis of the gene, designated GNGT2, showed a structure consisting of 3 exons and 2 introns, with the intron splice sites similar to those of the rod G-gamma-1 gene (GNGT1; 189970). By FISH, Ong et al. (1997) localized the GNGT2 gene to 17q21.

Full details of the abovementioned studies are described in the following publications, the disclosure of which are hereby incorporated by reference:

Ong, O. C.; Hu, K.; Rong, H.; Lee, R. H.; Fung, B. K.-K.: Gene structure and chromosome localization of the G-gamma-c subunit of human cone G-protein (GNGT2). Genomics 44:101-109, 1997; and Ong, O. C.; Yamane, H. K.; Phan, K. B.; Fong, H. K.; Bok, D.; Lee, R. H.; Fung, B. K.-K.: Molecular cloning and characterization of the G protein gamma subunit of cone photoreceptors.

Further studies establishing the function and utilities of GNGT2 are found in John Hopkins OMIM database record ID 603655, and in cited publications listed in Table 5, which are hereby incorporated by reference. Guanine nucleotide binding protein-like 1 (GNL1, Accession NP_005266.1) is another GAM94 target gene, herein designated TARGET GENE. GNL1 BINDING SITE is a target binding site found in the 5' untranslated region of mRNA encoded by GNL1, corresponding to a target binding site such as BINDING SITE I, BINDING SITE II or BINDING SITE III of FIG. 8. Table 4 illustrates the complementarity of the nucleotide sequences of GNL1 BINDING SITE, designated SEQ ID:14132, to the nucleotide sequence of GAM94 RNA, herein designated GAM RNA, also designated SEQ ID:332.

Another function of GAM94 is therefore inhibition of Guanine nucleotide binding protein-like 1 (GNL1, Accession NP_005266.1). Accordingly, utilities of GAM94 include diagnosis, prevention and treatment of diseases and clinical conditions associated with GNL1.

Golgi autoantigen, golgin subfamily a, 2-like, y-linked (GOLGA2LY, Accession XP_034789.4) is another GAM94 target gene, herein designated TARGET GENE. GOLGA2LY BINDING SITE is a target binding site found in the 5' untranslated region of mRNA encoded by GOLGA2LY, corresponding to a target binding site such as BINDING SITE I, BINDING SITE II or BINDING SITE III of FIG. 8. Table 4 illustrates the complementarity of the nucleotide sequences of GOLGA2LY BINDING SITE, designated SEQ ID:1437, to the nucleotide sequence of GAM94 RNA, herein designated GAM RNA, also designated SEQ ID:332.

Another function of GAM94 is therefore inhibition of Golgi autoantigen, golgin subfamily a, 2-like, y-linked (GOLGA2LY, Accession XP_034789.4). Accordingly, utilities of GAM94 include diagnosis, prevention and treatment of diseases and clinical conditions associated with GOLGA2LY.

GOR (Accession NP_758439.1) is another GAM94 target gene, herein designated TARGET GENE. GOR BINDING SITE is a target binding site found in the 3' untranslated region of mRNA encoded by GOR, corresponding to a target binding site such as BINDING SITE I, BINDING SITE II or BINDING SITE III of FIG. 8. Table 4 illustrates the complementarity of the nucleotide sequences of GOR BINDING SITE, designated SEQ ID:2708, to the nucleotide sequence of GAM94 RNA, herein designated GAM RNA, also designated SEQ ID:332.

Another function of GAM94 is therefore inhibition of GOR (Accession NP_758439.1). Accordingly, utilities of GAM94 include diagnosis, prevention and treatment of diseases and clinical conditions associated with GOR.

Glycoprotein a33 (transmembrane) (GPA33, Accession NP_005805.1) is another GAM94 target gene, herein designated TARGET GENE. GPA33 BINDING SITE is a target binding site found in the 5' untranslated region of mRNA encoded by GPA33, corresponding to a target binding site such as BINDING SITE I, BINDING SITE II or BINDING SITE III of FIG. 8. Table 4 illustrates the complementarity of the nucleotide sequences of GPA33 BINDING SITE, designated SEQ ID:15497, to the nucleotide sequence of GAM94 RNA, herein designated GAM RNA, also designated SEQ ID:332.

Another function of GAM94 is therefore inhibition of Glycoprotein a33 (transmembrane) (GPA33, Accession NP_005805.1). Accordingly, utilities of GAM94 include diagnosis, prevention and treatment of diseases and clinical conditions associated with GPA33.

Glycoprotein m6b (GPM6B, Accession NP_005269.1) is another GAM94 target gene, herein designated TARGET GENE. GPM6B BINDING SITE is a target binding site found in the 5' untranslated region of mRNA encoded by GPM6B, corresponding to a target binding site such as BINDING SITE I, BINDING SITE II or BINDING SITE III of FIG. 8. Table 4 illustrates the complementarity of the nucleotide sequences of GPM6B BINDING SITE, designated SEQ ID:4391, to the nucleotide sequence of GAM94 RNA, herein designated GAM RNA, also designated SEQ ID:332.

Another function of GAM94 is therefore inhibition of Glycoprotein m6b (GPM6B, Accession NP_005269.1), a gene which may be involved in neural development. Accordingly, utilities of GAM94 include diagnosis, prevention and treatment of diseases and clinical conditions associated with GPM6B.

The function of GPM6B has been established by previous studies. Yan et al. (1993) used monoclonal antibodies raised against antigens in mouse brain fractions to isolate 2 related cDNAs from an expression library. The cDNAs, designated M6a (OMIM Ref. No. 601275) and M6b, are highly similar to the myelin proteolipid protein (OMIM Ref. No. 300401) and are expressed during early development of the mouse central nervous system. Partial human genomic and cDNA clones for M6b (symbol =GPM6B) were obtained by Olinsky et al. (1996). They found that M6b is expressed in both neurons and glia and was detected in the cerebellar Bergmann glia, in glia within white matter tracts of the cerebellum and cerebrum, and in embryonic dorsal root ganglia Olinsky et al. (1996) mapped the gene to Xp22.2 by fluorescence in situ hybridization. Narayanan et al. (1998) described the structure of the M6b gene and refined the physical mapping of the gene to a location between markers DXS69E and DXS414. They presented data from a mutation analysis on 55 patients with Rett syndrome (RTT; 312750), from which they concluded that it was very unlikely that M6b is involved in Rett syndrome. A relationship had been suggested by the fact that the gene maps to the same region of Xp as does RTT and by the fact that M6b is a member of the proteolipid protein gene family.

Full details of the abovementioned studies are described in the following publications, the disclosure of which are hereby incorporated by reference:

Narayanan, V.; Olinsky, S.; Dahle, E.; Naidu, S.; Zoghbi, H. Y.: Mutation analysis of the M6b gene in patients with Rett syndrome. Am. J. Med. Genet. 78:165-168, 1998; and Olinsky, S.; Loop, B. T.; DeKosky, A.; Ripepi, B.; Weng, W.; Cummins, J.; Wenger, S. L.; Yan, Y.; Lagenaur, C.; Narayanan, V.: Chromosomal mapping of the human M6 genes. Genomics 33:53.

Further studies establishing the function and utilities of GPM6B are found in John Hopkins OMIM database record ID 300051, and in cited publications listed in Table 5, which are hereby incorporated by reference. G protein-coupled receptor 55 (GPR55, Accession NP_005674.1) is another GAM94 target gene, herein designated TARGET GENE. GPR55 BINDING SITE is a target binding site found in the 3' untranslated region of mRNA encoded by GPR55, corresponding to a target binding site such as BINDING SITE I, BINDING SITE II or BINDING SITE III of FIG. 8. Table 4 illustrates the complementarity of the nucleotide sequences of GPR55 BINDING SITE, designated SEQ ID:4012, to the nucleotide sequence of GAM94 RNA, herein designated GAM RNA, also designated SEQ ID:332.

Another function of GAM94 is therefore inhibition of G protein-coupled receptor 55 (GPR55, Accession NP_005674.1). Accordingly, utilities of GAM94 include diagnosis, prevention and treatment of diseases and clinical conditions associated with GPR55.

G protein-coupled receptor 56 (GPR56, Accession NP_005673.2) is another GAM94 target gene, herein designated TARGET GENE. GPR56 BINDING SITE is a target binding site found in the 3' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:5025, to the nucleotide sequence of GAM94 RNA, herein designated GAM RNA, also designated SEQ ID:332.

Another function of GAM94 is therefore inhibition of G protein-coupled receptor 56 (GPR56, Accession NP_005673.2), a gene which transduces extracellular signals through heterotrimeric G proteins. Accordingly, utilities of GAM94 include diagnosis, prevention and treatment of diseases and clinical conditions associated with GPR56.

The function of GPR56 and its association with various diseases and clinical conditions, has been established by previous studies, as described hereinabove with reference to GAM63.1. G protein-coupled receptor 62 (GPR62, Accession NP_543141.1) is another GAM94 target gene, herein designated TARGET GENE. GPR62 BINDING SITE1 and GPR62 BINDING SITE2 are target binding sites found in untranslated regions of mRNA encoded by GPR62, corresponding to target binding sites such as BINDING SITE I, BINDING SITE II or BINDING SITE III of FIG. 8. Table 4 illustrates the complementarity of the nucleotide sequences of GPR62 BINDING SITE1 and GPR62 BINDING SITE2, designated SEQ ID:14335 and SEQ ID:15063 respectively, to the nucleotide sequence of GAM94 RNA, herein designated GAM RNA, also designated SEQ ID:332.

Another function of GAM94 is therefore inhibition of G protein-coupled receptor 62 (GPR62, Accession NP_543141.1). Accordingly, utilities of GAM94 include diagnosis, prevention and treatment of diseases and clinical conditions associated with GPR62.

G protein-coupled receptor 72 (GPR72, Accession NP_057624.1) is another GAM94 target gene, herein designated TARGET GENE. GPR72 BINDING SITE is a target binding site found in the 3' untranslated region of mRNA encoded by GPR72, corresponding to a target binding site such as BINDING SITE I, BINDING SITE II or BINDING SITE III of FIG. 8. Table 4 illustrates the complementarity of the nucleotide sequences of GPR72 BINDING SITE, designated SEQ ID:15584, to the nucleotide sequence of GAM94 RNA, herein designated GAM RNA, also designated SEQ ID:332.

Another function of GAM94 is therefore inhibition of G protein-coupled receptor 72 (GPR72, Accession NP_057624.1). Accordingly, utilities of GAM94 include diagnosis, prevention and treatment of diseases and clinical conditions associated with GPR72.

Glutamate receptor, ionotrophic, ampa 3 (GRIA3, Accession NP_000819.1) is another GAM94 target gene, herein designated TARGET GENE. GRIA3 BINDING SITE is a target binding site found in the 5' untranslated region of multiple transcripts of mRNA encoded by GRIA3, corresponding to a target binding site such as BINDING SITE I, BINDING SITE II or BINDING SITE III of FIG. 8. Table 4 illustrates the complementarity of the nucleotide sequences of GRIA3 BINDING SITE, designated SEQ ID:14641, to the nucleotide sequence of GAM94 RNA, herein designated GAM RNA, also designated SEQ ID:332.

Another function of GAM94 is therefore inhibition of Glutamate receptor, ionotrophic, ampa 3 (GRIA3, Accession NP_000819.1). Accordingly, utilities of GAM94 include diagnosis, prevention and treatment of diseases and clinical conditions associated with GRIA3.

Glutamate receptor, ionotropic, n-methyl-d-aspartate 3a (GRIN3A, Accession NP_597702.1) is another GAM94 target gene, herein designated TARGET GENE. GRIN3A BINDING SITE is a target binding site found in the 3' untranslated region of mRNA encoded by GRIN3A, corresponding to a target binding site such as BINDING SITE I, BINDING SITE II or BINDING SITE III of FIG. 8. Table 4 illustrates the complementarity of the nucleotide sequences of GRIN3A BINDING SITE, designated SEQ ID:13739, to the nucleotide sequence of GAM94 RNA, herein designated GAM RNA, also designated SEQ ID:332.

Another function of GAM94 is therefore inhibition of Glutamate receptor, ionotropic, n-methyl-d-aspartate 3a (GRIN3A, Accession NP_597702.1). Accordingly, utilities of GAM94 include diagnosis, prevention and treatment of diseases and clinical conditions associated with GRIN3A.

Goosecoid (GSC, Accession NP_776248.1) is another GAM94 target gene, herein designated TARGET GENE. GSC BINDING SITE is a target binding site found in the 3' untranslated region of mRNA encoded by GSC, corresponding to a target binding site such as BINDING SITE I, BINDING SITE II or BINDING SITE III of FIG. 8. Table 4 illustrates the complementarity of the nucleotide sequences of GSC BINDING SITE, designated SEQ ID:17283, to the nucleotide sequence of GAM94 RNA, herein designated GAM RNA, also designated SEQ ID:332.

Another function of GAM94 is therefore inhibition of Goosecoid (GSC, Accession NP_776248.1). Accordingly, utilities of GAM94 include diagnosis, prevention and treatment of diseases and clinical conditions associated with GSC.

Heart and neural crest derivatives expressed 2 (HAND2, Accession NP_068808.1) is another GAM94 target gene, herein designated TARGET GENE. HAND2 BINDING SITE is a target binding site found in the 3' untranslated region of mRNA encoded by HAND2, corresponding to a target binding site such as BINDING SITE I, BINDING SITE II or BINDING SITE III of FIG. 8. Table 4 illustrates the complementarity of the nucleotide sequences of HAND2 BINDING SITE, designated SEQ ID:8738, to the nucleotide sequence of GAM94 RNA, herein designated GAM RNA, also designated SEQ ID:332.

Another function of GAM94 is therefore inhibition of Heart and neural crest derivatives expressed 2 (HAND2, Accession NP_068808.1). Accordingly, utilities of GAM94 include diagnosis, prevention and treatment of diseases and clinical conditions associated with HAND2.

Hepatitis b virus x associated protein (HBXAP, Accession NP_057662.2) is another GAM94 target gene, herein designated TARGET GENE. HBXAP BINDING SITE is a target binding site found in the 5' untranslated region of mRNA encoded by HBXAP, corresponding to a target binding site such as BINDING SITE I, BINDING SITE II or BINDING SITE III of FIG. 8. Table 4 illustrates the complementarity of the nucleotide sequences of HBXAP BINDING SITE, designated SEQ ID:5810, to the nucleotide sequence of GAM94 RNA, herein designated GAM RNA, also designated SEQ ID:332.

Another function of GAM94 is therefore inhibition of Hepatitis b virus x associated protein (HBXAP, Accession NP_057662.2). Accordingly, utilities of GAM94 include diagnosis, prevention and treatment of diseases and clinical conditions associated with HBXAP.

Hemogen (HEMGN, Accession NP_060907.1) is another GAM94 target gene, herein designated TARGET GENE. HEMGN BINDING SITE is a target binding site found in the 5' untranslated region of mRNA encoded by HEMGN, corresponding to a target binding site such as BINDING SITE I, BINDING SITE II or BINDING SITE III of FIG. 8. Table 4 illustrates the complementarity of the nucleotide sequences of HEMGN BINDING SITE, designated SEQ ID:18446, to the nucleotide sequence of GAM94 RNA, herein designated GAM RNA, also designated SEQ ID:332.

Another function of GAM94 is therefore inhibition of Hemogen (HEMGN, Accession NP_060907.1). Accordingly, utilities of GAM94 include diagnosis, prevention and treatment of diseases and clinical conditions associated with HEMGN.

HIC (Accession XP_041273.1) is another GAM94 target gene, herein designated TARGET GENE. HIC BINDING SITE is a target binding site found in the 5' untranslated region of mRNA encoded by HIC, corresponding to a target binding site such as BINDING SITE I, BINDING SITE II or BINDING SITE III of FIG. 8. Table 4 illustrates the complementarity of the nucleotide sequences of HIC BINDING SITE, designated SEQ ID:5416, to the nucleotide sequence of GAM94 RNA, herein designated GAM RNA, also designated SEQ ID:332.

Another function of GAM94 is therefore inhibition of HIC (Accession XP_041273.1). Accordingly, utilities of GAM94 include diagnosis, prevention and treatment of diseases and clinical conditions associated with HIC.

HIS1 (Accession NP_006451.1) is another GAM94 target gene, herein designated TARGET GENE. HIS1 BINDING SITE is a target binding site found in the 5' untranslated region of mRNA encoded by HIS1, corresponding to a target binding site such as BINDING SITE I, BINDING SITE II or BINDING SITE III of FIG. 8. Table 4 illustrates the complementarity of the nucleotide sequences of HIS1 BINDING SITE, designated SEQ ID:3217, to the nucleotide sequence of GAM94 RNA, herein designated GAM RNA, also designated SEQ ID:332.

Another function of GAM94 is therefore inhibition of HIS1 (Accession NP_006451.1). Accordingly, utilities of GAM94 include diagnosis, prevention and treatment of diseases and clinical conditions associated with HIS1.

High-mobility group box 2 (HMGB2, Accession NP_002120.1) is another GAM94 target gene, herein designated TARGET GENE. HMGB2 BINDING SITE is a target binding site found in the 3' untranslated region of mRNA encoded by HMGB2, corresponding to a target binding site such as BINDING SITE I, BINDING SITE II or BINDING SITE III of FIG. 8. Table 4 illustrates the complementarity of the nucleotide sequences of HMGB2 BINDING SITE, designated SEQ ID:15162, to the nucleotide sequence of GAM94 RNA, herein designated GAM RNA, also designated SEQ ID:332.

Another function of GAM94 is therefore inhibition of High-mobility group box 2 (HMGB2, Accession NP_002120.1), a gene which binds to single-stranded DNA, unwinds double-stranded DNA, and increases transcription. Accordingly, utilities of GAM94 include diagnosis, prevention and treatment of diseases and clinical conditions associated with HMGB2.

The function of HMGB2 has been established by previous studies. The high mobility group (HMG) proteins are localized in the nuclei of higher eukaryotes and occur in 3 families, 1 of which includes HMG1 (OMIM Ref. No. 163905) and HMG2. These proteins include a so-called HMG box which is involved in DNA binding. Both HMG1 and HMG2 proteins bind to single-stranded DNA, unwind double-stranded DNA, and increase transcription (Wanschura et al., 1996). By screening a human genomic library with the pig thymus cDNA coding for chromosomal protein HGM2, Shirakawa and Yoshida (1992) isolated a 4,341-bp fragment containing the entire gene encoding this protein. The gene was 2,665 bp long from the start site to the end of transcription and comprised 5 exons. Length of the mRNA predicted from the exons was 1,125 bp. The canonical 5-prime regulatory motifs, CCAAT, were present, whereas the TATA element was absent from the gene. The primary structure of the human HMG2 protein consisted of 208 amino acid residues and was different from that of the pig HGM2 in only 2 amino acids; one was exchanged and the other was missing.

Full details of the abovementioned studies are described in the following publications, the disclosure of which are hereby incorporated by reference:

Shirakawa, H.; Yoshida, M.: Structure of a gene coding for human HMG2 protein. J. Biol. Chem. 267:6641-6645, 1992; and Wanschura, S.; Schoenmakers, E. F. P. M.; Huysmans, C.; Bartnitzke, S.; Van de Ven, W. J. M.; Bullerdiek, J.: Mapping of the human HMG2 gene to 4q31. Genomics 31:264-265, 1996.

Further studies establishing the function and utilities of HMGB2 are found in John Hopkins OMIM database record ID 163906, and in cited publications listed in Table 5, which are hereby incorporated by reference. HMP19 (Accession NP_057064.1) is another GAM94 target gene, herein designated TARGET GENE. HMP19 BINDING SITE is a target binding site found in the 3' untranslated region of mRNA encoded by HMP19, corresponding to a target binding site such as BINDING SITE I, BINDING SITE II or BINDING SITE III of FIG. 8. Table 4 illustrates the complementarity of the nucleotide sequences of HMP19 BINDING SITE, designated SEQ ID:15566, to the nucleotide sequence of GAM94 RNA, herein designated GAM RNA, also designated SEQ ID:332.

Another function of GAM94 is therefore inhibition of HMP19 (Accession NP_057064.1). Accordingly, utilities of GAM94 include diagnosis, prevention and treatment of diseases and clinical conditions associated with HMP19.

Homeo box a13 (HOXA13, Accession NP_000513.2) is another GAM94 target gene, herein designated TARGET GENE. HOXA13 BINDING SITE is a target binding site found in the 3' untranslated region of mRNA encoded by HOXA13, corresponding to a target binding site such as BINDING SITE I, BINDING SITE II or BINDING SITE III of FIG. 8. Table 4 illustrates the complementarity of the nucleotide sequences of HOXA13 BINDING SITE, designated SEQ ID:14274, to the nucleotide sequence of GAM94 RNA, herein designated GAM RNA, also designated SEQ ID:332.

Another function of GAM94 is therefore inhibition of Homeo box a13 (HOXA13, Accession NP_000513.2). Accordingly, utilities of GAM94 include diagnosis, prevention and treatment of diseases and clinical conditions associated with HOXA13.

Homeo box b5 (HOXB5, Accession NP_002138.1) is another GAM94 target gene, herein designated TARGET GENE. HOXB5 BINDING SITE is a target binding site found in the 3' untranslated region of mRNA encoded by HOXB5, corresponding to a target binding site such as BINDING SITE I, BINDING SITE II or BINDING SITE III of FIG. 8. Table 4 illustrates the complementarity of the nucleotide sequences of HOXB5 BINDING SITE, designated SEQ ID:18456, to the nucleotide sequence of GAM94 RNA, herein designated GAM RNA, also designated SEQ ID:332.

Another function of GAM94 is therefore inhibition of Homeo box b5 (HOXB5, Accession NP_002138.1), a gene which may regulate gene expresion, morphogenesis and differentiation. Accordingly, utilities of GAM94 include diagnosis, prevention and treatment of diseases and clinical conditions associated with HOXB5.

The function of HOXB5 has been established by previous studies. As reviewed by Acampora et al. (1989), the homeo box region 2 contains 9 homeo box genes in 180 kb of DNA on chromosome 17. The order, from 5-prime to 3-prime, is HOXB9 (HOX2E), HOXB8 (HOX2D), HOXB7 (HOX2C), HOXB6 (HOX2B), HOXB5 (HOX2A), HOXB4 (HOX2F), HOXB3 (HOX2G), HOXB2 (HOX2H), HOXB1 (HOX2I). Classical models of craniofacial development argue that the neural crest is prepatterned or preprogrammed to make specific head structures before its migration from the neural tube.

In contrast, recent studies in several vertebrates, including mouse, chick, and zebrafish, have provided evidence for plasticity in patterning neural crest populations. Using tissue transposition and molecular analyses in avian embryos, Trainor et al. (2002) reconciled these findings by demonstrating that classical manipulation experiments, which form the basis of the prepatterning model, involved transplantation of a local signaling center, the isthmic organizer. FGF8 (OMIM Ref. No. 600483) signaling from the isthmus alters HOXA2 expression and consequently branchial arch patterning, demonstrating that neural crest cells are patterned by environmental signals.

Full details of the abovementioned studies are described in the following publications, the disclosure of which are hereby incorporated by reference:

Acampora, D.; D'Esposito, M.; Faiella, A.; Pannese, M.; Migliaccio, E.; Morelli, F.; Stornaiuolo, A.; Nigro, V.; Simeone, A.; Boncinelli, E.: The human HOX gene family. Nucleic Acids Res. 17:10385-10402, 1989; and Trainor, P. A.; Ariza-McNaughton, L.; Krumlauf, R.: Role of the isthmus and FGFs in resolving the paradox of neural crest plasticity and prepatterning. Science 295:1288-1291, 2002.

Further studies establishing the function and utilities of HOXB5 are found in John Hopkins OMIM database record ID 142960, and in cited publications listed in Table 5, which are hereby incorporated by reference. Homeo box b6 (HOXB6, Accession NP_724779.1) is another GAM94 target gene, herein designated TARGET GENE. HOXB6 BINDING SITE1 through HOXB6 BINDING SITE3 are target binding sites found in untranslated regions of multiple transcripts of mRNA encoded by HOXB6, corresponding to target binding sites such as BINDING SITE I, BINDING SITE II or BINDING SITE III of FIG. 8. Table 4 illustrates the complementarity of the nucleotide sequences of HOXB6 BINDING SITE1 through HOXB6 BINDING SITE3, designated SEQ ID:6159, SEQ ID:15879 and SEQ ID:6159 respectively, to the nucleotide sequence of GAM94 RNA, herein designated GAM RNA, also designated SEQ ID:332.

Another function of GAM94 is therefore inhibition of Homeo box b6 (HOXB6, Accession NP_724779.1), a gene which participates in establishing segmentation patterns and in determining segment identities. Accordingly, utilities of GAM94 include diagnosis, prevention and treatment of diseases and clinical conditions associated with HOXB6.

The function of HOXB6 and its association with various diseases and clinical conditions, has been established by previous studies, as described hereinabove with reference to GAM48.2. Homeo box b6 (HOXB6, Accession NP_061825.2) is another GAM94 target gene, herein designated TARGET GENE. HOXB6 BINDING SITE1 through HOXB6 BINDING SITE3 are target binding sites found in untranslated regions of multiple transcripts of mRNA encoded by HOXB6, corresponding to target binding sites such as BINDING SITE I, BINDING SITE II or BINDING SITE III of FIG. 8. Table 4 illustrates the complementarity of the nucleotide sequences of HOXB6 BINDING SITE1 through HOXB6 BINDING SITE3, designated SEQ ID:13497, SEQ ID:13497 and SEQ ID:6159 respectively, to the nucleotide sequence of GAM94 RNA, herein designated GAM RNA, also designated SEQ ID:332.

Another function of GAM94 is therefore inhibition of Homeo box b6 (HOXB6, Accession NP_061825.2), a gene which participates in establishing segmentation patterns and in determining segment identities. Accordingly, utilities of GAM94 include diagnosis, prevention and treatment of diseases and clinical conditions associated with HOXB6.

The function of HOXB6 and its association with various diseases and clinical conditions, has been established by previous studies, as described hereinabove with reference to GAM48.2. Homeo box b6 (HOXB6, Accession NP_724778.1) is another GAM94 target gene, herein designated TARGET GENE. HOXB6 BINDING SITE1 through HOXB6 BINDING SITE3 are target binding sites found in untranslated regions of multiple transcripts of mRNA encoded by HOXB6, corresponding to target binding sites such as BINDING SITE I, BINDING SITE II or BINDING SITE III of FIG. 8. Table 4 illustrates the complementarity of the nucleotide sequences of HOXB6 BINDING SITE1 through HOXB6 BINDING SITE3, designated SEQ ID:15879, SEQ ID:13497 and SEQ ID:9089 respectively, to the nucleotide sequence of GAM94 RNA, herein designated GAM RNA, also designated SEQ ID:332.

Another function of GAM94 is therefore inhibition of Homeo box b6 (HOXB6, Accession NP_724778.1), a gene which participates in establishing segmentation patterns and in determining segment identities. Accordingly, utilities of GAM94 include diagnosis, prevention and treatment of diseases and clinical conditions associated with HOXB6.

The function of HOXB6 and its association with various diseases and clinical conditions, has been established by previous studies, as described hereinabove with reference to GAM48.2. Homeo box c6 (HOXC6, Accession NP_710160.1) is another GAM94 target gene, herein designated TARGET GENE. HOXC6 BINDING SITE is a target binding site found in the 5' untranslated region of multiple transcripts of mRNA encoded by HOXC6, corresponding to a target binding site such as BINDING SITE I, BINDING SITE II or BINDING SITE III of FIG. 8. Table 4 illustrates the complementarity of the nucleotide sequences of HOXC6 BINDING SITE, designated SEQ ID:9089, to the nucleotide sequence of GAM94 RNA, herein designated GAM RNA, also designated SEQ ID:332.

Another function of GAM94 is therefore inhibition of Homeo box c6 (HOXC6, Accession NP_710160.1), a gene which is part of a developmental regulatory system. Accordingly, utilities of GAM94 include diagnosis, prevention and treatment of diseases and clinical conditions associated with HOXC6.

The function of HOXC6 has been established by previous studies. Simeone et al. (1987) characterized 2 human cDNA clones, each containing a homeo box region. The corresponding genes, termed c1 (HOXB7; 142962) and c8 (HOXC6), were evaluated in different organs and body parts during human embryonic and fetal development. Differential expression suggested that the genes play a key role in a variety of developmental processes. Homeodomain-containing proteins are transcription factors that regulate the coordinated expression of multiple genes involved in development, differentiation, and malignant transformation. Chariot et al. (1996) cloned 2 distinct forms of HOXC6 cDNA from the human breast cancer cell line MCF7. These cDNAs correspond to 2.2- and 1.8-kb transcripts that differ at their 5-prime ends and encode 153- and 235-amino acid homeodomain-containing proteins, respectively. The authors found that the 2.2-kb HOXC6 transcript is downregulated in human breast cancer cells, whereas the 1.8-kb transcript is expressed in many human tumors, including breast and ovarian carcinomas. Chariot et al. (1996) showed that both HOXC6 gene products can repress transcription from a consensus HOX-binding sequence in MDA-MB231 breast cancer cells and can cooperate with other HOX proteins, such as HOXB7, on their target genes.

Full details of the abovementioned studies are described in the following publications, the disclosure of which are hereby incorporated by reference:

Chariot, A.; Castronovo, V.; Le, P.; Gillet, C.; Sobel, M. E.; Gielen, J.: Cloning and expression of a new HOXC6 transcript encoding a repressing protein. Biochem. J. 319:91-97, 1996; and Simeone, A.; Mavilio, F.; Acampora, D.; Giampaolo, A.; Faiella, A.; Zappavigna, V.; D'Esposito, M.; Pannese, M.; Russo, G.; Boncinelli, E.; Peschle, C.: Two human homeobox genes, c1 an.

Further studies establishing the function and utilities of HOXC6 are found in John Hopkins OMIM database record ID 142972, and in cited publications listed in Table 5, which are hereby incorporated by reference. Hippocalcin like 4 (HPCAL4, Accession NP_057341.1) is another GAM94 target gene, herein designated TARGET GENE. HPCAL4 BINDING SITE is a target binding site found in the 3' untranslated region of mRNA encoded by HPCAL4, corresponding to a target binding site such as BINDING SITE I, BINDING SITE II or BINDING SITE III of FIG. 8. Table 4 illustrates the complementarity of the nucleotide sequences of HPCAL4 BINDING SITE, designated SEQ ID:15640, to the nucleotide sequence of GAM94 RNA, herein designated GAM RNA, also designated SEQ ID:332.

Another function of GAM94 is therefore inhibition of Hippocalcin like 4 (HPCAL4, Accession NP_057341.1). Accordingly, utilities of GAM94 include diagnosis, prevention and treatment of diseases and clinical conditions associated with HPCAL4.

HSPC056 (Accession NP_054873.1) is another GAM94 target gene, herein designated TARGET GENE. HSPC056 BINDING SITE is a target binding site found in the 3' untranslated region of mRNA encoded by HSPC056, corresponding to a target binding site such as BINDING SITE I, BINDING SITE II or BINDING SITE III of FIG. 8. Table 4 illustrates the complementarity of the nucleotide sequences of HSPC056 BINDING SITE, designated SEQ ID:15755, to the nucleotide sequence of GAM94 RNA, herein designated GAM RNA, also designated SEQ ID:332.

Another function of GAM94 is therefore inhibition of HSPC056 (Accession NP_054873.1). Accordingly, utilities of GAM94 include diagnosis, prevention and treatment of diseases and clinical conditions associated with HSPC056.

HSPC159 (Accession NP_054900.1) is another GAM94 target gene, herein designated TARGET GENE. HSPC159 BINDING SITE is a target binding site found in the 3' untranslated region of mRNA encoded by HSPC159, corresponding to a target binding site such as BINDING SITE I, BINDING SITE II or BINDING SITE III of FIG. 8. Table 4 illustrates the complementarity of the nucleotide sequences of HSPC159 BINDING SITE, designated SEQ ID:5350, to the nucleotide sequence of GAM94 RNA, herein designated GAM RNA, also designated SEQ ID:332.

Another function of GAM94 is therefore inhibition of HSPC159 (Accession NP_054900.1). Accordingly, utilities of GAM94 include diagnosis, prevention and treatment of diseases and clinical conditions associated with HSPC159.

Islet cell autoantigen 1, 69 kda (ICA1, Accession NP_071683.1) is another GAM94 target gene, herein designated TARGET GENE. ICA1 BINDING SITE is a target binding site found in the 5' untranslated region of multiple transcripts of mRNA encoded by ICA1, corresponding to a target binding site such as BINDING SITE I, BINDING SITE II or BINDING SITE III of FIG. 8. Table 4 illustrates the complementarity of the nucleotide sequences of ICA1 BIND- ING SITE, designated SEQ ID:6433, to the nucleotide sequence of GAM94 RNA, herein designated GAM RNA, also designated SEQ ID:332.

Another function of GAM94 is therefore inhibition of Islet cell autoantigen 1, 69 kda (ICA1, Accession NP_071683.1), a gene which encodes Islet cell autoantigen 1 and therefore may be associated with Insulin- dependent diabetes mellitus. Accordingly, utilities of GAM94 include diagnosis, prevention and treatment of Insulin-dependent diabetes mellitus, and of other diseases and clinical conditions associated with ICA1.

The function of ICA1 has been established by previous studies. Pietropaolo et al. (1993) identified a novel 69-kD peptide autoantigen (ICA69) associated with insulin-dependent diabetes mellitus (IDDM) by screening a human islet lambda-gt11 cDNA expression library with cytoplasmic islet cell antibody positive sera from relatives of IDDM patients who progressed to the overt disease. The deduced open reading frame of the ICA69 cDNA predicted a 483-amino acid protein. ICA69 showed no nucleotide or amino acid sequence relation to any known sequence in GenBank except for 2 short regions of similarity with bovine serum albumin (BSA). The ICA69 cDNA probe hybridized with a 2-kb mRNA in polyadenylated RNA from human pancreas, brain, heart, thyroid, and kidney. The structural gene for ICA69 was designated ICA1. A homolog in the mouse, designated Ica1, was mapped to the proximal end of chromosome 6, within 6 cM of the MET protooncogene (OMIM Ref. No. 164860). One can deduce from homology of synteny that the human ICA1 gene is probably located in the region 7q31, which is conserved between mouse and human. Thus, Pietropaolo et al. (1993) added another islet antigen to the isoforms of the neuroendocrine-associated enzyme glutamic acid decarboxylase (GAD; 138275) which react with sera from IDDM patients as well as from patients with stiff-man syndrome (OMIM Ref. No. 184850). However, by isotopic in situ hybridization, Gaedigk et al. (1994) demonstrated that the ICA1 gene maps to human 7p22. Gaedigk et al. (1996) reported that the mouse Ica1 gene is distributed over more than 100 kb on chromosome 6. The single murine genomic locus contains 14 coding exons, ranging from 39 to 271 bp in length. They found that the human and mouse intron/exon junctions are identical. They cloned cDNAs and identified alternatively spliced mRNA transcripts. All splice variants encoded the conserved T-cell epitope (in exon 2) recognized by autoreactive T cells in diabetic children and diabetes-prone NOD mice.

Full details of the abovementioned studies are described in the following publications, the disclosure of which are hereby incorporated by reference:

Gaedigk, R.; Duncan, A. M. V.; Miyazaki, I.; Robinson, B. H.; Dosch, H.-M.: ICA1 encoding p69, a protein linked to the development of type 1 diabetes, maps to human chromosome 7p22. Cytogenet. Cell Genet. 66: 274-276, 1994; and Gaedigk, R.; Karges, W.; Hui, M. F.; Scherer, S. W.; Dosch, H.-M.: Genomic organization and transcript analysis of ICAp69, a target antigen in diabetic autoimmunity. Genomics 38:382-39.

Further studies establishing the function and utilities of ICA1 are found in John Hopkins OMIM database record ID 147625, and in cited publications listed in Table 5, which are hereby incorporated by reference. Islet cell autoantigen 1, 69 kda (ICA1, Accession NP_004959.1) is another GAM94 target gene, herein designated TARGET GENE. ICA1 BINDING SITE is a target binding site found in the 5' untranslated region of multiple transcripts of mRNA encoded by ICA1, corresponding to a target binding site such as BINDING SITE I, BINDING SITE II or BINDING SITE III of FIG. 8. Table 4 illustrates the complementarity of the nucleotide sequences of ICA1 BINDING SITE, designated SEQ ID:6433, to the nucleotide sequence of GAM94 RNA, herein designated GAM RNA, also designated SEQ ID:332.

Another function of GAM94 is therefore inhibition of Islet cell autoantigen 1, 69 kda (ICA1, Accession NP_004959.1), a gene which encodes Islet cell autoantigen 1 and therefore may be associated with Insulin- dependent diabetes mellitus. Accordingly, utilities of GAM94 include diagnosis, prevention and treatment of Insulin-dependent diabetes mellitus, and of other diseases and clinical conditions associated with ICA1.

The function of ICA1 has been established by previous studies. Pietropaolo et al. (1993) identified a novel 69-kD peptide autoantigen (ICA69) associated with insulin-dependent diabetes mellitus (IDDM) by screening a human islet lambda-gt11 cDNA expression library with cytoplasmic islet cell antibody positive sera from relatives of IDDM patients who progressed to the overt disease. The deduced open reading frame of the ICA69 cDNA predicted a 483-amino acid protein. ICA69 showed no nucleotide or amino acid sequence relation to any known sequence in GenBank except for 2 short regions of similarity with bovine serum albumin (BSA). The ICA69 cDNA probe hybridized with a 2-kb mRNA in polyadenylated RNA from human pancreas, brain, heart, thyroid, and kidney. The structural gene for ICA69 was designated ICA1. A homolog in the mouse, designated Ica1, was mapped to the proximal end of chromosome 6, within 6 cM of the MET protooncogene (OMIM Ref. No. 164860). One can deduce from homology of synteny that the human ICA1 gene is probably located in the region 7q31, which is conserved between mouse and human. Thus, Pietropaolo et al. (1993) added another islet antigen to the isoforms of the neuroendocrine-associated enzyme glutamic acid decarboxylase (GAD; 138275) which react with sera from IDDM patients as well as from patients with stiff-man syndrome (OMIM Ref. No. 184850). However, by isotopic in situ hybridization, Gaedigk et al. (1994) demonstrated that the ICA1 gene maps to human 7p22. Gaedigk et al. (1996) reported that the mouse Ica1 gene is distributed over more than 100 kb on chromosome 6. The single murine genomic locus contains 14 coding exons, ranging from 39 to 271 bp in length. They found that the human and mouse intron/exon junctions are identical. They cloned cDNAs and identified alternatively spliced mRNA transcripts. All splice variants encoded the conserved T-cell epitope (in exon 2) recognized by autoreactive T cells in diabetic children and diabetes-prone NOD mice.

Full details of the abovementioned studies are described in the following publications, the disclosure of which are hereby incorporated by reference:

Gaedigk, R.; Duncan, A. M. V.; Miyazaki, I.; Robinson, B. H.; Dosch, H.-M.: ICA1 encoding p69, a protein linked to the development of type 1 diabetes, maps to human chromosome 7p22. Cytogenet. Cell Genet. 66:274-276, 1994; and Gaedigk, R.; Karges, W.; Hui, M. F.; Scherer, S. W.; Dosch, H.-M.: Genomic organization and transcript analysis of ICAp69, a target antigen in diabetic autoimmunity. Genomics 38:382-39.

Further studies establishing the function and utilities of ICA1 are found in John Hopkins OMIM database record ID 147625, and in cited publications listed in Table 5, which are hereby incorporated by reference. Interferon (alpha, beta and omega) receptor 2 (IFNAR2, Accession NP_000865.2) is another GAM94 target gene, herein designated TARGET GENE. IFNAR2 BINDING SITE is a target binding site found in the 3' untranslated region of mRNA encoded by IFNAR2, corresponding to a target binding site such as BINDING SITE I, BINDING SITE II or BINDING SITE III of FIG. 8. Table 4 illustrates the complementarity of the nucleotide sequences of IFNAR2 BINDING SITE, designated SEQ ID:15907, to the nucleotide sequence of GAM94 RNA, herein designated GAM RNA, also designated SEQ ID:332.

Another function of GAM94 is therefore inhibition of Interferon (alpha, beta and omega) receptor 2 (IFNAR2, Accession NP_000865.2), a gene which is a receptor for interferons alpha and beta. Accordingly, utilities of GAM94 include diagnosis, prevention and treatment of diseases and clinical conditions associated with IFNAR2.

The function of IFNAR2 and its association with various diseases and clinical conditions, has been established by previous studies, as described hereinabove with reference to GAM30.1. Insulin-like growth factor 1 (somatomedin c) (IGF1, Accession NP_000609.1) is another GAM94 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:12026, to the nucleotide sequence of GAM94 RNA, herein designated GAM RNA, also designated SEQ ID:332.

Another function of GAM94 is therefore inhibition of Insulin-like growth factor 1 (somatomedin c) (IGF1, Accession NP_000609.1), a gene which are structurally and functionally related to insulin but have a much higher growth-promoting activity and therefore may be associated with Growth retardation with sensorineural deafness and mental retardation. Accordingly, utilities of GAM94 include diagnosis, prevention and treatment of Growth retardation with sensorineural deafness and mental retardation, and of other diseases and clinical conditions associated with IGF1.

The function of IGF1 and its association with various diseases and clinical conditions, has been established by previous studies, as described hereinabove with reference to GAM66.2. Interleukin 15 receptor, alpha (IL15RA, Accession NP_002180.1) is another GAM94 target gene, herein designated TARGET GENE. IL15RA BINDING SITE is a target binding site found in the 3' untranslated region of multiple transcripts of mRNA encoded by IL15RA, corresponding to a target binding site such as BINDING SITE I, BINDING SITE II or BINDING SITE III of FIG. 8. Table 4 illustrates the complementarity of the nucleotide sequences of IL15RA BINDING SITE, designated SEQ ID:17728, to the nucleotide sequence of GAM94 RNA, herein designated GAM RNA, also designated SEQ ID:332.

Another function of GAM94 is therefore inhibition of Interleukin 15 receptor, alpha (IL15RA, Accession NP_002180.1), a gene which is essential for signal transduction. Accordingly, utilities of GAM94 include diagnosis, prevention and treatment of diseases and clinical conditions associated with IL15RA.

The function of IL15RA has been established by previous studies. Interleukin 2 (OMIM Ref. No. 147680) and interleukin 15 (OMIM Ref. No. 600554) are cytokines with overlapping but distinct biologic effects. Their receptors share 2 subunits, the IL2R beta (OMIM Ref. No. 146710) and gamma (OMIM Ref. No. 308380) chains, which are essential for signal transduction. The IL2 receptor requires an additional IL2-specific alpha subunit for high affinity IL2 binding (OMIM Ref. No. 147730). Giri et al. (1995) identified and cloned a murine IL15-specific alpha subunit and showed that it is structurally related to IL2R-alpha. However, the murine IL15R-alpha alone bound IL15 with a 1,000-fold higher affinity than that seen with IL2R-alpha and IL2. Anderson et al. (1995) extended these studies into the human system with the isolation of 3 differentially spliced human IL15R-alpha variants that are all capable of high affinity binding of IL15. The cytoplasmic domain of IL15R-alpha, like that of IL2R-alpha is dispensable for mitogenic signaling, suggesting that the primary role of the alpha chains is to confer high affinity binding. At high concentrations, IL-15, like IL-2, is able to signal through a complex of IL2R-beta and -gamma in the absence of the alpha subunit. Furthermore, the IL15RA and IL2RA genes have a similar intron/exon organization and are closely linked in both human and murine genomes. The IL2RA gene (OMIM Ref. No. 147730) had been previously mapped to 10p15-p14 and its homolog to mouse chromosome 2. The human gene IL15RA was mapped to 10p15-p14 by fluorescence in situ hybridization and the mouse Il15ra gene was mapped to chromosome 2 by interspecific backcross mapping.

Full details of the abovementioned studies are described in the following publications, the disclosure of which are hereby incorporated by reference:

Anderson, D. M.; Kumaki, S.; Ahdieh, M.; Bertles, J.; Tometsko, M.; Loomis, A.; Giri, J.; Copeland, N. G.; Gilbert, D. J.; Jenkins, N. A.; Valentine, V.; Shapiro, D. N.; Morris, S. W.; Park, L. S.; Cosman, D.: Functional characterization of the human interleukin-15 receptor alpha chain and close linkage of IL15RA and IL2RA genes. J. Biol. Chem. 270:29862-29869, 1995; and Giri, J. G.; Kumaki, S.; Ahdieh, M.; Friend, D. J.; Loomis, A.; Shanebeck, K.; DuBose, R.; Cosman, D.; Park, L. S.; Anderson, D. M.: Identification and cloning of a novel IL-15 binding.

Further studies establishing the function and utilities of IL15RA are found in John Hopkins OMIM database record ID 601070, and in cited publications listed in Table 5, which are hereby incorporated by reference. Interleukin 15 receptor, alpha (IL15RA, Accession NP_751950.1) is another GAM94 target gene, herein designated TARGET GENE. IL15RA BINDING SITE is a target binding site found in the 3' untranslated region of multiple transcripts of mRNA encoded by IL15RA, corresponding to a target binding site such as BINDING SITE I, BINDING SITE II or BINDING SITE III of FIG. 8. Table 4 illustrates the complementarity of the nucleotide sequences of IL15RA BINDING SITE, designated SEQ ID:17728, to the nucleotide sequence of GAM94 RNA, herein designated GAM RNA, also designated SEQ ID:332.

Another function of GAM94 is therefore inhibition of Interleukin 15 receptor, alpha (IL15RA, Accession NP_751950.1), a gene which is essential for signal transduction. Accordingly, utilities of GAM94 include diagnosis, prevention and treatment of diseases and clinical conditions associated with IL15RA.

The function of IL15RA has been established by previous studies. Interleukin 2 (OMIM Ref. No. 147680) and interleukin 15 (OMIM Ref. No. 600554) are cytokines with overlapping but distinct biologic effects. Their receptors share 2 subunits, the IL2R beta (OMIM Ref. No. 146710) and gamma (OMIM Ref. No. 308380) chains, which are essential for signal transduction. The IL2 receptor requires an additional IL2-specific alpha subunit for high affinity IL2 binding (OMIM Ref. No. 147730). Giri et al. (1995) identified and cloned a murine IL15-specific alpha subunit and showed that it is structurally related to IL2R-alpha. However, the murine IL15R-alpha alone bound IL15 with a 1,000-fold higher affinity than that seen with IL2R-alpha and IL2. Anderson et al. (1995) extended these studies into the human system with the isolation of 3 differentially spliced human IL15R-alpha variants that are all capable of high affinity binding of IL15. The cytoplasmic domain of IL15R-alpha, like that of IL2R-alpha is dispensable for mitogenic signaling, suggesting that the primary role of the alpha chains is to confer high affinity binding. At high concentrations, IL-15, like IL-2, is able to signal through a complex of IL2R-beta and -gamma in the absence of the alpha subunit. Furthermore, the IL15RA and IL2RA genes have a similar intron/exon organization and are closely linked in both human and murine genomes. The IL2RA gene (OMIM Ref. No. 147730) had been previously mapped to 10p15-p14 and its homolog to mouse chromosome 2. The human gene IL15RA was mapped to 10p15-p14 by fluorescence in situ hybridization and the mouse Il15ra gene was mapped to chromosome 2 by interspecific backcross mapping.

Full details of the abovementioned studies are described in the following publications, the disclosure of which are hereby incorporated by reference:

Anderson, D. M.; Kumaki, S.; Ahdieh, M.; Bertles, J.; Tometsko, M.; Loomis, A.; Giri, J.; Copeland, N. G.; Gilbert, D. J.; Jenkins, N. A.; Valentine, V.; Shapiro, D. N.; Morris, S. W.; Park, L. S.; Cosman, D.: Functional characterization of the human interleukin-15 receptor alpha chain and close linkage of IL15RA and IL2RA genes. J. Biol. Chem. 270:29862-29869, 1995; and Giri, J. G.; Kumaki, S.; Ahdieh, M.; Friend, D. J.; Loomis, A.; Shanebeck, K.; DuBose, R.; Cosman, D.; Park, L. S.; Anderson, D. M.: Identification and cloning of a novel IL-15 binding.

Further studies establishing the function and utilities of IL15RA are found in John Hopkins OMIM database record ID 601070, and in cited publications listed in Table 5, which are hereby incorporated by reference. Interleukin 19 (IL19, Accession NP_037503.2) is another GAM94 target gene, herein designated TARGET GENE. IL19 BINDING SITE is a target binding site found in the 5' untranslated region of multiple transcripts of mRNA encoded by IL19, corresponding to a target binding site such as BINDING SITE I, BINDING SITE II or BINDING SITE III of FIG. 8. Table 4 illustrates the complementarity of the nucleotide sequences of IL19 BINDING SITE, designated SEQ ID:1253, to the nucleotide sequence of GAM94 RNA, herein designated GAM RNA, also designated SEQ ID:332.

Another function of GAM94 is therefore inhibition of Interleukin 19 (IL19, Accession NP_037503.2), a gene which may play a role in B-cell activation and autoantibody production. Accordingly, utilities of GAM94 include diagnosis, prevention and treatment of diseases and clinical conditions associated with IL19.

The function of IL19 has been established by previous studies. Interleukin-10 (IL10; 124092) is a multifunctional cytokine that has antiinflammatory properties through its ability to downregulate antigen presentation and macrophage activation. It also plays a role in B-cell activation and autoantibody production. The IL10 family of cytokines includes IL19, IL20 (OMIM Ref. No. 605619), MDA7 (OMIM Ref. No. 604136), and IL22 (OMIM Ref. No. 605330). By searching EST databases using IL10 as the probe, followed by screening an Epstein-Barr virus-transformed B-cell cDNA library, Gallagher et al. (2000) obtained a cDNA encoding IL19. Sequence analysis predicted that the 177-amino acid protein contains a signal peptide, 2 potential N-linked glycosylation sites, and 4 conserved cysteine residues necessary for correct folding of the IL10 monomer. IL19 shares 82% identity with IL10 in the hydrophobic core, but only 53% similarity in the putative IL10 receptor-alpha (OMIM Ref. No. 146933)-interacting residues. Northern blot kinetic analysis detected expression of IL10 before IL19 in lipopolysaccharide (LPS)-stimulated monocytes. IL19 expression was enhanced in the presence of IL4 (OMIM Ref. No. 147780) or IL13 (OMIM Ref. No. 147683), but not gamma-interferon (OMIM Ref. No. 147570), in LPS-stimulated monocytes. Granulocyte-macrophage colony-stimulating factor (GMCSF; 138960), but not other cytokines, was capable of inducing IL19 expression. Western blot analysis showed expression of a 35- to 40-kD protein that was reduced to 21 kD by glycosidase treatment. Genomic sequence analysis determined that the IL19 gene spans nearly 6 kb and, like IL10, contains 5 exons Full details of the abovementioned studies are described in the following publications, the disclosure of which are hereby incorporated by reference:

Blumberg, H.; Conklin, D.; Xu, W.; Grossmann, A.; Brender, T.; Carollo, S.; Eagan, M.; Foster, D.; Haldeman, B. A.; Hammond, A.; Haugen, H.; Jelinek, L.; and 14 others: Interleukin 20: discovery, receptor identification, and role in epidermal function. Cell 104:9-19, 2001; and Gallagher, G.; Dickensheets, H.; Eskdale, J.; Izotova, L. S.; Mirochnitchenko, O. V.; Peat, J. D.; Vazquez, N.; Pestka, S.; Donnelly, R. P.; Kotenko, S. V.: Cloning, expression and ini.

Further studies establishing the function and utilities of IL19 are found in John Hopkins OMIM database record ID 605687, and in cited publications listed in Table 5, which are hereby incorporated by reference. Interleukin 1 receptor-like 1 (IL1RL1, Accession NP_057316.3) is another GAM94 target gene, herein designated TARGET GENE. IL1RL1 BINDING SITE is a target binding site found in the 5' untranslated region of multiple transcripts of mRNA encoded by IL1RL1, corresponding to a target binding site such as BINDING SITE I, BINDING SITE II or BINDING SITE III of FIG. 8. Table 4 illustrates the complementarity of the nucleotide sequences of IL1RL1 BINDING SITE, designated SEQ ID:15835, to the nucleotide sequence of GAM94 RNA, herein designated GAM RNA, also designated SEQ ID:332.

Another function of GAM94 is therefore inhibition of Interleukin 1 receptor-like 1 (IL1RL1, Accession NP_057316.3), a gene which is possibly involved in regulation of t-lymphocyte action. Accordingly, utilities of GAM94 include diagnosis, prevention and treatment of diseases and clinical conditions associated with IL1RL1.

The function of IL1RL1 and its association with various diseases and clinical conditions, has been established by previous studies, as described hereinabove with reference to GAM47.1. Interleukin 2 (IL2, Accession NP_000577.2) is another GAM94 target gene, herein designated TARGET GENE. IL2 BINDING SITE is a target binding site found in the 5' untranslated region of mRNA encoded by IL2, corresponding to a target binding site such as BINDING SITE I, BINDING SITE II or BINDING SITE III of FIG. 8. Table 4 illustrates the complementarity of the nucleotide sequences of IL2 BINDING SITE, designated SEQ ID:4856, to the nucleotide sequence of GAM94 RNA, herein designated GAM RNA, also designated SEQ ID:332.

Another function of GAM94 is therefore inhibition of Interleukin 2 (IL2, Accession NP_000577.2), a gene which is a powerfully immunoregulatory lymphokine that is produced by lectin-or antigen-activated T cells. Accordingly, utilities of GAM94 include diagnosis, prevention and treatment of diseases and clinical conditions associated with IL2.

The function of IL2 has been established by previous studies. Interleukin- 2 (IL2), formerly referred to as T-cell growth factor, is a powerfully immunoregulatory lymphokine that is produced by lectin-or antigen-activated T cells. Not only is it produced by mature T lymphocytes on stimulation but also constitutively by certain T-cell lymphoma cell lines. It is useful in the study of the molecular nature of T-cell differentiation and because, like interferons, it augments natural killer cell activity, it might have use in the treatment of cancer. Lowenthal et al. (1985) presented evidence that IL2 can act as a growth hormone for both B and T lymphocytes. Thus, IL2 is a better designation than TCGF. See review of Smith (1988). IL2 has a molecular weight of 15,000. Taniguchi et al. (1983) cloned the human IL2 gene. Fujita et al. (1983) found that the IL2 gene has a promoter sequence homologous to that of the human gamma interferon gene. Using a cloned human TCGF gene in somatic cell hybridization studies, Seigel et al. (1984) assigned the TCGF locus to chromosome 4. In situ hybridization narrowed the assignment to 4q26-q28. Evidence was presented to indicate that TCGF and RAF2 (OMIM Ref. No. 164760), the pseudogene form of the oncogene RAF1, is not closely linked to TCGF although it is on chromosome 4. Fiorentino et al. (1989) assigned the Il2 locus to mouse chromosome 3 by Southern analysis of Chinese hamster/mouse somatic cell hybrid cells, and Webb et al. (1990) localized it to bands B-C by in situ hybridization Full details of the abovementioned studies are described in the following publications, the disclosure of which are hereby incorporated by reference:

Shows, T.; Eddy, R.; Haley, L.; Byers, M.; Henry, M.; Fujita, T.; Matsui, H.; Taniguchi, T.: Interleukin 2 (IL2) is assigned to human chromosome 4. Somat. Cell Molec. Genet. 10:315-318, 1984; and Smith, K. A.: Interleukin-2: inception, impact, and implications. Science 240:1169-1176, 1988.

Further studies establishing the function and utilities of IL2 are found in John Hopkins OMIM database record ID 147680, and in cited publications listed in Table 5, which are hereby incorporated by reference. Interleukin 28 receptor, alpha (IL28RA, Accession NP_775088.1) is another GAM94 target gene, herein designated TARGET GENE. IL28RA BINDING SITE1 and IL28RA BINDING SITE2 are target binding sites found in untranslated regions of multiple transcripts of mRNA encoded by IL28RA, corresponding to target binding sites such as BINDING SITE I, BINDING SITE II or BINDING SITE III of FIG. 8. Table 4 illustrates the complementarity of the nucleotide sequences of IL28RA BINDING SITE1 and IL28RA BINDING SITE2, designated SEQ ID:18482 and SEQ ID:2495 respectively, to the nucleotide sequence of GAM94 RNA, herein designated GAM RNA, also designated SEQ ID:332.

Another function of GAM94 is therefore inhibition of Interleukin 28 receptor, alpha (IL28RA, Accession NP_775088.1). Accordingly, utilities of GAM94 include diagnosis, prevention and treatment of diseases and clinical conditions associated with IL28RA.

Interleukin 6 receptor (IL6R, Accession NP_000556.1) is another GAM94 target gene, herein designated TARGET GENE. IL6R BINDING SITE is a target binding site found in the 3' untranslated region of multiple transcripts of mRNA encoded by IL6R, corresponding to a target binding site such as BINDING SITE I, BINDING SITE II or BINDING SITE III of FIG. 8. Table 4 illustrates the complementarity of the nucleotide sequences of IL6R BINDING SITE, designated SEQ ID:10665, to the nucleotide sequence of GAM94 RNA, herein designated GAM RNA, also designated SEQ ID:332.

Another function of GAM94 is therefore inhibition of Interleukin 6 receptor (IL6R, Accession NP_000556.1), a gene which is essential to the regulation of the immune response, hematopoiesis, and acute-phase reactions. Accordingly, utilities of GAM94 include diagnosis, prevention and treatment of diseases and clinical conditions associated with IL6R.

The function of IL6R has been established by previous studies. Whereas the 0.9-kb IFN-beta-1 mRNA is transcribed from an intron-free IFNB1 gene located on 9p (OMIM Ref. No. 147640), IFN-beta-2 is the translation product of a 1.3-kb mRNA derived from an intron-containing IFNB2 gene not located on chromosome 9. The IFN-beta-2 mRNA does not cross-hybridize with IFN-beta-1 cDNA probes and vice-versa. Sehgal et al. (1986) mapped IFNB2 to chromosome 7 by means of a cDNA clone in blot-hybridization experiments on DNA from a panel of human-rodent somatic cell hybrids. Zilberstein et al. (1986) cloned cDNA for the 1.3-kb RNA designated IFNB2. Expression studies showed that the IFN-beta-2 secreted by DNA-transformed rodent cells is a processed 21-kD protein whose activity is cross- neutralized by antibodies to human IFN-beta-1 but not to alpha or gamma interferon. The biologic significance of IFN-beta-2 lies in the fact that it is induced under conditions in which IFN-beta-1 is not induced, as in metabolically stressed cells. Its induction by IL1 (OMIM Ref. No. 147720) and TNF (OMIM Ref. No. 191160) suggests that it may play a role as an autocrine mediator of some effects of these cytokines in inflammation and acute phase responses, as well as regulate cell proliferation. As discussed by Sehgal et al. (1987), IFNB2 is identical to B-cell differentiation factor (BSF2) and enhances proliferation in hybridoma/plasmacytoma cells. Hirano et al. (1986) reported the molecular cloning, structural analysis, and functional expression of cDNA encoding human BSF2. The primary sequence of BSF2 deduced from the cDNA shows that it has 184 amino acids and is distinct from other interleukins. In addition to its antiviral activity, beta-2 interferon elicits acute phase response in liver cells and is identical to hepatocyte stimulatory factor. It also is identical to hybridoma growth factor. A subset of plasmacytoma (PCT), designated extramedullary PCT, is distinguished from multiple myeloma and solitary PCT of bone by its distribution among various tissue sites but not bone marrow. Extramedullary (extraosseus) PCTs are rare spontaneous neoplasms of mice but are readily induced in a susceptible strain, BALB/c, by treatment with pristane. The tumors develop in peritoneal granulomas and are characterized by Myc-activating t(12;15) chromosomal translocations and, most frequently, by secretion of IgA. To test directly the contribution of IL6 to PCT development, Kovalchuk et al. (2002) generated BALB/c mice carrying a widely expressed IL6 transgene. All mice exhibited lymphoproliferation and plasmacytosis. By 18 months of age, more than half developed readily transplantable PCTs in lymph nodes, Peyer patches, and sometimes spleen. These neoplasms also had the t(12;15) translocations, but remarkably, none expressed IgA. Approximately 30% of the mice developed follicular and diffuse large cell B-cell lymphomas that often coexisted with PCTs. These findings provided a unique model of extramedullary PCT for studies on pathogenesis and treatment and suggested a role for IL6 in the genesis of germinal center-derived lymphomas Full details of the abovementioned studies are described in the following publications, the disclosure of which are hereby incorporated by reference:

Hirano, T.; Yasukawa, K.; Harada, H.; Taga, T.; Watanabe, Y.; Matsuda, T.; Kashiwamura, S.; Nakajima, K.; Koyama, K.; Iwamatsu, A.; Tsunasawa, S.; Sakiyama, F.; Matsui, H.; Takahara, Y.; Taniguchi, T.; Kishimoto, T.: Complementary DNA for a novel human interleukin (BSF-2) that induces B lymphocytes to produce immunoglobulin. Nature 324:73-76, 1986; and Kovalchuk, A. L.; Kim, J. S.; Park, S. S.; Coleman, A. E.; Ward, J. M.; Morse, H. C, III; Kishimoto, T.; Potter, M.; Janz, S.: IL-6 transgenic mouse model for extraosseous plasmacytoma.

Further studies establishing the function and utilities of IL6R are found in John Hopkins OMIM database record ID 147880, and in cited publications listed in Table 5, which are hereby incorporated by reference. Interleukin 6 receptor (IL6R, Accession NP_852004.1) is another GAM94 target gene, herein designated TARGET GENE. IL6R BINDING SITE is a target binding site found in the 3' untranslated region of multiple transcripts of mRNA encoded by IL6R, corresponding to a target binding site such as BINDING SITE I, BINDING SITE II or BINDING SITE III of FIG. 8. Table 4 illustrates the complementarity of the nucleotide sequences of IL6R BINDING SITE, designated SEQ ID:10665, to the nucleotide sequence of GAM94 RNA, herein designated GAM RNA, also designated SEQ ID:332.

Another function of GAM94 is therefore inhibition of Interleukin 6 receptor (IL6R, Accession NP_852004.1), a gene which is essential to the regulation of the immune response, hematopoiesis, and acute-phase reactions. Accordingly, utilities of GAM94 include diagnosis, prevention and treatment of diseases and clinical conditions associated with IL6R.

The function of IL6R has been established by previous studies. Whereas the 0.9-kb IFN-beta-1 mRNA is transcribed from an intron-free IFNB1 gene located on 9p (OMIM Ref. No. 147640), IFN-beta-2 is the translation product of a 1.3-kb mRNA derived from an intron-containing IFNB2 gene not located on chromosome 9. The IFN-beta-2 mRNA does not cross-hybridize with IFN-beta-1 cDNA probes and vice-versa. Sehgal et al. (1986) mapped IFNB2 to chromosome 7 by means of a cDNA clone in blot-hybridization experiments on DNA from a panel of human-rodent somatic cell hybrids. Zilberstein et al. (1986) cloned cDNA for the 1.3-kb RNA designated IFNB2. Expression studies showed that the IFN-beta-2 secreted by DNA- transformed rodent cells is a processed 21-kD protein whose activity is cross- neutralized by antibodies to human IFN-beta-1 but not to alpha or gamma interferon. The biologic significance of IFN-beta-2 lies in the fact that it is induced under conditions in which IFN-beta-1 is not induced, as in metabolically stressed cells. Its induction by IL1 (OMIM Ref. No. 147720) and TNF (OMIM Ref. No. 191160) suggests that it may play a role as an autocrine mediator of some effects of these cytokines in inflammation and acute phase responses, as well as regulate cell proliferation. As discussed by Sehgal et al. (1987), IFNB2 is identical to B-cell differentiation factor (BSF2) and enhances proliferation in hybridoma/plasmacytoma cells. Hirano et al. (1986) reported the molecular cloning, structural analysis, and functional expression of cDNA encoding human BSF2. The primary sequence of BSF2 deduced from the cDNA shows that it has 184 amino acids and is distinct from other interleukins. In addition to its antiviral activity, beta-2 interferon elicits acute phase response in liver cells and is identical to hepatocyte stimulatory factor. It also is identical to hybridoma growth factor. A subset of plasmacytoma (PCT), designated extramedullary PCT, is distinguished from multiple myeloma and solitary PCT of bone by its distribution among various tissue sites but not bone marrow. Extramedullary (extraosseus) PCTs are rare spontaneous neoplasms of mice but are readily induced in a susceptible strain, BALB/c, by treatment with pristane. The tumors develop in peritoneal granulomas and are characterized by Myc-activating t(12;15) chromosomal translocations and, most frequently, by secretion of IgA. To test directly the contribution of IL6 to PCT development, Kovalchuk et al. (2002) generated BALB/c mice carrying a widely expressed IL6 transgene. All mice exhibited lymphoproliferation and plasmacytosis. By 18 months of age, more than half developed readily transplantable PCTs in lymph nodes, Peyer patches, and sometimes spleen. These neoplasms also had the t(12;15) translocations, but remarkably, none expressed IgA. Approximately 30% of the mice developed follicular and diffuse large cell B-cell lymphomas that often coexisted with PCTs. These findings provided a unique model of extramedullary PCT for studies on pathogenesis and treatment and suggested a role for IL6 in the genesis of germinal center-derived lymphomas Full details of the abovementioned studies are described in the following publications, the disclosure of which are hereby incorporated by reference:

Hirano, T.; Yasukawa, K.; Harada, H.; Taga, T.; Watanabe, Y.; Matsuda, T.; Kashiwamura, S.; Nakajima, K.; Koyama, K.; Iwamatsu, A.; Tsunasawa, S.; Sakiyama, F.; Matsui, H.; Takahara, Y.; Taniguchi, T.; Kishimoto, T.: Complementary DNA for a novel human interleukin (BSF-2) that induces B lymphocytes to produce immunoglobulin. Nature 324:73-76, 1986; and Kovalchuk, A. L.; Kim, J. S.; Park, S. S.; Coleman, A. E.; Ward, J. M.; Morse, H. C, III; Kishimoto, T.; Potter, M.; Janz, S.: IL-6 transgenic mouse model for extraosseous plasmacytoma.

Further studies establishing the function and utilities of IL6R are found in John Hopkins OMIM database record ID 147880, and in cited publications listed in Table 5, which are hereby incorporated by reference. Inhibitor of growth family, member 3 (ING3, Accession NP_061944.1) is another GAM94 target gene, herein designated TARGET GENE. ING3 BINDING SITE is a target binding site found in the 3' untranslated region of mRNA encoded by ING3, corresponding to a target binding site such as BINDING SITE I, BINDING SITE II or BINDING SITE III of FIG. 8. Table 4 illustrates the complementarity of the nucleotide sequences of ING3 BINDING SITE, designated SEQ ID:3094, to the nucleotide sequence of GAM94 RNA, herein designated GAM RNA, also designated SEQ ID:332.

Another function of GAM94 is therefore inhibition of Inhibitor of growth family, member 3 (ING3, Accession NP_061944.1). Accordingly, utilities of GAM94 include diagnosis, prevention and treatment of diseases and clinical conditions associated with ING3.

IPO8 (Accession NP_006381.1) is another GAM94 target gene, herein designated TARGET GENE. IPO8 BINDING SITE is a target binding site found in the 5' untranslated region of mRNA encoded by IPO8, corresponding to a target binding site such as BINDING SITE I, BINDING SITE II or BINDING SITE III of FIG. 8. Table 4 illustrates the complementarity of the nucleotide sequences of IPO8 BINDING SITE, designated SEQ ID:3120, to the nucleotide sequence of GAM94 RNA, herein designated GAM RNA, also designated SEQ ID:332.

Another function of GAM94 is therefore inhibition of IPO8 (Accession NP_006381.1). Accordingly, utilities of GAM94 include diagnosis, prevention and treatment of diseases and clinical conditions associated with IPO8.

Janus kinase 2 (a protein tyrosine kinase) (JAK2, Accession NP_004963.1) is another GAM94 target gene, herein designated TARGET GENE. JAK2 BINDING SITE is a target binding site found in the 5' untranslated region of mRNA encoded by JAK2, corresponding to a target binding site such as BINDING SITE I, BINDING SITE II or BINDING SITE III of FIG. 8. Table 4 illustrates the complementarity of the nucleotide sequences of JAK2 BINDING SITE, designated SEQ ID:17718, to the nucleotide sequence of GAM94 RNA, herein designated GAM RNA, also designated SEQ ID:332.

Another function of GAM94 is therefore inhibition of Janus kinase 2 (a protein tyrosine kinase) (JAK2, Accession NP_004963.1), a gene which tyrosine kinase of the non-receptor type, involved in interleukin 3 signal transduction. and therefore may be associated with Pre-b acute myeloid leukemia. Accordingly, utilities of GAM94 include diagnosis, prevention and treatment of Pre-b acute myeloid leukemia, and of other diseases and clinical conditions associated with JAK2.

The function of JAK2 has been established by previous studies. JAK2 kinase is a member of a family of tyrosine kinases involved in cytokine receptor signaling. See 147795 for background information on Janus kinases In addition to its role as a kidney cytokine regulating hematopoiesis, erythropoietin (OMIM Ref. No. 133170) is also produced in the brain after oxidative or nitrosative stress. The transcription factor HIF1 (OMIM Ref. No. 603348) upregulates erythropoietin following hypoxic stimuli. Digicayliogu and Lipton (2001) demonstrated that preconditioning with erythropoietin protects neurons in models of ischemic and degenerative damage due to excitotoxins and consequent generation of free radicals, including nitric oxide. Activation of neuronal erythropoietin receptors (EPOR; 133171) prevents apoptosis induced by NMDA or nitric oxide by triggering crosstalk between the signaling pathways JAK2 and NFKB (see OMIM Ref. No. 164011). Digicaylioglu and Lipton (2001) demonstrated that erythropoietin receptor- mediated activation of JAK2 leads to phosphorylation of the inhibitor of NFKB (I-kappa-B-alpha; 164008), subsequent nuclear translocation of the transcription factor NFKB, and NFKB-dependent transcription of neuroprotective genes. Transfection of cerebrocortical neurons with a dominant interfering form of JAK2 or an I- kappa-B-alpha superrepressor blocks erythropoietin-mediated prevention of neuronal apoptosis. Thus, neuronal erythropoietin receptors activate a neuroprotective pathway that is distinct from previously well characterized JAK and NFKB functions. Moreover, this erythropoietin effect may underlie neuroprotection mediated by hypoxic-ischemic preconditioning. Huang et al. (2001) showed that JAK2, and more specifically just its intact N-terminal domain, binds to EPOR in the endoplasmic reticulum and promotes its cell surface expression. This interaction was specific, as JAK1 had no effect. Residues 32 to 58 of the JAK2 JH7 domain were required for EPOR surface expression. Alanine scanning mutagenesis of the EPOR membrane proximal region revealed 2 modes of EPOR-JAK2 interaction. A continuous block of EPOR residues was required for functional, ligand- independent binding to JAK2 and cell surface receptor expression, whereas 4 specific residues were essential in switching on prebound JAK2 after ligand binding. Thus, in addition to its kinase activity required for cytokine receptor signaling, JAK is also an essential subunit required for surface expression of cytokine receptors.

Animal model experiments lend further support to the function of JAK2. Neubauer et al. (1998) also performed a targeted inactivation of Jak2 in mice. Jak2 -/- embryos were anemic and died around day 12.5 postcoitum. Primitive erythrocytes were found, but definitive erythropoiesis was absent. Compared to erythropoietin receptor-deficient mice, the phenotype of Jak2 deficiency was more severe. Fetal liver BFU-E and CFU-E colonies were completely absent. However, multilineage hematopoietic stem cells (CD34-low, c-kit-pos) were found, and B lymphopoiesis appeared intact. In contrast to IFN-alpha stimulation, Jak2 -/- cells did not respond to IFN-gamma. Jak2 -/-embryonic stem cells were competent for LIF signaling. These data also demonstrated that Jak2 has pivotal functions for signal transduction of a set of cytokine receptors required in definitive erythropoiesis It is appreciated that the abovementioned animal model for JAK2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Neubauer, H.; Cumano, A.; Muller, M.; Wu, H.; Huffstadt, U.; Pfeffer, K.: Jak2 deficiency defines an essential developmental checkpoint in definitive hematopoiesis. Cell 93:397-409, 1998; and Digicaylioglu, M.; Lipton, S. A.: Erythropoietin-mediated neuroprotection involves cross-talk between Jak2 and NF-kappa-B signalling cascades. Nature 412:641-647, 2001.

Further studies establishing the function and utilities of JAK2 are found in John Hopkins OMIM database record ID 147796, and in cited publications listed in Table 5, which are hereby incorporated by reference. Potassium voltage-gated channel, shaker-related subfamily, member 4 (KCNA4, Accession NP_002224.1) is another GAM94 target gene, herein designated TARGET GENE. KCNA4 BINDING SITE is a target binding site found in the 3' untranslated region of mRNA encoded by KCNA4, corresponding to a target binding site such as BINDING SITE I, BINDING SITE II or BINDING SITE III of FIG. 8. Table 4 illustrates the complementarity of the nucleotide sequences of KCNA4 BINDING SITE, designated SEQ ID:3266, to the nucleotide sequence of GAM94 RNA, herein designated GAM RNA, also designated SEQ ID:332.

Another function of GAM94 is therefore inhibition of Potassium voltage-gated channel, shaker-related subfamily, member 4 (KCNA4, Accession NP_002224.1), a gene which might be important in the regulation of the fast repolarizing phase of action potentials in heart. Accordingly, utilities of GAM94 include diagnosis, prevention and treatment of diseases and clinical conditions associated with KCNA4.

The function of KCNA4 has been established by previous studies. Potassium voltage-gated ion channels are highly diverse membrane proteins that seem to be present in nearly every eukaryotic cell (see OMIM Ref. No. 176260). The rat genome encodes a potassium-channel (K-channel) family (RCK) homologous to the Shaker channels of Drosophila (Stuehmer et al., 1989). Only 1 member of this rat K-channel family, RCK4, was found to express A-type, i.e., rapidly inactivating, K- channels. Philipson et al. (1990) provided the sequence of the cDNA corresponding to a fetal skeletal muscle potassium channel related to RCK4. The predicted 653-amino acid PCN2 protein shares 55% sequence identity with PCN1 (OMIM Ref. No. 176267) (Philipson et al., 1991). Tamkun et al. (1991) cloned a full-length human cDNA showing 97% identity to RCK4 and referred to it as HK1. HK1 mRNA was expressed in heart, in particular in the atrium and ventricle. Therefore, they concluded that the K-channel formed by this protein might be important in the regulation of the fast repolarizing phase of action potentials in heart and thus might influence the duration of cardiac action potential. Grandy et al. (1992) mapped the KCNA4 gene to 11p14-p13. Using PCR, Gessler et al. (1992) produced a genomic HK1 DNA probe to map the gene on human chromosome 11p14 by study of somatic cell hybrids and by pulsed field gel electrophoresis (PFGE). The somatic cell hybrid analysis demonstrated that the gene is in the WAGR (OMIM Ref. No. 137357) region. PFGE analysis and comparison with the well-established PFGE map of the region localized the gene to 11p14, 200 to 600 kb telomeric to FSHB (OMIM Ref. No. 136530). Thus, as the FSHB gene is located at 11p14, close to the 11p13/p14 boundary, the HK1 gene could be assigned to the proximal part of that band, namely, 11p14.1. From observations in cases of WAGR leading to deletion in this region, Gessler et al. (1992) concluded that a hemizygous deletion of HK1 may have little phenotypic effect, perhaps because of less stringent requirements for the control of expression levels for this gene. The HK1 gene is located in the wrong position to be a plausible candidate gene for the long QT syndrome (LQT1; 192500). Philipson et al. (1993) mapped a potassium channel gene, which they symbolized KCNA4, to 11q13.4-q14.1 by a combination of segregation in a panel of reduced human-mouse somatic cell hybrids and isotopic in situ hybridization Full details of the abovementioned studies are described in the following publications, the disclosure of which are hereby incorporated by reference:

Gessler, M.; Grupe, A.; Grzeschik, K.-H.; Pongs, O.: The potassium channel gene HK1 maps to human chromosome 11p14.1, close to the FSHB gene. Hum. Genet. 90:319-321, 1992; and Grandy, D.; Mathew, M. K.; Ramaswami, M.; Tanouy, M.; Sheffield, V.; Jones, C. A.; Al-Dhalimi, M.; Zhang, Y.; Saez, C.; Litt, M.: A human voltage-gated potassium channel gene, HuKII, m.

Further studies establishing the function and utilities of KCNA4 are found in John Hopkins OMIM database record ID 176266, and in cited publications listed in Table 5, which are hereby incorporated by reference. Potassium inwardly-rectifying channel, subfamily j, member 15 (KCNJ15, Accession NP_002234.2) is another GAM94 target gene, herein designated TARGET GENE. KCNJ15 BINDING SITE is a target binding site found in the 3' untranslated region of multiple transcripts of mRNA encoded by KCNJ15, corresponding to a target binding site such as BINDING SITE I, BINDING SITE II or BINDING SITE III of FIG. 8. Table 4 illustrates the complementarity of the nucleotide sequences of KCNJ15 BINDING SITE, designated SEQ ID:18499, to the nucleotide sequence of GAM94 RNA, herein designated GAM RNA, also designated SEQ ID:332.

Another function of GAM94 is therefore inhibition of Potassium inwardly-rectifying channel, subfamily j, member 15 (KCNJ15, Accession NP_002234.2). Accordingly, utilities of GAM94 include diagnosis, prevention and treatment of diseases and clinical conditions associated with KCNJ15.

Potassium inwardly-rectifying channel, subfamily j, member 15 (KCNJ15, Accession NP_733932.1) is another GAM94 target gene, herein designated TARGET GENE. KCNJ15 BINDING SITE is a target binding site found in the 3' untranslated region of multiple transcripts of mRNA encoded by KCNJ15, corresponding to a target binding site such as BINDING SITE I, BINDING SITE II or BINDING SITE III of FIG. 8. Table 4 illustrates the complementarity of the nucleotide sequences of KCNJ15 BINDING SITE, designated SEQ ID:18499, to the nucleotide sequence of GAM94 RNA, herein designated GAM RNA, also designated SEQ ID:332.

Another function of GAM94 is therefore inhibition of Potassium inwardly-rectifying channel, subfamily j, member 15 (KCNJ15, Accession NP_733932.1). Accordingly, utilities of GAM94 include diagnosis, prevention and treatment of diseases and clinical conditions associated with KCNJ15.

Potassium inwardly-rectifying channel, subfamily j, member 15 (KCNJ15, Accession NP_733933.1) is another GAM94 target gene, herein designated TARGET GENE. KCNJ15 BINDING SITE is a target binding site found in the 3' untranslated region of multiple transcripts of mRNA encoded by KCNJ15, corresponding to a target binding site such as BINDING SITE I, BINDING SITE II or BINDING SITE III of FIG. 8. Table 4 illustrates the complementarity of the nucleotide sequences of KCNJ15 BINDING SITE, designated SEQ ID:18499, to the nucleotide sequence of GAM94 RNA, herein designated GAM RNA, also designated SEQ ID:332.

Another function of GAM94 is therefore inhibition of Potassium inwardly-rectifying channel, subfamily j, member 15 (KCNJ15, Accession NP_733933.1). Accordingly, utilities of GAM94 include diagnosis, prevention and treatment of diseases and clinical conditions associated with KCNJ15.

Potassium channel, subfamily k, member 6 (KCNK6, Accession NP_004814.1) is another GAM94 target gene, herein designated TARGET GENE. KCNK6 BINDING SITE is a target binding site found in the 3' untranslated region of mRNA encoded by KCNK6, corresponding to a target binding site such as BINDING SITE I, BINDING SITE II or BINDING SITE III of FIG. 8. Table 4 illustrates the complementarity of the nucleotide sequences of KCNK6 BINDING SITE, designated SEQ ID:2279, to the nucleotide sequence of GAM94 RNA, herein designated GAM RNA, also designated SEQ ID:332.

Another function of GAM94 is therefore inhibition of Potassium channel, subfamily k, member 6 (KCNK6, Accession NP_004814.1), a gene which is an inward rectifying potassium channel protein. Accordingly, utilities of GAM94 include diagnosis, prevention and treatment of diseases and clinical conditions associated with KCNK6.

The function of KCNK6 and its association with various diseases and clinical conditions, has been established by previous studies, as described hereinabove with reference to GAM72.1. Potassium large conductance calcium-activated channel, subfamily m beta member 3 (KCNMB3, Accession NP_741981.1) is another GAM94 target gene, herein designated TARGET GENE. KCNMB3 BINDING SITE is a target binding site found in the 5' untranslated region of multiple transcripts of mRNA encoded by KCNMB3, corresponding to a target binding site such as BINDING SITE I, BINDING SITE II or BINDING SITE III of FIG. 8. Table 4 illustrates the complementarity of the nucleotide sequences of KCNMB3 BINDING SITE, designated SEQ ID:5079, to the nucleotide sequence of GAM94 RNA, herein designated GAM RNA, also designated SEQ ID:332.

Another function of GAM94 is therefore inhibition of Potassium large conductance calcium-activated channel, subfamily m beta member 3 (KCNMB3, Accession NP_741981.1), a gene which is similar to a regulatory subunit of Ca-activated potassium channel. Accordingly, utilities of GAM94 include diagnosis, prevention and treatment of diseases and clinical conditions associated with KCNMB3.

The function of KCNMB3 has been established by previous studies. The large conductance, calcium-activated potassium (BK) channel is a member of the Shaker-related 6-transmembrane domain potassium channel superfamily that is sensitive to voltage and calcium. BK channels are composed of a pore-forming alpha subunit (KCNMA1, or HSLO; 600150) and, in some tissues, a beta subunit. The beta-1 subunit (KCNMB1; 603951) is expressed predominantly in smooth muscle cells, whereas the beta-2 subunit (KCNMB2; 605214) is expressed in endocrine tissue, such as adrenal chromaffin cells Uebele et al. (2000) determined that KCNMB3 is a family of 4 related subunits, KCNMB3a (277 amino acids), KCNMB3b (257 amino acids), KCNMB3c (275 amino acids), and KCNMB3d (279 amino acids), that arise from alternative splicing. The subunits vary only in their cytoplasmic N-terminal sequences and share 256 C-terminal amino acids. Genomic sequence analysis determined that the KCNMB3 gene contains 6 exons, 3 of which (1a, 1b, and 1c/d) encode sequences unique to each of the splice variants. RT-PCR analysis showed that KCNMB3a has a relatively restricted distribution (spleen, placenta, pancreas, kidney, and heart), while the other variants are more widely expressed. KCNMB3c was notably abundant in pancreas. In situ hybridization analysis demonstrated that KCNMB3c expression is restricted to pancreatic beta cells. Coexpression of KCNMB3a, -b, and -c with KCNMA1 resulted in partial inactivation of activating currents; KCNMB3d did not induce detectable inactivation. By FISH and somatic cell hybrid analysis, Riazi et al. (1999) mapped the KCNMB3 gene to 3q26.3-q27. Uebele et al. (2000) also mapped the KCNMB3 gene to 3q26.3-q27.1, in close proximity to KCNMB2, by radiation hybrid and FISH analysis Full details of the abovementioned studies are described in the following publications, the disclosure of which are hereby incorporated by reference:

Behrens, R.; Nolting, A.; Reimann, F.; Schwarz, M.; Waldschutz, R.; Pongs, O.: hKCNMB3 and hKCNMB4, cloning and characterization of two members of the large-conductance calcium-activated potassium channel beta subunit family. FEBS Lett. 474:99-106, 2000; and Brenner, R.; Jegla, T. J.; Wickenden, A.; Liu, Y.; Aldrich, R. W.: Cloning and functional characterization of novel large conductance calcium-activated potassium channel beta subunits.

Further studies establishing the function and utilities of KCNMB3 are found in John Hopkins OMIM database record ID 605222, and in cited publications listed in Table 5, which are hereby incorporated by reference. Potassium large conductance calcium-activated channel, subfamily m beta member 3 (KCNMB3, Accession NP_055222.3) is another GAM94 target gene, herein designated TARGET GENE. KCNMB3 BINDING SITE is a target binding site found in the 5' untranslated region of multiple transcripts of mRNA encoded by KCNMB3, corresponding to a target binding site such as BINDING SITE I, BINDING SITE II or BINDING SITE III of FIG. 8. Table 4 illustrates the complementarity of the nucleotide sequences of KCNMB3 BINDING SITE, designated SEQ ID:5079, to the nucleotide sequence of GAM94 RNA, herein designated GAM RNA, also designated SEQ ID:332.

Another function of GAM94 is therefore inhibition of Potassium large conductance calcium-activated channel, subfamily m beta member 3 (KCNMB3, Accession NP_055222.3), a gene which is similar to a regulatory subunit of Ca-activated potassium channel. Accordingly, utilities of GAM94 include diagnosis, prevention and treatment of diseases and clinical conditions associated with KCNMB3.

The function of KCNMB3 has been established by previous studies. The large conductance, calcium-activated potassium (BK) channel is a member of the Shaker-related 6-transmembrane domain potassium channel superfamily that is sensitive to voltage and calcium. BK channels are composed of a pore-forming alpha subunit (KCNMA1, or HSLO; 600150) and, in some tissues, a beta subunit. The beta-1 subunit (KCNMB1; 603951) is expressed predominantly in smooth muscle cells, whereas the beta-2 subunit (KCNMB2; 605214) is expressed in endocrine tissue, such as adrenal chromaffin cells Uebele et al. (2000) determined that KCNMB3 is a family of 4 related subunits, KCNMB3a (277 amino acids), KCNMB3b (257 amino acids), KCNMB3c (275 amino acids), and KCNMB3d (279 amino acids), that arise from alternative splicing. The subunits vary only in their cytoplasmic N-terminal sequences and share 256 C-terminal amino acids. Genomic sequence analysis determined that the KCNMB3 gene contains 6 exons, 3 of which (1a, 1b, and 1c/d) encode sequences unique to each of the splice variants. RT-PCR analysis showed that KCNMB3a has a relatively restricted distribution (spleen, placenta, pancreas, kidney, and heart), while the other variants are more widely expressed. KCNMB3c was notably abundant in pancreas. In situ hybridization analysis demonstrated that KCNMB3c expression is restricted to pancreatic beta cells. Coexpression of KCNMB3a, -b, and -c with KCNMA1 resulted in partial inactivation of activating currents; KCNMB3d did not induce detectable inactivation. By FISH and somatic cell hybrid analysis, Riazi et al. (1999) mapped the KCNMB3 gene to 3q26.3-q27. Uebele et al. (2000) also mapped the KCNMB3 gene to 3q26.3-q27.1, in close proximity to KCNMB2, by radiation hybrid and FISH analysis Full details of the abovementioned studies are described in the following publications, the disclosure of which are hereby incorporated by reference:

Behrens, R.; Nolting, A.; Reimann, F.; Schwarz, M.; Waldschutz, R.; Pongs, O.: hKCNMB3 and hKCNMB4, cloning and characterization of two members of the large-conductance calcium-activated potassium channel beta subunit family. FEBS Lett. 474:99-106, 2000; and Brenner, R.; Jegla, T. J.; Wickenden, A.; Liu, Y.; Aldrich, R. W.: Cloning and functional characterization of novel large conductance calcium-activated potassium channel beta subunits.

Further studies establishing the function and utilities of KCNMB3 are found in John Hopkins OMIM database record ID 605222, and in cited publications listed in Table 5, which are hereby incorporated by reference. Potassium intermediate/small conductance calcium-activated channel, subfamily n, member 3 (KCNN3, Accession NP_740752.1) is another GAM94 target gene, herein designated TARGET GENE. KCNN3 BINDING SITE is a target binding site found in the 3' untranslated region of multiple transcripts of mRNA encoded by KCNN3, corresponding to a target binding site such as BINDING SITE I, BINDING SITE II or BINDING SITE III of FIG. 8. Table 4 illustrates the complementarity of the nucleotide sequences of KCNN3 BINDING SITE, designated SEQ ID:10793, to the nucleotide sequence of GAM94 RNA, herein designated GAM RNA, also designated SEQ ID:332.

Another function of GAM94 is therefore inhibition of Potassium intermediate/small conductance calcium-activated channel, subfamily n, member 3 (KCNN3, Accession NP_740752.1), a gene which forms a voltage- independent potassium channel activated by intracellular calcium. Accordingly, utilities of GAM94 include diagnosis, prevention and treatment of diseases and clinical conditions associated with KCNN3.

The function of KCNN3 has been established by previous studies. Action potentials in vertebrate neurons are followed by an afterhyperpolarization (AHP) that may persist for several seconds and may have profound consequences for the firing pattern of the neuron. Each component of the AHP is kinetically distinct and is mediated by different calcium-activated potassium channels. SK channels are activated in a voltage- independent manner and have a relatively small unit conductance and high sensitivity to calcium. See 602754. Kohler et al. (1996) isolated rat and human brain cDNAs encoding a family of SK channels which they designated SK1 (KCNN1; 602982), SK2 (OMIM Ref. No. 605879), and SK3. All 3 proteins contain intracellular N and C termini and 6 highly conserved transmembrane segments. In situ hybridization revealed that mRNAs encoding these subunits are widely expressed in rat brain with distinct but overlapping patterns Austin et al. (1999) mapped this gene, which they referred to as human KCa3 (hKCa3), to 1q21 by radiation hybrid analysis. In the families from the National Institute of Mental Health (NIMH) Schizophrenia Genetics Initiative, they compared transmission to discordant sibs and parental transmission to affected offspring. Overall, there was no convincing evidence that KCNN3 CAG lengths differed between schizophrenics and controls. There was also no evidence of excessive parental transmission of long CAG repeat alleles to affected offspring. Sun et al. (2001) reported the genomic organization and a promoter analysis of the KCNN3 gene Animal model experiments lend further support to the function of KCNN3. Bond et al. (2000) targeted the SK3 gene by homologous recombination for the insertion of a gene switch that permitted experimental regulation of SK3 expression while retaining normal SK3 promoter function. An absence of SK3 did not present overt phenotypic consequences. However, SK3 overexpression induced abnormal respiratory responses to hypoxia and compromised parturition, presumably by effects on uterine contraction. Both conditions were corrected by silencing the gene. Bond et al. (2000) concluded that their results implicate SK3 channels as potential therapeutic targets for disorders such as sleep apnea or sudden infant death syndrome and for regulating uterine contractions during labor.

It is appreciated that the abovementioned animal model for KCNN3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sun, G.; Tomita, H.; Shakkottai, V. G.; Gargus, J. J.: Genomic organization and promoter analysis of human KCNN3 gene. J. Hum. Genet. 46:463-470, 2001; and Bond, C. T.; Sprengel, R.; Bissonnette, J. M.; Kaufmann, W. A.; Pribnow, D.; Neelands, T.; Storck, T.; Baetscher, M.; Jerecic, J.; Maylie, J.; Knaus, H.-G.; Seeburg, P. H.; Adelman, J.

Further studies establishing the function and utilities of KCNN3 are found in John Hopkins OMIM database record ID 602983, and in cited publications listed in Table 5, which are hereby incorporated by reference. Potassium intermediate/small conductance calcium-activated channel, subfamily n, member 3 (KCNN3, Accession NP_002240.2) is another GAM94 target gene, herein designated TARGET GENE. KCNN3 BINDING SITE is a target binding site found in the 3' untranslated region of multiple transcripts of mRNA encoded by KCNN3, corresponding to a target binding site such as BINDING SITE I, BINDING SITE II or BINDING SITE III of FIG. 8. Table 4 illustrates the complementarity of the nucleotide sequences of KCNN3 BINDING SITE, designated SEQ ID:10793, to the nucleotide sequence of GAM94 RNA, herein designated GAM RNA, also designated SEQ ID:332.

Another function of GAM94 is therefore inhibition of Potassium intermediate/small conductance calcium-activated channel, subfamily n, member 3 (KCNN3, Accession NP_002240.2), a gene which forms a voltage-independent potassium channel activated by intracellular calcium. Accordingly, utilities of GAM94 include diagnosis, prevention and treatment of diseases and clinical conditions associated with KCNN3.

The function of KCNN3 has been established by previous studies. Action potentials in vertebrate neurons are followed by an afterhyperpolarization (AHP) that may persist for several seconds and may have profound consequences for the firing pattern of the neuron. Each component of the AHP is kinetically distinct and is mediated by different calcium-activated potassium channels. SK channels are activated in a voltage-independent manner and have a relatively small unit conductance and high sensitivity to calcium. See 602754. Kohler et al. (1996) isolated rat and human brain cDNAs encoding a family of SK channels which they designated SK1 (KCNN1; 602982), SK2 (OMIM Ref. No. 605879), and SK3. All 3 proteins contain intracellular N and C termini and 6 highly conserved transmembrane segments. In situ hybridization revealed that mRNAs encoding these subunits are widely expressed in rat brain with distinct but overlapping patterns Austin et al. (1999) mapped this gene, which they referred to as human KCa3 (hKCa3), to 1q21 by radiation hybrid analysis. In the families from the National Institute of Mental Health (NIMH) Schizophrenia Genetics Initiative, they compared transmission to discordant sibs and parental transmission to affected offspring. Overall, there was no convincing evidence that KCNN3 CAG lengths differed between schizophrenics and controls. There was also no evidence of excessive parental transmission of long CAG repeat alleles to affected offspring. Sun et al. (2001) reported the genomic organization and a promoter analysis of the KCNN3 gene Animal model experiments lend further support to the function of KCNN3. Bond et al. (2000) targeted the SK3 gene by homologous recombination for the insertion of a gene switch that permitted experimental regulation of SK3 expression while retaining normal SK3 promoter function. An absence of SK3 did not present overt phenotypic consequences. However, SK3 overexpression induced abnormal respiratory responses to hypoxia and compromised parturition, presumably by effects on uterine contraction. Both conditions were corrected by silencing the gene. Bond et al. (2000) concluded that their results implicate SK3 channels as potential therapeutic targets for disorders such as sleep apnea or sudden infant death syndrome and for regulating uterine contractions during labor.

It is appreciated that the abovementioned animal model for KCNN3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sun, G.; Tomita, H.; Shakkottai, V. G.; Gargus, J. J.: Genomic organization and promoter analysis of human KCNN3 gene. J. Hum. Genet. 46:463-470, 2001; and Bond, C. T.; Sprengel, R.; Bissonnette, J. M.; Kaufmann, W. A.; Pribnow, D.; Neelands, T.; Storck, T.; Baetscher, M.; Jerecic, J.; Maylie, J.; Knaus, H.-G.; Seeburg, P. H.; Adelman, J.

Further studies establishing the function and utilities of KCNN3 are found in John Hopkins OMIM database record ID 602983, and in cited publications listed in Table 5, which are hereby incorporated by reference. Potassium voltage-gated channel, delayed-rectifier, subfamily s, member 2 (KCNS2, Accession XP_043106.1) is another GAM94 target gene, herein designated TARGET GENE. KCNS2 BINDING SITE is a target binding site found in the 3' untranslated region of mRNA encoded by KCNS2, corresponding to a target binding site such as BINDING SITE I, BINDING SITE II or BINDING SITE III of FIG. 8. Table 4 illustrates the complementarity of the nucleotide sequences of KCNS2 BINDING SITE, designated SEQ ID:7405, to the nucleotide sequence of GAM94 RNA, herein designated GAM RNA, also designated SEQ ID:332.

Another function of GAM94 is therefore inhibition of Potassium voltage-gated channel, delayed-rectifier, subfamily s, member 2 (KCNS2, Accession XP_043106.1), a gene which mediates the voltage-dependent potassium ion permeability of excitable membranes. Accordingly, utilities of GAM94 include diagnosis, prevention and treatment of diseases and clinical conditions associated with KCNS2.

The function of KCNS2 and its association with various diseases and clinical conditions, has been established by previous studies, as described hereinabove with reference to GAM67.1. KIAA0063 (Accession NP_055691.1) is another GAM94 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:4542, to the nucleotide sequence of GAM94 RNA, herein designated GAM RNA, also designated SEQ ID:332.

Another function of GAM94 is therefore inhibition of KIAA0063 (Accession NP_055691.1). Accordingly, utilities of GAM94 include diagnosis, prevention and treatment of diseases and clinical conditions associated with KIAA0063.

KIAA0152 (Accession NP_055545.1) is another GAM94 target gene, herein designated TARGET GENE. KIAA0152 BINDING SITE is a target binding site found in the 3' untranslated region of mRNA encoded by KIAA0152, corresponding to a target binding site such as BINDING SITE I, BINDING SITE II or BINDING SITE III of FIG. 8. Table 4 illustrates the complementarity of the nucleotide sequences of KIAA0152 BINDING SITE, designated SEQ ID:9197, to the nucleotide sequence of GAM94 RNA, herein designated GAM RNA, also designated SEQ ID:332.

Another function of GAM94 is therefore inhibition of KIAA0152 (Accession NP_055545.1). Accordingly, utilities of GAM94 include diagnosis, prevention and treatment of diseases and clinical conditions associated with KIAA0152.

KIAA0193 (Accession NP_055581.2) is another GAM94 target gene, herein designated TARGET GENE. KIAA0193 BINDING SITE is a target binding site found in the 3' untranslated region of mRNA encoded by KIAA0193, corresponding to a target binding site such as BINDING SITE I, BINDING SITE II or BINDING SITE III of FIG. 8. Table 4 illustrates the complementarity of the nucleotide sequences of KIAA0193 BINDING SITE, designated SEQ ID:18064, to the nucleotide sequence of GAM94 RNA, herein designated GAM RNA, also designated SEQ ID:332.

Another function of GAM94 is therefore inhibition of KIAA0193 (Accession NP_055581.2). Accordingly, utilities of GAM94 include diagnosis, prevention and treatment of diseases and clinical conditions associated with KIAA0193.

KIAA0237 (Accession NP_055562.1) is another GAM94 target gene, herein designated TARGET GENE. KIAA0237 BINDING SITE1 and KIAA0237 BINDING SITE2 are target binding sites found in untranslated regions of mRNA encoded by KIAA0237, corresponding to target binding sites such as BINDING SITE I, BINDING SITE II or BINDING SITE III of FIG. 8. Table 4 illustrates the complementarity of the nucleotide sequences of KIAA0237 BINDING SITE1 and KIAA0237 BINDING SITE2, designated SEQ ID:20043 and SEQ ID:19421 respectively, to the nucleotide sequence of GAM94 RNA, herein designated GAM RNA, also designated SEQ ID:332.

Another function of GAM94 is therefore inhibition of KIAA0237 (Accession NP_055562.1). Accordingly, utilities of GAM94 include diagnosis, prevention and treatment of diseases and clinical conditions associated with KIAA0237.

KIAA0280 (Accession XP_166238.1) is another GAM94 target gene, herein designated TARGET GENE. KIAA0280 BINDING SITE1 and KIAA0280 BINDING SITE2 are target binding sites found in untranslated regions of mRNA encoded by KIAA0280, corresponding to target binding sites such as BINDING SITE I, BINDING SITE II or BINDING SITE III of FIG. 8. Table 4 illustrates the complementarity of the nucleotide sequences of KIAA0280 BINDING SITE1 and KIAA0280 BINDING SITE2, designated SEQ ID:18800 and SEQ ID:16465 respectively, to the nucleotide sequence of GAM94 RNA, herein designated GAM RNA, also designated SEQ ID:332.

Another function of GAM94 is therefore inhibition of KIAA0280 (Accession XP_166238.1). Accordingly, utilities of GAM94 include diagnosis, prevention and treatment of diseases and clinical conditions associated with KIAA0280.

KIAA0303 (Accession XP_291141.2) is another GAM94 target gene, herein designated TARGET GENE. KIAA0303 BINDING SITE is a target binding site found in the 3' untranslated region of mRNA encoded by KIAA0303, corresponding to a target binding site such as BINDING SITE I, BINDING SITE II or BINDING SITE III of FIG. 8. Table 4 illustrates the complementarity of the nucleotide sequences of KIAA0303 BINDING SITE, designated SEQ ID:477, to the nucleotide sequence of GAM94 RNA, herein designated GAM RNA, also designated SEQ ID:332.

Another function of GAM94 is therefore inhibition of KIAA0303 (Accession XP_291141.2). Accordingly, utilities of GAM94 include diagnosis, prevention and treatment of diseases and clinical conditions associated with KIAA0303.

KIAA0375 (Accession XP_048462.1) is another GAM94 target gene, herein designated TARGET GENE. KIAA0375 BINDING SITE is a target binding site found in the 3' untranslated region of mRNA encoded by KIAA0375, corresponding to a target binding site such as BINDING SITE I, BINDING SITE II or BINDING SITE III of FIG. 8. Table 4 illustrates the complementarity of the nucleotide sequences of KIAA0375 BINDING SITE, designated SEQ ID:7737, to the nucleotide sequence of GAM94 RNA, herein designated GAM RNA, also designated SEQ ID:332.

Another function of GAM94 is therefore inhibition of KIAA0375 (Accession XP_048462.1). Accordingly, utilities of GAM94 include diagnosis, prevention and treatment of diseases and clinical conditions associated with KIAA0375.

KIAA0376 (Accession XP_037759.2) is another GAM94 target gene, herein designated TARGET GENE. KIAA0376 BINDING SITE is a target binding site found in the 3' untranslated region of mRNA encoded by KIAA0376, corresponding to a target binding site such as BINDING SITE I, BINDING SITE II or BINDING SITE III of FIG. 8. Table 4 illustrates the complementarity of the nucleotide sequences of KIAA0376 BINDING SITE, designated SEQ ID:19848, to the nucleotide sequence of GAM94 RNA, herein designated GAM RNA, also designated SEQ ID:332.

Another function of GAM94 is therefore inhibition of KIAA0376 (Accession XP_037759.2). Accordingly, utilities of GAM94 include diagnosis, prevention and treatment of diseases and clinical conditions associated with KIAA0376.

KIAA0431 (Accession NP_056066.1) is another GAM94 target gene, herein designated TARGET GENE. KIAA0431 BINDING SITE is a target binding site found in the 5' untranslated region of mRNA encoded by KIAA0431, corresponding to a target binding site such as BINDING SITE I, BINDING SITE II or BINDING SITE III of FIG. 8. Table 4 illustrates the complementarity of the nucleotide sequences of KIAA0431 BINDING SITE, designated SEQ ID:9717, to the nucleotide sequence of GAM94 RNA, herein designated GAM RNA, also designated SEQ ID:332.

Another function of GAM94 is therefore inhibition of KIAA0431 (Accession NP_056066.1). Accordingly, utilities of GAM94 include diagnosis, prevention and treatment of diseases and clinical conditions associated with KIAA0431.

KIAA0557 (Accession XP_085507.1) is another GAM94 target gene, herein designated TARGET GENE. KIAA0557 BINDING SITE is a target binding site found in the 3' untranslated region of mRNA encoded by KIAA0557, corresponding to a target binding site such as BINDING SITE I, BINDING SITE II or BINDING SITE III of FIG. 8. Table 4 illustrates the complementarity of the nucleotide sequences of KIAA0557 BINDING SITE, designated SEQ ID:19825, to the nucleotide sequence of GAM94 RNA, herein designated GAM RNA, also designated SEQ ID:332.

Another function of GAM94 is therefore inhibition of KIAA0557 (Accession XP_085507.1). Accordingly, utilities of GAM94 include diagnosis, prevention and treatment of diseases and clinical conditions associated with KIAA0557.

KIAA0570 (Accession XP_291018.1) is another GAM94 target gene, herein designated TARGET GENE. KIAA0570 BINDING SITE is a target binding site found in the 3' untranslated region of mRNA encoded by KIAA0570, corresponding to a target binding site such as BINDING SITE I, BINDING SITE II or BINDING SITE III of FIG. 8. Table 4 illustrates the complementarity of the nucleotide sequences of KIAA0570 BINDING SITE, designated SEQ ID:17900, to the nucleotide sequence of GAM94 RNA, herein designated GAM RNA, also designated SEQ ID:332.

Another function of GAM94 is therefore inhibition of KIAA0570 (Accession XP_291018.1). Accordingly, utilities of GAM94 include diagnosis, prevention and treatment of diseases and clinical conditions associated with KIAA0570.

KIAA0592 (Accession XP_170645.2) is another GAM94 target gene, herein designated TARGET GENE. KIAA0592 BINDING SITE is a target binding site found in the 5' untranslated region of mRNA encoded by KIAA0592, corresponding to a target binding site such as BINDING SITE I, BINDING SITE II or BINDING SITE III of FIG. 8. Table 4 illustrates the complementarity of the nucleotide sequences of KIAA0592 BINDING SITE, designated SEQ ID:3081, to the nucleotide sequence of GAM94 RNA, herein designated GAM RNA, also designated SEQ ID:332.

Another function of GAM94 is therefore inhibition of KIAA0592 (Accession XP_170645.2). Accordingly, utilities of GAM94 include diagnosis, prevention and treatment of diseases and clinical conditions associated with KIAA0592.

KIAA0922 (Accession NP_056011.1) is another GAM94 target gene, herein designated TARGET GENE. KIAA0922 BINDING SITE is a target binding site found in the 5' untranslated region of mRNA encoded by KIAA0922, corresponding to a target binding site such as BINDING SITE I, BINDING SITE II or BINDING SITE III of FIG. 8. Table 4 illustrates the complementarity of the nucleotide sequences of KIAA0922 BINDING SITE, designated SEQ ID:9702, to the nucleotide sequence of GAM94 RNA, herein designated GAM RNA, also designated SEQ ID:332.

Another function of GAM94 is therefore inhibition of KIAA0922 (Accession NP_056011.1). Accordingly, utilities of GAM94 include diagnosis, prevention and treatment of diseases and clinical conditions associated with KIAA0922.

KIAA0934 (Accession XP_034536.4) is another GAM94 target gene, herein designated TARGET GENE. KIAA0934 BINDING SITE is a target binding site found in the 3' untranslated region of mRNA encoded by KIAA0934, corresponding to a target binding site such as BINDING SITE I, BINDING SITE II or BINDING SITE III of FIG. 8. Table 4 illustrates the complementarity of the nucleotide sequences of KIAA0934 BINDING SITE, designated SEQ ID:12863, to the nucleotide sequence of GAM94 RNA, herein designated GAM RNA, also designated SEQ ID:332.

Another function of GAM94 is therefore inhibition of KIAA0934 (Accession XP_034536.4). Accordingly, utilities of GAM94 include diagnosis, prevention and treatment of diseases and clinical conditions associated with KIAA0934.

KIAA1032 (Accession XP_038604.4) is another GAM94 target gene, herein designated TARGET GENE. KIAA1032 BINDING SITE is a target binding site found in the 3' untranslated region of mRNA encoded by KIAA1032, corresponding to a target binding site such as BINDING SITE I, BINDING SITE II or BINDING SITE III of FIG. 8. Table 4 illustrates the complementarity of the nucleotide sequences of KIAA1032 BINDING SITE, designated SEQ ID:11779, to the nucleotide sequence of GAM94 RNA, herein designated GAM RNA, also designated SEQ ID:332.

Another function of GAM94 is therefore inhibition of KIAA1032 (Accession XP_038604.4). Accordingly, utilities of GAM94 include diagnosis, prevention and treatment of diseases and clinical conditions associated with KIAA1032.

KIAA1076 (Accession XP_037523.6) is another GAM94 target gene, herein designated TARGET GENE. KIAA1076 BINDING SITE is a target binding site found in the 5' untranslated region of mRNA encoded by KIAA1076, corresponding to a target binding site such as BINDING SITE I, BINDING SITE II or BINDING SITE III of FIG. 8. Table 4 illustrates the complementarity of the nucleotide sequences of KIAA1076 BINDING SITE, designated SEQ ID:19836, to the nucleotide sequence of GAM94 RNA, herein designated GAM RNA, also designated SEQ ID:332.

Another function of GAM94 is therefore inhibition of KIAA1076 (Accession XP_037523.6). Accordingly, utilities of GAM94 include diagnosis, prevention and treatment of diseases and clinical conditions associated with KIAA1076.

KIAA1202 (Accession XP_050478.1) is another GAM94 target gene, herein designated TARGET GENE. KIAA1202 BINDING SITE1 through KIAA1202 BINDING SITE4 are target binding sites found in untranslated regions of mRNA encoded by KIAA1202, corresponding to target binding sites such as BINDING SITE I, BINDING SITE II or BINDING SITE III of FIG. 8. Table 4 illustrates the complementarity of the nucleotide sequences of KIAA1202 BINDING SITE1 through KIAA1202 BINDING SITE4, designated SEQ ID:10637, SEQ ID:1445, SEQ ID:6664 and SEQ ID:11414 respectively, to the nucleotide sequence of GAM94 RNA, herein designated GAM RNA, also designated SEQ ID:332.

Another function of GAM94 is therefore inhibition of KIAA1202 (Accession XP_050478.1). Accordingly, utilities of GAM94 include diagnosis, prevention and treatment of diseases and clinical conditions associated with KIAA1202.

KIAA1210 (Accession XP_172801.1) is another GAM94 target gene, herein designated TARGET GENE. KIAA1210 BINDING SITE1 and KIAA1210 BINDING SITE2 are target binding sites found in untranslated regions of mRNA encoded by KIAA1210, corresponding to target binding sites such as BINDING SITE I, BINDING SITE II or BINDING SITE III of FIG. 8. Table 4 illustrates the complementarity of the nucleotide sequences of KIAA1210 BINDING SITE1 and KIAA1210 BINDING SITE2, designated SEQ ID:2528 and SEQ ID:15805 respectively, to the nucleotide sequence of GAM94 RNA, herein designated GAM RNA, also designated SEQ ID:332.

Another function of GAM94 is therefore inhibition of KIAA1210 (Accession XP_172801.1). Accordingly, utilities of GAM94 include diagnosis, prevention and treatment of diseases and clinical conditions associated with KIAA1210.

KIAA1376 (Accession XP_033042.2) is another GAM94 target gene, herein designated TARGET GENE. KIAA1376 BINDING SITE is a target binding site found in the 3' untranslated region of mRNA encoded by KIAA1376, corresponding to a target binding site such as BINDING SITE I, BINDING SITE II or BINDING SITE III of FIG. 8. Table 4 illustrates the complementarity of the nucleotide sequences of KIAA1376 BINDING SITE, designated SEQ ID:15428, to the nucleotide sequence of GAM94 RNA, herein designated GAM RNA, also designated SEQ ID:332.

Another function of GAM94 is therefore inhibition of KIAA1376 (Accession XP_033042.2). Accordingly, utilities of GAM94 include diagnosis, prevention and treatment of diseases and clinical conditions associated with KIAA1376.

KIAA1399 (Accession XP_046685.4) is another GAM94 target gene, herein designated TARGET GENE. KIAA1399 BINDING SITE is a target binding site found in the 5' untranslated region of mRNA encoded by KIAA1399, corresponding to a target binding site such as BINDING SITE I, BINDING SITE II or BINDING SITE III of FIG. 8. Table 4 illustrates the complementarity of the nucleotide sequences of KIAA1399 BINDING SITE, designated SEQ ID:9460, to the nucleotide sequence of GAM94 RNA, herein designated GAM RNA, also designated SEQ ID:332.

Another function of GAM94 is therefore inhibition of KIAA1399 (Accession XP_046685.4). Accordingly, utilities of GAM94 include diagnosis, prevention and treatment of diseases and clinical conditions associated with KIAA1399.

KIAA1416 (Accession XP_098762.3) is another GAM94 target gene, herein designated TARGET GENE. KIAA1416 BINDING SITE is a target binding site found in the 3' untranslated region of mRNA encoded by KIAA1416, corresponding to a target binding site such as BINDING SITE I, BINDING SITE II or BINDING SITE III of FIG. 8. Table 4 illustrates the complementarity of the nucleotide sequences of KIAA1416 BINDING SITE, designated SEQ ID:12761, to the nucleotide sequence of GAM94 RNA, herein designated GAM RNA, also designated SEQ ID:332.

Another function of GAM94 is therefore inhibition of KIAA1416 (Accession XP_098762.3). Accordingly, utilities of GAM94 include diagnosis, prevention and treatment of diseases and clinical conditions associated with KIAA1416.

KIAA1447 (Accession XP_290770.2) is another GAM94 target gene, herein designated TARGET GENE. KIAA1447 BINDING SITE is a target binding site found in the 5' untranslated region of mRNA encoded by KIAA1447, corresponding to a target binding site such as BINDING SITE I, BINDING SITE II or BINDING SITE III of FIG. 8. Table 4 illustrates the complementarity of the nucleotide sequences of KIAA1447 BINDING SITE, designated SEQ ID:754, to the nucleotide sequence of GAM94 RNA, herein designated GAM RNA, also designated SEQ ID:332.

Another function of GAM94 is therefore inhibition of KIAA1447 (Accession XP_290770.2). Accordingly, utilities of GAM94 include diagnosis, prevention and treatment of diseases and clinical conditions associated with KIAA1447.

KIAA1550 (Accession XP_039393.3) is another GAM94 target gene, herein designated TARGET GENE. KIAA1550 BINDING SITE is a target binding site found in the 3' untranslated region of mRNA encoded by KIAA1550, corresponding to a target binding site such as BINDING SITE I, BINDING SITE II or BINDING SITE III of FIG. 8. Table 4 illustrates the complementarity of the nucleotide sequences of KIAA1550 BINDING SITE, designated SEQ ID:16791, to the nucleotide sequence of GAM94 RNA, herein designated GAM RNA, also designated SEQ ID:332.

Another function of GAM94 is therefore inhibition of KIAA1550 (Accession XP_039393.3). Accordingly, utilities of GAM94 include diagnosis, prevention and treatment of diseases and clinical conditions associated with KIAA1550.

KIAA1684 (Accession XP_290806.1) is another GAM94 target gene, herein designated TARGET GENE. KIAA1684 BINDING SITE is a target binding site found in the 3' untranslated region of mRNA encoded by KIAA1684, corresponding to a target binding site such as BINDING SITE I, BINDING SITE II or BINDING SITE III of FIG. 8. Table 4 illustrates the complementarity of the nucleotide sequences of KIAA1684 BINDING SITE, designated SEQ ID:14267, to the nucleotide sequence of GAM94 RNA, herein designated GAM RNA, also designated SEQ ID:332.

Another function of GAM94 is therefore inhibition of KIAA1684 (Accession XP_290806.1). Accordingly, utilities of GAM94 include diagnosis, prevention and treatment of diseases and clinical conditions associated with KIAA1684.

KIAA1729 (Accession XP_114418.2) is another GAM94 target gene, herein designated TARGET GENE. KIAA1729 BINDING SITE is a target binding site found in the 3' untranslated region of mRNA encoded by KIAA1729, corresponding to a target binding site such as BINDING SITE I, BINDING SITE II or BINDING SITE III of FIG. 8. Table 4 illustrates the complementarity of the nucleotide sequences of KIAA1729 BINDING SITE, designated SEQ ID:12326, to the nucleotide sequence of GAM94 RNA, herein designated GAM RNA, also designated SEQ ID:332.

Another function of GAM94 is therefore inhibition of KIAA1729 (Accession XP_114418.2). Accordingly, utilities of GAM94 include diagnosis, prevention and treatment of diseases and clinical conditions associated with KIAA1729.

KIAA1731 (Accession XP_290545.1) is another GAM94 target gene, herein designated TARGET GENE. KIAA1731

BINDING SITE is a target binding site found in the 3' untranslated region of mRNA encoded by KIAA1731, corresponding to a target binding site such as BINDING SITE I, BINDING SITE II or BINDING SITE III of FIG. 8. Table 4 illustrates the complementarity of the nucleotide sequences of KIAA1731 BINDING SITE, designated SEQ ID:6800, to the nucleotide sequence of GAM94 RNA, herein designated GAM RNA, also designated SEQ ID:332.

Another function of GAM94 is therefore inhibition of KIAA1731 (Accession XP_290545.1). Accordingly, utilities of GAM94 include diagnosis, prevention and treatment of diseases and clinical conditions associated with KIAA1731.

KIAA1735 (Accession XP_290496.1) is another GAM94 target gene, herein designated TARGET GENE. KIAA1735 BINDING SITE is a target binding site found in the 5' untranslated region of mRNA encoded by KIAA1735, corresponding to a target binding site such as BINDING SITE I, BINDING SITE II or BINDING SITE III of FIG. 8. Table 4 illustrates the complementarity of the nucleotide sequences of KIAA1735 BINDING SITE, designated SEQ ID:12832, to the nucleotide sequence of GAM94 RNA, herein designated GAM RNA, also designated SEQ ID:332.

Another function of GAM94 is therefore inhibition of KIAA1735 (Accession XP_290496.1). Accordingly, utilities of GAM94 include diagnosis, prevention and treatment of diseases and clinical conditions associated with KIAA1735.

KIAA1827 (Accession XP_290834.1) is another GAM94 target gene, herein designated TARGET GENE. KIAA1827 BINDING SITE1 and KIAA1827 BINDING SITE2 are target binding sites found in untranslated regions of mRNA encoded by KIAA1827, corresponding to target binding sites such as BINDING SITE I, BINDING SITE II or BINDING SITE III of FIG. 8. Table 4 illustrates the complementarity of the nucleotide sequences of KIAA1827 BINDING SITE1 and KIAA1827 BINDING SITE2, designated SEQ ID:6984 and SEQ ID:5677 respectively, to the nucleotide sequence of GAM94 RNA, herein designated GAM RNA, also designated SEQ ID:332.

Another function of GAM94 is therefore inhibition of KIAA1827 (Accession XP_290834.1). Accordingly, utilities of GAM94 include diagnosis, prevention and treatment of diseases and clinical conditions associated with KIAA1827.

KIAA1853 (Accession XP_045184.1) is another GAM94 target gene, herein designated TARGET GENE. KIAA1853 BINDING SITE1 and KIAA1853 BINDING SITE2 are target binding sites found in untranslated regions of mRNA encoded by KIAA1853, corresponding to target binding sites such as BINDING SITE I, BINDING SITE II or BINDING SITE III of FIG. 8. Table 4 illustrates the complementarity of the nucleotide sequences of KIAA1853 BINDING SITE1 and KIAA1853 BINDING SITE2, designated SEQ ID:10772 and SEQ ID:4894 respectively, to the nucleotide sequence of GAM94 RNA, herein designated GAM RNA, also designated SEQ ID:332.

Another function of GAM94 is therefore inhibition of KIAA1853 (Accession XP_045184.1). Accordingly, utilities of GAM94 include diagnosis, prevention and treatment of diseases and clinical conditions associated with KIAA1853.

KIAA1870 (Accession NP_115537.1) is another GAM94 target gene, herein designated TARGET GENE. KIAA1870 BINDING SITE is a target binding site found in the 3' untranslated region of multiple transcripts of mRNA encoded by KIAA1870, corresponding to a target binding site such as BINDING SITE I, BINDING SITE II or BINDING SITE III of FIG. 8. Table 4 illustrates the complementarity of the nucleotide sequences of KIAA1870 BINDING SITE, designated SEQ ID:17798, to the nucleotide sequence of GAM94 RNA, herein designated GAM RNA, also designated SEQ ID:332.

Another function of GAM94 is therefore inhibition of KIAA1870 (Accession NP_115537.1). Accordingly, utilities of GAM94 include diagnosis, prevention and treatment of diseases and clinical conditions associated with KIAA1870.

KIAA2001 (Accession XP_291322.1) is another GAM94 target gene, herein designated TARGET GENE. KIAA2001 BINDING SITE1 and KIAA2001 BINDING SITE2 are target binding sites found in untranslated regions of mRNA encoded by KIAA2001, corresponding to target binding sites such as BINDING SITE I, BINDING SITE II or BINDING SITE III of FIG. 8. Table 4 illustrates the complementarity of the nucleotide sequences of KIAA2001 BINDING SITE1 and KIAA2001 BINDING SITE2, designated SEQ ID:3364 and SEQ ID:19659 respectively, to the nucleotide sequence of GAM94 RNA, herein designated GAM RNA, also designated SEQ ID:332.

Another function of GAM94 is therefore inhibition of KIAA2001 (Accession XP_291322.1). Accordingly, utilities of GAM94 include diagnosis, prevention and treatment of diseases and clinical conditions associated with KIAA2001.

KR18 (Accession NP_150630.1) is another GAM94 target gene, herein designated TARGET GENE. KR18 BINDING SITE1 through KR18 BINDING SITE3 are target binding sites found in untranslated regions of mRNA encoded by KR18, corresponding to target binding sites such as BINDING SITE I, BINDING SITE II or BINDING SITE III of FIG. 8. Table 4 illustrates the complementarity of the nucleotide sequences of KR18 BINDING SITE1 through KR18 BINDING SITE3, designated SEQ ID:8750, SEQ ID:16888 and SEQ ID:5169 respectively, to the nucleotide sequence of GAM94 RNA, herein designated GAM RNA, also designated SEQ ID:332.

Another function of GAM94 is therefore inhibition of KR18 (Accession NP_150630.1). Accordingly, utilities of GAM94 include diagnosis, prevention and treatment of diseases and clinical conditions associated with KR18.

LANO (Accession NP_060684.1) is another GAM94 target gene, herein designated TARGET GENE. LANO BINDING SITE is a target binding site found in the 3' untranslated region of multiple transcripts of mRNA encoded by LANO, corresponding to a target binding site such as BINDING SITE I, BINDING SITE II or BINDING SITE III of FIG. 8. Table 4 illustrates the complementarity of the nucleotide sequences of LANO BINDING SITE, designated SEQ ID:2628, to the nucleotide sequence of GAM94 RNA, herein designated GAM RNA, also designated SEQ ID:332.

Another function of GAM94 is therefore inhibition of LANO (Accession NP_060684.1). Accordingly, utilities of GAM94 include diagnosis, prevention and treatment of diseases and clinical conditions associated with LANO.

Lag1 longevity assurance homolog 2 (s. cerevisiae) (LASS2, Accession NP_037516.2) is another GAM94 target gene, herein designated TARGET GENE. LASS2 BINDING SITE is a target binding site found in the 3' untranslated region of multiple transcripts of mRNA encoded by LASS2, corresponding to a target binding site such as BINDING SITE I, BINDING SITE II or BINDING SITE III of FIG. 8. Table 4 illustrates the complementarity of the nucleotide sequences of LASS2 BINDING SITE, designated SEQ ID:1787, to the nucleotide sequence of GAM94 RNA, herein designated GAM RNA, also designated SEQ ID:332.

Another function of GAM94 is therefore inhibition of Lag1 longevity assurance homolog 2 (s. cerevisiae) (LASS2, Accession NP_037516.2). Accordingly, utilities of GAM94 include diagnosis, prevention and treatment of diseases and clinical conditions associated with LASS2.

Leptin (obesity homolog, mouse) (LEP, Accession NP_000221.1) is another GAM94 target gene, herein designated TARGET GENE. LEP BINDING SITE is a target binding site found in the 3' untranslated region of mRNA encoded by LEP, corresponding to a target binding site such as BINDING SITE I, BINDING SITE II or BINDING SITE III of FIG. 8. Table 4 illustrates the complementarity of the nucleotide sequences of LEP BINDING SITE, designated SEQ ID:8384, to the nucleotide sequence of GAM94 RNA, herein designated GAM RNA, also designated SEQ ID:332.

Another function of GAM94 is therefore inhibition of Leptin (obesity homolog, mouse) (LEP, Accession NP_000221.1). Accordingly, utilities of GAM94 include diagnosis, prevention and treatment of diseases and clinical conditions associated with LEP.

Leucine-rich repeat lgi family, member 4 (LGI4, Accession NP_644813.1) is another GAM94 target gene, herein designated TARGET GENE. LGI4 BINDING SITE is a target binding site found in the 5' untranslated region of mRNA encoded by LGI4, corresponding to a target binding site such as BINDING SITE I, BINDING SITE II or BINDING SITE III of FIG. 8. Table 4 illustrates the complementarity of the nucleotide sequences of LGI4 BINDING SITE, designated SEQ ID:18376, to the nucleotide sequence of GAM94 RNA, herein designated GAM RNA, also designated SEQ ID:332.

Another function of GAM94 is therefore inhibition of Leucine-rich repeat lgi family, member 4 (LGI4, Accession NP_644813.1). Accordingly, utilities of GAM94 include diagnosis, prevention and treatment of diseases and clinical conditions associated with LGI4.

Leukemia inhibitory factor (cholinergic differentiation factor) (LIF, Accession NP_002300.1) is another GAM94 target gene, herein designated TARGET GENE. LIF BINDING SITE is a target binding site found in the 3' untranslated region of mRNA encoded by LIF, corresponding to a target binding site such as BINDING SITE I, BINDING SITE II or BINDING SITE III of FIG. 8. Table 4 illustrates the complementarity of the nucleotide sequences of LIF BINDING SITE, designated SEQ ID:7255, to the nucleotide sequence of GAM94 RNA, herein designated GAM RNA, also designated SEQ ID:332.

Another function of GAM94 is therefore inhibition of Leukemia inhibitory factor (cholinergic differentiation factor) (LIF, Accession NP_002300.1). Accordingly, utilities of GAM94 include diagnosis, prevention and treatment of diseases and clinical conditions associated with LIF.

Leukocyte immunoglobulin-like receptor, subfamily b (with tm and itim domains), member 1 (LILRB1, Accession NP_006660.1) is another GAM94 target gene, herein designated TARGET GENE. LILRB1 BINDING SITE is a target binding site found in the 5' untranslated region of mRNA encoded by LILRB1, corresponding to a target binding site such as BINDING SITE I, BINDING SITE II or BINDING SITE III of FIG. 8. Table 4 illustrates the complementarity of the nucleotide sequences of LILRB1 BINDING SITE, designated SEQ ID:9402, to the nucleotide sequence of GAM94 RNA, herein designated GAM RNA, also designated SEQ ID:332.

Another function of GAM94 is therefore inhibition of Leukocyte immunoglobulin-like receptor, subfamily b (with tm and itim domains), member 1 (LILRB1, Accession NP_006660.1). Accordingly, utilities of GAM94 include diagnosis, prevention and treatment of diseases and clinical conditions associated with LILRB1.

Lim domains containing 1 (LIMD1, Accession NP_055055.1) is another GAM94 target gene, herein designated TARGET GENE. LIMD1 BINDING SITE is a target binding site found in the 3' untranslated region of mRNA encoded by LIMD1, corresponding to a target binding site such as BINDING SITE I, BINDING SITE II or BINDING SITE III of FIG. 8. Table 4 illustrates the complementarity of the nucleotide sequences of LIMD1 BINDING SITE, designated SEQ ID:573, to the nucleotide sequence of GAM94 RNA, herein designated GAM RNA, also designated SEQ ID:332.

Another function of GAM94 is therefore inhibition of Lim domains containing 1 (LIMD1, Accession NP_055055.1). Accordingly, utilities of GAM94 include diagnosis, prevention and treatment of diseases and clinical conditions associated with LIMD1.

Lipase, member h (LIPH, Accession NP_640341.1) is another GAM94 target gene, herein designated TARGET GENE. LIPH BINDING SITE is a target binding site found in the 3' untranslated region of mRNA encoded by LIPH, corresponding to a target binding site such as BINDING SITE I, BINDING SITE II or BINDING SITE III of FIG. 8. Table 4 illustrates the complementarity of the nucleotide sequences of LIPH BINDING SITE, designated SEQ ID:6330, to the nucleotide sequence of GAM94 RNA, herein designated GAM RNA, also designated SEQ ID:332.

Another function of GAM94 is therefore inhibition of Lipase, member h (LIPH, Accession NP_640341.1). Accordingly, utilities of GAM94 include diagnosis, prevention and treatment of diseases and clinical conditions associated with LIPH.

Lim domain only 7 (LMO7, Accession NP_056668.1) is another GAM94 target gene, herein designated TARGET GENE. LMO7 BINDING SITE is a target binding site found in the 5' untranslated region of multiple transcripts of mRNA encoded by LMO7, corresponding to a target binding site such as BINDING SITE I, BINDING SITE II or BINDING SITE III of FIG. 8. Table 4 illustrates the complementarity of the nucleotide sequences of LMO7 BINDING SITE, designated SEQ ID:2940, to the nucleotide sequence of GAM94 RNA, herein designated GAM RNA, also designated SEQ ID:332.

Another function of GAM94 is therefore inhibition of Lim domain only 7 (LMO7, Accession NP_056668.1). Accordingly, utilities of GAM94 include diagnosis, prevention and treatment of diseases and clinical conditions associated with LMO7.

Lim domain only 7 (LMO7, Accession NP_056667.1) is another GAM94 target gene, herein designated TARGET GENE. LMO7 BINDING SITE is a target binding site found in the 5' untranslated region of multiple transcripts of mRNA encoded by LMO7, corresponding to a target binding site such as BINDING SITE I, BINDING SITE II or BINDING SITE III of FIG. 8. Table 4 illustrates the complementarity of the nucleotide sequences of LMO7 BINDING SITE, designated SEQ ID:2940, to the nucleotide sequence of GAM94 RNA, herein designated GAM RNA, also designated SEQ ID:332.

Another function of GAM94 is therefore inhibition of Lim domain only 7 (LMO7, Accession NP_056667.1). Accordingly, utilities of GAM94 include diagnosis, prevention and treatment of diseases and clinical conditions associated with LMO7.

Lim domain only 7 (LMO7, Accession NP_005349.2) is another GAM94 target gene, herein designated TARGET GENE. LMO7 BINDING SITE is a target binding site found in the 5' untranslated region of multiple transcripts of mRNA encoded by LMO7, corresponding to a target binding site such as BINDING SITE I, BINDING SITE II or BINDING SITE III of FIG. 8. Table 4 illustrates the complementarity of the nucleotide sequences of LMO7 BINDING SITE, designated SEQ ID:2940, to the nucleotide sequence of GAM94 RNA, herein designated GAM RNA, also designated SEQ ID:332.

Another function of GAM94 is therefore inhibition of Lim domain only 7 (LMO7, Accession NP_005349.2). Accordingly, utilities of GAM94 include diagnosis, prevention and treatment of diseases and clinical conditions associated with LMO7.

Leiomodin 3 (fetal) (LMOD3, Accession XP_067529.3) is another GAM94 target gene, herein designated TARGET GENE. LMOD3 BINDING SITE is a target binding site found in the 3' untranslated region of mRNA encoded by LMOD3, corresponding to a target binding site such as BINDING SITE I, BINDING SITE II or BINDING SITE III of FIG. 8. Table 4 illustrates the complementarity of the nucleotide sequences of LMOD3 BINDING SITE, designated SEQ ID:4830, to the nucleotide sequence of GAM94 RNA, herein designated GAM RNA, also designated SEQ ID:332.

Another function of GAM94 is therefore inhibition of Leiomodin 3 (fetal) (LMOD3, Accession XP_067529.3). Accordingly, utilities of GAM94 include diagnosis, prevention and treatment of diseases and clinical conditions associated with LMOD3.

LOC114971 (Accession XP_054936.4) is another GAM94 target gene, herein designated TARGET GENE. LOC114971 BINDING SITE is a target binding site found in the 3' untranslated region of mRNA encoded by LOC114971, corresponding to a target binding site such as BINDING SITE I, BINDING SITE II or BINDING SITE III of FIG. 8. Table 4 illustrates the complementarity of the nucleotide sequences of LOC114971 BINDING SITE, designated SEQ ID:3594, to the nucleotide sequence of GAM94 RNA, herein designated GAM RNA, also designated SEQ ID:332.

Another function of GAM94 is therefore inhibition of LOC114971 (Accession XP_054936.4). Accordingly, utilities of GAM94 include diagnosis, prevention and treatment of diseases and clinical conditions associated with LOC114971.

LOC116071 (Accession NP_612465.2) is another GAM94 target gene, herein designated TARGET GENE. LOC116071 BINDING SITE is a target binding site found in the 5' untranslated region of mRNA encoded by LOC116071, corresponding to a target binding site such as BINDING SITE I, BINDING SITE II or BINDING SITE III of FIG. 8. Table 4 illustrates the complementarity of the nucleotide sequences of LOC116071 BINDING SITE, designated SEQ ID:6765, to the nucleotide sequence of GAM94 RNA, herein designated GAM RNA, also designated SEQ ID:332.

Another function of GAM94 is therefore inhibition of LOC116071 (Accession NP_612465.2). Accordingly, utilities of GAM94 include diagnosis, prevention and treatment of diseases and clinical conditions associated with LOC116071.

LOC123264 (Accession XP_058693.1) is another GAM94 target gene, herein designated TARGET GENE. LOC123264 BINDING SITE is a target binding site found in the 5' untranslated region of mRNA encoded by LOC123264, corresponding to a target binding site such as BINDING SITE I, BINDING SITE II or BINDING SITE III of FIG. 8. Table 4 illustrates the complementarity of the nucleotide sequences of LOC123264 BINDING SITE, designated SEQ ID:9559, to the nucleotide sequence of GAM94 RNA, herein designated GAM RNA, also designated SEQ ID:332.

Another function of GAM94 is therefore inhibition of LOC123264 (Accession XP_058693.1). Accordingly, utilities of GAM94 include diagnosis, prevention and treatment of diseases and clinical conditions associated with LOC123264.

LOC123397 (Accession XP_063630.4) is another GAM94 target gene, herein designated TARGET GENE. LOC123397 BINDING SITE is a target binding site found in the 5' untranslated region of mRNA encoded by LOC123397, corresponding to a target binding site such as BINDING SITE I, BINDING SITE II or BINDING SITE III of FIG. 8. Table 4 illustrates the complementarity of the nucleotide sequences of LOC123397 BINDING SITE, designated SEQ ID:8234, to the nucleotide sequence of GAM94 RNA, herein designated GAM RNA, also designated SEQ ID:332.

Another function of GAM94 is therefore inhibition of LOC123397 (Accession XP_063630.4). Accordingly, utilities of GAM94 include diagnosis, prevention and treatment of diseases and clinical conditions associated with LOC123397.

LOC123876 (Accession XP_058743.4) is another GAM94 target gene, herein designated TARGET GENE. LOC123876 BINDING SITE is a target binding site found in the 3' untranslated region of mRNA encoded by LOC123876, corresponding to a target binding site such as BINDING SITE I, BINDING SITE II or BINDING SITE III of FIG. 8. Table 4 illustrates the complementarity of the nucleotide sequences of LOC123876 BINDING SITE, designated SEQ ID:15004, to the nucleotide sequence of GAM94 RNA, herein designated GAM RNA, also designated SEQ ID:332.

Another function of GAM94 is therefore inhibition of LOC123876 (Accession XP_058743.4). Accordingly, utilities of GAM94 include diagnosis, prevention and treatment of diseases and clinical conditions associated with LOC123876.

LOC126782 (Accession XP_059080.1) is another GAM94 target gene, herein designated TARGET GENE. LOC126782 BINDING SITE is a target binding site found in the 3' untranslated region of mRNA encoded by LOC126782, corresponding to a target binding site such as BINDING SITE I, BINDING SITE II or BINDING SITE III of FIG. 8. Table 4 illustrates the complementarity of the nucleotide sequences of LOC126782 BINDING SITE, designated SEQ ID:8295, to the nucleotide sequence of GAM94 RNA, herein designated GAM RNA, also designated SEQ ID:332.

Another function of GAM94 is therefore inhibition of LOC126782 (Accession XP_059080.1). Accordingly, utilities of GAM94 include diagnosis, prevention and treatment of diseases and clinical conditions associated with LOC126782.

LOC131963 (Accession XP_067689.1) is another GAM94 target gene, herein designated TARGET GENE. LOC131963 BINDING SITE is a target binding site found in the 3' untranslated region of mRNA encoded by LOC131963, corresponding to a target binding site such as BINDING SITE I, BINDING SITE II or BINDING SITE III of FIG. 8. Table 4 illustrates the complementarity of the nucleotide sequences of LOC131963 BINDING SITE, designated SEQ ID:13672, to the nucleotide sequence of GAM94 RNA, herein designated GAM RNA, also designated SEQ ID:332.

Another function of GAM94 is therefore inhibition of LOC131963 (Accession XP_067689.1). Accordingly, utilities of GAM94 include diagnosis, prevention and treatment of diseases and clinical conditions associated with LOC131963.

LOC135293 (Accession XP_072402.4) is another GAM94 target gene, herein designated TARGET GENE. LOC135293 BINDING SITE is a target binding site found in the 3' untranslated region of mRNA encoded by LOC135293, corresponding to a target binding site such as BINDING SITE I, BINDING SITE II or BINDING SITE III of FIG. 8. Table 4 illustrates the complementarity of the nucleotide sequences of LOC135293 BINDING SITE, designated SEQ ID:6631, to the nucleotide sequence of GAM94 RNA, herein designated GAM RNA, also designated SEQ ID:332.

Another function of GAM94 is therefore inhibition of LOC135293 (Accession XP_072402.4). Accordingly, utilities of GAM94 include diagnosis, prevention and treatment of diseases and clinical conditions associated with LOC135293.

LOC135818 (Accession XP_059804.4) is another GAM94 target gene, herein designated TARGET GENE. LOC135818 BINDING SITE is a target binding site found in the 5' untranslated region of mRNA encoded by LOC135818, corresponding to a target binding site such as BINDING SITE I, BINDING SITE II or BINDING SITE III of FIG. 8. Table 4 illustrates the complementarity of the nucleotide sequences of LOC135818 BINDING SITE, designated SEQ ID:7298, to the nucleotide sequence of GAM94 RNA, herein designated GAM RNA, also designated SEQ ID:332.

Another function of GAM94 is therefore inhibition of LOC135818 (Accession XP_059804.4). Accordingly, utilities of GAM94 include diagnosis, prevention and treatment of diseases and clinical conditions associated with LOC135818.

LOC136345 (Accession XP_072455.2) is another GAM94 target gene, herein designated TARGET GENE. LOC136345 BINDING SITE is a target binding site found in the 5' untranslated region of mRNA encoded by LOC136345, corresponding to a target binding site such as BINDING SITE I, BINDING SITE II or BINDING SITE III of FIG. 8. Table 4 illustrates the complementarity of the nucleotide sequences of LOC136345 BINDING SITE, designated SEQ ID:6912, to the nucleotide sequence of GAM94 RNA, herein designated GAM RNA, also designated SEQ ID:332.

Another function of GAM94 is therefore inhibition of LOC136345 (Accession XP_072455.2). Accordingly, utilities of GAM94 include diagnosis, prevention and treatment of diseases and clinical conditions associated with LOC136345.

LOC143146 (Accession XP_011844.4) is another GAM94 target gene, herein designated TARGET GENE. LOC143146 BINDING SITE is a target binding site found in the 5' untranslated region of mRNA encoded by LOC143146, corresponding to a target binding site such as BINDING SITE I, BINDING SITE II or BINDING SITE III of FIG. 8. Table 4 illustrates the complementarity of the nucleotide sequences of LOC143146 BINDING SITE, designated SEQ ID:12827, to the nucleotide sequence of GAM94 RNA, herein designated GAM RNA, also designated SEQ ID:332.

Another function of GAM94 is therefore inhibition of LOC143146 (Accession XP_011844.4). Accordingly, utilities of GAM94 include diagnosis, prevention and treatment of diseases and clinical conditions associated with LOC143146.

LOC143310 (Accession XP_084485.1) is another GAM94 target gene, herein designated TARGET GENE. LOC143310 BINDING SITE is a target binding site found in the 3' untranslated region of mRNA encoded by LOC143310, corresponding to a target binding site such as BINDING SITE I, BINDING SITE II or BINDING SITE III of FIG. 8. Table 4 illustrates the complementarity of the nucleotide sequences of LOC143310 BINDING SITE, designated SEQ ID:16252, to the nucleotide sequence of GAM94 RNA, herein designated GAM RNA, also designated SEQ ID:332.

Another function of GAM94 is therefore inhibition of LOC143310 (Accession XP_084485.1). Accordingly, utilities of GAM94 include diagnosis, prevention and treatment of diseases and clinical conditions associated with LOC143310.

LOC143381 (Accession XP_084501.1) is another GAM94 target gene, herein designated TARGET GENE. LOC143381 BINDING SITE is a target binding site found in the 3' untranslated region of mRNA encoded by LOC143381, corresponding to a target binding site such as BINDING SITE I, BINDING SITE II or BINDING SITE III of FIG. 8. Table 4 illustrates the complementarity of the nucleotide sequences of LOC143381 BINDING SITE, designated SEQ ID:11353, to the nucleotide sequence of GAM94 RNA, herein designated GAM RNA, also designated SEQ ID:332.

Another function of GAM94 is therefore inhibition of LOC143381 (Accession XP_084501.1). Accordingly, utilities of GAM94 include diagnosis, prevention and treatment of diseases and clinical conditions associated with LOC143381.

LOC144147 (Accession XP_049879.1) is another GAM94 target gene, herein designated TARGET GENE. LOC144147 BINDING SITE is a target binding site found in the 3' untranslated region of mRNA encoded by LOC144147, corresponding to a target binding site such as BINDING SITE I, BINDING SITE II or BINDING SITE III of FIG. 8. Table 4 illustrates the complementarity of the nucleotide sequences of LOC144147 BINDING SITE, designated SEQ ID:16427, to the nucleotide sequence of GAM94 RNA, herein designated GAM RNA, also designated SEQ ID:332.

Another function of GAM94 is therefore inhibition of LOC144147 (Accession XP_049879.1). Accordingly, utilities of GAM94 include diagnosis, prevention and treatment of diseases and clinical conditions associated with LOC144147.

LOC144698 (Accession XP_084939.1) is another GAM94 target gene, herein designated TARGET GENE. LOC144698 BINDING SITE is a target binding site found in the 5' untranslated region of mRNA encoded by LOC144698, corresponding to a target binding site such as BINDING SITE I, BINDING SITE II or BINDING SITE III of FIG. 8. Table 4 illustrates the complementarity of the nucleotide sequences of LOC144698 BINDING SITE, designated SEQ ID:11632, to the nucleotide sequence of GAM94 RNA, herein designated GAM RNA, also designated SEQ ID:332.

Another function of GAM94 is therefore inhibition of LOC144698 (Accession XP_084939.1). Accordingly, utilities of GAM94 include diagnosis, prevention and treatment of diseases and clinical conditions associated with LOC144698.

LOC144776 (Accession XP_084964.1) is another GAM94 target gene, herein designated TARGET GENE. LOC144776 BINDING SITE is a target binding site found in the 3' untranslated region of mRNA encoded by LOC144776, corresponding to a target binding site such as BINDING SITE I, BINDING SITE II or BINDING SITE III of FIG. 8. Table 4 illustrates the complementarity of the nucleotide sequences of LOC144776 BINDING SITE, designated SEQ ID:15562, to the nucleotide sequence of GAM94 RNA, herein designated GAM RNA, also designated SEQ ID:332.

Another function of GAM94 is therefore inhibition of LOC144776 (Accession XP_084964.1). Accordingly, utilities of GAM94 include diagnosis, prevention and treatment of diseases and clinical conditions associated with LOC144776.

LOC145844 (Accession XP_085255.1) is another GAM94 target gene, herein designated TARGET GENE. LOC145844 BINDING SITE is a target binding site found in the 3' untranslated region of mRNA encoded by LOC145844, corresponding to a target binding site such as BINDING SITE I, BINDING SITE II or BINDING SITE III of FIG. 8. Table 4 illustrates the complementarity of the nucleotide sequences of LOC145844 BINDING SITE, designated SEQ ID:10944, to the nucleotide sequence of GAM94 RNA, herein designated GAM RNA, also designated SEQ ID:332.

Another function of GAM94 is therefore inhibition of LOC145844 (Accession XP_085255.1). Accordingly, utilities of GAM94 include diagnosis, prevention and treatment of diseases and clinical conditions associated with LOC145844.

LOC146488 (Accession XP_047748.5) is another GAM94 target gene, herein designated TARGET GENE. LOC146488 BINDING SITE is a target binding site found in the 3' untranslated region of mRNA encoded by LOC146488, corresponding to a target binding site such as BINDING SITE I, BINDING SITE II or BINDING SITE III of FIG. 8. Table 4 illustrates the complementarity of the nucleotide sequences of LOC146488 BINDING SITE, designated SEQ ID:4919, to the nucleotide sequence of GAM94 RNA, herein designated GAM RNA, also designated SEQ ID:332.

Another function of GAM94 is therefore inhibition of LOC146488 (Accession XP_047748.5). Accordingly, utilities of GAM94 include diagnosis, prevention and treatment of diseases and clinical conditions associated with LOC146488.

LOC146520 (Accession XP_085492.1) is another GAM94 target gene, herein designated TARGET GENE. LOC146520 BINDING SITE is a target binding site found in the 3' untranslated region of mRNA encoded by LOC146520, corresponding to a target binding site such as BINDING SITE I, BINDING SITE II or BINDING SITE III of FIG. 8. Table 4 illustrates the complementarity of the nucleotide sequences of LOC146520 BINDING SITE, designated SEQ ID:19003, to the nucleotide sequence of GAM94 RNA, herein designated GAM RNA, also designated SEQ ID:332.

Another function of GAM94 is therefore inhibition of LOC146520 (Accession XP_085492.1). Accordingly, utilities of GAM94 include diagnosis, prevention and treatment of diseases and clinical conditions associated with LOC146520.

LOC146713 (Accession XP_097071.2) is another GAM94 target gene, herein designated TARGET GENE. LOC146713 BINDING SITE is a target binding site found in the 3' untranslated region of mRNA encoded by LOC146713, corresponding to a target binding site such as BINDING SITE I, BINDING SITE II or BINDING SITE III of FIG. 8. Table 4 illustrates the complementarity of the nucleotide sequences of LOC146713 BINDING SITE, designated SEQ ID:5569, to the nucleotide sequence of GAM94 RNA, herein designated GAM RNA, also designated SEQ ID:332.

Another function of GAM94 is therefore inhibition of LOC146713 (Accession XP_097071.2). Accordingly, utilities of GAM94 include diagnosis, prevention and treatment of diseases and clinical conditions associated with LOC146713.

LOC146894 (Accession NP_660316.1) is another GAM94 target gene, herein designated TARGET GENE. LOC146894 BINDING SITE1 and LOC146894 BINDING SITE2 are target binding sites found in untranslated regions of mRNA encoded by LOC146894, corresponding to target binding sites such as BINDING SITE I, BINDING SITE II or BINDING SITE III of FIG. 8. Table 4 illustrates the complementarity of the nucleotide sequences of LOC146894 BINDING SITE1 and LOC146894 BINDING SITE2, designated SEQ ID:17315 and SEQ ID:1807 respectively, to the nucleotide sequence of GAM94 RNA, herein designated GAM RNA, also designated SEQ ID:332.

Another function of GAM94 is therefore inhibition of LOC146894 (Accession NP_660316.1). Accordingly, utilities of GAM94 include diagnosis, prevention and treatment of diseases and clinical conditions associated with LOC146894.

LOC146953 (Accession XP_085659.2) is another GAM94 target gene, herein designated TARGET GENE. LOC146953 BINDING SITE is a target binding site found in the 5' untranslated region of mRNA encoded by LOC146953, corresponding to a target binding site such as BINDING SITE I, BINDING SITE II or BINDING SITE III of FIG. 8. Table 4 illustrates the complementarity of the nucleotide sequences of LOC146953 BINDING SITE, designated SEQ ID:8227, to the nucleotide sequence of GAM94 RNA, herein designated GAM RNA, also designated SEQ ID:332.

Another function of GAM94 is therefore inhibition of LOC146953 (Accession XP_085659.2). Accordingly, utilities of GAM94 include diagnosis, prevention and treatment of diseases and clinical conditions associated with LOC146953.

LOC147658 (Accession XP_085827.1) is another GAM94 target gene, herein designated TARGET GENE. LOC147658 BINDING SITE1 and LOC147658 BINDING SITE2 are target binding sites found in untranslated regions of mRNA encoded by LOC147658, corresponding to target binding sites such as BINDING SITE I, BINDING SITE II or BINDING SITE III of FIG. 8. Table 4 illustrates the complementarity of the nucleotide sequences of LOC147658 BINDING SITE1 and LOC147658 BINDING SITE2, designated SEQ ID:5048 and SEQ ID:3916 respectively, to the nucleotide sequence of GAM94 RNA, herein designated GAM RNA, also designated SEQ ID:332.

Another function of GAM94 is therefore inhibition of LOC147658 (Accession XP_085827.1). Accordingly, utilities of GAM94 include diagnosis, prevention and treatment of diseases and clinical conditions associated with LOC147658.

LOC148166 (Accession XP_086077.1) is another GAM94 target gene, herein designated TARGET GENE. LOC148166 BINDING SITE is a target binding site found in the 5' untranslated region of mRNA encoded by LOC148166, corresponding to a target binding site such as BINDING SITE I, BINDING SITE II or BINDING SITE III of FIG. 8. Table 4 illustrates the complementarity of the nucleotide sequences of LOC148166 BINDING SITE, designated SEQ ID:5237, to the nucleotide sequence of GAM94 RNA, herein designated GAM RNA, also designated SEQ ID:332.

Another function of GAM94 is therefore inhibition of LOC148166 (Accession XP_086077.1). Accordingly, utilities of GAM94 include diagnosis, prevention and treatment of diseases and clinical conditions associated with LOC148166.

LOC148756 (Accession XP_097516.1) is another GAM94 target gene, herein designated TARGET GENE. LOC148756 BINDING SITE is a target binding site found in the 5' untranslated region of mRNA encoded by LOC148756, corresponding to a target binding site such as BINDING SITE I, BINDING SITE II or BINDING SITE III of FIG. 8. Table 4 illustrates the complementarity of the nucleotide sequences of LOC148756 BINDING SITE, designated SEQ ID:16045, to the nucleotide sequence of GAM94 RNA, herein designated GAM RNA, also designated SEQ ID:332.

Another function of GAM94 is therefore inhibition of LOC148756 (Accession XP_097516.1). Accordingly, utilities of GAM94 include diagnosis, prevention and treatment of diseases and clinical conditions associated with LOC148756.

LOC149271 (Accession XP_086475.1) is another GAM94 target gene, herein designated TARGET GENE. LOC149271 BINDING SITE1 and LOC149271 BINDING SITE2 are target binding sites found in untranslated regions of mRNA encoded by LOC149271, corresponding to target binding sites such as BINDING SITE I, BINDING SITE II or BINDING SITE III of FIG. 8. Table 4 illustrates the complementarity of the nucleotide sequences of LOC149271 BINDING SITE1 and LOC149271 BINDING SITE2, designated SEQ ID:3067 and SEQ ID:8920 respectively, to the nucleotide sequence of GAM94 RNA, herein designated GAM RNA, also designated SEQ ID:332.

Another function of GAM94 is therefore inhibition of LOC149271 (Accession XP_086475.1). Accordingly, utilities of GAM94 include diagnosis, prevention and treatment of diseases and clinical conditions associated with LOC149271.

LOC149606 (Accession XP_086600.1) is another GAM94 target gene, herein designated TARGET GENE. LOC149606 BINDING SITE is a target binding site found in the 3' untranslated region of mRNA encoded by LOC149606, corresponding to a target binding site such as BINDING SITE I, BINDING SITE II or BINDING SITE III of FIG. 8. Table 4 illustrates the complementarity of the nucleotide sequences of LOC149606 BINDING SITE, designated SEQ ID:3591, to the nucleotide sequence of GAM94 RNA, herein designated GAM RNA, also designated SEQ ID:332.

Another function of GAM94 is therefore inhibition of LOC149606 (Accession XP_086600.1). Accordingly, utilities of GAM94 include diagnosis, prevention and treatment of diseases and clinical conditions associated with LOC149606.

LOC150862 (Accession XP_087029.1) is another GAM94 target gene, herein designated TARGET GENE. LOC150862 BINDING SITE is a target binding site found in the 5' untranslated region of mRNA encoded by LOC150862, corresponding to a target binding site such as BINDING SITE I, BINDING SITE II or BINDING SITE III of FIG. 8. Table 4 illustrates the complementarity of the nucleotide sequences of LOC150862 BINDING SITE, designated SEQ ID:11883, to the nucleotide sequence of GAM94 RNA, herein designated GAM RNA, also designated SEQ ID:332.

Another function of GAM94 is therefore inhibition of LOC150862 (Accession XP_087029.1). Accordingly, utilities of GAM94 include diagnosis, prevention and treatment of diseases and clinical conditions associated with LOC150862.

LOC151623 (Accession XP_098096.5) is another GAM94 target gene, herein designated TARGET GENE. LOC151623 BINDING SITE is a target binding site found in the 5' untranslated region of mRNA encoded by LOC151623, corresponding to a target binding site such as BINDING SITE I, BINDING SITE II or BINDING SITE III of FIG. 8. Table 4 illustrates the complementarity of the nucleotide sequences of LOC151623 BINDING SITE, designated SEQ ID:11767, to the nucleotide sequence of GAM94 RNA, herein designated GAM RNA, also designated SEQ ID:332.

Another function of GAM94 is therefore inhibition of LOC151623 (Accession XP_098096.5). Accordingly, utilities of GAM94 include diagnosis, prevention and treatment of diseases and clinical conditions associated with LOC151623.

LOC151871 (Accession NP_620170.1) is another GAM94 target gene, herein designated TARGET GENE. LOC151871 BINDING SITE is a target binding site found in the 3' untranslated region of mRNA encoded by LOC151871, corresponding to a target binding site such as BINDING SITE I, BINDING SITE II or BINDING SITE III of FIG. 8. Table 4 illustrates the complementarity of the nucleotide sequences of LOC151871 BINDING SITE, designated SEQ ID:1818, to the nucleotide sequence of GAM94 RNA, herein designated GAM RNA, also designated SEQ ID:332.

Another function of GAM94 is therefore inhibition of LOC151871 (Accession NP_620170.1). Accordingly, utilities of GAM94 include diagnosis, prevention and treatment of diseases and clinical conditions associated with LOC151871.

LOC152922 (Accession XP_094100.4) is another GAM94 target gene, herein designated TARGET GENE. LOC152922 BINDING SITE is a target binding site found in the 5' untranslated region of mRNA encoded by LOC152922, corresponding to a target binding site such as BINDING SITE I, BINDING SITE II or BINDING SITE III of FIG. 8. Table 4 illustrates the complementarity of the nucleotide sequences of LOC152922 BINDING SITE, designated SEQ ID:6972, to the nucleotide sequence of GAM94 RNA, herein designated GAM RNA, also designated SEQ ID:332.

Another function of GAM94 is therefore inhibition of LOC152922 (Accession XP_094100.4). Accordingly, utilities of GAM94 include diagnosis, prevention and treatment of diseases and clinical conditions associated with LOC152922.

LOC152924 (Accession XP_087560.1) is another GAM94 target gene, herein designated TARGET GENE. LOC152924 BINDING SITE is a target binding site found in the 3' untranslated region of mRNA encoded by LOC152924, corresponding to a target binding site such as BINDING SITE I, BINDING SITE II or BINDING SITE III of FIG. 8. Table 4 illustrates the complementarity of the nucleotide sequences of LOC152924 BINDING SITE, designated SEQ ID:17739, to the nucleotide sequence of GAM94 RNA, herein designated GAM RNA, also designated SEQ ID:332.

Another function of GAM94 is therefore inhibition of LOC152924 (Accession XP_087560.1). Accordingly, utilities of GAM94 include diagnosis, prevention and treatment of diseases and clinical conditions associated with LOC152924.

LOC155081 (Accession XP_088145.2) is another GAM94 target gene, herein designated TARGET GENE. LOC155081 BINDING SITE is a target binding site found in the 5' untranslated region of mRNA encoded by LOC155081, corresponding to a target binding site such as BINDING SITE I, BINDING SITE II or BINDING SITE III of FIG. 8. Table 4 illustrates the complementarity of the nucleotide sequences of LOC155081 BINDING SITE, designated SEQ ID:1346, to the nucleotide sequence of GAM94 RNA, herein designated GAM RNA, also designated SEQ ID:332.

Another function of GAM94 is therefore inhibition of LOC155081 (Accession XP_088145.2). Accordingly, utilities of GAM94 include diagnosis, prevention and treatment of diseases and clinical conditions associated with LOC155081.

LOC157273 (Accession XP_098743.1) is another GAM94 target gene, herein designated TARGET GENE.

LOC157273 BINDING SITE is a target binding site found in the 5' untranslated region of mRNA encoded by LOC157273, corresponding to a target binding site such as BINDING SITE I, BINDING SITE II or BINDING SITE III of FIG. 8. Table 4 illustrates the complementarity of the nucleotide sequences of LOC157273 BINDING SITE, designated SEQ ID:12456, to the nucleotide sequence of GAM94 RNA, herein designated GAM RNA, also designated SEQ ID:332.

Another function of GAM94 is therefore inhibition of LOC157273 (Accession XP_098743.1). Accordingly, utilities of GAM94 include diagnosis, prevention and treatment of diseases and clinical conditions associated with LOC157273.

LOC157376 (Accession XP_088301.1) is another GAM94 target gene, herein designated TARGET GENE. LOC157376 BINDING SITE is a target binding site found in the 3' untranslated region of mRNA encoded by LOC157376, corresponding to a target binding site such as BINDING SITE I, BINDING SITE II or BINDING SITE III of FIG. 8. Table 4 illustrates the complementarity of the nucleotide sequences of LOC157376 BINDING SITE, designated SEQ ID:16253, to the nucleotide sequence of GAM94 RNA, herein designated GAM RNA, also designated SEQ ID:332.

Another function of GAM94 is therefore inhibition of LOC157376 (Accession XP_088301.1). Accordingly, utilities of GAM94 include diagnosis, prevention and treatment of diseases and clinical conditions associated with LOC157376.

LOC157858 (Accession XP_098833.2) is another GAM94 target gene, herein designated TARGET GENE. LOC157858 BINDING SITE1 and LOC157858 BINDING SITE2 are target binding sites found in untranslated regions of mRNA encoded by LOC157858, corresponding to target binding sites such as BINDING SITE I, BINDING SITE II or BINDING SITE III of FIG. 8. Table 4 illustrates the complementarity of the nucleotide sequences of LOC157858 BINDING SITE1 and LOC157858 BINDING SITE2, designated SEQ ID:19502 and SEQ ID:3986 respectively, to the nucleotide sequence of GAM94 RNA, herein designated GAM RNA, also designated SEQ ID:332.

Another function of GAM94 is therefore inhibition of LOC157858 (Accession XP_098833.2). Accordingly, utilities of GAM94 include diagnosis, prevention and treatment of diseases and clinical conditions associated with LOC157858.

LOC158130 (Accession XP_044880.1) is another GAM94 target gene, herein designated TARGET GENE. LOC158130 BINDING SITE is a target binding site found in the 3' untranslated region of mRNA encoded by LOC158130, corresponding to a target binding site such as BINDING SITE I, BINDING SITE II or BINDING SITE III of FIG. 8. Table 4 illustrates the complementarity of the nucleotide sequences of LOC158130 BINDING SITE, designated SEQ ID:12067, to the nucleotide sequence of GAM94 RNA, herein designated GAM RNA, also designated SEQ ID:332.

Another function of GAM94 is therefore inhibition of LOC158130 (Accession XP_044880.1). Accordingly, utilities of GAM94 include diagnosis, prevention and treatment of diseases and clinical conditions associated with LOC158130.

LOC158435 (Accession NP_612506.1) is another GAM94 target gene, herein designated TARGET GENE. LOC158435 BINDING SITE is a target binding site found in the 3' untranslated region of mRNA encoded by LOC158435, corresponding to a target binding site such as BINDING SITE I, BINDING SITE II or BINDING SITE III of FIG. 8. Table 4 illustrates the complementarity of the nucleotide sequences of LOC158435 BINDING SITE, designated SEQ ID:14942, to the nucleotide sequence of GAM94 RNA, herein designated GAM RNA, also designated SEQ ID:332.

Another function of GAM94 is therefore inhibition of LOC158435 (Accession NP_612506.1). Accordingly, utilities of GAM94 include diagnosis, prevention and treatment of diseases and clinical conditions associated with LOC158435.

LOC159036 (Accession XP_099018.1) is another GAM94 target gene, herein designated TARGET GENE. LOC159036 BINDING SITE1 and LOC159036 BINDING SITE2 are target binding sites found in untranslated regions of mRNA encoded by LOC159036, corresponding to target binding sites such as BINDING SITE I, BINDING SITE II or BINDING SITE III of FIG. 8. Table 4 illustrates the complementarity of the nucleotide sequences of LOC159036 BINDING SITE1 and LOC159036 BINDING SITE2, designated SEQ ID:5842 and SEQ ID:12457 respectively, to the nucleotide sequence of GAM94 RNA, herein designated GAM RNA, also designated SEQ ID:332.

Another function of GAM94 is therefore inhibition of LOC159036 (Accession XP_099018.1). Accordingly, utilities of GAM94 include diagnosis, prevention and treatment of diseases and clinical conditions associated with LOC159036.

LOC159184 (Accession XP_010658.4) is another GAM94 target gene, herein designated TARGET GENE. LOC159184 BINDING SITE is a target binding site found in the 3' untranslated region of mRNA encoded by LOC159184, corresponding to a target binding site such as BINDING SITE I, BINDING SITE II or BINDING SITE III of FIG. 8. Table 4 illustrates the complementarity of the nucleotide sequences of LOC159184 BINDING SITE, designated SEQ ID:11617, to the nucleotide sequence of GAM94 RNA, herein designated GAM RNA, also designated SEQ ID:332.

Another function of GAM94 is therefore inhibition of LOC159184 (Accession XP_010658.4). Accordingly, utilities of GAM94 include diagnosis, prevention and treatment of diseases and clinical conditions associated with LOC159184.

LOC162952 (Accession XP_091891.4) is another GAM94 target gene, herein designated TARGET GENE. LOC162952 BINDING SITE1 and LOC162952 BINDING SITE2 are target binding sites found in untranslated regions of mRNA encoded by LOC162952, corresponding to target binding sites such as BINDING SITE I, BINDING SITE II or BINDING SITE III of FIG. 8. Table 4 illustrates the complementarity of the nucleotide sequences of LOC162952 BINDING SITE1 and LOC162952 BINDING SITE2, designated SEQ ID:9818 and SEQ ID:4321 respectively, to the nucleotide sequence of GAM94 RNA, herein designated GAM RNA, also designated SEQ ID:332.

Another function of GAM94 is therefore inhibition of LOC162952 (Accession XP_091891.4). Accordingly, utilities of GAM94 include diagnosis, prevention and treatment of diseases and clinical conditions associated with LOC162952.

LOC169924 (Accession XP_092983.4) is another GAM94 target gene, herein designated TARGET GENE. LOC169924 BINDING SITE is a target binding site found in the 5' untranslated region of mRNA encoded by LOC169924, corresponding to a target binding site such as BINDING SITE I, BINDING SITE II or BINDING SITE III of FIG. 8. Table 4 illustrates the complementarity of the nucleotide sequences of LOC169924 BINDING SITE, designated SEQ ID:18410, to the nucleotide sequence of GAM94 RNA, herein designated GAM RNA, also designated SEQ ID:332.

Another function of GAM94 is therefore inhibition of LOC169924 (Accession XP_092983.4). Accordingly, utilities of GAM94 include diagnosis, prevention and treatment of diseases and clinical conditions associated with LOC169924.

LOC197317 (Accession XP_117014.1) is another GAM94 target gene, herein designated TARGET GENE. LOC197317 BINDING SITE is a target binding site found in the 5' untranslated region of mRNA encoded by LOC197317, corresponding to a target binding site such as BINDING SITE I, BINDING SITE II or BINDING SITE III of FIG. 8. Table 4 illustrates the complementarity of the nucleotide sequences of LOC197317 BINDING SITE, designated SEQ ID:12560, to the nucleotide sequence of GAM94 RNA, herein designated GAM RNA, also designated SEQ ID:332.

Another function of GAM94 is therefore inhibition of LOC197317 (Accession XP_117014.1). Accordingly, utilities of GAM94 include diagnosis, prevention and treatment of diseases and clinical conditions associated with LOC197317.

LOC197342 (Accession XP_113869.1) is another GAM94 target gene, herein designated TARGET GENE. LOC197342 BINDING SITE is a target binding site found in the 3' untranslated region of mRNA encoded by LOC197342, corresponding to a target binding site such as BINDING SITE I, BINDING SITE II or BINDING SITE III of FIG. 8. Table 4 illustrates the complementarity of the nucleotide sequences of LOC197342 BINDING SITE, designated SEQ ID:15635, to the nucleotide sequence of GAM94 RNA, herein designated GAM RNA, also designated SEQ ID:332.

Another function of GAM94 is therefore inhibition of LOC197342 (Accession XP_113869.1). Accordingly, utilities of GAM94 include diagnosis, prevention and treatment of diseases and clinical conditions associated with LOC197342.

LOC200420 (Accession NP_660343.1) is another GAM94 target gene, herein designated TARGET GENE. LOC200420 BINDING SITE is a target binding site found in the 3' untranslated region of mRNA encoded by LOC200420, corresponding to a target binding site such as BINDING SITE I, BINDING SITE II or BINDING SITE III of FIG. 8. Table 4 illustrates the complementarity of the nucleotide sequences of LOC200420 BINDING SITE, designated SEQ ID:14717, to the nucleotide sequence of GAM94 RNA, herein designated GAM RNA, also designated SEQ ID:332.

Another function of GAM94 is therefore inhibition of LOC200420 (Accession NP_660343.1). Accordingly, utilities of GAM94 include diagnosis, prevention and treatment of diseases and clinical conditions associated with LOC200420.

LOC201158 (Accession NP_660344.1) is another GAM94 target gene, herein designated TARGET GENE. LOC201158 BINDING SITE1 and LOC201158 BINDING SITE2 are target binding sites found in untranslated regions of mRNA encoded by LOC201158, corresponding to target binding sites such as BINDING SITE I, BINDING SITE II or BINDING SITE III of FIG. 8. Table 4 illustrates the complementarity of the nucleotide sequences of LOC201158 BINDING SITE1 and LOC201158 BINDING SITE2, designated SEQ ID:886 and SEQ ID:2274 respectively, to the nucleotide sequence of GAM94 RNA, herein designated GAM RNA, also designated SEQ ID:332.

Another function of GAM94 is therefore inhibition of LOC201158 (Accession NP_660344.1). Accordingly, utilities of GAM94 include diagnosis, prevention and treatment of diseases and clinical conditions associated with LOC201158.

LOC201164 (Accession NP_849158.1) is another GAM94 target gene, herein designated TARGET GENE. LOC201164 BINDING SITE is a target binding site found in the 3' untranslated region of multiple transcripts of mRNA encoded by LOC201164, corresponding to a target binding site such as BINDING SITE I, BINDING SITE II or BINDING SITE III of FIG. 8. Table 4 illustrates the complementarity of the nucleotide sequences of LOC201164 BINDING SITE, designated SEQ ID:1481, to the nucleotide sequence of GAM94 RNA, herein designated GAM RNA, also designated SEQ ID:332.

Another function of GAM94 is therefore inhibition of LOC201164 (Accession NP_849158.1). Accordingly, utilities of GAM94 include diagnosis, prevention and treatment of diseases and clinical conditions associated with LOC201164.

LOC201164 (Accession XP_290750.1) is another GAM94 target gene, herein designated TARGET GENE. LOC201164 BINDING SITE is a target binding site found in the 3' untranslated region of multiple transcripts of mRNA encoded by LOC201164, corresponding to a target binding site such as BINDING SITE I, BINDING SITE II or BINDING SITE III of FIG. 8. Table 4 illustrates the complementarity of the nucleotide sequences of LOC201164 BINDING SITE, designated SEQ ID:1481, to the nucleotide sequence of GAM94 RNA, herein designated GAM RNA, also designated SEQ ID:332.

Another function of GAM94 is therefore inhibition of LOC201164 (Accession XP_290750.1). Accordingly, utilities of GAM94 include diagnosis, prevention and treatment of diseases and clinical conditions associated with LOC201164.

LOC201617 (Accession XP_117315.1) is another GAM94 target gene, herein designated TARGET GENE. LOC201617 BINDING SITE1 and LOC201617 BINDING SITE2 are target binding sites found in untranslated regions of mRNA encoded by LOC201617, corresponding to target binding sites such as BINDING SITE I, BINDING SITE II or BINDING SITE III of FIG. 8. Table 4 illustrates the complementarity of the nucleotide sequences of LOC201617 BINDING SITE1 and LOC201617 BINDING SITE2, designated SEQ ID:12689 and SEQ ID:5425 respectively, to the nucleotide sequence of GAM94 RNA, herein designated GAM RNA, also designated SEQ ID:332.

Another function of GAM94 is therefore inhibition of LOC201617 (Accession XP_117315.1). Accordingly, utilities of GAM94 include diagnosis, prevention and treatment of diseases and clinical conditions associated with LOC201617.

LOC203413 (Accession XP_117548.1) is another GAM94 target gene, herein designated TARGET GENE. LOC203413 BINDING SITE is a target binding site found in the 5' untranslated region of mRNA encoded by LOC203413, corresponding to a target binding site such as BINDING SITE I, BINDING SITE II or BINDING SITE III of FIG. 8. Table 4 illustrates the complementarity of the nucleotide sequences of LOC203413 BINDING SITE, designated SEQ ID:16230, to the nucleotide sequence of GAM94 RNA, herein designated GAM RNA, also designated SEQ ID:332.

Another function of GAM94 is therefore inhibition of LOC203413 (Accession XP_117548.1). Accordingly, utilities of GAM94 include diagnosis, prevention and treatment of diseases and clinical conditions associated with LOC203413.

LOC203859 (Accession XP_115009.3) is another GAM94 target gene, herein designated TARGET GENE. LOC203859 BINDING SITE is a target binding site found in the 5' untranslated region of mRNA encoded by LOC203859, corresponding to a target binding site such as BINDING SITE I, BINDING SITE II or BINDING SITE III of FIG. 8. Table 4 illustrates the complementarity of the nucleotide sequences of LOC203859 BINDING SITE, designated SEQ ID:7325, to the nucleotide sequence of GAM94 RNA, herein designated GAM RNA, also designated SEQ ID:332.

Another function of GAM94 is therefore inhibition of LOC203859 (Accession XP__115009.3). Accordingly, utilities of GAM94 include diagnosis, prevention and treatment of diseases and clinical conditions associated with LOC203859.

LOC220070 (Accession NP__660351.1) is another GAM94 target gene, herein designated TARGET GENE. LOC220070 BINDING SITE is a target binding site found in the 3' untranslated region of mRNA encoded by LOC220070, corresponding to a target binding site such as BINDING SITE I, BINDING SITE II or BINDING SITE III of FIG. 8. Table 4 illustrates the complementarity of the nucleotide sequences of LOC220070 BINDING SITE, designated SEQ ID:19843, to the nucleotide sequence of GAM94 RNA, herein designated GAM RNA, also designated SEQ ID:332.

Another function of GAM94 is therefore inhibition of LOC220070 (Accession NP__660351.1). Accordingly, utilities of GAM94 include diagnosis, prevention and treatment of diseases and clinical conditions associated with LOC220070.

LOC220763 (Accession XP__055551.1) is another GAM94 target gene, herein designated TARGET GENE. LOC220763 BINDING SITE1 and LOC220763 BINDING SITE2 are target binding sites found in untranslated regions of mRNA encoded by LOC220763, corresponding to target binding sites such as BINDING SITE I, BINDING SITE II or BINDING SITE III of FIG. 8. Table 4 illustrates the complementarity of the nucleotide sequences of LOC220763 BINDING SITE1 and LOC220763 BINDING SITE2, designated SEQ ID:18116 and SEQ ID:14370 respectively, to the nucleotide sequence of GAM94 RNA, herein designated GAM RNA, also designated SEQ ID:332.

Another function of GAM94 is therefore inhibition of LOC220763 (Accession XP__055551.1). Accordingly, utilities of GAM94 include diagnosis, prevention and treatment of diseases and clinical conditions associated with LOC220763.

LOC221218 (Accession XP__166281.3) is another GAM94 target gene, herein designated TARGET GENE. LOC221218 BINDING SITE is a target binding site found in the 5' untranslated region of mRNA encoded by LOC221218, corresponding to a target binding site such as BINDING SITE I, BINDING SITE II or BINDING SITE III of FIG. 8. Table 4 illustrates the complementarity of the nucleotide sequences of LOC221218 BINDING SITE, designated SEQ ID:19455, to the nucleotide sequence of GAM94 RNA, herein designated GAM RNA, also designated SEQ ID:332.

Another function of GAM94 is therefore inhibition of LOC221218 (Accession XP__166281.3). Accordingly, utilities of GAM94 include diagnosis, prevention and treatment of diseases and clinical conditions associated with LOC221218.

LOC221576 (Accession XP__168088.1) is another GAM94 target gene, herein designated TARGET GENE. LOC221576 BINDING SITE is a target binding site found in the 5' untranslated region of mRNA encoded by LOC221576, corresponding to a target binding site such as BINDING SITE I, BINDING SITE II or BINDING SITE III of FIG. 8. Table 4 illustrates the complementarity of the nucleotide sequences of LOC221576 BINDING SITE, designated SEQ ID:11589, to the nucleotide sequence of GAM94 RNA, herein designated GAM RNA, also designated SEQ ID:332.

Another function of GAM94 is therefore inhibition of LOC221576 (Accession XP__168088.1). Accordingly, utilities of GAM94 include diagnosis, prevention and treatment of diseases and clinical conditions associated with LOC221576.

LOC221711 (Accession XP__166411.1) is another GAM94 target gene, herein designated TARGET GENE. LOC221711 BINDING SITE is a target binding site found in the 3' untranslated region of mRNA encoded by LOC221711, corresponding to a target binding site such as BINDING SITE I, BINDING SITE II or BINDING SITE III of FIG. 8. Table 4 illustrates the complementarity of the nucleotide sequences of LOC221711 BINDING SITE, designated SEQ ID:9150, to the nucleotide sequence of GAM94 RNA, herein designated GAM RNA, also designated SEQ ID:332.

Another function of GAM94 is therefore inhibition of LOC221711 (Accession XP__166411.1). Accordingly, utilities of GAM94 include diagnosis, prevention and treatment of diseases and clinical conditions associated with LOC221711.

LOC221922 (Accession XP__166555.2) is another GAM94 target gene, herein designated TARGET GENE. LOC221922 BINDING SITE is a target binding site found in the 3' untranslated region of mRNA encoded by LOC221922, corresponding to a target binding site such as BINDING SITE I, BINDING SITE II or BINDING SITE III of FIG. 8. Table 4 illustrates the complementarity of the nucleotide sequences of LOC221922 BINDING SITE, designated SEQ ID:7052, to the nucleotide sequence of GAM94 RNA, herein designated GAM RNA, also designated SEQ ID:332.

Another function of GAM94 is therefore inhibition of LOC221922 (Accession XP__166555.2). Accordingly, utilities of GAM94 include diagnosis, prevention and treatment of diseases and clinical conditions associated with LOC221922.

LOC221931 (Accession XP__168348.1) is another GAM94 target gene, herein designated TARGET GENE. LOC221931 BINDING SITE is a target binding site found in the 5' untranslated region of mRNA encoded by LOC221931, corresponding to a target binding site such as BINDING SITE I, BINDING SITE II or BINDING SITE III of FIG. 8. Table 4 illustrates the complementarity of the nucleotide sequences of LOC221931 BINDING SITE, designated SEQ ID:4736, to the nucleotide sequence of GAM94 RNA, herein designated GAM RNA, also designated SEQ ID:332.

Another function of GAM94 is therefore inhibition of LOC221931 (Accession XP__168348.1). Accordingly, utilities of GAM94 include diagnosis, prevention and treatment of diseases and clinical conditions associated with LOC221931.

LOC221981 (Accession XP__168344.1) is another GAM94 target gene, herein designated TARGET GENE. LOC221981 BINDING SITE is a target binding site found in the 3' untranslated region of mRNA encoded by LOC221981, corresponding to a target binding site such as BINDING SITE I, BINDING SITE II or BINDING SITE III of FIG. 8. Table 4 illustrates the complementarity of the nucleotide sequences of LOC221981 BINDING SITE, designated SEQ ID:9228, to the nucleotide sequence of GAM94 RNA, herein designated GAM RNA, also designated SEQ ID:332.

Another function of GAM94 is therefore inhibition of LOC221981 (Accession XP__168344.1). Accordingly, utilities of GAM94 include diagnosis, prevention and treatment of diseases and clinical conditions associated with LOC221981.

LOC222699 (Accession XP_291197.1) is another GAM94 target gene, herein designated TARGET GENE. LOC222699 BINDING SITE1 and LOC222699 BINDING SITE2 are target binding sites found in untranslated regions of mRNA encoded by LOC222699, corresponding to target binding sites such as BINDING SITE I, BINDING SITE II or BINDING SITE III of FIG. 8. Table 4 illustrates the complementarity of the nucleotide sequences of LOC222699 BINDING SITE1 and LOC222699 BINDING SITE2, designated SEQ ID:16962 and SEQ ID:8126 respectively, to the nucleotide sequence of GAM94 RNA, herein designated GAM RNA, also designated SEQ ID:332.

Another function of GAM94 is therefore inhibition of LOC222699 (Accession XP_291197.1). Accordingly, utilities of GAM94 include diagnosis, prevention and treatment of diseases and clinical conditions associated with LOC222699.

LOC253148 (Accession XP_173032.1) is another GAM94 target gene, herein designated TARGET GENE. LOC253148 BINDING SITE is a target binding site found in the 5' untranslated region of mRNA encoded by LOC253148, corresponding to a target binding site such as BINDING SITE I, BINDING SITE II or BINDING SITE III of FIG. 8. Table 4 illustrates the complementarity of the nucleotide sequences of LOC253148 BINDING SITE, designated SEQ ID:6000, to the nucleotide sequence of GAM94 RNA, herein designated GAM RNA, also designated SEQ ID:332.

Another function of GAM94 is therefore inhibition of LOC253148 (Accession XP_173032.1). Accordingly, utilities of GAM94 include diagnosis, prevention and treatment of diseases and clinical conditions associated with LOC253148.

LOC253805 (Accession XP_172854.1) is another GAM94 target gene, herein designated TARGET GENE. LOC253805 BINDING SITE is a target binding site found in the 5' untranslated region of mRNA encoded by LOC253805, corresponding to a target binding site such as BINDING SITE I, BINDING SITE II or BINDING SITE III of FIG. 8. Table 4 illustrates the complementarity of the nucleotide sequences of LOC253805 BINDING SITE, designated SEQ ID:10542, to the nucleotide sequence of GAM94 RNA, herein designated GAM RNA, also designated SEQ ID:332.

Another function of GAM94 is therefore inhibition of LOC253805 (Accession XP_172854.1). Accordingly, utilities of GAM94 include diagnosis, prevention and treatment of diseases and clinical conditions associated with LOC253805.

LOC253839 (Accession XP_170875.1) is another GAM94 target gene, herein designated TARGET GENE. LOC253839 BINDING SITE1 and LOC253839 BINDING SITE2 are target binding sites found in untranslated regions of mRNA encoded by LOC253839, corresponding to target binding sites such as BINDING SITE I, BINDING SITE II or BINDING SITE III of FIG. 8. Table 4 illustrates the complementarity of the nucleotide sequences of LOC253839 BINDING SITE1 and LOC253839 BINDING SITE2, designated SEQ ID:4687 and SEQ ID:17089 respectively, to the nucleotide sequence of GAM94 RNA, herein designated GAM RNA, also designated SEQ ID:332.

Another function of GAM94 is therefore inhibition of LOC253839 (Accession XP_170875.1). Accordingly, utilities of GAM94 include diagnosis, prevention and treatment of diseases and clinical conditions associated with LOC253839.

LOC253982 (Accession XP_170804.3) is another GAM94 target gene, herein designated TARGET GENE. LOC253982 BINDING SITE1 and LOC253982 BINDING SITE2 are target binding sites found in untranslated regions of mRNA encoded by LOC253982, corresponding to target binding sites such as BINDING SITE I, BINDING SITE II or BINDING SITE III of FIG. 8. Table 4 illustrates the complementarity of the nucleotide sequences of LOC253982 BINDING SITE1 and LOC253982 BINDING SITE2, designated SEQ ID:17182 and SEQ ID:2355 respectively, to the nucleotide sequence of GAM94 RNA, herein designated GAM RNA, also designated SEQ ID:332.

Another function of GAM94 is therefore inhibition of LOC253982 (Accession XP_170804.3). Accordingly, utilities of GAM94 include diagnosis, prevention and treatment of diseases and clinical conditions associated with LOC253982.

LOC253992 (Accession XP_172953.2) is another GAM94 target gene, herein designated TARGET GENE. LOC253992 BINDING SITE1 and LOC253992 BINDING SITE2 are target binding sites found in untranslated regions of mRNA encoded by LOC253992, corresponding to target binding sites such as BINDING SITE I, BINDING SITE II or BINDING SITE III of FIG. 8. Table 4 illustrates the complementarity of the nucleotide sequences of LOC253992 BINDING SITE1 and LOC253992 BINDING SITE2, designated SEQ ID:12822 and SEQ ID:19414 respectively, to the nucleotide sequence of GAM94 RNA, herein designated GAM RNA, also designated SEQ ID:332.

Another function of GAM94 is therefore inhibition of LOC253992 (Accession XP_172953.2). Accordingly, utilities of GAM94 include diagnosis, prevention and treatment of diseases and clinical conditions associated with LOC253992.

LOC255849 (Accession XP_172855.1) is another GAM94 target gene, herein designated TARGET GENE. LOC255849 BINDING SITE is a target binding site found in the 3' untranslated region of mRNA encoded by LOC255849, corresponding to a target binding site such as BINDING SITE I, BINDING SITE II or BINDING SITE III of FIG. 8. Table 4 illustrates the complementarity of the nucleotide sequences of LOC255849 BINDING SITE, designated SEQ ID:7005, to the nucleotide sequence of GAM94 RNA, herein designated GAM RNA, also designated SEQ ID:332.

Another function of GAM94 is therefore inhibition of LOC255849 (Accession XP_172855.1). Accordingly, utilities of GAM94 include diagnosis, prevention and treatment of diseases and clinical conditions associated with LOC255849.

LOC256614 (Accession XP_172864.1) is another GAM94 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:1367, to the nucleotide sequence of GAM94 RNA, herein designated GAM RNA, also designated SEQ ID:332.

Another function of GAM94 is therefore inhibition of LOC256614 (Accession XP_172864.1). Accordingly, utilities of GAM94 include diagnosis, prevention and treatment of diseases and clinical conditions associated with LOC256614.

LOC257358 (Accession XP_173138.1) is another GAM94 target gene, herein designated TARGET GENE. LOC257358 BINDING SITE is a target binding site found in the 3' untranslated region of mRNA encoded by LOC257358, corresponding to a target binding site such as BINDING SITE I, BINDING SITE II or BINDING SITE III of FIG. 8. Table 4 illustrates the complementarity of the nucleotide sequences of LOC257358 BINDING SITE, designated SEQ ID:2994, to the nucleotide sequence of GAM94 RNA, herein designated GAM RNA, also designated SEQ ID:332.

Another function of GAM94 is therefore inhibition of LOC257358 (Accession XP_173138.1). Accordingly, utilities of GAM94 include diagnosis, prevention and treatment of diseases and clinical conditions associated with LOC257358.

LOC282888 (Accession XP_212605.1) is another GAM94 target gene, herein designated TARGET GENE. LOC282888 BINDING SITE is a target binding site found in the 5' untranslated region of mRNA encoded by LOC282888, corresponding to a target binding site such as BINDING SITE I, BINDING SITE II or BINDING SITE III of FIG. 8. Table 4 illustrates the complementarity of the nucleotide sequences of LOC282888 BINDING SITE, designated SEQ ID:11589, to the nucleotide sequence of GAM94 RNA, herein designated GAM RNA, also designated SEQ ID:332.

Another function of GAM94 is therefore inhibition of LOC282888 (Accession XP_212605.1). Accordingly, utilities of GAM94 include diagnosis, prevention and treatment of diseases and clinical conditions associated with LOC282888.

LOC282926 (Accession XP_212646.1) is another GAM94 target gene, herein designated TARGET GENE. LOC282926 BINDING SITE is a target binding site found in the 5' untranslated region of mRNA encoded by LOC282926, corresponding to a target binding site such as BINDING SITE I, BINDING SITE II or BINDING SITE III of FIG. 8. Table 4 illustrates the complementarity of the nucleotide sequences of LOC282926 BINDING SITE, designated SEQ ID:11589, to the nucleotide sequence of GAM94 RNA, herein designated GAM RNA, also designated SEQ ID:332.

Another function of GAM94 is therefore inhibition of LOC282926 (Accession XP_212646.1). Accordingly, utilities of GAM94 include diagnosis, prevention and treatment of diseases and clinical conditions associated with LOC282926.

LOC282986 (Accession XP_208469.1) is another GAM94 target gene, herein designated TARGET GENE. LOC282986 BINDING SITE is a target binding site found in the 3' untranslated region of mRNA encoded by LOC282986, corresponding to a target binding site such as BINDING SITE I, BINDING SITE II or BINDING SITE III of FIG. 8. Table 4 illustrates the complementarity of the nucleotide sequences of LOC282986 BINDING SITE, designated SEQ ID:15064, to the nucleotide sequence of GAM94 RNA, herein designated GAM RNA, also designated SEQ ID:332.

Another function of GAM94 is therefore inhibition of LOC282986 (Accession XP_208469.1). Accordingly, utilities of GAM94 include diagnosis, prevention and treatment of diseases and clinical conditions associated with LOC282986.

LOC283010 (Accession XP_210848.1) is another GAM94 target gene, herein designated TARGET GENE. LOC283010 BINDING SITE is a target binding site found in the 3' untranslated region of mRNA encoded by LOC283010, corresponding to a target binding site such as BINDING SITE I, BINDING SITE II or BINDING SITE III of FIG. 8. Table 4 illustrates the complementarity of the nucleotide sequences of LOC283010 BINDING SITE, designated SEQ ID:1988, to the nucleotide sequence of GAM94 RNA, herein designated GAM RNA, also designated SEQ ID:332.

Another function of GAM94 is therefore inhibition of LOC283010 (Accession XP_210848.1). Accordingly, utilities of GAM94 include diagnosis, prevention and treatment of diseases and clinical conditions associated with LOC283010.

LOC283032 (Accession XP_208489.1) is another GAM94 target gene, herein designated TARGET GENE. LOC283032 BINDING SITE is a target binding site found in the 3' untranslated region of mRNA encoded by LOC283032, corresponding to a target binding site such as BINDING SITE I, BINDING SITE II or BINDING SITE III of FIG. 8. Table 4 illustrates the complementarity of the nucleotide sequences of LOC283032 BINDING SITE, designated SEQ ID:10557, to the nucleotide sequence of GAM94 RNA, herein designated GAM RNA, also designated SEQ ID:332.

Another function of GAM94 is therefore inhibition of LOC283032 (Accession XP_208489.1). Accordingly, utilities of GAM94 include diagnosis, prevention and treatment of diseases and clinical conditions associated with LOC283032.

LOC283047 (Accession XP_210870.1) is another GAM94 target gene, herein designated TARGET GENE. LOC283047 BINDING SITE is a target binding site found in the 3' untranslated region of mRNA encoded by LOC283047, corresponding to a target binding site such as BINDING SITE I, BINDING SITE II or BINDING SITE III of FIG. 8. Table 4 illustrates the complementarity of the nucleotide sequences of LOC283047 BINDING SITE, designated SEQ ID:3684, to the nucleotide sequence of GAM94 RNA, herein designated GAM RNA, also designated SEQ ID:332.

Another function of GAM94 is therefore inhibition of LOC283047 (Accession XP_210870.1). Accordingly, utilities of GAM94 include diagnosis, prevention and treatment of diseases and clinical conditions associated with LOC283047.

LOC283053 (Accession XP_210869.1) is another GAM94 target gene, herein designated TARGET GENE. LOC283053 BINDING SITE is a target binding site found in the 3' untranslated region of mRNA encoded by LOC283053, corresponding to a target binding site such as BINDING SITE I, BINDING SITE II or BINDING SITE III of FIG. 8. Table 4 illustrates the complementarity of the nucleotide sequences of LOC283053 BINDING SITE, designated SEQ ID:1988, to the nucleotide sequence of GAM94 RNA, herein designated GAM RNA, also designated SEQ ID:332.

Another function of GAM94 is therefore inhibition of LOC283053 (Accession XP_210869.1). Accordingly, utilities of GAM94 include diagnosis, prevention and treatment of diseases and clinical conditions associated with LOC283053.

LOC283129 (Accession XP_208524.1) is another GAM94 target gene, herein designated TARGET GENE. LOC283129 BINDING SITE is a target binding site found in the 5' untranslated region of mRNA encoded by LOC283129, corresponding to a target binding site such as BINDING SITE I, BINDING SITE II or BINDING SITE III of FIG. 8. Table 4 illustrates the complementarity of the nucleotide sequences of LOC283129 BINDING SITE, designated SEQ ID:16555, to the nucleotide sequence of GAM94 RNA, herein designated GAM RNA, also designated SEQ ID:332.

Another function of GAM94 is therefore inhibition of LOC283129 (Accession XP_208524.1). Accordingly, utilities of GAM94 include diagnosis, prevention and treatment of diseases and clinical conditions associated with LOC283129.

LOC283167 (Accession XP_210921.1) is another GAM94 target gene, herein designated TARGET GENE. LOC283167 BINDING SITE is a target binding site found in the 3' untranslated region of mRNA encoded by LOC283167, corresponding to a target binding site such as BINDING SITE I, BINDING SITE II or BINDING SITE III of FIG. 8. Table 4 illustrates the complementarity of the nucleotide sequences of LOC283167 BINDING SITE, designated SEQ ID:9978, to the nucleotide sequence of GAM94 RNA, herein designated GAM RNA, also designated SEQ ID:332.

Another function of GAM94 is therefore inhibition of LOC283167 (Accession XP_210921.1). Accordingly, utilities of GAM94 include diagnosis, prevention and treatment of diseases and clinical conditions associated with LOC283167.

LOC283194 (Accession XP_210932.2) is another GAM94 target gene, herein designated TARGET GENE. LOC283194 BINDING SITE is a target binding site found in the 5' untranslated region of mRNA encoded by LOC283194, corresponding to a target binding site such as BINDING SITE I, BINDING SITE II or BINDING SITE III of FIG. 8. Table 4 illustrates the complementarity of the nucleotide sequences of LOC283194 BINDING SITE, designated SEQ ID:15353, to the nucleotide sequence of GAM94 RNA, herein designated GAM RNA, also designated SEQ ID:332.

Another function of GAM94 is therefore inhibition of LOC283194 (Accession XP_210932.2). Accordingly, utilities of GAM94 include diagnosis, prevention and treatment of diseases and clinical conditions associated with LOC283194.

LOC283314 (Accession XP_210969.1) is another GAM94 target gene, herein designated TARGET GENE. LOC283314 BINDING SITE is a target binding site found in the 3' untranslated region of mRNA encoded by LOC283314, corresponding to a target binding site such as BINDING SITE I, BINDING SITE II or BINDING SITE III of FIG. 8. Table 4 illustrates the complementarity of the nucleotide sequences of LOC283314 BINDING SITE, designated SEQ ID:13566, to the nucleotide sequence of GAM94 RNA, herein designated GAM RNA, also designated SEQ ID:332.

Another function of GAM94 is therefore inhibition of LOC283314 (Accession XP_210969.1). Accordingly, utilities of GAM94 include diagnosis, prevention and treatment of diseases and clinical conditions associated with LOC283314.

LOC283315 (Accession XP_210974.1) is another GAM94 target gene, herein designated TARGET GENE. LOC283315 BINDING SITE is a target binding site found in the 5' untranslated region of mRNA encoded by LOC283315, corresponding to a target binding site such as BINDING SITE I, BINDING SITE II or BINDING SITE III of FIG. 8. Table 4 illustrates the complementarity of the nucleotide sequences of LOC283315 BINDING SITE, designated SEQ ID:19603, to the nucleotide sequence of GAM94 RNA, herein designated GAM RNA, also designated SEQ ID:332.

Another function of GAM94 is therefore inhibition of LOC283315 (Accession XP_210974.1). Accordingly, utilities of GAM94 include diagnosis, prevention and treatment of diseases and clinical conditions associated with LOC283315.

LOC283329 (Accession XP_210978.1) is another GAM94 target gene, herein designated TARGET GENE. LOC283329 BINDING SITE1 and LOC283329 BINDING SITE2 are target binding sites found in untranslated regions of mRNA encoded by LOC283329, corresponding to target binding sites such as BINDING SITE I, BINDING SITE II or BINDING SITE III of FIG. 8. Table 4 illustrates the complementarity of the nucleotide sequences of LOC283329 BINDING SITE1 and LOC283329 BINDING SITE2, designated SEQ ID:3885 and SEQ ID:2261 respectively, to the nucleotide sequence of GAM94 RNA, herein designated GAM RNA, also designated SEQ ID:332.

Another function of GAM94 is therefore inhibition of LOC283329 (Accession XP_210978.1). Accordingly, utilities of GAM94 include diagnosis, prevention and treatment of diseases and clinical conditions associated with LOC283329.

LOC283381 (Accession XP_211006.1) is another GAM94 target gene, herein designated TARGET GENE. LOC283381 BINDING SITE1 and LOC283381 BINDING SITE2 are target binding sites found in untranslated regions of mRNA encoded by LOC283381, corresponding to target binding sites such as BINDING SITE I, BINDING SITE II or BINDING SITE III of FIG. 8. Table 4 illustrates the complementarity of the nucleotide sequences of LOC283381 BINDING SITE1 and LOC283381 BINDING SITE2, designated SEQ ID:18381 and SEQ ID:10870 respectively, to the nucleotide sequence of GAM94 RNA, herein designated GAM RNA, also designated SEQ ID:332.

Another function of GAM94 is therefore inhibition of LOC283381 (Accession XP_211006.1). Accordingly, utilities of GAM94 include diagnosis, prevention and treatment of diseases and clinical conditions associated with LOC283381.

LOC283423 (Accession XP_211031.1) is another GAM94 target gene, herein designated TARGET GENE. LOC283423 BINDING SITE is a target binding site found in the 3' untranslated region of mRNA encoded by LOC283423, corresponding to a target binding site such as BINDING SITE I, BINDING SITE II or BINDING SITE III of FIG. 8. Table 4 illustrates the complementarity of the nucleotide sequences of LOC283423 BINDING SITE, designated SEQ ID:11385, to the nucleotide sequence of GAM94 RNA, herein designated GAM RNA, also designated SEQ ID:332.

Another function of GAM94 is therefore inhibition of LOC283423 (Accession XP_211031.1). Accordingly, utilities of GAM94 include diagnosis, prevention and treatment of diseases and clinical conditions associated with LOC283423.

LOC283439 (Accession XP_211039.1) is another GAM94 target gene, herein designated TARGET GENE. LOC283439 BINDING SITE is a target binding site found in the 5' untranslated region of mRNA encoded by LOC283439, corresponding to a target binding site such as BINDING SITE I, BINDING SITE II or BINDING SITE III of FIG. 8. Table 4 illustrates the complementarity of the nucleotide sequences of LOC283439 BINDING SITE, designated SEQ ID:15116, to the nucleotide sequence of GAM94 RNA, herein designated GAM RNA, also designated SEQ ID:332.

Another function of GAM94 is therefore inhibition of LOC283439 (Accession XP_211039.1). Accordingly, utilities of GAM94 include diagnosis, prevention and treatment of diseases and clinical conditions associated with LOC283439.

LOC283558 (Accession XP_208101.1) is another GAM94 target gene, herein designated TARGET GENE. LOC283558 BINDING SITE is a target binding site found in the 5' untranslated region of mRNA encoded by LOC283558, corresponding to a target binding site such as BINDING SITE I, BINDING SITE II or BINDING SITE III of FIG. 8. Table 4 illustrates the complementarity of the nucleotide sequences of LOC283558 BINDING SITE, designated SEQ ID:12690, to the nucleotide sequence of GAM94 RNA, herein designated GAM RNA, also designated SEQ ID:332.

Another function of GAM94 is therefore inhibition of LOC283558 (Accession XP_208101.1). Accordingly, utilities of GAM94 include diagnosis, prevention and treatment of diseases and clinical conditions associated with LOC283558.

LOC283639 (Accession XP_211135.1) is another GAM94 target gene, herein designated TARGET GENE. LOC283639 BINDING SITE is a target binding site found in the 3' untranslated region of mRNA encoded by LOC283639, corresponding to a target binding site such as BINDING SITE I, BINDING SITE II or BINDING SITE III of FIG. 8. Table 4 illustrates the complementarity of the nucleotide sequences of LOC283639 BINDING SITE, designated SEQ ID:2425, to the nucleotide sequence of GAM94 RNA, herein designated GAM RNA, also designated SEQ ID:332.

Another function of GAM94 is therefore inhibition of LOC283639 (Accession XP_211135.1). Accordingly, utilities of GAM94 include diagnosis, prevention and treatment of diseases and clinical conditions associated with LOC283639.

LOC283667 (Accession XP_211149.1) is another GAM94 target gene, herein designated TARGET GENE. LOC283667 BINDING SITE is a target binding site found in the 3' untranslated region of mRNA encoded by LOC283667, corresponding to a target binding site such as BINDING SITE I, BINDING SITE II or BINDING SITE III of FIG. 8. Table 4 illustrates the complementarity of the nucleotide sequences of LOC283667 BINDING SITE, designated SEQ ID:18438, to the nucleotide sequence of GAM94 RNA, herein designated GAM RNA, also designated SEQ ID:332.

Another function of GAM94 is therefore inhibition of LOC283667 (Accession XP_211149.1). Accordingly, utilities of GAM94 include diagnosis, prevention and treatment of diseases and clinical conditions associated with LOC283667.

LOC283717 (Accession XP_208798.2) is another GAM94 target gene, herein designated TARGET GENE. LOC283717 BINDING SITE is a target binding site found in the 5' untranslated region of mRNA encoded by LOC283717, corresponding to a target binding site such as BINDING SITE I, BINDING SITE II or BINDING SITE III of FIG. 8. Table 4 illustrates the complementarity of the nucleotide sequences of LOC283717 BINDING SITE, designated SEQ ID:6827, to the nucleotide sequence of GAM94 RNA, herein designated GAM RNA, also designated SEQ ID:332.

Another function of GAM94 is therefore inhibition of LOC283717 (Accession XP_208798.2). Accordingly, utilities of GAM94 include diagnosis, prevention and treatment of diseases and clinical conditions associated with LOC283717.

LOC283738 (Accession XP_211186.1) is another GAM94 target gene, herein designated TARGET GENE. LOC283738 BINDING SITE is a target binding site found in the 5' untranslated region of mRNA encoded by LOC283738, corresponding to a target binding site such as BINDING SITE I, BINDING SITE II or BINDING SITE III of FIG. 8. Table 4 illustrates the complementarity of the nucleotide sequences of LOC283738 BINDING SITE, designated SEQ ID:15870, to the nucleotide sequence of GAM94 RNA, herein designated GAM RNA, also designated SEQ ID:332.

Another function of GAM94 is therefore inhibition of LOC283738 (Accession XP_211186.1). Accordingly, utilities of GAM94 include diagnosis, prevention and treatment of diseases and clinical conditions associated with LOC283738.

LOC283743 (Accession XP_208815.1) is another GAM94 target gene, herein designated TARGET GENE. LOC283743 BINDING SITE is a target binding site found in the 3' untranslated region of mRNA encoded by LOC283743, corresponding to a target binding site such as BINDING SITE I, BINDING SITE II or BINDING SITE III of FIG. 8. Table 4 illustrates the complementarity of the nucleotide sequences of LOC283743 BINDING SITE, designated SEQ ID:14856, to the nucleotide sequence of GAM94 RNA, herein designated GAM RNA, also designated SEQ ID:332.

Another function of GAM94 is therefore inhibition of LOC283743 (Accession XP_208815.1). Accordingly, utilities of GAM94 include diagnosis, prevention and treatment of diseases and clinical conditions associated with LOC283743.

LOC283767 (Accession XP_208835.1) is another GAM94 target gene, herein designated TARGET GENE. LOC283767 BINDING SITE is a target binding site found in the 5' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:8147, to the nucleotide sequence of GAM94 RNA, herein designated GAM RNA, also designated SEQ ID:332.

Another function of GAM94 is therefore inhibition of LOC283767 (Accession XP_208835.1). Accordingly, utilities of GAM94 include diagnosis, prevention and treatment of diseases and clinical conditions associated with LOC283767.

LOC283834 (Accession XP_211225.1) is another GAM94 target gene, herein designated TARGET GENE. LOC283834 BINDING SITE is a target binding site found in the 3' untranslated region of mRNA encoded by LOC283834, corresponding to a target binding site such as BINDING SITE I, BINDING SITE II or BINDING SITE III of FIG. 8. Table 4 illustrates the complementarity of the nucleotide sequences of LOC283834 BINDING SITE, designated SEQ ID:632, to the nucleotide sequence of GAM94 RNA, herein designated GAM RNA, also designated SEQ ID:332.

Another function of GAM94 is therefore inhibition of LOC283834 (Accession XP_211225.1). Accordingly, utilities of GAM94 include diagnosis, prevention and treatment of diseases and clinical conditions associated with LOC283834.

LOC283894 (Accession XP_211250.1) is another GAM94 target gene, herein designated TARGET GENE. LOC283894 BINDING SITE is a target binding site found in the 5' untranslated region of mRNA encoded by LOC283894, corresponding to a target binding site such as BINDING SITE I, BINDING SITE II or BINDING SITE III of FIG. 8. Table 4 illustrates the complementarity of the nucleotide sequences of LOC283894 BINDING SITE, designated SEQ ID:6537, to the nucleotide sequence of GAM94 RNA, herein designated GAM RNA, also designated SEQ ID:332.

Another function of GAM94 is therefore inhibition of LOC283894 (Accession XP_211250.1). Accordingly, utilities of GAM94 include diagnosis, prevention and treatment of diseases and clinical conditions associated with LOC283894.

LOC283909 (Accession XP_211256.1) is another GAM94 target gene, herein designated TARGET GENE. LOC283909 BINDING SITE is a target binding site found in the 5' untranslated region of mRNA encoded by LOC283909, corresponding to a target binding site such as BINDING SITE I, BINDING SITE II or BINDING SITE III of FIG. 8. Table 4 illustrates the complementarity of the nucleotide sequences of LOC283909 BINDING SITE, designated SEQ ID:19947, to the nucleotide sequence of GAM94 RNA, herein designated GAM RNA, also designated SEQ ID:332.

Another function of GAM94 is therefore inhibition of LOC283909 (Accession XP_211256.1). Accordingly, utilities of GAM94 include diagnosis, prevention and treatment of diseases and clinical conditions associated with LOC283909.

LOC283963 (Accession XP_211275.2) is another GAM94 target gene, herein designated TARGET GENE. LOC283963 BINDING SITE is a target binding site found in the 3' untranslated region of mRNA encoded by LOC283963, corresponding to a target binding site such as BINDING SITE I, BINDING SITE II or BINDING SITE III of FIG. 8. Table 4 illustrates the complementarity of the nucleotide sequences of LOC283963 BINDING SITE, designated SEQ ID:9286, to the nucleotide sequence of GAM94 RNA, herein designated GAM RNA, also designated SEQ ID:332.

Another function of GAM94 is therefore inhibition of LOC283963 (Accession XP_211275.2). Accordingly, utilities of GAM94 include diagnosis, prevention and treatment of diseases and clinical conditions associated with LOC283963.

LOC283993 (Accession XP_211293.1) is another GAM94 target gene, herein designated TARGET GENE. LOC283993 BINDING SITE is a target binding site found in the 5' untranslated region of mRNA encoded by LOC283993, corresponding to a target binding site such as BINDING SITE I, BINDING SITE II or BINDING SITE III of FIG. 8. Table 4 illustrates the complementarity of the nucleotide sequences of LOC283993 BINDING SITE, designated SEQ ID:11731, to the nucleotide sequence of GAM94 RNA, herein designated GAM RNA, also designated SEQ ID:332.

Another function of GAM94 is therefore inhibition of LOC283993 (Accession XP_211293.1). Accordingly, utilities of GAM94 include diagnosis, prevention and treatment of diseases and clinical conditions associated with LOC283993.

LOC284036 (Accession XP_211306.1) is another GAM94 target gene, herein designated TARGET GENE. LOC284036 BINDING SITE is a target binding site found in the 3' untranslated region of mRNA encoded by LOC284036, corresponding to a target binding site such as BINDING SITE I, BINDING SITE II or BINDING SITE III of FIG. 8. Table 4 illustrates the complementarity of the nucleotide sequences of LOC284036 BINDING SITE, designated SEQ ID:16812, to the nucleotide sequence of GAM94 RNA, herein designated GAM RNA, also designated SEQ ID:332.

Another function of GAM94 is therefore inhibition of LOC284036 (Accession XP_211306.1). Accordingly, utilities of GAM94 include diagnosis, prevention and treatment of diseases and clinical conditions associated with LOC284036.

LOC284093 (Accession XP_211331.1) is another GAM94 target gene, herein designated TARGET GENE. LOC284093 BINDING SITE is a target binding site found in the 3' untranslated region of mRNA encoded by LOC284093, corresponding to a target binding site such as BINDING SITE I, BINDING SITE II or BINDING SITE III of FIG. 8. Table 4 illustrates the complementarity of the nucleotide sequences of LOC284093 BINDING SITE, designated SEQ ID:13458, to the nucleotide sequence of GAM94 RNA, herein designated GAM RNA, also designated SEQ ID:332.

Another function of GAM94 is therefore inhibition of LOC284093 (Accession XP_211331.1). Accordingly, utilities of GAM94 include diagnosis, prevention and treatment of diseases and clinical conditions associated with LOC284093.

LOC284106 (Accession XP_209004.1) is another GAM94 target gene, herein designated TARGET GENE. LOC284106 BINDING SITE is a target binding site found in the 3' untranslated region of mRNA encoded by LOC284106, corresponding to a target binding site such as BINDING SITE I, BINDING SITE II or BINDING SITE III of FIG. 8. Table 4 illustrates the complementarity of the nucleotide sequences of LOC284106 BINDING SITE, designated SEQ ID:3622, to the nucleotide sequence of GAM94 RNA, herein designated GAM RNA, also designated SEQ ID:332.

Another function of GAM94 is therefore inhibition of LOC284106 (Accession XP_209004.1). Accordingly, utilities of GAM94 include diagnosis, prevention and treatment of diseases and clinical conditions associated with LOC284106.

LOC284109 (Accession XP_211330.2) is another GAM94 target gene, herein designated TARGET GENE. LOC284109 BINDING SITE is a target binding site found in the 3' untranslated region of mRNA encoded by LOC284109, corresponding to a target binding site such as BINDING SITE I, BINDING SITE II or BINDING SITE III of FIG. 8. Table 4 illustrates the complementarity of the nucleotide sequences of LOC284109 BINDING SITE, designated SEQ ID:12668, to the nucleotide sequence of GAM94 RNA, herein designated GAM RNA, also designated SEQ ID:332.

Another function of GAM94 is therefore inhibition of LOC284109 (Accession XP_211330.2). Accordingly, utilities of GAM94 include diagnosis, prevention and treatment of diseases and clinical conditions associated with LOC284109.

LOC284158 (Accession XP_209041.1) is another GAM94 target gene, herein designated TARGET GENE. LOC284158 BINDING SITE is a target binding site found in the 5' untranslated region of mRNA encoded by LOC284158, corresponding to a target binding site such as BINDING SITE I, BINDING SITE II or BINDING SITE III of FIG. 8. Table 4 illustrates the complementarity of the nucleotide sequences of LOC284158 BINDING SITE, designated SEQ ID:14340, to the nucleotide sequence of GAM94 RNA, herein designated GAM RNA, also designated SEQ ID:332.

Another function of GAM94 is therefore inhibition of LOC284158 (Accession XP_209041.1). Accordingly, utilities of GAM94 include diagnosis, prevention and treatment of diseases and clinical conditions associated with LOC284158.

LOC284166 (Accession XP_209050.1) is another GAM94 target gene, herein designated TARGET GENE. LOC284166 BINDING SITE is a target binding site found in the 5' untranslated region of mRNA encoded by LOC284166, corresponding to a target binding site such as BINDING SITE I, BINDING SITE II or BINDING SITE III of FIG. 8. Table 4 illustrates the complementarity of the nucleotide sequences of LOC284166 BINDING SITE, designated SEQ ID:574, to the nucleotide sequence of GAM94 RNA, herein designated GAM RNA, also designated SEQ ID:332.

Another function of GAM94 is therefore inhibition of LOC284166 (Accession XP_209050.1). Accordingly, utilities of GAM94 include diagnosis, prevention and treatment of diseases and clinical conditions associated with LOC284166.

LOC284171 (Accession XP_209051.1) is another GAM94 target gene, herein designated TARGET GENE. LOC284171 BINDING SITE is a target binding site found in the 3' untranslated region of mRNA encoded by LOC284171, corresponding to a target binding site such as BINDING SITE I, BINDING SITE II or BINDING SITE III of FIG. 8. Table 4 illustrates the complementarity of the nucleotide sequences of LOC284171 BINDING SITE, designated SEQ ID:4956, to the nucleotide sequence of GAM94 RNA, herein designated GAM RNA, also designated SEQ ID:332.

Another function of GAM94 is therefore inhibition of LOC284171 (Accession XP_209051.1). Accordingly, utilities of GAM94 include diagnosis, prevention and treatment of diseases and clinical conditions associated with LOC284171.

LOC284185 (Accession XP_209062.2) is another GAM94 target gene, herein designated TARGET GENE. LOC284185 BINDING SITE is a target binding site found in the 5' untranslated region of mRNA encoded by LOC284185, corresponding to a target binding site such as BINDING SITE I, BINDING SITE II or BINDING SITE III of FIG. 8. Table 4 illustrates the complementarity of the nucleotide sequences of LOC284185 BINDING SITE, designated SEQ ID:11838, to the nucleotide sequence of GAM94 RNA, herein designated GAM RNA, also designated SEQ ID:332.

Another function of GAM94 is therefore inhibition of LOC284185 (Accession XP_209062.2). Accordingly, utilities of GAM94 include diagnosis, prevention and treatment of diseases and clinical conditions associated with LOC284185.

LOC284200 (Accession XP_209065.1) is another GAM94 target gene, herein designated TARGET GENE. LOC284200 BINDING SITE is a target binding site found in the 3' untranslated region of mRNA encoded by LOC284200, corresponding to a target binding site such as BINDING SITE I, BINDING SITE II or BINDING SITE III of FIG. 8. Table 4 illustrates the complementarity of the nucleotide sequences of LOC284200 BINDING SITE, designated SEQ ID:14624, to the nucleotide sequence of GAM94 RNA, herein designated GAM RNA, also designated SEQ ID:332.

Another function of GAM94 is therefore inhibition of LOC284200 (Accession XP_209065.1). Accordingly, utilities of GAM94 include diagnosis, prevention and treatment of diseases and clinical conditions associated with LOC284200.

LOC284277 (Accession XP_209102.1) is another GAM94 target gene, herein designated TARGET GENE. LOC284277 BINDING SITE is a target binding site found in the 3' untranslated region of mRNA encoded by LOC284277, corresponding to a target binding site such as BINDING SITE I, BINDING SITE II or BINDING SITE III of FIG. 8. Table 4 illustrates the complementarity of the nucleotide sequences of LOC284277 BINDING SITE, designated SEQ ID:11892, to the nucleotide sequence of GAM94 RNA, herein designated GAM RNA, also designated SEQ ID:332.

Another function of GAM94 is therefore inhibition of LOC284277 (Accession XP_209102.1). Accordingly, utilities of GAM94 include diagnosis, prevention and treatment of diseases and clinical conditions associated with LOC284277.

LOC284281 (Accession XP_211415.1) is another GAM94 target gene, herein designated TARGET GENE. LOC284281 BINDING SITE is a target binding site found in the 5' untranslated region of mRNA encoded by LOC284281, corresponding to a target binding site such as BINDING SITE I, BINDING SITE II or BINDING SITE III of FIG. 8. Table 4 illustrates the complementarity of the nucleotide sequences of LOC284281 BINDING SITE, designated SEQ ID:12346, to the nucleotide sequence of GAM94 RNA, herein designated GAM RNA, also designated SEQ ID:332.

Another function of GAM94 is therefore inhibition of LOC284281 (Accession XP_211415.1). Accordingly, utilities of GAM94 include diagnosis, prevention and treatment of diseases and clinical conditions associated with LOC284281.

LOC284313 (Accession XP_209116.1) is another GAM94 target gene, herein designated TARGET GENE. LOC284313 BINDING SITE is a target binding site found in the 5' untranslated region of mRNA encoded by LOC284313, corresponding to a target binding site such as BINDING SITE I, BINDING SITE II or BINDING SITE III of FIG. 8. Table 4 illustrates the complementarity of the nucleotide sequences of LOC284313 BINDING SITE, designated SEQ ID:911, to the nucleotide sequence of GAM94 RNA, herein designated GAM RNA, also designated SEQ ID:332.

Another function of GAM94 is therefore inhibition of LOC284313 (Accession XP_209116.1). Accordingly, utilities of GAM94 include diagnosis, prevention and treatment of diseases and clinical conditions associated with LOC284313.

LOC284361 (Accession NP_778233.2) is another GAM94 target gene, herein designated TARGET GENE. LOC284361 BINDING SITE1 and LOC284361 BINDING SITE2 are target binding sites found in untranslated regions of mRNA encoded by LOC284361, corresponding to target binding sites such as BINDING SITE I, BINDING SITE II or BINDING SITE III of FIG. 8. Table 4 illustrates the complementarity of the nucleotide sequences of LOC284361 BINDING SITE1 and LOC284361 BINDING SITE2, designated SEQ ID:2133 and SEQ ID:7597 respectively, to the nucleotide sequence of GAM94 RNA, herein designated GAM RNA, also designated SEQ ID:332.

Another function of GAM94 is therefore inhibition of LOC284361 (Accession NP_778233.2). Accordingly, utilities of GAM94 include diagnosis, prevention and treatment of diseases and clinical conditions associated with LOC284361.

LOC284514 (Accession XP_209244.1) is another GAM94 target gene, herein designated TARGET GENE. LOC284514 BINDING SITE is a target binding site found in the 3' untranslated region of mRNA encoded by LOC284514, corresponding to a target binding site such as BINDING SITE I, BINDING SITE II or BINDING SITE III of FIG. 8. Table 4 illustrates the complementarity of the nucleotide sequences of LOC284514 BINDING SITE, designated SEQ ID:7648, to the nucleotide sequence of GAM94 RNA, herein designated GAM RNA, also designated SEQ ID:332.

Another function of GAM94 is therefore inhibition of LOC284514 (Accession XP_209244.1). Accordingly, utilities of GAM94 include diagnosis, prevention and treatment of diseases and clinical conditions associated with LOC284514.

LOC284526 (Accession XP_211508.1) is another GAM94 target gene, herein designated TARGET GENE. LOC284526 BINDING SITE is a target binding site found in the 3' untranslated region of mRNA encoded by LOC284526, corresponding to a target binding site such as BINDING SITE I, BINDING SITE II or BINDING SITE III of FIG. 8. Table 4 illustrates the complementarity of the nucleotide sequences of LOC284526 BINDING SITE, designated SEQ ID:4914, to the nucleotide sequence of GAM94 RNA, herein designated GAM RNA, also designated SEQ ID:332.

Another function of GAM94 is therefore inhibition of LOC284526 (Accession XP_211508.1). Accordingly, utilities of GAM94 include diagnosis, prevention and treatment of diseases and clinical conditions associated with LOC284526.

LOC284584 (Accession XP_211528.3) is another GAM94 target gene, herein designated TARGET GENE. LOC284584 BINDING SITE is a target binding site found in the 3' untranslated region of mRNA encoded by LOC284584, corresponding to a target binding site such as BINDING SITE I, BINDING SITE II or BINDING SITE III of FIG. 8. Table 4 illustrates the complementarity of the nucleotide sequences of LOC284584 BINDING SITE, designated SEQ ID:13941, to the nucleotide sequence of GAM94 RNA, herein designated GAM RNA, also designated SEQ ID:332.

Another function of GAM94 is therefore inhibition of LOC284584 (Accession XP_211528.3). Accordingly, utilities of GAM94 include diagnosis, prevention and treatment of diseases and clinical conditions associated with LOC284584.

LOC284612 (Accession XP_211551.1) is another GAM94 target gene, herein designated TARGET GENE. LOC284612 BINDING SITE is a target binding site found in the 3' untranslated region of mRNA encoded by LOC284612, corresponding to a target binding site such as BINDING SITE I, BINDING SITE II or BINDING SITE III of FIG. 8. Table 4 illustrates the complementarity of the nucleotide sequences of LOC284612 BINDING SITE, designated SEQ ID:9049, to the nucleotide sequence of GAM94 RNA, herein designated GAM RNA, also designated SEQ ID:332.

Another function of GAM94 is therefore inhibition of LOC284612 (Accession XP_211551.1). Accordingly, utilities of GAM94 include diagnosis, prevention and treatment of diseases and clinical conditions associated with LOC284612.

LOC284621 (Accession XP_208227.1) is another GAM94 target gene, herein designated TARGET GENE. LOC284621 BINDING SITE is a target binding site found in the 3' untranslated region of mRNA encoded by LOC284621, corresponding to a target binding site such as BINDING SITE I, BINDING SITE II or BINDING SITE III of FIG. 8. Table 4 illustrates the complementarity of the nucleotide sequences of LOC284621 BINDING SITE, designated SEQ ID:8361, to the nucleotide sequence of GAM94 RNA, herein designated GAM RNA, also designated SEQ ID:332.

Another function of GAM94 is therefore inhibition of LOC284621 (Accession XP_208227.1). Accordingly, utilities of GAM94 include diagnosis, prevention and treatment of diseases and clinical conditions associated with LOC284621.

LOC284647 (Accession XP_211569.1) is another GAM94 target gene, herein designated TARGET GENE. LOC284647 BINDING SITE is a target binding site found in the 3' untranslated region of mRNA encoded by LOC284647, corresponding to a target binding site such as BINDING SITE I, BINDING SITE II or BINDING SITE III of FIG. 8. Table 4 illustrates the complementarity of the nucleotide sequences of LOC284647 BINDING SITE, designated SEQ ID:7303, to the nucleotide sequence of GAM94 RNA, herein designated GAM RNA, also designated SEQ ID:332.

Another function of GAM94 is therefore inhibition of LOC284647 (Accession XP_211569.1). Accordingly, utilities of GAM94 include diagnosis, prevention and treatment of diseases and clinical conditions associated with LOC284647.

LOC284665 (Accession XP_211581.1) is another GAM94 target gene, herein designated TARGET GENE. LOC284665 BINDING SITE1 and LOC284665 BINDING SITE2 are target binding sites found in untranslated regions of mRNA encoded by LOC284665, corresponding to target binding sites such as BINDING SITE I, BINDING SITE II or BINDING SITE III of FIG. 8. Table 4 illustrates the complementarity of the nucleotide sequences of LOC284665 BINDING SITE1 and LOC284665 BINDING SITE2, designated SEQ ID:2955 and SEQ ID:10092 respectively, to the nucleotide sequence of GAM94 RNA, herein designated GAM RNA, also designated SEQ ID:332.

Another function of GAM94 is therefore inhibition of LOC284665 (Accession XP_211581.1). Accordingly, utilities of GAM94 include diagnosis, prevention and treatment of diseases and clinical conditions associated with LOC284665.

LOC284669 (Accession XP_211584.1) is another GAM94 target gene, herein designated TARGET GENE. LOC284669 BINDING SITE is a target binding site found in the 3' untranslated region of mRNA encoded by LOC284669, corresponding to a target binding site such as BINDING SITE I, BINDING SITE II or BINDING SITE III of FIG. 8. Table 4 illustrates the complementarity of the nucleotide sequences of LOC284669 BINDING SITE, designated SEQ ID:16579, to the nucleotide sequence of GAM94 RNA, herein designated GAM RNA, also designated SEQ ID:332.

Another function of GAM94 is therefore inhibition of LOC284669 (Accession XP_211584.1). Accordingly, utilities of GAM94 include diagnosis, prevention and treatment of diseases and clinical conditions associated with LOC284669.

LOC284671 (Accession XP_209313.2) is another GAM94 target gene, herein designated TARGET GENE. LOC284671 BINDING SITE is a target binding site found in the 5' untranslated region of mRNA encoded by LOC284671, corresponding to a target binding site such as BINDING SITE I, BINDING SITE II or BINDING SITE III of FIG. 8. Table 4 illustrates the complementarity of the nucleotide sequences of LOC284671 BINDING SITE, designated SEQ ID:11553, to the nucleotide sequence of GAM94 RNA, herein designated GAM RNA, also designated SEQ ID:332.

Another function of GAM94 is therefore inhibition of LOC284671 (Accession XP_209313.2). Accordingly, utilities of GAM94 include diagnosis, prevention and treatment of diseases and clinical conditions associated with LOC284671.

LOC284751 (Accession XP_211622.1) is another GAM94 target gene, herein designated TARGET GENE. LOC284751 BINDING SITE is a target binding site found in the 3' untranslated region of mRNA encoded by LOC284751, corresponding to a target binding site such as BINDING SITE I, BINDING SITE II or BINDING SITE III of FIG. 8. Table 4 illustrates the complementarity of the nucleotide sequences of LOC284751 BINDING SITE, designated SEQ ID:2392, to the nucleotide sequence of GAM94 RNA, herein designated GAM RNA, also designated SEQ ID:332.

Another function of GAM94 is therefore inhibition of LOC284751 (Accession XP_211622.1). Accordingly, utilities of GAM94 include diagnosis, prevention and treatment of diseases and clinical conditions associated with LOC284751.

LOC284810 (Accession XP_209368.1) is another GAM94 target gene, herein designated TARGET GENE. LOC284810 BINDING SITE is a target binding site found in the 3' untranslated region of mRNA encoded by LOC284810, corresponding to a target binding site such as BINDING SITE I, BINDING SITE II or BINDING SITE III of FIG. 8. Table 4 illustrates the complementarity of the nucleotide sequences of LOC284810 BINDING SITE, designated SEQ ID:8984, to the nucleotide sequence of GAM94 RNA, herein designated GAM RNA, also designated SEQ ID:332.

Another function of GAM94 is therefore inhibition of LOC284810 (Accession XP_209368.1). Accordingly, utilities of GAM94 include diagnosis, prevention and treatment of diseases and clinical conditions associated with LOC284810.

LOC284851 (Accession XP_211667.1) is another GAM94 target gene, herein designated TARGET GENE.

LOC284851 BINDING SITE is a target binding site found in the 3' untranslated region of mRNA encoded by LOC284851, corresponding to a target binding site such as BINDING SITE I, BINDING SITE II or BINDING SITE III of FIG. 8. Table 4 illustrates the complementarity of the nucleotide sequences of LOC284851 BINDING SITE, designated SEQ ID:15871, to the nucleotide sequence of GAM94 RNA, herein designated GAM RNA, also designated SEQ ID:332.

Another function of GAM94 is therefore inhibition of LOC284851 (Accession XP_211667.1). Accordingly, utilities of GAM94 include diagnosis, prevention and treatment of diseases and clinical conditions associated with LOC284851.

LOC284906 (Accession XP_209402.1) is another GAM94 target gene, herein designated TARGET GENE. LOC284906 BINDING SITE is a target binding site found in the 3' untranslated region of mRNA encoded by LOC284906, corresponding to a target binding site such as BINDING SITE I, BINDING SITE II or BINDING SITE III of FIG. 8. Table 4 illustrates the complementarity of the nucleotide sequences of LOC284906 BINDING SITE, designated SEQ ID:19372, to the nucleotide sequence of GAM94 RNA, herein designated GAM RNA, also designated SEQ ID:332.

Another function of GAM94 is therefore inhibition of LOC284906 (Accession XP_209402.1). Accordingly, utilities of GAM94 include diagnosis, prevention and treatment of diseases and clinical conditions associated with LOC284906.

LOC284907 (Accession XP_209397.1) is another GAM94 target gene, herein designated TARGET GENE. LOC284907 BINDING SITE is a target binding site found in the 3' untranslated region of mRNA encoded by LOC284907, corresponding to a target binding site such as BINDING SITE I, BINDING SITE II or BINDING SITE III of FIG. 8. Table 4 illustrates the complementarity of the nucleotide sequences of LOC284907 BINDING SITE, designated SEQ ID:15731, to the nucleotide sequence of GAM94 RNA, herein designated GAM RNA, also designated SEQ ID:332.

Another function of GAM94 is therefore inhibition of LOC284907 (Accession XP_209397.1). Accordingly, utilities of GAM94 include diagnosis, prevention and treatment of diseases and clinical conditions associated with LOC284907.

LOC284911 (Accession XP_211684.1) is another GAM94 target gene, herein designated TARGET GENE. LOC284911 BINDING SITE is a target binding site found in the 3' untranslated region of mRNA encoded by LOC284911, corresponding to a target binding site such as BINDING SITE I, BINDING SITE II or BINDING SITE III of FIG. 8. Table 4 illustrates the complementarity of the nucleotide sequences of LOC284911 BINDING SITE, designated SEQ ID:11375, to the nucleotide sequence of GAM94 RNA, herein designated GAM RNA, also designated SEQ ID:332.

Another function of GAM94 is therefore inhibition of LOC284911 (Accession XP_211684.1). Accordingly, utilities of GAM94 include diagnosis, prevention and treatment of diseases and clinical conditions associated with LOC284911.

LOC284925 (Accession XP_209414.1) is another GAM94 target gene, herein designated TARGET GENE. LOC284925 BINDING SITE is a target binding site found in the 3' untranslated region of mRNA encoded by LOC284925, corresponding to a target binding site such as BINDING SITE I, BINDING SITE II or BINDING SITE III of FIG. 8. Table 4 illustrates the complementarity of the nucleotide sequences of LOC284925 BINDING SITE, designated SEQ ID:14715, to the nucleotide sequence of GAM94 RNA, herein designated GAM RNA, also designated SEQ ID:332.

Another function of GAM94 is therefore inhibition of LOC284925 (Accession XP_209414.1). Accordingly, utilities of GAM94 include diagnosis, prevention and treatment of diseases and clinical conditions associated with LOC284925.

LOC284939 (Accession XP_211700.1) is another GAM94 target gene, herein designated TARGET GENE. LOC284939 BINDING SITE is a target binding site found in the 5' untranslated region of mRNA encoded by LOC284939, corresponding to a target binding site such as BINDING SITE I, BINDING SITE II or BINDING SITE III of FIG. 8. Table 4 illustrates the complementarity of the nucleotide sequences of LOC284939 BINDING SITE, designated SEQ ID:3044, to the nucleotide sequence of GAM94 RNA, herein designated GAM RNA, also designated SEQ ID:332.

Another function of GAM94 is therefore inhibition of LOC284939 (Accession XP_211700.1). Accordingly, utilities of GAM94 include diagnosis, prevention and treatment of diseases and clinical conditions associated with LOC284939.

LOC285043 (Accession XP_211742.1) is another GAM94 target gene, herein designated TARGET GENE. LOC285043 BINDING SITE1 and LOC285043 BINDING SITE2 are target binding sites found in untranslated regions of mRNA encoded by LOC285043, corresponding to target binding sites such as BINDING SITE I, BINDING SITE II or BINDING SITE III of FIG. 8. Table 4 illustrates the complementarity of the nucleotide sequences of LOC285043 BINDING SITE1 and LOC285043 BINDING SITE2, designated SEQ ID:1295 and SEQ ID:1869 respectively, to the nucleotide sequence of GAM94 RNA, herein designated GAM RNA, also designated SEQ ID:332.

Another function of GAM94 is therefore inhibition of LOC285043 (Accession XP_211742.1). Accordingly, utilities of GAM94 include diagnosis, prevention and treatment of diseases and clinical conditions associated with LOC285043.

LOC285123 (Accession XP_211773.1) is another GAM94 target gene, herein designated TARGET GENE. LOC285123 BINDING SITE is a target binding site found in the 3' untranslated region of mRNA encoded by LOC285123, corresponding to a target binding site such as BINDING SITE I, BINDING SITE II or BINDING SITE III of FIG. 8. Table 4 illustrates the complementarity of the nucleotide sequences of LOC285123 BINDING SITE, designated SEQ ID:13262, to the nucleotide sequence of GAM94 RNA, herein designated GAM RNA, also designated SEQ ID:332.

Another function of GAM94 is therefore inhibition of LOC285123 (Accession XP_211773.1). Accordingly, utilities of GAM94 include diagnosis, prevention and treatment of diseases and clinical conditions associated with LOC285123.

LOC285226 (Accession XP_209522.1) is another GAM94 target gene, herein designated TARGET GENE. LOC285226 BINDING SITE is a target binding site found in the 3' untranslated region of mRNA encoded by LOC285226, corresponding to a target binding site such as BINDING SITE I, BINDING SITE II or BINDING SITE III of FIG. 8. Table 4 illustrates the complementarity of the nucleotide sequences of LOC285226 BINDING SITE, designated SEQ ID:4047, to the nucleotide sequence of GAM94 RNA, herein designated GAM RNA, also designated SEQ ID:332.

Another function of GAM94 is therefore inhibition of LOC285226 (Accession XP_209522.1). Accordingly, utilities of GAM94 include diagnosis, prevention and treatment of diseases and clinical conditions associated with LOC285226.

LOC285256 (Accession XP_211818.1) is another GAM94 target gene, herein designated TARGET GENE. LOC285256 BINDING SITE is a target binding site found in the 3' untranslated region of mRNA encoded by LOC285256, corresponding to a target binding site such as BINDING SITE I, BINDING SITE II or BINDING SITE III of FIG. 8. Table 4 illustrates the complementarity of the nucleotide sequences of LOC285256 BINDING SITE, designated SEQ ID:19463, to the nucleotide sequence of GAM94 RNA, herein designated GAM RNA, also designated SEQ ID:332.

Another function of GAM94 is therefore inhibition of LOC285256 (Accession XP_211818.1). Accordingly, utilities of GAM94 include diagnosis, prevention and treatment of diseases and clinical conditions associated with LOC285256.

LOC285283 (Accession XP_208017.1) is another GAM94 target gene, herein designated TARGET GENE. LOC285283 BINDING SITE is a target binding site found in the 3' untranslated region of mRNA encoded by LOC285283, corresponding to a target binding site such as BINDING SITE I, BINDING SITE II or BINDING SITE III of FIG. 8. Table 4 illustrates the complementarity of the nucleotide sequences of LOC285283 BINDING SITE, designated SEQ ID:13463, to the nucleotide sequence of GAM94 RNA, herein designated GAM RNA, also designated SEQ ID:332.

Another function of GAM94 is therefore inhibition of LOC285283 (Accession XP_208017.1). Accordingly, utilities of GAM94 include diagnosis, prevention and treatment of diseases and clinical conditions associated with LOC285283.

LOC285329 (Accession XP_209569.1) is another GAM94 target gene, herein designated TARGET GENE. LOC285329 BINDING SITE is a target binding site found in the 3' untranslated region of mRNA encoded by LOC285329, corresponding to a target binding site such as BINDING SITE I, BINDING SITE II or BINDING SITE III of FIG. 8. Table 4 illustrates the complementarity of the nucleotide sequences of LOC285329 BINDING SITE, designated SEQ ID:3250, to the nucleotide sequence of GAM94 RNA, herein designated GAM RNA, also designated SEQ ID:332.

Another function of GAM94 is therefore inhibition of LOC285329 (Accession XP_209569.1). Accordingly, utilities of GAM94 include diagnosis, prevention and treatment of diseases and clinical conditions associated with LOC285329.

LOC285359 (Accession XP_211858.1) is another GAM94 target gene, herein designated TARGET GENE. LOC285359 BINDING SITE is a target binding site found in the 3' untranslated region of mRNA encoded by LOC285359, corresponding to a target binding site such as BINDING SITE I, BINDING SITE II or BINDING SITE III of FIG. 8. Table 4 illustrates the complementarity of the nucleotide sequences of LOC285359 BINDING SITE, designated SEQ ID:18819, to the nucleotide sequence of GAM94 RNA, herein designated GAM RNA, also designated SEQ ID:332.

Another function of GAM94 is therefore inhibition of LOC285359 (Accession XP_211858.1). Accordingly, utilities of GAM94 include diagnosis, prevention and treatment of diseases and clinical conditions associated with LOC285359.

LOC285376 (Accession XP_211864.1) is another GAM94 target gene, herein designated TARGET GENE. LOC285376 BINDING SITE1 and LOC285376 BINDING SITE2 are target binding sites found in untranslated regions of mRNA encoded by LOC285376, corresponding to target binding sites such as BINDING SITE I, BINDING SITE II or BINDING SITE III of FIG. 8. Table 4 illustrates the complementarity of the nucleotide sequences of LOC285376 BINDING SITE1 and LOC285376 BINDING SITE2, designated SEQ ID:4042 and SEQ ID:10455 respectively, to the nucleotide sequence of GAM94 RNA, herein designated GAM RNA, also designated SEQ ID:332.

Another function of GAM94 is therefore inhibition of LOC285376 (Accession XP_211864.1). Accordingly, utilities of GAM94 include diagnosis, prevention and treatment of diseases and clinical conditions associated with LOC285376.

LOC285408 (Accession XP_211886.3) is another GAM94 target gene, herein designated TARGET GENE. LOC285408 BINDING SITE is a target binding site found in the 5' untranslated region of mRNA encoded by LOC285408, corresponding to a target binding site such as BINDING SITE I, BINDING SITE II or BINDING SITE III of FIG. 8. Table 4 illustrates the complementarity of the nucleotide sequences of LOC285408 BINDING SITE, designated SEQ ID:19174, to the nucleotide sequence of GAM94 RNA, herein designated GAM RNA, also designated SEQ ID:332.

Another function of GAM94 is therefore inhibition of LOC285408 (Accession XP_211886.3). Accordingly, utilities of GAM94 include diagnosis, prevention and treatment of diseases and clinical conditions associated with LOC285408.

LOC285561 (Accession XP_211940.1) is another GAM94 target gene, herein designated TARGET GENE. LOC285561 BINDING SITE is a target binding site found in the 5' untranslated region of mRNA encoded by LOC285561, corresponding to a target binding site such as BINDING SITE I, BINDING SITE II or BINDING SITE III of FIG. 8. Table 4 illustrates the complementarity of the nucleotide sequences of LOC285561 BINDING SITE, designated SEQ ID:4265, to the nucleotide sequence of GAM94 RNA, herein designated GAM RNA, also designated SEQ ID:332.

Another function of GAM94 is therefore inhibition of LOC285561 (Accession XP_211940.1). Accordingly, utilities of GAM94 include diagnosis, prevention and treatment of diseases and clinical conditions associated with LOC285561.

LOC285581 (Accession XP_211942.1) is another GAM94 target gene, herein designated TARGET GENE. LOC285581 BINDING SITE is a target binding site found in the 3' untranslated region of mRNA encoded by LOC285581, corresponding to a target binding site such as BINDING SITE I, BINDING SITE II or BINDING SITE III of FIG. 8. Table 4 illustrates the complementarity of the nucleotide sequences of LOC285581 BINDING SITE, designated SEQ ID:2844, to the nucleotide sequence of GAM94 RNA, herein designated GAM RNA, also designated SEQ ID:332.

Another function of GAM94 is therefore inhibition of LOC285581 (Accession XP_211942.1). Accordingly, utilities of GAM94 include diagnosis, prevention and treatment of diseases and clinical conditions associated with LOC285581.

LOC285593 (Accession XP_211944.1) is another GAM94 target gene, herein designated TARGET GENE. LOC285593 BINDING SITE is a target binding site found in the 5' untranslated region of mRNA encoded by LOC285593, corresponding to a target binding site such as BINDING SITE I, BINDING SITE II or BINDING SITE III of FIG. 8. Table 4 illustrates the complementarity of the nucleotide sequences of LOC285593 BINDING SITE, designated SEQ ID:18196, to the nucleotide sequence of GAM94 RNA, herein designated GAM RNA, also designated SEQ ID:332.

Another function of GAM94 is therefore inhibition of LOC285593 (Accession XP_211944.1). Accordingly, utilities of GAM94 include diagnosis, prevention and treatment of diseases and clinical conditions associated with LOC285593.

LOC285626 (Accession XP_211959.1) is another GAM94 target gene, herein designated TARGET GENE. LOC285626 BINDING SITE is a target binding site found in the 5' untranslated region of mRNA encoded by LOC285626, corresponding to a target binding site such as BINDING SITE I, BINDING SITE II or BINDING SITE III of FIG. 8. Table 4 illustrates the complementarity of the nucleotide sequences of LOC285626 BINDING SITE, designated SEQ ID:11670, to the nucleotide sequence of GAM94 RNA, herein designated GAM RNA, also designated SEQ ID:332.

Another function of GAM94 is therefore inhibition of LOC285626 (Accession XP_211959.1). Accordingly, utilities of GAM94 include diagnosis, prevention and treatment of diseases and clinical conditions associated with LOC285626.

LOC285719 (Accession XP_211990.1) is another GAM94 target gene, herein designated TARGET GENE. LOC285719 BINDING SITE1 and LOC285719 BINDING SITE2 are target binding sites found in untranslated regions of mRNA encoded by LOC285719, corresponding to target binding sites such as BINDING SITE I, BINDING SITE II or BINDING SITE III of FIG. 8. Table 4 illustrates the complementarity of the nucleotide sequences of LOC285719 BINDING SITE1 and LOC285719 BINDING SITE2, designated SEQ ID:16194 and SEQ ID:13781 respectively, to the nucleotide sequence of GAM94 RNA, herein designated GAM RNA, also designated SEQ ID:332.

Another function of GAM94 is therefore inhibition of LOC285719 (Accession XP_211990.1). Accordingly, utilities of GAM94 include diagnosis, prevention and treatment of diseases and clinical conditions associated with LOC285719.

LOC285727 (Accession XP_212000.1) is another GAM94 target gene, herein designated TARGET GENE. LOC285727 BINDING SITE is a target binding site found in the 3' untranslated region of mRNA encoded by LOC285727, corresponding to a target binding site such as BINDING SITE I, BINDING SITE II or BINDING SITE III of FIG. 8. Table 4 illustrates the complementarity of the nucleotide sequences of LOC285727 BINDING SITE, designated SEQ ID:9830, to the nucleotide sequence of GAM94 RNA, herein designated GAM RNA, also designated SEQ ID:332.

Another function of GAM94 is therefore inhibition of LOC285727 (Accession XP_212000.1). Accordingly, utilities of GAM94 include diagnosis, prevention and treatment of diseases and clinical conditions associated with LOC285727.

LOC285737 (Accession XP_208346.1) is another GAM94 target gene, herein designated TARGET GENE. LOC285737 BINDING SITE is a target binding site found in the 3' untranslated region of mRNA encoded by LOC285737, corresponding to a target binding site such as BINDING SITE I, BINDING SITE II or BINDING SITE III of FIG. 8. Table 4 illustrates the complementarity of the nucleotide sequences of LOC285737 BINDING SITE, designated SEQ ID:19245, to the nucleotide sequence of GAM94 RNA, herein designated GAM RNA, also designated SEQ ID:332.

Another function of GAM94 is therefore inhibition of LOC285737 (Accession XP_208346.1). Accordingly, utilities of GAM94 include diagnosis, prevention and treatment of diseases and clinical conditions associated with LOC285737.

LOC285744 (Accession XP_209743.1) is another GAM94 target gene, herein designated TARGET GENE. LOC285744 BINDING SITE is a target binding site found in the 3' untranslated region of mRNA encoded by LOC285744, corresponding to a target binding site such as BINDING SITE I, BINDING SITE II or BINDING SITE III of FIG. 8. Table 4 illustrates the complementarity of the nucleotide sequences of LOC285744 BINDING SITE, designated SEQ ID:14530, to the nucleotide sequence of GAM94 RNA, herein designated GAM RNA, also designated SEQ ID:332.

Another function of GAM94 is therefore inhibition of LOC285744 (Accession XP_209743.1). Accordingly, utilities of GAM94 include diagnosis, prevention and treatment of diseases and clinical conditions associated with LOC285744.

LOC285769 (Accession XP_209755.1) is another GAM94 target gene, herein designated TARGET GENE. LOC285769 BINDING SITE is a target binding site found in the 3' untranslated region of mRNA encoded by LOC285769, corresponding to a target binding site such as BINDING SITE I, BINDING SITE II or BINDING SITE III of FIG. 8. Table 4 illustrates the complementarity of the nucleotide sequences of LOC285769 BINDING SITE, designated SEQ ID:10416, to the nucleotide sequence of GAM94 RNA, herein designated GAM RNA, also designated SEQ ID:332.

Another function of GAM94 is therefore inhibition of LOC285769 (Accession XP_209755.1). Accordingly, utilities of GAM94 include diagnosis, prevention and treatment of diseases and clinical conditions associated with LOC285769.

LOC285778 (Accession XP_209756.1) is another GAM94 target gene, herein designated TARGET GENE. LOC285778 BINDING SITE is a target binding site found in the 3' untranslated region of mRNA encoded by LOC285778, corresponding to a target binding site such as BINDING SITE I, BINDING SITE II or BINDING SITE III of FIG. 8. Table 4 illustrates the complementarity of the nucleotide sequences of LOC285778 BINDING SITE, designated SEQ ID:3549, to the nucleotide sequence of GAM94 RNA, herein designated GAM RNA, also designated SEQ ID:332.

Another function of GAM94 is therefore inhibition of LOC285778 (Accession XP_209756.1). Accordingly, utilities of GAM94 include diagnosis, prevention and treatment of diseases and clinical conditions associated with LOC285778.

LOC285781 (Accession XP_212018.1) is another GAM94 target gene, herein designated TARGET GENE. LOC285781 BINDING SITE is a target binding site found in the 5' untranslated region of mRNA encoded by LOC285781, corresponding to a target binding site such as BINDING SITE I, BINDING SITE II or BINDING SITE III of FIG. 8. Table 4 illustrates the complementarity of the nucleotide sequences of LOC285781 BINDING SITE, designated SEQ ID:12982, to the nucleotide sequence of GAM94 RNA, herein designated GAM RNA, also designated SEQ ID:332.

Another function of GAM94 is therefore inhibition of LOC285781 (Accession XP_212018.1). Accordingly, utilities of GAM94 include diagnosis, prevention and treatment of diseases and clinical conditions associated with LOC285781.

LOC285806 (Accession XP_212028.1) is another GAM94 target gene, herein designated TARGET GENE. LOC285806 BINDING SITE is a target binding site found in the 3' untranslated region of mRNA encoded by LOC285806, corresponding to a target binding site such as BINDING SITE I, BINDING SITE II or BINDING SITE III of FIG. 8. Table 4 illustrates the complementarity of the nucleotide sequences of LOC285806 BINDING SITE, designated SEQ ID:3350, to the nucleotide sequence of GAM94 RNA, herein designated GAM RNA, also designated SEQ ID:332.

Another function of GAM94 is therefore inhibition of LOC285806 (Accession XP_212028.1). Accordingly, utilities of GAM94 include diagnosis, prevention and treatment of diseases and clinical conditions associated with LOC285806.

LOC285854 (Accession XP_209770.1) is another GAM94 target gene, herein designated TARGET GENE. LOC285854 BINDING SITE is a target binding site found in the 3' untranslated region of mRNA encoded by LOC285854, corresponding to a target binding site such as BINDING SITE I, BINDING SITE II or BINDING SITE III of FIG. 8. Table 4 illustrates the complementarity of the nucleotide sequences of LOC285854 BINDING SITE, designated SEQ ID:10315, to the nucleotide sequence of GAM94 RNA, herein designated GAM RNA, also designated SEQ ID:332.

Another function of GAM94 is therefore inhibition of LOC285854 (Accession XP_209770.1). Accordingly, utilities of GAM94 include diagnosis, prevention and treatment of diseases and clinical conditions associated with LOC285854.

LOC285933 (Accession XP_212102.1) is another GAM94 target gene, herein designated TARGET GENE. LOC285933 BINDING SITE is a target binding site found in the 3' untranslated region of mRNA encoded by LOC285933, corresponding to a target binding site such as BINDING SITE I, BINDING SITE II or BINDING SITE III of FIG. 8. Table 4 illustrates the complementarity of the nucleotide sequences of LOC285933 BINDING SITE, designated SEQ ID:1456, to the nucleotide sequence of GAM94 RNA, herein designated GAM RNA, also designated SEQ ID:332.

Another function of GAM94 is therefore inhibition of LOC285933 (Accession XP_212102.1). Accordingly, utilities of GAM94 include diagnosis, prevention and treatment of diseases and clinical conditions associated with LOC285933.

LOC286008 (Accession XP_212134.1) is another GAM94 target gene, herein designated TARGET GENE. LOC286008 BINDING SITE is a target binding site found in the 3' untranslated region of mRNA encoded by LOC286008, corresponding to a target binding site such as BINDING SITE I, BINDING SITE II or BINDING SITE III of FIG. 8. Table 4 illustrates the complementarity of the nucleotide sequences of LOC286008 BINDING SITE, designated SEQ ID:7067, to the nucleotide sequence of GAM94 RNA, herein designated GAM RNA, also designated SEQ ID:332.

Another function of GAM94 is therefore inhibition of LOC286008 (Accession XP_212134.1). Accordingly, utilities of GAM94 include diagnosis, prevention and treatment of diseases and clinical conditions associated with LOC286008.

LOC286046 (Accession NP_775954.1) is another GAM94 target gene, herein designated TARGET GENE. LOC286046 BINDING SITE is a target binding site found in the 3' untranslated region of mRNA encoded by LOC286046, corresponding to a target binding site such as BINDING SITE I, BINDING SITE II or BINDING SITE III of FIG. 8. Table 4 illustrates the complementarity of the nucleotide sequences of LOC286046 BINDING SITE, designated SEQ ID:2256, to the nucleotide sequence of GAM94 RNA, herein designated GAM RNA, also designated SEQ ID:332.

Another function of GAM94 is therefore inhibition of LOC286046 (Accession NP_775954.1). Accordingly, utilities of GAM94 include diagnosis, prevention and treatment of diseases and clinical conditions associated with LOC286046.

LOC286059 (Accession XP_212156.1) is another GAM94 target gene, herein designated TARGET GENE. LOC286059 BINDING SITE1 and LOC286059 BINDING SITE2 are target binding sites found in untranslated regions of mRNA encoded by LOC286059, corresponding to target binding sites such as BINDING SITE I, BINDING SITE II or BINDING SITE III of FIG. 8. Table 4 illustrates the complementarity of the nucleotide sequences of LOC286059 BINDING SITE1 and LOC286059 BINDING SITE2, designated SEQ ID:5125 and SEQ ID:12587 respectively, to the nucleotide sequence of GAM94 RNA, herein designated GAM RNA, also designated SEQ ID:332.

Another function of GAM94 is therefore inhibition of LOC286059 (Accession XP_212156.1). Accordingly, utilities of GAM94 include diagnosis, prevention and treatment of diseases and clinical conditions associated with LOC286059.

LOC286131 (Accession XP_210719.1) is another GAM94 target gene, herein designated TARGET GENE. LOC286131 BINDING SITE is a target binding site found in the 5' untranslated region of mRNA encoded by LOC286131, corresponding to a target binding site such as BINDING SITE I, BINDING SITE II or BINDING SITE III of FIG. 8. Table 4 illustrates the complementarity of the nucleotide sequences of LOC286131 BINDING SITE, designated SEQ ID:20048, to the nucleotide sequence of GAM94 RNA, herein designated GAM RNA, also designated SEQ ID:332.

Another function of GAM94 is therefore inhibition of LOC286131 (Accession XP_210719.1). Accordingly, utilities of GAM94 include diagnosis, prevention and treatment of diseases and clinical conditions associated with LOC286131.

LOC286180 (Accession XP_212213.1) is another GAM94 target gene, herein designated TARGET GENE. LOC286180 BINDING SITE is a target binding site found in the 3' untranslated region of mRNA encoded by LOC286180, corresponding to a target binding site such as BINDING SITE I, BINDING SITE II or BINDING SITE III of FIG. 8. Table 4 illustrates the complementarity of the nucleotide sequences of LOC286180 BINDING SITE, designated SEQ ID:17161, to the nucleotide sequence of GAM94 RNA, herein designated GAM RNA, also designated SEQ ID:332.

Another function of GAM94 is therefore inhibition of LOC286180 (Accession XP_212213.1). Accordingly, utilities of GAM94 include diagnosis, prevention and treatment of diseases and clinical conditions associated with LOC286180.

LOC286188 (Accession XP_209933.1) is another GAM94 target gene, herein designated TARGET GENE. LOC286188 BINDING SITE1 and LOC286188 BINDING SITE2 are target binding sites found in untranslated regions of mRNA encoded by LOC286188, corresponding to target binding sites such as BINDING SITE I, BINDING SITE II or BINDING SITE III of FIG. 8. Table 4 illustrates the complementarity of the nucleotide sequences of LOC286188 BINDING SITE1 and LOC286188 BINDING SITE2, designated SEQ ID:3917 and SEQ ID:12855 respectively, to the nucleotide sequence of GAM94 RNA, herein designated GAM RNA, also designated SEQ ID:332.

Another function of GAM94 is therefore inhibition of LOC286188 (Accession XP_209933.1). Accordingly, utilities of GAM94 include diagnosis, prevention and treatment of diseases and clinical conditions associated with LOC286188.

LOC286206 (Accession XP_209953.1) is another GAM94 target gene, herein designated TARGET GENE. LOC286206 BINDING SITE is a target binding site found in the 3' untranslated region of mRNA encoded by LOC286206, corresponding to a target binding site such as BINDING SITE I, BINDING SITE II or BINDING SITE III of FIG. 8. Table 4 illustrates the complementarity of the nucleotide sequences of LOC286206 BINDING SITE, designated SEQ ID:2441, to the nucleotide sequence of GAM94 RNA, herein designated GAM RNA, also designated SEQ ID:332.

Another function of GAM94 is therefore inhibition of LOC286206 (Accession XP_209953.1). Accordingly, utilities of GAM94 include diagnosis, prevention and treatment of diseases and clinical conditions associated with LOC286206.

LOC286235 (Accession XP_212238.1) is another GAM94 target gene, herein designated TARGET GENE. LOC286235 BINDING SITE is a target binding site found in the 3' untranslated region of mRNA encoded by LOC286235, corresponding to a target binding site such as BINDING SITE I, BINDING SITE II or BINDING SITE III of FIG. 8. Table 4 illustrates the complementarity of the nucleotide sequences of LOC286235 BINDING SITE, designated SEQ ID:15563, to the nucleotide sequence of GAM94 RNA, herein designated GAM RNA, also designated SEQ ID:332.

Another function of GAM94 is therefore inhibition of LOC286235 (Accession XP_212238.1). Accordingly, utilities of GAM94 include diagnosis, prevention and treatment of diseases and clinical conditions associated with LOC286235.

LOC286359 (Accession XP_212288.1) is another GAM94 target gene, herein designated TARGET GENE. LOC286359 BINDING SITE is a target binding site found in the 3' untranslated region of mRNA encoded by LOC286359, corresponding to a target binding site such as BINDING SITE I, BINDING SITE II or BINDING SITE III of FIG. 8. Table 4 illustrates the complementarity of the nucleotide sequences of LOC286359 BINDING SITE, designated SEQ ID:12006, to the nucleotide sequence of GAM94 RNA, herein designated GAM RNA, also designated SEQ ID:332.

Another function of GAM94 is therefore inhibition of LOC286359 (Accession XP_212288.1). Accordingly, utilities of GAM94 include diagnosis, prevention and treatment of diseases and clinical conditions associated with LOC286359.

LOC286395 (Accession XP_212308.1) is another GAM94 target gene, herein designated TARGET GENE. LOC286395 BINDING SITE is a target binding site found in the 5' untranslated region of mRNA encoded by LOC286395, corresponding to a target binding site such as BINDING SITE I, BINDING SITE II or BINDING SITE III of FIG. 8. Table 4 illustrates the complementarity of the nucleotide sequences of LOC286395 BINDING SITE, designated SEQ ID:7767, to the nucleotide sequence of GAM94 RNA, herein designated GAM RNA, also designated SEQ ID:332.

Another function of GAM94 is therefore inhibition of LOC286395 (Accession XP_212308.1). Accordingly, utilities of GAM94 include diagnosis, prevention and treatment of diseases and clinical conditions associated with LOC286395.

LOC286421 (Accession XP_212313.1) is another GAM94 target gene, herein designated TARGET GENE. LOC286421 BINDING SITE is a target binding site found in the 5' untranslated region of mRNA encoded by LOC286421, corresponding to a target binding site such as BINDING SITE I, BINDING SITE II or BINDING SITE III of FIG. 8. Table 4 illustrates the complementarity of the nucleotide sequences of LOC286421 BINDING SITE, designated SEQ ID:15065, to the nucleotide sequence of GAM94 RNA, herein designated GAM RNA, also designated SEQ ID:332.

Another function of GAM94 is therefore inhibition of LOC286421 (Accession XP_212313.1). Accordingly, utilities of GAM94 include diagnosis, prevention and treatment of diseases and clinical conditions associated with LOC286421.

LOC286430 (Accession XP_210044.1) is another GAM94 target gene, herein designated TARGET GENE. LOC286430 BINDING SITE is a target binding site found in the 3' untranslated region of mRNA encoded by LOC286430, corresponding to a target binding site such as BINDING SITE I, BINDING SITE II or BINDING SITE III of FIG. 8. Table 4 illustrates the complementarity of the nucleotide sequences of LOC286430 BINDING SITE, designated SEQ ID:9648, to the nucleotide sequence of GAM94 RNA, herein designated GAM RNA, also designated SEQ ID:332.

Another function of GAM94 is therefore inhibition of LOC286430 (Accession XP_210044.1). Accordingly, utilities of GAM94 include diagnosis, prevention and treatment of diseases and clinical conditions associated with LOC286430.

LOC286448 (Accession XP_212322.1) is another GAM94 target gene, herein designated TARGET GENE. LOC286448 BINDING SITE is a target binding site found in the 3' untranslated region of mRNA encoded by LOC286448, corresponding to a target binding site such as BINDING SITE I, BINDING SITE II or BINDING SITE III of FIG. 8. Table 4 illustrates the complementarity of the nucleotide sequences of LOC286448 BINDING SITE, designated SEQ ID:15291, to the nucleotide sequence of GAM94 RNA, herein designated GAM RNA, also designated SEQ ID:332.

Another function of GAM94 is therefore inhibition of LOC286448 (Accession XP_212322.1). Accordingly, utilities of GAM94 include diagnosis, prevention and treatment of diseases and clinical conditions associated with LOC286448.

LOC286449 (Accession XP_212321.1) is another GAM94 target gene, herein designated TARGET GENE. LOC286449 BINDING SITE is a target binding site found in the 5' untranslated region of mRNA encoded by LOC286449, corresponding to a target binding site such as BINDING SITE I, BINDING SITE II or BINDING SITE III of FIG. 8. Table 4 illustrates the complementarity of the nucleotide sequences of LOC286449 BINDING SITE, designated SEQ ID:4136, to the nucleotide sequence of GAM94 RNA, herein designated GAM RNA, also designated SEQ ID:332.

Another function of GAM94 is therefore inhibition of LOC286449 (Accession XP_212321.1). Accordingly, utilities of GAM94 include diagnosis, prevention and treatment of diseases and clinical conditions associated with LOC286449.

LOC286545 (Accession XP_208450.1) is another GAM94 target gene, herein designated TARGET GENE. LOC286545 BINDING SITE is a target binding site found in the 3' untranslated region of mRNA encoded by LOC286545, corresponding to a target binding site such as BINDING SITE I, BINDING SITE II or BINDING SITE III of FIG. 8. Table 4 illustrates the complementarity of the nucleotide sequences of LOC286545 BINDING SITE, designated SEQ ID:1891, to the nucleotide sequence of GAM94 RNA, herein designated GAM RNA, also designated SEQ ID:332.

Another function of GAM94 is therefore inhibition of LOC286545 (Accession XP_208450.1). Accordingly, utilities of GAM94 include diagnosis, prevention and treatment of diseases and clinical conditions associated with LOC286545.

LOC338562 (Accession XP_294654.1) is another GAM94 target gene, herein designated TARGET GENE. LOC338562 BINDING SITE is a target binding site found in the 3' untranslated region of mRNA encoded by LOC338562, corresponding to a target binding site such as BINDING SITE I, BINDING SITE II or BINDING SITE III of FIG. 8. Table 4 illustrates the complementarity of the nucleotide sequences of LOC338562 BINDING SITE, designated SEQ ID:20131, to the nucleotide sequence of GAM94 RNA, herein designated GAM RNA, also designated SEQ ID:332.

Another function of GAM94 is therefore inhibition of LOC338562 (Accession XP_294654.1). Accordingly, utilities of GAM94 include diagnosis, prevention and treatment of diseases and clinical conditions associated with LOC338562.

LOC338607 (Accession XP_294661.1) is another GAM94 target gene, herein designated TARGET GENE. LOC338607 BINDING SITE is a target binding site found in the 5' untranslated region of mRNA encoded by LOC338607, corresponding to a target binding site such as BINDING SITE I, BINDING SITE II or BINDING SITE III of FIG. 8. Table 4 illustrates the complementarity of the nucleotide sequences of LOC338607 BINDING SITE, designated SEQ ID:7298, to the nucleotide sequence of GAM94 RNA, herein designated GAM RNA, also designated SEQ ID:332.

Another function of GAM94 is therefore inhibition of LOC338607 (Accession XP_294661.1). Accordingly, utilities of GAM94 include diagnosis, prevention and treatment of diseases and clinical conditions associated with LOC338607.

LOC338707 (Accession XP_290534.1) is another GAM94 target gene, herein designated TARGET GENE. LOC338707 BINDING SITE is a target binding site found in the 5' untranslated region of mRNA encoded by LOC338707, corresponding to a target binding site such as BINDING SITE I, BINDING SITE II or BINDING SITE III of FIG. 8. Table 4 illustrates the complementarity of the nucleotide sequences of LOC338707 BINDING SITE, designated SEQ ID:16308, to the nucleotide sequence of GAM94 RNA, herein designated GAM RNA, also designated SEQ ID:332.

Another function of GAM94 is therefore inhibition of LOC338707 (Accession XP_290534.1). Accordingly, utilities of GAM94 include diagnosis, prevention and treatment of diseases and clinical conditions associated with LOC338707.

LOC338739 (Accession XP_294690.1) is another GAM94 target gene, herein designated TARGET GENE. LOC338739 BINDING SITE is a target binding site found in the 3' untranslated region of mRNA encoded by LOC338739, corresponding to a target binding site such as BINDING SITE I, BINDING SITE II or BINDING SITE III of FIG. 8. Table 4 illustrates the complementarity of the nucleotide sequences of LOC338739 BINDING SITE, designated SEQ ID:18110, to the nucleotide sequence of GAM94 RNA, herein designated GAM RNA, also designated SEQ ID:332.

Another function of GAM94 is therefore inhibition of LOC338739 (Accession XP_294690.1). Accordingly, utilities of GAM94 include diagnosis, prevention and treatment of diseases and clinical conditions associated with LOC338739.

LOC338817 (Accession XP_290588.1) is another GAM94 target gene, herein designated TARGET GENE. LOC338817 BINDING SITE is a target binding site found in the 3' untranslated region of mRNA encoded by LOC338817, corresponding to a target binding site such as BINDING SITE I, BINDING SITE II or BINDING SITE III of FIG. 8. Table 4 illustrates the complementarity of the nucleotide sequences of LOC338817 BINDING SITE, designated SEQ ID:19080, to the nucleotide sequence of GAM94 RNA, herein designated GAM RNA, also designated SEQ ID:332.

Another function of GAM94 is therefore inhibition of LOC338817 (Accession XP_290588.1). Accordingly, utilities of GAM94 include diagnosis, prevention and treatment of diseases and clinical conditions associated with LOC338817.

LOC338819 (Accession XP_290216.1) is another GAM94 target gene, herein designated TARGET GENE. LOC338819 BINDING SITE1 and LOC338819 BINDING SITE2 are target binding sites found in untranslated regions of mRNA encoded by LOC338819, corresponding to target binding sites such as BINDING SITE I, BINDING SITE II or BINDING SITE III of FIG. 8. Table 4 illustrates the complementarity of the nucleotide sequences of LOC338819 BINDING SITE1 and LOC338819 BINDING SITE2, designated SEQ ID:12463 and SEQ ID:6696 respectively, to the nucleotide sequence of GAM94 RNA, herein designated GAM RNA, also designated SEQ ID:332.

Another function of GAM94 is therefore inhibition of LOC338819 (Accession XP_290216.1). Accordingly, utilities of GAM94 include diagnosis, prevention and treatment of diseases and clinical conditions associated with LOC338819.

LOC338963 (Accession XP_294757.1) is another GAM94 target gene, herein designated TARGET GENE. LOC338963 BINDING SITE is a target binding site found in the 5' untranslated region of mRNA encoded by LOC338963, corresponding to a target binding site such as BINDING SITE I, BINDING SITE II or BINDING SITE III of FIG. 8. Table 4 illustrates the complementarity of the nucleotide sequences of LOC338963 BINDING SITE, designated SEQ ID:9380, to the nucleotide sequence of GAM94 RNA, herein designated GAM RNA, also designated SEQ ID:332.

Another function of GAM94 is therefore inhibition of LOC338963 (Accession XP_294757.1). Accordingly, utilities of GAM94 include diagnosis, prevention and treatment of diseases and clinical conditions associated with LOC338963.

LOC338969 (Accession XP_290223.1) is another GAM94 target gene, herein designated TARGET GENE. LOC338969 BINDING SITE is a target binding site found in the 5' untranslated region of mRNA encoded by LOC338969, corresponding to a target binding site such as BINDING SITE I, BINDING SITE II or BINDING SITE III of FIG. 8. Table 4 illustrates the complementarity of the nucleotide sequences of LOC338969 BINDING SITE, designated SEQ ID:6827, to the nucleotide sequence of GAM94 RNA, herein designated GAM RNA, also designated SEQ ID:332.

Another function of GAM94 is therefore inhibition of LOC338969 (Accession XP_290223.1). Accordingly, utilities of GAM94 include diagnosis, prevention and treatment of diseases and clinical conditions associated with LOC338969.

LOC338971 (Accession XP_208845.3) is another GAM94 target gene, herein designated TARGET GENE. LOC338971 BINDING SITE is a target binding site found in the 5' untranslated region of mRNA encoded by LOC338971, corresponding to a target binding site such as BINDING SITE I, BINDING SITE II or BINDING SITE III of FIG. 8. Table 4 illustrates the complementarity of the nucleotide sequences of LOC338971 BINDING SITE, designated SEQ ID:8072, to the nucleotide sequence of GAM94 RNA, herein designated GAM RNA, also designated SEQ ID:332.

Another function of GAM94 is therefore inhibition of LOC338971 (Accession XP_208845.3). Accordingly, utilities of GAM94 include diagnosis, prevention and treatment of diseases and clinical conditions associated with LOC338971.

LOC338976 (Accession XP_294762.1) is another GAM94 target gene, herein designated TARGET GENE. LOC338976 BINDING SITE is a target binding site found in the 5' untranslated region of mRNA encoded by LOC338976, corresponding to a target binding site such as BINDING SITE I, BINDING SITE II or BINDING SITE III of FIG. 8. Table 4 illustrates the complementarity of the nucleotide sequences of LOC338976 BINDING SITE, designated SEQ ID:4715, to the nucleotide sequence of GAM94 RNA, herein designated GAM RNA, also designated SEQ ID:332.

Another function of GAM94 is therefore inhibition of LOC338976 (Accession XP_294762.1). Accordingly, utilities of GAM94 include diagnosis, prevention and treatment of diseases and clinical conditions associated with LOC338976.

LOC338991 (Accession XP_290663.1) is another GAM94 target gene, herein designated TARGET GENE. LOC338991 BINDING SITE is a target binding site found in the 5' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:8147, to the nucleotide sequence of GAM94 RNA, herein designated GAM RNA, also designated SEQ ID:332.

Another function of GAM94 is therefore inhibition of LOC338991 (Accession XP_290663.1). Accordingly, utilities of GAM94 include diagnosis, prevention and treatment of diseases and clinical conditions associated with LOC338991.

LOC338999 (Accession XP_290659.1) is another GAM94 target gene, herein designated TARGET GENE. LOC338999 BINDING SITE is a target binding site found in the 5' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:17003, to the nucleotide sequence of GAM94 RNA, herein designated GAM RNA, also designated SEQ ID:332.

Another function of GAM94 is therefore inhibition of LOC338999 (Accession XP_290659.1). Accordingly, utilities of GAM94 include diagnosis, prevention and treatment of diseases and clinical conditions associated with LOC338999.

LOC339022 (Accession XP_294775.1) is another GAM94 target gene, herein designated TARGET GENE. LOC339022 BINDING SITE is a target binding site found in the 3' untranslated region of mRNA encoded by LOC339022, corresponding to a target binding site such as BINDING SITE I, BINDING SITE II or BINDING SITE III of FIG. 8. Table 4 illustrates the complementarity of the nucleotide sequences of LOC339022 BINDING SITE, designated SEQ ID:5473, to the nucleotide sequence of GAM94 RNA, herein designated GAM RNA, also designated SEQ ID:332.

Another function of GAM94 is therefore inhibition of LOC339022 (Accession XP_294775.1). Accordingly, utilities of GAM94 include diagnosis, prevention and treatment of diseases and clinical conditions associated with LOC339022.

LOC339071 (Accession XP_294800.1) is another GAM94 target gene, herein designated TARGET GENE. LOC339071 BINDING SITE is a target binding site found in the 5' untranslated region of mRNA encoded by LOC339071, corresponding to a target binding site such as BINDING SITE I, BINDING SITE II or BINDING SITE III of FIG. 8. Table 4 illustrates the complementarity of the nucleotide sequences of LOC339071 BINDING SITE, designated SEQ ID:6907, to the nucleotide sequence of GAM94 RNA, herein designated GAM RNA, also designated SEQ ID:332.

Another function of GAM94 is therefore inhibition of LOC339071 (Accession XP_294800.1). Accordingly, utilities of GAM94 include diagnosis, prevention and treatment of diseases and clinical conditions associated with LOC339071.

LOC339149 (Accession XP_294830.1) is another GAM94 target gene, herein designated TARGET GENE. LOC339149 BINDING SITE is a target binding site found in the 5' untranslated region of mRNA encoded by LOC339149, corresponding to a target binding site such as BINDING SITE I, BINDING SITE II or BINDING SITE III of FIG. 8. Table 4 illustrates the complementarity of the nucleotide sequences of LOC339149 BINDING SITE, designated SEQ ID:7097, to the nucleotide sequence of GAM94 RNA, herein designated GAM RNA, also designated SEQ ID:332.

Another function of GAM94 is therefore inhibition of LOC339149 (Accession XP_294830.1). Accordingly, utilities of GAM94 include diagnosis, prevention and treatment of diseases and clinical conditions associated with LOC339149.

LOC339173 (Accession XP_290741.1) is another GAM94 target gene, herein designated TARGET GENE. LOC339173 BINDING SITE is a target binding site found in the 3' untranslated region of mRNA encoded by LOC339173, corresponding to a target binding site such as BINDING SITE I, BINDING SITE II or BINDING SITE III of FIG. 8. Table 4 illustrates the complementarity of the nucleotide sequences of LOC339173 BINDING SITE, designated SEQ ID:14624, to the nucleotide sequence of GAM94 RNA, herein designated GAM RNA, also designated SEQ ID:332.

Another function of GAM94 is therefore inhibition of LOC339173 (Accession XP_290741.1). Accordingly, utilities of GAM94 include diagnosis, prevention and treatment of diseases and clinical conditions associated with LOC339173.

LOC339316 (Accession XP_294913.1) is another GAM94 target gene, herein designated TARGET GENE. LOC339316 BINDING SITE is a target binding site found in the 3' untranslated region of mRNA encoded by LOC339316, corresponding to a target binding site such as BINDING SITE I, BINDING SITE II or BINDING SITE III of FIG. 8. Table 4 illustrates the complementarity of the nucleotide sequences of LOC339316 BINDING SITE, designated SEQ ID:2772, to the nucleotide sequence of GAM94 RNA, herein designated GAM RNA, also designated SEQ ID:332.

Another function of GAM94 is therefore inhibition of LOC339316 (Accession XP_294913.1). Accordingly, utilities of GAM94 include diagnosis, prevention and treatment of diseases and clinical conditions associated with LOC339316.

LOC339361 (Accession XP_290824.1) is another GAM94 target gene, herein designated TARGET GENE. LOC339361 BINDING SITE is a target binding site found in the 3' untranslated region of mRNA encoded by LOC339361, corresponding to a target binding site such as BINDING SITE I, BINDING SITE II or BINDING SITE III of FIG. 8. Table 4 illustrates the complementarity of the nucleotide sequences of LOC339361 BINDING SITE, designated SEQ ID:17128, to the nucleotide sequence of GAM94 RNA, herein designated GAM RNA, also designated SEQ ID:332.

Another function of GAM94 is therefore inhibition of LOC339361 (Accession XP_290824.1). Accordingly, utilities of GAM94 include diagnosis, prevention and treatment of diseases and clinical conditions associated with LOC339361.

LOC339822 (Accession XP_295076.1) is another GAM94 target gene, herein designated TARGET GENE. LOC339822 BINDING SITE is a target binding site found in the 3' untranslated region of mRNA encoded by LOC339822, corresponding to a target binding site such as BINDING SITE I, BINDING SITE II or BINDING SITE III of FIG. 8. Table 4 illustrates the complementarity of the nucleotide sequences of LOC339822 BINDING SITE, designated SEQ ID:6920, to the nucleotide sequence of GAM94 RNA, herein designated GAM RNA, also designated SEQ ID:332.

Another function of GAM94 is therefore inhibition of LOC339822 (Accession XP_295076.1). Accordingly, utilities of GAM94 include diagnosis, prevention and treatment of diseases and clinical conditions associated with LOC339822.

LOC339827 (Accession XP_295078.1) is another GAM94 target gene, herein designated TARGET GENE. LOC339827 BINDING SITE is a target binding site found in the 3' untranslated region of mRNA encoded by LOC339827, corresponding to a target binding site such as BINDING SITE I, BINDING SITE II or BINDING SITE III of FIG. 8. Table 4 illustrates the complementarity of the nucleotide sequences of LOC339827 BINDING SITE, designated SEQ ID:5741, to the nucleotide sequence of GAM94 RNA, herein designated GAM RNA, also designated SEQ ID:332.

Another function of GAM94 is therefore inhibition of LOC339827 (Accession XP_295078.1). Accordingly, utilities of GAM94 include diagnosis, prevention and treatment of diseases and clinical conditions associated with LOC339827.

LOC339856 (Accession XP_295087.1) is another GAM94 target gene, herein designated TARGET GENE. LOC339856 BINDING SITE is a target binding site found in the 5' untranslated region of mRNA encoded by LOC339856, corresponding to a target binding site such as BINDING SITE I, BINDING SITE II or BINDING SITE III of FIG. 8. Table 4 illustrates the complementarity of the nucleotide sequences of LOC339856 BINDING SITE, designated SEQ ID:12966, to the nucleotide sequence of GAM94 RNA, herein designated GAM RNA, also designated SEQ ID:332.

Another function of GAM94 is therefore inhibition of LOC339856 (Accession XP_295087.1). Accordingly, utilities of GAM94 include diagnosis, prevention and treatment of diseases and clinical conditions associated with LOC339856.

LOC340073 (Accession XP_295149.1) is another GAM94 target gene, herein designated TARGET GENE. LOC340073 BINDING SITE is a target binding site found in the 5' untranslated region of mRNA encoded by LOC340073, corresponding to a target binding site such as BINDING SITE I, BINDING SITE II or BINDING SITE III of FIG. 8. Table 4 illustrates the complementarity of the nucleotide sequences of LOC340073 BINDING SITE, designated SEQ ID:2275, to the nucleotide sequence of GAM94 RNA, herein designated GAM RNA, also designated SEQ ID:332.

Another function of GAM94 is therefore inhibition of LOC340073 (Accession XP_295149.1). Accordingly, utilities of GAM94 include diagnosis, prevention and treatment of diseases and clinical conditions associated with LOC340073.

LOC340090 (Accession XP_295154.1) is another GAM94 target gene, herein designated TARGET GENE. LOC340090 BINDING SITE is a target binding site found in the 5' untranslated region of mRNA encoded by LOC340090, corresponding to a target binding site such as BINDING SITE I, BINDING SITE II or BINDING SITE III of FIG. 8. Table 4 illustrates the complementarity of the nucleotide sequences of LOC340090 BINDING SITE, designated SEQ ID:16277, to the nucleotide sequence of GAM94 RNA, herein designated GAM RNA, also designated SEQ ID:332.

Another function of GAM94 is therefore inhibition of LOC340090 (Accession XP_295154.1). Accordingly, utilities of GAM94 include diagnosis, prevention and treatment of diseases and clinical conditions associated with LOC340090.

LOC340095 (Accession XP_295160.1) is another GAM94 target gene, herein designated TARGET GENE. LOC340095 BINDING SITE is a target binding site found in the 3' untranslated region of mRNA encoded by LOC340095, corresponding to a target binding site such as BINDING SITE I, BINDING SITE II or BINDING SITE III of FIG. 8. Table 4 illustrates the complementarity of the nucleotide sequences of LOC340095 BINDING SITE, designated SEQ ID:17500, to the nucleotide sequence of GAM94 RNA, herein designated GAM RNA, also designated SEQ ID:332.

Another function of GAM94 is therefore inhibition of LOC340095 (Accession XP_295160.1). Accordingly, utilities of GAM94 include diagnosis, prevention and treatment of diseases and clinical conditions associated with LOC340095.

LOC340127 (Accession XP_290379.1) is another GAM94 target gene, herein designated TARGET GENE. LOC340127 BINDING SITE is a target binding site found in the 3' untranslated region of mRNA encoded by LOC340127, corresponding to a target binding site such as BINDING SITE I, BINDING SITE II or BINDING SITE III of FIG. 8. Table 4 illustrates the complementarity of the nucleotide sequences of LOC340127 BINDING SITE, designated SEQ ID:7442, to the nucleotide sequence of GAM94 RNA, herein designated GAM RNA, also designated SEQ ID:332.

Another function of GAM94 is therefore inhibition of LOC340127 (Accession XP_290379.1). Accordingly, utilities of GAM94 include diagnosis, prevention and treatment of diseases and clinical conditions associated with LOC340127.

LOC340184 (Accession XP_295183.1) is another GAM94 target gene, herein designated TARGET GENE. LOC340184 BINDING SITE is a target binding site found in the 3' untranslated region of mRNA encoded by LOC340184, corresponding to a target binding site such as BINDING SITE I, BINDING SITE II or BINDING SITE III of FIG. 8. Table 4 illustrates the complementarity of the nucleotide sequences of LOC340184 BINDING SITE, designated SEQ ID:5971, to the nucleotide sequence of GAM94 RNA, herein designated GAM RNA, also designated SEQ ID:332.

Another function of GAM94 is therefore inhibition of LOC340184 (Accession XP_295183.1). Accordingly, utilities of GAM94 include diagnosis, prevention and treatment of diseases and clinical conditions associated with LOC340184.

LOC340428 (Accession XP_290420.1) is another GAM94 target gene, herein designated TARGET GENE.

LOC340428 BINDING SITE1 through LOC340428 BINDING SITE3 are target binding sites found in untranslated regions of mRNA encoded by LOC340428, corresponding to target binding sites such as BINDING SITE I, BINDING SITE II or BINDING SITE III of FIG. 8. Table 4 illustrates the complementarity of the nucleotide sequences of LOC340428 BINDING SITE1 through LOC340428 BINDING SITE3, designated SEQ ID:15514, SEQ ID:4350 and SEQ ID:18623 respectively, to the nucleotide sequence of GAM94 RNA, herein designated GAM RNA, also designated SEQ ID:332.

Another function of GAM94 is therefore inhibition of LOC340428 (Accession XP_290420.1). Accordingly, utilities of GAM94 include diagnosis, prevention and treatment of diseases and clinical conditions associated with LOC340428.

LOC340449 (Accession XP_290424.2) is another GAM94 target gene, herein designated TARGET GENE. LOC340449 BINDING SITE is a target binding site found in the 3' untranslated region of mRNA encoded by LOC340449, corresponding to a target binding site such as BINDING SITE I, BINDING SITE II or BINDING SITE III of FIG. 8. Table 4 illustrates the complementarity of the nucleotide sequences of LOC340449 BINDING SITE, designated SEQ ID:2708, to the nucleotide sequence of GAM94 RNA, herein designated GAM RNA, also designated SEQ ID:332.

Another function of GAM94 is therefore inhibition of LOC340449 (Accession XP_290424.2). Accordingly, utilities of GAM94 include diagnosis, prevention and treatment of diseases and clinical conditions associated with LOC340449.

LOC340895 (Accession XP_295865.1) is another GAM94 target gene, herein designated TARGET GENE. LOC340895 BINDING SITE is a target binding site found in the 3' untranslated region of mRNA encoded by LOC340895, corresponding to a target binding site such as BINDING SITE I, BINDING SITE II or BINDING SITE III of FIG. 8. Table 4 illustrates the complementarity of the nucleotide sequences of LOC340895 BINDING SITE, designated SEQ ID:9851, to the nucleotide sequence of GAM94 RNA, herein designated GAM RNA, also designated SEQ ID:332.

Another function of GAM94 is therefore inhibition of LOC340895 (Accession XP_295865.1). Accordingly, utilities of GAM94 include diagnosis, prevention and treatment of diseases and clinical conditions associated with LOC340895.

LOC341692 (Accession XP_292171.1) is another GAM94 target gene, herein designated TARGET GENE. LOC341692 BINDING SITE is a target binding site found in the 5' untranslated region of mRNA encoded by LOC341692, corresponding to a target binding site such as BINDING SITE I, BINDING SITE II or BINDING SITE III of FIG. 8. Table 4 illustrates the complementarity of the nucleotide sequences of LOC341692 BINDING SITE, designated SEQ ID:998, to the nucleotide sequence of GAM94 RNA, herein designated GAM RNA, also designated SEQ ID:332.

Another function of GAM94 is therefore inhibition of LOC341692 (Accession XP_292171.1). Accordingly, utilities of GAM94 include diagnosis, prevention and treatment of diseases and clinical conditions associated with LOC341692.

LOC342125 (Accession XP_292375.1) is another GAM94 target gene, herein designated TARGET GENE. LOC342125 BINDING SITE1 through LOC342125 BINDING SITE4 are target binding sites found in untranslated regions of mRNA encoded by LOC342125, corresponding to target binding sites such as BINDING SITE I, BINDING SITE II or BINDING SITE III of FIG. 8. Table 4 illustrates the complementarity of the nucleotide sequences of LOC342125 BINDING SITE1 through LOC342125 BINDING SITE4, designated SEQ ID:5420, SEQ ID:19109, SEQ ID:16605 and SEQ ID:8505 respectively, to the nucleotide sequence of GAM94 RNA, herein designated GAM RNA, also designated SEQ ID:332.

Another function of GAM94 is therefore inhibition of LOC342125 (Accession XP_292375.1). Accordingly, utilities of GAM94 include diagnosis, prevention and treatment of diseases and clinical conditions associated with LOC342125.

LOC342490 (Accession XP_296905.2) is another GAM94 target gene, herein designated TARGET GENE. LOC342490 BINDING SITE1 and LOC342490 BINDING SITE2 are target binding sites found in untranslated regions of mRNA encoded by LOC342490, corresponding to target binding sites such as BINDING SITE I, BINDING SITE II or BINDING SITE III of FIG. 8. Table 4 illustrates the complementarity of the nucleotide sequences of LOC342490 BINDING SITE1 and LOC342490 BINDING SITE2, designated SEQ ID:12046 and SEQ ID:14647 respectively, to the nucleotide sequence of GAM94 RNA, herein designated GAM RNA, also designated SEQ ID:332.

Another function of GAM94 is therefore inhibition of LOC342490 (Accession XP_296905.2). Accordingly, utilities of GAM94 include diagnosis, prevention and treatment of diseases and clinical conditions associated with LOC342490.

LOC342926 (Accession XP_292790.2) is another GAM94 target gene, herein designated TARGET GENE. LOC342926 BINDING SITE1 through LOC342926 BINDING SITE3 are target binding sites found in untranslated regions of mRNA encoded by LOC342926, corresponding to target binding sites such as BINDING SITE I, BINDING SITE II or BINDING SITE III of FIG. 8. Table 4 illustrates the complementarity of the nucleotide sequences of LOC342926 BINDING SITE1 through LOC342926 BINDING SITE3, designated SEQ ID:10371, SEQ ID:17495 and SEQ ID:5714 respectively, to the nucleotide sequence of GAM94 RNA, herein designated GAM RNA, also designated SEQ ID:332.

Another function of GAM94 is therefore inhibition of LOC342926 (Accession XP_292790.2). Accordingly, utilities of GAM94 include diagnosis, prevention and treatment of diseases and clinical conditions associated with LOC342926.

LOC343100 (Accession XP_295344.1) is another GAM94 target gene, herein designated TARGET GENE. LOC343100 BINDING SITE is a target binding site found in the 3' untranslated region of mRNA encoded by LOC343100, corresponding to a target binding site such as BINDING SITE I, BINDING SITE II or BINDING SITE III of FIG. 8. Table 4 illustrates the complementarity of the nucleotide sequences of LOC343100 BINDING SITE, designated SEQ ID:7081, to the nucleotide sequence of GAM94 RNA, herein designated GAM RNA, also designated SEQ ID:332.

Another function of GAM94 is therefore inhibition of LOC343100 (Accession XP_295344.1). Accordingly, utilities of GAM94 include diagnosis, prevention and treatment of diseases and clinical conditions associated with LOC343100.

LOC344600 (Accession XP_293499.2) is another GAM94 target gene, herein designated TARGET GENE. LOC344600 BINDING SITE is a target binding site found in the 5' untranslated region of mRNA encoded by LOC344600, corresponding to a target binding site such as BINDING SITE I, BINDING SITE II or BINDING SITE III of FIG. 8. Table 4 illustrates the complementarity of the nucleotide sequences of LOC344600 BINDING SITE, designated SEQ ID:18489, to the nucleotide sequence of GAM94 RNA, herein designated GAM RNA, also designated SEQ ID:332.

Another function of GAM94 is therefore inhibition of LOC344600 (Accession XP_293499.2). Accordingly, utilities of GAM94 include diagnosis, prevention and treatment of diseases and clinical conditions associated with LOC344600.

LOC345119 (Accession XP_298539.1) is another GAM94 target gene, herein designated TARGET GENE. LOC345119 BINDING SITE is a target binding site found in the 5' untranslated region of mRNA encoded by LOC345119, corresponding to a target binding site such as BINDING SITE I, BINDING SITE II or BINDING SITE III of FIG. 8. Table 4 illustrates the complementarity of the nucleotide sequences of LOC345119 BINDING SITE, designated SEQ ID:9265, to the nucleotide sequence of GAM94 RNA, herein designated GAM RNA, also designated SEQ ID:332.

Another function of GAM94 is therefore inhibition of LOC345119 (Accession XP_298539.1). Accordingly, utilities of GAM94 include diagnosis, prevention and treatment of diseases and clinical conditions associated with LOC345119.

LOC346284 (Accession XP_294161.2) is another GAM94 target gene, herein designated TARGET GENE. LOC346284 BINDING SITE1 and LOC346284 BINDING SITE2 are target binding sites found in untranslated regions of mRNA encoded by LOC346284, corresponding to target binding sites such as BINDING SITE I, BINDING SITE II or BINDING SITE III of FIG. 8. Table 4 illustrates the complementarity of the nucleotide sequences of LOC346284 BINDING SITE1 and LOC346284 BINDING SITE2, designated SEQ ID:658 and SEQ ID:10841 respectively, to the nucleotide sequence of GAM94 RNA, herein designated GAM RNA, also designated SEQ ID:332.

Another function of GAM94 is therefore inhibition of LOC346284 (Accession XP_294161.2). Accordingly, utilities of GAM94 include diagnosis, prevention and treatment of diseases and clinical conditions associated with LOC346284.

LOC346539 (Accession XP_299537.1) is another GAM94 target gene, herein designated TARGET GENE. LOC346539 BINDING SITE is a target binding site found in the 3' untranslated region of mRNA encoded by LOC346539, corresponding to a target binding site such as BINDING SITE I, BINDING SITE II or BINDING SITE III of FIG. 8. Table 4 illustrates the complementarity of the nucleotide sequences of LOC346539 BINDING SITE, designated SEQ ID:14088, to the nucleotide sequence of GAM94 RNA, herein designated GAM RNA, also designated SEQ ID:332.

Another function of GAM94 is therefore inhibition of LOC346539 (Accession XP_299537.1). Accordingly, utilities of GAM94 include diagnosis, prevention and treatment of diseases and clinical conditions associated with LOC346539.

LOC347774 (Accession XP_290475.1) is another GAM94 target gene, herein designated TARGET GENE. LOC347774 BINDING SITE is a target binding site found in the 3' untranslated region of mRNA encoded by LOC347774, corresponding to a target binding site such as BINDING SITE I, BINDING SITE II or BINDING SITE III of FIG. 8. Table 4 illustrates the complementarity of the nucleotide sequences of LOC347774 BINDING SITE, designated SEQ ID:734, to the nucleotide sequence of GAM94 RNA, herein designated GAM RNA, also designated SEQ ID:332.

Another function of GAM94 is therefore inhibition of LOC347774 (Accession XP_290475.1). Accordingly, utilities of GAM94 include diagnosis, prevention and treatment of diseases and clinical conditions associated with LOC347774.

LOC347929 (Accession XP_302565.1) is another GAM94 target gene, herein designated TARGET GENE. LOC347929 BINDING SITE is a target binding site found in the 5' untranslated region of mRNA encoded by LOC347929, corresponding to a target binding site such as BINDING SITE I, BINDING SITE II or BINDING SITE III of FIG. 8. Table 4 illustrates the complementarity of the nucleotide sequences of LOC347929 BINDING SITE, designated SEQ ID:7034, to the nucleotide sequence of GAM94 RNA, herein designated GAM RNA, also designated SEQ ID:332.

Another function of GAM94 is therefore inhibition of LOC347929 (Accession XP_302565.1). Accordingly, utilities of GAM94 include diagnosis, prevention and treatment of diseases and clinical conditions associated with LOC347929.

LOC348072 (Accession XP_302652.1) is another GAM94 target gene, herein designated TARGET GENE. LOC348072 BINDING SITE1 and LOC348072 BINDING SITE2 are target binding sites found in untranslated regions of mRNA encoded by LOC348072, corresponding to target binding sites such as BINDING SITE I, BINDING SITE II or BINDING SITE III of FIG. 8. Table 4 illustrates the complementarity of the nucleotide sequences of LOC348072 BINDING SITE1 and LOC348072 BINDING SITE2, designated SEQ ID:8955 and SEQ ID:4715 respectively, to the nucleotide sequence of GAM94 RNA, herein designated GAM RNA, also designated SEQ ID:332.

Another function of GAM94 is therefore inhibition of LOC348072 (Accession XP_302652.1). Accordingly, utilities of GAM94 include diagnosis, prevention and treatment of diseases and clinical conditions associated with LOC348072.

LOC348073 (Accession XP_300287.1) is another GAM94 target gene, herein designated TARGET GENE. LOC348073 BINDING SITE is a target binding site found in the 5' untranslated region of mRNA encoded by LOC348073, corresponding to a target binding site such as BINDING SITE I, BINDING SITE II or BINDING SITE III of FIG. 8. Table 4 illustrates the complementarity of the nucleotide sequences of LOC348073 BINDING SITE, designated SEQ ID:11526, to the nucleotide sequence of GAM94 RNA, herein designated GAM RNA, also designated SEQ ID:332.

Another function of GAM94 is therefore inhibition of LOC348073 (Accession XP_300287.1). Accordingly, utilities of GAM94 include diagnosis, prevention and treatment of diseases and clinical conditions associated with LOC348073.

LOC348108 (Accession XP_300621.1) is another GAM94 target gene, herein designated TARGET GENE. LOC348108 BINDING SITE is a target binding site found in the 5' untranslated region of mRNA encoded by LOC348108, corresponding to a target binding site such as BINDING SITE I, BINDING SITE II or BINDING SITE III of FIG. 8. Table 4 illustrates the complementarity of the nucleotide sequences of LOC348108 BINDING SITE, designated SEQ ID:1437, to the nucleotide sequence of GAM94 RNA, herein designated GAM RNA, also designated SEQ ID:332.

Another function of GAM94 is therefore inhibition of LOC348108 (Accession XP_300621.1). Accordingly, utilities of GAM94 include diagnosis, prevention and treatment of diseases and clinical conditions associated with LOC348108.

LOC348113 (Accession XP_300623.1) is another GAM94 target gene, herein designated TARGET GENE.

LOC348113 BINDING SITE is a target binding site found in the 5' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:8147, to the nucleotide sequence of GAM94 RNA, herein designated GAM RNA, also designated SEQ ID:332.

Another function of GAM94 is therefore inhibition of LOC348113 (Accession XP_300623.1). Accordingly, utilities of GAM94 include diagnosis, prevention and treatment of diseases and clinical conditions associated with LOC348113.

LOC348142 (Accession XP_300636.1) is another GAM94 target gene, herein designated TARGET GENE. LOC348142 BINDING SITE is a target binding site found in the 5' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:8147, to the nucleotide sequence of GAM94 RNA, herein designated GAM RNA, also designated SEQ ID:332.

Another function of GAM94 is therefore inhibition of LOC348142 (Accession XP_300636.1). Accordingly, utilities of GAM94 include diagnosis, prevention and treatment of diseases and clinical conditions associated with LOC348142.

LOC348158 (Accession XP_300646.1) is another GAM94 target gene, herein designated TARGET GENE. LOC348158 BINDING SITE is a target binding site found in the 3' untranslated region of mRNA encoded by LOC348158, corresponding to a target binding site such as BINDING SITE I, BINDING SITE II or BINDING SITE III of FIG. 8. Table 4 illustrates the complementarity of the nucleotide sequences of LOC348158 BINDING SITE, designated SEQ ID:15004, to the nucleotide sequence of GAM94 RNA, herein designated GAM RNA, also designated SEQ ID:332.

Another function of GAM94 is therefore inhibition of LOC348158 (Accession XP_300646.1). Accordingly, utilities of GAM94 include diagnosis, prevention and treatment of diseases and clinical conditions associated with LOC348158.

LOC348209 (Accession XP_300304.1) is another GAM94 target gene, herein designated TARGET GENE. LOC348209 BINDING SITE is a target binding site found in the 3' untranslated region of mRNA encoded by LOC348209, corresponding to a target binding site such as BINDING SITE I, BINDING SITE II or BINDING SITE III of FIG. 8. Table 4 illustrates the complementarity of the nucleotide sequences of LOC348209 BINDING SITE, designated SEQ ID:4919, to the nucleotide sequence of GAM94 RNA, herein designated GAM RNA, also designated SEQ ID:332.

Another function of GAM94 is therefore inhibition of LOC348209 (Accession XP_300304.1). Accordingly, utilities of GAM94 include diagnosis, prevention and treatment of diseases and clinical conditions associated with LOC348209.

LOC348404 (Accession XP_302745.1) is another GAM94 target gene, herein designated TARGET GENE. LOC348404 BINDING SITE is a target binding site found in the 3' untranslated region of mRNA encoded by LOC348404, corresponding to a target binding site such as BINDING SITE I, BINDING SITE II or BINDING SITE III of FIG. 8. Table 4 illustrates the complementarity of the nucleotide sequences of LOC348404 BINDING SITE, designated SEQ ID:15845, to the nucleotide sequence of GAM94 RNA, herein designated GAM RNA, also designated SEQ ID:332.

Another function of GAM94 is therefore inhibition of LOC348404 (Accession XP_302745.1). Accordingly, utilities of GAM94 include diagnosis, prevention and treatment of diseases and clinical conditions associated with LOC348404.

LOC348466 (Accession XP_301189.1) is another GAM94 target gene, herein designated TARGET GENE. LOC348466 BINDING SITE is a target binding site found in the 5' untranslated region of mRNA encoded by LOC348466, corresponding to a target binding site such as BINDING SITE I, BINDING SITE II or BINDING SITE III of FIG. 8. Table 4 illustrates the complementarity of the nucleotide sequences of LOC348466 BINDING SITE, designated SEQ ID:5736, to the nucleotide sequence of GAM94 RNA, herein designated GAM RNA, also designated SEQ ID:332.

Another function of GAM94 is therefore inhibition of LOC348466 (Accession XP_301189.1). Accordingly, utilities of GAM94 include diagnosis, prevention and treatment of diseases and clinical conditions associated with LOC348466.

LOC348583 (Accession XP_302833.1) is another GAM94 target gene, herein designated TARGET GENE. LOC348583 BINDING SITE1 and LOC348583 BINDING SITE2 are target binding sites found in untranslated regions of mRNA encoded by LOC348583, corresponding to target binding sites such as BINDING SITE I, BINDING SITE II or BINDING SITE III of FIG. 8. Table 4 illustrates the complementarity of the nucleotide sequences of LOC348583 BINDING SITE1 and LOC348583 BINDING SITE2, designated SEQ ID:13486 and SEQ ID:9852 respectively, to the nucleotide sequence of GAM94 RNA, herein designated GAM RNA, also designated SEQ ID:332.

Another function of GAM94 is therefore inhibition of LOC348583 (Accession XP_302833.1). Accordingly, utilities of GAM94 include diagnosis, prevention and treatment of diseases and clinical conditions associated with LOC348583.

LOC348790 (Accession XP_300843.1) is another GAM94 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:12887, to the nucleotide sequence of GAM94 RNA, herein designated GAM RNA, also designated SEQ ID:332.

Another function of GAM94 is therefore inhibition of LOC348790 (Accession XP_300843.1). Accordingly, utilities of GAM94 include diagnosis, prevention and treatment of diseases and clinical conditions associated with LOC348790.

LOC348808 (Accession XP_302893.1) is another GAM94 target gene, herein designated TARGET GENE. LOC348808 BINDING SITE1 and LOC348808 BINDING SITE2 are target binding sites found in untranslated regions of mRNA encoded by LOC348808, corresponding to target binding sites such as BINDING SITE I, BINDING SITE II or BINDING SITE III of FIG. 8. Table 4 illustrates the complementarity of the nucleotide sequences of LOC348808 BINDING SITE1 and LOC348808 BINDING SITE2, designated SEQ ID:19110 and SEQ ID:7768 respectively, to the nucleotide sequence of GAM94 RNA, herein designated GAM RNA, also designated SEQ ID:332.

Another function of GAM94 is therefore inhibition of LOC348808 (Accession XP_302893.1). Accordingly, utilities of GAM94 include diagnosis, prevention and treatment of diseases and clinical conditions associated with LOC348808.

LOC348835 (Accession XP_302902.1) is another GAM94 target gene, herein designated TARGET GENE. LOC348835 BINDING SITE1 and LOC348835 BINDING SITE2 are target binding sites found in untranslated regions of mRNA encoded by LOC348835, corresponding to target binding sites such as BINDING SITE I, BINDING SITE II or BINDING SITE III of FIG. 8. Table 4 illustrates the complementarity of the nucleotide sequences of LOC348835 BINDING SITE1 and LOC348835 BINDING SITE2, designated SEQ ID:4351 and SEQ ID:1352 respectively, to the nucleotide sequence of GAM94 RNA, herein designated GAM RNA, also designated SEQ ID:332.

Another function of GAM94 is therefore inhibition of LOC348835 (Accession XP_302902.1). Accordingly, utilities of GAM94 include diagnosis, prevention and treatment of diseases and clinical conditions associated with LOC348835.

LOC348938 (Accession XP_300883.1) is another GAM94 target gene, herein designated TARGET GENE. LOC348938 BINDING SITE is a target binding site found in the 3' untranslated region of mRNA encoded by LOC348938, corresponding to a target binding site such as BINDING SITE I, BINDING SITE II or BINDING SITE III of FIG. 8. Table 4 illustrates the complementarity of the nucleotide sequences of LOC348938 BINDING SITE, designated SEQ ID:11023, to the nucleotide sequence of GAM94 RNA, herein designated GAM RNA, also designated SEQ ID:332.

Another function of GAM94 is therefore inhibition of LOC348938 (Accession XP_300883.1). Accordingly, utilities of GAM94 include diagnosis, prevention and treatment of diseases and clinical conditions associated with LOC348938.

LOC349005 (Accession XP_302242.1) is another GAM94 target gene, herein designated TARGET GENE. LOC349005 BINDING SITE is a target binding site found in the 5' untranslated region of mRNA encoded by LOC349005, corresponding to a target binding site such as BINDING SITE I, BINDING SITE II or BINDING SITE III of FIG. 8. Table 4 illustrates the complementarity of the nucleotide sequences of LOC349005 BINDING SITE, designated SEQ ID:14229, to the nucleotide sequence of GAM94 RNA, herein designated GAM RNA, also designated SEQ ID:332.

Another function of GAM94 is therefore inhibition of LOC349005 (Accession XP_302242.1). Accordingly, utilities of GAM94 include diagnosis, prevention and treatment of diseases and clinical conditions associated with LOC349005.

LOC349361 (Accession XP_303035.1) is another GAM94 target gene, herein designated TARGET GENE. LOC349361 BINDING SITE is a target binding site found in the 5' untranslated region of mRNA encoded by LOC349361, corresponding to a target binding site such as BINDING SITE I, BINDING SITE II or BINDING SITE III of FIG. 8. Table 4 illustrates the complementarity of the nucleotide sequences of LOC349361 BINDING SITE, designated SEQ ID:17756, to the nucleotide sequence of GAM94 RNA, herein designated GAM RNA, also designated SEQ ID:332.

Another function of GAM94 is therefore inhibition of LOC349361 (Accession XP_303035.1). Accordingly, utilities of GAM94 include diagnosis, prevention and treatment of diseases and clinical conditions associated with LOC349361.

LOC349457 (Accession XP_291364.1) is another GAM94 target gene, herein designated TARGET GENE. LOC349457 BINDING SITE is a target binding site found in the 5' untranslated region of mRNA encoded by LOC349457, corresponding to a target binding site such as BINDING SITE I, BINDING SITE II or BINDING SITE III of FIG. 8. Table 4 illustrates the complementarity of the nucleotide sequences of LOC349457 BINDING SITE, designated SEQ ID:1437, to the nucleotide sequence of GAM94 RNA, herein designated GAM RNA, also designated SEQ ID:332.

Another function of GAM94 is therefore inhibition of LOC349457 (Accession XP_291364.1). Accordingly, utilities of GAM94 include diagnosis, prevention and treatment of diseases and clinical conditions associated with LOC349457.

LOC349762 (Accession XP_303541.1) is another GAM94 target gene, herein designated TARGET GENE. LOC349762 BINDING SITE is a target binding site found in the 5' untranslated region of mRNA encoded by LOC349762, corresponding to a target binding site such as BINDING SITE I, BINDING SITE II or BINDING SITE III of FIG. 8. Table 4 illustrates the complementarity of the nucleotide sequences of LOC349762 BINDING SITE, designated SEQ ID:12514, to the nucleotide sequence of GAM94 RNA, herein designated GAM RNA, also designated SEQ ID:332.

Another function of GAM94 is therefore inhibition of LOC349762 (Accession XP_303541.1). Accordingly, utilities of GAM94 include diagnosis, prevention and treatment of diseases and clinical conditions associated with LOC349762.

LOC350642 (Accession XP_301093.1) is another GAM94 target gene, herein designated TARGET GENE. LOC350642 BINDING SITE is a target binding site found in the 5' untranslated region of mRNA encoded by LOC350642, corresponding to a target binding site such as BINDING SITE I, BINDING SITE II or BINDING SITE III of FIG. 8. Table 4 illustrates the complementarity of the nucleotide sequences of LOC350642 BINDING SITE, designated SEQ ID:15794, to the nucleotide sequence of GAM94 RNA, herein designated GAM RNA, also designated SEQ ID:332.

Another function of GAM94 is therefore inhibition of LOC350642 (Accession XP_301093.1). Accordingly, utilities of GAM94 include diagnosis, prevention and treatment of diseases and clinical conditions associated with LOC350642.

LOC351096 (Accession XP_304287.1) is another GAM94 target gene, herein designated TARGET GENE. LOC351096 BINDING SITE is a target binding site found in the 5' untranslated region of mRNA encoded by LOC351096, corresponding to a target binding site such as BINDING SITE I, BINDING SITE II or BINDING SITE III of FIG. 8. Table 4 illustrates the complementarity of the nucleotide sequences of LOC351096 BINDING SITE, designated SEQ ID:11443, to the nucleotide sequence of GAM94 RNA, herein designated GAM RNA, also designated SEQ ID:332.

Another function of GAM94 is therefore inhibition of LOC351096 (Accession XP_304287.1). Accordingly, utilities of GAM94 include diagnosis, prevention and treatment of diseases and clinical conditions associated with LOC351096.

LOC351523 (Accession XP_304883.1) is another GAM94 target gene, herein designated TARGET GENE. LOC351523 BINDING SITE is a target binding site found in the 5' untranslated region of mRNA encoded by LOC351523, corresponding to a target binding site such as BINDING SITE I, BINDING SITE II or BINDING SITE III of FIG. 8. Table 4 illustrates the complementarity of the nucleotide sequences of LOC351523 BINDING SITE, designated SEQ ID:13224, to the nucleotide sequence of GAM94 RNA, herein designated GAM RNA, also designated SEQ ID:332.

Another function of GAM94 is therefore inhibition of LOC351523 (Accession XP_304883.1). Accordingly, utilities of GAM94 include diagnosis, prevention and treatment of diseases and clinical conditions associated with LOC351523.

LOC351922 (Accession XP_305261.1) is another GAM94 target gene, herein designated TARGET GENE. LOC351922 BINDING SITE is a target binding site found in the 5' untranslated region of mRNA encoded by LOC351922, corresponding to a target binding site such as BINDING SITE I, BINDING SITE II or BINDING SITE III of FIG. 8. Table 4 illustrates the complementarity of the nucleotide sequences of LOC351922 BINDING SITE, designated SEQ ID:4818, to the nucleotide sequence of GAM94 RNA, herein designated GAM RNA, also designated SEQ ID:332.

Another function of GAM94 is therefore inhibition of LOC351922 (Accession XP_305261.1). Accordingly, utilities of GAM94 include diagnosis, prevention and treatment of diseases and clinical conditions associated with LOC351922.

LOC51186 (Accession NP_057387.1) is another GAM94 target gene, herein designated TARGET GENE. LOC51186 BINDING SITE is a target binding site found in the 5' untranslated region of mRNA encoded by LOC51186, corresponding to a target binding site such as BINDING SITE I, BINDING SITE II or BINDING SITE III of FIG. 8. Table 4 illustrates the complementarity of the nucleotide sequences of LOC51186 BINDING SITE, designated SEQ ID:11318, to the nucleotide sequence of GAM94 RNA, herein designated GAM RNA, also designated SEQ ID:332.

Another function of GAM94 is therefore inhibition of LOC51186 (Accession NP_057387.1). Accordingly, utilities of GAM94 include diagnosis, prevention and treatment of diseases and clinical conditions associated with LOC51186.

LOC51320 (Accession NP_057710.1) is another GAM94 target gene, herein designated TARGET GENE. LOC51320 BINDING SITE is a target binding site found in the 3' untranslated region of mRNA encoded by LOC51320, corresponding to a target binding site such as BINDING SITE I, BINDING SITE II or BINDING SITE III of FIG. 8. Table 4 illustrates the complementarity of the nucleotide sequences of LOC51320 BINDING SITE, designated SEQ ID:18717, to the nucleotide sequence of GAM94 RNA, herein designated GAM RNA, also designated SEQ ID:332.

Another function of GAM94 is therefore inhibition of LOC51320 (Accession NP_057710.1). Accordingly, utilities of GAM94 include diagnosis, prevention and treatment of diseases and clinical conditions associated with LOC51320.

LOC55580 (Accession NP_060041.1) is another GAM94 target gene, herein designated TARGET GENE. LOC55580 BINDING SITE is a target binding site found in the 3' untranslated region of mRNA encoded by LOC55580, corresponding to a target binding site such as BINDING SITE I, BINDING SITE II or BINDING SITE III of FIG. 8. Table 4 illustrates the complementarity of the nucleotide sequences of LOC55580 BINDING SITE, designated SEQ ID:16096, to the nucleotide sequence of GAM94 RNA, herein designated GAM RNA, also designated SEQ ID:332.

Another function of GAM94 is therefore inhibition of LOC55580 (Accession NP_060041.1). Accordingly, utilities of GAM94 include diagnosis, prevention and treatment of diseases and clinical conditions associated with LOC55580.

LOC55862 (Accession NP_060949.1) is another GAM94 target gene, herein designated TARGET GENE. LOC55862 BINDING SITE is a target binding site found in the 5' untranslated region of mRNA encoded by LOC55862, corresponding to a target binding site such as BINDING SITE I, BINDING SITE II or BINDING SITE III of FIG. 8. Table 4 illustrates the complementarity of the nucleotide sequences of LOC55862 BINDING SITE, designated SEQ ID:19025, to the nucleotide sequence of GAM94 RNA, herein designated GAM RNA, also designated SEQ ID:332.

Another function of GAM94 is therefore inhibition of LOC55862 (Accession NP_060949.1). Accordingly, utilities of GAM94 include diagnosis, prevention and treatment of diseases and clinical conditions associated with LOC55862.

LOC90462 (Accession XP_031852.2) is another GAM94 target gene, herein designated TARGET GENE. LOC90462 BINDING SITE is a target binding site found in the 3' untranslated region of mRNA encoded by LOC90462, corresponding to a target binding site such as BINDING SITE I, BINDING SITE II or BINDING SITE III of FIG. 8. Table 4 illustrates the complementarity of the nucleotide sequences of LOC90462 BINDING SITE, designated SEQ ID:9094, to the nucleotide sequence of GAM94 RNA, herein designated GAM RNA, also designated SEQ ID:332.

Another function of GAM94 is therefore inhibition of LOC90462 (Accession XP_031852.2). Accordingly, utilities of GAM94 include diagnosis, prevention and treatment of diseases and clinical conditions associated with LOC90462.

LOC90673 (Accession XP_033391.5) is another GAM94 target gene, herein designated TARGET GENE. LOC90673 BINDING SITE is a target binding site found in the 3' untranslated region of mRNA encoded by LOC90673, corresponding to a target binding site such as BINDING SITE I, BINDING SITE II or BINDING SITE III of FIG. 8. Table 4 illustrates the complementarity of the nucleotide sequences of LOC90673 BINDING SITE, designated SEQ ID:15191, to the nucleotide sequence of GAM94 RNA, herein designated GAM RNA, also designated SEQ ID:332.

Another function of GAM94 is therefore inhibition of LOC90673 (Accession XP_033391.5). Accordingly, utilities of GAM94 include diagnosis, prevention and treatment of diseases and clinical conditions associated with LOC90673.

LOC90906 (Accession XP_034809.1) is another GAM94 target gene, herein designated TARGET GENE. LOC90906 BINDING SITE1 and LOC90906 BINDING SITE2 are target binding sites found in untranslated regions of mRNA encoded by LOC90906, corresponding to target binding sites such as BINDING SITE I, BINDING SITE II or BINDING SITE III of FIG. 8. Table 4 illustrates the complementarity of the nucleotide sequences of LOC90906 BINDING SITE1 and LOC90906 BINDING SITE2, designated SEQ ID:16963 and SEQ ID:16489 respectively, to the nucleotide sequence of GAM94 RNA, herein designated GAM RNA, also designated SEQ ID:332.

Another function of GAM94 is therefore inhibition of LOC90906 (Accession XP_034809.1). Accordingly, utilities of GAM94 include diagnosis, prevention and treatment of diseases and clinical conditions associated with LOC90906.

LOC91149 (Accession XP_036480.1) is another GAM94 target gene, herein designated TARGET GENE. LOC91149

BINDING SITE is a target binding site found in the 3' untranslated region of mRNA encoded by LOC91149, corresponding to a target binding site such as BINDING SITE I, BINDING SITE II or BINDING SITE III of FIG. 8. Table 4 illustrates the complementarity of the nucleotide sequences of LOC91149 BINDING SITE, designated SEQ ID:13502, to the nucleotide sequence of GAM94 RNA, herein designated GAM RNA, also designated SEQ ID:332.

Another function of GAM94 is therefore inhibition of LOC91149 (Accession XP_036480.1). Accordingly, utilities of GAM94 include diagnosis, prevention and treatment of diseases and clinical conditions associated with LOC91149.

LOC91263 (Accession XP_037264.1) is another GAM94 target gene, herein designated TARGET GENE. LOC91263 BINDING SITE is a target binding site found in the 3' untranslated region of mRNA encoded by LOC91263, corresponding to a target binding site such as BINDING SITE I, BINDING SITE II or BINDING SITE III of FIG. 8. Table 4 illustrates the complementarity of the nucleotide sequences of LOC91263 BINDING SITE, designated SEQ ID:19186, to the nucleotide sequence of GAM94 RNA, herein designated GAM RNA, also designated SEQ ID:332.

Another function of GAM94 is therefore inhibition of LOC91263 (Accession XP_037264.1). Accordingly, utilities of GAM94 include diagnosis, prevention and treatment of diseases and clinical conditions associated with LOC91263.

LOC91565 (Accession XP_039231.1) is another GAM94 target gene, herein designated TARGET GENE. LOC91565 BINDING SITE1 and LOC91565 BINDING SITE2 are target binding sites found in untranslated regions of mRNA encoded by LOC91565, corresponding to target binding sites such as BINDING SITE I, BINDING SITE II or BINDING SITE III of FIG. 8. Table 4 illustrates the complementarity of the nucleotide sequences of LOC91565 BINDING SITE1 and LOC91565 BINDING SITE2, designated SEQ ID:5752 and SEQ ID:8304 respectively, to the nucleotide sequence of GAM94 RNA, herein designated GAM RNA, also designated SEQ ID:332.

Another function of GAM94 is therefore inhibition of LOC91565 (Accession XP_039231.1). Accordingly, utilities of GAM94 include diagnosis, prevention and treatment of diseases and clinical conditions associated with LOC91565.

LOC91661 (Accession NP_612381.1) is another GAM94 target gene, herein designated TARGET GENE. LOC91661 BINDING SITE1 and LOC91661 BINDING SITE2 are target binding sites found in untranslated regions of mRNA encoded by LOC91661, corresponding to target binding sites such as BINDING SITE I, BINDING SITE II or BINDING SITE III of FIG. 8. Table 4 illustrates the complementarity of the nucleotide sequences of LOC91661 BINDING SITE1 and LOC91661 BINDING SITE2, designated SEQ ID:18909 and SEQ ID:16542 respectively, to the nucleotide sequence of GAM94 RNA, herein designated GAM RNA, also designated SEQ ID:332.

Another function of GAM94 is therefore inhibition of LOC91661 (Accession NP_612381.1). Accordingly, utilities of GAM94 include diagnosis, prevention and treatment of diseases and clinical conditions associated with LOC91661.

LOC91875 (Accession NP_612385.1) is another GAM94 target gene, herein designated TARGET GENE. LOC91875 BINDING SITE is a target binding site found in the 3' untranslated region of mRNA encoded by LOC91875, corresponding to a target binding site such as BINDING SITE I, BINDING SITE II or BINDING SITE III of FIG. 8. Table 4 illustrates the complementarity of the nucleotide sequences of LOC91875 BINDING SITE, designated SEQ ID:15925, to the nucleotide sequence of GAM94 RNA, herein designated GAM RNA, also designated SEQ ID:332.

Another function of GAM94 is therefore inhibition of LOC91875 (Accession NP_612385.1). Accordingly, utilities of GAM94 include diagnosis, prevention and treatment of diseases and clinical conditions associated with LOC91875.

LOC92017 (Accession XP_042234.2) is another GAM94 target gene, herein designated TARGET GENE. LOC92017 BINDING SITE is a target binding site found in the 3' untranslated region of mRNA encoded by LOC92017, corresponding to a target binding site such as BINDING SITE I, BINDING SITE II or BINDING SITE III of FIG. 8. Table 4 illustrates the complementarity of the nucleotide sequences of LOC92017 BINDING SITE, designated SEQ ID:3847, to the nucleotide sequence of GAM94 RNA, herein designated GAM RNA, also designated SEQ ID:332.

Another function of GAM94 is therefore inhibition of LOC92017 (Accession XP_042234.2). Accordingly, utilities of GAM94 include diagnosis, prevention and treatment of diseases and clinical conditions associated with LOC92017.

LOC92170 (Accession NP_612393.1) is another GAM94 target gene, herein designated TARGET GENE. LOC92170 BINDING SITE is a target binding site found in the 3' untranslated region of mRNA encoded by LOC92170, corresponding to a target binding site such as BINDING SITE I, BINDING SITE II or BINDING SITE III of FIG. 8. Table 4 illustrates the complementarity of the nucleotide sequences of LOC92170 BINDING SITE, designated SEQ ID:12672, to the nucleotide sequence of GAM94 RNA, herein designated GAM RNA, also designated SEQ ID:332.

Another function of GAM94 is therefore inhibition of LOC92170 (Accession NP_612393.1). Accordingly, utilities of GAM94 include diagnosis, prevention and treatment of diseases and clinical conditions associated with LOC92170.

LOC92312 (Accession XP_044166.4) is another GAM94 target gene, herein designated TARGET GENE. LOC92312 BINDING SITE1 through LOC92312 BINDING SITE4 are target binding sites found in untranslated regions of mRNA encoded by LOC92312, corresponding to target binding sites such as BINDING SITE I, BINDING SITE II or BINDING SITE III of FIG. 8. Table 4 illustrates the complementarity of the nucleotide sequences of LOC92312 BINDING SITE1 through LOC92312 BINDING SITE4, designated SEQ ID:8613, SEQ ID:13054, SEQ ID:1665 and SEQ ID:10275 respectively, to the nucleotide sequence of GAM94 RNA, herein designated GAM RNA, also designated SEQ ID:332.

Another function of GAM94 is therefore inhibition of LOC92312 (Accession XP_044166.4). Accordingly, utilities of GAM94 include diagnosis, prevention and treatment of diseases and clinical conditions associated with LOC92312.

Leukotriene b4 receptor (LTB4R, Accession NP_000743.1) is another GAM94 target gene, herein designated TARGET GENE. LTB4R BINDING SITE is a target binding site found in the 3' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:9294, to the nucleotide sequence of GAM94 RNA, herein designated GAM RNA, also designated SEQ ID:332.

Another function of GAM94 is therefore inhibition of Leukotriene b4 receptor (LTB4R, Accession NP_000743.1), a gene which may be the cardiac p2y receptor involved in the regulation of cardiac muscle contraction through modulation of l-type calcium currents. Accordingly, utilities of GAM94 include diagnosis, prevention and treatment of diseases and clinical conditions associated with LTB4R.

The function of LTB4R and its association with various diseases and clinical conditions, has been established by previous studies, as described hereinabove with reference to GAM30.1. Macrophage erythroblast attacher (MAEA, Accession NP_005873.1) is another GAM94 target gene, herein designated TARGET GENE. MAEA BINDING SITE is a target binding site found in the 3' untranslated region of mRNA encoded by MAEA, corresponding to a target binding site such as BINDING SITE I, BINDING SITE II or BINDING SITE III of FIG. 8. Table 4 illustrates the complementarity of the nucleotide sequences of MAEA BINDING SITE, designated SEQ ID:4163, to the nucleotide sequence of GAM94 RNA, herein designated GAM RNA, also designated SEQ ID:332.

Another function of GAM94 is therefore inhibition of Macrophage erythroblast attacher (MAEA, Accession NP_005873.1). Accordingly, utilities of GAM94 include diagnosis, prevention and treatment of diseases and clinical conditions associated with MAEA.

Melanoma antigen, family a, 8 (MAGEA8, Accession NP_005355.2) is another GAM94 target gene, herein designated TARGET GENE. MAGEA8 BINDING SITE is a target binding site found in the 3' untranslated region of mRNA encoded by MAGEA8, corresponding to a target binding site such as BINDING SITE I, BINDING SITE II or BINDING SITE III of FIG. 8. Table 4 illustrates the complementarity of the nucleotide sequences of MAGEA8 BINDING SITE, designated SEQ ID:7752, to the nucleotide sequence of GAM94 RNA, herein designated GAM RNA, also designated SEQ ID:332.

Another function of GAM94 is therefore inhibition of Melanoma antigen, family a, 8 (MAGEA8, Accession NP_005355.2), a gene which may play a role in embryonal development and tumor transformation or progression. Accordingly, utilities of GAM94 include diagnosis, prevention and treatment of diseases and clinical conditions associated with MAGEA8.

The function of MAGEA8 has been established by previous studies. The MAGEA family consists of 12 genes (MAGEA1 to MAGEA12), of which 6, MAGEA1 (OMIM Ref. No. 300016), MAGEA2 (OMIM Ref. No. 300173), MAGEA3 (OMIM Ref. No. 300174), MAGEA4 (OMIM Ref. No. 300175), MAGEA6 (OMIM Ref. No. 300176), and MAGEA12 (OMIM Ref. No. 300177), are expressed in melanomas and other cancers. For further background information on the MAGEA family, see 300016. De Plaen et al. (1994) identified the 12 MAGEA genes. MAGEA8 appeared to be a weakly expressed member of the family. Rogner et al. (1995) isolated a MAGEA8 cDNA from a fetal brain cDNA library. By analysis of cell hybrids, ordered YACs, and cosmids, Rogner et al. (1995) localized the MAGEA cluster to Xq28. They showed that the 12 genes are arranged in 3 clusters within 3.5 Mb. De Plaen et al. (1999) mapped the mouse Mage8 gene to the X chromosome.

Full details of the abovementioned studies are described in the following publications, the disclosure of which are hereby incorporated by reference:

De Plaen, E.; De Backer, O.; Arnaud, D.; Bonjean, B.; Chomez, P.; Martelange, V.; Avner, P.; Baldacci, P.; Babinet, C.; Hwang, S.-Y.; Knowles, B.; Boon, T.: A new family of mouse genes homologous to the human MAGE genes. Genomics 55:176-184, 1999; and Rogner, U. C.; Wilke, K.; Steck, E.; Korn, B.; Poustka, A.: The melanoma antigen gene (MAGE) family is clustered in the chromosomal band Xq28. Genomics 29:725-731, 1995.

Further studies establishing the function and utilities of MAGEA8 are found in John Hopkins OMIM database record ID 300341, and in cited publications listed in Table 5, which are hereby incorporated by reference. Microtubule-associated protein 1b (MAP1B, Accession NP_114399.1) is another GAM94 target gene, herein designated TARGET GENE. MAP1B BINDING SITE1 and MAP1B BINDING SITE2 are target binding sites found in untranslated regions of multiple transcripts of mRNA encoded by MAP1B, corresponding to target binding sites such as BINDING SITE I, BINDING SITE II or BINDING SITE III of FIG. 8. Table 4 illustrates the complementarity of the nucleotide sequences of MAP1B BINDING SITE1 and MAP1B BINDING SITE2, designated SEQ ID:1647 and SEQ ID:6508 respectively, to the nucleotide sequence of GAM94 RNA, herein designated GAM RNA, also designated SEQ ID:332.

Another function of GAM94 is therefore inhibition of Microtubule-associated protein 1b (MAP1B, Accession NP_114399.1), a gene which may have a role in neuronal plasticity and brain development. Accordingly, utilities of GAM94 include diagnosis, prevention and treatment of diseases and clinical conditions associated with MAP1B.

The function of MAP1B and its association with various diseases and clinical conditions, has been established by previous studies, as described hereinabove with reference to GAM38.1. Microtubule-associated protein 1b (MAP1B, Accession NP_005900.1) is another GAM94 target gene, herein designated TARGET GENE. MAP1B BINDING SITE1 and MAP1B BINDING SITE2 are target binding sites found in untranslated regions of multiple transcripts of mRNA encoded by MAP1B, corresponding to target binding sites such as BINDING SITE I, BINDING SITE II or BINDING SITE III of FIG. 8. Table 4 illustrates the complementarity of the nucleotide sequences of MAP1B BINDING SITE1 and MAP1B BINDING SITE2, designated SEQ ID:1647 and SEQ ID:6508 respectively, to the nucleotide sequence of GAM94 RNA, herein designated GAM RNA, also designated SEQ ID:332.

Another function of GAM94 is therefore inhibition of Microtubule-associated protein 1b (MAP1B, Accession NP_005900.1), a gene which may have a role in neuronal plasticity and brain development. Accordingly, utilities of GAM94 include diagnosis, prevention and treatment of diseases and clinical conditions associated with MAP1B.

The function of MAP1B and its association with various diseases and clinical conditions, has been established by previous studies, as described hereinabove with reference to GAM38.1. Mitogen-activated protein kinase kinase kinase 2 (MAP3K2, Accession NP_006600.2) is another GAM94 target gene, herein designated TARGET GENE. MAP3K2 BINDING SITE is a target binding site found in the 3' untranslated region of mRNA encoded by MAP3K2, corresponding to a target binding site such as BINDING SITE I, BINDING SITE II or BINDING SITE III of FIG. 8. Table 4 illustrates the complementarity of the nucleotide sequences of MAP3K2 BINDING SITE, designated SEQ ID:2581, to the nucleotide sequence of GAM94 RNA, herein designated GAM RNA, also designated SEQ ID:332.

Another function of GAM94 is therefore inhibition of Mitogen-activated protein kinase kinase kinase 2 (MAP3K2, Accession NP_006600.2). Accordingly, utilities of GAM94 include diagnosis, prevention and treatment of diseases and clinical conditions associated with MAP3K2.

Mads box transcription enhancer factor 2, polypeptide c (myocyte enhancer factor 2c) (MEF2C, Accession NP_002388.2) is another GAM94 target gene, herein designated TARGET GENE. MEF2C BINDING SITE is a target binding site found in the 5' untranslated region of mRNA encoded by MEF2C, corresponding to a target binding site such as BINDING SITE I, BINDING SITE II or BINDING SITE III of FIG. 8. Table 4 illustrates the complementarity of the nucleotide sequences of MEF2C BINDING SITE, designated SEQ ID:16421, to the nucleotide sequence of GAM94 RNA, herein designated GAM RNA, also designated SEQ ID:332.

Another function of GAM94 is therefore inhibition of Mads box transcription enhancer factor 2, polypeptide c (myocyte enhancer factor 2c) (MEF2C, Accession NP_002388.2), a gene which regulates muscle-specific and mitogen-inducible genes. Accordingly, utilities of GAM94 include diagnosis, prevention and treatment of diseases and clinical conditions associated with MEF2C.

The function of MEF2C has been established by previous studies. The MEF2 family of regulatory proteins are, like the myogenic basic helix-loop-helix proteins (e.g., 159970), involved in myogenesis; see MEF2A (OMIM Ref. No. 600660). McDermott et al. (1993) cloned a member of the MEF2 family of proteins from a human skeletal muscle cDNA library using a fragment of the MEF2A cDNA as a probe. Transcripts of MEF2C were found in the skeletal muscle and brain. Alternative splice variants were found, 1 of which was unique to the brain. Leifer et al. (1993) found that the brain form was expressed by neurons in particular layers of the cerebral cortex and that expression declined during postnatal development. The skeletal isoform of the cDNA encodes a 465-amino acid protein with conserved MADS and MEF2 domains. Like the other MEF2 gene products, MEF2C has both DNA binding and trans-activating activities indistinguishable from other members of the family. MEF2C, however, is induced late during myogenic differentiation and has a strict tissue-specific pattern of expression not seen in MEF2A or MEF2B. Breitbart et al. (1993) suggested that, while MEF2A may be involved in induction of muscle differentiation, MEF2C may be involved with maintenance of the differentiated state. CREB-binding protein (CBP; 600140)/p300 (OMIM Ref. No. 602700) and p300/CBP-associated factor (PCAF; 602203) are coactivators for MEF2C during differentiation. Chen et al. (2000) showed that NCOA2 mediates the coactivation of MEF2C-dependent transcription through interaction with the MADS box domain of MEF2C. They proposed a model of cooperative interaction between NCOA2, myogenin (MYOG; 159980), and MEF2C in the regulation of muscle- specific gene expression. During mammalian development, electrical activity promotes the calcium-dependent survival of neurons that have made appropriate synaptic connections. Mao et al. (1999) showed that calcium influx into cerebellar neurons triggers the activation of the MKK6 (OMIM Ref. No. 601254)-p38 MAP kinase (OMIM Ref. No. 600289) cascade and that the p38 MAP kinase then phosphorylates and activates MEF2s. Once activated by this calcium-dependent p38 MAP kinase signaling pathway, MEF2 can regulate the expression of genes that are critical for survival of newly differentiated neurons. These findings demonstrated that MEF2 is a calcium-regulated transcription factor and defined a function for MEF2 during nervous system development that is distinct from previously well-characterized functions of MEF2 during muscle differentiation. Martin et al. (1994) mapped Mef2 to mouse chromosome 13. By fluorescence in situ hybridization, Krainc et al. (1995) mapped human MEF2C to 5q14, a region with homology of synteny to the mouse location. Members of the MEF2 family of MADs-box transcription factors bind to an A-T-rich DNA sequence associated with muscle-specific genes. The murine MEF2C gene is expressed in heart precursor cells before formation of the linear heart tube. In mice homozygous for a known mutation of MEF2C, Lin et al. (1997) found that the heart tube did not undergo looping morphogenesis, the future right ventricle did not form, and a subset of cardiac muscle genes was not expressed. The absence of the right ventricular region of the mutant correlated with downregulation of the dHAND gene, which encodes a basic helix-loop-helix transcription factor required for cardiac morphogenesis. The authors concluded that MEF2C is an essential regulator of cardiac morphogenesis and right ventricular development.

Full details of the abovementioned studies are described in the following publications, the disclosure of which are hereby incorporated by reference:

Breitbart, R. E.; Liang, C.; Smoot, L. B.; Laheru, D. A.; Mahdavi, V.; Nadal-Ginard, B.: A fourth human MEF2 transcription factor, hMEF2D, is an early marker of the myogenic lineage. Development 118:1095-1106, 1993; and Chen, S. L.; Dowhan, D. H.; Hosking, B. M.; Muscat, G. E. O.: The steroid receptor coactivator, GRIP-1, is necessary for MEF-2C-dependent gene expression and skeletal muscle differenti.

Further studies establishing the function and utilities of MEF2C are found in John Hopkins OMIM database record ID 600662, and in cited publications listed in Table 5, which are hereby incorporated by reference. MEGF10 (Accession NP_115822.1) is another GAM94 target gene, herein designated TARGET GENE. MEGF10 BINDING SITE is a target binding site found in the 3' untranslated region of mRNA encoded by MEGF10, corresponding to a target binding site such as BINDING SITE I, BINDING SITE II or BINDING SITE III of FIG. 8. Table 4 illustrates the complementarity of the nucleotide sequences of MEGF10 BINDING SITE, designated SEQ ID:15932, to the nucleotide sequence of GAM94 RNA, herein designated GAM RNA, also designated SEQ ID:332.

Another function of GAM94 is therefore inhibition of MEGF10 (Accession NP_115822.1). Accordingly, utilities of GAM94 include diagnosis, prevention and treatment of diseases and clinical conditions associated with MEGF10.

Meis1, myeloid ecotropic viral integration site 1 homolog 2 (mouse) (MEIS2, Accession NP_733775.1) is another GAM94 target gene, herein designated TARGET GENE. MEIS2 BINDING SITE1 and MEIS2 BINDING SITE2 are target binding sites found in untranslated regions of multiple transcripts of mRNA encoded by MEIS2, corresponding to target binding sites such as BINDING SITE I, BINDING SITE II or BINDING SITE III of FIG. 8. Table 4 illustrates the complementarity of the nucleotide sequences of MEIS2 BINDING SITE1 and MEIS2 BINDING SITE2, designated SEQ ID:19135 and SEQ ID:19135 respectively, to the nucleotide sequence of GAM94 RNA, herein designated GAM RNA, also designated SEQ ID:332.

Another function of GAM94 is therefore inhibition of Meis1, myeloid ecotropic viral integration site 1 homolog 2 (mouse) (MEIS2, Accession NP_733775.1), a gene which may regulate gene expression and control cell differentiation.

Accordingly, utilities of GAM94 include diagnosis, prevention and treatment of diseases and clinical conditions associated with MEIS2.

The function of MEIS2 has been established by previous studies. The Meis1 locus (OMIM Ref. No. 601739) was isolated as a common site of viral integration involved in myeloid leukemia in BXH-2 mice. Steelman et al. (1997) noted that MEIS1 encodes a homeo box protein belonging to the TALE ('three amino acid loop extension') family of homeodomain-containing proteins. The homeodomain of MEIS1 is the only conserved motif in the entire 390-amino acid protein. Steelman et al. (1997) reported that Southern blot analyses using the MEIS1 homeodomain as a probe revealed the existence of a family of Meis1-related genes (MRGs) in several divergent species. In addition, the 3-prime untranslated region (UTR) of MEIS1 is remarkably conserved in evolution. Steelman et al. (1997) cloned Meis1-related genes from the mouse and human genomes. One such gene, which the authors designated Mrg1, shares a similar genomic organization in the mouse with Meis1 but was found to be located on mouse chromosome 2, not mouse chromosome 11, where Meis1 maps. In humans, Steelman et al. (1997) mapped MRG1 to 15q22-q25 in a region associated with various cytogenetic abnormalities associated with acute myelocytic leukemia, chronic myeloid leukemia, and astrocytomas. The authors reported data suggesting that another related gene (MRG2) maps to human chromosome 17. During the course of their studies of the human MEIS1 homeo box gene, Smith et al. (1997) identified a gene closely related but not identical to MEIS1. Sequence analysis showed it to be the human counterpart of the mouse gene Meis2 (Nakamura et al., 1996). Human MEIS2 was found to be expressed in various human tissues. In hematopoietic tissues, the lymphoid organs expressed high levels of MEIS2 as 2 transcripts of 4.0 kb and 3.5 kb. MEIS2 is also expressed in some regions of the brain, such as the putamen. Nakamura et al. (1996) mapped the mouse Meis2 gene to chromosome 2 in a region syntenic to human 15q. By fluorescence in situ hybridization with a genomic MEIS2 clone, Smith et al. (1997) mapped the human MEIS2 gene to a position that is 27% of the distance from the chromosome 15 centromere to the telomere, corresponding to 15q14. Capdevila et al. (1999) showed that restriction of expression of the chick homeobox gene Meis2 to proximal regions of the limb bud is essential for limb development, since ectopic Meis2 severely disrupted limb outgrowth. They also uncovered an antagonistic relationship between the secreted factor Gremlin (OMIM Ref. No. 603054) and the bone morphogenetic proteins (Bmps; OMIM Ref. No. 112264) that is required to maintain the Sonic hedgehog (OMIM Ref. No. 600725)/fibroblast growth factor (see OMIM Ref. No. 131220) loop that regulates distal outgrowth. These proximal and distal factors were found to have coordinated activities: Meis2 could repress distal genes, and the Bmp and Hoxd (OMIM Ref. No. 142987) genes restricted Meis2 expression to the proximal limb bud. Moreover, combinations of Bmps and apical ectodermal ridge (AER) factors were sufficient to distalize proximal limb cells. These results unveiled a set of proximal-distal regulatory interactions that establish and maintain outgrowth of the vertebrate limb. Mercader et al. (1999) described the role of homeo box genes Meis1, Meis2, and Pbx1 (OMIM Ref. No. 176310) in the development of mouse, chicken, and Drosophila limbs. Mercader et al. (1999) found that Meis1 and Meis2 expression is restricted to the proximal domain, coincident with the previously reported domain in which Pbx1 is localized to the nucleus. Meis1 regulates Pbx1 activity by promoting nuclear import of the Pbx1 protein. Mercader et al. (1999) also demonstrated that ectopic expression of Meis1 in chicken disrupts distal limb development and induces distal- to - proximal transformations. Mercader et al. (1999) concluded that the restriction of Meis1 to proximal regions of the vertebrate limb is essential to specify cell fates and differentiation patterns along the proximodistal axis of the limb.

Full details of the abovementioned studies are described in the following publications, the disclosure of which are hereby incorporated by reference:

Capdevila, J.; Tsukui, T.; Esteban, C. R.; Zappavigna, V.; Belmonte, J. C. I.: Control of vertebrate limb outgrowth by the proximal factor Meis2 and distal antagonism of BMPs by Gremlin. Molec. Cell 4:839-849, 1999. ; and Mercader, N.; Leonardo, E.; Azpiazu, N.; Serrano, A.; Morata, G.; Martinez-A, C.; Torres, M.: Conserved regulation of proximodistal limb axis development by Meis1/Hth. Nature 402:425.

Further studies establishing the function and utilities of MEIS2 are found in John Hopkins OMIM database record ID 601740, and in cited publications listed in Table 5, which are hereby incorporated by reference. Meis1, myeloid ecotropic viral integration site 1 homolog 2 (mouse) (MEIS2, Accession NP_064534.1) is another GAM94 target gene, herein designated TARGET GENE. MEIS2 BINDING SITE1 and MEIS2 BINDING SITE2 are target binding sites found in untranslated regions of multiple transcripts of mRNA encoded by MEIS2, corresponding to target binding sites such as BINDING SITE I, BINDING SITE II or BINDING SITE III of FIG. 8. Table 4 illustrates the complementarity of the nucleotide sequences of MEIS2 BINDING SITE1 and MEIS2 BINDING SITE2, designated SEQ ID:19135 and SEQ ID:19135 respectively, to the nucleotide sequence of GAM94 RNA, herein designated GAM RNA, also designated SEQ ID:332.

Another function of GAM94 is therefore inhibition of Meis1, myeloid ecotropic viral integration site 1 homolog 2 (mouse) (MEIS2, Accession NP_064534.1), a gene which may regulate gene expression and control cell differentiation. Accordingly, utilities of GAM94 include diagnosis, prevention and treatment of diseases and clinical conditions associated with MEIS2.

The function of MEIS2 has been established by previous studies. The Meis1 locus (OMIM Ref. No. 601739) was isolated as a common site of viral integration involved in myeloid leukemia in BXH-2 mice. Steelman et al. (1997) noted that MEIS1 encodes a homeo box protein belonging to the TALE ('three amino acid loop extension') family of homeodomain-containing proteins. The homeodomain of MEIS1 is the only conserved motif in the entire 390-amino acid protein. Steelman et al. (1997) reported that Southern blot analyses using the MEIS1 homeodomain as a probe revealed the existence of a family of Meis1-related genes (MRGs) in several divergent species. In addition, the 3-prime untranslated region (UTR) of MEIS1 is remarkably conserved in evolution. Steelman et al. (1997) cloned Meis1-related genes from the mouse and human genomes. One such gene, which the authors designated Mrg1, shares a similar genomic organization in the mouse with Meis1 but was found to be located on mouse chromosome 2, not mouse chromosome 11, where Meis1 maps. In humans, Steelman et al. (1997) mapped MRG1 to 15q22-q25 in a region associated with various cytogenetic abnormalities associated with acute myelocytic leukemia, chronic myeloid leukemia, and astrocytomas. The authors reported data suggesting that another related gene (MRG2) maps to human chromosome 17. During the course of their studies of the human MEIS1 homeo box gene, Smith et al. (1997) identified a gene closely related but not identical to MEIS1. Sequence analysis showed it to be the human counterpart of the mouse gene Meis2 (Nakamura et al., 1996). Human MEIS2 was found to be expressed in various human tissues. In hematopoietic tissues, the lymphoid organs expressed high levels of MEIS2 as 2 transcripts of 4.0 kb and 3.5 kb. MEIS2 is also expressed in some regions of the brain, such as the putamen. Nakamura et al. (1996) mapped the mouse Meis2 gene to chromosome 2 in a region syntenic to human 15q. By fluorescence in situ hybridization with a genomic MEIS2 clone, Smith et al. (1997) mapped the human MEIS2 gene to a position that is 27% of the distance from the chromosome 15 centromere to the telomere, corresponding to 15q14. Capdevila et al. (1999) showed that restriction of expression of the chick homeobox gene Meis2 to proximal regions of the limb bud is essential for limb development, since ectopic Meis2 severely disrupted limb outgrowth. They also uncovered an antagonistic relationship between the secreted factor Gremlin (OMIM Ref. No. 603054) and the bone morphogenetic proteins (Bmps; OMIM Ref. No. 112264) that is required to maintain the Sonic hedgehog (OMIM Ref. No. 600725)/fibroblast growth factor (see OMIM Ref. No. 131220) loop that regulates distal outgrowth. These proximal and distal factors were found to have coordinated activities: Meis2 could repress distal genes, and the Bmp and Hoxd (OMIM Ref. No. 142987) genes restricted Meis2 expression to the proximal limb bud. Moreover, combinations of Bmps and apical ectodermal ridge (AER) factors were sufficient to distalize proximal limb cells. These results unveiled a set of proximal-distal regulatory interactions that establish and maintain outgrowth of the vertebrate limb. Mercader et al. (1999) described the role of homeo box genes Meis1, Meis2, and Pbx1 (OMIM Ref. No. 176310) in the development of mouse, chicken, and Drosophila limbs. Mercader et al. (1999) found that Meis1 and Meis2 expression is restricted to the proximal domain, coincident with the previously reported domain in which Pbx1 is localized to the nucleus. Meis1 regulates Pbx1 activity by promoting nuclear import of the Pbx1 protein. Mercader et al. (1999) also demonstrated that ectopic expression of Meis1 in chicken disrupts distal limb development and induces distal- to - proximal transformations. Mercader et al. (1999) concluded that the restriction of Meis1 to proximal regions of the vertebrate limb is essential to specify cell fates and differentiation patterns along the proximodistal axis of the limb.

Full details of the abovementioned studies are described in the following publications, the disclosure of which are hereby incorporated by reference:

Capdevila, J.; Tsukui, T.; Esteban, C. R.; Zappavigna, V.; Belmonte, J. C. I.: Control of vertebrate limb outgrowth by the proximal factor Meis2 and distal antagonism of BMPs by Gremlin. Molec. Cell 4:839-849, 1999. ; and Mercader, N.; Leonardo, E.; Azpiazu, N.; Serrano, A.; Morata, G.; Martinez-A, C.; Torres, M.: Conserved regulation of proximodistal limb axis development by Meis1/Hth. Nature 402:425.

Further studies establishing the function and utilities of MEIS2 are found in John Hopkins OMIM database record ID 601740, and in cited publications listed in Table 5, which are hereby incorporated by reference. Meis1, myeloid ecotropic viral integration site 1 homolog 2 (mouse) (MEIS2, Accession NP_002390.1) is another GAM94 target gene, herein designated TARGET GENE. MEIS2 BINDING SITE1 and MEIS2 BINDING SITE2 are target binding sites found in untranslated regions of multiple transcripts of mRNA encoded by MEIS2, corresponding to target binding sites such as BINDING SITE I, BINDING SITE II or BINDING SITE III of FIG. 8. Table 4 illustrates the complementarity of the nucleotide sequences of MEIS2 BINDING SITE1 and MEIS2 BINDING SITE2, designated SEQ ID:2527 and SEQ ID:19135 respectively, to the nucleotide sequence of GAM94 RNA, herein designated GAM RNA, also designated SEQ ID:332.

Another function of GAM94 is therefore inhibition of Meis1, myeloid ecotropic viral integration site 1 homolog 2 (mouse) (MEIS2, Accession NP_002390.1), a gene which may regulate gene expression and control cell differentiation. Accordingly, utilities of GAM94 include diagnosis, prevention and treatment of diseases and clinical conditions associated with MEIS2.

The function of MEIS2 has been established by previous studies. The Meis1 locus (OMIM Ref. No. 601739) was isolated as a common site of viral integration involved in myeloid leukemia in BXH-2 mice. Steelman et al. (1997) noted that MEIS1 encodes a homeo box protein belonging to the TALE ('three amino acid loop extension') family of homeodomain-containing proteins. The homeodomain of MEIS1 is the only conserved motif in the entire 390-amino acid protein. Steelman et al. (1997) reported that Southern blot analyses using the MEIS1 homeodomain as a probe revealed the existence of a family of Meis1-related genes (MRGs) in several divergent species. In addition, the 3-prime untranslated region (UTR) of MEIS1 is remarkably conserved in evolution. Steelman et al. (1997) cloned Meis1-related genes from the mouse and human genomes. One such gene, which the authors designated Mrg1, shares a similar genomic organization in the mouse with Meis1 but was found to be located on mouse chromosome 2, not mouse chromosome 11, where Meis1 maps. In humans, Steelman et al. (1997) mapped MRG1 to 15q22-q25 in a region associated with various cytogenetic abnormalities associated with acute myelocytic leukemia, chronic myeloid leukemia, and astrocytomas. The authors reported data suggesting that another related gene (MRG2) maps to human chromosome 17. During the course of their studies of the human MEIS1 homeo box gene, Smith et al. (1997) identified a gene closely related but not identical to MEIS1. Sequence analysis showed it to be the human counterpart of the mouse gene Meis2 (Nakamura et al., 1996). Human MEIS2 was found to be expressed in various human tissues. In hematopoietic tissues, the lymphoid organs expressed high levels of MEIS2 as 2 transcripts of 4.0 kb and 3.5 kb. MEIS2 is also expressed in some regions of the brain, such as the putamen. Nakamura et al. (1996) mapped the mouse Meis2 gene to chromosome 2 in a region syntenic to human 15q. By fluorescence in situ hybridization with a genomic MEIS2 clone, Smith et al. (1997) mapped the human MEIS2 gene to a position that is 27% of the distance from the chromosome 15 centromere to the telomere, corresponding to 15q14. Capdevila et al. (1999) showed that restriction of expression of the chick homeobox gene Meis2 to proximal regions of the limb bud is essential for limb development, since ectopic Meis2 severely disrupted limb outgrowth. They also uncovered an antagonistic relationship between the secreted factor Gremlin (OMIM Ref. No. 603054) and the bone morphogenetic proteins (Bmps; OMIM Ref. No. 112264) that is required to maintain the Sonic hedgehog (OMIM Ref. No. 600725)/fibroblast growth factor (see OMIM Ref. No. 131220) loop that regulates distal outgrowth. These proximal and distal factors were found to have coordinated activities: Meis2 could repress distal genes, and the Bmp and Hoxd (OMIM Ref. No. 142987) genes restricted Meis2 expression to the proximal limb bud. Moreover, combinations of Bmps and apical ectodermal ridge (AER) factors were sufficient to distalize proximal limb cells. These results unveiled a set of proximal-distal regulatory interactions that establish and maintain outgrowth of the vertebrate limb. Mercader et al. (1999) described the role of homeo box genes Meis1, Meis2, and Pbx1 (OMIM Ref. No. 176310) in the development of mouse, chicken, and Drosophila limbs. Mercader et al. (1999) found that Meis1 and Meis2 expression is restricted to the proximal domain, coincident with the previously reported domain in which Pbx1 is localized to the nucleus. Meis1 regulates Pbx1 activity by promoting nuclear import of the Pbx1 protein. Mercader et al. (1999) also demonstrated that ectopic expression of Meis1 in chicken disrupts distal limb development and induces distal- to - proximal transformations. Mercader et al. (1999) concluded that the restriction of Meis1 to proximal regions of the vertebrate limb is essential to specify cell fates and differentiation patterns along the proximodistal axis of the limb.

Full details of the abovementioned studies are described in the following publications, the disclosure of which are hereby incorporated by reference:

Capdevila, J.; Tsukui, T.; Esteban, C. R.; Zappavigna, V.; Belmonte, J. C. I.: Control of vertebrate limb outgrowth by the proximal factor Meis2 and distal antagonism of BMPs by Gremlin. Molec. Cell 4:839-849, 1999. ; and Mercader, N.; Leonardo, E.; Azpiazu, N.; Serrano, A.; Morata, G.; Martinez-A, C.; Torres, M.: Conserved regulation of proximodistal limb axis development by Meis1/Hth. Nature 402:425.

Further studies establishing the function and utilities of MEIS2 are found in John Hopkins OMIM database record ID 601740, and in cited publications listed in Table 5, which are hereby incorporated by reference. MGC12921 (Accession NP_116117.1) is another GAM94 target gene, herein designated TARGET GENE. MGC12921 BINDING SITE is a target binding site found in the 5' untranslated region of mRNA encoded by MGC12921, corresponding to a target binding site such as BINDING SITE I, BINDING SITE II or BINDING SITE III of FIG. 8. Table 4 illustrates the complementarity of the nucleotide sequences of MGC12921 BINDING SITE, designated SEQ ID:13510, to the nucleotide sequence of GAM94 RNA, herein designated GAM RNA, also designated SEQ ID:332.

Another function of GAM94 is therefore inhibition of MGC12921 (Accession NP_116117.1). Accordingly, utilities of GAM94 include diagnosis, prevention and treatment of diseases and clinical conditions associated with MGC12921.

MGC14136 (Accession NP_116299.1) is another GAM94 target gene, herein designated TARGET GENE. MGC14136 BINDING SITE is a target binding site found in the 3' untranslated region of mRNA encoded by MGC14136, corresponding to a target binding site such as BINDING SITE I, BINDING SITE II or BINDING SITE III of FIG. 8. Table 4 illustrates the complementarity of the nucleotide sequences of MGC14136 BINDING SITE, designated SEQ ID:1773, to the nucleotide sequence of GAM94 RNA, herein designated GAM RNA, also designated SEQ ID:332.

Another function of GAM94 is therefore inhibition of MGC14136 (Accession NP_116299.1). Accordingly, utilities of GAM94 include diagnosis, prevention and treatment of diseases and clinical conditions associated with MGC14136.

MGC15476 (Accession NP_659493.1) is another GAM94 target gene, herein designated TARGET GENE. MGC15476 BINDING SITE is a target binding site found in the 3' untranslated region of mRNA encoded by MGC15476, corresponding to a target binding site such as BINDING SITE I, BINDING SITE II or BINDING SITE III of FIG. 8. Table 4 illustrates the complementarity of the nucleotide sequences of MGC15476 BINDING SITE, designated SEQ ID:524, to the nucleotide sequence of GAM94 RNA, herein designated GAM RNA, also designated SEQ ID:332.

Another function of GAM94 is therefore inhibition of MGC15476 (Accession NP_659493.1). Accordingly, utilities of GAM94 include diagnosis, prevention and treatment of diseases and clinical conditions associated with MGC15476.

MGC15631 (Accession NP_116142.1) is another GAM94 target gene, herein designated TARGET GENE. MGC15631 BINDING SITE is a target binding site found in the 5' untranslated region of mRNA encoded by MGC15631, corresponding to a target binding site such as BINDING SITE I, BINDING SITE II or BINDING SITE III of FIG. 8. Table 4 illustrates the complementarity of the nucleotide sequences of MGC15631 BINDING SITE, designated SEQ ID:17793, to the nucleotide sequence of GAM94 RNA, herein designated GAM RNA, also designated SEQ ID:332.

Another function of GAM94 is therefore inhibition of MGC15631 (Accession NP_116142.1). Accordingly, utilities of GAM94 include diagnosis, prevention and treatment of diseases and clinical conditions associated with MGC15631.

MGC16044 (Accession NP_612380.1) is another GAM94 target gene, herein designated TARGET GENE. MGC16044 BINDING SITE is a target binding site found in the 5' untranslated region of mRNA encoded by MGC16044, corresponding to a target binding site such as BINDING SITE I, BINDING SITE II or BINDING SITE III of FIG. 8. Table 4 illustrates the complementarity of the nucleotide sequences of MGC16044 BINDING SITE, designated SEQ ID:10140, to the nucleotide sequence of GAM94 RNA, herein designated GAM RNA, also designated SEQ ID:332.

Another function of GAM94 is therefore inhibition of MGC16044 (Accession NP_612380.1). Accordingly, utilities of GAM94 include diagnosis, prevention and treatment of diseases and clinical conditions associated with MGC16044.

MGC16063 (Accession NP_444275.1) is another GAM94 target gene, herein designated TARGET GENE. MGC16063 BINDING SITE is a target binding site found in the 5' untranslated region of mRNA encoded by MGC16063, corresponding to a target binding site such as BINDING SITE I, BINDING SITE II or BINDING SITE III of FIG. 8. Table 4 illustrates the complementarity of the nucleotide sequences of MGC16063 BINDING SITE, designated SEQ ID:17265, to the nucleotide sequence of GAM94 RNA, herein designated GAM RNA, also designated SEQ ID:332.

Another function of GAM94 is therefore inhibition of MGC16063 (Accession NP_444275.1). Accordingly, utilities of GAM94 include diagnosis, prevention and treatment of diseases and clinical conditions associated with MGC16063.

MGC23980 (Accession NP_659442.2) is another GAM94 target gene, herein designated TARGET GENE. MGC23980 BINDING SITE is a target binding site found in the 3' untranslated region of mRNA encoded by MGC23980, corresponding to a target binding site such as BINDING SITE I, BINDING SITE II or BINDING SITE III of FIG. 8. Table 4 illustrates the complementarity of the nucleotide sequences of MGC23980 BINDING SITE, designated SEQ ID:4692, to the nucleotide sequence of GAM94 RNA, herein designated GAM RNA, also designated SEQ ID:332.

Another function of GAM94 is therefore inhibition of MGC23980 (Accession NP_659442.2). Accordingly, utilities of GAM94 include diagnosis, prevention and treatment of diseases and clinical conditions associated with MGC23980.

MGC24995 (Accession NP_714914.1) is another GAM94 target gene, herein designated TARGET GENE. MGC24995 BINDING SITE is a target binding site found in the 3' untranslated region of mRNA encoded by MGC24995, corresponding to a target binding site such as BINDING SITE I, BINDING SITE II or BINDING SITE III of FIG. 8. Table 4 illustrates the complementarity of the nucleotide sequences of MGC24995 BINDING SITE, designated SEQ ID:18721, to the nucleotide sequence of GAM94 RNA, herein designated GAM RNA, also designated SEQ ID:332.

Another function of GAM94 is therefore inhibition of MGC24995 (Accession NP_714914.1). Accordingly, utilities of GAM94 include diagnosis, prevention and treatment of diseases and clinical conditions associated with MGC24995.

MGC2705 (Accession NP_116090.2) is another GAM94 target gene, herein designated TARGET GENE. MGC2705 BINDING SITE is a target binding site found in the 5' untranslated region of mRNA encoded by MGC2705, corresponding to a target binding site such as BINDING SITE I, BINDING SITE II or BINDING SITE III of FIG. 8. Table 4 illustrates the complementarity of the nucleotide sequences of MGC2705 BINDING SITE, designated SEQ ID:4995, to the nucleotide sequence of GAM94 RNA, herein designated GAM RNA, also designated SEQ ID:332.

Another function of GAM94 is therefore inhibition of MGC2705 (Accession NP_116090.2). Accordingly, utilities of GAM94 include diagnosis, prevention and treatment of diseases and clinical conditions associated with MGC2705.

MGC27382 (Accession XP_294972.1) is another GAM94 target gene, herein designated TARGET GENE. MGC27382 BINDING SITE is a target binding site found in the 3' untranslated region of mRNA encoded by MGC27382, corresponding to a target binding site such as BINDING SITE I, BINDING SITE II or BINDING SITE III of FIG. 8. Table 4 illustrates the complementarity of the nucleotide sequences of MGC27382 BINDING SITE, designated SEQ ID:10511, to the nucleotide sequence of GAM94 RNA, herein designated GAM RNA, also designated SEQ ID:332.

Another function of GAM94 is therefore inhibition of MGC27382 (Accession XP_294972.1). Accordingly, utilities of GAM94 include diagnosis, prevention and treatment of diseases and clinical conditions associated with MGC27382.

MGC32104 (Accession NP_653285.1) is another GAM94 target gene, herein designated TARGET GENE. MGC32104 BINDING SITE1 and MGC32104 BINDING SITE2 are target binding sites found in untranslated regions of mRNA encoded by MGC32104, corresponding to target binding sites such as BINDING SITE I, BINDING SITE II or BINDING SITE III of FIG. 8. Table 4 illustrates the complementarity of the nucleotide sequences of MGC32104 BINDING SITE1 and MGC32104 BINDING SITE2, designated SEQ ID:6076 and SEQ ID:3355 respectively, to the nucleotide sequence of GAM94 RNA, herein designated GAM RNA, also designated SEQ ID:332.

Another function of GAM94 is therefore inhibition of MGC32104 (Accession NP_653285.1). Accordingly, utilities of GAM94 include diagnosis, prevention and treatment of diseases and clinical conditions associated with MGC32104.

MGC3262 (Accession NP_076934.1) is another GAM94 target gene, herein designated TARGET GENE. MGC3262 BINDING SITE is a target binding site found in the 3' untranslated region of mRNA encoded by MGC3262, corresponding to a target binding site such as BINDING SITE I, BINDING SITE II or BINDING SITE III of FIG. 8. Table 4 illustrates the complementarity of the nucleotide sequences of MGC3262 BINDING SITE, designated SEQ ID:8239, to the nucleotide sequence of GAM94 RNA, herein designated GAM RNA, also designated SEQ ID:332.

Another function of GAM94 is therefore inhibition of MGC3262 (Accession NP_076934.1). Accordingly, utilities of GAM94 include diagnosis, prevention and treatment of diseases and clinical conditions associated with MGC3262.

MGC33974 (Accession NP_699181.1) is another GAM94 target gene, herein designated TARGET GENE. MGC33974 BINDING SITE is a target binding site found in the 3' untranslated region of mRNA encoded by MGC33974, corresponding to a target binding site such as BINDING SITE I, BINDING SITE II or BINDING SITE III of FIG. 8. Table 4 illustrates the complementarity of the nucleotide sequences of MGC33974 BINDING SITE, designated SEQ ID:16821, to the nucleotide sequence of GAM94 RNA, herein designated GAM RNA, also designated SEQ ID:332.

Another function of GAM94 is therefore inhibition of MGC33974 (Accession NP_699181.1). Accordingly, utilities of GAM94 include diagnosis, prevention and treatment of diseases and clinical conditions associated with MGC33974.

MGC39518 (Accession NP_776183.1) is another GAM94 target gene, herein designated TARGET GENE. MGC39518 BINDING SITE is a target binding site found in the 5' untranslated region of mRNA encoded by MGC39518, corresponding to a target binding site such as BINDING SITE I, BINDING SITE II or BINDING SITE III of FIG. 8. Table 4 illustrates the complementarity of the nucleotide sequences of MGC39518 BINDING SITE, designated SEQ ID:4349, to the nucleotide sequence of GAM94 RNA, herein designated GAM RNA, also designated SEQ ID:332.

Another function of GAM94 is therefore inhibition of MGC39518 (Accession NP_776183.1). Accordingly, utilities of GAM94 include diagnosis, prevention and treatment of diseases and clinical conditions associated with MGC39518.

MGC40107 (Accession NP_689979.1) is another GAM94 target gene, herein designated TARGET GENE. MGC40107 BINDING SITE is a target binding site found in the 3' untranslated region of mRNA encoded by MGC40107, corresponding to a target binding site such as BINDING SITE I, BINDING SITE II or BINDING SITE III of FIG. 8. Table 4 illustrates the complementarity of the nucleotide sequences of MGC40107 BINDING SITE, designated SEQ ID:20005, to the nucleotide sequence of GAM94 RNA, herein designated GAM RNA, also designated SEQ ID:332.

Another function of GAM94 is therefore inhibition of MGC40107 (Accession NP_689979.1). Accordingly, utilities of GAM94 include diagnosis, prevention and treatment of diseases and clinical conditions associated with MGC40107.

MGC40168 (Accession NP_714920.1) is another GAM94 target gene, herein designated TARGET GENE. MGC40168 BINDING SITE is a target binding site found in the 3' untranslated region of mRNA encoded by MGC40168, corresponding to a target binding site such as BINDING SITE I, BINDING SITE II or BINDING SITE III of FIG. 8. Table 4 illustrates the complementarity of the nucleotide sequences of MGC40168 BINDING SITE, designated SEQ ID:10970, to the nucleotide sequence of GAM94 RNA, herein designated GAM RNA, also designated SEQ ID:332.

Another function of GAM94 is therefore inhibition of MGC40168 (Accession NP_714920.1). Accordingly, utilities of GAM94 include diagnosis, prevention and treatment of diseases and clinical conditions associated with MGC40168.

MGC4607 (Accession NP_113631.1) is another GAM94 target gene, herein designated TARGET GENE. MGC4607 BINDING SITE is a target binding site found in the 5' untranslated region of mRNA encoded by MGC4607, corresponding to a target binding site such as BINDING SITE I, BINDING SITE II or BINDING SITE III of FIG. 8. Table 4 illustrates the complementarity of the nucleotide sequences of MGC4607 BINDING SITE, designated SEQ ID:10730, to the nucleotide sequence of GAM94 RNA, herein designated GAM RNA, also designated SEQ ID:332.

Another function of GAM94 is therefore inhibition of MGC4607 (Accession NP_113631.1). Accordingly, utilities of GAM94 include diagnosis, prevention and treatment of diseases and clinical conditions associated with MGC4607.

Meningioma (disrupted in balanced translocation) 1 (MN1, Accession NP_002421.2) is another GAM94 target gene, herein designated TARGET GENE. MN1 BINDING SITE is a target binding site found in the 3' untranslated region of mRNA encoded by MN1, corresponding to a target binding site such as BINDING SITE I, BINDING SITE II or BINDING SITE III of FIG. 8. Table 4 illustrates the complementarity of the nucleotide sequences of MN1 BINDING SITE, designated SEQ ID:15003, to the nucleotide sequence of GAM94 RNA, herein designated GAM RNA, also designated SEQ ID:332.

Another function of GAM94 is therefore inhibition of Meningioma (disrupted in balanced translocation) 1 (MN1, Accession NP_002421.2). Accordingly, utilities of GAM94 include diagnosis, prevention and treatment of diseases and clinical conditions associated with MN1.

MOST2 (Accession NP_064635.1) is another GAM94 target gene, herein designated TARGET GENE. MOST2 BINDING SITE is a target binding site found in the 5' untranslated region of mRNA encoded by MOST2, corresponding to a target binding site such as BINDING SITE I, BINDING SITE II or BINDING SITE III of FIG. 8. Table 4 illustrates the complementarity of the nucleotide sequences of MOST2 BINDING SITE, designated SEQ ID:677, to the nucleotide sequence of GAM94 RNA, herein designated GAM RNA, also designated SEQ ID:332.

Another function of GAM94 is therefore inhibition of MOST2 (Accession NP_064635.1). Accordingly, utilities of GAM94 include diagnosis, prevention and treatment of diseases and clinical conditions associated with MOST2.

MOT8 (Accession NP_061324.1) is another GAM94 target gene, herein designated TARGET GENE. MOT8 BINDING SITE is a target binding site found in the 3' untranslated region of mRNA encoded by MOT8, corresponding to a target binding site such as BINDING SITE I, BINDING SITE II or BINDING SITE III of FIG. 8. Table 4 illustrates the complementarity of the nucleotide sequences of MOT8 BINDING SITE, designated SEQ ID:16345, to the nucleotide sequence of GAM94 RNA, herein designated GAM RNA, also designated SEQ ID:332.

Another function of GAM94 is therefore inhibition of MOT8 (Accession NP_061324.1). Accordingly, utilities of GAM94 include diagnosis, prevention and treatment of diseases and clinical conditions associated with MOT8.

Mll septin-like fusion (MSF, Accession NP_006631.1) is another GAM94 target gene, herein designated TARGET GENE. MSF BINDING SITE is a target binding site found in the 5' untranslated region of mRNA encoded by MSF, corresponding to a target binding site such as BINDING SITE I, BINDING SITE II or BINDING SITE III of FIG. 8. Table 4 illustrates the complementarity of the nucleotide sequences of MSF BINDING SITE, designated SEQ ID:18395, to the nucleotide sequence of GAM94 RNA, herein designated GAM RNA, also designated SEQ ID:332.

Another function of GAM94 is therefore inhibition of Mll septin-like fusion (MSF, Accession NP_006631.1), a gene which plays a role in the cell cycle. and therefore may be associated with Therapy-related acute myeloid leukemia, ovarian tumors. Accordingly, utilities of GAM94 include diagnosis, prevention and treatment of Therapy-related acute myeloid leukemia, ovarian tumors, and of other diseases and clinical conditions associated with MSF.

The function of MSF and its association with various diseases and clinical conditions, has been established by previous studies, as described hereinabove with reference to GAM71.1. Myotubularin related protein 9 (MTMR9, Accession NP_056273.2) is another GAM94 target gene, herein designated TARGET GENE. MTMR9 BINDING SITE is a target binding site found in the 3' untranslated region of mRNA encoded by MTMR9, corresponding to a target binding site such as BINDING SITE I, BINDING SITE II or BINDING SITE III of FIG. 8. Table 4 illustrates the complementarity of the nucleotide sequences of MTMR9 BINDING SITE, designated SEQ ID:15033, to the nucleotide sequence of GAM94 RNA, herein designated GAM RNA, also designated SEQ ID:332.

Another function of GAM94 is therefore inhibition of Myotubularin related protein 9 (MTMR9, Accession NP_056273.2). Accordingly, utilities of GAM94 include diagnosis, prevention and treatment of diseases and clinical conditions associated with MTMR9.

Mucin 17 (MUC17, Accession XP_168583.2) is another GAM94 target gene, herein designated TARGET GENE. MUC17 BINDING SITE is a target binding site found in the 3' untranslated region of mRNA encoded by MUC17, corresponding to a target binding site such as BINDING SITE I, BINDING SITE II or BINDING SITE III of FIG. 8. Table 4 illustrates the complementarity of the nucleotide sequences of MUC17 BINDING SITE, designated SEQ ID:678, to the nucleotide sequence of GAM94 RNA, herein designated GAM RNA, also designated SEQ ID:332.

Another function of GAM94 is therefore inhibition of Mucin 17 (MUC17, Accession XP_168583.2). Accordingly, utilities of GAM94 include diagnosis, prevention and treatment of diseases and clinical conditions associated with MUC17.

Max interacting protein 1 (MXI1, Accession NP_569157.1) is another GAM94 target gene, herein designated TARGET GENE. MXI1 BINDING SITE is a target binding site found in the 3' untranslated region of multiple transcripts of mRNA encoded by MXI1, corresponding to a target binding site such as BINDING SITE I, BINDING SITE II or BINDING SITE III of FIG. 8. Table 4 illustrates the complementarity of the nucleotide sequences of MXI1 BINDING SITE, designated SEQ ID:1149, to the nucleotide sequence of GAM94 RNA, herein designated GAM RNA, also designated SEQ ID:332.

Another function of GAM94 is therefore inhibition of Max interacting protein 1 (MXI1, Accession NP_569157.1), a gene which acts as a tumor suppressor in vivo, engages the MYC network in a functionally relevant manner and therefore may be associated with Prostate cancer, neurofibrosarcoma. Accordingly, utilities of GAM94 include diagnosis, prevention and treatment of Prostate cancer, neurofibrosarcoma, and of other diseases and clinical conditions associated with MXI1.

The function of MXI1 has been established by previous studies. One of the most common chromosomal abnormalities in prostate cancer involves loss of 10q22-qter. Rarely, a smaller deletion, involving 10q24-q25 has been observed, suggesting the presence of a tumor suppressor gene at that site. Prochownik et al. (1998) prospectively evaluated prostate tumors for loss of MXI1 by FISH and cytogenetic techniques. Of 40 tumors, 21 (53%) demonstrated loss of a single MXI1 allele, as determined by FISH. In 10 cases with cytogenetically normal long arms of chromosome 10, but with FISH-documented deletion of MXI1, 8 mutations of MXI1 were identified. Five of the mutant proteins were incapable of binding DNA in association with MAX. Prochownik et al. (1998) concluded that MXI1 gene loss in prostate cancer is common and most frequently involves a cytogenetically undetectable deletion.

Animal model experiments lend further support to the function of MXI1. MXI1 belongs to the family of proteins that function as potent antagonists of MYC oncoproteins. This antagonism relates to their ability to compete with MYC for the protein MAX and for consensus DNA binding sites and to recruit Sin3 proteins and their associated corepressors. Schreiber-Agus et al. (1998) disrupted the Mxi1 open reading frame in transgenic mice by eliminating an exon required for the production of the 2 mouse Mxi1 isoforms. They showed that the mice lacking Mxi1 exhibit progressive multisystem abnormalities. The mice also showed increased susceptibility to tumorigenesis either following carcinogen treatment or when also deficient in INK4A (OMIM Ref. No. 600160). This cancer-prone phenotype may correspond with the enhanced ability of several MXI1-deficient cell types, including prostatic epithelium, to proliferate. The results show that MXI1 is involved in the homeostasis of differentiated organ systems, acts as a tumor suppressor in vivo, and engages the MYC network in a functionally relevant manner. In histologic studies of the mice, Schreiber-Agus et al. (1998) focused particularly on organs that normally express high or sustained levels of Mxi1, e.g., brain, spleen, kidney, and liver, and on tissue types that are susceptible to tumorigenesis when a putative tumor suppressor is lost from the 10q24-q26 region; for example, the spleen and thymus are susceptible to T-cell leukemia, the prostatic epithelium to prostate cancer, and the brain to glioblastoma multiforme when the 10q24-q26 region is mutated.

It is appreciated that the abovementioned animal model for MXI1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Prochownik, E. V.; Grove, L. E.; Deubler, D.; Zhu, X. L.; Stephenson, R. A.; Rohr, L. R.; Yin, X.; Brothman, A. R.: Commonly occurring loss and mutation of the MXI1 gene in prostate cancer. Genes Chromosomes Cancer 22:295-304, 1998; and Schreiber-Agus, N.; Meng, Y.; Hoang, T.; Hou, H., Jr.; Chen, K.; Greenberg, R.; Cordon-Cardo, C.; Lee, H.-W.; DePinho, R. A.: Role of Mxi1 in ageing organ systems and the regulation of.

Further studies establishing the function and utilities of MXI1 are found in John Hopkins OMIM database record ID 600020, and in cited publications listed in Table 5, which are hereby incorporated by reference. Max interacting protein 1 (MXI1, Accession NP_005953.2) is another GAM94 target gene, herein designated TARGET GENE. MXI1 BINDING SITE is a target binding site found in the 3' untranslated region of multiple transcripts of mRNA encoded by MXI1, corresponding to a target binding site such as BINDING SITE I, BINDING SITE II or BINDING SITE III of FIG. 8. Table 4 illustrates the complementarity of the nucleotide sequences of MXI1 BINDING SITE, designated SEQ ID:1149, to the nucleotide sequence of GAM94 RNA, herein designated GAM RNA, also designated SEQ ID:332.

Another function of GAM94 is therefore inhibition of Max interacting protein 1 (MXI1, Accession NP_005953.2), a gene which acts as a tumor suppressor in vivo, engages the MYC network in a functionally relevant manner and therefore may be associated with Prostate cancer, neurofibrosarcoma. Accordingly, utilities of GAM94 include diagnosis, prevention and treatment of Prostate cancer, neurofibrosarcoma, and of other diseases and clinical conditions associated with MXI1.

The function of MXI1 has been established by previous studies. One of the most common chromosomal abnormalities in prostate cancer involves loss of 10q22-qter. Rarely, a smaller deletion, involving 10q24-q25 has been observed, suggesting the presence of a tumor suppressor gene at that site. Prochownik et al. (1998) prospectively evaluated prostate tumors for loss of MXI1 by FISH and cytogenetic techniques. Of 40 tumors, 21 (53%) demonstrated loss of a single MXI1 allele, as determined by FISH. In 10 cases with cytogenetically normal long arms of chromosome 10, but with FISH- documented deletion of MXI1, 8 mutations of MXI1 were identified. Five of the mutant proteins were incapable of binding DNA in association with MAX. Prochownik et al. (1998) concluded that MXI1 gene loss in prostate cancer is common and most frequently involves a cytogenetically undetectable deletion.

Animal model experiments lend further support to the function of MXI1. MXI1 belongs to the family of proteins that function as potent antagonists of MYC oncoproteins. This antagonism relates to their ability to compete with MYC for the protein MAX and for consensus DNA binding sites and to recruit Sin3 proteins and their associated corepressors. Schreiber-Agus et al. (1998) disrupted the Mxi1 open reading frame in transgenic mice by eliminating an exon required for the production of the 2 mouse Mxi1 isoforms. They showed that the mice lacking Mxi1 exhibit progressive multisystem abnormalities. The mice also showed increased susceptibility to tumorigenesis either following carcinogen treatment or when also deficient in INK4A (OMIM Ref. No. 600160). This cancer-prone phenotype may correspond with the enhanced ability of several MXI1-deficient cell types, including prostatic epithelium, to proliferate. The results show that MXI1 is involved in the homeostasis of differentiated organ systems, acts as a tumor suppressor in vivo, and engages the MYC network in a functionally relevant manner. In histologic studies of the mice, Schreiber-Agus et al. (1998) focused particularly on organs that normally express high or sustained levels of Mxi1, e.g., brain, spleen, kidney, and liver, and on tissue types that are susceptible to tumorigenesis when a putative tumor suppressor is lost from the 10q24-q26 region; for example, the spleen and thymus are susceptible to T-cell leukemia, the prostatic epithelium to prostate cancer, and the brain to glioblastoma multiforme when the 10q24-q26 region is mutated.

It is appreciated that the abovementioned animal model for MXI1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Prochownik, E. V.; Grove, L. E.; Deubler, D.; Zhu, X. L.; Stephenson, R. A.; Rohr, L. R.; Yin, X.; Brothman, A. R.: Commonly occurring loss and mutation of the MXI1 gene in prostate cancer. Genes Chromosomes Cancer 22:295-304, 1998; and Schreiber-Agus, N.; Meng, Y.; Hoang, T.; Hou, H., Jr.; Chen, K.; Greenberg, R.; Cordon-Cardo, C.; Lee, H.-W.; DePinho, R. A.: Role of Mxi1 in ageing organ systems and the regulation of.

Further studies establishing the function and utilities of MXI1 are found in John Hopkins OMIM database record ID 600020, and in cited publications listed in Table 5, which are hereby incorporated by reference. Myosin, heavy polypeptide 10, non-muscle (MYH10, Accession XP_290747.1) is another GAM94 target gene, herein designated TARGET GENE. MYH10 BINDING SITE is a target binding site found in the 5' untranslated region of mRNA encoded by MYH10, corresponding to a target binding site such as BINDING SITE I, BINDING SITE II or BINDING SITE III of FIG. 8. Table 4 illustrates the complementarity of the nucleotide sequences of MYH10 BINDING SITE, designated SEQ ID:4996, to the nucleotide sequence of GAM94 RNA, herein designated GAM RNA, also designated SEQ ID:332.

Another function of GAM94 is therefore inhibition of Myosin, heavy polypeptide 10, non-muscle (MYH10, Accession XP_290747.1) . Accordingly, utilities of GAM94 include diagnosis, prevention and treatment of diseases and clinical conditions associated with MYH10.

Myosin, light polypeptide kinase (MYLK, Accession NP_444256.1) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_444256.1), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myosin, light polypeptide kinase (MYLK, Accession NP_444255.1) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_444255.1), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myosin, light polypeptide kinase (MYLK, Accession NP_444258.1) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_444258.1), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myosin, light polypeptide kinase (MYLK, Accession NP_444259.1) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_444259.1), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myosin, light polypeptide kinase (MYLK, Accession NP_444254.1) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_444254.1), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myosin, light polypeptide kinase (MYLK, Accession NP_005956.2) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_005956.2), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myosin, light polypeptide kinase (MYLK, Accession NP_444260.1) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_444260.1), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myosin, light polypeptide kinase (MYLK, Accession NP_444257.1) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_444257.1), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myosin, light polypeptide kinase (MYLK, Accession NP_444253.1) is another GAM94 target gene, herein designated TARGET GENE. MYLK BINDING SITE is a target binding site found in the 3' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:786, to the nucleotide sequence of GAM94 RNA, herein designated GAM RNA, also designated SEQ ID:332.

Another function of GAM94 is therefore inhibition of Myosin, light polypeptide kinase (MYLK, Accession NP_444253.1), a gene which is involved in contraction of smooth muscle. Accordingly, utilities of GAM94 include diagnosis, prevention and treatment of diseases and clinical conditions associated with MYLK.

The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G. : The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in cited publications listed in Table 5, which are hereby incorporated by reference. Myozenin 2 (MYOZ2, Accession NP_057683.1) is another GAM94 target gene, herein designated TARGET GENE. MYOZ2 BINDING SITE is a target binding site found in the 3' untranslated region of mRNA encoded by MYOZ2, corresponding to a target binding site such as BINDING SITE I, BINDING SITE II or BINDING SITE III of FIG. 8. Table 4 illustrates the complementarity of the nucleotide sequences of MYOZ2 BINDING SITE, designated SEQ ID:7967, to the nucleotide sequence of GAM94 RNA, herein designated GAM RNA, also designated SEQ ID:332.

Another function of GAM94 is therefore inhibition of Myozenin 2 (MYOZ2, Accession NP_057683.1). Accordingly, utilities of GAM94 include diagnosis, prevention and treatment of diseases and clinical conditions associated with MYOZ2.

Neurofilament, heavy polypeptide 200 kda (NEFH, Accession NP_066554.1) is another GAM94 target gene, herein designated TARGET GENE. NEFH BINDING SITE is a target binding site found in the 3' untranslated region of mRNA encoded by NEFH, corresponding to a target binding site such as BINDING SITE I, BINDING SITE II or BINDING SITE III of FIG. 8. Table 4 illustrates the complementarity of the nucleotide sequences of NEFH BINDING SITE, designated SEQ ID:15071, to the nucleotide sequence of GAM94 RNA, herein designated GAM RNA, also designated SEQ ID:332.

Another function of GAM94 is therefore inhibition of Neurofilament, heavy polypeptide 200 kda (NEFH, Accession NP_066554.1), a gene which is involved in the maintenance of neuronal caliber and in mature axons and therefore may be associated with Amyotrophic lateral sclerosis. Accordingly, utilities of GAM94 include diagnosis, prevention and treatment of Amyotrophic lateral sclerosis, and of other diseases and clinical conditions associated with NEFH.

The function of NEFH has been established by previous studies. See 162280. Mattei et al. (1988) used a rat cDNA probe coding for the C-terminal extension of the NFH gene to assign, by in situ hybridization, the human NFH gene to 22q12.1-q13.1. The possible implications of the fact that neurologic disorders such as meningioma map to this region were discussed. In the course of cloning the region between 2 markers, D22S212 and D22S32, that flank the NF2 (OMIM Ref. No. 101000) gene, Rouleau et al. (1993) identified a gene with a neuronal pattern of expression and a transcript size identical to that of NEFH. Use of NEFH cDNA confirmed the identity. There is compelling evidence that the NEFH locus is close to the NF2 locus. For example, Watson et al. (1993) found that the NEFH locus was hemizygous in a deletion that was observed in affected members of a family with NF2 and was estimated to be about 700 kb long. The NF2 locus has been positioned at 22q12.2. Bucan et al. (1993) mapped the homologous murine gene, which they symbolized Nfh, to chromosome 11. The tail of the heavy neurofilament subunit is composed of the repeating amino acid motif, usually X-lysine-serine-proline-Y-lysine (OMIM Ref. No. XKSPYK), where X is a single amino acid and Y is 1 to 3 amino acids. There are 2 common polymorphic variants of 44 and 45 repeats. The tail probably regulates axonal caliber, with interfilament spacing determined by phosphorylation of the KSP motifs. According to Al-Chalabi et al. (1999), the polymorphic variants had been mislabeled in the published literature as 44 and 43 repeat variants, respectively, and therefore were referred to by them simply as long (L) and short (S) alleles.

Full details of the abovementioned studies are described in the following publications, the disclosure of which are hereby incorporated by reference:

Al-Chalabi, A.; Andersen, P. M.; Nilsson, P.; Chioza, B.; Andersson, J. L.; Russ, C.; Shaw, C. E.; Powell, J. F.; Leigh, P. N.: Deletions of the heavy neurofilament subunit tail in amyotrophic lateral sclerosis. Hum. Molec. Genet. 8:157-164, 1999; and Watson, C. J.; Gaunt, L.; Evans, G.; Patel, K.; Harris, R.; Strachan, T.: A disease-associated germline deletion maps the type 2 neurofibromatosis (NF2) gene between the Ewing sarcoma.

Further studies establishing the function and utilities of NEFH are found in John Hopkins OMIM database record ID 162230, and in cited publications listed in Table 5, which are hereby incorporated by reference. Sialidase 3 (membrane sialidase) (NEU3, Accession NP_006647.2) is another GAM94 target gene, herein designated TARGET GENE. NEU3 BINDING SITE is a target binding site found in the 3' untranslated region of mRNA encoded by NEU3, corresponding to a target binding site such as BINDING SITE I, BINDING SITE II or BINDING SITE III of FIG. 8. Table 4 illustrates the complementarity of the nucleotide sequences of NEU3 BINDING SITE, designated SEQ ID:18396, to the nucleotide sequence of GAM94 RNA, herein designated GAM RNA, also designated SEQ ID:332.

Another function of GAM94 is therefore inhibition of Sialidase 3 (membrane sialidase) (NEU3, Accession NP_006647.2). Accordingly, utilities of GAM94 include diagnosis, prevention and treatment of diseases and clinical conditions associated with NEU3.

Nuclear factor (erythroid-derived 2), 45 kda (NFE2, Accession NP_006154.1) is another GAM94 target gene, herein designated TARGET GENE. NFE2 BINDING SITE is a target binding site found in the 3' untranslated region of mRNA encoded by NFE2, corresponding to a target binding site such as BINDING SITE I, BINDING SITE II or BINDING SITE III of FIG. 8. Table 4 illustrates the complementarity of the nucleotide sequences of NFE2 BINDING SITE, designated SEQ ID:6329, to the nucleotide sequence of GAM94 RNA, herein designated GAM RNA, also designated SEQ ID:332.

Another function of GAM94 is therefore inhibition of Nuclear factor (erythroid-derived 2), 45 kda (NFE2, Accession NP_006154.1), a gene which regulates expression of the beta globin gene. Accordingly, utilities of GAM94 include diagnosis, prevention and treatment of diseases and clinical conditions associated with NFE2.

The function of NFE2 has been established by previous studies. Peters et al. (1993) demonstrated that the Nfe2 gene in the mouse maps to chromosome 15 in a region containing the microcytic anemia (mk) gene. Homozygous mk mice were shown by Bannerman et al. (1972) to have defective intestinal iron transport and severe anemia. Peters et al. (1993) demonstrated Nfe2 expression in the mouse small intestine and NF-E2 binding activity in nuclear extracts of a human colon carcinoma cell line (OMIM Ref. No. Caco-2). Caco-2 cells possess properties of the small intestine, including the ability to transport iron. These data together indicated that NF-E2 plays a role in all aspects of hemoglobin production: globin synthesis, heme synthesis, and the procurement of iron. (NF-E2 recognition sites are present not only in the locus control regions of the globin genes but also in the gene promoters of 2 heme biosynthetic enzymes, porphobilinogen deaminase (OMIM Ref. No. 176000) and ferrochelatase (OMIM Ref. No. 177000).) The 45-kD subunit of the human globin locus control region binding protein, NFE2, was cloned by homology to the murine gene. Immunoprecipitation experiments demonstrated in vivo association of the p45 subunit with an 18-kD protein (see OMIM Ref. No. MAFG, 602020, and MAFK, 600197). Because bZIP proteins bind DNA as dimers, it is likely that native NFE2 is a heterodimer of 45- and 18-kD subunits. By fluorescence in situ hybridization, Weremowicz et al. (1993) assigned the p45 subunit of NFE2 to 12q13. Chan et al. (1993) likewise cloned the human homolog of mouse NF-E2. Extensive survey of human tissue samples found that NFE2 expression is not limited to erythropoietic organs. Expression in the colon and testis suggested that NFE2 may participate in the regulation of genes other than globin Full details of the abovementioned studies are described in the following publications, the disclosure of which are hereby incorporated by reference:

Shivdasani, R. A.; Rosenblatt, M. F.; Zucker-Franklin, D.; Jackson, C. W.; Hunt, P.; Saris, C. J. M.; Orkin, S. H.: Transcription factor NF-E2 is required for platelet formation independent of the actions of thrombopoietin/MGDF in megakaryocyte development. Cell 81:695-704, 1995; and Weremowicz, S.; Andrews, N. C.; Orkin, S. H.; Morton, C. C.: Mapping the p45 subunit of human NFE2 to 12q13. (Abstract) Human Genome Mapping Workshop 93 25, 1993.

Further studies establishing the function and utilities of NFE2 are found in John Hopkins OMIM database record ID 601490, and in cited publications listed in Table 5, which are hereby incorporated by reference. Nuclear factor i/b (NFIB, Accession NP_005587.1) is another GAM94 target gene, herein designated TARGET GENE. NFIB BINDING SITE is a target binding site found in the 3' untranslated region of mRNA encoded by NFIB, corresponding to a target binding site such as BINDING SITE I, BINDING SITE II or BINDING SITE III of FIG. 8. Table 4 illustrates the complementarity of the nucleotide sequences of NFIB BINDING SITE, designated SEQ ID:9068, to the nucleotide sequence of GAM94 RNA, herein designated GAM RNA, also designated SEQ ID:332.

Another function of GAM94 is therefore inhibition of Nuclear factor i/b (NFIB, Accession NP_005587.1), a gene which recognizes and binds the palindromic sequence 5'-ttg-gcnnnnngccaa-3' present in viral and cellular promoters. Accordingly, utilities of GAM94 include diagnosis, prevention and treatment of diseases and clinical conditions associated with NFIB.

The function of NFIB has been established by previous studies. See nuclear factor I/A (NFIA; 600727). Qian et al. (1995) mapped the NFIB gene to chromosome 9p24.1 by fluorescence in situ hybridization. Approximately 12% of all pleomorphic adenomas of the salivary glands are characterized by chromosome aberrations involving 12q13-q15. Several chromosomes have been found as translocation partners of chromosome 12, and some of these are recurrent. The target gene on 12q13-q15 involved in the translocation is HMGIC (OMIM Ref. No. 600698). Fusion partner genes include LPP (OMIM Ref. No. 600700) on 3q, ALDH2 (OMIM Ref. No. 100650) on 12q24.1, and FHIT (OMIM Ref. No. 601153) on 3p. Using 3-prime-RACE analysis of a primary adenoma with an apparently normal karyotype, Geurts et al. (1998) found an HMGIC fusion transcript containing ectopic sequences derived from the NFIB gene. In a second adenoma with an ins(9;12)(p23;q12q15) as the sole anomaly, they also found an HMGIC/NFIB hybrid transcript. Nucleotide sequence analysis of the fusion transcripts indicated that the genetic aberration in both tumors resulted in the replacement of a carboxy-terminal segment of HMGIC by the last 5 amino acids of NFIB Full details of the abovementioned studies are described in the following publications, the disclosure of which are hereby incorporated by reference:

Geurts, J. M. W.; Schoenmakers, E. F. P. M.; Roijer, E.; Astrom, A.-K.; Stenman, G.; van de Ven, W. J. M.: Identification of NFIB as recurrent translocation partner gene of HMGIC in pleomorphic adenomas. Oncogene 16:865-872, 1998; and Qian, F.; Kruse, U.; Lichter, P.; Sippel, A. E.: Chromosomal localization of the four genes (NFIA, B, C, and X) for the human transcription factor nuclear factor I by FISH. Genomics 28.

Further studies establishing the function and utilities of NFIB are found in John Hopkins OMIM database record ID 600728, and in cited publications listed in Table 5, which are hereby incorporated by reference. Nucleolar protein 3 (apoptosis repressor with card domain) (NOL3, Accession NP_003937.1) is another GAM94 target gene, herein designated TARGET GENE. NOL3 BINDING SITE is a target binding site found in the 3' untranslated region of mRNA encoded by NOL3, corresponding to a target binding site such as BINDING SITE I, BINDING SITE II or BINDING SITE III of FIG. 8. Table 4 illustrates the complementarity of the nucleotide sequences of NOL3 BINDING SITE, designated SEQ ID:13717, to the nucleotide sequence of GAM94 RNA, herein designated GAM RNA, also designated SEQ ID:332.

Another function of GAM94 is therefore inhibition of Nucleolar protein 3 (apoptosis repressor with card domain) (NOL3, Accession NP_003937.1), a gene which inhibits CASP2 and CASP8 and interacts with splicing factors. Accordingly, utilities of GAM94 include diagnosis, prevention and treatment of diseases and clinical conditions associated with NOL3.

The function of NOL3 and its association with various diseases and clinical conditions, has been established by previous studies, as described hereinabove with reference to GAM47.1. Nuclear receptor subfamily 1, group h, member 2 (NR1H2, Accession NP_009052.1) is another GAM94 target gene, herein designated TARGET GENE. NR1H2 BINDING SITE is a target binding site found in the 5' untranslated region of mRNA encoded by NR1H2, corresponding to a target binding site such as BINDING SITE I, BINDING SITE II or BINDING SITE III of FIG. 8. Table 4 illustrates the complementarity of the nucleotide sequences of NR1H2 BINDING SITE, designated SEQ ID:14187, to the nucleotide sequence of GAM94 RNA, herein designated GAM RNA, also designated SEQ ID:332.

Another function of GAM94 is therefore inhibition of Nuclear receptor subfamily 1, group h, member 2 (NR1H2, Accession NP_009052.1), a gene which binds preferentially to double-stranded oligonucleotide direct repeats. Accordingly, utilities of GAM94 include diagnosis, prevention and treatment of diseases and clinical conditions associated with NR1H2.

The function of NR1H2 has been established by previous studies. The LX receptors (LXRs) were originally identified as orphan members of the nuclear receptor superfamily because their ligands were unknown. Like other receptors in the family. LXRs heterodimerize with retinoid X receptor (see OMIM Ref. No. 180245) and bind to specific response elements (LXREs) characterized by direct repeats separated by 4 nucleotides. Two genes, alpha (LXRA, 602423) and beta, are known to encode LXR proteins (Song et al., 1995).

Animal model experiments lend further support to the function of NR1H2. Repa et al. (2002) presented evidence for the direct control of the ATP-binding cassette sterol transporters Abca1 (OMIM Ref. No. 600046), Abcg5 (OMIM Ref. No.

605459), and Abcg8 (OMIM Ref. No. 605460) by the liver X receptors. The intensity of hepatic and jejunal staining for Abcg5/g8 and Abca1 was increased in normal mice fed cholesterol or other Lxr agonists. Cholesterol feeding resulted in upregulation of Abcg5 and Abcg8 in the Lxrb null mice, but not in the Lxra null or double knockout mice, suggesting that Lxra is required for sterol upregulation of Abcg5/g8 in this model. In a rat hepatoma cell line, Lxr-dependent transcription of the Abcg5/g8 genes was cycloheximide-resistant, indicating that these genes are directly regulated by the liver X receptors.

It is appreciated that the abovementioned animal model for NR1H2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Repa, J. J.; Berge, K. E.; Pomajzl, C.; Richardson, J. A.; Hobbs, H.; Mangelsdorf, D. J.: Regulation of ATP-binding cassette sterol transporters ABCG5 and ABCG8 by the liver X receptors alpha and beta. J. Biol. Chem. 277:18793-18800, 2002; and Song, C.; Hiipakka, R. A.; Kokontis, J. M.; Liao, S.: Ubiquitous receptor: structures, immunocytochemical localization, and modulation of gene activation by receptors for retinoic ac.

Further studies establishing the function and utilities of NR1H2 are found in John Hopkins OMIM database record ID 600380, and in cited publications listed in Table 5, which are hereby incorporated by reference. Nuclear receptor subfamily 4, group a, member 3 (NR4A3, Accession NP_775290.1) is another GAM94 target gene, herein designated TARGET GENE. NR4A3 BINDING SITE is a target binding site found in the 5' untranslated region of multiple transcripts of mRNA encoded by NR4A3, corresponding to a target binding site such as BINDING SITE I, BINDING SITE II or BINDING SITE III of FIG. 8. Table 4 illustrates the complementarity of the nucleotide sequences of NR4A3 BINDING SITE, designated SEQ ID:15634, to the nucleotide sequence of GAM94 RNA, herein designated GAM RNA, also designated SEQ ID:332.

Another function of GAM94 is therefore inhibition of Nuclear receptor subfamily 4, group a, member 3 (NR4A3, Accession NP_775290.1). Accordingly, utilities of GAM94 include diagnosis, prevention and treatment of diseases and clinical conditions associated with NR4A3.

Netrin 4 (NTN4, Accession NP_067052.1) is another GAM94 target gene, herein designated TARGET GENE. NTN4 BINDING SITE is a target binding site found in the 5' untranslated region of mRNA encoded by NTN4, corresponding to a target binding site such as BINDING SITE I, BINDING SITE II or BINDING SITE III of FIG. 8. Table 4 illustrates the complementarity of the nucleotide sequences of NTN4 BINDING SITE, designated SEQ ID:4071, to the nucleotide sequence of GAM94 RNA, herein designated GAM RNA, also designated SEQ ID:332.

Another function of GAM94 is therefore inhibition of Netrin 4 (NTN4, Accession NP_067052.1). Accordingly, utilities of GAM94 include diagnosis, prevention and treatment of diseases and clinical conditions associated with NTN4.

Nucleoporin 54 kda (NUP54, Accession NP_059122.2) is another GAM94 target gene, herein designated TARGET GENE. NUP54 BINDING SITE is a target binding site found in the 3' untranslated region of mRNA encoded by NUP54, corresponding to a target binding site such as BINDING SITE I, BINDING SITE II or BINDING SITE III of FIG. 8. Table 4 illustrates the complementarity of the nucleotide sequences of NUP54 BINDING SITE, designated SEQ ID:16346, to the nucleotide sequence of GAM94 RNA, herein designated GAM RNA, also designated SEQ ID:332.

Another function of GAM94 is therefore inhibition of Nucleoporin 54 kda (NUP54, Accession NP_059122.2). Accordingly, utilities of GAM94 include diagnosis, prevention and treatment of diseases and clinical conditions associated with NUP54.

NX17 (Accession NP_065716.1) is another GAM94 target gene, herein designated TARGET GENE. NX17 BINDING SITE is a target binding site found in the 5' untranslated region of mRNA encoded by NX17, corresponding to a target binding site such as BINDING SITE I, BINDING SITE II or BINDING SITE III of FIG. 8. Table 4 illustrates the complementarity of the nucleotide sequences of NX17 BINDING SITE, designated SEQ ID:14516, to the nucleotide sequence of GAM94 RNA, herein designated GAM RNA, also designated SEQ ID:332.

Another function of GAM94 is therefore inhibition of NX17 (Accession NP_065716.1). Accordingly, utilities of GAM94 include diagnosis, prevention and treatment of diseases and clinical conditions associated with NX17.

Nyctalopin (Ny, Accession NP_072089.1) is another GAM94 target gene, herein designated TARGET GENE. NYX BINDING SITE is a target binding site found in the 5' untranslated region of mRNA encoded by Ny, corresponding to a target binding site such as BINDING SITE I, BINDING SITE II or BINDING SITE III of FIG. 8. Table 4 illustrates the complementarity of the nucleotide sequences of NYX BINDING SITE, designated SEQ ID:8632, to the nucleotide sequence of GAM94 RNA, herein designated GAM RNA, also designated SEQ ID:332.

Another function of GAM94 is therefore inhibition of Nyctalopin (Ny, Accession NP_072089.1), a gene which functions as the von willebrand factor receptor and mediates von willebrand factor-dependent platelet adhesion to blood vessels. the adhesion of platelets to injured vascular surfaces in the arterial circulation is a critical initiating event in hemostasis (by similarity). and therefore is associated with X-linked complete congenital stationary night blindness. Accordingly, utilities of GAM94 include diagnosis, prevention and treatment of X-linked complete congenital stationary night blindness, and of other diseases and clinical conditions associated with NYX.

The function of NYX has been established by previous studies. By positional cloning and the candidate gene approach, directed at the elucidation of the defect in complete congenital stationary night blindness (CSNB1; 310500), Bech-Hansen et al. (2000) identified a novel gene, Ny, that encodes a protein (nyctalopin) of 481 amino acids. Nyctalopin shows sequence similarity with members of the superfamily of proteins containing tandem arrays of the leucine-rich repeat (LRR) motif, as well as other features qualifying the protein as a member of the subfamily of small leucine-rich proteoglycans (SLRPs). By PCR amplification of tissue-specific cDNA, Bech- Hansen et al. (2000) detected expression of NYX in retina and kidney only. In the retina it appeared to be expressed in photoreceptors, bipolar and amacrine interneurons, and ganglion cells. Pusch et al. (2000) likewise detected 14 different mutations. In 3 families the gene was partially deleted. They found expression of the gene at low levels in retina, brain, testis, and muscle.

Full details of the abovementioned studies are described in the following publications, the disclosure of which are hereby incorporated by reference:

Bech-Hansen, N. T.; Naylor, M. J.; Maybaum, T. A.; Sparkes, R. L.; Koop, B.; Birch, D. G.; Bergen, A. A. B.; Prinsen, C. F. M.; Polomeno, R. C.; Gal, A.; Drack, A. V.; Musarella, M. A.; Jacobson, S. G.; Young, R. S. L.; Weleber, R. G.: Mutations in Ny, encoding the leucine-rich proteoglycan nyctalopin, cause X-linked complete congenital stationary night blindness. Nature Genet. 26:319-323, 2000. ; and Pusch, C. M.; Zeitz, C.; Brandau, O.; Pesch, K.; Achatz, H.; Feil, S.; Scharfe, C.; Maurer, J.; Jacobi, F. K.; Pinckers, A.; Andreasson, S.; Hardcastle, A.; Wissinger, B.; Berger, W.

Further studies establishing the function and utilities of NYX are found in John Hopkins OMIM database record ID 300278, and in cited publications listed in Table 5, which are hereby incorporated by reference. Oxysterol binding protein-like 11 (OSBPL11, Accession NP_073613.2) is another GAM94 target gene, herein designated TARGET GENE. OSBPL11 BINDING SITE is a target binding site found in the 3' untranslated region of mRNA encoded by OSBPL11, corresponding to a target binding site such as BINDING SITE I, BINDING SITE II or BINDING SITE III of FIG. 8. Table 4 illustrates the complementarity of the nucleotide sequences of OSBPL11 BINDING SITE, designated SEQ ID:7034, to the nucleotide sequence of GAM94 RNA, herein designated GAM RNA, also designated SEQ ID:332.

Another function of GAM94 is therefore inhibition of Oxysterol binding protein-like 11 (OSBPL11, Accession NP_073613.2). Accordingly, utilities of GAM94 include diagnosis, prevention and treatment of diseases and clinical conditions associated with OSBPL11.

Oxysterol binding protein-like 3 (OSBPL3, Accession NP_663160.1) is another GAM94 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:6630, to the nucleotide sequence of GAM94 RNA, herein designated GAM RNA, also designated SEQ ID:332.

Another function of GAM94 is therefore inhibition of Oxysterol binding protein-like 3 (OSBPL3, Accession NP_663160.1). Accordingly, utilities of GAM94 include diagnosis, prevention and treatment of diseases and clinical conditions associated with OSBPL3.

Oxysterol binding protein-like 3 (OSBPL3, Accession NP_663161.1) is another GAM94 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:6630, to the nucleotide sequence of GAM94 RNA, herein designated GAM RNA, also designated SEQ ID:332.

Another function of GAM94 is therefore inhibition of Oxysterol binding protein-like 3 (OSBPL3, Accession NP_663161.1). Accordingly, utilities of GAM94 include diagnosis, prevention and treatment of diseases and clinical conditions associated with OSBPL3.

Oxysterol binding protein-like 3 (OSBPL3, Accession NP_663164.1) is another GAM94 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:6630, to the nucleotide sequence of GAM94 RNA, herein designated GAM RNA, also designated SEQ ID:332.

Another function of GAM94 is therefore inhibition of Oxysterol binding protein-like 3 (OSBPL3, Accession NP_663164.1). Accordingly, utilities of GAM94 include diagnosis, prevention and treatment of diseases and clinical conditions associated with OSBPL3.

Oxysterol binding protein-like 3 (OSBPL3, Accession NP_056365.1) is another GAM94 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:6630, to the nucleotide sequence of GAM94 RNA, herein designated GAM RNA, also designated SEQ ID:332.

Another function of GAM94 is therefore inhibition of Oxysterol binding protein-like 3 (OSBPL3, Accession NP_056365.1). Accordingly, utilities of GAM94 include diagnosis, prevention and treatment of diseases and clinical conditions associated with OSBPL3.

Oxysterol binding protein-like 3 (OSBPL3, Accession NP_663162.1) is another GAM94 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:6630, to the nucleotide sequence of GAM94 RNA, herein designated GAM RNA, also designated SEQ ID:332.

Another function of GAM94 is therefore inhibition of Oxysterol binding protein-like 3 (OSBPL3, Accession NP_663162.1). Accordingly, utilities of GAM94 include diagnosis, prevention and treatment of diseases and clinical conditions associated with OSBPL3.

Oxysterol binding protein-like 3 (OSBPL3, Accession NP_663163.1) is another GAM94 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:6630, to the nucleotide sequence of GAM94 RNA, herein designated GAM RNA, also designated SEQ ID:332.

Another function of GAM94 is therefore inhibition of Oxysterol binding protein-like 3 (OSBPL3, Accession NP_663163.1). Accordingly, utilities of GAM94 include diagnosis, prevention and treatment of diseases and clinical conditions associated with OSBPL3.

Orthodenticle homolog 1 (drosophila) (OTX1, Accession NP_055377.1) is another GAM94 target gene, herein designated TARGET GENE. OTX1 BINDING SITE is a target binding site found in the 3' untranslated region of mRNA encoded by OTX1, corresponding to a target binding site such as BINDING SITE I, BINDING SITE II or BINDING SITE III of FIG. 8. Table 4 illustrates the complementarity of the nucleotide sequences of OTX1 BINDING SITE, designated SEQ ID:2466, to the nucleotide sequence of GAM94 RNA, herein designated GAM RNA, also designated SEQ ID:332.

Another function of GAM94 is therefore inhibition of Orthodenticle homolog 1 (drosophila) (OTX1, Accession NP_055377.1), a gene which plays a role in the development of the brain and the sense organs. Accordingly, utilities of GAM94 include diagnosis, prevention and treatment of diseases and clinical conditions associated with OTX1.

The function of OTX1 has been established by previous studies. OTX1 is a homeobox family gene related to a gene expressed in the developing Drosophila head termed 'orthodenticle.' Simeone et al. (1992) identified rodent OTX2 (OMIM Ref. No. 600037). A homolog is also found in the zebrafish. Tissue expression of OTX1 is similar to that of OTX2 but is more restricted (Boncinelli et al., 1993). Frantz et al. (1994) showed that Otx1 mRNA was expressed by precursors of deep-layer neurons within cortical layers 5 and 6 of the rat brain during both postnatal and adult life. Using a cosmid containing the gene, Kastury et al. (1994) mapped human OTX1 to 2p13 by fluorescence in situ hybridization, near the locus for EMX1 (OMIM Ref. No. 600034).

Animal model experiments lend further support to the function of OTX1. Acampora et al. (1996) produced null mice by replacing Otx1 with the lacZ gene. Otx -/- mice exhibited epileptic behavior with the characteristics of both focal and generalized seizures. Anatomic and histologic analyses of brains from 2-4-month-old Otx -/- mice revealed multiple abnormalities affecting mainly the telencephalic, temporal, and perirhinal areas, the hippocampus, mesencephalon, and cerebellum, and the acoustic and visual sense organs. Acampora et al. (1996) reported that in older Otx -/- mice the epileptic behavior and frequency of seizures were somewhat reduced, although they never disappeared. They detected neither epileptic behavior nor electrical seizures in Otx+(/-) mice. The authors stated that this study provides the first evidence that loss of function of a homeobox-containing gene affects brain development and induces spontaneous epilepsy.

It is appreciated that the abovementioned animal model for OTX1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Frantz, G. D.; Weimann, J. M.; Levin, M. E.; McConnell, S. K.: Otx1 and Otx2 define layers and regions in developing cerebral cortex and cerebellum. J. Neurosci. 14:5725-5740, 1994; and Acampora, D.; Mazan, S.; Avantaggiato, V.; Barone, P.; Tuorto, F.; Lallemand, Y.; Brulet, P.; Simeone, A.: Epilepsy and brain abnormalities in mice lacking the Otx1 gene. Nature Genet.

Further studies establishing the function and utilities of OTX1 are found in John Hopkins OMIM database record ID 600036, and in cited publications listed in Table 5, which are hereby incorporated by reference. P21(cdkn1a)-activated kinase 7 (PAK7, Accession NP_817127.1) is another GAM94 target gene, herein designated TARGET GENE. PAK7 BINDING SITE1 through PAK7 BINDING SITE3 are target binding sites found in untranslated regions of multiple transcripts of mRNA encoded by PAK7, corresponding to target binding sites such as BINDING SITE I, BINDING SITE II or BINDING SITE III of FIG. 8. Table 4 illustrates the complementarity of the nucleotide sequences of PAK7 BINDING SITE1 through PAK7 BINDING SITE3, designated SEQ ID:15289, SEQ ID:12660 and SEQ ID:12660 respectively, to the nucleotide sequence of GAM94 RNA, herein designated GAM RNA, also designated SEQ ID:332.

Another function of GAM94 is therefore inhibition of P21 (cdkn1a)-activated kinase 7 (PAK7, Accession NP_817127.1). Accordingly, utilities of GAM94 include diagnosis, prevention and treatment of diseases and clinical conditions associated with PAK7.

P21(cdkn1a)-activated kinase 7 (PAK7, Accession NP_065074.1) is another GAM94 target gene, herein designated TARGET GENE. PAK7 BINDING SITE1 through PAK7 BINDING SITE3 are target binding sites found in untranslated regions of multiple transcripts of mRNA encoded by PAK7, corresponding to target binding sites such as BINDING SITE I, BINDING SITE II or BINDING SITE III of FIG. 8. Table 4 illustrates the complementarity of the nucleotide sequences of PAK7 BINDING SITE1 through PAK7 BINDING SITE3, designated SEQ ID:2124, SEQ ID:15289 and SEQ ID:2124 respectively, to the nucleotide sequence of GAM94 RNA, herein designated GAM RNA, also designated SEQ ID:332.

Another function of GAM94 is therefore inhibition of P21 (cdkn1a)-activated kinase 7 (PAK7, Accession NP_065074.1). Accordingly, utilities of GAM94 include diagnosis, prevention and treatment of diseases and clinical conditions associated with PAK7.

Poly(a) polymerase beta (testis specific) (PAPOLB, Accession NP_064529.2) is another GAM94 target gene, herein designated TARGET GENE. PAPOLB BINDING SITE is a target binding site found in the 3' untranslated region of mRNA encoded by PAPOLB, corresponding to a target binding site such as BINDING SITE I, BINDING SITE II or BINDING SITE III of FIG. 8. Table 4 illustrates the complementarity of the nucleotide sequences of PAPOLB BINDING SITE, designated SEQ ID:2613, to the nucleotide sequence of GAM94 RNA, herein designated GAM RNA, also designated SEQ ID:332.

Another function of GAM94 is therefore inhibition of Poly (a) polymerase beta (testis specific) (PAPOLB, Accession NP_064529.2). Accordingly, utilities of GAM94 include diagnosis, prevention and treatment of diseases and clinical conditions associated with PAPOLB.

Paired box gene 2 (PAX2, Accession NP_003978.1) is another GAM94 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:17177, to the nucleotide sequence of GAM94 RNA, herein designated GAM RNA, also designated SEQ ID:332.

Another function of GAM94 is therefore inhibition of Paired box gene 2 (PAX2, Accession NP_003978.1), a gene which involves in kidney cell differentiation and therefore is associated with Renal-coloboma syndrome. Accordingly, utilities of GAM94 include diagnosis, prevention and treatment of Renal-coloboma syndrome, and of other diseases and clinical conditions associated with PAX2.

The function of PAX2 and its association with various diseases and clinical conditions, has been established by previous studies, as described hereinabove with reference to GAM47.1. Paired box gene 2 (PAX2, Accession NP_000269.1) is another GAM94 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:17177, to the nucleotide sequence of GAM94 RNA, herein designated GAM RNA, also designated SEQ ID:332.

Another function of GAM94 is therefore inhibition of Paired box gene 2 (PAX2, Accession NP_000269.1), a gene which involves in kidney cell differentiation and therefore is associated with Renal-coloboma syndrome. Accordingly, utilities of GAM94 include diagnosis, prevention and treatment of Renal-coloboma syndrome, and of other diseases and clinical conditions associated with PAX2.

The function of PAX2 and its association with various diseases and clinical conditions, has been established by previous studies, as described hereinabove with reference to GAM47.1. Paired box gene 2 (PAX2, Accession NP_003980.1) is another GAM94 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:17177, to the nucleotide sequence of GAM94 RNA, herein designated GAM RNA, also designated SEQ ID:332.

Another function of GAM94 is therefore inhibition of Paired box gene 2 (PAX2, Accession NP_003980.1), a gene which involves in kidney cell differentiation and therefore is associated with Renal-coloboma syndrome. Accordingly, utilities of GAM94 include diagnosis, prevention and treatment of Renal-coloboma syndrome, and of other diseases and clinical conditions associated with PAX2.

The function of PAX2 and its association with various diseases and clinical conditions, has been established by previous studies, as described hereinabove with reference to GAM47.1. Paired box gene 2 (PAX2, Accession NP_003981.1) is another GAM94 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:17177, to the nucleotide sequence of GAM94 RNA, herein designated GAM RNA, also designated SEQ ID:332.

Another function of GAM94 is therefore inhibition of Paired box gene 2 (PAX2, Accession NP_003981.1), a gene which involves in kidney cell differentiation and therefore is associated with Renal-coloboma syndrome. Accordingly, utilities of GAM94 include diagnosis, prevention and treatment of Renal-coloboma syndrome, and of other diseases and clinical conditions associated with PAX2.

The function of PAX2 and its association with various diseases and clinical conditions, has been established by previous studies, as described hereinabove with reference to GAM47.1. Paired box gene 2 (PAX2, Accession NP_003979.1) is another GAM94 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:17177, to the nucleotide sequence of GAM94 RNA, herein designated GAM RNA, also designated SEQ ID:332.

Another function of GAM94 is therefore inhibition of Paired box gene 2 (PAX2, Accession NP_003979.1), a gene which involves in kidney cell differentiation and therefore is associated with Renal-coloboma syndrome. Accordingly, utilities of GAM94 include diagnosis, prevention and treatment of Renal-coloboma syndrome, and of other diseases and clinical conditions associated with PAX2.

The function of PAX2 and its association with various diseases and clinical conditions, has been established by previous studies, as described hereinabove with reference to GAM47.1. Paired box gene 7 (PAX7, Accession NP_002575.1) is another GAM94 target gene, herein designated TARGET GENE. PAX7 BINDING SITE is a target binding site found in the 5' untranslated region of multiple transcripts of mRNA encoded by PAX7, corresponding to a target binding site such as BINDING SITE I, BINDING SITE II or BINDING SITE III of FIG. 8. Table 4 illustrates the complementarity of the nucleotide sequences of PAX7 BINDING SITE, designated SEQ ID:17455, to the nucleotide sequence of GAM94 RNA, herein designated GAM RNA, also designated SEQ ID:332.

Another function of GAM94 is therefore inhibition of Paired box gene 7 (PAX7, Accession NP_002575.1), a gene which involves in myogenesis and therefore is associated with Rhabdomyosarcoma-2. Accordingly, utilities of GAM94 include diagnosis, prevention and treatment of Rhabdomyosarcoma-2, and of other diseases and clinical conditions associated with PAX7.

The function of PAX7 has been established by previous studies. In a review of 28 published cases of the pediatric soft tissue cancer alveolar rhabdomyosarcoma (OMIM Ref. No. 268220), Whang-Peng et al. (1992) found a characteristic t(2;13)(q35;q14) translocation and a variant t(1;13)(p36;q14) translocation in 64% and 18% of the cases, respectively. Subsequent molecular biology studies demonstrated that these translocations fuse the PAX3 gene (OMIM Ref. No. 193500) on chromosome 2 or the PAX7 gene on chromosome 1 with the forkhead in rhabdomyosarcoma gene (OMIM Ref. No. 136533) on chromosome 13 to generate PAX3/FKHR or PAX7/FKHR fusion genes. These genes encode chimeric transcription factors which, in the case of PAX3/FKHR, was shown to activate excessively transcription from binding targets of the wildtype PAX3 transcription factor. Using FISH, RT-PCR, and quantitative Southern blot analyses, Barr et al. (1996) demonstrated that these fusion genes are amplified in 20% of fusion-positive tumors. In particular, they found in vivo amplification of these fusions in 1 of 22 PAX3/FKHR-positive cases and 5 of 7 PAX7/FKHR-positive cases. By representational difference analysis, Seale et al. (2000) isolated mouse Pax7 as a gene specifically expressed in cultured satellite cell-derived myoblasts. In situ hybridization revealed that Pax7 is also expressed in satellite cells residing in adult muscle. Cell culture and electron microscopic analysis showed a complete absence of satellite cells in Pax7 -/-skeletal muscle. Surprisingly, fluorescence-activated cell sorting analysis indicated that the proportion of muscle-derived stem cells was unaffected. Stem cells from Pax7 -/-muscle displayed an almost 10-fold increase in their ability to form hematopoietic colonies. These results demonstrated that satellite cells and muscle-derived stem cells represent distinct cell populations. Furthermore, these studies suggested that induction of Pax7 in muscle-derived stem cells induces satellite cell specification by restricting alternate developmental programs.

Animal model experiments lend further support to the function of PAX7. By representational difference analysis, Seale et al. (2000) isolated mouse Pax7 as a gene specifically expressed in cultured satellite cell-derived myoblasts. In situ hybridization revealed that Pax7 is also expressed in satellite cells residing in adult muscle. Cell culture and electron microscopic analysis showed a complete absence of satellite cells in Pax7 -/-skeletal muscle. Surprisingly, fluorescence-activated cell sorting analysis indicated that the proportion of muscle- derived stem cells was unaffected. Stem cells from Pax7 -/-muscle displayed an almost 10-fold increase in their ability to form hematopoietic colonies. These results demonstrated that satellite cells and muscle-derived stem cells represent distinct cell populations. Furthermore, these studies suggested that induction of Pax7 in muscle-derived stem cells induces satellite cell specification by restricting alternate developmental programs.

It is appreciated that the abovementioned animal model for PAX7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Barr, F. G.; Nauta, L. E.; Davis, R. J.; Schafer, B. W.; Nycum, L. M.; Biegel, J. A.: In vivo amplification of the PAX3-FKHR and PAX7-FKHR fusion genes in alveolar rhabdomyosarcoma. Hum. Molec. Genet. 5:15-21, 1996; and Seale, P.; Sabourin, L. A.; Girgis-Gabardo, A.; Mansouri, A.; Gruss, P.; Rudnicki, M. A.: Pax7 is required for the specification of myogenic satellite cells. Cell 102:777-786, 2000.

Further studies establishing the function and utilities of PAX7 are found in John Hopkins OMIM database record ID 167410, and in cited publications listed in Table 5, which are hereby incorporated by reference. Paired box gene 7 (PAX7, Accession NP_039236.1) is another GAM94 target gene, herein designated TARGET GENE. PAX7 BINDING SITE is a target binding site found in the 5' untranslated region of multiple transcripts of mRNA encoded by PAX7, corresponding to a target binding site such as BINDING SITE I, BINDING SITE II or BINDING SITE III of FIG. 8. Table 4 illustrates the complementarity of the nucleotide sequences of PAX7 BINDING SITE, designated SEQ ID:17455, to the nucleotide sequence of GAM94 RNA, herein designated GAM RNA, also designated SEQ ID:332.

Another function of GAM94 is therefore inhibition of Paired box gene 7 (PAX7, Accession NP_039236.1), a gene which involves in myogenesis and therefore is associated with Rhabdomyosarcoma-2. Accordingly, utilities of GAM94 include diagnosis, prevention and treatment of Rhabdomyosarcoma-2, and of other diseases and clinical conditions associated with PAX7.

The function of PAX7 has been established by previous studies. In a review of 28 published cases of the pediatric soft tissue cancer alveolar rhabdomyosarcoma (OMIM Ref. No. 268220), Whang-Peng et al. (1992) found a characteristic t(2;13)(q35;q14) translocation and a variant t(1;13)(p36;q14) translocation in 64% and 18% of the cases, respectively. Subsequent molecular biology studies demonstrated that these translocations fuse the PAX3 gene (OMIM Ref. No. 193500) on chromosome 2 or the PAX7 gene on chromosome 1 with the forkhead in rhabdomyosarcoma gene (OMIM Ref. No. 136533) on chromosome 13 to generate PAX3/FKHR or PAX7/FKHR fusion genes. These genes encode chimeric transcription factors which, in the case of PAX3/FKHR, was shown to activate excessively transcription from binding targets of the wildtype PAX3 transcription factor. Using FISH, RT-PCR, and quantitative Southern blot analyses, Barr et al. (1996) demonstrated that these fusion genes are amplified in 20% of fusion-positive tumors. In particular, they found in vivo amplification of these fusions in 1 of 22 PAX3/FKHR-positive cases and 5 of 7 PAX7/FKHR-positive cases. By representational difference analysis, Seale et al. (2000) isolated mouse Pax7 as a gene specifically expressed in cultured satellite cell-derived myoblasts. In situ hybridization revealed that Pax7 is also expressed in satellite cells residing in adult muscle. Cell culture and electron microscopic analysis showed a complete absence of satellite cells in Pax7 -/-skeletal muscle. Surprisingly, fluorescence-activated cell sorting analysis indicated that the proportion of muscle- derived stem cells was unaffected. Stem cells from Pax7 -/-muscle displayed an almost 10-fold increase in their ability to form hematopoietic colonies. These results demonstrated that satellite cells and muscle-derived stem cells represent distinct cell populations. Furthermore, these studies suggested that induction of Pax7 in muscle-derived stem cells induces satellite cell specification by restricting alternate developmental programs.

Animal model experiments lend further support to the function of PAX7. By representational difference analysis, Seale et al. (2000) isolated mouse Pax7 as a gene specifically expressed in cultured satellite cell-derived myoblasts. In situ hybridization revealed that Pax7 is also expressed in satellite cells residing in adult muscle. Cell culture and electron microscopic analysis showed a complete absence of satellite cells in Pax7 -/-skeletal muscle. Surprisingly, fluorescence-activated cell sorting analysis indicated that the proportion of muscle- derived stem cells was unaffected. Stem cells from Pax7 -/-muscle displayed an almost 10-fold increase in their ability to form hematopoietic colonies. These results demonstrated that satellite cells and muscle-derived stem cells represent distinct cell populations. Furthermore, these studies suggested that induction of Pax7 in muscle-derived stem cells induces satellite cell specification by restricting alternate developmental programs.

It is appreciated that the abovementioned animal model for PAX7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Barr, F. G.; Nauta, L. E.; Davis, R. J.; Schafer, B. W.; Nycum, L. M.; Biegel, J. A.: In vivo amplification of the PAX3-FKHR and PAX7-FKHR fusion genes in alveolar rhabdomyosarcoma. Hum. Molec. Genet. 5:15-21, 1996; and Seale, P.; Sabourin, L. A.; Girgis-Gabardo, A.; Mansouri, A.; Gruss, P.; Rudnicki, M. A.: Pax7 is required for the specification of myogenic satellite cells. Cell 102:777-786, 2000.

Further studies establishing the function and utilities of PAX7 are found in John Hopkins OMIM database record ID 167410, and in cited publications listed in Table 5, which are hereby incorporated by reference. Protocadherin 10 (PCDH10, Accession NP_116586.1) is another GAM94 target gene, herein designated TARGET GENE. PCDH10 BINDING SITE is a target binding site found in the 5' untranslated region of multiple transcripts of mRNA encoded by PCDH10, corresponding to a target binding site such as BINDING SITE I, BINDING SITE II or BINDING SITE III of FIG. 8. Table 4 illustrates the complementarity of the nucleotide sequences of PCDH10 BINDING SITE, designated SEQ ID:11480, to the nucleotide sequence of GAM94 RNA, herein designated GAM RNA, also designated SEQ ID:332.

Another function of GAM94 is therefore inhibition of Protocadherin 10 (PCDH10, Accession NP_116586.1). Accordingly, utilities of GAM94 include diagnosis, prevention and treatment of diseases and clinical conditions associated with PCDH10.

Protocadherin 10 (PCDH10, Accession NP_065866.1) is another GAM94 target gene, herein designated TARGET GENE. PCDH10 BINDING SITE is a target binding site found in the 5' untranslated region of multiple transcripts of mRNA encoded by PCDH10, corresponding to a target binding site such as BINDING SITE I, BINDING SITE II or BINDING SITE III of FIG. 8. Table 4 illustrates the complementarity of the nucleotide sequences of PCDH10 BINDING SITE, designated SEQ ID:11480, to the nucleotide sequence of GAM94 RNA, herein designated GAM RNA, also designated SEQ ID:332.

Another function of GAM94 is therefore inhibition of Protocadherin 10 (PCDH10, Accession NP_065866.1). Accordingly, utilities of GAM94 include diagnosis, prevention and treatment of diseases and clinical conditions associated with PCDH10.

PCF11 (Accession NP_056969.1) is another GAM94 target gene, herein designated TARGET GENE. PCF11 BINDING SITE is a target binding site found in the 5' untranslated region of mRNA encoded by PCF11, corresponding to a target binding site such as BINDING SITE I, BINDING SITE II or BINDING SITE III of FIG. 8. Table 4 illustrates the complementarity of the nucleotide sequences of PCF11 BINDING SITE, designated SEQ ID:6695, to the nucleotide sequence of GAM94 RNA, herein designated GAM RNA, also designated SEQ ID:332.

Another function of GAM94 is therefore inhibition of PCF11 (Accession NP_056969.1). Accordingly, utilities of GAM94 include diagnosis, prevention and treatment of diseases and clinical conditions associated with PCF11.

Phosphodiesterase 4b, camp-specific (phosphodiesterase e4 dunce homolog, drosophila) (PDE4B, Accession NP_002591.1) is another GAM94 target gene, herein designated TARGET GENE. PDE4B BINDING SITE is a target binding site found in the 3' untranslated region of mRNA encoded by PDE4B, corresponding to a target binding site such as BINDING SITE I, BINDING SITE II or BINDING SITE III of FIG. 8. Table 4 illustrates the complementarity of the nucleotide sequences of PDE4B BINDING SITE, designated SEQ ID:7674, to the nucleotide sequence of GAM94 RNA, herein designated GAM RNA, also designated SEQ ID:332.

Another function of GAM94 is therefore inhibition of Phosphodiesterase 4b, camp-specific (phosphodiesterase e4 dunce homolog, drosophila) (PDE4B, Accession NP_002591.1), a gene which may be involved in mediating central nervous system effects of therapeutic agents ranging from antidepressants to antiasthmatic and anti-inflammatory agents. Accordingly, utilities of GAM94 include diagnosis, prevention and treatment of diseases and clinical conditions associated with PDE4B.

The function of PDE4B and its association with various diseases and clinical conditions, has been established by previous studies, as described hereinabove with reference to GAM31.1. Phosphodiesterase 4c, camp-specific (phosphodiesterase e1 dunce homolog, drosophila) (PDE4C, Accession NP_000914.1) is another GAM94 target gene, herein designated TARGET GENE. PDE4C BINDING SITE is a target binding site found in the 3' untranslated region of mRNA encoded by PDE4C, corresponding to a target binding site such as BINDING SITE I, BINDING SITE II or BINDING SITE III of FIG. 8. Table 4 illustrates the complementarity of the nucleotide sequences of PDE4C BINDING SITE, designated SEQ ID:14459, to the nucleotide sequence of GAM94 RNA, herein designated GAM RNA, also designated SEQ ID:332.

Another function of GAM94 is therefore inhibition of Phosphodiesterase 4c, camp-specific (phosphodiesterase e1 dunce homolog, drosophila) (PDE4C, Accession NP_000914.1), a gene which is a cAMP-specific phosphodiesterase and may be a protein involved in learning and memory. Accordingly, utilities of GAM94 include diagnosis, prevention and treatment of diseases and clinical conditions associated with PDE4C.

The function of PDE4C and its association with various diseases and clinical conditions, has been established by previous studies, as described hereinabove with reference to GAM65.1. PDZGEF1 (Accession NP_055062.1) is another GAM94 target gene, herein designated TARGET GENE. PDZGEF1 BINDING SITE is a target binding site found in the 3' untranslated region of mRNA encoded by PDZGEF1, corresponding to a target binding site such as BINDING SITE I, BINDING SITE II or BINDING SITE III of FIG. 8. Table 4 illustrates the complementarity of the nucleotide sequences of PDZGEF1 BINDING SITE, designated SEQ ID:15137, to the nucleotide sequence of GAM94 RNA, herein designated GAM RNA, also designated SEQ ID:332.

Another function of GAM94 is therefore inhibition of PDZGEF1 (Accession NP_055062.1). Accordingly, utilities of GAM94 include diagnosis, prevention and treatment of diseases and clinical conditions associated with PDZGEF1.

PDZK3 (Accession NP_835260.1) is another GAM94 target gene, herein designated TARGET GENE. PDZK3 BINDING SITE1 and PDZK3 BINDING SITE2 are target binding sites found in untranslated regions of multiple transcripts of mRNA encoded by PDZK3, corresponding to target binding sites such as BINDING SITE I, BINDING SITE II or BINDING SITE III of FIG. 8. Table 4 illustrates the complementarity of the nucleotide sequences of PDZK3 BINDING SITE1 and PDZK3 BINDING SITE2, designated SEQ ID:13677 and SEQ ID:13677 respectively, to the nucleotide sequence of GAM94 RNA, herein designated GAM RNA, also designated SEQ ID:332.

Another function of GAM94 is therefore inhibition of PDZK3 (Accession NP_835260.1). Accordingly, utilities of GAM94 include diagnosis, prevention and treatment of diseases and clinical conditions associated with PDZK3.

PDZK3 (Accession NP_055837.2) is another GAM94 target gene, herein designated TARGET GENE. PDZK3 BINDING SITE1 and PDZK3 BINDING SITE2 are target binding sites found in untranslated regions of multiple transcripts of mRNA encoded by PDZK3, corresponding to target binding sites such as BINDING SITE I, BINDING SITE II or BINDING SITE III of FIG. 8. Table 4 illustrates the complementarity of the nucleotide sequences of PDZK3 BINDING SITE1 and PDZK3 BINDING SITE2, designated SEQ ID:4585 and SEQ ID:4585 respectively, to the nucleotide sequence of GAM94 RNA, herein designated GAM RNA, also designated SEQ ID:332.

Another function of GAM94 is therefore inhibition of PDZK3 (Accession NP_055837.2). Accordingly, utilities of GAM94 include diagnosis, prevention and treatment of diseases and clinical conditions associated with PDZK3.

Prefoldin 1 (PFDN1, Accession NP_002613.2) is another GAM94 target gene, herein designated TARGET GENE. PFDN1 BINDING SITE1 and PFDN1 BINDING SITE2 are target binding sites found in untranslated regions of mRNA encoded by PFDN1, corresponding to target binding sites such as BINDING SITE I, BINDING SITE II or BINDING SITE III of FIG. 8. Table 4 illustrates the complementarity of the nucleotide sequences of PFDN1 BINDING SITE1 and PFDN1 BINDING SITE2, designated SEQ ID:6722 and SEQ ID:13206 respectively, to the nucleotide sequence of GAM94 RNA, herein designated GAM RNA, also designated SEQ ID:332.

Another function of GAM94 is therefore inhibition of Prefoldin 1 (PFDN1, Accession NP_002613.2). Accordingly, utilities of GAM94 include diagnosis, prevention and treatment of diseases and clinical conditions associated with PFDN1.

Pan-hematopoietic expression (PHEMX, Accession NP_620592.1) is another GAM94 target gene, herein designated TARGET GENE. PHEMX BINDING SITE is a target binding site found in the 5' untranslated region of multiple transcripts of mRNA encoded by PHEMX, corresponding to a target binding site such as BINDING SITE I, BINDING SITE II or BINDING SITE III of FIG. 8. Table 4 illustrates the complementarity of the nucleotide sequences of PHEMX BINDING SITE, designated SEQ ID:12316, to the nucleotide sequence of GAM94 RNA, herein designated GAM RNA, also designated SEQ ID:332.

Another function of GAM94 is therefore inhibition of Pan-hematopoietic expression (PHEMX, Accession NP_620592.1), a gene which is an important tumor-suppressor gene region. Accordingly, utilities of GAM94 include diagnosis, prevention and treatment of diseases and clinical conditions associated with PHEMX.

The function of PHEMX has been established by previous studies. Lee et al. (1999) noted that 7 imprinted genes had been identified on 11p15: IGF2 (OMIM Ref. No. 147470), which encodes an important autocrine growth factor in cancer; H19 (OMIM Ref. No. 103280), an untranslated RNA whose imprinting regulates IGF2; ASCL2 (OMIM Ref. No. 601886), a homolog of Drosophila achaete-scute that is expressed in the trophoblast; KCNQ1 (OMIM Ref. No. 192500), which encodes a voltage-gated potassium channel; p57(KIP2) (CDKN1C; 600856), which encodes a cyclin-dependent kinase inhibitor; TSSC5 (IMPT1; 602631), which encodes a predicted transmembrane transporter; and TSSC3 (OMIM Ref. No. 602131), also known as IPL, a homolog of a mouse apoptosis-inducing gene. With the exception of IGF2, all of these genes are expressed from the maternal allele. Because of the large number of imprinted genes on 11p15, spanning approximately 1 Mb, this region appears to represent 1 of 2 known large imprinted domains in the human genome, the other being the Prader-Willi/Angelman syndrome domain of 15q11-q13 (see OMIM Ref. No. 105830). Koi et al. (1993) isolated a subchromosomal transferable fragment (STF) that suppresses in vitro growth of the rhabdomyosarcoma cell line RD, confirming the existence of 1 or more tumor suppressor genes within this region. Hu et al. (1997) found that the STF spans approximately 2.5 Mb, with D11S12 at its proximal end and D11S1318 at its distal end. Within a cluster of imprinted genes in this STF, Lee et al. (1999) identified 2 novel genes, designated TSSC4 (OMIM Ref. No. 603852) and TSSC6, that were not imprinted in any of the fetal or extraembryonic tissues examined. The TSSC6 cDNA encodes a predicted protein of 290 amino acids that shows no close similarity to previously reported proteins. Northern blot analysis failed to detect TSSC6 gene expression; however, RT-PCR analysis suggested that the TSSC6 gene is ubiquitously expressed at low levels. The TSSC4 and TSSC6 genes are both located in the center of the 1-Mb imprinted domain on 11p15 that contains the 7 imprinted genes. Thus, the imprinted gene domain of 11p15 appears to contain at least 2 imprinted subdomains, between which the TSSC4 and TSSC6 genes substantially escape imprinting, due either to a lack of initial silencing or to an early developmental relaxation of imprinting Full details of the abovementioned studies are described in the following publications, the disclosure of which are hereby incorporated by reference:

Koi, M.; Johnson, L. A.; Kalikin, L. M.; Little, P. F. R.; Nakamura, Y.; Feinberg, A. P.: Tumor cell growth arrest caused by subchromosomal transferable DNA fragments from chromosome 11. Science 260:361-364, 1993; and Lee, M. P.; Brandenburg, S.; Landes, G. M.; Adams, M.; Miller, G.; Feinberg, A. P. : Two novel genes in the center of the 11p15 imprinted domain escape genomic imprinting. Hum. Molec. Ge.

Further studies establishing the function and utilities of PHEMX are found in John Hopkins OMIM database record ID 603853, and in cited publications listed in Table 5, which are hereby incorporated by reference. Pan-hematopoietic expression (PHEMX, Accession NP_620591.1) is another GAM94 target gene, herein designated TARGET GENE. PHEMX BINDING SITE is a target binding site found in the 5' untranslated region of multiple transcripts of mRNA encoded by PHEMX, corresponding to a target binding site such as BINDING SITE I, BINDING SITE II or BINDING SITE III of FIG. 8. Table 4 illustrates the complementarity of the nucleotide sequences of PHEMX BINDING SITE, designated SEQ ID:12316, to the nucleotide sequence of GAM94 RNA, herein designated GAM RNA, also designated SEQ ID:332.

Another function of GAM94 is therefore inhibition of Pan-hematopoietic expression (PHEMX, Accession NP_620591.1), a gene which is an important tumor-suppressor gene region. Accordingly, utilities of GAM94 include diagnosis, prevention and treatment of diseases and clinical conditions associated with PHEMX.

The function of PHEMX has been established by previous studies. Lee et al. (1999) noted that 7 imprinted genes had been identified on 11p15: IGF2 (OMIM Ref. No. 147470), which encodes an important autocrine growth factor in cancer; H19 (OMIM Ref. No. 103280), an untranslated RNA whose imprinting regulates IGF2; ASCL2 (OMIM Ref. No. 601886), a homolog of Drosophila achaete-scute that is expressed in the trophoblast; KCNQ1 (OMIM Ref. No. 192500), which encodes a voltage-gated potassium channel; p57(KIP2) (CDKN1C; 600856), which encodes a cyclin-dependent kinase inhibitor; TSSC5 (IMPT1; 602631), which encodes a predicted transmembrane transporter; and TSSC3 (OMIM Ref. No. 602131), also known as IPL, a homolog of a mouse apoptosis-inducing gene. With the exception of IGF2, all of these genes are expressed from the maternal allele. Because of the large number of imprinted genes on 11p15, spanning approximately 1 Mb, this region appears to represent 1 of 2 known large imprinted domains in the human genome, the other being the Prader-Willi/Angelman syndrome domain of 15q11-q13 (see OMIM Ref. No. 105830). Koi et al. (1993) isolated a subchromosomal transferable fragment (STF) that suppresses in vitro growth of the rhabdomyosarcoma cell line RD, confirming the existence of 1 or more tumor suppressor genes within this region. Hu et al. (1997) found that the STF spans approximately 2.5 Mb, with D11S12 at its proximal end and D11S1318 at its distal end. Within a cluster of imprinted genes in this STF, Lee et al. (1999) identified 2 novel genes, designated TSSC4 (OMIM Ref. No. 603852) and TSSC6, that were not imprinted in any of the fetal or extraembryonic tissues examined. The TSSC6 cDNA encodes a predicted protein of 290 amino acids that shows no close similarity to previously reported proteins.

Northern blot analysis failed to detect TSSC6 gene expression; however, RT-PCR analysis suggested that the TSSC6 gene is ubiquitously expressed at low levels. The TSSC4 and TSSC6 genes are both located in the center of the 1-Mb imprinted domain on 11p15 that contains the 7 imprinted genes. Thus, the imprinted gene domain of 11p15 appears to contain at least 2 imprinted subdomains, between which the TSSC4 and TSSC6 genes substantially escape imprinting, due either to a lack of initial silencing or to an early developmental relaxation of imprinting Full details of the abovementioned studies are described in the following publications, the disclosure of which are hereby incorporated by reference:

Koi, M.; Johnson, L. A.; Kalikin, L. M.; Little, P. F. R.; Nakamura, Y.; Feinberg, A. P.: Tumor cell growth arrest caused by subchromosomal transferable DNA fragments from chromosome 11. Science 260:361-364, 1993; and Lee, M. P.; Brandenburg, S.; Landes, G. M.; Adams, M.; Miller, G.; Feinberg, A. P. : Two novel genes in the center of the 11p15 imprinted domain escape genomic imprinting. Hum. Molec. Ge.

Further studies establishing the function and utilities of PHEMX are found in John Hopkins OMIM database record ID 603853, and in cited publications listed in Table 5, which are hereby incorporated by reference. PHT2 (Accession NP_057666.1) is another GAM94 target gene, herein designated TARGET GENE. PHT2 BINDING SITE is a target binding site found in the 5' untranslated region of mRNA encoded by PHT2, corresponding to a target binding site such as BINDING SITE I, BINDING SITE II or BINDING SITE III of FIG. 8. Table 4 illustrates the complementarity of the nucleotide sequences of PHT2 BINDING SITE, designated SEQ ID:13637, to the nucleotide sequence of GAM94 RNA, herein designated GAM RNA, also designated SEQ ID:332.

Another function of GAM94 is therefore inhibition of PHT2 (Accession NP_057666.1). Accordingly, utilities of GAM94 include diagnosis, prevention and treatment of diseases and clinical conditions associated with PHT2.

Phosphatidylinositol-4-phosphate 5-kinase, type i, beta (PIP5K1B, Accession NP_003549.1) is another GAM94 target gene, herein designated TARGET GENE. PIP5K1B BINDING SITE is a target binding site found in the 5' untranslated region of mRNA encoded by PIP5K1B, corresponding to a target binding site such as BINDING SITE I, BINDING SITE II or BINDING SITE III of FIG. 8. Table 4 illustrates the complementarity of the nucleotide sequences of PIP5K1B BINDING SITE, designated SEQ ID:9155, to the nucleotide sequence of GAM94 RNA, herein designated GAM RNA, also designated SEQ ID:332.

Another function of GAM94 is therefore inhibition of Phosphatidylinositol-4-phosphate 5-kinase, type i, beta (PIP5K1B, Accession NP_003549.1), a gene which catalyses the phosphorylation of phosphatidylinositol-4-phosphate to form phosphatidylinositol-4,5-biphosphate and therefore may be associated with Friedreich ataxia. Accordingly, utilities of GAM94 include diagnosis, prevention and treatment of Friedreich ataxia, and of other diseases and clinical conditions associated with PIP5K1B.

The function of PIP5K1B has been established by previous studies. Carvajal et al. (1995) reported the isolation of a gene from the region of the genome associated with Friedreich ataxia (FRDA; 229300). Expression was found to be complex, with multiple transcripts detected in a variety of tissues and evidence of alternative splicing and developmental control. The predicted amino acid sequence for the 2.7-kb transcript showed a marked homology to the deduced amino acid sequence of the MSS4 protein of Saccharomyces cerevisiae, which had been proposed to function in the phosphoinositide cycle, thus suggesting a potential role for the human homolog in signal transduction. Although no evidence of mutation was detected in the transcript, the sequence (which they designated STM7. I) represented only one of the shorter alternatively spliced species identified by Northern analysis and direct sequencing. Carvajal et al. (1996) reported that the X25 (frataxin- encoding) gene described by Campuzano et al. (1996) and shown to be associated with mutations in FRDA patients comprises part of a gene that they had previously identified and named STM7. They reported that the transcription of both STM7 and X25 occurs from the centromere toward the telomere, that the reported sequences of STM7 and X25 did not represent a full-length transcript, that multiple transcripts for each of these genes are present in Northern blots, and that several of these transcripts are of similar size. Carvajal et al. (1996) also reported that less than 10 kb separates the CpG island identified in the X25/exon 1 from the 3-prime end of STM7/exon 16. They further demonstrated that the recombinant protein corresponding to the STM7.1 transcript has phosphatidylinositol-4-phosphate 5-kinase activity. See 606829 for further discussion of the relationship between STM7 and FRDA.

Full details of the abovementioned studies are described in the following publications, the disclosure of which are hereby incorporated by reference:

Campuzano, V.; Montermini, L.; Molto, M. D.; Pianese, L.; Cossee, M.; Cavalcanti, F.; Monros, E.; Rodius, F.; Duclos, F.; Monticelli, A.; Zara, F.; Canizares, J.; Koutnikova, H.; Bidichandani, S. I.; Gellera, C.; Brice, A.; Trouillas, P.; De Michele, G.; Filla, A.; De Frutos, R.; Palau, F.; Patel, P. I.; Di Donato, S.; Mandel, J. -L.; Cocozza, S.; Koenig, M.; Pandolfo, M.: Friedreich's ataxia: autosomal recessive disease caused by an intronic GAA triplet repeat expansion. Science 271:1423-1427, 1996; and Carvajal, J. J.; Pook, M. A.; dos Santos, M.; Doudney, K.; Hillermann, R.; Minogue, S.; Williamson, R.; Hsuan, J. J.; Chamberlain, S.: The Friedreich's ataxia gene encodes a novel phos.

Further studies establishing the function and utilities of PIP5K1B are found in John Hopkins OMIM database record ID 602745, and in cited publications listed in Table 5, which are hereby incorporated by reference. Phosphatidylserine decarboxylase (PISD, Accession NP_055153.1) is another GAM94 target gene, herein designated TARGET GENE. PISD BINDING SITE1 and PISD BINDING SITE2 are target binding sites found in untranslated regions of mRNA encoded by PISD, corresponding to target binding sites such as BINDING SITE I, BINDING SITE II or BINDING SITE III of FIG. 8. Table 4 illustrates the complementarity of the nucleotide sequences of PISD BINDING SITE1 and PISD BINDING SITE2, designated SEQ ID:19454 and SEQ ID:3283 respectively, to the nucleotide sequence of GAM94 RNA, herein designated GAM RNA, also designated SEQ ID:332.

Another function of GAM94 is therefore inhibition of Phosphatidylserine decarboxylase (PISD, Accession NP_055153.1). Accordingly, utilities of GAM94 include diagnosis, prevention and treatment of diseases and clinical conditions associated with PISD.

Paired-like homeodomain transcription factor 2 (PITX2, Accession NP_700475.1) is another GAM94 target gene, herein designated TARGET GENE. PITX2 BINDING SITE is a target binding site found in the 5' untranslated region of multiple transcripts of mRNA encoded by PITX2, corresponding to a target binding site such as BINDING SITE I, BINDING SITE II or BINDING SITE III of FIG. 8. Table 4 illustrates the complementarity of the nucleotide sequences of PITX2 BINDING SITE, designated SEQ ID:3506, to the nucleotide sequence of GAM94 RNA, herein designated GAM RNA, also designated SEQ ID:332.

Another function of GAM94 is therefore inhibition of Paired-like homeodomain transcription factor 2 (PITX2, Accession NP_700475.1). Accordingly, utilities of GAM94 include diagnosis, prevention and treatment of diseases and clinical conditions associated with PITX2.

Paired-like homeodomain transcription factor 2 (PITX2, Accession NP_700476.1) is another GAM94 target gene, herein designated TARGET GENE. PITX2 BINDING SITE is a target binding site found in the 5' untranslated region of multiple transcripts of mRNA encoded by PITX2, corresponding to a target binding site such as BINDING SITE I, BINDING SITE II or BINDING SITE III of FIG. 8. Table 4 illustrates the complementarity of the nucleotide sequences of PITX2 BINDING SITE, designated SEQ ID:3506, to the nucleotide sequence of GAM94 RNA, herein designated GAM RNA, also designated SEQ ID:332.

Another function of GAM94 is therefore inhibition of Paired-like homeodomain transcription factor 2 (PITX2, Accession NP_700476.1). Accordingly, utilities of GAM94 include diagnosis, prevention and treatment of diseases and clinical conditions associated with PITX2.

Pbx/knotted 1 homeobox 2 (PKNOX2, Accession NP_071345.1) is another GAM94 target gene, herein designated TARGET GENE. PKNOX2 BINDING SITE is a target binding site found in the 3' untranslated region of mRNA encoded by PKNOX2, corresponding to a target binding site such as BINDING SITE I, BINDING SITE II or BINDING SITE III of FIG. 8. Table 4 illustrates the complementarity of the nucleotide sequences of PKNOX2 BINDING SITE, designated SEQ ID:2901, to the nucleotide sequence of GAM94 RNA, herein designated GAM RNA, also designated SEQ ID:332.

Another function of GAM94 is therefore inhibition of Pbx/knotted 1 homeobox 2 (PKNOX2, Accession NP_071345.1). Accordingly, utilities of GAM94 include diagnosis, prevention and treatment of diseases and clinical conditions associated with PKNOX2.

Placenta-specific 3 (PLAC3, Accession NP_068755.1) is another GAM94 target gene, herein designated TARGET GENE. PLAC3 BINDING SITE is a target binding site found in the 5' untranslated region of multiple transcripts of mRNA encoded by PLAC3, corresponding to a target binding site such as BINDING SITE I, BINDING SITE II or BINDING SITE III of FIG. 8. Table 4 illustrates the complementarity of the nucleotide sequences of PLAC3 BINDING SITE, designated SEQ ID:12261, to the nucleotide sequence of GAM94 RNA, herein designated GAM RNA, also designated SEQ ID:332.

Another function of GAM94 is therefore inhibition of Placenta-specific 3 (PLAC3, Accession NP_068755.1). Accordingly, utilities of GAM94 include diagnosis, prevention and treatment of diseases and clinical conditions associated with PLAC3.

Placenta-specific 3 (PLAC3, Accession NP_064714.1) is another GAM94 target gene, herein designated TARGET GENE. PLAC3 BINDING SITE is a target binding site found in the 5' untranslated region of multiple transcripts of mRNA encoded by PLAC3, corresponding to a target binding site such as BINDING SITE I, BINDING SITE II or BINDING SITE III of FIG. 8. Table 4 illustrates the complementarity of the nucleotide sequences of PLAC3 BINDING SITE, designated SEQ ID:12261, to the nucleotide sequence of GAM94 RNA, herein designated GAM RNA, also designated SEQ ID:332.

Another function of GAM94 is therefore inhibition of Placenta-specific 3 (PLAC3, Accession NP_064714.1). Accordingly, utilities of GAM94 include diagnosis, prevention and treatment of diseases and clinical conditions associated with PLAC3.

Phospholipase c, delta 3 (PLCD3, Accession NP_588614.1) is another GAM94 target gene, herein designated TARGET GENE. PLCD3 BINDING SITE is a target binding site found in the 3' untranslated region of mRNA encoded by PLCD3, corresponding to a target binding site such as BINDING SITE I, BINDING SITE II or BINDING SITE III of FIG. 8. Table 4 illustrates the complementarity of the nucleotide sequences of PLCD3 BINDING SITE, designated SEQ ID:3472, to the nucleotide sequence of GAM94 RNA, herein designated GAM RNA, also designated SEQ ID:332.

Another function of GAM94 is therefore inhibition of Phospholipase c, delta 3 (PLCD3, Accession NP_588614.1). Accordingly, utilities of GAM94 include diagnosis, prevention and treatment of diseases and clinical conditions associated with PLCD3.

Phospholipase c, delta 4 (PLCD4, Accession NP_116115.1) is another GAM94 target gene, herein designated TARGET GENE. PLCD4 BINDING SITE is a target binding site found in the 5' untranslated region of mRNA encoded by PLCD4, corresponding to a target binding site such as BINDING SITE I, BINDING SITE II or BINDING SITE III of FIG. 8. Table 4 illustrates the complementarity of the nucleotide sequences of PLCD4 BINDING SITE, designated SEQ ID:18501, to the nucleotide sequence of GAM94 RNA, herein designated GAM RNA, also designated SEQ ID:332.

Another function of GAM94 is therefore inhibition of Phospholipase c, delta 4 (PLCD4, Accession NP_116115.1). Accordingly, utilities of GAM94 include diagnosis, prevention and treatment of diseases and clinical conditions associated with PLCD4.

Phospholipase c-like 2 (PLCL2, Accession NP_055999.1) is another GAM94 target gene, herein designated TARGET GENE. PLCL2 BINDING SITE is a target binding site found in the 5' untranslated region of mRNA encoded by PLCL2, corresponding to a target binding site such as BINDING SITE I, BINDING SITE II or BINDING SITE III of FIG. 8. Table 4 illustrates the complementarity of the nucleotide sequences of PLCL2 BINDING SITE, designated SEQ ID:2076, to the nucleotide sequence of GAM94 RNA, herein designated GAM RNA, also designated SEQ ID:332.

Another function of GAM94 is therefore inhibition of Phospholipase c-like 2 (PLCL2, Accession NP_055999.1). Accordingly, utilities of GAM94 include diagnosis, prevention and treatment of diseases and clinical conditions associated with PLCL2.

Plexin a2 (PLXNA2, Accession NP_079455.1) is another GAM94 target gene, herein designated TARGET GENE. PLXNA2 BINDING SITE is a target binding site found in the 3' untranslated region of mRNA encoded by PLXNA2, corresponding to a target binding site such as BINDING SITE I, BINDING SITE II or BINDING SITE III of FIG. 8. Table 4 illustrates the complementarity of the nucleotide sequences of PLXNA2 BINDING SITE, designated SEQ ID:18949, to the nucleotide sequence of GAM94 RNA, herein designated GAM RNA, also designated SEQ ID:332.

Another function of GAM94 is therefore inhibition of Plexin a2 (PLXNA2, Accession NP_079455.1), a gene which is a transmembrane protein. Accordingly, utilities of GAM94 include diagnosis, prevention and treatment of diseases and clinical conditions associated with PLXNA2.

The function of PLXNA2 and its association with various diseases and clinical conditions, has been established by previous studies, as described hereinabove with reference to GAM65.1. Plexin b2 (PLXNB2, Accession NP_036533.1) is another GAM94 target gene, herein designated TARGET GENE. PLXNB2 BINDING SITE is a target binding site found in the 3' untranslated region of mRNA encoded by PLXNB2, corresponding to a target binding site such as BINDING SITE I, BINDING SITE II or BINDING SITE III of FIG. 8. Table 4 illustrates the complementarity of the nucleotide sequences of PLXNB2 BINDING SITE, designated SEQ ID:8876, to the nucleotide sequence of GAM94 RNA, herein designated GAM RNA, also designated SEQ ID:332.

Another function of GAM94 is therefore inhibition of Plexin b2 (PLXNB2, Accession NP_036533.1), a gene which is a novel member of the plexin family. Accordingly, utilities of GAM94 include diagnosis, prevention and treatment of diseases and clinical conditions associated with PLXNB2.

The function of PLXNB2 has been established by previous studies. Using the technique of differential display, Shinoura et al. (1995) identified a cDNA fragment that was differentially expressed in malignant vs benign brain tumors. By screening a human fetal brain cDNA library with this fragment, they isolated a novel cDNA, which they termed MM1. MM1 was expressed almost 8-fold higher in glioblastomas compared to low-grade astrocytomas and slightly higher in malignant menangiomas than in benign menangiomas. By screening human brain cDNAs for those encoding proteins larger than 60 kD, Nagase et al. (1997) identified the MM1 gene, which they called KIAA0315. By RT-PCR amplification starting from the partial cDNA sequences of clones MM1 and KIAA0315, Tamagnone et al. (1999) identified the cDNA sequence of a novel member of the plexin gene family and named the gene plexin B2. Using a radiation hybrid mapping panel, Nagase et al. (1997) mapped the PLXNB2 gene to chromosome 22. By sequence analysis, Tamagnone et al. (1999) showed that the PLXNB2 gene maps to 22q13.31-q13.33 in the BAC clone (GenBank AL022328) containing the MAPK12 (OMIM Ref. No. 602399) and MAPK11 (OMIM Ref. No. 602898) genes.

Full details of the abovementioned studies are described in the following publications, the disclosure of which are hereby incorporated by reference:

Shinoura, N.; Shamraj, O. I.; Hugenholz, H.; Zhu, J. G.; McBlack, P.; Warnick, R.; Tew, J. J.; Wani, M. A.; Menon, A. G.: Identification and partial sequence of a cDNA that is differentially expressed in human brain tumors. Cancer Lett. 89:215-221, 1995; and Tamagnone, L.; Artigiani, S.; Chen, H.; He, Z.; Ming, G.; Song, H.; Chedotal, A.; Winberg, M. L.; Goodman, C. S.; Poo, M.; Tessier-Lavigne, M.; Comoglio, P. M.: Plexins are a large fam.

Further studies establishing the function and utilities of PLXNB2 are found in John Hopkins OMIM database record ID 604293, and in cited publications listed in Table 5, which are hereby incorporated by reference. Postmeiotic segregation increased 2-like 5 (PMS2L5, Accession NP_777590.1) is another GAM94 target gene, herein designated TARGET GENE. PMS2L5 BINDING SITE is a target binding site found in the 5' untranslated region of mRNA encoded by PMS2L5, corresponding to a target binding site such as BINDING SITE I, BINDING SITE II or BINDING SITE III of FIG. 8. Table 4 illustrates the complementarity of the nucleotide sequences of PMS2L5 BINDING SITE, designated SEQ ID:9051, to the nucleotide sequence of GAM94 RNA, herein designated GAM RNA, also designated SEQ ID:332.

Another function of GAM94 is therefore inhibition of Postmeiotic segregation increased 2-like 5 (PMS2L5, Accession NP_777590.1). Accordingly, utilities of GAM94 include diagnosis, prevention and treatment of diseases and clinical conditions associated with PMS2L5.

Paraneoplastic antigen like 5 (PNMA5, Accession NP_443158.1) is another GAM94 target gene, herein designated TARGET GENE. PNMA5 BINDING SITE1 through PNMA5 BINDING SITE3 are target binding sites found in untranslated regions of mRNA encoded by PNMA5, corresponding to target binding sites such as BINDING SITE I, BINDING SITE II or BINDING SITE III of FIG. 8. Table 4 illustrates the complementarity of the nucleotide sequences of PNMA5 BINDING SITE1 through PNMA5 BINDING SITE3, designated SEQ ID:4787, SEQ ID:10336 and SEQ ID:12546 respectively, to the nucleotide sequence of GAM94 RNA, herein designated GAM RNA, also designated SEQ ID:332.

Another function of GAM94 is therefore inhibition of Paraneoplastic antigen like 5 (PNMA5, Accession NP_443158.1). Accordingly, utilities of GAM94 include diagnosis, prevention and treatment of diseases and clinical conditions associated with PNMA5.

Polymerase (dna directed) kappa (POLK, Accession NP_057302.1) is another GAM94 target gene, herein designated TARGET GENE. POLK BINDING SITE is a target binding site found in the 5' untranslated region of mRNA encoded by POLK, corresponding to a target binding site such as BINDING SITE I, BINDING SITE II or BINDING SITE III of FIG. 8. Table 4 illustrates the complementarity of the nucleotide sequences of POLK BINDING SITE, designated SEQ ID:7290, to the nucleotide sequence of GAM94 RNA, herein designated GAM RNA, also designated SEQ ID:332.

Another function of GAM94 is therefore inhibition of Polymerase (dna directed) kappa (POLK, Accession NP_057302.1), a gene which is necessary for chromosome segregation. Accordingly, utilities of GAM94 include diagnosis, prevention and treatment of diseases and clinical conditions associated with POLK.

The function of POLK and its association with various diseases and clinical conditions, has been established by previous studies, as described hereinabove with reference to GAM72.1. Pou domain, class 3, transcription factor 2 (POU3F2, Accession NP_005595.1) is another GAM94 target gene, herein designated TARGET GENE. POU3F2 BINDING SITE is a target binding site found in the 5' untranslated region of mRNA encoded by POU3F2, corresponding to a target binding site such as BINDING SITE I, BINDING SITE II or BINDING SITE III of FIG. 8. Table 4 illustrates the complementarity of the nucleotide sequences of POU3F2 BINDING SITE, designated SEQ ID:19974, to the nucleotide sequence of GAM94 RNA, herein designated GAM RNA, also designated SEQ ID:332.

Another function of GAM94 is therefore inhibition of Pou domain, class 3, transcription factor 2 (POU3F2, Accession NP_005595.1), a gene which positively regulates the genes under the control of corticotropin-releasing hormone.

Accordingly, utilities of GAM94 include diagnosis, prevention and treatment of diseases and clinical conditions associated with POU3F2.

The function of POU3F2 has been established by previous studies. N-Oct-3 is a protein belonging to a large family of transcription factors that bind to the octameric DNA sequence ATGCAAAT. Most of these proteins share a highly homologous region, referred to as the POU domain, which occurs in several mammalian transcription factors, including the octamer-binding proteins Oct1 (POU2F1; 164175) and Oct2 (POU2F2; 164176), and the pituitary protein Pit1 (PIT1; 173110). Class III POU genes are expressed predominantly in the CNS. It is likely that CNS-specific transcription factors such as these play an important role in mammalian neurogenesis by regulating their diverse patterns of gene expression. The human counterpart of the mouse brain-2 gene (Brn2) was first identified in nuclear extracts from brain and was termed N-Oct-3 (Schreiber et al., 1993). The protein is expressed in the CNS during development and in adult brain. Atanasoski et al. (1995) reported the isolation, characterization, and chromosomal localization of the human POU3F2 gene which encodes the N-Oct-3 protein. The gene is intronless. Sequencing of 650 bp of the promoter region showed 84% sequence identity of POU3F2 with the mouse Brn2 gene. By Southern blot analysis of somatic cell hybrids and by in situ hybridization, Atanasoski et al. (1995) mapped the POU3F2 gene to 6q16. Xia et al. (1993) mapped the Brn2 (OMIM Ref. No. Pou3f2) gene to mouse chromosome 4.

Full details of the abovementioned studies are described in the following publications, the disclosure of which are hereby incorporated by reference:

Atanasoski, S.; Toldo, S. S.; Malipiero, U.; Schreiber, E.; Fries, R.; Fontana, A.: Isolation of the human genomic brain-2/N-Oct 3 gene (POUF3) and assignment to chromosome 6q16. Genomics 26:272-280, 1995; and Xia, Y.-R.; Andersen, B.; Mehrabian, M.; Diep, A. T.; Warden, C. H.; Mohandas, T.; McEvilly, R. J.; Rosenfeld, M. G.; Lusis, A. J.: Chromosomal organization of mammalian POU domain factors.

Further studies establishing the function and utilities of POU3F2 are found in John Hopkins OMIM database record ID 600494, and in cited publications listed in Table 5, which are hereby incorporated by reference. Ptprf interacting protein, binding protein 2 (liprin beta 2) (PPFIBP2, Accession XP_084578.4) is another GAM94 target gene, herein designated TARGET GENE. PPFIBP2 BINDING SITE is a target binding site found in the 5' untranslated region of mRNA encoded by PPFIBP2, corresponding to a target binding site such as BINDING SITE I, BINDING SITE II or BINDING SITE III of FIG. 8. Table 4 illustrates the complementarity of the nucleotide sequences of PPFIBP2 BINDING SITE, designated SEQ ID:10296, to the nucleotide sequence of GAM94 RNA, herein designated GAM RNA, also designated SEQ ID:332.

Another function of GAM94 is therefore inhibition of Ptprf interacting protein, binding protein 2 (liprin beta 2) (PPFIBP2, Accession XP_084578.4). Accordingly, utilities of GAM94 include diagnosis, prevention and treatment of diseases and clinical conditions associated with PPFIBP2.

Protein phosphatase 1f (pp2c domain containing) (PPM1F, Accession NP_055449.1) is another GAM94 target gene, herein designated TARGET GENE. PPM1F BINDING SITE is a target binding site found in the 3' untranslated region of mRNA encoded by PPM1F, corresponding to a target binding site such as BINDING SITE I, BINDING SITE II or BINDING SITE III of FIG. 8. Table 4 illustrates the complementarity of the nucleotide sequences of PPM1F BINDING SITE, designated SEQ ID:10074, to the nucleotide sequence of GAM94 RNA, herein designated GAM RNA, also designated SEQ ID:332.

Another function of GAM94 is therefore inhibition of Protein phosphatase 1f (pp2c domain containing) (PPM1F, Accession NP_055449.1). Accordingly, utilities of GAM94 include diagnosis, prevention and treatment of diseases and clinical conditions associated with PPM1F.

Protein phosphatase 1, regulatory (inhibitor) subunit 11 (PPP1R11, Accession NP_740751.1) is another GAM94 target gene, herein designated TARGET GENE. PPP1R11 BINDING SITE1 and PPP1R11 BINDING SITE2 are target binding sites found in untranslated regions of multiple transcripts of mRNA encoded by PPP1R11, corresponding to target binding sites such as BINDING SITE I, BINDING SITE II or BINDING SITE III of FIG. 8. Table 4 illustrates the complementarity of the nucleotide sequences of PPP1R11 BINDING SITE1 and PPP1R11 BINDING SITE2, designated SEQ ID:4808 and SEQ ID:8137 respectively, to the nucleotide sequence of GAM94 RNA, herein designated GAM RNA, also designated SEQ ID:332.

Another function of GAM94 is therefore inhibition of Protein phosphatase 1, regulatory (inhibitor) subunit 11 (PPP1R11, Accession NP_740751.1), a gene which inhibits rabbit muscle protein phosphatase-1 in vitro. Accordingly, utilities of GAM94 include diagnosis, prevention and treatment of diseases and clinical conditions associated with PPP1R11.

The function of PPP1R11 has been established by previous studies. Using a cDNA selection technique to identify genes in the hemochromatosis (OMIM Ref. No. 235200) gene region on 6p21.3, El Kahloun et al. (1993) cloned PPP1R11, which they called HCGV (hemochromatosis candidate gene V). By screening cDNA libraries and using PCR techniques, Giffon et al. (1996) obtained a full-length cDNA encoding PPP1R11. The predicted 126-amino acid PPP1R11 protein contains 8 potential phosphorylation sites and a C-terminal PEST pattern that is characteristic of proteins with short half-lives. PPP1R11 shares 89.7% amino acid identity with its mouse homolog, Tctex5. Northern blot analysis detected a 1.8-kb PPP1R11 transcript in all fetal and adult tissues tested. The PPP1R11 gene appeared to be widely preserved throughout animal evolution, and Giffon et al. (1996) detected fragments on the DNAs of primates, rat, dog, cow, and rabbit. By screening sequence databases, Lepourcelet et al. (1996) identified a cDNA clone that suggested the existence of at least 1 spliced isoform of PPP1R11. Using a yeast 2-hybrid screen to identify putative protein phosphatase-1 (PP1; OMIM Ref. No. 176875)-binding proteins, Zhang et al. (1998) obtained a cDNA encoding PPP1R11, which they called inhibitor-3. They reported that PPP1R11 is hydrophilic, heat stable, and behaves anomalously on SDS-PAGE, with an apparent molecular mass of 23 kD compared with its calculated molecular mass of 14 kD, and on gel filtration, with a relative molecular weight of 55,000. Zhang et al. (1998) showed that PPP1R11 is a specific inhibitor of PP1 with a differential sensitivity toward the metal-independent and metal-dependent forms of PP1. They hypothesized that the PP1-binding ability of PPP1R11 is due at least in part to the possession of a VxW motif. PPP1R11 is well conserved in evolution, with related genes in S. cerevisiae, S. pombe, and C. elegans.

Full details of the abovementioned studies are described in the following publications, the disclosure of which are hereby incorporated by reference:

Lepourcelet, M.; Andrieux, N.; Giffon, T.; Pichon, L.; Hampe, A.; Galibert, F.; Mosser, J.: Systematic sequencing of the human HLA-A/HLA-F region: establishment of a cosmid contig and identification of a new gene cluster within 37 kb of sequence. Genomics 37:316-326, 1996; and Zhang, J.; Zhang, L.; Zhao, S.; Lee, E. Y. C.: Identification and characterization of the human HCG V gene product as a novel inhibitor of protein phosphatase-1. Biochemistry 37:16728.

Further studies establishing the function and utilities of PPP1R11 are found in John Hopkins OMIM database record ID 606670, and in cited publications listed in Table 5, which are hereby incorporated by reference. Protein phosphatase 1, regulatory (inhibitor) subunit 11 (PPP1R11, Accession NP_068778.1) is another GAM94 target gene, herein designated TARGET GENE. PPP1R11 BINDING SITE1 and PPP1R11 BINDING SITE2 are target binding sites found in untranslated regions of multiple transcripts of mRNA encoded by PPP1R11, corresponding to target binding sites such as BINDING SITE I, BINDING SITE II or BINDING SITE III of FIG. 8. Table 4 illustrates the complementarity of the nucleotide sequences of PPP1R11 BINDING SITE1 and PPP1R11 BINDING SITE2, designated SEQ ID:4808 and SEQ ID:8137 respectively, to the nucleotide sequence of GAM94 RNA, herein designated GAM RNA, also designated SEQ ID:332.

Another function of GAM94 is therefore inhibition of Protein phosphatase 1, regulatory (inhibitor) subunit 11 (PPP1R11, Accession NP_068778.1), a gene which inhibits rabbit muscle protein phosphatase-1 in vitro. Accordingly, utilities of GAM94 include diagnosis, prevention and treatment of diseases and clinical conditions associated with PPP1R11.

The function of PPP1R11 has been established by previous studies. Using a cDNA selection technique to identify genes in the hemochromatosis (OMIM Ref. No. 235200) gene region on 6p21.3, El Kahloun et al. (1993) cloned PPP1R11, which they called HCGV (hemochromatosis candidate gene V). By screening cDNA libraries and using PCR techniques, Giffon et al. (1996) obtained a full-length cDNA encoding PPP1R11. The predicted 126-amino acid PPP1R11 protein contains 8 potential phosphorylation sites and a C-terminal PEST pattern that is characteristic of proteins with short half-lives. PPP1R11 shares 89.7% amino acid identity with its mouse homolog, Tctex5. Northern blot analysis detected a 1.8-kb PPP1R11 transcript in all fetal and adult tissues tested. The PPP1R11 gene appeared to be widely preserved throughout animal evolution, and Giffon et al. (1996) detected fragments on the DNAs of primates, rat, dog, cow, and rabbit. By screening sequence databases, Lepourcelet et al. (1996) identified a cDNA clone that suggested the existence of at least 1 spliced isoform of PPP1R11. Using a yeast 2-hybrid screen to identify putative protein phosphatase-1 (PP1; OMIM Ref. No. 176875)-binding proteins, Zhang et al. (1998) obtained a cDNA encoding PPP1R11, which they called inhibitor-3. They reported that PPP1R11 is hydrophilic, heat stable, and behaves anomalously on SDS- PAGE, with an apparent molecular mass of 23 kD compared with its calculated molecular mass of 14 kD, and on gel filtration, with a relative molecular weight of 55,000. Zhang et al. (1998) showed that PPP1R11 is a specific inhibitor of PP1 with a differential sensitivity toward the metal- independent and metal-dependent forms of PP1. They hypothesized that the PP1-binding ability of PPP1R11 is due at least in part to the possession of a VxW motif. PPP1R11 is well conserved in evolution, with related genes in S. cerevisiae, S. pombe, and C. elegans.

Full details of the abovementioned studies are described in the following publications, the disclosure of which are hereby incorporated by reference:

Lepourcelet, M.; Andrieux, N.; Giffon, T.; Pichon, L.; Hampe, A.; Galibert, F.; Mosser, J.: Systematic sequencing of the human HLA-A/HLA-F region: establishment of a cosmid contig and identification of a new gene cluster within 37 kb of sequence. Genomics 37:316-326, 1996; and Zhang, J.; Zhang, L.; Zhao, S.; Lee, E. Y. C.: Identification and characterization of the human HCG V gene product as a novel inhibitor of protein phosphatase-1. Biochemistry 37:16728.

Further studies establishing the function and utilities of PPP1R11 are found in John Hopkins OMIM database record ID 606670, and in cited publications listed in Table 5, which are hereby incorporated by reference. Protein phosphatase 1, regulatory (inhibitor) subunit 3b (PPP1R3B, Accession NP_078883.1) is another GAM94 target gene, herein designated TARGET GENE. PPP1R3B BINDING SITE is a target binding site found in the 3' untranslated region of mRNA encoded by PPP1R3B, corresponding to a target binding site such as BINDING SITE I, BINDING SITE II or BINDING SITE III of FIG. 8. Table 4 illustrates the complementarity of the nucleotide sequences of PPP1R3B BINDING SITE, designated SEQ ID:16205, to the nucleotide sequence of GAM94 RNA, herein designated GAM RNA, also designated SEQ ID:332.

Another function of GAM94 is therefore inhibition of Protein phosphatase 1, regulatory (inhibitor) subunit 3b (PPP1R3B, Accession NP_078883.1). Accordingly, utilities of GAM94 include diagnosis, prevention and treatment of diseases and clinical conditions associated with PPP1R3B.

Protein phosphatase 2 (formerly 2a), regulatory subunit a (pr 65), beta isoform (PPP2R1B, Accession NP_002707.2) is another GAM94 target gene, herein designated TARGET GENE. PPP2R1B BINDING SITE is a target binding site found in the 5' untranslated region of mRNA encoded by PPP2R1B, corresponding to a target binding site such as BINDING SITE I, BINDING SITE II or BINDING SITE III of FIG. 8. Table 4 illustrates the complementarity of the nucleotide sequences of PPP2R1B BINDING SITE, designated SEQ ID:18668, to the nucleotide sequence of GAM94 RNA, herein designated GAM RNA, also designated SEQ ID:332.

Another function of GAM94 is therefore inhibition of Protein phosphatase 2 (formerly 2a), regulatory subunit a (pr 65), beta isoform (PPP2R1B, Accession NP_002707.2), a gene which is necessary for interaction of the catalytic PP2A-C and variable PP2A-B subunits. Accordingly, utilities of GAM94 include diagnosis, prevention and treatment of diseases and clinical conditions associated with PPP2R1B.

The function of PPP2R1B has been established by previous studies. Loss of heterozygosity (LOH) at 11q22-q24 has been associated with lung, colon, breast, cervical, head and neck, and ovarian cancers, as well as melanoma (Arai et al., 1996). Introduction of a normal chromosome 11, or a derivative t(X;11) chromosome containing 11pter-q23, can reverse the tumorigenic potential of several types of cancer cells and Wilms tumor when introduced into nude mice. These studies suggest that one or more tumor suppressor genes are located centromeric to the t(X;11) breakpoint at 11q23. Because of a high frequency of LOH in lung cancer cells involving D11S1647 and D11S1987, Wang et al. (1998) systematically surveyed the region between these 2 markers for candidate tumor suppressor genes. Over 100 candidate genes and expressed sequenced tags (ESTs) were identified from a radiation hybrid map of chromosome 11 and from the NCBI transcript map. One of the EST sequences (OMIM Ref. No. M65254) corresponded to a subunit of the serine/threonine protein phosphatase 2A (PP2A). PP2A is an important regulatory enzyme that down regulates the mitogen-activated protein kinase (MAPK) cascade, relays signals for cell proliferation, and appears to be linked to carcinogenesis. The PP2A holoenzyme exists in several trimeric forms consisting of a 36-kD core catalytic subunit, PP2A-C; a 65-kD structural/regulatory component, PP2A-A; and a variable regulatory subunit, PP2A-B, which confers distinct properties on the holoenzyme. Each subunit exists as multiple isoforms encoded by different genes, so that there are many forms of the PP2A trimer, differing in expression pattern and specificity. The gene identified (Wang et al., 1998) at 11q23, denoted PPP2R1B, encodes the beta-isoform of the structural-regulatory A subunit PP2A-A-beta. This subunit is necessary for interaction of the catalytic PP2A-C and variable PP2A-B subunits and is critical for phosphatase activity (Walter and Mumby, 1993). Wang et al. (1998) determined the precise physical location of PPP2R1B by colocalizing it within P1-derived artificial chromosome (PAC) clones that contained sequence tagged sites on 11q22-q23. They confirmed that the PPP2R1B gene is located in a region showing high frequency LOH. Sequencing of the PPP2R1B gene revealed somatic alterations in 15% (5 in 32) of primary lung tumors, 6% (4 in 70) of lung tumor-derived cell lines, and 15% (2 in 13) of primary colon tumors. One deletion mutation generated a truncated PP2A-A-beta protein that was unable to bind to the catalytic subunit of the PP2A holoenzyme. The PPP2R1B gene product may suppress tumor development through its role in cell cycle regulation and cellular growth control.

Full details of the abovementioned studies are described in the following publications, the disclosure of which are hereby incorporated by reference:

Wang, S. S.; Esplin, E. D.; Li, J. L.; Huang, L.; Gazdar, A.; Minna, J.; Evans, G. A.: Alterations of the PPP2R1B gene in human lung and colon cancer. Science 282:284-287, 1998; and Wang, S. S.; Esplin, E. D.; Li, J. L.; Huang, L.; Gazdar, A.; Minna, J.; Evans, G. A.: Alterations of the PPP2R1B gene in human lung and colon cancer. Science 282:284-287, 1998.

Further studies establishing the function and utilities of PPP2R1B are found in John Hopkins OMIM database record ID 603113, and in cited publications listed in Table 5, which are hereby incorporated by reference. Protein phosphatase 2 (formerly 2a), regulatory subunit b (pr 52), beta isoform (PPP2R2B, Accession NP_004567.1) is another GAM94 target gene, herein designated TARGET GENE. PPP2R2B BINDING SITE is a target binding site found in the 3' untranslated region of mRNA encoded by PPP2R2B, corresponding to a target binding site such as BINDING SITE I, BINDING SITE II or BINDING SITE III of FIG. 8. Table 4 illustrates the complementarity of the nucleotide sequences of PPP2R2B BINDING SITE, designated SEQ ID:15433, to the nucleotide sequence of GAM94 RNA, herein designated GAM RNA, also designated SEQ ID:332.

Another function of GAM94 is therefore inhibition of Protein phosphatase 2 (formerly 2a), regulatory subunit b (pr 52), beta isoform (PPP2R2B, Accession NP_004567.1). Accordingly, utilities of GAM94 include diagnosis, prevention and treatment of diseases and clinical conditions associated with PPP2R2B.

Pancreatic polypeptide 2 (PPY2, Accession NP_066578.1) is another GAM94 target gene, herein designated TARGET GENE. PPY2 BINDING SITE is a target binding site found in the 3' untranslated region of mRNA encoded by PPY2, corresponding to a target binding site such as BINDING SITE I, BINDING SITE II or BINDING SITE III of FIG. 8. Table 4 illustrates the complementarity of the nucleotide sequences of PPY2 BINDING SITE, designated SEQ ID:19063, to the nucleotide sequence of GAM94 RNA, herein designated GAM RNA, also designated SEQ ID:332.

Another function of GAM94 is therefore inhibition of Pancreatic polypeptide 2 (PPY2, Accession NP_066578.1). Accordingly, utilities of GAM94 include diagnosis, prevention and treatment of diseases and clinical conditions associated with PPY2.

Preimplantation protein 3 (PREI3, Accession NP_056202.1) is another GAM94 target gene, herein designated TARGET GENE. PREI3 BINDING SITE is a target binding site found in the 3' untranslated region of mRNA encoded by PREI3, corresponding to a target binding site such as BINDING SITE I, BINDING SITE II or BINDING SITE III of FIG. 8. Table 4 illustrates the complementarity of the nucleotide sequences of PREI3 BINDING SITE, designated SEQ ID:3082, to the nucleotide sequence of GAM94 RNA, herein designated GAM RNA, also designated SEQ ID:332.

Another function of GAM94 is therefore inhibition of Preimplantation protein 3 (PREI3, Accession NP_056202.1). Accordingly, utilities of GAM94 include diagnosis, prevention and treatment of diseases and clinical conditions associated with PREI3.

Protein kinase c binding protein 1 (PRKCBP1, Accession NP_036540.2) is another GAM94 target gene, herein designated TARGET GENE. PRKCBP1 BINDING SITE is a target binding site found in the 5' untranslated region of mRNA encoded by PRKCBP1, corresponding to a target binding site such as BINDING SITE I, BINDING SITE II or BINDING SITE III of FIG. 8. Table 4 illustrates the complementarity of the nucleotide sequences of PRKCBP1 BINDING SITE, designated SEQ ID:13695, to the nucleotide sequence of GAM94 RNA, herein designated GAM RNA, also designated SEQ ID:332.

Another function of GAM94 is therefore inhibition of Protein kinase c binding protein 1 (PRKCBP1, Accession NP_036540.2). Accordingly, utilities of GAM94 include diagnosis, prevention and treatment of diseases and clinical conditions associated with PRKCBP1.

PRO0327 (Accession NP_054844.1) is another GAM94 target gene, herein designated TARGET GENE. PRO0327 BINDING SITE is a target binding site found in the 3' untranslated region of mRNA encoded by PRO0327, corresponding to a target binding site such as BINDING SITE I, BINDING SITE II or BINDING SITE III of FIG. 8. Table 4 illustrates the complementarity of the nucleotide sequences of PRO0327 BINDING SITE, designated SEQ ID:13463, to the nucleotide sequence of GAM94 RNA, herein designated GAM RNA, also designated SEQ ID:332.

Another function of GAM94 is therefore inhibition of PRO0327 (Accession NP_054844.1). Accordingly, utilities of GAM94 include diagnosis, prevention and treatment of diseases and clinical conditions associated with PRO0327.

PRO0767 (Accession NP_054802.1) is another GAM94 target gene, herein designated TARGET GENE. PRO0767 BINDING SITE is a target binding site found in the 3' untranslated region of mRNA encoded by PRO0767, corresponding to a target binding site such as BINDING SITE I, BINDING SITE II or BINDING SITE III of FIG. 8. Table 4 illustrates the complementarity of the nucleotide sequences of PRO0767 BINDING SITE, designated SEQ ID:14093, to the nucleotide sequence of GAM94 RNA, herein designated GAM RNA, also designated SEQ ID:332.

Another function of GAM94 is therefore inhibition of PRO0767 (Accession NP_054802.1). Accordingly, utilities of GAM94 include diagnosis, prevention and treatment of diseases and clinical conditions associated with PRO0767.

PRO0943 (Accession NP_061038.1) is another GAM94 target gene, herein designated TARGET GENE. PRO0943 BINDING SITE is a target binding site found in the 3' untranslated region of mRNA encoded by PRO0943, corresponding to a target binding site such as BINDING SITE I, BINDING SITE II or BINDING SITE III of FIG. 8. Table 4 illustrates the complementarity of the nucleotide sequences of PRO0943 BINDING SITE, designated SEQ ID:17160, to the nucleotide sequence of GAM94 RNA, herein designated GAM RNA, also designated SEQ ID:332.

Another function of GAM94 is therefore inhibition of PRO0943 (Accession NP_061038.1). Accordingly, utilities of GAM94 include diagnosis, prevention and treatment of diseases and clinical conditions associated with PRO0943.

PRO1787 (Accession NP_061076.1) is another GAM94 target gene, herein designated TARGET GENE. PRO1787 BINDING SITE is a target binding site found in the 3' untranslated region of mRNA encoded by PRO1787, corresponding to a target binding site such as BINDING SITE I, BINDING SITE II or BINDING SITE III of FIG. 8. Table 4 illustrates the complementarity of the nucleotide sequences of PRO1787 BINDING SITE, designated SEQ ID:16488, to the nucleotide sequence of GAM94 RNA, herein designated GAM RNA, also designated SEQ ID:332.

Another function of GAM94 is therefore inhibition of PRO1787 (Accession NP_061076.1). Accordingly, utilities of GAM94 include diagnosis, prevention and treatment of diseases and clinical conditions associated with PRO1787.

Pregnancy specific beta-1-glycoprotein 1 (PSG1, Accession NP_008836.2) is another GAM94 target gene, herein designated TARGET GENE. PSG1 BINDING SITE is a target binding site found in the 3' untranslated region of mRNA encoded by PSG1, corresponding to a target binding site such as BINDING SITE I, BINDING SITE II or BINDING SITE III of FIG. 8. Table 4 illustrates the complementarity of the nucleotide sequences of PSG1 BINDING SITE, designated SEQ ID:1739, to the nucleotide sequence of GAM94 RNA, herein designated GAM RNA, also designated SEQ ID:332.

Another function of GAM94 is therefore inhibition of Pregnancy specific beta-1-glycoprotein 1 (PSG1, Accession NP_008836.2), a gene which is a member of the pregnancy-specific glycoprotein (PSG) and CEA families. Accordingly, utilities of GAM94 include diagnosis, prevention and treatment of diseases and clinical conditions associated with PSG1.

The function of PSG1 has been established by previous studies. The human placenta is a multihormonal endocrine organ which produces hormones, enzymes, and other molecules that support fetal survival and development. Chorionic gonadotropin (118850, 118860), placental lactogen (OMIM Ref. No. 150200), and placental alkaline phosphatase (OMIM Ref. No. 171800) are 3 of the best-known placental proteins. Immunochemical studies on the protein composition of the serum in human pregnancy revealed several so-called pregnancy-specific proteins, including pregnancy-specific beta-1-glycoprotein (PSBG). PSBG becomes detectable in serum during the first 2 to 3 weeks of pregnancy and increases as pregnancy progresses, rising to a very high level of 200 to 400 micrograms per milliliter. Although its exact physiologic role during pregnancy is unknown, the high quantity produced by the placenta argues for its importance. PSBG isolated from human placenta consists of a set of at least 3 glycoproteins with apparent molecular masses of 72, 64, and 54 kD, respectively. The heterogeneity is confirmed by detection of 3 nonglycosylated polypeptides of 50, 48, and 36 kD, which can be immunoprecipitated by antiserum to placental PSBG obtained by in vitro translation of placental polyadenylated RNA. Watanabe and Chou (1988) examined the structural relationship of these proteins by the isolation and study of cDNA clones The members of the CEA/PSG gene family have a characteristic N- terminal domain that is homologous to the immunoglobulin variable region. Khan et al. (1992) estimated the size of the PSG subfamily by identification of N-domain exons from isolated genomic clones and from total genomic DNA through PCR amplification and DNA sequence determination. They found that the PSG subfamily contains at least 11 different genes. For 7 of these, 2 DNA sequences differing from each other in 1 to 4 nucleotides were detected. Most likely they represent different alleles. All of the PSGs except PSG1, PSG4 (OMIM Ref. No. 176393), and PSG8 (OMIM Ref. No. 176397) contain the arginine- glycine-aspartic acid sequence at position 93-95 corresponding to the complementarity determining region 3 of immunoglobulin. Parsimony analysis of 24 CEA and PSG sequences using 12 members of the immunoglobulin gene superfamily as out-groups to root the family tree showed that the N-domain of the CEA group genes evolved in one major branch and the PSG group genes in the other. Brandriff et al. (1992) estimated that the CEA-PSG gene family region spans 1.1 to 1.2 Mb. Using a high-resolution restriction fragment fingerprinting technique, Olsen et al. (1994) assembled 256 cosmids spanning the PSG region on 19q13.2 into a single 700-kb contig. FISH to sperm pronuclei and cosmid walking experiments indicated that this PSG contig is telomeric of CGM8 at the telomeric end of the CEA subgroup gene cluster. Detailed restriction mapping and hybridization with gene-specific probes indicated that the order of the 11 PSG genes in the contig is cen-PSG3 (OMIM Ref. No. 176392)-PSG8-PSG12 (PSG10; 176399)-PSG1- -PSG6 (OMIM Ref. No. 176395)-PSG7 (OMIM Ref. No. 176396)-PSG13 (PSG11; 176401)-PSG2 (OMIM Ref. No. 176391)-PSG5 (OMIM Ref. No. 176394)-PSG4-PSG11 (PSG9; 176398)-tel. The PSG genes are tandemly oriented in a 5-prime to 3-prime direction from telomere to centromere. The CEA subgroup gene CGM11 is located at the telomeric end of the PSG gene cluster, and 6 genes belonging to a third CEA family subgroup, namely CGM13 through CGM18 (later OMIM Ref. No. 109770), are interspersed among the PSG genes.

Full details of the abovementioned studies are described in the following publications, the disclosure of which are hereby incorporated by reference:

Brandriff, B. F.; Gordon, L. A.; Tynan, K. T.; Olsen, A. S.; Mohrenweiser, H. W.; Fertitta, A.; Carrano, A. V.; Trask, B. J.: Order and genomic distances among members of the carcinoembryonic antigen (CEA) gene family determined by fluorescence in situ hybridization. Genomics 12:773-779, 1992; and Teglund, S.; Olsen, A.; Khan, W. N.; Frangsmy, L.; Hammarstrom, S.: The pregnancy- specific glycoprotein (PSG) gene cluster on human chromosome 19: fine structure of the 11 PSG genes a.

Further studies establishing the function and utilities of PSG1 are found in John Hopkins OMIM database record ID 176390, and in cited publications listed in Table 5, which are hereby incorporated by reference. PSPC1 (Accession NP_060752.1) is another GAM94 target gene, herein designated TARGET GENE. PSPC1 BINDING SITE is a target binding site found in the 3' untranslated region of mRNA encoded by PSPC1, corresponding to a target binding site such as BINDING SITE I, BINDING SITE II or BINDING SITE III of FIG. 8. Table 4 illustrates the complementarity of the nucleotide sequences of PSPC1 BINDING SITE, designated SEQ ID:2242, to the nucleotide sequence of GAM94 RNA, herein designated GAM RNA, also designated SEQ ID:332.

Another function of GAM94 is therefore inhibition of PSPC1 (Accession NP_060752.1). Accordingly, utilities of GAM94 include diagnosis, prevention and treatment of diseases and clinical conditions associated with PSPC1.

Prostaglandin f2 receptor negative regulator (PTGFRN, Accession XP_040709.3) is another GAM94 target gene, herein designated TARGET GENE. PTGFRN BINDING SITE is a target binding site found in the 5' untranslated region of mRNA encoded by PTGFRN, corresponding to a target binding site such as BINDING SITE I, BINDING SITE II or BINDING SITE III of FIG. 8. Table 4 illustrates the complementarity of the nucleotide sequences of PTGFRN BINDING SITE, designated SEQ ID:992, to the nucleotide sequence of GAM94 RNA, herein designated GAM RNA, also designated SEQ ID:332.

Another function of GAM94 is therefore inhibition of Prostaglandin f2 receptor negative regulator (PTGFRN, Accession XP_040709.3), a gene which inhibits the binding of prostaglandin f2-alpha (pgf2-alpha) to its specific fp receptor. Accordingly, utilities of GAM94 include diagnosis, prevention and treatment of diseases and clinical conditions associated with PTGFRN.

The function of PTGFRN has been established by previous studies. Orlicky et al. (1996) isolated a protein that copurifies with bovine prostaglandin F-2-alpha receptor (FP) and cloned the corresponding rat cDNA. Transfection experiments suggested that this protein inhibits binding of PGF-2-alpha to FP. Histologically, this protein (called FP regulatory protein, or FPRP, by them) shows a distribution coinciding well with those cells and tissues that respond to PGF-2-alpha.

Full details of the abovementioned studies are described in the following publications, the disclosure of which are hereby incorporated by reference:

Nagase, T.; Kikuno, R.; Ishikawa, K.; Hirosawa, M.; Ohara, O.: Prediction of the coding sequences of unidentified human genes. XVI. The complete sequences of 150 new cDNA clones from brain which code for large proteins in vitro. DNA Res. 7:65-73, 2000; and Stipp et al. (2001) used moderately stringent Brij96/97 detergent extraction to show that FPRP associates specifically with CD81 and CD9 but not with other tetraspanin molecules, such as C.

Further studies establishing the function and utilities of PTGFRN are found in John Hopkins OMIM database record ID 601204, and in cited publications listed in Table 5, which are hereby incorporated by reference. Ptk2 protein tyrosine kinase 2 (PTK2, Accession NP_005598.3) is another GAM94 target gene, herein designated TARGET GENE. PTK2 BINDING SITE is a target binding site found in the 3' untranslated region of multiple transcripts of mRNA encoded by PTK2, corresponding to a target binding site such as BINDING SITE I, BINDING SITE II or BINDING SITE III of FIG. 8. Table 4 illustrates the complementarity of the nucleotide sequences of PTK2 BINDING SITE, designated SEQ ID:18787, to the nucleotide sequence of GAM94 RNA, herein designated GAM RNA, also designated SEQ ID:332.

Another function of GAM94 is therefore inhibition of Ptk2 protein tyrosine kinase 2 (PTK2, Accession NP_005598.3), a gene which involves in intracellular signal transduction pathway and is a putative homolog of chicken focal adhesion associated kinase. Accordingly, utilities of GAM94 include diagnosis, prevention and treatment of diseases and clinical conditions associated with PTK2.

The function of PTK2 and its association with various diseases and clinical conditions, has been established by previous studies, as described hereinabove with reference to GAM65.2. Ptk2 protein tyrosine kinase 2 (PTK2, Accession NP_722560.1) is another GAM94 target gene, herein designated TARGET GENE. PTK2 BINDING SITE is a target binding site found in the 3' untranslated region of multiple transcripts of mRNA encoded by PTK2, corresponding to a target binding site such as BINDING SITE I, BINDING SITE II or BINDING SITE III of FIG. 8. Table 4 illustrates the complementarity of the nucleotide sequences of PTK2 BINDING SITE, designated SEQ ID:18787, to the nucleotide sequence of GAM94 RNA, herein designated GAM RNA, also designated SEQ ID:332.

Another function of GAM94 is therefore inhibition of Ptk2 protein tyrosine kinase 2 (PTK2, Accession NP_722560.1), a gene which involves in intracellular signal transduction pathway and is a putative homolog of chicken focal adhesion associated kinase. Accordingly, utilities of GAM94 include diagnosis, prevention and treatment of diseases and clinical conditions associated with PTK2.

The function of PTK2 and its association with various diseases and clinical conditions, has been established by previous studies, as described hereinabove with reference to GAM65.2. Protein tyrosine phosphatase, non-receptor type 4 (megakaryocyte) (PTPN4, Accession NP_002821.1) is another GAM94 target gene, herein designated TARGET GENE. PTPN4 BINDING SITE is a target binding site found in the 5' untranslated region of mRNA encoded by PTPN4, corresponding to a target binding site such as BINDING SITE I, BINDING SITE II or BINDING SITE III of FIG. 8. Table 4 illustrates the complementarity of the nucleotide sequences of PTPN4 BINDING SITE, designated SEQ ID:6994, to the nucleotide sequence of GAM94 RNA, herein designated GAM RNA, also designated SEQ ID:332.

Another function of GAM94 is therefore inhibition of Protein tyrosine phosphatase, non-receptor type 4 (megakaryocyte) (PTPN4, Accession NP_002821.1). Accordingly, utilities of GAM94 include diagnosis, prevention and treatment of diseases and clinical conditions associated with PTPN4.

Protein tyrosine phosphatase, non-receptor type 6 (PTPN6, Accession NP_536859.1) is another GAM94 target gene, herein designated TARGET GENE. PTPN6 BINDING SITE is a target binding site found in the 3' untranslated region of multiple transcripts of mRNA encoded by PTPN6, corresponding to a target binding site such as BINDING SITE I, BINDING SITE II or BINDING SITE III of FIG. 8. Table 4 illustrates the complementarity of the nucleotide sequences of PTPN6 BINDING SITE, designated SEQ ID:5903, to the nucleotide sequence of GAM94 RNA, herein designated GAM RNA, also designated SEQ ID:332.

Another function of GAM94 is therefore inhibition of Protein tyrosine phosphatase, non-receptor type 6 (PTPN6, Accession NP_536859.1), a gene which plays a key role in hematopoiesis and therefore may be associated with Leukemia. Accordingly, utilities of GAM94 include diagnosis, prevention and treatment of Leukemia, and of other diseases and clinical conditions associated with PTPN6.

The function of PTPN6 has been established by previous studies. The growth and functional responses of hematopoietic cells are regulated through tyrosine phosphorylation of proteins. Using a PCR approach, Yi et al. (1991) identified 3 novel tyrosine protein phosphatases in hematopoietic cells. One of these, expressed predominantly in hematopoietic cells, was termed hematopoietic cell phosphatase (HCPH). From a pre-B-cell-derived library, Matthews et al. (1992) cloned the mouse PTPN6 cDNA, which they designated SHP (Src homology region 2-domain phosphatase). Yi et al. (1992) obtained complete cDNAs for both the human and the murine HCPH and mapped the gene in the human to 12p13-p12 by fluorescence in situ hybridization. The human gene was also cloned from a breast cancer cell line and was termed PTP1C by Shen et al. (1991). This is a cytoplasmic protein that contains a phosphatase-catalytic domain in the carboxyl terminal region and 2 tandemly repeated, src-homology 2 (SH2) domains in the amino terminal region. SH2 domains were first identified in the SRC gene family and found in a variety of proteins involved in signal transduction. The SH2 domains may recognize phosphorylated tyrosine residues and direct protein-protein associations. By study of panels of somatic cell hybrids and fluorescence in situ hybridization, Plutzky et al. (1992) determined that the gene encoding the nontransmembrane protein-tyrosine phosphatase of the nonreceptor type 6 is located in region 12p13. Plutzky et al. (1992) suggested that since PTPN6 is expressed at high levels in hematopoietic cells of all lineages and its expression is induced early in hematopoietic differentiation, and since 12p13 is a region commonly involved in leukemia-associated chromosomal abnormalities, altered expression and/or structure of PTPN6 may play a role in leukemogenesis. Using a genomic probe in interspecific backcross analysis, Yi et al. (1992) mapped the murine Hcph gene to chromosome 6 where it was found to be tightly linked to the Tnfr-2 and Ly-4 genes. Mice with the recessive 'moth eaten' (me) or the allelic 'viable moth eaten' mutations express a severe autoimmune and immunodeficiency syndrome. Tsui et al. (1993) showed that the basic defect involves lesions in the gene that encodes hematopoietic cell phosphatase. Shultz et al. (1993) showed that 2 allelic 'motheaten' mutations result in aberrant splicing of the Hcph transcript. Thus, 'motheaten' was the first animal model for a specific protein-tyrosine phosphatase deficiency, useful in determining the precise role of HCPH in hematopoiesis. Banville et al. (1995) demonstrated that the PTPN6 gene consists of 17 exons spanning 17 kb of DNA. Three nonhematopoietic PTPN6 transcripts were identified in a variety of cell lines and were shown to be transcribed from a common promoter. The hematopoietic form of the PTPN6 transcript is initiated at a downstream promoter separated by 7 kb from the upstream promoter. This downstream promoter is active exclusively in cells of the hematopoietic lineage.

Full details of the abovementioned studies are described in the following publications, the disclosure of which are hereby incorporated by reference:

Plutzky, J.; Neel, B. G.; Rosenberg, R. D.; Eddy, R. L.; Byers, M. G.; Jani-Sait, S.; Shows, T. B.: Chromosomal localization of an SH2-containing tyrosine phosphatase (PTPN6). Genomics 13:869-872, 1992; and Tsui, H. W.; Siminovitch, K. A.; de Souza, L.; Tsui, F. W. L.: Motheaten and viable motheaten mice have mutations in the haematopoietic cell phosphatase gene. Nature Genet. 4:124-129, 199.

Further studies establishing the function and utilities of PTPN6 are found in John Hopkins OMIM database record ID 176883, and in cited publications listed in Table 5, which are hereby incorporated by reference. Pumilio homolog 2 (drosophila) (PUM2, Accession NP_056132.1) is another GAM94 target gene, herein designated TARGET GENE. PUM2 BINDING SITE is a target binding site found in the 3' untranslated region of mRNA encoded by PUM2, corresponding to a target binding site such as BINDING SITE I, BINDING SITE II or BINDING SITE III of FIG. 8. Table 4 illustrates the complementarity of the nucleotide sequences of PUM2 BINDING SITE, designated SEQ ID:2095, to the nucleotide sequence of GAM94 RNA, herein designated GAM RNA, also designated SEQ ID:332.

Another function of GAM94 is therefore inhibition of Pumilio homolog 2 (drosophila) (PUM2, Accession NP_056132.1). Accordingly, utilities of GAM94 include diagnosis, prevention and treatment of diseases and clinical conditions associated with PUM2.

Pwp2 periodic tryptophan protein homolog (yeast) (PWP2H, Accession NP_005040.1) is another GAM94 target gene, herein designated TARGET GENE. PWP2H BINDING SITE is a target binding site found in the 3' untranslated region of mRNA encoded by PWP2H, corresponding to a target binding site such as BINDING SITE I, BINDING SITE II or BINDING SITE III of FIG. 8. Table 4 illustrates the complementarity of the nucleotide sequences of PWP2H BINDING SITE, designated SEQ ID:17316, to the nucleotide sequence of GAM94 RNA, herein designated GAM RNA, also designated SEQ ID:332.

Another function of GAM94 is therefore inhibition of Pwp2 periodic tryptophan protein homolog (yeast) (PWP2H, Accession NP_005040.1), a gene which is a member of the beta transducin protein superfamily and therefore may be associated with Holoprosencephaly-1 (hpe1). Accordingly, utilities of GAM94 include diagnosis, prevention and treatment of Holoprosencephaly-1 (hpe1), and of other diseases and clinical conditions associated with PWP2H.

The function of PWP2H has been established by previous studies. As part of a study to identify genes that might be implicated in Down syndrome, Lalioti et al. (1996) used exon trapping from cosmids that had been mapped to 21q22.3. An exon was isolated that encoded a predicted protein which was similar to the yeast PWP2 gene, a member of the tryptophan-aspartate (WD) repeat-containing superfamily. PWP2 is essential for viability and may play a role in the early G1 phase of the cell cycle. The complete coding region of human PWP2, obtained from fetal brain and fetal kidney cDNA libraries, encodes a 919-amino acid predicted protein with over 40% identity to the yeast protein. It also shares similarity to the beta subunits of the trimeric G-protein family (e.g., 139380). The protein contains 5 complete WD repeats and an acidic domain between the second and third WD motifs. Northern blots showed a 3.4-kb PWP2 mRNA in all fetal and adult tissues examined. Based on cosmid contig analysis, the gene was mapped approximately 200 kb proximal to PFKL (OMIM Ref. No. 171860). To identify candidate genes for diseases mapping to 21q22.3, Lafreniere et al. (1996) assembled a 770-kb cosmid and a BAC contig containing 8 tightly linked markers. They then restriction mapped these cosmids and BACs using 8 rare cutting enzymes, with the goal of identifying CpG-rich islands. A homology search using the sequence from one such island identified an expressed sequence tag (EST) with homology to PWP2 of yeast. Northern blot analysis revealed a 3.3- kb transcript that was highly expressed in all tissues tested. A 3,157-bp cDNA contained an open reading frame potentially encoding 919 amino acid residues. The predicted protein shows 42% identity and 57% similarity at the amino acid level to the yeast PWP2 protein. The PWP gene is split into 21 exons, ranging in size from 53 to 516 bp, and spans an estimated 25 kb. The gene is transcribed in a 21cen- to -21qter direction, with its 5-prime end mapping approximately 195 kb proximal to the 5- prime end of the PFKL gene. Lafreniere et al. (1996) suggested that this gene is a candidate for the site of the mutation causing holoprosencephaly-1 (HPE1; 236100).

Full details of the abovementioned studies are described in the following publications, the disclosure of which are hereby incorporated by reference:

Lafreniere, R. G.; Rochefort, D. L.; Chretien, N.; Neville, C. E.; Korneluk, R. G.; Zuo, L.; Wei, Y.; Lichter, J.; Rouleau, G. A.: Isolation and genomic structure of a human homolog of the yeast periodic tryptophan protein 2 (PWP2) gene mapping to 21q22.3. Genome Res. 6:1216-1226, 1996; and Lalioti, M. D.; Chen, H.; Rossier, C.; Shafaatian, R.; Reid, J. D.; Antonarakis, S. E.: Cloning the cDNA of human PWP2, which encodes a protein with WD repeats and maps to 21q22.3. Geno.

Further studies establishing the function and utilities of PWP2H are found in John Hopkins OMIM database record ID 601475, and in cited publications listed in Table 5, which are hereby incorporated by reference. QKI (Accession XP_037438.4) is another GAM94 target gene, herein designated TARGET GENE. QKI BINDING SITE is a target binding site found in the 5' untranslated region of mRNA encoded by QKI, corresponding to a target binding site such as BINDING SITE I, BINDING SITE II or BINDING SITE III of FIG. 8. Table 4 illustrates the complementarity of the nucleotide sequences of QKI BINDING SITE, designated SEQ ID:15541, to the nucleotide sequence of GAM94 RNA, herein designated GAM RNA, also designated SEQ ID:332.

Another function of GAM94 is therefore inhibition of QKI (Accession XP_037438.4). Accordingly, utilities of GAM94 include diagnosis, prevention and treatment of diseases and clinical conditions associated with QKI.

Rab11-FIP3 (Accession NP_055515.1) is another GAM94 target gene, herein designated TARGET GENE. Rab11-FIP3 BINDING SITE is a target binding site found in the 3' untranslated region of mRNA encoded by Rab11-FIP3, corresponding to a target binding site such as BINDING SITE I, BINDING SITE II or BINDING SITE III of FIG. 8. Table 4 illustrates the complementarity of the nucleotide sequences of Rab11-FIP3 BINDING SITE, designated SEQ ID:5368, to the nucleotide sequence of GAM94 RNA, herein designated GAM RNA, also designated SEQ ID:332.

Another function of GAM94 is therefore inhibition of Rab11-FIP3 (Accession NP_055515.1). Accordingly, utilities of GAM94 include diagnosis, prevention and treatment of diseases and clinical conditions associated with Rab11-FIP3.

Rab13, member ras oncogene family (RAB13, Accession NP_002861.1) is another GAM94 target gene, herein designated TARGET GENE. RAB13 BINDING SITE is a target binding site found in the 3' untranslated region of mRNA encoded by RAB13, corresponding to a target binding site such as BINDING SITE I, BINDING SITE II or BINDING SITE III of FIG. 8. Table 4 illustrates the complementarity of the nucleotide sequences of RAB13 BINDING SITE, designated SEQ ID:19823, to the nucleotide sequence of GAM94 RNA, herein designated GAM RNA, also designated SEQ ID:332.

Another function of GAM94 is therefore inhibition of Rab13, member ras oncogene family (RAB13, Accession NP_002861.1), a gene which is a member of the RAB family of small GTPases. Accordingly, utilities of GAM94 include diagnosis, prevention and treatment of diseases and clinical conditions associated with RAB13.

The function of RAB13 has been established by previous studies. The Rab proteins comprise the largest group of Ras-associated small GTPases and in mammalian cells at least 40 proteins have been identified (Novick and Zerial, 1997). Rab proteins are specific regulators of vesicular traffic and the complexity of the Rab protein family correlates with the diversity of cellular vesicle transport routes. A different Rab protein may be required for each step of vesicular transport. For example, the yeast Sec4 protein appears to be required exclusively for the delivery of Golgi-derived secretory vesicles to the plasma membrane (Salminen and Novick, 1987). By screening a human intestinal epithelial cell (OMIM Ref. No. Caco- 2) cDNA library with a degenerate oligonucleotide based on a sequence present in the effector domain of the Sec4 protein, Zahraoui et al. (1994) isolated a cDNA encoding RAB13. The predicted 203-amino acid protein has the typical structural features of Ras-related proteins, including a conserved GTP-binding site. RAB13 displays 61% and 56% amino acid identity with the human RAB8 (OMIM Ref. No. 165040) and yeast Sec4 proteins, respectively. These proteins share a long conserved N-terminal region but have divergent C-terminal portions. Northern blot analysis showed that RAB13 is expressed as a 1.2-kb transcript in Caco-2 cells. Immunoblot analysis using antibodies against RAB13 detected a 24-kD protein in Caco-2 cell lysates. Immunofluorescence studies demonstrated that RAB13 colocalizes with the tight junction marker ZO1 (TJP1; 601009) in epithelial cells. In cells devoid of tight junctions, RAB13 associates with vesicles dispersed throughout the cytoplasm. Leek et al. (1997) mapped the RAB13 gene to 12q13 by in situ hybridization.

Full details of the abovementioned studies are described in the following publications, the disclosure of which are hereby incorporated by reference:

Leek, J. P.; Hamlin, P. J.; Wilton, J.; Lench, N. J.: Assignment of the Rab13 gene (RAB13) to human chromosome band 12q13 by in situ hybridization. Cytogenet. Cell Genet. 79:210-211, 1997; and Novick, P.; Zerial, M.: The diversity of Rab proteins in vesicle transport. Curr. Opin. Cell Biol. 9:496-504, 1997.

Further studies establishing the function and utilities of RAB13 are found in John Hopkins OMIM database record ID 602672, and in cited publications listed in Table 5, which are hereby incorporated by reference. Rab17, member ras oncogene family (RAB17, Accession NP_071894.1) is another GAM94 target gene, herein designated TARGET GENE. RAB17 BINDING SITE is a target binding site found in the 5' untranslated region of mRNA encoded by RAB17, corresponding to a target binding site such as BINDING SITE I, BINDING SITE II or BINDING SITE III of FIG. 8. Table 4 illustrates the complementarity of the nucleotide sequences of RAB17 BINDING SITE, designated SEQ ID:18736, to the nucleotide sequence of GAM94 RNA, herein designated GAM RNA, also designated SEQ ID:332.

Another function of GAM94 is therefore inhibition of Rab17, member ras oncogene family (RAB17, Accession NP_071894.1). Accordingly, utilities of GAM94 include diagnosis, prevention and treatment of diseases and clinical conditions associated with RAB17.

Rab5a, member ras oncogene family (RAB5A, Accession NP_004153.2) is another GAM94 target gene, herein designated TARGET GENE. RAB5A BINDING SITE is a target binding site found in the 5' untranslated region of mRNA encoded by RAB5A, corresponding to a target binding site such as BINDING SITE I, BINDING SITE II or BINDING SITE III of FIG. 8. Table 4 illustrates the complementarity of the nucleotide sequences of RAB5A BINDING SITE, designated SEQ ID:18284, to the nucleotide sequence of GAM94 RNA, herein designated GAM RNA, also designated SEQ ID:332.

Another function of GAM94 is therefore inhibition of Rab5a, member ras oncogene family (RAB5A, Accession NP_004153.2), a gene which is a rate-limiting component of the machinery regulating the kinetics of membrane traffic.

Accordingly, utilities of GAM94 include diagnosis, prevention and treatment of diseases and clinical conditions associated with RAB5A.

The function of RAB5A has been established by previous studies. The S. cerevisiae YPT1 and SEC4 genes encode Ras-related GTP-binding proteins involved in the regulation of secretion. Mammalian cells express a large number of RAB proteins, GTP-binding proteins closely related to YPT1 and SEC4. By screening a human pheochromocytoma library with probes derived from the SEC4 gene and from various rat and human RAB cDNAs, Zahraoui et al. (1989) isolated cDNAs encoding RAB1 (OMIM Ref. No. 179508), RAB2 (OMIM Ref. No. 179509), RAB3A (OMIM Ref. No. 179490), RAB3B (OMIM Ref. No. 179510), RAB4 (OMIM Ref. No. 179511), RAB5, and RAB6 (OMIM Ref. No. 179513). Except for the closely related RAB3A and RAB3B, the deduced human RAB proteins share 32 to 50% homology. The predicted 214-amino acid RAB5 protein is 31% and 38% identical to SEC4 and YPT1, respectively. All 6 human RAB proteins tested bound GTP and exhibited GTPase activities in vitro. Northern blot analysis revealed that RAB5 was expressed as 2.7- and 2.8-kb mRNAs in a human fibroblast cell line. Bucci et al. (1992) demonstrated that RAB5 is a rate-limiting component of the machinery regulating the kinetics of membrane traffic in the early endocytic pathway. Stenmark et al. (1995) reported that rabaptin-5 (OMIM Ref. No. 603616) is an effector of RAB5 that transmits the signal of the active GTP-bound RAB5 conformation to the membrane docking and/or fusion apparatus. Xiao et al. (1997) found that tuberin (OMIM Ref. No. 191092) exhibits substantial GTPase-activating protein (GAP) activity towards RAB5, and that rabaptin-5 mediates the tuberin association with RAB5. The authors suggested that tuberin functions as a RAB5GAP in vivo to negatively regulate RAB5-GTP activity in endocytosis.

Full details of the abovementioned studies are described in the following publications, the disclosure of which are hereby incorporated by reference:

Bucci, C.; Parton, R. G.; Mather, I. H.; Stunnenberg, H.; Simons, K.; Hoflack, B.; Zerial, M.: The small GTPase rab5 functions as a regulatory factor in the early endocytic pathway. Cell 70:715-728, 1992; and Xiao, G.-H.; Shoarinejad, F.; Jin, F.; Golemis, E. A.; Yeung, R. S.: The tuberous sclerosis 2 gene product, tuberin, functions as a Rab5 GTPase activating protein (GAP) in modulating en.

Further studies establishing the function and utilities of RAB5A are found in John Hopkins OMIM database record ID 179512, and in cited publications listed in Table 5, which are hereby incorporated by reference. RAD54B (Accession NP_602310.1) is another GAM94 target gene, herein designated TARGET GENE. RAD54B BINDING SITE is a target binding site found in the 3' untranslated region of multiple transcripts of mRNA encoded by RAD54B, corresponding to a target binding site such as BINDING SITE I, BINDING SITE II or BINDING SITE III of FIG. 8. Table 4 illustrates the complementarity of the nucleotide sequences of RAD54B BINDING SITE, designated SEQ ID:8649, to the nucleotide sequence of GAM94 RNA, herein designated GAM RNA, also designated SEQ ID:332.

Another function of GAM94 is therefore inhibition of RAD54B (Accession NP_602310.1), a gene which is involved in dna repair and mitotic recombination and therefore may be associated with Lymphoma and colon cancer. Accordingly, utilities of GAM94 include diagnosis, prevention and treatment of Lymphoma and colon cancer, and of other diseases and clinical conditions associated with RAD54B.

The function of RAD54B and its association with various diseases and clinical conditions, has been established by previous studies, as described hereinabove with reference to GAM55.2. RAGB (Accession NP_057740.1) is another GAM94 target gene, herein designated TARGET GENE. RAGB BINDING SITE is a target binding site found in the 5' untranslated region of multiple transcripts of mRNA encoded by RAGB, corresponding to a target binding site such as BINDING SITE I, BINDING SITE II or BINDING SITE III of FIG. 8. Table 4 illustrates the complementarity of the nucleotide sequences of RAGB BINDING SITE, designated SEQ ID:16756, to the nucleotide sequence of GAM94 RNA, herein designated GAM RNA, also designated SEQ ID:332.

Another function of GAM94 is therefore inhibition of RAGB (Accession NP_057740.1). Accordingly, utilities of GAM94 include diagnosis, prevention and treatment of diseases and clinical conditions associated with RAGB.

RAGB (Accession NP_006055.2) is another GAM94 target gene, herein designated TARGET GENE. RAGB BINDING SITE is a target binding site found in the 5' untranslated region of multiple transcripts of mRNA encoded by RAGB, corresponding to a target binding site such as BINDING SITE I, BINDING SITE II or BINDING SITE III of FIG. 8. Table 4 illustrates the complementarity of the nucleotide sequences of RAGB BINDING SITE, designated SEQ ID:16756, to the nucleotide sequence of GAM94 RNA, herein designated GAM RNA, also designated SEQ ID:332.

Another function of GAM94 is therefore inhibition of RAGB (Accession NP_006055.2). Accordingly, utilities of GAM94 include diagnosis, prevention and treatment of diseases and clinical conditions associated with RAGB.

Ras association (ralgds/af-6) domain family 2 (RASSF2, Accession NP_739579.1) is another GAM94 target gene, herein designated TARGET GENE. RASSF2 BINDING SITE is a target binding site found in the 5' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:16451, to the nucleotide sequence of GAM94 RNA, herein designated GAM RNA, also designated SEQ ID:332.

Another function of GAM94 is therefore inhibition of Ras association (ralgds/af-6) domain family 2 (RASSF2, Accession NP_739579.1). Accordingly, utilities of GAM94 include diagnosis, prevention and treatment of diseases and clinical conditions associated with RASSF2.

Retinoblastoma-like 1 (p107) (RBL1, Accession NP_002886.1) is another GAM94 target gene, herein designated TARGET GENE. RBL1 BINDING SITE is a target binding site found in the 5' untranslated region of mRNA encoded by RBL1, corresponding to a target binding site such as BINDING SITE I, BINDING SITE II or BINDING SITE III of FIG. 8. Table 4 illustrates the complementarity of the nucleotide sequences of RBL1 BINDING SITE, designated SEQ ID:15482, to the nucleotide sequence of GAM94 RNA, herein designated GAM RNA, also designated SEQ ID:332.

Another function of GAM94 is therefore inhibition of Retinoblastoma-like 1 (p107) (RBL1, Accession NP_002886.1), a gene which has an important role in negatively regulating the rate of progression of the cell cycle. Accordingly, utilities of GAM94 include diagnosis, prevention and treatment of diseases and clinical conditions associated with RBL1.

The function of RBL1 and its association with various diseases and clinical conditions, has been established by previous studies, as described hereinabove with reference to GAM72.1. Rna binding motif protein 9 (RBM9, Accession NP_055124.1) is another GAM94 target gene, herein designated TARGET GENE. RBM9 BINDING SITE is a target binding site found in the 3' untranslated region of mRNA encoded by RBM9, corresponding to a target binding site such as BINDING SITE I, BINDING SITE II or BINDING SITE III of FIG. 8. Table 4 illustrates the complementarity of the nucleotide sequences of RBM9 BINDING SITE, designated SEQ ID:13123, to the nucleotide sequence of GAM94 RNA, herein designated GAM RNA, also designated SEQ ID:332.

Another function of GAM94 is therefore inhibition of Rna binding motif protein 9 (RBM9, Accession NP_055124.1). Accordingly, utilities of GAM94 include diagnosis, prevention and treatment of diseases and clinical conditions associated with RBM9.

RIL (Accession NP_003678.2) is another GAM94 target gene, herein designated TARGET GENE. RIL BINDING SITE is a target binding site found in the 3' untranslated region of mRNA encoded by RIL, corresponding to a target binding site such as BINDING SITE I, BINDING SITE II or BINDING SITE III of FIG. 8. Table 4 illustrates the complementarity of the nucleotide sequences of RIL BINDING SITE, designated SEQ ID:16498, to the nucleotide sequence of GAM94 RNA, herein designated GAM RNA, also designated SEQ ID:332.

Another function of GAM94 is therefore inhibition of RIL (Accession NP_003678.2). Accordingly, utilities of GAM94 include diagnosis, prevention and treatment of diseases and clinical conditions associated with RIL.

Rar-related orphan receptor a (RORA, Accession NP_002934.1) is another GAM94 target gene, herein designated TARGET GENE. RORA BINDING SITE is a target binding site found in the 3' untranslated region of multiple transcripts of mRNA encoded by RORA, corresponding to a target binding site such as BINDING SITE I, BINDING SITE II or BINDING SITE III of FIG. 8. Table 4 illustrates the complementarity of the nucleotide sequences of RORA BINDING SITE, designated SEQ ID:6954, to the nucleotide sequence of GAM94 RNA, herein designated GAM RNA, also designated SEQ ID:332.

Another function of GAM94 is therefore inhibition of Rar-related orphan receptor a (RORA, Accession NP_002934.1), a gene which binds dna as a monomer to hormone response elements (hre) containing a single core motif half-site preceded by a short a-t rich sequences. Accordingly, utilities of GAM94 include diagnosis, prevention and treatment of diseases and clinical conditions associated with RORA.

The function of RORA has been established by previous studies. Meyer et al. (2000) showed that the RORA gene and the RORC (OMIM Ref. No. 602943) gene, but not the RORB gene, are expressed in mesenchymal stem cells derived from bone marrow. Cells undergoing osteogenic differentiation showed increased messenger signal expression. They found that homozygous 'staggerer' mutants have thin long bones compared with heterozygous animals and wildtype littermates and that the bones of sg/sg animals are osteopenic. They concluded that the product of the Rora gene most likely acts by direct modulation of a bone matrix component Animal model experiments lend further support to the function of RORA. The recessive mouse mutation 'staggerer' (sg) is associated with severe cerebellar ataxia due to a cell-autonomous defect in the development of Purkinje cells. These cells are reduced in numbers and show immature morphology, synaptic arrangement, biochemical properties, and gene expression. In addition, sg heterozygotes show accelerated dendritic atrophy and cell loss, suggesting that sg has a role in mature Purkinje cells. Certain functions of the immune system are also affected. Hamilton et al. (1996) mapped sg to a 160-kb interval on mouse chromosome 9 that was found to contain the gene encoding Rora, a member of the nuclear hormone receptor superfamily. Furthermore, sg mice were found to carry a deletion within the Rora gene that prevents translation of the ligand-binding homology domain. Based on these results, they proposed a model in which Rora interacts with the thyroid hormone signaling pathway to induce Purkinje cell maturation. Of the 4 different isoforms of the Rora gene that are generated by a combination of alternative promoter usage and exon splicing and that differ in their DNA-binding properties, Matysiak-Scholze and Nehls (1997) found that isoforms Rora1 and Rora4 are specifically coexpressed in the murine cerebellum and human cerebellum. Thus, at least 2 isoforms of the murine Rora gene are affected by the genomic deletion associated with the sg phenotype. The finding of cerebellum-specific coregulation of Rora1 and Rora4 suggested that distinct sets of target genes regulated by the Rora1 and Rora4 isoforms are required for Purkinje cell development It is appreciated that the abovementioned animal model for RORA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Meyer, T.; Kneissel, M.; Mariani, J.; Fournier, B.: In vitro and in vivo evidence for orphan nuclear receptor ROR-alpha function in bone metabolism. Proc. Nat. Acad. Sci. 97:9197-9202, 2000; and Matysiak-Scholze, U.; Nehls, M.: The structural integrity of ROR-alpha isoforms is mutated in staggerer mice: cerebellar coexpression of ROR-alpha-1 and ROR-alpha-4. Genomics 43:78-84, 1.

Further studies establishing the function and utilities of RORA are found in John Hopkins OMIM database record ID 600825, and in cited publications listed in Table 5, which are hereby incorporated by reference. Rar-related orphan receptor a (RORA, Accession NP_599023.1) is another GAM94 target gene, herein designated TARGET GENE. RORA BINDING SITE is a target binding site found in the 3' untranslated region of multiple transcripts of mRNA encoded by RORA, corresponding to a target binding site such as BINDING SITE I, BINDING SITE II or BINDING SITE III of FIG. 8. Table 4 illustrates the complementarity of the nucleotide sequences of RORA BINDING SITE, designated SEQ ID:6954, to the nucleotide sequence of GAM94 RNA, herein designated GAM RNA, also designated SEQ ID:332.

Another function of GAM94 is therefore inhibition of Rar-related orphan receptor a (RORA, Accession NP_599023.1), a gene which binds dna as a monomer to hormone response elements (hre) containing a single core motif half-site preceded by a short a-t rich sequences. Accordingly, utilities of GAM94 include diagnosis, prevention and treatment of diseases and clinical conditions associated with RORA.

The function of RORA has been established by previous studies. Meyer et al. (2000) showed that the RORA gene and the RORC (OMIM Ref. No. 602943) gene, but not the RORB gene, are expressed in mesenchymal stem cells derived from bone marrow. Cells undergoing osteogenic differentiation showed increased messenger signal expression. They found that homozygous 'staggerer' mutants have thin long bones compared with heterozygous animals and wildtype littermates and that the bones of sg/sg animals are osteopenic. They concluded that the product of the Rora gene most likely acts by direct modulation of a bone matrix component Animal model experiments lend further support to the function of RORA. The recessive mouse mutation 'staggerer' (sg) is associated with severe cerebellar ataxia due to a cell-autonomous defect in the development of Purkinje cells. These cells are reduced in numbers and show immature morphology, synaptic arrangement, biochemical properties, and gene expression. In addition, sg heterozygotes show accelerated dendritic atrophy and cell loss, suggesting that sg has a role in mature Purkinje cells. Certain functions of the immune system are also affected. Hamilton et al. (1996) mapped sg to a 160-kb interval on mouse chromosome 9 that was found to contain the gene encoding Rora, a member of the nuclear hormone receptor superfamily. Furthermore, sg mice were found to carry a deletion within the Rora gene that prevents translation of the ligand-binding homology domain. Based on these results, they proposed a model in which Rora interacts with the thyroid hormone signaling pathway to induce Purkinje cell maturation. Of the 4 different isoforms of the Rora gene that are generated by a combination of alternative promoter usage and exon splicing and that differ in their DNA-binding properties, Matysiak-Scholze and Nehls (1997) found that isoforms Rora1 and Rora4 are specifically coexpressed in the murine cerebellum and human cerebellum. Thus, at least 2 isoforms of the murine Rora gene are affected by the genomic deletion associated with the sg phenotype. The finding of cerebellum-specific coregulation of Rora1 and Rora4 suggested that distinct sets of target genes regulated by the Rora1 and Rora4 isoforms are required for Purkinje cell development It is appreciated that the abovementioned animal model for RORA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Meyer, T.; Kneissel, M.; Mariani, J.; Fournier, B.: In vitro and in vivo evidence for orphan nuclear receptor ROR-alpha function in bone metabolism. Proc. Nat. Acad. Sci. 97:9197-9202, 2000; and Matysiak-Scholze, U.; Nehls, M.: The structural integrity of ROR-alpha isoforms is mutated in staggerer mice: cerebellar coexpression of ROR-alpha-1 and ROR-alpha-4. Genomics 43:78-84, 1.

Further studies establishing the function and utilities of RORA are found in John Hopkins OMIM database record ID 600825, and in cited publications listed in Table 5, which are hereby incorporated by reference. Rar-related orphan receptor a (RORA, Accession NP_599024.1) is another GAM94 target gene, herein designated TARGET GENE. RORA BINDING SITE is a target binding site found in the 3' untranslated region of multiple transcripts of mRNA encoded by RORA, corresponding to a target binding site such as BINDING SITE I, BINDING SITE II or BINDING SITE III of FIG. 8. Table 4 illustrates the complementarity of the nucleotide sequences of RORA BINDING SITE, designated SEQ ID:6954, to the nucleotide sequence of GAM94 RNA, herein designated GAM RNA, also designated SEQ ID:332.

Another function of GAM94 is therefore inhibition of Rar-related orphan receptor a (RORA, Accession NP_599024.1), a gene which binds dna as a monomer to hormone response elements (hre) containing a single core motif half-site preceded by a short a-t rich sequences. Accordingly, utilities of GAM94 include diagnosis, prevention and treatment of diseases and clinical conditions associated with RORA.

The function of RORA has been established by previous studies. Meyer et al. (2000) showed that the RORA gene and the RORC (OMIM Ref. No. 602943) gene, but not the RORB gene, are expressed in mesenchymal stem cells derived from bone marrow. Cells undergoing osteogenic differentiation showed increased messenger signal expression. They found that homozygous 'staggerer' mutants have thin long bones compared with heterozygous animals and wildtype littermates and that the bones of sg/sg animals are osteopenic. They concluded that the product of the Rora gene most likely acts by direct modulation of a bone matrix component Animal model experiments lend further support to the function of RORA. The recessive mouse mutation 'staggerer' (sg) is associated with severe cerebellar ataxia due to a cell-autonomous defect in the development of Purkinje cells. These cells are reduced in numbers and show immature morphology, synaptic arrangement, biochemical properties, and gene expression. In addition, sg heterozygotes show accelerated dendritic atrophy and cell loss, suggesting that sg has a role in mature Purkinje cells. Certain functions of the immune system are also affected. Hamilton et al. (1996) mapped sg to a 160-kb interval on mouse chromosome 9 that was found to contain the gene encoding Rora, a member of the nuclear hormone receptor superfamily. Furthermore, sg mice were found to carry a deletion within the Rora gene that prevents translation of the ligand-binding homology domain. Based on these results, they proposed a model in which Rora interacts with the thyroid hormone signaling pathway to induce Purkinje cell maturation. Of the 4 different isoforms of the Rora gene that are generated by a combination of alternative promoter usage and exon splicing and that differ in their DNA-binding properties, Matysiak-Scholze and Nehls (1997) found that isoforms Rora1 and Rora4 are specifically coexpressed in the murine cerebellum and human cerebellum. Thus, at least 2 isoforms of the murine Rora gene are affected by the genomic deletion associated with the sg phenotype. The finding of cerebellum-specific coregulation of Rora1 and Rora4 suggested that distinct sets of target genes regulated by the Rora1 and Rora4 isoforms are required for Purkinje cell development It is appreciated that the abovementioned animal model for RORA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Meyer, T.; Kneissel, M.; Mariani, J.; Fournier, B.: In vitro and in vivo evidence for orphan nuclear receptor ROR-alpha function in bone metabolism. Proc. Nat. Acad. Sci. 97:9197-9202, 2000; and Matysiak-Scholze, U.; Nehls, M.: The structural integrity of ROR-alpha isoforms is mutated in staggerer mice: cerebellar coexpression of ROR-alpha-1 and ROR-alpha-4. Genomics 43:78-84, 1.

Further studies establishing the function and utilities of RORA are found in John Hopkins OMIM database record ID 600825, and in cited publications listed in Table 5, which are hereby incorporated by reference. Rar-related orphan receptor a (RORA, Accession NP_599022.1) is another GAM94 target gene, herein designated TARGET GENE. RORA BINDING SITE is a target binding site found in the 3' untranslated region of multiple transcripts of mRNA encoded by RORA, corresponding to a target binding site such as BINDING SITE I, BINDING SITE II or BINDING SITE III of FIG. 8. Table 4 illustrates the complementarity of the nucleotide sequences of RORA BINDING SITE, designated SEQ ID:6954, to the nucleotide sequence of GAM94 RNA, herein designated GAM RNA, also designated SEQ ID:332.

Another function of GAM94 is therefore inhibition of Rar-related orphan receptor a (RORA, Accession NP_599022.1), a gene which binds dna as a monomer to hormone response elements (hre) containing a single core motif half-site preceded by a short a-t rich sequences. Accordingly, utilities of GAM94 include diagnosis, prevention and treatment of diseases and clinical conditions associated with RORA.

The function of RORA has been established by previous studies. Meyer et al. (2000) showed that the RORA gene and the RORC (OMIM Ref. No. 602943) gene, but not the RORB gene, are expressed in mesenchymal stem cells derived from bone marrow. Cells undergoing osteogenic differentiation showed increased messenger signal expression. They found that homozygous 'staggerer' mutants have thin long bones compared with heterozygous animals and wildtype littermates and that the bones of sg/sg animals are osteopenic. They concluded that the product of the Rora gene most likely acts by direct modulation of a bone matrix component Animal model experiments lend further support to the function of RORA. The recessive mouse mutation 'staggerer' (sg) is associated with severe cerebellar ataxia due to a cell-autonomous defect in the development of Purkinje cells. These cells are reduced in numbers and show immature morphology, synaptic arrangement, biochemical properties, and gene expression. In addition, sg heterozygotes show accelerated dendritic atrophy and cell loss, suggesting that sg has a role in mature Purkinje cells. Hamilton et al. (1996) mapped sg to a 160-kb interval on mouse chromosome 9 that was found to contain the gene encoding Rora, a member of the nuclear hormone receptor superfamily. Furthermore, sg mice were found to carry a deletion within the Rora gene that prevents translation of the ligand-binding homology domain. Based on these results, they proposed a model in which Rora interacts with the thyroid hormone signaling pathway to induce Purkinje cell maturation. Of the 4 different isoforms of the Rora gene that are generated by a combination of alternative promoter usage and exon splicing and that differ in their DNA-binding properties, Matysiak-Scholze and Nehls (1997) found that isoforms Rora1 and Rora4 are specifically coexpressed in the murine cerebellum and human cerebellum. Thus, at least 2 isoforms of the murine Rora gene are affected by the genomic deletion associated with the sg phenotype. The finding of cerebellum-specific coregulation of Rora1 and Rora4 suggested that distinct sets of target genes regulated by the Rora1 and Rora4 isoforms are required for Purkinje cell development It is appreciated that the abovementioned animal model for RORA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Meyer, T.; Kneissel, M.; Mariani, J.; Fournier, B.: In vitro and in vivo evidence for orphan nuclear receptor ROR-alpha function in bone metabolism. Proc. Nat. Acad. Sci. 97:9197-9202, 2000; and Matysiak-Scholze, U.; Nehls, M.: The structural integrity of ROR-alpha isoforms is mutated in staggerer mice: cerebellar coexpression of ROR-alpha-1 and ROR-alpha-4. Genomics 43:78-84, 1.

Further studies establishing the function and utilities of RORA are found in John Hopkins OMIM database record ID 600825, and in cited publications listed in Table 5, which are hereby incorporated by reference. Replication protein a2, 32 kda (RPA2, Accession NP_002937.1) is another GAM94 target gene, herein designated TARGET GENE. RPA2 BINDING SITE is a target binding site found in the 5' untranslated region of mRNA encoded by RPA2, corresponding to a target binding site such as BINDING SITE I, BINDING SITE II or BINDING SITE III of FIG. 8. Table 4 illustrates the complementarity of the nucleotide sequences of RPA2 BINDING SITE, designated SEQ ID:595, to the nucleotide sequence of GAM94 RNA, herein designated GAM RNA, also designated SEQ ID:332.

Another function of GAM94 is therefore inhibition of Replication protein a2, 32 kda (RPA2, Accession NP_002937.1). Accordingly, utilities of GAM94 include diagnosis, prevention and treatment of diseases and clinical conditions associated with RPA2.

Ribosomal protein l22 (RPL22, Accession NP_000974.1) is another GAM94 target gene, herein designated TARGET GENE. RPL22 BINDING SITE is a target binding site found in the 3' untranslated region of mRNA encoded by RPL22, corresponding to a target binding site such as BINDING SITE I, BINDING SITE II or BINDING SITE III of FIG. 8. Table 4 illustrates the complementarity of the nucleotide sequences of RPL22 BINDING SITE, designated SEQ ID:16388, to the nucleotide sequence of GAM94 RNA, herein designated GAM RNA, also designated SEQ ID:332.

Another function of GAM94 is therefore inhibition of Ribosomal protein l22 (RPL22, Accession NP_000974.1), a gene which is a component of the large 60s ribosomal subunit;binds herparin. Accordingly, utilities of GAM94 include diagnosis, prevention and treatment of diseases and clinical conditions associated with RPL22.

The function of RPL22 has been established by previous studies. A reciprocal translocation between the long arms of chromosomes 3 and 21, at bands 3q26 and 21q22, occurs as an acquired clonal chromosomal abnormality in malignant cells from patients with therapy-related myelodysplastic syndrome or acute myeloid leukemia, as well as in some patients with chronic myeloid leukemia in blast crisis. Nucifora et al. (1993) showed that the gene on chromosome 21 is AML1 (OMIM Ref. No. 151385), which is fused to the ETO gene (OMIM Ref. No. 133435) in 8;21 translocations. Nucifora et al. (1993) isolated a fusion cDNA clone from a t(3;21) library derived from a patient with therapy-related myelodysplastic syndrome; this clone contained sequences from AML1 and from EAP, which they localized to 3q26 from the location of the breakpoint on chromosome 3. EAP is a highly expressed small nuclear protein of 128 residues associated with Epstein-Barr virus small RNA. The fusion clone contained the DNA-binding 5-prime part of AML1 that is fused to ETO in the t(8;21) and, in addition, at least 1 other exon. The translocation replaced the last 9 codons of AML1 with the last 96 codons of EAP. The fusion does not maintain the correct reading frame of EAP and may not lead to a functional chimeric protein. EAP has been identified as the ribosomal protein L22 Nucifora and Rowley (1995) reviewed the involvement of the AML1 gene in the 8;21 and 3;21 translocations in acute and chronic myeloid leukemia. Three loci closely situated to each other on 3q26 are involved in fusions with AML1 in the 3;21 translocations: EVI1 (OMIM Ref. No. 165215), EAP, and MDS1 (OMIM Ref. No. 600049). They pointed out that the order of the genes on 3q26 is TEL-EAP-MDS1-EVI1 and provided a diagram (their FIG. 5) of the 3q26 region containing these genes and of the various chimeric junctions they had isolated from t(3;21) patients Full details of the abovementioned studies are described in the following publications, the disclosure of which are hereby incorporated by reference:

Nucifora, G.; Begy, C. R.; Erickson, R.; Drabkin, H. A.; Rowley, J. D.: The 3;21 translocation in myelodysplasia results in a fusion transcript between the AML1 gene and the gene for EAP, a highly conserved protein associated with the Epstein-Barr virus small RNA EBER 1. Proc. Nat. Acad. Sci. 90:7784-7788, 1993; and Nucifora, G.; Rowley, J. D.: AML1 and the 8;21 and 3;21 translocations in acute and chronic myeloid leukemia. Blood 86:1-14, 1995.

Further studies establishing the function and utilities of RPL22 are found in John Hopkins OMIM database record ID 180474, and in cited publications listed in Table 5, which are hereby incorporated by reference. RRS1 (Accession NP_055984.1) is another GAM94 target gene, herein designated TARGET GENE. RRS1 BINDING SITE is a target binding site found in the 3' untranslated region of mRNA encoded by RRS1, corresponding to a target binding site such as BINDING SITE I, BINDING SITE II or BINDING SITE III of FIG. 8. Table 4 illustrates the complementarity of the nucleotide sequences of RRS1 BINDING SITE, designated SEQ ID:15022, to the nucleotide sequence of GAM94 RNA, herein designated GAM RNA, also designated SEQ ID:332.

Another function of GAM94 is therefore inhibition of RRS1 (Accession NP_055984.1). Accordingly, utilities of GAM94 include diagnosis, prevention and treatment of diseases and clinical conditions associated with RRS1.

Spinocerebellar ataxia 1 (olivopontocerebellar ataxia 1, autosomal dominant, ataxin 1) (SCA1, Accession NP_000323.1) is another GAM94 target gene, herein designated TARGET GENE. SCA1 BINDING SITE is a target binding site found in the 3' untranslated region of mRNA encoded by SCA1, corresponding to a target binding site such as BINDING SITE I, BINDING SITE II or BINDING SITE III of FIG. 8. Table 4 illustrates the complementarity of the nucleotide sequences of SCA1 BINDING SITE, designated SEQ ID:19326, to the nucleotide sequence of GAM94 RNA, herein designated GAM RNA, also designated SEQ ID:332.

Another function of GAM94 is therefore inhibition of Spinocerebellar ataxia 1 (olivopontocerebellar ataxia 1, autosomal dominant, ataxin 1) (SCA1, Accession NP_000323.1). Accordingly, utilities of GAM94 include diagnosis, prevention and treatment of diseases and clinical conditions associated with SCA1.

SCAMP5 (Accession NP_620417.1) is another GAM94 target gene, herein designated TARGET GENE. SCAMP5 BINDING SITE is a target binding site found in the 3' untranslated region of mRNA encoded by SCAMP5, corresponding to a target binding site such as BINDING SITE I, BINDING SITE II or BINDING SITE III of FIG. 8. Table 4 illustrates the complementarity of the nucleotide sequences of SCAMP5 BINDING SITE, designated SEQ ID:12952, to the nucleotide sequence of GAM94 RNA, herein designated GAM RNA, also designated SEQ ID:332.

Another function of GAM94 is therefore inhibition of SCAMP5 (Accession NP_620417.1). Accordingly, utilities of GAM94 include diagnosis, prevention and treatment of diseases and clinical conditions associated with SCAMP5.

Sodium channel, voltage-gated, type iv, beta polypeptide (SCN4B, Accession NP_777594.1) is another GAM94 target gene, herein designated TARGET GENE. SCN4B BINDING SITE is a target binding site found in the 3' untranslated region of mRNA encoded by SCN4B, corresponding to a target binding site such as BINDING SITE I, BINDING SITE II or BINDING SITE III of FIG. 8. Table 4 illustrates the complementarity of the nucleotide sequences of SCN4B BINDING SITE, designated SEQ ID:2309, to the nucleotide sequence of GAM94 RNA, herein designated GAM RNA, also designated SEQ ID:332.

Another function of GAM94 is therefore inhibition of Sodium channel, voltage-gated, type iv, beta polypeptide (SCN4B, Accession NP_777594.1). Accordingly, utilities of GAM94 include diagnosis, prevention and treatment of diseases and clinical conditions associated with SCN4B.

Sema domain, immunoglobulin domain (ig), short basic domain, secreted, (semaphorin) 3e (SEMA3E, Accession NP_036563.1) is another GAM94 target gene, herein designated TARGET GENE. SEMA3E BINDING SITE is a target binding site found in the 3' untranslated region of mRNA encoded by SEMA3E, corresponding to a target binding site such as BINDING SITE I, BINDING SITE II or BINDING SITE III of FIG. 8. Table 4 illustrates the complementarity of the nucleotide sequences of SEMA3E BINDING SITE, designated SEQ ID:10055, to the nucleotide sequence of GAM94 RNA, herein designated GAM RNA, also designated SEQ ID:332.

Another function of GAM94 is therefore inhibition of Sema domain, immunoglobulin domain (ig), short basic domain, secreted, (semaphorin) 3e (SEMA3E, Accession NP_036563.1). Accordingly, utilities of GAM94 include diagnosis, prevention and treatment of diseases and clinical conditions associated with SEMA3E.

Serine (or cysteine) proteinase inhibitor, clade b (ovalbumin), member 9 (SERPINB9, Accession NP_004146.1) is another GAM94 target gene, herein designated TARGET GENE. SERPINB9 BINDING SITE is a target binding site found in the 3' untranslated region of mRNA encoded by SERPINB9, corresponding to a target binding site such as BINDING SITE I, BINDING SITE II or BINDING SITE III of FIG. 8. Table 4 illustrates the complementarity of the nucleotide sequences of SERPINB9 BINDING SITE, designated SEQ ID:8680, to the nucleotide sequence of GAM94 RNA, herein designated GAM RNA, also designated SEQ ID:332.

Another function of GAM94 is therefore inhibition of Serine (or cysteine) proteinase inhibitor, clade b (ovalbumin), member 9 (SERPINB9, Accession NP_004146.1), a gene which may be a serpin serine protease inhibitor that interacts with granzyme B (GZMB). Accordingly, utilities of GAM94 include diagnosis, prevention and treatment of diseases and clinical conditions associated with SERPINB9.

The function of SERPINB9 and its association with various diseases and clinical conditions, has been established by previous studies, as described hereinabove with reference to GAM88.2. SFMBT (Accession NP_057413.1) is another GAM94 target gene, herein designated TARGET GENE. SFMBT BINDING SITE1 and SFMBT BINDING SITE2 are target binding sites found in untranslated regions of mRNA encoded by SFMBT, corresponding to target binding sites such as BINDING SITE I, BINDING SITE II or BINDING SITE III of FIG. 8. Table 4 illustrates the complementarity of the nucleotide sequences of SFMBT BINDING SITE1 and SFMBT BINDING SITE2, designated SEQ ID:17462 and SEQ ID:2582 respectively, to the nucleotide sequence of GAM94 RNA, herein designated GAM RNA, also designated SEQ ID:332.

Another function of GAM94 is therefore inhibition of SFMBT (Accession NP_057413.1). Accordingly, utilities of GAM94 include diagnosis, prevention and treatment of diseases and clinical conditions associated with SFMBT.

Secreted frizzled-related protein 4 (SFRP4, Accession NP_003005.1) is another GAM94 target gene, herein designated TARGET GENE. SFRP4 BINDING SITE is a target binding site found in the 3' untranslated region of mRNA encoded by SFRP4, corresponding to a target binding site such as BINDING SITE I, BINDING SITE II or BINDING SITE III of FIG. 8. Table 4 illustrates the complementarity of the nucleotide sequences of SFRP4 BINDING SITE, designated SEQ ID:2316, to the nucleotide sequence of GAM94 RNA, herein designated GAM RNA, also designated SEQ ID:332.

Another function of GAM94 is therefore inhibition of Secreted frizzled-related protein 4 (SFRP4, Accession NP_003005.1). Accordingly, utilities of GAM94 include diagnosis, prevention and treatment of diseases and clinical conditions associated with SFRP4.

Splicing factor, arginine/serine-rich 8 (suppressor-of-white-apricot homolog, drosophila) (SFRS8, Accession NP_689421.1) is another GAM94 target gene, herein designated TARGET GENE. SFRS8 BINDING SITE1 and SFRS8 BINDING SITE2 are target binding sites found in untranslated regions of multiple transcripts of mRNA encoded by SFRS8, corresponding to target binding sites such as BINDING SITE I, BINDING SITE II or BINDING SITE III of FIG. 8. Table 4 illustrates the complementarity of the nucleotide sequences of SFRS8 BINDING SITE1 and SFRS8 BINDING SITE2, designated SEQ ID:1589 and SEQ ID:3151 respectively, to the nucleotide sequence of GAM94 RNA, herein designated GAM RNA, also designated SEQ ID:332.

Another function of GAM94 is therefore inhibition of Splicing factor, arginine/serine-rich 8 (suppressor-of-white-apricot homolog, drosophila) (SFRS8, Accession NP_689421.1). Accordingly, utilities of GAM94 include diagnosis, prevention and treatment of diseases and clinical conditions associated with SFRS8.

Sh3 domain binding glutamic acid-rich protein like 2 (SH3BGRL2, Accession NP_113657.1) is another GAM94 target gene, herein designated TARGET GENE. SH3BGRL2 BINDING SITE is a target binding site found in the 3' untranslated region of mRNA encoded by SH3BGRL2, corresponding to a target binding site such as BINDING SITE I, BINDING SITE II or BINDING SITE III of FIG. 8. Table 4 illustrates the complementarity of the nucleotide sequences of SH3BGRL2 BINDING SITE, designated SEQ ID:10168, to the nucleotide sequence of GAM94 RNA, herein designated GAM RNA, also designated SEQ ID:332.

Another function of GAM94 is therefore inhibition of Sh3 domain binding glutamic acid-rich protein like 2 (SH3BGRL2, Accession NP_113657.1). Accordingly, utilities of GAM94 include diagnosis, prevention and treatment of diseases and clinical conditions associated with SH3BGRL2.

Sialic acid binding ig-like lectin 5 (SIGLEC5, Accession NP_003821.1) is another GAM94 target gene, herein designated TARGET GENE. SIGLEC5 BINDING SITE is a target binding site found in the 3' untranslated region of mRNA encoded by SIGLEC5, corresponding to a target binding site such as BINDING SITE I, BINDING SITE II or BINDING SITE III of FIG. 8. Table 4 illustrates the complementarity of the nucleotide sequences of SIGLEC5 BINDING SITE, designated SEQ ID:18811, to the nucleotide sequence of GAM94 RNA, herein designated GAM RNA, also designated SEQ ID:332.

Another function of GAM94 is therefore inhibition of Sialic acid binding ig-like lectin 5 (SIGLEC5, Accession NP_003821.1), a gene which is a cell adhesion molecule for postnatal neural development. Accordingly, utilities of GAM94 include diagnosis, prevention and treatment of diseases and clinical conditions associated with SIGLEC5.

The function of SIGLEC5 has been established by previous studies. The sialic acid-binding immunoglobulin-like lectins (SIGLECs), such as CD33 (OMIM Ref. No. 159590), are a subgroup of the immunoglobulin (Ig) superfamily that mediate protein-carbohydrate interactions. They specifically interact with sialic acids in glycoproteins and glycolipids, with each SIGLEC having a particular preference for both the nature of the sialic acid and its glycosidic linkage to adjacent sugars. SIGLECs have similar structures, including extracellular Ig-like domains composed of an N- terminal V-set domain followed by varying numbers of C2-set domains. It appears that all SIGLECs have an unusual arrangement of conserved cysteine residues in the V- set and adjacent C2-set domains. Most SIGLECs are expressed uniquely within the hematopoietic system. By searching an EST database for cDNAs that encode proteins with sequence similarity to the CD33 protein, Cornish et al. (1998) identified a novel SIGLEC, which they named SIGLEC5. They isolated a full-length human macrophage SIGLEC5 cDNA encoding a deduced 551-amino acid protein with all the key structural features of SIGLECs. SIGLEC5 contains a signal peptide, 4 extracellular Ig-like domains consisting of an N-terminal V-set domain and 3 C2-set domains, a transmembrane domain, 2 cytoplasmic ITIM (immunoreceptor tyrosine-based inhibitory motif)-like motifs, and 8 potential N-linked glycosylation sites. SIGLEC5 has high sequence similarity to CD33 and OBBP1 (SIGLEC6; 604405). Western blot analysis of neutrophil lysates indicated that SIGLEC5 exists as a disulfide-linked dimer of approximately 140 kD. Recombinant SIGLEC5 expressed in COS cells mediated sialic acid-dependent binding to human erythrocytes. SIGLEC5 bound to alpha-2,3- and alpha-2,6-linked sialic acid equally. Northern blot analysis detected 2 major SIGLEC5 transcripts of 2.4 and 3.4 kb in various tissues, with the highest levels in hematopoietic organs, notably bone marrow and spleen. SIGLEC5 protein was present on neutrophils but absent from leukemic cell lines representing early stages of myelomonocytic differentiation. By screening a human erythroleukemic cell line cDNA library with a full-length OBBP1 cDNA, Patel et al. (1999) isolated a cDNA encoding OBBP2. They stated that OBBP2 is identical to SIGLEC5 (Cornish et al., 1998). The deduced OBBP2 protein shares 59% and 56% sequence identity with OBBP1 and CD33, respectively. All 3 of these proteins have a cytoplasmic domain containing putative sites of tyrosine phosphorylation, including an immunoreceptor tyrosine kinase inhibitory motif and a motif found in SLAM (OMIM Ref. No. 603492) and SLAM-like proteins. Recombinant OBBP2 and CD33 bound weakly to leptin, whereas OBBP1 exhibited tight and specific binding to leptin. Northern blot analysis detected highest OBBP2 expression in peripheral blood leukocytes, with moderate to low expression in spleen, lung, and placenta.

Full details of the abovementioned studies are described in the following publications, the disclosure of which are hereby incorporated by reference:

Cornish, A. L.; Freeman, S.; Forbes, G.; Ni, J.; Zhang, M.; Cepeda, M.; Gentz, R.; Augustus, M.; Carter, K. C.; Crocker, P. R.: Characterization of siglec-5, a novel glycoprotein expressed on myeloid cells related to CD33. Blood 92: 2123-2132, 1998; and Patel, N.; Brinkman-Van der Linden, E. C. M.; Altmann, S. W.; Gish, K.; Balasubramanian, S.; Timans, J. C.; Peterson, D.; Bell, M. P.; Bazan, J. F.; Varki, A.; Kastelein, R. A.: OB-BP1/Si.

Further studies establishing the function and utilities of SIGLEC5 are found in John Hopkins OMIM database record ID 604200, and in cited publications listed in Table 5, which are hereby incorporated by reference. Sine oculis homeobox homolog 2 (drosophila) (SIX2, Accession NP_058628.2) is another GAM94 target gene, herein designated TARGET GENE. SIX2 BINDING SITE is a target binding site found in the 3' untranslated region of mRNA encoded by SIX2, corresponding to a target binding site such as BINDING SITE I, BINDING SITE II or BINDING SITE III of FIG. 8. Table 4 illustrates the complementarity of the nucleotide sequences of SIX2 BINDING SITE, designated SEQ ID:9606, to the nucleotide sequence of GAM94 RNA, herein designated GAM RNA, also designated SEQ ID:332.

Another function of GAM94 is therefore inhibition of Sine oculis homeobox homolog 2 (drosophila) (SIX2, Accession NP_058628.2), a gene which may be involved in limb tendon and ligament development (by similarity). Accordingly, utilities of GAM94 include diagnosis, prevention and treatment of diseases and clinical conditions associated with SIX2.

The function of SIX2 has been established by previous studies. By screening a human genomic library with a human SIX1 cDNA (OMIM Ref. No. 601205), Boucher et al. (2000) identified the SIX2 gene. Using the SIX2 genomic sequence, they isolated a human fetus SIX2 cDNA. The predicted 291-amino acid SIX2 protein contains a SIX domain and a homeodomain. The human SIX2 protein is almost identical to the mouse Six2 protein. Northern blot analysis of human tissues detected strong expression of a major 2.2-kb SIX2 transcript in skeletal muscle, with weaker expression in pancreas. RT-PCR showed SIX2 expression in all human fetal tissues tested except lung. In adult tissues, RT-PCR revealed SIX2 expression in skeletal muscle, pancreas, ovary, and sclera; SIX2 expression was not detected in other regions of the adult eye and optic nerve or in adult heart, lung, kidney, liver, or breast. Boucher et al. (2000) determined that the human SIX2 gene contains 2 exons.

Full details of the abovementioned studies are described in the following publications, the disclosure of which are hereby incorporated by reference:

Boucher, C. A.; Winchester, C. L.; Hamilton, G. M.; Winter, A. D.; Johnson, K. J.; Bailey, M. E. S.: Structure, mapping and expression of the human gene encoding the homeodomain protein, SIX2. Gene 247:145-151, 2000; and Oliver, G.; Wehr, R.; Jenkins, N. A.; Copeland, N. G.; Cheyette, B. N. R.; Hartenstein, V.; Zipursky, S. L.; Gruss, P.: Homeobox genes and connective tissue patterning. Development 12.

Further studies establishing the function and utilities of SIX2 are found in John Hopkins OMIM database record ID 604994, and in cited publications listed in Table 5, which are hereby incorporated by reference. Solute carrier family 11 (proton-coupled divalent metal ion transporters), member 2 (SLC11A2, Accession NP_000608.1) is another GAM94 target gene, herein designated TARGET GENE. SLC11A2 BINDING SITE is a target binding site found in the 3' untranslated region of mRNA encoded by SLC11A2, corresponding to a target binding site such as BINDING SITE I, BINDING SITE II or BINDING SITE III of FIG. 8. Table 4 illustrates the complementarity of the nucleotide sequences of SLC11A2 BINDING SITE, designated SEQ ID:3415, to the nucleotide sequence of GAM94 RNA, herein designated GAM RNA, also designated SEQ ID:332.

Another function of GAM94 is therefore inhibition of Solute carrier family 11 (proton-coupled divalent metal ion transporters), member 2 (SLC11A2, Accession NP_000608.1). Accordingly, utilities of GAM94 include diagnosis, prevention and treatment of diseases and clinical conditions associated with SLC11A2.

Solute carrier family 12 (potassium/chloride transporters), member 8 (SLC12A8, Accession NP_078904.1) is another GAM94 target gene, herein designated TARGET GENE. SLC12A8 BINDING SITE is a target binding site found in the 5' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:8454, to the nucleotide sequence of GAM94 RNA, herein designated GAM RNA, also designated SEQ ID:332.

Another function of GAM94 is therefore inhibition of Solute carrier family 12 (potassium/chloride transporters), member 8 (SLC12A8, Accession NP_078904.1). Accordingly, utilities of GAM94 include diagnosis, prevention and treatment of diseases and clinical conditions associated with SLC12A8.

Solute carrier family 14 (urea transporter), member 1 (kidd blood group) (SLC14A1, Accession NP_056949.1) is another GAM94 target gene, herein designated TARGET GENE. SLC14A1 BINDING SITE is a target binding site found in the 3' untranslated region of mRNA encoded by SLC14A1, corresponding to a target binding site such as BINDING SITE I, BINDING SITE II or BINDING SITE III of FIG. 8. Table 4 illustrates the complementarity of the nucleotide sequences of SLC14A1 BINDING SITE, designated SEQ ID:9326, to the nucleotide sequence of GAM94 RNA, herein designated GAM RNA, also designated SEQ ID:332.

Another function of GAM94 is therefore inhibition of Solute carrier family 14 (urea transporter), member 1 (kidd blood group) (SLC14A1, Accession NP_056949.1), a gene which is a urea transporters in spermatogenesis. and therefore may be associated with Urine concentration defect. Accordingly, utilities of GAM94 include diagnosis, prevention and treatment of Urine concentration defect, and of other diseases and clinical conditions associated with SLC14A1.

The function of SLC14A1 has been established by previous studies. Tsukaguchi et al. (1997) undertook a characterization of the tissue distribution and physiologic role of the erythrocyte urea transporter, UT11, by studying its rat homolog and testing whether there are additional urea transporter isoforms expressed in rat kidney. Using a PCR-based homology cloning approach with degenerate primers corresponding to conserved regions of the UT family of genes, they isolated a kidney urea transporter that appeared to be the rat homolog of human UT11. The rat gene, symbolized UT3 by them, was strongly expressed in the kidney. Furthermore, UT3 was expressed in testis, brain, bone marrow, and spleen. Its expression in the rat testis suggested a potential role for urea transporters in spermatogenesis. On in situ hybridization of testis, UT3 was detected in Sertoli cells associated with the early stages of spermatocyte development. The distribution in the kidneys suggested that UT3 is involved in counter-current exchange between ascending and descending vasa recta, to enhance the cortico-papillary osmolality gradient. Although Jk-null red blood cells have reduced urea permeability, the Jk deficiency is not associated with any obvious clinical syndrome except for a urine concentration defect (Sands et al., 1992) that probably results from the absence of the Jk protein expressed on endothelial cells of the vasa recta of kidney (Xu et al., 1997; Promeneur et al., 1996). Persons with the Jk-null phenotype are detected because antibody against Jk3 can develop after immunization by transfusion or pregnancy, and this antibody may cause immediate and delayed hemolytic transfusion reactions (Lucien et al. (2002)).

Full details of the abovementioned studies are described in the following publications, the disclosure of which are hereby incorporated by reference:

Tsukaguchi, H.; Shayakul, C.; Berger, U. V.; Tokui, T.; Brown, D.; Hediger, M. A.: Cloning and characterization of the urea transportation UT3: localization in rat kidney and testis. J. Clin. Invest. 99:1506-1515, 1997. ; and Sands, J. M.; Gargus, J. J.; Frohlich, O.; Gunn, R. B.; Kokko, J. P.: Urinary concentrating ability in patients with Jk(a/b) blood type who lack carrier-mediated urea transport. J. Am. Soc.

Further studies establishing the function and utilities of SLC14A1 are found in John Hopkins OMIM database record ID 111000, and in cited publications listed in Table 5, which are hereby incorporated by reference. Solute carrier family 17 (sodium phosphate), member 3 (SLC17A3, Accession NP_006623.1) is another GAM94 target gene, herein designated TARGET GENE. SLC17A3 BINDING SITE is a target binding site found in the 5' untranslated region of mRNA encoded by SLC17A3, corresponding to a target binding site such as BINDING SITE I, BINDING SITE II or BINDING SITE III of FIG. 8. Table 4 illustrates the complementarity of the nucleotide sequences of SLC17A3 BINDING SITE, designated SEQ ID:9674, to the nucleotide sequence of GAM94 RNA, herein designated GAM RNA, also designated SEQ ID:332.

Another function of GAM94 is therefore inhibition of Solute carrier family 17 (sodium phosphate), member 3 (SLC17A3, Accession NP_006623.1). Accordingly, utilities of GAM94 include diagnosis, prevention and treatment of diseases and clinical conditions associated with SLC17A3.

Solute carrier family 28 (sodium-coupled nucleoside transporter), member 2 (SLC28A2, Accession NP_004203.1) is another GAM94 target gene, herein designated TARGET GENE. SLC28A2 BINDING SITE is a target binding site found in the 5' untranslated region of mRNA encoded by SLC28A2, corresponding to a target binding site such as BINDING SITE I, BINDING SITE II or BINDING SITE III of FIG. 8. Table 4 illustrates the complementarity of the nucleotide sequences of SLC28A2 BINDING SITE, designated SEQ ID:12812, to the nucleotide sequence of GAM94 RNA, herein designated GAM RNA, also designated SEQ ID:332.

Another function of GAM94 is therefore inhibition of Solute carrier family 28 (sodium-coupled nucleoside transporter), member 2 (SLC28A2, Accession NP_004203.1). Accordingly, utilities of GAM94 include diagnosis, prevention and treatment of diseases and clinical conditions associated with SLC28A2.

Solute carrier family 38, member 3 (SLC38A3, Accession NP_006832.1) is another GAM94 target gene, herein designated TARGET GENE. SLC38A3 BINDING SITE is a target binding site found in the 3' untranslated region of mRNA encoded by SLC38A3, corresponding to a target binding site such as BINDING SITE I, BINDING SITE II or BINDING SITE III of FIG. 8. Table 4 illustrates the complementarity of the nucleotide sequences of SLC38A3 BINDING SITE, designated SEQ ID:14679, to the nucleotide sequence of GAM94 RNA, herein designated GAM RNA, also designated SEQ ID:332.

Another function of GAM94 is therefore inhibition of Solute carrier family 38, member 3 (SLC38A3, Accession NP_006832.1), a gene which involves H+ exchange and Na+ cotransport, mediates glutamine efflux and uptake. Accordingly, utilities of GAM94 include diagnosis, prevention and treatment of diseases and clinical conditions associated with SLC38A3.

The function of SLC38A3 has been established by previous studies. The amino acid glutamine has a central role in nitrogen metabolism. Although the molecular mechanisms responsible for its transport across cell membranes are poorly understood, classical amino acid transport system N appears particularly important. Using intracellular pH measurements, Chaudhry et al. (1999) identified an orphan protein, which they called SN1, related to the vesicular GABA transporter (VGAT) as system N Functional analysis by Chaudhry et al. (1999) showed that this protein involves H+ exchange as well as Na+ cotransport and, under physiologic conditions, mediates glutamine efflux as well as uptake. Together with the pattern of SN1 expression, these unusual properties suggested novel physiologic roles for system N in nitrogen metabolism and synaptic transmission Full details of the abovementioned studies are described in the following publications, the disclosure of which are hereby incorporated by reference:

Chaudhry, F. A.; Reimer, R. J.; Krizaj, D.; Barber, D.; Storm-Mathisen, J.; Copenhagen, D. R.; Edwards, R. H.: Molecular analysis of system N suggests novel physiological roles in nitrogen metabolism and synaptic transmission. Cell 99: 769-780, 1999; and Lerman, M. I.; Minna, J. D.: The 630-kb lung cancer homozygous deletion region on human chromosome 3p21.3: identification and evaluation of the resident candidate tumor suppressor genes.

Further studies establishing the function and utilities of SLC38A3 are found in John Hopkins OMIM database record ID 604437, and in cited publications listed in Table 5, which are hereby incorporated by reference. Solute carrier family 38, member 5 (SLC38A5, Accession NP_277053.1) is another GAM94 target gene, herein designated TARGET GENE. SLC38A5 BINDING SITE is a target binding site found in the 3' untranslated region of mRNA encoded by SLC38A5, corresponding to a target binding site such as BINDING SITE I, BINDING SITE II or BINDING SITE III of FIG. 8. Table 4 illustrates the complementarity of the nucleotide sequences of SLC38A5 BINDING SITE, designated SEQ ID:13273, to the nucleotide sequence of GAM94 RNA, herein designated GAM RNA, also designated SEQ ID:332.

Another function of GAM94 is therefore inhibition of Solute carrier family 38, member 5 (SLC38A5, Accession NP_277053.1). Accordingly, utilities of GAM94 include diagnosis, prevention and treatment of diseases and clinical conditions associated with SLC38A5.

Solute carrier family 6 (neurotransmitter transporter, creatine), member 8 (SLC6A8, Accession NP_005620.1) is another GAM94 target gene, herein designated TARGET GENE. SLC6A8 BINDING SITE is a target binding site found in the 3' untranslated region of mRNA encoded by SLC6A8, corresponding to a target binding site such as BINDING SITE I, BINDING SITE II or BINDING SITE III of FIG. 8. Table 4 illustrates the complementarity of the nucleotide sequences of SLC6A8 BINDING SITE, designated SEQ ID:17109, to the nucleotide sequence of GAM94 RNA, herein designated GAM RNA, also designated SEQ ID:332.

Another function of GAM94 is therefore inhibition of Solute carrier family 6 (neurotransmitter transporter, creatine), member 8 (SLC6A8, Accession NP_005620.1). Accordingly, utilities of GAM94 include diagnosis, prevention and treatment of diseases and clinical conditions associated with SLC6A8.

Swi/snf related, matrix associated, actin dependent regulator of chromatin, subfamily a, member 5 (SMARCA5, Accession NP_003592.2) is another GAM94 target gene, herein designated TARGET GENE. SMARCA5 BINDING SITE is a target binding site found in the 5' untranslated region of mRNA encoded by SMARCA5, corresponding to a target binding site such as BINDING SITE I, BINDING SITE II or BINDING SITE III of FIG. 8. Table 4 illustrates the complementarity of the nucleotide sequences of SMARCA5 BINDING SITE, designated SEQ ID:8202, to the nucleotide sequence of GAM94 RNA, herein designated GAM RNA, also designated SEQ ID:332.

Another function of GAM94 is therefore inhibition of Swi/snf related, matrix associated, actin dependent regulator of chromatin, subfamily a, member 5 (SMARCA5, Accession NP_003592.2), a gene which is involved in chromatin assembly and remodeling. Accordingly, utilities of GAM94 include diagnosis, prevention and treatment of diseases and clinical conditions associated with SMARCA5.

The function of SMARCA5 has been established by previous studies. Poot et al. (2000) identified SMARCA5, which they called SNF2H, within a chromatin remodeling complex, CHRAC, purified from HeLa cell nuclear extracts. They confirmed an interaction between SMARCA5 and ACF1 (BAZ1A). Two small histone-fold proteins, CHRAC17 (POLE3; 607267) and CHRAC15 (CHRAC1; 607268), copurified with the complex, and the authors showed that these proteins form a DNA-binding heterodimer. Poot et al. (2000) determined that the purified complex could mobilize nucleosomes into a regularly spaced nucleosomal array and that the spacing activity was strictly ATP-dependent. By Western blot analysis of protein expression levels in several human and mammalian cell lines, Bozhenok et al. (2002) determined that SMARCA5 interacts with BAZ1B (OMIM Ref. No. 605681). In vitro analysis of the mouse Smarca5-Baz1b complex showed that, in the presence of ATP, the complex can create regular nucleosomal arrays from irregular chromatin Full details of the abovementioned studies are described in the following publications, the disclosure of which are hereby incorporated by reference:

Bozhenok, L.; Wade, P. A.; Varga-Weisz, P.: WSTF-ISWI chromatin remodeling complex targets heterochromatic replication foci. EMBO J. 21:2231-2241, 2002; and Poot, R. A.; Dellaire, G.; Hulsmann, B. B.; Grimaldi, M. A.; Corona, D. F. V.; Becker, P. B.; Bickmore, W. A.; Varga-Weisz, P. D.: HuCHRAC, a human ISWI chromatin remodelling complex cont.

Further studies establishing the function and utilities of SMARCA5 are found in John Hopkins OMIM database record ID 603375, and in cited publications listed in Table 5, which are hereby incorporated by reference. Swi/snf related, matrix associated, actin dependent regulator of chromatin, subfamily f, member 1 (SMARCF1, Accession NP_060920.4) is another GAM94 target gene, herein designated TARGET GENE. SMARCF1 BINDING SITE is a target binding site found in the 3' untranslated region of multiple transcripts of mRNA encoded by SMARCF1, corresponding to a target binding site such as BINDING SITE I, BINDING SITE II or BINDING SITE III of FIG. 8. Table 4 illustrates the complementarity of the nucleotide sequences of SMARCF1 BINDING SITE, designated SEQ ID:19730, to the nucleotide sequence of GAM94 RNA, herein designated GAM RNA, also designated SEQ ID:332.

Another function of GAM94 is therefore inhibition of Swi/snf related, matrix associated, actin dependent regulator of chromatin, subfamily f, member 1 (SMARCF1, Accession NP_060920.4). Accordingly, utilities of GAM94 include diagnosis, prevention and treatment of diseases and clinical conditions associated with SMARCF1.

Small nuclear rna activating complex, polypeptide 1, 43 kda (SNAPC1, Accession NP_003073.1) is another GAM94 target gene, herein designated TARGET GENE. SNAPC1 BINDING SITE is a target binding site found in the 3' untranslated region of mRNA encoded by SNAPC1, corresponding to a target binding site such as BINDING SITE I, BINDING SITE II or BINDING SITE III of FIG. 8. Table 4 illustrates the complementarity of the nucleotide sequences of SNAPC1 BINDING SITE, designated SEQ ID:11862, to the nucleotide sequence of GAM94 RNA, herein designated GAM RNA, also designated SEQ ID:332.

Another function of GAM94 is therefore inhibition of Small nuclear rna activating complex, polypeptide 1, 43 kda (SNAPC1, Accession NP_003073.1). Accordingly, utilities of GAM94 include diagnosis, prevention and treatment of diseases and clinical conditions associated with SNAPC1.

Synuclein, alpha (non a4 component of amyloid precursor) (SNCA, Accession NP_009292.1) is another GAM94 target gene, herein designated TARGET GENE. SNCA BINDING SITE is a target binding site found in the 3' untranslated region of multiple transcripts of mRNA encoded by SNCA, corresponding to a target binding site such as BINDING SITE I, BINDING SITE II or BINDING SITE III of FIG. 8. Table 4 illustrates the complementarity of the nucleotide sequences of SNCA BINDING SITE, designated SEQ ID:11031, to the nucleotide sequence of GAM94 RNA, herein designated GAM RNA, also designated SEQ ID:332.

Another function of GAM94 is therefore inhibition of Synuclein, alpha (non a4 component of amyloid precursor) (SNCA, Accession NP_009292.1). Accordingly, utilities of GAM94 include diagnosis, prevention and treatment of diseases and clinical conditions associated with SNCA.

Synuclein, alpha (non a4 component of amyloid precursor) (SNCA, Accession NP_000336.1) is another GAM94 target gene, herein designated TARGET GENE. SNCA BINDING SITE is a target binding site found in the 3' untranslated region of multiple transcripts of mRNA encoded by SNCA, corresponding to a target binding site such as BINDING SITE I, BINDING SITE II or BINDING SITE III of FIG. 8. Table 4 illustrates the complementarity of the nucleotide sequences of SNCA BINDING SITE, designated SEQ ID:11031, to the nucleotide sequence of GAM94 RNA, herein designated GAM RNA, also designated SEQ ID:332.

Another function of GAM94 is therefore inhibition of Synuclein, alpha (non a4 component of amyloid precursor) (SNCA, Accession NP_000336.1). Accordingly, utilities of GAM94 include diagnosis, prevention and treatment of diseases and clinical conditions associated with SNCA.

SNW1 (Accession NP_036377.1) is another GAM94 target gene, herein designated TARGET GENE. SNW1 BINDING SITE is a target binding site found in the 3' untranslated region of mRNA encoded by SNW1, corresponding to a target binding site such as BINDING SITE I, BINDING SITE II or BINDING SITE III of FIG. 8. Table 4 illustrates the complementarity of the nucleotide sequences of SNW1 BINDING SITE, designated SEQ ID:9744, to the nucleotide sequence of GAM94 RNA, herein designated GAM RNA, also designated SEQ ID:332.

Another function of GAM94 is therefore inhibition of SNW1 (Accession NP_036377.1). Accordingly, utilities of GAM94 include diagnosis, prevention and treatment of diseases and clinical conditions associated with SNW1.

Sorting nexin 9 (SNX9, Accession NP_057308.1) is another GAM94 target gene, herein designated TARGET GENE. SNX9 BINDING SITE is a target binding site found in the 3' untranslated region of mRNA encoded by SNX9, corresponding to a target binding site such as BINDING SITE I, BINDING SITE II or BINDING SITE III of FIG. 8. Table 4 illustrates the complementarity of the nucleotide sequences of SNX9 BINDING SITE, designated SEQ ID:16044, to the nucleotide sequence of GAM94 RNA, herein designated GAM RNA, also designated SEQ ID:332.

Another function of GAM94 is therefore inhibition of Sorting nexin 9 (SNX9, Accession NP_057308.1). Accordingly, utilities of GAM94 include diagnosis, prevention and treatment of diseases and clinical conditions associated with SNX9.

Sry (sex determining region y)-box 9 (campomelic dysplasia, autosomal sex-reversal) (SOX9, Accession NP_000337.1) is another GAM94 target gene, herein designated TARGET GENE. SOX9 BINDING SITE is a target binding site found in the 5' untranslated region of mRNA encoded by SOX9, corresponding to a target binding site such as BINDING SITE I, BINDING SITE II or BINDING SITE III of FIG. 8. Table 4 illustrates the complementarity of the nucleotide sequences of SOX9 BINDING SITE, designated SEQ ID:3166, to the nucleotide sequence of GAM94 RNA, herein designated GAM RNA, also designated SEQ ID:332.

Another function of GAM94 is therefore inhibition of Sry (sex determining region y)-box 9 (campomelic dysplasia, autosomal sex-reversal) (SOX9, Accession NP_000337.1), a gene which regulates the expression of other genes involved in chondrogenesis. Accordingly, utilities of GAM94 include diagnosis, prevention and treatment of diseases and clinical conditions associated with SOX9.

The function of SOX9 and its association with various diseases and clinical conditions, has been established by previous studies, as described hereinabove with reference to GAM63.1. Spermatogenesis associated 1 (SPATA1, Accession NP_071749.1) is another GAM94 target gene, herein designated TARGET GENE. SPATA1 BINDING SITE is a target binding site found in the 3' untranslated region of mRNA encoded by SPATA1, corresponding to a target binding site such as BINDING SITE I, BINDING SITE II or BINDING SITE III of FIG. 8. Table 4 illustrates the complementarity of the nucleotide sequences of SPATA1 BINDING SITE, designated SEQ ID:18673, to the nucleotide sequence of GAM94 RNA, herein designated GAM RNA, also designated SEQ ID:332.

Another function of GAM94 is therefore inhibition of Spermatogenesis associated 1 (SPATA1, Accession NP_071749.1). Accordingly, utilities of GAM94 include diagnosis, prevention and treatment of diseases and clinical conditions associated with SPATA1.

Sprouty homolog 3 (drosophila) (SPRY3, Accession NP_005831.1) is another GAM94 target gene, herein designated TARGET GENE. SPRY3 BINDING SITE1 and SPRY3 BINDING SITE2 are target binding sites found in untranslated regions of mRNA encoded by SPRY3, corresponding to target binding sites such as BINDING SITE I, BINDING SITE II or BINDING SITE III of FIG. 8. Table 4 illustrates the complementarity of the nucleotide sequences of SPRY3 BINDING SITE1 and SPRY3 BINDING SITE2, designated SEQ ID:15586 and SEQ ID:9428 respectively, to the nucleotide sequence of GAM94 RNA, herein designated GAM RNA, also designated SEQ ID:332.

Another function of GAM94 is therefore inhibition of Sprouty homolog 3 (drosophila) (SPRY3, Accession NP_005831.1). Accordingly, utilities of GAM94 include diagnosis, prevention and treatment of diseases and clinical conditions associated with SPRY3.

Serum response factor (c-fos serum response element-binding transcription factor) (SRF, Accession NP_003122.1) is another GAM94 target gene, herein designated TARGET GENE. SRF BINDING SITE is a target binding site found in the 3' untranslated region of mRNA encoded by SRF, corresponding to a target binding site such as BINDING SITE I, BINDING SITE II or BINDING SITE III of FIG. 8. Table 4 illustrates the complementarity of the nucleotide sequences of SRF BINDING SITE, designated SEQ ID:844, to the nucleotide sequence of GAM94 RNA, herein designated GAM RNA, also designated SEQ ID:332.

Another function of GAM94 is therefore inhibition of Serum response factor (c-fos serum response element-binding transcription factor) (SRF, Accession NP_003122.1). Accordingly, utilities of GAM94 include diagnosis, prevention and treatment of diseases and clinical conditions associated with SRF.

SRGAP2 (Accession NP_055665.1) is another GAM94 target gene, herein designated TARGET GENE. SRGAP2 BINDING SITE is a target binding site found in the 5' untranslated region of mRNA encoded by SRGAP2, corresponding to a target binding site such as BINDING SITE I, BINDING SITE II or BINDING SITE III of FIG. 8. Table 4 illustrates the complementarity of the nucleotide sequences of SRGAP2 BINDING SITE, designated SEQ ID:16111, to the nucleotide sequence of GAM94 RNA, herein designated GAM RNA, also designated SEQ ID:332.

Another function of GAM94 is therefore inhibition of SRGAP2 (Accession NP_055665.1). Accordingly, utilities of GAM94 include diagnosis, prevention and treatment of diseases and clinical conditions associated with SRGAP2.

Sarcalumenin (SRL, Accession XP_064152.3) is another GAM94 target gene, herein designated TARGET GENE. SRL BINDING SITE is a target binding site found in the 5' untranslated region of mRNA encoded by SRL, corresponding to a target binding site such as BINDING SITE I, BINDING SITE II or BINDING SITE III of FIG. 8. Table 4 illustrates the complementarity of the nucleotide sequences of SRL BINDING SITE, designated SEQ ID:16356, to the nucleotide sequence of GAM94 RNA, herein designated GAM RNA, also designated SEQ ID:332.

Another function of GAM94 is therefore inhibition of Sarcalumenin (SRL, Accession XP_064152.3). Accordingly, utilities of GAM94 include diagnosis, prevention and treatment of diseases and clinical conditions associated with SRL.

SRPUL (Accession NP_055282.1) is another GAM94 target gene, herein designated TARGET GENE. SRPUL BINDING SITE1 and SRPUL BINDING SITE2 are target binding sites found in untranslated regions of mRNA encoded by SRPUL, corresponding to target binding sites such as BINDING SITE I, BINDING SITE II or BINDING SITE III of FIG. 8. Table 4 illustrates the complementarity of the nucleotide sequences of SRPUL BINDING SITE1 and SRPUL BINDING SITE2, designated SEQ ID:13474 and SEQ ID:8925 respectively, to the nucleotide sequence of GAM94 RNA, herein designated GAM RNA, also designated SEQ ID:332.

Another function of GAM94 is therefore inhibition of SRPUL (Accession NP_055282.1). Accordingly, utilities of GAM94 include diagnosis, prevention and treatment of diseases and clinical conditions associated with SRPUL.

SSH1 (Accession NP_061857.1) is another GAM94 target gene, herein designated TARGET GENE. SSH1 BIND- ING SITE is a target binding site found in the 3' untranslated region of mRNA encoded by SSH1, corresponding to a target binding site such as BINDING SITE I, BINDING SITE II or BINDING SITE III of FIG. 8. Table 4 illustrates the complementarity of the nucleotide sequences of SSH1 BINDING SITE, designated SEQ ID:1987, to the nucleotide sequence of GAM94 RNA, herein designated GAM RNA, also designated SEQ ID:332.

Another function of GAM94 is therefore inhibition of SSH1 (Accession NP_061857.1). Accordingly, utilities of GAM94 include diagnosis, prevention and treatment of diseases and clinical conditions associated with SSH1.

Signal sequence receptor, beta (translocon-associated protein beta) (SSR2, Accession NP_003136.1) is another GAM94 target gene, herein designated TARGET GENE. SSR2 BINDING SITE is a target binding site found in the 3' untranslated region of mRNA encoded by SSR2, corresponding to a target binding site such as BINDING SITE I, BINDING SITE II or BINDING SITE III of FIG. 8. Table 4 illustrates the complementarity of the nucleotide sequences of SSR2 BINDING SITE, designated SEQ ID:9632, to the nucleotide sequence of GAM94 RNA, herein designated GAM RNA, also designated SEQ ID:332.

Another function of GAM94 is therefore inhibition of Signal sequence receptor, beta (translocon-associated protein beta) (SSR2, Accession NP_003136.1). Accordingly, utilities of GAM94 include diagnosis, prevention and treatment of diseases and clinical conditions associated with SSR2.

Stanniocalcin 2 (STC2, Accession NP_003705.1) is another GAM94 target gene, herein designated TARGET GENE. STC2 BINDING SITE is a target binding site found in the 5' untranslated region of mRNA encoded by STC2, corresponding to a target binding site such as BINDING SITE I, BINDING SITE II or BINDING SITE III of FIG. 8. Table 4 illustrates the complementarity of the nucleotide sequences of STC2 BINDING SITE, designated SEQ ID:19667, to the nucleotide sequence of GAM94 RNA, herein designated GAM RNA, also designated SEQ ID:332.

Another function of GAM94 is therefore inhibition of Stanniocalcin 2 (STC2, Accession NP_003705.1). Accordingly, utilities of GAM94 include diagnosis, prevention and treatment of diseases and clinical conditions associated with STC2.

Stathmin-like 4 (STMN4, Accession NP_110422.2) is another GAM94 target gene, herein designated TARGET GENE. STMN4 BINDING SITE is a target binding site found in the 3' untranslated region of mRNA encoded by STMN4, corresponding to a target binding site such as BINDING SITE I, BINDING SITE II or BINDING SITE III of FIG. 8. Table 4 illustrates the complementarity of the nucleotide sequences of STMN4 BINDING SITE, designated SEQ ID:18271, to the nucleotide sequence of GAM94 RNA, herein designated GAM RNA, also designated SEQ ID:332.

Another function of GAM94 is therefore inhibition of Stathmin-like 4 (STMN4, Accession NP_110422.2). Accordingly, utilities of GAM94 include diagnosis, prevention and treatment of diseases and clinical conditions associated with STMN4.

Surfeit 6 (SURF6, Accession NP_006744.2) is another GAM94 target gene, herein designated TARGET GENE. SURF6 BINDING SITE is a target binding site found in the 3' untranslated region of mRNA encoded by SURF6, corresponding to a target binding site such as BINDING SITE I, BINDING SITE II or BINDING SITE III of FIG. 8. Table 4 illustrates the complementarity of the nucleotide sequences of SURF6 BINDING SITE, designated SEQ ID:10512, to the nucleotide sequence of GAM94 RNA, herein designated GAM RNA, also designated SEQ ID:332.

Another function of GAM94 is therefore inhibition of Surfeit 6 (SURF6, Accession NP_006744.2). Accordingly, utilities of GAM94 include diagnosis, prevention and treatment of diseases and clinical conditions associated with SURF6.

SV2A (Accession NP_055664.1) is another GAM94 target gene, herein designated TARGET GENE. SV2A BINDING SITE is a target binding site found in the 3' untranslated region of mRNA encoded by SV2A, corresponding to a target binding site such as BINDING SITE I, BINDING SITE II or BINDING SITE III of FIG. 8. Table 4 illustrates the complementarity of the nucleotide sequences of SV2A BINDING SITE, designated SEQ ID:17251, to the nucleotide sequence of GAM94 RNA, herein designated GAM RNA, also designated SEQ ID:332.

Another function of GAM94 is therefore inhibition of SV2A (Accession NP_055664.1). Accordingly, utilities of GAM94 include diagnosis, prevention and treatment of diseases and clinical conditions associated with SV2A.

Synaptogyrin 1 (SYNGR1, Accession NP_663783.1) is another GAM94 target gene, herein designated TARGET GENE. SYNGR1 BINDING SITE is a target binding site found in the 3' untranslated region of multiple transcripts of mRNA encoded by SYNGR1, corresponding to a target binding site such as BINDING SITE I, BINDING SITE II or BINDING SITE III of FIG. 8. Table 4 illustrates the complementarity of the nucleotide sequences of SYNGR1 BINDING SITE, designated SEQ ID:5970, to the nucleotide sequence of GAM94 RNA, herein designated GAM RNA, also designated SEQ ID:332.

Another function of GAM94 is therefore inhibition of Synaptogyrin 1 (SYNGR1, Accession NP_663783.1), a gene which belongs to transmembrane synaptic vesicle protein and may function in membrane recycling. Accordingly, utilities of GAM94 include diagnosis, prevention and treatment of diseases and clinical conditions associated with SYNGR1.

The function of SYNGR1 and its association with various diseases and clinical conditions, has been established by previous studies, as described hereinabove with reference to GAM63.1. Synaptotagmin xi (SYT11, Accession NP_689493.2) is another GAM94 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:10869, to the nucleotide sequence of GAM94 RNA, herein designated GAM RNA, also designated SEQ ID:332.

Another function of GAM94 is therefore inhibition of Synaptotagmin xi (SYT11, Accession NP_689493.2). Accordingly, utilities of GAM94 include diagnosis, prevention and treatment of diseases and clinical conditions associated with SYT11.

T-box 15 (TBX15, Accession NP_689593.1) is another GAM94 target gene, herein designated TARGET GENE. TBX15 BINDING SITE is a target binding site found in the 3' untranslated region of mRNA encoded by TBX15, corresponding to a target binding site such as BINDING SITE I, BINDING SITE II or BINDING SITE III of FIG. 8. Table 4 illustrates the complementarity of the nucleotide sequences of TBX15 BINDING SITE, designated SEQ ID:14891, to the nucleotide sequence of GAM94 RNA, herein designated GAM RNA, also designated SEQ ID:332.

Another function of GAM94 is therefore inhibition of T-box 15 (TBX15, Accession NP_689593.1). Accordingly, utilities of GAM94 include diagnosis, prevention and treatment of diseases and clinical conditions associated with TBX15.

T-box 19 (TBX19, Accession NP_005140.1) is another GAM94 target gene, herein designated TARGET GENE. TBX19 BINDING SITE is a target binding site found in the 3' untranslated region of mRNA encoded by TBX19, corresponding to a target binding site such as BINDING SITE I, BINDING SITE II or BINDING SITE III of FIG. 8. Table 4 illustrates the complementarity of the nucleotide sequences of TBX19 BINDING SITE, designated SEQ ID:12762, to the nucleotide sequence of GAM94 RNA, herein designated GAM RNA, also designated SEQ ID:332.

Another function of GAM94 is therefore inhibition of T-box 19 (TBX19, Accession NP_005140.1). Accordingly, utilities of GAM94 include diagnosis, prevention and treatment of diseases and clinical conditions associated with TBX19.

Teratocarcinoma-derived growth factor 1 (TDGF1, Accession NP_003203.1) is another GAM94 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:5595, to the nucleotide sequence of GAM94 RNA, herein designated GAM RNA, also designated SEQ ID:332.

Another function of GAM94 is therefore inhibition of Teratocarcinoma-derived growth factor 1 (TDGF1, Accession NP_003203.1), a gene which can play a role in the determination of the epiblastic cells that subsequently give rise to the mesoderm. and therefore may be associated with Forebrain defects. Accordingly, utilities of GAM94 include diagnosis, prevention and treatment of Forebrain defects, and of other diseases and clinical conditions associated with TDGF1.

The function of TDGF1 and its association with various diseases and clinical conditions, has been established by previous studies, as described hereinabove with reference to GAM30.1. TED (Accession NP_056501.1) is another GAM94 target gene, herein designated TARGET GENE. TED BINDING SITE is a target binding site found in the 3' untranslated region of mRNA encoded by TED, corresponding to a target binding site such as BINDING SITE I, BINDING SITE II or BINDING SITE III of FIG. 8. Table 4 illustrates the complementarity of the nucleotide sequences of TED BINDING SITE, designated SEQ ID:8214, to the nucleotide sequence of GAM94 RNA, herein designated GAM RNA, also designated SEQ ID:332.

Another function of GAM94 is therefore inhibition of TED (Accession NP_056501.1). Accordingly, utilities of GAM94 include diagnosis, prevention and treatment of diseases and clinical conditions associated with TED.

TEM8 (Accession NP_444262.1) is another GAM94 target gene, herein designated TARGET GENE. TEM8 BINDING SITE is a target binding site found in the 3' untranslated region of multiple transcripts of mRNA encoded by TEM8, corresponding to a target binding site such as BINDING SITE I, BINDING SITE II or BINDING SITE III of FIG. 8. Table 4 illustrates the complementarity of the nucleotide sequences of TEM8 BINDING SITE, designated SEQ ID:7297, to the nucleotide sequence of GAM94 RNA, herein designated GAM RNA, also designated SEQ ID:332.

Another function of GAM94 is therefore inhibition of TEM8 (Accession NP_444262.1), a gene which is a tumor-specific endothelial marker and therefore may be associated with Colorectal cancer. Accordingly, utilities of GAM94 include diagnosis, prevention and treatment of Colorectal cancer, and of other diseases and clinical conditions associated with TEM8.

The function of TEM8 has been established by previous studies. St. Croix et al. (2000) compared gene expression patterns of endothelial cells derived from blood vessels of normal and malignant colorectal tissues to identify genes involved in tumor angiogenesis. Among the genes they identified was TEM8, which encodes a 564-amino acid protein. Bradley et al. (2001) isolated a cDNA encoding ATR and determined that the first 364 amino acids of the 368-amino acid ATR protein are identical to those of TEM8. The C-terminal ends of the ATR and TEM8 proteins then diverge, presumably due to alternative splicing, such that ATR has a cytoplasmic tail of only 25 amino acids, whereas TEM8 has a cytoplasmic tail of 221 amino acids. (Bradley et al. (2001) noted in proof that another apparently full-length ATR/TEM8-related cDNA clone (GenBank BC01207) encodes a protein with yet another C-terminal end.) The ATR protein contains a 27-amino acid signal peptide; a 293-amino acid extracellular domain with 3 putative end-length glycosylation sites; and a 23-amino acid putative transmembrane region followed by the short cytoplasmic tail. An extracellular von Willebrand factor type A (VWA) domain is located between residues 44 and 216 of the ATR protein. The cytoplasmic tail of ATR contains an acidic cluster (EESEE) similar to a motif in the cytoplasmic tail of furin (OMIM Ref. No. 136950) that specifies basolateral sorting of this protease in polarized epithelial cells. The mouse homolog of ATR/TEM8 is highly related to the human clones, showing more than 98% sequence identity in the extracellular domain. ATR and/or TEM8 is expressed in a number of different tissues, including central nervous system, heart, lung, and lymphocytes. Bradley et al. (2001) confirmed that the VWA domain of ATR binds directly to the protective antigen of anthrax, suggesting that ATR may also function as a protective antigen receptor. They suggested that the finding that the soluble VWA domain of ATR inhibits toxin action, coupled with the use of the cloned receptor as a tool for identifying inhibitors of the protective antigen-receptor interaction, holds promise for the development of novel approaches for the treatment of anthrax.

Full details of the abovementioned studies are described in the following publications, the disclosure of which are hereby incorporated by reference:

St. Croix, B.; Rago, C.; Velculescu, V.; Traverso, G.; Romans, K. E.; Montgomery, E.; Lal, A.; Riggins, G. J.; Lengauer, C.; Vogelstein, B.; Kinzler, K. W.: Genes expressed in human tumor endothelium. Science 289:1197-1202, 2000; and Bradley, K. A.; Mogridge, J.; Mourez, M.; Collier, R. J.; Young, J. A. T.: Identification of the cellular receptor for anthrax toxin. Nature 414:160-161, 2001.

Further studies establishing the function and utilities of TEM8 are found in John Hopkins OMIM database record ID 606410, and in cited publications listed in Table 5, which are hereby incorporated by reference. Telomeric repeat binding factor 2, interacting protein (TERF2IP, Accession NP_061848.1) is another GAM94 target gene, herein designated TARGET GENE. TERF2IP BINDING SITE is a target binding site found in the 3' untranslated region of mRNA encoded by TERF2IP, corresponding to a target binding site such as BINDING SITE I, BINDING SITE II or BINDING SITE III of FIG. 8. Table 4 illustrates the complementarity of the nucleotide sequences of TERF2IP BINDING SITE, designated SEQ ID:4291, to the nucleotide sequence of GAM94 RNA, herein designated GAM RNA, also designated SEQ ID:332.

Another function of GAM94 is therefore inhibition of Telomeric repeat binding factor 2, interacting protein (TERF2IP, Accession NP_061848.1). Accordingly, utilities of GAM94 include diagnosis, prevention and treatment of diseases and clinical conditions associated with TERF2IP.

Transforming growth factor, alpha (TGFA, Accession NP_003227.1) is another GAM94 target gene, herein designated TARGET GENE. TGFA BINDING SITE is a target binding site found in the 3' untranslated region of mRNA encoded by TGFA, corresponding to a target binding site such as BINDING SITE I, BINDING SITE II or BINDING SITE III of FIG. 8. Table 4 illustrates the complementarity of the nucleotide sequences of TGFA BINDING SITE, designated SEQ ID:6056, to the nucleotide sequence of GAM94 RNA, herein designated GAM RNA, also designated SEQ ID:332.

Another function of GAM94 is therefore inhibition of Transforming growth factor, alpha (TGFA, Accession NP_003227.1), a gene which is able to bind to the egf receptor and to act synergistically with tgf beta to promote anchorage-independent cell proliferation in soft agar. Accordingly, utilities of GAM94 include diagnosis, prevention and treatment of diseases and clinical conditions associated with TGFA.

The function of TGFA has been established by previous studies. Ellis et al. (1987) presented evidence that TGFA plays a role in certain paraneoplastic manifestations of melanoma: the sign of Leser-Trelat (the sudden appearance of, or increase in the number and size of, seborrheic keratoses), acanthosis nigricans, and eruptive acrochordons (sudden onset of multiple skin tags). Fernandez-Larrea et al. (1999) used the 2-hybrid screen to identify pro-TGF-alpha cytoplasmic domain-binding proteins, which they referred to as TACIPs (pro-TGF-alpha cytoplasmic domain- interacting proteins), involved in the trafficking of pro-TGF-alpha. They cloned 2 such proteins, which they designated TACIP1 (OMIM Ref. No. 601017) and TACIP18 (OMIM Ref. No. 602217). The circadian clock in the suprachiasmatic nucleus is thought to drive daily rhythms of behavior by secreting factors that act locally within the hypothalamus. In a systematic screen, Kramer et al. (2001) identified TGFA as a likely suprachiasmatic nucleus inhibitor of locomotion. TGFA is expressed rhythmically in the suprachiasmatic nucleus, and when infused into the third ventricle it reversibly inhibited locomotor activity and disrupted circadian sleep-wake cycles. These actions were mediated by EGF receptors on neurons in the hypothalamic subparaventricular zone. Mice with a hypomorphic EGF receptor mutation exhibited excessive daytime locomotor activity and failed to suppress activity when exposed to light. Kramer et al. (2001) concluded that their results implicate EGF receptor signaling in the daily control of locomotor activity. They identified a neural circuit in the hypothalamus that likely mediates the regulation of behavior both by the suprachiasmatic nucleus and the retina using TGFA and EGF receptors in the retinohypothalamic tract.

Full details of the abovementioned studies are described in the following publications, the disclosure of which are hereby incorporated by reference:

Fernandez-Larrea, J.; Merlos-Suarez, A.; Urena, J. M.; Baselga, J.; Arribas, J. : A role for a PDZ protein in the early secretory pathway for the targeting of proTGF- alpha to the cell surface. Molec. Cell 3:423-433, 1999; and Kramer, A.; Yang, F.-C.; Snodgrass, P.; Li, X.; Scammell, T. E.; Davis, F. C.; Weitz, C. J.: Regulation of daily locomotor activity and sleep by hypothalamic EGF receptor signaling. S.

Further studies establishing the function and utilities of TGFA are found in John Hopkins OMIM database record ID 190170, and in cited publications listed in Table 5, which are hereby incorporated by reference. Transglutaminase 3 (e polypeptide, protein-glutamine-gamma-glutamyltransferase) (TGM3, Accession NP_003236.1) is another GAM94 target gene, herein designated TARGET GENE. TGM3 BINDING SITE is a target binding site found in the 5' untranslated region of mRNA encoded by TGM3, corresponding to a target binding site such as BINDING SITE I, BINDING SITE II or BINDING SITE III of FIG. 8. Table 4 illustrates the complementarity of the nucleotide sequences of TGM3 BINDING SITE, designated SEQ ID:14294, to the nucleotide sequence of GAM94 RNA, herein designated GAM RNA, also designated SEQ ID:332.

Another function of GAM94 is therefore inhibition of Transglutaminase 3 (e polypeptide, protein-glutamine-gamma-glutamyltransferase) (TGM3, Accession NP_003236.1), a gene which is cross-links structural proteins and forms the cornified cell envelope. Accordingly, utilities of GAM94 include diagnosis, prevention and treatment of diseases and clinical conditions associated with TGM3.

The function of TGM3 has been established by previous studies. Kim et al. (1994) demonstrated that TGM3 is encoded by a gene of 42.8 kb containing 13 exons. Kim et al. (1994) compared the exon/intron organization with that of the other transglutaminase genes and suggested on this basis and on the basis of sequence homologies that TGM2 and TGM3 belong to a branch of a phylogenetic tree distinct from other transglutaminases. Using a combination of primer extension and PCR with degenerate oligonucleotide primers based on the partial protein sequence of guinea pig TGase3, Kim et al. (1993) isolated partial TGase3 cDNAs from newborn mouse and human foreskin epidermis. The authors used a combination of techniques to clone additional cDNAs corresponding to the entire coding regions of both human and mouse TGase3. The predicted proteins contain 692 amino acids and are 75% identical. Most of the sequence variation occurs in the vicinity of the proteolytic activation site, which lies at the most flexible and hydrophilic region of the molecule. Kim et al. (1993) suggested that cleavage of this exposed flexible hinge region promotes a conformational change in the protein to a more compact form, resulting in activation of the enzyme. When expressed in yeast cells, human TGase3 exhibited significant transglutaminase activity. Northern blot analysis revealed that the 2.9-kb TGase3 mRNA is expressed in human foreskin and in mouse epidermis and hair follicles. TGase3 expression in mammalian cells was regulated by calcium, as with other late epidermal differentiation products such as loricrin (OMIM Ref. No. 152445) and profilaggrin (OMIM Ref. No. 135940), suggesting to the authors that TGase3 is responsible for the later stages of cell envelope formation in the epidermis and hair follicle.

Full details of the abovementioned studies are described in the following publications, the disclosure of which are hereby incorporated by reference:

Kim, I.-G.; Lee, S.-C.; Lee, J.-H.; Yang, J.-M.; Chung, S.-I.; Steinert, P. M. : Structure and organization of the human transglutaminase 3 gene: evolutionary relationship to the transglutaminase family. J. Invest. Derm. 103:137-142, 1994; and Kim, I.-G.; Gorman, J. J.; Park, S.-C.; Chung, S.-I.; Steinert, P. M.: The deduced sequence of the novel protransglutaminase E (TGase3) of human and mouse. J. Biol. Chem. 268:12682-126.

Further studies establishing the function and utilities of TGM3 are found in John Hopkins OMIM database record ID 600238, and in cited publications listed in Table 5, which are hereby incorporated by reference. THSD2 (Accession NP_116173.2) is another GAM94 target gene, herein designated TARGET GENE. THSD2 BINDING SITE is a target binding site found in the 5' untranslated region of mRNA encoded by THSD2, corresponding to a target binding site such as BINDING SITE I, BINDING SITE II or BINDING SITE III of FIG. 8. Table 4 illustrates the complementarity of the nucleotide sequences of THSD2 BINDING SITE, designated SEQ ID:2496, to the nucleotide sequence of GAM94 RNA, herein designated GAM RNA, also designated SEQ ID:332.

Another function of GAM94 is therefore inhibition of THSD2 (Accession NP_116173.2). Accordingly, utilities of GAM94 include diagnosis, prevention and treatment of diseases and clinical conditions associated with THSD2.

Thiamine triphosphatase (THTPA, Accession NP_077304.1) is another GAM94 target gene, herein designated TARGET GENE. THTPA BINDING SITE is a target binding site found in the 3' untranslated region of mRNA encoded by THTPA, corresponding to a target binding site such as BINDING SITE I, BINDING SITE II or BINDING SITE III of FIG. 8. Table 4 illustrates the complementarity of the nucleotide sequences of THTPA BINDING SITE, designated SEQ ID:2304, to the nucleotide sequence of GAM94 RNA, herein designated GAM RNA, also designated SEQ ID:332.

Another function of GAM94 is therefore inhibition of Thiamine triphosphatase (THTPA, Accession NP_077304.1). Accordingly, utilities of GAM94 include diagnosis, prevention and treatment of diseases and clinical conditions associated with THTPA.

Transducin-like enhancer of split 1 (e(sp1) homolog, drosophila) (TLE1, Accession NP_005068.2) is another GAM94 target gene, herein designated TARGET GENE. TLE1 BINDING SITE1 and TLE1 BINDING SITE2 are target binding sites found in untranslated regions of mRNA encoded by TLE1, corresponding to target binding sites such as BINDING SITE I, BINDING SITE II or BINDING SITE III of FIG. 8. Table 4 illustrates the complementarity of the nucleotide sequences of TLE1 BINDING SITE1 and TLE1 BINDING SITE2, designated SEQ ID:12325 and SEQ ID:2500 respectively, to the nucleotide sequence of GAM94 RNA, herein designated GAM RNA, also designated SEQ ID:332.

Another function of GAM94 is therefore inhibition of Transducin-like enhancer of split 1 (e(sp1) homolog, drosophila) (TLE1, Accession NP_005068.2), a gene which plays a role during epithelial differentiation. Accordingly, utilities of GAM94 include diagnosis, prevention and treatment of diseases and clinical conditions associated with TLE1.

The function of TLE1 has been established by previous studies. Stifani et al. (1992) described human homologs of Drosophila groucho protein; these were designated TLE for 'transducin-like enhancer of split.' Miyasaka et al. (1993) reported the cDNA cloning, nucleotide and deduced amino acid sequencing, and tissue- specific expression of mouse and human TLE genes (also known as ESG for 'enhancer of split groucho'). By Southern blot analysis of genomic DNA from human/Chinese hamster somatic hybrid cell lines, Miyasaka et al. (1993) mapped the human TLE1 gene to chromosome 9 and the TLE3 gene (OMIM Ref. No. 600190) to chromosome 15. Although they mapped the TLE3 gene to 15q22, Liu et al. (1996) found that the TLE1 and TLE2 (OMIM Ref. No. 601041) genes are organized in a tandem array on 19p13.3. These assignments were determined by fluorescence in situ hybridization (FISH). Liu et al. (1996) showed that expression of individual TLE genes correlated with immature epithelial cells that are progressing toward that terminally differentiated state, suggesting a role during epithelial differentiation. In both normal tissues and tissues resulting from incorrect or incomplete maturation events (such as metaplastic and neoplastic transformations), TLE expression was elevated and coincided with 'Notch' (OMIM Ref. No. 190198) expression, implicating these molecules in the maintenance of the undifferentiated state in epithelial cells. By FISH, Liu et al. (1996) found a TLE-related gene on chromosome 9q22 and concluded that it represents a new TLE gene or a pseudogene.

Full details of the abovementioned studies are described in the following publications, the disclosure of which are hereby incorporated by reference:

Miyasaka, H.; Choudhury, B. K.; Hou, E. W.; Li, S. S.-L.: Molecular cloning and expression of mouse and human cDNA encoding AES and ESG proteins with strong similarity to Drosophila enhancer of split groucho protein. Europ. J. Biochem. 216:343-352, 1993; and Liu, Y.; Dehni, G.; Purcell, K. J.; Sokolow, J.; Carcangiu, M. L.; Artavanis- Tsakonas, S.; Stifani, S.: Epithelial expression and chromosomal location of human TLE genes: implications f.

Further studies establishing the function and utilities of TLE1 are found in John Hopkins OMIM database record ID 600189, and in cited publications listed in Table 5, which are hereby incorporated by reference. Transmembrane 7 superfamily member 2 (TM7SF2, Accession NP_003264.1) is another GAM94 target gene, herein designated TARGET GENE. TM7SF2 BINDING SITE is a target binding site found in the 3' untranslated region of mRNA encoded by TM7SF2, corresponding to a target binding site such as BINDING SITE I, BINDING SITE II or BINDING SITE III of FIG. 8. Table 4 illustrates the complementarity of the nucleotide sequences of TM7SF2 BINDING SITE, designated SEQ ID:5692, to the nucleotide sequence of GAM94 RNA, herein designated GAM RNA, also designated SEQ ID:332.

Another function of GAM94 is therefore inhibition of Transmembrane 7 superfamily member 2 (TM7SF2, Accession NP_003264.1). Accordingly, utilities of GAM94 include diagnosis, prevention and treatment of diseases and clinical conditions associated with TM7SF2.

Transmembrane, prostate androgen induced rna (TMEPAI, Accession NP_064567.2) is another GAM94 target gene, herein designated TARGET GENE. TMEPAI BINDING SITE is a target binding site found in the 3' untranslated region of mRNA encoded by TMEPAI, corresponding to a target binding site such as BINDING SITE I, BINDING SITE II or BINDING SITE III of FIG. 8. Table 4 illustrates the complementarity of the nucleotide sequences of TMEPAI BINDING SITE, designated SEQ ID:11793, to the nucleotide sequence of GAM94 RNA, herein designated GAM RNA, also designated SEQ ID:332.

Another function of GAM94 is therefore inhibition of Transmembrane, prostate androgen induced rna (TMEPAI, Accession NP_064567.2). Accordingly, utilities of GAM94 include diagnosis, prevention and treatment of diseases and clinical conditions associated with TMEPAI.

Tumor necrosis factor receptor superfamily, member 13b (TNFRSF13B, Accession NP_036584.1) is another GAM94 target gene, herein designated TARGET GENE. TNFRSF13B BINDING SITE is a target binding site found in the 3' untranslated region of mRNA encoded by TNFRSF13B, corresponding to a target binding site such as BINDING SITE I, BINDING SITE II or BINDING SITE III of FIG. 8. Table 4 illustrates the complementarity of the nucleotide sequences of TNFRSF13B BINDING SITE, designated SEQ ID:17895, to the nucleotide sequence of GAM94 RNA, herein designated GAM RNA, also designated SEQ ID:332.

Another function of GAM94 is therefore inhibition of Tumor necrosis factor receptor superfamily, member 13b (TNFRSF13B, Accession NP_036584.1). Accordingly, utilities of GAM94 include diagnosis, prevention and treatment of diseases and clinical conditions associated with TNFRSF13B.

Trophoblast glycoprotein (TPBG, Accession NP_006661.1) is another GAM94 target gene, herein designated TARGET GENE. TPBG BINDING SITE is a target binding site found in the 5' untranslated region of mRNA encoded by TPBG, corresponding to a target binding site such as BINDING SITE I, BINDING SITE II or BINDING SITE III of FIG. 8. Table 4 illustrates the complementarity of the nucleotide sequences of TPBG BINDING SITE, designated SEQ ID:3490, to the nucleotide sequence of GAM94 RNA, herein designated GAM RNA, also designated SEQ ID:332.

Another function of GAM94 is therefore inhibition of Trophoblast glycoprotein (TPBG, Accession NP_006661.1). Accordingly, utilities of GAM94 include diagnosis, prevention and treatment of diseases and clinical conditions associated with TPBG.

Tripartite motif-containing 38 (TRIM38, Accession NP_006346.1) is another GAM94 target gene, herein designated TARGET GENE. TRIM38 BINDING SITE is a target binding site found in the 3' untranslated region of mRNA encoded by TRIM38, corresponding to a target binding site such as BINDING SITE I, BINDING SITE II or BINDING SITE III of FIG. 8. Table 4 illustrates the complementarity of the nucleotide sequences of TRIM38 BINDING SITE, designated SEQ ID:19253, to the nucleotide sequence of GAM94 RNA, herein designated GAM RNA, also designated SEQ ID:332.

Another function of GAM94 is therefore inhibition of Tripartite motif-containing 38 (TRIM38, Accession NP_006346.1). Accordingly, utilities of GAM94 include diagnosis, prevention and treatment of diseases and clinical conditions associated with TRIM38.

TRIM56 (Accession NP_112223.1) is another GAM94 target gene, herein designated TARGET GENE. TRIM56 BINDING SITE is a target binding site found in the 5' untranslated region of multiple transcripts of mRNA encoded by TRIM56, corresponding to a target binding site such as BINDING SITE I, BINDING SITE II or BINDING SITE III of FIG. 8. Table 4 illustrates the complementarity of the nucleotide sequences of TRIM56 BINDING SITE, designated SEQ ID:17780, to the nucleotide sequence of GAM94 RNA, herein designated GAM RNA, also designated SEQ ID:332.

Another function of GAM94 is therefore inhibition of TRIM56 (Accession NP_112223.1). Accordingly, utilities of GAM94 include diagnosis, prevention and treatment of diseases and clinical conditions associated with TRIM56.

TRIM56 (Accession XP_168586.1) is another GAM94 target gene, herein designated TARGET GENE. TRIM56 BINDING SITE is a target binding site found in the 5' untranslated region of multiple transcripts of mRNA encoded by TRIM56, corresponding to a target binding site such as BINDING SITE I, BINDING SITE II or BINDING SITE III of FIG. 8. Table 4 illustrates the complementarity of the nucleotide sequences of TRIM56 BINDING SITE, designated SEQ ID:17780, to the nucleotide sequence of GAM94 RNA, herein designated GAM RNA, also designated SEQ ID:332.

Another function of GAM94 is therefore inhibition of TRIM56 (Accession XP_168586.1). Accordingly, utilities of GAM94 include diagnosis, prevention and treatment of diseases and clinical conditions associated with TRIM56.

Transient receptor potential cation channel, subfamily m, member 1 (TRPM1, Accession NP_002411.2) is another GAM94 target gene, herein designated TARGET GENE. TRPM1 BINDING SITE1 and TRPM1 BINDING SITE2 are target binding sites found in untranslated regions of mRNA encoded by TRPM1, corresponding to target binding sites such as BINDING SITE I, BINDING SITE II or BINDING SITE III of FIG. 8. Table 4 illustrates the complementarity of the nucleotide sequences of TRPM1 BINDING SITE1 and TRPM1 BINDING SITE2, designated SEQ ID:13846 and SEQ ID:12837 respectively, to the nucleotide sequence of GAM94 RNA, herein designated GAM RNA, also designated SEQ ID:332.

Another function of GAM94 is therefore inhibition of Transient receptor potential cation channel, subfamily m, member 1 (TRPM1, Accession NP_002411.2), a gene which is suggested to mediate calcium entry. Accordingly, utilities of GAM94 include diagnosis, prevention and treatment of diseases and clinical conditions associated with TRPM1.

The function of TRPM1 has been established by previous studies. Hunter et al. (1998) cloned the human melastatin cDNA from a retina cDNA library. The gene encodes a 1,533-amino acid polypeptide with homology to members of the transient receptor potential (Trp) family of calcium channels (see OMIM Ref. No. TRPC1; 602343). They also cloned the mouse melastatin genomic region and found that the promoter contains 4 consensus binding sites for the microphthalmia-associated transcription factor (MITF; 156845). One of these binding sites is an M box, a motif shared by the tyrosinase pigmentation genes (see OMIM Ref. No. TYRP1; 115501). Xu et al. (2001) found that TRPM1 mediates Ca(2+) entry when expressed in HEK293 cells. They found that a short form of TRPM1 interacts directly with and suppresses the activity of full-length TRPM1, possibly by inhibiting translocation of the full-length form to the plasma membrane. Using differential display analysis, Fang and Setaluri (2000) found TRPM1 among genes overexpressed in pigmented metastatic human melanoma cells treated with the differentiation inducer hexamethylene bisacetamide (HMBA). They found multiple short transcripts, from both the 5-prime and 3-prime ends of TRPM1, in melanocytes and pigmented metastatic melanoma cell lines. They found the full-length 5.4-kb transcript only in melanocytes. Northern blot and RT-PCR analysis demonstrated that HMBA treatment upregulates expression of the full-length and a 5-prime short form of TRPM1.

Full details of the abovementioned studies are described in the following publications, the disclosure of which are hereby incorporated by reference:

Hunter, J. J.; Shao, J.; Smutko, J. S.; Dussault, B. J.; Nagle, D. L.; Woolf, E. A.; Holmgren, L. M.; Moore, K. J.; Shyjan, A. W.: Chromosomal localization and genomic characterization of the mouse melastatin gene (Mlsn1). Genomics 54:116-123, 1998; and Xu, X. Z.; Moebius, F.; Gill, D. L.; Montell, C.: Regulation of melastatin, a TRP-related protein, through interaction with a cytoplasmic isoform. Proc. Nat. Acad. Sci. 98:10692-10697, 20.

Further studies establishing the function and utilities of TRPM1 are found in John Hopkins OMIM database record ID 603576, and in cited publications listed in Table 5, which are hereby incorporated by reference. Transient receptor potential cation channel, subfamily m, member 3 (TRPM3, Accession NP_079247.2) is another GAM94 target gene, herein designated TARGET GENE. TRPM3 BINDING SITE is a target binding site found in the 3' untranslated region of mRNA encoded by TRPM3, corresponding to a target binding site such as BINDING SITE I, BINDING SITE II or BINDING SITE III of FIG. 8. Table 4 illustrates the complementarity of the nucleotide sequences of TRPM3 BINDING SITE, designated SEQ ID:13071, to the nucleotide sequence of GAM94 RNA, herein designated GAM RNA, also designated SEQ ID:332.

Another function of GAM94 is therefore inhibition of Transient receptor potential cation channel, subfamily m, member 3 (TRPM3, Accession NP_079247.2). Accordingly, utilities of GAM94 include diagnosis, prevention and treatment of diseases and clinical conditions associated with TRPM3.

Txk tyrosine kinase (TXK, Accession NP_003319.1) is another GAM94 target gene, herein designated TARGET GENE. TXK BINDING SITE is a target binding site found in the 3' untranslated region of mRNA encoded by TXK, corresponding to a target binding site such as BINDING SITE I, BINDING SITE II or BINDING SITE III of FIG. 8. Table 4 illustrates the complementarity of the nucleotide sequences of TXK BINDING SITE, designated SEQ ID:19521, to the nucleotide sequence of GAM94 RNA, herein designated GAM RNA, also designated SEQ ID:332.

Another function of GAM94 is therefore inhibition of Txk tyrosine kinase (TXK, Accession NP_003319.1), a gene which is a non-receptor protein tyrosine kinase and a member of the Tec subfamily of Src kinases. Accordingly, utilities of GAM94 include diagnosis, prevention and treatment of diseases and clinical conditions associated with TXK.

The function of TXK has been established by previous studies. TXK expression is restricted to the Th1/Th0 subset of T lymphocytes with gamma-interferon (IFNG; 147570)-producing potential. By immunoblot analysis, Takeba et al. (2002) showed that TXK binds to the IFNG promoter in the region -53 to -39 bp from the transcription start site, a site distinct from previously characterized IFNG promoter binding locations. Luciferase reporter analysis indicated that phosphorylated TXK enhances IFNG transcriptional activity severalfold. Comparative sequence analysis established that this DNA-binding motif is conserved not only across mammalian species but also among human Th1 cell-associated protein genes, e.g., CCR5 (OMIM Ref. No. 601373) and TNF (OMIM Ref. No. 191160). Takeba et al. (2002) proposed that TXK acts as a Th1 cell-specific transcription factor Animal model experiments lend further support to the function of TXK. By homologous recombination, Schaeffer et al. (1999) disrupted the Rlk gene in mice. Heterozygotes were completely normal. Homozygous null Rlk mice showed increased amounts of Itk mRNA. The authors hypothesized that upregulation of related Tec kinases may partially compensate for the lack of Rlk. Schaeffer et al. (1999) therefore generated Rlk -/- Itk -/- mice by interbreeding. Itk-deficient mice have reduced numbers of mature T cells, particularly CD4+ cells, causing a decreased CD4- to -CD8 ratio. Rlk -/- Itk -/- mutants, however, had normal T cell numbers. Both CD4+ and CD8+ cell numbers are increased relative to Itk -/- mice. The persistent abnormal ratio of CD4+ to CD8+ cells suggested an altered regulation of lymphoid development and homeostasis in the double mutants. The double mutants had marked defects in T-cell receptor responses including proliferation, cytokine production, and apoptosis in vitro and adaptive immune responses to Toxoplasma gondii in vivo. Molecular events immediately downstream from the T-cell receptor were intact in Rlk -/- Itk -/- cells, but intermediate events including inositol trisphosphate production, calcium mobilization, and mitogen-activated protein kinase activation were impaired, establishing Tec kinases as critical regulators of T-cell receptor signaling required for phospholipase C-gamma activation It is appreciated that the abovementioned animal model for TXK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Takeba, Y.; Nagafuchi, H.; Takeno, M.; Kashiwakura, J.; Suzuki, N.: Txk, a member of nonreceptor tyrosine kinase of Tec family, acts as a Th1 cell-specific transcription factor and regulates IFN-gamma gene transcription. J. Immun. 168: 2365-2370, 2002; and Schaeffer, E. M.; Debnath, J.; Yap, G.; McVicar, D.; Liao, X. C.; Littman, D. R.; Sher, A.; Varmus, H. E.; Lenardo, M. J.; Schwartzberg, P. L.: Requirement for Tec kinases Rlk and Itk in.

Further studies establishing the function and utilities of TXK are found in John Hopkins OMIM database record ID 600058, and in cited publications listed in Table 5, which are hereby incorporated by reference. Ubiquitin-activating enzyme e1 (a1s9t and bn75 temperature sensitivity complementing) (UBE1, Accession NP_003325.2) is another GAM94 target gene, herein designated TARGET GENE. UBE1 BINDING SITE is a target binding site found in the 5' untranslated region of multiple transcripts of mRNA encoded by UBE1, corresponding to a target binding site such as BINDING SITE I, BINDING SITE II or BINDING SITE III of FIG. 8. Table 4 illustrates the complementarity of the nucleotide sequences of UBE1 BINDING SITE, designated SEQ ID:2682, to the nucleotide sequence of GAM94 RNA, herein designated GAM RNA, also designated SEQ ID:332.

Another function of GAM94 is therefore inhibition of Ubiquitin-activating enzyme e1 (a1s9t and bn75 temperature sensitivity complementing) (UBE1, Accession NP_003325.2). Accordingly, utilities of GAM94 include diagnosis, prevention and treatment of diseases and clinical conditions associated with UBE1.

Ubiquitin-conjugating enzyme e2, j1 (ubc6 homolog, yeast) (UBE2J1, Accession NP_057105.1) is another GAM94 target gene, herein designated TARGET GENE. UBE2J1 BINDING SITE is a target binding site found in the 3' untranslated region of multiple transcripts of mRNA encoded by UBE2J1, corresponding to a target binding site such as BINDING SITE I, BINDING SITE II or BINDING SITE III of FIG. 8. Table 4 illustrates the complementarity of the nucleotide sequences of UBE2J1 BINDING SITE, designated SEQ ID:19768, to the nucleotide sequence of GAM94 RNA, herein designated GAM RNA, also designated SEQ ID:332.

Another function of GAM94 is therefore inhibition of Ubiquitin-conjugating enzyme e2, j1 (ubc6 homolog, yeast) (UBE2J1, Accession NP_057105.1). Accordingly, utilities of GAM94 include diagnosis, prevention and treatment of diseases and clinical conditions associated with UBE2J1.

Upstream transcription factor 1 (USF1, Accession NP_009053.1) is another GAM94 target gene, herein designated TARGET GENE. USF1 BINDING SITE is a target binding site found in the 5' untranslated region of mRNA encoded by USF1, corresponding to a target binding site such as BINDING SITE I, BINDING SITE II or BINDING SITE III of FIG. 8. Table 4 illustrates the complementarity of the nucleotide sequences of USF1 BINDING SITE, designated SEQ ID:17504, to the nucleotide sequence of GAM94 RNA, herein designated GAM RNA, also designated SEQ ID:332.

Another function of GAM94 is therefore inhibition of Upstream transcription factor 1 (USF1, Accession NP_009053.1), a gene which is a member of the helix-loop-helix group of regulatory proteins and binds to DNA as a dimer. Accordingly, utilities of GAM94 include diagnosis, prevention and treatment of diseases and clinical conditions associated with USF1.

The function of USF1 has been established by previous studies. The upstream stimulatory factor is a ubiquitously expressed cellular transcription factor that binds to a symmetrical DNA sequence that is found in a variety of viral and cellular promoters. Purified USF consists of 2 related polypeptides of 43 and 44 kD (USF2; 600390). Microsequence analysis of purified USF protein allowed the cloning of the USF gene (Gregor et al., 1990). Hosts and pathogens evolve various responses for controlling infection and evading destruction, respectively. Using column chromatography, Zhong et al. (2001) identified a factor in Chlamydia trachomatis, the causative organism of trachoma and chronic urogenital infection, that degrades the transcription factors RFX5 (OMIM Ref. No. 601863) and USF1. The degradation of these host factors correlates with the suppression of MHC class I and class II antigen expression in infected cells, thereby suppressing the host immune response.

Full details of the abovementioned studies are described in the following publications, the disclosure of which are hereby incorporated by reference:

Gregor, P. D.; Sawadogo, M.; Roeder, R. G.: The adenovirus major late transcription factor USF is a member of the helix-loop-helix group of regulatory proteins and binds to DNA as a dimer. Genes Dev. 4:1730-1740, 1990; and Zhong, G.; Fan, P.; Ji, H.; Dong, F.; Huang, Y.: Identification of a chlamydial protease-like activity factor responsible for the degradation of host transcription factors. J. Exp. Med.

Further studies establishing the function and utilities of USF1 are found in John Hopkins OMIM database record ID 191523, and in cited publications listed in Table 5, which are hereby incorporated by reference. Ubiquitin specific protease 14 (trna-guanine transglycosylase) (USP14, Accession NP_005142.1) is another GAM94 target gene, herein designated TARGET GENE. USP14 BINDING SITE is a target binding site found in the 3' untranslated region of mRNA encoded by USP14, corresponding to a target binding site such as BINDING SITE I, BINDING SITE II or BINDING SITE III of FIG. 8. Table 4 illustrates the complementarity of the nucleotide sequences of USP14 BINDING SITE, designated SEQ ID:1660, to the nucleotide sequence of GAM94 RNA, herein designated GAM RNA, also designated SEQ ID:332.

Another function of GAM94 is therefore inhibition of Ubiquitin specific protease 14 (trna-guanine transglycosylase) (USP14, Accession NP_005142.1), a gene which is similar to ubiquitin-specific cysteine (thiol) proteases and tRNA-guanine transglycosylase. Accordingly, utilities of GAM94 include diagnosis, prevention and treatment of diseases and clinical conditions associated with USP14.

The function of USP14 has been established by previous studies. Using Tgt purified from rabbit erythrocytes, Deshpande et al. (1996) measured significant tRNA-guanine transglycosylase activity. Noting significant sequence similarity between Tgt and the deubiquitinating enzyme family, they proposed that Tgt may act as a signal to link deficiency of the transglycosylase product, queuosine, to the ubiquitin- dependent proteolytic pathway for the removal of abnormal or inappropriately expressed proteins. The International Radiation Hybrid Mapping Consortium mapped the USP14 gene to chromosome 18 (SJGC-11272). Wilson et al. (2002) stated that 2 human neurologic disorders possibly involving alterations of synaptic function map to 18p near USP14: major affective disorder-1 (MAFD1; 125480) and schizophrenia disorder 8 (SCZD8; 603206).

Animal model experiments lend further support to the function of USP14. Mice that are homozygous with respect to the spontaneous mutation ax(J) in the ataxia (ax) gene develop severe tremors by 2 to 3 weeks of age followed by hindlimb paralysis and death by 6 to 10 weeks of age. Wilson et al. (2002) showed that ax encodes Usp14, one of the large family of cysteine proteases that specifically feed ubiquitin conjugates. Although Usp14 can cleave a ubiquitin-tagged protein in vitro, it is unable to process polyubiquitin, which is belived to be associated with the protein aggregates seen in Parkinson disease, spinocerebellar ataxia type 1 (SCA1; 164400), and gracile axonal dystrophy (GAD) in mice. The physiologic substrate of Usp14 may therefore contain a monoubiquitin side chain, the removal of which would regulate processes such as protein localization and protein activity. Expression of Usp14 is altered in homozygous ax(J) mice as a result of the insertion of an intracisternal A particle (IAP) into intron 5 of Usp14. In contrast to other neurodegenerative disorders such as Parkinson disease and SCA1 in humans and GAD in mice, neither ubiquitin-positive protein aggregates nor neuronal cell loss was detectable in the CNS of ax(J) mice. Instead, these mice had defects in synaptic transmission in both the central and peripheral nervous systems. These results suggested that ubiquitin proteases are important in regulating synaptic activity in mammals.

It is appreciated that the abovementioned animal model for USP14 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Deshpande, K. L.; Seubert, P. H.; Tillman, D. M.; Farkas, W. R.; Katze, J. R.: Cloning and characterization of cDNA encoding the rabbit tRNA-guanine transglycosylase 60-kilodalton subunit. Arch. Biochem. Biophys. 326:1-7, 1996; and Wilson, S. M.; Bhattacharyy, B.; Rachel, R. A.; Coppola, V.; Tessarollo, L.; Householder, D. B.; Fletcher, C. F.; Miller, R. J.; Copeland, N. G.; Jenkins, N. A.: Synaptic defects in at.

Further studies establishing the function and utilities of USP14 are found in John Hopkins OMIM database record ID 607274, and in cited publications listed in Table 5, which are hereby incorporated by reference. Vitamin d (1,25- dihydroxyvitamin d3) receptor (VDR, Accession NP_000367.1) is another GAM94 target gene, herein designated TARGET GENE. VDR BINDING SITE is a target binding site found in the 3' untranslated region of mRNA encoded by VDR, corresponding to a target binding site such as BINDING SITE I, BINDING SITE II or BINDING SITE III of FIG. 8. Table 4 illustrates the complementarity of the nucleotide sequences of VDR BINDING SITE, designated SEQ ID:5451, to the nucleotide sequence of GAM94 RNA, herein designated GAM RNA, also designated SEQ ID:332.

Another function of GAM94 is therefore inhibition of Vitamin d (1,25-dihydroxyvitamin d3) receptor (VDR, Accession NP_000367.1). Accordingly, utilities of GAM94 include diagnosis, prevention and treatment of diseases and clinical conditions associated with VDR.

Vascular endothelial growth factor b (VEGFB, Accession NP_003368.1) is another GAM94 target gene, herein designated TARGET GENE. VEGFB BINDING SITE is a target binding site found in the 3' untranslated region of mRNA encoded by VEGFB, corresponding to a target binding site such as BINDING SITE I, BINDING SITE II or BINDING SITE III of FIG. 8. Table 4 illustrates the complementarity of the nucleotide sequences of VEGFB BINDING SITE, designated SEQ ID:20042, to the nucleotide sequence of GAM94 RNA, herein designated GAM RNA, also designated SEQ ID:332.

Another function of GAM94 is therefore inhibition of Vascular endothelial growth factor b (VEGFB, Accession NP_003368.1), a gene which is a growth factor for endothelial cells. Accordingly, utilities of GAM94 include diagnosis, prevention and treatment of diseases and clinical conditions associated with VEGFB.

The function of VEGFB and its association with various diseases and clinical conditions, has been established by previous studies, as described hereinabove with reference to GAM47.1. VGLL2 (Accession NP_703154.1) is another GAM94 target gene, herein designated TARGET GENE. VGLL2 BINDING SITE is a target binding site found in the 3' untranslated region of mRNA encoded by VGLL2, corresponding to a target binding site such as BINDING SITE I, BINDING SITE II or BINDING SITE III of FIG. 8. Table 4 illustrates the complementarity of the nucleotide sequences of VGLL2 BINDING SITE, designated SEQ ID:1486, to the nucleotide sequence of GAM94 RNA, herein designated GAM RNA, also designated SEQ ID:332.

Another function of GAM94 is therefore inhibition of VGLL2 (Accession NP_703154.1). Accordingly, utilities of GAM94 include diagnosis, prevention and treatment of diseases and clinical conditions associated with VGLL2.

Vanin 1 (VNN1, Accession NP_004657.1) is another GAM94 target gene, herein designated TARGET GENE. VNN1 BINDING SITE is a target binding site found in the 3' untranslated region of mRNA encoded by VNN1, corresponding to a target binding site such as BINDING SITE I, BINDING SITE II or BINDING SITE III of FIG. 8. Table 4 illustrates the complementarity of the nucleotide sequences of VNN1 BINDING SITE, designated SEQ ID:11888, to the nucleotide sequence of GAM94 RNA, herein designated GAM RNA, also designated SEQ ID:332.

Another function of GAM94 is therefore inhibition of Vanin 1 (VNN1, Accession NP_004657.1), a gene which may regulate steps in thymus homing and play a role in mammalian sexual development. Accordingly, utilities of GAM94 include diagnosis, prevention and treatment of diseases and clinical conditions associated with VNN1.

The function of VNN1 and its association with various diseases and clinical conditions, has been established by previous studies, as described hereinabove with reference to GAM65.1. Vacuolar protein sorting 41 (yeast) (VPS41, Accession NP_055211.1) is another GAM94 target gene, herein designated TARGET GENE. VPS41 BINDING SITE is a target binding site found in the 3' untranslated region of multiple transcripts of mRNA encoded by VPS41, corresponding to a target binding site such as BINDING SITE I, BINDING SITE II or BINDING SITE III of FIG. 8. Table 4 illustrates the complementarity of the nucleotide sequences of VPS41 BINDING SITE, designated SEQ ID:18763, to the nucleotide sequence of GAM94 RNA, herein designated GAM RNA, also designated SEQ ID:332.

Another function of GAM94 is therefore inhibition of Vacuolar protein sorting 41 (yeast) (VPS41, Accession NP_055211.1). Accordingly, utilities of GAM94 include diagnosis, prevention and treatment of diseases and clinical conditions associated with VPS41.

WDFY2 (Accession NP_443182.1) is another GAM94 target gene, herein designated TARGET GENE. WDFY2 BINDING SITE is a target binding site found in the 3' untranslated region of mRNA encoded by WDFY2, corresponding to a target binding site such as BINDING SITE I, BINDING SITE II or BINDING SITE III of FIG. 8. Table 4 illustrates the complementarity of the nucleotide sequences of WDFY2 BINDING SITE, designated SEQ ID:9273, to the nucleotide sequence of GAM94 RNA, herein designated GAM RNA, also designated SEQ ID:332.

Another function of GAM94 is therefore inhibition of WDFY2 (Accession NP_443182.1). Accordingly, utilities of GAM94 include diagnosis, prevention and treatment of diseases and clinical conditions associated with WDFY2.

WDR22 (Accession XP_031102.1) is another GAM94 target gene, herein designated TARGET GENE. WDR22 BINDING SITE is a target binding site found in the 3' untranslated region of mRNA encoded by WDR22, corresponding to a target binding site such as BINDING SITE I, BINDING SITE II or BINDING SITE III of FIG. 8. Table 4 illustrates the complementarity of the nucleotide sequences of WDR22 BINDING SITE, designated SEQ ID:14695, to the nucleotide sequence of GAM94 RNA, herein designated GAM RNA, also designated SEQ ID:332.

Another function of GAM94 is therefore inhibition of WDR22 (Accession XP_031102.1). Accordingly, utilities of GAM94 include diagnosis, prevention and treatment of diseases and clinical conditions associated with WDR22.

Wd repeat domain 9 (WDR9, Accession NP_061836.2) is another GAM94 target gene, herein designated TARGET GENE. WDR9 BINDING SITE1 and WDR9 BINDING SITE2 are target binding sites found in untranslated regions of multiple transcripts of mRNA encoded by WDR9, corresponding to target binding sites such as BINDING SITE I, BINDING SITE II or BINDING SITE III of FIG. 8. Table 4 illustrates the complementarity of the nucleotide sequences of WDR9 BINDING SITE1 and WDR9 BINDING SITE2, designated SEQ ID:16206 and SEQ ID:2792 respectively, to the nucleotide sequence of GAM94 RNA, herein designated GAM RNA, also designated SEQ ID:332.

Another function of GAM94 is therefore inhibition of Wd repeat domain 9 (WDR9, Accession NP_061836.2). Accordingly, utilities of GAM94 include diagnosis, prevention and treatment of diseases and clinical conditions associated with WDR9.

Tryptophan rich basic protein (WRB, Accession NP_004618.2) is another GAM94 target gene, herein designated TARGET GENE. WRB BINDING SITE is a target binding site found in the 3' untranslated region of mRNA encoded by WRB, corresponding to a target binding site such as BINDING SITE I, BINDING SITE II or BINDING SITE III of FIG. 8. Table 4 illustrates the complementarity of the nucleotide sequences of WRB BINDING SITE, designated SEQ ID:17433, to the nucleotide sequence of GAM94 RNA, herein designated GAM RNA, also designated SEQ ID:332.

Another function of GAM94 is therefore inhibition of Tryptophan rich basic protein (WRB, Accession NP_004618.2). Accordingly, utilities of GAM94 include diagnosis, prevention and treatment of diseases and clinical conditions associated with WRB.

ZFHX2 (Accession XP_033370.7) is another GAM94 target gene, herein designated TARGET GENE. ZFHX2 BINDING SITE is a target binding site found in the 3' untranslated region of mRNA encoded by ZFHX2, corresponding to a target binding site such as BINDING SITE I, BINDING SITE II or BINDING SITE III of FIG. 8. Table 4 illustrates the complementarity of the nucleotide sequences of ZFHX2 BINDING SITE, designated SEQ ID:3631, to the nucleotide sequence of GAM94 RNA, herein designated GAM RNA, also designated SEQ ID:332.

Another function of GAM94 is therefore inhibition of ZFHX2 (Accession XP_033370.7). Accordingly, utilities of GAM94 include diagnosis, prevention and treatment of diseases and clinical conditions associated with ZFHX2.

ZIC4 (Accession NP_115529.2) is another GAM94 target gene, herein designated TARGET GENE. ZIC4 BINDING SITE is a target binding site found in the 3' untranslated region of mRNA encoded by ZIC4, corresponding to a target binding site such as BINDING SITE I, BINDING SITE II or BINDING SITE III of FIG. 8. Table 4 illustrates the complementarity of the nucleotide sequences of ZIC4 BINDING SITE, designated SEQ ID:4435, to the nucleotide sequence of GAM94 RNA, herein designated GAM RNA, also designated SEQ ID:332.

Another function of GAM94 is therefore inhibition of ZIC4 (Accession NP_115529.2). Accordingly, utilities of GAM94 include diagnosis, prevention and treatment of diseases and clinical conditions associated with ZIC4.

Zinc finger protein 228 (ZNF228, Accession NP_037512.1) is another GAM94 target gene, herein designated TARGET GENE. ZNF228 BINDING SITE is a target binding site found in the 5' untranslated region of mRNA encoded by ZNF228, corresponding to a target binding site such as BINDING SITE I, BINDING SITE II or BINDING SITE III of FIG. 8. Table 4 illustrates the complementarity of the nucleotide sequences of ZNF228 BINDING SITE, designated SEQ ID:17645, to the nucleotide sequence of GAM94 RNA, herein designated GAM RNA, also designated SEQ ID:332.

Another function of GAM94 is therefore inhibition of Zinc finger protein 228 (ZNF228, Accession NP_037512.1). Accordingly, utilities of GAM94 include diagnosis, prevention and treatment of diseases and clinical conditions associated with ZNF228.

Zinc finger protein 347 (ZNF347, Accession NP_115973.1) is another GAM94 target gene, herein designated TARGET GENE. ZNF347 BINDING SITE1 through ZNF347 BINDING SITE3 are target binding sites found in untranslated regions of mRNA encoded by ZNF347, corresponding to target binding sites such as BINDING SITE I, BINDING SITE II or BINDING SITE III of FIG. 8. Table 4 illustrates the complementarity of the nucleotide sequences of ZNF347 BINDING SITE1 through ZNF347 BINDING SITE3, designated SEQ ID:13718, SEQ ID:6828 and SEQ ID:17666 respectively, to the nucleotide sequence of GAM94 RNA, herein designated GAM RNA, also designated SEQ ID:332.

Another function of GAM94 is therefore inhibition of Zinc finger protein 347 (ZNF347, Accession NP_115973.1). Accordingly, utilities of GAM94 include diagnosis, prevention and treatment of diseases and clinical conditions associated with ZNF347.

Zinc finger protein 396 (ZNF396, Accession NP_665699.1) is another GAM94 target gene, herein designated TARGET GENE. ZNF396 BINDING SITE is a target binding site found in the 3' untranslated region of mRNA encoded by ZNF396, corresponding to a target binding site such as BINDING SITE I, BINDING SITE II or BINDING SITE III of FIG. 8. Table 4 illustrates the complementarity of the nucleotide sequences of ZNF396 BINDING SITE, designated SEQ ID:12937, to the nucleotide sequence of GAM94 RNA, herein designated GAM RNA, also designated SEQ ID:332.

Another function of GAM94 is therefore inhibition of Zinc finger protein 396 (ZNF396, Accession NP_665699.1). Accordingly, utilities of GAM94 include diagnosis, prevention and treatment of diseases and clinical conditions associated with ZNF396.

ZNF409 (Accession NP_055709.1) is another GAM94 target gene, herein designated TARGET GENE. ZNF409 BINDING SITE is a target binding site found in the 3' untranslated region of mRNA encoded by ZNF409, corresponding to a target binding site such as BINDING SITE I, BINDING SITE II or BINDING SITE III of FIG. 8. Table 4 illustrates the complementarity of the nucleotide sequences of ZNF409 BINDING SITE, designated SEQ ID:18512, to the nucleotide sequence of GAM94 RNA, herein designated GAM RNA, also designated SEQ ID:332.

Another function of GAM94 is therefore inhibition of ZNF409 (Accession NP_055709.1). Accordingly, utilities of GAM94 include diagnosis, prevention and treatment of diseases and clinical conditions associated with ZNF409.

Zinc finger protein 83 (hpf1) (ZNF83, Accession NP_060770.2) is another GAM94 target gene, herein designated TARGET GENE. ZNF83 BINDING SITE is a target binding site found in the 5' untranslated region of mRNA encoded by ZNF83, corresponding to a target binding site such as BINDING SITE I, BINDING SITE II or BINDING SITE III of FIG. 8. Table 4 illustrates the complementarity of the nucleotide sequences of ZNF83 BINDING SITE, designated SEQ ID:5124, to the nucleotide sequence of GAM94 RNA, herein designated GAM RNA, also designated SEQ ID:332.

Another function of GAM94 is therefore inhibition of Zinc finger protein 83 (hpf1) (ZNF83, Accession NP_060770.2). Accordingly, utilities of GAM94 include diagnosis, prevention and treatment of diseases and clinical conditions associated with ZNF83.

FIG. 8 further provides a conceptual description of a novel bioinformatically detected of the present invention, referred to here as Genomic Address Messenger 95 (GAM95), which modulates expression of respective target genes thereof, the function and utility of which target genes is known in the art.

GAM95 is a novel bioinformatically detected regulatory, non protein coding, micro RNA (miRNA) gene. The method by which GAM95 was detected is described hereinabove with reference to FIGS. 8-15.

GAM95 gene, herein designated GAM GENE, and GAM95 target gene, herein designated TARGET GENE, are human genes contained in the human genome.

GAM95 gene encodes a GAM95 precursor RNA, herein designated GAM PRECURSOR RNA. Similar to other miRNA genes, and unlike most ordinary genes, GAM95 precursor RNA does not encode a protein. A nucleotide sequence identical or highly similar to the nucleotide sequence of GAM95 precursor RNA is designated SEQ ID:104, and is provided hereinbelow with reference to the sequence listing part. Nucleotide sequence SEQ ID:104 is located at position 23786019 relative to chromosome 19.

GAM95 precursor RNA folds onto itself, forming GAM95 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM95 precursor RNA folds onto itself, forming GAM95 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM95 precursor RNA, designated SEQ-ID:104, and a schematic representation of a predicted secondary folding of GAM95 folded precursor RNA are further described with reference to Table 2, hereby incorporated by reference.

An enzyme complex designated DICER COMPLEX, 'dices' the GAM95 folded precursor RNA into GAM95 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM95 RNA is designated SEQ ID:273, and is provided hereinbelow with references to the sequence listing part and Table 3, hereby incorporated by reference.

GAM95 target gene, herein designated TARGET GENE, encodes a corresponding messenger RNA, GAM95 target RNA, herein designated GAM TARGET RNA. GAM95 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM95 RNA, herein designated GAM RNA, binds complementarily to one or more target binding sites located in untranslated regions of GAM95 target RNA, herein designated GAM TARGET RNA. This complementary binding is due to the fact that the nucleotide sequence of GAM95 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM95 RNA may have a different number of target binding sites in untranslated regions of a GAM95 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM95 RNA, herein designated GAM RNA, to target binding sites on GAM95 target RNA, herein designated GAM TARGET RNA, such as BINDING SITE I, BINDING SITE II and BINDING SITE III, inhibits translation of GAM95 target RNA into GAM95 target protein, herein designated GAM TARGET PROTEIN. GAM target protein is therefore outlined by a broken line.

It is appreciated that GAM95 target gene, herein designated TARGET GENE, in fact represents a plurality of GAM95 target genes. The mRNA of each one of this plurality of GAM95 target genes comprises one or more target binding sites, each having a nucleotide sequence which is at least partly complementary to GAM95 RNA, herein designated GAM RNA, and which when bound by GAM95 RNA causes inhibition of translation of respective one or more GAM95 target proteins.

It is further appreciated by one skilled in the art that the mode of translational inhibition illustrated by FIG. 8 with specific reference to translational inhibition exerted by GAM95 gene, herein designated GAM GENE, on one or more GAM95 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM95 correlate with, and may be deduced from, the identity of the target genes which GAM95 binds and inhibits, and the function of these target genes, as elaborated hereinbelow.

LOC131000 (Accession) is a GAM95 target gene, herein designated TARGET GENE. LOC131000 BINDING SITE is a target binding site found in the 5' untranslated region of mRNA encoded by LOC131000, corresponding to a target binding site such as BINDING SITE I, BINDING SITE II or BINDING SITE III of FIG. 8. Table 4 illustrates the complementarity of the nucleotide sequences of LOC131000 BINDING SITE, designated SEQ ID:17288, to the nucleotide sequence of GAM95 RNA, herein designated GAM RNA, also designated SEQ ID:273.

A function of GAM95 is therefore inhibition of LOC131000 (Accession). Accordingly, utilities of GAM95 include diagnosis, prevention and treatment of diseases and clinical conditions associated with LOC131000.

FIG. 8 further provides a conceptual description of a novel bioinformatically detected of the present invention, referred to here as Genomic Address Messenger 96 (GAM96), which modulates expression of respective target genes thereof, the function and utility of which target genes is known in the art.

GAM96 is a novel bioinformatically detected regulatory, non protein coding, micro RNA (miRNA) gene. The method by which GAM96 was detected is described hereinabove with reference to FIGS. 8-15.

GAM96 gene, herein designated GAM GENE, and GAM96 target gene, herein designated TARGET GENE, are human genes contained in the human genome.

GAM96 gene encodes a GAM96 precursor RNA, herein designated GAM PRECURSOR RNA. Similar to other miRNA genes, and unlike most ordinary genes, GAM96 precursor RNA does not encode a protein. A nucleotide sequence identical or highly similar to the nucleotide sequence of GAM96 precursor RNA is designated SEQ ID:121, and is provided hereinbelow with reference to the sequence listing part. Nucleotide sequence SEQ ID:121 is located at position 60893521 relative to chromosome 17.

GAM96 precursor RNA folds onto itself, forming GAM96 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM96 precursor RNA folds onto itself, forming GAM96 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM96 precursor RNA, designated SEQ-ID:121, and a schematic representation of a predicted secondary folding of GAM96 folded precursor RNA are further described with reference to Table 2, hereby incorporated by reference.

An enzyme complex designated DICER COMPLEX, 'dices' the GAM96 folded precursor RNA into GAM96 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM96 RNA is designated SEQ ID:394, and is provided hereinbelow with references to the sequence listing part and Table 3, hereby incorporated by reference.

GAM96 target gene, herein designated TARGET GENE, encodes a corresponding messenger RNA, GAM96 target RNA, herein designated GAM TARGET RNA. GAM96 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM96 RNA, herein designated GAM RNA, binds complementarily to one or more target binding sites located in untranslated regions of GAM96 target RNA, herein designated GAM TARGET RNA. This complementary binding is due to the fact that the nucleotide sequence of GAM96 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM96 RNA may have a different number of target binding sites in untranslated regions of a GAM96 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM96 RNA, herein designated GAM RNA, to target binding sites on GAM96 target RNA, herein designated GAM TARGET RNA, such as BINDING SITE I, BINDING SITE II and BINDING SITE III, inhibits translation of GAM96 target RNA into GAM96 target protein, herein designated GAM TARGET PROTEIN. GAM target protein is therefore outlined by a broken line.

It is appreciated that GAM96 target gene, herein designated TARGET GENE, in fact represents a plurality of GAM96 target genes. The mRNA of each one of this plurality of GAM96 target genes comprises one or more target binding sites, each having a nucleotide sequence which is at least partly complementary to GAM96 RNA, herein designated GAM RNA, and which when bound by GAM96 RNA causes inhibition of translation of respective one or more GAM96 target proteins.

It is further appreciated by one skilled in the art that the mode of translational inhibition illustrated by FIG. 8 with specific reference to translational inhibition exerted by GAM96 gene, herein designated GAM GENE, on one or more GAM96 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM96 correlate with, and may be deduced from, the identity of the target genes which GAM96 binds and inhibits, and the function of these target genes, as elaborated hereinbelow.

Atp-binding cassette, sub-family a (abc1), member 1 (ABCA1, Accession NP_005493.2) is a GAM96 target gene, herein designated TARGET GENE. ABCA1 BINDING SITE is a target binding site found in the 3' untranslated region of mRNA encoded by ABCA1, corresponding to a target binding site such as BINDING SITE I, BINDING SITE II or BINDING SITE III of FIG. 8. Table 4 illustrates the complementarity of the nucleotide sequences of ABCA1 BINDING SITE, designated SEQ ID:14553, to the nucleotide sequence of GAM96 RNA, herein designated GAM RNA, also designated SEQ ID:394.

A function of GAM96 is therefore inhibition of Atp-binding cassette, sub-family a (abc1), member 1 (ABCA1, Accession NP_005493.2), a gene which camp-dependent and sulfonylurea-sensitive anion transporter. and therefore is associated with Tangier disease (high density lipoprotein deficiency type i). Accordingly, utilities of GAM96 include diagnosis, prevention and treatment of Tangier disease (high density lipoprotein deficiency type i), and of other diseases and clinical conditions associated with ABCA1.

The function of ABCA1 and its association with various diseases and clinical conditions, has been established by previous studies, as described hereinabove with reference to GAM94.1. Atp-binding cassette, sub-family c (cftr/mrp), member 1 (ABCC1, Accession NP_004987.1) is another GAM96 target gene, herein designated TARGET GENE. ABCC1 BINDING SITE is a target binding site found in the 3' untranslated region of multiple transcripts of mRNA encoded by ABCC1, corresponding to a target binding site such as BINDING SITE I, BINDING SITE II or BINDING SITE III of FIG. 8. Table 4 illustrates the complementarity of the nucleotide sequences of ABCC1 BINDING SITE, designated SEQ ID:3827, to the nucleotide sequence of GAM96 RNA, herein designated GAM RNA, also designated SEQ ID:394.

Another function of GAM96 is therefore inhibition of Atp-binding cassette, sub-family c (cftr/mrp), member 1 (ABCC1, Accession NP_004987.1), a gene which may participate directly in the active transport of drugs into subcellular organelles or influence drug distribution indirectly.

Accordingly, utilities of GAM96 include diagnosis, prevention and treatment of diseases and clinical conditions associated with ABCC1.

The function of ABCC1 has been established by previous studies. Cole et al. (1992) identified a transporter protein whose gene is overexpressed in a multidrug-resistant variant of the small cell lung cancer cell line NCI-H69. Unlike most tumor cell lines that are resistant to multiple chemotherapeutic agents, it did not overexpress the transmembrane transport protein P-glycoprotein (MDR1; 171050). Cole et al. (1992) isolated cDNA clones corresponding to mRNAs overexpressed in the resistant H69 cells. One cDNA hybridized to an mRNA of 7.8 to 8.2 kb that was expressed 100- to 200-fold higher in the resistant cells than in the drug-sensitive H69 cells. Overexpression was associated with amplification of the cognate gene. The cDNA contained a single open reading frame of 1,522 amino acids encoding a protein that they designated MRP, for 'multidrug resistance-associated protein.' Database analyses demonstrated similarities in primary sequence to the adenosine triphosphate (ATP)-binding cassette (ABC) superfamily of transport systems. Included in this superfamily are the genes for MDR1 and for the cystic fibrosis transmembrane conductance regulator (CFTR; 602421). Northern blot analysis readily detected MRP transcripts in lung, testis, and peripheral blood mononuclear cells; MRP transcripts were below the level of detection in placenta, brain, kidney, salivary gland, uterus, liver, and spleen. By isotopic in situ hybridization, Cole et al. (1992) mapped the MRP1 gene to chromosome 16p13.1. Grant et al. (1997) located the MRP1 gene close to the short arm breakpoint of the pericentric inversion associated with the M4Eo subclass of acute myeloid leukemia and on the telomeric side of the MYH11 gene (OMIM Ref. No. 160745).

Full details of the abovementioned studies are described in the following publications, the disclosure of which are hereby incorporated by reference:

Cole, S. P. C.; Bhardwaj, G.; Gerlach, J. H.; Mackie, J. E.; Grant, C. E.; Almquist, K. C.; Stewart, A. J.; Kurz, E. U.; Duncan, A. M. V.; Deeley, R. G.: Overexpression of a transporter gene in a multidrug-resistant human lung cancer cell line. Science 258:1650-1654, 1992; and Grant, C. E.; Kurz, E. U.; Cole, S. P. C.; Deeley, R. G.: Analysis of the intron-exon organization of the human multidrug-resistance protein gene (MRP) and alternative splicing of its m.

Further studies establishing the function and utilities of ABCC1 are found in John Hopkins OMIM database record ID 158343, and in cited publications listed in Table 5, which are hereby incorporated by reference. Atp-binding cassette, sub-family c (cftr/mrp), member 1 (ABCC1, Accession NP_063956.1) is another GAM96 target gene, herein designated TARGET GENE. ABCC1 BINDING SITE is a target binding site found in the 3' untranslated region of multiple transcripts of mRNA encoded by ABCC1, corresponding to a target binding site such as BINDING SITE I, BINDING SITE II or BINDING SITE III of FIG. 8. Table 4 illustrates the complementarity of the nucleotide sequences of ABCC1 BINDING SITE, designated SEQ ID:3827, to the nucleotide sequence of GAM96 RNA, herein designated GAM RNA, also designated SEQ ID:394.

Another function of GAM96 is therefore inhibition of Atp-binding cassette, sub-family c (cftr/mrp), member 1 (ABCC1, Accession NP_063956.1), a gene which may participate directly in the active transport of drugs into subcellular organelles or influence drug distribution indirectly.

Accordingly, utilities of GAM96 include diagnosis, prevention and treatment of diseases and clinical conditions associated with ABCC1.

The function of ABCC1 has been established by previous studies. Cole et al. (1992) identified a transporter protein whose gene is overexpressed in a multidrug-resistant variant of the small cell lung cancer cell line NCI-H69. Unlike most tumor cell lines that are resistant to multiple chemotherapeutic agents, it did not overexpress the transmembrane transport protein P-glycoprotein (MDR1; 171050). Cole et al. (1992) isolated cDNA clones corresponding to mRNAs overexpressed in the resistant H69 cells. One cDNA hybridized to an mRNA of 7.8 to 8.2 kb that was expressed 100- to 200-fold higher in the resistant cells than in the drug-sensitive H69 cells. Overexpression was associated with amplification of the cognate gene. The cDNA contained a single open reading frame of 1,522 amino acids encoding a protein that they designated MRP, for 'multidrug resistance-associated protein.' Database analyses demonstrated similarities in primary sequence to the adenosine triphosphate (ATP)-binding cassette (ABC) superfamily of transport systems. Included in this superfamily are the genes for MDR1 and for the cystic fibrosis transmembrane conductance regulator (CFTR; 602421). Northern blot analysis readily detected MRP transcripts in lung, testis, and peripheral blood mononuclear cells; MRP transcripts were below the level of detection in placenta, brain, kidney, salivary gland, uterus, liver, and spleen. By isotopic in situ hybridization, Cole et al. (1992) mapped the MRP1 gene to chromosome 16p13.1. Grant et al. (1997) located the MRP1 gene close to the short arm breakpoint of the pericentric inversion associated with the M4Eo subclass of acute myeloid leukemia and on the telomeric side of the MYH11 gene (OMIM Ref. No. 160745).

Full details of the abovementioned studies are described in the following publications, the disclosure of which are hereby incorporated by reference:

Cole, S. P. C.; Bhardwaj, G.; Gerlach, J. H.; Mackie, J. E.; Grant, C. E.; Almquist, K. C.; Stewart, A. J.; Kurz, E. U.; Duncan, A. M. V.; Deeley, R. G.: Overexpression of a transporter gene in a multidrug-resistant human lung cancer cell line. Science 258:1650-1654, 1992; and Grant, C. E.; Kurz, E. U.; Cole, S. P. C.; Deeley, R. G.: Analysis of the intron-exon organization of the human multidrug-resistance protein gene (MRP) and alternative splicing of its m.

Further studies establishing the function and utilities of ABCC1 are found in John Hopkins OMIM database record ID 158343, and in cited publications listed in Table 5, which are hereby incorporated by reference. Atp-binding cassette, sub-family c (cftr/mrp), member 1 (ABCC1, Accession NP_063957.1) is another GAM96 target gene, herein designated TARGET GENE. ABCC1 BINDING SITE is a target binding site found in the 3' untranslated region of multiple transcripts of mRNA encoded by ABCC1, corresponding to a target binding site such as BINDING SITE I, BINDING SITE II or BINDING SITE III of FIG. 8. Table 4 illustrates the complementarity of the nucleotide sequences of ABCC1 BINDING SITE, designated SEQ ID:3827, to the nucleotide sequence of GAM96 RNA, herein designated GAM RNA, also designated SEQ ID:394.

Another function of GAM96 is therefore inhibition of Atp-binding cassette, sub-family c (cftr/mrp), member 1 (ABCC1, Accession NP_063957.1), a gene which may participate directly in the active transport of drugs into subcellular organelles or influence drug distribution indirectly.

Accordingly, utilities of GAM96 include diagnosis, prevention and treatment of diseases and clinical conditions associated with ABCC1.

The function of ABCC1 has been established by previous studies. Cole et al. (1992) identified a transporter protein whose gene is overexpressed in a multidrug-resistant variant of the small cell lung cancer cell line NCI-H69. Unlike most tumor cell lines that are resistant to multiple chemotherapeutic agents, it did not overexpress the transmembrane transport protein P-glycoprotein (MDR1; 171050). Cole et al. (1992) isolated cDNA clones corresponding to mRNAs overexpressed in the resistant H69 cells. One cDNA hybridized to an mRNA of 7.8 to 8.2 kb that was expressed 100- to 200-fold higher in the resistant cells than in the drug-sensitive H69 cells. Overexpression was associated with amplification of the cognate gene. The cDNA contained a single open reading frame of 1,522 amino acids encoding a protein that they designated MRP, for 'multidrug resistance-associated protein.' Database analyses demonstrated similarities in primary sequence to the adenosine triphosphate (ATP)-binding cassette (ABC) superfamily of transport systems. Included in this superfamily are the genes for MDR1 and for the cystic fibrosis transmembrane conductance regulator (CFTR; 602421). Northern blot analysis readily detected MRP transcripts in lung, testis, and peripheral blood mononuclear cells; MRP transcripts were below the level of detection in placenta, brain, kidney, salivary gland, uterus, liver, and spleen. By isotopic in situ hybridization, Cole et al. (1992) mapped the MRP1 gene to chromosome 16p13.1. Grant et al. (1997) located the MRP1 gene close to the short arm breakpoint of the pericentric inversion associated with the M4Eo subclass of acute myeloid leukemia and on the telomeric side of the MYH11 gene (OMIM Ref. No. 160745).

Full details of the abovementioned studies are described in the following publications, the disclosure of which are hereby incorporated by reference:

Cole, S. P. C.; Bhardwaj, G.; Gerlach, J. H.; Mackie, J. E.; Grant, C. E.; Almquist, K. C.; Stewart, A. J.; Kurz, E. U.; Duncan, A. M. V.; Deeley, R. G.: Overexpression of a transporter gene in a multidrug-resistant human lung cancer cell line. Science 258:1650-1654, 1992; and Grant, C. E.; Kurz, E. U.; Cole, S. P. C.; Deeley, R. G.: Analysis of the intron-exon organization of the human multidrug-resistance protein gene (MRP) and alternative splicing of its m.

Further studies establishing the function and utilities of ABCC1 are found in John Hopkins OMIM database record ID 158343, and in cited publications listed in Table 5, which are hereby incorporated by reference. Atp-binding cassette, sub-family c (cftr/mrp), member 1 (ABCC1, Accession NP_063954.1) is another GAM96 target gene, herein designated TARGET GENE. ABCC1 BINDING SITE is a target binding site found in the 3' untranslated region of multiple transcripts of mRNA encoded by ABCC1, corresponding to a target binding site such as BINDING SITE I, BINDING SITE II or BINDING SITE III of FIG. 8. Table 4 illustrates the complementarity of the nucleotide sequences of ABCC1 BINDING SITE, designated SEQ ID:3827, to the nucleotide sequence of GAM96 RNA, herein designated GAM RNA, also designated SEQ ID:394.

Another function of GAM96 is therefore inhibition of Atp-binding cassette, sub-family c (cftr/mrp), member 1 (ABCC1, Accession NP_063954.1), a gene which may participate directly in the active transport of drugs into subcellular organelles or influence drug distribution indirectly.

Accordingly, utilities of GAM96 include diagnosis, prevention and treatment of diseases and clinical conditions associated with ABCC1.

The function of ABCC1 has been established by previous studies. Cole et al. (1992) identified a transporter protein whose gene is overexpressed in a multidrug-resistant variant of the small cell lung cancer cell line NCI-H69. Unlike most tumor cell lines that are resistant to multiple chemotherapeutic agents, it did not overexpress the transmembrane transport protein P-glycoprotein (MDR1; 171050). Cole et al. (1992) isolated cDNA clones corresponding to mRNAs overexpressed in the resistant H69 cells. One cDNA hybridized to an mRNA of 7.8 to 8.2 kb that was expressed 100- to 200-fold higher in the resistant cells than in the drug-sensitive H69 cells. Overexpression was associated with amplification of the cognate gene. The cDNA contained a single open reading frame of 1,522 amino acids encoding a protein that they designated MRP, for 'multidrug resistance-associated protein.' Database analyses demonstrated similarities in primary sequence to the adenosine triphosphate (ATP)-binding cassette (ABC) superfamily of transport systems. Included in this superfamily are the genes for MDR1 and for the cystic fibrosis transmembrane conductance regulator (CFTR; 602421). Northern blot analysis readily detected MRP transcripts in lung, testis, and peripheral blood mononuclear cells; MRP transcripts were below the level of detection in placenta, brain, kidney, salivary gland, uterus, liver, and spleen. By isotopic in situ hybridization, Cole et al. (1992) mapped the MRP1 gene to chromosome 16p13.1. Grant et al. (1997) located the MRP1 gene close to the short arm breakpoint of the pericentric inversion associated with the M4Eo subclass of acute myeloid leukemia and on the telomeric side of the MYH11 gene (OMIM Ref. No. 160745).

Full details of the abovementioned studies are described in the following publications, the disclosure of which are hereby incorporated by reference:

Cole, S. P. C.; Bhardwaj, G.; Gerlach, J. H.; Mackie, J. E.; Grant, C. E.; Almquist, K. C.; Stewart, A. J.; Kurz, E. U.; Duncan, A. M. V.; Deeley, R. G.: Overexpression of a transporter gene in a multidrug-resistant human lung cancer cell line. Science 258:1650-1654, 1992; and Grant, C. E.; Kurz, E. U.; Cole, S. P. C.; Deeley, R. G.: Analysis of the intron-exon organization of the human multidrug-resistance protein gene (MRP) and alternative splicing of its m.

Further studies establishing the function and utilities of ABCC1 are found in John Hopkins OMIM database record ID 158343, and in cited publications listed in Table 5, which are hereby incorporated by reference. Atp-binding cassette, sub-family c (cftr/mrp), member 1 (ABCC1, Accession NP_063953.1) is another GAM96 target gene, herein designated TARGET GENE. ABCC1 BINDING SITE is a target binding site found in the 3' untranslated region of multiple transcripts of mRNA encoded by ABCC1, corresponding to a target binding site such as BINDING SITE I, BINDING SITE II or BINDING SITE III of FIG. 8. Table 4 illustrates the complementarity of the nucleotide sequences of ABCC1 BINDING SITE, designated SEQ ID:3827, to the nucleotide sequence of GAM96 RNA, herein designated GAM RNA, also designated SEQ ID:394.

Another function of GAM96 is therefore inhibition of Atp-binding cassette, sub-family c (cftr/mrp), member 1 (ABCC1, Accession NP_063953.1), a gene which may participate directly in the active transport of drugs into subcellular organelles or influence drug distribution indirectly.

Accordingly, utilities of GAM96 include diagnosis, prevention and treatment of diseases and clinical conditions associated with ABCC1.

The function of ABCC1 has been established by previous studies. Cole et al. (1992) identified a transporter protein whose gene is overexpressed in a multidrug-resistant variant of the small cell lung cancer cell line NCI-H69. Unlike most tumor cell lines that are resistant to multiple chemotherapeutic agents, it did not overexpress the transmembrane transport protein P-glycoprotein (MDR1; 171050). Cole et al. (1992) isolated cDNA clones corresponding to mRNAs overexpressed in the resistant H69 cells. One cDNA hybridized to an mRNA of 7.8 to 8.2 kb that was expressed 100- to 200-fold higher in the resistant cells than in the drug-sensitive H69 cells. Overexpression was associated with amplification of the cognate gene. The cDNA contained a single open reading frame of 1,522 amino acids encoding a protein that they designated MRP, for 'multidrug resistance-associated protein.' Database analyses demonstrated similarities in primary sequence to the adenosine triphosphate (ATP)-binding cassette (ABC) superfamily of transport systems. Included in this superfamily are the genes for MDR1 and for the cystic fibrosis transmembrane conductance regulator (CFTR; 602421). Northern blot analysis readily detected MRP transcripts in lung, testis, and peripheral blood mononuclear cells; MRP transcripts were below the level of detection in placenta, brain, kidney, salivary gland, uterus, liver, and spleen. By isotopic in situ hybridization, Cole et al. (1992) mapped the MRP1 gene to chromosome 16p13.1. Grant et al. (1997) located the MRP1 gene close to the short arm breakpoint of the pericentric inversion associated with the M4Eo subclass of acute myeloid leukemia and on the telomeric side of the MYH11 gene (OMIM Ref. No. 160745).

Full details of the abovementioned studies are described in the following publications, the disclosure of which are hereby incorporated by reference:

Cole, S. P. C.; Bhardwaj, G.; Gerlach, J. H.; Mackie, J. E.; Grant, C. E.; Almquist, K. C.; Stewart, A. J.; Kurz, E. U.; Duncan, A. M. V.; Deeley, R. G.: Overexpression of a transporter gene in a multidrug-resistant human lung cancer cell line. Science 258:1650-1654, 1992; and Grant, C. E.; Kurz, E. U.; Cole, S. P. C.; Deeley, R. G.: Analysis of the intron-exon organization of the human multidrug-resistance protein gene (MRP) and alternative splicing of its m.

Further studies establishing the function and utilities of ABCC1 are found in John Hopkins OMIM database record ID 158343, and in cited publications listed in Table 5, which are hereby incorporated by reference. Atp-binding cassette, sub-family c (cftr/mrp), member 1 (ABCC1, Accession NP_063915.1) is another GAM96 target gene, herein designated TARGET GENE. ABCC1 BINDING SITE is a target binding site found in the 3' untranslated region of multiple transcripts of mRNA encoded by ABCC1, corresponding to a target binding site such as BINDING SITE I, BINDING SITE II or BINDING SITE III of FIG. 8. Table 4 illustrates the complementarity of the nucleotide sequences of ABCC1 BINDING SITE, designated SEQ ID:3827, to the nucleotide sequence of GAM96 RNA, herein designated GAM RNA, also designated SEQ ID:394.

Another function of GAM96 is therefore inhibition of Atp-binding cassette, sub-family c (cftr/mrp), member 1 (ABCC1, Accession NP_063915.1), a gene which may participate directly in the active transport of drugs into subcellular organelles or influence drug distribution indirectly.

Accordingly, utilities of GAM96 include diagnosis, prevention and treatment of diseases and clinical conditions associated with ABCC1.

The function of ABCC1 has been established by previous studies. Cole et al. (1992) identified a transporter protein whose gene is overexpressed in a multidrug-resistant variant of the small cell lung cancer cell line NCI-H69. Unlike most tumor cell lines that are resistant to multiple chemotherapeutic agents, it did not overexpress the transmembrane transport protein P-glycoprotein (MDR1; 171050). Cole et al. (1992) isolated cDNA clones corresponding to mRNAs overexpressed in the resistant H69 cells. One cDNA hybridized to an mRNA of 7.8 to 8.2 kb that was expressed 100- to 200-fold higher in the resistant cells than in the drug-sensitive H69 cells. Overexpression was associated with amplification of the cognate gene. The cDNA contained a single open reading frame of 1,522 amino acids encoding a protein that they designated MRP, for 'multidrug resistance-associated protein.' Database analyses demonstrated similarities in primary sequence to the adenosine triphosphate (ATP)-binding cassette (ABC) superfamily of transport systems. Included in this superfamily are the genes for MDR1 and for the cystic fibrosis transmembrane conductance regulator (CFTR; 602421). Northern blot analysis readily detected MRP transcripts in lung, testis, and peripheral blood mononuclear cells; MRP transcripts were below the level of detection in placenta, brain, kidney, salivary gland, uterus, liver, and spleen. By isotopic in situ hybridization, Cole et al. (1992) mapped the MRP1 gene to chromosome 16p13.1. Grant et al. (1997) located the MRP1 gene close to the short arm breakpoint of the pericentric inversion associated with the M4Eo subclass of acute myeloid leukemia and on the telomeric side of the MYH11 gene (OMIM Ref. No. 160745).

Full details of the abovementioned studies are described in the following publications, the disclosure of which are hereby incorporated by reference:

Cole, S. P. C.; Bhardwaj, G.; Gerlach, J. H.; Mackie, J. E.; Grant, C. E.; Almquist, K. C.; Stewart, A. J.; Kurz, E. U.; Duncan, A. M. V.; Deeley, R. G.: Overexpression of a transporter gene in a multidrug-resistant human lung cancer cell line. Science 258:1650-1654, 1992; and Grant, C. E.; Kurz, E. U.; Cole, S. P. C.; Deeley, R. G.: Analysis of the intron-exon organization of the human multidrug-resistance protein gene (MRP) and alternative splicing of its m.

Further studies establishing the function and utilities of ABCC1 are found in John Hopkins OMIM database record ID 158343, and in cited publications listed in Table 5, which are hereby incorporated by reference. Actin binding lim protein 1 (ABLIM1, Accession NP_006711.2) is another GAM96 target gene, herein designated TARGET GENE. ABLIM1 BINDING SITE1 and ABLIM1 BINDING SITE2 are target binding sites found in untranslated regions of multiple transcripts of mRNA encoded by ABLIM1, corresponding to target binding sites such as BINDING SITE I, BINDING SITE II or BINDING SITE III of FIG. 8. Table 4 illustrates the complementarity of the nucleotide sequences of ABLIM1 BINDING SITE1 and ABLIM1 BINDING SITE2, designated SEQ ID:1918 and SEQ ID:13766 respectively, to the nucleotide sequence of GAM96 RNA, herein designated GAM RNA, also designated SEQ ID:394.

Another function of GAM96 is therefore inhibition of Actin binding lim protein 1 (ABLIM1, Accession NP_006711.2). Accordingly, utilities of GAM96 include diagnosis, prevention and treatment of diseases and clinical conditions associated with ABLIM1.

Actin binding lim protein 1 (ABLIM1, Accession NP_006710.2) is another GAM96 target gene, herein designated TARGET GENE. ABLIM1 BINDING SITE1 and ABLIM1 BINDING SITE2 are target binding sites found in untranslated regions of multiple transcripts of mRNA encoded by ABLIM1, corresponding to target binding sites such as BINDING SITE I, BINDING SITE II or BINDING SITE III of FIG. 8. Table 4 illustrates the complementarity of the nucleotide sequences of ABLIM1 BINDING SITE1 and ABLIM1 BINDING SITE2, designated SEQ ID:13766 and SEQ ID:1918 respectively, to the nucleotide sequence of GAM96 RNA, herein designated GAM RNA, also designated SEQ ID:394.

Another function of GAM96 is therefore inhibition of Actin binding lim protein 1 (ABLIM1, Accession NP_006710.2). Accordingly, utilities of GAM96 include diagnosis, prevention and treatment of diseases and clinical conditions associated with ABLIM1.

Actin binding lim protein 1 (ABLIM1, Accession NP_006711.2) is another GAM96 target gene, herein designated TARGET GENE. ABLIM1 BINDING SITE1 and ABLIM1 BINDING SITE2 are target binding sites found in untranslated regions of multiple transcripts of mRNA encoded by ABLIM1, corresponding to target binding sites such as BINDING SITE I, BINDING SITE II or BINDING SITE III of FIG. 8. Table 4 illustrates the complementarity of the nucleotide sequences of ABLIM1 BINDING SITE1 and ABLIM1 BINDING SITE2, designated SEQ ID:13766 and SEQ ID:1918 respectively, to the nucleotide sequence of GAM96 RNA, herein designated GAM RNA, also designated SEQ ID:394.

Another function of GAM96 is therefore inhibition of Actin binding lim protein 1 (ABLIM1, Accession NP_006711.2). Accordingly, utilities of GAM96 include diagnosis, prevention and treatment of diseases and clinical conditions associated with ABLIM1.

Adenylate cyclase 6 (ADCY6, Accession NP_056085.1) is another GAM96 target gene, herein designated TARGET GENE. ADCY6 BINDING SITE is a target binding site found in the 3' untranslated region of multiple transcripts of mRNA encoded by ADCY6, corresponding to a target binding site such as BINDING SITE I, BINDING SITE II or BINDING SITE III of FIG. 8. Table 4 illustrates the complementarity of the nucleotide sequences of ADCY6 BINDING SITE, designated SEQ ID:8443, to the nucleotide sequence of GAM96 RNA, herein designated GAM RNA, also designated SEQ ID:394.

Another function of GAM96 is therefore inhibition of Adenylate cyclase 6 (ADCY6, Accession NP_056085.1), a gene which this a membrane-bound, ca(2+)-inhibitable adenylyl cyclase (by similarity). Accordingly, utilities of GAM96 include diagnosis, prevention and treatment of diseases and clinical conditions associated with ADCY6.

The function of ADCY6 and its association with various diseases and clinical conditions, has been established by previous studies, as described hereinabove with reference to GAM67.2. Adenylate cyclase 6 (ADCY6, Accession NP_066193.1) is another GAM96 target gene, herein designated TARGET GENE. ADCY6 BINDING SITE is a target binding site found in the 3' untranslated region of multiple transcripts of mRNA encoded by ADCY6, corresponding to a target binding site such as BINDING SITE I, BINDING SITE II or BINDING SITE III of FIG. 8. Table 4 illustrates the complementarity of the nucleotide sequences of ADCY6 BINDING SITE, designated SEQ ID:8443, to the nucleotide sequence of GAM96 RNA, herein designated GAM RNA, also designated SEQ ID:394.

Another function of GAM96 is therefore inhibition of Adenylate cyclase 6 (ADCY6, Accession NP_066193.1), a gene which this a membrane-bound, ca(2+)-inhibitable adenylyl cyclase (by similarity). Accordingly, utilities of GAM96 include diagnosis, prevention and treatment of diseases and clinical conditions associated with ADCY6.

The function of ADCY6 and its association with various diseases and clinical conditions, has been established by previous studies, as described hereinabove with reference to GAM67.2. A kinase (prka) anchor protein 13 (AKAP13, Accession NP_658913.1) is another GAM96 target gene, herein designated TARGET GENE. AKAP13 BINDING SITE is a target binding site found in the 3' untranslated region of multiple transcripts of mRNA encoded by AKAP13, corresponding to a target binding site such as BINDING SITE I, BINDING SITE II or BINDING SITE III of FIG. 8. Table 4 illustrates the complementarity of the nucleotide sequences of AKAP13 BINDING SITE, designated SEQ ID:13225, to the nucleotide sequence of GAM96 RNA, herein designated GAM RNA, also designated SEQ ID:394.

Another function of GAM96 is therefore inhibition of A kinase (prka) anchor protein 13 (AKAP13, Accession NP_658913.1), a gene which regulates subcellular localization of type II cAMP-dependent PKA. Accordingly, utilities of GAM96 include diagnosis, prevention and treatment of diseases and clinical conditions associated with AKAP13.

The function of AKAP13 and its association with various diseases and clinical conditions, has been established by previous studies, as described hereinabove with reference to GAM54.1. A kinase (prka) anchor protein 13 (AKAP13, Accession NP_009131.2) is another GAM96 target gene, herein designated TARGET GENE. AKAP13 BINDING SITE is a target binding site found in the 3' untranslated region of multiple transcripts of mRNA encoded by AKAP13, corresponding to a target binding site such as BINDING SITE I, BINDING SITE II or BINDING SITE III of FIG. 8. Table 4 illustrates the complementarity of the nucleotide sequences of AKAP13 BINDING SITE, designated SEQ ID:13225, to the nucleotide sequence of GAM96 RNA, herein designated GAM RNA, also designated SEQ ID:394.

Another function of GAM96 is therefore inhibition of A kinase (prka) anchor protein 13 (AKAP13, Accession NP_009131.2), a gene which regulates subcellular localization of type II cAMP-dependent PKA. Accordingly, utilities of GAM96 include diagnosis, prevention and treatment of diseases and clinical conditions associated with AKAP13.

The function of AKAP13 and its association with various diseases and clinical conditions, has been established by previous studies, as described hereinabove with reference to GAM54.1. A kinase (prka) anchor protein 13 (AKAP13, Accession NP_006729.4) is another GAM96 target gene, herein designated TARGET GENE. AKAP13 BINDING SITE is a target binding site found in the 3' untranslated region of multiple transcripts of mRNA encoded by AKAP13, corresponding to a target binding site such as BINDING SITE I, BINDING SITE II or BINDING SITE III of FIG. 8. Table 4 illustrates the complementarity of the nucleotide sequences of AKAP13 BINDING SITE, designated SEQ ID:13225, to the nucleotide sequence of GAM96 RNA, herein designated GAM RNA, also designated SEQ ID:394.

Another function of GAM96 is therefore inhibition of A kinase (prka) anchor protein 13 (AKAP13, Accession NP_006729.4), a gene which regulates subcellular localization of type II cAMP-dependent PKA. Accordingly, utilities of GAM96 include diagnosis, prevention and treatment of diseases and clinical conditions associated with AKAP13.

The function of AKAP13 and its association with various diseases and clinical conditions, has been established by previous studies, as described hereinabove with reference to GAM54.1. Aldehyde dehydrogenase 1 family, member a3 (ALDH1A3, Accession NP_000684.1) is another GAM96 target gene, herein designated TARGET GENE. ALDH1A3 BINDING SITE is a target binding site found in the 3' untranslated region of mRNA encoded by ALDH1A3, corresponding to a target binding site such as BINDING SITE I, BINDING SITE II or BINDING SITE III of FIG. 8. Table 4 illustrates the complementarity of the nucleotide sequences of ALDH1A3 BINDING SITE, designated SEQ ID:9790, to the nucleotide sequence of GAM96 RNA, herein designated GAM RNA, also designated SEQ ID:394.

Another function of GAM96 is therefore inhibition of Aldehyde dehydrogenase 1 family, member a3 (ALDH1A3, Accession NP_000684.1), a gene which plays a major role in the detoxification of aldehydes generated by alcohol metabolism and lipid peroxidation. Accordingly, utilities of GAM96 include diagnosis, prevention and treatment of diseases and clinical conditions associated with ALDH1A3.

The function of ALDH1A3 has been established by previous studies. Hsu et al. (1994) identified and characterized the ALDH6 gene. The existence of this unique ALDH isozyme in human saliva and its polymorphism had previously been demonstrated. The ALDH6 cDNA is 3,457 bp long and contains an open reading frame encoding 512 amino acids. The deduced amino acid sequence shows that the protein is larger than human liver ALDH1 (OMIM Ref. No. 100640) by 11 residues at the N terminus, and the degree of identity between the 2 isozymes is 70% with an alignment of 500 amino acid residues. Northern blot analysis demonstrated that the ALDH6 gene is expressed at low levels in many tissues and at higher levels in salivary gland, stomach, and kidney. By in situ hybridization of chick and mouse embryos, Grun et al. (2000) demonstrated expression of Aldh1a3 in the developing sensory neuroepithelia of the ey, nose, and ear, and in discreet sites within the central nervous system. Expression of chick Aldh1a3 in a human choriocarcinoma cell line conferred increased sensitivity to retinol in a retinoic acid receptor (see OMIM Ref. No. 180240)- dependent reporter assay. GENE STRUCTURE Hsu et al. (1994) determined that the ALDH6 gene spans about 37 kb and contains 13 exons. Putative TATA and CCAAT boxes and Sp1 binding sites were found in the 5-prime upstream region of the gene.

Full details of the abovementioned studies are described in the following publications, the disclosure of which are hereby incorporated by reference:

Grun, F.; Hirose, Y.; Kawauchi, S.; Ogura, T.; Umesono, K.: Aldehyde dehydrogenase 6, a cytosolic retinaldehyde dehydrogenase prominently expressed in sensory neuroepithelia during development. J. Biol. Chem. 275:41210-41218, 2000; and Hsu, L. C.; Chang, W.-C.; Hiraoka, L.; Hsieh, C.-L.: Molecular cloning, genomic organization, and chromosomal localization of an additional human aldehyde dehydrogenase gene, ALDH6. G.

Further studies establishing the function and utilities of ALDH1A3 are found in John Hopkins OMIM database record ID 600463, and in cited publications listed in Table 5, which are hereby incorporated by reference. ALEX3 (Accession NP_057691.1) is another GAM96 target gene, herein designated TARGET GENE. ALEX3 BINDING SITE is a target binding site found in the 3' untranslated region of multiple transcripts of mRNA encoded by ALEX3, corresponding to a target binding site such as BINDING SITE I, BINDING SITE II or BINDING SITE III of FIG. 8. Table 4 illustrates the complementarity of the nucleotide sequences of ALEX3 BINDING SITE, designated SEQ ID:13767, to the nucleotide sequence of GAM96 RNA, herein designated GAM RNA, also designated SEQ ID:394.

Another function of GAM96 is therefore inhibition of ALEX3 (Accession NP_057691.1). Accordingly, utilities of GAM96 include diagnosis, prevention and treatment of diseases and clinical conditions associated with ALEX3.

ALEX3 (Accession NP_808817.1) is another GAM96 target gene, herein designated TARGET GENE. ALEX3 BINDING SITE is a target binding site found in the 3' untranslated region of multiple transcripts of mRNA encoded by ALEX3, corresponding to a target binding site such as BINDING SITE I, BINDING SITE II or BINDING SITE III of FIG. 8. Table 4 illustrates the complementarity of the nucleotide sequences of ALEX3 BINDING SITE, designated SEQ ID:13767, to the nucleotide sequence of GAM96 RNA, herein designated GAM RNA, also designated SEQ ID:394.

Another function of GAM96 is therefore inhibition of ALEX3 (Accession NP_808817.1). Accordingly, utilities of GAM96 include diagnosis, prevention and treatment of diseases and clinical conditions associated with ALEX3.

ALEX3 (Accession NP_808816.1) is another GAM96 target gene, herein designated TARGET GENE. ALEX3 BINDING SITE is a target binding site found in the 3' untranslated region of multiple transcripts of mRNA encoded by ALEX3, corresponding to a target binding site such as BINDING SITE I, BINDING SITE II or BINDING SITE III of FIG. 8. Table 4 illustrates the complementarity of the nucleotide sequences of ALEX3 BINDING SITE, designated SEQ ID:13767, to the nucleotide sequence of GAM96 RNA, herein designated GAM RNA, also designated SEQ ID:394.

Another function of GAM96 is therefore inhibition of ALEX3 (Accession NP_808816.1). Accordingly, utilities of GAM96 include diagnosis, prevention and treatment of diseases and clinical conditions associated with ALEX3.

Rho guanine nucleotide exchange factor (gef) 15 (ARHGEF15, Accession NP_055773.1) is another GAM96 target gene, herein designated TARGET GENE. ARHGEF15 BINDING SITE is a target binding site found in the 3' untranslated region of multiple transcripts of mRNA encoded by ARHGEF15, corresponding to a target binding site such as BINDING SITE I, BINDING SITE II or BINDING SITE III of FIG. 8. Table 4 illustrates the complementarity of the nucleotide sequences of ARHGEF15 BINDING SITE, designated SEQ ID:10259, to the nucleotide sequence of GAM96 RNA, herein designated GAM RNA, also designated SEQ ID:394.

Another function of GAM96 is therefore inhibition of Rho guanine nucleotide exchange factor (gef) 15 (ARHGEF15, Accession NP_055773.1). Accordingly, utilities of GAM96 include diagnosis, prevention and treatment of diseases and clinical conditions associated with ARHGEF15.

Rho guanine nucleotide exchange factor (gef) 15 (ARHGEF15, Accession NP_776089.1) is another GAM96 target gene, herein designated TARGET GENE. ARHGEF15 BINDING SITE is a target binding site found in the 3' untranslated region of multiple transcripts of mRNA encoded by ARHGEF15, corresponding to a target binding site such as BINDING SITE I, BINDING SITE II or BINDING SITE III of FIG. 8. Table 4 illustrates the complementarity of the nucleotide sequences of ARHGEF15 BINDING SITE, designated SEQ ID:10259, to the nucleotide sequence of GAM96 RNA, herein designated GAM RNA, also designated SEQ ID:394.

Another function of GAM96 is therefore inhibition of Rho guanine nucleotide exchange factor (gef) 15 (ARHGEF15, Accession NP_776089.1). Accordingly, utilities of GAM96 include diagnosis, prevention and treatment of diseases and clinical conditions associated with ARHGEF15.

ARK5 (Accession NP_055655.1) is another GAM96 target gene, herein designated TARGET GENE. ARK5 BINDING SITE is a target binding site found in the 3' untranslated region of mRNA encoded by ARK5, corresponding to a target binding site such as BINDING SITE I, BINDING SITE II or BINDING SITE III of FIG. 8. Table 4 illustrates the complementarity of the nucleotide sequences of ARK5 BINDING SITE, designated SEQ ID:16825, to the nucleotide sequence of GAM96 RNA, herein designated GAM RNA, also designated SEQ ID:394.

Another function of GAM96 is therefore inhibition of ARK5 (Accession NP_055655.1). Accordingly, utilities of GAM96 include diagnosis, prevention and treatment of diseases and clinical conditions associated with ARK5.

ASH1 (Accession NP_060959.1) is another GAM96 target gene, herein designated TARGET GENE. ASH1 BINDING SITE is a target binding site found in the 3' untranslated region of mRNA encoded by ASH1, corresponding to a target binding site such as BINDING SITE I, BINDING SITE II or BINDING SITE III of FIG. 8. Table 4 illustrates the complementarity of the nucleotide sequences of ASH1 BINDING SITE, designated SEQ ID:16309, to the nucleotide sequence of GAM96 RNA, herein designated GAM RNA, also designated SEQ ID:394.

Another function of GAM96 is therefore inhibition of ASH1 (Accession NP_060959.1), a gene which is a candidate regulator of development in the mammalian central nervous system and neural crest. Accordingly, utilities of GAM96 include diagnosis, prevention and treatment of diseases and clinical conditions associated with ASH1.

The function of ASH1 has been established by previous studies. Using retroviral labeling in organotypic slice cultures of the embryonic human forebrain, Letinic et al. (2002) demonstrated the existence of 2 distinct lineages of neocortical GABAergic neurons. One lineage expresses DLX1 (OMIM Ref. No. 600029) and DLX2 (OMIM Ref. No. 126255) and MASH1 transcription factors, represents 65% of neocortical GABAergic neurons in humans, and originates from MASH1-expressing progenitors of the neocortical ventricular and subventricular zone of the dorsal forebrain. The second lineage, characterized by the expression of DLX1 and DLX2 but not MASH1, forms around 35% of the GABAergic neurons and originates from the ganglionic eminence of the ventral forebrain. Letinic et al. (2002) suggested that modifications in the expression pattern of transcription factors in the forebrain may underlie species-specific programs for the generation of neocortical local circuit neurons and that distinct lineages of cortical interneurons may be differentially affected in genetic and acquired diseases of the human brain Animal model experiments lend further support to the function of ASH1. By homologous recombination in embryonic stem cells, Guillemot et al. (1993) created a null allele of the Mash1 gene. Homozygous mice died at birth with apparent breathing and feeding defects. The brain and spinal cord appeared normal, but the olfactory epithelium and sympathetic, parasympathetic, and enteric ganglia were severely affected. These observations suggested that the Mash1 gene, like its Drosophila homologs, controls a basic operation in development of neuronal progenitors in distinct neural lineages It is appreciated that the abovementioned animal model for ASH1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Letinic, K.; Zoncu, R.; Rakic, P.: Origin of GABAergic neurons in the human neocortex. Nature 417:645-649, 2002; and Guillemot, F.; Lo, L.-C.; Johnson, J. E.; Auerbach, A.; Anderson, D. J.; Joyner, A. L.: Mammalian achaete-scute homolog 1 is required for the early development of olfactory and autonom.

Further studies establishing the function and utilities of ASH1 are found in John Hopkins OMIM database record ID 100790, and in cited publications listed in Table 5, which are hereby incorporated by reference. Btb and cnc homology 1, basic leucine zipper transcription factor 2 (BACH2, Accession NP_068585.1) is another GAM96 target gene, herein designated TARGET GENE. BACH2 BINDING SITE is a target binding site found in the 5' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:13426, to the nucleotide sequence of GAM96 RNA, herein designated GAM RNA, also designated SEQ ID:394.

Another function of GAM96 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM96 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. Bone gamma-carboxyglutamate (gla) protein (osteocalcin) (BGLAP, Accession NP_000702.1) is another GAM96 target gene, herein designated TARGET GENE. BGLAP BINDING SITE is a target binding site found in the 3' untranslated region of mRNA encoded by BGLAP, corresponding to a target binding site such as BINDING SITE I, BINDING SITE II or BINDING SITE III of FIG. 8. Table 4 illustrates the complementarity of the nucleotide sequences of BGLAP BINDING SITE, designated SEQ ID:17362, to the nucleotide sequence of GAM96 RNA, herein designated GAM RNA, also designated SEQ ID:394.

Another function of GAM96 is therefore inhibition of Bone gamma-carboxyglutamate (gla) protein (osteocalcin) (BGLAP, Accession NP_000702.1), a gene which associates with the mineralized matrix of bone. Accordingly, utilities of GAM96 include diagnosis, prevention and treatment of diseases and clinical conditions associated with BGLAP.

The function of BGLAP has been established by previous studies. Bone gamma- carboxyglutamic acid (Gla) protein (BGLAP, or BGP) is a small, highly conserved molecule associated with the mineralized matrix of bone. Its interaction with synthetic hydroxyapatite in vitro is absolutely dependent on its content of 3 residues of gamma-carboxyglutamic acid, the amino acid formed posttranslationally from glutamic acid by a vitamin K-dependent process. Celeste et al. (1986) used mouse and rat cDNA clones to isolate the human BGP gene. It has 4 exons. Comparison of the exon structure of the BGP gene and the factor IX gene (OMIM Ref. No. 306900), which is a gamma-carboxylated clotting factor, suggested that the exons encoding the part of the leader peptides presumably directing gamma-carboxylation arose from a common ancestral sequence. Kerner et al. (1989) described regions within the BGP promoter that contribute to basal expression of the osteocalcin gene in osteoblast-like cells in culture. Further, they defined a 21-basepair element that acts in cis to mediate vitamin D inducibility of the osteocalcin gene.

Full details of the abovementioned studies are described in the following publications, the disclosure of which are hereby incorporated by reference:

Celeste, A. J.; Rosen, V.; Buecker, J. L.; Kriz, R.; Wang, E. A.; Wozney, J. M.: Isolation of the human gene for bone gla protein utilizing mouse and rat cDNA clones. EMBO J. 5:1885-1890, 1986; and Kerner, S. A.; Scott, R. A.; Pike, J. W.: Sequence elements in the human osteocalcin gene confer basal activation and inducible response to hormonal vitamin D(3). Proc. Nat. Acad. Sci.

Further studies establishing the function and utilities of BGLAP are found in John Hopkins OMIM database record ID 112260, and in cited publications listed in Table 5, which are hereby incorporated by reference. C14orf132 (Accession NP_064600.1) is another GAM96 target gene, herein designated TARGET GENE. C14orf132 BINDING SITE is a target binding site found in the 3' untranslated region of mRNA encoded by C14orf132, corresponding to a target binding site such as BINDING SITE I, BINDING SITE II or BINDING SITE III of FIG. 8. Table 4 illustrates the complementarity of the nucleotide sequences of C14orf132 BINDING SITE, designated SEQ ID:691, to the nucleotide sequence of GAM96 RNA, herein designated GAM RNA, also designated SEQ ID:394.

Another function of GAM96 is therefore inhibition of C14orf132 (Accession NP_064600.1). Accordingly, utilities of GAM96 include diagnosis, prevention and treatment of diseases and clinical conditions associated with C14orf132.

C14orf140 (Accession NP_078919.1) is another GAM96 target gene, herein designated TARGET GENE. C14orf140 BINDING SITE is a target binding site found in the 3' untranslated region of mRNA encoded by C14orf140, corresponding to a target binding site such as BINDING SITE I, BINDING SITE II or BINDING SITE III of FIG. 8. Table 4 illustrates the complementarity of the nucleotide sequences of C14orf140 BINDING SITE, designated SEQ ID:20031, to the nucleotide sequence of GAM96 RNA, herein designated GAM RNA, also designated SEQ ID:394.

Another function of GAM96 is therefore inhibition of C14orf140 (Accession NP_078919.1). Accordingly, utilities of GAM96 include diagnosis, prevention and treatment of diseases and clinical conditions associated with C14orf140.

C4orf9 (Accession XP_035572.1) is another GAM96 target gene, herein designated TARGET GENE. C4orf9 BINDING SITE is a target binding site found in the 3' untranslated region of mRNA encoded by C4orf9, corresponding to a target binding site such as BINDING SITE I, BINDING SITE II or BINDING SITE III of FIG. 8. Table 4 illustrates the complementarity of the nucleotide sequences of C4orf9 BINDING SITE, designated SEQ ID:4126, to the nucleotide sequence of GAM96 RNA, herein designated GAM RNA, also designated SEQ ID:394.

Another function of GAM96 is therefore inhibition of C4orf9 (Accession XP_035572.1). Accordingly, utilities of GAM96 include diagnosis, prevention and treatment of diseases and clinical conditions associated with C4orf9.

Chromosome 6 open reading frame 31 (C6orf31, Accession NP_085154.2) is another GAM96 target gene, herein designated TARGET GENE. C6orf31 BINDING SITE is a target binding site found in the 3' untranslated region of mRNA encoded by C6orf31, corresponding to a target binding site such as BINDING SITE I, BINDING SITE II or BINDING SITE III of FIG. 8. Table 4 illustrates the complementarity of the nucleotide sequences of C6orf31 BINDING SITE, designated SEQ ID:17451, to the nucleotide sequence of GAM96 RNA, herein designated GAM RNA, also designated SEQ ID:394.

Another function of GAM96 is therefore inhibition of Chromosome 6 open reading frame 31 (C6orf31, Accession NP_085154.2). Accordingly, utilities of GAM96 include diagnosis, prevention and treatment of diseases and clinical conditions associated with C6orf31.

Chromosome 7 open reading frame 10 (C7orf10, Accession NP_079004.1) is another GAM96 target gene, herein designated TARGET GENE. C7orf10 BINDING SITE is a target binding site found in the 3' untranslated region of mRNA encoded by C7orf10, corresponding to a target binding site such as BINDING SITE I, BINDING SITE II or BINDING SITE III of FIG. 8. Table 4 illustrates the complementarity of the nucleotide sequences of C7orf10 BINDING SITE, designated SEQ ID:11807, to the nucleotide sequence of GAM96 RNA, herein designated GAM RNA, also designated SEQ ID:394.

Another function of GAM96 is therefore inhibition of Chromosome 7 open reading frame 10 (C7orf10, Accession NP_079004.1). Accordingly, utilities of GAM96 include diagnosis, prevention and treatment of diseases and clinical conditions associated with C7orf10.

Ca2+-dependent activator protein for secretion (CADPS, Accession NP_003707.1) is another GAM96 target gene, herein designated TARGET GENE. CADPS BINDING SITE is a target binding site found in the 3' untranslated region of mRNA encoded by CADPS, corresponding to a target binding site such as BINDING SITE I, BINDING SITE II or BINDING SITE III of FIG. 8. Table 4 illustrates the complementarity of the nucleotide sequences of CADPS BINDING SITE, designated SEQ ID:11125, to the nucleotide sequence of GAM96 RNA, herein designated GAM RNA, also designated SEQ ID:394.

Another function of GAM96 is therefore inhibition of Ca2+-dependent activator protein for secretion (CADPS, Accession NP_003707.1), a gene which is required for the Ca2+-regulated exocytosis of secretory vesicles. Accordingly, utilities of GAM96 include diagnosis, prevention and treatment of diseases and clinical conditions associated with CADPS.

The function of CADPS has been established by previous studies. Calcium-activated secretion in neuroendocrine cells is dependent on ATP and cytosolic proteins such as NSF (OMIM Ref. No. 601633), SNAPs (see OMIM Ref. No. 603215) GTP-binding proteins, and components of a vesicle coat complex. Walent et al. (1992) isolated a rat cytosolic factor, which they termed p145, that reconstitutes Ca(2+)-activated secretion via dense core vesicle exocytosis in permeable neuroendocrine cells. The protein is a dimer of 145-kD subunits. By screening rat brain cDNA libraries with anti-p145, Ann et al. (1997) obtained a cDNA encoding a protein of 1,289 amino acids, which they designated CAPS. Sequence analysis revealed an overall hydrophilic protein with 2 potential coiled-coil regions. Northern blot analysis on mRNA from human tissue revealed expression of a 5.6- kb transcript in brain, pancreas, hypothalamus, pituitary, and adrenal, but not in heart, placenta, lung, liver, skeletal muscle, or kidney. The sequence of rat CAPS is 75% similar and 54% identical to that of C. elegans UNC31; loss-of-function UNC31 mutants exhibit multiple nervous system defects.

Equilibrium dialysis studies showed that CAPS is a calcium-binding protein. By subcellular fractionation of isolated rat presynaptic nerve terminals, or synaptosomes, Berwin et al. (1998) determined that CAPS is primarily associated with plasma membranes and large dense core vesicles but not with small clear synaptic vesicles.

Full details of the abovementioned studies are described in the following publications, the disclosure of which are hereby incorporated by reference:

Walent, J. H.; Porter, B. W.; Martin, T. F. J.: A novel 145 kd brain cytosolic protein reconstitutes Ca(2+)-regulated secretion in permeable neuroendocrine cells. Cell 70:765-775, 1992; and Ann, K.; Kowalchy, J. A.; Loyet, K. M.; Martin, T. F. J.: Novel Ca(2+)- binding protein (CAPS) related to UNC-31 required for Ca(2+)- activated exocytosis. J. Biol. Chem. 272:19637-1964.

Further studies establishing the function and utilities of CADPS are found in John Hopkins OMIM database record ID 604667, and in cited publications listed in Table 5, which are hereby incorporated by reference. Cd209 antigen (CD209, Accession NP_066978.1) is another GAM96 target gene, herein designated TARGET GENE. CD209 BINDING SITE is a target binding site found in the 3' untranslated region of mRNA encoded by CD209, corresponding to a target binding site such as BINDING SITE I, BINDING SITE II or BINDING SITE III of FIG. 8. Table 4 illustrates the complementarity of the nucleotide sequences of CD209 BINDING SITE, designated SEQ ID:18162, to the nucleotide sequence of GAM96 RNA, herein designated GAM RNA, also designated SEQ ID:394.

Another function of GAM96 is therefore inhibition of Cd209 antigen (CD209, Accession NP_066978.1), a gene which may play an important role in the CD4-independent association of HIV with cells. Accordingly, utilities of GAM96 include diagnosis, prevention and treatment of diseases and clinical conditions associated with CD209.

The function of CD209 has been established by previous studies. DCs capture microorganisms that enter peripheral mucosal tissues, and then migrate to secondary lymphoid organs, where they present these in antigenic form to resting T cells, thus initiating adaptive immune responses. Geijtenbeek et al. (2000) described the properties of DCSIGN, which is highly expressed on DCs present in mucosal tissues and binds to the HIV-1 envelope glycoprotein gp120. DCSIGN does not function as a receptor for viral entry into DCs but instead promotes efficient infection in trans of cells that express CD4 and chemokine receptors. Geijtenbeek et al. (2000) proposed that DCSIGN efficiently captures HIV-1 in the periphery and facilitates its transport to secondary lymphoid organs rich in T cells, to enhance infection in trans of these target cells. The binding of the human immunodeficiency virus (HIV) envelope glycoprotein gp120 to the cell surface receptor CD4 (OMIM Ref. No. 186940) had been considered a primary determinant of viral tropism. A number of cell types, however, can be infected by the virus, or bind gp120, in the absence of CD4 expression. Human placenta had been identified as a tissue that binds gp120 in a CD4-independent manner. By expression cloning, Curtis et al. (1992) screened a placenta cDNA library and isolated a cDNA (clone 11) encoding a gp120-binding protein unrelated to CD4. The 1.3-kb cDNA predicts a 404-amino acid protein with a calculated molecular mass of 45,775 Da. The gp120-binding protein is organized into 3 domains: an N-terminal cytoplasmic and hydrophobic region, a set of tandem repeats (7 complete and 1 incomplete), and a C-terminal domain with homology to C-type (calcium-dependent) lectins. A type II membrane orientation (N-terminal cytoplasmic) was predicted both by the cDNA sequence and by the reactivity of C-terminal peptide-specific antiserum with the surface of clone 11-transfected cells. Native and recombinant gp120 and whole virus bound transfected cells. Gp120 binding was high affinity (Kd, 1.3 to 1.6 nM) and was inhibited by mannan, D-mannose, and L-fucose; once bound, gp120 was internalized rapidly. These data demonstrated that the gp120-binding protein is a membrane-associated mannose-binding lectin. Curtis et al. (1992) suggested that proteins of this type may play an important role in the CD4-independent association of HIV with cells.

Full details of the abovementioned studies are described in the following publications, the disclosure of which are hereby incorporated by reference:

Geijtenbeek, T. B. H.; Kwon, D. S.; Torensma, R.; van Vliet, S. J.; van Duijnhoven, G. C. F.; Middel, J.; Cornelissen, I. L. M. H. A.; Nottet, H. S. L. M.; KewalRamani, V. N.; Littman, D. R.; Figdor, C. G.; van Kooy, Y.: DC-SIGN, a dendritic cell- specific HIV-1-binding protein that enhances trans-infection of T cells. Cell 100:587-597, 2000; and Curtis, B. M.; Scharnowske, S.; Watson, A. J.: Sequence and expression of a membrane- associated C-type lectin that exhibits CD4-independent binding of human immunodeficiency virus enve.

Further studies establishing the function and utilities of CD209 are found in John Hopkins OMIM database record ID 604672, and in cited publications listed in Table 5, which are hereby incorporated by reference. Choline kinase-like (CHKL, Accession NP_689466.1) is another GAM96 target gene, herein designated TARGET GENE. CHKL BINDING SITE1 and CHKL BINDING SITE2 are target binding sites found in untranslated regions of multiple transcripts of mRNA encoded by CHKL, corresponding to target binding sites such as BINDING SITE I, BINDING SITE II or BINDING SITE III of FIG. 8. Table 4 illustrates the complementarity of the nucleotide sequences of CHKL BINDING SITE1 and CHKL BINDING SITE2, designated SEQ ID:13794 and SEQ ID:8093 respectively, to the nucleotide sequence of GAM96 RNA, herein designated GAM RNA, also designated SEQ ID:394.

Another function of GAM96 is therefore inhibition of Choline kinase-like (CHKL, Accession NP_689466.1). Accordingly, utilities of GAM96 include diagnosis, prevention and treatment of diseases and clinical conditions associated with CHKL.

Chloride channel, nucleotide-sensitive, 1a (CLNS1A, Accession NP_001284.1) is another GAM96 target gene, herein designated TARGET GENE. CLNS1A BINDING SITE is a target binding site found in the 3' untranslated region of mRNA encoded by CLNS1A, corresponding to a target binding site such as BINDING SITE I, BINDING SITE II or BINDING SITE III of FIG. 8. Table 4 illustrates the complementarity of the nucleotide sequences of CLNS1A BINDING SITE, designated SEQ ID:3510, to the nucleotide sequence of GAM96 RNA, herein designated GAM RNA, also designated SEQ ID:394.

Another function of GAM96 is therefore inhibition of Chloride channel, nucleotide-sensitive, 1a (CLNS1A, Accession NP_001284.1), a gene which may participate in cellular volume control. Accordingly, utilities of GAM96 include diagnosis, prevention and treatment of diseases and clinical conditions associated with CLNS1A.

The function of CLNS1A has been established by previous studies. Anguita et al. (1995) cloned a novel gene encoding the chloride channel I(Cln) from a human ocular ciliary epithelial cell cDNA library. The gene encodes a 237-amino acid polypeptide that is over 90% identical to rat and canine I(Cln). The predicted protein contains 4 putative transmembrane domains. By Northern blot analysis, Nagl et al. (1996) found that the gene is expressed as an approximately 1.7-kb message in a variety of human tissues. Nagl et al. (1996) cloned the genomic DNA of the CLNS1A gene and showed that the gene comprises several exons spanning 19 kb of the genome. Schwartz et al. (1997) cloned I(Cln) from human reticulocyte cDNA. I(Cln) protein from red blood cell ghost membranes migrated as 2 bands, 37 and 43 kD, on SDS-PAGE. Schwartz et al. (1997) immunolocalized I(Cln) to the red blood cell membrane and, by the yeast 2-hybrid system, demonstrated that it formed stable complexes with beta-actin (OMIM Ref. No. 102630). The authors suggested that I(Cln) is involved in chloride transport and volume regulation in red blood cells.

Full details of the abovementioned studies are described in the following publications, the disclosure of which are hereby incorporated by reference:

Anguita, J.; Chalfant, M. L.; Civan, M. M.; Coca-Prados, M.: Molecular cloning of the human volume-sensitive chloride conductance regulatory protein, pI(Cln), from ocular ciliary epithelium. Biochem. Biophys. Res. Commun. 208: 89-95, 1995; and Buyse, G.; De Greef, C.; Raeymaekers, L.; Droogmans, G.; Nilius, B.; Eggermont, J. : The ubiquitously expressed pI(Cln) protein forms homomeric complexes in vitro. Biochem. Biophys. Res.

Further studies establishing the function and utilities of CLNS1A are found in John Hopkins OMIM database record ID 602158, and in cited publications listed in Table 5, which are hereby incorporated by reference. Collagen, type xi, alpha 2 (COL11A2, Accession NP_542412.1) is another GAM96 target gene, herein designated TARGET GENE. COL11A2 BINDING SITE is a target binding site found in the 5' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:6777, to the nucleotide sequence of GAM96 RNA, herein designated GAM RNA, also designated SEQ ID:394.

Another function of GAM96 is therefore inhibition of Collagen, type xi, alpha 2 (COL11A2, Accession NP_542412.1). Accordingly, utilities of GAM96 include diagnosis, prevention and treatment of diseases and clinical conditions associated with COL11A2.

Collagen, type xi, alpha 2 (COL11A2, Accession NP_542410.1) is another GAM96 target gene, herein designated TARGET GENE. COL11A2 BINDING SITE is a target binding site found in the 5' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:6777, to the nucleotide sequence of GAM96 RNA, herein designated GAM RNA, also designated SEQ ID:394.

Another function of GAM96 is therefore inhibition of Collagen, type xi, alpha 2 (COL11A2, Accession NP_542410.1). Accordingly, utilities of GAM96 include diagnosis, prevention and treatment of diseases and clinical conditions associated with COL11A2.

Collagen, type xi, alpha 2 (COL11A2, Accession NP_542411.1) is another GAM96 target gene, herein designated TARGET GENE. COL11A2 BINDING SITE is a target binding site found in the 5' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:6777, to the nucleotide sequence of GAM96 RNA, herein designated GAM RNA, also designated SEQ ID:394.

Another function of GAM96 is therefore inhibition of Collagen, type xi, alpha 2 (COL11A2, Accession NP_542411.1). Accordingly, utilities of GAM96 include diagnosis, prevention and treatment of diseases and clinical conditions associated with COL11A2.

Carnitine palmitoyltransferase 1b (muscle) (CPT1B, Accession NP_689452.1) is another GAM96 target gene, herein designated TARGET GENE. CPT1B BINDING SITE1 and CPT1B BINDING SITE2 are target binding sites found in untranslated regions of multiple transcripts of mRNA encoded by CPT1B, corresponding to target binding sites such as BINDING SITE I, BINDING SITE II or BINDING SITE III of FIG. 8. Table 4 illustrates the complementarity of the nucleotide sequences of CPT1B BINDING SITE1 and CPT1B BINDING SITE2, designated SEQ ID:13794 and SEQ ID:8093 respectively, to the nucleotide sequence of GAM96 RNA, herein designated GAM RNA, also designated SEQ ID:394.

Another function of GAM96 is therefore inhibition of Carnitine palmitoyltransferase 1b (muscle) (CPT1B, Accession NP_689452.1), a gene which is a rate-controlling enzyme of long-chain fatty acid b-oxidation pathway. Accordingly, utilities of GAM96 include diagnosis, prevention and treatment of diseases and clinical conditions associated with CPT1B.

The function of CPT1B and its association with various diseases and clinical conditions, has been established by previous studies, as described hereinabove with reference to GAM47.1. Carnitine palmitoyltransferase 1b (muscle) (CPT1B, Accession NP_004368.1) is another GAM96 target gene, herein designated TARGET GENE. CPT1B BINDING SITE1 and CPT1B BINDING SITE2 are target binding sites found in untranslated regions of multiple transcripts of mRNA encoded by CPT1B, corresponding to target binding sites such as BINDING SITE I, BINDING SITE II or BINDING SITE III of FIG. 8. Table 4 illustrates the complementarity of the nucleotide sequences of CPT1B BINDING SITE1 and CPT1B BINDING SITE2, designated SEQ ID:13794 and SEQ ID:13794 respectively, to the nucleotide sequence of GAM96 RNA, herein designated GAM RNA, also designated SEQ ID:394.

Another function of GAM96 is therefore inhibition of Carnitine palmitoyltransferase 1b (muscle) (CPT1B, Accession NP_004368.1), a gene which is a rate-controlling enzyme of long-chain fatty acid b-oxidation pathway. Accordingly, utilities of GAM96 include diagnosis, prevention and treatment of diseases and clinical conditions associated with CPT1B.

The function of CPT1B and its association with various diseases and clinical conditions, has been established by previous studies, as described hereinabove with reference to GAM47.1. Carnitine palmitoyltransferase 1b (muscle) (CPT1B, Accession NP_689451.1) is another GAM96 target gene, herein designated TARGET GENE. CPT1B BINDING SITE1 and CPT1B BINDING SITE2 are target binding sites found in untranslated regions of multiple transcripts of mRNA encoded by CPT1B, corresponding to target binding sites such as BINDING SITE I, BINDING SITE II or BINDING SITE III of FIG. 8. Table 4 illustrates the complementarity of the nucleotide sequences of CPT1B BINDING SITE1 and CPT1B BINDING SITE2, designated SEQ ID:13794 and SEQ ID:15756 respectively, to the nucleotide sequence of GAM96 RNA, herein designated GAM RNA, also designated SEQ ID:394.

Another function of GAM96 is therefore inhibition of Carnitine palmitoyltransferase 1b (muscle) (CPT1B, Accession NP_689451.1), a gene which is a rate-controlling enzyme of long-chain fatty acid b-oxidation pathway. Accordingly, utilities of GAM96 include diagnosis, prevention and treatment of diseases and clinical conditions associated with CPT1B.

The function of CPT1B and its association with various diseases and clinical conditions, has been established by previous studies, as described hereinabove with reference to GAM47.1. Cytochrome p450, subfamily iia (phenobarbital-inducible), polypeptide 7 (CYP2A7, Accession NP_000755.2) is another GAM96 target gene, herein designated TARGET GENE. CYP2A7 BINDING SITE is a target binding site found in the 5' untranslated region of multiple transcripts of mRNA encoded by CYP2A7, corresponding to a target binding site such as BINDING SITE I, BINDING SITE II or BINDING SITE III of FIG. 8. Table 4 illustrates the complementarity of the nucleotide sequences of CYP2A7 BINDING SITE, designated SEQ ID:15756, to the nucleotide sequence of GAM96 RNA, herein designated GAM RNA, also designated SEQ ID:394.

Another function of GAM96 is therefore inhibition of Cytochrome p450, subfamily iia (phenobarbital-inducible), polypeptide 7 (CYP2A7, Accession NP_000755.2). Accordingly, utilities of GAM96 include diagnosis, prevention and treatment of diseases and clinical conditions associated with CYP2A7.

Death-associated protein kinase 2 (DAPK2, Accession NP_055141.2) is another GAM96 target gene, herein designated TARGET GENE. DAPK2 BINDING SITE is a target binding site found in the 3' untranslated region of mRNA encoded by DAPK2, corresponding to a target binding site such as BINDING SITE I, BINDING SITE II or BINDING SITE III of FIG. 8. Table 4 illustrates the complementarity of the nucleotide sequences of DAPK2 BINDING SITE, designated SEQ ID:17977, to the nucleotide sequence of GAM96 RNA, herein designated GAM RNA, also designated SEQ ID:394.

Another function of GAM96 is therefore inhibition of Death-associated protein kinase 2 (DAPK2, Accession NP_055141.2). Accordingly, utilities of GAM96 include diagnosis, prevention and treatment of diseases and clinical conditions associated with DAPK2.

Dihydrofolate reductase (DHFR, Accession NP_000782.1) is another GAM96 target gene, herein designated TARGET GENE. DHFR BINDING SITE is a target binding site found in the 3' untranslated region of mRNA encoded by DHFR, corresponding to a target binding site such as BINDING SITE I, BINDING SITE II or BINDING SITE III of FIG. 8. Table 4 illustrates the complementarity of the nucleotide sequences of DHFR BINDING SITE, designated SEQ ID:4871, to the nucleotide sequence of GAM96 RNA, herein designated GAM RNA, also designated SEQ ID:394.

Another function of GAM96 is therefore inhibition of Dihydrofolate reductase (DHFR, Accession NP_000782.1), a gene which converts dihydrofolate into tetrahydrofolate. Accordingly, utilities of GAM96 include diagnosis, prevention and treatment of diseases and clinical conditions associated with DHFR.

The function of DHFR and its association with various diseases and clinical conditions, has been established by previous studies, as described hereinabove with reference to GAM64.1. DIS3 (Accession NP_055768.2) is another GAM96 target gene, herein designated TARGET GENE. DIS3 BINDING SITE is a target binding site found in the 3' untranslated region of mRNA encoded by DIS3, corresponding to a target binding site such as BINDING SITE I, BINDING SITE II or BINDING SITE III of FIG. 8. Table 4 illustrates the complementarity of the nucleotide sequences of DIS3 BINDING SITE, designated SEQ ID:16298, to the nucleotide sequence of GAM96 RNA, herein designated GAM RNA, also designated SEQ ID:394.

Another function of GAM96 is therefore inhibition of DIS3 (Accession NP_055768.2). Accordingly, utilities of GAM96 include diagnosis, prevention and treatment of diseases and clinical conditions associated with DIS3.

DKFZP434B204 (Accession XP_300993.1) is another GAM96 target gene, herein designated TARGET GENE. DKFZP434B204 BINDING SITE is a target binding site found in the 5' untranslated region of mRNA encoded by DKFZP434B204, corresponding to a target binding site such as BINDING SITE I, BINDING SITE II or BINDING SITE III of FIG. 8. Table 4 illustrates the complementarity of the nucleotide sequences of DKFZP434B204 BINDING SITE, designated SEQ ID:19187, to the nucleotide sequence of GAM96 RNA, herein designated GAM RNA, also designated SEQ ID:394.

Another function of GAM96 is therefore inhibition of DKFZP434B204 (Accession XP_300993.1). Accordingly, utilities of GAM96 include diagnosis, prevention and treatment of diseases and clinical conditions associated with DKFZP434B204.

DKFZp434C1714 (Accession NP_690047.1) is another GAM96 target gene, herein designated TARGET GENE. DKFZp434C1714 BINDING SITE is a target binding site found in the 3' untranslated region of mRNA encoded by DKFZp434C1714, corresponding to a target binding site such as BINDING SITE I, BINDING SITE II or BINDING SITE III of FIG. 8. Table 4 illustrates the complementarity of the nucleotide sequences of DKFZp434C1714 BINDING SITE, designated SEQ ID:10751, to the nucleotide sequence of GAM96 RNA, herein designated GAM RNA, also designated SEQ ID:394.

Another function of GAM96 is therefore inhibition of DKFZp434C1714 (Accession NP_690047.1). Accordingly, utilities of GAM96 include diagnosis, prevention and treatment of diseases and clinical conditions associated with DKFZp434C1714.

DKFZP434G1411 (Accession XP_166383.1) is another GAM96 target gene, herein designated TARGET GENE. DKFZP434G1411 BINDING SITE is a target binding site found in the 5' untranslated region of mRNA encoded by DKFZP434G1411, corresponding to a target binding site such as BINDING SITE I, BINDING SITE II or BINDING SITE III of FIG. 8. Table 4 illustrates the complementarity of the nucleotide sequences of DKFZP434G1411 BINDING SITE, designated SEQ ID:7012, to the nucleotide sequence of GAM96 RNA, herein designated GAM RNA, also designated SEQ ID:394.

Another function of GAM96 is therefore inhibition of DKFZP434G1411 (Accession XP_166383.1). Accordingly, utilities of GAM96 include diagnosis, prevention and treatment of diseases and clinical conditions associated with DKFZP434G1411.

DKFZP434H0820 (Accession NP_073744.1) is another GAM96 target gene, herein designated TARGET GENE. DKFZP434H0820 BINDING SITE is a target binding site found in the 3' untranslated region of mRNA encoded by DKFZP434H0820, corresponding to a target binding site such as BINDING SITE I, BINDING SITE II or BINDING SITE III of FIG. 8. Table 4 illustrates the complementarity of the nucleotide sequences of DKFZP434H0820 BINDING SITE, designated SEQ ID:16671, to the nucleotide sequence of GAM96 RNA, herein designated GAM RNA, also designated SEQ ID:394.

Another function of GAM96 is therefore inhibition of DKFZP434H0820 (Accession NP_073744.1). Accordingly, utilities of GAM96 include diagnosis, prevention and treatment of diseases and clinical conditions associated with DKFZP434H0820.

DKFZP434J154 (Accession NP_056425.1) is another GAM96 target gene, herein designated TARGET GENE. DKFZP434J154 BINDING SITE is a target binding site found in the 3' untranslated region of multiple transcripts of mRNA encoded by DKFZP434J154, corresponding to a target binding site such as BINDING SITE I, BINDING SITE II or BINDING SITE III of FIG. 8. Table 4 illustrates the complementarity of the nucleotide sequences of DKFZP434J154 BINDING SITE, designated SEQ ID:1790, to the nucleotide sequence of GAM96 RNA, herein designated GAM RNA, also designated SEQ ID:394.

Another function of GAM96 is therefore inhibition of DKFZP434J154 (Accession NP_056425.1). Accordingly, utilities of GAM96 include diagnosis, prevention and treatment of diseases and clinical conditions associated with DKFZP434J154.

DKFZP564K2062 (Accession NP_056236.1) is another GAM96 target gene, herein designated TARGET GENE. DKFZP564K2062 BINDING SITE is a target binding site found in the 3' untranslated region of mRNA encoded by DKFZP564K2062, corresponding to a target binding site such as BINDING SITE I, BINDING SITE II or BINDING SITE III of FIG. 8. Table 4 illustrates the complementarity of the nucleotide sequences of DKFZP564K2062 BINDING SITE, designated SEQ ID:15475, to the nucleotide sequence of GAM96 RNA, herein designated GAM RNA, also designated SEQ ID:394.

Another function of GAM96 is therefore inhibition of DKFZP564K2062 (Accession NP_056236.1). Accordingly, utilities of GAM96 include diagnosis, prevention and treatment of diseases and clinical conditions associated with DKFZP564K2062.

DKFZp586I1420 (Accession NP_689960.1) is another GAM96 target gene, herein designated TARGET GENE. DKFZp586I1420 BINDING SITE is a target binding site found in the 3' untranslated region of mRNA encoded by DKFZp586I1420, corresponding to a target binding site such as BINDING SITE I, BINDING SITE II or BINDING SITE III of FIG. 8. Table 4 illustrates the complementarity of the nucleotide sequences of DKFZp586I1420 BINDING SITE, designated SEQ ID:13013, to the nucleotide sequence of GAM96 RNA, herein designated GAM RNA, also designated SEQ ID:394.

Another function of GAM96 is therefore inhibition of DKFZp586I1420 (Accession NP_689960.1). Accordingly, utilities of GAM96 include diagnosis, prevention and treatment of diseases and clinical conditions associated with DKFZp586I1420.

DKFZP586I2223 (Accession NP_056253.2) is another GAM96 target gene, herein designated TARGET GENE. DKFZP586I2223 BINDING SITE is a target binding site found in the 3' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:13101, to the nucleotide sequence of GAM96 RNA, herein designated GAM RNA, also designated SEQ ID:394.

Another function of GAM96 is therefore inhibition of DKFZP586I2223 (Accession NP_056253.2). Accordingly, utilities of GAM96 include diagnosis, prevention and treatment of diseases and clinical conditions associated with DKFZP586I2223.

DKFZP586I2223 (Accession NP_542768.1) is another GAM96 target gene, herein designated TARGET GENE. DKFZP586I2223 BINDING SITE is a target binding site found in the 3' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:13101, to the nucleotide sequence of GAM96 RNA, herein designated GAM RNA, also designated SEQ ID:394.

Another function of GAM96 is therefore inhibition of DKFZP586I2223 (Accession NP_542768.1). Accordingly, utilities of GAM96 include diagnosis, prevention and treatment of diseases and clinical conditions associated with DKFZP586I2223.

DKFZP586I2223 (Accession NP_542769.1) is another GAM96 target gene, herein designated TARGET GENE. DKFZP586I2223 BINDING SITE is a target binding site found in the 3' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:13101, to the nucleotide sequence of GAM96 RNA, herein designated GAM RNA, also designated SEQ ID:394.

Another function of GAM96 is therefore inhibition of DKFZP586I2223 (Accession NP_542769.1). Accordingly, utilities of GAM96 include diagnosis, prevention and treatment of diseases and clinical conditions associated with DKFZP586I2223.

DKFZp761A132 (Accession NP_115672.1) is another GAM96 target gene, herein designated TARGET GENE. DKFZp761A132 BINDING SITE is a target binding site found in the 3' untranslated region of mRNA encoded by DKFZp761A132, corresponding to a target binding site such as BINDING SITE I, BINDING SITE II or BINDING SITE III of FIG. 8. Table 4 illustrates the complementarity of the nucleotide sequences of DKFZp761A132 BINDING SITE, designated SEQ ID:9980, to the nucleotide sequence of GAM96 RNA, herein designated GAM RNA, also designated SEQ ID:394.

Another function of GAM96 is therefore inhibition of DKFZp761A132 (Accession NP_115672.1). Accordingly, utilities of GAM96 include diagnosis, prevention and treatment of diseases and clinical conditions associated with DKFZp761A132.

DKFZp761B107 (Accession NP_775734.1) is another GAM96 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:2288, to the nucleotide sequence of GAM96 RNA, herein designated GAM RNA, also designated SEQ ID:394.

Another function of GAM96 is therefore inhibition of DKFZp761B107 (Accession NP_775734.1). Accordingly, utilities of GAM96 include diagnosis, prevention and treatment of diseases and clinical conditions associated with DKFZp761B107.

DKFZp761I2123 (Accession XP_166582.2) is another GAM96 target gene, herein designated TARGET GENE. DKFZp761I2123 BINDING SITE is a target binding site found in the 5' untranslated region of mRNA encoded by DKFZp761I2123, corresponding to a target binding site such as BINDING SITE I, BINDING SITE II or BINDING SITE III of FIG. 8. Table 4 illustrates the complementarity of the nucleotide sequences of DKFZp761I2123 BINDING SITE, designated SEQ ID:16727, to the nucleotide sequence of GAM96 RNA, herein designated GAM RNA, also designated SEQ ID:394.

Another function of GAM96 is therefore inhibition of DKFZp761I2123 (Accession XP_166582.2). Accordingly, utilities of GAM96 include diagnosis, prevention and treatment of diseases and clinical conditions associated with DKFZp761I2123.

Down syndrome critical region gene 1 (DSCR1, Accession NP_004405.2) is another GAM96 target gene, herein designated TARGET GENE. DSCR1 BINDING SITE is a target binding site found in the 3' untranslated region of mRNA encoded by DSCR1, corresponding to a target binding site such as BINDING SITE I, BINDING SITE II or BINDING SITE III of FIG. 8. Table 4 illustrates the complementarity of the nucleotide sequences of DSCR1 BINDING SITE, designated SEQ ID:5007, to the nucleotide sequence of GAM96 RNA, herein designated GAM RNA, also designated SEQ ID:394.

Another function of GAM96 is therefore inhibition of Down syndrome critical region gene 1 (DSCR1, Accession NP_004405.2), a gene which inhibits calcineurin-dependent transcriptional responses. Accordingly, utilities of GAM96 include diagnosis, prevention and treatment of diseases and clinical conditions associated with DSCR1.

The function of DSCR1 has been established by previous studies. The study of patients with partial trisomy 21 has defined an area of approximately 3 Mb at chromosomal region 21q22 as the minimal candidate region for the Down syndrome phenotype (OMIM Ref. No. 190685). Using a novel exon cloning strategy, Fuentes et al. (1995) identified several putative exons from region 21q22.1-q22.2. One exon was used to isolate fetal brain cDNAs corresponding to a gene that the authors designated DSCR1. The predicted 171-amino acid protein contains 2 proline-rich regions, a putative DNA-binding domain, and an acidic region. Northern blot analysis revealed that the 2.2-kb DSCR1 transcript is expressed at the highest levels in fetal brain and adult heart and at lower levels in various other tissues. An additional 2-kb mRNA was detected in fetal and adult liver. Increased expression in the brains of young rats compared with adults suggested to Fuentes et al. (1995) that DSCR1 plays a role during central nervous system development. Fuentes et al. (1997) determined that DSCR1 spans nearly 45 kb and contains 7 exons, 4 of which are alternative first exons. They found tissue-specific expression patterns for the alternative transcripts. Kingsbury and Cunningham (2000) referred to the proteins encoded by the MCIP genes as calcipressins. Functional analysis showed that when expressed in yeast, DSCR1 and ZAKI4 inhibited calcineurin function. The authors proposed that increased expression of DSCR1 in trisomy-21 individuals may contribute to the neurologic, cardiac, or immunologic defects of Down syndrome.

Full details of the abovementioned studies are described in the following publications, the disclosure of which are hereby incorporated by reference:

Fuentes, J. J.; Pritchard, M. A.; Estivill, X.: Genomic organization, alternative splicing, and expression patterns of the DSCR1 (Down syndrome candidate region 1) gene. Genomics 44:358-361, 1997; and Kingsbury, T. J.; Cunningham, K. W.: A conserved family of calcineurin regulators. Genes Dev. 14:1595-1604, 2000.

Further studies establishing the function and utilities of DSCR1 are found in John Hopkins OMIM database record ID 602917, and in cited publications listed in Table 5, which are hereby incorporated by reference. DUSP18 (Accession NP_689724.2) is another GAM96 target gene, herein designated TARGET GENE. DUSP18 BINDING SITE is a target binding site found in the 3' untranslated region of mRNA encoded by DUSP18, corresponding to a target binding site such as BINDING SITE I, BINDING SITE II or BINDING SITE III of FIG. 8. Table 4 illustrates the complementarity of the nucleotide sequences of DUSP18 BINDING SITE, designated SEQ ID:14263, to the nucleotide sequence of GAM96 RNA, herein designated GAM RNA, also designated SEQ ID:394.

Another function of GAM96 is therefore inhibition of DUSP18 (Accession NP_689724.2). Accordingly, utilities of GAM96 include diagnosis, prevention and treatment of diseases and clinical conditions associated with DUSP18.

Eukaryotic translation initiation factor 2, subunit 1 alpha, 35 kda (EIF2S1, Accession NP_004085.1) is another GAM96 target gene, herein designated TARGET GENE. EIF2S1 BINDING SITE is a target binding site found in the 3' untranslated region of mRNA encoded by EIF2S1, corresponding to a target binding site such as BINDING SITE I, BINDING SITE II or BINDING SITE III of FIG. 8. Table 4 illustrates the complementarity of the nucleotide sequences of EIF2S1 BINDING SITE, designated SEQ ID:15812, to the nucleotide sequence of GAM96 RNA, herein designated GAM RNA, also designated SEQ ID:394.

Another function of GAM96 is therefore inhibition of Eukaryotic translation initiation factor 2, subunit 1 alpha, 35 kda (EIF2S1, Accession NP_004085.1). Accordingly, utilities of GAM96 include diagnosis, prevention and treatment of diseases and clinical conditions associated with EIF2S1.

Ectonucleoside triphosphate diphosphohydrolase 3 (ENTPD3, Accession NP_001239.1) is another GAM96 target gene, herein designated TARGET GENE. ENTPD3 BINDING SITE is a target binding site found in the 3' untranslated region of mRNA encoded by ENTPD3, corresponding to a target binding site such as BINDING SITE I, BINDING SITE II or BINDING SITE III of FIG. 8. Table 4 illustrates the complementarity of the nucleotide sequences of ENTPD3 BINDING SITE, designated SEQ ID:1288, to the nucleotide sequence of GAM96 RNA, herein designated GAM RNA, also designated SEQ ID:394.

Another function of GAM96 is therefore inhibition of Ectonucleoside triphosphate diphosphohydrolase 3 (ENTPD3, Accession NP_001239.1). Accordingly, utilities of GAM96 include diagnosis, prevention and treatment of diseases and clinical conditions associated with ENTPD3.

EPAC (Accession NP_006096.2) is another GAM96 target gene, herein designated TARGET GENE. EPAC BINDING SITE is a target binding site found in the 5' untranslated region of mRNA encoded by EPAC, corresponding to a target binding site such as BINDING SITE I, BINDING SITE II or BINDING SITE III of FIG. 8. Table 4 illustrates the complementarity of the nucleotide sequences of EPAC BINDING SITE, designated SEQ ID:3791, to the nucleotide sequence of GAM96 RNA, herein designated GAM RNA, also designated SEQ ID:394.

Another function of GAM96 is therefore inhibition of EPAC (Accession NP_006096.2), a gene which activates the ras family member Rap1 by promoting GTP binding. Accordingly, utilities of GAM96 include diagnosis, prevention and treatment of diseases and clinical conditions associated with EPAC.

The function of EPAC has been established by previous studies. cAMP is a second messenger that induces a wide range of responses in different cell types, including activation of the RAS-related GTPase RAP1A (OMIM Ref. No. 179520). By searching databases for proteins with cAMP-binding sites and homology to guanine nucleotide exchange factors (GEFs) for RAS (OMIM Ref. No. 190020) and RAP1, followed by RT-PCR, de Rooij et al. (1998) isolated a cDNA encoding EPAC. Sequence analysis predicted that the 881-amino acid EPAC protein has a cAMP- binding site; a GEF homology domain; a RAS exchange motif, which may be important in GEF structure stabilization; and a DEP (dishevelled, egl10, pleckstrin) domain, which may be involved in membrane attachment. Northern blot analysis revealed ubiquitous expression of EPAC, with highest levels in kidney and heart. Binding analysis confirmed a direct interaction between EPAC and cAMP. Functional analysis showed that EPAC is a GEF for RAP1A that is directly regulated by cAMP. Using differential display for brain-enriched genes related to signaling in striatum, and by screening for second messenger motifs, Kawasaki et al. (1998) obtained cDNAs encoding EPAC, which they called cAMP-GEFI, and cAMP-GEFII (OMIM Ref. No. 606058). Expression of cAMP-GEFI and cAMP-GEFII activated RAP1A after forskolin and 3-isobutyl-1-methylxanthine stimulation, independent of the protein kinase A (see OMIM Ref. No. 176911) pathway. cAMP-GEFI and cAMP-GEFII expression did not activate or only slightly activated other RAS superfamily members after stimulation. Mutational analysis determined that the cAMP-binding site of cAMP-GEFI is necessary for activation of RAP1A. Northern blot analysis detected wide expression of a predominant 4.0-kb cAMP-GEFI transcript in various tissues and brain regions. In situ hybridization analysis demonstrated broad, low-level expression of cAMP-GEFI in adult rat brain and selective expression in neonatal brain, including septum and thalamus.

Full details of the abovementioned studies are described in the following publications, the disclosure of which are hereby incorporated by reference:

de Rooij, J.; Zwartkruis, F. J. T.; Verheijen, M. H. G.; Cool, R. H.; Nijman, S. M. B.; Wittinghofer, A.; Bos, J. L.: Epac is a Rap1 guanine-nucleotide-exchange factor directly activated by cyclic AMP. Nature 396:474-477, 1998; and Kawasaki, H.; Springett, G. M.; Mochizuki, N.; Toki, S.; Nakay, M.; Matsuda, M.; Housman, D. E.; Graybiel, A. M.: A family of cAMP-binding proteins that directly activate Rap1. Scienc.

Further studies establishing the function and utilities of EPAC are found in John Hopkins OMIM database record ID 606057, and in cited publications listed in Table 5, which are hereby incorporated by reference. Ephb1 (EPHB1, Accession NP_004432.1) is another GAM96 target gene, herein designated TARGET GENE. EPHB1 BINDING SITE is a target binding site found in the 3' untranslated region of mRNA encoded by EPHB1, corresponding to a target binding site such as BINDING SITE I, BINDING SITE II or BINDING SITE III of FIG. 8. Table 4 illustrates the complementarity of the nucleotide sequences of EPHB1 BINDING SITE, designated SEQ ID:9482, to the nucleotide sequence of GAM96 RNA, herein designated GAM RNA, also designated SEQ ID:394.

Another function of GAM96 is therefore inhibition of Ephb1 (EPHB1, Accession NP_004432.1), a gene which receptor for members of the ephrin-b family. binds to ephrin-b1, -b2 and -b3. Accordingly, utilities of GAM96 include diagnosis, prevention and treatment of diseases and clinical conditions associated with EPHB1.

The function of EPHB1 has been established by previous studies. See 179610 for background on Eph receptors and their ligands, the ephrins. Tang et al. (1995) cloned and characterized a member of the EPH-related receptor protein tyrosine kinases and designated it NET (neuronally expressed EPH-related tyrosine kinase). The cDNA was isolated from a fetal brain expression library using a monoclonal antibody. The 3.9-kb RNA encodes a predicted protein of 984 amino acids with 2 hydrophobic regions corresponding to possible signal peptide and transmembrane domains. The NET protein shares 99% amino acid identity with Elk, the rat homolog. Northern blots showed maximal NET expression in the nervous system and in some tumor cell lines derived from neuroectoderm. Using immunohistochemical analysis of the developing mouse hindbrain, Cowan et al. (2000) detected Ephb1 expression in the floor plate and in hindbrain regions where facial and inner ear efferent neurons are located. Contractor et al. (2002) reported that mossy fiber long-term potentiation was reduced by perfusion of postsynaptic neurons with peptides and antibodies that interfere with binding of EphB receptor tyrosine kinases to the PDZ protein GRIP (GRIP1; 604597). Mossy fiber long-term potentiation was also reduced by extracellular application of soluble forms of beta-ephrins, which are normally membrane-anchored presynaptic ligands for the EphB receptors. The application of soluble ligands for presynaptic ephrins increased basal excitatory transmission and occluded both tetanus and forskolin-induced synaptic potentiation. Contractor et al. (2002) concluded that the PDZ interactions in postsynaptic neuron and transsynaptic interactions between postsynaptic EphB receptors and presynaptic beta-ephrins are necessary for the induction of mossy fiber long-term potentiation. Tang et al. (1995) mapped the EPHB1 gene to 3q21-q23 by fluorescence in situ hybridization.

Full details of the abovementioned studies are described in the following publications, the disclosure of which are hereby incorporated by reference:

Tang, X. X.; Biegel, J. A.; Nycum, L. M.; Yoshioka, A.; Brodeur, G. M.; Pleasure, D. E.; Ikegaki, N.: cDNA cloning, molecular characterization, and chromosomal localization of NET (EPHT2), a human EPH-related receptor protein-tyrosine kinase gene preferentially expressed in brain.:Genomics 29:426-437, 1995; and Contractor, A.; Rogers, C.; Maron, C.; Henkemeyer, M.; Swanson, G. T.; Heinemann, S. F.: Trans-synaptic Eph receptor-ephrin signaling in hippocampal mossy fiber LTP. Science 296:1864-1.

Further studies establishing the function and utilities of EPHB1 are found in John Hopkins OMIM database record ID 600600, and in cited publications listed in Table 5, which are hereby incorporated by reference. Era g-protein-like 1 (e. coli) (ERAL1, Accession NP_005693.1) is another GAM96 target gene, herein designated TARGET GENE. ERAL1 BINDING SITE is a target binding site found in the 3' untranslated region of mRNA encoded by ERAL1, corresponding to a target binding site such as BINDING SITE I, BINDING SITE II or BINDING SITE III of FIG. 8. Table 4 illustrates the complementarity of the nucleotide sequences of ERAL1 BINDING SITE, designated SEQ ID:18451, to the nucleotide sequence of GAM96 RNA, herein designated GAM RNA, also designated SEQ ID:394.

Another function of GAM96 is therefore inhibition of Era g-protein-like 1 (e. coli) (ERAL1, Accession NP_005693.1). Accordingly, utilities of GAM96 include diagnosis, prevention and treatment of diseases and clinical conditions associated with ERAL1.

Coagulation factor xiii, a1 polypeptide (F13A1, Accession NP_000120.1) is another GAM96 target gene, herein designated TARGET GENE. F13A1 BINDING SITE is a target binding site found in the 3' untranslated region of mRNA encoded by F13A1, corresponding to a target binding site such as BINDING SITE I, BINDING SITE II or BINDING SITE III of FIG. 8. Table 4 illustrates the complementarity of the nucleotide sequences of F13A1 BINDING SITE, designated SEQ ID:5986, to the nucleotide sequence of GAM96 RNA, herein designated GAM RNA, also designated SEQ ID:394.

Another function of GAM96 is therefore inhibition of Coagulation factor xiii, a1 polypeptide (F13A1, Accession NP_000120.1). Accordingly, utilities of GAM96 include diagnosis, prevention and treatment of diseases and clinical conditions associated with F13A1.

Coagulation factor ix (plasma thromboplastic component, christmas disease, hemophilia b) (F9, Accession NP_000124.1) is another GAM96 target gene, herein designated TARGET GENE. F9 BINDING SITE is a target binding site found in the 3' untranslated region of mRNA encoded by F9, corresponding to a target binding site such as BINDING SITE I, BINDING SITE II or BINDING SITE III of FIG. 8. Table 4 illustrates the complementarity of the nucleotide sequences of F9 BINDING SITE, designated SEQ ID:946, to the nucleotide sequence of GAM96 RNA, herein designated GAM RNA, also designated SEQ ID:394.

Another function of GAM96 is therefore inhibition of Coagulation factor ix (plasma thromboplastic component, christmas disease, hemophilia b) (F9, Accession NP_000124.1). Accordingly, utilities of GAM96 include diagnosis, prevention and treatment of diseases and clinical conditions associated with F9.

F-box only protein 22 (FBXO22, Accession NP_671717.1) is another GAM96 target gene, herein designated TARGET GENE. FBXO22 BINDING SITE is a target binding site found in the 3' untranslated region of multiple transcripts of mRNA encoded by FBXO22, corresponding to a target binding site such as BINDING SITE I, BINDING SITE II or BINDING SITE III of FIG. 8. Table 4 illustrates the complementarity of the nucleotide sequences of FBXO22 BINDING SITE, designated SEQ ID:9917, to the nucleotide sequence of GAM96 RNA, herein designated GAM RNA, also designated SEQ ID:394.

Another function of GAM96 is therefore inhibition of F-box only protein 22 (FBXO22, Accession NP_671717.1). Accordingly, utilities of GAM96 include diagnosis, prevention and treatment of diseases and clinical conditions associated with FBXO22.

Fetuin b (FETUB, Accession NP_055190.1) is another GAM96 target gene, herein designated TARGET GENE. FETUB BINDING SITE is a target binding site found in the 3' untranslated region of mRNA encoded by FETUB, corresponding to a target binding site such as BINDING SITE I, BINDING SITE II or BINDING SITE III of FIG. 8. Table 4 illustrates the complementarity of the nucleotide sequences of FETUB BINDING SITE, designated SEQ ID:5702, to the nucleotide sequence of GAM96 RNA, herein designated GAM RNA, also designated SEQ ID:394.

Another function of GAM96 is therefore inhibition of Fetuin b (FETUB, Accession NP_055190.1), a gene which Member of the cystatin family of cysteine protease inhibitors. Accordingly, utilities of GAM96 include diagnosis, prevention and treatment of diseases and clinical conditions associated with FETUB.

The function of FETUB has been established by previous studies. The fetuin family, which is part of the cystatin superfamily, encompasses a series of tightly related proteins that are synthesized mostly in the liver. Fetuins have been implicated in several diverse functions, including osteogenesis and bone resorption, regulation of the insulin and hepatocyte growth factor receptors (147670 and 164860, respectively, and response to systemic inflammation. In an effort to identify hepatic genes preferentially expressed during acute inflammation, Olivier et al. (1999) identified a partial cDNA encoding rat fetuin B (Fetub). Northern blot analysis detected liver-specific expression of rat Fetub. By searching an EST database using the full-length rat sequence as the probe, Olivier et al. (2000) identified cDNAs encoding human and mouse FETUB. The 382-amino acid human FETUB protein shares sequence and structural similarity with fetuin A (FETUA; 138680). The human, mouse, and rat FETUB proteins share 61% amino acid identity. Northern blot analysis detected a developmentally regulated expression pattern for Fetub in mouse and rat liver that differed between species. In response to inflammatory stimulus, hepatic levels of rat Fetua and Fetub were downregulated. Using ESTs, Olivier et al. (2000) mapped the FETUB gene to 3q27, where the FETUA gene is localized.

Full details of the abovementioned studies are described in the following publications, the disclosure of which are hereby incorporated by reference:

Olivier, E.; Soury, E.; Risler, J. L.; Smith, F.; Schneider, K.; Lochner, K.; Jouzeau, J.Y.; Fey, G. H.; Salier, J. P.: A novel set of hepatic mRNAs preferentially expressed during an acute inflammation in rat represents mostly intracellular proteins. Genomics 57:352-364, 1999; and Olivier, E.; Soury, E.; Ruminy, P.; Husson, A.; Parmentier, F.; Daveau, M.; Salier, J.-P.: Fetuin-B, a second member of the fetuin family in mammals. Biochem. J. 350:589-597, 2000.

Further studies establishing the function and utilities of FETUB are found in John Hopkins OMIM database record ID 605954, and in cited publications listed in Table 5, which are hereby incorporated by reference. FLJ10211 (Accession XP_290820.1) is another GAM96 target gene, herein designated TARGET GENE. FLJ10211 BINDING SITE is a target binding site found in the 3' untranslated region of mRNA encoded by FLJ10211, corresponding to a target binding site such as BINDING SITE I, BINDING SITE II or BINDING SITE III of FIG. 8. Table 4 illustrates the complementarity of the nucleotide sequences of FLJ10211 BINDING SITE, designated SEQ ID:10874, to the nucleotide sequence of GAM96 RNA, herein designated GAM RNA, also designated SEQ ID:394.

Another function of GAM96 is therefore inhibition of FLJ10211 (Accession XP_290820.1). Accordingly, utilities of GAM96 include diagnosis, prevention and treatment of diseases and clinical conditions associated with FLJ10211.

FLJ10260 (Accession NP_060512.2) is another GAM96 target gene, herein designated TARGET GENE. FLJ10260 BINDING SITE is a target binding site found in the 5' untranslated region of mRNA encoded by FLJ10260, corresponding to a target binding site such as BINDING SITE I, BINDING SITE II or BINDING SITE III of FIG. 8. Table 4 illustrates the complementarity of the nucleotide sequences of FLJ10260 BINDING SITE, designated SEQ ID:3452, to the nucleotide sequence of GAM96 RNA, herein designated GAM RNA, also designated SEQ ID:394.

Another function of GAM96 is therefore inhibition of FLJ10260 (Accession NP_060512.2). Accordingly, utilities of GAM96 include diagnosis, prevention and treatment of diseases and clinical conditions associated with FLJ10260.

FLJ10751 (Accession NP_060709.1) is another GAM96 target gene, herein designated TARGET GENE. FLJ10751 BINDING SITE is a target binding site found in the 3' untranslated region of multiple transcripts of mRNA encoded by FLJ10751, corresponding to a target binding site such as BINDING SITE I, BINDING SITE II or BINDING SITE III of FIG. 8. Table 4 illustrates the complementarity of the nucleotide sequences of FLJ10751 BINDING SITE, designated SEQ ID:18465, to the nucleotide sequence of GAM96 RNA, herein designated GAM RNA, also designated SEQ ID:394.

Another function of GAM96 is therefore inhibition of FLJ10751 (Accession NP_060709.1). Accordingly, utilities of GAM96 include diagnosis, prevention and treatment of diseases and clinical conditions associated with FLJ10751.

FLJ10751 (Accession NP_060675.1) is another GAM96 target gene, herein designated TARGET GENE. FLJ10751 BINDING SITE is a target binding site found in the 3' untranslated region of multiple transcripts of mRNA encoded by FLJ10751, corresponding to a target binding site such as BINDING SITE I, BINDING SITE II or BINDING SITE III of FIG. 8. Table 4 illustrates the complementarity of the nucleotide sequences of FLJ10751 BINDING SITE, designated SEQ ID:18465, to the nucleotide sequence of GAM96 RNA, herein designated GAM RNA, also designated SEQ ID:394.

Another function of GAM96 is therefore inhibition of FLJ10751 (Accession NP_060675.1). Accordingly, utilities of GAM96 include diagnosis, prevention and treatment of diseases and clinical conditions associated with FLJ10751.

FLJ11011 (Accession NP_060769.1) is another GAM96 target gene, herein designated TARGET GENE. FLJ11011 BINDING SITE is a target binding site found in the 3' untranslated region of mRNA encoded by FLJ11011, corresponding to a target binding site such as BINDING SITE I, BINDING SITE II or BINDING SITE III of FIG. 8. Table 4 illustrates the complementarity of the nucleotide sequences of FLJ11011 BINDING SITE, designated SEQ ID:16891, to the nucleotide sequence of GAM96 RNA, herein designated GAM RNA, also designated SEQ ID:394.

Another function of GAM96 is therefore inhibition of FLJ11011 (Accession NP_060769.1). Accordingly, utilities of GAM96 include diagnosis, prevention and treatment of diseases and clinical conditions associated with FLJ11011.

FLJ11117 (Accession NP_060799.1) is another GAM96 target gene, herein designated TARGET GENE. FLJ11117 BINDING SITE is a target binding site found in the 3' untranslated region of mRNA encoded by FLJ11117, corresponding to a target binding site such as BINDING SITE I, BINDING SITE II or BINDING SITE III of FIG. 8. Table 4 illustrates the complementarity of the nucleotide sequences of FLJ11117 BINDING SITE, designated SEQ ID:582, to the nucleotide sequence of GAM96 RNA, herein designated GAM RNA, also designated SEQ ID:394.

Another function of GAM96 is therefore inhibition of FLJ11117 (Accession NP_060799.1). Accordingly, utilities of GAM96 include diagnosis, prevention and treatment of diseases and clinical conditions associated with FLJ11117.

FLJ11320 (Accession NP_060859.2) is another GAM96 target gene, herein designated TARGET GENE. FLJ11320

BINDING SITE is a target binding site found in the 3' untranslated region of mRNA encoded by FLJ11320, corresponding to a target binding site such as BINDING SITE I, BINDING SITE II or BINDING SITE III of FIG. 8. Table 4 illustrates the complementarity of the nucleotide sequences of FLJ11320 BINDING SITE, designated SEQ ID:18433, to the nucleotide sequence of GAM96 RNA, herein designated GAM RNA, also designated SEQ ID:394.

Another function of GAM96 is therefore inhibition of FLJ11320 (Accession NP_060859.2). Accordingly, utilities of GAM96 include diagnosis, prevention and treatment of diseases and clinical conditions associated with FLJ11320.

FLJ12287 (Accession NP_071762.2) is another GAM96 target gene, herein designated TARGET GENE. FLJ12287 BINDING SITE is a target binding site found in the 3' untranslated region of mRNA encoded by FLJ12287, corresponding to a target binding site such as BINDING SITE I, BINDING SITE II or BINDING SITE III of FIG. 8. Table 4 illustrates the complementarity of the nucleotide sequences of FLJ12287 BINDING SITE, designated SEQ ID:15505, to the nucleotide sequence of GAM96 RNA, herein designated GAM RNA, also designated SEQ ID:394.

Another function of GAM96 is therefore inhibition of FLJ12287 (Accession NP_071762.2). Accordingly, utilities of GAM96 include diagnosis, prevention and treatment of diseases and clinical conditions associated with FLJ12287.

FLJ12592 (Accession NP_115545.2) is another GAM96 target gene, herein designated TARGET GENE. FLJ12592 BINDING SITE is a target binding site found in the 5' untranslated region of mRNA encoded by FLJ12592, corresponding to a target binding site such as BINDING SITE I, BINDING SITE II or BINDING SITE III of FIG. 8. Table 4 illustrates the complementarity of the nucleotide sequences of FLJ12592 BINDING SITE, designated SEQ ID:6618, to the nucleotide sequence of GAM96 RNA, herein designated GAM RNA, also designated SEQ ID:394.

Another function of GAM96 is therefore inhibition of FLJ12592 (Accession NP_115545.2). Accordingly, utilities of GAM96 include diagnosis, prevention and treatment of diseases and clinical conditions associated with FLJ12592.

FLJ12806 (Accession NP_073742.1) is another GAM96 target gene, herein designated TARGET GENE. FLJ12806 BINDING SITE is a target binding site found in the 3' untranslated region of mRNA encoded by FLJ12806, corresponding to a target binding site such as BINDING SITE I, BINDING SITE II or BINDING SITE III of FIG. 8. Table 4 illustrates the complementarity of the nucleotide sequences of FLJ12806 BINDING SITE, designated SEQ ID:1666, to the nucleotide sequence of GAM96 RNA, herein designated GAM RNA, also designated SEQ ID:394.

Another function of GAM96 is therefore inhibition of FLJ12806 (Accession NP_073742.1). Accordingly, utilities of GAM96 include diagnosis, prevention and treatment of diseases and clinical conditions associated with FLJ12806.

FLJ14800 (Accession NP_116229.1) is another GAM96 target gene, herein designated TARGET GENE. FLJ14800 BINDING SITE1 and FLJ14800 BINDING SITE2 are target binding sites found in untranslated regions of mRNA encoded by FLJ14800, corresponding to target binding sites such as BINDING SITE I, BINDING SITE II or BINDING SITE III of FIG. 8. Table 4 illustrates the complementarity of the nucleotide sequences of FLJ14800 BINDING SITE1 and FLJ14800 BINDING SITE2, designated SEQ ID:9483 and SEQ ID:5726 respectively, to the nucleotide sequence of GAM96 RNA, herein designated GAM RNA, also designated SEQ ID:394.

Another function of GAM96 is therefore inhibition of FLJ14800 (Accession NP_116229.1). Accordingly, utilities of GAM96 include diagnosis, prevention and treatment of diseases and clinical conditions associated with FLJ14800.

FLJ20320 (Accession NP_060235.1) is another GAM96 target gene, herein designated TARGET GENE. FLJ20320 BINDING SITE is a target binding site found in the 5' untranslated region of mRNA encoded by FLJ20320, corresponding to a target binding site such as BINDING SITE I, BINDING SITE II or BINDING SITE III of FIG. 8. Table 4 illustrates the complementarity of the nucleotide sequences of FLJ20320 BINDING SITE, designated SEQ ID:18080, to the nucleotide sequence of GAM96 RNA, herein designated GAM RNA, also designated SEQ ID:394.

Another function of GAM96 is therefore inhibition of FLJ20320 (Accession NP_060235.1). Accordingly, utilities of GAM96 include diagnosis, prevention and treatment of diseases and clinical conditions associated with FLJ20320.

FLJ20337 (Accession NP_060242.1) is another GAM96 target gene, herein designated TARGET GENE. FLJ20337 BINDING SITE is a target binding site found in the 3' untranslated region of mRNA encoded by FLJ20337, corresponding to a target binding site such as BINDING SITE I, BINDING SITE II or BINDING SITE III of FIG. 8. Table 4 illustrates the complementarity of the nucleotide sequences of FLJ20337 BINDING SITE, designated SEQ ID:5583, to the nucleotide sequence of GAM96 RNA, herein designated GAM RNA, also designated SEQ ID:394.

Another function of GAM96 is therefore inhibition of FLJ20337 (Accession NP_060242.1). Accordingly, utilities of GAM96 include diagnosis, prevention and treatment of diseases and clinical conditions associated with FLJ20337.

FLJ20509 (Accession NP_060321.1) is another GAM96 target gene, herein designated TARGET GENE. FLJ20509 BINDING SITE is a target binding site found in the 5' untranslated region of mRNA encoded by FLJ20509, corresponding to a target binding site such as BINDING SITE I, BINDING SITE II or BINDING SITE III of FIG. 8. Table 4 illustrates the complementarity of the nucleotide sequences of FLJ20509 BINDING SITE, designated SEQ ID:3424, to the nucleotide sequence of GAM96 RNA, herein designated GAM RNA, also designated SEQ ID:394.

Another function of GAM96 is therefore inhibition of FLJ20509 (Accession NP_060321.1). Accordingly, utilities of GAM96 include diagnosis, prevention and treatment of diseases and clinical conditions associated with FLJ20509.

FLJ21603 (Accession NP_079038.1) is another GAM96 target gene, herein designated TARGET GENE. FLJ21603 BINDING SITE is a target binding site found in the 3' untranslated region of mRNA encoded by FLJ21603, corresponding to a target binding site such as BINDING SITE I, BINDING SITE II or BINDING SITE III of FIG. 8. Table 4 illustrates the complementarity of the nucleotide sequences of FLJ21603 BINDING SITE, designated SEQ ID:6263, to the nucleotide sequence of GAM96 RNA, herein designated GAM RNA, also designated SEQ ID:394.

Another function of GAM96 is therefore inhibition of FLJ21603 (Accession NP_079038.1). Accordingly, utilities of GAM96 include diagnosis, prevention and treatment of diseases and clinical conditions associated with FLJ21603.

FLJ22353 (Accession NP_078863.1) is another GAM96 target gene, herein designated TARGET GENE. FLJ22353 BINDING SITE is a target binding site found in the 3' untranslated region of mRNA encoded by FLJ22353, corresponding to a target binding site such as BINDING SITE I, BINDING SITE II or BINDING SITE III of FIG. 8. Table 4 illustrates the complementarity of the nucleotide sequences of FLJ22353 BINDING SITE, designated SEQ ID:6381, to the nucleotide sequence of GAM96 RNA, herein designated GAM RNA, also designated SEQ ID:394.

Another function of GAM96 is therefore inhibition of FLJ22353 (Accession NP_078863.1). Accordingly, utilities of GAM96 include diagnosis, prevention and treatment of diseases and clinical conditions associated with FLJ22353.

FLJ22386 (Accession NP_078865.1) is another GAM96 target gene, herein designated TARGET GENE. FLJ22386 BINDING SITE is a target binding site found in the 3' untranslated region of mRNA encoded by FLJ22386, corresponding to a target binding site such as BINDING SITE I, BINDING SITE II or BINDING SITE III of FIG. 8. Table 4 illustrates the complementarity of the nucleotide sequences of FLJ22386 BINDING SITE, designated SEQ ID:8060, to the nucleotide sequence of GAM96 RNA, herein designated GAM RNA, also designated SEQ ID:394.

Another function of GAM96 is therefore inhibition of FLJ22386 (Accession NP_078865.1). Accordingly, utilities of GAM96 include diagnosis, prevention and treatment of diseases and clinical conditions associated with FLJ22386.

FLJ22578 (Accession NP_079140.1) is another GAM96 target gene, herein designated TARGET GENE. FLJ22578 BINDING SITE is a target binding site found in the 5' untranslated region of mRNA encoded by FLJ22578, corresponding to a target binding site such as BINDING SITE I, BINDING SITE II or BINDING SITE III of FIG. 8. Table 4 illustrates the complementarity of the nucleotide sequences of FLJ22578 BINDING SITE, designated SEQ ID:15354, to the nucleotide sequence of GAM96 RNA, herein designated GAM RNA, also designated SEQ ID:394.

Another function of GAM96 is therefore inhibition of FLJ22578 (Accession NP_079140.1). Accordingly, utilities of GAM96 include diagnosis, prevention and treatment of diseases and clinical conditions associated with FLJ22578.

FLJ23168 (Accession NP_079331.2) is another GAM96 target gene, herein designated TARGET GENE. FLJ23168 BINDING SITE is a target binding site found in the 3' untranslated region of mRNA encoded by FLJ23168, corresponding to a target binding site such as BINDING SITE I, BINDING SITE II or BINDING SITE III of FIG. 8. Table 4 illustrates the complementarity of the nucleotide sequences of FLJ23168 BINDING SITE, designated SEQ ID:9803, to the nucleotide sequence of GAM96 RNA, herein designated GAM RNA, also designated SEQ ID:394.

Another function of GAM96 is therefore inhibition of FLJ23168 (Accession NP_079331.2). Accordingly, utilities of GAM96 include diagnosis, prevention and treatment of diseases and clinical conditions associated with FLJ23168.

FLJ30092 (Accession NP_659420.1) is another GAM96 target gene, herein designated TARGET GENE. FLJ30092 BINDING SITE is a target binding site found in the 3' untranslated region of mRNA encoded by FLJ30092, corresponding to a target binding site such as BINDING SITE I, BINDING SITE II or BINDING SITE III of FIG. 8. Table 4 illustrates the complementarity of the nucleotide sequences of FLJ30092 BINDING SITE, designated SEQ ID:7410, to the nucleotide sequence of GAM96 RNA, herein designated GAM RNA, also designated SEQ ID:394.

Another function of GAM96 is therefore inhibition of FLJ30092 (Accession NP_659420.1). Accordingly, utilities of GAM96 include diagnosis, prevention and treatment of diseases and clinical conditions associated with FLJ30092.

FLJ30317 (Accession NP_742148.1) is another GAM96 target gene, herein designated TARGET GENE. FLJ30317 BINDING SITE is a target binding site found in the 3' untranslated region of mRNA encoded by FLJ30317, corresponding to a target binding site such as BINDING SITE I, BINDING SITE II or BINDING SITE III of FIG. 8. Table 4 illustrates the complementarity of the nucleotide sequences of FLJ30317 BINDING SITE, designated SEQ ID:19948, to the nucleotide sequence of GAM96 RNA, herein designated GAM RNA, also designated SEQ ID:394.

Another function of GAM96 is therefore inhibition of FLJ30317 (Accession NP_742148.1). Accordingly, utilities of GAM96 include diagnosis, prevention and treatment of diseases and clinical conditions associated with FLJ30317.

FLJ30791 (Accession NP_653295.1) is another GAM96 target gene, herein designated TARGET GENE. FLJ30791 BINDING SITE is a target binding site found in the 5' untranslated region of mRNA encoded by FLJ30791, corresponding to a target binding site such as BINDING SITE I, BINDING SITE II or BINDING SITE III of FIG. 8. Table 4 illustrates the complementarity of the nucleotide sequences of FLJ30791 BINDING SITE, designated SEQ ID:4121, to the nucleotide sequence of GAM96 RNA, herein designated GAM RNA, also designated SEQ ID:394.

Another function of GAM96 is therefore inhibition of FLJ30791 (Accession NP_653295.1). Accordingly, utilities of GAM96 include diagnosis, prevention and treatment of diseases and clinical conditions associated with FLJ30791.

FLJ31340 (Accession NP_689961.1) is another GAM96 target gene, herein designated TARGET GENE. FLJ31340 BINDING SITE is a target binding site found in the 3' untranslated region of mRNA encoded by FLJ31340, corresponding to a target binding site such as BINDING SITE I, BINDING SITE II or BINDING SITE III of FIG. 8. Table 4 illustrates the complementarity of the nucleotide sequences of FLJ31340 BINDING SITE, designated SEQ ID:2540, to the nucleotide sequence of GAM96 RNA, herein designated GAM RNA, also designated SEQ ID:394.

Another function of GAM96 is therefore inhibition of FLJ31340 (Accession NP_689961.1). Accordingly, utilities of GAM96 include diagnosis, prevention and treatment of diseases and clinical conditions associated with FLJ31340.

FLJ31737 (Accession NP_659421.1) is another GAM96 target gene, herein designated TARGET GENE. FLJ31737 BINDING SITE is a target binding site found in the 3' untranslated region of mRNA encoded by FLJ31737, corresponding to a target binding site such as BINDING SITE I, BINDING SITE II or BINDING SITE III of FIG. 8. Table 4 illustrates the complementarity of the nucleotide sequences of FLJ31737 BINDING SITE, designated SEQ ID:8026, to the nucleotide sequence of GAM96 RNA, herein designated GAM RNA, also designated SEQ ID:394.

Another function of GAM96 is therefore inhibition of FLJ31737 (Accession NP_659421.1). Accordingly, utilities of GAM96 include diagnosis, prevention and treatment of diseases and clinical conditions associated with FLJ31737.

FLJ32830 (Accession NP_689994.1) is another GAM96 target gene, herein designated TARGET GENE. FLJ32830 BINDING SITE is a target binding site found in the 5' untranslated region of mRNA encoded by FLJ32830, corresponding to a target binding site such as BINDING SITE I, BINDING SITE II or BINDING SITE III of FIG. 8. Table 4 illustrates the complementarity of the nucleotide sequences of FLJ32830 BINDING SITE, designated SEQ ID:16084, to the nucleotide sequence of GAM96 RNA, herein designated GAM RNA, also designated SEQ ID:394.

Another function of GAM96 is therefore inhibition of FLJ32830 (Accession NP_689994.1). Accordingly, utilities of GAM96 include diagnosis, prevention and treatment of diseases and clinical conditions associated with FLJ32830.

FLJ35866 (Accession XP_300990.1) is another GAM96 target gene, herein designated TARGET GENE. FLJ35866 BINDING SITE is a target binding site found in the 5' untranslated region of multiple transcripts of mRNA encoded by FLJ35866, corresponding to a target binding site such as BINDING SITE I, BINDING SITE II or BINDING SITE III of FIG. 8. Table 4 illustrates the complementarity of the nucleotide sequences of FLJ35866 BINDING SITE, designated SEQ ID:1168, to the nucleotide sequence of GAM96 RNA, herein designated GAM RNA, also designated SEQ ID:394.

Another function of GAM96 is therefore inhibition of FLJ35866 (Accession XP_300990.1). Accordingly, utilities of GAM96 include diagnosis, prevention and treatment of diseases and clinical conditions associated with FLJ35866.

FLJ38377 (Accession NP_689911.1) is another GAM96 target gene, herein designated TARGET GENE. FLJ38377 BINDING SITE is a target binding site found in the 5' untranslated region of mRNA encoded by FLJ38377, corresponding to a target binding site such as BINDING SITE I, BINDING SITE II or BINDING SITE III of FIG. 8. Table 4 illustrates the complementarity of the nucleotide sequences of FLJ38377 BINDING SITE, designated SEQ ID:13942, to the nucleotide sequence of GAM96 RNA, herein designated GAM RNA, also designated SEQ ID:394.

Another function of GAM96 is therefore inhibition of FLJ38377 (Accession NP_689911.1). Accordingly, utilities of GAM96 include diagnosis, prevention and treatment of diseases and clinical conditions associated with FLJ38377.

FLJ38426 (Accession NP_775882.1) is another GAM96 target gene, herein designated TARGET GENE. FLJ38426 BINDING SITE is a target binding site found in the 3' untranslated region of mRNA encoded by FLJ38426, corresponding to a target binding site such as BINDING SITE I, BINDING SITE II or BINDING SITE III of FIG. 8. Table 4 illustrates the complementarity of the nucleotide sequences of FLJ38426 BINDING SITE, designated SEQ ID:13647, to the nucleotide sequence of GAM96 RNA, herein designated GAM RNA, also designated SEQ ID:394.

Another function of GAM96 is therefore inhibition of FLJ38426 (Accession NP_775882.1). Accordingly, utilities of GAM96 include diagnosis, prevention and treatment of diseases and clinical conditions associated with FLJ38426.

FLJ38608 (Accession NP_694947.1) is another GAM96 target gene, herein designated TARGET GENE. FLJ38608 BINDING SITE is a target binding site found in the 3' untranslated region of mRNA encoded by FLJ38608, corresponding to a target binding site such as BINDING SITE I, BINDING SITE II or BINDING SITE III of FIG. 8. Table 4 illustrates the complementarity of the nucleotide sequences of FLJ38608 BINDING SITE, designated SEQ ID:12240, to the nucleotide sequence of GAM96 RNA, herein designated GAM RNA, also designated SEQ ID:394.

Another function of GAM96 is therefore inhibition of FLJ38608 (Accession NP_694947.1). Accordingly, utilities of GAM96 include diagnosis, prevention and treatment of diseases and clinical conditions associated with FLJ38608.

FLJ39058 (Accession NP_775851.1) is another GAM96 target gene, herein designated TARGET GENE. FLJ39058 BINDING SITE is a target binding site found in the 3' untranslated region of mRNA encoded by FLJ39058, corresponding to a target binding site such as BINDING SITE I, BINDING SITE II or BINDING SITE III of FIG. 8. Table 4 illustrates the complementarity of the nucleotide sequences of FLJ39058 BINDING SITE, designated SEQ ID:7832, to the nucleotide sequence of GAM96 RNA, herein designated GAM RNA, also designated SEQ ID:394.

Another function of GAM96 is therefore inhibition of FLJ39058 (Accession NP_775851.1). Accordingly, utilities of GAM96 include diagnosis, prevention and treatment of diseases and clinical conditions associated with FLJ39058.

Fragile x mental retardation 2 (FMR2, Accession NP_002016.1) is another GAM96 target gene, herein designated TARGET GENE. FMR2 BINDING SITE is a target binding site found in the 3' untranslated region of mRNA encoded by FMR2, corresponding to a target binding site such as BINDING SITE I, BINDING SITE II or BINDING SITE III of FIG. 8. Table 4 illustrates the complementarity of the nucleotide sequences of FMR2 BINDING SITE, designated SEQ ID:12667, to the nucleotide sequence of GAM96 RNA, herein designated GAM RNA, also designated SEQ ID:394.

Another function of GAM96 is therefore inhibition of Fragile x mental retardation 2 (FMR2, Accession NP_002016.1). Accordingly, utilities of GAM96 include diagnosis, prevention and treatment of diseases and clinical conditions associated with FMR2.

Grb2-associated binding protein 3 (GAB3, Accession NP_542179.1) is another GAM96 target gene, herein designated TARGET GENE. GAB3 BINDING SITE is a target binding site found in the 3' untranslated region of mRNA encoded by GAB3, corresponding to a target binding site such as BINDING SITE I, BINDING SITE II or BINDING SITE III of FIG. 8. Table 4 illustrates the complementarity of the nucleotide sequences of GAB3 BINDING SITE, designated SEQ ID:19604, to the nucleotide sequence of GAM96 RNA, herein designated GAM RNA, also designated SEQ ID:394.

Another function of GAM96 is therefore inhibition of Grb2-associated binding protein 3 (GAB3, Accession NP_542179.1). Accordingly, utilities of GAM96 include diagnosis, prevention and treatment of diseases and clinical conditions associated with GAB3.

Udp-n-acetyl-alpha-d-galactosamine:polypeptide n-acetylgalactosaminyltransferase 2 (galnac-t2) (GALNT2, Accession NP_004472.1) is another GAM96 target gene, herein designated TARGET GENE. GALNT2 BINDING SITE is a target binding site found in the 3' untranslated region of mRNA encoded by GALNT2, corresponding to a target binding site such as BINDING SITE I, BINDING SITE II or BINDING SITE III of FIG. 8. Table 4 illustrates the complementarity of the nucleotide sequences of GALNT2 BINDING SITE, designated SEQ ID:3290, to the nucleotide sequence of GAM96 RNA, herein designated GAM RNA, also designated SEQ ID:394.

Another function of GAM96 is therefore inhibition of Udp-n-acetyl-alpha-d-galactosamine:polypeptide n-acetylgalactosaminyltransferase 2 (galnac-t2) (GALNT2, Accession NP_004472.1), a gene which catalyzes the initial reaction in o-linked oligosaccharide biosynthesis. Accordingly, utilities of GAM96 include diagnosis, prevention and treatment of diseases and clinical conditions associated with GALNT2.

The function of GALNT2 has been established by previous studies. UDP-N- acetyl-alpha-D-galactosamine:polypeptide N-acetylgalactosaminyltransferase (GalNAc- T; EC 2.4.1.41) transfers an N-acetyl galactosamine (OMIM Ref. No. GalNAc) to the hydroxyl group of a serine or threonine residue in the first step of O-linked oligosaccharide biosynthesis. White et al. (1995) purified GALNT2, termed GalNAc-T2 by them, from human placenta, using a defined synthetic acceptor peptide as an affinity ligand. They also identified a cDNA for GALNT2 using polymerase chain reaction with primers derived from the protein sequence of the purified GALNT2. The GALNT2 cDNA encodes a predicted 571-amino acid protein of approximately 64 kD (White et al., 1995). Bennett et al. (1998) found that the GALNT1 (OMIM Ref. No. 602273), GALNT2, and GALNT3 (OMIM Ref. No. 601756) genes contain 11, 16, and 10 exons, respectively. Several intron/exon boundaries are conserved within the 3 genes. By FISH, Bennett et al. (1998) mapped the GALNT2 gene to chromosome 1q41-q42.

Full details of the abovementioned studies are described in the following publications, the disclosure of which are hereby incorporated by reference:

Bennett, E. P.; Weghuis, D. O.; Merkx, G.; Geurts van Kessel, A.; Eiberg, H.; Clausen, H.: Genomic organization and chromosomal localization of three members of the UDP-N- acetylgalactosamine:polypeptide N-acetylgalactosaminyltransferase family. Glycobiology 8:547-555, 1998; and White, T.; Bennett, E. P.; Takio, K.; Sorensen, T.; Bonding, N.; Clausen, H.: Purification and cDNA cloning of a human UDP-N-acetyl-alpha-D- galactosamine:polypeptide N-acetylgalactosam.

Further studies establishing the function and utilities of GALNT2 are found in John Hopkins OMIM database record ID 602274, and in cited publications listed in Table 5, which are hereby incorporated by reference. Glycoprotein a repetitions predominant (GARP, Accession NP_005503.1) is another GAM96 target gene, herein designated TARGET GENE. GARP BINDING SITE is a target binding site found in the 3' untranslated region of mRNA encoded by GARP, corresponding to a target binding site such as BINDING SITE I, BINDING SITE II or BINDING SITE III of FIG. 8. Table 4 illustrates the complementarity of the nucleotide sequences of GARP BINDING SITE, designated SEQ ID:7696, to the nucleotide sequence of GAM96 RNA, herein designated GAM RNA, also designated SEQ ID:394.

Another function of GAM96 is therefore inhibition of Glycoprotein a repetitions predominant (GARP, Accession NP_005503.1). Accordingly, utilities of GAM96 include diagnosis, prevention and treatment of diseases and clinical conditions associated with GARP.

Golgi apparatus protein 1 (GLG1, Accession NP_036333.1) is another GAM96 target gene, herein designated TARGET GENE. GLG1 BINDING SITE is a target binding site found in the 3' untranslated region of mRNA encoded by GLG1, corresponding to a target binding site such as BINDING SITE I, BINDING SITE II or BINDING SITE III of FIG. 8. Table 4 illustrates the complementarity of the nucleotide sequences of GLG1 BINDING SITE, designated SEQ ID:19296, to the nucleotide sequence of GAM96 RNA, herein designated GAM RNA, also designated SEQ ID:394.

Another function of GAM96 is therefore inhibition of Golgi apparatus protein 1 (GLG1, Accession NP_036333.1). Accordingly, utilities of GAM96 include diagnosis, prevention and treatment of diseases and clinical conditions associated with GLG1.

Guanine nucleotide binding protein (g protein), beta 5 (GNB5, Accession NP_006569.1) is another GAM96 target gene, herein designated TARGET GENE. GNB5 BINDING SITE is a target binding site found in the 3' untranslated region of multiple transcripts of mRNA encoded by GNB5, corresponding to a target binding site such as BINDING SITE I, BINDING SITE II or BINDING SITE III of FIG. 8. Table 4 illustrates the complementarity of the nucleotide sequences of GNB5 BINDING SITE, designated SEQ ID:19704, to the nucleotide sequence of GAM96 RNA, herein designated GAM RNA, also designated SEQ ID:394.

Another function of GAM96 is therefore inhibition of Guanine nucleotide binding protein (g protein), beta 5 (GNB5, Accession NP_006569.1), a gene which functions as a modulator or transducer in various transmembrane signaling systems. Accordingly, utilities of GAM96 include diagnosis, prevention and treatment of diseases and clinical conditions associated with GNB5.

The function of GNB5 has been established by previous studies. Using a degenerate PCR approach to screen a human brain cDNA library, Jones et al. (1998) cloned the beta-5 subunit, symbolized GNB5, of G protein. In contrast to beta subunits 1 through 4, which are at least 83% homologous, GNB5 is only 50% homologous to the other beta subunits. On the other hand, the predicted 353-amino acid protein sequence is 99.4% homologous to the mouse beta-5 protein, with only 2 conservative amino acid differences. Northern blot analysis revealed that mouse Gnb5 is expressed predominantly in brain (Watson et al., 1994), whereas human GNB5 is expressed at high levels not only in brain but also in pancreas, kidney, and heart (Jones et al., 1998), as a major 3.0- and minor 2.0- and 9.0-kb transcripts. Within the brain, (Jones et al., 1998) detected highest expression in cerebellum, cerebral cortex, occipital pole, frontal lobe, temporal lobe, and caudate putamen, and lowest expression in corpus callosum and spinal cord.

Animal model experiments lend further support to the function of GNB5. The 'flailer' (flr) mouse exhibits a phenotype consisting of frequent falling, convulsive limb movements (leg flailing), and ataxia persistent into adulthood. Jones et al. (2000) determined that the flailer mouse expresses a novel gene combining the promoter and first 2 exons of Gnb5 with the C-terminal exons of the closely linked myosin-5A (MyoVA) gene (Myo5a; 160777). Biochemical and genetic studies indicated that the flailer protein, which is expressed predominantly in brain, competes with wildtype MyoVA in vivo, preventing the localization of smooth endoplasmic reticulum vesicles in the dendritic spines of cerebellar Purkinje cells. The flailer protein thus has a dominant-negative mechanism of action with a recessive mode of inheritance due to the dependence of competitive binding on the ratio between mutant and wildtype proteins. The chromosomal arrangement of Myo5a upstream of Gnb5 is consistent with nonhomologous recombination as the mutational mechanism.

It is appreciated that the abovementioned animal model for GNB5 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jones, J. M.; Huang, J.-D.; Mermall, V.; Hamilton, B. A.; Mooseker, M. S.; Escay, A.; Copeland, N. G.; Jenkins, N. A.; Meisler, M. H.: The mouse neurological mutant flailer expresses a novel hybrid gene derived by exon shuffling between Gnb5 and Myo5a. Hum. Molec. Genet. 9:821-828, 2000; and Watson, A. J.; Katz, A.; Simon, M. I.: A fifth member of the mammalian G-protein beta subunit family: expression in brain and activation of the beta-2 isotype of phospholipase C. J.

Further studies establishing the function and utilities of GNB5 are found in John Hopkins OMIM database record ID 604447, and in cited publications listed in Table 5, which are hereby incorporated by reference. Guanine nucleotide binding protein (g protein), beta 5 (GNB5, Accession NP_057278.2) is another GAM96 target gene, herein designated TARGET GENE. GNB5 BINDING SITE is a target binding site found in the 3' untranslated region of multiple transcripts of mRNA encoded by GNB5, corresponding to a target binding site such as BINDING SITE I, BINDING SITE II or BINDING SITE III of FIG. 8. Table 4 illustrates the complementarity of the nucleotide sequences of GNB5 BINDING SITE, designated SEQ ID:19704, to the nucleotide sequence of GAM96 RNA, herein designated GAM RNA, also designated SEQ ID:394.

Another function of GAM96 is therefore inhibition of Guanine nucleotide binding protein (g protein), beta 5 (GNB5, Accession NP_057278.2), a gene which functions as a modulator or transducer in various transmembrane signaling systems. Accordingly, utilities of GAM96 include diagnosis, prevention and treatment of diseases and clinical conditions associated with GNB5.

The function of GNB5 has been established by previous studies. Using a degenerate PCR approach to screen a human brain cDNA library, Jones et al. (1998) cloned the beta-5 subunit, symbolized GNB5, of G protein. In contrast to beta subunits 1 through 4, which are at least 83% homologous, GNB5 is only 50% homologous to the other beta subunits. On the other hand, the predicted 353-amino acid protein sequence is 99.4% homologous to the mouse beta-5 protein, with only 2 conservative amino acid differences. Northern blot analysis revealed that mouse Gnb5 is expressed predominantly in brain (Watson et al., 1994), whereas human GNB5 is expressed at high levels not only in brain but also in pancreas, kidney, and heart (Jones et al., 1998), as a major 3.0- and minor 2.0- and 9.0-kb transcripts. Within the brain, (Jones et al., 1998) detected highest expression in cerebellum, cerebral cortex, occipital pole, frontal lobe, temporal lobe, and caudate putamen, and lowest expression in corpus callosum and spinal cord.

Animal model experiments lend further support to the function of GNB5. The 'flailer' (flr) mouse exhibits a phenotype consisting of frequent falling, convulsive limb movements (leg flailing), and ataxia persistent into adulthood. Jones et al. (2000) determined that the flailer mouse expresses a novel gene combining the promoter and first 2 exons of Gnb5 with the C-terminal exons of the closely linked myosin-5A (MyoVA) gene (Myo5a; 160777). Biochemical and genetic studies indicated that the flailer protein, which is expressed predominantly in brain, competes with wildtype MyoVA in vivo, preventing the localization of smooth endoplasmic reticulum vesicles in the dendritic spines of cerebellar Purkinje cells. The flailer protein thus has a dominant-negative mechanism of action with a recessive mode of inheritance due to the dependence of competitive binding on the ratio between mutant and wildtype proteins. The chromosomal arrangement of Myo5a upstream of Gnb5 is consistent with nonhomologous recombination as the mutational mechanism.

It is appreciated that the abovementioned animal model for GNB5 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jones, J. M.; Huang, J.-D.; Mermall, V.; Hamilton, B. A.; Mooseker, M. S.; Escay, A.; Copeland, N. G.; Jenkins, N. A.; Meisler, M. H.: The mouse neurological mutant flailer expresses a novel hybrid gene derived by exon shuffling between Gnb5 and Myo5a. Hum. Molec. Genet. 9:821-828, 2000; and Watson, A. J.; Katz, A.; Simon, M. I.: A fifth member of the mammalian G-protein beta subunit family: expression in brain and activation of the beta-2 isotype of phospholipase C. J.

Further studies establishing the function and utilities of GNB5 are found in John Hopkins OMIM database record ID 604447, and in cited publications listed in Table 5, which are hereby incorporated by reference. GNPNAT1 (Accession XP_085119.1) is another GAM96 target gene, herein designated TARGET GENE. GNPNAT1 BINDING SITE is a target binding site found in the 3' untranslated region of mRNA encoded by GNPNAT1, corresponding to a target binding site such as BINDING SITE I, BINDING SITE II or BINDING SITE III of FIG. 8. Table 4 illustrates the complementarity of the nucleotide sequences of GNPNAT1 BINDING SITE, designated SEQ ID:8591, to the nucleotide sequence of GAM96 RNA, herein designated GAM RNA, also designated SEQ ID:394.

Another function of GAM96 is therefore inhibition of GNPNAT1 (Accession XP_085119.1). Accordingly, utilities of GAM96 include diagnosis, prevention and treatment of diseases and clinical conditions associated with GNPNAT1.

Golgi autoantigen, golgin subfamily a, 4 (GOLGA4, Accession NP_002069.2) is another GAM96 target gene, herein designated TARGET GENE. GOLGA4 BINDING SITE is a target binding site found in the 3' untranslated region of mRNA encoded by GOLGA4, corresponding to a target binding site such as BINDING SITE I, BINDING SITE II or BINDING SITE III of FIG. 8. Table 4 illustrates the complementarity of the nucleotide sequences of GOLGA4 BINDING SITE, designated SEQ ID:12047, to the nucleotide sequence of GAM96 RNA, herein designated GAM RNA, also designated SEQ ID:394.

Another function of GAM96 is therefore inhibition of Golgi autoantigen, golgin subfamily a, 4 (GOLGA4, Accession NP_002069.2), a gene which may play a role in vesicular transport from the trans-golgi. and therefore may be associated with Disease sjoegren's syndrome and in hepatitis b. Accordingly, utilities of GAM96 include diagnosis, prevention and treatment of Disease sjoegren's syndrome and in hepatitis b., and of other diseases and clinical conditions associated with GOLGA4.

The function of GOLGA4 has been established by previous studies. To characterize the Golgi complex, Kooy et al. (1992) used serum from a Sjogren syndrome (OMIM Ref. No. 270150) patient with a high titer of anti-Golgi autoantibodies. The serum immunoprecipitated a 230-kD protein that was specifically localized to the cytosolic surface of what is probably the trans-face of the Golgi stack. The 230-kD Golgi protein appears to be a peripheral membrane component. The authors detected the 230-kD antigen in several cell types and species. By screening a HeLa cell cDNA expression library with the anti-Golgi autoantibodies, Erlich et al. (1996) identified a p230 cDNA. The 7.7-kb p230 mRNA encodes a 2,230-amino acid protein with a predicted coiled-coil structure, stabilized by heptad repeats. The p230 protein also contains a granin motif (see OMIM Ref. No. 113705). By SDS-PAGE, p230 from HeLa cells migrates as a 230-kD protein. Daigo et al. (1999) found that the trans-Golgi gene contains at least 11 exons. Independently, Fritzler et al. (1995) cloned a partial GOLGA4 cDNA using serum from a Sjogren syndrome patient. Based on its predicted molecular mass, they designated the GOLGA4 protein 'golgin-245.'

Full details of the abovementioned studies are described in the following publications, the disclosure of which are hereby incorporated by reference:

Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.; Nakamura, Y.: Characterization of a 1200-kb genomic segment of chromosome 3p22-p21.3. DNA Res. 6:37-44, 1999; and Fritzler, M. J.; Lung, C.-C.; Hamel, J. C.; Griffith, K. J.; Chan, E. K. L.: Molecular characterization of golgin-245, a novel Golgi complex protein containing a granin signature. J. B.

Further studies establishing the function and utilities of GOLGA4 are found in John Hopkins OMIM database record ID 602509, and in cited publications listed in Table 5, which are hereby incorporated by reference. Golgi reassembly stacking protein 1, 65 kda (GORASP1, Accession NP_114105.1) is another GAM96 target gene, herein designated TARGET GENE. GORASP1 BINDING SITE is a target binding site found in the 3' untranslated region of mRNA encoded by GORASP1, corresponding to a target binding site such as BINDING SITE I, BINDING SITE II or BINDING SITE III of FIG. 8. Table 4 illustrates the complementarity of the nucleotide sequences of GORASP1 BINDING SITE, designated SEQ ID:8526, to the nucleotide sequence of GAM96 RNA, herein designated GAM RNA, also designated SEQ ID:394.

Another function of GAM96 is therefore inhibition of Golgi reassembly stacking protein 1, 65 kda (GORASP1, Accession NP_114105.1), a gene which has some funtion with the Golgi apparatus. Accordingly, utilities of GAM96 include diagnosis, prevention and treatment of diseases and clinical conditions associated with GORASP1.

The function of GORASP1 and its association with various diseases and clinical conditions, has been established by previous studies, as described hereinabove with reference to GAM75.1. Glycoprotein m6a (GPM6A, Accession NP_005268.1) is another GAM96 target gene, herein designated TARGET GENE. GPM6A BINDING SITE is a target binding site found in the 3' untranslated region of mRNA encoded by GPM6A, corresponding to a target binding site such as BINDING SITE I, BINDING SITE II or BINDING SITE III of FIG. 8. Table 4 illustrates the complementarity of the nucleotide sequences of GPM6A BINDING SITE, designated SEQ ID:14453, to the nucleotide sequence of GAM96 RNA, herein designated GAM RNA, also designated SEQ ID:394.

Another function of GAM96 is therefore inhibition of Glycoprotein m6a (GPM6A, Accession NP_005268.1), a gene which may play a role in neuronal development. Accordingly, utilities of GAM96 include diagnosis, prevention and treatment of diseases and clinical conditions associated with GPM6A.

The function of GPM6A has been established by previous studies. Yan et al. (1993) used monoclonal antibodies raised against antigens in mouse brain fractions to isolate 2 related cDNAs from an expression library. The cDNAs, which they designated M6a and M6b (OMIM Ref. No. 300051), are highly similar to the myelin proteolipid protein (OMIM Ref. No. 300401) and are expressed during early development of the mouse central nervous system (CNS). Olinsky et al. (1996) found that the M6a gene (GPM6A) is expressed only in neurons. They obtained partial human genomic and cDNA clones for M6a and mapped the gene to 4q34 by fluorescence in situ hybridization. M6, a cell surface glycoprotein mainly expressed on neurons in the murine CNS, plays significant roles in neural cell adhesion and some aspects of neurite growth (Lagenaur et al., 1992). Shimizu et al. (1996) isolated a human cDNA that is highly homologous to the murine gene, symbolized Gpm6, that encodes M6. The human gene, GPM6A, contains an open reading frame of 834 nucleotides encoding a peptide of 278 amino acids. Northern blot analysis revealed specific expression in human brain. By radiation hybrid mapping, Shimizu et al. (1996) assigned the GPM6A gene to 4q33-q34.

Full details of the abovementioned studies are described in the following publications, the disclosure of which are hereby incorporated by reference:

Shimizu, F.; Watanabe, T. K.; Fujiwara, T.; Takahashi, E.; Nakamura, Y.; Maekawa, H.: Isolation and mapping of the human glycoprotein M6 gene (GPM6A) to 4q33- to - q34. Cytogenet. Cell Genet. 74:138-139, 1996; and Yan, Y.; Lagenaur, C.; Narayanan, V.: Molecular cloning of M6: identification of a PLP/DM20 gene family. Neuron 11:423-431, 1993.

Further studies establishing the function and utilities of GPM6A are found in John Hopkins OMIM database record ID 601275, and in cited publications listed in Table 5, which are hereby incorporated by reference. G protein-coupled receptor 26 (GPR26, Accession NP_703143.1) is another GAM96 target gene, herein designated TARGET GENE. GPR26 BINDING SITE is a target binding site found in the 3' untranslated region of mRNA encoded by GPR26, corresponding to a target binding site such as BINDING SITE I, BINDING SITE II or BINDING SITE III of FIG. 8. Table 4 illustrates the complementarity of the nucleotide sequences of GPR26 BINDING SITE, designated SEQ ID:8305, to the nucleotide sequence of GAM96 RNA, herein designated GAM RNA, also designated SEQ ID:394.

Another function of GAM96 is therefore inhibition of G protein-coupled receptor 26 (GPR26, Accession NP_703143.1). Accordingly, utilities of GAM96 include diagnosis, prevention and treatment of diseases and clinical conditions associated with GPR26.

G protein-coupled receptor 63 (GPR63, Accession NP_110411.1) is another GAM96 target gene, herein designated TARGET GENE. GPR63 BINDING SITE is a target binding site found in the 3' untranslated region of mRNA encoded by GPR63, corresponding to a target binding site such as BINDING SITE I, BINDING SITE II or BINDING SITE III of FIG. 8. Table 4 illustrates the complementarity of the nucleotide sequences of GPR63 BINDING SITE, designated SEQ ID:9429, to the nucleotide sequence of GAM96 RNA, herein designated GAM RNA, also designated SEQ ID:394.

Another function of GAM96 is therefore inhibition of G protein-coupled receptor 63 (GPR63, Accession NP_110411.1), a gene which transduces extracellular signals through heterotrimeric G proteins. Accordingly, utilities of GAM96 include diagnosis, prevention and treatment of diseases and clinical conditions associated with GPR63.

The function of GPR63 has been established by previous studies. Using degenerate primers designed from sequence conserved between Xenopus and mouse PSP24 homologs, Kawasawa et al. (2000) cloned GPR63, which they called PSP24B, by PCR followed by RACE using human brain mRNA as template. The deduced 419-amino acid protein shares 57% identity with Xenopus PSP24 and 92% identity with the mouse homolog. Lee et al. (2001) identified GPR63 within a human genomic DNA library using GPR61 (OMIM Ref. No. 606916) as probe. Primers to the intronless sequence were synthesized, and GPR63 cDNA was amplified by PCR and cloned. Northern blot analysis revealed expression of a single 6.8-kb transcript in various brain regions, with stronger expression in caudate and thalamus, and fainter expression in hypothalamus and midbrain. Kawasawa et al. (2000) cloned mouse Gpr63, which they called mPSP24B, by screening a mouse genomic library with the cDNA fragment of Xenopus PSP24. The 6.0-kb mouse transcript was expressed almost exclusively in brain. In situ hybridization of mouse brain sections revealed expression in neuronal cells such as olfactory mitral cells, cortical neurons, hippocampal pyramidal cells, and Purkinje cells in the cerebellum. Kawasawa et al. (2000) noted that Xenopus PSP24 was originally identified as a lysophosphatidic acid receptor (LPA). Functional analysis of mouse Gpr63 transfected into a rat hepatoma cell line suggested that the mouse protein does not function as an LPA receptor.

Full details of the abovementioned studies are described in the following publications, the disclosure of which are hereby incorporated by reference:

Kawasawa, Y.; Kume, K.; Nakade, S.; Haga, H.; Izumi, T.; Shimizu, T.: Brain-specific expression of novel G-protein-coupled receptors, with homologies to Xenopus PSP24 and human GPR45. Biochem. Biophys. Res. Commun. 276:952-956, 2000; and Lee, D. K.; George, S. R.; Cheng, R.; Nguyen, T.; Liu, Y.; Brown, M.; Lynch, K. R.; O'Dowd, B. F.: Identification of four novel human G protein-coupled receptors expressed in the brai.

Further studies establishing the function and utilities of GPR63 are found in John Hopkins OMIM database record ID 606915, and in cited publications listed in Table 5, which are hereby incorporated by reference. G protein-coupled receptor kinase 2-like (drosophila) (GPRK2L, Accession NP_005298.1) is another GAM96 target gene, herein designated TARGET GENE. GPRK2L BINDING SITE is a target binding site found in the 3' untranslated region of mRNA encoded by GPRK2L, corresponding to a target binding site such as BINDING SITE I, BINDING SITE II or BINDING SITE III of FIG. 8. Table 4 illustrates the complementarity of the nucleotide sequences of GPRK2L BINDING SITE, designated SEQ ID:7782, to the nucleotide sequence of GAM96 RNA, herein designated GAM RNA, also designated SEQ ID:394.

Another function of GAM96 is therefore inhibition of G protein-coupled receptor kinase 2-like (drosophila) (GPRK2L, Accession NP_005298.1), a gene which plays a role in receptor desensitization. Accordingly, utilities of GAM96 include diagnosis, prevention and treatment of diseases and clinical conditions associated with GPRK2L.

The function of GPRK2L has been established by previous studies. Premont et al. (1996) determined that there are 4 isoforms of GPRK2L, or GRK4. The full-length protein contains 578 amino acids, while the splice variants enode proteins that contain 546, 532, and 500 amino acids due to the absence of exon 2, exon 15, and both exons 2 and 15, respectively. Northern blot analysis of 16 human tissues detected high expression of a 2.5-kb GPRK2L transcript only in testis. Sallese et al. (1997) showed that only the full-length GRK4 protein has kinase activity and that it interacts with and is inhibitable by calmodulin (CALM1; 114180).

Full details of the abovementioned studies are described in the following publications, the disclosure of which are hereby incorporated by reference:

Premont, R. T.; Macrae, A. D.; Stoffel, R. H.; Chung, N.; Pitcher, J. A.; Ambrose, C.; Inglese, J.; MacDonald, M. E.; Lefkowitz, R. J.: Characterization of the G protein- coupled receptor kinase GRK4: identification of four splice variants. J. Biol. Chem. 271:6403-6410, 1996; and Sallese, M.; Mariggio, S.; Collodel, G.; Moretti, E.; Piomboni, P.; Baccetti, B.; De Blasi, A.: G protein-coupled receptor kinase GRK4: molecular analysis of the four isoforms and ult.

Further studies establishing the function and utilities of GPRK2L are found in John Hopkins OMIM database record ID 137026, and in cited publications listed in Table 5, which are hereby incorporated by reference. GRCC9 (Accession NP_116030.1) is another GAM96 target gene, herein designated TARGET GENE. GRCC9 BINDING SITE is a target binding site found in the 3' untranslated region of mRNA encoded by GRCC9, corresponding to a target binding site such as BINDING SITE I, BINDING SITE II or BINDING SITE III of FIG. 8. Table 4 illustrates the complementarity of the nucleotide sequences of GRCC9 BINDING SITE, designated SEQ ID:4675, to the nucleotide sequence of GAM96 RNA, herein designated GAM RNA, also designated SEQ ID:394.

Another function of GAM96 is therefore inhibition of GRCC9 (Accession NP_116030.1). Accordingly, utilities of GAM96 include diagnosis, prevention and treatment of diseases and clinical conditions associated with GRCC9.

Hbs1-like (s. cerevisiae) (HBS1L, Accession NP_006611.1) is another GAM96 target gene, herein designated TARGET GENE. HBS1L BINDING SITE is a target binding site found in the 3' untranslated region of mRNA encoded by HBS1L, corresponding to a target binding site such as BINDING SITE I, BINDING SITE II or BINDING SITE III of FIG. 8. Table 4 illustrates the complementarity of the nucleotide sequences of HBS1L BINDING SITE, designated SEQ ID:17413, to the nucleotide sequence of GAM96 RNA, herein designated GAM RNA, also designated SEQ ID:394.

Another function of GAM96 is therefore inhibition of Hbs1-like (s. cerevisiae) (HBS1L, Accession NP_006611.1). Accordingly, utilities of GAM96 include diagnosis, prevention and treatment of diseases and clinical conditions associated with HBS1L.

HIST2H2BE (Accession NP_003519.1) is another GAM96 target gene, herein designated TARGET GENE. HIST2H2BE BINDING SITE is a target binding site found in the 3' untranslated region of mRNA encoded by HIST2H2BE, corresponding to a target binding site such as BINDING SITE I, BINDING SITE II or BINDING SITE III of FIG. 8. Table 4 illustrates the complementarity of the nucleotide sequences of HIST2H2BE BINDING SITE, designated SEQ ID:6859, to the nucleotide sequence of GAM96 RNA, herein designated GAM RNA, also designated SEQ ID:394.

Another function of GAM96 is therefore inhibition of HIST2H2BE (Accession NP_003519.1). Accordingly, utilities of GAM96 include diagnosis, prevention and treatment of diseases and clinical conditions associated with HIST2H2BE.

Histocompatibility (minor) 13 (HM13, Accession NP_848697.1) is another GAM96 target gene, herein designated TARGET GENE. HM13 BINDING SITE is a target binding site found in the 3' untranslated region of multiple transcripts of mRNA encoded by HM13, corresponding to a target binding site such as BINDING SITE I, BINDING SITE II or BINDING SITE III of FIG. 8. Table 4 illustrates the complementarity of the nucleotide sequences of HM13 BINDING SITE, designated SEQ ID:9742, to the nucleotide sequence of GAM96 RNA, herein designated GAM RNA, also designated SEQ ID:394.

Another function of GAM96 is therefore inhibition of Histocompatibility (minor) 13 (HM13, Accession NP_848697.1). Accordingly, utilities of GAM96 include diagnosis, prevention and treatment of diseases and clinical conditions associated with HM13.

HTCD37 (Accession NP_067045.1) is another GAM96 target gene, herein designated TARGET GENE. HTCD37 BINDING SITE is a target binding site found in the 3' untranslated region of mRNA encoded by HTCD37, corresponding to a target binding site such as BINDING SITE I, BINDING SITE II or BINDING SITE III of FIG. 8. Table 4 illustrates the complementarity of the nucleotide sequences of HTCD37 BINDING SITE, designated SEQ ID:16787, to the nucleotide sequence of GAM96 RNA, herein designated GAM RNA, also designated SEQ ID:394.

Another function of GAM96 is therefore inhibition of HTCD37 (Accession NP_067045.1). Accordingly, utilities of GAM96 include diagnosis, prevention and treatment of diseases and clinical conditions associated with HTCD37.

HUMAGCGB (Accession XP_291083.2) is another GAM96 target gene, herein designated TARGET GENE. HUMAGCGB BINDING SITE is a target binding site found in the 3' untranslated region of multiple transcripts of mRNA encoded by HUMAGCGB, corresponding to a target binding site such as BINDING SITE I, BINDING SITE II or BINDING SITE III of FIG. 8. Table 4 illustrates the complementarity of the nucleotide sequences of HUMAGCGB BINDING SITE, designated SEQ ID:10039, to the nucleotide sequence of GAM96 RNA, herein designated GAM RNA, also designated SEQ ID:394.

Another function of GAM96 is therefore inhibition of HUMAGCGB (Accession XP_291083.2). Accordingly, utilities of GAM96 include diagnosis, prevention and treatment of diseases and clinical conditions associated with HUMAGCGB.

HUMAGCGB (Accession NP_037418.2) is another GAM96 target gene, herein designated TARGET GENE. HUMAGCGB BINDING SITE is a target binding site found in the 3' untranslated region of multiple transcripts of mRNA encoded by HUMAGCGB, corresponding to a target binding site such as BINDING SITE I, BINDING SITE II or BINDING SITE III of FIG. 8. Table 4 illustrates the complementarity of the nucleotide sequences of HUMAGCGB BINDING SITE, designated SEQ ID:10039, to the nucleotide sequence of GAM96 RNA, herein designated GAM RNA, also designated SEQ ID:394.

Another function of GAM96 is therefore inhibition of HUMAGCGB (Accession NP_037418.2). Accordingly, utilities of GAM96 include diagnosis, prevention and treatment of diseases and clinical conditions associated with HUMAGCGB.

Iduronate 2-sulfatase (hunter syndrome) (IDS, Accession NP_000193.1) is another GAM96 target gene, herein designated TARGET GENE. IDS BINDING SITE is a target binding site found in the 3' untranslated region of multiple transcripts of mRNA encoded by IDS, corresponding to a target binding site such as BINDING SITE I, BINDING SITE II or BINDING SITE III of FIG. 8. Table 4 illustrates the complementarity of the nucleotide sequences of IDS BINDING SITE, designated SEQ ID:2510, to the nucleotide sequence of GAM96 RNA, herein designated GAM RNA, also designated SEQ ID:394.

Another function of GAM96 is therefore inhibition of Iduronate 2-sulfatase (hunter syndrome) (IDS, Accession NP_000193.1). Accordingly, utilities of GAM96 include diagnosis, prevention and treatment of diseases and clinical conditions associated with IDS.

Interleukin enhancer binding factor 3, 90 kda (ILF3, Accession NP_036350.2) is another GAM96 target gene, herein designated TARGET GENE. ILF3 BINDING SITE is a target binding site found in the 3' untranslated region of multiple transcripts of mRNA encoded by ILF3, corresponding to a target binding site such as BINDING SITE I, BINDING SITE II or BINDING SITE III of FIG. 8. Table 4 illustrates the complementarity of the nucleotide sequences of ILF3 BINDING SITE, designated SEQ ID:12695, to the nucleotide sequence of GAM96 RNA, herein designated GAM RNA, also designated SEQ ID:394.

Another function of GAM96 is therefore inhibition of Interleukin enhancer binding factor 3, 90 kda (ILF3, Accession NP_036350.2). Accordingly, utilities of GAM96 include diagnosis, prevention and treatment of diseases and clinical conditions associated with ILF3.

Lysyl-trna synthetase (KARS, Accession NP_005539.1) is another GAM96 target gene, herein designated TARGET GENE. KARS BINDING SITE is a target binding site found in the 3' untranslated region of mRNA encoded by KARS, corresponding to a target binding site such as BINDING SITE I, BINDING SITE II or BINDING SITE III of FIG. 8. Table 4 illustrates the complementarity of the nucleotide sequences of KARS BINDING SITE, designated SEQ ID:13190, to the nucleotide sequence of GAM96 RNA, herein designated GAM RNA, also designated SEQ ID:394.

Another function of GAM96 is therefore inhibition of Lysyl-trna synthetase (KARS, Accession NP_005539.1), a gene which functions in protein biosynthesis and therefore may be associated with Autoimmune diseases. Accordingly, utilities of GAM96 include diagnosis, prevention and treatment of Autoimmune diseases, and of other diseases and clinical conditions associated with KARS.

The function of KARS has been established by previous studies. Protein synthesis is initiated by the attachment of amino acids to cognate tRNAs by aminoacyl-tRNA synthetases. At least 6 of 20 human aminoacyl-tRNA synthetases have been identified as targets of autoantibodies in the autoimmune disease polymyositis/dermatomyositis. One of these is lysyl-tRNA synthetase, symbolized KARS (Targoff et al. (1993)). Tolkunova et al. (2000) identified 2 full-length sequences for KARS and determined that they represent cytoplasmic and mitochondrial isoforms. The 625-amino acid mitochondrial enzyme and the 597-amino acid cytoplasmic enzyme are identical over the last 576 amino acids, but the mitochondrial enzyme has a different 49-amino acid N terminus containing a mitochondrial targeting sequence. Transfection of both fluorescence-tagged isoforms into an osteosarcoma cell line showed that the cytoplasmic isoform produced a diffuse, cellwide fluorescence, while the mitochondrial isoform resulted in a punctate pattern that colocalized with mitochondrial markers. Ribonuclease protection analysis indicated that the mRNA encoding the cytoplasmic isoform makes up approximately 70%, and the mitochondrial isoform approximately 30%, of mature KARS transcripts. Tolkunova et al. (2000) found that both full-length mitochondrial and cytoplasmic KARS, purified after expression in E. coli, aminoacylated in vitro transcripts corresponding to both the cytoplasmic and mitochondrial tRNA-lys. Tolkunova et al. (2000) determined that the KARS gene contains 15 exons and spans about 20 kb. The cytoplasmic and mitochondrial KARS isoforms result from alternative splicing of the first 3 exons. Tolkunova et al. (2000) found that the initiation codons for KARS and RAP1 (OMIM Ref. No. 605061) are separated by 243 bp. This region lacks a conventional TATA sequence but contains several SP1 (OMIM Ref. No. 189906)-binding domains oriented in both directions Full details of the abovementioned studies are described in the following publications, the disclosure of which are hereby incorporated by reference:

Tolkunova, E.; Park, H.; Xia, J.; King, M. P.; Davidson, E.: The human lysyl-tRNA synthetase gene encodes both the cytoplasmic and mitochondrial enzymes by means of an unusual alternative splicing of the primary transcript. J. Biol. Chem. 275:35063-35069, 2000; and Maas, S.; Kim, Y.-G.; Rich, A.: Genomic clustering of tRNA-specific adenosine deaminase ADAT1 and two tRNA synthetases. Mammalian Genome 12:387-393, 2001.

Further studies establishing the function and utilities of KARS are found in John Hopkins OMIM database record ID 601421, and in cited publications listed in Table 5, which are hereby incorporated by reference. KBF2 (Accession NP__056958.1) is another GAM96 target gene, herein designated TARGET GENE. KBF2 BINDING SITE is a target binding site found in the 3' untranslated region of mRNA encoded by KBF2, corresponding to a target binding site such as BINDING SITE I, BINDING SITE II or BINDING SITE III of FIG. 8. Table 4 illustrates the complementarity of the nucleotide sequences of KBF2 BINDING SITE, designated SEQ ID:9785, to the nucleotide sequence of GAM96 RNA, herein designated GAM RNA, also designated SEQ ID:394.

Another function of GAM96 is therefore inhibition of KBF2 (Accession NP__056958.1). Accordingly, utilities of GAM96 include diagnosis, prevention and treatment of diseases and clinical conditions associated with KBF2.

Potassium voltage-gated channel, shaker-related subfamily, member 6 (KCNA6, Accession NP__002226.1) is another GAM96 target gene, herein designated TARGET GENE. KCNA6 BINDING SITE is a target binding site found in the 3' untranslated region of mRNA encoded by KCNA6, corresponding to a target binding site such as BINDING SITE I, BINDING SITE II or BINDING SITE III of FIG. 8. Table 4 illustrates the complementarity of the nucleotide sequences of KCNA6 BINDING SITE, designated SEQ ID:1371, to the nucleotide sequence of GAM96 RNA, herein designated GAM RNA, also designated SEQ ID:394.

Another function of GAM96 is therefore inhibition of Potassium voltage-gated channel, shaker-related subfamily, member 6 (KCNA6, Accession NP__002226.1), a gene which mediates the voltage-dependent potassium ion permeability of excitable membranes. Accordingly, utilities of GAM96 include diagnosis, prevention and treatment of diseases and clinical conditions associated with KCNA6.

The function of KCNA6 and its association with various diseases and clinical conditions, has been established by previous studies, as described hereinabove with reference to GAM63.1. Kv channel interacting protein 2 (KCNIP2, Accession NP__775284.1) is another GAM96 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:12228, to the nucleotide sequence of GAM96 RNA, herein designated GAM RNA, also designated SEQ ID:394.

Another function of GAM96 is therefore inhibition of Kv channel interacting protein 2 (KCNIP2, Accession NP__775284.1). Accordingly, utilities of GAM96 include diagnosis, prevention and treatment of diseases and clinical conditions associated with KCNIP2.

Kv channel interacting protein 2 (KCNIP2, Accession NP__775283.1) is another GAM96 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:12228, to the nucleotide sequence of GAM96 RNA, herein designated GAM RNA, also designated SEQ ID:394.

Another function of GAM96 is therefore inhibition of Kv channel interacting protein 2 (KCNIP2, Accession NP__775283.1). Accordingly, utilities of GAM96 include diagnosis, prevention and treatment of diseases and clinical conditions associated with KCNIP2.

Kv channel interacting protein 2 (KCNIP2, Accession NP__775287.1) is another GAM96 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:12228, to the nucleotide sequence of GAM96 RNA, herein designated GAM RNA, also designated SEQ ID:394.

Another function of GAM96 is therefore inhibition of Kv channel interacting protein 2 (KCNIP2, Accession NP__775287.1). Accordingly, utilities of GAM96 include diagnosis, prevention and treatment of diseases and clinical conditions associated with KCNIP2.

Kv channel interacting protein 2 (KCNIP2, Accession NP__775285.1) is another GAM96 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:12228, to the nucleotide sequence of GAM96 RNA, herein designated GAM RNA, also designated SEQ ID:394.

Another function of GAM96 is therefore inhibition of Kv channel interacting protein 2 (KCNIP2, Accession NP__775285.1). Accordingly, utilities of GAM96 include diagnosis, prevention and treatment of diseases and clinical conditions associated with KCNIP2.

Kv channel interacting protein 2 (KCNIP2, Accession NP__775286.1) is another GAM96 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:12228, to the nucleotide sequence of GAM96 RNA, herein designated GAM RNA, also designated SEQ ID:394.

Another function of GAM96 is therefore inhibition of Kv channel interacting protein 2 (KCNIP2, Accession NP__775286.1). Accordingly, utilities of GAM96 include diagnosis, prevention and treatment of diseases and clinical conditions associated with KCNIP2.

Kv channel interacting protein 2 (KCNIP2, Accession NP__055406.2) is another GAM96 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:12228, to the nucleotide sequence of GAM96 RNA, herein designated GAM RNA, also designated SEQ ID:394.

Another function of GAM96 is therefore inhibition of Kv channel interacting protein 2 (KCNIP2, Accession NP_055406.2). Accordingly, utilities of GAM96 include diagnosis, prevention and treatment of diseases and clinical conditions associated with KCNIP2.

Kv channel interacting protein 2 (KCNIP2, Accession NP_775464.1) is another GAM96 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:12228, to the nucleotide sequence of GAM96 RNA, herein designated GAM RNA, also designated SEQ ID:394.

Another function of GAM96 is therefore inhibition of Kv channel interacting protein 2 (KCNIP2, Accession NP_775464.1). Accordingly, utilities of GAM96 include diagnosis, prevention and treatment of diseases and clinical conditions associated with KCNIP2.

Potassium voltage-gated channel, kqt-like subfamily, member 2 (KCNQ2, Accession NP_004509.2) is another GAM96 target gene, herein designated TARGET GENE. KCNQ2 BINDING SITE is a target binding site found in the 3' untranslated region of multiple transcripts of mRNA encoded by KCNQ2, corresponding to a target binding site such as BINDING SITE I, BINDING SITE II or BINDING SITE III of FIG. 8. Table 4 illustrates the complementarity of the nucleotide sequences of KCNQ2 BINDING SITE, designated SEQ ID:13173, to the nucleotide sequence of GAM96 RNA, herein designated GAM RNA, also designated SEQ ID:394.

Another function of GAM96 is therefore inhibition of Potassium voltage-gated channel, kqt-like subfamily, member 2 (KCNQ2, Accession NP_004509.2), a gene which is probably important in the regulation of neuronal excitability. and therefore is associated with Epilepsy, benign neonatal, 1. Accordingly, utilities of GAM96 include diagnosis, prevention and treatment of Epilepsy, benign neonatal, 1, and of other diseases and clinical conditions associated with KCNQ2.

The function of KCNQ2 and its association with various diseases and clinical conditions, has been established by previous studies, as described hereinabove with reference to GAM47.1. KIAA0056 (Accession XP_166201.1) is another GAM96 target gene, herein designated TARGET GENE. KIAA0056 BINDING SITE is a target binding site found in the 5' untranslated region of mRNA encoded by KIAA0056, corresponding to a target binding site such as BINDING SITE I, BINDING SITE II or BINDING SITE III of FIG. 8. Table 4 illustrates the complementarity of the nucleotide sequences of KIAA0056 BINDING SITE, designated SEQ ID:13907, to the nucleotide sequence of GAM96 RNA, herein designated GAM RNA, also designated SEQ ID:394.

Another function of GAM96 is therefore inhibition of KIAA0056 (Accession XP_166201.1). Accordingly, utilities of GAM96 include diagnosis, prevention and treatment of diseases and clinical conditions associated with KIAA0056.

KIAA0186 (Accession NP_066545.1) is another GAM96 target gene, herein designated TARGET GENE. KIAA0186 BINDING SITE is a target binding site found in the 3' untranslated region of mRNA encoded by KIAA0186, corresponding to a target binding site such as BINDING SITE I, BINDING SITE II or BINDING SITE III of FIG. 8. Table 4 illustrates the complementarity of the nucleotide sequences of KIAA0186 BINDING SITE, designated SEQ ID:13734, to the nucleotide sequence of GAM96 RNA, herein designated GAM RNA, also designated SEQ ID:394.

Another function of GAM96 is therefore inhibition of KIAA0186 (Accession NP_066545.1). Accordingly, utilities of GAM96 include diagnosis, prevention and treatment of diseases and clinical conditions associated with KIAA0186.

KIAA0316 (Accession XP_045712.5) is another GAM96 target gene, herein designated TARGET GENE. KIAA0316 BINDING SITE is a target binding site found in the 3' untranslated region of mRNA encoded by KIAA0316, corresponding to a target binding site such as BINDING SITE I, BINDING SITE II or BINDING SITE III of FIG. 8. Table 4 illustrates the complementarity of the nucleotide sequences of KIAA0316 BINDING SITE, designated SEQ ID:17156, to the nucleotide sequence of GAM96 RNA, herein designated GAM RNA, also designated SEQ ID:394.

Another function of GAM96 is therefore inhibition of KIAA0316 (Accession XP_045712.5). Accordingly, utilities of GAM96 include diagnosis, prevention and treatment of diseases and clinical conditions associated with KIAA0316.

KIAA0459 (Accession XP_027862.1) is another GAM96 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:1902, to the nucleotide sequence of GAM96 RNA, herein designated GAM RNA, also designated SEQ ID:394.

Another function of GAM96 is therefore inhibition of KIAA0459 (Accession XP_027862.1). Accordingly, utilities of GAM96 include diagnosis, prevention and treatment of diseases and clinical conditions associated with KIAA0459.

KIAA0676 (Accession NP_055858.1) is another GAM96 target gene, herein designated TARGET GENE. KIAA0676 BINDING SITE is a target binding site found in the 3' untranslated region of mRNA encoded by KIAA0676, corresponding to a target binding site such as BINDING SITE I, BINDING SITE II or BINDING SITE III of FIG. 8. Table 4 illustrates the complementarity of the nucleotide sequences of KIAA0676 BINDING SITE, designated SEQ ID:17472, to the nucleotide sequence of GAM96 RNA, herein designated GAM RNA, also designated SEQ ID:394.

Another function of GAM96 is therefore inhibition of KIAA0676 (Accession NP_055858.1). Accordingly, utilities of GAM96 include diagnosis, prevention and treatment of diseases and clinical conditions associated with KIAA0676.

KIAA0828 (Accession NP_056143.1) is another GAM96 target gene, herein designated TARGET GENE. KIAA0828 BINDING SITE is a target binding site found in the 3' untranslated region of mRNA encoded by KIAA0828, corresponding to a target binding site such as BINDING SITE I, BINDING SITE II or BINDING SITE III of FIG. 8. Table 4 illustrates the complementarity of the nucleotide sequences of KIAA0828 BINDING SITE, designated SEQ ID:11600, to the nucleotide sequence of GAM96 RNA, herein designated GAM RNA, also designated SEQ ID:394.

Another function of GAM96 is therefore inhibition of KIAA0828 (Accession NP_056143.1). Accordingly, utilities of GAM96 include diagnosis, prevention and treatment of diseases and clinical conditions associated with KIAA0828.

KIAA0831 (Accession NP_055739.1) is another GAM96 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:15913, to the nucleotide sequence of GAM96 RNA, herein designated GAM RNA, also designated SEQ ID:394.

Another function of GAM96 is therefore inhibition of KIAA0831 (Accession NP_055739.1). Accordingly, utilities of GAM96 include diagnosis, prevention and treatment of diseases and clinical conditions associated with KIAA0831.

KIAA1036 (Accession NP_055724.1) is another GAM96 target gene, herein designated TARGET GENE. KIAA1036 BINDING SITE is a target binding site found in the 3' untranslated region of mRNA encoded by KIAA1036, corresponding to a target binding site such as BINDING SITE I, BINDING SITE II or BINDING SITE III of FIG. 8. Table 4 illustrates the complementarity of the nucleotide sequences of KIAA1036 BINDING SITE, designated SEQ ID:15246, to the nucleotide sequence of GAM96 RNA, herein designated GAM RNA, also designated SEQ ID:394.

Another function of GAM96 is therefore inhibition of KIAA1036 (Accession NP_055724.1). Accordingly, utilities of GAM96 include diagnosis, prevention and treatment of diseases and clinical conditions associated with KIAA1036.

KIAA1045 (Accession XP_048592.1) is another GAM96 target gene, herein designated TARGET GENE. KIAA1045 BINDING SITE is a target binding site found in the 3' untranslated region of mRNA encoded by KIAA1045, corresponding to a target binding site such as BINDING SITE I, BINDING SITE II or BINDING SITE III of FIG. 8. Table 4 illustrates the complementarity of the nucleotide sequences of KIAA1045 BINDING SITE, designated SEQ ID:14051, to the nucleotide sequence of GAM96 RNA, herein designated GAM RNA, also designated SEQ ID:394.

Another function of GAM96 is therefore inhibition of KIAA1045 (Accession XP_048592.1). Accordingly, utilities of GAM96 include diagnosis, prevention and treatment of diseases and clinical conditions associated with KIAA1045.

KIAA1332 (Accession XP_048774.2) is another GAM96 target gene, herein designated TARGET GENE. KIAA1332 BINDING SITE is a target binding site found in the 3' untranslated region of mRNA encoded by KIAA1332, corresponding to a target binding site such as BINDING SITE I, BINDING SITE II or BINDING SITE III of FIG. 8. Table 4 illustrates the complementarity of the nucleotide sequences of KIAA1332 BINDING SITE, designated SEQ ID:419, to the nucleotide sequence of GAM96 RNA, herein designated GAM RNA, also designated SEQ ID:394.

Another function of GAM96 is therefore inhibition of KIAA1332 (Accession XP_048774.2). Accordingly, utilities of GAM96 include diagnosis, prevention and treatment of diseases and clinical conditions associated with KIAA1332.

KIAA1576 (Accession NP_065978.1) is another GAM96 target gene, herein designated TARGET GENE. KIAA1576 BINDING SITE is a target binding site found in the 3' untranslated region of mRNA encoded by KIAA1576, corresponding to a target binding site such as BINDING SITE I, BINDING SITE II or BINDING SITE III of FIG. 8. Table 4 illustrates the complementarity of the nucleotide sequences of KIAA1576 BINDING SITE, designated SEQ ID:18988, to the nucleotide sequence of GAM96 RNA, herein designated GAM RNA, also designated SEQ ID:394.

Another function of GAM96 is therefore inhibition of KIAA1576 (Accession NP_065978.1). Accordingly, utilities of GAM96 include diagnosis, prevention and treatment of diseases and clinical conditions associated with KIAA1576.

KIAA1719 (Accession XP_042936.1) is another GAM96 target gene, herein designated TARGET GENE. KIAA1719 BINDING SITE is a target binding site found in the 3' untranslated region of mRNA encoded by KIAA1719, corresponding to a target binding site such as BINDING SITE I, BINDING SITE II or BINDING SITE III of FIG. 8. Table 4 illustrates the complementarity of the nucleotide sequences of KIAA1719 BINDING SITE, designated SEQ ID:18820, to the nucleotide sequence of GAM96 RNA, herein designated GAM RNA, also designated SEQ ID:394.

Another function of GAM96 is therefore inhibition of KIAA1719 (Accession XP_042936.1). Accordingly, utilities of GAM96 include diagnosis, prevention and treatment of diseases and clinical conditions associated with KIAA1719.

KIAA1735 (Accession XP_290496.1) is another GAM96 target gene, herein designated TARGET GENE. KIAA1735 BINDING SITE is a target binding site found in the 3' untranslated region of mRNA encoded by KIAA1735, corresponding to a target binding site such as BINDING SITE I, BINDING SITE II or BINDING SITE III of FIG. 8. Table 4 illustrates the complementarity of the nucleotide sequences of KIAA1735 BINDING SITE, designated SEQ ID:12607, to the nucleotide sequence of GAM96 RNA, herein designated GAM RNA, also designated SEQ ID:394.

Another function of GAM96 is therefore inhibition of KIAA1735 (Accession XP_290496.1). Accordingly, utilities of GAM96 include diagnosis, prevention and treatment of diseases and clinical conditions associated with KIAA1735.

KIAA1765 (Accession XP_047355.1) is another GAM96 target gene, herein designated TARGET GENE. KIAA1765 BINDING SITE is a target binding site found in the 3' untranslated region of mRNA encoded by KIAA1765, corresponding to a target binding site such as BINDING SITE I, BINDING SITE II or BINDING SITE III of FIG. 8. Table 4 illustrates the complementarity of the nucleotide sequences of KIAA1765 BINDING SITE, designated SEQ ID:7558, to the nucleotide sequence of GAM96 RNA, herein designated GAM RNA, also designated SEQ ID:394.

Another function of GAM96 is therefore inhibition of KIAA1765 (Accession XP_047355.1). Accordingly, utilities of GAM96 include diagnosis, prevention and treatment of diseases and clinical conditions associated with KIAA1765.

KIAA1924 (Accession NP_694971.2) is another GAM96 target gene, herein designated TARGET GENE. KIAA1924 BINDING SITE is a target binding site found in the 3' untranslated region of mRNA encoded by KIAA1924, corresponding to a target binding site such as BINDING SITE I, BINDING SITE II or BINDING SITE III of FIG. 8. Table 4 illustrates the complementarity of the nucleotide sequences of KIAA1924 BINDING SITE, designated SEQ ID:9076, to the nucleotide sequence of GAM96 RNA, herein designated GAM RNA, also designated SEQ ID:394.

Another function of GAM96 is therefore inhibition of KIAA1924 (Accession NP_694971.2). Accordingly, utilities of GAM96 include diagnosis, prevention and treatment of diseases and clinical conditions associated with KIAA1924.

KIAA1950 (Accession XP_166532.1) is another GAM96 target gene, herein designated TARGET GENE. KIAA1950 BINDING SITE is a target binding site found in the 3' untranslated region of mRNA encoded by KIAA1950, corresponding to a target binding site such as BINDING SITE I, BINDING SITE II or BINDING SITE III of FIG. 8. Table 4 illustrates the complementarity of the nucleotide sequences of KIAA1950 BINDING SITE, designated SEQ ID:7520, to the nucleotide sequence of GAM96 RNA, herein designated GAM RNA, also designated SEQ ID:394.

Another function of GAM96 is therefore inhibition of KIAA1950 (Accession XP_166532.1). Accordingly, utilities of GAM96 include diagnosis, prevention and treatment of diseases and clinical conditions associated with KIAA1950.

KIP3 (Accession NP_473454.1) is another GAM96 target gene, herein designated TARGET GENE. KIP3 BINDING SITE is a target binding site found in the 3' untranslated region of mRNA encoded by KIP3, corresponding to a target binding site such as BINDING SITE I, BINDING SITE II or BINDING SITE III of FIG. 8. Table 4 illustrates the complementarity of the nucleotide sequences of KIP3 BINDING SITE, designated SEQ ID:7794, to the nucleotide sequence of GAM96 RNA, herein designated GAM RNA, also designated SEQ ID:394.

Another function of GAM96 is therefore inhibition of KIP3 (Accession NP_473454.1). Accordingly, utilities of GAM96 include diagnosis, prevention and treatment of diseases and clinical conditions associated with KIP3.

Keratin 23 (histone deacetylase inducible) (KRT23, Accession NP_056330.3) is another GAM96 target gene, herein designated TARGET GENE. KRT23 BINDING SITE is a target binding site found in the 5' untranslated region of multiple transcripts of mRNA encoded by KRT23, corresponding to a target binding site such as BINDING SITE I, BINDING SITE II or BINDING SITE III of FIG. 8. Table 4 illustrates the complementarity of the nucleotide sequences of KRT23 BINDING SITE, designated SEQ ID:1919, to the nucleotide sequence of GAM96 RNA, herein designated GAM RNA, also designated SEQ ID:394.

Another function of GAM96 is therefore inhibition of Keratin 23 (histone deacetylase inducible) (KRT23, Accession NP_056330.3) . Accordingly, utilities of GAM96 include diagnosis, prevention and treatment of diseases and clinical conditions associated with KRT23.

Lanc lantibiotic synthetase component c-like 1 (bacterial) (LANCL1, Accession NP_006046.1) is another GAM96 target gene, herein designated TARGET GENE. LANCL1 BINDING SITE is a target binding site found in the 3' untranslated region of mRNA encoded by LANCL1, corresponding to a target binding site such as BINDING SITE I, BINDING SITE II or BINDING SITE III of FIG. 8. Table 4 illustrates the complementarity of the nucleotide sequences of LANCL1 BINDING SITE, designated SEQ ID:3104, to the nucleotide sequence of GAM96 RNA, herein designated GAM RNA, also designated SEQ ID:394.

Another function of GAM96 is therefore inhibition of Lanc lantibiotic synthetase component c-like 1 (bacterial) (LANCL1, Accession NP_006046.1), a gene which binds the C-terminus of stomatin. Accordingly, utilities of GAM96 include diagnosis, prevention and treatment of diseases and clinical conditions associated with LANCL1.

The function of LANCL1 and its association with various diseases and clinical conditions, has been established by previous studies, as described hereinabove with reference to GAM88.2. Lanc lantibiotic synthetase component c-like 2 (bacterial) (LANCL2, Accession NP_061167.1) is another GAM96 target gene, herein designated TARGET GENE. LANCL2 BINDING SITE is a target binding site found in the 3' untranslated region of mRNA encoded by LANCL2, corresponding to a target binding site such as BINDING SITE I, BINDING SITE II or BINDING SITE III of FIG. 8. Table 4 illustrates the complementarity of the nucleotide sequences of LANCL2 BINDING SITE, designated SEQ ID:15186, to the nucleotide sequence of GAM96 RNA, herein designated GAM RNA, also designated SEQ ID:394.

Another function of GAM96 is therefore inhibition of Lanc lantibiotic synthetase component c-like 2 (bacterial) (LANCL2, Accession NP_061167.1). Accordingly, utilities of GAM96 include diagnosis, prevention and treatment of diseases and clinical conditions associated with LANCL2.

LOC118812 (Accession XP_058346.2) is another GAM96 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:17463, to the nucleotide sequence of GAM96 RNA, herein designated GAM RNA, also designated SEQ ID:394.

Another function of GAM96 is therefore inhibition of LOC118812 (Accession XP_058346.2). Accordingly, utilities of GAM96 include diagnosis, prevention and treatment of diseases and clinical conditions associated with LOC118812.

LOC118812 (Accession NP_849154.1) is another GAM96 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:17463, to the nucleotide sequence of GAM96 RNA, herein designated GAM RNA, also designated SEQ ID:394.

Another function of GAM96 is therefore inhibition of LOC118812 (Accession NP_849154.1). Accordingly, utilities of GAM96 include diagnosis, prevention and treatment of diseases and clinical conditions associated with LOC118812.

LOC123232 (Accession XP_058692.1) is another GAM96 target gene, herein designated TARGET GENE. LOC123232 BINDING SITE is a target binding site found in the 3' untranslated region of mRNA encoded by LOC123232, corresponding to a target binding site such as BINDING SITE I, BINDING SITE II or BINDING SITE III of FIG. 8. Table 4 illustrates the complementarity of the nucleotide sequences of LOC123232 BINDING SITE, designated SEQ ID:6644, to the nucleotide sequence of GAM96 RNA, herein designated GAM RNA, also designated SEQ ID:394.

Another function of GAM96 is therefore inhibition of LOC123232 (Accession XP_058692.1). Accordingly, utilities of GAM96 include diagnosis, prevention and treatment of diseases and clinical conditions associated with LOC123232.

LOC130612 (Accession XP_059461.1) is another GAM96 target gene, herein designated TARGET GENE. LOC130612 BINDING SITE is a target binding site found in the 3' untranslated region of mRNA encoded by LOC130612, corresponding to a target binding site such as BINDING SITE I, BINDING SITE II or BINDING SITE III of FIG. 8. Table 4 illustrates the complementarity of the nucleotide sequences of LOC130612 BINDING SITE, designated SEQ ID:8428, to the nucleotide sequence of GAM96 RNA, herein designated GAM RNA, also designated SEQ ID:394.

Another function of GAM96 is therefore inhibition of LOC130612 (Accession XP_059461.1). Accordingly, utilities of GAM96 include diagnosis, prevention and treatment of diseases and clinical conditions associated with LOC130612.

LOC134466 (Accession XP_068858.3) is another GAM96 target gene, herein designated TARGET GENE. LOC134466 BINDING SITE is a target binding site found in the 5' untranslated region of mRNA encoded by LOC134466, corresponding to a target binding site such as BINDING SITE I, BINDING SITE II or BINDING SITE III of FIG. 8. Table 4 illustrates the complementarity of the nucleotide sequences of LOC134466 BINDING SITE, designated SEQ ID:18543, to the nucleotide sequence of GAM96 RNA, herein designated GAM RNA, also designated SEQ ID:394.

Another function of GAM96 is therefore inhibition of LOC134466 (Accession XP_068858.3). Accordingly, utilities of GAM96 include diagnosis, prevention and treatment of diseases and clinical conditions associated with LOC134466.

LOC139135 (Accession NP_775764.1) is another GAM96 target gene, herein designated TARGET GENE. LOC139135 BINDING SITE is a target binding site found in the 3' untranslated region of mRNA encoded by LOC139135, corresponding to a target binding site such as BINDING SITE I, BINDING SITE II or BINDING SITE III of FIG. 8. Table 4 illustrates the complementarity of the nucleotide sequences of LOC139135 BINDING SITE, designated SEQ ID:5578, to the nucleotide sequence of GAM96 RNA, herein designated GAM RNA, also designated SEQ ID:394.

Another function of GAM96 is therefore inhibition of LOC139135 (Accession NP_775764.1). Accordingly, utilities of GAM96 include diagnosis, prevention and treatment of diseases and clinical conditions associated with LOC139135.

LOC146174 (Accession NP_775772.1) is another GAM96 target gene, herein designated TARGET GENE. LOC146174 BINDING SITE is a target binding site found in the 5' untranslated region of mRNA encoded by LOC146174, corresponding to a target binding site such as BINDING SITE I, BINDING SITE II or BINDING SITE III of FIG. 8. Table 4 illustrates the complementarity of the nucleotide sequences of LOC146174 BINDING SITE, designated SEQ ID:13043, to the nucleotide sequence of GAM96 RNA, herein designated GAM RNA, also designated SEQ ID:394.

Another function of GAM96 is therefore inhibition of LOC146174 (Accession NP_775772.1). Accordingly, utilities of GAM96 include diagnosis, prevention and treatment of diseases and clinical conditions associated with LOC146174.

LOC147515 (Accession XP_097243.1) is another GAM96 target gene, herein designated TARGET GENE. LOC147515 BINDING SITE is a target binding site found in the 3' untranslated region of mRNA encoded by LOC147515, corresponding to a target binding site such as BINDING SITE I, BINDING SITE II or BINDING SITE III of FIG. 8. Table 4 illustrates the complementarity of the nucleotide sequences of LOC147515 BINDING SITE, designated SEQ ID:8521, to the nucleotide sequence of GAM96 RNA, herein designated GAM RNA, also designated SEQ ID:394.

Another function of GAM96 is therefore inhibition of LOC147515 (Accession XP_097243.1). Accordingly, utilities of GAM96 include diagnosis, prevention and treatment of diseases and clinical conditions associated with LOC147515.

LOC148824 (Accession XP_097527.1) is another GAM96 target gene, herein designated TARGET GENE. LOC148824 BINDING SITE is a target binding site found in the 3' untranslated region of mRNA encoded by LOC148824, corresponding to a target binding site such as BINDING SITE I, BINDING SITE II or BINDING SITE III of FIG. 8. Table 4 illustrates the complementarity of the nucleotide sequences of LOC148824 BINDING SITE, designated SEQ ID:2847, to the nucleotide sequence of GAM96 RNA, herein designated GAM RNA, also designated SEQ ID:394.

Another function of GAM96 is therefore inhibition of LOC148824 (Accession XP_097527.1). Accordingly, utilities of GAM96 include diagnosis, prevention and treatment of diseases and clinical conditions associated with LOC148824.

LOC150035 (Accession XP_097793.1) is another GAM96 target gene, herein designated TARGET GENE. LOC150035 BINDING SITE is a target binding site found in the 5' untranslated region of mRNA encoded by LOC150035, corresponding to a target binding site such as BINDING SITE I, BINDING SITE II or BINDING SITE III of FIG. 8. Table 4 illustrates the complementarity of the nucleotide sequences of LOC150035 BINDING SITE, designated SEQ ID:452, to the nucleotide sequence of GAM96 RNA, herein designated GAM RNA, also designated SEQ ID:394.

Another function of GAM96 is therefore inhibition of LOC150035 (Accession XP_097793.1). Accordingly, utilities of GAM96 include diagnosis, prevention and treatment of diseases and clinical conditions associated with LOC150035.

LOC150212 (Accession XP_086827.2) is another GAM96 target gene, herein designated TARGET GENE. LOC150212 BINDING SITE is a target binding site found in the 5' untranslated region of mRNA encoded by LOC150212, corresponding to a target binding site such as BINDING SITE I, BINDING SITE II or BINDING SITE III of FIG. 8. Table 4 illustrates the complementarity of the nucleotide sequences of LOC150212 BINDING SITE, designated SEQ ID:2217, to the nucleotide sequence of GAM96 RNA, herein designated GAM RNA, also designated SEQ ID:394.

Another function of GAM96 is therefore inhibition of LOC150212 (Accession XP_086827.2). Accordingly, utilities of GAM96 include diagnosis, prevention and treatment of diseases and clinical conditions associated with LOC150212.

LOC150946 (Accession XP_097977.2) is another GAM96 target gene, herein designated TARGET GENE. LOC150946 BINDING SITE is a target binding site found in the 3' untranslated region of mRNA encoded by LOC150946, corresponding to a target binding site such as BINDING SITE I, BINDING SITE II or BINDING SITE III of FIG. 8. Table 4 illustrates the complementarity of the nucleotide sequences of LOC150946 BINDING SITE, designated SEQ ID:1643, to the nucleotide sequence of GAM96 RNA, herein designated GAM RNA, also designated SEQ ID:394.

Another function of GAM96 is therefore inhibition of LOC150946 (Accession XP_097977.2). Accordingly, utilities of GAM96 include diagnosis, prevention and treatment of diseases and clinical conditions associated with LOC150946.

LOC153277 (Accession XP_295161.1) is another GAM96 target gene, herein designated TARGET GENE. LOC153277 BINDING SITE is a target binding site found in the 5' untranslated region of mRNA encoded by LOC153277, corresponding to a target binding site such as BINDING SITE I, BINDING SITE II or BINDING SITE III of FIG. 8. Table 4 illustrates the complementarity of the nucleotide sequences of LOC153277 BINDING SITE, designated SEQ ID:1123, to the nucleotide sequence of GAM96 RNA, herein designated GAM RNA, also designated SEQ ID:394.

Another function of GAM96 is therefore inhibition of LOC153277 (Accession XP_295161.1). Accordingly, utilities of GAM96 include diagnosis, prevention and treatment of diseases and clinical conditions associated with LOC153277.

LOC155004 (Accession XP_088114.2) is another GAM96 target gene, herein designated TARGET GENE. LOC155004 BINDING SITE is a target binding site found in the 3' untranslated region of mRNA encoded by LOC155004, corresponding to a target binding site such as BINDING SITE I, BINDING SITE II or BINDING SITE III of FIG. 8. Table 4 illustrates the complementarity of the nucleotide sequences of LOC155004 BINDING SITE, designated SEQ ID:3970, to the nucleotide sequence of GAM96 RNA, herein designated GAM RNA, also designated SEQ ID:394.

Another function of GAM96 is therefore inhibition of LOC155004 (Accession XP_088114.2). Accordingly, utilities of GAM96 include diagnosis, prevention and treatment of diseases and clinical conditions associated with LOC155004.

LOC157226 (Accession XP_033876.1) is another GAM96 target gene, herein designated TARGET GENE. LOC157226 BINDING SITE is a target binding site found in the 5' untranslated region of mRNA encoded by LOC157226, corresponding to a target binding site such as BINDING SITE I, BINDING SITE II or BINDING SITE III of FIG. 8. Table 4 illustrates the complementarity of the nucleotide sequences of LOC157226 BINDING SITE, designated SEQ ID:18145, to the nucleotide sequence of GAM96 RNA, herein designated GAM RNA, also designated SEQ ID:394.

Another function of GAM96 is therefore inhibition of LOC157226 (Accession XP_033876.1). Accordingly, utilities of GAM96 include diagnosis, prevention and treatment of diseases and clinical conditions associated with LOC157226.

LOC157562 (Accession XP_098779.1) is another GAM96 target gene, herein designated TARGET GENE. LOC157562 BINDING SITE is a target binding site found in the 5' untranslated region of mRNA encoded by LOC157562, corresponding to a target binding site such as BINDING SITE I, BINDING SITE II or BINDING SITE III of FIG. 8. Table 4 illustrates the complementarity of the nucleotide sequences of LOC157562 BINDING SITE, designated SEQ ID:7115, to the nucleotide sequence of GAM96 RNA, herein designated GAM RNA, also designated SEQ ID:394.

Another function of GAM96 is therefore inhibition of LOC157562 (Accession XP_098779.1). Accordingly, utilities of GAM96 include diagnosis, prevention and treatment of diseases and clinical conditions associated with LOC157562.

LOC158812 (Accession XP_088679.1) is another GAM96 target gene, herein designated TARGET GENE. LOC158812 BINDING SITE is a target binding site found in the 3' untranslated region of mRNA encoded by LOC158812, corresponding to a target binding site such as BINDING SITE I, BINDING SITE II or BINDING SITE III of FIG. 8. Table 4 illustrates the complementarity of the nucleotide sequences of LOC158812 BINDING SITE, designated SEQ ID:11303, to the nucleotide sequence of GAM96 RNA, herein designated GAM RNA, also designated SEQ ID:394.

Another function of GAM96 is therefore inhibition of LOC158812 (Accession XP_088679.1). Accordingly, utilities of GAM96 include diagnosis, prevention and treatment of diseases and clinical conditions associated with LOC158812.

LOC158813 (Accession XP_088680.1) is another GAM96 target gene, herein designated TARGET GENE. LOC158813 BINDING SITE is a target binding site found in the 3' untranslated region of mRNA encoded by LOC158813, corresponding to a target binding site such as BINDING SITE I, BINDING SITE II or BINDING SITE III of FIG. 8. Table 4 illustrates the complementarity of the nucleotide sequences of LOC158813 BINDING SITE, designated SEQ ID:11303, to the nucleotide sequence of GAM96 RNA, herein designated GAM RNA, also designated SEQ ID:394.

Another function of GAM96 is therefore inhibition of LOC158813 (Accession XP_088680.1). Accordingly, utilities of GAM96 include diagnosis, prevention and treatment of diseases and clinical conditions associated with LOC158813.

LOC167691 (Accession XP_094623.1) is another GAM96 target gene, herein designated TARGET GENE. LOC167691 BINDING SITE is a target binding site found in the 3' untranslated region of mRNA encoded by LOC167691, corresponding to a target binding site such as BINDING SITE I, BINDING SITE II or BINDING SITE III of FIG. 8. Table 4 illustrates the complementarity of the nucleotide sequences of LOC167691 BINDING SITE, designated SEQ ID:8140, to the nucleotide sequence of GAM96 RNA, herein designated GAM RNA, also designated SEQ ID:394.

Another function of GAM96 is therefore inhibition of LOC167691 (Accession XP_094623.1). Accordingly, utilities of GAM96 include diagnosis, prevention and treatment of diseases and clinical conditions associated with LOC167691.

LOC196483 (Accession XP_016909.6) is another GAM96 target gene, herein designated TARGET GENE. LOC196483 BINDING SITE is a target binding site found in the 5' untranslated region of mRNA encoded by LOC196483, corresponding to a target binding site such as BINDING SITE I, BINDING SITE II or BINDING SITE III of FIG. 8. Table 4 illustrates the complementarity of the nucleotide sequences of LOC196483 BINDING SITE, designated SEQ ID:14696, to the nucleotide sequence of GAM96 RNA, herein designated GAM RNA, also designated SEQ ID:394.

Another function of GAM96 is therefore inhibition of LOC196483 (Accession XP_016909.6). Accordingly, utilities of GAM96 include diagnosis, prevention and treatment of diseases and clinical conditions associated with LOC196483.

LOC199858 (Accession XP_114040.1) is another GAM96 target gene, herein designated TARGET GENE. LOC199858 BINDING SITE is a target binding site found in the 3' untranslated region of mRNA encoded by LOC199858, corresponding to a target binding site such as BINDING SITE I, BINDING SITE II or BINDING SITE III of FIG. 8. Table 4 illustrates the complementarity of the nucleotide sequences of LOC199858 BINDING SITE, designated SEQ ID:11822, to the nucleotide sequence of GAM96 RNA, herein designated GAM RNA, also designated SEQ ID:394.

Another function of GAM96 is therefore inhibition of LOC199858 (Accession XP_114040.1). Accordingly, utilities of GAM96 include diagnosis, prevention and treatment of diseases and clinical conditions associated with LOC199858.

LOC200609 (Accession XP_117256.1) is another GAM96 target gene, herein designated TARGET GENE. LOC200609 BINDING SITE is a target binding site found in the 5' untranslated region of mRNA encoded by LOC200609, corresponding to a target binding site such as BINDING SITE I, BINDING SITE II or BINDING SITE III of FIG. 8. Table 4 illustrates the complementarity of the nucleotide sequences of LOC200609 BINDING SITE, designated SEQ ID:1503, to the nucleotide sequence of GAM96 RNA, herein designated GAM RNA, also designated SEQ ID:394.

Another function of GAM96 is therefore inhibition of LOC200609 (Accession XP_117256.1). Accordingly, utilities of GAM96 include diagnosis, prevention and treatment of diseases and clinical conditions associated with LOC200609.

LOC200895 (Accession NP_789785.1) is another GAM96 target gene, herein designated TARGET GENE. LOC200895 BINDING SITE is a target binding site found in the 3' untranslated region of mRNA encoded by LOC200895, corresponding to a target binding site such as BINDING SITE I, BINDING SITE II or BINDING SITE III of FIG. 8. Table 4 illustrates the complementarity of the nucleotide sequences of LOC200895 BINDING SITE, designated SEQ ID:11068, to the nucleotide sequence of GAM96 RNA, herein designated GAM RNA, also designated SEQ ID:394.

Another function of GAM96 is therefore inhibition of LOC200895 (Accession NP_789785.1). Accordingly, utilities of GAM96 include diagnosis, prevention and treatment of diseases and clinical conditions associated with LOC200895.

LOC200916 (Accession XP_114317.3) is another GAM96 target gene, herein designated TARGET GENE. LOC200916 BINDING SITE is a target binding site found in the 3' untranslated region of mRNA encoded by LOC200916, corresponding to a target binding site such as BINDING SITE I, BINDING SITE II or BINDING SITE III of FIG. 8. Table 4 illustrates the complementarity of the nucleotide sequences of LOC200916 BINDING SITE, designated SEQ ID:903, to the nucleotide sequence of GAM96 RNA, herein designated GAM RNA, also designated SEQ ID:394.

Another function of GAM96 is therefore inhibition of LOC200916 (Accession XP_114317.3). Accordingly, utilities of GAM96 include diagnosis, prevention and treatment of diseases and clinical conditions associated with LOC200916.

LOC201725 (Accession XP_114370.1) is another GAM96 target gene, herein designated TARGET GENE. LOC201725 BINDING SITE is a target binding site found in the 3' untranslated region of mRNA encoded by LOC201725, corresponding to a target binding site such as BINDING SITE I, BINDING SITE II or BINDING SITE III of FIG. 8. Table 4 illustrates the complementarity of the nucleotide sequences of LOC201725 BINDING SITE, designated SEQ ID:3356, to the nucleotide sequence of GAM96 RNA, herein designated GAM RNA, also designated SEQ ID:394.

Another function of GAM96 is therefore inhibition of LOC201725 (Accession XP_114370.1). Accordingly, utilities of GAM96 include diagnosis, prevention and treatment of diseases and clinical conditions associated with LOC201725.

LOC219919 (Accession XP_167785.1) is another GAM96 target gene, herein designated TARGET GENE. LOC219919 BINDING SITE1 and LOC219919 BINDING SITE2 are target binding sites found in untranslated regions of mRNA encoded by LOC219919, corresponding to target binding sites such as BINDING SITE I, BINDING SITE II or BINDING SITE III of FIG. 8. Table 4 illustrates the complementarity of the nucleotide sequences of LOC219919 BINDING SITE1 and LOC219919 BINDING SITE2, designated SEQ ID:13602 and SEQ ID:6258 respectively, to the nucleotide sequence of GAM96 RNA, herein designated GAM RNA, also designated SEQ ID:394.

Another function of GAM96 is therefore inhibition of LOC219919 (Accession XP_167785.1). Accordingly, utilities of GAM96 include diagnosis, prevention and treatment of diseases and clinical conditions associated with LOC219919.

LOC222057 (Accession XP_166594.2) is another GAM96 target gene, herein designated TARGET GENE. LOC222057 BINDING SITE is a target binding site found in the 3' untranslated region of mRNA encoded by LOC222057, corresponding to a target binding site such as BINDING SITE I, BINDING SITE II or BINDING SITE III of FIG. 8. Table 4 illustrates the complementarity of the nucleotide sequences of LOC222057 BINDING SITE, designated SEQ ID:6288, to the nucleotide sequence of GAM96 RNA, herein designated GAM RNA, also designated SEQ ID:394.

Another function of GAM96 is therefore inhibition of LOC222057 (Accession XP_166594.2). Accordingly, utilities of GAM96 include diagnosis, prevention and treatment of diseases and clinical conditions associated with LOC222057.

LOC222171 (Accession NP_787083.1) is another GAM96 target gene, herein designated TARGET GENE. LOC222171 BINDING SITE is a target binding site found in the 3' untranslated region of mRNA encoded by LOC222171, corresponding to a target binding site such as BINDING SITE I, BINDING SITE II or BINDING SITE III of FIG. 8. Table 4 illustrates the complementarity of the nucleotide sequences of LOC222171 BINDING SITE, designated SEQ ID:10483, to the nucleotide sequence of GAM96 RNA, herein designated GAM RNA, also designated SEQ ID:394.

Another function of GAM96 is therefore inhibition of LOC222171 (Accession NP_787083.1). Accordingly, utilities of GAM96 include diagnosis, prevention and treatment of diseases and clinical conditions associated with LOC222171.

LOC253573 (Accession XP_173110.1) is another GAM96 target gene, herein designated TARGET GENE. LOC253573 BINDING SITE1 and LOC253573 BINDING SITE2 are target binding sites found in untranslated regions of mRNA encoded by LOC253573, corresponding to target binding sites such as BINDING SITE I, BINDING SITE II or BINDING SITE III of FIG. 8. Table 4 illustrates the complementarity of the nucleotide sequences of LOC253573 BINDING SITE1 and LOC253573 BINDING SITE2, designated SEQ ID:4331 and SEQ ID:18972 respectively, to the nucleotide sequence of GAM96 RNA, herein designated GAM RNA, also designated SEQ ID:394.

Another function of GAM96 is therefore inhibition of LOC253573 (Accession XP_173110.1). Accordingly, utilities of GAM96 include diagnosis, prevention and treatment of diseases and clinical conditions associated with LOC253573.

LOC255480 (Accession XP_172895.1) is another GAM96 target gene, herein designated TARGET GENE. LOC255480 BINDING SITE is a target binding site found in the 5' untranslated region of mRNA encoded by LOC255480, corresponding to a target binding site such as BINDING SITE I, BINDING SITE II or BINDING SITE III of FIG. 8. Table 4 illustrates the complementarity of the nucleotide sequences of LOC255480 BINDING SITE, designated SEQ ID:18477, to the nucleotide sequence of GAM96 RNA, herein designated GAM RNA, also designated SEQ ID:394.

Another function of GAM96 is therefore inhibition of LOC255480 (Accession XP_172895.1). Accordingly, utilities of GAM96 include diagnosis, prevention and treatment of diseases and clinical conditions associated with LOC255480.

LOC256248 (Accession XP_172550.1) is another GAM96 target gene, herein designated TARGET GENE. LOC256248 BINDING SITE is a target binding site found in the 5' untranslated region of mRNA encoded by LOC256248, corresponding to a target binding site such as BINDING SITE I, BINDING SITE II or BINDING SITE III of FIG. 8. Table 4 illustrates the complementarity of the nucleotide sequences of LOC256248 BINDING SITE, designated SEQ ID:8993, to the nucleotide sequence of GAM96 RNA, herein designated GAM RNA, also designated SEQ ID:394.

Another function of GAM96 is therefore inhibition of LOC256248 (Accession XP_172550.1). Accordingly, utilities of GAM96 include diagnosis, prevention and treatment of diseases and clinical conditions associated with LOC256248.

LOC283104 (Accession XP_210888.1) is another GAM96 target gene, herein designated TARGET GENE. LOC283104 BINDING SITE is a target binding site found in the 5' untranslated region of mRNA encoded by LOC283104, corresponding to a target binding site such as BINDING SITE I, BINDING SITE II or BINDING SITE III of FIG. 8. Table 4 illustrates the complementarity of the nucleotide sequences of LOC283104 BINDING SITE, designated SEQ ID:9301, to the nucleotide sequence of GAM96 RNA, herein designated GAM RNA, also designated SEQ ID:394.

Another function of GAM96 is therefore inhibition of LOC283104 (Accession XP_210888.1). Accordingly, utilities of GAM96 include diagnosis, prevention and treatment of diseases and clinical conditions associated with LOC283104.

LOC283331 (Accession XP_210977.1) is another GAM96 target gene, herein designated TARGET GENE. LOC283331 BINDING SITE is a target binding site found in the 5' untranslated region of mRNA encoded by LOC283331, corresponding to a target binding site such as BINDING SITE I, BINDING SITE II or BINDING SITE III of FIG. 8. Table 4 illustrates the complementarity of the nucleotide sequences of LOC283331 BINDING SITE, designated SEQ ID:3714, to the nucleotide sequence of GAM96 RNA, herein designated GAM RNA, also designated SEQ ID:394.

Another function of GAM96 is therefore inhibition of LOC283331 (Accession XP_210977.1). Accordingly, utilities of GAM96 include diagnosis, prevention and treatment of diseases and clinical conditions associated with LOC283331.

LOC283724 (Accession XP_208806.1) is another GAM96 target gene, herein designated TARGET GENE. LOC283724 BINDING SITE is a target binding site found in the 3' untranslated region of mRNA encoded by LOC283724, corresponding to a target binding site such as BINDING SITE I, BINDING SITE II or BINDING SITE III of FIG. 8. Table 4 illustrates the complementarity of the nucleotide sequences of LOC283724 BINDING SITE, designated SEQ ID:17874, to the nucleotide sequence of GAM96 RNA, herein designated GAM RNA, also designated SEQ ID:394.

Another function of GAM96 is therefore inhibition of LOC283724 (Accession XP_208806.1). Accordingly, utilities of GAM96 include diagnosis, prevention and treatment of diseases and clinical conditions associated with LOC283724.

LOC283731 (Accession XP_211184.1) is another GAM96 target gene, herein designated TARGET GENE. LOC283731 BINDING SITE is a target binding site found in the 5' untranslated region of mRNA encoded by LOC283731, corresponding to a target binding site such as BINDING SITE I, BINDING SITE II or BINDING SITE III of FIG. 8. Table 4 illustrates the complementarity of the nucleotide sequences of LOC283731 BINDING SITE, designated SEQ ID:2171, to the nucleotide sequence of GAM96 RNA, herein designated GAM RNA, also designated SEQ ID:394.

Another function of GAM96 is therefore inhibition of LOC283731 (Accession XP_211184.1). Accordingly, utilities of GAM96 include diagnosis, prevention and treatment of diseases and clinical conditions associated with LOC283731.

LOC283834 (Accession XP_211225.1) is another GAM96 target gene, herein designated TARGET GENE. LOC283834 BINDING SITE is a target binding site found in the 3' untranslated region of mRNA encoded by LOC283834, corresponding to a target binding site such as BINDING SITE I, BINDING SITE II or BINDING SITE III of FIG. 8. Table 4 illustrates the complementarity of the nucleotide sequences of LOC283834 BINDING SITE, designated SEQ ID:17890, to the nucleotide sequence of GAM96 RNA, herein designated GAM RNA, also designated SEQ ID:394.

Another function of GAM96 is therefore inhibition of LOC283834 (Accession XP_211225.1). Accordingly, utilities of GAM96 include diagnosis, prevention and treatment of diseases and clinical conditions associated with LOC283834.

LOC284023 (Accession XP_208983.3) is another GAM96 target gene, herein designated TARGET GENE. LOC284023 BINDING SITE is a target binding site found in the 3' untranslated region of mRNA encoded by LOC284023, corresponding to a target binding site such as BINDING SITE I, BINDING SITE II or BINDING SITE III of FIG. 8. Table 4 illustrates the complementarity of the nucleotide sequences of LOC284023 BINDING SITE, designated SEQ ID:10544, to the nucleotide sequence of GAM96 RNA, herein designated GAM RNA, also designated SEQ ID:394.

Another function of GAM96 is therefore inhibition of LOC284023 (Accession XP_208983.3). Accordingly, utilities of GAM96 include diagnosis, prevention and treatment of diseases and clinical conditions associated with LOC284023.

LOC284031 (Accession XP_208982.1) is another GAM96 target gene, herein designated TARGET GENE. LOC284031 BINDING SITE is a target binding site found in the 3' untranslated region of mRNA encoded by LOC284031, corresponding to a target binding site such as BINDING SITE I, BINDING SITE II or BINDING SITE III of FIG. 8. Table 4 illustrates the complementarity of the nucleotide sequences of LOC284031 BINDING SITE, designated SEQ ID:14747, to the nucleotide sequence of GAM96 RNA, herein designated GAM RNA, also designated SEQ ID:394.

Another function of GAM96 is therefore inhibition of LOC284031 (Accession XP_208982.1). Accordingly, utilities of GAM96 include diagnosis, prevention and treatment of diseases and clinical conditions associated with LOC284031.

LOC284054 (Accession XP_208987.1) is another GAM96 target gene, herein designated TARGET GENE. LOC284054 BINDING SITE is a target binding site found in the 3' untranslated region of mRNA encoded by LOC284054, corresponding to a target binding site such as BINDING SITE I, BINDING SITE II or BINDING SITE III of FIG. 8. Table 4 illustrates the complementarity of the nucleotide sequences of LOC284054 BINDING SITE, designated SEQ ID:14039, to the nucleotide sequence of GAM96 RNA, herein designated GAM RNA, also designated SEQ ID:394.

Another function of GAM96 is therefore inhibition of LOC284054 (Accession XP_208987.1). Accordingly, utilities of GAM96 include diagnosis, prevention and treatment of diseases and clinical conditions associated with LOC284054.

LOC284057 (Accession XP_208989.1) is another GAM96 target gene, herein designated TARGET GENE. LOC284057 BINDING SITE is a target binding site found in the 3' untranslated region of mRNA encoded by LOC284057, corresponding to a target binding site such as BINDING SITE I, BINDING SITE II or BINDING SITE III of FIG. 8. Table 4 illustrates the complementarity of the nucleotide sequences of LOC284057 BINDING SITE, designated SEQ ID:19081, to the nucleotide sequence of GAM96 RNA, herein designated GAM RNA, also designated SEQ ID:394.

Another function of GAM96 is therefore inhibition of LOC284057 (Accession XP_208989.1). Accordingly, utilities of GAM96 include diagnosis, prevention and treatment of diseases and clinical conditions associated with LOC284057.

LOC284117 (Accession XP_209024.1) is another GAM96 target gene, herein designated TARGET GENE. LOC284117 BINDING SITE is a target binding site found in the 3' untranslated region of mRNA encoded by LOC284117, corresponding to a target binding site such as BINDING SITE I, BINDING SITE II or BINDING SITE III of FIG. 8. Table 4 illustrates the complementarity of the nucleotide sequences of LOC284117 BINDING SITE, designated SEQ ID:4099, to the nucleotide sequence of GAM96 RNA, herein designated GAM RNA, also designated SEQ ID:394.

Another function of GAM96 is therefore inhibition of LOC284117 (Accession XP_209024.1). Accordingly, utilities of GAM96 include diagnosis, prevention and treatment of diseases and clinical conditions associated with LOC284117.

LOC284305 (Accession XP_211425.1) is another GAM96 target gene, herein designated TARGET GENE. LOC284305 BINDING SITE is a target binding site found in the 5' untranslated region of mRNA encoded by LOC284305, corresponding to a target binding site such as BINDING SITE I, BINDING SITE II or BINDING SITE III of FIG. 8. Table 4 illustrates the complementarity of the nucleotide sequences of LOC284305 BINDING SITE, designated SEQ ID:11555, to the nucleotide sequence of GAM96 RNA, herein designated GAM RNA, also designated SEQ ID:394.

Another function of GAM96 is therefore inhibition of LOC284305 (Accession XP_211425.1). Accordingly, utilities of GAM96 include diagnosis, prevention and treatment of diseases and clinical conditions associated with LOC284305.

LOC284325 (Accession XP_209143.1) is another GAM96 target gene, herein designated TARGET GENE. LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:833, to the nucleotide sequence of GAM96 RNA, herein designated GAM RNA, also designated SEQ ID:394.

Another function of GAM96 is therefore inhibition of LOC284325 (Accession XP_209143.1). Accordingly, utilities of GAM96 include diagnosis, prevention and treatment of diseases and clinical conditions associated with LOC284325.

LOC284440 (Accession XP_209210.1) is another GAM96 target gene, herein designated TARGET GENE. LOC284440 BINDING SITE is a target binding site found in the 5' untranslated region of mRNA encoded by LOC284440, corresponding to a target binding site such as BINDING SITE I, BINDING SITE II or BINDING SITE III of FIG. 8. Table 4 illustrates the complementarity of the nucleotide sequences of LOC284440 BINDING SITE, designated SEQ ID:11999, to the nucleotide sequence of GAM96 RNA, herein designated GAM RNA, also designated SEQ ID:394.

Another function of GAM96 is therefore inhibition of LOC284440 (Accession XP_209210.1). Accordingly, utilities of GAM96 include diagnosis, prevention and treatment of diseases and clinical conditions associated with LOC284440.

LOC284452 (Accession XP_211469.1) is another GAM96 target gene, herein designated TARGET GENE. LOC284452 BINDING SITE is a target binding site found in the 5' untranslated region of mRNA encoded by LOC284452, corresponding to a target binding site such as BINDING SITE I, BINDING SITE II or BINDING SITE III of FIG. 8. Table 4 illustrates the complementarity of the nucleotide sequences of LOC284452 BINDING SITE, designated SEQ ID:9502, to the nucleotide sequence of GAM96 RNA, herein designated GAM RNA, also designated SEQ ID:394.

Another function of GAM96 is therefore inhibition of LOC284452 (Accession XP_211469.1). Accordingly, utilities of GAM96 include diagnosis, prevention and treatment of diseases and clinical conditions associated with LOC284452.

LOC284473 (Accession XP_211474.1) is another GAM96 target gene, herein designated TARGET GENE. LOC284473 BINDING SITE is a target binding site found in the 3' untranslated region of mRNA encoded by LOC284473, corresponding to a target binding site such as BINDING SITE I, BINDING SITE II or BINDING SITE III of FIG. 8. Table 4 illustrates the complementarity of the nucleotide sequences of LOC284473 BINDING SITE, designated SEQ ID:6210, to the nucleotide sequence of GAM96 RNA, herein designated GAM RNA, also designated SEQ ID:394.

Another function of GAM96 is therefore inhibition of LOC284473 (Accession XP_211474.1). Accordingly, utilities of GAM96 include diagnosis, prevention and treatment of diseases and clinical conditions associated with LOC284473.

LOC284600 (Accession XP_211548.1) is another GAM96 target gene, herein designated TARGET GENE. LOC284600 BINDING SITE is a target binding site found in the 5' untranslated region of mRNA encoded by LOC284600, corresponding to a target binding site such as BINDING SITE I, BINDING SITE II or BINDING SITE III of FIG. 8. Table 4 illustrates the complementarity of the nucleotide sequences of LOC284600 BINDING SITE, designated SEQ ID:8522, to the nucleotide sequence of GAM96 RNA, herein designated GAM RNA, also designated SEQ ID:394.

Another function of GAM96 is therefore inhibition of LOC284600 (Accession XP_211548.1). Accordingly, utilities of GAM96 include diagnosis, prevention and treatment of diseases and clinical conditions associated with LOC284600.

LOC284759 (Accession XP_209363.1) is another GAM96 target gene, herein designated TARGET GENE. LOC284759 BINDING SITE is a target binding site found in the 5' untranslated region of mRNA encoded by LOC284759, corresponding to a target binding site such as BINDING SITE I, BINDING SITE II or BINDING SITE III of FIG. 8. Table 4 illustrates the complementarity of the nucleotide sequences of LOC284759 BINDING SITE, designated SEQ ID:11795, to the nucleotide sequence of GAM96 RNA, herein designated GAM RNA, also designated SEQ ID:394.

Another function of GAM96 is therefore inhibition of LOC284759 (Accession XP_209363.1). Accordingly, utilities of GAM96 include diagnosis, prevention and treatment of diseases and clinical conditions associated with LOC284759.

LOC284831 (Accession XP_211644.1) is another GAM96 target gene, herein designated TARGET GENE. LOC284831 BINDING SITE is a target binding site found in the 5' untranslated region of mRNA encoded by LOC284831, corresponding to a target binding site such as BINDING SITE I, BINDING SITE II or BINDING SITE III of FIG. 8. Table 4 illustrates the complementarity of the nucleotide sequences of LOC284831 BINDING SITE, designated SEQ ID:13771, to the nucleotide sequence of GAM96 RNA, herein designated GAM RNA, also designated SEQ ID:394.

Another function of GAM96 is therefore inhibition of LOC284831 (Accession XP_211644.1). Accordingly, utilities of GAM96 include diagnosis, prevention and treatment of diseases and clinical conditions associated with LOC284831.

LOC285033 (Accession XP_211739.1) is another GAM96 target gene, herein designated TARGET GENE. LOC285033 BINDING SITE is a target binding site found in the 5' untranslated region of mRNA encoded by LOC285033, corresponding to a target binding site such as BINDING SITE I, BINDING SITE II or BINDING SITE III of FIG. 8. Table 4 illustrates the complementarity of the nucleotide sequences of LOC285033 BINDING SITE, designated SEQ ID:933, to the nucleotide sequence of GAM96 RNA, herein designated GAM RNA, also designated SEQ ID:394.

Another function of GAM96 is therefore inhibition of LOC285033 (Accession XP_211739.1). Accordingly, utilities of GAM96 include diagnosis, prevention and treatment of diseases and clinical conditions associated with LOC285033.

LOC285173 (Accession XP_211795.1) is another GAM96 target gene, herein designated TARGET GENE. LOC285173 BINDING SITE is a target binding site found in the 5' untranslated region of mRNA encoded by LOC285173, corresponding to a target binding site such as BINDING SITE I, BINDING SITE II or BINDING SITE III of FIG. 8. Table 4 illustrates the complementarity of the nucleotide sequences of LOC285173 BINDING SITE, designated SEQ ID:17372, to the nucleotide sequence of GAM96 RNA, herein designated GAM RNA, also designated SEQ ID:394.

Another function of GAM96 is therefore inhibition of LOC285173 (Accession XP_211795.1). Accordingly, utilities of GAM96 include diagnosis, prevention and treatment of diseases and clinical conditions associated with LOC285173.

LOC285191 (Accession XP_211802.1) is another GAM96 target gene, herein designated TARGET GENE. LOC285191 BINDING SITE is a target binding site found in the 5' untranslated region of mRNA encoded by LOC285191, corresponding to a target binding site such as BINDING SITE I, BINDING SITE II or BINDING SITE III of FIG. 8. Table 4 illustrates the complementarity of the nucleotide sequences of LOC285191 BINDING SITE, designated SEQ ID:9868, to the nucleotide sequence of GAM96 RNA, herein designated GAM RNA, also designated SEQ ID:394.

Another function of GAM96 is therefore inhibition of LOC285191 (Accession XP_211802.1). Accordingly, utilities of GAM96 include diagnosis, prevention and treatment of diseases and clinical conditions associated with LOC285191.

LOC285205 (Accession XP_211805.1) is another GAM96 target gene, herein designated TARGET GENE. LOC285205 BINDING SITE is a target binding site found in the 3' untranslated region of mRNA encoded by LOC285205, corresponding to a target binding site such as BINDING SITE I, BINDING SITE II or BINDING SITE III of FIG. 8. Table 4 illustrates the complementarity of the nucleotide sequences of LOC285205 BINDING SITE, designated SEQ ID:11893, to the nucleotide sequence of GAM96 RNA, herein designated GAM RNA, also designated SEQ ID:394.

Another function of GAM96 is therefore inhibition of LOC285205 (Accession XP_211805.1). Accordingly, utilities of GAM96 include diagnosis, prevention and treatment of diseases and clinical conditions associated with LOC285205.

LOC285266 (Accession XP_211823.1) is another GAM96 target gene, herein designated TARGET GENE. LOC285266 BINDING SITE is a target binding site found in the 3' untranslated region of mRNA encoded by LOC285266, corresponding to a target binding site such as BINDING SITE I, BINDING SITE II or BINDING SITE III of FIG. 8. Table 4 illustrates the complementarity of the nucleotide sequences of LOC285266 BINDING SITE, designated SEQ ID:8215, to the nucleotide sequence of GAM96 RNA, herein designated GAM RNA, also designated SEQ ID:394.

Another function of GAM96 is therefore inhibition of LOC285266 (Accession XP_211823.1). Accordingly, utilities of GAM96 include diagnosis, prevention and treatment of diseases and clinical conditions associated with LOC285266.

LOC285295 (Accession XP_211833.1) is another GAM96 target gene, herein designated TARGET GENE. LOC285295 BINDING SITE is a target binding site found in the 5' untranslated region of mRNA encoded by LOC285295, corresponding to a target binding site such as BINDING SITE I, BINDING SITE II or BINDING SITE III of FIG. 8. Table 4 illustrates the complementarity of the nucleotide sequences of LOC285295 BINDING SITE, designated SEQ ID:13602, to the nucleotide sequence of GAM96 RNA, herein designated GAM RNA, also designated SEQ ID:394.

Another function of GAM96 is therefore inhibition of LOC285295 (Accession XP_211833.1). Accordingly, utilities of GAM96 include diagnosis, prevention and treatment of diseases and clinical conditions associated with LOC285295.

LOC285309 (Accession XP_211839.1) is another GAM96 target gene, herein designated TARGET GENE. LOC285309 BINDING SITE1 and LOC285309 BINDING SITE2 are target binding sites found in untranslated regions of mRNA encoded by LOC285309, corresponding to target binding sites such as BINDING SITE I, BINDING SITE II or BINDING SITE III of FIG. 8. Table 4 illustrates the complementarity of the nucleotide sequences of LOC285309 BINDING SITE1 and LOC285309 BINDING SITE2, designated SEQ ID:6068 and SEQ ID:13602 respectively, to the nucleotide sequence of GAM96 RNA, herein designated GAM RNA, also designated SEQ ID:394.

Another function of GAM96 is therefore inhibition of LOC285309 (Accession XP_211839.1). Accordingly, utilities of GAM96 include diagnosis, prevention and treatment of diseases and clinical conditions associated with LOC285309.

LOC285506 (Accession XP_209641.1) is another GAM96 target gene, herein designated TARGET GENE. LOC285506 BINDING SITE is a target binding site found in the 3' untranslated region of mRNA encoded by LOC285506, corresponding to a target binding site such as BINDING SITE I, BINDING SITE II or BINDING SITE III of FIG. 8. Table 4 illustrates the complementarity of the nucleotide sequences of LOC285506 BINDING SITE, designated SEQ ID:4219, to the nucleotide sequence of GAM96 RNA, herein designated GAM RNA, also designated SEQ ID:394.

Another function of GAM96 is therefore inhibition of LOC285506 (Accession XP_209641.1). Accordingly, utilities of GAM96 include diagnosis, prevention and treatment of diseases and clinical conditions associated with LOC285506.

LOC285556 (Accession XP_211939.1) is another GAM96 target gene, herein designated TARGET GENE. LOC285556 BINDING SITE is a target binding site found in the 3' untranslated region of mRNA encoded by LOC285556, corresponding to a target binding site such as BINDING SITE I, BINDING SITE II or BINDING SITE III of FIG. 8. Table 4 illustrates the complementarity of the nucleotide sequences of LOC285556 BINDING SITE, designated SEQ ID:1124, to the nucleotide sequence of GAM96 RNA, herein designated GAM RNA, also designated SEQ ID:394.

Another function of GAM96 is therefore inhibition of LOC285556 (Accession XP_211939.1). Accordingly, utilities of GAM96 include diagnosis, prevention and treatment of diseases and clinical conditions associated with LOC285556.

LOC285638 (Accession XP_209693.1) is another GAM96 target gene, herein designated TARGET GENE. LOC285638 BINDING SITE is a target binding site found in the 5' untranslated region of mRNA encoded by LOC285638, corresponding to a target binding site such as BINDING SITE I, BINDING SITE II or BINDING SITE III of FIG. 8. Table 4 illustrates the complementarity of the nucleotide sequences of LOC285638 BINDING SITE, designated SEQ ID:16938, to the nucleotide sequence of GAM96 RNA, herein designated GAM RNA, also designated SEQ ID:394.

Another function of GAM96 is therefore inhibition of LOC285638 (Accession XP_209693.1). Accordingly, utilities of GAM96 include diagnosis, prevention and treatment of diseases and clinical conditions associated with LOC285638.

LOC285673 (Accession XP_209720.1) is another GAM96 target gene, herein designated TARGET GENE. LOC285673 BINDING SITE is a target binding site found in the 3' untranslated region of mRNA encoded by LOC285673, corresponding to a target binding site such as BINDING SITE I, BINDING SITE II or BINDING SITE III of FIG. 8. Table 4 illustrates the complementarity of the nucleotide sequences of LOC285673 BINDING SITE, designated SEQ ID:9819, to the nucleotide sequence of GAM96 RNA, herein designated GAM RNA, also designated SEQ ID:394.

Another function of GAM96 is therefore inhibition of LOC285673 (Accession XP_209720.1). Accordingly, utilities of GAM96 include diagnosis, prevention and treatment of diseases and clinical conditions associated with LOC285673.

LOC285744 (Accession XP_209743.1) is another GAM96 target gene, herein designated TARGET GENE. LOC285744 BINDING SITE is a target binding site found in the 3' untranslated region of mRNA encoded by LOC285744, corresponding to a target binding site such as BINDING SITE I, BINDING SITE II or BINDING SITE III of FIG. 8. Table 4 illustrates the complementarity of the nucleotide sequences of LOC285744 BINDING SITE, designated SEQ ID:10189, to the nucleotide sequence of GAM96 RNA, herein designated GAM RNA, also designated SEQ ID:394.

Another function of GAM96 is therefore inhibition of LOC285744 (Accession XP_209743.1). Accordingly, utilities of GAM96 include diagnosis, prevention and treatment of diseases and clinical conditions associated with LOC285744.

LOC285851 (Accession XP_212039.1) is another GAM96 target gene, herein designated TARGET GENE. LOC285851 BINDING SITE is a target binding site found in the 3' untranslated region of mRNA encoded by LOC285851, corresponding to a target binding site such as BINDING SITE I, BINDING SITE II or BINDING SITE III of FIG. 8. Table 4 illustrates the complementarity of the nucleotide sequences of LOC285851 BINDING SITE, designated SEQ ID:9838, to the nucleotide sequence of GAM96 RNA, herein designated GAM RNA, also designated SEQ ID:394.

Another function of GAM96 is therefore inhibition of LOC285851 (Accession XP_212039.1). Accordingly, utilities of GAM96 include diagnosis, prevention and treatment of diseases and clinical conditions associated with LOC285851.

LOC285951 (Accession XP_212090.1) is another GAM96 target gene, herein designated TARGET GENE. LOC285951 BINDING SITE is a target binding site found in the 5' untranslated region of mRNA encoded by LOC285951, corresponding to a target binding site such as BINDING SITE I, BINDING SITE II or BINDING SITE III of FIG. 8. Table 4 illustrates the complementarity of the nucleotide sequences of LOC285951 BINDING SITE, designated SEQ ID:4449, to the nucleotide sequence of GAM96 RNA, herein designated GAM RNA, also designated SEQ ID:394.

Another function of GAM96 is therefore inhibition of LOC285951 (Accession XP_212090.1). Accordingly, utilities of GAM96 include diagnosis, prevention and treatment of diseases and clinical conditions associated with LOC285951.

LOC286218 (Accession XP_212235.1) is another GAM96 target gene, herein designated TARGET GENE. LOC286218 BINDING SITE is a target binding site found in the 3' untranslated region of mRNA encoded by LOC286218, corresponding to a target binding site such as BINDING SITE I, BINDING SITE II or BINDING SITE III of FIG. 8. Table 4 illustrates the complementarity of the nucleotide sequences of LOC286218 BINDING SITE, designated SEQ ID:2398, to the nucleotide sequence of GAM96 RNA, herein designated GAM RNA, also designated SEQ ID:394.

Another function of GAM96 is therefore inhibition of LOC286218 (Accession XP_212235.1). Accordingly, utilities of GAM96 include diagnosis, prevention and treatment of diseases and clinical conditions associated with LOC286218.

LOC338746 (Accession XP_290549.1) is another GAM96 target gene, herein designated TARGET GENE. LOC338746 BINDING SITE is a target binding site found in the 3' untranslated region of mRNA encoded by LOC338746, corresponding to a target binding site such as BINDING SITE I, BINDING SITE II or BINDING SITE III of FIG. 8. Table 4 illustrates the complementarity of the nucleotide sequences of LOC338746 BINDING SITE, designated SEQ ID:9649, to the nucleotide sequence of GAM96 RNA, herein designated GAM RNA, also designated SEQ ID:394.

Another function of GAM96 is therefore inhibition of LOC338746 (Accession XP_290549.1). Accordingly, utilities of GAM96 include diagnosis, prevention and treatment of diseases and clinical conditions associated with LOC338746.

LOC338799 (Accession XP_290580.1) is another GAM96 target gene, herein designated TARGET GENE. LOC338799 BINDING SITE is a target binding site found in the 5' untranslated region of multiple transcripts of mRNA encoded by LOC338799, corresponding to a target binding site such as BINDING SITE I, BINDING SITE II or BINDING SITE III of FIG. 8. Table 4 illustrates the complementarity of the nucleotide sequences of LOC338799 BINDING SITE, designated SEQ ID:19175, to the nucleotide sequence of GAM96 RNA, herein designated GAM RNA, also designated SEQ ID:394.

Another function of GAM96 is therefore inhibition of LOC338799 (Accession XP_290580.1). Accordingly, utilities of GAM96 include diagnosis, prevention and treatment of diseases and clinical conditions associated with LOC338799.

LOC338899 (Accession XP_294740.1) is another GAM96 target gene, herein designated TARGET GENE. LOC338899 BINDING SITE is a target binding site found in the 3' untranslated region of mRNA encoded by LOC338899, corresponding to a target binding site such as BINDING SITE I, BINDING SITE II or BINDING SITE III of FIG. 8. Table 4 illustrates the complementarity of the nucleotide sequences of LOC338899 BINDING SITE, designated SEQ ID:5337, to the nucleotide sequence of GAM96 RNA, herein designated GAM RNA, also designated SEQ ID:394.

Another function of GAM96 is therefore inhibition of LOC338899 (Accession XP_294740.1). Accordingly, utilities of GAM96 include diagnosis, prevention and treatment of diseases and clinical conditions associated with LOC338899.

LOC339062 (Accession XP_294795.1) is another GAM96 target gene, herein designated TARGET GENE. LOC339062 BINDING SITE is a target binding site found in the 5' untranslated region of mRNA encoded by LOC339062, corresponding to a target binding site such as BINDING SITE I, BINDING SITE II or BINDING SITE III of FIG. 8. Table 4 illustrates the complementarity of the nucleotide sequences of LOC339062 BINDING SITE, designated SEQ ID:10862, to the nucleotide sequence of GAM96 RNA, herein designated GAM RNA, also designated SEQ ID:394.

Another function of GAM96 is therefore inhibition of LOC339062 (Accession XP_294795.1). Accordingly, utilities of GAM96 include diagnosis, prevention and treatment of diseases and clinical conditions associated with LOC339062.

LOC339373 (Accession XP_294921.1) is another GAM96 target gene, herein designated TARGET GENE. LOC339373 BINDING SITE is a target binding site found in the 3' untranslated region of mRNA encoded by LOC339373, corresponding to a target binding site such as BINDING SITE I, BINDING SITE II or BINDING SITE III of FIG. 8. Table 4 illustrates the complementarity of the nucleotide sequences of LOC339373 BINDING SITE, designated SEQ ID:12281, to the nucleotide sequence of GAM96 RNA, herein designated GAM RNA, also designated SEQ ID:394.

Another function of GAM96 is therefore inhibition of LOC339373 (Accession XP_294921.1). Accordingly, utilities of GAM96 include diagnosis, prevention and treatment of diseases and clinical conditions associated with LOC339373.

LOC339378 (Accession XP_294923.1) is another GAM96 target gene, herein designated TARGET GENE. LOC339378 BINDING SITE is a target binding site found in the 5' untranslated region of mRNA encoded by LOC339378, corresponding to a target binding site such as BINDING SITE I, BINDING SITE II or BINDING SITE III of FIG. 8. Table 4 illustrates the complementarity of the nucleotide sequences of LOC339378 BINDING SITE, designated SEQ ID:13147, to the nucleotide sequence of GAM96 RNA, herein designated GAM RNA, also designated SEQ ID:394.

Another function of GAM96 is therefore inhibition of LOC339378 (Accession XP_294923.1). Accordingly, utilities of GAM96 include diagnosis, prevention and treatment of diseases and clinical conditions associated with LOC339378.

LOC339622 (Accession XP_295016.1) is another GAM96 target gene, herein designated TARGET GENE. LOC339622 BINDING SITE is a target binding site found in the 5' untranslated region of mRNA encoded by LOC339622, corresponding to a target binding site such as BINDING SITE I, BINDING SITE II or BINDING SITE III of FIG. 8. Table 4 illustrates the complementarity of the nucleotide sequences of LOC339622 BINDING SITE, designated SEQ ID:4595, to the nucleotide sequence of GAM96 RNA, herein designated GAM RNA, also designated SEQ ID:394.

Another function of GAM96 is therefore inhibition of LOC339622 (Accession XP_295016.1). Accordingly, utilities of GAM96 include diagnosis, prevention and treatment of diseases and clinical conditions associated with LOC339622.

LOC339669 (Accession XP_290982.1) is another GAM96 target gene, herein designated TARGET GENE. LOC339669 BINDING SITE is a target binding site found in the 5' untranslated region of mRNA encoded by LOC339669, corresponding to a target binding site such as BINDING SITE I, BINDING SITE II or BINDING SITE III of FIG. 8. Table 4 illustrates the complementarity of the nucleotide sequences of LOC339669 BINDING SITE, designated SEQ ID:4448, to the nucleotide sequence of GAM96 RNA, herein designated GAM RNA, also designated SEQ ID:394.

Another function of GAM96 is therefore inhibition of LOC339669 (Accession XP_290982.1). Accordingly, utilities of GAM96 include diagnosis, prevention and treatment of diseases and clinical conditions associated with LOC339669.

LOC340074 (Accession XP_295148.1) is another GAM96 target gene, herein designated TARGET GENE. LOC340074 BINDING SITE is a target binding site found in the 3' untranslated region of mRNA encoded by LOC340074, corresponding to a target binding site such as BINDING SITE I, BINDING SITE II or BINDING SITE III of FIG. 8. Table 4 illustrates the complementarity of the nucleotide sequences of LOC340074 BINDING SITE, designated SEQ ID:5987, to the nucleotide sequence of GAM96 RNA, herein designated GAM RNA, also designated SEQ ID:394.

Another function of GAM96 is therefore inhibition of LOC340074 (Accession XP_295148.1). Accordingly, utilities of GAM96 include diagnosis, prevention and treatment of diseases and clinical conditions associated with LOC340074.

LOC340170 (Accession XP_291160.1) is another GAM96 target gene, herein designated TARGET GENE.

LOC340170 BINDING SITE is a target binding site found in the 5' untranslated region of mRNA encoded by LOC340170, corresponding to a target binding site such as BINDING SITE I, BINDING SITE II or BINDING SITE III of FIG. 8. Table 4 illustrates the complementarity of the nucleotide sequences of LOC340170 BINDING SITE, designated SEQ ID:7614, to the nucleotide sequence of GAM96 RNA, herein designated GAM RNA, also designated SEQ ID:394.

Another function of GAM96 is therefore inhibition of LOC340170 (Accession XP_291160.1). Accordingly, utilities of GAM96 include diagnosis, prevention and treatment of diseases and clinical conditions associated with LOC340170.

LOC340353 (Accession XP_295221.1) is another GAM96 target gene, herein designated TARGET GENE. LOC340353 BINDING SITE is a target binding site found in the 3' untranslated region of mRNA encoded by LOC340353, corresponding to a target binding site such as BINDING SITE I, BINDING SITE II or BINDING SITE III of FIG. 8. Table 4 illustrates the complementarity of the nucleotide sequences of LOC340353 BINDING SITE, designated SEQ ID:4624, to the nucleotide sequence of GAM96 RNA, herein designated GAM RNA, also designated SEQ ID:394.

Another function of GAM96 is therefore inhibition of LOC340353 (Accession XP_295221.1). Accordingly, utilities of GAM96 include diagnosis, prevention and treatment of diseases and clinical conditions associated with LOC340353.

LOC340464 (Accession XP_291300.1) is another GAM96 target gene, herein designated TARGET GENE. LOC340464 BINDING SITE is a target binding site found in the 5' untranslated region of mRNA encoded by LOC340464, corresponding to a target binding site such as BINDING SITE I, BINDING SITE II or BINDING SITE III of FIG. 8. Table 4 illustrates the complementarity of the nucleotide sequences of LOC340464 BINDING SITE, designated SEQ ID:6259, to the nucleotide sequence of GAM96 RNA, herein designated GAM RNA, also designated SEQ ID:394.

Another function of GAM96 is therefore inhibition of LOC340464 (Accession XP_291300.1). Accordingly, utilities of GAM96 include diagnosis, prevention and treatment of diseases and clinical conditions associated with LOC340464.

LOC340850 (Accession XP_295799.1) is another GAM96 target gene, herein designated TARGET GENE. LOC340850 BINDING SITE is a target binding site found in the 3' untranslated region of mRNA encoded by LOC340850, corresponding to a target binding site such as BINDING SITE I, BINDING SITE II or BINDING SITE III of FIG. 8. Table 4 illustrates the complementarity of the nucleotide sequences of LOC340850 BINDING SITE, designated SEQ ID:2511, to the nucleotide sequence of GAM96 RNA, herein designated GAM RNA, also designated SEQ ID:394.

Another function of GAM96 is therefore inhibition of LOC340850 (Accession XP_295799.1). Accordingly, utilities of GAM96 include diagnosis, prevention and treatment of diseases and clinical conditions associated with LOC340850.

LOC347864 (Accession XP_302614.1) is another GAM96 target gene, herein designated TARGET GENE. LOC347864 BINDING SITE is a target binding site found in the 3' untranslated region of mRNA encoded by LOC347864, corresponding to a target binding site such as BINDING SITE I, BINDING SITE II or BINDING SITE III of FIG. 8. Table 4 illustrates the complementarity of the nucleotide sequences of LOC347864 BINDING SITE, designated SEQ ID:1097, to the nucleotide sequence of GAM96 RNA, herein designated GAM RNA, also designated SEQ ID:394.

Another function of GAM96 is therefore inhibition of LOC347864 (Accession XP_302614.1). Accordingly, utilities of GAM96 include diagnosis, prevention and treatment of diseases and clinical conditions associated with LOC347864.

LOC347888 (Accession XP_302563.1) is another GAM96 target gene, herein designated TARGET GENE. LOC347888 BINDING SITE is a target binding site found in the 3' untranslated region of mRNA encoded by LOC347888, corresponding to a target binding site such as BINDING SITE I, BINDING SITE II or BINDING SITE III of FIG. 8. Table 4 illustrates the complementarity of the nucleotide sequences of LOC347888 BINDING SITE, designated SEQ ID:3644, to the nucleotide sequence of GAM96 RNA, herein designated GAM RNA, also designated SEQ ID:394.

Another function of GAM96 is therefore inhibition of LOC347888 (Accession XP_302563.1). Accordingly, utilities of GAM96 include diagnosis, prevention and treatment of diseases and clinical conditions associated with LOC347888.

LOC348528 (Accession XP_302814.1) is another GAM96 target gene, herein designated TARGET GENE. LOC348528 BINDING SITE is a target binding site found in the 3' untranslated region of mRNA encoded by LOC348528, corresponding to a target binding site such as BINDING SITE I, BINDING SITE II or BINDING SITE III of FIG. 8. Table 4 illustrates the complementarity of the nucleotide sequences of LOC348528 BINDING SITE, designated SEQ ID:17828, to the nucleotide sequence of GAM96 RNA, herein designated GAM RNA, also designated SEQ ID:394.

Another function of GAM96 is therefore inhibition of LOC348528 (Accession XP_302814.1). Accordingly, utilities of GAM96 include diagnosis, prevention and treatment of diseases and clinical conditions associated with LOC348528.

LOC349049 (Accession XP_300919.1) is another GAM96 target gene, herein designated TARGET GENE. LOC349049 BINDING SITE is a target binding site found in the 3' untranslated region of mRNA encoded by LOC349049, corresponding to a target binding site such as BINDING SITE I, BINDING SITE II or BINDING SITE III of FIG. 8. Table 4 illustrates the complementarity of the nucleotide sequences of LOC349049 BINDING SITE, designated SEQ ID:19254, to the nucleotide sequence of GAM96 RNA, herein designated GAM RNA, also designated SEQ ID:394.

Another function of GAM96 is therefore inhibition of LOC349049 (Accession XP_300919.1). Accordingly, utilities of GAM96 include diagnosis, prevention and treatment of diseases and clinical conditions associated with LOC349049.

LOC349234 (Accession XP_300987.1) is another GAM96 target gene, herein designated TARGET GENE. LOC349234 BINDING SITE is a target binding site found in the 3' untranslated region of mRNA encoded by LOC349234, corresponding to a target binding site such as BINDING SITE I, BINDING SITE II or BINDING SITE III of FIG. 8. Table 4 illustrates the complementarity of the nucleotide sequences of LOC349234 BINDING SITE, designated SEQ ID:4813, to the nucleotide sequence of GAM96 RNA, herein designated GAM RNA, also designated SEQ ID:394.

Another function of GAM96 is therefore inhibition of LOC349234 (Accession XP_300987.1). Accordingly, utilities of GAM96 include diagnosis, prevention and treatment of diseases and clinical conditions associated with LOC349234.

LOC349256 (Accession XP_300994.1) is another GAM96 target gene, herein designated TARGET GENE. LOC349256 BINDING SITE is a target binding site found in the 5' untranslated region of mRNA encoded by LOC349256, corresponding to a target binding site such as BINDING SITE I, BINDING SITE II or BINDING SITE III of FIG. 8. Table 4 illustrates the complementarity of the nucleotide sequences of LOC349256 BINDING SITE, designated SEQ ID:19187, to the nucleotide sequence of GAM96 RNA, herein designated GAM RNA, also designated SEQ ID:394.

Another function of GAM96 is therefore inhibition of LOC349256 (Accession XP_300994.1). Accordingly, utilities of GAM96 include diagnosis, prevention and treatment of diseases and clinical conditions associated with LOC349256.

LOC349351 (Accession XP_028319.4) is another GAM96 target gene, herein designated TARGET GENE. LOC349351 BINDING SITE is a target binding site found in the 5' untranslated region of mRNA encoded by LOC349351, corresponding to a target binding site such as BINDING SITE I, BINDING SITE II or BINDING SITE III of FIG. 8. Table 4 illustrates the complementarity of the nucleotide sequences of LOC349351 BINDING SITE, designated SEQ ID:19187, to the nucleotide sequence of GAM96 RNA, herein designated GAM RNA, also designated SEQ ID:394.

Another function of GAM96 is therefore inhibition of LOC349351 (Accession XP_028319.4). Accordingly, utilities of GAM96 include diagnosis, prevention and treatment of diseases and clinical conditions associated with LOC349351.

LOC63928 (Accession NP_071380.1) is another GAM96 target gene, herein designated TARGET GENE. LOC63928 BINDING SITE is a target binding site found in the 3' untranslated region of mRNA encoded by LOC63928, corresponding to a target binding site such as BINDING SITE I, BINDING SITE II or BINDING SITE III of FIG. 8. Table 4 illustrates the complementarity of the nucleotide sequences of LOC63928 BINDING SITE, designated SEQ ID:7473, to the nucleotide sequence of GAM96 RNA, herein designated GAM RNA, also designated SEQ ID:394.

Another function of GAM96 is therefore inhibition of LOC63928 (Accession NP_071380.1). Accordingly, utilities of GAM96 include diagnosis, prevention and treatment of diseases and clinical conditions associated with LOC63928.

LOC90906 (Accession XP_034809.1) is another GAM96 target gene, herein designated TARGET GENE. LOC90906 BINDING SITE is a target binding site found in the 5' untranslated region of mRNA encoded by LOC90906, corresponding to a target binding site such as BINDING SITE I, BINDING SITE II or BINDING SITE III of FIG. 8. Table 4 illustrates the complementarity of the nucleotide sequences of LOC90906 BINDING SITE, designated SEQ ID:5553, to the nucleotide sequence of GAM96 RNA, herein designated GAM RNA, also designated SEQ ID:394.

Another function of GAM96 is therefore inhibition of LOC90906 (Accession XP_034809.1). Accordingly, utilities of GAM96 include diagnosis, prevention and treatment of diseases and clinical conditions associated with LOC90906.

LOC91266 (Accession XP_037268.1) is another GAM96 target gene, herein designated TARGET GENE. LOC91266 BINDING SITE is a target binding site found in the 5' untranslated region of mRNA encoded by LOC91266, corresponding to a target binding site such as BINDING SITE I, BINDING SITE II or BINDING SITE III of FIG. 8. Table 4 illustrates the complementarity of the nucleotide sequences of LOC91266 BINDING SITE, designated SEQ ID:4369, to the nucleotide sequence of GAM96 RNA, herein designated GAM RNA, also designated SEQ ID:394.

Another function of GAM96 is therefore inhibition of LOC91266 (Accession XP_037268.1). Accordingly, utilities of GAM96 include diagnosis, prevention and treatment of diseases and clinical conditions associated with LOC91266.

LOC92230 (Accession XP_043733.1) is another GAM96 target gene, herein designated TARGET GENE. LOC92230 BINDING SITE is a target binding site found in the 5' untranslated region of mRNA encoded by LOC92230, corresponding to a target binding site such as BINDING SITE I, BINDING SITE II or BINDING SITE III of FIG. 8. Table 4 illustrates the complementarity of the nucleotide sequences of LOC92230 BINDING SITE, designated SEQ ID:18989, to the nucleotide sequence of GAM96 RNA, herein designated GAM RNA, also designated SEQ ID:394.

Another function of GAM96 is therefore inhibition of LOC92230 (Accession XP_043733.1). Accordingly, utilities of GAM96 include diagnosis, prevention and treatment of diseases and clinical conditions associated with LOC92230.

Microtubule-associated protein 6 (MAP6, Accession XP_166256.1) is another GAM96 target gene, herein designated TARGET GENE. MAP6 BINDING SITE is a target binding site found in the 3' untranslated region of mRNA encoded by MAP6, corresponding to a target binding site such as BINDING SITE I, BINDING SITE II or BINDING SITE III of FIG. 8. Table 4 illustrates the complementarity of the nucleotide sequences of MAP6 BINDING SITE, designated SEQ ID:11998, to the nucleotide sequence of GAM96 RNA, herein designated GAM RNA, also designated SEQ ID:394.

Another function of GAM96 is therefore inhibition of Microtubule-associated protein 6 (MAP6, Accession XP_166256.1). Accordingly, utilities of GAM96 include diagnosis, prevention and treatment of diseases and clinical conditions associated with MAP6.

Max gene associated (MGA, Accession XP_031689.3) is another GAM96 target gene, herein designated TARGET GENE. MGA BINDING SITE is a target binding site found in the 3' untranslated region of mRNA encoded by MGA, corresponding to a target binding site such as BINDING SITE I, BINDING SITE II or BINDING SITE III of FIG. 8. Table 4 illustrates the complementarity of the nucleotide sequences of MGA BINDING SITE, designated SEQ ID:2236, to the nucleotide sequence of GAM96 RNA, herein designated GAM RNA, also designated SEQ ID:394.

Another function of GAM96 is therefore inhibition of Max gene associated (MGA, Accession XP_031689.3), a gene which plays a role in the final steps of digestion of starch. Accordingly, utilities of GAM96 include diagnosis, prevention and treatment of diseases and clinical conditions associated with MGA.

The function of MGA and its association with various diseases and clinical conditions, has been established by previous studies, as described hereinabove with reference to GAM47.1. MGC10233 (Accession NP_689928.1) is another GAM96 target gene, herein designated TARGET GENE. MGC10233 BINDING SITE is a target binding site found in the 3' untranslated region of mRNA encoded by MGC10233, corresponding to a target binding site such as BINDING SITE I, BINDING SITE II or BINDING SITE III of FIG. 8. Table 4 illustrates the complementarity of the nucleotide sequences of MGC10233 BINDING SITE, designated SEQ ID:12991, to the nucleotide sequence of GAM96 RNA, herein designated GAM RNA, also designated SEQ ID:394.

Another function of GAM96 is therefore inhibition of MGC10233 (Accession NP_689928.1). Accordingly, utilities of GAM96 include diagnosis, prevention and treatment of diseases and clinical conditions associated with MGC10233.

MGC10812 (Accession NP_113613.1) is another GAM96 target gene, herein designated TARGET GENE. MGC10812 BINDING SITE is a target binding site found in the 3' untranslated region of mRNA encoded by MGC10812, corresponding to a target binding site such as BINDING SITE I, BINDING SITE II or BINDING SITE III of FIG. 8. Table 4 illustrates the complementarity of the nucleotide sequences of MGC10812 BINDING SITE, designated SEQ ID:3998, to the nucleotide sequence of GAM96 RNA, herein designated GAM RNA, also designated SEQ ID:394.

Another function of GAM96 is therefore inhibition of MGC10812 (Accession NP_113613.1). Accordingly, utilities of GAM96 include diagnosis, prevention and treatment of diseases and clinical conditions associated with MGC10812.

MGC13125 (Accession NP_116114.1) is another GAM96 target gene, herein designated TARGET GENE. MGC13125 BINDING SITE is a target binding site found in the 3' untranslated region of mRNA encoded by MGC13125, corresponding to a target binding site such as BINDING SITE I, BINDING SITE II or BINDING SITE III of FIG. 8. Table 4 illustrates the complementarity of the nucleotide sequences of MGC13125 BINDING SITE, designated SEQ ID:5483, to the nucleotide sequence of GAM96 RNA, herein designated GAM RNA, also designated SEQ ID:394.

Another function of GAM96 is therefore inhibition of MGC13125 (Accession NP_116114.1). Accordingly, utilities of GAM96 include diagnosis, prevention and treatment of diseases and clinical conditions associated with MGC13125.

MGC2474 (Accession NP_076420.1) is another GAM96 target gene, herein designated TARGET GENE. MGC2474 BINDING SITE is a target binding site found in the 5' untranslated region of mRNA encoded by MGC2474, corresponding to a target binding site such as BINDING SITE I, BINDING SITE II or BINDING SITE III of FIG. 8. Table 4 illustrates the complementarity of the nucleotide sequences of MGC2474 BINDING SITE, designated SEQ ID:17757, to the nucleotide sequence of GAM96 RNA, herein designated GAM RNA, also designated SEQ ID:394.

Another function of GAM96 is therefore inhibition of MGC2474 (Accession NP_076420.1). Accordingly, utilities of GAM96 include diagnosis, prevention and treatment of diseases and clinical conditions associated with MGC2474.

MGC26733 (Accession NP_659429.2) is another GAM96 target gene, herein designated TARGET GENE. MGC26733 BINDING SITE is a target binding site found in the 5' untranslated region of mRNA encoded by MGC26733, corresponding to a target binding site such as BINDING SITE I, BINDING SITE II or BINDING SITE III of FIG. 8. Table 4 illustrates the complementarity of the nucleotide sequences of MGC26733 BINDING SITE, designated SEQ ID:18016, to the nucleotide sequence of GAM96 RNA, herein designated GAM RNA, also designated SEQ ID:394.

Another function of GAM96 is therefore inhibition of MGC26733 (Accession NP_659429.2). Accordingly, utilities of GAM96 include diagnosis, prevention and treatment of diseases and clinical conditions associated with MGC26733.

MGC2749 (Accession NP_076974.1) is another GAM96 target gene, herein designated TARGET GENE. MGC2749 BINDING SITE is a target binding site found in the 3' untranslated region of mRNA encoded by MGC2749, corresponding to a target binding site such as BINDING SITE I, BINDING SITE II or BINDING SITE III of FIG. 8. Table 4 illustrates the complementarity of the nucleotide sequences of MGC2749 BINDING SITE, designated SEQ ID:680, to the nucleotide sequence of GAM96 RNA, herein designated GAM RNA, also designated SEQ ID:394.

Another function of GAM96 is therefore inhibition of MGC2749 (Accession NP_076974.1). Accordingly, utilities of GAM96 include diagnosis, prevention and treatment of diseases and clinical conditions associated with MGC2749.

MGC3222 (Accession NP_077310.1) is another GAM96 target gene, herein designated TARGET GENE. MGC3222 BINDING SITE is a target binding site found in the 3' untranslated region of mRNA encoded by MGC3222, corresponding to a target binding site such as BINDING SITE I, BINDING SITE II or BINDING SITE III of FIG. 8. Table 4 illustrates the complementarity of the nucleotide sequences of MGC3222 BINDING SITE, designated SEQ ID:11500, to the nucleotide sequence of GAM96 RNA, herein designated GAM RNA, also designated SEQ ID:394.

Another function of GAM96 is therefore inhibition of MGC3222 (Accession NP_077310.1). Accordingly, utilities of GAM96 include diagnosis, prevention and treatment of diseases and clinical conditions associated with MGC3222.

MGC34680 (Accession NP_689559.1) is another GAM96 target gene, herein designated TARGET GENE. MGC34680 BINDING SITE is a target binding site found in the 3' untranslated region of mRNA encoded by MGC34680, corresponding to a target binding site such as BINDING SITE I, BINDING SITE II or BINDING SITE III of FIG. 8. Table 4 illustrates the complementarity of the nucleotide sequences of MGC34680 BINDING SITE, designated SEQ ID:1068, to the nucleotide sequence of GAM96 RNA, herein designated GAM RNA, also designated SEQ ID:394.

Another function of GAM96 is therefore inhibition of MGC34680 (Accession NP_689559.1). Accordingly, utilities of GAM96 include diagnosis, prevention and treatment of diseases and clinical conditions associated with MGC34680.

MGC34695 (Accession NP_775826.1) is another GAM96 target gene, herein designated TARGET GENE. MGC34695 BINDING SITE is a target binding site found in the 3' untranslated region of mRNA encoded by MGC34695, corresponding to a target binding site such as BINDING SITE I, BINDING SITE II or BINDING SITE III of FIG. 8. Table 4 illustrates the complementarity of the nucleotide sequences of MGC34695 BINDING SITE, designated SEQ ID:14230, to the nucleotide sequence of GAM96 RNA, herein designated GAM RNA, also designated SEQ ID:394.

Another function of GAM96 is therefore inhibition of MGC34695 (Accession NP_775826.1). Accordingly, utilities of GAM96 include diagnosis, prevention and treatment of diseases and clinical conditions associated with MGC34695.

MGC35206 (Accession NP_848647.1) is another GAM96 target gene, herein designated TARGET GENE. MGC35206 BINDING SITE is a target binding site found in the 5' untranslated region of mRNA encoded by MGC35206, corresponding to a target binding site such as BINDING SITE I, BINDING SITE II or BINDING SITE III of FIG. 8. Table 4 illustrates the complementarity of the nucleotide sequences of MGC35206 BINDING SITE, designated SEQ ID:4448, to the nucleotide sequence of GAM96 RNA, herein designated GAM RNA, also designated SEQ ID:394.

Another function of GAM96 is therefore inhibition of MGC35206 (Accession NP_848647.1). Accordingly, utilities of GAM96 include diagnosis, prevention and treatment of diseases and clinical conditions associated with MGC35206.

MGC42530 (Accession NP_775841.1) is another GAM96 target gene, herein designated TARGET GENE. MGC42530 BINDING SITE is a target binding site found in the 3' untranslated region of mRNA encoded by MGC42530, corresponding to a target binding site such as BINDING SITE I, BINDING SITE II or BINDING SITE III of FIG. 8. Table 4 illustrates the complementarity of the nucleotide sequences of MGC42530 BINDING SITE, designated SEQ ID:12415, to the nucleotide sequence of GAM96 RNA, herein designated GAM RNA, also designated SEQ ID:394.

Another function of GAM96 is therefore inhibition of MGC42530 (Accession NP_775841.1). Accordingly, utilities of GAM96 include diagnosis, prevention and treatment of diseases and clinical conditions associated with MGC42530.

MGC4734 (Accession NP_659488.1) is another GAM96 target gene, herein designated TARGET GENE. MGC4734 BINDING SITE is a target binding site found in the 3' untranslated region of mRNA encoded by MGC4734, corresponding to a target binding site such as BINDING SITE I, BINDING SITE II or BINDING SITE III of FIG. 8. Table 4 illustrates the complementarity of the nucleotide sequences of MGC4734 BINDING SITE, designated SEQ ID:12722, to the nucleotide sequence of GAM96 RNA, herein designated GAM RNA, also designated SEQ ID:394.

Another function of GAM96 is therefore inhibition of MGC4734 (Accession NP_659488.1). Accordingly, utilities of GAM96 include diagnosis, prevention and treatment of diseases and clinical conditions associated with MGC4734.

MGC5508 (Accession NP_076997.1) is another GAM96 target gene, herein designated TARGET GENE. MGC5508 BINDING SITE is a target binding site found in the 3' untranslated region of mRNA encoded by MGC5508, corresponding to a target binding site such as BINDING SITE I, BINDING SITE II or BINDING SITE III of FIG. 8. Table 4 illustrates the complementarity of the nucleotide sequences of MGC5508 BINDING SITE, designated SEQ ID:15558, to the nucleotide sequence of GAM96 RNA, herein designated GAM RNA, also designated SEQ ID:394.

Another function of GAM96 is therefore inhibition of MGC5508 (Accession NP_076997.1). Accordingly, utilities of GAM96 include diagnosis, prevention and treatment of diseases and clinical conditions associated with MGC5508.

Myeloid/lymphoid or mixed-lineage leukemia (trithorax homolog, drosophila); translocated to, 2 (MLLT2, Accession NP_005926.1) is another GAM96 target gene, herein designated TARGET GENE. MLLT2 BINDING SITE is a target binding site found in the 3' untranslated region of mRNA encoded by MLLT2, corresponding to a target binding site such as BINDING SITE I, BINDING SITE II or BINDING SITE III of FIG. 8. Table 4 illustrates the complementarity of the nucleotide sequences of MLLT2 BINDING SITE, designated SEQ ID:15646, to the nucleotide sequence of GAM96 RNA, herein designated GAM RNA, also designated SEQ ID:394.

Another function of GAM96 is therefore inhibition of Myeloid/lymphoid or mixed-lineage leukemia (trithorax homolog, drosophila); translocated to, 2 (MLLT2, Accession NP_005926.1), a gene which is a Putative transcription factor. and therefore is associated with Acute leukemias. Accordingly, utilities of GAM96 include diagnosis, prevention and treatment of Acute leukemias, and of other diseases and clinical conditions associated with MLLT2.

The function of MLLT2 has been established by previous studies. Nakamura et al. (1993) found that the gene on chromosome 4q21 that is fused with the ALL1 gene in patients with acute lymphoblastic leukemia and translocation t(4;11) (q21;q23) and the gene on chromosome 9 that is fused with the ALL1 gene on chromosome 11 in patients with leukemia and the t(9;11)(p22;q23) show high sequence homology with the ENL gene on chromosome 19 which is fused to the ALL1 gene in patients with leukemia and the translocation t(11;19) (q23;p13). They found further that the protein products of the AF4, AF9 (MLLT3), and ENL (MLLT1) genes contained nuclear targeting sequences as well as serine-rich and proline-rich regions. Stretches abundant in basic amino acids were also present in the 3 proteins. These results indicated that the different proteins fused to ALL1 polypeptides in leukemia provide similar functional domains. Uckun et al. (1998) analyzed bone marrow leukemic cells of 17 infants and 127 children with newly diagnosed acute lymphatic leukemia (ALL), as well as fetal liver and bone marrow and normal infant bone marrow samples for the presence of a t(4;11) translocation, using standard cytogenetic techniques and expression of an MLL-AF4 fusion transcript by standard RT-PCR assays as well as nested RT-PCR that is 100-fold more sensitive than the standard RT-PCR. Overall, 9 of the 17 infants and 17 of 127 noninfant pediatric ALL patients were positive for expression of MLL-AF4 fusion transcripts. None of the MLL-AF4(+) cases were positive for E2A-PBX1 (147141; 176310) or BCR-ABL (151410; 189980) fusion transcript expression. Although 8 of 9 MLL-AF4(+) infants had cytogenetically detectable t(4;11) translocation, 15 of the 17 MLL-AF4(+) noninfants were t(4;11) negative. Infants with MLL-AF4(+) ALL had poor outcomes, whereas noninfant fusion-gene-positive, translocation-negative patients has favorable outcomes similar to MLL-AF4(-) patients. Notably, MLL-AF4 transcripts also were detected by nested RT-PCR in 4 of 16 fetal bone marrows, 5 of 13 fetal livers, and 1 of 6 normal infant bone marrows, but not in any of the 44 remission bone marrow specimens from pediatric ALL patients. These results represented unprecedented evidence that MLL-AF4 fusion transcripts can be present in normal hematopoietic cells, indicating that their expression is insufficient for leukemic transformation of normal lymphocyte precursors.

Full details of the abovementioned studies are described in the following publications, the disclosure of which are hereby incorporated by reference:

Nakamura, T.; Alder, H.; Gu, Y.; Prasad, R.; Canaani, O.; Kamada, N.; Gale, R. P.; Lange, B.; Crist, W. M.; Nowell, P. C.; Croce, C. M.; Canaani, E.: Genes on chromosomes 4, 9, and 19 involved in 11q23 abnormalities in acute leukemia share sequence homology and/or common motifs. Proc. Nat. Acad. Sci. 90:4631-4635, 1993; and Uckun, F. M.; Herman-Hatten, K.; Crotty, M.-L.; Sensel, M. G.; Sather, H. N.; Tuel- Ahlgren, L.; Sarquis, M. B.; Bostrom, B.; Nachman, J. B.; Steinherz, P. G.; Gaynon, P. S.; Heerema, N.

Further studies establishing the function and utilities of MLLT2 are found in John Hopkins OMIM database record ID 159557, and in cited publications listed in Table 5, which are hereby incorporated by reference. MLR2 (Accession XP_050988.1) is another GAM96 target gene, herein designated TARGET GENE. MLR2 BINDING SITE is a target binding site found in the 3' untranslated region of mRNA encoded by MLR2, corresponding to a target binding site such as BINDING SITE I, BINDING SITE II or BINDING SITE III of FIG. 8. Table 4 illustrates the complementarity of the nucleotide sequences of MLR2 BINDING SITE, designated SEQ ID:18894, to the nucleotide sequence of GAM96 RNA, herein designated GAM RNA, also designated SEQ ID:394.

Another function of GAM96 is therefore inhibition of MLR2 (Accession XP_050988.1). Accordingly, utilities of GAM96 include diagnosis, prevention and treatment of diseases and clinical conditions associated with MLR2.

Mitochondrial ribosomal protein s12 (MRPS12, Accession NP_203527.1) is another GAM96 target gene, herein designated TARGET GENE. MRPS12 BINDING SITE is a target binding site found in the 5' untranslated region of multiple transcripts of mRNA encoded by MRPS12, corresponding to a target binding site such as BINDING SITE I, BINDING SITE II or BINDING SITE III of FIG. 8. Table 4 illustrates the complementarity of the nucleotide sequences of MRPS12 BINDING SITE, designated SEQ ID:9214, to the nucleotide sequence of GAM96 RNA, herein designated GAM RNA, also designated SEQ ID:394.

Another function of GAM96 is therefore inhibition of Mitochondrial ribosomal protein s12 (MRPS12, Accession NP_203527.1), a gene which is a component of the mitochondrial ribosome. Accordingly, utilities of GAM96 include diagnosis, prevention and treatment of diseases and clinical conditions associated with MRPS12.

The function of MRPS12 has been established by previous studies. accuracy center. To characterize human nuclear genes encoding components of the mitochondrial gene expression machinery, Shah et al. (1998) searched an expressed sequence tag (EST) database with the amino acid sequence of E. coli rpsL. They isolated over 30 ESTs comprising a single contig in both human and mouse, and they stated that this indicates RPMS12 is likely a single-copy gene in the genomes of these mammals. The RPMS12 protein has an N-terminal extension containing basic and hydroxyl-group amino acids, consistent with a role for RPMS12 in mitochondrial targeting. Johnson et al. (1998) cloned the gene encoding human mitochondrial ribosomal protein S12 based on its homology to the Drosophila tko gene. They found that the gene stretches over 1.7 kb of genomic DNA. The mRNA showed 3 distinct patterns of splicing within the 5-prime untranslated region, with 1 form predominant over the other 2, in all human tissues examined. The coding region of the leader sequence is interrupted in codon 17 by a second intron of 990 bp. The predicted protein is translated as a prepeptide of 138 amino acids and processed to a peptide of 112 amino acids with a molecular mass of 12.3 kD. The authors pointed out that the functional role of RPMS12 makes it a candidate gene for susceptibility to aminoglycoside ototoxicity (OMIM Ref. No. 580000), which in some cases is demonstrably due to mutation in the mitochondrial gene encoding mitochondrial ribosomal RNA 12S, MTRNR1 (OMIM Ref. No. 561000).

Full details of the abovementioned studies are described in the following publications, the disclosure of which are hereby incorporated by reference:

Johnson, D. F.; Hamon, M.; Fischel-Ghodsian, N.: Characterization of the human mitochondrial ribosomal S12 gene. Genomics 52:363-368, 1998; and Shah, Z. H.; Migliosi, V.; Miller, S. C. M.; Wang, A.; Friedman, T. B.; Jacobs, H. T.: Chromosomal locations of three human nuclear genes (RPSM12, TUFM, and AFG3L1) specifying putative.

Further studies establishing the function and utilities of MRPS12 are found in John Hopkins OMIM database record ID 603021, and in cited publications listed in Table 5, which are hereby incorporated by reference. Mitochondrial ribosomal protein s12 (MRPS12, Accession NP_066930.1) is another GAM96 target gene, herein designated TARGET GENE. MRPS12 BINDING SITE is a target binding site found in the 5' untranslated region of multiple transcripts of mRNA encoded by MRPS12, corresponding to a target binding site such as BINDING SITE I, BINDING SITE II or BINDING SITE III of FIG. 8. Table 4 illustrates the complementarity of the nucleotide sequences of MRPS12 BINDING SITE, designated SEQ ID:9214, to the nucleotide sequence of GAM96 RNA, herein designated GAM RNA, also designated SEQ ID:394.

Another function of GAM96 is therefore inhibition of Mitochondrial ribosomal protein s12 (MRPS12, Accession NP_066930.1), a gene which is a component of the mitochondrial ribosome. Accordingly, utilities of GAM96 include diagnosis, prevention and treatment of diseases and clinical conditions associated with MRPS12.

The function of MRPS12 has been established by previous studies. accuracy center. To characterize human nuclear genes encoding components of the mitochondrial gene expression machinery, Shah et al. (1998) searched an expressed sequence tag (EST) database with the amino acid sequence of E. coli rpsL. They isolated over 30 ESTs comprising a single contig in both human and mouse, and they stated that this indicates RPMS12 is likely a single-copy gene in the genomes of these mammals. The RPMS12 protein has an N-terminal extension containing basic and hydroxyl-group amino acids, consistent with a role for RPMS12 in mitochondrial targeting. Johnson et al. (1998) cloned the gene encoding human mitochondrial ribosomal protein S12 based on its homology to the Drosophila tko gene. They found that the gene stretches over 1.7 kb of genomic DNA. The mRNA showed 3 distinct patterns of splicing within the 5-prime untranslated region, with 1 form predominant over the other 2, in all human tissues examined. The coding region of the leader sequence is interrupted in codon 17 by a second intron of 990 bp. The predicted protein is translated as a prepeptide of 138 amino acids and processed to a peptide of 112 amino acids with a molecular mass of 12.3 kD. The authors pointed out that the functional role of RPMS12 makes it a candidate gene for susceptibility to aminoglycoside ototoxicity (OMIM Ref. No. 580000), which in some cases is demonstrably due to mutation in the mitochondrial gene encoding mitochondrial ribosomal RNA 12S, MTRNR1 (OMIM Ref. No. 561000).

Full details of the abovementioned studies are described in the following publications, the disclosure of which are hereby incorporated by reference:

Johnson, D. F.; Hamon, M.; Fischel-Ghodsian, N.: Characterization of the human mitochondrial ribosomal S12 gene. Genomics 52:363-368, 1998; and Shah, Z. H.; Migliosi, V.; Miller, S. C. M.; Wang, A.; Friedman, T. B.; Jacobs, H. T.: Chromosomal locations of three human nuclear genes (RPSM12, TUFM, and AFG3L1) specifying putative.

Further studies establishing the function and utilities of MRPS12 are found in John Hopkins OMIM database record ID 603021, and in cited publications listed in Table 5, which are hereby incorporated by reference. Musculin (activated b-cell factor-1) (MSC, Accession NP_005089.1) is another GAM96 target gene, herein designated TARGET GENE. MSC BINDING SITE is a target binding site found in the 3' untranslated region of mRNA encoded by MSC, corresponding to a target binding site such as BINDING SITE I, BINDING SITE II or BINDING SITE III of FIG. 8. Table 4 illustrates the complementarity of the nucleotide sequences of MSC BINDING SITE, designated SEQ ID:2216, to the nucleotide sequence of GAM96 RNA, herein designated GAM RNA, also designated SEQ ID:394.

Another function of GAM96 is therefore inhibition of Musculin (activated b-cell factor-1) (MSC, Accession NP_005089.1). Accordingly, utilities of GAM96 include diagnosis, prevention and treatment of diseases and clinical conditions associated with MSC.

N-acetyltransferase 5 (ard1 homolog, s. cerevisiae) (NAT5, Accession NP_852668.1) is another GAM96 target gene, herein designated TARGET GENE. NAT5 BINDING SITE is a target binding site found in the 3' untranslated region of multiple transcripts of mRNA encoded by NAT5, corresponding to a target binding site such as BINDING SITE I, BINDING SITE II or BINDING SITE III of FIG. 8. Table 4 illustrates the complementarity of the nucleotide sequences of NAT5 BINDING SITE, designated SEQ ID:13542, to the nucleotide sequence of GAM96 RNA, herein designated GAM RNA, also designated SEQ ID:394.

Another function of GAM96 is therefore inhibition of N-acetyltransferase 5 (ard1 homolog, s. cerevisiae) (NAT5, Accession NP_852668.1). Accordingly, utilities of GAM96 include diagnosis, prevention and treatment of diseases and clinical conditions associated with NAT5.

N-acetyltransferase 5 (ard1 homolog, s. cerevisiae) (NAT5, Accession NP_057184.1) is another GAM96 target gene, herein designated TARGET GENE. NAT5 BINDING SITE is a target binding site found in the 3' untranslated region of multiple transcripts of mRNA encoded by NAT5, corresponding to a target binding site such as BINDING SITE I, BINDING SITE II or BINDING SITE III of FIG. 8. Table 4 illustrates the complementarity of the nucleotide sequences of NAT5 BINDING SITE, designated SEQ ID:13542, to the nucleotide sequence of GAM96 RNA, herein designated GAM RNA, also designated SEQ ID:394.

Another function of GAM96 is therefore inhibition of N-acetyltransferase 5 (ard1 homolog, s. cerevisiae) (NAT5, Accession NP_057184.1). Accordingly, utilities of GAM96 include diagnosis, prevention and treatment of diseases and clinical conditions associated with NAT5.

N-acetyltransferase 5 (ard1 homolog, s. cerevisiae) (NAT5, Accession NP_852669.1) is another GAM96 target gene, herein designated TARGET GENE. NAT5 BINDING SITE is a target binding site found in the 3' untranslated region of multiple transcripts of mRNA encoded by NAT5, corresponding to a target binding site such as BINDING SITE I, BINDING SITE II or BINDING SITE III of FIG. 8. Table 4 illustrates the complementarity of the nucleotide sequences of NAT5 BINDING SITE, designated SEQ ID:13542, to the nucleotide sequence of GAM96 RNA, herein designated GAM RNA, also designated SEQ ID:394.

Another function of GAM96 is therefore inhibition of N-acetyltransferase 5 (ard1 homolog, s. cerevisiae) (NAT5, Accession NP_852669.1). Accordingly, utilities of GAM96 include diagnosis, prevention and treatment of diseases and clinical conditions associated with NAT5.

Nadph oxidase 1 (NOX1, Accession NP_008983.1) is another GAM96 target gene, herein designated TARGET GENE. NOX1 BINDING SITE is a target binding site found in the 5' untranslated region of multiple transcripts of mRNA encoded by NOX1, corresponding to a target binding site such as BINDING SITE I, BINDING SITE II or BINDING SITE III of FIG. 8. Table 4 illustrates the complementarity of the nucleotide sequences of NOX1 BINDING SITE, designated SEQ ID:13865, to the nucleotide sequence of GAM96 RNA, herein designated GAM RNA, also designated SEQ ID:394.

Another function of GAM96 is therefore inhibition of Nadph oxidase 1 (NOX1, Accession NP_008983.1), a gene which mediates the h+ currents of resting phagocytes and other tissues. Accordingly, utilities of GAM96 include diagnosis, prevention and treatment of diseases and clinical conditions associated with NOX1.

The function of NOX1 has been established by previous studies. Voltage-gated proton (hydrogen) channels play an important role in cellular defense against acidic stress. They are unique among ion channels with respect to their extremely high selectivity, marked temperature dependence, and unitary conductance, which is 3 orders of magnitude lower than that of most other ion channels. Starace et al. (1997) demonstrated that arginine- to - histidine mutations were sufficient to turn the voltage sensor of the Shaker K+ channel (see OMIM Ref. No. 176260) into a voltage-gated H+ conductance. The critical residues are reminiscent of a motif within the predicted third transmembrane domain of gp91-phox, the electron-transporting subunit of the phagocyte NADPH oxidase encoded by the CYBB gene (OMIM Ref. No. 306400). When NOH1S was stably expressed in HEK293 cells by Banfi et al. (2000), it generated voltage-dependent, outward H+ currents. The currents activated slowly upon depolarization, and several seconds were required to elicit maximal amplitude, as expected for voltage-dependent H+ currents of epithelial cells and phagocytes. The NOH1S currents were reversibly blocked by zinc, a known H+ channel inhibitor. Banfi et al. (2000) argued that the fact that NOH1S does not contain an electron transport chain suggests that H+ conductance is its main physiologic function, whereas flavocytochromes such as NOH1L or gp91-phox might conduct H+ ions as part of their electron transport mechanism.

Full details of the abovementioned studies are described in the following publications, the disclosure of which are hereby incorporated by reference:

Banfi, B.; Maturana, A.; Jaconi, S.; Arnaudeau, S.; Laforge, T.; Sinha, S.; Ligeti, E.; Demaurex, N.; Krause, K.-H.: A mammalian H+ channel generated through alternative splicing of the NADPH oxidase homolog NOH-1. Science 287:138-141, 2000; and Starace, D. M; Stefani, E.; Bezanilla, F.: Voltage-dependent proton transport by the voltage sensor of the Shaker K+ channel. Neuron 19:1319-1327, 1997.

Further studies establishing the function and utilities of NOX1 are found in John Hopkins OMIM database record ID 300225, and in cited publications listed in Table 5, which are hereby incorporated by reference. Neurotensin receptor 2 (NTSR2, Accession NP_036476.1) is another GAM96 target gene, herein designated TARGET GENE. NTSR2 BINDING SITE is a target binding site found in the 5' untranslated region of mRNA encoded by NTSR2, corresponding to a target binding site such as BINDING SITE I, BINDING SITE II or BINDING SITE III of FIG. 8. Table 4 illustrates the complementarity of the nucleotide sequences of NTSR2 BINDING SITE, designated SEQ ID:3637, to the nucleotide sequence of GAM96 RNA, herein designated GAM RNA, also designated SEQ ID:394.

Another function of GAM96 is therefore inhibition of Neurotensin receptor 2 (NTSR2, Accession NP_036476.1). Accordingly, utilities of GAM96 include diagnosis, prevention and treatment of diseases and clinical conditions associated with NTSR2.

2'-5'-oligoadenylate synthetase 3, 100 kda (OAS3, Accession NP_006178.1) is another GAM96 target gene, herein designated TARGET GENE. OAS3 BINDING SITE is a target binding site found in the 3' untranslated region of mRNA encoded by OAS3, corresponding to a target binding site such as BINDING SITE I, BINDING SITE II or BINDING SITE III of FIG. 8. Table 4 illustrates the complementarity of the nucleotide sequences of OAS3 BINDING SITE, designated SEQ ID:12448, to the nucleotide sequence of GAM96 RNA, herein designated GAM RNA, also designated SEQ ID:394.

Another function of GAM96 is therefore inhibition of 2'-5'-oligoadenylate synthetase 3, 100 kda (OAS3, Accession NP_006178.1), a gene which may play a role in mediating resistance to virus infection, control of cell growth, differentiation, and apoptosis. Accordingly, utilities of GAM96 include diagnosis, prevention and treatment of diseases and clinical conditions associated with OAS3.

The function of OAS3 and its association with various diseases and clinical conditions, has been established by previous studies, as described hereinabove with reference to GAM63.1. P15RS (Accession NP_060640.2) is another GAM96 target gene, herein designated TARGET GENE. P15RS BINDING SITE is a target binding site found in the 3' untranslated region of mRNA encoded by P15RS, corresponding to a target binding site such as BINDING SITE I, BINDING SITE II or BINDING SITE III of FIG. 8. Table 4 illustrates the complementarity of the nucleotide sequences of P15RS BINDING SITE, designated SEQ ID:11233, to the nucleotide sequence of GAM96 RNA, herein designated GAM RNA, also designated SEQ ID:394.

Another function of GAM96 is therefore inhibition of P15RS (Accession NP_060640.2). Accordingly, utilities of GAM96 include diagnosis, prevention and treatment of diseases and clinical conditions associated with P15RS.

Procollagen-proline, 2-oxoglutarate 4-dioxygenase (proline 4-hydroxylase), alpha polypeptide i (P4HA1, Accession NP_000908.1) is another GAM96 target gene, herein designated TARGET GENE. P4HA1 BINDING SITE is a target binding site found in the 3' untranslated region of mRNA encoded by P4HA1, corresponding to a target binding site such as BINDING SITE I, BINDING SITE II or BINDING SITE III of FIG. 8. Table 4 illustrates the complementarity of the nucleotide sequences of P4HA1 BINDING SITE, designated SEQ ID:3572, to the nucleotide sequence of GAM96 RNA, herein designated GAM RNA, also designated SEQ ID:394.

Another function of GAM96 is therefore inhibition of Procollagen-proline, 2-oxoglutarate 4-dioxygenase (proline 4-hydroxylase), alpha polypeptide i (P4HA1, Accession NP_000908.1), a gene which catalyzes the formation of 4-hydroxyproline in collagen. Accordingly, utilities of GAM96 include diagnosis, prevention and treatment of diseases and clinical conditions associated with P4HA1.

The function of P4HA1 has been established by previous studies. Prolyl 4-hydroxylase (EC 1.14.11.2) plays a central role in collagen synthesis. It catalyzes the formation of 4-hydroxyproline in collagens by hydroxylation of proline residues in peptide linkages. The 4-hydroxyproline residues are essential for the folding of the newly synthesized procollagen polypeptide chain into triple helical molecules. The active enzyme is a tetramer of 2 alpha and 2 beta subunits with a molecular weight of about 240,000. The beta subunit (P4HB; 176790) is identical to the enzyme disulfide isomerase (EC 5.3.4.1) and a major cellular thyroid-binding protein. The alpha subunit probably contributes a major part of the catalytic site of the enzyme. Helaakoski et al. (1989) isolated cDNA clones for the alpha subunit. They found that the clones encode a polypeptide of 517 amino acid residues and a signal peptide of 17 amino acids. Southern blot analyses of human genomic DNA with a cDNA probe for the alpha subunit suggested the presence of only 1 gene encoding 2 types of mRNA, which appear to result from mutually exclusive alternative splicing of primary transcripts of 1 gene. Helaakoski et al. (1994) reported that the P4HA gene covers more than 69 kilobases and consists of 16 exons. Evidence had previously been presented for a mutually exclusive alternative splicing of RNA transcripts of the gene. The present data indicated that the mutually exclusive sequences found in the mRNAs are coded by 2 consecutive, homologous 71-bp exons, 9 and 10. These exons are identical in their first 5 basepairs and the overall identity between them is 61% at the nucleotide level and 58% at the level of the coded amino acids. Both types of mRNA were found to be expressed in all of the tissues studied, but in some tissues the type coding for the exon 9 or exon 10 sequences was more abundant than the other type.

Full details of the abovementioned studies are described in the following publications, the disclosure of which are hereby incorporated by reference:

Helaakoski, T.; Vuori, K.; Myllyla, R.; Kivirikko, K. I.; Pihlajaniemi, T.: Molecular cloning of the alpha-subunit of human prolyl 4-hydroxylase: the complete cDNA- derived amino acid sequence and evidence for alternative splicing of RNA transcripts. Proc. Nat. Acad. Sci. 86:4392-4396, 1989; and Helaakoski, T.; Veijola, J.; Vuori, K.; Rehn, M.; Chow, L. T.; Taillon-Miller, P.; Kivirikko, K. I.; Pihlajaniemi, T.: Structure and expression of the human gene for the alpha subunit.

Further studies establishing the function and utilities of P4HA1 are found in John Hopkins OMIM database record ID 176710, and in cited publications listed in Table 5, which are hereby incorporated by reference. Poly(a) binding protein, cytoplasmic 1 (PABPC1, Accession NP_002559.1) is another GAM96 target gene, herein designated TARGET GENE. PABPC1 BINDING SITE is a target binding site found in the 3' untranslated region of mRNA encoded by PABPC1, corresponding to a target binding site such as BINDING SITE I, BINDING SITE II or BINDING SITE III of FIG. 8. Table 4 illustrates the complementarity of the nucleotide sequences of PABPC1 BINDING SITE, designated SEQ ID:18105, to the nucleotide sequence of GAM96 RNA, herein designated GAM RNA, also designated SEQ ID:394.

Another function of GAM96 is therefore inhibition of Poly (a) binding protein, cytoplasmic 1 (PABPC1, Accession NP_002559.1), a gene which involves in cytoplasmic regulatory processes of mRNA metabolism. Accordingly, utilities of GAM96 include diagnosis, prevention and treatment of diseases and clinical conditions associated with PABPC1.

The function of PABPC1 and its association with various diseases and clinical conditions, has been established by previous studies, as described hereinabove with reference to GAM66.2. Phosphoribosylaminoimidazole carboxylase, phosphoribosylaminoimidazole succinocarboxamide synthetase (PAICS, Accession NP_006443.1) is another GAM96 target gene, herein designated TARGET GENE. PAICS BINDING SITE is a target binding site found in the 3' untranslated region of mRNA encoded by PAICS, corresponding to a target binding site such as BINDING SITE I, BINDING SITE II or BINDING SITE III of FIG. 8. Table 4 illustrates the complementarity of the nucleotide sequences of PAICS BINDING SITE, designated SEQ ID:1992, to the nucleotide sequence of GAM96 RNA, herein designated GAM RNA, also designated SEQ ID:394.

Another function of GAM96 is therefore inhibition of Phosphoribosylaminoimidazole carboxylase, phosphoribosylaminoimidazole succinocarboxamide synthetase (PAICS, Accession NP_006443.1), a gene which is required for purine biosynthesis. Accordingly, utilities of GAM96 include diagnosis, prevention and treatment of diseases and clinical conditions associated with PAICS.

The function of PAICS has been established by previous studies. Schild et al. (1990) used the functional complementation of mutations in Saccharomyces cerevisiae to isolate a human cDNA clone complementing the ade-2 (phosphoribosylaminoimidazole carboxylase; EC 4.1.1.21) yeast mutation. The same cDNA also complemented ade-1 (phosphoribosylaminoimidazole succinocarboxamide synthetase; EC 6.3.2.6); thus, this is a bifunctional enzyme. Although these enzymes are encoded by genes on different chromosomes in yeast, their enzymatic activities copurify from chicken livers, and the complementation of both activities by this single cDNA clone suggests that the enzyme is bifunctional in humans. Barton et al. (1991) mapped the gene to chromosome 4 by fusing Chinese hamster ovary (CHO) cells carrying the Ade(-)D mutation with human lymphocytes using inactivated Sendai virus. Two of the isolated subclones contained only the long arm of human chromosome 4 translocated onto a CHO chromosome, thus providing evidence that the gene in question is on 4q. By subjecting 2 of the subclones containing chromosome 4 to BrdU visible light segregation, Barton et al. (1991) demonstrated that all of the isolated purine auxotrophic cell lines showed a loss of 4q. It is noteworthy that this bifunctional enzyme maps to the same general region as the monofunctional enzyme PPAT (OMIM Ref. No. 172450), which catalyzes the first step in the biosynthetic pathway for the production of AMP from phosphoribosylpyrophosphate (PRPP) and maps to 4pter-q21. AIR carboxylase (EC 4.1.1.21)/SAICAR synthetase (EC 6.3.2.6) is a bifunctional enzyme, the activities of which are required for steps 6 and 7, respectively, of purine biosynthesis. Brayton et al. (1994) demonstrated that in the human, as in the chicken, the GPAT gene (OMIM Ref. No. 172450), which catalyzes the first and presumably rate-limiting reaction in purine biosynthesis, is closely linked and divergently transcribed. The intergenic region is approximately 625 bp in the human and 229 bp in the chicken. Although there are several examples for bidirectional transcription in higher eukaryotes, GPAT-AIRC was the first example for bidirectional transcription of tightly coupled genes that are not structurally related but are involved in the same pathway. This may be a eukaryotic equivalent of a prokaryotic operon.

Full details of the abovementioned studies are described in the following publications, the disclosure of which are hereby incorporated by reference:

Schild, D.; Brake, A. J.; Kiefer, M. C.; Young, D.; Barr, P. J.: Cloning of three human multifunctional de novo purine biosynthetic genes by functional complementation of yeast mutations. Proc. Nat. Acad. Sci. 87:2916-2920, 1990; and Brayton, K. A.; Chen, Z.; Zhou, G.; Nagy, P. L.; Gavalas, A.; Trent, J. M.; Deaven, L. L.; Dixon, J. E.; Zalkin, H.: Two genes for de novo purine nucleotide synthesis on human chromosom.

Further studies establishing the function and utilities of PAICS are found in John Hopkins OMIM database record ID 172439, and in cited publications listed in Table 5, which are hereby incorporated by reference. Poly(rc) binding protein 4 (PCBP4, Accession NP_065151.1) is another GAM96 target gene, herein designated TARGET GENE. PCBP4 BINDING SITE is a target binding site found in the 3' untranslated region of multiple transcripts of mRNA encoded by PCBP4, corresponding to a target binding site such as BINDING SITE I, BINDING SITE II or BINDING SITE III of FIG. 8. Table 4 illustrates the complementarity of the nucleotide sequences of PCBP4 BINDING SITE, designated SEQ ID:2715, to the nucleotide sequence of GAM96 RNA, herein designated GAM RNA, also designated SEQ ID:394.

Another function of GAM96 is therefore inhibition of Poly (rc) binding protein 4 (PCBP4, Accession NP_065151.1). Accordingly, utilities of GAM96 include diagnosis, prevention and treatment of diseases and clinical conditions associated with PCBP4.

Poly(rc) binding protein 4 (PCBP4, Accession NP_127502.1) is another GAM96 target gene, herein designated TARGET GENE. PCBP4 BINDING SITE is a target binding site found in the 3' untranslated region of multiple transcripts of mRNA encoded by PCBP4, corresponding to a target binding site such as BINDING SITE I, BINDING SITE II or BINDING SITE III of FIG. 8. Table 4 illustrates the complementarity of the nucleotide sequences of PCBP4 BINDING SITE, designated SEQ ID:2715, to the nucleotide sequence of GAM96 RNA, herein designated GAM RNA, also designated SEQ ID:394.

Another function of GAM96 is therefore inhibition of Poly (rc) binding protein 4 (PCBP4, Accession NP_127502.1). Accordingly, utilities of GAM96 include diagnosis, prevention and treatment of diseases and clinical conditions associated with PCBP4.

Poly(rc) binding protein 4 (PCBP4, Accession NP_127501.1) is another GAM96 target gene, herein designated TARGET GENE. PCBP4 BINDING SITE is a target binding site found in the 3' untranslated region of multiple transcripts of mRNA encoded by PCBP4, corresponding to a target binding site such as BINDING SITE I, BINDING SITE II or BINDING SITE III of FIG. 8. Table 4 illustrates the complementarity of the nucleotide sequences of PCBP4 BINDING SITE, designated SEQ ID:2715, to the nucleotide sequence of GAM96 RNA, herein designated GAM RNA, also designated SEQ ID:394.

Another function of GAM96 is therefore inhibition of Poly (rc) binding protein 4 (PCBP4, Accession NP_127501.1). Accordingly, utilities of GAM96 include diagnosis, prevention and treatment of diseases and clinical conditions associated with PCBP4.

Poly(rc) binding protein 4 (PCBP4, Accession NP_127503.1) is another GAM96 target gene, herein designated TARGET GENE. PCBP4 BINDING SITE is a target binding site found in the 3' untranslated region of multiple transcripts of mRNA encoded by PCBP4, corresponding to a target binding site such as BINDING SITE I, BINDING SITE II or BINDING SITE III of FIG. 8. Table 4 illustrates the complementarity of the nucleotide sequences of PCBP4 BINDING SITE, designated SEQ ID:2715, to the nucleotide sequence of GAM96 RNA, herein designated GAM RNA, also designated SEQ ID:394.

Another function of GAM96 is therefore inhibition of Poly (rc) binding protein 4 (PCBP4, Accession NP_127503.1). Accordingly, utilities of GAM96 include diagnosis, prevention and treatment of diseases and clinical conditions associated with PCBP4.

Protocadherin alpha 9 (PCDHA9, Accession NP_054724.1) is another GAM96 target gene, herein designated TARGET GENE. PCDHA9 BINDING SITE is a target binding site found in the 3' untranslated region of multiple transcripts of mRNA encoded by PCDHA9, corresponding to a target binding site such as BINDING SITE I, BINDING SITE II or BINDING SITE III of FIG. 8. Table 4 illustrates the complementarity of the nucleotide sequences of PCDHA9 BINDING SITE, designated SEQ ID:7481, to the nucleotide sequence of GAM96 RNA, herein designated GAM RNA, also designated SEQ ID:394.

Another function of GAM96 is therefore inhibition of Protocadherin alpha 9 (PCDHA9, Accession NP_054724.1), a gene which is a calcium-dependent cell-adhesion protein. Accordingly, utilities of GAM96 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Pyruvate dehydrogenase kinase, isoenzyme 2 (PDK2, Accession NP_002602.2) is another GAM96 target gene, herein designated TARGET GENE. PDK2 BINDING SITE is a target binding site found in the 3' untranslated region of mRNA encoded by PDK2, corresponding to a target binding site such as BINDING SITE I, BINDING SITE II or BINDING SITE III of FIG. 8. Table 4 illustrates the complementarity of the nucleotide sequences of PDK2 BINDING SITE, designated SEQ ID:7892, to the nucleotide sequence of GAM96 RNA, herein designated GAM RNA, also designated SEQ ID:394.

Another function of GAM96 is therefore inhibition of Pyruvate dehydrogenase kinase, isoenzyme 2 (PDK2, Accession NP_002602.2). Accordingly, utilities of GAM96 include diagnosis, prevention and treatment of diseases and clinical conditions associated with PDK2.

Paternally expressed 10 (PEG10, Accession NP_055883.1) is another GAM96 target gene, herein designated TARGET GENE. PEG10 BINDING SITE is a target binding site found in the 3' untranslated region of mRNA encoded by PEG10, corresponding to a target binding site such as BINDING SITE I, BINDING SITE II or BINDING SITE III of FIG. 8. Table 4 illustrates the complementarity of the nucleotide sequences of PEG10 BINDING SITE, designated SEQ ID:11113, to the nucleotide sequence of GAM96 RNA, herein designated GAM RNA, also designated SEQ ID:394.

Another function of GAM96 is therefore inhibition of Paternally expressed 10 (PEG10, Accession NP_055883.1). Accordingly, utilities of GAM96 include diagnosis, prevention and treatment of diseases and clinical conditions associated with PEG10.

6-phosphofructo -2-kinase/fructose-2,6-biphosphatase 4 (PFKFB4, Accession NP_004558.1) is another GAM96 target gene, herein designated TARGET GENE. PFKFB4 BINDING SITE is a target binding site found in the 3' untranslated region of mRNA encoded by PFKFB4, corresponding to a target binding site such as BINDING SITE I, BINDING SITE II or BINDING SITE III of FIG. 8. Table 4 illustrates the complementarity of the nucleotide sequences of PFKFB4 BINDING SITE, designated SEQ ID:10430, to the nucleotide sequence of GAM96 RNA, herein designated GAM RNA, also designated SEQ ID:394.

Another function of GAM96 is therefore inhibition of 6-phosphofructo -2-kinase/fructose-2,6-biphosphatase 4 (PFKFB4, Accession NP_004558.1), a gene which catalyzes synthesis and degradation of fructose 2,6-bisphosphate. Accordingly, utilities of GAM96 include diagnosis, prevention and treatment of diseases and clinical conditions associated with PFKFB4.

The function of PFKFB4 and its association with various diseases and clinical conditions, has been established by previous studies, as described hereinabove with reference to GAM47.1. Polymeric immunoglobulin receptor (PIGR, Accession NP_002635.2) is another GAM96 target gene, herein designated TARGET GENE. PIGR BINDING SITE is a target binding site found in the 3' untranslated region of mRNA encoded by PIGR, corresponding to a target binding site such as BINDING SITE I, BINDING SITE II or BINDING SITE III of FIG. 8. Table 4 illustrates the complementarity of the nucleotide sequences of PIGR BINDING SITE, designated SEQ ID:20111, to the nucleotide sequence of GAM96 RNA, herein designated GAM RNA, also designated SEQ ID:394.

Another function of GAM96 is therefore inhibition of Polymeric immunoglobulin receptor (PIGR, Accession NP_002635.2). Accordingly, utilities of GAM96 include diagnosis, prevention and treatment of diseases and clinical conditions associated with PIGR.

Phosphatidylinositol-4-phosphate 5-kinase, type ii, beta (PIP5K2B, Accession NP_619632.1) is another GAM96 target gene, herein designated TARGET GENE. PIP5K2B BINDING SITE is a target binding site found in the 5' untranslated region of multiple transcripts of mRNA encoded by PIP5K2B, corresponding to a target binding site such as BINDING SITE I, BINDING SITE II or BINDING SITE III of FIG. 8. Table 4 illustrates the complementarity of the nucleotide sequences of PIP5K2B BINDING SITE, designated SEQ ID:18234, to the nucleotide sequence of GAM96 RNA, herein designated GAM RNA, also designated SEQ ID:394.

Another function of GAM96 is therefore inhibition of Phosphatidylinositol-4-phosphate 5-kinase, type ii, beta (PIP5K2B, Accession NP_619632.1). Accordingly, utilities of GAM96 include diagnosis, prevention and treatment of diseases and clinical conditions associated with PIP5K2B.

Phosphatidylinositol-4-phosphate 5-kinase, type ii, beta (PIP5K2B, Accession NP_003550.1) is another GAM96 target gene, herein designated TARGET GENE. PIP5K2B BINDING SITE is a target binding site found in the 5' untranslated region of multiple transcripts of mRNA encoded by PIP5K2B, corresponding to a target binding site such as BINDING SITE I, BINDING SITE II or BINDING SITE III of FIG. 8. Table 4 illustrates the complementarity of the nucleotide sequences of PIP5K2B BINDING SITE, designated SEQ ID:18234, to the nucleotide sequence of GAM96 RNA, herein designated GAM RNA, also designated SEQ ID:394.

Another function of GAM96 is therefore inhibition of Phosphatidylinositol-4-phosphate 5-kinase, type ii, beta (PIP5K2B, Accession NP_003550.1). Accordingly, utilities of GAM96 include diagnosis, prevention and treatment of diseases and clinical conditions associated with PIP5K2B.

Pbx/knotted 1 homeobox 1 (PKNOX1, Accession NP_004562.2) is another GAM96 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:12842, to the nucleotide sequence of GAM96 RNA, herein designated GAM RNA, also designated SEQ ID:394.

Another function of GAM96 is therefore inhibition of Pbx/knotted 1 homeobox 1 (PKNOX1, Accession NP_004562.2), a gene which may regulate gene expression and control cell differentiation. Accordingly, utilities of GAM96 include diagnosis, prevention and treatment of diseases and clinical conditions associated with PKNOX1.

The function of PKNOX1 and its association with various diseases and clinical conditions, has been established by previous studies, as described hereinabove with reference to GAM55.1. Phospholipase a2, group iva (cytosolic, calcium-dependent) (PLA2G4A, Accession NP_077734.1) is another GAM96 target gene, herein designated TARGET GENE. PLA2G4A BINDING SITE is a target binding site found in the 3' untranslated region of mRNA encoded by PLA2G4A, corresponding to a target binding site such as BINDING SITE I, BINDING SITE II or BINDING SITE III of FIG. 8. Table 4 illustrates the complementarity of the nucleotide sequences of PLA2G4A BINDING SITE, designated SEQ ID:11581, to the nucleotide sequence of GAM96 RNA, herein designated GAM RNA, also designated SEQ ID:394.

Another function of GAM96 is therefore inhibition of Phospholipase a2, group iva (cytosolic, calcium-dependent) (PLA2G4A, Accession NP_077734.1), a gene which catalyzes the release of arachidonic acid from membrane phospholipids. Accordingly, utilities of GAM96 include diagnosis, prevention and treatment of diseases and clinical conditions associated with PLA2G4A.

The function of PLA2G4A has been established by previous studies. Cytosolic phospholipase A2 (PLA2; EC 3.1.1.4) catalyzes the release of arachidonic acid from membrane phospholipids. Arachidonic acid in turn serves as precursor for a wide spectrum of biologic effectors, collectively known as eicosanoids, that are involved in hemodynamic regulation, inflammatory responses, and other cellular processes. Dennis (1994) reviewed various types of PLA2. The best characterized is the group II PLA2 originally isolated from human synovial fluid (i.e., PLA2G2A; 172411). Groups I (human pancreatic, PLA2G1B (OMIM Ref. No. 172410); also found in cobras and kraits), II (synovial; also found in rattlesnakes and vipers), and III (forms of which were described in bee and lizard) are secreted; group IV is cytosolic. Cytosolic phospholipase A2 described here (see OMIM Ref. No. GenBank AF065216) is distinct from the synovial phospholipase A2 (PLA2G2A; 172411); it has a large molecular weight; is DTT-insensitive; is activated at a nanomolar to micromolar calcium concentration range, which prevails in the cytosol; and is arachidonic acid-specific at the sn-2 position (Skorecki, 1995). PLA2B, the synovial phospholipase A2 described by Seilhamer et al. (1989), is a small molecular weight enzyme that is DTT-sensitive. PLA2B is secreted from cells, active in the micromolar to millimolar calcium concentration range that prevails in the extracellular medium, and active in inflammatory exudates. Sharp et al. (1991) amplified PLA2G4A by PCR with human U937 monoblast cells, using degenerate primers designed from the purified sequenced protein. They cloned PLA2G4 cDNA from a U937 library screened with the PCR product. The deduced 749-amino acid protein has a predicted molecular mass of 85 kD and contains several potential PKC and tyrosine kinase phosphorylation sites. Northern blot analysis detected an approximately 3-kb transcript in U937 cells. Western blot analysis of U937 cells revealed that PLA2G4 migrates with an apparent molecular mass of 100 kD. Tay et al. (1995) mapped the PLA2G4A gene to rat chromosome 13 by PCR-based intercross genotyping and to human 1q25 by fluorescence in situ hybridization. The gene encoding the enzyme prostaglandin-endoperoxide synthase-2, also known as cyclooxygenase-2 (PTGS2; 600262), had previously been mapped to the same chromosomal region, raising the possibility of coordinate regulation. PTGS2 is downstream of cytosolic phospholipase A2 in the biochemical pathway for eicosanoid production.

Full details of the abovementioned studies are described in the following publications, the disclosure of which are hereby incorporated by reference:

Dennis, E. A.: Diversity of group types, regulation, and function of phospholipase A2. J. Biol. Chem. 269:13057-13060, 1994; and Tay, A.; Simon, J. S.; Squire, J.; Hamel, K.; Jacob, H. J.; Skorecki, K.: Cytosolic phospholipase A2 gene in human and rat: chromosomal localization and polymorphic markers. Genomics 26.

Further studies establishing the function and utilities of PLA2G4A are found in John Hopkins OMIM database record ID 600522, and in cited publications listed in Table 5, which are hereby incorporated by reference. Pleiomorphic adenoma gene-like 1 (PLAGL1, Accession NP_006709.2) is another GAM96 target gene, herein designated TARGET GENE. PLAGL1 BINDING SITE is a target binding site found in the 5' untranslated region of multiple transcripts of mRNA encoded by PLAGL1, corresponding to a target binding site such as BINDING SITE I, BINDING SITE II or BINDING SITE III of FIG. 8. Table 4 illustrates the complementarity of the nucleotide sequences of PLAGL1 BINDING SITE, designated SEQ ID:15766, to the nucleotide sequence of GAM96 RNA, herein designated GAM RNA, also designated SEQ ID:394.

Another function of GAM96 is therefore inhibition of Pleiomorphic adenoma gene-like 1 (PLAGL1, Accession NP_006709.2), a gene which regulates apoptosis and cell cycle arrest. Accordingly, utilities of GAM96 include diagnosis, prevention and treatment of diseases and clinical conditions associated with PLAGL1.

The function of PLAGL1 has been established by previous studies. Cell proliferation is regulated through connected molecular pathways controlling cell division, differentiation, growth arrest, and apoptosis. A tight control of these events is necessary to the maintenance of homeostasis from development to senescence and involves multiple genes. Dysregulation of some of these genes can lead to pathologic situations such as neurodegenerative disorders, immunodeficiency syndromes, and cancer. Early studies on tumor development focused on oncogenes, the genes whose gain of function leads to enhanced cell growth. The inactivation of a tumor suppressor gene, in contrast, can contribute to the growth deregulation of a tumor cell. This tumor suppressor gene inactivation can occur through a loss-of-function mutation accompanied by a loss of heterozygosity, homozygous deletion, or epigenetic mechanisms. Several lines of evidence suggest a tumor suppressor function to a candidate gene: involvement in familial predisposition to cancer, inactivation in human tumors, tumor formation in null-mutant mice, and functional properties compatible with a role in cell proliferation or development. The candidates in which all of these criteria had been fulfilled include p53 (OMIM Ref. No. 191170), RB (OMIM Ref. No. 180200), p16 (OMIM Ref. No. 600160), and VHL (OMIM Ref. No. 193300). Spengler et al. (1997) isolated a novel mouse gene, designated Zac, which encodes a protein with 7 zinc fingers of the C2H2 type that is only distantly related to previously isolated zinc finger proteins and that inhibits tumor cell proliferation in vitro and in vivo in nude mice. They showed that these antiproliferative properties ensued from the regulation of 2 pathways critical to the activity of p53, i.e., cell cycle progression and apoptosis. Thus, mouse Zac was the first gene unrelated to p53 that was found to regulate these 2 fundamental genetic programs. The authors hypothesized that Zac also could share with p53 its tumor suppressor activity and isolated the human homolog of Zac to investigate its putative tumor suppressor function. They found that human ZAC is a widely expressed zinc finger protein that shows transactivation and DNA-binding activities. Furthermore, like its mouse counterpart and p53, ZAC inhibits tumor cell proliferation through the induction of both apoptosis and cell cycle arrest. Kamiya et al. (2000) described a screen for new imprinted human genes, and in this way identified the ZAC/PLAGL1 gene as a strong candidate for transient neonatal diabetes mellitus (TNDM; 601410). To screen for imprinted genes, they compared parthenogenetic DNA from a chimeric patient FD and androgenetic DNA from hydatidiform mole, using restriction landmark genome scanning for methylation. This resulted in identification of 2 novel imprinted loci, one of which (NV149) mapped to the TNDM region of 6q24. From analysis of the corresponding genomic region, it was determined that NV149 lies approximately 60 kb upstream of the ZAC/PLAGL1 gene. RT-PCR analysis was used to confirm that the ZAC/PLAGL1 gene is expressed only from the paternal allele in a variety of tissues. TNDM is known to result from upregulation of a paternally expressed gene on 6q24. Kamiya et al. (2000) pointed to the paternal expression, map position, and known biologic properties of ZAC/PLAGL1 as making it highly likely that it is the TNDM gene. In particular, ZAC/PLAGL1 is a transcriptional regulator of the type 1 receptor for pituitary adenylate cyclase-activating polypeptide (OMIM Ref. No. 102981), which is the most potent known insulin secretagogue and an important mediator of autocrine control of insulin secretion in the pancreatic islet.

Full details of the abovementioned studies are described in the following publications, the disclosure of which are hereby incorporated by reference:

Spengler, D.; Villalba, M.; Hoffmann, A.; Pantaloni, C.; Houssami, S.; Bockaert, J.; Journot, L.: Regulation of apoptosis and cell cycle arrest by Zac1, a novel zinc finger protein expressed in the pituitary gland and the brain. EMBO J. 16:2814-2825, 1997; and Kamiy, M.; Judson, H.; Okazaki, Y.; Kusakabe, M.; Muramatsu, M.; Takada, S.; Takagi, N.; Arima, T.; Wake, N.; Kamimura, K.; Satomura, K.; Hermann, R.; Bonthron, D. T.; Hayashizaki, Y..

Further studies establishing the function and utilities of PLAGL1 are found in John Hopkins OMIM database record ID 603044, and in cited publications listed in Table 5, which are hereby incorporated by reference. Proteolipid protein 1 (pelizaeus-merzbacher disease, spastic paraplegia 2, uncomplicated) (PLP1, Accession NP_000524.2) is another GAM96 target gene, herein designated TARGET GENE. PLP1 BINDING SITE is a target binding site found in the 3' untranslated region of mRNA encoded by PLP1, corresponding to a target binding site such as BINDING SITE I, BINDING SITE II or BINDING SITE III of FIG. 8. Table 4 illustrates the complementarity of the nucleotide sequences of PLP1 BINDING SITE, designated SEQ ID:7068, to the nucleotide sequence of GAM96 RNA, herein designated GAM RNA, also designated SEQ ID:394.

Another function of GAM96 is therefore inhibition of Proteolipid protein 1 (pelizaeus-merzbacher disease, spastic paraplegia 2, uncomplicated) (PLP1, Accession NP_000524.2). Accordingly, utilities of GAM96 include diagnosis, prevention and treatment of diseases and clinical conditions associated with PLP1.

Paired mesoderm homeo box 1 (PMX1, Accession NP_073207.1) is another GAM96 target gene, herein designated TARGET GENE. PMX1 BINDING SITE is a target binding site found in the 3' untranslated region of multiple transcripts of mRNA encoded by PMX1, corresponding to a target binding site such as BINDING SITE I, BINDING SITE II or BINDING SITE III of FIG. 8. Table 4 illustrates the complementarity of the nucleotide sequences of PMX1 BINDING SITE, designated SEQ ID:2960, to the nucleotide sequence of GAM96 RNA, herein designated GAM RNA, also designated SEQ ID:394.

Another function of GAM96 is therefore inhibition of Paired mesoderm homeo box 1 (PMX1, Accession NP_073207.1), a gene which acts as a transcriptional regulator of muscle creatine kinase. Accordingly, utilities of GAM96 include diagnosis, prevention and treatment of diseases and clinical conditions associated with PMX1.

The function of PMX1 has been established by previous studies. Homeo box genes are expressed in specific temporal and spatial patterns and function as transcriptional regulators of developmental processes. The murine homeo box gene Pmx (paired mesoderm homeo box), previously called K-2 and mHox, is expressed in a mesodermally restricted pattern in embryos and most abundantly in cardiac, skeletal, and smooth muscle tissues in adults (Kern et al., 1994). Grueneberg et al. (1992) cloned the homologous human gene. By means of interspecific backcross analysis, Kern et al. (1994) determined that the Pmx gene is located on mouse chromosome 1, approximately 3.3 cM distal to the Gsh-4 homeo box locus. The gene contains at least 5 exons spanning a minimum of 60 kb of genomic DNA, making this the largest known murine homeo box gene. The homologous human gene may map to 1q inasmuch as this region is syntenic with the region of mouse chromosome 1 where Pmx is located. Norris et al. (2000) mapped the human PRRX1 gene to 1q23 by fluorescence in situ hybridization.

Full details of the abovementioned studies are described in the following publications, the disclosure of which are hereby incorporated by reference:

Grueneberg, D. A.; Natesan, S.; Alexandre, C.; Gilman, M. Z.: Human and Drosophila homeodomain proteins that enhance the DNA-binding activity of serum response factor. Science 257:1089-1095, 1992; and Norris, R. A.; Scott, K. K.; Moore, C. S.; Stetten, G.; Brown, C. R.; Jabs, E. W.; Wulfsberg, E. A.; y, J.; Kern, M. J.: Human PRRX1 and PRRX2 genes: cloning, expression, genomic localiz.

Further studies establishing the function and utilities of PMX1 are found in John Hopkins OMIM database record ID 167420, and in cited publications listed in Table 5, which are hereby incorporated by reference. Paired mesoderm homeo box 1 (PMX1, Accession NP_008833.1) is another GAM96 target gene, herein designated TARGET GENE. PMX1 BINDING SITE is a target binding site found in the 3' untranslated region of multiple transcripts of mRNA encoded by PMX1, corresponding to a target binding site such as BINDING SITE I, BINDING SITE II or BINDING SITE III of FIG. 8. Table 4 illustrates the complementarity of the nucleotide sequences of PMX1 BINDING SITE, designated SEQ ID:2960, to the nucleotide sequence of GAM96 RNA, herein designated GAM RNA, also designated SEQ ID:394.

Another function of GAM96 is therefore inhibition of Paired mesoderm homeo box 1 (PMX1, Accession NP_008833.1), a gene which acts as a transcriptional regulator of muscle creatine kinase. Accordingly, utilities of GAM96 include diagnosis, prevention and treatment of diseases and clinical conditions associated with PMX1.

The function of PMX1 has been established by previous studies. Homeo box genes are expressed in specific temporal and spatial patterns and function as transcriptional regulators of developmental processes. The murine homeo box gene Pmx (paired mesoderm homeo box), previously called K-2 and mHox, is expressed in a mesodermally restricted pattern in embryos and most abundantly in cardiac, skeletal, and smooth muscle tissues in adults (Kern et al., 1994). Grueneberg et al. (1992) cloned the homologous human gene. By means of interspecific backcross analysis, Kern et al. (1994) determined that the Pmx gene is located on mouse chromosome 1, approximately 3.3 cM distal to the Gsh-4 homeo box locus. The gene contains at least 5 exons spanning a minimum of 60 kb of genomic DNA, making this the largest known murine homeo box gene. The homologous human gene may map to 1q inasmuch as this region is syntenic with the region of mouse chromosome 1 where Pmx is located. Norris et al. (2000) mapped the human PRRX1 gene to 1q23 by fluorescence in situ hybridization.

Full details of the abovementioned studies are described in the following publications, the disclosure of which are hereby incorporated by reference:

Grueneberg, D. A.; Natesan, S.; Alexandre, C.; Gilman, M. Z.: Human and Drosophila homeodomain proteins that enhance the DNA-binding activity of serum response factor. Science 257:1089-1095, 1992; and Norris, R. A.; Scott, K. K.; Moore, C. S.; Stetten, G.; Brown, C. R.; Jabs, E. W.; Wulfsberg, E. A.; y, J.; Kern, M. J.: Human PRRX1 and PRRX2 genes: cloning, expression, genomic localiz.

Further studies establishing the function and utilities of PMX1 are found in John Hopkins OMIM database record ID 167420, and in cited publications listed in Table 5, which are hereby incorporated by reference. Polymerase (dna directed) sigma (POLS, Accession NP_008930.1) is another GAM96 target gene, herein designated TARGET GENE. POLS BINDING SITE is a target binding site found in the 3' untranslated region of mRNA encoded by POLS, corresponding to a target binding site such as BINDING SITE I, BINDING SITE II or BINDING SITE III of FIG. 8. Table 4 illustrates the complementarity of the nucleotide sequences of POLS BINDING SITE, designated SEQ ID:9961, to the nucleotide sequence of GAM96 RNA, herein designated GAM RNA, also designated SEQ ID:394.

Another function of GAM96 is therefore inhibition of Polymerase (dna directed) sigma (POLS, Accession NP_008930.1), a gene which is necessary for chromosome segregation. Accordingly, utilities of GAM96 include diagnosis, prevention and treatment of diseases and clinical conditions associated with POLS.

The function of POLS has been established by previous studies. Wang et al. (2000) found that yeast TRF4, an evolutionarily conserved gene necessary for chromosome segregation, encodes a DNA polymerase with beta-polymerase-like properties. A double mutant in the redundant homologs TRF4 and TRF5 is unable to complete S phase, whereas a TRF4 single mutant completes a presumably defective S phase that results in the failure of cohesion between the replicated sister chromatids. This suggested that TRFs are a key link in the coordination between DNA replication and sister chromatid cohesion. Walowsky et al. (1999) noted that a region of the human TRF4-1 gene is identical to an STS (OMIM Ref. No. G06245) mapping to 5p15. This region of chromosome 5p is among the most common regions amplified in small cell lung tumor cell lines and in primary small cell tumors. In addition, amplifications in this region are frequently found in high-grade ovarian tumors.

Full details of the abovementioned studies are described in the following publications, the disclosure of which are hereby incorporated by reference:

Wang, Z.; Castano, I. B.; De Las Penas, A.; Adams, C.; Christman, M. F.: Pol kappa: a DNA polymerase required for sister chromatid cohesion. Science 289:774-779, 2000; and Walowsky, C.; Fitzhugh, D. J.; Castano, I. B.; Ju, J. Y.; Levin, N. A.; Christman, M. F.: The topoisomerase-related function gene TRF4 affects cellular sensitivity to the antitumor agent.

Further studies establishing the function and utilities of POLS are found in John Hopkins OMIM database record ID 605198, and in cited publications listed in Table 5, which are hereby incorporated by reference. Protein phosphatase 2, regulatory subunit b (b56), delta isoform (PPP2R5D, Accession NP_006236.1) is another GAM96 target gene, herein designated TARGET GENE. PPP2R5D BINDING SITE is a target binding site found in the 3' untranslated region of multiple transcripts of mRNA encoded by PPP2R5D, corresponding to a target binding site such as BINDING SITE I, BINDING SITE II or BINDING SITE III of FIG. 8. Table 4 illustrates the complementarity of the nucleotide sequences of PPP2R5D BINDING SITE, designated SEQ ID:19741, to the nucleotide sequence of GAM96 RNA, herein designated GAM RNA, also designated SEQ ID:394.

Another function of GAM96 is therefore inhibition of Protein phosphatase 2, regulatory subunit b (b56), delta isoform (PPP2R5D, Accession NP_006236.1), a gene which is a regulatory subunit of protein phosphatase 2A. Accordingly, utilities of GAM96 include diagnosis, prevention and treatment of diseases and clinical conditions associated with PPP2R5D.

The function of PPP2R5D has been established by previous studies. Protein phosphorylation is a regulatory mechanism commonly employed in cellular processes such as cell cycle progression, growth factor signaling, and cell transformation. Protein phosphatase 2A (PP2A), a heterotrimeric serine/threonine phosphatase, has been implicated in a variety of regulatory processes including cell growth and division, muscle contraction, and gene transcription. PP2A is composed of a 36-kD catalytic subunit (OMIM Ref. No. 176915), a highly homologous 65-kD structural subunit, and any of several different regulatory subunits which control its specificity. According to McCright et al. (1996), the B56 family of regulatory subunits is encoded by at least 5 homologous but distinct genes, termed B56-alpha, -beta, -gamma, -delta, and -epsilon. McCright et al. (1996) cloned the B56-delta gene from a human fetal brain cDNA library using a partial cDNA sequence. They found that B56-delta encoded a 602-amino acid protein with a predicted molecular mass of 69,947 Da. This subunit is able to form a functional trimeric PP2A phosphatase when combined with an A and a C subunit.

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A-PPP2R5E), highly expressed in muscle and brain, to chromosome regions 1q41, 11q12, 3p21, 6p21.1, and 7p11.2- to - p12. Genomics 36:168-170, 1996; and McCright, B.; Rivers, A. M.; Audlin, S.; Virshup, D. M.: The B56 family of protein phosphatase 2A (PP2A) regulatory subunits encodes differentiation- induced phosphoproteins that target.

Further studies establishing the function and utilities of PPP2R5D are found in John Hopkins OMIM database record ID 601646, and in cited publications listed in Table 5, which are hereby incorporated by reference. Protein phosphatase 2, regulatory subunit b (b56), delta isoform (PPP2R5D, Accession NP_851308.1) is another GAM96 target gene, herein designated TARGET GENE. PPP2R5D BINDING SITE is a target binding site found in the 3' untranslated region of multiple transcripts of mRNA encoded by PPP2R5D, corresponding to a target binding site such as BINDING SITE I, BINDING SITE II or BINDING SITE III of FIG. 8. Table 4 illustrates the complementarity of the nucleotide sequences of PPP2R5D BINDING SITE, designated SEQ ID:19741, to the nucleotide sequence of GAM96 RNA, herein designated GAM RNA, also designated SEQ ID:394.

Another function of GAM96 is therefore inhibition of Protein phosphatase 2, regulatory subunit b (b56), delta isoform (PPP2R5D, Accession NP_851308.1), a gene which is a regulatory subunit of protein phosphatase 2A. Accordingly, utilities of GAM96 include diagnosis, prevention and treatment of diseases and clinical conditions associated with PPP2R5D.

The function of PPP2R5D has been established by previous studies. Protein phosphorylation is a regulatory mechanism commonly employed in cellular processes such as cell cycle progression, growth factor signaling, and cell transformation. Protein phosphatase 2A (PP2A), a heterotrimeric serine/threonine phosphatase, has been implicated in a variety of regulatory processes including cell growth and division, muscle contraction, and gene transcription. PP2A is composed of a 36-kD catalytic subunit (OMIM Ref. No. 176915), a highly homologous 65-kD structural subunit, and any of several different regulatory subunits which control its specificity. According to McCright et al. (1996), the B56 family of regulatory subunits is encoded by at least 5 homologous but distinct genes, termed B56-alpha, -beta, -gamma, -delta, and -epsilon. McCright et al. (1996) cloned the B56-delta gene from a human fetal brain cDNA library using a partial cDNA sequence. They found that B56-delta encoded a 602-amino acid protein with a predicted molecular mass of 69,947 Da. This subunit is able to form a functional trimeric PP2A phosphatase when combined with an A and a C subunit.

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A-PPP2R5E), highly expressed in muscle and brain, to chromosome regions 1q41, 11q12, 3p21, 6p21.1, and 7p11.2- to - p12. Genomics 36:168-170, 1996; and McCright, B.; Rivers, A. M.; Audlin, S.; Virshup, D. M.: The B56 family of protein phosphatase 2A (PP2A) regulatory subunits encodes differentiation- induced phosphoproteins that target.

Further studies establishing the function and utilities of PPP2R5D are found in John Hopkins OMIM database record ID 601646, and in cited publications listed in Table 5, which are hereby incorporated by reference. Protein phosphatase 2, regulatory subunit b (b56), delta isoform (PPP2R5D, Accession NP_851307.1) is another GAM96 target gene, herein designated TARGET GENE. PPP2R5D BINDING SITE is a target binding site found in the 3' untranslated region of multiple transcripts of mRNA encoded by PPP2R5D, corresponding to a target binding site such as BINDING SITE I, BINDING SITE II or BINDING SITE III of FIG. 8. Table 4 illustrates the complementarity of the nucleotide sequences of PPP2R5D BINDING SITE, designated SEQ ID:19741, to the nucleotide sequence of GAM96 RNA, herein designated GAM RNA, also designated SEQ ID:394.

Another function of GAM96 is therefore inhibition of Protein phosphatase 2, regulatory subunit b (b56), delta isoform (PPP2R5D, Accession NP_851307.1), a gene which is a regulatory subunit of protein phosphatase 2A. Accordingly, utilities of GAM96 include diagnosis, prevention and treatment of diseases and clinical conditions associated with PPP2R5D.

The function of PPP2R5D has been established by previous studies. Protein phosphorylation is a regulatory mechanism commonly employed in cellular processes such as cell cycle progression, growth factor signaling, and cell transformation. Protein phosphatase 2A (PP2A), a heterotrimeric serine/threonine phosphatase, has been implicated in a variety of regulatory processes including cell growth and division, muscle contraction, and gene transcription. PP2A is composed of a 36-kD catalytic subunit (OMIM Ref. No. 176915), a highly homologous 65-kD structural subunit, and any of several different regulatory subunits which control its specificity. According to McCright et al. (1996), the B56 family of regulatory subunits is encoded by at least 5 homologous but distinct genes, termed B56-alpha, -beta, -gamma, -delta, and -epsilon. McCright et al. (1996) cloned the B56-delta gene from a human fetal brain cDNA library using a partial cDNA sequence. They found that B56-delta encoded a 602-amino acid protein with a predicted molecular mass of 69,947 Da. This subunit is able to form a functional trimeric PP2A phosphatase when combined with an A and a C subunit.

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A-PPP2R5E), highly expressed in muscle and brain, to chromosome regions 1q41, 11q12, 3p21, 6p21.1, and 7p11.2- to - p12. Genomics 36:168-170, 1996; and McCright, B.; Rivers, A. M.; Audlin, S.; Virshup, D. M.: The B56 family of protein phosphatase 2A (PP2A) regulatory subunits encodes differentiation- induced phosphoproteins that target.

Further studies establishing the function and utilities of PPP2R5D are found in John Hopkins OMIM database record ID 601646, and in cited publications listed in Table 5, which are hereby incorporated by reference. Prokineticin 1 (PROK1, Accession NP_115790.1) is another GAM96 target gene, herein designated TARGET GENE. PROK1 BINDING SITE is a target binding site found in the 3' untranslated region of mRNA encoded by PROK1, corresponding to a target binding site such as BINDING SITE I, BINDING SITE II or BINDING SITE III of FIG. 8. Table 4 illustrates the complementarity of the nucleotide sequences of PROK1 BINDING SITE, designated SEQ ID:18144, to the nucleotide sequence of GAM96 RNA, herein designated GAM RNA, also designated SEQ ID:394.

Another function of GAM96 is therefore inhibition of Prokineticin 1 (PROK1, Accession NP_115790.1), a gene which induces proliferation, migration and fenestration in capillary endothelial cells derived from endocrine glands. Accordingly, utilities of GAM96 include diagnosis, prevention and treatment of diseases and clinical conditions associated with PROK1.

The function of PROK1 has been established by previous studies. Endocrine gland-derived vascular endothelial growth factor (EG-VEGF) induces proliferation, migration, and fenestration in capillary endothelial cells derived from endocrine glands. Its expression is induced by hypoxia and is restricted to the steroidogenic glands (ovary, testis, adrenal, and placenta). Its expression is often complementary to the expression of VEGF (OMIM Ref. No. 192240), suggesting that these molecules function in a coordinated manner. LeCouter et al. (2001) screened a library of purified human secreted proteins for the ability to induce proliferation in primary bovine adrenal cortex-derived capillary endothelial cells.

EG-VEGF was capable of inducing a strong and reproducible mitogenic response. Mature EG-VEGF is a protein with a relative molecular mass of 8,600 encoded by a cDNA cloned from human ovary library. The 1.4-kb cDNA encodes a protein of 105 amino acids with a well defined signal sequence. The mature protein is predicted to have 86 amino acids, including 10 cysteines, and an expected isoelectric point of 8.46. These cysteines potentially form 5 disulfide bridges. EG-VEGF displays a high degree of homology to a nontoxic protein purified from the venom of the black mamba snake, venom protein A (VPRA). The structure of native VPRA was solved, and the disulfide bridge partners were revealed. The number and spacing of cysteines are completely conserved between VPRA and EG-VEGF. BV8, a human molecule closely related to a peptide isolated from the yellow-bellied toad, is 58% identical to the EG-VEGF mature protein. There is also significant homology to the carboxy-terminal sequence of Xenopus dickkopf (see OMIM Ref. No. 605189) and to colipase (OMIM Ref. No. 120105). Li et al. (2001) identified EG-VEGF as prokineticin-1. EG-VEGF is mitogenic and chemoattractive and able to induce fenestration. EG-VEGF expression is induced by hypoxia, and there is an HIF1 (OMIM Ref. No. 603348) binding site present on EG-VEGF. EG-VEGF is able to induce angiogenesis and ovarian cyst formation. Northern blot analysis demonstrated expression in testis, ovary, adrenal gland, and placenta. A signal was detectable in prostate after prolonged exposure Full details of the abovementioned studies are described in the following publications, the disclosure of which are hereby incorporated by reference:

LeCouter, J.; Kowalski, J.; Foster, J.; Hass, P.; Zhang, Z.; Dillard-Telm, L.; Frantz, G.; Rangell, L.; DeGuzman, L.; Keller, G.-A.; Peale, F.; Gurney, P.; Hillan, K. J.; Ferrara, N.: Identification of an angiogenic mitogen selective for endocrine gland endothelium. Nature 412:877-884, 2001; and Li, M.; Bullock, C. M.; Knauer, D. J.; Ehlert, F. J.; Zhou, Q. Y.: Identification of two prokineticin cDNAs: recombinant proteins potently contract gastrointestinal smooth muscle. Mol.

Further studies establishing the function and utilities of PROK1 are found in John Hopkins OMIM database record ID 606233, and in cited publications listed in Table 5, which are hereby incorporated by reference. Peroxisomal farnesylated protein (PXF, Accession NP_002848.1) is another GAM96 target gene, herein designated TARGET GENE. PXF BINDING SITE is a target binding site found in the 3' untranslated region of mRNA encoded by PXF, corresponding to a target binding site such as BINDING SITE I, BINDING SITE II or BINDING SITE III of FIG. 8. Table 4 illustrates the complementarity of the nucleotide sequences of PXF BINDING SITE, designated SEQ ID:4076, to the nucleotide sequence of GAM96 RNA, herein designated GAM RNA, also designated SEQ ID:394.

Another function of GAM96 is therefore inhibition of Peroxisomal farnesylated protein (PXF, Accession NP_002848.1), a gene which may function in peroxisomal biogenesis or assembly and therefore may be associated with Peroxisome biogenesis disorder (pbd). Accordingly, utilities of GAM96 include diagnosis, prevention and treatment of Peroxisome biogenesis disorder (pbd), and of other diseases and clinical conditions associated with PXF.

The function of PXF has been established by previous studies. The covalent attachment of prenyl lipids, such as farnesyl or geranylgeranyl groups, by specific transferases is indispensable for the cellular sorting of many proteins. James et al. (1994) identified in hamster a farnesylated protein, called peroxisomal farnesylated protein or PxF, that localized to the outer surface of peroxisomes. Kammerer et al. (1997) found that the protein sequence of PxF is 93% identical to that of HK33, a human protein identified by Braun et al. (1994). Braun et al. (1994) reported that HK33 is a predicted 299-amino acid protein with a mass of 33 kD by SDS-PAGE. Northern blot analysis and RT-PCR revealed that HK33 is expressed ubiquitously as 2.2 to 2.5-kb and 4-kb mRNAs. The fact that the gene was transcribed in all cells and tissues tested indicated its status as a housekeeping gene. Braun et al. (1994) demonstrated that at least 2 different HK33 transcripts result from the use of alternative polyadenylation sites. Kammerer et al. (1997) isolated 4 variant HK33, or PXF, mRNAs produced by alternative splicing. They found that the proteins encoded by 2 of the splice variants were farnesylated in vitro. Using immunoelectron microscopy, Kammerer et al. (1997) showed that PXF is localized to the cytoplasmic surface of peroxisomes in liver cells. These authors reported that the PXF gene contains 8 exons and spans approximately 9 kb. The basal promoter is located within the first 239 bp upstream of the coding region.

Full details of the abovementioned studies are described in the following publications, the disclosure of which are hereby incorporated by reference:

Braun, A.; Kammerer, S.; Weissenhorn, W.; Weiss, E. H.; Cleve, H.: Sequence of a putative human housekeeping gene (HK33) localized on chromosome 1. Gene 146:291-295, 1994; and Kammerer, S.; Arnold, N.; Gutensohn, W.; Mewes, H.-W.; Kunau, W.-H.; Hofler, G.; Roscher, A. A.; Braun, A.: Genomic organization and molecular characterization of a gene encoding HsPX.

Further studies establishing the function and utilities of PXF are found in John Hopkins OMIM database record ID 600279, and in cited publications listed in Table 5, which are hereby incorporated by reference. Peroxisomal membrane protein 3, 35 kda (zellweger syndrome) (PXMP3, Accession NP_000309.1) is another GAM96 target gene, herein designated TARGET GENE. PXMP3 BINDING SITE is a target binding site found in the 5' untranslated region of mRNA encoded by PXMP3, corresponding to a target binding site such as BINDING SITE I, BINDING SITE II or BINDING SITE III of FIG. 8. Table 4 illustrates the complementarity of the nucleotide sequences of PXMP3 BINDING SITE, designated SEQ ID:12286, to the nucleotide sequence of GAM96 RNA, herein designated GAM RNA, also designated SEQ ID:394.

Another function of GAM96 is therefore inhibition of Peroxisomal membrane protein 3, 35 kda (zellweger syndrome) (PXMP3, Accession NP_000309.1). Accordingly, utilities of GAM96 include diagnosis, prevention and treatment of diseases and clinical conditions associated with PXMP3.

Rab22a, member ras oncogene family (RAB22A, Accession NP_065724.1) is another GAM96 target gene, herein designated TARGET GENE. RAB22A BINDING SITE is a target binding site found in the 3' untranslated region of mRNA encoded by RAB22A, corresponding to a target binding site such as BINDING SITE I, BINDING SITE II or BINDING SITE III of FIG. 8. Table 4 illustrates the complementarity of the nucleotide sequences of RAB22A BINDING SITE, designated SEQ ID:10718, to the nucleotide sequence of GAM96 RNA, herein designated GAM RNA, also designated SEQ ID:394.

Another function of GAM96 is therefore inhibition of Rab22a, member ras oncogene family (RAB22A, Accession NP_065724.1). Accordingly, utilities of GAM96 include diagnosis, prevention and treatment of diseases and clinical conditions associated with RAB22A.

Rap1, gtpase activating protein 1 (RAP1GA1, Accession NP_002876.1) is another GAM96 target gene, herein designated TARGET GENE. RAP1GA1 BINDING SITE is a target binding site found in the 3' untranslated region of mRNA encoded by RAP1GA1, corresponding to a target binding site such as BINDING SITE I, BINDING SITE II or BINDING SITE III of FIG. 8. Table 4 illustrates the complementarity of the nucleotide sequences of RAP1GA1 BINDING SITE, designated SEQ ID:17705, to the nucleotide sequence of GAM96 RNA, herein designated GAM RNA, also designated SEQ ID:394.

Another function of GAM96 is therefore inhibition of Rap1, gtpase activating protein 1 (RAP1GA1, Accession NP_002876.1). Accordingly, utilities of GAM96 include diagnosis, prevention and treatment of diseases and clinical conditions associated with RAP1GA1.

RASSF5 (Accession NP_113625.1) is another GAM96 target gene, herein designated TARGET GENE. RASSF5 BINDING SITE is a target binding site found in the 3' untranslated region of multiple transcripts of mRNA encoded by RASSF5, corresponding to a target binding site such as BINDING SITE I, BINDING SITE II or BINDING SITE III of FIG. 8. Table 4 illustrates the complementarity of the nucleotide sequences of RASSF5 BINDING SITE, designated SEQ ID:1440, to the nucleotide sequence of GAM96 RNA, herein designated GAM RNA, also designated SEQ ID:394.

Another function of GAM96 is therefore inhibition of RASSF5 (Accession NP_113625.1). Accordingly, utilities of GAM96 include diagnosis, prevention and treatment of diseases and clinical conditions associated with RASSF5.

RDH-E2 (Accession NP_620419.1) is another GAM96 target gene, herein designated TARGET GENE. RDH-E2 BINDING SITE is a target binding site found in the 3' untranslated region of mRNA encoded by RDH-E2, corresponding to a target binding site such as BINDING SITE I, BINDING SITE II or BINDING SITE III of FIG. 8. Table 4 illustrates the complementarity of the nucleotide sequences of RDH-E2 BINDING SITE, designated SEQ ID:18476, to the nucleotide sequence of GAM96 RNA, herein designated GAM RNA, also designated SEQ ID:394.

Another function of GAM96 is therefore inhibition of RDH-E2 (Accession NP_620419.1). Accordingly, utilities of GAM96 include diagnosis, prevention and treatment of diseases and clinical conditions associated with RDH-E2.

Renin (REN, Accession XP_085689.1) is another GAM96 target gene, herein designated TARGET GENE. REN BINDING SITE is a target binding site found in the 5' untranslated region of multiple transcripts of mRNA encoded by REN, corresponding to a target binding site such as BINDING SITE I, BINDING SITE II or BINDING SITE III of FIG. 8. Table 4 illustrates the complementarity of the nucleotide sequences of REN BINDING SITE, designated SEQ ID:4098, to the nucleotide sequence of GAM96 RNA, herein designated GAM RNA, also designated SEQ ID:394.

Another function of GAM96 is therefore inhibition of Renin (REN, Accession XP_085689.1). Accordingly, utilities of GAM96 include diagnosis, prevention and treatment of diseases and clinical conditions associated with REN.

RP42 (Accession NP_065691.1) is another GAM96 target gene, herein designated TARGET GENE. RP42 BINDING SITE is a target binding site found in the 3' untranslated region of mRNA encoded by RP42, corresponding to a target binding site such as BINDING SITE I, BINDING SITE II or BINDING SITE III of FIG. 8. Table 4 illustrates the complementarity of the nucleotide sequences of RP42 BINDING SITE, designated SEQ ID:2138, to the nucleotide sequence of GAM96 RNA, herein designated GAM RNA, also designated SEQ ID:394.

Another function of GAM96 is therefore inhibition of RP42 (Accession NP_065691.1), a gene which not clear yet and therefore may be associated with Autism. Accordingly, utilities of GAM96 include diagnosis, prevention and treatment of Autism, and of other diseases and clinical conditions associated with RP42.

The function of RP42 has been established by previous studies. In a systematic search for genes expressed in proliferating neuroblasts whose human orthologs map to susceptibility loci for autism (OMIM Ref. No. 209850), Mas et al. (2000) isolated a novel mouse gene, which they designated RP42. They obtained the human homolog by combining contigs of human ESTs and RT-PCR of human embryonic mRNAs. The deduced human and mouse RP42 proteins contain 259 amino acids and differ by only 2 residues. They show 30 to 36% overall sequence identity to an S. pombe and a C. elegans protein, suggesting that the RP42 protein has an important cellular function. Northern blot analysis in the mouse embryo demonstrated expression of 2 transcripts, with the larger transcript reaching peak expression from E11 to E15, and the smaller transcript showing high expression from E7 to E15, indicating developmentally regulated expression, which was found particularly in proliferating neuroblasts. In mouse adult tissues, 3 transcripts were expressed in testis, kidney, liver, skeletal muscle, and heart, with weaker expression in brain. Northern blot analysis of adult human tissues detected 2 RP42 transcripts of approximately 3.7 and 2.7 kb at lower levels of expression than in mouse. RT-PCR showed that RP42 is expressed in the human embryo telencephalon Mas et al. (2000) identified the human RP42 sequence in a cluster of embryonic neuronally expressed genes on a PAC mapping to 6q16, making it a candidate gene for the susceptibility autism locus previously assigned to this region Full details of the abovementioned studies are described in the following publications, the disclosure of which are hereby incorporated by reference:

Mas, C.; Bourgeois, F.; Bulfone, A.; Levacher, B.; Mugnier, C.; Simonneau, M.: Cloning and expression analysis of a novel gene, RP42, mapping to an autism susceptibility locus on 6q16. Genomics 65:70-74, 2000; and Mas, C.; Bourgeois, F.; Bulfone, A.; Levacher, B.; Mugnier, C.; Simonneau, M.: Cloning and expression analysis of a novel gene, RP42, mapping to an autism susceptibility locus on 6q16. Ge.

Further studies establishing the function and utilities of RP42 are found in John Hopkins OMIM database record ID 605905, and in cited publications listed in Table 5, which are hereby incorporated by reference. Sodium channel, voltage-gated, type v, alpha polypeptide (long (electrocardiographic) qt syndrome 3) (SCN5A, Accession NP_000326.2) is another GAM96 target gene, herein designated TARGET GENE. SCN5A BINDING SITE is a target binding site found in the 3' untranslated region of mRNA encoded by SCN5A, corresponding to a target binding site such as BINDING SITE I, BINDING SITE II or BINDING SITE III of FIG. 8. Table 4 illustrates the complementarity of the nucleotide sequences of SCN5A BINDING SITE, designated SEQ ID:18915, to the nucleotide sequence of GAM96 RNA, herein designated GAM RNA, also designated SEQ ID:394.

Another function of GAM96 is therefore inhibition of Sodium channel, voltage-gated, type v, alpha polypeptide (long (electrocardiographic) qt syndrome 3) (SCN5A, Accession NP_000326.2). Accordingly, utilities of GAM96 include diagnosis, prevention and treatment of diseases and clinical conditions associated with SCN5A.

SEC61B (Accession NP_006799.1) is another GAM96 target gene, herein designated TARGET GENE. SEC61B BINDING SITE is a target binding site found in the 3' untranslated region of mRNA encoded by SEC61B, corresponding to a target binding site such as BINDING SITE I, BINDING SITE II or BINDING SITE III of FIG. 8. Table 4 illustrates the complementarity of the nucleotide sequences of SEC61B BINDING SITE, designated SEQ ID:9649, to the nucleotide sequence of GAM96 RNA, herein designated GAM RNA, also designated SEQ ID:394.

Another function of GAM96 is therefore inhibition of SEC61B (Accession NP_006799.1). Accordingly, utilities of GAM96 include diagnosis, prevention and treatment of diseases and clinical conditions associated with SEC61B.

Sh3-domain binding protein 2 (SH3BP2, Accession NP_003014.2) is another GAM96 target gene, herein designated TARGET GENE. SH3BP2 BINDING SITE is a target binding site found in the 3' untranslated region of mRNA encoded by SH3BP2, corresponding to a target binding site such as BINDING SITE I, BINDING SITE II or BINDING SITE III of FIG. 8. Table 4 illustrates the complementarity of the nucleotide sequences of SH3BP2 BINDING SITE, designated SEQ ID:1516, to the nucleotide sequence of GAM96 RNA, herein designated GAM RNA, also designated SEQ ID:394.

Another function of GAM96 is therefore inhibition of Sh3-domain binding protein 2 (SH3BP2, Accession NP_003014.2). Accordingly, utilities of GAM96 include diagnosis, prevention and treatment of diseases and clinical conditions associated with SH3BP2.

Solute carrier family 4, sodium bicarbonate cotransporter, member 4 (SLC4A4, Accession NP_003750.1) is another GAM96 target gene, herein designated TARGET GENE. SLC4A4 BINDING SITE is a target binding site found in the 3' untranslated region of mRNA encoded by SLC4A4, corresponding to a target binding site such as BINDING SITE I, BINDING SITE II or BINDING SITE III of FIG. 8. Table 4 illustrates the complementarity of the nucleotide sequences of SLC4A4 BINDING SITE, designated SEQ ID:12800, to the nucleotide sequence of GAM96 RNA, herein designated GAM RNA, also designated SEQ ID:394.

Another function of GAM96 is therefore inhibition of Solute carrier family 4, sodium bicarbonate cotransporter, member 4 (SLC4A4, Accession NP_003750.1), a gene which is a sodium bicarbonate cotransporter and therefore may be associated with Proximal renal tubular acidosis, mental retardation, and bilateral glaucoma, cataracts, and band keratopathy. Accordingly, utilities of GAM96 include diagnosis, prevention and treatment of Proximal renal tubular acidosis, mental retardation, and bilateral glaucoma, cataracts, and band keratopathy, and of other diseases and clinical conditions associated with SLC4A4.

The function of SLC4A4 has been established by previous studies. By screening a human heart cDNA library with rat kidney Nbc cDNAs, followed by a PCR approach, Choi et al. (1999) isolated a full-length cDNA encoding a heart NBC, which they called hhNBC. They reported that the coding sequence of hhNBC is identical to that of pNBC (Abuladze et al., 1998). However, the 5-prime untranslated regions of hhNBC and pNBC differ. Northern blot analysis using the 5-prime region of the hhNBC coding sequence as probe detected an approximately 9-kb transcript that was strongly expressed in pancreas and weakly expressed in heart and brain. Choi et al. (1999) found that both hhNBC and kNBC (Burnham et al., 1997), when expressed in Xenopus, are electrogenic. Soleimani and Burnham (2000) stated that kNBC (Burnham et al., 1997) and pNBC (Abuladze et al., 1998) are encoded by splice variants of the same gene, SLC4A4, which they called NBC1. Mutations in the SLC4A4 gene (e.g., 603345.0001, 603345.0002) cause proximal renal tubular acidosis with bilateral glaucoma, cataracts, and band keratopathy (OMIM Ref. No. 604278). Such mutations may increase the bicarbonate concentration in the corneal stroma, which would facilitate calcium deposition leading to band keratopathy. Igarashi et al. (1999) suggested that the kidney and pancreatic NBCs are derived from a common gene by alternative splicing and that mutations at the common region would inactivate both isoforms. Studies by Usui et al. (1999) confirmed that both kidney and pancreatic NBC are involved in the transport of sodium and bicarbonate out of the corneal stroma and into the aqueous humor.

Full details of the abovementioned studies are described in the following publications, the disclosure of which are hereby incorporated by reference:

Soleimani, M.; Burnham, C. E.: Physiologic and molecular aspects of the Na(+):HCO(3-) cotransporter in health and disease processes. Kidney Int. 57: 371-384, 2000; and Choi, I.; Romero, M. F.; Khandoudi, N.; Bril, A.; Boron, W. F.: Cloning and characterization of a human electrogenic Na(+)-HCO(3-) cotransporter isoform (hhNBC). Am. J. Physiol. 276: C57.

Further studies establishing the function and utilities of SLC4A4 are found in John Hopkins OMIM database record ID 603345, and in cited publications listed in Table 5, which are hereby incorporated by reference. Solute carrier family 5 (sodium-dependent vitamin transporter), member 6 (SLC5A6, Accession NP_066918.1) is another GAM96 target gene, herein designated TARGET GENE. SLC5A6 BINDING SITE is a target binding site found in the 3' untranslated region of mRNA encoded by SLC5A6, corresponding to a target binding site such as BINDING SITE I, BINDING SITE II or BINDING SITE III of FIG. 8. Table 4 illustrates the complementarity of the nucleotide sequences of SLC5A6 BINDING SITE, designated SEQ ID:10988, to the nucleotide sequence of GAM96 RNA, herein designated GAM RNA, also designated SEQ ID:394.

Another function of GAM96 is therefore inhibition of Solute carrier family 5 (sodium-dependent vitamin transporter), member 6 (SLC5A6, Accession NP_066918.1). Accordingly, utilities of GAM96 include diagnosis, prevention and treatment of diseases and clinical conditions associated with SLC5A6.

SLC5A8 (Accession NP_666018.1) is another GAM96 target gene, herein designated TARGET GENE. SLC5A8 BINDING SITE is a target binding site found in the 5' untranslated region of mRNA encoded by SLC5A8, corresponding to a target binding site such as BINDING SITE I, BINDING SITE II or BINDING SITE III of FIG. 8. Table 4 illustrates the complementarity of the nucleotide sequences of SLC5A8 BINDING SITE, designated SEQ ID:7461, to the nucleotide sequence of GAM96 RNA, herein designated GAM RNA, also designated SEQ ID:394.

Another function of GAM96 is therefore inhibition of SLC5A8 (Accession NP_666018.1). Accordingly, utilities of GAM96 include diagnosis, prevention and treatment of diseases and clinical conditions associated with SLC5A8.

Sp3 transcription factor (SP3, Accession XP_092672.2) is another GAM96 target gene, herein designated TARGET GENE. SP3 BINDING SITE is a target binding site found in the 5' untranslated region of mRNA encoded by SP3, corresponding to a target binding site such as BINDING SITE I, BINDING SITE II or BINDING SITE III of FIG. 8. Table 4 illustrates the complementarity of the nucleotide sequences of SP3 BINDING SITE, designated SEQ ID:18315, to the nucleotide sequence of GAM96 RNA, herein designated GAM RNA, also designated SEQ ID:394.

Another function of GAM96 is therefore inhibition of Sp3 transcription factor (SP3, Accession XP_092672.2), a gene which binds to gt and gc boxes promoters elements. Accordingly, utilities of GAM96 include diagnosis, prevention and treatment of diseases and clinical conditions associated with SP3.

The function of SP3 has been established by previous studies. Kingsley and Winoto (1992) noted that in T cells, a consensus GT box similar to the GC box is bound by Sp1. Gel shift analysis showed that other regulatory proteins also bind the GT box. They then cloned 2 novel cDNAs using the Sp1 zinc finger domain as a probe. These new transcription factors, termed Sp2 (OMIM Ref. No. 601801) and Sp3 by them, encode proteins with several transactivation domains and a zinc finger DNA-binding domain with homology to Sp1. The Sp3 cDNA encodes an open reading frame of 713 amino acids. They found that the amino acid sequence of Sp3 is 90% homologous to that of Sp1 within the zinc finger region, and that there is significant homology throughout the protein. Kingsley and Winoto (1992) found that, when expressed in vitro, both Sp1 and Sp3 bind strongly to GC- and GT-box regulatory elements. Hagen et al. (1992) independently performed recognition site screening for factors which bind to the GT motif of the uteroglobin promoter. They isolated Sp3 and Sp4 (OMIM Ref. No. 600540), referring to them as SPR2 and SPR1 (for Sp-related factors 2 and 1) respectively. Northern blot analysis showed that Sp3 is expressed as a 5.0-kb message in all cell lines and tissues tested. Hagen et al. (1994) found that Sp3 represses Sp1-mediated transcriptional activation, suggesting that Sp3 is an inhibitory member of the Sp gene family.

Full details of the abovementioned studies are described in the following publications, the disclosure of which are hereby incorporated by reference:

Kalff-Suske, M.; Kunz, J.; Grzeschik, K.-H.; Suske, G.: Human Sp3 transcriptional regulator gene (SP3) maps to chromosome 2q31. Genomics 37:410-412, 1996; and Hagen, G.; Muller, S.; Beato, M.; Suske, G.: Cloning by recognition site screening of two novel GT box binding proteins: a family of Sp1 related genes. Nucleic Acids Res. 20:5519-5525, 19.

Further studies establishing the function and utilities of SP3 are found in John Hopkins OMIM database record ID 415000, and in cited publications listed in Table 5, which are hereby incorporated by reference. Sprouty homolog 3 (drosophila) (SPRY3, Accession NP_005831.1) is another GAM96 target gene, herein designated TARGET GENE. SPRY3 BINDING SITE is a target binding site found in the 3' untranslated region of mRNA encoded by SPRY3, corresponding to a target binding site such as BINDING SITE I, BINDING SITE II or BINDING SITE III of FIG. 8. Table 4 illustrates the complementarity of the nucleotide sequences of SPRY3 BINDING SITE, designated SEQ ID:11554, to the nucleotide sequence of GAM96 RNA, herein designated GAM RNA, also designated SEQ ID:394.

Another function of GAM96 is therefore inhibition of Sprouty homolog 3 (drosophila) (SPRY3, Accession NP_005831.1). Accordingly, utilities of GAM96 include diagnosis, prevention and treatment of diseases and clinical conditions associated with SPRY3.

SRP (Accession NP_149976.1) is another GAM96 target gene, herein designated TARGET GENE. SRP BINDING SITE is a target binding site found in the 3' untranslated region of mRNA encoded by SRP, corresponding to a target binding site such as BINDING SITE I, BINDING SITE II or BINDING SITE III of FIG. 8. Table 4 illustrates the complementarity of the nucleotide sequences of SRP BINDING SITE, designated SEQ ID:1261, to the nucleotide sequence of GAM96 RNA, herein designated GAM RNA, also designated SEQ ID:394.

Another function of GAM96 is therefore inhibition of SRP (Accession NP_149976.1), a gene which ligands for the type 2 CRH receptor . Accordingly, utilities of GAM96 include diagnosis, prevention and treatment of diseases and clinical conditions associated with SRP.

The function of SRP has been established by previous studies. The stresscopin (SCP; 605901) and stresscopin-related peptide (SRP) genes encode specific ligands for the type 2 CRH receptor (CRHR2; 602034), which mediates stress coping responses during the recovery phase of stress. Hsu and Hsueh (2001) identified human stresscopin (SCP) and stresscopin-related peptide (SRP) as corticotropin-releasing hormone (CRH)/urocortin (OMIM Ref. No. 600945) family members. The 112-amino acid human SRP open reading frame contains a signal peptide for secretion, and the region containing the 43-amino acid mature peptide is flanked by potential proteolytic cleavage sites and an alpha-amidation donor residue. A stretch of 30 residues at the respective carboxy termini of human and pufferfish SRP has an extended alpha-helical structure shared by all CRH family peptides. SRP is expressed in diverse peripheral tissues as well as in the central nervous system. Treatment with stresscopin or stresscopin-related peptide suppressed food intake and delayed gastric emptying in mice and decreased heat-induced edema in rats. Hsu and Hsueh (2001) concluded that SCP and SRP might represent endogenous ligands for maintaining homeostasis after stress, and could allow the design of drugs to ameliorate stress-related diseases. Reyes et al. (2001) cloned mouse urocortin II, a homolog of human SRP, and a partial cDNA encoding human SRP, which they termed urocortin-related peptide (URP). The mouse and human proteins share 76% amino acid identity. Hybridization histochemistry showed expression in cell groups involved in stress-related physiologic and behavioral functions. By analysis of a BAC clone, Reyes et al. (2001) mapped the SRP gene to chromosome 3p21.3.

Full details of the abovementioned studies are described in the following publications, the disclosure of which are hereby incorporated by reference:

Hsu, S. Y.; Hsueh, A. J. W.: Human stresscopin and stresscopin-related peptide are selective ligands for the type 2 corticotropin-releasing hormone receptor. Nature Med. 7:605-611, 2001; and Reyes, T. M.; Lewis, K.; Perrin, M. H.; Kunitake, K. S.; Vaughan, J.; Arias, C. A.; Hogenesch, J. B.; Gulyas, J.; Rivier, J.; Vale, W. W.; Sawchenko, P. E.: Urocortin II: a member of.

Further studies establishing the function and utilities of SRP are found in John Hopkins OMIM database record ID 605902, and in cited publications listed in Table 5, which are hereby incorporated by reference. Serine/threonine kinase 23 (STK23, Accession NP_055185.1) is another GAM96 target gene, herein designated TARGET GENE. STK23 BINDING SITE is a target binding site found in the 3' untranslated region of mRNA encoded by STK23, corresponding to a target binding site such as BINDING SITE I, BINDING SITE II or BINDING SITE III of FIG. 8. Table 4 illustrates the complementarity of the nucleotide sequences of STK23 BINDING SITE, designated SEQ ID:7482, to the nucleotide sequence of GAM96 RNA, herein designated GAM RNA, also designated SEQ ID:394.

Another function of GAM96 is therefore inhibition of Serine/threonine kinase 23 (STK23, Accession NP_055185.1). Accordingly, utilities of GAM96 include diagnosis, prevention and treatment of diseases and clinical conditions associated with STK23.

T54 (Accession NP_056513.2) is another GAM96 target gene, herein designated TARGET GENE. T54 BINDING SITE is a target binding site found in the 3' untranslated region of mRNA encoded by T54, corresponding to a target binding site such as BINDING SITE I, BINDING SITE II or BINDING SITE III of FIG. 8. Table 4 illustrates the complementarity of the nucleotide sequences of T54 BINDING SITE, designated SEQ ID:8102, to the nucleotide sequence of GAM96 RNA, herein designated GAM RNA, also designated SEQ ID:394.

Another function of GAM96 is therefore inhibition of T54 (Accession NP_056513.2). Accordingly, utilities of GAM96 include diagnosis, prevention and treatment of diseases and clinical conditions associated with T54.

T-box 4 (TBX4, Accession NP_060958.2) is another GAM96 target gene, herein designated TARGET GENE. TBX4 BINDING SITE is a target binding site found in the 3' untranslated region of mRNA encoded by TBX4, corresponding to a target binding site such as BINDING SITE I, BINDING SITE II or BINDING SITE III of FIG. 8. Table 4 illustrates the complementarity of the nucleotide sequences of TBX4 BINDING SITE, designated SEQ ID:3489, to the nucleotide sequence of GAM96 RNA, herein designated GAM RNA, also designated SEQ ID:394.

Another function of GAM96 is therefore inhibition of T-box 4 (TBX4, Accession NP_060958.2). Accordingly, utilities of GAM96 include diagnosis, prevention and treatment of diseases and clinical conditions associated with TBX4.

Transcription factor-like 5 (basic helix-loop-helix) (TCFL5, Accession NP_006593.1) is another GAM96 target gene, herein designated TARGET GENE. TCFL5 BINDING SITE is a target binding site found in the 3' untranslated region of mRNA encoded by TCFL5, corresponding to a target binding site such as BINDING SITE I, BINDING SITE II or BINDING SITE III of FIG. 8. Table 4 illustrates the complementarity of the nucleotide sequences of TCFL5 BINDING SITE, designated SEQ ID:19813, to the nucleotide sequence of GAM96 RNA, herein designated GAM RNA, also designated SEQ ID:394.

Another function of GAM96 is therefore inhibition of Transcription factor-like 5 (basic helix-loop-helix) (TCFL5, Accession NP_006593.1). Accordingly, utilities of GAM96 include diagnosis, prevention and treatment of diseases and clinical conditions associated with TCFL5.

TIM50L (Accession XP_053074.2) is another GAM96 target gene, herein designated TARGET GENE. TIM50L BINDING SITE is a target binding site found in the 3' untranslated region of mRNA encoded by TIM50L, corresponding to a target binding site such as BINDING SITE I, BINDING SITE II or BINDING SITE III of FIG. 8. Table 4 illustrates the complementarity of the nucleotide sequences of TIM50L BINDING SITE, designated SEQ ID:12301, to the nucleotide sequence of GAM96 RNA, herein designated GAM RNA, also designated SEQ ID:394.

Another function of GAM96 is therefore inhibition of TIM50L (Accession XP_053074.2). Accordingly, utilities of GAM96 include diagnosis, prevention and treatment of diseases and clinical conditions associated with TIM50L.

Tumor necrosis factor (ligand) superfamily, member 9 (TNFSF9, Accession NP_003802.1) is another GAM96 target gene, herein designated TARGET GENE. TNFSF9 BINDING SITE is a target binding site found in the 3' untranslated region of mRNA encoded by TNFSF9, corresponding to a target binding site such as BINDING SITE I, BINDING SITE II or BINDING SITE III of FIG. 8. Table 4 illustrates the complementarity of the nucleotide sequences of TNFSF9 BINDING SITE, designated SEQ ID:19645, to the nucleotide sequence of GAM96 RNA, herein designated GAM RNA, also designated SEQ ID:394.

Another function of GAM96 is therefore inhibition of Tumor necrosis factor (ligand) superfamily, member 9 (TNFSF9, Accession NP_003802.1). Accordingly, utilities of GAM96 include diagnosis, prevention and treatment of diseases and clinical conditions associated with TNFSF9.

Tropomyosin 3 (TPM3, Accession NP_689476.1) is another GAM96 target gene, herein designated TARGET GENE. TPM3 BINDING SITE is a target binding site found in the 5' untranslated region of multiple transcripts of mRNA encoded by TPM3, corresponding to a target binding site such as BINDING SITE I, BINDING SITE II or BINDING SITE III of FIG. 8. Table 4 illustrates the complementarity of the nucleotide sequences of TPM3 BINDING SITE, designated SEQ ID:8850, to the nucleotide sequence of GAM96 RNA, herein designated GAM RNA, also designated SEQ ID:394.

Another function of GAM96 is therefore inhibition of Tropomyosin 3 (TPM3, Accession NP_689476.1). Accordingly, utilities of GAM96 include diagnosis, prevention and treatment of diseases and clinical conditions associated with TPM3.

Tripartite motif-containing 31 (TRIM31, Accession NP_438111.1) is another GAM96 target gene, herein designated TARGET GENE. TRIM31 BINDING SITE is a target binding site found in the 5' untranslated region of multiple transcripts of mRNA encoded by TRIM31, corresponding to a target binding site such as BINDING SITE I, BINDING SITE II or BINDING SITE III of FIG. 8. Table 4 illustrates the complementarity of the nucleotide sequences of TRIM31 BINDING SITE, designated SEQ ID:1342, to the nucleotide sequence of GAM96 RNA, herein designated GAM RNA, also designated SEQ ID:394.

Another function of GAM96 is therefore inhibition of Tripartite motif-containing 31 (TRIM31, Accession NP_438111.1). Accordingly, utilities of GAM96 include diagnosis, prevention and treatment of diseases and clinical conditions associated with TRIM31.

Tripartite motif-containing 31 (TRIM31, Accession NP_008959.2) is another GAM96 target gene, herein designated TARGET GENE. TRIM31 BINDING SITE is a target binding site found in the 5' untranslated region of multiple transcripts of mRNA encoded by TRIM31, corresponding to a target binding site such as BINDING SITE I, BINDING SITE II or BINDING SITE III of FIG. 8. Table 4 illustrates the complementarity of the nucleotide sequences of TRIM31 BINDING SITE, designated SEQ ID:1342, to the nucleotide sequence of GAM96 RNA, herein designated GAM RNA, also designated SEQ ID:394.

Another function of GAM96 is therefore inhibition of Tripartite motif-containing 31 (TRIM31, Accession NP_008959.2). Accordingly, utilities of GAM96 include diagnosis, prevention and treatment of diseases and clinical conditions associated with TRIM31.

Ubiquitin associated protein 2 (UBAP2, Accession NP_680476.1) is another GAM96 target gene, herein designated TARGET GENE. UBAP2 BINDING SITE is a target binding site found in the 3' untranslated region of multiple transcripts of mRNA encoded by UBAP2, corresponding to a target binding site such as BINDING SITE I, BINDING SITE II or BINDING SITE III of FIG. 8. Table 4 illustrates the complementarity of the nucleotide sequences of UBAP2 BINDING SITE, designated SEQ ID:11910, to the nucleotide sequence of GAM96 RNA, herein designated GAM RNA, also designated SEQ ID:394.

Another function of GAM96 is therefore inhibition of Ubiquitin associated protein 2 (UBAP2, Accession NP_680476.1). Accordingly, utilities of GAM96 include diagnosis, prevention and treatment of diseases and clinical conditions associated with UBAP2.

Ubiquitously transcribed tetratricopeptide repeat gene, x chromosome (UTX, Accession NP_066963.1) is another GAM96 target gene, herein designated TARGET GENE. UTX BINDING SITE is a target binding site found in the 3' untranslated region of mRNA encoded by UTX, corresponding to a target binding site such as BINDING SITE I, BINDING SITE II or BINDING SITE III of FIG. 8. Table 4 illustrates the complementarity of the nucleotide sequences of UTX BINDING SITE, designated SEQ ID:7037, to the nucleotide sequence of GAM96 RNA, herein designated GAM RNA, also designated SEQ ID:394.

Another function of GAM96 is therefore inhibition of Ubiquitously transcribed tetratricopeptide repeat gene, x chromosome (UTX, Accession NP_066963.1), a gene which contains tetratricopeptide repeat motifs believed to mediate protein- protein interaction. Accordingly, utilities of GAM96 include diagnosis, prevention and treatment of diseases and clinical conditions associated with UTX.

The function of UTX has been established by previous studies. Greenfield et al. (1996) described a mouse Y-linked gene, Uty (OMIM Ref. No. 400009), which is widely expressed and encodes a tetratricopeptide repeat (TPR) protein. TPR motifs are found in a variety of functionally distinct proteins and are believed to mediate protein- protein interaction. The 5.5-kb Uty transcript encodes a 1,186 amino acid protein with 8 TPR motifs in its N terminus. Greenfield et al. (1998) reported that the human UTY gene maps to band 5C. This band is known to contain one or more genes functioning in spermatogenesis and a Y-specific growth gene. Greenfield et al. (1998) described the isolation of an X-linked homolog of Uty, called Utx (ubiquitously transcribed TPR gene on the X chromosome), which is expressed from the inactive X chromosome in both mice and humans. The gene maps to the proximal region of the mouse X chromosome in an interval containing the Maoa (OMIM Ref. No. 309850) and Maob (OMIM Ref. No. 309860) genes, thus placing it in band A2-A3. By Southern analysis of a panel of rodent/human somatic cell hybrids carrying derivative X chromosomes, Greenfield et al. (1998) mapped the human UTX gene to Xp11.3-p11.23. By fluorescence in situ hybridization on normal human metaphase spreads, they refined the localization to Xp11.2

Full details of the abovementioned studies are described in the following publications, the disclosure of which are hereby incorporated by reference:

Greenfield, A.; Carrel, L.; Pennisi, D.; Philippe, C.; Quaderi, N.; Siggers, P.; Steiner, K.; Tam, P. P. L.; Monaco, A. P.; Willard, H. F.; Koopman, P.: The UTX gene escapes X inactivation in mice and humans. Hum. Molec. Genet. 7:737-742, 1998; and Greenfield, A. J.; Scott, D.; Pennisi, D.; Ehrmann, I.; Ellis, P.; Cooper, L.; Simpson, E.; Koopman, P.: An H-YDb epitope is encoded by a novel mouse Y chromosome gene. Nature Genet. 1.

Further studies establishing the function and utilities of UTX are found in John Hopkins OMIM database record ID 300128, and in cited publications listed in Table 5, which are hereby incorporated by reference. Vang-like 2 (van gogh, drosophila) (VANGL2, Accession XP_049695.4) is another GAM96 target gene, herein designated TARGET GENE. VANGL2 BINDING SITE is a target binding site found in the 3' untranslated region of mRNA encoded by VANGL2, corresponding to a target binding site such as BINDING SITE I, BINDING SITE II or BINDING SITE III of FIG. 8. Table 4 illustrates the complementarity of the nucleotide sequences of VANGL2 BINDING SITE, designated SEQ ID:10530, to the nucleotide sequence of GAM96 RNA, herein designated GAM RNA, also designated SEQ ID:394.

Another function of GAM96 is therefore inhibition of Vang-like 2 (van gogh, drosophila) (VANGL2, Accession XP_049695.4), a gene which may take part in defining the lateral boundary of floorplate differentiation and therefore may be associated with Neural tube defects. Accordingly, utilities of GAM96 include diagnosis, prevention and treatment of Neural tube defects, and of other diseases and clinical conditions associated with VANGL2.

The function of VANGL2 and its association with various diseases and clinical conditions, has been established by previous studies, as described hereinabove with reference to GAM47.1. Vav 3 oncogene (VAV3, Accession NP_006104.3) is another GAM96 target gene, herein designated TARGET GENE. VAV3 BINDING SITE is a target binding site found in the 3' untranslated region of mRNA encoded by VAV3, corresponding to a target binding site such as BINDING SITE I, BINDING SITE II or BINDING SITE III of FIG. 8. Table 4 illustrates the complementarity of the nucleotide sequences of VAV3 BINDING SITE, designated SEQ ID:17719, to the nucleotide sequence of GAM96 RNA, herein designated GAM RNA, also designated SEQ ID:394.

Another function of GAM96 is therefore inhibition of Vav 3 oncogene (VAV3, Accession NP_006104.3). Accordingly, utilities of GAM96 include diagnosis, prevention and treatment of diseases and clinical conditions associated with VAV3.

Williams beuren syndrome chromosome region 21 (WBSCR21, Accession NP_683713.1) is another GAM96 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:19321, to the nucleotide sequence of GAM96 RNA, herein designated GAM RNA, also designated SEQ ID:394.

Another function of GAM96 is therefore inhibition of Williams beuren syndrome chromosome region 21 (WBSCR21, Accession NP_683713.1). Accordingly, utilities of GAM96 include diagnosis, prevention and treatment of diseases and clinical conditions associated with WBSCR21.

Williams beuren syndrome chromosome region 21 (WBSCR21, Accession NP_112585.2) is another GAM96 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:19321, to the nucleotide sequence of GAM96 RNA, herein designated GAM RNA, also designated SEQ ID:394.

Another function of GAM96 is therefore inhibition of Williams beuren syndrome chromosome region 21 (WBSCR21, Accession NP_112585.2). Accordingly, utilities of GAM96 include diagnosis, prevention and treatment of diseases and clinical conditions associated with WBSCR21.

ZFP276 (Accession NP_689500.1) is another GAM96 target gene, herein designated TARGET GENE. ZFP276 BINDING SITE is a target binding site found in the 5' untranslated region of mRNA encoded by ZFP276, corresponding to a target binding site such as BINDING SITE I, BINDING SITE II or BINDING SITE III of FIG. 8. Table 4 illustrates the complementarity of the nucleotide sequences of ZFP276 BINDING SITE, designated SEQ ID:1176, to the nucleotide sequence of GAM96 RNA, herein designated GAM RNA, also designated SEQ ID:394.

Another function of GAM96 is therefore inhibition of ZFP276 (Accession NP_689500.1). Accordingly, utilities of GAM96 include diagnosis, prevention and treatment of diseases and clinical conditions associated with ZFP276.

ZFYVE26 (Accession XP_031077.1) is another GAM96 target gene, herein designated TARGET GENE. ZFYVE26 BINDING SITE is a target binding site found in the 3' untranslated region of mRNA encoded by ZFYVE26, corresponding to a target binding site such as BINDING SITE I, BINDING SITE II or BINDING SITE III of FIG. 8. Table 4 illustrates the complementarity of the nucleotide sequences of ZFYVE26 BINDING SITE, designated SEQ ID:13984, to the nucleotide sequence of GAM96 RNA, herein designated GAM RNA, also designated SEQ ID:394.

Another function of GAM96 is therefore inhibition of ZFYVE26 (Accession XP_031077.1). Accordingly, utilities of GAM96 include diagnosis, prevention and treatment of diseases and clinical conditions associated with ZFYVE26.

Zinc finger protein 297b (ZNF297B, Accession NP_054726.1) is another GAM96 target gene, herein designated TARGET GENE. ZNF297B BINDING SITE is a target binding site found in the 3' untranslated region of mRNA encoded by ZNF297B, corresponding to a target binding site such as BINDING SITE I, BINDING SITE II or BINDING SITE III of FIG. 8. Table 4 illustrates the complementarity of the nucleotide sequences of ZNF297B BINDING SITE, designated SEQ ID:12416, to the nucleotide sequence of GAM96 RNA, herein designated GAM RNA, also designated SEQ ID:394.

Another function of GAM96 is therefore inhibition of Zinc finger protein 297b (ZNF297B, Accession NP_054726.1). Accordingly, utilities of GAM96 include diagnosis, prevention and treatment of diseases and clinical conditions associated with ZNF297B.

FIG. 8 further provides a conceptual description of a novel bioinformatically detected of the present invention, referred to here as Genomic Address Messenger 97 (GAM97), which modulates expression of respective target genes thereof, the function and utility of which target genes is known in the art.

GAM97 is a novel bioinformatically detected regulatory, non protein coding, micro RNA (miRNA) gene. The method by which GAM97 was detected is described hereinabove with reference to FIGS. 8-15.

GAM97 gene, herein designated GAM GENE, and GAM97 target gene, herein designated TARGET GENE, are human genes contained in the human genome.

GAM97 gene encodes a GAM97 precursor RNA, herein designated GAM PRECURSOR RNA. Similar to other miRNA genes, and unlike most ordinary genes, GAM97 precursor RNA does not encode a protein. A nucleotide sequence identical or highly similar to the nucleotide sequence of GAM97 precursor RNA is designated SEQ ID:175, and is provided hereinbelow with reference to the sequence listing part.

GAM97 precursor RNA folds onto itself, forming GAM97 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM97 precursor RNA folds onto itself, forming GAM97 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM97 precursor RNA, designated SEQ-ID:175, and a schematic representation of a predicted secondary folding of GAM97 folded precursor RNA are further described with reference to Table 2, hereby incorporated by reference.

An enzyme complex designated DICER COMPLEX, 'dices' the GAM97 folded precursor RNA into GAM97 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM97 RNA is designated SEQ ID:274, and is provided hereinbelow with references to the sequence listing part and Table 3, hereby incorporated by reference.

GAM97 target gene, herein designated TARGET GENE, encodes a corresponding messenger RNA, GAM97 target RNA, herein designated GAM TARGET RNA. GAM97 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM97 RNA, herein designated GAM RNA, binds complementarily to one or more target binding sites located in untranslated regions of GAM97 target RNA, herein designated GAM TARGET RNA. This complementary binding is due to the fact that the nucleotide sequence of GAM97 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM97 RNA may have a different number of target binding sites in untranslated regions of a GAM97 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM97 RNA, herein designated GAM RNA, to target binding sites on GAM97 target RNA, herein designated GAM TARGET RNA, such as BINDING SITE I, BINDING SITE II and BINDING SITE III, inhibits translation of GAM97 target RNA into GAM97 target protein, herein designated GAM TARGET PROTEIN. GAM target protein is therefore outlined by a broken line.

It is appreciated that GAM97 target gene, herein designated TARGET GENE, in fact represents a plurality of GAM97 target genes. The mRNA of each one of this plurality of GAM97 target genes comprises one or more target binding sites, each having a nucleotide sequence which is at least partly complementary to GAM97 RNA, herein designated GAM RNA, and which when bound by GAM97 RNA causes inhibition of translation of respective one or more GAM97 target proteins.

It is further appreciated by one skilled in the art that the mode of translational inhibition illustrated by FIG. 8 with specific reference to translational inhibition exerted by GAM97 gene, herein designated GAM GENE, on one or more GAM97 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM97 correlate with, and may be deduced from, the identity of the target genes which GAM97 binds and inhibits, and the function of these target genes, as elaborated hereinbelow.

Ac-like transposable element (ALTE, Accession NM_004729.1) is a GAM97 target gene, herein designated TARGET GENE. ALTE BINDING SITE is a target binding site found in the 3' untranslated region of mRNA encoded by ALTE, corresponding to a target binding site such as BINDING SITE I, BINDING SITE II or BINDING SITE III of FIG. 8. Table 4 illustrates the complementarity of the nucleotide sequences of ALTE BINDING SITE, designated SEQ ID:13580, to the nucleotide sequence of GAM97 RNA, herein designated GAM RNA, also designated SEQ ID:274.

A function of GAM97 is therefore inhibition of Ac-like transposable element (ALTE, Accession NM_004729.1). Accordingly, utilities of GAM97 include diagnosis, prevention and treatment of diseases and clinical conditions associated with ALTE.

Chromosome 21 open reading frame 5 (C21orf5, Accession NM_005128.1) is another GAM97 target gene, herein designated TARGET GENE. C21orf5 BINDING SITE is a target binding site found in the 3' untranslated region of mRNA encoded by C21orf5, corresponding to a target binding site such as BINDING SITE I, BINDING SITE II or BINDING SITE III of FIG. 8. Table 4 illustrates the complementarity of the nucleotide sequences of C21orf5 BINDING SITE, designated SEQ ID:16569, to the nucleotide sequence of GAM97 RNA, herein designated GAM RNA, also designated SEQ ID:274.

Another function of GAM97 is therefore inhibition of Chromosome 21 open reading frame 5 (C21orf5, Accession NM_005128.1). Accordingly, utilities of GAM97 include diagnosis, prevention and treatment of diseases and clinical conditions associated with C21orf5.

Chemokine (c-c motif) receptor 6 (CCR6, Accession NM_031409.1) is another GAM97 target gene, herein designated TARGET GENE. CCR6 BINDING SITE is a target binding site found in the 3' untranslated region of multiple transcripts of mRNA encoded by CCR6, corresponding to a target binding site such as BINDING SITE I, BINDING SITE II or BINDING SITE III of FIG. 8. Table 4 illustrates the complementarity of the nucleotide sequences of CCR6 BINDING SITE, designated SEQ ID:12282, to the nucleotide sequence of GAM97 RNA, herein designated GAM RNA, also designated SEQ ID:274.

Another function of GAM97 is therefore inhibition of Chemokine (c-c motif) receptor 6 (CCR6, Accession NM_031409.1). Accordingly, utilities of GAM97 include diagnosis, prevention and treatment of diseases and clinical conditions associated with CCR6.

DKFZP434N161 (Accession) is another GAM97 target gene, herein designated TARGET GENE. DKFZP434N161 BINDING SITE is a target binding site found in the 3' untranslated region of mRNA encoded by DKFZP434N161, corresponding to a target binding site such as BINDING SITE I, BINDING SITE II or BINDING SITE III of FIG. 8. Table 4 illustrates the complementarity of the nucleotide sequences of DKFZP434N161 BINDING SITE, designated SEQ ID:10163, to the nucleotide sequence of GAM97 RNA, herein designated GAM RNA, also designated SEQ ID:274.

Another function of GAM97 is therefore inhibition of DKFZP434N161 (Accession). Accordingly, utilities of GAM97 include diagnosis, prevention and treatment of diseases and clinical conditions associated with DKFZP434N161.

Coagulation factor ii (thrombin) receptor (F2R, Accession NM_001992.2) is another GAM97 target gene, herein designated TARGET GENE. F2R BINDING SITE is a target binding site found in the 3' untranslated region of mRNA encoded by F2R, corresponding to a target binding site such as BINDING SITE I, BINDING SITE II or BINDING SITE III of FIG. 8. Table 4 illustrates the complementarity of the nucleotide sequences of F2R BINDING SITE, designated SEQ ID:8374, to the nucleotide sequence of GAM97 RNA, herein designated GAM RNA, also designated SEQ ID:274.

Another function of GAM97 is therefore inhibition of Coagulation factor ii (thrombin) receptor (F2R, Accession NM_001992.2), a gene which Thrombin receptor; G protein-coupled receptor involved in platelet activation. Accordingly, utilities of GAM97 include diagnosis, prevention and treatment of diseases and clinical conditions associated with F2R.

The function of F2R has been established by previous studies. Coughlin et al. (1992) reviewed the cloning and characterization of a platelet thrombin (OMIM Ref. No. 176930) receptor (Vu et al., 1991). The thrombin receptor is structurally related to other members of the 7-transmembrane receptor family and has been isolated from diverse cell types. It is intimately involved in the regulation of the thrombotic response. Using PCR analyses of a human/rodent hybrid cell mapping panel, Bahou et al. (1993) assigned the TR gene to chromosome 5. By fluorescence in situ hybridization, they refined the localization to 5q13, confirming its presence as a single locus in the human genome. Poirier et al. (1996) mapped the Cf2r gene to mouse chromosome 13 by studies of an interspecific backcross. Utilizing 2 distinct radiation hybrid mapping panels with different levels of resolution, Schmidt et al. (1997) demonstrated that this gene, sometimes referred to as PAR1, and the proteinase activated receptor-2 gene (OMIM Ref. No. 600933) are tightly linked. Physical mapping using yeast artificial chromosomes and inversion field gel electrophoresis demonstrated that they are maximally separated by 90 kb. Riewald et al. (2002) demonstrated that activated protein C (OMIM Ref. No. 176860) uses the endothelial cell protein C receptor (EPCR; 600646) as a coreceptor for cleavage of protease-activated receptor 1 (PAR1) on endothelial cells. Gene profiling demonstrated that PAR1 signaling could account for all activated protein C-induced protective genes, including the immunomodulatory monocyte chemoattractant protein-1 (MCP1; 158105), which was selectively induced by activation of PAR1, but not PAR2 (OMIM Ref. No. 600933). Thus, Riewald et al. (2002) concluded that the prototypical thrombin receptor is the target for EPCR-dependent APC signaling, suggesting a role for this receptor cascade in protection from sepsis.

Animal model experiments lend further support to the function of F2R. Griffin et al. (2001) reported a role for Par1, a protease-activated G protein-coupled receptor for thrombin, in embryonic development. Approximately one- half of Par1 -/- embryos died at midgestation with bleeding from multiple sites. Par1 is expressed in endothelial cells, and a Par1 transgene driven by an endothelial-specific promoter prevented death of Par1 -/- embryos. Griffin et al. (2001) concluded that the coagulation cascade and PAR1 modulate endothelial cell function in developing blood vessels and that thrombin's actions on endothelial cells, rather than on platelets, mesenchymal cells, or fibrinogen (see OMIM Ref. No. 134820), contribute to vascular development and hemostasis in the mouse embryo.

It is appreciated that the abovementioned animal model for F2R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Coughlin, S. R.; Vu, T.-K. H.; Hung, D. T.; Wheaton, V. I.: Characterization of a functional thrombin receptor: issues and opportunities. J. Clin. Invest. 89: 351-355, 1992; and Riewald, M.; Petrovan, R. J.; Donner, A.; Mueller, B. M.; Ruf, W.: Activation of endothelial cell protease activated receptor 1 by the protein C pathway. Science 296:1880-1882, 2002.

Further studies establishing the function and utilities of F2R are found in John Hopkins OMIM database record ID 187930, and in cited publications listed in Table 5, which are hereby incorporated by reference. FLJ10547 (Accession NM_018134.1) is another GAM97 target gene, herein designated TARGET GENE. FLJ10547 BINDING SITE is a target binding site found in the 3' untranslated region of mRNA encoded by FLJ10547, corresponding to a target binding site such as BINDING SITE I, BINDING SITE II or BINDING SITE III of FIG. 8. Table 4 illustrates the complementarity of the nucleotide sequences of FLJ10547 BINDING SITE, designated SEQ ID:9138, to the nucleotide sequence of GAM97 RNA, herein designated GAM RNA, also designated SEQ ID:274.

Another function of GAM97 is therefore inhibition of FLJ10547 (Accession NM_018134.1). Accordingly, utilities of GAM97 include diagnosis, prevention and treatment of diseases and clinical conditions associated with FLJ10547.

FLJ11996 (Accession NM_024976.1) is another GAM97 target gene, herein designated TARGET GENE. FLJ11996 BINDING SITE is a target binding site found in the 3' untranslated region of mRNA encoded by FLJ11996, corresponding to a target binding site such as BINDING SITE I, BINDING SITE II or BINDING SITE III of FIG. 8. Table 4 illustrates the complementarity of the nucleotide sequences of FLJ11996 BINDING SITE, designated SEQ ID:4576, to the nucleotide sequence of GAM97 RNA, herein designated GAM RNA, also designated SEQ ID:274.

Another function of GAM97 is therefore inhibition of FLJ11996 (Accession NM_024976.1). Accordingly, utilities of GAM97 include diagnosis, prevention and treatment of diseases and clinical conditions associated with FLJ11996.

FLJ12294 (Accession NM_025100.1) is another GAM97 target gene, herein designated TARGET GENE. FLJ12294 BINDING SITE is a target binding site found in the 3' untranslated region of mRNA encoded by FLJ12294, corresponding to a target binding site such as BINDING SITE I, BINDING SITE II or BINDING SITE III of FIG. 8. Table 4 illustrates the complementarity of the nucleotide sequences of FLJ12294 BINDING SITE, designated SEQ ID:11796, to the nucleotide sequence of GAM97 RNA, herein designated GAM RNA, also designated SEQ ID:274.

Another function of GAM97 is therefore inhibition of FLJ12294 (Accession NM_025100.1). Accordingly, utilities of GAM97 include diagnosis, prevention and treatment of diseases and clinical conditions associated with FLJ12294.

FLJ13659 (Accession) is another GAM97 target gene, herein designated TARGET GENE. FLJ13659 BINDING SITE is a target binding site found in the 3' untranslated region of mRNA encoded by FLJ13659, corresponding to a target binding site such as BINDING SITE I, BINDING SITE II or BINDING SITE III of FIG. 8. Table 4 illustrates the complementarity of the nucleotide sequences of FLJ13659 BINDING SITE, designated SEQ ID:10768, to the nucleotide sequence of GAM97 RNA, herein designated GAM RNA, also designated SEQ ID:274.

Another function of GAM97 is therefore inhibition of FLJ13659 (Accession). Accordingly, utilities of GAM97 include diagnosis, prevention and treatment of diseases and clinical conditions associated with FLJ13659.

FLJ13848 (Accession NM_024771.1) is another GAM97 target gene, herein designated TARGET GENE. FLJ13848 BINDING SITE is a target binding site found in the 3' untranslated region of mRNA encoded by FLJ13848, corresponding to a target binding site such as BINDING SITE I, BINDING SITE II or BINDING SITE III of FIG. 8. Table 4 illustrates the complementarity of the nucleotide sequences of FLJ13848 BINDING SITE, designated SEQ ID:14972, to the nucleotide sequence of GAM97 RNA, herein designated GAM RNA, also designated SEQ ID:274.

Another function of GAM97 is therefore inhibition of FLJ13848 (Accession NM_024771.1). Accordingly, utilities of GAM97 include diagnosis, prevention and treatment of diseases and clinical conditions associated with FLJ13848.

FLJ14129 (Accession NM_030895.1) is another GAM97 target gene, herein designated TARGET GENE. FLJ14129 BINDING SITE is a target binding site found in the 3' untranslated region of mRNA encoded by FLJ14129, corresponding to a target binding site such as BINDING SITE I, BINDING SITE II or BINDING SITE III of FIG. 8. Table 4 illustrates the complementarity of the nucleotide sequences of FLJ14129 BINDING SITE, designated SEQ ID:13220, to the nucleotide sequence of GAM97 RNA, herein designated GAM RNA, also designated SEQ ID:274.

Another function of GAM97 is therefore inhibition of FLJ14129 (Accession NM_030895.1). Accordingly, utilities of GAM97 include diagnosis, prevention and treatment of diseases and clinical conditions associated with FLJ14129.

FLJ14326 (Accession) is another GAM97 target gene, herein designated TARGET GENE. FLJ14326 BINDING SITE is a target binding site found in the 3' untranslated region of mRNA encoded by FLJ14326, corresponding to a target binding site such as BINDING SITE I, BINDING SITE II or BINDING SITE III of FIG. 8. Table 4 illustrates the complementarity of the nucleotide sequences of FLJ14326 BINDING SITE, designated SEQ ID:6959, to the nucleotide sequence of GAM97 RNA, herein designated GAM RNA, also designated SEQ ID:274.

Another function of GAM97 is therefore inhibition of FLJ14326 (Accession). Accordingly, utilities of GAM97 include diagnosis, prevention and treatment of diseases and clinical conditions associated with FLJ14326.

FLJ20004 (Accession) is another GAM97 target gene, herein designated TARGET GENE. FLJ20004 BINDING SITE is a target binding site found in the 3' untranslated region of mRNA encoded by FLJ20004, corresponding to a target binding site such as BINDING SITE I, BINDING SITE II or BINDING SITE III of FIG. 8. Table 4 illustrates the complementarity of the nucleotide sequences of FLJ20004 BINDING SITE, designated SEQ ID:4766, to the nucleotide sequence of GAM97 RNA, herein designated GAM RNA, also designated SEQ ID:274.

Another function of GAM97 is therefore inhibition of FLJ20004 (Accession). Accordingly, utilities of GAM97 include diagnosis, prevention and treatment of diseases and clinical conditions associated with FLJ20004.

FLJ20045 (Accession NM_017638.1) is another GAM97 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:665, to the nucleotide sequence of GAM97 RNA, herein designated GAM RNA, also designated SEQ ID:274.

Another function of GAM97 is therefore inhibition of FLJ20045 (Accession NM_017638.1). Accordingly, utilities of GAM97 include diagnosis, prevention and treatment of diseases and clinical conditions associated with FLJ20045.

FLJ22167 (Accession NM_024533.2) is another GAM97 target gene, herein designated TARGET GENE. FLJ22167 BINDING SITE is a target binding site found in the 3' untranslated region of mRNA encoded by FLJ22167, corresponding to a target binding site such as BINDING SITE I, BINDING SITE II or BINDING SITE III of FIG. 8. Table 4 illustrates the complementarity of the nucleotide sequences of FLJ22167 BINDING SITE, designated SEQ ID:11162, to the nucleotide sequence of GAM97 RNA, herein designated GAM RNA, also designated SEQ ID:274.

Another function of GAM97 is therefore inhibition of FLJ22167 (Accession NM_024533.2). Accordingly, utilities of GAM97 include diagnosis, prevention and treatment of diseases and clinical conditions associated with FLJ22167.

FLJ23499 (Accession NM_022761.1) is another GAM97 target gene, herein designated TARGET GENE. FLJ23499 BINDING SITE is a target binding site found in the 3' untranslated region of mRNA encoded by FLJ23499, corresponding to a target binding site such as BINDING SITE I, BINDING SITE II or BINDING SITE III of FIG. 8. Table 4 illustrates the complementarity of the nucleotide sequences of FLJ23499 BINDING SITE, designated SEQ ID:7763, to the nucleotide sequence of GAM97 RNA, herein designated GAM RNA, also designated SEQ ID:274.

Another function of GAM97 is therefore inhibition of FLJ23499 (Accession NM_022761.1). Accordingly, utilities of GAM97 include diagnosis, prevention and treatment of diseases and clinical conditions associated with FLJ23499.

FLJ31455 (Accession NM_144964.1) is another GAM97 target gene, herein designated TARGET GENE. FLJ31455 BINDING SITE is a target binding site found in the 3' untranslated region of mRNA encoded by FLJ31455, corresponding to a target binding site such as BINDING SITE I, BINDING SITE II or BINDING SITE III of FIG. 8. Table 4 illustrates the complementarity of the nucleotide sequences of FLJ31455 BINDING SITE, designated SEQ ID:12283, to the nucleotide sequence of GAM97 RNA, herein designated GAM RNA, also designated SEQ ID:274.

Another function of GAM97 is therefore inhibition of FLJ31455 (Accession NM_144964.1). Accordingly, utilities of GAM97 include diagnosis, prevention and treatment of diseases and clinical conditions associated with FLJ31455.

FRSB (Accession NM_005687.2) is another GAM97 target gene, herein designated TARGET GENE. FRSB BINDING SITE is a target binding site found in the 3' untranslated region of mRNA encoded by FRSB, corresponding to a target binding site such as BINDING SITE I, BINDING SITE II or BINDING SITE III of FIG. 8. Table 4 illustrates the complementarity of the nucleotide sequences of FRSB BINDING SITE, designated SEQ ID:17514, to the nucleotide sequence of GAM97 RNA, herein designated GAM RNA, also designated SEQ ID:274.

Another function of GAM97 is therefore inhibition of FRSB (Accession NM_005687.2). Accordingly, utilities of GAM97 include diagnosis, prevention and treatment of diseases and clinical conditions associated with FRSB.

Fus interacting protein (serine-arginine rich) 1 (FUSIP1, Accession NM_006625.3) is another GAM97 target gene, herein designated TARGET GENE. FUSIP1 BINDING SITE is a target binding site found in the 3' untranslated region of multiple transcripts of mRNA encoded by FUSIP1, corresponding to a target binding site such as BINDING SITE I, BINDING SITE II or BINDING SITE III of FIG. 8. Table 4 illustrates the complementarity of the nucleotide sequences of FUSIP1 BINDING SITE, designated SEQ ID:10769, to the nucleotide sequence of GAM97 RNA, herein designated GAM RNA, also designated SEQ ID:274.

Another function of GAM97 is therefore inhibition of Fus interacting protein (serine-arginine rich) 1 (FUSIP1, Accession NM_006625.3). Accordingly, utilities of GAM97 include diagnosis, prevention and treatment of diseases and clinical conditions associated with FUSIP1.

Fucosyltransferase 6 (alpha (1,3) fucosyltransferase) (FUT6, Accession NM_000150.1) is another GAM97 target gene, herein designated TARGET GENE. FUT6 BINDING SITE is a target binding site found in the 3' untranslated region of mRNA encoded by FUT6, corresponding to a target binding site such as BINDING SITE I, BINDING SITE II or BINDING SITE III of FIG. 8. Table 4 illustrates the complementarity of the nucleotide sequences of FUT6 BINDING SITE, designated SEQ ID:6754, to the nucleotide sequence of GAM97 RNA, herein designated GAM RNA, also designated SEQ ID:274.

Another function of GAM97 is therefore inhibition of Fucosyltransferase 6 (alpha (1,3) fucosyltransferase) (FUT6, Accession NM_000150.1), a gene which is involved in the biosynthesis of the e-selectin ligand, sialyl-lewis x. catalyzes the transfer of fucose from gdp-beta-fucose to alpha-2,3 sialylated substrates. Accordingly, utilities of GAM97 include diagnosis, prevention and treatment of diseases and clinical conditions associated with FUT6.

The function of FUT6 and its association with various diseases and clinical conditions, has been established by previous studies, as described hereinabove with reference to GAM47.1. Huntingtin interacting protein 1 (HIP1, Accession NM_005338.3) is another GAM97 target gene, herein designated TARGET GENE. HIP1 BINDING SITE is a target binding site found in the 3' untranslated region of mRNA encoded by HIP1, corresponding to a target binding site such as BINDING SITE I, BINDING SITE II or BINDING SITE III of FIG. 8. Table 4 illustrates the complementarity of the nucleotide sequences of HIP1 BINDING SITE, designated SEQ ID:3689, to the nucleotide sequence of GAM97 RNA, herein designated GAM RNA, also designated SEQ ID:274.

Another function of GAM97 is therefore inhibition of Huntingtin interacting protein 1 (HIP1, Accession NM_005338.3), a gene which is a membrane protein and interacts with huntingtin. and therefore may be associated with Huntington disease. Accordingly, utilities of GAM97 include diagnosis, prevention and treatment of Huntington disease, and of other diseases and clinical conditions associated with HIP1.

The function of HIP1 and its association with various diseases and clinical conditions, has been established by previous studies, as described hereinabove with reference to GAM72.1. Interleukin 18 (interferon-gamma-inducing factor) (IL18, Accession NM_001562.2) is another GAM97 target gene, herein designated TARGET GENE. IL18 BINDING SITE is a target binding site found in the 3' untranslated region of mRNA encoded by IL18, corresponding to a target binding site such as BINDING SITE I, BINDING SITE II or BINDING SITE III of FIG. 8. Table 4 illustrates the complementarity of the nucleotide sequences of IL18 BINDING SITE, designated SEQ ID:13191, to the nucleotide sequence of GAM97 RNA, herein designated GAM RNA, also designated SEQ ID:274.

Another function of GAM97 is therefore inhibition of Interleukin 18 (interferon-gamma-inducing factor) (IL18, Accession NM_001562.2), a gene which augments natural killer cell activity in spleen cells and stimulates interferon gamma production in t helper type i cells. and therefore may be associated with Crohn disease. Accordingly, utilities of GAM97 include diagnosis, prevention and treatment of Crohn disease, and of other diseases and clinical conditions associated with IL18.

The function of IL18 and its association with various diseases and clinical conditions, has been established by previous studies, as described hereinabove with reference to GAM72.1. KIAA0441 (Accession NM_014797.1) is another GAM97 target gene, herein designated TARGET GENE. KIAA0441 BINDING SITE is a target binding site found in the 3' untranslated region of mRNA encoded by KIAA0441, corresponding to a target binding site such as BINDING SITE I, BINDING SITE II or BINDING SITE III of FIG. 8. Table 4 illustrates the complementarity of the nucleotide sequences of KIAA0441 BINDING SITE, designated SEQ ID:11797, to the nucleotide sequence of GAM97 RNA, herein designated GAM RNA, also designated SEQ ID:274.

Another function of GAM97 is therefore inhibition of KIAA0441 (Accession NM_014797.1). Accordingly, utilities of GAM97 include diagnosis, prevention and treatment of diseases and clinical conditions associated with KIAA0441.

KIAA0798 (Accession) is another GAM97 target gene, herein designated TARGET GENE. KIAA0798 BINDING SITE is a target binding site found in the 3' untranslated region of mRNA encoded by KIAA0798, corresponding to a target binding site such as BINDING SITE I, BINDING SITE II or BINDING SITE III of FIG. 8. Table 4 illustrates the complementarity of the nucleotide sequences of KIAA0798 BINDING SITE, designated SEQ ID:13756, to the nucleotide sequence of GAM97 RNA, herein designated GAM RNA, also designated SEQ ID:274.

Another function of GAM97 is therefore inhibition of KIAA0798 (Accession). Accordingly, utilities of GAM97 include diagnosis, prevention and treatment of diseases and clinical conditions associated with KIAA0798.

KIAA0872 (Accession NM_014940.1) is another GAM97 target gene, herein designated TARGET GENE. KIAA0872 BINDING SITE is a target binding site found in the 3' untranslated region of mRNA encoded by KIAA0872, corresponding to a target binding site such as BINDING SITE I, BINDING SITE II or BINDING SITE III of FIG. 8. Table 4 illustrates the complementarity of the nucleotide sequences of KIAA0872 BINDING SITE, designated SEQ ID:13072, to the nucleotide sequence of GAM97 RNA, herein designated GAM RNA, also designated SEQ ID:274.

Another function of GAM97 is therefore inhibition of KIAA0872 (Accession NM_014940.1). Accordingly, utilities of GAM97 include diagnosis, prevention and treatment of diseases and clinical conditions associated with KIAA0872.

KIAA1456 (Accession XM_040100.4) is another GAM97 target gene, herein designated TARGET GENE. KIAA1456 BINDING SITE is a target binding site found in the 5' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:14943, to the nucleotide sequence of GAM97 RNA, herein designated GAM RNA, also designated SEQ ID:274.

Another function of GAM97 is therefore inhibition of KIAA1456 (Accession XM_040100.4). Accordingly, utilities of GAM97 include diagnosis, prevention and treatment of diseases and clinical conditions associated with KIAA1456.

KIAA1614 (Accession XM_046531.1) is another GAM97 target gene, herein designated TARGET GENE. KIAA1614 BINDING SITE is a target binding site found in the 5' untranslated region of mRNA encoded by KIAA1614, corresponding to a target binding site such as BINDING SITE I, BINDING SITE II or BINDING SITE III of FIG. 8. Table 4 illustrates the complementarity of the nucleotide sequences of KIAA1614 BINDING SITE, designated SEQ ID:628, to the nucleotide sequence of GAM97 RNA, herein designated GAM RNA, also designated SEQ ID:274.

Another function of GAM97 is therefore inhibition of KIAA1614 (Accession XM_046531.1). Accordingly, utilities of GAM97 include diagnosis, prevention and treatment of diseases and clinical conditions associated with KIAA1614.

KREMEN (Accession) is another GAM97 target gene, herein designated TARGET GENE. KREMEN BINDING SITE is a target binding site found in the 3' untranslated region of mRNA encoded by KREMEN, corresponding to a target binding site such as BINDING SITE I, BINDING SITE II or BINDING SITE III of FIG. 8. Table 4 illustrates the complementarity of the nucleotide sequences of KREMEN BINDING SITE, designated SEQ ID:2640, to the nucleotide sequence of GAM97 RNA, herein designated GAM RNA, also designated SEQ ID:274.

Another function of GAM97 is therefore inhibition of KREMEN (Accession) . Accordingly, utilities of GAM97 include diagnosis, prevention and treatment of diseases and clinical conditions associated with KREMEN.

LOC127262 (Accession XM_072073.6) is another GAM97 target gene, herein designated TARGET GENE. LOC127262 BINDING SITE is a target binding site found in the 3' untranslated region of mRNA encoded by LOC127262, corresponding to a target binding site such as BINDING SITE I, BINDING SITE II or BINDING SITE III of FIG. 8. Table 4 illustrates the complementarity of the nucleotide sequences of LOC127262 BINDING SITE, designated SEQ ID:17509, to the nucleotide sequence of GAM97 RNA, herein designated GAM RNA, also designated SEQ ID:274.

Another function of GAM97 is therefore inhibition of LOC127262 (Accession XM_072073.6). Accordingly, utilities of GAM97 include diagnosis, prevention and treatment of diseases and clinical conditions associated with LOC127262.

LOC145216 (Accession XM_096730.1) is another GAM97 target gene, herein designated TARGET GENE. LOC145216 BINDING SITE is a target binding site found in the 3' untranslated region of mRNA encoded by LOC145216, corresponding to a target binding site such as BINDING SITE I, BINDING SITE II or BINDING SITE III of FIG. 8. Table 4 illustrates the complementarity of the nucleotide sequences of LOC145216 BINDING SITE, designated SEQ ID:7110, to the nucleotide sequence of GAM97 RNA, herein designated GAM RNA, also designated SEQ ID:274.

Another function of GAM97 is therefore inhibition of LOC145216 (Accession XM_096730.1). Accordingly, utilities of GAM97 include diagnosis, prevention and treatment of diseases and clinical conditions associated with LOC145216.

LOC145231 (Accession XM_096740.1) is another GAM97 target gene, herein designated TARGET GENE. LOC145231 BINDING SITE is a target binding site found in the 3' untranslated region of mRNA encoded by LOC145231, corresponding to a target binding site such as BINDING SITE I, BINDING SITE II or BINDING SITE III of FIG. 8. Table 4 illustrates the complementarity of the nucleotide sequences of LOC145231 BINDING SITE, designated SEQ ID:17584, to the nucleotide sequence of GAM97 RNA, herein designated GAM RNA, also designated SEQ ID:274.

Another function of GAM97 is therefore inhibition of LOC145231 (Accession XM_096740.1). Accordingly, utilities of GAM97 include diagnosis, prevention and treatment of diseases and clinical conditions associated with LOC145231.

LOC146756 (Accession XM_097085.5) is another GAM97 target gene, herein designated TARGET GENE. LOC146756 BINDING SITE is a target binding site found in the 3' untranslated region of mRNA encoded by LOC146756, corresponding to a target binding site such as BINDING SITE I, BINDING SITE II or BINDING SITE III of FIG. 8. Table 4 illustrates the complementarity of the nucleotide sequences of LOC146756 BINDING SITE, designated SEQ ID:6711, to the nucleotide sequence of GAM97 RNA, herein designated GAM RNA, also designated SEQ ID:274.

Another function of GAM97 is therefore inhibition of LOC146756 (Accession XM_097085.5). Accordingly, utilities of GAM97 include diagnosis, prevention and treatment of diseases and clinical conditions associated with LOC146756.

LOC148946 (Accession) is another GAM97 target gene, herein designated TARGET GENE. LOC148946 BINDING SITE is a target binding site found in the 3' untranslated region of mRNA encoded by LOC148946, corresponding to a target binding site such as BINDING SITE I, BINDING SITE II or BINDING SITE III of FIG. 8. Table 4 illustrates the complementarity of the nucleotide sequences of LOC148946 BINDING SITE, designated SEQ ID:13319, to the nucleotide sequence of GAM97 RNA, herein designated GAM RNA, also designated SEQ ID:274.

Another function of GAM97 is therefore inhibition of LOC148946 (Accession). Accordingly, utilities of GAM97 include diagnosis, prevention and treatment of diseases and clinical conditions associated with LOC148946.

LOC150185 (Accession) is another GAM97 target gene, herein designated TARGET GENE. LOC150185 BINDING SITE is a target binding site found in the 3' untranslated region of mRNA encoded by LOC150185, corresponding to a target binding site such as BINDING SITE I, BINDING SITE II or BINDING SITE III of FIG. 8. Table 4 illustrates the complementarity of the nucleotide sequences of LOC150185 BINDING SITE, designated SEQ ID:13995, to the nucleotide sequence of GAM97 RNA, herein designated GAM RNA, also designated SEQ ID:274.

Another function of GAM97 is therefore inhibition of LOC150185 (Accession). Accordingly, utilities of GAM97 include diagnosis, prevention and treatment of diseases and clinical conditions associated with LOC150185.

LOC197201 (Accession XM_113839.4) is another GAM97 target gene, herein designated TARGET GENE. LOC197201 BINDING SITE is a target binding site found in the 3' untranslated region of mRNA encoded by LOC197201, corresponding to a target binding site such as BINDING SITE I, BINDING SITE II or BINDING SITE III of FIG. 8. Table 4 illustrates the complementarity of the nucleotide sequences of LOC197201 BINDING SITE, designated SEQ ID:9296, to the nucleotide sequence of GAM97 RNA, herein designated GAM RNA, also designated SEQ ID:274.

Another function of GAM97 is therefore inhibition of LOC197201 (Accession XM_113839.4). Accordingly, utilities of GAM97 include diagnosis, prevention and treatment of diseases and clinical conditions associated with LOC197201.

LOC200251 (Accession) is another GAM97 target gene, herein designated TARGET GENE. LOC200251 BINDING SITE is a target binding site found in the 5' untranslated region of mRNA encoded by LOC200251, corresponding to a target binding site such as BINDING SITE I, BINDING SITE II or BINDING SITE III of FIG. 8. Table 4 illustrates the complementarity of the nucleotide sequences of LOC200251 BINDING SITE, designated SEQ ID:18779, to the nucleotide sequence of GAM97 RNA, herein designated GAM RNA, also designated SEQ ID:274.

Another function of GAM97 is therefore inhibition of LOC200251 (Accession). Accordingly, utilities of GAM97 include diagnosis, prevention and treatment of diseases and clinical conditions associated with LOC200251.

LOC219722 (Accession XM_167593.1) is another GAM97 target gene, herein designated TARGET GENE. LOC219722 BINDING SITE is a target binding site found in the 5' untranslated region of mRNA encoded by LOC219722, corresponding to a target binding site such as BINDING SITE I, BINDING SITE II or BINDING SITE III of FIG. 8. Table 4 illustrates the complementarity of the nucleotide sequences of LOC219722 BINDING SITE, designated SEQ ID:19631, to the nucleotide sequence of GAM97 RNA, herein designated GAM RNA, also designated SEQ ID:274.

Another function of GAM97 is therefore inhibition of LOC219722 (Accession XM_167593.1). Accordingly, utilities of GAM97 include diagnosis, prevention and treatment of diseases and clinical conditions associated with LOC219722.

LOC221641 (Accession) is another GAM97 target gene, herein designated TARGET GENE. LOC221641 BINDING SITE is a target binding site found in the 5' untranslated region of mRNA encoded by LOC221641, corresponding to a target binding site such as BINDING SITE I, BINDING SITE II or BINDING SITE III of FIG. 8. Table 4 illustrates the complementarity of the nucleotide sequences of LOC221641

BINDING SITE, designated SEQ ID:4944, to the nucleotide sequence of GAM97 RNA, herein designated GAM RNA, also designated SEQ ID:274.

Another function of GAM97 is therefore inhibition of LOC221641 (Accession). Accordingly, utilities of GAM97 include diagnosis, prevention and treatment of diseases and clinical conditions associated with LOC221641.

LOC221954 (Accession XM_168349.1) is another GAM97 target gene, herein designated TARGET GENE. LOC221954 BINDING SITE is a target binding site found in the 5' untranslated region of mRNA encoded by LOC221954, corresponding to a target binding site such as BINDING SITE I, BINDING SITE II or BINDING SITE III of FIG. 8. Table 4 illustrates the complementarity of the nucleotide sequences of LOC221954 BINDING SITE, designated SEQ ID:15826, to the nucleotide sequence of GAM97 RNA, herein designated GAM RNA, also designated SEQ ID:274.

Another function of GAM97 is therefore inhibition of LOC221954 (Accession XM_168349.1). Accordingly, utilities of GAM97 include diagnosis, prevention and treatment of diseases and clinical conditions associated with LOC221954.

LOC254531 (Accession NM_153613.1) is another GAM97 target gene, herein designated TARGET GENE. LOC254531 BINDING SITE is a target binding site found in the 5' untranslated region of mRNA encoded by LOC254531, corresponding to a target binding site such as BINDING SITE I, BINDING SITE II or BINDING SITE III of FIG. 8. Table 4 illustrates the complementarity of the nucleotide sequences of LOC254531 BINDING SITE, designated SEQ ID:12649, to the nucleotide sequence of GAM97 RNA, herein designated GAM RNA, also designated SEQ ID:274.

Another function of GAM97 is therefore inhibition of LOC254531 (Accession NM_153613.1). Accordingly, utilities of GAM97 include diagnosis, prevention and treatment of diseases and clinical conditions associated with LOC254531.

LOC255196 (Accession) is another GAM97 target gene, herein designated TARGET GENE. LOC255196 BINDING SITE1 and LOC255196 BINDING SITE2 are target binding sites found in untranslated regions of mRNA encoded by LOC255196, corresponding to target binding sites such as BINDING SITE I, BINDING SITE II or BINDING SITE III of FIG. 8. Table 4 illustrates the complementarity of the nucleotide sequences of LOC255196 BINDING SITE1 and LOC255196 BINDING SITE2, designated SEQ ID:10392 and SEQ ID:19720 respectively, to the nucleotide sequence of GAM97 RNA, herein designated GAM RNA, also designated SEQ ID:274.

Another function of GAM97 is therefore inhibition of LOC255196 (Accession). Accordingly, utilities of GAM97 include diagnosis, prevention and treatment of diseases and clinical conditions associated with LOC255196.

LOC255937 (Accession) is another GAM97 target gene, herein designated TARGET GENE. LOC255937 BINDING SITE is a target binding site found in the 3' untranslated region of mRNA encoded by LOC255937, corresponding to a target binding site such as BINDING SITE I, BINDING SITE II or BINDING SITE III of FIG. 8. Table 4 illustrates the complementarity of the nucleotide sequences of LOC255937 BINDING SITE, designated SEQ ID:4791, to the nucleotide sequence of GAM97 RNA, herein designated GAM RNA, also designated SEQ ID:274.

Another function of GAM97 is therefore inhibition of LOC255937 (Accession). Accordingly, utilities of GAM97 include diagnosis, prevention and treatment of diseases and clinical conditions associated with LOC255937.

LOC257576 (Accession) is another GAM97 target gene, herein designated TARGET GENE. LOC257576 BINDING SITE is a target binding site found in the 3' untranslated region of mRNA encoded by LOC257576, corresponding to a target binding site such as BINDING SITE I, BINDING SITE II or BINDING SITE III of FIG. 8. Table 4 illustrates the complementarity of the nucleotide sequences of LOC257576 BINDING SITE, designated SEQ ID:10645, to the nucleotide sequence of GAM97 RNA, herein designated GAM RNA, also designated SEQ ID:274.

Another function of GAM97 is therefore inhibition of LOC257576 (Accession). Accordingly, utilities of GAM97 include diagnosis, prevention and treatment of diseases and clinical conditions associated with LOC257576.

LOC57118 (Accession) is another GAM97 target gene, herein designated TARGET GENE. LOC57118 BINDING SITE is a target binding site found in the 5' untranslated region of mRNA encoded by LOC57118, corresponding to a target binding site such as BINDING SITE I, BINDING SITE II or BINDING SITE III of FIG. 8. Table 4 illustrates the complementarity of the nucleotide sequences of LOC57118 BINDING SITE, designated SEQ ID:11157, to the nucleotide sequence of GAM97 RNA, herein designated GAM RNA, also designated SEQ ID:274.

Another function of GAM97 is therefore inhibition of LOC57118 (Accession). Accordingly, utilities of GAM97 include diagnosis, prevention and treatment of diseases and clinical conditions associated with LOC57118.

Mannan-binding lectin serine protease 1 (c4/c2 activating component of ra-reactive factor) (MASP1, Accession NM_001879.3) is another GAM97 target gene, herein designated TARGET GENE. MASP1 BINDING SITE is a target binding site found in the 3' untranslated region of multiple transcripts of mRNA encoded by MASP1, corresponding to a target binding site such as BINDING SITE I, BINDING SITE II or BINDING SITE III of FIG. 8. Table 4 illustrates the complementarity of the nucleotide sequences of MASP1 BINDING SITE, designated SEQ ID:692, to the nucleotide sequence of GAM97 RNA, herein designated GAM RNA, also designated SEQ ID:274.

Another function of GAM97 is therefore inhibition of Mannan-binding lectin serine protease 1 (c4/c2 activating component of ra-reactive factor) (MASP1, Accession NM_001879.3), a gene which a complement- dependent bactericidal factor. Accordingly, utilities of GAM97 include diagnosis, prevention and treatment of diseases and clinical conditions associated with MASP1.

The function of MASP1 and its association with various diseases and clinical conditions, has been established by previous studies, as described hereinabove with reference to GAM40.1. MGC10765 (Accession NM_024345.1) is another GAM97 target gene, herein designated TARGET GENE. MGC10765 BINDING SITE is a target binding site found in the 3' untranslated region of mRNA encoded by MGC10765, corresponding to a target binding site such as BINDING SITE I, BINDING SITE II or BINDING SITE III of FIG. 8. Table 4 illustrates the complementarity of the nucleotide sequences of MGC10765 BINDING SITE, designated SEQ ID:10417, to the nucleotide sequence of GAM97 RNA, herein designated GAM RNA, also designated SEQ ID:274.

Another function of GAM97 is therefore inhibition of MGC10765 (Accession NM_024345.1). Accordingly, utilities of GAM97 include diagnosis, prevention and treatment of diseases and clinical conditions associated with MGC10765.

MGC14799 (Accession NM_032336.1) is another GAM97 target gene, herein designated TARGET GENE. MGC14799 BINDING SITE is a target binding site found in the 3' untranslated region of mRNA encoded by MGC14799, corresponding to a target binding site such as BINDING SITE I, BINDING SITE II or BINDING SITE III of FIG. 8. Table 4 illustrates the complementarity of the nucleotide sequences of MGC14799 BINDING SITE, designated SEQ ID:15396, to the nucleotide sequence of GAM97 RNA, herein designated GAM RNA, also designated SEQ ID:274.

Another function of GAM97 is therefore inhibition of MGC14799 (Accession NM_032336.1). Accordingly, utilities of GAM97 include diagnosis, prevention and treatment of diseases and clinical conditions associated with MGC14799.

Solute carrier family 14 (urea transporter), member 2 (SLC14A2, Accession NM_007163.2) is another GAM97 target gene, herein designated TARGET GENE. SLC14A2 BINDING SITE is a target binding site found in the 3' untranslated region of mRNA encoded by SLC14A2, corresponding to a target binding site such as BINDING SITE I, BINDING SITE II or BINDING SITE III of FIG. 8. Table 4 illustrates the complementarity of the nucleotide sequences of SLC14A2 BINDING SITE, designated SEQ ID:5703, to the nucleotide sequence of GAM97 RNA, herein designated GAM RNA, also designated SEQ ID:274.

Another function of GAM97 is therefore inhibition of Solute carrier family 14 (urea transporter), member 2 (SLC14A2, Accession NM_007163.2), a gene which is a renal urea transporter 2. and therefore may be associated with Orthostatic hypotension. Accordingly, utilities of GAM97 include diagnosis, prevention and treatment of Orthostatic hypotension, and of other diseases and clinical conditions associated with SLC14A2.

The function of SLC14A2 has been established by previous studies. Genetic variation in proteins that determine sodium reabsorption and excretion significantly influences blood pressure. Ranade et al. (2001) investigated whether nucleotide variation in human UT2 could be associated with variation in blood pressure. Seven single-nucleotide polymorphisms (SNPs) were identified, including val227 to ile and ala357 to thr. Over 1,000 hypertensive and low- normotensive individuals of Chinese origin were genotyped. The ile227 and ala357 alleles were associated with low diastolic blood pressure in men but not women, with odds ratios 2.1 (95% confidence interval 1.5-2.7, P less than 0.001) and 1.5 (95% confidence interval 1.2-1.8, P less than 0.001), respectively. There was a similar trend for systolic blood pressure, and odds ratios for the ile227 and ala357 alleles were 1.7 (95% confidence interval 1.2-2.3, P =0.002) and 1.3 (95% confidence interval 1.1-1.6, P =0.007), respectively, in men. DeStefano et al. (1998) identified a locus for orthostatic hypotension (OHDS; 143850) on chromosome 18q, with a peak lod score of 3.92 at D18S1367 in 2 linked families. The proximity of human UT2 makes it a potential candidate gene for this autosomal dominant disorder.

Full details of the abovementioned studies are described in the following publications, the disclosure of which are hereby incorporated by reference:

Ranade, K.; Wu, K.-W.; Hwu, C.-M.; Ting, C.-T.; Pei, D.; Pesich, R.; Hebert, J.; Chen, Y.-D. I.; Pratt, R.; Olshen, R.; Masaki, K.; Risch, N.; Cox, D. R.; Botstein, D.: Genetic variation in the human urea transporter-2 is associated with variation in blood pressure. Hum. Molec. Genet. 10:2157-2164, 2001; and DeStefano, A. L.; Baldwin, C. T.; Burzsty, M.; Gavras, I.; Handy, D. E.; Joost, O.; Martel, T.; Nicolaou, M.; Schwartz, F.; Streeten, D. H. P.; Farrer, L. A.; Gavras, H. : Autosomal domin.

Further studies establishing the function and utilities of SLC14A2 are found in John Hopkins OMIM database record ID 601611, and in cited publications listed in Table 5, which are hereby incorporated by reference. T-cell leukemia translocation altered gene (TCTA, Accession NM_022171.1) is another GAM97 target gene, herein designated TARGET GENE. TCTA BINDING SITE is a target binding site found in the 3' untranslated region of mRNA encoded by TCTA, corresponding to a target binding site such as BINDING SITE I, BINDING SITE II or BINDING SITE III of FIG. 8. Table 4 illustrates the complementarity of the nucleotide sequences of TCTA BINDING SITE, designated SEQ ID:681, to the nucleotide sequence of GAM97 RNA, herein designated GAM RNA, also designated SEQ ID:274.

Another function of GAM97 is therefore inhibition of T-cell leukemia translocation altered gene (TCTA, Accession NM_022171.1). Accordingly, utilities of GAM97 include diagnosis, prevention and treatment of diseases and clinical conditions associated with TCTA.

Zinc finger protein 33a (kox 31) (ZNF33A, Accession NM_006974.1) is another GAM97 target gene, herein designated TARGET GENE. ZNF33A BINDING SITE is a target binding site found in the 3' untranslated region of mRNA encoded by ZNF33A, corresponding to a target binding site such as BINDING SITE I, BINDING SITE II or BINDING SITE III of FIG. 8. Table 4 illustrates the complementarity of the nucleotide sequences of ZNF33A BINDING SITE, designated SEQ ID:11954, to the nucleotide sequence of GAM97 RNA, herein designated GAM RNA, also designated SEQ ID:274.

Another function of GAM97 is therefore inhibition of Zinc finger protein 33a (kox 31) (ZNF33A, Accession NM_006974.1). Accordingly, utilities of GAM97 include diagnosis, prevention and treatment of diseases and clinical conditions associated with ZNF33A.

Zinc finger protein 347 (ZNF347, Accession NM_032584.1) is another GAM97 target gene, herein designated TARGET GENE. ZNF347 BINDING SITE is a target binding site found in the 3' untranslated region of mRNA encoded by ZNF347, corresponding to a target binding site such as BINDING SITE I, BINDING SITE II or BINDING SITE III of FIG. 8. Table 4 illustrates the complementarity of the nucleotide sequences of ZNF347 BINDING SITE, designated SEQ ID:4168, to the nucleotide sequence of GAM97 RNA, herein designated GAM RNA, also designated SEQ ID:274.

Another function of GAM97 is therefore inhibition of Zinc finger protein 347 (ZNF347, Accession NM_032584.1). Accordingly, utilities of GAM97 include diagnosis, prevention and treatment of diseases and clinical conditions associated with ZNF347.

FIG. 8 further provides a conceptual description of a novel bioinformatically detected of the present invention, referred to here as Genomic Address Messenger 98 (GAM98), which modulates expression of respective target genes thereof, the function and utility of which target genes is known in the art.

GAM98 is a novel bioinformatically detected regulatory, non protein coding, micro RNA (miRNA) gene. The method by which GAM98 was detected is described hereinabove with reference to FIGS. 8-15.

GAM98 gene, herein designated GAM GENE, and GAM98 target gene, herein designated TARGET GENE, are human genes contained in the human genome.

GAM98 gene encodes a GAM98 precursor RNA, herein designated GAM PRECURSOR RNA. Similar to other miRNA genes, and unlike most ordinary genes, GAM98 precursor RNA does not encode a protein. A nucleotide sequence identical or highly similar to the nucleotide sequence of GAM98 precursor RNA is designated SEQ ID:61, and is provided hereinbelow with reference to the sequence listing part.

GAM98 precursor RNA folds onto itself, forming GAM98 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM98 precursor RNA folds onto itself, forming GAM98 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM98 precursor RNA, designated SEQ-ID:61, and a schematic representation of a predicted secondary folding of GAM98 folded precursor RNA are further described with reference to Table 2, hereby incorporated by reference.

An enzyme complex designated DICER COMPLEX, 'dices' the GAM98 folded precursor RNA into GAM98 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM98 RNA is designated SEQ ID:344, and is provided hereinbelow with references to the sequence listing part and Table 3, hereby incorporated by reference.

GAM98 target gene, herein designated TARGET GENE, encodes a corresponding messenger RNA, GAM98 target RNA, herein designated GAM TARGET RNA. GAM98 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM98 RNA, herein designated GAM RNA, binds complementarily to one or more target binding sites located in untranslated regions of GAM98 target RNA, herein designated GAM TARGET RNA. This complementary binding is due to the fact that the nucleotide sequence of GAM98 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM98 RNA may have a different number of target binding sites in untranslated regions of a GAM98 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM98 RNA, herein designated GAM RNA, to target binding sites on GAM98 target RNA, herein designated GAM TARGET RNA, such as BINDING SITE I, BINDING SITE II and BINDING SITE III, inhibits translation of GAM98 target RNA into GAM98 target protein, herein designated GAM TARGET PROTEIN. GAM target protein is therefore outlined by a broken line.

It is appreciated that GAM98 target gene, herein designated TARGET GENE, in fact represents a plurality of GAM98 target genes. The mRNA of each one of this plurality of GAM98 target genes comprises one or more target binding sites, each having a nucleotide sequence which is at least partly complementary to GAM98 RNA, herein designated GAM RNA, and which when bound by GAM98 RNA causes inhibition of translation of respective one or more GAM98 target proteins.

It is further appreciated by one skilled in the art that the mode of translational inhibition illustrated by FIG. 8 with specific reference to translational inhibition exerted by GAM98 gene, herein designated GAM GENE, on one or more GAM98 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM98 correlate with, and may be deduced from, the identity of the target genes which GAM98 binds and inhibits, and the function of these target genes, as elaborated hereinbelow.

Growth arrest-specific 7 (GAS7, Accession NM_005890.1) is a GAM98 target gene, herein designated TARGET GENE. GAS7 BINDING SITE is a target binding site found in the 3' untranslated region of multiple transcripts of mRNA encoded by GAS7, corresponding to a target binding site such as BINDING SITE I, BINDING SITE II or BINDING SITE III of FIG. 8. Table 4 illustrates the complementarity of the nucleotide sequences of GAS7 BINDING SITE, designated SEQ ID:8289, to the nucleotide sequence of GAM98 RNA, herein designated GAM RNA, also designated SEQ ID:344.

A function of GAM98 is therefore inhibition of Growth arrest-specific 7 (GAS7, Accession NM_005890.1), a gene which may play a role in promoting maturation and morphological differentiation of cerebellar neurons. and therefore may be associated with Leukemias with myeloid/lymphoid (mll). Accordingly, utilities of GAM98 include diagnosis, prevention and treatment of Leukemias with myeloid/lymphoid (mll), and of other diseases and clinical conditions associated with GAS7.

The function of GAS7 and its association with various diseases and clinical conditions, has been established by previous studies, as described hereinabove with reference to GAM72.1. LOC254685 (Accession) is another GAM98 target gene, herein designated TARGET GENE. LOC254685 BINDING SITE is a target binding site found in the 5' untranslated region of mRNA encoded by LOC254685, corresponding to a target binding site such as BINDING SITE I, BINDING SITE II or BINDING SITE III of FIG. 8. Table 4 illustrates the complementarity of the nucleotide sequences of LOC254685 BINDING SITE, designated SEQ ID:19570, to the nucleotide sequence of GAM98 RNA, herein designated GAM RNA, also designated SEQ ID:344.

Another function of GAM98 is therefore inhibition of LOC254685 (Accession). Accordingly, utilities of GAM98 include diagnosis, prevention and treatment of diseases and clinical conditions associated with LOC254685.

LOC96597 (Accession XM_039922.2) is another GAM98 target gene, herein designated TARGET GENE. LOC96597 BINDING SITE is a target binding site found in the 3' untranslated region of mRNA encoded by LOC96597, corresponding to a target binding site such as BINDING SITE I, BINDING SITE II or BINDING SITE III of FIG. 8. Table 4 illustrates the complementarity of the nucleotide sequences of LOC96597 BINDING SITE, designated SEQ ID:7069, to the nucleotide sequence of GAM98 RNA, herein designated GAM RNA, also designated SEQ ID:344.

Another function of GAM98 is therefore inhibition of LOC96597 (Accession XM_039922.2). Accordingly, utilities of GAM98 include diagnosis, prevention and treatment of diseases and clinical conditions associated with LOC96597.

Solute carrier family 7 (cationic amino acid transporter, y+ system), member 5 (SLC7A5, Accession NM_003486.2) is another GAM98 target gene, herein designated TARGET GENE. SLC7A5 BINDING SITE is a target binding site found in the 3' untranslated region of mRNA encoded by SLC7A5, corresponding to a target binding site such as BINDING SITE I, BINDING SITE II or BINDING SITE III of FIG. 8. Table 4 illustrates the complementarity of the nucleotide sequences of SLC7A5 BINDING SITE, designated SEQ ID:6778, to the nucleotide sequence of GAM98 RNA, herein designated GAM RNA, also designated SEQ ID:344.

Another function of GAM98 is therefore inhibition of Solute carrier family 7 (cationic amino acid transporter, y+ system), member 5 (SLC7A5, Accession NM_003486.2), a gene which mediates transport of large and small neutral amino acids. Accordingly, utilities of GAM98 include diagnosis, prevention and treatment of diseases and clinical conditions associated with SLC7A5.

The function of SLC7A5 has been established by previous studies. Gaugitsch et al. (1992) cloned a partial human E16 cDNA sequence that was expressed in activated lymphocytes. It was cloned by virtue of its AUUUA rapid degradation signal. Kanai et al. (1998) used expression cloning to isolate a rat cDNA termed LAT1. They showed that LAT1 encoded a protein necessary for system L amino acid transport, thought to be a major route by which cells import large neutral amino acids with branched or aromatic side chains. Mastroberardino et al. (1998) identified the human E16 protein (AF077866) as the first light chain of 4F2 (OMIM Ref. No. 158070), a cell surface glycoprotein, and showed that the resulting heterodimeric complex mediates L-type amino acid transport. Maglott et al. (1994) mapped a gene fragment, EST00889 (OMIM Ref. No. M78741), to chromosome 16 (D16S469E). The map position was refined to 16q24.3 by use of a panel of mouse/human somatic cell hybrids. Maglott et al. (1994) showed that the gene is expressed abundantly in adult lung and liver, and is also expressed in human brain, thymus, retina, and some other tissues.

Full details of the abovementioned studies are described in the following publications, the disclosure of which are hereby incorporated by reference:

Mastroberardino, L.; Spindler, B.; Pfeiffer, R.; Skelly, P. J.; Loffing, J.; Shoemaker, C. B.; Verrey, F.: Amino-acid transport by heterodimers of 4F2hc/CD98 and members of a permease family. Nature 395:288-291, 1998; and Maglott, D. R.; Durkin, A. S.; Lane, S. A.; Callen, D. F.; Feldblyum, T. V.; Nierman, W. C.: The gene for membrane protein E16 (D16S469E) maps to human chromosome 16q24.3 and is expressed.

Further studies establishing the function and utilities of SLC7A5 are found in John Hopkins OMIM database record ID 600182, and in cited publications listed in Table 5, which are hereby incorporated by reference.

FIG. 8 further provides a conceptual description of a novel bioinformatically detected of the present invention, referred to here as Genomic Address Messenger 99 (GAM99), which modulates expression of respective target genes thereof, the function and utility of which target genes is known in the art.

GAM99 is a novel bioinformatically detected regulatory, non protein coding, micro RNA (miRNA) gene. The method by which GAM99 was detected is described hereinabove with reference to FIGS. 8-15.

GAM99 gene, herein designated GAM GENE, and GAM99 target gene, herein designated TARGET GENE, are human genes contained in the human genome.

GAM99 gene encodes a GAM99 precursor RNA, herein designated GAM PRECURSOR RNA. Similar to other miRNA genes, and unlike most ordinary genes, GAM99 precursor RNA does not encode a protein. A nucleotide sequence identical or highly similar to the nucleotide sequence of GAM99 precursor RNA is designated SEQ ID:135, and is provided hereinbelow with reference to the sequence listing part. Nucleotide sequence SEQ ID:135 is located at position 15 relative to chromosome 10.

GAM99 precursor RNA folds onto itself, forming GAM99 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM99 precursor RNA folds onto itself, forming GAM99 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM99 precursor RNA, designated SEQ-ID:135, and a schematic representation of a predicted secondary folding of GAM99 folded precursor RNA are further described with reference to Table 2, hereby incorporated by reference.

An enzyme complex designated DICER COMPLEX, 'dices' the GAM99 folded precursor RNA into GAM99 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM99 RNA is designated SEQ ID:320, and is provided hereinbelow with references to the sequence listing part and Table 3, hereby incorporated by reference.

GAM99 target gene, herein designated TARGET GENE, encodes a corresponding messenger RNA, GAM99 target RNA, herein designated GAM TARGET RNA. GAM99 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM99 RNA, herein designated GAM RNA, binds complementarily to one or more target binding sites located in untranslated regions of GAM99 target RNA, herein designated GAM TARGET RNA. This complementary binding is due to the fact that the nucleotide sequence of GAM99 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM99 RNA may have a different number of target binding sites in untranslated regions of a GAM99 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM99 RNA, herein designated GAM RNA, to target binding sites on GAM99 target RNA, herein designated GAM TARGET RNA, such as BINDING SITE I, BINDING SITE II and BINDING SITE III, inhibits translation of GAM99 target RNA into GAM99 target protein, herein designated GAM TARGET PROTEIN. GAM target protein is therefore outlined by a broken line.

It is appreciated that GAM99 target gene, herein designated TARGET GENE, in fact represents a plurality of GAM99 target genes. The mRNA of each one of this plurality of GAM99 target genes comprises one or more target binding sites, each having a nucleotide sequence which is at least partly complementary to GAM99 RNA, herein designated GAM RNA, and which when bound by GAM99 RNA causes inhibition of translation of respective one or more GAM99 target proteins.

It is further appreciated by one skilled in the art that the mode of translational inhibition illustrated by FIG. 8 with specific reference to translational inhibition exerted by GAM99 gene, herein designated GAM GENE, on one or more GAM99 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM99 correlate with, and may be deduced from, the identity of the target genes which GAM99 binds and inhibits, and the function of these target genes, as elaborated hereinbelow.

Actin, alpha, cardiac muscle (ACTC, Accession NP_005150.1) is a GAM99 target gene, herein designated TARGET GENE. ACTC BINDING SITE is a target binding site found in the 3' untranslated region of mRNA encoded by ACTC, corresponding to a target binding site such as BINDING SITE I, BINDING SITE II or BINDING SITE III of FIG. 8. Table 4 illustrates the complementarity of the nucleotide sequences of ACTC BINDING SITE, designated SEQ ID:17458, to the nucleotide sequence of GAM99 RNA, herein designated GAM RNA, also designated SEQ ID:320.

A function of GAM99 is therefore inhibition of Actin, alpha, cardiac muscle (ACTC, Accession NP_005150.1), a gene which Actin of cells including muscle and therefore may be associated with Idiopathic dilated cardiomyopathy (idc), and of familial hypertrophic cardiomyopathy (fhc). Accordingly, utilities of GAM99 include diagnosis, prevention and treatment of Idiopathic dilated cardiomyopathy (idc), and of familial hypertrophic cardiomyopathy (fhc), and of other diseases and clinical conditions associated with ACTC.

The function of ACTC has been established by previous studies. Actin has been identified in many kinds of cells including muscle, where it is a major constituent of the thin filament, and platelets. Muscle actins from sources as diverse as rabbits and fish are very similar in amino acid sequence. Elzinga et al. (1976) examined whether actin in different tissues of the same organism are products of the same gene. They found that human platelet and human cardiac actins differ by one amino acid, viz., threonine and valine, respectively, at position 129. Thus they must be determined by different genes. Actins can be separated by isoelectric focusing into 3 main groups which show more than 90% homology of amino acid sequence. Firtel (1981) referred to the actin of smooth muscle, the most acidic form, as alpha type and the 2 cytoplasmic forms as beta and gamma. Beta and gamma actins are involved in the cytoskeleton and in internal cell mobility phenomena. The actins constitute multiple gene families. There is only a 4% amino acid difference in the actins of Physarum and mammals. In mammals, 4 different muscle actins have been sequenced: from fast muscle, heart, aorta, and stomach. These vary only by 4 to 6 amino acids from each other, and by about 25 amino acids from the beta and gamma actins. Thus, from the protein data, at least 6 actin genes would be expected in mammals. Recombinant DNA probes for both actin and myosin of the mouse have been made (Weydert et al., 1981). Because actin is a highly conserved protein, Engel et al. (1981) could use cloned actin genes from Drosophila and from chicken to isolate 12 actin gene fragments from a human DNA library. Restriction endonuclease studies of each indicated that they are not allelic and are from nonoverlapping regions of the genome. In all, 25 to 30 EcoRI fragments homologous to actin genes were found in the human genome and no restriction site polymorphism was found indicating evolutionary conservatism. Humphries et al. (1981) used probes from the mouse to detect actin genes in human DNA and concluded that there are about 20 actin genes in the human genome. Three lines of evidence supported this number: the rate of hybridization of the mouse probe with human DNA; the fact that the probe hybridizes to 17-20 bands in Southern blots of restriction enzyme digests of total human DNA; restriction enzyme mapping of individual human actin genes indicating at least 9 different genes, judged on probability grounds to have been picked from a pool of at least 20. Litt and Luty (1989) used PCR to amplify a microsatellite hypervariable repeat in the human cardiac actin gene. They detected 12 different allelic fragments in 37 unrelated individuals, of whom 32 were heterozygous. (Weber and May (1989) also found that (GT)n repeats within human loci are highly polymorphic.) In vertebrates, 6 actin isoforms are known:4 muscle types (skeletal, cardiac, and 2 smooth muscle types) and 2 nonmuscle types (cytoplasmic actins). In a 36-year-old mother and 2 daughters, aged 5 and 2 years, of German ancestry who had CMD (see OMIM Ref. No. 115200), Olson et al. (1998) found a G- to - A substitution in codon 312 in exon 5 of the ACTC gene, resulting in an arg312- to - his (R312H) amino acid substitution. A 15-year-old son likewise had inherited the mutation but had not developed CMD.

Full details of the abovementioned studies are described in the following publications, the disclosure of which are hereby incorporated by reference:

Weber, J. L.; May, P. E.: Abundant class of human DNA polymorphisms which can be typed using the polymerase chain reaction. Am. J. Hum. Genet. 44:388-396, 1989; and Olson, T. M.; Michels, V. V.; Thibodeau, S. N.; Tai, Y.-S.; Keating, M. T.: Actin mutations in dilated cardiomyopathy, a heritable form of heart failure. Science 280:750-752, 1998.

Further studies establishing the function and utilities of ACTC are found in John Hopkins OMIM database record ID 102540, and in cited publications listed in Table 5, which are hereby incorporated by reference. AD-020 (Accession NP_064526.1) is another GAM99 target gene, herein designated TARGET GENE. AD-020 BINDING SITE is a target binding site found in the 3' untranslated region of mRNA encoded by AD-020, corresponding to a target binding site such as BINDING SITE I, BINDING SITE II or BINDING SITE III of FIG. 8. Table 4 illustrates the complementarity of the nucleotide sequences of AD-020 BINDING SITE, designated SEQ ID:9059, to the nucleotide sequence of GAM99 RNA, herein designated GAM RNA, also designated SEQ ID:320.

Another function of GAM99 is therefore inhibition of AD-020 (Accession NP_064526.1). Accordingly, utilities of GAM99 include diagnosis, prevention and treatment of diseases and clinical conditions associated with AD-020.

A kinase (prka) anchor protein 2 (AKAP2, Accession NP_009134.1) is another GAM99 target gene, herein designated TARGET GENE. AKAP2 BINDING SITE is a target binding site found in the 3' untranslated region of multiple transcripts of mRNA encoded by AKAP2, corresponding to a target binding site such as BINDING SITE I, BINDING SITE II or BINDING SITE III of FIG. 8. Table 4 illustrates the complementarity of the nucleotide sequences of AKAP2 BINDING SITE, designated SEQ ID:17496, to the nucleotide sequence of GAM99 RNA, herein designated GAM RNA, also designated SEQ ID:320.

Another function of GAM99 is therefore inhibition of A kinase (prka) anchor protein 2 (AKAP2, Accession NP_009134.1), a gene which binds to regulatory subunit (rii) of protein kinase a. Accordingly, utilities of GAM99 include diagnosis, prevention and treatment of diseases and clinical conditions associated with AKAP2.

The function of AKAP2 and its association with various diseases and clinical conditions, has been established by previous studies, as described hereinabove with reference to GAM94.1. Aspartoacylase (aminoacylase 2, canavan disease) (ASPA, Accession NP_000040.1) is another GAM99 target gene, herein designated TARGET GENE. ASPA BINDING SITE is a target binding site found in the 3' untranslated region of mRNA encoded by ASPA, corresponding to a target binding site such as BINDING SITE I, BINDING SITE II or BINDING SITE III of FIG. 8. Table 4 illustrates the complementarity of the nucleotide sequences of ASPA BINDING SITE, designated SEQ ID:13895, to the nucleotide sequence of GAM99 RNA, herein designated GAM RNA, also designated SEQ ID:320.

Another function of GAM99 is therefore inhibition of Aspartoacylase (aminoacylase 2, canavan disease) (ASPA, Accession NP_000040.1). Accordingly, utilities of GAM99 include diagnosis, prevention and treatment of diseases and clinical conditions associated with ASPA.

B7 (Accession NP_008923.1) is another GAM99 target gene, herein designated TARGET GENE. B7 BINDING SITE is a target binding site found in the 5' untranslated region of multiple transcripts of mRNA encoded by B7, corresponding to a target binding site such as BINDING SITE I, BINDING SITE II or BINDING SITE III of FIG. 8. Table 4 illustrates the complementarity of the nucleotide sequences of B7 BINDING SITE, designated SEQ ID:11263, to the nucleotide sequence of GAM99 RNA, herein designated GAM RNA, also designated SEQ ID:320.

Another function of GAM99 is therefore inhibition of B7 (Accession NP_008923.1). Accordingly, utilities of GAM99 include diagnosis, prevention and treatment of diseases and clinical conditions associated with B7.

BASE (Accession NP_776258.1) is another GAM99 target gene, herein designated TARGET GENE. BASE BINDING SITE is a target binding site found in the 3' untranslated region of mRNA encoded by BASE, corresponding to a target binding site such as BINDING SITE I, BINDING SITE II or BINDING SITE III of FIG. 8. Table 4 illustrates the complementarity of the nucleotide sequences of BASE BINDING SITE, designated SEQ ID:13840, to the nucleotide sequence of GAM99 RNA, herein designated GAM RNA, also designated SEQ ID:320.

Another function of GAM99 is therefore inhibition of BASE (Accession NP_776258.1). Accordingly, utilities of GAM99 include diagnosis, prevention and treatment of diseases and clinical conditions associated with BASE.

Basic leucine zipper and w2 domains 2 (BZW2, Accession NP_054757.1) is another GAM99 target gene, herein designated TARGET GENE. BZW2 BINDING SITE is a target binding site found in the 3' untranslated region of mRNA encoded by BZW2, corresponding to a target binding site such as BINDING SITE I, BINDING SITE II or BINDING SITE III of FIG. 8. Table 4 illustrates the complementarity of the nucleotide sequences of BZW2 BINDING SITE, designated SEQ ID:2127, to the nucleotide sequence of GAM99 RNA, herein designated GAM RNA, also designated SEQ ID:320.

Another function of GAM99 is therefore inhibition of Basic leucine zipper and w2 domains 2 (BZW2, Accession NP_054757.1). Accordingly, utilities of GAM99 include diagnosis, prevention and treatment of diseases and clinical conditions associated with BZW2.

C14orf135 (Accession NP_071940.2) is another GAM99 target gene, herein designated TARGET GENE. C14orf135 BINDING SITE is a target binding site found in the 5' untranslated region of mRNA encoded by C14orf135, corresponding to a target binding site such as BINDING SITE I, BINDING SITE II or BINDING SITE III of FIG. 8. Table 4 illustrates the complementarity of the nucleotide sequences of C14orf135 BINDING SITE, designated SEQ ID:8362, to the nucleotide sequence of GAM99 RNA, herein designated GAM RNA, also designated SEQ ID:320.

Another function of GAM99 is therefore inhibition of C14orf135 (Accession NP_071940.2). Accordingly, utilities of GAM99 include diagnosis, prevention and treatment of diseases and clinical conditions associated with C14orf135.

Chromosome 15 open reading frame 5 (C15orf5, Accession NP_112206.1) is another GAM99 target gene, herein designated TARGET GENE. C15orf5 BINDING SITE is a target binding site found in the 3' untranslated region of mRNA encoded by C15orf5, corresponding to a target binding site such as BINDING SITE I, BINDING SITE II or BINDING SITE III of FIG. 8. Table 4 illustrates the complementarity of the nucleotide sequences of C15orf5 BINDING SITE, designated SEQ ID:5753, to the nucleotide sequence of GAM99 RNA, herein designated GAM RNA, also designated SEQ ID:320.

Another function of GAM99 is therefore inhibition of Chromosome 15 open reading frame 5 (C15orf5, Accession NP_112206.1). Accordingly, utilities of GAM99 include diagnosis, prevention and treatment of diseases and clinical conditions associated with C15orf5.

Chromosome 1 open reading frame 24 (C1orf24, Accession NP_443198.1) is another GAM99 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:19182, to the nucleotide sequence of GAM99 RNA, herein designated GAM RNA, also designated SEQ ID:320.

Another function of GAM99 is therefore inhibition of Chromosome 1 open reading frame 24 (C1orf24, Accession NP_443198.1). Accordingly, utilities of GAM99 include diagnosis, prevention and treatment of diseases and clinical conditions associated with C1orf24.

Complement component 1, q subcomponent, receptor 1 (C1QR1, Accession NP_036204.1) is another GAM99 target gene, herein designated TARGET GENE. C1QR1 BINDING SITE is a target binding site found in the 3' untranslated region of mRNA encoded by C1QR1, corresponding to a target binding site such as BINDING SITE I, BINDING SITE II or BINDING SITE III of FIG. 8. Table 4 illustrates the complementarity of the nucleotide sequences of C1QR1 BINDING SITE, designated SEQ ID:4397, to the nucleotide sequence of GAM99 RNA, herein designated GAM RNA, also designated SEQ ID:320.

Another function of GAM99 is therefore inhibition of Complement component 1, q subcomponent, receptor 1 (C1QR1, Accession NP_036204.1). Accordingly, utilities of GAM99 include diagnosis, prevention and treatment of diseases and clinical conditions associated with C1QR1.

Chromosome 20 open reading frame 103 (C20orf103, Accession NP_036393.1) is another GAM99 target gene, herein designated TARGET GENE. C20orf103 BINDING SITE1 and C20orf103 BINDING SITE2 are target binding sites found in untranslated regions of mRNA encoded by C20orf103, corresponding to target binding sites such as BINDING SITE I, BINDING SITE II or BINDING SITE III of FIG. 8. Table 4 illustrates the complementarity of the nucleotide sequences of C20orf103 BINDING SITE1 and C20orf103 BINDING SITE2, designated SEQ ID:3291 and SEQ ID:1178 respectively, to the nucleotide sequence of GAM99 RNA, herein designated GAM RNA, also designated SEQ ID:320.

Another function of GAM99 is therefore inhibition of Chromosome 20 open reading frame 103 (C20orf103, Accession NP_036393.1). Accordingly, utilities of GAM99 include diagnosis, prevention and treatment of diseases and clinical conditions associated with C20orf103.

Chromosome 20 open reading frame 45 (C20orf45, Accession NP_057129.1) is another GAM99 target gene, herein designated TARGET GENE. C20orf45 BINDING SITE is a target binding site found in the 3' untranslated region of mRNA encoded by C20orf45, corresponding to a target binding site such as BINDING SITE I, BINDING SITE II or BINDING SITE III of FIG. 8. Table 4 illustrates the complementarity of the nucleotide sequences of C20orf45 BINDING SITE, designated SEQ ID:18788, to the nucleotide sequence of GAM99 RNA, herein designated GAM RNA, also designated SEQ ID:320.

Another function of GAM99 is therefore inhibition of Chromosome 20 open reading frame 45 (C20orf45, Accession NP_057129.1). Accordingly, utilities of GAM99 include diagnosis, prevention and treatment of diseases and clinical conditions associated with C20orf45.

Chromosome 20 open reading frame 55 (C20orf55, Accession NP_113612.1) is another GAM99 target gene, herein designated TARGET GENE. C20orf55 BINDING SITE is a target binding site found in the 5' untranslated region of mRNA encoded by C20orf55, corresponding to a target binding site such as BINDING SITE I, BINDING SITE II or BINDING SITE III of FIG. 8. Table 4 illustrates the complementarity of the nucleotide sequences of C20orf55 BINDING SITE, designated SEQ ID:481, to the nucleotide sequence of GAM99 RNA, herein designated GAM RNA, also designated SEQ ID:320.

Another function of GAM99 is therefore inhibition of Chromosome 20 open reading frame 55 (C20orf55, Accession NP_113612.1). Accordingly, utilities of GAM99 include diagnosis, prevention and treatment of diseases and clinical conditions associated with C20orf55.

Chromosome 21 open reading frame 67 (C21orf67, Accession NP_478068.1) is another GAM99 target gene, herein designated TARGET GENE. C21orf67 BINDING SITE is a target binding site found in the 3' untranslated region of mRNA encoded by C21orf67, corresponding to a target binding site such as BINDING SITE I, BINDING SITE II or BINDING SITE III of FIG. 8. Table 4 illustrates the complementarity of the nucleotide sequences of C21orf67 BINDING SITE, designated SEQ ID:531, to the nucleotide sequence of GAM99 RNA, herein designated GAM RNA, also designated SEQ ID:320.

Another function of GAM99 is therefore inhibition of Chromosome 21 open reading frame 67 (C21orf67, Accession NP_478068.1). Accordingly, utilities of GAM99 include diagnosis, prevention and treatment of diseases and clinical conditions associated with C21orf67.

CAB2 (Accession NP_219487.2) is another GAM99 target gene, herein designated TARGET GENE. CAB2 BINDING SITE is a target binding site found in the 3' untranslated region of mRNA encoded by CAB2, corresponding to a target binding site such as BINDING SITE I, BINDING SITE II or BINDING SITE III of FIG. 8. Table 4 illustrates the complementarity of the nucleotide sequences of CAB2 BINDING SITE, designated SEQ ID:17481, to the nucleotide sequence of GAM99 RNA, herein designated GAM RNA, also designated SEQ ID:320.

Another function of GAM99 is therefore inhibition of CAB2 (Accession NP_219487.2). Accordingly, utilities of GAM99 include diagnosis, prevention and treatment of diseases and clinical conditions associated with CAB2.

Cysteine conjugate-beta lyase; cytoplasmic (glutamine transaminase k, kyneurenine aminotransferase) (CCBL1, Accession NP_004050.1) is another GAM99 target gene, herein designated TARGET GENE. CCBL1 BINDING SITE is a target binding site found in the 3' untranslated region of mRNA encoded by CCBL1, corresponding to a target binding site such as BINDING SITE I, BINDING SITE II or BINDING SITE III of FIG. 8. Table 4 illustrates the complementarity of the nucleotide sequences of CCBL1 BINDING SITE, designated SEQ ID:8720, to the nucleotide sequence of GAM99 RNA, herein designated GAM RNA, also designated SEQ ID:320.

Another function of GAM99 is therefore inhibition of Cysteine conjugate-beta lyase; cytoplasmic (glutamine transaminase k, kyneurenine aminotransferase) (CCBL1, Accession NP_004050.1). Accordingly, utilities of GAM99 include diagnosis, prevention and treatment of diseases and clinical conditions associated with CCBL1.

Cdc14 cell division cycle 14 homolog b (s. cerevisiae) (CDC14B, Accession NP_201588.1) is another GAM99 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:12278, to the nucleotide sequence of GAM99 RNA, herein designated GAM RNA, also designated SEQ ID:320.

Another function of GAM99 is therefore inhibition of Cdc14 cell division cycle 14 homolog b (s. cerevisiae) (CDC14B, Accession NP_201588.1). Accordingly, utilities of GAM99 include diagnosis, prevention and treatment of diseases and clinical conditions associated with CDC14B.

Cdc14 cell division cycle 14 homolog b (s. cerevisiae) (CDC14B, Accession NP_003662.1) is another GAM99 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:12278, to the nucleotide sequence of GAM99 RNA, herein designated GAM RNA, also designated SEQ ID:320.

Another function of GAM99 is therefore inhibition of Cdc14 cell division cycle 14 homolog b (s. cerevisiae) (CDC14B, Accession NP_003662.1). Accordingly, utilities of GAM99 include diagnosis, prevention and treatment of diseases and clinical conditions associated with CDC14B.

Choline kinase-like (CHKL, Accession NP_689466.1) is another GAM99 target gene, herein designated TARGET GENE. CHKL BINDING SITE is a target binding site found in the 3' untranslated region of multiple transcripts of mRNA encoded by CHKL, corresponding to a target binding site such as BINDING SITE I, BINDING SITE II or BINDING SITE III of FIG. 8. Table 4 illustrates the complementarity of the nucleotide sequences of CHKL BINDING SITE, designated SEQ ID:15506, to the nucleotide sequence of GAM99 RNA, herein designated GAM RNA, also designated SEQ ID:320.

Another function of GAM99 is therefore inhibition of Choline kinase-like (CHKL, Accession NP_689466.1). Accordingly, utilities of GAM99 include diagnosis, prevention and treatment of diseases and clinical conditions associated with CHKL.

Copine vi (neuronal) (CPNE6, Accession NP_006023.1) is another GAM99 target gene, herein designated TARGET GENE. CPNE6 BINDING SITE is a target binding site found in the 3' untranslated region of mRNA encoded by CPNE6, corresponding to a target binding site such as BINDING SITE I, BINDING SITE II or BINDING SITE III of FIG. 8. Table 4 illustrates the complementarity of the nucleotide sequences of CPNE6 BINDING SITE, designated SEQ ID:15300, to the nucleotide sequence of GAM99 RNA, herein designated GAM RNA, also designated SEQ ID:320.

Another function of GAM99 is therefore inhibition of Copine vi (neuronal) (CPNE6, Accession NP_006023.1), a gene which may have a role in membrane trafficking. Accordingly, utilities of GAM99 include diagnosis, prevention and treatment of diseases and clinical conditions associated with CPNE6.

The function of CPNE6 has been established by previous studies. Using a 2-dimensional cDNA display system, restriction landmark cDNA scanning, Nakayama et al. (1998) isolated copine VI, which they designated N-copine, from mouse and human brain cDNA libraries. The human cDNA encodes a 557-amino acid protein. Like copine I, copine VI contains 2 C2 domains in the N terminus that show greater similarity to those of PLC-gamma (see OMIM Ref. No. 172420) rather than those of double C2 domain proteins. Northern blot analysis detected a 2.2-kb transcript in brain only. By in situ hybridization, Nakayama et al. (1998) demonstrated that expression of CPNE6 is upregulated by neuronal activity such as kainate stimulation. The authors suggested that CPNE6 may play a role in synaptic plasticity. In further in situ hybridization studies in mouse, Nakayama et al. (1999) demonstrated that CPNE6 is expressed exclusively in neurons of the hippocampus and in the main and accessory olfactory bulbs, where various forms of synaptic plasticity and memory formation occur. Immunohistochemical studies detected CPNE6 mainly in the cell bodies and dentrites in the neurons, suggesting that CPNE6 has a role in postsynaptic events, in contrast to the presynaptic roles of the double C2 domain proteins. A GST-fusion protein with the second C2 domain of copine VI showed calcium-dependent binding to phosphatidylserine, indicating that this domain is responsible for the calcium-dependent association of copine VI with the membrane Full details of the abovementioned studies are described in the following publications, the disclosure of which are hereby incorporated by reference:

Nakayama, T.; Yaoi, T.; Kuwajima, G.: Localization and subcellular distribution of N-copine in mouse brain. J. Neurochem. 72:373-379, 1999; and Nakayama, T.; Yaoi, Y.; Yasui, M.; Kuwajima, G.: N-copine: a novel two C2- domain-containing protein with neuronal activity-regulated expression. FEBS Lett. 428:80-84, 1998.

Further studies establishing the function and utilities of CPNE6 are found in John Hopkins OMIM database record ID 605688, and in cited publications listed in Table 5, which are hereby incorporated by reference. Carnitine palmitoyltransferase 1b (muscle) (CPT1B, Accession NP_689453.1) is another GAM99 target gene, herein designated TARGET GENE. CPT1B BINDING SITE is a target binding site found in the 3' untranslated region of multiple transcripts of mRNA encoded by CPT1B, corresponding to a target binding site such as BINDING SITE I, BINDING SITE II or BINDING SITE III of FIG. 8. Table 4 illustrates the complementarity of the nucleotide sequences of CPT1B BINDING SITE, designated SEQ ID:15506, to the nucleotide sequence of GAM99 RNA, herein designated GAM RNA, also designated SEQ ID:320.

Another function of GAM99 is therefore inhibition of Carnitine palmitoyltransferase 1b (muscle) (CPT1B, Accession NP_689453.1), a gene which is a rate-controlling enzyme of long-chain fatty acid b-oxidation pathway. Accordingly, utilities of GAM99 include diagnosis, prevention and treatment of diseases and clinical conditions associated with CPT1B.

The function of CPT1B and its association with various diseases and clinical conditions, has been established by previous studies, as described hereinabove with reference to GAM47.1. Cathepsin k (pycnodysostosis) (CTSK, Accession NP_000387.1) is another GAM99 target gene, herein designated TARGET GENE. CTSK BINDING SITE is a target binding site found in the 3' untranslated region of mRNA encoded by CTSK, corresponding to a target binding site such as BINDING SITE I, BINDING SITE II or BINDING SITE III of FIG. 8. Table 4 illustrates the complementarity of the nucleotide sequences of CTSK BINDING SITE, designated SEQ ID:5778, to the nucleotide sequence of GAM99 RNA, herein designated GAM RNA, also designated SEQ ID:320.

Another function of GAM99 is therefore inhibition of Cathepsin k (pycnodysostosis) (CTSK, Accession NP_000387.1). Accordingly, utilities of GAM99 include diagnosis, prevention and treatment of diseases and clinical conditions associated with CTSK.

Chemokine (c-x3-c motif) receptor 1 (CX3CR1, Accession NP_001328.1) is another GAM99 target gene, herein designated TARGET GENE. CX3CR1 BINDING SITE is a target binding site found in the 3' untranslated region of mRNA encoded by CX3CR1, corresponding to a target binding site such as BINDING SITE I, BINDING SITE II or BINDING SITE III of FIG. 8. Table 4 illustrates the complementarity of the nucleotide sequences of CX3CR1 BINDING SITE, designated SEQ ID:15434, to the nucleotide sequence of GAM99 RNA, herein designated GAM RNA, also designated SEQ ID:320.

Another function of GAM99 is therefore inhibition of Chemokine (c-x3-c motif) receptor 1 (CX3CR1, Accession NP_001328.1), a gene which mediates both the adhesive and migratory functions of fractalkine and therefore may be associated with Human immunodeficiency virus type 1. Accordingly, utilities of GAM99 include diagnosis, prevention and treatment of Human immunodeficiency virus type 1., and of other diseases and clinical conditions associated with CX3CR1.

The function of CX3CR1 and its association with various diseases and clinical conditions, has been established by previous studies, as described hereinabove with reference to GAM44.1. Chemokine (c-x-c motif) ligand 9 (CXCL9, Accession NP_002407.1) is another GAM99 target gene, herein designated TARGET GENE. CXCL9 BINDING SITE is a target binding site found in the 3' untranslated region of mRNA encoded by CXCL9, corresponding to a target binding site such as BINDING SITE I, BINDING SITE II or BINDING SITE III of FIG. 8. Table 4 illustrates the complementarity of the nucleotide sequences of CXCL9 BINDING SITE, designated SEQ ID:5355, to the nucleotide sequence of GAM99 RNA, herein designated GAM RNA, also designated SEQ ID:320.

Another function of GAM99 is therefore inhibition of Chemokine (c-x-c motif) ligand 9 (CXCL9, Accession NP_002407.1). Accordingly, utilities of GAM99 include diagnosis, prevention and treatment of diseases and clinical conditions associated with CXCL9.

CYP20A1 (Accession NP_065725.2) is another GAM99 target gene, herein designated TARGET GENE. CYP20A1 BINDING SITE is a target binding site found in the 3' untranslated region of multiple transcripts of mRNA encoded by CYP20A1, corresponding to a target binding site such as BINDING SITE I, BINDING SITE II or BINDING SITE III of FIG. 8. Table 4 illustrates the complementarity of the nucleotide sequences of CYP20A1 BINDING SITE, designated SEQ ID:6915, to the nucleotide sequence of GAM99 RNA, herein designated GAM RNA, also designated SEQ ID:320.

Another function of GAM99 is therefore inhibition of CYP20A1 (Accession NP_065725.2). Accordingly, utilities of GAM99 include diagnosis, prevention and treatment of diseases and clinical conditions associated with CYP20A1.

DARP (Accession NP_659431.3) is another GAM99 target gene, herein designated TARGET GENE. DARP BINDING SITE is a target binding site found in the 3' untranslated region of mRNA encoded by DARP, corresponding to a target binding site such as BINDING SITE I, BINDING SITE II or BINDING SITE III of FIG. 8. Table 4 illustrates the complementarity of the nucleotide sequences of DARP BINDING SITE, designated SEQ ID:10261, to the nucleotide sequence of GAM99 RNA, herein designated GAM RNA, also designated SEQ ID:320.

Another function of GAM99 is therefore inhibition of DARP (Accession NP_659431.3). Accordingly, utilities of GAM99 include diagnosis, prevention and treatment of diseases and clinical conditions associated with DARP.

Dynactin 1 (p150, glued homolog, drosophila) (DCTN1, Accession NP_004073.2) is another GAM99 target gene, herein designated TARGET GENE. DCTN1 BINDING SITE is a target binding site found in the 5' untranslated region of multiple transcripts of mRNA encoded by DCTN1, corresponding to a target binding site such as BINDING SITE I, BINDING SITE II or BINDING SITE III of FIG. 8. Table 4 illustrates the complementarity of the nucleotide sequences of DCTN1 BINDING SITE, designated SEQ ID:11619, to the nucleotide sequence of GAM99 RNA, herein designated GAM RNA, also designated SEQ ID:320.

Another function of GAM99 is therefore inhibition of Dynactin 1 (p150, glued homolog, drosophila) (DCTN1, Accession NP_004073.2), a gene which is a microtubule-based biologic motor protein. Accordingly, utilities of GAM99 include diagnosis, prevention and treatment of diseases and clinical conditions associated with DCTN1.

The function of DCTN1 and its association with various diseases and clinical conditions, has been established by previous studies, as described hereinabove with reference to GAM47.1. Deiodinase, iodothyronine, type i (DIO1, Accession NP_000783.2) is another GAM99 target gene, herein designated TARGET GENE. DIO1 BINDING SITE1 and DIO1 BINDING SITE2 are target binding sites found in untranslated regions of mRNA encoded by DIO1, corresponding to target binding sites such as BINDING SITE I, BINDING SITE II or BINDING SITE III of FIG. 8. Table 4 illustrates the complementarity of the nucleotide sequences of DIO1 BINDING SITE1 and DIO1 BINDING SITE2, designated SEQ ID:1704 and SEQ ID:6987 respectively, to the nucleotide sequence of GAM99 RNA, herein designated GAM RNA, also designated SEQ ID:320.

Another function of GAM99 is therefore inhibition of Deiodinase, iodothyronine, type i (DIO1, Accession NP_000783.2). Accordingly, utilities of GAM99 include diagnosis, prevention and treatment of diseases and clinical conditions associated with DIO1.

DKFZp313M0720 (Accession XP_113743.3) is another GAM99 target gene, herein designated TARGET GENE. DKFZp313M0720 BINDING SITE is a target binding site found in the 3' untranslated region of mRNA encoded by DKFZp313M0720, corresponding to a target binding site such as BINDING SITE I, BINDING SITE II or BINDING SITE III of FIG. 8. Table 4 illustrates the complementarity of the nucleotide sequences of DKFZp313M0720 BINDING SITE, designated SEQ ID:13887, to the nucleotide sequence of GAM99 RNA, herein designated GAM RNA, also designated SEQ ID:320.

Another function of GAM99 is therefore inhibition of DKFZp313M0720 (Accession XP_113743.3). Accordingly, utilities of GAM99 include diagnosis, prevention and treatment of diseases and clinical conditions associated with DKFZp313M0720.

DKFZp434A2417 (Accession NP_663736.1) is another GAM99 target gene, herein designated TARGET GENE. DKFZp434A2417 BINDING SITE is a target binding site found in the 3' untranslated region of mRNA encoded by DKFZp434A2417, corresponding to a target binding site such as BINDING SITE I, BINDING SITE II or BINDING SITE III of FIG. 8. Table 4 illustrates the complementarity of the nucleotide sequences of DKFZp434A2417 BINDING SITE, designated SEQ ID:20081, to the nucleotide sequence of GAM99 RNA, herein designated GAM RNA, also designated SEQ ID:320.

Another function of GAM99 is therefore inhibition of DKFZp434A2417 (Accession NP_663736.1). Accordingly, utilities of GAM99 include diagnosis, prevention and treatment of diseases and clinical conditions associated with DKFZp434A2417.

Fat tumor suppressor homolog 2 (drosophila) (FAT2, Accession NP_001438.1) is another GAM99 target gene, herein designated TARGET GENE. FAT2 BINDING SITE is a target binding site found in the 3' untranslated region of mRNA encoded by FAT2, corresponding to a target binding site such as BINDING SITE I, BINDING SITE II or BINDING SITE III of FIG. 8. Table 4 illustrates the complementarity of the nucleotide sequences of FAT2 BINDING SITE, designated SEQ ID:1177, to the nucleotide sequence of GAM99 RNA, herein designated GAM RNA, also designated SEQ ID:320.

Another function of GAM99 is therefore inhibition of Fat tumor suppressor homolog 2 (drosophila) (FAT2, Accession NP_001438.1), a gene which could function as a cell-adhesion protein. Accordingly, utilities of GAM99 include diagnosis, prevention and treatment of diseases and clinical conditions associated with FAT2.

The function of FAT2 has been established by previous studies. The domain that characterizes epidermal growth factor (EGF; 131530) consists of approximately 50 amino acids with 3 disulfide bonds. EGF-like domains are believed to play a critical role in a number of extracellular events, including cell adhesion and receptor-ligand interactions. Proteins with EGF-like domains often consist of more than 1,000 amino acids, have multiple copies of the EGF-like domain, and contain additional domains known to be involved in specific protein-protein interactions. To identify proteins containing EGF-like domains, Nakayama et al. (1998) searched a database of long cDNA sequences randomly selected from a human brain cDNA library for those that encode an EGF-like motif. They identified several partial cDNAs encoding novel proteins with EGF-like domains, such as FAT2, which they named MEGF1. Nakayama et al. (1998) isolated a rat cDNA containing the complete Megf1 coding sequence. The predicted Megf1 protein has a signal sequence, 34 cadherin motifs (see OMIM Ref. No. 603006), a laminin G domain (see OMIM Ref. No. 601033), 2 EGF-like domains, a transmembrane domain, a cytoplasmic proline-rich sequence, and a cytoplasmic RGD (arginine-glycine- aspartic acid) motif, which is found in proteins modulating cell adhesion. The predicted structure of Megf1 is similar overall to the structures of the Drosophila 'fat' gene product and human FAT (OMIM Ref. No. 600976), although the number of EGF-like domains varies among these proteins. The Drosophila fat gene is a tumor suppressor gene whose product controls cell proliferation and morphogenesis in the imaginal discs in a contact-dependent manner. Northern blot analysis of various regions of rat brain detected Megf1 expression only in the cerebellum.

Full details of the abovementioned studies are described in the following publications, the disclosure of which are hereby incorporated by reference:

Nakayama, M.; Nakajima, D.; Nagase, T.; Nomura, N.; Seki, N.; Ohara, O.: Identification of high-molecular-weight proteins with multiple EGF-like motifs by motif-trap screening. Genomics 51:27-34, 1998; and Wu, Q.; Maniatis, T.: Large exons encoding multiple ectodomains are a characteristic feature of protocadherin genes. Proc. Nat. Acad. Sci. 97:3124-3129, 2000.

Further studies establishing the function and utilities of FAT2 are found in John Hopkins OMIM database record ID 604269, and in cited publications listed in Table 5, which are hereby incorporated by reference. F-box and leucine-rich repeat protein 5 (FBXL5, Accession NP_036293.1) is another GAM99 target gene, herein designated TARGET GENE. FBXL5 BINDING SITE is a target binding site found in the 3' untranslated region of multiple transcripts of mRNA encoded by FBXL5, corresponding to a target binding site such as BINDING SITE I, BINDING SITE II or BINDING SITE III of FIG. 8. Table 4 illustrates the complementarity of the nucleotide sequences of FBXL5 BINDING SITE, designated SEQ ID:15662, to the nucleotide sequence of GAM99 RNA, herein designated GAM RNA, also designated SEQ ID:320.

Another function of GAM99 is therefore inhibition of F-box and leucine-rich repeat protein 5 (FBXL5, Accession NP_036293.1), a gene which is a putative SCF ubiquitin ligase subunit involved in protein degradation. Accordingly, utilities of GAM99 include diagnosis, prevention and treatment of diseases and clinical conditions associated with FBXL5.

The function of FBXL5 has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). Winston et al. (1999) predicted the presence of 6 leucine-rich repeats (LRRs) in FBXL5. RT-PCR analysis detected expression in all tissues tested, with highest levels in heart and pancreas.

Full details of the abovementioned studies are described in the following publications, the disclosure of which are hereby incorporated by reference:

Ilyin, G. P.; Rialland, M.; Pigeon, C.; Guguen-Guillouzo, C.: cDNA cloning and expression analysis of new members of the mammalian F-box protein family. Genomics 67:40-47, 2000; and Winston, J. T.; Koepp, D. M.; Zhu, C.; Elledge, S. J.; Harper, J. W.: A family of mammalian F-box proteins. Curr. Biol. 9:1180-1182, 1999.

Further studies establishing the function and utilities of FBXL5 are found in John Hopkins OMIM database record ID 605655, and in cited publications listed in Table 5, which are hereby incorporated by reference. F-box and leucine-rich repeat protein 5 (FBXL5, Accession NP_277077.1) is another GAM99 target gene, herein designated TARGET GENE. FBXL5 BINDING SITE is a target binding site found in the 3' untranslated region of multiple transcripts of mRNA encoded by FBXL5, corresponding to a target binding site such as BINDING SITE I, BINDING SITE II or BINDING SITE III of FIG. 8. Table 4 illustrates the complementarity of the nucleotide sequences of FBXL5 BINDING SITE, designated SEQ ID:15662, to the nucleotide sequence of GAM99 RNA, herein designated GAM RNA, also designated SEQ ID:320.

Another function of GAM99 is therefore inhibition of F-box and leucine-rich repeat protein 5 (FBXL5, Accession NP_277077.1), a gene which is a putative SCF ubiquitin ligase subunit involved in protein degradation. Accordingly, utilities of GAM99 include diagnosis, prevention and treatment of diseases and clinical conditions associated with FBXL5.

The function of FBXL5 has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). Winston et al. (1999) predicted the presence of 6 leucine-rich repeats (LRRs) in FBXL5. RT-PCR analysis detected expression in all tissues tested, with highest levels in heart and pancreas.

Full details of the abovementioned studies are described in the following publications, the disclosure of which are hereby incorporated by reference:

Ilyin, G. P.; Rialland, M.; Pigeon, C.; Guguen-Guillouzo, C.: cDNA cloning and expression analysis of new members of the mammalian F-box protein family. Genomics 67:40-47, 2000; and Winston, J. T.; Koepp, D. M.; Zhu, C.; Elledge, S. J.; Harper, J. W.: A family of mammalian F-box proteins. Curr. Biol. 9:1180-1182, 1999.

Further studies establishing the function and utilities of FBXL5 are found in John Hopkins OMIM database record ID 605655, and in cited publications listed in Table 5, which are hereby incorporated by reference. FLJ10204 (Accession NP_060494.1) is another GAM99 target gene, herein designated TARGET GENE. FLJ10204 BINDING SITE is a target binding site found in the 3' untranslated region of mRNA encoded by FLJ10204, corresponding to a target binding site such as BINDING SITE I, BINDING SITE II or BINDING SITE III of FIG. 8. Table 4 illustrates the complementarity of the nucleotide sequences of FLJ10204 BINDING SITE, designated SEQ ID:16040, to the nucleotide sequence of GAM99 RNA, herein designated GAM RNA, also designated SEQ ID:320.

Another function of GAM99 is therefore inhibition of FLJ10204 (Accession NP_060494.1). Accordingly, utilities of GAM99 include diagnosis, prevention and treatment of diseases and clinical conditions associated with FLJ10204.

FLJ10330 (Accession NP_060531.1) is another GAM99 target gene, herein designated TARGET GENE. FLJ10330 BINDING SITE is a target binding site found in the 3' untranslated region of mRNA encoded by FLJ10330, corresponding to a target binding site such as BINDING SITE I, BINDING SITE II or BINDING SITE III of FIG. 8. Table 4 illustrates the complementarity of the nucleotide sequences of FLJ10330 BINDING SITE, designated SEQ ID:8822, to the nucleotide sequence of GAM99 RNA, herein designated GAM RNA, also designated SEQ ID:320.

Another function of GAM99 is therefore inhibition of FLJ10330 (Accession NP_060531.1). Accordingly, utilities of GAM99 include diagnosis, prevention and treatment of diseases and clinical conditions associated with FLJ10330.

FLJ10769 (Accession NP_060680.1) is another GAM99 target gene, herein designated TARGET GENE. FLJ10769 BINDING SITE is a target binding site found in the 3' untranslated region of mRNA encoded by FLJ10769, corresponding to a target binding site such as BINDING SITE I, BINDING SITE II or BINDING SITE III of FIG. 8. Table 4 illustrates the complementarity of the nucleotide sequences of FLJ10769 BINDING SITE, designated SEQ ID:14541, to the nucleotide sequence of GAM99 RNA, herein designated GAM RNA, also designated SEQ ID:320.

Another function of GAM99 is therefore inhibition of FLJ10769 (Accession NP_060680.1). Accordingly, utilities of GAM99 include diagnosis, prevention and treatment of diseases and clinical conditions associated with FLJ10769.

FLJ11269 (Accession NP_060842.2) is another GAM99 target gene, herein designated TARGET GENE. FLJ11269 BINDING SITE is a target binding site found in the 3' untranslated region of mRNA encoded by FLJ11269, corresponding to a target binding site such as BINDING SITE I, BINDING SITE II or BINDING SITE III of FIG. 8. Table 4 illustrates the complementarity of the nucleotide sequences of FLJ11269 BINDING SITE, designated SEQ ID:19814, to the nucleotide sequence of GAM99 RNA, herein designated GAM RNA, also designated SEQ ID:320.

Another function of GAM99 is therefore inhibition of FLJ11269 (Accession NP_060842.2). Accordingly, utilities of GAM99 include diagnosis, prevention and treatment of diseases and clinical conditions associated with FLJ11269.

FLJ12960 (Accession NP_078914.1) is another GAM99 target gene, herein designated TARGET GENE. FLJ12960 BINDING SITE is a target binding site found in the 3' untranslated region of mRNA encoded by FLJ12960, corresponding to a target binding site such as BINDING SITE I, BINDING SITE II or BINDING SITE III of FIG. 8. Table 4 illustrates the complementarity of the nucleotide sequences of FLJ12960 BINDING SITE, designated SEQ ID:4577, to the nucleotide sequence of GAM99 RNA, herein designated GAM RNA, also designated SEQ ID:320.

Another function of GAM99 is therefore inhibition of FLJ12960 (Accession NP_078914.1). Accordingly, utilities of GAM99 include diagnosis, prevention and treatment of diseases and clinical conditions associated with FLJ12960.

FLJ13397 (Accession NP_079224.1) is another GAM99 target gene, herein designated TARGET GENE. FLJ13397 BINDING SITE is a target binding site found in the 3' untranslated region of mRNA encoded by FLJ13397, corresponding to a target binding site such as BINDING SITE I, BINDING SITE II or BINDING SITE III of FIG. 8. Table 4 illustrates the complementarity of the nucleotide sequences of FLJ13397 BINDING SITE, designated SEQ ID:4021, to the nucleotide sequence of GAM99 RNA, herein designated GAM RNA, also designated SEQ ID:320.

Another function of GAM99 is therefore inhibition of FLJ13397 (Accession NP_079224.1). Accordingly, utilities of GAM99 include diagnosis, prevention and treatment of diseases and clinical conditions associated with FLJ13397.

FLJ14721 (Accession NP_116218.1) is another GAM99 target gene, herein designated TARGET GENE. FLJ14721 BINDING SITE1 and FLJ14721 BINDING SITE2 are target binding sites found in untranslated regions of mRNA encoded by FLJ14721, corresponding to target binding sites such as BINDING SITE I, BINDING SITE II or BINDING SITE III of FIG. 8. Table 4 illustrates the complementarity of the nucleotide sequences of FLJ14721 BINDING SITE1 and FLJ14721 BINDING SITE2, designated SEQ ID:14815 and SEQ ID:16399 respectively, to the nucleotide sequence of GAM99 RNA, herein designated GAM RNA, also designated SEQ ID:320.

Another function of GAM99 is therefore inhibition of FLJ14721 (Accession NP_116218.1). Accordingly, utilities of GAM99 include diagnosis, prevention and treatment of diseases and clinical conditions associated with FLJ14721.

FLJ20898 (Accession NP_078876.1) is another GAM99 target gene, herein designated TARGET GENE. FLJ20898 BINDING SITE is a target binding site found in the 5' untranslated region of mRNA encoded by FLJ20898, corresponding to a target binding site such as BINDING SITE I, BINDING SITE II or BINDING SITE III of FIG. 8. Table 4 illustrates the complementarity of the nucleotide sequences of FLJ20898 BINDING SITE, designated SEQ ID:5699, to the nucleotide sequence of GAM99 RNA, herein designated GAM RNA, also designated SEQ ID:320.

Another function of GAM99 is therefore inhibition of FLJ20898 (Accession NP_078876.1). Accordingly, utilities of GAM99 include diagnosis, prevention and treatment of diseases and clinical conditions associated with FLJ20898.

FLJ20986 (Accession NP_078800.2) is another GAM99 target gene, herein designated TARGET GENE. FLJ20986 BINDING SITE is a target binding site found in the 5' untranslated region of mRNA encoded by FLJ20986, corresponding to a target binding site such as BINDING SITE I, BINDING SITE II or BINDING SITE III of FIG. 8. Table 4 illustrates the complementarity of the nucleotide sequences of FLJ20986 BINDING SITE, designated SEQ ID:5649, to the nucleotide sequence of GAM99 RNA, herein designated GAM RNA, also designated SEQ ID:320.

Another function of GAM99 is therefore inhibition of FLJ20986 (Accession NP_078800.2). Accordingly, utilities of GAM99 include diagnosis, prevention and treatment of diseases and clinical conditions associated with FLJ20986.

FLJ23129 (Accession NP_079039.1) is another GAM99 target gene, herein designated TARGET GENE. FLJ23129 BINDING SITE is a target binding site found in the 3' untranslated region of mRNA encoded by FLJ23129, corresponding to a target binding site such as BINDING SITE I, BINDING SITE II or BINDING SITE III of FIG. 8. Table 4 illustrates the complementarity of the nucleotide sequences of FLJ23129 BINDING SITE, designated SEQ ID:15636, to the nucleotide sequence of GAM99 RNA, herein designated GAM RNA, also designated SEQ ID:320.

Another function of GAM99 is therefore inhibition of FLJ23129 (Accession NP_079039.1). Accordingly, utilities of GAM99 include diagnosis, prevention and treatment of diseases and clinical conditions associated with FLJ23129.

FLJ32932 (Accession NP_690873.1) is another GAM99 target gene, herein designated TARGET GENE. FLJ32932 BINDING SITE is a target binding site found in the 3' untranslated region of mRNA encoded by FLJ32932, corresponding to a target binding site such as BINDING SITE I, BINDING SITE II or BINDING SITE III of FIG. 8. Table 4 illustrates the complementarity of the nucleotide sequences of FLJ32932 BINDING SITE, designated SEQ ID:1197, to the nucleotide sequence of GAM99 RNA, herein designated GAM RNA, also designated SEQ ID:320.

Another function of GAM99 is therefore inhibition of FLJ32932 (Accession NP_690873.1). Accordingly, utilities of GAM99 include diagnosis, prevention and treatment of diseases and clinical conditions associated with FLJ32932.

FLJ33167 (Accession NP_689896.1) is another GAM99 target gene, herein designated TARGET GENE. FLJ33167 BINDING SITE is a target binding site found in the 5' untranslated region of mRNA encoded by FLJ33167, corresponding to a target binding site such as BINDING SITE I, BINDING SITE II or BINDING SITE III of FIG. 8. Table 4 illustrates the complementarity of the nucleotide sequences of FLJ33167 BINDING SITE, designated SEQ ID:20132, to the nucleotide sequence of GAM99 RNA, herein designated GAM RNA, also designated SEQ ID:320.

Another function of GAM99 is therefore inhibition of FLJ33167 (Accession NP_689896.1). Accordingly, utilities of GAM99 include diagnosis, prevention and treatment of diseases and clinical conditions associated with FLJ33167.

Glucose-6-phosphatase, catalytic (glycogen storage disease type i, von gierke disease) (G6PC, Accession NP_000142.1) is another GAM99 target gene, herein designated TARGET GENE. G6PC BINDING SITE is a target binding site found in the 3' untranslated region of mRNA encoded by G6PC, corresponding to a target binding site such as BINDING SITE I, BINDING SITE II or BINDING SITE III of FIG. 8. Table 4 illustrates the complementarity of the nucleotide sequences of G6PC BINDING SITE, designated SEQ ID:3569, to the nucleotide sequence of GAM99 RNA, herein designated GAM RNA, also designated SEQ ID:320.

Another function of GAM99 is therefore inhibition of Glucose-6-phosphatase, catalytic (glycogen storage disease type i, von gierke disease) (G6PC, Accession NP_000142.1). Accordingly, utilities of GAM99 include diagnosis, prevention and treatment of diseases and clinical conditions associated with G6PC.

Group-specific component (vitamin d binding protein) (GC, Accession NP_000574.1) is another GAM99 target gene, herein designated TARGET GENE. GC BINDING SITE is a target binding site found in the 3' untranslated region of mRNA encoded by GC, corresponding to a target binding site such as BINDING SITE I, BINDING SITE II or BINDING SITE III of FIG. 8. Table 4 illustrates the complementarity of the nucleotide sequences of GC BINDING SITE, designated SEQ ID:2597, to the nucleotide sequence of GAM99 RNA, herein designated GAM RNA, also designated SEQ ID:320.

Another function of GAM99 is therefore inhibition of Group-specific component (vitamin d binding protein) (GC, Accession NP_000574.1), a gene which transports vitamin D and its plasma metabolites to target tissues. Accordingly, utilities of GAM99 include diagnosis, prevention and treatment of diseases and clinical conditions associated with GC.

The function of GC has been established by previous studies. Chapman et al. (1997) found that the mouse Gbx2 gene contains a single intron, a feature of the human GBX2 gene. They mapped Gbx2 to mouse chromosome 1. They extended the known expression pattern of Gbx2 beyond the gastrulation-stage embryo and the developing CNS to pluripotent cells in vitro and in vivo. Gbx2 expression was demonstrated in undifferentiated embryonic stem cells but was downregulated in differentiated cell populations. In the embry, Gbx2 expression was detected before primitive streak formation, in the inner cell mass of the preimplantation embryo. Chapman et al. (1997) suggested Gbx2 as a candidate control gene for cell pluripotency and differentiation in the embryo.

Animal model experiments lend further support to the function of GC. The mid/hindbrain junction can act as an organizer to direct the development of the midbrain and anterior hindbrain. In mice, Otx2 (OMIM Ref. No. 600037) is expressed in the forebrain and midbrain and Gbx2 is expressed in the anterior hindbrain, with a shared border at the level of the mid/hindbrain organizer. Millet et al. (1999) demonstrated that in Gbx2 -/- mutants, the earliest phenotype is a posterior expansion of the Otx2 domain during early somite stages. Furthermore, organizer genes are expressed at the shifted Otx2 border, but not in a normal spatial relationship. To test whether Gbx2 is sufficient to position the mid/hindbrain organizer, Millet et al. (1999) transiently expressed Gbx2 in the caudal Otx2 domain and found that the Otx2 caudal border was indeed shifted rostrally, and a normal-appearing organizer formed at this new Otx2 border. Transgenic embryos then showed an expanded hindbrain and a reduced midbrain at embryonic day 9.5 to 10. Millet et al. (1999) proposed that the formation of a normal mid/hindbrain organizer depends on a sharp Otx2 caudal border and that Gbx2 is required to position and sharpen this border.

It is appreciated that the abovementioned animal model for GC is acknowledged by those skilled in the art as a scientifically valid animal model, as can be further appreciated from the publications sited hereinbelow.

Full details of the abovementioned studies are described in the following publications, the disclosure of which are hereby incorporated by reference:

Svasti, J.; Kurosky, A.; Bennett, A.; Bowman, B. H.: Molecular basis for the three major forms of human serum vitamin D binding protein (group-specific component). Biochemistry 18:1611-1617, 1979; and Millet, S.; Campbell, K.; Epstein, D. J.; Losos, K.; Harris, E.; Joyner, A. L.: A role for Gbx2 in repression of Otx2 and positioning the mid/hindbrain organizer. Nature 401:161-164, 19.

Further studies establishing the function and utilities of GC are found in John Hopkins OMIM database record ID 139200, and in cited publications listed in Table 5, which are hereby incorporated by reference. Gap junction protein, beta 6 (connexin 30) (GJB6, Accession NP_006774.1) is another GAM99 target gene, herein designated TARGET GENE. GJB6 BINDING SITE is a target binding site found in the 3' untranslated region of mRNA encoded by GJB6, corresponding to a target binding site such as BINDING SITE I, BINDING SITE II or BINDING SITE III of FIG. 8. Table 4 illustrates the complementarity of the nucleotide sequences of GJB6 BINDING SITE, designated SEQ ID:18208, to the nucleotide sequence of GAM99 RNA, herein designated GAM RNA, also designated SEQ ID:320.

Another function of GAM99 is therefore inhibition of Gap junction protein, beta 6 (connexin 30) (GJB6, Accession NP_006774.1). Accordingly, utilities of GAM99 include diagnosis, prevention and treatment of diseases and clinical conditions associated with GJB6.

Glycoprotein v (platelet) (GP5, Accession NP_004479.1) is another GAM99 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:15292, to the nucleotide sequence of GAM99 RNA, herein designated GAM RNA, also designated SEQ ID:320.

Another function of GAM99 is therefore inhibition of Glycoprotein v (platelet) (GP5, Accession NP_004479.1). Accordingly, utilities of GAM99 include diagnosis, prevention and treatment of diseases and clinical conditions associated with GP5.

Glycoprotein (transmembrane) nmb (GPNMB, Accession NP_002501.1) is another GAM99 target gene, herein designated TARGET GENE. GPNMB BINDING SITE is a target binding site found in the 3' untranslated region of mRNA encoded by GPNMB, corresponding to a target binding site such as BINDING SITE I, BINDING SITE II or BINDING SITE III of FIG. 8. Table 4 illustrates the complementarity of the nucleotide sequences of GPNMB BINDING SITE, designated SEQ ID:2512, to the nucleotide sequence of GAM99 RNA, herein designated GAM RNA, also designated SEQ ID:320.

Another function of GAM99 is therefore inhibition of Glycoprotein (transmembrane) nmb (GPNMB, Accession NP_002501.1). Accordingly, utilities of GAM99 include diagnosis, prevention and treatment of diseases and clinical conditions associated with GPNMB.

G protein-coupled receptor 18 (GPR18, Accession NP_005283.1) is another GAM99 target gene, herein designated TARGET GENE. GPR18 BINDING SITE is a target binding site found in the 5' untranslated region of mRNA encoded by GPR18, corresponding to a target binding site such as BINDING SITE I, BINDING SITE II or BINDING SITE III of FIG. 8. Table 4 illustrates the complementarity of the nucleotide sequences of GPR18 BINDING SITE, designated SEQ ID:4838, to the nucleotide sequence of GAM99 RNA, herein designated GAM RNA, also designated SEQ ID:320.

Another function of GAM99 is therefore inhibition of G protein-coupled receptor 18 (GPR18, Accession NP_005283.1). Accordingly, utilities of GAM99 include diagnosis, prevention and treatment of diseases and clinical conditions associated with GPR18.

Huntingtin-associated protein interacting protein (duo) (HAPIP, Accession NP_003938.1) is another GAM99 target gene, herein designated TARGET GENE. HAPIP BINDING SITE is a target binding site found in the 3' untranslated region of mRNA encoded by HAPIP, corresponding to a target binding site such as BINDING SITE I, BINDING SITE II or BINDING SITE III of FIG. 8. Table 4 illustrates the complementarity of the nucleotide sequences of HAPIP BINDING SITE, designated SEQ ID:10617, to the nucleotide sequence of GAM99 RNA, herein designated GAM RNA, also designated SEQ ID:320.

Another function of GAM99 is therefore inhibition of Huntingtin-associated protein interacting protein (duo) (HAPIP, Accession NP_003938.1). Accordingly, utilities of GAM99 include diagnosis, prevention and treatment of diseases and clinical conditions associated with HAPIP.

Homeo box a1 (HOXA1, Accession NP_705873.1) is another GAM99 target gene, herein designated TARGET GENE. HOXA1 BINDING SITE is a target binding site found in the 3' untranslated region of multiple transcripts of mRNA encoded by HOXA1, corresponding to a target binding site such as BINDING SITE I, BINDING SITE II or BINDING SITE III of FIG. 8. Table 4 illustrates the complementarity of the nucleotide sequences of HOXA1 BINDING SITE, designated SEQ ID:9804, to the nucleotide sequence of GAM99 RNA, herein designated GAM RNA, also designated SEQ ID:320.

Another function of GAM99 is therefore inhibition of Homeo box a1 (HOXA1, Accession NP_705873.1). Accordingly, utilities of GAM99 include diagnosis, prevention and treatment of diseases and clinical conditions associated with HOXA1.

Islet cell autoantigen 1, 69 kda (ICA1, Accession NP_071682.1) is another GAM99 target gene, herein designated TARGET GENE. ICA1 BINDING SITE is a target binding site found in the 3' untranslated region of multiple transcripts of mRNA encoded by ICA1, corresponding to a target binding site such as BINDING SITE I, BINDING SITE II or BINDING SITE III of FIG. 8. Table 4 illustrates the complementarity of the nucleotide sequences of ICA1 BINDING SITE, designated SEQ ID:6344, to the nucleotide sequence of GAM99 RNA, herein designated GAM RNA, also designated SEQ ID:320.

Another function of GAM99 is therefore inhibition of Islet cell autoantigen 1, 69 kda (ICA1, Accession NP_071682.1), a gene which encodes Islet cell autoantigen 1 and therefore may be associated with Insulin- dependent diabetes mellitus. Accordingly, utilities of GAM99 include diagnosis, prevention and treatment of Insulin-dependent diabetes mellitus, and of other diseases and clinical conditions associated with ICA1.

The function of ICA1 and its association with various diseases and clinical conditions, has been established by previous studies, as described hereinabove with reference to GAM94.1. Interleukin 1 family, member 10 (theta) (IL1F10, Accession NP_115945.4) is another GAM99 target gene, herein designated TARGET GENE. IL1F10 BINDING SITE is a target binding site found in the 5' untranslated region of multiple transcripts of mRNA encoded by IL1F10, corresponding to a target binding site such as BINDING SITE I, BINDING SITE II or BINDING SITE III of FIG. 8. Table 4 illustrates the complementarity of the nucleotide sequences of IL1F10 BINDING SITE, designated SEQ ID:8455, to the nucleotide sequence of GAM99 RNA, herein designated GAM RNA, also designated SEQ ID:320.

Another function of GAM99 is therefore inhibition of Interleukin 1 family, member 10 (theta) (IL1F10, Accession NP_115945.4). Accordingly, utilities of GAM99 include diagnosis, prevention and treatment of diseases and clinical conditions associated with IL1F10.

Interleukin enhancer binding factor 2, 45 kda (ILF2, Accession NP_004506.2) is another GAM99 target gene, herein designated TARGET GENE. ILF2 BINDING SITE is a target binding site found in the 3' untranslated region of mRNA encoded by ILF2, corresponding to a target binding site such as BINDING SITE I, BINDING SITE II or BINDING SITE III of FIG. 8. Table 4 illustrates the complementarity of the nucleotide sequences of ILF2 BINDING SITE, designated SEQ ID:9869, to the nucleotide sequence of GAM99 RNA, herein designated GAM RNA, also designated SEQ ID:320.

Another function of GAM99 is therefore inhibition of Interleukin enhancer binding factor 2, 45 kda (ILF2, Accession NP_004506.2). Accordingly, utilities of GAM99 include diagnosis, prevention and treatment of diseases and clinical conditions associated with ILF2.

INHBE (Accession NP_113667.1) is another GAM99 target gene, herein designated TARGET GENE. INHBE BINDING SITE is a target binding site found in the 3' untranslated region of mRNA encoded by INHBE, corresponding to a target binding site such as BINDING SITE I, BINDING SITE II or BINDING SITE III of FIG. 8. Table 4 illustrates the complementarity of the nucleotide sequences of INHBE BINDING SITE, designated SEQ ID:2641, to the nucleotide sequence of GAM99 RNA, herein designated GAM RNA, also designated SEQ ID:320.

Another function of GAM99 is therefore inhibition of INHBE (Accession NP_113667.1). Accordingly, utilities of GAM99 include diagnosis, prevention and treatment of diseases and clinical conditions associated with INHBE.

Iron-responsive element binding protein 2 (IREB2, Accession XP_039114.2) is another GAM99 target gene, herein designated TARGET GENE. IREB2 BINDING SITE is a target binding site found in the 3' untranslated region of mRNA encoded by IREB2, corresponding to a target binding site such as BINDING SITE I, BINDING SITE II or BINDING SITE III of FIG. 8. Table 4 illustrates the complementarity of the nucleotide sequences of IREB2 BINDING SITE, designated SEQ ID:10640, to the nucleotide sequence of GAM99 RNA, herein designated GAM RNA, also designated SEQ ID:320.

Another function of GAM99 is therefore inhibition of Iron-responsive element binding protein 2 (IREB2, Accession XP_039114.2), a gene which binds mRNAs that contain iron-responsive elements. and therefore may be associated with Misregulation of iron metabolism and neurodegenerative disease. Accordingly, utilities of GAM99 include diagnosis, prevention and treatment of Misregulation of iron metabolism and neurodegenerative disease, and of other diseases and clinical conditions associated with IREB2.

The function of IREB2 has been established by previous studies. Rouault et al. (1990) identified a second IRE-binding protein, for which the degenerate screening of the oligonucleotide used in identifying the cDNA for IREB1 (OMIM Ref. No. 100880) also served as a successful sequencing primer. The second IREBP, represented by 'clone 10.1,' contained an inserted stretch of 73 amino acids between amino acids 37 and 38 of IREB1; the IREB2 gene product lacked a region homologous to the sequences between amino acids 436 and 470 of IREB1. Wu et al. (1999) demonstrated that the c-myc (OMIM Ref. No. 190080) protein stimulates expression of IRP2. Hentze and Kuhn (1996) reviewed the function of IRP2. IRP2 is less abundant than IRP1 (IREB1) in most cells. The strongest expression is in intestine and brain (Henderson et al., 1993). Human IRP2 is 57% identical to human IRP1. IRP2 has a molecular mass of 105 kD, which is slightly larger than that of IRP1 due to a 73-amino acid insertion. Iwai et al. (1995) demonstrated that the 73-amino acid insertion mediates IRP2 degradation in iron-replete cells. Guo et al. (1994) and Samaniego et al. (1994) showed that IRP2 has no aconitase activity. By Southern analysis of somatic cell hybrid DNAs, Rouault et al. (1990) assigned the IREB2 gene to chromosome 15.

Animal model experiments lend further support to the function of IREB2. LaVaute et al. (2001) showed that in mice, targeted disruption of the Ireb2 gene resulted in misregulation of iron metabolism in the intestinal mucosa and neurodegenerative disease of the central nervous system. In adulthood, Ireb2 -/- mice developed a movement disorder characterized by ataxia, bradykinesia, and tremor. Significant accumulations of iron in white matter tracts and nuclei throughout the brain preceded the onset of neurodegeneration and movement disorder symptoms by many months. Ferric iron accumulated in the cytosol of neurons and oligodendrocytes in distinctive regions of the brain. Abnormal accumulations of ferritin colocalized with iron accumulations in populations of neurons that degenerated. Ireb2 -/- mice initially grew and developed normally. Mice older than 6 months of age developed a progressive neurodegenerative disorder characterized initially by an unsteady, wide- based gait and subtle kyphosis followed by gradual onset of ataxia, vestibular dysfunction, tremor, bradykinesia, and postural abnormalities. Balance and grip strength measured using the hanging wire test indicated severe impairment, whereas heterozygous mice showed an intermediate degree of impairment It is appreciated that the abovementioned animal model for IREB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hentze, M. W.; Kuhn, L. C.: Molecular control of vertebrate iron metabolism: mRNA- based regulatory circuits operated by iron, nitric oxide, and oxidative stress. Proc. Nat. Acad. Sci. 93:8175-8182, 1996; and LaVaute, T.; Smith, S.; Cooperman, S.; Iwai, K.; Land, W.; Meyron-Holtz, E.; Drake, S. K.; Miller, G.; Abu-Asab, M.; Tsokos, M.; Switzer, R., III; Grinberg, A.; Love, P.; Tresser, N.; Ro.

Further studies establishing the function and utilities of IREB2 are found in John Hopkins OMIM database record ID 147582, and in cited publications listed in Table 5, which are hereby incorporated by reference. Interferon regulatory factor 4 (IRF4, Accession NP_002451.1) is another GAM99 target gene, herein designated TARGET GENE. IRF4 BINDING SITE is a target binding site found in the 3' untranslated region of mRNA encoded by IRF4, corresponding to a target binding site such as BINDING SITE I, BINDING SITE II or BINDING SITE III of FIG. 8. Table 4 illustrates the complementarity of the nucleotide sequences of IRF4 BINDING SITE, designated SEQ ID:13735, to the nucleotide sequence of GAM99 RNA, herein designated GAM RNA, also designated SEQ ID:320.

Another function of GAM99 is therefore inhibition of Interferon regulatory factor 4 (IRF4, Accession NP_002451.1). Accordingly, utilities of GAM99 include diagnosis, prevention and treatment of diseases and clinical conditions associated with IRF4.

Junction plakoglobin (JUP, Accession NP_068831.1) is another GAM99 target gene, herein designated TARGET GENE. JUP BINDING SITE is a target binding site found in the 3' untranslated region of multiple transcripts of mRNA encoded by JUP, corresponding to a target binding site such as BINDING SITE I, BINDING SITE II or BINDING SITE III of FIG. 8. Table 4 illustrates the complementarity of the nucleotide sequences of JUP BINDING SITE, designated SEQ ID:3039, to the nucleotide sequence of GAM99 RNA, herein designated GAM RNA, also designated SEQ ID:320.

Another function of GAM99 is therefore inhibition of Junction plakoglobin (JUP, Accession NP_068831.1), a gene which plays a central role in the structure and function of submembranous plaques. and therefore may be associated with Naxos disease. Accordingly, utilities of GAM99 include diagnosis, prevention and treatment of Naxos disease, and of other diseases and clinical conditions associated with JUP.

The function of JUP has been established by previous studies. Plakoglobin is a major cytoplasmic protein that occurs in a soluble and a membrane-associated form and is the only known constituent common to the submembranous plaques of both kinds of adhering junctions, the desmosomes and the intermediate junctions. It is a desmoplakin (see OMIM Ref. No. 125647) and is referred to as DP III. DP I and DP II are splice variants of the same gene. Using a partial cDNA clone for bovine plakoglobin, Franke et al. (1989) isolated cDNAs encoding human plakoglobin, determined its nucleotide sequence, and deduced the complete amino acid sequence. The polypeptide encoded by the cDNA was synthesized by in vitro transcription and translation and identified by its comigration with authentic plakoglobin in 2-dimensional gel electrophoresis. The protein, which has 744 amino acids and a molecular weight of 81,750 Da, is unrelated to any known protein and is highly conserved between human and bovine tissues. Only one kind of plakoglobin mRNA (OMIM Ref. No. 3.4 kb) was found in most tissues, but an additional mRNA (OMIM Ref. No. 3.7 kb) was detected in certain human tumor cell lines. Arnemann et al. (1991) established a PCR assay for the gene coding for plakoglobin and used it to test human/mouse and human/rat somatic cell hybrids with different contents of human chromosomes. In this way, they were able to assign DP3 to chromosome 7. By analysis of progeny from 2 interspecific backcrosses, Guenet et al. (1995) mapped the Jup gene to mouse chromosome 11. Thus, the human JUP gene is probably on 7p because that is the portion of the chromosome showing homology of synteny to mouse 11. However, mouse 11 shows much more extensive homology to human chromosome 17 and, indeed, studies using both Southern blot analysis of human/rodent cell hybrids and linkage studies with an intragenic polymorphism demonstrated that the plakoglobin gene is located on 17q21 (Aberle OMIM Ref. No. later). Using a monochromosomal human-rodent somatic cell hybrid panel, Cowley et al. (1997) likewise showed that the JUP gene is located on chromosome 17. McKoy et al. (2000) identified a 2-basepair deletion in homozygous state in the plakoglobin gene in individuals affected with Naxos disease (OMIM Ref. No. 601214). Western blot analysis showed that the mutation causes a frameshift and premature termination of the protein. The finding of a deletion in plakoglobin in arrhythmogenic right ventricular cardiomyopathy suggests that the proteins involved in cell-cell adhesion play an important role in maintaining myocyte integrity and that when junctions are disrupted, cell death with fatty and fibrous tissue replacement occurs. Nomenclature: Since the term plakoglobin is in increasingly accepted usage, it may be desirable to have a gene symbol that is closer to it, e.g., PKGB. Although the development of gene symbols that reflect families of proteins (and genes) to which the entity belongs has some justification, it can be confusing. The symbol JUP is derived from junction plakoglobin.

Animal model experiments lend further support to the function of JUP. Ruiz et al. (1996) generated mice deficient in plakoglobin by targeted disruption. Plakoglobin mutant mouse embryos showed decreased myofiber compliance and reduced cell- cell adhesion as a result of defects in the number and structure of desmosomes within the myocardium. Consequently, when myocardial cells undergo increased mechanical stress, e.g., at embryonic day 10.5 from the onset of embryonic blood circulation, the mice die from ventricular rupture. Plakoglobin-deficient C57BL/6 mice that survive longer, to around birth, show an additional skin phenotype. Epidermal desmosomes of these mice are disorganized and detached from the cytokeratin filaments, presenting features similar to the human blistering disease epidermolytic hyperkeratosis It is appreciated that the abovementioned animal model for JUP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bierkamp, C.; Mclaughlin, K. J.; Schwarz, H.; Huber, O.; Kemler, R.: Embryonic heart and skin defects in mice lacking plakoglobin. Dev. Biol. 180:780-785, 1996; and McKoy, G.; Protonotarios, N.; Crosby, A.; Tsatsopoulou, A.; Anastasakis, A.; Coonar, A.; Norman, M.; Baboonian, C.; Jeffery, S.; McKenna, W. J.: Identification of a deletion in plakogl.

Further studies establishing the function and utilities of JUP are found in John Hopkins OMIM database record ID 173325, and in cited publications listed in Table 5, which are hereby incorporated by reference. Junction plakoglobin (JUP, Accession NP_002221.1) is another GAM99 target gene, herein designated TARGET GENE. JUP BINDING SITE is a target binding site found in the 3' untranslated region of multiple transcripts of mRNA encoded by JUP, corresponding to a target binding site such as BINDING SITE I, BINDING SITE II or BINDING SITE III of FIG. 8. Table 4 illustrates the complementarity of the nucleotide sequences of JUP BINDING SITE, designated SEQ ID:3039, to the nucleotide sequence of GAM99 RNA, herein designated GAM RNA, also designated SEQ ID:320.

Another function of GAM99 is therefore inhibition of Junction plakoglobin (JUP, Accession NP_002221.1), a gene which plays a central role in the structure and function of submembranous plaques. and therefore may be associated with Naxos disease. Accordingly, utilities of GAM99 include diagnosis, prevention and treatment of Naxos disease, and of other diseases and clinical conditions associated with JUP.

The function of JUP has been established by previous studies. Plakoglobin is a major cytoplasmic protein that occurs in a soluble and a membrane-associated form and is the only known constituent common to the submembranous plaques of both kinds of adhering junctions, the desmosomes and the intermediate junctions. It is a desmoplakin (see OMIM Ref. No. 125647) and is referred to as DP III. DP I and DP II are splice variants of the same gene. Using a partial cDNA clone for bovine plakoglobin, Franke et al. (1989) isolated cDNAs encoding human plakoglobin, determined its nucleotide sequence, and deduced the complete amino acid sequence. The polypeptide encoded by the cDNA was synthesized by in vitro transcription and translation and identified by its comigration with authentic plakoglobin in 2-dimensional gel electrophoresis. The protein, which has 744 amino acids and a molecular weight of 81,750 Da, is unrelated to any known protein and is highly conserved between human and bovine tissues. Only one kind of plakoglobin mRNA (OMIM Ref. No. 3.4 kb) was found in most tissues, but an additional mRNA (OMIM Ref. No. 3.7 kb) was detected in certain human tumor cell lines. Arnemann et al. (1991) established a PCR assay for the gene coding for plakoglobin and used it to test human/mouse and human/rat somatic cell hybrids with different contents of human chromosomes. In this way, they were able to assign DP3 to chromosome 7. By analysis of progeny from 2 interspecific backcrosses, Guenet et al. (1995) mapped the Jup gene to mouse chromosome 11. Thus, the human JUP gene is probably on 7p because that is the portion of the chromosome showing homology of synteny to mouse 11. However, mouse 11 shows much more extensive homology to human chromosome 17 and, indeed, studies using both Southern blot analysis of human/rodent cell hybrids and linkage studies with an intragenic polymorphism demonstrated that the plakoglobin gene is located on 17q21 (Aberle OMIM Ref. No. later). Using a monochromosomal human-rodent somatic cell hybrid panel, Cowley et al. (1997) likewise showed that the JUP gene is located on chromosome 17. McKoy et al. (2000) identified a 2-basepair deletion in homozygous state in the plakoglobin gene in individuals affected with Naxos disease (OMIM Ref. No. 601214). Western blot analysis showed that the mutation causes a frameshift and premature termination of the protein. The finding of a deletion in plakoglobin in arrhythmogenic right ventricular cardiomyopathy suggests that the proteins involved in cell-cell adhesion play an important role in maintaining myocyte integrity and that when junctions are disrupted, cell death with fatty and fibrous tissue replacement occurs. Nomenclature: Since the term plakoglobin is in increasingly accepted usage, it may be desirable to have a gene symbol that is closer to it, e.g., PKGB. Although the development of gene symbols that reflect families of proteins (and genes) to which the entity belongs has some justification, it can be confusing. The symbol JUP is derived from junction plakoglobin.

Animal model experiments lend further support to the function of JUP. Ruiz et al. (1996) generated mice deficient in plakoglobin by targeted disruption. Plakoglobin mutant mouse embryos showed decreased myofiber compliance and reduced cell- cell adhesion as a result of defects in the number and structure of desmosomes within the myocardium. Consequently, when myocardial cells undergo increased mechanical stress, e.g., at embryonic day 10.5 from the onset of embryonic blood circulation, the mice die from ventricular rupture. Plakoglobin-deficient C57BL/6 mice that survive longer, to around birth, show an additional skin phenotype. Epidermal desmosomes of these mice are disorganized and detached from the cytokeratin filaments, presenting features similar to the human blistering disease epidermolytic hyperkeratosis It is appreciated that the abovementioned animal model for JUP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bierkamp, C.; Mclaughlin, K. J.; Schwarz, H.; Huber, O.; Kemler, R.: Embryonic heart and skin defects in mice lacking plakoglobin. Dev. Biol. 180:780-785, 1996; and McKoy, G.; Protonotarios, N.; Crosby, A.; Tsatsopoulou, A.; Anastasakis, A.; Coonar, A.; Norman, M.; Baboonian, C.; Jeffery, S.; McKenna, W. J.: Identification of a deletion in plakogl.

Further studies establishing the function and utilities of JUP are found in John Hopkins OMIM database record ID 173325, and in cited publications listed in Table 5, which are hereby incorporated by reference. KIAA0638 (Accession XP_290497.1) is another GAM99 target gene, herein designated TARGET GENE. KIAA0638 BINDING SITE is a target binding site found in the 3' untranslated region of mRNA encoded by KIAA0638, corresponding to a target binding site such as BINDING SITE I, BINDING SITE II or BINDING SITE III of FIG. 8. Table 4 illustrates the complementarity of the nucleotide sequences of KIAA0638 BINDING SITE, designated SEQ ID:9348, to the nucleotide sequence of GAM99 RNA, herein designated GAM RNA, also designated SEQ ID:320.

Another function of GAM99 is therefore inhibition of KIAA0638 (Accession XP_290497.1). Accordingly, utilities of GAM99 include diagnosis, prevention and treatment of diseases and clinical conditions associated with KIAA0638.

KIAA0841 (Accession XP_049237.1) is another GAM99 target gene, herein designated TARGET GENE. KIAA0841 BINDING SITE is a target binding site found in the 3' untranslated region of mRNA encoded by KIAA0841, corresponding to a target binding site such as BINDING SITE I, BINDING SITE II or BINDING SITE III of FIG. 8. Table 4 illustrates the complementarity of the nucleotide sequences of KIAA0841 BINDING SITE, designated SEQ ID:1976, to the nucleotide sequence of GAM99 RNA, herein designated GAM RNA, also designated SEQ ID:320.

Another function of GAM99 is therefore inhibition of KIAA0841 (Accession XP_049237.1). Accordingly, utilities of GAM99 include diagnosis, prevention and treatment of diseases and clinical conditions associated with KIAA0841.

KIAA1068 (Accession NP_056147.1) is another GAM99 target gene, herein designated TARGET GENE. KIAA1068 BINDING SITE is a target binding site found in the 3' untranslated region of mRNA encoded by KIAA1068, corresponding to a target binding site such as BINDING SITE I, BINDING SITE II or BINDING SITE III of FIG. 8. Table 4 illustrates the complementarity of the nucleotide sequences of KIAA1068 BINDING SITE, designated SEQ ID:18247, to the nucleotide sequence of GAM99 RNA, herein designated GAM RNA, also designated SEQ ID:320.

Another function of GAM99 is therefore inhibition of KIAA1068 (Accession NP_056147.1). Accordingly, utilities of GAM99 include diagnosis, prevention and treatment of diseases and clinical conditions associated with KIAA1068.

KIAA1107 (Accession XP_034086.1) is another GAM99 target gene, herein designated TARGET GENE. KIAA1107 BINDING SITE is a target binding site found in the 5' untranslated region of mRNA encoded by KIAA1107, corresponding to a target binding site such as BINDING SITE I, BINDING SITE II or BINDING SITE III of FIG. 8. Table 4 illustrates the complementarity of the nucleotide sequences of KIAA1107 BINDING SITE, designated SEQ ID:18484, to the nucleotide sequence of GAM99 RNA, herein designated GAM RNA, also designated SEQ ID:320.

Another function of GAM99 is therefore inhibition of KIAA1107 (Accession XP_034086.1). Accordingly, utilities of GAM99 include diagnosis, prevention and treatment of diseases and clinical conditions associated with KIAA1107.

KIAA1193 (Accession XP_041843.1) is another GAM99 target gene, herein designated TARGET GENE. KIAA1193 BINDING SITE is a target binding site found in the 3' untranslated region of mRNA encoded by KIAA1193, corresponding to a target binding site such as BINDING SITE I, BINDING SITE II or BINDING SITE III of FIG. 8. Table 4 illustrates the complementarity of the nucleotide sequences of KIAA1193 BINDING SITE, designated SEQ ID:10805, to the nucleotide sequence of GAM99 RNA, herein designated GAM RNA, also designated SEQ ID:320.

Another function of GAM99 is therefore inhibition of KIAA1193 (Accession XP_041843.1). Accordingly, utilities of GAM99 include diagnosis, prevention and treatment of diseases and clinical conditions associated with KIAA1193.

KIAA1576 (Accession NP_065978.1) is another GAM99 target gene, herein designated TARGET GENE. KIAA1576 BINDING SITE is a target binding site found in the 3' untranslated region of mRNA encoded by KIAA1576, corresponding to a target binding site such as BINDING SITE I, BINDING SITE II or BINDING SITE III of FIG. 8. Table 4 illustrates the complementarity of the nucleotide sequences of KIAA1576 BINDING SITE, designated SEQ ID:9853, to the nucleotide sequence of GAM99 RNA, herein designated GAM RNA, also designated SEQ ID:320.

Another function of GAM99 is therefore inhibition of KIAA1576 (Accession NP_065978.1). Accordingly, utilities of GAM99 include diagnosis, prevention and treatment of diseases and clinical conditions associated with KIAA1576.

KIAA1911 (Accession XP_056302.1) is another GAM99 target gene, herein designated TARGET GENE. KIAA1911 BINDING SITE is a target binding site found in the 3' untranslated region of mRNA encoded by KIAA1911, corresponding to a target binding site such as BINDING SITE I, BINDING SITE II or BINDING SITE III of FIG. 8. Table 4 illustrates the complementarity of the nucleotide sequences of KIAA1911 BINDING SITE, designated SEQ ID:14728, to the nucleotide sequence of GAM99 RNA, herein designated GAM RNA, also designated SEQ ID:320.

Another function of GAM99 is therefore inhibition of KIAA1911 (Accession XP_056302.1). Accordingly, utilities of GAM99 include diagnosis, prevention and treatment of diseases and clinical conditions associated with KIAA1911.

KIAA1940 (Accession XP_086981.2) is another GAM99 target gene, herein designated TARGET GENE. KIAA1940 BINDING SITE is a target binding site found in the 3' untranslated region of mRNA encoded by KIAA1940, corresponding to a target binding site such as BINDING SITE I, BINDING SITE II or BINDING SITE III of FIG. 8. Table 4 illustrates the complementarity of the nucleotide sequences of KIAA1940 BINDING SITE, designated SEQ ID:13001, to the nucleotide sequence of GAM99 RNA, herein designated GAM RNA, also designated SEQ ID:320.

Another function of GAM99 is therefore inhibition of KIAA1940 (Accession XP_086981.2). Accordingly, utilities of GAM99 include diagnosis, prevention and treatment of diseases and clinical conditions associated with KIAA1940.

Kinesin family member 1b (KIF1B, Accession NP_055889.1) is another GAM99 target gene, herein designated TARGET GENE. KIF1B BINDING SITE is a target binding site found in the 5' untranslated region of mRNA encoded by KIF1B, corresponding to a target binding site such as BINDING SITE I, BINDING SITE II or BINDING SITE III of FIG. 8. Table 4 illustrates the complementarity of the nucleotide sequences of KIF1B BINDING SITE, designated SEQ ID:5704, to the nucleotide sequence of GAM99 RNA, herein designated GAM RNA, also designated SEQ ID:320.

Another function of GAM99 is therefore inhibition of Kinesin family member 1b (KIF1B, Accession NP_055889.1), a gene which motor for anterograde transport of mitochondria. has a microtubule plus end-directed motility. and therefore is associated with Charcot-marie-tooth disease, neuronal type, a. Accordingly, utilities of GAM99 include diagnosis, prevention and treatment of Charcot-marie- tooth disease, neuronal type, a, and of other diseases and clinical conditions associated with KIF1B.

The function of KIF1B and its association with various diseases and clinical conditions, has been established by previous studies, as described hereinabove with reference to GAM72.1. Klotho (KL, Accession NP_710150.1) is another GAM99 target gene, herein designated TARGET GENE. KL BINDING SITE is a target binding site found in the 3' untranslated region of multiple transcripts of mRNA encoded by KL, corresponding to a target binding site such as BINDING SITE I, BINDING SITE II or BINDING SITE III of FIG. 8. Table 4 illustrates the complementarity of the nucleotide sequences of KL BINDING SITE, designated SEQ ID:7411, to the nucleotide sequence of GAM99 RNA, herein designated GAM RNA, also designated SEQ ID:320.

Another function of GAM99 is therefore inhibition of Klotho (KL, Accession NP_710150.1), a gene which has similarity to beta-glucosidases. Accordingly, utilities of GAM99 include diagnosis, prevention and treatment of diseases and clinical conditions associated with KL.

The function of KL and its association with various diseases and clinical conditions, has been established by previous studies, as described hereinabove with reference to GAM48.2. Kallikrein 5 (KLK5, Accession NP_036559.1) is another GAM99 target gene, herein designated TARGET GENE. KLK5 BINDING SITE is a target binding site found in the 3' untranslated region of mRNA encoded by KLK5, corresponding to a target binding site such as BINDING SITE I, BINDING SITE II or BINDING SITE III of FIG. 8. Table 4 illustrates the complementarity of the nucleotide sequences of KLK5 BINDING SITE, designated SEQ ID:1827, to the nucleotide sequence of GAM99 RNA, herein designated GAM RNA, also designated SEQ ID:320.

Another function of GAM99 is therefore inhibition of Kallikrein 5 (KLK5, Accession NP_036559.1), a gene which may be involved in desquamation. Accordingly, utilities of GAM99 include diagnosis, prevention and treatment of diseases and clinical conditions associated with KLK5.

The function of KLK5 has been established by previous studies. Kallikreins, a subgroup of serine proteases, have diverse physiologic functions in many tissues. For additional background information on kallikreins, see 147960. The stratum corneum, the outermost layer of the skin, provides chemical and mechanical resistance. The layer is derived from anucleated, anabolically dead corneocytes that are differentiated from a subset of proliferating keratinocytes. After a 2- to 4-week period, the cells are shed in the process of desquamation. By zymographic analysis of corneocyte extracts, biochemical purification, N-terminal sequencing, database searching, and PCR of a keratinocyte library using degenerate primers, Brattsand and Egelrud (1999) isolated a cDNA encoding KLK5, which they termed SCTE. The deduced 293- amino acid protein contains a signal peptide, a propeptide, and a 227-amino acid catalytically active enzyme with 4 potential N-linked glycosylation sites and conserved serine-protease sites. Northern blot analysis detected a 1.6-kb transcript in a keratinocyte cell line. Western blot analysis showed expression of proteins ranging from 25 to 37 kD in plantar stratum corneum cells and 40 kD for the recombinant protein. After glycosidase treatment, all samples were expressed as approximately 33-kD proteins. RT-PCR analysis detected strong expression in skin, and after additional amplification, expression was also detected in other tissues, particularly brain, placenta, and kidney. Using a positional candidate approach to identify additional KLK genes on 19q13.3-q13.4, followed by EST database searching and PCR, Yousef and Diamandis (1999) obtained a cDNA encoding KLK5, which they called KLKL2. RT-PCR analysis detected expression primarily in brain, mammary gland, and testis, with lower levels in other tissues. In the presence of estrogens and progestins, KLK5 expression was upregulated in a breast cancer cell line. By genomic sequence analysis, Yousef and Diamandis (1999) determined that the KLK5 gene contains 5 coding exons spanning 9.3 kb on chromosome 19q13.3-q13.4. Harvey et al. (2000) mapped the KLK5 gene to chromosome 19q13.4 in the KLK gene cluster between KLK4 (OMIM Ref. No. 603767) and KLK6 (OMIM Ref. No. 602652). They noted that KLK5 to KLK14 are transcribed telomere to centromere. Kim et al. (2001) noted that KLK5 is expressed in a subset of ovarian tumors. They found a strong positive correlation between KLK5 expression and tumor grade and disease stage. They concluded that KLK5 expression is associated with more aggressive forms of epithelial ovarian carcinoma Full details of the abovementioned studies are described in the following publications, the disclosure of which are hereby incorporated by reference:

Kim, H.; Scorillas, A.; Katsaros, D.; Yousef, G. M.; Massobrio, M.; Fracchioli, S.; Piccinno, R.; Gordini, G.; Diamandis, E. P.: Human kallikrein gene 5 (KLK5) expression is an indicator of poor prognosis in ovarian cancer. Brit. J. Cancer 84:643-650, 2001; and Yousef, G. M.; Diamandis, E. P.: The new kallikrein-like gene, KLK-L2: molecular characterization, mapping, tissue expression, and hormonal regulation. J. Biol. Chem. 274: 37511-37516.

Further studies establishing the function and utilities of KLK5 are found in John Hopkins OMIM database record ID 605643, and in cited publications listed in Table 5, which are hereby incorporated by reference. Low density lipoprotein receptor (familial hypercholesterolemia) (LDLR, Accession NP_000518.1) is another GAM99 target gene, herein designated TARGET GENE. LDLR BINDING SITE is a target binding site found in the 3' untranslated region of mRNA encoded by LDLR, corresponding to a target binding site such as BINDING SITE I, BINDING SITE II or BINDING SITE III of FIG. 8. Table 4 illustrates the complementarity of the nucleotide sequences of LDLR BINDING SITE, designated SEQ ID:18207, to the nucleotide sequence of GAM99 RNA, herein designated GAM RNA, also designated SEQ ID:320.

Another function of GAM99 is therefore inhibition of Low density lipoprotein receptor (familial hypercholesterolemia) (LDLR, Accession NP_000518.1), a gene which also acts as a tumor suppressor. and therefore is associated with Familial hypercholesterolemia. Accordingly, utilities of GAM99 include diagnosis, prevention and treatment of Familial hypercholesterolemia, and of other diseases and clinical conditions associated with LDLR.

The function of LDLR has been established by previous studies. The low density lipoprotein receptor is a cell surface receptor that plays an important role in cholesterol homeostasis. The low density lipoprotein receptor is synthesized as a 120-kD glycoprotein precursor that undergoes change to a 160-kD mature glycoprotein through the covalent addition of a 40-kD protein (Tolleshaug et al., 1982). Yamamoto et al. (1984) reported that the human LDL receptor is an 839-amino acid protein rich in cysteine, with multiple copies of the Alu family of repetitive DNAs. Russell et al. (1984) demonstrated DNA sequence homology of the LDL receptor with the epidermal growth factor receptor (EGF; 131530). Francke et al. (1984) assigned the LDL receptor to chromosome 19 on the basis of expression studies in hamster-human somatic cell hybrids. The LDLR gene was regionalized to 19p13.1-p13.3 by in situ hybridization (Lindgren et al., 1985). Frank et al. (1989) identified RFLPs of the mouse LDL receptor gene and used them to map the gene, designated Ldlr, to the proximal region of chromosome 9. Using interspecific backcrosses, they established the order and interval distances for this and several other loci on mouse chromosome 9, namely, APOA4 (OMIM Ref. No. 107690), which is on chromosome 11 in man, and mannosephosphate isomerase (OMIM Ref. No. 154550), which is on chromosome 15 in man. In a patient with homozygous familial hypercholesterolemia (FH; 143890), Hobbs et al. (1986) described an LDL receptor mutant in which 1 of the 7 repeating units constituting the ligand binding domain had been deleted. The deletion arose by homologous recombination by repetitive Alu sequences in intron 4 and intron 5 of the gene. The deletion removed exon 5, which normally encodes the sixth repeat of the ligand binding domain. In the resultant mRNA, exon 4 was found to be spliced to exon 6, preserving the reading frame. The resulting shortened protein reaches the cell surface and reacts with antireceptor antibodies but does not bind LDL. It does, however, bind VLDL, a lipoprotein that contains apoprotein E as well as apoprotein B-100. The findings in this instructive case support the hypothesis that the 7 repeated sequences in the receptor constitute the LDL binding domain, that the sixth repeat is required for binding of LDL but not of VLDL, and that deletion of a single repeat can alter the binding specificity of the LDL receptor. Horsthemke et al. (1987) analyzed DNA from 70 patients in the UK with heterozygous familial hypercholesterolemia. In most, the restriction fragment pattern of the LDLR gene was indistinguishable from the normal; however, 3 patients were found to have a deletion of about 1 kb in the central portion of the gene. In 2 patients, the deletion included all or part of exon 5 (606945.0027); in the third, the deletion included exon 7 (606945.0033). Including a previously described patient with a deletion in the 3-prime part of the gene, these results indicated that 4 out of 70 patients, or 6%, have deletions. Langlois et al. (1988) screened 234 unrelated heterozygotes for FH to detect major rearrangements in the LDLR gene. Total genomic DNA was analyzed by Southern blot hybridization to probes encompassing exons 1 to 18 of the LDLR gene. Six different mutations were detected and characterized by use of exon-specific probes and detailed restriction mapping. The frequency of deletions in the Langlois et al. (1988) study was 2.5% (6 out of 234 patients). An illustration of previously mapped deletions and the deletions identified in this study (a total of 16) suggested that particular areas in the LDLR gene are susceptible to deletion. In a Japanese subject with homozygous hypercholesterolemia, Lehrman et al. (1987) found a 7.8- kb deletion in LDLR (606945.0029). The deletion joined intron 15 to the middle of exon 18, which encodes the 3-prime untranslated region, thereby removing all 3-prime splice acceptor sites distal to intron 15. The mRNA should produce a truncated receptor that lacks the normal membrane-COOH terminus. Rudiger et al. (1991) reviewed previously described deletions in the LDLR gene in cases of familial hypercholesterolemia and reported the finding of a deletion in 3 of 25 unrelated patients with FH. Defesche and Kastelein (1998) stated that more than 350 different mutations had been found in patients with familial hypercholesterolemia. They tabulated the preferential geographic distribution that has been demonstrated for some of the LDL receptor mutations. For example, in the West of Scotland about half of the index cases of FH were found to have the cys163- to - tyr mutation (606945.0058). Defesche and Kastelein (1998) commented on the geographic associations of LDL receptor mutations within the Netherlands.

Full details of the abovementioned studies are described in the following publications, the disclosure of which are hereby incorporated by reference:

Durst, R.; Colombo, R.; Shpitzen, S.; Ben Avi, L.; Friedlander, Y.; Wexler, R.; Raal, F. J.; Marais, D. A.; Defesche, J. C.; Mandelshtam, M. Y.; Kotze, M. J.; Leitersdorf, E.; Meiner, V.: Recent origin and spread of a common Lithuanian mutation, G197del LDLR, causing familial hypercholesterolemia: positive selection is not always necessary to account for disease incidence among Ashkenazi Jews. Am. J. Hum. Genet. 68:1172-1188, 2001; and Rudiger, N. S.; Heinsvig, E. M.; Hansen, F. A.; Faergeman, O.; Bolund, L.; Gregersen, N.: DNA deletions in the low density lipoprotein (LDL) receptor gene in Danish families with fami.

Further studies establishing the function and utilities of LDLR are found in John Hopkins OMIM database record ID 606945, and in cited publications listed in Table 5, which are hereby incorporated by reference. LOC130589 (Accession NP_620156.1) is another GAM99 target gene, herein designated TARGET GENE. LOC130589 BINDING SITE is a target binding site found in the 3' untranslated region of mRNA encoded by LOC130589, corresponding to a target binding site such as BINDING SITE I, BINDING SITE II or BINDING SITE III of FIG. 8. Table 4 illustrates the complementarity of the nucleotide sequences of LOC130589 BINDING SITE, designated SEQ ID:15914, to the nucleotide sequence of GAM99 RNA, herein designated GAM RNA, also designated SEQ ID:320.

Another function of GAM99 is therefore inhibition of LOC130589 (Accession NP_620156.1). Accordingly, utilities of GAM99 include diagnosis, prevention and treatment of diseases and clinical conditions associated with LOC130589.

LOC144486 (Accession XP_096608.1) is another GAM99 target gene, herein designated TARGET GENE. LOC144486 BINDING SITE is a target binding site found in the 3' untranslated region of mRNA encoded by LOC144486, corresponding to a target binding site such as BINDING SITE I, BINDING SITE II or BINDING SITE III of FIG. 8. Table 4 illustrates the complementarity of the nucleotide sequences of LOC144486 BINDING SITE, designated SEQ ID:6916, to the nucleotide sequence of GAM99 RNA, herein designated GAM RNA, also designated SEQ ID:320.

Another function of GAM99 is therefore inhibition of LOC144486 (Accession XP_096608.1). Accordingly, utilities of GAM99 include diagnosis, prevention and treatment of diseases and clinical conditions associated with LOC144486.

LOC144817 (Accession XP_084972.1) is another GAM99 target gene, herein designated TARGET GENE. LOC144817 BINDING SITE is a target binding site found in the 3' untranslated region of mRNA encoded by LOC144817, corresponding to a target binding site such as BINDING SITE I, BINDING SITE II or BINDING SITE III of FIG. 8. Table 4 illustrates the complementarity of the nucleotide sequences of LOC144817 BINDING SITE, designated SEQ ID:6779, to the nucleotide sequence of GAM99 RNA, herein designated GAM RNA, also designated SEQ ID:320.

Another function of GAM99 is therefore inhibition of LOC144817 (Accession XP_084972.1). Accordingly, utilities of GAM99 include diagnosis, prevention and treatment of diseases and clinical conditions associated with LOC144817.

LOC145694 (Accession XP_096838.1) is another GAM99 target gene, herein designated TARGET GENE. LOC145694 BINDING SITE is a target binding site found in the 3' untranslated region of mRNA encoded by LOC145694, corresponding to a target binding site such as BINDING SITE I, BINDING SITE II or BINDING SITE III of FIG. 8. Table 4 illustrates the complementarity of the nucleotide sequences of LOC145694 BINDING SITE, designated SEQ ID:15776, to the nucleotide sequence of GAM99 RNA, herein designated GAM RNA, also designated SEQ ID:320.

Another function of GAM99 is therefore inhibition of LOC145694 (Accession XP_096838.1). Accordingly, utilities of GAM99 include diagnosis, prevention and treatment of diseases and clinical conditions associated with LOC145694.

LOC148229 (Accession XP_086103.2) is another GAM99 target gene, herein designated TARGET GENE. LOC148229 BINDING SITE is a target binding site found in the 5' untranslated region of mRNA encoded by LOC148229, corresponding to a target binding site such as BINDING SITE I, BINDING SITE II or BINDING SITE III of FIG. 8. Table 4 illustrates the complementarity of the nucleotide sequences of LOC148229 BINDING SITE, designated SEQ ID:15339, to the nucleotide sequence of GAM99 RNA, herein designated GAM RNA, also designated SEQ ID:320.

Another function of GAM99 is therefore inhibition of LOC148229 (Accession XP_086103.2). Accordingly, utilities of GAM99 include diagnosis, prevention and treatment of diseases and clinical conditions associated with LOC148229.

LOC158314 (Accession XP_098920.1) is another GAM99 target gene, herein designated TARGET GENE. LOC158314 BINDING SITE is a target binding site found in the 3' untranslated region of mRNA encoded by LOC158314, corresponding to a target binding site such as BINDING SITE I, BINDING SITE II or BINDING SITE III of FIG. 8. Table 4 illustrates the complementarity of the nucleotide sequences of LOC158314 BINDING SITE, designated SEQ ID:3652, to the nucleotide sequence of GAM99 RNA, herein designated GAM RNA, also designated SEQ ID:320.

Another function of GAM99 is therefore inhibition of LOC158314 (Accession XP_098920.1). Accordingly, utilities of GAM99 include diagnosis, prevention and treatment of diseases and clinical conditions associated with LOC158314.

LOC170394 (Accession XP_096329.1) is another GAM99 target gene, herein designated TARGET GENE. LOC170394 BINDING SITE is a target binding site found in the 5' untranslated region of mRNA encoded by LOC170394, corresponding to a target binding site such as BINDING SITE I, BINDING SITE II or BINDING SITE III of FIG. 8. Table 4 illustrates the complementarity of the nucleotide sequences of LOC170394 BINDING SITE, designated SEQ ID:19448, to the nucleotide sequence of GAM99 RNA, herein designated GAM RNA, also designated SEQ ID:320.

Another function of GAM99 is therefore inhibition of LOC170394 (Accession XP_096329.1). Accordingly, utilities of GAM99 include diagnosis, prevention and treatment of diseases and clinical conditions associated with LOC170394.

LOC202134 (Accession XP_117365.1) is another GAM99 target gene, herein designated TARGET GENE. LOC202134 BINDING SITE is a target binding site found in the 3' untranslated region of mRNA encoded by LOC202134, corresponding to a target binding site such as BINDING SITE I, BINDING SITE II or BINDING SITE III of FIG. 8. Table 4 illustrates the complementarity of the nucleotide sequences of LOC202134 BINDING SITE, designated SEQ ID:19255, to the nucleotide sequence of GAM99 RNA, herein designated GAM RNA, also designated SEQ ID:320.

Another function of GAM99 is therefore inhibition of LOC202134 (Accession XP_117365.1). Accordingly, utilities of GAM99 include diagnosis, prevention and treatment of diseases and clinical conditions associated with LOC202134.

LOC253187 (Accession XP_173139.1) is another GAM99 target gene, herein designated TARGET GENE. LOC253187 BINDING SITE is a target binding site found in the 5' untranslated region of mRNA encoded by LOC253187, corresponding to a target binding site such as BINDING SITE I, BINDING SITE II or BINDING SITE III of FIG. 8. Table 4 illustrates the complementarity of the nucleotide sequences of LOC253187 BINDING SITE, designated SEQ ID:7893, to the nucleotide sequence of GAM99 RNA, herein designated GAM RNA, also designated SEQ ID:320.

Another function of GAM99 is therefore inhibition of LOC253187 (Accession XP_173139.1). Accordingly, utilities of GAM99 include diagnosis, prevention and treatment of diseases and clinical conditions associated with LOC253187.

LOC255480 (Accession XP_172895.1) is another GAM99 target gene, herein designated TARGET GENE. LOC255480 BINDING SITE is a target binding site found in the 5' untranslated region of mRNA encoded by LOC255480, corresponding to a target binding site such as BINDING SITE I, BINDING SITE II or BINDING SITE III of FIG. 8. Table 4 illustrates the complementarity of the nucleotide sequences of LOC255480 BINDING SITE, designated SEQ ID:14608, to the nucleotide sequence of GAM99 RNA, herein designated GAM RNA, also designated SEQ ID:320.

Another function of GAM99 is therefore inhibition of LOC255480 (Accession XP_172895.1). Accordingly, utilities of GAM99 include diagnosis, prevention and treatment of diseases and clinical conditions associated with LOC255480.

LOC283107 (Accession XP_210889.1) is another GAM99 target gene, herein designated TARGET GENE. LOC283107 BINDING SITE is a target binding site found in the 3' untranslated region of mRNA encoded by LOC283107, corresponding to a target binding site such as BINDING SITE I, BINDING SITE II or BINDING SITE III of FIG. 8. Table 4 illustrates the complementarity of the nucleotide sequences of LOC283107 BINDING SITE, designated SEQ ID:2178, to the nucleotide sequence of GAM99 RNA, herein designated GAM RNA, also designated SEQ ID:320.

Another function of GAM99 is therefore inhibition of LOC283107 (Accession XP_210889.1). Accordingly, utilities of GAM99 include diagnosis, prevention and treatment of diseases and clinical conditions associated with LOC283107.

LOC283270 (Accession XP_210956.1) is another GAM99 target gene, herein designated TARGET GENE. LOC283270 BINDING SITE is a target binding site found in the 5' untranslated region of mRNA encoded by LOC283270, corresponding to a target binding site such as BINDING SITE I, BINDING SITE II or BINDING SITE III of FIG. 8. Table 4 illustrates the complementarity of the nucleotide sequences of LOC283270 BINDING SITE, designated SEQ ID:19809, to the nucleotide sequence of GAM99 RNA, herein designated GAM RNA, also designated SEQ ID:320.

Another function of GAM99 is therefore inhibition of LOC283270 (Accession XP_210956.1). Accordingly, utilities of GAM99 include diagnosis, prevention and treatment of diseases and clinical conditions associated with LOC283270.

LOC283633 (Accession XP_208762.1) is another GAM99 target gene, herein designated TARGET GENE. LOC283633 BINDING SITE is a target binding site found in the 5' untranslated region of mRNA encoded by LOC283633, corresponding to a target binding site such as BINDING SITE I, BINDING SITE II or BINDING SITE III of FIG. 8. Table 4 illustrates the complementarity of the nucleotide sequences of LOC283633 BINDING SITE, designated SEQ ID:19415, to the nucleotide sequence of GAM99 RNA, herein designated GAM RNA, also designated SEQ ID:320.

Another function of GAM99 is therefore inhibition of LOC283633 (Accession XP_208762.1). Accordingly, utilities of GAM99 include diagnosis, prevention and treatment of diseases and clinical conditions associated with LOC283633.

LOC283889 (Accession XP_208899.1) is another GAM99 target gene, herein designated TARGET GENE. LOC283889 BINDING SITE is a target binding site found in the 3' untranslated region of mRNA encoded by LOC283889, corresponding to a target binding site such as BINDING SITE I, BINDING SITE II or BINDING SITE III of FIG. 8. Table 4 illustrates the complementarity of the nucleotide sequences of LOC283889 BINDING SITE, designated SEQ ID:16591, to the nucleotide sequence of GAM99 RNA, herein designated GAM RNA, also designated SEQ ID:320.

Another function of GAM99 is therefore inhibition of LOC283889 (Accession XP_208899.1). Accordingly, utilities of GAM99 include diagnosis, prevention and treatment of diseases and clinical conditions associated with LOC283889.

LOC284001 (Accession XP_208958.2) is another GAM99 target gene, herein designated TARGET GENE. LOC284001 BINDING SITE is a target binding site found in the 3' untranslated region of mRNA encoded by LOC284001, corresponding to a target binding site such as BINDING SITE I, BINDING SITE II or BINDING SITE III of FIG. 8. Table 4 illustrates the complementarity of the nucleotide sequences of LOC284001 BINDING SITE, designated SEQ ID:10403, to the nucleotide sequence of GAM99 RNA, herein designated GAM RNA, also designated SEQ ID:320.

Another function of GAM99 is therefore inhibition of LOC284001 (Accession XP_208958.2). Accordingly, utilities of GAM99 include diagnosis, prevention and treatment of diseases and clinical conditions associated with LOC284001.

LOC284024 (Accession XP_208970.1) is another GAM99 target gene, herein designated TARGET GENE. LOC284024 BINDING SITE is a target binding site found in the 5' untranslated region of mRNA encoded by LOC284024, corresponding to a target binding site such as BINDING SITE I, BINDING SITE II or BINDING SITE III of FIG. 8. Table 4 illustrates the complementarity of the nucleotide sequences of LOC284024 BINDING SITE, designated SEQ ID:5062, to the nucleotide sequence of GAM99 RNA, herein designated GAM RNA, also designated SEQ ID:320.

Another function of GAM99 is therefore inhibition of LOC284024 (Accession XP_208970.1). Accordingly, utilities of GAM99 include diagnosis, prevention and treatment of diseases and clinical conditions associated with LOC284024.

LOC284344 (Accession XP_209161.1) is another GAM99 target gene, herein designated TARGET GENE. LOC284344 BINDING SITE is a target binding site found in the 3' untranslated region of mRNA encoded by LOC284344, corresponding to a target binding site such as BINDING SITE I, BINDING SITE II or BINDING SITE III of FIG. 8. Table 4 illustrates the complementarity of the nucleotide sequences of LOC284344 BINDING SITE, designated SEQ ID:13243, to the nucleotide sequence of GAM99 RNA, herein designated GAM RNA, also designated SEQ ID:320.

Another function of GAM99 is therefore inhibition of LOC284344 (Accession XP_209161.1). Accordingly, utilities of GAM99 include diagnosis, prevention and treatment of diseases and clinical conditions associated with LOC284344.

LOC284542 (Accession XP_209254.1) is another GAM99 target gene, herein designated TARGET GENE. LOC284542 BINDING SITE1 and LOC284542 BINDING SITE2 are target binding sites found in untranslated regions of mRNA encoded by LOC284542, corresponding to target binding sites such as BINDING SITE I, BINDING SITE II or BINDING SITE III of FIG. 8. Table 4 illustrates the complementarity of the nucleotide sequences of LOC284542 BINDING SITE1 and LOC284542 BINDING SITE2, designated SEQ ID:3690 and SEQ ID:8640 respectively, to the nucleotide sequence of GAM99 RNA, herein designated GAM RNA, also designated SEQ ID:320.

Another function of GAM99 is therefore inhibition of LOC284542 (Accession XP_209254.1). Accordingly, utilities of GAM99 include diagnosis, prevention and treatment of diseases and clinical conditions associated with LOC284542.

LOC284749 (Accession XP_211623.1) is another GAM99 target gene, herein designated TARGET GENE. LOC284749 BINDING SITE is a target binding site found in the 5' untranslated region of mRNA encoded by LOC284749, corresponding to a target binding site such as BINDING SITE I, BINDING SITE II or BINDING SITE III of FIG. 8. Table 4 illustrates the complementarity of the nucleotide sequences of LOC284749 BINDING SITE, designated SEQ ID:2267, to the nucleotide sequence of GAM99 RNA, herein designated GAM RNA, also designated SEQ ID:320.

Another function of GAM99 is therefore inhibition of LOC284749 (Accession XP_211623.1). Accordingly, utilities of GAM99 include diagnosis, prevention and treatment of diseases and clinical conditions associated with LOC284749.

LOC284824 (Accession XP_211652.1) is another GAM99 target gene, herein designated TARGET GENE. LOC284824 BINDING SITE is a target binding site found in the 3' untranslated region of mRNA encoded by LOC284824, corresponding to a target binding site such as BINDING SITE I, BINDING SITE II or BINDING SITE III of FIG. 8. Table 4 illustrates the complementarity of the nucleotide sequences of LOC284824 BINDING SITE, designated SEQ ID:3070, to the nucleotide sequence of GAM99 RNA, herein designated GAM RNA, also designated SEQ ID:320.

Another function of GAM99 is therefore inhibition of LOC284824 (Accession XP_211652.1). Accordingly, utilities of GAM99 include diagnosis, prevention and treatment of diseases and clinical conditions associated with LOC284824.

LOC284899 (Accession XP_211680.1) is another GAM99 target gene, herein designated TARGET GENE. LOC284899 BINDING SITE is a target binding site found in the 5' untranslated region of mRNA encoded by LOC284899, corresponding to a target binding site such as BINDING SITE I, BINDING SITE II or BINDING SITE III of FIG. 8. Table 4 illustrates the complementarity of the nucleotide sequences of LOC284899 BINDING SITE, designated SEQ ID:2009, to the nucleotide sequence of GAM99 RNA, herein designated GAM RNA, also designated SEQ ID:320.

Another function of GAM99 is therefore inhibition of LOC284899 (Accession XP_211680.1). Accordingly, utilities of GAM99 include diagnosis, prevention and treatment of diseases and clinical conditions associated with LOC284899.

LOC285123 (Accession XP_211773.1) is another GAM99 target gene, herein designated TARGET GENE. LOC285123 BINDING SITE is a target binding site found in the 3' untranslated region of mRNA encoded by LOC285123, corresponding to a target binding site such as BINDING SITE I, BINDING SITE II or BINDING SITE III of FIG. 8. Table 4 illustrates the complementarity of the nucleotide sequences of LOC285123 BINDING SITE, designated SEQ ID:15571, to the nucleotide sequence of GAM99 RNA, herein designated GAM RNA, also designated SEQ ID:320.

Another function of GAM99 is therefore inhibition of LOC285123 (Accession XP_211773.1). Accordingly, utilities of GAM99 include diagnosis, prevention and treatment of diseases and clinical conditions associated with LOC285123.

LOC285332 (Accession XP_211845.1) is another GAM99 target gene, herein designated TARGET GENE. LOC285332 BINDING SITE is a target binding site found in the 3' untranslated region of mRNA encoded by LOC285332, corresponding to a target binding site such as BINDING SITE I, BINDING SITE II or BINDING SITE III of FIG. 8. Table 4 illustrates the complementarity of the nucleotide sequences of LOC285332 BINDING SITE, designated SEQ ID:3373, to the nucleotide sequence of GAM99 RNA, herein designated GAM RNA, also designated SEQ ID:320.

Another function of GAM99 is therefore inhibition of LOC285332 (Accession XP_211845.1). Accordingly, utilities of GAM99 include diagnosis, prevention and treatment of diseases and clinical conditions associated with LOC285332.

LOC285366 (Accession XP_209581.1) is another GAM99 target gene, herein designated TARGET GENE. LOC285366 BINDING SITE is a target binding site found in the 3' untranslated region of mRNA encoded by LOC285366, corresponding to a target binding site such as BINDING SITE I, BINDING SITE II or BINDING SITE III of FIG. 8. Table 4 illustrates the complementarity of the nucleotide sequences of LOC285366 BINDING SITE, designated SEQ ID:1542, to the nucleotide sequence of GAM99 RNA, herein designated GAM RNA, also designated SEQ ID:320.

Another function of GAM99 is therefore inhibition of LOC285366 (Accession XP_209581.1). Accordingly, utilities of GAM99 include diagnosis, prevention and treatment of diseases and clinical conditions associated with LOC285366.

LOC285388 (Accession XP_208316.1) is another GAM99 target gene, herein designated TARGET GENE. LOC285388 BINDING SITE is a target binding site found in the 5' untranslated region of mRNA encoded by LOC285388, corresponding to a target binding site such as BINDING SITE I, BINDING SITE II or BINDING SITE III of FIG. 8. Table 4 illustrates the complementarity of the nucleotide sequences of LOC285388 BINDING SITE, designated SEQ ID:19495, to the nucleotide sequence of GAM99 RNA, herein designated GAM RNA, also designated SEQ ID:320.

Another function of GAM99 is therefore inhibition of LOC285388 (Accession XP_208316.1). Accordingly, utilities of GAM99 include diagnosis, prevention and treatment of diseases and clinical conditions associated with LOC285388.

LOC286101 (Accession XP_209902.1) is another GAM99 target gene, herein designated TARGET GENE. LOC286101 BINDING SITE is a target binding site found in the 3' untranslated region of mRNA encoded by LOC286101, corresponding to a target binding site such as BINDING SITE I, BINDING SITE II or BINDING SITE III of FIG. 8. Table 4 illustrates the complementarity of the nucleotide sequences of LOC286101 BINDING SITE, designated SEQ ID:16310, to the nucleotide sequence of GAM99 RNA, herein designated GAM RNA, also designated SEQ ID:320.

Another function of GAM99 is therefore inhibition of LOC286101 (Accession XP_209902.1). Accordingly, utilities of GAM99 include diagnosis, prevention and treatment of diseases and clinical conditions associated with LOC286101.

LOC286184 (Accession XP_212216.1) is another GAM99 target gene, herein designated TARGET GENE. LOC286184 BINDING SITE is a target binding site found in the 3' untranslated region of mRNA encoded by LOC286184, corresponding to a target binding site such as BINDING SITE I, BINDING SITE II or BINDING SITE III of FIG. 8. Table 4 illustrates the complementarity of the nucleotide sequences of LOC286184 BINDING SITE, designated SEQ ID:15285, to the nucleotide sequence of GAM99 RNA, herein designated GAM RNA, also designated SEQ ID:320.

Another function of GAM99 is therefore inhibition of LOC286184 (Accession XP_212216.1). Accordingly, utilities of GAM99 include diagnosis, prevention and treatment of diseases and clinical conditions associated with LOC286184.

LOC286188 (Accession XP_209933.1) is another GAM99 target gene, herein designated TARGET GENE. LOC286188 BINDING SITE is a target binding site found in the 3' untranslated region of mRNA encoded by LOC286188, corresponding to a target binding site such as BINDING SITE I, BINDING SITE II or BINDING SITE III of FIG. 8. Table 4 illustrates the complementarity of the nucleotide sequences of LOC286188 BINDING SITE, designated SEQ ID:2050, to the nucleotide sequence of GAM99 RNA, herein designated GAM RNA, also designated SEQ ID:320.

Another function of GAM99 is therefore inhibition of LOC286188 (Accession XP_209933.1). Accordingly, utilities of GAM99 include diagnosis, prevention and treatment of diseases and clinical conditions associated with LOC286188.

LOC339199 (Accession XP_290759.1) is another GAM99 target gene, herein designated TARGET GENE. LOC339199 BINDING SITE is a target binding site found in the 3' untranslated region of mRNA encoded by LOC339199, corresponding to a target binding site such as BINDING SITE I, BINDING SITE II or BINDING SITE III of FIG. 8. Table 4 illustrates the complementarity of the nucleotide sequences of LOC339199 BINDING SITE, designated SEQ ID:20117, to the nucleotide sequence of GAM99 RNA, herein designated GAM RNA, also designated SEQ ID:320.

Another function of GAM99 is therefore inhibition of LOC339199 (Accession XP_290759.1). Accordingly, utilities of GAM99 include diagnosis, prevention and treatment of diseases and clinical conditions associated with LOC339199.

LOC340371 (Accession XP_291255.2) is another GAM99 target gene, herein designated TARGET GENE. LOC340371 BINDING SITE is a target binding site found in the 3' untranslated region of multiple transcripts of mRNA encoded by LOC340371, corresponding to a target binding site such as BINDING SITE I, BINDING SITE II or BINDING SITE III of FIG. 8. Table 4 illustrates the complementarity of the nucleotide sequences of LOC340371 BINDING SITE, designated SEQ ID:6677, to the nucleotide sequence of GAM99 RNA, herein designated GAM RNA, also designated SEQ ID:320.

Another function of GAM99 is therefore inhibition of LOC340371 (Accession XP_291255.2). Accordingly, utilities of GAM99 include diagnosis, prevention and treatment of diseases and clinical conditions associated with LOC340371.

LOC340371 (Accession NP_848659.1) is another GAM99 target gene, herein designated TARGET GENE. LOC340371 BINDING SITE is a target binding site found in the 3' untranslated region of multiple transcripts of mRNA encoded by LOC340371, corresponding to a target binding site such as BINDING SITE I, BINDING SITE II or BINDING SITE III of FIG. 8. Table 4 illustrates the complementarity of the nucleotide sequences of LOC340371 BINDING SITE, designated SEQ ID:6677, to the nucleotide sequence of GAM99 RNA, herein designated GAM RNA, also designated SEQ ID:320.

Another function of GAM99 is therefore inhibition of LOC340371 (Accession NP_848659.1). Accordingly, utilities of GAM99 include diagnosis, prevention and treatment of diseases and clinical conditions associated with LOC340371.

LOC342346 (Accession XP_296817.2) is another GAM99 target gene, herein designated TARGET GENE. LOC342346 BINDING SITE is a target binding site found in the 5' untranslated region of mRNA encoded by LOC342346, corresponding to a target binding site such as BINDING SITE I, BINDING SITE II or BINDING SITE III of FIG. 8. Table 4 illustrates the complementarity of the nucleotide sequences of LOC342346 BINDING SITE, designated SEQ ID:6898, to the nucleotide sequence of GAM99 RNA, herein designated GAM RNA, also designated SEQ ID:320.

Another function of GAM99 is therefore inhibition of LOC342346 (Accession XP_296817.2). Accordingly, utilities of GAM99 include diagnosis, prevention and treatment of diseases and clinical conditions associated with LOC342346.

LOC346284 (Accession XP_294161.2) is another GAM99 target gene, herein designated TARGET GENE. LOC346284 BINDING SITE is a target binding site found in the 5' untranslated region of mRNA encoded by LOC346284, corresponding to a target binding site such as BINDING SITE I, BINDING SITE II or BINDING SITE III of FIG. 8. Table 4 illustrates the complementarity of the nucleotide sequences of LOC346284 BINDING SITE, designated SEQ ID:18310, to the nucleotide sequence of GAM99 RNA, herein designated GAM RNA, also designated SEQ ID:320.

Another function of GAM99 is therefore inhibition of LOC346284 (Accession XP_294161.2). Accordingly, utilities of GAM99 include diagnosis, prevention and treatment of diseases and clinical conditions associated with LOC346284.

LOC349228 (Accession XP_303005.1) is another GAM99 target gene, herein designated TARGET GENE. LOC349228 BINDING SITE is a target binding site found in the 3' untranslated region of mRNA encoded by LOC349228, corresponding to a target binding site such as BINDING SITE I, BINDING SITE II or BINDING SITE III of FIG. 8. Table 4 illustrates the complementarity of the nucleotide sequences of LOC349228 BINDING SITE, designated SEQ ID:8523, to the nucleotide sequence of GAM99 RNA, herein designated GAM RNA, also designated SEQ ID:320.

Another function of GAM99 is therefore inhibition of LOC349228 (Accession XP_303005.1). Accordingly, utilities of GAM99 include diagnosis, prevention and treatment of diseases and clinical conditions associated with LOC349228.

LOC349282 (Accession XP_301008.1) is another GAM99 target gene, herein designated TARGET GENE. LOC349282 BINDING SITE is a target binding site found in the 5' untranslated region of mRNA encoded by LOC349282, corresponding to a target binding site such as BINDING SITE I, BINDING SITE II or BINDING SITE III of FIG. 8. Table 4 illustrates the complementarity of the nucleotide sequences of LOC349282 BINDING SITE, designated SEQ ID:4792, to the nucleotide sequence of GAM99 RNA, herein designated GAM RNA, also designated SEQ ID:320.

Another function of GAM99 is therefore inhibition of LOC349282 (Accession XP_301008.1). Accordingly, utilities of GAM99 include diagnosis, prevention and treatment of diseases and clinical conditions associated with LOC349282.

LOC349313 (Accession XP_301024.1) is another GAM99 target gene, herein designated TARGET GENE. LOC349313 BINDING SITE is a target binding site found in the 5' untranslated region of mRNA encoded by LOC349313, corresponding to a target binding site such as BINDING SITE I, BINDING SITE II or BINDING SITE III of FIG. 8. Table 4 illustrates the complementarity of the nucleotide sequences of LOC349313 BINDING SITE, designated SEQ ID:4792, to the nucleotide sequence of GAM99 RNA, herein designated GAM RNA, also designated SEQ ID:320.

Another function of GAM99 is therefore inhibition of LOC349313 (Accession XP_301024.1). Accordingly, utilities of GAM99 include diagnosis, prevention and treatment of diseases and clinical conditions associated with LOC349313.

LOC57209 (Accession XP_290488.1) is another GAM99 target gene, herein designated TARGET GENE. LOC57209 BINDING SITE is a target binding site found in the 3' untranslated region of mRNA encoded by LOC57209, corresponding to a target binding site such as BINDING SITE I, BINDING SITE II or BINDING SITE III of FIG. 8. Table 4 illustrates the complementarity of the nucleotide sequences of LOC57209 BINDING SITE, designated SEQ ID:2672, to the nucleotide sequence of GAM99 RNA, herein designated GAM RNA, also designated SEQ ID:320.

Another function of GAM99 is therefore inhibition of LOC57209 (Accession XP_290488.1). Accordingly, utilities of GAM99 include diagnosis, prevention and treatment of diseases and clinical conditions associated with LOC57209.

LOC63920 (Accession NP_071373.2) is another GAM99 target gene, herein designated TARGET GENE. LOC63920 BINDING SITE is a target binding site found in the 5' untranslated region of mRNA encoded by LOC63920, corresponding to a target binding site such as BINDING SITE I, BINDING SITE II or BINDING SITE III of FIG. 8. Table 4 illustrates the complementarity of the nucleotide sequences of LOC63920 BINDING SITE, designated SEQ ID:6406, to the nucleotide sequence of GAM99 RNA, herein designated GAM RNA, also designated SEQ ID:320.

Another function of GAM99 is therefore inhibition of LOC63920 (Accession NP_071373.2). Accordingly, utilities of GAM99 include diagnosis, prevention and treatment of diseases and clinical conditions associated with LOC63920.

LOC94468 (Accession XP_017293.3) is another GAM99 target gene, herein designated TARGET GENE. LOC94468 BINDING SITE is a target binding site found in the 5' untranslated region of mRNA encoded by LOC94468, corresponding to a target binding site such as BINDING SITE I, BINDING SITE II or BINDING SITE III of FIG. 8. Table 4 illustrates the complementarity of the nucleotide sequences of LOC94468 BINDING SITE, designated SEQ ID:1169, to the nucleotide sequence of GAM99 RNA, herein designated GAM RNA, also designated SEQ ID:320.

Another function of GAM99 is therefore inhibition of LOC94468 (Accession XP_017293.3). Accordingly, utilities of GAM99 include diagnosis, prevention and treatment of diseases and clinical conditions associated with LOC94468.

Leupaxin (LPXN, Accession NP_004802.1) is another GAM99 target gene, herein designated TARGET GENE. LPXN BINDING SITE is a target binding site found in the 3' untranslated region of mRNA encoded by LPXN, corresponding to a target binding site such as BINDING SITE I, BINDING SITE II or BINDING SITE III of FIG. 8. Table 4 illustrates the complementarity of the nucleotide sequences of LPXN BINDING SITE, designated SEQ ID:9179, to the nucleotide sequence of GAM99 RNA, herein designated GAM RNA, also designated SEQ ID:320.

Another function of GAM99 is therefore inhibition of Leupaxin (LPXN, Accession NP_004802.1). Accordingly, utilities of GAM99 include diagnosis, prevention and treatment of diseases and clinical conditions associated with LPXN.

Melanoma antigen, family a, 4 (MAGEA4, Accession NP_002353.2) is another GAM99 target gene, herein designated TARGET GENE. MAGEA4 BINDING SITE is a target binding site found in the 3' untranslated region of mRNA encoded by MAGEA4, corresponding to a target binding site such as BINDING SITE I, BINDING SITE II or BINDING SITE III of FIG. 8. Table 4 illustrates the complementarity of the nucleotide sequences of MAGEA4 BINDING SITE, designated SEQ ID:6081, to the nucleotide sequence of GAM99 RNA, herein designated GAM RNA, also designated SEQ ID:320.

Another function of GAM99 is therefore inhibition of Melanoma antigen, family a, 4 (MAGEA4, Accession NP_002353.2), a gene which may play a role in embryonal development and tumor transformation or tumor progression and therefore may be associated with Hodgkin disease. Accordingly, utilities of GAM99 include diagnosis, prevention and treatment of Hodgkin disease, and of other diseases and clinical conditions associated with MAGEA4.

The function of MAGEA4 has been established by previous studies. Genes of the MAGE-A family are expressed in several types of solid tumors but are silent in normal tissues, with the exception of male germline cells, which do not carry HLA molecules. Therefore, peptides encoded by MAGE-A genes are strictly tumor-specific antigens that can be recognized by CTL and constitute promising targets for immunotherapy. Chambost et al. (2000) found that 5 of 18 samples (28%) from patients with Hodgkin disease expressed MAGE-A4. In tissue sections, staining by a monoclonal antibody that recognizes MAGE-A4 protein was observed in 11 of 53 samples (21%) from patients with Hodgkin disease. In the positive samples, the Reed-Sternberg cells were strongly stained, whereas the surrounding cells were not. These results indicated that Hodgkin disease may be a target for specific immunotherapy involving MAGE-A4 antigens. De Plaen et al. (1994) used human/rodent cell hybrids to map the MAGE family A cluster to Xq26-qter. Rogner et al. (1995) refined the mapping of the MAGE family A cluster to Xq28. The 12 genes are arranged in 3 clusters within 3.5 Mb.

Full details of the abovementioned studies are described in the following publications, the disclosure of which are hereby incorporated by reference:

Chambost, H.; Van Baren, N.; Brasseur, F.; Godelaine, D.; Xerri, L.; Landi, S. J.; Theate, I.; Plumas, J.; Spagnoli, G. C.; Michel, G.; Coulie, P. G.; Olive, D.: Expression of gene MAGE-A4 in Reed-Sternberg cells. Blood 95:3530-3533, 2000; and De Plaen, E.; Arden, K.; Traversari, C.; Gaforio, J. J.; Szikora, J.-P.; De Smet, C.; Brasseur, F.; van der Bruggen, P.; Lethe, B.; Lurquin, C.; Brasseur, R.; Chomez, P.; De Backer, O.

Further studies establishing the function and utilities of MAGEA4 are found in John Hopkins OMIM database record ID 300175, and in cited publications listed in Table 5, which are hereby incorporated by reference. Mitogen-activated protein kinase kinase 1 (MAP2K1, Accession NP_002746.1) is another GAM99 target gene, herein designated TARGET GENE. MAP2K1 BINDING SITE is a target binding site found in the 3' untranslated region of mRNA encoded by MAP2K1, corresponding to a target binding site such as BINDING SITE I, BINDING SITE II or BINDING SITE III of FIG. 8. Table 4 illustrates the complementarity of the nucleotide sequences of MAP2K1 BINDING SITE, designated SEQ ID:20080, to the nucleotide sequence of GAM99 RNA, herein designated GAM RNA, also designated SEQ ID:320.

Another function of GAM99 is therefore inhibition of Mitogen-activated protein kinase kinase 1 (MAP2K1, Accession NP_002746.1), a gene which is a signaling intermediate, may take part in cell transformation and therefore may be associated with Colon cancer. Accordingly, utilities of GAM99 include diagnosis, prevention and treatment of Colon cancer, and of other diseases and clinical conditions associated with MAP2K1.

The function of MAP2K1 has been established by previous studies. Mitogen-activated protein (MAP) kinases, also known as extracellular signal-regulated kinases (ERKs) (see OMIM Ref. No. PRKM1; 176948), are thought to act as an integration point for multiple biochemical signals because they are activated by a wide variety of extracellular signals, are rapidly phosphorylated on threonine and tyrosine residues, and are highly conserved in evolution (Crews et al., 1992). A critical protein kinase lies upstream of MAP kinase and stimulates the enzymatic activity of MAP kinase. Crews et al. (1992) cloned a mouse cDNA, denoted Mek1 (for Map/Erk kinase-1) by them, that encodes a member of this protein kinase family. The 393-amino acid, 43.5-kD protein is most closely related in size and sequence to the product encoded by the byr1 gene of S. pombe. Crews et al. (1992) found that Mek1 protein expressed in bacteria phosphorylates the Erk gene product in vitro. They showed that the Mek1 gene is highly expressed in murine brain. Ryan et al. (2000) showed that inhibition of MEK1 blocks p53 (OMIM Ref. No. 191170)-induced NF-kappa-B activation and apoptosis but not cell cycle arrest. They demonstrated that p53 activates NF-kappa-B through the RAF/MEK1/p90(rsk) (see OMIM Ref. No. 601684) pathway rather than the TNFR1 (OMIM Ref. No. 191190)/TRAF2 (OMIM Ref. No. 601895)/IKK (e.g., 600664) pathway used by TNFA (OMIM Ref. No. 191160). To elucidate the mechanism through which MAPK signaling regulates the MYOD (OMIM Ref. No. 159970) family of transcription factors, Perry et al. (2001) investigated the role of the signaling intermediate MEK1 in myogenesis. Transfection of activated MEK1 strongly repressed gene activation and myogenic conversion by the MYOD family. This repression was not mediated by direct phosphorylation of MYOD or by changes in MYOD stability or subcellular distribution. Deletion mapping revealed that MEK1-mediated repression required the MYOD N-terminal transactivation domain. Moreover, activated MEK1 was nuclearly localized and bound a complex containing MYOD in a manner that was dependent on the presence of the MYOD N terminus. These data demonstrated that MEK1 signaling has a strong negative effect on MYOD activity via a mechanism involving binding of MEK1 to the nuclear MYOD transcriptional comple Full details of the abovementioned studies are described in the following publications, the disclosure of which are hereby incorporated by reference:

Crews, C. M.; Alessandrini, A.; Erikson, R. L.: The primary structure of MEK, a protein kinase that phosphorylates the ERK gene product. Science 258:478-480, 1992; and Perry, R. L. S.; Parker, M. H.; Rudnicki, M. A.: Activated MEK1 binds the nuclear MyoD transcriptional complex to repress transactivation. Molec. Cell 8: 291-301, 2001.

Further studies establishing the function and utilities of MAP2K1 are found in John Hopkins OMIM database record ID 176872, and in cited publications listed in Table 5, which are hereby incorporated by reference. MGC14141 (Accession NP_116317.1) is another GAM99 target gene, herein designated TARGET GENE. MGC14141 BINDING SITE is a target binding site found in the 3' untranslated region of mRNA encoded by MGC14141, corresponding to a target binding site such as BINDING SITE I, BINDING SITE II or BINDING SITE III of FIG. 8. Table 4 illustrates the complementarity of the nucleotide sequences of MGC14141 BINDING SITE, designated SEQ ID:3511, to the nucleotide sequence of GAM99 RNA, herein designated GAM RNA, also designated SEQ ID:320.

Another function of GAM99 is therefore inhibition of MGC14141 (Accession NP_116317.1). Accordingly, utilities of GAM99 include diagnosis, prevention and treatment of diseases and clinical conditions associated with MGC14141.

MGC34648 (Accession NP_689873.1) is another GAM99 target gene, herein designated TARGET GENE. MGC34648 BINDING SITE is a target binding site found in the 3' untranslated region of mRNA encoded by MGC34648, corresponding to a target binding site such as BINDING SITE I, BINDING SITE II or BINDING SITE III of FIG. 8. Table 4 illustrates the complementarity of the nucleotide sequences of MGC34648 BINDING SITE, designated SEQ ID:5090, to the nucleotide sequence of GAM99 RNA, herein designated GAM RNA, also designated SEQ ID:320.

Another function of GAM99 is therefore inhibition of MGC34648 (Accession NP_689873.1). Accordingly, utilities of GAM99 include diagnosis, prevention and treatment of diseases and clinical conditions associated with MGC34648.

MGC4189 (Accession NP_115684.1) is another GAM99 target gene, herein designated TARGET GENE. MGC4189 BINDING SITE is a target binding site found in the 3' untranslated region of mRNA encoded by MGC4189, corresponding to a target binding site such as BINDING SITE I, BINDING SITE II or BINDING SITE III of FIG. 8. Table 4 illustrates the complementarity of the nucleotide sequences of MGC4189 BINDING SITE, designated SEQ ID:9209, to the nucleotide sequence of GAM99 RNA, herein designated GAM RNA, also designated SEQ ID:320.

Another function of GAM99 is therefore inhibition of MGC4189 (Accession NP_115684.1). Accordingly, utilities of GAM99 include diagnosis, prevention and treatment of diseases and clinical conditions associated with MGC4189.

Myeloid/lymphoid or mixed-lineage leukemia (trithorax homolog, drosophila); translocated to, 2 (MLLT2, Accession NP_005926.1) is another GAM99 target gene, herein designated TARGET GENE. MLLT2 BINDING SITE is a target binding site found in the 3' untranslated region of mRNA encoded by MLLT2, corresponding to a target binding site such as BINDING SITE I, BINDING SITE II or BINDING SITE III of FIG. 8. Table 4 illustrates the complementarity of the nucleotide sequences of MLLT2 BINDING SITE, designated SEQ ID:6110, to the nucleotide sequence of GAM99 RNA, herein designated GAM RNA, also designated SEQ ID:320.

Another function of GAM99 is therefore inhibition of Myeloid/lymphoid or mixed-lineage leukemia (trithorax homolog, drosophila); translocated to, 2 (MLLT2, Accession NP_005926.1), a gene which is a Putative transcription factor. and therefore is associated with Acute leukemias. Accordingly, utilities of GAM99 include diagnosis, prevention and treatment of Acute leukemias, and of other diseases and clinical conditions associated with MLLT2.

The function of MLLT2 and its association with various diseases and clinical conditions, has been established by previous studies, as described hereinabove with reference to GAM96.1.2'-5'-oligoadenylate synthetase 2, 69/71 kda (OAS2, Accession NP_002526.1) is another GAM99 target gene, herein designated TARGET GENE. OAS2 BINDING SITE1 and OAS2 BINDING SITE2 are target binding sites found in untranslated regions of multiple transcripts of mRNA encoded by OAS2, corresponding to target binding sites such as BINDING SITE I, BINDING SITE II or BINDING SITE III of FIG. 8. Table 4 illustrates the complementarity of the nucleotide sequences of OAS2 BINDING SITE1 and OAS2 BINDING SITE2, designated SEQ ID:4904 and SEQ ID:18197 respectively, to the nucleotide sequence of GAM99 RNA, herein designated GAM RNA, also designated SEQ ID:320.

Another function of GAM99 is therefore inhibition of 2'-5'-oligoadenylate synthetase 2, 69/71 kda (OAS2, Accession NP_002526.1), a gene which may play a role in mediating resistance to virus infection, control of cell growth, differentiation, and apoptosis. Accordingly, utilities of GAM99 include diagnosis, prevention and treatment of diseases and clinical conditions associated with OAS2.

The function of OAS2 has been established by previous studies. The 2-prime, 5-prime oligoadenylate synthetases (OASs) are interferon-induced proteins characterized by their capacity to catalyze the synthesis of 2-prime, 5- prime oligomers of adenosine (2-5As). See OAS1 (OMIM Ref. No. 164350). Hovanessian et al. (1987) found that interferon-treated human cells contain several OASs corresponding to proteins of 40 (OAS1), 46 (OAS1), 69, and 100 (OMIM Ref. No. 603351) kD. Marie et al. (1989) generated highly specific polyclonal antibodies against p69, the 69-kD OAS. By screening an interferon-treated human cell expression library with the anti-p69 antibodies, Marie and Hovanessian (1992) isolated a partial OAS2 cDNA. They screened additional libraries with the partial cDNA and recovered cDNAs encoding 2 OAS2 isoforms. The smaller isoform is encoded by 2 mRNAs that differ in the length of the 3-prime untranslated region. Northern blot analysis revealed that OAS2 is expressed as 4 interferon-induced mRNAs in human cells. The predicted OAS2 proteins have a common 683-amino acid sequence and different 3-prime termini. By SDS- PAGE of in vitro transcription/translation products, the authors showed that 2 isoforms have molecular masses of 69 and 71 kD. Both isoforms exhibited OAS activity in vitro. Sequence analysis indicated that OAS2 contains 2 OAS1-homologous domains separated by a proline-rich putative linker region. The N- and C-terminal domains are 41% and 53% identical to OAS1, respectively. Marie and Hovanessian (1992) suggested that the OAS2 gene derived from the fusion of 2 ancestral genes analogous to OAS1. By fluorescence in situ hybridization and by inclusion within mapped clones, Hovnanian et al. (1998) determined that the OAS1, OAS2, and OAS3 genes are clustered with a 130-kb region on 12q24.2.

Full details of the abovementioned studies are described in the following publications, the disclosure of which are hereby incorporated by reference:

Hovnanian, A.; Rebouillat, D.; Mattei, M.-G.; Levy, E. R.; Marie, I.; Monaco, A. P.; Hovanessian, A. G.: The human 2-prime, 5-prime-oligoadenylate synthetase locus is composed of three distinct genes clustered on chromosome 12q24.2 encoding the 100-, 69-, and 40-kDa forms. Genomics 52:267-277, 1998; and Marie, I.; Hovanessian, A. G.: The 69-kDa 2-5A synthetase is composed of two homologous and adjacent functional domains. J. Biol. Chem. 267: 9933-9939, 1992.

Further studies establishing the function and utilities of OAS2 are found in John Hopkins OMIM database record ID 603350, and in cited publications listed in Table 5, which are hereby incorporated by reference. Protein phosphatase 2, regulatory subunit b (b56), gamma isoform (PPP2R5C, Accession NP_848701.1) is another GAM99 target gene, herein designated TARGET GENE. PPP2R5C BINDING SITE is a target binding site found in the 3' untranslated region of multiple transcripts of mRNA encoded by PPP2R5C, corresponding to a target binding site such as BINDING SITE I, BINDING SITE II or BINDING SITE III of FIG. 8. Table 4 illustrates the complementarity of the nucleotide sequences of PPP2R5C BINDING SITE, designated SEQ ID:9224, to the nucleotide sequence of GAM99 RNA, herein designated GAM RNA, also designated SEQ ID:320.

Another function of GAM99 is therefore inhibition of Protein phosphatase 2, regulatory subunit b (b56), gamma isoform (PPP2R5C, Accession NP_848701.1), a gene which is a regulatory subunit of protein phosphatase 2A. Accordingly, utilities of GAM99 include diagnosis, prevention and treatment of diseases and clinical conditions associated with PPP2R5C.

The function of PPP2R5C has been established by previous studies. Protein phosphorylation is a regulatory mechanism commonly employed in cellular processes such as cell cycle progression, growth factor signaling, and cell transformation. Protein phosphatase 2A (PP2A), a heterotrimeric serine/threonine phosphatase, has been implicated in a variety of regulatory processes including cell growth and division, muscle contraction, and gene transcription. PP2A is a trimeric enzyme composed of a catalytic subunit (OMIM Ref. No. 176915), a structural subunit, and any of several different regulatory subunits which control its specificity. One family of related PP2A regulatory subunits is designated the B56 family and contains at least 5 different members (McCright and Virshup (1995)). The alpha (OMIM Ref. No. 601643) and gamma subunits are expressed at highest levels in skeletal and cardiac muscle. Both the delta (OMIM Ref. No. 601646) and gamma subunits encode nuclear phosphoproteins and at least 3 splice variants of the gamma subunit have been reported. The longest gamma isoform is a phosphoprotein, but the shortest is not.

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A-PPP2R5E), highly expressed in muscle and brain, to chromosome regions 1q41, 11q12, 3p21, 6p21.1, and 7p11.2- to - p12. Genomics 36:168-170, 1996; and McCright, B.; Virshup, D. M.: Identification of a new family of protein phosphatase 2A regulatory subunits. J. Biol. Chem. 270:26123-26128, 1995.

Further studies establishing the function and utilities of PPP2R5C are found in John Hopkins OMIM database record ID 601645, and in cited publications listed in Table 5, which are hereby incorporated by reference. Protein phosphatase 2, regulatory subunit b (b56), gamma isoform (PPP2R5C, Accession NP_002710.2) is another GAM99 target gene, herein designated TARGET GENE. PPP2R5C BINDING SITE is a target binding site found in the 3' untranslated region of multiple transcripts of mRNA encoded by PPP2R5C, corresponding to a target binding site such as BINDING SITE I, BINDING SITE II or BINDING SITE III of FIG. 8. Table 4 illustrates the complementarity of the nucleotide sequences of PPP2R5C BINDING SITE, designated SEQ ID:9224, to the nucleotide sequence of GAM99 RNA, herein designated GAM RNA, also designated SEQ ID:320.

Another function of GAM99 is therefore inhibition of Protein phosphatase 2, regulatory subunit b (b56), gamma isoform (PPP2R5C, Accession NP_002710.2), a gene which is a regulatory subunit of protein phosphatase 2A. Accordingly, utilities of GAM99 include diagnosis, prevention and treatment of diseases and clinical conditions associated with PPP2R5C.

The function of PPP2R5C has been established by previous studies. Protein phosphorylation is a regulatory mechanism commonly employed in cellular processes such as cell cycle progression, growth factor signaling, and cell transformation. Protein phosphatase 2A (PP2A), a heterotrimeric serine/threonine phosphatase, has been implicated in a variety of regulatory processes including cell growth and division, muscle contraction, and gene transcription. PP2A is a trimeric enzyme composed of a catalytic subunit (OMIM Ref. No. 176915), a structural subunit, and any of several different regulatory subunits which control its specificity. One family of related PP2A regulatory subunits is designated the B56 family and contains at least 5 different members (McCright and Virshup (1995)). The alpha (OMIM Ref. No. 601643) and gamma subunits are expressed at highest levels in skeletal and cardiac muscle. Both the delta (OMIM Ref. No. 601646) and gamma subunits encode nuclear phosphoproteins and at least 3 splice variants of the gamma subunit have been reported. The longest gamma isoform is a phosphoprotein, but the shortest is not.

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A-PPP2R5E), highly expressed in muscle and brain, to chromosome regions 1q41, 11q12, 3p21, 6p21.1, and 7p11.2- to - p12. Genomics 36:168-170, 1996; and McCright, B.; Virshup, D. M.: Identification of a new family of protein phosphatase 2A regulatory subunits. J. Biol. Chem. 270:26123-26128, 1995.

Further studies establishing the function and utilities of PPP2R5C are found in John Hopkins OMIM database record ID 601645, and in cited publications listed in Table 5, which are hereby incorporated by reference. Protein kinase c, beta 1 (PRKCB1, Accession NP_002729.2) is another GAM99 target gene, herein designated TARGET GENE. PRKCB1 BINDING SITE is a target binding site found in the 3' untranslated region of mRNA encoded by PRKCB1, corresponding to a target binding site such as BINDING SITE I, BINDING SITE II or BINDING SITE III of FIG. 8. Table 4 illustrates the complementarity of the nucleotide sequences of PRKCB1 BINDING SITE, designated SEQ ID:10260, to the nucleotide sequence of GAM99 RNA, herein designated GAM RNA, also designated SEQ ID:320.

Another function of GAM99 is therefore inhibition of Protein kinase c, beta 1 (PRKCB1, Accession NP_002729.2), a gene which is a calcium-activated, phospholipid-dependent, serine- and threonine-specific enzyme. Accordingly, utilities of GAM99 include diagnosis, prevention and treatment of diseases and clinical conditions associated with PRKCB1.

The function of PRKCB1 has been established by previous studies. Greenham et al. (1998) determined the genomic structure of the PRKCB gene. The PRKCB gene consists of 18 exons spanning 375 kb, with a particularly large intron of over 150 kb between exons 2 and 3. Exons range from 32 to 174 bp in length. Francke et al. (1989) stated that the most likely location of PKCB is 16p11.2.

Animal model experiments lend further support to the function of PRKCB1. Leitges et al. (1996) found that mice homozygous for a targeted disruption of the Prkcb1 gene develop an immunodeficiency characterized by impaired humoral immune responses and reduced cellular responses of B cells similar to X-linked immunodeficiency (Xid) in mice (see OMIM Ref. No. 300300). Thus, they concluded that the 2 isoforms, PKC-beta-I (OMIM Ref. No. PRKCB1) and PKC-beta- II (OMIM Ref. No. PRKCB2), play an important role in B-cell activation and may be functionally linked to Bruton tyrosine kinase (OMIM Ref. No. 300300) in antigen receptor-mediated signal transduction. Su et al. (2002) showed that mice lacking Prkcb are unable to activate Nfkb (OMIM Ref. No. 164011) and promote cell survival in B cells upon BCR signaling, or even in mast cells which, unlike B cells, also express Prkcq (OMIM Ref. No. 600448). The failure to activate Nfkb is associated with a lack of Ikba (OMIM Ref. No. 164008) degradation as well as an absence of Ikka (OMIM Ref. No. 600664) phosphorylation activity. Prkcb -/- mice, lacking the Prkcb enzyme in lipid rafts after BCR stimulation, are also unable to recruit Ikka and Ikkb (OMIM Ref. No. 603258) to the rafts in B cells and have a reduced capacity to recruit other members of the BCR signalosome. However, Prkcb-deficient mice, unlike Xid mice, do have mature B cells expressing IgM and IgD, suggesting that the cells are maintained by an alternative Nfkb-activating pathway, e.g., through CD40 (OMIM Ref. No. 109535). Su et al. (2002) observed that specific Prkcb small molecule inhibitors block the survival of non-Hodgkin diffuse large B cell lymphoma (DLBCL) cell lines, with the effective dose depending on the level of cellular Prkcb. DLBCL lines not expressing Prkcb were not susceptible to the inhibitors. Su et al. (2002) proposed that PRKCB inhibitors and inhibitors of other PRKC isoforms may be effective in treating disorders characterized by dysregulated NFKB survival signaling.

It is appreciated that the abovementioned animal model for PRKCB1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leitges, M.; Schmedt, C.; Guinamard, R.; Davoust, J.; Schaal, S.; Stabel, S.; Tarakhovsky, A.: Immunodeficiency in protein kinase C-beta-deficient mice. Science 273:788-791, 1996; and Su, T. T.; Guo, B.; Kawakami, Y.; Sommer, K.; Chae, K.; Humphries, L. A.; Kato, R. M.; Kang, S.; Patrone, L.; Wall, R.; Teitell, M.; Leitges, M.; Kawakami, T.; Rawlings, D. J.: PKC-beta.

Further studies establishing the function and utilities of PRKCB1 are found in John Hopkins OMIM database record ID 176970, and in cited publications listed in Table 5, which are hereby incorporated by reference. Protein kinase c, nu (PRKCN, Accession NP_005804.1) is another GAM99 target gene, herein designated TARGET GENE. PRKCN BINDING SITE is a target binding site found in the 3' untranslated region of mRNA encoded by PRKCN, corresponding to a target binding site such as BINDING SITE I, BINDING SITE II or BINDING SITE III of FIG. 8. Table 4 illustrates the complementarity of the nucleotide sequences of PRKCN BINDING SITE, designated SEQ ID:11840, to the nucleotide sequence of GAM99 RNA, herein designated GAM RNA, also designated SEQ ID:320.

Another function of GAM99 is therefore inhibition of Protein kinase c, nu (PRKCN, Accession NP_005804.1). Accordingly, utilities of GAM99 include diagnosis, prevention and treatment of diseases and clinical conditions associated with PRKCN.

Prp4 pre-mrna processing factor 4 homolog (yeast) (PRPF4, Accession NP_004688.2) is another GAM99 target gene, herein designated TARGET GENE. PRPF4 BINDING SITE is a target binding site found in the 3' untranslated region of mRNA encoded by PRPF4, corresponding to a target binding site such as BINDING SITE I, BINDING SITE II or BINDING SITE III of FIG. 8. Table 4 illustrates the complementarity of the nucleotide sequences of PRPF4 BINDING SITE, designated SEQ ID:6260, to the nucleotide sequence of GAM99 RNA, herein designated GAM RNA, also designated SEQ ID:320.

Another function of GAM99 is therefore inhibition of Prp4 pre-mrna processing factor 4 homolog (yeast) (PRPF4, Accession NP_004688.2). Accordingly, utilities of GAM99 include diagnosis, prevention and treatment of diseases and clinical conditions associated with PRPF4.

Pregnancy specific beta-1-glycoprotein 1 (PSG1, Accession NP_008836.2) is another GAM99 target gene, herein designated TARGET GENE. PSG1 BINDING SITE is a target binding site found in the 5' untranslated region of mRNA encoded by PSG1, corresponding to a target binding site such as BINDING SITE I, BINDING SITE II or BINDING SITE III of FIG. 8. Table 4 illustrates the complementarity of the nucleotide sequences of PSG1 BINDING SITE, designated SEQ ID:3147, to the nucleotide sequence of GAM99 RNA, herein designated GAM RNA, also designated SEQ ID:320.

Another function of GAM99 is therefore inhibition of Pregnancy specific beta-1-glycoprotein 1 (PSG1, Accession NP_008836.2), a gene which is a member of the pregnancy-specific glycoprotein (PSG) and CEA families. Accordingly, utilities of GAM99 include diagnosis, prevention and treatment of diseases and clinical conditions associated with PSG1.

The function of PSG1 and its association with various diseases and clinical conditions, has been established by previous studies, as described hereinabove with reference to GAM94.1. Pregnancy specific beta-1-glycoprotein 4 (PSG4, Accession NP_002771.1) is another GAM99 target gene, herein designated TARGET GENE. PSG4 BINDING SITE is a target binding site found in the 3' untranslated region of mRNA encoded by PSG4, corresponding to a target binding site such as BINDING SITE I, BINDING SITE II or BINDING SITE III of FIG. 8. Table 4 illustrates the complementarity of the nucleotide sequences of PSG4 BINDING SITE, designated SEQ ID:4422, to the nucleotide sequence of GAM99 RNA, herein designated GAM RNA, also designated SEQ ID:320.

Another function of GAM99 is therefore inhibition of Pregnancy specific beta-1-glycoprotein 4 (PSG4, Accession NP_002771.1), a gene which is a member of the pregnancy-specific glycoprotein (PSG) and CEA families. Accordingly, utilities of GAM99 include diagnosis, prevention and treatment of diseases and clinical conditions associated with PSG4.

The function of PSG4 has been established by previous studies. The human pregnancy-specific glycoproteins (PSGs) are a group of molecules that are mainly produced by the placental syncytiotrophoblasts during pregnancy. PSGs comprise a subgroup of the carcinoembryonic antigen (CEA) family, which belongs to the immunoglobulin superfamily. See PSG3 (OMIM Ref. No. 176392) for additional information about PSGs. Teglund et al. (1994) found that the PSG4 gene contains 6 exons. They noted that PSG9, which had been thought to be a novel gene, is in fact an allelic variant of PSG4 that differs by 6 bp in the coding region. (The OMIM Ref. No. 176398.) Studies by several groups resulted in the mapping of the CEA gene family to 19q13.1-q13.2 (Thompson et al., 1990; Thompson et al., 1992; Tynan et al., 1992; Trask et al., 1993). The PSG subgroup is located telomeric of the CEA subgroup, and together they span approximately 1.1 to 1.2 Mb (Brandriff et al., 1992; Tynan et al., 1992). Using a high-resolution restriction fragment fingerprinting technique, Olsen et al. (1994) assembled 256 cosmids spanning the PSG region on 19q13.2 into a single 700-kb contig. FISH to sperm pronuclei and cosmid walking experiments indicated that this PSG contig is telomeric of CGM8 at the telomeric end of the CEA subgroup gene cluster. Detailed restriction mapping and hybridization with gene-specific probes indicated that the order of the 11 PSG genes in the contig is cen-PSG3-PSG8 (OMIM Ref. No. 176397)-PSG12 (PSG10; 176399)-PSG1 (OMIM Ref. No. 176390)-PSG6 (OMIM Ref. No. 176395)-PSG7 (OMIM Ref. No. 176396)-PSG13 (PSG11; 176401)-PSG2 (OMIM Ref. No. 176391)-PSG5 (OMIM Ref. No. 176394)-PSG4-PSG11 (PSG9; 176398)-tel. The PSG genes are tandemly oriented in a 5-prime to 3-prime direction from telomere to centromere. The CEA subgroup gene CGM11 is located at the telomeric end of the PSG gene cluster, and 6 genes belonging to a third CEA family subgroup, namely CGM13 through CGM18 (later OMIM Ref. No. 109770), are interspersed among the PSG genes. Nomenclature: Beauchemin et al. (1999) provided a revised nomenclature for the CEA gene family. Based on this nomenclature, the CEA family is composed of the PSG subfamily, the CEACAM subfamily (see OMIM Ref. No. 109770), and the CEACAM pseudogene (CEACAMP) subfamily (see OMIM Ref. No. 109770). PSG11, PSG12, and PSG13 were renamed PSG9, PSG10, and PSG11, respectively Full details of the abovementioned studies are described in the following publications, the disclosure of which are hereby incorporated by reference:

Beauchemin, N.; Draber, P.; Dveksler, G.; Gold, P.; Gray-Owen, S.; Grunert, F.; Hammarstrom, S.; Holmes, K. V.; Karlsson, A.; Kuroki, M.; Lin, S.-H.; Lucka, L.; and 13 others: Redefined nomenclature for members of the carcinoembryonic antigen family. Exp. Cell Res. 252:243-249, 1999; and Brandriff, B. F.; Gordon, L. A.; Tynan, K. T.; Olsen, A. S.; Mohrenweiser, H. W.; Fertitta, A.; Carrano, A. V.; Trask, B. J.: Order and genomic distances among members of the carcinoem.

Further studies establishing the function and utilities of PSG4 are found in John Hopkins OMIM database record ID 176393, and in cited publications listed in Table 5, which are hereby incorporated by reference. Phosphotriesterase related (PTER, Accession NP_109589.2) is another GAM99 target gene, herein designated TARGET GENE. PTER BINDING SITE is a target binding site found in the 3' untranslated region of mRNA encoded by PTER, corresponding to a target binding site such as BINDING SITE I, BINDING SITE II or BINDING SITE III of FIG. 8. Table 4 illustrates the complementarity of the nucleotide sequences of PTER BINDING SITE, designated SEQ ID:10176, to the nucleotide sequence of GAM99 RNA, herein designated GAM RNA, also designated SEQ ID:320.

Another function of GAM99 is therefore inhibition of Phosphotriesterase related (PTER, Accession NP_109589.2), a gene which is a phosphotriesterase homology protein. Accordingly, utilities of GAM99 include diagnosis, prevention and treatment of diseases and clinical conditions associated with PTER.

The function of PTER and its association with various diseases and clinical conditions, has been established by previous studies, as described hereinabove with reference to GAM55.1. Rab7, member ras oncogene family-like 1 (RAB7L1, Accession NP_003920.1) is another GAM99 target gene, herein designated TARGET GENE. RAB7L1 BINDING SITE is a target binding site found in the 3' untranslated region of mRNA encoded by RAB7L1, corresponding to a target binding site such as BINDING SITE I, BINDING SITE II or BINDING SITE III of FIG. 8. Table 4 illustrates the complementarity of the nucleotide sequences of RAB7L1 BINDING SITE, designated SEQ ID:6897, to the nucleotide sequence of GAM99 RNA, herein designated GAM RNA, also designated SEQ ID:320.

Another function of GAM99 is therefore inhibition of Rab7, member ras oncogene family-like 1 (RAB7L1, Accession NP_003920.1). Accordingly, utilities of GAM99 include diagnosis, prevention and treatment of diseases and clinical conditions associated with RAB7L1.

Ring finger protein (c3hc4 type) 8 (RNF8, Accession NP_003949.1) is another GAM99 target gene, herein designated TARGET GENE. RNF8 BINDING SITE is a target binding site found in the 3' untranslated region of mRNA encoded by RNF8, corresponding to a target binding site such as BINDING SITE I, BINDING SITE II or BINDING SITE III of FIG. 8. Table 4 illustrates the complementarity of the nucleotide sequences of RNF8 BINDING SITE, designated SEQ ID:17319, to the nucleotide sequence of GAM99 RNA, herein designated GAM RNA, also designated SEQ ID:320.

Another function of GAM99 is therefore inhibition of Ring finger protein (c3hc4 type) 8 (RNF8, Accession NP_003949.1). Accordingly, utilities of GAM99 include diagnosis, prevention and treatment of diseases and clinical conditions associated with RNF8.

Secreted frizzled-related protein 4 (SFRP4, Accession NP_003005.1) is another GAM99 target gene, herein designated TARGET GENE. SFRP4 BINDING SITE is a target binding site found in the 3' untranslated region of mRNA encoded by SFRP4, corresponding to a target binding site such as BINDING SITE I, BINDING SITE II or BINDING SITE III of FIG. 8. Table 4 illustrates the complementarity of the nucleotide sequences of SFRP4 BINDING SITE, designated SEQ ID:19985, to the nucleotide sequence of GAM99 RNA, herein designated GAM RNA, also designated SEQ ID:320.

Another function of GAM99 is therefore inhibition of Secreted frizzled-related protein 4 (SFRP4, Accession NP_003005.1). Accordingly, utilities of GAM99 include diagnosis, prevention and treatment of diseases and clinical conditions associated with SFRP4.

Solute carrier family 25 (mitochondrial carrier; ornithine transporter) member 15 (SLC25A15, Accession NP_055067.1) is another GAM99 target gene, herein designated TARGET GENE. SLC25A15 BINDING SITE is a target binding site found in the 3' untranslated region of mRNA encoded by SLC25A15, corresponding to a target binding site such as BINDING SITE I, BINDING SITE II or BINDING SITE III of FIG. 8. Table 4 illustrates the complementarity of the nucleotide sequences of SLC25A15 BINDING SITE, designated SEQ ID:1242, to the nucleotide sequence of GAM99 RNA, herein designated GAM RNA, also designated SEQ ID:320.

Another function of GAM99 is therefore inhibition of Solute carrier family 25 (mitochondrial carrier; ornithine transporter) member 15 (SLC25A15, Accession NP_055067.1), a gene which participates theornithine transport across inner mitochondrial membrane, from the cytoplasm to the matrix and therefore is associated with Hyperornithinemia-hyperammonemia- homocitrullinuria syndrome (hhh syndrome). Accordingly, utilities of GAM99 include diagnosis, prevention and treatment of Hyperornithinemia-hyperammonemia-homocitrullinuria syndrome (hhh syndrome), and of other diseases and clinical conditions associated with SLC25A15.

The function of SLC25A15 has been established by previous studies. The urea cycle is an example of metabolic homeostasis, maintaining concentrations of a toxic metabolite, ammonium ions, in a narrow, tolerable range despite more than 10-fold variations in dietary intake of its precursor, nitrogen. Five enzymes in 2 subcellular compartments (mitochondrial matrix and cytosol) accomplish this feat. Another vital component of the urea cycle is the transporter required to move ornithine across the inner mitochondrial membrane from cytosol to mitochondrial matrix. This is the transporter that is defective in hyperornithinemia-hyperammonemia-homocitrullinuria (HHH syndrome; 238970 Neurospora crassa ARG13 and Saccharomyces cerevisiae ARG11 encode mitochondrial carrier family proteins that transport ornithine across the mitochondrial inner membrane. Camacho et al. (1999) used their sequences to identify EST candidates derived from genes that encode orthologous mammalian transporters. They thereby identified a gene, ORNT1, that maps to 13q14 and whose expression, similar to that of other urea cycle components, was high in liver and varied with changes in dietary protein. ORNT1 expression restored ornithine metabolism in fibroblasts from patients with HHH syndrome. They found that the ORNT1 gene encodes a 301-residue protein with 95% identity to mouse Ornt1 and 28% identity to Neurospora ARG13. Expression of either murine or human ORNT1 restored normal ornithine metabolism in HHH fibroblasts. The protein localized to mitochondria. In a survey of 11 HHH probands, Camacho et al. (1999) identified 3 ORNT1 mutant alleles that accounted for 21 of 22 possible mutant ORNT1 genes in these patients Full details of the abovementioned studies are described in the following publications, the disclosure of which are hereby incorporated by reference:

Camacho, J. A.; Obie, C.; Biery, B.; Goodman, B. K.; Hu, C.-A.; Almashanu, S.; Steel, G.; Casey, R.; Lambert, M.; Mitchell, G. A.; Valle, D.: Hyperornithinaemia- hyperammonaemia-homocitrullinuria syndrome is caused by mutations in a gene encoding a mitochondrial ornithine transporter. Nature Genet. 22:151-158, 1999; and Tsujino, S.; Kanazawa, N.; Ohashi, T.; Eto, Y.; Saito, T.; Kira, J.; Yamada, T.: Three novel mutations (G27E, insAAC, R179X) in the ORNT1 gene of Japanese patients with hyperornithinemia.

Further studies establishing the function and utilities of SLC25A15 are found in John Hopkins OMIM database record ID 603861, and in cited publications listed in Table 5, which are hereby incorporated by reference. Solute carrier family 2 (facilitated glucose/fructose transporter), member 5 (SLC2A5, Accession NP_003030.1) is another GAM99 target gene, herein designated TARGET GENE. SLC2A5 BINDING SITE is a target binding site found in the 3' untranslated region of mRNA encoded by SLC2A5, corresponding to a target binding site such as BINDING SITE I, BINDING SITE II or BINDING SITE III of FIG. 8. Table 4 illustrates the complementarity of the nucleotide sequences of SLC2A5 BINDING SITE, designated SEQ ID:5294, to the nucleotide sequence of GAM99 RNA, herein designated GAM RNA, also designated SEQ ID:320.

Another function of GAM99 is therefore inhibition of Solute carrier family 2 (facilitated glucose/fructose transporter), member 5 (SLC2A5, Accession NP_003030.1), a gene which has probable role as a fructose transporter. Accordingly, utilities of GAM99 include diagnosis, prevention and treatment of diseases and clinical conditions associated with SLC2A5.

The function of SLC2A5 has been established by previous studies. Davidson et al. (1992) showed that the glucose transporter isoform, GLUT5, is expressed on the brush border membrane of human small intestinal enterocytes. Burant et al. (1992) showed further that GLUT5 is a fructose transporter and may be largely responsible for the uptake of fructose from the lumen of the small intestine. GLUT2, which is present on the basolateral membrane of enterocytes, probably mediates the efflux of fructose from these cells. In addition, GLUT5 is probably responsible for the uptake of fructose by spermatozoa. The pattern of GLUT5 immunoreactivity in maturing spermatids suggested that the expression of GLUT5 may serve as a marker for terminal maturation of male germ cells. An increasing fraction of calories consumed in Western diets is derived from fructose. Increases in fructose consumption have been implicated in a rising incidence of hypertriglyceridemia and hyperinsulinemia. Mutations in the small intestinal sodium/glucose cotransporter (OMIM Ref. No. 182380), which effectively abolish glucose uptake, have no effect on the absorption of fructose, indicating a separate fructose carrier protein. Using cDNA probes for Southern blotting of DNA from somatic cell hybrids and for in situ hybridization, Fan et al. (1989) showed that the GLUT5 gene (also symbolized SLC2A5) is located on chromosome 1. Also see Kayano et al. (1990). White et al. (1998) concluded that the correct assignment of SLC2A5 is 1p36.2. This was confirmed by use of somatic cell and radiation hybrid mapping panels and was consistent with previous EST mapping data. The carbonic anhydrase-6 (CA6; 114780) and alpha-enolase (ENO1; 172430) genes were physically linked to SLCA5 in yeast- and P1-artificial chromosome (YAC and PAC) contigs. PACs from the contig were mapped to 1p36.2 by fluorescence in situ hybridization.

Full details of the abovementioned studies are described in the following publications, the disclosure of which are hereby incorporated by reference:

Davidson, N. O.; Hausman, A. M. L.; Ifkovits, C. A.; Buse, J. B.; Gould, G. W.; Burant, C. F.; Bell, G. I.: Human intestinal glucose transporter expression and localization of GLUT5. Am. J. Physiol. 262: C795-C800, 1992; and White, P. S.; Jensen, S. J.; Rajalingam, V.; Stairs, D.; Sulman, E. P.; Maris, J. M.; Biegel, J. A.; Wooster, R.; Brodeur, G. M.: Physical mapping of the CA6, ENO1, and SLC2A5 (GLUT5) gene.

Further studies establishing the function and utilities of SLC2A5 are found in John Hopkins OMIM database record ID 138230, and in cited publications listed in Table 5, which are hereby incorporated by reference. Sorbin and sh3 domain containing 1 (SORBS1, Accession NP_056200.1) is another GAM99 target gene, herein designated TARGET GENE.

SORBS1 BINDING SITE is a target binding site found in the 3' untranslated region of mRNA encoded by SORBS1, corresponding to a target binding site such as BINDING SITE I, BINDING SITE II or BINDING SITE III of FIG. 8. Table 4 illustrates the complementarity of the nucleotide sequences of SORBS1 BINDING SITE, designated SEQ ID:5727, to the nucleotide sequence of GAM99 RNA, herein designated GAM RNA, also designated SEQ ID:320.

Another function of GAM99 is therefore inhibition of Sorbin and sh3 domain containing 1 (SORBS1, Accession NP_056200.1), a gene which necessary for cell polarization during vegetative growth and therefore may be associated with Obesity and type 2 diabetes. Accordingly, utilities of GAM99 include diagnosis, prevention and treatment of Obesity and type 2 diabetes, and of other diseases and clinical conditions associated with SORBS1.

The function of SORBS1 has been established by previous studies. Lin et al. (2001) identified 14 single-nucleotide polymorphisms (SNPs) in the human SH3P12 gene, which they called SORBS1. Studies in 202 nonobese, 113 obese, and 455 subjects with type II diabetes (OMIM Ref. No. 125853) revealed that the alanine allele of a T228A polymorphism in exon 7 exerted a protective role for both obesity (OMIM Ref. No. 601665) (relative risk 0.466; 95% confidence interval 0.265 to 0.821) and diabetes (relative risk 0.668; 95% confidence interval 0.472 to 0.945). Neither allele of the R74W polymorphism was associated with either obesity or diabetes. The authors suggested that the SH3P12 gene may play an important role in the pathogenesis of human disorders with insulin resistance. Insulin stimulates the transport of glucose into fat and muscle cells and initiates its actions by binding to its tyrosine kinase receptor, leading to the phosphorylation of intracellular substrates. One such substrate is the CBL protooncogene product. CBL is recruited to the insulin receptor by interaction with the adaptor protein CAP, through 1 of 3 adjacent SH3 domains in the C terminus of CAP. Upon phosphorylation of CBL, the CAP-CBL complex dissociates from the insulin receptor and moves to a caveolin (see OMIM Ref. No. 601047)-enriched triton- insoluble membrane fraction (Mastick et al., 1995). To identify a molecular mechanism underlying this subcellular redistribution, Baumann et al. (2000) screened a yeast 2-hybrid library using the N-terminal region of CAP and identified the caveolar protein flotillin (OMIM Ref. No. 131560). Flotillin forms a ternary complex with CAP and CBL, directing the localization of the CAP-CBL complex to a lipid raft subdomain of the plasma membrane. Expression of the N-terminal domain of CAP in 3T3-L1 adipocytes blocks the stimulation of glucose transport by insulin, without affecting signaling events that depend on phosphatidylinositol-3-OH kinase (see OMIM Ref. No. 602838). Thus, localization of the CBL-CAP complex to lipid rafts generates a pathway that is crucial in the regulation of glucose uptake.

Full details of the abovementioned studies are described in the following publications, the disclosure of which are hereby incorporated by reference:

Lin, W.-H.; Chiu, K. C.; Chang, H.-M.; Lee, K.-C.; Tai, T.-Y.; Chuang, L.-M. : Molecular scanning of the human sorbin and SH3-domain-containing-1 (SORBS1) gene: positive association of the T228A polymorphism with obesity and type 2 diabetes. Hum. Molec. Genet. 10:1753-1760, 2001; and Baumann, C. A.; Ribon, V.; Kanzaki, M.; Thurmond, D. C.; Mora, S.; Shigematsu, S.; Bickel, P. E.; Pessin, J. E.; Saltiel, A. R.: CAP defines a second signalling pathway required for insul.

Further studies establishing the function and utilities of SORBS1 are found in John Hopkins OMIM database record ID 605264, and in cited publications listed in Table 5, which are hereby incorporated by reference. Stromal antigen 2 (STAG2, Accession NP_006594.3) is another GAM99 target gene, herein designated TARGET GENE. STAG2 BINDING SITE is a target binding site found in the 5' untranslated region of mRNA encoded by STAG2, corresponding to a target binding site such as BINDING SITE I, BINDING SITE II or BINDING SITE III of FIG. 8. Table 4 illustrates the complementarity of the nucleotide sequences of STAG2 BINDING SITE, designated SEQ ID:8903, to the nucleotide sequence of GAM99 RNA, herein designated GAM RNA, also designated SEQ ID:320.

Another function of GAM99 is therefore inhibition of Stromal antigen 2 (STAG2, Accession NP_006594.3). Accordingly, utilities of GAM99 include diagnosis, prevention and treatment of diseases and clinical conditions associated with STAG2.

SWAP2 (Accession NP_008987.1) is another GAM99 target gene, herein designated TARGET GENE. SWAP2 BINDING SITE is a target binding site found in the 3' untranslated region of mRNA encoded by SWAP2, corresponding to a target binding site such as BINDING SITE I, BINDING SITE II or BINDING SITE III of FIG. 8. Table 4 illustrates the complementarity of the nucleotide sequences of SWAP2 BINDING SITE, designated SEQ ID:18106, to the nucleotide sequence of GAM99 RNA, herein designated GAM RNA, also designated SEQ ID:320.

Another function of GAM99 is therefore inhibition of SWAP2 (Accession NP_008987.1). Accordingly, utilities of GAM99 include diagnosis, prevention and treatment of diseases and clinical conditions associated with SWAP2.

T-box 19 (TBX19, Accession NP_005140.1) is another GAM99 target gene, herein designated TARGET GENE. TBX19 BINDING SITE is a target binding site found in the 3' untranslated region of mRNA encoded by TBX19, corresponding to a target binding site such as BINDING SITE I, BINDING SITE II or BINDING SITE III of FIG. 8. Table 4 illustrates the complementarity of the nucleotide sequences of TBX19 BINDING SITE, designated SEQ ID:16617, to the nucleotide sequence of GAM99 RNA, herein designated GAM RNA, also designated SEQ ID:320.

Another function of GAM99 is therefore inhibition of T-box 19 (TBX19, Accession NP_005140.1). Accordingly, utilities of GAM99 include diagnosis, prevention and treatment of diseases and clinical conditions associated with TBX19.

Tolloid-like 2 (TLL2, Accession NP_036597.1) is another GAM99 target gene, herein designated TARGET GENE. TLL2 BINDING SITE is a target binding site found in the 3' untranslated region of mRNA encoded by TLL2, corresponding to a target binding site such as BINDING SITE I, BINDING SITE II or BINDING SITE III of FIG. 8. Table 4 illustrates the complementarity of the nucleotide sequences of TLL2 BINDING SITE, designated SEQ ID:17891, to the nucleotide sequence of GAM99 RNA, herein designated GAM RNA, also designated SEQ ID:320.

Another function of GAM99 is therefore inhibition of Tolloid-like 2 (TLL2, Accession NP_036597.1), a gene which induces cartilage and bone formation. Accordingly, utilities of GAM99 include diagnosis, prevention and treatment of diseases and clinical conditions associated with TLL2.

The function of TLL2 and its association with various diseases and clinical conditions, has been established by previous studies, as described hereinabove with reference to GAM67.2. Tumor necrosis factor (tnf superfamily, member 2) (TNF, Accession NP_000585.2) is another GAM99 target gene, herein designated TARGET GENE. TNF BINDING SITE is a target binding site found in the 3' untranslated region of mRNA encoded by TNF, corresponding to a target binding site such as BINDING SITE I, BINDING SITE II or BINDING SITE III of FIG. 8. Table 4 illustrates the complementarity of the nucleotide sequences of TNF BINDING SITE, designated SEQ ID:3783, to the nucleotide sequence of GAM99 RNA, herein designated GAM RNA, also designated SEQ ID:320.

Another function of GAM99 is therefore inhibition of Tumor necrosis factor (tnf superfamily, member 2) (TNF, Accession NP_000585.2), a gene which mediates proinflammatory responses and apoptosis and therefore may be associated with Sepsis, cerebral malaria, multiple sclerosis, rheumatoid arthritis, systemic lupus erythematosus and crohn disease, as well as cancer. Accordingly, utilities of GAM99 include diagnosis, prevention and treatment of Sepsis, cerebral malaria, multiple sclerosis, rheumatoid arthritis, systemic lupus erythematosus and crohn disease, as well as cancer, and of other diseases and clinical conditions associated with TNF.

The function of TNF has been established by previous studies. Ruuls and Sedgwick (1999) reviewed the problem of unlinking TNF biology from that of the MHC. Dysregulation and, in particular, overproduction of TNF have been implicated in a variety of human diseases, including sepsis, cerebral malaria, and autoimmune diseases such as multiple sclerosis (OMIM Ref. No. 126200), rheumatoid arthritis, systemic lupus erythematosus (OMIM Ref. No. 152700), and Crohn disease (see OMIM Ref. No. 266600), as well as cancer. Susceptibility to many of these diseases is thought to have a genetic basis, and the TNF gene is considered a candidate predisposing gene. However, unraveling the importance of genetic variation in the TNF gene to disease susceptibility or severity is complicated by its location within the MHC, a highly polymorphic region that encodes numerous genes involved in immunologic responses. Ruuls and Sedgwick (1999) reviewed studies that had analyzed the contribution of TNF and related genes to susceptibility to human disease, and they discussed how the presence of the TNF gene within the MHC may potentially complicate the interpretation of studies in animal models in which the TNF gene is experimentally manipulated.

Animal model experiments lend further support to the function of TNF. Bruce et al. (1996) used targeted gene disruption to generate mice lacking either the p55 or the p75 TNF receptors; mice lacking both p55 and p75 were generated from crosses of the singly deficient mice. The TNFR-deficient (TNFR-KO) mice exhibited no overt phenotype under unchallenged conditions. Bruce et al. (1996) reported that damage to neurons caused by focal cerebral ischemia and epileptic seizures was exacerbated in the TNFR-KO mice, indicating that TNF serves a neuroprotective function. Their studies indicated that TNF protects neurons by stimulating antioxidative pathways. Injury-induced microglial activation was suppressed in TNFR-KO mice. They concluded that drugs which target TNF signaling pathways may prove beneficial in treating stroke or traumatic brain injury.

It is appreciated that the abovementioned animal model for TNF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ruuls, S. R.; Sedgwick, J. D.: Unlinking tumor necrosis factor biology from the major histocompatibility complex: lessons from human genetics and animal models. Am. J. Hum. Genet. 65:294-301, 1999; and Bruce, A. J.; Boling, W.; Kindy, M. S.; Peschon, J.; Kraemer, P. J.; Carpenter, M. K.; Holtsberg, F. W.; Mattson, M. P.: Altered neuronal and microglial responses to excitotoxic and is.

Further studies establishing the function and utilities of TNF are found in John Hopkins OMIM database record ID 191160, and in cited publications listed in Table 5, which are hereby incorporated by reference. Transient receptor potential cation channel, subfamily c, member 1 (TRPC1, Accession NP_003295.1) is another GAM99 target gene, herein designated TARGET GENE. TRPC1 BINDING SITE is a target binding site found in the 3' untranslated region of mRNA encoded by TRPC1, corresponding to a target binding site such as BINDING SITE I, BINDING SITE II or BINDING SITE III of FIG. 8. Table 4 illustrates the complementarity of the nucleotide sequences of TRPC1 BINDING SITE, designated SEQ ID:18535, to the nucleotide sequence of GAM99 RNA, herein designated GAM RNA, also designated SEQ ID:320.

Another function of GAM99 is therefore inhibition of Transient receptor potential cation channel, subfamily c, member 1 (TRPC1, Accession NP_003295.1), a gene which acts as a non-voltage-sensitive store-operated Ca2+ channel. Accordingly, utilities of GAM99 include diagnosis, prevention and treatment of diseases and clinical conditions associated with TRPC1.

The function of TRPC1 has been established by previous studies. Zitt et al. (1996) cloned a truncated TRPC1 cDNA, which they designated TRPC1A, that lacks amino acids 109-143 of the human TRP1 sequence. By transfection studies in Chinese hamster ovary cells, Zitt et al. (1996) showed that the TRPC1A gene product functions as a store-operated calcium-permeable cation channel. Zhu et al. (1996) similarly showed that TRPC1 increased store-operated calcium entry in transfected COS cells. Xu et al. (1997) reported that the TRPC1 and TRPC3 proteins form heteromultimeric complexes. Berg et al. (1997) stated that TRPC1 is expressed in megakaryocytic cell lines and therefore may play a role in calcium homeostasis in megakaryocytes and platelets.

Full details of the abovementioned studies are described in the following publications, the disclosure of which are hereby incorporated by reference:

Zitt, C.; Zobel, A.; Obukhov, A. G.; Harteneck, C.; Kalkbrenner, F.; Luckhoff, A.; Schultz, G.: Cloning and functional expression of a human Ca(2+)-permeable cation channel activated by calcium store depletion. Neuron 16:1189-1196, 1996; and Xu, X.-Z. S.; Li, H.-S.; Guggino, W. B.; Montell, C.: Coassembly of TRP and TRPL produces a distinct store-operated conductance. Cell 89:1155-1164, 1997.

Further studies establishing the function and utilities of TRPC1 are found in John Hopkins OMIM database record ID 602343, and in cited publications listed in Table 5, which are hereby incorporated by reference. TU3A (Accession NP_009108.1) is another GAM99 target gene, herein designated TARGET GENE. TU3A BINDING SITE is a target binding site found in the 5' untranslated region of mRNA encoded by TU3A, corresponding to a target binding site such as BINDING SITE I, BINDING SITE II or BINDING SITE III of FIG. 8. Table 4 illustrates the complementarity of the nucleotide sequences of TU3A BINDING SITE, designated SEQ ID:18290, to the nucleotide sequence of GAM99 RNA, herein designated GAM RNA, also designated SEQ ID:320.

Another function of GAM99 is therefore inhibition of TU3A (Accession NP_009108.1). Accordingly, utilities of GAM99 include diagnosis, prevention and treatment of diseases and clinical conditions associated with TU3A.

Ubiquilin 1 (UBQLN1, Accession NP_038466.2) is another GAM99 target gene, herein designated TARGET GENE. UBQLN1 BINDING SITE is a target binding site found in the 3' untranslated region of multiple transcripts of mRNA encoded by UBQLN1, corresponding to a target binding site such as BINDING SITE I, BINDING SITE II or BINDING SITE III of FIG. 8. Table 4 illustrates the complementarity of the nucleotide sequences of UBQLN1 BINDING SITE, designated SEQ ID:17847, to the nucleotide sequence of GAM99 RNA, herein designated GAM RNA, also designated SEQ ID:320.

Another function of GAM99 is therefore inhibition of Ubiquilin 1 (UBQLN1, Accession NP_038466.2), a gene which may have a role in regulating cell cycle progression. Accordingly, utilities of GAM99 include diagnosis, prevention and treatment of diseases and clinical conditions associated with UBQLN1.

The function of UBQLN1 has been established by previous studies. By screening a human nigra cDNA library with a rat DA41 cDNA as a probe, Hanaoka et al. (2000) isolated the human DA41 homolog. Human DA41 encodes a 589-amino acid protein with a predicted molecular mass of 62.4 kD. The protein shows 86% amino acid sequence identity with the rat protein, indicating the evolutionarily conserved structure and function of DA41. DA41 was expressed ubiquitously in adult human tissues, with relatively higher levels in pituitary gland, adrenal gland, kidney, thymus, and placenta. By performing independent yeast 2-hybrid screens, Kleijnen et al. (2000) isolated cDNAs encoding PLIC1 and PLIC2 (UBQLN2; 300264), homologs of the mouse Plics (proteins linking integrin-associated protein (IAP; 601028) and cytoskeleton) and the yeast Dsk2 protein. PLIC1, also called UBQLN1, shares 72% amino acid identity with PLIC2. Two motifs are conserved in the mammalian PLICs and yeast Dsk2, an N-terminal ubiquitin (OMIM Ref. No. 191320)-like (UBL) domain and a C-terminal ubiquitin-associated (UBA) domain. Unlike ubiquitin, the UBL domain of the PLICs does not have a diglycine motif in its C terminus; the diglycine motif serves as a target site for cellular hydrolases that release ubiquitin from precursor fusion proteins. The absence of a GG sequence suggests that the UBL domain in the PLICs is an integral part of the open reading frame. The UBA domain is a loosely defined sequence motif present in multiple enzyme classes of the ubiquitination machinery. The most notable difference between the mammalian PLICs is the presence of a collagen-like motif in PLIC2 that is absent in PLIC1 and yeast Dsk2. This domain is most homologous to the collagen-like oncoprotein of herpesvirus Saimiri, STP-C488, which is implicated in intracellular signaling via the RAS- RAF pathway (see OMIM Ref. No. 190020). The collagen-like domain of PLIC2 contains 8 PXGP motifs that are susceptible to cleavage by collagenase in vitro. Kleijnen et al (2000) showed that the human PLICs physically associate with both proteasomes and ubiquitin ligases in large complexes. Overexpression of PLICs interfered with the in vivo degradation of 2 unrelated ubiquitin-dependent proteasome substrates, p53 (OMIM Ref. No. 191170) and I-kappa-B-alpha (NFKBIA; 164008), but not a ubiquitin-independent substrate. These findings raised the possibility that the PLICs, and possibly related ubiquitin-like family members, may functionally link the ubiquitination machinery to the proteasome to affect in vivo protein degradation.

Full details of the abovementioned studies are described in the following publications, the disclosure of which are hereby incorporated by reference:

Hanaoka, E.; Ozaki, T.; Ohira, M.; Nakamura, Y.; Suzuki, M.; Takahashi, E.; Moriy, H.; Nakagawara, A.; Sakiyama, S.: Molecular cloning and expression analysis of the human DA41 gene and its mapping to chromosome 9q21.2-q21.3. J. Hum. Genet. 45:188-191, 2000; and Kleijnen, M. F.; Shih, A. H.; Zhou, P.; Kumar, S.; Soccio, R. E.; Kedersha, N. L.; Gill, G.; Howley, P. M.: The hPLIC proteins may provide a link between the ubiquitination machinery.

Further studies establishing the function and utilities of UBQLN1 are found in John Hopkins OMIM database record ID 605046, and in cited publications listed in Table 5, which are hereby incorporated by reference. Uridine monophosphate synthetase (orotate phosphoribosyl transferase and orotidine-5'-decarboxylase) (UMPS, Accession NP_000364.1) is another GAM99 target gene, herein designated TARGET GENE. UMPS BINDING SITE is a target binding site found in the 3' untranslated region of mRNA encoded by UMPS, corresponding to a target binding site such as BINDING SITE I, BINDING SITE II or BINDING SITE III of FIG. 8. Table 4 illustrates the complementarity of the nucleotide sequences of UMPS BINDING SITE, designated SEQ ID:15501, to the nucleotide sequence of GAM99 RNA, herein designated GAM RNA, also designated SEQ ID:320.

Another function of GAM99 is therefore inhibition of Uridine monophosphate synthetase (orotate phosphoribosyl transferase and orotidine-5'-decarboxylase) (UMPS, Accession NP_000364.1). Accordingly, utilities of GAM99 include diagnosis, prevention and treatment of diseases and clinical conditions associated with UMPS.

Was protein family, member 3 (WASF3, Accession NP_006637.2) is another GAM99 target gene, herein designated TARGET GENE. WASF3 BINDING SITE1 and WASF3 BINDING SITE2 are target binding sites found in untranslated regions of mRNA encoded by WASF3, corresponding to target binding sites such as BINDING SITE I, BINDING SITE II or BINDING SITE III of FIG. 8. Table 4 illustrates the complementarity of the nucleotide sequences of WASF3 BINDING SITE1 and WASF3 BINDING SITE2, designated SEQ ID:16728 and SEQ ID:7833 respectively, to the nucleotide sequence of GAM99 RNA, herein designated GAM RNA, also designated SEQ ID:320.

Another function of GAM99 is therefore inhibition of Was protein family, member 3 (WASF3, Accession NP_006637.2), a gene which stimulates actin polymerization. Accordingly, utilities of GAM99 include diagnosis, prevention and treatment of diseases and clinical conditions associated with WASF3.

The function of WASF3 and its association with various diseases and clinical conditions, has been established by previous studies, as described hereinabove with reference to GAM65.2. Extracellular link domain containing 1 (XLKD1, Accession NP_006682.1) is another GAM99 target gene, herein designated TARGET GENE. XLKD1 BINDING SITE is a target binding site found in the 3' untranslated region of mRNA encoded by XLKD1, corresponding to a target binding site such as BINDING SITE I, BINDING SITE II or BINDING SITE III of FIG. 8. Table 4 illustrates the complementarity of the nucleotide sequences of XLKD1 BINDING SITE, designated SEQ ID:11348, to the nucleotide sequence of GAM99 RNA, herein designated GAM RNA, also designated SEQ ID:320.

Another function of GAM99 is therefore inhibition of Extracellular link domain containing 1 (XLKD1, Accession NP_006682.1). Accordingly, utilities of GAM99 include diagnosis, prevention and treatment of diseases and clinical conditions associated with XLKD1.

FIG. 8 further provides a conceptual description of a novel bioinformatically detected of the present invention, referred to here as Genomic Address Messenger 100 (GAM100), which modulates expression of respective target genes thereof, the function and utility of which target genes is known in the art.

GAM100 is a novel bioinformatically detected regulatory, non protein coding, micro RNA (miRNA) gene. The method by which GAM100 was detected is described hereinabove with reference to FIGS. 8-15.

GAM100 gene, herein designated GAM GENE, and GAM100 target gene, herein designated TARGET GENE, are human genes contained in the human genome.

GAM100 gene encodes a GAM100 precursor RNA, herein designated GAM PRECURSOR RNA. Similar to other miRNA genes, and unlike most ordinary genes, GAM100 precursor RNA does not encode a protein. A nucleotide sequence identical or highly similar to the nucleotide sequence of GAM100 precursor RNA is designated SEQ ID:91, and is provided hereinbelow with reference to the sequence listing part. Nucleotide sequence SEQ ID:91 is located at position 56 relative to chromosome 7.

GAM100 precursor RNA folds onto itself, forming GAM100 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM100 precursor RNA folds onto itself, forming GAM100 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM100 precursor RNA, designated SEQ-ID:91, and a schematic representation of a predicted secondary folding of GAM100 folded precursor RNA are further described with reference to Table 2, hereby incorporated by reference.

An enzyme complex designated DICER COMPLEX, 'dices' the GAM100 folded precursor RNA into GAM100 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM100 RNA is designated SEQ ID:243, and is provided hereinbelow with references to the sequence listing part and Table 3, hereby incorporated by reference.

GAM100 target gene, herein designated TARGET GENE, encodes a corresponding messenger RNA, GAM100 target RNA, herein designated GAM TARGET RNA. GAM100 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM100 RNA, herein designated GAM RNA, binds complementarily to one or more target binding sites located in untranslated regions of GAM100 target RNA, herein designated GAM TARGET RNA. This complementary binding is due to the fact that the nucleotide sequence of GAM100 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM100 RNA may have a different number of target binding sites in untranslated regions of a GAM100 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM100 RNA, herein designated GAM RNA, to target binding sites on GAM100 target RNA, herein designated GAM TARGET RNA, such as BINDING SITE I, BINDING SITE II and BINDING SITE III, inhibits translation of GAM100 target RNA into GAM100 target protein, herein designated GAM TARGET PROTEIN. GAM target protein is therefore outlined by a broken line.

It is appreciated that GAM100 target gene, herein designated TARGET GENE, in fact represents a plurality of GAM100 target genes. The mRNA of each one of this plurality of GAM100 target genes comprises one or more target binding sites, each having a nucleotide sequence which is at least partly complementary to GAM100 RNA, herein designated GAM RNA, and which when bound by GAM100 RNA causes inhibition of translation of respective one or more GAM100 target proteins.

It is further appreciated by one skilled in the art that the mode of translational inhibition illustrated by FIG. 8 with specific reference to translational inhibition exerted by GAM100 gene, herein designated GAM GENE, on one or more GAM100 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM100 correlate with, and may be deduced from, the identity of the target genes which GAM100 binds and inhibits, and the function of these target genes, as elaborated hereinbelow.

Acyl-coenzyme a dehydrogenase, short/branched chain (ACADSB, Accession NP_001600.1) is a GAM100 target gene, herein designated TARGET GENE. ACADSB BINDING SITE is a target binding site found in the 3' untranslated region of mRNA encoded by ACADSB, corresponding to a target binding site such as BINDING SITE I, BINDING SITE II or BINDING SITE III of FIG. 8. Table 4 illustrates the complementarity of the nucleotide sequences of ACADSB BINDING SITE, designated SEQ ID:9071, to the nucleotide sequence of GAM100 RNA, herein designated GAM RNA, also designated SEQ ID:243.

A function of GAM100 is therefore inhibition of Acyl-coenzyme a dehydrogenase, short/branched chain (ACADSB, Accession NP_001600.1). Accordingly, utilities of GAM100 include diagnosis, prevention and treatment of diseases and clinical conditions associated with ACADSB.

S-adenosylmethionine decarboxylase 1 (AMD1, Accession NP_001625.1) is another GAM100 target gene, herein designated TARGET GENE. AMD1 BINDING SITE is a target binding site found in the 3' untranslated region of mRNA encoded by AMD1, corresponding to a target binding site such as BINDING SITE I, BINDING SITE II or BINDING SITE III of FIG. 8. Table 4 illustrates the complementarity of the nucleotide sequences of AMD1 BINDING SITE, designated SEQ ID:693, to the nucleotide sequence of GAM100 RNA, herein designated GAM RNA, also designated SEQ ID:243.

Another function of GAM100 is therefore inhibition of S-adenosylmethionine decarboxylase 1 (AMD1, Accession NP_001625.1), a gene which catalyzes the removal of the carboxylate group of S-adenosylmethionine in the polyamine biosynthesis pathway. Accordingly, utilities of GAM100 include diagnosis, prevention and treatment of diseases and clinical conditions associated with AMD1.

The function of AMD1 has been established by previous studies. The polyamines spermine, spermidine, and putrescine are low molecular weight aliphatic amines essential for cellular proliferation and tumor promotion. Ornithine decarboxylase (ODC; 165640) and S-adenosylmethionine decarboxylase (AdoMetDC) catalyze the rate-limiting steps in polyamine biosynthesis. A concordant rise in ODC and AdoMetDC activity is seen in various neoplastic conditions including colon cancer and benign colonic polyps. A rat cDNA clone for AdoMetDC was used by Radford et al. (1987, 1989) in mouse- human somatic cell hybrid experiments to map the AMD gene to chromosomes 6 and X. They demonstrated that the gene on chromosome 6, symbolized AMD1, is not amplified in colon neoplasia. The sequence on X, symbolized AMD2, was localized to Xq22-q28 and may represent a pseudogene. That AMD2 is indeed a pseudogene was indicated by the findings of Maric et al. (1992) that the X-chromosome gene lacks introns which are present in the chromosome 6 gene. The gene on chromosome 6 encompasses at least 22 kb and comprises 9 exons and 8 introns, in contrast to the corresponding rat gene that has only 8 exons. Other aspects of the structure and organization were presented by Maric et al. (1992). Pulkka et al. (1993) characterized 2 AMD genes in the rat and localized both to rat chromosome 20 by mouse-rat somatic cell hybrids. They showed a high degree of conservation of sequence and structural organization in the coding portions but the 5-prime flanking regions were totally different. Maric et al. (1995) characterized the AMD pseudogene on the X chromosome. It lacks all the introns present in AMD1 and has numerous mutations in the protein-coding region. By fluorescence in situ hybridization, they mapped AMD1 to 6q21-q22 and the pseudogene, which they referred to as AMD2, to Xq28.

Full details of the abovementioned studies are described in the following publications, the disclosure of which are hereby incorporated by reference:

Maric, S. C.; Crozat, A.; Janne, O. A.: Structure and organization of the human S- adenosylmethionine decarboxylase gene. J. Biol. Chem. 267:18915-18923, 1992; and Maric, S. C.; Crozat, A.; Louhimo, J.; Knuutila, S.; Janne, O. A.: The human S- adenosylmethionine decarboxylase gene: nucleotide sequence of a pseudogene and chromosomal localization o.

Further studies establishing the function and utilities of AMD1 are found in John Hopkins OMIM database record ID 180980, and in cited publications listed in Table 5, which are hereby incorporated by reference. Adp-ribosylation factor 3 (ARF3, Accession NP_001650.1) is another GAM100 target gene, herein designated TARGET GENE. ARF3 BINDING SITE is a target binding site found in the 3' untranslated region of mRNA encoded by ARF3, corresponding to a target binding site such as BINDING SITE I, BINDING SITE II or BINDING SITE III of FIG. 8. Table 4 illustrates the complementarity of the nucleotide sequences of ARF3 BINDING SITE, designated SEQ ID:11427, to the nucleotide sequence of GAM100 RNA, herein designated GAM RNA, also designated SEQ ID:243.

Another function of GAM100 is therefore inhibition of Adp-ribosylation factor 3 (ARF3, Accession NP_001650.1). Accordingly, utilities of GAM100 include diagnosis, prevention and treatment of diseases and clinical conditions associated with ARF3.

ARHGAP11A (Accession NP_055598.1) is another GAM100 target gene, herein designated TARGET GENE. ARHGAP11A BINDING SITE is a target binding site found in the 3' untranslated region of mRNA encoded by ARHGAP11A, corresponding to a target binding site such as BINDING SITE I, BINDING SITE II or BINDING SITE III of FIG. 8. Table 4 illustrates the complementarity of the nucleotide sequences of ARHGAP11A BINDING SITE, designated SEQ ID:8456, to the nucleotide sequence of GAM100 RNA, herein designated GAM RNA, also designated SEQ ID:243.

Another function of GAM100 is therefore inhibition of ARHGAP11A (Accession NP_055598.1). Accordingly, utilities of GAM100 include diagnosis, prevention and treatment of diseases and clinical conditions associated with ARHGAP11A.

Atpase, h+ transporting, lysosomal 42 kda, v1 subunit c isoform 2 (ATP6V1C2, Accession NP_653184.1) is another GAM100 target gene, herein designated TARGET GENE. ATP6V1C2 BINDING SITE is a target binding site found in the 3' untranslated region of mRNA encoded by ATP6V1C2, corresponding to a target binding site such as BINDING SITE I, BINDING SITE II or BINDING SITE III of FIG. 8. Table 4 illustrates the complementarity of the nucleotide sequences of ATP6V1C2 BINDING SITE, designated SEQ ID:15117, to the nucleotide sequence of GAM100 RNA, herein designated GAM RNA, also designated SEQ ID:243.

Another function of GAM100 is therefore inhibition of Atpase, h+ transporting, lysosomal 42 kda, v1 subunit c isoform 2 (ATP6V1C2, Accession NP_653184.1). Accordingly, utilities of GAM100 include diagnosis, prevention and treatment of diseases and clinical conditions associated with ATP6V1C2.

Btb and cnc homology 1, basic leucine zipper transcription factor 1 (BACH1, Accession NP_001177.1) is another GAM100 target gene, herein designated TARGET GENE. BACH1 BINDING SITE is a target binding site found in the 3' untranslated region of mRNA encoded by BACH1, corresponding to a target binding site such as BINDING SITE I, BINDING SITE II or BINDING SITE III of FIG. 8. Table 4 illustrates the complementarity of the nucleotide sequences of BACH1 BINDING SITE, designated SEQ ID:4647, to the nucleotide sequence of GAM100 RNA, herein designated GAM RNA, also designated SEQ ID:243.

Another function of GAM100 is therefore inhibition of Btb and cnc homology 1, basic leucine zipper transcription factor 1 (BACH1, Accession NP_001177.1), a gene which acts as repressor or activator, binds to nf- e2 binding sites. Accordingly, utilities of GAM100 include diagnosis, prevention and treatment of diseases and clinical conditions associated with BACH1.

The function of BACH1 has been established by previous studies. Members of the small Maf family are basic region leucine zipper (bZip) proteins that can function as transcriptional activators or repressors (see OMIM Ref. No. MAFG, 602020). Small Maf proteins can switch from transcriptional repressors to activators, depending on the proteins with which they form heterodimers. Using a yeast 2 hybrid screen to identify MafK (OMIM Ref. No. 600197) heterodimerization partners, Oyake et al. (1996) identified mouse cDNAs encoding Bach1 and Bach2. Both Bach proteins contained a BTB (broad complex-tramtrack-bric-a-brac) or POZ (poxvirus and zinc finger) protein interaction domain and a CNC (Cap'n'collar)-type bZip domain. Oyake et al. (1996) demonstrated that Bach1 and Bach2 (OMIM Ref. No. 605394) form heterodimers with MafK, and function as transcriptional activators or repressors when expressed in mammalian cells. Therefore, the authors suggested that the Bach proteins play important roles in coordinating transcription activation and repression by MafK. While developing a physical map of chromosome 21, both Ohira et al. (1998) and Blouin et al. (1998) isolated cDNAs encoding human BACH1. Ohira et al. (1998) reported that the sequence of the predicted 736-amino acid human protein is 80% identical to that of mouse Bach1. Human BACH1, like mouse Bach1, contains a BTB domain and CNC bZip domain. Northern analysis revealed that BACH1 is expressed ubiquitously as a 5.5-kb mRNA. An additional strong 3-kb signal was seen in testis.

Full details of the abovementioned studies are described in the following publications, the disclosure of which are hereby incorporated by reference:

Ohira, M.; Seki, N.; Nagase, T.; Ishikawa, K.; Nomura, N.; Ohara, O.: Characterization of a human homolog (BACH1) of the mouse Bach1 gene encoding a BTB-basic leucine zipper transcription factor and its mapping to chromosome 21q22.1. Genomics 47:300-306, 1998; and Oyake, T.; Itoh, K.; Motohashi 1. Blouin, J.-L.; Sail, G. D.; Guipponi, M.; Rossier, C.; Pappasavas, M.-P.; Antonarakis, S. E.: Isolation of the human BACH1 transcription regulator gene.

Further studies establishing the function and utilities of BACH1 are found in John Hopkins OMIM database record ID 602751, and in cited publications listed in Table 5, which are hereby incorporated by reference. Btb and cnc homology 1, basic leucine zipper transcription factor 2 (BACH2, Accession NP_068585.1) is another GAM100 target gene, herein designated TARGET GENE. BACH2 BINDING SITE is a target binding site found in the 3' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:8027, to the nucleotide sequence of GAM100 RNA, herein designated GAM RNA, also designated SEQ ID:243.

Another function of GAM100 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM100 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. Bcl2-associated athanogene 2 (BAG2, Accession NP_004273.1) is another GAM100 target gene, herein designated TARGET GENE. BAG2 BINDING SITE is a target binding site found in the 3' untranslated region of mRNA encoded by BAG2, corresponding to a target binding site such as BINDING SITE I, BINDING SITE II or BINDING SITE III of FIG. 8. Table 4 illustrates the complementarity of the nucleotide sequences of BAG2 BINDING SITE, designated SEQ ID:9686, to the nucleotide sequence of GAM100 RNA, herein designated GAM RNA, also designated SEQ ID:243.

Another function of GAM100 is therefore inhibition of Bcl2-associated athanogene 2 (BAG2, Accession NP_004273.1). Accordingly, utilities of GAM100 include diagnosis, prevention and treatment of diseases and clinical conditions associated with BAG2.

BLP2 (Accession NP_079417.1) is another GAM100 target gene, herein designated TARGET GENE. BLP2 BINDING SITE is a target binding site found in the 3' untranslated region of multiple transcripts of mRNA encoded by BLP2, corresponding to a target binding site such as BINDING SITE I, BINDING SITE II or BINDING SITE III of FIG. 8. Table 4 illustrates the complementarity of the nucleotide sequences of BLP2 BINDING SITE, designated SEQ ID:6931, to the nucleotide sequence of GAM100 RNA, herein designated GAM RNA, also designated SEQ ID:243.

Another function of GAM100 is therefore inhibition of BLP2 (Accession NP_079417.1). Accordingly, utilities of GAM100 include diagnosis, prevention and treatment of diseases and clinical conditions associated with BLP2.

BLP2 (Accession NP_510883.1) is another GAM100 target gene, herein designated TARGET GENE. BLP2 BINDING SITE is a target binding site found in the 3' untranslated region of multiple transcripts of mRNA encoded by BLP2, corresponding to a target binding site such as BINDING SITE I, BINDING SITE II or BINDING SITE III of FIG. 8. Table 4 illustrates the complementarity of the nucleotide sequences of BLP2 BINDING SITE, designated SEQ ID:6931, to the nucleotide sequence of GAM100 RNA, herein designated GAM RNA, also designated SEQ ID:243.

Another function of GAM100 is therefore inhibition of BLP2 (Accession NP_510883.1). Accordingly, utilities of GAM100 include diagnosis, prevention and treatment of diseases and clinical conditions associated with BLP2.

C10orf5 (Accession XP_172843.1) is another GAM100 target gene, herein designated TARGET GENE. C10orf5 BINDING SITE is a target binding site found in the 3' untranslated region of multiple transcripts of mRNA encoded by C10orf5, corresponding to a target binding site such as BINDING SITE I, BINDING SITE II or BINDING SITE III of FIG. 8. Table 4 illustrates the complementarity of the nucleotide sequences of C10orf5 BINDING SITE, designated SEQ ID:16299, to the nucleotide sequence of GAM100 RNA, herein designated GAM RNA, also designated SEQ ID:243.

Another function of GAM100 is therefore inhibition of C10orf5 (Accession XP_172843.1). Accordingly, utilities of GAM100 include diagnosis, prevention and treatment of diseases and clinical conditions associated with C10orf5.

C14orf146 (Accession NP_689660.2) is another GAM100 target gene, herein designated TARGET GENE. C14orf146 BINDING SITE is a target binding site found in the 5' untranslated region of mRNA encoded by C14orf146, corresponding to a target binding site such as BINDING SITE I, BINDING SITE II or BINDING SITE III of FIG. 8. Table 4 illustrates the complementarity of the nucleotide sequences of C14orf146 BINDING SITE, designated SEQ ID:10104, to the nucleotide sequence of GAM100 RNA, herein designated GAM RNA, also designated SEQ ID:243.

Another function of GAM100 is therefore inhibition of C14orf146 (Accession NP_689660.2). Accordingly, utilities of GAM100 include diagnosis, prevention and treatment of diseases and clinical conditions associated with C14orf146.

Chromosome 20 open reading frame 64 (C20orf64, Accession NP_291028.2) is another GAM100 target gene, herein designated TARGET GENE. C20orf64 BINDING SITE is a target binding site found in the 3' untranslated region of mRNA encoded by C20orf64, corresponding to a target binding site such as BINDING SITE I, BINDING SITE II or BINDING SITE III of FIG. 8. Table 4 illustrates the complementarity of the nucleotide sequences of C20orf64 BINDING SITE, designated SEQ ID:19464, to the nucleotide sequence of GAM100 RNA, herein designated GAM RNA, also designated SEQ ID:243.

Another function of GAM100 is therefore inhibition of Chromosome 20 open reading frame 64 (C20orf64, Accession NP_291028.2). Accordingly, utilities of GAM100 include diagnosis, prevention and treatment of diseases and clinical conditions associated with C20orf64.

C6orf151 (Accession NP_689764.1) is another GAM100 target gene, herein designated TARGET GENE. C6orf151 BINDING SITE is a target binding site found in the 3' untranslated region of mRNA encoded by C6orf151, corresponding to a target binding site such as BINDING SITE I, BINDING SITE II or BINDING SITE III of FIG. 8. Table 4 illustrates the complementarity of the nucleotide sequences of C6orf151 BINDING SITE, designated SEQ ID:12717, to the nucleotide sequence of GAM100 RNA, herein designated GAM RNA, also designated SEQ ID:243.

Another function of GAM100 is therefore inhibition of C6orf151 (Accession NP_689764.1). Accordingly, utilities of GAM100 include diagnosis, prevention and treatment of diseases and clinical conditions associated with C6orf151.

Chromosome 9 open reading frame 5 (C9orf5, Accession NP_114401.1) is another GAM100 target gene, herein designated TARGET GENE. C9orf5 BINDING SITE is a target binding site found in the 3' untranslated region of mRNA encoded by C9orf5, corresponding to a target binding site such as BINDING SITE I, BINDING SITE II or BINDING SITE III of FIG. 8. Table 4 illustrates the complementarity of the nucleotide sequences of C9orf5 BINDING SITE, designated SEQ ID:14642, to the nucleotide sequence of GAM100 RNA, herein designated GAM RNA, also designated SEQ ID:243.

Another function of GAM100 is therefore inhibition of Chromosome 9 open reading frame 5 (C9orf5, Accession NP_114401.1). Accordingly, utilities of GAM100 include diagnosis, prevention and treatment of diseases and clinical conditions associated with C9orf5.

Calmodulin binding transcription activator 1 (CAMTA1, Accession XP_042323.7) is another GAM100 target gene, herein designated TARGET GENE. CAMTA1 BINDING SITE is a target binding site found in the 3' untranslated region of mRNA encoded by CAMTA1, corresponding to a target binding site such as BINDING SITE I, BINDING SITE II or BINDING SITE III of FIG. 8. Table 4 illustrates the complementarity of the nucleotide sequences of CAMTA1 BINDING SITE, designated SEQ ID:10875, to the nucleotide sequence of GAM100 RNA, herein designated GAM RNA, also designated SEQ ID:243.

Another function of GAM100 is therefore inhibition of Calmodulin binding transcription activator 1 (CAMTA1, Accession XP_042323.7). Accordingly, utilities of GAM100 include diagnosis, prevention and treatment of diseases and clinical conditions associated with CAMTA1.

Cholecystokinin b receptor (CCKBR, Accession NP_000722.2) is another GAM100 target gene, herein designated TARGET GENE. CCKBR BINDING SITE is a target binding site found in the 3' untranslated region of multiple transcripts of mRNA encoded by CCKBR, corresponding to a target binding site such as BINDING SITE I, BINDING SITE II or BINDING SITE III of FIG. 8. Table 4 illustrates the complementarity of the nucleotide sequences of CCKBR BINDING SITE, designated SEQ ID:3824, to the nucleotide sequence of GAM100 RNA, herein designated GAM RNA, also designated SEQ ID:243.

Another function of GAM100 is therefore inhibition of Cholecystokinin b receptor (CCKBR, Accession NP_000722.2), a gene which bonds cholecystokinin, regulates emotion and gastric acid secretion. Accordingly, utilities of GAM100 include diagnosis, prevention and treatment of diseases and clinical conditions associated with CCKBR.

The function of CCKBR and its association with various diseases and clinical conditions, has been established by previous studies, as described hereinabove with reference to GAM44.1. Cholecystokinin b receptor (CCKBR, Accession NP_795344.1) is another GAM100 target gene, herein designated TARGET GENE. CCKBR BINDING SITE is a target binding site found in the 3' untranslated region of multiple transcripts of mRNA encoded by CCKBR, corresponding to a target binding site such as BINDING SITE I, BINDING SITE II or BINDING SITE III of FIG. 8. Table 4 illustrates the complementarity of the nucleotide sequences of CCKBR BINDING SITE, designated SEQ ID:3824, to the nucleotide sequence of GAM100 RNA, herein designated GAM RNA, also designated SEQ ID:243.

Another function of GAM100 is therefore inhibition of Cholecystokinin b receptor (CCKBR, Accession NP_795344.1), a gene which bonds cholecystokinin, regulates emotion and gastric acid secretion. Accordingly, utilities of GAM100 include diagnosis, prevention and treatment of diseases and clinical conditions associated with CCKBR.

The function of CCKBR and its association with various diseases and clinical conditions, has been established by previous studies, as described hereinabove with reference to GAM44.1. Chemokine (c-c motif) receptor 9 (CCR9, Accession NP_006632.2) is another GAM100 target gene, herein designated TARGET GENE. CCR9 BINDING SITE is a target binding site found in the 3' untranslated region of multiple transcripts of mRNA encoded by CCR9, corresponding to a target binding site such as BINDING SITE I, BINDING SITE II or BINDING SITE III of FIG. 8. Table 4 illustrates the complementarity of the nucleotide sequences of CCR9 BINDING SITE, designated SEQ ID:2819, to the nucleotide sequence of GAM100 RNA, herein designated GAM RNA, also designated SEQ ID:243.

Another function of GAM100 is therefore inhibition of Chemokine (c-c motif) receptor 9 (CCR9, Accession NP_006632.2), a gene which binds beta-chemokine family and subsequently transduces a signal by increasing the intracellular calcium ions level. Accordingly, utilities of GAM100 include diagnosis, prevention and treatment of diseases and clinical conditions associated with CCR9.

The function of CCR9 has been established by previous studies. Chemokines are small peptides involved in the chemotaxis and activation of leukocytes in response to inflammation, tissue damage, or infection. Chemokine receptors belong to the superfamily of G protein-coupled receptors. See CMKBR1 (OMIM Ref. No. 601159) for background. Nibbs et al. (1997) stated that they had previously identified the mouse cysteine-cysteine (C-C) chemokine receptor D6. To identify the human homolog of D6, they performed PCR on human genomic DNA using primers based on the sequence of the mouse D6 gene. The human D6 gene encodes a predicted 384-amino acid protein that contains the characteristic 7 transmembrane domains and 4 conserved cysteine residues of chemokine receptors. The human and mouse D6 proteins share 71% amino acid identity. By Northern blot analysis, human D6 is expressed as approximately 4- and 6-kb transcripts in several tissues, with the highest expression in placenta. Although human D6 binds with relatively high-affinity to the majority of members of the beta-chemokine family (for example, MCP2; 602283), Nibbs et al. (1997) were unable to demonstrate any signaling following the ligand binding. Therefore, the International Union of Pharmacology (OMIM Ref. No. IUPHAR) proposed that the human D6 receptor be designated ccr9, with the lower cases indicating that receptor function has not been demonstrated. Bonini et al. (1997) cloned a cDNA encoding CMKBR9, which they called CCR10 because it is homologous to rat 'Ccr10-related receptor' (Ccr10rR). The CMKBR9 and rat Ccr10rR proteins have 72% amino acid identity. By PCR of a radiation hybrid panel, Bonini et al. (1997) mapped the CMKBR9 (CCBP2) gene to 3p21.32-p21.31, a region containing other C-C chemokine receptor genes such as CMKBR1, CMKBR2 (OMIM Ref. No. 601267), CMKBR3 (OMIM Ref. No. 601268), and CMKBR5 (OMIM Ref. No. 601373). By radiation hybrid analysis and organization of BAC contigs by FISH on combed genomic DNA, Maho et al. (1999) localized the CCBP2 gene within the CCR cluster at 3p21.3.

Full details of the abovementioned studies are described in the following publications, the disclosure of which are hereby incorporated by reference:

Nibbs, R. J. B.; Wylie, S. M.; Yang, J.; Landau, N. R.; Graham, G. J.: Cloning and characterization of a novel promiscuous human beta-chemokine receptor D6. J. Biol. Chem. 272:32078-32083, 1997; and Bonini, J. A.; Martin, S. K.; Dralyuk, F.; Roe, M. W.; Philipson, L. H.; Steiner, D. F.: Cloning, expression, and chromosomal mapping of a novel human CC-chemokine receptor (CCR10) that.

Further studies establishing the function and utilities of CCR9 are found in John Hopkins OMIM database record ID 602648, and in cited publications listed in Table 5, which are hereby incorporated by reference. Chemokine (c-c motif) receptor 9 (CCR9, Accession NP_112477.1) is another GAM100 target gene, herein designated TARGET GENE. CCR9 BINDING SITE is a target binding site found in the 3' untranslated region of multiple transcripts of mRNA encoded by CCR9, corresponding to a target binding site such as BINDING SITE I, BINDING SITE II or BINDING SITE III of FIG. 8. Table 4 illustrates the complementarity of the nucleotide sequences of CCR9 BINDING SITE, designated SEQ ID:2819, to the nucleotide sequence of GAM100 RNA, herein designated GAM RNA, also designated SEQ ID:243.

Another function of GAM100 is therefore inhibition of Chemokine (c-c motif) receptor 9 (CCR9, Accession NP_112477.1), a gene which binds beta-chemokine family and subsequently transduces a signal by increasing the intracellular calcium ions level. Accordingly, utilities of GAM100 include diagnosis, prevention and treatment of diseases and clinical conditions associated with CCR9.

The function of CCR9 has been established by previous studies. Chemokines are small peptides involved in the chemotaxis and activation of leukocytes in response to inflammation, tissue damage, or infection. Chemokine receptors belong to the superfamily of G protein-coupled receptors. See CMKBR1 (OMIM Ref. No. 601159) for background. Nibbs et al. (1997) stated that they had previously identified the mouse cysteine-cysteine (C-C) chemokine receptor D6. To identify the human homolog of D6, they performed PCR on human genomic DNA using primers based on the sequence of the mouse D6 gene. The human D6 gene encodes a predicted 384-amino acid protein that contains the characteristic 7 transmembrane domains and 4 conserved cysteine residues of chemokine receptors. The human and mouse D6 proteins share 71% amino acid identity. By Northern blot analysis, human D6 is expressed as approximately 4- and 6-kb transcripts in several tissues, with the highest expression in placenta. Although human D6 binds with relatively high-affinity to the majority of members of the beta-chemokine family (for example, MCP2; 602283), Nibbs et al. (1997) were unable to demonstrate any signaling following the ligand binding. Therefore, the International Union of Pharmacology (OMIM Ref. No. IUPHAR) proposed that the human D6 receptor be designated ccr9, with the lower cases indicating that receptor function has not been demonstrated. Bonini et al. (1997) cloned a cDNA encoding CMKBR9, which they called CCR10 because it is homologous to rat 'Ccr10-related receptor' (Ccr10rR). The CMKBR9 and rat Ccr10rR proteins have 72% amino acid identity. By PCR of a radiation hybrid panel, Bonini et al. (1997) mapped the CMKBR9 (CCBP2) gene to 3p21.32-p21.31, a region containing other C-C chemokine receptor genes such as CMKBR1, CMKBR2 (OMIM Ref. No. 601267), CMKBR3 (OMIM Ref. No. 601268), and CMKBR5 (OMIM Ref. No. 601373). By radiation hybrid analysis and organization of BAC contigs by FISH on combed genomic DNA, Maho et al. (1999) localized the CCBP2 gene within the CCR cluster at 3p21.3.

Full details of the abovementioned studies are described in the following publications, the disclosure of which are hereby incorporated by reference:

Nibbs, R. J. B.; Wylie, S. M.; Yang, J.; Landau, N. R.; Graham, G. J.: Cloning and characterization of a novel promiscuous human beta-chemokine receptor D6. J. Biol. Chem. 272:32078-32083, 1997; and Bonini, J. A.; Martin, S. K.; Dralyuk, F.; Roe, M. W.; Philipson, L. H.; Steiner, D. F.: Cloning, expression, and chromosomal mapping of a novel human CC-chemokine receptor (CCR10) that.

Further studies establishing the function and utilities of CCR9 are found in John Hopkins OMIM database record ID 602648, and in cited publications listed in Table 5, which are hereby incorporated by reference. CG012 (Accession XP_096710.1) is another GAM100 target gene, herein designated TARGET GENE. CG012 BINDING SITE is a target binding site found in the 5' untranslated region of mRNA encoded by CG012, corresponding to a target binding site such as BINDING SITE I, BINDING SITE II or BINDING SITE III of FIG. 8. Table 4 illustrates the complementarity of the nucleotide sequences of CG012 BINDING SITE, designated SEQ ID:20065, to the nucleotide sequence of GAM100 RNA, herein designated GAM RNA, also designated SEQ ID:243.

Another function of GAM100 is therefore inhibition of CG012 (Accession XP_096710.1). Accordingly, utilities of GAM100 include diagnosis, prevention and treatment of diseases and clinical conditions associated with CG012.

Claudin 12 (CLDN12, Accession NP_036261.1) is another GAM100 target gene, herein designated TARGET GENE. CLDN12 BINDING SITE is a target binding site found in the 3' untranslated region of mRNA encoded by CLDN12, corresponding to a target binding site such as BINDING SITE I, BINDING SITE II or BINDING SITE III of FIG. 8. Table 4 illustrates the complementarity of the nucleotide sequences of CLDN12 BINDING SITE, designated SEQ ID:8251, to the nucleotide sequence of GAM100 RNA, herein designated GAM RNA, also designated SEQ ID:243.

Another function of GAM100 is therefore inhibition of Claudin 12 (CLDN12, Accession NP_036261.1). Accordingly, utilities of GAM100 include diagnosis, prevention and treatment of diseases and clinical conditions associated with CLDN12.

Collagen, type xxi, alpha 1 (COL21A1, Accession NP_110447.2) is another GAM100 target gene, herein designated TARGET GENE. COL21A1 BINDING SITE is a target binding site found in the 3' untranslated region of mRNA encoded by COL21A1, corresponding to a target binding site such as BINDING SITE I, BINDING SITE II or BINDING SITE III of FIG. 8. Table 4 illustrates the complementarity of the nucleotide sequences of COL21A1 BINDING SITE, designated SEQ ID:15079, to the nucleotide sequence of GAM100 RNA, herein designated GAM RNA, also designated SEQ ID:243.

Another function of GAM100 is therefore inhibition of Collagen, type xxi, alpha 1 (COL21A1, Accession NP_110447.2). Accordingly, utilities of GAM100 include diagnosis, prevention and treatment of diseases and clinical conditions associated with COL21A1.

CPGL2 (Accession NP_116038.4) is another GAM100 target gene, herein designated TARGET GENE. CPGL2 BINDING SITE is a target binding site found in the 3' untranslated region of mRNA encoded by CPGL2, corresponding to a target binding site such as BINDING SITE I, BINDING SITE II or BINDING SITE III of FIG. 8. Table 4 illustrates the complementarity of the nucleotide sequences of CPGL2 BINDING SITE, designated SEQ ID:10752, to the nucleotide sequence of GAM100 RNA, herein designated GAM RNA, also designated SEQ ID:243.

Another function of GAM100 is therefore inhibition of CPGL2 (Accession NP_116038.4). Accordingly, utilities of GAM100 include diagnosis, prevention and treatment of diseases and clinical conditions associated with CPGL2.

Cytochrome p450, subfamily viia (cholesterol 7 alpha-monooxygenase), polypeptide 1 (CYP7A1, Accession NP_000771.1) is another GAM100 target gene, herein designated TARGET GENE. CYP7A1 BINDING SITE is a target binding site found in the 3' untranslated region of mRNA encoded by CYP7A1, corresponding to a target binding site such as BINDING SITE I, BINDING SITE II or BINDING SITE III of FIG. 8. Table 4 illustrates the complementarity of the nucleotide sequences of CYP7A1 BINDING SITE, designated SEQ ID:2570, to the nucleotide sequence of GAM100 RNA, herein designated GAM RNA, also designated SEQ ID:243.

Another function of GAM100 is therefore inhibition of Cytochrome p450, subfamily viia (cholesterol 7 alpha-monooxygenase), polypeptide 1 (CYP7A1, Accession NP_000771.1), a gene which functions in cholesterol and bile acid metabolism . and therefore may be associated with Metabolic liver disease. Accordingly, utilities of GAM100 include diagnosis, prevention and treatment of Metabolic liver disease, and of other diseases and clinical conditions associated with CYP7A1.

The function of CYP7A1 has been established by previous studies. In an elegant series of experiments designed to understand the effect of retinoid X receptor (RXR; OMIM Ref. No. 180245) activation on cholesterol balance, Repa et al. (2000) treated animals with the rexinoid LG268. Animals treated with rexinoid exhibited marked changes in cholesterol balance, including inhibition of cholesterol absorption and repressed bile acid synthesis. Studies with receptor-selective agonists revealed that oxysterol receptors (LXRs, OMIM Ref. No. 602423 and 600380) and the bile acid receptor, FXR (OMIM Ref. No. 603826), are the RXR heterodimeric partners that mediate these effects by regulating expression of the reverse-cholesterol transporter, ABC1 (OMIM Ref. No. 600046), and the rate-limiting enzyme of bile acid synthesis, CYP7A1, respectively. These RXR heterodimers serve as key regulators in cholesterol homeostasis by governing reverse cholesterol transport from peripheral tissues, bile acid synthesis in liver, and cholesterol absorption in intestine. Activation of RXR/LXR heterodimers inhibits cholesterol absorption by upregulation of ABC1 expression in the small intestine. Activation of RXR/FXR heterodimers represses CYP7A1 expression and bile acid production, leading to a failure to solubilize and absorb cholesterol. Studies have shown that RXR/FXR- mediated repression of CYP7A1 is dominant over RXR/LXR-mediated induction of CYP7A1, which explains why the rexinoid represses rather than activates CYP7A1 (Lu et al., 2000). Activation of the LXR signaling pathway results in the upregulation of ABC1 in peripheral cells, including macrophages, to efflux free cholesterol for transport back to the liver through high density lipoprotein, where it is converted to bile acids by the LXR-mediated increase in CYP7A1 expression. Secretion of biliary cholesterol in the presence of increased bile acid pools normally results in enhanced reabsorption of cholesterol; however, with the increased expression of ABC1 and efflux of cholesterol back into the lumen, there is a reduction in cholesterol absorption and net excretion of cholesterol and bile acid. Rexinoids therefore offer a novel class of agents for treating elevated cholesterol. Agellon et al. (2002) found that wildtype mice and mice transgenic for human CYP7A1 respond differently to cholesterol feeding. Cholesterol feeding stimulated Cyp7a1 mRNA abundance and enzymatic activity in wildtype mice, but repressed human CYP7A1 mRNA and activity in transgenic mice. In transfected hepatoma cells, cholesterol increased mouse Cyp7a1 gene promoter activity, but had no effect on the human CYYP7A1 gene promoter. By electrophoretic mobility shift assay, Agellon et al. (2002) found interaction of LXR:RXR with the mouse promoter, but no binding to the human promoter.

Full details of the abovementioned studies are described in the following publications, the disclosure of which are hereby incorporated by reference:

Lu, T. T.; Makishima, M.; Repa, J. J.; Schoonjans, K.; Kerr, T. A.; Auwerx, J.; Mangelsdorf, D. J.: Molecular basis for feedback regulation of bile acid synthesis by nuclear receptors. Molec. Cell 6:507-515, 2000; and Agellon, L. B.; Drover, V. A. B.; Cheema, S. K.; Gbaguidi, G. F.; Walsh, A.: Dietary cholesterol fails to stimulate the human cholesterol 7-alpha-hydroxylase gene (CYP7A1) in transgeni.

Further studies establishing the function and utilities of CYP7A1 are found in John Hopkins OMIM database record ID 118455, and in cited publications listed in Table 5, which are hereby incorporated by reference. DKFZp434A171 (Accession NP_115626.1) is another GAM100 target gene, herein designated TARGET GENE. DKFZp434A171 BINDING SITE is a target binding site found in the 3' untranslated region of mRNA encoded by DKFZp434A171, corresponding to a target binding site such as BINDING SITE I, BINDING SITE II or BINDING SITE III of FIG. 8. Table 4 illustrates the complementarity of the nucleotide sequences of DKFZp434A171 BINDING SITE, designated SEQ ID:8438, to the nucleotide sequence of GAM100 RNA, herein designated GAM RNA, also designated SEQ ID:243.

Another function of GAM100 is therefore inhibition of DKFZp434A171 (Accession NP_115626.1). Accordingly, utilities of GAM100 include diagnosis, prevention and treatment of diseases and clinical conditions associated with DKFZp434A171.

DKFZp434N2030 (Accession XP_037555.8) is another GAM100 target gene, herein designated TARGET GENE. DKFZp434N2030 BINDING SITE is a target binding site found in the 3' untranslated region of mRNA encoded by DKFZp434N2030, corresponding to a target binding site such as BINDING SITE I, BINDING SITE II or BINDING SITE III of FIG. 8. Table 4 illustrates the complementarity of the nucleotide sequences of DKFZp434N2030 BINDING SITE, designated SEQ ID:8864, to the nucleotide sequence of GAM100 RNA, herein designated GAM RNA, also designated SEQ ID:243.

Another function of GAM100 is therefore inhibition of DKFZp434N2030 (Accession XP_037555.8). Accordingly, utilities of GAM100 include diagnosis, prevention and treatment of diseases and clinical conditions associated with DKFZp434N2030.

DKFZP564D166 (Accession NP_108648.1) is another GAM100 target gene, herein designated TARGET GENE. DKFZP564D166 BINDING SITE is a target binding site found in the 3' untranslated region of multiple transcripts of mRNA encoded by DKFZP564D166, corresponding to a target binding site such as BINDING SITE I, BINDING SITE II or BINDING SITE III of FIG. 8. Table 4 illustrates the complementarity of the nucleotide sequences of DKFZP564D166 BINDING SITE, designated SEQ ID:11086, to the nucleotide sequence of GAM100 RNA, herein designated GAM RNA, also designated SEQ ID:243.

Another function of GAM100 is therefore inhibition of DKFZP564D166 (Accession NP_108648.1). Accordingly, utilities of GAM100 include diagnosis, prevention and treatment of diseases and clinical conditions associated with DKFZP564D166.

DKFZp566H0824 (Accession NP_060005.1) is another GAM100 target gene, herein designated TARGET GENE. DKFZp566H0824 BINDING SITE is a target binding site found in the 5' untranslated region of mRNA encoded by DKFZp566H0824, corresponding to a target binding site such as BINDING SITE I, BINDING SITE II or BINDING SITE III of FIG. 8. Table 4 illustrates the complementarity of the nucleotide sequences of DKFZp566H0824 BINDING SITE, designated SEQ ID:15799, to the nucleotide sequence of GAM100 RNA, herein designated GAM RNA, also designated SEQ ID:243.

Another function of GAM100 is therefore inhibition of DKFZp566H0824 (Accession NP_060005.1). Accordingly, utilities of GAM100 include diagnosis, prevention and treatment of diseases and clinical conditions associated with DKFZp566H0824.

DKFZp667M2411 (Accession XP_290795.1) is another GAM100 target gene, herein designated TARGET GENE. DKFZp667M2411 BINDING SITE is a target binding site found in the 5' untranslated region of mRNA encoded by DKFZp667M2411, corresponding to a target binding site such as BINDING SITE I, BINDING SITE II or BINDING SITE III of FIG. 8. Table 4 illustrates the complementarity of the nucleotide sequences of DKFZp667M2411 BINDING SITE, designated SEQ ID:13698, to the nucleotide sequence of GAM100 RNA, herein designated GAM RNA, also designated SEQ ID:243.

Another function of GAM100 is therefore inhibition of DKFZp667M2411 (Accession XP_290795.1). Accordingly, utilities of GAM100 include diagnosis, prevention and treatment of diseases and clinical conditions associated with DKFZp667M2411.

DKFZp761O17121 (Accession NP_115663.1) is another GAM100 target gene, herein designated TARGET GENE. DKFZp761O17121 BINDING SITE is a target binding site found in the 3' untranslated region of mRNA encoded by DKFZp761O17121, corresponding to a target binding site such as BINDING SITE I, BINDING SITE II or BINDING SITE III of FIG. 8. Table 4 illustrates the complementarity of the nucleotide sequences of DKFZp761O17121 BINDING SITE, designated SEQ ID:1198, to the nucleotide sequence of GAM100 RNA, herein designated GAM RNA, also designated SEQ ID:243.

Another function of GAM100 is therefore inhibition of DKFZp761O17121 (Accession NP_115663.1). Accordingly, utilities of GAM100 include diagnosis, prevention and treatment of diseases and clinical conditions associated with DKFZp761O17121.

Dentin matrix acidic phosphoprotein (DMP1, Accession NP_004398.1) is another GAM100 target gene, herein designated TARGET GENE. DMP1 BINDING SITE is a target binding site found in the 3' untranslated region of mRNA encoded by DMP1, corresponding to a target binding site such as BINDING SITE I, BINDING SITE II or BINDING SITE III of FIG. 8. Table 4 illustrates the complementarity of the nucleotide sequences of DMP1 BINDING SITE, designated SEQ ID:5295, to the nucleotide sequence of GAM100 RNA, herein designated GAM RNA, also designated SEQ ID:243.

Another function of GAM100 is therefore inhibition of Dentin matrix acidic phosphoprotein (DMP1, Accession NP_004398.1), a gene which regulates mineralization of bone and dentin. Accordingly, utilities of GAM100 include diagnosis, prevention and treatment of diseases and clinical conditions associated with DMP1.

The function of DMP1 has been established by previous studies. George et al. (1993) isolated a dentin matrix acidic phosphoprotein from a rat odontoblast cDNA library. It is a serine-rich acidic protein that has numerous potential phosphorylation sites, especially for messenger-independent kinases of the casein kinase II group. Expression analysis showed that dmp1 message is essentially dentin- specific. The mouse dmp1 gene was mapped to 5q21, a region of the mouse genome that shows homology of synteny with human 4q21. Dentinogenesis imperfecta type II (OMIM Ref. No. 125490) maps to that region of the genome, namely 4q13-q21. This prompted Aplin et al. (1995) to isolate a cosmid containing the human DMP1 gene. The isolation of a short tandem repeat polymorphism at this locus allowed them to map DMP1 to 4q21 and demonstrate that it is tightly linked to DGI1 in 2 families. The creation of a YAC contig around the gene for osteopontin (OMIM Ref. No. 166490) allowed them to demonstrate that DMP1 is located within 150 kb of the bone sialoprotein locus (OMIM Ref. No. 147563) and within 490 kb of the SPP1 locus. Mutation search in both SPP1 and IBSP in individuals with dentinogenesis imperfecta yielded negative results. DMP1 is a candidate for similar mutation screen. MacDougall et al. (1996) used fluorescence in situ hybridization to map DMP1 to 4q21. By screening a cDNA library constructed from mandibular and maxillary third molars with the mouse Dmp1 sequence as the probe, Hirst et al. (1997) isolated a cDNA encoding DMP1. The deduced 513-amino acid, highly acidic, serine-rich protein has a hydrophobic signal peptide, an Arg-Gly-Asp cell-attachment sequence, and numerous potential serine phosphorylation sites. Genomic sequence analysis indicated that the DMP1 gene contains 6 exons, and no disease-specific mutations were identified in 2 families with type II dentinogenesis imperfecta.

Full details of the abovementioned studies are described in the following publications, the disclosure of which are hereby incorporated by reference:

Hirst, K. L.; Simmons, D.; Feng, J.; Aplin, H.; Dixon, M. J.; MacDougall, M.: Elucidation of the sequence and the genomic organization of the human dentin matrix acidic phosphoprotein 1 (DMP1) gene: exclusion of the locus from a causative role in the pathogenesis of dentinogenesis imperfecta type II. Genomics 42:38-45, 1997; and MacDougall, M.; DuPont, B. R.; Simmons, D.; Leach, R. J.: Assignment of DMP1 to human chromosome 4 band q21 by in situ hybridization. Cytogenet. Cell. Genet. 74:189 only, 1996.

Further studies establishing the function and utilities of DMP1 are found in John Hopkins OMIM database record ID 600980, and in cited publications listed in Table 5, which are hereby incorporated by reference. Dystrobrevin, beta (DTNB, Accession NP_149159.1) is another GAM100 target gene, herein designated TARGET GENE. DTNB BINDING SITE is a target binding site found in the 3' untranslated region of multiple transcripts of mRNA encoded by DTNB, corresponding to a target binding site such as BINDING SITE I, BINDING SITE II or BINDING SITE III of FIG. 8. Table 4 illustrates the complementarity of the nucleotide sequences of DTNB BINDING SITE, designated SEQ ID:17907, to the nucleotide sequence of GAM100 RNA, herein designated GAM RNA, also designated SEQ ID:243.

Another function of GAM100 is therefore inhibition of Dystrobrevin, beta (DTNB, Accession NP_149159.1), a gene which is a part of a dystrophin- associated protein complex. and therefore may be associated with Limb-girdle muscular dystrophy. Accordingly, utilities of GAM100 include diagnosis, prevention and treatment of Limb-girdle muscular dystrophy, and of other diseases and clinical conditions associated with DTNB.

The function of DTNB has been established by previous studies. Dystrophin, a component of muscle that is defective in Duchenne muscular dystrophy (DMD; 310200), binds to a complex of proteins and glycoproteins, the dystrophin-associated protein complex (DPC), which effectively forms a transmembrane link between the extracellular matrix, and the cytoskeleton of the muscle fiber. The DPC can be divided into 3 subcomplexes: the dystroglycan complex, the sarcoglycan complex, and the cytoplasmic complex. The dystroglycan complex consists of 2 proteins, alpha- and beta- dystroglycan (DAG1, 128239; DAG2, 600119), that bind to laminin and dystrophin, respectively. The sarcoglycan complex is composed of 4 transmembrane glycoproteins: alpha-, beta-, gamma-, and delta-sarcoglycan, and a 25-kD protein 25DAP. Mutations in all 4 sarcoglycan genes have been found in patients with different forms of limb-girdle muscular dystrophy. The cytoplasmic component of the DPC is composed of the syntrophin family of related proteins and the dystrophin-related protein, dystrobrevin. Peters et al. (1997) described beta-dystrobrevin. They cloned cDNAs from human liver libraries that encode a 627-amino acid polypeptide with a predicted molecular weight of 71 kD. The protein copurified with the dystrobrevin short form, Dp71. The mammalian dystrobrevin genes encode several protein isoforms that are expressed in different tissues, including brain and muscle. Blake et al. (1998) designated the isoform expressed in muscle as alpha-dystrobrevin and used the designation beta-dystrobrevin for the dystrophin- related protein they found to be abundantly expressed in brain and other tissues but not in muscle. Beta-dystrobrevin is encoded by a 2.5-kb alternatively spliced transcript that is found throughout the brain. In common with dystrophin, beta- dystrobrevin is found in neurons of the cortex and hippocampal formation, but it is not found in the brain microvasculature. In the brain, beta-dystrobrevin coprecipitates with the dystrophin isoforms Dp71 and Dp140. The findings of Blake et al. (1998) indicated that the composition of the dystrophin-associated protein complex in the brain differs from that in muscle. Because beta-dystrobrevin and dystrophin are expressed in similar populations of neurons in the hippocampus and cortex, it is possible that beta-dystrobrevin interacts directly with dystrophin. If this is the case, then beta-dystrobrevin levels may be reduced in DMD patients similar to the reduction in sarcolemmal staining seen with other components of the DPC in dystrophic muscle. The findings may be relevant to the cognitive dysfunction affecting many patients with Duchenne muscular dystrophy.

Full details of the abovementioned studies are described in the following publications, the disclosure of which are hereby incorporated by reference:

Blake, D. J.; Nawrotzki, R.; Loh, N. Y.; Gorecki, D. C.; Davies, K. E.: Beta- dystrobrevin, a member of the dystrophin-related protein family. Proc. Nat. Acad. Sci. 95:241-246, 1998; and Peters, M. F.; O'Brien, K. F.; Sadoulet-Puccio, H. M.; Kunkel, L. M.; Adams, M. E.; Froehner, S. C.: Beta-dystrobrevin, a new member of the dystrophin family: identification, cloning.

Further studies establishing the function and utilities of DTNB are found in John Hopkins OMIM database record ID 602415, and in cited publications listed in Table 5, which are hereby incorporated by reference. Dysferlin, limb girdle muscular dystrophy 2b (autosomal recessive) (DYSF, Accession NP_003485.1) is another GAM100 target gene, herein designated TARGET GENE. DYSF BINDING SITE is a target binding site found in the 3' untranslated region of mRNA encoded by DYSF, corresponding to a target binding site such as BINDING SITE I, BINDING SITE II or BINDING SITE III of FIG. 8. Table 4 illustrates the complementarity of the nucleotide sequences of DYSF BINDING SITE, designated SEQ ID:17950, to the nucleotide sequence of GAM100 RNA, herein designated GAM RNA, also designated SEQ ID:243.

Another function of GAM100 is therefore inhibition of Dysferlin, limb girdle muscular dystrophy 2b (autosomal recessive) (DYSF, Accession NP_003485.1), a gene which is highly expressed in skeletal muscle. and therefore is associated with Miyoshi myopathy, limb girdle muscular dystrophy type 2b. Accordingly, utilities of GAM100 include diagnosis, prevention and treatment of Miyoshi myopathy, limb girdle muscular dystrophy type 2b, and of other diseases and clinical conditions associated with DYSF.

The function of DYSF has been established by previous studies. The limb-girdle muscular dystrophies are a genetically heterogeneous group of inherited progressive muscular disorders that affect mainly the proximal musculature, with evidence for at least 3 autosomal dominant and 8 autosomal recessive loci. The recessive forms for the most part involve mutations in genes encoding components of the dystrophin-associated complex; another form, LGMD2A (OMIM Ref. No. 253600), is caused by mutations in the gene for the muscle-specific protease calpain 3 (CAPN3; 114340). Miyoshi myopathy (MM; 254130) is an adult-onset, recessively inherited distal muscular dystrophy that maps to 2p13. A form of recessive limb-girdle muscular dystrophy, designated LGMD2B (OMIM Ref. No. 253601), maps to the same chromosomal region. This raised the possibility that MM and LGMD2B are allelic disorders. In fact they were shown to be varying expressions of the same mutant gene; 2 large, inbred kindreds whose members included both MM and LGMD2B patients were described by Weiler et al. (1996) and Illarioshkin et al. (1996, 1997). Affected individuals in both pedigrees shared the same haplotype. Differences in the phenotype appeared to be due to additional modifying factors. Liu et al. (1998) constructed a 3-Mb PAC contig spanning the MM candidate region. This clarified the order of genetic markers across the area, provided 5 new polymorphic markers within it, and narrowed the locus to approximately 2 Mb. They found 5 skeletal muscle ESTs that mapped in this region. Liu et al. (1998) reported that 1 of these ESTs is located in a novel, full-length 6.9-kb muscle cDNA; they designated the corresponding protein dysferlin.

Animal model experiments lend further support to the function of DYSF. The SJL mouse strain (Festing, 1979) is susceptible to many induced autoimmune diseases such as experimental autoimmune encephalitis (EAE) and inflammatory muscle disease. Additionally, the skeletal muscle of SJL mice was shown to have an increased regenerative capacity and demonstrates the spontaneous occurrence of what was designated an 'inflammatory myopathy,' accompanied by loss of strength. By histopathologic examinations of muscles in SJL mice of different ages, Bittner et al. (1999) found features compatible with a progressive muscular dystrophy, including degenerative and regenerative changes of muscle fibers and a progressive fibrosis. Histologically, the changes were observed in mice as young as 3 weeks of age. Changes affected primarily the proximal muscle groups, whereas the distal muscles remained less affected. The morphologic alterations were associated with signs of slowly progressive muscle weakness, which Bittner et al. (1999) detected as early as 3 weeks after birth when mice were suspended by their tails. The phenotype was found to be inherited as an autosomal recessive trait and was found to map to mouse chromosome 6, in a region syntenic with human 2p13, where the DYSF gene maps. Because of this synteny, Bittner et al. (1999) studied dysferlin in these mice. They found a reduction to approximately 15% of control levels in SJL mice. They found a 171-bp deletion in the Dysf gene of SJL mice, predicted to result in removal of 57 amino acids, including most of the fourth C2 domain. The last C2 domain is conserved in other members of the fer-like gene family.

It is appreciated that the abovementioned animal model for DYSF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bittner, R. E.; Anderson, L. V. B.; Burkhardt, E.; Bashir, R.; Vafiadaki, E.; Ivanova, S.; Raffelsberger, T.; Maerk, I.; Hoger, H.; Jung, M.; Karbasiyan, M.; Storch, M.; Lassmann, H.; Moss, J. A.; Davison, K.; Harrison, R.; Bushby, K. M. D.; Reis, A.: Dysferlin deletion in SJL mice (SJL-Dysf) defines a natural model for limb girdle muscular dystrophy 2B. (Letter) Nature Genet. 23:141-142, 1999; and Liu, J.; Wu, C.; Bossie, K.; Bejaoui, K.; Hosler, B. A.; Gingrich, J. C.; Ben Hamida, M.; Hentati, F.; Schurr, E.; de Jong, P. J.; Brown, R. H., Jr.: Generation of 3-Mb PAC contig sp.

Further studies establishing the function and utilities of DYSF are found in John Hopkins OMIM database record ID 603009, and in cited publications listed in Table 5, which are hereby incorporated by reference. EFG2 (Accession NP_733792.1) is another GAM100 target gene, herein designated TARGET GENE. EFG2 BINDING SITE is a target binding site found in the 3' untranslated region of multiple transcripts of mRNA encoded by EFG2, corresponding to a target binding site such as BINDING SITE I, BINDING SITE II or BINDING SITE III of FIG. 8. Table 4 illustrates the complementarity of the nucleotide sequences of EFG2 BINDING SITE, designated SEQ ID:14944, to the nucleotide sequence of GAM100 RNA, herein designated GAM RNA, also designated SEQ ID:243.

Another function of GAM100 is therefore inhibition of EFG2 (Accession NP_733792.1). Accordingly, utilities of GAM100 include diagnosis, prevention and treatment of diseases and clinical conditions associated with EFG2.

EFG2 (Accession NP_115756.2) is another GAM100 target gene, herein designated TARGET GENE. EFG2 BINDING SITE is a target binding site found in the 3' untranslated region of multiple transcripts of mRNA encoded by EFG2, corresponding to a target binding site such as BINDING SITE I, BINDING SITE II or BINDING SITE III of FIG. 8. Table 4 illustrates the complementarity of the nucleotide sequences of EFG2 BINDING SITE, designated SEQ ID:14944, to the nucleotide sequence of GAM100 RNA, herein designated GAM RNA, also designated SEQ ID:243.

Another function of GAM100 is therefore inhibition of EFG2 (Accession NP_115756.2). Accordingly, utilities of GAM100 include diagnosis, prevention and treatment of diseases and clinical conditions associated with EFG2.

Enabled homolog (drosophila) (ENAH, Accession NP_060682.1) is another GAM100 target gene, herein designated TARGET GENE. ENAH BINDING SITE is a target binding site found in the 3' untranslated region of mRNA encoded by ENAH, corresponding to a target binding site such as BINDING SITE I, BINDING SITE II or BINDING SITE III of FIG. 8. Table 4 illustrates the complementarity of the nucleotide sequences of ENAH BINDING SITE, designated SEQ ID:12776, to the nucleotide sequence of GAM100 RNA, herein designated GAM RNA, also designated SEQ ID:243.

Another function of GAM100 is therefore inhibition of Enabled homolog (drosophila) (ENAH, Accession NP_060682.1). Accordingly, utilities of GAM100 include diagnosis, prevention and treatment of diseases and clinical conditions associated with ENAH.

Fatty-acid-coenzyme a ligase, long-chain 1 (FACL1, Accession NP_001986.1) is another GAM100 target gene, herein designated TARGET GENE. FACL1 BINDING SITE is a target binding site found in the 5' untranslated region of mRNA encoded by FACL1, corresponding to a target binding site such as BINDING SITE I, BINDING SITE II or BINDING SITE III of FIG. 8. Table 4 illustrates the complementarity of the nucleotide sequences of FACL1 BINDING SITE, designated SEQ ID:20169, to the nucleotide sequence of GAM100 RNA, herein designated GAM RNA, also designated SEQ ID:243.

Another function of GAM100 is therefore inhibition of Fatty-acid-coenzyme a ligase, long-chain 1 (FACL1, Accession NP_001986.1) . Accordingly, utilities of GAM100 include diagnosis, prevention and treatment of diseases and clinical conditions associated with FACL1.

FLJ20303 (Accession NP_060225.2) is another GAM100 target gene, herein designated TARGET GENE. FLJ20303 BINDING SITE is a target binding site found in the 3' untranslated region of mRNA encoded by FLJ20303, corresponding to a target binding site such as BINDING SITE I, BINDING SITE II or BINDING SITE III of FIG. 8. Table 4 illustrates the complementarity of the nucleotide sequences of FLJ20303 BINDING SITE, designated SEQ ID:16995, to the nucleotide sequence of GAM100 RNA, herein designated GAM RNA, also designated SEQ ID:243.

Another function of GAM100 is therefore inhibition of FLJ20303 (Accession NP_060225.2). Accordingly, utilities of GAM100 include diagnosis, prevention and treatment of diseases and clinical conditions associated with FLJ20303.

FLJ23834 (Accession NP_689963.1) is another GAM100 target gene, herein designated TARGET GENE. FLJ23834 BINDING SITE is a target binding site found in the 5' untranslated region of mRNA encoded by FLJ23834, corresponding to a target binding site such as BINDING SITE I, BINDING SITE II or BINDING SITE III of FIG. 8. Table 4 illustrates the complementarity of the nucleotide sequences of FLJ23834 BINDING SITE, designated SEQ ID:2419, to the nucleotide sequence of GAM100 RNA, herein designated GAM RNA, also designated SEQ ID:243.

Another function of GAM100 is therefore inhibition of FLJ23834 (Accession NP_689963.1). Accordingly, utilities of GAM100 include diagnosis, prevention and treatment of diseases and clinical conditions associated with FLJ23834.

FLJ32894 (Accession NP_653268.1) is another GAM100 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:3993, to the nucleotide sequence of GAM100 RNA, herein designated GAM RNA, also designated SEQ ID:243.

Another function of GAM100 is therefore inhibition of FLJ32894 (Accession NP_653268.1). Accordingly, utilities of GAM100 include diagnosis, prevention and treatment of diseases and clinical conditions associated with FLJ32894.

FLJ33768 (Accession NP_775881.1) is another GAM100 target gene, herein designated TARGET GENE. FLJ33768 BINDING SITE is a target binding site found in the 3' untranslated region of mRNA encoded by FLJ33768, corresponding to a target binding site such as BINDING SITE I, BINDING SITE II or BINDING SITE III of FIG. 8. Table 4 illustrates the complementarity of the nucleotide sequences of FLJ33768 BINDING SITE, designated SEQ ID:4332, to the nucleotide sequence of GAM100 RNA, herein designated GAM RNA, also designated SEQ ID:243.

Another function of GAM100 is therefore inhibition of FLJ33768 (Accession NP_775881.1). Accordingly, utilities of GAM100 include diagnosis, prevention and treatment of diseases and clinical conditions associated with FLJ33768.

FLJ34922 (Accession NP_689483.1) is another GAM100 target gene, herein designated TARGET GENE. FLJ34922 BINDING SITE is a target binding site found in the 3' untranslated region of mRNA encoded by FLJ34922, corresponding to a target binding site such as BINDING SITE I, BINDING SITE II or BINDING SITE III of FIG. 8. Table 4 illustrates the complementarity of the nucleotide sequences of FLJ34922 BINDING SITE, designated SEQ ID:14134, to the nucleotide sequence of GAM100 RNA, herein designated GAM RNA, also designated SEQ ID:243.

Another function of GAM100 is therefore inhibition of FLJ34922 (Accession NP_689483.1). Accordingly, utilities of GAM100 include diagnosis, prevention and treatment of diseases and clinical conditions associated with FLJ34922.

FLJ39106 (Accession NP_775900.1) is another GAM100 target gene, herein designated TARGET GENE. FLJ39106 BINDING SITE is a target binding site found in the 3' untranslated region of mRNA encoded by FLJ39106, corresponding to a target binding site such as BINDING SITE I, BINDING SITE II or BINDING SITE III of FIG. 8. Table 4 illustrates the complementarity of the nucleotide sequences of FLJ39106 BINDING SITE, designated SEQ ID:12417, to the nucleotide sequence of GAM100 RNA, herein designated GAM RNA, also designated SEQ ID:243.

Another function of GAM100 is therefore inhibition of FLJ39106 (Accession NP_775900.1). Accordingly, utilities of GAM100 include diagnosis, prevention and treatment of diseases and clinical conditions associated with FLJ39106.

FLJ90430 (Accession NP_848653.1) is another GAM100 target gene, herein designated TARGET GENE. FLJ90430 BINDING SITE is a target binding site found in the 3' untranslated region of mRNA encoded by FLJ90430, corresponding to a target binding site such as BINDING SITE I, BINDING SITE II or BINDING SITE III of FIG. 8. Table 4 illustrates the complementarity of the nucleotide sequences of FLJ90430 BINDING SITE, designated SEQ ID:14531, to the nucleotide sequence of GAM100 RNA, herein designated GAM RNA, also designated SEQ ID:243.

Another function of GAM100 is therefore inhibition of FLJ90430 (Accession NP_848653.1). Accordingly, utilities of GAM100 include diagnosis, prevention and treatment of diseases and clinical conditions associated with FLJ90430.

GCC185 (Accession NP_852118.1) is another GAM100 target gene, herein designated TARGET GENE. GCC185 BINDING SITE is a target binding site found in the 3' untranslated region of multiple transcripts of mRNA encoded by GCC185, corresponding to a target binding site such as BINDING SITE I, BINDING SITE II or BINDING SITE III of FIG. 8. Table 4 illustrates the complementarity of the nucleotide sequences of GCC185 BINDING SITE, designated SEQ ID:18198, to the nucleotide sequence of GAM100 RNA, herein designated GAM RNA, also designated SEQ ID:243.

Another function of GAM100 is therefore inhibition of GCC185 (Accession NP_852118.1). Accordingly, utilities of GAM100 include diagnosis, prevention and treatment of diseases and clinical conditions associated with GCC185.

GCC185 (Accession NP_055450.1) is another GAM100 target gene, herein designated TARGET GENE. GCC185 BINDING SITE is a target binding site found in the 3' untranslated region of multiple transcripts of mRNA encoded by GCC185, corresponding to a target binding site such as BINDING SITE I, BINDING SITE II or BINDING SITE III of FIG. 8. Table 4 illustrates the complementarity of the nucleotide sequences of GCC185 BINDING SITE, designated SEQ ID:18198, to the nucleotide sequence of GAM100 RNA, herein designated GAM RNA, also designated SEQ ID:243.

Another function of GAM100 is therefore inhibition of GCC185 (Accession NP_055450.1). Accordingly, utilities of GAM100 include diagnosis, prevention and treatment of diseases and clinical conditions associated with GCC185.

Gephyrin (GPHN, Accession NP_065857.1) is another GAM100 target gene, herein designated TARGET GENE. GPHN BINDING SITE is a target binding site found in the 3' untranslated region of mRNA encoded by GPHN, corresponding to a target binding site such as BINDING SITE I, BINDING SITE II or BINDING SITE III of FIG. 8. Table 4 illustrates the complementarity of the nucleotide sequences of GPHN BINDING SITE, designated SEQ ID:6063, to the nucleotide sequence of GAM100 RNA, herein designated GAM RNA, also designated SEQ ID:243.

Another function of GAM100 is therefore inhibition of Gephyrin (GPHN, Accession NP_065857.1). Accordingly, utilities of GAM100 include diagnosis, prevention and treatment of diseases and clinical conditions associated with GPHN.

Interleukin 5 (colony-stimulating factor, eosinophil) (IL5, Accession NP_000870.1) is another GAM100 target gene, herein designated TARGET GENE. IL5 BINDING SITE is a target binding site found in the 3' untranslated region of mRNA encoded by IL5, corresponding to a target binding site such as BINDING SITE I, BINDING SITE II or BINDING SITE III of FIG. 8. Table 4 illustrates the complementarity of the nucleotide sequences of IL5 BINDING SITE, designated SEQ ID:16606, to the nucleotide sequence of GAM100 RNA, herein designated GAM RNA, also designated SEQ ID:243.

Another function of GAM100 is therefore inhibition of Interleukin 5 (colony-stimulating factor, eosinophil) (IL5, Accession NP_000870.1), a gene which induces terminal differentiation of late-developing b-cells to immunoglobulin secreting cells. and therefore may be associated with 5q-syndrome. Accordingly, utilities of GAM100 include diagnosis, prevention and treatment of 5q-syndrome, and of other diseases and clinical conditions associated with IL5.

The function of IL5 has been established by previous studies. Campbell et al. (1987) cloned eosinophil differentiation factor (EDF) from a genomic library in lambda phage by using a murine EDF cDNA clone as a probe. The human gene contains 3 introns. The predicted amino acid sequence of 134 amino acids was identical to that reported for human interleukin-5 but showed no significant homology with other known hematopoietic growth regulators. Interleukin-5 is a selective eosinophil-activating growth hormone. The amino acid sequence was about 70% identical to that of murine EDF. Recombinant human EDF, expressed from the human EDF gene after transfection into monkey COS cells, stimulated the production of eosinophils and eosinophil colonies from normal human bone marrow but had no effect on the production of neutrophils or mononuclear cells (monocytes and lymphoid cells). Tanabe et al. (1987) cloned the IL5 gene and determined its structure. Yokota et al. (1987) concluded that a single cDNA clone encodes a protein that acts as a growth and differentiation factor for both B cells and eosinophils By analysis of human YAC transgenic mice containing the 5q31 cytokine genes, Lacy et al. (2000) determined that the human proteins are produced under Th2 conditions in vitro and in response to Nippostrongylus brasiliensis, a Th2-inducing stimulus, in vivo. The authors observed no adverse effects on murine lymphoid organs. Fewer cells produced the endogenous mouse cytokines in transgenic than in control mice, suggesting competition for stable expression between the mouse and human genes. The data also suggested that regulatory elements within the human transgene are capable of interacting with trans-acting murine factors Full details of the abovementioned studies are described in the following publications, the disclosure of which are hereby incorporated by reference:

Loots, G. G.; Locksley, R. M.; Blankespoor, C. M.; Wang, Z. E.; Miller, W.; Rubin, E. M.; Frazer, K. A.: Identification of a coordinate regulator of interleukins 4, 13, and 5 by cross-species sequence comparisons. Science 288: 136-140, 2000; and Lacy, D. A.; Wang, Z.-E.; Symula, D. J.; McArthur, C. J.; Rubin, E. M.; Frazer, K. A.; Locksley, R. M.: Faithful expression of the human 5q31 cytokine cluster in transgenic mice. J. Im.

Further studies establishing the function and utilities of IL5 are found in John Hopkins OMIM database record ID 147850, and in cited publications listed in Table 5, which are hereby incorporated by reference. Interphotoreceptor matrix proteoglycan 1 (IMPG1, Accession NP_001554.2) is another GAM100 target gene, herein designated TARGET GENE. IMPG1 BINDING SITE is a target binding site found in the 3' untranslated region of mRNA encoded by IMPG1, corresponding to a target binding site such as BINDING SITE I, BINDING SITE II or BINDING SITE III of FIG. 8. Table 4 illustrates the complementarity of the nucleotide sequences of IMPG1 BINDING SITE, designated SEQ ID:5063, to the nucleotide sequence of GAM100 RNA, herein designated GAM RNA, also designated SEQ ID:243.

Another function of GAM100 is therefore inhibition of Interphotoreceptor matrix proteoglycan 1 (IMPG1, Accession NP_001554.2), a gene which Interphotoreceptor matrix proteoglycan 1; extracellular matrix protein and therefore may be associated with Autosomal dominant stargardt-like macular dystrophies. Accordingly, utilities of GAM100 include diagnosis, prevention and treatment of Autosomal dominant stargardt-like macular dystrophies, and of other diseases and clinical conditions associated with IMPG1.

The function of IMPG1 has been established by previous studies. Interphotoreceptor matrix glycoconjugates, which are largely proteoglycans, appear to participate in retinal adhesion and in maintaining photoreceptor viability. Kuehn and Hageman (1995) isolated monkey interphotoreceptor matrix proteoglycan-1 (Impg1), which the authors designated IPM-150, from an SDS-polyacrylamide gel and utilized amino acid sequence data from the isolated protein to design RT-PCR primers for amplification of monkey retinal mRNA. They used the resulting clone to screen a human cDNA library and isolated an 809-bp cDNA, which shares 97% homology with the monkey sequence and encodes human IMPG1. The putative protein, a chondroitin 6-sulfate proteoglycan, contains 4 consensus sequences for hyaluronan binding and 3 for N-glycosylation, as well as several potential O-glycosylation sites. To assess the role of the IMPG1 gene in human retinal dystrophies, Felbor et al. (1998) determined its genomic organization and chromosomal location. It is composed of 17 exons ranging from 21 to 533 bp, including an alternatively spliced exon 2. Using somatic cell hybrid mapping and fluorescence in situ hybridization analysis, they assigned the IMPG1 locus to 6q13-q15. This interval overlaps with the chromosomal localization of several human retinopathies, including autosomal dominant Stargardt- like macular dystrophy (STGD3; 600110), progressive bifocal chorioretinal atrophy (PBCRA; 600790), and North Carolina macular dystrophy (MCDR1; 136550). Thus, IMPG1 represents an attractive candidate for these 6q-linked disorders. Gehrig et al. (1998) found no disease-associated mutations in the IMPG1 gene in a single patient from an autosomal dominant STGD family or in patients from 6q-linked multigenerational families diagnosed with PBCRA or MCDR1.

Full details of the abovementioned studies are described in the following publications, the disclosure of which are hereby incorporated by reference:

Felbor, U.; Gehrig, A.; Sauer, C. G.; Marquardt, A.; Kohler, M.; Schmid, M.; Weber, B. H. F.: Genomic organization and chromosomal localization of the interphotoreceptor matrix proteoglycan-1 (IMPG1) gene: a candidate for 6q-linked retinopathies. Cytogenet. Cell Genet. 81:12-17, 1998; and Gehrig, A.; Felbor, U.; Kelsell, R. E.; Hunt, D. M.; Maumenee, I. H.; Weber, B. H. F.: Assessment of the interphotoreceptor matrix proteoglycan-1 (IMPG1) gene localised to 6q13-q15 in a.

Further studies establishing the function and utilities of IMPG1 are found in John Hopkins OMIM database record ID 602870, and in cited publications listed in Table 5, which are hereby incorporated by reference. Inositol 1,4,5-triphosphate receptor, type 2 (ITPR2, Accession NP_002214.1) is another GAM100 target gene, herein designated TARGET GENE. ITPR2 BINDING SITE is a target binding site found in the 3' untranslated region of mRNA encoded by ITPR2, corresponding to a target binding site such as BINDING SITE I, BINDING SITE II or BINDING SITE III of FIG. 8. Table 4 illustrates the complementarity of the nucleotide sequences of ITPR2 BINDING SITE, designated SEQ ID:4278, to the nucleotide sequence of GAM100 RNA, herein designated GAM RNA, also designated SEQ ID:243.

Another function of GAM100 is therefore inhibition of Inositol 1,4,5-triphosphate receptor, type 2 (ITPR2, Accession NP_002214.1). Accordingly, utilities of GAM100 include diagnosis, prevention and treatment of diseases and clinical conditions associated with ITPR2.

JUB (Accession NP_116265.1) is another GAM100 target gene, herein designated TARGET GENE. JUB BINDING SITE is a target binding site found in the 3' untranslated region of mRNA encoded by JUB, corresponding to a target binding site such as BINDING SITE I, BINDING SITE II or BINDING SITE III of FIG. 8. Table 4 illustrates the complementarity of the nucleotide sequences of JUB BINDING SITE, designated SEQ ID:17497, to the nucleotide sequence of GAM100 RNA, herein designated GAM RNA, also designated SEQ ID:243.

Another function of GAM100 is therefore inhibition of JUB (Accession NP_116265.1). Accordingly, utilities of GAM100 include diagnosis, prevention and treatment of diseases and clinical conditions associated with JUB.

KIAA0391 (Accession NP_055487.1) is another GAM100 target gene, herein designated TARGET GENE. KIAA0391 BINDING SITE is a target binding site found in the 3' untranslated region of mRNA encoded by KIAA0391, corresponding to a target binding site such as BINDING SITE I, BINDING SITE II or BINDING SITE III of FIG. 8. Table 4 illustrates the complementarity of the nucleotide sequences of KIAA0391 BINDING SITE, designated SEQ ID:8518, to the nucleotide sequence of GAM100 RNA, herein designated GAM RNA, also designated SEQ ID:243.

Another function of GAM100 is therefore inhibition of KIAA0391 (Accession NP_055487.1). Accordingly, utilities of GAM100 include diagnosis, prevention and treatment of diseases and clinical conditions associated with KIAA0391.

KIAA0738 (Accession NP_055534.1) is another GAM100 target gene, herein designated TARGET GENE. KIAA0738 BINDING SITE is a target binding site found in the 3' untranslated region of mRNA encoded by KIAA0738, corresponding to a target binding site such as BINDING SITE I, BINDING SITE II or BINDING SITE III of FIG. 8. Table 4 illustrates the complementarity of the nucleotide sequences of KIAA0738 BINDING SITE, designated SEQ ID:17995, to the nucleotide sequence of GAM100 RNA, herein designated GAM RNA, also designated SEQ ID:243.

Another function of GAM100 is therefore inhibition of KIAA0738 (Accession NP_055534.1). Accordingly, utilities of GAM100 include diagnosis, prevention and treatment of diseases and clinical conditions associated with KIAA0738.

KIAA1495 (Accession NP_065922.1) is another GAM100 target gene, herein designated TARGET GENE. KIAA1495 BINDING SITE is a target binding site found in the 3' untranslated region of mRNA encoded by KIAA1495, corresponding to a target binding site such as BINDING SITE I, BINDING SITE II or BINDING SITE III of FIG. 8. Table 4 illustrates the complementarity of the nucleotide sequences of KIAA1495 BINDING SITE, designated SEQ ID:17775, to the nucleotide sequence of GAM100 RNA, herein designated GAM RNA, also designated SEQ ID:243.

Another function of GAM100 is therefore inhibition of KIAA1495 (Accession NP_065922.1). Accordingly, utilities of GAM100 include diagnosis, prevention and treatment of diseases and clinical conditions associated with KIAA1495.

KIAA2024 (Accession NP_742067.1) is another GAM100 target gene, herein designated TARGET GENE. KIAA2024 BINDING SITE is a target binding site found in the 5' untranslated region of mRNA encoded by KIAA2024, corresponding to a target binding site such as BINDING SITE I, BINDING SITE II or BINDING SITE III of FIG. 8. Table 4 illustrates the complementarity of the nucleotide sequences of KIAA2024 BINDING SITE, designated SEQ ID:18881, to the nucleotide sequence of GAM100 RNA, herein designated GAM RNA, also designated SEQ ID:243.

Another function of GAM100 is therefore inhibition of KIAA2024 (Accession NP_742067.1). Accordingly, utilities of GAM100 include diagnosis, prevention and treatment of diseases and clinical conditions associated with KIAA2024.

Lamin b receptor (LBR, Accession NP_002287.1) is another GAM100 target gene, herein designated TARGET GENE. LBR BINDING SITE is a target binding site found in the 3' untranslated region of mRNA encoded by LBR, corresponding to a target binding site such as BINDING SITE I, BINDING SITE II or BINDING SITE III of FIG. 8. Table 4 illustrates the complementarity of the nucleotide sequences of LBR BINDING SITE, designated SEQ ID:14697, to the nucleotide sequence of GAM100 RNA, herein designated GAM RNA, also designated SEQ ID:243.

Another function of GAM100 is therefore inhibition of Lamin b receptor (LBR, Accession NP_002287.1). Accordingly, utilities of GAM100 include diagnosis, prevention and treatment of diseases and clinical conditions associated with LBR.

LGN (Accession NP_037428.2) is another GAM100 target gene, herein designated TARGET GENE. LGN BINDING SITE is a target binding site found in the 3' untranslated region of mRNA encoded by LGN, corresponding to a target binding site such as BINDING SITE I, BINDING SITE II or BINDING SITE III of FIG. 8. Table 4 illustrates the complementarity of the nucleotide sequences of LGN BINDING SITE, designated SEQ ID:6174, to the nucleotide sequence of GAM100 RNA, herein designated GAM RNA, also designated SEQ ID:243.

Another function of GAM100 is therefore inhibition of LGN (Accession NP_037428.2). Accordingly, utilities of GAM100 include diagnosis, prevention and treatment of diseases and clinical conditions associated with LGN.

LOC113521 (Accession NP_660283.1) is another GAM100 target gene, herein designated TARGET GENE. LOC113521 BINDING SITE is a target binding site found in the 3' untranslated region of mRNA encoded by LOC113521, corresponding to a target binding site such as BINDING SITE I, BINDING SITE II or BINDING SITE III of FIG. 8. Table 4 illustrates the complementarity of the nucleotide sequences of LOC113521 BINDING SITE, designated SEQ ID:1372, to the nucleotide sequence of GAM100 RNA, herein designated GAM RNA, also designated SEQ ID:243.

Another function of GAM100 is therefore inhibition of LOC113521 (Accession NP_660283.1). Accordingly, utilities of GAM100 include diagnosis, prevention and treatment of diseases and clinical conditions associated with LOC113521.

LOC123722 (Accession XP_058721.2) is another GAM100 target gene, herein designated TARGET GENE. LOC123722 BINDING SITE is a target binding site found in the 3' untranslated region of mRNA encoded by LOC123722, corresponding to a target binding site such as BINDING SITE I, BINDING SITE II or BINDING SITE III of FIG. 8. Table 4 illustrates the complementarity of the nucleotide sequences of LOC123722 BINDING SITE, designated SEQ ID:15605, to the nucleotide sequence of GAM100 RNA, herein designated GAM RNA, also designated SEQ ID:243.

Another function of GAM100 is therefore inhibition of LOC123722 (Accession XP_058721.2). Accordingly, utilities of GAM100 include diagnosis, prevention and treatment of diseases and clinical conditions associated with LOC123722.

LOC126536 (Accession XP_059054.1) is another GAM100 target gene, herein designated TARGET GENE. LOC126536 BINDING SITE is a target binding site found in the 3' untranslated region of mRNA encoded by LOC126536, corresponding to a target binding site such as BINDING SITE I, BINDING SITE II or BINDING SITE III of FIG. 8. Table 4 illustrates the complementarity of the nucleotide sequences of LOC126536 BINDING SITE, designated SEQ ID:13459, to the nucleotide sequence of GAM100 RNA, herein designated GAM RNA, also designated SEQ ID:243.

Another function of GAM100 is therefore inhibition of LOC126536 (Accession XP_059054.1). Accordingly, utilities of GAM100 include diagnosis, prevention and treatment of diseases and clinical conditions associated with LOC126536.

LOC126669 (Accession XP_060121.4) is another GAM100 target gene, herein designated TARGET GENE. LOC126669 BINDING SITE is a target binding site found in the 3' untranslated region of mRNA encoded by LOC126669, corresponding to a target binding site such as BINDING SITE I, BINDING SITE II or BINDING SITE III of FIG. 8. Table 4 illustrates the complementarity of the nucleotide sequences of LOC126669 BINDING SITE, designated SEQ ID:18742, to the nucleotide sequence of GAM100 RNA, herein designated GAM RNA, also designated SEQ ID:243.

Another function of GAM100 is therefore inhibition of LOC126669 (Accession XP_060121.4). Accordingly, utilities of GAM100 include diagnosis, prevention and treatment of diseases and clinical conditions associated with LOC126669.

LOC131368 (Accession NP_778226.1) is another GAM100 target gene, herein designated TARGET GENE. LOC131368 BINDING SITE is a target binding site found in the 3' untranslated region of mRNA encoded by LOC131368, corresponding to a target binding site such as BINDING SITE I, BINDING SITE II or BINDING SITE III of FIG. 8. Table 4 illustrates the complementarity of the nucleotide sequences of LOC131368 BINDING SITE, designated SEQ ID:14040, to the nucleotide sequence of GAM100 RNA, herein designated GAM RNA, also designated SEQ ID:243.

Another function of GAM100 is therefore inhibition of LOC131368 (Accession NP_778226.1). Accordingly, utilities of GAM100 include diagnosis, prevention and treatment of diseases and clinical conditions associated with LOC131368.

LOC150868 (Accession XP_087028.1) is another GAM100 target gene, herein designated TARGET GENE. LOC150868 BINDING SITE is a target binding site found in the 3' untranslated region of mRNA encoded by LOC150868, corresponding to a target binding site such as BINDING SITE I, BINDING SITE II or BINDING SITE III of FIG. 8. Table 4 illustrates the complementarity of the nucleotide sequences of LOC150868 BINDING SITE, designated SEQ ID:8784, to the nucleotide sequence of GAM100 RNA, herein designated GAM RNA, also designated SEQ ID:243.

Another function of GAM100 is therefore inhibition of LOC150868 (Accession XP_087028.1). Accordingly, utilities of GAM100 include diagnosis, prevention and treatment of diseases and clinical conditions associated with LOC150868.

LOC151512 (Accession XP_098072.2) is another GAM100 target gene, herein designated TARGET GENE. LOC151512 BINDING SITE is a target binding site found in the 3' untranslated region of mRNA encoded by LOC151512, corresponding to a target binding site such as BINDING SITE I, BINDING SITE II or BINDING SITE III of FIG. 8. Table 4 illustrates the complementarity of the nucleotide sequences of LOC151512 BINDING SITE, designated SEQ ID:453, to the nucleotide sequence of GAM100 RNA, herein designated GAM RNA, also designated SEQ ID:243.

Another function of GAM100 is therefore inhibition of LOC151512 (Accession XP_098072.2). Accordingly, utilities of GAM100 include diagnosis, prevention and treatment of diseases and clinical conditions associated with LOC151512.

LOC153139 (Accession XP_098318.1) is another GAM100 target gene, herein designated TARGET GENE. LOC153139 BINDING SITE is a target binding site found in the 5' untranslated region of mRNA encoded by LOC153139, corresponding to a target binding site such as BINDING SITE I, BINDING SITE II or BINDING SITE III of FIG. 8. Table 4 illustrates the complementarity of the nucleotide sequences of LOC153139 BINDING SITE, designated SEQ ID:7609, to the nucleotide sequence of GAM100 RNA, herein designated GAM RNA, also designated SEQ ID:243.

Another function of GAM100 is therefore inhibition of LOC153139 (Accession XP_098318.1). Accordingly, utilities of GAM100 include diagnosis, prevention and treatment of diseases and clinical conditions associated with LOC153139.

LOC154184 (Accession XP_098488.2) is another GAM100 target gene, herein designated TARGET GENE. LOC154184 BINDING SITE is a target binding site found in the 5' untranslated region of mRNA encoded by LOC154184, corresponding to a target binding site such as BINDING SITE I, BINDING SITE II or BINDING SITE III of FIG. 8. Table 4 illustrates the complementarity of the nucleotide sequences of LOC154184 BINDING SITE, designated SEQ ID:7609, to the nucleotide sequence of GAM100 RNA, herein designated GAM RNA, also designated SEQ ID:243.

Another function of GAM100 is therefore inhibition of LOC154184 (Accession XP_098488.2). Accordingly, utilities of GAM100 include diagnosis, prevention and treatment of diseases and clinical conditions associated with LOC154184.

LOC158450 (Accession XP_088580.1) is another GAM100 target gene, herein designated TARGET GENE. LOC158450 BINDING SITE is a target binding site found in the 5' untranslated region of mRNA encoded by LOC158450, corresponding to a target binding site such as BINDING SITE I, BINDING SITE II or BINDING SITE III of FIG. 8. Table 4 illustrates the complementarity of the nucleotide sequences of LOC158450 BINDING SITE, designated SEQ ID:1108, to the nucleotide sequence of GAM100 RNA, herein designated GAM RNA, also designated SEQ ID:243.

Another function of GAM100 is therefore inhibition of LOC158450 (Accession XP_088580.1). Accordingly, utilities of GAM100 include diagnosis, prevention and treatment of diseases and clinical conditions associated with LOC158450.

LOC158927 (Accession XP_099004.1) is another GAM100 target gene, herein designated TARGET GENE. LOC158927 BINDING SITE is a target binding site found in the 3' untranslated region of mRNA encoded by LOC158927, corresponding to a target binding site such as BINDING SITE I, BINDING SITE II or BINDING SITE III of FIG. 8. Table 4 illustrates the complementarity of the nucleotide sequences of LOC158927 BINDING SITE, designated SEQ ID:3321, to the nucleotide sequence of GAM100 RNA, herein designated GAM RNA, also designated SEQ ID:243.

Another function of GAM100 is therefore inhibition of LOC158927 (Accession XP_099004.1). Accordingly, utilities of GAM100 include diagnosis, prevention and treatment of diseases and clinical conditions associated with LOC158927.

LOC163404 (Accession XP_088864.3) is another GAM100 target gene, herein designated TARGET GENE. LOC163404 BINDING SITE is a target binding site found in the 3' untranslated region of mRNA encoded by LOC163404, corresponding to a target binding site such as BINDING SITE I, BINDING SITE II or BINDING SITE III of FIG. 8. Table 4 illustrates the complementarity of the nucleotide sequences of LOC163404 BINDING SITE, designated SEQ ID:6012, to the nucleotide sequence of GAM100 RNA, herein designated GAM RNA, also designated SEQ ID:243.

Another function of GAM100 is therefore inhibition of LOC163404 (Accession XP_088864.3). Accordingly, utilities of GAM100 include diagnosis, prevention and treatment of diseases and clinical conditions associated with LOC163404.

LOC196996 (Accession XP_113796.1) is another GAM100 target gene, herein designated TARGET GENE. LOC196996 BINDING SITE is a target binding site found in the 3' untranslated region of mRNA encoded by LOC196996, corresponding to a target binding site such as BINDING SITE I, BINDING SITE II or BINDING SITE III of FIG. 8. Table 4 illustrates the complementarity of the nucleotide sequences of LOC196996 BINDING SITE, designated SEQ ID:7822, to the nucleotide sequence of GAM100 RNA, herein designated GAM RNA, also designated SEQ ID:243.

Another function of GAM100 is therefore inhibition of LOC196996 (Accession XP_113796.1). Accordingly, utilities of GAM100 include diagnosis, prevention and treatment of diseases and clinical conditions associated with LOC196996.

LOC221981 (Accession XP_168344.1) is another GAM100 target gene, herein designated TARGET GENE. LOC221981 BINDING SITE is a target binding site found in the 3' untranslated region of mRNA encoded by LOC221981, corresponding to a target binding site such as BINDING SITE I, BINDING SITE II or BINDING SITE III of FIG. 8. Table 4 illustrates the complementarity of the nucleotide sequences of LOC221981 BINDING SITE, designated SEQ ID:14341, to the nucleotide sequence of GAM100 RNA, herein designated GAM RNA, also designated SEQ ID:243.

Another function of GAM100 is therefore inhibition of LOC221981 (Accession XP_168344.1). Accordingly, utilities of GAM100 include diagnosis, prevention and treatment of diseases and clinical conditions associated with LOC221981.

LOC222159 (Accession XP_168421.2) is another GAM100 target gene, herein designated TARGET GENE. LOC222159 BINDING SITE is a target binding site found in the 5' untranslated region of multiple transcripts of mRNA encoded by LOC222159, corresponding to a target binding site such as BINDING SITE I, BINDING SITE II or BINDING SITE III of FIG. 8. Table 4 illustrates the complementarity of the nucleotide sequences of LOC222159 BINDING SITE, designated SEQ ID:3184, to the nucleotide sequence of GAM100 RNA, herein designated GAM RNA, also designated SEQ ID:243.

Another function of GAM100 is therefore inhibition of LOC222159 (Accession XP_168421.2). Accordingly, utilities of GAM100 include diagnosis, prevention and treatment of diseases and clinical conditions associated with LOC222159.

LOC255045 (Accession XP_171243.2) is another GAM100 target gene, herein designated TARGET GENE. LOC255045 BINDING SITE is a target binding site found in the 3' untranslated region of mRNA encoded by LOC255045, corresponding to a target binding site such as BINDING SITE I, BINDING SITE II or BINDING SITE III of FIG. 8. Table 4 illustrates the complementarity of the nucleotide sequences of LOC255045 BINDING SITE, designated SEQ ID:15757, to the nucleotide sequence of GAM100 RNA, herein designated GAM RNA, also designated SEQ ID:243.

Another function of GAM100 is therefore inhibition of LOC255045 (Accession XP_171243.2). Accordingly, utilities of GAM100 include diagnosis, prevention and treatment of diseases and clinical conditions associated with LOC255045.

LOC283075 (Accession XP_208500.1) is another GAM100 target gene, herein designated TARGET GENE. LOC283075 BINDING SITE is a target binding site found in the 3' untranslated region of mRNA encoded by LOC283075, corresponding to a target binding site such as BINDING SITE I, BINDING SITE II or BINDING SITE III of FIG. 8. Table 4 illustrates the complementarity of the nucleotide sequences of LOC283075 BINDING SITE, designated SEQ ID:11284, to the nucleotide sequence of GAM100 RNA, herein designated GAM RNA, also designated SEQ ID:243.

Another function of GAM100 is therefore inhibition of LOC283075 (Accession XP_208500.1). Accordingly, utilities of GAM100 include diagnosis, prevention and treatment of diseases and clinical conditions associated with LOC283075.

LOC283435 (Accession XP_211035.1) is another GAM100 target gene, herein designated TARGET GENE. LOC283435 BINDING SITE is a target binding site found in the 3' untranslated region of mRNA encoded by LOC283435, corresponding to a target binding site such as BINDING SITE I, BINDING SITE II or BINDING SITE III of FIG. 8. Table 4 illustrates the complementarity of the nucleotide sequences of LOC283435 BINDING SITE, designated SEQ ID:3292, to the nucleotide sequence of GAM100 RNA, herein designated GAM RNA, also designated SEQ ID:243.

Another function of GAM100 is therefore inhibition of LOC283435 (Accession XP_211035.1). Accordingly, utilities of GAM100 include diagnosis, prevention and treatment of diseases and clinical conditions associated with LOC283435.

LOC283484 (Accession XP_211053.1) is another GAM100 target gene, herein designated TARGET GENE. LOC283484 BINDING SITE is a target binding site found in the 5' untranslated region of mRNA encoded by LOC283484, corresponding to a target binding site such as BINDING SITE I, BINDING SITE II or BINDING SITE III of FIG. 8. Table 4 illustrates the complementarity of the nucleotide sequences of LOC283484 BINDING SITE, designated SEQ ID:9750, to the nucleotide sequence of GAM100 RNA, herein designated GAM RNA, also designated SEQ ID:243.

Another function of GAM100 is therefore inhibition of LOC283484 (Accession XP_211053.1). Accordingly, utilities of GAM100 include diagnosis, prevention and treatment of diseases and clinical conditions associated with LOC283484.

LOC283665 (Accession XP_211143.1) is another GAM100 target gene, herein designated TARGET GENE. LOC283665 BINDING SITE is a target binding site found in the 3' untranslated region of mRNA encoded by LOC283665, corresponding to a target binding site such as BINDING SITE I, BINDING SITE II or BINDING SITE III of FIG. 8. Table 4 illustrates the complementarity of the nucleotide sequences of LOC283665 BINDING SITE, designated SEQ ID:12992, to the nucleotide sequence of GAM100 RNA, herein designated GAM RNA, also designated SEQ ID:243.

Another function of GAM100 is therefore inhibition of LOC283665 (Accession XP_211143.1). Accordingly, utilities of GAM100 include diagnosis, prevention and treatment of diseases and clinical conditions associated with LOC283665.

LOC283690 (Accession XP_211167.1) is another GAM100 target gene, herein designated TARGET GENE. LOC283690 BINDING SITE is a target binding site found in the 3' untranslated region of mRNA encoded by LOC283690, corresponding to a target binding site such as BINDING SITE I, BINDING SITE II or BINDING SITE III of FIG. 8. Table 4 illustrates the complementarity of the nucleotide sequences of LOC283690 BINDING SITE, designated SEQ ID:2565, to the nucleotide sequence of GAM100 RNA, herein designated GAM RNA, also designated SEQ ID:243.

Another function of GAM100 is therefore inhibition of LOC283690 (Accession XP_211167.1). Accordingly, utilities of GAM100 include diagnosis, prevention and treatment of diseases and clinical conditions associated with LOC283690.

LOC283810 (Accession XP_208853.1) is another GAM100 target gene, herein designated TARGET GENE. LOC283810 BINDING SITE is a target binding site found in the 3' untranslated region of mRNA encoded by LOC283810, corresponding to a target binding site such as BINDING SITE I, BINDING SITE II or BINDING SITE III of FIG. 8. Table 4 illustrates the complementarity of the nucleotide sequences of LOC283810 BINDING SITE, designated SEQ ID:12634, to the nucleotide sequence of GAM100 RNA, herein designated GAM RNA, also designated SEQ ID:243.

Another function of GAM100 is therefore inhibition of LOC283810 (Accession XP_208853.1). Accordingly, utilities of GAM100 include diagnosis, prevention and treatment of diseases and clinical conditions associated with LOC283810.

LOC284166 (Accession XP_209050.1) is another GAM100 target gene, herein designated TARGET GENE. LOC284166 BINDING SITE is a target binding site found in the 3' untranslated region of mRNA encoded by LOC284166, corresponding to a target binding site such as BINDING SITE I, BINDING SITE II or BINDING SITE III of FIG. 8. Table 4 illustrates the complementarity of the nucleotide sequences of LOC284166 BINDING SITE, designated SEQ ID:16685, to the nucleotide sequence of GAM100 RNA, herein designated GAM RNA, also designated SEQ ID:243.

Another function of GAM100 is therefore inhibition of LOC284166 (Accession XP_209050.1). Accordingly, utilities of GAM100 include diagnosis, prevention and treatment of diseases and clinical conditions associated with LOC284166.

LOC284304 (Accession XP_211426.1) is another GAM100 target gene, herein designated TARGET GENE. LOC284304 BINDING SITE is a target binding site found in the 5' untranslated region of mRNA encoded by LOC284304, corresponding to a target binding site such as BINDING SITE I, BINDING SITE II or BINDING SITE III of FIG. 8. Table 4 illustrates the complementarity of the nucleotide sequences of LOC284304 BINDING SITE, designated SEQ ID:5700, to the nucleotide sequence of GAM100 RNA, herein designated GAM RNA, also designated SEQ ID:243.

Another function of GAM100 is therefore inhibition of LOC284304 (Accession XP_211426.1). Accordingly, utilities of GAM100 include diagnosis, prevention and treatment of diseases and clinical conditions associated with LOC284304.

LOC284925 (Accession XP_209414.1) is another GAM100 target gene, herein designated TARGET GENE. LOC284925 BINDING SITE is a target binding site found in the 3' untranslated region of mRNA encoded by LOC284925, corresponding to a target binding site such as BINDING SITE I, BINDING SITE II or BINDING SITE III of FIG. 8. Table 4 illustrates the complementarity of the nucleotide sequences of LOC284925 BINDING SITE, designated SEQ ID:1198, to the nucleotide sequence of GAM100 RNA, herein designated GAM RNA, also designated SEQ ID:243.

Another function of GAM100 is therefore inhibition of LOC284925 (Accession XP_209414.1). Accordingly, utilities of GAM100 include diagnosis, prevention and treatment of diseases and clinical conditions associated with LOC284925.

LOC285190 (Accession XP_208296.1) is another GAM100 target gene, herein designated TARGET GENE. LOC285190 BINDING SITE is a target binding site found in the 3' untranslated region of mRNA encoded by LOC285190, corresponding to a target binding site such as BINDING SITE I, BINDING SITE II or BINDING SITE III of FIG. 8. Table 4 illustrates the complementarity of the nucleotide sequences of LOC285190 BINDING SITE, designated SEQ ID:18198, to the nucleotide sequence of GAM100 RNA, herein designated GAM RNA, also designated SEQ ID:243.

Another function of GAM100 is therefore inhibition of LOC285190 (Accession XP_208296.1). Accordingly, utilities of GAM100 include diagnosis, prevention and treatment of diseases and clinical conditions associated with LOC285190.

LOC285229 (Accession XP_211812.1) is another GAM100 target gene, herein designated TARGET GENE. LOC285229 BINDING SITE is a target binding site found in the 5' untranslated region of mRNA encoded by LOC285229, corresponding to a target binding site such as BINDING SITE I, BINDING SITE II or BINDING SITE III of FIG. 8. Table 4 illustrates the complementarity of the nucleotide sequences of LOC285229 BINDING SITE, designated SEQ ID:12704, to the nucleotide sequence of GAM100 RNA, herein designated GAM RNA, also designated SEQ ID:243.

Another function of GAM100 is therefore inhibition of LOC285229 (Accession XP_211812.1). Accordingly, utilities of GAM100 include diagnosis, prevention and treatment of diseases and clinical conditions associated with LOC285229.

LOC285726 (Accession XP_211998.1) is another GAM100 target gene, herein designated TARGET GENE. LOC285726 BINDING SITE is a target binding site found in the 3' untranslated region of mRNA encoded by LOC285726, corresponding to a target binding site such as BINDING SITE I, BINDING SITE II or BINDING SITE III of FIG. 8. Table 4 illustrates the complementarity of the nucleotide sequences of LOC285726 BINDING SITE, designated SEQ ID:3743, to the nucleotide sequence of GAM100 RNA, herein designated GAM RNA, also designated SEQ ID:243.

Another function of GAM100 is therefore inhibition of LOC285726 (Accession XP_211998.1). Accordingly, utilities of GAM100 include diagnosis, prevention and treatment of diseases and clinical conditions associated with LOC285726.

LOC285749 (Accession XP_212010.1) is another GAM100 target gene, herein designated TARGET GENE. LOC285749 BINDING SITE is a target binding site found in the 5' untranslated region of mRNA encoded by LOC285749, corresponding to a target binding site such as BINDING SITE I, BINDING SITE II or BINDING SITE III of FIG. 8. Table 4 illustrates the complementarity of the nucleotide sequences of LOC285749 BINDING SITE, designated SEQ ID:7609, to the nucleotide sequence of GAM100 RNA, herein designated GAM RNA, also designated SEQ ID:243.

Another function of GAM100 is therefore inhibition of LOC285749 (Accession XP_212010.1). Accordingly, utilities of GAM100 include diagnosis, prevention and treatment of diseases and clinical conditions associated with LOC285749.

LOC338558 (Accession XP_290465.1) is another GAM100 target gene, herein designated TARGET GENE. LOC338558 BINDING SITE is a target binding site found in the 3' untranslated region of mRNA encoded by LOC338558, corresponding to a target binding site such as BINDING SITE I, BINDING SITE II or BINDING SITE III of FIG. 8. Table 4 illustrates the complementarity of the nucleotide sequences of LOC338558 BINDING SITE, designated SEQ ID:16649, to the nucleotide sequence of GAM100 RNA, herein designated GAM RNA, also designated SEQ ID:243.

Another function of GAM100 is therefore inhibition of LOC338558 (Accession XP_290465.1). Accordingly, utilities of GAM100 include diagnosis, prevention and treatment of diseases and clinical conditions associated with LOC338558.

LOC339512 (Accession XP_290935.1) is another GAM100 target gene, herein designated TARGET GENE. LOC339512 BINDING SITE is a target binding site found in the 3' untranslated region of mRNA encoded by LOC339512, corresponding to a target binding site such as BINDING SITE I, BINDING SITE II or BINDING SITE III of FIG. 8. Table 4 illustrates the complementarity of the nucleotide sequences of LOC339512 BINDING SITE, designated SEQ ID:14625, to the nucleotide sequence of GAM100 RNA, herein designated GAM RNA, also designated SEQ ID:243.

Another function of GAM100 is therefore inhibition of LOC339512 (Accession XP_290935.1). Accordingly, utilities of GAM100 include diagnosis, prevention and treatment of diseases and clinical conditions associated with LOC339512.

LOC340138 (Accession XP_291153.1) is another GAM100 target gene, herein designated TARGET GENE. LOC340138 BINDING SITE is a target binding site found in the 3' untranslated region of mRNA encoded by LOC340138, corresponding to a target binding site such as BINDING SITE I, BINDING SITE II or BINDING SITE III of FIG. 8. Table 4 illustrates the complementarity of the nucleotide sequences of LOC340138 BINDING SITE, designated SEQ ID:15795, to the nucleotide sequence of GAM100 RNA, herein designated GAM RNA, also designated SEQ ID:243.

Another function of GAM100 is therefore inhibition of LOC340138 (Accession XP_291153.1). Accordingly, utilities of GAM100 include diagnosis, prevention and treatment of diseases and clinical conditions associated with LOC340138.

LOC340252 (Accession XP_291212.1) is another GAM100 target gene, herein designated TARGET GENE. LOC340252 BINDING SITE is a target binding site found in the 3' untranslated region of mRNA encoded by LOC340252, corresponding to a target binding site such as BINDING SITE I, BINDING SITE II or BINDING SITE III of FIG. 8. Table 4 illustrates the complementarity of the nucleotide sequences of LOC340252 BINDING SITE, designated SEQ ID:14531, to the nucleotide sequence of GAM100 RNA, herein designated GAM RNA, also designated SEQ ID:243.

Another function of GAM100 is therefore inhibition of LOC340252 (Accession XP_291212.1). Accordingly, utilities of GAM100 include diagnosis, prevention and treatment of diseases and clinical conditions associated with LOC340252.

LOC340452 (Accession XP_291294.1) is another GAM100 target gene, herein designated TARGET GENE. LOC340452 BINDING SITE is a target binding site found in the 3' untranslated region of mRNA encoded by LOC340452, corresponding to a target binding site such as BINDING SITE I, BINDING SITE II or BINDING SITE III of FIG. 8. Table 4 illustrates the complementarity of the nucleotide sequences of LOC340452 BINDING SITE, designated SEQ ID:6289, to the nucleotide sequence of GAM100 RNA, herein designated GAM RNA, also designated SEQ ID:243.

Another function of GAM100 is therefore inhibition of LOC340452 (Accession XP_291294.1). Accordingly, utilities of GAM100 include diagnosis, prevention and treatment of diseases and clinical conditions associated with LOC340452.

LOC348235 (Accession XP_300670.1) is another GAM100 target gene, herein designated TARGET GENE. LOC348235 BINDING SITE is a target binding site found in the 3' untranslated region of mRNA encoded by LOC348235, corresponding to a target binding site such as BINDING SITE I, BINDING SITE II or BINDING SITE III of FIG. 8. Table 4 illustrates the complementarity of the nucleotide sequences of LOC348235 BINDING SITE, designated SEQ ID:6032, to the nucleotide sequence of GAM100 RNA, herein designated GAM RNA, also designated SEQ ID:243.

Another function of GAM100 is therefore inhibition of LOC348235 (Accession XP_300670.1). Accordingly, utilities of GAM100 include diagnosis, prevention and treatment of diseases and clinical conditions associated with LOC348235.

LOC348290 (Accession XP_302713.1) is another GAM100 target gene, herein designated TARGET GENE. LOC348290 BINDING SITE is a target binding site found in the 5' untranslated region of mRNA encoded by LOC348290, corresponding to a target binding site such as BINDING SITE I, BINDING SITE II or BINDING SITE III of FIG. 8. Table 4 illustrates the complementarity of the nucleotide sequences of LOC348290 BINDING SITE, designated SEQ ID:6749, to the nucleotide sequence of GAM100 RNA, herein designated GAM RNA, also designated SEQ ID:243.

Another function of GAM100 is therefore inhibition of LOC348290 (Accession XP_302713.1). Accordingly, utilities of GAM100 include diagnosis, prevention and treatment of diseases and clinical conditions associated with LOC348290.

LOC348396 (Accession XP_300729.1) is another GAM100 target gene, herein designated TARGET GENE. LOC348396 BINDING SITE is a target binding site found in the 3' untranslated region of mRNA encoded by LOC348396, corresponding to a target binding site such as BINDING SITE I, BINDING SITE II or BINDING SITE III of FIG. 8. Table 4 illustrates the complementarity of the nucleotide sequences of LOC348396 BINDING SITE, designated SEQ ID:10842, to the nucleotide sequence of GAM100 RNA, herein designated GAM RNA, also designated SEQ ID:243.

Another function of GAM100 is therefore inhibition of LOC348396 (Accession XP_300729.1). Accordingly, utilities of GAM100 include diagnosis, prevention and treatment of diseases and clinical conditions associated with LOC348396.

LOC348655 (Accession XP_300391.1) is another GAM100 target gene, herein designated TARGET GENE. LOC348655 BINDING SITE is a target binding site found in the 3' untranslated region of mRNA encoded by LOC348655, corresponding to a target binding site such as BINDING SITE I, BINDING SITE II or BINDING SITE III of FIG. 8. Table 4 illustrates the complementarity of the nucleotide sequences of LOC348655 BINDING SITE, designated SEQ ID:3869, to the nucleotide sequence of GAM100 RNA, herein designated GAM RNA, also designated SEQ ID:243.

Another function of GAM100 is therefore inhibition of LOC348655 (Accession XP_300391.1). Accordingly, utilities of GAM100 include diagnosis, prevention and treatment of diseases and clinical conditions associated with LOC348655.

LOC348705 (Accession XP_300396.1) is another GAM100 target gene, herein designated TARGET GENE. LOC348705 BINDING SITE is a target binding site found in the 3' untranslated region of mRNA encoded by LOC348705, corresponding to a target binding site such as BINDING SITE I, BINDING SITE II or BINDING SITE III of FIG. 8. Table 4 illustrates the complementarity of the nucleotide sequences of LOC348705 BINDING SITE, designated SEQ ID:13038, to the nucleotide sequence of GAM100 RNA, herein designated GAM RNA, also designated SEQ ID:243.

Another function of GAM100 is therefore inhibition of LOC348705 (Accession XP_300396.1). Accordingly, utilities of GAM100 include diagnosis, prevention and treatment of diseases and clinical conditions associated with LOC348705.

LOC348749 (Accession XP_302880.1) is another GAM100 target gene, herein designated TARGET GENE. LOC348749 BINDING SITE is a target binding site found in the 3' untranslated region of mRNA encoded by LOC348749, corresponding to a target binding site such as BINDING SITE I, BINDING SITE II or BINDING SITE III of FIG. 8. Table 4 illustrates the complementarity of the nucleotide sequences of LOC348749 BINDING SITE, designated SEQ ID:10545, to the nucleotide sequence of GAM100 RNA, herein designated GAM RNA, also designated SEQ ID:243.

Another function of GAM100 is therefore inhibition of LOC348749 (Accession XP_302880.1). Accordingly, utilities of GAM100 include diagnosis, prevention and treatment of diseases and clinical conditions associated with LOC348749.

LOC51336 (Accession NP_057730.1) is another GAM100 target gene, herein designated TARGET GENE. LOC51336 BINDING SITE is a target binding site found in the 5' untranslated region of mRNA encoded by LOC51336, corresponding to a target binding site such as BINDING SITE I, BINDING SITE II or BINDING SITE III of FIG. 8. Table 4 illustrates the complementarity of the nucleotide sequences of LOC51336 BINDING SITE, designated SEQ ID:16981, to the nucleotide sequence of GAM100 RNA, herein designated GAM RNA, also designated SEQ ID:243.

Another function of GAM100 is therefore inhibition of LOC51336 (Accession NP_057730.1). Accordingly, utilities of GAM100 include diagnosis, prevention and treatment of diseases and clinical conditions associated with LOC51336.

LOC57086 (Accession NP_065084.1) is another GAM100 target gene, herein designated TARGET GENE. LOC57086 BINDING SITE is a target binding site found in the 3' untranslated region of mRNA encoded by LOC57086, corresponding to a target binding site such as BINDING SITE I, BINDING SITE II or BINDING SITE III of FIG. 8. Table 4 illustrates the complementarity of the nucleotide sequences of LOC57086 BINDING SITE, designated SEQ ID:15672, to the nucleotide sequence of GAM100 RNA, herein designated GAM RNA, also designated SEQ ID:243.

Another function of GAM100 is therefore inhibition of LOC57086 (Accession NP_065084.1). Accordingly, utilities of GAM100 include diagnosis, prevention and treatment of diseases and clinical conditions associated with LOC57086.

LOC92606 (Accession XP_046097.1) is another GAM100 target gene, herein designated TARGET GENE. LOC92606 BINDING SITE is a target binding site found in the 3' untranslated region of mRNA encoded by LOC92606, corresponding to a target binding site such as BINDING SITE I, BINDING SITE II or BINDING SITE III of FIG. 8. Table 4 illustrates the complementarity of the nucleotide sequences of LOC92606 BINDING SITE, designated SEQ ID:20066, to the nucleotide sequence of GAM100 RNA, herein designated GAM RNA, also designated SEQ ID:243.

Another function of GAM100 is therefore inhibition of LOC92606 (Accession XP_046097.1). Accordingly, utilities of GAM100 include diagnosis, prevention and treatment of diseases and clinical conditions associated with LOC92606.

Lecithin retinol acyltransferase (phosphatidylcholine-retinol o-acyltransferase) (LRAT, Accession NP_004735.1) is another GAM100 target gene, herein designated TARGET GENE. LRAT BINDING SITE is a target binding site found in the 3' untranslated region of mRNA encoded by LRAT, corresponding to a target binding site such as BINDING SITE I, BINDING SITE II or BINDING SITE III of FIG. 8. Table 4 illustrates the complementarity of the nucleotide sequences of LRAT BINDING SITE, designated SEQ ID:7406, to the nucleotide sequence of GAM100 RNA, herein designated GAM RNA, also designated SEQ ID:243.

Another function of GAM100 is therefore inhibition of Lecithin retinol acyltransferase (phosphatidylcholine-retinol o-acyltransferase) (LRAT, Accession NP_004735.1). Accordingly, utilities of GAM100 include diagnosis, prevention and treatment of diseases and clinical conditions associated with LRAT.

Mad, mothers against decapentaplegic homolog 4 (drosophila) (MADH4, Accession NP_005350.1) is another GAM100 target gene, herein designated TARGET GENE. MADH4 BINDING SITE is a target binding site found in the 3' untranslated region of mRNA encoded by MADH4, corresponding to a target binding site such as BINDING SITE I, BINDING SITE II or BINDING SITE III of FIG. 8. Table 4 illustrates the complementarity of the nucleotide sequences of MADH4 BINDING SITE, designated SEQ ID:7427, to the nucleotide sequence of GAM100 RNA, herein designated GAM RNA, also designated SEQ ID:243.

Another function of GAM100 is therefore inhibition of Mad, mothers against decapentaplegic homolog 4 (drosophila) (MADH4, Accession NP_005350.1), a gene which common mediator of signal transduction by tgf-beta (transforming growth factor) superfamily; smad4 is the common smad (co-smad). promotes binding of the smad2/smad4/ fast-1 complex to dna and provides an activation function required for smad1 or smad2 to stimulate transcription. may act as a tumor suppressor. and therefore is associated with Pancreatic carcinoma. Accordingly, utilities of GAM100 include diagnosis, prevention and treatment of Pancreatic carcinoma, and of other diseases and clinical conditions associated with MADH4.

The function of MADH4 has been established by previous studies. About 90% of human pancreatic carcinomas show allelic loss at 18q. Hahn et al. (1996) reported the identification of a putative tumor suppressor gene on chromosome 18q21.1 that may be a candidate for pancreatic carcinoma. The gene was homozygously deleted in 25 of 84 tumors and mutations were identified as somatic mutations in 6 of 27 carcinomas that lacked deletions. The gene was localized by deletion analysis of xenograft DNA. Markers absent in these samples were used to screen the CEPH mega-YAC library. YACs spanning the minimal deletion region were subcloned as cosmids for sequencing and recovery of cDNAs. A 2,680-bp cDNA was found and shown to code for a predicted 552-amino acid protein. The predicted protein shares blocks of as much as 85% similarity to the Drosophila Mad protein and the Caenorhabditis elegans sma-2,-3 and -4 proteins. In Drosophila, homozygous Mad mutants exhibit a variety of developmental defects. The authors showed that the human gene contains 11 exons. Hahn et al. (1996) designated the gene DPC4 (for homozygously deleted in pancreatic carcinoma, locus 4). This region of chromosome 18q also contains a gene (DCC; 120470) found to be deleted in colorectal cancers.

Animal model experiments lend further support to the function of MADH4. Takaku et al. (1998) inactivated the mouse Dpc4 (Smad4) homolog. The homozygous mutants were embryonic lethal, whereas the heterozygotes showed no abnormality. The investigators then introduced the Dpc4 mutation into the knockout mice for the mouse homolog of the human APC (OMIM Ref. No. 175100) gene, Apc-delta716, a model for human familial adenomatous polyposis. Because both Apc and Dpc4 are located on mouse chromosome 18, they constructed compound heterozygotes carrying both mutations on the same chromosome by meiotic recombination. In such mice, intestinal polyps developed into more malignant tumors than those in the simple Apc-delta716 heterozygotes, showing an extensive stromal cell proliferation, submucosal invasion, cell type heterogeneity, and in vivo transplantability. Takaku et al. (1998) suggested that mutations in DPC4 play a significant role in the malignant progression of colorectal tumors. Sirard et al. (1998) demonstrated that homozygous Smad4 mutant mice died before embryonic day 7.5. Mutant embryos have reduced size, fail to gastrulate or express a mesodermal marker, and show abnormal visceral endoderm development. Growth retardation of the Smad4-deficient embryos results from reduced cell proliferation rather than increased apoptosis. Aggregation of mutant Smad4 embryonic stem cells with wildtype tetraploid morulae rescued the gastrulation defect. The results of Sirard et al. (1998) indicated that Smad4 is initially required for the differentiation of the visceral endoderm and that the gastrulation defect in the epiblast is secondary and noncell autonomous. Rescued embryos showed severe anterior truncations, indicating a second important role for Smad4 in anterior patterning during embryogenesis It is appreciated that the abovementioned animal model for MADH4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sirard, C.; de la Pompa, J. L.; Elia, A.; Itie, A.; Mirtsos, C.; Cheung, A.; Hahn, S.; Wakeham, A.; Schwartz, L.; Kern, S. E.; Rossant, J.; Mak, T. W.: The tumor suppressor gene Smad4/Dpc4 is required for gastrulation and later for anterior development of the mouse embryo. Genes Dev. 12:107-119, 1998; and Hahn, S. A.; Schutte, M.; Hoque, T. M. S.; Moskaluk, C. A.; da Costa, L. T.; Rozenblum, E.; Weinstein, C. L.; Fischer, A.; Yeo, C. J.; Hruban, R. H.; Kern, S. E. : DPC4, a candidate tumor s.

Further studies establishing the function and utilities of MADH4 are found in John Hopkins OMIM database record ID 600993, and in cited publications listed in Table 5, which are hereby incorporated by reference. Microtubule-associated protein 2 (MAP2, Accession NP_002365.2) is another GAM100 target gene, herein designated TARGET GENE. MAP2 BINDING SITE is a target binding site found in the 5' untranslated region of multiple transcripts of mRNA encoded by MAP2, corresponding to a target binding site such as BINDING SITE I, BINDING SITE II or BINDING SITE III of FIG. 8. Table 4 illustrates the complementarity of the nucleotide sequences of MAP2 BINDING SITE, designated SEQ ID:3835, to the nucleotide sequence of GAM100 RNA, herein designated GAM RNA, also designated SEQ ID:243.

Another function of GAM100 is therefore inhibition of Microtubule-associated protein 2 (MAP2, Accession NP_002365.2), a gene which may act in stabilizing microtubules against depolymerization.also seems to have a stiffening effect on microtubules. Accordingly, utilities of GAM100 include diagnosis, prevention and treatment of diseases and clinical conditions associated with MAP2.

The function of MAP2 has been established by previous studies. For nerve cells to develop their highly polarized form, appropriate structural molecules must be targeted to either axons or dendrites. This could be achieved by the synthesis of structural proteins in the cell body and their sorting to either axons or dendrites by specific transport mechanisms. For dendrites, an alternative possibility is that proteins could be synthesized locally in the dendritic cytoplasm. This would allow regulation of the production of structural molecules in response to local demand during dendritic development. The existence of dendritic polyribosomes and the demonstration that newly synthesized RNA is transported into the dendrites of neurons differentiating in culture support the feasibility of dendritic protein synthesis. By in situ hybridization with specific cDNA probes, Garner et al. (1988) showed that mRNA for the dendrite- specific microtubule-associated protein MAP2 was present in dendrites in the developing brain. By contrast, the mRNA for tubulin (OMIM Ref. No. 191120), a protein present in both axons and dendrites, was localized exclusively in neuronal cell bodies Animal model experiments lend further support to the function of MAP2. Marsden et al. (1996) produced transgenic mice that overexpress embryonic Map2 (referred to by them as MAP2c) without inducing detectable effects on the morphology of neurons. The transgenic MAP2c was present in dendrites but not in axons but transgenic MAP2c messenger RNA was limited to cell bodies. The authors concluded that dendritic localization of transgenic MAP2c protein was not the result of previous transport of its mRNA but implies the existence of a protein-based mechanism capable of sorting MAP2 protein isoforms It is appreciated that the abovementioned animal model for MAP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Garner, C. C.; Tucker, R. P.; Matus, A.: Selective localization of messenger RNA for cytoskeletal protein MAP2 in dendrites. Nature 336:674-677, 1988; and Marsden, K. M.; Doll, T.; Ferralli, J.; Botteri, F.; Matus, A.: Transgenic expression of embryonic MAP2 in adult mouse brain: implications for neuronal polarization. J. Neurosci. 16:3265.

Further studies establishing the function and utilities of MAP2 are found in John Hopkins OMIM database record ID 157130, and in cited publications listed in Table 5, which are hereby incorporated by reference. Microtubule-associated protein 2 (MAP2, Accession NP_114035.1) is another GAM100 target gene, herein designated TARGET GENE. MAP2 BINDING SITE is a target binding site found in the 5' untranslated region of multiple transcripts of mRNA encoded by MAP2, corresponding to a target binding site such as BINDING SITE I, BINDING SITE II or BINDING SITE III of FIG. 8. Table 4 illustrates the complementarity of the nucleotide sequences of MAP2 BINDING SITE, designated SEQ ID:3835, to the nucleotide sequence of GAM100 RNA, herein designated GAM RNA, also designated SEQ ID:243.

Another function of GAM100 is therefore inhibition of Microtubule-associated protein 2 (MAP2, Accession NP_114035.1), a gene which may act in stabilizing microtubules against depolymerization.also seems to have a stiffening effect on microtubules. Accordingly, utilities of GAM100 include diagnosis, prevention and treatment of diseases and clinical conditions associated with MAP2.

The function of MAP2 has been established by previous studies. For nerve cells to develop their highly polarized form, appropriate structural molecules must be targeted to either axons or dendrites. This could be achieved by the synthesis of structural proteins in the cell body and their sorting to either axons or dendrites by specific transport mechanisms. For dendrites, an alternative possibility is that proteins could be synthesized locally in the dendritic cytoplasm. This would allow regulation of the production of structural molecules in response to local demand during dendritic development. The existence of dendritic polyribosomes and the demonstration that newly synthesized RNA is transported into the dendrites of neurons differentiating in culture support the feasibility of dendritic protein synthesis. By in situ hybridization with specific cDNA probes, Garner et al. (1988) showed that mRNA for the dendrite- specific microtubule-associated protein MAP2 was present in dendrites in the developing brain. By contrast, the mRNA for tubulin (OMIM Ref. No. 191120), a protein present in both axons and dendrites, was localized exclusively in neuronal cell bodies Animal model experiments lend further support to the function of MAP2. Marsden et al. (1996) produced transgenic mice that overexpress embryonic Map2 (referred to by them as MAP2c) without inducing detectable effects on the morphology of neurons. The transgenic MAP2c was present in dendrites but not in axons but transgenic MAP2c messenger RNA was limited to cell bodies. The authors concluded that dendritic localization of transgenic MAP2c protein was not the result of previous transport of its mRNA but implies the existence of a protein-based mechanism capable of sorting MAP2 protein isoforms It is appreciated that the abovementioned animal model for MAP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Garner, C. C.; Tucker, R. P.; Matus, A.: Selective localization of messenger RNA for cytoskeletal protein MAP2 in dendrites. Nature 336:674-677, 1988; and Marsden, K. M.; Doll, T.; Ferralli, J.; Botteri, F.; Matus, A.: Transgenic expression of embryonic MAP2 in adult mouse brain: implications for neuronal polarization. J. Neurosci. 16:3265.

Further studies establishing the function and utilities of MAP2 are found in John Hopkins OMIM database record ID 157130, and in cited publications listed in Table 5, which are hereby incorporated by reference. Microtubule-associated protein 2 (MAP2, Accession NP_114033.1) is another GAM100 target gene, herein designated TARGET GENE. MAP2 BINDING SITE is a target binding site found in the 5' untranslated region of multiple transcripts of mRNA encoded by MAP2, corresponding to a target binding site such as BINDING SITE I, BINDING SITE II or BINDING SITE III of FIG. 8. Table 4 illustrates the complementarity of the nucleotide sequences of MAP2 BINDING SITE, designated SEQ ID:3835, to the nucleotide sequence of GAM100 RNA, herein designated GAM RNA, also designated SEQ ID:243.

Another function of GAM100 is therefore inhibition of Microtubule-associated protein 2 (MAP2, Accession NP_114033.1), a gene which may act in stabilizing microtubules against depolymerization.also seems to have a stiffening effect on microtubules. Accordingly, utilities of GAM100 include diagnosis, prevention and treatment of diseases and clinical conditions associated with MAP2.

The function of MAP2 has been established by previous studies. For nerve cells to develop their highly polarized form, appropriate structural molecules must be targeted to either axons or dendrites. This could be achieved by the synthesis of structural proteins in the cell body and their sorting to either axons or dendrites by specific transport mechanisms. For dendrites, an alternative possibility is that proteins could be synthesized locally in the dendritic cytoplasm. This would allow regulation of the production of structural molecules in response to local demand during dendritic development. The existence of dendritic polyribosomes and the demonstration that newly synthesized RNA is transported into the dendrites of neurons differentiating in culture support the feasibility of dendritic protein synthesis. By in situ hybridization with specific cDNA probes, Garner et al. (1988) showed that mRNA for the dendrite- specific microtubule-associated protein MAP2 was present in dendrites in the developing brain. By contrast, the mRNA for tubulin (OMIM Ref. No. 191120), a protein present in both axons and dendrites, was localized exclusively in neuronal cell bodies Animal model experiments lend further support to the function of MAP2. Marsden et al. (1996) produced transgenic mice that overexpress embryonic Map2 (referred to by them as MAP2c) without inducing detectable effects on the morphology of neurons. The transgenic MAP2c was present in dendrites but not in axons but transgenic MAP2c messenger RNA was limited to cell bodies. The authors concluded that dendritic localization of transgenic MAP2c protein was not the result of previous transport of its mRNA but implies the existence of a protein-based mechanism capable of sorting MAP2 protein isoforms It is appreciated that the abovementioned animal model for MAP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Garner, C. C.; Tucker, R. P.; Matus, A.: Selective localization of messenger RNA for cytoskeletal protein MAP2 in dendrites. Nature 336:674-677, 1988; and Marsden, K. M.; Doll, T.; Ferralli, J.; Botteri, F.; Matus, A.: Transgenic expression of embryonic MAP2 in adult mouse brain: implications for neuronal polarization. J. Neurosci. 16:3265.

Further studies establishing the function and utilities of MAP2 are found in John Hopkins OMIM database record ID 157130, and in cited publications listed in Table 5, which are hereby incorporated by reference. Microtubule-associated protein 2 (MAP2, Accession NP_114034.1) is another GAM100 target gene, herein designated TARGET GENE. MAP2 BINDING SITE is a target binding site found in the 5' untranslated region of multiple transcripts of mRNA encoded by MAP2, corresponding to a target binding site such as BINDING SITE I, BINDING SITE II or BINDING SITE III of FIG. 8. Table 4 illustrates the complementarity of the nucleotide sequences of MAP2 BINDING SITE, designated SEQ ID:3835, to the nucleotide sequence of GAM100 RNA, herein designated GAM RNA, also designated SEQ ID:243.

Another function of GAM100 is therefore inhibition of Microtubule-associated protein 2 (MAP2, Accession NP_114034.1), a gene which may act in stabilizing microtubules against depolymerization.also seems to have a stiffening effect on microtubules. Accordingly, utilities of GAM100 include diagnosis, prevention and treatment of diseases and clinical conditions associated with MAP2.

The function of MAP2 has been established by previous studies. For nerve cells to develop their highly polarized form, appropriate structural molecules must be targeted to either axons or dendrites. This could be achieved by the synthesis of structural proteins in the cell body and their sorting to either axons or dendrites by specific transport mechanisms. For dendrites, an alternative possibility is that proteins could be synthesized locally in the dendritic cytoplasm. This would allow regulation of the production of structural molecules in response to local demand during dendritic development. The existence of dendritic polyribosomes and the demonstration that newly synthesized RNA is transported into the dendrites of neurons differentiating in culture support the feasibility of dendritic protein synthesis. By in situ hybridization with specific cDNA probes, Garner et al. (1988) showed that mRNA for the dendrite- specific microtubule-associated protein MAP2 was present in dendrites in the developing brain. By contrast, the mRNA for tubulin (OMIM Ref. No. 191120), a protein present in both axons and dendrites, was localized exclusively in neuronal cell bodies Animal model experiments lend further support to the function of MAP2. Marsden et al. (1996) produced transgenic mice that overexpress embryonic Map2 (referred to by them as MAP2c) without inducing detectable effects on the morphology of neurons. The transgenic MAP2c was present in dendrites but not in axons but transgenic MAP2c messenger RNA was limited to cell bodies. The authors concluded that dendritic localization of transgenic MAP2c protein was not the result of previous transport of its mRNA but implies the existence of a protein-based mechanism capable of sorting MAP2 protein isoforms It is appreciated that the abovementioned animal model for MAP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Garner, C. C.; Tucker, R. P.; Matus, A.: Selective localization of messenger RNA for cytoskeletal protein MAP2 in dendrites. Nature 336:674-677, 1988; and Marsden, K. M.; Doll, T.; Ferralli, J.; Botteri, F.; Matus, A.: Transgenic expression of embryonic MAP2 in adult mouse brain: implications for neuronal polarization. J. Neurosci. 16:3265.

Further studies establishing the function and utilities of MAP2 are found in John Hopkins OMIM database record ID 157130, and in cited publications listed in Table 5, which are hereby incorporated by reference. Methylcrotonoyl-coenzyme a carboxylase 1 (alpha) (MCCC1, Accession NP_064551.2) is another GAM100 target gene, herein designated TARGET GENE. MCCC1 BINDING SITE is a target binding site found in the 3' untranslated region of mRNA encoded by MCCC1, corresponding to a target binding site such as BINDING SITE I, BINDING SITE II or BINDING SITE III of FIG. 8. Table 4 illustrates the complementarity of the nucleotide sequences of MCCC1 BINDING SITE, designated SEQ ID:16428, to the nucleotide sequence of GAM100 RNA, herein designated GAM RNA, also designated SEQ ID:243.

Another function of GAM100 is therefore inhibition of Methylcrotonoyl-coenzyme a carboxylase 1 (alpha) (MCCC1, Accession NP_064551.2). Accordingly, utilities of GAM100 include diagnosis, prevention and treatment of diseases and clinical conditions associated with MCCC1.

MDS024 (Accession NP_068592.1) is another GAM100 target gene, herein designated TARGET GENE. MDS024 BINDING SITE1 and MDS024 BINDING SITE2 are target binding sites found in untranslated regions of mRNA encoded by MDS024, corresponding to target binding sites such as BINDING SITE I, BINDING SITE II or BINDING SITE III of FIG. 8. Table 4 illustrates the complementarity of the nucleotide sequences of MDS024 BINDING SITE1 and MDS024 BINDING SITE2, designated SEQ ID:10207 and SEQ ID:7227 respectively, to the nucleotide sequence of GAM100 RNA, herein designated GAM RNA, also designated SEQ ID:243.

Another function of GAM100 is therefore inhibition of MDS024 (Accession NP_068592.1). Accordingly, utilities of GAM100 include diagnosis, prevention and treatment of diseases and clinical conditions associated with MDS024.

MGC34079 (Accession NP_689688.1) is another GAM100 target gene, herein designated TARGET GENE. MGC34079 BINDING SITE is a target binding site found in the 3' untranslated region of mRNA encoded by MGC34079, corresponding to a target binding site such as BINDING SITE I, BINDING SITE II or BINDING SITE III of FIG. 8. Table 4 illustrates the complementarity of the nucleotide sequences of MGC34079 BINDING SITE, designated SEQ ID:13369, to the nucleotide sequence of GAM100 RNA, herein designated GAM RNA, also designated SEQ ID:243.

Another function of GAM100 is therefore inhibition of MGC34079 (Accession NP_689688.1). Accordingly, utilities of GAM100 include diagnosis, prevention and treatment of diseases and clinical conditions associated with MGC34079.

MGC48998 (Accession NP_848645.1) is another GAM100 target gene, herein designated TARGET GENE. MGC48998 BINDING SITE is a target binding site found in the 3' untranslated region of mRNA encoded by MGC48998, corresponding to a target binding site such as BINDING SITE I, BINDING SITE II or BINDING SITE III of FIG. 8. Table 4 illustrates the complementarity of the nucleotide sequences of MGC48998 BINDING SITE, designated SEQ ID:14625, to the nucleotide sequence of GAM100 RNA, herein designated GAM RNA, also designated SEQ ID:243.

Another function of GAM100 is therefore inhibition of MGC48998 (Accession NP_848645.1). Accordingly, utilities of GAM100 include diagnosis, prevention and treatment of diseases and clinical conditions associated with MGC48998.

Neuronal pentraxin i (NPTX1, Accession NP_002513.1) is another GAM100 target gene, herein designated TARGET GENE. NPTX1 BINDING SITE is a target binding site found in the 3' untranslated region of mRNA encoded by NPTX1, corresponding to a target binding site such as BINDING SITE I, BINDING SITE II or BINDING SITE III of FIG. 8. Table 4 illustrates the complementarity of the nucleotide sequences of NPTX1 BINDING SITE, designated SEQ ID:9030, to the nucleotide sequence of GAM100 RNA, herein designated GAM RNA, also designated SEQ ID:243.

Another function of GAM100 is therefore inhibition of Neuronal pentraxin i (NPTX1, Accession NP_002513.1), a gene which may be involved in synaptic uptake of extracellular material and is very strongly similar to rat NP1. Accordingly, utilities of GAM100 include diagnosis, prevention and treatment of diseases and clinical conditions associated with NPTX1.

The function of NPTX1 and its association with various diseases and clinical conditions, has been established by previous studies, as described hereinabove with reference to GAM48.2. Nucleoporin 214 kda (NUP214, Accession NP_005076.2) is another GAM100 target gene, herein designated TARGET GENE. NUP214 BINDING SITE is a target binding site found in the 3' untranslated region of multiple transcripts of mRNA encoded by NUP214, corresponding to a target binding site such as BINDING SITE I, BINDING SITE II or BINDING SITE III of FIG. 8. Table 4 illustrates the complementarity of the nucleotide sequences of NUP214 BINDING SITE, designated SEQ ID:18578, to the nucleotide sequence of GAM100 RNA, herein designated GAM RNA, also designated SEQ ID:243.

Another function of GAM100 is therefore inhibition of Nucleoporin 214 kda (NUP214, Accession NP_005076.2), a gene which mediates nucleocytoplasmic transport. Accordingly, utilities of GAM100 include diagnosis, prevention and treatment of diseases and clinical conditions associated with NUP214.

The function of NUP214 has been established by previous studies. The CAN gene on human 9q34 forms a fusion gene with the DEK (OMIM Ref. No. 125264) gene at 6p23 in a subset of acute myeloid leukemia (acute nonlymphocytic leukemia) carrying a t(6;9)(p23;q34) translocation. Von Lindern et al. (1990) estimated that the CAN gene lies 360 kb distal to ABL (OMIM Ref. No. 189980). The breakpoints in the translocations were clustered in an 8-kb intron of a gene encoding a 7.5-kb transcript. The gene was called Cain (symbol, CAN), presumably for 'cancer intron on nine.' The gene measured more than 65 kb and was transcribed 5-prime centromeric- to -3-prime telomeric on the chromosome. It is the 3-prime portion of the CAN gene that participates in the fusion gene in the leukemogenic translocation t(6;9).

Animal model experiments lend further support to the function of NUP214. Van Deursen et al. (1996) created Can-/- knockout mice by targeted disruption and embryonic stem (ES) cell technology. No Can-/- knockout mice were identified in heterozygous crosses, demonstrating that Can is essential for embryonic development. Lethality occurs between 4.0-4.5 days postcoitum, after the depletion of maternal Can sources. Homozygous Can-/-ES cells are not viable. In 3.5-day-old mutant embryos, cultured in vitro, progressive depletion of Can leads to cell cycle arrest in G2 phase, and eventually to blastocele collapse, impaired NLS-mediated protein uptake, and nuclear accumulation of polyadenylated RNA. The defective Can-depleted embryos did not display any gross morphologic abnormalities of the nuclear envelope or nuclear pore complex (NPC). The results suggested to the authors that Can is critical to cell cycle progression and required for both nuclear protein import and mRNA export.

It is appreciated that the abovementioned animal model for NUP214 is acknowledged by those skilled in the art as a scientifically valid animal model, as can be further appreciated from the publications sited hereinbelow.

Full details of the abovementioned studies are described in the following publications, the disclosure of which are hereby incorporated by reference:

van Deursen, J.; Boer, J.; Kasper, L.; Grosveld, G.: G(2) arrest and impaired nucleocytoplasmic transport in mouse embryos lacking the proto - oncogene CAN/Nup214. EMBO J. 15:5574-5583, 1996; and von Lindern, M.; Poustka, A.; Lehrach, H.; Grosveld, G.: The (6;9) chromosome translocation, associated with a specific subtype of acute nonlymphocytic leukemia, leads to aberrant tra.

Further studies establishing the function and utilities of NUP214 are found in John Hopkins OMIM database record ID 114350, and in cited publications listed in Table 5, which are hereby incorporated by reference. Nucleoporin 214 kda (NUP214, Accession NP_705906.1) is another GAM100 target gene, herein designated TARGET GENE. NUP214 BINDING SITE is a target binding site found in the 3' untranslated region of multiple transcripts of mRNA encoded by NUP214, corresponding to a target binding site such as BINDING SITE I, BINDING SITE II or BINDING SITE III of FIG. 8. Table 4 illustrates the complementarity of the nucleotide sequences of NUP214 BINDING SITE, designated SEQ ID:18578, to the nucleotide sequence of GAM100 RNA, herein designated GAM RNA, also designated SEQ ID:243.

Another function of GAM100 is therefore inhibition of Nucleoporin 214 kda (NUP214, Accession NP_705906.1), a gene which mediates nucleocytoplasmic transport. Accordingly, utilities of GAM100 include diagnosis, prevention and treatment of diseases and clinical conditions associated with NUP214.

The function of NUP214 has been established by previous studies. The CAN gene on human 9q34 forms a fusion gene with the DEK (OMIM Ref. No. 125264) gene at 6p23 in a subset of acute myeloid leukemia (acute nonlymphocytic leukemia) carrying a t(6;9)(p23;q34) translocation. Von Lindern et al. (1990) estimated that the CAN gene lies 360 kb distal to ABL (OMIM Ref. No. 189980). The breakpoints in the translocations were clustered in an 8-kb intron of a gene encoding a 7.5-kb transcript. The gene was called Cain (symbol, CAN), presumably for 'cancer intron on nine.' The gene measured more than 65 kb and was transcribed 5-prime centromeric- to -3-prime telomeric on the chromosome. It is the 3-prime portion of the CAN gene that participates in the fusion gene in the leukemogenic translocation t(6;9).

Animal model experiments lend further support to the function of NUP214. Van Deursen et al. (1996) created Can-/- knockout mice by targeted disruption and embryonic stem (ES) cell technology. No Can-/- knockout mice were identified in heterozygous crosses, demonstrating that Can is essential for embryonic development. Lethality occurs between 4.0-4.5 days postcoitum, after the depletion of maternal Can sources. Homozygous Can-/-ES cells are not viable. In 3.5-day-old mutant embryos, cultured in vitro, progressive depletion of Can leads to cell cycle arrest in G2 phase, and eventually to blastocele collapse, impaired NLS- mediated protein uptake, and nuclear accumulation of polyadenylated RNA. The defective Can-depleted embryos did not display any gross morphologic abnormalities of the nuclear envelope or nuclear pore complex (NPC). The results suggested to the authors that Can is critical to cell cycle progression and required for both nuclear protein import and mRNA export.

It is appreciated that the abovementioned animal model for NUP214 is acknowledged by those skilled in the art as a scientifically valid animal model, as can be further appreciated from the publications sited hereinbelow.

Full details of the abovementioned studies are described in the following publications, the disclosure of which are hereby incorporated by reference:

van Deursen, J.; Boer, J.; Kasper, L.; Grosveld, G.: G(2) arrest and impaired nucleocytoplasmic transport in mouse embryos lacking the proto - oncogene CAN/Nup214. EMBO J. 15:5574-5583, 1996; and von Lindern, M.; Poustka, A.; Lehrach, H.; Grosveld, G.: The (6;9) chromosome translocation, associated with a specific subtype of acute nonlymphocytic leukemia, leads to aberrant tra.

Further studies establishing the function and utilities of NUP214 are found in John Hopkins OMIM database record ID 114350, and in cited publications listed in Table 5, which are hereby incorporated by reference. Nuclear transport factor 2-like export factor 2 (NXT2, Accession NP_061168.2) is another GAM100 target gene, herein designated TARGET GENE. NXT2 BINDING SITE is a target binding site found in the 3' untranslated region of mRNA encoded by NXT2, corresponding to a target binding site such as BINDING SITE I, BINDING SITE II or BINDING SITE III of FIG. 8. Table 4 illustrates the complementarity of the nucleotide sequences of NXT2 BINDING SITE, designated SEQ ID:14988, to the nucleotide sequence of GAM100 RNA, herein designated GAM RNA, also designated SEQ ID:243.

Another function of GAM100 is therefore inhibition of Nuclear transport factor 2-like export factor 2 (NXT2, Accession NP_061168.2). Accordingly, utilities of GAM100 include diagnosis, prevention and treatment of diseases and clinical conditions associated with NXT2.

O-linked n-acetylglucosamine (glcnac) transferase (udp-n-acetylglucosamine:polypeptide-n-acetylglucosaminyl transferase) (OGT, Accession NP_003596.1) is another GAM100 target gene, herein designated TARGET GENE. OGT BINDING SITE is a target binding site found in the 5' untranslated region of mRNA encoded by OGT, corresponding to a target binding site such as BINDING SITE I, BINDING SITE II or BINDING SITE III of FIG. 8. Table 4 illustrates the complementarity of the nucleotide sequences of OGT BINDING SITE, designated SEQ ID:19937, to the nucleotide sequence of GAM100 RNA, herein designated GAM RNA, also designated SEQ ID:243.

Another function of GAM100 is therefore inhibition of O-linked n-acetylglucosamine (glcnac) transferase (udp-n-acetylglucosamine:polypeptide-n-acetylglucosaminyl transferase) (OGT, Accession NP_003596.1), a gene which has a role in the glycosylation of nuclear and cytoplasmic proteins. Accordingly, utilities of GAM100 include diagnosis, prevention and treatment of diseases and clinical conditions associated with OGT.

The function of OGT has been established by previous studies. O-linked N- acetylglucosamine (O-GlcNAc) transferase (OGT) catalyzes the addition of a single N- acetylglucosamine in O-glycosidic linkage to serine or threonine residues. Since both phosphorylation and glycosylation compete for similar serine or threonine residues, the 2 processes may compete for sites, or they may alter the substrate specificity of nearby sites by steric or electrostatic effects (Lubas et al., 1997). Haltiwanger et al. (1992) purified rat liver OGT and determined that it has a molecular mass of 340 kD. They proposed that OGT exists as a heterotrimeric complex with 2 subunits of 110 kD and 1 of 78 kD. However, using rabbit OGT, Lubas et al. (1997) analyzed the proteolytic fingerprint of both polypeptides and found that the 2 are related. They suggested that the 78 kD band is a proteolytic product of the 110 kD polypeptide or the product of an alternative translation start site. Kreppel et al. (1997) cloned rat cDNAs encoding the 110-kD subunit. Immunofluorescence of human cells expressing rat OGT indicated that OGT is present in both the nucleus and cytosol.

Full details of the abovementioned studies are described in the following publications, the disclosure of which are hereby incorporated by reference:

Kreppel, L. K.; Blomberg, M. A.; Hart, G. W.: Dynamic glycosylation of nuclear and cytosolic proteins: cloning and characterization of a unique O-GlcNAc transferase with multiple tetratricopeptide repeats. J. Biol. Chem. 272:9308-9315, 1997; and Lubas, W. A.; Frank, D. W.; Krause, M.; Hanover, J. A.: O-linked GlcNAc transferase is a conserved nucleocytoplasmic protein containing tetratricopeptide repeats. J. Biol. Chem. 272:9.

Further studies establishing the function and utilities of OGT are found in John Hopkins OMIM database record ID 300255, and in cited publications listed in Table 5, which are hereby incorporated by reference. P2RY12 (Accession NP_073625.1) is another GAM100 target gene, herein designated TARGET GENE. P2RY12 BINDING SITE is a target binding site found in the 3' untranslated region of multiple transcripts of mRNA encoded by P2RY12, corresponding to a target binding site such as BINDING SITE I, BINDING SITE II or BINDING SITE III of FIG. 8. Table 4 illustrates the complementarity of the nucleotide sequences of P2RY12 BINDING SITE, designated SEQ ID:11851, to the nucleotide sequence of GAM100 RNA, herein designated GAM RNA, also designated SEQ ID:243.

Another function of GAM100 is therefore inhibition of P2RY12 (Accession NP_073625.1), a gene which couples to udp-glucose and other udp-sugar and therefore is associated with Platelet adp receptor defect. Accordingly, utilities of GAM100 include diagnosis, prevention and treatment of Platelet adp receptor defect, and of other diseases and clinical conditions associated with P2RY12.

The function of P2RY12 has been established by previous studies. Nurden et al. (1995) studied a family with what may be a similar abnormality in that ADP induced a small and rapidly reversible platelet aggregation even at high doses. This was associated with a markedly reduced binding of ADP to platelets and a failure of ADP to lower the content of cAMP of platelets preincubated with prostaglandin E1. Electron microscopy showed that the ADP-induced aggregates of platelets in the proband were composed of loosely bound shape-changed platelets with few contact points. Thus, this receptor defect has had a direct influence on the capacity of platelets to bind to each other in response to ADP. The proband was a 61-year-old Caucasian man with a history of episodes of excessive bleeding. The first severe episode occurred at the age of 17 when, after a minor accident, he developed a subretinal hemorrhage that led to the loss of an eye. A second major episode occurred during surgery performed when he was 28 years old. The third episode occurred during middle age when pulmonary bleeding led to hemoptysis. Other affected members of the family included a sister, an uncle who died as a result of severe epistaxis, and his father, who died from bleeding after a motor accident. The parents were cousins. There was no information on the mother, who died during the proband's early childhood. Studies in the sister appeared to indicate that she was similarly involved, whereas the only offspring of the proband appeared normal. Despite the consanguinity, the inheritance of the defect may be autosomal dominant. ADP mediates platelet aggregation through its action on 2 G protein-coupled receptor subtypes. The P2Y1 receptor (P2RY1; 601167) couples to Gq and mobilizes intracellular calcium ions to mediate platelet shape change and aggregation. The second ADP receptor required for aggregation, variously called P2YADP, P2YAC, P2YCy, or P2TAC, is coupled to the inhibition of adenylyl cyclase through Gi. This receptor is the target of efficacious antithrombotic agents, such as ticlopidine and clopidogrel. To identify this Gi-linked platelet ADP receptor, Hollopeter et al. (2001) engineered Xenopus oocytes to allow the detection of Gi-linked responses through a sensitive electrophysiologic assay. The human gene cloned, which the authors termed P2Y12, encodes a protein of 342 amino acids that contains 4 extracellular cysteine residues. Northern blot analysis detected abundant P2Y12 expression in human platelets, with lower expression in brain. The predominant transcript of 2.4 kb was absent from all other tissues examined, including peripheral blood leukocytes. A fainter species of approximately 4.5 kb was also detected in platelet and brain, whereas a prominent band of approximately 1.0 kb was observed only in platelet RNA. Within the brain, the 2.4-kb species was observed in numerous subregions, including the amygdala, caudate nucleus, corpus callosum, hippocampus, substantia nigra, and thalamus. In situ hybridization suggested a glial expression pattern.

Full details of the abovementioned studies are described in the following publications, the disclosure of which are hereby incorporated by reference:

Nurden, P.; Savi, P.; Heilmann, E.; Bihour, C.; Herbert, J.-M.; Maffrand, J.-P.; Nurden, A.: An inherited bleeding disorder linked to a defective interaction between ADP and its receptor on platelets: its influence on glycoprotein IIb-IIIa complex function. J. Clin. Invest. 95:1612-1622, 1995; and Hollopeter, G.; Jantzen, H.-M.; Vincent, D.; Li, G.; England, L.; Ramakrishnan, V.; Yang, R.-B.; Nurden, P.; Nurden, A.; Julius, D.; Conley, P. B.: Identification of the platelet ADP re.

Further studies establishing the function and utilities of P2RY12 are found in John Hopkins OMIM database record ID 600515, and in cited publications listed in Table 5, which are hereby incorporated by reference. P2RY12 (Accession NP_795345.1) is another GAM100 target gene, herein designated TARGET GENE. P2RY12 BINDING SITE is a target binding site found in the 3' untranslated region of multiple transcripts of mRNA encoded by P2RY12, corresponding to a target binding site such as BINDING SITE I, BINDING SITE II or BINDING SITE III of FIG. 8. Table 4 illustrates the complementarity of the nucleotide sequences of P2RY12 BINDING SITE, designated SEQ ID:11851, to the nucleotide sequence of GAM100 RNA, herein designated GAM RNA, also designated SEQ ID:243.

Another function of GAM100 is therefore inhibition of P2RY12 (Accession NP_795345.1), a gene which couples to udp-glucose and other udp-sugar and therefore is associated with Platelet adp receptor defect. Accordingly, utilities of GAM100 include diagnosis, prevention and treatment of Platelet adp receptor defect, and of other diseases and clinical conditions associated with P2RY12.

The function of P2RY12 has been established by previous studies. Nurden et al. (1995) studied a family with what may be a similar abnormality in that ADP induced a small and rapidly reversible platelet aggregation even at high doses. This was associated with a markedly reduced binding of ADP to platelets and a failure of ADP to lower the content of cAMP of platelets preincubated with prostaglandin E1. Electron microscopy showed that the ADP-induced aggregates of platelets in the proband were composed of loosely bound shape-changed platelets with few contact points. Thus, this receptor defect has had a direct influence on the capacity of platelets to bind to each other in response to ADP. The proband was a 61-year-old Caucasian man with a history of episodes of excessive bleeding. The first severe episode occurred at the age of 17 when, after a minor accident, he developed a subretinal hemorrhage that led to the loss of an eye. A second major episode occurred during surgery performed when he was 28 years old. The third episode occurred during middle age when pulmonary bleeding led to hemoptysis. Other affected members of the family included a sister, an uncle who died as a result of severe epistaxis, and his father, who died from bleeding after a motor accident. The parents were cousins. There was no information on the mother, who died during the proband's early childhood. Studies in the sister appeared to indicate that she was similarly involved, whereas the only offspring of the proband appeared normal. Despite the consanguinity, the inheritance of the defect may be autosomal dominant. ADP mediates platelet aggregation through its action on 2 G protein-coupled receptor subtypes. The P2Y1 receptor (P2RY1; 601167) couples to Gq and mobilizes intracellular calcium ions to mediate platelet shape change and aggregation. The second ADP receptor required for aggregation, variously called P2YADP, P2YAC, P2YCy, or P2TAC, is coupled to the inhibition of adenylyl cyclase through Gi. This receptor is the target of efficacious antithrombotic agents, such as ticlopidine and clopidogrel. To identify this Gi-linked platelet ADP receptor, Hollopeter et al. (2001) engineered Xenopus oocytes to allow the detection of Gi-linked responses through a sensitive electrophysiologic assay. The human gene cloned, which the authors termed P2Y12, encodes a protein of 342 amino acids that contains 4 extracellular cysteine residues. Northern blot analysis detected abundant P2Y12 expression in human platelets, with lower expression in brain. The predominant transcript of 2.4 kb was absent from all other tissues examined, including peripheral blood leukocytes. A fainter species of approximately 4.5 kb was also detected in platelet and brain, whereas a prominent band of approximately 1.0 kb was observed only in platelet RNA. Within the brain, the 2.4-kb species was observed in numerous subregions, including the amygdala, caudate nucleus, corpus callosum, hippocampus, substantia nigra, and thalamus. In situ hybridization suggested a glial expression pattern.

Full details of the abovementioned studies are described in the following publications, the disclosure of which are hereby incorporated by reference:

Nurden, P.; Savi, P.; Heilmann, E.; Bihour, C.; Herbert, J.-M.; Maffrand, J.-P.; Nurden, A.: An inherited bleeding disorder linked to a defective interaction between ADP and its receptor on platelets: its influence on glycoprotein IIb-IIIa complex function. J. Clin. Invest. 95:1612-1622, 1995; and Hollopeter, G.; Jantzen, H.-M.; Vincent, D.; Li, G.; England, L.; Ramakrishnan, V.; Yang, R.-B.; Nurden, P.; Nurden, A.; Julius, D.; Conley, P. B.: Identification of the platelet ADP re.

Further studies establishing the function and utilities of P2RY12 are found in John Hopkins OMIM database record ID 600515, and in cited publications listed in Table 5, which are hereby incorporated by reference. Paired basic amino acid cleaving system 4 (PACE4, Accession NP_612192.1) is another GAM100 target gene, herein designated TARGET GENE. PACE4 BINDING SITE is a target binding site found in the 3' untranslated region of multiple transcripts of mRNA encoded by PACE4, corresponding to a target binding site such as BINDING SITE I, BINDING SITE II or BINDING SITE III of FIG. 8. Table 4 illustrates the complementarity of the nucleotide sequences of PACE4 BINDING SITE, designated SEQ ID:6407, to the nucleotide sequence of GAM100 RNA, herein designated GAM RNA, also designated SEQ ID:243.

Another function of GAM100 is therefore inhibition of Paired basic amino acid cleaving system 4 (PACE4, Accession NP_612192.1), a gene which processes hormone precursors by cleaving paired basic amino acids. Accordingly, utilities of GAM100 include diagnosis, prevention and treatment of diseases and clinical conditions associated with PACE4.

The function of PACE4 and its association with various diseases and clinical conditions, has been established by previous studies, as described hereinabove with reference to GAM31.1. Paired basic amino acid cleaving system 4 (PACE4, Accession NP_002561.1) is another GAM100 target gene, herein designated TARGET GENE. PACE4 BINDING SITE is a target binding site found in the 3' untranslated region of multiple transcripts of mRNA encoded by PACE4, corresponding to a target binding site such as BINDING SITE I, BINDING SITE II or BINDING SITE III of FIG. 8. Table 4 illustrates the complementarity of the nucleotide sequences of PACE4 BINDING SITE, designated SEQ ID:6407, to the nucleotide sequence of GAM100 RNA, herein designated GAM RNA, also designated SEQ ID:243.

Another function of GAM100 is therefore inhibition of Paired basic amino acid cleaving system 4 (PACE4, Accession NP_002561.1), a gene which processes hormone precursors by cleaving paired basic amino acids. Accordingly, utilities of GAM100 include diagnosis, prevention and treatment of diseases and clinical conditions associated with PACE4.

The function of PACE4 and its association with various diseases and clinical conditions, has been established by previous studies, as described hereinabove with reference to GAM31.1. Poly(a)-specific ribonuclease (deadenylation nuclease) (PARN, Accession NP_002573.1) is another GAM100 target gene, herein designated TARGET GENE. PARN BINDING SITE is a target binding site found in the 3' untranslated region of mRNA encoded by PARN, corresponding to a target binding site such as BINDING SITE I, BINDING SITE II or BINDING SITE III of FIG. 8. Table 4 illustrates the complementarity of the nucleotide sequences of PARN BINDING SITE, designated SEQ ID:12302, to the nucleotide sequence of GAM100 RNA, herein designated GAM RNA, also designated SEQ ID:243.

Another function of GAM100 is therefore inhibition of Poly(a)-specific ribonuclease (deadenylation nuclease) (PARN, Accession NP_002573.1), a gene which degrades mRNA poly(A) tails during oocyte maturation. Accordingly, utilities of GAM100 include diagnosis, prevention and treatment of diseases and clinical conditions associated with PARN.

The function of PARN has been established by previous studies. Exonucleolytic degradation of the poly(A) tail is often the first step in the decay of eukaryotic mRNAs. Korner and Wahle (1997) purified the enzyme for deadenylation, PARN, which they named DAN, from calf thymus. Korner et al. (1998) partially sequenced the bovine PARN protein. By searching an EST database with the bovine PARN peptide sequences, they identified a human PARN EST encoding a deduced 639-amino acid protein. The calculated molecular mass of human PARN is 73.5 kD, which was the mass of recombinant PARN expressed in E. coli. The human PARN protein shows sequence similarity to the RNase D family of 3-prime exonucleases, which includes E. coli polymerase I. PARN is a 3-prime exonuclease that prefers poly(A) as the substrate. In an in vitro assay, PARN activity was partially inhibited by PAB1 (OMIM Ref. No. 604679), resulting in phased shortening of the poly(A) tail of the polyadenylated RNA substrate. The PARN protein is located in both the nucleus and the cytoplasm. It is not stably associated with polysomes or ribosomal subunits. Northern blot analysis detected a 3.1-kb PARN transcript in HeLa cell extracts. The authors noted that the PARN gene is widely expressed. Korner et al. (1998) noted that the PARN gene maps to chromosome 16.

Full details of the abovementioned studies are described in the following publications, the disclosure of which are hereby incorporated by reference:

Korner, C. G.; Wahle, E.: Poly(A) tail shortening by a mammalian poly(A)-specific 3-prime-exoribonuclease. J. Biol. Chem. 272:10448-10456, 1997; and Korner, C. G.; Wormington, M.; Muckenthaler, M.; Schneider, S.; Dehlin, E.; Wahle, E.: The deadenylating nuclease (DAN) is involved in poly(A) tail removal during the meiotic maturation.

Further studies establishing the function and utilities of PARN are found in John Hopkins OMIM database record ID 604212, and in cited publications listed in Table 5, which are hereby incorporated by reference. PHF11 (Accession NP_057203.1) is another GAM100 target gene, herein designated TARGET GENE. PHF11 BINDING SITE is a target binding site found in the 5' untranslated region of mRNA encoded by PHF11, corresponding to a target binding site such as BINDING SITE I, BINDING SITE II or BINDING SITE III of FIG. 8. Table 4 illustrates the complementarity of the nucleotide sequences of PHF11 BINDING SITE, designated SEQ ID:608, to the nucleotide sequence of GAM100 RNA, herein designated GAM RNA, also designated SEQ ID:243.

Another function of GAM100 is therefore inhibition of PHF11 (Accession NP_057203.1). Accordingly, utilities of GAM100 include diagnosis, prevention and treatment of diseases and clinical conditions associated with PHF11.

Protein kinase, dna-activated, catalytic polypeptide (PRKDC, Accession NP_008835.5) is another GAM100 target gene, herein designated TARGET GENE. PRKDC BINDING SITE is a target binding site found in the 3' untranslated region of mRNA encoded by PRKDC, corresponding to a target binding site such as BINDING SITE I, BINDING SITE II or BINDING SITE III of FIG. 8. Table 4 illustrates the complementarity of the nucleotide sequences of PRKDC BINDING SITE, designated SEQ ID:9408, to the nucleotide sequence of GAM100 RNA, herein designated GAM RNA, also designated SEQ ID:243.

Another function of GAM100 is therefore inhibition of Protein kinase, dna-activated, catalytic polypeptide (PRKDC, Accession NP_008835.5), a gene which is a novel member of the protein (PKC) gene family. Accordingly, utilities of GAM100 include diagnosis, prevention and treatment of diseases and clinical conditions associated with PRKDC.

The function of PRKDC has been established by previous studies. DNA-dependent protein kinase is a nuclear protein serine/threonine kinase present in a wide variety of eukaryotic species. One of its conspicuous features is that it must be bound to DNA to express its catalytic properties. It can be fractionated into 2 components: one is a large polypeptide corresponding to the catalytic subunit. On its own, the catalytic subunit of DNA-PK is inactive and relies on the other DNA-PK component to direct it to the DNA and trigger its kinase activity. The second component is the autoimmune antigen Ku (OMIM Ref. No. 152690), which is encoded by a gene, G22P1, located on chromosome 22q. One physiologic function for DNA-PK may be to modulate transcription, since it has been shown to phosphorylate several transcription factors in vitro (Anderson and Lees-Miller, 1992). Also, purified human DNA-PK has been reported to inhibit RNA polymerase I transcription in a purified mouse in vitro system (Kuhn et al., 1995) and in a partially purified Xenopus laevis cell extract (Labhart, 1995), although DNA-PK did not similarly inhibit transcription by RNA polymerases II or III (Labhart, 1995). Hartley et al. (1995) noted that DNA- PK activation requires DNA double-stranded breaks for other discontinuities in the DNA double helix, owing to the fact that Ku binds specifically to these structures. This suggests that DNA-PK may function in vivo by recognizing DNA ends at sites of DNA damage or that occur as recombination intermediates. Indeed, cells defective in DNA-PK components are hypersensitive to killing by ionizing radiation owing to an inability to repair double-stranded breaks effectively. Cells defective in either Ku or DNA-PK catalytic subunit are also unable to perform V(D)J recombination, the site-specific recombination process that takes place in developing B and T lymphocytes to generate the variable regions of immunoglobulin and T cell receptor genes. In the absence of DNA- PK function, V(D)J recombination intermediates are unable to be processed and ligated. In mammalian cells, abrogation of telomeric repeat-binding factor TRF2 (OMIM Ref. No. 602027) or DNA-PK activity causes end- to - end chromosomal fusion, thus establishing a central role for these proteins in telomere function. Bailey et al. (2001) demonstrated that TRF2-mediated end-capping occurs after telomere replication. The postreplicative requirement for TRF2 and DNA-PK catalytic subunit is confined to only half of the telomeres, namely, those that were produced by leading-strand DNA synthesis. Bailey et al. (2001) concluded that their results demonstrate a crucial difference in postreplicative processing of telomeres that is linked to their mode of replication. Ma et al. (2002) reported that the Artemis protein (OMIM Ref. No. 605988) forms a complex with PRKDS in the absence of DNA. The purified Artemis protein alone possesses single-strand-specific 5-prime- to -3-prime exonuclease activity. Upon complex formation, PRKDS phosphorylates Artemis, and Artemis acquires endonucleolytic activity on 5-prime and 3- prime overhangs, as well as hairpins. The Artemis-PRKDS complex can open hairpins generated by the RAG (see OMIM Ref. No. 179615) complex. Thus, PRKDC regulates Artemis by both phosphorylation and complex formation to permit enzymatic activities that are critical for the hairpin-opening step of V(D)J recombination and for the 5-prime and 3-prime overhang processing in nonhomologous DNA end joining.

Full details of the abovementioned studies are described in the following publications, the disclosure of which are hereby incorporated by reference:

Bailey, S. M.; Cornforth, M. N.; Kurimasa, A.; Chen, D. J.; Goodwin, E. H.: Strand- specific postreplicative processing of mammalian telomeres. Science 293:2462-2465, 2001; and Ma, Y.; Pannicke, U.; Schwarz, K.; Lieber, M. R.: Hairpin opening and overhang processing by an Artemis/DNA-dependent protein kinase complex in nonhomologous end joining and V(D)J rec.

Further studies establishing the function and utilities of PRKDC are found in John Hopkins OMIM database record ID 600899, and in cited publications listed in Table 5, which are hereby incorporated by reference. Prostaglandin-endoperoxide synthase 2 (prostaglandin g/h synthase and cyclooxygenase) (PTGS2, Accession NP_000954.1) is another GAM100 target gene, herein designated TARGET GENE. PTGS2 BINDING SITE is a target binding site found in the 3' untranslated region of mRNA encoded by PTGS2, corresponding to a target binding site such as BINDING SITE I, BINDING SITE II or BINDING SITE III of FIG. 8. Table 4 illustrates the complementarity of the nucleotide sequences of PTGS2 BINDING SITE, designated SEQ ID:10794, to the nucleotide sequence of GAM100 RNA, herein designated GAM RNA, also designated SEQ ID:243.

Another function of GAM100 is therefore inhibition of Prostaglandin-endoperoxide synthase 2 (prostaglandin g/h synthase and cyclooxygenase) (PTGS2, Accession NP_000954.1), a gene which may have a role as a major mediator of inflammation and/or a role for prostanoid signaling in activity-dependent plasticity. and therefore may be associated with Inflammatory diseases such as rheumatoid arthritis. Accordingly, utilities of GAM100 include diagnosis, prevention and treatment of Inflammatory diseases such as rheumatoid arthritis, and of other diseases and clinical conditions associated with PTGS2.

The function of PTGS2 has been established by previous studies. Inflammation causes the induction of COX2, leading to the release of prostanoids, which sensitize peripheral nociceptor terminals and produce localized pain hypersensitivity. Peripheral inflammation also generates pain hypersensitivity in neighboring uninjured tissue, because of the increased neuronal excitability in the spinal cord, and a syndrome comprising diffuse muscle and joint pain, fever, lethargy, and anorexia. Samad et al. (2001) showed that COX2 may be involved in central nervous system (CNS) responses, by finding a widespread induction of COX2 expression in spinal cord neurons and in other regions of the CNS, elevating prostaglandin E2 (PGE2) levels in the cerebrospinal fluid. The major inducer of central COX2 upregulation is IL1-beta in the CNS, and as basal phospholipase A2 (see OMIM Ref. No. 600522) activity in the CNS does not change with peripheral inflammation, COX2 levels must regulate central prostanoid production. In the rat, intraspinal administration of an interleukin-converting enzyme or COX2 inhibitor decreased inflammation-induced central PGE2 levels and mechanical hyperalgesia. Thus, Samad et al. (2001) concluded that preventing central prostanoid production by inhibiting the IL1-beta-mediated induction of COX2 in neurons or by inhibiting central COX2 activity reduces centrally generated inflammatory pain hypersensitivity.

Animal model experiments lend further support to the function of PTGS2. Morham et al. (1995) noted that cyclooxygenase-2 (COX2) is induced at high levels in migratory and other responding cells by proinflammatory stimuli. COX2 is generally considered to be a mediator of inflammation. Its isoform, COX1, is constitutively expressed in most tissues and is thought to mediate 'housekeeping' functions. These 2 enzymes are therapeutic targets of the widely used nonsteroidal antiinflammatory drugs (OMIM Ref. No. NSAIDs). To investigate further the different physiologic roles of these isoforms, Morham et al. (1995) used homologous recombination to disrupt the mouse gene encoding COX2 (Ptgs2). Mice lacking COX2 were found to have normal inflammatory responses to treatments with tetradecanoyl phorbol acetate or arachidonic acid. However, they developed severe nephropathy and were susceptible to peritonitis.

It is appreciated that the abovementioned animal model for PTGS2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Morham, S. G.; Langenbach, R.; Loftin, C. D.; Tiano, H. F.; Vouloumanos, N.; Jennette, J. C.; Mahler, J. F.; Kluckman, K. D.; Ledford, A.; Lee, C. A.; Smithies, O.: Prostaglandin synthase 2 gene disruption causes severe renal pathology in the mouse. Cell 83:473-482, 1995; and Samad, T. A.; Moore, K. A.; Sapirstein, A.; Billet, S.; Allchorne, A.; Poole, S.; Bonventre, J. V.; Woolf, C. J.: Interleukin-1-beta-mediated induction of Cox- 2 in the CNS contributes.

Further studies establishing the function and utilities of PTGS2 are found in John Hopkins OMIM database record ID 600262, and in cited publications listed in Table 5, which are hereby incorporated by reference. Rab27a, member ras oncogene family (RAB27A, Accession NP_004571.2) is another GAM100 target gene, herein designated TARGET GENE. RAB27A BINDING SITE is a target binding site found in the 3' untranslated region of mRNA encoded by RAB27A, corresponding to a target binding site such as BINDING SITE I, BINDING SITE II or BINDING SITE III of FIG. 8. Table 4 illustrates the complementarity of the nucleotide sequences of RAB27A BINDING SITE, designated SEQ ID:10792, to the nucleotide sequence of GAM100 RNA, herein designated GAM RNA, also designated SEQ ID:243.

Another function of GAM100 is therefore inhibition of Rab27a, member ras oncogene family (RAB27A, Accession NP_004571.2). Accordingly, utilities of GAM100 include diagnosis, prevention and treatment of diseases and clinical conditions associated with RAB27A.

Ran binding protein 2-like 1 (RANBP2L1, Accession NP_005045.1) is another GAM100 target gene, herein designated TARGET GENE. RANBP2L1 BINDING SITE is a target binding site found in the 3' untranslated region of multiple transcripts of mRNA encoded by RANBP2L1, corresponding to a target binding site such as BINDING SITE I, BINDING SITE II or BINDING SITE III of FIG. 8. Table 4 illustrates the complementarity of the nucleotide sequences of RANBP2L1 BINDING SITE, designated SEQ ID:3869, to the nucleotide sequence of GAM100 RNA, herein designated GAM RNA, also designated SEQ ID:243.

Another function of GAM100 is therefore inhibition of Ran binding protein 2-like 1 (RANBP2L1, Accession NP_005045.1) . Accordingly, utilities of GAM100 include diagnosis, prevention and treatment of diseases and clinical conditions associated with RANBP2L1.

Retinoblastoma binding protein 1 (RBBP1, Accession NP_075377.1) is another GAM100 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:15909, to the nucleotide sequence of GAM100 RNA, herein designated GAM RNA, also designated SEQ ID:243.

Another function of GAM100 is therefore inhibition of Retinoblastoma binding protein 1 (RBBP1, Accession NP_075377.1). Accordingly, utilities of GAM100 include diagnosis, prevention and treatment of diseases and clinical conditions associated with RBBP1.

Retinoblastoma binding protein 1 (RBBP1, Accession NP_075376.1) is another GAM100 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:15909, to the nucleotide sequence of GAM100 RNA, herein designated GAM RNA, also designated SEQ ID:243.

Another function of GAM100 is therefore inhibition of Retinoblastoma binding protein 1 (RBBP1, Accession NP_075376.1). Accordingly, utilities of GAM100 include diagnosis, prevention and treatment of diseases and clinical conditions associated with RBBP1.

Retinoblastoma binding protein 1 (RBBP1, Accession NP_002883.2) is another GAM100 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:15909, to the nucleotide sequence of GAM100 RNA, herein designated GAM RNA, also designated SEQ ID:243.

Another function of GAM100 is therefore inhibition of Retinoblastoma binding protein 1 (RBBP1, Accession NP_002883.2). Accordingly, utilities of GAM100 include diagnosis, prevention and treatment of diseases and clinical conditions associated with RBBP1.

Selectin e (endothelial adhesion molecule 1) (SELE, Accession NP_000441.1) is another GAM100 target gene, herein designated TARGET GENE. SELE BINDING SITE is a target binding site found in the 3' untranslated region of mRNA encoded by SELE, corresponding to a target binding site such as BINDING SITE I, BINDING SITE II or BINDING SITE III of FIG. 8. Table 4 illustrates the complementarity of the nucleotide sequences of SELE BINDING SITE, designated SEQ ID:5666, to the nucleotide sequence of GAM100 RNA, herein designated GAM RNA, also designated SEQ ID:243.

Another function of GAM100 is therefore inhibition of Selectin e (endothelial adhesion molecule 1) (SELE, Accession NP_000441.1), a gene which expressed on cytokine induced endothelial cells and mediates their binding to leukocytes. Accordingly, utilities of GAM100 include diagnosis, prevention and treatment of diseases and clinical conditions associated with SELE.

The function of SELE has been established by previous studies. Zheng et al. (2001) examined whether a polymorphism in the SELE gene, due to a G- to - T mutation (98G-T) in the untranslated region of exon 2, was related to premature coronary artery disease (CAD). Both lipid and nonlipid risk factors, including the ser128- to - arg substitution studied by Wenzel et al. (1994), were also assessed. The frequency of the 98G-T mutation was found to be significantly increased among male patients under 45 years of age and female patients under 55 years of age. After controlling for other CAD risk factors by multiple logistic analysis, the 98G-T mutation was still a significant predictor of premature CAD. The glaucomas are a group of optic neuropathies comprising the leading cause of irreversible blindness worldwide. Elevated intraocular pressure due to a reduction in normal aqueous outflow is a major causal risk factor. Wang et al. (2001) found that ELAM1, the earliest marker for the atherosclerotic plaque in the vasculature, was consistently present on trabecular meshwork cells in the outflow pathways of eyes with glaucomas of diverse etiology. They determined expression of ELAM1 to be controlled by activation of an interleukin-1 (see OMIM Ref. No. 147760) autocrine feedback loop through transcription factor NK-kappa-B (see OMIM Ref. No. 164011), and activity of this signaling pathway was shown to protect trabecular meshwork cells against oxidative stress. Wang et al. (2001) concluded that their findings characterized a protective stress response specific to the eye's aqueous outflow pathways and provided the first known diagnostic indicator of glaucomatous trabecular meshwork cells. They further indicated that common mechanisms contribute to the pathophysiology of the glaucomas and vascular diseases.

Full details of the abovementioned studies are described in the following publications, the disclosure of which are hereby incorporated by reference:

Wang, N.; Chintala, S. K.; Fini, M. E.; Schuman, J. S.: Activation of a tissue- specific stress response in the aqueous outflow pathway of the eye defines the glaucoma disease phenotype. Nature Med. 7:304-309, 2001; and Zheng, F.; Chevalier, J. A.; Zhang, L. Q.; Virgil, D.; y, S. Q.; Kwiterovich, P. O.: An HphI polymorphism in the E-selectin gene is associated with premature coronary artery diseas.

Further studies establishing the function and utilities of SELE are found in John Hopkins OMIM database record ID 131210, and in cited publications listed in Table 5, which are hereby incorporated by reference. SERPINA11 (Accession NP_783866.1) is another GAM100 target gene, herein designated TARGET GENE. SERPINA11 BINDING SITE is a target binding site found in the 3' untranslated region of mRNA encoded by SERPINA11, corresponding to a target binding site such as BINDING SITE I, BINDING SITE II or BINDING SITE III of FIG. 8. Table 4 illustrates the complementarity of the nucleotide sequences of SERPINA11 BINDING SITE, designated SEQ ID:8073, to the nucleotide sequence of GAM100 RNA, herein designated GAM RNA, also designated SEQ ID:243.

Another function of GAM100 is therefore inhibition of SERPINA11 (Accession NP_783866.1). Accordingly, utilities of GAM100 include diagnosis, prevention and treatment of diseases and clinical conditions associated with SERPINA11.

Serine (or cysteine) proteinase inhibitor, clade b (ovalbumin), member 7 (SERPINB7, Accession NP_003775.1) is another GAM100 target gene, herein designated TARGET GENE. SERPINB7 BINDING SITE is a target binding site found in the 3' untranslated region of mRNA encoded by SERPINB7, corresponding to a target binding site such as BINDING SITE I, BINDING SITE II or BINDING SITE III of FIG. 8. Table 4 illustrates the complementarity of the nucleotide sequences of SERPINB7 BINDING SITE, designated SEQ ID:18333, to the nucleotide sequence of GAM100 RNA, herein designated GAM RNA, also designated SEQ ID:243.

Another function of GAM100 is therefore inhibition of Serine (or cysteine) proteinase inhibitor, clade b (ovalbumin), member 7 (SERPINB7, Accession NP_003775.1). Accordingly, utilities of GAM100 include diagnosis, prevention and treatment of diseases and clinical conditions associated with SERPINB7.

Sh3-domain grb2-like endophilin b1 (SH3GLB1, Accession NP_057093.1) is another GAM100 target gene, herein designated TARGET GENE. SH3GLB1 BINDING SITE is a target binding site found in the 3' untranslated region of mRNA encoded by SH3GLB1, corresponding to a target binding site such as BINDING SITE I, BINDING SITE II or BINDING SITE III of FIG. 8. Table 4 illustrates the complementarity of the nucleotide sequences of SH3GLB1 BINDING SITE, designated SEQ ID:19111, to the nucleotide sequence of GAM100 RNA, herein designated GAM RNA, also designated SEQ ID:243.

Another function of GAM100 is therefore inhibition of Sh3-domain grb2-like endophilin b1 (SH3GLB1, Accession NP_057093.1). Accordingly, utilities of GAM100 include diagnosis, prevention and treatment of diseases and clinical conditions associated with SH3GLB1.

Seven in absentia homolog 1 (drosophila) (SIAH1, Accession NP_003022.1) is another GAM100 target gene, herein designated TARGET GENE. SIAH1 BINDING SITE is a target binding site found in the 3' untranslated region of mRNA encoded by SIAH1, corresponding to a target binding site such as BINDING SITE I, BINDING SITE II or BINDING SITE III of FIG. 8. Table 4 illustrates the complementarity of the nucleotide sequences of SIAH1 BINDING SITE, designated SEQ ID:6318, to the nucleotide sequence of GAM100 RNA, herein designated GAM RNA, also designated SEQ ID:243.

Another function of GAM100 is therefore inhibition of Seven in absentia homolog 1 (drosophila) (SIAH1, Accession NP_003022.1), a gene which mediates a beta-catenin degradation pathway linking p53 activation to cell cycle control. Accordingly, utilities of GAM100 include diagnosis, prevention and treatment of diseases and clinical conditions associated with SIAH1.

The function of SIAH1 has been established by previous studies. Hu et al. (1997) found that SIAH1 and SIAH2 are expressed in many normal and neoplastic tissues, and only subtle differences in their expression were noted. However, 1 of 3 murine homologs, Siah1b, was strongly induced in fibroblasts undergoing apoptotic cell death. While a previous study suggested that sina is a nuclear protein, epitope-labeled sina and SIAH1 proteins were found in the cytoplasm of Drosophila and mammalian cells. Their substantial evolutionary conservation, role in specifying cell fate, and activation in apoptotic cells suggested that the SIAH proteins have important roles in vertebrate development. Furthermore, given the role of sina in Drosophila photoreceptor development, SIAH2 was considered a candidate for the Usher syndrome type 3 (OMIM Ref. No. 276902) gene, which maps to 3q21-q25. Liu et al. (2001) found that SIAH1 interacts with the C terminus of the adenomatous polyposis coli protein (APC; 175100) and promotes degradation of beta-catenin in mammalian cells. The ability of SIAH1 to downregulate beta-catenin signaling was also demonstrated by hypodorsalization of Xenopus embryos. Unexpectedly, degradation of beta-catenin by SIAH1 was independent of glycogen synthase kinase 3-beta (OMIM Ref. No. 605004)-mediated phosphorylation and did not require the F-box protein BTRC (OMIM Ref. No. 603482). These results indicated that APC and SIAH1 mediate a beta-catenin degradation pathway linking p53 activation to cell cycle control.

Full details of the abovementioned studies are described in the following publications, the disclosure of which are hereby incorporated by reference:

Hu, G.; Chung, Y.-L.; Glover, T.; Valentine, V.; Look, A T.; Fearon, E. R.: Characterization of human homologs of the Drosophila seven in absentia (sina) gene. Genomics 46:103-111, 1997; and Liu, J.; Stevens, J.; Rote, C. A.; Yost, H. J.; Hu, Y.; Neufeld, K. L.; White, R. L.; Matsunami, N.: Siah-1 mediates a novel beta-catenin degradation pathway linking p53 to the adenomatou.

Further studies establishing the function and utilities of SIAH1 are found in John Hopkins OMIM database record ID 602212, and in cited publications listed in Table 5, which are hereby incorporated by reference. Solute carrier family 26, member 4 (SLC26A4, Accession NP_000432.1) is another GAM100 target gene, herein designated TARGET GENE. SLC26A4 BINDING SITE is a target binding site found in the 3' untranslated region of mRNA encoded by SLC26A4, corresponding to a target binding site such as BINDING SITE I, BINDING SITE II or BINDING SITE III of FIG. 8. Table 4 illustrates the complementarity of the nucleotide sequences of SLC26A4 BINDING SITE, designated SEQ ID:851, to the nucleotide sequence of GAM100 RNA, herein designated GAM RNA, also designated SEQ ID:243.

Another function of GAM100 is therefore inhibition of Solute carrier family 26, member 4 (SLC26A4, Accession NP_000432.1). Accordingly, utilities of GAM100 include diagnosis, prevention and treatment of diseases and clinical conditions associated with SLC26A4.

ST18 (Accession NP_055497.1) is another GAM100 target gene, herein designated TARGET GENE. ST18 BINDING SITE is a target binding site found in the 3' untranslated region of mRNA encoded by ST18, corresponding to a target binding site such as BINDING SITE I, BINDING SITE II or BINDING SITE III of FIG. 8. Table 4 illustrates the complementarity of the nucleotide sequences of ST18 BINDING SITE, designated SEQ ID:12777, to the nucleotide sequence of GAM100 RNA, herein designated GAM RNA, also designated SEQ ID:243.

Another function of GAM100 is therefore inhibition of ST18 (Accession NP_055497.1). Accordingly, utilities of GAM100 include diagnosis, prevention and treatment of diseases and clinical conditions associated with ST18.

Stomatin (STOM, Accession NP_004090.3) is another GAM100 target gene, herein designated TARGET GENE. STOM BINDING SITE is a target binding site found in the 3' untranslated region of mRNA encoded by STOM, corresponding to a target binding site such as BINDING SITE I, BINDING SITE II or BINDING SITE III of FIG. 8. Table 4 illustrates the complementarity of the nucleotide sequences of STOM BINDING SITE, designated SEQ ID:4767, to the nucleotide sequence of GAM100 RNA, herein designated GAM RNA, also designated SEQ ID:243.

Another function of GAM100 is therefore inhibition of Stomatin (STOM, Accession NP_004090.3). Accordingly, utilities of GAM100 include diagnosis, prevention and treatment of diseases and clinical conditions associated with STOM.

Syntaxin 3a (STX3A, Accession NP_004168.1) is another GAM100 target gene, herein designated TARGET GENE. STX3A BINDING SITE is a target binding site found in the 3' untranslated region of mRNA encoded by STX3A, corresponding to a target binding site such as BINDING SITE I, BINDING SITE II or BINDING SITE III of FIG. 8. Table 4 illustrates the complementarity of the nucleotide sequences of STX3A BINDING SITE, designated SEQ ID:8245, to the nucleotide sequence of GAM100 RNA, herein designated GAM RNA, also designated SEQ ID:243.

Another function of GAM100 is therefore inhibition of Syntaxin 3a (STX3A, Accession NP_004168.1). Accordingly, utilities of GAM100 include diagnosis, prevention and treatment of diseases and clinical conditions associated with STX3A.

Surfeit 6 (SURF6, Accession NP_006744.2) is another GAM100 target gene, herein designated TARGET GENE. SURF6 BINDING SITE is a target binding site found in the 3' untranslated region of mRNA encoded by SURF6, corresponding to a target binding site such as BINDING SITE I, BINDING SITE II or BINDING SITE III of FIG. 8. Table 4 illustrates the complementarity of the nucleotide sequences of SURF6 BINDING SITE, designated SEQ ID:11475, to the nucleotide sequence of GAM100 RNA, herein designated GAM RNA, also designated SEQ ID:243.

Another function of GAM100 is therefore inhibition of Surfeit 6 (SURF6, Accession NP_006744.2). Accordingly, utilities of GAM100 include diagnosis, prevention and treatment of diseases and clinical conditions associated with SURF6.

SV2B (Accession NP_055663.1) is another GAM100 target gene, herein designated TARGET GENE. SV2B BINDING SITE is a target binding site found in the 5' untranslated region of mRNA encoded by SV2B, corresponding to a target binding site such as BINDING SITE I, BINDING SITE II or BINDING SITE III of FIG. 8. Table 4 illustrates the complementarity of the nucleotide sequences of SV2B BINDING SITE, designated SEQ ID:2730, to the nucleotide sequence of GAM100 RNA, herein designated GAM RNA, also designated SEQ ID:243.

Another function of GAM100 is therefore inhibition of SV2B (Accession NP_055663.1). Accordingly, utilities of GAM100 include diagnosis, prevention and treatment of diseases and clinical conditions associated with SV2B.

T-complex 10 (mouse) (TCP10, Accession NP_004601.1) is another GAM100 target gene, herein designated TARGET GENE. TCP10 BINDING SITE is a target binding site found in the 3' untranslated region of mRNA encoded by TCP10, corresponding to a target binding site such as BINDING SITE I, BINDING SITE II or BINDING SITE III of FIG. 8. Table 4 illustrates the complementarity of the nucleotide sequences of TCP10 BINDING SITE, designated SEQ ID:15502, to the nucleotide sequence of GAM100 RNA, herein designated GAM RNA, also designated SEQ ID:243.

Another function of GAM100 is therefore inhibition of T-complex 10 (mouse) (TCP10, Accession NP_004601.1). Accordingly, utilities of GAM100 include diagnosis, prevention and treatment of diseases and clinical conditions associated with TCP10.

Transforming growth factor, alpha (TGFA, Accession NP_003227.1) is another GAM100 target gene, herein designated TARGET GENE. TGFA BINDING SITE is a target binding site found in the 3' untranslated region of mRNA encoded by TGFA, corresponding to a target binding site such as BINDING SITE I, BINDING SITE II or BINDING SITE III of FIG. 8. Table 4 illustrates the complementarity of the nucleotide sequences of TGFA BINDING SITE, designated SEQ ID:4927, to the nucleotide sequence of GAM100 RNA, herein designated GAM RNA, also designated SEQ ID:243.

Another function of GAM100 is therefore inhibition of Transforming growth factor, alpha (TGFA, Accession NP_003227.1), a gene which is able to bind to the egf receptor and to act synergistically with tgf beta to promote anchorage- independent cell proliferation in soft agar. Accordingly, utilities of GAM100 include diagnosis, prevention and treatment of diseases and clinical conditions associated with TGFA.

The function of TGFA and its association with various diseases and clinical conditions, has been established by previous studies, as described hereinabove with reference to GAM94.1. Tumor necrosis factor (ligand) superfamily, member 15 (TNFSF15, Accession NP_005109.2) is another GAM100 target gene, herein designated TARGET GENE. TNFSF15 BINDING SITE is a target binding site found in the 3' untranslated region of mRNA encoded by TNFSF15, corresponding to a target binding site such as BINDING SITE I, BINDING SITE II or BINDING SITE III of FIG. 8. Table 4 illustrates the complementarity of the nucleotide sequences of TNFSF15 BINDING SITE, designated SEQ ID:1209, to the nucleotide sequence of GAM100 RNA, herein designated GAM RNA, also designated SEQ ID:243.

Another function of GAM100 is therefore inhibition of Tumor necrosis factor (ligand) superfamily, member 15 (TNFSF15, Accession NP_005109.2), a gene which acts as an autocrine factor to induce apoptosis in endothelial cells. Accordingly, utilities of GAM100 include diagnosis, prevention and treatment of diseases and clinical conditions associated with TNFSF15.

The function of TNFSF15 has been established by previous studies. Zhai et al. (1999) found that expression of a recombinant soluble form of VEGI inhibited the growth of colon carcinomas in mice, and the tumors expressing the soluble VEGI had markedly reduced vascularization. Conditioned media from cells expressing soluble VEGI dramatically inhibited proliferation of bovine aortic endothelial cells. Zhai et al. (1999) concluded that VEGI is an angiogenesis inhibitor that functions in part by directly inhibiting endothelial cell proliferation. Yue et al. (1999) reported that TL1 causes endothelial cell apoptosis via activation of the stress protein kinases SAPK/JNK (see OMIM Ref. No. 601158) and p38 MAPK (see OMIM Ref. No. 600289) and the caspases, primarily caspase-3 (OMIM Ref. No. 600636). By functional analysis, Migone et al. (2002) showed that TL1A, but not TL1, induces nuclear factor kappa-B (NFKB; OMIM Ref. No. 164011) activation in cells expressing DR3. Exposure of T lymphocytes, but not other cells, to TL1A enhanced IL2 receptor-alpha (IL2RA; 147730) and IL2 receptor-beta (IL2RB; 146710) expression on these cells, increased proliferation in response to IL2 (OMIM Ref. No. 147680), and induced secretion of IFNG and granulocyte-macrophage colony-stimulating factor (GMCSF, or CSF2; 138960), but not other cytokines, especially in the presence of anti-CD28 (OMIM Ref. No. 186760) costimulation. Exposure of an erythroleukemic cell line (TF-1), but not activated T cells, to TL1A induced caspase activation and cell death, particularly when protein synthesis was inhibited. Migone et al. (2002) showed that treatment of mice with recombinant TL1A strongly enhanced graft-versus-host reactivity, consistent with DR3 being mainly expressed on activated T cells.

Full details of the abovementioned studies are described in the following publications, the disclosure of which are hereby incorporated by reference:

Yue, T.-L.; Ni, J.; Romanic, A. M.; Gu, J.-L.; Keller, P.; Wang, C.; Kumar, S.; y, G.; Hart, T. K.; Wang, X.; Xia, Z.; DeWolf, W. E., Jr.; Feuerstein, G. Z.: TL1, a novel tumor necrosis factor-like cytokine, induces apoptosis in endothelial cells: involvement of activation of stress protein kinases (stress-activated protein kinase and p38 mitogen-activated protein kinase) and caspase-3-like protease. J. Biol. Chem. 274:1479-1486, 1999; and Zhai, Y.; Ni, J.; Jiang, G.-W.; Lu, J.; Xing, L.; Lincoln, C.; Carter, K. C.; Janat, F.; Kozak, D.; Xu, S.; Rojas, L.; Aggarwal, B. B.; Ruben, S.; Li, L.-Y.; Gentz, R.; y, G.-L.: VEGI.

Further studies establishing the function and utilities of TNFSF15 are found in John Hopkins OMIM database record ID 604052, and in cited publications listed in Table 5, which are hereby incorporated by reference. Tripartite motif-containing 38 (TRIM38, Accession NP_006346.1) is another GAM100 target gene, herein designated TARGET GENE. TRIM38 BINDING SITE is a target binding site found in the 3' untranslated region of mRNA encoded by TRIM38, corresponding to a target binding site such as BINDING SITE I, BINDING SITE II or BINDING SITE III of FIG. 8. Table 4 illustrates the complementarity of the nucleotide sequences of TRIM38 BINDING SITE, designated SEQ ID:13589, to the nucleotide sequence of GAM100 RNA, herein designated GAM RNA, also designated SEQ ID:243.

Another function of GAM100 is therefore inhibition of Tripartite motif-containing 38 (TRIM38, Accession NP_006346.1). Accordingly, utilities of GAM100 include diagnosis, prevention and treatment of diseases and clinical conditions associated with TRIM38.

Ubx domain containing 2 (UBXD2, Accession NP_055422.1) is another GAM100 target gene, herein designated TARGET GENE. UBXD2 BINDING SITE is a target binding site found in the 3' untranslated region of mRNA encoded by UBXD2, corresponding to a target binding site such as BINDING SITE I, BINDING SITE II or BINDING SITE III of FIG. 8. Table 4 illustrates the complementarity of the nucleotide sequences of UBXD2 BINDING SITE, designated SEQ ID:5517, to the nucleotide sequence of GAM100 RNA, herein designated GAM RNA, also designated SEQ ID:243.

Another function of GAM100 is therefore inhibition of Ubx domain containing 2 (UBXD2, Accession NP_055422.1). Accordingly, utilities of GAM100 include diagnosis, prevention and treatment of diseases and clinical conditions associated with UBXD2.

Ubiquitously transcribed tetratricopeptide repeat gene, y chromosome (UTY, Accession NP_009056.2) is another GAM100 target gene, herein designated TARGET GENE. UTY BINDING SITE is a target binding site found in the 3' untranslated region of mRNA encoded by UTY, corresponding to a target binding site such as BINDING SITE I, BINDING SITE II or BINDING SITE III of FIG. 8. Table 4 illustrates the complementarity of the nucleotide sequences of UTY BINDING SITE, designated SEQ ID:2880, to the nucleotide sequence of GAM100 RNA, herein designated GAM RNA, also designated SEQ ID:243.

Another function of GAM100 is therefore inhibition of Ubiquitously transcribed tetratricopeptide repeat gene, y chromosome (UTY, Accession NP_009056.2), a gene which is an ubiquitous tetratricopeptide repeat protein with unknown function. Accordingly, utilities of GAM100 include diagnosis, prevention and treatment of diseases and clinical conditions associated with UTY.

The function of UTY has been established by previous studies. Greenfield et al. (1996) described a mouse Y-linked gene, Uty, which is widely expressed and encodes a tetratricopeptide repeat (TPR) protein. TPR motifs are found in a variety of functionally distinct proteins and are believed to mediate protein-protein interaction. The 5.5-kb Uty transcript encodes a 1,186 amino acid protein with 8 TPR motifs in its N terminus. Greenfield et al. (1998) reported that the human UTY gene maps to band 5C. This band is known to contain one or more genes functioning in spermatogenesis and a Y-specific growth gene. See 300128 for a description of the X-linked homolog of UTY. Foresta et al. (2000) reported a complete sequence map of the AZFa region (see OMIM Ref. No. 415000), the genomic structure of AZFa genes, and their deletion analysis in 173 infertile men with well-defined spermatogenic alterations. Deletions were found in 9 patients: DBY (OMIM Ref. No. 400010) alone was deleted in 6, DFFRY (USP9Y; 400005) only in 1, and 1 each with USP9Y-DBY or DBY-UTY missing. No patients solely lacked UTY. Patients lacking DBY exhibited either Sertoli cell-only syndrome or severe hypospermatogenesis. The authors suggested that DBY and USP9Y play key roles in the spermatogenic process.

Full details of the abovementioned studies are described in the following publications, the disclosure of which are hereby incorporated by reference:

Greenfield, A.; Scott, D.; Pennisi, D.; Ehrmann, I.; Ellis, P.; Cooper, L.; Simpson, E.; Koopman, P.: An H-YDb epitope is encoded by a novel mouse Y chromosome gene. Nature Genet. 14:474-478, 1996; and Foresta, C.; Ferlin, A.; Moro, E.: Deletion and expression analysis of AZFa genes on the human Y chromosome revealed a major role for DBY in male infertility. Hum. Molec. Genet. 9:1161-11.

Further studies establishing the function and utilities of UTY are found in John Hopkins OMIM database record ID 400009, and in cited publications listed in Table 5, which are hereby incorporated by reference. Vacuolar protein sorting 26 (yeast) (VPS26, Accession NP_004887.2) is another GAM100 target gene, herein designated TARGET GENE. VPS26 BINDING SITE is a target binding site found in the 3' untranslated region of mRNA encoded by VPS26, corresponding to a target binding site such as BINDING SITE I, BINDING SITE II or BINDING SITE III of FIG. 8. Table 4 illustrates the complementarity of the nucleotide sequences of VPS26 BINDING SITE, designated SEQ ID:11671, to the nucleotide sequence of GAM100 RNA, herein designated GAM RNA, also designated SEQ ID:243.

Another function of GAM100 is therefore inhibition of Vacuolar protein sorting 26 (yeast) (VPS26, Accession NP_004887.2), a gene which is a sorting protein-ensures the proper delivery of organelle-specific proteins. Accordingly, utilities of GAM100 include diagnosis, prevention and treatment of diseases and clinical conditions associated with VPS26.

The function of VPS26 has been established by previous studies. Haft et al. (2000) used yeast 2-hybrid assay, mutation analysis, and expression in mammalian cells to define the binding interactions among VPS26 and other human orthologs of yeast vacuolar protein sorting proteins, VPS29 (OMIM Ref. No. 606932), SNX1 (OMIM Ref. No. 601272), and VPS35 (OMIM Ref. No. 606931). Their results are consistent with a model in which VPS26 is bound to VPS35 in a multimeric complex. Haft et al. (2000) identified a discrete domain within VPS35 that interacts with VPS26. Gel filtration chromatography of COS-7 cells showed that both recombinant and endogenous VPS proteins coelute as a 220- to 240-kD complex, and in the absence of VPS35, neither VPS26 nor VPS29 is found in the complex. By database searching with the S. cerevisiae and mouse Vps26p/HB58/PEP8 sequences as probe, Haft et al. (2000) identified a human VPS26 EST. The deduced 327-amino acid protein was predicted to be a soluble protein. Northern blot analysis of multiple human tissues revealed ubiquitous expression of a single transcript of about 3 kb. Highest expression was found in heart, skeletal muscle, kidney, liver, and placenta, with lower expression in brain, spleen, small intestine, and lung, and lowest expression in colon, thymus, and leukocytes.

Full details of the abovementioned studies are described in the following publications, the disclosure of which are hereby incorporated by reference:

Haft, C. R.; de la Luz Sierra, M.; Bafford, R.; Lesniak, M. A.; Barr, V. A.; Taylor, S. I.: Human orthologs of yeast vacuolar protein sorting proteins Vps26, 29, and 35: assembly into multimeric complexes. Molec. Biol. Cell 11:4105-4116, 2000; and Mao, M.; Fu, G.; Wu, J.-S.; Zhang, Q.-H.; Zhou, J.; Kan, L.-X.; Huang, Q.-H.; He, K.-L.; Gu, B.-W.; Han, Z.-G.; Shen, Y.; Gu, J.; y, Y.-P.; Xu, S.-H.; Wang, Y.-X.; Chen, S.-J.; Chen.

Further studies establishing the function and utilities of VPS26 are found in John Hopkins OMIM database record ID 605506, and in cited publications listed in Table 5, which are hereby incorporated by reference. WDFY3 (Accession NP_055806.2) is another GAM100 target gene, herein designated TARGET GENE. WDFY3 BINDING SITE is a target binding site found in the 5' untranslated region of multiple transcripts of mRNA encoded by WDFY3, corresponding to a target binding site such as BINDING SITE I, BINDING SITE II or BINDING SITE III of FIG. 8. Table 4 illustrates the complementarity of the nucleotide sequences of WDFY3 BINDING SITE, designated SEQ ID:17077, to the nucleotide sequence of GAM100 RNA, herein designated GAM RNA, also designated SEQ ID:243.

Another function of GAM100 is therefore inhibition of WDFY3 (Accession NP_055806.2). Accordingly, utilities of GAM100 include diagnosis, prevention and treatment of diseases and clinical conditions associated with WDFY3.

Zinc finger protein 91 homolog (mouse) (ZFP91, Accession NP_444251.1) is another GAM100 target gene, herein designated TARGET GENE. ZFP91 BINDING SITE is a target binding site found in the 3' untranslated region of multiple transcripts of mRNA encoded by ZFP91, corresponding to a target binding site such as BINDING SITE I, BINDING SITE II or BINDING SITE III of FIG. 8. Table 4 illustrates the complementarity of the nucleotide sequences of ZFP91 BINDING SITE, designated SEQ ID:2399, to the nucleotide sequence of GAM100 RNA, herein designated GAM RNA, also designated SEQ ID:243.

Another function of GAM100 is therefore inhibition of Zinc finger protein 91 homolog (mouse) (ZFP91, Accession NP_444251.1). Accordingly, utilities of GAM100 include diagnosis, prevention and treatment of diseases and clinical conditions associated with ZFP91.

ZID (Accession NP_006617.1) is another GAM100 target gene, herein designated TARGET GENE. ZID BINDING SITE is a target binding site found in the 3' untranslated region of mRNA encoded by ZID, corresponding to a target binding site such as BINDING SITE I, BINDING SITE II or BINDING SITE III of FIG. 8. Table 4 illustrates the complementarity of the nucleotide sequences of ZID BINDING SITE, designated SEQ ID:19367, to the nucleotide sequence of GAM100 RNA, herein designated GAM RNA, also designated SEQ ID:243.

Another function of GAM100 is therefore inhibition of ZID (Accession NP_006617.1). Accordingly, utilities of GAM100 include diagnosis, prevention and treatment of diseases and clinical conditions associated with ZID.

Zinc finger protein 75a (ZNF75A, Accession NP_694573.1) is another GAM100 target gene, herein designated TARGET GENE. ZNF75A BINDING SITE is a target binding site found in the 3' untranslated region of mRNA encoded by ZNF75A, corresponding to a target binding site such as BINDING SITE I, BINDING SITE II or BINDING SITE III of FIG. 8. Table 4 illustrates the complementarity of the nucleotide sequences of ZNF75A BINDING SITE, designated SEQ ID:6345, to the nucleotide sequence of GAM100 RNA, herein designated GAM RNA, also designated SEQ ID:243.

Another function of GAM100 is therefore inhibition of Zinc finger protein 75a (ZNF75A, Accession NP_694573.1). Accordingly, utilities of GAM100 include diagnosis, prevention and treatment of diseases and clinical conditions associated with ZNF75A.

FIG. 8 further provides a conceptual description of a novel bioinformatically detected of the present invention, referred to here as Genomic Address Messenger 101 (GAM101), which modulates expression of respective target genes thereof, the function and utility of which target genes is known in the art.

GAM101 is a novel bioinformatically detected regulatory, non protein coding, micro RNA (miRNA) gene. The method by which GAM101 was detected is described hereinabove with reference to FIGS. 8-15.

GAM101 gene, herein designated GAM GENE, and GAM101 target gene, herein designated TARGET GENE, are human genes contained in the human genome.

GAM101 gene encodes a GAM101 precursor RNA, herein designated GAM PRECURSOR RNA. Similar to other miRNA genes, and unlike most ordinary genes, GAM101 precursor RNA does not encode a protein. A nucleotide sequence identical or highly similar to the nucleotide sequence of GAM101 precursor RNA is designated SEQ ID:43, and is provided hereinbelow with reference to the sequence listing part.

GAM101 precursor RNA folds onto itself, forming GAM101 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM101 precursor RNA folds onto itself, forming GAM101 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM101 precursor RNA, designated SEQ-ID:43, and a schematic representation of a predicted secondary folding of GAM101 folded precursor RNA are further described with reference to Table 2, hereby incorporated by reference.

An enzyme complex designated DICER COMPLEX, 'dices' the GAM101 folded precursor RNA into GAM101 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM101 RNA is designated SEQ ID:302, and is provided hereinbelow with references to the sequence listing part and Table 3, hereby incorporated by reference.

GAM101 target gene, herein designated TARGET GENE, encodes a corresponding messenger RNA, GAM101 target RNA, herein designated GAM TARGET RNA. GAM101 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM101 RNA, herein designated GAM RNA, binds complementarily to one or more target binding sites located in untranslated regions of GAM101 target RNA, herein designated GAM TARGET RNA. This complementary binding is due to the fact that the nucleotide sequence of GAM101 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM101 RNA may have a different number of target binding sites in untranslated regions of a GAM101 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM101 RNA, herein designated GAM RNA, to target binding sites on GAM101 target RNA, herein designated GAM TARGET RNA, such as BINDING SITE I, BINDING SITE II and BINDING SITE III, inhibits translation of GAM101 target RNA into GAM101 target protein, herein designated GAM TARGET PROTEIN. GAM target protein is therefore outlined by a broken line.

It is appreciated that GAM101 target gene, herein designated TARGET GENE, in fact represents a plurality of GAM101 target genes. The mRNA of each one of this plurality of GAM101 target genes comprises one or more target binding sites, each having a nucleotide sequence which is at least partly complementary to GAM101 RNA, herein designated GAM RNA, and which when bound by GAM101 RNA causes inhibition of translation of respective one or more GAM101 target proteins.

It is further appreciated by one skilled in the art that the mode of translational inhibition illustrated by FIG. 8 with specific reference to translational inhibition exerted by GAM101 gene, herein designated GAM GENE, on one or more GAM101 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM101 correlate with, and may be deduced from, the identity of the target genes which GAM101 binds and inhibits, and the function of these target genes, as elaborated hereinbelow.

Karyopherin alpha 6 (importin alpha 7) (KPNA6, Accession NM_012316.3) is a GAM101 target gene, herein designated TARGET GENE. KPNA6 BINDING SITE is a target binding site found in the 3' untranslated region of mRNA encoded by KPNA6, corresponding to a target binding site such as BINDING SITE I, BINDING SITE II or BINDING SITE III of FIG. 8. Table 4 illustrates the complementarity of the nucleotide sequences of KPNA6 BINDING SITE, designated SEQ ID:17036, to the nucleotide sequence of GAM101 RNA, herein designated GAM RNA, also designated SEQ ID:302.

A function of GAM101 is therefore inhibition of Karyopherin alpha 6 (importin alpha 7) (KPNA6, Accession NM_012316.3). Accordingly, utilities of GAM101 include diagnosis, prevention and treatment of diseases and clinical conditions associated with KPNA6.

REG-IV (Accession NM_032044.1) is another GAM101 target gene, herein designated TARGET GENE. REG-IV BINDING SITE is a target binding site found in the 5' untranslated region of mRNA encoded by REG-IV, corresponding to a target binding site such as BINDING SITE I, BINDING SITE II or BINDING SITE III of FIG. 8. Table 4 illustrates the complementarity of the nucleotide sequences of REG-IV BINDING SITE, designated SEQ ID:12913, to the nucleotide sequence of GAM101 RNA, herein designated GAM RNA, also designated SEQ ID:302.

Another function of GAM101 is therefore inhibition of REG-IV (Accession NM_032044.1). Accordingly, utilities of GAM101 include diagnosis, prevention and treatment of diseases and clinical conditions associated with REG-IV.

Serine/threonine kinase 38 (STK38, Accession NM_007271.1) is another GAM101 target gene, herein designated TARGET GENE. STK38 BINDING SITE is a target binding site found in the 5' untranslated region of mRNA encoded by STK38, corresponding to a target binding site such as BINDING SITE I, BINDING SITE II or BINDING SITE III of FIG. 8. Table 4 illustrates the complementarity of the nucleotide sequences of STK38 BINDING SITE, designated SEQ ID:14993, to the nucleotide sequence of GAM101 RNA, herein designated GAM RNA, also designated SEQ ID:302.

Another function of GAM101 is therefore inhibition of Serine/threonine kinase 38 (STK38, Accession NM_007271.1). Accordingly, utilities of GAM101 include diagnosis, prevention and treatment of diseases and clinical conditions associated with STK38.

Ubiquitin specific protease 29 (USP29, Accession NM_020903.1) is another GAM101 target gene, herein designated TARGET GENE. USP29 BINDING SITE is a target binding site found in the 3' untranslated region of mRNA encoded by USP29, corresponding to a target binding site such as BINDING SITE I, BINDING SITE II or BINDING SITE III of FIG. 8. Table 4 illustrates the complementarity of the nucleotide sequences of USP29 BINDING SITE, designated SEQ ID:1408, to the nucleotide sequence of GAM101 RNA, herein designated GAM RNA, also designated SEQ ID:302.

Another function of GAM101 is therefore inhibition of Ubiquitin specific protease 29 (USP29, Accession NM_020903.1). Accordingly, utilities of GAM101 include diagnosis, prevention and treatment of diseases and clinical conditions associated with USP29.

FIG. 8 further provides a conceptual description of a novel bioinformatically detected of the present invention, referred to here as Genomic Address Messenger 102 (GAM102), which modulates expression of respective target genes thereof, the function and utility of which target genes is known in the art.

GAM102 is a novel bioinformatically detected regulatory, non protein coding, micro RNA (miRNA) gene. The method by which GAM102 was detected is described hereinabove with reference to FIGS. 8-15.

GAM102 gene, herein designated GAM GENE, and GAM102 target gene, herein designated TARGET GENE, are human genes contained in the human genome.

GAM102 gene encodes a GAM102 precursor RNA, herein designated GAM PRECURSOR RNA. Similar to other miRNA genes, and unlike most ordinary genes, GAM102 precursor RNA does not encode a protein. A nucleotide sequence identical or highly similar to the nucleotide sequence of GAM102 precursor RNA is designated SEQ ID:15, and is provided hereinbelow with reference to the sequence listing part.

GAM102 precursor RNA folds onto itself, forming GAM102 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM102 precursor RNA folds onto itself, forming GAM102 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM102 precursor RNA, designated SEQ-ID:15, and a schematic representation of a predicted secondary folding of GAM102 folded precursor RNA are further described with reference to Table 2, hereby incorporated by reference.

An enzyme complex designated DICER COMPLEX, 'dices' the GAM102 folded precursor RNA into GAM102 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM102 RNA is designated SEQ ID:349, and is provided hereinbelow with references to the sequence listing part and Table 3, hereby incorporated by reference.

GAM102 target gene, herein designated TARGET GENE, encodes a corresponding messenger RNA, GAM102 target RNA, herein designated GAM TARGET RNA. GAM102 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM102 RNA, herein designated GAM RNA, binds complementarily to one or more target binding sites located in untranslated regions of GAM102 target RNA, herein designated GAM TARGET RNA. This complementary binding is due to the fact that the nucleotide sequence of GAM102 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM102 RNA may have a different number of target binding sites in untranslated regions of a GAM102 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM102 RNA, herein designated GAM RNA, to target binding sites on GAM102 target RNA, herein designated GAM TARGET RNA, such as BINDING SITE I, BINDING SITE II and BINDING SITE III, inhibits translation of GAM102 target RNA into GAM102 target protein, herein designated GAM TARGET PROTEIN. GAM target protein is therefore outlined by a broken line.

It is appreciated that GAM102 target gene, herein designated TARGET GENE, in fact represents a plurality of GAM102 target genes. The mRNA of each one of this plurality of GAM102 target genes comprises one or more target binding sites, each having a nucleotide sequence which is at least partly complementary to GAM102 RNA, herein designated GAM RNA, and which when bound by GAM102 RNA causes inhibition of translation of respective one or more GAM102 target proteins.

It is further appreciated by one skilled in the art that the mode of translational inhibition illustrated by FIG. 8 with specific reference to translational inhibition exerted by GAM102 gene, herein designated GAM GENE, on one or more GAM102 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM102 correlate with, and may be deduced from, the identity of the target genes which GAM102 binds and inhibits, and the function of these target genes, as elaborated hereinbelow.

LOC137829 (Accession XM_059923.2) is a GAM102 target gene, herein designated TARGET GENE. LOC137829 BINDING SITE is a target binding site found in the 5' untranslated region of mRNA encoded by LOC137829, corresponding to a target binding site such as BINDING SITE I, BINDING SITE II or BINDING SITE III of FIG. 8. Table 4 illustrates the complementarity of the nucleotide sequences of LOC137829 BINDING SITE, designated SEQ ID:5436, to the nucleotide sequence of GAM102 RNA, herein designated GAM RNA, also designated SEQ ID:349.

A function of GAM102 is therefore inhibition of LOC137829 (Accession XM_059923.2). Accordingly, utilities of GAM102 include diagnosis, prevention and treatment of diseases and clinical conditions associated with LOC137829.

Zinc finger protein 323 (ZNF323, Accession NM_030899.2) is another GAM102 target gene, herein designated TARGET GENE. ZNF323 BINDING SITE is a target binding site found in the 5' untranslated region of mRNA encoded by ZNF323, corresponding to a target binding site such as BINDING SITE I, BINDING SITE II or BINDING SITE III of FIG. 8. Table 4 illustrates the complementarity of the nucleotide sequences of ZNF323 BINDING SITE, designated SEQ ID:8592, to the nucleotide sequence of GAM102 RNA, herein designated GAM RNA, also designated SEQ ID:349.

Another function of GAM102 is therefore inhibition of Zinc finger protein 323 (ZNF323, Accession NM_030899.2). Accordingly, utilities of GAM102 include diagnosis, prevention and treatment of diseases and clinical conditions associated with ZNF323.

FIG. 8 further provides a conceptual description of a novel bioinformatically detected of the present invention, referred to here as Genomic Address Messenger 103 (GAM103), which modulates expression of respective target genes thereof, the function and utility of which target genes is known in the art.

GAM103 is a novel bioinformatically detected regulatory, non protein coding, micro RNA (miRNA) gene. The method by which GAM103 was detected is described hereinabove with reference to FIGS. 8-15.

GAM103 gene, herein designated GAM GENE, and GAM103 target gene, herein designated TARGET GENE, are human genes contained in the human genome.

GAM103 gene encodes a GAM103 precursor RNA, herein designated GAM PRECURSOR RNA. Similar to other miRNA genes, and unlike most ordinary genes, GAM103 precursor RNA does not encode a protein. A nucleotide sequence identical or highly similar to the nucleotide sequence of GAM103 precursor RNA is designated SEQ ID:132, and is provided hereinbelow with reference to the sequence listing part.

GAM103 precursor RNA folds onto itself, forming GAM103 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM103 precursor RNA folds onto itself, forming GAM103 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM103 precursor RNA, designated SEQ-ID:132, and a schematic representation of a predicted secondary folding of GAM103 folded precursor RNA are further described with reference to Table 2, hereby incorporated by reference.

An enzyme complex designated DICER COMPLEX, 'dices' the GAM103 folded precursor RNA into GAM103 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM103 RNA is designated SEQ ID:276, and is provided hereinbelow with references to the sequence listing part and Table 3, hereby incorporated by reference.

GAM103 target gene, herein designated TARGET GENE, encodes a corresponding messenger RNA, GAM103 target RNA, herein designated GAM TARGET RNA. GAM103 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM103 RNA, herein designated GAM RNA, binds complementarily to one or more target binding sites located in untranslated regions of GAM103 target RNA, herein designated GAM TARGET RNA. This complementary binding is due to the fact that the nucleotide sequence of GAM103 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM103 RNA may have a different number of target binding sites in untranslated regions of a GAM103 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM103 RNA, herein designated GAM RNA, to target binding sites on GAM103 target RNA, herein designated GAM TARGET RNA, such as BINDING SITE I, BINDING SITE II and BINDING SITE III, inhibits translation of GAM103 target RNA into GAM103 target protein, herein designated GAM TARGET PROTEIN. GAM target protein is therefore outlined by a broken line.

It is appreciated that GAM103 target gene, herein designated TARGET GENE, in fact represents a plurality of GAM103 target genes. The mRNA of each one of this plurality of GAM103 target genes comprises one or more target binding sites, each having a nucleotide sequence which is at least partly complementary to GAM103 RNA, herein designated GAM RNA, and which when bound by GAM103 RNA causes inhibition of translation of respective one or more GAM103 target proteins.

It is further appreciated by one skilled in the art that the mode of translational inhibition illustrated by FIG. 8 with specific reference to translational inhibition exerted by GAM103 gene, herein designated GAM GENE, on one or more GAM103 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM103 correlate with, and may be deduced from, the identity of the target genes which GAM103 binds and inhibits, and the function of these target genes, as elaborated hereinbelow.

FLJ13855 (Accession NM_023079.2) is a GAM103 target gene, herein designated TARGET GENE. FLJ13855 BINDING SITE is a target binding site found in the 3' untranslated region of mRNA encoded by FLJ13855, corresponding to a target binding site such as BINDING SITE I, BINDING SITE II or BINDING SITE III of FIG. 8. Table 4 illustrates the complementarity of the nucleotide sequences of FLJ13855 BINDING SITE, designated SEQ ID:14225, to the nucleotide sequence of GAM103 RNA, herein designated GAM RNA, also designated SEQ ID:276.

A function of GAM103 is therefore inhibition of FLJ13855 (Accession NM_023079.2). Accordingly, utilities of GAM103 include diagnosis, prevention and treatment of diseases and clinical conditions associated with FLJ13855.

Inositol 1,4,5-triphosphate receptor, type 3 (ITPR3, Accession NM_002224.1) is another GAM103 target gene, herein designated TARGET GENE. ITPR3 BINDING SITE is a target binding site found in the 3' untranslated region of mRNA encoded by ITPR3, corresponding to a target binding site such as BINDING SITE I, BINDING SITE II or BINDING SITE III of FIG. 8. Table 4 illustrates the complementarity of the nucleotide sequences of ITPR3 BINDING SITE, designated SEQ ID:4198, to the nucleotide sequence of GAM103 RNA, herein designated GAM RNA, also designated SEQ ID:276.

Another function of GAM103 is therefore inhibition of Inositol 1,4,5-triphosphate receptor, type 3 (ITPR3, Accession NM_002224.1), a gene which may be responsible for calcium release from intracellular stores. Accordingly, utilities of GAM103 include diagnosis, prevention and treatment of diseases and clinical conditions associated with ITPR3.

The function of ITPR3 has been established by previous studies. See 147265. Ozcelik et al. (1991) found that a cDNA probe for ITPR3 hybridized to DNA from hybrid cells containing human chromosome 6. In one hybrid that carried 6pter-p21, in the absence of an intact copy of this chromosome, hybridization was observed, thus mapping the gene to 6pter-p21. ITPR3 transduces many hormonal signals that regulate Ca(2+)-dependent processes in the intestinal epithelium. Maranto (1994) described complete sequence of the ITPR3 polypeptide (2,671 amino acids). Primary structure analysis indicated a pattern of conserved and variable regions, characteristic of the particular gene family. Immunocytochemical localization in the intestine was determined. Yamamoto - Hino et al. (1994) likewise mapped the ITPR3 gene to chromosome 6, specifically to 6p21, by isotopic in situ hybridization. They showed that the type 3 receptor was present in all hematopoietic and lymphoma cell lines tested Full details of the abovementioned studies are described in the following publications, the disclosure of which are hereby incorporated by reference:

Maranto, A. R.: Primary structure, ligand binding, and localization of the human type 3 inositol 1,4,5-trisphosphate receptor expressed in intestinal epithelium. J. Biol. Chem. 269:1222-1230, 1994; and Ozcelik, T.; Suedhof, T. C.; Francke, U.: The genes for inositol 1,4,5- triphosphate receptors 1 (ITPR1) and 3 (ITPR3) are localized on human chromosomes 3p and 6pter-p21, respectively.

Further studies establishing the function and utilities of ITPR3 are found in John Hopkins OMIM database record ID 147267, and in cited publications listed in Table 5, which are hereby incorporated by reference. KIAA1240 (Accession XM_039676.3) is another GAM103 target gene, herein designated TARGET GENE. KIAA1240 BINDING SITE is a target binding site found in the 3' untranslated region of mRNA encoded by KIAA1240, corresponding to a target binding site such as BINDING SITE I, BINDING SITE II or BINDING SITE III of FIG. 8. Table 4 illustrates the complementarity of the nucleotide sequences of KIAA1240 BINDING SITE, designated SEQ ID:5226, to the nucleotide sequence of GAM103 RNA, herein designated GAM RNA, also designated SEQ ID:276.

Another function of GAM103 is therefore inhibition of KIAA1240 (Accession XM_039676.3). Accordingly, utilities of GAM103 include diagnosis, prevention and treatment of diseases and clinical conditions associated with KIAA1240.

KIAA1719 (Accession XM_042936.3) is another GAM103 target gene, herein designated TARGET GENE. KIAA1719 BINDING SITE is a target binding site found in the 3' untranslated region of mRNA encoded by KIAA1719, corresponding to a target binding site such as BINDING SITE I, BINDING SITE II or BINDING SITE III of FIG. 8. Table 4 illustrates the complementarity of the nucleotide sequences of KIAA1719 BINDING SITE, designated SEQ ID:11994, to the nucleotide sequence of GAM103 RNA, herein designated GAM RNA, also designated SEQ ID:276.

Another function of GAM103 is therefore inhibition of KIAA1719 (Accession XM_042936.3). Accordingly, utilities of GAM103 include diagnosis, prevention and treatment of diseases and clinical conditions associated with KIAA1719.

LOC199692 (Accession NM_145295.1) is another GAM103 target gene, herein designated TARGET GENE. LOC199692 BINDING SITE is a target binding site found in the 3' untranslated region of mRNA encoded by LOC199692, corresponding to a target binding site such as BINDING SITE I, BINDING SITE II or BINDING SITE III of FIG. 8. Table 4 illustrates the complementarity of the nucleotide sequences of LOC199692 BINDING SITE, designated SEQ ID:7894, to the nucleotide sequence of GAM103 RNA, herein designated GAM RNA, also designated SEQ ID:276.

Another function of GAM103 is therefore inhibition of LOC199692 (Accession NM_145295.1). Accordingly, utilities of GAM103 include diagnosis, prevention and treatment of diseases and clinical conditions associated with LOC199692.

FIG. 8 further provides a conceptual description of a novel bioinformatically detected of the present invention, referred to here as Genomic Address Messenger 104 (GAM104), which modulates expression of respective target genes thereof, the function and utility of which target genes is known in the art.

GAM104 is a novel bioinformatically detected regulatory, non protein coding, micro RNA (miRNA) gene. The method by which GAM104 was detected is described hereinabove with reference to FIGS. 8-15.

GAM104 gene, herein designated GAM GENE, and GAM104 target gene, herein designated TARGET GENE, are human genes contained in the human genome.

GAM104 gene encodes a GAM104 precursor RNA, herein designated GAM PRECURSOR RNA. Similar to other miRNA genes, and unlike most ordinary genes, GAM104 precursor RNA does not encode a protein. A nucleotide sequence identical or highly similar to the nucleotide sequence of GAM104 precursor RNA is designated SEQ ID:137, and is provided hereinbelow with reference to the sequence listing part.

GAM104 precursor RNA folds onto itself, forming GAM104 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM104 precursor RNA folds onto itself, forming GAM104 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM104 precursor RNA, designated SEQ-ID:137, and a schematic representation of a predicted secondary folding of GAM104 folded precursor RNA are further described with reference to Table 2, hereby incorporated by reference.

An enzyme complex designated DICER COMPLEX, 'dices' the GAM104 folded precursor RNA into GAM104 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM104 RNA is designated SEQ ID:355, and is provided hereinbelow with references to the sequence listing part and Table 3, hereby incorporated by reference.

GAM104 target gene, herein designated TARGET GENE, encodes a corresponding messenger RNA, GAM104 target RNA, herein designated GAM TARGET RNA. GAM104 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM104 RNA, herein designated GAM RNA, binds complementarily to one or more target binding sites located in untranslated regions of GAM104 target RNA, herein designated GAM TARGET RNA. This complementary binding is due to the fact that the nucleotide sequence of GAM104 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM104 RNA may have a different number of target binding sites in untranslated regions of a GAM104 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM104 RNA, herein designated GAM RNA, to target binding sites on GAM104 target RNA, herein designated GAM TARGET RNA, such as BINDING SITE I, BINDING SITE II and BINDING SITE III, inhibits translation of GAM104 target RNA into GAM104 target protein, herein designated GAM TARGET PROTEIN. GAM target protein is therefore outlined by a broken line.

It is appreciated that GAM104 target gene, herein designated TARGET GENE, in fact represents a plurality of GAM104 target genes. The mRNA of each one of this plurality of GAM104 target genes comprises one or more target binding sites, each having a nucleotide sequence which is at least partly complementary to GAM104 RNA, herein designated GAM RNA, and which when bound by GAM104 RNA causes inhibition of translation of respective one or more GAM104 target proteins.

It is further appreciated by one skilled in the art that the mode of translational inhibition illustrated by FIG. 8 with specific reference to translational inhibition exerted by GAM104 gene, herein designated GAM GENE, on one or more GAM104 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM104 correlate with, and may be deduced from, the identity of the target genes which GAM104 binds and inhibits, and the function of these target genes, as elaborated hereinbelow.

4-aminobutyrate aminotransferase (ABAT, Accession NP_000654.1) is a GAM104 target gene, herein designated TARGET GENE. ABAT BINDING SITE is a target binding site found in the 3' untranslated region of mRNA encoded by ABAT, corresponding to a target binding site such as BINDING SITE I, BINDING SITE II or BINDING SITE III of FIG. 8. Table 4 illustrates the complementarity of the nucleotide sequences of ABAT BINDING SITE, designated SEQ ID:8488, to the nucleotide sequence of GAM104 RNA, herein designated GAM RNA, also designated SEQ ID:355.

A function of GAM104 is therefore inhibition of 4-aminobutyrate aminotransferase (ABAT, Accession NP_000654.1). Accordingly, utilities of GAM104 include diagnosis, prevention and treatment of diseases and clinical conditions associated with ABAT.

V-abl abelson murine leukemia viral oncogene homolog 2 (arg, abelson-related gene) (ABL2, Accession NP_009298.1) is another GAM104 target gene, herein designated TARGET GENE. ABL2 BINDING SITE is a target binding site found in the 3' untranslated region of multiple transcripts of mRNA encoded by ABL2, corresponding to a target binding site such as BINDING SITE I, BINDING SITE II or BINDING SITE III of FIG. 8. Table 4 illustrates the complementarity of the nucleotide sequences of ABL2 BINDING SITE, designated SEQ ID:7728, to the nucleotide sequence of GAM104 RNA, herein designated GAM RNA, also designated SEQ ID:355.

Another function of GAM104 is therefore inhibition of V-abl abelson murine leukemia viral oncogene homolog 2 (arg, abelson-related gene) (ABL2, Accession NP_009298.1), a gene which Cytoplasmic tyrosine kinase of the Abelson subfamily. and therefore may be associated with Acute myeloid leukemia. Accordingly, utilities of GAM104 include diagnosis, prevention and treatment of Acute myeloid leukemia, and of other diseases and clinical conditions associated with ABL2.

The function of ABL2 has been established by previous studies. Kruh et al. (1986) identified a novel oncogene related to ABL (OMIM Ref. No. 189980) in DNA sequences from human plasma. The new sequence, called ARG by the authors, was localized by in situ hybridization and somatic cell analysis to human chromosome 1q24-q25. The detection of a novel 12-kb transcript from this gene in human normal and tumor cells establishes it as a new member of the tyrosine kinase family that is closely related to but distinct from ABL. A constitutional fragile site is located at 1q24-q25. Seldin and Kruh (1989) mapped the mouse homolog (Abll) to chromosome 1 by analysis of segregation with other distal chromosome 1 genetic polymorphisms in a panel of DNAs from interspecific backcross mice. This defined a region of distal mouse chromosome 1 homologous with human chromosome 1q21-q32.

Full details of the abovementioned studies are described in the following publications, the disclosure of which are hereby incorporated by reference:

Kruh, G. D.; King, C. R.; Kraus, M. H.; Popescu, N. C.; Amsbaugh, S. C.; McBride, W. O.; Aaronson, S. A.: A novel human gene closely related to the abl proto - oncogene. Science 234:1545-1548, 1986; and Seldin, M. F.; Kruh, G. D.: Mapping of Abll within a conserved linkage group on distal mouse chromosome 1 syntenic with human chromosome 1 using an interspecific cross. Genomics 4:221.

Further studies establishing the function and utilities of ABL2 are found in John Hopkins OMIM database record ID 164690, and in cited publications listed in Table 5, which are hereby incorporated by reference. V-abl abelson murine leukemia viral oncogene homolog 2 (arg, abelson-related gene) (ABL2, Accession NP_005149.2) is another GAM104 target gene, herein designated TARGET GENE. ABL2 BINDING SITE is a target binding site found in the 3' untranslated region of multiple transcripts of mRNA encoded by ABL2, corresponding to a target binding site such as BINDING SITE I, BINDING SITE II or BINDING SITE III of FIG. 8. Table 4 illustrates the complementarity of the nucleotide sequences of ABL2 BINDING SITE, designated SEQ ID:7728, to the nucleotide sequence of GAM104 RNA, herein designated GAM RNA, also designated SEQ ID:355.

Another function of GAM104 is therefore inhibition of V-abl abelson murine leukemia viral oncogene homolog 2 (arg, abelson-related gene) (ABL2, Accession NP_005149.2), a gene which Cytoplasmic tyrosine kinase of the Abelson subfamily. and therefore may be associated with Acute myeloid leukemia. Accordingly, utilities of GAM104 include diagnosis, prevention and treatment of Acute myeloid leukemia, and of other diseases and clinical conditions associated with ABL2.

The function of ABL2 has been established by previous studies. Kruh et al. (1986) identified a novel oncogene related to ABL (OMIM Ref. No. 189980) in DNA sequences from human plasma. The new sequence, called ARG by the authors, was localized by in situ hybridization and somatic cell analysis to human chromosome 1q24-q25. The detection of a novel 12-kb transcript from this gene in human normal and tumor cells establishes it as a new member of the tyrosine kinase family that is closely related to but distinct from ABL. A constitutional fragile site is located at 1q24-q25. Seldin and Kruh (1989) mapped the mouse homolog (Abll) to chromosome 1 by analysis of segregation with other distal chromosome 1 genetic polymorphisms in a panel of DNAs from interspecific backcross mice. This defined a region of distal mouse chromosome 1 homologous with human chromosome 1q21-q32.

Full details of the abovementioned studies are described in the following publications, the disclosure of which are hereby incorporated by reference:

Kruh, G. D.; King, C. R.; Kraus, M. H.; Popescu, N. C.; Amsbaugh, S. C.; McBride, W. O.; Aaronson, S. A.: A novel human gene closely related to the abl proto - oncogene. Science 234:1545-1548, 1986; and Seldin, M. F.; Kruh, G. D.: Mapping of Abll within a conserved linkage group on distal mouse chromosome 1 syntenic with human chromosome 1 using an interspecific cross. Genomics 4:221.

Further studies establishing the function and utilities of ABL2 are found in John Hopkins OMIM database record ID 164690, and in cited publications listed in Table 5, which are hereby incorporated by reference. Adenylate cyclase activating polypeptide 1 (pituitary) (ADCYAP1, Accession NP__001108.1) is another GAM104 target gene, herein designated TARGET GENE. ADCYAP1 BINDING SITE is a target binding site found in the 3' untranslated region of mRNA encoded by ADCYAP1, corresponding to a target binding site such as BINDING SITE I, BINDING SITE II or BINDING SITE III of FIG. 8. Table 4 illustrates the complementarity of the nucleotide sequences of ADCYAP1 BINDING SITE, designated SEQ ID:13625, to the nucleotide sequence of GAM104 RNA, herein designated GAM RNA, also designated SEQ ID:355.

Another function of GAM104 is therefore inhibition of Adenylate cyclase activating polypeptide 1 (pituitary) (ADCYAP1, Accession NP_001108.1). Accordingly, utilities of GAM104 include diagnosis, prevention and treatment of diseases and clinical conditions associated with ADCYAP1.

Amyotrophic lateral sclerosis 2 (juvenile) chromosome region, candidate 3 (ALS2CR3, Accession NP__055864.1) is another GAM104 target gene, herein designated TARGET GENE. ALS2CR3 BINDING SITE is a target binding site found in the 3' untranslated region of mRNA encoded by ALS2CR3, corresponding to a target binding site such as BINDING SITE I, BINDING SITE II or BINDING SITE III of FIG. 8. Table 4 illustrates the complementarity of the nucleotide sequences of ALS2CR3 BINDING SITE, designated SEQ ID:4241, to the nucleotide sequence of GAM104 RNA, herein designated GAM RNA, also designated SEQ ID:355.

Another function of GAM104 is therefore inhibition of Amyotrophic lateral sclerosis 2 (juvenile) chromosome region, candidate 3 (ALS2CR3, Accession NP__055864.1). Accordingly, utilities of GAM104 include diagnosis, prevention and treatment of diseases and clinical conditions associated with ALS2CR3.

Aryl-hydrocarbon receptor nuclear translocator 2 (ARNT2, Accession NP__055677.1) is another GAM104 target gene, herein designated TARGET GENE. ARNT2 BINDING SITE is a target binding site found in the 3' untranslated region of mRNA encoded by ARNT2, corresponding to a target binding site such as BINDING SITE I, BINDING SITE II or BINDING SITE III of FIG. 8. Table 4 illustrates the complementarity of the nucleotide sequences of ARNT2 BINDING SITE, designated SEQ ID:7789, to the nucleotide sequence of GAM104 RNA, herein designated GAM RNA, also designated SEQ ID:355.

Another function of GAM104 is therefore inhibition of Aryl-hydrocarbon receptor nuclear translocator 2 (ARNT2, Accession NP__055677.1), a gene which specifically recognizes the xenobiotic response element (xre). Accordingly, utilities of GAM104 include diagnosis, prevention and treatment of diseases and clinical conditions associated with ARNT2.

The function of ARNT2 and its association with various diseases and clinical conditions, has been established by previous studies, as described hereinabove with reference to GAM67.1. BART1 (Accession NP__036238.1) is another GAM104 target gene, herein designated TARGET GENE. BART1 BINDING SITE is a target binding site found in the 3' untranslated region of mRNA encoded by BART1, corresponding to a target binding site such as BINDING SITE I, BINDING SITE II or BINDING SITE III of FIG. 8. Table 4 illustrates the complementarity of the nucleotide sequences of BART1 BINDING SITE, designated SEQ ID:2233, to the nucleotide sequence of GAM104 RNA, herein designated GAM RNA, also designated SEQ ID:355.

Another function of GAM104 is therefore inhibition of BART1 (Accession NP__036238.1). Accordingly, utilities of GAM104 include diagnosis, prevention and treatment of diseases and clinical conditions associated with BART1.

Hla-b associated transcript 1 (BAT1, Accession NP__004631.1) is another GAM104 target gene, herein designated TARGET GENE. BAT1 BINDING SITE is a target binding site found in the 5' untranslated region of multiple transcripts of mRNA encoded by BAT1, corresponding to a target binding site such as BINDING SITE I, BINDING SITE II or BINDING SITE III of FIG. 8. Table 4 illustrates the complementarity of the nucleotide sequences of BAT1 BINDING SITE, designated SEQ ID:7126, to the nucleotide sequence of GAM104 RNA, herein designated GAM RNA, also designated SEQ ID:355.

Another function of GAM104 is therefore inhibition of Hla-b associated transcript 1 (BAT1, Accession NP__004631.1), a gene which associates with the major histocompatibility complex, a negative regulator of inflammation. Accordingly, utilities of GAM104 include diagnosis, prevention and treatment of diseases and clinical conditions associated with BAT1.

The function of BAT1 and its association with various diseases and clinical conditions, has been established by previous studies, as described hereinabove with reference to GAM48.2. Bromodomain adjacent to zinc finger domain, 2a (BAZ2A, Accession NP__038477.1) is another GAM104 target gene, herein designated TARGET GENE. BAZ2A BINDING SITE is a target binding site found in the 3' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:6461, to the nucleotide sequence of GAM104 RNA, herein designated GAM RNA, also designated SEQ ID:355.

Another function of GAM104 is therefore inhibition of Bromodomain adjacent to zinc finger domain, 2a (BAZ2A, Accession NP__038477.1) . Accordingly, utilities of GAM104 include diagnosis, prevention and treatment of diseases and clinical conditions associated with BAZ2A.

Brca2 and cdkn1a interacting protein (BCCIP, Accession NP_057651.1) is another GAM104 target gene, herein designated TARGET GENE. BCCIP BINDING SITE is a target binding site found in the 3' untranslated region of multiple transcripts of mRNA encoded by BCCIP, corresponding to a target binding site such as BINDING SITE I, BINDING SITE II or BINDING SITE III of FIG. 8. Table 4 illustrates the complementarity of the nucleotide sequences of BCCIP BINDING SITE, designated SEQ ID:18876, to the nucleotide sequence of GAM104 RNA, herein designated GAM RNA, also designated SEQ ID:355.

Another function of GAM104 is therefore inhibition of Brca2 and cdkn1a interacting protein (BCCIP, Accession NP__057651.1). Accordingly, utilities of GAM104 include diagnosis, prevention and treatment of diseases and clinical conditions associated with BCCIP.

Baculoviral iap repeat-containing 5 (survivin) (BIRC5, Accession NP__001159.1) is another GAM104 target gene, herein designated TARGET GENE. BIRC5 BINDING SITE is a target binding site found in the 3' untranslated region of mRNA encoded by BIRC5, corresponding to a target binding site such as BINDING SITE I, BINDING SITE II or BINDING SITE III of FIG. 8. Table 4 illustrates the complementarity of the nucleotide sequences of BIRC5 BINDING SITE, designated SEQ ID:12241, to the nucleotide sequence of GAM104 RNA, herein designated GAM RNA, also designated SEQ ID:355.

Another function of GAM104 is therefore inhibition of Baculoviral iap repeat-containing 5 (survivin) (BIRC5, Accession NP_001159.1). Accordingly, utilities of GAM104 include diagnosis, prevention and treatment of diseases and clinical conditions associated with BIRC5.

Complement component 5 receptor 1 (c5a ligand) (C5R1, Accession NP_001727.1) is another GAM104 target gene, herein designated TARGET GENE. C5R1 BINDING SITE is a target binding site found in the 3' untranslated region of mRNA encoded by C5R1, corresponding to a target binding site such as BINDING SITE I, BINDING SITE II or BINDING SITE III of FIG. 8. Table 4 illustrates the complementarity of the nucleotide sequences of C5R1 BINDING SITE, designated SEQ ID:18094, to the nucleotide sequence of GAM104 RNA, herein designated GAM RNA, also designated SEQ ID:355.

Another function of GAM104 is therefore inhibition of Complement component 5 receptor 1 (c5a ligand) (C5R1, Accession NP_001727.1), a gene which has a nonredundant function and is required for mucosal host cell defense in the lung and therefore may be associated with Asthma and pneumonia. Accordingly, utilities of GAM104 include diagnosis, prevention and treatment of Asthma and pneumonia, and of other diseases and clinical conditions associated with C5R1.

The function of C5R1 and its association with various diseases and clinical conditions, has been established by previous studies, as described hereinabove with reference to GAM66.1. Deleted in azoospermia (DAZ, Accession NP_004072.1) is another GAM104 target gene, herein designated TARGET GENE. DAZ BINDING SITE is a target binding site found in the 5' untranslated region of multiple transcripts of mRNA encoded by DAZ, corresponding to a target binding site such as BINDING SITE I, BINDING SITE II or BINDING SITE III of FIG. 8. Table 4 illustrates the complementarity of the nucleotide sequences of DAZ BINDING SITE, designated SEQ ID:2687, to the nucleotide sequence of GAM104 RNA, herein designated GAM RNA, also designated SEQ ID:355.

Another function of GAM104 is therefore inhibition of Deleted in azoospermia (DAZ, Accession NP_004072.1), a gene which may play a role in the germ-cell-specific patterns of RNA splicing and storage and therefore may be associated with Male infertility. Accordingly, utilities of GAM104 include diagnosis, prevention and treatment of Male infertility, and of other diseases and clinical conditions associated with DAZ.

The function of DAZ has been established by previous studies. Cooke et al. (1996) postulated that the DAZ gene product may play a role in the germ-cell-specific patterns of RNA splicing and storage. They isolated the mouse homolog of DAZ and mapped it by fluorescence in situ hybridization to chromosome 17 at position 25.6 cM. Cooke et al. (1996) reported that the predicted protein product of the mouse homolog is highly homologous to that of the human gene. By RT-PCR analysis, they established that transcripts occur only in mouse germ cells. Deletions of the azoospermia factors on the Y chromosome long arm are an important cause of male infertility, and they may involve germ cell-specific genes or ubiquitously expressed genes. Foresta et al. (2001) hypothesized that microdeletions involving genes specifically expressed in germ cells should not alter Sertoli cell function. To examine this, they evaluated the testicular hormonal function in infertile patients affected by severe testiculopathies with and without Yq microdeletions, with particular emphasis on Sertoli cell function. They studied 102 well-characterized infertile patients; 27 had Yq microdeletions, and 75 were classified as idiopathic infertiles. Patients with Yq microdeletions had lower FSH (see OMIM Ref. No. 136530) and higher inhibin B (see OMIM Ref. No. 147290) plasma concentrations compared to patients without microdeletions, suggesting that Sertoli cell function in Yq-deleted men is only partially altered. Furthermore, patients with deletions involving germ cell-specific genes had higher concentrations of inhibin B compared to patients with deletions of ubiquitously expressed genes. The authors inferred that a specific alteration of germ cells only partially influences Sertoli cell function. The hormonal status of patients without deletions suggested that in such cases the cause of the spermatogenic defect may have damaged both Sertoli and germ cells. Inhibin B production in patients with Yq deletions was about 70% higher than in nondeleted patients, and the functional relationship between FSH and inhibin B was normally preserved.

Full details of the abovementioned studies are described in the following publications, the disclosure of which are hereby incorporated by reference:

Cooke, H. J.; Lee, M.; Kerr, S.; Ruggiu, M.: A murine homologue of the human DAZ gene is autosomal and expressed only in male and female gonads. Hum. Molec. Genet. 5:513-516, 1996; and Foresta, C.; Bertella, A.; Moro, E.; Roverato, A.; Merico, M.; Ferlin, A.: Sertoli cell function in infertile patients with and without microdeletions of the azoospermia factors on th.

Further studies establishing the function and utilities of DAZ are found in John Hopkins OMIM database record ID 400003, and in cited publications listed in Table 5, which are hereby incorporated by reference. Deleted in azoospermia (DAZ, Accession XP_088763.3) is another GAM104 target gene, herein designated TARGET GENE. DAZ BINDING SITE is a target binding site found in the 5' untranslated region of multiple transcripts of mRNA encoded by DAZ, corresponding to a target binding site such as BINDING SITE I, BINDING SITE II or BINDING SITE III of FIG. 8. Table 4 illustrates the complementarity of the nucleotide sequences of DAZ BINDING SITE, designated SEQ ID:2687, to the nucleotide sequence of GAM104 RNA, herein designated GAM RNA, also designated SEQ ID:355.

Another function of GAM104 is therefore inhibition of Deleted in azoospermia (DAZ, Accession XP_088763.3), a gene which may play a role in the germ-cell-specific patterns of RNA splicing and storage and therefore may be associated with Male infertility. Accordingly, utilities of GAM104 include diagnosis, prevention and treatment of Male infertility, and of other diseases and clinical conditions associated with DAZ.

The function of DAZ has been established by previous studies. Cooke et al. (1996) postulated that the DAZ gene product may play a role in the germ-cell-specific patterns of RNA splicing and storage. They isolated the mouse homolog of DAZ and mapped it by fluorescence in situ hybridization to chromosome 17 at position 25.6 cM. Cooke et al. (1996) reported that the predicted protein product of the mouse homolog is highly homologous to that of the human gene. By RT-PCR analysis, they established that transcripts occur only in mouse germ cells. Deletions of the azoospermia factors on the Y chromosome long arm are an important cause of male infertility, and they may involve germ cell-specific genes or ubiquitously expressed genes. Foresta et al. (2001) hypothesized that microdeletions involving genes specifically expressed in germ cells should not alter Sertoli cell function. To examine this, they evaluated the testicular hormonal function in infertile patients affected by severe testiculopathies with and without Yq microdeletions, with particular emphasis on Sertoli cell function. They studied 102 well-characterized infertile patients; 27 had Yq microdeletions, and 75 were classified as idiopathic infertiles. Patients with Yq microdeletions had lower FSH (see OMIM Ref. No. 136530) and higher inhibin B (see OMIM Ref. No. 147290) plasma concentrations compared to patients without microdeletions, suggesting that Sertoli cell function in Yq-deleted men is only partially altered. Furthermore, patients with deletions involving germ cell-specific genes had higher concentrations of inhibin B compared to patients with deletions of ubiquitously expressed genes. The authors inferred that a specific alteration of germ cells only partially influences Sertoli cell function. The hormonal status of patients without deletions suggested that in such cases the cause of the spermatogenic defect may have damaged both Sertoli and germ cells. Inhibin B production in patients with Yq deletions was about 70% higher than in nondeleted patients, and the functional relationship between FSH and inhibin B was normally preserved.

Full details of the abovementioned studies are described in the following publications, the disclosure of which are hereby incorporated by reference:

Cooke, H. J.; Lee, M.; Kerr, S.; Ruggiu, M.: A murine homologue of the human DAZ gene is autosomal and expressed only in male and female gonads. Hum. Molec. Genet. 5:513-516, 1996; and Foresta, C.; Bertella, A.; Moro, E.; Roverato, A.; Merico, M.; Ferlin, A.: Sertoli cell function in infertile patients with and without microdeletions of the azoospermia factors on th.

Further studies establishing the function and utilities of DAZ are found in John Hopkins OMIM database record ID 400003, and in cited publications listed in Table 5, which are hereby incorporated by reference. Deleted in azoospermia 2 (DAZ2, Accession NP_065096.1) is another GAM104 target gene, herein designated TARGET GENE. DAZ2 BINDING SITE is a target binding site found in the 5' untranslated region of mRNA encoded by DAZ2, corresponding to a target binding site such as BINDING SITE I, BINDING SITE II or BINDING SITE III of FIG. 8. Table 4 illustrates the complementarity of the nucleotide sequences of DAZ2 BINDING SITE, designated SEQ ID:2687, to the nucleotide sequence of GAM104 RNA, herein designated GAM RNA, also designated SEQ ID:355.

Another function of GAM104 is therefore inhibition of Deleted in azoospermia 2 (DAZ2, Accession NP_065096.1). Accordingly, utilities of GAM104 include diagnosis, prevention and treatment of diseases and clinical conditions associated with DAZ2.

Deleted in azoospermia 3 (DAZ3, Accession NP_065097.1) is another GAM104 target gene, herein designated TARGET GENE. DAZ3 BINDING SITE is a target binding site found in the 5' untranslated region of mRNA encoded by DAZ3, corresponding to a target binding site such as BINDING SITE I, BINDING SITE II or BINDING SITE III of FIG. 8. Table 4 illustrates the complementarity of the nucleotide sequences of DAZ3 BINDING SITE, designated SEQ ID:2687, to the nucleotide sequence of GAM104 RNA, herein designated GAM RNA, also designated SEQ ID:355.

Another function of GAM104 is therefore inhibition of Deleted in azoospermia 3 (DAZ3, Accession NP_065097.1). Accordingly, utilities of GAM104 include diagnosis, prevention and treatment of diseases and clinical conditions associated with DAZ3.

DKFZP566D1346 (Accession NP_110443.1) is another GAM104 target gene, herein designated TARGET GENE. DKFZP566D1346 BINDING SITE is a target binding site found in the 3' untranslated region of mRNA encoded by DKFZP566D1346, corresponding to a target binding site such as BINDING SITE I, BINDING SITE II or BINDING SITE III of FIG. 8. Table 4 illustrates the complementarity of the nucleotide sequences of DKFZP566D1346 BINDING SITE, designated SEQ ID:9349, to the nucleotide sequence of GAM104 RNA, herein designated GAM RNA, also designated SEQ ID:355.

Another function of GAM104 is therefore inhibition of DKFZP566D1346 (Accession NP_110443.1). Accordingly, utilities of GAM104 include diagnosis, prevention and treatment of diseases and clinical conditions associated with DKFZP566D1346.

DKFZP586C1324 (Accession XP_045876.1) is another GAM104 target gene, herein designated TARGET GENE. DKFZP586C1324 BINDING SITE is a target binding site found in the 3' untranslated region of mRNA encoded by DKFZP586C1324, corresponding to a target binding site such as BINDING SITE I, BINDING SITE II or BINDING SITE III of FIG. 8. Table 4 illustrates the complementarity of the nucleotide sequences of DKFZP586C1324 BINDING SITE, designated SEQ ID:2243, to the nucleotide sequence of GAM104 RNA, herein designated GAM RNA, also designated SEQ ID:355.

Another function of GAM104 is therefore inhibition of DKFZP586C1324 (Accession XP_045876.1). Accordingly, utilities of GAM104 include diagnosis, prevention and treatment of diseases and clinical conditions associated with DKFZP586C1324.

DKFZP586M0622 (Accession NP_056398.1) is another GAM104 target gene, herein designated TARGET GENE. DKFZP586M0622 BINDING SITE is a target binding site found in the 3' untranslated region of mRNA encoded by DKFZP586M0622, corresponding to a target binding site such as BINDING SITE I, BINDING SITE II or BINDING SITE III of FIG. 8. Table 4 illustrates the complementarity of the nucleotide sequences of DKFZP586M0622 BINDING SITE, designated SEQ ID:15334, to the nucleotide sequence of GAM104 RNA, herein designated GAM RNA, also designated SEQ ID:355.

Another function of GAM104 is therefore inhibition of DKFZP586M0622 (Accession NP_056398.1). Accordingly, utilities of GAM104 include diagnosis, prevention and treatment of diseases and clinical conditions associated with DKFZP586M0622.

DKFZp761D112 (Accession NP_115673.1) is another GAM104 target gene, herein designated TARGET GENE. DKFZp761D112 BINDING SITE is a target binding site found in the 3' untranslated region of mRNA encoded by DKFZp761D112, corresponding to a target binding site such as BINDING SITE I, BINDING SITE II or BINDING SITE III of FIG. 8. Table 4 illustrates the complementarity of the nucleotide sequences of DKFZp761D112 BINDING SITE, designated SEQ ID:10890, to the nucleotide sequence of GAM104 RNA, herein designated GAM RNA, also designated SEQ ID:355.

Another function of GAM104 is therefore inhibition of DKFZp761D112 (Accession NP_115673.1). Accordingly, utilities of GAM104 include diagnosis, prevention and treatment of diseases and clinical conditions associated with DKFZp761D112.

Endothelin 3 (EDN3, Accession NP_000105.1) is another GAM104 target gene, herein designated TARGET GENE. EDN3 BINDING SITE is a target binding site found in the 3' untranslated region of mRNA encoded by EDN3, corresponding to a target binding site such as BINDING SITE I, BINDING SITE II or BINDING SITE III of FIG. 8. Table 4 illustrates the complementarity of the nucleotide sequences of EDN3 BINDING SITE, designated SEQ ID:20067, to the nucleotide sequence of GAM104 RNA, herein designated GAM RNA, also designated SEQ ID:355.

Another function of GAM104 is therefore inhibition of Endothelin 3 (EDN3, Accession NP_000105.1). Accordingly, utilities of GAM104 include diagnosis, prevention and treatment of diseases and clinical conditions associated with EDN3.

Fatty-acid-coenzyme a ligase, long-chain 4 (FACL4, Accession NP_004449.1) is another GAM104 target gene, herein designated TARGET GENE. FACL4 BINDING SITE is a target binding site found in the 3' untranslated region of multiple transcripts of mRNA encoded by FACL4, corresponding to a target binding site such as BINDING SITE I, BINDING SITE II or BINDING SITE III of FIG. 8. Table 4 illustrates the complementarity of the nucleotide sequences of FACL4 BINDING SITE, designated SEQ ID:19125, to the nucleotide sequence of GAM104 RNA, herein designated GAM RNA, also designated SEQ ID:355.

Another function of GAM104 is therefore inhibition of Fatty-acid-coenzyme a ligase, long-chain 4 (FACL4, Accession NP_004449.1) . Accordingly, utilities of GAM104 include diagnosis, prevention and treatment of diseases and clinical conditions associated with FACL4.

Fatty-acid-coenzyme a ligase, long-chain 4 (FACL4, Accession NP_075266.1) is another GAM104 target gene, herein designated TARGET GENE. FACL4 BINDING SITE is a target binding site found in the 3' untranslated region of multiple transcripts of mRNA encoded by FACL4, corresponding to a target binding site such as BINDING SITE I, BINDING SITE II or BINDING SITE III of FIG. 8. Table 4 illustrates the complementarity of the nucleotide sequences of FACL4 BINDING SITE, designated SEQ ID:19125, to the nucleotide sequence of GAM104 RNA, herein designated GAM RNA, also designated SEQ ID:355.

Another function of GAM104 is therefore inhibition of Fatty-acid-coenzyme a ligase, long-chain 4 (FACL4, Accession NP_075266.1) . Accordingly, utilities of GAM104 include diagnosis, prevention and treatment of diseases and clinical conditions associated with FACL4.

FBXW8 (Accession NP_699179.2) is another GAM104 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:2739, to the nucleotide sequence of GAM104 RNA, herein designated GAM RNA, also designated SEQ ID:355.

Another function of GAM104 is therefore inhibition of FBXW8 (Accession NP_699179.2). Accordingly, utilities of GAM104 include diagnosis, prevention and treatment of diseases and clinical conditions associated with FBXW8.

FBXW8 (Accession NP_036306.1) is another GAM104 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:2739, to the nucleotide sequence of GAM104 RNA, herein designated GAM RNA, also designated SEQ ID:355.

Another function of GAM104 is therefore inhibition of FBXW8 (Accession NP_036306.1). Accordingly, utilities of GAM104 include diagnosis, prevention and treatment of diseases and clinical conditions associated with FBXW8.

FLJ10970 (Accession NP_060756.1) is another GAM104 target gene, herein designated TARGET GENE. FLJ10970 BINDING SITE is a target binding site found in the 3' untranslated region of mRNA encoded by FLJ10970, corresponding to a target binding site such as BINDING SITE I, BINDING SITE II or BINDING SITE III of FIG. 8. Table 4 illustrates the complementarity of the nucleotide sequences of FLJ10970 BINDING SITE, designated SEQ ID:11476, to the nucleotide sequence of GAM104 RNA, herein designated GAM RNA, also designated SEQ ID:355.

Another function of GAM104 is therefore inhibition of FLJ10970 (Accession NP_060756.1). Accordingly, utilities of GAM104 include diagnosis, prevention and treatment of diseases and clinical conditions associated with FLJ10970.

FLJ14825 (Accession NP_116236.1) is another GAM104 target gene, herein designated TARGET GENE. FLJ14825 BINDING SITE is a target binding site found in the 3' untranslated region of mRNA encoded by FLJ14825, corresponding to a target binding site such as BINDING SITE I, BINDING SITE II or BINDING SITE III of FIG. 8. Table 4 illustrates the complementarity of the nucleotide sequences of FLJ14825 BINDING SITE, designated SEQ ID:7343, to the nucleotide sequence of GAM104 RNA, herein designated GAM RNA, also designated SEQ ID:355.

Another function of GAM104 is therefore inhibition of FLJ14825 (Accession NP_116236.1). Accordingly, utilities of GAM104 include diagnosis, prevention and treatment of diseases and clinical conditions associated with FLJ14825.

FLJ20445 (Accession NP_060294.1) is another GAM104 target gene, herein designated TARGET GENE. FLJ20445 BINDING SITE is a target binding site found in the 3' untranslated region of mRNA encoded by FLJ20445, corresponding to a target binding site such as BINDING SITE I, BINDING SITE II or BINDING SITE III of FIG. 8. Table 4 illustrates the complementarity of the nucleotide sequences of FLJ20445 BINDING SITE, designated SEQ ID:18174, to the nucleotide sequence of GAM104 RNA, herein designated GAM RNA, also designated SEQ ID:355.

Another function of GAM104 is therefore inhibition of FLJ20445 (Accession NP_060294.1). Accordingly, utilities of GAM104 include diagnosis, prevention and treatment of diseases and clinical conditions associated with FLJ20445.

FLJ23462 (Accession NP_079119.2) is another GAM104 target gene, herein designated TARGET GENE. FLJ23462 BINDING SITE is a target binding site found in the 3' untranslated region of mRNA encoded by FLJ23462, corresponding to a target binding site such as BINDING SITE I, BINDING SITE II or BINDING SITE III of FIG. 8. Table 4 illustrates the complementarity of the nucleotide sequences of FLJ23462 BINDING SITE, designated SEQ ID:12718, to the nucleotide sequence of GAM104 RNA, herein designated GAM RNA, also designated SEQ ID:355.

Another function of GAM104 is therefore inhibition of FLJ23462 (Accession NP_079119.2). Accordingly, utilities of GAM104 include diagnosis, prevention and treatment of diseases and clinical conditions associated with FLJ23462.

Forkhead box e2 (FOXE2, Accession NP_036317.1) is another GAM104 target gene, herein designated TARGET GENE. FOXE2 BINDING SITE is a target binding site found in the 5' untranslated region of mRNA encoded by FOXE2, corresponding to a target binding site such as BINDING SITE I, BINDING SITE II or BINDING SITE III of FIG. 8. Table 4 illustrates the complementarity of the nucleotide sequences of FOXE2 BINDING SITE, designated SEQ ID:10393, to the nucleotide sequence of GAM104 RNA, herein designated GAM RNA, also designated SEQ ID:355.

Another function of GAM104 is therefore inhibition of Forkhead box e2 (FOXE2, Accession NP_036317.1). Accordingly, utilities of GAM104 include diagnosis, prevention and treatment of diseases and clinical conditions associated with FOXE2.

GALNT13 (Accession XP_054951.3) is another GAM104 target gene, herein designated TARGET GENE. GALNT13 BINDING SITE is a target binding site found in the 3' untranslated region of mRNA encoded by GALNT13, corresponding to a target binding site such as BINDING SITE I, BINDING SITE II or BINDING SITE III of FIG. 8. Table 4 illustrates the complementarity of the nucleotide sequences of GALNT13 BINDING SITE, designated SEQ ID:3213, to the nucleotide sequence of GAM104 RNA, herein designated GAM RNA, also designated SEQ ID:355.

Another function of GAM104 is therefore inhibition of GALNT13 (Accession XP_054951.3). Accordingly, utilities of GAM104 include diagnosis, prevention and treatment of diseases and clinical conditions associated with GALNT13.

Golgi complex associated protein 1, 60 kda (GOCAP1, Accession NP_073572.2) is another GAM104 target gene, herein designated TARGET GENE. GOCAP1 BINDING SITE is a target binding site found in the 3' untranslated region of mRNA encoded by GOCAP1, corresponding to a target binding site such as BINDING SITE I, BINDING SITE II or BINDING SITE III of FIG. 8. Table 4 illustrates the complementarity of the nucleotide sequences of GOCAP1 BINDING SITE, designated SEQ ID:19496, to the nucleotide sequence of GAM104 RNA, herein designated GAM RNA, also designated SEQ ID:355.

Another function of GAM104 is therefore inhibition of Golgi complex associated protein 1, 60 kda (GOCAP1, Accession NP_073572.2). Accordingly, utilities of GAM104 include diagnosis, prevention and treatment of diseases and clinical conditions associated with GOCAP1.

Glutamate receptor, metabotropic 7 (GRM7, Accession NP_000835.1) is another GAM104 target gene, herein designated TARGET GENE. GRM7 BINDING SITE is a target binding site found in the 3' untranslated region of mRNA encoded by GRM7, corresponding to a target binding site such as BINDING SITE I, BINDING SITE II or BINDING SITE III of FIG. 8. Table 4 illustrates the complementarity of the nucleotide sequences of GRM7 BINDING SITE, designated SEQ ID:862, to the nucleotide sequence of GAM104 RNA, herein designated GAM RNA, also designated SEQ ID:355.

Another function of GAM104 is therefore inhibition of Glutamate receptor, metabotropic 7 (GRM7, Accession NP_000835.1), a gene which is mediated by a g-protein that inhibits adenylate cyclase activity. Accordingly, utilities of GAM104 include diagnosis, prevention and treatment of diseases and clinical conditions associated with GRM7.

The function of GRM7 has been established by previous studies. L-glutamate, a major excitatory neurotransmitter, interacts with both ionotropic and metabotropic glutamate receptors. See mGluR3 (OMIM Ref. No. 601115). The metabotropic glutamate receptors (OMIM Ref. No. mGluRs), which are G protein-coupled receptors, have been divided into 3 groups on the basis of sequence homology, putative signal transduction mechanisms, and pharmacologic properties. Group II and group III mGluRs are linked to the inhibition of the cyclic AMP cascade, but differ in their agonist selectivities. Okamoto et al. (1994) isolated cDNAs encoding rat mGluR7. The predicted mGluR7 protein shares the structural profile of other mGluRs, with a signal peptide and a large extracellular domain followed by 7 membrane-spanning domains. This receptor shows a high degree of similarity to the group III receptors mGluR4 (OMIM Ref. No. 604100) and mGluR6 (OMIM Ref. No. 604096) in terms of both amino acid sequence and agonist selectivity. In situ hybridization to rat brain tissues indicated that the mGluR7 gene is expressed widely, unlike mGluR4 and mGluR6. Wu et al. (1998) and Makoff et al. (1996) isolated human brain cDNAs encoding mGluR7. They both reported that the predicted 915-amino acid human protein is 99% identical to rat mGluR7. Wu et al. (1998) stated that the group III human receptors, mGluR7, mGluR4, and mGluR8 (OMIM Ref. No. 601116), share 67 to 70% protein sequence similarity with each other and 42 to 45% similarity with the group I and group II receptors. Using in situ hybridization, Makoff et al. (1996) determined that mGluR7 is expressed in many areas of the human brain, especially in the cerebral cortex, hippocampus, and cerebellum.

Full details of the abovementioned studies are described in the following publications, the disclosure of which are hereby incorporated by reference:

Okamoto, N.; Hori, S.; Akazawa, C.; Hayashi, Y.; Shigemoto, R.; Mizuno, N.; Nakanishi, S.: Molecular characterization of a new metabotropic glutamate receptor mGluR7 coupled to inhibitory cyclic AMP signal transduction. J. Biol. Chem. 269:1231-1236, 1994; and Wu, S.; Wright, R. A.; Rockey, P. K.; Burgett, S. G.; Arnold, J. S.; Rosteck, P. R., Jr.; Johnson, B. G.; Schoepp, D. D.; Belagaje, R. M.: Group III human metabotropic glutamate recept.

Further studies establishing the function and utilities of GRM7 are found in John Hopkins OMIM database record ID 604101, and in cited publications listed in Table 5, which are hereby incorporated by reference. H17739 (Accession NP_542403.1) is another GAM104 target gene, herein designated TARGET GENE. H17739 BINDING SITE is a target binding site found in the 3' untranslated region of mRNA encoded by H17739, corresponding to a target binding site such as BINDING SITE I, BINDING SITE II or BINDING SITE III of FIG. 8. Table 4 illustrates the complementarity of the nucleotide sequences of H17739 BINDING SITE, designated SEQ ID:10958, to the nucleotide sequence of GAM104 RNA, herein designated GAM RNA, also designated SEQ ID:355.

Another function of GAM104 is therefore inhibition of H17739 (Accession NP_542403.1). Accordingly, utilities of GAM104 include diagnosis, prevention and treatment of diseases and clinical conditions associated with H17739.

Inhibitor of growth family, member 1 (ING1, Accession NP_005528.2) is another GAM104 target gene, herein designated TARGET GENE. ING1 BINDING SITE is a target binding site found in the 3' untranslated region of mRNA encoded by ING1, corresponding to a target binding site such as BINDING SITE I, BINDING SITE II or BINDING SITE III of FIG. 8. Table 4 illustrates the complementarity of the nucleotide sequences of ING1 BINDING SITE, designated SEQ ID:15187, to the nucleotide sequence of GAM104 RNA, herein designated GAM RNA, also designated SEQ ID:355.

Another function of GAM104 is therefore inhibition of Inhibitor of growth family, member 1 (ING1, Accession NP_005528.2), a gene which acts as a potent growth regulator in normal and in established cells. and therefore may be associated with Squamous cell carcinoma. Accordingly, utilities of GAM104 include diagnosis, prevention and treatment of Squamous cell carcinoma, and of other diseases and clinical conditions associated with ING1.

The function of ING1 has been established by previous studies. Garkavtsev et al. (1996) described a new strategy for the isolation of tumor suppressor genes. This strategy was based on subtractive hybridization followed by selection of transforming genetic suppressor elements. It was used to isolate a novel gene called ING1 which encodes a 33-kD protein (294 amino acids) that displays the characteristics of a tumor suppressor gene. Garkavtsev et al. (1996) reported that expression of high levels of transfected constructs of this gene inhibited growth, while chronic expression of antisense constructs promoted cell transformation. They observed reduced expression of ING1 in some breast cancer cell lines and mutation of ING1 in neuroblastoma cells. Garkavtsev et al. (1997) showed, using indirect immunofluorescence, that the p33(ING1) protein is located in the nucleus, which is consistent with its proposed role as a growth regulator. By fluorescence in situ hybridization, they localized the ING1 gene to 13q33-q34. Using the radiation hybrid mapping technique, Zeremski et al. (1997) mapped ING1 to 13q34.

Full details of the abovementioned studies are described in the following publications, the disclosure of which are hereby incorporated by reference:

Garkavtsev, I.; Kazarov, A.; Gudkov, A.; Riabowol, K.: Suppression of the novel growth inhibitor p33(ING1) promotes neoplastic transformation. Nature Genet. 14:415-420, 1996. Note: Erratum: Nature Genet. 23:373 only, 1999; and Gunduz, M.; Ouchida, M.; Fukushima, K.; Hanafusa, H.; Etani, T.; Nishioka, S.; Nishizaki, K.; Shimizu, K.: Genomic structure of the human ING1 gene and tumor- specific mutations detected.

Further studies establishing the function and utilities of ING1 are found in John Hopkins OMIM database record ID 601566, and in cited publications listed in Table 5, which are hereby incorporated by reference. Jun d proto - oncogene (JUND, Accession NP_005345.2) is another GAM104 target gene, herein designated TARGET GENE. JUND BINDING SITE1 and JUND BINDING SITE2 are target binding sites found in untranslated regions of mRNA encoded by JUND, corresponding to target binding sites such as BINDING SITE I, BINDING SITE II or BINDING SITE III of FIG. 8. Table 4 illustrates the complementarity of the nucleotide sequences of JUND BINDING SITE1 and JUND BINDING SITE2, designated SEQ ID:3027 and SEQ ID:15023 respectively, to the nucleotide sequence of GAM104 RNA, herein designated GAM RNA, also designated SEQ ID:355.

Another function of GAM104 is therefore inhibition of Jun d proto - oncogene (JUND, Accession NP_005345.2), a gene which binds an ap-1 site. Accordingly, utilities of GAM104 include diagnosis, prevention and treatment of diseases and clinical conditions associated with JUND.

The function of JUND has been established by previous studies. JUND is the most broadly expressed member of the JUN family and the AP1 transcription factor complex (see OMIM Ref. No. 165160). Weitzman et al. (2000) found that primary fibroblasts lacking murine Jund displayed p53 (OMIM Ref. No. 191170)- dependent growth arrest, upregulated p19(ARF) (see OMIM Ref. No. 600160) expression, and premature senescence. In contrast, immortalized cell lines lacking Jund showed increased proliferation and higher cyclin D1 (CCND1; 168461) levels. These properties were reminiscent of the effects of oncogenic RAS (OMIM Ref. No. 190020) expression on primary and established cell cultures. Furthermore, Jund -/- fibroblasts exhibited increased p53-dependent apoptosis upon ultraviolet irradiation and were sensitive to the cytotoxic effects of tumor necrosis factor-alpha (TNF; 191160). The antiapoptotic role of JUND was confirmed using an in vivo model of TNF-mediated hepatitis. The authors proposed that JUND protects cells from senescence, or apoptotic responses to stress stimuli, by acting as a modulator of the signaling pathways that link RAS to p53. By fluorescence in situ hybridization, Trask et al. (1993) assigned the JUND gene to 19p13.1-p12. Sullivan et al. (1999) found that the JUND gene contains no introns and is located about 27 kb proximal to PDE4C (OMIM Ref. No. 600128).

Full details of the abovementioned studies are described in the following publications, the disclosure of which are hereby incorporated by reference:

Sullivan, M.; Olsen, A. S.; Houslay, M. D.: Genomic organisation of the human cyclic AMP-specific phosphodiesterase PDE4C gene and its chromosomal localisation to 19p13.1, between RAB3A and JUND. Cell. Signal. 11:735-742, 1999; and Weitzman, J. B.; Fiette, L.; Matsuo, K.; Yaniv, M.: JunD protects cells from p53-dependent senescence and apoptosis. Molec. Cell 6:1109-1119, 2000.

Further studies establishing the function and utilities of JUND are found in John Hopkins OMIM database record ID 165162, and in cited publications listed in Table 5, which are hereby incorporated by reference. KIAA1243 (Accession NP_054767.1) is another GAM104 target gene, herein designated TARGET GENE. KIAA1243 BINDING SITE is a target binding site found in the 3' untranslated region of mRNA encoded by KIAA1243, corresponding to a target binding site such as BINDING SITE I, BINDING SITE II or BINDING SITE III of FIG. 8. Table 4 illustrates the complementarity of the nucleotide sequences of KIAA1243 BINDING SITE, designated SEQ ID:18193, to the nucleotide sequence of GAM104 RNA, herein designated GAM RNA, also designated SEQ ID:355.

Another function of GAM104 is therefore inhibition of KIAA1243 (Accession NP_054767.1). Accordingly, utilities of GAM104 include diagnosis, prevention and treatment of diseases and clinical conditions associated with KIAA1243.

KIAA1456 (Accession XP_040100.3) is another GAM104 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:13381, to the nucleotide sequence of GAM104 RNA, herein designated GAM RNA, also designated SEQ ID:355.

Another function of GAM104 is therefore inhibition of KIAA1456 (Accession XP_040100.3). Accordingly, utilities of GAM104 include diagnosis, prevention and treatment of diseases and clinical conditions associated with KIAA1456.

KIAA1465 (Accession XP_027396.4) is another GAM104 target gene, herein designated TARGET GENE. KIAA1465 BINDING SITE is a target binding site found in the 3' untranslated region of mRNA encoded by KIAA1465, corresponding to a target binding site such as BINDING SITE I, BINDING SITE II or BINDING SITE III of FIG. 8. Table 4 illustrates the complementarity of the nucleotide sequences of KIAA1465 BINDING SITE, designated SEQ ID:10494, to the nucleotide sequence of GAM104 RNA, herein designated GAM RNA, also designated SEQ ID:355.

Another function of GAM104 is therefore inhibition of KIAA1465 (Accession XP_027396.4). Accordingly, utilities of GAM104 include diagnosis, prevention and treatment of diseases and clinical conditions associated with KIAA1465.

KIAA1486 (Accession XP_041126.4) is another GAM104 target gene, herein designated TARGET GENE. KIAA1486 BINDING SITE is a target binding site found in the 3' untranslated region of mRNA encoded by KIAA1486, corresponding to a target binding site such as BINDING SITE I, BINDING SITE II or BINDING SITE III of FIG. 8. Table 4 illustrates the complementarity of the nucleotide sequences of KIAA1486 BINDING SITE, designated SEQ ID:19705, to the nucleotide sequence of GAM104 RNA, herein designated GAM RNA, also designated SEQ ID:355.

Another function of GAM104 is therefore inhibition of KIAA1486 (Accession XP_041126.4). Accordingly, utilities of GAM104 include diagnosis, prevention and treatment of diseases and clinical conditions associated with KIAA1486.

KIAA1998 (Accession XP_068710.3) is another GAM104 target gene, herein designated TARGET GENE. KIAA1998 BINDING SITE is a target binding site found in the 3' untranslated region of mRNA encoded by KIAA1998, corresponding to a target binding site such as BINDING SITE I, BINDING SITE II or BINDING SITE III of FIG. 8. Table 4 illustrates the complementarity of the nucleotide sequences of KIAA1998 BINDING SITE, designated SEQ ID:17442, to the nucleotide sequence of GAM104 RNA, herein designated GAM RNA, also designated SEQ ID:355.

Another function of GAM104 is therefore inhibition of KIAA1998 (Accession XP_068710.3). Accordingly, utilities of GAM104 include diagnosis, prevention and treatment of diseases and clinical conditions associated with KIAA1998.

LOC114928 (Accession NP_612446.1) is another GAM104 target gene, herein designated TARGET GENE. LOC114928 BINDING SITE is a target binding site found in the 3' untranslated region of mRNA encoded by LOC114928, corresponding to a target binding site such as BINDING SITE I, BINDING SITE II or BINDING SITE III of FIG. 8. Table 4 illustrates the complementarity of the nucleotide sequences of LOC114928 BINDING SITE, designated SEQ ID:17875, to the nucleotide sequence of GAM104 RNA, herein designated GAM RNA, also designated SEQ ID:355.

Another function of GAM104 is therefore inhibition of LOC114928 (Accession NP_612446.1). Accordingly, utilities of GAM104 include diagnosis, prevention and treatment of diseases and clinical conditions associated with LOC114928.

LOC143891 (Accession XP_084661.3) is another GAM104 target gene, herein designated TARGET GENE. LOC143891 BINDING SITE is a target binding site found in the 3' untranslated region of mRNA encoded by LOC143891, corresponding to a target binding site such as BINDING SITE I, BINDING SITE II or BINDING SITE III of FIG. 8. Table 4 illustrates the complementarity of the nucleotide sequences of LOC143891 BINDING SITE, designated SEQ ID:6237, to the nucleotide sequence of GAM104 RNA, herein designated GAM RNA, also designated SEQ ID:355.

Another function of GAM104 is therefore inhibition of LOC143891 (Accession XP_084661.3). Accordingly, utilities of GAM104 include diagnosis, prevention and treatment of diseases and clinical conditions associated with LOC143891.

LOC158376 (Accession XP_098934.1) is another GAM104 target gene, herein designated TARGET GENE. LOC158376 BINDING SITE is a target binding site found in the 3' untranslated region of mRNA encoded by LOC158376, corresponding to a target binding site such as BINDING SITE I, BINDING SITE II or BINDING SITE III of FIG. 8. Table 4 illustrates the complementarity of the nucleotide sequences of LOC158376 BINDING SITE, designated SEQ ID:20082, to the nucleotide sequence of GAM104 RNA, herein designated GAM RNA, also designated SEQ ID:355.

Another function of GAM104 is therefore inhibition of LOC158376 (Accession XP_098934.1). Accordingly, utilities of GAM104 include diagnosis, prevention and treatment of diseases and clinical conditions associated with LOC158376.

LOC282921 (Accession XP_212571.1) is another GAM104 target gene, herein designated TARGET GENE. LOC282921 BINDING SITE is a target binding site found in the 3' untranslated region of mRNA encoded by LOC282921, corresponding to a target binding site such as BINDING SITE I, BINDING SITE II or BINDING SITE III of FIG. 8. Table 4 illustrates the complementarity of the nucleotide sequences of LOC282921 BINDING SITE, designated SEQ ID:7126, to the nucleotide sequence of GAM104 RNA, herein designated GAM RNA, also designated SEQ ID:355.

Another function of GAM104 is therefore inhibition of LOC282921 (Accession XP_212571.1). Accordingly, utilities of GAM104 include diagnosis, prevention and treatment of diseases and clinical conditions associated with LOC282921.

LOC282957 (Accession XP_212619.1) is another GAM104 target gene, herein designated TARGET GENE. LOC282957 BINDING SITE is a target binding site found in the 3' untranslated region of mRNA encoded by LOC282957, corresponding to a target binding site such as BINDING SITE I, BINDING SITE II or BINDING SITE III of FIG. 8. Table 4 illustrates the complementarity of the nucleotide sequences of LOC282957 BINDING SITE, designated SEQ ID:7126, to the nucleotide sequence of GAM104 RNA, herein designated GAM RNA, also designated SEQ ID:355.

Another function of GAM104 is therefore inhibition of LOC282957 (Accession XP_212619.1). Accordingly, utilities of GAM104 include diagnosis, prevention and treatment of diseases and clinical conditions associated with LOC282957.

LOC282963 (Accession XP_210834.1) is another GAM104 target gene, herein designated TARGET GENE. LOC282963 BINDING SITE is a target binding site found in the 3' untranslated region of mRNA encoded by LOC282963, corresponding to a target binding site such as BINDING SITE I, BINDING SITE II or BINDING SITE III of FIG. 8. Table 4 illustrates the complementarity of the nucleotide sequences of LOC282963 BINDING SITE, designated SEQ ID:7981, to the nucleotide sequence of GAM104 RNA, herein designated GAM RNA, also designated SEQ ID:355.

Another function of GAM104 is therefore inhibition of LOC282963 (Accession XP_210834.1). Accordingly, utilities of GAM104 include diagnosis, prevention and treatment of diseases and clinical conditions associated with LOC282963.

LOC283678 (Accession XP_211159.2) is another GAM104 target gene, herein designated TARGET GENE. LOC283678 BINDING SITE is a target binding site found in the 3' untranslated region of mRNA encoded by LOC283678, corresponding to a target binding site such as BINDING SITE I, BINDING SITE II or BINDING SITE III of FIG. 8. Table 4 illustrates the complementarity of the nucleotide sequences of LOC283678 BINDING SITE, designated SEQ ID:2214, to the nucleotide sequence of GAM104 RNA, herein designated GAM RNA, also designated SEQ ID:355.

Another function of GAM104 is therefore inhibition of LOC283678 (Accession XP_211159.2). Accordingly, utilities of GAM104 include diagnosis, prevention and treatment of diseases and clinical conditions associated with LOC283678.

LOC284892 (Accession XP_211673.1) is another GAM104 target gene, herein designated TARGET GENE. LOC284892 BINDING SITE is a target binding site found in the 5' untranslated region of mRNA encoded by LOC284892, corresponding to a target binding site such as BINDING SITE I, BINDING SITE II or BINDING SITE III of FIG. 8. Table 4 illustrates the complementarity of the nucleotide sequences of LOC284892 BINDING SITE, designated SEQ ID:1220, to the nucleotide sequence of GAM104 RNA, herein designated GAM RNA, also designated SEQ ID:355.

Another function of GAM104 is therefore inhibition of LOC284892 (Accession XP_211673.1). Accordingly, utilities of GAM104 include diagnosis, prevention and treatment of diseases and clinical conditions associated with LOC284892.

LOC285837 (Accession XP_209780.1) is another GAM104 target gene, herein designated TARGET GENE. LOC285837 BINDING SITE is a target binding site found in the 3' untranslated region of mRNA encoded by LOC285837, corresponding to a target binding site such as BINDING SITE I, BINDING SITE II or BINDING SITE III of FIG. 8. Table 4 illustrates the complementarity of the nucleotide sequences of LOC285837 BINDING SITE, designated SEQ ID:7126, to the nucleotide sequence of GAM104 RNA, herein designated GAM RNA, also designated SEQ ID:355.

Another function of GAM104 is therefore inhibition of LOC285837 (Accession XP_209780.1). Accordingly, utilities of GAM104 include diagnosis, prevention and treatment of diseases and clinical conditions associated with LOC285837.

LOC285952 (Accession XP_209821.1) is another GAM104 target gene, herein designated TARGET GENE. LOC285952 BINDING SITE is a target binding site found in the 3' untranslated region of mRNA encoded by LOC285952, corresponding to a target binding site such as BINDING SITE I, BINDING SITE II or BINDING SITE III of FIG. 8. Table 4 illustrates the complementarity of the nucleotide sequences of LOC285952 BINDING SITE, designated SEQ ID:3485, to the nucleotide sequence of GAM104 RNA, herein designated GAM RNA, also designated SEQ ID:355.

Another function of GAM104 is therefore inhibition of LOC285952 (Accession XP_209821.1). Accordingly, utilities of GAM104 include diagnosis, prevention and treatment of diseases and clinical conditions associated with LOC285952.

LOC285953 (Accession XP_209820.1) is another GAM104 target gene, herein designated TARGET GENE. LOC285953 BINDING SITE is a target binding site found in the 3' untranslated region of mRNA encoded by LOC285953, corresponding to a target binding site such as BINDING SITE I, BINDING SITE II or BINDING SITE III of FIG. 8. Table 4 illustrates the complementarity of the nucleotide sequences of LOC285953 BINDING SITE, designated SEQ ID:14299, to the nucleotide sequence of GAM104 RNA, herein designated GAM RNA, also designated SEQ ID:355.

Another function of GAM104 is therefore inhibition of LOC285953 (Accession XP_209820.1). Accordingly, utilities of GAM104 include diagnosis, prevention and treatment of diseases and clinical conditions associated with LOC285953.

LOC338819 (Accession XP_290216.1) is another GAM104 target gene, herein designated TARGET GENE. LOC338819 BINDING SITE is a target binding site found in the 3' untranslated region of mRNA encoded by LOC338819, corresponding to a target binding site such as BINDING SITE I, BINDING SITE II or BINDING SITE III of FIG. 8. Table 4 illustrates the complementarity of the nucleotide sequences of LOC338819 BINDING SITE, designated SEQ ID:13795, to the nucleotide sequence of GAM104 RNA, herein designated GAM RNA, also designated SEQ ID:355.

Another function of GAM104 is therefore inhibition of LOC338819 (Accession XP_290216.1). Accordingly, utilities of GAM104 include diagnosis, prevention and treatment of diseases and clinical conditions associated with LOC338819.

LOC340628 (Accession XP_291365.1) is another GAM104 target gene, herein designated TARGET GENE. LOC340628 BINDING SITE is a target binding site found in the 5' untranslated region of mRNA encoded by LOC340628, corresponding to a target binding site such as BINDING SITE I, BINDING SITE II or BINDING SITE III of FIG. 8. Table 4 illustrates the complementarity of the nucleotide sequences of LOC340628 BINDING SITE, designated SEQ ID:2687, to the nucleotide sequence of GAM104 RNA, herein designated GAM RNA, also designated SEQ ID:355.

Another function of GAM104 is therefore inhibition of LOC340628 (Accession XP_291365.1). Accordingly, utilities of GAM104 include diagnosis, prevention and treatment of diseases and clinical conditions associated with LOC340628.

LOC348480 (Accession XP_302773.1) is another GAM104 target gene, herein designated TARGET GENE. LOC348480 BINDING SITE is a target binding site found in the 3' untranslated region of mRNA encoded by LOC348480, corresponding to a target binding site such as BINDING SITE I, BINDING SITE II or BINDING SITE III of FIG. 8. Table 4 illustrates the complementarity of the nucleotide sequences of LOC348480 BINDING SITE, designated SEQ ID:6255, to the nucleotide sequence of GAM104 RNA, herein designated GAM RNA, also designated SEQ ID:355.

Another function of GAM104 is therefore inhibition of LOC348480 (Accession XP_302773.1). Accordingly, utilities of GAM104 include diagnosis, prevention and treatment of diseases and clinical conditions associated with LOC348480.

LOC348687 (Accession XP_302853.1) is another GAM104 target gene, herein designated TARGET GENE. LOC348687 BINDING SITE is a target binding site found in the 3' untranslated region of mRNA encoded by LOC348687, corresponding to a target binding site such as BINDING SITE I, BINDING SITE II or BINDING SITE III of FIG. 8. Table 4 illustrates the complementarity of the nucleotide sequences of LOC348687 BINDING SITE, designated SEQ ID:6408, to the nucleotide sequence of GAM104 RNA, herein designated GAM RNA, also designated SEQ ID:355.

Another function of GAM104 is therefore inhibition of LOC348687 (Accession XP_302853.1). Accordingly, utilities of GAM104 include diagnosis, prevention and treatment of diseases and clinical conditions associated with LOC348687.

LOC51136 (Accession NP_057209.2) is another GAM104 target gene, herein designated TARGET GENE. LOC51136 BINDING SITE is a target binding site found in the 3' untranslated region of mRNA encoded by LOC51136, corresponding to a target binding site such as BINDING SITE I, BINDING SITE II or BINDING SITE III of FIG. 8. Table 4 illustrates the complementarity of the nucleotide sequences of LOC51136 BINDING SITE, designated SEQ ID:11206, to the nucleotide sequence of GAM104 RNA, herein designated GAM RNA, also designated SEQ ID:355.

Another function of GAM104 is therefore inhibition of LOC51136 (Accession NP_057209.2). Accordingly, utilities of GAM104 include diagnosis, prevention and treatment of diseases and clinical conditions associated with LOC51136.

LoopADR (Accession NP_113624.1) is another GAM104 target gene, herein designated TARGET GENE. LoopADR BINDING SITE is a target binding site found in the 3' untranslated region of mRNA encoded by LoopADR, corresponding to a target binding site such as BINDING SITE I, BINDING SITE II or BINDING SITE III of FIG. 8. Table 4 illustrates the complementarity of the nucleotide sequences of LoopADR BINDING SITE, designated SEQ ID:3456, to the nucleotide sequence of GAM104 RNA, herein designated GAM RNA, also designated SEQ ID:355.

Another function of GAM104 is therefore inhibition of LoopADR (Accession NP_113624.1). Accordingly, utilities of GAM104 include diagnosis, prevention and treatment of diseases and clinical conditions associated with LoopADR.

MAPKBP1 (Accession XP_031706.7) is another GAM104 target gene, herein designated TARGET GENE. MAPKBP1 BINDING SITE is a target binding site found in the 3' untranslated region of mRNA encoded by MAPKBP1, corresponding to a target binding site such as BINDING SITE I, BINDING SITE II or BINDING SITE III of FIG. 8. Table 4 illustrates the complementarity of the nucleotide sequences of MAPKBP1 BINDING SITE, designated SEQ ID:12122, to the nucleotide sequence of GAM104 RNA, herein designated GAM RNA, also designated SEQ ID:355.

Another function of GAM104 is therefore inhibition of MAPKBP1 (Accession XP_031706.7). Accordingly, utilities of GAM104 include diagnosis, prevention and treatment of diseases and clinical conditions associated with MAPKBP1.

Meningioma (disrupted in balanced translocation) 1 (MN1, Accession NP_002421.2) is another GAM104 target gene, herein designated TARGET GENE. MN1 BINDING SITE1 and MN1 BINDING SITE2 are target binding sites found in untranslated regions of mRNA encoded by MN1, corresponding to target binding sites such as BINDING SITE I, BINDING SITE II or BINDING SITE III of FIG. 8. Table 4 illustrates the complementarity of the nucleotide sequences of MN1 BINDING SITE1 and MN1 BINDING SITE2, designated SEQ ID:5008 and SEQ ID:11831 respectively, to the nucleotide sequence of GAM104 RNA, herein designated GAM RNA, also designated SEQ ID:355.

Another function of GAM104 is therefore inhibition of Meningioma (disrupted in balanced translocation) 1 (MN1, Accession NP_002421.2). Accordingly, utilities of GAM104 include diagnosis, prevention and treatment of diseases and clinical conditions associated with MN1.

Nucleosome assembly protein 1-like 1 (NAP1L1, Accession NP_004528.1) is another GAM104 target gene, herein designated TARGET GENE. NAP1L1 BINDING SITE is a target binding site found in the 3' untranslated region of multiple transcripts of mRNA encoded by NAP1L1, corresponding to a target binding site such as BINDING SITE I, BINDING SITE II or BINDING SITE III of FIG. 8. Table 4 illustrates the complementarity of the nucleotide sequences of NAP1L1 BINDING SITE, designated SEQ ID:19810, to the nucleotide sequence of GAM104 RNA, herein designated GAM RNA, also designated SEQ ID:355.

Another function of GAM104 is therefore inhibition of Nucleosome assembly protein 1-like 1 (NAP1L1, Accession NP_004528.1). Accordingly, utilities of GAM104 include diagnosis, prevention and treatment of diseases and clinical conditions associated with NAP1L1.

Nucleosome assembly protein 1-like 1 (NAP1L1, Accession NP_631946.1) is another GAM104 target gene, herein designated TARGET GENE. NAP1L1 BINDING SITE is a target binding site found in the 3' untranslated region of multiple transcripts of mRNA encoded by NAP1L1, corresponding to a target binding site such as BINDING SITE I, BINDING SITE II or BINDING SITE III of FIG. 8. Table 4 illustrates the complementarity of the nucleotide sequences of NAP1L1 BINDING SITE, designated SEQ ID:19810, to the nucleotide sequence of GAM104 RNA, herein designated GAM RNA, also designated SEQ ID:355.

Another function of GAM104 is therefore inhibition of Nucleosome assembly protein 1-like 1 (NAP1L1, Accession NP_631946.1). Accordingly, utilities of GAM104 include diagnosis, prevention and treatment of diseases and clinical conditions associated with NAP1L1.

Protocadherin beta 9 (PCDHB9, Accession NP_061992.2) is another GAM104 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:5387, to the nucleotide sequence of GAM104 RNA, herein designated GAM RNA, also designated SEQ ID:355.

Another function of GAM104 is therefore inhibition of Protocadherin beta 9 (PCDHB9, Accession NP_061992.2), a gene which is a potential calcium-dependent cell-adhesion protein. Accordingly, utilities of GAM104 include diagnosis, prevention and treatment of diseases and clinical conditions associated with PCDHB9.

The function of PCDHB9 and its association with various diseases and clinical conditions, has been established by previous studies, as described hereinabove with reference to GAM72.1. Phospholipase c, delta 4 (PLCD4, Accession NP_116115.1) is another GAM104 target gene, herein designated TARGET GENE. PLCD4 BINDING SITE is a target binding site found in the 3' untranslated region of mRNA encoded by PLCD4, corresponding to a target binding site such as BINDING SITE I, BINDING SITE II or BINDING SITE III of FIG. 8. Table 4 illustrates the complementarity of the nucleotide sequences of PLCD4 BINDING SITE, designated SEQ ID:4220, to the nucleotide sequence of GAM104 RNA, herein designated GAM RNA, also designated SEQ ID:355.

Another function of GAM104 is therefore inhibition of Phospholipase c, delta 4 (PLCD4, Accession NP_116115.1). Accordingly, utilities of GAM104 include diagnosis, prevention and treatment of diseases and clinical conditions associated with PLCD4.

PTD012 (Accession NP_054758.2) is another GAM104 target gene, herein designated TARGET GENE. PTD012 BINDING SITE is a target binding site found in the 3' untranslated region of mRNA encoded by PTD012, corresponding to a target binding site such as BINDING SITE I, BINDING SITE II or BINDING SITE III of FIG. 8. Table 4 illustrates the complementarity of the nucleotide sequences of PTD012 BINDING SITE, designated SEQ ID:10079, to the nucleotide sequence of GAM104 RNA, herein designated GAM RNA, also designated SEQ ID:355.

Another function of GAM104 is therefore inhibition of PTD012 (Accession NP_054758.2). Accordingly, utilities of GAM104 include diagnosis, prevention and treatment of diseases and clinical conditions associated with PTD012.

Recombination activating gene 1 (RAG1, Accession NP_000439.1) is another GAM104 target gene, herein designated TARGET GENE. RAG1 BINDING SITE is a target binding site found in the 3' untranslated region of mRNA encoded by RAG1, corresponding to a target binding site such as BINDING SITE I, BINDING SITE II or BINDING SITE III of FIG. 8. Table 4 illustrates the complementarity of the nucleotide sequences of RAG1 BINDING SITE, designated SEQ ID:18485, to the nucleotide sequence of GAM104 RNA, herein designated GAM RNA, also designated SEQ ID:355.

Another function of GAM104 is therefore inhibition of Recombination activating gene 1 (RAG1, Accession NP_000439.1). Accordingly, utilities of GAM104 include diagnosis, prevention and treatment of diseases and clinical conditions associated with RAG1.

Sodium channel, voltage-gated, type v, alpha polypeptide (long (electrocardiographic) qt syndrome 3) (SCN5A, Accession NP_000326.2) is another GAM104 target gene, herein designated TARGET GENE. SCN5A BINDING SITE is a target binding site found in the 3' untranslated region of mRNA encoded by SCN5A, corresponding to a target binding site such as BINDING SITE I, BINDING SITE II or BINDING SITE III of FIG. 8. Table 4 illustrates the complementarity of the nucleotide sequences of SCN5A BINDING SITE, designated SEQ ID:19424, to the nucleotide sequence of GAM104 RNA, herein designated GAM RNA, also designated SEQ ID:355.

Another function of GAM104 is therefore inhibition of Sodium channel, voltage-gated, type v, alpha polypeptide (long (electrocardiographic) qt syndrome 3) (SCN5A, Accession NP_000326.2). Accordingly, utilities of GAM104 include diagnosis, prevention and treatment of diseases and clinical conditions associated with SCN5A.

Splicing factor proline/glutamine rich (polypyrimidine tract binding protein associated) (SFPQ, Accession NP_005057.1) is another GAM104 target gene, herein designated TARGET GENE. SFPQ BINDING SITE is a target binding site found in the 3' untranslated region of mRNA encoded by SFPQ, corresponding to a target binding site such as BINDING SITE I, BINDING SITE II or BINDING SITE III of FIG. 8. Table 4 illustrates the complementarity of the nucleotide sequences of SFPQ BINDING SITE, designated SEQ ID:9786, to the nucleotide sequence of GAM104 RNA, herein designated GAM RNA, also designated SEQ ID:355.

Another function of GAM104 is therefore inhibition of Splicing factor proline/glutamine rich (polypyrimidine tract binding protein associated) (SFPQ, Accession NP_005057.1), a gene which binds intronic polypyrimidine tracts. Accordingly, utilities of GAM104 include diagnosis, prevention and treatment of diseases and clinical conditions associated with SFPQ.

The function of SFPQ and its association with various diseases and clinical conditions, has been established by previous studies, as described hereinabove with reference to GAM31.1. Testis expressed sequence 11 (TEX11, Accession NP_112566.1) is another GAM104 target gene, herein designated TARGET GENE. TEX11 BINDING SITE is a target binding site found in the 3' untranslated region of mRNA encoded by TEX11, corresponding to a target binding site such as BINDING SITE I, BINDING SITE II or BINDING SITE III of FIG. 8. Table 4 illustrates the complementarity of the nucleotide sequences of TEX11 BINDING SITE, designated SEQ ID:12751, to the nucleotide sequence of GAM104 RNA, herein designated GAM RNA, also designated SEQ ID:355.

Another function of GAM104 is therefore inhibition of Testis expressed sequence 11 (TEX11, Accession NP_112566.1). Accordingly, utilities of GAM104 include diagnosis, prevention and treatment of diseases and clinical conditions associated with TEX11.

Testis expressed sequence 14 (TEX14, Accession NP_112562.1) is another GAM104 target gene, herein designated TARGET GENE. TEX14 BINDING SITE is a target binding site found in the 3' untranslated region of mRNA encoded by TEX14, corresponding to a target binding site such as BINDING SITE I, BINDING SITE II or BINDING SITE III of FIG. 8. Table 4 illustrates the complementarity of the nucleotide sequences of TEX14 BINDING SITE, designated SEQ ID:6837, to the nucleotide sequence of GAM104 RNA, herein designated GAM RNA, also designated SEQ ID:355.

Another function of GAM104 is therefore inhibition of Testis expressed sequence 14 (TEX14, Accession NP_112562.1). Accordingly, utilities of GAM104 include diagnosis, prevention and treatment of diseases and clinical conditions associated with TEX14.

Wd repeat domain 5 (WDR5, Accession NP_438172.1) is another GAM104 target gene, herein designated TARGET GENE. WDR5 BINDING SITE is a target binding site found in the 3' untranslated region of multiple transcripts of mRNA encoded by WDR5, corresponding to a target binding site such as BINDING SITE I, BINDING SITE II or BINDING SITE III of FIG. 8. Table 4 illustrates the complementarity of the nucleotide sequences of WDR5 BINDING SITE, designated SEQ ID:9726, to the nucleotide sequence of GAM104 RNA, herein designated GAM RNA, also designated SEQ ID:355.

Another function of GAM104 is therefore inhibition of Wd repeat domain 5 (WDR5, Accession NP_438172.1). Accordingly, utilities of GAM104 include diagnosis, prevention and treatment of diseases and clinical conditions associated with WDR5.

Zinc finger, dhhc domain containing 2 (ZDHHC2, Accession NP_057437.1) is another GAM104 target gene, herein designated TARGET GENE. ZDHHC2 BINDING SITE is a target binding site found in the 3' untranslated region of mRNA encoded by ZDHHC2, corresponding to a target binding site such as BINDING SITE I, BINDING SITE II or BINDING SITE III of FIG. 8. Table 4 illustrates the complementarity of the nucleotide sequences of ZDHHC2 BINDING SITE, designated SEQ ID:7683, to the nucleotide sequence of GAM104 RNA, herein designated GAM RNA, also designated SEQ ID:355.

Another function of GAM104 is therefore inhibition of Zinc finger, dhhc domain containing 2 (ZDHHC2, Accession NP_057437.1). Accordingly, utilities of GAM104 include diagnosis, prevention and treatment of diseases and clinical conditions associated with ZDHHC2.

Zinc finger protein 339 (ZNF339, Accession NP_067043.1) is another GAM104 target gene, herein designated TARGET GENE. ZNF339 BINDING SITE is a target binding site found in the 3' untranslated region of mRNA encoded by ZNF339, corresponding to a target binding site such as BINDING SITE I, BINDING SITE II or BINDING SITE III of FIG. 8. Table 4 illustrates the complementarity of the nucleotide sequences of ZNF339 BINDING SITE, designated SEQ ID:10412, to the nucleotide sequence of GAM104 RNA, herein designated GAM RNA, also designated SEQ ID:355.

Another function of GAM104 is therefore inhibition of Zinc finger protein 339 (ZNF339, Accession NP_067043.1).

Accordingly, utilities of GAM104 include diagnosis, prevention and treatment of diseases and clinical conditions associated with ZNF339.

FIG. 8 further provides a conceptual description of a novel bioinformatically detected of the present invention, referred to here as Genomic Address Messenger 105 (GAM105), which modulates expression of respective target genes thereof, the function and utility of which target genes is known in the art.

GAM105 is a novel bioinformatically detected regulatory, non protein coding, micro RNA (miRNA) gene. The method by which GAM105 was detected is described hereinabove with reference to FIGS. 8-15.

GAM105 gene, herein designated GAM GENE, and GAM105 target gene, herein designated TARGET GENE, are human genes contained in the human genome.

GAM105 gene encodes a GAM105 precursor RNA, herein designated GAM PRECURSOR RNA. Similar to other miRNA genes, and unlike most ordinary genes, GAM105 precursor RNA does not encode a protein. A nucleotide sequence identical or highly similar to the nucleotide sequence of GAM105 precursor RNA is designated SEQ ID:138, and is provided hereinbelow with reference to the sequence listing part.

GAM105 precursor RNA folds onto itself, forming GAM105 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM105 precursor RNA folds onto itself, forming GAM105 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM105 precursor RNA, designated SEQ-ID:138, and a schematic representation of a predicted secondary folding of GAM105 folded precursor RNA are further described with reference to Table 2, hereby incorporated by reference.

An enzyme complex designated DICER COMPLEX, 'dices' the GAM105 folded precursor RNA into GAM105 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM105 RNA is designated SEQ ID:318, and is provided hereinbelow with references to the sequence listing part and Table 3, hereby incorporated by reference.

GAM105 target gene, herein designated TARGET GENE, encodes a corresponding messenger RNA, GAM105 target RNA, herein designated GAM TARGET RNA. GAM105 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM105 RNA, herein designated GAM RNA, binds complementarily to one or more target binding sites located in untranslated regions of GAM105 target RNA, herein designated GAM TARGET RNA. This complementary binding is due to the fact that the nucleotide sequence of GAM105 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM105 RNA may have a different number of target binding sites in untranslated regions of a GAM105 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM105 RNA, herein designated GAM RNA, to target binding sites on GAM105 target RNA, herein designated GAM TARGET RNA, such as BINDING SITE I, BINDING SITE II and BINDING SITE III, inhibits translation of GAM105 target RNA into GAM105 target protein, herein designated GAM TARGET PROTEIN. GAM target protein is therefore outlined by a broken line.

It is appreciated that GAM105 target gene, herein designated TARGET GENE, in fact represents a plurality of GAM105 target genes. The mRNA of each one of this plurality of GAM105 target genes comprises one or more target binding sites, each having a nucleotide sequence which is at least partly complementary to GAM105 RNA, herein designated GAM RNA, and which when bound by GAM105 RNA causes inhibition of translation of respective one or more GAM105 target proteins.

It is further appreciated by one skilled in the art that the mode of translational inhibition illustrated by FIG. 8 with specific reference to translational inhibition exerted by GAM105 gene, herein designated GAM GENE, on one or more GAM105 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM105 correlate with, and may be deduced from, the identity of the target genes which GAM105 binds and inhibits, and the function of these target genes, as elaborated hereinbelow.

Atpase, class v, type 10d (ATP10D, Accession NM_020453.2) is a GAM105 target gene, herein designated TARGET GENE. ATP10D BINDING SITE is a target binding site found in the 5' untranslated region of mRNA encoded by ATP10D, corresponding to a target binding site such as BINDING SITE I, BINDING SITE II or BINDING SITE III of FIG. 8. Table 4 illustrates the complementarity of the nucleotide sequences of ATP10D BINDING SITE, designated SEQ ID:13724, to the nucleotide sequence of GAM105 RNA, herein designated GAM RNA, also designated SEQ ID:318.

A function of GAM105 is therefore inhibition of Atpase, class v, type 10d (ATP10D, Accession NM_020453.2). Accordingly, utilities of GAM105 include diagnosis, prevention and treatment of diseases and clinical conditions associated with ATP10D.

Collagen, type xix, alpha 1 (COL19A1, Accession NM_001858.2) is another GAM105 target gene, herein designated TARGET GENE. COL19A1 BINDING SITE is a target binding site found in the 3' untranslated region of mRNA encoded by COL19A1, corresponding to a target binding site such as BINDING SITE I, BINDING SITE II or BINDING SITE III of FIG. 8. Table 4 illustrates the complementarity of the nucleotide sequences of COL19A1 BINDING SITE, designated SEQ ID:19700, to the nucleotide sequence of GAM105 RNA, herein designated GAM RNA, also designated SEQ ID:318.

Another function of GAM105 is therefore inhibition of Collagen, type xix, alpha 1 (COL19A1, Accession NM_001858.2), a gene which may act as a cross-bridge between fibrils and other extracellular matrix molecules. Accordingly, utilities of GAM105 include diagnosis, prevention and treatment of diseases and clinical conditions associated with COL19A1.

The function of COL19A1 and its association with various diseases and clinical conditions, has been established by previous studies, as described hereinabove with reference to GAM94.1. DKFZP727G051 (Accession XM_045308.6) is another GAM105 target gene, herein designated TARGET GENE. DKFZP727G051 BINDING SITE is a target binding site found in the 3' untranslated region of mRNA encoded by DKFZP727G051, corresponding to a target binding site such as BINDING SITE I, BINDING SITE II or BINDING SITE III of FIG. 8. Table 4 illustrates the complementarity of the nucleotide sequences of DKFZP727G051 BINDING SITE, designated SEQ ID:6512, to the nucleotide sequence of GAM105 RNA, herein designated GAM RNA, also designated SEQ ID:318.

Another function of GAM105 is therefore inhibition of DKFZP727G051 (Accession XM_045308.6). Accordingly, utilities of GAM105 include diagnosis, prevention and treatment of diseases and clinical conditions associated with DKFZP727G051.

Eyes absent homolog 3 (drosophila) (EYA3, Accession NM_001990.2) is another GAM105 target gene, herein designated TARGET GENE. EYA3 BINDING SITE is a target binding site found in the 5' untranslated region of multiple transcripts of mRNA encoded by EYA3, corresponding to a target binding site such as BINDING SITE I, BINDING SITE II or BINDING SITE III of FIG. 8. Table 4 illustrates the complementarity of the nucleotide sequences of EYA3 BINDING SITE, designated SEQ ID:15188, to the nucleotide sequence of GAM105 RNA, herein designated GAM RNA, also designated SEQ ID:318.

Another function of GAM105 is therefore inhibition of Eyes absent homolog 3 (drosophila) (EYA3, Accession NM_001990.2), a gene which may be involved in development of the eye. Accordingly, utilities of GAM105 include diagnosis, prevention and treatment of diseases and clinical conditions associated with EYA3.

The function of EYA3 has been established by previous studies. Abdelhak et al. (1997) identified 3 members of a novel family homologous to Drosophila 'eyes absent' gene (eya). One of these, EYA1 (OMIM Ref. No. 601653), was demonstrated to be mutant in cases of branchiootorenal dysplasia (BOR; 113650). EYA2 (OMIM Ref. No. 601654) and EYA3, like EYA1, are expressed in the ninth week of human development and may also underlie developmental defects. Xu et al. (1997) showed that in the limbs of 10.5-day mouse embryos, Eya1 expression was largely restricted to the flexor tendons, whereas Eya2 was expressed in the extensor tendons and probably also in the ligments of the phalanges. They demonstrated that the proline/serine/threonine-rich N-terminal regions of the protein products of the Eya1, Eya2, and Eya3 genes have transcriptional activator activity. These results supported a role for the Eya genes in connective tissue patterning in the limbs. Zimmerman et al. (1997) mapped the murine Eya3 gene to mouse chromosome 4 in the region syntenic with human 1p36. In the mouse, no recombination was detected between the Eya3 gene and the gene encoding the oncogene FGR (OMIM Ref. No. 164940) which is located on 1p36.2-p36.1. By fluorescence in situ hybridization, Zimmerman et al. (1997) established that the human EYA3 gene is on 1p36.

Full details of the abovementioned studies are described in the following publications, the disclosure of which are hereby incorporated by reference:

Abdelhak, S.; Kalatzis, V.; Heilig, R.; Compain, S.; Samson, D.; Vincent, C.; Weil, D.; Cruaud, C.; Sahly, I.; Leibovici, M.; Bitner-Glindzicz, M.; Francis, M.; Lacombe, D.; Vigneron, J.; Charachon, R.; Boven, K.; Bedbeder, P.; Van Regemorter, N.; Weissenbach, J.; Petit, C.: A human homologue of the Drosophila eyes absent gene underlies branchio-oto - renal (BOR) syndrome and identifies a novel gene family. Nature Genet. 15:157-164, 1997; and Xu, P.-X.; Cheng, J.; Epstein, J. A.; Maas, R. L.: Mouse Eya genes are expressed during limb tendon development and encode a transcriptional activation function. Proc. Nat. Acad. Sci.

Further studies establishing the function and utilities of EYA3 are found in John Hopkins OMIM database record ID 601655, and in cited publications listed in Table 5, which are hereby incorporated by reference. KIAA1550 (Accession XM_039393.3) is another GAM105 target gene, herein designated TARGET GENE. KIAA1550 BINDING SITE is a target binding site found in the 3' untranslated region of mRNA encoded by KIAA1550, corresponding to a target binding site such as BINDING SITE I, BINDING SITE II or BINDING SITE III of FIG. 8. Table 4 illustrates the complementarity of the nucleotide sequences of KIAA1550 BINDING SITE, designated SEQ ID:16950, to the nucleotide sequence of GAM105 RNA, herein designated GAM RNA, also designated SEQ ID:318.

Another function of GAM105 is therefore inhibition of KIAA1550 (Accession XM_039393.3). Accordingly, utilities of GAM105 include diagnosis, prevention and treatment of diseases and clinical conditions associated with KIAA1550.

Solute carrier family 12 (potassium/chloride transporters), member 7 (SLC12A7, Accession NM_006598.1) is another GAM105 target gene, herein designated TARGET GENE. SLC12A7 BINDING SITE is a target binding site found in the 3' untranslated region of mRNA encoded by SLC12A7, corresponding to a target binding site such as BINDING SITE I, BINDING SITE II or BINDING SITE III of FIG. 8. Table 4 illustrates the complementarity of the nucleotide sequences of SLC12A7 BINDING SITE, designated SEQ ID:17473, to the nucleotide sequence of GAM105 RNA, herein designated GAM RNA, also designated SEQ ID:318.

Another function of GAM105 is therefore inhibition of Solute carrier family 12 (potassium/chloride transporters), member 7 (SLC12A7, Accession NM_006598.1), a gene which is a potassium/chloride- cotransporter. Accordingly, utilities of GAM105 include diagnosis, prevention and treatment of diseases and clinical conditions associated with SLC12A7.

The function of SLC12A7 has been established by previous studies. By searching EST databases, Mount et al. (1999) identified a cDNA encoding SLC12A7, which they initially termed KCC3 but later renamed KCC4. The deduced 1,083-amino acid SLC12A7 protein contains 12 membrane-spanning segments, 8 phosphorylation sites, 7 of which are in the C terminus, and 4 potential N-glycosylation sites. SLC12A7 shares 65% amino acid identity with SLC12A4 (OMIM Ref. No. 604119) and 66% identity with SLC12A6 (OMIM Ref. No. 604878). Northern blot analysis detected a 5.3-kb SLC12A7 transcript in most tissues tested, with highest expression in heart and kidney and little or no expression in adult brain. Functional analysis confirmed that SLC12A7 is a KCC.

Animal model experiments lend further support to the function of SLC12A7. Boettger et al. (2002) generated mice constitutively lacking KCC4, which is predominantly expressed in kidney, heart, lung, and liver. Kcc4 -/-mice were born at the expected mendelian ratio. They were viable and fertile; however, their body weight was roughly 90% that of their littermates. Mice had normal hearing loss at postnatal day 14, indicated by normal auditory brainstem responses. Hearing deteriorated quickly during the following week, after which mice were nearly deaf, with a hearing loss of 70 to 80 decibels. Histologic analysis revealed that the inner ear developed normally and could not be distinguished from those of wildtype animals at postnatal day 14. At postnatal day 21, however, outer hair cells of basal turns of the cochlea were almost totally absent, whereas inner hair cells were still present. The degeneration proceeded from basal to apical turns. In adult knockout mice, the organ of Corti was lost completely in basal turns. In apical turns, some hair cells survived, accounting for the residual hearing ability in adult mice. Even in adult mice, there was no collapse of the Reissner membrane, which separates the scala media from the scala vestibuli, suggesting that Kcc4 is not essential for endolymph production. Outer hair cells of Kcc4 -/- mice degenerated before Deiters cells were lost, although Deiters cells and not outer hair cells normally express Kcc4 at this stage. This is consistent with a disturbance of extracellular homeostasis due to impaired salt uptake by Deiters cells, and may lead to death of outer hair cells by osmotic stress or membrane depolarization. Deafness in Kcc4 - /-mice was associated with renal tubular acidosis. The urine of knockout mice was more alkaline than that of wildtype littermates, whereas concentrations of sodium, potassium, and chloride were not changed. Blood gas analysis indicated a compensated metabolic acidosis with significantly decreased base excess. Immunofluorescence revealed that Kcc4 is expressed in basolateral membranes of several nephron segments. Intracellular chloride concentration was increased in proximal tubules and particularly in alpha- intercalated cells of knockout mice. Considering the prominent chloride/bicarbonate exchange activity in alpha-intercalated cells, the rise in intracellular chloride predicts a more alkaline intracellular pH in the knockout mice. This will decrease apical proton secretion by increasing the electrochemical gradient against which pumping has to occur. Thus, KCC4 joins the hydrogen ATPase (OMIM Ref. No. 192132) and AE1 anion exchanger (OMIM Ref. No. 109270) as the third transport protein of alpha-intercalated cells whose mutation entails renal tubular acidosis. Boettger et al. (2002) concluded that KCC4 is important for potassium recycling by siphoning potassium ions after their exit from outer hair cells into supporting Deiters cells, where potassium enters the gap junction pathway.

It is appreciated that the abovementioned animal model for SLC12A7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Mount, D. B.; Mercado, A.; Song, L.; Xu, J.; George, A. L., Jr.; Delpire, E.; Gamba, G.: Cloning and characterization of KCC3 and KCC4, new members of the cation-chloride cotransporter gene family. J. Biol. Chem. 274:16355-16362, 1999; and Boettger, T.; Hubner, C. A.; Maler, H.; Rust, M. B.; Beck, F. X.; Jentsch, T. J.: Deafness and renal tubular acidosis in mice lacking the K-CI co-transporter Kcc4. Nature 416:874-878, 20.

Further studies establishing the function and utilities of SLC12A7 are found in John Hopkins OMIM database record ID 604879, and in cited publications listed in Table 5, which are hereby incorporated by reference.

FIG. 8 further provides a conceptual description of a novel bioinformatically detected of the present invention, referred to here as Genomic Address Messenger 106 (GAM106), which modulates expression of respective target genes thereof, the function and utility of which target genes is known in the art.

GAM106 is a novel bioinformatically detected regulatory, non protein coding, micro RNA (miRNA) gene. The method by which GAM106 was detected is described hereinabove with reference to FIGS. 8-15.

GAM106 gene, herein designated GAM GENE, and GAM106 target gene, herein designated TARGET GENE, are human genes contained in the human genome.

GAM106 gene encodes a GAM106 precursor RNA, herein designated GAM PRECURSOR RNA. Similar to other miRNA genes, and unlike most ordinary genes, GAM106 precursor RNA does not encode a protein. A nucleotide sequence identical or highly similar to the nucleotide sequence of GAM106 precursor RNA is designated SEQ ID:173, and is provided hereinbelow with reference to the sequence listing part. Nucleotide sequence SEQ ID:173 is located at position 13445376 relative to chromosome 20.

GAM106 precursor RNA folds onto itself, forming GAM106 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM106 precursor RNA folds onto itself, forming GAM106 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM106 precursor RNA, designated SEQ-ID:173, and a schematic representation of a predicted secondary folding of GAM106 folded precursor RNA are further described with reference to Table 2, hereby incorporated by reference.

An enzyme complex designated DICER COMPLEX, 'dices' the GAM106 folded precursor RNA into GAM106 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM106 RNA is designated SEQ ID:231, and is provided hereinbelow with references to the sequence listing part and Table 3, hereby incorporated by reference.

GAM106 target gene, herein designated TARGET GENE, encodes a corresponding messenger RNA, GAM106 target RNA, herein designated GAM TARGET RNA. GAM106 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM106 RNA, herein designated GAM RNA, binds complementarily to one or more target binding sites located in untranslated regions of GAM106 target RNA, herein designated GAM TARGET RNA. This complementary binding is due to the fact that the nucleotide sequence of GAM106 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM106 RNA may have a different number of target binding sites in untranslated regions of a GAM106 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM106 RNA, herein designated GAM RNA, to target binding sites on GAM106 target RNA, herein designated GAM TARGET RNA, such as BINDING SITE I, BINDING SITE II and BINDING SITE III, inhibits translation of GAM106 target RNA into GAM106 target protein, herein designated GAM TARGET PROTEIN. GAM target protein is therefore outlined by a broken line.

It is appreciated that GAM106 target gene, herein designated TARGET GENE, in fact represents a plurality of GAM106 target genes. The mRNA of each one of this plurality of GAM106 target genes comprises one or more target binding sites, each having a nucleotide sequence which is at least partly complementary to GAM106 RNA, herein designated GAM RNA, and which when bound by GAM106 RNA causes inhibition of translation of respective one or more GAM106 target proteins.

It is further appreciated by one skilled in the art that the mode of translational inhibition illustrated by FIG. 8 with specific reference to translational inhibition exerted by GAM106 gene, herein designated GAM GENE, on one or more GAM106 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM106 correlate with, and may be deduced from, the identity of the target genes which GAM106 binds and inhibits, and the function of these target genes, as elaborated hereinbelow.

AD024 (Accession NP_065726.1) is a GAM106 target gene, herein designated TARGET GENE. AD024 BINDING SITE is a target binding site found in the 3' untranslated region of mRNA encoded by AD024, corresponding to a target binding site such as BINDING SITE I, BINDING SITE II or BINDING SITE III of FIG. 8. Table 4 illustrates the complementarity of the nucleotide sequences of AD024 BINDING SITE, designated SEQ ID:14955, to the nucleotide sequence of GAM106 RNA, herein designated GAM RNA, also designated SEQ ID:231.

A function of GAM106 is therefore inhibition of AD024 (Accession NP_065726.1). Accordingly, utilities of GAM106 include diagnosis, prevention and treatment of diseases and clinical conditions associated with AD024.

AEBP2 (Accession NP_694939.1) is another GAM106 target gene, herein designated TARGET GENE. AEBP2 BINDING SITE is a target binding site found in the 3' untranslated region of mRNA encoded by AEBP2, corresponding to a target binding site such as BINDING SITE I, BINDING SITE II or BINDING SITE III of FIG. 8. Table 4 illustrates the complementarity of the nucleotide sequences of AEBP2 BINDING SITE, designated SEQ ID:20032, to the nucleotide sequence of GAM106 RNA, herein designated GAM RNA, also designated SEQ ID:231.

Another function of GAM106 is therefore inhibition of AEBP2 (Accession NP_694939.1). Accordingly, utilities of GAM106 include diagnosis, prevention and treatment of diseases and clinical conditions associated with AEBP2.

C14orf77 (Accession XP_085101.1) is another GAM106 target gene, herein designated TARGET GENE. C14orf77 BINDING SITE is a target binding site found in the 3' untranslated region of mRNA encoded by C14orf77, corresponding to a target binding site such as BINDING SITE I, BINDING SITE II or BINDING SITE III of FIG. 8. Table 4 illustrates the complementarity of the nucleotide sequences of C14orf77 BINDING SITE, designated SEQ ID:17031, to the nucleotide sequence of GAM106 RNA, herein designated GAM RNA, also designated SEQ ID:231.

Another function of GAM106 is therefore inhibition of C14orf77 (Accession XP_085101.1). Accordingly, utilities of GAM106 include diagnosis, prevention and treatment of diseases and clinical conditions associated with C14orf77.

Chromosome 20 open reading frame 142 (C20orf142, Accession XP_300782.1) is another GAM106 target gene, herein designated TARGET GENE. C20orf142 BINDING SITE is a target binding site found in the 3' untranslated region of mRNA encoded by C20orf142, corresponding to a target binding site such as BINDING SITE I, BINDING SITE II or BINDING SITE III of FIG. 8. Table 4 illustrates the complementarity of the nucleotide sequences of C20orf142 BINDING SITE, designated SEQ ID:17640, to the nucleotide sequence of GAM106 RNA, herein designated GAM RNA, also designated SEQ ID:231.

Another function of GAM106 is therefore inhibition of Chromosome 20 open reading frame 142 (C20orf142, Accession XP_300782.1). Accordingly, utilities of GAM106 include diagnosis, prevention and treatment of diseases and clinical conditions associated with C20orf142.

Chromosome 20 open reading frame 147 (C20orf147, Accession NP_689880.1) is another GAM106 target gene, herein designated TARGET GENE. C20orf147 BINDING SITE is a target binding site found in the 3' untranslated region of mRNA encoded by C20orf147, corresponding to a target binding site such as BINDING SITE I, BINDING SITE II or BINDING SITE III of FIG. 8. Table 4 illustrates the complementarity of the nucleotide sequences of C20orf147 BINDING SITE, designated SEQ ID:4450, to the nucleotide sequence of GAM106 RNA, herein designated GAM RNA, also designated SEQ ID:231.

Another function of GAM106 is therefore inhibition of Chromosome 20 open reading frame 147 (C20orf147, Accession NP_689880.1). Accordingly, utilities of GAM106 include diagnosis, prevention and treatment of diseases and clinical conditions associated with C20orf147.

CYCS (Accession NP_061820.1) is another GAM106 target gene, herein designated TARGET GENE. CYCS BINDING SITE is a target binding site found in the 3' untranslated region of mRNA encoded by CYCS, corresponding to a target binding site such as BINDING SITE I, BINDING SITE II or BINDING SITE III of FIG. 8. Table 4 illustrates the complementarity of the nucleotide sequences of CYCS BINDING SITE, designated SEQ ID:6813, to the nucleotide sequence of GAM106 RNA, herein designated GAM RNA, also designated SEQ ID:231.

Another function of GAM106 is therefore inhibition of CYCS (Accession NP_061820.1). Accordingly, utilities of GAM106 include diagnosis, prevention and treatment of diseases and clinical conditions associated with CYCS.

DKFZP564D172 (Accession NP_114431.2) is another GAM106 target gene, herein designated TARGET GENE. DKFZP564D172 BINDING SITE is a target binding site found in the 3' untranslated region of mRNA encoded by DKFZP564D172, corresponding to a target binding site such as BINDING SITE I, BINDING SITE II or BINDING SITE III of FIG. 8. Table 4 illustrates the complementarity of the nucleotide sequences of DKFZP564D172 BINDING SITE, designated SEQ ID:4872, to the nucleotide sequence of GAM106 RNA, herein designated GAM RNA, also designated SEQ ID:231.

Another function of GAM106 is therefore inhibition of DKFZP564D172 (Accession NP_114431.2). Accordingly, utilities of GAM106 include diagnosis, prevention and treatment of diseases and clinical conditions associated with DKFZP564D172.

DKFZp761A078 (Accession XP_089143.5) is another GAM106 target gene, herein designated TARGET GENE. DKFZp761A078 BINDING SITE is a target binding site found in the 5' untranslated region of mRNA encoded by DKFZp761A078, corresponding to a target binding site such as BINDING SITE I, BINDING SITE II or BINDING SITE III of FIG. 8. Table 4 illustrates the complementarity of the nucleotide sequences of DKFZp761A078 BINDING SITE, designated SEQ ID:2068, to the nucleotide sequence of GAM106 RNA, herein designated GAM RNA, also designated SEQ ID:231.

Another function of GAM106 is therefore inhibition of DKFZp761A078 (Accession XP_089143.5). Accordingly, utilities of GAM106 include diagnosis, prevention and treatment of diseases and clinical conditions associated with DKFZp761A078.

Fibroblast growth factor 5 (FGF5, Accession NP_149134.1) is another GAM106 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:14955, to the nucleotide sequence of GAM106 RNA, herein designated GAM RNA, also designated SEQ ID:231.

Another function of GAM106 is therefore inhibition of Fibroblast growth factor 5 (FGF5, Accession NP_149134.1), a gene which induces transformation and may regulate neuronal differentiation. Accordingly, utilities of GAM106 include diagnosis, prevention and treatment of diseases and clinical conditions associated with FGF5.

The function of FGF5 has been established by previous studies. Zhan et al. (1988) identified a fifth oncogene related to fibroblast growth factors and termed it FGF5. The other four are FGFA (OMIM Ref. No. 131220), FGFB (OMIM Ref. No. 134920), INT2 (OMIM Ref. No. 164950), and HST (OMIM Ref. No. 164980). FGF5 was discovered when it acquired transforming potential by a DNA rearrangement accompanying transfection of NIH 3T3 cells with human tumor DNA. Two regions of the FGF5 sequence, containing 122 of its 267 amino acid residues, were 40 to 50% homologous to the sequences of the 4 other members of the FGF oncogene family. FGF5, furthermore, was found to have a 3-exon structure typical for members of this family. FGF5 was found to be expressed in neonatal brain and in 3 of 13 human tumor cell lines examined. Nguyen et al. (1988) mapped FGF5 to 4q21 by in situ hybridization. Thus, it is not in the same cluster as the related HST and INT2 genes, which are coamplified in some tumor cells and were found by Nguyen et al. (1988), using pulsed field gel analysis, to be separated by only 40 kb. By polymerase chain reaction (PCR) amplification of target sequences in DNAs from somatic cell hybrids, Dionne et al. (1990) mapped the FGF5 gene to chromosome 4. By in situ chromosomal hybridization, Mattei et al. (1992) demonstrated that the corresponding gene in the mouse is on chromosome 5. Hebert et al. (1994) found that mice homozygous for a null allele of the Fgf5 gene, produced by gene targeting in embryonic stem cells, have abnormally long hair. This phenotype appeared identical to that of mice homozygous for the spontaneous mutation 'angora' (go). The transgenic mutant and the 'go' mutant failed to complement one another, and exon 1 of Fgf5 was found to be deleted in DNA from go homozygotes. Expression of Fgf5 is detected in hair follicles from wildtype mice and is localized to the outer root sheath during the anagen VI phase of the hair growth cycle. The findings were interpreted as evidence that FGF5 functions as an inhibitor of hair elongation, thus identifying a molecule whose normal function is apparently to regulate one step in the progression of the follicle through the hair growth cycle. It will be of interest to search for mutations in the FGF5 gene in hypertrichosis universalis (145700, 145701) as well as in other forms of hypertrichosis such as hairy elbows (OMIM Ref. No. 139600).

Full details of the abovementioned studies are described in the following publications, the disclosure of which are hereby incorporated by reference:

Zhan, X.; Bates, B.; Hu, X.; Goldfarb, M.: The human FGF-5 oncogene encodes a novel protein related to fibroblast growth factors. Molec. Cell. Biol. 8:3487-3495, 1988; and Hebert, J. M.; Rosenquist, T.; Gotz, J.; Martin, G. R.: FGF5 as a regulator of the hair growth cycle: evidence from targeted and spontaneous mutations. Cell 78:1017-1025, 1994.

Further studies establishing the function and utilities of FGF5 are found in John Hopkins OMIM database record ID 165190, and in cited publications listed in Table 5, which are hereby incorporated by reference. Fibroblast growth factor 5 (FGF5, Accession NP_004455.1) is another GAM106 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:14955, to the nucleotide sequence of GAM106 RNA, herein designated GAM RNA, also designated SEQ ID:231.

Another function of GAM106 is therefore inhibition of Fibroblast growth factor 5 (FGF5, Accession NP_004455.1), a gene which induces transformation and may regulate neuronal differentiation. Accordingly, utilities of GAM106 include diagnosis, prevention and treatment of diseases and clinical conditions associated with FGF5.

The function of FGF5 has been established by previous studies. Zhan et al. (1988) identified a fifth oncogene related to fibroblast growth factors and termed it FGF5. The other four are FGFA (OMIM Ref. No. 131220), FGFB (OMIM Ref. No. 134920), INT2 (OMIM Ref. No. 164950), and HST (OMIM Ref. No. 164980). FGF5 was discovered when it acquired transforming potential by a DNA rearrangement accompanying transfection of NIH 3T3 cells with human tumor DNA. Two regions of the FGF5 sequence, containing 122 of its 267 amino acid residues, were 40 to 50% homologous to the sequences of the 4 other members of the FGF oncogene family. FGF5, furthermore, was found to have a 3-exon structure typical for members of this family. FGF5 was found to be expressed in neonatal brain and in 3 of 13 human tumor cell lines examined. Nguyen et al. (1988) mapped FGF5 to 4q21 by in situ hybridization. Thus, it is not in the same cluster as the related HST and INT2 genes, which are coamplified in some tumor cells and were found by Nguyen et al. (1988), using pulsed field gel analysis, to be separated by only 40 kb. By polymerase chain reaction (PCR) amplification of target sequences in DNAs from somatic cell hybrids, Dionne et al. (1990) mapped the FGF5 gene to chromosome 4. By in situ chromosomal hybridization, Mattei et al. (1992) demonstrated that the corresponding gene in the mouse is on chromosome 5. Hebert et al. (1994) found that mice homozygous for a null allele of the Fgf5 gene, produced by gene targeting in embryonic stem cells, have abnormally long hair. This phenotype appeared identical to that of mice homozygous for the spontaneous mutation 'angora' (go). The transgenic mutant and the 'go' mutant failed to complement one another, and exon 1 of Fgf5 was found to be deleted in DNA from go homozygotes. Expression of Fgf5 is detected in hair follicles from wildtype mice and is localized to the outer root sheath during the anagen VI phase of the hair growth cycle. The findings were interpreted as evidence that FGF5 functions as an inhibitor of hair elongation, thus identifying a molecule whose normal function is apparently to regulate one step in the progression of the follicle through the hair growth cycle. It will be of interest to search for mutations in the FGF5 gene in hypertrichosis universalis (145700, 145701) as well as in other forms of hypertrichosis such as hairy elbows (OMIM Ref. No. 139600).

Full details of the abovementioned studies are described in the following publications, the disclosure of which are hereby incorporated by reference:

Zhan, X.; Bates, B.; Hu, X.; Goldfarb, M.: The human FGF-5 oncogene encodes a novel protein related to fibroblast growth factors. Molec. Cell. Biol. 8:3487-3495, 1988; and Hebert, J. M.; Rosenquist, T.; Gotz, J.; Martin, G. R.: FGF5 as a regulator of the hair growth cycle: evidence from targeted and spontaneous mutations. Cell 78:1017-1025, 1994.

Further studies establishing the function and utilities of FGF5 are found in John Hopkins OMIM database record ID 165190, and in cited publications listed in Table 5, which are hereby incorporated by reference. FLJ10613 (Accession NP_061940.1) is another GAM106 target gene, herein designated TARGET GENE. FLJ10613 BINDING SITE is a target binding site found in the 3' untranslated region of mRNA encoded by FLJ10613, corresponding to a target binding site such as BINDING SITE I, BINDING SITE II or BINDING SITE III of FIG. 8. Table 4 illustrates the complementarity of the nucleotide sequences of FLJ10613 BINDING SITE, designated SEQ ID:18157, to the nucleotide sequence of GAM106 RNA, herein designated GAM RNA, also designated SEQ ID:231.

Another function of GAM106 is therefore inhibition of FLJ10613 (Accession NP_061940.1). Accordingly, utilities of GAM106 include diagnosis, prevention and treatment of diseases and clinical conditions associated with FLJ10613.

FLJ10815 (Accession NP_060701.1) is another GAM106 target gene, herein designated TARGET GENE. FLJ10815 BINDING SITE is a target binding site found in the 3' untranslated region of mRNA encoded by FLJ10815, corresponding to a target binding site such as BINDING SITE I, BINDING SITE II or BINDING SITE III of FIG. 8. Table 4 illustrates the complementarity of the nucleotide sequences of FLJ10815 BINDING SITE, designated SEQ ID:5821, to the nucleotide sequence of GAM106 RNA, herein designated GAM RNA, also designated SEQ ID:231.

Another function of GAM106 is therefore inhibition of FLJ10815 (Accession NP_060701.1). Accordingly, utilities of GAM106 include diagnosis, prevention and treatment of diseases and clinical conditions associated with FLJ10815.

FLJ20360 (Accession NP_060252.1) is another GAM106 target gene, herein designated TARGET GENE. FLJ20360 BINDING SITE is a target binding site found in the 3' untranslated region of mRNA encoded by FLJ20360, corresponding to a target binding site such as BINDING SITE I, BINDING SITE II or BINDING SITE III of FIG. 8. Table 4 illustrates the complementarity of the nucleotide sequences of FLJ20360 BINDING SITE, designated SEQ ID:9007, to the nucleotide sequence of GAM106 RNA, herein designated GAM RNA, also designated SEQ ID:231.

Another function of GAM106 is therefore inhibition of FLJ20360 (Accession NP_060252.1). Accordingly, utilities of GAM106 include diagnosis, prevention and treatment of diseases and clinical conditions associated with FLJ20360.

FLJ38716 (Accession NP_689580.1) is another GAM106 target gene, herein designated TARGET GENE. FLJ38716 BINDING SITE is a target binding site found in the 3' untranslated region of mRNA encoded by FLJ38716, corresponding to a target binding site such as BINDING SITE I, BINDING SITE II or BINDING SITE III of FIG. 8. Table 4 illustrates the complementarity of the nucleotide sequences of FLJ38716 BINDING SITE, designated SEQ ID:19701, to the nucleotide sequence of GAM106 RNA, herein designated GAM RNA, also designated SEQ ID:231.

Another function of GAM106 is therefore inhibition of FLJ38716 (Accession NP_689580.1). Accordingly, utilities of GAM106 include diagnosis, prevention and treatment of diseases and clinical conditions associated with FLJ38716.

Fms-related tyrosine kinase 3 (FLT3, Accession NP_004110.1) is another GAM106 target gene, herein designated TARGET GENE. FLT3 BINDING SITE is a target binding site found in the 3' untranslated region of mRNA encoded by FLT3, corresponding to a target binding site such as BINDING SITE I, BINDING SITE II or BINDING SITE III of FIG. 8. Table 4 illustrates the complementarity of the nucleotide sequences of FLT3 BINDING SITE, designated SEQ ID:20091, to the nucleotide sequence of GAM106 RNA, herein designated GAM RNA, also designated SEQ ID:231.

Another function of GAM106 is therefore inhibition of Fms-related tyrosine kinase 3 (FLT3, Accession NP_004110.1). Accordingly, utilities of GAM106 include diagnosis, prevention and treatment of diseases and clinical conditions associated with FLT3.

Gap junction protein, alpha 4, 37 kda (connexin 37) (GJA4, Accession NP_002051.1) is another GAM106 target gene, herein designated TARGET GENE. GJA4 BINDING SITE is a target binding site found in the 3' untranslated region of mRNA encoded by GJA4, corresponding to a target binding site such as BINDING SITE I, BINDING SITE II or BINDING SITE III of FIG. 8. Table 4 illustrates the complementarity of the nucleotide sequences of GJA4 BINDING SITE, designated SEQ ID:17924, to the nucleotide sequence of GAM106 RNA, herein designated GAM RNA, also designated SEQ ID:231.

Another function of GAM106 is therefore inhibition of Gap junction protein, alpha 4, 37 kda (connexin 37) (GJA4, Accession NP_002051.1), a gene which has a role in intercellular transport and communication. Accordingly, utilities of GAM106 include diagnosis, prevention and treatment of diseases and clinical conditions associated with GJA4.

The function of GJA4 has been established by previous studies. See 121011. Reed et al. (1993) used PCR amplification and cDNA library screening to clone DNA encoding the connexin 37 gap junction protein. The derived polypeptide contained 333 amino acids, with a predicted molecular mass of about 37 kD. RNA blots demonstrated that CX37 is expressed in multiple organs and tissues, including heart, uterus, ovary, and blood vessel endothelium, and in primary cultures of vascular endothelial cells. Reed et al. (1993) demonstrated that CX37 can form functional cell- to - cell channels that have unique voltage-dependence and unitary conductance properties. Willecke et al. (1990) used a mouse cDNA probe in Southern analysis of human-mouse somatic cell hybrids to map the human CX37 gene to 1pter-q12. CX40 (OMIM Ref. No. 121013) was assigned to the same region of chromosome 1. Haefliger et al. (1992) showed that the homologs of CX37 and one other connexin gene are located on rat chromosome 4.

Full details of the abovementioned studies are described in the following publications, the disclosure of which are hereby incorporated by reference:

Haefliger, J.-A.; Bruzzone, R.; Jenkins, N. A.; Gilbert, D. J.; Copeland, N. G.; Paul, D. L.: Four novel members of the connexin family of gap junction proteins: molecular cloning, expression, and chromosome mapping. J. Biol. Chem. 267: 2057-2064, 1992; and Reed, K. E.; Westphale, E. M.; Larson, D. M.; Wang, H.-Z.; Veenstra, R. D.; Beyer, E. C.: Molecular cloning and functional expression of human connexin37, an endothelial cell gap jun.

Further studies establishing the function and utilities of GJA4 are found in John Hopkins OMIM database record ID 121012, and in cited publications listed in Table 5, which are hereby incorporated by reference. Gastrin-releasing peptide receptor (GRPR, Accession NP_005305.1) is another GAM106 target gene, herein designated TARGET GENE. GRPR BINDING SITE is a target binding site found in the 5' untranslated region of mRNA encoded by GRPR, corresponding to a target binding site such as BINDING SITE I, BINDING SITE II or BINDING SITE III of FIG. 8. Table 4 illustrates the complementarity of the nucleotide sequences of GRPR BINDING SITE, designated SEQ ID:10332, to the nucleotide sequence of GAM106 RNA, herein designated GAM RNA, also designated SEQ ID:231.

Another function of GAM106 is therefore inhibition of Gastrin-releasing peptide receptor (GRPR, Accession NP_005305.1), a gene which mediates its action by association with g proteins that activate a phosphatidylinositol-calcium second messenger system. Accordingly, utilities of GAM106 include diagnosis, prevention and treatment of diseases and clinical conditions associated with GRPR.

The function of GRPR has been established by previous studies. Expression of gastrin- releasing polypeptide (GRP; 137260) and its receptor in tumors suggests that these molecules are part of an autocrine loop for growth. Spindel et al. (1990) cloned the human GRP receptor cDNA from a library made from a small cell lung carcinoma cell line using the mouse GRP receptor. The cDNA was in turn used to screen a human genomic library. Schantz et al. (1991) designed PCR primers that span the exon encoding amino acids 139 to 256 of the GRP receptor and used these for the analysis of somatic cell hybrids. In this way they found that the GRPR gene is located on the X chromosome. A panel of hybrids with translocations of the X chromosome permitted regionalization of the gene to Xp11-q11. Maslen and Boyd (1993) found that GRPR maps to Xp22.3-p21.2 rather than to the Xp11-q11 interval as previously reported. The assignment of GRPR to distal Xp was supported by the comparative map position in the mouse. The mapping in the human was done by means of PCR amplification from a panel of somatic cell hybrids that retained reduced portions of the X chromosome; the mapping in the mouse was done by linkage studies in interspecific backcross matings. Shiraishi et al. (1996) noted that within the haploid genome there are approximately 1,000 copies of the human endogenous retrovirus-like sequence, HERV-H. Although these sequences are scattered throughout the genome, in situ hybridization experiments showed discrete clusters positioned on 1p and 7q. Shiraishi et al. (1996) located 3 HERV-H sequences that were unexpectedly clustered within a 300-kb region close to the GRPR locus on the X chromosome.

Full details of the abovementioned studies are described in the following publications, the disclosure of which are hereby incorporated by reference:

Shiraishi, M.; Alitalo, T.; Sekiy, T.: The chromosomal organization of the human endogenous retrovirus-like sequence HERV-H: clustering of the HERV-H sequences in a 300-kb region close to the GRPR locus on the X chromosome. DNA Res. 3: 425-429, 1996; and Spindel, E. R.; Giladi, E.; Brehm, P.; Goodman, R. H.; Segerson, T. P.: Cloning and functional characterization of a complementary DNA encoding the murine fibroblast bombesin/gastrin-re.

Further studies establishing the function and utilities of GRPR are found in John Hopkins OMIM database record ID 305670, and in cited publications listed in Table 5, which are hereby incorporated by reference. Integrin, alpha 9 (ITGA9, Accession NP_002198.1) is another GAM106 target gene, herein designated TARGET GENE. ITGA9 BINDING SITE is a target binding site found in the 3' untranslated region of mRNA encoded by ITGA9, corresponding to a target binding site such as BINDING SITE I, BINDING SITE II or BINDING SITE III of FIG. 8. Table 4 illustrates the complementarity of the nucleotide sequences of ITGA9 BINDING SITE, designated SEQ ID:4333, to the nucleotide sequence of GAM106 RNA, herein designated GAM RNA, also designated SEQ ID:231.

Another function of GAM106 is therefore inhibition of Integrin, alpha 9 (ITGA9, Accession NP_002198.1), a gene which recognizes the sequence a-e-i-d-g-i-e-l in cytotactin. and therefore may be associated with Lung cancer. Accordingly, utilities of GAM106 include diagnosis, prevention and treatment of Lung cancer, and of other diseases and clinical conditions associated with ITGA9.

The function of ITGA9 has been established by previous studies. The integrins are a large family of cell surface glycoproteins that mediate cell-cell adhesion and cell-matrix adhesion. Integrins are heterodimers composed of an alpha and a beta subunit bound noncovalently to each other. Alpha integrins contain a large N-terminal extracellular domain with 7 conserved repeats of putative metal binding domains, a transmembrane segment, and a short C-terminal cytoplasmic tail. Some alpha integrins also contain an approximately 200-amino acid insertion (I) domain, and some undergo cleavage near the transmembrane domain. Integrin alpha-4 (ITGA4; 192975) defines a distinct subfamily of alpha integrins because it is not cleaved and lacks an I domain. See 600536. Erle et al. (1991) isolated a partial cDNA encoding a novel alpha integrin, which they designated alpha-A, from guinea pig epithelial cells. By a combination of techniques, Palmer et al. (1993) isolated cDNAs encoding integrin alpha-9, the human homolog of alpha-A. The predicted alpha-9 protein contains 1,006 amino acids and is structurally similar to alpha-4. Overall, the alpha-4 and alpha-9 proteins are 39% identical. Immunoprecipitation studies demonstrated that alpha-9 forms an integrin heterodimer with beta-1 (OMIM Ref. No. 135630). Using immunohistochemistry, Palmer et al. (1993) found that the alpha-9 protein was expressed in human airway and in various mouse tissues, including airway epithelial cells, basal layers of squamous epithelium, smooth muscle, skeletal muscle, and hepatocytes. By analysis of a cloned segment from 3p22-p21.3, Daigo et al. (1999) determined that the integrin-alpha-RLC gene contains 28 exons and is located in this region. Yamakawa et al. (1993) identified a region of homozygous deletions on chromosome 3p21.3 in lung cancer cell lines. Hibi et al. (1994) determined that this region includes the ITGA9 gene, which they referred to as alpha-RLC (alpha related to the development of lung cancer). The predicted alpha-RLC protein contains 1,035 amino acids with a putative 29-amino acid N-terminal signal sequence. Northern blot analysis revealed that the alpha-RLC gene was expressed as 9.5- and 4.1-kb transcripts in all fetal tissues tested, and at lower levels in most adult tissues. Hibi et al. (1994) suggested that the 2 transcripts result from the use of alternative polyadenylation signals. Alpha-RLC expression was aberrantly upregulated in both cell lines and primary tumors of small cell lung cancer (SCLC; 182280), indicating that altered expression of alpha-RLC may contribute to the malignant phenotype of SCLC Full details of the abovementioned studies are described in the following publications, the disclosure of which are hereby incorporated by reference:

Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.; Nakamura, Y.: Characterization of a 1200-kb genomic segment of chromosome 3p22-p21.3. DNA Res. 6:37-44, 1999; and Erle, D. J.; Sheppard, D.; Breuss, J.; Ruegg, C.; Pytela, R.: Novel integrin alpha and beta subunit cDNAs identified in airway epithelial cells and lung leukocytes using the polymerase.

Further studies establishing the function and utilities of ITGA9 are found in John Hopkins OMIM database record ID 603963, and in cited publications listed in Table 5, which are hereby incorporated by reference. KIAA1143 (Accession XP_044014.1) is another GAM106 target gene, herein designated TARGET GENE. KIAA1143 BINDING SITE is a target binding site found in the 3' untranslated region of mRNA encoded by KIAA1143, corresponding to a target binding site such as BINDING SITE I, BINDING SITE II or BINDING SITE III of FIG. 8. Table 4 illustrates the complementarity of the nucleotide sequences of KIAA1143 BINDING SITE, designated SEQ ID:2396, to the nucleotide sequence of GAM106 RNA, herein designated GAM RNA, also designated SEQ ID:231.

Another function of GAM106 is therefore inhibition of KIAA1143 (Accession XP_044014.1). Accordingly, utilities of GAM106 include diagnosis, prevention and treatment of diseases and clinical conditions associated with KIAA1143.

KIAA1198 (Accession NP_065765.1) is another GAM106 target gene, herein designated TARGET GENE. KIAA1198 BINDING SITE is a target binding site found in the 3' untranslated region of mRNA encoded by KIAA1198, corresponding to a target binding site such as BINDING SITE I, BINDING SITE II or BINDING SITE III of FIG. 8. Table 4 illustrates the complementarity of the nucleotide sequences of KIAA1198 BINDING SITE, designated SEQ ID:20133, to the nucleotide sequence of GAM106 RNA, herein designated GAM RNA, also designated SEQ ID:231.

Another function of GAM106 is therefore inhibition of KIAA1198 (Accession NP_065765.1). Accordingly, utilities of GAM106 include diagnosis, prevention and treatment of diseases and clinical conditions associated with KIAA1198.

KIAA1765 (Accession XP_047355.1) is another GAM106 target gene, herein designated TARGET GENE. KIAA1765 BINDING SITE is a target binding site found in the 3' untranslated region of mRNA encoded by KIAA1765, corresponding to a target binding site such as BINDING SITE I, BINDING SITE II or BINDING SITE III of FIG. 8. Table 4 illustrates the complementarity of the nucleotide sequences of KIAA1765 BINDING SITE, designated SEQ ID:18828, to the nucleotide sequence of GAM106 RNA, herein designated GAM RNA, also designated SEQ ID:231.

Another function of GAM106 is therefore inhibition of KIAA1765 (Accession XP_047355.1). Accordingly, utilities of GAM106 include diagnosis, prevention and treatment of diseases and clinical conditions associated with KIAA1765.

LOC145786 (Accession XP_096860.1) is another GAM106 target gene, herein designated TARGET GENE. LOC145786 BINDING SITE is a target binding site found in the 5' untranslated region of mRNA encoded by LOC145786, corresponding to a target binding site such as BINDING SITE I, BINDING SITE II or BINDING SITE III of FIG. 8. Table 4 illustrates the complementarity of the nucleotide sequences of LOC145786 BINDING SITE, designated SEQ ID:823, to the nucleotide sequence of GAM106 RNA, herein designated GAM RNA, also designated SEQ ID:231.

Another function of GAM106 is therefore inhibition of LOC145786 (Accession XP_096860.1). Accordingly, utilities of GAM106 include diagnosis, prevention and treatment of diseases and clinical conditions associated with LOC145786.

LOC146489 (Accession XP_047734.7) is another GAM106 target gene, herein designated TARGET GENE. LOC146489 BINDING SITE is a target binding site found in the 3' untranslated region of mRNA encoded by LOC146489, corresponding to a target binding site such as BINDING SITE I, BINDING SITE II or BINDING SITE III of FIG. 8. Table 4 illustrates the complementarity of the nucleotide sequences of LOC146489 BINDING SITE, designated SEQ ID:4016, to the nucleotide sequence of GAM106 RNA, herein designated GAM RNA, also designated SEQ ID:231.

Another function of GAM106 is therefore inhibition of LOC146489 (Accession XP_047734.7). Accordingly, utilities of GAM106 include diagnosis, prevention and treatment of diseases and clinical conditions associated with LOC146489.

LOC146733 (Accession XP_097076.1) is another GAM106 target gene, herein designated TARGET GENE. LOC146733 BINDING SITE is a target binding site found in the 3' untranslated region of mRNA encoded by LOC146733, corresponding to a target binding site such as BINDING SITE I, BINDING SITE II or BINDING SITE III of FIG. 8. Table 4 illustrates the complementarity of the nucleotide sequences of LOC146733 BINDING SITE, designated SEQ ID:14955, to the nucleotide sequence of GAM106 RNA, herein designated GAM RNA, also designated SEQ ID:231.

Another function of GAM106 is therefore inhibition of LOC146733 (Accession XP_097076.1). Accordingly, utilities of GAM106 include diagnosis, prevention and treatment of diseases and clinical conditions associated with LOC146733.

LOC154084 (Accession XP_098468.1) is another GAM106 target gene, herein designated TARGET GENE. LOC154084 BINDING SITE is a target binding site found in the 5' untranslated region of mRNA encoded by LOC154084, corresponding to a target binding site such as BINDING SITE I, BINDING SITE II or BINDING SITE III of FIG. 8. Table 4 illustrates the complementarity of the nucleotide sequences of LOC154084 BINDING SITE, designated SEQ ID:4793, to the nucleotide sequence of GAM106 RNA, herein designated GAM RNA, also designated SEQ ID:231.

Another function of GAM106 is therefore inhibition of LOC154084 (Accession XP_098468.1). Accordingly, utilities of GAM106 include diagnosis, prevention and treatment of diseases and clinical conditions associated with LOC154084.

LOC165324 (Accession XP_092518.1) is another GAM106 target gene, herein designated TARGET GENE. LOC165324 BINDING SITE is a target binding site found in the 3' untranslated region of mRNA encoded by LOC165324, corresponding to a target binding site such as BINDING SITE I, BINDING SITE II or BINDING SITE III of FIG. 8. Table 4 illustrates the complementarity of the nucleotide sequences of LOC165324 BINDING SITE, designated SEQ ID:18910, to the nucleotide sequence of GAM106 RNA, herein designated GAM RNA, also designated SEQ ID:231.

Another function of GAM106 is therefore inhibition of LOC165324 (Accession XP_092518.1). Accordingly, utilities of GAM106 include diagnosis, prevention and treatment of diseases and clinical conditions associated with LOC165324.

LOC283633 (Accession XP_208762.1) is another GAM106 target gene, herein designated TARGET GENE. LOC283633 BINDING SITE is a target binding site found in the 5' untranslated region of mRNA encoded by LOC283633, corresponding to a target binding site such as BINDING SITE I, BINDING SITE II or BINDING SITE III of FIG. 8. Table 4 illustrates the complementarity of the nucleotide sequences of LOC283633 BINDING SITE, designated SEQ ID:2396, to the nucleotide sequence of GAM106 RNA, herein designated GAM RNA, also designated SEQ ID:231.

Another function of GAM106 is therefore inhibition of LOC283633 (Accession XP_208762.1). Accordingly, utilities of GAM106 include diagnosis, prevention and treatment of diseases and clinical conditions associated with LOC283633.

LOC284409 (Accession XP_211447.1) is another GAM106 target gene, herein designated TARGET GENE. LOC284409 BINDING SITE is a target binding site found in the 3' untranslated region of mRNA encoded by LOC284409, corresponding to a target binding site such as BINDING SITE I, BINDING SITE II or BINDING SITE III of FIG. 8. Table 4 illustrates the complementarity of the nucleotide sequences of LOC284409 BINDING SITE, designated SEQ ID:9942, to the nucleotide sequence of GAM106 RNA, herein designated GAM RNA, also designated SEQ ID:231.

Another function of GAM106 is therefore inhibition of LOC284409 (Accession XP_211447.1). Accordingly, utilities of GAM106 include diagnosis, prevention and treatment of diseases and clinical conditions associated with LOC284409.

LOC284997 (Accession XP_211723.1) is another GAM106 target gene, herein designated TARGET GENE. LOC284997 BINDING SITE is a target binding site found in the 3' untranslated region of mRNA encoded by LOC284997, corresponding to a target binding site such as BINDING SITE I, BINDING SITE II or BINDING SITE III of FIG. 8. Table 4 illustrates the complementarity of the nucleotide sequences of LOC284997 BINDING SITE, designated SEQ ID:12650, to the nucleotide sequence of GAM106 RNA, herein designated GAM RNA, also designated SEQ ID:231.

Another function of GAM106 is therefore inhibition of LOC284997 (Accession XP_211723.1). Accordingly, utilities of GAM106 include diagnosis, prevention and treatment of diseases and clinical conditions associated with LOC284997.

LOC285153 (Accession XP_211786.1) is another GAM106 target gene, herein designated TARGET GENE. LOC285153 BINDING SITE is a target binding site found in the 3' untranslated region of mRNA encoded by LOC285153, corresponding to a target binding site such as BINDING SITE I, BINDING SITE II or BINDING SITE III of FIG. 8. Table 4 illustrates the complementarity of the nucleotide sequences of LOC285153 BINDING SITE, designated SEQ ID:3357, to the nucleotide sequence of GAM106 RNA, herein designated GAM RNA, also designated SEQ ID:231.

Another function of GAM106 is therefore inhibition of LOC285153 (Accession XP_211786.1). Accordingly, utilities of GAM106 include diagnosis, prevention and treatment of diseases and clinical conditions associated with LOC285153.

LOC286356 (Accession XP_212290.1) is another GAM106 target gene, herein designated TARGET GENE. LOC286356 BINDING SITE is a target binding site found in the 5' untranslated region of mRNA encoded by LOC286356, corresponding to a target binding site such as BINDING SITE I, BINDING SITE II or BINDING SITE III of FIG. 8. Table 4 illustrates the complementarity of the nucleotide sequences of LOC286356 BINDING SITE, designated SEQ ID:14955, to the nucleotide sequence of GAM106 RNA, herein designated GAM RNA, also designated SEQ ID:231.

Another function of GAM106 is therefore inhibition of LOC286356 (Accession XP_212290.1). Accordingly, utilities of GAM106 include diagnosis, prevention and treatment of diseases and clinical conditions associated with LOC286356.

LOC286435 (Accession XP_210047.1) is another GAM106 target gene, herein designated TARGET GENE. LOC286435 BINDING SITE is a target binding site found in the 5' untranslated region of mRNA encoded by LOC286435, corresponding to a target binding site such as BINDING SITE I, BINDING SITE II or BINDING SITE III of FIG. 8. Table 4 illustrates the complementarity of the nucleotide sequences of LOC286435 BINDING SITE, designated SEQ ID:18372, to the nucleotide sequence of GAM106 RNA, herein designated GAM RNA, also designated SEQ ID:231.

Another function of GAM106 is therefore inhibition of LOC286435 (Accession XP_210047.1). Accordingly, utilities of GAM106 include diagnosis, prevention and treatment of diseases and clinical conditions associated with LOC286435.

LOC339832 (Accession XP_295079.1) is another GAM106 target gene, herein designated TARGET GENE. LOC339832 BINDING SITE is a target binding site found in the 3' untranslated region of mRNA encoded by LOC339832, corresponding to a target binding site such as BINDING SITE I, BINDING SITE II or BINDING SITE III of FIG. 8. Table 4 illustrates the complementarity of the nucleotide sequences of LOC339832 BINDING SITE, designated SEQ ID:13768, to the nucleotide sequence of GAM106 RNA, herein designated GAM RNA, also designated SEQ ID:231.

Another function of GAM106 is therefore inhibition of LOC339832 (Accession XP_295079.1). Accordingly, utilities of GAM106 include diagnosis, prevention and treatment of diseases and clinical conditions associated with LOC339832.

LOC339865 (Accession XP_295089.1) is another GAM106 target gene, herein designated TARGET GENE. LOC339865 BINDING SITE is a target binding site found in the 3' untranslated region of mRNA encoded by LOC339865, corresponding to a target binding site such as BINDING SITE I, BINDING SITE II or BINDING SITE III of FIG. 8. Table 4 illustrates the complementarity of the nucleotide sequences of LOC339865 BINDING SITE, designated SEQ ID:14955, to the nucleotide sequence of GAM106 RNA, herein designated GAM RNA, also designated SEQ ID:231.

Another function of GAM106 is therefore inhibition of LOC339865 (Accession XP_295089.1). Accordingly, utilities of GAM106 include diagnosis, prevention and treatment of diseases and clinical conditions associated with LOC339865.

LOC348264 (Accession XP_302706.1) is another GAM106 target gene, herein designated TARGET GENE. LOC348264 BINDING SITE is a target binding site found in the 3' untranslated region of mRNA encoded by LOC348264, corresponding to a target binding site such as BINDING SITE I, BINDING SITE II or BINDING SITE III of FIG. 8. Table 4 illustrates the complementarity of the nucleotide sequences of LOC348264 BINDING SITE, designated SEQ ID:13642, to the nucleotide sequence of GAM106 RNA, herein designated GAM RNA, also designated SEQ ID:231.

Another function of GAM106 is therefore inhibition of LOC348264 (Accession XP_302706.1). Accordingly, utilities of GAM106 include diagnosis, prevention and treatment of diseases and clinical conditions associated with LOC348264.

LOC348265 (Accession XP_302705.1) is another GAM106 target gene, herein designated TARGET GENE. LOC348265 BINDING SITE is a target binding site found in the 3' untranslated region of mRNA encoded by LOC348265, corresponding to a target binding site such as BINDING SITE I, BINDING SITE II or BINDING SITE III of FIG. 8. Table 4 illustrates the complementarity of the nucleotide sequences of LOC348265 BINDING SITE, designated SEQ ID:13642, to the nucleotide sequence of GAM106 RNA, herein designated GAM RNA, also designated SEQ ID:231.

Another function of GAM106 is therefore inhibition of LOC348265 (Accession XP_302705.1). Accordingly, utilities of GAM106 include diagnosis, prevention and treatment of diseases and clinical conditions associated with LOC348265.

LOC348721 (Accession XP_300822.1) is another GAM106 target gene, herein designated TARGET GENE. LOC348721 BINDING SITE is a target binding site found in the 3' untranslated region of mRNA encoded by LOC348721, corresponding to a target binding site such as BINDING SITE I, BINDING SITE II or BINDING SITE III of FIG. 8. Table 4 illustrates the complementarity of the nucleotide sequences of LOC348721 BINDING SITE, designated SEQ ID:1854, to the nucleotide sequence of GAM106 RNA, herein designated GAM RNA, also designated SEQ ID:231.

Another function of GAM106 is therefore inhibition of LOC348721 (Accession XP_300822.1). Accordingly, utilities of GAM106 include diagnosis, prevention and treatment of diseases and clinical conditions associated with LOC348721.

LOC349430 (Accession XP_301084.1) is another GAM106 target gene, herein designated TARGET GENE. LOC349430 BINDING SITE is a target binding site found in the 5' untranslated region of mRNA encoded by LOC349430, corresponding to a target binding site such as BINDING SITE I, BINDING SITE II or BINDING SITE III of FIG. 8. Table 4 illustrates the complementarity of the nucleotide sequences of LOC349430 BINDING SITE, designated SEQ ID:18372, to the nucleotide sequence of GAM106 RNA, herein designated GAM RNA, also designated SEQ ID:231.

Another function of GAM106 is therefore inhibition of LOC349430 (Accession XP_301084.1). Accordingly, utilities of GAM106 include diagnosis, prevention and treatment of diseases and clinical conditions associated with LOC349430.

LOC349432 (Accession XP_301086.1) is another GAM106 target gene, herein designated TARGET GENE. LOC349432 BINDING SITE is a target binding site found in the 5' untranslated region of mRNA encoded by LOC349432, corresponding to a target binding site such as BINDING SITE I, BINDING SITE II or BINDING SITE III of FIG. 8. Table 4 illustrates the complementarity of the nucleotide sequences of LOC349432 BINDING SITE, designated SEQ ID:18372, to the nucleotide sequence of GAM106 RNA, herein designated GAM RNA, also designated SEQ ID:231.

Another function of GAM106 is therefore inhibition of LOC349432 (Accession XP_301086.1). Accordingly, utilities of GAM106 include diagnosis, prevention and treatment of diseases and clinical conditions associated with LOC349432.

LOC57086 (Accession NP_065084.1) is another GAM106 target gene, herein designated TARGET GENE. LOC57086 BINDING SITE is a target binding site found in the 3' untranslated region of mRNA encoded by LOC57086, corresponding to a target binding site such as BINDING SITE I, BINDING SITE II or BINDING SITE III of FIG. 8. Table 4 illustrates the complementarity of the nucleotide sequences of LOC57086 BINDING SITE, designated SEQ ID:14955, to the nucleotide sequence of GAM106 RNA, herein designated GAM RNA, also designated SEQ ID:231.

Another function of GAM106 is therefore inhibition of LOC57086 (Accession NP_065084.1). Accordingly, utilities of GAM106 include diagnosis, prevention and treatment of diseases and clinical conditions associated with LOC57086.

Leucine zipper and ctnnbip1 domain containing (LZIC, Accession NP_115744.2) is another GAM106 target gene, herein designated TARGET GENE. LZIC BINDING SITE is a target binding site found in the 5' untranslated region of mRNA encoded by LZIC, corresponding to a target binding site such as BINDING SITE I, BINDING SITE II or BINDING SITE III of FIG. 8. Table 4 illustrates the complementarity of the nucleotide sequences of LZIC BINDING SITE, designated SEQ ID:14665, to the nucleotide sequence of GAM106 RNA, herein designated GAM RNA, also designated SEQ ID:231.

Another function of GAM106 is therefore inhibition of Leucine zipper and ctnnbip1 domain containing (LZIC, Accession NP_115744.2). Accordingly, utilities of GAM106 include diagnosis, prevention and treatment of diseases and clinical conditions associated with LZIC.

Mitogen-activated protein kinase kinase kinase 7 interacting protein 2 (MAP3K7IP2, Accession NP_663317.1) is another GAM106 target gene, herein designated TARGET GENE. MAP3K7IP2 BINDING SITE is a target binding site found in the 3' untranslated region of multiple transcripts of mRNA encoded by MAP3K7IP2, corresponding to a target binding site such as BINDING SITE I, BINDING SITE II or BINDING SITE III of FIG. 8. Table 4 illustrates the complementarity of the nucleotide sequences of MAP3K7IP2 BINDING SITE, designated SEQ ID:17213, to the nucleotide sequence of GAM106 RNA, herein designated GAM RNA, also designated SEQ ID:231.

Another function of GAM106 is therefore inhibition of Mitogen-activated protein kinase kinase kinase 7 interacting protein 2 (MAP3K7IP2, Accession NP_663317.1). Accordingly, utilities of GAM106 include diagnosis, prevention and treatment of diseases and clinical conditions associated with MAP3K7IP2.

Mitogen-activated protein kinase kinase kinase 7 interacting protein 2 (MAP3K7IP2, Accession NP_055908.1) is another GAM106 target gene, herein designated TARGET GENE. MAP3K7IP2 BINDING SITE is a target binding site found in the 3' untranslated region of multiple transcripts of mRNA encoded by MAP3K7IP2, corresponding to a target binding site such as BINDING SITE I, BINDING SITE II or BINDING SITE III of FIG. 8. Table 4 illustrates the complementarity of the nucleotide sequences of MAP3K7IP2 BINDING SITE, designated SEQ ID:17213, to the nucleotide sequence of GAM106 RNA, herein designated GAM RNA, also designated SEQ ID:231.

Another function of GAM106 is therefore inhibition of Mitogen-activated protein kinase kinase kinase 7 interacting protein 2 (MAP3K7IP2, Accession NP_055908.1). Accordingly, utilities of GAM106 include diagnosis, prevention and treatment of diseases and clinical conditions associated with MAP3K7IP2.

MGC11386 (Accession NP_116322.1) is another GAM106 target gene, herein designated TARGET GENE. MGC11386 BINDING SITE is a target binding site found in the 3' untranslated region of mRNA encoded by MGC11386, corresponding to a target binding site such as BINDING SITE I, BINDING SITE II or BINDING SITE III of FIG. 8. Table 4 illustrates the complementarity of the nucleotide sequences of MGC11386 BINDING SITE, designated SEQ ID:5748, to the nucleotide sequence of GAM106 RNA, herein designated GAM RNA, also designated SEQ ID:231.

Another function of GAM106 is therefore inhibition of MGC11386 (Accession NP_116322.1). Accordingly, utilities of GAM106 include diagnosis, prevention and treatment of diseases and clinical conditions associated with MGC11386.

MGC27005 (Accession NP_689795.2) is another GAM106 target gene, herein designated TARGET GENE. MGC27005 BINDING SITE is a target binding site found in the 3' untranslated region of mRNA encoded by MGC27005, corresponding to a target binding site such as BINDING SITE I, BINDING SITE II or BINDING SITE III of FIG. 8. Table 4 illustrates the complementarity of the nucleotide sequences of MGC27005 BINDING SITE, designated SEQ ID:14955, to the nucleotide sequence of GAM106 RNA, herein designated GAM RNA, also designated SEQ ID:231.

Another function of GAM106 is therefore inhibition of MGC27005 (Accession NP_689795.2). Accordingly, utilities of GAM106 include diagnosis, prevention and treatment of diseases and clinical conditions associated with MGC27005.

Machado-joseph disease (spinocerebellar ataxia 3, olivopontocerebellar ataxia 3, autosomal dominant, ataxin 3) (MJD, Accession NP_004984.2) is another GAM106 target gene, herein designated TARGET GENE. MJD BINDING SITE is a target binding site found in the 3' untranslated region of multiple transcripts of mRNA encoded by MJD, corresponding to a target binding site such as BINDING SITE I, BINDING SITE II or BINDING SITE III of FIG. 8. Table 4 illustrates the complementarity of the nucleotide sequences of MJD BINDING SITE, designated SEQ ID:18203, to the nucleotide sequence of GAM106 RNA, herein designated GAM RNA, also designated SEQ ID:231.

Another function of GAM106 is therefore inhibition of Machado-joseph disease (spinocerebellar ataxia 3, olivopontocerebellar ataxia 3, autosomal dominant, ataxin 3) (MJD, Accession NP_004984.2). Accordingly, utilities of GAM106 include diagnosis, prevention and treatment of diseases and clinical conditions associated with MJD.

Machado-joseph disease (spinocerebellar ataxia 3, olivopontocerebellar ataxia 3, autosomal dominant, ataxin 3) (MJD, Accession NP_109376.1) is another GAM106 target gene, herein designated TARGET GENE. MJD BINDING SITE is a target binding site found in the 3' untranslated region of multiple transcripts of mRNA encoded by MJD, corresponding to a target binding site such as BINDING SITE I, BINDING SITE II or BINDING SITE III of FIG. 8. Table 4 illustrates the complementarity of the nucleotide sequences of MJD BINDING SITE, designated SEQ ID:18203, to the nucleotide sequence of GAM106 RNA, herein designated GAM RNA, also designated SEQ ID:231.

Another function of GAM106 is therefore inhibition of Machado-joseph disease (spinocerebellar ataxia 3, olivopontocerebellar ataxia 3, autosomal dominant, ataxin 3) (MJD, Accession NP_109376.1). Accordingly, utilities of GAM106 include diagnosis, prevention and treatment of diseases and clinical conditions associated with MJD.

Oligophrenin 1 (OPHN1, Accession NP_002538.1) is another GAM106 target gene, herein designated TARGET GENE. OPHN1 BINDING SITE is a target binding site found in the 3' untranslated region of mRNA encoded by OPHN1, corresponding to a target binding site such as BINDING SITE I, BINDING SITE II or BINDING SITE III of FIG. 8. Table 4 illustrates the complementarity of the nucleotide sequences of OPHN1 BINDING SITE, designated SEQ ID:14955, to the nucleotide sequence of GAM106 RNA, herein designated GAM RNA, also designated SEQ ID:231.

Another function of GAM106 is therefore inhibition of Oligophrenin 1 (OPHN1, Accession NP_002538.1). Accordingly, utilities of GAM106 include diagnosis, prevention and treatment of diseases and clinical conditions associated with OPHN1.

Phosphodiesterase 10a (PDE10A, Accession NP_006652.1) is another GAM106 target gene, herein designated TARGET GENE. PDE10A BINDING SITE is a target binding site found in the 3' untranslated region of mRNA encoded by PDE10A, corresponding to a target binding site such as BINDING SITE I, BINDING SITE II or BINDING SITE III of FIG. 8. Table 4 illustrates the complementarity of the nucleotide sequences of PDE10A BINDING SITE, designated SEQ ID:13919, to the nucleotide sequence of GAM106 RNA, herein designated GAM RNA, also designated SEQ ID:231.

Another function of GAM106 is therefore inhibition of Phosphodiesterase 10a (PDE10A, Accession NP_006652.1). Accordingly, utilities of GAM106 include diagnosis, prevention and treatment of diseases and clinical conditions associated with PDE10A.

Phosphorylase kinase, alpha 1 (muscle) (PHKA1, Accession NP_002628.1) is another GAM106 target gene, herein designated TARGET GENE. PHKA1 BINDING SITE is a target binding site found in the 3' untranslated region of mRNA encoded by PHKA1, corresponding to a target binding site such as BINDING SITE I, BINDING SITE II or BINDING SITE III of FIG. 8. Table 4 illustrates the complementarity of the nucleotide sequences of PHKA1 BINDING SITE, designated SEQ ID:9297, to the nucleotide sequence of GAM106 RNA, herein designated GAM RNA, also designated SEQ ID:231.

Another function of GAM106 is therefore inhibition of Phosphorylase kinase, alpha 1 (muscle) (PHKA1, Accession NP_002628.1). Accordingly, utilities of GAM106 include diagnosis, prevention and treatment of diseases and clinical conditions associated with PHKA1.

Prostaglandin-endoperoxide synthase 2 (prostaglandin g/h synthase and cyclooxygenase) (PTGS2, Accession NP_000954.1) is another GAM106 target gene, herein designated TARGET GENE. PTGS2 BINDING SITE is a target binding site found in the 3' untranslated region of mRNA encoded by PTGS2, corresponding to a target binding site such as BINDING SITE I, BINDING SITE II or BINDING SITE III of FIG. 8. Table 4 illustrates the complementarity of the nucleotide sequences of PTGS2 BINDING SITE, designated SEQ ID:10976, to the nucleotide sequence of GAM106 RNA, herein designated GAM RNA, also designated SEQ ID:231.

Another function of GAM106 is therefore inhibition of Prostaglandin-endoperoxide synthase 2 (prostaglandin g/h synthase and cyclooxygenase) (PTGS2, Accession NP_000954.1), a gene which may have a role as a major mediator of inflammation and/or a role for prostanoid signaling in activity-dependent plasticity. and therefore may be associated with Inflammatory diseases such as rheumatoid arthritis. Accordingly, utilities of GAM106 include diagnosis, prevention and treatment of Inflammatory diseases such as rheumatoid arthritis, and of other diseases and clinical conditions associated with PTGS2.

The function of PTGS2 and its association with various diseases and clinical conditions, has been established by previous studies, as described hereinabove with reference to GAM100.1. Rab3a interacting protein (rabin3) (RAB3IP, Accession NP_071901.2) is another GAM106 target gene, herein designated TARGET GENE. RAB3IP BINDING SITE is a target binding site found in the 5' untranslated region of mRNA encoded by RAB3IP, corresponding to a target binding site such as BINDING SITE I, BINDING SITE II or BINDING SITE III of FIG. 8. Table 4 illustrates the complementarity of the nucleotide sequences of RAB3IP BINDING SITE, designated SEQ ID:13725, to the nucleotide sequence of GAM106 RNA, herein designated GAM RNA, also designated SEQ ID:231.

Another function of GAM106 is therefore inhibition of Rab3a interacting protein (rabin3) (RAB3IP, Accession NP_071901.2). Accordingly, utilities of GAM106 include diagnosis, prevention and treatment of diseases and clinical conditions associated with RAB3IP.

RASGRP3 (Accession NP_733772.1) is another GAM106 target gene, herein designated TARGET GENE. RASGRP3 BINDING SITE is a target binding site found in the 3' untranslated region of multiple transcripts of mRNA encoded by RASGRP3, corresponding to a target binding site such as BINDING SITE I, BINDING SITE II or BINDING SITE III of FIG. 8. Table 4 illustrates the complementarity of the nucleotide sequences of RASGRP3 BINDING SITE, designated SEQ ID:9577, to the nucleotide sequence of GAM106 RNA, herein designated GAM RNA, also designated SEQ ID:231.

Another function of GAM106 is therefore inhibition of RASGRP3 (Accession NP_733772.1). Accordingly, utilities of GAM106 include diagnosis, prevention and treatment of diseases and clinical conditions associated with RASGRP3.

RETNLB (Accession NP_115968.1) is another GAM106 target gene, herein designated TARGET GENE. RETNLB BINDING SITE is a target binding site found in the 3' untranslated region of mRNA encoded by RETNLB, corresponding to a target binding site such as BINDING SITE I, BINDING SITE II or BINDING SITE III of FIG. 8. Table 4 illustrates the complementarity of the nucleotide sequences of RETNLB BINDING SITE, designated SEQ ID:14955, to the nucleotide sequence of GAM106 RNA, herein designated GAM RNA, also designated SEQ ID:231.

Another function of GAM106 is therefore inhibition of RETNLB (Accession NP_115968.1). Accordingly, utilities of GAM106 include diagnosis, prevention and treatment of diseases and clinical conditions associated with RETNLB.

Rhomboid, veinlet-like 1 (drosophila) (RHBDL, Accession NP_003952.1) is another GAM106 target gene, herein designated TARGET GENE. RHBDL BINDING SITE is a target binding site found in the 3' untranslated region of mRNA encoded by RHBDL, corresponding to a target binding site such as BINDING SITE I, BINDING SITE II or BINDING SITE III of FIG. 8. Table 4 illustrates the complementarity of the nucleotide sequences of RHBDL BINDING SITE, designated SEQ ID:4596, to the nucleotide sequence of GAM106 RNA, herein designated GAM RNA, also designated SEQ ID:231.

Another function of GAM106 is therefore inhibition of Rhomboid, veinlet-like 1 (drosophila) (RHBDL, Accession NP_003952.1). Accordingly, utilities of GAM106 include diagnosis, prevention and treatment of diseases and clinical conditions associated with RHBDL.

Ring finger protein 32 (RNF32, Accession NP_112198.1) is another GAM106 target gene, herein designated TARGET GENE. RNF32 BINDING SITE is a target binding site found in the 3' untranslated region of mRNA encoded by RNF32, corresponding to a target binding site such as BINDING SITE I, BINDING SITE II or BINDING SITE III of FIG. 8. Table 4 illustrates the complementarity of the nucleotide sequences of RNF32 BINDING SITE, designated SEQ ID:14433, to the nucleotide sequence of GAM106 RNA, herein designated GAM RNA, also designated SEQ ID:231.

Another function of GAM106 is therefore inhibition of Ring finger protein 32 (RNF32, Accession NP_112198.1). Accordingly, utilities of GAM106 include diagnosis, prevention and treatment of diseases and clinical conditions associated with RNF32.

S100 calcium binding protein, beta (neural) (S100B, Accession NP_006263.1) is another GAM106 target gene, herein designated TARGET GENE. S100B BINDING SITE is a target binding site found in the 3' untranslated region of mRNA encoded by S100B, corresponding to a target binding site such as BINDING SITE I, BINDING SITE II or BINDING SITE III of FIG. 8. Table 4 illustrates the complementarity of the nucleotide sequences of S100B BINDING SITE, designated SEQ ID:14463, to the nucleotide sequence of GAM106 RNA, herein designated GAM RNA, also designated SEQ ID:231.

Another function of GAM106 is therefore inhibition of S100 calcium binding protein, beta (neural) (S100B, Accession NP_006263.1), a gene which weakly binds calcium but binds zinc very tightly-distinct binding sites with different affinities exist for both ions on each monomer. Accordingly, utilities of GAM106 include diagnosis, prevention and treatment of diseases and clinical conditions associated with S100B.

The function of S100B and its association with various diseases and clinical conditions, has been established by previous studies, as described hereinabove with reference to GAM49.1. STAF42 (Accession NP_444281.1) is another GAM106 target gene, herein designated TARGET GENE. STAF42 BINDING SITE is a target binding site found in the 3' untranslated region of mRNA encoded by STAF42, corresponding to a target binding site such as BINDING SITE I, BINDING SITE II or BINDING SITE III of FIG. 8. Table 4 illustrates the complementarity of the nucleotide sequences of STAF42 BINDING SITE, designated SEQ ID:565, to the nucleotide sequence of GAM106 RNA, herein designated GAM RNA, also designated SEQ ID:231.

Another function of GAM106 is therefore inhibition of STAF42 (Accession NP_444281.1). Accordingly, utilities of GAM106 include diagnosis, prevention and treatment of diseases and clinical conditions associated with STAF42.

Syntaxin 7 (STX7, Accession NP_003560.1) is another GAM106 target gene, herein designated TARGET GENE. STX7 BINDING SITE is a target binding site found in the 3' untranslated region of mRNA encoded by STX7, corresponding to a target binding site such as BINDING SITE I, BINDING SITE II or BINDING SITE III of FIG. 8. Table 4 illustrates the complementarity of the nucleotide sequences of STX7 BINDING SITE, designated SEQ ID:10787, to the nucleotide sequence of GAM106 RNA, herein designated GAM RNA, also designated SEQ ID:231.

Another function of GAM106 is therefore inhibition of Syntaxin 7 (STX7, Accession NP_003560.1). Accordingly, utilities of GAM106 include diagnosis, prevention and treatment of diseases and clinical conditions associated with STX7.

Surfeit 5 (SURF5, Accession NP_852468.1) is another GAM106 target gene, herein designated TARGET GENE. SURF5 BINDING SITE is a target binding site found in the 3' untranslated region of multiple transcripts of mRNA encoded by SURF5, corresponding to a target binding site such as BINDING SITE I, BINDING SITE II or BINDING SITE III of FIG. 8. Table 4 illustrates the complementarity of the nucleotide sequences of SURF5 BINDING SITE, designated SEQ ID:6232, to the nucleotide sequence of GAM106 RNA, herein designated GAM RNA, also designated SEQ ID:231.

Another function of GAM106 is therefore inhibition of Surfeit 5 (SURF5, Accession NP_852468.1). Accordingly, utilities of GAM106 include diagnosis, prevention and treatment of diseases and clinical conditions associated with SURF5.

Tbc1 domain family, member 2 (TBC1D2, Accession NP_060891.1) is another GAM106 target gene, herein designated TARGET GENE. TBC1D2 BINDING SITE is a target binding site found in the 5' untranslated region of mRNA encoded by TBC1D2, corresponding to a target binding site such as BINDING SITE I, BINDING SITE II or BINDING SITE III of FIG. 8. Table 4 illustrates the complementarity of the nucleotide sequences of TBC1D2 BINDING SITE, designated SEQ ID:4122, to the nucleotide sequence of GAM106 RNA, herein designated GAM RNA, also designated SEQ ID:231.

Another function of GAM106 is therefore inhibition of Tbc1 domain family, member 2 (TBC1D2, Accession NP_060891.1). Accordingly, utilities of GAM106 include diagnosis, prevention and treatment of diseases and clinical conditions associated with TBC1D2.

Tolloid-like 1 (TLL1, Accession NP_036596.3) is another GAM106 target gene, herein designated TARGET GENE. TLL1 BINDING SITE is a target binding site found in the 3' untranslated region of mRNA encoded by TLL1, corresponding to a target binding site such as BINDING SITE I, BINDING SITE II or BINDING SITE III of FIG. 8. Table 4 illustrates the complementarity of the nucleotide sequences of TLL1 BINDING SITE, designated SEQ ID:5091, to the nucleotide sequence of GAM106 RNA, herein designated GAM RNA, also designated SEQ ID:231.

Another function of GAM106 is therefore inhibition of Tolloid-like 1 (TLL1, Accession NP_036596.3), a gene which is involved in bone morphogenesis. Accordingly, utilities of GAM106 include diagnosis, prevention and treatment of diseases and clinical conditions associated with TLL1.

The function of TLL1 has been established by previous studies. Scott et al. (1999) compared enzymatic activities and expression domains of 4 mammalian BMP1/TLD-like proteases and found differences in their ability to process fibrillar collagen precursors and to cleave chordin (OMIM Ref. No. 603475). As previously demonstrated for BMP1 and TLD, TLL1 specifically processes procollagen C-propeptides at the physiologically relevant site, whereas TLL2 (OMIM Ref. No. 606743) lacks this activity. BMP1 and TLL1 cleave chordin, at sites similar to procollagen C-propeptide cleavage sites, and counteract dorsalizing effects of chordin upon overexpression on Xenopus embryos. Proteases TLD and TLL2 do not cleave chordin.

Animal model experiments lend further support to the function of TLL1. Clark et al. (1999) used gene targeting in embryonic stem cells to produce mice with a disrupted allele for Tll1. Homozygous mutants were embryonic lethal, with death at midgestation from cardiac failure and a constellation of developmental defects confined to the heart. Constant features were incomplete formation of the muscular interventricular septum and an abnormal and novel positioning of the heart and aorta.

It is appreciated that the abovementioned animal model for TLL1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Scott, I. C.; Blitz, I. L.; Pappano, W. N.; Imamura, Y.; Clark, T. G.; Steiglitz, B. M.; Thomas, C. L.; Maas, S. A.; Takahara, K.; Cho, K. W. Y.; Greenspan, D. S.: Mammalian BMP-1/tolloid-related metalloproteinases, including novel family member mammalian tolloid-like 2, have differential enzymatic activities and distributions of expression relevant to patterning and skeletogenesis. Dev. Biol. 213:283-300, 1999; and Clark, T. G.; Conway, S. J.; Scott, I. C.; Labosky, P. A.; Winnier, G.; Bundy, J.; Hogan, B. L. M.; Greenspan, D. S.: The mammalian Tolloid-like 1 gene, Tll1, is necessary for normal s.

Further studies establishing the function and utilities of TLL1 are found in John Hopkins OMIM database record ID 606742, and in cited publications listed in Table 5, which are hereby incorporated by reference.

FIG. 8 further provides a conceptual description of a novel bioinformatically detected of the present invention, referred to here as Genomic Address Messenger 107 (GAM107), which modulates expression of respective target genes thereof, the function and utility of which target genes is known in the art.

GAM107 is a novel bioinformatically detected regulatory, non protein coding, micro RNA (miRNA) gene. The method by which GAM107 was detected is described hereinabove with reference to FIGS. 8-15.

GAM107 gene, herein designated GAM GENE, and GAM107 target gene, herein designated TARGET GENE, are human genes contained in the human genome.

GAM107 gene encodes a GAM107 precursor RNA, herein designated GAM PRECURSOR RNA. Similar to other miRNA genes, and unlike most ordinary genes, GAM107 precursor RNA does not encode a protein. A nucleotide sequence identical or highly similar to the nucleotide sequence of GAM107 precursor RNA is designated SEQ ID:79, and is provided hereinbelow with reference to the sequence listing part.

GAM107 precursor RNA folds onto itself, forming GAM107 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM107 precursor RNA folds onto itself, forming GAM107 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM107 precursor RNA, designated SEQ-ID:79, and a schematic representation of a predicted secondary folding of GAM107 folded precursor RNA are further described with reference to Table 2, hereby incorporated by reference.

An enzyme complex designated DICER COMPLEX, 'dices' the GAM107 folded precursor RNA into GAM107 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM107 RNA is designated SEQ ID:341, and is provided hereinbelow with references to the sequence listing part and Table 3, hereby incorporated by reference.

GAM107 target gene, herein designated TARGET GENE, encodes a corresponding messenger RNA, GAM107 target RNA, herein designated GAM TARGET RNA. GAM107 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM107 RNA, herein designated GAM RNA, binds complementarily to one or more target binding sites located in untranslated regions of GAM107 target RNA, herein designated GAM TARGET RNA. This complementary binding is due to the fact that the nucleotide sequence of GAM107 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM107 RNA may have a different number of target binding sites in untranslated regions of a GAM107 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM107 RNA, herein designated GAM RNA, to target binding sites on GAM107 target RNA, herein designated GAM TARGET RNA, such as BINDING SITE I, BINDING SITE II and BINDING SITE III, inhibits translation of GAM107 target RNA into GAM107 target protein, herein designated GAM TARGET PROTEIN. GAM target protein is therefore outlined by a broken line.

It is appreciated that GAM107 target gene, herein designated TARGET GENE, in fact represents a plurality of GAM107 target genes. The mRNA of each one of this plurality of GAM107 target genes comprises one or more target binding sites, each having a nucleotide sequence which is at least partly complementary to GAM107 RNA, herein designated GAM RNA, and which when bound by GAM107 RNA causes inhibition of translation of respective one or more GAM107 target proteins.

It is further appreciated by one skilled in the art that the mode of translational inhibition illustrated by FIG. 8 with specific reference to translational inhibition exerted by GAM107 gene, herein designated GAM GENE, on one or more GAM107 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM107 correlate with, and may be deduced from, the identity of the target genes which GAM107 binds and inhibits, and the function of these target genes, as elaborated hereinbelow.

Butyrophilin, subfamily 2, member a2 (BTN2A2, Accession NM_006995.2) is a GAM107 target gene, herein designated TARGET GENE. BTN2A2 BINDING SITE is a target binding site found in the 3' untranslated region of mRNA encoded by BTN2A2, corresponding to a target binding site such as BINDING SITE I, BINDING SITE II or BINDING SITE III of FIG. 8. Table 4 illustrates the complementarity of the nucleotide sequences of BTN2A2 BINDING SITE, designated SEQ ID:19308, to the nucleotide sequence of GAM107 RNA, herein designated GAM RNA, also designated SEQ ID:341.

A function of GAM107 is therefore inhibition of Butyrophilin, subfamily 2, member a2 (BTN2A2, Accession NM_006995.2). Accordingly, utilities of GAM107 include diagnosis, prevention and treatment of diseases and clinical conditions associated with BTN2A2.

Distal-less homeobox 4 (DLX4, Accession NM_138281.1) is another GAM107 target gene, herein designated TARGET GENE. DLX4 BINDING SITE is a target binding site found in the 3' untranslated region of multiple transcripts of mRNA encoded by DLX4, corresponding to a target binding site such as BINDING SITE I, BINDING SITE II or BINDING SITE III of FIG. 8. Table 4 illustrates the complementarity of the nucleotide sequences of DLX4 BINDING SITE, designated SEQ ID:489, to the nucleotide sequence of GAM107 RNA, herein designated GAM RNA, also designated SEQ ID:341.

Another function of GAM107 is therefore inhibition of Distal-less homeobox 4 (DLX4, Accession NM_138281.1), a gene which may regulate gene expression, morphogenesis, and differentiation. Accordingly, utilities of GAM107 include diagnosis, prevention and treatment of diseases and clinical conditions associated with DLX4.

The function of DLX4 has been established by previous studies. Using degenerate PCR, Nakamura et al. (1996) cloned a gene, which they referred to as DLX7, from human and mouse that may represent the mammalian ortholog of the newt gene NuHBox-5. They isolated a human cDNA predicting a 167-amino acid protein. The homeodomains of these genes are highly similar to those of all other vertebrate DLX genes, but there is divergence upstream of the homeodomain between the human and mouse DLX7 genes and between DLX7 and other DLX genes. They presented evidence that the mouse Dlx7 gene is alternatively spliced. By Northern blot analysis, Nakamura et al. (1996) found that DLX7 is expressed as a 2.3-kb transcript in several human cell lines. By fluorescence in situ hybridization (FISH), Nakamura et al. (1996) mapped DLX7 to 17q21.3-q22. They stated that the human DLX7 and DLX3 (OMIM Ref. No. 600525) genes are 10 kb apart and are arranged in a tail- to - tail tandem orientation, similarly to that found in mouse. Using dual-color FISH, Nakamura et al. (1996) determined that human DLX7 and HOX9B (OMIM Ref. No. 142964) lie within 2 Mb of one another. Quinn et al. (1997) undertook a DNA binding site screen of a 32-week human placental cDNA library using a consensus homeodomain binding site as a probe. They claimed that this study represented the first library screen carried out to isolate homeo box genes from the human placenta. They found that 3 homeo box genes known to be expressed in embry, HB24 (OMIM Ref. No. 142995), GAX (OMIM Ref. No. 600535), and MSX2 (OMIM Ref. No. 123101), are also expressed in the placenta. They also identified a novel homeo box gene, designated DLX4 by them, that showed 85% sequence identity with the homeodomain encoded by the Drosophila 'distal- less' gene. Using FISH, they assigned DLX4 to 17q21-q22. This placed DLX4 in the same region of chromosome 17 as a member of the distal-less family gene DLX3 (OMIM Ref. No. 600525) and the HOXB homeo box gene cluster (see OMIM Ref. No. HOXB1; 142968). DLX1 (OMIM Ref. No. 600029) and DLX2 (OMIM Ref. No. 126255) are closely linked on chromosome 2; DLX5 (OMIM Ref. No. 600028) and DLX6 (OMIM Ref. No. 600030) are closely linked on chromosome 7. Thus, Quinn et al. (1997) predicted that DLX3 and DLX4 are closely linked and that they arose through gene duplication and divergence from a common ancestral precursor.

Full details of the abovementioned studies are described in the following publications, the disclosure of which are hereby incorporated by reference:

Morasso, M. I.; Yonescu, R.; Griffin, C. A.; Sargent, T. D.: Localization of human DLX8 to chromosome 17q21.3-q22 by fluorescence in situ hybridization. Mammalian Genome 8:302-303, 1997; and Nakamura, S.; Stock, D. W.; Wydner, K. L.; Bollekens, J. A.; Takeshita, K.; Nagai, B. M.; Chiba, S.; Kitamura, T.; Freeland, T. M.; Zhao, Z.; Minowada, J.; Lawrence, J. B.; Weiss, K. M.

Further studies establishing the function and utilities of DLX4 are found in John Hopkins OMIM database record ID 601911, and in cited publications listed in Table 5, which are hereby incorporated by reference. LOC127534 (Accession) is another GAM107 target gene, herein designated TARGET GENE. LOC127534 BINDING SITE is a target binding site found in the 3' untranslated region of mRNA encoded by LOC127534, corresponding to a target binding site such as BINDING SITE I, BINDING SITE II or BINDING SITE III of FIG. 8. Table 4 illustrates the complementarity of the nucleotide sequences of LOC127534 BINDING SITE, designated SEQ ID:8266, to the nucleotide sequence of GAM107 RNA, herein designated GAM RNA, also designated SEQ ID:341.

Another function of GAM107 is therefore inhibition of LOC127534 (Accession). Accordingly, utilities of GAM107 include diagnosis, prevention and treatment of diseases and clinical conditions associated with LOC127534.

FIG. 8 further provides a conceptual description of a novel bioinformatically detected of the present invention, referred to here as Genomic Address Messenger 108 (GAM108), which modulates expression of respective target genes thereof, the function and utility of which target genes is known in the art.

GAM108 is a novel bioinformatically detected regulatory, non protein coding, micro RNA (miRNA) gene. The method by which GAM108 was detected is described hereinabove with reference to FIGS. 8-15.

GAM108 gene, herein designated GAM GENE, and GAM108 target gene, herein designated TARGET GENE, are human genes contained in the human genome.

GAM108 gene encodes a GAM108 precursor RNA, herein designated GAM PRECURSOR RNA. Similar to other miRNA genes, and unlike most ordinary genes, GAM108 precursor RNA does not encode a protein. A nucleotide sequence identical or highly similar to the nucleotide sequence of GAM108 precursor RNA is designated SEQ ID:171, and is provided hereinbelow with reference to the sequence listing part.

GAM108 precursor RNA folds onto itself, forming GAM108 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM108 precursor RNA folds onto itself, forming GAM108 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM108 precursor RNA, designated SEQ-ID:171, and a schematic representation of a predicted secondary folding of GAM108 folded precursor RNA are further described with reference to Table 2, hereby incorporated by reference.

An enzyme complex designated DICER COMPLEX, 'dices' the GAM108 folded precursor RNA into GAM108 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM108 RNA is designated SEQ ID:298, and is provided hereinbelow with references to the sequence listing part and Table 3, hereby incorporated by reference.

GAM108 target gene, herein designated TARGET GENE, encodes a corresponding messenger RNA, GAM108 target RNA, herein designated GAM TARGET RNA. GAM108 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM108 RNA, herein designated GAM RNA, binds complementarily to one or more target binding sites located in untranslated regions of GAM108 target RNA, herein designated GAM TARGET RNA. This complementary binding is due to the fact that the nucleotide sequence of GAM108 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM108 RNA may have a different number of target binding sites in untranslated regions of a GAM108 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM108 RNA, herein designated GAM RNA, to target binding sites on GAM108 target RNA, herein designated GAM TARGET RNA, such as BINDING SITE I, BINDING SITE II and BINDING SITE III, inhibits translation of GAM108 target RNA into GAM108 target protein, herein designated GAM TARGET PROTEIN. GAM target protein is therefore outlined by a broken line.

It is appreciated that GAM108 target gene, herein designated TARGET GENE, in fact represents a plurality of GAM108 target genes. The mRNA of each one of this plurality of GAM108 target genes comprises one or more target binding sites, each having a nucleotide sequence which is at least partly complementary to GAM108 RNA, herein designated GAM RNA, and which when bound by GAM108 RNA causes inhibition of translation of respective one or more GAM108 target proteins.

It is further appreciated by one skilled in the art that the mode of translational inhibition illustrated by FIG. 8 with specific reference to translational inhibition exerted by GAM108 gene, herein designated GAM GENE, on one or more GAM108 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM108 correlate with, and may be deduced from, the identity of the target genes which GAM108 binds and inhibits, and the function of these target genes, as elaborated hereinbelow.

FLJ21276 (Accession) is a GAM108 target gene, herein designated TARGET GENE. FLJ21276 BINDING SITE is a target binding site found in the 3' untranslated region of mRNA encoded by FLJ21276, corresponding to a target binding site such as BINDING SITE I, BINDING SITE II or BINDING SITE III of FIG. 8. Table 4 illustrates the complementarity of the nucleotide sequences of FLJ21276 BINDING SITE, designated SEQ ID:532, to the nucleotide sequence of GAM108 RNA, herein designated GAM RNA, also designated SEQ ID:298.

A function of GAM108 is therefore inhibition of FLJ21276 (Accession). Accordingly, utilities of GAM108 include diagnosis, prevention and treatment of diseases and clinical conditions associated with FLJ21276.

Forkhead box e1 (thyroid transcription factor 2) (FOXE1, Accession NM_004473.3) is another GAM108 target gene, herein designated TARGET GENE. FOXE1 BINDING SITE is a target binding site found in the 3' untranslated region of mRNA encoded by FOXE1, corresponding to a target binding site such as BINDING SITE I, BINDING SITE II or BINDING SITE III of FIG. 8. Table 4 illustrates the complementarity of the nucleotide sequences of FOXE1 BINDING SITE, designated SEQ ID:9989, to the nucleotide sequence of GAM108 RNA, herein designated GAM RNA, also designated SEQ ID:298.

Another function of GAM108 is therefore inhibition of Forkhead box e1 (thyroid transcription factor 2) (FOXE1, Accession NM_004473.3). Accordingly, utilities of GAM108 include diagnosis, prevention and treatment of diseases and clinical conditions associated with FOXE1.

Protein kinase (camp-dependent, catalytic) inhibitor gamma (PKIG, Accession NM_007066.2) is another GAM108 target gene, herein designated TARGET GENE. PKIG BINDING SITE is a target binding site found in the 3' untranslated region of mRNA encoded by PKIG, corresponding to a target binding site such as BINDING SITE I, BINDING SITE II or BINDING SITE III of FIG. 8. Table 4 illustrates the complementarity of the nucleotide sequences of PKIG BINDING SITE, designated SEQ ID:15790, to the nucleotide sequence of GAM108 RNA, herein designated GAM RNA, also designated SEQ ID:298.

Another function of GAM108 is therefore inhibition of Protein kinase (camp-dependent, catalytic) inhibitor gamma (PKIG, Accession NM_007066.2). Accordingly, utilities of GAM108 include diagnosis, prevention and treatment of diseases and clinical conditions associated with PKIG.

FIG. 8 further provides a conceptual description of a novel bioinformatically detected of the present invention, referred to here as Genomic Address Messenger 109 (GAM109), which modulates expression of respective target genes thereof, the function and utility of which target genes is known in the art.

GAM109 is a novel bioinformatically detected regulatory, non protein coding, micro RNA (miRNA) gene. The method by which GAM109 was detected is described hereinabove with reference to FIGS. 8-15.

GAM109 gene, herein designated GAM GENE, and GAM109 target gene, herein designated TARGET GENE, are human genes contained in the human genome.

GAM109 gene encodes a GAM109 precursor RNA, herein designated GAM PRECURSOR RNA. Similar to other miRNA genes, and unlike most ordinary genes, GAM109 precursor RNA does not encode a protein. A nucleotide sequence identical or highly similar to the nucleotide sequence of GAM109 precursor RNA is designated SEQ ID:90, and is provided hereinbelow with reference to the sequence listing part.

GAM109 precursor RNA folds onto itself, forming GAM109 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM109 precursor RNA folds onto itself, forming GAM109 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM109 precursor RNA, designated SEQ-ID:90, and a schematic representation of a predicted secondary folding of GAM109 folded precursor RNA are further described with reference to Table 2, hereby incorporated by reference.

An enzyme complex designated DICER COMPLEX, 'dices' the GAM109 folded precursor RNA into GAM109 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM109 RNA is designated SEQ ID:290, and is provided hereinbelow with references to the sequence listing part and Table 3, hereby incorporated by reference.

GAM109 target gene, herein designated TARGET GENE, encodes a corresponding messenger RNA, GAM109 target RNA, herein designated GAM TARGET RNA. GAM109 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM109 RNA, herein designated GAM RNA, binds complementarily to one or more target binding sites located in untranslated regions of GAM109 target RNA, herein designated GAM TARGET RNA. This complementary binding is due to the fact that the nucleotide sequence of GAM109 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM109 RNA may have a different number of target binding sites in untranslated regions of a GAM109 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM109 RNA, herein designated GAM RNA, to target binding sites on GAM109 target RNA, herein designated GAM TARGET RNA, such as BINDING SITE I, BINDING SITE II and BINDING SITE III, inhibits translation of GAM109 target RNA into GAM109 target protein, herein designated GAM TARGET PROTEIN. GAM target protein is therefore outlined by a broken line.

It is appreciated that GAM109 target gene, herein designated TARGET GENE, in fact represents a plurality of GAM109 target genes. The mRNA of each one of this plurality of GAM109 target genes comprises one or more target binding sites, each having a nucleotide sequence which is at least partly complementary to GAM109 RNA, herein designated GAM RNA, and which when bound by GAM109 RNA causes inhibition of translation of respective one or more GAM109 target proteins.

It is further appreciated by one skilled in the art that the mode of translational inhibition illustrated by FIG. 8 with specific reference to translational inhibition exerted by GAM109 gene, herein designated GAM GENE, on one or more GAM109 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM109 correlate with, and may be deduced from, the identity of the target genes which GAM109 binds and inhibits, and the function of these target genes, as elaborated hereinbelow.

A disintegrin and metalloproteinase domain 10 (ADAM10, Accession NM_001110.1) is a GAM109 target gene, herein designated TARGET GENE. ADAM10 BINDING SITE is a target binding site found in the 5' untranslated region of mRNA encoded by ADAM10, corresponding to a target binding site such as BINDING SITE I, BINDING SITE II or BINDING SITE III of FIG. 8. Table 4 illustrates the complementarity of the nucleotide sequences of ADAM10 BINDING SITE, designated SEQ ID:14240, to the nucleotide sequence of GAM109 RNA, herein designated GAM RNA, also designated SEQ ID:290.

A function of GAM109 is therefore inhibition of A disintegrin and metalloproteinase domain 10 (ADAM10, Accession NM_001110.1), a gene which Member of ADAM family of zinc metalloproteases. Accordingly, utilities of GAM109 include diagnosis, prevention and treatment of diseases and clinical conditions associated with ADAM10.

The function of ADAM10 and its association with various diseases and clinical conditions, has been established by previous studies, as described hereinabove with reference to GAM47.1. Atpase, h+ transporting, lysosomal 21 kda, v0 subunit c" (ATP6V0B, Accession NM_004047.2) is another GAM109 target gene, herein designated TARGET GENE. ATP6V0B BINDING SITE is a target binding site found in the 3' untranslated region of mRNA encoded by ATP6V0B, corresponding to a target binding site such as BINDING SITE I, BINDING SITE II or BINDING SITE III of FIG. 8. Table 4 illustrates the complementarity of the nucleotide sequences of ATP6V0B BINDING SITE, designated SEQ ID:18127, to the nucleotide sequence of GAM109 RNA, herein designated GAM RNA, also designated SEQ ID:290.

Another function of GAM109 is therefore inhibition of Atpase, h+ transporting, lysosomal 21 kda, v0 subunit c" (ATP6V0B, Accession NM_004047.2). Accordingly, utilities of GAM109 include diagnosis, prevention and treatment of diseases and clinical conditions associated with ATP6V0B.

BMF (Accession NM_033503.2) is another GAM109 target gene, herein designated TARGET GENE. BMF BINDING SITE is a target binding site found in the 3' untranslated region of mRNA encoded by BMF, corresponding to a target binding site such as BINDING SITE I, BINDING SITE II or BINDING SITE III of FIG. 8. Table 4 illustrates the complementarity of the nucleotide sequences of BMF BINDING SITE, designated SEQ ID:13824, to the nucleotide sequence of GAM109 RNA, herein designated GAM RNA, also designated SEQ ID:290.

Another function of GAM109 is therefore inhibition of BMF (Accession NM_033503.2). Accordingly, utilities of GAM109 include diagnosis, prevention and treatment of diseases and clinical conditions associated with BMF.

BOP (Accession XM_097915.2) is another GAM109 target gene, herein designated TARGET GENE. BOP BINDING SITE is a target binding site found in the 5' untranslated region of mRNA encoded by BOP, corresponding to a target binding site such as BINDING SITE I, BINDING SITE II or BINDING SITE III of FIG. 8. Table 4 illustrates the complementarity of the nucleotide sequences of BOP BINDING SITE, designated SEQ ID:6290, to the nucleotide sequence of GAM109 RNA, herein designated GAM RNA, also designated SEQ ID:290.

Another function of GAM109 is therefore inhibition of BOP (Accession XM_097915.2). Accordingly, utilities of GAM109 include diagnosis, prevention and treatment of diseases and clinical conditions associated with BOP.

Chromosome 20 open reading frame 124 (C20orf124, Accession XM_300247.1) is another GAM109 target gene, herein designated TARGET GENE. C20orf124 BINDING SITE is a target binding site found in the 3' untranslated region of mRNA encoded by C20orf124, corresponding to a target binding site such as BINDING SITE I, BINDING SITE II or BINDING SITE III of FIG. 8. Table 4 illustrates the complementarity of the nucleotide sequences of C20orf124 BINDING SITE, designated SEQ ID:14412, to the nucleotide sequence of GAM109 RNA, herein designated GAM RNA, also designated SEQ ID:290.

Another function of GAM109 is therefore inhibition of Chromosome 20 open reading frame 124 (C20orf124, Accession XM_300247.1). Accordingly, utilities of GAM109 include diagnosis, prevention and treatment of diseases and clinical conditions associated with C20orf124.

Core-binding factor, runt domain, alpha subunit 2; translocated to, 2 (CBFA2T2, Accession NM_175864.1) is another GAM109 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:2361, to the nucleotide sequence of GAM109 RNA, herein designated GAM RNA, also designated SEQ ID:290.

Another function of GAM109 is therefore inhibition of Core-binding factor, runt domain, alpha subunit 2; translocated to, 2 (CBFA2T2, Accession NM_175864.1), a gene which is a putative transcription factor. Accordingly, utilities of GAM109 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. FLJ21709 (Accession) is another GAM109 target gene, herein designated TARGET GENE. FLJ21709 BINDING SITE is a target binding site found in the 3' untranslated region of mRNA encoded by FLJ21709, corresponding to a target binding site such as BINDING SITE I, BINDING SITE II or BINDING SITE III of FIG. 8. Table 4 illustrates the complementarity of the nucleotide sequences of FLJ21709 BINDING SITE, designated SEQ ID:15800, to the nucleotide sequence of GAM109 RNA, herein designated GAM RNA, also designated SEQ ID:290.

Another function of GAM109 is therefore inhibition of FLJ21709 (Accession). Accordingly, utilities of GAM109 include diagnosis, prevention and treatment of diseases and clinical conditions associated with FLJ21709.

KIAA1110 (Accession) is another GAM109 target gene, herein designated TARGET GENE. KIAA1110 BINDING SITE is a target binding site found in the 3' untranslated region of mRNA encoded by KIAA1110, corresponding to a target binding site such as BINDING SITE I, BINDING SITE II or BINDING SITE III of FIG. 8. Table 4 illustrates the complementarity of the nucleotide sequences of KIAA1110 BINDING SITE, designated SEQ ID:12180, to the nucleotide sequence of GAM109 RNA, herein designated GAM RNA, also designated SEQ ID:290.

Another function of GAM109 is therefore inhibition of KIAA1110 (Accession). Accordingly, utilities of GAM109 include diagnosis, prevention and treatment of diseases and clinical conditions associated with KIAA1110.

KIAA1466 (Accession XM_050285.2) is another GAM109 target gene, herein designated TARGET GENE. KIAA1466 BINDING SITE is a target binding site found in the 3' untranslated region of mRNA encoded by KIAA1466, corresponding to a target binding site such as BINDING SITE I, BINDING SITE II or BINDING SITE III of FIG. 8. Table 4 illustrates the complementarity of the nucleotide sequences of KIAA1466 BINDING SITE, designated SEQ ID:15690, to the nucleotide sequence of GAM109 RNA, herein designated GAM RNA, also designated SEQ ID:290.

Another function of GAM109 is therefore inhibition of KIAA1466 (Accession XM_050285.2). Accordingly, utilities of GAM109 include diagnosis, prevention and treatment of diseases and clinical conditions associated with KIAA1466.

KIAA1879 (Accession XM_056635.4) is another GAM109 target gene, herein designated TARGET GENE. KIAA1879 BINDING SITE is a target binding site found in the 5' untranslated region of mRNA encoded by KIAA1879, corresponding to a target binding site such as BINDING SITE I, BINDING SITE II or BINDING SITE III of FIG. 8. Table 4 illustrates the complementarity of the nucleotide sequences of KIAA1879 BINDING SITE, designated SEQ ID:5187, to the nucleotide sequence of GAM109 RNA, herein designated GAM RNA, also designated SEQ ID:290.

Another function of GAM109 is therefore inhibition of KIAA1879 (Accession XM_056635.4). Accordingly, utilities of GAM109 include diagnosis, prevention and treatment of diseases and clinical conditions associated with KIAA1879.

LOC131873 (Accession XM_067585.7) is another GAM109 target gene, herein designated TARGET GENE. LOC131873 BINDING SITE is a target binding site found in the 5' untranslated region of mRNA encoded by LOC131873, corresponding to a target binding site such as BINDING SITE I, BINDING SITE II or BINDING SITE III of FIG. 8. Table 4 illustrates the complementarity of the nucleotide sequences of LOC131873 BINDING SITE, designated SEQ ID:14590, to the nucleotide sequence of GAM109 RNA, herein designated GAM RNA, also designated SEQ ID:290.

Another function of GAM109 is therefore inhibition of LOC131873 (Accession XM_067585.7). Accordingly, utilities of GAM109 include diagnosis, prevention and treatment of diseases and clinical conditions associated with LOC131873.

LOC203297 (Accession) is another GAM109 target gene, herein designated TARGET GENE. LOC203297 BINDING SITE is a target binding site found in the 5' untranslated region of mRNA encoded by LOC203297, corresponding to a target binding site such as BINDING SITE I, BINDING SITE II or BINDING SITE III of FIG. 8. Table 4 illustrates the complementarity of the nucleotide sequences of LOC203297 BINDING SITE, designated SEQ ID:2084, to the nucleotide sequence of GAM109 RNA, herein designated GAM RNA, also designated SEQ ID:290.

Another function of GAM109 is therefore inhibition of LOC203297 (Accession). Accordingly, utilities of GAM109 include diagnosis, prevention and treatment of diseases and clinical conditions associated with LOC203297.

LOC221922 (Accession XM_166555.1) is another GAM109 target gene, herein designated TARGET GENE. LOC221922 BINDING SITE1 and LOC221922 BINDING SITE2 are target binding sites found in untranslated regions of mRNA encoded by LOC221922, corresponding to target binding sites such as BINDING SITE I, BINDING SITE II or BINDING SITE III of FIG. 8. Table 4 illustrates the complementarity of the nucleotide sequences of LOC221922 BINDING SITE1 and LOC221922 BINDING SITE2, designated SEQ ID:15720 and SEQ ID:4591 respectively, to the nucleotide sequence of GAM109 RNA, herein designated GAM RNA, also designated SEQ ID:290.

Another function of GAM109 is therefore inhibition of LOC221922 (Accession XM_166555.1). Accordingly, utilities of GAM109 include diagnosis, prevention and treatment of diseases and clinical conditions associated with LOC221922.

LOC91266 (Accession XM_037268.7) is another GAM109 target gene, herein designated TARGET GENE. LOC91266 BINDING SITE is a target binding site found in the 5' untranslated region of mRNA encoded by LOC91266, corresponding to a target binding site such as BINDING SITE I, BINDING SITE II or BINDING SITE III of FIG. 8. Table 4 illustrates the complementarity of the nucleotide sequences of LOC91266 BINDING SITE, designated SEQ ID:4492, to the nucleotide sequence of GAM109 RNA, herein designated GAM RNA, also designated SEQ ID:290.

Another function of GAM109 is therefore inhibition of LOC91266 (Accession XM_037268.7). Accordingly, utilities of GAM109 include diagnosis, prevention and treatment of diseases and clinical conditions associated with LOC91266.

Transmembrane, prostate androgen induced rna (TMEPAI, Accession NM_020182.2) is another GAM109 target gene, herein designated TARGET GENE. TMEPAI BINDING SITE is a target binding site found in the 3' untranslated region of mRNA encoded by TMEPAI, corresponding to a target binding site such as BINDING SITE I, BINDING SITE II or BINDING SITE III of FIG. 8. Table 4 illustrates the complementarity of the nucleotide sequences of TMEPAI BINDING SITE, designated SEQ ID:1160, to the nucleotide sequence of GAM109 RNA, herein designated GAM RNA, also designated SEQ ID:290.

Another function of GAM109 is therefore inhibition of Transmembrane, prostate androgen induced rna (TMEPAI, Accession NM_020182.2). Accordingly, utilities of GAM109 include diagnosis, prevention and treatment of diseases and clinical conditions associated with TMEPAI.

VEZATIN (Accession NM_017599.2) is another GAM109 target gene, herein designated TARGET GENE. VEZATIN BINDING SITE is a target binding site found in the 3' untranslated region of mRNA encoded by VEZATIN, corresponding to a target binding site such as BINDING SITE I, BINDING SITE II or BINDING SITE III of FIG. 8. Table 4 illustrates the complementarity of the nucleotide sequences of VEZATIN BINDING SITE, designated SEQ ID:3317, to the nucleotide sequence of GAM109 RNA, herein designated GAM RNA, also designated SEQ ID:290.

Another function of GAM109 is therefore inhibition of VEZATIN (Accession NM_017599.2). Accordingly, utilities of GAM109 include diagnosis, prevention and treatment of diseases and clinical conditions associated with VEZATIN.

ZFP106 (Accession NM_022473.1) is another GAM109 target gene, herein designated TARGET GENE. ZFP106 BINDING SITE is a target binding site found in the 3' untranslated region of mRNA encoded by ZFP106, corresponding to a target binding site such as BINDING SITE I, BINDING SITE II or BINDING SITE III of FIG. 8. Table 4 illustrates the complementarity of the nucleotide sequences of ZFP106 BINDING SITE, designated SEQ ID:11274, to the nucleotide sequence of GAM109 RNA, herein designated GAM RNA, also designated SEQ ID:290.

Another function of GAM109 is therefore inhibition of ZFP106 (Accession NM_022473.1). Accordingly, utilities of GAM109 include diagnosis, prevention and treatment of diseases and clinical conditions associated with ZFP106.

FIG. 8 further provides a conceptual description of a novel bioinformatically detected of the present invention, referred to here as Genomic Address Messenger 110 (GAM110), which modulates expression of respective target genes thereof, the function and utility of which target genes is known in the art.

GAM110 is a novel bioinformatically detected regulatory, non protein coding, micro RNA (miRNA) gene. The method by which GAM110 was detected is described hereinabove with reference to FIGS. 8-15.

GAM110 gene, herein designated GAM GENE, and GAM110 target gene, herein designated TARGET GENE, are human genes contained in the human genome.

GAM110 gene encodes a GAM110 precursor RNA, herein designated GAM PRECURSOR RNA. Similar to other miRNA genes, and unlike most ordinary genes, GAM110 precursor RNA does not encode a protein. A nucleotide sequence identical or highly similar to the nucleotide sequence of GAM110 precursor RNA is designated SEQ ID:115, and is provided hereinbelow with reference to the sequence listing part. Nucleotide sequence SEQ ID:115 is located at position 6152245 relative to chromosome 19.

GAM110 precursor RNA folds onto itself, forming GAM110 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM110 precursor RNA folds onto itself, forming GAM110 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM110 precursor RNA, designated SEQ-ID:115, and a schematic representation of a predicted secondary folding of GAM110 folded precursor RNA are further described with reference to Table 2, hereby incorporated by reference.

An enzyme complex designated DICER COMPLEX, 'dices' the GAM110 folded precursor RNA into GAM110 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM110 RNA is designated SEQ ID:375, and is provided hereinbelow with references to the sequence listing part and Table 3, hereby incorporated by reference.

GAM110 target gene, herein designated TARGET GENE, encodes a corresponding messenger RNA, GAM110 target RNA, herein designated GAM TARGET RNA. GAM110 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM110 RNA, herein designated GAM RNA, binds complementarily to one or more target binding sites located in untranslated regions of GAM110 target RNA, herein designated GAM TARGET RNA. This complementary binding is due to the fact that the nucleotide sequence of GAM110 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM110 RNA may have a different number of target binding sites in untranslated regions of a GAM110 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM110 RNA, herein designated GAM RNA, to target binding sites on GAM110 target RNA, herein designated GAM TARGET RNA, such as BINDING SITE I, BINDING SITE II and BINDING SITE III, inhibits translation of GAM110 target RNA into GAM110 target protein, herein designated GAM TARGET PROTEIN. GAM target protein is therefore outlined by a broken line.

It is appreciated that GAM110 target gene, herein designated TARGET GENE, in fact represents a plurality of GAM110 target genes. The mRNA of each one of this plurality of GAM110 target genes comprises one or more target binding sites, each having a nucleotide sequence which is at least partly complementary to GAM110 RNA, herein designated GAM RNA, and which when bound by GAM110 RNA causes inhibition of translation of respective one or more GAM110 target proteins.

It is further appreciated by one skilled in the art that the mode of translational inhibition illustrated by FIG. 8 with specific reference to translational inhibition exerted by GAM110 gene, herein designated GAM GENE, on one or more GAM110 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM110 correlate with, and may be deduced from, the identity of the target genes which GAM110 binds and inhibits, and the function of these target genes, as elaborated hereinbelow.

LOC147670 (Accession XM_097265.6) is a GAM110 target gene, herein designated TARGET GENE. LOC147670 BINDING SITE is a target binding site found in the 5' untranslated region of mRNA encoded by LOC147670, corresponding to a target binding site such as BINDING SITE I, BINDING SITE II or BINDING SITE III of FIG. 8. Table 4 illustrates the complementarity of the nucleotide sequences of LOC147670 BINDING SITE, designated SEQ ID:10171, to the nucleotide sequence of GAM110 RNA, herein designated GAM RNA, also designated SEQ ID:375.

A function of GAM110 is therefore inhibition of LOC147670 (Accession XM_097265.6). Accordingly, utilities of GAM110 include diagnosis, prevention and treatment of diseases and clinical conditions associated with LOC147670.

FIG. 8 further provides a conceptual description of a novel bioinformatically detected of the present invention, referred to here as Genomic Address Messenger 111 (GAM111), which modulates expression of respective target genes thereof, the function and utility of which target genes is known in the art.

GAM111 is a novel bioinformatically detected regulatory, non protein coding, micro RNA (miRNA) gene. The method by which GAM111 was detected is described hereinabove with reference to FIGS. 8-15.

GAM111 gene, herein designated GAM GENE, and GAM111 target gene, herein designated TARGET GENE, are human genes contained in the human genome.

GAM111 gene encodes a GAM111 precursor RNA, herein designated GAM PRECURSOR RNA. Similar to other miRNA genes, and unlike most ordinary genes, GAM111 precursor RNA does not encode a protein. A nucleotide sequence identical or highly similar to the nucleotide sequence of GAM111 precursor RNA is designated SEQ ID:3, and is provided hereinbelow with reference to the sequence listing part.

GAM111 precursor RNA folds onto itself, forming GAM111 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM111 precursor RNA folds onto itself, forming GAM111 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM111 precursor RNA, designated SEQ-ID:3, and a schematic representation of a predicted secondary folding of GAM111 folded precursor RNA are further described with reference to Table 2, hereby incorporated by reference.

An enzyme complex designated DICER COMPLEX, 'dices' the GAM111 folded precursor RNA into GAM111 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM111 RNA is designated SEQ ID:311, and is provided hereinbelow with references to the sequence listing part and Table 3, hereby incorporated by reference.

GAM111 target gene, herein designated TARGET GENE, encodes a corresponding messenger RNA, GAM111 target RNA, herein designated GAM TARGET RNA. GAM111 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM111 RNA, herein designated GAM RNA, binds complementarily to one or more target binding sites located in untranslated regions of GAM111 target RNA, herein designated GAM TARGET RNA. This complementary binding is due to the fact that the nucleotide sequence of GAM111 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM111 RNA may have a different number of target binding sites in untranslated regions of a GAM111 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM111 RNA, herein designated GAM RNA, to target binding sites on GAM111 target RNA, herein designated GAM TARGET RNA, such as BINDING SITE I, BINDING SITE II and BINDING SITE III, inhibits translation of GAM111 target RNA into GAM111 target protein, herein designated GAM TARGET PROTEIN. GAM target protein is therefore outlined by a broken line.

It is appreciated that GAM111 target gene, herein designated TARGET GENE, in fact represents a plurality of GAM111 target genes. The mRNA of each one of this plurality of GAM111 target genes comprises one or more target binding sites, each having a nucleotide sequence which is at least partly complementary to GAM111 RNA, herein designated GAM RNA, and which when bound by GAM111 RNA causes inhibition of translation of respective one or more GAM111 target proteins.

It is further appreciated by one skilled in the art that the mode of translational inhibition illustrated by FIG. 8 with specific reference to translational inhibition exerted by GAM111 gene, herein designated GAM GENE, on one or more GAM111 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM111 correlate with, and may be deduced from, the identity of the target genes which GAM111 binds and inhibits, and the function of these target genes, as elaborated hereinbelow.

HA-1 (Accession XM_037574.3) is a GAM111 target gene, herein designated TARGET GENE. HA-1 BINDING SITE is a target binding site found in the 3' untranslated region of mRNA encoded by HA-1, corresponding to a target binding site such as BINDING SITE I, BINDING SITE II or BINDING SITE III of FIG. 8. Table 4 illustrates the complementarity of the nucleotide sequences of HA-1 BINDING SITE, designated SEQ ID:8389, to the nucleotide sequence of GAM111 RNA, herein designated GAM RNA, also designated SEQ ID:311.

A function of GAM111 is therefore inhibition of HA-1 (Accession XM_037574.3). Accordingly, utilities of GAM111 include diagnosis, prevention and treatment of diseases and clinical conditions associated with HA-1.

LOC219513 (Accession) is another GAM111 target gene, herein designated TARGET GENE. LOC219513 BINDING SITE is a target binding site found in the 5' untranslated region of mRNA encoded by LOC219513, corresponding to a target binding site such as BINDING SITE I, BINDING SITE II or BINDING SITE III of FIG. 8. Table 4 illustrates the complementarity of the nucleotide sequences of LOC219513

BINDING SITE, designated SEQ ID:3411, to the nucleotide sequence of GAM111 RNA, herein designated GAM RNA, also designated SEQ ID:311.

Another function of GAM111 is therefore inhibition of LOC219513 (Accession). Accordingly, utilities of GAM111 include diagnosis, prevention and treatment of diseases and clinical conditions associated with LOC219513.

LOC257442 (Accession) is another GAM111 target gene, herein designated TARGET GENE. LOC257442 BINDING SITE is a target binding site found in the 5' untranslated region of mRNA encoded by LOC257442, corresponding to a target binding site such as BINDING SITE I, BINDING SITE II or BINDING SITE III of FIG. 8. Table 4 illustrates the complementarity of the nucleotide sequences of LOC257442 BINDING SITE, designated SEQ ID:6598, to the nucleotide sequence of GAM111 RNA, herein designated GAM RNA, also designated SEQ ID:311.

Another function of GAM111 is therefore inhibition of LOC257442 (Accession). Accordingly, utilities of GAM111 include diagnosis, prevention and treatment of diseases and clinical conditions associated with LOC257442.

LOC91947 (Accession XM_041721.3) is another GAM111 target gene, herein designated TARGET GENE. LOC91947 BINDING SITE is a target binding site found in the 3' untranslated region of mRNA encoded by LOC91947, corresponding to a target binding site such as BINDING SITE I, BINDING SITE II or BINDING SITE III of FIG. 8. Table 4 illustrates the complementarity of the nucleotide sequences of LOC91947 BINDING SITE, designated SEQ ID:14120, to the nucleotide sequence of GAM111 RNA, herein designated GAM RNA, also designated SEQ ID:311.

Another function of GAM111 is therefore inhibition of LOC91947 (Accession XM_041721.3). Accordingly, utilities of GAM111 include diagnosis, prevention and treatment of diseases and clinical conditions associated with LOC91947.

Maltase-glucoamylase (alpha-glucosidase) (MGAM, Accession NM_004668.1) is another GAM111 target gene, herein designated TARGET GENE. MGAM BINDING SITE is a target binding site found in the 3' untranslated region of mRNA encoded by MGAM, corresponding to a target binding site such as BINDING SITE I, BINDING SITE II or BINDING SITE III of FIG. 8. Table 4 illustrates the complementarity of the nucleotide sequences of MGAM BINDING SITE, designated SEQ ID:11018, to the nucleotide sequence of GAM111 RNA, herein designated GAM RNA, also designated SEQ ID:311.

Another function of GAM111 is therefore inhibition of Maltase-glucoamylase (alpha-glucosidase) (MGAM, Accession NM_004668.1), a gene which plays a role in the final steps of digestion of starch. Accordingly, utilities of GAM111 include diagnosis, prevention and treatment of diseases and clinical conditions associated with MGAM.

The function of MGAM has been established by previous studies. Maltase-glucoamylase (MGA; EC 3.2.1.20) is a brush border membrane enzyme that plays a role in the final steps of digestion of starch. Naim et al. (1988) showed that it is synthesized as a single-chain polypeptide precursor, acquires N- and O-linked carbohydrates, and does not undergo intracellular or extracellular proteolytic cleavage. Nichols et al. (1998) purified and partially sequenced the human maltase-glucoamylase protein. By RT-PCR using degenerate oligonucleotides based on the MGA protein sequence, they isolated human small intestine MGA cDNAs. The deduced 1,857-amino acid MGA protein has a putative type II membrane anchor, 2 WIDMNE catalytic sites, which are characteristic of carbohydrate hydrolases such as sucrase-isomaltase (SI; 222900), and 2 glycosyl hydrolase family 31 signature 2 sequences. MGA also has 19 potential N-glycosylation sites and 253 potential O-glycosylation sites. The MGA protein shares 59% sequence identity with SI. RT-PCR detected MGA expression in human small intestine, granulocyte, and kidney but not in salivary gland or pancreas.

Full details of the abovementioned studies are described in the following publications, the disclosure of which are hereby incorporated by reference:

Naim, H. Y.; Sterchi, E. E.; Lentze, M. J.: Structure, biosynthesis, and glycosylation of human small intestinal maltase-glucoamylase. J. Biol. Chem. 263:19709-19717, 1988; and Nichols, B. L.; Eldering, J.; Avery, S.; Hahn, D.; Quaroni, A.; Sterchi, E.: Human small intestinal maltase-glucoamylase cDNA cloning: homology to sucrase-isomaltase. J. Biol. Chem. 273:3.

Further studies establishing the function and utilities of MGAM are found in John Hopkins OMIM database record ID 154360, and in cited publications listed in Table 5, which are hereby incorporated by reference. Peroxisome proliferative activated receptor, alpha (PPARA, Accession NM_005036.2) is another GAM111 target gene, herein designated TARGET GENE. PPARA BINDING SITE is a target binding site found in the 5' untranslated region of mRNA encoded by PPARA, corresponding to a target binding site such as BINDING SITE I, BINDING SITE II or BINDING SITE III of FIG. 8. Table 4 illustrates the complementarity of the nucleotide sequences of PPARA BINDING SITE, designated SEQ ID:5628, to the nucleotide sequence of GAM111 RNA, herein designated GAM RNA, also designated SEQ ID:311.

Another function of GAM111 is therefore inhibition of Peroxisome proliferative activated receptor, alpha (PPARA, Accession NM_005036.2), a gene which controls the peroxisomal beta-oxidation pathway of fatty acids by activating transcription of acyl-coa oxidase gene. and therefore may be associated with Obesity. Accordingly, utilities of GAM111 include diagnosis, prevention and treatment of Obesity, and of other diseases and clinical conditions associated with PPARA.

The function of PPARA has been established by previous studies. Kersten et al. (2000) reviewed the roles of PPARs in health and disease Animal model experiments lend further support to the function of PPARA. Adenovirus-induced hyperleptinemia (see OMIM Ref. No. leptin; 164160) causes rapid disappearance of body fat in normal rats, presumably by upregulating fatty acid oxidation within white adipocytes. To determine the role of PPARA expression, which was increased during the rapid loss of fat, Lee et al. (2002) infused adenovirus-leptin into PPARA-null and PPARA-wildtype mice. Despite similar degrees of hyperleptinemia and reduction in food intake, epididymal fat pad weight declined 55% in wildtype but only 6% in null mice; liver triacylglycerol fell 39% in the wildtype group but was unchanged in the null group. Carnitine palmitoyltransferase-1 (OMIM Ref. No. 600528) mRNA rose 52% in the wildtype mice but did not increase in the null mice. The most striking transcription difference was the 3-fold rise in PGC1-alpha (PPARGC1; 604517) mRNA in white adipose tissue that occurred in PPARA-wildtype but not in PPARA-null mice. Moreover, baseline expression of PGC1-alpha in the null mice was below normal. The role of the PGC1 coactivator in mitochondrial biogenesis, thermogenesis, and gluconeogenesis is well established. Lee et al. (2002) found the most plausible interpretation of the findings in white adipose tissue to be that leptin induces, through upregulation of PGC1-alpha expression, a PPARA-dependent increase in mitochondrial biogenesis that increases fatty acid oxidation sufficiently to deplete triglyceride stores with a relatively modest increase in the transcription and/or activities of the enzymes of fatty acid oxidation. During the sustained hyperleptinemia induced by adenovirus transfer of the leptin gene, white adipocytes acquire features of brown adipocytes and are converted from fat-storing to fat-burning cells, in large part through upregulation of PGC1-alpha.

It is appreciated that the abovementioned animal model for PPARA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kersten, S.; Desvergne, B.; Wahli, W.: Roles of PPARs in health and disease. Nature 405:421-424, 2000; and Lee, Y.; y, X.; Gonzales, F.; Mangelsdorf, D. J.; Wang, M.-Y.; Richardson, C.; Witters, L. A.; Unger, R. H.: PPAR-alpha is necessary for the lipopenic action of hyperleptinemia on whi.

Further studies establishing the function and utilities of PPARA are found in John Hopkins OMIM database record ID 170998, and in cited publications listed in Table 5, which are hereby incorporated by reference.

FIG. 8 further provides a conceptual description of a novel bioinformatically detected of the present invention, referred to here as Genomic Address Messenger 112 (GAM112), which modulates expression of respective target genes thereof, the function and utility of which target genes is known in the art.

GAM112 is a novel bioinformatically detected regulatory, non protein coding, micro RNA (miRNA) gene. The method by which GAM112 was detected is described hereinabove with reference to FIGS. 8-15.

GAM112 gene, herein designated GAM GENE, and GAM112 target gene, herein designated TARGET GENE, are human genes contained in the human genome.

GAM112 gene encodes a GAM112 precursor RNA, herein designated GAM PRECURSOR RNA. Similar to other miRNA genes, and unlike most ordinary genes, GAM112 precursor RNA does not encode a protein. A nucleotide sequence identical or highly similar to the nucleotide sequence of GAM112 precursor RNA is designated SEQ ID:195, and is provided hereinbelow with reference to the sequence listing part. Nucleotide sequence SEQ ID:195 is located at position 47490563 relative to chromosome X.

GAM112 precursor RNA folds onto itself, forming GAM112 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM112 precursor RNA folds onto itself, forming GAM112 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM112 precursor RNA, designated SEQ-ID:195, and a schematic representation of a predicted secondary folding of GAM112 folded precursor RNA are further described with reference to Table 2, hereby incorporated by reference.

An enzyme complex designated DICER COMPLEX, 'dices' the GAM112 folded precursor RNA into GAM112 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM112 RNA is designated SEQ ID:263, and is provided hereinbelow with references to the sequence listing part and Table 3, hereby incorporated by reference.

GAM112 target gene, herein designated TARGET GENE, encodes a corresponding messenger RNA, GAM112 target RNA, herein designated GAM TARGET RNA. GAM112 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM112 RNA, herein designated GAM RNA, binds complementarily to one or more target binding sites located in untranslated regions of GAM112 target RNA, herein designated GAM TARGET RNA. This complementary binding is due to the fact that the nucleotide sequence of GAM112 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM112 RNA may have a different number of target binding sites in untranslated regions of a GAM112 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM112 RNA, herein designated GAM RNA, to target binding sites on GAM112 target RNA, herein designated GAM TARGET RNA, such as BINDING SITE I, BINDING SITE II and BINDING SITE III, inhibits translation of GAM112 target RNA into GAM112 target protein, herein designated GAM TARGET PROTEIN. GAM target protein is therefore outlined by a broken line.

It is appreciated that GAM112 target gene, herein designated TARGET GENE, in fact represents a plurality of GAM112 target genes. The mRNA of each one of this plurality of GAM112 target genes comprises one or more target binding sites, each having a nucleotide sequence which is at least partly complementary to GAM112 RNA, herein designated GAM RNA, and which when bound by GAM112 RNA causes inhibition of translation of respective one or more GAM112 target proteins.

It is further appreciated by one skilled in the art that the mode of translational inhibition illustrated by FIG. 8 with specific reference to translational inhibition exerted by GAM112 gene, herein designated GAM GENE, on one or more GAM112 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM112 correlate with, and may be deduced from, the identity of the target genes which GAM112 binds and inhibits, and the function of these target genes, as elaborated hereinbelow.

Arp1 actin-related protein 1 homolog a, centractin alpha (yeast) (ACTR1A, Accession NP_005727.1) is a GAM112 target gene, herein designated TARGET GENE. ACTR1A BINDING SITE is a target binding site found in the 3' untranslated region of mRNA encoded by ACTR1A, corresponding to a target binding site such as BINDING SITE I, BINDING SITE II or BINDING SITE III of FIG. 8. Table 4 illustrates the complementarity of the nucleotide sequences of ACTR1A BINDING SITE, designated SEQ ID:16686, to the nucleotide sequence of GAM112 RNA, herein designated GAM RNA, also designated SEQ ID:263.

A function of GAM112 is therefore inhibition of Arp1 actin-related protein 1 homolog a, centractin alpha (yeast) (ACTR1A, Accession NP_005727.1). Accordingly, utilities of GAM112 include diagnosis, prevention and treatment of diseases and clinical conditions associated with ACTR1A.

APRIN (Accession NP_055847.1) is another GAM112 target gene, herein designated TARGET GENE. APRIN BINDING SITE is a target binding site found in the 3' untranslated region of multiple transcripts of mRNA encoded by APRIN, corresponding to a target binding site such as BINDING SITE I, BINDING SITE II or BINDING SITE III of FIG. 8. Table 4 illustrates the complementarity of the nucleotide sequences of APRIN BINDING SITE, designated SEQ ID:18895, to the nucleotide sequence of GAM112 RNA, herein designated GAM RNA, also designated SEQ ID:263.

Another function of GAM112 is therefore inhibition of APRIN (Accession NP_055847.1). Accordingly, utilities of GAM112 include diagnosis, prevention and treatment of diseases and clinical conditions associated with APRIN.

Atpase, na+/k+ transporting, alpha 2 (+) polypeptide (ATP1A2, Accession NP_000693.1) is another GAM112 target gene, herein designated TARGET GENE. ATP1A2 BINDING SITE is a target binding site found in the 3' untranslated region of mRNA encoded by ATP1A2, corresponding to a target binding site such as BINDING SITE I, BINDING SITE II or BINDING SITE III of FIG. 8. Table 4 illustrates the complementarity of the nucleotide sequences of ATP1A2 BINDING SITE, designated SEQ ID:4788, to the nucleotide sequence of GAM112 RNA, herein designated GAM RNA, also designated SEQ ID:263.

Another function of GAM112 is therefore inhibition of Atpase, na+/k+ transporting, alpha 2 (+) polypeptide (ATP1A2, Accession NP_000693.1). Accordingly, utilities of GAM112 include diagnosis, prevention and treatment of diseases and clinical conditions associated with ATP1A2.

Caudal type homeo box transcription factor 2 (CDX2, Accession NP_001256.1) is another GAM112 target gene, herein designated TARGET GENE. CDX2 BINDING SITE is a target binding site found in the 3' untranslated region of mRNA encoded by CDX2, corresponding to a target binding site such as BINDING SITE I, BINDING SITE II or BINDING SITE III of FIG. 8. Table 4 illustrates the complementarity of the nucleotide sequences of CDX2 BINDING SITE, designated SEQ ID:6285, to the nucleotide sequence of GAM112 RNA, herein designated GAM RNA, also designated SEQ ID:263.

Another function of GAM112 is therefore inhibition of Caudal type homeo box transcription factor 2 (CDX2, Accession NP_001256.1), a gene which is involved in the transcriptional regulation of multiple genes expressed in the intestinal epithelium. Accordingly, utilities of GAM112 include diagnosis, prevention and treatment of diseases and clinical conditions associated with CDX2.

The function of CDX2 has been established by previous studies. The level and beta-cell specificity of insulin gene expression are regulated by a set of nuclear proteins that bind to specific sequences within the promoter of the insulin gene (INS; 176730) and interact with RNA polymerase to activate or repress transcription. The proteins LMX1 (OMIM Ref. No. 600298) and CDX3 are homeodomain proteins that bind an A/T-rich sequence in the insulin promoter and stimulate its transcription. German et al. (1994) demonstrated by fluorescence in situ hybridization that the CDX3 gene is located on 13q12.3. The gene encoding another insulin-regulating transcription factor, ISL1 (OMIM Ref. No. 600366), maps to 5q. In Drosophila, disturbing the expression of the homeo box gene 'caudal' causes a severe disruption in body segmentation and global body patterning. In the mouse, 3 homologs of Drosophila 'caudal' were identified: Cdx1 (OMIM Ref. No. 600746), Cdx2, and Cdx4 (OMIM Ref. No. 300025). By homologous recombination in embryonic stem (ES) cells, Chawengsaksophak et al. (1997) generated a null mutation of murine Cdx2. Homozygote null mutants died between 3.5 and 5.5 days postcoitum. Heterozygous mutants exhibited a variable phenotype, with many showing tail abnormalities or stunted growth. Skeletal analysis demonstrated a homeotic shift of vertebrae and compatible malformations of the ribs. Within the first 3 months of life, 90% of Cdx2 heterozygotes developed multiple intestinal adenomatous polyps, particularly in the proximal colon. These polyps occasionally contained areas of true metaplasia. In contrast to the surrounding intestinal epithelium, the neoplastic cells did not express Cdx2 from the remaining allele. These results suggested that Cdx2 mutation is the primary event in the genesis of these intestinal tumors, a 2-hit phenomenon having been involved in their pathogenesis.

Full details of the abovementioned studies are described in the following publications, the disclosure of which are hereby incorporated by reference:

German, M. S.; Wang, J.; Fernald, A. A.; Espinosa, R., III; Le Beau, M. M.; Bell, G. I.: Localization of the genes encoding two transcription factors, LMX1 and CDX3, regulating insulin gene expression to human chromosomes 1 and 13. Genomics 24:403-404, 1994; and Chawengsaksophak, K.; James, R.; Hammond, V. E.; Kontgen, F.; Beck, F.: Homeosis and intestinal tumours in Cdx2 mutant mice. Nature 386:84-87, 1997.

Further studies establishing the function and utilities of CDX2 are found in John Hopkins OMIM database record ID 600297, and in cited publications listed in Table 5, which are hereby incorporated by reference. Carbamoyl-phosphate synthetase 1, mitochondrial (CPS1, Accession NP_001866.2) is another GAM112 target gene, herein designated TARGET GENE. CPS1 BINDING SITE is a target binding site found in the 3' untranslated region of mRNA encoded by CPS1, corresponding to a target binding site such as BINDING SITE I, BINDING SITE II or BINDING SITE III of FIG. 8. Table 4 illustrates the complementarity of the nucleotide sequences of CPS1 BINDING SITE, designated SEQ ID:7610, to the nucleotide sequence of GAM112 RNA, herein designated GAM RNA, also designated SEQ ID:263.

Another function of GAM112 is therefore inhibition of Carbamoyl-phosphate synthetase 1, mitochondrial (CPS1, Accession NP_001866.2) . Accordingly, utilities of GAM112 include diagnosis, prevention and treatment of diseases and clinical conditions associated with CPS1.

Cytochrome p450, subfamily viia (cholesterol 7 alpha-monooxygenase), polypeptide 1 (CYP7A1, Accession NP_000771.1) is another GAM112 target gene, herein designated TARGET GENE. CYP7A1 BINDING SITE is a target binding site found in the 3' untranslated region of mRNA encoded by CYP7A1, corresponding to a target binding site such as BINDING SITE I, BINDING SITE II or BINDING SITE III of FIG. 8. Table 4 illustrates the complementarity of the nucleotide sequences of CYP7A1 BINDING SITE, designated SEQ ID:7483, to the nucleotide sequence of GAM112 RNA, herein designated GAM RNA, also designated SEQ ID:263.

Another function of GAM112 is therefore inhibition of Cytochrome p450, subfamily viia (cholesterol 7 alpha-monooxygenase), polypeptide 1 (CYP7A1, Accession NP_000771.1), a gene which functions in cholesterol and bile acid metabolism . and therefore may be associated with Metabolic liver disease. Accordingly, utilities of GAM112 include diagnosis, prevention and treatment of Metabolic liver disease, and of other diseases and clinical conditions associated with CYP7A1.

The function of CYP7A1 and its association with various diseases and clinical conditions, has been established by previous studies, as described hereinabove with reference to GAM100.1. Cysteinyl leukotriene receptor 2 (CYSLTR2, Accession NP_065110.1) is another GAM112 target gene, herein designated TARGET GENE. CYSLTR2 BINDING SITE is a target binding site found in the 3' untranslated region of mRNA encoded by CYSLTR2, corresponding to a target binding site such as BINDING SITE I, BINDING SITE II or BINDING SITE III of FIG. 8. Table 4 illustrates the complementarity of the nucleotide sequences of CYSLTR2 BINDING SITE, designated SEQ ID:8375, to the nucleotide sequence of GAM112 RNA, herein designated GAM RNA, also designated SEQ ID:263.

Another function of GAM112 is therefore inhibition of Cysteinyl leukotriene receptor 2 (CYSLTR2, Accession NP_065110.1). Accordingly, utilities of GAM112 include diagnosis, prevention and treatment of diseases and clinical conditions associated with CYSLTR2.

Erythrocyte membrane protein band 4.1 like 4b (EPB41L4B, Accession NP_061987.2) is another GAM112 target gene, herein designated TARGET GENE. EPB41L4B BINDING SITE is a target binding site found in the 3' untranslated region of multiple transcripts of mRNA encoded by EPB41L4B, corresponding to a target binding site such as BINDING SITE I, BINDING SITE II or BINDING SITE III of FIG. 8. Table 4 illustrates the complementarity of the nucleotide sequences of EPB41L4B BINDING SITE, designated SEQ ID:9787, to the nucleotide sequence of GAM112 RNA, herein designated GAM RNA, also designated SEQ ID:263.

Another function of GAM112 is therefore inhibition of Erythrocyte membrane protein band 4.1 like 4b (EPB41L4B, Accession NP_061987.2). Accordingly, utilities of GAM112 include diagnosis, prevention and treatment of diseases and clinical conditions associated with EPB41L4B.

FLJ10378 (Accession NP_115615.2) is another GAM112 target gene, herein designated TARGET GENE. FLJ10378 BINDING SITE is a target binding site found in the 3' untranslated region of multiple transcripts of mRNA encoded by FLJ10378, corresponding to a target binding site such as BINDING SITE I, BINDING SITE II or BINDING SITE III of FIG. 8. Table 4 illustrates the complementarity of the nucleotide sequences of FLJ10378 BINDING SITE, designated SEQ ID:1040, to the nucleotide sequence of GAM112 RNA, herein designated GAM RNA, also designated SEQ ID:263.

Another function of GAM112 is therefore inhibition of FLJ10378 (Accession NP_115615.2). Accordingly, utilities of GAM112 include diagnosis, prevention and treatment of diseases and clinical conditions associated with FLJ10378.

FLJ11710 (Accession NP_079122.1) is another GAM112 target gene, herein designated TARGET GENE. FLJ11710 BINDING SITE is a target binding site found in the 3' untranslated region of mRNA encoded by FLJ11710, corresponding to a target binding site such as BINDING SITE I, BINDING SITE II or BINDING SITE III of FIG. 8. Table 4 illustrates the complementarity of the nucleotide sequences of FLJ11710 BINDING SITE, designated SEQ ID:16607, to the nucleotide sequence of GAM112 RNA, herein designated GAM RNA, also designated SEQ ID:263.

Another function of GAM112 is therefore inhibition of FLJ11710 (Accession NP_079122.1). Accordingly, utilities of GAM112 include diagnosis, prevention and treatment of diseases and clinical conditions associated with FLJ11710.

FLJ12921 (Accession NP_079151.1) is another GAM112 target gene, herein designated TARGET GENE. FLJ12921 BINDING SITE is a target binding site found in the 3' untranslated region of mRNA encoded by FLJ12921, corresponding to a target binding site such as BINDING SITE I, BINDING SITE II or BINDING SITE III of FIG. 8. Table 4 illustrates the complementarity of the nucleotide sequences of FLJ12921 BINDING SITE, designated SEQ ID:8731, to the nucleotide sequence of GAM112 RNA, herein designated GAM RNA, also designated SEQ ID:263.

Another function of GAM112 is therefore inhibition of FLJ12921 (Accession NP_079151.1). Accordingly, utilities of GAM112 include diagnosis, prevention and treatment of diseases and clinical conditions associated with FLJ12921.

FLJ22029 (Accession NP_079225.2) is another GAM112 target gene, herein designated TARGET GENE. FLJ22029 BINDING SITE is a target binding site found in the 5' untranslated region of mRNA encoded by FLJ22029, corresponding to a target binding site such as BINDING SITE I, BINDING SITE II or BINDING SITE III of FIG. 8. Table 4 illustrates the complementarity of the nucleotide sequences of FLJ22029 BINDING SITE, designated SEQ ID:9484, to the nucleotide sequence of GAM112 RNA, herein designated GAM RNA, also designated SEQ ID:263.

Another function of GAM112 is therefore inhibition of FLJ22029 (Accession NP_079225.2). Accordingly, utilities of GAM112 include diagnosis, prevention and treatment of diseases and clinical conditions associated with FLJ22029.

FLJ36812 (Accession NP_694992.1) is another GAM112 target gene, herein designated TARGET GENE. FLJ36812 BINDING SITE is a target binding site found in the 3' untranslated region of mRNA encoded by FLJ36812, corresponding to a target binding site such as BINDING SITE I, BINDING SITE II or BINDING SITE III of FIG. 8. Table 4 illustrates the complementarity of the nucleotide sequences of FLJ36812 BINDING SITE, designated SEQ ID:9912, to the nucleotide sequence of GAM112 RNA, herein designated GAM RNA, also designated SEQ ID:263.

Another function of GAM112 is therefore inhibition of FLJ36812 (Accession NP_694992.1). Accordingly, utilities of GAM112 include diagnosis, prevention and treatment of diseases and clinical conditions associated with FLJ36812.

Grb2-associated binding protein 2 (GAB2, Accession NP_536739.1) is another GAM112 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:4928, to the nucleotide sequence of GAM112 RNA, herein designated GAM RNA, also designated SEQ ID:263.

Another function of GAM112 is therefore inhibition of Grb2-associated binding protein 2 (GAB2, Accession NP_536739.1), a gene which act as adapters for transmitting various signals. Accordingly, utilities of GAM112 include diagnosis, prevention and treatment of diseases and clinical conditions associated with GAB2.

The function of GAB2 and its association with various diseases and clinical conditions, has been established by previous studies, as described hereinabove with reference to GAM63.1. Grb2-associated binding protein 2 (GAB2, Accession NP_036428.1) is another GAM112 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:4928, to the nucleotide sequence of GAM112 RNA, herein designated GAM RNA, also designated SEQ ID:263.

Another function of GAM112 is therefore inhibition of Grb2-associated binding protein 2 (GAB2, Accession NP_036428.1), a gene which act as adapters for transmitting various signals. Accordingly, utilities of GAM112 include diagnosis, prevention and treatment of diseases and clinical conditions associated with GAB2.

The function of GAB2 and its association with various diseases and clinical conditions, has been established by previous studies, as described hereinabove with reference to GAM63.1. Gephyrin (GPHN, Accession NP_065857.1) is another GAM112 target gene, herein designated TARGET GENE. GPHN BINDING SITE is a target binding site found in the 3' untranslated region of mRNA encoded by GPHN, corresponding to a target binding site such as BINDING SITE I, BINDING SITE II or BINDING SITE III of FIG. 8. Table 4 illustrates the complementarity of the nucleotide sequences of GPHN BINDING SITE, designated SEQ ID:7304, to the nucleotide sequence of GAM112 RNA, herein designated GAM RNA, also designated SEQ ID:263.

Another function of GAM112 is therefore inhibition of Gephyrin (GPHN, Accession NP_065857.1). Accordingly, utilities of GAM112 include diagnosis, prevention and treatment of diseases and clinical conditions associated with GPHN.

GPP34R (Accession NP_060648.2) is another GAM112 target gene, herein designated TARGET GENE. GPP34R BINDING SITE is a target binding site found in the 3' untranslated region of mRNA encoded by GPP34R, corresponding to a target binding site such as BINDING SITE I, BINDING SITE II or BINDING SITE III of FIG. 8. Table 4 illustrates the complementarity of the nucleotide sequences of GPP34R BINDING SITE, designated SEQ ID:7889, to the nucleotide sequence of GAM112 RNA, herein designated GAM RNA, also designated SEQ ID:263.

Another function of GAM112 is therefore inhibition of GPP34R (Accession NP_060648.2). Accordingly, utilities of GAM112 include diagnosis, prevention and treatment of diseases and clinical conditions associated with GPP34R.

Hira interacting protein 3 (HIRIP3, Accession NP_003600.2) is another GAM112 target gene, herein designated TARGET GENE. HIRIP3 BINDING SITE is a target binding site found in the 5' untranslated region of mRNA encoded by HIRIP3, corresponding to a target binding site such as BINDING SITE I, BINDING SITE II or BINDING SITE III of FIG. 8. Table 4 illustrates the complementarity of the nucleotide sequences of HIRIP3 BINDING SITE, designated SEQ ID:7164, to the nucleotide sequence of GAM112 RNA, herein designated GAM RNA, also designated SEQ ID:263.

Another function of GAM112 is therefore inhibition of Hira interacting protein 3 (HIRIP3, Accession NP_003600.2). Accordingly, utilities of GAM112 include diagnosis, prevention and treatment of diseases and clinical conditions associated with HIRIP3.

Heterogeneous nuclear ribonucleoprotein a/b (HNRPAB, Accession NP_004490.1) is another GAM112 target gene, herein designated TARGET GENE. HNRPAB BINDING SITE is a target binding site found in the 3' untranslated region of multiple transcripts of mRNA encoded by HNRPAB, corresponding to a target binding site such as BINDING SITE I, BINDING SITE II or BINDING SITE III of FIG. 8. Table 4 illustrates the complementarity of the nucleotide sequences of HNRPAB BINDING SITE, designated SEQ ID:1037, to the nucleotide sequence of GAM112 RNA, herein designated GAM RNA, also designated SEQ ID:263.

Another function of GAM112 is therefore inhibition of Heterogeneous nuclear ribonucleoprotein a/b (HNRPAB, Accession NP_004490.1). Accordingly, utilities of GAM112 include diagnosis, prevention and treatment of diseases and clinical conditions associated with HNRPAB.

Heterogeneous nuclear ribonucleoprotein a/b (HNRPAB, Accession NP_112556.1) is another GAM112 target gene, herein designated TARGET GENE. HNRPAB BINDING SITE is a target binding site found in the 3' untranslated region of multiple transcripts of mRNA encoded by HNRPAB, corresponding to a target binding site such as BINDING SITE I, BINDING SITE II or BINDING SITE III of FIG. 8. Table 4 illustrates the complementarity of the nucleotide sequences of HNRPAB BINDING SITE, designated SEQ ID:1037, to the nucleotide sequence of GAM112 RNA, herein designated GAM RNA, also designated SEQ ID:263.

Another function of GAM112 is therefore inhibition of Heterogeneous nuclear ribonucleoprotein a/b (HNRPAB, Accession NP_112556.1). Accordingly, utilities of GAM112 include diagnosis, prevention and treatment of diseases and clinical conditions associated with HNRPAB.

KIAA0493 (Accession XP_034717.1) is another GAM112 target gene, herein designated TARGET GENE. KIAA0493 BINDING SITE is a target binding site found in the 5' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:5227, to the nucleotide sequence of GAM112 RNA, herein designated GAM RNA, also designated SEQ ID:263.

Another function of GAM112 is therefore inhibition of KIAA0493 (Accession XP_034717.1). Accordingly, utilities of GAM112 include diagnosis, prevention and treatment of diseases and clinical conditions associated with KIAA0493.

KIAA0564 (Accession XP_038664.6) is another GAM112 target gene, herein designated TARGET GENE. KIAA0564 BINDING SITE is a target binding site found in the 3' untranslated region of mRNA encoded by KIAA0564, corresponding to a target binding site such as BINDING SITE I, BINDING SITE II or BINDING SITE III of FIG. 8. Table 4 illustrates the complementarity of the nucleotide sequences of KIAA0564 BINDING SITE, designated SEQ ID:15894, to the nucleotide sequence of GAM112 RNA, herein designated GAM RNA, also designated SEQ ID:263.

Another function of GAM112 is therefore inhibition of KIAA0564 (Accession XP_038664.6). Accordingly, utilities of GAM112 include diagnosis, prevention and treatment of diseases and clinical conditions associated with KIAA0564.

KIAA1796 (Accession XP_166146.3) is another GAM112 target gene, herein designated TARGET GENE. KIAA1796 BINDING SITE is a target binding site found in the 3' untranslated region of mRNA encoded by KIAA1796, corresponding to a target binding site such as BINDING SITE I, BINDING SITE II or BINDING SITE III of FIG. 8. Table 4 illustrates the complementarity of the nucleotide sequences of KIAA1796 BINDING SITE, designated SEQ ID:12645, to the nucleotide sequence of GAM112 RNA, herein designated GAM RNA, also designated SEQ ID:263.

Another function of GAM112 is therefore inhibition of KIAA1796 (Accession XP_166146.3). Accordingly, utilities of GAM112 include diagnosis, prevention and treatment of diseases and clinical conditions associated with KIAA1796.

LAP1B (Accession NP_056417.1) is another GAM112 target gene, herein designated TARGET GENE. LAP1B BINDING SITE is a target binding site found in the 3' untranslated region of mRNA encoded by LAP1B, corresponding to a target binding site such as BINDING SITE I, BINDING SITE II or BINDING SITE III of FIG. 8. Table 4 illustrates the complementarity of the nucleotide sequences of LAP1B BINDING SITE, designated SEQ ID:1138, to the nucleotide sequence of GAM112 RNA, herein designated GAM RNA, also designated SEQ ID:263.

Another function of GAM112 is therefore inhibition of LAP1B (Accession NP_056417.1). Accordingly, utilities of GAM112 include diagnosis, prevention and treatment of diseases and clinical conditions associated with LAP1B.

Lim and sh3 protein 1 (LASP1, Accession NP_006139.1) is another GAM112 target gene, herein designated TARGET GENE. LASP1 BINDING SITE is a target binding site found in the 3' untranslated region of mRNA encoded by LASP1, corresponding to a target binding site such as BINDING SITE I, BINDING SITE II or BINDING SITE III of FIG. 8. Table 4 illustrates the complementarity of the nucleotide sequences of LASP1 BINDING SITE, designated SEQ ID:13445, to the nucleotide sequence of GAM112 RNA, herein designated GAM RNA, also designated SEQ ID:263.

Another function of GAM112 is therefore inhibition of Lim and sh3 protein 1 (LASP1, Accession NP_006139.1). Accordingly, utilities of GAM112 include diagnosis, prevention and treatment of diseases and clinical conditions associated with LASP1.

LOC145231 (Accession XP_096740.1) is another GAM112 target gene, herein designated TARGET GENE. LOC145231 BINDING SITE is a target binding site found in the 3' untranslated region of mRNA encoded by LOC145231, corresponding to a target binding site such as BINDING SITE I, BINDING SITE II or BINDING SITE III of FIG. 8. Table 4 illustrates the complementarity of the nucleotide sequences of LOC145231 BINDING SITE, designated SEQ ID:13603, to the nucleotide sequence of GAM112 RNA, herein designated GAM RNA, also designated SEQ ID:263.

Another function of GAM112 is therefore inhibition of LOC145231 (Accession XP_096740.1). Accordingly, utilities of GAM112 include diagnosis, prevention and treatment of diseases and clinical conditions associated with LOC145231.

LOC146346 (Accession XP_085430.1) is another GAM112 target gene, herein designated TARGET GENE. LOC146346 BINDING SITE is a target binding site found in the 5' untranslated region of mRNA encoded by LOC146346, corresponding to a target binding site such as BINDING SITE I, BINDING SITE II or BINDING SITE III of FIG. 8. Table 4 illustrates the complementarity of the nucleotide sequences of LOC146346 BINDING SITE, designated SEQ ID:10788, to the nucleotide sequence of GAM112 RNA, herein designated GAM RNA, also designated SEQ ID:263.

Another function of GAM112 is therefore inhibition of LOC146346 (Accession XP_085430.1). Accordingly, utilities of GAM112 include diagnosis, prevention and treatment of diseases and clinical conditions associated with LOC146346.

LOC283547 (Accession XP_211120.1) is another GAM112 target gene, herein designated TARGET GENE. LOC283547 BINDING SITE is a target binding site found in the 3' untranslated region of mRNA encoded by LOC283547, corresponding to a target binding site such as BINDING SITE I, BINDING SITE II or BINDING SITE III of FIG. 8. Table 4 illustrates the complementarity of the nucleotide sequences of LOC283547 BINDING SITE, designated SEQ ID:18815, to the nucleotide sequence of GAM112 RNA, herein designated GAM RNA, also designated SEQ ID:263.

Another function of GAM112 is therefore inhibition of LOC283547 (Accession XP_211120.1). Accordingly, utilities of GAM112 include diagnosis, prevention and treatment of diseases and clinical conditions associated with LOC283547.

LOC284378 (Accession XP_209131.1) is another GAM112 target gene, herein designated TARGET GENE. LOC284378 BINDING SITE is a target binding site found in the 3' untranslated region of mRNA encoded by LOC284378, corresponding to a target binding site such as BINDING SITE I, BINDING SITE II or BINDING SITE III of FIG. 8. Table 4 illustrates the complementarity of the nucleotide sequences of LOC284378 BINDING SITE, designated SEQ ID:13825, to the nucleotide sequence of GAM112 RNA, herein designated GAM RNA, also designated SEQ ID:263.

Another function of GAM112 is therefore inhibition of LOC284378 (Accession XP_209131.1). Accordingly, utilities of GAM112 include diagnosis, prevention and treatment of diseases and clinical conditions associated with LOC284378.

LOC284568 (Accession XP_209263.1) is another GAM112 target gene, herein designated TARGET GENE. LOC284568 BINDING SITE is a target binding site found in the 5' untranslated region of mRNA encoded by LOC284568, corresponding to a target binding site such as BINDING SITE I, BINDING SITE II or BINDING SITE III of FIG. 8. Table 4 illustrates the complementarity of the nucleotide sequences of LOC284568 BINDING SITE, designated SEQ ID:5227, to the nucleotide sequence of GAM112 RNA, herein designated GAM RNA, also designated SEQ ID:263.

Another function of GAM112 is therefore inhibition of LOC284568 (Accession XP_209263.1). Accordingly, utilities of GAM112 include diagnosis, prevention and treatment of diseases and clinical conditions associated with LOC284568.

LOC284805 (Accession XP_209371.1) is another GAM112 target gene, herein designated TARGET GENE. LOC284805 BINDING SITE is a target binding site found in the 3' untranslated region of mRNA encoded by LOC284805, corresponding to a target binding site such as BINDING SITE I, BINDING SITE II or BINDING SITE III of FIG. 8. Table 4 illustrates the complementarity of the nucleotide sequences of LOC284805 BINDING SITE, designated SEQ ID:7153, to the nucleotide sequence of GAM112 RNA, herein designated GAM RNA, also designated SEQ ID:263.

Another function of GAM112 is therefore inhibition of LOC284805 (Accession XP_209371.1). Accordingly, utilities of GAM112 include diagnosis, prevention and treatment of diseases and clinical conditions associated with LOC284805.

LOC284955 (Accession XP_208268.1) is another GAM112 target gene, herein designated TARGET GENE. LOC284955 BINDING SITE is a target binding site found in the 3' untranslated region of mRNA encoded by LOC284955, corresponding to a target binding site such as BINDING SITE I, BINDING SITE II or BINDING SITE III of FIG. 8. Table 4 illustrates the complementarity of the nucleotide sequences of LOC284955 BINDING SITE, designated SEQ ID:20187, to the nucleotide sequence of GAM112 RNA, herein designated GAM RNA, also designated SEQ ID:263.

Another function of GAM112 is therefore inhibition of LOC284955 (Accession XP_208268.1). Accordingly, utilities of GAM112 include diagnosis, prevention and treatment of diseases and clinical conditions associated with LOC284955.

LOC286207 (Accession XP_209941.1) is another GAM112 target gene, herein designated TARGET GENE. LOC286207 BINDING SITE is a target binding site found in the 3' untranslated region of mRNA encoded by LOC286207, corresponding to a target binding site such as BINDING SITE I, BINDING SITE II or BINDING SITE III of FIG. 8. Table 4 illustrates the complementarity of the nucleotide sequences of LOC286207 BINDING SITE, designated SEQ ID:5356, to the nucleotide sequence of GAM112 RNA, herein designated GAM RNA, also designated SEQ ID:263.

Another function of GAM112 is therefore inhibition of LOC286207 (Accession XP_209941.1). Accordingly, utilities of GAM112 include diagnosis, prevention and treatment of diseases and clinical conditions associated with LOC286207.

LOC345610 (Accession XP_298913.2) is another GAM112 target gene, herein designated TARGET GENE. LOC345610 BINDING SITE is a target binding site found in the 5' untranslated region of mRNA encoded by LOC345610, corresponding to a target binding site such as BINDING SITE I, BINDING SITE II or BINDING SITE III of FIG. 8. Table 4 illustrates the complementarity of the nucleotide sequences of LOC345610 BINDING SITE, designated SEQ ID:19831, to the nucleotide sequence of GAM112 RNA, herein designated GAM RNA, also designated SEQ ID:263.

Another function of GAM112 is therefore inhibition of LOC345610 (Accession XP_298913.2). Accordingly, utilities of GAM112 include diagnosis, prevention and treatment of diseases and clinical conditions associated with LOC345610.

LOC346625 (Accession XP_299603.1) is another GAM112 target gene, herein designated TARGET GENE. LOC346625 BINDING SITE is a target binding site found in the 5' untranslated region of mRNA encoded by LOC346625, corresponding to a target binding site such as BINDING SITE I, BINDING SITE II or BINDING SITE III of FIG. 8. Table 4 illustrates the complementarity of the nucleotide sequences of LOC346625 BINDING SITE, designated SEQ ID:11576, to the nucleotide sequence of GAM112 RNA, herein designated GAM RNA, also designated SEQ ID:263.

Another function of GAM112 is therefore inhibition of LOC346625 (Accession XP_299603.1). Accordingly, utilities of GAM112 include diagnosis, prevention and treatment of diseases and clinical conditions associated with LOC346625.

LOC348416 (Accession XP_300733.1) is another GAM112 target gene, herein designated TARGET GENE. LOC348416 BINDING SITE is a target binding site found in the 3' untranslated region of mRNA encoded by LOC348416, corresponding to a target binding site such as BINDING SITE I, BINDING SITE II or BINDING SITE III of FIG. 8. Table 4 illustrates the complementarity of the nucleotide sequences of LOC348416 BINDING SITE, designated SEQ ID:2541, to the nucleotide sequence of GAM112 RNA, herein designated GAM RNA, also designated SEQ ID:263.

Another function of GAM112 is therefore inhibition of LOC348416 (Accession XP_300733.1). Accordingly, utilities of GAM112 include diagnosis, prevention and treatment of diseases and clinical conditions associated with LOC348416.

LOC348836 (Accession XP_300859.1) is another GAM112 target gene, herein designated TARGET GENE. LOC348836 BINDING SITE is a target binding site found in the 3' untranslated region of mRNA encoded by LOC348836, corresponding to a target binding site such as BINDING SITE I, BINDING SITE II or BINDING SITE III of FIG. 8. Table 4 illustrates the complementarity of the nucleotide sequences of LOC348836 BINDING SITE, designated SEQ ID:533, to the nucleotide sequence of GAM112 RNA, herein designated GAM RNA, also designated SEQ ID:263.

Another function of GAM112 is therefore inhibition of LOC348836 (Accession XP_300859.1). Accordingly, utilities of GAM112 include diagnosis, prevention and treatment of diseases and clinical conditions associated with LOC348836.

Lim domain containing preferred translocation partner in lipoma (LPP, Accession NP_005569.1) is another GAM112 target gene, herein designated TARGET GENE. LPP BINDING SITE is a target binding site found in the 3' untranslated region of mRNA encoded by LPP, corresponding to a target binding site such as BINDING SITE I, BINDING SITE II or BINDING SITE III of FIG. 8. Table 4 illustrates the complementarity of the nucleotide sequences of LPP BINDING SITE, designated SEQ ID:11376, to the nucleotide sequence of GAM112 RNA, herein designated GAM RNA, also designated SEQ ID:263.

Another function of GAM112 is therefore inhibition of Lim domain containing preferred translocation partner in lipoma (LPP, Accession NP_005569.1). Accordingly, utilities of GAM112 include diagnosis, prevention and treatment of diseases and clinical conditions associated with LPP.

MGC4677 (Accession NP_443103.1) is another GAM112 target gene, herein designated TARGET GENE. MGC4677 BINDING SITE is a target binding site found in the 3' untranslated region of mRNA encoded by MGC4677, corresponding to a target binding site such as BINDING SITE I, BINDING SITE II or BINDING SITE III of FIG. 8. Table 4 illustrates the complementarity of the nucleotide sequences of MGC4677 BINDING SITE, designated SEQ ID:20187, to the nucleotide sequence of GAM112 RNA, herein designated GAM RNA, also designated SEQ ID:263.

Another function of GAM112 is therefore inhibition of MGC4677 (Accession NP_443103.1). Accordingly, utilities of GAM112 include diagnosis, prevention and treatment of diseases and clinical conditions associated with MGC4677.

Midline 1 (opitz/bbb syndrome) (MID1, Accession NP_150633.1) is another GAM112 target gene, herein designated TARGET GENE. MID1 BINDING SITE is a target binding site found in the 3' untranslated region of multiple transcripts of mRNA encoded by MID1, corresponding to a target binding site such as BINDING SITE I, BINDING SITE II or BINDING SITE III of FIG. 8. Table 4 illustrates the complementarity of the nucleotide sequences of MID1 BINDING SITE, designated SEQ ID:3318, to the nucleotide sequence of GAM112 RNA, herein designated GAM RNA, also designated SEQ ID:263.

Another function of GAM112 is therefore inhibition of Midline 1 (opitz/bbb syndrome) (MID1, Accession NP_150633.1). Accordingly, utilities of GAM112 include diagnosis, prevention and treatment of diseases and clinical conditions associated with MID1.

Midline 1 (opitz/bbb syndrome) (MID1, Accession NP_000372.1) is another GAM112 target gene, herein designated TARGET GENE. MID1 BINDING SITE is a target binding site found in the 3' untranslated region of multiple transcripts of mRNA encoded by MID1, corresponding to a target binding site such as BINDING SITE I, BINDING SITE II or BINDING SITE III of FIG. 8. Table 4 illustrates the complementarity of the nucleotide sequences of MID1 BINDING SITE, designated SEQ ID:3318, to the nucleotide sequence of GAM112 RNA, herein designated GAM RNA, also designated SEQ ID:263.

Another function of GAM112 is therefore inhibition of Midline 1 (opitz/bbb syndrome) (MID1, Accession NP_000372.1). Accordingly, utilities of GAM112 include diagnosis, prevention and treatment of diseases and clinical conditions associated with MID1.

Pleiomorphic adenoma gene 1 (PLAG1, Accession NP_002646.1) is another GAM112 target gene, herein designated TARGET GENE. PLAG1 BINDING SITE is a target binding site found in the 3' untranslated region of mRNA encoded by PLAG1, corresponding to a target binding site such as BINDING SITE I, BINDING SITE II or BINDING SITE III of FIG. 8. Table 4 illustrates the complementarity of the nucleotide sequences of PLAG1 BINDING SITE, designated SEQ ID:11279, to the nucleotide sequence of GAM112 RNA, herein designated GAM RNA, also designated SEQ ID:263.

Another function of GAM112 is therefore inhibition of Pleiomorphic adenoma gene 1 (PLAG1, Accession NP_002646.1), a gene which contains a zinc finger domain. Accordingly, utilities of GAM112 include diagnosis, prevention and treatment of diseases and clinical conditions associated with PLAG1.

The function of PLAG1 and its association with various diseases and clinical conditions, has been established by previous studies, as described hereinabove with reference to GAM47.1. Sp2 transcription factor (SP2, Accession NP_003101.2) is another GAM112 target gene, herein designated TARGET GENE. SP2 BINDING SITE is a target binding site found in the 5' untranslated region of mRNA encoded by SP2, corresponding to a target binding site such as BINDING SITE I, BINDING SITE II or BINDING SITE III of FIG. 8. Table 4 illustrates the complementarity of the nucleotide sequences of SP2 BINDING SITE, designated SEQ ID:9721, to the nucleotide sequence of GAM112 RNA, herein designated GAM RNA, also designated SEQ ID:263.

Another function of GAM112 is therefore inhibition of Sp2 transcription factor (SP2, Accession NP_003101.2). Accordingly, utilities of GAM112 include diagnosis, prevention and treatment of diseases and clinical conditions associated with SP2.

Zinc finger protein 216 (ZNF216, Accession NP_005998.1) is another GAM112 target gene, herein designated TARGET GENE. ZNF216 BINDING SITE is a target binding site found in the 3' untranslated region of mRNA encoded by ZNF216, corresponding to a target binding site such as BINDING SITE I, BINDING SITE II or BINDING SITE III of FIG. 8. Table 4 illustrates the complementarity of the nucleotide sequences of ZNF216 BINDING SITE, designated SEQ ID:14718, to the nucleotide sequence of GAM112 RNA, herein designated GAM RNA, also designated SEQ ID:263.

Another function of GAM112 is therefore inhibition of Zinc finger protein 216 (ZNF216, Accession NP_005998.1). Accordingly, utilities of GAM112 include diagnosis, prevention and treatment of diseases and clinical conditions associated with ZNF216.

FIG. 8 further provides a conceptual description of a novel bioinformatically detected of the present invention, referred to here as Genomic Address Messenger 113 (GAM113), which modulates expression of respective target genes thereof, the function and utility of which target genes is known in the art.

GAM113 is a novel bioinformatically detected regulatory, non protein coding, micro RNA (miRNA) gene. The method by which GAM113 was detected is described hereinabove with reference to FIGS. 8-15.

GAM113 gene, herein designated GAM GENE, and GAM113 target gene, herein designated TARGET GENE, are human genes contained in the human genome.

GAM113 gene encodes a GAM113 precursor RNA, herein designated GAM PRECURSOR RNA. Similar to other miRNA genes, and unlike most ordinary genes, GAM113 precursor RNA does not encode a protein. A nucleotide sequence identical or highly similar to the nucleotide sequence of GAM113 precursor RNA is designated SEQ ID:74, and is provided hereinbelow with reference to the sequence listing part.

GAM113 precursor RNA folds onto itself, forming GAM113 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM113 precursor RNA folds onto itself, forming GAM113 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM113 precursor RNA, designated SEQ-ID:74, and a schematic representation of a predicted secondary folding of GAM113 folded precursor RNA are further described with reference to Table 2, hereby incorporated by reference.

An enzyme complex designated DICER COMPLEX, 'dices' the GAM113 folded precursor RNA into GAM113 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM113 RNA is designated SEQ ID:233, and is provided hereinbelow with references to the sequence listing part and Table 3, hereby incorporated by reference.

GAM113 target gene, herein designated TARGET GENE, encodes a corresponding messenger RNA, GAM113 target RNA, herein designated GAM TARGET RNA. GAM113 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM113 RNA, herein designated GAM RNA, binds complementarily to one or more target binding sites located in untranslated regions of GAM113 target RNA, herein designated GAM TARGET RNA. This complementary binding is due to the fact that the nucleotide sequence of GAM113 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM113 RNA may have a different number of target binding sites in untranslated regions of a GAM113 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM113 RNA, herein designated GAM RNA, to target binding sites on GAM113 target RNA, herein designated GAM TARGET RNA, such as BINDING SITE I, BINDING SITE II and BINDING SITE III, inhibits translation of GAM113 target RNA into GAM113 target protein, herein designated GAM TARGET PROTEIN. GAM target protein is therefore outlined by a broken line.

It is appreciated that GAM113 target gene, herein designated TARGET GENE, in fact represents a plurality of GAM113 target genes. The mRNA of each one of this plurality of GAM113 target genes comprises one or more target binding sites, each having a nucleotide sequence which is at least partly complementary to GAM113 RNA, herein designated GAM RNA, and which when bound by GAM113 RNA causes inhibition of translation of respective one or more GAM113 target proteins.

It is further appreciated by one skilled in the art that the mode of translational inhibition illustrated by FIG. 8 with specific reference to translational inhibition exerted by GAM113 gene, herein designated GAM GENE, on one or more GAM113 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM113 correlate with, and may be deduced from, the identity of the target genes which GAM113 binds and inhibits, and the function of these target genes, as elaborated hereinbelow.

Chromosome 20 open reading frame 27 (C20orf27, Accession NM_017874.1) is a GAM113 target gene, herein designated TARGET GENE. C20orf27 BINDING SITE is a target binding site found in the 5' untranslated region of mRNA encoded by C20orf27, corresponding to a target binding site such as BINDING SITE I, BINDING SITE II or BINDING SITE III of FIG. 8. Table 4 illustrates the complementarity of the nucleotide sequences of C20orf27 BINDING SITE, designated SEQ ID:12502, to the nucleotide sequence of GAM113 RNA, herein designated GAM RNA, also designated SEQ ID:233.

A function of GAM113 is therefore inhibition of Chromosome 20 open reading frame 27 (C20orf27, Accession NM_017874.1). Accordingly, utilities of GAM113 include diagnosis, prevention and treatment of diseases and clinical conditions associated with C20orf27.

LOC255975 (Accession XM_171083.2) is another GAM113 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:16326, to the nucleotide sequence of GAM113 RNA, herein designated GAM RNA, also designated SEQ ID:233.

Another function of GAM113 is therefore inhibition of LOC255975 (Accession XM_171083.2). Accordingly, utilities of GAM113 include diagnosis, prevention and treatment of diseases and clinical conditions associated with LOC255975.

LOC92017 (Accession XM_042234.3) is another GAM113 target gene, herein designated TARGET GENE. LOC92017 BINDING SITE is a target binding site found in the 5' untranslated region of mRNA encoded by LOC92017, corresponding to a target binding site such as BINDING SITE I, BINDING SITE II or BINDING SITE III of FIG. 8. Table 4 illustrates the complementarity of the nucleotide sequences of LOC92017 BINDING SITE, designated SEQ ID:12778, to the nucleotide sequence of GAM113 RNA, herein designated GAM RNA, also designated SEQ ID:233.

Another function of GAM113 is therefore inhibition of LOC92017 (Accession XM_042234.3). Accordingly, utilities of GAM113 include diagnosis, prevention and treatment of diseases and clinical conditions associated with LOC92017.

FIG. 8 further provides a conceptual description of a novel bioinformatically detected of the present invention, referred to here as Genomic Address Messenger 114 (GAM114), which modulates expression of respective target genes thereof, the function and utility of which target genes is known in the art.

GAM114 is a novel bioinformatically detected regulatory, non protein coding, micro RNA (miRNA) gene. The method by which GAM114 was detected is described hereinabove with reference to FIGS. 8-15.

GAM114 gene, herein designated GAM GENE, and GAM114 target gene, herein designated TARGET GENE, are human genes contained in the human genome.

GAM114 gene encodes a GAM114 precursor RNA, herein designated GAM PRECURSOR RNA. Similar to other miRNA genes, and unlike most ordinary genes, GAM114 precursor RNA does not encode a protein. A nucleotide sequence identical or highly similar to the nucleotide sequence of GAM114 precursor RNA is designated SEQ ID:75, and is provided hereinbelow with reference to the sequence listing part.

GAM114 precursor RNA folds onto itself, forming GAM114 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM114 precursor RNA folds onto itself, forming GAM114 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM114 precursor RNA, designated SEQ-ID:75, and a schematic representation of a predicted secondary folding of GAM114 folded precursor RNA are further described with reference to Table 2, hereby incorporated by reference.

An enzyme complex designated DICER COMPLEX, 'dices' the GAM114 folded precursor RNA into GAM114 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM114 RNA is designated SEQ ID:288, and is provided hereinbelow with references to the sequence listing part and Table 3, hereby incorporated by reference.

GAM114 target gene, herein designated TARGET GENE, encodes a corresponding messenger RNA, GAM114 target RNA, herein designated GAM TARGET RNA. GAM114 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM114 RNA, herein designated GAM RNA, binds complementarily to one or more target binding sites located in untranslated regions of GAM114 target RNA, herein designated GAM TARGET RNA. This complementary binding is due to the fact that the nucleotide sequence of GAM114 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM114 RNA may have a different number of target binding sites in untranslated regions of a GAM114 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM114 RNA, herein designated GAM RNA, to target binding sites on GAM114 target RNA, herein designated GAM TARGET RNA, such as BINDING SITE I, BINDING SITE II and BINDING SITE III, inhibits translation of GAM114 target RNA into GAM114 target protein, herein designated GAM TARGET PROTEIN. GAM target protein is therefore outlined by a broken line.

It is appreciated that GAM114 target gene, herein designated TARGET GENE, in fact represents a plurality of GAM114 target genes. The mRNA of each one of this plurality of GAM114 target genes comprises one or more target binding sites, each having a nucleotide sequence which is at least partly complementary to GAM114 RNA, herein designated GAM RNA, and which when bound by GAM114 RNA causes inhibition of translation of respective one or more GAM114 target proteins.

It is further appreciated by one skilled in the art that the mode of translational inhibition illustrated by FIG. 8 with specific reference to translational inhibition exerted by GAM114 gene, herein designated GAM GENE, on one or more GAM114 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM114 correlate with, and may be deduced from, the identity of the target genes which GAM114 binds and inhibits, and the function of these target genes, as elaborated hereinbelow.

ATP10C (Accession) is a GAM114 target gene, herein designated TARGET GENE. ATP10C BINDING SITE is a target binding site found in the 3' untranslated region of mRNA encoded by ATP10C, corresponding to a target binding site such as BINDING SITE I, BINDING SITE II or BINDING SITE III of FIG. 8. Table 4 illustrates the complementarity of the nucleotide sequences of ATP10C BINDING SITE, designated SEQ ID:17918, to the nucleotide sequence of GAM114 RNA, herein designated GAM RNA, also designated SEQ ID:288.

A function of GAM114 is therefore inhibition of ATP10C (Accession), a gene which is phosphorylated in their intermediate state, drives uphill transport of ions across membranes and therefore may be associated with Angelman syndrome, obesity resembling that of prader-willi syndrome. Accordingly, utilities of GAM114 include diagnosis, prevention and treatment of Angelman syndrome, obesity resembling that of prader-willi syndrome, and of other diseases and clinical conditions associated with ATP10C.

The function of ATP10C has been established by previous studies. Meguro et al. (2001) reported that the ATP10C gene is maternally expressed, that it maps within the most common interval of deletion responsible for Angelman syndrome (AS; 105830) (15q11-q13), and that ATP10C expression is virtually absent from Angelman syndrome patients with imprinting mutations, as well as from patients with maternal deletions of 15q11-q13. Previously, although AS patients infrequently have mutations in the UBE3A gene (OMIM Ref. No. 601623), which encodes a ubiquitin ligase required for long-term synaptic potentiation (LTP), most cases were attributable to de novo maternal deletions of the critical 15q region. Herzing et al. (2001) reported that ATP10C maps within 200 kb distal to UBE3A and, like UBE3A, demonstrates imprinted, preferential maternal expression in human brain. They suggested that ATP10C is a candidate for chromosome 15-associated autism as well as the Angelman syndrome phenotype.

Animal model experiments lend further support to the function of ATP10C. Dhar et al. (2000) reported that maternal inheritance of deletions of the mouse Atp10c gene resulted in increased body fat. The obese phenotype was consistently observed in the mouse model for Angelman syndrome with paternal uniparental disomy (Cattanach et al., 1997). Meguro et al. (2001) speculated that ATP10C may be an aminophospholipid translocase involved in phospholipid transport.

It is appreciated that the abovementioned animal model for ATP10C is acknowledged by those skilled in the art as a scientifically valid animal model, as can be further appreciated from the publications sited hereinbelow.

Full details of the abovementioned studies are described in the following publications, the disclosure of which are hereby incorporated by reference:

Meguro, M.; Kashiwagi, A.; Mitsuy, K.; Nakao, M.; Kondo, I.; Saitoh, S.; Oshimura, M.: A novel maternally expressed gene, ATP10C, encodes a putative aminophospholipid translocase associated with Angelman syndrome. Nature Genet. 28:19-20, 2001; and Cattanach, B. M.; Barr, J. A.; Beechey, C. V.; Martin, J.; Noebels, J.; Jones, J. : A candidate model for Angelman syndrome in the mouse. Mammalian Genome 8:472-478, 1997.

Further studies establishing the function and utilities of ATP10C are found in John Hopkins OMIM database record ID 605855, and in cited publications listed in Table 5, which are hereby incorporated by reference.

FIG. 8 further provides a conceptual description of a novel bioinformatically detected of the present invention, referred to here as Genomic Address Messenger 115 (GAM115), which modulates expression of respective target genes thereof, the function and utility of which target genes is known in the art.

GAM115 is a novel bioinformatically detected regulatory, non protein coding, micro RNA (miRNA) gene. The method by which GAM115 was detected is described hereinabove with reference to FIGS. 8-15.

GAM115 gene, herein designated GAM GENE, and GAM115 target gene, herein designated TARGET GENE, are human genes contained in the human genome.

GAM115 gene encodes a GAM115 precursor RNA, herein designated GAM PRECURSOR RNA. Similar to other miRNA genes, and unlike most ordinary genes, GAM115 precursor RNA does not encode a protein. A nucleotide sequence identical or highly similar to the nucleotide sequence of GAM115 precursor RNA is designated SEQ ID:103, and is provided hereinbelow with reference to the sequence listing part. Nucleotide sequence SEQ ID:103 is located at position 80233984 relative to chromosome 17.

GAM115 precursor RNA folds onto itself, forming GAM115 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM115 precursor RNA folds onto itself, forming GAM115 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM115 precursor RNA, designated SEQ-ID:103, and a schematic representation of a predicted secondary folding of GAM115 folded precursor RNA are further described with reference to Table 2, hereby incorporated by reference.

An enzyme complex designated DICER COMPLEX, 'dices' the GAM115 folded precursor RNA into GAM115 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM115 RNA is designated SEQ ID:229, and is provided hereinbelow with references to the sequence listing part and Table 3, hereby incorporated by reference.

GAM115 target gene, herein designated TARGET GENE, encodes a corresponding messenger RNA, GAM115 target RNA, herein designated GAM TARGET RNA. GAM115 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM115 RNA, herein designated GAM RNA, binds complementarily to one or more target binding sites located in untranslated regions of GAM115 target RNA, herein designated GAM TARGET RNA. This complementary binding is due to the fact that the nucleotide sequence of GAM115 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM115 RNA may have a different number of target binding sites in untranslated regions of a GAM115 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM115 RNA, herein designated GAM RNA, to target binding sites on GAM115 target RNA, herein designated GAM TARGET RNA, such as BINDING SITE I, BINDING SITE II and BINDING SITE III, inhibits translation of GAM115 target RNA into GAM115 target protein, herein designated GAM TARGET PROTEIN. GAM target protein is therefore outlined by a broken line.

It is appreciated that GAM115 target gene, herein designated TARGET GENE, in fact represents a plurality of GAM115 target genes. The mRNA of each one of this plurality of GAM115 target genes comprises one or more target binding sites, each having a nucleotide sequence which is at least partly complementary to GAM115 RNA, herein designated GAM RNA, and which when bound by GAM115 RNA causes inhibition of translation of respective one or more GAM115 target proteins.

It is further appreciated by one skilled in the art that the mode of translational inhibition illustrated by FIG. 8 with specific reference to translational inhibition exerted by GAM115 gene, herein designated GAM GENE, on one or more GAM115 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM115 correlate with, and may be deduced from, the identity of the target genes which GAM115 binds and inhibits, and the function of these target genes, as elaborated hereinbelow.

FLJ20257 (Accession NM_019606.3) is a GAM115 target gene, herein designated TARGET GENE. FLJ20257 BINDING SITE is a target binding site found in the 5' untranslated region of mRNA encoded by FLJ20257, corresponding to a target binding site such as BINDING SITE I, BINDING SITE II or BINDING SITE III of FIG. 8. Table 4 illustrates the complementarity of the nucleotide sequences of FLJ20257 BINDING SITE, designated SEQ ID:3143, to the nucleotide sequence of GAM115 RNA, herein designated GAM RNA, also designated SEQ ID:229.

A function of GAM115 is therefore inhibition of FLJ20257 (Accession NM_019606.3). Accordingly, utilities of GAM115 include diagnosis, prevention and treatment of diseases and clinical conditions associated with FLJ20257.

LOC201627 (Accession) is another GAM115 target gene, herein designated TARGET GENE. LOC201627 BINDING SITE is a target binding site found in the 3' untranslated region of mRNA encoded by LOC201627, corresponding to a target binding site such as BINDING SITE I, BINDING SITE II or BINDING SITE III of FIG. 8. Table 4 illustrates the complementarity of the nucleotide sequences of LOC201627 BINDING SITE, designated SEQ ID:10333, to the nucleotide sequence of GAM115 RNA, herein designated GAM RNA, also designated SEQ ID:229.

Another function of GAM115 is therefore inhibition of LOC201627 (Accession). Accordingly, utilities of GAM115 include diagnosis, prevention and treatment of diseases and clinical conditions associated with LOC201627.

LOC51015 (Accession) is another GAM115 target gene, herein designated TARGET GENE. LOC51015 BINDING SITE is a target binding site found in the 3' untranslated region of mRNA encoded by LOC51015, corresponding to a target binding site such as BINDING SITE I, BINDING SITE II or BINDING SITE III of FIG. 8. Table 4 illustrates the complementarity of the nucleotide sequences of LOC51015 BINDING SITE, designated SEQ ID:14480, to the nucleotide sequence of GAM115 RNA, herein designated GAM RNA, also designated SEQ ID:229.

Another function of GAM115 is therefore inhibition of LOC51015 (Accession). Accordingly, utilities of GAM115 include diagnosis, prevention and treatment of diseases and clinical conditions associated with LOC51015.

Protease, serine, 21 (testisin) (PRSS21, Accession NM_006799.2) is another GAM115 target gene, herein designated TARGET GENE. PRSS21 BINDING SITE is a target binding site found in the 3' untranslated region of multiple transcripts of mRNA encoded by PRSS21, corresponding to a target binding site such as BINDING SITE I, BINDING SITE II or BINDING SITE III of FIG. 8. Table 4 illustrates the complementarity of the nucleotide sequences of PRSS21 BINDING SITE, designated SEQ ID:3015, to the nucleotide sequence of GAM115 RNA, herein designated GAM RNA, also designated SEQ ID:229.

Another function of GAM115 is therefore inhibition of Protease, serine, 21 (testisin) (PRSS21, Accession NM_006799.2). Accordingly, utilities of GAM115 include diagnosis, prevention and treatment of diseases and clinical conditions associated with PRSS21.

FIG. 8 further provides a conceptual description of a novel bioinformatically detected of the present invention, referred to here as Genomic Address Messenger 116 (GAM116), which modulates expression of respective target genes thereof, the function and utility of which target genes is known in the art.

GAM116 is a novel bioinformatically detected regulatory, non protein coding, micro RNA (miRNA) gene. The method by which GAM116 was detected is described hereinabove with reference to FIGS. 8-15.

GAM116 gene, herein designated GAM GENE, and GAM116 target gene, herein designated TARGET GENE, are human genes contained in the human genome.

GAM116 gene encodes a GAM116 precursor RNA, herein designated GAM PRECURSOR RNA. Similar to other miRNA genes, and unlike most ordinary genes, GAM116 precursor RNA does not encode a protein. A nucleotide sequence identical or highly similar to the nucleotide sequence of GAM116 precursor RNA is designated SEQ ID:100, and is provided hereinbelow with reference to the sequence listing part.

GAM116 precursor RNA folds onto itself, forming GAM116 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM116 precursor RNA folds onto itself, forming GAM116 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM116 precursor RNA, designated SEQ-ID:100, and a schematic representation of a predicted secondary folding of GAM116 folded precursor RNA are further described with reference to Table 2, hereby incorporated by reference.

An enzyme complex designated DICER COMPLEX, 'dices' the GAM116 folded precursor RNA into GAM116 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM116 RNA is designated SEQ ID:301, and is provided hereinbelow with references to the sequence listing part and Table 3, hereby incorporated by reference.

GAM116 target gene, herein designated TARGET GENE, encodes a corresponding messenger RNA, GAM116 target RNA, herein designated GAM TARGET RNA. GAM116 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM116 RNA, herein designated GAM RNA, binds complementarily to one or more target binding sites located in untranslated regions of GAM116 target RNA, herein designated GAM TARGET RNA. This complementary binding is due to the fact that the nucleotide sequence of GAM116 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM116 RNA may have a different number of target binding sites in untranslated regions of a GAM116 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM116 RNA, herein designated GAM RNA, to target binding sites on GAM116 target RNA, herein designated GAM TARGET RNA, such as BINDING SITE I, BINDING SITE II and BINDING SITE III, inhibits translation of GAM116 target RNA into GAM116 target protein, herein designated GAM TARGET PROTEIN. GAM target protein is therefore outlined by a broken line.

It is appreciated that GAM116 target gene, herein designated TARGET GENE, in fact represents a plurality of GAM116 target genes. The mRNA of each one of this plurality of GAM116 target genes comprises one or more target binding sites, each having a nucleotide sequence which is at least partly complementary to GAM116 RNA, herein designated GAM RNA, and which when bound by GAM116 RNA causes inhibition of translation of respective one or more GAM116 target proteins.

It is further appreciated by one skilled in the art that the mode of translational inhibition illustrated by FIG. 8 with specific reference to translational inhibition exerted by GAM116 gene, herein designated GAM GENE, on one or more GAM116 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM116 correlate with, and may be deduced from, the identity of the target genes which GAM116 binds and inhibits, and the function of these target genes, as elaborated hereinbelow.

Acyl-coenzyme a dehydrogenase, long chain (ACADL, Accession NP_001599.1) is a GAM116 target gene, herein designated TARGET GENE. ACADL BINDING SITE is a target binding site found in the 3' untranslated region of mRNA encoded by ACADL, corresponding to a target binding site such as BINDING SITE I, BINDING SITE II or BINDING SITE III of FIG. 8. Table 4 illustrates the complementarity of the nucleotide sequences of ACADL BINDING SITE, designated SEQ ID:2475, to the nucleotide sequence of GAM116 RNA, herein designated GAM RNA, also designated SEQ ID:301.

A function of GAM116 is therefore inhibition of Acyl-coenzyme a dehydrogenase, long chain (ACADL, Accession NP_001599.1). Accordingly, utilities of GAM116 include diagnosis, prevention and treatment of diseases and clinical conditions associated with ACADL.

AD023 (Accession NP_065730.2) is another GAM116 target gene, herein designated TARGET GENE. AD023 BINDING SITE is a target binding site found in the 3' untranslated region of mRNA encoded by AD023, corresponding to a target binding site such as BINDING SITE I, BINDING SITE II or BINDING SITE III of FIG. 8. Table 4 illustrates the complementarity of the nucleotide sequences of AD023 BINDING SITE, designated SEQ ID:12888, to the nucleotide sequence of GAM116 RNA, herein designated GAM RNA, also designated SEQ ID:301.

Another function of GAM116 is therefore inhibition of AD023 (Accession NP_065730.2). Accordingly, utilities of GAM116 include diagnosis, prevention and treatment of diseases and clinical conditions associated with AD023.

Adenosine kinase (ADK, Accession NP_001114.1) is another GAM116 target gene, herein designated TARGET GENE. ADK BINDING SITE is a target binding site found in the 3' untranslated region of multiple transcripts of mRNA encoded by ADK, corresponding to a target binding site such as BINDING SITE I, BINDING SITE II or BINDING SITE III of FIG. 8. Table 4 illustrates the complementarity of the nucleotide sequences of ADK BINDING SITE, designated SEQ ID:19386, to the nucleotide sequence of GAM116 RNA, herein designated GAM RNA, also designated SEQ ID:301.

Another function of GAM116 is therefore inhibition of Adenosine kinase (ADK, Accession NP_001114.1), a gene which Adenosine kinase; catalyzes conversion of adenosine to AMP. Accordingly, utilities of GAM116 include diagnosis, prevention and treatment of diseases and clinical conditions associated with ADK.

The function of ADK has been established by previous studies. Adenosine kinase (ATP:adenosine 5-prime-phosphotransferase; EC 2.7.1.20) is an abundant enzyme in mammalian tissues that catalyzes the transfer of the gamma-phosphate from ATP to adenosine, thereby serving as a potentially important regulator of concentrations of both extracellular adenosine and intracellular adenine nucleotides. Adenosine has widespread effects on the cardiovascular, nervous, respiratory, and immune systems and inhibitors of ADK could play an important pharmacological role in increasing intravascular adenosine concentrations and acting as antiinflammatory agents. Spychala et al. (1996) obtained full-length cDNA clones encoding catalytically active ADK from lymphocyte, placental, and liver cDNA libraries. On Northern blots of all tissues examined, they identified mRNA species of 1.3 and 1.8 kb, attributable to alternative polyadenylation sites at the 3-prime end of the gene. The encoded protein consisted of 345 amino acids with a calculated molecular size of 38.7 kD and without any sequence similarities to other well-characterized mammalian nucleoside kinases. In contrast, 2 regions were identified with significant sequence identity to microbial ribokinase and fructokinases and a bacterial inosine/guanosine kinase. Thus, ADK is a structurally distinct mammalian nucleoside kinase that appears to be akin to sugar kinases of microbial origin. McNally et al. (1997) also cloned human cDNAs encoding adenosine kinase. They found cDNAs encoding both the 345-amino acid form and a 362-amino acid form of the enzyme. These 2 alternately spliced forms differed only at the 5-prime end. When expressed, both isoforms of the enzyme phosphorylated adenosine with identical kinetics and both required Mg2+ for activity. The structural gene for this enzyme was tentatively assigned to chromosome 10 by somatic cell hybrid studies (Klobutcher et al., 1976). By the principle of gene dosage, Francke and Thompson (1979) concluded by exclusion that ADK must be in the region 10q11-10q24. In a case of trisomy 10p, Snyder et al. (1984) found normal levels of ADK.

Animal model experiments lend further support to the function of ADK. Boison et al. (2002) pursued the hypothesis that a deficit in adenosine-dependent metabolism is a causative factor for the development of microvesicular hepatic steatosis. A deficiency of adenosine kinase, the major adenosine-removing enzyme of postnatal liver, was expected to affect liver function on 3 levels: availability of adenine nucleotides; disruption of the futile cycle between AMP and adenosine; and maintenance of transmethylation reactions. In homozygous Adk -/- mice, generated through Adk-targeting, embryonic stem cells developed normally during embryogenesis. However, within 4 days after birth they displayed microvesicular hepatic steatosis and died within 14 days with fatty liver. Adenine nucleotides were decreased and S-adenosylhomocysteine, a potent inhibitor of transmethylation reactions, was increased in the mutant liver.

It is appreciated that the abovementioned animal model for ADK is acknowledged by those skilled in the art as a scientifically valid animal model, as can be further appreciated from the publications sited hereinbelow.

Full details of the abovementioned studies are described in the following publications, the disclosure of which are hereby incorporated by reference:

McNally, T.; Helfrich, R. J.; Cowart, M.; Dorwin, S. A.; Meuth, J. L.; Idler, K. B.; Klute, K. A.; Simmer, R. L.; Kowaluk, E. A.; Halbert, D. N.: Cloning and expression of the adenosine kinase gene from rat and human tissues. Biochem. Biophys. Res. Commun. 231:645-650, 1997; and Boison, D.; Scheurer, L.; Zumsteg, V.; Rulicke, T.; Litynski, P.; Fowler, B.; Brandner, S.; Mohler, H.: Neonatal hepatic steatosis by disruption of the adenosine kinase gene. Proc. Nat.

Further studies establishing the function and utilities of ADK are found in John Hopkins OMIM database record ID 102750, and in cited publications listed in Table 5, which are hereby incorporated by reference. Adenosine kinase (ADK, Accession NP_006712.1) is another GAM116 target gene, herein designated TARGET GENE. ADK BINDING SITE is a target binding site found in the 3' untranslated region of multiple transcripts of mRNA encoded by ADK, corresponding to a target binding site such as BINDING SITE I, BINDING SITE II or BINDING SITE III of FIG. 8. Table 4 illustrates the complementarity of the nucleotide sequences of ADK BINDING SITE, designated SEQ ID:19386, to the nucleotide sequence of GAM116 RNA, herein designated GAM RNA, also designated SEQ ID:301.

Another function of GAM116 is therefore inhibition of Adenosine kinase (ADK, Accession NP_006712.1), a gene which Adenosine kinase; catalyzes conversion of adenosine to AMP. Accordingly, utilities of GAM116 include diagnosis, prevention and treatment of diseases and clinical conditions associated with ADK.

The function of ADK has been established by previous studies. Adenosine kinase (ATP:adenosine 5-prime-phosphotransferase; EC 2.7.1.20) is an abundant enzyme in mammalian tissues that catalyzes the transfer of the gamma-phosphate from ATP to adenosine, thereby serving as a potentially important regulator of concentrations of both extracellular adenosine and intracellular adenine nucleotides. Adenosine has widespread effects on the cardiovascular, nervous, respiratory, and immune systems and inhibitors of ADK could play an important pharmacological role in increasing intravascular adenosine concentrations and acting as antiinflammatory agents. Spychala et al. (1996) obtained full-length cDNA clones encoding catalytically active ADK from lymphocyte, placental, and liver cDNA libraries. On Northern blots of all tissues examined, they identified mRNA species of 1.3 and 1.8 kb, attributable to alternative polyadenylation sites at the 3-prime end of the gene. The encoded protein consisted of 345 amino acids with a calculated molecular size of 38.7 kD and without any sequence similarities to other well-characterized mammalian nucleoside kinases. In contrast, 2 regions were identified with significant sequence identity to microbial ribokinase and fructokinases and a bacterial inosine/guanosine kinase. Thus, ADK is a structurally distinct mammalian nucleoside kinase that appears to be akin to sugar kinases of microbial origin. McNally et al. (1997) also cloned human cDNAs encoding adenosine kinase. They found cDNAs encoding both the 345-amino acid form and a 362-amino acid form of the enzyme. These 2 alternately spliced forms differed only at the 5-prime end. When expressed, both isoforms of the enzyme phosphorylated adenosine with identical kinetics and both required Mg2+ for activity. The structural gene for this enzyme was tentatively assigned to chromosome 10 by somatic cell hybrid studies (Klobutcher et al., 1976). By the principle of gene dosage, Francke and Thompson (1979) concluded by exclusion that ADK must be in the region 10q11-10q24. In a case of trisomy 10p, Snyder et al. (1984) found normal levels of ADK.

Animal model experiments lend further support to the function of ADK. Boison et al. (2002) pursued the hypothesis that a deficit in adenosine-dependent metabolism is a causative factor for the development of microvesicular hepatic steatosis. A deficiency of adenosine kinase, the major adenosine-removing enzyme of postnatal liver, was expected to affect liver function on 3 levels: availability of adenine nucleotides; disruption of the futile cycle between AMP and adenosine; and maintenance of transmethylation reactions. In homozygous Adk -/- mice, generated through Adk-targeting, embryonic stem cells developed normally during embryogenesis. However, within 4 days after birth they displayed microvesicular hepatic steatosis and died within 14 days with fatty liver. Adenine nucleotides were decreased and S-adenosylhomocysteine, a potent inhibitor of transmethylation reactions, was increased in the mutant liver.

It is appreciated that the abovementioned animal model for ADK is acknowledged by those skilled in the art as a scientifically valid animal model, as can be further appreciated from the publications sited hereinbelow.

Full details of the abovementioned studies are described in the following publications, the disclosure of which are hereby incorporated by reference:

McNally, T.; Helfrich, R. J.; Cowart, M.; Dorwin, S. A.; Meuth, J. L.; Idler, K. B.; Klute, K. A.; Simmer, R. L.; Kowaluk, E. A.; Halbert, D. N.: Cloning and expression of the adenosine kinase gene from rat and human tissues. Biochem. Biophys. Res. Commun. 231:645-650, 1997; and Boison, D.; Scheurer, L.; Zumsteg, V.; Rulicke, T.; Litynski, P.; Fowler, B.; Brandner, S.; Mohler, H.: Neonatal hepatic steatosis by disruption of the adenosine kinase gene. Proc. Nat.

Further studies establishing the function and utilities of ADK are found in John Hopkins OMIM database record ID 102750, and in cited publications listed in Table 5, which are hereby incorporated by reference. Aminomethyltransferase (glycine cleavage system protein t) (AMT, Accession NP_000472.1) is another GAM116 target gene, herein designated TARGET GENE. AMT BINDING SITE is a target binding site found in the 3' untranslated region of mRNA encoded by AMT, corresponding to a target binding site such as BINDING SITE I, BINDING SITE II or BINDING SITE III of FIG. 8. Table 4 illustrates the complementarity of the nucleotide sequences of AMT BINDING SITE, designated SEQ ID:16729, to the nucleotide sequence of GAM116 RNA, herein designated GAM RNA, also designated SEQ ID:301.

Another function of GAM116 is therefore inhibition of Aminomethyltransferase (glycine cleavage system protein t) (AMT, Accession NP_000472.1). Accordingly, utilities of GAM116 include diagnosis, prevention and treatment of diseases and clinical conditions associated with AMT.

ANAPC1 (Accession NP_073153.1) is another GAM116 target gene, herein designated TARGET GENE. ANAPC1 BINDING SITE is a target binding site found in the 5' untranslated region of mRNA encoded by ANAPC1, corresponding to a target binding site such as BINDING SITE I, BINDING SITE II or BINDING SITE III of FIG. 8. Table 4 illustrates the complementarity of the nucleotide sequences of ANAPC1 BINDING SITE, designated SEQ ID:14212, to the nucleotide sequence of GAM116 RNA, herein designated GAM RNA, also designated SEQ ID:301.

Another function of GAM116 is therefore inhibition of ANAPC1 (Accession NP_073153.1). Accordingly, utilities of GAM116 include diagnosis, prevention and treatment of diseases and clinical conditions associated with ANAPC1.

Ap1 gamma subunit binding protein 1 (AP1GBP1, Accession NP_009178.2) is another GAM116 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:1791, to the nucleotide sequence of GAM116 RNA, herein designated GAM RNA, also designated SEQ ID:301.

Another function of GAM116 is therefore inhibition of Ap1 gamma subunit binding protein 1 (AP1GBP1, Accession NP_009178.2). Accordingly, utilities of GAM116 include diagnosis, prevention and treatment of diseases and clinical conditions associated with AP1GBP1.

Ap1 gamma subunit binding protein 1 (AP1GBP1, Accession NP_542117.1) is another GAM116 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:1791, to the nucleotide sequence of GAM116 RNA, herein designated GAM RNA, also designated SEQ ID:301.

Another function of GAM116 is therefore inhibition of Ap1 gamma subunit binding protein 1 (AP1GBP1, Accession NP_542117.1). Accordingly, utilities of GAM116 include diagnosis, prevention and treatment of diseases and clinical conditions associated with AP1GBP1.

Rho guanine nucleotide exchange factor (gef) 4 (ARHGEF4, Accession NP_127462.1) is another GAM116 target gene, herein designated TARGET GENE. ARHGEF4 BINDING SITE is a target binding site found in the 5' untranslated region of multiple transcripts of mRNA encoded by ARHGEF4, corresponding to a target binding site such as BINDING SITE I, BINDING SITE II or BINDING SITE III of FIG. 8. Table 4 illustrates the complementarity of the nucleotide sequences of ARHGEF4 BINDING SITE, designated SEQ ID:12767, to the nucleotide sequence of GAM116 RNA, herein designated GAM RNA, also designated SEQ ID:301.

Another function of GAM116 is therefore inhibition of Rho guanine nucleotide exchange factor (gef) 4 (ARHGEF4, Accession NP_127462.1). Accordingly, utilities of GAM116 include diagnosis, prevention and treatment of diseases and clinical conditions associated with ARHGEF4.

Rho guanine nucleotide exchange factor (gef) 4 (ARHGEF4, Accession NP_056135.2) is another GAM116 target gene, herein designated TARGET GENE. ARHGEF4 BINDING SITE is a target binding site found in the 5' untranslated region of multiple transcripts of mRNA encoded by ARHGEF4, corresponding to a target binding site such as BINDING SITE I, BINDING SITE II or BINDING SITE III of FIG. 8. Table 4 illustrates the complementarity of the nucleotide sequences of ARHGEF4 BINDING SITE, designated SEQ ID:12767, to the nucleotide sequence of GAM116 RNA, herein designated GAM RNA, also designated SEQ ID:301.

Another function of GAM116 is therefore inhibition of Rho guanine nucleotide exchange factor (gef) 4 (ARHGEF4, Accession NP_056135.2). Accordingly, utilities of GAM116 include diagnosis, prevention and treatment of diseases and clinical conditions associated with ARHGEF4.

Aryl-hydrocarbon receptor nuclear translocator 2 (ARNT2, Accession NP_055677.1) is another GAM116 target gene, herein designated TARGET GENE. ARNT2 BINDING SITE is a target binding site found in the 3' untranslated region of mRNA encoded by ARNT2, corresponding to a target binding site such as BINDING SITE I, BINDING SITE II or BINDING SITE III of FIG. 8. Table 4 illustrates the complementarity of the nucleotide sequences of ARNT2 BINDING SITE, designated SEQ ID:6462, to the nucleotide sequence of GAM116 RNA, herein designated GAM RNA, also designated SEQ ID:301.

Another function of GAM116 is therefore inhibition of Aryl-hydrocarbon receptor nuclear translocator 2 (ARNT2, Accession NP_055677.1), a gene which specifically recognizes the xenobiotic response element (xre). Accordingly, utilities of GAM116 include diagnosis, prevention and treatment of diseases and clinical conditions associated with ARNT2.

The function of ARNT2 and its association with various diseases and clinical conditions, has been established by previous studies, as described hereinabove with reference to GAM67.1. ARP5 (Accession NP_114123.2) is another GAM116 target gene, herein designated TARGET GENE. ARP5 BINDING SITE1 and ARP5 BINDING SITE2 are target binding sites found in untranslated regions of mRNA encoded by ARP5, corresponding to target binding sites such as BINDING SITE I, BINDING SITE II or BINDING SITE III of FIG. 8. Table 4 illustrates the complementarity of the nucleotide sequences of ARP5 BINDING SITE1 and ARP5 BINDING SITE2, designated SEQ ID:6833 and SEQ ID:5338 respectively, to the nucleotide sequence of GAM116 RNA, herein designated GAM RNA, also designated SEQ ID:301.

Another function of GAM116 is therefore inhibition of ARP5 (Accession NP_114123.2). Accordingly, utilities of GAM116 include diagnosis, prevention and treatment of diseases and clinical conditions associated with ARP5.

ATP6V1A (Accession NP_001681.2) is another GAM116 target gene, herein designated TARGET GENE. ATP6V1A BINDING SITE is a target binding site found in the 3' untranslated region of mRNA encoded by ATP6V1A, corresponding to a target binding site such as BINDING SITE I, BINDING SITE II or BINDING SITE III of FIG. 8. Table 4 illustrates the complementarity of the nucleotide sequences of ATP6V1A BINDING SITE, designated SEQ ID:6211, to the nucleotide sequence of GAM116 RNA, herein designated GAM RNA, also designated SEQ ID:301.

Another function of GAM116 is therefore inhibition of ATP6V1A (Accession NP_001681.2). Accordingly, utilities of GAM116 include diagnosis, prevention and treatment of diseases and clinical conditions associated with ATP6V1A.

Attractin (ATRN, Accession NP_647537.1) is another GAM116 target gene, herein designated TARGET GENE. ATRN BINDING SITE is a target binding site found in the 3' untranslated region of multiple transcripts of mRNA encoded by ATRN, corresponding to a target binding site such as BINDING SITE I, BINDING SITE II or BINDING SITE III of FIG. 8. Table 4 illustrates the complementarity of the nucleotide sequences of ATRN BINDING SITE, designated SEQ ID:8323, to the nucleotide sequence of GAM116 RNA, herein designated GAM RNA, also designated SEQ ID:301.

Another function of GAM116 is therefore inhibition of Attractin (ATRN, Accession NP_647537.1), a gene which is involved in the initial immune cell clustering during inflammatory response. Accordingly, utilities of GAM116 include diagnosis, prevention and treatment of diseases and clinical conditions associated with ATRN.

The function of ATRN and its association with various diseases and clinical conditions, has been established by previous studies, as described hereinabove with reference to GAM47.1. Udp-gal:betaglcnac beta 1,4-galactosyltransferase, polypeptide 3 (B4GALT3, Accession NP_003770.1) is another GAM116 target gene, herein designated TARGET GENE. B4GALT3 BINDING SITE is a target binding site found in the 3' untranslated region of mRNA encoded by B4GALT3, corresponding to a target binding site such as BINDING SITE I, BINDING SITE II or BINDING SITE III of FIG. 8. Table 4 illustrates the complementarity of the nucleotide sequences of B4GALT3 BINDING SITE, designated SEQ ID:13333, to the nucleotide sequence of GAM116 RNA, herein designated GAM RNA, also designated SEQ ID:301.

Another function of GAM116 is therefore inhibition of Udp-gal:betaglcnac beta 1,4-galactosyltransferase, polypeptide 3 (B4GALT3, Accession NP_003770.1). Accordingly, utilities of GAM116 include diagnosis, prevention and treatment of diseases and clinical conditions associated with B4GALT3.

Udp-gal:betaglcnac beta 1,4-galactosyltransferase, polypeptide 4 (B4GALT4, Accession NP_003769.1) is another GAM116 target gene, herein designated TARGET GENE. B4GALT4 BINDING SITE is a target binding site found in the 5' untranslated region of mRNA encoded by B4GALT4, corresponding to a target binding site such as BINDING SITE I, BINDING SITE II or BINDING SITE III of FIG. 8. Table 4 illustrates the complementarity of the nucleotide sequences of B4GALT4 BINDING SITE, designated SEQ ID:5385, to the nucleotide sequence of GAM116 RNA, herein designated GAM RNA, also designated SEQ ID:301.

Another function of GAM116 is therefore inhibition of Udp-gal:betaglcnac beta 1,4-galactosyltransferase, polypeptide 4 (B4GALT4, Accession NP_003769.1). Accordingly, utilities of GAM116 include diagnosis, prevention and treatment of diseases and clinical conditions associated with B4GALT4.

B-cell cll/lymphoma 6 (zinc finger protein 51) (BCL6, Accession NP_620309.1) is another GAM116 target gene, herein designated TARGET GENE. BCL6 BINDING SITE is a target binding site found in the 5' untranslated region of multiple transcripts of mRNA encoded by BCL6, corresponding to a target binding site such as BINDING SITE I, BINDING SITE II or BINDING SITE III of FIG. 8. Table 4 illustrates the complementarity of the nucleotide sequences of BCL6 BINDING SITE, designated SEQ ID:14159, to the nucleotide sequence of GAM116 RNA, herein designated GAM RNA, also designated SEQ ID:301.

Another function of GAM116 is therefore inhibition of B-cell cll/lymphoma 6 (zinc finger protein 51) (BCL6, Accession NP_620309.1), a gene which is involved in the generation and maintenance of both T and B cells during immune responses and therefore may be associated with B-cell non-hodgkin lymphoma, diffuse large cell lymphomas and follicular lymphomas. Accordingly, utilities of GAM116 include diagnosis, prevention and treatment of B-cell non-hodgkin lymphoma, diffuse large cell lymphomas and follicular lymphomas, and of other diseases and clinical conditions associated with BCL6.

The function of BCL6 and its association with various diseases and clinical conditions, has been established by previous studies, as described hereinabove with reference to GAM90.1. B-cell cll/lymphoma 6 (zinc finger protein 51) (BCL6, Accession NP_001697.2) is another GAM116 target gene, herein designated TARGET GENE. BCL6 BINDING SITE is a target binding site found in the 5' untranslated region of multiple transcripts of mRNA encoded by BCL6, corresponding to a target binding site such as BINDING SITE I, BINDING SITE II or BINDING SITE III of FIG. 8. Table 4 illustrates the complementarity of the nucleotide sequences of BCL6 BINDING SITE, designated SEQ ID:14159, to the nucleotide sequence of GAM116 RNA, herein designated GAM RNA, also designated SEQ ID:301.

Another function of GAM116 is therefore inhibition of B-cell cll/lymphoma 6 (zinc finger protein 51) (BCL6, Accession NP_001697.2), a gene which is involved in the generation and maintenance of both T and B cells during immune responses and therefore may be associated with B-cell non-hodgkin lymphoma, diffuse large cell lymphomas and follicular lymphomas. Accordingly, utilities of GAM116 include diagnosis, prevention and treatment of B-cell non-hodgkin lymphoma, diffuse large cell lymphomas and follicular lymphomas, and of other diseases and clinical conditions associated with BCL6.

The function of BCL6 and its association with various diseases and clinical conditions, has been established by previous studies, as described hereinabove with reference to GAM90.1. B lymphoma mo-mlv insertion region (mouse) (BMI1, Accession NP_005171.4) is another GAM116 target gene, herein designated TARGET GENE. BMI1 BINDING SITE is a target binding site found in the 3' untranslated region of mRNA encoded by BMI1, corresponding to a target binding site such as BINDING SITE I, BINDING SITE II or BINDING SITE III of FIG. 8. Table 4 illustrates the complementarity of the nucleotide sequences of BMI1 BINDING SITE, designated SEQ ID:5333, to the nucleotide sequence of GAM116 RNA, herein designated GAM RNA, also designated SEQ ID:301.

Another function of GAM116 is therefore inhibition of B lymphoma mo-mlv insertion region (mouse) (BMI1, Accession NP_005171.4). Accordingly, utilities of GAM116 include diagnosis, prevention and treatment of diseases and clinical conditions associated with BMI1.

Btg family, member 2 (BTG2, Accession NP_006754.1) is another GAM116 target gene, herein designated TARGET GENE. BTG2 BINDING SITE is a target binding site found in the 3' untranslated region of mRNA encoded by BTG2, corresponding to a target binding site such as BINDING SITE I, BINDING SITE II or BINDING SITE III of FIG. 8. Table 4 illustrates the complementarity of the nucleotide sequences of BTG2 BINDING SITE, designated SEQ ID:8685, to the nucleotide sequence of GAM116 RNA, herein designated GAM RNA, also designated SEQ ID:301.

Another function of GAM116 is therefore inhibition of Btg family, member 2 (BTG2, Accession NP_006754.1). Accordingly, utilities of GAM116 include diagnosis, prevention and treatment of diseases and clinical conditions associated with BTG2.

C16orf5 (Accession NP_037531.1) is another GAM116 target gene, herein designated TARGET GENE. C16orf5 BINDING SITE is a target binding site found in the 3' untranslated region of mRNA encoded by C16orf5, corresponding to a target binding site such as BINDING SITE I, BINDING SITE II or BINDING SITE III of FIG. 8. Table 4 illustrates the complementarity of the nucleotide sequences of C16orf5 BINDING SITE, designated SEQ ID:20128, to the nucleotide sequence of GAM116 RNA, herein designated GAM RNA, also designated SEQ ID:301.

Another function of GAM116 is therefore inhibition of C16orf5 (Accession NP_037531.1). Accordingly, utilities of GAM116 include diagnosis, prevention and treatment of diseases and clinical conditions associated with C16orf5.

Chromosome 1 open reading frame 9 (C1orf9, Accession NP_055098.1) is another GAM116 target gene, herein designated TARGET GENE. C1orf9 BINDING SITE1 and C1orf9 BINDING SITE2 are target binding sites found in untranslated regions of multiple transcripts of mRNA encoded by C1orf9, corresponding to target binding sites such as BINDING SITE I, BINDING SITE II or BINDING SITE III of FIG. 8. Table 4 illustrates the complementarity of the nucleotide sequences of C1orf9 BINDING SITE1 and C1orf9 BINDING SITE2, designated SEQ ID:15293 and SEQ ID:17492 respectively, to the nucleotide sequence of GAM116 RNA, herein designated GAM RNA, also designated SEQ ID:301.

Another function of GAM116 is therefore inhibition of Chromosome 1 open reading frame 9 (C1orf9, Accession NP_055098.1). Accordingly, utilities of GAM116 include diagnosis, prevention and treatment of diseases and clinical conditions associated with C1orf9.

Chromosome 1 open reading frame 9 (C1orf9, Accession NP_057311.1) is another GAM116 target gene, herein designated TARGET GENE. C1orf9 BINDING SITE1 and C1orf9 BINDING SITE2 are target binding sites found in untranslated regions of multiple transcripts of mRNA encoded by C1orf9, corresponding to target binding sites such as BINDING SITE I, BINDING SITE II or BINDING SITE III of FIG. 8. Table 4 illustrates the complementarity of the nucleotide sequences of C1orf9 BINDING SITE1 and C1orf9 BINDING SITE2, designated SEQ ID:15293 and SEQ ID:15419 respectively, to the nucleotide sequence of GAM116 RNA, herein designated GAM RNA, also designated SEQ ID:301.

Another function of GAM116 is therefore inhibition of Chromosome 1 open reading frame 9 (C1orf9, Accession NP_057311.1). Accordingly, utilities of GAM116 include diagnosis, prevention and treatment of diseases and clinical conditions associated with C1orf9.

Chromosome 21 open reading frame 108 (C21orf108, Accession XP_114191.2) is another GAM116 target gene, herein designated TARGET GENE. C21orf108 BINDING SITE is a target binding site found in the 3' untranslated region of mRNA encoded by C21orf108, corresponding to a target binding site such as BINDING SITE I, BINDING SITE II or BINDING SITE III of FIG. 8. Table 4 illustrates the complementarity of the nucleotide sequences of C21orf108 BINDING SITE, designated SEQ ID:19399, to the nucleotide sequence of GAM116 RNA, herein designated GAM RNA, also designated SEQ ID:301.

Another function of GAM116 is therefore inhibition of Chromosome 21 open reading frame 108 (C21orf108, Accession XP_114191.2). Accordingly, utilities of GAM116 include diagnosis, prevention and treatment of diseases and clinical conditions associated with C21orf108.

C5orf13 (Accession NP_004763.1) is another GAM116 target gene, herein designated TARGET GENE. C5orf13 BINDING SITE is a target binding site found in the 3' untranslated region of mRNA encoded by C5orf13, corresponding to a target binding site such as BINDING SITE I, BINDING SITE II or BINDING SITE III of FIG. 8. Table 4 illustrates the complementarity of the nucleotide sequences of C5orf13 BINDING SITE, designated SEQ ID:900, to the nucleotide sequence of GAM116 RNA, herein designated GAM RNA, also designated SEQ ID:301.

Another function of GAM116 is therefore inhibition of C5orf13 (Accession NP_004763.1). Accordingly, utilities of GAM116 include diagnosis, prevention and treatment of diseases and clinical conditions associated with C5orf13.

CABIN1 (Accession NP_036427.1) is another GAM116 target gene, herein designated TARGET GENE. CABIN1 BINDING SITE is a target binding site found in the 3' untranslated region of mRNA encoded by CABIN1, corresponding to a target binding site such as BINDING SITE I, BINDING SITE II or BINDING SITE III of FIG. 8. Table 4 illustrates the complementarity of the nucleotide sequences of CABIN1 BINDING SITE, designated SEQ ID:16423, to the nucleotide sequence of GAM116 RNA, herein designated GAM RNA, also designated SEQ ID:301.

Another function of GAM116 is therefore inhibition of CABIN1 (Accession NP_036427.1). Accordingly, utilities of GAM116 include diagnosis, prevention and treatment of diseases and clinical conditions associated with CABIN1.

Caspase 8, apoptosis-related cysteine protease (CASP8, Accession NP_203521.1) is another GAM116 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:10011, to the nucleotide sequence of GAM116 RNA, herein designated GAM RNA, also designated SEQ ID:301.

Another function of GAM116 is therefore inhibition of Caspase 8, apoptosis-related cysteine protease (CASP8, Accession NP_203521.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM116 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Cyclin d1 (prad1: parathyroid adenomatosis 1) (CCND1, Accession NP_444284.1) is another GAM116 target gene, herein designated TARGET GENE. CCND1 BINDING SITE is a target binding site found in the 3' untranslated region of mRNA encoded by CCND1, corresponding to a target binding site such as BINDING SITE I, BINDING SITE II or BINDING SITE III of FIG. 8. Table 4 illustrates the complementarity of the nucleotide sequences of CCND1 BINDING SITE, designated SEQ ID:6838, to the nucleotide sequence of GAM116 RNA, herein designated GAM RNA, also designated SEQ ID:301.

Another function of GAM116 is therefore inhibition of Cyclin d1 (prad1: parathyroid adenomatosis 1) (CCND1, Accession NP_444284.1), a gene which is involved in the control of cell cycle and is required for Schwann cell proliferation to proceed normally during Wallerian degeneration. and therefore may be associated with T(11q13)-bearing b-lymphoid and lymphoid tumors. Accordingly, utilities of GAM116 include diagnosis, prevention and treatment of T(11q13)-bearing b-lymphoid and lymphoid tumors, and of other diseases and clinical conditions associated with CCND1.

The function of CCND1 has been established by previous studies. Tsujimoto et al. (1984) cloned the chromosomal breakpoint of chronic lymphocytic leukemia (CLL; OMIM Ref. No. 151400) cells of the B-cell type carrying t(11;14) (q13;q32). The breakpoint was in the joining segment of the heavy chain locus on chromosome 14. A probe that is specific for chromosome 11 and maps immediately 5-prime to the breakpoint on 14q+ was isolated. The probe detected a rearrangement of the homologous genomic DNA segment in CLL cells and in DNA from a diffuse large cell lymphoma with the t(11;14) translocation. This rearranged DNA segment was not present in Burkitt lymphoma cells with the t(8;14) translocation or in nonneoplastic human lymphoblastoid cells. The probe thus can be used to identify and characterize a gene located on 11q13 involved in the malignant transformation of B cells in the t(11;14) translocation. Tsujimoto et al. (1984) referred to this gene as BCL1. In 2 different cases of B-cell chronic lymphatic leukemia, Tsujimoto et al. (1985) found that the breakpoints on chromosome 11 were within 8 nucleotides of each other and on chromosome 14 involved the J4 DNA segment of the Ig heavy chain segment. Because they detected a 7mer-9mer signallike sequence with a 12-base-long spacer on the normal chromosome 11, close to the breakpoint, they speculated that the t(11;14) chromosome translocation in CLL may be sequence specific and may involve the recombination system for immunoglobulin V-D-J gene segment joining.

Animal model experiments lend further support to the function of CCND1. Ma et al. (1998) studied cyclin D1-deficient mice, which have small eyes with thin retinas, and observed that there was a lower level of retinal cell proliferation and a unique pattern of photoreceptor cell death. Death was first observed in scattered clusters of cells in the retina. It then appeared to spread from these few cells to nearby photoreceptors, eventually producing extensive holes in the photoreceptor layer. These holes appeared to be filled with interneurons from the inner nuclear layer. The death occurred mainly during the second to fourth postnatal weeks. Other models of photoreceptor degeneration in rodents differed in that they occur more uniformly across the retina, with death proceeding over a longer period of time until all, or nearly all, of the photoreceptors degenerate. Ma et al. (1998) found that expression of a bcl2 transgene could not prevent the death.

It is appreciated that the abovementioned animal model for CCND1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ma, C.; Papermaster, D.; Cepko, C. L.: A unique pattern of photoreceptor degeneration in cyclin D1 mutant mice. Proc. Nat. Acad. Sci. 95:9938-9943, 1998; and Tsujimoto, Y.; Yunis, J.; Onorato - Showe, L.; Erikson, J.; Nowell, P. C.; Croce, C. M.: Molecular cloning of the chromosomal breakpoint of B-cell lymphomas and leukemias with the t(11;1.

Further studies establishing the function and utilities of CCND1 are found in John Hopkins OMIM database record ID 168461, and in cited publications listed in Table 5, which are hereby incorporated by reference. Cerebellar degeneration-related protein 2, 62 kda (CDR2, Accession XP_071866.2) is another GAM116 target gene, herein designated TARGET GENE. CDR2 BINDING SITE is a target binding site found in the 3' untranslated region of mRNA encoded by CDR2, corresponding to a target binding site such as BINDING SITE I, BINDING SITE II or BINDING SITE III of FIG. 8. Table 4 illustrates the complementarity of the nucleotide sequences of CDR2 BINDING SITE, designated SEQ ID:5603, to the nucleotide sequence of GAM116 RNA, herein designated GAM RNA, also designated SEQ ID:301.

Another function of GAM116 is therefore inhibition of Cerebellar degeneration-related protein 2, 62 kda (CDR2, Accession XP_071866.2), a gene which plays a role in cytokinesis, cell shape, and functions such as secretion and capping. and therefore may be associated with Paraneoplastic cerebellar degeneration. Accordingly, utilities of GAM116 include diagnosis, prevention and treatment of Paraneoplastic cerebellar degeneration, and of other diseases and clinical conditions associated with CDR2.

The function of CDR2 and its association with various diseases and clinical conditions, has been established by previous studies, as described hereinabove with reference to GAM42.1. Centaurin, delta 1 (CENTD1, Accession NP_056045.2) is another GAM116 target gene, herein designated TARGET GENE. CENTD1 BINDING SITE is a target binding site found in the 5' untranslated region of multiple transcripts of mRNA encoded by CENTD1, corresponding to a target binding site such as BINDING SITE I, BINDING SITE II or BINDING SITE III of FIG. 8. Table 4 illustrates the complementarity of the nucleotide sequences of CENTD1 BINDING SITE, designated SEQ ID:10052, to the nucleotide sequence of GAM116 RNA, herein designated GAM RNA, also designated SEQ ID:301.

Another function of GAM116 is therefore inhibition of Centaurin, delta 1 (CENTD1, Accession NP_056045.2), a gene which is nvolved in cell signaling/communication. Accordingly, utilities of GAM116 include diagnosis, prevention and treatment of diseases and clinical conditions associated with CENTD1.

The function of CENTD1 has been established by previous studies. By screening brain cDNAs for the potential to encode proteins that are at least 50 kD, Nagase et al. (1998) identified a partial cDNA encoding CENTD1, which they called KIAA0580. The protein was predicted to be involved in cell signaling/communication. RT-PCR analysis detected expression of KIAA0580 in all tissues tested except skeletal muscle. By searching sequence databases, followed by 5-prime RACE, Miura et al. (2002) obtained full-length cDNAs encoding CENTD1 and CENTD2 (OMIM Ref. No. 606646), which they called ARAP2 and ARAP1, respectively. Like ARAP1, the 1,704-amino acid ARAP2 protein contains ARF-GAP (see OMIM Ref. No. 103180), RHO-GAP (see OMIM Ref. No. 602732), ankyrin repeat (see OMIM Ref. No. 605787), RAS (OMIM Ref. No. 190020)-associating, and 5 pleckstrin (OMIM Ref. No. 173570) homology (PH) domains. However, unlike ARAP1, ARAP2 also has a sterile alpha motif (SAM) domain like that found in EphA receptor (see OMIM Ref. No. 179610) and a region of homology to the switch-2 domain of RAB13 (OMIM Ref. No. 602672). The RHO-GAP domain of ARAP2 lacks the predicted catalytic arginine and is therefore unlikely to have RHO-GAP activity. Northern blot analysis showed that ARAP2 is much more variably expressed than ARAP1. The highest ARAP2 expression levels were in brain, thymus, spleen, kidney, peripheral blood leukocytes, lymph node, spinal cord, and thyroid. Two messages at 7.5 and 11 kb were found in brain, and 7.5- and 8.5-kb messages were found in thymus, spleen, kidney, peripheral blood leukocytes, and lymph node. Of the hematopoietic tissues examined, only bone marrow did not show ARAP2 expression.

Full details of the abovementioned studies are described in the following publications, the disclosure of which are hereby incorporated by reference:

Miura, K.; Jacques, K. M.; Stauffer, S.; Kubosaki, A.; Zhu, K.; Hirsch, D. S.; Resau, J.; Zheng, Y.; Randazzo, P. A.: ARAP1: a point of convergence for Arf and Rho signaling. Molec. Cell 9:109-119, 2002; and Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 10.

Further studies establishing the function and utilities of CENTD1 are found in John Hopkins OMIM database record ID 606645, and in cited publications listed in Table 5, which are hereby incorporated by reference. Chromodomain helicase dna binding protein 3 (CHD3, Accession NP_001263.1) is another GAM116 target gene, herein designated TARGET GENE. CHD3 BINDING SITE is a target binding site found in the 3' untranslated region of mRNA encoded by CHD3, corresponding to a target binding site such as BINDING SITE I, BINDING SITE II or BINDING SITE III of FIG. 8. Table 4 illustrates the complementarity of the nucleotide sequences of CHD3 BINDING SITE, designated SEQ ID:773, to the nucleotide sequence of GAM116 RNA, herein designated GAM RNA, also designated SEQ ID:301.

Another function of GAM116 is therefore inhibition of Chromodomain helicase dna binding protein 3 (CHD3, Accession NP_001263.1), a gene which may regulate gene expression and chromatin structure. and therefore may be associated with Dermatomyositis. Accordingly, utilities of GAM116 include diagnosis, prevention and treatment of Dermatomyositis, and of other diseases and clinical conditions associated with CHD3.

The function of CHD3 has been established by previous studies. Anti-Mi2 autoantibody is strongly associated with dermatomyositis and is found in sera of 20% of dermatomyositis patients. Mi2 antigen consists of at least 8 components. By immunoscreening human thymocyte and HeLa cell cDNA expression libraries with anti-Mi2 patient sera, Ge et al. (1995) isolated a partial cDNA encoding Mi2-alpha, or CHD3. The deduced partial protein contains 4 potential zinc finger domains. Antibodies against recombinant Mi2-alpha reacted with a 240-kD HeLa cell protein. Northern blot analysis detected a single 7.5- to 8.0-kb Mi2-alpha transcript in HeLa cells. Seelig et al. (1996) noted that the Mi2-alpha and Mi2-beta (CHD4; 603277) proteins react with most or all dermatomyositis patient anti-Mi2 sera. While these proteins are distinct, they have stretches of identical sequence that could result in shared epitopes.

Full details of the abovementioned studies are described in the following publications, the disclosure of which are hereby incorporated by reference:

Ge, Q.; Nilasena, D. S.; O'Brien, C. A.; Frank, M. B.; Targoff, I. N.: Molecular analysis of a major antigenic region of the 240-kD protein of Mi-2 autoantigen. J. Clin. Invest. 96:1730-1737, 1995; and Seelig, H. P.; Renz, M.; Targoff, I. N.; Ge, Q.; Frank, M. B.: Two forms of the major antigenic protein of the dermatomyositis-specific Mi-2 autoantigen. (Letter) Arthritis Rheum. 39.

Further studies establishing the function and utilities of CHD3 are found in John Hopkins OMIM database record ID 602120, and in cited publications listed in Table 5, which are hereby incorporated by reference. CIDE-3 (Accession NP_071377.2) is another GAM116 target gene, herein designated TARGET GENE. CIDE-3 BINDING SITE is a target binding site found in the 5' untranslated region of mRNA encoded by CIDE-3, corresponding to a target binding site such as BINDING SITE I, BINDING SITE II or BINDING SITE III of FIG. 8. Table 4 illustrates the complementarity of the nucleotide sequences of CIDE-3 BINDING SITE, designated SEQ ID:19483, to the nucleotide sequence of GAM116 RNA, herein designated GAM RNA, also designated SEQ ID:301.

Another function of GAM116 is therefore inhibition of CIDE-3 (Accession NP_071377.2). Accordingly, utilities of GAM116 include diagnosis, prevention and treatment of diseases and clinical conditions associated with CIDE-3.

Collagen, type x, alpha 1(schmid metaphyseal chondrodysplasia) (COL10A1, Accession NP_000484.2) is another GAM116 target gene, herein designated TARGET GENE. COL10A1 BINDING SITE is a target binding site found in the 3' untranslated region of mRNA encoded by COL10A1, corresponding to a target binding site such as BINDING SITE I, BINDING SITE II or BINDING SITE III of FIG. 8. Table 4 illustrates the complementarity of the nucleotide sequences of COL10A1 BINDING SITE, designated SEQ ID:5855, to the nucleotide sequence of GAM116 RNA, herein designated GAM RNA, also designated SEQ ID:301.

Another function of GAM116 is therefore inhibition of Collagen, type x, alpha 1(schmid metaphyseal chondrodysplasia) (COL10A1, Accession NP_000484.2). Accordingly, utilities of GAM116 include diagnosis, prevention and treatment of diseases and clinical conditions associated with COL10A1.

Collagen, type xi, alpha 2 (COL11A2, Accession NP_542411.1) is another GAM116 target gene, herein designated TARGET GENE. COL11A2 BINDING SITE is a target binding site found in the 3' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:14857, to the nucleotide sequence of GAM116 RNA, herein designated GAM RNA, also designated SEQ ID:301.

Another function of GAM116 is therefore inhibition of Collagen, type xi, alpha 2 (COL11A2, Accession NP_542411.1). Accordingly, utilities of GAM116 include diagnosis, prevention and treatment of diseases and clinical conditions associated with COL11A2.

Collagen, type xi, alpha 2 (COL11A2, Accession NP_542412.1) is another GAM116 target gene, herein designated TARGET GENE. COL11A2 BINDING SITE is a target binding site found in the 3' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:14857, to the nucleotide sequence of GAM116 RNA, herein designated GAM RNA, also designated SEQ ID:301.

Another function of GAM116 is therefore inhibition of Collagen, type xi, alpha 2 (COL11A2, Accession NP_542412.1). Accordingly, utilities of GAM116 include diagnosis, prevention and treatment of diseases and clinical conditions associated with COL11A2.

Collagen, type xi, alpha 2 (COL11A2, Accession NP_542410.1) is another GAM116 target gene, herein designated TARGET GENE. COL11A2 BINDING SITE is a target binding site found in the 3' untranslated region of multiple transcripts of mRNA encoded by COL11A2, corresponding to a target binding site such as BINDING SITE I, BINDING SITE II or BINDING SITE III of FIG. 8. Table 4 illustrates the complementarity of the nucleotide sequences of COL11A2 BINDING SITE, designated SEQ ID:14857, to the nucleotide sequence of GAM116 RNA, herein designated GAM RNA, also designated SEQ ID:301.

Another function of GAM116 is therefore inhibition of Collagen, type xi, alpha 2 (COL11A2, Accession NP_542410.1). Accordingly, utilities of GAM116 include diagnosis, prevention and treatment of diseases and clinical conditions associated with COL11A2.

Collagen, type xxi, alpha 1 (COL21A1, Accession NP_110447.2) is another GAM116 target gene, herein designated TARGET GENE. COL21A1 BINDING SITE is a target binding site found in the 3' untranslated region of mRNA encoded by COL21A1, corresponding to a target binding site such as BINDING SITE I, BINDING SITE II or BINDING SITE III of FIG. 8. Table 4 illustrates the complementarity of the nucleotide sequences of COL21A1 BINDING SITE, designated SEQ ID:7623, to the nucleotide sequence of GAM116 RNA, herein designated GAM RNA, also designated SEQ ID:301.

Another function of GAM116 is therefore inhibition of Collagen, type xxi, alpha 1 (COL21A1, Accession NP_110447.2). Accordingly, utilities of GAM116 include diagnosis, prevention and treatment of diseases and clinical conditions associated with COL21A1.

Complexin 1 (CPLX1, Accession NP_006642.1) is another GAM116 target gene, herein designated TARGET GENE. CPLX1 BINDING SITE is a target binding site found in the 5' untranslated region of mRNA encoded by CPLX1, corresponding to a target binding site such as BINDING SITE I, BINDING SITE II or BINDING SITE III of FIG. 8. Table 4 illustrates the complementarity of the nucleotide sequences of CPLX1 BINDING SITE, designated SEQ ID:3486, to the nucleotide sequence of GAM116 RNA, herein designated GAM RNA, also designated SEQ ID:301.

Another function of GAM116 is therefore inhibition of Complexin 1 (CPLX1, Accession NP_006642.1). Accordingly, utilities of GAM116 include diagnosis, prevention and treatment of diseases and clinical conditions associated with CPLX1.

Cytochrome p450, subfamily i (dioxin-inducible), polypeptide 1 (glaucoma 3, primary infantile) (CYP1B1, Accession NP_000095.1) is another GAM116 target gene, herein designated TARGET GENE. CYP1B1 BINDING SITE is a target binding site found in the 3' untranslated region of mRNA encoded by CYP1B1, corresponding to a target binding site such as BINDING SITE I, BINDING SITE II or BINDING SITE III of FIG. 8. Table 4 illustrates the complementarity of the nucleotide sequences of CYP1B1 BINDING SITE, designated SEQ ID:11514, to the nucleotide sequence of GAM116 RNA, herein designated GAM RNA, also designated SEQ ID:301.

Another function of GAM116 is therefore inhibition of Cytochrome p450, subfamily i (dioxin-inducible), polypeptide 1 (glaucoma 3, primary infantile) (CYP1B1, Accession NP_000095.1), a gene which participates in the metabolism of a molecule that is a participant in eye development. and therefore is associated with Glaucoma, primary congenital, peters anomaly. Accordingly, utilities of GAM116 include diagnosis, prevention and treatment of Glaucoma, primary congenital, peters anomaly, and of other diseases and clinical conditions associated with CYP1B1.

The function of CYP1B1 has been established by previous studies. In the study of candidate genes identified in the critical region of 2p21 where a major gene for primary congenital glaucoma, GLC3A (OMIM Ref. No. 231300), had been mapped by linkage studies, Stoilov et al. (1997) found the CYP1B1 gene, which had previously been identified by Sutter et al. (1994). From a determination of the intron/exon junctions of this gene, Stoilov et al. (1997) concluded that the gene contains 3 exons and 2 introns. The entire coding sequence of the genes is contained in exons 2 and 3. This genomic structure agreed with that reported by Tang et al. (1996). Screening for the presence of coding sequence changes in the CYP1B1 gene, Stoilov et al. (1997) identified 3 different truncating mutations: a 13-bp deletion found in 1 consanguineous and 1 nonconsanguineous family (601771.0001); a single cytosine insertion observed in another 2 consanguineous families (601771.0002); and a large deletion found in an additional consanguineous family. In addition, a G- to - C transversion at nucleotide 1640 of the CYP1B1 coding sequence was found that caused a val432- to - leu amino acid substitution. This change created an EcoR57 restriction site, thus providing a rapid screening method. Heterozygosity for the val432- to - leu change was found in 51.4% of 70 normal individuals. This amino acid change was not in that part of CYP1B1 that represented conserved sequences, and both valine and leucine are neutral and hydrophobic. Their very similar aliphatic side groups differ by a single -CH2 group. Therefore, this change appeared to represent a common amino acid polymorphism that is not related to the primary congenital glaucoma phenotype. Identification of CYP1B1 as the gene affected in primary congenital glaucoma was said by Stoilov et al. (1997) to be the first example in which mutations in a member of the cytochrome P450 superfamily results in a primary developmental defect. The finding was not unexpected, however, as a link between members of this superfamily and the processes of growth and differentiation had been postulated previously. They speculated that CYP1B1 participates in the metabolism of an as-yet-unknown biologically active molecule that is a participant in eye development. Stoilov et al. (1997) demonstrated that a stable protein product is produced in the affected subjects of these families, and that the 3 mutations they described would be expected to result in a product lacking between 189 and 254 amino acids from the C terminus. This segment harbors the invariant cysteine of all known cytochrome P450 amino sequences; in CYP1B1 it is cys470. Schwartzman et al. (1987) implicated a cytochrome-P450-dependent arachidonate metabolite that inhibits Na+,K+-ATPase in the cornea in regulating corneal transparency and aqueous humor secretion. This finding is consistent with the clouding of the cornea and increased intraocular pressure, the 2 major diagnostic criteria for primary congenital glaucoma.

Full details of the abovementioned studies are described in the following publications, the disclosure of which are hereby incorporated by reference:

Bejjani, B. A.; Lewis, R. A.; Tomey, K. F.; Anderson, K. L.; Dueker, D. K.; Jabak, M.; Astle, W. F.; Otterud, B.; Leppert, M.; Lupski, J. R.: Mutations in CYP1B1, the gene for cytochrome P4501B1, are the predominant cause of primary congenital glaucoma in Saudi Arabia. Am. J. Hum. Genet. 62:325-333, 1998; and Stoilov, I.; Akarsu, A. N.; Alozie, I.; Child, A.; Barsoum-Homsy, M.; Turacli, M. E.; Or, M.; Lewis, R. A.; Ozdemir, N.; Brice, G.; Aktan, S. G.; Chevrette, L.; Coca- Prados, M.; Sarfara.

Further studies establishing the function and utilities of CYP1B1 are found in John Hopkins OMIM database record ID 601771, and in cited publications listed in Table 5, which are hereby incorporated by reference. Dynactin 4 (p62) (DCTN4, Accession NP_057305.1) is another GAM116 target gene, herein designated TARGET GENE. DCTN4 BINDING SITE is a target binding site found in the 3' untranslated region of mRNA encoded by DCTN4, corresponding to a target binding site such as BINDING SITE I, BINDING SITE II or BINDING SITE III of FIG. 8. Table 4 illustrates the complementarity of the nucleotide sequences of DCTN4 BINDING SITE, designated SEQ ID:7697, to the nucleotide sequence of GAM116 RNA, herein designated GAM RNA, also designated SEQ ID:301.

Another function of GAM116 is therefore inhibition of Dynactin 4 (p62) (DCTN4, Accession NP_057305.1). Accordingly, utilities of GAM116 include diagnosis, prevention and treatment of diseases and clinical conditions associated with DCTN4.

Disrupted in schizophrenia 1 (DISC1, Accession NP_061132.1) is another GAM116 target gene, herein designated TARGET GENE. DISC1 BINDING SITE is a target binding site found in the 3' untranslated region of mRNA encoded by DISC1, corresponding to a target binding site such as BINDING SITE I, BINDING SITE II or BINDING SITE III of FIG. 8. Table 4 illustrates the complementarity of the nucleotide sequences of DISC1 BINDING SITE, designated SEQ ID:6142, to the nucleotide sequence of GAM116 RNA, herein designated GAM RNA, also designated SEQ ID:301.

Another function of GAM116 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM116 include diagnosis, prevention and treatment of Schizophrenia, and of other diseases and clinical conditions associated with DISC1.

The function of DISC1 has been established by previous studies. Millar et al. (2000) isolated and sequenced the breakpoints on chromosomes 1 and 11 in the Scottish family carrying the translocation, and by sequence analysis concluded that no genes were within the region surrounding the chromosome 11 breakpoint. The authors found that, by contrast, the corresponding region on chromosome 1 was gene-dense and that not 1, but 2, novel genes were directly disrupted by the translocation. They named these genes 'disrupted in schizophrenia' 1 and 2 (DISC1 and DISC2, 606271). The major DISC1 transcript is approximately 7.5 kb, contains an open reading frame encoding 854 amino acids, and is ubiquitously expressed. The protein is predicted to consist of a globular N-terminal domain(s) and helical C-terminal domain that has the potential to form a coiled-coil by interaction with another protein(s). Similar structures are thought to be present in a variety of unrelated proteins that are known to function in the nervous system. The putative structure of the protein encoded by DISC1 is therefore compatible with a role in the nervous system. DISC2 apparently specifies a single exon thought to be a noncoding RNA molecule that is antisense to DISC1, an arrangement that has been observed at other loci where the antisense RNA may regulate expression of the sense gene. The authors concluded that DISC1 and DISC2 should be considered formal candidate genes for susceptibility to psychiatric illness. The family studied by St. Clair et al. (1990) and Millar et al. (2000) was originally ascertained by Jacobs et al. (1970), who reported the translocation in the propositus, who had adolescent conduct disorder, and in members of 4 generations of the extended family. Blackwood et al. (2001) provided a follow-up. Of the 87 members of the family who were karyotyped, 37 carried the translocation. A psychiatric diagnosis was reached in 29 carriers, 38 noncarriers, and the 2 founders (who were not karyotyped). The range of symptoms in this family crossed traditional diagnostic boundaries, and the locus identified by the breakpoint on 1q42 appeared to be implicated in either schizophrenia or bipolar disorder. Furthermore, Blackwood (2000) reported abnormalities in the auditory P300 event-related potential, which showed prolonged latency and reduced amplitude in affected members of the family.

Full details of the abovementioned studies are described in the following publications, the disclosure of which are hereby incorporated by reference:

Blackwood, D. H. R.; Fordyce, A.; Walker, M. T.; St. Clair, D. M.; Porteous, D. J.; Muir, W. J.: Schizophrenia and affective disorders-cosegretation with a translocation at chromosome 1q42 that directly disrupts brain-expressed genes: clinical and P300 findings in a family. Am. J. Hum. Genet. 69:428-433, 2001; and Ekelund, J.; Hovatta, I.; Parker, A.; Paunio, T.; Varilo, T.; Martin, R.; Suhonen, J.; Ellonen, P.; Chan, G.; Sinsheimer, J. S.; Sobel, E.; Juvonen, H.; Arajarvi, R.; Partonen, T.; Suv.

Further studies establishing the function and utilities of DISC1 are found in John Hopkins OMIM database record ID 605210, and in cited publications listed in Table 5, which are hereby incorporated by reference. DKFZP434J046 (Accession NP_056486.1) is another GAM116 target gene, herein designated TARGET GENE. DKFZP434J046 BINDING SITE is a target binding site found in the 5' untranslated region of mRNA encoded by DKFZP434J046, corresponding to a target binding site such as BINDING SITE I, BINDING SITE II or BINDING SITE III of FIG. 8. Table 4 illustrates the complementarity of the nucleotide sequences of DKFZP434J046 BINDING SITE, designated SEQ ID:4305, to the nucleotide sequence of GAM116 RNA, herein designated GAM RNA, also designated SEQ ID:301.

Another function of GAM116 is therefore inhibition of DKFZP434J046 (Accession NP_056486.1). Accordingly, utilities of GAM116 include diagnosis, prevention and treatment of diseases and clinical conditions associated with DKFZP434J046.

DKFZP564K0822 (Accession NP_110423.2) is another GAM116 target gene, herein designated TARGET GENE. DKFZP564K0822 BINDING SITE is a target binding site found in the 3' untranslated region of mRNA encoded by DKFZP564K0822, corresponding to a target binding site such as BINDING SITE I, BINDING SITE II or BINDING SITE III of FIG. 8. Table 4 illustrates the complementarity of the nucleotide sequences of DKFZP564K0822 BINDING SITE, designated SEQ ID:8390, to the nucleotide sequence of GAM116 RNA, herein designated GAM RNA, also designated SEQ ID:301.

Another function of GAM116 is therefore inhibition of DKFZP564K0822 (Accession NP_110423.2). Accordingly, utilities of GAM116 include diagnosis, prevention and treatment of diseases and clinical conditions associated with DKFZP564K0822.

DKFZp761B128 (Accession NP_689650.1) is another GAM116 target gene, herein designated TARGET GENE. DKFZp761B128 BINDING SITE is a target binding site found in the 5' untranslated region of mRNA encoded by DKFZp761B128, corresponding to a target binding site such as BINDING SITE I, BINDING SITE II or BINDING SITE III of FIG. 8. Table 4 illustrates the complementarity of the nucleotide sequences of DKFZp761B128 BINDING SITE, designated SEQ ID:19522, to the nucleotide sequence of GAM116 RNA, herein designated GAM RNA, also designated SEQ ID:301.

Another function of GAM116 is therefore inhibition of DKFZp761B128 (Accession NP_689650.1). Accordingly, utilities of GAM116 include diagnosis, prevention and treatment of diseases and clinical conditions associated with DKFZp761B128.

DKFZp761G0122 (Accession NP_689874.1) is another GAM116 target gene, herein designated TARGET GENE. DKFZp761G0122 BINDING SITE is a target binding site found in the 3' untranslated region of mRNA encoded by DKFZp761G0122, corresponding to a target binding site such as BINDING SITE I, BINDING SITE II or BINDING SITE III of FIG. 8. Table 4 illustrates the complementarity of the nucleotide sequences of DKFZp761G0122 BINDING SITE, designated SEQ ID:9943, to the nucleotide sequence of GAM116 RNA, herein designated GAM RNA, also designated SEQ ID:301.

Another function of GAM116 is therefore inhibition of DKFZp761G0122 (Accession NP_689874.1). Accordingly, utilities of GAM116 include diagnosis, prevention and treatment of diseases and clinical conditions associated with DKFZp761G0122.

Dickkopf homolog 2 (xenopus laevis) (DKK2, Accession NP_055236.1) is another GAM116 target gene, herein designated TARGET GENE. DKK2 BINDING SITE is a target binding site found in the 5' untranslated region of mRNA encoded by DKK2, corresponding to a target binding site such as BINDING SITE I, BINDING SITE II or BINDING SITE III of FIG. 8. Table 4 illustrates the complementarity of the nucleotide sequences of DKK2 BINDING SITE, designated SEQ ID:10328, to the nucleotide sequence of GAM116 RNA, herein designated GAM RNA, also designated SEQ ID:301.

Another function of GAM116 is therefore inhibition of Dickkopf homolog 2 (xenopus laevis) (DKK2, Accession NP_055236.1). Accordingly, utilities of GAM116 include diagnosis, prevention and treatment of diseases and clinical conditions associated with DKK2.

Dihydrolipoamide s-acetyltransferase (e2 component of pyruvate dehydrogenase complex) (DLAT, Accession NP_001922.2) is another GAM116 target gene, herein designated TARGET GENE. DLAT BINDING SITE is a target binding site found in the 3' untranslated region of mRNA encoded by DLAT, corresponding to a target binding site such as BINDING SITE I, BINDING SITE II or BINDING SITE III of FIG. 8. Table 4 illustrates the complementarity of the nucleotide sequences of DLAT BINDING SITE, designated SEQ ID:16982, to the nucleotide sequence of GAM116 RNA, herein designated GAM RNA, also designated SEQ ID:301.

Another function of GAM116 is therefore inhibition of Dihydrolipoamide s-acetyltransferase (e2 component of pyruvate dehydrogenase complex) (DLAT, Accession NP_001922.2). Accordingly, utilities of GAM116 include diagnosis, prevention and treatment of diseases and clinical conditions associated with DLAT.

DOT1L (Accession NP_115871.1) is another GAM116 target gene, herein designated TARGET GENE. DOT1L BINDING SITE is a target binding site found in the 3' untranslated region of mRNA encoded by DOT1L, corresponding to a target binding site such as BINDING SITE I, BINDING SITE II or BINDING SITE III of FIG. 8. Table 4 illustrates the complementarity of the nucleotide sequences of DOT1L BINDING SITE, designated SEQ ID:5058, to the nucleotide sequence of GAM116 RNA, herein designated GAM RNA, also designated SEQ ID:301.

Another function of GAM116 is therefore inhibition of DOT1L (Accession NP_115871.1). Accordingly, utilities of GAM116 include diagnosis, prevention and treatment of diseases and clinical conditions associated with DOT1L.

DRIL2 (Accession NP_006456.1) is another GAM116 target gene, herein designated TARGET GENE. DRIL2 BINDING SITE is a target binding site found in the 3' untranslated region of mRNA encoded by DRIL2, corresponding to a target binding site such as BINDING SITE I, BINDING SITE II or BINDING SITE III of FIG. 8. Table 4 illustrates the complementarity of the nucleotide sequences of DRIL2 BINDING SITE, designated SEQ ID:4242, to the nucleotide sequence of GAM116 RNA, herein designated GAM RNA, also designated SEQ ID:301.

Another function of GAM116 is therefore inhibition of DRIL2 (Accession NP_006456.1). Accordingly, utilities of GAM116 include diagnosis, prevention and treatment of diseases and clinical conditions associated with DRIL2.

Down syndrome critical region gene 3 (DSCR3, Accession NP_006043.1) is another GAM116 target gene, herein designated TARGET GENE. DSCR3 BINDING SITE is a target binding site found in the 3' untranslated region of mRNA encoded by DSCR3, corresponding to a target binding site such as BINDING SITE I, BINDING SITE II or BINDING SITE III of FIG. 8. Table 4 illustrates the complementarity of the nucleotide sequences of DSCR3 BINDING SITE, designated SEQ ID:16394, to the nucleotide sequence of GAM116 RNA, herein designated GAM RNA, also designated SEQ ID:301.

Another function of GAM116 is therefore inhibition of Down syndrome critical region gene 3 (DSCR3, Accession NP_006043.1). Accordingly, utilities of GAM116 include diagnosis, prevention and treatment of diseases and clinical conditions associated with DSCR3.

Eyes absent homolog 1 (drosophila) (EYA1, Accession NP_742055.1) is another GAM116 target gene, herein designated TARGET GENE. EYA1 BINDING SITE is a target binding site found in the 3' untranslated region of multiple transcripts of mRNA encoded by EYA1, corresponding to a target binding site such as BINDING SITE I, BINDING SITE II or BINDING SITE III of FIG. 8. Table 4 illustrates the complementarity of the nucleotide sequences of EYA1

BINDING SITE, designated SEQ ID:8370, to the nucleotide sequence of GAM116 RNA, herein designated GAM RNA, also designated SEQ ID:301.

Another function of GAM116 is therefore inhibition of Eyes absent homolog 1 (drosophila) (EYA1, Accession NP_742055.1). Accordingly, utilities of GAM116 include diagnosis, prevention and treatment of diseases and clinical conditions associated with EYA1.

Eyes absent homolog 1 (drosophila) (EYA1, Accession NP_000494.2) is another GAM116 target gene, herein designated TARGET GENE. EYA1 BINDING SITE is a target binding site found in the 3' untranslated region of multiple transcripts of mRNA encoded by EYA1, corresponding to a target binding site such as BINDING SITE I, BINDING SITE II or BINDING SITE III of FIG. 8. Table 4 illustrates the complementarity of the nucleotide sequences of EYA1 BINDING SITE, designated SEQ ID:8370, to the nucleotide sequence of GAM116 RNA, herein designated GAM RNA, also designated SEQ ID:301.

Another function of GAM116 is therefore inhibition of Eyes absent homolog 1 (drosophila) (EYA1, Accession NP_000494.2). Accordingly, utilities of GAM116 include diagnosis, prevention and treatment of diseases and clinical conditions associated with EYA1.

Eyes absent homolog 1 (drosophila) (EYA1, Accession NP_742057.1) is another GAM116 target gene, herein designated TARGET GENE. EYA1 BINDING SITE is a target binding site found in the 3' untranslated region of multiple transcripts of mRNA encoded by EYA1, corresponding to a target binding site such as BINDING SITE I, BINDING SITE II or BINDING SITE III of FIG. 8. Table 4 illustrates the complementarity of the nucleotide sequences of EYA1 BINDING SITE, designated SEQ ID:8370, to the nucleotide sequence of GAM116 RNA, herein designated GAM RNA, also designated SEQ ID:301.

Another function of GAM116 is therefore inhibition of Eyes absent homolog 1 (drosophila) (EYA1, Accession NP_742057.1). Accordingly, utilities of GAM116 include diagnosis, prevention and treatment of diseases and clinical conditions associated with EYA1.

Eyes absent homolog 1 (drosophila) (EYA1, Accession NP_742056.1) is another GAM116 target gene, herein designated TARGET GENE. EYA1 BINDING SITE is a target binding site found in the 3' untranslated region of multiple transcripts of mRNA encoded by EYA1, corresponding to a target binding site such as BINDING SITE I, BINDING SITE II or BINDING SITE III of FIG. 8. Table 4 illustrates the complementarity of the nucleotide sequences of EYA1 BINDING SITE, designated SEQ ID:8370, to the nucleotide sequence of GAM116 RNA, herein designated GAM RNA, also designated SEQ ID:301.

Another function of GAM116 is therefore inhibition of Eyes absent homolog 1 (drosophila) (EYA1, Accession NP_742056.1). Accordingly, utilities of GAM116 include diagnosis, prevention and treatment of diseases and clinical conditions associated with EYA1.

Coagulation factor ii (thrombin) receptor-like 3 (F2RL3, Accession NP_003941.1) is another GAM116 target gene, herein designated TARGET GENE. F2RL3 BINDING SITE is a target binding site found in the 3' untranslated region of mRNA encoded by F2RL3, corresponding to a target binding site such as BINDING SITE I, BINDING SITE II or BINDING SITE III of FIG. 8. Table 4 illustrates the complementarity of the nucleotide sequences of F2RL3 BINDING SITE, designated SEQ ID:4749, to the nucleotide sequence of GAM116 RNA, herein designated GAM RNA, also designated SEQ ID:301.

Another function of GAM116 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM116 include diagnosis, prevention and treatment of diseases and clinical conditions associated with F2RL3.

The function of F2RL3 and its association with various diseases and clinical conditions, has been established by previous studies, as described hereinabove with reference to GAM72.1. F-box only protein 7 (FBXO7, Accession NP_036311.2) is another GAM116 target gene, herein designated TARGET GENE. FBXO7 BINDING SITE is a target binding site found in the 5' untranslated region of mRNA encoded by FBXO7, corresponding to a target binding site such as BINDING SITE I, BINDING SITE II or BINDING SITE III of FIG. 8. Table 4 illustrates the complementarity of the nucleotide sequences of FBXO7 BINDING SITE, designated SEQ ID:10093, to the nucleotide sequence of GAM116 RNA, herein designated GAM RNA, also designated SEQ ID:301.

Another function of GAM116 is therefore inhibition of F-box only protein 7 (FBXO7, Accession NP_036311.2), a gene which Fubunit of the SCF ubiquitin protein ligase complex, recruits substrates to ubiquitin conjugating enzymes. Accordingly, utilities of GAM116 include diagnosis, prevention and treatment of diseases and clinical conditions associated with FBXO7.

The function of FBXO7 has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). Using RT-PCR analysis, Winston et al. (1999) found high expression of FBXO7 in brain, heart, kidney, liver, lung, skeletal muscle, and placenta, with lower levels in pancreas.

Full details of the abovementioned studies are described in the following publications, the disclosure of which are hereby incorporated by reference:

Ilyin, G. P.; Rialland, M.; Pigeon, C.; Guguen-Guillouzo, C.: cDNA cloning and expression analysis of new members of the mammalian F-box protein family. Genomics 67:40-47, 2000; and Winston, J. T.; Koepp, D. M.; Zhu, C.; Elledge, S. J.; Harper, J. W.: A family of mammalian F-box proteins. Curr. Biol. 9:1180-1182, 1999.

Further studies establishing the function and utilities of FBXO7 are found in John Hopkins OMIM database record ID 605648, and in cited publications listed in Table 5, which are hereby incorporated by reference. FLJ10035 (Accession NP_060444.1) is another GAM116 target gene, herein designated TARGET GENE. FLJ10035 BINDING SITE is a target binding site found in the 3' untranslated region of multiple transcripts of mRNA encoded by FLJ10035, corresponding to a target binding site such as BINDING SITE I, BINDING SITE II or BINDING SITE III of FIG. 8. Table 4 illustrates the complementarity of the nucleotide sequences of FLJ10035 BINDING SITE, designated SEQ ID:12536, to the nucleotide sequence of GAM116 RNA, herein designated GAM RNA, also designated SEQ ID:301.

Another function of GAM116 is therefore inhibition of FLJ10035 (Accession NP_060444.1). Accordingly, utilities of GAM116 include diagnosis, prevention and treatment of diseases and clinical conditions associated with FLJ10035.

FLJ11149 (Accession NP_060809.2) is another GAM116 target gene, herein designated TARGET GENE. FLJ11149 BINDING SITE is a target binding site found in the 3' untranslated region of mRNA encoded by FLJ11149, corresponding to a target binding site such as BINDING SITE I, BINDING SITE II or BINDING SITE III of FIG. 8. Table 4 illustrates the complementarity of the nucleotide sequences of FLJ11149 BINDING SITE, designated SEQ ID:14300, to the nucleotide sequence of GAM116 RNA, herein designated GAM RNA, also designated SEQ ID:301.

Another function of GAM116 is therefore inhibition of FLJ11149 (Accession NP_060809.2). Accordingly, utilities of GAM116 include diagnosis, prevention and treatment of diseases and clinical conditions associated with FLJ11149.

FLJ11155 (Accession NP_060812.1) is another GAM116 target gene, herein designated TARGET GENE. FLJ11155 BINDING SITE is a target binding site found in the 3' untranslated region of mRNA encoded by FLJ11155, corresponding to a target binding site such as BINDING SITE I, BINDING SITE II or BINDING SITE III of FIG. 8. Table 4 illustrates the complementarity of the nucleotide sequences of FLJ11155 BINDING SITE, designated SEQ ID:8506, to the nucleotide sequence of GAM116 RNA, herein designated GAM RNA, also designated SEQ ID:301.

Another function of GAM116 is therefore inhibition of FLJ11155 (Accession NP_060812.1). Accordingly, utilities of GAM116 include diagnosis, prevention and treatment of diseases and clinical conditions associated with FLJ11155.

FLJ11274 (Accession NP_060845.1) is another GAM116 target gene, herein designated TARGET GENE. FLJ11274 BINDING SITE is a target binding site found in the 5' untranslated region of mRNA encoded by FLJ11274, corresponding to a target binding site such as BINDING SITE I, BINDING SITE II or BINDING SITE III of FIG. 8. Table 4 illustrates the complementarity of the nucleotide sequences of FLJ11274 BINDING SITE, designated SEQ ID:7491, to the nucleotide sequence of GAM116 RNA, herein designated GAM RNA, also designated SEQ ID:301.

Another function of GAM116 is therefore inhibition of FLJ11274 (Accession NP_060845.1). Accordingly, utilities of GAM116 include diagnosis, prevention and treatment of diseases and clinical conditions associated with FLJ11274.

FLJ11800 (Accession NP_079250.1) is another GAM116 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:11823, to the nucleotide sequence of GAM116 RNA, herein designated GAM RNA, also designated SEQ ID:301.

Another function of GAM116 is therefore inhibition of FLJ11800 (Accession NP_079250.1). Accordingly, utilities of GAM116 include diagnosis, prevention and treatment of diseases and clinical conditions associated with FLJ11800.

FLJ12190 (Accession NP_079347.1) is another GAM116 target gene, herein designated TARGET GENE. FLJ12190 BINDING SITE is a target binding site found in the 3' untranslated region of mRNA encoded by FLJ12190, corresponding to a target binding site such as BINDING SITE I, BINDING SITE II or BINDING SITE III of FIG. 8. Table 4 illustrates the complementarity of the nucleotide sequences of FLJ12190 BINDING SITE, designated SEQ ID:15397, to the nucleotide sequence of GAM116 RNA, herein designated GAM RNA, also designated SEQ ID:301.

Another function of GAM116 is therefore inhibition of FLJ12190 (Accession NP_079347.1). Accordingly, utilities of GAM116 include diagnosis, prevention and treatment of diseases and clinical conditions associated with FLJ12190.

FLJ12443 (Accession NP_079106.2) is another GAM116 target gene, herein designated TARGET GENE. FLJ12443 BINDING SITE is a target binding site found in the 3' untranslated region of mRNA encoded by FLJ12443, corresponding to a target binding site such as BINDING SITE I, BINDING SITE II or BINDING SITE III of FIG. 8. Table 4 illustrates the complementarity of the nucleotide sequences of FLJ12443 BINDING SITE, designated SEQ ID:19826, to the nucleotide sequence of GAM116 RNA, herein designated GAM RNA, also designated SEQ ID:301.

Another function of GAM116 is therefore inhibition of FLJ12443 (Accession NP_079106.2). Accordingly, utilities of GAM116 include diagnosis, prevention and treatment of diseases and clinical conditions associated with FLJ12443.

FLJ12586 (Accession NP_078896.2) is another GAM116 target gene, herein designated TARGET GENE. FLJ12586 BINDING SITE is a target binding site found in the 3' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:2047, to the nucleotide sequence of GAM116 RNA, herein designated GAM RNA, also designated SEQ ID:301.

Another function of GAM116 is therefore inhibition of FLJ12586 (Accession NP_078896.2). Accordingly, utilities of GAM116 include diagnosis, prevention and treatment of diseases and clinical conditions associated with FLJ12586.

FLJ12650 (Accession NP_078798.1) is another GAM116 target gene, herein designated TARGET GENE. FLJ12650 BINDING SITE is a target binding site found in the 3' untranslated region of mRNA encoded by FLJ12650, corresponding to a target binding site such as BINDING SITE I, BINDING SITE II or BINDING SITE III of FIG. 8. Table 4 illustrates the complementarity of the nucleotide sequences of FLJ12650 BINDING SITE, designated SEQ ID:2476, to the nucleotide sequence of GAM116 RNA, herein designated GAM RNA, also designated SEQ ID:301.

Another function of GAM116 is therefore inhibition of FLJ12650 (Accession NP_078798.1). Accordingly, utilities of GAM116 include diagnosis, prevention and treatment of diseases and clinical conditions associated with FLJ12650.

FLJ12800 (Accession NP_075054.1) is another GAM116 target gene, herein designated TARGET GENE. FLJ12800 BINDING SITE is a target binding site found in the 3' untranslated region of mRNA encoded by FLJ12800, corresponding to a target binding site such as BINDING SITE I, BINDING SITE II or BINDING SITE III of FIG. 8. Table 4 illustrates the complementarity of the nucleotide sequences of FLJ12800 BINDING SITE, designated SEQ ID:1109, to the nucleotide sequence of GAM116 RNA, herein designated GAM RNA, also designated SEQ ID:301.

Another function of GAM116 is therefore inhibition of FLJ12800 (Accession NP_075054.1). Accordingly, utilities of GAM116 include diagnosis, prevention and treatment of diseases and clinical conditions associated with FLJ12800.

FLJ13204 (Accession NP_079037.2) is another GAM116 target gene, herein designated TARGET GENE. FLJ13204 BINDING SITE is a target binding site found in the 3' untranslated region of mRNA encoded by FLJ13204, corresponding to a target binding site such as BINDING SITE I, BINDING SITE II or BINDING SITE III of FIG. 8. Table 4 illustrates the complementarity of the nucleotide sequences of FLJ13204 BINDING SITE, designated SEQ ID:13933, to the nucleotide sequence of GAM116 RNA, herein designated GAM RNA, also designated SEQ ID:301.

Another function of GAM116 is therefore inhibition of FLJ13204 (Accession NP_079037.2). Accordingly, utilities of GAM116 include diagnosis, prevention and treatment of diseases and clinical conditions associated with FLJ13204.

FLJ13855 (Accession NP_075567.1) is another GAM116 target gene, herein designated TARGET GENE. FLJ13855 BINDING SITE is a target binding site found in the 5' untranslated region of mRNA encoded by FLJ13855, corresponding to a target binding site such as BINDING SITE I, BINDING SITE II or BINDING SITE III of FIG. 8. Table 4 illustrates the complementarity of the nucleotide sequences of FLJ13855 BINDING SITE, designated SEQ ID:18367, to the nucleotide sequence of GAM116 RNA, herein designated GAM RNA, also designated SEQ ID:301.

Another function of GAM116 is therefore inhibition of FLJ13855 (Accession NP_075567.1). Accordingly, utilities of GAM116 include diagnosis, prevention and treatment of diseases and clinical conditions associated with FLJ13855.

FLJ14082 (Accession NP_079300.1) is another GAM116 target gene, herein designated TARGET GENE. FLJ14082 BINDING SITE is a target binding site found in the 3' untranslated region of mRNA encoded by FLJ14082, corresponding to a target binding site such as BINDING SITE I, BINDING SITE II or BINDING SITE III of FIG. 8. Table 4 illustrates the complementarity of the nucleotide sequences of FLJ14082 BINDING SITE, designated SEQ ID:15997, to the nucleotide sequence of GAM116 RNA, herein designated GAM RNA, also designated SEQ ID:301.

Another function of GAM116 is therefore inhibition of FLJ14082 (Accession NP_079300.1). Accordingly, utilities of GAM116 include diagnosis, prevention and treatment of diseases and clinical conditions associated with FLJ14082.

FLJ14564 (Accession NP_115939.1) is another GAM116 target gene, herein designated TARGET GENE. FLJ14564 BINDING SITE is a target binding site found in the 3' untranslated region of mRNA encoded by FLJ14564, corresponding to a target binding site such as BINDING SITE I, BINDING SITE II or BINDING SITE III of FIG. 8. Table 4 illustrates the complementarity of the nucleotide sequences of FLJ14564 BINDING SITE, designated SEQ ID:8020, to the nucleotide sequence of GAM116 RNA, herein designated GAM RNA, also designated SEQ ID:301.

Another function of GAM116 is therefore inhibition of FLJ14564 (Accession NP_115939.1). Accordingly, utilities of GAM116 include diagnosis, prevention and treatment of diseases and clinical conditions associated with FLJ14564.

FLJ20257 (Accession NP_062552.1) is another GAM116 target gene, herein designated TARGET GENE. FLJ20257 BINDING SITE is a target binding site found in the 3' untranslated region of mRNA encoded by FLJ20257, corresponding to a target binding site such as BINDING SITE I, BINDING SITE II or BINDING SITE III of FIG. 8. Table 4 illustrates the complementarity of the nucleotide sequences of FLJ20257 BINDING SITE, designated SEQ ID:1289, to the nucleotide sequence of GAM116 RNA, herein designated GAM RNA, also designated SEQ ID:301.

Another function of GAM116 is therefore inhibition of FLJ20257 (Accession NP_062552.1). Accordingly, utilities of GAM116 include diagnosis, prevention and treatment of diseases and clinical conditions associated with FLJ20257.

FLJ20716 (Accession NP_060408.2) is another GAM116 target gene, herein designated TARGET GENE. FLJ20716 BINDING SITE is a target binding site found in the 3' untranslated region of mRNA encoded by FLJ20716, corresponding to a target binding site such as BINDING SITE I, BINDING SITE II or BINDING SITE III of FIG. 8. Table 4 illustrates the complementarity of the nucleotide sequences of FLJ20716 BINDING SITE, designated SEQ ID:4364, to the nucleotide sequence of GAM116 RNA, herein designated GAM RNA, also designated SEQ ID:301.

Another function of GAM116 is therefore inhibition of FLJ20716 (Accession NP_060408.2). Accordingly, utilities of GAM116 include diagnosis, prevention and treatment of diseases and clinical conditions associated with FLJ20716.

FLJ22490 (Accession NP_079066.2) is another GAM116 target gene, herein designated TARGET GENE. FLJ22490 BINDING SITE is a target binding site found in the 5' untranslated region of mRNA encoded by FLJ22490, corresponding to a target binding site such as BINDING SITE I, BINDING SITE II or BINDING SITE III of FIG. 8. Table 4 illustrates the complementarity of the nucleotide sequences of FLJ22490 BINDING SITE, designated SEQ ID:4123, to the nucleotide sequence of GAM116 RNA, herein designated GAM RNA, also designated SEQ ID:301.

Another function of GAM116 is therefore inhibition of FLJ22490 (Accession NP_079066.2). Accordingly, utilities of GAM116 include diagnosis, prevention and treatment of diseases and clinical conditions associated with FLJ22490.

FLJ22494 (Accession NP_079091.1) is another GAM116 target gene, herein designated TARGET GENE. FLJ22494 BINDING SITE is a target binding site found in the 5' untranslated region of mRNA encoded by FLJ22494, corresponding to a target binding site such as BINDING SITE I, BINDING SITE II or BINDING SITE III of FIG. 8. Table 4 illustrates the complementarity of the nucleotide sequences of FLJ22494 BINDING SITE, designated SEQ ID:11620, to the nucleotide sequence of GAM116 RNA, herein designated GAM RNA, also designated SEQ ID:301.

Another function of GAM116 is therefore inhibition of FLJ22494 (Accession NP_079091.1). Accordingly, utilities of GAM116 include diagnosis, prevention and treatment of diseases and clinical conditions associated with FLJ22494.

FLJ22944 (Accession NP_079421.2) is another GAM116 target gene, herein designated TARGET GENE. FLJ22944 BINDING SITE is a target binding site found in the 3' untranslated region of mRNA encoded by FLJ22944, corresponding to a target binding site such as BINDING SITE I, BINDING SITE II or BINDING SITE III of FIG. 8. Table 4 illustrates the complementarity of the nucleotide sequences of FLJ22944 BINDING SITE, designated SEQ ID:16245, to the nucleotide sequence of GAM116 RNA, herein designated GAM RNA, also designated SEQ ID:301.

Another function of GAM116 is therefore inhibition of FLJ22944 (Accession NP_079421.2). Accordingly, utilities of GAM116 include diagnosis, prevention and treatment of diseases and clinical conditions associated with FLJ22944.

FLJ30313 (Accession NP_689970.1) is another GAM116 target gene, herein designated TARGET GENE. FLJ30313 BINDING SITE is a target binding site found in the 3' untranslated region of mRNA encoded by FLJ30313, corresponding to a target binding site such as BINDING SITE I, BINDING SITE II or BINDING SITE III of FIG. 8. Table 4 illustrates the complementarity of the nucleotide sequences of FLJ30313 BINDING SITE, designated SEQ ID:956, to the nucleotide sequence of GAM116 RNA, herein designated GAM RNA, also designated SEQ ID:301.

Another function of GAM116 is therefore inhibition of FLJ30313 (Accession NP_689970.1). Accordingly, utilities of GAM116 include diagnosis, prevention and treatment of diseases and clinical conditions associated with FLJ30313.

FLJ32029 (Accession NP_775853.2) is another GAM116 target gene, herein designated TARGET GENE. FLJ32029 BINDING SITE is a target binding site found in the 3' untranslated region of mRNA encoded by FLJ32029, corresponding to a target binding site such as BINDING SITE I, BINDING SITE II or BINDING SITE III of FIG. 8. Table 4 illustrates the complementarity of the nucleotide sequences of FLJ32029 BINDING SITE, designated SEQ ID:16839, to the nucleotide sequence of GAM116 RNA, herein designated GAM RNA, also designated SEQ ID:301.

Another function of GAM116 is therefore inhibition of FLJ32029 (Accession NP_775853.2). Accordingly, utilities of GAM116 include diagnosis, prevention and treatment of diseases and clinical conditions associated with FLJ32029.

FLJ35838 (Accession NP_775803.1) is another GAM116 target gene, herein designated TARGET GENE. FLJ35838 BINDING SITE is a target binding site found in the 3' untranslated region of mRNA encoded by FLJ35838, corresponding to a target binding site such as BINDING SITE I, BINDING SITE II or BINDING SITE III of FIG. 8. Table 4 illustrates the complementarity of the nucleotide sequences of FLJ35838 BINDING SITE, designated SEQ ID:1616, to the nucleotide sequence of GAM116 RNA, herein designated GAM RNA, also designated SEQ ID:301.

Another function of GAM116 is therefore inhibition of FLJ35838 (Accession NP_775803.1). Accordingly, utilities of GAM116 include diagnosis, prevention and treatment of diseases and clinical conditions associated with FLJ35838.

FLJ36504 (Accession NP_787106.2) is another GAM116 target gene, herein designated TARGET GENE. FLJ36504 BINDING SITE is a target binding site found in the 3' untranslated region of mRNA encoded by FLJ36504, corresponding to a target binding site such as BINDING SITE I, BINDING SITE II or BINDING SITE III of FIG. 8. Table 4 illustrates the complementarity of the nucleotide sequences of FLJ36504 BINDING SITE, designated SEQ ID:9901, to the nucleotide sequence of GAM116 RNA, herein designated GAM RNA, also designated SEQ ID:301.

Another function of GAM116 is therefore inhibition of FLJ36504 (Accession NP_787106.2). Accordingly, utilities of GAM116 include diagnosis, prevention and treatment of diseases and clinical conditions associated with FLJ36504.

FLJ36749 (Accession NP_775877.1) is another GAM116 target gene, herein designated TARGET GENE. FLJ36749 BINDING SITE is a target binding site found in the 3' untranslated region of mRNA encoded by FLJ36749, corresponding to a target binding site such as BINDING SITE I, BINDING SITE II or BINDING SITE III of FIG. 8. Table 4 illustrates the complementarity of the nucleotide sequences of FLJ36749 BINDING SITE, designated SEQ ID:16158, to the nucleotide sequence of GAM116 RNA, herein designated GAM RNA, also designated SEQ ID:301.

Another function of GAM116 is therefore inhibition of FLJ36749 (Accession NP_775877.1). Accordingly, utilities of GAM116 include diagnosis, prevention and treatment of diseases and clinical conditions associated with FLJ36749.

FLJ36928 (Accession NP_775822.1) is another GAM116 target gene, herein designated TARGET GENE. FLJ36928 BINDING SITE is a target binding site found in the 3' untranslated region of mRNA encoded by FLJ36928, corresponding to a target binding site such as BINDING SITE I, BINDING SITE II or BINDING SITE III of FIG. 8. Table 4 illustrates the complementarity of the nucleotide sequences of FLJ36928 BINDING SITE, designated SEQ ID:12357, to the nucleotide sequence of GAM116 RNA, herein designated GAM RNA, also designated SEQ ID:301.

Another function of GAM116 is therefore inhibition of FLJ36928 (Accession NP_775822.1). Accordingly, utilities of GAM116 include diagnosis, prevention and treatment of diseases and clinical conditions associated with FLJ36928.

FLJ39106 (Accession NP_775900.1) is another GAM116 target gene, herein designated TARGET GENE. FLJ39106 BINDING SITE is a target binding site found in the 3' untranslated region of mRNA encoded by FLJ39106, corresponding to a target binding site such as BINDING SITE I, BINDING SITE II or BINDING SITE III of FIG. 8. Table 4 illustrates the complementarity of the nucleotide sequences of FLJ39106 BINDING SITE, designated SEQ ID:4522, to the nucleotide sequence of GAM116 RNA, herein designated GAM RNA, also designated SEQ ID:301.

Another function of GAM116 is therefore inhibition of FLJ39106 (Accession NP_775900.1). Accordingly, utilities of GAM116 include diagnosis, prevention and treatment of diseases and clinical conditions associated with FLJ39106.

FLJ39654 (Accession NP_787110.1) is another GAM116 target gene, herein designated TARGET GENE. FLJ39654 BINDING SITE is a target binding site found in the 3' untranslated region of mRNA encoded by FLJ39654, corresponding to a target binding site such as BINDING SITE I, BINDING SITE II or BINDING SITE III of FIG. 8. Table 4 illustrates the complementarity of the nucleotide sequences of FLJ39654 BINDING SITE, designated SEQ ID:8884, to the nucleotide sequence of GAM116 RNA, herein designated GAM RNA, also designated SEQ ID:301.

Another function of GAM116 is therefore inhibition of FLJ39654 (Accession NP_787110.1). Accordingly, utilities of GAM116 include diagnosis, prevention and treatment of diseases and clinical conditions associated with FLJ39654.

Fibronectin leucine rich transmembrane protein 3 (FLRT3, Accession NP_037413.1) is another GAM116 target gene, herein designated TARGET GENE. FLRT3 BINDING SITE is a target binding site found in the 3' untranslated region of mRNA encoded by FLRT3, corresponding to a target binding site such as BINDING SITE I, BINDING SITE II or BINDING SITE III of FIG. 8. Table 4 illustrates the complementarity of the nucleotide sequences of FLRT3 BINDING SITE, designated SEQ ID:3900, to the nucleotide sequence of GAM116 RNA, herein designated GAM RNA, also designated SEQ ID:301.

Another function of GAM116 is therefore inhibition of Fibronectin leucine rich transmembrane protein 3 (FLRT3, Accession NP_037413.1). Accordingly, utilities of GAM116 include diagnosis, prevention and treatment of diseases and clinical conditions associated with FLRT3.

Forkhead box a1 (FOXA1, Accession NP_004487.2) is another GAM116 target gene, herein designated TARGET GENE. FOXA1 BINDING SITE is a target binding site found in the 5' untranslated region of mRNA encoded by FOXA1, corresponding to a target binding site such as BINDING SITE I, BINDING SITE II or BINDING SITE III of FIG. 8. Table 4 illustrates the complementarity of the nucleotide sequences of FOXA1 BINDING SITE, designated SEQ ID:15349, to the nucleotide sequence of GAM116 RNA, herein designated GAM RNA, also designated SEQ ID:301.

Another function of GAM116 is therefore inhibition of Forkhead box a1 (FOXA1, Accession NP_004487.2).

Accordingly, utilities of GAM116 include diagnosis, prevention and treatment of diseases and clinical conditions associated with FOXA1.

Forkhead box m1 (FOXM1, Accession NP_068772.1) is another GAM116 target gene, herein designated TARGET GENE. FOXM1 BINDING SITE is a target binding site found in the 3' untranslated region of mRNA encoded by FOXM1, corresponding to a target binding site such as BINDING SITE I, BINDING SITE II or BINDING SITE III of FIG. 8. Table 4 illustrates the complementarity of the nucleotide sequences of FOXM1 BINDING SITE, designated SEQ ID:15673, to the nucleotide sequence of GAM116 RNA, herein designated GAM RNA, also designated SEQ ID:301.

Another function of GAM116 is therefore inhibition of Forkhead box m1 (FOXM1, Accession NP_068772.1), a gene which may play a role in the control of cell proliferation. Accordingly, utilities of GAM116 include diagnosis, prevention and treatment of diseases and clinical conditions associated with FOXM1.

The function of FOXM1 has been established by previous studies. The 'forkhead' gene family, originally identified in Drosophila, comprises transcription factors with a conserved 100-amino acid DNA-binding motif. One group of factors with the forkhead, or winged-helix, domain is the hepatocyte nuclear factor-3 family of proteins, which appears to regulate cell-specific transcription in hepatocytes and in respiratory and intestinal epithelia. In an attempt to identify forkhead domain transcription factors involved in intestinal cell differentiation, Ye et al. (1997) isolated FKHL16, which they designated HNF3/forkhead homolog-11 (HFH11), from a human colon carcinoma cell line. On Northern blots, FKHL16 is expressed primarily in thymus, testis, small intestine, and colon, moderately in ovary, and at reduced levels in other tissues. Ye et al. (1997) found 2 alternatively spliced FKHL16 mRNAs, yielding predicted proteins of 801 (OMIM Ref. No. HFH11A) and 748 (OMIM Ref. No. HFH11B) amino acids. Both isoforms contain 2 PEST regions, associated with rapid protein degradation. Expression studies in mouse revealed that Fkhl16 is transcribed broadly in embryos, but is expressed only in adult organs containing proliferating cells involved in replenishing differentiated cell populations or in response to growth factors released during injury or repair. By analyzing the promoter region of human FKHL16, or TRIDENT, Korver et al. (1997) found that the 300 bp upstream of the transcription start site are essential for the cell cycle- specific expression of FKHL16. They stated that the promoter data in combination with the expression of FKHL16 in cycling, but not resting, cells indicate that this protein is likely to play a role in the control of cell proliferation. By analysis of cDNA microarray, Ly et al. (2000) showed that diminished proliferation exhibited by fibroblasts from either elderly patients or patients with Hutchinson- Gilford progeria (OMIM Ref. No. 176670) was associated with reduced expression of cell cycle genes as well as a decline in FOXM1B (OMIM Ref. No. HFH11B) levels. Wang et al. (2001) showed that increased levels of Foxm1b in regenerating liver of old transgenic mice restored the sharp peaks in hepatocyte DNA replication and mitosis that are the hallmarks of young regenerating mouse liver. Restoration of the young regenerating liver phenotype was associated with increased expression of numerous cell cycle regulatory genes. Cotransfection assays in the human hepatoma HepG2 cell line demonstrated that FOXM1B protein stimulated expression of both the cyclin B1 (OMIM Ref. No. 123836) and cyclin D1 (OMIM Ref. No. 168461) promoters, suggesting that these cyclin genes are a direct FOXM1B transcription target. The results suggested that FOXM1B controls the transcription network of genes that are essential for cell division and exit from mitosis. The results indicated that reduced expression of the FOXM1B transcription factor contributes to the decline in cellular proliferation observed in the aging process.

Full details of the abovementioned studies are described in the following publications, the disclosure of which are hereby incorporated by reference:

Westendorf, J. M.; Rao, P. N.; Gerace, L.: Cloning of cDNAs for M-phase phosphoproteins recognized by the MPM2 monoclonal antibody and determination of the phosphorylated epitope. Proc. Nat. Acad. Sci. 91:714-718, 1994; and Yao, K.-M.; Sha, M.; Lu, Z.; Wong, G. G.: Molecular analysis of a novel winged helix protein, WIN: expression pattern, DNA binding property, and alternative splicing within the DNA bin.

Further studies establishing the function and utilities of FOXM1 are found in John Hopkins OMIM database record ID 602341, and in cited publications listed in Table 5, which are hereby incorporated by reference. GALNT13 (Accession XP_054951.3) is another GAM116 target gene, herein designated TARGET GENE. GALNT13 BINDING SITE is a target binding site found in the 3' untranslated region of mRNA encoded by GALNT13, corresponding to a target binding site such as BINDING SITE I, BINDING SITE II or BINDING SITE III of FIG. 8. Table 4 illustrates the complementarity of the nucleotide sequences of GALNT13 BINDING SITE, designated SEQ ID:16772, to the nucleotide sequence of GAM116 RNA, herein designated GAM RNA, also designated SEQ ID:301.

Another function of GAM116 is therefore inhibition of GALNT13 (Accession XP_054951.3). Accordingly, utilities of GAM116 include diagnosis, prevention and treatment of diseases and clinical conditions associated with GALNT13.

Glucosidase, beta; acid (includes glucosylceramidase) (GBA, Accession NP_000148.1) is another GAM116 target gene, herein designated TARGET GENE. GBA BINDING SITE is a target binding site found in the 3' untranslated region of mRNA encoded by GBA, corresponding to a target binding site such as BINDING SITE I, BINDING SITE II or BINDING SITE III of FIG. 8. Table 4 illustrates the complementarity of the nucleotide sequences of GBA BINDING SITE, designated SEQ ID:8745, to the nucleotide sequence of GAM116 RNA, herein designated GAM RNA, also designated SEQ ID:301.

Another function of GAM116 is therefore inhibition of Glucosidase, beta; acid (includes glucosylceramidase) (GBA, Accession NP_000148.1). Accordingly, utilities of GAM116 include diagnosis, prevention and treatment of diseases and clinical conditions associated with GBA.

GLTP (Accession NP_057517.1) is another GAM116 target gene, herein designated TARGET GENE. GLTP BINDING SITE is a target binding site found in the 3' untranslated region of mRNA encoded by GLTP, corresponding to a target binding site such as BINDING SITE I, BINDING SITE II or BINDING SITE III of FIG. 8. Table 4 illustrates the complementarity of the nucleotide sequences of GLTP BINDING SITE, designated SEQ ID:6571, to the nucleotide sequence of GAM116 RNA, herein designated GAM RNA, also designated SEQ ID:301.

Another function of GAM116 is therefore inhibition of GLTP (Accession NP_057517.1). Accordingly, utilities of GAM116 include diagnosis, prevention and treatment of diseases and clinical conditions associated with GLTP.

GOR (Accession NP__758439.1) is another GAM116 target gene, herein designated TARGET GENE. GOR BINDING SITE is a target binding site found in the 3' untranslated region of mRNA encoded by GOR, corresponding to a target binding site such as BINDING SITE I, BINDING SITE II or BINDING SITE III of FIG. 8. Table 4 illustrates the complementarity of the nucleotide sequences of GOR BINDING SITE, designated SEQ ID:10062, to the nucleotide sequence of GAM116 RNA, herein designated GAM RNA, also designated SEQ ID:301.

Another function of GAM116 is therefore inhibition of GOR (Accession NP__758439.1). Accordingly, utilities of GAM116 include diagnosis, prevention and treatment of diseases and clinical conditions associated with GOR.

G protein-coupled receptor 26 (GPR26, Accession NP__703143.1) is another GAM116 target gene, herein designated TARGET GENE. GPR26 BINDING SITE is a target binding site found in the 3' untranslated region of mRNA encoded by GPR26, corresponding to a target binding site such as BINDING SITE I, BINDING SITE II or BINDING SITE III of FIG. 8. Table 4 illustrates the complementarity of the nucleotide sequences of GPR26 BINDING SITE, designated SEQ ID:8715, to the nucleotide sequence of GAM116 RNA, herein designated GAM RNA, also designated SEQ ID:301.

Another function of GAM116 is therefore inhibition of G protein-coupled receptor 26 (GPR26, Accession NP__703143.1). Accordingly, utilities of GAM116 include diagnosis, prevention and treatment of diseases and clinical conditions associated with GPR26.

Huntingtin (huntington disease) (HD, Accession NP__002102.2) is another GAM116 target gene, herein designated TARGET GENE. HD BINDING SITE is a target binding site found in the 3' untranslated region of mRNA encoded by HD, corresponding to a target binding site such as BINDING SITE I, BINDING SITE II or BINDING SITE III of FIG. 8. Table 4 illustrates the complementarity of the nucleotide sequences of HD BINDING SITE, designated SEQ ID:3274, to the nucleotide sequence of GAM116 RNA, herein designated GAM RNA, also designated SEQ ID:301.

Another function of GAM116 is therefore inhibition of Huntingtin (huntington disease) (HD, Accession NP__002102.2). Accordingly, utilities of GAM116 include diagnosis, prevention and treatment of diseases and clinical conditions associated with HD.

Hypermethylated in cancer 2 (HIC2, Accession XP__036937.2) is another GAM116 target gene, herein designated TARGET GENE. HIC2 BINDING SITE is a target binding site found in the 3' untranslated region of multiple transcripts of mRNA encoded by HIC2, corresponding to a target binding site such as BINDING SITE I, BINDING SITE II or BINDING SITE III of FIG. 8. Table 4 illustrates the complementarity of the nucleotide sequences of HIC2 BINDING SITE, designated SEQ ID:16826, to the nucleotide sequence of GAM116 RNA, herein designated GAM RNA, also designated SEQ ID:301.

Another function of GAM116 is therefore inhibition of Hypermethylated in cancer 2 (HIC2, Accession XP__036937.2). Accordingly, utilities of GAM116 include diagnosis, prevention and treatment of diseases and clinical conditions associated with HIC2.

Hypermethylated in cancer 2 (HIC2, Accession NP__055909.1) is another GAM116 target gene, herein designated TARGET GENE. HIC2 BINDING SITE is a target binding site found in the 3' untranslated region of multiple transcripts of mRNA encoded by HIC2, corresponding to a target binding site such as BINDING SITE I, BINDING SITE II or BINDING SITE III of FIG. 8. Table 4 illustrates the complementarity of the nucleotide sequences of HIC2 BINDING SITE, designated SEQ ID:16826, to the nucleotide sequence of GAM116 RNA, herein designated GAM RNA, also designated SEQ ID:301.

Another function of GAM116 is therefore inhibition of Hypermethylated in cancer 2 (HIC2, Accession NP__055909.1). Accordingly, utilities of GAM116 include diagnosis, prevention and treatment of diseases and clinical conditions associated with HIC2.

HSPC039 (Accession NP__057181.1) is another GAM116 target gene, herein designated TARGET GENE. HSPC039 BINDING SITE is a target binding site found in the 3' untranslated region of mRNA encoded by HSPC039, corresponding to a target binding site such as BINDING SITE I, BINDING SITE II or BINDING SITE III of FIG. 8. Table 4 illustrates the complementarity of the nucleotide sequences of HSPC039 BINDING SITE, designated SEQ ID:6893, to the nucleotide sequence of GAM116 RNA, herein designated GAM RNA, also designated SEQ ID:301.

Another function of GAM116 is therefore inhibition of HSPC039 (Accession NP__057181.1). Accordingly, utilities of GAM116 include diagnosis, prevention and treatment of diseases and clinical conditions associated with HSPC039.

HSPC056 (Accession NP__054873.1) is another GAM116 target gene, herein designated TARGET GENE. HSPC056 BINDING SITE is a target binding site found in the 3' untranslated region of mRNA encoded by HSPC056, corresponding to a target binding site such as BINDING SITE I, BINDING SITE II or BINDING SITE III of FIG. 8. Table 4 illustrates the complementarity of the nucleotide sequences of HSPC056 BINDING SITE, designated SEQ ID:6808, to the nucleotide sequence of GAM116 RNA, herein designated GAM RNA, also designated SEQ ID:301.

Another function of GAM116 is therefore inhibition of HSPC056 (Accession NP__054873.1). Accordingly, utilities of GAM116 include diagnosis, prevention and treatment of diseases and clinical conditions associated with HSPC056.

HT002 (Accession NP__054785.2) is another GAM116 target gene, herein designated TARGET GENE. HT002 BINDING SITE is a target binding site found in the 3' untranslated region of mRNA encoded by HT002, corresponding to a target binding site such as BINDING SITE I, BINDING SITE II or BINDING SITE III of FIG. 8. Table 4 illustrates the complementarity of the nucleotide sequences of HT002 BINDING SITE, designated SEQ ID:13026, to the nucleotide sequence of GAM116 RNA, herein designated GAM RNA, also designated SEQ ID:301.

Another function of GAM116 is therefore inhibition of HT002 (Accession NP__054785.2). Accordingly, utilities of GAM116 include diagnosis, prevention and treatment of diseases and clinical conditions associated with HT002.

5-hydroxytryptamine (serotonin) receptor 4 (HTR4, Accession NP__000861.1) is another GAM116 target gene, herein designated TARGET GENE. HTR4 BINDING SITE is a target binding site found in the 3' untranslated region of mRNA encoded by HTR4, corresponding to a target binding site such as BINDING SITE I, BINDING SITE II or BINDING SITE III of FIG. 8. Table 4 illustrates the complementarity of the nucleotide sequences of HTR4 BINDING SITE, designated SEQ ID:2727, to the nucleotide sequence of GAM116 RNA, herein designated GAM RNA, also designated SEQ ID:301.

Another function of GAM116 is therefore inhibition of 5-hydroxytryptamine (serotonin) receptor 4 (HTR4, Accession NP_000861.1), a gene which mediates calcium channel currents. Accordingly, utilities of GAM116 include diagnosis, prevention and treatment of diseases and clinical conditions associated with HTR4.

The function of HTR4 has been established by previous studies. The 5-hydroxytryptamine-4 receptor was first characterized by Dumuis et al. (1988) in mouse colliculi neurons. Subsequently, Eglen et al. (1995) showed that 5-HTR4 mediates widespread effects in central and peripheral nervous systems. Serotonin acts as a stimulant to atrial cardiac cells in only a few mammalian species including human, monkey, and pig but not rodents. Cells from human atrium respond to 5-HT stimulation by producing an L-type calcium current. Blondel et al. (1997) used PCR, based on primers to the central region of rat 5-HT4 receptor, to clone a human 5-HT4 receptor, which they called 5-HT4A. Sequence analysis showed that this cDNA encodes a 387-amino acid polypeptide with 7 putative transmembrane domains and several potential regulatory sites. Blondel et al. (1997) found that 5-HT4A is the same length and 93% identical to the shorter of the 2 alternately spliced forms of the rat 5-HT4 receptor. RT-PCR analysis showed that the 5- HT4A mRNA is expressed in human ileum, brain, and atrium, but not in the ventricle. COS-7 cells expressing the 5-HT4 receptor respond to serotonin stimulation with pharmacologic profiles similar to those seen in human atrial myocytes, suggesting to Blondel et al. (1997) that 5-HT4A is the protein responsible for the serotonin responsiveness of the human atrium.

Full details of the abovementioned studies are described in the following publications, the disclosure of which are hereby incorporated by reference:

Claeysen, S.; Fay, P.; Sebben, M.; Lemaire, S.; Bockaert, J.; Dumuis, A.; Taviaux, S.: Assignment of 5-hydroxytryptamine receptor (HTR4) to human chromosome 5 bands q31- to - q33 by in situ hybridization. Cytogenet. Cell Genet. 78:133-134, 1997; and Dumuis, A.; Bouhelal, R.; Sebben, M.; Cory, R.; Bockaert, J.: A nonclassical 5-hydroxytryptamine receptor positively coupled with adenylate cyclase in the central nervous system. Molec.

Further studies establishing the function and utilities of HTR4 are found in John Hopkins OMIM database record ID 602164, and in cited publications listed in Table 5, which are hereby incorporated by reference. HUMAGCGB (Accession XP_291083.2) is another GAM116 target gene, herein designated TARGET GENE. HUMAGCGB BINDING SITE is a target binding site found in the 3' untranslated region of multiple transcripts of mRNA encoded by HUMAGCGB, corresponding to a target binding site such as BINDING SITE I, BINDING SITE II or BINDING SITE III of FIG. 8. Table 4 illustrates the complementarity of the nucleotide sequences of HUMAGCGB BINDING SITE, designated SEQ ID:466, to the nucleotide sequence of GAM116 RNA, herein designated GAM RNA, also designated SEQ ID:301.

Another function of GAM116 is therefore inhibition of HUMAGCGB (Accession XP_291083.2). Accordingly, utilities of GAM116 include diagnosis, prevention and treatment of diseases and clinical conditions associated with HUMAGCGB.

HUMAGCGB (Accession NP_037418.2) is another GAM116 target gene, herein designated TARGET GENE. HUMAGCGB BINDING SITE is a target binding site found in the 3' untranslated region of multiple transcripts of mRNA encoded by HUMAGCGB, corresponding to a target binding site such as BINDING SITE I, BINDING SITE II or BINDING SITE III of FIG. 8. Table 4 illustrates the complementarity of the nucleotide sequences of HUMAGCGB BINDING SITE, designated SEQ ID:466, to the nucleotide sequence of GAM116 RNA, herein designated GAM RNA, also designated SEQ ID:301.

Another function of GAM116 is therefore inhibition of HUMAGCGB (Accession NP_037418.2). Accordingly, utilities of GAM116 include diagnosis, prevention and treatment of diseases and clinical conditions associated with HUMAGCGB.

ICK (Accession NP_057597.2) is another GAM116 target gene, herein designated TARGET GENE. ICK BINDING SITE is a target binding site found in the 5' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:20049, to the nucleotide sequence of GAM116 RNA, herein designated GAM RNA, also designated SEQ ID:301.

Another function of GAM116 is therefore inhibition of ICK (Accession NP_057597.2). Accordingly, utilities of GAM116 include diagnosis, prevention and treatment of diseases and clinical conditions associated with ICK.

ICK (Accession NP_766629.1) is another GAM116 target gene, herein designated TARGET GENE. ICK BINDING SITE is a target binding site found in the 5' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:20049, to the nucleotide sequence of GAM116 RNA, herein designated GAM RNA, also designated SEQ ID:301.

Another function of GAM116 is therefore inhibition of ICK (Accession NP_766629.1). Accordingly, utilities of GAM116 include diagnosis, prevention and treatment of diseases and clinical conditions associated with ICK.

ICK (Accession NP_055735.1) is another GAM116 target gene, herein designated TARGET GENE. ICK BINDING SITE is a target binding site found in the 5' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:20049, to the nucleotide sequence of GAM116 RNA, herein designated GAM RNA, also designated SEQ ID:301.

Another function of GAM116 is therefore inhibition of ICK (Accession NP_055735.1). Accordingly, utilities of GAM116 include diagnosis, prevention and treatment of diseases and clinical conditions associated with ICK.

Interleukin 6 receptor (IL6R, Accession NP_852004.1) is another GAM116 target gene, herein designated TARGET GENE. IL6R BINDING SITE is a target binding site found in the 3' untranslated region of multiple transcripts of mRNA encoded by IL6R, corresponding to a target binding site such as BINDING SITE I, BINDING SITE II or BINDING SITE III of FIG. 8. Table 4 illustrates the complementarity of the nucleotide sequences of IL6R BINDING SITE, designated SEQ ID:12823, to the nucleotide sequence of GAM116 RNA, herein designated GAM RNA, also designated SEQ ID:301.

Another function of GAM116 is therefore inhibition of Interleukin 6 receptor (IL6R, Accession NP_852004.1), a gene which is essential to the regulation of the immune response, hematopoiesis, and acute-phase reactions. Accordingly, utilities of GAM116 include diagnosis, prevention and treatment of diseases and clinical conditions associated with IL6R.

The function of IL6R and its association with various diseases and clinical conditions, has been established by previous studies, as described hereinabove with reference to GAM94.1. Interleukin 6 receptor (IL6R, Accession NP_000556.1) is another GAM116 target gene, herein designated TARGET GENE. IL6R BINDING SITE is a target binding site found in the 3' untranslated region of multiple transcripts of mRNA encoded by IL6R, corresponding to a target binding site such as BINDING SITE I, BINDING SITE II or BINDING SITE III of FIG. 8. Table 4 illustrates the complementarity of the nucleotide sequences of IL6R BINDING SITE, designated SEQ ID:12823, to the nucleotide sequence of GAM116 RNA, herein designated GAM RNA, also designated SEQ ID:301.

Another function of GAM116 is therefore inhibition of Interleukin 6 receptor (IL6R, Accession NP_000556.1), a gene which is essential to the regulation of the immune response, hematopoiesis, and acute-phase reactions. Accordingly, utilities of GAM116 include diagnosis, prevention and treatment of diseases and clinical conditions associated with IL6R.

The function of IL6R and its association with various diseases and clinical conditions, has been established by previous studies, as described hereinabove with reference to GAM94.1. Insulin receptor (INSR, Accession NP_000199.1) is another GAM116 target gene, herein designated TARGET GENE. INSR BINDING SITE is a target binding site found in the 3' untranslated region of mRNA encoded by INSR, corresponding to a target binding site such as BINDING SITE I, BINDING SITE II or BINDING SITE III of FIG. 8. Table 4 illustrates the complementarity of the nucleotide sequences of INSR BINDING SITE, designated SEQ ID:8240, to the nucleotide sequence of GAM116 RNA, herein designated GAM RNA, also designated SEQ ID:301.

Another function of GAM116 is therefore inhibition of Insulin receptor (INSR, Accession NP_000199.1), a gene which binds insulin and has a tyrosine- protein kinase activity. and therefore is associated with Various forms of insulin resistance. Accordingly, utilities of GAM116 include diagnosis, prevention and treatment of Various forms of insulin resistance, and of other diseases and clinical conditions associated with INSR.

The function of INSR has been established by previous studies. The insulin (INS; 176730) receptor is a tetramer of 2 alpha and 2 beta subunits. The alpha and beta subunits are coded by a single gene and are joined by disulfide bonds, a mechanism parallel to that of the ligand, insulin (Rubin, 1984). Mutation in either the structural gene or some of the processing steps may lead to insulin resistance. Ullrich et al. (1985) deduced the entire 1,370-amino acid sequence from a cDNA clone. The precursor starts with a 27-amino acid signal sequence, followed by the receptor alpha subunit, a precursor processing enzyme cleavage site, then the beta subunit containing a single 23-amino acid transmembrane sequence. Seino et al. (1989) found that the INSR gene spans more than 120 kb and has 22 exons. All introns interrupt protein coding regions of the gene. The 11 exons encoding the alpha subunit are dispersed over more than 90 kb, whereas the 11 exons encoding the beta subunit are located together in a region of about 30 kb. Three transcriptional initiation sites were identified, located 276, 282, and 283 bp upstream of the translation initiation site. There is heterogeneity of insulin receptors in different tissues Leibiger et al. (2001) showed that insulin activates the transcription of its own gene and that of the beta-cell glucokinase gene (GCK; 138079) by different mechanisms. Whereas INS gene transcription is promoted by signaling through INSR type A (without exon 11), phosphatidylinositol 3-kinase (PI3K) class IA (see OMIM Ref. No. 171833), and the 70-kD S6 kinase, insulin stimulates the beta-cell GCK gene by signaling via INSR type B (with exon 11), PI3K class II (see OMIM Ref. No. 602838)-like activity, and protein kinase B (OMIM Ref. No. 164730). These data provided evidence for selectivity in insulin action via the 2 INSR isoforms, the molecular basis being preferential signaling through different PI3K and protein kinases. Using a yeast 2-hybrid system, Dey et al. (1998) identified a regulatory subunit of PI3K, PIK3R3 (OMIM Ref. No. 606076), as a binding partner of INSR. They concluded that PIK3R3 interacts with IGF1R (OMIM Ref. No. 147370) and INSR in a kinase-dependent manner, providing an alternative pathway for the activation of PI3K by these 2 receptors. Rajala and Anderson (2001) sought to identify the tyrosine-phosphorylated protein(s) in the bovine rod outer segments (ROS) that are associated with PI3K. They concluded that tyrosine phosphorylation of the beta subunit of the insulin receptor is involved in the regulation of PI3K activity in the ROS.

Animal model experiments lend further support to the function of INSR. Belke et al. (2002) generated mice with a cardiomyocyte-specific insulin receptor knockout (CIRKO), using cre/loxP recombination. Hearts of CIRKO mice were 20 to 30% smaller because of decreased postnatal hypertrophy of cardiomyocytes; they had persistent expression of the fetal beta-myosin heavy chain isoform, approximately half the normal expression of glucose transporter-1 (GLUT1; 138140), and a 2-fold increase in GLUT4 expression. Cardiac glucose uptake was increased in vivo, glycolysis was increased in isolated working hearts, and there was reduced expression of enzymes that catalyze mitochondrial beta-oxidation, leading to decreased fatty acid oxidation rates.

It is appreciated that the abovementioned animal model for INSR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leibiger, B.; Leibiger, I. B.; Moede, T.; Kemper, S.; Kulkarni, R. N.; Kahn, C. R.; de Vargas, L. M.; Berggren, P.-O.: Selective insulin signaling through A and B insulin receptors regulates transcription of insulin and glucokinase genes in pancreatic beta cells. Molec. Cell 7:559-570, 2001; and Belke, D. D.; Betuing, S.; Tuttle, M. J.; Graveleau, C.; Young, M. E.; Pham, M.; Zhang, D.; Cooksey, R. C.; McClain, D. A.; Litwin, S. E.; Taegtmeyer, H.; Severson, D.; Kahn, C. R.; Abe.

Further studies establishing the function and utilities of INSR are found in John Hopkins OMIM database record ID 147670, and in cited publications listed in Table 5, which are hereby incorporated by reference. Inositol 1,4,5-triphosphate receptor, type 2 (ITPR2, Accession NP_002214.1) is another GAM116 target gene, herein designated TARGET GENE. ITPR2 BINDING SITE is a target binding site found in the 3' untranslated region of mRNA encoded by ITPR2, corresponding to a target binding site such as BINDING SITE I, BINDING SITE II or BINDING SITE III of FIG. 8. Table 4 illustrates the complementarity of the nucleotide sequences of ITPR2 BINDING SITE, designated SEQ ID:19491, to the nucleotide sequence of GAM116 RNA, herein designated GAM RNA, also designated SEQ ID:301.

Another function of GAM116 is therefore inhibition of Inositol 1,4,5-triphosphate receptor, type 2 (ITPR2, Accession NP_002214.1). Accordingly, utilities of GAM116 include diagnosis, prevention and treatment of diseases and clinical conditions associated with ITPR2.

Potassium inwardly-rectifying channel, subfamily j, member 10 (KCNJ10, Accession NP_002232.2) is another GAM116 target gene, herein designated TARGET GENE. KCNJ10 BINDING SITE is a target binding site found in the 3' untranslated region of mRNA encoded by KCNJ10, corresponding to a target binding site such as BINDING SITE I, BINDING SITE II or BINDING SITE III of FIG. 8. Table 4 illustrates the complementarity of the nucleotide sequences of KCNJ10 BINDING SITE, designated SEQ ID:5460, to the nucleotide sequence of GAM116 RNA, herein designated GAM RNA, also designated SEQ ID:301.

Another function of GAM116 is therefore inhibition of Potassium inwardly-rectifying channel, subfamily j, member 10 (KCNJ10, Accession NP_002232.2), a gene which may be responsible for potassium buffering action of glial cells in the brain. Accordingly, utilities of GAM116 include diagnosis, prevention and treatment of diseases and clinical conditions associated with KCNJ10.

The function of KCNJ10 and its association with various diseases and clinical conditions, has been established by previous studies, as described hereinabove with reference to GAM31.1. Potassium large conductance calcium-activated channel, subfamily m, alpha member 1 (KCNMA1, Accession NP_002238.2) is another GAM116 target gene, herein designated TARGET GENE. KCNMA1 BINDING SITE is a target binding site found in the 3' untranslated region of mRNA encoded by KCNMA1, corresponding to a target binding site such as BINDING SITE I, BINDING SITE II or BINDING SITE III of FIG. 8. Table 4 illustrates the complementarity of the nucleotide sequences of KCNMA1 BINDING SITE, designated SEQ ID:8898, to the nucleotide sequence of GAM116 RNA, herein designated GAM RNA, also designated SEQ ID:301.

Another function of GAM116 is therefore inhibition of Potassium large conductance calcium-activated channel, subfamily m, alpha member 1 (KCNMA1, Accession NP_002238.2), a gene which is an alpha subunit 1 of the large conductance calcium-activated K channel. Accordingly, utilities of GAM116 include diagnosis, prevention and treatment of diseases and clinical conditions associated with KCNMA1.

The function of KCNMA1 has been established by previous studies. Potassium channels play a key role in the transmission of information within the neuromuscular system by translating ionic fluxes across cellular membrane into electrical impulses and by interconverting and transducing electrical and chemical signals. Among this class of polypeptides, K+ channels represent the most extensive and diverse group. While all K+ channels are alike in their selective permeability to K+ over other monovalent ions, they can be subdivided into 2 distinct types: voltage- activated K+ channels, which respond to changes in membrane potential, and Ca(2+)-activated K+ channels, which respond primarily to increases in intracellular calcium ion concentrations. The first structural gene of a calcium- activated potassium channel was isolated through study of mutations of the Drosophila 'slowpoke' (slo) locus, which were found specifically to eliminate a fast, calcium- activated potassium current in adult and larval muscles and in larval neurons. Pallanck and Ganetzky (1994) cloned human and mouse homologs of the Drosophila gene and demonstrated that the encoded polypeptides have more than 50% amino acid identity with their Drosophila counterparts. In addition, like the Drosophila 'slowpoke' gene, both the mouse and the human genes generate multiple transcripts by alternative splicing Silberberg and Magleby (1999) suggested that the finding of Valverde et al. (1999) that estrogen directly activates vascular smooth muscle maxi-K channels may pave the way for the design of new drugs for prevention of cardiovascular disease Full details of the abovementioned studies are described in the following publications, the disclosure of which are hereby incorporated by reference:

Pallanck, L.; Ganetzky, B.: Cloning and characterization of human and mouse homologs of the Drosophila calcium-activated potassium channel gene, slowpoke. Hum. Molec. Genet. 3:1239-1243, 1994; and Ramanathan, K.; Michael, T. H.; Jiang, G.-J.; Hiel, H.; Fuchs, P. A.: A molecular mechanism for electrical tuning of cochlear hair cells. Science 283:215- 217, 1999.

Further studies establishing the function and utilities of KCNMA1 are found in John Hopkins OMIM database record ID 600150, and in cited publications listed in Table 5, which are hereby incorporated by reference. KIAA0062 (Accession XP_046677.3) is another GAM116 target gene, herein designated TARGET GENE. KIAA0062 BINDING SITE is a target binding site found in the 3' untranslated region of mRNA encoded by KIAA0062, corresponding to a target binding site such as BINDING SITE I, BINDING SITE II or BINDING SITE III of FIG. 8. Table 4 illustrates the complementarity of the nucleotide sequences of KIAA0062 BINDING SITE, designated SEQ ID:12869, to the nucleotide sequence of GAM116 RNA, herein designated GAM RNA, also designated SEQ ID:301.

Another function of GAM116 is therefore inhibition of KIAA0062 (Accession XP_046677.3). Accordingly, utilities of GAM116 include diagnosis, prevention and treatment of diseases and clinical conditions associated with KIAA0062.

KIAA0240 (Accession XP_166479.2) is another GAM116 target gene, herein designated TARGET GENE. KIAA0240 BINDING SITE is a target binding site found in the 3' untranslated region of mRNA encoded by KIAA0240, corresponding to a target binding site such as BINDING SITE I, BINDING SITE II or BINDING SITE III of FIG. 8. Table 4 illustrates the complementarity of the nucleotide sequences of KIAA0240 BINDING SITE, designated SEQ ID:18158, to the nucleotide sequence of GAM116 RNA, herein designated GAM RNA, also designated SEQ ID:301.

Another function of GAM116 is therefore inhibition of KIAA0240 (Accession XP_166479.2). Accordingly, utilities of GAM116 include diagnosis, prevention and treatment of diseases and clinical conditions associated with KIAA0240.

KIAA0316 (Accession XP_045712.5) is another GAM116 target gene, herein designated TARGET GENE. KIAA0316 BINDING SITE1 and KIAA0316 BINDING SITE2 are target binding sites found in untranslated regions of mRNA encoded by KIAA0316, corresponding to target binding sites such as BINDING SITE I, BINDING SITE II or BINDING SITE III of FIG. 8. Table 4 illustrates the complementarity of the nucleotide sequences of KIAA0316 BINDING SITE1 and KIAA0316 BINDING SITE2, designated SEQ ID:11176 and SEQ ID:13615 respectively, to the nucleotide sequence of GAM116 RNA, herein designated GAM RNA, also designated SEQ ID:301.

Another function of GAM116 is therefore inhibition of KIAA0316 (Accession XP_045712.5). Accordingly, utilities of GAM116 include diagnosis, prevention and treatment of diseases and clinical conditions associated with KIAA0316.

KIAA0527 (Accession XP_171054.1) is another GAM116 target gene, herein designated TARGET GENE.

KIAA0527 BINDING SITE is a target binding site found in the 3' untranslated region of mRNA encoded by KIAA0527, corresponding to a target binding site such as BINDING SITE I, BINDING SITE II or BINDING SITE III of FIG. 8. Table 4 illustrates the complementarity of the nucleotide sequences of KIAA0527 BINDING SITE, designated SEQ ID:4493, to the nucleotide sequence of GAM116 RNA, herein designated GAM RNA, also designated SEQ ID:301.

Another function of GAM116 is therefore inhibition of KIAA0527 (Accession XP_171054.1). Accordingly, utilities of GAM116 include diagnosis, prevention and treatment of diseases and clinical conditions associated with KIAA0527.

KIAA0663 (Accession NP_055642.1) is another GAM116 target gene, herein designated TARGET GENE. KIAA0663 BINDING SITE is a target binding site found in the 3' untranslated region of mRNA encoded by KIAA0663, corresponding to a target binding site such as BINDING SITE I, BINDING SITE II or BINDING SITE III of FIG. 8. Table 4 illustrates the complementarity of the nucleotide sequences of KIAA0663 BINDING SITE, designated SEQ ID:15758, to the nucleotide sequence of GAM116 RNA, herein designated GAM RNA, also designated SEQ ID:301.

Another function of GAM116 is therefore inhibition of KIAA0663 (Accession NP_055642.1). Accordingly, utilities of GAM116 include diagnosis, prevention and treatment of diseases and clinical conditions associated with KIAA0663.

KIAA0682 (Accession NP_055667.1) is another GAM116 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:4750, to the nucleotide sequence of GAM116 RNA, herein designated GAM RNA, also designated SEQ ID:301.

Another function of GAM116 is therefore inhibition of KIAA0682 (Accession NP_055667.1). Accordingly, utilities of GAM116 include diagnosis, prevention and treatment of diseases and clinical conditions associated with KIAA0682.

KIAA1036 (Accession NP_055724.1) is another GAM116 target gene, herein designated TARGET GENE. KIAA1036 BINDING SITE is a target binding site found in the 3' untranslated region of mRNA encoded by KIAA1036, corresponding to a target binding site such as BINDING SITE I, BINDING SITE II or BINDING SITE III of FIG. 8. Table 4 illustrates the complementarity of the nucleotide sequences of KIAA1036 BINDING SITE, designated SEQ ID:3396, to the nucleotide sequence of GAM116 RNA, herein designated GAM RNA, also designated SEQ ID:301.

Another function of GAM116 is therefore inhibition of KIAA1036 (Accession NP_055724.1). Accordingly, utilities of GAM116 include diagnosis, prevention and treatment of diseases and clinical conditions associated with KIAA1036.

KIAA1055 (Accession NP_055894.1) is another GAM116 target gene, herein designated TARGET GENE. KIAA1055 BINDING SITE is a target binding site found in the 3' untranslated region of mRNA encoded by KIAA1055, corresponding to a target binding site such as BINDING SITE I, BINDING SITE II or BINDING SITE III of FIG. 8. Table 4 illustrates the complementarity of the nucleotide sequences of KIAA1055 BINDING SITE, designated SEQ ID:9566, to the nucleotide sequence of GAM116 RNA, herein designated GAM RNA, also designated SEQ ID:301.

Another function of GAM116 is therefore inhibition of KIAA1055 (Accession NP_055894.1). Accordingly, utilities of GAM116 include diagnosis, prevention and treatment of diseases and clinical conditions associated with KIAA1055.

KIAA1069 (Accession XP_042635.3) is another GAM116 target gene, herein designated TARGET GENE. KIAA1069 BINDING SITE is a target binding site found in the 3' untranslated region of mRNA encoded by KIAA1069, corresponding to a target binding site such as BINDING SITE I, BINDING SITE II or BINDING SITE III of FIG. 8. Table 4 illustrates the complementarity of the nucleotide sequences of KIAA1069 BINDING SITE, designated SEQ ID:9350, to the nucleotide sequence of GAM116 RNA, herein designated GAM RNA, also designated SEQ ID:301.

Another function of GAM116 is therefore inhibition of KIAA1069 (Accession XP_042635.3). Accordingly, utilities of GAM116 include diagnosis, prevention and treatment of diseases and clinical conditions associated with KIAA1069.

KIAA1102 (Accession XP_044461.6) is another GAM116 target gene, herein designated TARGET GENE. KIAA1102 BINDING SITE is a target binding site found in the 3' untranslated region of mRNA encoded by KIAA1102, corresponding to a target binding site such as BINDING SITE I, BINDING SITE II or BINDING SITE III of FIG. 8. Table 4 illustrates the complementarity of the nucleotide sequences of KIAA1102 BINDING SITE, designated SEQ ID:12914, to the nucleotide sequence of GAM116 RNA, herein designated GAM RNA, also designated SEQ ID:301.

Another function of GAM116 is therefore inhibition of KIAA1102 (Accession XP_044461.6). Accordingly, utilities of GAM116 include diagnosis, prevention and treatment of diseases and clinical conditions associated with KIAA1102.

KIAA1446 (Accession NP_065887.1) is another GAM116 target gene, herein designated TARGET GENE. KIAA1446 BINDING SITE is a target binding site found in the 5' untranslated region of mRNA encoded by KIAA1446, corresponding to a target binding site such as BINDING SITE I, BINDING SITE II or BINDING SITE III of FIG. 8. Table 4 illustrates the complementarity of the nucleotide sequences of KIAA1446 BINDING SITE, designated SEQ ID:7053, to the nucleotide sequence of GAM116 RNA, herein designated GAM RNA, also designated SEQ ID:301.

Another function of GAM116 is therefore inhibition of KIAA1446 (Accession NP_065887.1). Accordingly, utilities of GAM116 include diagnosis, prevention and treatment of diseases and clinical conditions associated with KIAA1446.

KIAA1727 (Accession XP_034262.4) is another GAM116 target gene, herein designated TARGET GENE. KIAA1727 BINDING SITE is a target binding site found in the 3' untranslated region of mRNA encoded by KIAA1727, corresponding to a target binding site such as BINDING SITE I, BINDING SITE II or BINDING SITE III of FIG. 8. Table 4 illustrates the complementarity of the nucleotide sequences of KIAA1727 BINDING SITE, designated SEQ ID:18595, to the nucleotide sequence of GAM116 RNA, herein designated GAM RNA, also designated SEQ ID:301.

Another function of GAM116 is therefore inhibition of KIAA1727 (Accession XP_034262.4). Accordingly, utilities of GAM116 include diagnosis, prevention and treatment of diseases and clinical conditions associated with KIAA1727.

KIAA1737 (Accession NP_219494.1) is another GAM116 target gene, herein designated TARGET GENE. KIAA1737 BINDING SITE is a target binding site found in the 3' untranslated region of mRNA encoded by KIAA1737, corresponding to a target binding site such as BINDING SITE I, BINDING SITE II or BINDING SITE III of FIG. 8. Table 4 illustrates the complementarity of the nucleotide sequences of KIAA1737 BINDING SITE, designated SEQ ID:19523, to the nucleotide sequence of GAM116 RNA, herein designated GAM RNA, also designated SEQ ID:301.

Another function of GAM116 is therefore inhibition of KIAA1737 (Accession NP_219494.1). Accordingly, utilities of GAM116 include diagnosis, prevention and treatment of diseases and clinical conditions associated with KIAA1737.

KIAA1755 (Accession XP_028810.2) is another GAM116 target gene, herein designated TARGET GENE. KIAA1755 BINDING SITE is a target binding site found in the 5' untranslated region of mRNA encoded by KIAA1755, corresponding to a target binding site such as BINDING SITE I, BINDING SITE II or BINDING SITE III of FIG. 8. Table 4 illustrates the complementarity of the nucleotide sequences of KIAA1755 BINDING SITE, designated SEQ ID:530, to the nucleotide sequence of GAM116 RNA, herein designated GAM RNA, also designated SEQ ID:301.

Another function of GAM116 is therefore inhibition of KIAA1755 (Accession XP_028810.2). Accordingly, utilities of GAM116 include diagnosis, prevention and treatment of diseases and clinical conditions associated with KIAA1755.

Lactation elevated 1 (LACE1, Accession NP_660358.2) is another GAM116 target gene, herein designated TARGET GENE. LACE1 BINDING SITE is a target binding site found in the 3' untranslated region of mRNA encoded by LACE1, corresponding to a target binding site such as BINDING SITE I, BINDING SITE II or BINDING SITE III of FIG. 8. Table 4 illustrates the complementarity of the nucleotide sequences of LACE1 BINDING SITE, designated SEQ ID:17474, to the nucleotide sequence of GAM116 RNA, herein designated GAM RNA, also designated SEQ ID:301.

Another function of GAM116 is therefore inhibition of Lactation elevated 1 (LACE1, Accession NP_660358.2). Accordingly, utilities of GAM116 include diagnosis, prevention and treatment of diseases and clinical conditions associated with LACE1.

Lethal giant larvae homolog 1 (drosophila) (LLGL1, Accession NP_004131.2) is another GAM116 target gene, herein designated TARGET GENE. LLGL1 BINDING SITE is a target binding site found in the 3' untranslated region of mRNA encoded by LLGL1, corresponding to a target binding site such as BINDING SITE I, BINDING SITE II or BINDING SITE III of FIG. 8. Table 4 illustrates the complementarity of the nucleotide sequences of LLGL1 BINDING SITE, designated SEQ ID:4923, to the nucleotide sequence of GAM116 RNA, herein designated GAM RNA, also designated SEQ ID:301.

Another function of GAM116 is therefore inhibition of Lethal giant larvae homolog 1 (drosophila) (LLGL1, Accession NP_004131.2), a gene which has a role in control of cell proliferation and differentiation during development. Accordingly, utilities of GAM116 include diagnosis, prevention and treatment of diseases and clinical conditions associated with LLGL1.

The function of LLGL1 has been established by previous studies. Ohshiro et al. (2000) demonstrated in Drosophila that lethal giant larvae (Lgl) is essential for asymmetric cortical localization of all basal determinants in mitotic neuroblasts, and is therefore indispensable for neural fate decisions. Lgl, which itself is uniformly cortical, interacts with several types of myosin to localize the determinants. Another tumor suppressor protein, lethal discs large (Dlg) (DLG1; 601014), participates in this process by regulating the localization of Lgl. The localization of the apical components is unaffected in Lgl or Dlg mutants. Thus, Lgl and Dlg act in a common process that differentially mediates cortical protein targeting in mitotic neuroblasts, and creates intrinsic differences between daughter cells. Peng et al. (2000) showed that the tumor suppressor genes Lgl and Dlg regulate basal protein targeting, but not apical complex formation or spindle orientation, in both embryonic and larval Drosophila neuroblasts. Dlg protein is apically enriched and is required for maintaining cortical localization of Lgl protein. Basal protein targeting requires microfilament and myosin function, yet the Lgl phenotype is strongly suppressed by reducing levels of myosin II. Peng et al. (2000) concluded that Dlg and Lgl promote, and myosin II inhibits, actomyosin-dependent basal protein targeting in neuroblasts.

Full details of the abovementioned studies are described in the following publications, the disclosure of which are hereby incorporated by reference:

Ohshiro, T.; Yagami, T.; Zhang, C.; Matsuzaki, F.: Role of cortical tumour- suppressor proteins in asymmetric division of Drosophila neuroblast. Nature 408:593-596, 2000; and Peng, C.-Y.; Manning, L.; Albertson, R.; Doe, C. Q.: The tumour-suppressor genes lgl and dlg regulate basal protein targeting in Drosophila neuroblasts. Nature 408:596-600, 2000.

Further studies establishing the function and utilities of LLGL1 are found in John Hopkins OMIM database record ID 600966, and in cited publications listed in Table 5, which are hereby incorporated by reference. LOC115123 (Accession XP_055276.1) is another GAM116 target gene, herein designated TARGET GENE. LOC115123 BINDING SITE is a target binding site found in the 3' untranslated region of mRNA encoded by LOC115123, corresponding to a target binding site such as BINDING SITE I, BINDING SITE II or BINDING SITE III of FIG. 8. Table 4 illustrates the complementarity of the nucleotide sequences of LOC115123 BINDING SITE, designated SEQ ID:18723, to the nucleotide sequence of GAM116 RNA, herein designated GAM RNA, also designated SEQ ID:301.

Another function of GAM116 is therefore inhibition of LOC115123 (Accession XP_055276.1). Accordingly, utilities of GAM116 include diagnosis, prevention and treatment of diseases and clinical conditions associated with LOC115123.

LOC116166 (Accession XP_007651.11) is another GAM116 target gene, herein designated TARGET GENE. LOC116166 BINDING SITE is a target binding site found in the 3' untranslated region of mRNA encoded by LOC116166, corresponding to a target binding site such as BINDING SITE I, BINDING SITE II or BINDING SITE III of FIG. 8. Table 4 illustrates the complementarity of the nucleotide sequences of LOC116166 BINDING SITE, designated SEQ ID:10531, to the nucleotide sequence of GAM116 RNA, herein designated GAM RNA, also designated SEQ ID:301.

Another function of GAM116 is therefore inhibition of LOC116166 (Accession XP_007651.11). Accordingly, utilities of GAM116 include diagnosis, prevention and treatment of diseases and clinical conditions associated with LOC116166.

LOC118487 (Accession XP_058325.1) is another GAM116 target gene, herein designated TARGET GENE. LOC118487 BINDING SITE is a target binding site found in the 3' untranslated region of mRNA encoded by LOC118487, corresponding to a target binding site such as BINDING SITE I, BINDING SITE II or BINDING SITE III of FIG. 8. Table 4 illustrates the complementarity of the nucleotide sequences of LOC118487 BINDING SITE, designated SEQ ID:2230, to the nucleotide sequence of GAM116 RNA, herein designated GAM RNA, also designated SEQ ID:301.

Another function of GAM116 is therefore inhibition of LOC118487 (Accession XP_058325.1). Accordingly, utilities of GAM116 include diagnosis, prevention and treatment of diseases and clinical conditions associated with LOC118487.

LOC121498 (Accession XP_062669.7) is another GAM116 target gene, herein designated TARGET GENE. LOC121498 BINDING SITE is a target binding site found in the 5' untranslated region of mRNA encoded by LOC121498, corresponding to a target binding site such as BINDING SITE I, BINDING SITE II or BINDING SITE III of FIG. 8. Table 4 illustrates the complementarity of the nucleotide sequences of LOC121498 BINDING SITE, designated SEQ ID:6256, to the nucleotide sequence of GAM116 RNA, herein designated GAM RNA, also designated SEQ ID:301.

Another function of GAM116 is therefore inhibition of LOC121498 (Accession XP_062669.7). Accordingly, utilities of GAM116 include diagnosis, prevention and treatment of diseases and clinical conditions associated with LOC121498.

LOC123722 (Accession XP_058721.2) is another GAM116 target gene, herein designated TARGET GENE. LOC123722 BINDING SITE is a target binding site found in the 5' untranslated region of mRNA encoded by LOC123722, corresponding to a target binding site such as BINDING SITE I, BINDING SITE II or BINDING SITE III of FIG. 8. Table 4 illustrates the complementarity of the nucleotide sequences of LOC123722 BINDING SITE, designated SEQ ID:17925, to the nucleotide sequence of GAM116 RNA, herein designated GAM RNA, also designated SEQ ID:301.

Another function of GAM116 is therefore inhibition of LOC123722 (Accession XP_058721.2). Accordingly, utilities of GAM116 include diagnosis, prevention and treatment of diseases and clinical conditions associated with LOC123722.

LOC137829 (Accession XP_059923.2) is another GAM116 target gene, herein designated TARGET GENE. LOC137829 BINDING SITE is a target binding site found in the 3' untranslated region of mRNA encoded by LOC137829, corresponding to a target binding site such as BINDING SITE I, BINDING SITE II or BINDING SITE III of FIG. 8. Table 4 illustrates the complementarity of the nucleotide sequences of LOC137829 BINDING SITE, designated SEQ ID:11715, to the nucleotide sequence of GAM116 RNA, herein designated GAM RNA, also designated SEQ ID:301.

Another function of GAM116 is therefore inhibition of LOC137829 (Accession XP_059923.2). Accordingly, utilities of GAM116 include diagnosis, prevention and treatment of diseases and clinical conditions associated with LOC137829.

LOC144809 (Accession XP_096680.2) is another GAM116 target gene, herein designated TARGET GENE. LOC144809 BINDING SITE is a target binding site found in the 3' untranslated region of mRNA encoded by LOC144809, corresponding to a target binding site such as BINDING SITE I, BINDING SITE II or BINDING SITE III of FIG. 8. Table 4 illustrates the complementarity of the nucleotide sequences of LOC144809 BINDING SITE, designated SEQ ID:18252, to the nucleotide sequence of GAM116 RNA, herein designated GAM RNA, also designated SEQ ID:301.

Another function of GAM116 is therefore inhibition of LOC144809 (Accession XP_096680.2). Accordingly, utilities of GAM116 include diagnosis, prevention and treatment of diseases and clinical conditions associated with LOC144809.

LOC148823 (Accession NP_660321.1) is another GAM116 target gene, herein designated TARGET GENE. LOC148823 BINDING SITE is a target binding site found in the 5' untranslated region of mRNA encoded by LOC148823, corresponding to a target binding site such as BINDING SITE I, BINDING SITE II or BINDING SITE III of FIG. 8. Table 4 illustrates the complementarity of the nucleotide sequences of LOC148823 BINDING SITE, designated SEQ ID:5548, to the nucleotide sequence of GAM116 RNA, herein designated GAM RNA, also designated SEQ ID:301.

Another function of GAM116 is therefore inhibition of LOC148823 (Accession NP_660321.1). Accordingly, utilities of GAM116 include diagnosis, prevention and treatment of diseases and clinical conditions associated with LOC148823.

LOC149464 (Accession XP_097645.1) is another GAM116 target gene, herein designated TARGET GENE. LOC149464 BINDING SITE is a target binding site found in the 5' untranslated region of mRNA encoded by LOC149464, corresponding to a target binding site such as BINDING SITE I, BINDING SITE II or BINDING SITE III of FIG. 8. Table 4 illustrates the complementarity of the nucleotide sequences of LOC149464 BINDING SITE, designated SEQ ID:16914, to the nucleotide sequence of GAM116 RNA, herein designated GAM RNA, also designated SEQ ID:301.

Another function of GAM116 is therefore inhibition of LOC149464 (Accession XP_097645.1). Accordingly, utilities of GAM116 include diagnosis, prevention and treatment of diseases and clinical conditions associated with LOC149464.

LOC151610 (Accession XP_087245.1) is another GAM116 target gene, herein designated TARGET GENE. LOC151610 BINDING SITE is a target binding site found in the 5' untranslated region of mRNA encoded by LOC151610, corresponding to a target binding site such as BINDING SITE I, BINDING SITE II or BINDING SITE III of FIG. 8. Table 4 illustrates the complementarity of the nucleotide sequences of LOC151610 BINDING SITE, designated SEQ ID:15421, to the nucleotide sequence of GAM116 RNA, herein designated GAM RNA, also designated SEQ ID:301.

Another function of GAM116 is therefore inhibition of LOC151610 (Accession XP_087245.1). Accordingly, utilities of GAM116 include diagnosis, prevention and treatment of diseases and clinical conditions associated with LOC151610.

LOC152765 (Accession XP_087519.1) is another GAM116 target gene, herein designated TARGET GENE. LOC152765 BINDING SITE is a target binding site found in the 5' untranslated region of mRNA encoded by LOC152765, corresponding to a target binding site such as BINDING SITE I, BINDING SITE II or BINDING SITE III of FIG. 8. Table 4 illustrates the complementarity of the nucleotide sequences of LOC152765 BINDING SITE, designated SEQ ID:18619, to the nucleotide sequence of GAM116 RNA, herein designated GAM RNA, also designated SEQ ID:301.

Another function of GAM116 is therefore inhibition of LOC152765 (Accession XP_087519.1). Accordingly, utilities of GAM116 include diagnosis, prevention and treatment of diseases and clinical conditions associated with LOC152765.

LOC153232 (Accession XP_098331.1) is another GAM116 target gene, herein designated TARGET GENE.

LOC153232 BINDING SITE is a target binding site found in the 5' untranslated region of mRNA encoded by LOC153232, corresponding to a target binding site such as BINDING SITE I, BINDING SITE II or BINDING SITE III of FIG. 8. Table 4 illustrates the complementarity of the nucleotide sequences of LOC153232 BINDING SITE, designated SEQ ID:14107, to the nucleotide sequence of GAM116 RNA, herein designated GAM RNA, also designated SEQ ID:301.

Another function of GAM116 is therefore inhibition of LOC153232 (Accession XP_098331.1). Accordingly, utilities of GAM116 include diagnosis, prevention and treatment of diseases and clinical conditions associated with LOC153232.

LOC153516 (Accession NP_612500.1) is another GAM116 target gene, herein designated TARGET GENE. LOC153516 BINDING SITE is a target binding site found in the 3' untranslated region of mRNA encoded by LOC153516, corresponding to a target binding site such as BINDING SITE I, BINDING SITE II or BINDING SITE III of FIG. 8. Table 4 illustrates the complementarity of the nucleotide sequences of LOC153516 BINDING SITE, designated SEQ ID:19757, to the nucleotide sequence of GAM116 RNA, herein designated GAM RNA, also designated SEQ ID:301.

Another function of GAM116 is therefore inhibition of LOC153516 (Accession NP_612500.1). Accordingly, utilities of GAM116 include diagnosis, prevention and treatment of diseases and clinical conditions associated with LOC153516.

LOC153811 (Accession XP_087779.2) is another GAM116 target gene, herein designated TARGET GENE. LOC153811 BINDING SITE is a target binding site found in the 5' untranslated region of mRNA encoded by LOC153811, corresponding to a target binding site such as BINDING SITE I, BINDING SITE II or BINDING SITE III of FIG. 8. Table 4 illustrates the complementarity of the nucleotide sequences of LOC153811 BINDING SITE, designated SEQ ID:12476, to the nucleotide sequence of GAM116 RNA, herein designated GAM RNA, also designated SEQ ID:301.

Another function of GAM116 is therefore inhibition of LOC153811 (Accession XP_087779.2). Accordingly, utilities of GAM116 include diagnosis, prevention and treatment of diseases and clinical conditions associated with LOC153811.

LOC157627 (Accession XP_088347.2) is another GAM116 target gene, herein designated TARGET GENE. LOC157627 BINDING SITE is a target binding site found in the 3' untranslated region of mRNA encoded by LOC157627, corresponding to a target binding site such as BINDING SITE I, BINDING SITE II or BINDING SITE III of FIG. 8. Table 4 illustrates the complementarity of the nucleotide sequences of LOC157627 BINDING SITE, designated SEQ ID:13960, to the nucleotide sequence of GAM116 RNA, herein designated GAM RNA, also designated SEQ ID:301.

Another function of GAM116 is therefore inhibition of LOC157627 (Accession XP_088347.2). Accordingly, utilities of GAM116 include diagnosis, prevention and treatment of diseases and clinical conditions associated with LOC157627.

LOC166077 (Accession XP_093643.3) is another GAM116 target gene, herein designated TARGET GENE. LOC166077 BINDING SITE is a target binding site found in the 5' untranslated region of mRNA encoded by LOC166077, corresponding to a target binding site such as BINDING SITE I, BINDING SITE II or BINDING SITE III of FIG. 8. Table 4 illustrates the complementarity of the nucleotide sequences of LOC166077 BINDING SITE, designated SEQ ID:12164, to the nucleotide sequence of GAM116 RNA, herein designated GAM RNA, also designated SEQ ID:301.

Another function of GAM116 is therefore inhibition of LOC166077 (Accession XP_093643.3). Accordingly, utilities of GAM116 include diagnosis, prevention and treatment of diseases and clinical conditions associated with LOC166077.

LOC201164 (Accession NP_849158.1) is another GAM116 target gene, herein designated TARGET GENE. LOC201164 BINDING SITE is a target binding site found in the 3' untranslated region of multiple transcripts of mRNA encoded by LOC201164, corresponding to a target binding site such as BINDING SITE I, BINDING SITE II or BINDING SITE III of FIG. 8. Table 4 illustrates the complementarity of the nucleotide sequences of LOC201164 BINDING SITE, designated SEQ ID:3600, to the nucleotide sequence of GAM116 RNA, herein designated GAM RNA, also designated SEQ ID:301.

Another function of GAM116 is therefore inhibition of LOC201164 (Accession NP_849158.1). Accordingly, utilities of GAM116 include diagnosis, prevention and treatment of diseases and clinical conditions associated with LOC201164.

LOC201164 (Accession XP_290750.1) is another GAM116 target gene, herein designated TARGET GENE. LOC201164 BINDING SITE is a target binding site found in the 3' untranslated region of multiple transcripts of mRNA encoded by LOC201164, corresponding to a target binding site such as BINDING SITE I, BINDING SITE II or BINDING SITE III of FIG. 8. Table 4 illustrates the complementarity of the nucleotide sequences of LOC201164 BINDING SITE, designated SEQ ID:3600, to the nucleotide sequence of GAM116 RNA, herein designated GAM RNA, also designated SEQ ID:301.

Another function of GAM116 is therefore inhibition of LOC201164 (Accession XP_290750.1). Accordingly, utilities of GAM116 include diagnosis, prevention and treatment of diseases and clinical conditions associated with LOC201164.

LOC203447 (Accession XP_114703.1) is another GAM116 target gene, herein designated TARGET GENE. LOC203447 BINDING SITE is a target binding site found in the 3' untranslated region of mRNA encoded by LOC203447, corresponding to a target binding site such as BINDING SITE I, BINDING SITE II or BINDING SITE III of FIG. 8. Table 4 illustrates the complementarity of the nucleotide sequences of LOC203447 BINDING SITE, designated SEQ ID:2716, to the nucleotide sequence of GAM116 RNA, herein designated GAM RNA, also designated SEQ ID:301.

Another function of GAM116 is therefore inhibition of LOC203447 (Accession XP_114703.1). Accordingly, utilities of GAM116 include diagnosis, prevention and treatment of diseases and clinical conditions associated with LOC203447.

LOC203562 (Accession XP_117553.1) is another GAM116 target gene, herein designated TARGET GENE. LOC203562 BINDING SITE is a target binding site found in the 5' untranslated region of mRNA encoded by LOC203562, corresponding to a target binding site such as BINDING SITE I, BINDING SITE II or BINDING SITE III of FIG. 8. Table 4 illustrates the complementarity of the nucleotide sequences of LOC203562 BINDING SITE, designated SEQ ID:11114, to the nucleotide sequence of GAM116 RNA, herein designated GAM RNA, also designated SEQ ID:301.

Another function of GAM116 is therefore inhibition of LOC203562 (Accession XP_117553.1). Accordingly, utilities of GAM116 include diagnosis, prevention and treatment of diseases and clinical conditions associated with LOC203562.

LOC219842 (Accession XP_167775.1) is another GAM116 target gene, herein designated TARGET GENE. LOC219842 BINDING SITE is a target binding site found in the 3' untranslated region of mRNA encoded by LOC219842, corresponding to a target binding site such as BINDING SITE I, BINDING SITE II or BINDING SITE III of FIG. 8. Table 4 illustrates the complementarity of the nucleotide sequences of LOC219842 BINDING SITE, designated SEQ ID:19459, to the nucleotide sequence of GAM116 RNA, herein designated GAM RNA, also designated SEQ ID:301.

Another function of GAM116 is therefore inhibition of LOC219842 (Accession XP_167775.1). Accordingly, utilities of GAM116 include diagnosis, prevention and treatment of diseases and clinical conditions associated with LOC219842.

LOC220635 (Accession XP_165433.1) is another GAM116 target gene, herein designated TARGET GENE. LOC220635 BINDING SITE is a target binding site found in the 3' untranslated region of mRNA encoded by LOC220635, corresponding to a target binding site such as BINDING SITE I, BINDING SITE II or BINDING SITE III of FIG. 8. Table 4 illustrates the complementarity of the nucleotide sequences of LOC220635 BINDING SITE, designated SEQ ID:13427, to the nucleotide sequence of GAM116 RNA, herein designated GAM RNA, also designated SEQ ID:301.

Another function of GAM116 is therefore inhibition of LOC220635 (Accession XP_165433.1). Accordingly, utilities of GAM116 include diagnosis, prevention and treatment of diseases and clinical conditions associated with LOC220635.

LOC253820 (Accession XP_171040.2) is another GAM116 target gene, herein designated TARGET GENE. LOC253820 BINDING SITE is a target binding site found in the 5' untranslated region of mRNA encoded by LOC253820, corresponding to a target binding site such as BINDING SITE I, BINDING SITE II or BINDING SITE III of FIG. 8. Table 4 illustrates the complementarity of the nucleotide sequences of LOC253820 BINDING SITE, designated SEQ ID:11595, to the nucleotide sequence of GAM116 RNA, herein designated GAM RNA, also designated SEQ ID:301.

Another function of GAM116 is therefore inhibition of LOC253820 (Accession XP_171040.2). Accordingly, utilities of GAM116 include diagnosis, prevention and treatment of diseases and clinical conditions associated with LOC253820.

LOC282905 (Accession XP_212606.1) is another GAM116 target gene, herein designated TARGET GENE. LOC282905 BINDING SITE is a target binding site found in the 5' untranslated region of mRNA encoded by LOC282905, corresponding to a target binding site such as BINDING SITE I, BINDING SITE II or BINDING SITE III of FIG. 8. Table 4 illustrates the complementarity of the nucleotide sequences of LOC282905 BINDING SITE, designated SEQ ID:15939, to the nucleotide sequence of GAM116 RNA, herein designated GAM RNA, also designated SEQ ID:301.

Another function of GAM116 is therefore inhibition of LOC282905 (Accession XP_212606.1). Accordingly, utilities of GAM116 include diagnosis, prevention and treatment of diseases and clinical conditions associated with LOC282905.

LOC282943 (Accession XP_212647.1) is another GAM116 target gene, herein designated TARGET GENE. LOC282943 BINDING SITE is a target binding site found in the 5' untranslated region of mRNA encoded by LOC282943, corresponding to a target binding site such as BINDING SITE I, BINDING SITE II or BINDING SITE III of FIG. 8. Table 4 illustrates the complementarity of the nucleotide sequences of LOC282943 BINDING SITE, designated SEQ ID:15939, to the nucleotide sequence of GAM116 RNA, herein designated GAM RNA, also designated SEQ ID:301.

Another function of GAM116 is therefore inhibition of LOC282943 (Accession XP_212647.1). Accordingly, utilities of GAM116 include diagnosis, prevention and treatment of diseases and clinical conditions associated with LOC282943.

LOC283295 (Accession XP_210964.1) is another GAM116 target gene, herein designated TARGET GENE. LOC283295 BINDING SITE is a target binding site found in the 3' untranslated region of mRNA encoded by LOC283295, corresponding to a target binding site such as BINDING SITE I, BINDING SITE II or BINDING SITE III of FIG. 8. Table 4 illustrates the complementarity of the nucleotide sequences of LOC283295 BINDING SITE, designated SEQ ID:4814, to the nucleotide sequence of GAM116 RNA, herein designated GAM RNA, also designated SEQ ID:301.

Another function of GAM116 is therefore inhibition of LOC283295 (Accession XP_210964.1). Accordingly, utilities of GAM116 include diagnosis, prevention and treatment of diseases and clinical conditions associated with LOC283295.

LOC283686 (Accession XP_211164.1) is another GAM116 target gene, herein designated TARGET GENE. LOC283686 BINDING SITE is a target binding site found in the 3' untranslated region of mRNA encoded by LOC283686, corresponding to a target binding site such as BINDING SITE I, BINDING SITE II or BINDING SITE III of FIG. 8. Table 4 illustrates the complementarity of the nucleotide sequences of LOC283686 BINDING SITE, designated SEQ ID:5207, to the nucleotide sequence of GAM116 RNA, herein designated GAM RNA, also designated SEQ ID:301.

Another function of GAM116 is therefore inhibition of LOC283686 (Accession XP_211164.1). Accordingly, utilities of GAM116 include diagnosis, prevention and treatment of diseases and clinical conditions associated with LOC283686.

LOC283889 (Accession XP_208899.1) is another GAM116 target gene, herein designated TARGET GENE. LOC283889 BINDING SITE is a target binding site found in the 3' untranslated region of mRNA encoded by LOC283889, corresponding to a target binding site such as BINDING SITE I, BINDING SITE II or BINDING SITE III of FIG. 8. Table 4 illustrates the complementarity of the nucleotide sequences of LOC283889 BINDING SITE, designated SEQ ID:19503, to the nucleotide sequence of GAM116 RNA, herein designated GAM RNA, also designated SEQ ID:301.

Another function of GAM116 is therefore inhibition of LOC283889 (Accession XP_208899.1). Accordingly, utilities of GAM116 include diagnosis, prevention and treatment of diseases and clinical conditions associated with LOC283889.

LOC283922 (Accession XP_208908.1) is another GAM116 target gene, herein designated TARGET GENE. LOC283922 BINDING SITE is a target binding site found in the 5' untranslated region of mRNA encoded by LOC283922, corresponding to a target binding site such as BINDING SITE I, BINDING SITE II or BINDING SITE III of FIG. 8. Table 4 illustrates the complementarity of the nucleotide sequences of LOC283922 BINDING SITE, designated SEQ ID:9479, to the nucleotide sequence of GAM116 RNA, herein designated GAM RNA, also designated SEQ ID:301.

Another function of GAM116 is therefore inhibition of LOC283922 (Accession XP_208908.1). Accordingly, utilities of GAM116 include diagnosis, prevention and treatment of diseases and clinical conditions associated with LOC283922.

LOC284048 (Accession XP_208152.1) is another GAM116 target gene, herein designated TARGET GENE. LOC284048 BINDING SITE is a target binding site found in the 3' untranslated region of mRNA encoded by LOC284048, corresponding to a target binding site such as BINDING SITE I, BINDING SITE II or BINDING SITE III of FIG. 8. Table 4 illustrates the complementarity of the nucleotide sequences of LOC284048 BINDING SITE, designated SEQ ID:11823, to the nucleotide sequence of GAM116 RNA, herein designated GAM RNA, also designated SEQ ID:301.

Another function of GAM116 is therefore inhibition of LOC284048 (Accession XP_208152.1). Accordingly, utilities of GAM116 include diagnosis, prevention and treatment of diseases and clinical conditions associated with LOC284048.

LOC284294 (Accession XP_211421.1) is another GAM116 target gene, herein designated TARGET GENE. LOC284294 BINDING SITE is a target binding site found in the 5' untranslated region of mRNA encoded by LOC284294, corresponding to a target binding site such as BINDING SITE I, BINDING SITE II or BINDING SITE III of FIG. 8. Table 4 illustrates the complementarity of the nucleotide sequences of LOC284294 BINDING SITE, designated SEQ ID:19309, to the nucleotide sequence of GAM116 RNA, herein designated GAM RNA, also designated SEQ ID:301.

Another function of GAM116 is therefore inhibition of LOC284294 (Accession XP_211421.1). Accordingly, utilities of GAM116 include diagnosis, prevention and treatment of diseases and clinical conditions associated with LOC284294.

LOC284462 (Accession XP_211475.1) is another GAM116 target gene, herein designated TARGET GENE. LOC284462 BINDING SITE is a target binding site found in the 3' untranslated region of mRNA encoded by LOC284462, corresponding to a target binding site such as BINDING SITE I, BINDING SITE II or BINDING SITE III of FIG. 8. Table 4 illustrates the complementarity of the nucleotide sequences of LOC284462 BINDING SITE, designated SEQ ID:19943, to the nucleotide sequence of GAM116 RNA, herein designated GAM RNA, also designated SEQ ID:301.

Another function of GAM116 is therefore inhibition of LOC284462 (Accession XP_211475.1). Accordingly, utilities of GAM116 include diagnosis, prevention and treatment of diseases and clinical conditions associated with LOC284462.

LOC284642 (Accession XP_208231.1) is another GAM116 target gene, herein designated TARGET GENE. LOC284642 BINDING SITE is a target binding site found in the 3' untranslated region of mRNA encoded by LOC284642, corresponding to a target binding site such as BINDING SITE I, BINDING SITE II or BINDING SITE III of FIG. 8. Table 4 illustrates the complementarity of the nucleotide sequences of LOC284642 BINDING SITE, designated SEQ ID:4242, to the nucleotide sequence of GAM116 RNA, herein designated GAM RNA, also designated SEQ ID:301.

Another function of GAM116 is therefore inhibition of LOC284642 (Accession XP_208231.1). Accordingly, utilities of GAM116 include diagnosis, prevention and treatment of diseases and clinical conditions associated with LOC284642.

LOC284828 (Accession XP_211650.1) is another GAM116 target gene, herein designated TARGET GENE. LOC284828 BINDING SITE is a target binding site found in the 5' untranslated region of mRNA encoded by LOC284828, corresponding to a target binding site such as BINDING SITE I, BINDING SITE II or BINDING SITE III of FIG. 8. Table 4 illustrates the complementarity of the nucleotide sequences of LOC284828 BINDING SITE, designated SEQ ID:9072, to the nucleotide sequence of GAM116 RNA, herein designated GAM RNA, also designated SEQ ID:301.

Another function of GAM116 is therefore inhibition of LOC284828 (Accession XP_211650.1). Accordingly, utilities of GAM116 include diagnosis, prevention and treatment of diseases and clinical conditions associated with LOC284828.

LOC284837 (Accession XP_211658.1) is another GAM116 target gene, herein designated TARGET GENE. LOC284837 BINDING SITE is a target binding site found in the 5' untranslated region of mRNA encoded by LOC284837, corresponding to a target binding site such as BINDING SITE I, BINDING SITE II or BINDING SITE III of FIG. 8. Table 4 illustrates the complementarity of the nucleotide sequences of LOC284837 BINDING SITE, designated SEQ ID:1526, to the nucleotide sequence of GAM116 RNA, herein designated GAM RNA, also designated SEQ ID:301.

Another function of GAM116 is therefore inhibition of LOC284837 (Accession XP_211658.1). Accordingly, utilities of GAM116 include diagnosis, prevention and treatment of diseases and clinical conditions associated with LOC284837.

LOC284947 (Accession XP_211705.1) is another GAM116 target gene, herein designated TARGET GENE. LOC284947 BINDING SITE is a target binding site found in the 3' untranslated region of mRNA encoded by LOC284947, corresponding to a target binding site such as BINDING SITE I, BINDING SITE II or BINDING SITE III of FIG. 8. Table 4 illustrates the complementarity of the nucleotide sequences of LOC284947 BINDING SITE, designated SEQ ID:1527, to the nucleotide sequence of GAM116 RNA, herein designated GAM RNA, also designated SEQ ID:301.

Another function of GAM116 is therefore inhibition of LOC284947 (Accession XP_211705.1). Accordingly, utilities of GAM116 include diagnosis, prevention and treatment of diseases and clinical conditions associated with LOC284947.

LOC285035 (Accession XP_209446.1) is another GAM116 target gene, herein designated TARGET GENE. LOC285035 BINDING SITE is a target binding site found in the 5' untranslated region of mRNA encoded by LOC285035, corresponding to a target binding site such as BINDING SITE I, BINDING SITE II or BINDING SITE III of FIG. 8. Table 4 illustrates the complementarity of the nucleotide sequences of LOC285035 BINDING SITE, designated SEQ ID:16141, to the nucleotide sequence of GAM116 RNA, herein designated GAM RNA, also designated SEQ ID:301.

Another function of GAM116 is therefore inhibition of LOC285035 (Accession XP_209446.1). Accordingly, utilities of GAM116 include diagnosis, prevention and treatment of diseases and clinical conditions associated with LOC285035.

LOC285131 (Accession XP_211772.1) is another GAM116 target gene, herein designated TARGET GENE. LOC285131 BINDING SITE is a target binding site found in the 5' untranslated region of mRNA encoded by LOC285131, corresponding to a target binding site such as BINDING SITE I, BINDING SITE II or BINDING SITE III of FIG. 8. Table 4 illustrates the complementarity of the nucleotide sequences of LOC285131 BINDING SITE, designated SEQ ID:15846, to the nucleotide sequence of GAM116 RNA, herein designated GAM RNA, also designated SEQ ID:301.

Another function of GAM116 is therefore inhibition of LOC285131 (Accession XP_211772.1). Accordingly, utilities of GAM116 include diagnosis, prevention and treatment of diseases and clinical conditions associated with LOC285131.

LOC285434 (Accession XP_209608.1) is another GAM116 target gene, herein designated TARGET GENE. LOC285434 BINDING SITE is a target binding site found in the 3' untranslated region of mRNA encoded by LOC285434, corresponding to a target binding site such as BINDING SITE I, BINDING SITE II or BINDING SITE III of FIG. 8. Table 4 illustrates the complementarity of the nucleotide sequences of LOC285434 BINDING SITE, designated SEQ ID:12379, to the nucleotide sequence of GAM116 RNA, herein designated GAM RNA, also designated SEQ ID:301.

Another function of GAM116 is therefore inhibition of LOC285434 (Accession XP_209608.1). Accordingly, utilities of GAM116 include diagnosis, prevention and treatment of diseases and clinical conditions associated with LOC285434.

LOC285560 (Accession XP_209660.1) is another GAM116 target gene, herein designated TARGET GENE. LOC285560 BINDING SITE is a target binding site found in the 3' untranslated region of mRNA encoded by LOC285560, corresponding to a target binding site such as BINDING SITE I, BINDING SITE II or BINDING SITE III of FIG. 8. Table 4 illustrates the complementarity of the nucleotide sequences of LOC285560 BINDING SITE, designated SEQ ID:19592, to the nucleotide sequence of GAM116 RNA, herein designated GAM RNA, also designated SEQ ID:301.

Another function of GAM116 is therefore inhibition of LOC285560 (Accession XP_209660.1). Accordingly, utilities of GAM116 include diagnosis, prevention and treatment of diseases and clinical conditions associated with LOC285560.

LOC285727 (Accession XP_212000.1) is another GAM116 target gene, herein designated TARGET GENE. LOC285727 BINDING SITE is a target binding site found in the 3' untranslated region of mRNA encoded by LOC285727, corresponding to a target binding site such as BINDING SITE I, BINDING SITE II or BINDING SITE III of FIG. 8. Table 4 illustrates the complementarity of the nucleotide sequences of LOC285727 BINDING SITE, designated SEQ ID:4300, to the nucleotide sequence of GAM116 RNA, herein designated GAM RNA, also designated SEQ ID:301.

Another function of GAM116 is therefore inhibition of LOC285727 (Accession XP_212000.1). Accordingly, utilities of GAM116 include diagnosis, prevention and treatment of diseases and clinical conditions associated with LOC285727.

LOC285830 (Accession XP_212043.1) is another GAM116 target gene, herein designated TARGET GENE. LOC285830 BINDING SITE is a target binding site found in the 5' untranslated region of mRNA encoded by LOC285830, corresponding to a target binding site such as BINDING SITE I, BINDING SITE II or BINDING SITE III of FIG. 8. Table 4 illustrates the complementarity of the nucleotide sequences of LOC285830 BINDING SITE, designated SEQ ID:15939, to the nucleotide sequence of GAM116 RNA, herein designated GAM RNA, also designated SEQ ID:301.

Another function of GAM116 is therefore inhibition of LOC285830 (Accession XP_212043.1). Accordingly, utilities of GAM116 include diagnosis, prevention and treatment of diseases and clinical conditions associated with LOC285830.

LOC285939 (Accession XP_208364.1) is another GAM116 target gene, herein designated TARGET GENE. LOC285939 BINDING SITE is a target binding site found in the 3' untranslated region of mRNA encoded by LOC285939, corresponding to a target binding site such as BINDING SITE I, BINDING SITE II or BINDING SITE III of FIG. 8. Table 4 illustrates the complementarity of the nucleotide sequences of LOC285939 BINDING SITE, designated SEQ ID:3194, to the nucleotide sequence of GAM116 RNA, herein designated GAM RNA, also designated SEQ ID:301.

Another function of GAM116 is therefore inhibition of LOC285939 (Accession XP_208364.1). Accordingly, utilities of GAM116 include diagnosis, prevention and treatment of diseases and clinical conditions associated with LOC285939.

LOC286026 (Accession XP_212119.1) is another GAM116 target gene, herein designated TARGET GENE. LOC286026 BINDING SITE is a target binding site found in the 5' untranslated region of mRNA encoded by LOC286026, corresponding to a target binding site such as BINDING SITE I, BINDING SITE II or BINDING SITE III of FIG. 8. Table 4 illustrates the complementarity of the nucleotide sequences of LOC286026 BINDING SITE, designated SEQ ID:5267, to the nucleotide sequence of GAM116 RNA, herein designated GAM RNA, also designated SEQ ID:301.

Another function of GAM116 is therefore inhibition of LOC286026 (Accession XP_212119.1). Accordingly, utilities of GAM116 include diagnosis, prevention and treatment of diseases and clinical conditions associated with LOC286026.

LOC286126 (Accession XP_212185.1) is another GAM116 target gene, herein designated TARGET GENE. LOC286126 BINDING SITE is a target binding site found in the 3' untranslated region of mRNA encoded by LOC286126, corresponding to a target binding site such as BINDING SITE I, BINDING SITE II or BINDING SITE III of FIG. 8. Table 4 illustrates the complementarity of the nucleotide sequences of LOC286126 BINDING SITE, designated SEQ ID:12515, to the nucleotide sequence of GAM116 RNA, herein designated GAM RNA, also designated SEQ ID:301.

Another function of GAM116 is therefore inhibition of LOC286126 (Accession XP_212185.1). Accordingly, utilities of GAM116 include diagnosis, prevention and treatment of diseases and clinical conditions associated with LOC286126.

LOC286500 (Accession XP_210080.1) is another GAM116 target gene, herein designated TARGET GENE. LOC286500 BINDING SITE is a target binding site found in the 3' untranslated region of mRNA encoded by LOC286500, corresponding to a target binding site such as BINDING SITE I, BINDING SITE II or BINDING SITE III of FIG. 8. Table 4 illustrates the complementarity of the nucleotide sequences of LOC286500 BINDING SITE, designated SEQ ID:9848, to the nucleotide sequence of GAM116 RNA, herein designated GAM RNA, also designated SEQ ID:301.

Another function of GAM116 is therefore inhibition of LOC286500 (Accession XP_210080.1). Accordingly, utilities of GAM116 include diagnosis, prevention and treatment of diseases and clinical conditions associated with LOC286500.

LOC338959 (Accession XP_294754.1) is another GAM116 target gene, herein designated TARGET GENE. LOC338959 BINDING SITE is a target binding site found in the 5' untranslated region of mRNA encoded by LOC338959, corresponding to a target binding site such as BINDING SITE I, BINDING SITE II or BINDING SITE III of FIG. 8. Table 4 illustrates the complementarity of the nucleotide sequences of LOC338959 BINDING SITE, designated SEQ ID:6175, to the nucleotide sequence of GAM116 RNA, herein designated GAM RNA, also designated SEQ ID:301.

Another function of GAM116 is therefore inhibition of LOC338959 (Accession XP_294754.1). Accordingly, utilities of GAM116 include diagnosis, prevention and treatment of diseases and clinical conditions associated with LOC338959.

LOC338987 (Accession XP_290664.1) is another GAM116 target gene, herein designated TARGET GENE. LOC338987 BINDING SITE is a target binding site found in the 3' untranslated region of mRNA encoded by LOC338987, corresponding to a target binding site such as BINDING SITE I, BINDING SITE II or BINDING SITE III of FIG. 8. Table 4 illustrates the complementarity of the nucleotide sequences of LOC338987 BINDING SITE, designated SEQ ID:3739, to the nucleotide sequence of GAM116 RNA, herein designated GAM RNA, also designated SEQ ID:301.

Another function of GAM116 is therefore inhibition of LOC338987 (Accession XP_290664.1). Accordingly, utilities of GAM116 include diagnosis, prevention and treatment of diseases and clinical conditions associated with LOC338987.

LOC339494 (Accession XP_290925.1) is another GAM116 target gene, herein designated TARGET GENE. LOC339494 BINDING SITE is a target binding site found in the 5' untranslated region of mRNA encoded by LOC339494, corresponding to a target binding site such as BINDING SITE I, BINDING SITE II or BINDING SITE III of FIG. 8. Table 4 illustrates the complementarity of the nucleotide sequences of LOC339494 BINDING SITE, designated SEQ ID:17103, to the nucleotide sequence of GAM116 RNA, herein designated GAM RNA, also designated SEQ ID:301.

Another function of GAM116 is therefore inhibition of LOC339494 (Accession XP_290925.1). Accordingly, utilities of GAM116 include diagnosis, prevention and treatment of diseases and clinical conditions associated with LOC339494.

LOC339622 (Accession XP_295016.1) is another GAM116 target gene, herein designated TARGET GENE. LOC339622 BINDING SITE is a target binding site found in the 5' untranslated region of mRNA encoded by LOC339622, corresponding to a target binding site such as BINDING SITE I, BINDING SITE II or BINDING SITE III of FIG. 8. Table 4 illustrates the complementarity of the nucleotide sequences of LOC339622 BINDING SITE, designated SEQ ID:8835, to the nucleotide sequence of GAM116 RNA, herein designated GAM RNA, also designated SEQ ID:301.

Another function of GAM116 is therefore inhibition of LOC339622 (Accession XP_295016.1). Accordingly, utilities of GAM116 include diagnosis, prevention and treatment of diseases and clinical conditions associated with LOC339622.

LOC339659 (Accession XP_290981.1) is another GAM116 target gene, herein designated TARGET GENE. LOC339659 BINDING SITE is a target binding site found in the 3' untranslated region of mRNA encoded by LOC339659, corresponding to a target binding site such as BINDING SITE I, BINDING SITE II or BINDING SITE III of FIG. 8. Table 4 illustrates the complementarity of the nucleotide sequences of LOC339659 BINDING SITE, designated SEQ ID:2508, to the nucleotide sequence of GAM116 RNA, herein designated GAM RNA, also designated SEQ ID:301.

Another function of GAM116 is therefore inhibition of LOC339659 (Accession XP_290981.1). Accordingly, utilities of GAM116 include diagnosis, prevention and treatment of diseases and clinical conditions associated with LOC339659.

LOC340128 (Accession XP_295164.2) is another GAM116 target gene, herein designated TARGET GENE. LOC340128 BINDING SITE is a target binding site found in the 5' untranslated region of mRNA encoded by LOC340128, corresponding to a target binding site such as BINDING SITE I, BINDING SITE II or BINDING SITE III of FIG. 8. Table 4 illustrates the complementarity of the nucleotide sequences of LOC340128 BINDING SITE, designated SEQ ID:2717, to the nucleotide sequence of GAM116 RNA, herein designated GAM RNA, also designated SEQ ID:301.

Another function of GAM116 is therefore inhibition of LOC340128 (Accession XP_295164.2). Accordingly, utilities of GAM116 include diagnosis, prevention and treatment of diseases and clinical conditions associated with LOC340128.

LOC340449 (Accession XP_290424.2) is another GAM116 target gene, herein designated TARGET GENE. LOC340449 BINDING SITE is a target binding site found in the 3' untranslated region of mRNA encoded by LOC340449, corresponding to a target binding site such as BINDING SITE I, BINDING SITE II or BINDING SITE III of FIG. 8. Table 4 illustrates the complementarity of the nucleotide sequences of LOC340449 BINDING SITE, designated SEQ ID:17429, to the nucleotide sequence of GAM116 RNA, herein designated GAM RNA, also designated SEQ ID:301.

Another function of GAM116 is therefore inhibition of LOC340449 (Accession XP_290424.2). Accordingly, utilities of GAM116 include diagnosis, prevention and treatment of diseases and clinical conditions associated with LOC340449.

LOC341041 (Accession XP_295977.1) is another GAM116 target gene, herein designated TARGET GENE. LOC341041 BINDING SITE is a target binding site found in the 3' untranslated region of mRNA encoded by LOC341041, corresponding to a target binding site such as BINDING SITE I, BINDING SITE II or BINDING SITE III of FIG. 8. Table 4 illustrates the complementarity of the nucleotide sequences of LOC341041 BINDING SITE, designated SEQ ID:19443, to the nucleotide sequence of GAM116 RNA, herein designated GAM RNA, also designated SEQ ID:301.

Another function of GAM116 is therefore inhibition of LOC341041 (Accession XP_295977.1). Accordingly, utilities of GAM116 include diagnosis, prevention and treatment of diseases and clinical conditions associated with LOC341041.

LOC343838 (Accession XP_293260.2) is another GAM116 target gene, herein designated TARGET GENE. LOC343838 BINDING SITE is a target binding site found in the 5' untranslated region of mRNA encoded by LOC343838, corresponding to a target binding site such as BINDING SITE I, BINDING SITE II or BINDING SITE III of FIG. 8. Table 4 illustrates the complementarity of the nucleotide sequences of LOC343838 BINDING SITE, designated SEQ ID:19387, to the nucleotide sequence of GAM116 RNA, herein designated GAM RNA, also designated SEQ ID:301.

Another function of GAM116 is therefore inhibition of LOC343838 (Accession XP_293260.2). Accordingly, utilities of GAM116 include diagnosis, prevention and treatment of diseases and clinical conditions associated with LOC343838.

LOC344622 (Accession XP_293503.1) is another GAM116 target gene, herein designated TARGET GENE. LOC344622 BINDING SITE is a target binding site found in the 5' untranslated region of mRNA encoded by LOC344622, corresponding to a target binding site such as BINDING SITE I, BINDING SITE II or BINDING SITE III of FIG. 8. Table 4 illustrates the complementarity of the nucleotide sequences of LOC344622 BINDING SITE, designated SEQ ID:4215, to the nucleotide sequence of GAM116 RNA, herein designated GAM RNA, also designated SEQ ID:301.

Another function of GAM116 is therefore inhibition of LOC344622 (Accession XP_293503.1). Accordingly, utilities of GAM116 include diagnosis, prevention and treatment of diseases and clinical conditions associated with LOC344622.

LOC347767 (Accession XP_300531.1) is another GAM116 target gene, herein designated TARGET GENE. LOC347767 BINDING SITE is a target binding site found in the 3' untranslated region of mRNA encoded by LOC347767, corresponding to a target binding site such as BINDING SITE I, BINDING SITE II or BINDING SITE III of FIG. 8. Table 4 illustrates the complementarity of the nucleotide sequences of LOC347767 BINDING SITE, designated SEQ ID:17800, to the nucleotide sequence of GAM116 RNA, herein designated GAM RNA, also designated SEQ ID:301.

Another function of GAM116 is therefore inhibition of LOC347767 (Accession XP_300531.1). Accordingly, utilities of GAM116 include diagnosis, prevention and treatment of diseases and clinical conditions associated with LOC347767.

LOC347924 (Accession XP_300570.1) is another GAM116 target gene, herein designated TARGET GENE. LOC347924 BINDING SITE is a target binding site found in the 5' untranslated region of mRNA encoded by LOC347924, corresponding to a target binding site such as BINDING SITE I, BINDING SITE II or BINDING SITE III of FIG. 8. Table 4 illustrates the complementarity of the nucleotide sequences of LOC347924 BINDING SITE, designated SEQ ID:18280, to the nucleotide sequence of GAM116 RNA, herein designated GAM RNA, also designated SEQ ID:301.

Another function of GAM116 is therefore inhibition of LOC347924 (Accession XP_300570.1). Accordingly, utilities of GAM116 include diagnosis, prevention and treatment of diseases and clinical conditions associated with LOC347924.

LOC348035 (Accession XP_300595.1) is another GAM116 target gene, herein designated TARGET GENE. LOC348035 BINDING SITE is a target binding site found in the 3' untranslated region of mRNA encoded by LOC348035, corresponding to a target binding site such as BINDING SITE I, BINDING SITE II or BINDING SITE III of FIG. 8. Table 4 illustrates the complementarity of the nucleotide sequences of LOC348035 BINDING SITE, designated SEQ ID:11344, to the nucleotide sequence of GAM116 RNA, herein designated GAM RNA, also designated SEQ ID:301.

Another function of GAM116 is therefore inhibition of LOC348035 (Accession XP_300595.1). Accordingly, utilities of GAM116 include diagnosis, prevention and treatment of diseases and clinical conditions associated with LOC348035.

LOC348182 (Accession XP_302676.1) is another GAM116 target gene, herein designated TARGET GENE. LOC348182 BINDING SITE is a target binding site found in the 5' untranslated region of mRNA encoded by LOC348182, corresponding to a target binding site such as BINDING SITE I, BINDING SITE II or BINDING SITE III of FIG. 8. Table 4 illustrates the complementarity of the nucleotide sequences of LOC348182 BINDING SITE, designated SEQ ID:5461, to the nucleotide sequence of GAM116 RNA, herein designated GAM RNA, also designated SEQ ID:301.

Another function of GAM116 is therefore inhibition of LOC348182 (Accession XP_302676.1). Accordingly, utilities of GAM116 include diagnosis, prevention and treatment of diseases and clinical conditions associated with LOC348182.

LOC348720 (Accession XP_300397.1) is another GAM116 target gene, herein designated TARGET GENE. LOC348720 BINDING SITE is a target binding site found in the 3' untranslated region of mRNA encoded by LOC348720, corresponding to a target binding site such as BINDING SITE I, BINDING SITE II or BINDING SITE III of FIG. 8. Table 4 illustrates the complementarity of the nucleotide sequences of LOC348720 BINDING SITE, designated SEQ ID:13427, to the nucleotide sequence of GAM116 RNA, herein designated GAM RNA, also designated SEQ ID:301.

Another function of GAM116 is therefore inhibition of LOC348720 (Accession XP_300397.1). Accordingly, utilities of GAM116 include diagnosis, prevention and treatment of diseases and clinical conditions associated with LOC348720.

LOC348761 (Accession XP_302869.1) is another GAM116 target gene, herein designated TARGET GENE. LOC348761 BINDING SITE is a target binding site found in the 3' untranslated region of mRNA encoded by LOC348761, corresponding to a target binding site such as BINDING SITE I, BINDING SITE II or BINDING SITE III of FIG. 8. Table 4 illustrates the complementarity of the nucleotide sequences of LOC348761 BINDING SITE, designated SEQ ID:15606, to the nucleotide sequence of GAM116 RNA, herein designated GAM RNA, also designated SEQ ID:301.

Another function of GAM116 is therefore inhibition of LOC348761 (Accession XP_302869.1). Accordingly, utilities of GAM116 include diagnosis, prevention and treatment of diseases and clinical conditions associated with LOC348761.

LOC348769 (Accession XP_300403.1) is another GAM116 target gene, herein designated TARGET GENE. LOC348769 BINDING SITE is a target binding site found in the 3' untranslated region of mRNA encoded by LOC348769, corresponding to a target binding site such as BINDING SITE I, BINDING SITE II or BINDING SITE III of FIG. 8. Table 4 illustrates the complementarity of the nucleotide sequences of LOC348769 BINDING SITE, designated SEQ ID:13427, to the nucleotide sequence of GAM116 RNA, herein designated GAM RNA, also designated SEQ ID:301.

Another function of GAM116 is therefore inhibition of LOC348769 (Accession XP_300403.1). Accordingly, utilities of GAM116 include diagnosis, prevention and treatment of diseases and clinical conditions associated with LOC348769.

LOC348780 (Accession XP_302884.1) is another GAM116 target gene, herein designated TARGET GENE. LOC348780 BINDING SITE is a target binding site found in the 5' untranslated region of mRNA encoded by LOC348780, corresponding to a target binding site such as BINDING SITE I, BINDING SITE II or BINDING SITE III of FIG. 8. Table 4 illustrates the complementarity of the nucleotide sequences of LOC348780 BINDING SITE, designated SEQ ID:10129, to the nucleotide sequence of GAM116 RNA, herein designated GAM RNA, also designated SEQ ID:301.

Another function of GAM116 is therefore inhibition of LOC348780 (Accession XP_302884.1). Accordingly, utilities of GAM116 include diagnosis, prevention and treatment of diseases and clinical conditions associated with LOC348780.

LOC349277 (Accession XP_303016.1) is another GAM116 target gene, herein designated TARGET GENE.

LOC349277 BINDING SITE is a target binding site found in the 5' untranslated region of mRNA encoded by LOC349277, corresponding to a target binding site such as BINDING SITE I, BINDING SITE II or BINDING SITE III of FIG. 8. Table 4 illustrates the complementarity of the nucleotide sequences of LOC349277 BINDING SITE, designated SEQ ID:16327, to the nucleotide sequence of GAM116 RNA, herein designated GAM RNA, also designated SEQ ID:301.

Another function of GAM116 is therefore inhibition of LOC349277 (Accession XP_303016.1). Accordingly, utilities of GAM116 include diagnosis, prevention and treatment of diseases and clinical conditions associated with LOC349277.

LOC56181 (Accession NP_062457.2) is another GAM116 target gene, herein designated TARGET GENE. LOC56181 BINDING SITE is a target binding site found in the 5' untranslated region of mRNA encoded by LOC56181, corresponding to a target binding site such as BINDING SITE I, BINDING SITE II or BINDING SITE III of FIG. 8. Table 4 illustrates the complementarity of the nucleotide sequences of LOC56181 BINDING SITE, designated SEQ ID:18280, to the nucleotide sequence of GAM116 RNA, herein designated GAM RNA, also designated SEQ ID:301.

Another function of GAM116 is therefore inhibition of LOC56181 (Accession NP_062457.2). Accordingly, utilities of GAM116 include diagnosis, prevention and treatment of diseases and clinical conditions associated with LOC56181.

LOC57117 (Accession NP_065128.2) is another GAM116 target gene, herein designated TARGET GENE. LOC57117 BINDING SITE is a target binding site found in the 5' untranslated region of mRNA encoded by LOC57117, corresponding to a target binding site such as BINDING SITE I, BINDING SITE II or BINDING SITE III of FIG. 8. Table 4 illustrates the complementarity of the nucleotide sequences of LOC57117 BINDING SITE, designated SEQ ID:3740, to the nucleotide sequence of GAM116 RNA, herein designated GAM RNA, also designated SEQ ID:301.

Another function of GAM116 is therefore inhibition of LOC57117 (Accession NP_065128.2). Accordingly, utilities of GAM116 include diagnosis, prevention and treatment of diseases and clinical conditions associated with LOC57117.

LOC83693 (Accession NP_113651.3) is another GAM116 target gene, herein designated TARGET GENE. LOC83693 BINDING SITE is a target binding site found in the 3' untranslated region of mRNA encoded by LOC83693, corresponding to a target binding site such as BINDING SITE I, BINDING SITE II or BINDING SITE III of FIG. 8. Table 4 illustrates the complementarity of the nucleotide sequences of LOC83693 BINDING SITE, designated SEQ ID:8686, to the nucleotide sequence of GAM116 RNA, herein designated GAM RNA, also designated SEQ ID:301.

Another function of GAM116 is therefore inhibition of LOC83693 (Accession NP_113651.3). Accordingly, utilities of GAM116 include diagnosis, prevention and treatment of diseases and clinical conditions associated with LOC83693.

LOC91768 (Accession NP_612384.1) is another GAM116 target gene, herein designated TARGET GENE. LOC91768 BINDING SITE is a target binding site found in the 3' untranslated region of mRNA encoded by LOC91768, corresponding to a target binding site such as BINDING SITE I, BINDING SITE II or BINDING SITE III of FIG. 8. Table 4 illustrates the complementarity of the nucleotide sequences of LOC91768 BINDING SITE, designated SEQ ID:2057, to the nucleotide sequence of GAM116 RNA, herein designated GAM RNA, also designated SEQ ID:301.

Another function of GAM116 is therefore inhibition of LOC91768 (Accession NP_612384.1). Accordingly, utilities of GAM116 include diagnosis, prevention and treatment of diseases and clinical conditions associated with LOC91768.

LOC92568 (Accession XP_045852.1) is another GAM116 target gene, herein designated TARGET GENE. LOC92568 BINDING SITE is a target binding site found in the 3' untranslated region of mRNA encoded by LOC92568, corresponding to a target binding site such as BINDING SITE I, BINDING SITE II or BINDING SITE III of FIG. 8. Table 4 illustrates the complementarity of the nucleotide sequences of LOC92568 BINDING SITE, designated SEQ ID:18855, to the nucleotide sequence of GAM116 RNA, herein designated GAM RNA, also designated SEQ ID:301.

Another function of GAM116 is therefore inhibition of LOC92568 (Accession XP_045852.1). Accordingly, utilities of GAM116 include diagnosis, prevention and treatment of diseases and clinical conditions associated with LOC92568.

LOC93463 (Accession XP_051528.1) is another GAM116 target gene, herein designated TARGET GENE. LOC93463 BINDING SITE is a target binding site found in the 3' untranslated region of mRNA encoded by LOC93463, corresponding to a target binding site such as BINDING SITE I, BINDING SITE II or BINDING SITE III of FIG. 8. Table 4 illustrates the complementarity of the nucleotide sequences of LOC93463 BINDING SITE, designated SEQ ID:16757, to the nucleotide sequence of GAM116 RNA, herein designated GAM RNA, also designated SEQ ID:301.

Another function of GAM116 is therefore inhibition of LOC93463 (Accession XP_051528.1). Accordingly, utilities of GAM116 include diagnosis, prevention and treatment of diseases and clinical conditions associated with LOC93463.

LOC94105 (Accession NP_149986.1) is another GAM116 target gene, herein designated TARGET GENE. LOC94105 BINDING SITE is a target binding site found in the 5' untranslated region of mRNA encoded by LOC94105, corresponding to a target binding site such as BINDING SITE I, BINDING SITE II or BINDING SITE III of FIG. 8. Table 4 illustrates the complementarity of the nucleotide sequences of LOC94105 BINDING SITE, designated SEQ ID:13826, to the nucleotide sequence of GAM116 RNA, herein designated GAM RNA, also designated SEQ ID:301.

Another function of GAM116 is therefore inhibition of LOC94105 (Accession NP_149986.1). Accordingly, utilities of GAM116 include diagnosis, prevention and treatment of diseases and clinical conditions associated with LOC94105.

Loss of heterozygosity, 11, chromosomal region 2, gene a (LOH11CR2A, Accession NP_055437.1) is another GAM116 target gene, herein designated TARGET GENE. LOH11CR2A BINDING SITE is a target binding site found in the 3' untranslated region of mRNA encoded by LOH11CR2A, corresponding to a target binding site such as BINDING SITE I, BINDING SITE II or BINDING SITE III of FIG. 8. Table 4 illustrates the complementarity of the nucleotide sequences of LOH11CR2A BINDING SITE, designated SEQ ID:12927, to the nucleotide sequence of GAM116 RNA, herein designated GAM RNA, also designated SEQ ID:301.

Another function of GAM116 is therefore inhibition of Loss of heterozygosity, 11, chromosomal region 2, gene a (LOH11CR2A, Accession NP_055437.1). Accordingly, utilities of GAM116 include diagnosis, prevention and treatment of diseases and clinical conditions associated with LOH11CR2A.

Mitogen-activated protein kinase kinase kinase 7 (MAP3K7, Accession NP_663305.1) is another GAM116 target gene, herein designated TARGET GENE. MAP3K7 BINDING SITE is a target binding site found in the 3' untranslated region of multiple transcripts of mRNA encoded by MAP3K7, corresponding to a target binding site such as BINDING SITE I, BINDING SITE II or BINDING SITE III of FIG. 8. Table 4 illustrates the complementarity of the nucleotide sequences of MAP3K7 BINDING SITE, designated SEQ ID:13790, to the nucleotide sequence of GAM116 RNA, herein designated GAM RNA, also designated SEQ ID:301.

Another function of GAM116 is therefore inhibition of Mitogen-activated protein kinase kinase kinase 7 (MAP3K7, Accession NP_663305.1), a gene which can phosphorylate and activate yet undefined mapkks. mediator of tgf-beta signal transduction. stimulates nf-kappa b activation. Accordingly, utilities of GAM116 include diagnosis, prevention and treatment of diseases and clinical conditions associated with MAP3K7.

The function of MAP3K7 has been established by previous studies. The MAP kinase (MAPK) cascades constitute functional units that couple upstream input signals to a variety of outputs through pathways that involve 3 protein kinases. MAPKKK (MAP3K; OMIM Ref. No. 602448) phosphorylates MAPKK (MAP2K; OMIM Ref. No. 176872), which in turn phosphorylates and activates MAPK (see OMIM Ref. No. 176948). One MAPK pathway in S. cerevisiae controls the response to mating pheromone. Yamaguchi et al. (1995) screened a mouse cDNA library for clones that could act as MAPKKKs, suppressing a defect in the mating pheromone response pathway. They identified a cDNA that encodes a predicted 579-amino acid protein, which they named TAK1 (TGF-beta-activated kinase). TAK1 has a putative N-terminal protein kinase domain. In mammalian cells, TAK1 regulates transcription by transforming growth factor-beta (TGFB; 190180). Only TAK1 protein missing the N-terminal 22 amino acids suppressed the yeast defect. This activated form also signaled in the absence of TGFB in mammalian cells Kondo et al. (1998) identified human ESTs that were homologous to mouse TAK1 and used the resulting sequence information to clone human TAK1 from lung cDNA. The predicted 579-amino acid human TAK1 protein is 99% identical to the mouse TAK1 protein. On Northern blots, TAK1 was expressed as a 3-kb mRNA in all tissues tested. Kondo et al. (1998) found 2 isoforms of TAK1 that differed by an insertion of 27 amino acids after amino acid 403

Full details of the abovementioned studies are described in the following publications, the disclosure of which are hereby incorporated by reference:

Yamaguchi, K.; Shirakabe, K.; Shibuy, H.; Irie, K.; Oishi, I.; Ueno, N.; Taniguchi, T.; Nishida, E.; Matsumoto, K.: Identification of a member of the MAPKKK family as a potential mediator of TGF-beta signal transduction. Science 270:2008-2011, 1995; and Kondo, M.; Osada, H.; Uchida, K.; Yanagisawa, K.; Masuda, A.; Takagi, K.; Takahashi, T.; Takahashi, T.: Molecular cloning of human TAK1 and its mutational analysis in human lung cancer.

Further studies establishing the function and utilities of MAP3K7 are found in John Hopkins OMIM database record ID 602614, and in cited publications listed in Table 5, which are hereby incorporated by reference. Mitogen-activated protein kinase kinase kinase 7 (MAP3K7, Accession NP_663306.1) is another GAM116 target gene, herein designated TARGET GENE. MAP3K7 BINDING SITE is a target binding site found in the 3' untranslated region of multiple transcripts of mRNA encoded by MAP3K7, corresponding to a target binding site such as BINDING SITE I, BINDING SITE II or BINDING SITE III of FIG. 8. Table 4 illustrates the complementarity of the nucleotide sequences of MAP3K7 BINDING SITE, designated SEQ ID:13790, to the nucleotide sequence of GAM116 RNA, herein designated GAM RNA, also designated SEQ ID:301.

Another function of GAM116 is therefore inhibition of Mitogen-activated protein kinase kinase kinase 7 (MAP3K7, Accession NP_663306.1), a gene which can phosphorylate and activate yet undefined mapkks. mediator of tgf-beta signal transduction. stimulates nf-kappa b activation. Accordingly, utilities of GAM116 include diagnosis, prevention and treatment of diseases and clinical conditions associated with MAP3K7.

The function of MAP3K7 has been established by previous studies. The MAP kinase (MAPK) cascades constitute functional units that couple upstream input signals to a variety of outputs through pathways that involve 3 protein kinases. MAPKKK (MAP3K; OMIM Ref. No. 602448) phosphorylates MAPKK (MAP2K; OMIM Ref. No. 176872), which in turn phosphorylates and activates MAPK (see OMIM Ref. No. 176948). One MAPK pathway in S. cerevisiae controls the response to mating pheromone. Yamaguchi et al. (1995) screened a mouse cDNA library for clones that could act as MAPKKKs, suppressing a defect in the mating pheromone response pathway. They identified a cDNA that encodes a predicted 579-amino acid protein, which they named TAK1 (TGF-beta-activated kinase). TAK1 has a putative N-terminal protein kinase domain. In mammalian cells, TAK1 regulates transcription by transforming growth factor-beta (TGFB; 190180). Only TAK1 protein missing the N-terminal 22 amino acids suppressed the yeast defect. This activated form also signaled in the absence of TGFB in mammalian cells Kondo et al. (1998) identified human ESTs that were homologous to mouse TAK1 and used the resulting sequence information to clone human TAK1 from lung cDNA. The predicted 579-amino acid human TAK1 protein is 99% identical to the mouse TAK1 protein. On Northern blots, TAK1 was expressed as a 3-kb mRNA in all tissues tested. Kondo et al. (1998) found 2 isoforms of TAK1 that differed by an insertion of 27 amino acids after amino acid 403

Full details of the abovementioned studies are described in the following publications, the disclosure of which are hereby incorporated by reference:

Yamaguchi, K.; Shirakabe, K.; Shibuy, H.; Irie, K.; Oishi, I.; Ueno, N.; Taniguchi, T.; Nishida, E.; Matsumoto, K.: Identification of a member of the MAPKKK family as a potential mediator of TGF-beta signal transduction. Science 270:2008-2011, 1995; and Kondo, M.; Osada, H.; Uchida, K.; Yanagisawa, K.; Masuda, A.; Takagi, K.; Takahashi, T.; Takahashi, T.: Molecular cloning of human TAK1 and its mutational analysis in human lung cancer.

Further studies establishing the function and utilities of MAP3K7 are found in John Hopkins OMIM database record ID 602614, and in cited publications listed in Table 5, which are hereby incorporated by reference. MAPKBP1 (Accession XP_031706.7) is another GAM116 target gene, herein designated TARGET GENE. MAPKBP1 BINDING SITE is a target binding site found in the 3' untranslated region of mRNA encoded by MAPKBP1, corresponding to a target binding site such as BINDING SITE I, BINDING SITE II or BINDING SITE III of FIG. 8. Table 4 illustrates the complementarity of the nucleotide sequences of MAPKBP1 BINDING SITE, designated SEQ ID:19619, to the nucleotide sequence of GAM116 RNA, herein designated GAM RNA, also designated SEQ ID:301.

Another function of GAM116 is therefore inhibition of MAPKBP1 (Accession XP_031706.7). Accordingly, utilities of GAM116 include diagnosis, prevention and treatment of diseases and clinical conditions associated with MAPKBP1.

Myeloid cell leukemia sequence 1 (bcl2-related) (MCL1, Accession NP_068779.1) is another GAM116 target gene, herein designated TARGET GENE. MCL1 BINDING SITE is a target binding site found in the 3' untranslated region of mRNA encoded by MCL1, corresponding to a target binding site such as BINDING SITE I, BINDING SITE II or BINDING SITE III of FIG. 8. Table 4 illustrates the complementarity of the nucleotide sequences of MCL1 BINDING SITE, designated SEQ ID:3273, to the nucleotide sequence of GAM116 RNA, herein designated GAM RNA, also designated SEQ ID:301.

Another function of GAM116 is therefore inhibition of Myeloid cell leukemia sequence 1 (bcl2-related) (MCL1, Accession NP_068779.1), a gene which involved in programing of differentiation and concomitant maintenance of viability. Accordingly, utilities of GAM116 include diagnosis, prevention and treatment of diseases and clinical conditions associated with MCL1.

The function of MCL1 and its association with various diseases and clinical conditions, has been established by previous studies, as described hereinabove with reference to GAM65.1. Myod family inhibitor (MDFI, Accession NP_005577.1) is another GAM116 target gene, herein designated TARGET GENE. MDFI BINDING SITE is a target binding site found in the 3' untranslated region of mRNA encoded by MDFI, corresponding to a target binding site such as BINDING SITE I, BINDING SITE II or BINDING SITE III of FIG. 8. Table 4 illustrates the complementarity of the nucleotide sequences of MDFI BINDING SITE, designated SEQ ID:7809, to the nucleotide sequence of GAM116 RNA, herein designated GAM RNA, also designated SEQ ID:301.

Another function of GAM116 is therefore inhibition of Myod family inhibitor (MDFI, Accession NP_005577.1), a gene which MyoD family inhibitor; interacts with and inhibits the MyoD family of transactivators. Accordingly, utilities of GAM116 include diagnosis, prevention and treatment of diseases and clinical conditions associated with MDFI.

The function of MDFI has been established by previous studies. During embryogenesis, cells from the ventral and dorsal parts of the somites give rise to sclerotome and dermomyotome, respectively. The latter contains skeletal muscle precursors determined by the MyoD (OMIM Ref. No. 159970) family of myogenic factors. Chen et al. (1996) isolated a mouse cDNA encoding an inhibitor of MyoD, Mdfi, which they termed I-mf. Mdfi is highly expressed in the sclerotome, whereas MyoD family members are concentrated in the dermomyotome. Functional analysis showed that Mdfi inhibits the transactivation activity of MyoD family members and represses myogenesis. Immunofluorescence microscopy revealed that Mdfi associates with MyoD family members in the cytoplasm and retains them by masking their nuclear localization signals. Kraut et al. (1998) found that Mdfi negatively regulates a subset of basic helix-loop- helix proteins, thereby influencing trophoblast and chondrogenic differentiation. The International Radiation Hybrid Mapping Consortium mapped the MDFI gene to chromosome 6 (stSG4448). Kraut (1997) reported that the MDFI gene maps to chromosome 6p21. By interspecific backcross analysis, Kraut (1997) mapped the mouse Mdfi gene to the central region of chromosome 17.

Full details of the abovementioned studies are described in the following publications, the disclosure of which are hereby incorporated by reference:

Chen, C. M.; Kraut, N.; Groudine, M.; Weintraub, H.: I-mf, a novel myogenic repressor, interacts with members of the MyoD family. Cell 86:731-741, 1996; and Kraut, N.: The gene encoding I-mf (Mdfi) maps to human chromosome 6p21 and mouse chromosome 17. Mammalian Genome 8:618-619, 1997.

Further studies establishing the function and utilities of MDFI are found in John Hopkins OMIM database record ID 604971, and in cited publications listed in Table 5, which are hereby incorporated by reference. MGC12458 (Accession NP_115704.1) is another GAM116 target gene, herein designated TARGET GENE. MGC12458 BINDING SITE is a target binding site found in the 3' untranslated region of mRNA encoded by MGC12458, corresponding to a target binding site such as BINDING SITE I, BINDING SITE II or BINDING SITE III of FIG. 8. Table 4 illustrates the complementarity of the nucleotide sequences of MGC12458 BINDING SITE, designated SEQ ID:11264, to the nucleotide sequence of GAM116 RNA, herein designated GAM RNA, also designated SEQ ID:301.

Another function of GAM116 is therefore inhibition of MGC12458 (Accession NP_115704.1). Accordingly, utilities of GAM116 include diagnosis, prevention and treatment of diseases and clinical conditions associated with MGC12458.

MGC12904 (Accession NP_112496.1) is another GAM116 target gene, herein designated TARGET GENE. MGC12904 BINDING SITE is a target binding site found in the 5' untranslated region of mRNA encoded by MGC12904, corresponding to a target binding site such as BINDING SITE I, BINDING SITE II or BINDING SITE III of FIG. 8. Table 4 illustrates the complementarity of the nucleotide sequences of MGC12904 BINDING SITE, designated SEQ ID:2673, to the nucleotide sequence of GAM116 RNA, herein designated GAM RNA, also designated SEQ ID:301.

Another function of GAM116 is therefore inhibition of MGC12904 (Accession NP_112496.1). Accordingly, utilities of GAM116 include diagnosis, prevention and treatment of diseases and clinical conditions associated with MGC12904.

MGC14801 (Accession NP_116094.1) is another GAM116 target gene, herein designated TARGET GENE. MGC14801 BINDING SITE is a target binding site found in the 3' untranslated region of mRNA encoded by MGC14801, corresponding to a target binding site such as BINDING SITE I, BINDING SITE II or BINDING SITE III of FIG. 8. Table 4 illustrates the complementarity of the nucleotide sequences of MGC14801 BINDING SITE, designated SEQ ID:7422, to the nucleotide sequence of GAM116 RNA, herein designated GAM RNA, also designated SEQ ID:301.

Another function of GAM116 is therefore inhibition of MGC14801 (Accession NP_116094.1). Accordingly, utilities of GAM116 include diagnosis, prevention and treatment of diseases and clinical conditions associated with MGC14801.

MGC15606 (Accession NP_659474.1) is another GAM116 target gene, herein designated TARGET GENE. MGC15606 BINDING SITE is a target binding site found in the 3' untranslated region of mRNA encoded by MGC15606, corresponding to a target binding site such as BINDING SITE I, BINDING SITE II or BINDING SITE III of FIG. 8. Table 4 illustrates the complementarity of the nucleotide sequences of MGC15606 BINDING SITE, designated SEQ ID:5629, to the nucleotide sequence of GAM116 RNA, herein designated GAM RNA, also designated SEQ ID:301.

Another function of GAM116 is therefore inhibition of MGC15606 (Accession NP_659474.1). Accordingly, utilities of GAM116 include diagnosis, prevention and treatment of diseases and clinical conditions associated with MGC15606.

MGC15937 (Accession NP_542392.2) is another GAM116 target gene, herein designated TARGET GENE. MGC15937 BINDING SITE is a target binding site found in the 3' untranslated region of mRNA encoded by MGC15937, corresponding to a target binding site such as BINDING SITE I, BINDING SITE II or BINDING SITE III of FIG. 8. Table 4 illustrates the complementarity of the nucleotide sequences of MGC15937 BINDING SITE, designated SEQ ID:12915, to the nucleotide sequence of GAM116 RNA, herein designated GAM RNA, also designated SEQ ID:301.

Another function of GAM116 is therefore inhibition of MGC15937 (Accession NP_542392.2). Accordingly, utilities of GAM116 include diagnosis, prevention and treatment of diseases and clinical conditions associated with MGC15937.

MGC23166 (Accession NP_689948.1) is another GAM116 target gene, herein designated TARGET GENE. MGC23166 BINDING SITE is a target binding site found in the 5' untranslated region of mRNA encoded by MGC23166, corresponding to a target binding site such as BINDING SITE I, BINDING SITE II or BINDING SITE III of FIG. 8. Table 4 illustrates the complementarity of the nucleotide sequences of MGC23166 BINDING SITE, designated SEQ ID:16537, to the nucleotide sequence of GAM116 RNA, herein designated GAM RNA, also designated SEQ ID:301.

Another function of GAM116 is therefore inhibition of MGC23166 (Accession NP_689948.1). Accordingly, utilities of GAM116 include diagnosis, prevention and treatment of diseases and clinical conditions associated with MGC23166.

MGC24995 (Accession NP_714914.1) is another GAM116 target gene, herein designated TARGET GENE. MGC24995 BINDING SITE is a target binding site found in the 5' untranslated region of mRNA encoded by MGC24995, corresponding to a target binding site such as BINDING SITE I, BINDING SITE II or BINDING SITE III of FIG. 8. Table 4 illustrates the complementarity of the nucleotide sequences of MGC24995 BINDING SITE, designated SEQ ID:10667, to the nucleotide sequence of GAM116 RNA, herein designated GAM RNA, also designated SEQ ID:301.

Another function of GAM116 is therefore inhibition of MGC24995 (Accession NP_714914.1). Accordingly, utilities of GAM116 include diagnosis, prevention and treatment of diseases and clinical conditions associated with MGC24995.

MGC26710 (Accession NP_689723.1) is another GAM116 target gene, herein designated TARGET GENE. MGC26710 BINDING SITE is a target binding site found in the 3' untranslated region of mRNA encoded by MGC26710, corresponding to a target binding site such as BINDING SITE I, BINDING SITE II or BINDING SITE III of FIG. 8. Table 4 illustrates the complementarity of the nucleotide sequences of MGC26710 BINDING SITE, designated SEQ ID:8483, to the nucleotide sequence of GAM116 RNA, herein designated GAM RNA, also designated SEQ ID:301.

Another function of GAM116 is therefore inhibition of MGC26710 (Accession NP_689723.1). Accordingly, utilities of GAM116 include diagnosis, prevention and treatment of diseases and clinical conditions associated with MGC26710.

MGC39696 (Accession NP_689984.1) is another GAM116 target gene, herein designated TARGET GENE. MGC39696 BINDING SITE is a target binding site found in the 5' untranslated region of mRNA encoded by MGC39696, corresponding to a target binding site such as BINDING SITE I, BINDING SITE II or BINDING SITE III of FIG. 8. Table 4 illustrates the complementarity of the nucleotide sequences of MGC39696 BINDING SITE, designated SEQ ID:9234, to the nucleotide sequence of GAM116 RNA, herein designated GAM RNA, also designated SEQ ID:301.

Another function of GAM116 is therefore inhibition of MGC39696 (Accession NP_689984.1). Accordingly, utilities of GAM116 include diagnosis, prevention and treatment of diseases and clinical conditions associated with MGC39696.

MGC45866 (Accession NP_689472.2) is another GAM116 target gene, herein designated TARGET GENE. MGC45866 BINDING SITE is a target binding site found in the 3' untranslated region of mRNA encoded by MGC45866, corresponding to a target binding site such as BINDING SITE I, BINDING SITE II or BINDING SITE III of FIG. 8. Table 4 illustrates the complementarity of the nucleotide sequences of MGC45866 BINDING SITE, designated SEQ ID:14643, to the nucleotide sequence of GAM116 RNA, herein designated GAM RNA, also designated SEQ ID:301.

Another function of GAM116 is therefore inhibition of MGC45866 (Accession NP_689472.2). Accordingly, utilities of GAM116 include diagnosis, prevention and treatment of diseases and clinical conditions associated with MGC45866.

MGC46732 (Accession NP_714925.1) is another GAM116 target gene, herein designated TARGET GENE. MGC46732 BINDING SITE is a target binding site found in the 3' untranslated region of mRNA encoded by MGC46732, corresponding to a target binding site such as BINDING SITE I, BINDING SITE II or BINDING SITE III of FIG. 8. Table 4 illustrates the complementarity of the nucleotide sequences of MGC46732 BINDING SITE, designated SEQ ID:10690, to the nucleotide sequence of GAM116 RNA, herein designated GAM RNA, also designated SEQ ID:301.

Another function of GAM116 is therefore inhibition of MGC46732 (Accession NP_714925.1). Accordingly, utilities of GAM116 include diagnosis, prevention and treatment of diseases and clinical conditions associated with MGC46732.

MGC48332 (Accession NP_848545.1) is another GAM116 target gene, herein designated TARGET GENE. MGC48332 BINDING SITE is a target binding site found in the 3' untranslated region of mRNA encoded by MGC48332, corresponding to a target binding site such as BINDING SITE I, BINDING SITE II or BINDING SITE III of FIG. 8. Table 4 illustrates the complementarity of the nucleotide sequences of MGC48332 BINDING SITE, designated SEQ ID:18723, to the nucleotide sequence of GAM116 RNA, herein designated GAM RNA, also designated SEQ ID:301.

Another function of GAM116 is therefore inhibition of MGC48332 (Accession NP_848545.1). Accordingly, utilities of GAM116 include diagnosis, prevention and treatment of diseases and clinical conditions associated with MGC48332.

MGC5442 (Accession NP_113622.1) is another GAM116 target gene, herein designated TARGET GENE. MGC5442 BINDING SITE is a target binding site found in the 3' untranslated region of mRNA encoded by MGC5442, corresponding to a target binding site such as BINDING SITE I, BINDING SITE II or BINDING SITE III of FIG. 8. Table 4 illustrates the complementarity of the nucleotide sequences of MGC5442 BINDING SITE, designated SEQ ID:18618, to the nucleotide sequence of GAM116 RNA, herein designated GAM RNA, also designated SEQ ID:301.

Another function of GAM116 is therefore inhibition of MGC5442 (Accession NP_113622.1). Accordingly, utilities of GAM116 include diagnosis, prevention and treatment of diseases and clinical conditions associated with MGC5442.

MGC57211 (Accession NP_787074.1) is another GAM116 target gene, herein designated TARGET GENE. MGC57211 BINDING SITE is a target binding site found in the 5' untranslated region of mRNA encoded by MGC57211, corresponding to a target binding site such as BINDING SITE I, BINDING SITE II or BINDING SITE III of FIG. 8. Table 4 illustrates the complementarity of the nucleotide sequences of MGC57211 BINDING SITE, designated SEQ ID:18590, to the nucleotide sequence of GAM116 RNA, herein designated GAM RNA, also designated SEQ ID:301.

Another function of GAM116 is therefore inhibition of MGC57211 (Accession NP_787074.1). Accordingly, utilities of GAM116 include diagnosis, prevention and treatment of diseases and clinical conditions associated with MGC57211.

MGC7036 (Accession NP_659495.1) is another GAM116 target gene, herein designated TARGET GENE. MGC7036 BINDING SITE is a target binding site found in the 3' untranslated region of mRNA encoded by MGC7036, corresponding to a target binding site such as BINDING SITE I, BINDING SITE II or BINDING SITE III of FIG. 8. Table 4 illustrates the complementarity of the nucleotide sequences of MGC7036 BINDING SITE, designated SEQ ID:5133, to the nucleotide sequence of GAM116 RNA, herein designated GAM RNA, also designated SEQ ID:301.

Another function of GAM116 is therefore inhibition of MGC7036 (Accession NP_659495.1). Accordingly, utilities of GAM116 include diagnosis, prevention and treatment of diseases and clinical conditions associated with MGC7036.

Max binding protein (MNT, Accession NP_064706.1) is another GAM116 target gene, herein designated TARGET GENE. MNT BINDING SITE is a target binding site found in the 3' untranslated region of mRNA encoded by MNT, corresponding to a target binding site such as BINDING SITE I, BINDING SITE II or BINDING SITE III of FIG. 8. Table 4 illustrates the complementarity of the nucleotide sequences of MNT BINDING SITE, designated SEQ ID:6137, to the nucleotide sequence of GAM116 RNA, herein designated GAM RNA, also designated SEQ ID:301.

Another function of GAM116 is therefore inhibition of Max binding protein (MNT, Accession NP_064706.1). Accordingly, utilities of GAM116 include diagnosis, prevention and treatment of diseases and clinical conditions associated with MNT.

Myotubularin related protein 4 (MTMR4, Accession NP_004678.2) is another GAM116 target gene, herein designated TARGET GENE. MTMR4 BINDING SITE is a target binding site found in the 3' untranslated region of mRNA encoded by MTMR4, corresponding to a target binding site such as BINDING SITE I, BINDING SITE II or BINDING SITE III of FIG. 8. Table 4 illustrates the complementarity of the nucleotide sequences of MTMR4 BINDING SITE, designated SEQ ID:6995, to the nucleotide sequence of GAM116 RNA, herein designated GAM RNA, also designated SEQ ID:301.

Another function of GAM116 is therefore inhibition of Myotubularin related protein 4 (MTMR4, Accession NP_004678.2), a gene which could be involved in a signal transduction pathway necessary for late myogenesis. Accordingly, utilities of GAM116 include diagnosis, prevention and treatment of diseases and clinical conditions associated with MTMR4.

The function of MTMR4 has been established by previous studies. Zhao et al. (2001) showed that MTMR4 dephosphorylates para-nitrophenylphosphate and phosphatidylinositol 3-phosphate.

Full details of the abovementioned studies are described in the following publications, the disclosure of which are hereby incorporated by reference:

Laporte, J.; Blondeau, F.; Buj-Bello, A.; Tentler, D.; Kretz, C.; Dahl, N.; Mandel, J.-L.: Characterization of the myotubularin dual specificity phosphatase gene family from yeast to human. Hum. Molec. Genet. 7:1703-1712, 1998. ; and Zhao, R.; Qi, Y.; Chen, J.; Zhao, Z. J.: FYVE-DSP2, a FYVE domain-containing dual specificity protein phosphatase that dephosphorylates phosphotidylinositol (sic) 3-phosphate. Exp. Cel.

Further studies establishing the function and utilities of MTMR4 are found in John Hopkins OMIM database record ID 603559, and in cited publications listed in Table 5, which are hereby incorporated by reference. Myoneurin (MYNN, Accession NP_061127.1) is another GAM116 target gene, herein designated TARGET GENE. MYNN BINDING SITE is a target binding site found in the 5' untranslated region of mRNA encoded by MYNN, corresponding to a target binding site such as BINDING SITE I, BINDING SITE II or BINDING SITE III of FIG. 8. Table 4 illustrates the complementarity of the nucleotide sequences of MYNN BINDING SITE, designated SEQ ID:18472, to the nucleotide sequence of GAM116 RNA, herein designated GAM RNA, also designated SEQ ID:301.

Another function of GAM116 is therefore inhibition of Myoneurin (MYNN, Accession NP_061127.1). Accordingly, utilities of GAM116 include diagnosis, prevention and treatment of diseases and clinical conditions associated with MYNN.

Neuron navigator 3 (NAV3, Accession NP_055718.2) is another GAM116 target gene, herein designated TARGET GENE. NAV3 BINDING SITE is a target binding site found in the 3' untranslated region of mRNA encoded by NAV3, corresponding to a target binding site such as BINDING SITE I, BINDING SITE II or BINDING SITE III of FIG. 8. Table 4 illustrates the complementarity of the nucleotide sequences of NAV3 BINDING SITE, designated SEQ ID:11894, to the nucleotide sequence of GAM116 RNA, herein designated GAM RNA, also designated SEQ ID:301.

Another function of GAM116 is therefore inhibition of Neuron navigator 3 (NAV3, Accession NP_055718.2). Accordingly, utilities of GAM116 include diagnosis, prevention and treatment of diseases and clinical conditions associated with NAV3.

Nuclear factor of kappa light polypeptide gene enhancer in b-cells inhibitor, epsilon (NFKBIE, Accession NP_004547.1) is another GAM116 target gene, herein designated TARGET GENE. NFKBIE BINDING SITE is a target binding site found in the 3' untranslated region of mRNA encoded by NFKBIE, corresponding to a target binding site such as BINDING SITE I, BINDING SITE II or BINDING SITE III of FIG. 8. Table 4 illustrates the complementarity of the nucleotide sequences of NFKBIE BINDING SITE, designated SEQ ID:6706, to the nucleotide sequence of GAM116 RNA, herein designated GAM RNA, also designated SEQ ID:301.

Another function of GAM116 is therefore inhibition of Nuclear factor of kappa light polypeptide gene enhancer in b-cells inhibitor, epsilon (NFKBIE, Accession NP_004547.1). Accordingly, utilities of GAM116 include diagnosis, prevention and treatment of diseases and clinical conditions associated with NFKBIE.

Nerve growth factor receptor (tnfr superfamily, member 16) (NGFR, Accession NP_002498.1) is another GAM116 target gene, herein designated TARGET GENE. NGFR BINDING SITE is a target binding site found in the 3' untranslated region of mRNA encoded by NGFR, corresponding to a target binding site such as BINDING SITE I, BINDING SITE II or BINDING SITE III of FIG. 8. Table 4 illustrates the complementarity of the nucleotide sequences of NGFR BINDING SITE, designated SEQ ID:774, to the nucleotide sequence of GAM116 RNA, herein designated GAM RNA, also designated SEQ ID:301.

Another function of GAM116 is therefore inhibition of Nerve growth factor receptor (tnfr superfamily, member 16) (NGFR, Accession NP_002498.1), a gene which can mediate cell survival as well as cell death of neural cells. Accordingly, utilities of GAM116 include diagnosis, prevention and treatment of diseases and clinical conditions associated with NGFR.

The function of NGFR has been established by previous studies. Bothwell (1996), Carter and Lewin (1997), and Bibel and Barde (2000) reviewed neurotrophins and their receptors. Nerve growth factor receptor (NGFR) is also referred to as p75(NTR) due to its molecular mass and its ability to bind at low affinity not only NGF (see OMIM Ref. No. 162030), but also other neurotrophins, including brain-derived neurotrophic factor (BDNF; 113505), neurotrophin-3 (NTF3; 162660), and neurotrophin-4/5 (NTF5; 162662). At the time of its discovery, NGFR was considered a unique type of protein. Subsequently, however, a large superfamily of tumor necrosis factor receptors were found to share the overall structure of NGFR (4 extracellular ligand-binding, cysteine-rich repeats, or CRs, and signaling through association with, or disassociation from, cytoplasmic interactors). The identification of this superfamily helped elucidate some of the biologic functions of NGFR, including its ultimate involvement in the nuclear factor kappa-B (NFKB; OMIM Ref. No. 164011) and apoptosis pathways. As a monomer, NGFR binds NGF with low affinity. Higher affinity binding is achieved by association with higher molecular mass, low-affinity neurotrophin receptors, namely the tropomyosin receptor kinases, TRKA (NTRK1; 191315), TRKB (NTRK2; 600456), and TRKC (NTRK3; 191316). TRKA, TRKB, and TRKC are specific for or 'preferred by' NGF, NTF5 and BDNF, and NTF3, respectively (Ip et al., 1993). NTF3 also binds to TRKA and TRKB, but with significantly lower affinity.

Animal model experiments lend further support to the function of NGFR. By targeted disruption of exon 3 of the Ngfr gene, which encodes CR2, CR3, and CR4, Lee et al. (1992) generated mice lacking functional Ngfr. The Ngfr -/- mice were viable and fertile but developed skin defects in all extremities as well as ulcers that were prone to secondary infection with loss of epidermis. Immunohistochemistry revealed a lack of calcitonin gene-related peptide (CALCA; 114130)- and substance P (OMIM Ref. No. 162320)-expressing peripheral sensory nerve fibers. Mutant mice had a loss of heat sensitivity but no defects in innervation of the iris or salivary gland. Mice carrying a single copy of a human NGFR transgene did not have neuropeptide and sensory loss or the peripheral ulcers.

It is appreciated that the abovementioned animal model for NGFR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bibel, M.; Barde, Y.-A.: Neurotrophins: key regulators of cell fate and cell shape in the vertebrate nervous system. Genes Dev. 14:2919-2937, 2000; and Lee, K. F.; Li, E.; Huber, J.; Landis, S. C.; Sharpe, A. H.; Chao, M. V.; Jaenisch, R.: Targeted mutation of the gene encoding the low affinity NGF receptor p75 leads to deficits in t.

Further studies establishing the function and utilities of NGFR are found in John Hopkins OMIM database record ID 162010, and in cited publications listed in Table 5, which are hereby incorporated by reference. Nipsnap homolog 1 (c. elegans) (NIPSNAP1, Accession NP_003625.1) is another GAM116 target gene, herein designated TARGET GENE. NIPSNAP1 BINDING SITE is a target binding site found in the 3' untranslated region of mRNA encoded by NIPSNAP1, corresponding to a target binding site such as BINDING SITE I, BINDING SITE II or BINDING SITE III of FIG. 8. Table 4 illustrates the complementarity of the nucleotide sequences of NIPSNAP1 BINDING SITE, designated SEQ ID:16570, to the nucleotide sequence of GAM116 RNA, herein designated GAM RNA, also designated SEQ ID:301.

Another function of GAM116 is therefore inhibition of Nipsnap homolog 1 (c. elegans) (NIPSNAP1, Accession NP_003625.1). Accordingly, utilities of GAM116 include diagnosis, prevention and treatment of diseases and clinical conditions associated with NIPSNAP1.

Nodal homolog (mouse) (NODAL, Accession NP_060525.2) is another GAM116 target gene, herein designated TARGET GENE. NODAL BINDING SITE is a target binding site found in the 5' untranslated region of mRNA encoded by NODAL, corresponding to a target binding site such as BINDING SITE I, BINDING SITE II or BINDING SITE III of FIG. 8. Table 4 illustrates the complementarity of the nucleotide sequences of NODAL BINDING SITE, designated SEQ ID:3383, to the nucleotide sequence of GAM116 RNA, herein designated GAM RNA, also designated SEQ ID:301.

Another function of GAM116 is therefore inhibition of Nodal homolog (mouse) (NODAL, Accession NP_060525.2). Accordingly, utilities of GAM116 include diagnosis, prevention and treatment of diseases and clinical conditions associated with NODAL.

NRBF-2 (Accession NP_110386.1) is another GAM116 target gene, herein designated TARGET GENE. NRBF-2 BINDING SITE is a target binding site found in the 3' untranslated region of mRNA encoded by NRBF-2, corresponding to a target binding site such as BINDING SITE I, BINDING SITE II or BINDING SITE III of FIG. 8. Table 4 illustrates the complementarity of the nucleotide sequences of NRBF-2 BINDING SITE, designated SEQ ID:2507, to the nucleotide sequence of GAM116 RNA, herein designated GAM RNA, also designated SEQ ID:301.

Another function of GAM116 is therefore inhibition of NRBF-2 (Accession NP_110386.1). Accordingly, utilities of GAM116 include diagnosis, prevention and treatment of diseases and clinical conditions associated with NRBF-2.

NUP210 (Accession NP_079199.2) is another GAM116 target gene, herein designated TARGET GENE. NUP210 BINDING SITE is a target binding site found in the 3' untranslated region of mRNA encoded by NUP210, corresponding to a target binding site such as BINDING SITE I, BINDING SITE II or BINDING SITE III of FIG. 8. Table 4 illustrates the complementarity of the nucleotide sequences of NUP210 BINDING SITE, designated SEQ ID:7611, to the nucleotide sequence of GAM116 RNA, herein designated GAM RNA, also designated SEQ ID:301.

Another function of GAM116 is therefore inhibition of NUP210 (Accession NP_079199.2). Accordingly, utilities of GAM116 include diagnosis, prevention and treatment of diseases and clinical conditions associated with NUP210.

Oculocerebrorenal syndrome of lowe (OCRL, Accession NP_000267.2) is another GAM116 target gene, herein designated TARGET GENE. OCRL BINDING SITE is a target binding site found in the 3' untranslated region of multiple transcripts of mRNA encoded by OCRL, corresponding to a target binding site such as BINDING SITE I, BINDING SITE II or BINDING SITE III of FIG. 8. Table 4 illustrates the complementarity of the nucleotide sequences of OCRL BINDING SITE, designated SEQ ID:5246, to the nucleotide sequence of GAM116 RNA, herein designated GAM RNA, also designated SEQ ID:301.

Another function of GAM116 is therefore inhibition of Oculocerebrorenal syndrome of lowe (OCRL, Accession NP_000267.2). Accordingly, utilities of GAM116 include diagnosis, prevention and treatment of diseases and clinical conditions associated with OCRL.

Oculocerebrorenal syndrome of lowe (OCRL, Accession NP_001578.2) is another GAM116 target gene, herein designated TARGET GENE. OCRL BINDING SITE is a target binding site found in the 3' untranslated region of multiple transcripts of mRNA encoded by OCRL, corresponding to a target binding site such as BINDING SITE I, BINDING SITE II or BINDING SITE III of FIG. 8. Table 4 illustrates the complementarity of the nucleotide sequences of OCRL BINDING SITE, designated SEQ ID:5246, to the nucleotide sequence of GAM116 RNA, herein designated GAM RNA, also designated SEQ ID:301.

Another function of GAM116 is therefore inhibition of Oculocerebrorenal syndrome of lowe (OCRL, Accession NP_001578.2). Accordingly, utilities of GAM116 include diagnosis, prevention and treatment of diseases and clinical conditions associated with OCRL.

Oncostatin m (OSM, Accession NP_065391.1) is another GAM116 target gene, herein designated TARGET GENE. OSM BINDING SITE is a target binding site found in the 3' untranslated region of mRNA encoded by OSM, corresponding to a target binding site such as BINDING SITE I, BINDING SITE II or BINDING SITE III of FIG. 8. Table 4 illustrates the complementarity of the nucleotide sequences of OSM BINDING SITE, designated SEQ ID:5982, to the nucleotide sequence of GAM116 RNA, herein designated GAM RNA, also designated SEQ ID:301.

Another function of GAM116 is therefore inhibition of Oncostatin m (OSM, Accession NP_065391.1), a gene which inhibits the proliferation of a number of tumor cell lines, caused an acute inflammatory reaction. Accordingly, utilities of GAM116 include diagnosis, prevention and treatment of diseases and clinical conditions associated with OSM.

The function of OSM and its association with various diseases and clinical conditions, has been established by previous studies, as described hereinabove with reference to GAM65.2. P101-PI3K (Accession NP_055123.1) is another GAM116 target gene, herein designated TARGET GENE. P101-PI3K BINDING SITE is a target binding site found in the 3' untranslated region of mRNA encoded by P101-PI3K, corresponding to a target binding site such as BINDING SITE I, BINDING SITE II or BINDING SITE III of FIG. 8. Table 4 illustrates the complementarity of the nucleotide sequences of P101-PI3K BINDING SITE, designated SEQ ID:16367, to the nucleotide sequence of GAM116 RNA, herein designated GAM RNA, also designated SEQ ID:301.

Another function of GAM116 is therefore inhibition of P101-PI3K (Accession NP_055123.1). Accordingly, utilities of GAM116 include diagnosis, prevention and treatment of diseases and clinical conditions associated with P101-PI3K.

P24B (Accession NP_031390.1) is another GAM116 target gene, herein designated TARGET GENE. P24B BINDING SITE is a target binding site found in the 3' untranslated region of mRNA encoded by P24B, corresponding to a target binding site such as BINDING SITE I, BINDING SITE II or BINDING SITE III of FIG. 8. Table 4 illustrates the complementarity of the nucleotide sequences of P24B BINDING SITE, designated SEQ ID:5315, to the nucleotide sequence of GAM116 RNA, herein designated GAM RNA, also designated SEQ ID:301.

Another function of GAM116 is therefore inhibition of P24B (Accession NP_031390.1). Accordingly, utilities of GAM116 include diagnosis, prevention and treatment of diseases and clinical conditions associated with P24B.

Platelet-activating factor acetylhydrolase 2, 40 kda (PAFAH2, Accession NP_000428.2) is another GAM116 target gene, herein designated TARGET GENE. PAFAH2 BINDING SITE is a target binding site found in the 3' untranslated region of mRNA encoded by PAFAH2, corresponding to a target binding site such as BINDING SITE I, BINDING SITE II or BINDING SITE III of FIG. 8. Table 4 illustrates the complementarity of the nucleotide sequences of PAFAH2 BINDING SITE, designated SEQ ID:7764, to the nucleotide sequence of GAM116 RNA, herein designated GAM RNA, also designated SEQ ID:301.

Another function of GAM116 is therefore inhibition of Platelet-activating factor acetylhydrolase 2, 40 kda (PAFAH2, Accession NP_000428.2). Accordingly, utilities of GAM116 include diagnosis, prevention and treatment of diseases and clinical conditions associated with PAFAH2.

PAIP2 (Accession NP_057564.2) is another GAM116 target gene, herein designated TARGET GENE. PAIP2 BINDING SITE is a target binding site found in the 3' untranslated region of mRNA encoded by PAIP2, corresponding to a target binding site such as BINDING SITE I, BINDING SITE II or BINDING SITE III of FIG. 8. Table 4 illustrates the complementarity of the nucleotide sequences of PAIP2 BINDING SITE, designated SEQ ID:13015, to the nucleotide sequence of GAM116 RNA, herein designated GAM RNA, also designated SEQ ID:301.

Another function of GAM116 is therefore inhibition of PAIP2 (Accession NP_057564.2). Accordingly, utilities of GAM116 include diagnosis, prevention and treatment of diseases and clinical conditions associated with PAIP2.

Poly(a) polymerase gamma (PAPOLG, Accession NP_075045.2) is another GAM116 target gene, herein designated TARGET GENE. PAPOLG BINDING SITE is a target binding site found in the 3' untranslated region of mRNA encoded by PAPOLG, corresponding to a target binding site such as BINDING SITE I, BINDING SITE II or BINDING SITE III of FIG. 8. Table 4 illustrates the complementarity of the nucleotide sequences of PAPOLG BINDING SITE, designated SEQ ID:2310, to the nucleotide sequence of GAM116 RNA, herein designated GAM RNA, also designated SEQ ID:301.

Another function of GAM116 is therefore inhibition of Poly(a) polymerase gamma (PAPOLG, Accession NP_075045.2). Accordingly, utilities of GAM116 include diagnosis, prevention and treatment of diseases and clinical conditions associated with PAPOLG.

PBXIP1 (Accession NP_065385.2) is another GAM116 target gene, herein designated TARGET GENE. PBXIP1 BINDING SITE is a target binding site found in the 3' untranslated region of mRNA encoded by PBXIP1, corresponding to a target binding site such as BINDING SITE I, BINDING SITE II or BINDING SITE III of FIG. 8. Table 4 illustrates the complementarity of the nucleotide sequences of PBXIP1 BINDING SITE, designated SEQ ID:11249, to the nucleotide sequence of GAM116 RNA, herein designated GAM RNA, also designated SEQ ID:301.

Another function of GAM116 is therefore inhibition of PBXIP1 (Accession NP_065385.2). Accordingly, utilities of GAM116 include diagnosis, prevention and treatment of diseases and clinical conditions associated with PBXIP1.

Protocadherin 10 (PCDH10, Accession NP_116586.1) is another GAM116 target gene, herein designated TARGET GENE. PCDH10 BINDING SITE is a target binding site found in the 3' untranslated region of multiple transcripts of mRNA encoded by PCDH10, corresponding to a target binding site such as BINDING SITE I, BINDING SITE II or BINDING SITE III of FIG. 8. Table 4 illustrates the complementarity of the nucleotide sequences of PCDH10 BINDING SITE, designated SEQ ID:10950, to the nucleotide sequence of GAM116 RNA, herein designated GAM RNA, also designated SEQ ID:301.

Another function of GAM116 is therefore inhibition of Protocadherin 10 (PCDH10, Accession NP_116586.1). Accordingly, utilities of GAM116 include diagnosis, prevention and treatment of diseases and clinical conditions associated with PCDH10.

Phosphodiesterase 4b, camp-specific (phosphodiesterase e4 dunce homolog, drosophila) (PDE4B, Accession NP_002591.1) is another GAM116 target gene, herein designated TARGET GENE. PDE4B BINDING SITE is a target binding site found in the 5' untranslated region of mRNA encoded by PDE4B, corresponding to a target binding site such as BINDING SITE I, BINDING SITE II or BINDING SITE III of FIG. 8. Table 4 illustrates the complementarity of the nucleotide sequences of PDE4B BINDING SITE, designated SEQ ID:13014, to the nucleotide sequence of GAM116 RNA, herein designated GAM RNA, also designated SEQ ID:301.

Another function of GAM116 is therefore inhibition of Phosphodiesterase 4b, camp-specific (phosphodiesterase e4 dunce homolog, drosophila) (PDE4B, Accession NP_002591.1), a gene which may be involved in mediating central nervous system effects of therapeutic agents ranging from antidepressants to antiasthmatic and anti-inflammatory agents. Accordingly, utilities of GAM116 include diagnosis, prevention and treatment of diseases and clinical conditions associated with PDE4B.

The function of PDE4B and its association with various diseases and clinical conditions, has been established by previous studies, as described hereinabove with reference to GAM31.1. Piggybac transposable element derived 5 (PGBD5, Accession NP_078830.2) is another GAM116 target gene, herein designated TARGET GENE. PGBD5 BINDING SITE is a target binding site found in the 3' untranslated region of mRNA encoded by PGBD5, corresponding to a target binding site such as BINDING SITE I, BINDING SITE II or BINDING SITE III of FIG. 8. Table 4 illustrates the complementarity of the nucleotide sequences of PGBD5 BINDING SITE, designated SEQ ID:19715, to the nucleotide sequence of GAM116 RNA, herein designated GAM RNA, also designated SEQ ID:301.

Another function of GAM116 is therefore inhibition of Piggybac transposable element derived 5 (PGBD5, Accession NP_078830.2). Accordingly, utilities of GAM116 include diagnosis, prevention and treatment of diseases and clinical conditions associated with PGBD5.

Phd finger protein 5a (PHF5A, Accession NP_116147.1) is another GAM116 target gene, herein designated TARGET GENE. PHF5A BINDING SITE is a target binding site found in the 3' untranslated region of mRNA encoded by PHF5A, corresponding to a target binding site such as BINDING SITE I, BINDING SITE II or BINDING SITE III of FIG. 8. Table 4 illustrates the complementarity of the nucleotide sequences of PHF5A BINDING SITE, designated SEQ ID:8541, to the nucleotide sequence of GAM116 RNA, herein designated GAM RNA, also designated SEQ ID:301.

Another function of GAM116 is therefore inhibition of Phd finger protein 5a (PHF5A, Accession NP_116147.1). Accordingly, utilities of GAM116 include diagnosis, prevention and treatment of diseases and clinical conditions associated with PHF5A.

Phosphatidylinositol glycan, class f (PIGF, Accession NP_775097.1) is another GAM116 target gene, herein designated TARGET GENE. PIGF BINDING SITE is a target binding site found in the 3' untranslated region of multiple transcripts of mRNA encoded by PIGF, corresponding to a target binding site such as BINDING SITE I, BINDING SITE II or BINDING SITE III of FIG. 8. Table 4 illustrates the complementarity of the nucleotide sequences of PIGF BINDING SITE, designated SEQ ID:15112, to the nucleotide sequence of GAM116 RNA, herein designated GAM RNA, also designated SEQ ID:301.

Another function of GAM116 is therefore inhibition of Phosphatidylinositol glycan, class f (PIGF, Accession NP_775097.1), a gene which is involved in gpi-anchor biosynthesis through the transfer of ethanolamine phosphate to the third mannose of gpi. Accordingly, utilities of GAM116 include diagnosis, prevention and treatment of diseases and clinical conditions associated with PIGF.

The function of PIGF has been established by previous studies. DNA damage and/or hyperproliferative signals activate wildtype p53 tumor suppressor protein (TP53; 191170), inducing cell cycle arrest or apoptosis. Mutations that inactivate p53 occur in 50% of all tumors. Polyak et al. (1997) used Ser. analysis of gene expression (SAGE) to evaluate cellular mRNA levels in a colorectal cancer cell line transfected with p53. Of 7,202 transcripts identified, only 14 were expressed at levels more than 10-fold higher in p53-expressing cells than in control cells. Polyak et al. (1997) termed these genes 'p53-induced genes,' or PIGs, several of which were predicted to encode redox-controlling proteins. They noted that reactive oxygen species (ROS) are potent inducers of apoptosis. Flow cytometric analysis showed that p53 expression induces ROS production, which increases as apoptosis progresses under some conditions. The authors stated that PIG8 is the human homolog of murine ei24, an etoposide-induced gene. Using a murine myeloid leukemia cell line expressing a temperature-sensitive p53 gene, Gu et al. (2000) showed that ei24, the murine homolog of PIG8, directly responds to p53 as an immediate- early response gene rather than as a secondary response to p53-mediated cell death. Electrophoretic mobility shift analysis demonstrated that purified wildtype p53 protein specifically binds to a p53 response element in the ei24 protein. By analysis of a BAC clone, Gu et al. (2000) determined that the PIG8 sequence reported by Polyak et al. (1997) is incorrect and that the corrected 358-amino acid PIG8 protein shares 98% amino acid identity with ei24. Western blot analysis indicated that ei24 expression is approximately 500-fold higher in dead cells than in healthy cells. Phase contrast and fluorescence microscopy showed that cells expressing Ei24 but not those coexpressing the apoptosis suppressor BCL2L1 (OMIM Ref. No. 600039) displayed the typical morphologic features of apoptosis. These results suggested that ei24 suppresses cell growth through the activation of an apoptotic pathway.

Full details of the abovementioned studies are described in the following publications, the disclosure of which are hereby incorporated by reference:

Gu, Z.; Flemington, C.; Chittenden, T.; Zambetti, G. P.: Ei24, a p53 response gene involved in growth suppression and apoptosis. Molec. Cell. Biol. 20:233-241, 2000; and Gu, Z.; Gilbert, D. J.; Valentine, V. A.; Jenkins, N. A.; Copeland, N. G.; Zambetti, G. P.: The p53-inducible gene EI24/PIG8 localizes to human chromosome 11q23 and the proximal region.

Further studies establishing the function and utilities of PIGF are found in John Hopkins OMIM database record ID 600153, and in cited publications listed in Table 5, which are hereby incorporated by reference. Peripheral myelin protein 22 (PMP22, Accession NP_696997.1) is another GAM116 target gene, herein designated TARGET GENE. PMP22 BINDING SITE is a target binding site found in the 5' untranslated region of multiple transcripts of mRNA encoded by PMP22, corresponding to a target binding site such as BINDING SITE I, BINDING SITE II or BINDING SITE III of FIG. 8. Table 4 illustrates the complementarity of the nucleotide sequences of PMP22 BINDING SITE, designated SEQ ID:14008, to the nucleotide sequence of GAM116 RNA, herein designated GAM RNA, also designated SEQ ID:301.

Another function of GAM116 is therefore inhibition of Peripheral myelin protein 22 (PMP22, Accession NP_696997.1). Accordingly, utilities of GAM116 include diagnosis, prevention and treatment of diseases and clinical conditions associated with PMP22.

Peripheral myelin protein 22 (PMP22, Accession NP_696996.1) is another GAM116 target gene, herein designated TARGET GENE. PMP22 BINDING SITE is a target binding site found in the 5' untranslated region of multiple transcripts of mRNA encoded by PMP22, corresponding to a target binding site such as BINDING SITE I, BINDING SITE II or BINDING SITE III of FIG. 8. Table 4 illustrates the complementarity of the nucleotide sequences of PMP22 BINDING SITE, designated SEQ ID:14008, to the nucleotide sequence of GAM116 RNA, herein designated GAM RNA, also designated SEQ ID:301.

Another function of GAM116 is therefore inhibition of Peripheral myelin protein 22 (PMP22, Accession NP_696996.1). Accordingly, utilities of GAM116 include diagnosis, prevention and treatment of diseases and clinical conditions associated with PMP22.

Peripheral myelin protein 22 (PMP22, Accession NP_000295.1) is another GAM116 target gene, herein designated TARGET GENE. PMP22 BINDING SITE is a target binding site found in the 5' untranslated region of multiple transcripts of mRNA encoded by PMP22, corresponding to a target binding site such as BINDING SITE I, BINDING SITE II or BINDING SITE III of FIG. 8. Table 4 illustrates the complementarity of the nucleotide sequences of PMP22 BINDING SITE, designated SEQ ID:14008, to the nucleotide sequence of GAM116 RNA, herein designated GAM RNA, also designated SEQ ID:301.

Another function of GAM116 is therefore inhibition of Peripheral myelin protein 22 (PMP22, Accession NP_000295.1). Accordingly, utilities of GAM116 include diagnosis, prevention and treatment of diseases and clinical conditions associated with PMP22.

Prion protein 2 (dublet) (PRND, Accession NP_036541.1) is another GAM116 target gene, herein designated TARGET GENE. PRND BINDING SITE is a target binding site found in the 3' untranslated region of mRNA encoded by PRND, corresponding to a target binding site such as BINDING SITE I, BINDING SITE II or BINDING SITE III of FIG. 8. Table 4 illustrates the complementarity of the nucleotide sequences of PRND BINDING SITE, designated SEQ ID:18816, to the nucleotide sequence of GAM116 RNA, herein designated GAM RNA, also designated SEQ ID:301.

Another function of GAM116 is therefore inhibition of Prion protein 2 (dublet) (PRND, Accession NP_036541.1), a gene which is similar to prion protein PRNP. Accordingly, utilities of GAM116 include diagnosis, prevention and treatment of diseases and clinical conditions associated with PRND.

The function of PRND has been established by previous studies. Lu et al. (2000) characterized the expression and structure of DPL by matrix-assisted laser desorption ionization (MALDI) mass spectrometry and electrospray mass spectrometry. Unlike PRP, DPL has a second disulfide bond that may contribute to the stability of its uniquely folded alpha-helical core. Lu et al. (2000) noted that PRP is most highly expressed in brain, whereas DPL is enriched in testis. Biochemical analysis determined that DPL resembles PRP in terms of solubility and protease sensitivity and undergoes cooperative and reversible unfolding during thermal denaturation. Silverman et al. (2000) showed that recombinant Dpl refolded under standard conditions adopts an alpha-helical conformation. When expressed in mouse neuroblastoma cells, Dpl possessed 2 N-linked oligosaccharides and was attached to the cell surface via a GPI anchor, much like the cellular prion protein. Dpl was present in brain samples of Rcm0 mice, which develop progressive ataxia with loss of Purkinje cells at around 70 weeks of age, but was absent in equivalent samples from asymptomatic Zurich and wildtype mice. Schroder et al. (2001) investigated whether there are any polymorphisms within the PRND gene that might cause or be involved in the development of transmissible spongiform encephalopathies. They screened the complete open reading frame of the human gene from 58 patients who had died of genetic or sporadic Creutzfeldt-Jakob disease (CJD; 123400), Alzheimer disease (OMIM Ref. No. 104300), or other neurologic disorders, and from 111 controls. They found 5 novel polymorphisms and 1 frameshift mutation. One silent polymorphism, which did not lead to an altered amino acid sequence, was also observed. Statistical analysis revealed a significant difference in the distribution of the PRND genotype at codon 174 between sporadic CJD patients and healthy controls. Like other investigators, they found no evidence that the strong association between sporadic CJD and the PRNP polymorphism at codon 129 (176640.0005) is influenced by different PRND genotypes.

Full details of the abovementioned studies are described in the following publications, the disclosure of which are hereby incorporated by reference:

Comincini, S.; Foti, M. G.; Tranulis, M. A.; Hills, D.; Di Guardo, G.; Vaccari, G.; Williams, J. L.; Harbitz, I., Ferretti, L.: Genomic organization, comparative analysis, and genetic polymorphisms of the bovine and ovine prion Doppel genes (PRND). Mammalian Genome 12:729-733, 2001; and Lu, K.; Wang, W.; Xie, Z.; Wong, B.-S.; Li, R.; Petersen, R. B.; Sy, M.-S.; Chen, S. G.: Expression and structural characterization of the recombinant human doppel protein. Biochemistr.

Further studies establishing the function and utilities of PRND are found in John Hopkins OMIM database record ID 604263, and in cited publications listed in Table 5, which are hereby incorporated by reference. PRO0461 (Accession NP_112558.1) is another GAM116 target gene, herein designated TARGET GENE. PRO0461 BINDING SITE is a target binding site found in the 5' untranslated region of mRNA encoded by PRO0461, corresponding to a target binding site such as BINDING SITE I, BINDING SITE II or BINDING SITE III of FIG. 8. Table 4 illustrates the complementarity of the nucleotide sequences of PRO0461 BINDING SITE, designated SEQ ID:5461, to the nucleotide sequence of GAM116 RNA, herein designated GAM RNA, also designated SEQ ID:301.

Another function of GAM116 is therefore inhibition of PRO0461 (Accession NP_112558.1). Accordingly, utilities of GAM116 include diagnosis, prevention and treatment of diseases and clinical conditions associated with PRO0461.

PRO2214 (Accession NP_060987.1) is another GAM116 target gene, herein designated TARGET GENE. PRO2214 BINDING SITE is a target binding site found in the 3' untranslated region of mRNA encoded by PRO2214, corresponding to a target binding site such as BINDING SITE I, BINDING SITE II or BINDING SITE III of FIG. 8. Table 4 illustrates the complementarity of the nucleotide sequences of PRO2214 BINDING SITE, designated SEQ ID:15420, to the nucleotide sequence of GAM116 RNA, herein designated GAM RNA, also designated SEQ ID:301.

Another function of GAM116 is therefore inhibition of PRO2214 (Accession NP_060987.1). Accordingly, utilities of GAM116 include diagnosis, prevention and treatment of diseases and clinical conditions associated with PRO2214.

Protein z, vitamin k-dependent plasma glycoprotein (PROZ, Accession NP_003882.1) is another GAM116 target gene, herein designated TARGET GENE. PROZ BINDING SITE is a target binding site found in the 3' untranslated region of mRNA encoded by PROZ, corresponding to a target binding site such as BINDING SITE I, BINDING SITE II or BINDING SITE III of FIG. 8. Table 4 illustrates the complementarity of the nucleotide sequences of PROZ BINDING SITE, designated SEQ ID:4273, to the nucleotide sequence of GAM116 RNA, herein designated GAM RNA, also designated SEQ ID:301.

Another function of GAM116 is therefore inhibition of Protein z, vitamin k-dependent plasma glycoprotein (PROZ, Accession NP_003882.1). Accordingly, utilities of GAM116 include diagnosis, prevention and treatment of diseases and clinical conditions associated with PROZ.

Prp4 pre-mrna processing factor 4 homolog b (yeast) (PRPF4B, Accession NP_003904.2) is another GAM116 target gene, herein designated TARGET GENE. PRPF4B BINDING SITE is a target binding site found in the 3' untranslated region of multiple transcripts of mRNA encoded by PRPF4B, corresponding to a target binding site such as BINDING SITE I, BINDING SITE II or BINDING SITE III of FIG. 8. Table 4 illustrates the complementarity of the nucleotide sequences of PRPF4B BINDING SITE, designated SEQ ID:18328, to the nucleotide sequence of GAM116 RNA, herein designated GAM RNA, also designated SEQ ID:301.

Another function of GAM116 is therefore inhibition of Prp4 pre-mrna processing factor 4 homolog b (yeast) (PRPF4B, Accession NP_003904.2). Accordingly, utilities of GAM116 include diagnosis, prevention and treatment of diseases and clinical conditions associated with PRPF4B.

Protein tyrosine phosphatase, receptor type, f (PTPRF, Accession NP_569707.1) is another GAM116 target gene, herein designated TARGET GENE. PTPRF BINDING SITE is a target binding site found in the 3' untranslated region of multiple transcripts of mRNA encoded by PTPRF, corresponding to a target binding site such as BINDING SITE I, BINDING SITE II or BINDING SITE III of FIG. 8. Table 4 illustrates the complementarity of the nucleotide sequences of PTPRF BINDING SITE, designated SEQ ID:2806, to the nucleotide sequence of GAM116 RNA, herein designated GAM RNA, also designated SEQ ID:301.

Another function of GAM116 is therefore inhibition of Protein tyrosine phosphatase, receptor type, f (PTPRF, Accession NP_569707.1), a gene which negatively regulates the insulin signaling pathway. Accordingly, utilities of GAM116 include diagnosis, prevention and treatment of diseases and clinical conditions associated with PTPRF.

The function of PTPRF has been established by previous studies. The LAR gene (symbolized PTPRF) encodes a membrane protein that has a cytoplasmic domain with homology to protein-tyrosine phosphatase 1B (OMIM Ref. No. 176885) and an extracellular domain homologous to the neural cellular adhesion molecule NCAM (OMIM Ref. No. 116930). The human LAR molecule closely resembles cell adhesion molecules, which suggests that it may be involved in the regulation of phosphotyrosine levels through cell-cell or cell-matrix interactions. As a first step toward site-directed mutagenesis studies of LAR function, Schaapveld et al. (1995) characterized the mouse Ptprf gene. They found that its cytoplasmic region is encoded by 11 exons that span only 4.5 kb of genomic DNA. Compared to the known exon-intron structures of other mammalian receptor-like protein tyrosine phosphatase genes such as Ptpra (encoding LRP; 176884) and Ptprc (coding for Ly-5; 151460), the portion of the Ptprf gene encoding the cytoplasmic region of murine LAR contained not only smaller, but also fewer introns. O'Grady et al. (1994) demonstrated that the human LAR gene is composed of 33 exons spanning over 85 kb. Exon 2 encodes the signal sequence and the first 4 amino acids in the mature LAR protein. The 3 immunoglobulin-like domains are encoded by exons 3 to 7, and the 8 fibronectin type III (OMIM Ref. No. FN-III) domains by exons 8 to 17. Exons 18 to 22 encode the juxtamembrane and transmembrane domains, and exons 23 to 33 encode the 2 conserved tyrosine phosphatase domains and the entire 3-prime untranslated region. Alternative splicing of LAR mRNA was revealed by RT-PCR analysis.

Full details of the abovementioned studies are described in the following publications, the disclosure of which are hereby incorporated by reference:

Schaapveld, R. Q. J.; van den Maagdenberg, A. M. J. M.; Schepens, J. T. G.; Olde Weghuis, D.; Geurts van Kessel, A.; Wieringa, B.; Hendriks, W. J. A. J.: The mouse gene Ptprf encoding the leukocyte common antigen-related molecule LAR: cloning, characterization, and chromosomal localization. Genomics 27:124-130, 1995; and O'Grady, P.; Krueger, N. X.; Streuli, M.; Saito, H.: Genomic organization of the human LAR protein tyrosine phosphatase gene and alternative splicing in the extracellular fibronectin ty.

Further studies establishing the function and utilities of PTPRF are found in John Hopkins OMIM database record ID 179590, and in cited publications listed in Table 5, which are hereby incorporated by reference. Protein tyrosine phosphatase, receptor type, f (PTPRF, Accession NP_002831.1) is another GAM116 target gene, herein designated TARGET GENE. PTPRF BINDING SITE is a target binding site found in the 3' untranslated region of multiple transcripts of mRNA encoded by PTPRF, corresponding to a target binding site such as BINDING SITE I, BINDING SITE II or BINDING SITE III of FIG. 8. Table 4 illustrates the complementarity of the nucleotide sequences of PTPRF BINDING SITE, designated SEQ ID:2806, to the nucleotide sequence of GAM116 RNA, herein designated GAM RNA, also designated SEQ ID:301.

Another function of GAM116 is therefore inhibition of Protein tyrosine phosphatase, receptor type, f (PTPRF, Accession NP_002831.1), a gene which negatively regulates the insulin signaling pathway. Accordingly, utilities of GAM116 include diagnosis, prevention and treatment of diseases and clinical conditions associated with PTPRF.

The function of PTPRF has been established by previous studies. The LAR gene (symbolized PTPRF) encodes a membrane protein that has a cytoplasmic domain with homology to protein-tyrosine phosphatase 1B (OMIM Ref. No. 176885) and an extracellular domain homologous to the neural cellular adhesion molecule NCAM (OMIM Ref. No. 116930). The human LAR molecule closely resembles cell adhesion molecules, which suggests that it may be involved in the regulation of phosphotyrosine levels through cell-cell or cell-matrix interactions. As a first step toward site-directed mutagenesis studies of LAR function, Schaapveld et al. (1995) characterized the mouse Ptprf gene. They found that its cytoplasmic region is encoded by 11 exons that span only 4.5 kb of genomic DNA. Compared to the known exon-intron structures of other mammalian receptor-like protein tyrosine phosphatase genes such as Ptpra (encoding LRP; 176884) and Ptprc (coding for Ly-5; 151460), the portion of the Ptprf gene encoding the cytoplasmic region of murine LAR contained not only smaller, but also fewer introns. O'Grady et al. (1994) demonstrated that the human LAR gene is composed of 33 exons spanning over 85 kb. Exon 2 encodes the signal sequence and the first 4 amino acids in the mature LAR protein. The 3 immunoglobulin-like domains are encoded by exons 3 to 7, and the 8 fibronectin type III (OMIM Ref. No. FN-III) domains by exons 8 to 17. Exons 18 to 22 encode the juxtamembrane and transmembrane domains, and exons 23 to 33 encode the 2 conserved tyrosine phosphatase domains and the entire 3-prime untranslated region. Alternative splicing of LAR mRNA was revealed by RT-PCR analysis.

Full details of the abovementioned studies are described in the following publications, the disclosure of which are hereby incorporated by reference:

Schaapveld, R. Q. J.; van den Maagdenberg, A. M. J. M.; Schepens, J. T. G.; Olde Weghuis, D.; Geurts van Kessel, A.; Wieringa, B.; Hendriks, W. J. A. J.: The mouse gene Ptprf encoding the leukocyte common antigen-related molecule LAR: cloning, characterization, and chromosomal localization. Genomics 27:124-130, 1995; and O'Grady, P.; Krueger, N. X.; Streuli, M.; Saito, H.: Genomic organization of the human LAR protein tyrosine phosphatase gene and alternative splicing in the extracellular fibronectin ty.

Further studies establishing the function and utilities of PTPRF are found in John Hopkins OMIM database record ID 179590, and in cited publications listed in Table 5, which are hereby incorporated by reference. RAB9P40 (Accession NP_005824.1) is another GAM116 target gene, herein designated TARGET GENE. RAB9P40 BINDING SITE is a target binding site found in the 5' untranslated region of mRNA encoded by RAB9P40, corresponding to a target binding site such as BINDING SITE I, BINDING SITE II or BINDING SITE III of FIG. 8. Table 4 illustrates the complementarity of the nucleotide sequences of RAB9P40 BINDING SITE, designated SEQ ID:6382, to the nucleotide sequence of GAM116 RNA, herein designated GAM RNA, also designated SEQ ID:301.

Another function of GAM116 is therefore inhibition of RAB9P40 (Accession NP_005824.1). Accordingly, utilities of GAM116 include diagnosis, prevention and treatment of diseases and clinical conditions associated with RAB9P40.

Rap1b, member of ras oncogene family (RAP1B, Accession NP_056461.1) is another GAM116 target gene, herein designated TARGET GENE. RAP1B BINDING SITE is a target binding site found in the 3' untranslated region of mRNA encoded by RAP1B, corresponding to a target binding site such as BINDING SITE I, BINDING SITE II or BINDING SITE III of FIG. 8. Table 4 illustrates the complementarity of the nucleotide sequences of RAP1B BINDING SITE, designated SEQ ID:16170, to the nucleotide sequence of GAM116 RNA, herein designated GAM RNA, also designated SEQ ID:301.

Another function of GAM116 is therefore inhibition of Rap1b, member of ras oncogene family (RAP1B, Accession NP_056461.1), a gene which induces morphological reversion of a cell line transformed by a ras oncogene. Accordingly, utilities of GAM116 include diagnosis, prevention and treatment of diseases and clinical conditions associated with RAP1B.

The function of RAP1B and its association with various diseases and clinical conditions, has been established by previous studies, as described hereinabove with reference to GAM44.1. Regulator of g-protein signalling 17 (RGS17, Accession NP_036551.3) is another GAM116 target gene, herein designated TARGET GENE. RGS17 BINDING SITE is a target binding site found in the 3' untranslated region of mRNA encoded by RGS17, corresponding to a target binding site such as BINDING SITE I, BINDING SITE II or BINDING SITE III of FIG. 8. Table 4 illustrates the complementarity of the nucleotide sequences of RGS17 BINDING SITE, designated SEQ ID:16913, to the nucleotide sequence of GAM116 RNA, herein designated GAM RNA, also designated SEQ ID:301.

Another function of GAM116 is therefore inhibition of Regulator of g-protein signalling 17 (RGS17, Accession NP_036551.3). Accordingly, utilities of GAM116 include diagnosis, prevention and treatment of diseases and clinical conditions associated with RGS17.

Regulator of g-protein signalling 6 (RGS6, Accession NP_004287.3) is another GAM116 target gene, herein designated TARGET GENE. RGS6 BINDING SITE is a target binding site found in the 3' untranslated region of mRNA encoded by RGS6, corresponding to a target binding site such as BINDING SITE I, BINDING SITE II or BINDING SITE III of FIG. 8. Table 4 illustrates the complementarity of the nucleotide sequences of RGS6 BINDING SITE, designated SEQ ID:7127, to the nucleotide sequence of GAM116 RNA, herein designated GAM RNA, also designated SEQ ID:301.

Another function of GAM116 is therefore inhibition of Regulator of g-protein signalling 6 (RGS6, Accession NP_004287.3). Accordingly, utilities of GAM116 include diagnosis, prevention and treatment of diseases and clinical conditions associated with RGS6.

Ring finger protein 24 (RNF24, Accession NP_009150.1) is another GAM116 target gene, herein designated TARGET GENE. RNF24 BINDING SITE is a target binding site found in the 3' untranslated region of mRNA encoded by RNF24, corresponding to a target binding site such as BINDING SITE I, BINDING SITE II or BINDING SITE III of FIG. 8. Table 4 illustrates the complementarity of the nucleotide sequences of RNF24 BINDING SITE, designated SEQ ID:18774, to the nucleotide sequence of GAM116 RNA, herein designated GAM RNA, also designated SEQ ID:301.

Another function of GAM116 is therefore inhibition of Ring finger protein 24 (RNF24, Accession NP_009150.1). Accordingly, utilities of GAM116 include diagnosis, prevention and treatment of diseases and clinical conditions associated with RNF24.

Ribosomal protein s24 (RPS24, Accession NP_148982.1) is another GAM116 target gene, herein designated TARGET GENE. RPS24 BINDING SITE is a target binding site found in the 3' untranslated region of multiple transcripts of mRNA encoded by RPS24, corresponding to a target binding site such as BINDING SITE I, BINDING SITE II or BINDING SITE III of FIG. 8. Table 4 illustrates the complementarity of the nucleotide sequences of RPS24 BINDING SITE, designated SEQ ID:4670, to the nucleotide sequence of GAM116 RNA, herein designated GAM RNA, also designated SEQ ID:301.

Another function of GAM116 is therefore inhibition of Ribosomal protein s24 (RPS24, Accession NP_148982.1), a gene which is a component of the small 40S ribosomal subunit. Accordingly, utilities of GAM116 include diagnosis, prevention and treatment of diseases and clinical conditions associated with RPS24.

The function of RPS24 has been established by previous studies. Eukaryotic ribosomes are composed of 4 RNA species (see OMIM Ref. No. 180450) and at least 80 proteins. Brown et al. (1990) isolated a human ribosomal protein gene encoding a predicted 133-amino acid protein by probing a fibrosarcoma cDNA library with a ribosomal protein gene from Chinese hamster. By comparing the in vitro translation product with S24 from purified ribosomes on 2- dimensional gels, Brown et al. (1990) showed that the gene encodes the 40S ribosomal subunit protein S24 (RPS24). Xu and Roufa (1996) reported that RPS24 is organized into 6 exons and is differentially spliced to yield 2 isoforms, S24a and S24c, that are present in varying ratios in different tissues. Jones et al. (1997) used PCR of radiation and somatic cell hybrid panels to map the RPS24 gene to 10q22-q23. Kenmochi et al. (1998) confirmed the RPS24 mapping assignment reported by Jones et al. (1997).

Full details of the abovementioned studies are described in the following publications, the disclosure of which are hereby incorporated by reference:

Xu, W.-B.; Roufa, D. J.: The gene encoding human ribosomal protein S24 and tissue-specific expression of differentially spliced mRNAs. Gene 169:257-262, 1996; and Jones, A.-M.; Marzella, R.; Rocchi, M.; Hewitt, J. E.: Mapping of the human ribosomal small subunit protein gene RPS24 to the chromosome 10q22-q23 boundary. Genomics 39:121-122, 1997.

Further studies establishing the function and utilities of RPS24 are found in John Hopkins OMIM database record ID 602412, and in cited publications listed in Table 5, which are hereby incorporated by reference. Ribosomal protein s24 (RPS24, Accession NP_001017.1) is another GAM116 target gene, herein designated TARGET GENE. RPS24 BINDING SITE is a target binding site found in the 3' untranslated region of multiple transcripts of mRNA encoded by RPS24, corresponding to a target binding site such as BINDING SITE I, BINDING SITE II or BINDING SITE III of FIG. 8. Table 4 illustrates the complementarity of the nucleotide sequences of RPS24 BINDING SITE, designated SEQ ID:4670, to the nucleotide sequence of GAM116 RNA, herein designated GAM RNA, also designated SEQ ID:301.

Another function of GAM116 is therefore inhibition of Ribosomal protein s24 (RPS24, Accession NP_001017.1), a gene which is a component of the small 40S ribosomal subunit. Accordingly, utilities of GAM116 include diagnosis, prevention and treatment of diseases and clinical conditions associated with RPS24.

The function of RPS24 has been established by previous studies. Eukaryotic ribosomes are composed of 4 RNA species (see OMIM Ref. No. 180450) and at least 80 proteins. Brown et al. (1990) isolated a human ribosomal protein gene encoding a predicted 133-amino acid protein by probing a fibrosarcoma cDNA library with a ribosomal protein gene from Chinese hamster. By comparing the in vitro translation product with S24 from purified ribosomes on 2- dimensional gels, Brown et al. (1990) showed that the gene encodes the 40S ribosomal subunit protein S24 (RPS24). Xu and Roufa (1996) reported that RPS24 is organized into 6 exons and is differentially spliced to yield 2 isoforms, S24a and S24c, that are present in varying ratios in different tissues. Jones et al. (1997) used PCR of radiation and somatic cell hybrid panels to map the RPS24 gene to 10q22-q23. Kenmochi et al. (1998) confirmed the RPS24 mapping assignment reported by Jones et al. (1997).

Full details of the abovementioned studies are described in the following publications, the disclosure of which are hereby incorporated by reference:

Xu, W.-B.; Roufa, D. J.: The gene encoding human ribosomal protein S24 and tissue-specific expression of differentially spliced mRNAs. Gene 169:257-262, 1996; and Jones, A.-M.; Marzella, R.; Rocchi, M.; Hewitt, J. E.: Mapping of the human ribosomal small subunit protein gene RPS24 to the chromosome 10q22-q23 boundary. Genomics 39:121-122, 1997.

Further studies establishing the function and utilities of RPS24 are found in John Hopkins OMIM database record ID 602412, and in cited publications listed in Table 5, which are hereby incorporated by reference. Sodium channel, voltage gated, type viii, alpha polypeptide (SCN8A, Accession NP_055006.1) is another GAM116 target gene, herein designated TARGET GENE. SCN8A BINDING SITE is a target binding site found in the 3' untranslated region of mRNA encoded by SCN8A, corresponding to a target binding site such as BINDING SITE I, BINDING SITE II or BINDING SITE III of FIG. 8. Table 4 illustrates the complementarity of the nucleotide sequences of SCN8A BINDING SITE, designated SEQ ID:8797, to the nucleotide sequence of GAM116 RNA, herein designated GAM RNA, also designated SEQ ID:301.

Another function of GAM116 is therefore inhibition of Sodium channel, voltage gated, type viii, alpha polypeptide (SCN8A, Accession NP_055006.1), a gene which is component of a brain voltage-gated sodium channel. Accordingly, utilities of GAM116 include diagnosis, prevention and treatment of diseases and clinical conditions associated with SCN8A.

The function of SCN8A and its association with various diseases and clinical conditions, has been established by previous studies, as described hereinabove with reference to GAM63.1. SE57-1 (Accession NP_079490.1) is another GAM116 target gene, herein designated TARGET GENE. SE57-1 BINDING SITE is a target binding site found in the 3' untranslated region of mRNA encoded by SE57-1, corresponding to a target binding site such as BINDING SITE I, BINDING SITE II or BINDING SITE III of FIG. 8. Table 4 illustrates the complementarity of the nucleotide sequences of SE57-1 BINDING SITE, designated SEQ ID:19416, to the nucleotide sequence of GAM116 RNA, herein designated GAM RNA, also designated SEQ ID:301.

Another function of GAM116 is therefore inhibition of SE57-1 (Accession NP_079490.1). Accordingly, utilities of GAM116 include diagnosis, prevention and treatment of diseases and clinical conditions associated with SE57-1.

Secreted frizzled-related protein 1 (SFRP1, Accession NP_003003.2) is another GAM116 target gene, herein designated TARGET GENE. SFRP1 BINDING SITE is a target binding site found in the 3' untranslated region of mRNA encoded by SFRP1, corresponding to a target binding site such as BINDING SITE I, BINDING SITE II or BINDING SITE III of FIG. 8. Table 4 illustrates the complementarity of the nucleotide sequences of SFRP1 BINDING SITE, designated SEQ ID:12977, to the nucleotide sequence of GAM116 RNA, herein designated GAM RNA, also designated SEQ ID:301.

Another function of GAM116 is therefore inhibition of Secreted frizzled-related protein 1 (SFRP1, Accession NP_003003.2), a gene which is a receptor for wnt proteins that may have an anti-apoptotic function and therefore may be associated with Colorectal cancer, gastric cancer, uterine leiomyomas. Accordingly, utilities of GAM116 include diagnosis, prevention and treatment of Colorectal cancer, gastric cancer, uterine leiomyomas, and of other diseases and clinical conditions associated with SFRP1.

The function of SFRP1 and its association with various diseases and clinical conditions, has been established by previous studies, as described hereinabove with reference to GAM40.1. Sideroflexin 5 (SFXN5, Accession NP_653180.1) is another GAM116 target gene, herein designated TARGET GENE. SFXN5 BINDING SITE is a target binding site found in the 3' untranslated region of mRNA encoded by SFXN5, corresponding to a target binding site such as BINDING SITE I, BINDING SITE II or BINDING SITE III of FIG. 8. Table 4 illustrates the complementarity of the nucleotide sequences of SFXN5 BINDING SITE, designated SEQ ID:13244, to the nucleotide sequence of GAM116 RNA, herein designated GAM RNA, also designated SEQ ID:301.

Another function of GAM116 is therefore inhibition of Sideroflexin 5 (SFXN5, Accession NP_653180.1). Accordingly, utilities of GAM116 include diagnosis, prevention and treatment of diseases and clinical conditions associated with SFXN5.

Solute carrier family 16 (monocarboxylic acid transporters), member 10 (SLC16A10, Accession NP_061063.2) is another GAM116 target gene, herein designated TARGET GENE. SLC16A10 BINDING SITE is a target binding site found in the 3' untranslated region of mRNA encoded by SLC16A10, corresponding to a target binding site such as BINDING SITE I, BINDING SITE II or BINDING SITE III of FIG. 8. Table 4 illustrates the complementarity of the nucleotide sequences of SLC16A10 BINDING SITE, designated SEQ ID:1239, to the nucleotide sequence of GAM116 RNA, herein designated GAM RNA, also designated SEQ ID:301.

Another function of GAM116 is therefore inhibition of Solute carrier family 16 (monocarboxylic acid transporters), member 10 (SLC16A10, Accession NP_061063.2). Accordingly, utilities of GAM116 include diagnosis, prevention and treatment of diseases and clinical conditions associated with SLC16A10.

Solute carrier family 22 (organic anion/cation transporter), member 12 (SLC22A12, Accession NP_653186.2) is another GAM116 target gene, herein designated TARGET GENE. SLC22A12 BINDING SITE is a target binding site found in the 5' untranslated region of multiple transcripts of mRNA encoded by SLC22A12, corresponding to a target binding site such as BINDING SITE I, BINDING SITE II or BINDING SITE III of FIG. 8. Table 4 illustrates the complementarity of the nucleotide sequences of SLC22A12 BINDING SITE, designated SEQ ID:3144, to the nucleotide sequence of GAM116 RNA, herein designated GAM RNA, also designated SEQ ID:301.

Another function of GAM116 is therefore inhibition of Solute carrier family 22 (organic anion/cation transporter), member 12 (SLC22A12, Accession NP_653186.2), a gene which is a urate-anion exchanger regulating blood yrate levels and therefore may be associated with Renal hypouricemia. Accordingly, utilities of GAM116 include diagnosis, prevention and treatment of Renal hypouricemia, and of other diseases and clinical conditions associated with SLC22A12.

The function of SLC22A12 has been established by previous studies. Enomoto et al. (2002) isolated a SLC22A12 cDNA from a human kidney cDNA library. The cDNA, which they called URAT1 for 'urate transporter-1,' corresponds to a gene of 2,642 basepairs encoding a protein of 555 amino acids, which they called URAT1 for 'urate transporter-1,' that is 42% identical to OAT4 (OMIM Ref. No. 607097). The hydropathy plot predicts 12 membrane-spanning domains in URAT1, which are similar to those in members of the OAT family. URAT1 has 3 consensus sequences for N-glycosylation and 2 cyclic AMP-dependent protein kinase phosphorylation sites. High stringency Northern analysis revealed predominant expression of URAT1 mRNA in the human adult and fetal kidney, and immunohistochemical analysis revealed that URAT1 protein is prominent in epithelial cells of the proximal tubule of the renal cortex. Under high magnification, the protein was found to be located in the luminal membrane of the epithelium of proximal tubules but not in that of distal tubules Enomoto et al. (2002) demonstrated that Xenopus oocytes injected with URAT1 cRNA exhibited time-dependent transport activity of [14C]urate but not of various typical substrates of OATs or organic cation transporters. URAT1 was found to be a cotransporter with anions, in particular chloride, bromide, or iodine, but not fluoride. Enomoto et al. (2002) found that urate transport via URAT1 is inhibited selectively by organic anions such as lactate, nicotinate, acetoacetate, hydroxybutyrate, and succinate. Para-aminohippurate (PAH), the representative substrate of OATs, did not exert an inhibitory effect on urate uptake via URAT1, consistent with the observation that PAH has no effect on the fractional excretion of urate in humans. Benzbromarone, probenecid, phenylbutazone, sulfinpyrazone, nonsteroidal antiinflammatory drugs, and diuretics inhibited urate uptake. Trans-stimulation experiments indicated that the major counteranions that exchange for urate via URAT1 are organic anions rather than inorganic chloride. Patients with renal hypouricemia (OMIM Ref. No. 220150) have mutations in URAT1.

Full details of the abovementioned studies are described in the following publications, the disclosure of which are hereby incorporated by reference:

Enomoto, A.; Kimura, H.; Chairoungdua, A.; Shigeta, Y.; Jutabha, P.; Cha, S. H.; Hosoyamada, M.; Takeda, M.; Sekine, T.; Igarashi, T.; Matsuo, H.; Kikuchi, Y.; Oda, T.; Ichida, K.; Hosoy, T.; Shimokata, K.; Niwa, T.; Kanai, Y.; Endou, H.: Molecular identification of a renal urate-anion exchanger that regulates blood urate levels. Nature 417:447-452, 2002; and Enomoto, A.; Kimura, H.; Chairoungdua, A.; Shigeta, Y.; Jutabha, P.; Cha, S. H.; Hosoyamada, M.; Takeda, M.; Sekine, T.; Igarashi, T.; Matsuo, H.; Kikuchi, Y.; Oda, T.; Ichida, K.; Hosoya.

Further studies establishing the function and utilities of SLC22A12 are found in John Hopkins OMIM database record ID 607096, and in cited publications listed in Table 5, which are hereby incorporated by reference. Solute carrier family 22 (organic anion/cation transporter), member 12 (SLC22A12, Accession NP_700357.1) is another GAM116 target gene, herein designated TARGET GENE. SLC22A12 BINDING SITE is a target binding site found in the 5' untranslated region of multiple transcripts of mRNA encoded by SLC22A12, corresponding to a target binding site such as BINDING SITE I, BINDING SITE II or BINDING SITE III of FIG. 8. Table 4 illustrates the complementarity of the nucleotide sequences of SLC22A12 BINDING SITE, designated SEQ ID:3144, to the nucleotide sequence of GAM116 RNA, herein designated GAM RNA, also designated SEQ ID:301.

Another function of GAM116 is therefore inhibition of Solute carrier family 22 (organic anion/cation transporter), member 12 (SLC22A12, Accession NP_700357.1), a gene which is a urate -anion exchanger regulating blood yrate levels and therefore may be associated with Renal hypouricemia. Accordingly, utilities of GAM116 include diagnosis, prevention and treatment of Renal hypouricemia, and of other diseases and clinical conditions associated with SLC22A12.

The function of SLC22A12 has been established by previous studies. Enomoto et al. (2002) isolated a SLC22A12 cDNA from a human kidney cDNA library. The cDNA, which they called URAT1 for 'urate transporter-1,' corresponds to a gene of 2,642 basepairs encoding a protein of 555 amino acids, which they called URAT1 for 'urate transporter-1,' that is 42% identical to OAT4 (OMIM Ref. No. 607097). The hydropathy plot predicts 12 membrane-spanning domains in URAT1, which are similar to those in members of the OAT family. URAT1 has 3 consensus sequences for N-glycosylation and 2 cyclic AMP-dependent protein kinase phosphorylation sites. High stringency Northern analysis revealed predominant expression of URAT1 mRNA in the human adult and fetal kidney, and immunohistochemical analysis revealed that URAT1 protein is prominent in epithelial cells of the proximal tubule of the renal cortex. Under high magnification, the protein was found to be located in the luminal membrane of the epithelium of proximal tubules but not in that of distal tubules Enomoto et al. (2002) demonstrated that Xenopus oocytes injected with URAT1 cRNA exhibited time-dependent transport activity of [14C]urate but not of various typical substrates of OATs or organic cation transporters. URAT1 was found to be a cotransporter with anions, in particular chloride, bromide, or iodine, but not fluoride. Enomoto et al. (2002) found that urate transport via URAT1 is inhibited selectively by organic anions such as lactate, nicotinate, acetoacetate, hydroxybutyrate, and succinate. Para-aminohippurate (PAH), the representative substrate of OATs, did not exert an inhibitory effect on urate uptake via URAT1, consistent with the observation that PAH has no effect on the fractional excretion of urate in humans. Benzbromarone, probenecid, phenylbutazone, sulfinpyrazone, nonsteroidal antiinflammatory drugs, and diuretics inhibited urate uptake. Trans-stimulation experiments indicated that the major counteranions that exchange for urate via URAT1 are organic anions rather than inorganic chloride. Patients with renal hypouricemia (OMIM Ref. No. 220150) have mutations in URAT1.

Full details of the abovementioned studies are described in the following publications, the disclosure of which are hereby incorporated by reference:

Enomoto, A.; Kimura, H.; Chairoungdua, A.; Shigeta, Y.; Jutabha, P.; Cha, S. H.; Hosoyamada, M.; Takeda, M.; Sekine, T.; Igarashi, T.; Matsuo, H.; Kikuchi, Y.; Oda, T.; Ichida, K.; Hosoy, T.; Shimokata, K.; Niwa, T.; Kanai, Y.; Endou, H.: Molecular identification of a renal urate-anion exchanger that regulates blood urate levels. Nature 417:447-452, 2002; and Enomoto, A.; Kimura, H.; Chairoungdua, A.; Shigeta, Y.; Jutabha, P.; Cha, S. H.; Hosoyamada, M.; Takeda, M.; Sekine, T.; Igarashi, T.; Matsuo, H.; Kikuchi, Y.; Oda, T.; Ichida, K.; Hosoya.

Further studies establishing the function and utilities of SLC22A12 are found in John Hopkins OMIM database record ID 607096, and in cited publications listed in Table 5, which are hereby incorporated by reference. Solute carrier family 9 (sodium/hydrogen exchanger), isoform 3 regulatory factor 1 (SLC9A3R1, Accession NP_004243.1) is another GAM116 target gene, herein designated TARGET GENE. SLC9A3R1 BINDING SITE is a target binding site found in the 3' untranslated region of mRNA encoded by SLC9A3R1, corresponding to a target binding site such as BINDING SITE I, BINDING SITE II or BINDING SITE III of FIG. 8. Table 4 illustrates the complementarity of the nucleotide sequences of SLC9A3R1 BINDING SITE, designated SEQ ID:11349, to the nucleotide sequence of GAM116 RNA, herein designated GAM RNA, also designated SEQ ID:301.

Another function of GAM116 is therefore inhibition of Solute carrier family 9 (sodium/hydrogen exchanger), isoform 3 regulatory factor 1 (SLC9A3R1, Accession NP_004243.1), a gene which is the regulatory cofactor of the NHE3 (SLC9A3) sodium/hydrogen antiporter. Accordingly, utilities of GAM116 include diagnosis, prevention and treatment of diseases and clinical conditions associated with SLC9A3R1.

The function of SLC9A3R1 and its association with various diseases and clinical conditions, has been established by previous studies, as described hereinabove with reference to GAM63.1. Sorbitol dehydrogenase (SORD, Accession NP_003095.1) is another GAM116 target gene, herein designated TARGET GENE. SORD BINDING SITE is a target binding site found in the 3' untranslated region of mRNA encoded by SORD, corresponding to a target binding site such as BINDING SITE I, BINDING SITE II or BINDING SITE III of FIG. 8. Table 4 illustrates the complementarity of the nucleotide sequences of SORD BINDING SITE, designated SEQ ID:10531, to the nucleotide sequence of GAM116 RNA, herein designated GAM RNA, also designated SEQ ID:301.

Another function of GAM116 is therefore inhibition of Sorbitol dehydrogenase (SORD, Accession NP_003095.1). Accordingly, utilities of GAM116 include diagnosis, prevention and treatment of diseases and clinical conditions associated with SORD.

Sry (sex determining region y)-box 1 (SOX1, Accession NP_005977.2) is another GAM116 target gene, herein designated TARGET GENE. SOX1 BINDING SITE is a target binding site found in the 3' untranslated region of mRNA encoded by SOX1, corresponding to a target binding site such as BINDING SITE I, BINDING SITE II or BINDING SITE III of FIG. 8. Table 4 illustrates the complementarity of the nucleotide sequences of SOX1 BINDING SITE, designated SEQ ID:17428, to the nucleotide sequence of GAM116 RNA, herein designated GAM RNA, also designated SEQ ID:301.

Another function of GAM116 is therefore inhibition of Sry (sex determining region y)-box 1 (SOX1, Accession NP_005977.2). Accordingly, utilities of GAM116 include diagnosis, prevention and treatment of diseases and clinical conditions associated with SOX1.

Sry (sex determining region y)-box 13 (SOX13, Accession NP_005677.1) is another GAM116 target gene, herein designated TARGET GENE. SOX13 BINDING SITE is a target binding site found in the 3' untranslated region of mRNA encoded by SOX13, corresponding to a target binding site such as BINDING SITE I, BINDING SITE II or BINDING SITE III of FIG. 8. Table 4 illustrates the complementarity of the nucleotide sequences of SOX13 BINDING SITE, designated SEQ ID:15099, to the nucleotide sequence of GAM116 RNA, herein designated GAM RNA, also designated SEQ ID:301.

Another function of GAM116 is therefore inhibition of Sry (sex determining region y)-box 13 (SOX13, Accession NP_005677.1). Accordingly, utilities of GAM116 include diagnosis, prevention and treatment of diseases and clinical conditions associated with SOX13.

Spermatogenesis associated 2 (SPATA2, Accession NP_006029.1) is another GAM116 target gene, herein designated TARGET GENE. SPATA2 BINDING SITE is a target binding site found in the 3' untranslated region of mRNA encoded by SPATA2, corresponding to a target binding site such as BINDING SITE I, BINDING SITE II or BINDING SITE III of FIG. 8. Table 4 illustrates the complementarity of the nucleotide sequences of SPATA2 BINDING SITE, designated SEQ ID:11422, to the nucleotide sequence of GAM116 RNA, herein designated GAM RNA, also designated SEQ ID:301.

Another function of GAM116 is therefore inhibition of Spermatogenesis associated 2 (SPATA2, Accession NP_006029.1). Accordingly, utilities of GAM116 include diagnosis, prevention and treatment of diseases and clinical conditions associated with SPATA2.

Suppression of tumorigenicity 14 (colon carcinoma, matriptase, epithin) (ST14, Accession NP_068813.1) is another GAM116 target gene, herein designated TARGET GENE. ST14 BINDING SITE is a target binding site found in the 3' untranslated region of mRNA encoded by ST14, corresponding to a target binding site such as BINDING SITE I, BINDING SITE II or BINDING SITE III of FIG. 8. Table 4 illustrates the complementarity of the nucleotide sequences of ST14 BINDING SITE, designated SEQ ID:14983, to the nucleotide sequence of GAM116 RNA, herein designated GAM RNA, also designated SEQ ID:301.

Another function of GAM116 is therefore inhibition of Suppression of tumorigenicity 14 (colon carcinoma, matriptase, epithin) (ST14, Accession NP_068813.1), a gene which is proposed to play a role in breast cancer invasion and metastasis. Accordingly, utilities of GAM116 include diagnosis, prevention and treatment of diseases and clinical conditions associated with ST14.

The function of ST14 has been established by previous studies. Lin et al. (1999) cloned an ST14 cDNA encoding a protease previously identified in breast cancer cells (Lin et al., 1997). The deduced 683-amino acid protein has a calculated molecular mass of 75.6 kD. It contains an integrin-binding site near the N terminus, 3 potential N-glycosylation sites, 4 tandem repeats homologous to the 35-amino acid cysteine-containing repeats of the LDL receptor, a putative proteolytic activation site, and a C-terminal region with similarity to the trypsin-like serine proteases. Lin et al. (1999) purified ST14 in a 95-kD complex with a 40-kD binding protein identified as SPINT1 (OMIM Ref. No. 605123), a Kunitz-type serine protease inhibitor. They found that ST14 is secreted from breast cancer cells and localizes at the cell surface. Takeuchi et al. (1999) independently cloned ST14 as a protease associated with prostatic cancer tumor cells, using degenerate primers for a chymotrypsin active site as probe. Sequence analysis showed that ST14 lacks a signal sequence and is likely to be a membrane-associated serine protease. By Northern blot analysis, they identified a 3.3-kb transcript in epithelial tissues including prostate, kidney, lung, small intestine, stomach, colon, and placenta, as well as in spleen, liver, leukocytes, and thymus. No expression was found in muscle, brain, ovary, or testis. Expression was also observed in a colorectal adenocarcinoma cell line, but not in several other cell lines tested. By Northern and Western blot analysis of normal breast and breast cancer cell lines, Oberst et al. (2001) found complete concordance in expression of ST14 and SPINT1; the expression correlated with expression of epithelial cell markers.

Full details of the abovementioned studies are described in the following publications, the disclosure of which are hereby incorporated by reference:

Lin, C.-Y.; Anders, J.; Johnson, M.; Sang, Q. A.; Dickson, R. B.: Molecular cloning of cDNA for matriptase, a matrix-degrading serine protease with trypsin-like activity. J. Biol. Chem. 274:18231-18236, 1999; and Takeuchi, T.; Shuman, M. A.; Craik, C. S.: Reverse biochemistry: use of macromolecular protease inhibitors to dissect complex biological processes and identify a membrane-type serine.

Further studies establishing the function and utilities of ST14 are found in John Hopkins OMIM database record ID 606797, and in cited publications listed in Table 5, which are hereby incorporated by reference. Tyrosyl-dna phosphodiesterase 1 (TDP1, Accession NP_060789.2) is another GAM116 target gene, herein designated TARGET GENE. TDP1 BINDING SITE is a target binding site found in the 3' untranslated region of mRNA encoded by TDP1, corresponding to a target binding site such as BINDING SITE I, BINDING SITE II or BINDING SITE III of FIG. 8. Table 4 illustrates the complementarity of the nucleotide sequences of TDP1 BINDING SITE, designated SEQ ID:14692, to the nucleotide sequence of GAM116 RNA, herein designated GAM RNA, also designated SEQ ID:301.

Another function of GAM116 is therefore inhibition of Tyrosyl-dna phosphodiesterase 1 (TDP1, Accession NP_060789.2). Accordingly, utilities of GAM116 include diagnosis, prevention and treatment of diseases and clinical conditions associated with TDP1.

TEM1 (Accession NP_065137.1) is another GAM116 target gene, herein designated TARGET GENE. TEM1 BINDING SITE is a target binding site found in the 3' untranslated region of mRNA encoded by TEM1, corresponding to a target binding site such as BINDING SITE I, BINDING SITE II or BINDING SITE III of FIG. 8. Table 4 illustrates the complementarity of the nucleotide sequences of TEM1 BINDING SITE, designated SEQ ID:14211, to the nucleotide sequence of GAM116 RNA, herein designated GAM RNA, also designated SEQ ID:301.

Another function of GAM116 is therefore inhibition of TEM1 (Accession NP_065137.1), a gene which involves in angiogenesis and therefore may be associated with Colorectal cancer. Accordingly, utilities of GAM116 include diagnosis, prevention and treatment of Colorectal cancer, and of other diseases and clinical conditions associated with TEM1.

The function of TEM1 has been established by previous studies. Endosialin, an antigen recognized by monoclonal antibody FB5, is expressed as a 165-kD cell surface glycoprotein on tumor blood vessel endothelium in several cancers, but is not detectable in normal tissue. By immunoaffinity and biochemical purification of endosialin from a neuroblastoma cell line, followed by microsequence analysis and EST database searching, Christian et al. (2001) isolated a full-length cDNA encoding endosialin, which is identical to TEM1. Sequence analysis predicted that the 757-amino acid type I membrane protein contains a signal peptide; 5 globular extracellular domains, including a C-type lectin (see OMIM Ref. No. 605306) domain, a Sushi/SCR/CCP (see OMIM Ref. No. 300187) domain, and 3 EGF (OMIM Ref. No. 131530) repeats; a mucin (see OMIM Ref. No. 158340)-like region; a transmembrane segment; and a short cytoplasmic tail. Carbohydrate analysis indicated that the endosialin protein carries abundantly sialylated, O-linked oligosaccharides and is reduced to 120 kD by sialidase treatment or to 95 kD with additional O-glycanase treatment. The N-terminal 360 residues of endosialin are homologous to thrombomodulin (THBD; 188040) and complement component 1q receptor (OMIM Ref. No. 120577). Northern blot analysis revealed expression of a single 2.6-kb transcript in endosialin-expressing cell lines. Christian et al. (2001) noted that mice and rats have close homologs of the TEM1 gene. Carson-Walter et al. (2001) determined that TEM1 shares 77% amino acid identity with the mouse protein. Using in situ hybridization analysis of human colorectal cancer, Carson-Walter et al. (2001) demonstrated that TEM1 was expressed clearly in the endothelial cells of the tumor stroma but not in the endothelial cells of normal colonic tissue. Mouse Tem1 was abundantly expressed in vessels infiltrating both mouse melanoma and human colon carcinoma cells implanted into mice. Using in situ hybridization to assay expression in various normal adult mouse tissues, Carson-Walter et al. (2001) detected only weak staining of endothelial cells in adrenal gland, brain, heart, intestine, lung, skeletal muscle, and pancreas. In embryos, they detected Tem1 in the vasculature of developing embryonic liver and brain.

Full details of the abovementioned studies are described in the following publications, the disclosure of which are hereby incorporated by reference:

Christian, S.; Ahorn, H.; Koehler, A.; Eisenhaber, F.; Rodi, H.-P.; Garin-Chesa, P.; Park, J. E.; Rettig, W. J.; Lenter, M. C.: Molecular cloning and characterization of endosialin, a C-type lectin-like cell surface receptor of tumor endothelium. J. Biol. Chem. 276:7408-7414, 2001; and Carson-Walter, E. B.; Watkins, D. N.; Nanda, A.; Vogelstein, B.; Kinzler, K. W.; St. Croix, B.: Cell surface tumor endothelial markers are conserved in mice and humans. Cancer Res. 61.

Further studies establishing the function and utilities of TEM1 are found in John Hopkins OMIM database record ID 606064, and in cited publications listed in Table 5, which are hereby incorporated by reference. Thy-1 cell surface antigen (THY1, Accession NP_006279.2) is another GAM116 target gene, herein designated TARGET GENE. THY1 BINDING SITE is a target binding site found in the 3' untranslated region of mRNA encoded by THY1, corresponding to a target binding site such as BINDING SITE I, BINDING SITE II or BINDING SITE III of FIG. 8. Table 4 illustrates the complementarity of the nucleotide sequences of THY1 BINDING SITE, designated SEQ ID:13826, to the nucleotide sequence of GAM116 RNA, herein designated GAM RNA, also designated SEQ ID:301.

Another function of GAM116 is therefore inhibition of Thy-1 cell surface antigen (THY1, Accession NP_006279.2), a gene which plays a role in cell-cell or cell-ligand interactions during synaptogenesis. Accordingly, utilities of GAM116 include diagnosis, prevention and treatment of diseases and clinical conditions associated with THY1.

The function of THY1 and its association with various diseases and clinical conditions, has been established by previous studies, as described hereinabove with reference to GAM74.1. Torsin family 2, member a (TOR2A, Accession NP_569726.1) is another GAM116 target gene, herein designated TARGET GENE. TOR2A BINDING SITE is a target binding site found in the 3' untranslated region of mRNA encoded by TOR2A, corresponding to a target binding site such as BINDING SITE I, BINDING SITE II or BINDING SITE III of FIG. 8. Table 4 illustrates the complementarity of the nucleotide sequences of TOR2A BINDING SITE, designated SEQ ID:12108, to the nucleotide sequence of GAM116 RNA, herein designated GAM RNA, also designated SEQ ID:301.

Another function of GAM116 is therefore inhibition of Torsin family 2, member a (TOR2A, Accession NP_569726.1). Accordingly, utilities of GAM116 include diagnosis, prevention and treatment of diseases and clinical conditions associated with TOR2A.

Tnf receptor-associated factor 1 (TRAF1, Accession NP_005649.1) is another GAM116 target gene, herein designated TARGET GENE. TRAF1 BINDING SITE is a target binding site found in the 3' untranslated region of mRNA encoded by TRAF1, corresponding to a target binding site such as BINDING SITE I, BINDING SITE II or BINDING SITE III of FIG. 8. Table 4 illustrates the complementarity of the nucleotide sequences of TRAF1 BINDING SITE, designated SEQ ID:4417, to the nucleotide sequence of GAM116 RNA, herein designated GAM RNA, also designated SEQ ID:301.

Another function of GAM116 is therefore inhibition of Tnf receptor-associated factor 1 (TRAF1, Accession NP_005649.1), a gene which signal transducer associated with the cytoplasmic domain of the 75 kda tumor necrosis factor receptor (tnf-r2). Accordingly, utilities of GAM116 include diagnosis, prevention and treatment of diseases and clinical conditions associated with TRAF1.

The function of TRAF1 has been established by previous studies. In order to determine how tumor necrosis factor (TNF; 191160) elicits cellular response, factors that interact with the cytoplasmic domain of TNF receptor-2 (TNFR2; 191191) were identified. Rothe et al. (1994) used the yeast-based 2-hybrid system to detect mouse proteins that interact with TNFR2. They identified and cloned 2 TNF receptor-associated factors, which they termed TRAF1 and TRAF2 (OMIM Ref. No. 601895). Each of the TRAFs contains a C-terminal TRAF domain of approximately 230 amino acids. TRAF1 and TRAF2 can form both homo- and heterodimers. Mosialos et al. (1995) identified the human homolog of TRAF1 as Epstein-Barr virus (EBV)- induced mRNA 6 (EBI6), an mRNA that is more abundant in EBV-infected B lymphoblasts than in uninfected control cells. The predicted 416-amino acid human protein is 86% identical to mouse TRAF1. Both the human and mouse proteins contain N-terminal zinc finger motifs and C-terminal TRAF domains. Northern blot analysis revealed that the 2.6-kb EBI6 mRNA is expressed in lung, spleen, tonsil, and weakly in placenta. Mosialos et al. (1995) found that LMP1, the EBV-transforming protein, specifically associates with LAP1 (TRAF3) or EBI6 in B lymphoblasts. LMP1 expression redirects LAP1 and EBI6 from scattered cytoplasmic structures to LMP1 plasma membrane patches. Both LAP1 and EBI6 associated with the cytoplasmic domain of p80/TNFR2 in vivo. The authors stated that the interaction of LMP1 with the LAP1 and EBI6 TNFR-associated proteins is evidence for the role of these proteins in signaling, and links LMP1-mediated transformation to signal transduction from the TNFR family. The structural hallmark of signal-transducing proteins associated with members of the TNFR superfamily is a novel C-terminal homology region of 230 amino acids, designated the TRAF domain. This domain is involved in a variety of specific protein-protein interactions. Siemienski et al. (1997) found that the human TRAF1 gene has a total length of approximately 12 kb. It is split into 6 exons, 4 of which encode parts of the TRAF domain. Analysis of the genomic structure of the TRAF domains of TRAF2 and TRAF3 (OMIM Ref. No. 601896) suggest that these domains are also encoded by several exons.

Animal model experiments lend further support to the function of TRAF1. Tsitsikov et al. (2001) generated Traf1 null mice. Although lymphocyte development was normal, T cells responded to anti-CD3 stimulation with enhanced proliferation. Through TNFR2, but not through TNFR1 (OMIM Ref. No. 191190), they also exhibited enhanced proliferation as well as NFKB (OMIM Ref. No. 164011) and AP1 activation. TNF-induced, lymphocyte-dependent skin necrosis occurred in Traf1 -/- mice at a suboptimal dose of the cytokine. Tsitsikov et al. (2001) concluded that TRAF1 negatively regulates TNFR2-mediated proliferation and NFKB activation It is appreciated that the abovementioned animal model for TRAF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Siemienski, K.; Peters, N.; Scheurich, P.; Wajant, H.: Organization of the human tumour necrosis factor receptor-associated factor 1 (TRAF1) gene and mapping to chromosome 9q33-34. Gene 195:35-39, 1997; and Tsitsikov, E. N.; Laouini, D.; Dunn, I. F.; Sannikova, T. Y.; Davidson, L.; Alt, F. W.; Geha, R. S.: TRAF1 is a negative regulator of TNF signaling: enhanced TNF signaling in TRAF1-defi.

Further studies establishing the function and utilities of TRAF1 are found in John Hopkins OMIM database record ID 601711, and in cited publications listed in Table 5, which are hereby incorporated by reference. Tripartite motif-containing 34 (TRIM34, Accession NP_569073.1) is another GAM116 target gene, herein designated TARGET GENE. TRIM34 BINDING SITE is a target binding site found in the 5' untranslated region of multiple transcripts of mRNA encoded by TRIM34, corresponding to a target binding site such as BINDING SITE I, BINDING SITE II or BINDING SITE III of FIG. 8. Table 4 illustrates the complementarity of the nucleotide sequences of TRIM34 BINDING SITE, designated SEQ ID:6774, to the nucleotide sequence of GAM116 RNA, herein designated GAM RNA, also designated SEQ ID:301.

Another function of GAM116 is therefore inhibition of Tripartite motif-containing 34 (TRIM34, Accession NP_569073.1). Accordingly, utilities of GAM116 include diagnosis, prevention and treatment of diseases and clinical conditions associated with TRIM34.

TSC22 (Accession NP_006013.1) is another GAM116 target gene, herein designated TARGET GENE. TSC22 BINDING SITE is a target binding site found in the 3' untranslated region of mRNA encoded by TSC22, corresponding to a target binding site such as BINDING SITE I, BINDING SITE II or BINDING SITE III of FIG. 8. Table 4 illustrates the complementarity of the nucleotide sequences of TSC22 BINDING SITE, designated SEQ ID:16490, to the nucleotide sequence of GAM116 RNA, herein designated GAM RNA, also designated SEQ ID:301.

Another function of GAM116 is therefore inhibition of TSC22 (Accession NP_006013.1). Accordingly, utilities of GAM116 include diagnosis, prevention and treatment of diseases and clinical conditions associated with TSC22.

Translin-associated factor x interacting protein 1 (TSNAXIP1, Accession NP_060900.1) is another GAM116 target gene, herein designated TARGET GENE. TSNAXIP1 BINDING SITE is a target binding site found in the 5' untranslated region of mRNA encoded by TSNAXIP1, corresponding to a target binding site such as BINDING SITE I, BINDING SITE II or BINDING SITE III of FIG. 8. Table 4 illustrates the complementarity of the nucleotide sequences of TSNAXIP1 BINDING SITE, designated SEQ ID:19890, to the nucleotide sequence of GAM116 RNA, herein designated GAM RNA, also designated SEQ ID:301.

Another function of GAM116 is therefore inhibition of Translin-associated factor x interacting protein 1 (TSNAXIP1, Accession NP_060900.1). Accordingly, utilities of GAM116 include diagnosis, prevention and treatment of diseases and clinical conditions associated with TSNAXIP1.

Vesicle transport through interaction with t-snares homolog 1b (yeast) (VTI1B, Accession NP_006361.1) is another GAM116 target gene, herein designated TARGET GENE. VTI1B BINDING SITE is a target binding site found in the 3' untranslated region of mRNA encoded by VTI1B, corresponding to a target binding site such as BINDING SITE I, BINDING SITE II or BINDING SITE III of FIG. 8. Table 4 illustrates the complementarity of the nucleotide sequences of VTI1B BINDING SITE, designated SEQ ID:18660, to the nucleotide sequence of GAM116 RNA, herein designated GAM RNA, also designated SEQ ID:301.

Another function of GAM116 is therefore inhibition of Vesicle transport through interaction with t-snares homolog 1b (yeast) (VTI1B, Accession NP_006361.1). Accordingly, utilities of GAM116 include diagnosis, prevention and treatment of diseases and clinical conditions associated with VTI1B.

Wingless-type mmtv integration site family, member 5a (WNT5A, Accession NP_003383.1) is another GAM116 target gene, herein designated TARGET GENE. WNT5A BINDING SITE is a target binding site found in the 3' untranslated region of mRNA encoded by WNT5A, corresponding to a target binding site such as BINDING SITE I, BINDING SITE II or BINDING SITE III of FIG. 8. Table 4 illustrates the complementarity of the nucleotide sequences of WNT5A BINDING SITE, designated SEQ ID:13031, to the nucleotide sequence of GAM116 RNA, herein designated GAM RNA, also designated SEQ ID:301.

Another function of GAM116 is therefore inhibition of Wingless-type mmtv integration site family, member 5a (WNT5A, Accession NP_003383.1), a gene which is a ligand for members of the frizzled family of seven transmembrane receptors and is probablely a developmental protein. Accordingly, utilities of GAM116 include diagnosis, prevention and treatment of diseases and clinical conditions associated with WNT5A.

The function of WNT5A has been established by previous studies. The Wnt genes belong to a family of protooncogenes with at least 13 known members that are expressed in species ranging from Drosophila to man. The name Wnt denotes the relationship of this family to the Drosophila segment polarity gene 'wingless' and to its vertebrate ortholog, Int1, a mouse protooncogene (see OMIM Ref. No. 164820). Transcription of Wnt family genes appears to be developmentally regulated in a precise temporal and spatial manner. The Wnt family is considered to be 1 of the 3 major families of signaling molecules in the mouse, the others being the fibroblast growth factor-related family (see OMIM Ref. No. 164980) and the transforming growth factor-beta-related family (TGFB; 190180). Using degenerate PCR and cDNA library screening to search for mouse genes related to Wnt1, Gavin et al. (1990) identified 6 new members of the Wnt gene family, including Wnt5a. The Wnt genes encode 38- to 43-kD cysteine-rich putative glycoproteins, which have features typical of secreted growth factors: a hydrophobic signal sequence and 21 conserved cysteine residues whose relative spacing is maintained. Northern blot analysis detected expression of Wnt5a in brain, lung, and heart. At least 5 distinct Wnt5a transcripts were observed, which Gavin et al. (1990) hypothesized were due to transcript variability 5-prime to the initiation methionine. In situ hybridization detected a complex spatial and temporal pattern of Wnt5a in the mouse, including expression in the developing central nervous system, limbs, facial processes and the posterior region of the fetus. Clark et al. (1993) cloned and sequenced several overlapping cDNAs encoding approximately 4.1 kb of the human homolog of Wnt5A. Expression of the human gene, symbolized WNT5A, was detected only in neonatal heart and lung. He et al. (1997) showed that human frizzled-5 (OMIM Ref. No. 601723) is the receptor for the Wnt5A ligand.

Full details of the abovementioned studies are described in the following publications, the disclosure of which are hereby incorporated by reference:

Gavin, B. J.; McMahon, J. A.; McMahon, A. P.: Expression of multiple novel Wnt-1/int-1-related genes during fetal and adult mouse development. Genes Dev. 4:2319-2332, 1990; and He, X.; Saint-Jeannet, J.-P.; Wang, Y.; Nathans, J.; Dawid, I.; Varmus, H.: A member of the frizzled protein family mediating axis induction by Wnt-5A. Science 275:1652-1654, 1997.

Further studies establishing the function and utilities of WNT5A are found in John Hopkins OMIM database record ID 164975, and in cited publications listed in Table 5, which are hereby incorporated by reference. XT3 (Accession NP_064593.1) is another GAM116 target gene, herein designated TARGET GENE. XT3 BINDING SITE is a target binding site found in the 3' untranslated region of multiple transcripts of mRNA encoded by XT3, corresponding to a target binding site such as BINDING SITE I, BINDING SITE II or BINDING SITE III of FIG. 8. Table 4 illustrates the complementarity of the nucleotide sequences of XT3 BINDING SITE, designated SEQ ID:16618, to the nucleotide sequence of GAM116 RNA, herein designated GAM RNA, also designated SEQ ID:301.

Another function of GAM116 is therefore inhibition of XT3 (Accession NP_064593.1), a gene which is a Kidney-specific orphan transporter. Accordingly, utilities of GAM116 include diagnosis, prevention and treatment of diseases and clinical conditions associated with XT3.

The function of XT3 and its association with various diseases and clinical conditions, has been established by previous studies, as described hereinabove with reference to GAM66.1. XT3 (Accession NP_071800.1) is another GAM116 target gene, herein designated TARGET GENE. XT3 BINDING SITE is a target binding site found in the 3' untranslated region of multiple transcripts of mRNA encoded by XT3, corresponding to a target binding site such as BINDING SITE I, BINDING SITE II or BINDING SITE III of FIG. 8. Table 4 illustrates the complementarity of the nucleotide sequences of XT3 BINDING SITE, designated SEQ ID:16618, to the nucleotide sequence of GAM116 RNA, herein designated GAM RNA, also designated SEQ ID:301.

Another function of GAM116 is therefore inhibition of XT3 (Accession NP_071800.1), a gene which is a Kidney-specific orphan transporter. Accordingly, utilities of GAM116 include diagnosis, prevention and treatment of diseases and clinical conditions associated with XT3.

The function of XT3 and its association with various diseases and clinical conditions, has been established by previous studies, as described hereinabove with reference to GAM66.1. Zinc finger protein 180 (hhz168) (ZNF180, Accession NP_037388.1) is another GAM116 target gene, herein designated TARGET GENE. ZNF180 BINDING SITE is a target binding site found in the 3' untranslated region of mRNA encoded by ZNF180, corresponding to a target binding site such as BINDING SITE I, BINDING SITE II or BINDING SITE III of FIG. 8. Table 4 illustrates the complementarity of the nucleotide sequences of ZNF180 BINDING SITE, designated SEQ ID:10372, to the nucleotide sequence of GAM116 RNA, herein designated GAM RNA, also designated SEQ ID:301.

Another function of GAM116 is therefore inhibition of Zinc finger protein 180 (hhz168) (ZNF180, Accession NP_037388.1). Accordingly, utilities of GAM116 include diagnosis, prevention and treatment of diseases and clinical conditions associated with ZNF180.

Zinc finger protein 31 (kox 29) (ZNF31, Accession NP_660281.1) is another GAM116 target gene, herein designated TARGET GENE. ZNF31 BINDING SITE is a target binding site found in the 3' untranslated region of mRNA encoded by ZNF31, corresponding to a target binding site such as BINDING SITE I, BINDING SITE II or BINDING SITE III of FIG. 8. Table 4 illustrates the complementarity of the nucleotide sequences of ZNF31 BINDING SITE, designated SEQ ID:9409, to the nucleotide sequence of GAM116 RNA, herein designated GAM RNA, also designated SEQ ID:301.

Another function of GAM116 is therefore inhibition of Zinc finger protein 31 (kox 29) (ZNF31, Accession NP_660281.1). Accordingly, utilities of GAM116 include diagnosis, prevention and treatment of diseases and clinical conditions associated with ZNF31.

Zinc finger protein 323 (ZNF323, Accession NP_112161.2) is another GAM116 target gene, herein designated TARGET GENE. ZNF323 BINDING SITE is a target binding site found in the 3' untranslated region of mRNA encoded by ZNF323, corresponding to a target binding site such as BINDING SITE I, BINDING SITE II or BINDING SITE III of FIG. 8. Table 4 illustrates the complementarity of the nucleotide sequences of ZNF323 BINDING SITE, designated SEQ ID:5822, to the nucleotide sequence of GAM116 RNA, herein designated GAM RNA, also designated SEQ ID:301.

Another function of GAM116 is therefore inhibition of Zinc finger protein 323 (ZNF323, Accession NP_112161.2). Accordingly, utilities of GAM116 include diagnosis, prevention and treatment of diseases and clinical conditions associated with ZNF323.

Zinc finger protein 70 (cos17) (ZNF70, Accession NP_852101.1) is another GAM116 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:2508, to the nucleotide sequence of GAM116 RNA, herein designated GAM RNA, also designated SEQ ID:301.

Another function of GAM116 is therefore inhibition of Zinc finger protein 70 (cos17) (ZNF70, Accession NP_852101.1). Accordingly, utilities of GAM116 include diagnosis, prevention and treatment of diseases and clinical conditions associated with ZNF70.

Zinc finger protein 70 (cos17) (ZNF70, Accession NP_068735.1) is another GAM116 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:2508, to the nucleotide sequence of GAM116 RNA, herein designated GAM RNA, also designated SEQ ID:301.

Another function of GAM116 is therefore inhibition of Zinc finger protein 70 (cos17) (ZNF70, Accession NP_068735.1). Accordingly, utilities of GAM116 include diagnosis, prevention and treatment of diseases and clinical conditions associated with ZNF70.

FIG. 8 further provides a conceptual description of a novel bioinformatically detected of the present invention, referred to here as Genomic Address Messenger 117 (GAM117), which modulates expression of respective target genes thereof, the function and utility of which target genes is known in the art.

GAM117 is a novel bioinformatically detected regulatory, non protein coding, micro RNA (miRNA) gene. The method by which GAM117 was detected is described hereinabove with reference to FIGS. 8-15.

GAM117 gene, herein designated GAM GENE, and GAM117 target gene, herein designated TARGET GENE, are human genes contained in the human genome.

GAM117 gene encodes a GAM117 precursor RNA, herein designated GAM PRECURSOR RNA. Similar to other miRNA genes, and unlike most ordinary genes, GAM117 precursor RNA does not encode a protein. A nucleotide sequence identical or highly similar to the nucleotide sequence of GAM117 precursor RNA is designated SEQ ID:151, and is provided hereinbelow with reference to the sequence listing part. Nucleotide sequence SEQ ID:151 is located at position 4744406 relative to chromosome 16.

GAM117 precursor RNA folds onto itself, forming GAM117 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM117 precursor RNA folds onto itself, forming GAM117 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM117 precursor RNA, designated SEQ-ID:151, and a schematic representation of a predicted secondary folding of GAM117 folded precursor RNA are further described with reference to Table 2, hereby incorporated by reference.

An enzyme complex designated DICER COMPLEX, 'dices' the GAM117 folded precursor RNA into GAM117 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM117 RNA is designated SEQ ID:216, and is provided hereinbelow with references to the sequence listing part and Table 3, hereby incorporated by reference.

GAM117 target gene, herein designated TARGET GENE, encodes a corresponding messenger RNA, GAM117 target RNA, herein designated GAM TARGET RNA. GAM117 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM117 RNA, herein designated GAM RNA, binds complementarily to one or more target binding sites located in untranslated regions of GAM117 target RNA, herein designated GAM TARGET RNA. This complementary binding is due to the fact that the nucleotide sequence of GAM117 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM117 RNA may have a different number of target binding sites in untranslated regions of a GAM117 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM117 RNA, herein designated GAM RNA, to target binding sites on GAM117 target RNA, herein designated GAM TARGET RNA, such as BINDING SITE I, BINDING SITE II and BINDING SITE III, inhibits translation of GAM117 target RNA into GAM117 target protein, herein designated GAM TARGET PROTEIN. GAM target protein is therefore outlined by a broken line.

It is appreciated that GAM117 target gene, herein designated TARGET GENE, in fact represents a plurality of GAM117 target genes. The mRNA of each one of this plurality of GAM117 target genes comprises one or more target binding sites, each having a nucleotide sequence which is at least partly complementary to GAM117 RNA, herein designated GAM RNA, and which when bound by GAM117 RNA causes inhibition of translation of respective one or more GAM117 target proteins.

It is further appreciated by one skilled in the art that the mode of translational inhibition illustrated by FIG. 8 with specific reference to translational inhibition exerted by GAM117 gene, herein designated GAM GENE, on one or more GAM117 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM117 correlate with, and may be deduced from, the identity of the target genes which GAM117 binds and inhibits, and the function of these target genes, as elaborated hereinbelow.

Chromosome 11 open reading frame 25 (C11orf25, Accession NM_031418.1) is a GAM117 target gene, herein designated TARGET GENE. C11orf25 BINDING SITE is a target binding site found in the 5' untranslated region of mRNA encoded by C11orf25, corresponding to a target binding site such as BINDING SITE I, BINDING SITE II or BINDING SITE III of FIG. 8. Table 4 illustrates the complementarity of the nucleotide sequences of C11orf25 BINDING SITE, designated SEQ ID:11610, to the nucleotide sequence of GAM117 RNA, herein designated GAM RNA, also designated SEQ ID:216.

A function of GAM117 is therefore inhibition of Chromosome 11 open reading frame 25 (C11orf25, Accession NM_031418.1). Accordingly, utilities of GAM117 include diagnosis, prevention and treatment of diseases and clinical conditions associated with C11orf25.

Chromosome 14 open reading frame 4 (C14orf4, Accession XM_041104.8) is another GAM117 target gene, herein designated TARGET GENE. C14orf4 BINDING SITE is a target binding site found in the 5' untranslated region of mRNA encoded by C14orf4, corresponding to a target binding site such as BINDING SITE I, BINDING SITE II or BINDING SITE III of FIG. 8. Table 4 illustrates the complementarity of the nucleotide sequences of C14orf4 BINDING SITE, designated SEQ ID:14295, to the nucleotide sequence of GAM117 RNA, herein designated GAM RNA, also designated SEQ ID:216.

Another function of GAM117 is therefore inhibition of Chromosome 14 open reading frame 4 (C14orf4, Accession XM_041104.8). Accordingly, utilities of GAM117 include diagnosis, prevention and treatment of diseases and clinical conditions associated with C14orf4.

ELL (Accession NM_006532.1) is another GAM117 target gene, herein designated TARGET GENE. ELL BINDING SITE is a target binding site found in the 3' untranslated region of mRNA encoded by ELL, corresponding to a target binding site such as BINDING SITE I, BINDING SITE II or BINDING SITE III of FIG. 8. Table 4 illustrates the complementarity of the nucleotide sequences of ELL BINDING SITE, designated SEQ ID:11377, to the nucleotide sequence of GAM117 RNA, herein designated GAM RNA, also designated SEQ ID:216.

Another function of GAM117 is therefore inhibition of ELL (Accession NM_006532.1). Accordingly, utilities of GAM117 include diagnosis, prevention and treatment of diseases and clinical conditions associated with ELL.

ENDO180 (Accession) is another GAM117 target gene, herein designated TARGET GENE. ENDO180 BINDING SITE is a target binding site found in the 3' untranslated region of mRNA encoded by ENDO180, corresponding to a target binding site such as BINDING SITE I, BINDING SITE II or BINDING SITE III of FIG. 8. Table 4 illustrates the complementarity of the nucleotide sequences of ENDO180 BINDING SITE, designated SEQ ID:5722, to the nucleotide sequence of GAM117 RNA, herein designated GAM RNA, also designated SEQ ID:216.

Another function of GAM117 is therefore inhibition of ENDO180 (Accession). Accordingly, utilities of GAM117 include diagnosis, prevention and treatment of diseases and clinical conditions associated with ENDO180.

FLJ14810 (Accession NM_032843.1) is another GAM117 target gene, herein designated TARGET GENE. FLJ14810 BINDING SITE is a target binding site found in the 3' untranslated region of mRNA encoded by FLJ14810, corresponding to a target binding site such as BINDING SITE I, BINDING SITE II or BINDING SITE III of FIG. 8. Table 4 illustrates the complementarity of the nucleotide sequences of FLJ14810 BINDING SITE, designated SEQ ID:9480, to the nucleotide sequence of GAM117 RNA, herein designated GAM RNA, also designated SEQ ID:216.

Another function of GAM117 is therefore inhibition of FLJ14810 (Accession NM_032843.1). Accordingly, utilities of GAM117 include diagnosis, prevention and treatment of diseases and clinical conditions associated with FLJ14810.

KIAA0237 (Accession NM_014747.1) is another GAM117 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:10563, to the nucleotide sequence of GAM117 RNA, herein designated GAM RNA, also designated SEQ ID:267.

Another function of GAM117 is therefore inhibition of KIAA0237 (Accession NM_014747.1). Accordingly, utilities of GAM117 include diagnosis, prevention and treatment of diseases and clinical conditions associated with KIAA0237.

KIAA0495 (Accession XM_031397.7) is another GAM117 target gene, herein designated TARGET GENE. KIAA0495 BINDING SITE is a target binding site found in the 5' untranslated region of mRNA encoded by KIAA0495, corresponding to a target binding site such as BINDING SITE I, BINDING SITE II or BINDING SITE III of FIG. 8. Table 4 illustrates the complementarity of the nucleotide sequences of KIAA0495 BINDING SITE, designated SEQ ID:1285, to the nucleotide sequence of GAM117 RNA, herein designated GAM RNA, also designated SEQ ID:216.

Another function of GAM117 is therefore inhibition of KIAA0495 (Accession XM_031397.7). Accordingly, utilities of GAM117 include diagnosis, prevention and treatment of diseases and clinical conditions associated with KIAA0495.

KIAA1332 (Accession XM_048774.4) is another GAM117 target gene, herein designated TARGET GENE. KIAA1332 BINDING SITE is a target binding site found in the 3' untranslated region of mRNA encoded by KIAA1332, corresponding to a target binding site such as BINDING SITE I, BINDING SITE II or BINDING SITE III of FIG. 8. Table 4 illustrates the complementarity of the nucleotide sequences of KIAA1332 BINDING SITE, designated SEQ ID:5038, to the nucleotide sequence of GAM117 RNA, herein designated GAM RNA, also designated SEQ ID:267.

Another function of GAM117 is therefore inhibition of KIAA1332 (Accession XM_048774.4). Accordingly, utilities of GAM117 include diagnosis, prevention and treatment of diseases and clinical conditions associated with KIAA1332.

LOC124930 (Accession) is another GAM117 target gene, herein designated TARGET GENE. LOC124930 BINDING SITE is a target binding site found in the 3' untranslated region of mRNA encoded by LOC124930, corresponding to a target binding site such as BINDING SITE I, BINDING SITE II or BINDING SITE III of FIG. 8. Table 4 illustrates the complementarity of the nucleotide sequences of LOC124930 BINDING SITE, designated SEQ ID:2231, to the nucleotide sequence of GAM117 RNA, herein designated GAM RNA, also designated SEQ ID:216.

Another function of GAM117 is therefore inhibition of LOC124930 (Accession). Accordingly, utilities of GAM117 include diagnosis, prevention and treatment of diseases and clinical conditions associated with LOC124930.

LOC143915 (Accession) is another GAM117 target gene, herein designated TARGET GENE. LOC143915 BINDING SITE is a target binding site found in the 3' untranslated region of mRNA encoded by LOC143915, corresponding to a target binding site such as BINDING SITE I, BINDING SITE II or BINDING SITE III of FIG. 8. Table 4 illustrates the complementarity of the nucleotide sequences of LOC143915 BINDING SITE, designated SEQ ID:11372, to the nucleotide sequence of GAM117 RNA, herein designated GAM RNA, also designated SEQ ID:216.

Another function of GAM117 is therefore inhibition of LOC143915 (Accession). Accordingly, utilities of GAM117 include diagnosis, prevention and treatment of diseases and clinical conditions associated with LOC143915.

LOC149830 (Accession NM_177549.1) is another GAM117 target gene, herein designated TARGET GENE. LOC149830 BINDING SITE is a target binding site found in the 3' untranslated region of mRNA encoded by LOC149830, corresponding to a target binding site such as BINDING SITE I, BINDING SITE II or BINDING SITE III of FIG. 8. Table 4 illustrates the complementarity of the nucleotide sequences of LOC149830 BINDING SITE, designated SEQ ID:17004, to the nucleotide sequence of GAM117 RNA, herein designated GAM RNA, also designated SEQ ID:216.

Another function of GAM117 is therefore inhibition of LOC149830 (Accession NM_177549.1). Accordingly, utilities of GAM117 include diagnosis, prevention and treatment of diseases and clinical conditions associated with LOC149830.

LOC152627 (Accession XM_087495.1) is another GAM117 target gene, herein designated TARGET GENE. LOC152627 BINDING SITE is a target binding site found in the 5' untranslated region of mRNA encoded by LOC152627, corresponding to a target binding site such as BINDING SITE I, BINDING SITE II or BINDING SITE III of FIG. 8. Table 4 illustrates the complementarity of the nucleotide sequences of LOC152627 BINDING SITE, designated SEQ ID:2005, to the nucleotide sequence of GAM117 RNA, herein designated GAM RNA, also designated SEQ ID:267.

Another function of GAM117 is therefore inhibition of LOC152627 (Accession XM_087495.1). Accordingly, utilities of GAM117 include diagnosis, prevention and treatment of diseases and clinical conditions associated with LOC152627.

LOC255696 (Accession) is another GAM117 target gene, herein designated TARGET GENE. LOC255696 BINDING SITE is a target binding site found in the 5' untranslated region of mRNA encoded by LOC255696, corresponding to a target binding site such as BINDING SITE I, BINDING SITE II or BINDING SITE III of FIG. 8. Table 4 illustrates the complementarity of the nucleotide sequences of LOC255696 BINDING SITE, designated SEQ ID:12910, to the nucleotide sequence of GAM117 RNA, herein designated GAM RNA, also designated SEQ ID:267.

Another function of GAM117 is therefore inhibition of LOC255696 (Accession). Accordingly, utilities of GAM117 include diagnosis, prevention and treatment of diseases and clinical conditions associated with LOC255696.

LOC91632 (Accession XM_039721.2) is another GAM117 target gene, herein designated TARGET GENE. LOC91632 BINDING SITE is a target binding site found in the 3' untranslated region of mRNA encoded by LOC91632, corresponding to a target binding site such as BINDING SITE I, BINDING SITE II or BINDING SITE III of FIG. 8. Table 4 illustrates the complementarity of the nucleotide sequences of LOC91632 BINDING SITE, designated SEQ ID:5850, to the nucleotide sequence of GAM117 RNA, herein designated GAM RNA, also designated SEQ ID:216.

Another function of GAM117 is therefore inhibition of LOC91632 (Accession XM_039721.2). Accordingly, utilities of GAM117 include diagnosis, prevention and treatment of diseases and clinical conditions associated with LOC91632.

Microtubule-associated protein, rp/eb family, member 3 (MAPRE3, Accession NM_012326.2) is another GAM117 target gene, herein designated TARGET GENE. MAPRE3 BINDING SITE is a target binding site found in the 3' untranslated region of mRNA encoded by MAPRE3, corresponding to a target binding site such as BINDING SITE I, BINDING SITE II or BINDING SITE III of FIG. 8. Table 4 illustrates the complementarity of the nucleotide sequences of MAPRE3 BINDING SITE, designated SEQ ID:8716, to the nucleotide sequence of GAM117 RNA, herein designated GAM RNA, also designated SEQ ID:216.

Another function of GAM117 is therefore inhibition of Microtubule-associated protein, rp/eb family, member 3 (MAPRE3, Accession NM_012326.2), a gene which interact with cytoplasmic microtubules,and with the adenomatous polyposis coli. Accordingly, utilities of GAM117 include diagnosis, prevention and treatment of diseases and clinical conditions associated with MAPRE3.

The function of MAPRE3 has been established by previous studies. EB1 family proteins (e.g., MAPRE1; 603108) interact with cytoplasmic microtubules in interphase cells, with mitotic spindles, and with the adenomatous polyposis coli (APC; 175100) tumor suppressor gene. Using a yeast 2-hybrid screen with the C terminus of APC-like (APCL) as bait, Nakagawa et al. (2000) isolated a cDNA encoding MAPRE3, which they termed EB3. The predicted 282-amino acid protein is 54% identical to MAPRE1. Northern blot analysis revealed expression of a 2.2-kb transcript predominantly in brain and muscle. GST pull-down analysis determined that a homologous region in the C termini of APC and APCL binds to MAPRE3. Immunofluorescence and confocal microscopy demonstrated that MAPRE3 is localized in the microtubule network and colocalizes with APCL in the perinucleus and microtubule network. By EST database searching, RT-PCR, and screening a fetal brain cDNA library, Su and Qi (2001) isolated a cDNA encoding a protein identical to the EB3 protein reported by Nakagawa et al. (2000), which they termed EBF3, and an alternative transcript encoding a 266-amino acid protein. RT-PCR and Western blot analyses indicated that both transcripts are ubiquitously expressed. Genomic sequence analysis showed that there are most likely 3 MAPRE genes: MAPRE1 encodes EB1; MAPRE2 (OMIM Ref. No. 605789) encodes RP1 and the EB2 fragment; and MAPRE3 encodes EBF3 and the fragment RP3. MAPRE3, like MAPRE1 and MAPRE2, contains 7 exons, but the coding region of MAPRE3 spans only 4.2 kb due to relatively short introns. Western blot analysis detected expression of both isoforms as approximately 32-kD proteins in most cell lines tested. Binding analysis determined that both isoforms interact with APC. By FISH, Nakagawa et al. (2000) mapped the MAPRE3 gene to 2p23.3-p23.1. Using radiation hybrid analysis, Su and Qi (2001) mapped the MAPRE3 gene to 2p23.3-p23.2, where it is closely linked and proximal to the ketohexokinase gene (OMIM Ref. No. 229800).

Full details of the abovementioned studies are described in the following publications, the disclosure of which are hereby incorporated by reference:

Nakagawa, H.; Koyama, K.; Murata, Y.; Morito, M.; Akiyama, T.; Nakamura,Y.: EB3, a novel member of the EB1 family preferentially expressed in the central nervous system, binds to a CNS-specific APC homologue. Oncogene 19:210-216, 2000; and Su, L.-K.; Qi, Y.: Characterization of human MAPRE genes and their proteins. Genomics 71:143-149, 2001.

Further studies establishing the function and utilities of MAPRE3 are found in John Hopkins OMIM database record ID 605788, and in cited publications listed in Table 5, which are hereby incorporated by reference.

FIG. 8 further provides a conceptual description of a novel bioinformatically detected of the present invention, referred to here as Genomic Address Messenger 118 (GAM118), which modulates expression of respective target genes thereof, the function and utility of which target genes is known in the art.

GAM118 is a novel bioinformatically detected regulatory, non protein coding, micro RNA (miRNA) gene. The method by which GAM118 was detected is described hereinabove with reference to FIGS. 8-15.

GAM118 gene, herein designated GAM GENE, and GAM118 target gene, herein designated TARGET GENE, are human genes contained in the human genome.

GAM118 gene encodes a GAM118 precursor RNA, herein designated GAM PRECURSOR RNA. Similar to other miRNA genes, and unlike most ordinary genes, GAM118 precursor RNA does not encode a protein. A nucleotide sequence identical or highly similar to the nucleotide sequence of GAM118 precursor RNA is designated SEQ ID:160, and is provided hereinbelow with reference to the sequence listing part.

GAM118 precursor RNA folds onto itself, forming GAM118 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM118 precursor RNA folds onto itself, forming GAM118 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM118 precursor RNA, designated SEQ-ID:160, and a schematic representation of a predicted secondary folding of GAM118 folded precursor RNA are further described with reference to Table 2, hereby incorporated by reference.

An enzyme complex designated DICER COMPLEX, 'dices' the GAM118 folded precursor RNA into GAM118 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM118 RNA is designated SEQ ID:363, and is provided hereinbelow with references to the sequence listing part and Table 3, hereby incorporated by reference.

GAM118 target gene, herein designated TARGET GENE, encodes a corresponding messenger RNA, GAM118 target RNA, herein designated GAM TARGET RNA. GAM118 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM118 RNA, herein designated GAM RNA, binds complementarily to one or more target binding sites located in untranslated regions of GAM118 target RNA, herein designated GAM TARGET RNA. This complementary binding is due to the fact that the nucleotide sequence of GAM118 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM118 RNA may have a different number of target binding sites in untranslated regions of a GAM118 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM118 RNA, herein designated GAM RNA, to target binding sites on GAM118 target RNA, herein designated GAM TARGET RNA, such as BINDING SITE I, BINDING SITE II and BINDING SITE III, inhibits translation of GAM118 target RNA into GAM118 target protein, herein designated GAM TARGET PROTEIN. GAM target protein is therefore outlined by a broken line.

It is appreciated that GAM118 target gene, herein designated TARGET GENE, in fact represents a plurality of GAM118 target genes. The mRNA of each one of this plurality of GAM118 target genes comprises one or more target binding sites, each having a nucleotide sequence which is at least partly complementary to GAM118 RNA, herein designated GAM RNA, and which when bound by GAM118 RNA causes inhibition of translation of respective one or more GAM118 target proteins.

It is further appreciated by one skilled in the art that the mode of translational inhibition illustrated by FIG. 8 with specific reference to translational inhibition exerted by GAM118 gene, herein designated GAM GENE, on one or more GAM118 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM118 correlate with, and may be deduced from, the identity of the target genes which GAM118 binds and inhibits, and the function of these target genes, as elaborated hereinbelow.

JM5 (Accession NM_007075.1) is a GAM118 target gene, herein designated TARGET GENE. JM5 BINDING SITE is a target binding site found in the 3' untranslated region of mRNA encoded by JM5, corresponding to a target binding site such as BINDING SITE I, BINDING SITE II or BINDING SITE III of FIG. 8. Table 4 illustrates the complementarity of the nucleotide sequences of JM5 BINDING SITE, designated SEQ ID:1897, to the nucleotide sequence of GAM118 RNA, herein designated GAM RNA, also designated SEQ ID:363.

A function of GAM118 is therefore inhibition of JM5 (Accession NM_007075.1). Accordingly, utilities of GAM118 include diagnosis, prevention and treatment of diseases and clinical conditions associated with JM5.

FIG. 8 further provides a conceptual description of a novel bioinformatically detected of the present invention, referred to here as Genomic Address Messenger 119 (GAM119), which modulates expression of respective target genes thereof, the function and utility of which target genes is known in the art.

GAM119 is a novel bioinformatically detected regulatory, non protein coding, micro RNA (miRNA) gene. The method by which GAM119 was detected is described hereinabove with reference to FIGS. 8-15.

GAM119 gene, herein designated GAM GENE, and GAM119 target gene, herein designated TARGET GENE, are human genes contained in the human genome.

GAM119 gene encodes a GAM119 precursor RNA, herein designated GAM PRECURSOR RNA. Similar to other miRNA genes, and unlike most ordinary genes, GAM119 precursor RNA does not encode a protein. A nucleotide sequence identical or highly similar to the nucleotide sequence of GAM119 precursor RNA is designated SEQ ID:4, and is provided hereinbelow with reference to the sequence listing part.

GAM119 precursor RNA folds onto itself, forming GAM119 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM119 precursor RNA folds onto itself, forming GAM119 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM119 precursor RNA, designated SEQ-ID:4, and a schematic representation of a predicted secondary folding of GAM119 folded precursor RNA are further described with reference to Table 2, hereby incorporated by reference.

An enzyme complex designated DICER COMPLEX, 'dices' the GAM119 folded precursor RNA into GAM119 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM119 RNA is designated SEQ ID:391, and is provided hereinbelow with references to the sequence listing part and Table 3, hereby incorporated by reference.

GAM119 target gene, herein designated TARGET GENE, encodes a corresponding messenger RNA, GAM119 target RNA, herein designated GAM TARGET RNA. GAM119 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM119 RNA, herein designated GAM RNA, binds complementarily to one or more target binding sites located in untranslated regions of GAM119 target RNA, herein designated GAM TARGET RNA. This complementary binding is due to the fact that the nucleotide sequence of GAM119 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM119 RNA may have a different number of target binding sites in untranslated regions of a GAM119 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM119 RNA, herein designated GAM RNA, to target binding sites on GAM119 target RNA, herein designated GAM TARGET RNA, such as BINDING SITE I, BINDING SITE II and BINDING SITE III, inhibits translation of GAM119 target RNA into GAM119 target protein, herein designated GAM TARGET PROTEIN. GAM target protein is therefore outlined by a broken line.

It is appreciated that GAM119 target gene, herein designated TARGET GENE, in fact represents a plurality of GAM119 target genes. The mRNA of each one of this plurality of GAM119 target genes comprises one or more target binding sites, each having a nucleotide sequence which is at least partly complementary to GAM119 RNA, herein designated GAM RNA, and which when bound by GAM119 RNA causes inhibition of translation of respective one or more GAM119 target proteins.

It is further appreciated by one skilled in the art that the mode of translational inhibition illustrated by FIG. 8 with specific reference to translational inhibition exerted by GAM119 gene, herein designated GAM GENE, on one or more GAM119 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM119 correlate with, and may be deduced from, the identity of the target genes which GAM119 binds and inhibits, and the function of these target genes, as elaborated hereinbelow.

Keratin associated protein 4-4 (KRTAP4-4, Accession NM_032524.1) is a GAM119 target gene, herein designated TARGET GENE. KRTAP4-4 BINDING SITE is a target binding site found in the 3' untranslated region of mRNA encoded by KRTAP4-4, corresponding to a target binding site such as BINDING SITE I, BINDING SITE II or BINDING SITE III of FIG. 8. Table 4 illustrates the complementarity of the nucleotide sequences of KRTAP4-4 BINDING SITE, designated SEQ ID:9962, to the nucleotide sequence of GAM119 RNA, herein designated GAM RNA, also designated SEQ ID:391.

A function of GAM119 is therefore inhibition of Keratin associated protein 4-4 (KRTAP4-4, Accession NM_032524.1). Accordingly, utilities of GAM119 include diagnosis, prevention and treatment of diseases and clinical conditions associated with KRTAP4-4.

LOC257444 (Accession XM_088028.2) is another GAM119 target gene, herein designated TARGET GENE. LOC257444 BINDING SITE is a target binding site found in the 3' untranslated region of mRNA encoded by LOC257444, corresponding to a target binding site such as BINDING SITE I, BINDING SITE II or BINDING SITE III of FIG. 8. Table 4 illustrates the complementarity of the nucleotide sequences of LOC257444 BINDING SITE, designated SEQ ID:6487, to the nucleotide sequence of GAM119 RNA, herein designated GAM RNA, also designated SEQ ID:391.

Another function of GAM119 is therefore inhibition of LOC257444 (Accession XM_088028.2). Accordingly, utilities of GAM119 include diagnosis, prevention and treatment of diseases and clinical conditions associated with LOC257444.

FIG. 8 further provides a conceptual description of a novel bioinformatically detected of the present invention, referred to here as Genomic Address Messenger 120 (GAM120), which modulates expression of respective target genes thereof, the function and utility of which target genes is known in the art.

GAM120 is a novel bioinformatically detected regulatory, non protein coding, micro RNA (miRNA) gene. The method by which GAM120 was detected is described hereinabove with reference to FIGS. 8-15.

GAM120 gene, herein designated GAM GENE, and GAM120 target gene, herein designated TARGET GENE, are human genes contained in the human genome.

GAM120 gene encodes a GAM120 precursor RNA, herein designated GAM PRECURSOR RNA. Similar to other miRNA genes, and unlike most ordinary genes, GAM120 precursor RNA does not encode a protein. A nucleotide sequence identical or highly similar to the nucleotide sequence of GAM120 precursor RNA is designated SEQ ID:191, and is provided hereinbelow with reference to the sequence listing part. Nucleotide sequence SEQ ID:191 is located at position 130315489 relative to chromosome 3.

GAM120 precursor RNA folds onto itself, forming GAM120 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM120 precursor RNA folds onto itself, forming GAM120 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM120 precursor RNA, designated SEQ-ID:191, and a schematic representation of a predicted secondary folding of GAM120 folded precursor RNA are further described with reference to Table 2, hereby incorporated by reference.

An enzyme complex designated DICER COMPLEX, 'dices' the GAM120 folded precursor RNA into GAM120 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM120 RNA is designated SEQ ID:285, and is provided hereinbelow with references to the sequence listing part and Table 3, hereby incorporated by reference.

GAM120 target gene, herein designated TARGET GENE, encodes a corresponding messenger RNA, GAM120 target RNA, herein designated GAM TARGET RNA. GAM120 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM120 RNA, herein designated GAM RNA, binds complementarily to one or more target binding sites located in untranslated regions of GAM120 target RNA, herein designated GAM TARGET RNA. This complementary binding is due to the fact that the nucleotide sequence of GAM120 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM120 RNA may have a different number of target binding sites in untranslated regions of a GAM120 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM120 RNA, herein designated GAM RNA, to target binding sites on GAM120 target RNA, herein designated GAM TARGET RNA, such as BINDING SITE I, BINDING SITE II and BINDING SITE III, inhibits translation of GAM120 target RNA into GAM120 target protein, herein designated GAM TARGET PROTEIN. GAM target protein is therefore outlined by a broken line.

It is appreciated that GAM120 target gene, herein designated TARGET GENE, in fact represents a plurality of GAM120 target genes. The mRNA of each one of this plurality of GAM120 target genes comprises one or more target binding sites, each having a nucleotide sequence which is at least partly complementary to GAM120 RNA, herein designated GAM RNA, and which when bound by GAM120 RNA causes inhibition of translation of respective one or more GAM120 target proteins.

It is further appreciated by one skilled in the art that the mode of translational inhibition illustrated by FIG. 8 with specific reference to translational inhibition exerted by GAM120 gene, herein designated GAM GENE, on one or more GAM120 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM120 correlate with, and may be deduced from, the identity of the target genes which GAM120 binds and inhibits, and the function of these target genes, as elaborated hereinbelow.

FLJ10521 (Accession NM_018125.1) is a GAM120 target gene, herein designated TARGET GENE. FLJ10521 BINDING SITE is a target binding site found in the 3' untranslated region of mRNA encoded by FLJ10521, corresponding to a target binding site such as BINDING SITE I, BINDING SITE II or BINDING SITE III of FIG. 8. Table 4 illustrates the complementarity of the nucleotide sequences of FLJ10521 BINDING SITE, designated SEQ ID:4274, to the nucleotide sequence of GAM120 RNA, herein designated GAM RNA, also designated SEQ ID:285.

A function of GAM120 is therefore inhibition of FLJ10521 (Accession NM_018125.1). Accordingly, utilities of GAM120 include diagnosis, prevention and treatment of diseases and clinical conditions associated with FLJ10521.

Folylpolyglutamate synthase (FPGS, Accession NM_004957.2) is another GAM120 target gene, herein designated TARGET GENE. FPGS BINDING SITE is a target binding site found in the 3' untranslated region of mRNA encoded by FPGS, corresponding to a target binding site such as BINDING SITE I, BINDING SITE II or BINDING SITE III of FIG. 8. Table 4 illustrates the complementarity of the nucleotide sequences of FPGS BINDING SITE, designated SEQ ID:7363, to the nucleotide sequence of GAM120 RNA, herein designated GAM RNA, also designated SEQ ID:285.

Another function of GAM120 is therefore inhibition of Folylpolyglutamate synthase (FPGS, Accession NM_004957.2), a gene which is involved in conversion of folates to polyglutamate derivatives. Accordingly, utilities of GAM120 include diagnosis, prevention and treatment of diseases and clinical conditions associated with FPGS.

The function of FPGS has been established by previous studies. By functional complementation of an Escherichia coli folC mutant, Garrow et al. (1992) cloned a human cDNA for folylpoly(gamma-glutamate) synthetase (FPGS; tetrahydrofolate:L- glutamate gamma-ligase (ADP forming); EC 6.3.2.17). The cDNA encodes a 545-residue protein of Mr 60,128. Expression of the cDNA in E. coli resulted in elevated expression of an enzyme with characteristics of mammalian FPGS. Furthermore, expression of the cDNA in AUXB1, a mammalian cell lacking FPGS activity, overcame the cell's requirement for thymidine and purines but did not overcome the cell's glycine auxotrophy, consistent with expression of the protein in the cytosol but not in the mitochondria. Freemantle et al. (1995) proposed that the mitochondrial and cytosolic forms of FPGS are, in fact, derived from the same gene, arising from the use of the 2 different translation initiation codons, and that the translation products differ by the presence of a 42-residue amino-terminal mitochondrial leader peptide. Taylor et al. (1995) likewise concluded that a single locus encodes FPGS-related sequences in the human genome. The complete 2256 nucleotides of cDNA for the 5-prime untranslated region, mitochondrial leader sequence, coding region, and 3-prime untranslated region were found to be distributed on 15 exons stretching over 11.2 kb of genomic DNA.

Full details of the abovementioned studies are described in the following publications, the disclosure of which are hereby incorporated by reference:

Freemantle, S. J.; Taylor, S. M.; Krystal, G.; Moran, R. G.: Upstream organization of and multiple transcripts from the human folylpoly-gamma-glutamate synthetase gene. J. Biol. Chem. 270:9579-9584, 1995; and Garrow, T. A.; Admon, A.; Shane, B.: Expression cloning of a human cDNA encoding folylpoly(gamma-glutamate) synthetase and determination of its primary structure. Proc. Nat. Acad. Sci.

Further studies establishing the function and utilities of FPGS are found in John Hopkins OMIM database record ID 136510, and in cited publications listed in Table 5, which are hereby incorporated by reference. HCC-4 (Accession NM_138611.1) is another GAM120 target gene, herein designated TARGET GENE. HCC-4 BINDING SITE is a target binding site found in the 5' untranslated region of mRNA encoded by HCC-4, corresponding to a target binding site such as BINDING SITE I, BINDING SITE II or BINDING SITE III of FIG. 8. Table 4 illustrates the complementarity of the nucleotide sequences of HCC-4 BINDING SITE, designated SEQ ID:1747, to the nucleotide sequence of GAM120 RNA, herein designated GAM RNA, also designated SEQ ID:285.

Another function of GAM120 is therefore inhibition of HCC-4 (Accession NM_138611.1). Accordingly, utilities of GAM120 include diagnosis, prevention and treatment of diseases and clinical conditions associated with HCC-4.

LOC253070 (Accession) is another GAM120 target gene, herein designated TARGET GENE. LOC253070 BINDING SITE is a target binding site found in the 3' untranslated region of mRNA encoded by LOC253070, corresponding to a target binding site such as BINDING SITE I, BINDING SITE II or BINDING SITE III of FIG. 8. Table 4 illustrates the complementarity of the nucleotide sequences of LOC253070 BINDING SITE, designated SEQ ID:19769, to the nucleotide sequence of GAM120 RNA, herein designated GAM RNA, also designated SEQ ID:285.

Another function of GAM120 is therefore inhibition of LOC253070 (Accession). Accordingly, utilities of GAM120 include diagnosis, prevention and treatment of diseases and clinical conditions associated with LOC253070.

Neurotrophic tyrosine kinase, receptor, type 2 (NTRK2, Accession NM_006180.2) is another GAM120 target gene, herein designated TARGET GENE. NTRK2 BINDING SITE is a target binding site found in the 5' untranslated region of mRNA encoded by NTRK2, corresponding to a target binding site such as BINDING SITE I, BINDING SITE II or BINDING SITE III of FIG. 8. Table 4 illustrates the complementarity of the nucleotide sequences of NTRK2 BINDING SITE, designated SEQ ID:17811, to the nucleotide sequence of GAM120 RNA, herein designated GAM RNA, also designated SEQ ID:285.

Another function of GAM120 is therefore inhibition of Neurotrophic tyrosine kinase, receptor, type 2 (NTRK2, Accession NM_006180.2), a gene which is involved in the development and/or maintenance of the nervous system. Accordingly, utilities of GAM120 include diagnosis, prevention and treatment of diseases and clinical conditions associated with NTRK2.

The function of NTRK2 has been established by previous studies. Nakagawara et al. (1995) isolated cDNAs spanning the entire coding region of both human full-length and truncated forms of TRKB from human brain cDNA libraries. The full-length TRKB coded for a protein of 822 amino acid residues. The putative mature peptide sequence was 49% and 55% homologous to human NTRK1 and NTRK3, respectively. Nine of 13 cysteine residues, 4 of 12 N- glycosylation sites in the extracellular domain, and 10 of 13 tyrosine residues in the intracellular domain are conserved among NTRK1, NTRK2, and NTRK3. Two major sizes of NTRK2 transcripts were expressed in human brain.

Animal model experiments lend further support to the function of NTRK2. To study the function of TRKB in the cerebellum, Rico et al. (2002) deleted the Trkb gene in mouse cerebellar precursors by Wnt1-driven Cre-mediated recombination. Despite the absence of Trkb, the mature cerebellum of mutant mice appeared similar to that of wildtype, with all types of cells present in normal numbers and positions. Granule and Purkinje cell dendrites appeared normal, and the former had typical numbers of excitatory synapses. By contrast, inhibitory interneurons were strongly affected. Although present in normal number, inhibitory interneurons exhibited reduced amounts of GABAergic markers and developed reduced numbers of GABAergic boutons and synaptic specializations. Thus, Rico et al. (2002) concluded that TRKB is essential to the development of GABAergic neurons and regulates synapse formation in addition to its role in the development of axon terminals.

It is appreciated that the abovementioned animal model for NTRK2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Nakagawara, A.; Liu, X.-G.; Ikegaki, N.; White, P. S.; Yamashiro, D. J.; Nycum, L. M.; Biegel, J. A.; Brodeur, G. M.: Cloning and chromosomal localization of the human TRK-B tyrosine kinase receptor gene (NTRK2). Genomics 25:538-546, 1995; and Rico, B.; Xu, B.; Reichardt, L. F.: TrkB receptor signaling is required for establishment of GABAergic synapses in the cerebellum. Nature Neurosci. 5:225-233, 2002.

Further studies establishing the function and utilities of NTRK2 are found in John Hopkins OMIM database record ID 600456, and in cited publications listed in Table 5, which are hereby incorporated by reference.

FIG. 8 further provides a conceptual description of a novel bioinformatically detected of the present invention, referred to here as Genomic Address Messenger 121 (GAM121), which modulates expression of respective target genes thereof, the function and utility of which target genes is known in the art.

GAM121 is a novel bioinformatically detected regulatory, non protein coding, micro RNA (miRNA) gene. The method by which GAM121 was detected is described hereinabove with reference to FIGS. 8-15.

GAM121 gene, herein designated GAM GENE, and GAM121 target gene, herein designated TARGET GENE, are human genes contained in the human genome.

GAM121 gene encodes a GAM121 precursor RNA, herein designated GAM PRECURSOR RNA. Similar to other miRNA genes, and unlike most ordinary genes, GAM121 precursor RNA does not encode a protein. A nucleotide sequence identical or highly similar to the nucleotide sequence of GAM121 precursor RNA is designated SEQ ID:69, and is provided hereinbelow with reference to the sequence listing part.

GAM121 precursor RNA folds onto itself, forming GAM121 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM121 precursor RNA folds onto itself, forming GAM121 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM121 precursor RNA, designated SEQ-ID:69, and a schematic representation of a predicted secondary folding of GAM121 folded precursor RNA are further described with reference to Table 2, hereby incorporated by reference.

An enzyme complex designated DICER COMPLEX, 'dices' the GAM121 folded precursor RNA into GAM121 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM121 RNA is designated SEQ ID:309, and is provided hereinbelow with references to the sequence listing part and Table 3, hereby incorporated by reference.

GAM121 target gene, herein designated TARGET GENE, encodes a corresponding messenger RNA, GAM121 target RNA, herein designated GAM TARGET RNA. GAM121 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM121 RNA, herein designated GAM RNA, binds complementarily to one or more target binding sites located in untranslated regions of GAM121 target RNA, herein designated GAM TARGET RNA. This complementary binding is due to the fact that the nucleotide sequence of GAM121 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM121 RNA may have a different number of target binding sites in untranslated regions of a GAM121 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM121 RNA, herein designated GAM RNA, to target binding sites on GAM121 target RNA, herein designated GAM TARGET RNA, such as BINDING SITE I, BINDING SITE II and BINDING SITE III, inhibits translation of GAM121 target RNA into GAM121 target protein, herein designated GAM TARGET PROTEIN. GAM target protein is therefore outlined by a broken line.

It is appreciated that GAM121 target gene, herein designated TARGET GENE, in fact represents a plurality of GAM121 target genes. The mRNA of each one of this plurality of GAM121 target genes comprises one or more target binding sites, each having a nucleotide sequence which is at least partly complementary to GAM121 RNA, herein designated GAM RNA, and which when bound by GAM121 RNA causes inhibition of translation of respective one or more GAM121 target proteins.

It is further appreciated by one skilled in the art that the mode of translational inhibition illustrated by FIG. 8 with specific reference to translational inhibition exerted by GAM121 gene, herein designated GAM GENE, on one or more GAM121 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM121 correlate with, and may be deduced from, the identity of the target genes which GAM121 binds and inhibits, and the function of these target genes, as elaborated hereinbelow.

A disintegrin and metalloproteinase domain 11 (ADAM11, Accession NM_002390.2) is a GAM121 target gene, herein designated TARGET GENE. ADAM11 BINDING SITE is a target binding site found in the 3' untranslated region of multiple transcripts of mRNA encoded by ADAM11, corresponding to a target binding site such as BINDING SITE I, BINDING SITE II or BINDING SITE III of FIG. 8. Table 4 illustrates the complementarity of the nucleotide sequences of ADAM11 BINDING SITE, designated SEQ ID:8088, to the nucleotide sequence of GAM121 RNA, herein designated GAM RNA, also designated SEQ ID:309.

A function of GAM121 is therefore inhibition of A disintegrin and metalloproteinase domain 11 (ADAM11, Accession NM_002390.2), a gene which Member of the ADAM family of zinc metalloproteases. and therefore may be associated with Breast and ovarian cancers. Accordingly, utilities of GAM121 include diagnosis, prevention and treatment of Breast and ovarian cancers, and of other diseases and clinical conditions associated with ADAM11.

The function of ADAM11 has been established by previous studies. From chromosomal region 17q21.3, where a tumor suppressor gene for breast and ovarian cancers is thought to reside, Emi et al. (1993) isolated a novel gene from a cosmid clone that showed somatic rearrangements in 2 breast cancers. The gene encoded a 524-amino acid metalloproteinase-like, disintegrin-like, and cysteine- rich (MDC) protein with sequence similarity to members of the snake-venom metalloprotease/disintegrin family and guinea-pig sperm-surface protein PH-30 (OMIM Ref. No. 601533). These proteins have been implicated in cell-cell or cell-extracellular matrix interactions. Rearrangements in both tumors involved multiple exons and disrupted the coding region of the gene. Sagane et al. (1998) noted that MDC is a member of the cellular disintegrin, or ADAM (a disintegrin and metalloproteinase), family. See ADAM20 (OMIM Ref. No. 603712). They isolated cDNAs encoding 2 related human proteins, MDC2 (OMIM Ref. No. 603709) and MDC3 (OMIM Ref. No. 603710). Northern blot analysis revealed that, like the MDC2 and MDC3 mRNAs, the 5-kb MDC transcript was expressed predominantly in brain.

Full details of the abovementioned studies are described in the following publications, the disclosure of which are hereby incorporated by reference:

Emi, M.; Katagiri, T.; Harada, Y.; Saito, H.; Inazawa, J.; Ito, I.; Kasumi, F.; Nakamura, Y.: A novel metalloprotease/disintegrin-like gene at 17q21.3 is somatically rearranged in two primary breast cancers. Nature Genet. 5:151-157, 1993; and Sagane, K.; Ohy, Y.; Hasegawa, Y.; Tanaka, I.: Metalloproteinase-like, disintegrin- like, cysteine-rich proteins MDC2 and MDC3: novel human cellular disintegrins highly expressed in the.

Further studies establishing the function and utilities of ADAM11 are found in John Hopkins OMIM database record ID 155120, and in cited publications listed in Table 5, which are hereby incorporated by reference. Annexin a6 (ANXA6, Accession NM_004033.1) is another GAM121 target gene, herein designated TARGET GENE. ANXA6 BINDING SITE is a target binding site found in the 3' untranslated region of multiple transcripts of mRNA encoded by ANXA6, corresponding to a target binding site such as BINDING SITE I, BINDING SITE II or BINDING SITE III of FIG. 8. Table 4 illustrates the complementarity of the nucleotide sequences of ANXA6 BINDING SITE, designated SEQ ID:12042, to the nucleotide sequence of GAM121 RNA, herein designated GAM RNA, also designated SEQ ID:309.

Another function of GAM121 is therefore inhibition of Annexin a6 (ANXA6, Accession NM_004033.1), a gene which may associate with cd21, and may regulate the release of ca(2+) from intracellular stores. Accordingly, utilities of GAM121 include diagnosis, prevention and treatment of diseases and clinical conditions associated with ANXA6.

The function of ANXA6 has been established by previous studies. The protein p68 is a member of a family of proteins that bind membrane or cytoskeleton in a Ca(2+)-dependent manner. They are characterized by homologous amino acid sequences that are present in multiple copies in each protein. The family is variously known as calelectrins, annexins, calpactins, endonexins, and lipocortins. p68 is an intracellular monomeric protein of approximately 68,000 MW. Davies et al. (1989) assigned the ANXA6 gene to 5q32-q34 by use of a cDNA clone to probe genomic DNA from rodent-human somatic cell hybrids and for in situ hybridization. The corresponding gene in the mouse was assigned to chromosome 11 by probing DNA from rodent-rodent somatic cell hybrids. Warrington and Bengtsson (1994) used 3 physical mapping methods (radiation hybrid mapping, pulsed field gel electrophoresis, and fluorescence in situ hybridization of interphase nuclei) to determine the order and relative distances between 12 loci in the 5q31-q33 region. ANXA6 was one of those loci. Smith et al. (1994) demonstrated that the ANX6 gene is approximately 60 kb long and contains 26 exons. The genomic sequence at the 3- prime end does not contain a canonical polyadenylylation signal. The genomic sequence upstream of the transcription start site contains TATAA and CAAT motifs. The spatial organization of the exons revealed no obvious similarities between the 2 halves of the ANX6 gene. Comparison of the intron/exon boundary positions of ANX6 with those of ANX1 (OMIM Ref. No. 151690) and ANX2 (OMIM Ref. No. 151740) revealed that within the repeated domains the breakpoints are perfectly conserved except for exon 8, which is 1 codon smaller in ANX2. The corresponding point in the second half of ANX6 is represented by 2 exons, exons 20 and 21. The latter exon is alternatively spliced, giving rise to annexin VI isoforms that differ with respect to a 6-amino acid insertion at the start of repeat 7.

Full details of the abovementioned studies are described in the following publications, the disclosure of which are hereby incorporated by reference:

Davies, A. A.; Moss, S. E.; Crompton, M. R.; Jones, T. A.; Spurr, N. K.; Sheer, D.; Kozak, C.; Crumpton, M. J.: The gene coding for the p68 calcium-binding protein is localized to bands q32-q34 of human chromosome 5, and to mouse chromosome 11. Hum. Genet. 82:234-238, 1989. ; and Smith, P. D.; Davies, A.; Crumpton, M. J.; Moss, S. E.: Structure of the human annexin VI gene. Proc. Nat. Acad. Sci. 91:2713-2717, 1994.

Further studies establishing the function and utilities of ANXA6 are found in John Hopkins OMIM database record ID 114070, and in cited publications listed in Table 5, which are hereby incorporated by reference. Cystatin e/m (CST6, Accession NM_001323.2) is another GAM121 target gene, herein designated TARGET GENE. CST6 BINDING SITE is a target binding site found in the 3' untranslated region of mRNA encoded by CST6, corresponding to a target binding site such as BINDING SITE I, BINDING SITE II or BINDING SITE III of FIG. 8. Table 4 illustrates the complementarity of the nucleotide sequences of CST6 BINDING SITE, designated SEQ ID:10154, to the nucleotide sequence of GAM121 RNA, herein designated GAM RNA, also designated SEQ ID:309.

Another function of GAM121 is therefore inhibition of Cystatin e/m (CST6, Accession NM_001323.2), a gene which is a cysteine (thiol) protease inhibitor that inhibits papain. and therefore may be associated with Metastatic tumors. Accordingly, utilities of GAM121 include diagnosis, prevention and treatment of Metastatic tumors, and of other diseases and clinical conditions associated with CST6.

The function of CST6 has been established by previous studies. Cystatins are endogenous inhibitors of mammalian lysosomal cysteine proteinases, such as cathepsins B (OMIM Ref. No. 116810), L (OMIM Ref. No. 116880), H (OMIM Ref. No. 116820), and S (OMIM Ref. No. 116845), and the plant cysteine proteinases papain, acinidin, and ficin. They function both intracellularly and extracellularly. All inhibitory cystatins display structural and functional similarities, and are members of a single protein superfamily comprising 3 distinct families of closely related proteins: stefins (see OMIM Ref. No. 184600), cystatins (see OMIM Ref. No. 123855), and kininogens (OMIM Ref. No. 228960). Using differential display, Sotiropoulou et al. (1997) identified a novel human cystatin, cystatin M, as being downregulated in metastatic breast tumor cells as compared to primary tumor cells. Stenman et al. (1997) mapped the gene encoding cystatin M (CST6) to 11q13 by fluorescence in situ hybridization. CST6 is a member of the type 2 cystatin gene family. All 7 previously cloned members of this family had been found to be clustered in a narrow region on 20p11.2.

Full details of the abovementioned studies are described in the following publications, the disclosure of which are hereby incorporated by reference:

Sotiropoulou, G.; Anisowicz, A.; Sager, R.: Identification, cloning, and characterization of cystatin M, a novel cysteine proteinase inhibitor, down-regulated in breast cancer. J. Biol. Chem. 272:903-910, 1997; and Stenman, G.; Astrom, A.-K.; Roijer, E.; Sotiropoulou, G.; Zhang, M.; Sager, R.: Assignment of a novel cysteine proteinase inhibitor (CST6) to 11q13 by fluorescence in situ hybridization.

Further studies establishing the function and utilities of CST6 are found in John Hopkins OMIM database record ID 601891, and in cited publications listed in Table 5, which are hereby incorporated by reference. FLJ13263 (Accession NM_025125.1) is another GAM121 target gene, herein designated TARGET GENE. FLJ13263 BINDING SITE is a target binding site found in the 3' untranslated region of mRNA encoded by FLJ13263, corresponding to a target binding site such as BINDING SITE I, BINDING SITE II or BINDING SITE III of FIG. 8. Table 4 illustrates the complementarity of the nucleotide sequences of FLJ13263 BINDING SITE, designated SEQ ID:18107, to the nucleotide sequence of GAM121 RNA, herein designated GAM RNA, also designated SEQ ID:309.

Another function of GAM121 is therefore inhibition of FLJ13263 (Accession NM_025125.1). Accordingly, utilities of GAM121 include diagnosis, prevention and treatment of diseases and clinical conditions associated with FLJ13263.

Homeo box (h6 family) 1 (HMX1, Accession) is another GAM121 target gene, herein designated TARGET GENE. HMX1 BINDING SITE is a target binding site found in the 3' untranslated region of mRNA encoded by HMX1, corresponding to a target binding site such as BINDING SITE I, BINDING SITE II or BINDING SITE III of FIG. 8. Table 4 illustrates the complementarity of the nucleotide sequences of HMX1 BINDING SITE, designated SEQ ID:18643, to the nucleotide sequence of GAM121 RNA, herein designated GAM RNA, also designated SEQ ID:309.

Another function of GAM121 is therefore inhibition of Homeo box (h6 family) 1 (HMX1, Accession), a gene which binds to the DNA. Accordingly, utilities of GAM121 include diagnosis, prevention and treatment of diseases and clinical conditions associated with HMX1.

The function of HMX1 has been established by previous studies. Proteins encoded by homeo box genes function as transcription factors capable of binding DNA. Structural analysis of homeodomains indicate that these proteins form a helix-turn- helix motif, with the third helix serving as a DNA binding recognition helix. The recognition helix has a highly conserved 8-amino acid region specific to many homeo box genes. This suggested that DNA probes based on the conserved region of the third helix would serve as powerful tools to screen for homeo box genes. Stadler et al. (1992) used this strategy to identify homeo box genes that are expressed in the developing human craniofacial region. Probing a cDNA library constructed from human embryonic craniofacial tissue, they identified a homeo box gene that mapped to 4p16.1. Designated H6, the 'new' gene shared only 57 to 65% amino acid identity to previously reported homeodomains. The mapping was performed by study of somatic cell hybrids containing specific deletions of human chromosome 4 using PCR methods, after initial assignment by hybridization of radiolabeled H6 DNA to Southern blots containing DNA derived from a mouse/human somatic cell hybrid containing only human chromosome 4. The initial assignment to 4p16.1 was confirmed by studies of linkage between a collection of markers on chromosome 4 and a 250-bp amplification product from H6 that demonstrated a single-strand conformation polymorphism (SSCP) when electrophoresed on a nondenaturing acrylamide gel. Although HOX7 (OMIM Ref. No. 142983) also maps to 4p16.1, it is unlikely that HOX7 and H6 are members of a homeo box cluster because the linkage data placed H6 more than 10 cM proximal to HOX7 and there was no significant amino acid identity of H6 and HOX7 outside the homeodomain. Wang et al. (1997) mapped the murine Hmx1 homeo box gene to the proximal region of mouse chromosome 5 by backcross matings.

Full details of the abovementioned studies are described in the following publications, the disclosure of which are hereby incorporated by reference:

Stadler, H. S.; Padanilam, B. J.; Buetow, K.; Murray, J. C.; Solursh, M.: Identification and genetic mapping of a homeobox gene to the 4p16.1 region of human chromosome 4. Proc. Nat. Acad. Sci. 89:11579-11583, 1992; and Wang, W.; Yoshiura, K.; Murray, J.; Lufkin, T.: Assignment of the murine Hmx1 homeobox gene to the proximal region of mouse chromosome 5. Mammalian Genome 8:869-876, 1997.

Further studies establishing the function and utilities of HMX1 are found in John Hopkins OMIM database record ID 142992, and in cited publications listed in Table 5, which are hereby incorporated by reference. KIAA0014 (Accession NM_014665.1) is another GAM121 target gene, herein designated TARGET GENE. KIAA0014 BINDING SITE is a target binding site found in the 3' untranslated region of mRNA encoded by KIAA0014, corresponding to a target binding site such as BINDING SITE I, BINDING SITE II or BINDING SITE III of FIG. 8. Table 4 illustrates the complementarity of the nucleotide sequences of KIAA0014 BINDING SITE, designated SEQ ID:17252, to the nucleotide sequence of GAM121 RNA, herein designated GAM RNA, also designated SEQ ID:309.

Another function of GAM121 is therefore inhibition of KIAA0014 (Accession NM_014665.1). Accordingly, utilities of GAM121 include diagnosis, prevention and treatment of diseases and clinical conditions associated with KIAA0014.

KIAA0140 (Accession NM_014661.1) is another GAM121 target gene, herein designated TARGET GENE. KIAA0140 BINDING SITE is a target binding site found in the 3' untranslated region of mRNA encoded by KIAA0140, corresponding to a target binding site such as BINDING SITE I, BINDING SITE II or BINDING SITE III of FIG. 8. Table 4 illustrates the complementarity of the nucleotide sequences of KIAA0140 BINDING SITE, designated SEQ ID:3528, to the nucleotide sequence of GAM121 RNA, herein designated GAM RNA, also designated SEQ ID:309.

Another function of GAM121 is therefore inhibition of KIAA0140 (Accession NM_014661.1). Accordingly, utilities of GAM121 include diagnosis, prevention and treatment of diseases and clinical conditions associated with KIAA0140.

LOC221424 (Accession XM_168060.2) is another GAM121 target gene, herein designated TARGET GENE. LOC221424 BINDING SITE is a target binding site found in the 3' untranslated region of mRNA encoded by LOC221424, corresponding to a target binding site such as BINDING SITE I, BINDING SITE II or BINDING SITE III of FIG. 8. Table 4 illustrates the complementarity of the nucleotide sequences of LOC221424 BINDING SITE, designated SEQ ID:7844, to the nucleotide sequence of GAM121 RNA, herein designated GAM RNA, also designated SEQ ID:309.

Another function of GAM121 is therefore inhibition of LOC221424 (Accession XM_168060.2). Accordingly, utilities of GAM121 include diagnosis, prevention and treatment of diseases and clinical conditions associated with LOC221424.

LOC256158 (Accession) is another GAM121 target gene, herein designated TARGET GENE. LOC256158 BINDING SITE is a target binding site found in the 5' untranslated region of mRNA encoded by LOC256158, corresponding to a target binding site such as BINDING SITE I, BINDING SITE II or BINDING SITE III of FIG. 8. Table 4 illustrates the complementarity of the nucleotide sequences of LOC256158 BINDING SITE, designated SEQ ID:3086, to the nucleotide sequence of GAM121 RNA, herein designated GAM RNA, also designated SEQ ID:309.

Another function of GAM121 is therefore inhibition of LOC256158 (Accession). Accordingly, utilities of GAM121 include diagnosis, prevention and treatment of diseases and clinical conditions associated with LOC256158.

LOC90120 (Accession XM_291299.1) is another GAM121 target gene, herein designated TARGET GENE. LOC90120 BINDING SITE is a target binding site found in the 5' untranslated region of mRNA encoded by LOC90120, corresponding to a target binding site such as BINDING SITE I, BINDING SITE II or BINDING SITE III of FIG. 8. Table 4 illustrates the complementarity of the nucleotide sequences of LOC90120 BINDING SITE, designated SEQ ID:7775, to the nucleotide sequence of GAM121 RNA, herein designated GAM RNA, also designated SEQ ID:309.

Another function of GAM121 is therefore inhibition of LOC90120 (Accession XM_291299.1). Accordingly, utilities of GAM121 include diagnosis, prevention and treatment of diseases and clinical conditions associated with LOC90120.

NKX2C (Accession) is another GAM121 target gene, herein designated TARGET GENE. NKX2C BINDING SITE is a target binding site found in the 3' untranslated region of mRNA encoded by NKX2C, corresponding to a target binding site such as BINDING SITE I, BINDING SITE II or BINDING SITE III of FIG. 8. Table 4 illustrates the complementarity of the nucleotide sequences of NKX2C BINDING SITE, designated SEQ ID:6138, to the nucleotide sequence of GAM121 RNA, herein designated GAM RNA, also designated SEQ ID:309.

Another function of GAM121 is therefore inhibition of NKX2C (Accession). Accordingly, utilities of GAM121 include diagnosis, prevention and treatment of diseases and clinical conditions associated with NKX2C.

Syndecan 3 (n-syndecan) (SDC3, Accession NM_014654.1) is another GAM121 target gene, herein designated TARGET GENE. SDC3 BINDING SITE is a target binding site found in the 3' untranslated region of mRNA encoded by SDC3, corresponding to a target binding site such as BINDING SITE I, BINDING SITE II or BINDING SITE III of FIG. 8. Table 4 illustrates the complementarity of the nucleotide sequences of SDC3 BINDING SITE, designated SEQ ID:12205, to the nucleotide sequence of GAM121 RNA, herein designated GAM RNA, also designated SEQ ID:309.

Another function of GAM121 is therefore inhibition of Syndecan 3 (n-syndecan) (SDC3, Accession NM_014654.1). Accordingly, utilities of GAM121 include diagnosis, prevention and treatment of diseases and clinical conditions associated with SDC3.

SDR1 (Accession NM_004753.1) is another GAM121 target gene, herein designated TARGET GENE. SDR1 BINDING SITE is a target binding site found in the 3' untranslated region of mRNA encoded by SDR1, corresponding to a target binding site such as BINDING SITE I, BINDING SITE II or BINDING SITE III of FIG. 8. Table 4 illustrates the complementarity of the nucleotide sequences of SDR1 BINDING SITE, designated SEQ ID:11207, to the nucleotide sequence of GAM121 RNA, herein designated GAM RNA, also designated SEQ ID:309.

Another function of GAM121 is therefore inhibition of SDR1 (Accession NM_004753.1). Accordingly, utilities of GAM121 include diagnosis, prevention and treatment of diseases and clinical conditions associated with SDR1.

Serine/threonine kinase 22d (spermiogenesis associated) (STK22D, Accession NM_032028.2) is another GAM121 target gene, herein designated TARGET GENE. STK22D BINDING SITE is a target binding site found in the 3' untranslated region of mRNA encoded by STK22D, corresponding to a target binding site such as BINDING SITE I, BINDING SITE II or BINDING SITE III of FIG. 8. Table 4 illustrates the complementarity of the nucleotide sequences of STK22D BINDING SITE, designated SEQ ID:2793, to the nucleotide sequence of GAM121 RNA, herein designated GAM RNA, also designated SEQ ID:309.

Another function of GAM121 is therefore inhibition of Serine/threonine kinase 22d (spermiogenesis associated) (STK22D, Accession NM_032028.2). Accordingly, utilities of GAM121 include diagnosis, prevention and treatment of diseases and clinical conditions associated with STK22D.

FIG. 8 further provides a conceptual description of a novel bioinformatically detected of the present invention, referred to here as Genomic Address Messenger 122 (GAM122), which modulates expression of respective target genes thereof, the function and utility of which target genes is known in the art.

GAM122 is a novel bioinformatically detected regulatory, non protein coding, micro RNA (miRNA) gene. The method by which GAM122 was detected is described hereinabove with reference to FIGS. 8-15.

GAM122 gene, herein designated GAM GENE, and GAM122 target gene, herein designated TARGET GENE, are human genes contained in the human genome.

GAM122 gene encodes a GAM122 precursor RNA, herein designated GAM PRECURSOR RNA. Similar to other miRNA genes, and unlike most ordinary genes, GAM122 precursor RNA does not encode a protein. A nucleotide sequence identical or highly similar to the nucleotide sequence of GAM122 precursor RNA is designated SEQ ID:34, and is provided hereinbelow with reference to the sequence listing part. Nucleotide sequence SEQ ID:34 is located at position 242201799 relative to chromosome 2.

GAM122 precursor RNA folds onto itself, forming GAM122 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM122 precursor RNA folds onto itself, forming GAM122 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM122 precursor RNA, designated SEQ-ID:34, and a schematic representation of a predicted secondary folding of GAM122 folded precursor RNA are further described with reference to Table 2, hereby incorporated by reference.

An enzyme complex designated DICER COMPLEX, 'dices' the GAM122 folded precursor RNA into GAM122 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM122 RNA is designated SEQ ID:337, and is provided hereinbelow with references to the sequence listing part and Table 3, hereby incorporated by reference.

GAM122 target gene, herein designated TARGET GENE, encodes a corresponding messenger RNA, GAM122 target RNA, herein designated GAM TARGET RNA. GAM122 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM122 RNA, herein designated GAM RNA, binds complementarily to one or more target binding sites located in untranslated regions of GAM122 target RNA, herein designated GAM TARGET RNA. This complementary binding is due to the fact that the nucleotide sequence of GAM122 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM122 RNA may have a different number of target binding sites in untranslated regions of a GAM122 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM122 RNA, herein designated GAM RNA, to target binding sites on GAM122 target RNA, herein designated GAM TARGET RNA, such as BINDING SITE I, BINDING SITE II and BINDING SITE III, inhibits translation of GAM122 target RNA into GAM122 target protein, herein designated GAM TARGET PROTEIN. GAM target protein is therefore outlined by a broken line.

It is appreciated that GAM122 target gene, herein designated TARGET GENE, in fact represents a plurality of GAM122 target genes. The mRNA of each one of this plurality of GAM122 target genes comprises one or more target binding sites, each having a nucleotide sequence which is at least partly complementary to GAM122 RNA, herein designated GAM RNA, and which when bound by GAM122 RNA causes inhibition of translation of respective one or more GAM122 target proteins.

It is further appreciated by one skilled in the art that the mode of translational inhibition illustrated by FIG. 8 with specific reference to translational inhibition exerted by GAM122 gene, herein designated GAM GENE, on one or more GAM122 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM122 correlate with, and may be deduced from, the identity of the target genes which GAM122 binds and inhibits, and the function of these target genes, as elaborated hereinbelow.

LOC254936 (Accession) is a GAM122 target gene, herein designated TARGET GENE. LOC254936 BINDING SITE is a target binding site found in the 5' untranslated region of mRNA encoded by LOC254936, corresponding to a target binding site such as BINDING SITE I, BINDING SITE II or BINDING SITE III of FIG. 8. Table 4 illustrates the complementarity of the nucleotide sequences of LOC254936 BINDING SITE, designated SEQ ID:4945, to the nucleotide sequence of GAM122 RNA, herein designated GAM RNA, also designated SEQ ID:337.

A function of GAM122 is therefore inhibition of LOC254936 (Accession). Accordingly, utilities of GAM122 include diagnosis, prevention and treatment of diseases and clinical conditions associated with LOC254936.

FIG. 8 further provides a conceptual description of a novel bioinformatically detected of the present invention, referred to here as Genomic Address Messenger 123 (GAM123), which modulates expression of respective target genes thereof, the function and utility of which target genes is known in the art.

GAM123 is a novel bioinformatically detected regulatory, non protein coding, micro RNA (miRNA) gene. The method by which GAM123 was detected is described hereinabove with reference to FIGS. 8-15.

GAM123 gene, herein designated GAM GENE, and GAM123 target gene, herein designated TARGET GENE, are human genes contained in the human genome.

GAM123 gene encodes a GAM123 precursor RNA, herein designated GAM PRECURSOR RNA. Similar to other miRNA genes, and unlike most ordinary genes, GAM123 precursor RNA does not encode a protein. A nucleotide sequence identical or highly similar to the nucleotide sequence of GAM123 precursor RNA is designated SEQ ID:166, and is provided hereinbelow with reference to the sequence listing part.

GAM123 precursor RNA folds onto itself, forming GAM123 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM123 precursor RNA folds onto itself, forming GAM123 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM123 precursor RNA, designated SEQ-ID:166, and a schematic representation of a predicted secondary folding of GAM123 folded precursor RNA are further described with reference to Table 2, hereby incorporated by reference.

An enzyme complex designated DICER COMPLEX, 'dices' the GAM123 folded precursor RNA into GAM123 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM123 RNA is designated SEQ ID:212, and is provided hereinbelow with references to the sequence listing part and Table 3, hereby incorporated by reference.

GAM123 target gene, herein designated TARGET GENE, encodes a corresponding messenger RNA, GAM123 target RNA, herein designated GAM TARGET RNA. GAM123 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM123 RNA, herein designated GAM RNA, binds complementarily to one or more target binding sites located in untranslated regions of GAM123 target RNA, herein designated GAM TARGET RNA. This complementary binding is due to the fact that the nucleotide sequence of GAM123 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM123 RNA may have a different number of target binding sites in untranslated regions of a GAM123 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM123 RNA, herein designated GAM RNA, to target binding sites on GAM123 target RNA, herein designated GAM TARGET RNA, such as BINDING SITE I, BINDING SITE II and BINDING SITE III, inhibits translation of GAM123 target RNA into GAM123 target protein, herein designated GAM TARGET PROTEIN. GAM target protein is therefore outlined by a broken line.

It is appreciated that GAM123 target gene, herein designated TARGET GENE, in fact represents a plurality of GAM123 target genes. The mRNA of each one of this plurality of GAM123 target genes comprises one or more target binding sites, each having a nucleotide sequence which is at least partly complementary to GAM123 RNA, herein designated GAM RNA, and which when bound by GAM123 RNA causes inhibition of translation of respective one or more GAM123 target proteins.

It is further appreciated by one skilled in the art that the mode of translational inhibition illustrated by FIG. 8 with specific reference to translational inhibition exerted by GAM123 gene, herein designated GAM GENE, on one or more GAM123 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM123 correlate with, and may be deduced from, the identity of the target genes which GAM123 binds and inhibits, and the function of these target genes, as elaborated hereinbelow.

Glycine cleavage system protein h (aminomethyl carrier) (GCSH, Accession NM_004483.1) is a GAM123 target gene, herein designated TARGET GENE. GCSH BINDING SITE is a target binding site found in the 3' untranslated region of mRNA encoded by GCSH, corresponding to a target binding site such as BINDING SITE I, BINDING SITE II or BINDING SITE III of FIG. 8. Table 4 illustrates the complementarity of the nucleotide sequences of GCSH BINDING SITE, designated SEQ ID:9934, to the nucleotide sequence of GAM123 RNA, herein designated GAM RNA, also designated SEQ ID:212.

A function of GAM123 is therefore inhibition of Glycine cleavage system protein h (aminomethyl carrier) (GCSH, Accession NM_004483.1). Accordingly, utilities of GAM123 include diagnosis, prevention and treatment of diseases and clinical conditions associated with GCSH.

FIG. 8 further provides a conceptual description of a novel bioinformatically detected of the present invention, referred to here as Genomic Address Messenger 124 (GAM124), which modulates expression of respective target genes thereof, the function and utility of which target genes is known in the art.

GAM124 is a novel bioinformatically detected regulatory, non protein coding, micro RNA (miRNA) gene. The method by which GAM124 was detected is described hereinabove with reference to FIGS. 8-15.

GAM124 gene, herein designated GAM GENE, and GAM124 target gene, herein designated TARGET GENE, are human genes contained in the human genome.

GAM124 gene encodes a GAM124 precursor RNA, herein designated GAM PRECURSOR RNA. Similar to other miRNA genes, and unlike most ordinary genes, GAM124 precursor RNA does not encode a protein. A nucleotide sequence identical or highly similar to the nucleotide sequence of GAM124 precursor RNA is designated SEQ ID:108, and is provided hereinbelow with reference to the sequence listing part.

GAM124 precursor RNA folds onto itself, forming GAM124 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM124 precursor RNA folds onto itself, forming GAM124 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM124 precursor RNA, designated SEQ-ID:108, and a schematic representation of a predicted secondary folding of GAM124 folded precursor RNA are further described with reference to Table 2, hereby incorporated by reference.

An enzyme complex designated DICER COMPLEX, 'dices' the GAM124 folded precursor RNA into GAM124 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM124 RNA is designated SEQ ID:323, and is provided hereinbelow with references to the sequence listing part and Table 3, hereby incorporated by reference.

GAM124 target gene, herein designated TARGET GENE, encodes a corresponding messenger RNA, GAM124 target RNA, herein designated GAM TARGET RNA. GAM124 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM124 RNA, herein designated GAM RNA, binds complementarily to one or more target binding sites located in untranslated regions of GAM124 target RNA, herein designated GAM TARGET RNA. This complementary binding is due to the fact that the nucleotide sequence of GAM124 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM124 RNA may have a different number of target binding sites in untranslated regions of a GAM124 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM124 RNA, herein designated GAM RNA, to target binding sites on GAM124 target RNA, herein designated GAM TARGET RNA, such as BINDING SITE I, BINDING SITE II and BINDING SITE III, inhibits translation of GAM124 target RNA into GAM124 target protein, herein designated GAM TARGET PROTEIN. GAM target protein is therefore outlined by a broken line.

It is appreciated that GAM124 target gene, herein designated TARGET GENE, in fact represents a plurality of GAM124 target genes. The mRNA of each one of this plurality of GAM124 target genes comprises one or more target binding sites, each having a nucleotide sequence which is at least partly complementary to GAM124 RNA, herein designated GAM RNA, and which when bound by GAM124 RNA causes inhibition of translation of respective one or more GAM124 target proteins.

It is further appreciated by one skilled in the art that the mode of translational inhibition illustrated by FIG. 8 with specific reference to translational inhibition exerted by GAM124 gene, herein designated GAM GENE, on one or more GAM124 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM124 correlate with, and may be deduced from, the identity of the target genes which GAM124 binds and inhibits, and the function of these target genes, as elaborated hereinbelow.

Deltex homolog 1 (drosophila) (DTX1, Accession NM_004416.1) is a GAM124 target gene, herein designated TARGET GENE. DTX1 BINDING SITE is a target binding site found in the 5' untranslated region of mRNA encoded by DTX1, corresponding to a target binding site such as BINDING SITE I, BINDING SITE II or BINDING SITE III of FIG. 8. Table 4 illustrates the complementarity of the nucleotide sequences of DTX1 BINDING SITE, designated SEQ ID:13928, to the nucleotide sequence of GAM124 RNA, herein designated GAM RNA, also designated SEQ ID:323.

A function of GAM124 is therefore inhibition of Deltex homolog 1 (drosophila) (DTX1, Accession NM_004416.1), a gene which modulates Notch signalling and bHLH transcription factor activity. Accordingly, utilities of GAM124 include diagnosis, prevention and treatment of diseases and clinical conditions associated with DTX1.

The function of DTX1 has been established by previous studies. Using the yeast interaction trap system, Matsuno et al. (1998) found that Drosophila and human deltex bind to the human SH3-domain containing protein GRB2 (OMIM Ref. No. 108355). Results from 2 different reporter assays allowed them for the first time to associate deltex with Notch-dependent transcriptional events. They presented evidence linking deltex to the modulation of basic helix-loop-helix (bHLH) transcription factor activity. After confirming that DTX1 is expressed in T lymphocytes at all stages of development, Izon et al. (2002) showed by RT- PCR analysis that murine Dtx1 is also expressed in hemopoietic stem cells and in B lymphocytes in all stages of development, whereas Notch1 expression is low in these cells. The authors transduced hemopoietic progenitor cells with Dtx1 expressing green fluorescent protein and found that mice with these cells had a marked decrease in T cells in the thymus, peripheral blood, and spleen. Instead, the thymus in these mice and in organ culture displayed B-cell development resembling the phenotype of mice deficient in Notch1. Expression of DTX1 partially inhibited transactivation of a CSL (RBPSUH; 147183)-dependent luciferase reporter by activated intracellular NOTCH1 (ICN1) in human and mouse cells. The N terminus of DTX1, which directly interacts with the NOTCH1 ankyrin repeats, inhibited transactivation by ICN1 possessing the ankyrin repeats, probably by inhibiting recruitment of coactivators to the C-terminal transactivation domain of NOTCH1. Izon et al. (2002) concluded that DTX1 is an inhibitor of NOTCH1 activity, a conclusion earlier suggested by the studies of Sestan et al. (1999) on dendritic outgrowth from human neurons.

Full details of the abovementioned studies are described in the following publications, the disclosure of which are hereby incorporated by reference:

Izon, D. J.; Aster, J. C.; He, Y.; Weng, A.; Karnell, F. G.; Patriub, V.; Xu, L.; Bakkour, S.; Rodriguez, C.; Allman, D.; Pear, W. S.: Deltex1 redirects lymphoid progenitors to the B cell lineage by antagonizing Notch1. Immunity 16:231-243, 2002; and Matsuno, K.; Eastman, D.; Mitsiades, T.; Quinn, A. M.; Carcanciu, M. L.; Ordentlich, P.; Kadesch, T.; Artavanis-Tsakonas, S.: Human deltex is a conserved regulator of Notch signalling.

Further studies establishing the function and utilities of DTX1 are found in John Hopkins OMIM database record ID 602582, and in cited publications listed in Table 5, which are hereby incorporated by reference. FLJ20695 (Accession) is another GAM124 target gene, herein designated TARGET GENE. FLJ20695 BINDING SITE is a target binding site found in the 5' untranslated region of mRNA encoded by FLJ20695, corresponding to a target binding site such as BINDING SITE I, BINDING SITE II or BINDING SITE III of FIG. 8. Table 4 illustrates the complementarity of the nucleotide sequences of FLJ20695 BINDING SITE, designated SEQ ID:10484, to the nucleotide sequence of GAM124 RNA, herein designated GAM RNA, also designated SEQ ID:323.

Another function of GAM124 is therefore inhibition of FLJ20695 (Accession). Accordingly, utilities of GAM124 include diagnosis, prevention and treatment of diseases and clinical conditions associated with FLJ20695.

Glia maturation factor, beta (GMFB, Accession NM_004124.1) is another GAM124 target gene, herein designated TARGET GENE. GMFB BINDING SITE is a target binding site found in the 5' untranslated region of mRNA encoded by GMFB, corresponding to a target binding site such as BINDING SITE I, BINDING SITE II or BINDING SITE III of FIG. 8. Table 4 illustrates the complementarity of the nucleotide sequences of GMFB BINDING SITE, designated SEQ ID:18850, to the nucleotide sequence of GAM124 RNA, herein designated GAM RNA, also designated SEQ ID:323.

Another function of GAM124 is therefore inhibition of Glia maturation factor, beta (GMFB, Accession NM_004124.1). Accordingly, utilities of GAM124 include diagnosis, prevention and treatment of diseases and clinical conditions associated with GMFB.

LOC163132 (Accession) is another GAM124 target gene, herein designated TARGET GENE. LOC163132 BINDING SITE is a target binding site found in the 5' untranslated region of mRNA encoded by LOC163132, corresponding to a target binding site such as BINDING SITE I, BINDING SITE II or BINDING SITE III of FIG. 8. Table 4 illustrates the complementarity of the nucleotide sequences of LOC163132 BINDING SITE, designated SEQ ID:20129, to the nucleotide sequence of GAM124 RNA, herein designated GAM RNA, also designated SEQ ID:323.

Another function of GAM124 is therefore inhibition of LOC163132 (Accession). Accordingly, utilities of GAM124 include diagnosis, prevention and treatment of diseases and clinical conditions associated with LOC163132.

Sterol regulatory element binding transcription factor 1 (SREBF1, Accession NM_004176.2) is another GAM124 target gene, herein designated TARGET GENE. SREBF1 BINDING SITE is a target binding site found in the 3' untranslated region of mRNA encoded by SREBF1, corresponding to a target binding site such as BINDING SITE I, BINDING SITE II or BINDING SITE III of FIG. 8. Table 4 illustrates the complementarity of the nucleotide sequences of SREBF1 BINDING SITE, designated SEQ ID:16586, to the nucleotide sequence of GAM124 RNA, herein designated GAM RNA, also designated SEQ ID:323.

Another function of GAM124 is therefore inhibition of Sterol regulatory element binding transcription factor 1 (SREBF1, Accession NM_004176.2), a gene which is a transcriptional activator that binds to the sterol regulatory element 1. Accordingly, utilities of GAM124 include diagnosis, prevention and treatment of diseases and clinical conditions associated with SREBF1.

The function of SREBF1 and its association with various diseases and clinical conditions, has been established by previous studies, as described hereinabove with reference to GAM67.1.

FIG. 8 further provides a conceptual description of a novel bioinformatically detected of the present invention, referred to here as Genomic Address Messenger 125 (GAM125), which modulates expression of respective target genes thereof, the function and utility of which target genes is known in the art.

GAM125 is a novel bioinformatically detected regulatory, non protein coding, micro RNA (miRNA) gene. The method by which GAM125 was detected is described hereinabove with reference to FIGS. 8-15.

GAM125 gene, herein designated GAM GENE, and GAM1 target gene, herein designated TARGET GENE, are human genes contained in the human genome.

GAM125 gene encodes a GAM125 precursor RNA, herein designated GAM PRECURSOR RNA. Similar to other miRNA genes, and unlike most ordinary genes, GAM125 precursor RNA does not encode a protein. A nucleotide sequence identical or highly similar to the nucleotide sequence of GAM125 precursor RNA is designated SEQ ID:44, and is provided hereinbelow with reference to the sequence listing part. Nucleotide sequence SEQ ID:44 is located at position 6134811 relative to chromosome 6.

GAM125 precursor RNA folds onto itself, forming GAM125 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM125 precursor RNA folds onto itself, forming GAM125 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM125 precursor RNA, designated SEQ-ID:44, and a schematic representation of a predicted secondary folding of GAM125 folded precursor RNA are further described with reference to Table 2, hereby incorporated by reference.

An enzyme complex designated DICER COMPLEX, 'dices' the GAM125 folded precursor RNA into GAM1 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM1RNA is designated SEQ ID:330, and is provided hereinbelow with references to the sequence listing part and Table 3, hereby incorporated by reference.

GAM1 target gene, herein designated TARGET GENE, encodes a corresponding messenger RNA, GAM1 target RNA, herein designated GAM TARGET RNA. GAM125 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM1 RNA, herein designated GAM RNA, binds complementarily to one or more target binding sites located in untranslated regions of GAM1 target RNA, herein designated GAM TARGET RNA. This complementary binding is due to the fact that the nucleotide sequence of GAM1 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM1 RNA may have a different number of target binding sites in untranslated regions of a GAM1 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM1 RNA, herein designated GAM RNA, to target binding sites on GAM1 target RNA, herein designated GAM TARGET RNA, such as BINDING SITE I, BINDING SITE II and BINDING SITE III, inhibits translation of GAM125 target RNA into GAM1 target protein, herein designated GAM TARGET PROTEIN. GAM target protein is therefore outlined by a broken line.

It is appreciated that GAM1 target gene, herein designated TARGET GENE, in fact represents a plurality of GAM1 target genes. The mRNA of each one of this plurality of GAM1 target genes comprises one or more target binding sites, each having a nucleotide sequence which is at least partly complementary to GAM1 RNA, herein designated GAM RNA, and which when bound by GAM1 RNA causes inhibition of translation of respective one or more GAM1 target proteins.

It is further appreciated by one skilled in the art that the mode of translational inhibition illustrated by FIG. 8 with specific reference to translational inhibition exerted by GAM125 gene, herein designated GAM GENE, on one or more GAM125 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM125 correlate with, and may be deduced from, the identity of the target genes which GAM125 binds and inhibits, and the function of these target genes, as elaborated hereinbelow.

Coagulation factor xiii, a1 polypeptide (F13A1, Accession NM_000129.2) is a GAM1 target gene, herein designated TARGET GENE. F13A1 BINDING SITE is a target binding site found in the 3' untranslated region of mRNA encoded by F13A1, corresponding to a target binding site such as BINDING SITE I, BINDING SITE II or BINDING SITE III of FIG. 8. Table 4 illustrates the complementarity of the nucleotide sequences of F13A1 BINDING SITE, designated SEQ ID:9703, to the nucleotide sequence of GAM1RNA, herein designated GAM RNA, also designated SEQ ID:330.

A function of GAM125 is therefore inhibition of Coagulation factor xiii, a1 polypeptide (F13A1, Accession NM_000129.2). Accordingly, utilities of GAM1 include diagnosis, prevention and treatment of diseases and clinical conditions associated with F13A1.

MEGF10 (Accession NM_032446.1) is another GAM125 target gene, herein designated TARGET GENE. MEGF10 BINDING SITE is a target binding site found in the 3' untranslated region of mRNA encoded by MEGF10, corresponding to a target binding site such as BINDING SITE I, BINDING SITE II or BINDING SITE III of FIG. 8. Table 4 illustrates the complementarity of the nucleotide sequences of MEGF10 BINDING SITE, designated SEQ ID:7443, to the nucleotide sequence of GAM1 RNA, herein designated GAM RNA, also designated SEQ ID:330.

Another function of GAM125 is therefore inhibition of MEGF10 (Accession NM_032446.1). Accordingly, utilities of GAM125 include diagnosis, prevention and treatment of diseases and clinical conditions associated with MEGF10.

FIG. 8 further provides a conceptual description of a novel bioinformatically detected of the present invention, referred to here as Genomic Address Messenger 126 (GAM126), which modulates expression of respective target genes thereof, the function and utility of which target genes is known in the art.

GAM126 is a novel bioinformatically detected regulatory, non protein coding, micro RNA (miRNA) gene. The method by which GAM126 was detected is described hereinabove with reference to FIGS. 8-15.

GAM126 gene, herein designated GAM GENE, and GAM126 target gene, herein designated TARGET GENE, are human genes contained in the human genome.

GAM126 gene encodes a GAM126 precursor RNA, herein designated GAM PRECURSOR RNA. Similar to other miRNA genes, and unlike most ordinary genes, GAM126 precursor RNA does not encode a protein. A nucleotide sequence identical or highly similar to the nucleotide sequence of GAM126 precursor RNA is designated SEQ ID:148, and is provided hereinbelow with reference to the sequence listing part.

GAM126 precursor RNA folds onto itself, forming GAM126 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM126 precursor RNA folds onto itself, forming GAM126 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM126 precursor RNA, designated SEQ-ID:148, and a schematic representation of a predicted secondary folding of GAM126 folded precursor RNA are further described with reference to Table 2, hereby incorporated by reference.

An enzyme complex designated DICER COMPLEX, 'dices' the GAM126 folded precursor RNA into GAM126 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM126 RNA is designated SEQ ID:312, and is provided hereinbelow with references to the sequence listing part and Table 3, hereby incorporated by reference.

GAM126 target gene, herein designated TARGET GENE, encodes a corresponding messenger RNA, GAM126 target RNA, herein designated GAM TARGET RNA. GAM126 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM126 RNA, herein designated GAM RNA, binds complementarily to one or more target binding sites located in untranslated regions of GAM126 target RNA, herein designated GAM TARGET RNA. This complementary binding is due to the fact that the nucleotide sequence of GAM126 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM126 RNA may have a different number of target binding sites in untranslated regions of a GAM126 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM126 RNA, herein designated GAM RNA, to target binding sites on GAM126 target RNA, herein designated GAM TARGET RNA, such as BINDING SITE I, BINDING SITE II and BINDING SITE III, inhibits translation of GAM126 target RNA into GAM126 target protein, herein designated GAM TARGET PROTEIN. GAM target protein is therefore outlined by a broken line.

It is appreciated that GAM126 target gene, herein designated TARGET GENE, in fact represents a plurality of GAM126 target genes. The mRNA of each one of this plurality of GAM126 target genes comprises one or more target binding sites, each having a nucleotide sequence which is at least partly complementary to GAM126 RNA, herein designated GAM RNA, and which when bound by GAM126 RNA causes inhibition of translation of respective one or more GAM126 target proteins.

It is further appreciated by one skilled in the art that the mode of translational inhibition illustrated by FIG. 8 with specific reference to translational inhibition exerted by GAM126 gene, herein designated GAM GENE, on one or more GAM126 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM126 correlate with, and may be deduced from, the identity of the target genes which GAM126 binds and inhibits, and the function of these target genes, as elaborated hereinbelow.

P21(cdkn1a)-activated kinase 6 (PAK6, Accession NM_020168.3) is a GAM126 target gene, herein designated TARGET GENE. PAK6 BINDING SITE is a target binding site found in the 3' untranslated region of mRNA encoded by PAK6, corresponding to a target binding site such as BINDING SITE I, BINDING SITE II or BINDING SITE III of FIG. 8. Table 4 illustrates the complementarity of the nucleotide sequences of PAK6 BINDING SITE, designated SEQ ID:7423, to the nucleotide sequence of GAM126 RNA, herein designated GAM RNA, also designated SEQ ID:312.

A function of GAM126 is therefore inhibition of P21 (cdkn1a)-activated kinase 6 (PAK6, Accession NM_020168.3). Accordingly, utilities of GAM126 include diagnosis, prevention and treatment of diseases and clinical conditions associated with PAK6.

FIG. 8 further provides a conceptual description of a novel bioinformatically detected of the present invention, referred to here as Genomic Address Messenger 127 (GAM127), which modulates expression of respective target genes thereof, the function and utility of which target genes is known in the art.

GAM127 is a novel bioinformatically detected regulatory, non protein coding, micro RNA (miRNA) gene. The method by which GAM127 was detected is described hereinabove with reference to FIGS. 8-15.

GAM127 gene, herein designated GAM GENE, and GAM127 target gene, herein designated TARGET GENE, are human genes contained in the human genome.

GAM127 gene encodes a GAM127 precursor RNA, herein designated GAM PRECURSOR RNA. Similar to other miRNA genes, and unlike most ordinary genes, GAM127 precursor RNA does not encode a protein. A nucleotide sequence identical or highly similar to the nucleotide sequence of GAM127 precursor RNA is designated SEQ ID:53, and is provided hereinbelow with reference to the sequence listing part.

GAM127 precursor RNA folds onto itself, forming GAM127 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM127 precursor RNA folds onto itself, forming GAM127 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM127 precursor RNA, designated SEQ-ID:53, and a schematic representation of a predicted secondary folding of GAM127 folded precursor RNA are further described with reference to Table 2, hereby incorporated by reference.

An enzyme complex designated DICER COMPLEX, 'dices' the GAM127 folded precursor RNA into GAM127 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM127 RNA is designated SEQ ID:321, and is provided hereinbelow with references to the sequence listing part and Table 3, hereby incorporated by reference.

GAM127 target gene, herein designated TARGET GENE, encodes a corresponding messenger RNA, GAM127 target RNA, herein designated GAM TARGET RNA. GAM127 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM127 RNA, herein designated GAM RNA, binds complementarily to one or more target binding sites located in untranslated regions of GAM127 target RNA, herein designated GAM TARGET RNA. This complementary binding is due to the fact that the nucleotide sequence of GAM127 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM127 RNA may have a different number of target binding sites in untranslated regions of a GAM127 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM127 RNA, herein designated GAM RNA, to target binding sites on GAM127 target RNA, herein designated GAM TARGET RNA, such as BINDING SITE I, BINDING SITE II and BINDING SITE III, inhibits translation of GAM127 target RNA into GAM127 target protein, herein designated GAM TARGET PROTEIN. GAM target protein is therefore outlined by a broken line.

It is appreciated that GAM127 target gene, herein designated TARGET GENE, in fact represents a plurality of GAM127 target genes. The mRNA of each one of this plurality of GAM127 target genes comprises one or more target binding sites, each having a nucleotide sequence which is at least partly complementary to GAM127 RNA, herein designated GAM RNA, and which when bound by GAM127 RNA causes inhibition of translation of respective one or more GAM127 target proteins.

It is further appreciated by one skilled in the art that the mode of translational inhibition illustrated by FIG. 8 with specific reference to translational inhibition exerted by GAM127 gene, herein designated GAM GENE, on one or more GAM127 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM127 correlate with, and may be deduced from, the identity of the target genes which GAM127 binds and inhibits, and the function of these target genes, as elaborated hereinbelow.

SPK (Accession NM_004819.1) is a GAM127 target gene, herein designated TARGET GENE. SPK BINDING SITE is a target binding site found in the 5' untranslated region of mRNA encoded by SPK, corresponding to a target binding site such as BINDING SITE I, BINDING SITE II or BINDING SITE III of FIG. 8. Table 4 illustrates the complementarity of the nucleotide sequences of SPK BINDING SITE, designated SEQ ID:12856, to the nucleotide sequence of GAM127 RNA, herein designated GAM RNA, also designated SEQ ID:321.

A function of GAM127 is therefore inhibition of SPK (Accession NM_004819.1). Accordingly, utilities of GAM127 include diagnosis, prevention and treatment of diseases and clinical conditions associated with SPK.

Vamp (vesicle-associated membrane protein)-associated protein a, 33 kda (VAPA, Accession NM_003574.2) is another GAM127 target gene, herein designated TARGET GENE. VAPA BINDING SITE1 and VAPA BINDING SITE2 are target binding sites found in untranslated regions of mRNA encoded by VAPA, corresponding to target binding sites such as BINDING SITE I, BINDING SITE II or BINDING SITE III of FIG. 8. Table 4 illustrates the complementarity of the nucleotide sequences of VAPA BINDING SITE1 and VAPA BINDING SITE2, designated SEQ ID:11936 and SEQ ID:2734 respectively, to the nucleotide sequence of GAM127 RNA, herein designated GAM RNA, also designated SEQ ID:321.

Another function of GAM127 is therefore inhibition of Vamp (vesicle-associated membrane protein)-associated protein a, 33 kda (VAPA, Accession NM_003574.2), a gene which may have a role in vesicle trafficking. Accordingly, utilities of GAM127 include diagnosis, prevention and treatment of diseases and clinical conditions associated with VAPA.

The function of VAPA has been established by previous studies. By searching an EST database for human homologs of the Aplysia 33-kD VAMP-associated protein (Vap33), Weir et al. (1998) identified a cDNA encoding VAPA, which they termed VAP33. Sequence analysis predicted that the 242-amino acid protein, which is 50% identical to the molluscan sequence, contains 8 potential phosphorylation sites, an alpha-helical coiled-coil domain, and a C-terminal transmembrane domain. Northern blot analysis of mouse tissues detected a major 1.9-kb transcript and minor 3.9- and 7.1-kb transcripts in all tissues tested, with highest expression in brain, testis, ovary, kidney and skeletal muscle. In contrast, Vap33 expression is neuron specific in Aplysia. Western blot analysis showed that VAPA interacts with VAMP1 (OMIM Ref. No. 185880) and VAMP2 (OMIM Ref. No. 185881) but not with SNAP25 (OMIM Ref. No. 600322). Nishimura et al. (1999) identified cDNAs encoding VAPA and the 60% homologous VAPB (OMIM Ref. No. 605704). Northern blot analysis detected a 1.7-kb VAPA transcript in all human tissues tested. SDS-PAGE analysis demonstrated that the transmembrane domain of recombinant VAPA interacted with VAPA and VAPB fusion proteins.

Full details of the abovementioned studies are described in the following publications, the disclosure of which are hereby incorporated by reference:

Weir, M. L.; Klip, A.; Trimble, W. S.: Identification of a human homologue of the vesicle-associated membrane protein (VAMP)-associated protein of 33 kDa (VAP- 33): a broadly expressed protein that binds to VAMP. Biochem. J. 333:247-251, 1998; and Nishimura, Y.; Hayashi, M.; Inada, H.; Tanaka, T.: Molecular cloning and characterization of mammalian homologues of vesicle-associated membrane protein- associated (VAMP-associated) prote.

Further studies establishing the function and utilities of VAPA are found in John Hopkins OMIM database record ID 605703, and in cited publications listed in Table 5, which are hereby incorporated by reference.

FIG. 8 further provides a conceptual description of a novel bioinformatically detected of the present invention, referred to here as Genomic Address Messenger 128 (GAM128), which modulates expression of respective target genes thereof, the function and utility of which target genes is known in the art.

GAM128 is a novel bioinformatically detected regulatory, non protein coding, micro RNA (miRNA) gene. The method by which GAM128 was detected is described hereinabove with reference to FIGS. 8-15.

GAM128 gene, herein designated GAM GENE, and GAM128 target gene, herein designated TARGET GENE, are human genes contained in the human genome.

GAM128 gene encodes a GAM128 precursor RNA, herein designated GAM PRECURSOR RNA. Similar to other miRNA genes, and unlike most ordinary genes, GAM128 precursor RNA does not encode a protein. A nucleotide sequence identical or highly similar to the nucleotide sequence of GAM128 precursor RNA is designated SEQ ID:168, and is provided hereinbelow with reference to the sequence listing part.

GAM128 precursor RNA folds onto itself, forming GAM128 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM128 precursor RNA folds onto itself, forming GAM128 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM128 precursor RNA, designated SEQ-ID:168, and a schematic representation of a predicted secondary folding of GAM128 folded precursor RNA are further described with reference to Table 2, hereby incorporated by reference.

An enzyme complex designated DICER COMPLEX, 'dices' the GAM128 folded precursor RNA into GAM128 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM128 RNA is designated SEQ ID:316, and is provided hereinbelow with references to the sequence listing part and Table 3, hereby incorporated by reference.

GAM128 target gene, herein designated TARGET GENE, encodes a corresponding messenger RNA, GAM128 target RNA, herein designated GAM TARGET RNA. GAM128 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM128 RNA, herein designated GAM RNA, binds complementarily to one or more target binding sites located in untranslated regions of GAM128 target RNA, herein designated GAM TARGET RNA. This complementary binding is due to the fact that the nucleotide sequence of GAM128 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM128 RNA may have a different number of target binding sites in untranslated regions of a GAM128 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM128 RNA, herein designated GAM RNA, to target binding sites on GAM128 target RNA, herein designated GAM TARGET RNA, such as BINDING SITE I, BINDING SITE II and BINDING SITE III, inhibits translation of GAM128 target RNA into GAM128 target protein, herein designated GAM TARGET PROTEIN. GAM target protein is therefore outlined by a broken line.

It is appreciated that GAM128 target gene, herein designated TARGET GENE, in fact represents a plurality of GAM128 target genes. The mRNA of each one of this plurality of GAM128 target genes comprises one or more target binding sites, each having a nucleotide sequence which is at least partly complementary to GAM128 RNA, herein designated GAM RNA, and which when bound by GAM128 RNA causes inhibition of translation of respective one or more GAM128 target proteins.

It is further appreciated by one skilled in the art that the mode of translational inhibition illustrated by FIG. 8 with specific reference to translational inhibition exerted by GAM128 gene, herein designated GAM GENE, on one or more GAM128 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM128 correlate with, and may be deduced from, the identity of the target genes which GAM128 binds and inhibits, and the function of these target genes, as elaborated hereinbelow.

A disintegrin-like and metalloprotease (reprolysin type) with thrombospondin type 1 motif, 8 (ADAMTS8, Accession NM_007037.2) is a GAM128 target gene, herein designated TARGET GENE. ADAMTS8 BINDING SITE is a target binding site found in the 3' untranslated region of mRNA encoded by ADAMTS8, corresponding to a target binding site such as BINDING SITE I, BINDING SITE II or BINDING SITE III of FIG. 8. Table 4 illustrates the complementarity of the nucleotide sequences of ADAMTS8 BINDING SITE, designated SEQ ID:7148, to the nucleotide sequence of GAM128 RNA, herein designated GAM RNA, also designated SEQ ID:316.

A function of GAM128 is therefore inhibition of A disintegrin-like and metalloprotease (reprolysin type) with thrombospondin type 1 motif, 8 (ADAMTS8, Accession NM_007037.2), a gene which has anti-angiogenic properties. Accordingly, utilities of GAM128 include diagnosis, prevention and treatment of diseases and clinical conditions associated with ADAMTS8.

The function of ADAMTS8 and its association with various diseases and clinical conditions, has been established by previous studies, as described hereinabove with reference to GAM94.1. ATP6M8-9 (Accession) is another GAM128 target gene, herein designated TARGET GENE. ATP6M8-9 BINDING SITE is a target binding site found in the 3' untranslated region of mRNA encoded by ATP6M8-9, corresponding to a target binding site such as BINDING SITE I, BINDING SITE II or BINDING SITE III of FIG. 8. Table 4 illustrates the complementarity of the nucleotide sequences of ATP6M8-9 BINDING SITE, designated SEQ ID:6599, to the nucleotide sequence of GAM128 RNA, herein designated GAM RNA, also designated SEQ ID:316.

Another function of GAM128 is therefore inhibition of ATP6M8-9 (Accession). Accordingly, utilities of GAM128 include diagnosis, prevention and treatment of diseases and clinical conditions associated with ATP6M8-9.

Herv-h ltr-associating 2 (HHLA2, Accession) is another GAM128 target gene, herein designated TARGET GENE. HHLA2 BINDING SITE is a target binding site found in the 3' untranslated region of mRNA encoded by HHLA2, corresponding to a target binding site such as BINDING SITE I, BINDING SITE II or BINDING SITE III of FIG. 8. Table 4 illustrates the complementarity of the nucleotide sequences of HHLA2 BINDING SITE, designated SEQ ID:16378, to the nucleotide sequence of GAM128 RNA, herein designated GAM RNA, also designated SEQ ID:316.

Another function of GAM128 is therefore inhibition of Herv-h ltr-associating 2 (HHLA2, Accession). Accordingly, utilities of GAM128 include diagnosis, prevention and treatment of diseases and clinical conditions associated with HHLA2.

KIAA0515 (Accession) is another GAM128 target gene, herein designated TARGET GENE. KIAA0515 BINDING SITE is a target binding site found in the 5' untranslated region of mRNA encoded by KIAA0515, corresponding to a target binding site such as BINDING SITE I, BINDING SITE II or BINDING SITE III of FIG. 8. Table 4 illustrates the complementarity of the nucleotide sequences of KIAA0515 BINDING SITE, designated SEQ ID:2335, to the nucleotide sequence of GAM128 RNA, herein designated GAM RNA, also designated SEQ ID:316.

Another function of GAM128 is therefore inhibition of KIAA0515 (Accession). Accordingly, utilities of GAM128 include diagnosis, prevention and treatment of diseases and clinical conditions associated with KIAA0515.

FIG. 8 further provides a conceptual description of a novel bioinformatically detected of the present invention, referred to here as Genomic Address Messenger 129 (GAM129), which modulates expression of respective target genes thereof, the function and utility of which target genes is known in the art.

GAM129 is a novel bioinformatically detected regulatory, non protein coding, micro RNA (miRNA) gene. The method by which GAM129 was detected is described hereinabove with reference to FIGS. 8-15.

GAM129 gene, herein designated GAM GENE, and GAM129 target gene, herein designated TARGET GENE, are human genes contained in the human genome.

GAM129 gene encodes a GAM129 precursor RNA, herein designated GAM PRECURSOR RNA. Similar to other miRNA genes, and unlike most ordinary genes, GAM129 precursor RNA does not encode a protein. A nucleotide sequence identical or highly similar to the nucleotide sequence of GAM129 precursor RNA is designated SEQ ID:181, and is provided hereinbelow with reference to the sequence listing part.

GAM129 precursor RNA folds onto itself, forming GAM129 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM129 precursor RNA folds onto itself, forming GAM129 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM129 precursor RNA, designated SEQ-ID:181, and a schematic representation of a predicted secondary folding of GAM129 folded precursor RNA are further described with reference to Table 2, hereby incorporated by reference.

An enzyme complex designated DICER COMPLEX, 'dices' the GAM129 folded precursor RNA into GAM129 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM129 RNA is designated SEQ ID:213, and is provided hereinbelow with references to the sequence listing part and Table 3, hereby incorporated by reference.

GAM129 target gene, herein designated TARGET GENE, encodes a corresponding messenger RNA, GAM129 target RNA, herein designated GAM TARGET RNA. GAM129 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM129 RNA, herein designated GAM RNA, binds complementarily to one or more target binding sites located in untranslated regions of GAM129 target RNA, herein designated GAM TARGET RNA. This complementary binding is due to the fact that the nucleotide sequence of GAM129 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM129 RNA may have a different number of target binding sites in untranslated regions of a GAM129 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM129 RNA, herein designated GAM RNA, to target binding sites on GAM129 target RNA, herein designated GAM TARGET RNA, such as BINDING SITE I, BINDING SITE II and BINDING SITE III, inhibits translation of GAM129 target RNA into GAM129 target protein, herein designated GAM TARGET PROTEIN. GAM target protein is therefore outlined by a broken line.

It is appreciated that GAM129 target gene, herein designated TARGET GENE, in fact represents a plurality of GAM129 target genes. The mRNA of each one of this plurality of GAM129 target genes comprises one or more target binding sites, each having a nucleotide sequence which is at least partly complementary to GAM129 RNA, herein designated GAM RNA, and which when bound by GAM129 RNA causes inhibition of translation of respective one or more GAM129 target proteins.

It is further appreciated by one skilled in the art that the mode of translational inhibition illustrated by FIG. 8 with specific reference to translational inhibition exerted by GAM129 gene, herein designated GAM GENE, on one or more GAM129 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM129 correlate with, and may be deduced from, the identity of the target genes which GAM129 binds and inhibits, and the function of these target genes, as elaborated hereinbelow.

A disintegrin and metalloproteinase domain 19 (meltrin beta) (ADAM19, Accession NM_033274.1) is a GAM129 target gene, herein designated TARGET GENE. ADAM19 BINDING SITE is a target binding site found in the 3' untranslated region of multiple transcripts of mRNA encoded by ADAM19, corresponding to a target binding site such as BINDING SITE I, BINDING SITE II or BINDING SITE III of FIG. 8. Table 4 illustrates the complementarity of the nucleotide sequences of ADAM19 BINDING SITE, designated SEQ ID:14108, to the nucleotide sequence of GAM129 RNA, herein designated GAM RNA, also designated SEQ ID:213.

A function of GAM129 is therefore inhibition of A disintegrin and metalloproteinase domain 19 (meltrin beta) (ADAM19, Accession NM_033274.1), a gene which participates in the proteolytic processing of beta- type neuregulin isoforms. Accordingly, utilities of GAM129 include diagnosis, prevention and treatment of diseases and clinical conditions associated with ADAM19.

The function of ADAM19 has been established by previous studies. Members of the ADAM family are cell surface proteins containing a disintegrin cell adhesion domain and a metalloproteinase domain. Inoue et al. (1998) cloned full-length cDNAs of mouse Adam19, which they referred to as meltrin-beta (see OMIM Ref. No. ADAM12, 602714). The ADAM19 gene encodes a 920-amino acid polypeptide, and Inoue et al. (1998) found that its sequence was most similar to ADAM12 and ADAM13. Northern blot analysis revealed that a major 6.5-kb transcript was expressed in all mouse tissues tested. Hirohata et al. (1998) used radiation hybrids to map ADAM19 to mouse chromosome 11 and to human chromosome 5q32-q33.

Full details of the abovementioned studies are described in the following publications, the disclosure of which are hereby incorporated by reference:

Hirohata, S.; Seldin, M. F.; Apte, S. S.: Chromosomal assignment of two ADAM genes, TACE (ADAM17) and MLTNB (ADAM19), to human chromosomes 2 and 5, respectively, and of Mltnb to mouse chromosome 11. Genomics 54:178-179, 1998; and Inoue, D.; Reid, M.; Lum, L.; Kratzschmar, J.; Weskamp, G.; Myung, Y. M.; Baron, R.; Blobel, C. P.: Cloning and initial characterization of mouse meltrin beta and analysis of the expre.

Further studies establishing the function and utilities of ADAM19 are found in John Hopkins OMIM database record ID 603640, and in cited publications listed in Table 5, which are hereby incorporated by reference. A disintegrin and metalloproteinase domain 8 (ADAM8, Accession NM_001109.1) is another GAM129 target gene, herein designated TARGET GENE. ADAM8 BINDING SITE is a target binding site found in the 3' untranslated region of mRNA encoded by ADAM8, corresponding to a target binding site such as BINDING SITE I, BINDING SITE II or BINDING SITE III of FIG. 8. Table 4 illustrates the complementarity of the nucleotide sequences of ADAM8 BINDING SITE, designated SEQ ID:17299, to the nucleotide sequence of GAM129 RNA, herein designated GAM RNA, also designated SEQ ID:213.

Another function of GAM129 is therefore inhibition of A disintegrin and metalloproteinase domain 8 (ADAM8, Accession NM_001109.1). Accordingly, utilities of GAM129 include diagnosis, prevention and treatment of diseases and clinical conditions associated with ADAM8.

Aquaporin 6, kidney specific (AQP6, Accession NM_053286.1) is another GAM129 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:3804, to the nucleotide sequence of GAM129 RNA, herein designated GAM RNA, also designated SEQ ID:213.

Another function of GAM129 is therefore inhibition of Aquaporin 6, kidney specific (AQP6, Accession NM_053286.1), a gene which participates in distinct physiologic function such as glomerular filtration, tubular endocytosis, and acid-base-metabolism. Accordingly, utilities of GAM129 include diagnosis, prevention and treatment of diseases and clinical conditions associated with AQP6.

The function of AQP6 and its association with various diseases and clinical conditions, has been established by previous studies, as described hereinabove with reference to GAM51.1. Atp synthase, h+ transporting, mitochondrial f1 complex, delta subunit (ATP5D, Accession NM_001687.1) is another GAM129 target gene, herein designated TARGET GENE. ATP5D BINDING SITE is a target binding site found in the 3' untranslated region of mRNA encoded by ATP5D, corresponding to a target binding site such as BINDING SITE I, BINDING SITE II or BINDING SITE III of FIG. 8. Table 4 illustrates the complementarity of the nucleotide sequences of ATP5D BINDING SITE, designated SEQ ID:13370, to the nucleotide sequence of GAM129 RNA, herein designated GAM RNA, also designated SEQ ID:213.

Another function of GAM129 is therefore inhibition of Atp synthase, h+ transporting, mitochondrial f1 complex, delta subunit (ATP5D, Accession NM_001687.1). Accordingly, utilities of GAM129 include diagnosis, prevention and treatment of diseases and clinical conditions associated with ATP5D.

Beta-site app-cleaving enzyme (BACE, Accession NM_138973.1) is another GAM129 target gene, herein designated TARGET GENE. BACE BINDING SITE is a target binding site found in the 5' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:16749, to the nucleotide sequence of GAM129 RNA, herein designated GAM RNA, also designated SEQ ID:213.

Another function of GAM129 is therefore inhibition of Beta-site app-cleaving enzyme (BACE, Accession NM_138973.1), a gene which is responsible for the proteolytic processing of the amyloid precursor protein and therefore may be associated with Alzheimer disease. Accordingly, utilities of GAM129 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Brca1 associated protein-1 (ubiquitin carboxy-terminal hydrolase) (BAP1, Accession NM_004656.2) is another GAM129 target gene, herein designated TARGET GENE. BAP1 BINDING SITE is a target binding site found in the 3' untranslated region of mRNA encoded by BAP1, corresponding to a target binding site such as BINDING SITE I, BINDING SITE II or BINDING SITE III of FIG. 8. Table 4 illustrates the complementarity of the nucleotide sequences of BAP1 BINDING SITE, designated SEQ ID:14852, to the nucleotide sequence of GAM129 RNA, herein designated GAM RNA, also designated SEQ ID:213.

Another function of GAM129 is therefore inhibition of Brca1 associated protein-1 (ubiquitin carboxy-terminal hydrolase) (BAP1, Accession NM_004656.2). Accordingly, utilities of GAM129 include diagnosis, prevention and treatment of diseases and clinical conditions associated with BAP1.

Burkitt lymphoma receptor 1, gtp binding protein (chemokine (c-x-c motif) receptor 5) (BLR1, Accession NM_001716.2) is another GAM129 target gene, herein designated TARGET GENE. BLR1 BINDING SITE is a target binding site found in the 3' untranslated region of multiple transcripts of mRNA encoded by BLR1, corresponding to a target binding site such as BINDING SITE I, BINDING SITE II or BINDING SITE III of FIG. 8. Table 4 illustrates the complementarity of the nucleotide sequences of BLR1 BINDING SITE, designated SEQ ID:17913, to the nucleotide sequence of GAM129 RNA, herein designated GAM RNA, also designated SEQ ID:213.

Another function of GAM129 is therefore inhibition of Burkitt lymphoma receptor 1, gtp binding protein (chemokine (c-x-c motif) receptor 5) (BLR1, Accession NM_001716.2). Accordingly, utilities of GAM129 include diagnosis, prevention and treatment of diseases and clinical conditions associated with BLR1.

Chromosome 1 open reading frame 1 (C1orf1, Accession NM_001213.1) is another GAM129 target gene, herein designated TARGET GENE. C1orf1 BINDING SITE is a target binding site found in the 3' untranslated region of mRNA encoded by C1orf1, corresponding to a target binding site such as BINDING SITE I, BINDING SITE II or BINDING SITE III of FIG. 8. Table 4 illustrates the complementarity of the nucleotide sequences of C1orf1 BINDING SITE, designated SEQ ID:1462, to the nucleotide sequence of GAM129 RNA, herein designated GAM RNA, also designated SEQ ID:213.

Another function of GAM129 is therefore inhibition of Chromosome 1 open reading frame 1 (C1orf1, Accession NM_001213.1). Accordingly, utilities of GAM129 include diagnosis, prevention and treatment of diseases and clinical conditions associated with C1orf1.

Chromosome 1 open reading frame 17 (C1orf17, Accession NM_015101.1) is another GAM129 target gene, herein designated TARGET GENE. C1orf17 BINDING SITE is a target binding site found in the 3' untranslated region of mRNA encoded by C1orf17, corresponding to a target binding site such as BINDING SITE I, BINDING SITE II or BINDING SITE III of FIG. 8. Table 4 illustrates the complementarity of the nucleotide sequences of C1orf17 BINDING SITE, designated SEQ ID:8671, to the nucleotide sequence of GAM129 RNA, herein designated GAM RNA, also designated SEQ ID:213.

Another function of GAM129 is therefore inhibition of Chromosome 1 open reading frame 17 (C1orf17, Accession NM_015101.1). Accordingly, utilities of GAM129 include diagnosis, prevention and treatment of diseases and clinical conditions associated with C1orf17.

Cd44 antigen (homing function and indian blood group system) (CD44, Accession NM_000610.2) is another GAM129 target gene, herein designated TARGET GENE. CD44 BINDING SITE is a target binding site found in the 5' untranslated region of mRNA encoded by CD44, corresponding to a target binding site such as BINDING SITE I, BINDING SITE II or BINDING SITE III of FIG. 8. Table 4 illustrates the complementarity of the nucleotide sequences of CD44 BINDING SITE, designated SEQ ID:12215, to the nucleotide sequence of GAM129 RNA, herein designated GAM RNA, also designated SEQ ID:213.

Another function of GAM129 is therefore inhibition of Cd44 antigen (homing function and indian blood group system) (CD44, Accession NM_000610.2), a gene which is main cell surface receptor for hyaluronate, and involves in matrix adhesion, lymphocyte activation and lymph node homing. and therefore may be associated with Tumor. Accordingly, utilities of GAM129 include diagnosis, prevention and treatment of Tumor, and of other diseases and clinical conditions associated with CD44.

The function of CD44 has been established by previous studies. Weber et al. (1996) noted that the CD44 gene encodes a transmembrane protein that is expressed as a family of molecular isoforms generated from alternative RNA splicing and posttranslational modifications. Certain CD44 isoforms that regulate activation and migration of lymphocytes and macrophages may also enhance local growth and metastatic spread of tumor cells. One ligand of CD44 is hyaluronic acid, binding of which to the NH2-terminal domain of CD44 enhances cellular aggregation and tumor cell growth. (Krainer et al. (1991) referred to CD44 as a 'hyaladherin'-see 601269.) Weber et al. (1996) demonstrated that another ligand is osteopontin (OMIM Ref. No. 166490). Osteopontin induces cellular chemotaxis but not homotypic aggregation of cells, whereas the inverse is true for the interaction between CD44 and hyaluronate. The alternative responses to CD44 ligation may be exploited by tumor cells to allow OPN-mediated metastatic spread and hyaluronate-dependent growth in newly colonized tissues in the process of tumor metastasis Animal model experiments lend further support to the function of CD44. Schmits et al. (1997) generated mice deficient in all known isoforms of Cd44 by targeting exons encoding the invariant N-terminal region of the molecule. Mice were born in mendelian ratio without any obvious developmental or neurologic deficits. Hematologic impairment was evidenced by altered tissue distribution of myeloid progenitors with increased levels of colony-forming unit-granulocyte-macrophage in bone marrow and reduced numbers in spleen. Fetal liver colony-forming unit-spleen and granulocyte colony-stimulating factor mobilization assay, together with reduced colony- forming unit-granulocyte-macrophage in peripheral blood, suggested that progenitor egress from the bone marrow was defective. Mice also developed exaggerated granuloma responses to Cryotosporidium parvum infection. Tumor studies showed that SV40- transformed Cd44-deficient fibroblasts were highly tumorigenic in nude mice, whereas reintroduction of Cd44 expression into these fibroblasts resulted in a dramatic inhibition of tumor growth.

It is appreciated that the abovementioned animal model for CD44 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weber, G. F.; Ashkar, S.; Glimcher, M. J.; Cantor, H.: Receptor-ligand interaction between CD44 and osteopontin (Eta-1). Science 271:509-512, 1996; and Schmits, R.; Filmus, J.; Gerwin, N.; Senaldi, G.; Kiefer, F.; Kundig, T.; Wakeham, A.; Shahinian, A.; Catzavelos, C.; Rak, J.; Furlonger, C.; Zakarian, A.; Simard, J. J.; Ohashi, P. S.

Further studies establishing the function and utilities of CD44 are found in John Hopkins OMIM database record ID 107269, and in cited publications listed in Table 5, which are hereby incorporated by reference. Cdc14 cell division cycle 14 homolog b (s. cerevisiae) (CDC14B, Accession NM_033332.1) is another GAM129 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:2869, to the nucleotide sequence of GAM129 RNA, herein designated GAM RNA, also designated SEQ ID:213.

Another function of GAM129 is therefore inhibition of Cdc14 cell division cycle 14 homolog b (s. cerevisiae) (CDC14B, Accession NM_033332.1). Accordingly, utilities of GAM129 include diagnosis, prevention and treatment of diseases and clinical conditions associated with CDC14B.

DDM36 (Accession) is another GAM129 target gene, herein designated TARGET GENE. DDM36 BINDING SITE is a target binding site found in the 3' untranslated region of mRNA encoded by DDM36, corresponding to a target binding site such as BINDING SITE I, BINDING SITE II or BINDING SITE III of FIG. 8. Table 4 illustrates the complementarity of the nucleotide sequences of DDM36

BINDING SITE, designated SEQ ID:9225, to the nucleotide sequence of GAM129 RNA, herein designated GAM RNA, also designated SEQ ID:213.

Another function of GAM129 is therefore inhibition of DDM36 (Accession). Accordingly, utilities of GAM129 include diagnosis, prevention and treatment of diseases and clinical conditions associated with DDM36.

Dead/h (asp-glu-ala-asp/his) box polypeptide 37 (DDX37, Accession NM_032656.2) is another GAM129 target gene, herein designated TARGET GENE. DDX37 BINDING SITE is a target binding site found in the 3' untranslated region of mRNA encoded by DDX37, corresponding to a target binding site such as BINDING SITE I, BINDING SITE II or BINDING SITE III of FIG. 8. Table 4 illustrates the complementarity of the nucleotide sequences of DDX37 BINDING SITE, designated SEQ ID:8055, to the nucleotide sequence of GAM129 RNA, herein designated GAM RNA, also designated SEQ ID:213.

Another function of GAM129 is therefore inhibition of Dead/h (asp-glu-ala-asp/his) box polypeptide 37 (DDX37, Accession NM_032656.2). Accordingly, utilities of GAM129 include diagnosis, prevention and treatment of diseases and clinical conditions associated with DDX37.

DKFZP434P0111 (Accession XM_041116.4) is another GAM129 target gene, herein designated TARGET GENE. DKFZP434P0111 BINDING SITE is a target binding site found in the 3' untranslated region of mRNA encoded by DKFZP434P0111, corresponding to a target binding site such as BINDING SITE I, BINDING SITE II or BINDING SITE III of FIG. 8. Table 4 illustrates the complementarity of the nucleotide sequences of DKFZP434P0111 BINDING SITE, designated SEQ ID:1216, to the nucleotide sequence of GAM129 RNA, herein designated GAM RNA, also designated SEQ ID:213.

Another function of GAM129 is therefore inhibition of DKFZP434P0111 (Accession XM_041116.4). Accordingly, utilities of GAM129 include diagnosis, prevention and treatment of diseases and clinical conditions associated with DKFZP434P0111.

DKFZp434P0531 (Accession XM_166410.3) is another GAM129 target gene, herein designated TARGET GENE. DKFZp434P0531 BINDING SITE is a target binding site found in the 3' untranslated region of mRNA encoded by DKFZp434P0531, corresponding to a target binding site such as BINDING SITE I, BINDING SITE II or BINDING SITE III of FIG. 8. Table 4 illustrates the complementarity of the nucleotide sequences of DKFZp434P0531 BINDING SITE, designated SEQ ID:18911, to the nucleotide sequence of GAM129 RNA, herein designated GAM RNA, also designated SEQ ID:213.

Another function of GAM129 is therefore inhibition of DKFZp434P0531 (Accession XM_166410.3). Accordingly, utilities of GAM129 include diagnosis, prevention and treatment of diseases and clinical conditions associated with DKFZp434P0531.

DKFZp547O146 (Accession NM_020224.1) is another GAM129 target gene, herein designated TARGET GENE. DKFZp547O146 BINDING SITE is a target binding site found in the 5' untranslated region of mRNA encoded by DKFZp547O146, corresponding to a target binding site such as BINDING SITE I, BINDING SITE II or BINDING SITE III of FIG. 8. Table 4 illustrates the complementarity of the nucleotide sequences of DKFZp547O146 BINDING SITE, designated SEQ ID:5182, to the nucleotide sequence of GAM129 RNA, herein designated GAM RNA, also designated SEQ ID:213.

Another function of GAM129 is therefore inhibition of DKFZp547O146 (Accession NM_020224.1). Accordingly, utilities of GAM129 include diagnosis, prevention and treatment of diseases and clinical conditions associated with DKFZp547O146.

Deoxynucleotidyltransferase, terminal (DNTT, Accession NM_004088.2) is another GAM129 target gene, herein designated TARGET GENE. DNTT BINDING SITE is a target binding site found in the 3' untranslated region of mRNA encoded by DNTT, corresponding to a target binding site such as BINDING SITE I, BINDING SITE II or BINDING SITE III of FIG. 8. Table 4 illustrates the complementarity of the nucleotide sequences of DNTT BINDING SITE, designated SEQ ID:14883, to the nucleotide sequence of GAM129 RNA, herein designated GAM RNA, also designated SEQ ID:213.

Another function of GAM129 is therefore inhibition of Deoxynucleotidyltransferase, terminal (DNTT, Accession NM_004088.2), a gene which is terminal deoxynucleotidyl transferase. Accordingly, utilities of GAM129 include diagnosis, prevention and treatment of diseases and clinical conditions associated with DNTT.

The function of DNTT has been established by previous studies. Among other considerations, Epplen et al. (1987) discussed the role of terminal transferase in the generation of diversity of T-cell receptor genes. As in humans, the mouse Dntt protein, containing 509 amino acids and encoded by 12 exons, contributes to Ig and T cell receptor diversity by catalyzing the addition of nontemplated nucleotides (N addition) at the junctions of gene segments. Thai et al. (2002) showed that in mouse the long form of Dntt, termed TdTL and containing 529 amino acids, is also involved in the generation of diversity by catalyzing the deletion of nucleotides at coding joins through a 3-prime- to -5-prime exonuclease activity. Searches of private and public databases revealed that 2 long isoforms possessing conserved exonuclease core motifs of DNTT also exist in humans and cattle, suggesting that this activity may also modify joining segments in these species.

Full details of the abovementioned studies are described in the following publications, the disclosure of which are hereby incorporated by reference:

Epplen, J. T.; Chluba, J.; Hardt, C.; Hinkkanen, A.; Steimle, V.; Stockinger, H.: Mammalian T-lymphocyte antigen receptor genes: genetic and nongenetic potential to generate variability. Hum. Genet. 75:300-310, 1987; and Thai, T.-H.; Purugganan, M. M.; Roth, D. B.; Kearney, J. F.: Distinct and opposite diversifying activities of terminal transferase splice variants. Nature Immun. 3:457-462, 2002.

Further studies establishing the function and utilities of DNTT are found in John Hopkins OMIM database record ID 187410, and in cited publications listed in Table 5, which are hereby incorporated by reference. Dedicator of cyto - kinesis 1 (DOCK1, Accession NM_001380.1) is another GAM129 target gene, herein designated TARGET GENE. DOCK1 BINDING SITE is a target binding site found in the 3' untranslated region of mRNA encoded by DOCK1, corresponding to a target binding site such as BINDING SITE I, BINDING SITE II or BINDING SITE III of FIG. 8. Table 4 illustrates the complementarity of the nucleotide sequences of DOCK1 BINDING SITE, designated SEQ ID:8758, to the nucleotide sequence of GAM129 RNA, herein designated GAM RNA, also designated SEQ ID:213.

Another function of GAM129 is therefore inhibition of Dedicator of cyto - kinesis 1 (DOCK1, Accession NM_001380.1), a gene which may function in the extension of cell surfaces. Accordingly, utilities of GAM129 include diagnosis, prevention and treatment of diseases and clinical conditions associated with DOCK1.

The function of DOCK1 has been established by previous studies. The CRK protein (OMIM Ref. No. 164762), comprised mostly of SH2 and SH3 src-homology domains, has an important role in signaling from focal adhesions. Along with other adaptor proteins such as GRB2 (OMIM Ref. No. 108355) and NCK (OMIM Ref. No. 600508), it receives signals through its SH2 domains from phosphotyrosine-containing peptides and transfers them to other proteins bound to its SH3 domains. Among proteins that bind to the SH3 domain of CRK are C3G (OMIM Ref. No. 600303), a guanine nucleotide exchange protein for RAP1 (OMIM Ref. No. 600278), and the 180-kD DOCK (downstream of CRK) protein. Hasegawa et al. (1996) isolated a cDNA for DOCK by screening an expression library with CRK SH3. They found a full-length cDNA that encodes a putative 1,866-amino acid polypeptide with an SH3 domain at its amino end. Northern blots showed a 7.6-kb transcript that was expressed in most tissues and most strongly in placenta, lungs, kidney, and pancreas. Wildtype DOCK180 was found in the cytoplasm and did not affect cell morphology. However, when farnesylated, the protein became associated with the cytoplasmic membrane and made spindle 3T3 cells become flattened and polygonal. Takai et al. (1996) mapped DOCK180 to 10q26.13-q26.3 by fluorescence in situ hybridization. During programmed cell death (apoptosis), cell corpses are rapidly engulfed. This engulfment process involves the recognition and subsequent phagocytosis of cell corpses by engulfing cells. Wu and Horvitz (1998) shed light on the previously obscure mechanisms by which cell corpses are engulfed. They reported that ced-5, a gene that is required for cell-corpse engulfment in the nematode Caenorhabditis elegans, encodes a protein that is similar to the human protein DOCK180 and the Drosophila melanogaster protein Myoblast City (MBC), both of which had been implicated in the extension of cell surfaces. C. elegans ced-5 mutants were defective not only in the engulfment of cell corpses but also in the migrations of 2 specific gonadal cells, the distal tip cells. The expression of human DOCK180 in C. elegans rescued the cell-migration defect of a ced-5 mutant. Wu and Horvitz (1998) presented evidence that ced-5 functions in engulfing cells during the engulfment of cell corpses. They suggested that ced-5 acts in the extension of the surface of an engulfing cell around a dying cell during programmed cell death. They named the new family of proteins that function in the extension of cell surfaces the CDM (for CED- 5, DOCK180, and MBC) family.

Full details of the abovementioned studies are described in the following publications, the disclosure of which are hereby incorporated by reference:

Savill, J.: Phagocytic docking without shocking. Nature 442-443, 1998; and

Takai, S.; Hasegawa, H.; Kiyokawa, E.; Yamada, K.; Kurata, T.; Matsuda, M.: Chromosomal mapping of the gene encoding DOCK180, a major Crk-binding protein, to 10q26.13-q26.3 by fluoresc.

Further studies establishing the function and utilities of DOCK1 are found in John Hopkins OMIM database record ID 601403, and in cited publications listed in Table 5, which are hereby incorporated by reference. DT1P1A10 (Accession NM_058163.1) is another GAM129 target gene, herein designated TARGET GENE. DT1P1A10 BINDING SITE is a target binding site found in the 3' untranslated region of mRNA encoded by DT1P1A10, corresponding to a target binding site such as BINDING SITE I, BINDING SITE II or BINDING SITE III of FIG. 8. Table 4 illustrates the complementarity of the nucleotide sequences of DT1P1A10 BINDING SITE, designated SEQ ID:19425, to the nucleotide sequence of GAM129 RNA, herein designated GAM RNA, also designated SEQ ID:213.

Another function of GAM129 is therefore inhibition of DT1P1A10 (Accession NM_058163.1). Accordingly, utilities of GAM129 include diagnosis, prevention and treatment of diseases and clinical conditions associated with DT1P1A10.

E1B-AP5 (Accession NM_144732.1) is another GAM129 target gene, herein designated TARGET GENE. E1B-AP5 BINDING SITE is a target binding site found in the 3' untranslated region of multiple transcripts of mRNA encoded by E1B-AP5, corresponding to a target binding site such as BINDING SITE I, BINDING SITE II or BINDING SITE III of FIG. 8. Table 4 illustrates the complementarity of the nucleotide sequences of E1B-AP5 BINDING SITE, designated SEQ ID:11392, to the nucleotide sequence of GAM129 RNA, herein designated GAM RNA, also designated SEQ ID:213.

Another function of GAM129 is therefore inhibition of E1B-AP5 (Accession NM_144732.1). Accordingly, utilities of GAM129 include diagnosis, prevention and treatment of diseases and clinical conditions associated with E1B-AP5.

Fibroblast growth factor receptor 3 (achondroplasia, thanatophoric dwarfism) (FGFR3, Accession NM_000142.2) is another GAM129 target gene, herein designated TARGET GENE. FGFR3 BINDING SITE is a target binding site found in the 3' untranslated region of multiple transcripts of mRNA encoded by FGFR3, corresponding to a target binding site such as BINDING SITE I, BINDING SITE II or BINDING SITE III of FIG. 8. Table 4 illustrates the complementarity of the nucleotide sequences of FGFR3 BINDING SITE, designated SEQ ID:7492, to the nucleotide sequence of GAM129 RNA, herein designated GAM RNA, also designated SEQ ID:213.

Another function of GAM129 is therefore inhibition of Fibroblast growth factor receptor 3 (achondroplasia, thanatophoric dwarfism) (FGFR3, Accession NM_000142.2). Accordingly, utilities of GAM129 include diagnosis, prevention and treatment of diseases and clinical conditions associated with FGFR3.

FLJ10204 (Accession NM_018024.1) is another GAM129 target gene, herein designated TARGET GENE. FLJ10204 BINDING SITE is a target binding site found in the 5' untranslated region of mRNA encoded by FLJ10204, corresponding to a target binding site such as BINDING SITE I, BINDING SITE II or BINDING SITE III of FIG. 8. Table 4 illustrates the complementarity of the nucleotide sequences of FLJ10204 BINDING SITE, designated SEQ ID:18329, to the nucleotide sequence of GAM129 RNA, herein designated GAM RNA, also designated SEQ ID:213.

Another function of GAM129 is therefore inhibition of FLJ10204 (Accession NM_018024.1). Accordingly, utilities of GAM129 include diagnosis, prevention and treatment of diseases and clinical conditions associated with FLJ10204.

FLJ11362 (Accession NM_021946.1) is another GAM129 target gene, herein designated TARGET GENE. FLJ11362 BINDING SITE is a target binding site found in the 3' untranslated region of mRNA encoded by FLJ11362, corresponding to a target binding site such as BINDING SITE I, BINDING SITE II or BINDING SITE III of FIG. 8. Table 4 illustrates the complementarity of the nucleotide sequences of FLJ11362 BINDING SITE, designated SEQ ID:10040, to the nucleotide sequence of GAM129 RNA, herein designated GAM RNA, also designated SEQ ID:213.

Another function of GAM129 is therefore inhibition of FLJ11362 (Accession NM_021946.1). Accordingly, utilities of GAM129 include diagnosis, prevention and treatment of diseases and clinical conditions associated with FLJ11362.

FLJ12783 (Accession) is another GAM129 target gene, herein designated TARGET GENE. FLJ12783 BINDING SITE is a target binding site found in the 3' untranslated region of mRNA encoded by FLJ12783, corresponding to a target binding site such as BINDING SITE I, BINDING SITE II or BINDING SITE III of FIG. 8. Table 4 illustrates the complementarity of the nucleotide sequences of FLJ12783 BINDING SITE, designated SEQ ID:15286, to the nucleotide sequence of GAM129 RNA, herein designated GAM RNA, also designated SEQ ID:213.

Another function of GAM129 is therefore inhibition of FLJ12783 (Accession). Accordingly, utilities of GAM129 include diagnosis, prevention and treatment of diseases and clinical conditions associated with FLJ12783.

FLJ14249 (Accession NM_106552.1) is another GAM129 target gene, herein designated TARGET GENE. FLJ14249 BINDING SITE is a target binding site found in the 3' untranslated region of multiple transcripts of mRNA encoded by FLJ14249, corresponding to a target binding site such as BINDING SITE I, BINDING SITE II or BINDING SITE III of FIG. 8. Table 4 illustrates the complementarity of the nucleotide sequences of FLJ14249 BINDING SITE, designated SEQ ID:7701, to the nucleotide sequence of GAM129 RNA, herein designated GAM RNA, also designated SEQ ID:213.

Another function of GAM129 is therefore inhibition of FLJ14249 (Accession NM_106552.1). Accordingly, utilities of GAM129 include diagnosis, prevention and treatment of diseases and clinical conditions associated with FLJ14249.

FLJ14594 (Accession NM_032808.1) is another GAM129 target gene, herein designated TARGET GENE. FLJ14594 BINDING SITE1 and FLJ14594 BINDING SITE2 are target binding sites found in untranslated regions of mRNA encoded by FLJ14594, corresponding to target binding sites such as BINDING SITE I, BINDING SITE II or BINDING SITE III of FIG. 8. Table 4 illustrates the complementarity of the nucleotide sequences of FLJ14594 BINDING SITE1 and FLJ14594 BINDING SITE2, designated SEQ ID:13720 and SEQ ID:10977 respectively, to the nucleotide sequence of GAM129 RNA, herein designated GAM RNA, also designated SEQ ID:213.

Another function of GAM129 is therefore inhibition of FLJ14594 (Accession NM_032808.1). Accordingly, utilities of GAM129 include diagnosis, prevention and treatment of diseases and clinical conditions associated with FLJ14594.

FLJ21135 (Accession NM_024866.1) is another GAM129 target gene, herein designated TARGET GENE. FLJ21135 BINDING SITE is a target binding site found in the 5' untranslated region of mRNA encoded by FLJ21135, corresponding to a target binding site such as BINDING SITE I, BINDING SITE II or BINDING SITE III of FIG. 8. Table 4 illustrates the complementarity of the nucleotide sequences of FLJ21135 BINDING SITE, designated SEQ ID:7521, to the nucleotide sequence of GAM129 RNA, herein designated GAM RNA, also designated SEQ ID:213.

Another function of GAM129 is therefore inhibition of FLJ21135 (Accession NM_024866.1). Accordingly, utilities of GAM129 include diagnosis, prevention and treatment of diseases and clinical conditions associated with FLJ21135.

FLJ22474 (Accession) is another GAM129 target gene, herein designated TARGET GENE. FLJ22474 BINDING SITE is a target binding site found in the 3' untranslated region of mRNA encoded by FLJ22474, corresponding to a target binding site such as BINDING SITE I, BINDING SITE II or BINDING SITE III of FIG. 8. Table 4 illustrates the complementarity of the nucleotide sequences of FLJ22474 BINDING SITE, designated SEQ ID:20015, to the nucleotide sequence of GAM129 RNA, herein designated GAM RNA, also designated SEQ ID:213.

Another function of GAM129 is therefore inhibition of FLJ22474 (Accession). Accordingly, utilities of GAM129 include diagnosis, prevention and treatment of diseases and clinical conditions associated with FLJ22474.

FLJ22814 (Accession NM_024916.1) is another GAM129 target gene, herein designated TARGET GENE. FLJ22814 BINDING SITE is a target binding site found in the 3' untranslated region of mRNA encoded by FLJ22814, corresponding to a target binding site such as BINDING SITE I, BINDING SITE II or BINDING SITE III of FIG. 8. Table 4 illustrates the complementarity of the nucleotide sequences of FLJ22814 BINDING SITE, designated SEQ ID:9345, to the nucleotide sequence of GAM129 RNA, herein designated GAM RNA, also designated SEQ ID:213.

Another function of GAM129 is therefore inhibition of FLJ22814 (Accession NM_024916.1). Accordingly, utilities of GAM129 include diagnosis, prevention and treatment of diseases and clinical conditions associated with FLJ22814.

FLJ30213 (Accession NM_145008.1) is another GAM129 target gene, herein designated TARGET GENE. FLJ30213 BINDING SITE is a target binding site found in the 5' untranslated region of mRNA encoded by FLJ30213, corresponding to a target binding site such as BINDING SITE I, BINDING SITE II or BINDING SITE III of FIG. 8. Table 4 illustrates the complementarity of the nucleotide sequences of FLJ30213 BINDING SITE, designated SEQ ID:17139, to the nucleotide sequence of GAM129 RNA, herein designated GAM RNA, also designated SEQ ID:213.

Another function of GAM129 is therefore inhibition of FLJ30213 (Accession NM_145008.1). Accordingly, utilities of GAM129 include diagnosis, prevention and treatment of diseases and clinical conditions associated with FLJ30213.

FLJ32818 (Accession NM_144685.1) is another GAM129 target gene, herein designated TARGET GENE. FLJ32818 BINDING SITE is a target binding site found in the 5' untranslated region of mRNA encoded by FLJ32818, corresponding to a target binding site such as BINDING SITE I, BINDING SITE II or BINDING SITE III of FIG. 8. Table 4 illustrates the complementarity of the nucleotide sequences of FLJ32818 BINDING SITE, designated SEQ ID:16718, to the nucleotide sequence of GAM129 RNA, herein designated GAM RNA, also designated SEQ ID:213.

Another function of GAM129 is therefore inhibition of FLJ32818 (Accession NM_144685.1). Accordingly, utilities of GAM129 include diagnosis, prevention and treatment of diseases and clinical conditions associated with FLJ32818.

FUS1 (Accession NM_007275.1) is another GAM129 target gene, herein designated TARGET GENE. FUS1 BINDING SITE is a target binding site found in the 3' untranslated region of mRNA encoded by FUS1, corresponding to a target binding site such as BINDING SITE I, BINDING SITE II or BINDING SITE III of FIG. 8. Table 4 illustrates the complementarity of the nucleotide sequences of FUS1 BINDING SITE, designated SEQ ID:12680, to the nucleotide sequence of GAM129 RNA, herein designated GAM RNA, also designated SEQ ID:213.

Another function of GAM129 is therefore inhibition of FUS1 (Accession NM_007275.1), a gene which may function as a tumor suppressor. and therefore may be associated with Lung cancer. Accordingly, utilities of GAM129 include diagnosis, prevention and treatment of Lung cancer, and of other diseases and clinical conditions associated with FUS1.

The function of FUS1 has been established by previous studies. Lerman and Minna (2000) identified a FUS1 mutation in 2 nonsmall cell lung cancer (NSCLC) cell lines that resulted in a 28-bp truncation at the 3- prime end of exon 2 and a predicted protein of only 82 amino acids. Using SSCP and CpG island promoter methylation analyses, Kondo et al. (2001) failed to detect mutations, polymorphisms, or methylation of FUS1 in lung cancer specimens. Western blot analysis indicated low or no expression of FUS1 in lung cancer cell lines. Overexpression of transfected wildtype but not mutant FUS1 in NSCLCs led to the detection of an approximately 20-kD protein and a dramatic reduction in colony-forming cells. Ecdysone-induced expression of FUS1 had the same effects. Flow cytometric analysis indicated that the arrest occurred in G1 phase.

Full details of the abovementioned studies are described in the following publications, the disclosure of which are hereby incorporated by reference:

Kondo, M.; Ji, L.; Kamibayashi, C.; Tomizawa, Y.; Randle, D.; Sekido, Y.; Yokota, J.; Kashuba, V.; Zabarovsky, E.; Kuzmin, I.; Lerman, M.; Roth, J.; Minna, J. D.: Overexpression of candidate tumor suppressor gene FUS1 isolated from the 3p21.3 homozygous deletion region leads to G1 arrest and growth inhibition of lung cancer cells. Oncogene 20:6258-6262, 2001; and Lerman, M. I.; Minna, J. D.: The 630-kb lung cancer homozygous deletion region on human chromosome 3p21.3: identification and evaluation of the resident candidate tumor suppressor gen.

Further studies establishing the function and utilities of FUS1 are found in John Hopkins OMIM database record ID 607052, and in cited publications listed in Table 5, which are hereby incorporated by reference. Grb2-associated binding protein 2 (GAB2, Accession NM_080491.1) is another GAM129 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:9984, to the nucleotide sequence of GAM129 RNA, herein designated GAM RNA, also designated SEQ ID:213.

Another function of GAM129 is therefore inhibition of Grb2-associated binding protein 2 (GAB2, Accession NM_080491.1), a gene which act as adapters for transmitting various signals. Accordingly, utilities of GAM129 include diagnosis, prevention and treatment of diseases and clinical conditions associated with GAB2.

The function of GAB2 and its association with various diseases and clinical conditions, has been established by previous studies, as described hereinabove with reference to GAM63.1. Grb2-associated binding protein 3 (GAB3, Accession NM_080612.1) is another GAM129 target gene, herein designated TARGET GENE. GAB3 BINDING SITE is a target binding site found in the 3' untranslated region of mRNA encoded by GAB3, corresponding to a target binding site such as BINDING SITE I, BINDING SITE II or BINDING SITE III of FIG. 8. Table 4 illustrates the complementarity of the nucleotide sequences of GAB3 BINDING SITE, designated SEQ ID:18513, to the nucleotide sequence of GAM129 RNA, herein designated GAM RNA, also designated SEQ ID:213.

Another function of GAM129 is therefore inhibition of Grb2-associated binding protein 3 (GAB3, Accession NM_080612.1). Accordingly, utilities of GAM129 include diagnosis, prevention and treatment of diseases and clinical conditions associated with GAB3.

Glucocorticoid receptor dna binding factor 1 (GRLF1, Accession NM_024342.1) is another GAM129 target gene, herein designated TARGET GENE. GRLF1 BINDING SITE is a target binding site found in the 3' untranslated region of multiple transcripts of mRNA encoded by GRLF1, corresponding to a target binding site such as BINDING SITE I, BINDING SITE II or BINDING SITE III of FIG. 8. Table 4 illustrates the complementarity of the nucleotide sequences of GRLF1 BINDING SITE, designated SEQ ID:5059, to the nucleotide sequence of GAM129 RNA, herein designated GAM RNA, also designated SEQ ID:213.

Another function of GAM129 is therefore inhibition of Glucocorticoid receptor dna binding factor 1 (GRLF1, Accession NM_024342.1), a gene which inhibits transcription of the glucocorticoid receptor gene. Accordingly, utilities of GAM129 include diagnosis, prevention and treatment of diseases and clinical conditions associated with GRLF1.

The function of GRLF1 and its association with various diseases and clinical conditions, has been established by previous studies, as described hereinabove with reference to GAM68.1. Integrin, alpha m (complement component receptor 3, alpha; also known as cd11b (p170), macrophage antigen alpha polypeptide) (ITGAM, Accession NM_000632.2) is another GAM129 target gene, herein designated TARGET GENE. ITGAM BINDING SITE is a target binding site found in the 5' untranslated region of mRNA encoded by ITGAM, corresponding to a target binding site such as BINDING SITE I, BINDING SITE II or BINDING SITE III of FIG. 8. Table 4 illustrates the complementarity of the nucleotide sequences of ITGAM BINDING SITE, designated SEQ ID:578, to the nucleotide sequence of GAM129 RNA, herein designated GAM RNA, also designated SEQ ID:213.

Another function of GAM129 is therefore inhibition of Integrin, alpha m (complement component receptor 3, alpha; also known as cd11b (p170), macrophage antigen alpha polypeptide) (ITGAM, Accession NM_000632.2), a gene which is invovled in various adhesive interactions of monocytes, macrophages and granulocytes as well as in mediating the uptake of complement-coated particles. Accordingly, utilities of GAM129 include diagnosis, prevention and treatment of diseases and clinical conditions associated with ITGAM.

The function of ITGAM and its association with various diseases and clinical conditions, has been established by previous studies, as described hereinabove with reference to GAM51.1. Potassium channel, subfamily k, member 5 (KCNK5, Accession NM_003740.2) is another GAM129 target gene, herein designated TARGET GENE. KCNK5 BINDING SITE is a target binding site found in the 5' untranslated region of mRNA encoded by KCNK5, corresponding to a target binding site such as BINDING SITE I, BINDING SITE II or BINDING SITE III of FIG. 8. Table 4 illustrates the complementarity of the nucleotide sequences of KCNK5 BINDING SITE, designated SEQ ID:14609, to the nucleotide sequence of GAM129 RNA, herein designated GAM RNA, also designated SEQ ID:213.

Another function of GAM129 is therefore inhibition of Potassium channel, subfamily k, member 5 (KCNK5, Accession NM_003740.2). Accordingly, utilities of GAM129 include diagnosis, prevention and treatment of diseases and clinical conditions associated with KCNK5.

KIAA0014 (Accession NM_014665.1) is another GAM129 target gene, herein designated TARGET GENE. KIAA0014 BINDING SITE is a target binding site found in the 3' untranslated region of mRNA encoded by KIAA0014, corresponding to a target binding site such as BINDING SITE I, BINDING SITE II or BINDING SITE III of FIG. 8. Table 4 illustrates the complementarity of the nucleotide sequences of KIAA0014 BINDING SITE, designated SEQ ID:10733, to the nucleotide sequence of GAM129 RNA, herein designated GAM RNA, also designated SEQ ID:213.

Another function of GAM129 is therefore inhibition of KIAA0014 (Accession NM_014665.1). Accordingly, utilities of GAM129 include diagnosis, prevention and treatment of diseases and clinical conditions associated with KIAA0014.

KIAA0544 (Accession) is another GAM129 target gene, herein designated TARGET GENE. KIAA0544 BINDING SITE is a target binding site found in the 3' untranslated region of mRNA encoded by KIAA0544, corresponding to a target binding site such as BINDING SITE I, BINDING SITE II or BINDING SITE III of FIG. 8. Table 4 illustrates the complementarity of the nucleotide sequences of KIAA0544 BINDING SITE, designated SEQ ID:20182, to the nucleotide sequence of GAM129 RNA, herein designated GAM RNA, also designated SEQ ID:213.

Another function of GAM129 is therefore inhibition of KIAA0544 (Accession). Accordingly, utilities of GAM129 include diagnosis, prevention and treatment of diseases and clinical conditions associated with KIAA0544.

KIAA0682 (Accession NM_014852.1) is another GAM129 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:5701, to the nucleotide sequence of GAM129 RNA, herein designated GAM RNA, also designated SEQ ID:213.

Another function of GAM129 is therefore inhibition of KIAA0682 (Accession NM_014852.1). Accordingly, utilities of GAM129 include diagnosis, prevention and treatment of diseases and clinical conditions associated with KIAA0682.

KIAA1086 (Accession XM_047610.1) is another GAM129 target gene, herein designated TARGET GENE. KIAA1086 BINDING SITE is a target binding site found in the 3' untranslated region of mRNA encoded by KIAA1086, corresponding to a target binding site such as BINDING SITE I, BINDING SITE II or BINDING SITE III of FIG. 8. Table 4 illustrates the complementarity of the nucleotide sequences of KIAA1086 BINDING SITE, designated SEQ ID:4946, to the nucleotide sequence of GAM129 RNA, herein designated GAM RNA, also designated SEQ ID:213.

Another function of GAM129 is therefore inhibition of KIAA1086 (Accession XM_047610.1). Accordingly, utilities of GAM129 include diagnosis, prevention and treatment of diseases and clinical conditions associated with KIAA1086.

KIAA1509 (Accession XM_029353.1) is another GAM129 target gene, herein designated TARGET GENE. KIAA1509 BINDING SITE is a target binding site found in the 3' untranslated region of mRNA encoded by KIAA1509, corresponding to a target binding site such as BINDING SITE I, BINDING SITE II or BINDING SITE III of FIG. 8. Table 4 illustrates the complementarity of the nucleotide sequences of KIAA1509 BINDING SITE, designated SEQ ID:16666, to the nucleotide sequence of GAM129 RNA, herein designated GAM RNA, also designated SEQ ID:213.

Another function of GAM129 is therefore inhibition of KIAA1509 (Accession XM_029353.1). Accordingly, utilities of GAM129 include diagnosis, prevention and treatment of diseases and clinical conditions associated with KIAA1509.

Leucine-rich repeat lgi family, member 3 (LGI3, Accession NM_139278.1) is another GAM129 target gene, herein designated TARGET GENE. LGI3 BINDING SITE is a target binding site found in the 5' untranslated region of mRNA encoded by LGI3, corresponding to a target binding site such as BINDING SITE I, BINDING SITE II or BINDING SITE III of FIG. 8. Table 4 illustrates the complementarity of the nucleotide sequences of LGI3 BINDING SITE, designated SEQ ID:1973, to the nucleotide sequence of GAM129 RNA, herein designated GAM RNA, also designated SEQ ID:213.

Another function of GAM129 is therefore inhibition of Leucine-rich repeat lgi family, member 3 (LGI3, Accession NM_139278.1). Accordingly, utilities of GAM129 include diagnosis, prevention and treatment of diseases and clinical conditions associated with LGI3.

Lim homeobox protein 1 (LHX1, Accession NM_005568.1) is another GAM129 target gene, herein designated TARGET GENE. LHX1 BINDING SITE is a target binding site found in the 5' untranslated region of mRNA encoded by LHX1, corresponding to a target binding site such as BINDING SITE I, BINDING SITE II or BINDING SITE III of FIG. 8. Table 4 illustrates the complementarity of the nucleotide sequences of LHX1 BINDING SITE, designated SEQ ID:20027, to the nucleotide sequence of GAM129 RNA, herein designated GAM RNA, also designated SEQ ID:213.

Another function of GAM129 is therefore inhibition of Lim homeobox protein 1 (LHX1, Accession NM_005568.1). Accordingly, utilities of GAM129 include diagnosis, prevention and treatment of diseases and clinical conditions associated with LHX1.

LOC123591 (Accession) is another GAM129 target gene, herein designated TARGET GENE. LOC123591 BINDING SITE is a target binding site found in the 3' untranslated region of mRNA encoded by LOC123591, corresponding to a target binding site such as BINDING SITE I, BINDING SITE II or BINDING SITE III of FIG. 8. Table 4 illustrates the complementarity of the nucleotide sequences of LOC123591 BINDING SITE, designated SEQ ID:3821, to the nucleotide sequence of GAM129 RNA, herein designated GAM RNA, also designated SEQ ID:213.

Another function of GAM129 is therefore inhibition of LOC123591 (Accession). Accordingly, utilities of GAM129 include diagnosis, prevention and treatment of diseases and clinical conditions associated with LOC123591.

LOC133383 (Accession) is another GAM129 target gene, herein designated TARGET GENE. LOC133383 BINDING SITE is a target binding site found in the 5' untranslated region of mRNA encoded by LOC133383, corresponding to a target binding site such as BINDING SITE I, BINDING SITE II or BINDING SITE III of FIG. 8. Table 4 illustrates the complementarity of the nucleotide sequences of LOC133383 BINDING SITE, designated SEQ ID:19811, to the nucleotide sequence of GAM129 RNA, herein designated GAM RNA, also designated SEQ ID:213.

Another function of GAM129 is therefore inhibition of LOC133383 (Accession). Accordingly, utilities of GAM129 include diagnosis, prevention and treatment of diseases and clinical conditions associated with LOC133383.

LOC135763 (Accession NM_138572.1) is another GAM129 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:19358, to the nucleotide sequence of GAM129 RNA, herein designated GAM RNA, also designated SEQ ID:213.

Another function of GAM129 is therefore inhibition of LOC135763 (Accession NM_138572.1). Accordingly, utilities of GAM129 include diagnosis, prevention and treatment of diseases and clinical conditions associated with LOC135763.

LOC139522 (Accession) is another GAM129 target gene, herein designated TARGET GENE. LOC139522 BINDING SITE is a target binding site found in the 5' untranslated region of mRNA encoded by LOC139522, corresponding to a target binding site such as BINDING SITE I, BINDING SITE II or BINDING SITE III of FIG. 8. Table 4 illustrates the complementarity of the nucleotide sequences of LOC139522 BINDING SITE, designated SEQ ID:11437, to the nucleotide sequence of GAM129 RNA, herein designated GAM RNA, also designated SEQ ID:213.

Another function of GAM129 is therefore inhibition of LOC139522 (Accession). Accordingly, utilities of GAM129 include diagnosis, prevention and treatment of diseases and clinical conditions associated with LOC139522.

LOC143286 (Accession XM_096412.1) is another GAM129 target gene, herein designated TARGET GENE. LOC143286 BINDING SITE is a target binding site found in the 5' untranslated region of mRNA encoded by LOC143286, corresponding to a target binding site such as BINDING SITE I, BINDING SITE II or BINDING SITE III of FIG. 8. Table 4 illustrates the complementarity of the nucleotide sequences of LOC143286 BINDING SITE, designated SEQ ID:6932, to the nucleotide sequence of GAM129 RNA, herein designated GAM RNA, also designated SEQ ID:213.

Another function of GAM129 is therefore inhibition of LOC143286 (Accession XM_096412.1). Accordingly, utilities of GAM129 include diagnosis, prevention and treatment of diseases and clinical conditions associated with LOC143286.

LOC144308 (Accession) is another GAM129 target gene, herein designated TARGET GENE. LOC144308 BINDING SITE is a target binding site found in the 3' untranslated region of mRNA encoded by LOC144308, corresponding to a target binding site such as BINDING SITE I, BINDING SITE II or BINDING SITE III of FIG. 8. Table 4 illustrates the complementarity of the nucleotide sequences of LOC144308 BINDING SITE, designated SEQ ID:916, to the nucleotide sequence of GAM129 RNA, herein designated GAM RNA, also designated SEQ ID:213.

Another function of GAM129 is therefore inhibition of LOC144308 (Accession). Accordingly, utilities of GAM129 include diagnosis, prevention and treatment of diseases and clinical conditions associated with LOC144308.

LOC145622 (Accession) is another GAM129 target gene, herein designated TARGET GENE. LOC145622 BINDING SITE is a target binding site found in the 5' untranslated region of mRNA encoded by LOC145622, corresponding to a target binding site such as BINDING SITE I, BINDING SITE II or BINDING SITE III of FIG. 8. Table 4 illustrates the complementarity of the nucleotide sequences of LOC145622 BINDING SITE, designated SEQ ID:12662, to the nucleotide sequence of GAM129 RNA, herein designated GAM RNA, also designated SEQ ID:213.

Another function of GAM129 is therefore inhibition of LOC145622 (Accession). Accordingly, utilities of GAM129 include diagnosis, prevention and treatment of diseases and clinical conditions associated with LOC145622.

LOC146272 (Accession XM_085396.1) is another GAM129 target gene, herein designated TARGET GENE. LOC146272 BINDING SITE is a target binding site found in the 5' untranslated region of mRNA encoded by LOC146272, corresponding to a target binding site such as BINDING SITE I, BINDING SITE II or BINDING SITE III of FIG. 8. Table 4 illustrates the complementarity of the nucleotide sequences of LOC146272 BINDING SITE, designated SEQ ID:2022, to the nucleotide sequence of GAM129 RNA, herein designated GAM RNA, also designated SEQ ID:213.

Another function of GAM129 is therefore inhibition of LOC146272 (Accession XM_085396.1). Accordingly, utilities of GAM129 include diagnosis, prevention and treatment of diseases and clinical conditions associated with LOC146272.

LOC146861 (Accession) is another GAM129 target gene, herein designated TARGET GENE. LOC146861 BINDING SITE is a target binding site found in the 5' untranslated region of mRNA encoded by LOC146861, corresponding to a target binding site such as BINDING SITE I, BINDING SITE II or BINDING SITE III of FIG. 8. Table 4 illustrates the complementarity of the nucleotide sequences of LOC146861 BINDING SITE, designated SEQ ID:4445, to the nucleotide sequence of GAM129 RNA, herein designated GAM RNA, also designated SEQ ID:213.

Another function of GAM129 is therefore inhibition of LOC146861 (Accession). Accordingly, utilities of GAM129 include diagnosis, prevention and treatment of diseases and clinical conditions associated with LOC146861.

LOC147118 (Accession) is another GAM129 target gene, herein designated TARGET GENE. LOC147118 BINDING SITE is a target binding site found in the 3' untranslated region of mRNA encoded by LOC147118, corresponding to a target binding site such as BINDING SITE I, BINDING SITE II or BINDING SITE III of FIG. 8. Table 4 illustrates the complementarity of the nucleotide sequences of LOC147118 BINDING SITE, designated SEQ ID:16773, to the nucleotide sequence of GAM129 RNA, herein designated GAM RNA, also designated SEQ ID:213.

Another function of GAM129 is therefore inhibition of LOC147118 (Accession). Accordingly, utilities of GAM129 include diagnosis, prevention and treatment of diseases and clinical conditions associated with LOC147118.

LOC147276 (Accession) is another GAM129 target gene, herein designated TARGET GENE. LOC147276 BINDING SITE is a target binding site found in the 3' untranslated region of mRNA encoded by LOC147276, corresponding to a target binding site such as BINDING SITE I, BINDING SITE II or BINDING SITE III of FIG. 8. Table 4 illustrates the complementarity of the nucleotide sequences of LOC147276 BINDING SITE, designated SEQ ID:14610, to the nucleotide sequence of GAM129 RNA, herein designated GAM RNA, also designated SEQ ID:213.

Another function of GAM129 is therefore inhibition of LOC147276 (Accession). Accordingly, utilities of GAM129 include diagnosis, prevention and treatment of diseases and clinical conditions associated with LOC147276.

LOC148089 (Accession) is another GAM129 target gene, herein designated TARGET GENE. LOC148089 BINDING SITE is a target binding site found in the 3' untranslated region of mRNA encoded by LOC148089, corresponding to a target binding site such as BINDING SITE I, BINDING SITE II or BINDING SITE III of FIG. 8. Table 4 illustrates the complementarity of the nucleotide sequences of LOC148089 BINDING SITE, designated SEQ ID:11808, to the nucleotide sequence of GAM129 RNA, herein designated GAM RNA, also designated SEQ ID:213.

Another function of GAM129 is therefore inhibition of LOC148089 (Accession). Accordingly, utilities of GAM129 include diagnosis, prevention and treatment of diseases and clinical conditions associated with LOC148089.

LOC150174 (Accession XM_086802.3) is another GAM129 target gene, herein designated TARGET GENE. LOC150174 BINDING SITE is a target binding site found in the 5' untranslated region of mRNA encoded by LOC150174, corresponding to a target binding site such as BINDING SITE I, BINDING SITE II or BINDING SITE III of FIG. 8. Table 4 illustrates the complementarity of the nucleotide sequences of LOC150174 BINDING SITE, designated SEQ ID:14548, to the nucleotide sequence of GAM129 RNA, herein designated GAM RNA, also designated SEQ ID:213.

Another function of GAM129 is therefore inhibition of LOC150174 (Accession XM_086802.3). Accordingly, utilities of GAM129 include diagnosis, prevention and treatment of diseases and clinical conditions associated with LOC150174.

LOC150213 (Accession XM_059324.2) is another GAM129 target gene, herein designated TARGET GENE. LOC150213 BINDING SITE is a target binding site found in the 5' untranslated region of mRNA encoded by LOC150213, corresponding to a target binding site such as BINDING SITE I, BINDING SITE II or BINDING SITE III of FIG. 8. Table 4 illustrates the complementarity of the nucleotide sequences of LOC150213 BINDING SITE, designated SEQ ID:16131, to the nucleotide sequence of GAM129 RNA, herein designated GAM RNA, also designated SEQ ID:213.

Another function of GAM129 is therefore inhibition of LOC150213 (Accession XM_059324.2). Accordingly, utilities of GAM129 include diagnosis, prevention and treatment of diseases and clinical conditions associated with LOC150213.

LOC150343 (Accession XM_086823.1) is another GAM129 target gene, herein designated TARGET GENE. LOC150343 BINDING SITE is a target binding site found in the 5' untranslated region of mRNA encoded by LOC150343, corresponding to a target binding site such as BINDING SITE I, BINDING SITE II or BINDING SITE III of FIG. 8. Table 4 illustrates the complementarity of the nucleotide sequences of LOC150343 BINDING SITE, designated SEQ ID:5518, to the nucleotide sequence of GAM129 RNA, herein designated GAM RNA, also designated SEQ ID:213.

Another function of GAM129 is therefore inhibition of LOC150343 (Accession XM_086823.1). Accordingly, utilities of GAM129 include diagnosis, prevention and treatment of diseases and clinical conditions associated with LOC150343.

LOC157531 (Accession XM_098772.1) is another GAM129 target gene, herein designated TARGET GENE. LOC157531 BINDING SITE is a target binding site found in the 5' untranslated region of multiple transcripts of mRNA encoded by LOC157531, corresponding to a target binding site such as BINDING SITE I, BINDING SITE II or BINDING SITE III of FIG. 8. Table 4 illustrates the complementarity of the nucleotide sequences of LOC157531 BINDING SITE, designated SEQ ID:2356, to the nucleotide sequence of GAM129 RNA, herein designated GAM RNA, also designated SEQ ID:213.

Another function of GAM129 is therefore inhibition of LOC157531 (Accession XM_098772.1). Accordingly, utilities of GAM129 include diagnosis, prevention and treatment of diseases and clinical conditions associated with LOC157531.

LOC161734 (Accession) is another GAM129 target gene, herein designated TARGET GENE. LOC161734 BINDING SITE is a target binding site found in the 5' untranslated region of mRNA encoded by LOC161734, corresponding to a target binding site such as BINDING SITE I, BINDING SITE II or BINDING SITE III of FIG. 8. Table 4 illustrates the complementarity of the nucleotide sequences of LOC161734 BINDING SITE, designated SEQ ID:8474, to the nucleotide sequence of GAM129 RNA, herein designated GAM RNA, also designated SEQ ID:213.

Another function of GAM129 is therefore inhibition of LOC161734 (Accession). Accordingly, utilities of GAM129 include diagnosis, prevention and treatment of diseases and clinical conditions associated with LOC161734.

LOC165741 (Accession) is another GAM129 target gene, herein designated TARGET GENE. LOC165741 BINDING SITE is a target binding site found in the 5' untranslated region of mRNA encoded by LOC165741, corresponding to a target binding site such as BINDING SITE I, BINDING SITE II or BINDING SITE III of FIG. 8. Table 4 illustrates the complementarity of the nucleotide sequences of LOC165741 BINDING SITE, designated SEQ ID:11611, to the nucleotide sequence of GAM129 RNA, herein designated GAM RNA, also designated SEQ ID:213.

Another function of GAM129 is therefore inhibition of LOC165741 (Accession). Accordingly, utilities of GAM129 include diagnosis, prevention and treatment of diseases and clinical conditions associated with LOC165741.

LOC205418 (Accession) is another GAM129 target gene, herein designated TARGET GENE. LOC205418 BINDING SITE is a target binding site found in the 5' untranslated region of mRNA encoded by LOC205418, corresponding to a target binding site such as BINDING SITE I, BINDING SITE II or BINDING SITE III of FIG. 8. Table 4 illustrates the complementarity of the nucleotide sequences of LOC205418 BINDING SITE, designated SEQ ID:9598, to the nucleotide sequence of GAM129 RNA, herein designated GAM RNA, also designated SEQ ID:213.

Another function of GAM129 is therefore inhibition of LOC205418 (Accession). Accordingly, utilities of GAM129 include diagnosis, prevention and treatment of diseases and clinical conditions associated with LOC205418.

LOC220739 (Accession XM_167548.3) is another GAM129 target gene, herein designated TARGET GENE. LOC220739 BINDING SITE is a target binding site found in the 3' untranslated region of mRNA encoded by LOC220739, corresponding to a target binding site such as BINDING SITE I, BINDING SITE II or BINDING SITE III of FIG. 8. Table 4 illustrates the complementarity of the nucleotide sequences of LOC220739 BINDING SITE, designated SEQ ID:1430, to the nucleotide sequence of GAM129 RNA, herein designated GAM RNA, also designated SEQ ID:213.

Another function of GAM129 is therefore inhibition of LOC220739 (Accession XM_167548.3). Accordingly, utilities of GAM129 include diagnosis, prevention and treatment of diseases and clinical conditions associated with LOC220739.

LOC221092 (Accession) is another GAM129 target gene, herein designated TARGET GENE. LOC221092 BINDING SITE is a target binding site found in the 5' untranslated region of mRNA encoded by LOC221092, corresponding to a target binding site such as BINDING SITE I, BINDING SITE II or BINDING SITE III of FIG. 8. Table 4 illustrates the complementarity of the nucleotide sequences of LOC221092 BINDING SITE, designated SEQ ID:6809, to the nucleotide sequence of GAM129 RNA, herein designated GAM RNA, also designated SEQ ID:213.

Another function of GAM129 is therefore inhibition of LOC221092 (Accession). Accordingly, utilities of GAM129 include diagnosis, prevention and treatment of diseases and clinical conditions associated with LOC221092.

LOC222057 (Accession XM_166594.4) is another GAM129 target gene, herein designated TARGET GENE. LOC222057 BINDING SITE is a target binding site found in the 3' untranslated region of mRNA encoded by LOC222057, corresponding to a target binding site such as BINDING SITE I, BINDING SITE II or BINDING SITE III of FIG. 8. Table 4 illustrates the complementarity of the nucleotide sequences of LOC222057 BINDING SITE, designated SEQ ID:14251, to the nucleotide sequence of GAM129 RNA, herein designated GAM RNA, also designated SEQ ID:213.

Another function of GAM129 is therefore inhibition of LOC222057 (Accession XM_166594.4). Accordingly, utilities of GAM129 include diagnosis, prevention and treatment of diseases and clinical conditions associated with LOC222057.

LOC222161 (Accession) is another GAM129 target gene, herein designated TARGET GENE. LOC222161 BINDING SITE is a target binding site found in the 5' untranslated region of mRNA encoded by LOC222161, corresponding to a target binding site such as BINDING SITE I, BINDING SITE II or BINDING SITE III of FIG. 8. Table 4 illustrates the complementarity of the nucleotide sequences of LOC222161 BINDING SITE, designated SEQ ID:10506, to the nucleotide sequence of GAM129 RNA, herein designated GAM RNA, also designated SEQ ID:213.

Another function of GAM129 is therefore inhibition of LOC222161 (Accession). Accordingly, utilities of GAM129 include diagnosis, prevention and treatment of diseases and clinical conditions associated with LOC222161.

LOC254263 (Accession XM_170654.3) is another GAM129 target gene, herein designated TARGET GENE. LOC254263 BINDING SITE is a target binding site found in the 3' untranslated region of mRNA encoded by LOC254263, corresponding to a target binding site such as BINDING SITE I, BINDING SITE II or BINDING SITE III of FIG. 8. Table 4 illustrates the complementarity of the nucleotide sequences of LOC254263 BINDING SITE, designated SEQ ID:12271, to the nucleotide sequence of GAM129 RNA, herein designated GAM RNA, also designated SEQ ID:213.

Another function of GAM129 is therefore inhibition of LOC254263 (Accession XM_170654.3). Accordingly, utilities of GAM129 include diagnosis, prevention and treatment of diseases and clinical conditions associated with LOC254263.

LOC254753 (Accession) is another GAM129 target gene, herein designated TARGET GENE. LOC254753 BINDING SITE is a target binding site found in the 3' untranslated region of mRNA encoded by LOC254753, corresponding to a target binding site such as BINDING SITE I, BINDING SITE II or BINDING SITE III of FIG. 8. Table 4 illustrates the complementarity of the nucleotide sequences of LOC254753 BINDING SITE, designated SEQ ID:13709, to the nucleotide sequence of GAM129 RNA, herein designated GAM RNA, also designated SEQ ID:213.

Another function of GAM129 is therefore inhibition of LOC254753 (Accession). Accordingly, utilities of GAM129 include diagnosis, prevention and treatment of diseases and clinical conditions associated with LOC254753.

LOC254944 (Accession XM_173170.1) is another GAM129 target gene, herein designated TARGET GENE. LOC254944 BINDING SITE is a target binding site found in the 3' untranslated region of mRNA encoded by LOC254944, corresponding to a target binding site such as BINDING SITE I, BINDING SITE II or BINDING SITE III of FIG. 8. Table 4 illustrates the complementarity of the nucleotide sequences of LOC254944 BINDING SITE, designated SEQ ID:16435, to the nucleotide sequence of GAM129 RNA, herein designated GAM RNA, also designated SEQ ID:213.

Another function of GAM129 is therefore inhibition of LOC254944 (Accession XM_173170.1). Accordingly, utilities of GAM129 include diagnosis, prevention and treatment of diseases and clinical conditions associated with LOC254944.

LOC51285 (Accession) is another GAM129 target gene, herein designated TARGET GENE. LOC51285 BINDING SITE is a target binding site found in the 5' untranslated region of mRNA encoded by LOC51285, corresponding to a target binding site such as BINDING SITE I, BINDING SITE II or BINDING SITE III of FIG. 8. Table 4 illustrates the complementarity of the nucleotide sequences of LOC51285 BINDING SITE, designated SEQ ID:3543, to the nucleotide sequence of GAM129 RNA, herein designated GAM RNA, also designated SEQ ID:213.

Another function of GAM129 is therefore inhibition of LOC51285 (Accession). Accordingly, utilities of GAM129 include diagnosis, prevention and treatment of diseases and clinical conditions associated with LOC51285.

LOC51667 (Accession) is another GAM129 target gene, herein designated TARGET GENE. LOC51667 BINDING SITE is a target binding site found in the 3' untranslated region of mRNA encoded by LOC51667, corresponding to a target binding site such as BINDING SITE I, BINDING SITE II or BINDING SITE III of FIG. 8. Table 4 illustrates the complementarity of the nucleotide sequences of LOC51667 BINDING SITE, designated SEQ ID:13920, to the nucleotide sequence of GAM129 RNA, herein designated GAM RNA, also designated SEQ ID:213.

Another function of GAM129 is therefore inhibition of LOC51667 (Accession). Accordingly, utilities of GAM129 include diagnosis, prevention and treatment of diseases and clinical conditions associated with LOC51667.

LOC58525 (Accession) is another GAM129 target gene, herein designated TARGET GENE. LOC58525 BINDING SITE is a target binding site found in the 3' untranslated region of mRNA encoded by LOC58525, corresponding to a target binding site such as BINDING SITE I, BINDING SITE II or BINDING SITE III of FIG. 8. Table 4 illustrates the complementarity of the nucleotide sequences of LOC58525 BINDING SITE, designated SEQ ID:12229, to the nucleotide sequence of GAM129 RNA, herein designated GAM RNA, also designated SEQ ID:213.

Another function of GAM129 is therefore inhibition of LOC58525 (Accession). Accordingly, utilities of GAM129 include diagnosis, prevention and treatment of diseases and clinical conditions associated with LOC58525.

Mannosidase, alpha, class 1a, member 1 (MAN1A1, Accession NM_005907.2) is another GAM129 target gene, herein designated TARGET GENE. MAN1A1 BINDING SITE is a target binding site found in the 5' untranslated region of mRNA encoded by MAN1A1, corresponding to a target binding site such as BINDING SITE I, BINDING SITE II or BINDING SITE III of FIG. 8. Table 4 illustrates the complementarity of the nucleotide sequences of MAN1A1 BINDING SITE, designated SEQ ID:1824, to the nucleotide sequence of GAM129 RNA, herein designated GAM RNA, also designated SEQ ID:213.

Another function of GAM129 is therefore inhibition of Mannosidase, alpha, class 1a, member 1 (MAN1A1, Accession NM_005907.2), a gene which removes 3 distinct mannose residues from peptide-bound Man(9)-GlcNAc(2) oligosaccharides. Accordingly, utilities of GAM129 include diagnosis, prevention and treatment of diseases and clinical conditions associated with MAN1A1.

The function of MAN1A1 has been established by previous studies. Man(9)-mannosidase (alpha-1,2-mannosidase 1A) catalyzes the removal of 3 distinct mannose residues from peptide-bound Man(9)-GlcNAc(2) oligosaccharides. See MAN2A1 (OMIM Ref. No. 154582) for general information. Using an oligonucleotide probe derived from a pig liver Man(9)-mannosidase-specific cDNA template, Bause et al. (1993) isolated Man(9)-mannosidase from a human kidney cDNA library. The full-length cDNA predicted a 625-amino acid protein with a calculated molecular mass of 71 kD. Man(9)-mannosidase is a type II transmembrane protein with a short cytoplasmic polypeptide tail, a single transmembrane domain acting as a noncleavable signal sequence, a large luminal catalytic domain, and 3 potential N-glycosylation sites Full details of the abovementioned studies are described in the following publications, the disclosure of which are hereby incorporated by reference:

Bause, E.; Bieberich, E.; Rolfs, A.; Volker, C.; Schmidt, B.: Molecular cloning and primary structure of Man(9)-mannosidase from human kidney. Eur. J. Biochem. 217:535-540, 1993; and Tremblay, L. O; Campbell Dyke, N.; Herscovics, A.: Molecular cloning, chromosomal mapping and tissue-specific expression of a novel human alpha-1,2-mannosidase gene involved in N-glycan.

Further studies establishing the function and utilities of MAN1A1 are found in John Hopkins OMIM database record ID 604344, and in cited publications listed in Table 5, which are hereby incorporated by reference. MGC10471 (Accession NM_030818.1) is another GAM129 target gene, herein designated TARGET GENE. MGC10471 BINDING SITE is a target binding site found in the 5' untranslated region of mRNA encoded by MGC10471, corresponding to a target binding site such as BINDING SITE I, BINDING SITE II or BINDING SITE III of FIG. 8. Table 4 illustrates the complementarity of the nucleotide sequences of MGC10471 BINDING SITE, designated SEQ ID:3302, to the nucleotide sequence of GAM129 RNA, herein designated GAM RNA, also designated SEQ ID:213.

Another function of GAM129 is therefore inhibition of MGC10471 (Accession NM_030818.1). Accordingly, utilities of GAM129 include diagnosis, prevention and treatment of diseases and clinical conditions associated with MGC10471.

MGC16186 (Accession NM_032372.1) is another GAM129 target gene, herein designated TARGET GENE. MGC16186 BINDING SITE is a target binding site found in the 3' untranslated region of mRNA encoded by MGC16186, corresponding to a target binding site such as BINDING SITE I, BINDING SITE II or BINDING SITE III of FIG. 8. Table 4 illustrates the complementarity of the nucleotide sequences of MGC16186 BINDING SITE, designated SEQ ID:15910, to the nucleotide sequence of GAM129 RNA, herein designated GAM RNA, also designated SEQ ID:213.

Another function of GAM129 is therefore inhibition of MGC16186 (Accession NM_032372.1). Accordingly, utilities of GAM129 include diagnosis, prevention and treatment of diseases and clinical conditions associated with MGC16186.

MGC4368 (Accession NM_024510.2) is another GAM129 target gene, herein designated TARGET GENE. MGC4368 BINDING SITE is a target binding site found in the 5' untranslated region of mRNA encoded by MGC4368, corresponding to a target binding site such as BINDING SITE I, BINDING SITE II or BINDING SITE III of FIG. 8. Table 4 illustrates the complementarity of the nucleotide sequences of MGC4368 BINDING SITE, designated SEQ ID:2451, to the nucleotide sequence of GAM129 RNA, herein designated GAM RNA, also designated SEQ ID:213.

Another function of GAM129 is therefore inhibition of MGC4368 (Accession NM_024510.2). Accordingly, utilities of GAM129 include diagnosis, prevention and treatment of diseases and clinical conditions associated with MGC4368.

MGC4796 (Accession XM_029031.7) is another GAM129 target gene, herein designated TARGET GENE. MGC4796 BINDING SITE is a target binding site found in the 3' untranslated region of multiple transcripts of mRNA encoded by MGC4796, corresponding to a target binding site such as BINDING SITE I, BINDING SITE II or BINDING SITE III of FIG. 8. Table 4 illustrates the complementarity of the nucleotide sequences of MGC4796 BINDING SITE, designated SEQ ID:3662, to the nucleotide sequence of GAM129 RNA, herein designated GAM RNA, also designated SEQ ID:213.

Another function of GAM129 is therefore inhibition of MGC4796 (Accession XM_029031.7). Accordingly, utilities of GAM129 include diagnosis, prevention and treatment of diseases and clinical conditions associated with MGC4796.

Matrix metalloproteinase 15 (membrane-inserted) (MMP15, Accession NM_002428.1) is another GAM129 target gene, herein designated TARGET GENE. MMP15 BINDING SITE is a target binding site found in the 3' untranslated region of mRNA encoded by MMP15, corresponding to a target binding site such as BINDING SITE I, BINDING SITE II or BINDING SITE III of FIG. 8. Table 4 illustrates the complementarity of the nucleotide sequences of MMP15 BINDING SITE, designated SEQ ID:15972, to the nucleotide sequence of GAM129 RNA, herein designated GAM RNA, also designated SEQ ID:213.

Another function of GAM129 is therefore inhibition of Matrix metalloproteinase 15 (membrane-inserted) (MMP15, Accession NM_002428.1). Accordingly, utilities of GAM129 include diagnosis, prevention and treatment of diseases and clinical conditions associated with MMP15.

Neurexophilin 3 (NXPH3, Accession NM_007225.1) is another GAM129 target gene, herein designated TARGET GENE. NXPH3 BINDING SITE1 and NXPH3 BINDING SITE2 are target binding sites found in untranslated regions of mRNA encoded by NXPH3, corresponding to target binding sites such as BINDING SITE I, BINDING SITE II or BINDING SITE III of FIG. 8. Table 4 illustrates the complementarity of the nucleotide sequences of NXPH3 BINDING SITE1 and NXPH3 BINDING SITE2, designated SEQ ID:2877 and SEQ ID:3126 respectively, to the nucleotide sequence of GAM129 RNA, herein designated GAM RNA, also designated SEQ ID:213.

Another function of GAM129 is therefore inhibition of Neurexophilin 3 (NXPH3, Accession NM_007225.1). Accordingly, utilities of GAM129 include diagnosis, prevention and treatment of diseases and clinical conditions associated with NXPH3.

Ovarian cancer overexpressed 1 (OVCOV1, Accession NM_173073.1) is another GAM129 target gene, herein designated TARGET GENE. OVCOV1 BINDING SITE is a target binding site found in the 5' untranslated region of multiple transcripts of mRNA encoded by OVCOV1, corresponding to a target binding site such as BINDING SITE I, BINDING SITE II or BINDING SITE III of FIG. 8. Table 4 illustrates the complementarity of the nucleotide sequences of OVCOV1 BINDING SITE, designated SEQ ID:15335, to the nucleotide sequence of GAM129 RNA, herein designated GAM RNA, also designated SEQ ID:213.

Another function of GAM129 is therefore inhibition of Ovarian cancer overexpressed 1 (OVCOV1, Accession NM_173073.1). Accordingly, utilities of GAM129 include diagnosis, prevention and treatment of diseases and clinical conditions associated with OVCOV1.

Phosphatidylinositol-4-phosphate 5-kinase, type i, gamma (PIP5K1C, Accession XM_047620.3) is another GAM129 target gene, herein designated TARGET GENE. PIP5K1C BINDING SITE is a target binding site found in the 3' untranslated region of multiple transcripts of mRNA encoded by PIP5K1C, corresponding to a target binding site such as BINDING SITE I, BINDING SITE II or BINDING SITE III of FIG. 8. Table 4 illustrates the complementarity of the nucleotide sequences of PIP5K1C BINDING SITE, designated SEQ ID:16602, to the nucleotide sequence of GAM129 RNA, herein designated GAM RNA, also designated SEQ ID:213.

Another function of GAM129 is therefore inhibition of Phosphatidylinositol-4-phosphate 5-kinase, type i, gamma (PIP5K1C, Accession XM_047620.3). Accordingly, utilities of GAM129 include diagnosis, prevention and treatment of diseases and clinical conditions associated with PIP5K1C.

Periaxin (PRX, Accession NM_020956.1) is another GAM129 target gene, herein designated TARGET GENE. PRX BINDING SITE is a target binding site found in the 3' untranslated region of mRNA encoded by PRX, corresponding to a target binding site such as BINDING SITE I, BINDING SITE II or BINDING SITE III of FIG. 8. Table 4 illustrates the complementarity of the nucleotide sequences of PRX BINDING SITE, designated SEQ ID:18306, to the nucleotide sequence of GAM129 RNA, herein designated GAM RNA, also designated SEQ ID:213.

Another function of GAM129 is therefore inhibition of Periaxin (PRX, Accession NM_020956.1), a gene which seems to be required for maintenance of peripheral nerve myelin sheath. may have a role in axon-glial interactions, possibly by interacting with the cytoplasmic domains of integral membrane proteins such as myelin- associated glycoprotein in the periaxonal regions of the schwann cell plasma membrane. may have a role in the early phases of myelin deposition and therefore is associated with Dejerine-sottas neuropathy, autosomal recessive. Accordingly, utilities of GAM129 include diagnosis, prevention and treatment of Dejerine-sottas neuropathy, autosomal recessive, and of other diseases and clinical conditions associated with PRX.

The function of PRX and its association with various diseases and clinical conditions, has been established by previous studies, as described hereinabove with reference to GAM30.1. Protein tyrosine phosphatase, receptor type, n polypeptide 2 (PTPRN2, Accession NM_130842.1) is another GAM129 target gene, herein designated TARGET GENE. PTPRN2 BINDING SITE is a target binding site found in the 3' untranslated region of multiple transcripts of mRNA encoded by PTPRN2, corresponding to a target binding site such as BINDING SITE I, BINDING SITE II or BINDING SITE III of FIG. 8. Table 4 illustrates the complementarity of the nucleotide sequences of PTPRN2 BINDING SITE, designated SEQ ID:17373, to the nucleotide sequence of GAM129 RNA, herein designated GAM RNA, also designated SEQ ID:213.

Another function of GAM129 is therefore inhibition of Protein tyrosine phosphatase, receptor type, n polypeptide 2 (PTPRN2, Accession NM_130842.1). Accordingly, utilities of GAM129 include diagnosis, prevention and treatment of diseases and clinical conditions associated with PTPRN2.

Phosphorylase, glycogen; brain (PYGB, Accession NM_002862.2) is another GAM129 target gene, herein designated TARGET GENE. PYGB BINDING SITE is a target binding site found in the 3' untranslated region of mRNA encoded by PYGB, corresponding to a target binding site such as BINDING SITE I, BINDING SITE II or BINDING SITE III of FIG. 8. Table 4 illustrates the complementarity of the nucleotide sequences of PYGB BINDING SITE, designated SEQ ID:19382, to the nucleotide sequence of GAM129 RNA, herein designated GAM RNA, also designated SEQ ID:213.

Another function of GAM129 is therefore inhibition of Phosphorylase, glycogen; brain (PYGB, Accession NM_002862.2). Accordingly, utilities of GAM129 include diagnosis, prevention and treatment of diseases and clinical conditions associated with PYGB.

Rab30, member ras oncogene family (RAB30, Accession NM_014488.2) is another GAM129 target gene, herein designated TARGET GENE. RAB30 BINDING SITE is a target binding site found in the 5' untranslated region of mRNA encoded by RAB30, corresponding to a target binding site such as BINDING SITE I, BINDING SITE II or BINDING SITE III of FIG. 8. Table 4 illustrates the complementarity of the nucleotide sequences of RAB30 BINDING SITE, designated SEQ ID:4058, to the nucleotide sequence of GAM129 RNA, herein designated GAM RNA, also designated SEQ ID:213.

Another function of GAM129 is therefore inhibition of Rab30, member ras oncogene family (RAB30, Accession NM_014488.2), a gene which is a GTP-binding protein. Accordingly, utilities of GAM129 include diagnosis, prevention and treatment of diseases and clinical conditions associated with RAB30.

The function of RAB30 has been established by previous studies. Chen et al. (1996) isolated a cDNA encoding RAB30, a small GTP-binding protein of the RAB family, from a human melanocyte cDNA library and from melanoma cells. The deduced 203-amino acid RAB30 protein shares minimal homology with previously documented GTPases. Northern blot analysis detected RAB30 transcripts ranging from 1.7 to 11 kb in most tissues tested. By somatic cell hybrid analysis, Chen et al. (1996) mapped the RAB30 gene to chromosome 11. Scott (2001) localized the RAB30 gene to 11q12-q14 based on sequence similarity between the RAB30 sequence (GenBank U57092) and chromosome 11 clones (GenBank AP000893 and AP000905).

Full details of the abovementioned studies are described in the following publications, the disclosure of which are hereby incorporated by reference:

Chen, D.; Guo, J.; Miki, T.; Tachibana, M.; Gahl, W. A.: Molecular cloning of two novel rab genes from human melanocytes. Gene 174:129-134, 1996; and Scott, A. F.: Personal Communication. Baltimore, Md., 2/26/2001.

Further studies establishing the function and utilities of RAB30 are found in John Hopkins OMIM database record ID 605693, and in cited publications listed in Table 5, which are hereby incorporated by reference. Ras association (ralgds/af-6) domain family 2 (RASSF2, Accession NM_014737.1) is another GAM129 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:13010, to the nucleotide sequence of GAM129 RNA, herein designated GAM RNA, also designated SEQ ID:213.

Another function of GAM129 is therefore inhibition of Ras association (ralgds/af-6) domain family 2 (RASSF2, Accession NM_014737.1). Accordingly, utilities of GAM129 include diagnosis, prevention and treatment of diseases and clinical conditions associated with RASSF2.

Rna binding motif protein, y chromosome, family 1, member a1 (RBMY1A1, Accession NM_005058.1) is another GAM129 target gene, herein designated TARGET GENE. RBMY1A1 BINDING SITE is a target binding site found in the 5' untranslated region of mRNA encoded by RBMY1A1, corresponding to a target binding site such as BINDING SITE I, BINDING SITE II or BINDING SITE III of FIG. 8. Table 4 illustrates the complementarity of the nucleotide sequences of RBMY1A1 BINDING SITE, designated SEQ ID:5003, to the nucleotide sequence of GAM129 RNA, herein designated GAM RNA, also designated SEQ ID:213.

Another function of GAM129 is therefore inhibition of Rna binding motif protein, y chromosome, family 1, member a1 (RBMY1A1, Accession NM_005058.1), a gene which is needed to organize a concentration gradient of a dorsalizing morphogen (dm) and is essential in somatic tissues. Accordingly, utilities of GAM129 include diagnosis, prevention and treatment of diseases and clinical conditions associated with RBMY1A1.

The function of RBMY1A1 has been established by previous studies. Delbridge et al. (1997) reviewed the literature on the RBM1 gene family. Expression of the human RBM1 gene family is confined to the spermatogonia and early primary spermatocytes in the lining of the seminiferous tubules in adults, but expression of the RBM1 gene family has also been demonstrated in the testis of 2-year-old and prepubertal boy, indicating that the RBM1 gene family may have an additional role in germ cell development. RBM1 is present as multiple copies in all eutherian species examined, including primates, rabbit, pig, cattle, sheep, and mouse. The RBM1 genes encode RNA-binding proteins containing a single N-terminal RNA-binding motif and a C-terminal auxiliary domain with 4 repeated segments with a high proportion of glycine, serine, and arginine residues, typical of many RNA-binding proteins. Two other genes that map to the same small region of the long arm of the human Y chromosome and are often deleted in azoospermic men are DAZ (OMIM Ref. No. 400003) and TSPY (OMIM Ref. No. 480100). Venables et al. (2000) used a yeast 2-hybrid system to show that RBM, the RBMX gene product hnRNP G (OMIM Ref. No. 300119), and a novel testis-specific relative (termed hnRNP G-T) interact with Tra2-beta (OMIM Ref. No. 602719), an activator of pre- mRNA splicing that is ubiquitous but highly expressed in testis. RBM and Tra2- beta colocalize in 2 major domains in human spermatocyte nuclei. Incubation with the protein interaction domain of RBM inhibited splicing in vitro of a specific pre-mRNA substrate containing an essential enhancer bound by Tra2-beta. The RNA- binding domain of RBM affected 5-prime splice site selection. The authors concluded that the hnRNP G family of proteins is involved in pre-mRNA splicing and hypothesized that RBM may be involved in Tra2-beta-dependent splicing in spermatocytes.

Full details of the abovementioned studies are described in the following publications, the disclosure of which are hereby incorporated by reference:

Delbridge, M. L.; Harry, J. L.; Toder, R.; Waugh O'Neill, R. J.; Ma, K.; Chandley, A. C.; Marshall Graves, J. A.: A human candidate spermatogenesis gene, RBM1, is conserved and amplified on the marsupial Y chromosome. Nature Genet. 15:131-136, 1997; and Venables, J. P.; Elliott, D. J.; Makarova, O. V.; Makarov, E. M.; Cooke, H. J.; Eperon, I. C.: RBMY, a probable human spermatogenesis factor, and other hnRNP G proteins interact with Tra.

Further studies establishing the function and utilities of RBMY1A1 are found in John Hopkins OMIM database record ID 400006, and in cited publications listed in Table 5, which are hereby incorporated by reference. Arginine-glutamic acid dipeptide (re) repeats (RERE, Accession NM_012102.2) is another GAM129 target gene, herein designated TARGET GENE. RERE BINDING SITE is a target binding site found in the 5' untranslated region of mRNA encoded by RERE, corresponding to a target binding site such as BINDING SITE I, BINDING SITE II or BINDING SITE III of FIG. 8. Table 4 illustrates the complementarity of the nucleotide sequences of RERE BINDING SITE, designated SEQ ID:1394, to the nucleotide sequence of GAM129 RNA, herein designated GAM RNA, also designated SEQ ID:213.

Another function of GAM129 is therefore inhibition of Arginine-glutamic acid dipeptide (re) repeats (RERE, Accession NM_012102.2), a gene which binds DRPLA and locates in the nucleus and therefore may be associated with Dentatorubral- pallidoluysian atrophy. Accordingly, utilities of GAM129 include diagnosis, prevention and treatment of Dentatorubral-pallidoluysian atrophy, and of other diseases and clinical conditions associated with RERE.

The function of RERE and its association with various diseases and clinical conditions, has been established by previous studies, as described hereinabove with reference to GAM47.1. RFT1 (Accession NM_052859.1) is another GAM129 target gene, herein designated TARGET GENE. RFT1 BINDING SITE is a target binding site found in the 3' untranslated region of mRNA encoded by RFT1, corresponding to a target binding site such as BINDING SITE I, BINDING SITE II or BINDING SITE III of FIG. 8. Table 4 illustrates the complementarity of the nucleotide sequences of RFT1 BINDING SITE, designated SEQ ID:9266, to the nucleotide sequence of GAM129 RNA, herein designated GAM RNA, also designated SEQ ID:213.

Another function of GAM129 is therefore inhibition of RFT1 (Accession NM_052859.1). Accordingly, utilities of GAM129 include diagnosis, prevention and treatment of diseases and clinical conditions associated with RFT1.

Regulator of g-protein signalling 19 interacting protein 1 (RGS19IP1, Accession NM_005716.1) is another GAM129 target gene, herein designated TARGET GENE. RGS19IP1 BINDING SITE is a target binding site found in the 3' untranslated region of mRNA encoded by RGS19IP1, corresponding to a target binding site such as BINDING SITE I, BINDING SITE II or BINDING SITE III of FIG. 8. Table 4 illustrates the complementarity of the nucleotide sequences of RGS19IP1 BINDING SITE, designated SEQ ID:2755, to the nucleotide sequence of GAM129 RNA, herein designated GAM RNA, also designated SEQ ID:213.

Another function of GAM129 is therefore inhibition of Regulator of g-protein signalling 19 interacting protein 1 (RGS19IP1, Accession NM_005716.1), a gene which is involved in g protein-linked signaling. Accordingly, utilities of GAM129 include diagnosis, prevention and treatment of diseases and clinical conditions associated with RGS19IP1.

The function of RGS19IP1 has been established by previous studies. Northern blot analysis detected a 1.8-kb C19ORF3 transcript in all tissues tested, with strongest expression in pancreas, followed by skeletal muscle, brain, kidney, placenta, lung, liver, and lowest expression in heart. Expression levels did not correlate with those of GAIP. Immunoblot analysis demonstrated the presence of C19ORF3 primarily in cytosolic fractions but also in membrane fractions. Immunofluorescence analysis showed expression of endogenous C19ORF3 in both a diffuse and a punctate staining pattern throughout the cytoplasm. Using a yeast 2-hybrid system, Bunn et al. (1999) isolated a cDNA encoding C19ORF3, which they called GLUT1CBP (GLUT1 (SLC2A1; 138140) C-terminus-binding protein). SDS-PAGE and Western blot analyses determined that C19ORF3 is expressed as a 39-kD protein in all tissues tested except small intestine. Yeast 2-hybrid analysis showed that C19ORF3 binds SLC2A1 through its PDZ domain. Northern blot analysis revealed similar expression patterns for C19ORF3 and SLC2A1, with both being expressed most strongly in brain. Using a yeast 2-hybrid screen for brain-interacting proteins, the authors determined that only SLC2A1, KIF1B, and alpha actinin-1 (ACTN1; 102575) bind C19ORF3 through its PDZ domain; myosin VI (MYO6; 600970) was shown to interact with C19ORF3 but not via the PDZ domain.

Full details of the abovementioned studies are described in the following publications, the disclosure of which are hereby incorporated by reference:

Bunn, R. C.; Jensen, M. A.; Reed, B. C.: Protein interactions with the glucose transporter binding protein GLUT1CBP that provide a link between GLUT1 and the cytoskeleton. Molec. Biol. Cell 10:819-832, 1999. ; and Von Kap-Herr, C.; Kandala, G.; Mann, S. S.; Hart, T. C.; Pettenati, M. J.; Setaluri, V.: Assignment of PDZ domain-containing protein GIPC gene (C19orf3) to human chromosome band 19p13.1 b.

Further studies establishing the function and utilities of RGS19IP1 are found in John Hopkins OMIM database record ID 605072, and in cited publications listed in Table 5, which are hereby incorporated by reference. Ras and rab interactor 3 (RIN3, Accession NM_024892.1) is another GAM129 target gene, herein designated TARGET GENE. RIN3 BINDING SITE is a target binding site found in the 5' untranslated region of mRNA encoded by RIN3, corresponding to a target binding site such as BINDING SITE I, BINDING SITE II or BINDING SITE III of FIG. 8. Table 4 illustrates the complementarity of the nucleotide sequences of RIN3 BINDING SITE, designated SEQ ID:17667, to the nucleotide sequence of GAM129 RNA, herein designated GAM RNA, also designated SEQ ID:213.

Another function of GAM129 is therefore inhibition of Ras and rab interactor 3 (RIN3, Accession NM_024892.1). Accordingly, utilities of GAM129 include diagnosis, prevention and treatment of diseases and clinical conditions associated with RIN3.

Ring finger protein 20 (RNF20, Accession NM_019592.4) is another GAM129 target gene, herein designated TARGET GENE. RNF20 BINDING SITE is a target binding site found in the 3' untranslated region of mRNA encoded by RNF20, corresponding to a target binding site such as BINDING SITE I, BINDING SITE II or BINDING SITE III of FIG. 8. Table 4 illustrates the complementarity of the nucleotide sequences of RNF20 BINDING SITE, designated SEQ ID:18452, to the nucleotide sequence of GAM129 RNA, herein designated GAM RNA, also designated SEQ ID:213.

Another function of GAM129 is therefore inhibition of Ring finger protein 20 (RNF20, Accession NM_019592.4). Accordingly, utilities of GAM129 include diagnosis, prevention and treatment of diseases and clinical conditions associated with RNF20.

RNTRE (Accession NM_014688.1) is another GAM129 target gene, herein designated TARGET GENE. RNTRE BINDING SITE is a target binding site found in the 3' untranslated region of mRNA encoded by RNTRE, corresponding to a target binding site such as BINDING SITE I, BINDING SITE II or BINDING SITE III of FIG. 8. Table 4 illustrates the complementarity of the nucleotide sequences of RNTRE BINDING SITE, designated SEQ ID:12347, to the nucleotide sequence of GAM129 RNA, herein designated GAM RNA, also designated SEQ ID:213.

Another function of GAM129 is therefore inhibition of RNTRE (Accession NM_014688.1), a gene which may be involved in cell proliferation. Accordingly, utilities of GAM129 include diagnosis, prevention and treatment of diseases and clinical conditions associated with RNTRE.

The function of RNTRE and its association with various diseases and clinical conditions, has been established by previous studies, as described hereinabove with reference to GAM63.1. RPP14 (Accession NM_007042.1) is another GAM129 target gene, herein designated TARGET GENE. RPP14 BINDING SITE is a target binding site found in the 3' untranslated region of mRNA encoded by RPP14, corresponding to a target binding site such as BINDING SITE I, BINDING SITE II or BINDING SITE III of FIG. 8. Table 4 illustrates the complementarity of the nucleotide sequences of RPP14 BINDING SITE, designated SEQ ID:4118, to the nucleotide sequence of GAM129 RNA, herein designated GAM RNA, also designated SEQ ID:213.

Another function of GAM129 is therefore inhibition of RPP14 (Accession NM_007042.1). Accordingly, utilities of GAM129 include diagnosis, prevention and treatment of diseases and clinical conditions associated with RPP14.

RRP22 (Accession NM_006477.1) is another GAM129 target gene, herein designated TARGET GENE. RRP22 BINDING SITE is a target binding site found in the 3' untranslated region of mRNA encoded by RRP22, corresponding to a target binding site such as BINDING SITE I, BINDING SITE II or BINDING SITE III of FIG. 8. Table 4 illustrates the complementarity of the nucleotide sequences of RRP22 BINDING SITE, designated SEQ ID:5851, to the nucleotide sequence of GAM129 RNA, herein designated GAM RNA, also designated SEQ ID:213.

Another function of GAM129 is therefore inhibition of RRP22 (Accession NM_006477.1). Accordingly, utilities of GAM129 include diagnosis, prevention and treatment of diseases and clinical conditions associated with RRP22.

SELB (Accession NM_021937.1) is another GAM129 target gene, herein designated TARGET GENE. SELB BINDING SITE is a target binding site found in the 3' untranslated region of mRNA encoded by SELB, corresponding to a target binding site such as BINDING SITE I, BINDING SITE II or BINDING SITE III of FIG. 8. Table 4 illustrates the complementarity of the nucleotide sequences of SELB BINDING SITE, designated SEQ ID:14956, to the nucleotide sequence of GAM129 RNA, herein designated GAM RNA, also designated SEQ ID:213.

Another function of GAM129 is therefore inhibition of SELB (Accession NM_021937.1). Accordingly, utilities of GAM129 include diagnosis, prevention and treatment of diseases and clinical conditions associated with SELB.

Sema domain, immunoglobulin domain (ig), and gpi membrane anchor, (semaphorin) 7a (SEMA7A, Accession NM_003612.1) is another GAM129 target gene, herein designated TARGET GENE. SEMA7A BINDING SITE is a target binding site found in the 3' untranslated region of mRNA encoded by SEMA7A, corresponding to a target binding site such as BINDING SITE I, BINDING SITE II or BINDING SITE III of FIG. 8. Table 4 illustrates the complementarity of the nucleotide sequences of SEMA7A BINDING SITE, designated SEQ ID:13896, to the nucleotide sequence of GAM129 RNA, herein designated GAM RNA, also designated SEQ ID:213.

Another function of GAM129 is therefore inhibition of Sema domain, immunoglobulin domain (ig), and gpi membrane anchor, (semaphorin) 7a (SEMA7A, Accession NM_003612.1). Accordingly, utilities of GAM129 include diagnosis, prevention and treatment of diseases and clinical conditions associated with SEMA7A.

Small glutamine-rich tetratricopeptide repeat (tpr)-containing (SGT, Accession NM_003021.2) is another GAM129 target gene, herein designated TARGET GENE. SGT BINDING SITE is a target binding site found in the 3' untranslated region of mRNA encoded by SGT, corresponding to a target binding site such as BINDING SITE I, BINDING SITE II or BINDING SITE III of FIG. 8. Table 4 illustrates the complementarity of the nucleotide sequences of SGT BINDING SITE, designated SEQ ID:2232, to the nucleotide sequence of GAM129 RNA, herein designated GAM RNA, also designated SEQ ID:213.

Another function of GAM129 is therefore inhibition of Small glutamine-rich tetratricopeptide repeat (tpr)-containing (SGT, Accession NM_003021.2). Accordingly, utilities of GAM129 include diagnosis, prevention and treatment of diseases and clinical conditions associated with SGT.

Solute carrier family 12 (potassium/chloride transporters), member 4 (SLC12A4, Accession NM_005072.2) is another GAM129 target gene, herein designated TARGET GENE. SLC12A4 BINDING SITE is a target binding site found in the 3' untranslated region of mRNA encoded by SLC12A4, corresponding to a target binding site such as BINDING SITE I, BINDING SITE II or BINDING SITE III of FIG. 8. Table 4 illustrates the complementarity of the nucleotide sequences of SLC12A4 BINDING SITE, designated SEQ ID:8109, to the nucleotide sequence of GAM129 RNA, herein designated GAM RNA, also designated SEQ ID:213.

Another function of GAM129 is therefore inhibition of Solute carrier family 12 (potassium/chloride transporters), member 4 (SLC12A4, Accession NM_005072.2), a gene which is a potassium-chloride cotransporter. Accordingly, utilities of GAM129 include diagnosis, prevention and treatment of diseases and clinical conditions associated with SLC12A4.

The function of SLC12A4 has been established by previous studies. Potassium-chloride cotransporters mediate the coupled movement of potassium and chloride ions across the plasma membrane. Gillen et al. (1996) cloned human potassium- chloride cotransporter-1 based on the identification of ESTs with moderate homology to NKCC1 (OMIM Ref. No. 600840). The full-length sequence was obtained from EST clones and by RT-PCR of HEK293 cell RNA. The 1,085-amino acid KCC1 protein is 24 to 25% identical to NKCC1 and SLC12A3 (OMIM Ref. No. 600968) and shares 97% identity with rabbit KCC1. The overall structure of KCC1 is similar to that of other cation-chloride cotransporters, with 12 predicted transmembrane regions, a large extracellular loop with potential N-linked glycosylation sites, and cytoplasmic N- and C-terminal domains. Northern blot analysis revealed that KCC1 is expressed ubiquitously. Gillen et al. (1996) demonstrated that KCC1 exhibits the functional properties of the red cell K-Cl cotransporter, including stimulation by swelling and N-ethylmaleimide, and low affinities for rubidium, chloride, and bumetanide. Pellegrino et al. (1998) demonstrated that levels of erythroid- KCC1 mRNA are upregulated during early stages of erythroid differentiation and fall to very low levels in later stages. They found no full-length KCC1 transcripts in human or mouse circulating reticulocytes. They suggested that erythroid- KCC1 may play a role in early erythroid maturation events.

Full details of the abovementioned studies are described in the following publications, the disclosure of which are hereby incorporated by reference:

Gillen, C. M.; Brill, S.; Payne, J. A.; Forbush, B., III : Molecular cloning and functional expression of the K-Cl cotransporter from rabbit, rat, and human: a new member of the cation-chloride cotransporter family. J. Biol. Chem. 271: 16237-16244, 1996; and Pellegrino, C. M.; Rybicki, A. C.; Musto, S.; Nagel, R. L.; Schwartz, R. S.: Molecular identification and expression of erythroid K:Cl cotransporter in human and mouse erythroleukemic cell.

Further studies establishing the function and utilities of SLC12A4 are found in John Hopkins OMIM database record ID 604119, and in cited publications listed in Table 5, which are hereby incorporated by reference. Steroid-5-alpha-reductase, alpha polypeptide 1 (3-oxo-5 alpha-steroid delta 4-dehydrogenase alpha 1) (SRD5A1, Accession NM_001047.1) is another GAM129 target gene, herein designated TARGET GENE. SRD5A1 BINDING SITE is a target binding site found in the 3' untranslated region of mRNA encoded by SRD5A1, corresponding to a target binding site such as BINDING SITE I, BINDING SITE II or BINDING SITE III of FIG. 8. Table 4 illustrates the complementarity of the nucleotide sequences of SRD5A1 BINDING SITE, designated SEQ ID:11202, to the nucleotide sequence of GAM129 RNA, herein designated GAM RNA, also designated SEQ ID:213.

Another function of GAM129 is therefore inhibition of Steroid-5-alpha-reductase, alpha polypeptide 1 (3-oxo-5 alpha-steroid delta 4-dehydrogenase alpha 1) (SRD5A1, Accession NM_001047.1), a gene which catalyzes the conversion of testosterone into 5- alpha-dihydrotestosterone and progesterone and therefore may be associated with Polycystic ovary syndrome (pcos). Accordingly, utilities of GAM129 include diagnosis, prevention and treatment of Polycystic ovary syndrome (pcos), and of other diseases and clinical conditions associated with SRD5A1.

The function of SRD5A1 has been established by previous studies. Harris et al. (1992) concluded that SRD5A1 is a minor component of the reductase activity in prostate although the gene was originally cloned from prostate. On the other hand, SRD5A1 appears to be the predominant isozyme of steroid 5-alpha-reductase in the scalp and elsewhere in the skin. The possibility of scalp-selective inhibitors being useful in the treatment of male pattern baldness, acne, and hirsutism, all 'disorders' that appear to be dihydrotestosterone dependent, was raised. Jenkins et al. (1992) used RFLPs of the SRD5A1 gene to exclude the gene as the site of the mutation in classic 5-alpha-reductase deficiency (pseudovaginal perineoscrotal hypospadias; 264600). They further showed that in contrast to the major steroid 5-alpha-reductase in the prostate and cultured skin fibroblasts, which was designated SRD5A2, the cDNA-encoded enzyme, representing SRD5A1, exhibited a neutral to basic pH optimum and was much less sensitive to inhibition by the 4-aza steroid finasteride.

Full details of the abovementioned studies are described in the following publications, the disclosure of which are hereby incorporated by reference:

Harris, G.; Azzolina, B.; Baginsky, W.; Cimis, G.; Rasmusson, G. H.; Tolman, R. L.; Raetz, C. R. H.; Ellsworth, K.: Identification and selective inhibition of an isozyme of steroid 5-alpha-reductase in human scalp. Proc. Nat. Acad. Sci. 89: 10787-10791, 1992; and Jenkins, E. P.; Andersson, S.; Imperato - McGinley, J.; Wilson, J. D.; Russell, D. W.: Genetic and pharmacological evidence for more than one human steroid 5-alpha- reductase. J. Clin. Invest.

Further studies establishing the function and utilities of SRD5A1 are found in John Hopkins OMIM database record ID 184753, and in cited publications listed in Table 5, which are hereby incorporated by reference. Suppressor of ty 6 homolog (s. cerevisiae) (SUPT6H, Accession NM_003170.2) is another GAM129 target gene, herein designated TARGET GENE. SUPT6H BINDING SITE is a target binding site found in the 3' untranslated region of mRNA encoded by SUPT6H, corresponding to a target binding site such as BINDING SITE I, BINDING SITE II or BINDING SITE III of FIG. 8. Table 4 illustrates the complementarity of the nucleotide sequences of SUPT6H BINDING SITE, designated SEQ ID:14488, to the nucleotide sequence of GAM129 RNA, herein designated GAM RNA, also designated SEQ ID:213.

Another function of GAM129 is therefore inhibition of Suppressor of ty 6 homolog (s. cerevisiae) (SUPT6H, Accession NM_003170.2), a gene which may normally act to repress transcription at a variety of loci, and also plays a role in chromatin structure or assembly. Accordingly, utilities of GAM129 include diagnosis, prevention and treatment of diseases and clinical conditions associated with SUPT6H.

The function of SUPT6H has been established by previous studies. Chiang et al. (1996) isolated and sequenced SUPT6H and Supt6h, the human and murine homologs of the Saccharomyces cerevisiae and Caenorhabditis elegans genes SPT6 and emb-5, respectively. The human and murine SPT6 homologs are virtually identical, as they share more than 98% identity and more than 99% similarity at the protein level. The derived amino acid sequences of these 2 genes predicted a 1,603-amino acid polypeptide in human and a 1,726-amino acid polypeptide in mouse, respectively. The proteins have a highly acidic 5-prime region, a degenerate SH2 domain, and a leucine zipper, features consistent with a nuclear protein that regulates transcription. Northern blotting revealed a 7.0-kb transcript that was expressed constitutively in both mouse and human. Chiang et al. (1996) commented that SUPT6H appears to be functionally analogous to SPT6 and emb-5 and may therefore regulate transcription through establishment or maintenance of chromatin structure. By PCR-based analysis of somatic cell hybrids and by fluorescence in situ hybridization, Chiang et al. (1996) mapped the human homolog to 17q11.2. Segre et al. (1995) detected a cDNA fragment from the Supt6h gene on a mouse YAC that also contained the 'nude' locus. Their data placed Supt6h approximately 100 kb from whn (OMIM Ref. No. 600838), which is located on mouse chromosome 11. Thus, the Supt6h gene was mapped to mouse chromosome 11B1, which exhibits extensive homology of synteny with proximal human 17q.

Full details of the abovementioned studies are described in the following publications, the disclosure of which are hereby incorporated by reference:

Chiang, P.-W.; Wang, S.; Smithivas, P.; Song, W.-J.; Ramamoorthy, S.; Hillman, J.; Puett, S.; Van Keuren, M. L.; Crombez, E.; Kumar, A.; Glover, T. W.; Miller, D. E.; Tsai C.-H.; Blackburn, C. C.; Chen, X.-N.; Sun, Z.; Cheng, J.-F.; Korenberg, J. R.; Kurnit, D. M.: Identification and analysis of the human and murine putative chromatin structure regulator SUPT6H and Supt6h. Genomics 34:328-333, 1996; and Segre, J. A.; Nemhauser, J. L.; Taylor, B. A.; Nadeau, J. H.; Lander, E. S.: Positional cloning of the nude locus: genetic, physical and transcription maps of the region and mutations.

Further studies establishing the function and utilities of SUPT6H are found in John Hopkins OMIM database record ID 601333, and in cited publications listed in Table 5, which are hereby incorporated by reference. Tea domain family member 2 (TEAD2, Accession NM_003598.1) is another GAM129 target gene, herein designated TARGET GENE. TEAD2 BINDING SITE is a target binding site found in the 3' untranslated region of mRNA encoded by TEAD2, corresponding to a target binding site such as BINDING SITE I, BINDING SITE II or BINDING SITE III of FIG. 8. Table 4 illustrates the complementarity of the nucleotide sequences of TEAD2 BINDING SITE, designated SEQ ID:18248, to the nucleotide sequence of GAM129 RNA, herein designated GAM RNA, also designated SEQ ID:213.

Another function of GAM129 is therefore inhibition of Tea domain family member 2 (TEAD2, Accession NM_003598.1), a gene which is a putative transcription factor that may be involved in the gene regulation of neural development. Accordingly, utilities of GAM129 include diagnosis, prevention and treatment of diseases and clinical conditions associated with TEAD2.

The function of TEAD2 has been established by previous studies. Jacquemin et al. (1996) cloned the mouse and human homologs of TEF4, a member of the TEA/ATTS transcription factor family. They found that a partial TEF4 cDNA encodes a protein that is 67% identical to TEF1 (OMIM Ref. No. 189967). Additionally, they observed that TEF4 can cooperatively bind the GT-IIC and Sph(I+II) enhansons of the SV40 enhancer. Jacquemin et al. (1996) determined by RT-PCR that human TEF4 is strongly expressed in a human ovarian carcinoma cell line, and they determined by in situ hybridization that tef4 is differentially expressed during mouse embryonic development. By fluorescence in situ hybridization and radiation hybrid analysis, Jacquemin et al. (1999) mapped the TEAD2 gene to 19q13.3.

Full details of the abovementioned studies are described in the following publications, the disclosure of which are hereby incorporated by reference:

Jacquemin, P.; Depetris, D.; Mattei, M.-G.; Martial, J. A.; Davidson, I.: Localization of human transcription factor TEF-4 and TEF-5 (TEAD2, TEAD3) genes to chromosomes 19q13.3 and 6p21.2 using fluorescence in situ hybridization and radiation hybrid analysis. Genomics 55:127-129, 1999; and Jacquemin, P.; Hwang, J.-J.; Martial, J. A.; Dolle, P.; Davidson, I.: A novel family of developmentally regulated mammalian transcription factors containing the TEA/ATTS DNA binding do.

Further studies establishing the function and utilities of TEAD2 are found in John Hopkins OMIM database record ID 601729, and in cited publications listed in Table 5, which are hereby incorporated by reference. Zinc finger, dhhc domain containing 7 (ZDHHC7, Accession NM_017740.1) is another GAM129 target gene, herein designated TARGET GENE. ZDHHC7 BINDING SITE is a target binding site found in the 5' untranslated region of mRNA encoded by ZDHHC7, corresponding to a target binding site such as BINDING SITE I, BINDING SITE II or BINDING SITE III of FIG. 8. Table 4 illustrates the complementarity of the nucleotide sequences of ZDHHC7 BINDING SITE, designated SEQ ID:3493, to the nucleotide sequence of GAM129 RNA, herein designated GAM RNA, also designated SEQ ID:213.

Another function of GAM129 is therefore inhibition of Zinc finger, dhhc domain containing 7 (ZDHHC7, Accession NM_017740.1). Accordingly, utilities of GAM129 include diagnosis, prevention and treatment of diseases and clinical conditions associated with ZDHHC7.

FIG. 8 further provides a conceptual description of a novel bioinformatically detected of the present invention, referred to here as Genomic Address Messenger 130 (GAM130), which modulates expression of respective target genes thereof, the function and utility of which target genes is known in the art.

GAM130 is a novel bioinformatically detected regulatory, non protein coding, micro RNA (miRNA) gene. The method by which GAM130 was detected is described hereinabove with reference to FIGS. 8-15.

GAM130 gene, herein designated GAM GENE, and GAM130 target gene, herein designated TARGET GENE, are human genes contained in the human genome.

GAM130 gene encodes a GAM130 precursor RNA, herein designated GAM PRECURSOR RNA. Similar to other miRNA genes, and unlike most ordinary genes, GAM130 precursor RNA does not encode a protein. A nucleotide sequence identical or highly similar to the nucleotide sequence of GAM130 precursor RNA is designated SEQ ID:127, and is provided hereinbelow with reference to the sequence listing part.

GAM130 precursor RNA folds onto itself, forming GAM130 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM130 precursor RNA folds onto itself, forming GAM130 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM130 precursor RNA, designated SEQ-ID:127, and a schematic representation of a predicted secondary folding of GAM130 folded precursor RNA are further described with reference to Table 2, hereby incorporated by reference.

An enzyme complex designated DICER COMPLEX, 'dices' the GAM130 folded precursor RNA into GAM130 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM130 RNA is designated SEQ ID:331, and is provided hereinbelow with references to the sequence listing part and Table 3, hereby incorporated by reference.

GAM130 target gene, herein designated TARGET GENE, encodes a corresponding messenger RNA, GAM130 target RNA, herein designated GAM TARGET RNA. GAM130 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM130 RNA, herein designated GAM RNA, binds complementarily to one or more target binding sites located in untranslated regions of GAM130 target RNA, herein designated GAM TARGET RNA. This complementary binding is due to the fact that the nucleotide sequence of GAM130 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM130 RNA may have a different number of target binding sites in untranslated regions of a GAM130 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM130 RNA, herein designated GAM RNA, to target binding sites on GAM130 target RNA, herein designated GAM TARGET RNA, such as BINDING SITE I, BINDING SITE II and BINDING SITE III, inhibits translation of GAM130 target RNA into GAM130 target protein, herein designated GAM TARGET PROTEIN. GAM target protein is therefore outlined by a broken line.

It is appreciated that GAM130 target gene, herein designated TARGET GENE, in fact represents a plurality of GAM130 target genes. The mRNA of each one of this plurality of GAM130 target genes comprises one or more target binding sites, each having a nucleotide sequence which is at least partly complementary to GAM130 RNA, herein designated GAM RNA, and which when bound by GAM130 RNA causes inhibition of translation of respective one or more GAM130 target proteins.

It is further appreciated by one skilled in the art that the mode of translational inhibition illustrated by FIG. 8 with specific reference to translational inhibition exerted by GAM130 gene, herein designated GAM GENE, on one or more GAM130 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM130 correlate with, and may be deduced from, the identity of the target genes which GAM130 binds and inhibits, and the function of these target genes, as elaborated hereinbelow.

Alpha-1-b glycoprotein (A1BG, Accession NP_570602.2) is a GAM130 target gene, herein designated TARGET GENE. A1BG BINDING SITE is a target binding site found in the 3' untranslated region of mRNA encoded by A1BG, corresponding to a target binding site such as BINDING SITE I, BINDING SITE II or BINDING SITE III of FIG. 8. Table 4 illustrates the complementarity of the nucleotide sequences of A1BG BINDING SITE, designated SEQ ID:6105, to the nucleotide sequence of GAM130 RNA, herein designated GAM RNA, also designated SEQ ID:331.

A function of GAM130 is therefore inhibition of Alpha-1-b glycoprotein (A1BG, Accession NP_570602.2), a gene which a plasma protein of unknown function. Accordingly, utilities of GAM130 include diagnosis, prevention and treatment of diseases and clinical conditions associated with A1BG.

The function of A1BG has been established by previous studies. The complete amino acid sequence of alpha-1B-glycoprotein, a plasma protein of unknown function, was determined by Ishioka et al. (1986). Sequence homology to immunoglobulins was recognized. Alpha-1B-glycoprotein is present in normal adult plasma at an average concentration of 22 mg/dl. Gahne et al. (1987) observed genetic polymorphism of A1B using one-dimensional horizontal polyacrylamide gel electrophoresis followed by Western blotting with specific antiserum. Three different phenotypes, designated 1-1, 1-2, and 2-2, were observed. Family data supported the hypothesis that the three phenotypes are determined by 2 codominant alleles at an autosomal locus. In pigs the homologous locus is linked to malignant hyperthermia (OMIM Ref. No. 145600). Several other linkages in pigs and in horses suggest that human chromosomes 19, 6, and 1 are 'candidate chromosomes' for bearing the human A1B. Juneja et al. (1988) found a higher degree of A1B polymorphism in American blacks than in Caucasian populations. They described new alleles. Eiberg et al. (1989) reported exclusion data for localization of the alpha-1B-glycoprotein gene polymorphism. Eiberg et al. (1989) found linkage between A1BG and Lutheran blood group (OMIM Ref. No. 111150); lod =3.06 at theta =0.05 in males, and lod =1.42 at theta =0.10 in females. They suggested that the most likely order of genes on chromosome 19 is C3-SE-LU-A1BG.

Full details of the abovementioned studies are described in the following publications, the disclosure of which are hereby incorporated by reference:

Ishioka, N.; Takahashi, N.; Putnam, F. W.: Amino acid sequence of human plasma alpha- 1B-glycoprotein: homology to the immunoglobulin supergene family. Proc. Nat. Acad. Sci. 83:2363-2367, 1986; and Eiberg, H.; Bisgaard, M. L.; Mohr, J.: Linkage between alpha-1-B-glycoprotein (A1BG) and Lutheran (LU) red blood group system: assignment to chromosome 19: new genetic variants of A1BG.

Further studies establishing the function and utilities of A1BG are found in John Hopkins OMIM database record ID 138670, and in cited publications listed in Table 5, which are hereby incorporated by reference. AAK1 (Accession NP_055726.2) is another GAM130 target gene, herein designated TARGET GENE. AAK1 BINDING SITE is a target binding site found in the 3' untranslated region of mRNA encoded by AAK1, corresponding to a target binding site such as BINDING SITE I, BINDING SITE II or BINDING SITE III of FIG. 8. Table 4 illustrates the complementarity of the nucleotide sequences of AAK1 BINDING SITE, designated SEQ ID:7111, to the nucleotide sequence of GAM130 RNA, herein designated GAM RNA, also designated SEQ ID:331.

Another function of GAM130 is therefore inhibition of AAK1 (Accession NP_055726.2). Accordingly, utilities of GAM130 include diagnosis, prevention and treatment of diseases and clinical conditions associated with AAK1.

AD7C-NTP (Accession NP_055301.1) is another GAM130 target gene, herein designated TARGET GENE. AD7C-NTP BINDING SITE1 and AD7C-NTP BINDING SITE2 are target binding sites found in untranslated regions of mRNA encoded by AD7C-NTP, corresponding to target binding sites such as BINDING SITE I, BINDING SITE II or BINDING SITE III of FIG. 8. Table 4 illustrates the complementarity of the nucleotide sequences of AD7C-NTP BINDING SITE1 and AD7C-NTP BINDING SITE2, designated SEQ ID:18860 and SEQ ID:9687 respectively, to the nucleotide sequence of GAM130 RNA, herein designated GAM RNA, also designated SEQ ID:331.

Another function of GAM130 is therefore inhibition of AD7C-NTP (Accession NP_055301.1). Accordingly, utilities of GAM130 include diagnosis, prevention and treatment of diseases and clinical conditions associated with AD7C-NTP.

Apc11 anaphase promoting complex subunit 11 homolog (yeast) (ANAPC11, Accession NP_057560.8) is another GAM130 target gene, herein designated TARGET GENE. ANAPC11 BINDING SITE is a target binding site found in the 5' untranslated region of mRNA encoded by ANAPC11, corresponding to a target binding site such as BINDING SITE I, BINDING SITE II or BINDING SITE III of FIG. 8. Table 4 illustrates the complementarity of the nucleotide sequences of ANAPC11 BINDING SITE, designated SEQ ID:10495, to the nucleotide sequence of GAM130 RNA, herein designated GAM RNA, also designated SEQ ID:331.

Another function of GAM130 is therefore inhibition of Apc11 anaphase promoting complex subunit 11 homolog (yeast) (ANAPC11, Accession NP_057560.8). Accordingly, utilities of GAM130 include diagnosis, prevention and treatment of diseases and clinical conditions associated with ANAPC11.

Adaptor-related protein complex 1, mu 1 subunit (AP1M1, Accession NP_115882.1) is another GAM130 target gene, herein designated TARGET GENE. AP1M1 BINDING SITE is a target binding site found in the 3' untranslated region of mRNA encoded by AP1M1, corresponding to a target binding site such as BINDING SITE I, BINDING SITE II or BINDING SITE III of FIG. 8. Table 4 illustrates the complementarity of the nucleotide sequences of AP1M1 BINDING SITE, designated SEQ ID:4671, to the nucleotide sequence of GAM130 RNA, herein designated GAM RNA, also designated SEQ ID:331.

Another function of GAM130 is therefore inhibition of Adaptor-related protein complex 1, mu 1 subunit (AP1M1, Accession NP_115882.1), a gene which promotes the formation of clathrin-coated pits and vesicles. Accordingly, utilities of GAM130 include diagnosis, prevention and treatment of diseases and clinical conditions associated with AP1M1.

The function of AP1M1 has been established by previous studies. Heterotetrameric adaptor complexes promote the formation of clathrin-coated pits and vesicles. The AP-1 adaptor, localized at the trans-Golgi network, is composed of 2 approximately 100-kD subunits, beta-prime adaptin (OMIM Ref. No. 600157) and gamma-adaptin (OMIM Ref. No. 603533); a medium subunit, AP47; and a small subunit, AP19 (OMIM Ref. No. 603531). Nakayama et al. (1991) isolated a mouse brain cDNA encoding AP47.

Full details of the abovementioned studies are described in the following publications, the disclosure of which are hereby incorporated by reference:

Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002; and Nakayama, Y.; Goebl, M.; O'Brine Greco, B.; Lemmon, S.; Pingchang Chow, E.; Kirchhausen, T.: The medium chains of the mammalian clathrin-associated proteins have a homolog in yeast. E.

Further studies establishing the function and utilities of AP1M1 are found in John Hopkins OMIM database record ID 603535, and in cited publications listed in Table 5, which are hereby incorporated by reference. APM1 (Accession NP_004788.1) is another GAM130 target gene, herein designated TARGET GENE. APM1 BINDING SITE is a target binding site found in the 3' untranslated region of mRNA encoded by APM1, corresponding to a target binding site such as BINDING SITE I, BINDING SITE II or BINDING SITE III of FIG. 8. Table 4 illustrates the complementarity of the nucleotide sequences of APM1 BINDING SITE, designated SEQ ID:4972, to the nucleotide sequence of GAM130 RNA, herein designated GAM RNA, also designated SEQ ID:331.

Another function of GAM130 is therefore inhibition of APM1 (Accession NP_004788.1). Accordingly, utilities of GAM130 include diagnosis, prevention and treatment of diseases and clinical conditions associated with APM1.

Apolipoprotein a-v (APOA5, Accession NP_443200.1) is another GAM130 target gene, herein designated TARGET GENE. APOA5 BINDING SITE is a target binding site found in the 3' untranslated region of mRNA encoded by APOA5, corresponding to a target binding site such as BINDING SITE I, BINDING SITE II or BINDING SITE III of FIG. 8. Table 4 illustrates the complementarity of the nucleotide sequences of APOA5 BINDING SITE, designated SEQ ID:9130, to the nucleotide sequence of GAM130 RNA, herein designated GAM RNA, also designated SEQ ID:331.

Another function of GAM130 is therefore inhibition of Apolipoprotein a-v (APOA5, Accession NP_443200.1). Accordingly, utilities of GAM130 include diagnosis, prevention and treatment of diseases and clinical conditions associated with APOA5.

Amyloid beta precursor protein (cytoplasmic tail) binding protein 2 (APPBP2, Accession NP_006371.2) is another GAM130 target gene, herein designated TARGET GENE. APPBP2 BINDING SITE is a target binding site found in the 3' untranslated region of mRNA encoded by APPBP2, corresponding to a target binding site such as BINDING SITE I, BINDING SITE II or BINDING SITE III of FIG. 8. Table 4 illustrates the complementarity of the nucleotide sequences of APPBP2 BINDING SITE, designated SEQ ID:6678, to the nucleotide sequence of GAM130 RNA, herein designated GAM RNA, also designated SEQ ID:331.

Another function of GAM130 is therefore inhibition of Amyloid beta precursor protein (cytoplasmic tail) binding protein 2 (APPBP2, Accession NP_006371.2), a gene which interacts with the basolateral sorting signal of amyloid precursor protein. and therefore may be associated with Alzheimer's disease. Accordingly, utilities of GAM130 include diagnosis, prevention and treatment of Alzheimer's disease, and of other diseases and clinical conditions associated with APPBP2.

The function of APPBP2 has been established by previous studies. Epithelial cell surfaces are divided into apical and basolateral domains. The basolateral sorting of cell surface proteins depends on the presence of peptide-based basolateral sorting signals (BaSS) in the cytoplasmic domains of proteins. Amyloid precursor protein (APP; 104760), a basolateral protein implicated in the pathogenesis of Alzheimer disease (AD; 104300), contains a tyrosine-based BaSS. Mutation of the tyrosine results in nonpolarized transport of APP. Using APP-BaSS as bait in a yeast 2-hybrid screen of a HeLa cell cDNA library, followed by negative selection with a tyr-ala mutant APP-BaSS as bait and 5-prime RACE, Zheng et al. (1998) isolated a cDNA encoding amyloid beta precursor protein-binding protein-2 (OMIM Ref. No. APPBP2), which they called PAT1 (protein interacting with APP tail-1). The deduced 585-amino acid hydrophilic APPBP2 protein, which is identical to the uncharacterized KIAA0228 protein identified by Nagase et al. (1996), lacks signal or transmembrane sequences but contains N- and C-terminal globular structures, a coiled coil domain, several protein kinase C phosphorylation sites, and 4 imperfect C-terminal tandem repeats. Binding analysis determined that APPBP2 binds specifically to the tyrosine-containing APP-BaSS and to to the complete cytoplasmic domain of APP; it does not bind to mutant APP-BaSS. Western blot analysis showed that APPBP2 is present as a 70-kD protein in both cytosolic and, together with APP, membrane-associated cell fractions. Immunofluorescence microscopy demonstrated that APPBP2 is present in the Golgi region and that its distribution overlaps that of APP. SDS-PAGE and immunoblotting showed that APPBP2 interacts with microtubules and is functionally associated with APP transport and/or processing. By Northern blot analysis, Nagase et al. (1996) detected ubiquitous expression of KIAA0228 as an approximately 6.5-kb transcript.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996; and Zheng, P.; Eastman, J.; Vande Pol, S.; Pimplikar, S. W.: PAT1, a microtubule- interacting protein, recognizes the basolateral sorting signal of amyloid precursor protein. Proc. Nat. Aca.

Further studies establishing the function and utilities of APPBP2 are found in John Hopkins OMIM database record ID 605324, and in cited publications listed in Table 5, which are hereby incorporated by reference. Ankyrin repeat and socs box-containing 9 (ASB9, Accession NP_076992.1) is another GAM130 target gene, herein designated TARGET GENE. ASB9 BINDING SITE is a target binding site found in the 5' untranslated region of mRNA encoded by ASB9, corresponding to a target binding site such as BINDING SITE I, BINDING SITE II or BINDING SITE III of FIG. 8. Table 4 illustrates the complementarity of the nucleotide sequences of ASB9 BINDING SITE, designated SEQ ID:6639, to the nucleotide sequence of GAM130 RNA, herein designated GAM RNA, also designated SEQ ID:331.

Another function of GAM130 is therefore inhibition of Ankyrin repeat and socs box-containing 9 (ASB9, Accession NP_076992.1). Accordingly, utilities of GAM130 include diagnosis, prevention and treatment of diseases and clinical conditions associated with ASB9.

Atpase, na+/k+ transporting, beta 2 polypeptide (ATP1B2, Accession NP_001669.1) is another GAM130 target gene, herein designated TARGET GENE. ATP1B2 BINDING SITE is a target binding site found in the 3' untranslated region of mRNA encoded by ATP1B2, corresponding to a target binding site such as BINDING SITE I, BINDING SITE II or BINDING SITE III of FIG. 8. Table 4 illustrates the complementarity of the nucleotide sequences of ATP1B2

BINDING SITE, designated SEQ ID:6894, to the nucleotide sequence of GAM130 RNA, herein designated GAM RNA, also designated SEQ ID:331.

Another function of GAM130 is therefore inhibition of Atpase, na+/k+ transporting, beta 2 polypeptide (ATP1B2, Accession NP_001669.1), a gene which catalyzes the hydrolysis of ATP coupled with the exchange of Na +/K+ ions across the plasma membrane. Accordingly, utilities of GAM130 include diagnosis, prevention and treatment of diseases and clinical conditions associated with ATP1B2.

The function of ATP1B2 has been established by previous studies. In the mouse, Malo et al. (1990) mapped the beta-2 subunit of sodium- potassium-ATPase to chromosome 11 in a segment that is conserved on the pericentromeric region of human chromosome 17. Thus, Malo et al. (1990) speculated that the human ATP1B2 gene is on the proximal short arm or pericentric area of chromosome 17. By somatic cell hybrid analysis, Hsieh et al. (1990) demonstrated that the gene is indeed located on human chromosome 17 and confirmed the assignment to mouse chromosome 11, They referred to the gene as AMOG (adhesion molecule on glia). The adhesion molecule on glia is an integral membrane glycoprotein of MW 45-50 K that is expressed by glial cells and mediates granule neuron migration along Bergmann glial cells in the developing cerebellum. The cDNA sequence of the mouse gene (Pagliusi et al., 1989) shows structural similarity to the beta subunit of Na,K-ATPase (ATP1B1; 182330). This enzyme consists of 2 subunits: a catalytic alpha subunit and a beta subunit of unknown function. Like ATP1B1, AMOG is molecularly associated with the alpha subunit and influences its catalytic activity. AMOG may be the same as what is referred to here as ATP1B2. Another beta-isoform gene expressed primarily in brain was isolated by Martin-Vasallo et al. (1989); its sequence is 97% identical to that for AMOG (Gloor et al., 1990). By study of recombinant inbred strains, Hsieh et al. (1990) placed the Amog locus close to the genes for zinc finger protein-3 (OMIM Ref. No. 194480) and the asialoglycoprotein receptor (108360, 108361) in a region of mouse chromosome 11 that is homologous to human 17p.

Full details of the abovementioned studies are described in the following publications, the disclosure of which are hereby incorporated by reference:

Gloor, S.; Antonicek, H.; Sweadner, K. J.; Pagliusi, S.; Frank, R.; Moos, M.; Schachner, M.: The adhesion molecule on glia (AMOG) is a homologue of the beta subunit of the Na,K-ATPase. J. Cell Biol. 110:165-174, 1990; and Martin-Vasallo, P.; Dackowski, P.; Emanuel, J. R.; Levenson, R.: Identification of a putative isoform of the Na,K-ATPase beta subunit: primary structure and tissue- specific expression.

Further studies establishing the function and utilities of ATP1B2 are found in John Hopkins OMIM database record ID 182331, and in cited publications listed in Table 5, which are hereby incorporated by reference. Atpase, (na+)/k+ transporting, beta 4 polypeptide (ATP1B4, Accession NP_036201.1) is another GAM130 target gene, herein designated TARGET GENE. ATP1B4 BINDING SITE is a target binding site found in the 3' untranslated region of mRNA encoded by ATP1B4, corresponding to a target binding site such as BINDING SITE I, BINDING SITE II or BINDING SITE III of FIG. 8. Table 4 illustrates the complementarity of the nucleotide sequences of ATP1B4 BINDING SITE, designated SEQ ID:16642, to the nucleotide sequence of GAM130 RNA, herein designated GAM RNA, also designated SEQ ID:331.

Another function of GAM130 is therefore inhibition of Atpase, (na+)/k+ transporting, beta 4 polypeptide (ATP1B4, Accession NP_036201.1). Accordingly, utilities of GAM130 include diagnosis, prevention and treatment of diseases and clinical conditions associated with ATP1B4.

BA108L7.2 (Accession NP_112233.2) is another GAM130 target gene, herein designated TARGET GENE. BA108L7.2 BINDING SITE is a target binding site found in the 3' untranslated region of mRNA encoded by BA108L7.2, corresponding to a target binding site such as BINDING SITE I, BINDING SITE II or BINDING SITE III of FIG. 8. Table 4 illustrates the complementarity of the nucleotide sequences of BA108L7.2 BINDING SITE, designated SEQ ID:2887, to the nucleotide sequence of GAM130 RNA, herein designated GAM RNA, also designated SEQ ID:331.

Another function of GAM130 is therefore inhibition of BA108L7.2 (Accession NP_112233.2). Accordingly, utilities of GAM130 include diagnosis, prevention and treatment of diseases and clinical conditions associated with BA108L7.2.

Bcl2-associated athanogene 5 (BAG5, Accession NP_004864.1) is another GAM130 target gene, herein designated TARGET GENE. BAG5 BINDING SITE is a target binding site found in the 3' untranslated region of mRNA encoded by BAG5, corresponding to a target binding site such as BINDING SITE I, BINDING SITE II or BINDING SITE III of FIG. 8. Table 4 illustrates the complementarity of the nucleotide sequences of BAG5 BINDING SITE, designated SEQ ID:770, to the nucleotide sequence of GAM130 RNA, herein designated GAM RNA, also designated SEQ ID:331.

Another function of GAM130 is therefore inhibition of Bcl2-associated athanogene 5 (BAG5, Accession NP_004864.1). Accordingly, utilities of GAM130 include diagnosis, prevention and treatment of diseases and clinical conditions associated with BAG5.

B melanoma antigen (BAGE, Accession NP_001178.1) is another GAM130 target gene, herein designated TARGET GENE. BAGE BINDING SITE is a target binding site found in the 3' untranslated region of mRNA encoded by BAGE, corresponding to a target binding site such as BINDING SITE I, BINDING SITE II or BINDING SITE III of FIG. 8. Table 4 illustrates the complementarity of the nucleotide sequences of BAGE BINDING SITE, designated SEQ ID:15169, to the nucleotide sequence of GAM130 RNA, herein designated GAM RNA, also designated SEQ ID:331.

Another function of GAM130 is therefore inhibition of B melanoma antigen (BAGE, Accession NP_001178.1). Accordingly, utilities of GAM130 include diagnosis, prevention and treatment of diseases and clinical conditions associated with BAGE.

BHD (Accession NP_659434.2) is another GAM130 target gene, herein designated TARGET GENE. BHD BINDING SITE is a target binding site found in the 3' untranslated region of multiple transcripts of mRNA encoded by BHD, corresponding to a target binding site such as BINDING SITE I, BINDING SITE II or BINDING SITE III of FIG. 8. Table 4 illustrates the complementarity of the nucleotide sequences of BHD BINDING SITE, designated SEQ ID:19933, to the nucleotide sequence of GAM130 RNA, herein designated GAM RNA, also designated SEQ ID:331.

Another function of GAM130 is therefore inhibition of BHD (Accession NP_659434.2). Accordingly, utilities of GAM130 include diagnosis, prevention and treatment of diseases and clinical conditions associated with BHD.

C14orf102 (Accession NP_060440.1) is another GAM130 target gene, herein designated TARGET GENE. C14orf102 BINDING SITE is a target binding site found in the 3' untranslated region of mRNA encoded by C14orf102, corresponding to a target binding site such as BINDING SITE I, BINDING SITE II or BINDING SITE III of FIG. 8. Table 4 illustrates the complementarity of the nucleotide sequences of C14orf102 BINDING SITE, designated SEQ ID:11571, to the nucleotide sequence of GAM130 RNA, herein designated GAM RNA, also designated SEQ ID:331.

Another function of GAM130 is therefore inhibition of C14orf102 (Accession NP_060440.1). Accordingly, utilities of GAM130 include diagnosis, prevention and treatment of diseases and clinical conditions associated with C14orf102.

C14orf113 (Accession NP_060100.1) is another GAM130 target gene, herein designated TARGET GENE. C14orf113 BINDING SITE is a target binding site found in the 3' untranslated region of mRNA encoded by C14orf113, corresponding to a target binding site such as BINDING SITE I, BINDING SITE II or BINDING SITE III of FIG. 8. Table 4 illustrates the complementarity of the nucleotide sequences of C14orf113 BINDING SITE, designated SEQ ID:19332, to the nucleotide sequence of GAM130 RNA, herein designated GAM RNA, also designated SEQ ID:331.

Another function of GAM130 is therefore inhibition of C14orf113 (Accession NP_060100.1). Accordingly, utilities of GAM130 include diagnosis, prevention and treatment of diseases and clinical conditions associated with C14orf113.

Chromosome 21 open reading frame 51 (C21orf51, Accession NP_478062.1) is another GAM130 target gene, herein designated TARGET GENE. C21orf51 BINDING SITE is a target binding site found in the 3' untranslated region of mRNA encoded by C21orf51, corresponding to a target binding site such as BINDING SITE I, BINDING SITE II or BINDING SITE III of FIG. 8. Table 4 illustrates the complementarity of the nucleotide sequences of C21orf51 BINDING SITE, designated SEQ ID:17801, to the nucleotide sequence of GAM130 RNA, herein designated GAM RNA, also designated SEQ ID:331.

Another function of GAM130 is therefore inhibition of Chromosome 21 open reading frame 51 (C21orf51, Accession NP_478062.1). Accordingly, utilities of GAM130 include diagnosis, prevention and treatment of diseases and clinical conditions associated with C21orf51.

C4orf9 (Accession XP_035572.1) is another GAM130 target gene, herein designated TARGET GENE. C4orf9 BINDING SITE is a target binding site found in the 3' untranslated region of mRNA encoded by C4orf9, corresponding to a target binding site such as BINDING SITE I, BINDING SITE II or BINDING SITE III of FIG. 8. Table 4 illustrates the complementarity of the nucleotide sequences of C4orf9 BINDING SITE, designated SEQ ID:6895, to the nucleotide sequence of GAM130 RNA, herein designated GAM RNA, also designated SEQ ID:331.

Another function of GAM130 is therefore inhibition of C4orf9 (Accession XP_035572.1). Accordingly, utilities of GAM130 include diagnosis, prevention and treatment of diseases and clinical conditions associated with C4orf9.

Chromosome 9 open reading frame 9 (C9orf9, Accession NP_061829.2) is another GAM130 target gene, herein designated TARGET GENE. C9orf9 BINDING SITE is a target binding site found in the 3' untranslated region of mRNA encoded by C9orf9, corresponding to a target binding site such as BINDING SITE I, BINDING SITE II or BINDING SITE III of FIG. 8. Table 4 illustrates the complementarity of the nucleotide sequences of C9orf9 BINDING SITE, designated SEQ ID:20130, to the nucleotide sequence of GAM130 RNA, herein designated GAM RNA, also designated SEQ ID:331.

Another function of GAM130 is therefore inhibition of Chromosome 9 open reading frame 9 (C9orf9, Accession NP_061829.2). Accordingly, utilities of GAM130 include diagnosis, prevention and treatment of diseases and clinical conditions associated with C9orf9.

Calcium modulating ligand (CAMLG, Accession NP_001736.1) is another GAM130 target gene, herein designated TARGET GENE. CAMLG BINDING SITE is a target binding site found in the 3' untranslated region of mRNA encoded by CAMLG, corresponding to a target binding site such as BINDING SITE I, BINDING SITE II or BINDING SITE III of FIG. 8. Table 4 illustrates the complementarity of the nucleotide sequences of CAMLG BINDING SITE, designated SEQ ID:16032, to the nucleotide sequence of GAM130 RNA, herein designated GAM RNA, also designated SEQ ID:331.

Another function of GAM130 is therefore inhibition of Calcium modulating ligand (CAMLG, Accession NP_001736.1), a gene which is likely involved in the mobilization of calcium as a result of the tcr/cd3 complex interaction. Accordingly, utilities of GAM130 include diagnosis, prevention and treatment of diseases and clinical conditions associated with CAMLG.

The function of CAMLG has been established by previous studies. Calcium-modulating cyclophilin ligand was discovered by Bram and Crabtree (1994) in a 2-hybrid screen for signaling molecules that interact with cyclophilin B (OMIM Ref. No. 123841). It appears to be involved in the regulation of calcium signaling to T lymphocytes and other cells. The murine gene, symbolized Caml, was localized by interspecific backcross analysis of the middle of chromosome 13. By fluorescence in situ hybridization, Bram et al. (1996) localized the human CAMLG gene to chromosome 5q23, a region known to be syntenic to mouse chromosome 13.

Full details of the abovementioned studies are described in the following publications, the disclosure of which are hereby incorporated by reference:

Bram, R. J.; Crabtree, G. R.: Calcium signalling in T cells stimulated by a cyclophilin B-binding protein. Nature 371: 355-358, 1994; and Bram, R. J.; Valentine, V.; Shapiro, D. N.; Jenkins, N. A.; Gilbert, D. J.; Copeland, N. G.: The gene for calcium-modulating cyclophilin ligand (CAMLG) is located on human chromosome 5.

Further studies establishing the function and utilities of CAMLG are found in John Hopkins OMIM database record ID 601118, and in cited publications listed in Table 5, which are hereby incorporated by reference. Caspase recruitment domain family, member 6 (CARD6, Accession NP_115976.2) is another GAM130 target gene, herein designated TARGET GENE. CARD6 BINDING SITE is a target binding site found in the 3' untranslated region of mRNA encoded by CARD6, corresponding to a target binding site such as BINDING SITE I, BINDING SITE II or BINDING SITE III of FIG. 8. Table 4 illustrates the complementarity of the nucleotide sequences of CARD6 BINDING SITE, designated SEQ ID:2870, to the nucleotide sequence of GAM130 RNA, herein designated GAM RNA, also designated SEQ ID:331.

Another function of GAM130 is therefore inhibition of Caspase recruitment domain family, member 6 (CARD6, Accession NP_115976.2) . Accordingly, utilities of GAM130 include diagnosis, prevention and treatment of diseases and clinical conditions associated with CARD6.

Core-binding factor, runt domain, alpha subunit 2; translocated to, 2 (CBFA2T2, Accession NP_005084.1) is another GAM130 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:3576, to the nucleotide sequence of GAM130 RNA, herein designated GAM RNA, also designated SEQ ID:331.

Another function of GAM130 is therefore inhibition of Core-binding factor, runt domain, alpha subunit 2; translocated to, 2 (CBFA2T2, Accession NP_005084.1), a gene which is a putative transcription factor. Accordingly, utilities of GAM130 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Core-binding factor, runt domain, alpha subunit 2; translocated to, 2 (CBFA2T2, Accession NP_787060.1) is another GAM130 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:3576, to the nucleotide sequence of GAM130 RNA, herein designated GAM RNA, also designated SEQ ID:331.

Another function of GAM130 is therefore inhibition of Core-binding factor, runt domain, alpha subunit 2; translocated to, 2 (CBFA2T2, Accession NP_787060.1), a gene which is a putative transcription factor. Accordingly, utilities of GAM130 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Chemokine (c-c motif) ligand 22 (CCL22, Accession NP_002981.2) is another GAM130 target gene, herein designated TARGET GENE. CCL22 BINDING SITE is a target binding site found in the 3' untranslated region of mRNA encoded by CCL22, corresponding to a target binding site such as BINDING SITE I, BINDING SITE II or BINDING SITE III of FIG. 8. Table 4 illustrates the complementarity of the nucleotide sequences of CCL22 BINDING SITE, designated SEQ ID:18224, to the nucleotide sequence of GAM130 RNA, herein designated GAM RNA, also designated SEQ ID:331.

Another function of GAM130 is therefore inhibition of Chemokine (c-c motif) ligand 22 (CCL22, Accession NP_002981.2). Accordingly, utilities of GAM130 include diagnosis, prevention and treatment of diseases and clinical conditions associated with CCL22.

Cyclin f (CCNF, Accession NP_001752.1) is another GAM130 target gene, herein designated TARGET GENE. CCNF BINDING SITE is a target binding site found in the 3' untranslated region of mRNA encoded by CCNF, corresponding to a target binding site such as BINDING SITE I, BINDING SITE II or BINDING SITE III of FIG. 8. Table 4 illustrates the complementarity of the nucleotide sequences of CCNF BINDING SITE, designated SEQ ID:3240, to the nucleotide sequence of GAM130 RNA, herein designated GAM RNA, also designated SEQ ID:331.

Another function of GAM130 is therefore inhibition of Cyclin f (CCNF, Accession NP_001752.1), a gene which likely to be involved in the control of the cell cycle during s phase and g2. Accordingly, utilities of GAM130 include diagnosis, prevention and treatment of diseases and clinical conditions associated with CCNF.

The function of CCNF has been established by previous studies. While searching in the 16p13.3 region for candidate genes for autosomal dominant polycystic kidney disease (PKD1; 173900), Kraus et al. (1994) identified a new member of the cyclin family. They characterized the transcript by sequencing, determination of exon/intron boundaries, and Northern blot analysis. Cyclin F is related to cyclins A (CCNA; 123835) and B (CCNB; 123836) by sequence, but its function is unknown. Cyclin F is the largest known human cyclin. Obermayr et al. (1995) mapped the gene to mouse chromosome 17 by analysis of hamster/mouse or human/mouse somatic cell hybrids containing Robertsonian translocations. For more accurate mapping, they used the BXD recombinant inbred strain system. Bai et al. (1996) determined that SKP1 (OMIM Ref. No. 601434) binds to CCNF, SKP2 (OMIM Ref. No. 601436), and potentially to other regulatory proteins that may be involved in ubiquitin proteolysis. Binding occurs through a novel motif, termed the F box. The F box contains about 40 residues and, in approximately half of the F-box proteins identified by Bai et al. (1996), it was associated with leucine-rich regions (LRRs), as in SKP2, or with WD40 repeats, as in BTRC (OMIM Ref. No. 603482). The F-box only proteins, including CCNF, contain no other recognizable motifs.

Full details of the abovementioned studies are described in the following publications, the disclosure of which are hereby incorporated by reference:

Kraus, B.; Pohlschmidt, M.; Leung, A. L. S.; Germino, G. G.; Snarey, A.; Schneider, M. C.; Reeders, S. T.; Frischauf, A.-M.: A novel cyclin gene (CCNF) in the region of the polycystic kidney disease gene (PKD1). Genomics 24:27-33, 1994; and Bai, C.; Sen, P.; Hofmann, K.; Ma, L.; Goebl, M.; Harper, J. W.; Elledge, S. J.: SKP1 connects cell cycle regulators to the ubiquitin proteolysis machinery through a novel motif, the F.

Further studies establishing the function and utilities of CCNF are found in John Hopkins OMIM database record ID 600227, and in cited publications listed in Table 5, which are hereby incorporated by reference. Cd209 antigen (CD209, Accession NP_066978.1) is another GAM130 target gene, herein designated TARGET GENE. CD209 BINDING SITE is a target binding site found in the 3' untranslated region of mRNA encoded by CD209, corresponding to a target binding site such as BINDING SITE I, BINDING SITE II or BINDING SITE III of FIG. 8. Table 4 illustrates the complementarity of the nucleotide sequences of CD209 BINDING SITE, designated SEQ ID:7192, to the nucleotide sequence of GAM130 RNA, herein designated GAM RNA, also designated SEQ ID:331.

Another function of GAM130 is therefore inhibition of Cd209 antigen (CD209, Accession NP_066978.1), a gene which may play an important role in the CD4-independent association of HIV with cells. Accordingly, utilities of GAM130 include diagnosis, prevention and treatment of diseases and clinical conditions associated with CD209.

The function of CD209 and its association with various diseases and clinical conditions, has been established by previous studies, as described hereinabove with reference to GAM96.1. Cdc14 cell division cycle 14 homolog b (s. cerevisiae) (CDC14B, Accession NP_201589.1) is another GAM130 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:2262, to the nucleotide sequence of GAM130 RNA, herein designated GAM RNA, also designated SEQ ID:331.

Another function of GAM130 is therefore inhibition of Cdc14 cell division cycle 14 homolog b (s. cerevisiae) (CDC14B, Accession NP__201589.1). Accordingly, utilities of GAM130 include diagnosis, prevention and treatment of diseases and clinical conditions associated with CDC14B.

CDKAL1 (Accession NP__060244.1) is another GAM130 target gene, herein designated TARGET GENE. CDKAL1 BINDING SITE is a target binding site found in the 3' untranslated region of mRNA encoded by CDKAL1, corresponding to a target binding site such as BINDING SITE I, BINDING SITE II or BINDING SITE III of FIG. 8. Table 4 illustrates the complementarity of the nucleotide sequences of CDKAL1 BINDING SITE, designated SEQ ID:2168, to the nucleotide sequence of GAM130 RNA, herein designated GAM RNA, also designated SEQ ID:331.

Another function of GAM130 is therefore inhibition of CDKAL1 (Accession NP__060244.1). Accordingly, utilities of GAM130 include diagnosis, prevention and treatment of diseases and clinical conditions associated with CDKAL1.

Cat eye syndrome chromosome region, candidate 1 (CECR1, Accession NP__059120.2) is another GAM130 target gene, herein designated TARGET GENE. CECR1 BINDING SITE is a target binding site found in the 3' untranslated region of multiple transcripts of mRNA encoded by CECR1, corresponding to a target binding site such as BINDING SITE I, BINDING SITE II or BINDING SITE III of FIG. 8. Table 4 illustrates the complementarity of the nucleotide sequences of CECR1 BINDING SITE, designated SEQ ID:15627, to the nucleotide sequence of GAM130 RNA, herein designated GAM RNA, also designated SEQ ID:331.

Another function of GAM130 is therefore inhibition of Cat eye syndrome chromosome region, candidate 1 (CECR1, Accession NP__059120.2). Accordingly, utilities of GAM130 include diagnosis, prevention and treatment of diseases and clinical conditions associated with CECR1.

Cat eye syndrome chromosome region, candidate 1 (CECR1, Accession NP__803124.1) is another GAM130 target gene, herein designated TARGET GENE. CECR1 BINDING SITE is a target binding site found in the 3' untranslated region of multiple transcripts of mRNA encoded by CECR1, corresponding to a target binding site such as BINDING SITE I, BINDING SITE II or BINDING SITE III of FIG. 8. Table 4 illustrates the complementarity of the nucleotide sequences of CECR1 BINDING SITE, designated SEQ ID:15627, to the nucleotide sequence of GAM130 RNA, herein designated GAM RNA, also designated SEQ ID:331.

Another function of GAM130 is therefore inhibition of Cat eye syndrome chromosome region, candidate 1 (CECR1, Accession NP__803124.1). Accordingly, utilities of GAM130 include diagnosis, prevention and treatment of diseases and clinical conditions associated with CECR1.

Centromere protein h (CENPH, Accession NP__075060.1) is another GAM130 target gene, herein designated TARGET GENE. CENPH BINDING SITE is a target binding site found in the 3' untranslated region of mRNA encoded by CENPH, corresponding to a target binding site such as BINDING SITE I, BINDING SITE II or BINDING SITE III of FIG. 8. Table 4 illustrates the complementarity of the nucleotide sequences of CENPH BINDING SITE, designated SEQ ID:14626, to the nucleotide sequence of GAM130 RNA, herein designated GAM RNA, also designated SEQ ID:331.

Another function of GAM130 is therefore inhibition of Centromere protein h (CENPH, Accession NP__075060.1). Accordingly, utilities of GAM130 include diagnosis, prevention and treatment of diseases and clinical conditions associated with CENPH.

CGI-18 (Accession NP__057031.1) is another GAM130 target gene, herein designated TARGET GENE. CGI-18 BINDING SITE is a target binding site found in the 5' untranslated region of mRNA encoded by CGI-18, corresponding to a target binding site such as BINDING SITE I, BINDING SITE II or BINDING SITE III of FIG. 8. Table 4 illustrates the complementarity of the nucleotide sequences of CGI-18 BINDING SITE, designated SEQ ID:8151, to the nucleotide sequence of GAM130 RNA, herein designated GAM RNA, also designated SEQ ID:331.

Another function of GAM130 is therefore inhibition of CGI-18 (Accession NP__057031.1). Accordingly, utilities of GAM130 include diagnosis, prevention and treatment of diseases and clinical conditions associated with CGI-18.

C-type (calcium dependent, carbohydrate-recognition domain) lectin, superfamily member 12 (CLECSF12, Accession NP__072092.2) is another GAM130 target gene, herein designated TARGET GENE. CLECSF12 BINDING SITE is a target binding site found in the 3' untranslated region of mRNA encoded by CLECSF12, corresponding to a target binding site such as BINDING SITE I, BINDING SITE II or BINDING SITE III of FIG. 8. Table 4 illustrates the complementarity of the nucleotide sequences of CLECSF12 BINDING SITE, designated SEQ ID:16032, to the nucleotide sequence of GAM130 RNA, herein designated GAM RNA, also designated SEQ ID:331.

Another function of GAM130 is therefore inhibition of C-type (calcium dependent, carbohydrate-recognition domain) lectin, superfamily member 12 (CLECSF12, Accession NP__072092.2), a gene which is a pattern- recognition receptor . Accordingly, utilities of GAM130 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. Cox15 homolog, cytochrome c oxidase assembly protein (yeast) (COX15, Accession NP__510870.1) is another GAM130 target gene, herein designated TARGET GENE. COX15 BINDING SITE is a target binding site found in the 3' untranslated region of multiple transcripts of mRNA encoded by COX15, corresponding to a target binding site such as BINDING SITE I, BINDING SITE II or BINDING SITE III of FIG. 8. Table 4 illustrates the complementarity of the nucleotide sequences of COX15 BINDING SITE, designated SEQ ID:2870, to the nucleotide sequence of GAM130 RNA, herein designated GAM RNA, also designated SEQ ID:331.

Another function of GAM130 is therefore inhibition of Cox15 homolog, cytochrome c oxidase assembly protein (yeast) (COX15, Accession NP__510870.1). Accordingly, utilities of GAM130 include diagnosis, prevention and treatment of diseases and clinical conditions associated with COX15.

Carboxypeptidase a4 (CPA4, Accession NP__057436.1) is another GAM130 target gene, herein designated TARGET GENE. CPA4 BINDING SITE is a target binding site found in the 3' untranslated region of mRNA encoded by CPA4, corresponding to a target binding site such as BINDING SITE I, BINDING SITE II or BINDING SITE III of FIG. 8. Table 4 illustrates the complementarity of the nucleotide sequences of CPA4 BINDING SITE, designated SEQ ID:14507, to the nucleotide sequence of GAM130 RNA, herein designated GAM RNA, also designated SEQ ID:331.

Another function of GAM130 is therefore inhibition of Carboxypeptidase a4 (CPA4, Accession NP_057436.1). Accordingly, utilities of GAM130 include diagnosis, prevention and treatment of diseases and clinical conditions associated with CPA4.

Cleavage and polyadenylation specific factor 2, 100 kda (CPSF2, Accession XP_029311.2) is another GAM130 target gene, herein designated TARGET GENE. CPSF2 BINDING SITE is a target binding site found in the 3' untranslated region of mRNA encoded by CPSF2, corresponding to a target binding site such as BINDING SITE I, BINDING SITE II or BINDING SITE III of FIG. 8. Table 4 illustrates the complementarity of the nucleotide sequences of CPSF2 BINDING SITE, designated SEQ ID:7534, to the nucleotide sequence of GAM130 RNA, herein designated GAM RNA, also designated SEQ ID:331.

Another function of GAM130 is therefore inhibition of Cleavage and polyadenylation specific factor 2, 100 kda (CPSF2, Accession XP_029311.2). Accordingly, utilities of GAM130 include diagnosis, prevention and treatment of diseases and clinical conditions associated with CPSF2.

CYCS (Accession NP_061820.1) is another GAM130 target gene, herein designated TARGET GENE. CYCS BINDING SITE1 and CYCS BINDING SITE2 are target binding sites found in untranslated regions of mRNA encoded by CYCS, corresponding to target binding sites such as BINDING SITE I, BINDING SITE II or BINDING SITE III of FIG. 8. Table 4 illustrates the complementarity of the nucleotide sequences of CYCS BINDING SITE1 and CYCS BINDING SITE2, designated SEQ ID:5106 and SEQ ID:18712 respectively, to the nucleotide sequence of GAM130 RNA, herein designated GAM RNA, also designated SEQ ID:331.

Another function of GAM130 is therefore inhibition of CYCS (Accession NP_061820.1). Accordingly, utilities of GAM130 include diagnosis, prevention and treatment of diseases and clinical conditions associated with CYCS.

Debranching enzyme homolog 1 (s. cerevisiae) (DBR1, Accession NP_057300.1) is another GAM130 target gene, herein designated TARGET GENE. DBR1 BINDING SITE is a target binding site found in the 3' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:1786, to the nucleotide sequence of GAM130 RNA, herein designated GAM RNA, also designated SEQ ID:331.

Another function of GAM130 is therefore inhibition of Debranching enzyme homolog 1 (s. cerevisiae) (DBR1, Accession NP_057300.1). Accordingly, utilities of GAM130 include diagnosis, prevention and treatment of diseases and clinical conditions associated with DBR1.

DCTN6 (Accession NP_006562.1) is another GAM130 target gene, herein designated TARGET GENE. DCTN6 BINDING SITE is a target binding site found in the 3' untranslated region of mRNA encoded by DCTN6, corresponding to a target binding site such as BINDING SITE I, BINDING SITE II or BINDING SITE III of FIG. 8. Table 4 illustrates the complementarity of the nucleotide sequences of DCTN6 BINDING SITE, designated SEQ ID:807, to the nucleotide sequence of GAM130 RNA, herein designated GAM RNA, also designated SEQ ID:331.

Another function of GAM130 is therefore inhibition of DCTN6 (Accession NP_006562.1). Accordingly, utilities of GAM130 include diagnosis, prevention and treatment of diseases and clinical conditions associated with DCTN6.

Dead/h (asp-glu-ala-asp/his) box polypeptide 11 (chl1-like helicase homolog, s. cerevisiae) (DDX11, Accession NP_085913.1) is another GAM130 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:14693, to the nucleotide sequence of GAM130 RNA, herein designated GAM RNA, also designated SEQ ID:331.

Another function of GAM130 is therefore inhibition of Dead/h (asp-glu-ala-asp/his) box polypeptide 11 (chl1-like helicase homolog, s. cerevisiae) (DDX11, Accession NP_085913.1), a gene which could be an ATP-dependent DNA-binding helicase and may intervene in cell cycle regulation. Accordingly, utilities of GAM130 include diagnosis, prevention and treatment of diseases and clinical conditions associated with DDX11.

The function of DDX11 and its association with various diseases and clinical conditions, has been established by previous studies, as described hereinabove with reference to GAM63.1. Dna fragmentation factor, 40 kda, beta polypeptide (caspase-activated dnase) (DFFB, Accession NP_004393.1) is another GAM130 target gene, herein designated TARGET GENE. DFFB BINDING SITE is a target binding site found in the 3' untranslated region of mRNA encoded by DFFB, corresponding to a target binding site such as BINDING SITE I, BINDING SITE II or BINDING SITE III of FIG. 8. Table 4 illustrates the complementarity of the nucleotide sequences of DFFB BINDING SITE, designated SEQ ID:11120, to the nucleotide sequence of GAM130 RNA, herein designated GAM RNA, also designated SEQ ID:331.

Another function of GAM130 is therefore inhibition of Dna fragmentation factor, 40 kda, beta polypeptide (caspase-activated dnase) (DFFB, Accession NP_004393.1), a gene which induces DNA fragmentation and chromatin condensation during apoptosis. Accordingly, utilities of GAM130 include diagnosis, prevention and treatment of diseases and clinical conditions associated with DFFB.

The function of DFFB has been established by previous studies. Binding of the Fas ligand (FASL; 134638), also known as apoptosis antigen ligand-1 (APT1LG1), a member of the tumor necrosis factor family, to its receptor Fas (OMIM Ref. No. 134637), also known as apoptosis antigen 1 (APT1), causes trimerization of the receptor. The trimerized receptor recruits caspase-8 (CASP8; 601763), also known as apoptosis-related cysteine protease, through the adaptor molecule FADD (OMIM Ref. No. 602457), which stands for 'Fas-associating protein with death domain;' the trimerized receptor activates CASP8 at the plasma membrane by forming the death-inducing signaling complex. Activated CASP8 sequentially activates other members of the caspase family, such as CASP3 and CASP6 (OMIM Ref. No. 601532), which act downstream in the caspase cascade. The activated caspases then cleave various cellular substrates to cause the morphologic cellular changes observed during apoptosis. Mukae et al. (1998) cloned and characterized a DNase that can be activated by CASP3 and is involved in the degradation of chromosomal DNA into nucleosomal units during apoptosis. The cDNA of human caspase-activated DNase (CAD) was found to be expressed in cells that easily undergo DNA fragmentation in response to apoptotic stimuli, but not in those that do not show apoptotic DNA fragmentation. Introduction of a CAD expression vector resulted in enhanced DNA fragmentation. By FISH, Mukae et al. (1998) localized the functional CAD gene to 1p36.3. The CAD mRNA was expressed in a limited number of human tissues, including pancreas, spleen, prostate, and ovary. By FISH, Judson et al. (2000) showed that DFFB lies distal to DFFA. They also mapped a processed DFFB pseudogene to chromosome 9. DFFB itself contains 7 coding exons spanning 10 kb. Exhaustive mutation screening of 41 neuroblastomas and other tumors in which a 1p36 tumor suppressor gene had been implicated showed no tumor-specific mutations. A coding region polymorphism was used to demonstrate uniformly biallelic expression in human fetal DFFB transcripts. Since the putative neuroblastoma tumor suppressor gene in distal 1p36 is predicted to be maternally expressed, the lack of imprinting and absence of somatic mutations in DFFB indicate that it probably is not the neuroblastoma tumor suppressor gene.

Full details of the abovementioned studies are described in the following publications, the disclosure of which are hereby incorporated by reference:

Judson, H.; van Roy, N.; Strain, L.; Vandesompele, J.; Van Gele, M.; Speleman, F.; Bonthron, D. T.: Structure and mutation analysis of the gene encoding DNA fragmentation factor 40 (caspase-activated nuclease), a candidate neuroblastoma tumour suppressor gene. Hum. Genet. 106:406-413, 2000; and Liu, X.; Zou, H.; Slaughter, C.; Wang, X.: DFF, a heterodimeric protein that functions downstream of caspase-3 to trigger DNA fragmentation during apoptosis. Cell 89:175-184, 1997.

Further studies establishing the function and utilities of DFFB are found in John Hopkins OMIM database record ID 601883, and in cited publications listed in Table 5, which are hereby incorporated by reference. Dihydrofolate reductase (DHFR, Accession NP_000782.1) is another GAM130 target gene, herein designated TARGET GENE. DHFR BINDING SITE is a target binding site found in the 3' untranslated region of mRNA encoded by DHFR, corresponding to a target binding site such as BINDING SITE I, BINDING SITE II or BINDING SITE III of FIG. 8. Table 4 illustrates the complementarity of the nucleotide sequences of DHFR BINDING SITE, designated SEQ ID:18204, to the nucleotide sequence of GAM130 RNA, herein designated GAM RNA, also designated SEQ ID:331.

Another function of GAM130 is therefore inhibition of Dihydrofolate reductase (DHFR, Accession NP_000782.1), a gene which converts dihydrofolate into tetrahydrofolate. Accordingly, utilities of GAM130 include diagnosis, prevention and treatment of diseases and clinical conditions associated with DHFR.

The function of DHFR and its association with various diseases and clinical conditions, has been established by previous studies, as described hereinabove with reference to GAM64.1. DKFZP564G092 (Accession NP_056416.1) is another GAM130 target gene, herein designated TARGET GENE. DKFZP564G092 BINDING SITE is a target binding site found in the 5' untranslated region of mRNA encoded by DKFZP564G092, corresponding to a target binding site such as BINDING SITE I, BINDING SITE II or BINDING SITE III of FIG. 8. Table 4 illustrates the complementarity of the nucleotide sequences of DKFZP564G092 BINDING SITE, designated SEQ ID:1337, to the nucleotide sequence of GAM130 RNA, herein designated GAM RNA, also designated SEQ ID:331.

Another function of GAM130 is therefore inhibition of DKFZP564G092 (Accession NP_056416.1). Accordingly, utilities of GAM130 include diagnosis, prevention and treatment of diseases and clinical conditions associated with DKFZP564G092.

DKFZp667B1218 (Accession NP_808881.1) is another GAM130 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:14527, to the nucleotide sequence of GAM130 RNA, herein designated GAM RNA, also designated SEQ ID:331.

Another function of GAM130 is therefore inhibition of DKFZp667B1218 (Accession NP_808881.1). Accordingly, utilities of GAM130 include diagnosis, prevention and treatment of diseases and clinical conditions associated with DKFZp667B1218.

DKFZp761J139 (Accession NP_115656.1) is another GAM130 target gene, herein designated TARGET GENE. DKFZp761J139 BINDING SITE is a target binding site found in the 5' untranslated region of mRNA encoded by DKFZp761J139, corresponding to a target binding site such as BINDING SITE I, BINDING SITE II or BINDING SITE III of FIG. 8. Table 4 illustrates the complementarity of the nucleotide sequences of DKFZp761J139 BINDING SITE, designated SEQ ID:6176, to the nucleotide sequence of GAM130 RNA, herein designated GAM RNA, also designated SEQ ID:331.

Another function of GAM130 is therefore inhibition of DKFZp761J139 (Accession NP_115656.1). Accordingly, utilities of GAM130 include diagnosis, prevention and treatment of diseases and clinical conditions associated with DKFZp761J139.

DKFZp761O0113 (Accession NP_060879.1) is another GAM130 target gene, herein designated TARGET GENE. DKFZp761O0113 BINDING SITE is a target binding site found in the 5' untranslated region of mRNA encoded by DKFZp761O0113, corresponding to a target binding site such as BINDING SITE I, BINDING SITE II or BINDING SITE III of FIG. 8. Table 4 illustrates the complementarity of the nucleotide sequences of DKFZp761O0113 BINDING SITE, designated SEQ ID:6894, to the nucleotide sequence of GAM130 RNA, herein designated GAM RNA, also designated SEQ ID:331.

Another function of GAM130 is therefore inhibition of DKFZp761O0113 (Accession NP_060879.1). Accordingly, utilities of GAM130 include diagnosis, prevention and treatment of diseases and clinical conditions associated with DKFZp761O0113.

DKFZp762I137 (Accession NP_689624.1) is another GAM130 target gene, herein designated TARGET GENE. DKFZp762I137 BINDING SITE is a target binding site found in the 3' untranslated region of mRNA encoded by DKFZp762I137, corresponding to a target binding site such as BINDING SITE I, BINDING SITE II or BINDING SITE III of FIG. 8. Table 4 illustrates the complementarity of the nucleotide sequences of DKFZp762I137 BINDING SITE, designated SEQ ID:2536, to the nucleotide sequence of GAM130 RNA, herein designated GAM RNA, also designated SEQ ID:331.

Another function of GAM130 is therefore inhibition of DKFZp762I137 (Accession NP_689624.1). Accordingly, utilities of GAM130 include diagnosis, prevention and treatment of diseases and clinical conditions associated with DKFZp762I137.

Down syndrome critical region gene 6 (DSCR6, Accession NP_061835.1) is another GAM130 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:10753, to the nucleotide sequence of GAM130 RNA, herein designated GAM RNA, also designated SEQ ID:331.

Another function of GAM130 is therefore inhibition of Down syndrome critical region gene 6 (DSCR6, Accession NP_061835.1). Accordingly, utilities of GAM130 include diagnosis, prevention and treatment of diseases and clinical conditions associated with DSCR6.

Dual specificity phosphatase 19 (DUSP19, Accession NP_543152.1) is another GAM130 target gene, herein designated TARGET GENE. DUSP19 BINDING SITE is a target binding site found in the 3' untranslated region of mRNA encoded by DUSP19, corresponding to a target binding site such as BINDING SITE I, BINDING SITE II or BINDING SITE III of FIG. 8. Table 4 illustrates the complementarity of the nucleotide sequences of DUSP19 BINDING SITE, designated SEQ ID:11650, to the nucleotide sequence of GAM130 RNA, herein designated GAM RNA, also designated SEQ ID:331.

Another function of GAM130 is therefore inhibition of Dual specificity phosphatase 19 (DUSP19, Accession NP_543152.1). Accordingly, utilities of GAM130 include diagnosis, prevention and treatment of diseases and clinical conditions associated with DUSP19.

Ecotropic viral integration site 5 (EVI5, Accession NP_005656.2) is another GAM130 target gene, herein designated TARGET GENE. EVI5 BINDING SITE is a target binding site found in the 3' untranslated region of mRNA encoded by EVI5, corresponding to a target binding site such as BINDING SITE I, BINDING SITE II or BINDING SITE III of FIG. 8. Table 4 illustrates the complementarity of the nucleotide sequences of EVI5 BINDING SITE, designated SEQ ID:1296, to the nucleotide sequence of GAM130 RNA, herein designated GAM RNA, also designated SEQ ID:331.

Another function of GAM130 is therefore inhibition of Ecotropic viral integration site 5 (EVI5, Accession NP_005656.2). Accordingly, utilities of GAM130 include diagnosis, prevention and treatment of diseases and clinical conditions associated with EVI5.

Fanconi anemia, complementation group f (FANCF, Accession NP_073562.1) is another GAM130 target gene, herein designated TARGET GENE. FANCF BINDING SITE is a target binding site found in the 3' untranslated region of mRNA encoded by FANCF, corresponding to a target binding site such as BINDING SITE I, BINDING SITE II or BINDING SITE III of FIG. 8. Table 4 illustrates the complementarity of the nucleotide sequences of FANCF BINDING SITE, designated SEQ ID:14481, to the nucleotide sequence of GAM130 RNA, herein designated GAM RNA, also designated SEQ ID:331.

Another function of GAM130 is therefore inhibition of Fanconi anemia, complementation group f (FANCF, Accession NP_073562.1). Accordingly, utilities of GAM130 include diagnosis, prevention and treatment of diseases and clinical conditions associated with FANCF.

FLJ10713 (Accession NP_060659.1) is another GAM130 target gene, herein designated TARGET GENE. FLJ10713 BINDING SITE is a target binding site found in the 3' untranslated region of mRNA encoded by FLJ10713, corresponding to a target binding site such as BINDING SITE I, BINDING SITE II or BINDING SITE III of FIG. 8. Table 4 illustrates the complementarity of the nucleotide sequences of FLJ10713 BINDING SITE, designated SEQ ID:10891, to the nucleotide sequence of GAM130 RNA, herein designated GAM RNA, also designated SEQ ID:331.

Another function of GAM130 is therefore inhibition of FLJ10713 (Accession NP_060659.1). Accordingly, utilities of GAM130 include diagnosis, prevention and treatment of diseases and clinical conditions associated with FLJ10713.

FLJ10902 (Accession NP_060736.1) is another GAM130 target gene, herein designated TARGET GENE. FLJ10902 BINDING SITE is a target binding site found in the 3' untranslated region of mRNA encoded by FLJ10902, corresponding to a target binding site such as BINDING SITE I, BINDING SITE II or BINDING SITE III of FIG. 8. Table 4 illustrates the complementarity of the nucleotide sequences of FLJ10902 BINDING SITE, designated SEQ ID:13320, to the nucleotide sequence of GAM130 RNA, herein designated GAM RNA, also designated SEQ ID:331.

Another function of GAM130 is therefore inhibition of FLJ10902 (Accession NP_060736.1). Accordingly, utilities of GAM130 include diagnosis, prevention and treatment of diseases and clinical conditions associated with FLJ10902.

FLJ10922 (Accession NP_060743.1) is another GAM130 target gene, herein designated TARGET GENE. FLJ10922 BINDING SITE is a target binding site found in the 3' untranslated region of mRNA encoded by FLJ10922, corresponding to a target binding site such as BINDING SITE I, BINDING SITE II or BINDING SITE III of FIG. 8. Table 4 illustrates the complementarity of the nucleotide sequences of FLJ10922 BINDING SITE, designated SEQ ID:5661, to the nucleotide sequence of GAM130 RNA, herein designated GAM RNA, also designated SEQ ID:331.

Another function of GAM130 is therefore inhibition of FLJ10922 (Accession NP_060743.1). Accordingly, utilities of GAM130 include diagnosis, prevention and treatment of diseases and clinical conditions associated with FLJ10922.

FLJ11235 (Accession NP_061906.1) is another GAM130 target gene, herein designated TARGET GENE. FLJ11235 BINDING SITE is a target binding site found in the 3' untranslated region of mRNA encoded by FLJ11235, corresponding to a target binding site such as BINDING SITE I, BINDING SITE II or BINDING SITE III of FIG. 8. Table 4 illustrates the complementarity of the nucleotide sequences of FLJ11235 BINDING SITE, designated SEQ ID:3449, to the nucleotide sequence of GAM130 RNA, herein designated GAM RNA, also designated SEQ ID:331.

Another function of GAM130 is therefore inhibition of FLJ11235 (Accession NP_061906.1). Accordingly, utilities of GAM130 include diagnosis, prevention and treatment of diseases and clinical conditions associated with FLJ11235.

FLJ11323 (Accession NP_060860.1) is another GAM130 target gene, herein designated TARGET GENE. FLJ11323 BINDING SITE is a target binding site found in the 3' untranslated region of multiple transcripts of mRNA encoded by FLJ11323, corresponding to a target binding site such as BINDING SITE I, BINDING SITE II or BINDING SITE III of FIG. 8. Table 4 illustrates the complementarity of the nucleotide sequences of FLJ11323 BINDING SITE, designated SEQ ID:4059, to the nucleotide sequence of GAM130 RNA, herein designated GAM RNA, also designated SEQ ID:331.

Another function of GAM130 is therefore inhibition of FLJ11323 (Accession NP_060860.1). Accordingly, utilities of GAM130 include diagnosis, prevention and treatment of diseases and clinical conditions associated with FLJ11323.

FLJ12586 (Accession NP_078896.2) is another GAM130 target gene, herein designated TARGET GENE. FLJ12586 BINDING SITE is a target binding site found in the 3' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:1864, to the nucleotide sequence of GAM130 RNA, herein designated GAM RNA, also designated SEQ ID:331.

Another function of GAM130 is therefore inhibition of FLJ12586 (Accession NP_078896.2). Accordingly, utilities of GAM130 include diagnosis, prevention and treatment of diseases and clinical conditions associated with FLJ12586.

FLJ12747 (Accession XP_290972.1) is another GAM130 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:11006, to the nucleotide sequence of GAM130 RNA, herein designated GAM RNA, also designated SEQ ID:331.

Another function of GAM130 is therefore inhibition of FLJ12747 (Accession XP_290972.1). Accordingly, utilities of GAM130 include diagnosis, prevention and treatment of diseases and clinical conditions associated with FLJ12747.

FLJ12903 (Accession NP_073590.1) is another GAM130 target gene, herein designated TARGET GENE. FLJ12903 BINDING SITE is a target binding site found in the 3' untranslated region of mRNA encoded by FLJ12903, corresponding to a target binding site such as BINDING SITE I, BINDING SITE II or BINDING SITE III of FIG. 8. Table 4 illustrates the complementarity of the nucleotide sequences of FLJ12903 BINDING SITE, designated SEQ ID:6673, to the nucleotide sequence of GAM130 RNA, herein designated GAM RNA, also designated SEQ ID:331.

Another function of GAM130 is therefore inhibition of FLJ12903 (Accession NP_073590.1). Accordingly, utilities of GAM130 include diagnosis, prevention and treatment of diseases and clinical conditions associated with FLJ12903.

FLJ12973 (Accession NP_079184.1) is another GAM130 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:2871, to the nucleotide sequence of GAM130 RNA, herein designated GAM RNA, also designated SEQ ID:331.

Another function of GAM130 is therefore inhibition of FLJ12973 (Accession NP_079184.1). Accordingly, utilities of GAM130 include diagnosis, prevention and treatment of diseases and clinical conditions associated with FLJ12973.

FLJ12975 (Accession NP_079085.2) is another GAM130 target gene, herein designated TARGET GENE. FLJ12975 BINDING SITE1 and FLJ12975 BINDING SITE2 are target binding sites found in untranslated regions of mRNA encoded by FLJ12975, corresponding to target binding sites such as BINDING SITE I, BINDING SITE II or BINDING SITE III of FIG. 8. Table 4 illustrates the complementarity of the nucleotide sequences of FLJ12975 BINDING SITE1 and FLJ12975 BINDING SITE2, designated SEQ ID:2871 and SEQ ID:16538 respectively, to the nucleotide sequence of GAM130 RNA, herein designated GAM RNA, also designated SEQ ID:331.

Another function of GAM130 is therefore inhibition of FLJ12975 (Accession NP_079085.2). Accordingly, utilities of GAM130 include diagnosis, prevention and treatment of diseases and clinical conditions associated with FLJ12975.

FLJ13114 (Accession NP_078817.1) is another GAM130 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:9782, to the nucleotide sequence of GAM130 RNA, herein designated GAM RNA, also designated SEQ ID:331.

Another function of GAM130 is therefore inhibition of FLJ13114 (Accession NP_078817.1). Accordingly, utilities of GAM130 include diagnosis, prevention and treatment of diseases and clinical conditions associated with FLJ13114.

FLJ14957 (Accession NP_116255.1) is another GAM130 target gene, herein designated TARGET GENE. FLJ14957 BINDING SITE is a target binding site found in the 3' untranslated region of mRNA encoded by FLJ14957, corresponding to a target binding site such as BINDING SITE I, BINDING SITE II or BINDING SITE III of FIG. 8. Table 4 illustrates the complementarity of the nucleotide sequences of FLJ14957 BINDING SITE, designated SEQ ID:11158, to the nucleotide sequence of GAM130 RNA, herein designated GAM RNA, also designated SEQ ID:331.

Another function of GAM130 is therefore inhibition of FLJ14957 (Accession NP_116255.1). Accordingly, utilities of GAM130 include diagnosis, prevention and treatment of diseases and clinical conditions associated with FLJ14957.

FLJ20079 (Accession NP_060126.1) is another GAM130 target gene, herein designated TARGET GENE. FLJ20079 BINDING SITE is a target binding site found in the 3' untranslated region of mRNA encoded by FLJ20079, corresponding to a target binding site such as BINDING SITE I, BINDING SITE II or BINDING SITE III of FIG. 8. Table 4 illustrates the complementarity of the nucleotide sequences of FLJ20079 BINDING SITE, designated SEQ ID:10863, to the nucleotide sequence of GAM130 RNA, herein designated GAM RNA, also designated SEQ ID:331.

Another function of GAM130 is therefore inhibition of FLJ20079 (Accession NP_060126.1). Accordingly, utilities of GAM130 include diagnosis, prevention and treatment of diseases and clinical conditions associated with FLJ20079.

FLJ20245 (Accession NP_060193.1) is another GAM130 target gene, herein designated TARGET GENE. FLJ20245 BINDING SITE is a target binding site found in the 3' untranslated region of mRNA encoded by FLJ20245, corresponding to a target binding site such as BINDING SITE I, BINDING SITE II or BINDING SITE III of FIG. 8. Table 4 illustrates the complementarity of the nucleotide sequences of FLJ20245 BINDING SITE, designated SEQ ID:7716, to the nucleotide sequence of GAM130 RNA, herein designated GAM RNA, also designated SEQ ID:331.

Another function of GAM130 is therefore inhibition of FLJ20245 (Accession NP_060193.1). Accordingly, utilities of GAM130 include diagnosis, prevention and treatment of diseases and clinical conditions associated with FLJ20245.

FLJ23074 (Accession NP_079328.1) is another GAM130 target gene, herein designated TARGET GENE. FLJ23074 BINDING SITE is a target binding site found in the 5' untranslated region of mRNA encoded by FLJ23074, corresponding to a target binding site such as BINDING SITE I, BINDING SITE II or BINDING SITE III of FIG. 8. Table 4 illustrates the complementarity of the nucleotide sequences of FLJ23074 BINDING SITE, designated SEQ ID:9888, to the nucleotide sequence of GAM130 RNA, herein designated GAM RNA, also designated SEQ ID:331.

Another function of GAM130 is therefore inhibition of FLJ23074 (Accession NP_079328.1). Accordingly, utilities of GAM130 include diagnosis, prevention and treatment of diseases and clinical conditions associated with FLJ23074.

FLJ23233 (Accession NP_078967.2) is another GAM130 target gene, herein designated TARGET GENE. FLJ23233 BINDING SITE is a target binding site found in the 3' untranslated region of mRNA encoded by FLJ23233, corresponding to a target binding site such as BINDING SITE I, BINDING SITE II or BINDING SITE III of FIG. 8. Table 4 illustrates the complementarity of the nucleotide sequences of FLJ23233 BINDING SITE, designated SEQ ID:14644, to the nucleotide sequence of GAM130 RNA, herein designated GAM RNA, also designated SEQ ID:331.

Another function of GAM130 is therefore inhibition of FLJ23233 (Accession NP_078967.2). Accordingly, utilities of GAM130 include diagnosis, prevention and treatment of diseases and clinical conditions associated with FLJ23233.

FLJ23556 (Accession NP_079156.1) is another GAM130 target gene, herein designated TARGET GENE. FLJ23556 BINDING SITE is a target binding site found in the 3' untranslated region of mRNA encoded by FLJ23556, corresponding to a target binding site such as BINDING SITE I, BINDING SITE II or BINDING SITE III of FIG. 8. Table 4 illustrates the complementarity of the nucleotide sequences of FLJ23556 BINDING SITE, designated SEQ ID:9031, to the nucleotide sequence of GAM130 RNA, herein designated GAM RNA, also designated SEQ ID:331.

Another function of GAM130 is therefore inhibition of FLJ23556 (Accession NP_079156.1). Accordingly, utilities of GAM130 include diagnosis, prevention and treatment of diseases and clinical conditions associated with FLJ23556.

FLJ23563 (Accession XP_041701.4) is another GAM130 target gene, herein designated TARGET GENE. FLJ23563 BINDING SITE is a target binding site found in the 3' untranslated region of mRNA encoded by FLJ23563, corresponding to a target binding site such as BINDING SITE I, BINDING SITE II or BINDING SITE III of FIG. 8. Table 4 illustrates the complementarity of the nucleotide sequences of FLJ23563 BINDING SITE, designated SEQ ID:7932, to the nucleotide sequence of GAM130 RNA, herein designated GAM RNA, also designated SEQ ID:331.

Another function of GAM130 is therefore inhibition of FLJ23563 (Accession XP_041701.4). Accordingly, utilities of GAM130 include diagnosis, prevention and treatment of diseases and clinical conditions associated with FLJ23563.

FLJ30532 (Accession NP_653325.1) is another GAM130 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:6894, to the nucleotide sequence of GAM130 RNA, herein designated GAM RNA, also designated SEQ ID:331.

Another function of GAM130 is therefore inhibition of FLJ30532 (Accession NP_653325.1). Accordingly, utilities of GAM130 include diagnosis, prevention and treatment of diseases and clinical conditions associated with FLJ30532.

FLJ31139 (Accession NP_775928.1) is another GAM130 target gene, herein designated TARGET GENE. FLJ31139 BINDING SITE1 and FLJ31139 BINDING SITE2 are target binding sites found in untranslated regions of mRNA encoded by FLJ31139, corresponding to target binding sites such as BINDING SITE I, BINDING SITE II or BINDING SITE III of FIG. 8. Table 4 illustrates the complementarity of the nucleotide sequences of FLJ31139 BINDING SITE1 and FLJ31139 BINDING SITE2, designated SEQ ID:7990 and SEQ ID:19702 respectively, to the nucleotide sequence of GAM130 RNA, herein designated GAM RNA, also designated SEQ ID:331.

Another function of GAM130 is therefore inhibition of FLJ31139 (Accession NP_775928.1). Accordingly, utilities of GAM130 include diagnosis, prevention and treatment of diseases and clinical conditions associated with FLJ31139.

FLJ31166 (Accession NP_694567.1) is another GAM130 target gene, herein designated TARGET GENE. FLJ31166 BINDING SITE is a target binding site found in the 3' untranslated region of mRNA encoded by FLJ31166, corresponding to a target binding site such as BINDING SITE I, BINDING SITE II or BINDING SITE III of FIG. 8. Table 4 illustrates the complementarity of the nucleotide sequences of FLJ31166 BINDING SITE, designated SEQ ID:11889, to the nucleotide sequence of GAM130 RNA, herein designated GAM RNA, also designated SEQ ID:331.

Another function of GAM130 is therefore inhibition of FLJ31166 (Accession NP_694567.1). Accordingly, utilities of GAM130 include diagnosis, prevention and treatment of diseases and clinical conditions associated with FLJ31166.

FLJ31338 (Accession NP_689682.1) is another GAM130 target gene, herein designated TARGET GENE. FLJ31338 BINDING SITE is a target binding site found in the 3' untranslated region of mRNA encoded by FLJ31338, corresponding to a target binding site such as BINDING SITE I, BINDING SITE II or BINDING SITE III of FIG. 8. Table 4 illustrates the complementarity of the nucleotide sequences of FLJ31338 BINDING SITE, designated SEQ ID:5852, to the nucleotide sequence of GAM130 RNA, herein designated GAM RNA, also designated SEQ ID:331.

Another function of GAM130 is therefore inhibition of FLJ31338 (Accession NP_689682.1). Accordingly, utilities of GAM130 include diagnosis, prevention and treatment of diseases and clinical conditions associated with FLJ31338.

FLJ31393 (Accession NP_694569.1) is another GAM130 target gene, herein designated TARGET GENE. FLJ31393 BINDING SITE is a target binding site found in the 5' untranslated region of mRNA encoded by FLJ31393, corresponding to a target binding site such as BINDING SITE I, BINDING SITE II or BINDING SITE III of FIG. 8. Table 4 illustrates the complementarity of the nucleotide sequences of FLJ31393 BINDING SITE, designated SEQ ID:18530, to the nucleotide sequence of GAM130 RNA, herein designated GAM RNA, also designated SEQ ID:331.

Another function of GAM130 is therefore inhibition of FLJ31393 (Accession NP_694569.1). Accordingly, utilities of GAM130 include diagnosis, prevention and treatment of diseases and clinical conditions associated with FLJ31393.

FLJ32096 (Accession NP_776156.1) is another GAM130 target gene, herein designated TARGET GENE. FLJ32096 BINDING SITE is a target binding site found in the 3' untranslated region of mRNA encoded by FLJ32096, corresponding to a target binding site such as BINDING SITE I, BINDING SITE II or BINDING SITE III of FIG. 8. Table 4 illustrates the complementarity of the nucleotide sequences of FLJ32096 BINDING SITE, designated SEQ ID:2283, to the nucleotide sequence of GAM130 RNA, herein designated GAM RNA, also designated SEQ ID:331.

Another function of GAM130 is therefore inhibition of FLJ32096 (Accession NP_776156.1). Accordingly, utilities of GAM130 include diagnosis, prevention and treatment of diseases and clinical conditions associated with FLJ32096.

FLJ32130 (Accession NP_689671.2) is another GAM130 target gene, herein designated TARGET GENE. FLJ32130 BINDING SITE is a target binding site found in the 3' untranslated region of mRNA encoded by FLJ32130, corresponding to a target binding site such as BINDING SITE I, BINDING SITE II or BINDING SITE III of FIG. 8. Table 4 illustrates the complementarity of the nucleotide sequences of FLJ32130 BINDING SITE, designated SEQ ID:6894, to the nucleotide sequence of GAM130 RNA, herein designated GAM RNA, also designated SEQ ID:331.

Another function of GAM130 is therefore inhibition of FLJ32130 (Accession NP_689671.2). Accordingly, utilities of GAM130 include diagnosis, prevention and treatment of diseases and clinical conditions associated with FLJ32130.

FLJ32865 (Accession NP_653214.1) is another GAM130 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:3876, to the nucleotide sequence of GAM130 RNA, herein designated GAM RNA, also designated SEQ ID:331.

Another function of GAM130 is therefore inhibition of FLJ32865 (Accession NP_653214.1). Accordingly, utilities of GAM130 include diagnosis, prevention and treatment of diseases and clinical conditions associated with FLJ32865.

FLJ34503 (Accession NP_775944.1) is another GAM130 target gene, herein designated TARGET GENE. FLJ34503 BINDING SITE is a target binding site found in the 5' untranslated region of mRNA encoded by FLJ34503, corresponding to a target binding site such as BINDING SITE I, BINDING SITE II or BINDING SITE III of FIG. 8. Table 4 illustrates the complementarity of the nucleotide sequences of FLJ34503 BINDING SITE, designated SEQ ID:17842, to the nucleotide sequence of GAM130 RNA, herein designated GAM RNA, also designated SEQ ID:331.

Another function of GAM130 is therefore inhibition of FLJ34503 (Accession NP_775944.1). Accordingly, utilities of GAM130 include diagnosis, prevention and treatment of diseases and clinical conditions associated with FLJ34503.

FLJ34969 (Accession XP_114353.1) is another GAM130 target gene, herein designated TARGET GENE. FLJ34969 BINDING SITE is a target binding site found in the 3' untranslated region of mRNA encoded by FLJ34969, corresponding to a target binding site such as BINDING SITE I, BINDING SITE II or BINDING SITE III of FIG. 8. Table 4 illustrates the complementarity of the nucleotide sequences of FLJ34969 BINDING SITE, designated SEQ ID:2871, to the nucleotide sequence of GAM130 RNA, herein designated GAM RNA, also designated SEQ ID:331.

Another function of GAM130 is therefore inhibition of FLJ34969 (Accession XP_114353.1). Accordingly, utilities of GAM130 include diagnosis, prevention and treatment of diseases and clinical conditions associated with FLJ34969.

FLJ37543 (Accession NP_775938.1) is another GAM130 target gene, herein designated TARGET GENE. FLJ37543 BINDING SITE is a target binding site found in the 3' untranslated region of mRNA encoded by FLJ37543, corresponding to a target binding site such as BINDING SITE I, BINDING SITE II or BINDING SITE III of FIG. 8. Table 4 illustrates the complementarity of the nucleotide sequences of FLJ37543 BINDING SITE, designated SEQ ID:4619, to the nucleotide sequence of GAM130 RNA, herein designated GAM RNA, also designated SEQ ID:331.

Another function of GAM130 is therefore inhibition of FLJ37543 (Accession NP_775938.1). Accordingly, utilities of GAM130 include diagnosis, prevention and treatment of diseases and clinical conditions associated with FLJ37543.

FLJ38944 (Accession NP_689574.1) is another GAM130 target gene, herein designated TARGET GENE. FLJ38944 BINDING SITE1 and FLJ38944 BINDING SITE2 are target binding sites found in untranslated regions of mRNA encoded by FLJ38944, corresponding to target binding sites such as BINDING SITE I, BINDING SITE II or BINDING SITE III of FIG. 8. Table 4 illustrates the complementarity of the nucleotide sequences of FLJ38944 BINDING SITE1 and FLJ38944 BINDING SITE2, designated SEQ ID:2995 and SEQ ID:16294 respectively, to the nucleotide sequence of GAM130 RNA, herein designated GAM RNA, also designated SEQ ID:331.

Another function of GAM130 is therefore inhibition of FLJ38944 (Accession NP_689574.1). Accordingly, utilities of GAM130 include diagnosis, prevention and treatment of diseases and clinical conditions associated with FLJ38944.

GPP34R (Accession NP_060648.2) is another GAM130 target gene, herein designated TARGET GENE. GPP34R BINDING SITE is a target binding site found in the 3' untranslated region of mRNA encoded by GPP34R, corresponding to a target binding site such as BINDING SITE I, BINDING SITE II or BINDING SITE III of FIG. 8. Table 4 illustrates the complementarity of the nucleotide sequences of GPP34R BINDING SITE, designated SEQ ID:8899, to the nucleotide sequence of GAM130 RNA, herein designated GAM RNA, also designated SEQ ID:331.

Another function of GAM130 is therefore inhibition of GPP34R (Accession NP_060648.2). Accordingly, utilities of GAM130 include diagnosis, prevention and treatment of diseases and clinical conditions associated with GPP34R.

G protein-coupled receptor 26 (GPR26, Accession NP_703143.1) is another GAM130 target gene, herein designated TARGET GENE. GPR26 BINDING SITE is a target binding site found in the 3' untranslated region of mRNA encoded by GPR26, corresponding to a target binding site such as BINDING SITE I, BINDING SITE II or BINDING SITE III of FIG. 8. Table 4 illustrates the complementarity of the nucleotide sequences of GPR26 BINDING SITE, designated SEQ ID:2669, to the nucleotide sequence of GAM130 RNA, herein designated GAM RNA, also designated SEQ ID:331.

Another function of GAM130 is therefore inhibition of G protein-coupled receptor 26 (GPR26, Accession NP_703143.1). Accordingly, utilities of GAM130 include diagnosis, prevention and treatment of diseases and clinical conditions associated with GPR26.

G1 to s phase transition 2 (GSPT2, Accession NP_060564.1) is another GAM130 target gene, herein designated TARGET GENE. GSPT2 BINDING SITE is a target binding site found in the 5' untranslated region of mRNA encoded by GSPT2, corresponding to a target binding site such as BINDING SITE I, BINDING SITE II or BINDING SITE III of FIG. 8. Table 4 illustrates the complementarity of the nucleotide sequences of GSPT2 BINDING SITE, designated SEQ ID:18829, to the nucleotide sequence of GAM130 RNA, herein designated GAM RNA, also designated SEQ ID:331.

Another function of GAM130 is therefore inhibition of G1 to s phase transition 2 (GSPT2, Accession NP_060564.1). Accordingly, utilities of GAM130 include diagnosis, prevention and treatment of diseases and clinical conditions associated with GSPT2.

HATH6 (Accession NP_116216.1) is another GAM130 target gene, herein designated TARGET GENE. HATH6 BINDING SITE is a target binding site found in the 3' untranslated region of mRNA encoded by HATH6, corresponding to a target binding site such as BINDING SITE I, BINDING SITE II or BINDING SITE III of FIG. 8. Table 4 illustrates the complementarity of the nucleotide sequences of HATH6 BINDING SITE, designated SEQ ID:15485, to the nucleotide sequence of GAM130 RNA, herein designated GAM RNA, also designated SEQ ID:331.

Another function of GAM130 is therefore inhibition of HATH6 (Accession NP_116216.1). Accordingly, utilities of GAM130 include diagnosis, prevention and treatment of diseases and clinical conditions associated with HATH6.

Interleukin 12 receptor, beta 1 (IL12RB1, Accession NP_714912.1) is another GAM130 target gene, herein designated TARGET GENE. IL12RB1 BINDING SITE is a target binding site found in the 3' untranslated region of multiple transcripts of mRNA encoded by IL12RB1, corresponding to a target binding site such as BINDING SITE I, BINDING SITE II or BINDING SITE III of FIG. 8. Table 4 illustrates the complementarity of the nucleotide sequences of IL12RB1 BINDING SITE, designated SEQ ID:1878, to the nucleotide sequence of GAM130 RNA, herein designated GAM RNA, also designated SEQ ID:331.

Another function of GAM130 is therefore inhibition of Interleukin 12 receptor, beta 1 (IL12RB1, Accession NP_714912.1). Accordingly, utilities of GAM130 include diagnosis, prevention and treatment of diseases and clinical conditions associated with IL12RB1.

Interleukin 19 (IL19, Accession NP_037503.2) is another GAM130 target gene, herein designated TARGET GENE. IL19 BINDING SITE is a target binding site found in the 5' untranslated region of multiple transcripts of mRNA encoded by IL19, corresponding to a target binding site such as BINDING SITE I, BINDING SITE II or BINDING SITE III of FIG. 8. Table 4 illustrates the complementarity of the nucleotide sequences of IL19 BINDING SITE, designated SEQ ID:8423, to the nucleotide sequence of GAM130 RNA, herein designated GAM RNA, also designated SEQ ID:331.

Another function of GAM130 is therefore inhibition of Interleukin 19 (IL19, Accession NP_037503.2), a gene which may play a role in B-cell activation and autoantibody production. Accordingly, utilities of GAM130 include diagnosis, prevention and treatment of diseases and clinical conditions associated with IL19.

The function of IL19 and its association with various diseases and clinical conditions, has been established by previous studies, as described hereinabove with reference to GAM94.1. Interleukin 1 receptor accessory protein-like 2 (IL1RAPL2, Accession NP_059112.1) is another GAM130 target gene, herein designated TARGET GENE. IL1RAPL2 BINDING SITE is a target binding site found in the 5' untranslated region of mRNA encoded by IL1RAPL2, corresponding to a target binding site such as BINDING SITE I, BINDING SITE II or BINDING SITE III of FIG. 8. Table 4 illustrates the complementarity of the nucleotide sequences of IL1RAPL2 BINDING SITE, designated SEQ ID:17936, to the nucleotide sequence of GAM130 RNA, herein designated GAM RNA, also designated SEQ ID:331.

Another function of GAM130 is therefore inhibition of Interleukin 1 receptor accessory protein-like 2 (IL1RAPL2, Accession NP_059112.1), a gene which may act in the development or function of the central nervous system. and therefore may be associated with Nonspecific mental retardation. Accordingly, utilities of GAM130 include diagnosis, prevention and treatment of Nonspecific mental retardation, and of other diseases and clinical conditions associated with IL1RAPL2.

The function of IL1RAPL2 has been established by previous studies. The IL1 receptor family is composed of bona fide receptors (e.g., IL1R (OMIM Ref. No. 147810) and IL18R (OMIM Ref. No. 604494)), decoy receptors (e.g., IL1R2; 147811), signaling accessory receptors (e.g., IL1RAP (OMIM Ref. No. 602626) and IL18RAP (OMIM Ref. No. 604509)), and structurally homologous orphan receptors. During searches of genomic databases with the IL1RAPL1 (OMIM Ref. No. 300206) cDNA sequence, Jin et al. (2000) identified a close homolog, which they designated IL1RAPL2, located on Xq22. They obtained a partial IL1RAPL2 cDNA by screening a human brain cDNA library. The cDNA encodes a deduced 658-amino acid protein that shares 65% identity with the IL1RAPL1 protein. Both proteins have novel C-terminal sequences not present in other members of the IL1 receptor family. The IL1RAPL2 gene is transcribed in a centromere-to-telomere direction. By searching genomic databases for sequences homologous to the Toll homology domain (THD), Sana et al. (2000) identified a cDNA encoding IL1RAPL2, which they termed IL1R9. Sequence analysis predicted that the 307-amino acid cytoplasmic tail of the 686-amino acid IL1RAPL2 protein contains an additional 120 to 130 residues beyond the THD, like IL1R8 (IL1RAPL1) but unlike other IL1Rs. Northern blot analysis revealed expression of a 5.5-kb transcript in fetal brain. Functional analysis determined that neither IL1RAPL1 nor IL1RAPL2 activate nuclear factor kappa-B (NFKB; OMIM Ref. No. 164011) except in the presence of bona fide receptors but not orphan receptors. Evolutionary sequence analysis suggested that these orphan receptors probably form a functionally distinct subset of the IL1R superfamily. Jin et al. (2000) and Sana et al. (2000) suggested that, like IL1RAPL1, IL1RAPL2 may be the site of mutations causing nonspecific mental retardation.

Full details of the abovementioned studies are described in the following publications, the disclosure of which are hereby incorporated by reference:

Jin, H.; Gardner, R. J.; Viswesvaraiah, R.; Muntoni, F.; Roberts, R. G.: Two novel members of the interleukin-1 receptor gene family, one deleted in Xp22.1-Xp21.3 mental retardation. Europ. J. Hum. Genet. 8:87-94, 2000; and Sana, T. R.; Debets, R.; Timans, J. C.; Bazan, J. F.; Kastelein, R. A.: Computational identification, cloning, and characterization of IL1R9, a novel interleukin- 1 receptor-like gene e.

Further studies establishing the function and utilities of IL1RAPL2 are found in John Hopkins OMIM database record ID 300277, and in cited publications listed in Table 5, which are hereby incorporated by reference. Indolethylamine n-methyltransferase (INMT, Accession NP_006765.3) is another GAM130 target gene, herein designated TARGET GENE. INMT BINDING SITE is a target binding site found in the 3' untranslated region of mRNA encoded by INMT, corresponding to a target binding site such as BINDING SITE I, BINDING SITE II or BINDING SITE III of FIG. 8. Table 4 illustrates the complementarity of the nucleotide sequences of INMT BINDING SITE, designated SEQ ID:2284, to the nucleotide sequence of GAM130 RNA, herein designated GAM RNA, also designated SEQ ID:331.

Another function of GAM130 is therefore inhibition of Indolethylamine n-methyltransferase (INMT, Accession NP_006765.3). Accordingly, utilities of GAM130 include diagnosis, prevention and treatment of diseases and clinical conditions associated with INMT.

KIAA0063 (Accession NP_055691.1) is another GAM130 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:11890, to the nucleotide sequence of GAM130 RNA, herein designated GAM RNA, also designated SEQ ID:331.

Another function of GAM130 is therefore inhibition of KIAA0063 (Accession NP_055691.1). Accordingly, utilities of GAM130 include diagnosis, prevention and treatment of diseases and clinical conditions associated with KIAA0063.

KIAA0117 (Accession XP_290939.1) is another GAM130 target gene, herein designated TARGET GENE. KIAA0117 BINDING SITE is a target binding site found in the 3' untranslated region of mRNA encoded by KIAA0117, corresponding to a target binding site such as BINDING SITE I, BINDING SITE II or BINDING SITE III of FIG. 8. Table 4 illustrates the complementarity of the nucleotide sequences of KIAA0117 BINDING SITE, designated SEQ ID:10770, to the nucleotide sequence of GAM130 RNA, herein designated GAM RNA, also designated SEQ ID:331.

Another function of GAM130 is therefore inhibition of KIAA0117 (Accession XP_290939.1). Accordingly, utilities of GAM130 include diagnosis, prevention and treatment of diseases and clinical conditions associated with KIAA0117.

KIAA0513 (Accession NP_055547.1) is another GAM130 target gene, herein designated TARGET GENE. KIAA0513 BINDING SITE is a target binding site found in the 3' untranslated region of mRNA encoded by KIAA0513, corresponding to a target binding site such as BINDING SITE I, BINDING SITE II or BINDING SITE III of FIG. 8. Table 4 illustrates the complementarity of the nucleotide sequences of KIAA0513 BINDING SITE, designated SEQ ID:6082, to the nucleotide sequence of GAM130 RNA, herein designated GAM RNA, also designated SEQ ID:331.

Another function of GAM130 is therefore inhibition of KIAA0513 (Accession NP_055547.1). Accordingly, utilities of GAM130 include diagnosis, prevention and treatment of diseases and clinical conditions associated with KIAA0513.

KIAA0527 (Accession XP_171054.1) is another GAM130 target gene, herein designated TARGET GENE. KIAA0527 BINDING SITE is a target binding site found in the 3' untranslated region of mRNA encoded by KIAA0527, corresponding to a target binding site such as BINDING SITE I, BINDING SITE II or BINDING SITE III of FIG. 8. Table 4 illustrates the complementarity of the nucleotide sequences of KIAA0527 BINDING SITE, designated SEQ ID:10779, to the nucleotide sequence of GAM130 RNA, herein designated GAM RNA, also designated SEQ ID:331.

Another function of GAM130 is therefore inhibition of KIAA0527 (Accession XP_171054.1). Accordingly, utilities of GAM130 include diagnosis, prevention and treatment of diseases and clinical conditions associated with KIAA0527.

KIAA0563 (Accession NP_055649.1) is another GAM130 target gene, herein designated TARGET GENE. KIAA0563 BINDING SITE1 and KIAA0563 BINDING SITE2 are target binding sites found in untranslated regions of mRNA encoded by KIAA0563, corresponding to target binding sites such as BINDING SITE I, BINDING SITE II or BINDING SITE III of FIG. 8. Table 4 illustrates the complementarity of the nucleotide sequences of KIAA0563 BINDING SITE1 and KIAA0563 BINDING SITE2, designated SEQ ID:6206 and SEQ ID:3624 respectively, to the nucleotide sequence of GAM130 RNA, herein designated GAM RNA, also designated SEQ ID:331.

Another function of GAM130 is therefore inhibition of KIAA0563 (Accession NP_055649.1). Accordingly, utilities of GAM130 include diagnosis, prevention and treatment of diseases and clinical conditions associated with KIAA0563.

KIAA0962 (Accession XP_290942.1) is another GAM130 target gene, herein designated TARGET GENE. KIAA0962 BINDING SITE is a target binding site found in the 3' untranslated region of mRNA encoded by KIAA0962, corresponding to a target binding site such as BINDING SITE I, BINDING SITE II or BINDING SITE III of FIG. 8. Table 4 illustrates the complementarity of the nucleotide sequences of KIAA0962 BINDING SITE, designated SEQ ID:2870, to the nucleotide sequence of GAM130 RNA, herein designated GAM RNA, also designated SEQ ID:331.

Another function of GAM130 is therefore inhibition of KIAA0962 (Accession XP_290942.1). Accordingly, utilities of GAM130 include diagnosis, prevention and treatment of diseases and clinical conditions associated with KIAA0962.

KIAA1002 (Accession XP_290584.1) is another GAM130 target gene, herein designated TARGET GENE. KIAA1002 BINDING SITE is a target binding site found in the 3' untranslated region of mRNA encoded by KIAA1002, corresponding to a target binding site such as BINDING SITE I, BINDING SITE II or BINDING SITE III of FIG. 8. Table 4 illustrates the complementarity of the nucleotide sequences of KIAA1002 BINDING SITE, designated SEQ ID:1603, to the nucleotide sequence of GAM130 RNA, herein designated GAM RNA, also designated SEQ ID:331.

Another function of GAM130 is therefore inhibition of KIAA1002 (Accession XP_290584.1). Accordingly, utilities of GAM130 include diagnosis, prevention and treatment of diseases and clinical conditions associated with KIAA1002.

KIAA1054 (Accession XP_043493.5) is another GAM130 target gene, herein designated TARGET GENE. KIAA1054 BINDING SITE is a target binding site found in the 3' untranslated region of mRNA encoded by KIAA1054, corresponding to a target binding site such as BINDING SITE I, BINDING SITE II or BINDING SITE III of FIG. 8. Table 4 illustrates the complementarity of the nucleotide sequences of KIAA1054 BINDING SITE, designated SEQ ID:5630, to the nucleotide sequence of GAM130 RNA, herein designated GAM RNA, also designated SEQ ID:331.

Another function of GAM130 is therefore inhibition of KIAA1054 (Accession XP_043493.5). Accordingly, utilities of GAM130 include diagnosis, prevention and treatment of diseases and clinical conditions associated with KIAA1054.

KIAA1170 (Accession XP_045907.2) is another GAM130 target gene, herein designated TARGET GENE. KIAA1170 BINDING SITE is a target binding site found in the 3' untranslated region of mRNA encoded by KIAA1170, corresponding to a target binding site such as BINDING SITE I, BINDING SITE II or BINDING SITE III of FIG. 8. Table 4 illustrates the complementarity of the nucleotide sequences of KIAA1170 BINDING SITE, designated SEQ ID:9008, to the nucleotide sequence of GAM130 RNA, herein designated GAM RNA, also designated SEQ ID:331.

Another function of GAM130 is therefore inhibition of KIAA1170 (Accession XP_045907.2). Accordingly, utilities of GAM130 include diagnosis, prevention and treatment of diseases and clinical conditions associated with KIAA1170.

KIAA1203 (Accession XP_049683.4) is another GAM130 target gene, herein designated TARGET GENE. KIAA1203 BINDING SITE is a target binding site found in the 3' untranslated region of mRNA encoded by KIAA1203, corresponding to a target binding site such as BINDING SITE I, BINDING SITE II or BINDING SITE III of FIG. 8. Table 4 illustrates the complementarity of the nucleotide sequences of KIAA1203 BINDING SITE, designated SEQ ID:14482, to the nucleotide sequence of GAM130 RNA, herein designated GAM RNA, also designated SEQ ID:331.

Another function of GAM130 is therefore inhibition of KIAA1203 (Accession XP_049683.4). Accordingly, utilities of GAM130 include diagnosis, prevention and treatment of diseases and clinical conditions associated with KIAA1203.

KIAA1257 (Accession XP_031577.2) is another GAM130 target gene, herein designated TARGET GENE. KIAA1257 BINDING SITE is a target binding site found in the 3' untranslated region of mRNA encoded by KIAA1257, corresponding to a target binding site such as BINDING SITE I, BINDING SITE II or BINDING SITE III of FIG. 8. Table 4 illustrates the complementarity of the nucleotide sequences of KIAA1257 BINDING SITE, designated SEQ ID:6895, to the nucleotide sequence of GAM130 RNA, herein designated GAM RNA, also designated SEQ ID:331.

Another function of GAM130 is therefore inhibition of KIAA1257 (Accession XP_031577.2). Accordingly, utilities of GAM130 include diagnosis, prevention and treatment of diseases and clinical conditions associated with KIAA1257.

KIAA1268 (Accession XP_291055.1) is another GAM130 target gene, herein designated TARGET GENE. KIAA1268 BINDING SITE is a target binding site found in the 3' untranslated region of mRNA encoded by KIAA1268, corresponding to a target binding site such as BINDING SITE I, BINDING SITE II or BINDING SITE III of FIG. 8. Table 4 illustrates the complementarity of the nucleotide sequences of KIAA1268 BINDING SITE, designated SEQ ID:14527, to the nucleotide sequence of GAM130 RNA, herein designated GAM RNA, also designated SEQ ID:331.

Another function of GAM130 is therefore inhibition of KIAA1268 (Accession XP_291055.1). Accordingly, utilities of GAM130 include diagnosis, prevention and treatment of diseases and clinical conditions associated with KIAA1268.

KIAA1615 (Accession NP_066002.1) is another GAM130 target gene, herein designated TARGET GENE. KIAA1615 BINDING SITE1 and KIAA1615 BINDING SITE2 are target binding sites found in untranslated regions of mRNA encoded by KIAA1615, corresponding to target binding sites such as BINDING SITE I, BINDING SITE II or BINDING SITE III of FIG. 8. Table 4 illustrates the complementarity of the nucleotide sequences of KIAA1615 BINDING SITE1 and KIAA1615 BINDING SITE2, designated SEQ ID:19161 and SEQ ID:19857 respectively, to the nucleotide sequence of GAM130 RNA, herein designated GAM RNA, also designated SEQ ID:331.

Another function of GAM130 is therefore inhibition of KIAA1615 (Accession NP_066002.1). Accordingly, utilities of GAM130 include diagnosis, prevention and treatment of diseases and clinical conditions associated with KIAA1615.

KIAA1712 (Accession XP_041497.2) is another GAM130 target gene, herein designated TARGET GENE. KIAA1712 BINDING SITE is a target binding site found in the 3' untranslated region of multiple transcripts of mRNA encoded by KIAA1712, corresponding to a target binding site such as BINDING SITE I, BINDING SITE II or BINDING SITE III of FIG. 8. Table 4 illustrates the complementarity of the nucleotide sequences of KIAA1712 BINDING SITE, designated SEQ ID:16424, to the nucleotide sequence of GAM130 RNA, herein designated GAM RNA, also designated SEQ ID:331.

Another function of GAM130 is therefore inhibition of KIAA1712 (Accession XP_041497.2). Accordingly, utilities of GAM130 include diagnosis, prevention and treatment of diseases and clinical conditions associated with KIAA1712.

KIAA1712 (Accession NP_085136.1) is another GAM130 target gene, herein designated TARGET GENE. KIAA1712 BINDING SITE is a target binding site found in the 3' untranslated region of multiple transcripts of mRNA encoded by KIAA1712, corresponding to a target binding site such as BINDING SITE I, BINDING SITE II or BINDING SITE III of FIG. 8. Table 4 illustrates the complementarity of the nucleotide sequences of KIAA1712 BINDING SITE, designated SEQ ID:16424, to the nucleotide sequence of GAM130 RNA, herein designated GAM RNA, also designated SEQ ID:331.

Another function of GAM130 is therefore inhibition of KIAA1712 (Accession NP_085136.1). Accordingly, utilities of GAM130 include diagnosis, prevention and treatment of diseases and clinical conditions associated with KIAA1712.

KIAA1737 (Accession NP_219494.1) is another GAM130 target gene, herein designated TARGET GENE. KIAA1737 BINDING SITE is a target binding site found in the 3' untranslated region of mRNA encoded by KIAA1737, corresponding to a target binding site such as BINDING SITE I, BINDING SITE II or BINDING SITE III of FIG. 8. Table 4 illustrates the complementarity of the nucleotide sequences of KIAA1737 BINDING SITE, designated SEQ ID:6894, to the nucleotide sequence of GAM130 RNA, herein designated GAM RNA, also designated SEQ ID:331.

Another function of GAM130 is therefore inhibition of KIAA1737 (Accession NP_219494.1). Accordingly, utilities of GAM130 include diagnosis, prevention and treatment of diseases and clinical conditions associated with KIAA1737.

KIAA1922 (Accession XP_057040.1) is another GAM130 target gene, herein designated TARGET GENE. KIAA1922 BINDING SITE is a target binding site found in the 5' untranslated region of mRNA encoded by KIAA1922, corresponding to a target binding site such as BINDING SITE I, BINDING SITE II or BINDING SITE III of FIG. 8. Table 4 illustrates the complementarity of the nucleotide sequences of KIAA1922 BINDING SITE, designated SEQ ID:6286, to the nucleotide sequence of GAM130 RNA, herein designated GAM RNA, also designated SEQ ID:331.

Another function of GAM130 is therefore inhibition of KIAA1922 (Accession XP_057040.1). Accordingly, utilities of GAM130 include diagnosis, prevention and treatment of diseases and clinical conditions associated with KIAA1922.

KIAA1987 (Accession XP_113870.1) is another GAM130 target gene, herein designated TARGET GENE.

KIAA1987 BINDING SITE is a target binding site found in the 5' untranslated region of mRNA encoded by KIAA1987, corresponding to a target binding site such as BINDING SITE I, BINDING SITE II or BINDING SITE III of FIG. 8. Table 4 illustrates the complementarity of the nucleotide sequences of KIAA1987 BINDING SITE, designated SEQ ID:14709, to the nucleotide sequence of GAM130 RNA, herein designated GAM RNA, also designated SEQ ID:331.

Another function of GAM130 is therefore inhibition of KIAA1987 (Accession XP_113870.1). Accordingly, utilities of GAM130 include diagnosis, prevention and treatment of diseases and clinical conditions associated with KIAA1987.

Lysosomal-associated membrane protein 3 (LAMP3, Accession NP_055213.1) is another GAM130 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:3877, to the nucleotide sequence of GAM130 RNA, herein designated GAM RNA, also designated SEQ ID:331.

Another function of GAM130 is therefore inhibition of Lysosomal-associated membrane protein 3 (LAMP3, Accession NP_055213.1). Accordingly, utilities of GAM130 include diagnosis, prevention and treatment of diseases and clinical conditions associated with LAMP3.

LNK (Accession NP_005466.1) is another GAM130 target gene, herein designated TARGET GENE. LNK BINDING SITE is a target binding site found in the 3' untranslated region of mRNA encoded by LNK, corresponding to a target binding site such as BINDING SITE I, BINDING SITE II or BINDING SITE III of FIG. 8. Table 4 illustrates the complementarity of the nucleotide sequences of LNK BINDING SITE, designated SEQ ID:8277, to the nucleotide sequence of GAM130 RNA, herein designated GAM RNA, also designated SEQ ID:331.

Another function of GAM130 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM130 include diagnosis, prevention and treatment of diseases and clinical conditions associated with LNK.

The function of LNK has been established by previous studies. By PCR using primers based on the rat Lnk sequence and by screening a Jurkat cDNA library, Li et al. (2000) obtained a cDNA encoding human LNK. Sequence analysis predicted that the 575-amino acid LNK protein contains an N-terminal proline-rich region, a pleckstrin homology (PH) domain, and an Src homology 2 (SH2) domain; the PH and SH2 domains are similar to those of the APS protein. Northern blot analysis detected low expression of a 6.8-kb LNK transcript in various lymphoid cell lines. Confocal fluorescence microscopy showed that the majority of LNK is located in the juxtanuclear region with some found near the plasma membrane. Immunoprecipitation analysis demonstrated that LNK is phosphorylated by LCK (OMIM Ref. No. 153390) but not by SYK (OMIM Ref. No. 600085) and that LNK binds to the tyrosine-phosphorylated TCR zeta chain via its SH2 domain. Functional analysis indicated that LNK inhibits the activation of NFAT (see OMIM Ref. No. 600489) in stimulated T cells Animal model experiments lend further support to the function of LNK. Takaki et al. (2000) generated Lnk-deficient mice and found that although they had unimpaired T-cell development in thymus, pre-B and immature B cells accumulated in enlarged spleens. In bone marrow, there was also an increase in B-lineage cells, reflecting enhanced production of B-cell progenitors due in part to hypersensitivity to SCF (KITLG; 184745) in the presence or absence of IL7 (OMIM Ref. No. 146660). Western blot analysis showed that mouse Lnk is actually a 68-kD protein It is appreciated that the abovementioned animal model for LNK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, Y.; He, X.; Schembri-King, J.; Jakes, S.; Hayashi, J.: Cloning and characterization of human Lnk, an adaptor protein with pleckstrin homology and Src homology 2 domains that can inhibit T cell activation. J. Immun. 164: 5199-5206, 2000; and Takaki, S.; Sauer, K.; Iritani, B. M.; Chien, S.; Ebihara, Y.; Tsuji, K.; Takatsu, K.; Perlmutter, R. M.: Control of B cell production by the adaptor protein Lnk: definition of a conserve.

Further studies establishing the function and utilities of LNK are found in John Hopkins OMIM database record ID 605093, and in cited publications listed in Table 5, which are hereby incorporated by reference. LOC119392 (Accession NP_660290.1) is another GAM130 target gene, herein designated TARGET GENE. LOC119392 BINDING SITE is a target binding site found in the 3' untranslated region of mRNA encoded by LOC119392, corresponding to a target binding site such as BINDING SITE I, BINDING SITE II or BINDING SITE III of FIG. 8. Table 4 illustrates the complementarity of the nucleotide sequences of LOC119392 BINDING SITE, designated SEQ ID:11220, to the nucleotide sequence of GAM130 RNA, herein designated GAM RNA, also designated SEQ ID:331.

Another function of GAM130 is therefore inhibition of LOC119392 (Accession NP_660290.1). Accordingly, utilities of GAM130 include diagnosis, prevention and treatment of diseases and clinical conditions associated with LOC119392.

LOC128387 (Accession XP_059243.2) is another GAM130 target gene, herein designated TARGET GENE. LOC128387 BINDING SITE is a target binding site found in the 3' untranslated region of mRNA encoded by LOC128387, corresponding to a target binding site such as BINDING SITE I, BINDING SITE II or BINDING SITE III of FIG. 8. Table 4 illustrates the complementarity of the nucleotide sequences of LOC128387 BINDING SITE, designated SEQ ID:13503, to the nucleotide sequence of GAM130 RNA, herein designated GAM RNA, also designated SEQ ID:331.

Another function of GAM130 is therefore inhibition of LOC128387 (Accession XP_059243.2). Accordingly, utilities of GAM130 include diagnosis, prevention and treatment of diseases and clinical conditions associated with LOC128387.

LOC135818 (Accession XP_059804.4) is another GAM130 target gene, herein designated TARGET GENE. LOC135818 BINDING SITE is a target binding site found in the 3' untranslated region of mRNA encoded by LOC135818, corresponding to a target binding site such as BINDING SITE I, BINDING SITE II or BINDING SITE III of FIG. 8. Table 4 illustrates the complementarity of the nucleotide sequences of LOC135818 BINDING SITE, designated SEQ ID:9805, to the nucleotide sequence of GAM130 RNA, herein designated GAM RNA, also designated SEQ ID:331.

Another function of GAM130 is therefore inhibition of LOC135818 (Accession XP_059804.4). Accordingly, utilities of GAM130 include diagnosis, prevention and treatment of diseases and clinical conditions associated with LOC135818.

LOC137886 (Accession XP_059929.3) is another GAM130 target gene, herein designated TARGET GENE. LOC137886 BINDING SITE is a target binding site found in the 3' untranslated region of mRNA encoded by LOC137886, corresponding to a target binding site such as BINDING SITE I, BINDING SITE II or BINDING SITE III of FIG. 8. Table 4 illustrates the complementarity of the nucleotide sequences of LOC137886 BINDING SITE, designated SEQ ID:16853, to the nucleotide sequence of GAM130 RNA, herein designated GAM RNA, also designated SEQ ID:331.

Another function of GAM130 is therefore inhibition of LOC137886 (Accession XP_059929.3). Accordingly, utilities of GAM130 include diagnosis, prevention and treatment of diseases and clinical conditions associated with LOC137886.

LOC143241 (Accession NP_620167.1) is another GAM130 target gene, herein designated TARGET GENE. LOC143241 BINDING SITE is a target binding site found in the 5' untranslated region of mRNA encoded by LOC143241, corresponding to a target binding site such as BINDING SITE I, BINDING SITE II or BINDING SITE III of FIG. 8. Table 4 illustrates the complementarity of the nucleotide sequences of LOC143241 BINDING SITE, designated SEQ ID:4120, to the nucleotide sequence of GAM130 RNA, herein designated GAM RNA, also designated SEQ ID:331.

Another function of GAM130 is therefore inhibition of LOC143241 (Accession NP_620167.1). Accordingly, utilities of GAM130 include diagnosis, prevention and treatment of diseases and clinical conditions associated with LOC143241.

LOC145053 (Accession XP_096714.1) is another GAM130 target gene, herein designated TARGET GENE. LOC145053 BINDING SITE is a target binding site found in the 3' untranslated region of mRNA encoded by LOC145053, corresponding to a target binding site such as BINDING SITE I, BINDING SITE II or BINDING SITE III of FIG. 8. Table 4 illustrates the complementarity of the nucleotide sequences of LOC145053 BINDING SITE, designated SEQ ID:6594, to the nucleotide sequence of GAM130 RNA, herein designated GAM RNA, also designated SEQ ID:331.

Another function of GAM130 is therefore inhibition of LOC145053 (Accession XP_096714.1). Accordingly, utilities of GAM130 include diagnosis, prevention and treatment of diseases and clinical conditions associated with LOC145053.

LOC146177 (Accession NP_778229.1) is another GAM130 target gene, herein designated TARGET GENE. LOC146177 BINDING SITE is a target binding site found in the 5' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:2870, to the nucleotide sequence of GAM130 RNA, herein designated GAM RNA, also designated SEQ ID:331.

Another function of GAM130 is therefore inhibition of LOC146177 (Accession NP_778229.1). Accordingly, utilities of GAM130 include diagnosis, prevention and treatment of diseases and clinical conditions associated with LOC146177.

LOC146229 (Accession XP_085387.1) is another GAM130 target gene, herein designated TARGET GENE. LOC146229 BINDING SITE1 and LOC146229 BINDING SITE2 are target binding sites found in untranslated regions of mRNA encoded by LOC146229, corresponding to target binding sites such as BINDING SITE I, BINDING SITE II or BINDING SITE III of FIG. 8. Table 4 illustrates the complementarity of the nucleotide sequences of LOC146229 BINDING SITE1 and LOC146229 BINDING SITE2, designated SEQ ID:8717 and SEQ ID:3994 respectively, to the nucleotide sequence of GAM130 RNA, herein designated GAM RNA, also designated SEQ ID:331.

Another function of GAM130 is therefore inhibition of LOC146229 (Accession XP_085387.1). Accordingly, utilities of GAM130 include diagnosis, prevention and treatment of diseases and clinical conditions associated with LOC146229.

LOC146784 (Accession XP_085588.1) is another GAM130 target gene, herein designated TARGET GENE. LOC146784 BINDING SITE is a target binding site found in the 5' untranslated region of mRNA encoded by LOC146784, corresponding to a target binding site such as BINDING SITE I, BINDING SITE II or BINDING SITE III of FIG. 8. Table 4 illustrates the complementarity of the nucleotide sequences of LOC146784 BINDING SITE, designated SEQ ID:14527, to the nucleotide sequence of GAM130 RNA, herein designated GAM RNA, also designated SEQ ID:331.

Another function of GAM130 is therefore inhibition of LOC146784 (Accession XP_085588.1). Accordingly, utilities of GAM130 include diagnosis, prevention and treatment of diseases and clinical conditions associated with LOC146784.

LOC147071 (Accession XP_054031.5) is another GAM130 target gene, herein designated TARGET GENE. LOC147071 BINDING SITE is a target binding site found in the 5' untranslated region of mRNA encoded by LOC147071, corresponding to a target binding site such as BINDING SITE I, BINDING SITE II or BINDING SITE III of FIG. 8. Table 4 illustrates the complementarity of the nucleotide sequences of LOC147071 BINDING SITE, designated SEQ ID:6206, to the nucleotide sequence of GAM130 RNA, herein designated GAM RNA, also designated SEQ ID:331.

Another function of GAM130 is therefore inhibition of LOC147071 (Accession XP_054031.5). Accordingly, utilities of GAM130 include diagnosis, prevention and treatment of diseases and clinical conditions associated with LOC147071.

LOC147841 (Accession XP_085924.2) is another GAM130 target gene, herein designated TARGET GENE. LOC147841 BINDING SITE is a target binding site found in the 3' untranslated region of mRNA encoded by LOC147841, corresponding to a target binding site such as BINDING SITE I, BINDING SITE II or BINDING SITE III of FIG. 8. Table 4 illustrates the complementarity of the nucleotide sequences of LOC147841 BINDING SITE, designated SEQ ID:739, to the nucleotide sequence of GAM130 RNA, herein designated GAM RNA, also designated SEQ ID:331.

Another function of GAM130 is therefore inhibition of LOC147841 (Accession XP_085924.2). Accordingly, utilities of GAM130 include diagnosis, prevention and treatment of diseases and clinical conditions associated with LOC147841.

LOC148137 (Accession NP_653293.1) is another GAM130 target gene, herein designated TARGET GENE. LOC148137 BINDING SITE is a target binding site found in the 3' untranslated region of mRNA encoded by LOC148137, corresponding to a target binding site such as BINDING SITE I, BINDING SITE II or BINDING SITE III of FIG. 8. Table 4 illustrates the complementarity of the nucleotide sequences of LOC148137 BINDING SITE, designated SEQ ID:2081, to the nucleotide sequence of GAM130 RNA, herein designated GAM RNA, also designated SEQ ID:331.

Another function of GAM130 is therefore inhibition of LOC148137 (Accession NP_653293.1). Accordingly, utilities of GAM130 include diagnosis, prevention and treatment of diseases and clinical conditions associated with LOC148137.

LOC148203 (Accession XP_086095.1) is another GAM130 target gene, herein designated TARGET GENE. LOC148203 BINDING SITE is a target binding site found in the 3' untranslated region of mRNA encoded by LOC148203, corresponding to a target binding site such as BINDING SITE I, BINDING SITE II or BINDING SITE III of FIG. 8. Table 4 illustrates the complementarity of the nucleotide sequences of LOC148203 BINDING SITE, designated SEQ ID:10581, to the nucleotide sequence of GAM130 RNA, herein designated GAM RNA, also designated SEQ ID:331.

Another function of GAM130 is therefore inhibition of LOC148203 (Accession XP_086095.1). Accordingly, utilities of GAM130 include diagnosis, prevention and treatment of diseases and clinical conditions associated with LOC148203.

LOC148709 (Accession XP_086281.1) is another GAM130 target gene, herein designated TARGET GENE. LOC148709 BINDING SITE is a target binding site found in the 3' untranslated region of mRNA encoded by LOC148709, corresponding to a target binding site such as BINDING SITE I, BINDING SITE II or BINDING SITE III of FIG. 8. Table 4 illustrates the complementarity of the nucleotide sequences of LOC148709 BINDING SITE, designated SEQ ID:13543, to the nucleotide sequence of GAM130 RNA, herein designated GAM RNA, also designated SEQ ID:331.

Another function of GAM130 is therefore inhibition of LOC148709 (Accession XP_086281.1). Accordingly, utilities of GAM130 include diagnosis, prevention and treatment of diseases and clinical conditions associated with LOC148709.

LOC149149 (Accession XP_097598.1) is another GAM130 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:18540, to the nucleotide sequence of GAM130 RNA, herein designated GAM RNA, also designated SEQ ID:331.

Another function of GAM130 is therefore inhibition of LOC149149 (Accession XP_097598.1). Accordingly, utilities of GAM130 include diagnosis, prevention and treatment of diseases and clinical conditions associated with LOC149149.

LOC149506 (Accession XP_097661.1) is another GAM130 target gene, herein designated TARGET GENE. LOC149506 BINDING SITE is a target binding site found in the 3' untranslated region of mRNA encoded by LOC149506, corresponding to a target binding site such as BINDING SITE I, BINDING SITE II or BINDING SITE III of FIG. 8. Table 4 illustrates the complementarity of the nucleotide sequences of LOC149506 BINDING SITE, designated SEQ ID:7438, to the nucleotide sequence of GAM130 RNA, herein designated GAM RNA, also designated SEQ ID:331.

Another function of GAM130 is therefore inhibition of LOC149506 (Accession XP_097661.1). Accordingly, utilities of GAM130 include diagnosis, prevention and treatment of diseases and clinical conditions associated with LOC149506.

LOC150587 (Accession XP_097917.1) is another GAM130 target gene, herein designated TARGET GENE. LOC150587 BINDING SITE is a target binding site found in the 5' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:14454, to the nucleotide sequence of GAM130 RNA, herein designated GAM RNA, also designated SEQ ID:331.

Another function of GAM130 is therefore inhibition of LOC150587 (Accession XP_097917.1). Accordingly, utilities of GAM130 include diagnosis, prevention and treatment of diseases and clinical conditions associated with LOC150587.

LOC152687 (Accession XP_087503.1) is another GAM130 target gene, herein designated TARGET GENE. LOC152687 BINDING SITE is a target binding site found in the 5' untranslated region of mRNA encoded by LOC152687, corresponding to a target binding site such as BINDING SITE I, BINDING SITE II or BINDING SITE III of FIG. 8. Table 4 illustrates the complementarity of the nucleotide sequences of LOC152687 BINDING SITE, designated SEQ ID:17776, to the nucleotide sequence of GAM130 RNA, herein designated GAM RNA, also designated SEQ ID:331.

Another function of GAM130 is therefore inhibition of LOC152687 (Accession XP_087503.1). Accordingly, utilities of GAM130 include diagnosis, prevention and treatment of diseases and clinical conditions associated with LOC152687.

LOC153346 (Accession XP_098364.1) is another GAM130 target gene, herein designated TARGET GENE. LOC153346 BINDING SITE is a target binding site found in the 5' untranslated region of mRNA encoded by LOC153346, corresponding to a target binding site such as BINDING SITE I, BINDING SITE II or BINDING SITE III of FIG. 8. Table 4 illustrates the complementarity of the nucleotide sequences of LOC153346 BINDING SITE, designated SEQ ID:1484, to the nucleotide sequence of GAM130 RNA, herein designated GAM RNA, also designated SEQ ID:331.

Another function of GAM130 is therefore inhibition of LOC153346 (Accession XP_098364.1). Accordingly, utilities of GAM130 include diagnosis, prevention and treatment of diseases and clinical conditions associated with LOC153346.

LOC153811 (Accession XP_087779.2) is another GAM130 target gene, herein designated TARGET GENE. LOC153811 BINDING SITE is a target binding site found in the 3' untranslated region of mRNA encoded by LOC153811, corresponding to a target binding site such as BINDING SITE I, BINDING SITE II or BINDING SITE III of FIG. 8. Table 4 illustrates the complementarity of the nucleotide sequences of LOC153811 BINDING SITE, designated SEQ ID:4924, to the nucleotide sequence of GAM130 RNA, herein designated GAM RNA, also designated SEQ ID:331.

Another function of GAM130 is therefore inhibition of LOC153811 (Accession XP_087779.2). Accordingly, utilities of GAM130 include diagnosis, prevention and treatment of diseases and clinical conditions associated with LOC153811.

LOC157623 (Accession XP_088346.6) is another GAM130 target gene, herein designated TARGET GENE. LOC157623 BINDING SITE is a target binding site found in the 3' untranslated region of mRNA encoded by LOC157623, corresponding to a target binding site such as BINDING SITE I, BINDING SITE II or BINDING SITE III of FIG. 8. Table 4 illustrates the complementarity of the nucleotide sequences of LOC157623 BINDING SITE, designated SEQ ID:18434, to the nucleotide sequence of GAM130 RNA, herein designated GAM RNA, also designated SEQ ID:331.

Another function of GAM130 is therefore inhibition of LOC157623 (Accession XP_088346.6). Accordingly, utilities of GAM130 include diagnosis, prevention and treatment of diseases and clinical conditions associated with LOC157623.

LOC157918 (Accession XP_098842.1) is another GAM130 target gene, herein designated TARGET GENE. LOC157918 BINDING SITE is a target binding site found in the 3' untranslated region of mRNA encoded by LOC157918, corresponding to a target binding site such as BINDING SITE I, BINDING SITE II or BINDING SITE III of FIG. 8. Table 4 illustrates the complementarity of the nucleotide sequences of LOC157918 BINDING SITE, designated SEQ ID:1338, to the nucleotide sequence of GAM130 RNA, herein designated GAM RNA, also designated SEQ ID:331.

Another function of GAM130 is therefore inhibition of LOC157918 (Accession XP_098842.1). Accordingly, utilities of GAM130 include diagnosis, prevention and treatment of diseases and clinical conditions associated with LOC157918.

LOC162427 (Accession NP_835227.1) is another GAM130 target gene, herein designated TARGET GENE. LOC162427 BINDING SITE is a target binding site found in the 3' untranslated region of multiple transcripts of mRNA encoded by LOC162427, corresponding to a target binding site such as BINDING SITE I, BINDING SITE II or BINDING SITE III of FIG. 8. Table 4 illustrates the complementarity of the nucleotide sequences of LOC162427 BINDING SITE, designated SEQ ID:14028, to the nucleotide sequence of GAM130 RNA, herein designated GAM RNA, also designated SEQ ID:331.

Another function of GAM130 is therefore inhibition of LOC162427 (Accession NP_835227.1). Accordingly, utilities of GAM130 include diagnosis, prevention and treatment of diseases and clinical conditions associated with LOC162427.

LOC162427 (Accession XP_091549.3) is another GAM130 target gene, herein designated TARGET GENE. LOC162427 BINDING SITE is a target binding site found in the 3' untranslated region of multiple transcripts of mRNA encoded by LOC162427, corresponding to a target binding site such as BINDING SITE I, BINDING SITE II or BINDING SITE III of FIG. 8. Table 4 illustrates the complementarity of the nucleotide sequences of LOC162427 BINDING SITE, designated SEQ ID:14028, to the nucleotide sequence of GAM130 RNA, herein designated GAM RNA, also designated SEQ ID:331.

Another function of GAM130 is therefore inhibition of LOC162427 (Accession XP_091549.3). Accordingly, utilities of GAM130 include diagnosis, prevention and treatment of diseases and clinical conditions associated with LOC162427.

LOC163227 (Accession NP_775802.1) is another GAM130 target gene, herein designated TARGET GENE. LOC163227 BINDING SITE is a target binding site found in the 3' untranslated region of mRNA encoded by LOC163227, corresponding to a target binding site such as BINDING SITE I, BINDING SITE II or BINDING SITE III of FIG. 8. Table 4 illustrates the complementarity of the nucleotide sequences of LOC163227 BINDING SITE, designated SEQ ID:799, to the nucleotide sequence of GAM130 RNA, herein designated GAM RNA, also designated SEQ ID:331.

Another function of GAM130 is therefore inhibition of LOC163227 (Accession NP_775802.1). Accordingly, utilities of GAM130 include diagnosis, prevention and treatment of diseases and clinical conditions associated with LOC163227.

LOC164091 (Accession XP_089356.1) is another GAM130 target gene, herein designated TARGET GENE. LOC164091 BINDING SITE is a target binding site found in the 3' untranslated region of mRNA encoded by LOC164091, corresponding to a target binding site such as BINDING SITE I, BINDING SITE II or BINDING SITE III of FIG. 8. Table 4 illustrates the complementarity of the nucleotide sequences of LOC164091 BINDING SITE, designated SEQ ID:20153, to the nucleotide sequence of GAM130 RNA, herein designated GAM RNA, also designated SEQ ID:331.

Another function of GAM130 is therefore inhibition of LOC164091 (Accession XP_089356.1). Accordingly, utilities of GAM130 include diagnosis, prevention and treatment of diseases and clinical conditions associated with LOC164091.

LOC169611 (Accession XP_095809.4) is another GAM130 target gene, herein designated TARGET GENE. LOC169611 BINDING SITE is a target binding site found in the 3' untranslated region of mRNA encoded by LOC169611, corresponding to a target binding site such as BINDING SITE I, BINDING SITE II or BINDING SITE III of FIG. 8. Table 4 illustrates the complementarity of the nucleotide sequences of LOC169611 BINDING SITE, designated SEQ ID:13298, to the nucleotide sequence of GAM130 RNA, herein designated GAM RNA, also designated SEQ ID:331.

Another function of GAM130 is therefore inhibition of LOC169611 (Accession XP_095809.4). Accordingly, utilities of GAM130 include diagnosis, prevention and treatment of diseases and clinical conditions associated with LOC169611.

LOC197358 (Accession XP_113872.2) is another GAM130 target gene, herein designated TARGET GENE. LOC197358 BINDING SITE is a target binding site found in the 3' untranslated region of mRNA encoded by LOC197358, corresponding to a target binding site such as BINDING SITE I, BINDING SITE II or BINDING SITE III of FIG. 8. Table 4 illustrates the complementarity of the nucleotide sequences of LOC197358 BINDING SITE, designated SEQ ID:15866, to the nucleotide sequence of GAM130 RNA, herein designated GAM RNA, also designated SEQ ID:331.

Another function of GAM130 is therefore inhibition of LOC197358 (Accession XP_113872.2). Accordingly, utilities of GAM130 include diagnosis, prevention and treatment of diseases and clinical conditions associated with LOC197358.

LOC200860 (Accession XP_117289.1) is another GAM130 target gene, herein designated TARGET GENE. LOC200860 BINDING SITE is a target binding site found in the 3' untranslated region of mRNA encoded by LOC200860, corresponding to a target binding site such as BINDING SITE I, BINDING SITE II or BINDING SITE III of FIG. 8. Table 4 illustrates the complementarity of the nucleotide sequences of LOC200860 BINDING SITE, designated SEQ ID:8785, to the nucleotide sequence of GAM130 RNA, herein designated GAM RNA, also designated SEQ ID:331.

Another function of GAM130 is therefore inhibition of LOC200860 (Accession XP_117289.1). Accordingly, utilities of GAM130 include diagnosis, prevention and treatment of diseases and clinical conditions associated with LOC200860.

LOC200895 (Accession NP_789785.1) is another GAM130 target gene, herein designated TARGET GENE. LOC200895 BINDING SITE is a target binding site found in the 3' untranslated region of mRNA encoded by LOC200895, corresponding to a target binding site such as BINDING SITE I, BINDING SITE II or BINDING SITE III of FIG. 8. Table 4 illustrates the complementarity of the nucleotide sequences of LOC200895 BINDING SITE, designated SEQ ID:6736, to the nucleotide sequence of GAM130 RNA, herein designated GAM RNA, also designated SEQ ID:331.

Another function of GAM130 is therefore inhibition of LOC200895 (Accession NP_789785.1). Accordingly, utilities of GAM130 include diagnosis, prevention and treatment of diseases and clinical conditions associated with LOC200895.

LOC219731 (Accession XP_167596.1) is another GAM130 target gene, herein designated TARGET GENE. LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:1485, to the nucleotide sequence of GAM130 RNA, herein designated GAM RNA, also designated SEQ ID:331.

Another function of GAM130 is therefore inhibition of LOC219731 (Accession XP_167596.1). Accordingly, utilities of GAM130 include diagnosis, prevention and treatment of diseases and clinical conditions associated with LOC219731.

LOC282890 (Accession XP_212581.1) is another GAM130 target gene, herein designated TARGET GENE. LOC282890 BINDING SITE is a target binding site found in the 5' untranslated region of mRNA encoded by LOC282890, corresponding to a target binding site such as BINDING SITE I, BINDING SITE II or BINDING SITE III of FIG. 8. Table 4 illustrates the complementarity of the nucleotide sequences of LOC282890 BINDING SITE, designated SEQ ID:14621, to the nucleotide sequence of GAM130 RNA, herein designated GAM RNA, also designated SEQ ID:331.

Another function of GAM130 is therefore inhibition of LOC282890 (Accession XP_212581.1). Accordingly, utilities of GAM130 include diagnosis, prevention and treatment of diseases and clinical conditions associated with LOC282890.

LOC282927 (Accession XP_212629.1) is another GAM130 target gene, herein designated TARGET GENE. LOC282927 BINDING SITE is a target binding site found in the 5' untranslated region of mRNA encoded by LOC282927, corresponding to a target binding site such as BINDING SITE I, BINDING SITE II or BINDING SITE III of FIG. 8. Table 4 illustrates the complementarity of the nucleotide sequences of LOC282927 BINDING SITE, designated SEQ ID:14621, to the nucleotide sequence of GAM130 RNA, herein designated GAM RNA, also designated SEQ ID:331.

Another function of GAM130 is therefore inhibition of LOC282927 (Accession XP_212629.1). Accordingly, utilities of GAM130 include diagnosis, prevention and treatment of diseases and clinical conditions associated with LOC282927.

LOC283177 (Accession XP_210903.1) is another GAM130 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:4745, to the nucleotide sequence of GAM130 RNA, herein designated GAM RNA, also designated SEQ ID:331.

Another function of GAM130 is therefore inhibition of LOC283177 (Accession XP_210903.1). Accordingly, utilities of GAM130 include diagnosis, prevention and treatment of diseases and clinical conditions associated with LOC283177.

LOC283262 (Accession XP_210952.1) is another GAM130 target gene, herein designated TARGET GENE. LOC283262 BINDING SITE is a target binding site found in the 5' untranslated region of mRNA encoded by LOC283262, corresponding to a target binding site such as BINDING SITE I, BINDING SITE II or BINDING SITE III of FIG. 8. Table 4 illustrates the complementarity of the nucleotide sequences of LOC283262 BINDING SITE, designated SEQ ID:18890, to the nucleotide sequence of GAM130 RNA, herein designated GAM RNA, also designated SEQ ID:331.

Another function of GAM130 is therefore inhibition of LOC283262 (Accession XP_210952.1). Accordingly, utilities of GAM130 include diagnosis, prevention and treatment of diseases and clinical conditions associated with LOC283262.

LOC283278 (Accession XP_210961.1) is another GAM130 target gene, herein designated TARGET GENE. LOC283278 BINDING SITE is a target binding site found in the 3' untranslated region of mRNA encoded by LOC283278, corresponding to a target binding site such as BINDING SITE I, BINDING SITE II or BINDING SITE III of FIG. 8. Table 4 illustrates the complementarity of the nucleotide sequences of LOC283278 BINDING SITE, designated SEQ ID:14527, to the nucleotide sequence of GAM130 RNA, herein designated GAM RNA, also designated SEQ ID:331.

Another function of GAM130 is therefore inhibition of LOC283278 (Accession XP_210961.1). Accordingly, utilities of GAM130 include diagnosis, prevention and treatment of diseases and clinical conditions associated with LOC283278.

LOC283323 (Accession XP_210973.1) is another GAM130 target gene, herein designated TARGET GENE. LOC283323 BINDING SITE is a target binding site found in the 3' untranslated region of mRNA encoded by LOC283323, corresponding to a target binding site such as BINDING SITE I, BINDING SITE II or BINDING SITE III of FIG. 8. Table 4 illustrates the complementarity of the nucleotide sequences of LOC283323 BINDING SITE, designated SEQ ID:8110, to the nucleotide sequence of GAM130 RNA, herein designated GAM RNA, also designated SEQ ID:331.

Another function of GAM130 is therefore inhibition of LOC283323 (Accession XP_210973.1). Accordingly, utilities of GAM130 include diagnosis, prevention and treatment of diseases and clinical conditions associated with LOC283323.

LOC283387 (Accession XP_211007.1) is another GAM130 target gene, herein designated TARGET GENE. LOC283387 BINDING SITE is a target binding site found in the 3' untranslated region of mRNA encoded by LOC283387, corresponding to a target binding site such as BINDING SITE I, BINDING SITE II or BINDING SITE III of FIG. 8. Table 4 illustrates the complementarity of the nucleotide sequences of LOC283387 BINDING SITE, designated SEQ ID:15080, to the nucleotide sequence of GAM130 RNA, herein designated GAM RNA, also designated SEQ ID:331.

Another function of GAM130 is therefore inhibition of LOC283387 (Accession XP_211007.1). Accordingly, utilities of GAM130 include diagnosis, prevention and treatment of diseases and clinical conditions associated with LOC283387.

LOC283863 (Accession XP_208875.1) is another GAM130 target gene, herein designated TARGET GENE. LOC283863 BINDING SITE1 and LOC283863 BINDING SITE2 are target binding sites found in untranslated regions of mRNA encoded by LOC283863, corresponding to target binding sites such as BINDING SITE I, BINDING SITE II or BINDING SITE III of FIG. 8. Table 4 illustrates the complementarity of the nucleotide sequences of LOC283863 BINDING SITE1 and LOC283863 BINDING SITE2, designated SEQ ID:7323 and SEQ ID:10774 respectively, to the nucleotide sequence of GAM130 RNA, herein designated GAM RNA, also designated SEQ ID:331.

Another function of GAM130 is therefore inhibition of LOC283863 (Accession XP_208875.1). Accordingly, utilities of GAM130 include diagnosis, prevention and treatment of diseases and clinical conditions associated with LOC283863.

LOC283928 (Accession XP_208909.1) is another GAM130 target gene, herein designated TARGET GENE. LOC283928 BINDING SITE is a target binding site found in the 5' untranslated region of mRNA encoded by LOC283928, corresponding to a target binding site such as BINDING SITE I, BINDING SITE II or BINDING SITE III of FIG. 8. Table 4 illustrates the complementarity of the nucleotide sequences of LOC283928 BINDING SITE, designated SEQ ID:17017, to the nucleotide sequence of GAM130 RNA, herein designated GAM RNA, also designated SEQ ID:331.

Another function of GAM130 is therefore inhibition of LOC283928 (Accession XP_208909.1). Accordingly, utilities of GAM130 include diagnosis, prevention and treatment of diseases and clinical conditions associated with LOC283928.

LOC284016 (Accession XP_211298.1) is another GAM130 target gene, herein designated TARGET GENE. LOC284016 BINDING SITE is a target binding site found in the 3' untranslated region of mRNA encoded by LOC284016, corresponding to a target binding site such as BINDING SITE I, BINDING SITE II or BINDING SITE III of FIG. 8. Table 4 illustrates the complementarity of the nucleotide sequences of LOC284016 BINDING SITE, designated SEQ ID:9226, to the nucleotide sequence of GAM130 RNA, herein designated GAM RNA, also designated SEQ ID:331.

Another function of GAM130 is therefore inhibition of LOC284016 (Accession XP_211298.1). Accordingly, utilities of GAM130 include diagnosis, prevention and treatment of diseases and clinical conditions associated with LOC284016.

LOC284019 (Accession XP_211302.1) is another GAM130 target gene, herein designated TARGET GENE. LOC284019 BINDING SITE is a target binding site found in the 5' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:13475, to the nucleotide sequence of GAM130 RNA, herein designated GAM RNA, also designated SEQ ID:331.

Another function of GAM130 is therefore inhibition of LOC284019 (Accession XP_211302.1). Accordingly, utilities of GAM130 include diagnosis, prevention and treatment of diseases and clinical conditions associated with LOC284019.

LOC284102 (Accession XP_211327.3) is another GAM130 target gene, herein designated TARGET GENE. LOC284102 BINDING SITE is a target binding site found in the 3' untranslated region of mRNA encoded by LOC284102, corresponding to a target binding site such as BINDING SITE I, BINDING SITE II or BINDING SITE III of FIG. 8. Table 4 illustrates the complementarity of the nucleotide sequences of LOC284102 BINDING SITE, designated SEQ ID:17387, to the nucleotide sequence of GAM130 RNA, herein designated GAM RNA, also designated SEQ ID:331.

Another function of GAM130 is therefore inhibition of LOC284102 (Accession XP_211327.3). Accordingly, utilities of GAM130 include diagnosis, prevention and treatment of diseases and clinical conditions associated with LOC284102.

LOC284108 (Accession XP_211328.1) is another GAM130 target gene, herein designated TARGET GENE. LOC284108 BINDING SITE is a target binding site found in the 3' untranslated region of mRNA encoded by LOC284108, corresponding to a target binding site such as BINDING SITE I, BINDING SITE II or BINDING SITE III of FIG. 8. Table 4 illustrates the complementarity of the nucleotide sequences of LOC284108 BINDING SITE, designated SEQ ID:16225, to the nucleotide sequence of GAM130 RNA, herein designated GAM RNA, also designated SEQ ID:331.

Another function of GAM130 is therefore inhibition of LOC284108 (Accession XP_211328.1). Accordingly, utilities of GAM130 include diagnosis, prevention and treatment of diseases and clinical conditions associated with LOC284108.

LOC284145 (Accession XP_211353.1) is another GAM130 target gene, herein designated TARGET GENE. LOC284145 BINDING SITE is a target binding site found in the 5' untranslated region of mRNA encoded by LOC284145, corresponding to a target binding site such as BINDING SITE I, BINDING SITE II or BINDING SITE III of FIG. 8. Table 4 illustrates the complementarity of the nucleotide sequences of LOC284145 BINDING SITE, designated SEQ ID:15416, to the nucleotide sequence of GAM130 RNA, herein designated GAM RNA, also designated SEQ ID:331.

Another function of GAM130 is therefore inhibition of LOC284145 (Accession XP_211353.1). Accordingly, utilities of GAM130 include diagnosis, prevention and treatment of diseases and clinical conditions associated with LOC284145.

LOC284183 (Accession XP_209059.1) is another GAM130 target gene, herein designated TARGET GENE. LOC284183 BINDING SITE is a target binding site found in the 5' untranslated region of mRNA encoded by LOC284183, corresponding to a target binding site such as BINDING SITE I, BINDING SITE II or BINDING SITE III of FIG. 8. Table 4 illustrates the complementarity of the nucleotide sequences of LOC284183 BINDING SITE, designated SEQ ID:8830, to the nucleotide sequence of GAM130 RNA, herein designated GAM RNA, also designated SEQ ID:331.

Another function of GAM130 is therefore inhibition of LOC284183 (Accession XP_209059.1). Accordingly, utilities of GAM130 include diagnosis, prevention and treatment of diseases and clinical conditions associated with LOC284183.

LOC284289 (Accession XP_209105.1) is another GAM130 target gene, herein designated TARGET GENE. LOC284289 BINDING SITE is a target binding site found in the 3' untranslated region of mRNA encoded by LOC284289, corresponding to a target binding site such as BINDING SITE I, BINDING SITE II or BINDING SITE III of FIG. 8. Table 4 illustrates the complementarity of the nucleotide sequences of LOC284289 BINDING SITE, designated SEQ ID:19045, to the nucleotide sequence of GAM130 RNA, herein designated GAM RNA, also designated SEQ ID:331.

Another function of GAM130 is therefore inhibition of LOC284289 (Accession XP_209105.1). Accordingly, utilities of GAM130 include diagnosis, prevention and treatment of diseases and clinical conditions associated with LOC284289.

LOC284304 (Accession XP_211426.1) is another GAM130 target gene, herein designated TARGET GENE. LOC284304 BINDING SITE is a target binding site found in the 3' untranslated region of mRNA encoded by LOC284304, corresponding to a target binding site such as BINDING SITE I, BINDING SITE II or BINDING SITE III of FIG. 8. Table 4 illustrates the complementarity of the nucleotide sequences of LOC284304 BINDING SITE, designated SEQ ID:16485, to the nucleotide sequence of GAM130 RNA, herein designated GAM RNA, also designated SEQ ID:331.

Another function of GAM130 is therefore inhibition of LOC284304 (Accession XP_211426.1). Accordingly, utilities of GAM130 include diagnosis, prevention and treatment of diseases and clinical conditions associated with LOC284304.

LOC284362 (Accession XP_211435.1) is another GAM130 target gene, herein designated TARGET GENE. LOC284362 BINDING SITE is a target binding site found in the 3' untranslated region of mRNA encoded by LOC284362, corresponding to a target binding site such as BINDING SITE I, BINDING SITE II or BINDING SITE III of FIG. 8. Table 4 illustrates the complementarity of the nucleotide sequences of LOC284362 BINDING SITE, designated SEQ ID:12705, to the nucleotide sequence of GAM130 RNA, herein designated GAM RNA, also designated SEQ ID:331.

Another function of GAM130 is therefore inhibition of LOC284362 (Accession XP_211435.1). Accordingly, utilities of GAM130 include diagnosis, prevention and treatment of diseases and clinical conditions associated with LOC284362.

LOC284375 (Accession XP_209154.1) is another GAM130 target gene, herein designated TARGET GENE. LOC284375 BINDING SITE is a target binding site found in the 3' untranslated region of mRNA encoded by LOC284375, corresponding to a target binding site such as BINDING SITE I, BINDING SITE II or BINDING SITE III of FIG. 8. Table 4 illustrates the complementarity of the nucleotide sequences of LOC284375 BINDING SITE, designated SEQ ID:1561, to the nucleotide sequence of GAM130 RNA, herein designated GAM RNA, also designated SEQ ID:331.

Another function of GAM130 is therefore inhibition of LOC284375 (Accession XP_209154.1). Accordingly, utilities of GAM130 include diagnosis, prevention and treatment of diseases and clinical conditions associated with LOC284375.

LOC284376 (Accession XP_209157.1) is another GAM130 target gene, herein designated TARGET GENE. LOC284376 BINDING SITE is a target binding site found in the 3' untranslated region of mRNA encoded by LOC284376, corresponding to a target binding site such as BINDING SITE I, BINDING SITE II or BINDING SITE III of FIG. 8. Table 4 illustrates the complementarity of the nucleotide sequences of LOC284376 BINDING SITE, designated SEQ ID:9009, to the nucleotide sequence of GAM130 RNA, herein designated GAM RNA, also designated SEQ ID:331.

Another function of GAM130 is therefore inhibition of LOC284376 (Accession XP_209157.1). Accordingly, utilities of GAM130 include diagnosis, prevention and treatment of diseases and clinical conditions associated with LOC284376.

LOC284405 (Accession XP_209183.2) is another GAM130 target gene, herein designated TARGET GENE. LOC284405 BINDING SITE is a target binding site found in the 3' untranslated region of mRNA encoded by LOC284405, corresponding to a target binding site such as BINDING SITE I, BINDING SITE II or BINDING SITE III of FIG. 8. Table 4 illustrates the complementarity of the nucleotide sequences of LOC284405 BINDING SITE, designated SEQ ID:4905, to the nucleotide sequence of GAM130 RNA, herein designated GAM RNA, also designated SEQ ID:331.

Another function of GAM130 is therefore inhibition of LOC284405 (Accession XP_209183.2). Accordingly, utilities of GAM130 include diagnosis, prevention and treatment of diseases and clinical conditions associated with LOC284405.

LOC284408 (Accession XP_211443.1) is another GAM130 target gene, herein designated TARGET GENE. LOC284408 BINDING SITE is a target binding site found in the 3' untranslated region of mRNA encoded by LOC284408, corresponding to a target binding site such as BINDING SITE I, BINDING SITE II or BINDING SITE III of FIG. 8. Table 4 illustrates the complementarity of the nucleotide sequences of LOC284408 BINDING SITE, designated SEQ ID:13699, to the nucleotide sequence of GAM130 RNA, herein designated GAM RNA, also designated SEQ ID:331.

Another function of GAM130 is therefore inhibition of LOC284408 (Accession XP_211443.1). Accordingly, utilities of GAM130 include diagnosis, prevention and treatment of diseases and clinical conditions associated with LOC284408.

LOC284675 (Accession XP_209319.1) is another GAM130 target gene, herein designated TARGET GENE. LOC284675 BINDING SITE is a target binding site found in the 5' untranslated region of mRNA encoded by LOC284675, corresponding to a target binding site such as BINDING SITE I, BINDING SITE II or BINDING SITE III of FIG. 8. Table 4 illustrates the complementarity of the nucleotide sequences of LOC284675 BINDING SITE, designated SEQ ID:1879, to the nucleotide sequence of GAM130 RNA, herein designated GAM RNA, also designated SEQ ID:331.

Another function of GAM130 is therefore inhibition of LOC284675 (Accession XP_209319.1). Accordingly, utilities of GAM130 include diagnosis, prevention and treatment of diseases and clinical conditions associated with LOC284675.

LOC284723 (Accession XP_211602.1) is another GAM130 target gene, herein designated TARGET GENE. LOC284723 BINDING SITE is a target binding site found in the 3' untranslated region of mRNA encoded by LOC284723, corresponding to a target binding site such as BINDING SITE I, BINDING SITE II or BINDING SITE III of FIG. 8. Table 4 illustrates the complementarity of the nucleotide sequences of LOC284723 BINDING SITE, designated SEQ ID:18764, to the nucleotide sequence of GAM130 RNA, herein designated GAM RNA, also designated SEQ ID:331.

Another function of GAM130 is therefore inhibition of LOC284723 (Accession XP_211602.1). Accordingly, utilities of GAM130 include diagnosis, prevention and treatment of diseases and clinical conditions associated with LOC284723.

LOC284805 (Accession XP_209371.1) is another GAM130 target gene, herein designated TARGET GENE. LOC284805 BINDING SITE is a target binding site found in the 3' untranslated region of mRNA encoded by LOC284805, corresponding to a target binding site such as BINDING SITE I, BINDING SITE II or BINDING SITE III of FIG. 8. Table 4 illustrates the complementarity of the nucleotide sequences of LOC284805 BINDING SITE, designated SEQ ID:11995, to the nucleotide sequence of GAM130 RNA, herein designated GAM RNA, also designated SEQ ID:331.

Another function of GAM130 is therefore inhibition of LOC284805 (Accession XP_209371.1). Accordingly, utilities of GAM130 include diagnosis, prevention and treatment of diseases and clinical conditions associated with LOC284805.

LOC284839 (Accession XP_211661.1) is another GAM130 target gene, herein designated TARGET GENE. LOC284839 BINDING SITE is a target binding site found in the 5' untranslated region of mRNA encoded by LOC284839, corresponding to a target binding site such as BINDING SITE I, BINDING SITE II or BINDING SITE III of FIG. 8. Table 4 illustrates the complementarity of the nucleotide sequences of LOC284839 BINDING SITE, designated SEQ ID:2803, to the nucleotide sequence of GAM130 RNA, herein designated GAM RNA, also designated SEQ ID:331.

Another function of GAM130 is therefore inhibition of LOC284839 (Accession XP_211661.1). Accordingly, utilities of GAM130 include diagnosis, prevention and treatment of diseases and clinical conditions associated with LOC284839.

LOC284934 (Accession XP_211696.1) is another GAM130 target gene, herein designated TARGET GENE. LOC284934 BINDING SITE is a target binding site found in the 5' untranslated region of mRNA encoded by LOC284934, corresponding to a target binding site such as BINDING SITE I, BINDING SITE II or BINDING SITE III of FIG. 8. Table 4 illustrates the complementarity of the nucleotide sequences of LOC284934 BINDING SITE, designated SEQ ID:5893, to the nucleotide sequence of GAM130 RNA, herein designated GAM RNA, also designated SEQ ID:331.

Another function of GAM130 is therefore inhibition of LOC284934 (Accession XP_211696.1). Accordingly, utilities of GAM130 include diagnosis, prevention and treatment of diseases and clinical conditions associated with LOC284934.

LOC284982 (Accession XP_211721.1) is another GAM130 target gene, herein designated TARGET GENE. LOC284982 BINDING SITE is a target binding site found in the 5' untranslated region of mRNA encoded by LOC284982, corresponding to a target binding site such as BINDING SITE I, BINDING SITE II or BINDING SITE III of FIG. 8. Table 4 illustrates the complementarity of the nucleotide sequences of LOC284982 BINDING SITE, designated SEQ ID:1947, to the nucleotide sequence of GAM130 RNA, herein designated GAM RNA, also designated SEQ ID:331.

Another function of GAM130 is therefore inhibition of LOC284982 (Accession XP_211721.1). Accordingly, utilities of GAM130 include diagnosis, prevention and treatment of diseases and clinical conditions associated with LOC284982.

LOC285058 (Accession XP_211753.1) is another GAM130 target gene, herein designated TARGET GENE. LOC285058 BINDING SITE is a target binding site found in the 5' untranslated region of mRNA encoded by LOC285058, corresponding to a target binding site such as BINDING SITE I, BINDING SITE II or BINDING SITE III of FIG. 8. Table 4 illustrates the complementarity of the nucleotide sequences of LOC285058 BINDING SITE, designated SEQ ID:5847, to the nucleotide sequence of GAM130 RNA, herein designated GAM RNA, also designated SEQ ID:331.

Another function of GAM130 is therefore inhibition of LOC285058 (Accession XP_211753.1). Accordingly, utilities of GAM130 include diagnosis, prevention and treatment of diseases and clinical conditions associated with LOC285058.

LOC285088 (Accession XP_209465.1) is another GAM130 target gene, herein designated TARGET GENE. LOC285088 BINDING SITE is a target binding site found in the 3' untranslated region of mRNA encoded by LOC285088, corresponding to a target binding site such as BINDING SITE I, BINDING SITE II or BINDING SITE III of FIG. 8. Table 4 illustrates the complementarity of the nucleotide sequences of LOC285088 BINDING SITE, designated SEQ ID:2058, to the nucleotide sequence of GAM130 RNA, herein designated GAM RNA, also designated SEQ ID:331.

Another function of GAM130 is therefore inhibition of LOC285088 (Accession XP_209465.1). Accordingly, utilities of GAM130 include diagnosis, prevention and treatment of diseases and clinical conditions associated with LOC285088.

LOC285169 (Accession XP_211797.1) is another GAM130 target gene, herein designated TARGET GENE. LOC285169 BINDING SITE is a target binding site found in the 3' untranslated region of mRNA encoded by LOC285169, corresponding to a target binding site such as BINDING SITE I, BINDING SITE II or BINDING SITE III of FIG. 8. Table 4 illustrates the complementarity of the nucleotide sequences of LOC285169 BINDING SITE, designated SEQ ID:14805, to the nucleotide sequence of GAM130 RNA, herein designated GAM RNA, also designated SEQ ID:331.

Another function of GAM130 is therefore inhibition of LOC285169 (Accession XP_211797.1). Accordingly, utilities of GAM130 include diagnosis, prevention and treatment of diseases and clinical conditions associated with LOC285169.

LOC285221 (Accession XP_209521.1) is another GAM130 target gene, herein designated TARGET GENE. LOC285221 BINDING SITE is a target binding site found in the 5' untranslated region of mRNA encoded by LOC285221, corresponding to a target binding site such as BINDING SITE I, BINDING SITE II or BINDING SITE III of FIG. 8. Table 4 illustrates the complementarity of the nucleotide sequences of LOC285221 BINDING SITE, designated SEQ ID:8332, to the nucleotide sequence of GAM130 RNA, herein designated GAM RNA, also designated SEQ ID:331.

Another function of GAM130 is therefore inhibition of LOC285221 (Accession XP_209521.1). Accordingly, utilities of GAM130 include diagnosis, prevention and treatment of diseases and clinical conditions associated with LOC285221.

LOC285281 (Accession XP_211829.1) is another GAM130 target gene, herein designated TARGET GENE. LOC285281 BINDING SITE is a target binding site found in the 5' untranslated region of mRNA encoded by LOC285281, corresponding to a target binding site such as BINDING SITE I, BINDING SITE II or BINDING SITE III of FIG. 8. Table 4 illustrates the complementarity of the nucleotide sequences of LOC285281 BINDING SITE, designated SEQ ID:8457, to the nucleotide sequence of GAM130 RNA, herein designated GAM RNA, also designated SEQ ID:331.

Another function of GAM130 is therefore inhibition of LOC285281 (Accession XP_211829.1). Accordingly, utilities of GAM130 include diagnosis, prevention and treatment of diseases and clinical conditions associated with LOC285281.

LOC285530 (Accession XP_209649.1) is another GAM130 target gene, herein designated TARGET GENE. LOC285530 BINDING SITE is a target binding site found in the 5' untranslated region of mRNA encoded by LOC285530, corresponding to a target binding site such as BINDING SITE I, BINDING SITE II or BINDING SITE III of FIG. 8. Table 4 illustrates the complementarity of the nucleotide sequences of LOC285530 BINDING SITE, designated SEQ ID:2078, to the nucleotide sequence of GAM130 RNA, herein designated GAM RNA, also designated SEQ ID:331.

Another function of GAM130 is therefore inhibition of LOC285530 (Accession XP_209649.1). Accordingly, utilities of GAM130 include diagnosis, prevention and treatment of diseases and clinical conditions associated with LOC285530.

LOC285813 (Accession XP_212036.1) is another GAM130 target gene, herein designated TARGET GENE. LOC285813 BINDING SITE is a target binding site found in the 5' untranslated region of mRNA encoded by LOC285813, corresponding to a target binding site such as BINDING SITE I, BINDING SITE II or BINDING SITE III of FIG. 8. Table 4 illustrates the complementarity of the nucleotide sequences of LOC285813 BINDING SITE, designated SEQ ID:2870, to the nucleotide sequence of GAM130 RNA, herein designated GAM RNA, also designated SEQ ID:331.

Another function of GAM130 is therefore inhibition of LOC285813 (Accession XP_212036.1). Accordingly, utilities of GAM130 include diagnosis, prevention and treatment of diseases and clinical conditions associated with LOC285813.

LOC285868 (Accession XP_209788.1) is another GAM130 target gene, herein designated TARGET GENE. LOC285868 BINDING SITE is a target binding site found in the 3' untranslated region of mRNA encoded by LOC285868, corresponding to a target binding site such as BINDING SITE I, BINDING SITE II or BINDING SITE III of FIG. 8. Table 4 illustrates the complementarity of the nucleotide sequences of LOC285868 BINDING SITE, designated SEQ ID:9981, to the nucleotide sequence of GAM130 RNA, herein designated GAM RNA, also designated SEQ ID:331.

Another function of GAM130 is therefore inhibition of LOC285868 (Accession XP_209788.1). Accordingly, utilities of GAM130 include diagnosis, prevention and treatment of diseases and clinical conditions associated with LOC285868.

LOC285924 (Accession XP_209816.1) is another GAM130 target gene, herein designated TARGET GENE. LOC285924 BINDING SITE is a target binding site found in the 3' untranslated region of mRNA encoded by LOC285924, corresponding to a target binding site such as BINDING SITE I, BINDING SITE II or BINDING SITE III of FIG. 8. Table 4 illustrates the complementarity of the nucleotide sequences of LOC285924 BINDING SITE, designated SEQ ID:6287, to the nucleotide sequence of GAM130 RNA, herein designated GAM RNA, also designated SEQ ID:331.

Another function of GAM130 is therefore inhibition of LOC285924 (Accession XP_209816.1). Accordingly, utilities of GAM130 include diagnosis, prevention and treatment of diseases and clinical conditions associated with LOC285924.

LOC285972 (Accession XP_212105.1) is another GAM130 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:9180, to the nucleotide sequence of GAM130 RNA, herein designated GAM RNA, also designated SEQ ID:331.

Another function of GAM130 is therefore inhibition of LOC285972 (Accession XP_212105.1). Accordingly, utilities of GAM130 include diagnosis, prevention and treatment of diseases and clinical conditions associated with LOC285972.

LOC285989 (Accession XP_212111.1) is another GAM130 target gene, herein designated TARGET GENE. LOC285989 BINDING SITE is a target binding site found in the 3' untranslated region of mRNA encoded by LOC285989, corresponding to a target binding site such as BINDING SITE I, BINDING SITE II or BINDING SITE III of FIG. 8. Table 4 illustrates the complementarity of the nucleotide sequences of LOC285989 BINDING SITE, designated SEQ ID:16032, to the nucleotide sequence of GAM130 RNA, herein designated GAM RNA, also designated SEQ ID:331.

Another function of GAM130 is therefore inhibition of LOC285989 (Accession XP_212111.1). Accordingly, utilities of GAM130 include diagnosis, prevention and treatment of diseases and clinical conditions associated with LOC285989.

LOC286002 (Accession XP_212132.1) is another GAM130 target gene, herein designated TARGET GENE. LOC286002 BINDING SITE is a target binding site found in the 5' untranslated region of mRNA encoded by LOC286002, corresponding to a target binding site such as BINDING SITE I, BINDING SITE II or BINDING SITE III of FIG. 8. Table 4 illustrates the complementarity of the nucleotide sequences of LOC286002 BINDING SITE, designated SEQ ID:10926, to the nucleotide sequence of GAM130 RNA, herein designated GAM RNA, also designated SEQ ID:331.

Another function of GAM130 is therefore inhibition of LOC286002 (Accession XP_212132.1). Accordingly, utilities of GAM130 include diagnosis, prevention and treatment of diseases and clinical conditions associated with LOC286002.

LOC286032 (Accession XP_209867.2) is another GAM130 target gene, herein designated TARGET GENE. LOC286032 BINDING SITE is a target binding site found in the 3' untranslated region of mRNA encoded by LOC286032, corresponding to a target binding site such as BINDING SITE I, BINDING SITE II or BINDING SITE III of FIG. 8. Table 4 illustrates the complementarity of the nucleotide sequences of LOC286032 BINDING SITE, designated SEQ ID:16758, to the nucleotide sequence of GAM130 RNA, herein designated GAM RNA, also designated SEQ ID:331.

Another function of GAM130 is therefore inhibition of LOC286032 (Accession XP_209867.2). Accordingly, utilities of GAM130 include diagnosis, prevention and treatment of diseases and clinical conditions associated with LOC286032.

LOC286039 (Accession XP_209873.1) is another GAM130 target gene, herein designated TARGET GENE. LOC286039 BINDING SITE is a target binding site found in the 5' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:9783, to the nucleotide sequence of GAM130 RNA, herein designated GAM RNA, also designated SEQ ID:331.

Another function of GAM130 is therefore inhibition of LOC286039 (Accession XP_209873.1). Accordingly, utilities of GAM130 include diagnosis, prevention and treatment of diseases and clinical conditions associated with LOC286039.

LOC286078 (Accession XP_212163.1) is another GAM130 target gene, herein designated TARGET GENE.

LOC286078 BINDING SITE is a target binding site found in the 5' untranslated region of mRNA encoded by LOC286078, corresponding to a target binding site such as BINDING SITE I, BINDING SITE II or BINDING SITE III of FIG. 8. Table 4 illustrates the complementarity of the nucleotide sequences of LOC286078 BINDING SITE, designated SEQ ID:13192, to the nucleotide sequence of GAM130 RNA, herein designated GAM RNA, also designated SEQ ID:331.

Another function of GAM130 is therefore inhibition of LOC286078 (Accession XP_212163.1). Accordingly, utilities of GAM130 include diagnosis, prevention and treatment of diseases and clinical conditions associated with LOC286078.

LOC286341 (Accession XP_212278.1) is another GAM130 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:6947, to the nucleotide sequence of GAM130 RNA, herein designated GAM RNA, also designated SEQ ID:331.

Another function of GAM130 is therefore inhibition of LOC286341 (Accession XP_212278.1). Accordingly, utilities of GAM130 include diagnosis, prevention and treatment of diseases and clinical conditions associated with LOC286341.

LOC286401 (Accession XP_212310.1) is another GAM130 target gene, herein designated TARGET GENE. LOC286401 BINDING SITE is a target binding site found in the 5' untranslated region of mRNA encoded by LOC286401, corresponding to a target binding site such as BINDING SITE I, BINDING SITE II or BINDING SITE III of FIG. 8. Table 4 illustrates the complementarity of the nucleotide sequences of LOC286401 BINDING SITE, designated SEQ ID:15744, to the nucleotide sequence of GAM130 RNA, herein designated GAM RNA, also designated SEQ ID:331.

Another function of GAM130 is therefore inhibition of LOC286401 (Accession XP_212310.1). Accordingly, utilities of GAM130 include diagnosis, prevention and treatment of diseases and clinical conditions associated with LOC286401.

LOC286467 (Accession XP_210063.1) is another GAM130 target gene, herein designated TARGET GENE. LOC286467 BINDING SITE is a target binding site found in the 3' untranslated region of mRNA encoded by LOC286467, corresponding to a target binding site such as BINDING SITE I, BINDING SITE II or BINDING SITE III of FIG. 8. Table 4 illustrates the complementarity of the nucleotide sequences of LOC286467 BINDING SITE, designated SEQ ID:6673, to the nucleotide sequence of GAM130 RNA, herein designated GAM RNA, also designated SEQ ID:331.

Another function of GAM130 is therefore inhibition of LOC286467 (Accession XP_210063.1). Accordingly, utilities of GAM130 include diagnosis, prevention and treatment of diseases and clinical conditions associated with LOC286467.

LOC286520 (Accession XP_212330.2) is another GAM130 target gene, herein designated TARGET GENE. LOC286520 BINDING SITE is a target binding site found in the 3' untranslated region of mRNA encoded by LOC286520, corresponding to a target binding site such as BINDING SITE I, BINDING SITE II or BINDING SITE III of FIG. 8. Table 4 illustrates the complementarity of the nucleotide sequences of LOC286520 BINDING SITE, designated SEQ ID:4789, to the nucleotide sequence of GAM130 RNA, herein designated GAM RNA, also designated SEQ ID:331.

Another function of GAM130 is therefore inhibition of LOC286520 (Accession XP_212330.2). Accordingly, utilities of GAM130 include diagnosis, prevention and treatment of diseases and clinical conditions associated with LOC286520.

LOC338565 (Accession XP_294653.1) is another GAM130 target gene, herein designated TARGET GENE. LOC338565 BINDING SITE is a target binding site found in the 3' untranslated region of mRNA encoded by LOC338565, corresponding to a target binding site such as BINDING SITE I, BINDING SITE II or BINDING SITE III of FIG. 8. Table 4 illustrates the complementarity of the nucleotide sequences of LOC338565 BINDING SITE, designated SEQ ID:9751, to the nucleotide sequence of GAM130 RNA, herein designated GAM RNA, also designated SEQ ID:331.

Another function of GAM130 is therefore inhibition of LOC338565 (Accession XP_294653.1). Accordingly, utilities of GAM130 include diagnosis, prevention and treatment of diseases and clinical conditions associated with LOC338565.

LOC338923 (Accession XP_294742.1) is another GAM130 target gene, herein designated TARGET GENE. LOC338923 BINDING SITE is a target binding site found in the 3' untranslated region of mRNA encoded by LOC338923, corresponding to a target binding site such as BINDING SITE I, BINDING SITE II or BINDING SITE III of FIG. 8. Table 4 illustrates the complementarity of the nucleotide sequences of LOC338923 BINDING SITE, designated SEQ ID:1240, to the nucleotide sequence of GAM130 RNA, herein designated GAM RNA, also designated SEQ ID:331.

Another function of GAM130 is therefore inhibition of LOC338923 (Accession XP_294742.1). Accordingly, utilities of GAM130 include diagnosis, prevention and treatment of diseases and clinical conditions associated with LOC338923.

LOC339077 (Accession XP_294802.2) is another GAM130 target gene, herein designated TARGET GENE. LOC339077 BINDING SITE is a target binding site found in the 3' untranslated region of mRNA encoded by LOC339077, corresponding to a target binding site such as BINDING SITE I, BINDING SITE II or BINDING SITE III of FIG. 8. Table 4 illustrates the complementarity of the nucleotide sequences of LOC339077 BINDING SITE, designated SEQ ID:4115, to the nucleotide sequence of GAM130 RNA, herein designated GAM RNA, also designated SEQ ID:331.

Another function of GAM130 is therefore inhibition of LOC339077 (Accession XP_294802.2). Accordingly, utilities of GAM130 include diagnosis, prevention and treatment of diseases and clinical conditions associated with LOC339077.

LOC339324 (Accession XP_290838.1) is another GAM130 target gene, herein designated TARGET GENE. LOC339324 BINDING SITE is a target binding site found in the 3' untranslated region of mRNA encoded by LOC339324, corresponding to a target binding site such as BINDING SITE I, BINDING SITE II or BINDING SITE III of FIG. 8. Table 4 illustrates the complementarity of the nucleotide sequences of LOC339324 BINDING SITE, designated SEQ ID:14109, to the nucleotide sequence of GAM130 RNA, herein designated GAM RNA, also designated SEQ ID:331.

Another function of GAM130 is therefore inhibition of LOC339324 (Accession XP_290838.1). Accordingly, utilities of GAM130 include diagnosis, prevention and treatment of diseases and clinical conditions associated with LOC339324.

LOC339373 (Accession XP_294921.1) is another GAM130 target gene, herein designated TARGET GENE. LOC339373 BINDING SITE is a target binding site found in the 5' untranslated region of mRNA encoded by LOC339373, corresponding to a target binding site such as BINDING SITE I, BINDING SITE II or BINDING SITE III of FIG. 8. Table 4 illustrates the complementarity of the nucleotide sequences of LOC339373 BINDING SITE, designated SEQ ID:1840, to the nucleotide sequence of GAM130 RNA, herein designated GAM RNA, also designated SEQ ID:331.

Another function of GAM130 is therefore inhibition of LOC339373 (Accession XP_294921.1). Accordingly, utilities of GAM130 include diagnosis, prevention and treatment of diseases and clinical conditions associated with LOC339373.

LOC339492 (Accession XP_290919.1) is another GAM130 target gene, herein designated TARGET GENE. LOC339492 BINDING SITE is a target binding site found in the 3' untranslated region of mRNA encoded by LOC339492, corresponding to a target binding site such as BINDING SITE I, BINDING SITE II or BINDING SITE III of FIG. 8. Table 4 illustrates the complementarity of the nucleotide sequences of LOC339492 BINDING SITE, designated SEQ ID:14527, to the nucleotide sequence of GAM130 RNA, herein designated GAM RNA, also designated SEQ ID:331.

Another function of GAM130 is therefore inhibition of LOC339492 (Accession XP_290919.1). Accordingly, utilities of GAM130 include diagnosis, prevention and treatment of diseases and clinical conditions associated with LOC339492.

LOC339833 (Accession XP_291031.1) is another GAM130 target gene, herein designated TARGET GENE. LOC339833 BINDING SITE is a target binding site found in the 3' untranslated region of mRNA encoded by LOC339833, corresponding to a target binding site such as BINDING SITE I, BINDING SITE II or BINDING SITE III of FIG. 8. Table 4 illustrates the complementarity of the nucleotide sequences of LOC339833 BINDING SITE, designated SEQ ID:3269, to the nucleotide sequence of GAM130 RNA, herein designated GAM RNA, also designated SEQ ID:331.

Another function of GAM130 is therefore inhibition of LOC339833 (Accession XP_291031.1). Accordingly, utilities of GAM130 include diagnosis, prevention and treatment of diseases and clinical conditions associated with LOC339833.

LOC339874 (Accession XP_295090.1) is another GAM130 target gene, herein designated TARGET GENE. LOC339874 BINDING SITE is a target binding site found in the 3' untranslated region of mRNA encoded by LOC339874, corresponding to a target binding site such as BINDING SITE I, BINDING SITE II or BINDING SITE III of FIG. 8. Table 4 illustrates the complementarity of the nucleotide sequences of LOC339874 BINDING SITE, designated SEQ ID:19270, to the nucleotide sequence of GAM130 RNA, herein designated GAM RNA, also designated SEQ ID:331.

Another function of GAM130 is therefore inhibition of LOC339874 (Accession XP_295090.1). Accordingly, utilities of GAM130 include diagnosis, prevention and treatment of diseases and clinical conditions associated with LOC339874.

LOC340037 (Accession XP_295137.1) is another GAM130 target gene, herein designated TARGET GENE. LOC340037 BINDING SITE is a target binding site found in the 3' untranslated region of mRNA encoded by LOC340037, corresponding to a target binding site such as BINDING SITE I, BINDING SITE II or BINDING SITE III of FIG. 8. Table 4 illustrates the complementarity of the nucleotide sequences of LOC340037 BINDING SITE, designated SEQ ID:13921, to the nucleotide sequence of GAM130 RNA, herein designated GAM RNA, also designated SEQ ID:331.

Another function of GAM130 is therefore inhibition of LOC340037 (Accession XP_295137.1). Accordingly, utilities of GAM130 include diagnosis, prevention and treatment of diseases and clinical conditions associated with LOC340037.

LOC340390 (Accession XP_291269.1) is another GAM130 target gene, herein designated TARGET GENE. LOC340390 BINDING SITE is a target binding site found in the 3' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:5604, to the nucleotide sequence of GAM130 RNA, herein designated GAM RNA, also designated SEQ ID:331.

Another function of GAM130 is therefore inhibition of LOC340390 (Accession XP_291269.1). Accordingly, utilities of GAM130 include diagnosis, prevention and treatment of diseases and clinical conditions associated with LOC340390.

LOC340408 (Accession XP_291274.1) is another GAM130 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:9783, to the nucleotide sequence of GAM130 RNA, herein designated GAM RNA, also designated SEQ ID:331.

Another function of GAM130 is therefore inhibition of LOC340408 (Accession XP_291274.1). Accordingly, utilities of GAM130 include diagnosis, prevention and treatment of diseases and clinical conditions associated with LOC340408.

LOC347644 (Accession XP_300206.1) is another GAM130 target gene, herein designated TARGET GENE. LOC347644 BINDING SITE is a target binding site found in the 5' untranslated region of mRNA encoded by LOC347644, corresponding to a target binding site such as BINDING SITE I, BINDING SITE II or BINDING SITE III of FIG. 8. Table 4 illustrates the complementarity of the nucleotide sequences of LOC347644 BINDING SITE, designated SEQ ID:14621, to the nucleotide sequence of GAM130 RNA, herein designated GAM RNA, also designated SEQ ID:331.

Another function of GAM130 is therefore inhibition of LOC347644 (Accession XP_300206.1). Accordingly, utilities of GAM130 include diagnosis, prevention and treatment of diseases and clinical conditions associated with LOC347644.

LOC347905 (Accession XP_302624.1) is another GAM130 target gene, herein designated TARGET GENE. LOC347905 BINDING SITE is a target binding site found in the 5' untranslated region of mRNA encoded by LOC347905, corresponding to a target binding site such as BINDING SITE I, BINDING SITE II or BINDING SITE III of FIG. 8. Table 4 illustrates the complementarity of the nucleotide sequences of LOC347905 BINDING SITE, designated SEQ ID:8346, to the nucleotide sequence of GAM130 RNA, herein designated GAM RNA, also designated SEQ ID:331.

Another function of GAM130 is therefore inhibition of LOC347905 (Accession XP_302624.1). Accordingly, utilities of GAM130 include diagnosis, prevention and treatment of diseases and clinical conditions associated with LOC347905.

LOC348115 (Accession XP_300626.1) is another GAM130 target gene, herein designated TARGET GENE. LOC348115 BINDING SITE is a target binding site found in the 5' untranslated region of mRNA encoded by LOC348115, corresponding to a target binding site such as BINDING SITE I, BINDING SITE II or BINDING SITE III of FIG. 8. Table 4 illustrates the complementarity of the nucleotide sequences of LOC348115 BINDING SITE, designated SEQ ID:16032, to the nucleotide sequence of GAM130 RNA, herein designated GAM RNA, also designated SEQ ID:331.

Another function of GAM130 is therefore inhibition of LOC348115 (Accession XP_300626.1). Accordingly, utilities of GAM130 include diagnosis, prevention and treatment of diseases and clinical conditions associated with LOC348115.

LOC348402 (Accession XP_300730.1) is another GAM130 target gene, herein designated TARGET GENE. LOC348402 BINDING SITE is a target binding site found in the 3' untranslated region of mRNA encoded by LOC348402, corresponding to a target binding site such as BINDING SITE I, BINDING SITE II or BINDING SITE III of FIG. 8. Table 4 illustrates the complementarity of the nucleotide sequences of LOC348402 BINDING SITE, designated SEQ ID:14527, to the nucleotide sequence of GAM130 RNA, herein designated GAM RNA, also designated SEQ ID:331.

Another function of GAM130 is therefore inhibition of LOC348402 (Accession XP_300730.1). Accordingly, utilities of GAM130 include diagnosis, prevention and treatment of diseases and clinical conditions associated with LOC348402.

LOC348492 (Accession XP_300758.1) is another GAM130 target gene, herein designated TARGET GENE. LOC348492 BINDING SITE is a target binding site found in the 3' untranslated region of mRNA encoded by LOC348492, corresponding to a target binding site such as BINDING SITE I, BINDING SITE II or BINDING SITE III of FIG. 8. Table 4 illustrates the complementarity of the nucleotide sequences of LOC348492 BINDING SITE, designated SEQ ID:688, to the nucleotide sequence of GAM130 RNA, herein designated GAM RNA, also designated SEQ ID:331.

Another function of GAM130 is therefore inhibition of LOC348492 (Accession XP_300758.1). Accordingly, utilities of GAM130 include diagnosis, prevention and treatment of diseases and clinical conditions associated with LOC348492.

LOC348528 (Accession XP_302814.1) is another GAM130 target gene, herein designated TARGET GENE. LOC348528 BINDING SITE is a target binding site found in the 3' untranslated region of mRNA encoded by LOC348528, corresponding to a target binding site such as BINDING SITE I, BINDING SITE II or BINDING SITE III of FIG. 8. Table 4 illustrates the complementarity of the nucleotide sequences of LOC348528 BINDING SITE, designated SEQ ID:19934, to the nucleotide sequence of GAM130 RNA, herein designated GAM RNA, also designated SEQ ID:331.

Another function of GAM130 is therefore inhibition of LOC348528 (Accession XP_302814.1). Accordingly, utilities of GAM130 include diagnosis, prevention and treatment of diseases and clinical conditions associated with LOC348528.

LOC348790 (Accession XP_300843.1) is another GAM130 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:1047, to the nucleotide sequence of GAM130 RNA, herein designated GAM RNA, also designated SEQ ID:331.

Another function of GAM130 is therefore inhibition of LOC348790 (Accession XP_300843.1). Accordingly, utilities of GAM130 include diagnosis, prevention and treatment of diseases and clinical conditions associated with LOC348790.

LOC348798 (Accession XP_300845.1) is another GAM130 target gene, herein designated TARGET GENE. LOC348798 BINDING SITE is a target binding site found in the 5' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:5380, to the nucleotide sequence of GAM130 RNA, herein designated GAM RNA, also designated SEQ ID:331.

Another function of GAM130 is therefore inhibition of LOC348798 (Accession XP_300845.1). Accordingly, utilities of GAM130 include diagnosis, prevention and treatment of diseases and clinical conditions associated with LOC348798.

LOC349024 (Accession XP_300250.1) is another GAM130 target gene, herein designated TARGET GENE. LOC349024 BINDING SITE is a target binding site found in the 3' untranslated region of mRNA encoded by LOC349024, corresponding to a target binding site such as BINDING SITE I, BINDING SITE II or BINDING SITE III of FIG. 8. Table 4 illustrates the complementarity of the nucleotide sequences of LOC349024 BINDING SITE, designated SEQ ID:3876, to the nucleotide sequence of GAM130 RNA, herein designated GAM RNA, also designated SEQ ID:331.

Another function of GAM130 is therefore inhibition of LOC349024 (Accession XP_300250.1). Accordingly, utilities of GAM130 include diagnosis, prevention and treatment of diseases and clinical conditions associated with LOC349024.

LOC349251 (Accession XP_300251.1) is another GAM130 target gene, herein designated TARGET GENE. LOC349251 BINDING SITE is a target binding site found in the 3' untranslated region of mRNA encoded by LOC349251, corresponding to a target binding site such as BINDING SITE I, BINDING SITE II or BINDING SITE III of FIG. 8. Table 4 illustrates the complementarity of the nucleotide sequences of LOC349251 BINDING SITE, designated SEQ ID:19162, to the nucleotide sequence of GAM130 RNA, herein designated GAM RNA, also designated SEQ ID:331.

Another function of GAM130 is therefore inhibition of LOC349251 (Accession XP_300251.1). Accordingly, utilities of GAM130 include diagnosis, prevention and treatment of diseases and clinical conditions associated with LOC349251.

LOC57107 (Accession NP_065114.2) is another GAM130 target gene, herein designated TARGET GENE. LOC57107 BINDING SITE is a target binding site found in the 3' untranslated region of mRNA encoded by LOC57107, corresponding to a target binding site such as BINDING SITE I, BINDING SITE II or BINDING SITE III of FIG. 8. Table 4 illustrates the complementarity of the nucleotide sequences of LOC57107 BINDING SITE, designated SEQ ID:7276, to the nucleotide sequence of GAM130 RNA, herein designated GAM RNA, also designated SEQ ID:331.

Another function of GAM130 is therefore inhibition of LOC57107 (Accession NP_065114.2). Accordingly, utilities of GAM130 include diagnosis, prevention and treatment of diseases and clinical conditions associated with LOC57107.

LOC57146 (Accession NP_065155.2) is another GAM130 target gene, herein designated TARGET GENE. LOC57146 BINDING SITE is a target binding site found in the 3' untranslated region of mRNA encoded by LOC57146, corresponding to a target binding site such as BINDING SITE I, BINDING SITE II or BINDING SITE III of FIG. 8. Table 4 illustrates the complementarity of the nucleotide sequences of LOC57146 BINDING SITE, designated SEQ ID:1157, to the nucleotide sequence of GAM130 RNA, herein designated GAM RNA, also designated SEQ ID:331.

Another function of GAM130 is therefore inhibition of LOC57146 (Accession NP_065155.2). Accordingly, utilities of GAM130 include diagnosis, prevention and treatment of diseases and clinical conditions associated with LOC57146.

LOC85026 (Accession NP_116326.1) is another GAM130 target gene, herein designated TARGET GENE. LOC85026 BINDING SITE is a target binding site found in the 5' untranslated region of mRNA encoded by LOC85026, corresponding to a target binding site such as BINDING SITE I, BINDING SITE II or BINDING SITE III of FIG. 8. Table 4 illustrates the complementarity of the nucleotide sequences of LOC85026 BINDING SITE, designated SEQ ID:5403, to the nucleotide sequence of GAM130 RNA, herein designated GAM RNA, also designated SEQ ID:331.

Another function of GAM130 is therefore inhibition of LOC85026 (Accession NP_116326.1). Accordingly, utilities of GAM130 include diagnosis, prevention and treatment of diseases and clinical conditions associated with LOC85026.

LOC90408 (Accession XP_031517.1) is another GAM130 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:6139, to the nucleotide sequence of GAM130 RNA, herein designated GAM RNA, also designated SEQ ID:331.

Another function of GAM130 is therefore inhibition of LOC90408 (Accession XP_031517.1). Accordingly, utilities of GAM130 include diagnosis, prevention and treatment of diseases and clinical conditions associated with LOC90408.

LOC91115 (Accession XP_036218.1) is another GAM130 target gene, herein designated TARGET GENE. LOC91115 BINDING SITE1 and LOC91115 BINDING SITE2 are target binding sites found in untranslated regions of mRNA encoded by LOC91115, corresponding to target binding sites such as BINDING SITE I, BINDING SITE II or BINDING SITE III of FIG. 8. Table 4 illustrates the complementarity of the nucleotide sequences of LOC91115 BINDING SITE1 and LOC91115 BINDING SITE2, designated SEQ ID:6171 and SEQ ID:17551 respectively, to the nucleotide sequence of GAM130 RNA, herein designated GAM RNA, also designated SEQ ID:331.

Another function of GAM130 is therefore inhibition of LOC91115 (Accession XP_036218.1). Accordingly, utilities of GAM130 include diagnosis, prevention and treatment of diseases and clinical conditions associated with LOC91115.

LOC91373 (Accession XP_038063.5) is another GAM130 target gene, herein designated TARGET GENE. LOC91373 BINDING SITE is a target binding site found in the 3' untranslated region of mRNA encoded by LOC91373, corresponding to a target binding site such as BINDING SITE I, BINDING SITE II or BINDING SITE III of FIG. 8. Table 4 illustrates the complementarity of the nucleotide sequences of LOC91373 BINDING SITE, designated SEQ ID:2713, to the nucleotide sequence of GAM130 RNA, herein designated GAM RNA, also designated SEQ ID:331.

Another function of GAM130 is therefore inhibition of LOC91373 (Accession XP_038063.5). Accordingly, utilities of GAM130 include diagnosis, prevention and treatment of diseases and clinical conditions associated with LOC91373.

LOC93206 (Accession XP_049838.1) is another GAM130 target gene, herein designated TARGET GENE. LOC93206 BINDING SITE is a target binding site found in the 3' untranslated region of mRNA encoded by LOC93206, corresponding to a target binding site such as BINDING SITE I, BINDING SITE II or BINDING SITE III of FIG. 8. Table 4 illustrates the complementarity of the nucleotide sequences of LOC93206 BINDING SITE, designated SEQ ID:6707, to the nucleotide sequence of GAM130 RNA, herein designated GAM RNA, also designated SEQ ID:331.

Another function of GAM130 is therefore inhibition of LOC93206 (Accession XP_049838.1). Accordingly, utilities of GAM130 include diagnosis, prevention and treatment of diseases and clinical conditions associated with LOC93206.

Leucine zipper, putative tumor suppressor 1 (LZTS1, Accession NP_066300.1) is another GAM130 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:3087, to the nucleotide sequence of GAM130 RNA, herein designated GAM RNA, also designated SEQ ID:331.

Another function of GAM130 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM130 include diagnosis, prevention and treatment of diseases and clinical conditions associated with LZTS1.

The function of LZTS1 has been established by previous studies. Ishii et al. (1999) positionally cloned and characterized the FEZ1/LZTS1 (leucine zipper, putative tumor suppressor-1) gene at 8p22, a region that is lost in many tumors, including prostate, breast, head and neck, esophageal, and urinary bladder carcinomas. The predicted FEZ1 protein contained a leucine- zipper region with similarity to the DNA-binding domain of the cAMP-responsive activating transcription factor-5 (OMIM Ref. No. 606398). Northern blot analysis revealed that FEZ2 is expressed almost ubiquitously in normal tissues, although expression is most abundant in testes. FEZ1 expression was undetectable in more than 60% of epithelial tumors, but FEZ1 mutations were found in primary esophageal cancers and in a prostate cancer cell line. Transcript analysis from several FEZ1-expressing tumors revealed truncated mRNAs, including a frameshift. Alteration and inactivation of the FEZ1 gene may play a role in various human tumors. Ishii et al. (2001) showed that introduction of FEZ1/LZTS1 into FEZ1/LZTS1-negative cancer cells resulted in suppression of tumorigenicity and reduced cell growth with accumulation of cells at late S-G2/M stage of the cell cycle. Their data showed that FEZ1/LZTS1 inhibits cancer cell growth through regulation of mitosis, and that its alterations result in abnormal cell growth Full details of the abovementioned studies are described in the following publications, the disclosure of which are hereby incorporated by reference:

Ishii, H.; Baffa, R.; Numata, S.-I.; Murakumo, Y.; Rattan, S.; Inoue, H.; Mori, M.; Fidanza, V.; Alder, H.; Croce, C. M.: The FEZ1 gene at chromosome 8p22 encodes a leucine-zipper protein, and its expression is altered in multiple human tumors. Proc. Nat. Acad. Sci. 96:3928-3933, 1999; and Ishii, H.; Vecchione, A.; Murakumo, Y.; Baldassarre, G.; Numata, S.; Trapasso, F.; Alder, H.; Baffa, R.; Croce, C. M.: FEZ1/LZTS1 gene at 8p22 suppresses cancer cell growth and regulat.

Further studies establishing the function and utilities of LZTS1 are found in John Hopkins OMIM database record ID 606551, and in cited publications listed in Table 5, which are hereby incorporated by reference. Mads box transcription enhancer factor 2, polypeptide a (myocyte enhancer factor 2a) (MEF2A, Accession NP_005578.1) is another GAM130 target gene, herein designated TARGET GENE. MEF2A BINDING SITE is a target binding site found in the 5' untranslated region of mRNA encoded by MEF2A, corresponding to a target binding site such as BINDING SITE I, BINDING SITE II or BINDING SITE III of FIG. 8. Table 4 illustrates the complementarity of the nucleotide sequences of MEF2A BINDING SITE, designated SEQ ID:10779, to the nucleotide sequence of GAM130 RNA, herein designated GAM RNA, also designated SEQ ID:331.

Another function of GAM130 is therefore inhibition of Mads box transcription enhancer factor 2, polypeptide a (myocyte enhancer factor 2a) (MEF2A, Accession NP_005578.1), a gene which binds a consensus sequence that regulates transcription. Accordingly, utilities of GAM130 include diagnosis, prevention and treatment of diseases and clinical conditions associated with MEF2A.

The function of MEF2A has been established by previous studies. The process of differentiation from mesodermal precursor cells to myoblasts has led to the discovery of a variety of tissue-specific factors that regulate muscle gene expression. The myogenic basic helix-loop-helix proteins, including myoD (OMIM Ref. No. 159970), myogenin (OMIM Ref. No. 159980), MYF5 (OMIM Ref. No. 159990), and MRF4 (OMIM Ref. No. 159991) are 1 class of identified factors. A second family of DNA binding regulatory proteins is the myocyte-specific enhancer factor-2 (MEF2) family. Each of these proteins binds to the MEF2 target DNA sequence present in the regulatory regions of many, if not all, muscle-specific genes. The MEF2 genes are members of the MADS gene family (named for the yeast mating type-specific transcription factor MCM1, the plant homeotic genes 'agamous' and 'deficiens' and the human serum response factor SRF (OMIM Ref. No. 600589)), a family that also includes several homeotic genes and other transcription factors, all of which share a conserved DNA-binding domain. Pollock and Treisman (1991) cloned a cDNA for MEF2A, which they designated as a member of the RSRF (related to serum response factor) family. They also described the protein's DNA binding properties and its potential role in regulation of growth factor-inducible and muscle specific sequences. MEF2A cDNAs were also obtained by Yu et al. (1992), who screened an expression library of primary human skeletal myocytes from vastus lateralis with a DNA probe containing multiple copies of the MEF2 binding sequence. The mRNA is ubiquitously expressed, with highest levels found in skeletal muscle, heart, and brain. Several alternative splice variants of MEF2A were identified that were predicted to encode different protein products. Using immunofluorescence, MEF2A protein was detected in the nuclei of skeletal and cardiac muscle cells. Hobson et al. (1995) mapped the MEF2A gene using somatic cell hybrid panel DNAs including deletion or derivative chromosome cell lines and regionalized it to 15q26 by fluorescence in situ hybridization (FISH) with a YAC shown to contain MEF2A. Mouse Mef2A was mapped by Martin et al. (1994) to chromosome 7. Suzuki et al. (1996) mapped the MEF2A gene to 15q26 by FISH. They isolated and mapped a partially processed pseudogene (OMIM Ref. No. MEF2AP) to 1q24-q25 by FISH.

Animal model experiments lend further support to the function of MEF2A. Naya et al. (2002) generated mice deficient in Mef2a, the predominant Mef2 gene expressed in postnatal cardiac muscle. Most mice lacking Mef2a died suddenly within the first week of life and exhibited pronounced dilation of the right ventricle, myofibrillar fragmentation, mitochondrial disorganization, and activation of a fetal cardiac gene program. The few Mef2a null mice that survived to adulthood also showed a deficiency of cardiac mitochondria and susceptibility to sudden death.

It is appreciated that the abovementioned animal model for MEF2A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pollock, R.; Treisman, R.: Human SRF-related proteins: DNA-binding properties and potential regulatory targets. Genes Dev. 5:2327-2341, 1991. ; and Suzuki, E.; Lowry, J.; Sonoda, G.; Testa, J. R.; Walsh, K.: Structures and chromosome locations of the human MEF2A gene and a pseudogene MEF2AP. Cytogenet. Cell Genet. 73:244-249, 1996.

Further studies establishing the function and utilities of MEF2A are found in John Hopkins OMIM database record ID 600660, and in cited publications listed in Table 5, which are hereby incorporated by reference. MEGF11 (Accession NP_115821.1) is another GAM130 target gene, herein designated TARGET GENE. MEGF11 BINDING SITE is a target binding site found in the 3' untranslated region of mRNA encoded by MEGF11, corresponding to a target binding site such as BINDING SITE I, BINDING SITE II or BINDING SITE III of FIG. 8. Table 4 illustrates the complementarity of the nucleotide sequences of MEGF11 BINDING SITE, designated SEQ ID:19297, to the nucleotide sequence of GAM130 RNA, herein designated GAM RNA, also designated SEQ ID:331.

Another function of GAM130 is therefore inhibition of MEGF11 (Accession NP_115821.1). Accordingly, utilities of GAM130 include diagnosis, prevention and treatment of diseases and clinical conditions associated with MEGF11.

MGC13138 (Accession NP_219363.1) is another GAM130 target gene, herein designated TARGET GENE. MGC13138 BINDING SITE is a target binding site found in the 3' untranslated region of mRNA encoded by MGC13138, corresponding to a target binding site such as BINDING SITE I, BINDING SITE II or BINDING SITE III of FIG. 8. Table 4 illustrates the complementarity of the nucleotide sequences of MGC13138 BINDING SITE, designated SEQ ID:19675, to the nucleotide sequence of GAM130 RNA, herein designated GAM RNA, also designated SEQ ID:331.

Another function of GAM130 is therefore inhibition of MGC13138 (Accession NP_219363.1). Accordingly, utilities of GAM130 include diagnosis, prevention and treatment of diseases and clinical conditions associated with MGC13138.

MGC19556 (Accession NP_291029.1) is another GAM130 target gene, herein designated TARGET GENE. MGC19556 BINDING SITE is a target binding site found in the 5' untranslated region of mRNA encoded by MGC19556, corresponding to a target binding site such as BINDING SITE I, BINDING SITE II or BINDING SITE III of FIG. 8. Table 4 illustrates the complementarity of the nucleotide sequences of MGC19556 BINDING SITE, designated SEQ ID:11634, to the nucleotide sequence of GAM130 RNA, herein designated GAM RNA, also designated SEQ ID:331.

Another function of GAM130 is therefore inhibition of MGC19556 (Accession NP_291029.1). Accordingly, utilities of GAM130 include diagnosis, prevention and treatment of diseases and clinical conditions associated with MGC19556.

MGC21675 (Accession NP_443093.1) is another GAM130 target gene, herein designated TARGET GENE. MGC21675 BINDING SITE is a target binding site found in the 3' untranslated region of mRNA encoded by MGC21675, corresponding to a target binding site such as BINDING SITE I, BINDING SITE II or BINDING SITE III of FIG. 8. Table 4 illustrates the complementarity of the nucleotide sequences of MGC21675 BINDING SITE, designated SEQ ID:16032, to the nucleotide sequence of GAM130 RNA, herein designated GAM RNA, also designated SEQ ID:331.

Another function of GAM130 is therefore inhibition of MGC21675 (Accession NP_443093.1). Accordingly, utilities of GAM130 include diagnosis, prevention and treatment of diseases and clinical conditions associated with MGC21675.

MGC2474 (Accession NP_076420.1) is another GAM130 target gene, herein designated TARGET GENE. MGC2474 BINDING SITE is a target binding site found in the 3' untranslated region of mRNA encoded by MGC2474, corresponding to a target binding site such as BINDING SITE I, BINDING SITE II or BINDING SITE III of FIG. 8. Table 4 illustrates the complementarity of the nucleotide sequences of MGC2474 BINDING SITE, designated SEQ ID:6895, to the nucleotide sequence of GAM130 RNA, herein designated GAM RNA, also designated SEQ ID:331.

Another function of GAM130 is therefore inhibition of MGC2474 (Accession NP_076420.1). Accordingly, utilities of GAM130 include diagnosis, prevention and treatment of diseases and clinical conditions associated with MGC2474.

MGC26706 (Accession NP_689794.1) is another GAM130 target gene, herein designated TARGET GENE. MGC26706 BINDING SITE is a target binding site found in the 3' untranslated region of mRNA encoded by MGC26706, corresponding to a target binding site such as BINDING SITE I, BINDING SITE II or BINDING SITE III of FIG. 8. Table 4 illustrates the complementarity of the nucleotide sequences of MGC26706 BINDING SITE, designated SEQ ID:12477, to the nucleotide sequence of GAM130 RNA, herein designated GAM RNA, also designated SEQ ID:331.

Another function of GAM130 is therefore inhibition of MGC26706 (Accession NP_689794.1). Accordingly, utilities of GAM130 include diagnosis, prevention and treatment of diseases and clinical conditions associated with MGC26706.

MGC27345 (Accession XP_300964.1) is another GAM130 target gene, herein designated TARGET GENE. MGC27345 BINDING SITE is a target binding site found in the 5' untranslated region of multiple transcripts of mRNA encoded by MGC27345, corresponding to a target binding site such as BINDING SITE I, BINDING SITE II or BINDING SITE III of FIG. 8. Table 4 illustrates the complementarity of the nucleotide sequences of MGC27345 BINDING SITE, designated SEQ ID:18775, to the nucleotide sequence of GAM130 RNA, herein designated GAM RNA, also designated SEQ ID:331.

Another function of GAM130 is therefore inhibition of MGC27345 (Accession XP_300964.1). Accordingly, utilities of GAM130 include diagnosis, prevention and treatment of diseases and clinical conditions associated with MGC27345.

MGC3329 (Accession NP_076991.2) is another GAM130 target gene, herein designated TARGET GENE. MGC3329 BINDING SITE is a target binding site found in the 3' untranslated region of mRNA encoded by MGC3329, corresponding to a target binding site such as BINDING SITE I, BINDING SITE II or BINDING SITE III of FIG. 8. Table 4 illustrates the complementarity of the nucleotide sequences of MGC3329 BINDING SITE, designated SEQ ID:16011, to the nucleotide sequence of GAM130 RNA, herein designated GAM RNA, also designated SEQ ID:331.

Another function of GAM130 is therefore inhibition of MGC3329 (Accession NP_076991.2). Accordingly, utilities of GAM130 include diagnosis, prevention and treatment of diseases and clinical conditions associated with MGC3329.

MGC35468 (Accession NP_694976.1) is another GAM130 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:2083, to the nucleotide sequence of GAM130 RNA, herein designated GAM RNA, also designated SEQ ID:331.

Another function of GAM130 is therefore inhibition of MGC35468 (Accession NP_694976.1). Accordingly, utilities of GAM130 include diagnosis, prevention and treatment of diseases and clinical conditions associated with MGC35468.

MGC3771 (Accession NP_112232.1) is another GAM130 target gene, herein designated TARGET GENE. MGC3771 BINDING SITE is a target binding site found in the 5' untranslated region of mRNA encoded by MGC3771, corresponding to a target binding site such as BINDING SITE I, BINDING SITE II or BINDING SITE III of FIG. 8. Table 4 illustrates the complementarity of the nucleotide sequences of MGC3771 BINDING SITE, designated SEQ ID:17353, to the nucleotide sequence of GAM130 RNA, herein designated GAM RNA, also designated SEQ ID:331.

Another function of GAM130 is therefore inhibition of MGC3771 (Accession NP_112232.1). Accordingly, utilities of GAM130 include diagnosis, prevention and treatment of diseases and clinical conditions associated with MGC3771.

MGC40579 (Accession NP_689989.1) is another GAM130 target gene, herein designated TARGET GENE. MGC40579 BINDING SITE is a target binding site found in the 3' untranslated region of mRNA encoded by MGC40579, corresponding to a target binding site such as BINDING SITE I, BINDING SITE II or BINDING SITE III of FIG. 8. Table 4 illustrates the complementarity of the nucleotide sequences of MGC40579 BINDING SITE, designated SEQ ID:16272, to the nucleotide sequence of GAM130 RNA, herein designated GAM RNA, also designated SEQ ID:331.

Another function of GAM130 is therefore inhibition of MGC40579 (Accession NP_689989.1). Accordingly, utilities of GAM130 include diagnosis, prevention and treatment of diseases and clinical conditions associated with MGC40579.

MGC50452 (Accession NP_775733.1) is another GAM130 target gene, herein designated TARGET GENE. MGC50452 BINDING SITE is a target binding site found in the 3' untranslated region of mRNA encoded by MGC50452, corresponding to a target binding site such as BINDING SITE I, BINDING SITE II or BINDING SITE III of FIG. 8. Table 4 illustrates the complementarity of the nucleotide sequences of MGC50452 BINDING SITE, designated SEQ ID:1368, to the nucleotide sequence of GAM130 RNA, herein designated GAM RNA, also designated SEQ ID:331.

Another function of GAM130 is therefore inhibition of MGC50452 (Accession NP_775733.1). Accordingly, utilities of GAM130 include diagnosis, prevention and treatment of diseases and clinical conditions associated with MGC50452.

MGRN1 (Accession XP_048119.4) is another GAM130 target gene, herein designated TARGET GENE. MGRN1 BINDING SITE is a target binding site found in the 3' untranslated region of mRNA encoded by MGRN1, corresponding to a target binding site such as BINDING SITE I, BINDING SITE II or BINDING SITE III of FIG. 8. Table 4 illustrates the complementarity of the nucleotide sequences of MGRN1 BINDING SITE, designated SEQ ID:16033, to the nucleotide sequence of GAM130 RNA, herein designated GAM RNA, also designated SEQ ID:331.

Another function of GAM130 is therefore inhibition of MGRN1 (Accession XP_048119.4). Accordingly, utilities of GAM130 include diagnosis, prevention and treatment of diseases and clinical conditions associated with MGRN1.

Melan-a (MLANA, Accession NP_005502.1) is another GAM130 target gene, herein designated TARGET GENE. MLANA BINDING SITE is a target binding site found in the 3' untranslated region of mRNA encoded by MLANA, corresponding to a target binding site such as BINDING SITE I, BINDING SITE II or BINDING SITE III of FIG. 8. Table 4 illustrates the complementarity of the nucleotide sequences of MLANA BINDING SITE, designated SEQ ID:10945, to the nucleotide sequence of GAM130 RNA, herein designated GAM RNA, also designated SEQ ID:331.

Another function of GAM130 is therefore inhibition of Melan-a (MLANA, Accession NP_005502.1). Accordingly, utilities of GAM130 include diagnosis, prevention and treatment of diseases and clinical conditions associated with MLANA.

Myeloid leukemia factor 1 (MLF1, Accession NP_071888.1) is another GAM130 target gene, herein designated TARGET GENE. MLF1 BINDING SITE is a target binding site found in the 5' untranslated region of mRNA encoded by MLF1, corresponding to a target binding site such as BINDING SITE I, BINDING SITE II or BINDING SITE III of FIG. 8. Table 4 illustrates the complementarity of the nucleotide sequences of MLF1 BINDING SITE, designated SEQ ID:15324, to the nucleotide sequence of GAM130 RNA, herein designated GAM RNA, also designated SEQ ID:331.

Another function of GAM130 is therefore inhibition of Myeloid leukemia factor 1 (MLF1, Accession NP_071888.1). Accordingly, utilities of GAM130 include diagnosis, prevention and treatment of diseases and clinical conditions associated with MLF1.

NAP4 (Accession XP_294897.2) is another GAM130 target gene, herein designated TARGET GENE. NAP4 BINDING SITE is a target binding site found in the 3' untranslated region of mRNA encoded by NAP4, corresponding to a target binding site such as BINDING SITE I, BINDING SITE II or BINDING SITE III of FIG. 8. Table 4 illustrates the complementarity of the nucleotide sequences of NAP4 BINDING SITE, designated SEQ ID:6341, to the nucleotide sequence of GAM130 RNA, herein designated GAM RNA, also designated SEQ ID:331.

Another function of GAM130 is therefore inhibition of NAP4 (Accession XP_294897.2). Accordingly, utilities of GAM130 include diagnosis, prevention and treatment of diseases and clinical conditions associated with NAP4.

NCAG1 (Accession NP_115536.1) is another GAM130 target gene, herein designated TARGET GENE. NCAG1 BINDING SITE is a target binding site found in the 3' untranslated region of mRNA encoded by NCAG1, corresponding to a target binding site such as BINDING SITE I, BINDING SITE II or BINDING SITE III of FIG. 8. Table 4 illustrates the complementarity of the nucleotide sequences of NCAG1 BINDING SITE, designated SEQ ID:11087, to the nucleotide sequence of GAM130 RNA, herein designated GAM RNA, also designated SEQ ID:331.

Another function of GAM130 is therefore inhibition of NCAG1 (Accession NP_115536.1). Accordingly, utilities of GAM130 include diagnosis, prevention and treatment of diseases and clinical conditions associated with NCAG1.

Ndrg family member 3 (NDRG3, Accession NP_114402.1) is another GAM130 target gene, herein designated TARGET GENE. NDRG3 BINDING SITE is a target binding site found in the 3' untranslated region of multiple transcripts of mRNA encoded by NDRG3, corresponding to a target binding site such as BINDING SITE I, BINDING SITE II or BINDING SITE III of FIG. 8. Table 4 illustrates the complementarity of the nucleotide sequences of NDRG3 BINDING SITE, designated SEQ ID:10779, to the nucleotide sequence of GAM130 RNA, herein designated GAM RNA, also designated SEQ ID:331.

Another function of GAM130 is therefore inhibition of Ndrg family member 3 (NDRG3, Accession NP_114402.1). Accordingly, utilities of GAM130 include diagnosis, prevention and treatment of diseases and clinical conditions associated with NDRG3.

NOSIP (Accession NP_057037.1) is another GAM130 target gene, herein designated TARGET GENE. NOSIP BINDING SITE is a target binding site found in the 5' untranslated region of mRNA encoded by NOSIP, corresponding to a target binding site such as BINDING SITE I, BINDING SITE II or BINDING SITE III of FIG. 8. Table 4 illustrates the complementarity of the nucleotide sequences of NOSIP BINDING SITE, designated SEQ ID:6878, to the nucleotide sequence of GAM130 RNA, herein designated GAM RNA, also designated SEQ ID:331.

Another function of GAM130 is therefore inhibition of NOSIP (Accession NP_057037.1). Accordingly, utilities of GAM130 include diagnosis, prevention and treatment of diseases and clinical conditions associated with NOSIP.

5'-nucleotidase, cytosolic ii (NT5C2, Accession NP_036361.1) is another GAM130 target gene, herein designated TARGET GENE. NT5C2 BINDING SITE is a target binding site found in the 5' untranslated region of mRNA encoded by NT5C2, corresponding to a target binding site such as BINDING SITE I, BINDING SITE II or BINDING SITE III of FIG. 8. Table 4 illustrates the complementarity of the nucleotide sequences of NT5C2 BINDING SITE, designated SEQ ID:20125, to the nucleotide sequence of GAM130 RNA, herein designated GAM RNA, also designated SEQ ID:331.

Another function of GAM130 is therefore inhibition of 5'-nucleotidase, cytosolic ii (NT5C2, Accession NP_036361.1). Accordingly, utilities of GAM130 include diagnosis, prevention and treatment of diseases and clinical conditions associated with NT5C2.

NUP43 (Accession NP_078923.2) is another GAM130 target gene, herein designated TARGET GENE. NUP43 BINDING SITE is a target binding site found in the 3' untranslated region of mRNA encoded by NUP43, corresponding to a target binding site such as BINDING SITE I, BINDING SITE II or BINDING SITE III of FIG. 8. Table 4 illustrates the complementarity of the nucleotide sequences of NUP43 BINDING SITE, designated SEQ ID:14929, to the nucleotide sequence of GAM130 RNA, herein designated GAM RNA, also designated SEQ ID:331.

Another function of GAM130 is therefore inhibition of NUP43 (Accession NP_078923.2). Accordingly, utilities of GAM130 include diagnosis, prevention and treatment of diseases and clinical conditions associated with NUP43.

Oxysterol binding protein-like 2 (OSBPL2, Accession NP_055650.1) is another GAM130 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:16028, to the nucleotide sequence of GAM130 RNA, herein designated GAM RNA, also designated SEQ ID:331.

Another function of GAM130 is therefore inhibition of Oxysterol binding protein-like 2 (OSBPL2, Accession NP_055650.1). Accordingly, utilities of GAM130 include diagnosis, prevention and treatment of diseases and clinical conditions associated with OSBPL2.

Oxysterol binding protein-like 2 (OSBPL2, Accession NP_653081.1) is another GAM130 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:16028, to the nucleotide sequence of GAM130 RNA, herein designated GAM RNA, also designated SEQ ID:331.

Another function of GAM130 is therefore inhibition of Oxysterol binding protein-like 2 (OSBPL2, Accession NP_653081.1). Accordingly, utilities of GAM130 include diagnosis, prevention and treatment of diseases and clinical conditions associated with OSBPL2.

Pas domain containing serine/threonine kinase (PASK, Accession NP_055963.1) is another GAM130 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:12272, to the nucleotide sequence of GAM130 RNA, herein designated GAM RNA, also designated SEQ ID:331.

Another function of GAM130 is therefore inhibition of Pas domain containing serine/threonine kinase (PASK, Accession NP_055963.1). Accordingly, utilities of GAM130 include diagnosis, prevention and treatment of diseases and clinical conditions associated with PASK.

Protocadherin beta 14 (PCDHB14, Accession NP_061757.1) is another GAM130 target gene, herein designated TARGET GENE. PCDHB14 BINDING SITE is a target binding site found in the 3' untranslated region of mRNA encoded by PCDHB14, corresponding to a target binding site such as BINDING SITE I, BINDING SITE II or BINDING SITE III of FIG. 8. Table 4 illustrates the complementarity of the nucleotide sequences of PCDHB14 BINDING SITE, designated SEQ ID:2918, to the nucleotide sequence of GAM130 RNA, herein designated GAM RNA, also designated SEQ ID:331.

Another function of GAM130 is therefore inhibition of Protocadherin beta 14 (PCDHB14, Accession NP_061757.1). Accordingly, utilities of GAM130 include diagnosis, prevention and treatment of diseases and clinical conditions associated with PCDHB14.

Period homolog 2 (drosophila) (PER2, Accession NP_073728.1) is another GAM130 target gene, herein designated TARGET GENE. PER2 BINDING SITE is a target binding site found in the 3' untranslated region of multiple transcripts of mRNA encoded by PER2, corresponding to a target binding site such as BINDING SITE I, BINDING SITE II or BINDING SITE III of FIG. 8. Table 4 illustrates the complementarity of the nucleotide sequences of PER2 BINDING SITE, designated SEQ ID:2668, to the nucleotide sequence of GAM130 RNA, herein designated GAM RNA, also designated SEQ ID:331.

Another function of GAM130 is therefore inhibition of Period homolog 2 (drosophila) (PER2, Accession NP_073728.1), a gene which Period homolog 2; putative circadian clock protein; has a PAS dimerization domain and therefore may be associated with Familial advanced sleep-phase syndrome. Accordingly, utilities of GAM130 include diagnosis, prevention and treatment of Familial advanced sleep-phase syndrome, and of other diseases and clinical conditions associated with PER2.

The function of PER2 has been established by previous studies. To investigate the biologic role of NPAS2 (OMIM Ref. No. 603347), Reick et al. (2001) prepared a neuroblastoma cell line capable of conditional induction of the NPAS2: BMAL1 (OMIM Ref. No. 602550) heterodimer and identified putative target genes by representational difference analysis, DNA microarray, and Northern blotting. Coinduction of NPAS2 and BMAL1 activated transcription of the endogenous Per1, Per2, and Cry1 (OMIM Ref. No. 601933) genes, which encode negatively activating components of the circadian regulatory apparatus, and repressed transcription of the endogenous BMAL1 gene. Analysis of the frontal cortex of wildtype mice kept in a 24-hour light-dark cycle revealed that Per1, Per2, and Cry1 mRNA levels were elevated during darkness and reduced during light, whereas BMAL1 mRNA displayed the opposite pattern. In situ hybridization assays of mice kept in constant darkness revealed that Per2 mRNA abundance did not oscillate as a function of circadian cycle in NPAS2- deficient mice. Thus, NPAS2 likely functions as part of a molecular clock operative in the mammalian forebrain.

Animal model experiments lend further support to the function of PER2. Shearman et al. (2000) demonstrated that in the mouse, the core mechanism for the master circadian clock consists of interacting positive and negative transcription and translation feedback loops. Analysis of Clock/Clock (OMIM Ref. No. 601851) mutant mice, homozygous Per2 mutants, and Cry-deficient mice revealed substantially altered Bmal1 (OMIM Ref. No. 602550) rhythms, consistent with a dominant role of Per2 in the positive regulation of the Bmal1 loop. In vitro analysis of Cry inhibition of Clock: Bmal1-mediated transcription shows that the inhibition is through direct protein-protein interactions, independent of the Per and Tim (OMIM Ref. No. 603887) proteins. Per2 is a positive regulator of the Bmal1 loop, and Cry1 and Cry2 are the negative regulators of the Period and Cryptochrome cycles.

It is appreciated that the abovementioned animal model for PER2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shearman, L. P.; Sriram, S.; Weaver, D. R.; Maywood, E. S.; Chaves, I.; Zheng, B.; Kume, K.; Lee, C. C.; van der Horst, G. T. J.; Hastings, M. H.; Reppert, S. M.: Interacting molecular loops in the mammalian circadian clock. Science 288: 1013-1019, 2000; and Shearman, L. P.; Zylka, M. J.; Weaver, D. R.; Kolakowski, L. F., Jr.; Reppert, S. M.: Two period homologs: circadian expression and photic regulation in the suprachiasmatic nuclei. Neu.

Further studies establishing the function and utilities of PER2 are found in John Hopkins OMIM database record ID 603426, and in cited publications listed in Table 5, which are hereby incorporated by reference. PEX5R (Accession NP_057643.1) is another GAM130 target gene, herein designated TARGET GENE. PEX5R BINDING SITE is a target binding site found in the 3' untranslated region of mRNA encoded by PEX5R, corresponding to a target binding site such as BINDING SITE I, BINDING SITE II or BINDING SITE III of FIG. 8. Table 4 illustrates the complementarity of the nucleotide sequences of PEX5R BINDING SITE, designated SEQ ID:4446, to the nucleotide sequence of GAM130 RNA, herein designated GAM RNA, also designated SEQ ID:331.

Another function of GAM130 is therefore inhibition of PEX5R (Accession NP_057643.1). Accordingly, utilities of GAM130 include diagnosis, prevention and treatment of diseases and clinical conditions associated with PEX5R.

Pbx/knotted 1 homeobox 1 (PKNOX1, Accession NP_004562.2) is another GAM130 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:14526, to the nucleotide sequence of GAM130 RNA, herein designated GAM RNA, also designated SEQ ID:331.

Another function of GAM130 is therefore inhibition of Pbx/knotted 1 homeobox 1 (PKNOX1, Accession NP_004562.2), a gene which may regulate gene expression and control cell differentiation. Accordingly, utilities of GAM130 include diagnosis, prevention and treatment of diseases and clinical conditions associated with PKNOX1.

The function of PKNOX1 and its association with various diseases and clinical conditions, has been established by previous studies, as described hereinabove with reference to GAM55.1. Protein phosphatase, ef hand calcium-binding domain 2 (PPEF2, Accession NP_006230.2) is another GAM130 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:6206, to the nucleotide sequence of GAM130 RNA, herein designated GAM RNA, also designated SEQ ID:331.

Another function of GAM130 is therefore inhibition of Protein phosphatase, ef hand calcium-binding domain 2 (PPEF2, Accession NP_006230.2), a gene which is a homolog of Drosophila rdgC. Accordingly, utilities of GAM130 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_690911.1) is another GAM130 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:6206, to the nucleotide sequence of GAM130 RNA, herein designated GAM RNA, also designated SEQ ID:331.

Another function of GAM130 is therefore inhibition of Protein phosphatase, ef hand calcium-binding domain 2 (PPEF2, Accession NP_690911.1), a gene which is a homolog of Drosophila rdgC. Accordingly, utilities of GAM130 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_690910.1) is another GAM130 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:6206, to the nucleotide sequence of GAM130 RNA, herein designated GAM RNA, also designated SEQ ID:331.

Another function of GAM130 is therefore inhibition of Protein phosphatase, ef hand calcium-binding domain 2 (PPEF2, Accession NP_690910.1), a gene which is a homolog of Drosophila rdgC. Accordingly, utilities of GAM130 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein kinase, y-linked (PRKY, Accession NP_002751.1) is another GAM130 target gene, herein designated TARGET GENE. PRKY BINDING SITE is a target binding site found in the 3' untranslated region of mRNA encoded by PRKY, corresponding to a target binding site such as BINDING SITE I, BINDING SITE II or BINDING SITE III of FIG. 8. Table 4 illustrates the complementarity of the nucleotide sequences of PRKY BINDING SITE, designated SEQ ID:9776, to the nucleotide sequence of GAM130 RNA, herein designated GAM RNA, also designated SEQ ID:331.

Another function of GAM130 is therefore inhibition of Protein kinase, y-linked (PRKY, Accession NP_002751.1), a gene which is a putative protein kinase. Accordingly, utilities of GAM130 include diagnosis, prevention and treatment of diseases and clinical conditions associated with PRKY.

The function of PRKY and its association with various diseases and clinical conditions, has been established by previous studies, as described hereinabove with reference to GAM72.1. Prion protein 2 (dublet) (PRND, Accession NP_036541.1) is another GAM130 target gene, herein designated TARGET GENE. PRND BINDING SITE is a target binding site found in the 3' untranslated region of mRNA encoded by PRND, corresponding to a target binding site such as BINDING SITE I, BINDING SITE II or BINDING SITE III of FIG. 8. Table 4 illustrates the complementarity of the nucleotide sequences of PRND BINDING SITE, designated SEQ ID:2712, to the nucleotide sequence of GAM130 RNA, herein designated GAM RNA, also designated SEQ ID:331.

Another function of GAM130 is therefore inhibition of Prion protein 2 (dublet) (PRND, Accession NP_036541.1), a gene which is similar to prion protein PRNP. Accordingly, utilities of GAM130 include diagnosis, prevention and treatment of diseases and clinical conditions associated with PRND.

The function of PRND and its association with various diseases and clinical conditions, has been established by previous studies, as described hereinabove with reference to GAM116.1. Prostaglandin i2 (prostacyclin) synthase (PTGIS, Accession NP_000952.1) is another GAM130 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:15449, to the nucleotide sequence of GAM130 RNA, herein designated GAM RNA, also designated SEQ ID:331.

Another function of GAM130 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM130 include diagnosis, prevention and treatment of diseases and clinical conditions associated with PTGIS.

The function of PTGIS and its association with various diseases and clinical conditions, has been established by previous studies, as described hereinabove with reference to GAM30.1. Prostaglandin-endoperoxide synthase 1 (prostaglandin g/h synthase and cyclooxygenase) (PTGS1, Accession NP_542158.1) is another GAM130 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:10350, to the nucleotide sequence of GAM130 RNA, herein designated GAM RNA, also designated SEQ ID:331.

Another function of GAM130 is therefore inhibition of Prostaglandin-endoperoxide synthase 1 (prostaglandin g/h synthase and cyclooxygenase) (PTGS1, Accession NP_542158.1), a gene which may play an important role in regulating or promoting cell proliferation in some normal and neoplastically transformed cells. Accordingly, utilities of GAM130 include diagnosis, prevention and treatment of diseases and clinical conditions associated with PTGS1.

The function of PTGS1 and its association with various diseases and clinical conditions, has been established by previous studies, as described hereinabove with reference to GAM40.1. Prostaglandin-endoperoxide synthase 1 (prostaglandin g/h synthase and cyclooxygenase) (PTGS1, Accession NP_000953.2) is another GAM130 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:10350, to the nucleotide sequence of GAM130 RNA, herein designated GAM RNA, also designated SEQ ID:331.

Another function of GAM130 is therefore inhibition of Prostaglandin-endoperoxide synthase 1 (prostaglandin g/h synthase and cyclooxygenase) (PTGS1, Accession NP_000953.2), a gene which may play an important role in regulating or promoting cell proliferation in some normal and neoplastically transformed cells. Accordingly, utilities of GAM130 include diagnosis, prevention and treatment of diseases and clinical conditions associated with PTGS1.

The function of PTGS1 and its association with various diseases and clinical conditions, has been established by previous studies, as described hereinabove with reference to GAM40.1. Protein tyrosine phosphatase, receptor type, k (PTPRK, Accession NP_002835.2) is another GAM130 target gene, herein designated TARGET GENE. PTPRK BINDING SITE is a target binding site found in the 3' untranslated region of mRNA encoded by PTPRK, corresponding to a target binding site such as BINDING SITE I, BINDING SITE II or BINDING SITE III of FIG. 8. Table 4 illustrates the complementarity of the nucleotide sequences of PTPRK BINDING SITE, designated SEQ ID:3473, to the nucleotide sequence of GAM130 RNA, herein designated GAM RNA, also designated SEQ ID:331.

Another function of GAM130 is therefore inhibition of Protein tyrosine phosphatase, receptor type, k (PTPRK, Accession NP_002835.2), a gene which regulates of processes involving cell contact and adhesion. Accordingly, utilities of GAM130 include diagnosis, prevention and treatment of diseases and clinical conditions associated with PTPRK.

The function of PTPRK has been established by previous studies. For general information about receptor-type protein-tyrosine phosphatases (PTPs), see PTPRA (OMIM Ref. No. 176884). Yang et al. (1997) used degenerate PCR to identify novel receptor PTPs in a human keratinocyte cDNA library. One of the genes identified was the human homolog of mouse PTPR-kappa. Human PTPR-kappa encodes a 1,440-amino acid polypeptide that is 98% identical to mouse PTPR-kappa. Northern blotting revealed that PTPR-kappa is expressed as a 7.0-kb transcript in a variety of tissues. Fuchs et al. (1996) also used degenerate PCR to clone human PTPR-kappa. Northern blotting revealed expression of PTPR-kappa in mammary carcinoma cell lines as well as in various tissues. Fuchs et al. (1996) noted that PTPR-kappa has several structural features, such as a MAM domain, an Ig-like domain, and fibronectin repeats, suggesting that it could be involved in cell adhesion. They showed that PTPR-kappa forms a complex with beta-catenin (OMIM Ref. No. 116806) and gamma-catenin/plakoglobin (OMIM Ref. No. 173325). They also showed that PTPR-kappa expression is dependent on cell density and that it colocalizes with catenins at adherens junctions. These findings suggest that PTPR-kappa may have a role in the regulation of processes involving cell contact and adhesion.

Full details of the abovementioned studies are described in the following publications, the disclosure of which are hereby incorporated by reference:

Fuchs, M.; Muller, T.; Lerch, M. M.; Ullrich, A.: Association of human protein-tyrosine phosphatase kappa with members of the armadillo family. J. Biol. Chem. 271:16712-16719, 1996; and Yang, Y.; Gil, M. C.; Choi, E. Y.; Park, S. H.; Pyun, K. H.; Ha, H.: Molecular cloning and chromosomal localization of a human gene homologous to the murine R-PTP-kappa, a receptor-type.

Further studies establishing the function and utilities of PTPRK are found in John Hopkins OMIM database record ID 602545, and in cited publications listed in Table 5, which are hereby incorporated by reference. Rab36, member ras oncogene family (RAB36, Accession NP_004905.1) is another GAM130 target gene, herein designated TARGET GENE. RAB36 BINDING SITE is a target binding site found in the 3' untranslated region of mRNA encoded by RAB36, corresponding to a target binding site such as BINDING SITE I, BINDING SITE II or BINDING SITE III of FIG. 8. Table 4 illustrates the complementarity of the nucleotide sequences of RAB36 BINDING SITE, designated SEQ ID:2081, to the nucleotide sequence of GAM130 RNA, herein designated GAM RNA, also designated SEQ ID:331.

Another function of GAM130 is therefore inhibition of Rab36, member ras oncogene family (RAB36, Accession NP_004905.1), a gene which is involved in protein transport. Accordingly, utilities of GAM130 include diagnosis, prevention and treatment of diseases and clinical conditions associated with RAB36.

The function of RAB36 has been established by previous studies. Homozygous deletions at chromosome 22q11.2 are a recurrent cytogenetic characteristic of malignant rhabdoid tumors (MRTs), suggesting the presence of a tumor suppressor gene in this region. Mori et al. (1999) constructed a deletion map of the relevant part of 22q11.2 from a panel of 7 MRT cell lines, and isolated a novel gene from the center of the region. The gene, designated RAB36, spans approximately 19 kb of genomic DNA and contains 11 exons. It encodes a deduced 333-amino acid protein that contains 3 phosphate/magnesium-binding motifs, 3 guanine-binding motifs, a tyrosine kinase phosphorylation site, and a C-terminal isoprenylation signal. It shares high amino acid sequence identity with mouse Rab23 (OMIM Ref. No. 606144) and human RAB13 (OMIM Ref. No. 602672). Northern blot analysis revealed 4.0- and 2.2-kb mRNAs in all human tissues examined. The larger transcript contains a longer 3-prime noncoding sequence. RT-PCR analysis revealed expression of RAB36 mRNAs in 1 MRT cell line and overexpression in 2 others. Direct sequencing of cDNA from these 3 cell lines showed neither nonsense nor frameshift mutations. Moreover, a colony-formation assay indicated that RAB36 is not concerned with cell proliferation or cell death. The authors thus concluded that RAB36 does not have a tumor suppressor function. Immunofluorescence studies localized RAB36 at the Golgi body, suggesting that RAB36, like some other Rab family proteins, is involved in vesicular transport around the Golgi apparatus. By use of exon trapping and large-scale genomic sequence analysis of 2 BAC clones, Zhou et al. (2000) also isolated RAB36, as well as another gene, RTDR1 (OMIM Ref. No. 605663), in the 22q11.2 region. They determined that RAB36 contains 11 exons. They also found no RAB36 mutations in rhabdoid tumor samples.

Full details of the abovementioned studies are described in the following publications, the disclosure of which are hereby incorporated by reference:

Mori, T.; Fukuda, Y.; Kuroda, H.; Matsumura, T.; Ota, S.; Sugimoto, T.; Nakamura, Y.; Inazawa, J.: Cloning and characterization of a novel Rab-family gene, Rab36, within the region at 22q11.2 that is homozygously deleted in malignant rhabdoid tumors. Biochem. Biophys. Res. Commun. 254:594-600, 1999; and Zhou, J.-Y.; Fogelgren, B.; Wang, Z.; Roe, B. A.; Biegel, J. A.: Isolation of genes from the rhabdoid tumor deletion region in chromosome band 22q11.2. Gene 241:133-141, 2000.

Further studies establishing the function and utilities of RAB36 are found in John Hopkins OMIM database record ID 605662, and in cited publications listed in Table 5, which are hereby incorporated by reference. RNF144 (Accession NP_055561.1) is another GAM130 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:4275, to the nucleotide sequence of GAM130 RNA, herein designated GAM RNA, also designated SEQ ID:331.

Another function of GAM130 is therefore inhibition of RNF144 (Accession NP_055561.1). Accordingly, utilities of GAM130 include diagnosis, prevention and treatment of diseases and clinical conditions associated with RNF144.

Retinitis pigmentosa 2 (x-linked recessive) (RP2, Accession NP_008846.1) is another GAM130 target gene, herein designated TARGET GENE. RP2 BINDING SITE is a target binding site found in the 3' untranslated region of mRNA encoded by RP2, corresponding to a target binding site such as BINDING SITE I, BINDING SITE II or BINDING SITE III of FIG. 8. Table 4 illustrates the complementarity of the nucleotide sequences of RP2 BINDING SITE, designated SEQ ID:14528, to the nucleotide sequence of GAM130 RNA, herein designated GAM RNA, also designated SEQ ID:331.

Another function of GAM130 is therefore inhibition of Retinitis pigmentosa 2 (x-linked recessive) (RP2, Accession NP_008846.1). Accordingly, utilities of GAM130 include diagnosis, prevention and treatment of diseases and clinical conditions associated with RP2.

Sex comb on midleg-like 2 (drosophila) (SCML2, Accession NP_006080.1) is another GAM130 target gene, herein designated TARGET GENE. SCML2 BINDING SITE is a target binding site found in the 3' untranslated region of mRNA encoded by SCML2, corresponding to a target binding site such as BINDING SITE I, BINDING SITE II or BINDING SITE III of FIG. 8. Table 4 illustrates the complementarity of the nucleotide sequences of SCML2 BINDING SITE, designated SEQ ID:15934, to the nucleotide sequence of GAM130 RNA, herein designated GAM RNA, also designated SEQ ID:331.

Another function of GAM130 is therefore inhibition of Sex comb on midleg-like 2 (drosophila) (SCML2, Accession NP_006080.1). Accordingly, utilities of GAM130 include diagnosis, prevention and treatment of diseases and clinical conditions associated with SCML2.

Spondyloepiphyseal dysplasia, late (SEDL, Accession NP_055378.1) is another GAM130 target gene, herein designated TARGET GENE. SEDL BINDING SITE is a target binding site found in the 3' untranslated region of mRNA encoded by SEDL, corresponding to a target binding site such as BINDING SITE I, BINDING SITE II or BINDING SITE III of FIG. 8. Table 4 illustrates the complementarity of the nucleotide sequences of SEDL BINDING SITE, designated SEQ ID:5004, to the nucleotide sequence of GAM130 RNA, herein designated GAM RNA, also designated SEQ ID:331.

Another function of GAM130 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM130 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. Tal1 (scl) interrupting locus (SIL, Accession NP_003026.1) is another GAM130 target gene, herein designated TARGET GENE. SIL BINDING SITE is a target binding site found in the 3' untranslated region of mRNA encoded by SIL, corresponding to a target binding site such as BINDING SITE I, BINDING SITE II or BINDING SITE III of FIG. 8. Table 4 illustrates the complementarity of the nucleotide sequences of SIL BINDING SITE, designated SEQ ID:7982, to the nucleotide sequence of GAM130 RNA, herein designated GAM RNA, also designated SEQ ID:331.

Another function of GAM130 is therefore inhibition of Tal1 (scl) interrupting locus (SIL, Accession NP_003026.1), a gene which may be required for axial development and left-right specification and therefore may be associated with Prominent midline neural tube defects, abnormal left-right development. Accordingly, utilities of GAM130 include diagnosis, prevention and treatment of Prominent midline neural tube defects, abnormal left-right development, and of other diseases and clinical conditions associated with SIL.

The function of SIL and its association with various diseases and clinical conditions, has been established by previous studies, as described hereinabove with reference to GAM30.1. Signal-regulatory protein beta 1 (SIRPB1, Accession NP_006056.1) is another GAM130 target gene, herein designated TARGET GENE. SIRPB1 BINDING SITE is a target binding site found in the 3' untranslated region of mRNA encoded by SIRPB1, corresponding to a target binding site such as BINDING SITE I, BINDING SITE II or BINDING SITE III of FIG. 8. Table 4 illustrates the complementarity of the nucleotide sequences of SIRPB1 BINDING SITE, designated SEQ ID:2065, to the nucleotide sequence of GAM130 RNA, herein designated GAM RNA, also designated SEQ ID:331.

Another function of GAM130 is therefore inhibition of Signal-regulatory protein beta 1 (SIRPB1, Accession NP_006056.1). Accordingly, utilities of GAM130 include diagnosis, prevention and treatment of diseases and clinical conditions associated with SIRPB1.

Solute carrier family 15 (oligopeptide transporter), member 1 (SLC15A1, Accession NP_005064.1) is another GAM130 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:2082, to the nucleotide sequence of GAM130 RNA, herein designated GAM RNA, also designated SEQ ID:331.

Another function of GAM130 is therefore inhibition of Solute carrier family 15 (oligopeptide transporter), member 1 (SLC15A1, Accession NP_005064.1), a gene which is a H(+)-coupled peptide transporter. Accordingly, utilities of GAM130 include diagnosis, prevention and treatment of diseases and clinical conditions associated with SLC15A1.

The function of SLC15A1 and its association with various diseases and clinical conditions, has been established by previous studies, as described hereinabove with reference to GAM30.1. Solute carrier family 24 (sodium/potassium/calcium exchanger), member 1 (SLC24A1, Accession NP_004718.1) is another GAM130 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:19932, to the nucleotide sequence of GAM130 RNA, herein designated GAM RNA, also designated SEQ ID:331.

Another function of GAM130 is therefore inhibition of Solute carrier family 24 (sodium/potassium/calcium exchanger), member 1 (SLC24A1, Accession NP_004718.1), a gene which is a critical component of the visual transduction cascade, controlling the calcium concentration of outer segments during light and darkness. Accordingly, utilities of GAM130 include diagnosis, prevention and treatment of diseases and clinical conditions associated with SLC24A1.

The function of SLC24A1 has been established by previous studies. By screening a human retinal cDNA library using the entire bovine rod sodium/potassium/calcium (Na-Ca+K) exchanger cDNA as a probe, Tucker et al. (1998) cloned the human NCKX1 gene. Human NCKX1 codes for a protein of 1,081 amino acids that shows 64% overall identity with the bovine protein. The 2 sets of putative transmembrane domains and their short connecting loops showed 94% identity, while the extracellular loop at the amino terminus was only 59% identical. Tucker et al. (1998) determined the genomic structure of the NCKX1 gene and found 1 intron in the 5-prime untranslated region and 8 within the coding region. Exon length varies from 54 to 2,037 bp Using fluorescence in situ hybridization and analysis of a radiation hybrid panel, Tucker et al. (1998) mapped the NCKX1 gene to chromosome 15q22

Full details of the abovementioned studies are described in the following publications, the disclosure of which are hereby incorporated by reference:

Tucker, J. E.; Winkfein, R. J.; Cooper, C. B.; Schnetkamp, P. P.: cDNA cloning of the human retinal rod Na-Ca + K exchanger: comparison with a revised bovine sequence. Invest. Ophthal. Vis. Sci. 39:435-440, 1998; and Tucker, J. E.; Winkfein, R. J.; Murthy, S. K.; Friedman, J. S.; Walter, M. A.; Demetrick, D. J.; Schnetkamp, P. P. M.: Chromosomal localization and genomic organization of the human retina.

Further studies establishing the function and utilities of SLC24A1 are found in John Hopkins OMIM database record ID 603617, and in cited publications listed in Table 5, which are hereby incorporated by reference. SLC35E2 (Accession XP_049733.6) is another GAM130 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:13221, to the nucleotide sequence of GAM130 RNA, herein designated GAM RNA, also designated SEQ ID:331.

Another function of GAM130 is therefore inhibition of SLC35E2 (Accession XP_049733.6). Accordingly, utilities of GAM130 include diagnosis, prevention and treatment of diseases and clinical conditions associated with SLC35E2.

Swi/snf related, matrix associated, actin dependent regulator of chromatin, subfamily d, member 1 (SMARCD1, Accession NP_620710.1) is another GAM130 target gene, herein designated TARGET GENE. SMARCD1 BINDING SITE is a target binding site found in the 3' untranslated region of multiple transcripts of mRNA encoded by SMARCD1, corresponding to a target binding site such as BINDING SITE I, BINDING SITE II or BINDING SITE III of FIG. 8. Table 4 illustrates the complementarity of the nucleotide sequences of SMARCD1 BINDING SITE, designated SEQ ID:3343, to the nucleotide sequence of GAM130 RNA, herein designated GAM RNA, also designated SEQ ID:331.

Another function of GAM130 is therefore inhibition of Swi/snf related, matrix associated, actin dependent regulator of chromatin, subfamily d, member 1 (SMARCD1, Accession NP_620710.1), a gene which is involved in chromatin assembly and remodeling. Accordingly, utilities of GAM130 include diagnosis, prevention and treatment of diseases and clinical conditions associated with SMARCD1.

The function of SMARCD1 and its association with various diseases and clinical conditions, has been established by previous studies, as described hereinabove with reference to GAM42.1. Swi/snf related, matrix associated, actin dependent regulator of chromatin, subfamily d, member 1 (SMARCD1, Accession NP_003067.2) is another GAM130 target gene, herein designated TARGET GENE. SMARCD1 BINDING SITE is a target binding site found in the 3' untranslated region of multiple transcripts of mRNA encoded by SMARCD1, corresponding to a target binding site such as BINDING SITE I, BINDING SITE II or BINDING SITE III of FIG. 8. Table 4 illustrates the complementarity of the nucleotide sequences of SMARCD1 BINDING SITE, designated SEQ ID:3343, to the nucleotide sequence of GAM130 RNA, herein designated GAM RNA, also designated SEQ ID:331.

Another function of GAM130 is therefore inhibition of Swi/snf related, matrix associated, actin dependent regulator of chromatin, subfamily d, member 1 (SMARCD1, Accession NP_003067.2), a gene which is involved in chromatin assembly and remodeling. Accordingly, utilities of GAM130 include diagnosis, prevention and treatment of diseases and clinical conditions associated with SMARCD1.

The function of SMARCD1 and its association with various diseases and clinical conditions, has been established by previous studies, as described hereinabove with reference to GAM42.1. SNARK (Accession NP_112214.1) is another GAM130 target gene, herein designated TARGET GENE. SNARK BINDING SITE is a target binding site found in the 3' untranslated region of mRNA encoded by SNARK, corresponding to a target binding site such as BINDING SITE I, BINDING SITE II or BINDING SITE III of FIG. 8. Table 4 illustrates the complementarity of the nucleotide sequences of SNARK BINDING SITE, designated SEQ ID:15170, to the nucleotide sequence of GAM130 RNA, herein designated GAM RNA, also designated SEQ ID:331.

Another function of GAM130 is therefore inhibition of SNARK (Accession NP_112214.1). Accordingly, utilities of GAM130 include diagnosis, prevention and treatment of diseases and clinical conditions associated with SNARK.

SNX22 (Accession NP_079074.1) is another GAM130 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:15559, to the nucleotide sequence of GAM130 RNA, herein designated GAM RNA, also designated SEQ ID:331.

Another function of GAM130 is therefore inhibition of SNX22 (Accession NP_079074.1). Accordingly, utilities of GAM130 include diagnosis, prevention and treatment of diseases and clinical conditions associated with SNX22.

Sialophorin (gpl115, leukosialin, cd43) (SPN, Accession NP_003114.1) is another GAM130 target gene, herein designated TARGET GENE. SPN BINDING SITE is a target binding site found in the 3' untranslated region of mRNA encoded by SPN, corresponding to a target binding site such as BINDING SITE I, BINDING SITE II or BINDING SITE III of FIG. 8. Table 4 illustrates the complementarity of the nucleotide sequences of SPN BINDING SITE, designated SEQ ID:7729, to the nucleotide sequence of GAM130 RNA, herein designated GAM RNA, also designated SEQ ID:331.

Another function of GAM130 is therefore inhibition of Sialophorin (gpl115, leukosialin, cd43) (SPN, Accession NP_003114.1), a gene which plays a role in the physicochemical properties of the t-cell surface and in lectin binding. presents carbohydrate ligands to selectins. . and therefore may be associated with Wiskott-aldrich syndrome. Accordingly, utilities of GAM130 include diagnosis, prevention and treatment of Wiskott-aldrich syndrome, and of other diseases and clinical conditions associated with SPN.

The function of SPN has been established by previous studies. Sialophorin is defective in lymphocytes of patients with Wiskott-Aldrich syndrome (OMIM Ref. No. 301000). Since the Wiskott-Aldrich syndrome is X-linked, its primary cause must reside in a defect of a gene other than the structural gene for sialophorin. (The existence of an autosomal form of Wiskott-Aldrich syndrome has been suggested (OMIM Ref. No. 277970).) Specific interaction of CD43 with a ligand on the surface of T cells appears to contribute to T-cell activation. Rosenstein et al. (1991) presented evidence that intercellular adhesion molecule-1 (ICAM1, or CD54; 147840) is a ligand for CD43. Rosenstein et al. (1991) suggested that the defect in T-cell function in Wiskott-Aldrich syndrome may result from defective CD43/ICAM1 interaction. Many patients with HIV infection have circulating anti-CD43 antibodies; these autoantibodies may contribute to the severe immunodeficiency found in AIDS patients. The immunologic synapse is the T cell-APC (antigen-presenting cell) contact site where T-cell receptors (TCRs), coreceptors, signaling molecules, and adhesion receptors polarize upon antigen recognition. The formation of the immunologic synapse is thought to be important for receptor signal transduction and full T-lymphocyte activation. CD43 is a large sialoprotein diffusely expressed in unactivated T cells. Using antigen-activated T cells and confocal microscopy, Delon et al. (2001) demonstrated that moesin (OMIM Ref. No. 309845) is excluded from the region of T cell-APC contact and colocalizes with CD43. Western blot and immunocytochemical analyses showed that moesin is rapidly dephosphorylated upon antigen recognition and then rephosphorylated on threonine residues. Only phosphorylated moesin was able to bind CD43. Delon et al. (2001) concluded that T-cell activation requires the removal of CD43 from the immunologic synapse to allow efficient engagement of the TCR with molecules on the APC.

Full details of the abovementioned studies are described in the following publications, the disclosure of which are hereby incorporated by reference:

Rosenstein, Y.; Park, J. K.; Hahn, W. C.; Rosen, F. S.; Bierer, B. E.; Burakoff, S. J.: CD43, a molecule defective in Wiskott-Aldrich syndrome, binds ICAM-1. Nature 354:233-235, 1991; and Delon, J.; Kaibuchi, K.; Germain, R. N.: Exclusion of CD43 from the immunological synapse is mediated by phosphorylation-regulated relocation of the cytoskeletal adaptor moesin. Immunity 1.

Further studies establishing the function and utilities of SPN are found in John Hopkins OMIM database record ID 182160, and in cited publications listed in Table 5, which are hereby incorporated by reference. Synovial sarcoma translocation, chromosome 18 (SS18, Accession NP_005628.1) is another GAM130 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:16460, to the nucleotide sequence of GAM130 RNA, herein designated GAM RNA, also designated SEQ ID:331.

Another function of GAM130 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM130 include diagnosis, prevention and treatment of Human synovial sarcomas, and of other diseases and clinical conditions associated with SS18.

The function of SS18 has been established by previous studies. Human synovial sarcomas contain a recurrent and specific chromosomal translocation t(X;18)(p11.2;q11.2). By screening a synovial sarcoma cDNA library with a YAC spanning the X chromosome breakpoint, Clark et al. (1994) identified a hybrid transcript that contained 5-prime sequences mapping to chromosome 18 and 3-prime sequences mapping to the X chromosome (see OMIM Ref. No. SSX1; 312820). A probe from the chromosome 18 gene sequence, symbolized SS18, detected genomic rearrangements in 10 of 13 synovial sarcomas. The chromosome 18 gene was symbolized SYT by Clark et al. (1994), but that symbol had already been used for synaptotagmin (OMIM Ref. No. 185605). Sequencing of cDNA clones showed that the normal SS18 gene encodes a protein rich in glutamine, proline, and glycine, and that in synovial sarcoma, rearrangement of the SS18 gene results in the formation of a fusion protein. Both the chromosome 18 and the X chromosome components failed to exhibit significant homology to known gene sequences. The SYT protein appears to act as a transcriptional coactivator and the SSX proteins as corepressors. Thaete et al. (1999) investigated the functional domains of the proteins. The SYT protein was found to contain a novel conserved 54-amino acid domain at the N terminus of the protein (the SNH domain) that is found in proteins from a wide variety of species, and a C-terminal domain, rich in glutamine, proline, glycine, and tyrosine (the QPGY domain), which contains the transcriptional activator sequences. Deletion of the SNH domain resulted in a more active transcriptional activator, suggesting that this domain acts as an inhibitor of the activation domain. The C-terminal SSX domain present in the SYT-SSX translocation protein contributes a transcriptional repressor domain to the protein. Thus, the fusion protein has transcriptional activating and repressing domains. Thaete et al. (1999) demonstrated that the human homolog of the SNF2/Brahma protein BRM (SMARCA2; 600014) colocalizes with SYT and SYT-SSX in nuclear speckles, and also interacts with SYT and SYT-SSX proteins in vitro. They suggested that this interaction may provide an explanation of how the SYT protein activates gene transcription.

Full details of the abovementioned studies are described in the following publications, the disclosure of which are hereby incorporated by reference:

Clark, J.; Rocques, P. J.; Crew, A. J.; Gill, S.; Shipley, J.; Chan, A. M.-L.; Gusterson, B. A.; Cooper, C. S.: Identification of novel genes, SYT and SSX, involved in the t(X;18) (p11.2;q11.2) translocation found in human synovial sarcoma. Nature Genet. 7:502-508, 1994; and Thaete, C.; Brett, D.; Monaghan, P.; Whitehouse, S.; Rennie, G.; Rayner, E.; Cooper, C. S.; Goodwin, G.: Functional domains of the SYT and SYT-SSX synovial sarcoma translocation prote.

Further studies establishing the function and utilities of SS18 are found in John Hopkins OMIM database record ID 600192, and in cited publications listed in Table 5, which are hereby incorporated by reference. Suppression of tumorigenicity 5 (ST5, Accession NP_631896.1) is another GAM130 target gene, herein designated TARGET GENE. ST5 BINDING SITE is a target binding site found in the 3' untranslated region of multiple transcripts of mRNA encoded by ST5, corresponding to a target binding site such as BINDING SITE I, BINDING SITE II or BINDING SITE III of FIG. 8. Table 4 illustrates the complementarity of the nucleotide sequences of ST5 BINDING SITE, designated SEQ ID:6346, to the nucleotide sequence of GAM130 RNA, herein designated GAM RNA, also designated SEQ ID:331.

Another function of GAM130 is therefore inhibition of Suppression of tumorigenicity 5 (ST5, Accession NP_631896.1), a gene which preferentially binds to the SH3 domain of c-Abl kinase, and acts as a regulator of MAPK1/ERK2 kinase. Accordingly, utilities of GAM130 include diagnosis, prevention and treatment of diseases and clinical conditions associated with ST5.

The function of ST5 and its association with various diseases and clinical conditions, has been established by previous studies, as described hereinabove with reference to GAM66.1. Suppression of tumorigenicity 5 (ST5, Accession NP_005409.2) is another GAM130 target gene, herein designated TARGET GENE. ST5 BINDING SITE is a target binding site found in the 3' untranslated region of multiple transcripts of mRNA encoded by ST5, corresponding to a target binding site such as BINDING SITE I, BINDING SITE II or BINDING SITE III of FIG. 8. Table 4 illustrates the complementarity of the nucleotide sequences of ST5 BINDING SITE, designated SEQ ID:6346, to the nucleotide sequence of GAM130 RNA, herein designated GAM RNA, also designated SEQ ID:331.

Another function of GAM130 is therefore inhibition of Suppression of tumorigenicity 5 (ST5, Accession NP_005409.2), a gene which preferentially binds to the SH3 domain of c-Abl kinase, and acts as a regulator of MAPK1/ERK2 kinase. Accordingly, utilities of GAM130 include diagnosis, prevention and treatment of diseases and clinical conditions associated with ST5.

The function of ST5 and its association with various diseases and clinical conditions, has been established by previous studies, as described hereinabove with reference to GAM66.1. Start domain containing 7 (STARD7, Accession NP_644672.1) is another GAM130 target gene, herein designated TARGET GENE. STARD7 BINDING SITE is a target binding site found in the 3' untranslated region of multiple transcripts of mRNA encoded by STARD7, corresponding to a target binding site such as BINDING SITE I, BINDING SITE II or BINDING SITE III of FIG. 8. Table 4 illustrates the complementarity of the nucleotide sequences of STARD7 BINDING SITE, designated SEQ ID:20092, to the nucleotide sequence of GAM130 RNA, herein designated GAM RNA, also designated SEQ ID:331.

Another function of GAM130 is therefore inhibition of Start domain containing 7 (STARD7, Accession NP_644672.1). Accordingly, utilities of GAM130 include diagnosis, prevention and treatment of diseases and clinical conditions associated with STARD7.

Start domain containing 7 (STARD7, Accession NP_064536.1) is another GAM130 target gene, herein designated TARGET GENE. STARD7 BINDING SITE is a target binding site found in the 3' untranslated region of multiple transcripts of mRNA encoded by STARD7, corresponding to a target binding site such as BINDING SITE I, BINDING SITE II or BINDING SITE III of FIG. 8. Table 4 illustrates the complementarity of the nucleotide sequences of STARD7 BINDING SITE, designated SEQ ID:20092, to the nucleotide sequence of GAM130 RNA, herein designated GAM RNA, also designated SEQ ID:331.

Another function of GAM130 is therefore inhibition of Start domain containing 7 (STARD7, Accession NP_064536.1). Accordingly, utilities of GAM130 include diagnosis, prevention and treatment of diseases and clinical conditions associated with STARD7.

Staufen, rna binding protein (drosophila) (STAU, Accession NP_004593.1) is another GAM130 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:7149, to the nucleotide sequence of GAM130 RNA, herein designated GAM RNA, also designated SEQ ID:331.

Another function of GAM130 is therefore inhibition of Staufen, rna binding protein (drosophila) (STAU, Accession NP_004593.1), a gene which may play a role in specific positioning of mrnas at given sites in the cell and in stimulating their translation at the site. Accordingly, utilities of GAM130 include diagnosis, prevention and treatment of diseases and clinical conditions associated with STAU.

The function of STAU and its association with various diseases and clinical conditions, has been established by previous studies, as described hereinabove with reference to GAM37.1. Stomatin (STOM, Accession NP_004090.3) is another GAM130 target gene, herein designated TARGET GENE. STOM BINDING SITE is a target binding site found in the 3' untranslated region of mRNA encoded by STOM, corresponding to a target binding site such as BINDING SITE I, BINDING SITE II or BINDING SITE III of FIG. 8. Table 4 illustrates the complementarity of the nucleotide sequences of STOM BINDING SITE, designated SEQ ID:11080, to the nucleotide sequence of GAM130 RNA, herein designated GAM RNA, also designated SEQ ID:331.

Another function of GAM130 is therefore inhibition of Stomatin (STOM, Accession NP_004090.3). Accordingly, utilities of GAM130 include diagnosis, prevention and treatment of diseases and clinical conditions associated with STOM.

Synaptotagmin xi (SYT11, Accession NP_689493.2) is another GAM130 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:11259, to the nucleotide sequence of GAM130 RNA, herein designated GAM RNA, also designated SEQ ID:331.

Another function of GAM130 is therefore inhibition of Synaptotagmin xi (SYT11, Accession NP_689493.2). Accordingly, utilities of GAM130 include diagnosis, prevention and treatment of diseases and clinical conditions associated with SYT11.

Synaptotagmin xiii (SYT13, Accession NP_065877.1) is another GAM130 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:1756, to the nucleotide sequence of GAM130 RNA, herein designated GAM RNA, also designated SEQ ID:331.

Another function of GAM130 is therefore inhibition of Synaptotagmin xiii (SYT13, Accession NP_065877.1). Accordingly, utilities of GAM130 include diagnosis, prevention and treatment of diseases and clinical conditions associated with SYT13.

Taf11 rna polymerase ii, tata box binding protein (tbp)-associated factor, 28 kda (TAF11, Accession NP_005634.1) is another GAM130 target gene, herein designated TARGET GENE. TAF11 BINDING SITE is a target binding site found in the 3' untranslated region of mRNA encoded by TAF11, corresponding to a target binding site such as BINDING SITE I, BINDING SITE II or BINDING SITE III of FIG. 8. Table 4 illustrates the complementarity of the nucleotide sequences of TAF11 BINDING SITE, designated SEQ ID:7353, to the nucleotide sequence of GAM130 RNA, herein designated GAM RNA, also designated SEQ ID:331.

Another function of GAM130 is therefore inhibition of Taf11 rna polymerase ii, tata box binding protein (tbp)-associated factor, 28 kda (TAF11, Accession NP_005634.1), a gene which plays a central role in mediating promoter responses to various activators and repressors. Accordingly, utilities of GAM130 include diagnosis, prevention and treatment of diseases and clinical conditions associated with TAF11.

The function of TAF11 has been established by previous studies. Mengus et al. (1995) immunopurified TFIID, separated the components by SDS-PAGE and transferred the bands to PVDF membrane for tryptic digestion, purified the resulting TAF peptides by reverse phase chromatography and subsequently obtained partial peptide sequence data. Degenerate oligomers of TAF2I (also referred to as TAFII28) were then used to screen a HeLa cell cDNA library. The TAFII28 cDNA encodes a 211-amino acid protein containing the expected tryptic peptides. It is about 50% identical to the Drosophila TAFII30-beta protein. The authors demonstrated that different domains of TAFII28 interact with TAFII18 (TAF2K; 600774) and TBP. Birck et al. (1998) determined the crystal structure of the human TBP-associated factor TAFII28/TAFII18 heterodimer and showed that these TAFIIs form a novel histone-like pair in the TFIID complex. The histone folds in TAFII28 and TAFII18 were not predicted from their primary sequence, indicating that these TAFIIs define a novel family of atypical histone fold sequences.

Full details of the abovementioned studies are described in the following publications, the disclosure of which are hereby incorporated by reference:

Birck, C.; Poch, O.; Romier, C.; Ruff, M.; Mengus, G.; Lavigne, A.-C.; Davidson, I.; Moras, D.: Human TAFII28 and TAFII18 interact through a histone fold encoded by atypical evolutionary conserved motifs also found in the SPT3 family. Cell 94:239-249, 1998; and Mengus, G.; May, M.; Jacq, X.; Staub, A.; Tora, L.; Chambon, P.; Davidson, I.: Cloning and characterization of hTAFII18, hTAFII20 and hTAFII28: three subunits of the human transcriptio.

Further studies establishing the function and utilities of TAF11 are found in John Hopkins OMIM database record ID 600772, and in cited publications listed in Table 5, which are hereby incorporated by reference. Tbc1 domain family, member 5 (TBC1D5, Accession NP_055559.1) is another GAM130 target gene, herein designated TARGET GENE. TBC1D5 BINDING SITE is a target binding site found in the 5' untranslated region of mRNA encoded by TBC1D5, corresponding to a target binding site such as BINDING SITE I, BINDING SITE II or BINDING SITE III of FIG. 8. Table 4 illustrates the complementarity of the nucleotide sequences of TBC1D5 BINDING SITE, designated SEQ ID:14371, to the nucleotide sequence of GAM130 RNA, herein designated GAM RNA, also designated SEQ ID:331.

Another function of GAM130 is therefore inhibition of Tbc1 domain family, member 5 (TBC1D5, Accession NP_055559.1) . Accordingly, utilities of GAM130 include diagnosis, prevention and treatment of diseases and clinical conditions associated with TBC1D5.

TERA (Accession NP_067061.1) is another GAM130 target gene, herein designated TARGET GENE. TERA BINDING SITE is a target binding site found in the 3' untranslated region of mRNA encoded by TERA, corresponding to a target binding site such as BINDING SITE I, BINDING SITE II or BINDING SITE III of FIG. 8. Table 4 illustrates the complementarity of the nucleotide sequences of TERA BINDING SITE, designated SEQ ID:19045, to the nucleotide sequence of GAM130 RNA, herein designated GAM RNA, also designated SEQ ID:331.

Another function of GAM130 is therefore inhibition of TERA (Accession NP_067061.1). Accordingly, utilities of GAM130 include diagnosis, prevention and treatment of diseases and clinical conditions associated with TERA.

TIM50L (Accession XP_053074.2) is another GAM130 target gene, herein designated TARGET GENE. TIM50L BINDING SITE is a target binding site found in the 3' untranslated region of mRNA encoded by TIM50L, corresponding to a target binding site such as BINDING SITE I, BINDING SITE II or BINDING SITE III of FIG. 8. Table 4 illustrates the complementarity of the nucleotide sequences of TIM50L BINDING SITE, designated SEQ ID:18544, to the nucleotide sequence of GAM130 RNA, herein designated GAM RNA, also designated SEQ ID:331.

Another function of GAM130 is therefore inhibition of TIM50L (Accession XP_053074.2). Accordingly, utilities of GAM130 include diagnosis, prevention and treatment of diseases and clinical conditions associated with TIM50L.

Tumor necrosis factor receptor superfamily, member 13c (TNFRSF13C, Accession NP_443177.1) is another GAM130 target gene, herein designated TARGET GENE. TNFRSF13C BINDING SITE is a target binding site found in the 3' untranslated region of mRNA encoded by TNFRSF13C, corresponding to a target binding site such as BINDING SITE I, BINDING SITE II or BINDING SITE III of FIG. 8. Table 4 illustrates the complementarity of the nucleotide sequences of TNFRSF13C BINDING SITE, designated SEQ ID:6834, to the nucleotide sequence of GAM130 RNA, herein designated GAM RNA, also designated SEQ ID:331.

Another function of GAM130 is therefore inhibition of Tumor necrosis factor receptor superfamily, member 13c (TNFRSF13C, Accession NP_443177.1), a gene which is a regulator of the peripheral B-cell population. Accordingly, utilities of GAM130 include diagnosis, prevention and treatment of diseases and clinical conditions associated with TNFRSF13C.

The function of TNFRSF13C has been established by previous studies. BAFF (TNFSF13B; 603969) enhances B-cell survival in vitro and is a regulator of the peripheral B-cell population. Overexpression of Baff in mice results in mature B-cell hyperplasia and symptoms of systemic lupus erythematosus (SLE; 152700) (Mackay et al., 1999). Likewise, some SLE patients have increased levels of BAFF in serum. Like APRIL (TNFSF13; 604472), BAFF binds to both TACI (OMIM Ref. No. 604907) and BCMA (TNFRSF17; 109545); however, mice deficient in these molecules maintain some B-cell function (Xu and Lam, 2001; Yan et al., 2001), suggesting the existence of a third BAFF receptor. By screening an expression library of a B-cell line with undetectable BCMA and low TACI expression, Thompson et al. (2001) isolated a cDNA encoding the third BAFF receptor, BAFFR. Sequence analysis predicted that the 184-amino acid transmembrane protein is 56% identical to the mouse protein. TNF receptors typically contain multiple cysteine-rich domains (CRDs), each with 6 cys residues. BAFFR, however, has only 1 CRD that contains 4 extracellular cys residues. The C terminus of BAFFR has a conserved region of 25 consecutive amino acids that is probably involved in signal transduction. Northern blot analysis revealed expression of a 4.5-kb BAFFR transcript in spleen and lymph node, with lower levels in thymus and peripheral blood leukocytes. Binding analysis indicated that BAFFR binds human and mouse BAFF but no other TNF ligand, including APRIL. Soluble BAFFR inhibited BAFF-mediated costimulation of B-cell proliferation. Thompson et al. (2001) concluded that BAFFR is the principal receptor required for BAFF-mediated mature B-cell survival. Claudio et al. (2002) showed that bone marrow (BM) cells from Nfkb2 (OMIM Ref. No. 164012)- deficient mice, but not Nfkb1 (OMIM Ref. No. 164011)-deficient mice, failed to increase relative and total IgD-positive transitional-1 (T1) stage B cells in response to Baff. In vivo, however, Nfkb2-deficient mice did generate mature B cells, but at reduced numbers. Mice of the aly/aly strain, which are naturally deficient in Nik (OMIM Ref. No. 604655), and mice of the A/WySNJ strain, which have a mutation in Baffr, also failed to produce T1 B cells in response to Baff. Baff stimulation enhanced expression of Bcl2 (OMIM Ref. No. 151430) in T1 B cells, thereby promoting B-cell survival, and caused the processing of the p100 form of Nfkb2 to p52, which again required Baffr and Nik, but not Nemo (IKKG; 300248). Immunoblot analysis showed that BM cells contained primarily p100. In contrast, T1 splenic cells had higher levels of p52, and even higher amounts of p52 were found in T2/mature B- cell subsets. Claudio et al. (2002) concluded that through sustained exposure, BAFF activates NFKB in B cells primarily via processing of p100 and contributes to B-cell survival in vivo probably from the T1 stage onwards.

Animal model experiments lend further support to the function of TNFRSF13C. Using PCR, Thompson et al. (2001) determined that the A/WySnJ strain of mice, which resemble Baff knockout mice in their reduced number of mature B cells, lack the intracellular signaling domain-encoding exon 3 of the Baffr gene. Flow cytometric analysis demonstrated that expression of the Baffr extracellular and transmembrane domains, which are encoded by exons 1 and 2, respectively, is maintained in this strain and that these cells are able to bind Baff.

It is appreciated that the abovementioned animal model for TNFRSF13C is acknowledged by those skilled in the art as a scientifically valid animal model, as can be further appreciated from the publications sited hereinbelow.

Full details of the abovementioned studies are described in the following publications, the disclosure of which are hereby incorporated by reference:

Claudio, E.; Brown, K.; Park, S.; Wang, H.; Siebenlist, U.: BAFF-induced NEMO- independent processing of NF-kappa-B2 in maturing B cells. Nature Immun. 3:958-965, 2002; and Thompson, J. S.; Bixler, S. A.; Qian, F.; Vora, K.; Scott, M. L.; Cachero, T. G.; Hession, C.; Schneider, P.; Sizing, I. D.; Mullen, C.; Strauch, K.; Zafari, M.; Benjamin, C. D.; Tschop.

Further studies establishing the function and utilities of TNFRSF13C are found in John Hopkins OMIM database record ID 606269, and in cited publications listed in Table 5, which are hereby incorporated by reference. Tumor protein p53 (li-fraumeni syndrome) (TP53, Accession NP_000537.2) is another GAM130 target gene, herein designated TARGET GENE. TP53 BINDING SITE is a target binding site found in the 3' untranslated region of mRNA encoded by TP53, corresponding to a target binding site such as BINDING SITE I, BINDING SITE II or BINDING SITE III of FIG. 8. Table 4 illustrates the complementarity of the nucleotide sequences of TP53 BINDING SITE, designated SEQ ID:3421, to the nucleotide sequence of GAM130 RNA, herein designated GAM RNA, also designated SEQ ID:331.

Another function of GAM130 is therefore inhibition of Tumor protein p53 (li-fraumeni syndrome) (TP53, Accession NP_000537.2). Accordingly, utilities of GAM130 include diagnosis, prevention and treatment of diseases and clinical conditions associated with TP53.

Thiopurine s-methyltransferase (TPMT, Accession NP_000358.1) is another GAM130 target gene, herein designated TARGET GENE. TPMT BINDING SITE is a target binding site found in the 3' untranslated region of mRNA encoded by TPMT, corresponding to a target binding site such as BINDING SITE I, BINDING SITE II or BINDING SITE III of FIG. 8. Table 4 illustrates the complementarity of the nucleotide sequences of TPMT BINDING SITE, designated SEQ ID:5228, to the nucleotide sequence of GAM130 RNA, herein designated GAM RNA, also designated SEQ ID:331.

Another function of GAM130 is therefore inhibition of Thiopurine s-methyltransferase (TPMT, Accession NP_000358.1), a gene which catalyzes the s-methylation of thiopurine drugs such as 6-mercaptopurine. and therefore may be associated with Thiopurine s-methyltransferase polymorphism. Accordingly, utilities of GAM130 include diagnosis, prevention and treatment of Thiopurine s-methyltransferase polymorphism, and of other diseases and clinical conditions associated with TPMT.

The function of TPMT has been established by previous studies. Thiopurine S- methyltransferase (TPMT; S-adenosyl-L-methionine:thiopurine S-methyltransferase; EC 2.1.1.67) catalyzes thiopurine S-methylation, an important metabolic pathway for drugs such as 6-mercaptopurine. Weinshilboum and Sladek (1980) found trimodality for level of red cell TPMT among 298 randomly selected subjects: 88.6% had high enzyme activity; 11.1% had intermediate activity and 0.3% had undetectable activity. This distribution conforms to Hardy-Weinberg expectations for a pair of autosomal codominant alleles for low and high activity, TPMT-L and TPMT- H, with frequencies of 0.059 and 0.941, respectively. Segregation in families ascertained through probands with undetectable activity was consistent with this hypothesis. This genetic polymorphism may be an important factor in individual variations in sensitivity to thiopurines. 6-Mercaptopurine (6-MP) can be inactivated by S-methylation, which is catalyzed by thiopurine methyltransferase. An alternative metabolic route leads to the formation of cytotoxic 6-thioguanine nucleotides (6-TGN). Lennard et al. (1990) investigated whether these 2 pathways compete to affect the therapeutic response to 6-MP, by measuring 6-TGN concentrations and TPMT enzymatic activity in red cells of 95 children on long-term 6-MP therapy for acute lymphoblastic leukemia (ALL). Red cell TPMT activities were also measured in 130 control children and 104 long-term survivors of ALL no longer on treatment. In the children on 6-MP, red cell 6-TGN correlated negatively with red cell TPMT activity. Children with 6-TGN concentrations below the group mean had higher TPMT activities and a higher subsequent relapse rate. Fifty of the 104 long-term survivors had been treated with low-dose protocols; this subgroup contained an excess of children with lower TPMT activities. The results indicated that genetically determined TPMT activity may be an important regulator of the cytotoxic effect of 6-MP, an effect which in turn may be important in influencing the outcome of therapy for childhood ALL. Klemetsdal et al. (1993) found in a group of healthy subjects that red blood cell TPMT activity was 8.3% higher in male subjects than in female subjects. Alves et al. (1999) applied a PCR-SSCP method for TPMT-specific detection which introduces a substantial technical simplification, avoiding the use of restriction enzyme treatment after PCR amplification. Additionally, the method allowed the simultaneous detection of a 474T-C transition, a frequent silent mutation in the non-Portuguese population (TPMT*1S =0.215). In a sample of 310 unrelated Northern Portuguese individuals, 15 were found to be heterozygous for the TPMT*3A allele (187680.0002) which is associated with TPMT enzymatic deficiency; the corresponding gene frequency estimate was 0.024. In an attempt to evaluate the relationship between the molecular TPMT genotype and reaction to treatments involving thiopurine drugs, Alves et al. (1999) analyzed a sample of 24 children who received curative therapy of acute lymphoblastic leukemia. Four of them were shown to be heterozygous for the TPMT*3A allele. An examination of their clinical histories showed that all 4 patients exhibited signs of severe hepatic toxicity during treatment. McLeod et al. (1999) studied the frequency of common TPMT variant alleles in 101 Kenyan individuals and 199 Caucasians. The frequency of mutant alleles was similar between the Caucasian (10.1%) and Kenyan (10.9%) populations; however, all mutant alleles in the Kenyan population were TPMT*3C (187680.0005) compared with 4.8% in Caucasians. In contrast, TPMT*3A (187680.0002) was the most common mutant allele in the Caucasian individuals.

Full details of the abovementioned studies are described in the following publications, the disclosure of which are hereby incorporated by reference:

Alves, S.; Prata, M.-J.; Ferreira, F.; Amorim, A.: Thiopurine methyltransferase pharmacogenetics: alternative molecular diagnosis and preliminary data from Northern Portugal. Pharmacogenetics 9:257-261, 1999; and Ameyaw, M.-M.; Collie-Duguid, E. S. R.; Powrie, R. H.; Ofori-Adjei, D.; McLeod, H. L.: Thiopurine methyltransferase alleles in British and Ghanaian populations. Hum. Molec. Genet. 8:3.

Further studies establishing the function and utilities of TPMT are found in John Hopkins OMIM database record ID 187680, and in cited publications listed in Table 5, which are hereby incorporated by reference. Tripartite motif-containing 5 (TRIM5, Accession NP_149023.1) is another GAM130 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:4494, to the nucleotide sequence of GAM130 RNA, herein designated GAM RNA, also designated SEQ ID:331.

Another function of GAM130 is therefore inhibition of Tripartite motif-containing 5 (TRIM5, Accession NP_149023.1). Accordingly, utilities of GAM130 include diagnosis, prevention and treatment of diseases and clinical conditions associated with TRIM5.

Transient receptor potential cation channel, subfamily m, member 6 (TRPM6, Accession NP_060132.3) is another GAM130 target gene, herein designated TARGET GENE. TRPM6 BINDING SITE is a target binding site found in the 3' untranslated region of mRNA encoded by TRPM6, corresponding to a target binding site such as BINDING SITE I, BINDING SITE II or BINDING SITE III of FIG. 8. Table 4 illustrates the complementarity of the nucleotide sequences of TRPM6 BINDING SITE, designated SEQ ID:5183, to the nucleotide sequence of GAM130 RNA, herein designated GAM RNA, also designated SEQ ID:331.

Another function of GAM130 is therefore inhibition of Transient receptor potential cation channel, subfamily m, member 6 (TRPM6, Accession NP_060132.3), a gene which contains a predicted ion channel domain and a protein kinase domain. and therefore is associated with Hypomagnesemia with secondary hypocalcemia. Accordingly, utilities of GAM130 include diagnosis, prevention and treatment of Hypomagnesemia with secondary hypocalcemia, and of other diseases and clinical conditions associated with TRPM6.

The function of TRPM6 has been established by previous studies. Schlingmann et al. (2002) and Walder et al. (2002) studied hypomagnesemia with secondary hypocalcemia (HSH; 602014), which maps to 9q22, and by positional cloning identified the TRPM6 gene as the site of causative mutations. Walder et al. (2002) found that the complete cDNA sequence of TRPM6 contains 8,429 nucleotides, including an open reading frame of 6,069 nucleotides. The predicted TRPM6 protein contains 2,022 amino acids, has a calculated molecular mass of roughly 234 kD, and contains a predicted ion channel domain and a protein kinase domain. Northern blot analysis detected an 8.5-kb transcript abundantly expressed in kidney and colon. By in situ hybridization to various human tissues, Schlingmann et al. (2002) observed TRPM6 mRNA in colon epithelial cells, duodenum, jejunum, and ileum. Schlingmann et al. (2002) studied 5 families (2 Turkish, 1 Swedish, 1 Israeli, and 1 Albanian) with typical HSH and discovered 7 mutations in the TRPM6 gene; the Swedish and Israeli families were nonconsanguineous and the affected children were compound heterozygotes for TRPM6 mutations. The age at onset of symptoms varied from 3 weeks to 4 months. Neurologic symptoms included tetany, muscle spasms, and seizures due to hypomagnesemic hypocalcemia. Walder et al. (2002) identified mutations in the TRPM6 gene in 7 families:3 Bedouin Arab families from Israel, 1 Arab family from Greece, a family in Germany, and 2 additional Arab families from Israel. This was the first case of a human disorder attributed to mutation in a channel kinase.

Full details of the abovementioned studies are described in the following publications, the disclosure of which are hereby incorporated by reference:

Walder, R. Y.; Landau, D.; Meyer, P.; Shalev, H.; Tsolia, M.; Borochowitz, Z.; Boettger, M. B.; Beck, G. E.; Englehardt, R. K.; Carmi, R.; Sheffield, V. C.: Mutation of TRPM6 causes familial hypomagnesemia with secondary hypocalcemia. Nature Genet. 31:171-174, 2002; and Schlingmann, K. P.; Weber, S.; Peters, M.; Nejsum, L. N.; Vitzthum, H.; Klingel, K.; Kratz, M.; Haddad, E.; Ristoff, E.; Dinour, D.; Syrrou, M.; Nielsen, S.; Sassen, M.; Waldegger, S.; S.

Further studies establishing the function and utilities of TRPM6 are found in John Hopkins OMIM database record ID 607009, and in cited publications listed in Table 5, which are hereby incorporated by reference. Transient receptor potential cation channel, subfamily v, member 1 (TRPV1, Accession NP_542436.1) is another GAM130 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:14336, to the nucleotide sequence of GAM130 RNA, herein designated GAM RNA, also designated SEQ ID:331.

Another function of GAM130 is therefore inhibition of Transient receptor potential cation channel, subfamily v, member 1 (TRPV1, Accession NP_542436.1), a gene which functions as a receptor for capsaicin. Accordingly, utilities of GAM130 include diagnosis, prevention and treatment of diseases and clinical conditions associated with TRPV1.

The function of TRPV1 has been established by previous studies. Chuang et al. (2001) demonstrated that bradykinin-or NGF-mediated potentiation of thermal sensitivity in vivo requires expression of VR1, a heat-activated ion channel on sensory neurons. Diminution of plasma membrane phosphatidylinositol-4,5,bisphosphate levels through antibody sequestration or PLC-mediated hydrolysis mimics the potentiating effects of bradykinin or NGF at the cellular level. Moreover, recruitment of PLC-gamma (OMIM Ref. No. 172420) to TRK-alpha (OMIM Ref. No. 191315) is essential for NGF-mediated potentiation of channel activity, and biochemical studies suggested that VR1 associates with this complex. Chuang et al. (2001) concluded that their studies delineate a biochemical mechanism through which bradykinin and NGF produce hypersensitivity and might explain how the activation of PLC signaling systems regulates other members of the TRP channel family.

Animal model experiments lend further support to the function of TRPV1. Caterina et al. (2000) generated mice deficient in VR1 by targeted disruption. VR1 -/- mice were viable, fertile, and largely indistinguishable from wildtype littermates. Caterina et al. (2000) demonstrated that sensory neurons from mice lacking VR1 are severely deficient in their responses to vanilloid compounds, protons, or heat greater than 43 degrees C. VR1 -/- mice showed normal responses to noxious mechanical stimuli but exhibited no vanilloid-evoked pain behavior, were impaired in the detection of painful heat, and showed little thermal hypersensitivity in the setting of inflammation. Thus, Caterina et al. (2000) concluded that VR1 is essential for selective modalities of pain sensation and for tissue injury-induced thermal hyperalgesia.

It is appreciated that the abovementioned animal model for TRPV1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chuang, H.; Prescott, E. D.; Kong, H.; Shields, S.; Jordt, S.-E.; Basbaum, A. I.; Chao, M. V.; Julius, D.: Bradykinin and nerve growth factor release the capsaicin receptor from PtdIns(4,5)P2-mediated inhibition. Nature 411:957-962, 2001; and Caterina, M. J.; Leffler, A.; Malmberg, A. B.; Martin, W. J.; Trafton, J.; Petersen- Zeltz, K. R.; Koltzenburg, M.; Basbaum, A. I.; Julius, D.: Impaired nociception and pain sensation in m.

Further studies establishing the function and utilities of TRPV1 are found in John Hopkins OMIM database record ID 602076, and in cited publications listed in Table 5, which are hereby incorporated by reference. Transient receptor potential cation channel, subfamily v, member 1 (TRPV1, Accession NP_542437.1) is another GAM130 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:14336, to the nucleotide sequence of GAM130 RNA, herein designated GAM RNA, also designated SEQ ID:331.

Another function of GAM130 is therefore inhibition of Transient receptor potential cation channel, subfamily v, member 1 (TRPV1, Accession NP_542437.1), a gene which functions as a receptor for capsaicin. Accordingly, utilities of GAM130 include diagnosis, prevention and treatment of diseases and clinical conditions associated with TRPV1.

The function of TRPV1 has been established by previous studies. Chuang et al. (2001) demonstrated that bradykinin-or NGF-mediated potentiation of thermal sensitivity in vivo requires expression of VR1, a heat-activated ion channel on sensory neurons. Diminution of plasma membrane phosphatidylinositol-4,5,bisphosphate levels through antibody sequestration or PLC-mediated hydrolysis mimics the potentiating effects of bradykinin or NGF at the cellular level. Moreover, recruitment of PLC-gamma (OMIM Ref. No. 172420) to TRK-alpha (OMIM Ref. No. 191315) is essential for NGF-mediated potentiation of channel activity, and biochemical studies suggested that VR1 associates with this complex. Chuang et al. (2001) concluded that their studies delineate a biochemical mechanism through which bradykinin and NGF produce hypersensitivity and might explain how the activation of PLC signaling systems regulates other members of the TRP channel family.

Animal model experiments lend further support to the function of TRPV1. Caterina et al. (2000) generated mice deficient in VR1 by targeted disruption. VR1 -/- mice were viable, fertile, and largely indistinguishable from wildtype littermates. Caterina et al. (2000) demonstrated that sensory neurons from mice lacking VR1 are severely deficient in their responses to vanilloid compounds, protons, or heat greater than 43 degrees C. VR1 -/- mice showed normal responses to noxious mechanical stimuli but exhibited no vanilloid-evoked pain behavior, were impaired in the detection of painful heat, and showed little thermal hypersensitivity in the setting of inflammation. Thus, Caterina et al. (2000) concluded that VR1 is essential for selective modalities of pain sensation and for tissue injury-induced thermal hyperalgesia.

It is appreciated that the abovementioned animal model for TRPV1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chuang, H.; Prescott, E. D.; Kong, H.; Shields, S.; Jordt, S.-E.; Basbaum, A. I.; Chao, M. V.; Julius, D.: Bradykinin and nerve growth factor release the capsaicin receptor from PtdIns(4,5)P2-mediated inhibition. Nature 411:957-962, 2001; and Caterina, M. J.; Leffler, A.; Malmberg, A. B.; Martin, W. J.; Trafton, J.; Petersen- Zeltz, K. R.; Koltzenburg, M.; Basbaum, A. I.; Julius, D.: Impaired nociception and pain sensation in m.

Further studies establishing the function and utilities of TRPV1 are found in John Hopkins OMIM database record ID 602076, and in cited publications listed in Table 5, which are hereby incorporated by reference. Transient receptor potential cation channel, subfamily v, member 1 (TRPV1, Accession NP_061197.3) is another GAM130 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:14336, to the nucleotide sequence of GAM130 RNA, herein designated GAM RNA, also designated SEQ ID:331.

Another function of GAM130 is therefore inhibition of Transient receptor potential cation channel, subfamily v, member 1 (TRPV1, Accession NP_061197.3), a gene which functions as a receptor for capsaicin. Accordingly, utilities of GAM130 include diagnosis, prevention and treatment of diseases and clinical conditions associated with TRPV1.

The function of TRPV1 has been established by previous studies. Chuang et al. (2001) demonstrated that bradykinin-or NGF-mediated potentiation of thermal sensitivity in vivo requires expression of VR1, a heat-activated ion channel on sensory neurons. Diminution of plasma membrane phosphatidylinositol-4,5,bisphosphate levels through antibody sequestration or PLC-mediated hydrolysis mimics the potentiating effects of bradykinin or NGF at the cellular level. Moreover, recruitment of PLC-gamma (OMIM Ref. No. 172420) to TRK-alpha (OMIM Ref. No. 191315) is essential for NGF-mediated potentiation of channel activity, and biochemical studies suggested that VR1 associates with this complex. Chuang et al. (2001) concluded that their studies delineate a biochemical mechanism through which bradykinin and NGF produce hypersensitivity and might explain how the activation of PLC signaling systems regulates other members of the TRP channel family.

Animal model experiments lend further support to the function of TRPV1. Caterina et al. (2000) generated mice deficient in VR1 by targeted disruption. VR1 -/- mice were viable, fertile, and largely indistinguishable from wildtype littermates. Caterina et al. (2000) demonstrated that sensory neurons from mice lacking VR1 are severely deficient in their responses to vanilloid compounds, protons, or heat greater than 43 degrees C. VR1 -/- mice showed normal responses to noxious mechanical stimuli but exhibited no vanilloid-evoked pain behavior, were impaired in the detection of painful heat, and showed little thermal hypersensitivity in the setting of inflammation. Thus, Caterina et al. (2000) concluded that VR1 is essential for selective modalities of pain sensation and for tissue injury-induced thermal hyperalgesia.

It is appreciated that the abovementioned animal model for TRPV1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chuang, H.; Prescott, E. D.; Kong, H.; Shields, S.; Jordt, S.-E.; Basbaum, A. I.; Chao, M. V.; Julius, D.: Bradykinin and nerve growth factor release the capsaicin receptor from PtdIns(4,5)P2-mediated inhibition. Nature 411:957-962, 2001; and Caterina, M. J.; Leffler, A.; Malmberg, A. B.; Martin, W. J.; Trafton, J.; Petersen- Zeltz, K. R.; Koltzenburg, M.; Basbaum, A. I.; Julius, D.: Impaired nociception and pain sensation in m.

Further studies establishing the function and utilities of TRPV1 are found in John Hopkins OMIM database record ID 602076, and in cited publications listed in Table 5, which are hereby incorporated by reference. Transient receptor potential cation channel, subfamily v, member 1 (TRPV1, Accession NP_542435.1) is another GAM130 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:14336, to the nucleotide sequence of GAM130 RNA, herein designated GAM RNA, also designated SEQ ID:331.

Another function of GAM130 is therefore inhibition of Transient receptor potential cation channel, subfamily v, member 1 (TRPV1, Accession NP_542435.1), a gene which functions as a receptor for capsaicin. Accordingly, utilities of GAM130 include diagnosis, prevention and treatment of diseases and clinical conditions associated with TRPV1.

The function of TRPV1 has been established by previous studies. Chuang et al. (2001) demonstrated that bradykinin-or NGF-mediated potentiation of thermal sensitivity in vivo requires expression of VR1, a heat-activated ion channel on sensory neurons. Diminution of plasma membrane phosphatidylinositol-4,5,bisphosphate levels through antibody sequestration or PLC-mediated hydrolysis mimics the potentiating effects of bradykinin or NGF at the cellular level. Moreover, recruitment of PLC-gamma (OMIM Ref. No. 172420) to TRK-alpha (OMIM Ref. No. 191315) is essential for NGF-mediated potentiation of channel activity, and biochemical studies suggested that VR1 associates with this complex. Chuang et al. (2001) concluded that their studies delineate a biochemical mechanism through which bradykinin and NGF produce hypersensitivity and might explain how the activation of PLC signaling systems regulates other members of the TRP channel family.

Animal model experiments lend further support to the function of TRPV1. Caterina et al. (2000) generated mice deficient in VR1 by targeted disruption. VR1 -/- mice were viable, fertile, and largely indistinguishable from wildtype littermates. Caterina et al. (2000) demonstrated that sensory neurons from mice lacking VR1 are severely deficient in their responses to vanilloid compounds, protons, or heat greater than 43 degrees C. VR1 -/- mice showed normal responses to noxious mechanical stimuli but exhibited no vanilloid-evoked pain behavior, were impaired in the detection of painful heat, and showed little thermal hypersensitivity in the setting of inflammation. Thus, Caterina et al. (2000) concluded that VR1 is essential for selective modalities of pain sensation and for tissue injury-induced thermal hyperalgesia.

It is appreciated that the abovementioned animal model for TRPV1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chuang, H.; Prescott, E. D.; Kong, H.; Shields, S.; Jordt, S.-E.; Basbaum, A. I.; Chao, M. V.; Julius, D.: Bradykinin and nerve growth factor release the capsaicin receptor from PtdIns(4,5)P2-mediated inhibition. Nature 411:957-962, 2001; and Caterina, M. J.; Leffler, A.; Malmberg, A. B.; Martin, W. J.; Trafton, J.; Petersen- Zeltz, K. R.; Koltzenburg, M.; Basbaum, A. I.; Julius, D.: Impaired nociception and pain sensation in m.

Further studies establishing the function and utilities of TRPV1 are found in John Hopkins OMIM database record ID 602076, and in cited publications listed in Table 5, which are hereby incorporated by reference. TU12B1-TY (Accession NP_057659.1) is another GAM130 target gene, herein designated TARGET GENE. TU12B1-TY BINDING SITE is a target binding site found in the 3' untranslated region of mRNA encoded by TU12B1-TY, corresponding to a target binding site such as BINDING SITE I, BINDING SITE II or BINDING SITE III of FIG. 8. Table 4 illustrates the complementarity of the nucleotide sequences of TU12B1-TY BINDING SITE, designated SEQ ID:18545, to the nucleotide sequence of GAM130 RNA, herein designated GAM RNA, also designated SEQ ID:331.

Another function of GAM130 is therefore inhibition of TU12B1-TY (Accession NP_057659.1). Accordingly, utilities of GAM130 include diagnosis, prevention and treatment of diseases and clinical conditions associated with TU12B1-TY.

Ubiquitin protein ligase e3a (human papilloma virus e6-associated protein, angelman syndrome) (UBE3A, Accession NP_570853.1) is another GAM130 target gene, herein designated TARGET GENE. UBE3A BINDING SITE is a target binding site found in the 3' untranslated region of multiple transcripts of mRNA encoded by UBE3A, corresponding to a target binding site such as BINDING SITE I, BINDING SITE II or BINDING SITE III of FIG. 8. Table 4 illustrates the complementarity of the nucleotide sequences of UBE3A BINDING SITE, designated SEQ ID:11737, to the nucleotide sequence of GAM130 RNA, herein designated GAM RNA, also designated SEQ ID:331.

Another function of GAM130 is therefore inhibition of Ubiquitin protein ligase e3a (human papilloma virus e6-associated protein, angelman syndrome) (UBE3A, Accession NP_570853.1). Accordingly, utilities of GAM130 include diagnosis, prevention and treatment of diseases and clinical conditions associated with UBE3A.

Ubiquitin protein ligase e3a (human papilloma virus e6-associated protein, angelman syndrome) (UBE3A, Accession NP_000453.2) is another GAM130 target gene, herein designated TARGET GENE. UBE3A BINDING SITE is a target binding site found in the 3' untranslated region of multiple transcripts of mRNA encoded by UBE3A, corresponding to a target binding site such as BINDING SITE I, BINDING SITE II or BINDING SITE III of FIG. 8. Table 4 illustrates the complementarity of the nucleotide sequences of UBE3A BINDING SITE, designated SEQ ID:11737, to the nucleotide sequence of GAM130 RNA, herein designated GAM RNA, also designated SEQ ID:331.

Another function of GAM130 is therefore inhibition of Ubiquitin protein ligase e3a (human papilloma virus e6-associated protein, angelman syndrome) (UBE3A, Accession NP_000453.2). Accordingly, utilities of GAM130 include diagnosis, prevention and treatment of diseases and clinical conditions associated with UBE3A.

Ubiquitin protein ligase e3a (human papilloma virus e6-associated protein, angelman syndrome) (UBE3A, Accession NP_570854.1) is another GAM130 target gene, herein designated TARGET GENE. UBE3A BINDING SITE is a target binding site found in the 3' untranslated region of multiple transcripts of mRNA encoded by UBE3A, corresponding to a target binding site such as BINDING SITE I, BINDING SITE II or BINDING SITE III of FIG. 8. Table 4 illustrates the complementarity of the nucleotide sequences of UBE3A BINDING SITE, designated SEQ ID:11737, to the nucleotide sequence of GAM130 RNA, herein designated GAM RNA, also designated SEQ ID:331.

Another function of GAM130 is therefore inhibition of Ubiquitin protein ligase e3a (human papilloma virus e6-associated protein, angelman syndrome) (UBE3A, Accession NP_570854.1). Accordingly, utilities of GAM130 include diagnosis, prevention and treatment of diseases and clinical conditions associated with UBE3A.

VIK (Accession NP_612503.1) is another GAM130 target gene, herein designated TARGET GENE. VIK BINDING SITE is a target binding site found in the 3' untranslated region of multiple transcripts of mRNA encoded by VIK, corresponding to a target binding site such as BINDING SITE I, BINDING SITE II or BINDING SITE III of FIG. 8. Table 4 illustrates the complementarity of the nucleotide sequences of VIK BINDING SITE, designated SEQ ID:1104, to the nucleotide sequence of GAM130 RNA, herein designated GAM RNA, also designated SEQ ID:331.

Another function of GAM130 is therefore inhibition of VIK (Accession NP_612503.1). Accordingly, utilities of GAM130 include diagnosis, prevention and treatment of diseases and clinical conditions associated with VIK.

Vesicle transport through interaction with t-snares homolog 1a (yeast) (VTI1A, Accession NP_660207.1) is another GAM130 target gene, herein designated TARGET GENE. VTI1A BINDING SITE is a target binding site found in the 3' untranslated region of mRNA encoded by VTI1A, corresponding to a target binding site such as BINDING SITE I, BINDING SITE II or BINDING SITE III of FIG. 8. Table 4 illustrates the complementarity of the nucleotide sequences of VTI1A BINDING SITE, designated SEQ ID:1804, to the nucleotide sequence of GAM130 RNA, herein designated GAM RNA, also designated SEQ ID:331.

Another function of GAM130 is therefore inhibition of Vesicle transport through interaction with t-snares homolog 1a (yeast) (VTI1A, Accession NP_660207.1). Accordingly, utilities of GAM130 include diagnosis, prevention and treatment of diseases and clinical conditions associated with VTI1A.

Zinc finger protein 253 (ZNF253, Accession NP_066385.1) is another GAM130 target gene, herein designated TARGET GENE. ZNF253 BINDING SITE is a target binding site found in the 3' untranslated region of mRNA encoded by ZNF253, corresponding to a target binding site such as BINDING SITE I, BINDING SITE II or BINDING SITE III of FIG. 8. Table 4 illustrates the complementarity of the nucleotide sequences of ZNF253 BINDING SITE, designated SEQ ID:6640, to the nucleotide sequence of GAM130 RNA, herein designated GAM RNA, also designated SEQ ID:331.

Another function of GAM130 is therefore inhibition of Zinc finger protein 253 (ZNF253, Accession NP_066385.1). Accordingly, utilities of GAM130 include diagnosis, prevention and treatment of diseases and clinical conditions associated with ZNF253.

Zinc finger protein 273 (ZNF273, Accession XP_088082.1) is another GAM130 target gene, herein designated TARGET GENE. ZNF273 BINDING SITE is a target binding site found in the 3' untranslated region of mRNA encoded by ZNF273, corresponding to a target binding site such as BINDING SITE I, BINDING SITE II or BINDING SITE III of FIG. 8. Table 4 illustrates the complementarity of the nucleotide sequences of ZNF273 BINDING SITE, designated SEQ ID:16028, to the nucleotide sequence of GAM130 RNA, herein designated GAM RNA, also designated SEQ ID:331.

Another function of GAM130 is therefore inhibition of Zinc finger protein 273 (ZNF273, Accession XP_088082.1). Accordingly, utilities of GAM130 include diagnosis, prevention and treatment of diseases and clinical conditions associated with ZNF273.

ZNF432 (Accession NP_055465.1) is another GAM130 target gene, herein designated TARGET GENE. ZNF432 BINDING SITE is a target binding site found in the 3' untranslated region of mRNA encoded by ZNF432, corresponding to a target binding site such as BINDING SITE I, BINDING SITE II or BINDING SITE III of FIG. 8. Table 4 illustrates the complementarity of the nucleotide sequences of ZNF432 BINDING SITE, designated SEQ ID:4119, to the nucleotide sequence of GAM130 RNA, herein designated GAM RNA, also designated SEQ ID:331.

Another function of GAM130 is therefore inhibition of ZNF432 (Accession NP_055465.1). Accordingly, utilities of GAM130 include diagnosis, prevention and treatment of diseases and clinical conditions associated with ZNF432.

FIG. 8 further provides a conceptual description of a novel bioinformatically detected of the present invention, referred to here as Genomic Address Messenger 131 (GAM131), which modulates expression of respective target genes thereof, the function and utility of which target genes is known in the art.

GAM131 is a novel bioinformatically detected regulatory, non protein coding, micro RNA (miRNA) gene. The method by which GAM131 was detected is described hereinabove with reference to FIGS. 8-15.

GAM131 gene, herein designated GAM GENE, and GAM131 target gene, herein designated TARGET GENE, are human genes contained in the human genome.

GAM131 gene encodes a GAM131 precursor RNA, herein designated GAM PRECURSOR RNA. Similar to other miRNA genes, and unlike most ordinary genes, GAM131 precursor RNA does not encode a protein. A nucleotide sequence identical or highly similar to the nucleotide sequence of GAM131 precursor RNA is designated SEQ ID:170, and is provided hereinbelow with reference to the sequence listing part.

GAM131 precursor RNA folds onto itself, forming GAM131 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM131 precursor RNA folds onto itself, forming GAM131 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM131 precursor RNA, designated SEQ-ID:170, and a schematic representation of a predicted secondary folding of GAM131 folded precursor RNA are further described with reference to Table 2, hereby incorporated by reference.

An enzyme complex designated DICER COMPLEX, 'dices' the GAM131 folded precursor RNA into GAM131 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM131 RNA is designated SEQ ID:313, and is provided hereinbelow with references to the sequence listing part and Table 3, hereby incorporated by reference.

GAM131 target gene, herein designated TARGET GENE, encodes a corresponding messenger RNA, GAM131 target RNA, herein designated GAM TARGET RNA. GAM131 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM131 RNA, herein designated GAM RNA, binds complementarily to one or more target binding sites located in untranslated regions of GAM131 target RNA, herein designated GAM TARGET RNA. This complementary binding is due to the fact that the nucleotide sequence of GAM131 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM131 RNA may have a different number of target binding sites in untranslated regions of a GAM131 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM131 RNA, herein designated GAM RNA, to target binding sites on GAM131 target RNA, herein designated GAM TARGET RNA, such as BINDING SITE I, BINDING SITE II and BINDING SITE III, inhibits translation of GAM131 target RNA into GAM131 target protein, herein designated GAM TARGET PROTEIN. GAM target protein is therefore outlined by a broken line.

It is appreciated that GAM131 target gene, herein designated TARGET GENE, in fact represents a plurality of GAM131 target genes. The mRNA of each one of this plurality of GAM131 target genes comprises one or more target binding sites, each having a nucleotide sequence which is at least partly complementary to GAM131 RNA, herein designated GAM RNA, and which when bound by GAM131 RNA causes inhibition of translation of respective one or more GAM131 target proteins.

It is further appreciated by one skilled in the art that the mode of translational inhibition illustrated by FIG. 8 with specific reference to translational inhibition exerted by GAM131 gene, herein designated GAM GENE, on one or more GAM131 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM131 correlate with, and may be deduced from, the identity of the target genes which GAM131 binds and inhibits, and the function of these target genes, as elaborated hereinbelow.

ASK (Accession NM_006716.1) is a GAM131 target gene, herein designated TARGET GENE. ASK BINDING SITE is a target binding site found in the 5' untranslated region of mRNA encoded by ASK, corresponding to a target binding site such as BINDING SITE I, BINDING SITE II or BINDING SITE III of FIG. 8. Table 4 illustrates the complementarity of the nucleotide sequences of ASK BINDING SITE, designated SEQ ID:7247, to the nucleotide sequence of GAM131 RNA, herein designated GAM RNA, also designated SEQ ID:313.

A function of GAM131 is therefore inhibition of ASK (Accession NM_006716.1). Accordingly, utilities of GAM131 include diagnosis, prevention and treatment of diseases and clinical conditions associated with ASK.

Atpase, class i, type 8b, member 2 (ATP8B2, Accession XM_290875.1) is another GAM131 target gene, herein designated TARGET GENE. ATP8B2 BINDING SITE is a target binding site found in the 5' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:13187, to the nucleotide sequence of GAM131 RNA, herein designated GAM RNA, also designated SEQ ID:313.

Another function of GAM131 is therefore inhibition of Atpase, class i, type 8b, member 2 (ATP8B2, Accession XM_290875.1). Accordingly, utilities of GAM131 include diagnosis, prevention and treatment of diseases and clinical conditions associated with ATP8B2.

LGP1 (Accession NM_032484.2) is another GAM131 target gene, herein designated TARGET GENE. LGP1 BINDING SITE is a target binding site found in the 3' untranslated region of mRNA encoded by LGP1, corresponding to a target binding site such as BINDING SITE I, BINDING SITE II or BINDING SITE III of FIG. 8. Table 4 illustrates the complementarity of the nucleotide sequences of LGP1 BINDING SITE, designated SEQ ID:18541, to the nucleotide sequence of GAM131 RNA, herein designated GAM RNA, also designated SEQ ID:313.

Another function of GAM131 is therefore inhibition of LGP1 (Accession NM_032484.2). Accordingly, utilities of GAM131 include diagnosis, prevention and treatment of diseases and clinical conditions associated with LGP1.

LHX6 (Accession NM_014368.1) is another GAM131 target gene, herein designated TARGET GENE. LHX6 BINDING SITE is a target binding site found in the 3' untranslated region of mRNA encoded by LHX6, corresponding to a target binding site such as BINDING SITE I, BINDING SITE II or BINDING SITE III of FIG. 8. Table 4 illustrates the complementarity of the nucleotide sequences of LHX6 BINDING SITE, designated SEQ ID:7257, to the nucleotide sequence of GAM131 RNA, herein designated GAM RNA, also designated SEQ ID:313.

Another function of GAM131 is therefore inhibition of LHX6 (Accession NM_014368.1). Accordingly, utilities of GAM131 include diagnosis, prevention and treatment of diseases and clinical conditions associated with LHX6.

LOC143162 (Accession) is another GAM131 target gene, herein designated TARGET GENE. LOC143162 BINDING SITE is a target binding site found in the 5' untranslated region of mRNA encoded by LOC143162, corresponding to a target binding site such as BINDING SITE I, BINDING SITE II or BINDING SITE III of FIG. 8. Table 4 illustrates the complementarity of the nucleotide sequences of LOC143162 BINDING SITE, designated SEQ ID:7765, to the nucleotide sequence of GAM131 RNA, herein designated GAM RNA, also designated SEQ ID:313.

Another function of GAM131 is therefore inhibition of LOC143162 (Accession). Accordingly, utilities of GAM131 include diagnosis, prevention and treatment of diseases and clinical conditions associated with LOC143162.

LOC145123 (Accession) is another GAM131 target gene, herein designated TARGET GENE. LOC145123 BINDING SITE is a target binding site found in the 3' untranslated region of mRNA encoded by LOC145123, corresponding to a target binding site such as BINDING SITE I, BINDING SITE II or BINDING SITE III of FIG. 8. Table 4 illustrates the complementarity of the nucleotide sequences of LOC145123 BINDING SITE, designated SEQ ID:15702, to the nucleotide sequence of GAM131 RNA, herein designated GAM RNA, also designated SEQ ID:313.

Another function of GAM131 is therefore inhibition of LOC145123 (Accession). Accordingly, utilities of GAM131 include diagnosis, prevention and treatment of diseases and clinical conditions associated with LOC145123.

LOC146990 (Accession XM_097149.2) is another GAM131 target gene, herein designated TARGET GENE. LOC146990 BINDING SITE is a target binding site found in the 5' untranslated region of mRNA encoded by LOC146990, corresponding to a target binding site such as BINDING SITE I, BINDING SITE II or BINDING SITE III of FIG. 8. Table 4 illustrates the complementarity of the nucleotide sequences of LOC146990 BINDING SITE, designated SEQ ID:17527, to the nucleotide sequence of GAM131 RNA, herein designated GAM RNA, also designated SEQ ID:313.

Another function of GAM131 is therefore inhibition of LOC146990 (Accession XM_097149.2). Accordingly, utilities of GAM131 include diagnosis, prevention and treatment of diseases and clinical conditions associated with LOC146990.

Prothymosin, alpha (gene sequence 28) (PTMA, Accession NM_002823.2) is another GAM131 target gene, herein designated TARGET GENE. PTMA BINDING SITE is a target binding site found in the 3' untranslated region of mRNA encoded by PTMA, corresponding to a target binding site such as BINDING SITE I, BINDING SITE II or BINDING SITE III of FIG. 8. Table 4 illustrates the complementarity of the nucleotide sequences of PTMA BINDING SITE, designated SEQ ID:19917, to the nucleotide sequence of GAM131 RNA, herein designated GAM RNA, also designated SEQ ID:313.

Another function of GAM131 is therefore inhibition of Prothymosin, alpha (gene sequence 28) (PTMA, Accession NM_002823.2), a gene which may mediate immune function by conferring resistance to certain opportunistic infections. Accordingly, utilities of GAM131 include diagnosis, prevention and treatment of diseases and clinical conditions associated with PTMA.

The function of PTMA has been established by previous studies. The thymus gland produces several hormones or hormone-like substances which are derived from a polypeptide precursor containing (in the rat) 113 amino acids and known as prothymosin-alpha. A peptide containing 28 amino acid residues, named thymosin-alpha-1, was originally isolated from calf thymosin fraction 5 and shown to restore various aspects of immune function in several in vitro and in vivo test systems. Thymosin-alpha-1 was subsequently isolated from a similar fraction from human thymosin and reported to have the same amino acid sequence as bovine thymosin-alpha-1. Haritos et al. (1984) isolated from fresh rat thymus a larger polypeptide named prothymosin-alpha, which contains the thymosin-alpha-1 sequence at its NH2 terminus. Prothymosin-alpha has also been isolated from human thymus. Goodall et al. (1986) constructed a cDNA library from human spleen mRNA and screened for clones containing cDNAs coding for prothymosin-alpha. Eschenfeldt and Berger (1986) identified cDNA clones for human prothymosin-alpha in cDNA libraries from staphylococcal endotoxin A-stimulated normal human lymphocytes. The encoded protein was found to be highly acidic (54 residues out of 111) and shared over 90% sequence homology with rat prothymosin-alpha. The peptide hormone thymosin-alpha-1 appeared at positions 2-29 of the prothymosin-alpha amino acid sequence. Manrow et al. (1992) concluded that of the 6 members of the prothymosin-alpha gene family that have been cloned and sequenced, only one is functional. Szabo et al. (1993) isolated a genomic clone encoding PTMA and subcloned and sequenced the 5-prime regulatory region. They used the 5-prime flanking cloned probe to localize the prothymosin gene to human chromosome 2 by Southern analysis of somatic cell hybrids.

Full details of the abovementioned studies are described in the following publications, the disclosure of which are hereby incorporated by reference:

Haritos, A. A.; Goodall, G. J.; Horecker, B. L.: Prothymosin alpha: isolation and properties of the major immunoreactive form of thymosin alpha-1 in rat thymus. Proc. Nat. Acad. Sci. 81:1008-1011, 1984; and Manrow, R. E.; Leone, A.; Krug, M. S.; Eschenfeldt, W. H.; Berger, S. L.: The human prothymosin alpha gene family contains several processed pseudogenes lacking deleterious lesions. Ge.

Further studies establishing the function and utilities of PTMA are found in John Hopkins OMIM database record ID 188390, and in cited publications listed in Table 5, which are hereby incorporated by reference. Transforming growth factor, alpha (TGFA, Accession NM_003236.1) is another GAM131 target gene, herein designated TARGET GENE. TGFA BINDING SITE is a target binding site found in the 3' untranslated region of mRNA encoded by TGFA, corresponding to a target binding site such as BINDING SITE I, BINDING SITE II or BINDING SITE III of FIG. 8. Table 4 illustrates the complementarity of the nucleotide sequences of TGFA BINDING SITE, designated SEQ ID:3907, to the nucleotide sequence of GAM131 RNA, herein designated GAM RNA, also designated SEQ ID:313.

Another function of GAM131 is therefore inhibition of Transforming growth factor, alpha (TGFA, Accession NM_003236.1), a gene which is able to bind to the egf receptor and to act synergistically with tgf beta to promote anchorage- independent cell proliferation in soft agar. Accordingly, utilities of GAM131 include diagnosis, prevention and treatment of diseases and clinical conditions associated with TGFA.

The function of TGFA and its association with various diseases and clinical conditions, has been established by previous studies, as described hereinabove with reference to GAM94.1.

FIG. 8 further provides a conceptual description of a novel bioinformatically detected of the present invention, referred to here as Genomic Address Messenger 132 (GAM132), which modulates expression of respective target genes thereof, the function and utility of which target genes is known in the art.

GAM132 is a novel bioinformatically detected regulatory, non protein coding, micro RNA (miRNA) gene. The method by which GAM132 was detected is described hereinabove with reference to FIGS. 8-15.

GAM132 gene, herein designated GAM GENE, and GAM132 target gene, herein designated TARGET GENE, are human genes contained in the human genome.

GAM132 gene encodes a GAM132 precursor RNA, herein designated GAM PRECURSOR RNA. Similar to other miRNA genes, and unlike most ordinary genes, GAM132 precursor RNA does not encode a protein. A nucleotide sequence identical or highly similar to the nucleotide sequence of GAM132 precursor RNA is designated SEQ ID:114, and is provided hereinbelow with reference to the sequence listing part.

GAM132 precursor RNA folds onto itself, forming GAM132 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM132 precursor RNA folds onto itself, forming GAM132 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM132 precursor RNA, designated SEQ-ID:114, and a schematic representation of a predicted secondary folding of GAM132 folded precursor RNA are further described with reference to Table 2, hereby incorporated by reference.

An enzyme complex designated DICER COMPLEX, 'dices' the GAM132 folded precursor RNA into GAM132 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM132 RNA is designated SEQ ID:369, and is provided hereinbelow with references to the sequence listing part and Table 3, hereby incorporated by reference.

GAM132 target gene, herein designated TARGET GENE, encodes a corresponding messenger RNA, GAM132 target RNA, herein designated GAM TARGET RNA. GAM132 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM132 RNA, herein designated GAM RNA, binds complementarily to one or more target binding sites located in untranslated regions of GAM132 target RNA, herein designated GAM TARGET RNA. This complementary binding is due to the fact that the nucleotide sequence of GAM132 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM132 RNA may have a different number of target binding sites in untranslated regions of a GAM132 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM132 RNA, herein designated GAM RNA, to target binding sites on GAM132 target RNA, herein designated GAM TARGET RNA, such as BINDING SITE I, BINDING SITE II and BINDING SITE III, inhibits translation of GAM132 target RNA into GAM132 target protein, herein designated GAM TARGET PROTEIN. GAM target protein is therefore outlined by a broken line.

It is appreciated that GAM132 target gene, herein designated TARGET GENE, in fact represents a plurality of GAM132 target genes. The mRNA of each one of this plurality of GAM132 target genes comprises one or more target binding sites, each having a nucleotide sequence which is at least partly complementary to GAM132 RNA, herein designated GAM RNA, and which when bound by GAM132 RNA causes inhibition of translation of respective one or more GAM132 target proteins.

It is further appreciated by one skilled in the art that the mode of translational inhibition illustrated by FIG. 8 with specific reference to translational inhibition exerted by GAM132 gene, herein designated GAM GENE, on one or more GAM132 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM132 correlate with, and may be deduced from, the identity of the target genes which GAM132 binds and inhibits, and the function of these target genes, as elaborated hereinbelow.

Chloride intracellular channel 5 (CLIC5, Accession NM_016929.1) is a GAM132 target gene, herein designated TARGET GENE. CLIC5 BINDING SITE is a target binding site found in the 3' untranslated region of mRNA encoded by CLIC5, corresponding to a target binding site such as BINDING SITE I, BINDING SITE II or BINDING SITE III of FIG. 8. Table 4 illustrates the complementarity of the nucleotide sequences of CLIC5 BINDING SITE, designated SEQ ID:17752, to the nucleotide sequence of GAM132 RNA, herein designated GAM RNA, also designated SEQ ID:369.

A function of GAM132 is therefore inhibition of Chloride intracellular channel 5 (CLIC5, Accession NM_016929.1). Accordingly, utilities of GAM132 include diagnosis, prevention and treatment of diseases and clinical conditions associated with CLIC5.

FLJ10377 (Accession NM_018077.1) is another GAM132 target gene, herein designated TARGET GENE. FLJ10377 BINDING SITE is a target binding site found in the 3' untranslated region of mRNA encoded by FLJ10377, corresponding to a target binding site such as BINDING SITE I, BINDING SITE II or BINDING SITE III of FIG. 8. Table 4 illustrates the complementarity of the nucleotide sequences of FLJ10377 BINDING SITE, designated SEQ ID:929, to the nucleotide sequence of GAM132 RNA, herein designated GAM RNA, also designated SEQ ID:369.

Another function of GAM132 is therefore inhibition of FLJ10377 (Accession NM_018077.1). Accordingly, utilities of GAM132 include diagnosis, prevention and treatment of diseases and clinical conditions associated with FLJ10377.

Paired box gene 2 (PAX2, Accession NM_003987.1) is another GAM132 target gene, herein designated TARGET GENE. PAX2 BINDING SITE is a target binding site found in the 3' untranslated region of multiple transcripts of mRNA encoded by PAX2, corresponding to a target binding site such as BINDING SITE I, BINDING SITE II or BINDING SITE III of FIG. 8. Table 4 illustrates the complementarity of the nucleotide sequences of PAX2 BINDING SITE, designated SEQ ID:16012, to the nucleotide sequence of GAM132 RNA, herein designated GAM RNA, also designated SEQ ID:369.

Another function of GAM132 is therefore inhibition of Paired box gene 2 (PAX2, Accession NM_003987.1), a gene which involves in kidney cell differentiation and therefore is associated with Renal-coloboma syndrome. Accordingly, utilities of GAM132 include diagnosis, prevention and treatment of Renal-coloboma syndrome, and of other diseases and clinical conditions associated with PAX2.

The function of PAX2 and its association with various diseases and clinical conditions, has been established by previous studies, as described hereinabove with reference to GAM47.1. Swi/snf related, matrix associated, actin dependent regulator of chromatin, subfamily e, member 1 (SMARCE1, Accession NM_003079.3) is another GAM132 target gene, herein designated TARGET GENE. SMARCE1 BINDING SITE is a target binding site found in the 3' untranslated region of mRNA encoded by SMARCE1, corresponding to a target binding site such as BINDING SITE I, BINDING SITE II or BINDING SITE III of FIG. 8. Table 4 illustrates the complementarity of the nucleotide sequences of SMARCE1 BINDING SITE, designated SEQ ID:3854, to the nucleotide sequence of GAM132 RNA, herein designated GAM RNA, also designated SEQ ID:369.

Another function of GAM132 is therefore inhibition of Swi/snf related, matrix associated, actin dependent regulator of chromatin, subfamily e, member 1 (SMARCE1, Accession NM_003079.3). Accordingly, utilities of GAM132 include diagnosis, prevention and treatment of diseases and clinical conditions associated with SMARCE1.

FIG. 8 further provides a conceptual description of a novel bioinformatically detected of the present invention, referred to here as Genomic Address Messenger 133 (GAM133), which modulates expression of respective target genes thereof, the function and utility of which target genes is known in the art.

GAM133 is a novel bioinformatically detected regulatory, non protein coding, micro RNA (miRNA) gene. The method by which GAM133 was detected is described hereinabove with reference to FIGS. 8-15.

GAM133 gene, herein designated GAM GENE, and GAM133 target gene, herein designated TARGET GENE, are human genes contained in the human genome.

GAM133 gene encodes a GAM133 precursor RNA, herein designated GAM PRECURSOR RNA. Similar to other miRNA genes, and unlike most ordinary genes, GAM133 precursor RNA does not encode a protein. A nucleotide sequence identical or highly similar to the nucleotide sequence of GAM133 precursor RNA is designated SEQ ID:88, and is provided hereinbelow with reference to the sequence listing part. Nucleotide sequence SEQ ID:88 is located at position 148414074 relative to chromosome 3.

GAM133 precursor RNA folds onto itself, forming GAM133 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM133 precursor RNA folds onto itself, forming GAM133 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM133 precursor RNA, designated SEQ-ID:88, and a schematic representation of a predicted secondary folding of GAM133 folded precursor RNA are further described with reference to Table 2, hereby incorporated by reference.

An enzyme complex designated DICER COMPLEX, 'dices' the GAM133 folded precursor RNA into GAM133 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM133 RNA is designated SEQ ID:211, and is provided hereinbelow with references to the sequence listing part and Table 3, hereby incorporated by reference.

GAM133 target gene, herein designated TARGET GENE, encodes a corresponding messenger RNA, GAM133 target RNA, herein designated GAM TARGET RNA. GAM133 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM133 RNA, herein designated GAM RNA, binds complementarily to one or more target binding sites located in untranslated regions of GAM133 target RNA, herein designated GAM TARGET RNA. This complementary binding is due to the fact that the nucleotide sequence of GAM133 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM133 RNA may have a different number of target binding sites in untranslated regions of a GAM133 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM133 RNA, herein designated GAM RNA, to target binding sites on GAM133 target RNA, herein designated GAM TARGET RNA, such as BINDING SITE I, BINDING SITE II and BINDING SITE III, inhibits translation of GAM133 target RNA into GAM133 target protein, herein designated GAM TARGET PROTEIN. GAM target protein is therefore outlined by a broken line.

It is appreciated that GAM133 target gene, herein designated TARGET GENE, in fact represents a plurality of GAM133 target genes. The mRNA of each one of this plurality of GAM133 target genes comprises one or more target binding sites, each having a nucleotide sequence which is at least partly complementary to GAM133 RNA, herein designated GAM RNA, and which when bound by GAM133 RNA causes inhibition of translation of respective one or more GAM133 target proteins.

It is further appreciated by one skilled in the art that the mode of translational inhibition illustrated by FIG. 8 with specific reference to translational inhibition exerted by GAM133 gene, herein designated GAM GENE, on one or more GAM133 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM133 correlate with, and may be deduced from, the identity of the target genes which GAM133 binds and inhibits, and the function of these target genes, as elaborated hereinbelow.

Afg3 atpase family gene 3-like 1 (yeast) (AFG3L1, Accession NP_001123.1) is a GAM133 target gene, herein designated TARGET GENE. AFG3L1 BINDING SITE is a target binding site found in the 3' untranslated region of mRNA encoded by AFG3L1, corresponding to a target binding site such as BINDING SITE I, BINDING SITE II or BINDING SITE III of FIG. 8. Table 4 illustrates the complementarity of the nucleotide sequences of AFG3L1 BINDING SITE, designated SEQ ID:18205, to the nucleotide sequence of GAM133 RNA, herein designated GAM RNA, also designated SEQ ID:211.

A function of GAM133 is therefore inhibition of Afg3 atpase family gene 3-like 1 (yeast) (AFG3L1, Accession NP_001123.1). Accordingly, utilities of GAM133 include diagnosis, prevention and treatment of diseases and clinical conditions associated with AFG3L1.

ARPP-21 (Accession NP_057384.1) is another GAM133 target gene, herein designated TARGET GENE. ARPP-21 BINDING SITE is a target binding site found in the 5' untranslated region of mRNA encoded by ARPP-21, corresponding to a target binding site such as BINDING SITE I, BINDING SITE II or BINDING SITE III of FIG. 8. Table 4 illustrates the complementarity of the nucleotide sequences of ARPP-21 BINDING SITE, designated SEQ ID:4699, to the nucleotide sequence of GAM133 RNA, herein designated GAM RNA, also designated SEQ ID:211.

Another function of GAM133 is therefore inhibition of ARPP-21 (Accession NP_057384.1). Accordingly, utilities of GAM133 include diagnosis, prevention and treatment of diseases and clinical conditions associated with ARPP-21.

Bcl2-like 2 (BCL2L2, Accession NP_004041.1) is another GAM133 target gene, herein designated TARGET GENE. BCL2L2 BINDING SITE is a target binding site found in the 3' untranslated region of mRNA encoded by BCL2L2, corresponding to a target binding site such as BINDING SITE I, BINDING SITE II or BINDING SITE III of FIG. 8. Table 4 illustrates the complementarity of the nucleotide sequences of BCL2L2 BINDING SITE, designated SEQ ID:19697, to the nucleotide sequence of GAM133 RNA, herein designated GAM RNA, also designated SEQ ID:211.

Another function of GAM133 is therefore inhibition of Bcl2-like 2 (BCL2L2, Accession NP_004041.1), a gene which promotes cell survival. Accordingly, utilities of GAM133 include diagnosis, prevention and treatment of diseases and clinical conditions associated with BCL2L2.

The function of BCL2L2 has been established by previous studies. Gibson et al. (1996) used degenerate PCR to clone a novel BCL2 homolog which they denoted BCLW. The gene encodes a 193-amino acid polypeptide. Gibson et al. (1996) also isolated the mouse BCLW gene; its amino acid sequence is 99% identical to that of the human gene. Mouse BCLW is expressed as a 3.7-kb mRNA in a variety of tissues, with highest expression in brain, colon, and salivary gland. In mouse hematopoietic cell lines, BCLW is expressed in myeloid cells and to a lesser extent in lymphoid cells. Like BCL2, expressed BCLW promotes cell survival under a variety of cytotoxic conditions. Gibson et al. (1996) used fluorescence in situ hybridization to map the BCLW gene to human chromosome 14q11.2-q12.

Animal model experiments lend further support to the function of BCL2L2. To identify genes required for mammalian spermatogenesis, Ross et al. (1998) screened lines of mutant mice created using a retroviral gene-trap system for male infertility. Homozygous ROSA41 male mice exhibited sterility associated with progressive testicular degeneration. Germ cell defects were first observed at 19 days postnatal. Spermatogenesis was blocked during late spermiogenesis in young adults. Gradual depletion of all stages of germ cells resulted in a Sertoli-cell-only phenotype by approximately 6 months of age. Subsequently, almost all Sertoli cells were lost from the seminiferous tubules, and the Leydig cell population was reduced. Molecular analysis indicated that the gene mutated in these mice is BCLW, a death-protecting member of the Bcl2 family. The mutant allele of Bclw in ROSA41 did not produce a Bclw polypeptide. Expression of Bclw in the testis appeared to be restricted to elongating spermatids and Sertoli cells.

It is appreciated that the abovementioned animal model for BCL2L2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gibson, L.; Holmgreen, S. P.; Huang, D. C. S.; Bernard, O.; Copeland, N. G.; Jenkins, N. A.; Sutherland, G. R.; Baker, E.; Adams, J. M.; Cory, S.: bcl-w, a novel member of the bcl-2 family, promotes cell survival. Oncogene 13:665-675, 1996; and Ross, A. J.; Waymire, K. G.; Moss, J. E.; Parlow, A. F.; Skinner, M. K.; Russell, L. D.; MacGregor, G. R.: Testicular degeneration in Bclw-deficient mice. Nature Genet. 18:251-256, 199.

Further studies establishing the function and utilities of BCL2L2 are found in John Hopkins OMIM database record ID 601931, and in cited publications listed in Table 5, which are hereby incorporated by reference. Chromosome 5 open reading frame 7 (C5orf7, Accession NP_057688.1) is another GAM133 target gene, herein designated TARGET GENE. C5orf7 BINDING SITE is a target binding site found in the 3' untranslated region of mRNA encoded by C5orf7, corresponding to a target binding site such as BINDING SITE I, BINDING SITE II or BINDING SITE III of FIG. 8. Table 4 illustrates the complementarity of the nucleotide sequences of C5orf7 BINDING SITE, designated SEQ ID:10526, to the nucleotide sequence of GAM133 RNA, herein designated GAM RNA, also designated SEQ ID:211.

Another function of GAM133 is therefore inhibition of Chromosome 5 open reading frame 7 (C5orf7, Accession NP_057688.1). Accordingly, utilities of GAM133 include diagnosis, prevention and treatment of diseases and clinical conditions associated with C5orf7.

CD109 (Accession NP_598000.1) is another GAM133 target gene, herein designated TARGET GENE. CD109 BINDING SITE is a target binding site found in the 3' untranslated region of mRNA encoded by CD109, corresponding to a target binding site such as BINDING SITE I, BINDING SITE II or BINDING SITE III of FIG. 8. Table 4 illustrates the complementarity of the nucleotide sequences of CD109 BINDING SITE, designated SEQ ID:15628, to the nucleotide sequence of GAM133 RNA, herein designated GAM RNA, also designated SEQ ID:211.

Another function of GAM133 is therefore inhibition of CD109 (Accession NP_598000.1). Accordingly, utilities of GAM133 include diagnosis, prevention and treatment of diseases and clinical conditions associated with CD109.

Cd72 antigen (CD72, Accession NP_001773.1) is another GAM133 target gene, herein designated TARGET GENE. CD72 BINDING SITE is a target binding site found in the 3' untranslated region of mRNA encoded by CD72, corresponding to a target binding site such as BINDING SITE I, BINDING SITE II or BINDING SITE III of FIG. 8. Table 4 illustrates the complementarity of the nucleotide sequences of CD72 BINDING SITE, designated SEQ ID:3671, to the nucleotide sequence of GAM133 RNA, herein designated GAM RNA, also designated SEQ ID:211.

Another function of GAM133 is therefore inhibition of Cd72 antigen (CD72, Accession NP_001773.1), a gene which may be involved in signals for B-cell proliferation. Accordingly, utilities of GAM133 include diagnosis, prevention and treatment of diseases and clinical conditions associated with CD72.

The function of CD72 has been established by previous studies. By means of monoclonal antibodies, Von Hoegen et al. (1991) demonstrated identity of CD72 to the human homolog of mouse Lyb2 and localized the gene to the short arm of human chromosome 9 by study of mouse/human somatic cell hybrids. The mouse Lyb2 gene had previously been mapped to chromosome 4. Expression of Lyb2 is restricted to B-lineage cells and is turned off in antibody-secreting plasma cells in both mice and humans. The protein may be involved in signals for B-cell proliferation. In a review of immune inhibitory receptors, Ravetch and Lanier (2000) pointed out that autoimmune disorders may result from the disruption of inhibitory receptors, particularly in their conserved intracellular immunoreceptor tyrosine-based inhibitory motifs (ITIMs). ITIMs are sites for alternative phosphorylation, typically by a Src kinase, and dephosphorylation, either by the tyrosine phosphatase SHP1 (OMIM Ref. No. 176883) or the inositol phosphatase SHIP (OMIM Ref. No. 601582), transducing signals to distinct pathways. B cells from CD72-deficient mice are hyperresponsive to lipopolysaccharide stimulation and B cell receptor aggregation Animal model experiments lend further support to the function of CD72. Using a mouse model, Kumanogoh et al. (2000) determined that the CD100 (SEMA4D; 601866) receptor plexin B1 (PLXNB1; 601053) is not detectable in lymphocytes, and that in the immune system, CD72 appears to be the receptor for CD100.

It is appreciated that the abovementioned animal model for CD72 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Von Hoegen, I.; Hsieh, C.-L.; Scharting, R.; Francke, U.; Parnes, J. R.: Identity of human Lyb-2 and CD72 and localization of the gene to chromosome 9. Europ. J. Immun. 21:1425-1431, 1991; and Ravetch, J. V.; Lanier, L. L.: Immune inhibitory receptors. Science 290:84-89, 2000.

Further studies establishing the function and utilities of CD72 are found in John Hopkins OMIM database record ID 107272, and in cited publications listed in Table 5, which are hereby incorporated by reference. CGI-69 (Accession NP_057100.1) is another GAM133 target gene, herein designated TARGET GENE. CGI-69 BINDING SITE is a target binding site found in the 5' untranslated region of mRNA encoded by CGI-69, corresponding to a target binding site such as BINDING SITE I, BINDING SITE II or BINDING SITE III of FIG. 8. Table 4 illustrates the complementarity of the nucleotide sequences of CGI-69 BINDING SITE, designated SEQ ID:11572, to the nucleotide sequence of GAM133 RNA, herein designated GAM RNA, also designated SEQ ID:211.

Another function of GAM133 is therefore inhibition of CGI-69 (Accession NP_057100.1). Accordingly, utilities of GAM133 include diagnosis, prevention and treatment of diseases and clinical conditions associated with CGI-69.

CYP24A1 (Accession NP_000773.1) is another GAM133 target gene, herein designated TARGET GENE. CYP24A1 BINDING SITE is a target binding site found in the 5' untranslated region of mRNA encoded by CYP24A1, corresponding to a target binding site such as BINDING SITE I, BINDING SITE II or BINDING SITE III of FIG. 8. Table 4 illustrates the complementarity of the nucleotide sequences of CYP24A1 BINDING SITE, designated SEQ ID:6890, to the nucleotide sequence of GAM133 RNA, herein designated GAM RNA, also designated SEQ ID:211.

Another function of GAM133 is therefore inhibition of CYP24A1 (Accession NP_000773.1). Accordingly, utilities of GAM133 include diagnosis, prevention and treatment of diseases and clinical conditions associated with CYP24A1.

DKFZp434F1719 (Accession NP_115624.1) is another GAM133 target gene, herein designated TARGET GENE. DKFZp434F1719 BINDING SITE is a target binding site found in the 3' untranslated region of mRNA encoded by DKFZp434F1719, corresponding to a target binding site such as BINDING SITE I, BINDING SITE II or BINDING SITE III of FIG. 8. Table 4 illustrates the complementarity of the nucleotide sequences of DKFZp434F1719 BINDING SITE, designated SEQ ID:11319, to the nucleotide sequence of GAM133 RNA, herein designated GAM RNA, also designated SEQ ID:211.

Another function of GAM133 is therefore inhibition of DKFZp434F1719 (Accession NP_115624.1). Accordingly, utilities of GAM133 include diagnosis, prevention and treatment of diseases and clinical conditions associated with DKFZp434F1719.

DKFZp667M2411 (Accession XP_290795.1) is another GAM133 target gene, herein designated TARGET GENE. DKFZp667M2411 BINDING SITE is a target binding site found in the 5' untranslated region of mRNA encoded by DKFZp667M2411, corresponding to a target binding site such as BINDING SITE I, BINDING SITE II or BINDING SITE III of FIG. 8. Table 4 illustrates the complementarity of the nucleotide sequences of DKFZp667M2411 BINDING SITE, designated SEQ ID:10447, to the nucleotide sequence of GAM133 RNA, herein designated GAM RNA, also designated SEQ ID:211.

Another function of GAM133 is therefore inhibition of DKFZp667M2411 (Accession XP_290795.1). Accordingly, utilities of GAM133 include diagnosis, prevention and treatment of diseases and clinical conditions associated with DKFZp667M2411.

DKFZp761H2121 (Accession NP_612212.1) is another GAM133 target gene, herein designated TARGET GENE. DKFZp761H2121 BINDING SITE is a target binding site found in the 5' untranslated region of mRNA encoded by DKFZp761H2121, corresponding to a target binding site such as BINDING SITE I, BINDING SITE II or BINDING SITE III of FIG. 8. Table 4 illustrates the complementarity of the nucleotide sequences of DKFZp761H2121 BINDING SITE, designated SEQ ID:9664, to the nucleotide sequence of GAM133 RNA, herein designated GAM RNA, also designated SEQ ID:211.

Another function of GAM133 is therefore inhibition of DKFZp761H2121 (Accession NP_612212.1). Accordingly, utilities of GAM133 include diagnosis, prevention and treatment of diseases and clinical conditions associated with DKFZp761H2121.

DKFZp761L1417 (Accession NP_690877.1) is another GAM133 target gene, herein designated TARGET GENE. DKFZp761L1417 BINDING SITE is a target binding site found in the 3' untranslated region of mRNA encoded by DKFZp761L1417, corresponding to a target binding site such as BINDING SITE I, BINDING SITE II or BINDING SITE III of FIG. 8. Table 4 illustrates the complementarity of the nucleotide sequences of DKFZp761L1417 BINDING SITE, designated SEQ ID:2227, to the nucleotide sequence of GAM133 RNA, herein designated GAM RNA, also designated SEQ ID:211.

Another function of GAM133 is therefore inhibition of DKFZp761L1417 (Accession NP_690877.1). Accordingly, utilities of GAM133 include diagnosis, prevention and treatment of diseases and clinical conditions associated with DKFZp761L1417.

Epiregulin (EREG, Accession NP_001423.1) is another GAM133 target gene, herein designated TARGET GENE. EREG BINDING SITE is a target binding site found in the 3' untranslated region of mRNA encoded by EREG, corresponding to a target binding site such as BINDING SITE I, BINDING SITE II or BINDING SITE III of FIG. 8. Table 4 illustrates the complementarity of the nucleotide sequences of EREG BINDING SITE, designated SEQ ID:11651, to the nucleotide sequence of GAM133 RNA, herein designated GAM RNA, also designated SEQ ID:211.

Another function of GAM133 is therefore inhibition of Epiregulin (EREG, Accession NP_001423.1). Accordingly, utilities of GAM133 include diagnosis, prevention and treatment of diseases and clinical conditions associated with EREG.

EXO70 (Accession NP_056034.1) is another GAM133 target gene, herein designated TARGET GENE. EXO70 BINDING SITE is a target binding site found in the 3' untranslated region of mRNA encoded by EXO70, corresponding to a target binding site such as BINDING SITE I, BINDING SITE II or BINDING SITE III of FIG. 8. Table 4 illustrates the complementarity of the nucleotide sequences of EXO70 BINDING SITE, designated SEQ ID:4489, to the nucleotide sequence of GAM133 RNA, herein designated GAM RNA, also designated SEQ ID:211.

Another function of GAM133 is therefore inhibition of EXO70 (Accession NP_056034.1). Accordingly, utilities of GAM133 include diagnosis, prevention and treatment of diseases and clinical conditions associated with EXO70.

Fat tumor suppressor homolog 2 (drosophila) (FAT2, Accession NP_001438.1) is another GAM133 target gene, herein designated TARGET GENE. FAT2 BINDING SITE is a target binding site found in the 3' untranslated region of mRNA encoded by FAT2, corresponding to a target binding site such as BINDING SITE I, BINDING SITE II or BINDING SITE III of FIG. 8. Table 4 illustrates the complementarity of the nucleotide sequences of FAT2 BINDING SITE, designated SEQ ID:12813, to the nucleotide sequence of GAM133 RNA, herein designated GAM RNA, also designated SEQ ID:211.

Another function of GAM133 is therefore inhibition of Fat tumor suppressor homolog 2 (drosophila) (FAT2, Accession NP_001438.1), a gene which could function as a cell-adhesion protein. Accordingly, utilities of GAM133 include diagnosis, prevention and treatment of diseases and clinical conditions associated with FAT2.

The function of FAT2 and its association with various diseases and clinical conditions, has been established by previous studies, as described hereinabove with reference to GAM99.1. Fk506 binding protein like (FKBPL, Accession NP_071393.2) is another GAM133 target gene, herein designated TARGET GENE. FKBPL BINDING SITE is a target binding site found in the 5' untranslated region of mRNA encoded by FKBPL, corresponding to a target binding site such as BINDING SITE I, BINDING SITE II or BINDING SITE III of FIG. 8. Table 4 illustrates the complementarity of the nucleotide sequences of FKBPL BINDING SITE, designated SEQ ID:12297, to the nucleotide sequence of GAM133 RNA, herein designated GAM RNA, also designated SEQ ID:211.

Another function of GAM133 is therefore inhibition of Fk506 binding protein like (FKBPL, Accession NP_071393.2). Accordingly, utilities of GAM133 include diagnosis, prevention and treatment of diseases and clinical conditions associated with FKBPL.

FLJ10120 (Accession NP_060471.1) is another GAM133 target gene, herein designated TARGET GENE. FLJ10120

BINDING SITE is a target binding site found in the 3' untranslated region of mRNA encoded by FLJ10120, corresponding to a target binding site such as BINDING SITE I, BINDING SITE II or BINDING SITE III of FIG. 8. Table 4 illustrates the complementarity of the nucleotide sequences of FLJ10120 BINDING SITE, designated SEQ ID:10447, to the nucleotide sequence of GAM133 RNA, herein designated GAM RNA, also designated SEQ ID:211.

Another function of GAM133 is therefore inhibition of FLJ10120 (Accession NP_060471.1). Accordingly, utilities of GAM133 include diagnosis, prevention and treatment of diseases and clinical conditions associated with FLJ10120.

FLJ10159 (Accession NP_060483.1) is another GAM133 target gene, herein designated TARGET GENE. FLJ10159 BINDING SITE is a target binding site found in the 3' untranslated region of mRNA encoded by FLJ10159, corresponding to a target binding site such as BINDING SITE I, BINDING SITE II or BINDING SITE III of FIG. 8. Table 4 illustrates the complementarity of the nucleotide sequences of FLJ10159 BINDING SITE, designated SEQ ID:2393, to the nucleotide sequence of GAM133 RNA, herein designated GAM RNA, also designated SEQ ID:211.

Another function of GAM133 is therefore inhibition of FLJ10159 (Accession NP_060483.1). Accordingly, utilities of GAM133 include diagnosis, prevention and treatment of diseases and clinical conditions associated with FLJ10159.

FLJ12541 (Accession NP_071764.2) is another GAM133 target gene, herein designated TARGET GENE. FLJ12541 BINDING SITE is a target binding site found in the 3' untranslated region of mRNA encoded by FLJ12541, corresponding to a target binding site such as BINDING SITE I, BINDING SITE II or BINDING SITE III of FIG. 8. Table 4 illustrates the complementarity of the nucleotide sequences of FLJ12541 BINDING SITE, designated SEQ ID:2066, to the nucleotide sequence of GAM133 RNA, herein designated GAM RNA, also designated SEQ ID:211.

Another function of GAM133 is therefore inhibition of FLJ12541 (Accession NP_071764.2). Accordingly, utilities of GAM133 include diagnosis, prevention and treatment of diseases and clinical conditions associated with FLJ12541.

FLJ12644 (Accession NP_075562.2) is another GAM133 target gene, herein designated TARGET GENE. FLJ12644 BINDING SITE is a target binding site found in the 5' untranslated region of mRNA encoded by FLJ12644, corresponding to a target binding site such as BINDING SITE I, BINDING SITE II or BINDING SITE III of FIG. 8. Table 4 illustrates the complementarity of the nucleotide sequences of FLJ12644 BINDING SITE, designated SEQ ID:7228, to the nucleotide sequence of GAM133 RNA, herein designated GAM RNA, also designated SEQ ID:211.

Another function of GAM133 is therefore inhibition of FLJ12644 (Accession NP_075562.2). Accordingly, utilities of GAM133 include diagnosis, prevention and treatment of diseases and clinical conditions associated with FLJ12644.

FLJ12750 (Accession NP_078943.1) is another GAM133 target gene, herein designated TARGET GENE. FLJ12750 BINDING SITE is a target binding site found in the 3' untranslated region of mRNA encoded by FLJ12750, corresponding to a target binding site such as BINDING SITE I, BINDING SITE II or BINDING SITE III of FIG. 8. Table 4 illustrates the complementarity of the nucleotide sequences of FLJ12750 BINDING SITE, designated SEQ ID:3004, to the nucleotide sequence of GAM133 RNA, herein designated GAM RNA, also designated SEQ ID:211.

Another function of GAM133 is therefore inhibition of FLJ12750 (Accession NP_078943.1). Accordingly, utilities of GAM133 include diagnosis, prevention and treatment of diseases and clinical conditions associated with FLJ12750.

FLJ20281 (Accession NP_060212.1) is another GAM133 target gene, herein designated TARGET GENE. FLJ20281 BINDING SITE is a target binding site found in the 3' untranslated region of multiple transcripts of mRNA encoded by FLJ20281, corresponding to a target binding site such as BINDING SITE I, BINDING SITE II or BINDING SITE III of FIG. 8. Table 4 illustrates the complementarity of the nucleotide sequences of FLJ20281 BINDING SITE, designated SEQ ID:5478, to the nucleotide sequence of GAM133 RNA, herein designated GAM RNA, also designated SEQ ID:211.

Another function of GAM133 is therefore inhibition of FLJ20281 (Accession NP_060212.1). Accordingly, utilities of GAM133 include diagnosis, prevention and treatment of diseases and clinical conditions associated with FLJ20281.

FLJ20716 (Accession NP_060408.2) is another GAM133 target gene, herein designated TARGET GENE. FLJ20716 BINDING SITE is a target binding site found in the 3' untranslated region of mRNA encoded by FLJ20716, corresponding to a target binding site such as BINDING SITE I, BINDING SITE II or BINDING SITE III of FIG. 8. Table 4 illustrates the complementarity of the nucleotide sequences of FLJ20716 BINDING SITE, designated SEQ ID:13390, to the nucleotide sequence of GAM133 RNA, herein designated GAM RNA, also designated SEQ ID:211.

Another function of GAM133 is therefore inhibition of FLJ20716 (Accession NP_060408.2). Accordingly, utilities of GAM133 include diagnosis, prevention and treatment of diseases and clinical conditions associated with FLJ20716.

FLJ21673 (Accession NP_112160.1) is another GAM133 target gene, herein designated TARGET GENE. FLJ21673 BINDING SITE is a target binding site found in the 5' untranslated region of mRNA encoded by FLJ21673, corresponding to a target binding site such as BINDING SITE I, BINDING SITE II or BINDING SITE III of FIG. 8. Table 4 illustrates the complementarity of the nucleotide sequences of FLJ21673 BINDING SITE, designated SEQ ID:18661, to the nucleotide sequence of GAM133 RNA, herein designated GAM RNA, also designated SEQ ID:211.

Another function of GAM133 is therefore inhibition of FLJ21673 (Accession NP_112160.1). Accordingly, utilities of GAM133 include diagnosis, prevention and treatment of diseases and clinical conditions associated with FLJ21673.

FLJ25067 (Accession NP_689717.2) is another GAM133 target gene, herein designated TARGET GENE. FLJ25067 BINDING SITE is a target binding site found in the 3' untranslated region of mRNA encoded by FLJ25067, corresponding to a target binding site such as BINDING SITE I, BINDING SITE II or BINDING SITE III of FIG. 8. Table 4 illustrates the complementarity of the nucleotide sequences of FLJ25067 BINDING SITE, designated SEQ ID:8347, to the nucleotide sequence of GAM133 RNA, herein designated GAM RNA, also designated SEQ ID:211.

Another function of GAM133 is therefore inhibition of FLJ25067 (Accession NP_689717.2). Accordingly, utilities of GAM133 include diagnosis, prevention and treatment of diseases and clinical conditions associated with FLJ25067.

FLJ31166 (Accession NP_694567.1) is another GAM133 target gene, herein designated TARGET GENE. FLJ31166 BINDING SITE is a target binding site found in the 5' untranslated region of mRNA encoded by FLJ31166, corresponding to a target binding site such as BINDING SITE I, BINDING SITE II or BINDING SITE III of FIG. 8. Table 4 illustrates the complementarity of the nucleotide sequences of FLJ31166 BINDING SITE, designated SEQ ID:2122, to the nucleotide sequence of GAM133 RNA, herein designated GAM RNA, also designated SEQ ID:211.

Another function of GAM133 is therefore inhibition of FLJ31166 (Accession NP_694567.1). Accordingly, utilities of GAM133 include diagnosis, prevention and treatment of diseases and clinical conditions associated with FLJ31166.

FLJ32069 (Accession NP_694578.1) is another GAM133 target gene, herein designated TARGET GENE. FLJ32069 BINDING SITE is a target binding site found in the 5' untranslated region of mRNA encoded by FLJ32069, corresponding to a target binding site such as BINDING SITE I, BINDING SITE II or BINDING SITE III of FIG. 8. Table 4 illustrates the complementarity of the nucleotide sequences of FLJ32069 BINDING SITE, designated SEQ ID:7828, to the nucleotide sequence of GAM133 RNA, herein designated GAM RNA, also designated SEQ ID:211.

Another function of GAM133 is therefore inhibition of FLJ32069 (Accession NP_694578.1). Accordingly, utilities of GAM133 include diagnosis, prevention and treatment of diseases and clinical conditions associated with FLJ32069.

FLJ32919 (Accession NP_653189.2) is another GAM133 target gene, herein designated TARGET GENE. FLJ32919 BINDING SITE is a target binding site found in the 5' untranslated region of mRNA encoded by FLJ32919, corresponding to a target binding site such as BINDING SITE I, BINDING SITE II or BINDING SITE III of FIG. 8. Table 4 illustrates the complementarity of the nucleotide sequences of FLJ32919 BINDING SITE, designated SEQ ID:1007, to the nucleotide sequence of GAM133 RNA, herein designated GAM RNA, also designated SEQ ID:211.

Another function of GAM133 is therefore inhibition of FLJ32919 (Accession NP_653189.2). Accordingly, utilities of GAM133 include diagnosis, prevention and treatment of diseases and clinical conditions associated with FLJ32919.

Fucosyltransferase 1 (galactoside 2-alpha-l-fucosyltransferase, bombay phenotype included) (FUT1, Accession NP_000139.1) is another GAM133 target gene, herein designated TARGET GENE. FUT1 BINDING SITE is a target binding site found in the 3' untranslated region of mRNA encoded by FUT1, corresponding to a target binding site such as BINDING SITE I, BINDING SITE II or BINDING SITE III of FIG. 8. Table 4 illustrates the complementarity of the nucleotide sequences of FUT1 BINDING SITE, designated SEQ ID:5184, to the nucleotide sequence of GAM133 RNA, herein designated GAM RNA, also designated SEQ ID:211.

Another function of GAM133 is therefore inhibition of Fucosyltransferase 1 (galactoside 2-alpha-l-fucosyltransferase, bombay phenotype included) (FUT1, Accession NP_000139.1). Accordingly, utilities of GAM133 include diagnosis, prevention and treatment of diseases and clinical conditions associated with FUT1.

Udp-n-acetyl-alpha-d-galactosamine:polypeptide n-acetylgalactosaminyltransferase 10 (galnac-t10) (GALNT10, Accession NP_060010.2) is another GAM133 target gene, herein designated TARGET GENE. GALNT10 BINDING SITE is a target binding site found in the 3' untranslated region of mRNA encoded by GALNT10, corresponding to a target binding site such as BINDING SITE I, BINDING SITE II or BINDING SITE III of FIG. 8. Table 4 illustrates the complementarity of the nucleotide sequences of GALNT10 BINDING SITE, designated SEQ ID:16339, to the nucleotide sequence of GAM133 RNA, herein designated GAM RNA, also designated SEQ ID:211.

Another function of GAM133 is therefore inhibition of Udp-n-acetyl-alpha-d-galactosamine:polypeptide n-acetylgalactosaminyltransferase 10 (galnac-t10) (GALNT10, Accession NP_060010.2). Accordingly, utilities of GAM133 include diagnosis, prevention and treatment of diseases and clinical conditions associated with GALNT10.

Guanine nucleotide binding protein (g protein), gamma 11 (GNG11, Accession NP_004117.1) is another GAM133 target gene, herein designated TARGET GENE. GNG11 BINDING SITE is a target binding site found in the 5' untranslated region of mRNA encoded by GNG11, corresponding to a target binding site such as BINDING SITE I, BINDING SITE II or BINDING SITE III of FIG. 8. Table 4 illustrates the complementarity of the nucleotide sequences of GNG11 BINDING SITE, designated SEQ ID:1974, to the nucleotide sequence of GAM133 RNA, herein designated GAM RNA, also designated SEQ ID:211.

Another function of GAM133 is therefore inhibition of Guanine nucleotide binding protein (g protein), gamma 11 (GNG11, Accession NP_004117.1). Accordingly, utilities of GAM133 include diagnosis, prevention and treatment of diseases and clinical conditions associated with GNG11.

HEMK (Accession NP_057257.1) is another GAM133 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:2688, to the nucleotide sequence of GAM133 RNA, herein designated GAM RNA, also designated SEQ ID:211.

Another function of GAM133 is therefore inhibition of HEMK (Accession NP_057257.1). Accordingly, utilities of GAM133 include diagnosis, prevention and treatment of diseases and clinical conditions associated with HEMK.

Homeo box c8 (HOXC8, Accession NP_073149.1) is another GAM133 target gene, herein designated TARGET GENE. HOXC8 BINDING SITE is a target binding site found in the 5' untranslated region of mRNA encoded by HOXC8, corresponding to a target binding site such as BINDING SITE I, BINDING SITE II or BINDING SITE III of FIG. 8. Table 4 illustrates the complementarity of the nucleotide sequences of HOXC8 BINDING SITE, designated SEQ ID:15450, to the nucleotide sequence of GAM133 RNA, herein designated GAM RNA, also designated SEQ ID:211.

Another function of GAM133 is therefore inhibition of Homeo box c8 (HOXC8, Accession NP_073149.1), a gene which is part of a developmental regulatory system . Accordingly, utilities of GAM133 include diagnosis, prevention and treatment of diseases and clinical conditions associated with HOXC8.

The function of HOXC8 has been established by previous studies. reviewed by Acampora et al. (1989), the homeo box region 3, which maps to 12q12-q13, contains at least 7 homeo boxes in 160 kb of DNA. HOX3A is homologous to mouse Hox-3.1; HOX3B to mouse Hox-3.2; HOX3C to mouse Hox-6.1, and HOX3D to mouse Hox-6.2. The order of genes, from 5-prime to 3-prime, is HOX3G, HOX3F, HOX3B, HOX3A, HOX3C, HOX3D, HOX3E (Acampora et al., 1989). Masuda et al. (1991) mapped the feline equivalent to chromosome B4, which shares syntenic homology with human chromosome 12 and mouse chromosome 15. This gene is also called HOXC8; see HOXC9 (OMIM Ref. No. 142971). Yueh et al. (1998) showed that overexpression of a Hoxc8 transgene causes cartilage defects whose severity depends on transgene dosage. The abnormal cartilage is characterized by an accumulation of proliferating chondrocytes and reduced maturation. Since Hoxc8 is normally expressed in chondrocytes, these results suggested that Hoxc8 continues to regulate skeletal development well beyond pattern formation in a tissue-specific manner, presumably by controlling the progression of cells along the chondrocyte differentiation pathway. They found that Hoxd4 and Hoxc8 appear to act on chondrocyte differentiation in a similar manner. The protein sequences of the 2 share 67% identity within the homeodomain and 50% in the hexapeptide motif but little similarity in the remaining 70% of the molecules. Isl1, which shares no significant sequence similarities with Hoxc8 or Hoxd4, is not associated with abnormalities of skeletal development, implying that the cartilage abnormalities are specifically induced by HOX genes. The capacity of the HOX genes to regulate cartilage differentiation suggests that they may be involved in human chondrodysplasias or other cartilage disorders.

Full details of the abovementioned studies are described in the following publications, the disclosure of which are hereby incorporated by reference:

Masuda, R.; Yuhki, N.; O'Brien, S. J.: Molecular cloning, chromosomal assignment, and nucleotide sequence of the feline homeobox HOX3A. Genomics 11:1007-1013, 1991; and Rabin, M.; Ferguson-Smith, A.; Hart, C. P.; Ruddle, F. H.: Cognate homeo-box loci mapped on homologous human and mouse chromosomes. Proc. Nat. Acad. Sci. 83:9104-9108, 1986.

Further studies establishing the function and utilities of HOXC8 are found in John Hopkins OMIM database record ID 142970, and in cited publications listed in Table 5, which are hereby incorporated by reference. Interferon regulatory factor 7 (IRF7, Accession NP_004021.1) is another GAM133 target gene, herein designated TARGET GENE. IRF7 BINDING SITE1 and IRF7 BINDING SITE2 are target binding sites found in untranslated regions of multiple transcripts of mRNA encoded by IRF7, corresponding to target binding sites such as BINDING SITE I, BINDING SITE II or BINDING SITE III of FIG. 8. Table 4 illustrates the complementarity of the nucleotide sequences of IRF7 BINDING SITE1 and IRF7 BINDING SITE2, designated SEQ ID:2970 and SEQ ID:19298 respectively, to the nucleotide sequence of GAM133 RNA, herein designated GAM RNA, also designated SEQ ID:211.

Another function of GAM133 is therefore inhibition of Interferon regulatory factor 7 (IRF7, Accession NP_004021.1). Accordingly, utilities of GAM133 include diagnosis, prevention and treatment of diseases and clinical conditions associated with IRF7.

KIAA0090 (Accession NP_055862.1) is another GAM133 target gene, herein designated TARGET GENE. KIAA0090 BINDING SITE is a target binding site found in the 3' untranslated region of mRNA encoded by KIAA0090, corresponding to a target binding site such as BINDING SITE I, BINDING SITE II or BINDING SITE III of FIG. 8. Table 4 illustrates the complementarity of the nucleotide sequences of KIAA0090 BINDING SITE, designated SEQ ID:9336, to the nucleotide sequence of GAM133 RNA, herein designated GAM RNA, also designated SEQ ID:211.

Another function of GAM133 is therefore inhibition of KIAA0090 (Accession NP_055862.1). Accordingly, utilities of GAM133 include diagnosis, prevention and treatment of diseases and clinical conditions associated with KIAA0090.

KIAA0931 (Accession XP_041191.2) is another GAM133 target gene, herein designated TARGET GENE. KIAA0931 BINDING SITE is a target binding site found in the 3' untranslated region of mRNA encoded by KIAA0931, corresponding to a target binding site such as BINDING SITE I, BINDING SITE II or BINDING SITE III of FIG. 8. Table 4 illustrates the complementarity of the nucleotide sequences of KIAA0931 BINDING SITE, designated SEQ ID:11269, to the nucleotide sequence of GAM133 RNA, herein designated GAM RNA, also designated SEQ ID:211.

Another function of GAM133 is therefore inhibition of KIAA0931 (Accession XP_041191.2). Accordingly, utilities of GAM133 include diagnosis, prevention and treatment of diseases and clinical conditions associated with KIAA0931.

KIAA1600 (Accession XP_049351.2) is another GAM133 target gene, herein designated TARGET GENE. KIAA1600 BINDING SITE is a target binding site found in the 3' untranslated region of mRNA encoded by KIAA1600, corresponding to a target binding site such as BINDING SITE I, BINDING SITE II or BINDING SITE III of FIG. 8. Table 4 illustrates the complementarity of the nucleotide sequences of KIAA1600 BINDING SITE, designated SEQ ID:6810, to the nucleotide sequence of GAM133 RNA, herein designated GAM RNA, also designated SEQ ID:211.

Another function of GAM133 is therefore inhibition of KIAA1600 (Accession XP_049351.2). Accordingly, utilities of GAM133 include diagnosis, prevention and treatment of diseases and clinical conditions associated with KIAA1600.

LNK (Accession NP_005466.1) is another GAM133 target gene, herein designated TARGET GENE. LNK BINDING SITE is a target binding site found in the 3' untranslated region of mRNA encoded by LNK, corresponding to a target binding site such as BINDING SITE I, BINDING SITE II or BINDING SITE III of FIG. 8. Table 4 illustrates the complementarity of the nucleotide sequences of LNK BINDING SITE, designated SEQ ID:15247, to the nucleotide sequence of GAM133 RNA, herein designated GAM RNA, also designated SEQ ID:211.

Another function of GAM133 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM133 include diagnosis, prevention and treatment of diseases and clinical conditions associated with LNK.

The function of LNK and its association with various diseases and clinical conditions, has been established by previous studies, as described hereinabove with reference to GAM130.1. LOC130813 (Accession XP_065904.1) is another GAM133 target gene, herein designated TARGET GENE. LOC130813 BINDING SITE is a target binding site found in the 3' untranslated region of mRNA encoded by LOC130813, corresponding to a target binding site such as BINDING SITE I, BINDING SITE II or BINDING SITE III of FIG. 8. Table 4 illustrates the complementarity of the nucleotide sequences of LOC130813 BINDING SITE, designated SEQ ID:11094, to the nucleotide sequence of GAM133 RNA, herein designated GAM RNA, also designated SEQ ID:211.

Another function of GAM133 is therefore inhibition of LOC130813 (Accession XP_065904.1). Accordingly, utilities of GAM133 include diagnosis, prevention and treatment of diseases and clinical conditions associated with LOC130813.

LOC147080 (Accession XP_097182.1) is another GAM133 target gene, herein designated TARGET GENE. LOC147080 BINDING SITE is a target binding site found in the 3' untranslated region of mRNA encoded by LOC147080, corresponding to a target binding site such as BINDING SITE I, BINDING SITE II or BINDING SITE III of FIG. 8. Table 4 illustrates the complementarity of the nucleotide sequences of LOC147080 BINDING SITE, designated SEQ ID:18953, to the nucleotide sequence of GAM133 RNA, herein designated GAM RNA, also designated SEQ ID:211.

Another function of GAM133 is therefore inhibition of LOC147080 (Accession XP_097182.1). Accordingly, utilities of GAM133 include diagnosis, prevention and treatment of diseases and clinical conditions associated with LOC147080.

LOC150157 (Accession XP_097823.1) is another GAM133 target gene, herein designated TARGET GENE. LOC150157 BINDING SITE is a target binding site found in the 5' untranslated region of mRNA encoded by LOC150157, corresponding to a target binding site such as BINDING SITE I, BINDING SITE II or BINDING SITE III of FIG. 8. Table 4 illustrates the complementarity of the nucleotide sequences of LOC150157 BINDING SITE, designated SEQ ID:13132, to the nucleotide sequence of GAM133 RNA, herein designated GAM RNA, also designated SEQ ID:211.

Another function of GAM133 is therefore inhibition of LOC150157 (Accession XP_097823.1). Accordingly, utilities of GAM133 include diagnosis, prevention and treatment of diseases and clinical conditions associated with LOC150157.

LOC151178 (Accession XP_087117.1) is another GAM133 target gene, herein designated TARGET GENE. LOC151178 BINDING SITE is a target binding site found in the 5' untranslated region of mRNA encoded by LOC151178, corresponding to a target binding site such as BINDING SITE I, BINDING SITE II or BINDING SITE III of FIG. 8. Table 4 illustrates the complementarity of the nucleotide sequences of LOC151178 BINDING SITE, designated SEQ ID:1582, to the nucleotide sequence of GAM133 RNA, herein designated GAM RNA, also designated SEQ ID:211.

Another function of GAM133 is therefore inhibition of LOC151178 (Accession XP_087117.1). Accordingly, utilities of GAM133 include diagnosis, prevention and treatment of diseases and clinical conditions associated with LOC151178.

LOC152098 (Accession XP_087384.2) is another GAM133 target gene, herein designated TARGET GENE. LOC152098 BINDING SITE is a target binding site found in the 3' untranslated region of mRNA encoded by LOC152098, corresponding to a target binding site such as BINDING SITE I, BINDING SITE II or BINDING SITE III of FIG. 8. Table 4 illustrates the complementarity of the nucleotide sequences of LOC152098 BINDING SITE, designated SEQ ID:16013, to the nucleotide sequence of GAM133 RNA, herein designated GAM RNA, also designated SEQ ID:211.

Another function of GAM133 is therefore inhibition of LOC152098 (Accession XP_087384.2). Accordingly, utilities of GAM133 include diagnosis, prevention and treatment of diseases and clinical conditions associated with LOC152098.

LOC152286 (Accession XP_098188.1) is another GAM133 target gene, herein designated TARGET GENE. LOC152286 BINDING SITE is a target binding site found in the 5' untranslated region of mRNA encoded by LOC152286, corresponding to a target binding site such as BINDING SITE I, BINDING SITE II or BINDING SITE III of FIG. 8. Table 4 illustrates the complementarity of the nucleotide sequences of LOC152286 BINDING SITE, designated SEQ ID:17068, to the nucleotide sequence of GAM133 RNA, herein designated GAM RNA, also designated SEQ ID:211.

Another function of GAM133 is therefore inhibition of LOC152286 (Accession XP_098188.1). Accordingly, utilities of GAM133 include diagnosis, prevention and treatment of diseases and clinical conditions associated with LOC152286.

LOC153811 (Accession XP_087779.2) is another GAM133 target gene, herein designated TARGET GENE. LOC153811 BINDING SITE is a target binding site found in the 3' untranslated region of mRNA encoded by LOC153811, corresponding to a target binding site such as BINDING SITE I, BINDING SITE II or BINDING SITE III of FIG. 8. Table 4 illustrates the complementarity of the nucleotide sequences of LOC153811 BINDING SITE, designated SEQ ID:6064, to the nucleotide sequence of GAM133 RNA, herein designated GAM RNA, also designated SEQ ID:211.

Another function of GAM133 is therefore inhibition of LOC153811 (Accession XP_087779.2). Accordingly, utilities of GAM133 include diagnosis, prevention and treatment of diseases and clinical conditions associated with LOC153811.

LOC200030 (Accession XP_086515.7) is another GAM133 target gene, herein designated TARGET GENE. LOC200030 BINDING SITE is a target binding site found in the 5' untranslated region of mRNA encoded by LOC200030, corresponding to a target binding site such as BINDING SITE I, BINDING SITE II or BINDING SITE III of FIG. 8. Table 4 illustrates the complementarity of the nucleotide sequences of LOC200030 BINDING SITE, designated SEQ ID:19333, to the nucleotide sequence of GAM133 RNA, herein designated GAM RNA, also designated SEQ ID:211.

Another function of GAM133 is therefore inhibition of LOC200030 (Accession XP_086515.7). Accordingly, utilities of GAM133 include diagnosis, prevention and treatment of diseases and clinical conditions associated with LOC200030.

LOC200205 (Accession XP_114152.1) is another GAM133 target gene, herein designated TARGET GENE. LOC200205 BINDING SITE is a target binding site found in the 3' untranslated region of mRNA encoded by LOC200205, corresponding to a target binding site such as BINDING SITE I, BINDING SITE II or BINDING SITE III of FIG. 8. Table 4 illustrates the complementarity of the nucleotide sequences of LOC200205 BINDING SITE, designated SEQ ID:14264, to the nucleotide sequence of GAM133 RNA, herein designated GAM RNA, also designated SEQ ID:211.

Another function of GAM133 is therefore inhibition of LOC200205 (Accession XP_114152.1). Accordingly, utilities of GAM133 include diagnosis, prevention and treatment of diseases and clinical conditions associated with LOC200205.

LOC200609 (Accession XP_117256.1) is another GAM133 target gene, herein designated TARGET GENE. LOC200609 BINDING SITE is a target binding site found in the 5' untranslated region of mRNA encoded by LOC200609, corresponding to a target binding site such as BINDING SITE I, BINDING SITE II or BINDING SITE III of FIG. 8. Table 4 illustrates the complementarity of the nucleotide sequences of LOC200609 BINDING SITE, designated SEQ ID:19040, to the nucleotide sequence of GAM133 RNA, herein designated GAM RNA, also designated SEQ ID:211.

Another function of GAM133 is therefore inhibition of LOC200609 (Accession XP_117256.1). Accordingly, utilities of GAM133 include diagnosis, prevention and treatment of diseases and clinical conditions associated with LOC200609.

LOC220739 (Accession XP_167548.3) is another GAM133 target gene, herein designated TARGET GENE. LOC220739 BINDING SITE is a target binding site found in the 5' untranslated region of mRNA encoded by LOC220739, corresponding to a target binding site such as BINDING SITE I, BINDING SITE II or BINDING SITE III of FIG. 8. Table 4 illustrates the complementarity of the nucleotide sequences of LOC220739 BINDING SITE, designated SEQ ID:13763, to the nucleotide sequence of GAM133 RNA, herein designated GAM RNA, also designated SEQ ID:211.

Another function of GAM133 is therefore inhibition of LOC220739 (Accession XP_167548.3). Accordingly, utilities of GAM133 include diagnosis, prevention and treatment of diseases and clinical conditions associated with LOC220739.

LOC223082 (Accession NP_667339.1) is another GAM133 target gene, herein designated TARGET GENE. LOC223082 BINDING SITE is a target binding site found in the 5' untranslated region of mRNA encoded by LOC223082, corresponding to a target binding site such as BINDING SITE I, BINDING SITE II or BINDING SITE III of FIG. 8. Table 4 illustrates the complementarity of the nucleotide sequences of LOC223082 BINDING SITE, designated SEQ ID:880, to the nucleotide sequence of GAM133 RNA, herein designated GAM RNA, also designated SEQ ID:211.

Another function of GAM133 is therefore inhibition of LOC223082 (Accession NP_667339.1). Accordingly, utilities of GAM133 include diagnosis, prevention and treatment of diseases and clinical conditions associated with LOC223082.

LOC283778 (Accession XP_211199.1) is another GAM133 target gene, herein designated TARGET GENE. LOC283778 BINDING SITE is a target binding site found in the 5' untranslated region of mRNA encoded by LOC283778, corresponding to a target binding site such as BINDING SITE I, BINDING SITE II or BINDING SITE III of FIG. 8. Table 4 illustrates the complementarity of the nucleotide sequences of LOC283778 BINDING SITE, designated SEQ ID:3741, to the nucleotide sequence of GAM133 RNA, herein designated GAM RNA, also designated SEQ ID:211.

Another function of GAM133 is therefore inhibition of LOC283778 (Accession XP_211199.1). Accordingly, utilities of GAM133 include diagnosis, prevention and treatment of diseases and clinical conditions associated with LOC283778.

LOC283834 (Accession XP_211225.1) is another GAM133 target gene, herein designated TARGET GENE. LOC283834 BINDING SITE is a target binding site found in the 3' untranslated region of mRNA encoded by LOC283834, corresponding to a target binding site such as BINDING SITE I, BINDING SITE II or BINDING SITE III of FIG. 8. Table 4 illustrates the complementarity of the nucleotide sequences of LOC283834 BINDING SITE, designated SEQ ID:16248, to the nucleotide sequence of GAM133 RNA, herein designated GAM RNA, also designated SEQ ID:211.

Another function of GAM133 is therefore inhibition of LOC283834 (Accession XP_211225.1). Accordingly, utilities of GAM133 include diagnosis, prevention and treatment of diseases and clinical conditions associated with LOC283834.

LOC284080 (Accession XP_211322.1) is another GAM133 target gene, herein designated TARGET GENE. LOC284080 BINDING SITE is a target binding site found in the 5' untranslated region of mRNA encoded by LOC284080, corresponding to a target binding site such as BINDING SITE I, BINDING SITE II or BINDING SITE III of FIG. 8. Table 4 illustrates the complementarity of the nucleotide sequences of LOC284080 BINDING SITE, designated SEQ ID:12843, to the nucleotide sequence of GAM133 RNA, herein designated GAM RNA, also designated SEQ ID:211.

Another function of GAM133 is therefore inhibition of LOC284080 (Accession XP_211322.1). Accordingly, utilities of GAM133 include diagnosis, prevention and treatment of diseases and clinical conditions associated with LOC284080.

LOC284410 (Accession XP_211449.1) is another GAM133 target gene, herein designated TARGET GENE. LOC284410 BINDING SITE is a target binding site found in the 5' untranslated region of mRNA encoded by LOC284410, corresponding to a target binding site such as BINDING SITE I, BINDING SITE II or BINDING SITE III of FIG. 8. Table 4 illustrates the complementarity of the nucleotide sequences of LOC284410 BINDING SITE, designated SEQ ID:2956, to the nucleotide sequence of GAM133 RNA, herein designated GAM RNA, also designated SEQ ID:211.

Another function of GAM133 is therefore inhibition of LOC284410 (Accession XP_211449.1). Accordingly, utilities of GAM133 include diagnosis, prevention and treatment of diseases and clinical conditions associated with LOC284410.

LOC284431 (Accession XP_209201.1) is another GAM133 target gene, herein designated TARGET GENE. LOC284431 BINDING SITE is a target binding site found in the 3' untranslated region of mRNA encoded by LOC284431, corresponding to a target binding site such as BINDING SITE I, BINDING SITE II or BINDING SITE III of FIG. 8. Table 4 illustrates the complementarity of the nucleotide sequences of LOC284431 BINDING SITE, designated SEQ ID:4523, to the nucleotide sequence of GAM133 RNA, herein designated GAM RNA, also designated SEQ ID:211.

Another function of GAM133 is therefore inhibition of LOC284431 (Accession XP_209201.1). Accordingly, utilities of GAM133 include diagnosis, prevention and treatment of diseases and clinical conditions associated with LOC284431.

LOC284642 (Accession XP_208231.1) is another GAM133 target gene, herein designated TARGET GENE. LOC284642 BINDING SITE is a target binding site found in the 3' untranslated region of mRNA encoded by LOC284642, corresponding to a target binding site such as BINDING SITE I, BINDING SITE II or BINDING SITE III of FIG. 8. Table 4 illustrates the complementarity of the nucleotide sequences of LOC284642 BINDING SITE, designated SEQ ID:3697, to the nucleotide sequence of GAM133 RNA, herein designated GAM RNA, also designated SEQ ID:211.

Another function of GAM133 is therefore inhibition of LOC284642 (Accession XP_208231.1). Accordingly, utilities of GAM133 include diagnosis, prevention and treatment of diseases and clinical conditions associated with LOC284642.

LOC284803 (Accession XP_211642.1) is another GAM133 target gene, herein designated TARGET GENE. LOC284803 BINDING SITE is a target binding site found in the 3' untranslated region of mRNA encoded by LOC284803, corresponding to a target binding site such as BINDING SITE I, BINDING SITE II or BINDING SITE III of FIG. 8. Table 4 illustrates the complementarity of the nucleotide sequences of LOC284803 BINDING SITE, designated SEQ ID:13866, to the nucleotide sequence of GAM133 RNA, herein designated GAM RNA, also designated SEQ ID:211.

Another function of GAM133 is therefore inhibition of LOC284803 (Accession XP_211642.1). Accordingly, utilities of GAM133 include diagnosis, prevention and treatment of diseases and clinical conditions associated with LOC284803.

LOC284834 (Accession XP_209378.1) is another GAM133 target gene, herein designated TARGET GENE. LOC284834 BINDING SITE is a target binding site found in the 3' untranslated region of mRNA encoded by LOC284834, corresponding to a target binding site such as BINDING SITE I, BINDING SITE II or BINDING SITE III of FIG. 8. Table 4 illustrates the complementarity of the nucleotide sequences of LOC284834 BINDING SITE, designated SEQ ID:11970, to the nucleotide sequence of GAM133 RNA, herein designated GAM RNA, also designated SEQ ID:211.

Another function of GAM133 is therefore inhibition of LOC284834 (Accession XP_209378.1). Accordingly, utilities of GAM133 include diagnosis, prevention and treatment of diseases and clinical conditions associated with LOC284834.

LOC284857 (Accession XP_211671.1) is another GAM133 target gene, herein designated TARGET GENE. LOC284857 BINDING SITE is a target binding site found in the 5' untranslated region of mRNA encoded by LOC284857, corresponding to a target binding site such as BINDING SITE I, BINDING SITE II or BINDING SITE III of FIG. 8. Table 4 illustrates the complementarity of the nucleotide sequences of LOC284857 BINDING SITE, designated SEQ ID:8371, to the nucleotide sequence of GAM133 RNA, herein designated GAM RNA, also designated SEQ ID:211.

Another function of GAM133 is therefore inhibition of LOC284857 (Accession XP_211671.1). Accordingly, utilities of GAM133 include diagnosis, prevention and treatment of diseases and clinical conditions associated with LOC284857.

LOC285419 (Accession XP_211890.1) is another GAM133 target gene, herein designated TARGET GENE. LOC285419 BINDING SITE is a target binding site found in the 5' untranslated region of mRNA encoded by LOC285419, corresponding to a target binding site such as BINDING SITE I, BINDING SITE II or BINDING SITE III of FIG. 8. Table 4 illustrates the complementarity of the nucleotide sequences of LOC285419 BINDING SITE, designated SEQ ID:10677, to the nucleotide sequence of GAM133 RNA, herein designated GAM RNA, also designated SEQ ID:211.

Another function of GAM133 is therefore inhibition of LOC285419 (Accession XP_211890.1). Accordingly, utilities of GAM133 include diagnosis, prevention and treatment of diseases and clinical conditions associated with LOC285419.

LOC285717 (Accession XP_211991.1) is another GAM133 target gene, herein designated TARGET GENE. LOC285717 BINDING SITE is a target binding site found in the 5' untranslated region of mRNA encoded by LOC285717, corresponding to a target binding site such as BINDING SITE I, BINDING SITE II or BINDING SITE III of FIG. 8. Table 4 illustrates the complementarity of the nucleotide sequences of LOC285717 BINDING SITE, designated SEQ ID:19478, to the nucleotide sequence of GAM133 RNA, herein designated GAM RNA, also designated SEQ ID:211.

Another function of GAM133 is therefore inhibition of LOC285717 (Accession XP_211991.1). Accordingly, utilities of GAM133 include diagnosis, prevention and treatment of diseases and clinical conditions associated with LOC285717.

LOC285827 (Accession XP_212038.1) is another GAM133 target gene, herein designated TARGET GENE. LOC285827 BINDING SITE1 and LOC285827 BINDING SITE2 are target binding sites found in untranslated regions of multiple transcripts of mRNA encoded by LOC285827, corresponding to target binding sites such as BINDING SITE I, BINDING SITE II or BINDING SITE III of FIG. 8. Table 4 illustrates the complementarity of the nucleotide sequences of LOC285827 BINDING SITE1 and LOC285827 BINDING SITE2, designated SEQ ID:13487 and SEQ ID:5696 respectively, to the nucleotide sequence of GAM133 RNA, herein designated GAM RNA, also designated SEQ ID:211.

Another function of GAM133 is therefore inhibition of LOC285827 (Accession XP_212038.1). Accordingly, utilities of GAM133 include diagnosis, prevention and treatment of diseases and clinical conditions associated with LOC285827.

LOC285827 (Accession XP_212645.1) is another GAM133 target gene, herein designated TARGET GENE. LOC285827 BINDING SITE1 and LOC285827 BINDING SITE2 are target binding sites found in untranslated regions of multiple transcripts of mRNA encoded by LOC285827, corresponding to target binding sites such as BINDING SITE I, BINDING SITE II or BINDING SITE III of FIG. 8. Table 4 illustrates the complementarity of the nucleotide sequences of LOC285827 BINDING SITE1 and LOC285827 BINDING SITE2, designated SEQ ID:13487 and SEQ ID:20006 respectively, to the nucleotide sequence of GAM133 RNA, herein designated GAM RNA, also designated SEQ ID:211.

Another function of GAM133 is therefore inhibition of LOC285827 (Accession XP_212645.1). Accordingly, utilities of GAM133 include diagnosis, prevention and treatment of diseases and clinical conditions associated with LOC285827.

LOC286026 (Accession XP_212119.1) is another GAM133 target gene, herein designated TARGET GENE. LOC286026 BINDING SITE is a target binding site found in the 5' untranslated region of mRNA encoded by LOC286026, corresponding to a target binding site such as BINDING SITE I, BINDING SITE II or BINDING SITE III of FIG. 8. Table 4 illustrates the complementarity of the nucleotide sequences of LOC286026 BINDING SITE, designated SEQ ID:13488, to the nucleotide sequence of GAM133 RNA, herein designated GAM RNA, also designated SEQ ID:211.

Another function of GAM133 is therefore inhibition of LOC286026 (Accession XP_212119.1). Accordingly, utilities of GAM133 include diagnosis, prevention and treatment of diseases and clinical conditions associated with LOC286026.

LOC286126 (Accession XP_212185.1) is another GAM133 target gene, herein designated TARGET GENE. LOC286126 BINDING SITE is a target binding site found in the 3' untranslated region of mRNA encoded by LOC286126, corresponding to a target binding site such as BINDING SITE I, BINDING SITE II or BINDING SITE III of FIG. 8. Table 4 illustrates the complementarity of the nucleotide sequences of LOC286126 BINDING SITE, designated SEQ ID:11832, to the nucleotide sequence of GAM133 RNA, herein designated GAM RNA, also designated SEQ ID:211.

Another function of GAM133 is therefore inhibition of LOC286126 (Accession XP_212185.1). Accordingly, utilities of GAM133 include diagnosis, prevention and treatment of diseases and clinical conditions associated with LOC286126.

LOC286299 (Accession XP_212257.1) is another GAM133 target gene, herein designated TARGET GENE. LOC286299 BINDING SITE is a target binding site found in the 5' untranslated region of mRNA encoded by LOC286299, corresponding to a target binding site such as BINDING SITE I, BINDING SITE II or BINDING SITE III of FIG. 8. Table 4 illustrates the complementarity of the nucleotide sequences of LOC286299 BINDING SITE, designated SEQ ID:19909, to the nucleotide sequence of GAM133 RNA, herein designated GAM RNA, also designated SEQ ID:211.

Another function of GAM133 is therefore inhibition of LOC286299 (Accession XP_212257.1). Accordingly, utilities of GAM133 include diagnosis, prevention and treatment of diseases and clinical conditions associated with LOC286299.

LOC286384 (Accession XP_212305.2) is another GAM133 target gene, herein designated TARGET GENE. LOC286384 BINDING SITE is a target binding site found in the 5' untranslated region of mRNA encoded by LOC286384, corresponding to a target binding site such as BINDING SITE I, BINDING SITE II or BINDING SITE III of FIG. 8. Table 4 illustrates the complementarity of the nucleotide sequences of LOC286384 BINDING SITE, designated SEQ ID:18912, to the nucleotide sequence of GAM133 RNA, herein designated GAM RNA, also designated SEQ ID:211.

Another function of GAM133 is therefore inhibition of LOC286384 (Accession XP_212305.2). Accordingly, utilities of GAM133 include diagnosis, prevention and treatment of diseases and clinical conditions associated with LOC286384.

LOC340156 (Accession XP_291158.1) is another GAM133 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:16425, to the nucleotide sequence of GAM133 RNA, herein designated GAM RNA, also designated SEQ ID:211.

Another function of GAM133 is therefore inhibition of LOC340156 (Accession XP_291158.1). Accordingly, utilities of GAM133 include diagnosis, prevention and treatment of diseases and clinical conditions associated with LOC340156.

LOC340268 (Accession XP_294634.1) is another GAM133 target gene, herein designated TARGET GENE. LOC340268 BINDING SITE is a target binding site found in the 5' untranslated region of mRNA encoded by LOC340268, corresponding to a target binding site such as BINDING SITE I, BINDING SITE II or BINDING SITE III of FIG. 8. Table 4 illustrates the complementarity of the nucleotide sequences of LOC340268 BINDING SITE, designated SEQ ID:8452, to the nucleotide sequence of GAM133 RNA, herein designated GAM RNA, also designated SEQ ID:211.

Another function of GAM133 is therefore inhibition of LOC340268 (Accession XP_294634.1). Accordingly, utilities of GAM133 include diagnosis, prevention and treatment of diseases and clinical conditions associated with LOC340268.

LOC340319 (Accession XP_295216.1) is another GAM133 target gene, herein designated TARGET GENE. LOC340319 BINDING SITE is a target binding site found in the 3' untranslated region of mRNA encoded by LOC340319, corresponding to a target binding site such as BINDING SITE I, BINDING SITE II or BINDING SITE III of FIG. 8. Table 4 illustrates the complementarity of the nucleotide sequences of LOC340319 BINDING SITE, designated SEQ ID:17510, to the nucleotide sequence of GAM133 RNA, herein designated GAM RNA, also designated SEQ ID:211.

Another function of GAM133 is therefore inhibition of LOC340319 (Accession XP_295216.1). Accordingly, utilities of GAM133 include diagnosis, prevention and treatment of diseases and clinical conditions associated with LOC340319.

LOC349557 (Accession XP_301266.1) is another GAM133 target gene, herein designated TARGET GENE. LOC349557 BINDING SITE is a target binding site found in the 5' untranslated region of mRNA encoded by LOC349557, corresponding to a target binding site such as BINDING SITE I, BINDING SITE II or BINDING SITE III of FIG. 8. Table 4 illustrates the complementarity of the nucleotide sequences of LOC349557 BINDING SITE, designated SEQ ID:20112, to the nucleotide sequence of GAM133 RNA, herein designated GAM RNA, also designated SEQ ID:211.

Another function of GAM133 is therefore inhibition of LOC349557 (Accession XP_301266.1). Accordingly, utilities of GAM133 include diagnosis, prevention and treatment of diseases and clinical conditions associated with LOC349557.

LOC57228 (Accession NP_065200.1) is another GAM133 target gene, herein designated TARGET GENE. LOC57228 BINDING SITE is a target binding site found in the 5' untranslated region of mRNA encoded by LOC57228, corresponding to a target binding site such as BINDING SITE I, BINDING SITE II or BINDING SITE III of FIG. 8. Table 4 illustrates the complementarity of the nucleotide sequences of LOC57228 BINDING SITE, designated SEQ ID:15721, to the nucleotide sequence of GAM133 RNA, herein designated GAM RNA, also designated SEQ ID:211.

Another function of GAM133 is therefore inhibition of LOC57228 (Accession NP_065200.1). Accordingly, utilities of GAM133 include diagnosis, prevention and treatment of diseases and clinical conditions associated with LOC57228.

LOC90470 (Accession XP_031975.1) is another GAM133 target gene, herein designated TARGET GENE. LOC90470 BINDING SITE is a target binding site found in the 5' untranslated region of mRNA encoded by LOC90470, corresponding to a target binding site such as BINDING SITE I, BINDING SITE II or BINDING SITE III of FIG. 8. Table 4 illustrates the complementarity of the nucleotide sequences of LOC90470 BINDING SITE, designated SEQ ID:3057, to the nucleotide sequence of GAM133 RNA, herein designated GAM RNA, also designated SEQ ID:211.

Another function of GAM133 is therefore inhibition of LOC90470 (Accession XP_031975.1). Accordingly, utilities of GAM133 include diagnosis, prevention and treatment of diseases and clinical conditions associated with LOC90470.

LUC7A (Accession NP_057508.2) is another GAM133 target gene, herein designated TARGET GENE. LUC7A BINDING SITE is a target binding site found in the 3' untranslated region of mRNA encoded by LUC7A, corresponding to a target binding site such as BINDING SITE I, BINDING SITE II or BINDING SITE III of FIG. 8. Table 4 illustrates the complementarity of the nucleotide sequences of LUC7A BINDING SITE, designated SEQ ID:11723, to the nucleotide sequence of GAM133 RNA, herein designated GAM RNA, also designated SEQ ID:211.

Another function of GAM133 is therefore inhibition of LUC7A (Accession NP_057508.2). Accordingly, utilities of GAM133 include diagnosis, prevention and treatment of diseases and clinical conditions associated with LUC7A.

Mannan-binding lectin serine protease 2 (MASP2, Accession NP_631947.1) is another GAM133 target gene, herein designated TARGET GENE. MASP2 BINDING SITE is a target binding site found in the 3' untranslated region of multiple transcripts of mRNA encoded by MASP2, corresponding to a target binding site such as BINDING SITE I, BINDING SITE II or BINDING SITE III of FIG. 8. Table 4 illustrates the complementarity of the nucleotide sequences of MASP2 BINDING SITE, designated SEQ ID:1650, to the nucleotide sequence of GAM133 RNA, herein designated GAM RNA, also designated SEQ ID:211.

Another function of GAM133 is therefore inhibition of Mannan-binding lectin serine protease 2 (MASP2, Accession NP_631947.1), a gene which be involved in an antibody-independent pathway that is initiated by binding of the mannan-binding lectin . Accordingly, utilities of GAM133 include diagnosis, prevention and treatment of diseases and clinical conditions associated with MASP2.

The function of MASP2 has been established by previous studies. The complement system is essential for the operation of the innate and adaptive immune defense. In addition to the classic pathway initiated by antigen-antibody complexes and the alternative pathway initiated by structures on microbial surfaces, there is an antibody-independent pathway that is initiated by binding of the mannan-binding lectin (MBL; 154545), which is structurally related to C1q (see OMIM Ref. No. 120550), to carbohydrates. MBL, the plasma levels of which are genetically determined, activates the complement pathway through the mannan-binding lectin serine proteases, or MASPs (see OMIM Ref. No. MASP1; 600521). Using affinity chromatography to purify carbohydrate-binding plasma proteins, followed by microsequence analysis and by RT-PCR on a liver cDNA library, Thiel et al. (1997) identified a cDNA encoding MASP2. MASP2 was expressed as a 52-kD protein under reducing conditions. Sequence analysis predicted that the 686-amino acid MASP2 protein shares 46 to 52% amino acid similarity (taking into account residues of a similar nature as well as identical residues) with C1r (see OMIM Ref. No. 216950), C1s (OMIM Ref. No. 120580), and MASP1; these proteins also share the same domain organization. MASP2 contains a 15- amino acid signal peptide, the 3 amino acids essential for the active center of a serine protease, and calcium-binding residues in the epidermal growth factor (EGF; 131530)-like domain. Unlike MASP1, however, MASP2 has no sites for N-linked glycosylation. Overall, MASP1 is most homologous to C1r and MASP2 is most homologous to C1s, supporting the notion that the MBL pathway may antedate the development of the specific immune system of vertebrates. Functional analysis showed that MASP2 activates C4 (see OMIM Ref. No. 120810), a requirement for the generation of a C3 (OMIM Ref. No. 120700)-converting complex. By screening a liver cDNA library, Stover et al. (1999) identified a cDNA encoding a shorter variant of MASP2, which they termed MAP19 (MBL-associated plasma protein of 19 kD). The deduced 185-amino acid MAP19 protein retains the signal peptide, the N-terminal CUB (see OMIM Ref. No. CUBN; 602997) domain, and the EGF-like domain of full-length MASP2, but it has a unique C-terminal sequence (EQSL) and lacks the serine protease catalytic domain. Northern blot analysis revealed higher expression of the 1.0- kb MAP19 transcript than of the 2.6-kb transcript encoding the serine protease domain of MASP2. Immunoblot analysis indicated that uncleaved MASP2 is expressed as a 76-kD protein, while the A chain has a molecular mass of 52 kD and the B chain has a mass of 31 kD. Stover et al. (1999) proposed that MAP19 has a role in modulating the activation of complement via the MBL pathway. By biochemical purification of a 22-kD protein associated with MASP1 preparations and peptide sequence analysis, Takahashi et al. (1999) cloned the short variant of MASP2, which they termed sMAP (small MBL- associated protein). Northern blot and RT-PCR analyses showed that MASP2 is expressed in the liver and that the short variant is the major transcript. By FISH, Stover et al. (1999) mapped the MASP2 gene to 1p36.3-p36.2. They confirmed this localization by radiation hybrid analysis.

Full details of the abovementioned studies are described in the following publications, the disclosure of which are hereby incorporated by reference:

Stover, C. M.; Thiel, S.; Thelen, M.; Lynch, N. J.; Vorup-Jensen, T.; Jensenius, J. C.; Schwaeble, W. J.: Two constituents of the initiation complex of the mannan- binding lectin activation pathway of complement are encoded by a single structural gene. J. Immun. 162:3481-3490, 1999; and Stover, C. M.; Schwaeble, W. J.; Lynch, N. J.; Thiel, S.; Speicher, M. R.: Assignment of the gene encoding mannan-binding lectin-associated serine protease 2 (MASP2) to human chromosom.

Further studies establishing the function and utilities of MASP2 are found in John Hopkins OMIM database record ID 605102, and in cited publications listed in Table 5, which are hereby incorporated by reference. Mannosyl (alpha-1,3-)-glycoprotein beta-1,4-n-acetylglucosaminyltransferase, isoenzyme a (MGAT4A, Accession NP_036346.1) is another GAM133 target gene, herein designated TARGET GENE. MGAT4A BINDING SITE is a target binding site found in the 5' untranslated region of mRNA encoded by MGAT4A, corresponding to a target binding site such as BINDING SITE I, BINDING SITE II or BINDING SITE III of FIG. 8. Table 4 illustrates the complementarity of the nucleotide sequences of MGAT4A BINDING SITE, designated SEQ ID:18765, to the nucleotide sequence of GAM133 RNA, herein designated GAM RNA, also designated SEQ ID:211.

Another function of GAM133 is therefore inhibition of Mannosyl (alpha-1,3-)-glycoprotein beta-1,4-n-acetylglucosaminyltransferase, isoenzyme a (MGAT4A, Accession NP_036346.1). Accordingly, utilities of GAM133 include diagnosis, prevention and treatment of diseases and clinical conditions associated with MGAT4A.

MGC11242 (Accession NP_077296.1) is another GAM133 target gene, herein designated TARGET GENE. MGC11242 BINDING SITE is a target binding site found in the 3' untranslated region of mRNA encoded by MGC11242, corresponding to a target binding site such as BINDING SITE I, BINDING SITE II or BINDING SITE III of FIG. 8. Table 4 illustrates the complementarity of the nucleotide sequences of MGC11242 BINDING SITE, designated SEQ ID:8424, to the nucleotide sequence of GAM133 RNA, herein designated GAM RNA, also designated SEQ ID:211.

Another function of GAM133 is therefore inhibition of MGC11242 (Accession NP_077296.1). Accordingly, utilities of GAM133 include diagnosis, prevention and treatment of diseases and clinical conditions associated with MGC11242.

MGC2817 (Accession NP_115900.1) is another GAM133 target gene, herein designated TARGET GENE. MGC2817 BINDING SITE is a target binding site found in the 5' untranslated region of mRNA encoded by MGC2817, corresponding to a target binding site such as BINDING SITE I, BINDING SITE II or BINDING SITE III of FIG. 8. Table 4 illustrates the complementarity of the nucleotide sequences of MGC2817 BINDING SITE, designated SEQ ID:16603, to the nucleotide sequence of GAM133 RNA, herein designated GAM RNA, also designated SEQ ID:211.

Another function of GAM133 is therefore inhibition of MGC2817 (Accession NP_115900.1). Accordingly, utilities of GAM133 include diagnosis, prevention and treatment of diseases and clinical conditions associated with MGC2817.

Neuromedin u (NMU, Accession NP_006672.1) is another GAM133 target gene, herein designated TARGET GENE. NMU BINDING SITE is a target binding site found in the 3' untranslated region of mRNA encoded by NMU, corresponding to a target binding site such as BINDING SITE I, BINDING SITE II or BINDING SITE III of FIG. 8. Table 4 illustrates the complementarity of the nucleotide sequences of NMU BINDING SITE, designated SEQ ID:14657, to the nucleotide sequence of GAM133 RNA, herein designated GAM RNA, also designated SEQ ID:211.

Another function of GAM133 is therefore inhibition of Neuromedin u (NMU, Accession NP_006672.1). Accordingly, utilities of GAM133 include diagnosis, prevention and treatment of diseases and clinical conditions associated with NMU.

Neurotensin receptor 1 (high affinity) (NTSR1, Accession NP_002522.1) is another GAM133 target gene, herein designated TARGET GENE. NTSR1 BINDING SITE is a target binding site found in the 3' untranslated region of mRNA encoded by NTSR1, corresponding to a target binding site such as BINDING SITE I, BINDING SITE II or BINDING SITE III of FIG. 8. Table 4 illustrates the complementarity of the nucleotide sequences of NTSR1 BINDING SITE, designated SEQ ID:2175, to the nucleotide sequence of GAM133 RNA, herein designated GAM RNA, also designated SEQ ID:211.

Another function of GAM133 is therefore inhibition of Neurotensin receptor 1 (high affinity) (NTSR1, Accession NP_002522.1), a gene which is associated with g proteins that activate a phosphatidylinositol-calcium second messenger system. Accordingly, utilities of GAM133 include diagnosis, prevention and treatment of diseases and clinical conditions associated with NTSR1.

The function of NTSR1 has been established by previous studies. The tridecapeptide neurotensin (OMIM Ref. No. 162650) is widely distributed in various regions of the brain and in peripheral tissues. In the brain, neurotensin acts as a neuromodulator, in particular of dopamine transmission in the nigrostriatal and mesocorticolimbic systems, suggesting its possible implication in dopamine-associated behavioral neurodegenerative and neuropsychiatric disorders. Its various effects are mediated by specific membrane receptors. Vita et al. (1993) isolated a cDNA encoding a human neurotensin receptor (NTSR1) and showed that it predicts a 418-amino acid protein that shares 84% homology with the rat protein. Le et al. (1997) also cloned human NTSR1 cDNA and its genomic DNA. The gene contains 4 exons and spans more than 10 kb. The authors identified a highly polymorphic tetranucleotide repeat approximately 3 kb from the gene. Southern blot analysis revealed that the NTSR1 gene is present in the human genome as a single-copy gene. Le et al. (1997) stated that the neurotensin receptor has 7 transmembrane spanning regions and high homology to other receptors that couple to G proteins. Vincent (1995) reviewed pharmacologic and molecular data suggesting the existence of other types of functional neurotensin receptors.

Full details of the abovementioned studies are described in the following publications, the disclosure of which are hereby incorporated by reference:

Le, F.; Groshan, K.; Zeng, X. P.; Richelson, E.: Characterization of the genomic structure, promoter region, and a tetranucleotide repeat polymorphism of the human neurotensin receptor gene. J. Biol. Chem. 272:1315-1322, 1997; and Vincent, J.-P.: Neurotensin receptors: binding properties, transduction pathway, and structure. Cell. Molec. Neurobiol. 15:501-512, 1995.

Further studies establishing the function and utilities of NTSR1 are found in John Hopkins OMIM database record ID 162651, and in cited publications listed in Table 5, which are hereby incorporated by reference. Nuclear mitotic apparatus protein 1 (NUMA1, Accession NP_006176.1) is another GAM133 target gene, herein designated TARGET GENE. NUMA1 BINDING SITE is a target binding site found in the 3' untranslated region of mRNA encoded by NUMA1, corresponding to a target binding site such as BINDING SITE I, BINDING SITE II or BINDING SITE III of FIG. 8. Table 4 illustrates the complementarity of the nucleotide sequences of NUMA1 BINDING SITE, designated SEQ ID:9820, to the nucleotide sequence of GAM133 RNA, herein designated GAM RNA, also designated SEQ ID:211.

Another function of GAM133 is therefore inhibition of Nuclear mitotic apparatus protein 1 (NUMA1, Accession NP_006176.1), a gene which is nuclear mitotic apparatus protein. Accordingly, utilities of GAM133 include diagnosis, prevention and treatment of diseases and clinical conditions associated with NUMA1.

The function of NUMA1 has been established by previous studies. The NuMA protein was one of the first to be described as a cell cycle-related protein based on a distinct immunofluorescent staining pattern: in interphase, NuMA is present throughout the nucleus, and in mitosis, it localizes to the spindle apparatus (Lydersen and Pettijohn, 1980). Some patients with autoimmune disease have antibodies directed against the NuMA protein. The full-length NUMA cDNA (Compton et al., 1992; Yang et al., 1992) predicts a protein with the largest known coiled-coil region in a protein. By fluorescence in situ hybridization, Sparks et al. (1993) demonstrated that the NUMA1 gene is present in single copy and located on 11q13. Acute promyelocytic leukemia (APL) is uniquely associated with chromosomal translocations that disrupt the gene encoding the retinoic acid receptor, RARA (OMIM Ref. No. 180240). In more than 99% of cases, this disruption results in the formation of a fusion of the RARA gene with the PML gene (OMIM Ref. No. 102578). In rare variants of APL, the RARA gene has been found to be fused to 1 of 2 other genes, PLZF (OMIM Ref. No. 176797) and NPM (OMIM Ref. No. 164040). Although RARA dysregulation is evidently important in APL, the role of the various fusion partners is unclear. Wells et al. (1997) characterized a fourth APL gene fusion, which linked exons encoding the retinoic acid and DNA-binding domains of RARA to 5-prime exons of NUMA1. The NUMA/RARA fusion protein existed in sheet-like nuclear aggregates with which normal NUMA partly colocalized. In contrast to t(15;17) APL (the usual variety) the intracellular distribution of PML was normal in these cells. Wells et al. (1997) suggested that interference with retinoid signaling, and not disruption of PML organization, is essential to the APL phenotype. Their work implicated for the first time an element of the mitotic apparatus in the molecular pathogenesis of human malignancy. The proband of their study was a Caucasian male first seen at 6 months of age for investigation of multiple cutaneous lesions. Despite this unusual clinical presentation, peripheral blood morphology and cell-surface immunophenotype were typical of APL. Routine analysis of diagnostic bone marrow revealed a clonal cytogenetic abnormality, t(11;17)(q13;q21). The patient was treated with all-trans retinoic acid and achieved complete remission; he remained in morphologic remission 38 months after autologous bone marrow transplantation.

Full details of the abovementioned studies are described in the following publications, the disclosure of which are hereby incorporated by reference:

Lydersen, B. K.; Pettijohn, D. E.: Human-specific nuclear protein that associates with the polar region of the mitotic apparatus: distribution in a human/hamster hybrid cell. Cell 22:489-499, 1980; and Wells, R. A.; Catzavelos, C.; Kamel-Reid, S.: Fusion of retinoic acid receptor alpha to NuMA, the nuclear mitotic apparatus protein, by a variant translocation in acute promyelocytic l.

Further studies establishing the function and utilities of NUMA1 are found in John Hopkins OMIM database record ID 164009, and in cited publications listed in Table 5, which are hereby incorporated by reference. Optic atrophy 3 (autosomal recessive, with chorea and spastic paraplegia) (OPA3, Accession NP_079412.1) is another GAM133 target gene, herein designated TARGET GENE. OPA3 BINDING SITE is a target binding site found in the 3' untranslated region of mRNA encoded by OPA3, corresponding to a target binding site such as BINDING SITE I, BINDING SITE II or BINDING SITE III of FIG. 8. Table 4 illustrates the complementarity of the nucleotide sequences of OPA3 BINDING SITE, designated SEQ ID:4447, to the nucleotide sequence of GAM133 RNA, herein designated GAM RNA, also designated SEQ ID:211.

Another function of GAM133 is therefore inhibition of Optic atrophy 3 (autosomal recessive, with chorea and spastic paraplegia) (OPA3, Accession NP_079412.1). Accordingly, utilities of GAM133 include diagnosis, prevention and treatment of diseases and clinical conditions associated with OPA3.

Oxidative-stress responsive 1 (OSR1, Accession NP_005100.1) is another GAM133 target gene, herein designated TARGET GENE. OSR1 BINDING SITE is a target binding site found in the 3' untranslated region of multiple transcripts of mRNA encoded by OSR1, corresponding to a target binding site such as BINDING SITE I, BINDING SITE II or BINDING SITE III of FIG. 8. Table 4 illustrates the complementarity of the nucleotide sequences of OSR1 BINDING SITE, designated SEQ ID:15350, to the nucleotide sequence of GAM133 RNA, herein designated GAM RNA, also designated SEQ ID:211.

Another function of GAM133 is therefore inhibition of Oxidative-stress responsive 1 (OSR1, Accession NP_005100.1), a gene which mediats stress-activated signals. Accordingly, utilities of GAM133 include diagnosis, prevention and treatment of diseases and clinical conditions associated with OSR1.

The function of OSR1 has been established by previous studies. The 3p22-p21.3 chromosomal region is one of 3 regions of 3p that is commonly deleted in various carcinomas. By analyzing a cloned segment from this region, Tamari et al. (1999) identified a novel gene that they designated OSR1 (oxidative stress-responsive-1) because the predicted 527-amino acid protein shares 39% identity with Ste20/oxidant stress-response kinase- 1 (OMIM Ref. No. 602255). The OSR1 gene contains 18 exons and spans approximately 90 kb. Northern blot analysis revealed that OSR1 was expressed as a 4.6-kb major transcript in all tissues tested. A less abundant 7.5-kb mRNA was detected in heart and skeletal muscle. Daigo et al. (1999) reported that the OSR1 gene is located between the OCTL1 (OMIM Ref. No. 604047) and MYD88 (OMIM Ref. No. 602170) genes on 3p22-p21.3.

Full details of the abovementioned studies are described in the following publications, the disclosure of which are hereby incorporated by reference:

Tamari, M.; Daigo, Y.; Nakamura, Y.: Isolation and characterization of a novel serine threonine kinase gene on chromosome 3q22-21.3. J. Hum. Genet. 44:116-120, 1999; and Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.

Further studies establishing the function and utilities of OSR1 are found in John Hopkins OMIM database record ID 604046, and in cited publications listed in Table 5, which are hereby incorporated by reference. PF20 (Accession NP_078808.2) is another GAM133 target gene, herein designated TARGET GENE. PF20 BINDING SITE is a target binding site found in the 3' untranslated region of mRNA encoded by PF20, corresponding to a target binding site such as BINDING SITE I, BINDING SITE II or BINDING SITE III of FIG. 8. Table 4 illustrates the complementarity of the nucleotide sequences of PF20 BINDING SITE, designated SEQ ID:1865, to the nucleotide sequence of GAM133 RNA, herein designated GAM RNA, also designated SEQ ID:211.

Another function of GAM133 is therefore inhibition of PF20 (Accession NP_078808.2). Accordingly, utilities of GAM133 include diagnosis, prevention and treatment of diseases and clinical conditions associated with PF20.

Paraneoplastic antigen like 5 (PNMA5, Accession NP_443158.1) is another GAM133 target gene, herein designated TARGET GENE. PNMA5 BINDING SITE is a target binding site found in the 3' untranslated region of mRNA encoded by PNMA5, corresponding to a target binding site such as BINDING SITE I, BINDING SITE II or BINDING SITE III of FIG. 8. Table 4 illustrates the complementarity of the nucleotide sequences of PNMA5 BINDING SITE, designated SEQ ID:13736, to the nucleotide sequence of GAM133 RNA, herein designated GAM RNA, also designated SEQ ID:211.

Another function of GAM133 is therefore inhibition of Paraneoplastic antigen like 5 (PNMA5, Accession NP_443158.1). Accordingly, utilities of GAM133 include diagnosis, prevention and treatment of diseases and clinical conditions associated with PNMA5.

Protein-o-mannosyltransferase 1 (POMT1, Accession NP_009102.2) is another GAM133 target gene, herein designated TARGET GENE. POMT1 BINDING SITE is a target binding site found in the 3' untranslated region of mRNA encoded by POMT1, corresponding to a target binding site such as BINDING SITE I, BINDING SITE II or BINDING SITE III of FIG. 8. Table 4 illustrates the complementarity of the nucleotide sequences of POMT1 BINDING SITE, designated SEQ ID:15100, to the nucleotide sequence of GAM133 RNA, herein designated GAM RNA, also designated SEQ ID:211.

Another function of GAM133 is therefore inhibition of Protein-o-mannosyltransferase 1 (POMT1, Accession NP_009102.2). Accordingly, utilities of GAM133 include diagnosis, prevention and treatment of diseases and clinical conditions associated with POMT1.

Ran binding protein 3 (RANBP3, Accession NP_015560.1) is another GAM133 target gene, herein designated TARGET GENE. RANBP3 BINDING SITE is a target binding site found in the 5' untranslated region of multiple transcripts of mRNA encoded by RANBP3, corresponding to a target binding site such as BINDING SITE I, BINDING SITE II or BINDING SITE III of FIG. 8. Table 4 illustrates the complementarity of the nucleotide sequences of RANBP3 BINDING SITE, designated SEQ ID:1217, to the nucleotide sequence of GAM133 RNA, herein designated GAM RNA, also designated SEQ ID:211.

Another function of GAM133 is therefore inhibition of Ran binding protein 3 (RANBP3, Accession NP_015560.1). Accordingly, utilities of GAM133 include diagnosis, prevention and treatment of diseases and clinical conditions associated with RANBP3.

Ras guanyl releasing protein 4 (RASGRP4, Accession NP_733748.1) is another GAM133 target gene, herein designated TARGET GENE. RASGRP4 BINDING SITE is a target binding site found in the 3' untranslated region of multiple transcripts of mRNA encoded by RASGRP4, corresponding to a target binding site such as BINDING SITE I, BINDING SITE II or BINDING SITE III of FIG. 8. Table 4 illustrates the complementarity of the nucleotide sequences of RASGRP4 BINDING SITE, designated SEQ ID:10789, to the nucleotide sequence of GAM133 RNA, herein designated GAM RNA, also designated SEQ ID:211.

Another function of GAM133 is therefore inhibition of Ras guanyl releasing protein 4 (RASGRP4, Accession NP_733748.1). Accordingly, utilities of GAM133 include diagnosis, prevention and treatment of diseases and clinical conditions associated with RASGRP4.

Ras guanyl releasing protein 4 (RASGRP4, Accession NP_733747.1) is another GAM133 target gene, herein designated TARGET GENE. RASGRP4 BINDING SITE is a target binding site found in the 3' untranslated region of multiple transcripts of mRNA encoded by RASGRP4, corresponding to a target binding site such as BINDING SITE I, BINDING SITE II or BINDING SITE III of FIG. 8. Table 4 illustrates the complementarity of the nucleotide sequences of RASGRP4 BINDING SITE, designated SEQ ID:10789, to the nucleotide sequence of GAM133 RNA, herein designated GAM RNA, also designated SEQ ID:211.

Another function of GAM133 is therefore inhibition of Ras guanyl releasing protein 4 (RASGRP4, Accession NP_733747.1). Accordingly, utilities of GAM133 include diagnosis, prevention and treatment of diseases and clinical conditions associated with RASGRP4.

Ras guanyl releasing protein 4 (RASGRP4, Accession NP_443181.2) is another GAM133 target gene, herein designated TARGET GENE. RASGRP4 BINDING SITE is a target binding site found in the 3' untranslated region of multiple transcripts of mRNA encoded by RASGRP4, corresponding to a target binding site such as BINDING SITE I, BINDING SITE II or BINDING SITE III of FIG. 8. Table 4 illustrates the complementarity of the nucleotide sequences of RASGRP4 BINDING SITE, designated SEQ ID:10789, to the nucleotide sequence of GAM133 RNA, herein designated GAM RNA, also designated SEQ ID:211.

Another function of GAM133 is therefore inhibition of Ras guanyl releasing protein 4 (RASGRP4, Accession NP_443181.2). Accordingly, utilities of GAM133 include diagnosis, prevention and treatment of diseases and clinical conditions associated with RASGRP4.

RNF121 (Accession NP_060790.2) is another GAM133 target gene, herein designated TARGET GENE. RNF121 BINDING SITE is a target binding site found in the 3' untranslated region of mRNA encoded by RNF121, corresponding to a target binding site such as BINDING SITE I, BINDING SITE II or BINDING SITE III of FIG. 8. Table 4 illustrates the complementarity of the nucleotide sequences of RNF121 BINDING SITE, designated SEQ ID:8732, to the nucleotide sequence of GAM133 RNA, herein designated GAM RNA, also designated SEQ ID:211.

Another function of GAM133 is therefore inhibition of RNF121 (Accession NP_060790.2). Accordingly, utilities of GAM133 include diagnosis, prevention and treatment of diseases and clinical conditions associated with RNF121.

Ribulose-5-phosphate-3-epimerase (RPE, Accession NP_008847.1) is another GAM133 target gene, herein designated TARGET GENE. RPE BINDING SITE is a target binding site found in the 5' untranslated region of mRNA encoded by RPE, corresponding to a target binding site such as BINDING SITE I, BINDING SITE II or BINDING SITE III of FIG. 8. Table 4 illustrates the complementarity of the nucleotide sequences of RPE BINDING SITE, designated SEQ ID:5773, to the nucleotide sequence of GAM133 RNA, herein designated GAM RNA, also designated SEQ ID:211.

Another function of GAM133 is therefore inhibition of Ribulose-5-phosphate-3-epimerase (RPE, Accession NP_008847.1). Accordingly, utilities of GAM133 include diagnosis, prevention and treatment of diseases and clinical conditions associated with RPE.

SELM (Accession NP_536355.1) is another GAM133 target gene, herein designated TARGET GENE. SELM BINDING SITE is a target binding site found in the 3' untranslated region of mRNA encoded by SELM, corresponding to a target binding site such as BINDING SITE I, BINDING SITE II or BINDING SITE III of FIG. 8. Table 4 illustrates the complementarity of the nucleotide sequences of SELM BINDING SITE, designated SEQ ID:15560, to the nucleotide sequence of GAM133 RNA, herein designated GAM RNA, also designated SEQ ID:211.

Another function of GAM133 is therefore inhibition of SELM (Accession NP_536355.1). Accordingly, utilities of GAM133 include diagnosis, prevention and treatment of diseases and clinical conditions associated with SELM.

SLC9A8 (Accession XP_030524.2) is another GAM133 target gene, herein designated TARGET GENE. SLC9A8 BINDING SITE is a target binding site found in the 3' untranslated region of mRNA encoded by SLC9A8, corresponding to a target binding site such as BINDING SITE I, BINDING SITE II or BINDING SITE III of FIG. 8. Table 4 illustrates the complementarity of the nucleotide sequences of SLC9A8 BINDING SITE, designated SEQ ID:17493, to the nucleotide sequence of GAM133 RNA, herein designated GAM RNA, also designated SEQ ID:211.

Another function of GAM133 is therefore inhibition of SLC9A8 (Accession XP_030524.2). Accordingly, utilities of GAM133 include diagnosis, prevention and treatment of diseases and clinical conditions associated with SLC9A8.

Transcription factor 7 (t-cell specific, hmg-box) (TCF7, Accession NP_003193.1) is another GAM133 target gene, herein designated TARGET GENE. TCF7 BINDING SITE is a target binding site found in the 3' untranslated region of mRNA encoded by TCF7, corresponding to a target binding site such as BINDING SITE I, BINDING SITE II or BINDING SITE III of FIG. 8. Table 4 illustrates the complementarity of the nucleotide sequences of TCF7 BINDING SITE, designated SEQ ID:15351, to the nucleotide sequence of GAM133 RNA, herein designated GAM RNA, also designated SEQ ID:211.

Another function of GAM133 is therefore inhibition of Transcription factor 7 (t-cell specific, hmg-box) (TCF7, Accession NP_003193.1). Accordingly, utilities of GAM133 include diagnosis, prevention and treatment of diseases and clinical conditions associated with TCF7.

Tgfb inducible early growth response (TIEG, Accession NP_005646.1) is another GAM133 target gene, herein designated TARGET GENE. TIEG BINDING SITE is a target binding site found in the 5' untranslated region of mRNA encoded by TIEG, corresponding to a target binding site such as BINDING SITE I, BINDING SITE II or BINDING SITE III of FIG. 8. Table 4 illustrates the complementarity of the nucleotide sequences of TIEG BINDING SITE, designated SEQ ID:6313, to the nucleotide sequence of GAM133 RNA, herein designated GAM RNA, also designated SEQ ID:211.

Another function of GAM133 is therefore inhibition of Tgfb inducible early growth response (TIEG, Accession NP_005646.1). Accordingly, utilities of GAM133 include diagnosis, prevention and treatment of diseases and clinical conditions associated with TIEG.

Ubiquitin-conjugating enzyme e2, j2 (ubc6 homolog, yeast) (UBE2J2, Accession NP_477515.1) is another GAM133 target gene, herein designated TARGET GENE. UBE2J2 BINDING SITE is a target binding site found in the 3' untranslated region of mRNA encoded by UBE2J2, corresponding to a target binding site such as BINDING SITE I, BINDING SITE II or BINDING SITE III of FIG. 8. Table 4 illustrates the complementarity of the nucleotide sequences of UBE2J2 BINDING SITE, designated SEQ ID:7344, to the nucleotide sequence of GAM133 RNA, herein designated GAM RNA, also designated SEQ ID:211.

Another function of GAM133 is therefore inhibition of Ubiquitin-conjugating enzyme e2, j2 (ubc6 homolog, yeast) (UBE2J2, Accession NP_477515.1). Accordingly, utilities of GAM133 include diagnosis, prevention and treatment of diseases and clinical conditions associated with UBE2J2.

Zinc finger protein 6 (cmpx1) (ZNF6, Accession NP_068838.2) is another GAM133 target gene, herein designated TARGET GENE. ZNF6 BINDING SITE is a target binding site found in the 5' untranslated region of mRNA encoded by ZNF6, corresponding to a target binding site such as BINDING SITE I, BINDING SITE II or BINDING SITE III of FIG. 8. Table 4 illustrates the complementarity of the nucleotide sequences of ZNF6 BINDING SITE, designated SEQ ID:740, to the nucleotide sequence of GAM133 RNA, herein designated GAM RNA, also designated SEQ ID:211.

Another function of GAM133 is therefore inhibition of Zinc finger protein 6 (cmpx1) (ZNF6, Accession NP_068838.2). Accordingly, utilities of GAM133 include diagnosis, prevention and treatment of diseases and clinical conditions associated with ZNF6.

FIG. 8 further provides a conceptual description of a novel bioinformatically detected of the present invention, referred to here as Genomic Address Messenger 134 (GAM134), which modulates expression of respective target genes thereof, the function and utility of which target genes is known in the art.

GAM134 is a novel bioinformatically detected regulatory, non protein coding, micro RNA (miRNA) gene. The method by which GAM134 was detected is described hereinabove with reference to FIGS. 8-15.

GAM134 gene, herein designated GAM GENE, and GAM134 target gene, herein designated TARGET GENE, are human genes contained in the human genome.

GAM134 gene encodes a GAM134 precursor RNA, herein designated GAM PRECURSOR RNA. Similar to other miRNA genes, and unlike most ordinary genes, GAM134 precursor RNA does not encode a protein. A nucleotide sequence identical or highly similar to the nucleotide sequence of GAM134 precursor RNA is designated SEQ ID:45, and is provided hereinbelow with reference to the sequence listing part.

GAM134 precursor RNA folds onto itself, forming GAM134 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM134 precursor RNA folds onto itself, forming GAM134 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM134 precursor RNA, designated SEQ-ID:45, and a schematic representation of a predicted secondary folding of GAM134 folded precursor RNA are further described with reference to Table 2, hereby incorporated by reference.

An enzyme complex designated DICER COMPLEX, 'dices' the GAM134 folded precursor RNA into GAM134 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM134 RNA is designated SEQ ID:339, and is provided hereinbelow with references to the sequence listing part and Table 3, hereby incorporated by reference.

GAM134 target gene, herein designated TARGET GENE, encodes a corresponding messenger RNA, GAM134 target RNA, herein designated GAM TARGET RNA. GAM134 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM134 RNA, herein designated GAM RNA, binds complementarily to one or more target binding sites located in untranslated regions of GAM134 target RNA, herein designated GAM TARGET RNA. This complementary binding is due to the fact that the nucleotide sequence of GAM134 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM134 RNA may have a different number of target binding sites in untranslated regions of a GAM134 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM134 RNA, herein designated GAM RNA, to target binding sites on GAM134 target RNA, herein designated GAM TARGET RNA, such as BINDING SITE I, BINDING SITE II and BINDING SITE III, inhibits translation of GAM134 target RNA into GAM134 target protein, herein designated GAM TARGET PROTEIN. GAM target protein is therefore outlined by a broken line.

It is appreciated that GAM134 target gene, herein designated TARGET GENE, in fact represents a plurality of GAM134 target genes. The mRNA of each one of this plurality of GAM134 target genes comprises one or more target binding sites, each having a nucleotide sequence which is at least partly complementary to GAM134 RNA, herein designated GAM RNA, and which when bound by GAM134 RNA causes inhibition of translation of respective one or more GAM134 target proteins.

It is further appreciated by one skilled in the art that the mode of translational inhibition illustrated by FIG. 8 with specific reference to translational inhibition exerted by GAM134 gene, herein designated GAM GENE, on one or more GAM134 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM134 correlate with, and may be deduced from, the identity of the target genes which GAM134 binds and inhibits, and the function of these target genes, as elaborated hereinbelow.

FLJ12876 (Accession) is a GAM134 target gene, herein designated TARGET GENE. FLJ12876 BINDING SITE is a target binding site found in the 3' untranslated region of mRNA encoded by FLJ12876, corresponding to a target binding site such as BINDING SITE I, BINDING SITE II or BINDING SITE III of FIG. 8. Table 4 illustrates the complementarity of the nucleotide sequences of FLJ12876 BINDING SITE, designated SEQ ID:19411, to the nucleotide sequence of GAM134 RNA, herein designated GAM RNA, also designated SEQ ID:339.

A function of GAM134 is therefore inhibition of FLJ12876 (Accession). Accordingly, utilities of GAM134 include diagnosis, prevention and treatment of diseases and clinical conditions associated with FLJ12876.

FLJ13842 (Accession NM_024645.1) is another GAM134 target gene, herein designated TARGET GENE. FLJ13842 BINDING SITE is a target binding site found in the 3' untranslated region of mRNA encoded by FLJ13842, corresponding to a target binding site such as BINDING SITE I, BINDING SITE II or BINDING SITE III of FIG. 8. Table 4 illustrates the complementarity of the nucleotide sequences of FLJ13842 BINDING SITE, designated SEQ ID:3226, to the nucleotide sequence of GAM134 RNA, herein designated GAM RNA, also designated SEQ ID:339.

Another function of GAM134 is therefore inhibition of FLJ13842 (Accession NM_024645.1). Accordingly, utilities of GAM134 include diagnosis, prevention and treatment of diseases and clinical conditions associated with FLJ13842.

Interleukin 18 receptor accessory protein (IL18RAP, Accession NM_003853.2) is another GAM134 target gene, herein designated TARGET GENE. IL18RAP BINDING SITE is a target binding site found in the 5' untranslated region of mRNA encoded by IL18RAP, corresponding to a target binding site such as BINDING SITE I, BINDING SITE II or BINDING SITE III of FIG. 8. Table 4 illustrates the complementarity of the nucleotide sequences of IL18RAP BINDING SITE, designated SEQ ID:3711, to the nucleotide sequence of GAM134 RNA, herein designated GAM RNA, also designated SEQ ID:339.

Another function of GAM134 is therefore inhibition of Interleukin 18 receptor accessory protein (IL18RAP, Accession NM_003853.2) . Accordingly, utilities of GAM134 include diagnosis, prevention and treatment of diseases and clinical conditions associated with IL18RAP.

LOC256380 (Accession XM_171128.2) is another GAM134 target gene, herein designated TARGET GENE. LOC256380 BINDING SITE is a target binding site found in the 5' untranslated region of mRNA encoded by LOC256380, corresponding to a target binding site such as BINDING SITE I, BINDING SITE II or BINDING SITE III of FIG. 8. Table 4 illustrates the complementarity of the nucleotide sequences of LOC256380 BINDING SITE, designated SEQ ID:19605, to the nucleotide sequence of GAM134 RNA, herein designated GAM RNA, also designated SEQ ID:339.

Another function of GAM134 is therefore inhibition of LOC256380 (Accession XM_171128.2). Accordingly, utilities of GAM134 include diagnosis, prevention and treatment of diseases and clinical conditions associated with LOC256380.

Mitogen-activated protein kinase kinase kinase 7 interacting protein 1 (MAP3K7IP1, Accession NM_006116.1) is another GAM134 target gene, herein designated TARGET GENE. MAP3K7IP1 BINDING SITE is a target binding site found in the 3' untranslated region of mRNA encoded by MAP3K7IP1, corresponding to a target binding site such as BINDING SITE I, BINDING SITE II or BINDING SITE III of FIG. 8. Table 4 illustrates the complementarity of the nucleotide sequences of MAP3K7IP1 BINDING SITE, designated SEQ ID:9771, to the nucleotide sequence of GAM134 RNA, herein designated GAM RNA, also designated SEQ ID:339.

Another function of GAM134 is therefore inhibition of Mitogen-activated protein kinase kinase kinase 7 interacting protein 1 (MAP3K7IP1, Accession NM_006116.1), a gene which may be an important signaling intermediate between tgfb receptors and map3k7/tak1. Accordingly, utilities of GAM134 include diagnosis, prevention and treatment of diseases and clinical conditions associated with MAP3K7IP1.

The function of MAP3K7IP1 and its association with various diseases and clinical conditions, has been established by previous studies, as described hereinabove with reference to GAM66.2. SCIN (Accession NM_033128.1) is another GAM134 target gene, herein designated TARGET GENE. SCIN BINDING SITE is a target binding site found in the 5' untranslated region of mRNA encoded by SCIN, corresponding to a target binding site such as BINDING SITE I, BINDING SITE II or BINDING SITE III of FIG. 8. Table 4 illustrates the complementarity of the nucleotide sequences of SCIN BINDING SITE, designated SEQ ID:6572, to the nucleotide sequence of GAM134 RNA, herein designated GAM RNA, also designated SEQ ID:339.

Another function of GAM134 is therefore inhibition of SCIN (Accession NM_033128.1). Accordingly, utilities of GAM134 include diagnosis, prevention and treatment of diseases and clinical conditions associated with SCIN.

Sh3-domain binding protein 2 (SH3BP2, Accession NM_003023.2) is another GAM134 target gene, herein designated TARGET GENE. SH3BP2 BINDING SITE is a target binding site found in the 3' untranslated region of mRNA encoded by SH3BP2, corresponding to a target binding site such as BINDING SITE I, BINDING SITE II or BINDING SITE III of FIG. 8. Table 4 illustrates the complementarity of the nucleotide sequences of SH3BP2 BINDING SITE, designated SEQ ID:4548, to the nucleotide sequence of GAM134 RNA, herein designated GAM RNA, also designated SEQ ID:339.

Another function of GAM134 is therefore inhibition of Sh3-domain binding protein 2 (SH3BP2, Accession NM_003023.2). Accordingly, utilities of GAM134 include diagnosis, prevention and treatment of diseases and clinical conditions associated with SH3BP2.

SOX30 (Accession NM_007017.1) is another GAM134 target gene, herein designated TARGET GENE. SOX30 BINDING SITE is a target binding site found in the 3' untranslated region of multiple transcripts of mRNA encoded by SOX30, corresponding to a target binding site such as BINDING SITE I, BINDING SITE II or BINDING SITE III of FIG. 8. Table 4 illustrates the complementarity of the nucleotide sequences of SOX30 BINDING SITE, designated SEQ ID:7345, to the nucleotide sequence of GAM134 RNA, herein designated GAM RNA, also designated SEQ ID:339.

Another function of GAM134 is therefore inhibition of SOX30 (Accession NM_007017.1). Accordingly, utilities of GAM134 include diagnosis, prevention and treatment of diseases and clinical conditions associated with SOX30.

FIG. 8 further provides a conceptual description of a novel bioinformatically detected of the present invention, referred to here as Genomic Address Messenger 135 (GAM135), which modulates expression of respective target genes thereof, the function and utility of which target genes is known in the art.

GAM135 is a novel bioinformatically detected regulatory, non protein coding, micro RNA (miRNA) gene. The method by which GAM135 was detected is described hereinabove with reference to FIGS. 8-15.

GAM135 gene, herein designated GAM GENE, and GAM135 target gene, herein designated TARGET GENE, are human genes contained in the human genome.

GAM135 gene encodes a GAM135 precursor RNA, herein designated GAM PRECURSOR RNA. Similar to other miRNA genes, and unlike most ordinary genes, GAM135 precursor RNA does not encode a protein. A nucleotide sequence identical or highly similar to the nucleotide sequence of GAM135 precursor RNA is designated SEQ ID:142, and is provided hereinbelow with reference to the sequence listing part. Nucleotide sequence SEQ ID:142 is located at position 88359935 relative to chromosome 15.

GAM135 precursor RNA folds onto itself, forming GAM135 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM135 precursor RNA folds onto itself, forming GAM135 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM135 precursor RNA, designated SEQ-ID:142, and a schematic representation of a predicted secondary folding of GAM135 folded precursor RNA are further described with reference to Table 2, hereby incorporated by reference.

An enzyme complex designated DICER COMPLEX, 'dices' the GAM135 folded precursor RNA into GAM135 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM135 RNA is designated SEQ ID:248, and is provided hereinbelow with references to the sequence listing part and Table 3, hereby incorporated by reference.

GAM135 target gene, herein designated TARGET GENE, encodes a corresponding messenger RNA, GAM135 target RNA, herein designated GAM TARGET RNA. GAM135 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM135 RNA, herein designated GAM RNA, binds complementarily to one or more target binding sites located in untranslated regions of GAM135 target RNA, herein designated GAM TARGET RNA. This complementary binding is due to the fact that the nucleotide sequence of GAM135 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM135 RNA may have a different number of target binding sites in untranslated regions of a GAM135 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM135 RNA, herein designated GAM RNA, to target binding sites on GAM135 target RNA, herein designated GAM TARGET RNA, such as BINDING SITE I, BINDING SITE II and BINDING SITE III, inhibits translation of GAM135 target RNA into GAM135 target protein, herein designated GAM TARGET PROTEIN. GAM target protein is therefore outlined by a broken line.

It is appreciated that GAM135 target gene, herein designated TARGET GENE, in fact represents a plurality of GAM135 target genes. The mRNA of each one of this plurality of GAM135 target genes comprises one or more target binding sites, each having a nucleotide sequence which is at least partly complementary to GAM135 RNA, herein designated GAM RNA, and which when bound by GAM135 RNA causes inhibition of translation of respective one or more GAM135 target proteins.

It is further appreciated by one skilled in the art that the mode of translational inhibition illustrated by FIG. 8 with specific reference to translational inhibition exerted by GAM135 gene, herein designated GAM GENE, on one or more GAM135 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM135 correlate with, and may be deduced from, the identity of the target genes which GAM135 binds and inhibits, and the function of these target genes, as elaborated hereinbelow.

Hematopoietic protein 1 (HEM1, Accession NM_005337.1) is a GAM135 target gene, herein designated TARGET GENE. HEM1 BINDING SITE is a target binding site found in the 5' untranslated region of mRNA encoded by HEM1, corresponding to a target binding site such as BINDING SITE I, BINDING SITE II or BINDING SITE III of FIG. 8. Table 4 illustrates the complementarity of the nucleotide sequences of HEM1 BINDING SITE, designated SEQ ID:11852, to the nucleotide sequence of GAM135 RNA, herein designated GAM RNA, also designated SEQ ID:248.

A function of GAM135 is therefore inhibition of Hematopoietic protein 1 (HEM1, Accession NM_005337.1). Accordingly, utilities of GAM135 include diagnosis, prevention and treatment of diseases and clinical conditions associated with HEM1.

KIAA0652 (Accession NM_014741.1) is another GAM135 target gene, herein designated TARGET GENE. KIAA0652 BINDING SITE is a target binding site found in the 5' untranslated region of mRNA encoded by KIAA0652, corresponding to a target binding site such as BINDING SITE I, BINDING SITE II or BINDING SITE III of FIG. 8. Table 4 illustrates the complementarity of the nucleotide sequences of KIAA0652 BINDING SITE, designated SEQ ID:11853, to the nucleotide sequence of GAM135 RNA, herein designated GAM RNA, also designated SEQ ID:248.

Another function of GAM135 is therefore inhibition of KIAA0652 (Accession NM_014741.1). Accordingly, utilities of GAM135 include diagnosis, prevention and treatment of diseases and clinical conditions associated with KIAA0652.

Sema domain, immunoglobulin domain (ig), transmembrane domain (tm) and short cytoplasmic domain, (semaphorin) 4b (SEMA4B, Accession XM_044533.9) is another GAM135 target gene, herein designated TARGET GENE. SEMA4B BINDING SITE is a target binding site found in the 3' untranslated region of multiple transcripts of mRNA encoded by SEMA4B, corresponding to a target binding site such as BINDING SITE I, BINDING SITE II or BINDING SITE III of FIG. 8. Table 4 illustrates the complementarity of the nucleotide sequences of SEMA4B BINDING SITE, designated SEQ ID:1258, to the nucleotide sequence of GAM135 RNA, herein designated GAM RNA, also designated SEQ ID:248.

Another function of GAM135 is therefore inhibition of Sema domain, immunoglobulin domain (ig), transmembrane domain (tm) and short cytoplasmic domain, (semaphorin) 4b (SEMA4B, Accession XM_044533.9). Accordingly, utilities of GAM135 include diagnosis, prevention and treatment of diseases and clinical conditions associated with SEMA4B.

FIG. 8 further provides a conceptual description of a novel bioinformatically detected of the present invention, referred to here as Genomic Address Messenger 136 (GAM136), which modulates expression of respective target genes thereof, the function and utility of which target genes is known in the art.

GAM136 is a novel bioinformatically detected regulatory, non protein coding, micro RNA (miRNA) gene. The method by which GAM136 was detected is described hereinabove with reference to FIGS. 8-15.

GAM136 gene, herein designated GAM GENE, and GAM136 target gene, herein designated TARGET GENE, are human genes contained in the human genome.

GAM136 gene encodes a GAM136 precursor RNA, herein designated GAM PRECURSOR RNA. Similar to other miRNA genes, and unlike most ordinary genes, GAM136 precursor RNA does not encode a protein. A nucleotide sequence identical or highly similar to the nucleotide sequence of GAM136 precursor RNA is designated SEQ ID:159, and is provided hereinbelow with reference to the sequence listing part.

GAM136 precursor RNA folds onto itself, forming GAM136 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM136 precursor RNA folds onto itself, forming GAM136 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM136 precursor RNA, designated SEQ-ID:159, and a schematic representation of a predicted secondary folding of GAM136 folded precursor RNA are further described with reference to Table 2, hereby incorporated by reference.

An enzyme complex designated DICER COMPLEX, 'dices' the GAM136 folded precursor RNA into GAM136 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM136 RNA is designated SEQ ID:279, and is provided hereinbelow with references to the sequence listing part and Table 3, hereby incorporated by reference.

GAM136 target gene, herein designated TARGET GENE, encodes a corresponding messenger RNA, GAM136 target RNA, herein designated GAM TARGET RNA. GAM136 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM136 RNA, herein designated GAM RNA, binds complementarily to one or more target binding sites located in untranslated regions of GAM136 target RNA, herein designated GAM TARGET RNA. This complementary binding is due to the fact that the nucleotide sequence of GAM136 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM136 RNA may have a different number of target binding sites in untranslated regions of a GAM136 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM136 RNA, herein designated GAM RNA, to target binding sites on GAM136 target RNA, herein designated GAM TARGET RNA, such as BINDING SITE I, BINDING SITE II and BINDING SITE III, inhibits translation of GAM136 target RNA into GAM136 target protein, herein designated GAM TARGET PROTEIN. GAM target protein is therefore outlined by a broken line.

It is appreciated that GAM136 target gene, herein designated TARGET GENE, in fact represents a plurality of GAM136 target genes. The mRNA of each one of this plurality of GAM136 target genes comprises one or more target binding sites, each having a nucleotide sequence which is at least partly complementary to GAM136 RNA, herein designated GAM RNA, and which when bound by GAM136 RNA causes inhibition of translation of respective one or more GAM136 target proteins.

It is further appreciated by one skilled in the art that the mode of translational inhibition illustrated by FIG. 8 with specific reference to translational inhibition exerted by GAM136 gene, herein designated GAM GENE, on one or more GAM136 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM136 correlate with, and may be deduced from, the identity of the target genes which GAM136 binds and inhibits, and the function of these target genes, as elaborated hereinbelow.

AAK1 (Accession NM_014911.2) is a GAM136 target gene, herein designated TARGET GENE. AAK1 BINDING SITE is a target binding site found in the 3' untranslated region of mRNA encoded by AAK1, corresponding to a target binding site such as BINDING SITE I, BINDING SITE II or BINDING SITE III of FIG. 8. Table 4 illustrates the complementarity of the nucleotide sequences of AAK1 BINDING SITE, designated SEQ ID:3779, to the nucleotide sequence of GAM136 RNA, herein designated GAM RNA, also designated SEQ ID:279.

A function of GAM136 is therefore inhibition of AAK1 (Accession NM_014911.2). Accordingly, utilities of GAM136 include diagnosis, prevention and treatment of diseases and clinical conditions associated with AAK1.

ABLIM (Accession) is another GAM136 target gene, herein designated TARGET GENE. ABLIM BINDING SITE is a target binding site found in the 3' untranslated region of mRNA encoded by ABLIM, corresponding to a target binding site such as BINDING SITE I, BINDING SITE II or BINDING SITE III of FIG. 8. Table 4 illustrates the complementarity of the nucleotide sequences of ABLIM BINDING SITE, designated SEQ ID:19479, to the nucleotide sequence of GAM136 RNA, herein designated GAM RNA, also designated SEQ ID:279.

Another function of GAM136 is therefore inhibition of ABLIM (Accession) . Accordingly, utilities of GAM136 include diagnosis, prevention and treatment of diseases and clinical conditions associated with ABLIM.

Acyl-coenzyme a dehydrogenase, short/branched chain (ACADSB, Accession NM_001609.1) is another GAM136 target gene, herein designated TARGET GENE. ACADSB BINDING SITE is a target binding site found in the 3' untranslated region of mRNA encoded by ACADSB, corresponding to a target binding site such as BINDING SITE I, BINDING SITE II or BINDING SITE III of FIG. 8. Table 4 illustrates the complementarity of the nucleotide sequences of ACADSB BINDING SITE, designated SEQ ID:15884, to the nucleotide sequence of GAM136 RNA, herein designated GAM RNA, also designated SEQ ID:279.

Another function of GAM136 is therefore inhibition of Acyl-coenzyme a dehydrogenase, short/branched chain (ACADSB, Accession NM_001609.1). Accordingly, utilities of GAM136 include diagnosis, prevention and treatment of diseases and clinical conditions associated with ACADSB.

Adenylate cyclase 6 (ADCY6, Accession NM_020983.2) is another GAM136 target gene, herein designated TARGET GENE. ADCY6 BINDING SITE is a target binding site found in the 5' untranslated region of multiple transcripts of mRNA encoded by ADCY6, corresponding to a target binding site such as BINDING SITE I, BINDING SITE II or BINDING SITE III of FIG. 8. Table 4 illustrates the complementarity of the nucleotide sequences of ADCY6 BINDING SITE, designated SEQ ID:17168, to the nucleotide sequence of GAM136 RNA, herein designated GAM RNA, also designated SEQ ID:279.

Another function of GAM136 is therefore inhibition of Adenylate cyclase 6 (ADCY6, Accession NM_020983.2), a gene which this a membrane-bound, ca(2+)-inhibitable adenylyl cyclase (by similarity). Accordingly, utilities of GAM136 include diagnosis, prevention and treatment of diseases and clinical conditions associated with ADCY6.

The function of ADCY6 and its association with various diseases and clinical conditions, has been established by previous studies, as described hereinabove with reference to GAM67.2. Aryl hydrocarbon receptor (AHR, Accession NM_001621.2) is another GAM136 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:4473, to the nucleotide sequence of GAM136 RNA, herein designated GAM RNA, also designated SEQ ID:279.

Another function of GAM136 is therefore inhibition of Aryl hydrocarbon receptor (AHR, Accession NM_001621.2), a gene which plays a role in modulating carcinogenesis through the induction of xenobiotic-metabolizing enzymes and therefore may be associated with Stomach tumors. Accordingly, utilities of GAM136 include diagnosis, prevention and treatment of Stomach tumors, and of other diseases and clinical conditions associated with AHR.

The function of AHR and its association with various diseases and clinical conditions, has been established by previous studies, as described hereinabove with reference to GAM30.1. Absent in melanoma 1 (AIM1, Accession XM_166300.1) is another GAM136 target gene, herein designated TARGET GENE. AIM1 BINDING SITE is a target binding site found in the 3' untranslated region of mRNA encoded by AIM1, corresponding to a target binding site such as BINDING SITE I, BINDING SITE II or BINDING SITE III of FIG. 8. Table 4 illustrates the complementarity of the nucleotide sequences of AIM1 BINDING SITE, designated SEQ ID:19229, to the nucleotide sequence of GAM136 RNA, herein designated GAM RNA, also designated SEQ ID:279.

Another function of GAM136 is therefore inhibition of Absent in melanoma 1 (AIM1, Accession XM_166300.1), a gene which is altered in association with tumor suppression in a model of human melanoma and therefore may be associated with Malignant melanoma. Accordingly, utilities of GAM136 include diagnosis, prevention and treatment of Malignant melanoma, and of other diseases and clinical conditions associated with AIM1.

The function of AIM1 has been established by previous studies. Chromosomal segregation during mitosis as well as meiosis is regulated by kinases and phosphatases. The Drosophila 'aurora' and S. cerevisiae Ipl1 serine/threonine protein kinases (STKs) are involved in mitotic events such as centrosome separation and chromosome segregation. Using a degenerate primer-based PCR method to screen for novel STKs, Shindo et al. (1998) isolated mouse and human cDNAs encoding STK12, which they termed ARK2 (aurora-related kinase-2). Sequence analysis of human STK12 predicted a 344-amino acid protein containing kinase domains that share high homology with the catalytic domains of other STKs. Cell cycle and Northern blot analyses showed that STK12 is expressed in the S phase and persistently thereafter. Western blot analysis indicated that STK12 is localized in the midbodies during anaphase. By FISH and radiation hybrid analysis, Kimura et al. (1998) mapped the STK12 gene to 17p13.1. Tatsuka et al. (1998) noted that the STK12 gene is localized in a region that is frequently deleted in tumors and that contains tumor-related genes such as p53 (OMIM Ref. No. 191170), CRK (OMIM Ref. No. 164762), and ABR (OMIM Ref. No. 600365). Using interspecific backcross mapping, Shindo et al. (1998) mapped the mouse Stk12 gene to chromosome 11 in a region showing homology of synteny with human 17p.

Full details of the abovementioned studies are described in the following publications, the disclosure of which are hereby incorporated by reference:

Shindo, M.; Nakano, H.; Kuroyanagi, H.; Shirasawa, T.; Mihara, M.; Gilbert, D. J.; Jenkins, N. A.; Copeland, N. G.; Yagita, H.; Okumura, K.: cDNA cloning, expression, subcellular localization, and chromosomal assignment of mammalian aurora homologues, aurora-related kinase (ARK) 1 and 2. Biochem. Biophys. Res. Commun. 244:285-292, 1998; and Kimura, M.; Matsuda, Y.; Yoshioka, T.; Sumi, N.; Okano, Y.: Identification and characterization of STK12/Aik2: a human gene related to aurora of Drosophila and yeast IPL1. Cytogenet. Ce.

Further studies establishing the function and utilities of AIM1 are found in John Hopkins OMIM database record ID 606202, and in cited publications listed in Table 5, which are hereby incorporated by reference. APM1 (Accession NM_004797.1) is another GAM136 target gene, herein designated TARGET GENE. APM1 BINDING SITE1 and APM1 BINDING SITE2 are target binding sites found in untranslated regions of mRNA encoded by APM1, corresponding to target binding sites such as BINDING SITE I, BINDING SITE II or BINDING SITE III of FIG. 8. Table 4 illustrates the complementarity of the nucleotide sequences of APM1 BINDING SITE1 and APM1 BINDING SITE2, designated SEQ ID:10876 and SEQ ID:1915 respectively, to the nucleotide sequence of GAM136 RNA, herein designated GAM RNA, also designated SEQ ID:279.

Another function of GAM136 is therefore inhibition of APM1 (Accession NM_004797.1). Accordingly, utilities of GAM136 include diagnosis, prevention and treatment of diseases and clinical conditions associated with APM1.

Apolipoprotein l, 2 (APOL2, Accession NM_145637.1) is another GAM136 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:3227, to the nucleotide sequence of GAM136 RNA, herein designated GAM RNA, also designated SEQ ID:279.

Another function of GAM136 is therefore inhibition of Apolipoprotein l, 2 (APOL2, Accession NM_145637.1). Accordingly, utilities of GAM136 include diagnosis, prevention and treatment of diseases and clinical conditions associated with APOL2.

Amyloid beta precursor protein (cytoplasmic tail) binding protein 2 (APPBP2, Accession NM_006380.2) is another GAM136 target gene, herein designated TARGET GENE. APPBP2 BINDING SITE is a target binding site found in the 3' untranslated region of mRNA encoded by APPBP2, corresponding to a target binding site such as BINDING SITE I, BINDING SITE II or BINDING SITE III of FIG. 8. Table 4 illustrates the complementarity of the nucleotide sequences of APPBP2 BINDING SITE, designated SEQ ID:15503, to the nucleotide sequence of GAM136 RNA, herein designated GAM RNA, also designated SEQ ID:279.

Another function of GAM136 is therefore inhibition of Amyloid beta precursor protein (cytoplasmic tail) binding protein 2 (APPBP2, Accession NM_006380.2), a gene which interacts with the basolateral sorting signal of amyloid precursor protein. and therefore may be associated with Alzheimer's disease. Accordingly, utilities of GAM136 include diagnosis, prevention and treatment of Alzheimer's disease, and of other diseases and clinical conditions associated with APPBP2.

The function of APPBP2 and its association with various diseases and clinical conditions, has been established by previous studies, as described hereinabove with reference to GAM130.1. APXL2 (Accession) is another GAM136 target gene, herein designated TARGET GENE. APXL2 BINDING SITE is a target binding site found in the 5' untranslated region of mRNA encoded by APXL2, corresponding to a target binding site such as BINDING SITE I, BINDING SITE II or BINDING SITE III of FIG. 8. Table 4 illustrates the complementarity of the nucleotide sequences of APXL2 BINDING SITE, designated SEQ ID:12429, to the nucleotide sequence of GAM136 RNA, herein designated GAM RNA, also designated SEQ ID:279.

Another function of GAM136 is therefore inhibition of APXL2 (Accession). Accordingly, utilities of GAM136 include diagnosis, prevention and treatment of diseases and clinical conditions associated with APXL2.

Ras homolog gene family, member f (in filopodia) (ARHF, Accession NM_019034.1) is another GAM136 target gene, herein designated TARGET GENE. ARHF BINDING SITE is a target binding site found in the 5' untranslated region of mRNA encoded by ARHF, corresponding to a target binding site such as BINDING SITE I, BINDING SITE II or BINDING SITE III of FIG. 8. Table 4 illustrates the complementarity of the nucleotide sequences of ARHF BINDING SITE, designated SEQ ID:10691, to the nucleotide sequence of GAM136 RNA, herein designated GAM RNA, also designated SEQ ID:279.

Another function of GAM136 is therefore inhibition of Ras homolog gene family, member f (in filopodia) (ARHF, Accession NM_019034.1). Accordingly, utilities of GAM136 include diagnosis, prevention and treatment of diseases and clinical conditions associated with ARHF.

Ankyrin repeat and socs box-containing 16 (ASB16, Accession NM_080863.4) is another GAM136 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:16106, to the nucleotide sequence of GAM136 RNA, herein designated GAM RNA, also designated SEQ ID:279.

Another function of GAM136 is therefore inhibition of Ankyrin repeat and socs box-containing 16 (ASB16, Accession NM_080863.4) . Accordingly, utilities of GAM136 include diagnosis, prevention and treatment of diseases and clinical conditions associated with ASB16.

Atpase, h+transporting, lysosomal 70 kda, v1 subunit a, isoform 1 (ATP6V1A1, Accession NM_001690.2) is another GAM136 target gene, herein designated TARGET GENE. ATP6V1A1 BINDING SITE is a target binding site found in the 5' untranslated region of mRNA encoded by ATP6V1A1, corresponding to a target binding site such as BINDING SITE I, BINDING SITE II or BINDING SITE III of FIG. 8. Table 4 illustrates the complementarity of the nucleotide sequences of ATP6V1A1 BINDING SITE, designated SEQ ID:2154, to the nucleotide sequence of GAM136 RNA, herein designated GAM RNA, also designated SEQ ID:279.

Another function of GAM136 is therefore inhibition of Atpase, h+transporting, lysosomal 70 kda, v1 subunit a, isoform 1 (ATP6V1A1, Accession NM_001690.2), a gene which is responsible for acidifying a variety of intracellular compartments in eukaryotic cells. Accordingly, utilities of GAM136 include diagnosis, prevention and treatment of diseases and clinical conditions associated with ATP6V1A1.

The function of ATP6V1A1 has been established by previous studies. Van Hille et al. (1993) cloned a partial cDNA clone for an A subunit isoform, which they designated VA68, from a human osteoclastoma tumor cDNA library by PCR using degenerate primers based on the bovine sequence. They obtained a full-length clone from a genomic library. The deduced 617-amino acid protein has a predicted molecular mass of about 68 kD and shows 99% sequence identity with the bovine brain subunit A. Northern blot analysis revealed ubiquitous expression of a major 4.8-kb band and a minor 3.4-kb band. They also identified a variant, which they designated HO68, encoding a 615-amino acid protein. By RNase protection assays and in situ hybridization, van Hille et al. (1995) determined that expression of the HO68 variant was specific to the osteoclastoma originally used to construct the cDNA library.

Full details of the abovementioned studies are described in the following publications, the disclosure of which are hereby incorporated by reference:

van Hille, B.; Richener, H.; Evans, D. B.; Green, J. R.; Bilbe, G.: Identification of two subunit A isoforms of the vacuolar H(+)-ATPase in human osteoclastoma. J. Biol. Chem. 268:7075-7080, 1993; and van Hille, B.; Richener, H.; Green, J. R.; Bilbe, G.: The ubiquitous VA68 isoform of subunit A of the vacuolar H(+)-ATPase is highly expressed in human osteoclasts. Biochem. Biophys.

Further studies establishing the function and utilities of ATP6V1A1 are found in John Hopkins OMIM database record ID 607027, and in cited publications listed in Table 5, which are hereby incorporated by reference. Atpase, cu++ transporting, alpha polypeptide (menkes syndrome) (ATP7A, Accession NM_000052.1) is another GAM136 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:12838, to the nucleotide sequence of GAM136 RNA, herein designated GAM RNA, also designated SEQ ID:279.

Another function of GAM136 is therefore inhibition of Atpase, cu++ transporting, alpha polypeptide (menkes syndrome) (ATP7A, Accession NM_000052.1). Accordingly, utilities of GAM136 include diagnosis, prevention and treatment of diseases and clinical conditions associated with ATP7A.

Atpase, class i, type 8b, member 2 (ATP8B2, Accession XM_290875.1) is another GAM136 target gene, herein designated TARGET GENE. ATP8B2 BINDING SITE is a target binding site found in the 5' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:8818, to the nucleotide sequence of GAM136 RNA, herein designated GAM RNA, also designated SEQ ID:279.

Another function of GAM136 is therefore inhibition of Atpase, class i, type 8b, member 2 (ATP8B2, Accession XM_290875.1). Accordingly, utilities of GAM136 include diagnosis, prevention and treatment of diseases and clinical conditions associated with ATP8B2.

Udp-gal:betaglcnac beta 1,4-galactosyltransferase, polypeptide 5 (B4GALT5, Accession NM_004776.2) is another GAM136 target gene, herein designated TARGET GENE. B4GALT5 BINDING SITE is a target binding site found in the 3' untranslated region of mRNA encoded by B4GALT5, corresponding to a target binding site such as BINDING SITE I, BINDING SITE II or BINDING SITE III of FIG. 8. Table 4 illustrates the complementarity of the nucleotide sequences of B4GALT5 BINDING SITE, designated SEQ ID:16556, to the nucleotide sequence of GAM136 RNA, herein designated GAM RNA, also designated SEQ ID:279.

Another function of GAM136 is therefore inhibition of Udp-gal:betaglcnac beta 1,4-galactosyltransferase, polypeptide 5 (B4GALT5, Accession NM_004776.2). Accordingly, utilities of GAM136 include diagnosis, prevention and treatment of diseases and clinical conditions associated with B4GALT5.

BA108L7.2 (Accession NM_030971.1) is another GAM136 target gene, herein designated TARGET GENE. BA108L7.2 BINDING SITE is a target binding site found in the 5' untranslated region of mRNA encoded by BA108L7.2, corresponding to a target binding site such as BINDING SITE I, BINDING SITE II or BINDING SITE III of FIG. 8. Table 4 illustrates the complementarity of the nucleotide sequences of BA108L7.2 BINDING SITE, designated SEQ ID:411, to the nucleotide sequence of GAM136 RNA, herein designated GAM RNA, also designated SEQ ID:279.

Another function of GAM136 is therefore inhibition of BA108L7.2 (Accession NM_030971.1). Accordingly, utilities of GAM136 include diagnosis, prevention and treatment of diseases and clinical conditions associated with BA108L7.2.

B-cell cll/lymphoma 10 (BCL10, Accession NM_003921.2) is another GAM136 target gene, herein designated TARGET GENE. BCL10 BINDING SITE is a target binding site found in the 3' untranslated region of mRNA encoded by BCL10, corresponding to a target binding site such as BINDING SITE I, BINDING SITE II or BINDING SITE III of FIG. 8. Table 4 illustrates the complementarity of the nucleotide sequences of BCL10 BINDING SITE, designated SEQ ID:5479, to the nucleotide sequence of GAM136 RNA, herein designated GAM RNA, also designated SEQ ID:279.

Another function of GAM136 is therefore inhibition of B-cell cll/lymphoma 10 (BCL10, Accession NM_003921.2), a gene which is a positive regulator of lymphocyte proliferation, NF-kappaB activator, and therefore may be associated with Malt lymphoma, follicular lymphoma. Accordingly, utilities of GAM136 include diagnosis, prevention and treatment of Malt lymphoma, follicular lymphoma, and of other diseases and clinical conditions associated with BCL10.

The function of BCL10 has been established by previous studies. B-cell lymphomas of mucosa-associated lymphoid tissue (MALT lymphomas) are the most common form of lymphoma arising in extranodal sites, in most cases arising in the gastric mucosa (Isaacson and Spencer, 1995). Cytogenetic studies of low-grade malignant MALT lymphoma identified abnormalities of chromosome 1p22, in particular translocation t(1;14)(p22;q32), as uncommon but recurrent events (Wotherspoon et al., 1992). Willis et al. (1999) cloned a t(1;14)(p22;q32) translocation breakpoint from a case of low-grade MALT lymphoma and identified a recurrent breakpoint upstream of the promoter of a novel gene, BCL10. The BCL10 gene encodes a predicted protein of 233 amino acids and is a cellular homolog of the equine herpesvirus-2 gene (E10); both contain an amino-terminal caspase recruitment domain (CARD) homologous to that found in several apoptotic molecules. BCL10 was found to be expressed as a transcript of 4.2 kb in all normal and malignant tissues examined. BCL10 and E10 activated nuclear factor kappa-B (NFKB; 164011) but caused apoptosis of 293 cells. BCL10 expressed in a MALT lymphoma exhibited a frameshift mutation resulting in truncation distal to the CARD. Truncated BCL10 activated NFKB but did not induce apoptosis. Wildtype BCL10 suppressed transformation, whereas mutant forms had lost this activity and displayed gain-of-function transforming activity.

Animal model experiments lend further support to the function of BCL10. Ruland et al. (2001) showed that one-third of Bcl10 -/-mouse embryos developed exencephaly, leading to embryonic lethality. Surprisingly, Bcl10 - /-cells retained susceptibility to various apoptotic stimuli in vivo and in vitro. However, surviving Bcl10 -/- mice were severely immunodeficient, and Bcl10 -/-lymphocytes were defective in antigen receptor or phorbol myristate acetate (PMA)/ionomycin-induced activation. Early tyrosine phosphorylation, mitogen-activated protein kinase (MAPK; OMIM Ref. No. 604921) and activator protein-1 (AP1; 165160) activation, and calcium signaling were normal in mutant lymphocytes, but antigen receptor-induced NFKB activation was absent. Thus, the authors concluded that BCL10 functions as a positive regulator of lymphocyte proliferation that specifically connects antigen receptor signaling in B and T cells to NFKB activation.

It is appreciated that the abovementioned animal model for BCL10 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Willis, T. G.; Jadayel, D. M.; Du, M.-Q.; Peng, H.; Perry, A. R.; Abdul-Rauf, M.; Price, H.; Karran, L.; Majekodunmi, O.; Wlodarska, I.; Pan, L.; Crook, T.; Hamoudi, R.; Isaacson, P. G.; Dyer, M. J. S.: Bcl10 is involved in t(1;14)(p22;q32) of MALT B cell lymphoma and mutated in multiple tumor types Cell 96:35-45, 1999; and Ruland, J.; Duncan, G. S.; Elia, A.; del Barco Barrantes, I.; Nguyen, L.; Plyte, S.; Millar, D. G.; Bouchard, D.; Wakeham, A.; Ohashi, P. S.; Mak, T. W.: Bcl10 is a positive regulator.

Further studies establishing the function and utilities of BCL10 are found in John Hopkins OMIM database record ID 603517, and in cited publications listed in Table 5, which are hereby incorporated by reference. Bradykinin receptor b1 (BDKRB1, Accession NM_000710.2) is another GAM136 target gene, herein designated TARGET GENE. BDKRB1 BINDING SITE is a target binding site found in the 5' untranslated region of mRNA encoded by BDKRB1, corresponding to a target binding site such as BINDING SITE I, BINDING SITE II or BINDING SITE III of FIG. 8. Table 4 illustrates the complementarity of the nucleotide sequences of BDKRB1 BINDING SITE, designated SEQ ID:3577, to the nucleotide sequence of GAM136 RNA, herein designated GAM RNA, also designated SEQ ID:279.

Another function of GAM136 is therefore inhibition of Bradykinin receptor b1 (BDKRB1, Accession NM_000710.2), a gene which mediates intracellular calcium flux. Accordingly, utilities of GAM136 include diagnosis, prevention and treatment of diseases and clinical conditions associated with BDKRB1.

The function of BDKRB1 has been established by previous studies. where activation of B2 receptors causes pronounced hypotension, bronchoconstriction, pain, and inflammation. Menke et al. (1994) isolated a cDNA clone encoding a human B1 bradykinin receptor from a human embryonic lung fibroblast cDNA library by expression cloning. An open reading frame encoding a 353-amino acid protein with the characteristics of a G protein-coupled receptor was found. Its amino acid sequence was 36% identical to that of the B2 bradykinin receptor (OMIM Ref. No. 113503). The expressed receptor had the pharmacologic characteristics of the B1 receptor subtype. The B1 receptor is synthesized de novo following tissue injury and mediates hyperalgesia in animal models of chronic inflammation. Yang and Polgar (1996) isolated the human B1 bradykinin receptor gene from a human lung fibroblast genomic DNA library. They found 2 differences between their coding sequence and that which was obtained by Menke et al. (1994): an A- to - C exchange at nucleotide position 2897 leading to replacement of arginine- 246 with serine and a C- to - T exchange at position 3025 which converts serine-259 to phenylalanine. Using luciferase activity assay, Yang and Polgar (1996) found 2 promoters for the human BDKRB1 gene. The first is a 451-bp fragment located in the 5-prime flanking region and the second is a 812-bp fragment found in the intron II region. The intron II region promoter showed a 10-fold decrease in luciferase activity relative to the 5-prime flanking region promoter. Yang and Polgar (1996) mapped the transcriptional initiation site of the BDKRB1 gene at 21 bp downstream of the TATA box. This site is 12 bp longer than that of the 5-prime untranslated region sequence published by MacNeil et al. (1995). In addition, 2 inverted orientation Alu repeats were found in the BDKRB1 gene.

Full details of the abovementioned studies are described in the following publications, the disclosure of which are hereby incorporated by reference:

Menke, J. G.; Borkowski, J. A.; Bierilo, K. K.; MacNeil, T.; Derrick, A. W.; Schneck, K. A.; Ransom, R. W.; Strader, C. D.; Linemeyer, D. L.; Hess, J. F.: Expression cloning of a human B1 bradykinin receptor. J. Biol. Chem. 269:21583-21586, 1994; and Yang, X.; Polgar, P.: Genomic structure of the human bradykinin B(1) receptor gene and preliminary characterization of its regulatory regions. Biochem. Biophys. Res. Commun. 222:718-72.

Further studies establishing the function and utilities of BDKRB1 are found in John Hopkins OMIM database record ID 600337, and in cited publications listed in Table 5, which are hereby incorporated by reference. Butyrophilin, subfamily 3, member a1 (BTN3A1, Accession NM_007048.2) is another GAM136 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:17443, to the nucleotide sequence of GAM136 RNA, herein designated GAM RNA, also designated SEQ ID:279.

Another function of GAM136 is therefore inhibition of Butyrophilin, subfamily 3, member a1 (BTN3A1, Accession NM_007048.2). Accordingly, utilities of GAM136 include diagnosis, prevention and treatment of diseases and clinical conditions associated with BTN3A1.

Chromosome 14 open reading frame 1 (C14orf1, Accession NM_007176.1) is another GAM136 target gene, herein designated TARGET GENE. C14orf1 BINDING SITE is a target binding site found in the 3' untranslated region of mRNA encoded by C14orf1, corresponding to a target binding site such as BINDING SITE I, BINDING SITE II or BINDING SITE III of FIG. 8. Table 4 illustrates the complementarity of the nucleotide sequences of C14orf1 BINDING SITE, designated SEQ ID:15476, to the nucleotide sequence of GAM136 RNA, herein designated GAM RNA, also designated SEQ ID:279.

Another function of GAM136 is therefore inhibition of Chromosome 14 open reading frame 1 (C14orf1, Accession NM_007176.1). Accordingly, utilities of GAM136 include diagnosis, prevention and treatment of diseases and clinical conditions associated with C14orf1.

Chromosome 22 open reading frame 19 (C22orf19, Accession NM_003678.2) is another GAM136 target gene, herein designated TARGET GENE. C22orf19 BINDING SITE is a target binding site found in the 3' untranslated region of mRNA encoded by C22orf19, corresponding to a target binding site such as BINDING SITE I, BINDING SITE II or BINDING SITE III of FIG. 8. Table 4 illustrates the complementarity of the nucleotide sequences of C22orf19 BINDING SITE, designated SEQ ID:8914, to the nucleotide sequence of GAM136 RNA, herein designated GAM RNA, also designated SEQ ID:279.

Another function of GAM136 is therefore inhibition of Chromosome 22 open reading frame 19 (C22orf19, Accession NM_003678.2). Accordingly, utilities of GAM136 include diagnosis, prevention and treatment of diseases and clinical conditions associated with C22orf19.

Chromosome 5 open reading frame 4 (C5orf4, Accession NM_032385.1) is another GAM136 target gene, herein designated TARGET GENE. C5orf4 BINDING SITE is a target binding site found in the 5' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:7970, to the nucleotide sequence of GAM136 RNA, herein designated GAM RNA, also designated SEQ ID:279.

Another function of GAM136 is therefore inhibition of Chromosome 5 open reading frame 4 (C5orf4, Accession NM_032385.1). Accordingly, utilities of GAM136 include diagnosis, prevention and treatment of diseases and clinical conditions associated with C5orf4.

C6orf5 (Accession) is another GAM136 target gene, herein designated TARGET GENE. C6orf5 BINDING SITE is a target binding site found in the 3' untranslated region of mRNA encoded by C6orf5, corresponding to a target binding site such as BINDING SITE I, BINDING SITE II or BINDING SITE III of FIG. 8. Table 4 illustrates the complementarity of the nucleotide sequences of C6orf5 BINDING SITE, designated SEQ ID:18128, to the nucleotide sequence of GAM136 RNA, herein designated GAM RNA, also designated SEQ ID:279.

Another function of GAM136 is therefore inhibition of C6orf5 (Accession). Accordingly, utilities of GAM136 include diagnosis, prevention and treatment of diseases and clinical conditions associated with C6orf5.

Chromosome 9 open reading frame 9 (C9orf9, Accession NM_018956.2) is another GAM136 target gene, herein designated TARGET GENE. C9orf9 BINDING SITE is a target binding site found in the 3' untranslated region of mRNA encoded by C9orf9, corresponding to a target binding site such as BINDING SITE I, BINDING SITE II or BINDING SITE III of FIG. 8. Table 4 illustrates the complementarity of the nucleotide sequences of C9orf9 BINDING SITE, designated SEQ ID:8425, to the nucleotide sequence of GAM136 RNA, herein designated GAM RNA, also designated SEQ ID:279.

Another function of GAM136 is therefore inhibition of Chromosome 9 open reading frame 9 (C9orf9, Accession NM_018956.2). Accordingly, utilities of GAM136 include diagnosis, prevention and treatment of diseases and clinical conditions associated with C9orf9.

Caspase recruitment domain family, member 6 (CARD6, Accession NM_032587.2) is another GAM136 target gene, herein designated TARGET GENE. CARD6 BINDING SITE is a target binding site found in the 3' untranslated region of mRNA encoded by CARD6, corresponding to a target binding site such as BINDING SITE I, BINDING SITE II or BINDING SITE III of FIG. 8. Table 4 illustrates the complementarity of the nucleotide sequences of CARD6 BINDING SITE, designated SEQ ID:5983, to the nucleotide sequence of GAM136 RNA, herein designated GAM RNA, also designated SEQ ID:279.

Another function of GAM136 is therefore inhibition of Caspase recruitment domain family, member 6 (CARD6, Accession NM_032587.2) . Accordingly, utilities of GAM136 include diagnosis, prevention and treatment of diseases and clinical conditions associated with CARD6.

Ccr4 carbon catabolite repression 4-like (s. cerevisiae) (CCRN4L, Accession NM_012118.1) is another GAM136 target gene, herein designated TARGET GENE. CCRN4L BINDING SITE is a target binding site found in the 3' untranslated region of mRNA encoded by CCRN4L, corresponding to a target binding site such as BINDING SITE I, BINDING SITE II or BINDING SITE III of FIG. 8. Table 4 illustrates the complementarity of the nucleotide sequences of CCRN4L BINDING SITE, designated SEQ ID:1330, to the nucleotide sequence of GAM136 RNA, herein designated GAM RNA, also designated SEQ ID:279.

Another function of GAM136 is therefore inhibition of Ccr4 carbon catabolite repression 4-like (s. cerevisiae) (CCRN4L, Accession NM_012118.1). Accordingly, utilities of GAM136 include diagnosis, prevention and treatment of diseases and clinical conditions associated with CCRN4L.

Cdc14 cell division cycle 14 homolog b (s. cerevisiae) (CDC14B, Accession NM_033332.1) is another GAM136 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:13617, to the nucleotide sequence of GAM136 RNA, herein designated GAM RNA, also designated SEQ ID:279.

Another function of GAM136 is therefore inhibition of Cdc14 cell division cycle 14 homolog b (s. cerevisiae) (CDC14B, Accession NM_033332.1). Accordingly, utilities of GAM136 include diagnosis, prevention and treatment of diseases and clinical conditions associated with CDC14B.

Carcinoembryonic antigen-related cell adhesion molecule 8 (CEACAM8, Accession NM_001816.2) is another GAM136 target gene, herein designated TARGET GENE. CEACAM8 BINDING SITE is a target binding site found in the 3' untranslated region of mRNA encoded by CEACAM8, corresponding to a target binding site such as BINDING SITE I, BINDING SITE II or BINDING SITE III of FIG. 8. Table 4 illustrates the complementarity of the nucleotide sequences of CEACAM8 BINDING SITE, designated SEQ ID:3822, to the nucleotide sequence of GAM136 RNA, herein designated GAM RNA, also designated SEQ ID:279.

Another function of GAM136 is therefore inhibition of Carcinoembryonic antigen-related cell adhesion molecule 8 (CEACAM8, Accession NM_001816.2). Accordingly, utilities of GAM136 include diagnosis, prevention and treatment of diseases and clinical conditions associated with CEACAM8.

Chromatin accessibility complex 1 (CHRAC1, Accession NM_017444.3) is another GAM136 target gene, herein designated TARGET GENE. CHRAC1 BINDING SITE is a target binding site found in the 3' untranslated region of mRNA encoded by CHRAC1, corresponding to a target binding site such as BINDING SITE I, BINDING SITE II or BINDING SITE III of FIG. 8. Table 4 illustrates the complementarity of the nucleotide sequences of CHRAC1 BINDING SITE, designated SEQ ID:14719, to the nucleotide sequence of GAM136 RNA, herein designated GAM RNA, also designated SEQ ID:279.

Another function of GAM136 is therefore inhibition of Chromatin accessibility complex 1 (CHRAC1, Accession NM_017444.3). Accordingly, utilities of GAM136 include diagnosis, prevention and treatment of diseases and clinical conditions associated with CHRAC1.

C-type (calcium dependent, carbohydrate-recognition domain) lectin, superfamily member 12 (CLECSF12, Accession NM_022570.2) is another GAM136 target gene, herein designated TARGET GENE. CLECSF12 BINDING SITE1 and CLECSF12 BINDING SITE2 are target binding sites found in untranslated regions of mRNA encoded by CLECSF12, corresponding to target binding sites such as BINDING SITE I, BINDING SITE II or BINDING SITE III of FIG. 8. Table 4 illustrates the complementarity of the nucleotide sequences of CLECSF12 BINDING SITE1 and CLECSF12 BINDING SITE2, designated SEQ ID:14434 and SEQ ID:10748 respectively, to the nucleotide sequence of GAM136 RNA, herein designated GAM RNA, also designated SEQ ID:279.

Another function of GAM136 is therefore inhibition of C-type (calcium dependent, carbohydrate-recognition domain) lectin, superfamily member 12 (CLECSF12, Accession NM_022570.2), a gene which is a pattern-recognition receptor. Accordingly, utilities of GAM136 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. Calponin 2 (CNN2, Accession NM_004368.1) is another GAM136 target gene, herein designated TARGET GENE. CNN2 BINDING SITE is a target binding site found in the 5' untranslated region of mRNA encoded by CNN2, corresponding to a target binding site such as BINDING SITE I, BINDING SITE II or BINDING SITE III of FIG. 8. Table 4 illustrates the complementarity of the nucleotide sequences of CNN2 BINDING SITE, designated SEQ ID:7340, to the nucleotide sequence of GAM136 RNA, herein designated GAM RNA, also designated SEQ ID:279.

Another function of GAM136 is therefore inhibition of Calponin 2 (CNN2, Accession NM_004368.1), a gene which may be involved in the structural organization and/or anchorage of actin filaments. Accordingly, utilities of GAM136 include diagnosis, prevention and treatment of diseases and clinical conditions associated with CNN2.

The function of CNN2 has been established by previous studies. Masuda et al. (1996) cloned a cDNA encoding calponin-2 (CNN2) by screening a human heart cDNA library with a CNN1 (OMIM Ref. No. 600806) cDNA. The CNN2 protein is 94.8% identical to mouse calponin h2 (see OMIM Ref. No. 600806), indicating that these proteins are homologs. The predicted CNN2 protein has 309 amino acids and a pI of 7.1. It contains motifs that are present in CNN1 and CNN3 (OMIM Ref. No. 602374):3 tandem repeats of 29 amino acids, an actin-binding domain, a VAV (OMIM Ref. No. 164875)-homologous region, and 2 consensus phosphorylation sites for tyrosine kinase at the C terminus. The 3-prime untranslated region of the CNN2 mRNA contains an Alu repetitive sequence in the antisense direction. RT-PCR detected CNN2 transcripts in both cultured smooth muscle and nonmuscle cells and showed that mouse calponin h2 is expressed in embryonic and adult heart. CNN2 protein localizes to the cell- to - cell junctions of cardiomyocytes and codistributes with vinculin (OMIM Ref. No. 193065). Masuda et al. (1996) suggested that CNN2 may be involved in the structural organization and/or anchorage of actin filaments and may function in the cell adhesion mechanism Cheng et al. (1994) mapped the CNN2 gene to 21q11.1 by hybridization to chromosome 21q-specific YACs.

Full details of the abovementioned studies are described in the following publications, the disclosure of which are hereby incorporated by reference:

Masuda, H.; Tanaka, K.; Takagi, M.; Ohgami, K.; Sakamaki, T.; Shibata, N.; Takahashi, K.: Molecular cloning and characterization of human non-smooth muscle calponin. J. Biochem. 120:415-424, 1996; and Cheng, J.-F.; Boyartchuk, V.; Zhu, Y.: Isolation and mapping of human chromosome 21 cDNA: progress in constructing a chromosome 21 expression map. Genomics 23:75-84, 1994.

Further studies establishing the function and utilities of CNN2 are found in John Hopkins OMIM database record ID 602373, and in cited publications listed in Table 5, which are hereby incorporated by reference. Cleavage and polyadenylation specific factor 2, 100 kda (CPSF2, Accession XM_029311.2) is another GAM136 target gene, herein designated TARGET GENE. CPSF2 BINDING SITE is a target binding site found in the 3' untranslated region of mRNA encoded by CPSF2, corresponding to a target binding site such as BINDING SITE I, BINDING SITE II or BINDING SITE III of FIG. 8. Table 4 illustrates the complementarity of the nucleotide sequences of CPSF2 BINDING SITE, designated SEQ ID:5334, to the nucleotide sequence of GAM136 RNA, herein designated GAM RNA, also designated SEQ ID:279.

Another function of GAM136 is therefore inhibition of Cleavage and polyadenylation specific factor 2, 100 kda (CPSF2, Accession XM_029311.2). Accordingly, utilities of GAM136 include diagnosis, prevention and treatment of diseases and clinical conditions associated with CPSF2.

Complement component (3b/4b) receptor 1, including knops blood group system (CR1, Accession NM_000651.3) is another GAM136 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:17680, to the nucleotide sequence of GAM136 RNA, herein designated GAM RNA, also designated SEQ ID:279.

Another function of GAM136 is therefore inhibition of Complement component (3b/4b) receptor 1, including knops blood group system (CR1, Accession NM_000651.3). Accordingly, utilities of GAM136 include diagnosis, prevention and treatment of diseases and clinical conditions associated with CR1.

Cartilage associated protein (CRTAP, Accession NM_006371.2) is another GAM136 target gene, herein designated TARGET GENE. CRTAP BINDING SITE is a target binding site found in the 3' untranslated region of mRNA encoded by CRTAP, corresponding to a target binding site such as BINDING SITE I, BINDING SITE II or BINDING SITE III of FIG. 8. Table 4 illustrates the complementarity of the nucleotide sequences of CRTAP BINDING SITE, designated SEQ ID:18368, to the nucleotide sequence of GAM136 RNA, herein designated GAM RNA, also designated SEQ ID:279.

Another function of GAM136 is therefore inhibition of Cartilage associated protein (CRTAP, Accession NM_006371.2), a gene which is a novel developmentally regulated chick embryo protein. Accordingly, utilities of GAM136 include diagnosis, prevention and treatment of diseases and clinical conditions associated with CRTAP.

The function of CRTAP has been established by previous studies. Castagnola et al. (1997) isolated a mouse Crtap cDNA from a subtracted library specific for mRNAs highly expressed in hypertrophic chondrocytes compared to proliferating and early differentiating chondrocytes. Using a mouse Crtap clone to screen a human fetal brain cDNA library, Tonachini et al. (1999) identified human CRTAP cDNA clones. Human CRTAP encodes a deduced 401-amino acid protein with a a putative signal peptide of 26 amino acids. CRTAP contains 2 potential N-glycosylation signals. CRTAP shares 89% amino acid sequence identity with mouse Crtap and 51% identity with the chick homolog. The mouse and human genes contain a C-terminal region of approximately 120 amino acids not present in the chick protein Using Northern blot analysis of human tissues, Tonachini et al. (1999) detected 2-kb and 4-kb CRTAP transcripts in brain, heart, kidney, lung, small intestine, and skeletal muscle. In all tissues except brain, the 2-kb transcript was more abundant. Using immunohistochemistry, the authors detected CRTAP expression in articular chondrocytes. In mouse, Morello et al. (1999) detected 3 Crtap transcripts in a range of tissues, including all mouse embryonic cartilages. In chick, Castagnola et al. (1997) detected a single Crtap transcript in a broad range of embryonic tissues with the strongest expression in the developing cartilage. They detected expression in the extracellular matrix of the forming cartilage surrounding the notochord, the developing sclera, the sphenoid and mandibular cartilage, the long bone cartilage, and the developing sternal cartilage Full details of the abovementioned studies are described in the following publications, the disclosure of which are hereby incorporated by reference:

Castagnola, P.; Gennari, M.; Morello, R.; Tonachini, L.; Marin, O.; Gaggero, A.; Cancedda, R.: Cartilage associated protein (CASP) is a novel developmentally regulated chick embryo protein. J. Cell Sci. 110:1351-1359, 1997; and Morello, R.; Tonachini, L.; Monticone, M.; Viggiano, L.; Rocchi, M.; Cancedda, R.; Castagnola, P.: cDNA cloning, characterization and chromosome mapping of Crtap encoding the mouse carti.

Further studies establishing the function and utilities of CRTAP are found in John Hopkins OMIM database record ID 605497, and in cited publications listed in Table 5, which are hereby incorporated by reference. Cytochrome p450, subfamily i (aromatic compound-inducible), polypeptide 2 (CYP1A2, Accession NM_000761.2) is another GAM136 target gene, herein designated TARGET GENE. CYP1A2 BINDING SITE1 and CYP1A2 BINDING SITE2 are target binding sites found in untranslated regions of mRNA encoded by CYP1A2, corresponding to target binding sites such as BINDING SITE I, BINDING SITE II or BINDING SITE III of FIG. 8. Table 4 illustrates the complementarity of the nucleotide sequences of CYP1A2 BINDING SITE1 and CYP1A2 BINDING SITE2, designated SEQ ID:414 and SEQ ID:6233 respectively, to the nucleotide sequence of GAM136 RNA, herein designated GAM RNA, also designated SEQ ID:279.

Another function of GAM136 is therefore inhibition of Cytochrome p450, subfamily i (aromatic compound-inducible), polypeptide 2 (CYP1A2, Accession NM_000761.2), a gene which intervenes in an NADPH-dependent electron transport pathway. and therefore may be associated with Porphyria cutanea tarda. Accordingly, utilities of GAM136 include diagnosis, prevention and treatment of Porphyria cutanea tarda, and of other diseases and clinical conditions associated with CYP1A2.

The function of CYP1A2 and its association with various diseases and clinical conditions, has been established by previous studies, as described hereinabove with reference to GAM30.1. Debranching enzyme homolog 1 (s. cerevisiae) (DBR1, Accession NM_016216.1) is another GAM136 target gene, herein designated TARGET GENE. DBR1 BINDING SITE is a target binding site found in the 5' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:3140, to the nucleotide sequence of GAM136 RNA, herein designated GAM RNA, also designated SEQ ID:279.

Another function of GAM136 is therefore inhibition of Debranching enzyme homolog 1 (s. cerevisiae) (DBR1, Accession NM_016216.1). Accordingly, utilities of GAM136 include diagnosis, prevention and treatment of diseases and clinical conditions associated with DBR1.

DCOHM (Accession NM_032151.2) is another GAM136 target gene, herein designated TARGET GENE. DCOHM BINDING SITE is a target binding site found in the 3' untranslated region of mRNA encoded by DCOHM, corresponding to a target binding site such as BINDING SITE I, BINDING SITE II or BINDING SITE III of FIG. 8. Table 4 illustrates the complementarity of the nucleotide sequences of DCOHM BINDING SITE, designated SEQ ID:2472, to the nucleotide sequence of GAM136 RNA, herein designated GAM RNA, also designated SEQ ID:279.

Another function of GAM136 is therefore inhibition of DCOHM (Accession NM_032151.2). Accordingly, utilities of GAM136 include diagnosis, prevention and treatment of diseases and clinical conditions associated with DCOHM.

Dna fragmentation factor, 40 kda, beta polypeptide (caspase-activated dnase) (DFFB, Accession NM_004402.1) is another GAM136 target gene, herein designated TARGET GENE. DFFB BINDING SITE is a target binding site found in the 3' untranslated region of mRNA encoded by DFFB, corresponding to a target binding site such as BINDING SITE I, BINDING SITE II or BINDING SITE III of FIG. 8. Table 4 illustrates the complementarity of the nucleotide sequences of DFFB BINDING SITE, designated SEQ ID:1322, to the nucleotide sequence of GAM136 RNA, herein designated GAM RNA, also designated SEQ ID:279.

Another function of GAM136 is therefore inhibition of Dna fragmentation factor, 40 kda, beta polypeptide (caspase-activated dnase) (DFFB, Accession NM_004402.1), a gene which induces DNA fragmentation and chromatin condensation during apoptosis. Accordingly, utilities of GAM136 include diagnosis, prevention and treatment of diseases and clinical conditions associated with DFFB.

The function of DFFB and its association with various diseases and clinical conditions, has been established by previous studies, as described hereinabove with reference to GAM130.1. DKFZp547H025 (Accession NM_020161.1) is another GAM136 target gene, herein designated TARGET GENE. DKFZp547H025 BINDING SITE is a target binding site found in the 3' untranslated region of mRNA encoded by DKFZp547H025, corresponding to a target binding site such as BINDING SITE I, BINDING SITE II or BINDING SITE III of FIG. 8. Table 4 illustrates the complementarity of the nucleotide sequences of DKFZp547H025 BINDING SITE, designated SEQ ID:5775, to the nucleotide sequence of GAM136 RNA, herein designated GAM RNA, also designated SEQ ID:279.

Another function of GAM136 is therefore inhibition of DKFZp547H025 (Accession NM_020161.1). Accordingly, utilities of GAM136 include diagnosis, prevention and treatment of diseases and clinical conditions associated with DKFZp547H025.

DKFZP564D166 (Accession NM_030658.2) is another GAM136 target gene, herein designated TARGET GENE. DKFZP564D166 BINDING SITE is a target binding site found in the 3' untranslated region of multiple transcripts of mRNA encoded by DKFZP564D166, corresponding to a target binding site such as BINDING SITE I, BINDING SITE II or BINDING SITE III of FIG. 8. Table 4 illustrates the complementarity of the nucleotide sequences of DKFZP564D166 BINDING SITE, designated SEQ ID:2023, to the nucleotide sequence of GAM136 RNA, herein designated GAM RNA, also designated SEQ ID:279.

Another function of GAM136 is therefore inhibition of DKFZP564D166 (Accession NM_030658.2). Accordingly, utilities of GAM136 include diagnosis, prevention and treatment of diseases and clinical conditions associated with DKFZP564D166.

DKFZP564K0322 (Accession NM_032040.1) is another GAM136 target gene, herein designated TARGET GENE. DKFZP564K0322 BINDING SITE is a target binding site found in the 3' untranslated region of mRNA encoded by DKFZP564K0322, corresponding to a target binding site such as BINDING SITE I, BINDING SITE II or BINDING SITE III of FIG. 8. Table 4 illustrates the complementarity of the nucleotide sequences of DKFZP564K0322 BINDING SITE, designated SEQ ID:17506, to the nucleotide sequence of GAM136 RNA, herein designated GAM RNA, also designated SEQ ID:279.

Another function of GAM136 is therefore inhibition of DKFZP564K0322 (Accession NM_032040.1). Accordingly, utilities of GAM136 include diagnosis, prevention and treatment of diseases and clinical conditions associated with DKFZP564K0322.

DKFZp761N1114 (Accession XM_086327.6) is another GAM136 target gene, herein designated TARGET GENE. DKFZp761N1114 BINDING SITE is a target binding site found in the 3' untranslated region of mRNA encoded by DKFZp761N1114, corresponding to a target binding site such as BINDING SITE I, BINDING SITE II or BINDING SITE III of FIG. 8. Table 4 illustrates the complementarity of the nucleotide sequences of DKFZp761N1114 BINDING SITE, designated SEQ ID:6234, to the nucleotide sequence of GAM136 RNA, herein designated GAM RNA, also designated SEQ ID:279.

Another function of GAM136 is therefore inhibition of DKFZp761N1114 (Accession XM_086327.6). Accordingly, utilities of GAM136 include diagnosis, prevention and treatment of diseases and clinical conditions associated with DKFZp761N1114.

DKFZp761O0113 (Accession NM_018409.1) is another GAM136 target gene, herein designated TARGET GENE. DKFZp761O0113 BINDING SITE is a target binding site found in the 5' untranslated region of mRNA encoded by DKFZp761O0113, corresponding to a target binding site such as BINDING SITE I, BINDING SITE II or BINDING SITE III of FIG. 8. Table 4 illustrates the complementarity of the nucleotide sequences of DKFZp761O0113 BINDING SITE, designated SEQ ID:14313, to the nucleotide sequence of GAM136 RNA, herein designated GAM RNA, also designated SEQ ID:279.

Another function of GAM136 is therefore inhibition of DKFZp761O0113 (Accession NM_018409.1). Accordingly, utilities of GAM136 include diagnosis, prevention and treatment of diseases and clinical conditions associated with DKFZp761O0113.

Down syndrome critical region gene 6 (DSCR6, Accession NM_018962.1) is another GAM136 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:14099, to the nucleotide sequence of GAM136 RNA, herein designated GAM RNA, also designated SEQ ID:279.

Another function of GAM136 is therefore inhibition of Down syndrome critical region gene 6 (DSCR6, Accession NM_018962.1). Accordingly, utilities of GAM136 include diagnosis, prevention and treatment of diseases and clinical conditions associated with DSCR6.

EPB72 (Accession) is another GAM136 target gene, herein designated TARGET GENE. EPB72 BINDING SITE is a target binding site found in the 3' untranslated region of mRNA encoded by EPB72, corresponding to a target binding site such as BINDING SITE I, BINDING SITE II or BINDING SITE III of FIG. 8. Table 4 illustrates the complementarity of the nucleotide sequences of EPB72 BINDING SITE, designated SEQ ID:5774, to the nucleotide sequence of GAM136 RNA, herein designated GAM RNA, also designated SEQ ID:279.

Another function of GAM136 is therefore inhibition of EPB72 (Accession), a gene which may regulate cation conductance. Accordingly, utilities of GAM136 include diagnosis, prevention and treatment of diseases and clinical conditions associated with EPB72.

The function of EPB72 has been established by previous studies. Erythrocyte surface protein band 7.2 is a 29,000-kD integral membrane protein that is exposed on the cytoplasmic surface of the membrane and is susceptible to phosphorylation by a cAMP-dependent protein kinase. Deficiency of this protein in red cells is responsible for stomatocytosis (OMIM Ref. No. 185000). The same protein can be demonstrated in human cell lines of epithelial and lymphoid origin, notably in HeLa cells. Hiebl-Dirschmied et al. (1991), therefore, could screen HeLa cell cDNA expression libraries with antibodies to the protein in order to isolate cDNA clones, determine the nucleotide sequence, and study the structure of the protein. HeLa and bone marrow cell-derived sequences were identical, except for one nucleotide; the deduced sequence of 287 amino acids was confirmed by sequence identity with peptides of the erythroid protein. Structural analysis assigned band 7 protein to the type Ib transmembrane proteins. Westberg et al. (1993) used a cDNA clone coding for stomatin to determine the chromosomal localization of the EPB72 gene. They assigned the gene to human chromosome 9 by Southern blot analysis of somatic cell hybrids. By analysis of hybrid cells containing only parts of chromosome 9, they regionalized the assignment to 9q34.1, proximal to the breakpoint that creates the Philadelphia chromosome of chronic myeloid leukemia (CML; 151410) and, therefore, proximal to the Abelson oncogene (OMIM Ref. No. 189980). Using fluorescence in situ hybridization, Gallagher et al. (1993) likewise mapped the EPB72 gene to 9q33-q34. They showed that EPB72 was not translocated with the 3-prime end of the ABL gene in the Philadelphia chromosome, suggesting that the EPB72 gene is centromeric to the ABL gene. Pilz et al. (1994) demonstrated that the homologous gene is located on mouse chromosome 2. To gain additional insight into the structure and function of this protein, Gallagher et al. (1995) cloned the mouse band 7.2b cDNA and studied its tissue-specific expression. They isolated 2,873 bp of cDNA with an open reading frame of 852 bp. The predicted protein was 284 amino acids with a molecular weight of 31 kD. They detected a wide pattern of expression, with high levels of mRNA in heart, liver, skeletal muscle, and testis but low levels in lung, brain, and spleen. Using fluorescence in situ hybridization, the murine band 7.2b gene was mapped to chromosome 2, at the border of the distal region of 2B and proximal region of C1, syntenic to 9q, the location of the human homolog. Models of the predicted protein structure showed a short NH2-terminal head, a strongly hydrophobic 28-amino acid stretch presumably encoding a single membrane-spanning domain, and a large domain composed of beta sheet and alpha helix. Database searching showed no significant homology of other known proteins to either the human or the murine band 7.2b. Gallagher and Forget (1995) determined the sequence of the full-length human band 7.2b cDNA, characterized the genomic structure of the EPB72 gene, studied its pattern of expression in different tissues, and characterized the promoter of the gene. The gene is composed of 7 exons distributed over 40 kb of DNA. Its promoter was identified as lacking a TATA box and to be GC-rich. It directed high-level expression of a reporter gene in both erythroid and non-erythroid cells. Unfried et al. (1995) showed that the human EPB72 gene contains 7 exons spanning about 30 kb. Two polyadenylation signals were found in the 3-prime UTR accounting for the 3.2- and 3.3-kb RNAs that are observed in Northern blots.

Animal model experiments lend further support to the function of EPB72. To examine the relationship between erythrocyte membrane protein 7.2b deficiency and the hemolytic anemia of human hereditary stomatocytosis, Zhu et al. (1999) created 7.2b knockout mice by standard gene targeting approaches. Despite a complete absence of protein 7.2b in homozygous knockout mice, there was no hemolytic anemia, and mouse red blood cells were normal in morphology, cell indices, hydration status, monovalent cation content, and ability to translocate lipids. Thus, their experiments suggested that 7.2b deficiency plays no direct role in the etiology of stomatocytosis and excluded any role of this protein as a mediator of cation transport in red blood cells.

It is appreciated that the abovementioned animal model for EPB72 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Zhu, Y.; Paszty, C.; Turetsky, T.; Tsai, S.; Kuypers, F. A.; Lee, G.; Cooper, P.; Gallagher, P. G.; Stevens, M. E.; Rubin, E.; Mohandas, N.; Mentzer, W. C.: Stomatocytosis is absent in 'stomatin'-deficient murine red blood cells. Blood 93:2404-2410, 1999; and Zhu, Y.; Paszty, C.; Turetsky, T.; Tsai, S.; Kuypers, F. A.; Lee, G.; Cooper, P.; Gallagher, P. G.; Stevens, M. E.; Rubin, E.; Mohandas, N.; Mentzer, W. C.: Stomatocytosis is absent in.

Further studies establishing the function and utilities of EPB72 are found in John Hopkins OMIM database record ID 133090, and in cited publications listed in Table 5, which are hereby incorporated by reference. Coagulation factor ii (thrombin) receptor-like 2 (F2RL2, Accession NM_004101.1) is another GAM136 target gene, herein designated TARGET GENE. F2RL2 BINDING SITE is a target binding site found in the 3' untranslated region of mRNA encoded by F2RL2, corresponding to a target binding site such as BINDING SITE I, BINDING SITE II or BINDING SITE III of FIG. 8. Table 4 illustrates the complementarity of the nucleotide sequences of F2RL2 BINDING SITE, designated SEQ ID:13299, to the nucleotide sequence of GAM136 RNA, herein designated GAM RNA, also designated SEQ ID:279.

Another function of GAM136 is therefore inhibition of Coagulation factor ii (thrombin) receptor-like 2 (F2RL2, Accession NM_004101.1), a gene which receptor for activated thrombin coupled to g proteins that stimulate phosphoinositide hydrolysis. Accordingly, utilities of GAM136 include diagnosis, prevention and treatment of diseases and clinical conditions associated with F2RL2.

The function of F2RL2 has been established by previous studies. Thrombin (OMIM Ref. No. 176930) is a coagulation protease that activates platelets, leukocytes, and endothelium and mesenchymal cells at sites of vascular injury, acting partly through an unusual proteolytically activated G protein-coupled receptor, coagulation factor II (thrombin) receptor (CF2R; 187930). Thrombin triggers cellular responses through protease-activated receptors (PARs), of which PAR3 is one. It is thought that PAR3 functions as a cofactor for the cleavage and activation of PAR4 (OMIM Ref. No. 602779) by thrombin (Nakanishi-Matsui et al., 2000; Sambrano et al, 2001). Using a PCR-based strategy, Ishihara et al. (1997)

isolated a human cDNA encoding a putative G protein-coupled receptor with 27% amino acid sequence similarity to CF2R, which they referred to as PAR1 (OMIM Ref. No. 107930), and 28% similarity to PAR2 (OMIM Ref. No. 600933). PAR2 is a possible trypsin receptor. The N- terminal exodomain of the new receptor, designated PAR3 by the investigators, contains a possible thrombin cleavage site at residues lys38/thr39, followed by a sequence strikingly identical to a thrombin-binding sequence in the leech anticoagulant hirudin. Ishihara et al. (1997) showed that PAR3 mediates thrombin-triggered phosphoinositide hydrolysis and is expressed in a variety of tissues, including human bone marrow and mouse megakaryocytes, making it a candidate for the sought-after second platelet thrombin receptor. They commented that PAR3 provides a new tool for understanding thrombin signaling and a possible target for therapeutics designed selectively to block thrombotic, inflammatory, and proliferative responses to thrombin. The human PAR1, PAR2, and PAR3 (Schmidt et al., 1997) genes were cloned and localized to 5q13, by in situ hybridization or use of radiation hybrid panels.

Animal model experiments lend further support to the function of F2RL2. Kahn et al. (1998) generated mice deficient in Par3 by targeted disruption. Thrombin responses in platelets from these mice were markedly delayed and diminished but not absent.

It is appreciated that the abovementioned animal model for F2RL2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sambrano, G. R.; Weiss, E. J.; Zheng, Y.-W.; Huang, W.; Coughlin, S. R.: Role of thrombin signalling in platelets in haemostasis and thrombosis. Nature 413:74-78, 2001; and Ishihara, H.; Connolly, A. J.; Zeng, D.; Kahn, M. L.; Zheng, Y. W.; Timmons, C.; Tram, T.; Coughlin, S. R.: Protease-activated receptor 3 is a second thrombin receptor in humans. Natur.

Further studies establishing the function and utilities of F2RL2 are found in John Hopkins OMIM database record ID 601919, and in cited publications listed in Table 5, which are hereby incorporated by reference. Coagulation factor iii (thromboplastin, tissue factor) (F3, Accession NM_001993.2) is another GAM136 target gene, herein designated TARGET GENE. F3 BINDING SITE is a target binding site found in the 5' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:5697, to the nucleotide sequence of GAM136 RNA, herein designated GAM RNA, also designated SEQ ID:279.

Another function of GAM136 is therefore inhibition of Coagulation factor iii (thromboplastin, tissue factor) (F3, Accession NM_001993.2), a gene which functions in normal hemostasis. Accordingly, utilities of GAM136 include diagnosis, prevention and treatment of diseases and clinical conditions associated with F3.

The function of F3 has been established by previous studies. Factor III, a glycoprotein component of cell membranes, is an essential cofactor for factor VII- dependent activation of blood coagulation and activates the extrinsic pathway of blood coagulation in the presence of factor XII and calcium. It may be the primary physiologic initiator of blood coagulation. This may explain why factor III is the only protein in the coagulation pathway for which a congenital deficiency has not been described. Carson et al. (1985) mapped F3 to 1pter-p21 by study of somatic cell hybrids with a species-specific sensitive chromogenic assay. Spicer et al. (1987) isolated cDNA clones for tissue factor. The amino acid sequence deduced from the nucleotide sequence of the cDNAs indicates that tissue factor is synthesized as a higher molecular weight precursor with a leader sequence of 32 amino acids, while the sequence of the mature protein suggests that there are 3 distinct domains: extracellular (residues 1-219), hydrophobic (residues 220-242), and cytoplasmic (residues 243-263). Scarpati et al. (1987) screened a human placenta cDNA library in lambda-gt11 for expression of tissue factor antigens. Among 4 million recombinant clones screened, one that was positive expressed a protein that shares epitopes with authentic human brain tissue factor. The 1.1-kb cDNA insert encodes a peptide containing the N-terminal protein sequence of brain tissue factor. By means of this clone used in hybridization to flow-sorted human chromosomes, Scarpati et al. (1987) showed that the tissue factor gene is located on chromosome 1. Scarpati et al. (1987) used a RFLP to map factor 3 to proximal 1p by multipoint linkage analysis with probes known to span that region. Judging by the location arrived at by somatic cell hybridization, the location of F3 may be in the region 1p22-p21. By in situ hybridization, Kao et al. (1988) likewise mapped F3 to 1p22-p21. Mackman et al. (1989) presented the complete sequence of the F3 gene. It is 12.4 kb long and has 6 exons separated by 5 introns. Mackman et al. (1990) concluded that the tissue factor promoter is relatively complex. Tissue factor (TF) is an integral membrane glycoprotein that, when exposed to plasma, is a potent procoagulant. As stated earlier, it is believed to be the physiologic initiator of blood coagulation. Toomey et al. (1997) found that, in contrast to findings of earlier studies which showed that TF- null mouse embryos did not survive beyond midgestation, 14% of TF-deficient embryos from a hybrid background escaped this early mortality and survived to birth. On gross and microscopic inspection, these late gestation, TF-deficient embryos appeared normal. Furthermore, the growth and vascularity of TF +/+, TF +/-, and TF - /-teratomas and teratocarcinomas were indistinguishable. Toomey et al. (1997) concluded that tumor-derived TF is not required for tumor growth and angiogenesis and that the combined data do not support an essential role for TF in embryonic vascular development.

Full details of the abovementioned studies are described in the following publications, the disclosure of which are hereby incorporated by reference:

Mackman, N.; Fowler, B. J.; Edgington, T. S.; Morrissey, J. H.: Functional analysis of the human tissue factor promoter and induction by serum. Proc. Nat. Acad. Sci. 87:2254-2258, 1990; and Toomey, J. R.; Kratzer, K. E.; Lasky, N. M.; Broze, G. J., Jr.: Effect of tissue factor deficiency on mouse and tumor development. Proc. Nat. Acad. Sci. 94:6922-6926, 1997.

Further studies establishing the function and utilities of F3 are found in John Hopkins OMIM database record ID 134390, and in cited publications listed in Table 5, which are hereby incorporated by reference. FBP17 (Accession) is another GAM136 target gene, herein designated TARGET GENE. FBP17 BINDING SITE is a target binding site found in the 3' untranslated region of mRNA encoded by FBP17, corresponding to a target binding site such as BINDING SITE I, BINDING SITE II or BINDING SITE III of FIG. 8. Table 4 illustrates the complementarity of the nucleotide sequences of FBP17 BINDING SITE, designated SEQ ID:13681, to the nucleotide sequence of GAM136 RNA, herein designated GAM RNA, also designated SEQ ID:279.

Another function of GAM136 is therefore inhibition of FBP17 (Accession). Accordingly, utilities of GAM136 include diagnosis, prevention and treatment of diseases and clinical conditions associated with FBP17.

Fc fragment of iga, receptor for (FCAR, Accession NM_002000.2) is another GAM136 target gene, herein designated TARGET GENE. FCAR BINDING SITE is a target binding site found in the 3' untranslated region of multiple transcripts of mRNA encoded by FCAR, corresponding to a target binding site such as BINDING SITE I, BINDING SITE II or BINDING SITE III of FIG. 8. Table 4 illustrates the complementarity of the nucleotide sequences of FCAR BINDING SITE, designated SEQ ID:14197, to the nucleotide sequence of GAM136 RNA, herein designated GAM RNA, also designated SEQ ID:279.

Another function of GAM136 is therefore inhibition of Fc fragment of iga, receptor for (FCAR, Accession NM_002000.2), a gene which binds to the fc region of immunoglobulins alpha and mediates several functions including cytokine production. and therefore may be associated with Iga nephropathy. Accordingly, utilities of GAM136 include diagnosis, prevention and treatment of Iga nephropathy, and of other diseases and clinical conditions associated with FCAR.

The function of FCAR has been established by previous studies. Human Fc-alpha receptor (FCAR) is present on a number of cell types, including neutrophils, monocytes, macrophages, and eosinophils. FCAR interacts with aggregated IgAs, such as IgA coated on the surface of an invading microorganism, and mediates several immunologic defense processes such as phagocytosis, antibody-dependent cell-mediated cytotoxicity, and stimulation of the release of inflammatory mediators. FCAR is a glycoprotein of 50 to 100 kD, with diversity on different cell types. Narita et al. (2001) examined polymorphisms in the promoter and 5-prime untranslated region of the FCAR gene in 151 patients with IgA nephropathy and 163 patients with other glomerular diseases shown to have no mesangial IgA deposition by renal biopsy. Haplotype analysis showed tight linkage disequilibrium among the polymorphisms. No significant association for the genotype, allele, and haplotype frequencies of the polymorphisms were shown between the patients with histologically proven IgA nephropathy and those with other glomerular diseases. Thus, the analyzed polymorphisms did not appear to be primarily involved in susceptibility to IgA nephropathy.

Full details of the abovementioned studies are described in the following publications, the disclosure of which are hereby incorporated by reference:

Narita, I.; Goto, S.; Saito, N.; Sakatsume, M.; Jin, S.; Omori, K.; Gejy, F.: Genetic polymorphisms in the promoter and 5-prime UTR region of the Fc alpha receptor (CD89) are not associated with a risk of IgA nephropathy. J. Hum. Genet. 46:694-698, 2001; and Maliszewski, C. R.; March, C. J.; Schoenborn, M. A.; Gimpel, S.; Shen, L.: Expression cloning of a human Fc receptor for IgA. J. Exp. Med. 172:1665-1672, 1990.

Further studies establishing the function and utilities of FCAR are found in John Hopkins OMIM database record ID 147045, and in cited publications listed in Table 5, which are hereby incorporated by reference. FCRH1 (Accession NM_052938.2) is another GAM136 target gene, herein designated TARGET GENE. FCRH1 BINDING SITE is a target binding site found in the 3' untranslated region of mRNA encoded by FCRH1, corresponding to a target binding site such as BINDING SITE I, BINDING SITE II or BINDING SITE III of FIG. 8. Table 4 illustrates the complementarity of the nucleotide sequences of FCRH1 BINDING SITE, designated SEQ ID:11769, to the nucleotide sequence of GAM136 RNA, herein designated GAM RNA, also designated SEQ ID:279.

Another function of GAM136 is therefore inhibition of FCRH1 (Accession NM_052938.2). Accordingly, utilities of GAM136 include diagnosis, prevention and treatment of diseases and clinical conditions associated with FCRH1.

Fer-1-like 4 (c. elegans) (FER1L4, Accession XM_300246.1) is another GAM136 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:6674, to the nucleotide sequence of GAM136 RNA, herein designated GAM RNA, also designated SEQ ID:279.

Another function of GAM136 is therefore inhibition of Fer-1-like 4 (c. elegans) (FER1L4, Accession XM_300246.1). Accordingly, utilities of GAM136 include diagnosis, prevention and treatment of diseases and clinical conditions associated with FER1L4.

Fasciculation and elongation protein zeta 1 (zygin i) (FEZ1, Accession NM_005103.3) is another GAM136 target gene, herein designated TARGET GENE. FEZ1 BINDING SITE is a target binding site found in the 3' untranslated region of multiple transcripts of mRNA encoded by FEZ1, corresponding to a target binding site such as BINDING SITE I, BINDING SITE II or BINDING SITE III of FIG. 8. Table 4 illustrates the complementarity of the nucleotide sequences of FEZ1 BINDING SITE, designated SEQ ID:4839, to the nucleotide sequence of GAM136 RNA, herein designated GAM RNA, also designated SEQ ID:279.

Another function of GAM136 is therefore inhibition of Fasciculation and elongation protein zeta 1 (zygin i) (FEZ1, Accession NM_005103.3), a gene which Zygin 1; may have a role in axonal outgrowth; has similarity to C. elegans UNC-76. Accordingly, utilities of GAM136 include diagnosis, prevention and treatment of diseases and clinical conditions associated with FEZ1.

The function of FEZ1 and its association with various diseases and clinical conditions, has been established by previous studies, as described hereinabove with reference to GAM30.1. Fk506 binding protein 9, 63 kda (FKBP9, Accession NM_007270.1) is another GAM136 target gene, herein designated TARGET GENE. FKBP9 BINDING SITE is a target binding site found in the 3' untranslated region of mRNA encoded by FKBP9, corresponding to a target binding site such as BINDING SITE I, BINDING SITE II or BINDING SITE III of FIG. 8. Table 4 illustrates the complementarity of the nucleotide sequences of FKBP9 BINDING SITE, designated SEQ ID:19504, to the nucleotide sequence of GAM136 RNA, herein designated GAM RNA, also designated SEQ ID:279.

Another function of GAM136 is therefore inhibition of Fk506 binding protein 9, 63 kda (FKBP9, Accession NM_007270.1) . Accordingly, utilities of GAM136 include diagnosis, prevention and treatment of diseases and clinical conditions associated with FKBP9.

FLJ10956 (Accession NM_018283.1) is another GAM136 target gene, herein designated TARGET GENE. FLJ10956 BINDING SITE is a target binding site found in the 3' untranslated region of mRNA encoded by FLJ10956, corresponding to a target binding site such as BINDING SITE I, BINDING SITE II or BINDING SITE III of FIG. 8. Table 4 illustrates the complementarity of the nucleotide sequences of FLJ10956 BINDING SITE, designated SEQ ID:10208, to the nucleotide sequence of GAM136 RNA, herein designated GAM RNA, also designated SEQ ID:279.

Another function of GAM136 is therefore inhibition of FLJ10956 (Accession NM_018283.1). Accordingly, utilities of GAM136 include diagnosis, prevention and treatment of diseases and clinical conditions associated with FLJ10956.

FLJ11467 (Accession NM_024963.2) is another GAM136 target gene, herein designated TARGET GENE. FLJ11467 BINDING SITE is a target binding site found in the 3' untranslated region of mRNA encoded by FLJ11467, corresponding to a target binding site such as BINDING SITE I, BINDING SITE II or BINDING SITE III of FIG. 8. Table 4 illustrates the complementarity of the nucleotide sequences of FLJ11467 BINDING SITE, designated SEQ ID:1757, to the nucleotide sequence of GAM136 RNA, herein designated GAM RNA, also designated SEQ ID:279.

Another function of GAM136 is therefore inhibition of FLJ11467 (Accession NM_024963.2). Accordingly, utilities of GAM136 include diagnosis, prevention and treatment of diseases and clinical conditions associated with FLJ11467.

FLJ11710 (Accession NM_024846.1) is another GAM136 target gene, herein designated TARGET GENE. FLJ11710 BINDING SITE is a target binding site found in the 3' untranslated region of mRNA encoded by FLJ11710, corresponding to a target binding site such as BINDING SITE I, BINDING SITE II or BINDING SITE III of FIG. 8. Table 4 illustrates the complementarity of the nucleotide sequences of FLJ11710 BINDING SITE, designated SEQ ID:12430, to the nucleotide sequence of GAM136 RNA, herein designated GAM RNA, also designated SEQ ID:279.

Another function of GAM136 is therefore inhibition of FLJ11710 (Accession NM_024846.1). Accordingly, utilities of GAM136 include diagnosis, prevention and treatment of diseases and clinical conditions associated with FLJ11710.

FLJ11800 (Accession NM_024974.1) is another GAM136 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:16539, to the nucleotide sequence of GAM136 RNA, herein designated GAM RNA, also designated SEQ ID:279.

Another function of GAM136 is therefore inhibition of FLJ11800 (Accession NM_024974.1). Accordingly, utilities of GAM136 include diagnosis, prevention and treatment of diseases and clinical conditions associated with FLJ11800.

FLJ12891 (Accession NM_024950.1) is another GAM136 target gene, herein designated TARGET GENE. FLJ12891 BINDING SITE is a target binding site found in the 3' untranslated region of mRNA encoded by FLJ12891, corresponding to a target binding site such as BINDING SITE I, BINDING SITE II or BINDING SITE III of FIG. 8. Table 4 illustrates the complementarity of the nucleotide sequences of FLJ12891 BINDING SITE, designated SEQ ID:15272, to the nucleotide sequence of GAM136 RNA, herein designated GAM RNA, also designated SEQ ID:279.

Another function of GAM136 is therefore inhibition of FLJ12891 (Accession NM_024950.1). Accordingly, utilities of GAM136 include diagnosis, prevention and treatment of diseases and clinical conditions associated with FLJ12891.

FLJ12973 (Accession NM_024908.1) is another GAM136 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:7618, to the nucleotide sequence of GAM136 RNA, herein designated GAM RNA, also designated SEQ ID:279.

Another function of GAM136 is therefore inhibition of FLJ12973 (Accession NM_024908.1). Accordingly, utilities of GAM136 include diagnosis, prevention and treatment of diseases and clinical conditions associated with FLJ12973.

FLJ13193 (Accession) is another GAM136 target gene, herein designated TARGET GENE. FLJ13193 BINDING SITE is a target binding site found in the 3' untranslated region of mRNA encoded by FLJ13193, corresponding to a target binding site such as BINDING SITE I, BINDING SITE II or BINDING SITE III of FIG. 8. Table 4 illustrates the complementarity of the nucleotide sequences of FLJ13193 BINDING SITE, designated SEQ ID:12298, to the nucleotide sequence of GAM136 RNA, herein designated GAM RNA, also designated SEQ ID:279.

Another function of GAM136 is therefore inhibition of FLJ13193 (Accession). Accordingly, utilities of GAM136 include diagnosis, prevention and treatment of diseases and clinical conditions associated with FLJ13193.

FLJ13456 (Accession XM_038291.5) is another GAM136 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:19891, to the nucleotide sequence of GAM136 RNA, herein designated GAM RNA, also designated SEQ ID:279.

Another function of GAM136 is therefore inhibition of FLJ13456 (Accession XM_038291.5). Accordingly, utilities of GAM136 include diagnosis, prevention and treatment of diseases and clinical conditions associated with FLJ13456.

FLJ14351 (Accession NM_024732.1) is another GAM136 target gene, herein designated TARGET GENE. FLJ14351 BINDING SITE is a target binding site found in the 3' untranslated region of mRNA encoded by FLJ14351, corresponding to a target binding site such as BINDING SITE I, BINDING SITE II or BINDING SITE III of FIG. 8. Table 4 illustrates the complementarity of the nucleotide sequences of FLJ14351 BINDING SITE, designated SEQ ID:14477, to the nucleotide sequence of GAM136 RNA, herein designated GAM RNA, also designated SEQ ID:279.

Another function of GAM136 is therefore inhibition of FLJ14351 (Accession NM_024732.1). Accordingly, utilities of GAM136 include diagnosis, prevention and treatment of diseases and clinical conditions associated with FLJ14351.

FLJ14803 (Accession NM_032842.1) is another GAM136 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:5984, to the nucleotide sequence of GAM136 RNA, herein designated GAM RNA, also designated SEQ ID:279.

Another function of GAM136 is therefore inhibition of FLJ14803 (Accession NM_032842.1). Accordingly, utilities of GAM136 include diagnosis, prevention and treatment of diseases and clinical conditions associated with FLJ14803.

FLJ14957 (Accession NM_032866.1) is another GAM136 target gene, herein designated TARGET GENE. FLJ14957 BINDING SITE is a target binding site found in the 3' untranslated region of mRNA encoded by FLJ14957, corresponding to a target binding site such as BINDING SITE I, BINDING SITE II or BINDING SITE III of FIG. 8. Table 4 illustrates the complementarity of the nucleotide sequences of FLJ14957 BINDING SITE, designated SEQ ID:16340, to the nucleotide sequence of GAM136 RNA, herein designated GAM RNA, also designated SEQ ID:279.

Another function of GAM136 is therefore inhibition of FLJ14957 (Accession NM_032866.1). Accordingly, utilities of GAM136 include diagnosis, prevention and treatment of diseases and clinical conditions associated with FLJ14957.

FLJ20004 (Accession) is another GAM136 target gene, herein designated TARGET GENE. FLJ20004 BINDING SITE is a target binding site found in the 3' untranslated region of mRNA encoded by FLJ20004, corresponding to a target binding site such as BINDING SITE I, BINDING SITE II or BINDING SITE III of FIG. 8. Table 4 illustrates the complementarity of the nucleotide sequences of FLJ20004 BINDING SITE, designated SEQ ID:14892, to the nucleotide sequence of GAM136 RNA, herein designated GAM RNA, also designated SEQ ID:279.

Another function of GAM136 is therefore inhibition of FLJ20004 (Accession). Accordingly, utilities of GAM136 include diagnosis, prevention and treatment of diseases and clinical conditions associated with FLJ20004.

FLJ20147 (Accession NM_017687.1) is another GAM136 target gene, herein designated TARGET GENE. FLJ20147 BINDING SITE is a target binding site found in the 3' untranslated region of mRNA encoded by FLJ20147, corresponding to a target binding site such as BINDING SITE I, BINDING SITE II or BINDING SITE III of FIG. 8. Table 4 illustrates the complementarity of the nucleotide sequences of FLJ20147 BINDING SITE, designated SEQ ID:15668, to the nucleotide sequence of GAM136 RNA, herein designated GAM RNA, also designated SEQ ID:279.

Another function of GAM136 is therefore inhibition of FLJ20147 (Accession NM_017687.1). Accordingly, utilities of GAM136 include diagnosis, prevention and treatment of diseases and clinical conditions associated with FLJ20147.

FLJ20342 (Accession NM_017774.1) is another GAM136 target gene, herein designated TARGET GENE. FLJ20342 BINDING SITE is a target binding site found in the 3' untranslated region of mRNA encoded by FLJ20342, corresponding to a target binding site such as BINDING SITE I, BINDING SITE II or BINDING SITE III of FIG. 8. Table 4 illustrates the complementarity of the nucleotide sequences of FLJ20342 BINDING SITE, designated SEQ ID:12081, to the nucleotide sequence of GAM136 RNA, herein designated GAM RNA, also designated SEQ ID:279.

Another function of GAM136 is therefore inhibition of FLJ20342 (Accession NM_017774.1). Accordingly, utilities of GAM136 include diagnosis, prevention and treatment of diseases and clinical conditions associated with FLJ20342.

FLJ20700 (Accession NM_017932.1) is another GAM136 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:7187, to the nucleotide sequence of GAM136 RNA, herein designated GAM RNA, also designated SEQ ID:279.

Another function of GAM136 is therefore inhibition of FLJ20700 (Accession NM_017932.1). Accordingly, utilities of GAM136 include diagnosis, prevention and treatment of diseases and clinical conditions associated with FLJ20700.

FLJ21603 (Accession) is another GAM136 target gene, herein designated TARGET GENE. FLJ21603 BINDING SITE is a target binding site found in the 3' untranslated region of mRNA encoded by FLJ21603, corresponding to a target binding site such as BINDING SITE I, BINDING SITE II or BINDING SITE III of FIG. 8. Table 4 illustrates the complementarity of the nucleotide sequences of FLJ21603 BINDING SITE, designated SEQ ID:17662, to the nucleotide sequence of GAM136 RNA, herein designated GAM RNA, also designated SEQ ID:279.

Another function of GAM136 is therefore inhibition of FLJ21603 (Accession). Accordingly, utilities of GAM136 include diagnosis, prevention and treatment of diseases and clinical conditions associated with FLJ21603.

FLJ23024 (Accession NM_014150.1) is another GAM136 target gene, herein designated TARGET GENE. FLJ23024 BINDING SITE is a target binding site found in the 3' untranslated region of mRNA encoded by FLJ23024, corresponding to a target binding site such as BINDING SITE I, BINDING SITE II or BINDING SITE III of FIG. 8. Table 4 illustrates the complementarity of the nucleotide sequences of FLJ23024 BINDING SITE, designated SEQ ID:8420, to the nucleotide sequence of GAM136 RNA, herein designated GAM RNA, also designated SEQ ID:279.

Another function of GAM136 is therefore inhibition of FLJ23024 (Accession NM_014150.1). Accordingly, utilities of GAM136 include diagnosis, prevention and treatment of diseases and clinical conditions associated with FLJ23024.

FLJ23356 (Accession NM_032237.2) is another GAM136 target gene, herein designated TARGET GENE. FLJ23356 BINDING SITE is a target binding site found in the 3' untranslated region of mRNA encoded by FLJ23356, corresponding to a target binding site such as BINDING SITE I, BINDING SITE II or BINDING SITE III of FIG. 8. Table 4 illustrates the complementarity of the nucleotide sequences of FLJ23356 BINDING SITE, designated SEQ ID:17951, to the nucleotide sequence of GAM136 RNA, herein designated GAM RNA, also designated SEQ ID:279.

Another function of GAM136 is therefore inhibition of FLJ23356 (Accession NM_032237.2). Accordingly, utilities of GAM136 include diagnosis, prevention and treatment of diseases and clinical conditions associated with FLJ23356.

FLJ23392 (Accession NM_024784.2) is another GAM136 target gene, herein designated TARGET GENE. FLJ23392 BINDING SITE is a target binding site found in the 3' untranslated region of mRNA encoded by FLJ23392, corresponding to a target binding site such as BINDING SITE I, BINDING SITE II or BINDING SITE III of FIG. 8. Table 4 illustrates the complementarity of the nucleotide sequences of FLJ23392 BINDING SITE, designated SEQ ID:2537, to the nucleotide sequence of GAM136 RNA, herein designated GAM RNA, also designated SEQ ID:279.

Another function of GAM136 is therefore inhibition of FLJ23392 (Accession NM_024784.2). Accordingly, utilities of GAM136 include diagnosis, prevention and treatment of diseases and clinical conditions associated with FLJ23392.

FLJ23416 (Accession NM_032238.1) is another GAM136 target gene, herein designated TARGET GENE. FLJ23416 BINDING SITE is a target binding site found in the 3' untranslated region of mRNA encoded by FLJ23416, corresponding to a target binding site such as BINDING SITE I, BINDING SITE II or BINDING SITE III of FIG. 8. Table 4 illustrates the complementarity of the nucleotide sequences of FLJ23416 BINDING SITE, designated SEQ ID:5179, to the nucleotide sequence of GAM136 RNA, herein designated GAM RNA, also designated SEQ ID:279.

Another function of GAM136 is therefore inhibition of FLJ23416 (Accession NM_032238.1). Accordingly, utilities of GAM136 include diagnosis, prevention and treatment of diseases and clinical conditions associated with FLJ23416.

FLJ23556 (Accession NM_024880.1) is another GAM136 target gene, herein designated TARGET GENE. FLJ23556 BINDING SITE is a target binding site found in the 3' untranslated region of mRNA encoded by FLJ23556, corresponding to a target binding site such as BINDING SITE I, BINDING SITE II or BINDING SITE III of FIG. 8. Table 4 illustrates the complementarity of the nucleotide sequences of FLJ23556 BINDING SITE, designated SEQ ID:10048, to the nucleotide sequence of GAM136 RNA, herein designated GAM RNA, also designated SEQ ID:279.

Another function of GAM136 is therefore inhibition of FLJ23556 (Accession NM_024880.1). Accordingly, utilities of GAM136 include diagnosis, prevention and treatment of diseases and clinical conditions associated with FLJ23556.

FLJ23563 (Accession XM_041701.5) is another GAM136 target gene, herein designated TARGET GENE. FLJ23563 BINDING SITE is a target binding site found in the 3' untranslated region of mRNA encoded by FLJ23563, corresponding to a target binding site such as BINDING SITE I, BINDING SITE II or BINDING SITE III of FIG. 8. Table 4 illustrates the complementarity of the nucleotide sequences of FLJ23563 BINDING SITE, designated SEQ ID:3685, to the nucleotide sequence of GAM136 RNA, herein designated GAM RNA, also designated SEQ ID:279.

Another function of GAM136 is therefore inhibition of FLJ23563 (Accession XM_041701.5). Accordingly, utilities of GAM136 include diagnosis, prevention and treatment of diseases and clinical conditions associated with FLJ23563.

FLJ32499 (Accession NM_144607.1) is another GAM136 target gene, herein designated TARGET GENE. FLJ32499 BINDING SITE is a target binding site found in the 3' untranslated region of mRNA encoded by FLJ32499, corresponding to a target binding site such as BINDING SITE I, BINDING SITE II or BINDING SITE III of FIG. 8. Table 4 illustrates the complementarity of the nucleotide sequences of FLJ32499 BINDING SITE, designated SEQ ID:8773, to the nucleotide sequence of GAM136 RNA, herein designated GAM RNA, also designated SEQ ID:279.

Another function of GAM136 is therefore inhibition of FLJ32499 (Accession NM_144607.1). Accordingly, utilities of GAM136 include diagnosis, prevention and treatment of diseases and clinical conditions associated with FLJ32499.

FLJ32865 (Accession NM_144613.1) is another GAM136 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:3736, to the nucleotide sequence of GAM136 RNA, herein designated GAM RNA, also designated SEQ ID:279.

Another function of GAM136 is therefore inhibition of FLJ32865 (Accession NM_144613.1). Accordingly, utilities of GAM136 include diagnosis, prevention and treatment of diseases and clinical conditions associated with FLJ32865.

Growth hormone receptor (GHR, Accession NM_000163.1) is another GAM136 target gene, herein designated TARGET GENE. GHR BINDING SITE is a target binding site found in the 3' untranslated region of mRNA encoded by GHR, corresponding to a target binding site such as BINDING SITE I, BINDING SITE II or BINDING SITE III of FIG. 8. Table 4 illustrates the complementarity of the nucleotide sequences of GHR BINDING SITE, designated SEQ ID:15462, to the nucleotide sequence of GAM136 RNA, herein designated GAM RNA, also designated SEQ ID:279.

Another function of GAM136 is therefore inhibition of Growth hormone receptor (GHR, Accession NM_000163.1). Accordingly, utilities of GAM136 include diagnosis, prevention and treatment of diseases and clinical conditions associated with GHR.

Golgi autoantigen, golgin subfamily a, 3 (GOLGA3, Accession NM_005895.1) is another GAM136 target gene, herein designated TARGET GENE. GOLGA3 BINDING SITE is a target binding site found in the 3' untranslated region of multiple transcripts of mRNA encoded by GOLGA3, corresponding to a target binding site such as BINDING SITE I, BINDING SITE II or BINDING SITE III of FIG. 8. Table 4 illustrates the complementarity of the nucleotide sequences of GOLGA3 BINDING SITE, designated SEQ ID:10858, to the nucleotide sequence of GAM136 RNA, herein designated GAM RNA, also designated SEQ ID:279.

Another function of GAM136 is therefore inhibition of Golgi autoantigen, golgin subfamily a, 3 (GOLGA3, Accession NM_005895.1) . Accordingly, utilities of GAM136 include diagnosis, prevention and treatment of diseases and clinical conditions associated with GOLGA3.

Glycoprotein v (platelet) (GP5, Accession NM_004488.1) is another GAM136 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:13821, to the nucleotide sequence of GAM136 RNA, herein designated GAM RNA, also designated SEQ ID:279.

Another function of GAM136 is therefore inhibition of Glycoprotein v (platelet) (GP5, Accession NM_004488.1). Accordingly, utilities of GAM136 include diagnosis, prevention and treatment of diseases and clinical conditions associated with GP5.

GR6 (Accession NM_007354.1) is another GAM136 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:16362, to the nucleotide sequence of GAM136 RNA, herein designated GAM RNA, also designated SEQ ID:279.

Another function of GAM136 is therefore inhibition of GR6 (Accession NM_007354.1). Accordingly, utilities of GAM136 include diagnosis, prevention and treatment of diseases and clinical conditions associated with GR6.

Glutamate receptor, metabotropic 6 (GRM6, Accession NM_000843.2) is another GAM136 target gene, herein designated TARGET GENE. GRM6 BINDING SITE is a target binding site found in the 3' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:19400, to the nucleotide sequence of GAM136 RNA, herein designated GAM RNA, also designated SEQ ID:279.

Another function of GAM136 is therefore inhibition of Glutamate receptor, metabotropic 6 (GRM6, Accession NM_000843.2). Accordingly, utilities of GAM136 include diagnosis, prevention and treatment of diseases and clinical conditions associated with GRM6.

GRWD (Accession NM_031485.1) is another GAM136 target gene, herein designated TARGET GENE. GRWD BINDING SITE is a target binding site found in the 3' untranslated region of mRNA encoded by GRWD, corresponding to a target binding site such as BINDING SITE I, BINDING SITE II or BINDING SITE III of FIG. 8. Table 4 illustrates the complementarity of the nucleotide sequences of GRWD BINDING SITE, designated SEQ ID:19632, to the nucleotide sequence of GAM136 RNA, herein designated GAM RNA, also designated SEQ ID:279.

Another function of GAM136 is therefore inhibition of GRWD (Accession NM_031485.1). Accordingly, utilities of GAM136 include diagnosis, prevention and treatment of diseases and clinical conditions associated with GRWD.

GTPBG3 (Accession NM_032620.1) is another GAM136 target gene, herein designated TARGET GENE. GTPBG3 BINDING SITE1 and GTPBG3 BINDING SITE2 are target binding sites found in untranslated regions of mRNA encoded by GTPBG3, corresponding to target binding sites such as BINDING SITE I, BINDING SITE II or BINDING SITE III of FIG. 8. Table 4 illustrates the complementarity of the nucleotide sequences of GTPBG3 BINDING SITE1 and GTPBG3 BINDING SITE2, designated SEQ ID:14680 and SEQ ID:18851 respectively, to the nucleotide sequence of GAM136 RNA, herein designated GAM RNA, also designated SEQ ID:279.

Another function of GAM136 is therefore inhibition of GTPBG3 (Accession NM_032620.1). Accordingly, utilities of GAM136 include diagnosis, prevention and treatment of diseases and clinical conditions associated with GTPBG3.

HCA4 (Accession) is another GAM136 target gene, herein designated TARGET GENE. HCA4 BINDING SITE is a target binding site found in the 3' untranslated region of mRNA encoded by HCA4, corresponding to a target binding site such as BINDING SITE I, BINDING SITE II or BINDING SITE III of FIG. 8. Table 4 illustrates the complementarity of the nucleotide sequences of HCA4 BINDING SITE, designated SEQ ID:5223, to the nucleotide sequence of GAM136 RNA, herein designated GAM RNA, also designated SEQ ID:279.

Another function of GAM136 is therefore inhibition of HCA4 (Accession). Accordingly, utilities of GAM136 include diagnosis, prevention and treatment of diseases and clinical conditions associated with HCA4.

Histamine receptor h4 (HRH4, Accession NM_021624.2) is another GAM136 target gene, herein designated TARGET GENE. HRH4 BINDING SITE is a target binding site found in the 3' untranslated region of mRNA encoded by HRH4, corresponding to a target binding site such as BINDING SITE I, BINDING SITE II or BINDING SITE III of FIG. 8. Table 4 illustrates the complementarity of the nucleotide sequences of HRH4 BINDING SITE, designated SEQ ID:8519, to the nucleotide sequence of GAM136 RNA, herein designated GAM RNA, also designated SEQ ID:279.

Another function of GAM136 is therefore inhibition of Histamine receptor h4 (HRH4, Accession NM_021624.2). Accordingly, utilities of GAM136 include diagnosis, prevention and treatment of diseases and clinical conditions associated with HRH4.

HSPC065 (Accession NM_014157.2) is another GAM136 target gene, herein designated TARGET GENE. HSPC065 BINDING SITE is a target binding site found in the 3' untranslated region of mRNA encoded by HSPC065, corresponding to a target binding site such as BINDING SITE I, BINDING SITE II or BINDING SITE III of FIG. 8. Table 4 illustrates the complementarity of the nucleotide sequences of HSPC065 BINDING SITE, designated SEQ ID:19775, to the nucleotide sequence of GAM136 RNA, herein designated GAM RNA, also designated SEQ ID:279.

Another function of GAM136 is therefore inhibition of HSPC065 (Accession NM_014157.2). Accordingly, utilities of GAM136 include diagnosis, prevention and treatment of diseases and clinical conditions associated with HSPC065.

Hormonally upregulated neu-associated kinase (HUNK, Accession NM_014586.1) is another GAM136 target gene, herein designated TARGET GENE. HUNK BINDING SITE is a target binding site found in the 3' untranslated region of mRNA encoded by HUNK, corresponding to a target binding site such as BINDING SITE I, BINDING SITE II or BINDING SITE III of FIG. 8. Table 4 illustrates the complementarity of the nucleotide sequences of HUNK BINDING SITE, designated SEQ ID:11495, to the nucleotide sequence of GAM136 RNA, herein designated GAM RNA, also designated SEQ ID:279.

Another function of GAM136 is therefore inhibition of Hormonally upregulated neu-associated kinase (HUNK, Accession NM_014586.1). Accordingly, utilities of GAM136 include diagnosis, prevention and treatment of diseases and clinical conditions associated with HUNK.

Immunoglobulin superfamily, member 2 (IGSF2, Accession NM_004258.1) is another GAM136 target gene, herein designated TARGET GENE. IGSF2 BINDING SITE is a target binding site found in the 3' untranslated region of mRNA encoded by IGSF2, corresponding to a target binding site such as BINDING SITE I, BINDING SITE II or BINDING SITE III of FIG. 8. Table 4 illustrates the complementarity of the nucleotide sequences of IGSF2 BINDING SITE, designated SEQ ID:8672, to the nucleotide sequence of GAM136 RNA, herein designated GAM RNA, also designated SEQ ID:279.

Another function of GAM136 is therefore inhibition of Immunoglobulin superfamily, member 2 (IGSF2, Accession NM_004258.1). Accordingly, utilities of GAM136 include diagnosis, prevention and treatment of diseases and clinical conditions associated with IGSF2.

IMPACT (Accession NM_018439.1) is another GAM136 target gene, herein designated TARGET GENE. IMPACT BINDING SITE is a target binding site found in the 3' untranslated region of mRNA encoded by IMPACT, corresponding to a target binding site such as BINDING SITE I, BINDING SITE II or BINDING SITE III of FIG. 8. Table 4 illustrates the complementarity of the nucleotide sequences of IMPACT BINDING SITE, designated SEQ ID:19776, to the nucleotide sequence of GAM136 RNA, herein designated GAM RNA, also designated SEQ ID:279.

Another function of GAM136 is therefore inhibition of IMPACT (Accession NM_018439.1). Accordingly, utilities of GAM136 include diagnosis, prevention and treatment of diseases and clinical conditions associated with IMPACT.

Indolethylamine n-methyltransferase (INMT, Accession NM_006774.3) is another GAM136 target gene, herein designated TARGET GENE. INMT BINDING SITE is a target binding site found in the 3' untranslated region of mRNA encoded by INMT, corresponding to a target binding site such as BINDING SITE I, BINDING SITE II or BINDING SITE III of FIG. 8. Table 4 illustrates the complementarity of the nucleotide sequences of INMT BINDING SITE, designated SEQ ID:3823, to the nucleotide sequence of GAM136 RNA, herein designated GAM RNA, also designated SEQ ID:279.

Another function of GAM136 is therefore inhibition of Indolethylamine n-methyltransferase (INMT, Accession NM_006774.3). Accordingly, utilities of GAM136 include diagnosis, prevention and treatment of diseases and clinical conditions associated with INMT.

Junctional adhesion molecule 1 (JAM1, Accession) is another GAM136 target gene, herein designated TARGET GENE. JAM1 BINDING SITE is a target binding site found in the 5' untranslated region of mRNA encoded by JAM1, corresponding to a target binding site such as BINDING SITE I, BINDING SITE II or BINDING SITE III of FIG. 8. Table 4 illustrates the complementarity of the nucleotide sequences of JAM1 BINDING SITE, designated SEQ ID:14909, to the nucleotide sequence of GAM136 RNA, herein designated GAM RNA, also designated SEQ ID:279.

Another function of GAM136 is therefore inhibition of Junctional adhesion molecule 1 (JAM1, Accession). Accordingly, utilities of GAM136 include diagnosis, prevention and treatment of diseases and clinical conditions associated with JAM1.

JM11 (Accession NM_033626.1) is another GAM136 target gene, herein designated TARGET GENE. JM11 BINDING SITE is a target binding site found in the 3' untranslated region of mRNA encoded by JM11, corresponding to a target binding site such as BINDING SITE I, BINDING SITE II or BINDING SITE III of FIG. 8. Table 4 illustrates the complementarity of the nucleotide sequences of JM11 BINDING SITE, designated SEQ ID:3482, to the nucleotide sequence of GAM136 RNA, herein designated GAM RNA, also designated SEQ ID:279.

Another function of GAM136 is therefore inhibition of JM11 (Accession NM_033626.1). Accordingly, utilities of GAM136 include diagnosis, prevention and treatment of diseases and clinical conditions associated with JM11.

KIAA0063 (Accession NM_014876.1) is another GAM136 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:3287, to the nucleotide sequence of GAM136 RNA, herein designated GAM RNA, also designated SEQ ID:279.

Another function of GAM136 is therefore inhibition of KIAA0063 (Accession NM_014876.1). Accordingly, utilities of GAM136 include diagnosis, prevention and treatment of diseases and clinical conditions associated with KIAA0063.

KIAA0087 (Accession NM_014769.1) is another GAM136 target gene, herein designated TARGET GENE. KIAA0087 BINDING SITE is a target binding site found in the 3' untranslated region of mRNA encoded by KIAA0087, corresponding to a target binding site such as BINDING SITE I, BINDING SITE II or BINDING SITE III of FIG. 8. Table 4 illustrates the complementarity of the nucleotide sequences of KIAA0087 BINDING SITE, designated SEQ ID:17094, to the nucleotide sequence of GAM136 RNA, herein designated GAM RNA, also designated SEQ ID:279.

Another function of GAM136 is therefore inhibition of KIAA0087 (Accession NM_014769.1). Accordingly, utilities of GAM136 include diagnosis, prevention and treatment of diseases and clinical conditions associated with KIAA0087.

KIAA0090 (Accession NM_015047.1) is another GAM136 target gene, herein designated TARGET GENE. KIAA0090 BINDING SITE is a target binding site found in the 3' untranslated region of mRNA encoded by KIAA0090, corresponding to a target binding site such as BINDING SITE I, BINDING SITE II or BINDING SITE III of FIG. 8. Table 4 illustrates the complementarity of the nucleotide sequences of KIAA0090 BINDING SITE, designated SEQ ID:1552, to the nucleotide sequence of GAM136 RNA, herein designated GAM RNA, also designated SEQ ID:279.

Another function of GAM136 is therefore inhibition of KIAA0090 (Accession NM_015047.1). Accordingly, utilities of GAM136 include diagnosis, prevention and treatment of diseases and clinical conditions associated with KIAA0090.

KIAA0161 (Accession) is another GAM136 target gene, herein designated TARGET GENE. KIAA0161 BINDING SITE is a target binding site found in the 3' untranslated region of mRNA encoded by KIAA0161, corresponding to a target binding site such as BINDING SITE I, BINDING SITE II or BINDING SITE III of FIG. 8. Table 4 illustrates the complementarity of the nucleotide sequences of KIAA0161 BINDING SITE, designated SEQ ID:15212, to the nucleotide sequence of GAM136 RNA, herein designated GAM RNA, also designated SEQ ID:279.

Another function of GAM136 is therefore inhibition of KIAA0161 (Accession). Accordingly, utilities of GAM136 include diagnosis, prevention and treatment of diseases and clinical conditions associated with KIAA0161.

KIAA0205 (Accession NM_014873.1) is another GAM136 target gene, herein designated TARGET GENE. KIAA0205 BINDING SITE is a target binding site found in the 3' untranslated region of mRNA encoded by KIAA0205, corresponding to a target binding site such as BINDING SITE I, BINDING SITE II or BINDING SITE III of FIG. 8. Table 4 illustrates the complementarity of the nucleotide sequences of KIAA0205 BINDING SITE, designated SEQ ID:11019, to the nucleotide sequence of GAM136 RNA, herein designated GAM RNA, also designated SEQ ID:279.

Another function of GAM136 is therefore inhibition of KIAA0205 (Accession NM_014873.1). Accordingly, utilities of GAM136 include diagnosis, prevention and treatment of diseases and clinical conditions associated with KIAA0205.

KIAA0210 (Accession) is another GAM136 target gene, herein designated TARGET GENE. KIAA0210 BINDING SITE1 and KIAA0210 BINDING SITE2 are target binding sites found in untranslated regions of mRNA encoded by KIAA0210, corresponding to target binding sites such as BINDING SITE I, BINDING SITE II or BINDING SITE III of FIG. 8. Table 4 illustrates the complementarity of the nucleotide sequences of KIAA0210 BINDING SITE1 and KIAA0210 BINDING SITE2, designated SEQ ID:12431 and SEQ ID:10972 respectively, to the nucleotide sequence of GAM136 RNA, herein designated GAM RNA, also designated SEQ ID:279.

Another function of GAM136 is therefore inhibition of KIAA0210 (Accession). Accordingly, utilities of GAM136 include diagnosis, prevention and treatment of diseases and clinical conditions associated with KIAA0210.

KIAA0406 (Accession NM_014657.1) is another GAM136 target gene, herein designated TARGET GENE. KIAA0406 BINDING SITE is a target binding site found in the 5' untranslated region of mRNA encoded by KIAA0406, corresponding to a target binding site such as BINDING SITE I, BINDING SITE II or BINDING SITE III of FIG. 8. Table 4 illustrates the complementarity of the nucleotide sequences of KIAA0406 BINDING SITE, designated SEQ ID:13524, to the nucleotide sequence of GAM136 RNA, herein designated GAM RNA, also designated SEQ ID:279.

Another function of GAM136 is therefore inhibition of KIAA0406 (Accession NM_014657.1). Accordingly, utilities of GAM136 include diagnosis, prevention and treatment of diseases and clinical conditions associated with KIAA0406.

KIAA0441 (Accession NM_014797.1) is another GAM136 target gene, herein designated TARGET GENE. KIAA0441 BINDING SITE is a target binding site found in the 3' untranslated region of mRNA encoded by KIAA0441, corresponding to a target binding site such as BINDING SITE I, BINDING SITE II or BINDING SITE III of FIG. 8. Table 4 illustrates the complementarity of the nucleotide sequences of KIAA0441 BINDING SITE, designated SEQ ID:1227, to the nucleotide sequence of GAM136 RNA, herein designated GAM RNA, also designated SEQ ID:279.

Another function of GAM136 is therefore inhibition of KIAA0441 (Accession NM_014797.1). Accordingly, utilities of GAM136 include diagnosis, prevention and treatment of diseases and clinical conditions associated with KIAA0441.

KIAA0447 (Accession) is another GAM136 target gene, herein designated TARGET GENE. KIAA0447 BINDING SITE is a target binding site found in the 3' untranslated region of mRNA encoded by KIAA0447, corresponding to a target binding site such as BINDING SITE I, BINDING SITE II or BINDING SITE III of FIG. 8. Table 4 illustrates the complementarity of the nucleotide sequences of KIAA0447 BINDING SITE, designated SEQ ID:9929, to the nucleotide sequence of GAM136 RNA, herein designated GAM RNA, also designated SEQ ID:279.

Another function of GAM136 is therefore inhibition of KIAA0447 (Accession). Accordingly, utilities of GAM136 include diagnosis, prevention and treatment of diseases and clinical conditions associated with KIAA0447.

KIAA0459 (Accession XM_027862.7) is another GAM136 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:16587, to the nucleotide sequence of GAM136 RNA, herein designated GAM RNA, also designated SEQ ID:279.

Another function of GAM136 is therefore inhibition of KIAA0459 (Accession XM_027862.7). Accordingly, utilities of GAM136 include diagnosis, prevention and treatment of diseases and clinical conditions associated with KIAA0459.

KIAA0493 (Accession XM_034717.8) is another GAM136 target gene, herein designated TARGET GENE. KIAA0493 BINDING SITE is a target binding site found in the 5' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:16273, to the nucleotide sequence of GAM136 RNA, herein designated GAM RNA, also designated SEQ ID:279.

Another function of GAM136 is therefore inhibition of KIAA0493 (Accession XM_034717.8). Accordingly, utilities of GAM136 include diagnosis, prevention and treatment of diseases and clinical conditions associated with KIAA0493.

KIAA0561 (Accession XM_038150.2) is another GAM136 target gene, herein designated TARGET GENE. KIAA0561 BINDING SITE is a target binding site found in the 3' untranslated region of mRNA encoded by KIAA0561, corresponding to a target binding site such as BINDING SITE I, BINDING SITE II or BINDING SITE III of FIG. 8. Table 4 illustrates the complementarity of the nucleotide sequences of KIAA0561 BINDING SITE, designated SEQ ID:10973, to the nucleotide sequence of GAM136 RNA, herein designated GAM RNA, also designated SEQ ID:279.

Another function of GAM136 is therefore inhibition of KIAA0561 (Accession XM_038150.2). Accordingly, utilities of GAM136 include diagnosis, prevention and treatment of diseases and clinical conditions associated with KIAA0561.

KIAA0594 (Accession) is another GAM136 target gene, herein designated TARGET GENE. KIAA0594 BINDING SITE is a target binding site found in the 3' untranslated region of mRNA encoded by KIAA0594, corresponding to a target binding site such as BINDING SITE I, BINDING SITE II or BINDING SITE III of FIG. 8. Table 4 illustrates the complementarity of the nucleotide sequences of KIAA0594 BINDING SITE, designated SEQ ID:9870, to the nucleotide sequence of GAM136 RNA, herein designated GAM RNA, also designated SEQ ID:279.

Another function of GAM136 is therefore inhibition of KIAA0594 (Accession). Accordingly, utilities of GAM136 include diagnosis, prevention and treatment of diseases and clinical conditions associated with KIAA0594.

KIAA0599 (Accession XM_085127.6) is another GAM136 target gene, herein designated TARGET GENE. KIAA0599 BINDING SITE is a target binding site found in the 3' untranslated region of mRNA encoded by KIAA0599, corresponding to a target binding site such as BINDING SITE I, BINDING SITE II or BINDING SITE III of FIG. 8. Table 4 illustrates the complementarity of the nucleotide sequences of KIAA0599 BINDING SITE, designated SEQ ID:18369, to the nucleotide sequence of GAM136 RNA, herein designated GAM RNA, also designated SEQ ID:279.

Another function of GAM136 is therefore inhibition of KIAA0599 (Accession XM_085127.6). Accordingly, utilities of GAM136 include diagnosis, prevention and treatment of diseases and clinical conditions associated with KIAA0599.

KIAA0711 (Accession NM_014867.1) is another GAM136 target gene, herein designated TARGET GENE. KIAA0711 BINDING SITE is a target binding site found in the 3' untranslated region of mRNA encoded by KIAA0711, corresponding to a target binding site such as BINDING SITE I, BINDING SITE II or BINDING SITE III of FIG. 8. Table 4 illustrates the complementarity of the nucleotide sequences of KIAA0711 BINDING SITE, designated SEQ ID:4700, to the nucleotide sequence of GAM136 RNA, herein designated GAM RNA, also designated SEQ ID:279.

Another function of GAM136 is therefore inhibition of KIAA0711 (Accession NM_014867.1). Accordingly, utilities of GAM136 include diagnosis, prevention and treatment of diseases and clinical conditions associated with KIAA0711.

KIAA0841 (Accession XM_049237.5) is another GAM136 target gene, herein designated TARGET GENE. KIAA0841 BINDING SITE is a target binding site found in the 3' untranslated region of mRNA encoded by KIAA0841, corresponding to a target binding site such as BINDING SITE I, BINDING SITE II or BINDING SITE III of FIG. 8. Table 4 illustrates the complementarity of the nucleotide sequences of KIAA0841 BINDING SITE, designated SEQ ID:4724, to the nucleotide sequence of GAM136 RNA, herein designated GAM RNA, also designated SEQ ID:279.

Another function of GAM136 is therefore inhibition of KIAA0841 (Accession XM_049237.5). Accordingly, utilities of GAM136 include diagnosis, prevention and treatment of diseases and clinical conditions associated with KIAA0841.

KIAA0924 (Accession NM_014897.1) is another GAM136 target gene, herein designated TARGET GENE. KIAA0924 BINDING SITE is a target binding site found in the 5' untranslated region of mRNA encoded by KIAA0924, corresponding to a target binding site such as BINDING SITE I, BINDING SITE II or BINDING SITE III of FIG. 8. Table 4 illustrates the complementarity of the nucleotide sequences of KIAA0924 BINDING SITE, designated SEQ ID:3141, to the nucleotide sequence of GAM136 RNA, herein designated GAM RNA, also designated SEQ ID:279.

Another function of GAM136 is therefore inhibition of KIAA0924 (Accession NM_014897.1). Accordingly, utilities of GAM136 include diagnosis, prevention and treatment of diseases and clinical conditions associated with KIAA0924.

KIAA0931 (Accession XM_041191.4) is another GAM136 target gene, herein designated TARGET GENE. KIAA0931 BINDING SITE is a target binding site found in the 3' untranslated region of mRNA encoded by KIAA0931, corresponding to a target binding site such as BINDING SITE I, BINDING SITE II or BINDING SITE III of FIG. 8. Table 4 illustrates the complementarity of the nucleotide sequences of KIAA0931 BINDING SITE, designated SEQ ID:19082, to the nucleotide sequence of GAM136 RNA, herein designated GAM RNA, also designated SEQ ID:279.

Another function of GAM136 is therefore inhibition of KIAA0931 (Accession XM_041191.4). Accordingly, utilities of GAM136 include diagnosis, prevention and treatment of diseases and clinical conditions associated with KIAA0931.

KIAA0961 (Accession NM_014898.1) is another GAM136 target gene, herein designated TARGET GENE. KIAA0961 BINDING SITE is a target binding site found in the 5' untranslated region of mRNA encoded by KIAA0961, corresponding to a target binding site such as BINDING SITE I, BINDING SITE II or BINDING SITE III of FIG. 8. Table 4 illustrates the complementarity of the nucleotide sequences of KIAA0961 BINDING SITE, designated SEQ ID:19593, to the nucleotide sequence of GAM136 RNA, herein designated GAM RNA, also designated SEQ ID:279.

Another function of GAM136 is therefore inhibition of KIAA0961 (Accession NM_014898.1). Accordingly, utilities of GAM136 include diagnosis, prevention and treatment of diseases and clinical conditions associated with KIAA0961.

KIAA1028 (Accession) is another GAM136 target gene, herein designated TARGET GENE. KIAA1028 BINDING SITE is a target binding site found in the 3' untranslated region of mRNA encoded by KIAA1028, corresponding to a target binding site such as BINDING SITE I, BINDING SITE II or BINDING SITE III of FIG. 8. Table 4 illustrates the complementarity of the nucleotide sequences of KIAA1028 BINDING SITE, designated SEQ ID:18235, to the nucleotide sequence of GAM136 RNA, herein designated GAM RNA, also designated SEQ ID:279.

Another function of GAM136 is therefore inhibition of KIAA1028 (Accession). Accordingly, utilities of GAM136 include diagnosis, prevention and treatment of diseases and clinical conditions associated with KIAA1028.

KIAA1143 (Accession XM_044014.3) is another GAM136 target gene, herein designated TARGET GENE. KIAA1143 BINDING SITE is a target binding site found in the 3' untranslated region of mRNA encoded by KIAA1143, corresponding to a target binding site such as BINDING SITE I, BINDING SITE II or BINDING SITE III of FIG. 8. Table 4 illustrates the complementarity of the nucleotide sequences of KIAA1143 BINDING SITE, designated SEQ ID:12426, to the nucleotide sequence of GAM136 RNA, herein designated GAM RNA, also designated SEQ ID:279.

Another function of GAM136 is therefore inhibition of KIAA1143 (Accession XM_044014.3). Accordingly, utilities of GAM136 include diagnosis, prevention and treatment of diseases and clinical conditions associated with KIAA1143.

KIAA1161 (Accession) is another GAM136 target gene, herein designated TARGET GENE. KIAA1161 BINDING SITE is a target binding site found in the 5' untranslated region of mRNA encoded by KIAA1161, corresponding to a target binding site such as BINDING SITE I, BINDING SITE II or BINDING SITE III of FIG. 8. Table 4 illustrates the complementarity of the nucleotide sequences of KIAA1161 BINDING SITE, designated SEQ ID:11081, to the nucleotide sequence of GAM136 RNA, herein designated GAM RNA, also designated SEQ ID:279.

Another function of GAM136 is therefore inhibition of KIAA1161 (Accession). Accordingly, utilities of GAM136 include diagnosis, prevention and treatment of diseases and clinical conditions associated with KIAA1161.

KIAA1185 (Accession NM_020710.1) is another GAM136 target gene, herein designated TARGET GENE. KIAA1185 BINDING SITE is a target binding site found in the 3' untranslated region of mRNA encoded by KIAA1185, corresponding to a target binding site such as BINDING SITE I, BINDING SITE II or BINDING SITE III of FIG. 8. Table 4 illustrates the complementarity of the nucleotide sequences of KIAA1185 BINDING SITE, designated SEQ ID:2134, to the nucleotide sequence of GAM136 RNA, herein designated GAM RNA, also designated SEQ ID:279.

Another function of GAM136 is therefore inhibition of KIAA1185 (Accession NM_020710.1). Accordingly, utilities of GAM136 include diagnosis, prevention and treatment of diseases and clinical conditions associated with KIAA1185.

KIAA1193 (Accession XM_041843.2) is another GAM136 target gene, herein designated TARGET GENE. KIAA1193 BINDING SITE is a target binding site found in the 3' untranslated region of mRNA encoded by KIAA1193, corresponding to a target binding site such as BINDING SITE I, BINDING SITE II or BINDING SITE III of FIG. 8. Table 4 illustrates the complementarity of the nucleotide sequences of KIAA1193 BINDING SITE, designated SEQ ID:18852, to the nucleotide sequence of GAM136 RNA, herein designated GAM RNA, also designated SEQ ID:279.

Another function of GAM136 is therefore inhibition of KIAA1193 (Accession XM_041843.2). Accordingly, utilities of GAM136 include diagnosis, prevention and treatment of diseases and clinical conditions associated with KIAA1193.

KIAA1210 (Accession XM_172801.1) is another GAM136 target gene, herein designated TARGET GENE. KIAA1210 BINDING SITE is a target binding site found in the 5' untranslated region of mRNA encoded by KIAA1210, corresponding to a target binding site such as BINDING SITE I, BINDING SITE II or BINDING SITE III of FIG. 8. Table 4 illustrates the complementarity of the nucleotide sequences of KIAA1210 BINDING SITE, designated SEQ ID:4237, to the nucleotide sequence of GAM136 RNA, herein designated GAM RNA, also designated SEQ ID:279.

Another function of GAM136 is therefore inhibition of KIAA1210 (Accession XM_172801.1). Accordingly, utilities of GAM136 include diagnosis, prevention and treatment of diseases and clinical conditions associated with KIAA1210.

KIAA1254 (Accession) is another GAM136 target gene, herein designated TARGET GENE. KIAA1254 BINDING SITE is a target binding site found in the 3' untranslated region of mRNA encoded by KIAA1254, corresponding to a target binding site such as BINDING SITE I, BINDING SITE II or BINDING SITE III of FIG. 8. Table 4 illustrates the complementarity of the nucleotide sequences of KIAA1254 BINDING SITE, designated SEQ ID:2406, to the nucleotide sequence of GAM136 RNA, herein designated GAM RNA, also designated SEQ ID:279.

Another function of GAM136 is therefore inhibition of KIAA1254 (Accession). Accordingly, utilities of GAM136 include diagnosis, prevention and treatment of diseases and clinical conditions associated with KIAA1254.

KIAA1257 (Accession XM_031577.3) is another GAM136 target gene, herein designated TARGET GENE. KIAA1257 BINDING SITE1 and KIAA1257 BINDING SITE2 are target binding sites found in untranslated regions of mRNA encoded by KIAA1257, corresponding to target binding sites such as BINDING SITE I, BINDING SITE II or BINDING SITE III of FIG. 8. Table 4 illustrates the complementarity of the nucleotide sequences of KIAA1257 BINDING SITE1 and KIAA1257 BINDING SITE2, designated SEQ ID:15885 and SEQ ID:5979 respectively, to the nucleotide sequence of GAM136 RNA, herein designated GAM RNA, also designated SEQ ID:279.

Another function of GAM136 is therefore inhibition of KIAA1257 (Accession XM_031577.3). Accordingly, utilities of GAM136 include diagnosis, prevention and treatment of diseases and clinical conditions associated with KIAA1257.

KIAA1280 (Accession NM_015691.1) is another GAM136 target gene, herein designated TARGET GENE. KIAA1280 BINDING SITE is a target binding site found in the 5' untranslated region of mRNA encoded by KIAA1280, corresponding to a target binding site such as BINDING SITE I, BINDING SITE II or BINDING SITE III of FIG. 8. Table 4 illustrates the complementarity of the nucleotide sequences of KIAA1280 BINDING SITE, designated SEQ ID:8845, to the nucleotide sequence of GAM136 RNA, herein designated GAM RNA, also designated SEQ ID:279.

Another function of GAM136 is therefore inhibition of KIAA1280 (Accession NM_015691.1). Accordingly, utilities of GAM136 include diagnosis, prevention and treatment of diseases and clinical conditions associated with KIAA1280.

KIAA1530 (Accession XM_042661.5) is another GAM136 target gene, herein designated TARGET GENE. KIAA1530 BINDING SITE is a target binding site found in the 5' untranslated region of mRNA encoded by KIAA1530, corresponding to a target binding site such as BINDING SITE I, BINDING SITE II or BINDING SITE III of FIG. 8. Table 4 illustrates the complementarity of the nucleotide sequences of KIAA1530 BINDING SITE, designated SEQ ID:13682, to the nucleotide sequence of GAM136 RNA, herein designated GAM RNA, also designated SEQ ID:279.

Another function of GAM136 is therefore inhibition of KIAA1530 (Accession XM_042661.5). Accordingly, utilities of GAM136 include diagnosis, prevention and treatment of diseases and clinical conditions associated with KIAA1530.

KIAA1649 (Accession) is another GAM136 target gene, herein designated TARGET GENE. KIAA1649 BINDING SITE is a target binding site found in the 3' untranslated region of mRNA encoded by KIAA1649, corresponding to a target binding site such as BINDING SITE I, BINDING SITE II or BINDING SITE III of FIG. 8. Table 4 illustrates the complementarity of the nucleotide sequences of KIAA1649 BINDING SITE, designated SEQ ID:16107, to the nucleotide sequence of GAM136 RNA, herein designated GAM RNA, also designated SEQ ID:279.

Another function of GAM136 is therefore inhibition of KIAA1649 (Accession). Accordingly, utilities of GAM136 include diagnosis, prevention and treatment of diseases and clinical conditions associated with KIAA1649.

KIAA1712 (Accession XM_041497.9) is another GAM136 target gene, herein designated TARGET GENE. KIAA1712 BINDING SITE is a target binding site found in the 3' untranslated region of multiple transcripts of mRNA encoded by KIAA1712, corresponding to a target binding site such as BINDING SITE I, BINDING SITE II or BINDING SITE III of FIG. 8. Table 4 illustrates the complementarity of the nucleotide sequences of KIAA1712 BINDING SITE, designated SEQ ID:5693, to the nucleotide sequence of GAM136 RNA, herein designated GAM RNA, also designated SEQ ID:279.

Another function of GAM136 is therefore inhibition of KIAA1712 (Accession XM_041497.9). Accordingly, utilities of GAM136 include diagnosis, prevention and treatment of diseases and clinical conditions associated with KIAA1712.

KIAA1727 (Accession XM_034262.6) is another GAM136 target gene, herein designated TARGET GENE. KIAA1727 BINDING SITE is a target binding site found in the 3' untranslated region of mRNA encoded by KIAA1727, corresponding to a target binding site such as BINDING SITE I, BINDING SITE II or BINDING SITE III of FIG. 8. Table 4 illustrates the complementarity of the nucleotide sequences of KIAA1727 BINDING SITE, designated SEQ ID:5388, to the nucleotide sequence of GAM136 RNA, herein designated GAM RNA, also designated SEQ ID:279.

Another function of GAM136 is therefore inhibition of KIAA1727 (Accession XM_034262.6). Accordingly, utilities of GAM136 include diagnosis, prevention and treatment of diseases and clinical conditions associated with KIAA1727.

KIAA1737 (Accession NM_033426.1) is another GAM136 target gene, herein designated TARGET GENE. KIAA1737 BINDING SITE is a target binding site found in the 3' untranslated region of mRNA encoded by KIAA1737, corresponding to a target binding site such as BINDING SITE I, BINDING SITE II or BINDING SITE III of FIG. 8. Table 4 illustrates the complementarity of the nucleotide sequences of KIAA1737 BINDING SITE, designated SEQ ID:3552, to the nucleotide sequence of GAM136 RNA, herein designated GAM RNA, also designated SEQ ID:279.

Another function of GAM136 is therefore inhibition of KIAA1737 (Accession NM_033426.1). Accordingly, utilities of GAM136 include diagnosis, prevention and treatment of diseases and clinical conditions associated with KIAA1737.

KIAA1829 (Accession XM_030378.2) is another GAM136 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:13422, to the nucleotide sequence of GAM136 RNA, herein designated GAM RNA, also designated SEQ ID:279.

Another function of GAM136 is therefore inhibition of KIAA1829 (Accession XM_030378.2). Accordingly, utilities of GAM136 include diagnosis, prevention and treatment of diseases and clinical conditions associated with KIAA1829.

KIAA1922 (Accession XM_057040.1) is another GAM136 target gene, herein designated TARGET GENE. KIAA1922 BINDING SITE is a target binding site found in the 5' untranslated region of mRNA encoded by KIAA1922, corresponding to a target binding site such as BINDING SITE I, BINDING SITE II or BINDING SITE III of FIG. 8. Table 4 illustrates the complementarity of the nucleotide sequences of KIAA1922 BINDING SITE, designated SEQ ID:13683, to the nucleotide sequence of GAM136 RNA, herein designated GAM RNA, also designated SEQ ID:279.

Another function of GAM136 is therefore inhibition of KIAA1922 (Accession XM_057040.1). Accordingly, utilities of GAM136 include diagnosis, prevention and treatment of diseases and clinical conditions associated with KIAA1922.

KIAA1924 (Accession NM_153239.2) is another GAM136 target gene, herein designated TARGET GENE. KIAA1924 BINDING SITE is a target binding site found in the 3' untranslated region of mRNA encoded by KIAA1924, corresponding to a target binding site such as BINDING SITE I, BINDING SITE II or BINDING SITE III of FIG. 8. Table 4 illustrates the complementarity of the nucleotide sequences of KIAA1924 BINDING SITE, designated SEQ ID:5980, to the nucleotide sequence of GAM136 RNA, herein designated GAM RNA, also designated SEQ ID:279.

Another function of GAM136 is therefore inhibition of KIAA1924 (Accession NM_153239.2). Accordingly, utilities of GAM136 include diagnosis, prevention and treatment of diseases and clinical conditions associated with KIAA1924.

KIAA1956 (Accession XM_085836.6) is another GAM136 target gene, herein designated TARGET GENE. KIAA1956 BINDING SITE is a target binding site found in the 3' untranslated region of mRNA encoded by KIAA1956, corresponding to a target binding site such as BINDING SITE I, BINDING SITE II or BINDING SITE III of FIG. 8. Table 4 illustrates the complementarity of the nucleotide sequences of KIAA1956 BINDING SITE, designated SEQ ID:17777, to the nucleotide sequence of GAM136 RNA, herein designated GAM RNA, also designated SEQ ID:279.

Another function of GAM136 is therefore inhibition of KIAA1956 (Accession XM_085836.6). Accordingly, utilities of GAM136 include diagnosis, prevention and treatment of diseases and clinical conditions associated with KIAA1956.

KIAA1971 (Accession XM_058720.5) is another GAM136 target gene, herein designated TARGET GENE. KIAA1971 BINDING SITE is a target binding site found in the 3' untranslated region of mRNA encoded by KIAA1971, corresponding to a target binding site such as BINDING SITE I, BINDING SITE II or BINDING SITE III of FIG. 8. Table 4 illustrates the complementarity of the nucleotide sequences of KIAA1971 BINDING SITE, designated SEQ ID:11033, to the nucleotide sequence of GAM136 RNA, herein designated GAM RNA, also designated SEQ ID:279.

Another function of GAM136 is therefore inhibition of KIAA1971 (Accession XM_058720.5). Accordingly, utilities of GAM136 include diagnosis, prevention and treatment of diseases and clinical conditions associated with KIAA1971.

Lysosomal-associated membrane protein 3 (LAMP3, Accession NM_014398.1) is another GAM136 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:13626, to the nucleotide sequence of GAM136 RNA, herein designated GAM RNA, also designated SEQ ID:279.

Another function of GAM136 is therefore inhibition of Lysosomal-associated membrane protein 3 (LAMP3, Accession NM_014398.1). Accordingly, utilities of GAM136 include diagnosis, prevention and treatment of diseases and clinical conditions associated with LAMP3.

Leukocyte immunoglobulin-like receptor, subfamily a (without tm domain), member 3 (LILRA3, Accession NM_006865.1) is another GAM136 target gene, herein designated TARGET GENE. LILRA3 BINDING SITE is a target binding site found in the 3' untranslated region of mRNA encoded by LILRA3, corresponding to a target binding site such as BINDING SITE I, BINDING SITE II or BINDING SITE III of FIG. 8. Table 4 illustrates the complementarity of the nucleotide sequences of LILRA3 BINDING SITE, designated SEQ ID:16588, to the nucleotide sequence of GAM136 RNA, herein designated GAM RNA, also designated SEQ ID:279.

Another function of GAM136 is therefore inhibition of Leukocyte immunoglobulin-like receptor, subfamily a (without tm domain), member 3 (LILRA3, Accession NM_006865.1). Accordingly, utilities of GAM136 include diagnosis, prevention and treatment of diseases and clinical conditions associated with LILRA3.

Lethal giant larvae homolog 1 (drosophila) (LLGL1, Accession NM_004140.2) is another GAM136 target gene, herein designated TARGET GENE. LLGL1 BINDING SITE is a target binding site found in the 3' untranslated region of mRNA encoded by LLGL1, corresponding to a target binding site such as BINDING SITE I, BINDING SITE II or BINDING SITE III of FIG. 8. Table 4 illustrates the complementarity of the nucleotide sequences of LLGL1 BINDING SITE, designated SEQ ID:17511, to the nucleotide sequence of GAM136 RNA, herein designated GAM RNA, also designated SEQ ID:279.

Another function of GAM136 is therefore inhibition of Lethal giant larvae homolog 1 (drosophila) (LLGL1, Accession NM_004140.2), a gene which has a role in control of cell proliferation and differentiation during development. Accordingly, utilities of GAM136 include diagnosis, prevention and treatment of diseases and clinical conditions associated with LLGL1.

The function of LLGL1 and its association with various diseases and clinical conditions, has been established by previous studies, as described hereinabove with reference to GAM116.1. LOC112724 (Accession) is another GAM136 target gene, herein designated TARGET GENE. LOC112724 BINDING SITE is a target binding site found in the 5' untranslated region of mRNA encoded by LOC112724, corresponding to a target binding site such as BINDING SITE I, BINDING SITE II or BINDING SITE III of FIG. 8. Table 4 illustrates the complementarity of the nucleotide sequences of LOC112724 BINDING SITE, designated SEQ ID:4017, to the nucleotide sequence of GAM136 RNA, herein designated GAM RNA, also designated SEQ ID:279.

Another function of GAM136 is therefore inhibition of LOC112724 (Accession). Accordingly, utilities of GAM136 include diagnosis, prevention and treatment of diseases and clinical conditions associated with LOC112724.

LOC113675 (Accession) is another GAM136 target gene, herein designated TARGET GENE. LOC113675 BINDING SITE is a target binding site found in the 5' untranslated region of mRNA encoded by LOC113675, corresponding to a target binding site such as BINDING SITE I, BINDING SITE II or BINDING SITE III of FIG. 8. Table 4 illustrates the complementarity of the nucleotide sequences of LOC113675 BINDING SITE, designated SEQ ID:5894, to the nucleotide sequence of GAM136 RNA, herein designated GAM RNA, also designated SEQ ID:279.

Another function of GAM136 is therefore inhibition of LOC113675 (Accession). Accordingly, utilities of GAM136 include diagnosis, prevention and treatment of diseases and clinical conditions associated with LOC113675.

LOC115219 (Accession XM_055499.4) is another GAM136 target gene, herein designated TARGET GENE. LOC115219 BINDING SITE is a target binding site found in the 5' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:1562, to the nucleotide sequence of GAM136 RNA, herein designated GAM RNA, also designated SEQ ID:279.

Another function of GAM136 is therefore inhibition of LOC115219 (Accession XM_055499.4). Accordingly, utilities of GAM136 include diagnosis, prevention and treatment of diseases and clinical conditions associated with LOC115219.

LOC119392 (Accession NM_145247.1) is another GAM136 target gene, herein designated TARGET GENE. LOC119392 BINDING SITE is a target binding site found in the 3' untranslated region of mRNA encoded by LOC119392, corresponding to a target binding site such as BINDING SITE I, BINDING SITE II or BINDING SITE III of FIG. 8. Table 4 illustrates the complementarity of the nucleotide sequences of LOC119392 BINDING SITE, designated SEQ ID:3818, to the nucleotide sequence of GAM136 RNA, herein designated GAM RNA, also designated SEQ ID:279.

Another function of GAM136 is therefore inhibition of LOC119392 (Accession NM_145247.1). Accordingly, utilities of GAM136 include diagnosis, prevention and treatment of diseases and clinical conditions associated with LOC119392.

LOC120939 (Accession) is another GAM136 target gene, herein designated TARGET GENE. LOC120939 BINDING SITE is a target binding site found in the 3' untranslated region of mRNA encoded by LOC120939, corresponding to a target binding site such as BINDING SITE I, BINDING SITE II or BINDING SITE III of FIG. 8. Table 4 illustrates the complementarity of the nucleotide sequences of LOC120939 BINDING SITE, designated SEQ ID:13240, to the nucleotide sequence of GAM136 RNA, herein designated GAM RNA, also designated SEQ ID:279.

Another function of GAM136 is therefore inhibition of LOC120939 (Accession). Accordingly, utilities of GAM136 include diagnosis, prevention and treatment of diseases and clinical conditions associated with LOC120939.

LOC126133 (Accession) is another GAM136 target gene, herein designated TARGET GENE. LOC126133 BINDING SITE is a target binding site found in the 3' untranslated region of mRNA encoded by LOC126133, corresponding to a target binding site such as BINDING SITE I, BINDING SITE II or BINDING SITE III of FIG. 8. Table 4 illustrates the complementarity of the nucleotide sequences of LOC126133 BINDING SITE, designated SEQ ID:17494, to the nucleotide sequence of GAM136 RNA, herein designated GAM RNA, also designated SEQ ID:279.

Another function of GAM136 is therefore inhibition of LOC126133 (Accession). Accordingly, utilities of GAM136 include diagnosis, prevention and treatment of diseases and clinical conditions associated with LOC126133.

LOC126669 (Accession XM_060121.4) is another GAM136 target gene, herein designated TARGET GENE. LOC126669 BINDING SITE is a target binding site found in the 5' untranslated region of mRNA encoded by LOC126669, corresponding to a target binding site such as BINDING SITE I, BINDING SITE II or BINDING SITE III of FIG. 8. Table 4 illustrates the complementarity of the nucleotide sequences of LOC126669 BINDING SITE, designated SEQ ID:9831, to the nucleotide sequence of GAM136 RNA, herein designated GAM RNA, also designated SEQ ID:279.

Another function of GAM136 is therefore inhibition of LOC126669 (Accession XM_060121.4). Accordingly, utilities of GAM136 include diagnosis, prevention and treatment of diseases and clinical conditions associated with LOC126669.

LOC128387 (Accession XM_059243.3) is another GAM136 target gene, herein designated TARGET GENE. LOC128387 BINDING SITE is a target binding site found in the 5' untranslated region of mRNA encoded by LOC128387, corresponding to a target binding site such as BINDING SITE I, BINDING SITE II or BINDING SITE III of FIG. 8. Table 4 illustrates the complementarity of the nucleotide sequences of LOC128387 BINDING SITE, designated SEQ ID:5976, to the nucleotide sequence of GAM136 RNA, herein designated GAM RNA, also designated SEQ ID:279.

Another function of GAM136 is therefore inhibition of LOC128387 (Accession XM_059243.3). Accordingly, utilities of GAM136 include diagnosis, prevention and treatment of diseases and clinical conditions associated with LOC128387.

LOC131308 (Accession) is another GAM136 target gene, herein designated TARGET GENE. LOC131308 BINDING SITE is a target binding site found in the 3' untranslated region of mRNA encoded by LOC131308, corresponding to a target binding site such as BINDING SITE I, BINDING SITE II or BINDING SITE III of FIG. 8. Table 4 illustrates the complementarity of the nucleotide sequences of LOC131308 BINDING SITE, designated SEQ ID:9826, to the nucleotide sequence of GAM136 RNA, herein designated GAM RNA, also designated SEQ ID:279.

Another function of GAM136 is therefore inhibition of LOC131308 (Accession). Accordingly, utilities of GAM136 include diagnosis, prevention and treatment of diseases and clinical conditions associated with LOC131308.

LOC135154 (Accession NM_145267.1) is another GAM136 target gene, herein designated TARGET GENE. LOC135154 BINDING SITE is a target binding site found in the 3' untranslated region of mRNA encoded by LOC135154, corresponding to a target binding site such as BINDING SITE I, BINDING SITE II or BINDING SITE III of FIG. 8. Table 4 illustrates the complementarity of the nucleotide sequences of LOC135154 BINDING SITE, designated SEQ ID:5005, to the nucleotide sequence of GAM136 RNA, herein designated GAM RNA, also designated SEQ ID:279.

Another function of GAM136 is therefore inhibition of LOC135154 (Accession NM_145267.1). Accordingly, utilities of GAM136 include diagnosis, prevention and treatment of diseases and clinical conditions associated with LOC135154.

LOC135398 (Accession) is another GAM136 target gene, herein designated TARGET GENE. LOC135398 BINDING SITE is a target binding site found in the 3' untranslated region of mRNA encoded by LOC135398, corresponding to a target binding site such as BINDING SITE I, BINDING SITE II or BINDING SITE III of FIG. 8. Table 4 illustrates the complementarity of the nucleotide sequences of LOC135398 BINDING SITE, designated SEQ ID:11002, to the nucleotide sequence of GAM136 RNA, herein designated GAM RNA, also designated SEQ ID:279.

Another function of GAM136 is therefore inhibition of LOC135398 (Accession). Accordingly, utilities of GAM136 include diagnosis, prevention and treatment of diseases and clinical conditions associated with LOC135398.

LOC135763 (Accession NM_138572.1) is another GAM136 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:3127, to the nucleotide sequence of GAM136 RNA, herein designated GAM RNA, also designated SEQ ID:279.

Another function of GAM136 is therefore inhibition of LOC135763 (Accession NM_138572.1). Accordingly, utilities of GAM136 include diagnosis, prevention and treatment of diseases and clinical conditions associated with LOC135763.

LOC138050 (Accession) is another GAM136 target gene, herein designated TARGET GENE. LOC138050 BINDING SITE is a target binding site found in the 5' untranslated region of mRNA encoded by LOC138050, corresponding to a target binding site such as BINDING SITE I, BINDING SITE II or BINDING SITE III of FIG. 8. Table 4 illustrates the complementarity of the nucleotide sequences of LOC138050 BINDING SITE, designated SEQ ID:5749, to the nucleotide sequence of GAM136 RNA, herein designated GAM RNA, also designated SEQ ID:279.

Another function of GAM136 is therefore inhibition of LOC138050 (Accession). Accordingly, utilities of GAM136 include diagnosis, prevention and treatment of diseases and clinical conditions associated with LOC138050.

LOC138199 (Accession) is another GAM136 target gene, herein designated TARGET GENE. LOC138199 BINDING SITE is a target binding site found in the 3' untranslated region of mRNA encoded by LOC138199, corresponding to a target binding site such as BINDING SITE I, BINDING SITE II or BINDING SITE III of FIG. 8. Table 4 illustrates the complementarity of the nucleotide sequences of LOC138199 BINDING SITE, designated SEQ ID:5770, to the nucleotide sequence of GAM136 RNA, herein designated GAM RNA, also designated SEQ ID:279.

Another function of GAM136 is therefore inhibition of LOC138199 (Accession). Accordingly, utilities of GAM136 include diagnosis, prevention and treatment of diseases and clinical conditions associated with LOC138199.

LOC142927 (Accession) is another GAM136 target gene, herein designated TARGET GENE. LOC142927 BINDING SITE is a target binding site found in the 5' untranslated region of mRNA encoded by LOC142927, corresponding to a target binding site such as BINDING SITE I, BINDING SITE II or BINDING SITE III of FIG. 8. Table 4 illustrates the complementarity of the nucleotide sequences of LOC142927 BINDING SITE, designated SEQ ID:9930, to the nucleotide sequence of GAM136 RNA, herein designated GAM RNA, also designated SEQ ID:279.

Another function of GAM136 is therefore inhibition of LOC142927 (Accession). Accordingly, utilities of GAM136 include diagnosis, prevention and treatment of diseases and clinical conditions associated with LOC142927.

LOC144317 (Accession XM_084813.4) is another GAM136 target gene, herein designated TARGET GENE. LOC144317 BINDING SITE is a target binding site found in the 5' untranslated region of mRNA encoded by LOC144317, corresponding to a target binding site such as BINDING SITE I, BINDING SITE II or BINDING SITE III of FIG. 8. Table 4 illustrates the complementarity of the nucleotide sequences of LOC144317 BINDING SITE, designated SEQ ID:14198, to the nucleotide sequence of GAM136 RNA, herein designated GAM RNA, also designated SEQ ID:279.

Another function of GAM136 is therefore inhibition of LOC144317 (Accession XM_084813.4). Accordingly, utilities of GAM136 include diagnosis, prevention and treatment of diseases and clinical conditions associated with LOC144317.

LOC145268 (Accession XM_085072.1) is another GAM136 target gene, herein designated TARGET GENE. LOC145268 BINDING SITE is a target binding site found in the 5' untranslated region of mRNA encoded by LOC145268, corresponding to a target binding site such as BINDING SITE I, BINDING SITE II or BINDING SITE III of FIG. 8. Table 4 illustrates the complementarity of the nucleotide sequences of LOC145268 BINDING SITE, designated SEQ ID:6134, to the nucleotide sequence of GAM136 RNA, herein designated GAM RNA, also designated SEQ ID:279.

Another function of GAM136 is therefore inhibition of LOC145268 (Accession XM_085072.1). Accordingly, utilities of GAM136 include diagnosis, prevention and treatment of diseases and clinical conditions associated with LOC145268.

LOC145622 (Accession) is another GAM136 target gene, herein designated TARGET GENE. LOC145622 BINDING SITE is a target binding site found in the 3' untranslated region of mRNA encoded by LOC145622, corresponding to a target binding site such as BINDING SITE I, BINDING SITE II or BINDING SITE III of FIG. 8. Table 4 illustrates the complementarity of the nucleotide sequences of LOC145622 BINDING SITE, designated SEQ ID:14806, to the nucleotide sequence of GAM136 RNA, herein designated GAM RNA, also designated SEQ ID:279.

Another function of GAM136 is therefore inhibition of LOC145622 (Accession). Accordingly, utilities of GAM136 include diagnosis, prevention and treatment of diseases and clinical conditions associated with LOC145622.

LOC145813 (Accession XM_096873.2) is another GAM136 target gene, herein designated TARGET GENE. LOC145813 BINDING SITE is a target binding site found in the 5' untranslated region of mRNA encoded by LOC145813, corresponding to a target binding site such as BINDING SITE I, BINDING SITE II or BINDING SITE III of FIG. 8. Table 4 illustrates the complementarity of the nucleotide sequences of LOC145813 BINDING SITE, designated SEQ ID:9548, to the nucleotide sequence of GAM136 RNA, herein designated GAM RNA, also designated SEQ ID:279.

Another function of GAM136 is therefore inhibition of LOC145813 (Accession XM_096873.2). Accordingly, utilities of GAM136 include diagnosis, prevention and treatment of diseases and clinical conditions associated with LOC145813.

LOC146229 (Accession XM_085387.1) is another GAM136 target gene, herein designated TARGET GENE. LOC146229 BINDING SITE1 and LOC146229 BINDING SITE2 are target binding sites found in untranslated regions of mRNA encoded by LOC146229, corresponding to target binding sites such as BINDING SITE I, BINDING SITE II or BINDING SITE III of FIG. 8. Table 4 illustrates the complementarity of the nucleotide sequences of LOC146229 BINDING SITE1 and LOC146229 BINDING SITE2, designated SEQ ID:12076 and SEQ ID:3787 respectively, to the nucleotide sequence of GAM136 RNA, herein designated GAM RNA, also designated SEQ ID:279.

Another function of GAM136 is therefore inhibition of LOC146229 (Accession XM_085387.1). Accordingly, utilities of GAM136 include diagnosis, prevention and treatment of diseases and clinical conditions associated with LOC146229.

LOC146443 (Accession XM_085461.6) is another GAM136 target gene, herein designated TARGET GENE. LOC146443 BINDING SITE is a target binding site found in the 5' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:14100, to the nucleotide sequence of GAM136 RNA, herein designated GAM RNA, also designated SEQ ID:279.

Another function of GAM136 is therefore inhibition of LOC146443 (Accession XM_085461.6). Accordingly, utilities of GAM136 include diagnosis, prevention and treatment of diseases and clinical conditions associated with LOC146443.

LOC146455 (Accession) is another GAM136 target gene, herein designated TARGET GENE. LOC146455 BINDING SITE is a target binding site found in the 5' untranslated region of mRNA encoded by LOC146455, corresponding to a target binding site such as BINDING SITE I, BINDING SITE II or BINDING SITE III of FIG. 8. Table 4 illustrates the complementarity of the nucleotide sequences of LOC146455 BINDING SITE, designated SEQ ID:12428, to the nucleotide sequence of GAM136 RNA, herein designated GAM RNA, also designated SEQ ID:279.

Another function of GAM136 is therefore inhibition of LOC146455 (Accession). Accordingly, utilities of GAM136 include diagnosis, prevention and treatment of diseases and clinical conditions associated with LOC146455.

LOC146901 (Accession XM_097121.1) is another GAM136 target gene, herein designated TARGET GENE. LOC146901 BINDING SITE is a target binding site found in the 3' untranslated region of mRNA encoded by LOC146901, corresponding to a target binding site such as BINDING SITE I, BINDING SITE II or BINDING SITE III of FIG. 8. Table 4 illustrates the complementarity of the nucleotide sequences of LOC146901 BINDING SITE, designated SEQ ID:14423, to the nucleotide sequence of GAM136 RNA, herein designated GAM RNA, also designated SEQ ID:279.

Another function of GAM136 is therefore inhibition of LOC146901 (Accession XM_097121.1). Accordingly, utilities of GAM136 include diagnosis, prevention and treatment of diseases and clinical conditions associated with LOC146901.

LOC146909 (Accession XM_085634.3) is another GAM136 target gene, herein designated TARGET GENE. LOC146909 BINDING SITE is a target binding site found in the 3' untranslated region of mRNA encoded by LOC146909, corresponding to a target binding site such as BINDING SITE I, BINDING SITE II or BINDING SITE III of FIG. 8. Table 4 illustrates the complementarity of the nucleotide sequences of LOC146909 BINDING SITE, designated SEQ ID:12423, to the nucleotide sequence of GAM136 RNA, herein designated GAM RNA, also designated SEQ ID:279.

Another function of GAM136 is therefore inhibition of LOC146909 (Accession XM_085634.3). Accordingly, utilities of GAM136 include diagnosis, prevention and treatment of diseases and clinical conditions associated with LOC146909.

LOC147276 (Accession) is another GAM136 target gene, herein designated TARGET GENE. LOC147276 BINDING SITE is a target binding site found in the 5' untranslated region of mRNA encoded by LOC147276, corresponding to a target binding site such as BINDING SITE I, BINDING SITE II or BINDING SITE III of FIG. 8. Table 4 illustrates the complementarity of the nucleotide sequences of LOC147276 BINDING SITE, designated SEQ ID:4474, to the nucleotide sequence of GAM136 RNA, herein designated GAM RNA, also designated SEQ ID:279.

Another function of GAM136 is therefore inhibition of LOC147276 (Accession). Accordingly, utilities of GAM136 include diagnosis, prevention and treatment of diseases and clinical conditions associated with LOC147276.

LOC147429 (Accession) is another GAM136 target gene, herein designated TARGET GENE. LOC147429 BINDING SITE is a target binding site found in the 5' untranslated region of mRNA encoded by LOC147429, corresponding to a target binding site such as BINDING SITE I, BINDING SITE II or BINDING SITE III of FIG. 8. Table 4 illustrates the complementarity of the nucleotide sequences of LOC147429 BINDING SITE, designated SEQ ID:15647, to the nucleotide sequence of GAM136 RNA, herein designated GAM RNA, also designated SEQ ID:279.

Another function of GAM136 is therefore inhibition of LOC147429 (Accession). Accordingly, utilities of GAM136 include diagnosis, prevention and treatment of diseases and clinical conditions associated with LOC147429.

LOC147660 (Accession) is another GAM136 target gene, herein designated TARGET GENE. LOC147660 BINDING SITE is a target binding site found in the 3' untranslated region of mRNA encoded by LOC147660, corresponding to a target binding site such as BINDING SITE I, BINDING SITE II or BINDING SITE III of FIG. 8. Table 4 illustrates the complementarity of the nucleotide sequences of LOC147660 BINDING SITE, designated SEQ ID:10507, to the nucleotide sequence of GAM136 RNA, herein designated GAM RNA, also designated SEQ ID:279.

Another function of GAM136 is therefore inhibition of LOC147660 (Accession). Accordingly, utilities of GAM136 include diagnosis, prevention and treatment of diseases and clinical conditions associated with LOC147660.

LOC147990 (Accession) is another GAM136 target gene, herein designated TARGET GENE. LOC147990 BINDING SITE is a target binding site found in the 3' untranslated region of mRNA encoded by LOC147990, corresponding to a target binding site such as BINDING SITE I, BINDING SITE II or BINDING SITE III of FIG. 8. Table 4 illustrates the complementarity of the nucleotide sequences of LOC147990 BINDING SITE, designated SEQ ID:4469, to the nucleotide sequence of GAM136 RNA, herein designated GAM RNA, also designated SEQ ID:279.

Another function of GAM136 is therefore inhibition of LOC147990 (Accession). Accordingly, utilities of GAM136 include diagnosis, prevention and treatment of diseases and clinical conditions associated with LOC147990.

LOC148137 (Accession NM_144692.1) is another GAM136 target gene, herein designated TARGET GENE. LOC148137 BINDING SITE is a target binding site found in the 3' untranslated region of mRNA encoded by LOC148137, corresponding to a target binding site such as BINDING SITE I, BINDING SITE II or BINDING SITE III of FIG. 8. Table 4 illustrates the complementarity of the nucleotide sequences of LOC148137 BINDING SITE, designated SEQ ID:17632, to the nucleotide sequence of GAM136 RNA, herein designated GAM RNA, also designated SEQ ID:279.

Another function of GAM136 is therefore inhibition of LOC148137 (Accession NM_144692.1). Accordingly, utilities of GAM136 include diagnosis, prevention and treatment of diseases and clinical conditions associated with LOC148137.

LOC148189 (Accession XM_086087.1) is another GAM136 target gene, herein designated TARGET GENE. LOC148189 BINDING SITE is a target binding site found in the 5' untranslated region of mRNA encoded by LOC148189, corresponding to a target binding site such as BINDING SITE I, BINDING SITE II or BINDING SITE III of FIG. 8. Table 4 illustrates the complementarity of the nucleotide sequences of LOC148189 BINDING SITE, designated SEQ ID:7424, to the nucleotide sequence of GAM136 RNA, herein designated GAM RNA, also designated SEQ ID:279.

Another function of GAM136 is therefore inhibition of LOC148189 (Accession XM_086087.1). Accordingly, utilities of GAM136 include diagnosis, prevention and treatment of diseases and clinical conditions associated with LOC148189.

LOC148195 (Accession) is another GAM136 target gene, herein designated TARGET GENE. LOC148195 BINDING SITE1 and LOC148195 BINDING SITE2 are target binding sites found in untranslated regions of mRNA encoded by LOC148195, corresponding to target binding sites such as BINDING SITE I, BINDING SITE II or BINDING SITE III of FIG. 8. Table 4 illustrates the complementarity of the nucleotide sequences of LOC148195 BINDING SITE1 and LOC148195 BINDING SITE2, designated SEQ ID:15515 and SEQ ID:1164 respectively, to the nucleotide sequence of GAM136 RNA, herein designated GAM RNA, also designated SEQ ID:279.

Another function of GAM136 is therefore inhibition of LOC148195 (Accession). Accordingly, utilities of GAM136 include diagnosis, prevention and treatment of diseases and clinical conditions associated with LOC148195.

LOC148645 (Accession) is another GAM136 target gene, herein designated TARGET GENE. LOC148645 BINDING SITE is a target binding site found in the 5' untranslated region of mRNA encoded by LOC148645, corresponding to a target binding site such as BINDING SITE I, BINDING SITE II or BINDING SITE III of FIG. 8. Table 4 illustrates the complementarity of the nucleotide sequences of LOC148645 BINDING SITE, designated SEQ ID:11573, to the nucleotide sequence of GAM136 RNA, herein designated GAM RNA, also designated SEQ ID:279.

Another function of GAM136 is therefore inhibition of LOC148645 (Accession). Accordingly, utilities of GAM136 include diagnosis, prevention and treatment of diseases and clinical conditions associated with LOC148645.

LOC148887 (Accession) is another GAM136 target gene, herein designated TARGET GENE. LOC148887 BINDING SITE is a target binding site found in the 5' untranslated region of mRNA encoded by LOC148887, corresponding to a target binding site such as BINDING SITE I, BINDING SITE II or BINDING SITE III of FIG. 8. Table 4 illustrates the complementarity of the nucleotide sequences of LOC148887 BINDING SITE, designated SEQ ID:13862, to the nucleotide sequence of GAM136 RNA, herein designated GAM RNA, also designated SEQ ID:279.

Another function of GAM136 is therefore inhibition of LOC148887 (Accession). Accordingly, utilities of GAM136 include diagnosis, prevention and treatment of diseases and clinical conditions associated with LOC148887.

LOC149117 (Accession) is another GAM136 target gene, herein designated TARGET GENE. LOC149117 BINDING SITE is a target binding site found in the 5' untranslated region of mRNA encoded by LOC149117, corresponding to a target binding site such as BINDING SITE I, BINDING SITE II or BINDING SITE III of FIG. 8. Table 4 illustrates the complementarity of the nucleotide sequences of LOC149117 BINDING SITE, designated SEQ ID:17663, to the nucleotide sequence of GAM136 RNA, herein designated GAM RNA, also designated SEQ ID:279.

Another function of GAM136 is therefore inhibition of LOC149117 (Accession). Accordingly, utilities of GAM136 include diagnosis, prevention and treatment of diseases and clinical conditions associated with LOC149117.

LOC149506 (Accession XM_097661.4) is another GAM136 target gene, herein designated TARGET GENE. LOC149506 BINDING SITE is a target binding site found in the 3' untranslated region of mRNA encoded by LOC149506, corresponding to a target binding site such as BINDING SITE I, BINDING SITE II or BINDING SITE III of FIG. 8. Table 4 illustrates the complementarity of the nucleotide sequences of LOC149506 BINDING SITE, designated SEQ ID:6703, to the nucleotide sequence of GAM136 RNA, herein designated GAM RNA, also designated SEQ ID:279.

Another function of GAM136 is therefore inhibition of LOC149506 (Accession XM_097661.4). Accordingly, utilities of GAM136 include diagnosis, prevention and treatment of diseases and clinical conditions associated with LOC149506.

LOC149692 (Accession XM_097706.1) is another GAM136 target gene, herein designated TARGET GENE. LOC149692 BINDING SITE is a target binding site found in the 3' untranslated region of mRNA encoded by LOC149692, corresponding to a target binding site such as BINDING SITE I, BINDING SITE II or BINDING SITE III of FIG. 8. Table 4 illustrates the complementarity of the nucleotide sequences of LOC149692 BINDING SITE, designated SEQ ID:14807, to the nucleotide sequence of GAM136 RNA, herein designated GAM RNA, also designated SEQ ID:279.

Another function of GAM136 is therefore inhibition of LOC149692 (Accession XM_097706.1). Accordingly, utilities of GAM136 include diagnosis, prevention and treatment of diseases and clinical conditions associated with LOC149692.

LOC150225 (Accession XM_097870.1) is another GAM136 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:9366, to the nucleotide sequence of GAM136 RNA, herein designated GAM RNA, also designated SEQ ID:279.

Another function of GAM136 is therefore inhibition of LOC150225 (Accession XM_097870.1). Accordingly, utilities of GAM136 include diagnosis, prevention and treatment of diseases and clinical conditions associated with LOC150225.

LOC150397 (Accession XM_086907.1) is another GAM136 target gene, herein designated TARGET GENE. LOC150397 BINDING SITE is a target binding site found in the 3' untranslated region of mRNA encoded by LOC150397, corresponding to a target binding site such as BINDING SITE I, BINDING SITE II or BINDING SITE III of FIG. 8. Table 4 illustrates the complementarity of the nucleotide sequences of LOC150397 BINDING SITE, designated SEQ ID:9404, to the nucleotide sequence of GAM136 RNA, herein designated GAM RNA, also designated SEQ ID:279.

Another function of GAM136 is therefore inhibition of LOC150397 (Accession XM_086907.1). Accordingly, utilities of GAM136 include diagnosis, prevention and treatment of diseases and clinical conditions associated with LOC150397.

LOC151057 (Accession XM_097998.2) is another GAM136 target gene, herein designated TARGET GENE. LOC151057 BINDING SITE is a target binding site found in the 5' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:9827, to the nucleotide sequence of GAM136 RNA, herein designated GAM RNA, also designated SEQ ID:279.

Another function of GAM136 is therefore inhibition of LOC151057 (Accession XM_097998.2). Accordingly, utilities of GAM136 include diagnosis, prevention and treatment of diseases and clinical conditions associated with LOC151057.

LOC151201 (Accession XM_098021.1) is another GAM136 target gene, herein designated TARGET GENE. LOC151201 BINDING SITE is a target binding site found in the 3' untranslated region of mRNA encoded by LOC151201, corresponding to a target binding site such as BINDING SITE I, BINDING SITE II or BINDING SITE III of FIG. 8. Table 4 illustrates the complementarity of the nucleotide sequences of LOC151201 BINDING SITE, designated SEQ ID:3995, to the nucleotide sequence of GAM136 RNA, herein designated GAM RNA, also designated SEQ ID:279.

Another function of GAM136 is therefore inhibition of LOC151201 (Accession XM_098021.1). Accordingly, utilities of GAM136 include diagnosis, prevention and treatment of diseases and clinical conditions associated with LOC151201.

LOC151475 (Accession XM_098063.1) is another GAM136 target gene, herein designated TARGET GENE. LOC151475 BINDING SITE is a target binding site found in the 5' untranslated region of mRNA encoded by LOC151475, corresponding to a target binding site such as BINDING SITE I, BINDING SITE II or BINDING SITE III of FIG. 8. Table 4 illustrates the complementarity of the nucleotide sequences of LOC151475 BINDING SITE, designated SEQ ID:19282, to the nucleotide sequence of GAM136 RNA, herein designated GAM RNA, also designated SEQ ID:279.

Another function of GAM136 is therefore inhibition of LOC151475 (Accession XM_098063.1). Accordingly, utilities of GAM136 include diagnosis, prevention and treatment of diseases and clinical conditions associated with LOC151475.

LOC151602 (Accession) is another GAM136 target gene, herein designated TARGET GENE. LOC151602 BINDING SITE is a target binding site found in the 3' untranslated region of mRNA encoded by LOC151602, corresponding to a target binding site such as BINDING SITE I, BINDING SITE II or BINDING SITE III of FIG. 8. Table 4 illustrates the complementarity of the nucleotide sequences of LOC151602 BINDING SITE, designated SEQ ID:16085, to the nucleotide sequence of GAM136 RNA, herein designated GAM RNA, also designated SEQ ID:279.

Another function of GAM136 is therefore inhibition of LOC151602 (Accession). Accordingly, utilities of GAM136 include diagnosis, prevention and treatment of diseases and clinical conditions associated with LOC151602.

LOC151826 (Accession) is another GAM136 target gene, herein designated TARGET GENE. LOC151826 BINDING SITE is a target binding site found in the 3' untranslated region of mRNA encoded by LOC151826, corresponding to a target binding site such as BINDING SITE I, BINDING SITE II or BINDING SITE III of FIG. 8. Table 4 illustrates the complementarity of the nucleotide sequences of LOC151826 BINDING SITE, designated SEQ ID:9541, to the nucleotide sequence of GAM136 RNA, herein designated GAM RNA, also designated SEQ ID:279.

Another function of GAM136 is therefore inhibition of LOC151826 (Accession). Accordingly, utilities of GAM136 include diagnosis, prevention and treatment of diseases and clinical conditions associated with LOC151826.

LOC152137 (Accession) is another GAM136 target gene, herein designated TARGET GENE. LOC152137 BINDING SITE is a target binding site found in the 3' untranslated region of mRNA encoded by LOC152137, corresponding to a target binding site such as BINDING SITE I, BINDING SITE II or BINDING SITE III of FIG. 8. Table 4 illustrates the complementarity of the nucleotide sequences of LOC152137 BINDING SITE, designated SEQ ID:8819, to the nucleotide sequence of GAM136 RNA, herein designated GAM RNA, also designated SEQ ID:279.

Another function of GAM136 is therefore inhibition of LOC152137 (Accession). Accordingly, utilities of GAM136 include diagnosis, prevention and treatment of diseases and clinical conditions associated with LOC152137.

LOC152220 (Accession) is another GAM136 target gene, herein designated TARGET GENE. LOC152220 BINDING SITE is a target binding site found in the 3' untranslated region of mRNA encoded by LOC152220, corresponding to a target binding site such as BINDING SITE I, BINDING SITE II or BINDING SITE III of FIG. 8. Table 4 illustrates the complementarity of the nucleotide sequences of LOC152220 BINDING SITE, designated SEQ ID:6805, to the nucleotide sequence of GAM136 RNA, herein designated GAM RNA, also designated SEQ ID:279.

Another function of GAM136 is therefore inhibition of LOC152220 (Accession). Accordingly, utilities of GAM136 include diagnosis, prevention and treatment of diseases and clinical conditions associated with LOC152220.

LOC152300 (Accession) is another GAM136 target gene, herein designated TARGET GENE. LOC152300 BINDING SITE is a target binding site found in the 5' untranslated region of mRNA encoded by LOC152300, corresponding to a target binding site such as BINDING SITE I, BINDING SITE II or BINDING SITE III of FIG. 8. Table 4 illustrates the complementarity of the nucleotide sequences of LOC152300 BINDING SITE, designated SEQ ID:412, to the nucleotide sequence of GAM136 RNA, herein designated GAM RNA, also designated SEQ ID:279.

Another function of GAM136 is therefore inhibition of LOC152300 (Accession). Accordingly, utilities of GAM136 include diagnosis, prevention and treatment of diseases and clinical conditions associated with LOC152300.

LOC152582 (Accession) is another GAM136 target gene, herein designated TARGET GENE. LOC152582 BINDING SITE is a target binding site found in the 5' untranslated region of mRNA encoded by LOC152582, corresponding to a target binding site such as BINDING SITE I, BINDING SITE II or BINDING SITE III of FIG. 8. Table 4 illustrates the complementarity of the nucleotide sequences of LOC152582 BINDING SITE, designated SEQ ID:10692, to the nucleotide sequence of GAM136 RNA, herein designated GAM RNA, also designated SEQ ID:279.

Another function of GAM136 is therefore inhibition of LOC152582 (Accession). Accordingly, utilities of GAM136 include diagnosis, prevention and treatment of diseases and clinical conditions associated with LOC152582.

LOC152719 (Accession XM_098257.1) is another GAM136 target gene, herein designated TARGET GENE. LOC152719 BINDING SITE1 and LOC152719 BINDING SITE2 are target binding sites found in untranslated regions of mRNA encoded by LOC152719, corresponding to target binding sites such as BINDING SITE I, BINDING SITE II or BINDING SITE III of FIG. 8. Table 4 illustrates the complementarity of the nucleotide sequences of LOC152719 BINDING SITE1 and LOC152719 BINDING SITE2, designated SEQ ID:5750 and SEQ ID:3422 respectively, to the nucleotide sequence of GAM136 RNA, herein designated GAM RNA, also designated SEQ ID:279.

Another function of GAM136 is therefore inhibition of LOC152719 (Accession XM_098257.1). Accordingly, utilities of GAM136 include diagnosis, prevention and treatment of diseases and clinical conditions associated with LOC152719.

LOC152794 (Accession XM_087525.1) is another GAM136 target gene, herein designated TARGET GENE. LOC152794 BINDING SITE is a target binding site found in the 5' untranslated region of mRNA encoded by LOC152794, corresponding to a target binding site such as BINDING SITE I, BINDING SITE II or BINDING SITE III of FIG. 8. Table 4 illustrates the complementarity of the nucleotide sequences of LOC152794 BINDING SITE, designated SEQ ID:8624, to the nucleotide sequence of GAM136 RNA, herein designated GAM RNA, also designated SEQ ID:279.

Another function of GAM136 is therefore inhibition of LOC152794 (Accession XM_087525.1). Accordingly, utilities of GAM136 include diagnosis, prevention and treatment of diseases and clinical conditions associated with LOC152794.

LOC153606 (Accession) is another GAM136 target gene, herein designated TARGET GENE. LOC153606 BINDING SITE is a target binding site found in the 5' untranslated region of mRNA encoded by LOC153606, corresponding to a target binding site such as BINDING SITE I, BINDING SITE II or BINDING SITE III of FIG. 8. Table 4 illustrates the complementarity of the nucleotide sequences of LOC153606 BINDING SITE, designated SEQ ID:6383, to the nucleotide sequence of GAM136 RNA, herein designated GAM RNA, also designated SEQ ID:279.

Another function of GAM136 is therefore inhibition of LOC153606 (Accession). Accordingly, utilities of GAM136 include diagnosis, prevention and treatment of diseases and clinical conditions associated with LOC153606.

LOC153688 (Accession) is another GAM136 target gene, herein designated TARGET GENE. LOC153688 BINDING SITE is a target binding site found in the 3' untranslated region of mRNA encoded by LOC153688, corresponding to a target binding site such as BINDING SITE I, BINDING SITE II or BINDING SITE III of FIG. 8. Table 4 illustrates the complementarity of the nucleotide sequences of LOC153688 BINDING SITE, designated SEQ ID:11003, to the nucleotide sequence of GAM136 RNA, herein designated GAM RNA, also designated SEQ ID:279.

Another function of GAM136 is therefore inhibition of LOC153688 (Accession). Accordingly, utilities of GAM136 include diagnosis, prevention and treatment of diseases and clinical conditions associated with LOC153688.

LOC153811 (Accession XM_087779.2) is another GAM136 target gene, herein designated TARGET GENE. LOC153811 BINDING SITE is a target binding site found in the 5' untranslated region of mRNA encoded by LOC153811, corresponding to a target binding site such as BINDING SITE I, BINDING SITE II or BINDING SITE III of FIG. 8. Table 4 illustrates the complementarity of the nucleotide sequences of LOC153811 BINDING SITE, designated SEQ ID:12732, to the nucleotide sequence of GAM136 RNA, herein designated GAM RNA, also designated SEQ ID:279.

Another function of GAM136 is therefore inhibition of LOC153811 (Accession XM_087779.2). Accordingly, utilities of GAM136 include diagnosis, prevention and treatment of diseases and clinical conditions associated with LOC153811.

LOC153883 (Accession XM_087798.1) is another GAM136 target gene, herein designated TARGET GENE. LOC153883 BINDING SITE is a target binding site found in the 5' untranslated region of mRNA encoded by LOC153883, corresponding to a target binding site such as BINDING SITE I, BINDING SITE II or BINDING SITE III of FIG. 8. Table 4 illustrates the complementarity of the nucleotide sequences of LOC153883 BINDING SITE, designated SEQ ID:14252, to the nucleotide sequence of GAM136 RNA, herein designated GAM RNA, also designated SEQ ID:279.

Another function of GAM136 is therefore inhibition of LOC153883 (Accession XM_087798.1). Accordingly, utilities of GAM136 include diagnosis, prevention and treatment of diseases and clinical conditions associated with LOC153883.

LOC154877 (Accession XM_098626.4) is another GAM136 target gene, herein designated TARGET GENE. LOC154877 BINDING SITE is a target binding site found in the 3' untranslated region of mRNA encoded by LOC154877, corresponding to a target binding site such as BINDING SITE I, BINDING SITE II or BINDING SITE III of FIG. 8. Table 4 illustrates the complementarity of the nucleotide sequences of LOC154877 BINDING SITE, designated SEQ ID:9289, to the nucleotide sequence of GAM136 RNA, herein designated GAM RNA, also designated SEQ ID:279.

Another function of GAM136 is therefore inhibition of LOC154877 (Accession XM_098626.4). Accordingly, utilities of GAM136 include diagnosis, prevention and treatment of diseases and clinical conditions associated with LOC154877.

LOC157506 (Accession) is another GAM136 target gene, herein designated TARGET GENE. LOC157506 BINDING SITE is a target binding site found in the 3' untranslated region of mRNA encoded by LOC157506, corresponding to a target binding site such as BINDING SITE I, BINDING SITE II or BINDING SITE III of FIG. 8. Table 4 illustrates the complementarity of the nucleotide sequences of LOC157506 BINDING SITE, designated SEQ ID:17205, to the nucleotide sequence of GAM136 RNA, herein designated GAM RNA, also designated SEQ ID:279.

Another function of GAM136 is therefore inhibition of LOC157506 (Accession). Accordingly, utilities of GAM136 include diagnosis, prevention and treatment of diseases and clinical conditions associated with LOC157506.

LOC157507 (Accession) is another GAM136 target gene, herein designated TARGET GENE. LOC157507 BINDING SITE is a target binding site found in the 5' untranslated region of mRNA encoded by LOC157507, corresponding to a target binding site such as BINDING SITE I, BINDING SITE II or BINDING SITE III of FIG. 8. Table 4 illustrates the complementarity of the nucleotide sequences of LOC157507 BINDING SITE, designated SEQ ID:15895, to the nucleotide sequence of GAM136 RNA, herein designated GAM RNA, also designated SEQ ID:279.

Another function of GAM136 is therefore inhibition of LOC157507 (Accession). Accordingly, utilities of GAM136 include diagnosis, prevention and treatment of diseases and clinical conditions associated with LOC157507.

LOC157798 (Accession) is another GAM136 target gene, herein designated TARGET GENE. LOC157798 BINDING SITE is a target binding site found in the 5' untranslated region of mRNA encoded by LOC157798, corresponding to a target binding site such as BINDING SITE I, BINDING SITE II or BINDING SITE III of FIG. 8. Table 4 illustrates the complementarity of the nucleotide sequences of LOC157798 BINDING SITE, designated SEQ ID:1563, to the nucleotide sequence of GAM136 RNA, herein designated GAM RNA, also designated SEQ ID:279.

Another function of GAM136 is therefore inhibition of LOC157798 (Accession). Accordingly, utilities of GAM136 include diagnosis, prevention and treatment of diseases and clinical conditions associated with LOC157798.

LOC157858 (Accession XM_098833.3) is another GAM136 target gene, herein designated TARGET GENE. LOC157858 BINDING SITE is a target binding site found in the 5' untranslated region of mRNA encoded by LOC157858, corresponding to a target binding site such as BINDING SITE I, BINDING SITE II or BINDING SITE III of FIG. 8. Table 4 illustrates the complementarity of the nucleotide sequences of LOC157858 BINDING SITE, designated SEQ ID:11827, to the nucleotide sequence of GAM136 RNA, herein designated GAM RNA, also designated SEQ ID:279.

Another function of GAM136 is therefore inhibition of LOC157858 (Accession XM_098833.3). Accordingly, utilities of GAM136 include diagnosis, prevention and treatment of diseases and clinical conditions associated with LOC157858.

LOC158402 (Accession XM_098936.1) is another GAM136 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:413, to the nucleotide sequence of GAM136 RNA, herein designated GAM RNA, also designated SEQ ID:279.

Another function of GAM136 is therefore inhibition of LOC158402 (Accession XM_098936.1). Accordingly, utilities of GAM136 include diagnosis, prevention and treatment of diseases and clinical conditions associated with LOC158402.

LOC158476 (Accession XM_098955.1) is another GAM136 target gene, herein designated TARGET GENE. LOC158476 BINDING SITE is a target binding site found in the 3' untranslated region of mRNA encoded by LOC158476, corresponding to a target binding site such as BINDING SITE I, BINDING SITE II or BINDING SITE III of FIG. 8. Table 4 illustrates the complementarity of the nucleotide sequences of LOC158476 BINDING SITE, designated SEQ ID:12077, to the nucleotide sequence of GAM136 RNA, herein designated GAM RNA, also designated SEQ ID:279.

Another function of GAM136 is therefore inhibition of LOC158476 (Accession XM_098955.1). Accordingly, utilities of GAM136 include diagnosis, prevention and treatment of diseases and clinical conditions associated with LOC158476.

LOC158668 (Accession XM_045161.1) is another GAM136 target gene, herein designated TARGET GENE. LOC158668 BINDING SITE is a target binding site found in the 3' untranslated region of mRNA encoded by LOC158668, corresponding to a target binding site such as BINDING SITE I, BINDING SITE II or BINDING SITE III of FIG. 8. Table 4 illustrates the complementarity of the nucleotide sequences of LOC158668 BINDING SITE, designated SEQ ID:8440, to the nucleotide sequence of GAM136 RNA, herein designated GAM RNA, also designated SEQ ID:279.

Another function of GAM136 is therefore inhibition of LOC158668 (Accession XM_045161.1). Accordingly, utilities of GAM136 include diagnosis, prevention and treatment of diseases and clinical conditions associated with LOC158668.

LOC162022 (Accession) is another GAM136 target gene, herein designated TARGET GENE. LOC162022 BINDING SITE is a target binding site found in the 5' untranslated region of mRNA encoded by LOC162022, corresponding to a target binding site such as BINDING SITE I, BINDING SITE II or BINDING SITE III of FIG. 8. Table 4 illustrates the complementarity of the nucleotide sequences of LOC162022 BINDING SITE, designated SEQ ID:16604, to the nucleotide sequence of GAM136 RNA, herein designated GAM RNA, also designated SEQ ID:279.

Another function of GAM136 is therefore inhibition of LOC162022 (Accession). Accordingly, utilities of GAM136 include diagnosis, prevention and treatment of diseases and clinical conditions associated with LOC162022.

LOC169611 (Accession XM_095809.4) is another GAM136 target gene, herein designated TARGET GENE. LOC169611 BINDING SITE is a target binding site found in the 3' untranslated region of mRNA encoded by LOC169611, corresponding to a target binding site such as BINDING SITE I, BINDING SITE II or BINDING SITE III of FIG. 8. Table 4 illustrates the complementarity of the nucleotide sequences of LOC169611 BINDING SITE, designated SEQ ID:11646, to the nucleotide sequence of GAM136 RNA, herein designated GAM RNA, also designated SEQ ID:279.

Another function of GAM136 is therefore inhibition of LOC169611 (Accession XM_095809.4). Accordingly, utilities of GAM136 include diagnosis, prevention and treatment of diseases and clinical conditions associated with LOC169611.

LOC196529 (Accession) is another GAM136 target gene, herein designated TARGET GENE. LOC196529 BINDING SITE is a target binding site found in the 3' untranslated region of mRNA encoded by LOC196529, corresponding to a target binding site such as BINDING SITE I, BINDING SITE II or BINDING SITE III of FIG. 8. Table 4 illustrates the complementarity of the nucleotide sequences of LOC196529 BINDING SITE, designated SEQ ID:5060, to the nucleotide sequence of GAM136 RNA, herein designated GAM RNA, also designated SEQ ID:279.

Another function of GAM136 is therefore inhibition of LOC196529 (Accession). Accordingly, utilities of GAM136 include diagnosis, prevention and treatment of diseases and clinical conditions associated with LOC196529.

LOC197358 (Accession XM_113872.2) is another GAM136 target gene, herein designated TARGET GENE.

LOC197358 BINDING SITE1 and LOC197358 BINDING SITE2 are target binding sites found in untranslated regions of mRNA encoded by LOC197358, corresponding to target binding sites such as BINDING SITE I, BINDING SITE II or BINDING SITE III of FIG. 8. Table 4 illustrates the complementarity of the nucleotide sequences of LOC197358 BINDING SITE1 and LOC197358 BINDING SITE2, designated SEQ ID:16351 and SEQ ID:17773 respectively, to the nucleotide sequence of GAM136 RNA, herein designated GAM RNA, also designated SEQ ID:279.

Another function of GAM136 is therefore inhibition of LOC197358 (Accession XM_113872.2). Accordingly, utilities of GAM136 include diagnosis, prevention and treatment of diseases and clinical conditions associated with LOC197358.

LOC200014 (Accession) is another GAM136 target gene, herein designated TARGET GENE. LOC200014 BINDING SITE is a target binding site found in the 3' untranslated region of mRNA encoded by LOC200014, corresponding to a target binding site such as BINDING SITE I, BINDING SITE II or BINDING SITE III of FIG. 8. Table 4 illustrates the complementarity of the nucleotide sequences of LOC200014 BINDING SITE, designated SEQ ID:3544, to the nucleotide sequence of GAM136 RNA, herein designated GAM RNA, also designated SEQ ID:279.

Another function of GAM136 is therefore inhibition of LOC200014 (Accession). Accordingly, utilities of GAM136 include diagnosis, prevention and treatment of diseases and clinical conditions associated with LOC200014.

LOC200169 (Accession XM_117200.2) is another GAM136 target gene, herein designated TARGET GENE. LOC200169 BINDING SITE is a target binding site found in the 5' untranslated region of multiple transcripts of mRNA encoded by LOC200169, corresponding to a target binding site such as BINDING SITE I, BINDING SITE II or BINDING SITE III of FIG. 8. Table 4 illustrates the complementarity of the nucleotide sequences of LOC200169 BINDING SITE, designated SEQ ID:6860, to the nucleotide sequence of GAM136 RNA, herein designated GAM RNA, also designated SEQ ID:279.

Another function of GAM136 is therefore inhibition of LOC200169 (Accession XM_117200.2). Accordingly, utilities of GAM136 include diagnosis, prevention and treatment of diseases and clinical conditions associated with LOC200169.

LOC200316 (Accession) is another GAM136 target gene, herein designated TARGET GENE. LOC200316 BINDING SITE is a target binding site found in the 3' untranslated region of mRNA encoded by LOC200316, corresponding to a target binding site such as BINDING SITE I, BINDING SITE II or BINDING SITE III of FIG. 8. Table 4 illustrates the complementarity of the nucleotide sequences of LOC200316 BINDING SITE, designated SEQ ID:6549, to the nucleotide sequence of GAM136 RNA, herein designated GAM RNA, also designated SEQ ID:279.

Another function of GAM136 is therefore inhibition of LOC200316 (Accession). Accordingly, utilities of GAM136 include diagnosis, prevention and treatment of diseases and clinical conditions associated with LOC200316.

LOC201164 (Accession XM_290750.1) is another GAM136 target gene, herein designated TARGET GENE. LOC201164 BINDING SITE is a target binding site found in the 3' untranslated region of multiple transcripts of mRNA encoded by LOC201164, corresponding to a target binding site such as BINDING SITE I, BINDING SITE II or BINDING SITE III of FIG. 8. Table 4 illustrates the complementarity of the nucleotide sequences of LOC201164 BINDING SITE, designated SEQ ID:17606, to the nucleotide sequence of GAM136 RNA, herein designated GAM RNA, also designated SEQ ID:279.

Another function of GAM136 is therefore inhibition of LOC201164 (Accession XM_290750.1). Accordingly, utilities of GAM136 include diagnosis, prevention and treatment of diseases and clinical conditions associated with LOC201164.

LOC201702 (Accession) is another GAM136 target gene, herein designated TARGET GENE. LOC201702 BINDING SITE is a target binding site found in the 5' untranslated region of mRNA encoded by LOC201702, corresponding to a target binding site such as BINDING SITE I, BINDING SITE II or BINDING SITE III of FIG. 8. Table 4 illustrates the complementarity of the nucleotide sequences of LOC201702 BINDING SITE, designated SEQ ID:7983, to the nucleotide sequence of GAM136 RNA, herein designated GAM RNA, also designated SEQ ID:279.

Another function of GAM136 is therefore inhibition of LOC201702 (Accession). Accordingly, utilities of GAM136 include diagnosis, prevention and treatment of diseases and clinical conditions associated with LOC201702.

LOC202459 (Accession NM_145303.1) is another GAM136 target gene, herein designated TARGET GENE. LOC202459 BINDING SITE is a target binding site found in the 5' untranslated region of mRNA encoded by LOC202459, corresponding to a target binding site such as BINDING SITE I, BINDING SITE II or BINDING SITE III of FIG. 8. Table 4 illustrates the complementarity of the nucleotide sequences of LOC202459 BINDING SITE, designated SEQ ID:5848, to the nucleotide sequence of GAM136 RNA, herein designated GAM RNA, also designated SEQ ID:279.

Another function of GAM136 is therefore inhibition of LOC202459 (Accession NM_145303.1). Accordingly, utilities of GAM136 include diagnosis, prevention and treatment of diseases and clinical conditions associated with LOC202459.

LOC203197 (Accession) is another GAM136 target gene, herein designated TARGET GENE. LOC203197 BINDING SITE is a target binding site found in the 5' untranslated region of mRNA encoded by LOC203197, corresponding to a target binding site such as BINDING SITE I, BINDING SITE II or BINDING SITE III of FIG. 8. Table 4 illustrates the complementarity of the nucleotide sequences of LOC203197 BINDING SITE, designated SEQ ID:18848, to the nucleotide sequence of GAM136 RNA, herein designated GAM RNA, also designated SEQ ID:279.

Another function of GAM136 is therefore inhibition of LOC203197 (Accession). Accordingly, utilities of GAM136 include diagnosis, prevention and treatment of diseases and clinical conditions associated with LOC203197.

LOC203427 (Accession NM_145305.1) is another GAM136 target gene, herein designated TARGET GENE. LOC203427 BINDING SITE is a target binding site found in the 3' untranslated region of mRNA encoded by LOC203427, corresponding to a target binding site such as BINDING SITE I, BINDING SITE II or BINDING SITE III of FIG. 8. Table 4 illustrates the complementarity of the nucleotide sequences of LOC203427 BINDING SITE, designated SEQ ID:20008, to the nucleotide sequence of GAM136 RNA, herein designated GAM RNA, also designated SEQ ID:279.

Another function of GAM136 is therefore inhibition of LOC203427 (Accession NM_145305.1). Accordingly, utilities of GAM136 include diagnosis, prevention and treatment of diseases and clinical conditions associated with LOC203427.

LOC204804 (Accession) is another GAM136 target gene, herein designated TARGET GENE. LOC204804 BINDING SITE is a target binding site found in the 3' untranslated region of mRNA encoded by LOC204804, corresponding to a target binding site such as BINDING SITE I, BINDING SITE II or BINDING SITE III of FIG. 8. Table 4 illustrates the complementarity of the nucleotide sequences of LOC204804 BINDING SITE, designated SEQ ID:3925, to the nucleotide sequence of GAM136 RNA, herein designated GAM RNA, also designated SEQ ID:279.

Another function of GAM136 is therefore inhibition of LOC204804 (Accession). Accordingly, utilities of GAM136 include diagnosis, prevention and treatment of diseases and clinical conditions associated with LOC204804.

LOC219673 (Accession) is another GAM136 target gene, herein designated TARGET GENE. LOC219673 BINDING SITE is a target binding site found in the 5' untranslated region of mRNA encoded by LOC219673, corresponding to a target binding site such as BINDING SITE I, BINDING SITE II or BINDING SITE III of FIG. 8. Table 4 illustrates the complementarity of the nucleotide sequences of LOC219673 BINDING SITE, designated SEQ ID:17829, to the nucleotide sequence of GAM136 RNA, herein designated GAM RNA, also designated SEQ ID:279.

Another function of GAM136 is therefore inhibition of LOC219673 (Accession). Accordingly, utilities of GAM136 include diagnosis, prevention and treatment of diseases and clinical conditions associated with LOC219673.

LOC219735 (Accession XM_167601.1) is another GAM136 target gene, herein designated TARGET GENE. LOC219735 BINDING SITE is a target binding site found in the 3' untranslated region of mRNA encoded by LOC219735, corresponding to a target binding site such as BINDING SITE I, BINDING SITE II or BINDING SITE III of FIG. 8. Table 4 illustrates the complementarity of the nucleotide sequences of LOC219735 BINDING SITE, designated SEQ ID:4328, to the nucleotide sequence of GAM136 RNA, herein designated GAM RNA, also designated SEQ ID:279.

Another function of GAM136 is therefore inhibition of LOC219735 (Accession XM_167601.1). Accordingly, utilities of GAM136 include diagnosis, prevention and treatment of diseases and clinical conditions associated with LOC219735.

LOC219894 (Accession XM_167782.3) is another GAM136 target gene, herein designated TARGET GENE. LOC219894 BINDING SITE is a target binding site found in the 3' untranslated region of mRNA encoded by LOC219894, corresponding to a target binding site such as BINDING SITE I, BINDING SITE II or BINDING SITE III of FIG. 8. Table 4 illustrates the complementarity of the nucleotide sequences of LOC219894 BINDING SITE, designated SEQ ID:16436, to the nucleotide sequence of GAM136 RNA, herein designated GAM RNA, also designated SEQ ID:279.

Another function of GAM136 is therefore inhibition of LOC219894 (Accession XM_167782.3). Accordingly, utilities of GAM136 include diagnosis, prevention and treatment of diseases and clinical conditions associated with LOC219894.

LOC220575 (Accession) is another GAM136 target gene, herein designated TARGET GENE. LOC220575 BINDING SITE is a target binding site found in the 3' untranslated region of mRNA encoded by LOC220575, corresponding to a target binding site such as BINDING SITE I, BINDING SITE II or BINDING SITE III of FIG. 8. Table 4 illustrates the complementarity of the nucleotide sequences of LOC220575 BINDING SITE, designated SEQ ID:12503, to the nucleotide sequence of GAM136 RNA, herein designated GAM RNA, also designated SEQ ID:279.

Another function of GAM136 is therefore inhibition of LOC220575 (Accession). Accordingly, utilities of GAM136 include diagnosis, prevention and treatment of diseases and clinical conditions associated with LOC220575.

LOC220662 (Accession) is another GAM136 target gene, herein designated TARGET GENE. LOC220662 BINDING SITE1 and LOC220662 BINDING SITE2 are target binding sites found in untranslated regions of mRNA encoded by LOC220662, corresponding to target binding sites such as BINDING SITE I, BINDING SITE II or BINDING SITE III of FIG. 8. Table 4 illustrates the complementarity of the nucleotide sequences of LOC220662 BINDING SITE1 and LOC220662 BINDING SITE2, designated SEQ ID:16580 and SEQ ID:17095 respectively, to the nucleotide sequence of GAM136 RNA, herein designated GAM RNA, also designated SEQ ID:279.

Another function of GAM136 is therefore inhibition of LOC220662 (Accession). Accordingly, utilities of GAM136 include diagnosis, prevention and treatment of diseases and clinical conditions associated with LOC220662.

LOC221174 (Accession XM_167915.1) is another GAM136 target gene, herein designated TARGET GENE. LOC221174 BINDING SITE is a target binding site found in the 5' untranslated region of mRNA encoded by LOC221174, corresponding to a target binding site such as BINDING SITE I, BINDING SITE II or BINDING SITE III of FIG. 8. Table 4 illustrates the complementarity of the nucleotide sequences of LOC221174 BINDING SITE, designated SEQ ID:15254, to the nucleotide sequence of GAM136 RNA, herein designated GAM RNA, also designated SEQ ID:279.

Another function of GAM136 is therefore inhibition of LOC221174 (Accession XM_167915.1). Accordingly, utilities of GAM136 include diagnosis, prevention and treatment of diseases and clinical conditions associated with LOC221174.

LOC221271 (Accession) is another GAM136 target gene, herein designated TARGET GENE. LOC221271 BINDING SITE is a target binding site found in the 3' untranslated region of mRNA encoded by LOC221271, corresponding to a target binding site such as BINDING SITE I, BINDING SITE II or BINDING SITE III of FIG. 8. Table 4 illustrates the complementarity of the nucleotide sequences of LOC221271 BINDING SITE, designated SEQ ID:2971, to the nucleotide sequence of GAM136 RNA, herein designated GAM RNA, also designated SEQ ID:279.

Another function of GAM136 is therefore inhibition of LOC221271 (Accession). Accordingly, utilities of GAM136 include diagnosis, prevention and treatment of diseases and clinical conditions associated with LOC221271.

LOC221663 (Accession XM_168131.1) is another GAM136 target gene, herein designated TARGET GENE. LOC221663 BINDING SITE is a target binding site found in the 5' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:14871, to the nucleotide sequence of GAM136 RNA, herein designated GAM RNA, also designated SEQ ID:279.

Another function of GAM136 is therefore inhibition of LOC221663 (Accession XM_168131.1). Accordingly, utilities of GAM136 include diagnosis, prevention and treatment of diseases and clinical conditions associated with LOC221663.

LOC245771 (Accession) is another GAM136 target gene, herein designated TARGET GENE. LOC245771 BINDING SITE is a target binding site found in the 5' untranslated region of mRNA encoded by LOC245771, corresponding to a target binding site such as BINDING SITE I, BINDING SITE II or BINDING SITE III of FIG. 8. Table 4 illustrates the complementarity of the nucleotide sequences of LOC245771 BINDING SITE, designated SEQ ID:14523, to the nucleotide sequence of GAM136 RNA, herein designated GAM RNA, also designated SEQ ID:279.

Another function of GAM136 is therefore inhibition of LOC245771 (Accession). Accordingly, utilities of GAM136 include diagnosis, prevention and treatment of diseases and clinical conditions associated with LOC245771.

LOC254013 (Accession) is another GAM136 target gene, herein designated TARGET GENE. LOC254013 BINDING SITE is a target binding site found in the 3' untranslated region of mRNA encoded by LOC254013, corresponding to a target binding site such as BINDING SITE I, BINDING SITE II or BINDING SITE III of FIG. 8. Table 4 illustrates the complementarity of the nucleotide sequences of LOC254013 BINDING SITE, designated SEQ ID:18200, to the nucleotide sequence of GAM136 RNA, herein designated GAM RNA, also designated SEQ ID:279.

Another function of GAM136 is therefore inhibition of LOC254013 (Accession). Accordingly, utilities of GAM136 include diagnosis, prevention and treatment of diseases and clinical conditions associated with LOC254013.

LOC254268 (Accession) is another GAM136 target gene, herein designated TARGET GENE. LOC254268 BINDING SITE is a target binding site found in the 3' untranslated region of mRNA encoded by LOC254268, corresponding to a target binding site such as BINDING SITE I, BINDING SITE II or BINDING SITE III of FIG. 8. Table 4 illustrates the complementarity of the nucleotide sequences of LOC254268 BINDING SITE, designated SEQ ID:7619, to the nucleotide sequence of GAM136 RNA, herein designated GAM RNA, also designated SEQ ID:279.

Another function of GAM136 is therefore inhibition of LOC254268 (Accession). Accordingly, utilities of GAM136 include diagnosis, prevention and treatment of diseases and clinical conditions associated with LOC254268.

LOC255196 (Accession) is another GAM136 target gene, herein designated TARGET GENE. LOC255196 BINDING SITE is a target binding site found in the 5' untranslated region of mRNA encoded by LOC255196, corresponding to a target binding site such as BINDING SITE I, BINDING SITE II or BINDING SITE III of FIG. 8. Table 4 illustrates the complementarity of the nucleotide sequences of LOC255196 BINDING SITE, designated SEQ ID:1324, to the nucleotide sequence of GAM136 RNA, herein designated GAM RNA, also designated SEQ ID:279.

Another function of GAM136 is therefore inhibition of LOC255196 (Accession). Accordingly, utilities of GAM136 include diagnosis, prevention and treatment of diseases and clinical conditions associated with LOC255196.

LOC255465 (Accession) is another GAM136 target gene, herein designated TARGET GENE. LOC255465 BINDING SITE1 and LOC255465 BINDING SITE2 are target binding sites found in untranslated regions of mRNA encoded by LOC255465, corresponding to target binding sites such as BINDING SITE I, BINDING SITE II or BINDING SITE III of FIG. 8. Table 4 illustrates the complementarity of the nucleotide sequences of LOC255465 BINDING SITE1 and LOC255465 BINDING SITE2, designated SEQ ID:9221 and SEQ ID:17676 respectively, to the nucleotide sequence of GAM136 RNA, herein designated GAM RNA, also designated SEQ ID:279.

Another function of GAM136 is therefore inhibition of LOC255465 (Accession). Accordingly, utilities of GAM136 include diagnosis, prevention and treatment of diseases and clinical conditions associated with LOC255465.

LOC255919 (Accession) is another GAM136 target gene, herein designated TARGET GENE. LOC255919 BINDING SITE is a target binding site found in the 3' untranslated region of mRNA encoded by LOC255919, corresponding to a target binding site such as BINDING SITE I, BINDING SITE II or BINDING SITE III of FIG. 8. Table 4 illustrates the complementarity of the nucleotide sequences of LOC255919 BINDING SITE, designated SEQ ID:2135, to the nucleotide sequence of GAM136 RNA, herein designated GAM RNA, also designated SEQ ID:279.

Another function of GAM136 is therefore inhibition of LOC255919 (Accession). Accordingly, utilities of GAM136 include diagnosis, prevention and treatment of diseases and clinical conditions associated with LOC255919.

LOC256923 (Accession) is another GAM136 target gene, herein designated TARGET GENE. LOC256923 BINDING SITE is a target binding site found in the 5' untranslated region of mRNA encoded by LOC256923, corresponding to a target binding site such as BINDING SITE I, BINDING SITE II or BINDING SITE III of FIG. 8. Table 4 illustrates the complementarity of the nucleotide sequences of LOC256923 BINDING SITE, designated SEQ ID:7013, to the nucleotide sequence of GAM136 RNA, herein designated GAM RNA, also designated SEQ ID:279.

Another function of GAM136 is therefore inhibition of LOC256923 (Accession). Accordingly, utilities of GAM136 include diagnosis, prevention and treatment of diseases and clinical conditions associated with LOC256923.

LOC257054 (Accession) is another GAM136 target gene, herein designated TARGET GENE. LOC257054 BINDING SITE1 and LOC257054 BINDING SITE2 are target binding sites found in untranslated regions of mRNA encoded by LOC257054, corresponding to target binding sites such as BINDING SITE I, BINDING SITE II or BINDING SITE III of FIG. 8. Table 4 illustrates the complementarity of the nucleotide sequences of LOC257054 BINDING SITE1 and LOC257054 BINDING SITE2, designated SEQ ID:14524 and SEQ ID:18129 respectively, to the nucleotide sequence of GAM136 RNA, herein designated GAM RNA, also designated SEQ ID:279.

Another function of GAM136 is therefore inhibition of LOC257054 (Accession). Accordingly, utilities of GAM136 include diagnosis, prevention and treatment of diseases and clinical conditions associated with LOC257054.

LOC90485 (Accession XM_032059.1) is another GAM136 target gene, herein designated TARGET GENE. LOC90485 BINDING SITE1 and LOC90485 BINDING SITE2 are target binding sites found in untranslated regions of mRNA encoded by LOC90485, corresponding to target binding sites such as BINDING SITE I, BINDING SITE II or BINDING SITE III of FIG. 8. Table 4 illustrates the complementarity of the nucleotide sequences of LOC90485 BINDING SITE1 and LOC90485 BINDING SITE2, designated SEQ ID:20154 and SEQ ID:15288 respectively, to the nucleotide sequence of GAM136 RNA, herein designated GAM RNA, also designated SEQ ID:279.

Another function of GAM136 is therefore inhibition of LOC90485 (Accession XM_032059.1). Accordingly, utilities of GAM136 include diagnosis, prevention and treatment of diseases and clinical conditions associated with LOC90485.

LOC90591 (Accession XM_032811.1) is another GAM136 target gene, herein designated TARGET GENE. LOC90591 BINDING SITE is a target binding site found in the 3' untranslated region of mRNA encoded by LOC90591, corresponding to a target binding site such as BINDING SITE I, BINDING SITE II or BINDING SITE III of FIG. 8. Table 4 illustrates the complementarity of the nucleotide sequences of LOC90591 BINDING SITE, designated SEQ ID:13863, to the nucleotide sequence of GAM136 RNA, herein designated GAM RNA, also designated SEQ ID:279.

Another function of GAM136 is therefore inhibition of LOC90591 (Accession XM_032811.1). Accordingly, utilities of GAM136 include diagnosis, prevention and treatment of diseases and clinical conditions associated with LOC90591.

LOC91115 (Accession XM_036218.4) is another GAM136 target gene, herein designated TARGET GENE. LOC91115 BINDING SITE is a target binding site found in the 5' untranslated region of mRNA encoded by LOC91115, corresponding to a target binding site such as BINDING SITE I, BINDING SITE II or BINDING SITE III of FIG. 8. Table 4 illustrates the complementarity of the nucleotide sequences of LOC91115 BINDING SITE, designated SEQ ID:4470, to the nucleotide sequence of GAM136 RNA, herein designated GAM RNA, also designated SEQ ID:279.

Another function of GAM136 is therefore inhibition of LOC91115 (Accession XM_036218.4). Accordingly, utilities of GAM136 include diagnosis, prevention and treatment of diseases and clinical conditions associated with LOC91115.

LOC91373 (Accession XM_038063.8) is another GAM136 target gene, herein designated TARGET GENE. LOC91373 BINDING SITE is a target binding site found in the 3' untranslated region of mRNA encoded by LOC91373, corresponding to a target binding site such as BINDING SITE I, BINDING SITE II or BINDING SITE III of FIG. 8. Table 4 illustrates the complementarity of the nucleotide sequences of LOC91373 BINDING SITE, designated SEQ ID:18364, to the nucleotide sequence of GAM136 RNA, herein designated GAM RNA, also designated SEQ ID:279.

Another function of GAM136 is therefore inhibition of LOC91373 (Accession XM_038063.8). Accordingly, utilities of GAM136 include diagnosis, prevention and treatment of diseases and clinical conditions associated with LOC91373.

LOC91547 (Accession XM_039093.5) is another GAM136 target gene, herein designated TARGET GENE. LOC91547 BINDING SITE is a target binding site found in the 3' untranslated region of mRNA encoded by LOC91547, corresponding to a target binding site such as BINDING SITE I, BINDING SITE II or BINDING SITE III of FIG. 8. Table 4 illustrates the complementarity of the nucleotide sequences of LOC91547 BINDING SITE, designated SEQ ID:19265, to the nucleotide sequence of GAM136 RNA, herein designated GAM RNA, also designated SEQ ID:279.

Another function of GAM136 is therefore inhibition of LOC91547 (Accession XM_039093.5). Accordingly, utilities of GAM136 include diagnosis, prevention and treatment of diseases and clinical conditions associated with LOC91547.

LOC91561 (Accession XM_039218.8) is another GAM136 target gene, herein designated TARGET GENE. LOC91561 BINDING SITE is a target binding site found in the 5' untranslated region of mRNA encoded by LOC91561, corresponding to a target binding site such as BINDING SITE I, BINDING SITE II or BINDING SITE III of FIG. 8. Table 4 illustrates the complementarity of the nucleotide sequences of LOC91561 BINDING SITE, designated SEQ ID:1319, to the nucleotide sequence of GAM136 RNA, herein designated GAM RNA, also designated SEQ ID:279.

Another function of GAM136 is therefore inhibition of LOC91561 (Accession XM_039218.8). Accordingly, utilities of GAM136 include diagnosis, prevention and treatment of diseases and clinical conditions associated with LOC91561.

LOC92148 (Accession XM_043160.9) is another GAM136 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:15402, to the nucleotide sequence of GAM136 RNA, herein designated GAM RNA, also designated SEQ ID:279.

Another function of GAM136 is therefore inhibition of LOC92148 (Accession XM_043160.9). Accordingly, utilities of GAM136 include diagnosis, prevention and treatment of diseases and clinical conditions associated with LOC92148.

LOC92466 (Accession) is another GAM136 target gene, herein designated TARGET GENE. LOC92466 BINDING SITE is a target binding site found in the 3' untranslated region of mRNA encoded by LOC92466, corresponding to a target binding site such as BINDING SITE I, BINDING SITE II or BINDING SITE III of FIG. 8. Table 4 illustrates the complementarity of the nucleotide sequences of LOC92466 BINDING SITE, designated SEQ ID:10843, to the nucleotide sequence of GAM136 RNA, herein designated GAM RNA, also designated SEQ ID:279.

Another function of GAM136 is therefore inhibition of LOC92466 (Accession). Accordingly, utilities of GAM136 include diagnosis, prevention and treatment of diseases and clinical conditions associated with LOC92466.

LOC92697 (Accession) is another GAM136 target gene, herein designated TARGET GENE. LOC92697 BINDING SITE is a target binding site found in the 5' untranslated region of mRNA encoded by LOC92697, corresponding to a target binding site such as BINDING SITE I, BINDING SITE II or BINDING SITE III of FIG. 8. Table 4 illustrates the complementarity of the nucleotide sequences of LOC92697 BINDING SITE, designated SEQ ID:3545, to the nucleotide sequence of GAM136 RNA, herein designated GAM RNA, also designated SEQ ID:279.

Another function of GAM136 is therefore inhibition of LOC92697 (Accession). Accordingly, utilities of GAM136 include diagnosis, prevention and treatment of diseases and clinical conditions associated with LOC92697.

Leukotriene b4 receptor (LTB4R, Accession NM_000752.1) is another GAM136 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:2471, to the nucleotide sequence of GAM136 RNA, herein designated GAM RNA, also designated SEQ ID:279.

Another function of GAM136 is therefore inhibition of Leukotriene b4 receptor (LTB4R, Accession NM_000752.1), a gene which may be the cardiac p2y receptor involved in the regulation of cardiac muscle contraction through modulation of l-type calcium currents. Accordingly, utilities of GAM136 include diagnosis, prevention and treatment of diseases and clinical conditions associated with LTB4R.

The function of LTB4R and its association with various diseases and clinical conditions, has been established by previous studies, as described hereinabove with reference to GAM30.1. MAIL (Accession NM_031419.1) is another GAM136 target gene, herein designated TARGET GENE. MAIL BINDING SITE is a target binding site found in the 3' untranslated region of mRNA encoded by MAIL, corresponding to a target binding site such as BINDING SITE I, BINDING SITE II or BINDING SITE III of FIG. 8. Table 4 illustrates the complementarity of the nucleotide sequences of MAIL BINDING SITE, designated SEQ ID:6513, to the nucleotide sequence of GAM136 RNA, herein designated GAM RNA, also designated SEQ ID:279.

Another function of GAM136 is therefore inhibition of MAIL (Accession NM_031419.1). Accordingly, utilities of GAM136 include diagnosis, prevention and treatment of diseases and clinical conditions associated with MAIL.

Male germ cell-associated kinase (MAK, Accession NM_005906.2) is another GAM136 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:19152, to the nucleotide sequence of GAM136 RNA, herein designated GAM RNA, also designated SEQ ID:279.

Another function of GAM136 is therefore inhibition of Male germ cell-associated kinase (MAK, Accession NM_005906.2), a gene which plays an important role in spermatogenesis. Accordingly, utilities of GAM136 include diagnosis, prevention and treatment of diseases and clinical conditions associated with MAK.

The function of MAK and its association with various diseases and clinical conditions, has been established by previous studies, as described hereinabove with reference to GAM30.1. Mannosidase, beta a, lysosomal-like (MANBAL, Accession NM_022077.2) is another GAM136 target gene, herein designated TARGET GENE. MANBAL BINDING SITE is a target binding site found in the 5' untranslated region of mRNA encoded by MANBAL, corresponding to a target binding site such as BINDING SITE I, BINDING SITE II or BINDING SITE III of FIG. 8. Table 4 illustrates the complementarity of the nucleotide sequences of MANBAL BINDING SITE, designated SEQ ID:638, to the nucleotide sequence of GAM136 RNA, herein designated GAM RNA, also designated SEQ ID:279.

Another function of GAM136 is therefore inhibition of Mannosidase, beta a, lysosomal-like (MANBAL, Accession NM_022077.2). Accordingly, utilities of GAM136 include diagnosis, prevention and treatment of diseases and clinical conditions associated with MANBAL.

MGC10200 (Accession NM_145060.1) is another GAM136 target gene, herein designated TARGET GENE. MGC10200 BINDING SITE is a target binding site found in the 3' untranslated region of mRNA encoded by MGC10200, corresponding to a target binding site such as BINDING SITE I, BINDING SITE II or BINDING SITE III of FIG. 8. Table 4 illustrates the complementarity of the nucleotide sequences of MGC10200 BINDING SITE, designated SEQ ID:8635, to the nucleotide sequence of GAM136 RNA, herein designated GAM RNA, also designated SEQ ID:279.

Another function of GAM136 is therefore inhibition of MGC10200 (Accession NM_145060.1). Accordingly, utilities of GAM136 include diagnosis, prevention and treatment of diseases and clinical conditions associated with MGC10200.

MGC14289 (Accession NM_080660.1) is another GAM136 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:11444, to the nucleotide sequence of GAM136 RNA, herein designated GAM RNA, also designated SEQ ID:279.

Another function of GAM136 is therefore inhibition of MGC14289 (Accession NM_080660.1). Accordingly, utilities of GAM136 include diagnosis, prevention and treatment of diseases and clinical conditions associated with MGC14289.

MGC15873 (Accession NM_032920.1) is another GAM136 target gene, herein designated TARGET GENE. MGC15873 BINDING SITE is a target binding site found in the 5' untranslated region of mRNA encoded by MGC15873, corresponding to a target binding site such as BINDING SITE I, BINDING SITE II or BINDING SITE III of FIG. 8. Table 4 illustrates the complementarity of the nucleotide sequences of MGC15873 BINDING SITE, designated SEQ ID:2473, to the nucleotide sequence of GAM136 RNA, herein designated GAM RNA, also designated SEQ ID:279.

Another function of GAM136 is therefore inhibition of MGC15873 (Accession NM_032920.1). Accordingly, utilities of GAM136 include diagnosis, prevention and treatment of diseases and clinical conditions associated with MGC15873.

MGC1842 (Accession XM_037797.4) is another GAM136 target gene, herein designated TARGET GENE. MGC1842 BINDING SITE is a target binding site found in the 3' untranslated region of mRNA encoded by MGC1842, corresponding to a target binding site such as BINDING SITE I, BINDING SITE II or BINDING SITE III of FIG. 8. Table 4 illustrates the complementarity of the nucleotide sequences of MGC1842 BINDING SITE, designated SEQ ID:7188, to the nucleotide sequence of GAM136 RNA, herein designated GAM RNA, also designated SEQ ID:279.

Another function of GAM136 is therefore inhibition of MGC1842 (Accession XM_037797.4). Accordingly, utilities of GAM136 include diagnosis, prevention and treatment of diseases and clinical conditions associated with MGC1842.

MGC2474 (Accession NM_023931.1) is another GAM136 target gene, herein designated TARGET GENE. MGC2474 BINDING SITE is a target binding site found in the 3' untranslated region of mRNA encoded by MGC2474, corresponding to a target binding site such as BINDING SITE I, BINDING SITE II or BINDING SITE III of FIG. 8. Table 4 illustrates the complementarity of the nucleotide sequences of MGC2474 BINDING SITE, designated SEQ ID:15463, to the nucleotide sequence of GAM136 RNA, herein designated GAM RNA, also designated SEQ ID:279.

Another function of GAM136 is therefore inhibition of MGC2474 (Accession NM_023931.1). Accordingly, utilities of GAM136 include diagnosis, prevention and treatment of diseases and clinical conditions associated with MGC2474.

MGC3329 (Accession NM_024086.2) is another GAM136 target gene, herein designated TARGET GENE. MGC3329 BINDING SITE is a target binding site found in the 3' untranslated region of mRNA encoded by MGC3329, corresponding to a target binding site such as BINDING SITE I, BINDING SITE II or BINDING SITE III of FIG. 8. Table 4 illustrates the complementarity of the nucleotide sequences of MGC3329 BINDING SITE, designated SEQ ID:12427, to the nucleotide sequence of GAM136 RNA, herein designated GAM RNA, also designated SEQ ID:279.

Another function of GAM136 is therefore inhibition of MGC3329 (Accession NM_024086.2). Accordingly, utilities of GAM136 include diagnosis, prevention and treatment of diseases and clinical conditions associated with MGC3329.

MGC4638 (Accession) is another GAM136 target gene, herein designated TARGET GENE. MGC4638 BINDING SITE is a target binding site found in the 3' untranslated region of mRNA encoded by MGC4638, corresponding to a target binding site such as BINDING SITE I, BINDING SITE II or BINDING SITE III of FIG. 8. Table 4 illustrates the complementarity of the nucleotide sequences of MGC4638 BINDING SITE, designated SEQ ID:3737, to the nucleotide sequence of GAM136 RNA, herein designated GAM RNA, also designated SEQ ID:279.

Another function of GAM136 is therefore inhibition of MGC4638 (Accession). Accordingly, utilities of GAM136 include diagnosis, prevention and treatment of diseases and clinical conditions associated with MGC4638.

Nadh dehydrogenase (ubiquinone) 1 beta subcomplex, 1, 7 kda (NDUFB1, Accession NM_004545.2) is another GAM136 target gene, herein designated TARGET GENE. NDUFB1 BINDING SITE is a target binding site found in the 5' untranslated region of mRNA encoded by NDUFB1, corresponding to a target binding site such as BINDING SITE I, BINDING SITE II or BINDING SITE III of FIG. 8. Table 4 illustrates the complementarity of the nucleotide sequences of NDUFB1 BINDING SITE, designated SEQ ID:2538, to the nucleotide sequence of GAM136 RNA, herein designated GAM RNA, also designated SEQ ID:279.

Another function of GAM136 is therefore inhibition of Nadh dehydrogenase (ubiquinone) 1 beta subcomplex, 1, 7 kda (NDUFB1, Accession NM_004545.2). Accordingly, utilities of GAM136 include diagnosis, prevention and treatment of diseases and clinical conditions associated with NDUFB1.

Nadh dehydrogenase (ubiquinone) 1, subcomplex unknown, 2, 14.5 kda (NDUFC2, Accession NM_004549.2) is another GAM136 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:8439, to the nucleotide sequence of GAM136 RNA, herein designated GAM RNA, also designated SEQ ID:279.

Another function of GAM136 is therefore inhibition of Nadh dehydrogenase (ubiquinone) 1, subcomplex unknown, 2, 14.5 kda (NDUFC2, Accession NM_004549.2). Accordingly, utilities of GAM136 include diagnosis, prevention and treatment of diseases and clinical conditions associated with NDUFC2.

NPR2L (Accession NM_006545.3) is another GAM136 target gene, herein designated TARGET GENE. NPR2L BINDING SITE is a target binding site found in the 3' untranslated region of mRNA encoded by NPR2L, corresponding to a target binding site such as BINDING SITE I, BINDING SITE II or BINDING SITE III of FIG. 8. Table 4 illustrates the complementarity of the nucleotide sequences of NPR2L BINDING SITE, designated SEQ ID:6977, to the nucleotide sequence of GAM136 RNA, herein designated GAM RNA, also designated SEQ ID:279.

Another function of GAM136 is therefore inhibition of NPR2L (Accession NM_006545.3). Accordingly, utilities of GAM136 include diagnosis, prevention and treatment of diseases and clinical conditions associated with NPR2L.

Nucleoredoxin (NXN, Accession NM_022463.2) is another GAM136 target gene, herein designated TARGET GENE. NXN BINDING SITE is a target binding site found in the 3' untranslated region of mRNA encoded by NXN, corresponding to a target binding site such as BINDING SITE I, BINDING SITE II or BINDING SITE III of FIG. 8. Table 4 illustrates the complementarity of the nucleotide sequences of NXN BINDING SITE, designated SEQ ID:15417, to the nucleotide sequence of GAM136 RNA, herein designated GAM RNA, also designated SEQ ID:279.

Another function of GAM136 is therefore inhibition of Nucleoredoxin (NXN, Accession NM_022463.2). Accordingly, utilities of GAM136 include diagnosis, prevention and treatment of diseases and clinical conditions associated with NXN.

Origin recognition complex, subunit 1-like (yeast) (ORC1L, Accession NM_004153.1) is another GAM136 target gene, herein designated TARGET GENE. ORC1L BINDING SITE is a target binding site found in the 3' untranslated region of mRNA encoded by ORC1L, corresponding to a target binding site such as BINDING SITE I, BINDING SITE II or BINDING SITE III of FIG. 8. Table 4 illustrates the complementarity of the nucleotide sequences of ORC1L BINDING SITE, designated SEQ ID:11234, to the nucleotide sequence of GAM136 RNA, herein designated GAM RNA, also designated SEQ ID:279.

Another function of GAM136 is therefore inhibition of Origin recognition complex, subunit 1-like (yeast) (ORC1L, Accession NM_004153.1), a gene which may be required for initiation of DNA replication. Accordingly, utilities of GAM136 include diagnosis, prevention and treatment of diseases and clinical conditions associated with ORC1L.

The function of ORC1L has been established by previous studies. In the yeast Saccharomyces cerevisiae, DNA replication is initiated by the origin of replication complex (ORC), a 6-subunit protein. All 6 genes encoding this complex (ORC1 through ORC6) are essential for viability in yeast. Yeast ORC1 encodes the largest subunit of the ORC and contains a cell division cycle-nucleoside triphosphate binding domain that is conserved among several yeast transcriptional regulators. Gavin et al. (1995) used degenerate PCR to clone a human homolog of the yeast ORC1 gene. The human ORC1 gene encodes an 861-amino acid protein that is 27% identical to yeast Orc1. Gavin et al. (1995) showed that ORC1 and ORC2 (ORC2L; 601182) can be coimmunoprecipitated, suggesting that they form a complex in vivo. Ohtani et al. (1996) showed that expression of human ORC1 is low in quiescent fibroblast cells and is induced by cell growth stimulation. They found that this control of expression is mediated by E2F (see OMIM Ref. No. 189971) transcriptional repression of the ORC1 promoter in quiescent cells. Activation of ORC1 transcription required G1 cyclin-dependent kinase activity. Ohtani et al. (1996) concluded that there is a direct link between the initiation of DNA replication and the cell growth regulatory pathway involving G1 cyclin- dependent kinase, the Rb tumor suppressor, and E2F.

Full details of the abovementioned studies are described in the following publications, the disclosure of which are hereby incorporated by reference:

Gavin, K. A.; Hidaka, M.; Stillman, B.: Conserved initiator proteins in eukaryotes. Science 270:1667-1671, 1995; and Ohtani, K.; DeGregori, J.; Leone, G.; Herendeen, D. R.; Kelly, T. J.; Nevins, J. R. : Expression of the HsOrc1 gene, a human ORC1 homolog, is regulated by cell proliferation via the E2F.

Further studies establishing the function and utilities of ORC1L are found in John Hopkins OMIM database record ID 601902, and in cited publications listed in Table 5, which are hereby incorporated by reference. Pas domain containing serine/threonine kinase (PASK, Accession NM_015148.1) is another GAM136 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:17796, to the nucleotide sequence of GAM136 RNA, herein designated GAM RNA, also designated SEQ ID:279.

Another function of GAM136 is therefore inhibition of Pas domain containing serine/threonine kinase (PASK, Accession NM_015148.1). Accordingly, utilities of GAM136 include diagnosis, prevention and treatment of diseases and clinical conditions associated with PASK.

Protocadherin beta 11 (PCDHB11, Accession NM_018931.2) is another GAM136 target gene, herein designated TARGET GENE. PCDHB11 BINDING SITE is a target binding site found in the 3' untranslated region of mRNA encoded by PCDHB11, corresponding to a target binding site such as BINDING SITE I, BINDING SITE II or BINDING SITE III of FIG. 8. Table 4 illustrates the complementarity of the nucleotide sequences of PCDHB11 BINDING SITE, designated SEQ ID:17334, to the nucleotide sequence of GAM136 RNA, herein designated GAM RNA, also designated SEQ ID:279.

Another function of GAM136 is therefore inhibition of Protocadherin beta 11 (PCDHB11, Accession NM_018931.2). Accordingly, utilities of GAM136 include diagnosis, prevention and treatment of diseases and clinical conditions associated with PCDHB11.

Phosducin-like (PDCL, Accession NM_005388.2) is another GAM136 target gene, herein designated TARGET GENE. PDCL BINDING SITE is a target binding site found in the 3' untranslated region of mRNA encoded by PDCL, corresponding to a target binding site such as BINDING SITE I, BINDING SITE II or BINDING SITE III of FIG. 8. Table 4 illustrates the complementarity of the nucleotide sequences of PDCL BINDING SITE, designated SEQ ID:15813, to the nucleotide sequence of GAM136 RNA, herein designated GAM RNA, also designated SEQ ID:279.

Another function of GAM136 is therefore inhibition of Phosducin-like (PDCL, Accession NM_005388.2), a gene which may regulate G-protein signaling and similar to phosducins. Accordingly, utilities of GAM136 include diagnosis, prevention and treatment of diseases and clinical conditions associated with PDCL.

The function of PDCL and its association with various diseases and clinical conditions, has been established by previous studies, as described hereinabove with reference to GAM30.1. Pdz domain containing 1 (PDZK1, Accession NM_002614.2) is another GAM136 target gene, herein designated TARGET GENE. PDZK1 BINDING SITE is a target binding site found in the 5' untranslated region of mRNA encoded by PDZK1, corresponding to a target binding site such as BINDING SITE I, BINDING SITE II or BINDING SITE III of FIG. 8. Table 4 illustrates the complementarity of the nucleotide sequences of PDZK1 BINDING SITE, designated SEQ ID:13616, to the nucleotide sequence of GAM136 RNA, herein designated GAM RNA, also designated SEQ ID:279.

Another function of GAM136 is therefore inhibition of Pdz domain containing 1 (PDZK1, Accession NM_002614.2), a gene which is a contains PDZ interaction domains, interacts with MAP17, a protein involved in control of cell proliferation. and therefore may be associated with Autosomal dominant hypophosphatemic rickets. Accordingly, utilities of GAM136 include diagnosis, prevention and treatment of Autosomal dominant hypophosphatemic rickets, and of other diseases and clinical conditions associated with PDZK1.

The function of PDZK1 has been established by previous studies. Custer et al. (1997) cloned a gene from rat kidney mRNA that encodes a protein regulated by dietary phosphate. They designated the protein Diphor-1 (dietary P(i)- regulated RNA-1) and found that it shares homology with the PDZ domain-containing protein Na+/H+exchanger regulatory factor. Diphor-1 specifically increased Na(+)-dependent phosphate uptake by 1.7 times when coexpressed in Xenopus laevis oocytes with the Na(+)-P(i) cotransporter, indicating that it may play an important role in cellular phosphate regulation. Diphor-1 mRNA expression was upregulated several fold by a restricted phosphate diet, highlighting the possible role of the protein in maintaining overall phosphate homeostasis. White et al. (1998) showed that PDZK1, a PDZ domain-containing protein highly homologous to rat Diphor-1, is expressed in human kidney. Based on its sequence similarity to rat Diphor-1, they considered PDZK1 a likely candidate for autosomal dominant hypophosphatemic rickets (ADHR; 193108), which maps to 12p13. However, they found by PCR analysis of a human/rodent somatic cell hybrid mapping panel and by radiation hybrid analysis that the PDZK1 gene maps to 1q21, thereby excluding it as a candidate for ADHR.

Full details of the abovementioned studies are described in the following publications, the disclosure of which are hereby incorporated by reference:

Kocher, O.; Comella, N.; Tognazzi, K.; Brown, L. F.: Identification and partial characterization of PDZK1: a novel protein containing PDZ interaction domains. Lab. Invest. 78:117-125, 1998; and Ikemoto, M.; Arai, H.; Feng, D.; Tanaka, K.; Aoki, J.; Dohmae, N.; Takio, K.; Adachi, H.; Tsujimoto, M.; Inoue, K.: Identification of a PDZ-domain-containing protein that interacts with.

Further studies establishing the function and utilities of PDZK1 are found in John Hopkins OMIM database record ID 603831, and in cited publications listed in Table 5, which are hereby incorporated by reference. Pellino homolog 1 (drosophila) (PELI1, Accession NM_020651.2) is another GAM136 target gene, herein designated TARGET GENE. PELI1 BINDING SITE1 and PELI1 BINDING SITE2 are target binding sites found in untranslated regions of mRNA encoded by PELI1, corresponding to target binding sites such as BINDING SITE I, BINDING SITE II or BINDING SITE III of FIG. 8. Table 4 illustrates the complementarity of the nucleotide sequences of PELI1 BINDING SITE1 and PELI1 BINDING SITE2, designated SEQ ID:18940 and SEQ ID:7342 respectively, to the nucleotide sequence of GAM136 RNA, herein designated GAM RNA, also designated SEQ ID:279.

Another function of GAM136 is therefore inhibition of Pellino homolog 1 (drosophila) (PELI1, Accession NM_020651.2). Accordingly, utilities of GAM136 include diagnosis, prevention and treatment of diseases and clinical conditions associated with PELI1.

Phosphoinositide-3-kinase, class 2, beta polypeptide (PIK3C2B, Accession NM_002646.2) is another GAM136 target gene, herein designated TARGET GENE. PIK3C2B BINDING SITE is a target binding site found in the 5' untranslated region of mRNA encoded by PIK3C2B, corresponding to a target binding site such as BINDING SITE I, BINDING SITE II or BINDING SITE III of FIG. 8. Table 4 illustrates the complementarity of the nucleotide sequences of PIK3C2B BINDING SITE, designated SEQ ID:18311, to the nucleotide sequence of GAM136 RNA, herein designated GAM RNA, also designated SEQ ID:279.

Another function of GAM136 is therefore inhibition of Phosphoinositide-3-kinase, class 2, beta polypeptide (PIK3C2B, Accession NM_002646.2). Accordingly, utilities of GAM136 include diagnosis, prevention and treatment of diseases and clinical conditions associated with PIK3C2B.

Phosphoinositide-3-kinase, catalytic, delta polypeptide (PIK3CD, Accession NM_005026.2) is another GAM136 target gene, herein designated TARGET GENE. PIK3CD BINDING SITE is a target binding site found in the 3' untranslated region of mRNA encoded by PIK3CD, corresponding to a target binding site such as BINDING SITE I, BINDING SITE II or BINDING SITE III of FIG. 8. Table 4 illustrates the complementarity of the nucleotide sequences of PIK3CD BINDING SITE, designated SEQ ID:17678, to the nucleotide sequence of GAM136 RNA, herein designated GAM RNA, also designated SEQ ID:279.

Another function of GAM136 is therefore inhibition of Phosphoinositide-3-kinase, catalytic, delta polypeptide (PIK3CD, Accession NM_005026.2), a gene which regulating cell growth. Accordingly, utilities of GAM136 include diagnosis, prevention and treatment of diseases and clinical conditions associated with PIK3CD.

The function of PIK3CD has been established by previous studies. Vanhaesebroeck et al. (1997) classified p110-delta as a class I PI3K because it displayed broad in vitro lipid substrate specificity. Like p110-alpha and p110-beta, p110-delta binds p85 adaptor proteins and GTP-bound Ras. These 3 class I PI3Ks were indistinguishable at the level of p85 adaptor protein selection or recruitment to activated receptor complexes. However, unlike p110-alpha, p110-delta does not phosphorylate p85, but instead has an autophosphorylation activity Animal model experiments lend further support to the function of PIK3CD. Okkenhaug et al. (2002) generated mice expressing a catalytically inactive form of Pik3cd (asp910 to ala). They observed impaired signaling and attenuated immune responses by antigen receptors of B and T cells from these mice. The presence of Pik3ca and Pik3cb did not compensate for Pik3cd in immune function. The mutant mice also developed inflammatory bowel disease. Since the IBD7 susceptibility locus (OMIM Ref. No. 605225) maps to chromosome 1p36, the authors suggested that PIK3CD may be a candidate susceptibility gene It is appreciated that the abovementioned animal model for PIK3CD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okkenhaug, K.; Bilancio, A.; Farjot, G.; Priddle, H.; Sancho, S.; Peskett, E.; Pearce, W.; Meek, S. E.; Salpekar, A.; Waterfield, M. D.; Smith, A. J. H.; Vanhaesebroeck, B.: Impaired B and T cell antigen receptor signaling in p110-delta PI 3-kinase mutant mice. Science 297:1031-1034, 2002; and Vanhaesebroeck, B.; Welham, M. J.; Kotani, K.; Stein, R.; Warne, P. H.; Zvelebil, M. J.; Higashi, K.; Volinia, S.; Downward, J.; Waterfield, M. D.: p110-delta, a novel phosphoinositide 3.

Further studies establishing the function and utilities of PIK3CD are found in John Hopkins OMIM database record ID 602839, and in cited publications listed in Table 5, which are hereby incorporated by reference. PIP3-E (Accession) is another GAM136 target gene, herein designated TARGET GENE. PIP3-E BINDING SITE is a target binding site found in the 3' untranslated region of mRNA encoded by PIP3-E, corresponding to a target binding site such as BINDING SITE I, BINDING SITE II or BINDING SITE III of FIG. 8. Table 4 illustrates the complementarity of the nucleotide sequences of PIP3-E BINDING SITE, designated SEQ ID:12706, to the nucleotide sequence of GAM136 RNA, herein designated GAM RNA, also designated SEQ ID:279.

Another function of GAM136 is therefore inhibition of PIP3-E (Accession). Accordingly, utilities of GAM136 include diagnosis, prevention and treatment of diseases and clinical conditions associated with PIP3-E.

Pro-melanin-concentrating hormone-like 1 (PMCHL1, Accession NM_031887.2) is another GAM136 target gene, herein designated TARGET GENE. PMCHL1 BINDING SITE is a target binding site found in the 3' untranslated region of mRNA encoded by PMCHL1, corresponding to a target binding site such as BINDING SITE I, BINDING SITE II or BINDING SITE III of FIG. 8. Table 4 illustrates the complementarity of the nucleotide sequences of PMCHL1 BINDING SITE, designated SEQ ID:17289, to the nucleotide sequence of GAM136 RNA, herein designated GAM RNA, also designated SEQ ID:279.

Another function of GAM136 is therefore inhibition of Pro-melanin-concentrating hormone-like 1 (PMCHL1, Accession NM_031887.2). Accordingly, utilities of GAM136 include diagnosis, prevention and treatment of diseases and clinical conditions associated with PMCHL1.

Peptidylprolyl isomerase d (cyclophilin d) (PPID, Accession NM_005038.1) is another GAM136 target gene, herein designated TARGET GENE. PPID BINDING SITE is a target binding site found in the 5' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:8817, to the nucleotide sequence of GAM136 RNA, herein designated GAM RNA, also designated SEQ ID:279.

Another function of GAM136 is therefore inhibition of Peptidylprolyl isomerase d (cyclophilin d) (PPID, Accession NM_005038.1), a gene which catalyzes the cis-trans isomerization of proline imidic peptide bonds in oligopeptides. Accordingly, utilities of GAM136 include diagnosis, prevention and treatment of diseases and clinical conditions associated with PPID.

The function of PPID has been established by previous studies. The cyclophilins are a conserved gene family of peptidyl-prolyl cis-trans isomerases (PPIases; OMIM Ref. No. 123840), the members of which bind the immunosuppressant cyclosporin A. Cyclophilin 40 (CyP-40, also CYPD) was identified by Kieffer et al. (1992) as a 40-kD cyclophilin-like protein with PPIase activity. In the bovine uterus, CyP-40 is a component of the estrogen receptor complex (see OMIM Ref. No. 133430). Kieffer et al. (1993) reported the cloning of a human cDNA homologous to the bovine CyP-40. The cDNA encodes a predicted 370-amino acid protein. The amino end is similar to that of other cyclophilins, while the carboxyl region resembles FKBP59 (OMIM Ref. No. 600611), a component of the glucocorticoid receptor complex. Yokoi et al. (1996) showed that the cyclophilin 40 (or PPID) gene contains 10 exons and spans 14.2 kb of genomic DNA. Ten Alu repeats occur within noncoding regions of the gene. Yokoi et al. (1996) mapped the PPID gene to chromosome 4 using a panel of somatic cell hybrid DNAs. By fluorescence in situ hybridization, Ratajczak et al. (1997) mapped the PPID gene to 4q31.3.

Full details of the abovementioned studies are described in the following publications, the disclosure of which are hereby incorporated by reference:

Ratajczak, T.; Woollatt, E.; Kumar, P.; Ward, B. K.; Minchin, R. F.; Baker, E.: Cyclophilin 40 (PPID) gene map position 4q31.3. Chromosome Res. 5:151 only, 1997; and Yokoi, H.; Shimizu, Y.; Anazawa, H.; Lefebvre, C. A.; Korneluk, R. G.; Ikeda; J.- E.: The structure and complete nucleotide sequence of the human cyclophilin 40 (PPID) gene. Genomics 35.

Further studies establishing the function and utilities of PPID are found in John Hopkins OMIM database record ID 601753, and in cited publications listed in Table 5, which are hereby incorporated by reference. Protein kinase, interferon-inducible double stranded rna dependent (PRKR, Accession NM_002759.1) is another GAM136 target gene, herein designated TARGET GENE. PRKR BINDING SITE is a target binding site found in the 3' untranslated region of mRNA encoded by PRKR, corresponding to a target binding site such as BINDING SITE I, BINDING SITE II or BINDING SITE III of FIG. 8. Table 4 illustrates the complementarity of the nucleotide sequences of PRKR BINDING SITE, designated SEQ ID:7341, to the nucleotide sequence of GAM136 RNA, herein designated GAM RNA, also designated SEQ ID:279.

Another function of GAM136 is therefore inhibition of Protein kinase, interferon-inducible double stranded rna dependent (PRKR, Accession NM_002759.1), a gene which catalyze the phosphorylation of the alpha subunit of eif2. and therefore may be associated with Huntington's disease. Accordingly, utilities of GAM136 include diagnosis, prevention and treatment of Huntington's disease, and of other diseases and clinical conditions associated with PRKR.

The function of PRKR has been established by previous studies. Ben-Asouli et al. (2002) showed that human gamma-interferon (IFNG; 147570) mRNA uses local activation of PKR in the cell to control its own translation yield. IFNG mRNA was found to activate PKR through a pseudoknot in its 5-prime untranslated region. Mutations that impaired pseudoknot stability reduced the ability to activate PKR and strongly increased the translation efficiency of IFNG mRNA. Nonphosphorylatable mutant eIF2-alpha, knockout of PKR, and the PKR inhibitors 2-aminopurine, transdominant- negative PKR, or vaccinia E3L correspondingly enhanced translation of IFNG mRNA. The potential to form the pseudoknot was found to be phylogenetically conserved. Ben- Asouli et al. (2002) proposed that the RNA pseudoknot acts to adjust translation of IFNG mRNA to the PKR level expressed in the cell. Barber et al. (1993) mapped the PRKR gene to 2p21 by in situ hybridization. The corresponding mouse gene was mapped to chromosome 17 (band E2) by the same method. Squire et al. (1993) assigned the PRKR gene to the boundary between 2p22 and 2p21 by fluorescence in situ hybridization.

Taylor et al. (1999) studied the mechanism underlying the resistance of hepatitis C virus (HCV) to interferon. They demonstrated that the HCV envelope protein E2 contains a sequence identical with phosphorylation sites of the interferon-inducible protein kinase PKR and the translation initiation factor EIF2-alpha, a target of PKR. E2 inhibited the kinase activity of PKR and blocked its inhibitory effect on protein synthesis and cell growth. This interaction of E2 in PKR may be one mechanism by which HCV circumvents the antiviral effect of interferon. Taylor et al. (1999) hypothesized that another potential outcome of PKR inhibition is the promotion of cell growth which may contribute to HCV-associated hepatocellular carcinoma. Huntington disease (OMIM Ref. No. 143100) is a neurodegenerative disorder caused by a trinucleotide repeat expansion within the huntingtin gene, resulting in generation of a polyglutamine tract in the protein product. Peel et al. (2001) showed that PKR preferentially bound mutant huntingtin RNA transcripts immobilized on streptavidin columns that had been incubated with human brain extracts. Immunohistochemical studies demonstrated that PKR was present in its activated form in both human Huntington autopsy material and brain tissue derived from Huntington yeast artificial chromosome transgenic mice. The increased immunolocalization of the activated kinase was more pronounced in areas most affected by the disease. The authors suggested a role for PKR activation in the Huntington disease process.

Full details of the abovementioned studies are described in the following publications, the disclosure of which are hereby incorporated by reference:

Ben-Asouli, Y.; Banai, Y.; Pel-Or, Y.; Shir, A.; Kaempfer, R.: Human interferon-gamma mRNA autoregulates its translation through a pseudoknot that activates the interferon-inducible protein kinase PKR. Cell 108:221-232, 2002; and Peel, A. L.; Rao, R. V.; Cottrell, B. A.; Hayden, M. R.; Ellerby, L. M.; Bredesen, D. E.: Double-stranded RNA-dependent protein kinase, PKR, binds preferentially to Huntington's diseas.

Further studies establishing the function and utilities of PRKR are found in John Hopkins OMIM database record ID 176871, and in cited publications listed in Table 5, which are hereby incorporated by reference. PRO0365 (Accession NM_014126.1) is another GAM136 target gene, herein designated TARGET GENE. PRO0365 BINDING SITE is a target binding site found in the 5' untranslated region of mRNA encoded by PRO0365, corresponding to a target binding site such as BINDING SITE I, BINDING SITE II or BINDING SITE III of FIG. 8. Table 4 illustrates the complementarity of the nucleotide sequences of PRO0365 BINDING SITE, designated SEQ ID:15753, to the nucleotide sequence of GAM136 RNA, herein designated GAM RNA, also designated SEQ ID:279.

Another function of GAM136 is therefore inhibition of PRO0365 (Accession NM_014126.1). Accordingly, utilities of GAM136 include diagnosis, prevention and treatment of diseases and clinical conditions associated with PRO0365.

PRO1992 (Accession) is another GAM136 target gene, herein designated TARGET GENE. PRO1992 BINDING SITE is a target binding site found in the 3' untranslated region of mRNA encoded by PRO1992, corresponding to a target binding site such as BINDING SITE I, BINDING SITE II or BINDING SITE III of FIG. 8. Table 4 illustrates the complementarity of the nucleotide sequences of PRO1992 BINDING SITE, designated SEQ ID:4868, to the nucleotide sequence of GAM136 RNA, herein designated GAM RNA, also designated SEQ ID:279.

Another function of GAM136 is therefore inhibition of PRO1992 (Accession). Accordingly, utilities of GAM136 include diagnosis, prevention and treatment of diseases and clinical conditions associated with PRO1992.

Proteasome (prosome, macropain) subunit, beta type, 2 (PSMB2, Accession NM_002794.3) is another GAM136 target gene, herein designated TARGET GENE. PSMB2 BINDING SITE is a target binding site found in the 3' untranslated region of mRNA encoded by PSMB2, corresponding to a target binding site such as BINDING SITE I, BINDING SITE II or BINDING SITE III of FIG. 8. Table 4 illustrates the complementarity of the nucleotide sequences of PSMB2 BINDING SITE, designated SEQ ID:15555, to the nucleotide sequence of GAM136 RNA, herein designated GAM RNA, also designated SEQ ID:279.

Another function of GAM136 is therefore inhibition of Proteasome (prosome, macropain) subunit, beta type, 2 (PSMB2, Accession NM_002794.3). Accordingly, utilities of GAM136 include diagnosis, prevention and treatment of diseases and clinical conditions associated with PSMB2.

Proline-serine-threonine phosphatase interacting protein 2 (PSTPIP2, Accession NM_024430.2) is another GAM136 target gene, herein designated TARGET GENE. PSTPIP2 BINDING SITE is a target binding site found in the 3' untranslated region of mRNA encoded by PSTPIP2, corresponding to a target binding site such as BINDING SITE I, BINDING SITE II or BINDING SITE III of FIG. 8. Table 4 illustrates the complementarity of the nucleotide sequences of PSTPIP2 BINDING SITE, designated SEQ ID:2794, to the nucleotide sequence of GAM136 RNA, herein designated GAM RNA, also designated SEQ ID:279.

Another function of GAM136 is therefore inhibition of Proline-serine-threonine phosphatase interacting protein 2 (PSTPIP2, Accession NM_024430.2). Accordingly, utilities of GAM136 include diagnosis, prevention and treatment of diseases and clinical conditions associated with PSTPIP2.

Prostaglandin e synthase (PTGES, Accession NM_004878.2) is another GAM136 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:2996, to the nucleotide sequence of GAM136 RNA, herein designated GAM RNA, also designated SEQ ID:279.

Another function of GAM136 is therefore inhibition of Prostaglandin e synthase (PTGES, Accession NM_004878.2). Accordingly, utilities of GAM136 include diagnosis, prevention and treatment of diseases and clinical conditions associated with PTGES.

Rab21, member ras oncogene family (RAB21, Accession NM_014999.1) is another GAM136 target gene, herein designated TARGET GENE. RAB21 BINDING SITE is a target binding site found in the 3' untranslated region of mRNA encoded by RAB21, corresponding to a target binding site such as BINDING SITE I, BINDING SITE II or BINDING SITE III of FIG. 8. Table 4 illustrates the complementarity of the nucleotide sequences of RAB21 BINDING SITE, designated SEQ ID:18931, to the nucleotide sequence of GAM136 RNA, herein designated GAM RNA, also designated SEQ ID:279.

Another function of GAM136 is therefore inhibition of Rab21, member ras oncogene family (RAB21, Accession NM_014999.1). Accordingly, utilities of GAM136 include diagnosis, prevention and treatment of diseases and clinical conditions associated with RAB21.

Rab39, member ras oncogene family (RAB39, Accession XM_084662.2) is another GAM136 target gene, herein designated TARGET GENE. RAB39 BINDING SITE is a target binding site found in the 3' untranslated region of mRNA encoded by RAB39, corresponding to a target binding site such as BINDING SITE I, BINDING SITE II or BINDING SITE III of FIG. 8. Table 4 illustrates the complementarity of the nucleotide sequences of RAB39 BINDING SITE, designated SEQ ID:4443, to the nucleotide sequence of GAM136 RNA, herein designated GAM RNA, also designated SEQ ID:279.

Another function of GAM136 is therefore inhibition of Rab39, member ras oncogene family (RAB39, Accession XM_084662.2). Accordingly, utilities of GAM136 include diagnosis, prevention and treatment of diseases and clinical conditions associated with RAB39.

Ras association (ralgds/af-6) domain family 2 (RASSF2, Accession NM_014737.1) is another GAM136 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:8520, to the nucleotide sequence of GAM136 RNA, herein designated GAM RNA, also designated SEQ ID:279.

Another function of GAM136 is therefore inhibition of Ras association (ralgds/af-6) domain family 2 (RASSF2, Accession NM_014737.1). Accordingly, utilities of GAM136 include diagnosis, prevention and treatment of diseases and clinical conditions associated with RASSF2.

Rna binding motif protein 8a (RBM8A, Accession NM_005105.2) is another GAM136 target gene, herein designated TARGET GENE. RBM8A BINDING SITE is a target binding site found in the 3' untranslated region of mRNA encoded by RBM8A, corresponding to a target binding site such as BINDING SITE I, BINDING SITE II or BINDING SITE III of FIG. 8. Table 4 illustrates the complementarity of the nucleotide sequences of RBM8A BINDING SITE, designated SEQ ID:18760, to the nucleotide sequence of GAM136 RNA, herein designated GAM RNA, also designated SEQ ID:279.

Another function of GAM136 is therefore inhibition of Rna binding motif protein 8a (RBM8A, Accession NM_005105.2), a gene which involves in the pathway of gene expression postsplicing nuclear preexport mRNPs, and newly exported cytoplasmic mRNPs. Accordingly, utilities of GAM136 include diagnosis, prevention and treatment of diseases and clinical conditions associated with RBM8A.

The function of RBM8A and its association with various diseases and clinical conditions, has been established by previous studies, as described hereinabove with reference to GAM47.1. RNO2 (Accession) is another GAM136 target gene, herein designated TARGET GENE. RNO2 BINDING SITE is a target binding site found in the 5' untranslated region of mRNA encoded by RNO2, corresponding to a target binding site such as BINDING SITE I, BINDING SITE II or BINDING SITE III of FIG. 8. Table 4 illustrates the complementarity of the nucleotide sequences of RNO2 BINDING SITE, designated SEQ ID:11666, to the nucleotide sequence of GAM136 RNA, herein designated GAM RNA, also designated SEQ ID:279.

Another function of GAM136 is therefore inhibition of RNO2 (Accession). Accordingly, utilities of GAM136 include diagnosis, prevention and treatment of diseases and clinical conditions associated with RNO2.

RPP30 (Accession NM_006413.2) is another GAM136 target gene, herein designated TARGET GENE. RPP30 BINDING SITE1 and RPP30 BINDING SITE2 are target binding sites found in untranslated regions of mRNA encoded by RPP30, corresponding to target binding sites such as BINDING SITE I, BINDING SITE II or BINDING SITE III of FIG. 8. Table 4 illustrates the complementarity of the nucleotide sequences of RPP30 BINDING SITE1 and RPP30 BINDING SITE2, designated SEQ ID:669 and SEQ ID:415 respectively, to the nucleotide sequence of GAM136 RNA, herein designated GAM RNA, also designated SEQ ID:279.

Another function of GAM136 is therefore inhibition of RPP30 (Accession NM_006413.2), a gene which is a component of ribonuclease p that processes 5' ends of precursor tRNAs. Accordingly, utilities of GAM136 include diagnosis, prevention and treatment of diseases and clinical conditions associated with RPP30.

The function of RPP30 has been established by previous studies. By biochemical purification of RNase P, micropeptide sequence analysis, and EST database searching, Eder et al. (1997) obtained a cDNA encoding RPP30. The deduced protein contains 268 amino acids with a predicted molecular mass of nearly 30 kD. Jarrous et al. (1998) determined that RPP30 is a target for antisera from systemic sclerosis patients. Immunoprecipitation analysis showed that polyclonal antibodies raised against RPP20, RPP30, RPP38, or RPP40 interact with RNase P from HeLa cells.

Full details of the abovementioned studies are described in the following publications, the disclosure of which are hereby incorporated by reference:

Eder, P. S.; Kekuda, R.; Stolc, V.; Altman, S.: Characterization of two scleroderma autoimmune antigens that copurify with human ribonuclease P. Proc. Nat. Acad. Sci. 94:1101-1106, 1997; and Jarrous, N.; Eder, P. S.; Guerrier-Takada, C.; Hoog, C.; Altman, S.: Autoantigenic properties of some protein subunits of catalytically active complexes of human ribonuclease P. RNA 4:407.

Further studies establishing the function and utilities of RPP30 are found in John Hopkins OMIM database record ID 606115, and in cited publications listed in Table 5, which are hereby incorporated by reference. Sterol-c4-methyl oxidase-like (SC4MOL, Accession NM_006745.2) is another GAM136 target gene, herein designated TARGET GENE. SC4MOL BINDING SITE is a target binding site found in the 3' untranslated region of mRNA encoded by SC4MOL, corresponding to a target binding site such as BINDING SITE I, BINDING SITE II or BINDING SITE III of FIG. 8. Table 4 illustrates the complementarity of the nucleotide sequences of SC4MOL BINDING SITE, designated SEQ ID:8501, to the nucleotide sequence of GAM136 RNA, herein designated GAM RNA, also designated SEQ ID:279.

Another function of GAM136 is therefore inhibition of Sterol-c4-methyl oxidase-like (SC4MOL, Accession NM_006745.2). Accordingly, utilities of GAM136 include diagnosis, prevention and treatment of diseases and clinical conditions associated with SC4MOL.

Sex comb on midleg-like 2 (drosophila) (SCML2, Accession NM_006089.1) is another GAM136 target gene, herein designated TARGET GENE. SCML2 BINDING SITE is a target binding site found in the 3' untranslated region of mRNA encoded by SCML2, corresponding to a target binding site such as BINDING SITE I, BINDING SITE II or BINDING SITE III of FIG. 8. Table 4 illustrates the complementarity of the nucleotide sequences of SCML2 BINDING SITE, designated SEQ ID:9298, to the nucleotide sequence of GAM136 RNA, herein designated GAM RNA, also designated SEQ ID:279.

Another function of GAM136 is therefore inhibition of Sex comb on midleg-like 2 (drosophila) (SCML2, Accession NM_006089.1). Accordingly, utilities of GAM136 include diagnosis, prevention and treatment of diseases and clinical conditions associated with SCML2.

SCYA22 (Accession) is another GAM136 target gene, herein designated TARGET GENE. SCYA22 BINDING SITE is a target binding site found in the 3' untranslated region of mRNA encoded by SCYA22, corresponding to a target binding site such as BINDING SITE I, BINDING SITE II or BINDING SITE III of FIG. 8. Table 4 illustrates the complementarity of the nucleotide sequences of SCYA22 BINDING SITE, designated SEQ ID:13867, to the nucleotide sequence of GAM136 RNA, herein designated GAM RNA, also designated SEQ ID:279.

Another function of GAM136 is therefore inhibition of SCYA22 (Accession). Accordingly, utilities of GAM136 include diagnosis, prevention and treatment of diseases and clinical conditions associated with SCYA22.

Spondyloepiphyseal dysplasia, late (SEDL, Accession NM_014563.1) is another GAM136 target gene, herein designated TARGET GENE. SEDL BINDING SITE is a target binding site found in the 3' untranslated region of mRNA encoded by SEDL, corresponding to a target binding site such as BINDING SITE I, BINDING SITE II or BINDING SITE III of FIG. 8. Table 4 illustrates the complementarity of the nucleotide sequences of SEDL BINDING SITE, designated SEQ ID:18071, to the nucleotide sequence of GAM136 RNA, herein designated GAM RNA, also designated SEQ ID:279.

Another function of GAM136 is therefore inhibition of Spondyloepiphyseal dysplasia, late (SEDL, Accession NM_014563.1), a gene which may play role in vesicular transport from endoplasmic reticulum to golgi. and therefore may be associated with Spondyloepiphyseal dysplasia. Accordingly, utilities of GAM136 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. Sema domain, seven thrombospondin repeats (type 1 and type 1-like), transmembrane domain (tm) and short cytoplasmic domain, (semaphorin) 5a (SEMA5A, Accession NM_003966.1) is another GAM136 target gene, herein designated TARGET GENE. SEMA5A BINDING SITE is a target binding site found in the 5' untranslated region of mRNA encoded by SEMA5A, corresponding to a target binding site such as BINDING SITE I, BINDING SITE II or BINDING SITE III of FIG. 8. Table 4 illustrates the complementarity of the nucleotide sequences of SEMA5A BINDING SITE, designated SEQ ID:11943, to the nucleotide sequence of GAM136 RNA, herein designated GAM RNA, also designated SEQ ID:279.

Another function of GAM136 is therefore inhibition of Sema domain, seven thrombospondin repeats (type 1 and type 1-like), transmembrane domain (tm) and short cytoplasmic domain, (semaphorin) 5a (SEMA5A, Accession NM_003966.1). Accordingly, utilities of GAM136 include diagnosis, prevention and treatment of diseases and clinical conditions associated with SEMA5A.

Selenoprotein n, 1 (SEPN1, Accession NM_020451.1) is another GAM136 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:17169, to the nucleotide sequence of GAM136 RNA, herein designated GAM RNA, also designated SEQ ID:279.

Another function of GAM136 is therefore inhibition of Selenoprotein n, 1 (SEPN1, Accession NM_020451.1). Accordingly, utilities of GAM136 include diagnosis, prevention and treatment of diseases and clinical conditions associated with SEPN1.

Small edrk-rich factor 1b (centromeric) (SERF1B, Accession NM_022978.1) is another GAM136 target gene, herein designated TARGET GENE. SERF1B BINDING SITE is a target binding site found in the 3' untranslated region of mRNA encoded by SERF1B, corresponding to a target binding site such as BINDING SITE I, BINDING SITE II or BINDING SITE III of FIG. 8. Table 4 illustrates the complementarity of the nucleotide sequences of SERF1B BINDING SITE, designated SEQ ID:18926, to the nucleotide sequence of GAM136 RNA, herein designated GAM RNA, also designated SEQ ID:279.

Another function of GAM136 is therefore inhibition of Small edrk-rich factor 1b (centromeric) (SERF1B, Accession NM_022978.1). Accordingly, utilities of GAM136 include diagnosis, prevention and treatment of diseases and clinical conditions associated with SERF1B.

Serine (or cysteine) proteinase inhibitor, clade b (ovalbumin), member 9 (SERPINB9, Accession NM_004155.2) is another GAM136 target gene, herein designated TARGET GENE. SERPINB9 BINDING SITE is a target binding site found in the 3' untranslated region of mRNA encoded by SERPINB9, corresponding to a target binding site such as BINDING SITE I, BINDING SITE II or BINDING SITE III of FIG. 8. Table 4 illustrates the complementarity of the nucleotide sequences of SERPINB9 BINDING SITE, designated SEQ ID:6595, to the nucleotide sequence of GAM136 RNA, herein designated GAM RNA, also designated SEQ ID:279.

Another function of GAM136 is therefore inhibition of Serine (or cysteine) proteinase inhibitor, clade b (ovalbumin), member 9 (SERPINB9, Accession NM_004155.2), a gene which may be a serpin serine protease inhibitor that interacts with granzyme B (GZMB). Accordingly, utilities of GAM136 include diagnosis, prevention and treatment of diseases and clinical conditions associated with SERPINB9.

The function of SERPINB9 and its association with various diseases and clinical conditions, has been established by previous studies, as described hereinabove with reference to GAM88.2. Sh3-domain binding protein 2 (SH3BP2, Accession NM_003023.2) is another GAM136 target gene, herein designated TARGET GENE. SH3BP2 BINDING SITE is a target binding site found in the 3' untranslated region of mRNA encoded by SH3BP2, corresponding to a target binding site such as BINDING SITE I, BINDING SITE II or BINDING SITE III of FIG. 8. Table 4 illustrates the complementarity of the nucleotide sequences of SH3BP2 BINDING SITE, designated SEQ ID:19004, to the nucleotide sequence of GAM136 RNA, herein designated GAM RNA, also designated SEQ ID:279.

Another function of GAM136 is therefore inhibition of Sh3-domain binding protein 2 (SH3BP2, Accession NM_003023.2). Accordingly, utilities of GAM136 include diagnosis, prevention and treatment of diseases and clinical conditions associated with SH3BP2.

Tal1 (scl) interrupting locus (SIL, Accession NM_003035.1) is another GAM136 target gene, herein designated TARGET GENE. SIL BINDING SITE is a target binding site found in the 3' untranslated region of mRNA encoded by SIL, corresponding to a target binding site such as BINDING SITE I, BINDING SITE II or BINDING SITE III of FIG. 8. Table 4 illustrates the complementarity of the nucleotide sequences of SIL BINDING SITE, designated SEQ ID:10047, to the nucleotide sequence of GAM136 RNA, herein designated GAM RNA, also designated SEQ ID:279.

Another function of GAM136 is therefore inhibition of Tal1 (scl) interrupting locus (SIL, Accession NM_003035.1), a gene which may be required for axial development and left-right specification and therefore may be associated with Prominent midline neural tube defects, abnormal left-right development. Accordingly, utilities of GAM136 include diagnosis, prevention and treatment of Prominent midline neural tube defects, abnormal left-right development, and of other diseases and clinical conditions associated with SIL.

The function of SIL and its association with various diseases and clinical conditions, has been established by previous studies, as described hereinabove with reference to GAM30.1. Solute carrier family 14 (urea transporter), member 2 (SLC14A2, Accession NM_007163.2) is another GAM136 target gene, herein designated TARGET GENE. SLC14A2 BINDING SITE is a target binding site found in the 5' untranslated region of mRNA encoded by SLC14A2, corresponding to a target binding site such as BINDING SITE I, BINDING SITE II or BINDING SITE III of FIG. 8. Table 4 illustrates the complementarity of the nucleotide sequences of SLC14A2 BINDING SITE, designated SEQ ID:9752, to the nucleotide sequence of GAM136 RNA, herein designated GAM RNA, also designated SEQ ID:279.

Another function of GAM136 is therefore inhibition of Solute carrier family 14 (urea transporter), member 2 (SLC14A2, Accession NM_007163.2), a gene which is a renal urea transporter 2. and therefore may be associated with Orthostatic hypotension. Accordingly, utilities of GAM136 include diagnosis, prevention and treatment of Orthostatic hypotension, and of other diseases and clinical conditions associated with SLC14A2.

The function of SLC14A2 and its association with various diseases and clinical conditions, has been established by previous studies, as described hereinabove with reference to GAM97.1. Solute carrier family 16 (monocarboxylic acid transporters), member 4 (SLC16A4, Accession NM_004696.1) is another GAM136 target gene, herein designated TARGET GENE. SLC16A4 BINDING SITE is a target binding site found in the 3' untranslated region of mRNA encoded by SLC16A4, corresponding to a target binding site such as BINDING SITE I, BINDING SITE II or BINDING SITE III of FIG. 8. Table 4 illustrates the complementarity of the nucleotide sequences of SLC16A4 BINDING SITE, designated SEQ ID:17675, to the nucleotide sequence of GAM136 RNA, herein designated GAM RNA, also designated SEQ ID:279.

Another function of GAM136 is therefore inhibition of Solute carrier family 16 (monocarboxylic acid transporters), member 4 (SLC16A4, Accession NM_004696.1). Accordingly, utilities of GAM136 include diagnosis, prevention and treatment of diseases and clinical conditions associated with SLC16A4.

Solute carrier family 2 (facilitated glucose transporter), member 10 (SLC2A10, Accession NM_030777.2) is another GAM136 target gene, herein designated TARGET GENE. SLC2A10 BINDING SITE is a target binding site found in the 3' untranslated region of mRNA encoded by SLC2A10, corresponding to a target binding site such as BINDING SITE I, BINDING SITE II or BINDING SITE III of FIG. 8. Table 4 illustrates the complementarity of the nucleotide sequences of SLC2A10 BINDING SITE, designated SEQ ID:15101, to the nucleotide sequence of GAM136 RNA, herein designated GAM RNA, also designated SEQ ID:279.

Another function of GAM136 is therefore inhibition of Solute carrier family 2 (facilitated glucose transporter), member 10 (SLC2A10, Accession NM_030777.2). Accordingly, utilities of GAM136 include diagnosis, prevention and treatment of diseases and clinical conditions associated with SLC2A10.

SMAC (Accession NM_138929.1) is another GAM136 target gene, herein designated TARGET GENE. SMAC BINDING SITE is a target binding site found in the 5' untranslated region of multiple transcripts of mRNA encoded by SMAC, corresponding to a target binding site such as BINDING SITE I, BINDING SITE II or BINDING SITE III of FIG. 8. Table 4 illustrates the complementarity of the nucleotide sequences of SMAC BINDING SITE, designated SEQ ID:11007, to the nucleotide sequence of GAM136 RNA, herein designated GAM RNA, also designated SEQ ID:279.

Another function of GAM136 is therefore inhibition of SMAC (Accession NM_138929.1), a gene which promotes apoptosis via caspase activation. Accordingly, utilities of GAM136 include diagnosis, prevention and treatment of diseases and clinical conditions associated with SMAC.

The function of SMAC has been established by previous studies. Verhagen et al. (2000) identified the murine homolog of SMAC, which they called DIABLO (direct IAP-binding protein with low pI). They showed that DIABLO can bind mammalian IAP homolog A (MIHA, or API3) and can also interact with MIHB (API1; 601712), MIHC (API2; 601721), and OpIAP, the baculoviral IAP. Immunoprecipitation and Western blot analysis indicated that the N-terminally processed, IAP-interacting form of DIABLO is concentrated in membrane fractions in healthy cells but is released into the MIHA-containing cytosolic fractions upon ultraviolet (UV) irradiation. Since transfection of cells with DIABLO was able to counter the protection afforded by MIHA against UV irradiation, the authors suggested that DIABLO may promote apoptosis by binding to IAPs and preventing them from inhibiting caspases. Chai et al. (2000) showed that SMAC/DIABLO promotes not only the proteolytic activation of procaspase-3, but also the enzymatic activity of mature caspase-3, both of which depend upon its ability to interact physically with IAPs.

Animal model experiments lend further support to the function of SMAC. Okada et al. (2002) generated Diablo-deficient mice by homologous recombination. Western blot analysis confirmed the null mutation. The mice were fertile and appeared grossly normal at more than 1 year of age, and histologic analysis failed to detect any abnormalities. In vitro analysis indicated an inhibition of procaspase-3 (CASP3; 600636) cleavage in Diablo -/-cell lysates, but all types of Diablo -/- cells tested responded normally to a number of apoptotic stimuli. Fas (OMIM Ref. No. 134637)-mediated apoptosis in liver was also normal in vivo in these mice. The authors concluded that a redundant molecule, possibly Omi (PRSS25; 606441), or molecules are capable of compensating for the loss of Diablo function. Alternatively, they suggested that Diablo may only regulate programmed cell death in specific situations or tissues not yet identified.

It is appreciated that the abovementioned animal model for SMAC is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okada, H.; Suh, W.-K.; Jin, J.; Woo, M.; Du, C.; Elia, A.; Duncan, G. S.; Wakeham, A.; Itie, A.; Lowe, S. W.; Wang, X.; Mak, T. W.: Generation and characterization of Smac/DIABLO-deficient mice. Molec. Cell. Biol. 22:3509-3517, 2002; and Verhagen, A. M.; Ekert, P. G.; Pakusch, M.; Silke, J.; Connolly, L. M.; Reid, G. E.; Moritz, R. L.; Simpson, R. J.; Vaux, D. L.: Identification of DIABLO, a mammalian protein that promote.

Further studies establishing the function and utilities of SMAC are found in John Hopkins OMIM database record ID 605219, and in cited publications listed in Table 5, which are hereby incorporated by reference. Synaptosomal-associated protein, 23 kda (SNAP23, Accession NM_003825.2) is another GAM136 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:3908, to the nucleotide sequence of GAM136 RNA, herein designated GAM RNA, also designated SEQ ID:279.

Another function of GAM136 is therefore inhibition of Synaptosomal-associated protein, 23 kda (SNAP23, Accession NM_003825.2), a gene which is essential component of the high affinity receptor for the general membrane fusion machinery. Accordingly, utilities of GAM136 include diagnosis, prevention and treatment of diseases and clinical conditions associated with SNAP23.

The function of SNAP23 and its association with various diseases and clinical conditions, has been established by previous studies, as described hereinabove with reference to GAM30.1. Sorting nexin 15 (SNX15, Accession NM_013306.2) is another GAM136 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:10190, to the nucleotide sequence of GAM136 RNA, herein designated GAM RNA, also designated SEQ ID:279.

Another function of GAM136 is therefore inhibition of Sorting nexin 15 (SNX15, Accession NM_013306.2). Accordingly, utilities of GAM136 include diagnosis, prevention and treatment of diseases and clinical conditions associated with SNX15.

SQV7L (Accession XM_047287.2) is another GAM136 target gene, herein designated TARGET GENE. SQV7L BINDING SITE is a target binding site found in the 5' untranslated region of mRNA encoded by SQV7L, corresponding to a target binding site such as BINDING SITE I, BINDING SITE II or BINDING SITE III of FIG. 8. Table 4 illustrates the complementarity of the nucleotide sequences of SQV7L BINDING SITE, designated SEQ ID:5878, to the nucleotide sequence of GAM136 RNA, herein designated GAM RNA, also designated SEQ ID:279.

Another function of GAM136 is therefore inhibition of SQV7L (Accession XM_047287.2). Accordingly, utilities of GAM136 include diagnosis, prevention and treatment of diseases and clinical conditions associated with SQV7L.

SS-56 (Accession NM_018073.4) is another GAM136 target gene, herein designated TARGET GENE. SS-56 BINDING SITE is a target binding site found in the 3' untranslated region of mRNA encoded by SS-56, corresponding to a target binding site such as BINDING SITE I, BINDING SITE II or BINDING SITE III of FIG. 8. Table 4 illustrates the complementarity of the nucleotide sequences of SS-56 BINDING SITE, designated SEQ ID:15880, to the nucleotide sequence of GAM136 RNA, herein designated GAM RNA, also designated SEQ ID:279.

Another function of GAM136 is therefore inhibition of SS-56 (Accession NM_018073.4). Accordingly, utilities of GAM136 include diagnosis, prevention and treatment of diseases and clinical conditions associated with SS-56.

SUN1 (Accession) is another GAM136 target gene, herein designated TARGET GENE. SUN1 BINDING SITE is a target binding site found in the 3' untranslated region of mRNA encoded by SUN1, corresponding to a target binding site such as BINDING SITE I, BINDING SITE II or BINDING SITE III of FIG. 8. Table 4 illustrates the complementarity of the nucleotide sequences of SUN1 BINDING SITE, designated SEQ ID:16363, to the nucleotide sequence of GAM136 RNA, herein designated GAM RNA, also designated SEQ ID:279.

Another function of GAM136 is therefore inhibition of SUN1 (Accession). Accordingly, utilities of GAM136 include diagnosis, prevention and treatment of diseases and clinical conditions associated with SUN1.

Tap binding protein (tapasin) (TAPBP, Accession NM_003190.3) is another GAM136 target gene, herein designated TARGET GENE. TAPBP BINDING SITE1 and TAPBP BINDING SITE2 are target binding sites found in untranslated regions of multiple transcripts of mRNA encoded by TAPBP, corresponding to target binding sites such as BINDING SITE I, BINDING SITE II or BINDING SITE III of FIG. 8. Table 4 illustrates the complementarity of the nucleotide sequences of TAPBP BINDING SITE1 and TAPBP BINDING SITE2, designated SEQ ID:7038 and SEQ ID:5937 respectively, to the nucleotide sequence of GAM136 RNA, herein designated GAM RNA, also designated SEQ ID:279.

Another function of GAM136 is therefore inhibition of Tap binding protein (tapasin) (TAPBP, Accession NM_003190.3), a gene which is involved in MHC class I-restricted antigen processing. Accordingly, utilities of GAM136 include diagnosis, prevention and treatment of diseases and clinical conditions associated with TAPBP.

The function of TAPBP has been established by previous studies. Newly assembled major histocompatibility complex (MHC) class I molecules (see OMIM Ref. No. 142800), together with the endoplasmic reticulum (ER) chaperone calreticulin (OMIM Ref. No. 109091), interact with the transporter associated with antigen processing (TAP1; 170260) through a molecule called tapasin (Sadasivan et al., 1996). By molecular cloning of tapasin, Ortmann et al. (1997) found it to be a type I transmembrane glycoprotein encoded by an MHC-linked gene. The mature protein has 428 amino acids with a single N-linked glycosylation site at position 233. It is a member of the immunoglobulin superfamily with a probable cytoplasmic ER retention signal. Up to 4 MHC class I/tapasin complexes were found to bind to each TAP molecule in Daudi and L001 cells. Expression of tapasin in a negative mutant human cell line restored class I/TAP association and normal class I cell surface expression. Tapasin expression also corrected the defective recognition of virus- infected cells of the same line by class I-restricted cytotoxic T cells, thus establishing a critical functional role for tapasin in MHC class I-restricted antigen processing. Herberg et al. (1998) identified an EST encoding the mouse tapasin homolog. Mayer and Klein (2001) proposed that tapasin is in reality an MHC class I molecule with a different function from that currently executed by conventional class I molecules. They based this proposal on the amino acid sequence similarity between tapasin and conventional class I molecules, on similarity of predicted tertiary structure and domain organization of the molecules, on similarity of exon/intron organization of the encoding genes, and on the mapping of the class IA and tapasin genes into the same chromosomal region in all jawed vertebrates that had been tested to that time (Michalova et al., 2000).

Full details of the abovementioned studies are described in the following publications, the disclosure of which are hereby incorporated by reference:

Mayer, W. E.; Klein, J.: Is tapasin a modified Mhc class I molecule? Immunogenetics 53:719-723, 2001; and Ortmann, B.; Copeman, J.; Lehner, P. J.; Sadasivan, B.; Herberg, J. A.; Grandea, A. G.; Riddell, S. R.; Tampe, R.; Spies, T.; Trowsdale, J.; Cresswell, P.: A critical role for tapasin.

Further studies establishing the function and utilities of TAPBP are found in John Hopkins OMIM database record ID 601962, and in cited publications listed in Table 5, which are hereby incorporated by reference. T-cell leukemia/lymphoma 6 (TCL6, Accession NM_020553.2) is another GAM136 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17772, to the nucleotide sequence of GAM136 RNA, herein designated GAM RNA, also designated SEQ ID:279.

Another function of GAM136 is therefore inhibition of T-cell leukemia/lymphoma 6 (TCL6, Accession NM_020553.2). Accordingly, utilities of GAM136 include diagnosis, prevention and treatment of diseases and clinical conditions associated with TCL6.

Teratocarcinoma-derived growth factor 1 (TDGF1, Accession NM_003212.1) is another GAM136 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:17005, to the nucleotide sequence of GAM136 RNA, herein designated GAM RNA, also designated SEQ ID:279.

Another function of GAM136 is therefore inhibition of Teratocarcinoma-derived growth factor 1 (TDGF1, Accession NM_003212.1), a gene which can play a role in the determination of the epiblastic cells that subsequently give rise to the mesoderm. and therefore may be associated with Forebrain defects. Accordingly, utilities of GAM136 include diagnosis, prevention and treatment of Forebrain defects, and of other diseases and clinical conditions associated with TDGF1.

The function of TDGF1 and its association with various diseases and clinical conditions, has been established by previous studies, as described hereinabove with reference to GAM30.1. Telomeric repeat binding factor 2 (TERF2, Accession NM_005652.2) is another GAM136 target gene, herein designated TARGET GENE. TERF2 BINDING SITE is a target binding site found in the 3' untranslated region of mRNA encoded by TERF2, corresponding to a target binding site such as BINDING SITE I, BINDING SITE II or BINDING SITE III of FIG. 8. Table 4 illustrates the complementarity of the nucleotide sequences of TERF2 BINDING SITE, designated SEQ ID:17679, to the nucleotide sequence of GAM136 RNA, herein designated GAM RNA, also designated SEQ ID:279.

Another function of GAM136 is therefore inhibition of Telomeric repeat binding factor 2 (TERF2, Accession NM_005652.2), a gene which plays a key role in the protective activity of telomeres. Accordingly, utilities of GAM136 include diagnosis, prevention and treatment of diseases and clinical conditions associated with TERF2.

The function of TERF2 and its association with various diseases and clinical conditions, has been established by previous studies, as described hereinabove with reference to GAM133.2. TIM3 (Accession) is another GAM136 target gene, herein designated TARGET GENE. TIM3 BINDING SITE is a target binding site found in the 5' untranslated region of mRNA encoded by TIM3, corresponding to a target binding site such as BINDING SITE I, BINDING SITE II or BINDING SITE III of FIG. 8. Table 4 illustrates the complementarity of the nucleotide sequences of TIM3 BINDING SITE, designated SEQ ID:19281, to the nucleotide sequence of GAM136 RNA, herein designated GAM RNA, also designated SEQ ID:279.

Another function of GAM136 is therefore inhibition of TIM3 (Accession), a gene which regulates macrophage activation and enhances the severity of experimental autoimmune encephalomyelitis in mice. Accordingly, utilities of GAM136 include diagnosis, prevention and treatment of diseases and clinical conditions associated with TIM3.

The function of TIM3 has been established by previous studies. By immunoscreening Th1 and Th2 cells with monoclonal antibodies derived from mouse Th1 cell-immunized rats, followed by gene-expression cloning, Monney et al. (2002) obtained a cDNA encoding mouse Tim3. By genomic database searching and RT-PCR, the authors isolated a cDNA encoding human TIM3. The deduced 301-amino acid type I membrane protein, 63% identical overall and 77% identical in the cytoplasmic domain, has an Ig variable-like domain, a mucin-like domain consisting of 31% serine and threonine residues, and a cytoplasmic domain with a tyrosine phosphorylation motif. Monney et al. (2002) noted that TIM3 is related to the hepatitis A virus cellular receptor (HAVCR1; 606518), also known as the kidney injury molecule (Kim1). Using flow cytometric and RT- PCR analysis, Monney et al. (2002) detected Tim3 only on activated Th1 cells and CD11b+ (ITGAM; 120980) macrophages. Cells expressing Tim3 predominate in the central nervous system of mice at the onset of experimental autoimmune encephalomyelitis (EAE), a Th1-mediated autoimmune disease. Anti-Tim3 treatment enhanced the clinical and pathologic severity of EAE and increased the number and activation level of macrophages. Monney et al. (2002) proposed that anti-Tim3 may trigger the production of proinflammatory cytokines in vivo and induce macrophage activation possibly by enhancing the migration of Th1 cells into the brain or by blocking an interaction between Tim3 and an inhibitory ligand.

Full details of the abovementioned studies are described in the following publications, the disclosure of which are hereby incorporated by reference:

Monney, L.; Sabatos, C.; Gaglia, J. L.; Ry, A.; Waldner, H.; Chernova, T.; Manning, S.; Greenfield, E. A.; Coyle, A. J.; Sobel, R. A.; Freeman, G. J.; Kuchroo, V. K.: Th1-specific cell surface protein regulates macrophage activation and severity of an autoimmune disease. Nature 415:536-541, 2002; and McIntire, J. J.; Umetsu, S. E.; Akbari, O.; Potter, M.; Kuchroo, V. K.; Barsh, G. S.; Freeman, G. J.; Umetsu, D. T.; DeKruyff, R. H.: Identification of Tapr (an airway hyperreactivity.

Further studies establishing the function and utilities of TIM3 are found in John Hopkins OMIM database record ID 606652, and in cited publications listed in Table 5, which are hereby incorporated by reference. Tight junction protein 1 (zona occludens 1) (TJP1, Accession NM_175610.1) is another GAM136 target gene, herein designated TARGET GENE. TJP1 BINDING SITE is a target binding site found in the 5' untranslated region of multiple transcripts of mRNA encoded by TJP1, corresponding to a target binding site such as BINDING SITE I, BINDING SITE II or BINDING SITE III of FIG. 8. Table 4 illustrates the complementarity of the nucleotide sequences of TJP1 BINDING SITE, designated SEQ ID:4867, to the nucleotide sequence of GAM136 RNA, herein designated GAM RNA, also designated SEQ ID:279.

Another function of GAM136 is therefore inhibition of Tight junction protein 1 (zona occludens 1) (TJP1, Accession NM_175610.1), a gene which colocalizes and interacts with cadherins in cells lacking tight junctions. Accordingly, utilities of GAM136 include diagnosis, prevention and treatment of diseases and clinical conditions associated with TJP1.

The function of TJP1 has been established by previous studies. Tight junction (zonula occludens) protein 1 (TJP1), also referred to as ZO-1, is a 200-kD protein located on a cytoplasmic membrane surface of vertebrate intercellular tight junctions. Willott et al. (1993) isolated a full-length cDNA sequence for human TJP1. Although the function of TJP1 is unknown, the cDNA sequence predicted a multidomain signaling protein homologous to the product of the 'discs large-1' tumor suppressor gene of Drosophila (OMIM Ref. No. 601014) and several other membrane-associated proteins in mammals. By fluorescence in situ hybridization using a cDNA probe, Mohandas et al. (1995) mapped TJP1 to 15q13. The Jackson Laboratory backcross DNA panel derived from interspecies crosses was used to map Tjp1 to mouse chromosome 7 in a region with conserved homology to 15q13. Fluorescence in situ hybridization studies on metaphases from patients with the Prader-Willi syndrome (OMIM Ref. No. 176270) and/or the Angelman syndrome (OMIM Ref. No. 105830) showed that TJP1 maps close but distal to the PWS/AS chromosome region.

Full details of the abovementioned studies are described in the following publications, the disclosure of which are hereby incorporated by reference:

Mohandas, T. K.; Chen, X.-N.; Rowe, L. B.; Birkenmeier, E. H.; Fanning, A. S.; Anderson, J. M.; Korenberg, J. R.: Localization of the tight junction protein gene TJP1 to human chromosome 15q13, distal to the Prader-Willi/Angelman region, and to mouse chromosome 7. Genomics 30:594-597, 1995; and Willott, E.; Balda, M. S.; Fanning, A. S.; Jameson, B.; Van Itallie, C.; Anderson, J. M.: The tight junction protein ZO-1 is homologous to the Drosophila discs- large tumor suppressor pr.

Further studies establishing the function and utilities of TJP1 are found in John Hopkins OMIM database record ID 601009, and in cited publications listed in Table 5, which are hereby incorporated by reference. Transmembrane, cochlear expressed, 1 (TMC1, Accession NM_138691.2) is another GAM136 target gene, herein designated TARGET GENE. TMC1 BINDING SITE is a target binding site found in the 5' untranslated region of mRNA encoded by TMC1, corresponding to a target binding site such as BINDING SITE I, BINDING SITE II or BINDING SITE III of FIG. 8. Table 4 illustrates the complementarity of the nucleotide sequences of TMC1 BINDING SITE, designated SEQ ID:10094, to the nucleotide sequence of GAM136 RNA, herein designated GAM RNA, also designated SEQ ID:279.

Another function of GAM136 is therefore inhibition of Transmembrane, cochlear expressed, 1 (TMC1, Accession NM_138691.2), a gene which is required for normal function of cochlear hair cells and therefore may be associated with Autosomal recessive nonsyndromic neurosensory deafness and autosomal dominant nonsyndromic sensorineural hearing loss. Accordingly, utilities of GAM136 include diagnosis, prevention and treatment of Autosomal recessive nonsyndromic neurosensory deafness and autosomal dominant nonsyndromic sensorineural hearing loss ., and of other diseases and clinical conditions associated with TMC1.

The function of TMC1 has been established by previous studies. By positional cloning, Kurima et al. (2002) identified the gene mutant in a form of autosomal dominant deafness (DFNA36; 606705) and of recessive deafness (DFNB7/B11; 600974) that map to the same interval on 9q13-q21. The authors evaluated several candidate genes in the critical region but found no mutations in the deaf families. To identify additional DFNA36/B7/B11 candidate genes based upon sequence similarity to related genes elsewhere in the genome, they initiated a systematic BLAST analysis of segments of genomic DNA sequence in the critical region. One sequence was found to be similar to a predicted gene (subsequently named TMC2; 606707) on 20p13. They used conserved sequences between TMC2 and the query sequence (subsequently named TMC1) on chromosome 9q13-q21 to design primers for amplifying potential TMC1 transcripts from a human fetal brain cDNA library. Kurima et al. (2002) found the longest open reading frame to be 2,283 nucleotides, predicting an 87-kD protein. The TMC1 protein is predicted to contain 6 transmembrane domains and to have cytoplasmic orientation of N and C termini. Kurima et al. (2002) obtained the orthologous mouse Tmc1 cDNA by RT-PCR and 5-prime and 3-prime RACE of mouse inner-ear cDNA. They found that in the mouse, Tmc1 mRNA is expressed in hair cells of the postnatal cochlea and vestibular end organs and is required for normal function of cochlear hair cells.

Animal model experiments lend further support to the function of TMC1. Vreugde et al. (2002) identified a missense mutation in the Tmc1 gene in the mouse deaf mutant 'Beethoven' (Bth). Thus it is a mouse model for autosomal dominant progressive hearing loss (DFNA36; 606705). Similarly, the recessive deafness mutation dn, which maps to mouse chromosome 19, is a model of profound congenital deafness caused by mutations in the TMC1 gene: DFNB7 (OMIM Ref. No. 600974), also known as DFNB11.

It is appreciated that the abovementioned animal model for TMC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kurima, K.; Peters. L. M.; Yang, Y.; Riazuddin, S.; Ahmed, Z. M.; Naz, S.; Arnaud, D.; Drury, S.; Mo, J.; Makishima, T.; Ghosh, M.; Menon, P. S. N.; and 13 others : Dominant and recessive deafness caused by mutations of a novel gene, TMC1, required for cochlear hair-cell function. Nature Genet. 30:277-284, 2002; and Vreugde, S.; Erven, A.; Kros, C. J.; Marcotti, W.; Fuches, H.; Kurima, K.; Wilcox, E. R.; Friedman, T. B.; Griffith, A. J.; Balling, R.; de Angelis, M. H.; Avraham, K. B.; Steel, K. P.

Further studies establishing the function and utilities of TMC1 are found in John Hopkins OMIM database record ID 606706, and in cited publications listed in Table 5, which are hereby incorporated by reference. Tumor necrosis factor receptor superfamily, member 10b (TNFRSF10B, Accession NM_147187.1) is another GAM136 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:16066, to the nucleotide sequence of GAM136 RNA, herein designated GAM RNA, also designated SEQ ID:279.

Another function of GAM136 is therefore inhibition of Tumor necrosis factor receptor superfamily, member 10b (TNFRSF10B, Accession NM_147187.1), a gene which forms complex that induces apoptosis. and therefore may be associated with Squamous cell carcinoma. Accordingly, utilities of GAM136 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor protein p53 (li-fraumeni syndrome) (TP53, Accession NM_000546.2) is another GAM136 target gene, herein designated TARGET GENE. TP53 BINDING SITE is a target binding site found in the 3' untranslated region of mRNA encoded by TP53, corresponding to a target binding site such as BINDING SITE I, BINDING SITE II or BINDING SITE III of FIG. 8. Table 4 illustrates the complementarity of the nucleotide sequences of TP53 BINDING SITE, designated SEQ ID:9481, to the nucleotide sequence of GAM136 RNA, herein designated GAM RNA, also designated SEQ ID:279.

Another function of GAM136 is therefore inhibition of Tumor protein p53 (li-fraumeni syndrome) (TP53, Accession NM_000546.2). Accordingly, utilities of GAM136 include diagnosis, prevention and treatment of diseases and clinical conditions associated with TP53.

Tripartite motif-containing 5 (TRIM5, Accession NM_033034.1) is another GAM136 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:18339, to the nucleotide sequence of GAM136 RNA, herein designated GAM RNA, also designated SEQ ID:279.

Another function of GAM136 is therefore inhibition of Tripartite motif-containing 5 (TRIM5, Accession NM_033034.1). Accordingly, utilities of GAM136 include diagnosis, prevention and treatment of diseases and clinical conditions associated with TRIM5.

Transient receptor potential cation channel, subfamily v, member 1 (TRPV1, Accession NM_080704.1) is another GAM136 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:4442, to the nucleotide sequence of GAM136 RNA, herein designated GAM RNA, also designated SEQ ID:279.

Another function of GAM136 is therefore inhibition of Transient receptor potential cation channel, subfamily v, member 1 (TRPV1, Accession NM_080704.1), a gene which functions as a receptor for capsaicin. Accordingly, utilities of GAM136 include diagnosis, prevention and treatment of diseases and clinical conditions associated with TRPV1.

The function of TRPV1 and its association with various diseases and clinical conditions, has been established by previous studies, as described hereinabove with reference to GAM130.1. TUCAN (Accession NM_014959.1) is another GAM136 target gene, herein designated TARGET GENE. TUCAN BINDING SITE is a target binding site found in the 5' untranslated region of mRNA encoded by TUCAN, corresponding to a target binding site such as BINDING SITE I, BINDING SITE II or BINDING SITE III of FIG. 8. Table 4 illustrates the complementarity of the nucleotide sequences of TUCAN BINDING SITE, designated SEQ ID:5981, to the nucleotide sequence of GAM136 RNA, herein designated GAM RNA, also designated SEQ ID:279.

Another function of GAM136 is therefore inhibition of TUCAN (Accession NM_014959.1). Accordingly, utilities of GAM136 include diagnosis, prevention and treatment of diseases and clinical conditions associated with TUCAN.

Tuftelin 1 (TUFT1, Accession NM_020127.1) is another GAM136 target gene, herein designated TARGET GENE. TUFT1 BINDING SITE is a target binding site found in the 3' untranslated region of mRNA encoded by TUFT1, corresponding to a target binding site such as BINDING SITE I, BINDING SITE II or BINDING SITE III of FIG. 8. Table 4 illustrates the complementarity of the nucleotide sequences of TUFT1 BINDING SITE, designated SEQ ID:5698, to the nucleotide sequence of GAM136 RNA, herein designated GAM RNA, also designated SEQ ID:279.

Another function of GAM136 is therefore inhibition of Tuftelin 1 (TUFT1, Accession NM_020127.1), a gene which appears to play a role in cytokinesis, cell shape, and specialized functions such as secretion and capping. Accordingly, utilities of GAM136 include diagnosis, prevention and treatment of diseases and clinical conditions associated with TUFT1.

The function of TUFT1 has been established by previous studies. Tuftelin is an acidic protein found in developing and mature extracellular enamel, the unique and highly mineralized ectodermal tissue covering vertebrate teeth (Deutsch, 1989; Deutsch et al., 1991). It is thought to play a major role in mineralization and structural organization of enamel. By fluorescence in situ hybridization, Deutsch et al. (1994) mapped the TUFT1 gene to 1q21-q31. They raised the possibility that an autosomal dominant form of amelogenesis imperfecta (104500, 104530) is due to a mutation in this gene. By FISH, Bashir et al. (1998) localized the TUFT1 gene to 1q21.

Full details of the abovementioned studies are described in the following publications, the disclosure of which are hereby incorporated by reference:

Deutsch, D.; Palmon, A.; Fisher, L. W.; Kolodny, N.; Termine, J. D.; Young, M. F. : Sequencing of bovine enamelin (tuftelin), a novel acidic enamel protein. J. Biol. Chem. 266: 16021-16028, 1991; and Deutsch, D.; Palmon, A.; Young, M. F.; Selig, S.; Kearns, W. G.; Fisher, L. W.: Mapping of the human tuftelin (TUFT1) gene to chromosome 1 by fluorescence in situ hybridization. (Abstrac.

Further studies establishing the function and utilities of TUFT1 are found in John Hopkins OMIM database record ID 600087, and in cited publications listed in Table 5, which are hereby incorporated by reference. Thioredoxin-like 2 (TXNL2, Accession NM_006541.1) is another GAM136 target gene, herein designated TARGET GENE. TXNL2 BINDING SITE is a target binding site found in the 3' untranslated region of mRNA encoded by TXNL2, corresponding to a target binding site such as BINDING SITE I, BINDING SITE II or BINDING SITE III of FIG. 8. Table 4 illustrates the complementarity of the nucleotide sequences of TXNL2 BINDING SITE, designated SEQ ID:3614, to the nucleotide sequence of GAM136 RNA, herein designated GAM RNA, also designated SEQ ID:279.

Another function of GAM136 is therefore inhibition of Thioredoxin-like 2 (TXNL2, Accession NM_006541.1). Accordingly, utilities of GAM136 include diagnosis, prevention and treatment of diseases and clinical conditions associated with TXNL2.

UBF-fl (Accession NM_032828.1) is another GAM136 target gene, herein designated TARGET GENE. UBF-fl BINDING SITE1 and UBF-fl BINDING SITE2 are target binding sites found in untranslated regions of mRNA encoded by UBF-fl, corresponding to target binding sites such as BINDING SITE I, BINDING SITE II or BINDING SITE III of FIG. 8. Table 4 illustrates the complementarity of the nucleotide sequences of UBF-fl BINDING SITE1 and UBF-fl BINDING SITE2, designated SEQ ID:3774 and SEQ ID:9865 respectively, to the nucleotide sequence of GAM136 RNA, herein designated GAM RNA, also designated SEQ ID:279.

Another function of GAM136 is therefore inhibition of UBF-fl (Accession NM_032828.1). Accordingly, utilities of GAM136 include diagnosis, prevention and treatment of diseases and clinical conditions associated with UBF-fl.

Vent-like homeobox 2 (VENTX2, Accession NM_014468.1) is another GAM136 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:1323, to the nucleotide sequence of GAM136 RNA, herein designated GAM RNA, also designated SEQ ID:279.

Another function of GAM136 is therefore inhibition of Vent-like homeobox 2 (VENTX2, Accession NM_014468.1). Accordingly, utilities of GAM136 include diagnosis, prevention and treatment of diseases and clinical conditions associated with VENTX2.

Vacuolar protein sorting 33a (yeast) (VPS33A, Accession NM_022916.2) is another GAM136 target gene, herein designated TARGET GENE. VPS33A BINDING SITE is a target binding site found in the 3' untranslated region of mRNA encoded by VPS33A, corresponding to a target binding site such as BINDING SITE I, BINDING SITE II or BINDING SITE III of FIG. 8. Table 4 illustrates the complementarity of the nucleotide sequences of VPS33A BINDING SITE, designated SEQ ID:6708, to the nucleotide sequence of GAM136 RNA, herein designated GAM RNA, also designated SEQ ID:279.

Another function of GAM136 is therefore inhibition of Vacuolar protein sorting 33a (yeast) (VPS33A, Accession NM_022916.2). Accordingly, utilities of GAM136 include diagnosis, prevention and treatment of diseases and clinical conditions associated with VPS33A.

Williams beuren syndrome chromosome region 20a (WBSCR20A, Accession NM_148956.1) is another GAM136 target gene, herein designated TARGET GENE. WBSCR20A BINDING SITE is a target binding site found in the 5' untranslated region of multiple transcripts of mRNA encoded by WBSCR20A, corresponding to a target binding site such as BINDING SITE I, BINDING SITE II or BINDING SITE III of FIG. 8. Table 4 illustrates the complementarity of the nucleotide sequences of WBSCR20A BINDING SITE, designated SEQ ID:18847, to the nucleotide sequence of GAM136 RNA, herein designated GAM RNA, also designated SEQ ID:279.

Another function of GAM136 is therefore inhibition of Williams beuren syndrome chromosome region 20a (WBSCR20A, Accession NM_148956.1). Accordingly, utilities of GAM136 include diagnosis, prevention and treatment of diseases and clinical conditions associated with WBSCR20A.

X-ray repair complementing defective repair in chinese hamster cells 2 (XRCC2, Accession NM_005431.1) is another GAM136 target gene, herein designated TARGET GENE. XRCC2 BINDING SITE1 and XRCC2 BINDING SITE2 are target binding sites found in untranslated regions of mRNA encoded by XRCC2, corresponding to target binding sites such as BINDING SITE I, BINDING SITE II or BINDING SITE III of FIG. 8. Table 4 illustrates the complementarity of the nucleotide sequences of XRCC2 BINDING SITE1 and XRCC2 BINDING SITE2, designated SEQ ID:12449 and SEQ ID:13590 respectively, to the nucleotide sequence of GAM136 RNA, herein designated GAM RNA, also designated SEQ ID:279.

Another function of GAM136 is therefore inhibition of X-ray repair complementing defective repair in chinese hamster cells 2 (XRCC2, Accession NM_005431.1), a gene which involves in the homologous recombination repair (hrr) pathway of double-stranded dna. Accordingly, utilities of GAM136 include diagnosis, prevention and treatment of diseases and clinical conditions associated with XRCC2.

The function of XRCC2 and its association with various diseases and clinical conditions, has been established by previous studies, as described hereinabove with reference to GAM72.1. V-yes-1 yamaguchi sarcoma viral oncogene homolog 1 (YES1, Accession NM_005433.2) is another GAM136 target gene, herein designated TARGET GENE. YES1 BINDING SITE is a target binding site found in the 5' untranslated region of mRNA encoded by YES1, corresponding to a target binding site such as BINDING SITE I, BINDING SITE II or BINDING SITE III of FIG. 8. Table 4 illustrates the complementarity of the nucleotide sequences of YES1 BINDING SITE, designated SEQ ID:416, to the nucleotide sequence of GAM136 RNA, herein designated GAM RNA, also designated SEQ ID:279.

Another function of GAM136 is therefore inhibition of V-yes-1 yamaguchi sarcoma viral oncogene homolog 1 (YES1, Accession NM_005433.2), a gene which is a putative protein-tyrosine kinase. Accordingly, utilities of GAM136 include diagnosis, prevention and treatment of diseases and clinical conditions associated with YES1.

The function of YES1 and its association with various diseases and clinical conditions, has been established by previous studies, as described hereinabove with reference to GAM30.1. Zinc finger protein 133 (clone phz-13) (ZNF133, Accession NM_003434.2) is another GAM136 target gene, herein designated TARGET GENE. ZNF133 BINDING SITE is a target binding site found in the 5' untranslated region of mRNA encoded by ZNF133, corresponding to a target binding site such as BINDING SITE I, BINDING SITE II or BINDING SITE III of FIG. 8. Table 4 illustrates the complementarity of the nucleotide sequences of ZNF133 BINDING SITE, designated SEQ ID:4840, to the nucleotide sequence of GAM136 RNA, herein designated GAM RNA, also designated SEQ ID:279.

Another function of GAM136 is therefore inhibition of Zinc finger protein 133 (clone phz-13) (ZNF133, Accession NM_003434.2). Accordingly, utilities of GAM136 include diagnosis, prevention and treatment of diseases and clinical conditions associated with ZNF133.

Zinc finger protein 221 (ZNF221, Accession NM_013359.1) is another GAM136 target gene, herein designated TARGET GENE. ZNF221 BINDING SITE is a target binding site found in the 3' untranslated region of mRNA encoded by ZNF221, corresponding to a target binding site such as BINDING SITE I, BINDING SITE II or BINDING SITE III of FIG. 8. Table 4 illustrates the complementarity of the nucleotide sequences of ZNF221 BINDING SITE, designated SEQ ID:13245, to the nucleotide sequence of GAM136 RNA, herein designated GAM RNA, also designated SEQ ID:279.

Another function of GAM136 is therefore inhibition of Zinc finger protein 221 (ZNF221, Accession NM_013359.1). Accordingly, utilities of GAM136 include diagnosis, prevention and treatment of diseases and clinical conditions associated with ZNF221.

Zinc finger protein 264 (ZNF264, Accession NM_003417.1) is another GAM136 target gene, herein designated TARGET GENE. ZNF264 BINDING SITE is a target binding site found in the 3' untranslated region of mRNA encoded by ZNF264, corresponding to a target binding site such as BINDING SITE I, BINDING SITE II or BINDING SITE III of FIG. 8. Table 4 illustrates the complementarity of the nucleotide sequences of ZNF264 BINDING SITE, designated SEQ ID:4725, to the nucleotide sequence of GAM136 RNA, herein designated GAM RNA, also designated SEQ ID:279.

Another function of GAM136 is therefore inhibition of Zinc finger protein 264 (ZNF264, Accession NM_003417.1). Accordingly, utilities of GAM136 include diagnosis, prevention and treatment of diseases and clinical conditions associated with ZNF264.

Zinc finger protein 338 (ZNF338, Accession) is another GAM136 target gene, herein designated TARGET GENE. ZNF338 BINDING SITE is a target binding site found in the 3' untranslated region of mRNA encoded by ZNF338, corresponding to a target binding site such as BINDING SITE I, BINDING SITE II or BINDING SITE III of FIG. 8. Table 4 illustrates the complementarity of the nucleotide sequences of ZNF338 BINDING SITE, designated SEQ ID:4054, to the nucleotide sequence of GAM136 RNA, herein designated GAM RNA, also designated SEQ ID:279.

Another function of GAM136 is therefore inhibition of Zinc finger protein 338 (ZNF338, Accession). Accordingly, utilities of GAM136 include diagnosis, prevention and treatment of diseases and clinical conditions associated with ZNF338.

Zinc finger protein 339 (ZNF339, Accession NM_021220.1) is another GAM136 target gene, herein designated TARGET GENE. ZNF339 BINDING SITE is a target binding site found in the 3' untranslated region of mRNA encoded by ZNF339, corresponding to a target binding site such as BINDING SITE I, BINDING SITE II or BINDING SITE III of FIG. 8. Table 4 illustrates the complementarity of the nucleotide sequences of ZNF339 BINDING SITE, designated SEQ ID:11496, to the nucleotide sequence of GAM136 RNA, herein designated GAM RNA, also designated SEQ ID:279.

Another function of GAM136 is therefore inhibition of Zinc finger protein 339 (ZNF339, Accession NM_021220.1). Accordingly, utilities of GAM136 include diagnosis, prevention and treatment of diseases and clinical conditions associated with ZNF339.

ZTL1 (Accession) is another GAM136 target gene, herein designated TARGET GENE. ZTL1 BINDING SITE is a target binding site found in the 3' untranslated region of mRNA encoded by ZTL1, corresponding to a target binding site such as BINDING SITE I, BINDING SITE II or BINDING SITE III of FIG. 8. Table 4 illustrates the complementarity of the nucleotide sequences of ZTL1 BINDING SITE, designated SEQ ID:20007, to the nucleotide sequence of GAM136 RNA, herein designated GAM RNA, also designated SEQ ID:279.

Another function of GAM136 is therefore inhibition of ZTL1 (Accession). Accordingly, utilities of GAM136 include diagnosis, prevention and treatment of diseases and clinical conditions associated with ZTL1.

FIG. 8 further provides a conceptual description of a novel bioinformatically detected of the present invention, referred to here as Genomic Address Messenger 137 (GAM137), which modulates expression of respective target genes thereof, the function and utility of which target genes is known in the art.

GAM137 is a novel bioinformatically detected regulatory, non protein coding, micro RNA (miRNA) gene. The method by which GAM137 was detected is described hereinabove with reference to FIGS. 8-15.

GAM137 gene, herein designated GAM GENE, and GAM137 target gene, herein designated TARGET GENE, are human genes contained in the human genome.

GAM137 gene encodes a GAM137 precursor RNA, herein designated GAM PRECURSOR RNA. Similar to other miRNA genes, and unlike most ordinary genes, GAM137 precursor RNA does not encode a protein. A nucleotide sequence identical or highly similar to the nucleotide sequence of GAM137 precursor RNA is designated SEQ ID:76, and is provided hereinbelow with reference to the sequence listing part.

GAM137 precursor RNA folds onto itself, forming GAM137 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM137 precursor RNA folds onto itself, forming GAM137 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM137 precursor RNA, designated SEQ-ID:76, and a schematic representation of a predicted secondary folding of GAM137 folded precursor RNA are further described with reference to Table 2, hereby incorporated by reference.

An enzyme complex designated DICER COMPLEX, 'dices' the GAM137 folded precursor RNA into GAM137 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM137 RNA is designated SEQ ID:202, and is provided hereinbelow with references to the sequence listing part and Table 3, hereby incorporated by reference.

GAM137 target gene, herein designated TARGET GENE, encodes a corresponding messenger RNA, GAM137 target RNA, herein designated GAM TARGET RNA. GAM137 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM137 RNA, herein designated GAM RNA, binds complementarily to one or more target binding sites located in untranslated regions of GAM137 target RNA, herein designated GAM TARGET RNA. This complementary binding is due to the fact that the nucleotide sequence of GAM137 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM137 RNA may have a different number of target binding sites in untranslated regions of a GAM137 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM137 RNA, herein designated GAM RNA, to target binding sites on GAM137 target RNA, herein designated GAM TARGET RNA, such as BINDING SITE I, BINDING SITE II and BINDING SITE III, inhibits translation of GAM137 target RNA into GAM137 target protein, herein designated GAM TARGET PROTEIN. GAM target protein is therefore outlined by a broken line.

It is appreciated that GAM137 target gene, herein designated TARGET GENE, in fact represents a plurality of GAM137 target genes. The mRNA of each one of this plurality of GAM137 target genes comprises one or more target binding sites, each having a nucleotide sequence which is at least partly complementary to GAM137 RNA, herein designated GAM RNA, and which when bound by GAM137 RNA causes inhibition of translation of respective one or more GAM137 target proteins.

It is further appreciated by one skilled in the art that the mode of translational inhibition illustrated by FIG. 8 with specific reference to translational inhibition exerted by GAM137 gene, herein designated GAM GENE, on one or more GAM137 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM137 correlate with, and may be deduced from, the identity of the target genes which GAM137 binds and inhibits, and the function of these target genes, as elaborated hereinbelow.

Bobby sox homolog (drosophila) (BBX, Accession NM_020235.2) is a GAM137 target gene, herein designated TARGET GENE. BBX BINDING SITE is a target binding site found in the 3' untranslated region of mRNA encoded by BBX, corresponding to a target binding site such as BINDING SITE I, BINDING SITE II or BINDING SITE III of FIG. 8. Table 4 illustrates the complementarity of the nucleotide sequences of BBX BINDING SITE, designated SEQ ID:2775, to the nucleotide sequence of GAM137 RNA, herein designated GAM RNA, also designated SEQ ID:202.

A function of GAM137 is therefore inhibition of Bobby sox homolog (drosophila) (BBX, Accession NM_020235.2). Accordingly, utilities of GAM137 include diagnosis, prevention and treatment of diseases and clinical conditions associated with BBX.

KIAA0323 (Accession XM_032634.1) is another GAM137 target gene, herein designated TARGET GENE. KIAA0323 BINDING SITE is a target binding site found in the 3' untranslated region of mRNA encoded by KIAA0323, corresponding to a target binding site such as BINDING SITE I, BINDING SITE II or BINDING SITE III of FIG. 8. Table 4 illustrates the complementarity of the nucleotide sequences of KIAA0323 BINDING SITE, designated SEQ ID:8515, to the nucleotide sequence of GAM137 RNA, herein designated GAM RNA, also designated SEQ ID:202.

Another function of GAM137 is therefore inhibition of KIAA0323 (Accession XM_032634.1). Accordingly, utilities of GAM137 include diagnosis, prevention and treatment of diseases and clinical conditions associated with KIAA0323.

LOC202347 (Accession XM_117390.1) is another GAM137 target gene, herein designated TARGET GENE. LOC202347 BINDING SITE is a target binding site found in the 3' untranslated region of mRNA encoded by LOC202347, corresponding to a target binding site such as BINDING SITE I, BINDING SITE II or BINDING SITE III of FIG. 8. Table 4 illustrates the complementarity of the nucleotide sequences of LOC202347 BINDING SITE, designated SEQ ID:3099, to the nucleotide sequence of GAM137 RNA, herein designated GAM RNA, also designated SEQ ID:202.

Another function of GAM137 is therefore inhibition of LOC202347 (Accession XM_117390.1). Accordingly, utilities of GAM137 include diagnosis, prevention and treatment of diseases and clinical conditions associated with LOC202347.

Transcription factor 7 (t-cell specific, hmg-box) (TCF7, Accession NM_003202.1) is another GAM137 target gene, herein designated TARGET GENE. TCF7 BINDING SITE is a target binding site found in the 3' untranslated region of mRNA encoded by TCF7, corresponding to a target binding site such as BINDING SITE I, BINDING SITE II or BINDING SITE III of FIG. 8. Table 4 illustrates the complementarity of the nucleotide sequences of TCF7 BINDING SITE, designated SEQ ID:8403, to the nucleotide sequence of GAM137 RNA, herein designated GAM RNA, also designated SEQ ID:202.

Another function of GAM137 is therefore inhibition of Transcription factor 7 (t-cell specific, hmg-box) (TCF7, Accession NM_003202.1). Accordingly, utilities of GAM137 include diagnosis, prevention and treatment of diseases and clinical conditions associated with TCF7.

FIG. 8 further provides a conceptual description of a novel bioinformatically detected of the present invention, referred to here as Genomic Address Messenger 138 (GAM138), which modulates expression of respective target genes thereof, the function and utility of which target genes is known in the art.

GAM138 is a novel bioinformatically detected regulatory, non protein coding, micro RNA (miRNA) gene. The method by which GAM138 was detected is described hereinabove with reference to FIGS. 8-15.

GAM138 gene, herein designated GAM GENE, and GAM138 target gene, herein designated TARGET GENE, are human genes contained in the human genome.

GAM138 gene encodes a GAM138 precursor RNA, herein designated GAM PRECURSOR RNA. Similar to other miRNA genes, and unlike most ordinary genes, GAM138 precursor RNA does not encode a protein. A nucleotide sequence identical or highly similar to the nucleotide sequence of GAM138 precursor RNA is designated SEQ ID:179, and is provided hereinbelow with reference to the sequence listing part.

GAM138 precursor RNA folds onto itself, forming GAM138 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM138 precursor RNA folds onto itself, forming GAM138 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM138 precursor RNA, designated SEQ-ID:179, and a schematic representation of a predicted secondary folding of GAM138 folded precursor RNA are further described with reference to Table 2, hereby incorporated by reference.

An enzyme complex designated DICER COMPLEX, 'dices' the GAM138 folded precursor RNA into GAM138 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM138 RNA is designated SEQ ID:222, and is provided hereinbelow with references to the sequence listing part and Table 3, hereby incorporated by reference.

GAM138 target gene, herein designated TARGET GENE, encodes a corresponding messenger RNA, GAM138 target RNA, herein designated GAM TARGET RNA. GAM138 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM138 RNA, herein designated GAM RNA, binds complementarily to one or more target binding sites located in untranslated regions of GAM138 target RNA, herein designated GAM TARGET RNA. This complementary binding is due to the fact that the nucleotide sequence of GAM138 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM138 RNA may have a different number of target binding sites in untranslated regions of a GAM138 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM138 RNA, herein designated GAM RNA, to target binding sites on GAM138 target RNA, herein designated GAM TARGET RNA, such as BINDING SITE I, BINDING SITE II and BINDING SITE III, inhibits translation of GAM138 target RNA into GAM138 target protein, herein designated GAM TARGET PROTEIN. GAM target protein is therefore outlined by a broken line.

It is appreciated that GAM138 target gene, herein designated TARGET GENE, in fact represents a plurality of GAM138 target genes. The mRNA of each one of this plurality of GAM138 target genes comprises one or more target binding sites, each having a nucleotide sequence which is at least partly complementary to GAM138 RNA, herein designated GAM RNA, and which when bound by GAM138 RNA causes inhibition of translation of respective one or more GAM138 target proteins.

It is further appreciated by one skilled in the art that the mode of translational inhibition illustrated by FIG. 8 with specific reference to translational inhibition exerted by GAM138 gene, herein designated GAM GENE, on one or more GAM138 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM138 correlate with, and may be deduced from, the identity of the target genes which GAM138 binds and inhibits, and the function of these target genes, as elaborated hereinbelow.

Chromosome 6 open reading frame 33 (C6orf33, Accession NM_133367.1) is a GAM138 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:8900, to the nucleotide sequence of GAM138 RNA, herein designated GAM RNA, also designated SEQ ID:222.

A function of GAM138 is therefore inhibition of Chromosome 6 open reading frame 33 (C6orf33, Accession NM_133367.1). Accordingly, utilities of GAM138 include diagnosis, prevention and treatment of diseases and clinical conditions associated with C6orf33.

Chromosome 9 open reading frame 9 (C9orf9, Accession NM_018956.2) is another GAM138 target gene, herein designated TARGET GENE. C9orf9 BINDING SITE is a target binding site found in the 3' untranslated region of mRNA encoded by C9orf9, corresponding to a target binding site such as BINDING SITE I, BINDING SITE II or BINDING SITE III of FIG. 8. Table 4 illustrates the complementarity of the nucleotide sequences of C9orf9 BINDING SITE, designated SEQ ID:5771, to the nucleotide sequence of GAM138 RNA, herein designated GAM RNA, also designated SEQ ID:222.

Another function of GAM138 is therefore inhibition of Chromosome 9 open reading frame 9 (C9orf9, Accession NM_018956.2). Accordingly, utilities of GAM138 include diagnosis, prevention and treatment of diseases and clinical conditions associated with C9orf9.

FLJ12973 (Accession NM_024908.1) is another GAM138 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:10308, to the nucleotide sequence of GAM138 RNA, herein designated GAM RNA, also designated SEQ ID:222.

Another function of GAM138 is therefore inhibition of FLJ12973 (Accession NM_024908.1). Accordingly, utilities of GAM138 include diagnosis, prevention and treatment of diseases and clinical conditions associated with FLJ12973.

FLJ20136 (Accession NM_017684.1) is another GAM138 target gene, herein designated TARGET GENE. FLJ20136 BINDING SITE is a target binding site found in the 3' untranslated region of mRNA encoded by FLJ20136, corresponding to a target binding site such as BINDING SITE I, BINDING SITE II or BINDING SITE III of FIG. 8. Table 4 illustrates the complementarity of the nucleotide sequences of FLJ20136 BINDING SITE, designated SEQ ID:650, to the nucleotide sequence of GAM138 RNA, herein designated GAM RNA, also designated SEQ ID:222.

Another function of GAM138 is therefore inhibition of FLJ20136 (Accession NM_017684.1). Accordingly, utilities of GAM138 include diagnosis, prevention and treatment of diseases and clinical conditions associated with FLJ20136.

FLJ20147 (Accession NM_017687.1) is another GAM138 target gene, herein designated TARGET GENE. FLJ20147 BINDING SITE is a target binding site found in the 3' untranslated region of mRNA encoded by FLJ20147, corresponding to a target binding site such as BINDING SITE I, BINDING SITE II or BINDING SITE III of FIG. 8. Table 4 illustrates the complementarity of the nucleotide sequences of FLJ20147 BINDING SITE, designated SEQ ID:6891, to the nucleotide sequence of GAM138 RNA, herein designated GAM RNA, also designated SEQ ID:222.

Another function of GAM138 is therefore inhibition of FLJ20147 (Accession NM_017687.1). Accordingly, utilities of GAM138 include diagnosis, prevention and treatment of diseases and clinical conditions associated with FLJ20147.

FLJ20700 (Accession NM_017932.1) is another GAM138 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:8502, to the nucleotide sequence of GAM138 RNA, herein designated GAM RNA, also designated SEQ ID:222.

Another function of GAM138 is therefore inhibition of FLJ20700 (Accession NM_017932.1). Accordingly, utilities of GAM138 include diagnosis, prevention and treatment of diseases and clinical conditions associated with FLJ20700.

FLJ20729 (Accession NM_017953.2) is another GAM138 target gene, herein designated TARGET GENE. FLJ20729 BINDING SITE is a target binding site found in the 3' untranslated region of mRNA encoded by FLJ20729, corresponding to a target binding site such as BINDING SITE I, BINDING SITE II or BINDING SITE III of FIG. 8. Table 4 illustrates the complementarity of the nucleotide sequences of FLJ20729 BINDING SITE, designated SEQ ID:11088, to the nucleotide sequence of GAM138 RNA, herein designated GAM RNA, also designated SEQ ID:222.

Another function of GAM138 is therefore inhibition of FLJ20729 (Accession NM_017953.2). Accordingly, utilities of GAM138 include diagnosis, prevention and treatment of diseases and clinical conditions associated with FLJ20729.

FLJ32865 (Accession NM_144613.1) is another GAM138 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:13561, to the nucleotide sequence of GAM138 RNA, herein designated GAM RNA, also designated SEQ ID:222.

Another function of GAM138 is therefore inhibition of FLJ32865 (Accession NM_144613.1). Accordingly, utilities of GAM138 include diagnosis, prevention and treatment of diseases and clinical conditions associated with FLJ32865.

KIAA0475 (Accession XM_301133.1) is another GAM138 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:14834, to the nucleotide sequence of GAM138 RNA, herein designated GAM RNA, also designated SEQ ID:222.

Another function of GAM138 is therefore inhibition of KIAA0475 (Accession XM_301133.1). Accordingly, utilities of GAM138 include diagnosis, prevention and treatment of diseases and clinical conditions associated with KIAA0475.

KIAA1257 (Accession XM_031577.3) is another GAM138 target gene, herein designated TARGET GENE. KIAA1257 BINDING SITE is a target binding site found in the 3' untranslated region of mRNA encoded by KIAA1257, corresponding to a target binding site such as BINDING SITE I, BINDING SITE II or BINDING SITE III of FIG. 8. Table 4 illustrates the complementarity of the nucleotide sequences of KIAA1257 BINDING SITE, designated SEQ ID:18365, to the nucleotide sequence of GAM138 RNA, herein designated GAM RNA, also designated SEQ ID:222.

Another function of GAM138 is therefore inhibition of KIAA1257 (Accession XM_031577.3). Accordingly, utilities of GAM138 include diagnosis, prevention and treatment of diseases and clinical conditions associated with KIAA1257.

KIAA1443 (Accession NM_020834.1) is another GAM138 target gene, herein designated TARGET GENE. KIAA1443 BINDING SITE is a target binding site found in the 3' untranslated region of mRNA encoded by KIAA1443, corresponding to a target binding site such as BINDING SITE I, BINDING SITE II or BINDING SITE III of FIG. 8. Table 4 illustrates the complementarity of the nucleotide sequences of KIAA1443 BINDING SITE, designated SEQ ID:17528, to the nucleotide sequence of GAM138 RNA, herein designated GAM RNA, also designated SEQ ID:222.

Another function of GAM138 is therefore inhibition of KIAA1443 (Accession NM_020834.1). Accordingly, utilities of GAM138 include diagnosis, prevention and treatment of diseases and clinical conditions associated with KIAA1443.

KIAA1668 (Accession) is another GAM138 target gene, herein designated TARGET GENE. KIAA1668 BINDING SITE is a target binding site found in the 3' untranslated region of mRNA encoded by KIAA1668, corresponding to a target binding site such as BINDING SITE I, BINDING SITE II or BINDING SITE III of FIG. 8. Table 4 illustrates the complementarity of the nucleotide sequences of KIAA1668 BINDING SITE, designated SEQ ID:19546, to the nucleotide sequence of GAM138 RNA, herein designated GAM RNA, also designated SEQ ID:222.

Another function of GAM138 is therefore inhibition of KIAA1668 (Accession). Accordingly, utilities of GAM138 include diagnosis, prevention and treatment of diseases and clinical conditions associated with KIAA1668.

Kelch-like 3 (drosophila) (KLHL3, Accession NM_017415.1) is another GAM138 target gene, herein designated TARGET GENE. KLHL3 BINDING SITE is a target binding site found in the 5' untranslated region of mRNA encoded by KLHL3, corresponding to a target binding site such as BINDING SITE I, BINDING SITE II or BINDING SITE III of FIG. 8. Table 4 illustrates the complementarity of the nucleotide sequences of KLHL3 BINDING SITE, designated SEQ ID:18573, to the nucleotide sequence of GAM138 RNA, herein designated GAM RNA, also designated SEQ ID:222.

Another function of GAM138 is therefore inhibition of Kelch-like 3 (drosophila) (KLHL3, Accession NM_017415.1). Accordingly, utilities of GAM138 include diagnosis, prevention and treatment of diseases and clinical conditions associated with KLHL3.

LNK (Accession NM_005475.1) is another GAM138 target gene, herein designated TARGET GENE. LNK BINDING SITE is a target binding site found in the 3' untranslated region of mRNA encoded by LNK, corresponding to a target binding site such as BINDING SITE I, BINDING SITE II or BINDING SITE III of FIG. 8. Table 4 illustrates the complementarity of the nucleotide sequences of LNK BINDING SITE, designated SEQ ID:18117, to the nucleotide sequence of GAM138 RNA, herein designated GAM RNA, also designated SEQ ID:222.

Another function of GAM138 is therefore inhibition of LNK (Accession NM_005475.1), a gene which links T-cell receptor activation signal to phospholipase c-gamma-1, grb-2 and phosphatidylinositol 3-kinase (by similarity). Accordingly, utilities of GAM138 include diagnosis, prevention and treatment of diseases and clinical conditions associated with LNK.

The function of LNK and its association with various diseases and clinical conditions, has been established by previous studies, as described hereinabove with reference to GAM130.1. LOC135818 (Accession XM_059804.4) is another GAM138 target gene, herein designated TARGET GENE. LOC135818 BINDING SITE is a target binding site found in the 3' untranslated region of mRNA encoded by LOC135818, corresponding to a target binding site such as BINDING SITE I, BINDING SITE II or BINDING SITE III of FIG. 8. Table 4 illustrates the complementarity of the nucleotide sequences of LOC135818 BINDING SITE, designated SEQ ID:3223, to the nucleotide sequence of GAM138 RNA, herein designated GAM RNA, also designated SEQ ID:222.

Another function of GAM138 is therefore inhibition of LOC135818 (Accession XM_059804.4). Accordingly, utilities of GAM138 include diagnosis, prevention and treatment of diseases and clinical conditions associated with LOC135818.

LOC142927 (Accession) is another GAM138 target gene, herein designated TARGET GENE. LOC142927 BINDING SITE is a target binding site found in the 5' untranslated region of mRNA encoded by LOC142927, corresponding to a target binding site such as BINDING SITE I, BINDING SITE II or BINDING SITE III of FIG. 8. Table 4 illustrates the complementarity of the nucleotide sequences of LOC142927 BINDING SITE, designated SEQ ID:13504, to the nucleotide sequence of GAM138 RNA, herein designated GAM RNA, also designated SEQ ID:222.

Another function of GAM138 is therefore inhibition of LOC142927 (Accession). Accordingly, utilities of GAM138 include diagnosis, prevention and treatment of diseases and clinical conditions associated with LOC142927.

LOC146229 (Accession XM_085387.1) is another GAM138 target gene, herein designated TARGET GENE. LOC146229 BINDING SITE is a target binding site found in the 3' untranslated region of mRNA encoded by LOC146229, corresponding to a target binding site such as BINDING SITE I, BINDING SITE II or BINDING SITE III of FIG. 8. Table 4 illustrates the complementarity of the nucleotide sequences of LOC146229 BINDING SITE, designated SEQ ID:9210, to the nucleotide sequence of GAM138 RNA, herein designated GAM RNA, also designated SEQ ID:222.

Another function of GAM138 is therefore inhibition of LOC146229 (Accession XM_085387.1). Accordingly, utilities of GAM138 include diagnosis, prevention and treatment of diseases and clinical conditions associated with LOC146229.

LOC150147 (Accession) is another GAM138 target gene, herein designated TARGET GENE. LOC150147 BINDING SITE is a target binding site found in the 5' untranslated region of mRNA encoded by LOC150147, corresponding to a target binding site such as BINDING SITE I, BINDING SITE II or BINDING SITE III of FIG. 8. Table 4 illustrates the complementarity of the nucleotide sequences of LOC150147 BINDING SITE, designated SEQ ID:18674, to the nucleotide sequence of GAM138 RNA, herein designated GAM RNA, also designated SEQ ID:222.

Another function of GAM138 is therefore inhibition of LOC150147 (Accession). Accordingly, utilities of GAM138 include diagnosis, prevention and treatment of diseases and clinical conditions associated with LOC150147.

LOC152220 (Accession) is another GAM138 target gene, herein designated TARGET GENE. LOC152220 BINDING SITE is a target binding site found in the 3' untranslated region of mRNA encoded by LOC152220, corresponding to a target binding site such as BINDING SITE I, BINDING SITE II or BINDING SITE III of FIG. 8. Table 4 illustrates the complementarity of the nucleotide sequences of LOC152220 BINDING SITE, designated SEQ ID:12911, to the nucleotide sequence of GAM138 RNA, herein designated GAM RNA, also designated SEQ ID:222.

Another function of GAM138 is therefore inhibition of LOC152220 (Accession). Accordingly, utilities of GAM138 include diagnosis, prevention and treatment of diseases and clinical conditions associated with LOC152220.

LOC154877 (Accession XM_098626.4) is another GAM138 target gene, herein designated TARGET GENE. LOC154877 BINDING SITE is a target binding site found in the 3' untranslated region of mRNA encoded by LOC154877, corresponding to a target binding site such as BINDING SITE I, BINDING SITE II or BINDING SITE III of FIG. 8. Table 4 illustrates the complementarity of the nucleotide sequences of LOC154877 BINDING SITE, designated SEQ ID:8021, to the nucleotide sequence of GAM138 RNA, herein designated GAM RNA, also designated SEQ ID:222.

Another function of GAM138 is therefore inhibition of LOC154877 (Accession XM_098626.4). Accordingly, utilities of GAM138 include diagnosis, prevention and treatment of diseases and clinical conditions associated with LOC154877.

LOC196529 (Accession) is another GAM138 target gene, herein designated TARGET GENE. LOC196529 BINDING SITE is a target binding site found in the 3' untranslated region of mRNA encoded by LOC196529, corresponding to a target binding site such as BINDING SITE I, BINDING SITE II or BINDING SITE III of FIG. 8. Table 4 illustrates the complementarity of the nucleotide sequences of LOC196529 BINDING SITE, designated SEQ ID:5335, to the nucleotide sequence of GAM138 RNA, herein designated GAM RNA, also designated SEQ ID:222.

Another function of GAM138 is therefore inhibition of LOC196529 (Accession). Accordingly, utilities of GAM138 include diagnosis, prevention and treatment of diseases and clinical conditions associated with LOC196529.

LOC204804 (Accession) is another GAM138 target gene, herein designated TARGET GENE. LOC204804 BINDING SITE is a target binding site found in the 3' untranslated region of mRNA encoded by LOC204804, corresponding to a target binding site such as BINDING SITE I, BINDING SITE II or BINDING SITE III of FIG. 8. Table 4 illustrates the complementarity of the nucleotide sequences of LOC204804 BINDING SITE, designated SEQ ID:2980, to the nucleotide sequence of GAM138 RNA, herein designated GAM RNA, also designated SEQ ID:222.

Another function of GAM138 is therefore inhibition of LOC204804 (Accession). Accordingly, utilities of GAM138 include diagnosis, prevention and treatment of diseases and clinical conditions associated with LOC204804.

LOC89932 (Accession) is another GAM138 target gene, herein designated TARGET GENE. LOC89932 BINDING SITE is a target binding site found in the 3' untranslated region of mRNA encoded by LOC89932, corresponding to a target binding site such as BINDING SITE I, BINDING SITE II or BINDING SITE III of FIG. 8. Table 4 illustrates the complementarity of the nucleotide sequences of LOC89932 BINDING SITE, designated SEQ ID:19547, to the nucleotide sequence of GAM138 RNA, herein designated GAM RNA, also designated SEQ ID:222.

Another function of GAM138 is therefore inhibition of LOC89932 (Accession). Accordingly, utilities of GAM138 include diagnosis, prevention and treatment of diseases and clinical conditions associated with LOC89932.

LOC91250 (Accession XM_037135.1) is another GAM138 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:14884, to the nucleotide sequence of GAM138 RNA, herein designated GAM RNA, also designated SEQ ID:222.

Another function of GAM138 is therefore inhibition of LOC91250 (Accession XM_037135.1). Accordingly, utilities of GAM138 include diagnosis, prevention and treatment of diseases and clinical conditions associated with LOC91250.

LOC91549 (Accession XM_039115.8) is another GAM138 target gene, herein designated TARGET GENE. LOC91549 BINDING SITE is a target binding site found in the 5' untranslated region of mRNA encoded by LOC91549, corresponding to a target binding site such as BINDING SITE I, BINDING SITE II or BINDING SITE III of FIG. 8. Table 4 illustrates the complementarity of the nucleotide sequences of LOC91549 BINDING SITE, designated SEQ ID:3224, to the nucleotide sequence of GAM138 RNA, herein designated GAM RNA, also designated SEQ ID:222.

Another function of GAM138 is therefore inhibition of LOC91549 (Accession XM_039115.8). Accordingly, utilities of GAM138 include diagnosis, prevention and treatment of diseases and clinical conditions associated with LOC91549.

LOC93349 (Accession NM_138402.2) is another GAM138 target gene, herein designated TARGET GENE. LOC93349 BINDING SITE is a target binding site found in the 3' untranslated region of mRNA encoded by LOC93349, corresponding to a target binding site such as BINDING SITE I, BINDING SITE II or BINDING SITE III of FIG. 8. Table 4 illustrates the complementarity of the nucleotide sequences of LOC93349 BINDING SITE, designated SEQ ID:10297, to the nucleotide sequence of GAM138 RNA, herein designated GAM RNA, also designated SEQ ID:222.

Another function of GAM138 is therefore inhibition of LOC93349 (Accession NM_138402.2). Accordingly, utilities of GAM138 include diagnosis, prevention and treatment of diseases and clinical conditions associated with LOC93349.

MGC13204 (Accession NM_031465.1) is another GAM138 target gene, herein designated TARGET GENE. MGC13204 BINDING SITE is a target binding site found in the 3' untranslated region of mRNA encoded by MGC13204, corresponding to a target binding site such as BINDING SITE I, BINDING SITE II or BINDING SITE III of FIG. 8. Table 4 illustrates the complementarity of the nucleotide sequences of MGC13204 BINDING SITE, designated SEQ ID:4720, to the nucleotide sequence of GAM138 RNA, herein designated GAM RNA, also designated SEQ ID:222.

Another function of GAM138 is therefore inhibition of MGC13204 (Accession NM_031465.1). Accordingly, utilities of GAM138 include diagnosis, prevention and treatment of diseases and clinical conditions associated with MGC13204.

MGC2477 (Accession NM_024099.1) is another GAM138 target gene, herein designated TARGET GENE. MGC2477 BINDING SITE1 and MGC2477 BINDING SITE2 are target binding sites found in untranslated regions of mRNA encoded by MGC2477, corresponding to target binding sites such as BINDING SITE I, BINDING SITE II or BINDING SITE III of FIG. 8. Table 4 illustrates the complementarity of the nucleotide sequences of MGC2477 BINDING SITE1 and MGC2477 BINDING SITE2, designated SEQ ID:12814 and SEQ ID:13562 respectively, to the nucleotide sequence of GAM138 RNA, herein designated GAM RNA, also designated SEQ ID:222.

Another function of GAM138 is therefore inhibition of MGC2477 (Accession NM_024099.1). Accordingly, utilities of GAM138 include diagnosis, prevention and treatment of diseases and clinical conditions associated with MGC2477.

Makorin, ring finger protein, 4 (MKRN4, Accession NM_030757.1) is another GAM138 target gene, herein designated TARGET GENE. MKRN4 BINDING SITE is a target binding site found in the 3' untranslated region of mRNA encoded by MKRN4, corresponding to a target binding site such as BINDING SITE I, BINDING SITE II or BINDING SITE III of FIG. 8. Table 4 illustrates the complementarity of the nucleotide sequences of MKRN4 BINDING SITE, designated SEQ ID:6362, to the nucleotide sequence of GAM138 RNA, herein designated GAM RNA, also designated SEQ ID:222.

Another function of GAM138 is therefore inhibition of Makorin, ring finger protein, 4 (MKRN4, Accession NM_030757.1). Accordingly, utilities of GAM138 include diagnosis, prevention and treatment of diseases and clinical conditions associated with MKRN4.

Mitochondrial ribosomal protein l49 (MRPL49, Accession NM_004927.2) is another GAM138 target gene, herein designated TARGET GENE. MRPL49 BINDING SITE is a target binding site found in the 3' untranslated region of mRNA encoded by MRPL49, corresponding to a target binding site such as BINDING SITE I, BINDING SITE II or BINDING SITE III of FIG. 8. Table 4 illustrates the complementarity of the nucleotide sequences of MRPL49 BINDING SITE, designated SEQ ID:12809, to the nucleotide sequence of GAM138 RNA, herein designated GAM RNA, also designated SEQ ID:222.

Another function of GAM138 is therefore inhibition of Mitochondrial ribosomal protein l49 (MRPL49, Accession NM_004927.2). Accordingly, utilities of GAM138 include diagnosis, prevention and treatment of diseases and clinical conditions associated with MRPL49.

Phosphoinositide-3-kinase, catalytic, delta polypeptide (PIK3CD, Accession NM_005026.2) is another GAM138 target gene, herein designated TARGET GENE. PIK3CD BINDING SITE is a target binding site found in the 3' untranslated region of mRNA encoded by PIK3CD, corresponding to a target binding site such as BINDING SITE I, BINDING SITE II or BINDING SITE III of FIG. 8. Table 4 illustrates the complementarity of the nucleotide sequences of PIK3CD BINDING SITE, designated SEQ ID:5480, to the nucleotide sequence of GAM138 RNA, herein designated GAM RNA, also designated SEQ ID:222.

Another function of GAM138 is therefore inhibition of Phosphoinositide-3-kinase, catalytic, delta polypeptide (PIK3CD, Accession NM_005026.2), a gene which regulating cell growth. Accordingly, utilities of GAM138 include diagnosis, prevention and treatment of diseases and clinical conditions associated with PIK3CD.

The function of PIK3CD and its association with various diseases and clinical conditions, has been established by previous studies, as described hereinabove with reference to GAM136.1. Protein kinase, lysine deficient 3 (PRKWNK3, Accession NM_020922.1) is another GAM138 target gene, herein designated TARGET GENE. PRKWNK3 BINDING SITE is a target binding site found in the 3' untranslated region of mRNA encoded by PRKWNK3, corresponding to a target binding site such as BINDING SITE I, BINDING SITE II or BINDING SITE III of FIG. 8. Table 4 illustrates the complementarity of the nucleotide sequences of PRKWNK3 BINDING SITE, designated SEQ ID:3228, to the nucleotide sequence of GAM138 RNA, herein designated GAM RNA, also designated SEQ ID:222.

Another function of GAM138 is therefore inhibition of Protein kinase, lysine deficient 3 (PRKWNK3, Accession NM_020922.1). Accordingly, utilities of GAM138 include diagnosis, prevention and treatment of diseases and clinical conditions associated with PRKWNK3.

RPP30 (Accession NM_006413.2) is another GAM138 target gene, herein designated TARGET GENE. RPP30 BINDING SITE is a target binding site found in the 3' untranslated region of mRNA encoded by RPP30, corresponding to a target binding site such as BINDING SITE I, BINDING SITE II or BINDING SITE III of FIG. 8. Table 4 illustrates the complementarity of the nucleotide sequences of RPP30 BINDING SITE, designated SEQ ID:1813, to the nucleotide sequence of GAM138 RNA, herein designated GAM RNA, also designated SEQ ID:222.

Another function of GAM138 is therefore inhibition of RPP30 (Accession NM_006413.2), a gene which is a component of ribonuclease p that processes 5' ends of precursor tRNAs. Accordingly, utilities of GAM138 include diagnosis, prevention and treatment of diseases and clinical conditions associated with RPP30.

The function of RPP30 and its association with various diseases and clinical conditions, has been established by previous studies, as described hereinabove with reference to GAM136.1. Solute carrier family 24 (sodium/potassium/calcium exchanger), member 1 (SLC24A1, Accession NM_004727.1) is another GAM138 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:14930, to the nucleotide sequence of GAM138 RNA, herein designated GAM RNA, also designated SEQ ID:222.

Another function of GAM138 is therefore inhibition of Solute carrier family 24 (sodium/potassium/calcium exchanger), member 1 (SLC24A1, Accession NM_004727.1), a gene which is a critical component of the visual transduction cascade, controlling the calcium concentration of outer segments during light and darkness. Accordingly, utilities of GAM138 include diagnosis, prevention and treatment of diseases and clinical conditions associated with SLC24A1.

The function of SLC24A1 and its association with various diseases and clinical conditions, has been established by previous studies, as described hereinabove with reference to GAM130.1. Thromboxane a2 receptor (TBXA2R, Accession NM_001060.2) is another GAM138 target gene, herein designated TARGET GENE. TBXA2R BINDING SITE is a target binding site found in the 3' untranslated region of mRNA encoded by TBXA2R, corresponding to a target binding site such as BINDING SITE I, BINDING SITE II or BINDING SITE III of FIG. 8. Table 4 illustrates the complementarity of the nucleotide sequences of TBXA2R BINDING SITE, designated SEQ ID:15791, to the nucleotide sequence of GAM138 RNA, herein designated GAM RNA, also designated SEQ ID:222.

Another function of GAM138 is therefore inhibition of Thromboxane a2 receptor (TBXA2R, Accession NM_001060.2), a gene which activates Ca2+-activated chloride channels; stimulates platelet aggregation and smooth muscle constriction and therefore may be associated with Bleeding disorder. Accordingly, utilities of GAM138 include diagnosis, prevention and treatment of Bleeding disorder, and of other diseases and clinical conditions associated with TBXA2R.

The function of TBXA2R and its association with various diseases and clinical conditions, has been established by previous studies, as described hereinabove with reference to GAM30.1. Tuftelin 1 (TUFT1, Accession NM_020127.1) is another GAM138 target gene, herein designated TARGET GENE. TUFT1 BINDING SITE is a target binding site found in the 3' untranslated region of mRNA encoded by TUFT1, corresponding to a target binding site such as BINDING SITE I, BINDING SITE II or BINDING SITE III of FIG. 8. Table 4 illustrates the complementarity of the nucleotide sequences of TUFT1 BINDING SITE, designated SEQ ID:18146, to the nucleotide sequence of GAM138 RNA, herein designated GAM RNA, also designated SEQ ID:222.

Another function of GAM138 is therefore inhibition of Tuftelin 1 (TUFT1, Accession NM_020127.1), a gene which appears to play a role in cytokinesis, cell shape, and specialized functions such as secretion and capping. Accordingly, utilities of GAM138 include diagnosis, prevention and treatment of diseases and clinical conditions associated with TUFT1.

The function of TUFT1 and its association with various diseases and clinical conditions, has been established by previous studies, as described hereinabove with reference to GAM136.1. Wolf-hirschhorn syndrome candidate 1 (WHSC1, Accession NM_133332.1) is another GAM138 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:13027, to the nucleotide sequence of GAM138 RNA, herein designated GAM RNA, also designated SEQ ID:222.

Another function of GAM138 is therefore inhibition of Wolf-hirschhorn syndrome candidate 1 (WHSC1, Accession NM_133332.1), a gene which binds covalently to and repairs g/t mismatches. and therefore may be associated with Wolf-hirschhorn syndrome. Accordingly, utilities of GAM138 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1.

FIG. 8 further provides a conceptual description of a novel bioinformatically detected of the present invention, referred to here as Genomic Address Messenger 139 (GAM139), which modulates expression of respective target genes thereof, the function and utility of which target genes is known in the art.

GAM139 is a novel bioinformatically detected regulatory, non protein coding, micro RNA (miRNA) gene. The method by which GAM139 was detected is described hereinabove with reference to FIGS. 8-15.

GAM139 gene, herein designated GAM GENE, and GAM139 target gene, herein designated TARGET GENE, are human genes contained in the human genome.

GAM139 gene encodes a GAM139 precursor RNA, herein designated GAM PRECURSOR RNA. Similar to other miRNA genes, and unlike most ordinary genes, GAM139 precursor RNA does not encode a protein. A nucleotide sequence identical or highly similar to the nucleotide sequence of GAM139 precursor RNA is designated SEQ ID:31, and is provided hereinbelow with reference to the sequence listing part. Nucleotide sequence SEQ ID:31 is located at position 93064885 relative to chromosome 11.

GAM139 precursor RNA folds onto itself, forming GAM139 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM139 precursor RNA folds onto itself, forming GAM139 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM139 precursor RNA, designated SEQ-ID:31, and a schematic representation of a predicted secondary folding of GAM139 folded precursor RNA are further described with reference to Table 2, hereby incorporated by reference.

An enzyme complex designated DICER COMPLEX, 'dices' the GAM139 folded precursor RNA into GAM139 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM139 RNA is designated SEQ ID:327, and is provided hereinbelow with references to the sequence listing part and Table 3, hereby incorporated by reference.

GAM139 target gene, herein designated TARGET GENE, encodes a corresponding messenger RNA, GAM139 target RNA, herein designated GAM TARGET RNA. GAM139 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM139 RNA, herein designated GAM RNA, binds complementarily to one or more target binding sites located in untranslated regions of GAM139 target RNA, herein designated GAM TARGET RNA. This complementary binding is due to the fact that the nucleotide sequence of GAM139 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM139 RNA may have a different number of target binding sites in untranslated regions of a GAM139 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM139 RNA, herein designated GAM RNA, to target binding sites on GAM139 target RNA, herein designated GAM TARGET RNA, such as BINDING SITE I, BINDING SITE II and BINDING SITE III, inhibits translation of GAM139 target RNA into GAM139 target protein, herein designated GAM TARGET PROTEIN. GAM target protein is therefore outlined by a broken line.

It is appreciated that GAM139 target gene, herein designated TARGET GENE, in fact represents a plurality of GAM139 target genes. The mRNA of each one of this plurality of GAM139 target genes comprises one or more target binding sites, each having a nucleotide sequence which is at least partly complementary to GAM139 RNA, herein designated GAM RNA, and which when bound by GAM139 RNA causes inhibition of translation of respective one or more GAM139 target proteins.

It is further appreciated by one skilled in the art that the mode of translational inhibition illustrated by FIG. 8 with specific reference to translational inhibition exerted by GAM139 gene, herein designated GAM GENE, on one or more GAM139 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM139 correlate with, and may be deduced from, the identity of the target genes which GAM139 binds and inhibits, and the function of these target genes, as elaborated hereinbelow.

Abhydrolase domain containing 1 (ABHD1, Accession NP_690609.1) is a GAM139 target gene, herein designated TARGET GENE. ABHD1 BINDING SITE is a target binding site found in the 3' untranslated region of multiple transcripts of mRNA encoded by ABHD1, corresponding to a target binding site such as BINDING SITE I, BINDING SITE II or BINDING SITE III of FIG. 8. Table 4 illustrates the complementarity of the nucleotide sequences of ABHD1 BINDING SITE, designated SEQ ID:18435, to the nucleotide sequence of GAM139 RNA, herein designated GAM RNA, also designated SEQ ID:327.

A function of GAM139 is therefore inhibition of Abhydrolase domain containing 1 (ABHD1, Accession NP_690609.1). Accordingly, utilities of GAM139 include diagnosis, prevention and treatment of diseases and clinical conditions associated with ABHD1.

Adenosine a2a receptor (ADORA2A, Accession NP_000666.2) is another GAM139 target gene, herein designated TARGET GENE. ADORA2A BINDING SITE is a target binding site found in the 3' untranslated region of mRNA encoded by ADORA2A, corresponding to a target binding site such as BINDING SITE I, BINDING SITE II or BINDING SITE III of FIG. 8. Table 4 illustrates the complementarity of the nucleotide sequences of ADORA2A BINDING SITE, designated SEQ ID:13460, to the nucleotide sequence of GAM139 RNA, herein designated GAM RNA, also designated SEQ ID:327.

Another function of GAM139 is therefore inhibition of Adenosine a2a receptor (ADORA2A, Accession NP_000666.2), a gene which regulates phagocytosis, apoptosis and platelet aggregation. Accordingly, utilities of GAM139 include diagnosis, prevention and treatment of diseases and clinical conditions associated with ADORA2A.

The function of ADORA2A has been established by previous studies. Adenosine is released from metabolically active cells by facilitated diffusion and is generated extracellularly by degradation of released ATP. Ledent et al. (1997) noted that it is a potent biologic mediator that modulates the activity of numerous cell types, including various neuronal populations, platelets, neutrophils and mast cells, and smooth muscle cells in bronchi and vasculature. Most of these effects help to protect cells and tissues during stress situations such as ischemia. Adenosine mediates its effects through 4 receptor subtypes: the A1 (ADORA1; 102775), A2a (also called RDC8), A2b (ADORA2B; 600446), and A3 (ADORA3; 600445) receptors. The A2a receptor is abundant in basal ganglia, vasculature and platelets, and stimulates adenylyl cyclase. It is a major target of caffeine. . Libert et al. (1991) and Szepetowski et al. (1993) were clearly mapping the same locus since they used the same RDC8 probe. Although the probe used by MacCollin et al. (1994) was reportedly very similar in sequence, it must in fact have come from a different locus (Gusella, 1994; Gaudray, 1994).

Animal model experiments lend further support to the function of ADORA2A. By homologous recombination, Ledent et al. (1997) disrupted the Adora2a gene in embryonic stem cells of mice and bred homozygous Adora2a-deficient mice.

It is appreciated that the abovementioned animal model for ADORA2A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ledent, C.; Vaugeois, J.-M.; Schiffmann, S. N.; Pedrazzini, T.; El Yacoubi, M. E.; Vanderhaeghen, J.-J.; Costentin, J.; Heath, J. K.; Vassart, G.; Parmentier, M.: Aggressiveness, hypoalgesia and high blood pressure in mice lacking the adenosine A2a receptor. Nature 388:674-678, 1997; and MacCollin, M.; Peterfreund, R.; MacDonald, M.; Fink, J. S.; Gusella, J.: Mapping of a human A2a adenosine receptor (ADORA2) to chromosome 22. Genomics 20:332-333, 1994.

Further studies establishing the function and utilities of ADORA2A are found in John Hopkins OMIM database record ID 102776, and in cited publications listed in Table 5, which are hereby incorporated by reference. Aldehyde dehydrogenase 5 family, member a1 (succinate-semialdehyde dehydrogenase) (ALDH5A1, Accession NP_001071.1) is another GAM139 target gene, herein designated TARGET GENE. ALDH5A1 BINDING SITE1 and ALDH5A1 BINDING SITE2 are target binding sites found in untranslated regions of multiple transcripts of mRNA encoded by ALDH5A1, corresponding to target binding sites such as BINDING SITE I, BINDING SITE II or BINDING SITE III of FIG. 8. Table 4 illustrates the complementarity of the nucleotide sequences of ALDH5A1 BINDING SITE1 and ALDH5A1 BINDING SITE2, designated SEQ ID:8267 and SEQ ID:5625 respectively, to the nucleotide sequence of GAM139 RNA, herein designated GAM RNA, also designated SEQ ID:327.

Another function of GAM139 is therefore inhibition of Aldehyde dehydrogenase 5 family, member a1 (succinate-semialdehyde dehydrogenase) (ALDH5A1, Accession NP_001071.1). Accordingly, utilities of GAM139 include diagnosis, prevention and treatment of diseases and clinical conditions associated with ALDH5A1.

Aldehyde dehydrogenase 5 family, member a1 (succinate-semialdehyde dehydrogenase) (ALDH5A1, Accession NP_001071.1) is another GAM139 target gene, herein designated TARGET GENE. ALDH5A1 BINDING SITE1 and ALDH5A1 BINDING SITE2 are target binding sites found in untranslated regions of multiple transcripts of mRNA encoded by ALDH5A1, corresponding to target binding sites such as BINDING SITE I, BINDING SITE II or BINDING SITE III of FIG. 8. Table 4 illustrates the complementarity of the nucleotide sequences of ALDH5A1 BINDING SITE1 and ALDH5A1 BINDING SITE2, designated SEQ ID:5625 and SEQ ID:8267 respectively, to the nucleotide sequence of GAM139 RNA, herein designated GAM RNA, also designated SEQ ID:327.

Another function of GAM139 is therefore inhibition of Aldehyde dehydrogenase 5 family, member a1 (succinate-semialdehyde dehydrogenase) (ALDH5A1, Accession NP_001071.1). Accordingly, utilities of GAM139 include diagnosis, prevention and treatment of diseases and clinical conditions associated with ALDH5A1.

Annexin a9 (ANXA9, Accession NP_003559.1) is another GAM139 target gene, herein designated TARGET GENE. ANXA9 BINDING SITE is a target binding site found in the 5' untranslated region of mRNA encoded by ANXA9, corresponding to a target binding site such as BINDING SITE I, BINDING SITE II or BINDING SITE III of FIG. 8. Table 4 illustrates the complementarity of the nucleotide sequences of ANXA9 BINDING SITE, designated SEQ ID:17446, to the nucleotide sequence of GAM139 RNA, herein designated GAM RNA, also designated SEQ ID:327.

Another function of GAM139 is therefore inhibition of Annexin a9 (ANXA9, Accession NP_003559.1), a gene which aggregates and cooperatively binds anionic phospholipids and extracellular matrix proteins. Accordingly, utilities of GAM139 include diagnosis, prevention and treatment of diseases and clinical conditions associated with ANXA9.

The function of ANXA9 has been established by previous studies. See 602572. Members of the annexin family contain 4 internal repeat domains, each of which includes a type II calcium-binding site. The calcium-binding sites are required for annexins to aggregate and cooperatively bind anionic phospholipids and extracellular matrix proteins. The tetrad core appears to form a calcium ion channel. By searching an EST database for novel annexins, Morgan and Fernandez (1998) identified cDNAs encoding annexin A9, which they called annexin 31. Sequence analysis revealed that the predicted 338-amino acid protein shares less than 40% sequence identity with other annexins. All 4 type II calcium-binding sites in annexin 31 contained amino acid substitutions that ablated their function. However, structural analysis suggested that the conserved putative ion channel was intact. Morgan and Fernandez (1998) proposed that annexin 31 represents a new subfamily of annexins in which the putative internal ion channel is dissociated from the external type II calcium-binding sites. By fluorescence in situ hybridization, Morgan et al. (1999) mapped the ANXA9 gene to chromosome 1q21.

Full details of the abovementioned studies are described in the following publications, the disclosure of which are hereby incorporated by reference:

Morgan, R. O.; Bell, D. W.; Testa, J. R.; Fernandez, M.-P.: Human annexin 31 genetic mapping and origin. Gene 227: 33-38, 1999; and Morgan, R. O.; Fernandez, M.-P.: Expression profile and structural divergence of novel human annexin 31. FEBS Lett. 434:300-304, 1998.

Further studies establishing the function and utilities of ANXA9 are found in John Hopkins OMIM database record ID 603319, and in cited publications listed in Table 5, which are hereby incorporated by reference. Adaptor-related protein complex 3, mu 1 subunit (AP3M1, Accession NP_036227.1) is another GAM139 target gene, herein designated TARGET GENE. AP3M1 BINDING SITE is a target binding site found in the 3' untranslated region of mRNA encoded by AP3M1, corresponding to a target binding site such as BINDING SITE I, BINDING SITE II or BINDING SITE III of FIG. 8. Table 4 illustrates the complementarity of the nucleotide sequences of AP3M1 BINDING SITE, designated SEQ ID:2765, to the nucleotide sequence of GAM139 RNA, herein designated GAM RNA, also designated SEQ ID:327.

Another function of GAM139 is therefore inhibition of Adaptor-related protein complex 3, mu 1 subunit (AP3M1, Accession NP_036227.1). Accordingly, utilities of GAM139 include diagnosis, prevention and treatment of diseases and clinical conditions associated with AP3M1.

Adp-ribosylation factor gtpase activating protein 3 (ARFGAP3, Accession NP_055385.2) is another GAM139 target gene, herein designated TARGET GENE. ARFGAP3 BINDING SITE is a target binding site found in the 5' untranslated region of mRNA encoded by ARFGAP3, corresponding to a target binding site such as BINDING SITE I, BINDING SITE II or BINDING SITE III of FIG. 8. Table 4 illustrates the complementarity of the nucleotide sequences of ARFGAP3 BINDING SITE, designated SEQ ID:917, to the nucleotide sequence of GAM139 RNA, herein designated GAM RNA, also designated SEQ ID:327.

Another function of GAM139 is therefore inhibition of Adp-ribosylation factor gtpase activating protein 3 (ARFGAP3, Accession NP_055385.2). Accordingly, utilities of GAM139 include diagnosis, prevention and treatment of diseases and clinical conditions associated with ARFGAP3.

Rho gtpase activating protein 1 (ARHGAP1, Accession NP_004299.1) is another GAM139 target gene, herein designated TARGET GENE. ARHGAP1 BINDING SITE is a target binding site found in the 3' untranslated region of mRNA encoded by ARHGAP1, corresponding to a target binding site such as BINDING SITE I, BINDING SITE II or BINDING SITE III of FIG. 8. Table 4 illustrates the complementarity of the nucleotide sequences of ARHGAP1 BINDING SITE, designated SEQ ID:18225, to the nucleotide sequence of GAM139 RNA, herein designated GAM RNA, also designated SEQ ID:327.

Another function of GAM139 is therefore inhibition of Rho gtpase activating protein 1 (ARHGAP1, Accession NP_004299.1). Accordingly, utilities of GAM139 include diagnosis, prevention and treatment of diseases and clinical conditions associated with ARHGAP1.

Rho gdp dissociation inhibitor (gdi) alpha (ARHGDIA, Accession NP_004300.1) is another GAM139 target gene, herein designated TARGET GENE. ARHGDIA BINDING SITE1 and ARHGDIA BINDING SITE2 are target binding sites found in untranslated regions of mRNA encoded by ARHGDIA, corresponding to target binding sites such as BINDING SITE I, BINDING SITE II or BINDING SITE III of FIG. 8. Table 4 illustrates the complementarity of the nucleotide sequences of ARHGDIA BINDING SITE1 and ARHGDIA BINDING SITE2, designated SEQ ID:15005 and SEQ ID:15152 respectively, to the nucleotide sequence of GAM139 RNA, herein designated GAM RNA, also designated SEQ ID:327.

Another function of GAM139 is therefore inhibition of Rho gdp dissociation inhibitor (gdi) alpha (ARHGDIA, Accession NP_004300.1), a gene which is a small guanine nucleotide exchange (GTP/GDP) factor. Accordingly, utilities of GAM139 include diagnosis, prevention and treatment of diseases and clinical conditions associated with ARHGDIA.

The function of ARHGDIA has been established by previous studies. Ras-related homologs (ARHs), also called Rho genes, belong to the RAS gene superfamily encoding small guanine nucleotide exchange (GTP/GDP) factors. The ARH proteins may be kept in the inactive, GDP-bound state by interaction with GDP dissociation inhibitors (GDIAs). By screening a transformed amnion cell library with an ARHGDIB (OMIM Ref. No. 602843) cDNA, Leffers et al. (1993) isolated cDNAs encoding ARHGDIA. They found that ARHGDIA corresponded to a protein in the keratinocyte 2-dimensional-gel protein database known as IEF (isoelectric focusing) 8118. By 2-dimensional gel electrophoresis, the predicted 204-amino acid protein had a pI of 4.74 and migrated at 29 kD. The amino acid sequences of human and bovine ARHGDIA are 97% identical. Leffers et al. (1993) found that the ARHGDIA gene contains 6 exons. Northern blot analysis revealed that ARHGDIA was expressed in all cell lines and tissues tested. Overexpression of ARHGDIB in mammalian cells caused them to 'round up' and disrupted the actin cytoskeleton, mimicking the phenotypic changes associated with inactivation of Rho proteins. Wagner et al. (1997) demonstrated by fluorescence in situ hybridization that the GDIA1 gene maps to 17q25.3. The assignment was confirmed by the use of a new somatic cell hybrid panel for 17q.

Full details of the abovementioned studies are described in the following publications, the disclosure of which are hereby incorporated by reference:

Leffers, H.; Nielsen, M. S.; Andersen, A. H.; Honore, B.; Madsen, P.; Vandekerckhove, J.; Celis, J. E.: Identification of two human rho GDP dissociation inhibitor proteins whose overexpression leads to disruption of the actin cytoskeleton. Exp. Cell Res. 209:165-174, 1993; and Wagner, T.; Tommerup, N.; Wirth, J.; Leffers, H.; Zimmer, J.; Back, E.; Weissenbach, J.; Scherer, G.: A somatic cell hybrid panel for distal 17q: GDIA1 maps to 17q25.3. Cytogenet. Cell.

Further studies establishing the function and utilities of ARHGDIA are found in John Hopkins OMIM database record ID 601925, and in cited publications listed in Table 5, which are hereby incorporated by reference. Rho gdp dissociation inhibitor (gdi) gamma (ARHGDIG, Accession NP_001167.1) is another GAM139 target gene, herein designated TARGET GENE. ARHGDIG BINDING SITE1 and ARHGDIG BINDING SITE2 are target binding sites found in untranslated regions of mRNA encoded by ARHGDIG, corresponding to target binding sites such as BINDING SITE I, BINDING SITE II or BINDING SITE III of FIG. 8. Table 4 illustrates the complementarity of the nucleotide sequences of ARHGDIG BINDING SITE1 and ARHGDIG BINDING SITE2, designated SEQ ID:6996 and SEQ ID:10749 respectively, to the nucleotide sequence of GAM139 RNA, herein designated GAM RNA, also designated SEQ ID:327.

Another function of GAM139 is therefore inhibition of Rho gdp dissociation inhibitor (gdi) gamma (ARHGDIG, Accession NP_001167.1). Accordingly, utilities of GAM139 include diagnosis, prevention and treatment of diseases and clinical conditions associated with ARHGDIG.

Rho guanine nucleotide exchange factor (gef) 4 (ARHGEF4, Accession NP_127462.1) is another GAM139 target gene, herein designated TARGET GENE. ARHGEF4

BINDING SITE1 and ARHGEF4 BINDING SITE2 are target binding sites found in untranslated regions of multiple transcripts of mRNA encoded by ARHGEF4, corresponding to target binding sites such as BINDING SITE I, BINDING SITE II or BINDING SITE III of FIG. 8. Table 4 illustrates the complementarity of the nucleotide sequences of ARHGEF4 BINDING SITE1 and ARHGEF4 BINDING SITE2, designated SEQ ID:7064 and SEQ ID:2155 respectively, to the nucleotide sequence of GAM139 RNA, herein designated GAM RNA, also designated SEQ ID:327.

Another function of GAM139 is therefore inhibition of Rho guanine nucleotide exchange factor (gef) 4 (ARHGEF4, Accession NP_127462.1). Accordingly, utilities of GAM139 include diagnosis, prevention and treatment of diseases and clinical conditions associated with ARHGEF4.

Rho guanine nucleotide exchange factor (gef) 4 (ARHGEF4, Accession NP_056135.2) is another GAM139 target gene, herein designated TARGET GENE. ARHGEF4 BINDING SITE1 and ARHGEF4 BINDING SITE2 are target binding sites found in untranslated regions of multiple transcripts of mRNA encoded by ARHGEF4, corresponding to target binding sites such as BINDING SITE I, BINDING SITE II or BINDING SITE III of FIG. 8. Table 4 illustrates the complementarity of the nucleotide sequences of ARHGEF4 BINDING SITE1 and ARHGEF4 BINDING SITE2, designated SEQ ID:7064 and SEQ ID:2155 respectively, to the nucleotide sequence of GAM139 RNA, herein designated GAM RNA, also designated SEQ ID:327.

Another function of GAM139 is therefore inhibition of Rho guanine nucleotide exchange factor (gef) 4 (ARHGEF4, Accession NP_056135.2). Accordingly, utilities of GAM139 include diagnosis, prevention and treatment of diseases and clinical conditions associated with ARHGEF4.

Rho guanine nucleotide exchange factor (gef) 7 (ARHGEF7, Accession NP_663788.1) is another GAM139 target gene, herein designated TARGET GENE. ARHGEF7 BINDING SITE is a target binding site found in the 3' untranslated region of multiple transcripts of mRNA encoded by ARHGEF7, corresponding to a target binding site such as BINDING SITE I, BINDING SITE II or BINDING SITE III of FIG. 8. Table 4 illustrates the complementarity of the nucleotide sequences of ARHGEF7 BINDING SITE, designated SEQ ID:8435, to the nucleotide sequence of GAM139 RNA, herein designated GAM RNA, also designated SEQ ID:327.

Another function of GAM139 is therefore inhibition of Rho guanine nucleotide exchange factor (gef) 7 (ARHGEF7, Accession NP_663788.1), a gene which acts as a rac1 guanine nucleotide exchange factor (gef) and can induce membrane ruffling. Accordingly, utilities of GAM139 include diagnosis, prevention and treatment of diseases and clinical conditions associated with ARHGEF7.

The function of ARHGEF7 and its association with various diseases and clinical conditions, has been established by previous studies, as described hereinabove with reference to GAM40.2. ARLTS1 (Accession NP_612459.1) is another GAM139 target gene, herein designated TARGET GENE. ARLTS1 BINDING SITE is a target binding site found in the 3' untranslated region of mRNA encoded by ARLTS1, corresponding to a target binding site such as BINDING SITE I, BINDING SITE II or BINDING SITE III of FIG. 8. Table 4 illustrates the complementarity of the nucleotide sequences of ARLTS1 BINDING SITE, designated SEQ ID:10485, to the nucleotide sequence of GAM139 RNA, herein designated GAM RNA, also designated SEQ ID:327.

Another function of GAM139 is therefore inhibition of ARLTS1 (Accession NP_612459.1). Accordingly, utilities of GAM139 include diagnosis, prevention and treatment of diseases and clinical conditions associated with ARLTS1.

Ankyrin repeat and socs box-containing 1 (ASB1, Accession NP_057198.1) is another GAM139 target gene, herein designated TARGET GENE. ASB1 BINDING SITE1 and ASB1 BINDING SITE2 are target binding sites found in untranslated regions of mRNA encoded by ASB1, corresponding to target binding sites such as BINDING SITE I, BINDING SITE II or BINDING SITE III of FIG. 8. Table 4 illustrates the complementarity of the nucleotide sequences of ASB1 BINDING SITE1 and ASB1 BINDING SITE2, designated SEQ ID:5956 and SEQ ID:16782 respectively, to the nucleotide sequence of GAM139 RNA, herein designated GAM RNA, also designated SEQ ID:327.

Another function of GAM139 is therefore inhibition of Ankyrin repeat and socs box-containing 1 (ASB1, Accession NP_057198.1), a gene which May mediate protein-protein interactions. Accordingly, utilities of GAM139 include diagnosis, prevention and treatment of diseases and clinical conditions associated with ASB1.

The function of ASB1 and its association with various diseases and clinical conditions, has been established by previous studies, as described hereinabove with reference to GAM47.1. Activating transcription factor 3 (ATF3, Accession NP_004015.2) is another GAM139 target gene, herein designated TARGET GENE. ATF3 BINDING SITE is a target binding site found in the 3' untranslated region of multiple transcripts of mRNA encoded by ATF3, corresponding to a target binding site such as BINDING SITE I, BINDING SITE II or BINDING SITE III of FIG. 8. Table 4 illustrates the complementarity of the nucleotide sequences of ATF3 BINDING SITE, designated SEQ ID:16226, to the nucleotide sequence of GAM139 RNA, herein designated GAM RNA, also designated SEQ ID:327.

Another function of GAM139 is therefore inhibition of Activating transcription factor 3 (ATF3, Accession NP_004015.2). Accordingly, utilities of GAM139 include diagnosis, prevention and treatment of diseases and clinical conditions associated with ATF3.

Udp-gal:betaglcnac beta 1,4-galactosyltransferase, polypeptide 5 (B4GALT5, Accession NP_004767.1) is another GAM139 target gene, herein designated TARGET GENE. B4GALT5 BINDING SITE is a target binding site found in the 3' untranslated region of mRNA encoded by B4GALT5, corresponding to a target binding site such as BINDING SITE I, BINDING SITE II or BINDING SITE III of FIG. 8. Table 4 illustrates the complementarity of the nucleotide sequences of B4GALT5 BINDING SITE, designated SEQ ID:2957, to the nucleotide sequence of GAM139 RNA, herein designated GAM RNA, also designated SEQ ID:327.

Another function of GAM139 is therefore inhibition of Udp-gal:betaglcnac beta 1,4-galactosyltransferase, polypeptide 5 (B4GALT5, Accession NP_004767.1). Accordingly, utilities of GAM139 include diagnosis, prevention and treatment of diseases and clinical conditions associated with B4GALT5.

Beta-site app-cleaving enzyme 2 (BACE2, Accession NP_620477.1) is another GAM139 target gene, herein designated TARGET GENE. BACE2 BINDING SITE1 through BACE2 BINDING SITE3 are target binding sites found in untranslated regions of multiple transcripts of mRNA encoded by BACE2, corresponding to target binding sites such as BINDING SITE I, BINDING SITE II or BINDING SITE III of FIG. 8. Table 4 illustrates the complementarity of the nucleotide sequences of BACE2 BINDING SITE1 through BACE2 BINDING SITE3, designated SEQ ID:16352, SEQ ID:5247 and SEQ ID:4701 respectively, to the nucleotide sequence of GAM139 RNA, herein designated GAM RNA, also designated SEQ ID:327.

Another function of GAM139 is therefore inhibition of Beta-site app-cleaving enzyme 2 (BACE2, Accession NP_620477.1), a gene which cleaves intracellularly the b-secretase site of amyloid precursor protein and therefore may be associated with Alzheimer's disease and down syndrome. Accordingly, utilities of GAM139 include diagnosis, prevention and treatment of Alzheimer's disease and down syndrome, and of other diseases and clinical conditions associated with BACE2.

The function of BACE2 has been established by previous studies. Deposition in the brain of the 39- to 43-amino acid amyloid-beta peptide is a hallmark of Alzheimer disease (AD; 104300), a frequent complication of Down syndrome (OMIM Ref. No. 190685) patients after age 30 years. Amyloid-beta is generated by proteolytic processing of the amyloid precursor protein (APP; 104760) by beta- and gamma-secretase at the N and C termini, respectively. Presenilin-1 (OMIM Ref. No. 104311) is involved in the gamma-secretase activity. BACE (OMIM Ref. No. 604252), a transmembrane aspartyl protease, possesses beta-secretase activity. By differential display RT-PCR of poorly and highly metastatic breast cancer cell lines, followed by screening a bone marrow stroma cell cDNA library, Xin et al. (2000) obtained a cDNA encoding BACE2, which they termed ALP56. Sequence analysis predicted that the 518-amino acid protein has 2 pepsin-like active centers, a signal sequence, a propeptide, and a long C-terminal extension including a transmembrane domain. Northern blot analysis detected 2.5- and 2.0-kb transcripts in metastatic tumors injected in SCID mice (see OMIM Ref. No. 202500). In situ hybridization analysis demonstrated high expression in breast, colon, and prostate cancer biopsies, as well as in normal prostate. Northern blot analysis of normal tissue revealed expression in prostate, pancreas, and placenta. Further exposure detected expression in all tissues tested except brain and lymphocytes. Western blot analysis showed expression of a 60-kD protein as well as apparent autocleavage products of 17 and 14 kD. By searching EST databases with the BACE sequence and identifying mapped sequences, Saunders et al. (1999) identified a cDNA encoding BACE2 and mapped the gene to 21q22.2-q22.3. Using FISH, Acquati et al. (2000) confirmed the localization of BACE2 to 21q22.3, within the Down syndrome critical region.

Full details of the abovementioned studies are described in the following publications, the disclosure of which are hereby incorporated by reference:

Xin, H.; Stephans, J. C.; Duan, X.; Harrowe, G.; Kim, E.; Grieshammer, U.; Kingsley, C.; Giese, K.: Identification of a novel aspartic-like protease differentially expressed in human breast cancer cell lines. Biochim. Biophys. Acta 1501:125-137, 2000; and Saunders, A. J.; Kim, T.-W.; Tanzi, R. E.: BACE maps to chromosome 11 and a BACE homolog, BACE2, reside in the obligate Down syndrome region of chromosome 21. Science 286:1255A only.

Further studies establishing the function and utilities of BACE2 are found in John Hopkins OMIM database record ID 605668, and in cited publications listed in Table 5, which are hereby incorporated by reference. Bromodomain adjacent to zinc finger domain, 2a (BAZ2A, Accession NP_038477.1) is another GAM139 target gene, herein designated TARGET GENE. BAZ2A BINDING SITE is a target binding site found in the 3' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:12267, to the nucleotide sequence of GAM139 RNA, herein designated GAM RNA, also designated SEQ ID:327.

Another function of GAM139 is therefore inhibition of Bromodomain adjacent to zinc finger domain, 2a (BAZ2A, Accession NP_038477.1) . Accordingly, utilities of GAM139 include diagnosis, prevention and treatment of diseases and clinical conditions associated with BAZ2A.

Brain protein i3 (BRI3, Accession NP_056194.1) is another GAM139 target gene, herein designated TARGET GENE. BRI3 BINDING SITE is a target binding site found in the 3' untranslated region of mRNA encoded by BRI3, corresponding to a target binding site such as BINDING SITE I, BINDING SITE II or BINDING SITE III of FIG. 8. Table 4 illustrates the complementarity of the nucleotide sequences of BRI3 BINDING SITE, designated SEQ ID:8333, to the nucleotide sequence of GAM139 RNA, herein designated GAM RNA, also designated SEQ ID:327.

Another function of GAM139 is therefore inhibition of Brain protein i3 (BRI3, Accession NP_056194.1). Accordingly, utilities of GAM139 include diagnosis, prevention and treatment of diseases and clinical conditions associated with BRI3.

BRMS1 (Accession NP_056214.1) is another GAM139 target gene, herein designated TARGET GENE. BRMS1 BINDING SITE is a target binding site found in the 3' untranslated region of multiple transcripts of mRNA encoded by BRMS1, corresponding to a target binding site such as BINDING SITE I, BINDING SITE II or BINDING SITE III of FIG. 8. Table 4 illustrates the complementarity of the nucleotide sequences of BRMS1 BINDING SITE, designated SEQ ID:10687, to the nucleotide sequence of GAM139 RNA, herein designated GAM RNA, also designated SEQ ID:327.

Another function of GAM139 is therefore inhibition of BRMS1 (Accession NP_056214.1), a gene which may be a mediator of metastasis suppression in breast carcinoma (by similarity). and therefore may be associated with Human breast cancer. Accordingly, utilities of GAM139 include diagnosis, prevention and treatment of Human breast cancer, and of other diseases and clinical conditions associated with BRMS1.

The function of BRMS1 has been established by previous studies. BRMS1 is a human breast carcinoma metastasis suppressor gene that maps to 11q13, a hotspot in breast cancer progression. To assess the effect of BRMS1 on breast carcinoma biologic behavior, Seraj et al. (2000) transfected BRMS1 into 2 independently derived metastatic human breast carcinoma cell lines. Stably transfected breast carcinoma cells still formed progressively growing, locally invasive tumors when injected into mammary fat pads, but were significantly less metastatic to lungs and regional lymph nodes.

Full details of the abovementioned studies are described in the following publications, the disclosure of which are hereby incorporated by reference:

Phillips, K. K.; Welch, D. R.; Miele, M. E.; Lee, J. H.; Wei, L. L.; Weissman, B. E.: Suppression of MDA-MB-435 breast carcinoma cell metastasis following the introduction of human chromosome 11. Cancer Res. 56:1222-1227, 1996; and Seraj, M. J.; Samant, R. S.; Verderame, M. F.; Welch, D. R.: Functional evidence for a novel human breast carcinoma metastasis suppressor, BRMS1, encoded at chromosome 11q13. Cancer Res.

Further studies establishing the function and utilities of BRMS1 are found in John Hopkins OMIM database record ID 606259, and in cited publications listed in Table 5, which are hereby incorporated by reference. C14orf107 (Accession NP_061057.1) is another GAM139 target gene, herein designated TARGET GENE. C14orf107 BINDING SITE1 and C14orf107 BINDING SITE2 are target binding sites found in untranslated regions of mRNA encoded by C14orf107, corresponding to target binding sites such as BINDING SITE I, BINDING SITE II or BINDING SITE III of FIG. 8. Table 4 illustrates the complementarity of the nucleotide sequences of C14orf107 BINDING SITE1 and C14orf107 BINDING SITE2, designated SEQ ID:9620 and SEQ ID:17830 respectively, to the nucleotide sequence of GAM139 RNA, herein designated GAM RNA, also designated SEQ ID:327.

Another function of GAM139 is therefore inhibition of C14orf107 (Accession NP_061057.1). Accordingly, utilities of GAM139 include diagnosis, prevention and treatment of diseases and clinical conditions associated with C14orf107.

Chromosome 14 open reading frame 9 (C14orf9, Accession NP_653169.1) is another GAM139 target gene, herein designated TARGET GENE. C14orf9 BINDING SITE is a target binding site found in the 3' untranslated region of mRNA encoded by C14orf9, corresponding to a target binding site such as BINDING SITE I, BINDING SITE II or BINDING SITE III of FIG. 8. Table 4 illustrates the complementarity of the nucleotide sequences of C14orf9 BINDING SITE, designated SEQ ID:17946, to the nucleotide sequence of GAM139 RNA, herein designated GAM RNA, also designated SEQ ID:327.

Another function of GAM139 is therefore inhibition of Chromosome 14 open reading frame 9 (C14orf9, Accession NP_653169.1). Accordingly, utilities of GAM139 include diagnosis, prevention and treatment of diseases and clinical conditions associated with C14orf9.

C15orf16 (Accession NP_570971.1) is another GAM139 target gene, herein designated TARGET GENE. C15orf16 BINDING SITE is a target binding site found in the 5' untranslated region of mRNA encoded by C15orf16, corresponding to a target binding site such as BINDING SITE I, BINDING SITE II or BINDING SITE III of FIG. 8. Table 4 illustrates the complementarity of the nucleotide sequences of C15orf16 BINDING SITE, designated SEQ ID:17482, to the nucleotide sequence of GAM139 RNA, herein designated GAM RNA, also designated SEQ ID:327.

Another function of GAM139 is therefore inhibition of C15orf16 (Accession NP_570971.1). Accordingly, utilities of GAM139 include diagnosis, prevention and treatment of diseases and clinical conditions associated with C15orf16.

C16orf5 (Accession NP_037531.1) is another GAM139 target gene, herein designated TARGET GENE. C16orf5 BINDING SITE is a target binding site found in the 3' untranslated region of mRNA encoded by C16orf5, corresponding to a target binding site such as BINDING SITE I, BINDING SITE II or BINDING SITE III of FIG. 8. Table 4 illustrates the complementarity of the nucleotide sequences of C16orf5 BINDING SITE, designated SEQ ID:9004, to the nucleotide sequence of GAM139 RNA, herein designated GAM RNA, also designated SEQ ID:327.

Another function of GAM139 is therefore inhibition of C16orf5 (Accession NP_037531.1). Accordingly, utilities of GAM139 include diagnosis, prevention and treatment of diseases and clinical conditions associated with C16orf5.

Chromosome 20 open reading frame 130 (C20orf130, Accession XP_029741.1) is another GAM139 target gene, herein designated TARGET GENE. C20orf130 BINDING SITE is a target binding site found in the 3' untranslated region of mRNA encoded by C20orf130, corresponding to a target binding site such as BINDING SITE I, BINDING SITE II or BINDING SITE III of FIG. 8. Table 4 illustrates the complementarity of the nucleotide sequences of C20orf130 BINDING SITE, designated SEQ ID:891, to the nucleotide sequence of GAM139 RNA, herein designated GAM RNA, also designated SEQ ID:327.

Another function of GAM139 is therefore inhibition of Chromosome 20 open reading frame 130 (C20orf130, Accession XP_029741.1). Accordingly, utilities of GAM139 include diagnosis, prevention and treatment of diseases and clinical conditions associated with C20orf130.

Chromosome 20 open reading frame 44 (C20orf44, Accession NP_060714.2) is another GAM139 target gene, herein designated TARGET GENE. C20orf44 BINDING SITE is a target binding site found in the 3' untranslated region of mRNA encoded by C20orf44, corresponding to a target binding site such as BINDING SITE I, BINDING SITE II or BINDING SITE III of FIG. 8. Table 4 illustrates the complementarity of the nucleotide sequences of C20orf44 BINDING SITE, designated SEQ ID:6027, to the nucleotide sequence of GAM139 RNA, herein designated GAM RNA, also designated SEQ ID:327.

Another function of GAM139 is therefore inhibition of Chromosome 20 open reading frame 44 (C20orf44, Accession NP_060714.2). Accordingly, utilities of GAM139 include diagnosis, prevention and treatment of diseases and clinical conditions associated with C20orf44.

Chromosome 22 open reading frame 5 (C22orf5, Accession NP_036396.1) is another GAM139 target gene, herein designated TARGET GENE. C22orf5 BINDING SITE is a target binding site found in the 3' untranslated region of mRNA encoded by C22orf5, corresponding to a target binding site such as BINDING SITE I, BINDING SITE II or BINDING SITE III of FIG. 8. Table 4 illustrates the complementarity of the nucleotide sequences of C22orf5 BINDING SITE, designated SEQ ID:1661, to the nucleotide sequence of GAM139 RNA, herein designated GAM RNA, also designated SEQ ID:327.

Another function of GAM139 is therefore inhibition of Chromosome 22 open reading frame 5 (C22orf5, Accession NP_036396.1). Accordingly, utilities of GAM139 include diagnosis, prevention and treatment of diseases and clinical conditions associated with C22orf5.

C6orf49 (Accession NP_060071.1) is another GAM139 target gene, herein designated TARGET GENE. C6orf49 BINDING SITE is a target binding site found in the 3' untranslated region of multiple transcripts of mRNA encoded by C6orf49, corresponding to a target binding site such as BINDING SITE I, BINDING SITE II or BINDING SITE III of FIG. 8. Table 4 illustrates the complementarity of the nucleotide sequences of C6orf49 BINDING SITE, designated SEQ ID:11971, to the nucleotide sequence of GAM139 RNA, herein designated GAM RNA, also designated SEQ ID:327.

Another function of GAM139 is therefore inhibition of C6orf49 (Accession NP_060071.1). Accordingly, utilities of GAM139 include diagnosis, prevention and treatment of diseases and clinical conditions associated with C6orf49.

Complement component 8, gamma polypeptide (C8G, Accession NP_000597.1) is another GAM139 target gene, herein designated TARGET GENE. C8G BINDING SITE is a target binding site found in the 3' untranslated region of mRNA encoded by C8G, corresponding to a target binding site such as BINDING SITE I, BINDING SITE II or BINDING SITE III of FIG. 8. Table 4 illustrates the complementarity of the nucleotide sequences of C8G BINDING SITE, designated SEQ ID:8475, to the nucleotide sequence of GAM139 RNA, herein designated GAM RNA, also designated SEQ ID:327.

Another function of GAM139 is therefore inhibition of Complement component 8, gamma polypeptide (C8G, Accession NP_000597.1), a gene which is one of three components of complement C8, a constituent of the membrane attack complex. Accordingly, utilities of GAM139 include diagnosis, prevention and treatment of diseases and clinical conditions associated with C8G.

The function of C8G has been established by previous studies. The eighth component of complement (C8) consists of 3 nonidentical subunits arranged asymmetrically as a disulfide-linked alpha-gamma dimer and a noncovalently associated beta chain. Genetic studies of C8 polymorphisms established that alpha-gamma and beta are encoded at different loci (see OMIM Ref. No. 120950, 120960). Implicit in this finding was the existence of 2 different genes and the likelihood that alpha-gamma is synthesized as a single-chain precursor. Ng et al. (1987), however, presented evidence that the C8 molecule is assembled from 3 different gene products, alpha, beta, and gamma, that undergo both covalent and noncovalent association to yield the mature protein. The linkage relationships of the gamma locus to the others are unknown. Ng et al. (1987) identified a cDNA clone containing the entire coding region for the human gamma polypeptide, and its sequence supported the existence of a separate gamma mRNA. Whereas the alpha chain and beta chain of C8 show an overall sequence homology to C6, C7, and C9 (which like C8 are involved in the membrane-attack complex that leads to lysis of target cells), the gamma chain was found by Haefliger et al. (1987) to show structural homology to protein HC (alpha-1-microglobulin/bikunin precursor; AMBP; 176870). This suggested a similar 3-dimensional structure of the 2 proteins and a possible functional relationship. Hunt et al. (1987) also pointed out the close sequence homology of C8G to alpha-1-microglobulin. The C8G gene and its protein product belong to the lipocalin superfamily, a group of distantly related and similarly folded proteins that are able to carry small lipophilic molecules such as retinol, odorants, and steroids. The lipocalin superfamily has a very ancient origin since lipocalins are found in arthropods as well as in vertebrates.

Full details of the abovementioned studies are described in the following publications, the disclosure of which are hereby incorporated by reference:

Ng, S. C.; Rao, A. G.; Howard, O. M. Z.; Sodetz, J. M.: The eighth component of human complement: evidence that it is an oligomeric serum protein assembled from products of three different genes. Biochemistry 26:5229-5233, 1987; and Hunt, L. T.; Elzanowski, A.; Barker, W. C.: The homology of complement factor C8 gamma chain and alpha-1-microglobulin. Biochem. Biophys. Res. Commun. 149:282-288, 1987.

Further studies establishing the function and utilities of C8G are found in John Hopkins OMIM database record ID 120930, and in cited publications listed in Table 5, which are hereby incorporated by reference. Chromosome 9 open reading frame 14 (C9orf14, Accession XP_098859.2) is another GAM139 target gene, herein designated TARGET GENE. C9orf14 BINDING SITE is a target binding site found in the 5' untranslated region of mRNA encoded by C9orf14, corresponding to a target binding site such as BINDING SITE I, BINDING SITE II or BINDING SITE III of FIG. 8. Table 4 illustrates the complementarity of the nucleotide sequences of C9orf14 BINDING SITE, designated SEQ ID:10704, to the nucleotide sequence of GAM139 RNA, herein designated GAM RNA, also designated SEQ ID:327.

Another function of GAM139 is therefore inhibition of Chromosome 9 open reading frame 14 (C9orf14, Accession XP_098859.2). Accordingly, utilities of GAM139 include diagnosis, prevention and treatment of diseases and clinical conditions associated with C9orf14.

Carbonic anhydrase xii (CA12, Accession NP_001209.1) is another GAM139 target gene, herein designated TARGET GENE. CA12 BINDING SITE is a target binding site found in the 3' untranslated region of mRNA encoded by CA12, corresponding to a target binding site such as BINDING SITE I, BINDING SITE II or BINDING SITE III of FIG. 8. Table 4 illustrates the complementarity of the nucleotide sequences of CA12 BINDING SITE, designated SEQ ID:4145, to the nucleotide sequence of GAM139 RNA, herein designated GAM RNA, also designated SEQ ID:327.

Another function of GAM139 is therefore inhibition of Carbonic anhydrase xii (CA12, Accession NP_001209.1), a gene which functions in cellular transport and metabolic processes and therefore may be associated with Cell renal carcinomas. Accordingly, utilities of GAM139 include diagnosis, prevention and treatment of Cell renal carcinomas, and of other diseases and clinical conditions associated with CA12.

The function of CA12 has been established by previous studies. Tureci et al. (1998) cloned the gene identified by Sahin et al. (1995) from the RCC and named it CA XII. The cDNA sequence encodes a deduced 354-amino acid protein with a predicted molecular mass of 39,448 Da and features of a type I membrane protein. The extracellular CA domain shows 30 to 42% similarity with known human CAs, contains all 3 zinc-binding histidine residues found in active CAs, and contains 2 potential sites for asparagine glycosylation. Expression of the CA XII cDNA in mammalian cells produced a 43- to 44-kD doublet; treatment with PNGase (endoglycosidase) F resulted in a single 39-kD product. The recombinant CA XII had appreciable catalytic activity. By Northern blot analysis, the authors detected a 4.5-kb CA XII transcript in normal human kidney, colon, and activated lymphocytes. They found that CA XII is overexpressed in 10% of clear cell renal carcinomas, as compared with the corresponding normal renal tissue. Sequencing revealed no differences between the RCC-derived cDNA and a CA XII cDNA isolated from normal kidney. Carbonic anhydrases (CAs) are a family of zinc metalloenzymes. For background information on the CA family, Full details of the abovementioned studies are described in the following publications, the disclosure of which are hereby incorporated by reference:

Tureci, O.; Sahin, U.; Vollmar, E.; Siemer, S.; Gottert, E.; Seitz, G.; Parkkila, A. K.; Shah, G. N.; Grubb, J. H.; Pfreundschuh, M.; Sly, W. S.: Human carbonic anhydrase XII: cDNA cloning, expression, and chromosomal localization of a carbonic anhydrase gene that is overexpressed in some renal cell cancers. Proc. Nat. Acad. Sci. 95:7608-7613, 1998; and Sahin, U.; Tureci, O.; Schmitt, H.; Cochlovius, B.; Johannes, T.; Schmits, R.; Stenner, F.; Luo, G.; Schobert, I.; Pfreundschuh, M.: Human neoplasms elicit multiple specific immune resp.

Further studies establishing the function and utilities of CA12 are found in John Hopkins OMIM database record ID 603263, and in cited publications listed in Table 5, which are hereby incorporated by reference. Calmodulin-like 3 (CALML3, Accession NP_005176.1) is another GAM139 target gene, herein designated TARGET GENE. CALML3 BINDING SITE is a target binding site found in the 5' untranslated region of mRNA encoded by CALML3, corresponding to a target binding site such as BINDING SITE I, BINDING SITE II or BINDING SITE III of FIG. 8. Table 4 illustrates the complementarity of the nucleotide sequences of CALML3 BINDING SITE, designated SEQ ID:7337, to the nucleotide sequence of GAM139 RNA, herein designated GAM RNA, also designated SEQ ID:327.

Another function of GAM139 is therefore inhibition of Calmodulin-like 3 (CALML3, Accession NP_005176.1). Accordingly, utilities of GAM139 include diagnosis, prevention and treatment of diseases and clinical conditions associated with CALML3.

Caspase 2, apoptosis-related cysteine protease (neural precursor cell expressed, developmentally down-regulated 2) (CASP2, Accession NP_116765.1) is another GAM139 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:9375, to the nucleotide sequence of GAM139 RNA, herein designated GAM RNA, also designated SEQ ID:327.

Another function of GAM139 is therefore inhibition of Caspase 2, apoptosis-related cysteine protease (neural precursor cell expressed, developmentally down-regulated 2) (CASP2, Accession NP_116765.1), a gene which involves in the activation cascade of caspases responsible for apoptosis execution. Accordingly, utilities of GAM139 include diagnosis, prevention and treatment of diseases and clinical conditions associated with CASP2.

The function of CASP2 has been established by previous studies. Lassus et al. (2002) found that cytotoxic stress causes activation of caspase-2 and that this caspase is required for the permeabilization of mitochondria. Caspase- 2 is required for stress-induced apoptosis and for release of cytochrome c and Smac (OMIM Ref. No. 605219) from mitochondria and for translocation of Bax from the cytoplasm to mitochondria.

Animal model experiments lend further support to the function of CASP2. To evaluate the requirement for caspase-2 in various aspects of apoptosis, Bergeron et al. (1998) generated caspase-2-deficient mice. Excess numbers of the germ cells were 'endowed' in ovaries of mutant mice, and the oocytes were resistant to cell death following exposure to chemotherapeutic drugs. Apoptosis mediated by granzyme B (OMIM Ref. No. 123910) and perforin (OMIM Ref. No. 170280) was defective in caspase-2-deficient B lymphoblasts. In contrast, cell death of motor neurons during development was accelerated in caspase-2-deficient mice. In addition, caspase-2-deficient sympathetic neurons underwent apoptosis more effectively than wildtype neurons when deprived of nerve growth factor. Thus, caspase- 2 acts as both a positive and a negative cell death effector, depending upon cell lineage and stage of development.

It is appreciated that the abovementioned animal model for CASP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bergeron, L.; Perez, G. I.; Macdonald, G.; Shi, L.; Sun, Y.; Jurisicova, A.; Varmuza, S.; Latham, K. E.; Flaws, J. A.; Salter, J. C. M.; Hara, H.; Moskowitz, M. A.; Li, E.; Greenberg, A.; Tilly, J. L.; Yuan, J.: Defects in regulation of apoptosis in caspase- 2-deficient mice. Genes Dev. 12:1304-1314, 1998; and Lassus, P.; Opitz-Aray, X.; Lazebnik, Y.: Requirement for caspase-2 in stress-induced apoptosis before mitochondrial permeabilization. Science 297:1352-1354, 2002.

Further studies establishing the function and utilities of CASP2 are found in John Hopkins OMIM database record ID 600639, and in cited publications listed in Table 5, which are hereby incorporated by reference. Caspase 2, apoptosis-related cysteine protease (neural precursor cell expressed, developmentally down-regulated 2) (CASP2, Accession NP_116766.1) is another GAM139 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:9375, to the nucleotide sequence of GAM139 RNA, herein designated GAM RNA, also designated SEQ ID:327.

Another function of GAM139 is therefore inhibition of Caspase 2, apoptosis-related cysteine protease (neural precursor cell expressed, developmentally down-regulated 2) (CASP2, Accession NP_116766.1), a gene which involves in the activation cascade of caspases responsible for apoptosis execution. Accordingly, utilities of GAM139 include diagnosis, prevention and treatment of diseases and clinical conditions associated with CASP2.

The function of CASP2 has been established by previous studies. Lassus et al. (2002) found that cytotoxic stress causes activation of caspase-2 and that this caspase is required for the permeabilization of mitochondria. Caspase- 2 is required for stress-induced apoptosis and for release of cytochrome c and Smac (OMIM Ref. No. 605219) from mitochondria and for translocation of Bax from the cytoplasm to mitochondria.

Animal model experiments lend further support to the function of CASP2. To evaluate the requirement for caspase-2 in various aspects of apoptosis, Bergeron et al. (1998) generated caspase-2-deficient mice. Excess numbers of the germ cells were 'endowed' in ovaries of mutant mice, and the oocytes were resistant to cell death following exposure to chemotherapeutic drugs. Apoptosis mediated by granzyme B (OMIM Ref. No. 123910) and perforin (OMIM Ref. No. 170280) was defective in caspase-2-deficient B lymphoblasts. In contrast, cell death of motor neurons during development was accelerated in caspase-2-deficient mice. In addition, caspase-2-deficient sympathetic neurons underwent apoptosis more effectively than wildtype neurons when deprived of nerve growth factor. Thus, caspase- 2 acts as both a positive and a negative cell death effector, depending upon cell lineage and stage of development.

It is appreciated that the abovementioned animal model for CASP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bergeron, L.; Perez, G. I.; Macdonald, G.; Shi, L.; Sun, Y.; Jurisicova, A.; Varmuza, S.; Latham, K. E.; Flaws, J. A.; Salter, J. C. M.; Hara, H.; Moskowitz, M. A.; Li, E.; Greenberg, A.; Tilly, J. L.; Yuan, J.: Defects in regulation of apoptosis in caspase- 2-deficient mice. Genes Dev. 12:1304-1314, 1998; and Lassus, P.; Opitz-Aray, X.; Lazebnik, Y.: Requirement for caspase-2 in stress-induced apoptosis before mitochondrial permeabilization. Science 297:1352-1354, 2002.

Further studies establishing the function and utilities of CASP2 are found in John Hopkins OMIM database record ID 600639, and in cited publications listed in Table 5, which are hereby incorporated by reference. Core-binding factor, runt domain, alpha subunit 2; translocated to, 1; cyclin d-related (CBFA2T1, Accession NP_783554.1) is another GAM139 target gene, herein designated TARGET GENE. CBFA2T1 BINDING SITE is a target binding site found in the 5' untranslated region of multiple transcripts of mRNA encoded by CBFA2T1, corresponding to a target binding site such as BINDING SITE I, BINDING SITE II or BINDING SITE III of FIG. 8. Table 4 illustrates the complementarity of the nucleotide sequences of CBFA2T1 BINDING SITE, designated SEQ ID:14704, to the nucleotide sequence of GAM139 RNA, herein designated GAM RNA, also designated SEQ ID:327.

Another function of GAM139 is therefore inhibition of Core-binding factor, runt domain, alpha subunit 2; translocated to, 1; cyclin d-related (CBFA2T1, Accession NP_783554.1), a gene which produces a chimeric gene made up of the 5-prime region of the AML1 gene fused to the 3-prime region of the ETO gene through translocation. and therefore may be associated with Human leukemia. Accordingly, utilities of GAM139 include diagnosis, prevention and treatment of Human leukemia, and of other diseases and clinical conditions associated with CBFA2T1.

The function of CBFA2T1 has been established by previous studies. Wolford and Prochazka (1998) reported that the MTG8 gene contains 13 exons spanning over 87 kb of DNA. They identified cDNAs representing alternatively spliced MTG8 transcripts in which a 155-bp exon (9a) is present. Inclusion of this exon changes the reading frame, resulting in the introduction of a premature stop codon. The encoded truncated proteins lack 177 C-terminal residues, which is the region containing 2 putative zinc finger motifs, the last P/S/T-rich domain, and a putative alpha-helical coiled-coil structure. Northern blot analysis of human tissues detected an approximately 5.5-kb MTG8 transcript in heart, brain, placenta, lung, skeletal muscle, and pancreas but not in liver or kidney. RT-PCR analysis of a number of human tissues showed highest levels of MTG8 expression in fetal brain, followed by adult brain and heart. Relatively abundant mRNA levels were also found in lung, pituitary, and placenta. When first identified as a partner with AML1 in acute myeloid leukemia (Erickson et al., 1992; Miyoshi et al., 1993), the gene was referred to as MTG8 for 'myeloid translocation gene on 8q22.' Wolford et al. (1998) found that MTG8 mRNAs are expressed at relatively high levels in human adipose tissue. They therefore investigated MTG8 as a candidate gene in obesity, studying the relationship between a highly polymorphic marker in the 3-prime untranslated region of the MTG8 gene and obesity in Pima Indians of Arizona, a population with one of the highest reported rates of obesity. They detected a male-specific association with age-adjusted percentage body fat ($p = 0.0002$), body mass index ($p = 0.01$), waist circumference ($p = 0.008$), and thigh circumference ($p = 0.02$). Comparative analysis of all 13 MTG8 exons in 30 Pimas did not reveal any genetic variants that could explain the association with obesity in males.

Full details of the abovementioned studies are described in the following publications, the disclosure of which are hereby incorporated by reference:

Wolford, J. K.; Prochazka, M.: Structure and expression of the human MTG8/ETO gene. Gene 212:103-109, 1998; and Miyoshi, H.; Kozu, T.; Shimizu, K.; Enomoto, K.; Maseki, N.; Kaneko, Y.; Kamada, N.; Ohki, M.: The t(8;21) translocation in acute myeloid leukemia results in production of an AML1-MTG8.

Further studies establishing the function and utilities of CBFA2T1 are found in John Hopkins OMIM database record ID 133435, and in cited publications listed in Table 5, which are hereby incorporated by reference. Carbonyl reductase 1 (CBR1, Accession NP_001748.1) is another GAM139 target gene, herein designated TARGET GENE. CBR1 BINDING SITE is a target binding site found in the 3' untranslated region of mRNA encoded by CBR1, corresponding to a target binding site such as BINDING SITE I, BINDING SITE II or BINDING SITE III of FIG. 8. Table 4 illustrates the complementarity of the nucleotide sequences of CBR1 BINDING SITE, designated SEQ ID:13028, to the nucleotide sequence of GAM139 RNA, herein designated GAM RNA, also designated SEQ ID:327.

Another function of GAM139 is therefore inhibition of Carbonyl reductase 1 (CBR1, Accession NP_001748.1), a gene which catalyze the reduction of a wide variety of carbonyl compounds including the antitumor anthracycline antibiotics. Accordingly, utilities of GAM139 include diagnosis, prevention and treatment of diseases and clinical conditions associated with CBR1.

The function of CBR1 has been established by previous studies. Carbonyl reductase (EC 1.1.1.184) is 1 of several monomeric, NADPH-dependent oxidoreductases having wide specificity for carbonyl compounds that are generally referred to as aldoketoreductases. Others include aldehyde reductase (EC 1.1.1.2; 103830) and aldose reductase (EC 1.1.1.21; 103880). Wermuth et al. (1988) isolated and characterized a cDNA complementary to carbonyl reductase mRNA from a human placenta cDNA library. The cDNA contained an open reading frame encoding a protein comprised of 277 amino acids with a molecular weight of 30,375. Comparison of the predicted protein sequence with the primary structures of other aldoketoreductases showed no significant homologies. A possible homology, on the other hand, was found between carbonyl reductase and 'short' subunit alcohol/polyol dehydrogenases. Carbonyl reductase catalyzes the reduction of a great variety of carbonyl compounds, e.g., quinones derived from polycyclic aromatic hydrocarbons, 9- ketoprostaglandins, and the antitumor anthracycline antibiotics daunorubicin and doxorubicin. The enzyme is widely distributed in human tissues and also occurs in other mammalian and nonmammalian species. In a carbonyl reductase cDNA cloned from a breast cancer cell line, Forrest et al. (1990) demonstrated 1,219 basepairs. Southern analysis of genomic DNA digested with several restriction enzymes and analyzed by hybridization with a labeled cDNA probe indicated that carbonyl reductase is probably coded by a single gene and does not belong to a family of structurally similar enzymes. Southern analysis of 17 mouse/human somatic cell hybrids showed that carbonyl reductase is located on chromosome 21. Carbonyl reductase mRNA was induced 3-or 4-fold in 24 hours with BHA, beta-naphthoflavone, or Sudan 1. Avramopoulos et al. (1992) confirmed assignment to chromosome 21 by genetic linkage mapping using a DNA polymorphism from the 3-prime untranslated region of the CBR gene. They demonstrated, furthermore, that the gene lies between that for interferon-alpha receptor (OMIM Ref. No. 107450) and D21S55, being about 3.4 and 7.2 cM, respectively, from the 2 flanking loci. The findings placed CBR in the telomeric band 21q22.3. By high-resolution fluorescence in situ hybridization, Lemieux et al. (1993) mapped the CBR gene to 21q22.12, very close to the SOD1 locus at position 21q22.11. CBR displayed gene dosage effects in trisomy 21 human lymphoblasts at both the DNA and the mRNA levels. With increasing chromosome 21 ploidy, lymphoblasts also showed increased aldo-keto reductase activity and increased quinone reductase activity. Both of these activities have been shown to be associated with carbonyl reductase. The location of CBR near SOD1 and the increased enzyme activity and potential for free radical modulation in trisomy 21 cells implicate CBR as a candidate for contributing to the pathology of Down syndrome.

Full details of the abovementioned studies are described in the following publications, the disclosure of which are hereby incorporated by reference:

Watanabe, K.; Sugawara, C.; Ono, A.; Fukuzumi, Y.; Itakura, S.; Yamazaki, M.; Tashiro, H.; Osoegawa, K.; Soeda, E.; Nomura, T.: Mapping of a novel human carbonyl reductase, CBR3, and ribosomal pseudogenes to human chromosome 21q22.2. Genomics 52:95-100, 1998; and Lemieux, N.; Malfoy, B.; Forrest, G. L.: Human carbonyl reductase (CBR) localized to band 21q22.1 by high-resolution fluorescence in situ hybridization displays gene dosage effects in t.

Further studies establishing the function and utilities of CBR1 are found in John Hopkins OMIM database record ID 114830, and in cited publications listed in Table 5, which are hereby incorporated by reference. Chemokine (c-c motif) receptor 8 (CCR8, Accession NP_005192.1) is another GAM139 target gene, herein designated TARGET GENE. CCR8 BINDING SITE is a target binding site found in the 5' untranslated region of mRNA encoded by CCR8, corresponding to a target binding site such as BINDING SITE I, BINDING SITE II or BINDING SITE III of FIG. 8. Table 4 illustrates the complementarity of the nucleotide sequences of CCR8 BINDING SITE, designated SEQ ID:2636, to the nucleotide sequence of GAM139 RNA, herein designated GAM RNA, also designated SEQ ID:327.

Another function of GAM139 is therefore inhibition of Chemokine (c-c motif) receptor 8 (CCR8, Accession NP_005192.1). Accordingly, utilities of GAM139 include diagnosis, prevention and treatment of diseases and clinical conditions associated with CCR8.

Cd151 antigen (CD151, Accession NP_620599.1) is another GAM139 target gene, herein designated TARGET GENE. CD151 BINDING SITE1 and CD151 BINDING SITE2 are target binding sites found in untranslated regions of multiple transcripts of mRNA encoded by CD151, corresponding to target binding sites such as BINDING SITE I, BINDING SITE II or BINDING SITE III of FIG. 8. Table 4 illustrates the complementarity of the nucleotide sequences of CD151 BINDING SITE1 and CD151 BINDING SITE2, designated SEQ ID:5033 and SEQ ID:15477 respectively, to the nucleotide sequence of GAM139 RNA, herein designated GAM RNA, also designated SEQ ID:327.

Another function of GAM139 is therefore inhibition of Cd151 antigen (CD151, Accession NP_620599.1). Accordingly, utilities of GAM139 include diagnosis, prevention and treatment of diseases and clinical conditions associated with CD151.

Cd151 antigen (CD151, Accession NP_620599.1) is another GAM139 target gene, herein designated TARGET GENE. CD151 BINDING SITE1 and CD151 BINDING SITE2 are target binding sites found in untranslated regions of multiple transcripts of mRNA encoded by CD151, corresponding to target binding sites such as BINDING SITE I, BINDING SITE II or BINDING SITE III of FIG. 8. Table 4 illustrates the complementarity of the nucleotide sequences of CD151 BINDING SITE1 and CD151 BINDING SITE2, designated SEQ ID:15477 and SEQ ID:5033 respectively, to the nucleotide sequence of GAM139 RNA, herein designated GAM RNA, also designated SEQ ID:327.

Another function of GAM139 is therefore inhibition of Cd151 antigen (CD151, Accession NP_620599.1). Accordingly, utilities of GAM139 include diagnosis, prevention and treatment of diseases and clinical conditions associated with CD151.

Cd1b antigen, b polypeptide (CD1B, Accession NP_001755.1) is another GAM139 target gene, herein designated TARGET GENE. CD1B BINDING SITE1 and CD1B BINDING SITE2 are target binding sites found in untranslated regions of mRNA encoded by CD1B, corresponding to target binding sites such as BINDING SITE I, BINDING SITE II or BINDING SITE III of FIG. 8. Table 4 illustrates the complementarity of the nucleotide sequences of CD1B BINDING SITE1 and CD1B BINDING SITE2, designated SEQ ID:6775 and SEQ ID:9277 respectively, to the nucleotide sequence of GAM139 RNA, herein designated GAM RNA, also designated SEQ ID:327.

Another function of GAM139 is therefore inhibition of Cd1b antigen, b polypeptide (CD1B, Accession NP_001755.1), a gene which is member B of the CD1 family and involved in antigen presentation. Accordingly, utilities of GAM139 include diagnosis, prevention and treatment of diseases and clinical conditions associated with CD1B.

The function of CD1B has been established by previous studies. CD1B is a group 1 member of the CD1 family of major histocompatibility (MHC)- like glycoproteins. See CD1A (OMIM Ref. No. 188370) for background on CD1 molecules. Beckman et al. (1994) and Sieling et al. (1995) showed that T cells can recognize not only peptide antigens presented by classical MHC molecules, but also virulence-associated mycobacterial lipid antigens such as mycolic acids and lipoarabinomannan (LAM) derivatives, respectively, presented to TCRA (OMIM Ref. No. 186880)/TCRB+ (OMIM Ref. No. 186930) CD4-CD8- T cells by CD1B-bearing antigen-presenting cells (APCs). Sieling et al. (1995) found that LAM recognition requires internalization and acidification in the endosomal compartment before presentation on the APC surface. Examining dermal leprosy (OMIM Ref. No. 246300) lesions by immunohistochemistry from patients with the tuberculoid form of the disease, associated with high specific cell-mediated immunity (CMI), Sieling et al. (1999) observed strong induction of CD1A, CD1B, and CD1C (OMIM Ref. No. 188340) expression. In contrast, lesions from patients with the lepromatous form, associated with weak or absent M. leprae-specific CMI, do not express CD1 antigens. Moreover, by 2-color immunofluorescence analysis, Sieling et al. (1999) demonstrated that the cells expressing CD1 antigens are CD83+ (OMIM Ref. No. 604534) dendritic cells, which are also highly efficient APCs for CD1B-restricted T cells in vitro. In a review of CD1 lipid antigen presentation, Park and Bendelac (2000) noted that lipid binding might occur in the secretory pathway, at the cell surface, or only after internalization in an acidified compartment. CD1B is located in the late endosome or lysosome. Access to the endocytic pathway is regulated by a tyrosine-based motif in the cytoplasmic tail of CD1 that differs among CD1B, CD1C, and CD1D (OMIM Ref. No. 188410).

Full details of the abovementioned studies are described in the following publications, the disclosure of which are hereby incorporated by reference:

Sieling, P. A.; Jullien, D.; Dahlem, M.; Tedder, T. F.; Rea, T. H.; Modlin, R. L.; Porcelli, S. A.: CD1 expression by dendritic cells in human leprosy lesions: correlation with effective host immunity. J. Immun. 162:1851-1858, 1999; and Park, S.-H.; Bendelac, A.: CD1-restricted T-cell responses and microbial infection. Nature 406:788-792, 2000.

Further studies establishing the function and utilities of CD1B are found in John Hopkins OMIM database record ID 188360, and in cited publications listed in Table 5, which are hereby incorporated by reference. Cd79a antigen (immunoglobulin-associated alpha) (CD79A, Accession NP_067612.1) is another GAM139 target gene, herein designated TARGET GENE. CD79A BINDING SITE is a target binding site found in the 3' untranslated region of multiple transcripts of mRNA encoded by CD79A, corresponding to a target binding site such as BINDING SITE I, BINDING SITE II or BINDING SITE III of FIG. 8. Table 4 illustrates the complementarity of the nucleotide sequences of CD79A BINDING SITE, designated SEQ ID:9511, to the nucleotide sequence of GAM139 RNA, herein designated GAM RNA, also designated SEQ ID:327.

Another function of GAM139 is therefore inhibition of Cd79a antigen (immunoglobulin-associated alpha) (CD79A, Accession NP_067612.1), a gene which may ba associated with surface immunoglobulin on B cells and involved in signal transduction. Accordingly, utilities of GAM139 include diagnosis, prevention and treatment of diseases and clinical conditions associated with CD79A.

The function of CD79A has been established by previous studies. The mouse mb1 gene was originally identified on the basis of its restricted expression in lymphocytes of B lineage. Predicted structural homology with the gamma chain of the CD3 complex of T cells (OMIM Ref. No. 186740) led to the suggestion that the MB1 protein may associate with surface immunoglobulin on B cells and be involved in signal transduction. To identify genes specifically expressed in normal human B cells, Ha et al. (1992) constructed a B minus T lymphocyte subtraction library and isolated a cDNA clone highly homologous to murine mb1. The full-length cDNA was found to encode a membrane glycoprotein of 226 amino acids which showed striking homology to the mouse mb1 through much of its structure. The B-cell antigen receptor complex consists of a clonally restricted antigen binding molecule (membrane Ig) associated noncovalently with an 'invariant' transducer/transporter complex, the CD79A/CD79B (alternatively known as Ig-alpha/Ig-beta) heterodimer; see review by Reth (1992). Hashimoto et al. (1994) determined the germline DNA sequence of the human IGA gene by PCR sequencing of a cosmid clone derived from an arrayed human chromosome 19 library. The IGA gene was localized to 19q13.2 in a site within the CEA (OMIM Ref. No. 114890)-like gene cluster. The initial assignment to chromosome 19 was done by searching a hamster/human somatic cell DNA panel for PCR products of a predicted size. Once the gene was localized to chromosome 19, a 19-enriched cosmid library was screened by Southern blotting with the identification of 6 probe-positive cosmids. These studies, as well as fluorescence in situ hybridization, precisely mapped the gene to 19q13.2. The gene was found to reside on a contig between CGM1, a member of the CEA family, and biliary glycoprotein I (BGP1; 109770), which are separated by less than 600 kb. Like the mouse counterpart, the human IGA gene has 5 exons interrupted by 4 introns Full details of the abovementioned studies are described in the following publications, the disclosure of which are hereby incorporated by reference:

Ha, H.; Kubagawa, H.; Burrows, P. D.: Molecular cloning and expression pattern of a human gene homologous to the murine mb-1 gene. J. Immun. 148:1526-1531, 1992; and Hashimoto, S.; Mohrenweiser, H. W.; Gregersen, P. K.; Chiorazzi, N.: Chromosomal localization, genomic structure, and allelic polymorphism of the human CD79a (Ig- alpha/mb-1) gene. Immun.

Further studies establishing the function and utilities of CD79A are found in John Hopkins OMIM database record ID 112205, and in cited publications listed in Table 5, which are hereby incorporated by reference. Cd79a antigen (immunoglobulin-associated alpha) (CD79A, Accession NP_001774.1) is another GAM139 target gene, herein designated TARGET GENE. CD79A BINDING SITE is a target binding site found in the 3' untranslated region of multiple transcripts of mRNA encoded by CD79A, corresponding to a target binding site such as BINDING SITE I, BINDING SITE II or BINDING SITE III of FIG. 8. Table 4 illustrates the complementarity of the nucleotide sequences of CD79A BINDING SITE, designated SEQ ID:9511, to the nucleotide sequence of GAM139 RNA, herein designated GAM RNA, also designated SEQ ID:327.

Another function of GAM139 is therefore inhibition of Cd79a antigen (immunoglobulin-associated alpha) (CD79A, Accession NP_001774.1), a gene which may ba associated with surface immunoglobulin on B cells and involved in signal transduction. Accordingly, utilities of GAM139 include diagnosis, prevention and treatment of diseases and clinical conditions associated with CD79A.

The function of CD79A has been established by previous studies. The mouse mb1 gene was originally identified on the basis of its restricted expression in lymphocytes of B lineage. Predicted structural homology with the gamma chain of the CD3 complex of T cells (OMIM Ref. No. 186740) led to the suggestion that the MB1 protein may associate with surface immunoglobulin on B cells and be involved in signal transduction. To identify genes specifically expressed in normal human B cells, Ha et al. (1992) constructed a B minus T lymphocyte subtraction library and isolated a cDNA clone highly homologous to murine mb1. The full-length cDNA was found to encode a membrane glycoprotein of 226 amino acids which showed striking homology to the mouse mb1 through much of its structure. The B-cell antigen receptor complex consists of a clonally restricted antigen binding molecule (membrane Ig) associated noncovalently with an 'invariant' transducer/transporter complex, the CD79A/CD79B (alternatively known as Ig-alpha/Ig-beta) heterodimer; see review by Reth (1992). Hashimoto et al. (1994) determined the germline DNA sequence of the human IGA gene by PCR sequencing of a cosmid clone derived from an arrayed human chromosome 19 library. The IGA gene was localized to 19q13.2 in a site within the CEA (OMIM Ref. No. 114890)-like gene cluster. The initial assignment to chromosome 19 was done by searching a hamster/human somatic cell DNA panel for PCR products of a predicted size. Once the gene was localized to chromosome 19, a 19-enriched cosmid library was screened by Southern blotting with the identification of 6 probe-positive cosmids. These studies, as well as fluorescence in situ hybridization, precisely mapped the gene to 19q13.2. The gene was found to reside on a contig between CGM1, a member of the CEA family, and biliary glycoprotein I (BGP1; 109770), which are separated by less than 600 kb. Like the mouse counterpart, the human IGA gene has 5 exons interrupted by 4 introns Full details of the abovementioned studies are described in the following publications, the disclosure of which are hereby incorporated by reference:

Ha, H.; Kubagawa, H.; Burrows, P. D.: Molecular cloning and expression pattern of a human gene homologous to the murine mb-1 gene. J. Immun. 148:1526-1531, 1992; and Hashimoto, S.; Mohrenweiser, H. W.; Gregersen, P. K.; Chiorazzi, N.: Chromosomal localization, genomic structure, and allelic polymorphism of the human CD79a (Ig- alpha/mb-1) gene. Immun.

Further studies establishing the function and utilities of CD79A are found in John Hopkins OMIM database record ID 112205, and in cited publications listed in Table 5, which are hereby incorporated by reference. Cd80 antigen (cd28 antigen ligand 1, b7-1 antigen) (CD80, Accession NP_005182.1) is another GAM139 target gene, herein designated TARGET GENE. CD80 BINDING SITE is a target binding site found in the 3' untranslated region of mRNA encoded by CD80, corresponding to a target binding site such as BINDING SITE I, BINDING SITE II or BINDING SITE III of FIG. 8. Table 4 illustrates the complementarity of the nucleotide sequences of CD80 BINDING SITE, designated SEQ ID:14816, to the nucleotide sequence of GAM139 RNA, herein designated GAM RNA, also designated SEQ ID:327.

Another function of GAM139 is therefore inhibition of Cd80 antigen (cd28 antigen ligand 1, b7-1 antigen) (CD80, Accession NP_005182.1), a gene which provides regulatory signals for T lymphocytes. Accordingly, utilities of GAM139 include diagnosis, prevention and treatment of diseases and clinical conditions associated with CD80.

The function of CD80 and its association with various diseases and clinical conditions, has been established by previous studies, as described hereinabove with reference to GAM66.2. Cd97 antigen (CD97, Accession NP_510966.1) is another GAM139 target gene, herein designated TARGET GENE. CD97 BINDING SITE is a target binding site found in the 3' untranslated region of multiple transcripts of mRNA encoded by CD97, corresponding to a target binding site such as BINDING SITE I, BINDING SITE II or BINDING SITE III of FIG. 8. Table 4 illustrates the complementarity of the nucleotide sequences of CD97 BINDING SITE, designated SEQ ID:830, to the nucleotide sequence of GAM139 RNA, herein designated GAM RNA, also designated SEQ ID:327.

Another function of GAM139 is therefore inhibition of Cd97 antigen (CD97, Accession NP_510966.1). Accordingly, utilities of GAM139 include diagnosis, prevention and treatment of diseases and clinical conditions associated with CD97.

Cd97 antigen (CD97, Accession NP_001775.2) is another GAM139 target gene, herein designated TARGET GENE. CD97 BINDING SITE is a target binding site found in the 3' untranslated region of multiple transcripts of mRNA encoded by CD97, corresponding to a target binding site such as BINDING SITE I, BINDING SITE II or BINDING SITE III of FIG. 8. Table 4 illustrates the complementarity of the nucleotide sequences of CD97 BINDING SITE, designated SEQ ID:830, to the nucleotide sequence of GAM139 RNA, herein designated GAM RNA, also designated SEQ ID:327.

Another function of GAM139 is therefore inhibition of Cd97 antigen (CD97, Accession NP_001775.2). Accordingly, utilities of GAM139 include diagnosis, prevention and treatment of diseases and clinical conditions associated with CD97.

Cell division cycle 42 (gtp binding protein, 25 kda) (CDC42, Accession NP_001782.1) is another GAM139 target gene, herein designated TARGET GENE. CDC42 BINDING SITE is a target binding site found in the 3' untranslated region of multiple transcripts of mRNA encoded by CDC42, corresponding to a target binding site such as BINDING SITE I, BINDING SITE II or BINDING SITE III of FIG. 8. Table 4 illustrates the complementarity of the nucleotide sequences of CDC42 BINDING SITE, designated SEQ ID:17563, to the nucleotide sequence of GAM139 RNA, herein designated GAM RNA, also designated SEQ ID:327.

Another function of GAM139 is therefore inhibition of Cell division cycle 42 (gtp binding protein, 25 kda) (CDC42, Accession NP_001782.1). Accordingly, utilities of GAM139 include diagnosis, prevention and treatment of diseases and clinical conditions associated with CDC42.

Cadherin 12, type 2 (n-cadherin 2) (CDH12, Accession NP_004052.2) is another GAM139 target gene, herein designated TARGET GENE. CDH12 BINDING SITE is a target binding site found in the 5' untranslated region of mRNA encoded by CDH12, corresponding to a target binding site such as BINDING SITE I, BINDING SITE II or BINDING SITE III of FIG. 8. Table 4 illustrates the complementarity of the nucleotide sequences of CDH12 BINDING SITE, designated SEQ ID:12987, to the nucleotide sequence of GAM139 RNA, herein designated GAM RNA, also designated SEQ ID:327.

Another function of GAM139 is therefore inhibition of Cadherin 12, type 2 (n-cadherin 2) (CDH12, Accession NP_004052.2). Accordingly, utilities of GAM139 include diagnosis, prevention and treatment of diseases and clinical conditions associated with CDH12.

Cyclin-dependent kinase inhibitor 1a (p21, cip1) (CDKN1A, Accession NP_510867.1) is another GAM139 target gene, herein designated TARGET GENE. CDKN1A BINDING SITE is a target binding site found in the 5' untranslated region of multiple transcripts of mRNA encoded by CDKN1A, corresponding to a target binding site such as BINDING SITE I, BINDING SITE II or BINDING SITE III of FIG. 8. Table 4 illustrates the complementarity of the nucleotide sequences of CDKN1A BINDING SITE, designated SEQ ID:10006, to the nucleotide sequence of GAM139 RNA, herein designated GAM RNA, also designated SEQ ID:327.

Another function of GAM139 is therefore inhibition of Cyclin-dependent kinase inhibitor 1a (p21, cip1) (CDKN1A, Accession NP_510867.1), a gene which inhibits cyclin-kinase activity and probably serves as the effector of p53 cell cycle control. and therefore may be associated with Lung cancer. Accordingly, utilities of GAM139 include diagnosis, prevention and treatment of Lung cancer, and of other diseases and clinical conditions associated with CDKN1A.

The function of CDKN1A has been established by previous studies. The preferred name and symbol for this gene are cyclin-dependent kinase inhibitor-1A (OMIM Ref. No. CDKN1A). Also referred to as p21 and as CDKN1, this protein inhibits cyclin-kinase activity, is tightly regulated at the transcriptional level by p53, and probably serves as the effector of p53 cell cycle control. The ability of p53 (OMIM Ref. No. 191170) to activate transcription from specific sequences suggests that genes induced by p53 may mediate its biologic role as a tumor suppressor. Using a subtractive hybridization approach, El-Deiry et al. (1993) identified a gene they called WAF1 (for wildtype p53-activated fragment 1), whose induction was associated with wildtype but not mutant p53 gene expression in a human brain tumor cell line. El-Deiry et al. (1993) found that the sequence, structure, and activation by p53 was conserved in rodents. Introduction of WAF1 cDNA suppressed the growth of human brain, lung, and colon tumor cells in culture. Using a yeast enhancer trap, they identified a p53-binding site 2.4 kb upstream of WAF1 coding sequences. The WAF1 promoter, including this p53-binding site, conferred p53-dependent inducibility upon a heterologous reporter gene. After acceptance of their paper for publication, El-Deiry et al. (1993) learned that Harper et al. (1993) had identified a gene, called CIP1, whose product binds to cyclin complexes and inhibits the function of cyclin-dependent kinases. They found that the sequence of CIP1, described by Harper et al. (1993) in the same issue of Cell, was identical to that of WAF1. The results provided a dramatic example of the interplay between tumor suppressor genes and the cell cycle.

Full details of the abovementioned studies are described in the following publications, the disclosure of which are hereby incorporated by reference:

El-Deiry, W. S.; Tokino, T.; Velculescu, V. E.; Levy, D. B.; Parsons, R.; Trent, J. M.; Lin, D.; Mercer, E.; Kinzler, K. W.; Vogelstein, B.: WAF1, a potential mediator of p53 tumor suppression. Cell 75:817-825, 1993; and Harper, J. W.; Adami, G. R.; Wei, N.; Keyomarsi, K.; Elledge, S. J.: The p21 Cdk-interacting protein Cip1 is a potent inhibitor of G1 cyclin- dependent kinases. Cell 75:805-816, 1993.

Further studies establishing the function and utilities of CDKN1A are found in John Hopkins OMIM database record ID 116899, and in cited publications listed in Table 5, which are hereby incorporated by reference. CDW92 (Accession NP_536856.2) is another GAM139 target gene, herein designated TARGET GENE. CDW92 BINDING SITE is a target binding site found in the 3' untranslated region of mRNA encoded by CDW92, corresponding to a target binding site such as BINDING SITE I, BINDING SITE II or BINDING SITE III of FIG. 8. Table 4 illustrates the complementarity of the nucleotide sequences of CDW92 BINDING SITE, designated SEQ ID:14794, to the nucleotide sequence of GAM139 RNA, herein designated GAM RNA, also designated SEQ ID:327.

Another function of GAM139 is therefore inhibition of CDW92 (Accession NP_536856.2). Accordingly, utilities of GAM139 include diagnosis, prevention and treatment of diseases and clinical conditions associated with CDW92.

Ceroid-lipofuscinosis, neuronal 8 (epilepsy, progressive with mental retardation) (CLN8, Accession NP_061764.2) is another GAM139 target gene, herein designated TARGET GENE. CLN8 BINDING SITE is a target binding site found in the 3' untranslated region of mRNA encoded by CLN8, corresponding to a target binding site such as BINDING SITE I, BINDING SITE II or BINDING SITE III of FIG. 8. Table 4 illustrates the complementarity of the nucleotide sequences of CLN8 BINDING SITE, designated SEQ ID:2997, to the nucleotide sequence of GAM139 RNA, herein designated GAM RNA, also designated SEQ ID:327.

Another function of GAM139 is therefore inhibition of Ceroid-lipofuscinosis, neuronal 8 (epilepsy, progressive with mental retardation) (CLN8, Accession NP_061764.2). Accordingly, utilities of GAM139 include diagnosis, prevention and treatment of diseases and clinical conditions associated with CLN8.

Calponin 1, basic, smooth muscle (CNN1, Accession NP_001290.2) is another GAM139 target gene, herein designated TARGET GENE. CNN1 BINDING SITE is a target binding site found in the 3' untranslated region of mRNA encoded by CNN1, corresponding to a target binding site such as BINDING SITE I, BINDING SITE II or BINDING SITE III of FIG. 8. Table 4 illustrates the complementarity of the nucleotide sequences of CNN1 BINDING SITE, designated SEQ ID:15985, to the nucleotide sequence of GAM139 RNA, herein designated GAM RNA, also designated SEQ ID:327.

Another function of GAM139 is therefore inhibition of Calponin 1, basic, smooth muscle (CNN1, Accession NP_001290.2), a gene which is able to inhibit the ATPase activity of myosin and may play a role in smooth muscle contraction. Accordingly, utilities of GAM139 include diagnosis, prevention and treatment of diseases and clinical conditions associated with CNN1.

The function of CNN1 and its association with various diseases and clinical conditions, has been established by previous studies, as described hereinabove with reference to GAM69.1. CPR8 (Accession NP_004739.2) is another GAM139 target gene, herein designated TARGET GENE. CPR8 BINDING SITE is a target binding site found in the 5' untranslated region of multiple transcripts of mRNA encoded by CPR8, corresponding to a target binding site such as BINDING SITE I, BINDING SITE II or BINDING SITE III of FIG. 8. Table 4 illustrates the complementarity of the nucleotide sequences of CPR8 BINDING SITE, designated SEQ ID:4018, to the nucleotide sequence of GAM139 RNA, herein designated GAM RNA, also designated SEQ ID:327.

Another function of GAM139 is therefore inhibition of CPR8 (Accession NP_004739.2). Accordingly, utilities of GAM139 include diagnosis, prevention and treatment of diseases and clinical conditions associated with CPR8.

C-src tyrosine kinase (CSK, Accession NP_004374.1) is another GAM139 target gene, herein designated TARGET GENE. CSK BINDING SITE is a target binding site found in the 3' untranslated region of mRNA encoded by CSK, corresponding to a target binding site such as BINDING SITE I, BINDING SITE II or BINDING SITE III of FIG. 8. Table 4 illustrates the complementarity of the nucleotide sequences of CSK BINDING SITE, designated SEQ ID:3625, to the nucleotide sequence of GAM139 RNA, herein designated GAM RNA, also designated SEQ ID:327.

Another function of GAM139 is therefore inhibition of C-src tyrosine kinase (CSK, Accession NP_004374.1), a gene which down-regulates antigen receptor signaling in T lymphocytes and the c-src oncoprotein. Accordingly, utilities of GAM139 include diagnosis, prevention and treatment of diseases and clinical conditions associated with CSK.

The function of CSK has been established by previous studies. Partanen et al. (1991) cloned a novel cytoplasmic tyrosine kinase designated CSK. This tyrosine kinase was shown to downregulate the tyrosine kinase activity of the c-src oncoprotein (OMIM Ref. No. 190090) through tyrosine phosphorylation of the c-src carboxy terminus. Since cell transformation by SRC oncoproteins is caused by various mechanisms that interfere with this phosphorylation, the CSK gene might function as an antioncogene (Armstrong et al., 1992). The CSK gene is ubiquitously expressed in human tissues as 2 mRNA species of 2.6 and 3.4 kb, although in some tissues and cell lines, only the larger mRNA is detected Cloutier and Veillette (1996) used the yeast 2-hybrid system to identify proteins associated with CSK. They found that the Src homology-3 (SH3) domain of CSK associates with a proline-rich region of PEP (OMIM Ref. No. 600716), a protein-tyrosine phosphatase expressed in hemopoietic cells. Cloutier and Veillette (1996) showed that this association is highly specific and speculated that PEP may be an effector and/or regulator of CSK in T cells and other hemopoietic cells Full details of the abovementioned studies are described in the following publications, the disclosure of which are hereby incorporated by reference:

Armstrong, E.; Cannizzaro, L.; Bergman, M.; Huebner, K.; Alitalo, K.: The c-src tyrosine kinase (CSK) gene, a potential antioncogene, localizes to human chromosome region 15q23-q25. Cytogenet. Cell Genet. 60:119-120, 1992; and Cloutier, J.-F.; Veillette, A.: Association of inhibitory tyrosine protein kinase p50(csk) with protein tyrosine phosphatase PEP in T cells and other hemopoietic cells. EMBO J. 15:4909.

Further studies establishing the function and utilities of CSK are found in John Hopkins OMIM database record ID 124095, and in cited publications listed in Table 5, which are hereby incorporated by reference. DC-TM4F2 (Accession NP_112189.1) is another GAM139 target gene, herein designated TARGET GENE. DC-TM4F2 BINDING SITE is a target binding site found in the 3' untranslated region of mRNA encoded by DC-TM4F2, corresponding to a target binding site such as BINDING SITE I, BINDING SITE II or BINDING SITE III of FIG. 8. Table 4 illustrates the complementarity of the nucleotide sequences of DC-TM4F2 BINDING SITE, designated SEQ ID:16599, to the nucleotide sequence of GAM139 RNA, herein designated GAM RNA, also designated SEQ ID:327.

Another function of GAM139 is therefore inhibition of DC-TM4F2 (Accession NP_112189.1). Accordingly, utilities of GAM139 include diagnosis, prevention and treatment of diseases and clinical conditions associated with DC-TM4F2.

Dead/h (asp-glu-ala-asp/his) box polypeptide 9 (rna helicase a, nuclear dna helicase ii; leukophysin) (DDX9, Accession NP_085077.1) is another GAM139 target gene, herein designated TARGET GENE. DDX9 BINDING SITE is a target binding site found in the 5' untranslated region of multiple transcripts of mRNA encoded by DDX9, corresponding to a target binding site such as BINDING SITE I, BINDING SITE II or BINDING SITE III of FIG. 8. Table 4 illustrates the complementarity of the nucleotide sequences of DDX9 BINDING SITE, designated SEQ ID:7248, to the nucleotide sequence of GAM139 RNA, herein designated GAM RNA, also designated SEQ ID:327.

Another function of GAM139 is therefore inhibition of Dead/h (asp-glu-ala-asp/his) box polypeptide 9 (rna helicase a, nuclear dna helicase ii; leukophysin) (DDX9, Accession NP_085077.1), a gene which plays an important role in transcription, RNA processing, translation, and RNA replication. Accordingly, utilities of GAM139 include diagnosis, prevention and treatment of diseases and clinical conditions associated with DDX9.

The function of DDX9 has been established by previous studies. RNA helicases play important roles in transcription, RNA processing, translation, and RNA replication. DEAD box proteins are putative RNA helicases that have a characteristic Asp-Glu-Ala- Asp (DEAD) box as 1 of 8 highly conserved sequence motifs. See 600396. The Drosophila 'maleless' (MLE) RNA helicase is thought to act as a regulator of X-linked gene expression. Lee and Hurwitz (1992) isolated and characterized human RNA helicase A, an abundant 130-kD nuclear enzyme of HeLa cells that unwinds double-stranded RNA in a 3-prime to 5-prime direction. By screening a HeLa cell expression library with antibodies against RNA helicase A, Lee and Hurwitz (1993) identified cDNAs encoding the enzyme. The predicted 1,279-amino acid protein shares sequence homology with the Drosophila MLE protein and other members of the DEAH subfamily of RNA helicases. The amino acid sequences of MLE and RNA helicase A are 49% identical, and antibodies against MLE recognize RNA helicase A. Northern blot analysis of HeLa cell RNA revealed RNA helicase A expression as a 4.2-kb transcript. Lee et al. (1998) isolated mouse RNA helicase A cDNAs. The predicted mouse and human proteins share 87% identity. Zhang et al. (1995) identified bovine nuclear DNA helicase II (NDHII) as the homolog of human RNA helicase A. Bovine NDHII unwinds both DNA and RNA. Zhang and Grosse (1997) demonstrated that recombinant human RNA helicase A, or NDHII, also unwinds both double-stranded RNA and double-stranded DNA in an ATP-dependent manner. They reported that the protein contains 2 copies of a double-stranded RNA-binding domain at its N terminus, a DEIH helicase core, and a C-terminal RGG box nucleic acid-binding domain. By analysis of mutant proteins, Zhang and Grosse (1997) found that the RNA-binding domains and RGG box influence and regulate RNA helicase A activity. They suggested a model in which RNA helicase A participates in melting of DNA:RNA hybrids, such as those that occur during transcription.

Full details of the abovementioned studies are described in the following publications, the disclosure of which are hereby incorporated by reference:

Lee, C.-G.; Hurwitz, J.: Human RNA helicase A is homologous to the maleless protein of Drosophila. J. Biol. Chem. 268:16822-16830, 1993; and Lee, C. G.; Hurwitz, J.: A new RNA helicase isolated from HeLa cells that catalytically translocates in the 3-prime to 5-prime direction. J. Biol. Chem. 267:4398-4407, 1992.

Further studies establishing the function and utilities of DDX9 are found in John Hopkins OMIM database record ID 603115, and in cited publications listed in Table 5, which are hereby incorporated by reference. Digeorge syndrome critical region gene 2 (DGCR2, Accession NP_005128.1) is another GAM139 target gene, herein designated TARGET GENE. DGCR2 BINDING SITE1 and DGCR2 BINDING SITE2 are target binding sites found in untranslated regions of mRNA encoded by DGCR2, corresponding to target binding sites such as BINDING SITE I, BINDING SITE II or BINDING SITE III of FIG. 8. Table 4 illustrates the complementarity of the nucleotide sequences of DGCR2 BINDING SITE1 and DGCR2 BINDING SITE2, designated SEQ ID:10100 and SEQ ID:10383 respectively, to the nucleotide sequence of GAM139 RNA, herein designated GAM RNA, also designated SEQ ID:327.

Another function of GAM139 is therefore inhibition of Digeorge syndrome critical region gene 2 (DGCR2, Accession NP_005128.1), a gene which is putative adhesion receptor and intervenes in cell-cell or cell-matrix interactions and therefore may be associated with Digeorge syndrome. Accordingly, utilities of GAM139 include diagnosis, prevention and treatment of Digeorge syndrome, and of other diseases and clinical conditions associated with DGCR2.

The function of DGCR2 and its association with various diseases and clinical conditions, has been established by previous studies, as described hereinabove with reference to GAM84.1. DIM1 (Accession NP_006692.1) is another GAM139 target gene, herein designated TARGET GENE. DIM1 BINDING SITE is a target binding site found in the 3' untranslated region of mRNA encoded by DIM1, corresponding to a target binding site such as BINDING SITE I, BINDING SITE II or BINDING SITE III of FIG. 8. Table 4 illustrates the complementarity of the nucleotide sequences of DIM1 BINDING SITE, designated SEQ ID:5268, to the nucleotide sequence of GAM139 RNA, herein designated GAM RNA, also designated SEQ ID:327.

Another function of GAM139 is therefore inhibition of DIM1 (Accession NP_006692.1). Accordingly, utilities of GAM139 include diagnosis, prevention and treatment of diseases and clinical conditions associated with DIM1.

DKFZP434H132 (Accession NP_056307.1) is another GAM139 target gene, herein designated TARGET GENE. DKFZP434H132 BINDING SITE is a target binding site found in the 5' untranslated region of mRNA encoded by DKFZP434H132, corresponding to a target binding site such as BINDING SITE I, BINDING SITE II or BINDING SITE III of FIG. 8. Table 4 illustrates the complementarity of the nucleotide sequences of DKFZP434H132 BINDING SITE, designated SEQ ID:18675, to the nucleotide sequence of GAM139 RNA, herein designated GAM RNA, also designated SEQ ID:327.

Another function of GAM139 is therefore inhibition of DKFZP434H132 (Accession NP_056307.1). Accordingly, utilities of GAM139 include diagnosis, prevention and treatment of diseases and clinical conditions associated with DKFZP434H132.

DKFZp434N035 (Accession NP_115638.1) is another GAM139 target gene, herein designated TARGET GENE. DKFZp434N035 BINDING SITE1 and DKFZp434N035 BINDING SITE2 are target binding sites found in untranslated regions of mRNA encoded by DKFZp434N035, corresponding to target binding sites such as BINDING SITE I, BINDING SITE II or BINDING SITE III of FIG. 8. Table 4 illustrates the complementarity of the nucleotide sequences of DKFZp434N035 BINDING SITE1 and DKFZp434N035 BINDING SITE2, designated SEQ ID:19517 and SEQ ID:4696 respectively, to the nucleotide sequence of GAM139 RNA, herein designated GAM RNA, also designated SEQ ID:327.

Another function of GAM139 is therefore inhibition of DKFZp434N035 (Accession NP_115638.1). Accordingly, utilities of GAM139 include diagnosis, prevention and treatment of diseases and clinical conditions associated with DKFZp434N035.

DKFZp434O0320 (Accession XP_097012.2) is another GAM139 target gene, herein designated TARGET GENE. DKFZp434O0320 BINDING SITE is a target binding site found in the 3' untranslated region of mRNA encoded by DKFZp434O0320, corresponding to a target binding site such as BINDING SITE I, BINDING SITE II or BINDING SITE III of FIG. 8. Table 4 illustrates the complementarity of the nucleotide sequences of DKFZp434O0320 BINDING SITE, designated SEQ ID:5662, to the nucleotide sequence of GAM139 RNA, herein designated GAM RNA, also designated SEQ ID:327.

Another function of GAM139 is therefore inhibition of DKFZp434O0320 (Accession XP_097012.2). Accordingly, utilities of GAM139 include diagnosis, prevention and treatment of diseases and clinical conditions associated with DKFZp434O0320.

DKFZp547I048 (Accession XP_302775.1) is another GAM139 target gene, herein designated TARGET GENE. DKFZp547I048 BINDING SITE is a target binding site found in the 3' untranslated region of mRNA encoded by DKFZp547I048, corresponding to a target binding site such as BINDING SITE I, BINDING SITE II or BINDING SITE III of FIG. 8. Table 4 illustrates the complementarity of the nucleotide sequences of DKFZp547I048 BINDING SITE, designated SEQ ID:13133, to the nucleotide sequence of GAM139 RNA, herein designated GAM RNA, also designated SEQ ID:327.

Another function of GAM139 is therefore inhibition of DKFZp547I048 (Accession XP_302775.1). Accordingly, utilities of GAM139 include diagnosis, prevention and treatment of diseases and clinical conditions associated with DKFZp547I048.

DKFZP564O0823 (Accession NP_056208.1) is another GAM139 target gene, herein designated TARGET GENE. DKFZP564O0823 BINDING SITE is a target binding site found in the 3' untranslated region of mRNA encoded by DKFZP564O0823, corresponding to a target binding site such as BINDING SITE I, BINDING SITE II or BINDING SITE III of FIG. 8. Table 4 illustrates the complementarity of the nucleotide sequences of DKFZP564O0823 BINDING SITE, designated SEQ ID:18382, to the nucleotide sequence of GAM139 RNA, herein designated GAM RNA, also designated SEQ ID:327.

Another function of GAM139 is therefore inhibition of DKFZP564O0823 (Accession NP_056208.1). Accordingly, utilities of GAM139 include diagnosis, prevention and treatment of diseases and clinical conditions associated with DKFZP564O0823.

Dedicator of cyto - kinesis 1 (DOCK1, Accession NP_001371.1) is another GAM139 target gene, herein designated TARGET GENE. DOCK1 BINDING SITE is a target binding site found in the 3' untranslated region of mRNA encoded by DOCK1, corresponding to a target binding site such as BINDING SITE I, BINDING SITE II or BINDING SITE III of FIG. 8. Table 4 illustrates the complementarity of the nucleotide sequences of DOCK1 BINDING SITE, designated SEQ ID:5679, to the nucleotide sequence of GAM139 RNA, herein designated GAM RNA, also designated SEQ ID:327.

Another function of GAM139 is therefore inhibition of Dedicator of cyto - kinesis 1 (DOCK1, Accession NP_001371.1), a gene which may function in the extension of cell surfaces. Accordingly, utilities of GAM139 include diagnosis, prevention and treatment of diseases and clinical conditions associated with DOCK1.

The function of DOCK1 and its association with various diseases and clinical conditions, has been established by previous studies, as described hereinabove with reference to GAM129.1. Dedicator of cyto - kinesis 2 (DOCK2, Accession NP_004937.1) is another GAM139 target gene, herein designated TARGET GENE. DOCK2 BINDING SITE is a target binding site found in the 3' untranslated region of multiple transcripts of mRNA encoded by DOCK2, corresponding to a target binding site such as BINDING SITE I, BINDING SITE II or BINDING SITE III of FIG. 8. Table 4 illustrates the complementarity of the nucleotide sequences of DOCK2 BINDING SITE, designated SEQ ID:17284, to the nucleotide sequence of GAM139 RNA, herein designated GAM RNA, also designated SEQ ID:327.

Another function of GAM139 is therefore inhibition of Dedicator of cyto - kinesis 2 (DOCK2, Accession NP_004937.1). Accordingly, utilities of GAM139 include diagnosis, prevention and treatment of diseases and clinical conditions associated with DOCK2.

Dedicator of cyto - kinesis 2 (DOCK2, Accession XP_047961.5) is another GAM139 target gene, herein designated TARGET GENE. DOCK2 BINDING SITE is a target binding site found in the 3' untranslated region of multiple transcripts of mRNA encoded by DOCK2, corresponding to a target binding site such as BINDING SITE I, BINDING SITE II or BINDING SITE III of FIG. 8. Table 4 illustrates the complementarity of the nucleotide sequences of DOCK2 BINDING SITE, designated SEQ ID:17284, to the nucleotide sequence of GAM139 RNA, herein designated GAM RNA, also designated SEQ ID:327.

Another function of GAM139 is therefore inhibition of Dedicator of cyto - kinesis 2 (DOCK2, Accession XP_047961.5). Accordingly, utilities of GAM139 include diagnosis, prevention and treatment of diseases and clinical conditions associated with DOCK2.

ECE2 (Accession NP_055508.1) is another GAM139 target gene, herein designated TARGET GENE. ECE2 BINDING SITE1 and ECE2 BINDING SITE2 are target binding sites found in untranslated regions of mRNA encoded by ECE2, corresponding to target binding sites such as BINDING SITE I, BINDING SITE II or BINDING SITE III of FIG. 8. Table 4 illustrates the complementarity of the nucleotide sequences of ECE2 BINDING SITE1 and ECE2 BINDING SITE2, designated SEQ ID:11759 and SEQ ID:14658 respectively, to the nucleotide sequence of GAM139 RNA, herein designated GAM RNA, also designated SEQ ID:327.

Another function of GAM139 is therefore inhibition of ECE2 (Accession NP_055508.1). Accordingly, utilities of GAM139 include diagnosis, prevention and treatment of diseases and clinical conditions associated with ECE2.

EDEM (Accession NP_055489.1) is another GAM139 target gene, herein designated TARGET GENE. EDEM BINDING SITE is a target binding site found in the 3' untranslated region of mRNA encoded by EDEM, corresponding to a target binding site such as BINDING SITE I, BINDING SITE II or BINDING SITE III of FIG. 8. Table 4 illustrates the complementarity of the nucleotide sequences of EDEM BINDING SITE, designated SEQ ID:16207, to the nucleotide sequence of GAM139 RNA, herein designated GAM RNA, also designated SEQ ID:327.

Another function of GAM139 is therefore inhibition of EDEM (Accession NP_055489.1). Accordingly, utilities of GAM139 include diagnosis, prevention and treatment of diseases and clinical conditions associated with EDEM.

Endothelin 2 (EDN2, Accession NP_001947.1) is another GAM139 target gene, herein designated TARGET GENE. EDN2 BINDING SITE is a target binding site found in the 3' untranslated region of mRNA encoded by EDN2, corresponding to a target binding site such as BINDING SITE I, BINDING SITE II or BINDING SITE III of FIG. 8. Table 4 illustrates the complementarity of the nucleotide sequences of EDN2 BINDING SITE, designated SEQ ID:12597, to the nucleotide sequence of GAM139 RNA, herein designated GAM RNA, also designated SEQ ID:327.

Another function of GAM139 is therefore inhibition of Endothelin 2 (EDN2, Accession NP_001947.1), a gene which is a precursor of the hormone endothelin 2 which is an endothelium-derived vasoconstrictor peptide. Accordingly, utilities of GAM139 include diagnosis, prevention and treatment of diseases and clinical conditions associated with EDN2.

The function of EDN2 has been established by previous studies. The human endothelins represent a gene family comprised of endothelin-1 (OMIM Ref. No. 131240), endothelin-2, and endothelin-3 (OMIM Ref. No. 131242). Based on the deduced amino acid sequences of the cloned ET2 and ET3 genes, corresponding proteins have been chemically synthesized and their vasoconstrictor activities studied. Of the 3 isopeptides, ET-2 has the most potent vasoconstrictor activity. Ohkubo et al. (1990) cloned cDNAs encoding human ET-2 precursor from a cDNA library constructed with mRNA derived from the human renal adenocarcinoma cell line, ACHN, which specifically secretes immunoreactive ET-2. The cDNA was found to contain 1.3 kb and to encode the preproprotein consisting of 178 amino acid residues. Northern blot analysis of mRNA suggested that the transcript was 1.4 kb. Bloch et al. (1991) used a cDNA clone for endothelin-2 to map the EDN2 gene to 1pter-p21 in human-mouse somatic cell hybrids. Southern blot hybridization demonstrated a single gene in both the human and the rat genome. Bloch et al. (1991) cloned the rat gene; the rat peptide differed from the human peptide at only 1 of 21 residues and was identical to mouse vasoactive intestinal contractor peptide (VIC). They concluded, therefore, that VIC is the mouse and rat analog of the human EDN2 gene. By Southern blot analysis of somatic cell hybrid DNAs and by in situ hybridization, Arinami et al. (1991) confirmed the assignment of EDN2 to chromosome 1 and regionalized it to 1p34. Deng et al. (1994) found in the rat that the endothelin-2 gene is located on chromosome 5 and cosegregates strongly with systolic blood pressure in an F2 population derived from a cross of the Dahl salt-sensitive rat and the Lewis rat. Thus, ET2 is a quantitative trait locus (QTL) for blood pressure in the rat. ET1, ET3, and endothelin receptor type A (ETA; 131243) in the rat did not cosegregate with blood pressure in the several F2 populations tested.

Full details of the abovementioned studies are described in the following publications, the disclosure of which are hereby incorporated by reference:

Bloch, K. D.; Hong, C. C.; Eddy, R. L.; Shows, T. B.; Quertermous, T.: cDNA cloning and chromosomal assignment of the endothelin 2 gene: vasoactive intestinal contractor peptide is rat endothelin 2. Genomics 10:236-242, 1991; and Deng, A. Y.; Dene, H.; Pravenec, M.; Rapp, J. P.: Genetic mapping of two new blood pressure quantitative trait loci in the rat by genotyping endothelin system genes. J. Clin. Invest. 93.

Further studies establishing the function and utilities of EDN2 are found in John Hopkins OMIM database record ID 131241, and in cited publications listed in Table 5, which are hereby incorporated by reference. Early growth response 3 (EGR3, Accession NP_004421.2) is another GAM139 target gene, herein designated TARGET GENE. EGR3 BINDING SITE is a target binding site found in the 3' untranslated region of mRNA encoded by EGR3, corresponding to a target binding site such as BINDING SITE I, BINDING SITE II or BINDING SITE III of FIG. 8. Table 4 illustrates the complementarity of the nucleotide sequences of EGR3 BINDING SITE, designated SEQ ID:18522, to the nucleotide sequence of GAM139 RNA, herein designated GAM RNA, also designated SEQ ID:327.

Another function of GAM139 is therefore inhibition of Early growth response 3 (EGR3, Accession NP_004421.2), a gene which is a putative transcription factor. Accordingly, utilities of GAM139 include diagnosis, prevention and treatment of diseases and clinical conditions associated with EGR3.

The function of EGR3 and its association with various diseases and clinical conditions, has been established by previous studies, as described hereinabove with reference to GAM63.1. Eh-domain containing 2 (EHD2, Accession NP_055416.2) is another GAM139 target gene, herein designated TARGET GENE. EHD2 BINDING SITE is a target binding site found in the 3' untranslated region of mRNA encoded by EHD2, corresponding to a target binding site such as BINDING SITE I, BINDING SITE II or BINDING SITE III of FIG. 8. Table 4 illustrates the complementarity of the nucleotide sequences of EHD2 BINDING SITE, designated SEQ ID:2637, to the nucleotide sequence of GAM139 RNA, herein designated GAM RNA, also designated SEQ ID:327.

Another function of GAM139 is therefore inhibition of Eh-domain containing 2 (EHD2, Accession NP_055416.2). Accordingly, utilities of GAM139 include diagnosis, prevention and treatment of diseases and clinical conditions associated with EHD2.

ELL (Accession NP_006523.1) is another GAM139 target gene, herein designated TARGET GENE. ELL BINDING SITE1 and ELL BINDING SITE2 are target binding sites found in untranslated regions of mRNA encoded by ELL, corresponding to target binding sites such as BINDING SITE I, BINDING SITE II or BINDING SITE III of FIG. 8. Table 4 illustrates the complementarity of the nucleotide sequences of ELL BINDING SITE1 and ELL BINDING SITE2, designated SEQ ID:15398 and SEQ ID:4864 respectively, to the nucleotide sequence of GAM139 RNA, herein designated GAM RNA, also designated SEQ ID:327.

Another function of GAM139 is therefore inhibition of ELL (Accession NP_006523.1). Accordingly, utilities of GAM139 include diagnosis, prevention and treatment of diseases and clinical conditions associated with ELL.

Epha1 (EPHA1, Accession NP_005223.1) is another GAM139 target gene, herein designated TARGET GENE. EPHA1 BINDING SITE is a target binding site found in the 3' untranslated region of mRNA encoded by EPHA1, corresponding to a target binding site such as BINDING SITE I, BINDING SITE II or BINDING SITE III of FIG. 8. Table 4 illustrates the complementarity of the nucleotide sequences of EPHA1 BINDING SITE, designated SEQ ID:1286, to the nucleotide sequence of GAM139 RNA, herein designated GAM RNA, also designated SEQ ID:327.

Another function of GAM139 is therefore inhibition of Epha1 (EPHA1, Accession NP_005223.1), a gene which acts as a receptor for members of the ephrin-a family. binds with a low affinity to ephrin-a1. Accordingly, utilities of GAM139 include diagnosis, prevention and treatment of diseases and clinical conditions associated with EPHA1.

The function of EPHA1 has been established by previous studies. The EPH and EPH-related receptors comprise the largest subfamily of receptor protein-tyrosine kinases. They have been implicated in mediating developmental events, particularly in the nervous system. Receptors in the Eph subfamily typically have a single kinase domain and an extracellular region containing a Cys-rich domain and 2 fibronectin type III repeats. The ligands for Eph receptors have been named ephrins by the Eph Nomenclature Committee (1997). Based on their structures and sequence relationships, ephrins are divided into the ephrin-A (EFNA) class, which are anchored to the membrane by a glycosylphosphatidylinositol linkage, and the ephrin-B (EFNB) class, which are transmembrane proteins. The Eph family of receptors are divided into 2 groups based on the similarity of their extracellular domain sequences and their affinities for binding ephrin-A and ephrin-B ligands. The Eph Nomenclature Committee (1997) proposed that Eph receptors interacting preferentially with ephrin-A proteins be called EphA and Eph receptors interacting preferentially with ephrin-B proteins be called EphB. Maru et al. (1988) reported characterization of the novel receptor tyrosine kinase gene, EPH. The splicing points of kinase domain- encoding exons were completely distinct from those of other protein tyrosine kinase genes, suggesting that this is the earliest evolutionary split within this family. In Northern blot analysis, EPH gene mRNA was detected in liver, lung, kidney, and testes of rat; screening of 25 human cancers of various cell types showed preferential expression in cells of epithelial origin. Overexpression of EPH mRNA was found in a hepatoma and a lung cancer without gene amplification. Southern blot analysis of DNAs from human-mouse hybrid clones with an EPH probe showed that this gene is present on human chromosome 7. Two other receptor tyrosine kinase genes, MET (OMIM Ref. No. 164860) and EGFR (OMIM Ref. No. 131550), are on the same chromosome. By in situ hybridization, Yoshida et al. (1989) assigned the EPH locus to 7q32-q36. Although ephrins form a high-affinity multivalent complex with their receptors present on axons, axons can be rapidly repelled rather than being bound. Hattori et al. (2000) showed that ephrin-A2 (OMIM Ref. No. 602756) forms a stable complex with the metalloproteinase Kuzbanian (ADAM10; 602192), involving interactions outside the cleavage region and the protease domain. Eph receptor binding triggered ephrin-A2 cleavage in a localized reaction specific to the cognate ligand. The cleavage-inhibiting mutation in ephrin-A2 delayed axon withdrawal. Hattori et al. (2000) concluded that their studies reveal mechanisms for protease recognition and control of cell surface proteins, and, for ephrin-A2, they may provide a means for efficient axon detachment and termination of signaling Full details of the abovementioned studies are described in the following publications, the disclosure of which are hereby incorporated by reference:

Hattori, M.; Osterfield, M.; Flanagan, J. G.: Regulated cleavage of a contact- mediated axon repellent. Science 289: 1360-1365, 2000; and Maru, Y.; Hirai, H.; Yoshida, M. C.; Takaku, F.: Evolution, expression, and chromosomal location of a novel receptor tyrosine kinase gene, eph. Molec. Cell. Biol. 8:3770-3776, 1988.

Further studies establishing the function and utilities of EPHA1 are found in John Hopkins OMIM database record ID 179610, and in cited publications listed in Table 5, which are hereby incorporated by reference. FBG3 (Accession NP_149438.1) is another GAM139 target gene, herein designated TARGET GENE. FBG3 BINDING SITE is a target binding site found in the 3' untranslated region of mRNA encoded by FBG3, corresponding to a target binding site such as BINDING SITE I, BINDING SITE II or BINDING SITE III of FIG. 8. Table 4 illustrates the complementarity of the nucleotide sequences of FBG3 BINDING SITE, designated SEQ ID:17902, to the nucleotide sequence of GAM139 RNA, herein designated GAM RNA, also designated SEQ ID:327.

Another function of GAM139 is therefore inhibition of FBG3 (Accession NP_149438.1). Accordingly, utilities of GAM139 include diagnosis, prevention and treatment of diseases and clinical conditions associated with FBG3.

FBXW8 (Accession NP_036306.1) is another GAM139 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:2670, to the nucleotide sequence of GAM139 RNA, herein designated GAM RNA, also designated SEQ ID:327.

Another function of GAM139 is therefore inhibition of FBXW8 (Accession NP_036306.1). Accordingly, utilities of GAM139 include diagnosis, prevention and treatment of diseases and clinical conditions associated with FBXW8.

FBXW8 (Accession NP_699179.2) is another GAM139 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:2670, to the nucleotide sequence of GAM139 RNA, herein designated GAM RNA, also designated SEQ ID:327.

Another function of GAM139 is therefore inhibition of FBXW8 (Accession NP_699179.2). Accordingly, utilities of GAM139 include diagnosis, prevention and treatment of diseases and clinical conditions associated with FBXW8.

FLJ10613 (Accession NP_061940.1) is another GAM139 target gene, herein designated TARGET GENE. FLJ10613 BINDING SITE is a target binding site found in the 3' untranslated region of mRNA encoded by FLJ10613, corresponding to a target binding site such as BINDING SITE I, BINDING SITE II or BINDING SITE III of FIG. 8. Table 4 illustrates the complementarity of the nucleotide sequences of FLJ10613 BINDING SITE, designated SEQ ID:15827, to the nucleotide sequence of GAM139 RNA, herein designated GAM RNA, also designated SEQ ID:327.

Another function of GAM139 is therefore inhibition of FLJ10613 (Accession NP_061940.1). Accordingly, utilities of GAM139 include diagnosis, prevention and treatment of diseases and clinical conditions associated with FLJ10613.

FLJ12409 (Accession NP_079381.1) is another GAM139 target gene, herein designated TARGET GENE. FLJ12409 BINDING SITE is a target binding site found in the 3' untranslated region of mRNA encoded by FLJ12409, corresponding to a target binding site such as BINDING SITE I, BINDING SITE II or BINDING SITE III of FIG. 8. Table 4 illustrates the complementarity of the nucleotide sequences of FLJ12409 BINDING SITE, designated SEQ ID:4490, to the nucleotide sequence of GAM139 RNA, herein designated GAM RNA, also designated SEQ ID:327.

Another function of GAM139 is therefore inhibition of FLJ12409 (Accession NP_079381.1). Accordingly, utilities of GAM139 include diagnosis, prevention and treatment of diseases and clinical conditions associated with FLJ12409.

FLJ12747 (Accession XP_290972.1) is another GAM139 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:2024, to the nucleotide sequence of GAM139 RNA, herein designated GAM RNA, also designated SEQ ID:327.

Another function of GAM139 is therefore inhibition of FLJ12747 (Accession XP_290972.1). Accordingly, utilities of GAM139 include diagnosis, prevention and treatment of diseases and clinical conditions associated with FLJ12747.

FLJ12750 (Accession NP_078943.1) is another GAM139 target gene, herein designated TARGET GENE. FLJ12750 BINDING SITE is a target binding site found in the 3' untranslated region of mRNA encoded by FLJ12750, corresponding to a target binding site such as BINDING SITE I, BINDING SITE II or BINDING SITE III of FIG. 8. Table 4 illustrates the complementarity of the nucleotide sequences of FLJ12750 BINDING SITE, designated SEQ ID:15623, to the nucleotide sequence of GAM139 RNA, herein designated GAM RNA, also designated SEQ ID:327.

Another function of GAM139 is therefore inhibition of FLJ12750 (Accession NP_078943.1). Accordingly, utilities of GAM139 include diagnosis, prevention and treatment of diseases and clinical conditions associated with FLJ12750.

FLJ12847 (Accession NP_078872.1) is another GAM139 target gene, herein designated TARGET GENE. FLJ12847 BINDING SITE is a target binding site found in the 3' untranslated region of mRNA encoded by FLJ12847, corresponding to a target binding site such as BINDING SITE I, BINDING SITE II or BINDING SITE III of FIG. 8. Table 4 illustrates the complementarity of the nucleotide sequences of FLJ12847 BINDING SITE, designated SEQ ID:6207, to the nucleotide sequence of GAM139 RNA, herein designated GAM RNA, also designated SEQ ID:327.

Another function of GAM139 is therefore inhibition of FLJ12847 (Accession NP_078872.1). Accordingly, utilities of GAM139 include diagnosis, prevention and treatment of diseases and clinical conditions associated with FLJ12847.

FLJ13241 (Accession NP_079364.1) is another GAM139 target gene, herein designated TARGET GENE. FLJ13241 BINDING SITE1 and FLJ13241 BINDING SITE2 are target binding sites found in untranslated regions of mRNA encoded by FLJ13241, corresponding to target binding sites such as BINDING SITE I, BINDING SITE II or BINDING SITE III of FIG. 8. Table 4 illustrates the complementarity of the nucleotide sequences of FLJ13241 BINDING SITE1 and FLJ13241 BINDING SITE2, designated SEQ ID:10155 and SEQ ID:3195 respectively, to the nucleotide sequence of GAM139 RNA, herein designated GAM RNA, also designated SEQ ID:327.

Another function of GAM139 is therefore inhibition of FLJ13241 (Accession NP_079364.1). Accordingly, utilities of GAM139 include diagnosis, prevention and treatment of diseases and clinical conditions associated with FLJ13241.

FLJ14069 (Accession NP_079299.1) is another GAM139 target gene, herein designated TARGET GENE. FLJ14069 BINDING SITE is a target binding site found in the 3' untranslated region of mRNA encoded by FLJ14069, corresponding to a target binding site such as BINDING SITE I, BINDING SITE II or BINDING SITE III of FIG. 8. Table 4 illustrates the complementarity of the nucleotide sequences of FLJ14069 BINDING SITE, designated SEQ ID:5034, to the nucleotide sequence of GAM139 RNA, herein designated GAM RNA, also designated SEQ ID:327.

Another function of GAM139 is therefore inhibition of FLJ14069 (Accession NP_079299.1). Accordingly, utilities of GAM139 include diagnosis, prevention and treatment of diseases and clinical conditions associated with FLJ14069.

FLJ14936 (Accession NP_116253.2) is another GAM139 target gene, herein designated TARGET GENE. FLJ14936 BINDING SITE1 and FLJ14936 BINDING SITE2 are target binding sites found in untranslated regions of multiple transcripts of mRNA encoded by FLJ14936, corresponding to target binding sites such as BINDING SITE I, BINDING SITE II or BINDING SITE III of FIG. 8. Table 4 illustrates the complementarity of the nucleotide sequences of FLJ14936 BINDING SITE1 and FLJ14936 BINDING SITE2, designated SEQ ID:18005 and SEQ ID:17123 respectively, to the nucleotide sequence of GAM139 RNA, herein designated GAM RNA, also designated SEQ ID:327.

Another function of GAM139 is therefore inhibition of FLJ14936 (Accession NP_116253.2). Accordingly, utilities of GAM139 include diagnosis, prevention and treatment of diseases and clinical conditions associated with FLJ14936.

FLJ20315 (Accession NP_060233.1) is another GAM139 target gene, herein designated TARGET GENE. FLJ20315 BINDING SITE is a target binding site found in the 3' untranslated region of mRNA encoded by FLJ20315, corresponding to a target binding site such as BINDING SITE I, BINDING SITE II or BINDING SITE III of FIG. 8. Table 4 illustrates the complementarity of the nucleotide sequences of FLJ20315 BINDING SITE, designated SEQ ID:13985, to the nucleotide sequence of GAM139 RNA, herein designated GAM RNA, also designated SEQ ID:327.

Another function of GAM139 is therefore inhibition of FLJ20315 (Accession NP_060233.1). Accordingly, utilities of GAM139 include diagnosis, prevention and treatment of diseases and clinical conditions associated with FLJ20315.

FLJ20558 (Accession NP_060350.1) is another GAM139 target gene, herein designated TARGET GENE. FLJ20558 BINDING SITE is a target binding site found in the 3' untranslated region of mRNA encoded by FLJ20558, corresponding to a target binding site such as BINDING SITE I, BINDING SITE II or BINDING SITE III of FIG. 8. Table 4 illustrates the complementarity of the nucleotide sequences of FLJ20558 BINDING SITE, designated SEQ ID:18638, to the nucleotide sequence of GAM139 RNA, herein designated GAM RNA, also designated SEQ ID:327.

Another function of GAM139 is therefore inhibition of FLJ20558 (Accession NP_060350.1). Accordingly, utilities of GAM139 include diagnosis, prevention and treatment of diseases and clinical conditions associated with FLJ20558.

FLJ20699 (Accession NP_060401.1) is another GAM139 target gene, herein designated TARGET GENE. FLJ20699 BINDING SITE1 and FLJ20699 BINDING SITE2 are target binding sites found in untranslated regions of mRNA encoded by FLJ20699, corresponding to target binding sites such as BINDING SITE I, BINDING SITE II or BINDING SITE III of FIG. 8. Table 4 illustrates the complementarity of the nucleotide sequences of FLJ20699 BINDING SITE1 and FLJ20699 BINDING SITE2, designated SEQ ID:7805 and SEQ ID:12279 respectively, to the nucleotide sequence of GAM139 RNA, herein designated GAM RNA, also designated SEQ ID:327.

Another function of GAM139 is therefore inhibition of FLJ20699 (Accession NP_060401.1). Accordingly, utilities of GAM139 include diagnosis, prevention and treatment of diseases and clinical conditions associated with FLJ20699.

FLJ21168 (Accession NP_079349.1) is another GAM139 target gene, herein designated TARGET GENE. FLJ21168 BINDING SITE is a target binding site found in the 5' untranslated region of mRNA encoded by FLJ21168, corresponding to a target binding site such as BINDING SITE I, BINDING SITE II or BINDING SITE III of FIG. 8. Table 4 illustrates the complementarity of the nucleotide sequences of FLJ21168 BINDING SITE, designated SEQ ID:1748, to the nucleotide sequence of GAM139 RNA, herein designated GAM RNA, also designated SEQ ID:327.

Another function of GAM139 is therefore inhibition of FLJ21168 (Accession NP_079349.1). Accordingly, utilities of GAM139 include diagnosis, prevention and treatment of diseases and clinical conditions associated with FLJ21168.

FLJ22672 (Accession NP_079173.2) is another GAM139 target gene, herein designated TARGET GENE. FLJ22672 BINDING SITE is a target binding site found in the 5' untranslated region of mRNA encoded by FLJ22672, corresponding to a target binding site such as BINDING SITE I, BINDING SITE II or BINDING SITE III of FIG. 8. Table 4 illustrates the complementarity of the nucleotide sequences of FLJ22672 BINDING SITE, designated SEQ ID:20087, to the nucleotide sequence of GAM139 RNA, herein designated GAM RNA, also designated SEQ ID:327.

Another function of GAM139 is therefore inhibition of FLJ22672 (Accession NP_079173.2). Accordingly, utilities of GAM139 include diagnosis, prevention and treatment of diseases and clinical conditions associated with FLJ22672.

FLJ25168 (Accession NP_689679.1) is another GAM139 target gene, herein designated TARGET GENE. FLJ25168 BINDING SITE is a target binding site found in the 5' untranslated region of mRNA encoded by FLJ25168, corresponding to a target binding site such as BINDING SITE I, BINDING SITE II or BINDING SITE III of FIG. 8. Table 4 illustrates the complementarity of the nucleotide sequences of FLJ25168 BINDING SITE, designated SEQ ID:14009, to the nucleotide sequence of GAM139 RNA, herein designated GAM RNA, also designated SEQ ID:327.

Another function of GAM139 is therefore inhibition of FLJ25168 (Accession NP_689679.1). Accordingly, utilities of GAM139 include diagnosis, prevention and treatment of diseases and clinical conditions associated with FLJ25168.

FLJ30430 (Accession NP_694554.1) is another GAM139 target gene, herein designated TARGET GENE. FLJ30430 BINDING SITE is a target binding site found in the 3' untranslated region of mRNA encoded by FLJ30430, corresponding to a target binding site such as BINDING SITE I, BINDING SITE II or BINDING SITE III of FIG. 8. Table 4 illustrates the complementarity of the nucleotide sequences of FLJ30430 BINDING SITE, designated SEQ ID:14922, to the nucleotide sequence of GAM139 RNA, herein designated GAM RNA, also designated SEQ ID:327.

Another function of GAM139 is therefore inhibition of FLJ30430 (Accession NP_694554.1). Accordingly, utilities of GAM139 include diagnosis, prevention and treatment of diseases and clinical conditions associated with FLJ30430.

FLJ32104 (Accession NP_694579.1) is another GAM139 target gene, herein designated TARGET GENE. FLJ32104 BINDING SITE1 and FLJ32104 BINDING SITE2 are target binding sites found in untranslated regions of mRNA encoded by FLJ32104, corresponding to target binding sites such as BINDING SITE I, BINDING SITE II or BINDING SITE III of FIG. 8. Table 4 illustrates the complementarity of the nucleotide sequences of FLJ32104 BINDING SITE1 and FLJ32104 BINDING SITE2, designated SEQ ID:8933 and SEQ ID:8172 respectively, to the nucleotide sequence of GAM139 RNA, herein designated GAM RNA, also designated SEQ ID:327.

Another function of GAM139 is therefore inhibition of FLJ32104 (Accession NP_694579.1). Accordingly, utilities of GAM139 include diagnosis, prevention and treatment of diseases and clinical conditions associated with FLJ32104.

FLJ32416 (Accession NP_653217.1) is another GAM139 target gene, herein designated TARGET GENE. FLJ32416 BINDING SITE is a target binding site found in the 5' untranslated region of mRNA encoded by FLJ32416, corresponding to a target binding site such as BINDING SITE I, BINDING SITE II or BINDING SITE III of FIG. 8. Table 4 illustrates the complementarity of the nucleotide sequences of FLJ32416 BINDING SITE, designated SEQ ID:15601, to the nucleotide sequence of GAM139 RNA, herein designated GAM RNA, also designated SEQ ID:327.

Another function of GAM139 is therefore inhibition of FLJ32416 (Accession NP_653217.1). Accordingly, utilities of GAM139 include diagnosis, prevention and treatment of diseases and clinical conditions associated with FLJ32416.

FLJ36666 (Accession NP_689695.1) is another GAM139 target gene, herein designated TARGET GENE. FLJ36666 BINDING SITE is a target binding site found in the 3' untranslated region of mRNA encoded by FLJ36666, corresponding to a target binding site such as BINDING SITE I, BINDING SITE II or BINDING SITE III of FIG. 8. Table 4 illustrates the complementarity of the nucleotide sequences of FLJ36666 BINDING SITE, designated SEQ ID:19742, to the nucleotide sequence of GAM139 RNA, herein designated GAM RNA, also designated SEQ ID:327.

Another function of GAM139 is therefore inhibition of FLJ36666 (Accession NP_689695.1). Accordingly, utilities of GAM139 include diagnosis, prevention and treatment of diseases and clinical conditions associated with FLJ36666.

FLJ38792 (Accession NP_848615.1) is another GAM139 target gene, herein designated TARGET GENE. FLJ38792 BINDING SITE1 and FLJ38792 BINDING SITE2 are target binding sites found in untranslated regions of mRNA encoded by FLJ38792, corresponding to target binding sites such as BINDING SITE I, BINDING SITE II or BINDING SITE III of FIG. 8. Table 4 illustrates the complementarity of the nucleotide sequences of FLJ38792 BINDING SITE1 and FLJ38792 BINDING SITE2, designated SEQ ID:9676 and SEQ ID:6257 respectively, to the nucleotide sequence of GAM139 RNA, herein designated GAM RNA, also designated SEQ ID:327.

Another function of GAM139 is therefore inhibition of FLJ38792 (Accession NP_848615.1). Accordingly, utilities of GAM139 include diagnosis, prevention and treatment of diseases and clinical conditions associated with FLJ38792.

FLJ40852 (Accession NP_775948.1) is another GAM139 target gene, herein designated TARGET GENE. FLJ40852 BINDING SITE1 and FLJ40852 BINDING SITE2 are target binding sites found in untranslated regions of mRNA encoded by FLJ40852, corresponding to target binding sites such as BINDING SITE I, BINDING SITE II or BINDING SITE III of FIG. 8. Table 4 illustrates the complementarity of the nucleotide sequences of FLJ40852 BINDING SITE1 and FLJ40852 BINDING SITE2, designated SEQ ID:13085 and SEQ ID:1395 respectively, to the nucleotide sequence of GAM139 RNA, herein designated GAM RNA, also designated SEQ ID:327.

Another function of GAM139 is therefore inhibition of FLJ40852 (Accession NP_775948.1). Accordingly, utilities of GAM139 include diagnosis, prevention and treatment of diseases and clinical conditions associated with FLJ40852.

FLJ90734 (Accession NP_699206.1) is another GAM139 target gene, herein designated TARGET GENE. FLJ90734 BINDING SITE is a target binding site found in the 5' untranslated region of mRNA encoded by FLJ90734, corresponding to a target binding site such as BINDING SITE I, BINDING SITE II or BINDING SITE III of FIG. 8. Table 4 illustrates the complementarity of the nucleotide sequences of FLJ90734 BINDING SITE, designated SEQ ID:15777, to the nucleotide sequence of GAM139 RNA, herein designated GAM RNA, also designated SEQ ID:327.

Another function of GAM139 is therefore inhibition of FLJ90734 (Accession NP_699206.1). Accordingly, utilities of GAM139 include diagnosis, prevention and treatment of diseases and clinical conditions associated with FLJ90734.

Formin binding protein 1 (FNBP1, Accession XP_052666.3) is another GAM139 target gene, herein designated TARGET GENE. FNBP1 BINDING SITE is a target binding site found in the 3' untranslated region of mRNA encoded by FNBP1, corresponding to a target binding site such as BINDING SITE I, BINDING SITE II or BINDING SITE III of FIG. 8. Table 4 illustrates the complementarity of the nucleotide sequences of FNBP1 BINDING SITE, designated SEQ ID:3529, to the nucleotide sequence of GAM139 RNA, herein designated GAM RNA, also designated SEQ ID:327.

Another function of GAM139 is therefore inhibition of Formin binding protein 1 (FNBP1, Accession XP_052666.3). Accordingly, utilities of GAM139 include diagnosis, prevention and treatment of diseases and clinical conditions associated with FNBP1.

Frizzled homolog 4 (drosophila) (FZD4, Accession NP_036325.2) is another GAM139 target gene, herein designated TARGET GENE. FZD4 BINDING SITE is a target binding site found in the 3' untranslated region of mRNA encoded by FZD4, corresponding to a target binding site such as BINDING SITE I, BINDING SITE II or BINDING SITE III of FIG. 8. Table 4 illustrates the complementarity of the nucleotide sequences of FZD4 BINDING SITE, designated SEQ ID:2318, to the nucleotide sequence of GAM139 RNA, herein designated GAM RNA, also designated SEQ ID:327.

Another function of GAM139 is therefore inhibition of Frizzled homolog 4 (drosophila) (FZD4, Accession NP_036325.2), a gene which may function in cell polarity, cell fate specification and cancer; similar to frizzled receptor family, has seven transmembrane domains and therefore may be associated with Familial exudative vitreoretinopathy. Accordingly, utilities of GAM139 include diagnosis, prevention and treatment of Familial exudative vitreoretinopathy, and of other diseases and clinical conditions associated with FZD4.

The function of FZD4 and its association with various diseases and clinical conditions, has been established by previous studies, as described hereinabove with reference to GAM67.1. Gaba(a) receptor-associated protein like 1 (GABARAPL1, Accession NP_113600.1) is another GAM139 target gene, herein designated TARGET GENE. GABARAPL1 BINDING SITE is a target binding site found in the 5' untranslated region of mRNA encoded by GABARAPL1, corresponding to a target binding site such as BINDING SITE I, BINDING SITE II or BINDING SITE III of FIG. 8. Table 4 illustrates the complementarity of the nucleotide sequences of GABARAPL1 BINDING SITE, designated SEQ ID:1612, to the nucleotide sequence of GAM139 RNA, herein designated GAM RNA, also designated SEQ ID:327.

Another function of GAM139 is therefore inhibition of Gaba(a) receptor-associated protein like 1 (GABARAPL1, Accession NP_113600.1). Accordingly, utilities of GAM139 include diagnosis, prevention and treatment of diseases and clinical conditions associated with GABARAPL1.

Gamma-aminobutyric acid (gaba) b receptor, 1 (GABBR1, Accession NP_068705.1) is another GAM139 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:19293, to the nucleotide sequence of GAM139 RNA, herein designated GAM RNA, also designated SEQ ID:327.

Another function of GAM139 is therefore inhibition of Gamma-aminobutyric acid (gaba) b receptor, 1 (GABBR1, Accession NP_068705.1). Accordingly, utilities of GAM139 include diagnosis, prevention and treatment of diseases and clinical conditions associated with GABBR1.

Cyclin g associated kinase (GAK, Accession NP_005246.1) is another GAM139 target gene, herein designated TARGET GENE. GAK BINDING SITE is a target binding site found in the 3' untranslated region of mRNA encoded by GAK, corresponding to a target binding site such as BINDING SITE I, BINDING SITE II or BINDING SITE III of FIG. 8. Table 4 illustrates the complementarity of the nucleotide sequences of GAK BINDING SITE, designated SEQ ID:3648, to the nucleotide sequence of GAM139 RNA, herein designated GAM RNA, also designated SEQ ID:327.

Another function of GAM139 is therefore inhibition of Cyclin g associated kinase (GAK, Accession NP_005246.1). Accordingly, utilities of GAM139 include diagnosis, prevention and treatment of diseases and clinical conditions associated with GAK.

Growth arrest-specific 7 (GAS7, Accession NP_005881.1) is another GAM139 target gene, herein designated TARGET GENE. GAS7 BINDING SITE is a target binding site found in the 3' untranslated region of multiple transcripts of mRNA encoded by GAS7, corresponding to a target binding site such as BINDING SITE I, BINDING SITE II or BINDING SITE III of FIG. 8. Table 4 illustrates the complementarity of the nucleotide sequences of GAS7

BINDING SITE, designated SEQ ID:6544, to the nucleotide sequence of GAM139 RNA, herein designated GAM RNA, also designated SEQ ID:327.

Another function of GAM139 is therefore inhibition of Growth arrest-specific 7 (GAS7, Accession NP_005881.1), a gene which may play a role in promoting maturation and morphological differentiation of cerebellar neurons. and therefore may be associated with Leukemias with myeloid/lymphoid (mll). Accordingly, utilities of GAM139 include diagnosis, prevention and treatment of Leukemias with myeloid/lymphoid (mll), and of other diseases and clinical conditions associated with GAS7.

The function of GAS7 and its association with various diseases and clinical conditions, has been established by previous studies, as described hereinabove with reference to GAM72.1. GAS8 (Accession NP_001472.1) is another GAM139 target gene, herein designated TARGET GENE. GAS8 BINDING SITE is a target binding site found in the 3' untranslated region of mRNA encoded by GAS8, corresponding to a target binding site such as BINDING SITE I, BINDING SITE II or BINDING SITE III of FIG. 8. Table 4 illustrates the complementarity of the nucleotide sequences of GAS8 BINDING SITE, designated SEQ ID:11159, to the nucleotide sequence of GAM139 RNA, herein designated GAM RNA, also designated SEQ ID:327.

Another function of GAM139 is therefore inhibition of GAS8 (Accession NP_001472.1). Accordingly, utilities of GAM139 include diagnosis, prevention and treatment of diseases and clinical conditions associated with GAS8.

GBP5 (Accession NP_443174.1) is another GAM139 target gene, herein designated TARGET GENE. GBP5 BINDING SITE is a target binding site found in the 5' untranslated region of mRNA encoded by GBP5, corresponding to a target binding site such as BINDING SITE I, BINDING SITE II or BINDING SITE III of FIG. 8. Table 4 illustrates the complementarity of the nucleotide sequences of GBP5 BINDING SITE, designated SEQ ID:13996, to the nucleotide sequence of GAM139 RNA, herein designated GAM RNA, also designated SEQ ID:327.

Another function of GAM139 is therefore inhibition of GBP5 (Accession NP_443174.1). Accordingly, utilities of GAM139 include diagnosis, prevention and treatment of diseases and clinical conditions associated with GBP5.

Glucosaminyl (n-acetyl) transferase 1, core 2 (beta-1,6-n-acetylglucosaminyltransferase) (GCNT1, Accession NP_001481.2) is another GAM139 target gene, herein designated TARGET GENE. GCNT1 BINDING SITE is a target binding site found in the 5' untranslated region of mRNA encoded by GCNT1, corresponding to a target binding site such as BINDING SITE I, BINDING SITE II or BINDING SITE III of FIG. 8. Table 4 illustrates the complementarity of the nucleotide sequences of GCNT1 BINDING SITE, designated SEQ ID:7810, to the nucleotide sequence of GAM139 RNA, herein designated GAM RNA, also designated SEQ ID:327.

Another function of GAM139 is therefore inhibition of Glucosaminyl (n-acetyl) transferase 1, core 2 (beta-1,6-n-acetylglucosaminyltransferase) (GCNT1, Accession NP_001481.2), a gene which forms critical branches in o-glycans. Accordingly, utilities of GAM139 include diagnosis, prevention and treatment of diseases and clinical conditions associated with GCNT1.

The function of GCNT1 has been established by previous studies. Bierhuizen et al. (1993) provided the sequence of the developmental I antigen encoded by the cDNA for a member of a beta-1,6-N-acetylglucosaminyltransferase gene family. By Northern blot analysis, Yeh et al. (1999) showed that multiple transcripts of GCNT1 were expressed in nearly all tissues tested, whereas expression of GCNT3 (OMIM Ref. No. 606836) was more restricted. Transcripts were also readily detected in some leukemic cell lines and in colon and cervical carcinoma cell lines, but not in a lung carcinoma cell line.

Full details of the abovementioned studies are described in the following publications, the disclosure of which are hereby incorporated by reference:

Bierhuizen, M. F. A.; Mattei, M.-G.; Fukuda, M.: Expression of the developmental I antigen by a cloned human cDNA encoding a member of a beta-1,6-N-acetylglucosaminyltransferase gene family. Genes Dev. 7:468-478, 1993; and Pilz, A.; Woodward, K.; Povey, S.; Abbott, C.: Comparative mapping of 50 human chromosome 9 loci in the laboratory mouse. Genomics 25:139-149, 1995.

Further studies establishing the function and utilities of GCNT1 are found in John Hopkins OMIM database record ID 600391, and in cited publications listed in Table 5, which are hereby incorporated by reference. Gdp dissociation inhibitor 2 (GDI2, Accession NP_001485.2) is another GAM139 target gene, herein designated TARGET GENE. GDI2 BINDING SITE is a target binding site found in the 3' untranslated region of mRNA encoded by GDI2, corresponding to a target binding site such as BINDING SITE I, BINDING SITE II or BINDING SITE III of FIG. 8. Table 4 illustrates the complementarity of the nucleotide sequences of GDI2 BINDING SITE, designated SEQ ID:15867, to the nucleotide sequence of GAM139 RNA, herein designated GAM RNA, also designated SEQ ID:327.

Another function of GAM139 is therefore inhibition of Gdp dissociation inhibitor 2 (GDI2, Accession NP_001485.2), a gene which regulates the gdp/gtp exchange reaction of most rab proteins by inhibiting the dissociation of gdp from them, and the subsequent binding of gtp to them. Accordingly, utilities of GAM139 include diagnosis, prevention and treatment of diseases and clinical conditions associated with GDI2.

The function of GDI2 has been established by previous studies. Various rab GDI-beta (RABGDIB) genes have been identified in a variety of species. It is a member of the GDP-dissociation inhibitor family, which includes GDI-alpha (RABGDIA; 300104). Shisheva et al. (1994) cloned mouse RABGDIB (which they referred to as 'smg p25A GDI') and reported the sequence. Sedlacek et al. (1995) found that the human RABGDIB sequence is 86.5% similar to RABGDIA, which they referred to as 'XAP-4.' Bachner et al. (1995) studied expression patterns of the 2 human genes. They showed that the 2.5-kb mRNA for RABGDIB is ubiquitously expressed, in contrast to RABGDIA, which is expressed primarily in neural and sensory tissues. By in situ hybridization, Sedlacek et al. (1998) demonstrated that the GDI2 gene maps to 10p15; a processed pseudogene mapped to 7p13-p11.

Full details of the abovementioned studies are described in the following publications, the disclosure of which are hereby incorporated by reference:

Sedlacek, Z.; Munstermann, E.; Mincheva, A.; Lichter, P.; Poustka, A.: The human rab GDI beta gene with long retroposon-rich introns maps to 10p15 and its pseudogene to 7p11-p13. Mammalian Genome 9:78-80, 1998; and Shisheva, A.; Sudhof, T. C.; Czech, M. P.: Cloning, characterization, and expression of a novel GDP dissociation inhibitor isoform from skeletal muscle. Molec. Cell. Biol. 14:3459-346.

Further studies establishing the function and utilities of GDI2 are found in John Hopkins OMIM database record ID 600767, and in cited publications listed in Table 5, which are hereby incorporated by reference. Glial fibrillary acidic protein (GFAP, Accession NP_002046.1) is another GAM139 target gene, herein designated TARGET GENE. GFAP BINDING SITE is a target binding site found in the 3' untranslated region of mRNA encoded by GFAP, corresponding to a target binding site such as BINDING SITE I, BINDING SITE II or BINDING SITE III of FIG. 8. Table 4 illustrates the complementarity of the nucleotide sequences of GFAP BINDING SITE, designated SEQ ID:5626, to the nucleotide sequence of GAM139 RNA, herein designated GAM RNA, also designated SEQ ID:327.

Another function of GAM139 is therefore inhibition of Glial fibrillary acidic protein (GFAP, Accession NP_002046.1). Accordingly, utilities of GAM139 include diagnosis, prevention and treatment of diseases and clinical conditions associated with GFAP.

Golgi associated, gamma adaptin ear containing, arf binding protein 2 (GGA2, Accession NP_619581.1) is another GAM139 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:10502, to the nucleotide sequence of GAM139 RNA, herein designated GAM RNA, also designated SEQ ID:327.

Another function of GAM139 is therefore inhibition of Golgi associated, gamma adaptin ear containing, arf binding protein 2 (GGA2, Accession NP_619581.1). Accordingly, utilities of GAM139 include diagnosis, prevention and treatment of diseases and clinical conditions associated with GGA2.

GK001 (Accession NP_064583.1) is another GAM139 target gene, herein designated TARGET GENE. GK001 BINDING SITE is a target binding site found in the 3' untranslated region of mRNA encoded by GK001, corresponding to a target binding site such as BINDING SITE I, BINDING SITE II or BINDING SITE III of FIG. 8. Table 4 illustrates the complementarity of the nucleotide sequences of GK001 BINDING SITE, designated SEQ ID:15464, to the nucleotide sequence of GAM139 RNA, herein designated GAM RNA, also designated SEQ ID:327.

Another function of GAM139 is therefore inhibition of GK001 (Accession NP_064583.1). Accordingly, utilities of GAM139 include diagnosis, prevention and treatment of diseases and clinical conditions associated with GK001.

Golgi autoantigen, golgin subfamily a, 1 (GOLGA1, Accession NP_002068.1) is another GAM139 target gene, herein designated TARGET GENE. GOLGA1 BINDING SITE1 and GOLGA1 BINDING SITE2 are target binding sites found in untranslated regions of mRNA encoded by GOLGA1, corresponding to target binding sites such as BINDING SITE I, BINDING SITE II or BINDING SITE III of FIG. 8. Table 4 illustrates the complementarity of the nucleotide sequences of GOLGA1 BINDING SITE1 and GOLGA1 BINDING SITE2, designated SEQ ID:426 and SEQ ID:14520 respectively, to the nucleotide sequence of GAM139 RNA, herein designated GAM RNA, also designated SEQ ID:327.

Another function of GAM139 is therefore inhibition of Golgi autoantigen, golgin subfamily a, 1 (GOLGA1, Accession NP_002068.1) . Accordingly, utilities of GAM139 include diagnosis, prevention and treatment of diseases and clinical conditions associated with GOLGA1.

Golgi snap receptor complex member 1 (GOSR1, Accession NP_004862.1) is another GAM139 target gene, herein designated TARGET GENE. GOSR1 BINDING SITE is a target binding site found in the 3' untranslated region of mRNA encoded by GOSR1, corresponding to a target binding site such as BINDING SITE I, BINDING SITE II or BINDING SITE III of FIG. 8. Table 4 illustrates the complementarity of the nucleotide sequences of GOSR1 BINDING SITE, designated SEQ ID:16929, to the nucleotide sequence of GAM139 RNA, herein designated GAM RNA, also designated SEQ ID:327.

Another function of GAM139 is therefore inhibition of Golgi snap receptor complex member 1 (GOSR1, Accession NP_004862.1), a gene which may regulate vesicle transport, docking, and fusion. Accordingly, utilities of GAM139 include diagnosis, prevention and treatment of diseases and clinical conditions associated with GOSR1.

The function of GOSR1 has been established by previous studies. The specificity of vesicular transport is thought to be determined by correct pairing of vesicle-associated SNAREs (v-SNAREs) with those on the target membrane (t-SNAREs). This complex then recruits soluble NSF attachment proteins (SNAPs) and N-ethylmaleimide-sensitive factor (NSF; 601633) to form a 20S fusion (or SNARE) complex. See SNAPA (OMIM Ref. No. 603215). Nagahama et al. (1996) identified GOS28, a putative Golgi v-SNARE of 28 kD that localized primarily to transport vesicles at the terminal rims of Golgi stacks. They demonstrated that GOS28 plays a role in intra-Golgi transport. Subramaniam et al. (1996) isolated cDNAs encoding rat GOS28, which they called p28 or GS28 (Golgi SNARE of 28 kD). Sequence analysis revealed that the predicted protein contained a central coiled-coil domain and a C-terminal membrane anchor. The authors found that GS28 is a core component of the Golgi 20S SNARE complex that participates in the docking or fusion stage of endoplasmic reticulum-Golgi transport. Lowe et al. (1997) reported that GS28 plays a role in transport from the endoplasmic reticulum to the cis-(inside face) and medial-Golgi, while the GS27 (OMIM Ref. No. 604027) Golgi SNARE participates in protein movement from the medial- Golgi towards the trans-Golgi (plasma-membrane face) and the trans-Golgi network. By searching EST databases using the rat GS28 protein sequence, Bui et al. (1999) identified human GS28 cDNAs. The deduced 250-amino acid human protein is 97% identical to rat GS28. Independently, Mao et al. (1998) identified a human GOS28 cDNA among a collection of cDNAs expressed in hematopoietic stem/progenitor cells.

Full details of the abovementioned studies are described in the following publications, the disclosure of which are hereby incorporated by reference:

Bui, T. D.; Levy, E. R.; Subramaniam, V. N.; Lowe, S. L.; Hong, W.: cDNA characterization and chromosomal mapping of human Golgi SNARE GS27 and GS28 to chromosome 17. Genomics 57:285-288, 1999. ; and Nagahama, M.; Orci, L.; Ravazzola, M.; Amherdt, M.; Lacomis, L.; Tempst, P.; Rothman, J. E.; Sollner, T. H.: A v-SNARE implicated in intra-Golgi transport. J. Cell Biol. 133:507-516.

Further studies establishing the function and utilities of GOSR1 are found in John Hopkins OMIM database record ID 604026, and in cited publications listed in Table 5, which are hereby incorporated by reference. Glycosylphosphatidylinositol specific phospholipase d1 (GPLD1, Accession NP_001494.2) is another GAM139 target gene, herein designated TARGET GENE. GPLD1 BINDING SITE is a target binding site found in the 5' untranslated region of multiple transcripts of mRNA encoded by GPLD1, corresponding to a target binding site such as BINDING SITE I, BINDING SITE II or BINDING SITE III of FIG. 8. Table 4 illustrates the complementarity of the nucleotide sequences of GPLD1 BINDING SITE, designated SEQ ID:2598, to the nucleotide sequence of GAM139 RNA, herein designated GAM RNA, also designated SEQ ID:327.

Another function of GAM139 is therefore inhibition of Glycosylphosphatidylinositol specific phospholipase d1 (GPLD1, Accession NP_001494.2), a gene which hydrolyses the inositol phosphate linkage in proteins anchored by phosphatidylinositol glycans to release these proteins from the membrane. Accordingly, utilities of GAM139 include diagnosis, prevention and treatment of diseases and clinical conditions associated with GPLD1.

The function of GPLD1 and its association with various diseases and clinical conditions, has been established by previous studies, as described hereinabove with reference to GAM44.1. G protein-coupled receptor 108 (GPR108, Accession XP_290854.1) is another GAM139 target gene, herein designated TARGET GENE. GPR108 BINDING SITE1 and GPR108 BINDING SITE2 are target binding sites found in untranslated regions of mRNA encoded by GPR108, corresponding to target binding sites such as BINDING SITE I, BINDING SITE II or BINDING SITE III of FIG. 8. Table 4 illustrates the complementarity of the nucleotide sequences of GPR108 BINDING SITE1 and GPR108 BINDING SITE2, designated SEQ ID:790 and SEQ ID:14653 respectively, to the nucleotide sequence of GAM139 RNA, herein designated GAM RNA, also designated SEQ ID:327.

Another function of GAM139 is therefore inhibition of G protein-coupled receptor 108 (GPR108, Accession XP_290854.1). Accordingly, utilities of GAM139 include diagnosis, prevention and treatment of diseases and clinical conditions associated with GPR108.

GPR124 (Accession NP_116166.6) is another GAM139 target gene, herein designated TARGET GENE. GPR124 BINDING SITE is a target binding site found in the 3' untranslated region of mRNA encoded by GPR124, corresponding to a target binding site such as BINDING SITE I, BINDING SITE II or BINDING SITE III of FIG. 8. Table 4 illustrates the complementarity of the nucleotide sequences of GPR124 BINDING SITE, designated SEQ ID:3798, to the nucleotide sequence of GAM139 RNA, herein designated GAM RNA, also designated SEQ ID:327.

Another function of GAM139 is therefore inhibition of GPR124 (Accession NP_116166.6). Accordingly, utilities of GAM139 include diagnosis, prevention and treatment of diseases and clinical conditions associated with GPR124.

G protein-coupled receptor 35 (GPR35, Accession NP_005292.1) is another GAM139 target gene, herein designated TARGET GENE. GPR35 BINDING SITE is a target binding site found in the 5' untranslated region of mRNA encoded by GPR35, corresponding to a target binding site such as BINDING SITE I, BINDING SITE II or BINDING SITE III of FIG. 8. Table 4 illustrates the complementarity of the nucleotide sequences of GPR35 BINDING SITE, designated SEQ ID:20062, to the nucleotide sequence of GAM139 RNA, herein designated GAM RNA, also designated SEQ ID:327.

Another function of GAM139 is therefore inhibition of G protein-coupled receptor 35 (GPR35, Accession NP_005292.1), a gene which transduces a variety of hormone, endogenous peptide, and neurotransmitter signals into intracellular effects via G proteins. Accordingly, utilities of GAM139 include diagnosis, prevention and treatment of diseases and clinical conditions associated with GPR35.

The function of GPR35 has been established by previous studies. G protein-coupled receptors (GPRs, or GPCRs) contain 7 hydrophobic transmembrane domains embedded in hydrophilic intra- and extracellular loops and transduce a variety of hormone, endogenous peptide, and neurotransmitter signals into intracellular effects via G proteins (see OMIM Ref. No. 601047 and 601908). O'Dowd et al. (1998) searched for genes related to GPR1 (OMIM Ref. No. 600239) by PCR of genomic DNA with degenerate primers based on the conserved transmembrane regions. They identified the GPR35 gene, which encodes a predicted 309-amino acid protein. Horikawa et al. (2000) identified the GPR35 gene in a 66-kb interval on chromosome 2 that showed linkage to noninsulin-dependent diabetes mellitus (NIDDM1; 601283). They detected GPR35 expression in all fetal and adult human tissues examined, with relatively higher levels in adult lung, small intestine, colon, and stomach. They observed transcripts of 2.4 and 4.4 kb in most tissues, and a single 9.4-kb transcript in skeletal muscle. The GPR35 gene consists of a single exon. Single-nucleotide polymorphisms (SNPs) in GPR35 did not show association with or linkage to type 2 diabetes.

Full details of the abovementioned studies are described in the following publications, the disclosure of which are hereby incorporated by reference:

Horikawa, Y.; Oda, N.; Cox, N. J.; Li, X.; Orho-Melander, M.; Hara, M.; Hinokio, Y.; Lindner, T. H.; Mashima, H.; Schwarz, P. E. H.; del Bosque-Plata, L.; Horikawa, Y.; and 14 others: Genetic variation in the gene encoding calpain-10 is associated with type 2 diabetes mellitus. Nature Genet. 26:163-175, 2000; and O'Dowd, B. F.; Nguyen, T.; Marchese, A.; Cheng, R.; Lynch, K. R.; Heng, H. H. Q.; Kolakowski, L. F., Jr.; George, S. R.: Discovery of three novel G-protein-coupled receptor genes. Gen.

Further studies establishing the function and utilities of GPR35 are found in John Hopkins OMIM database record ID 602646, and in cited publications listed in Table 5, which are hereby incorporated by reference. Glutamate receptor interacting protein 1 (GRIP1, Accession XP_290559.2) is another GAM139 target gene, herein designated TARGET GENE. GRIP1 BINDING SITE1 and GRIP1 BINDING SITE2 are target binding sites found in untranslated regions of mRNA encoded by GRIP1, corresponding to target binding sites such as BINDING SITE I, BINDING SITE II or BINDING SITE III of FIG. 8. Table 4 illustrates the complementarity of the nucleotide sequences of GRIP1 BINDING SITE1 and GRIP1 BINDING SITE2, designated SEQ ID:10480 and SEQ ID:7684 respectively, to the nucleotide sequence of GAM139 RNA, herein designated GAM RNA, also designated SEQ ID:327.

Another function of GAM139 is therefore inhibition of Glutamate receptor interacting protein 1 (GRIP1, Accession XP_290559.2). Accordingly, utilities of GAM139 include diagnosis, prevention and treatment of diseases and clinical conditions associated with GRIP1.

HIP14 (Accession NP_056151.1) is another GAM139 target gene, herein designated TARGET GENE. HIP14 BINDING SITE is a target binding site found in the 5' untranslated region of mRNA encoded by HIP14, corresponding to a target binding site such as BINDING SITE I, BINDING SITE II or BINDING SITE III of FIG. 8. Table 4 illustrates the complementarity of the nucleotide sequences of HIP14 BINDING SITE, designated SEQ ID:15808, to the nucleotide sequence of GAM139 RNA, herein designated GAM RNA, also designated SEQ ID:327.

Another function of GAM139 is therefore inhibition of HIP14 (Accession NP_056151.1). Accordingly, utilities of GAM139 include diagnosis, prevention and treatment of diseases and clinical conditions associated with HIP14.

High mobility group at-hook 1 (HMGA1, Accession NP_665906.1) is another GAM139 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:11875, to the nucleotide sequence of GAM139 RNA, herein designated GAM RNA, also designated SEQ ID:327.

Another function of GAM139 is therefore inhibition of High mobility group at-hook 1 (HMGA1, Accession NP_665906.1), a gene which orchestrates the assembly of a virus-induced enhanceosome by mediating a network of protein-DNA and protein-protein interactions. Accordingly, utilities of GAM139 include diagnosis, prevention and treatment of diseases and clinical conditions associated with HMGA1.

The function of HMGA1 has been established by previous studies. Aberrant expression of MYC (OMIM Ref. No. 190080) plays an important role in the pathogenesis of several human malignancies, most notably Burkitt lymphoma (OMIM Ref. No. 113970). MYC functions as a transcription factor that works in conjunction with a partner protein, MAX (OMIM Ref. No. 154950). There are numerous target genes of My, including CAD (OMIM Ref. No. 114010), which is required for DNA synthesis, and ODC (OMIM Ref. No. 165640) and telomerase (see OMIM Ref. No. TERT; 187270), which are involved in neoplastic transformation. By mutagenesis analysis of the HMGIY promoter, Wood et al. (2000) identified a MYC-MAX consensus DNA-binding site, an E box at nucleotide -1337. Northern blot analysis detected enhanced expression of HMGIY after stimulation by hydroxytamoxifen in a cell line expressing a MYC-estradiol receptor fusion protein. MYC-deficient fibroblasts had reduced expression of HMGIY. Western blot analysis detected increased expression of HMGIY protein in Burkitt lymphoma cell lines compared with Epstein-Barr virus-transformed B lymphocytes from a normal individual. An antisense construct decreased HMGIY protein expression, abrogated transformation of Burkitt lymphoma cells, and decreased the cell growth rate. Rat and human cell lines overexpressing HMGIY formed colonies in soft agar, and the rat cell line was tumorigenic in athymic nude mice. The results suggested that HMGIY is a potential oncogene. HMGIY orchestrates the assembly of a virus-induced enhanceosome, which consists of nuclear factor kappa-B (NFKB; 164011), interferon regulatory factors (e.g., IRF1; 147575), and ATF2 (OMIM Ref. No. 123811)/JUN (see OMIM Ref. No. 165160), by mediating a network of protein-DNA and protein-protein interactions (Thanos and Maniatis, 1995). The enhanceosome, which is assembled in a nucleosome-free enhancer region, activates transcription of beta-interferon (IFNB; 147640) through a program of chromatin-modifying activities that target a strategically positioned nucleosome that masks the TATA box and start site of transcription (Agalioti et al., 2000). Enhanceosome-activated transcription requires the recruitment of histone acetyltransferase proteins that modify histones and acetylate HMGIY. Munshi et al. (2001) showed that the accurate execution of the IFNB transcriptional switch depends on the ordered acetylation of HMGIY by CREB-binding protein (CBP; 600140) and p300/CBP-associated factor (PCAF; 602303)/GCN5 (OMIM Ref. No. 602301). Acetylation of HMGIY by CBP at lys65 destabilizes the enhanceosome, whereas acetylation by PCAF/GCN5 at lys71, which lies in a critical protein-protein interaction domain, potentiates transcription by stabilizing the enhanceosome and by preventing acetylation by CBP.

Full details of the abovementioned studies are described in the following publications, the disclosure of which are hereby incorporated by reference:

Wood, L. J.; Mukherjee, M.; Dolde, C. E.; Xu, Y.; Maher, J. F.; Bunton, T. E.; Williams, J. B.; Resar, L. M. S.: HMG-I/Y, a new c-Myc target gene and potential oncogene. Molec. Cell Biol. 20:5490-5502, 2000; and Munshi, N.; Agalioti, T.; Lomvardas, S.; Merika, M.; Chen, G.; Thanos, D.: Coordination of a transcriptional switch by HMGI(Y) acetylation. Science 293:1133-1136, 2001.

Further studies establishing the function and utilities of HMGA1 are found in John Hopkins OMIM database record ID 600701, and in cited publications listed in Table 5, which are hereby incorporated by reference. High mobility group at-hook 1 (HMGA1, Accession NP_665911.1) is another GAM139 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:11875, to the nucleotide sequence of GAM139 RNA, herein designated GAM RNA, also designated SEQ ID:327.

Another function of GAM139 is therefore inhibition of High mobility group at-hook 1 (HMGA1, Accession NP_665911.1), a gene which orchestrates the assembly of a virus-induced enhanceosome by mediating a network of protein-DNA and protein-protein interactions. Accordingly, utilities of GAM139 include diagnosis, prevention and treatment of diseases and clinical conditions associated with HMGA1.

The function of HMGA1 has been established by previous studies. Aberrant expression of MYC (OMIM Ref. No. 190080) plays an important role in the pathogenesis of several human malignancies, most notably Burkitt lymphoma (OMIM Ref. No. 113970). MYC functions as a transcription factor that works in conjunction with a partner protein, MAX (OMIM Ref. No. 154950). There are numerous target genes of My, including CAD (OMIM Ref. No. 114010), which is required for DNA synthesis, and ODC (OMIM Ref. No. 165640) and telomerase (see OMIM Ref. No. TERT; 187270), which are involved in neoplastic transformation. By mutagenesis analysis of the HMGIY promoter, Wood et al. (2000) identified a MYC-MAX consensus DNA-binding site, an E box at nucleotide -1337. Northern blot analysis detected enhanced expression of HMGIY after stimulation by hydroxytamoxifen in a cell line expressing a MYC-estradiol receptor fusion protein. MYC-deficient fibroblasts had reduced expression of HMGIY. Western blot analysis detected increased expression of HMGIY protein in Burkitt lymphoma cell lines compared with Epstein-Barr virus-transformed B lymphocytes from a normal individual. An antisense construct decreased HMGIY protein expression, abrogated transformation of Burkitt lymphoma cells, and decreased the cell growth rate. Rat and human cell lines overexpressing HMGIY formed colonies in soft agar, and the rat cell line was tumorigenic in athymic nude mice. The results suggested that HMGIY is a potential oncogene. HMGIY orchestrates the assembly of a virus-induced enhanceosome, which consists of nuclear factor kappa-B (NFKB; 164011), interferon regulatory factors (e.g., IRF1; 147575), and ATF2 (OMIM Ref. No. 123811)/JUN (see OMIM Ref. No. 165160), by mediating a network of protein-DNA and protein-protein interactions (Thanos and Maniatis, 1995). The enhanceosome, which is assembled in a nucleosome-free enhancer region, activates transcription of beta-interferon (IFNB; 147640) through a program of chromatin-modifying activities that target a strategically positioned nucleosome that masks the TATA box and start site of transcription (Agalioti et al., 2000). Enhanceosome-activated transcription requires the recruitment of histone acetyltransferase proteins that modify histones and acetylate HMGIY. Munshi et al. (2001) showed that the accurate execution of the IFNB transcriptional switch depends on the ordered acetylation of HMGIY by CREB-binding protein (CBP; 600140) and p300/CBP-associated factor (PCAF; 602303)/GCN5 (OMIM Ref. No. 602301). Acetylation of HMGIY by CBP at lys65 destabilizes the enhanceosome, whereas acetylation by PCAF/GCN5 at lys71, which lies in a critical protein-protein interaction domain, potentiates transcription by stabilizing the enhanceosome and by preventing acetylation by CBP.

Full details of the abovementioned studies are described in the following publications, the disclosure of which are hereby incorporated by reference:

Wood, L. J.; Mukherjee, M.; Dolde, C. E.; Xu, Y.; Maher, J. F.; Bunton, T. E.; Williams, J. B.; Resar, L. M. S.: HMG-I/Y, a new c-Myc target gene and potential oncogene. Molec. Cell Biol. 20:5490-5502, 2000; and Munshi, N.; Agalioti, T.; Lomvardas, S.; Merika, M.; Chen, G.; Thanos, D.: Coordination of a transcriptional switch by HMGI(Y) acetylation. Science 293:1133-1136, 2001.

Further studies establishing the function and utilities of HMGA1 are found in John Hopkins OMIM database record ID 600701, and in cited publications listed in Table 5, which are hereby incorporated by reference. High mobility group at-hook 1 (HMGA1, Accession NP_665907.1) is another GAM139 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:11875, to the nucleotide sequence of GAM139 RNA, herein designated GAM RNA, also designated SEQ ID:327.

Another function of GAM139 is therefore inhibition of High mobility group at-hook 1 (HMGA1, Accession NP_665907.1), a gene which orchestrates the assembly of a virus-induced enhanceosome by mediating a network of protein-DNA and protein-protein interactions. Accordingly, utilities of GAM139 include diagnosis, prevention and treatment of diseases and clinical conditions associated with HMGA1.

The function of HMGA1 has been established by previous studies. Aberrant expression of MYC (OMIM Ref. No. 190080) plays an important role in the pathogenesis of several human malignancies, most notably Burkitt lymphoma (OMIM Ref. No. 113970). MYC functions as a transcription factor that works in conjunction with a partner protein, MAX (OMIM Ref. No. 154950). There are numerous target genes of My, including CAD (OMIM Ref. No. 114010), which is required for DNA synthesis, and ODC (OMIM Ref. No. 165640) and telomerase (see OMIM Ref. No. TERT; 187270), which are involved in neoplastic transformation. By mutagenesis analysis of the HMGIY promoter, Wood et al. (2000) identified a MYC-MAX consensus DNA-binding site, an E box at nucleotide -1337. Northern blot analysis detected enhanced expression of HMGIY after stimulation by hydroxytamoxifen in a cell line expressing a MYC-estradiol receptor fusion protein. MYC-deficient fibroblasts had reduced expression of HMGIY. Western blot analysis detected increased expression of HMGIY protein in Burkitt lymphoma cell lines compared with Epstein-Barr virus-transformed B lymphocytes from a normal individual. An antisense construct decreased HMGIY protein expression, abrogated transformation of Burkitt lymphoma cells, and decreased the cell growth rate. Rat and human cell lines overexpressing HMGIY formed colonies in soft agar, and the rat cell line was tumorigenic in athymic nude mice. The results suggested that HMGIY is a potential oncogene. HMGIY orchestrates the assembly of a virus-induced enhanceosome, which consists of nuclear factor kappa-B (NFKB; 164011), interferon regulatory factors (e.g., IRF1; 147575), and ATF2 (OMIM Ref. No. 123811)/JUN (see OMIM Ref. No. 165160), by mediating a network of protein-DNA and protein-protein interactions (Thanos and Maniatis, 1995). The enhanceosome, which is assembled in a nucleosome-free enhancer region, activates transcription of beta- interferon (IFNB; 147640) through a program of chromatin-modifying activities that target a strategically positioned nucleosome that masks the TATA box and start site of transcription (Agalioti et al., 2000). Enhanceosome-activated transcription requires the recruitment of histone acetyltransferase proteins that modify histones and acetylate HMGIY. Munshi et al. (2001) showed that the accurate execution of the IFNB transcriptional switch depends on the ordered acetylation of HMGIY by CREB-binding protein (CBP; 600140) and p300/CBP-associated factor (PCAF; 602303)/GCN5 (OMIM Ref. No. 602301). Acetylation of HMGIY by CBP at lys65 destabilizes the enhanceosome, whereas acetylation by PCAF/GCN5 at lys71, which lies in a critical protein-protein interaction domain, potentiates transcription by stabilizing the enhanceosome and by preventing acetylation by CBP.

Full details of the abovementioned studies are described in the following publications, the disclosure of which are hereby incorporated by reference:

Wood, L. J.; Mukherjee, M.; Dolde, C. E.; Xu, Y.; Maher, J. F.; Bunton, T. E.; Williams, J. B.; Resar, L. M. S.: HMG-I/Y, a new c-Myc target gene and potential oncogene. Molec. Cell Biol. 20:5490-5502, 2000; and Munshi, N.; Agalioti, T.; Lomvardas, S.; Merika, M.; Chen, G.; Thanos, D.: Coordination of a transcriptional switch by HMGI(Y) acetylation. Science 293:1133-1136, 2001.

Further studies establishing the function and utilities of HMGA1 are found in John Hopkins OMIM database record ID 600701, and in cited publications listed in Table 5, which are hereby incorporated by reference. High mobility group at-hook 1 (HMGA1, Accession NP_665908.1) is another GAM139 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:11875, to the nucleotide sequence of GAM139 RNA, herein designated GAM RNA, also designated SEQ ID:327.

Another function of GAM139 is therefore inhibition of High mobility group at-hook 1 (HMGA1, Accession NP_665908.1), a gene which orchestrates the assembly of a virus-induced enhanceosome by mediating a network of protein-DNA and protein-protein interactions. Accordingly, utilities of GAM139 include diagnosis, prevention and treatment of diseases and clinical conditions associated with HMGA1.

The function of HMGA1 has been established by previous studies. Aberrant expression of MYC (OMIM Ref. No. 190080) plays an important role in the pathogenesis of several human malignancies, most notably Burkitt lymphoma (OMIM Ref. No. 113970). MYC functions as a transcription factor that works in conjunction with a partner protein, MAX (OMIM Ref. No. 154950). There are numerous target genes of My, including CAD (OMIM Ref. No. 114010), which is required for DNA synthesis, and ODC (OMIM Ref. No. 165640) and telomerase (see OMIM Ref. No. TERT; 187270), which are involved in neoplastic transformation. By mutagenesis analysis of the HMGIY promoter, Wood et al. (2000) identified a MYC-MAX consensus DNA-binding site, an E box at nucleotide -1337. Northern blot analysis detected enhanced expression of HMGIY after stimulation by hydroxytamoxifen in a cell line expressing a MYC-estradiol receptor fusion protein. MYC-deficient fibroblasts had reduced expression of HMGIY. Western blot analysis detected increased expression of HMGIY protein in Burkitt lymphoma cell lines compared with Epstein-Barr virus-transformed B lymphocytes from a normal individual. An antisense construct decreased HMGIY protein expression, abrogated transformation of Burkitt lymphoma cells, and decreased the cell growth rate. Rat and human cell lines overexpressing HMGIY formed colonies in soft agar, and the rat cell line was tumorigenic in athymic nude mice. The results suggested that HMGIY is a potential oncogene. HMGIY orchestrates the assembly of a virus-induced enhanceosome, which consists of nuclear factor kappa-B (NFKB; 164011), interferon regulatory factors (e.g., IRF1; 147575), and ATF2 (OMIM Ref. No. 123811)/JUN (see OMIM Ref. No. 165160), by mediating a network of protein-DNA and protein-protein interactions (Thanos and Maniatis, 1995). The enhanceosome, which is assembled in a nucleosome-free enhancer region, activates transcription of beta- interferon (IFNB; 147640) through a program of chromatin-modifying activities that target a strategically positioned nucleosome that masks the TATA box and start site of transcription (Agalioti et al., 2000). Enhanceosome-activated transcription requires the recruitment of histone acetyltransferase proteins that modify histones and acetylate HMGIY. Munshi et al. (2001) showed that the accurate execution of the IFNB transcriptional switch depends on the ordered acetylation of HMGIY by CREB-binding protein (CBP; 600140) and p300/CBP-associated factor (PCAF; 602303)/GCN5 (OMIM Ref. No. 602301). Acetylation of HMGIY by CBP at lys65 destabilizes the enhanceosome, whereas acetylation by PCAF/GCN5 at lys71, which lies in a critical protein-protein interaction domain, potentiates transcription by stabilizing the enhanceosome and by preventing acetylation by CBP.

Full details of the abovementioned studies are described in the following publications, the disclosure of which are hereby incorporated by reference:

Wood, L. J.; Mukherjee, M.; Dolde, C. E.; Xu, Y.; Maher, J. F.; Bunton, T. E.; Williams, J. B.; Resar, L. M. S.: HMG-I/Y, a new c-Myc target gene and potential oncogene. Molec. Cell Biol. 20:5490-5502, 2000; and Munshi, N.; Agalioti, T.; Lomvardas, S.; Merika, M.; Chen, G.; Thanos, D.: Coordination of a transcriptional switch by HMGI(Y) acetylation. Science 293:1133-1136, 2001.

Further studies establishing the function and utilities of HMGA1 are found in John Hopkins OMIM database record ID 600701, and in cited publications listed in Table 5, which are hereby incorporated by reference. High mobility group at-hook 1 (HMGA1, Accession NP_665910.1) is another GAM139 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:11875, to the nucleotide sequence of GAM139 RNA, herein designated GAM RNA, also designated SEQ ID:327.

Another function of GAM139 is therefore inhibition of High mobility group at-hook 1 (HMGA1, Accession NP_665910.1), a gene which orchestrates the assembly of a virus-induced enhanceosome by mediating a network of protein-DNA and protein-protein interactions. Accordingly, utilities of GAM139 include diagnosis, prevention and treatment of diseases and clinical conditions associated with HMGA1.

The function of HMGA1 has been established by previous studies. Aberrant expression of MYC (OMIM Ref. No. 190080) plays an important role in the pathogenesis of several human malignancies, most notably Burkitt lymphoma (OMIM Ref. No. 113970). MYC functions as a transcription factor that works in conjunction with a partner protein, MAX (OMIM Ref. No. 154950). There are numerous target genes of My, including CAD (OMIM Ref. No. 114010), which is required for DNA synthesis, and ODC (OMIM Ref. No. 165640) and telomerase (see OMIM Ref. No. TERT; 187270), which are involved in neoplastic transformation. By mutagenesis analysis of the HMGIY promoter, Wood et al. (2000) identified a MYC-MAX consensus DNA-binding site, an E box at nucleotide -1337. Northern blot analysis detected enhanced expression of HMGIY after stimulation by hydroxytamoxifen in a cell line expressing a MYC-estradiol receptor fusion protein. MYC-deficient fibroblasts had reduced expression of HMGIY. Western blot analysis detected increased expression of HMGIY protein in Burkitt lymphoma cell lines compared with Epstein-Barr virus-transformed B lymphocytes from a normal individual. An antisense construct decreased HMGIY protein expression, abrogated transformation of Burkitt lymphoma cells, and decreased the cell growth rate. Rat and human cell lines overexpressing HMGIY formed colonies in soft agar, and the rat cell line was tumorigenic in athymic nude mice. The results suggested that HMGIY is a potential oncogene. HMGIY orchestrates the assembly of a virus-induced enhanceosome, which consists of nuclear factor kappa-B (NFKB; 164011), interferon regulatory factors (e.g., IRF1; 147575), and ATF2 (OMIM Ref. No. 123811)/JUN (see OMIM Ref. No. 165160), by mediating a network of protein-DNA and protein-protein interactions (Thanos and Maniatis, 1995). The enhanceosome, which is assembled in a nucleosome-free enhancer region, activates transcription of beta- interferon (IFNB; 147640) through a program of chromatin-modifying activities that target a strategically positioned nucleosome that masks the TATA box and start site of transcription (Agalioti et al., 2000). Enhanceosome-activated transcription requires the recruitment of histone acetyltransferase proteins that modify histones and acetylate HMGIY. Munshi et al. (2001) showed that the accurate execution of the IFNB transcriptional switch depends on the ordered acetylation of HMGIY by CREB-binding protein (CBP; 600140) and p300/CBP-associated factor (PCAF; 602303)/GCN5 (OMIM Ref. No. 602301). Acetylation of HMGIY by CBP at lys65 destabilizes the enhanceosome, whereas acetylation by PCAF/GCN5 at lys71, which lies in a critical protein-protein interaction domain, potentiates transcription by stabilizing the enhanceosome and by preventing acetylation by CBP.

Full details of the abovementioned studies are described in the following publications, the disclosure of which are hereby incorporated by reference:

Wood, L. J.; Mukherjee, M.; Dolde, C. E.; Xu, Y.; Maher, J. F.; Bunton, T. E.; Williams, J. B.; Resar, L. M. S.: HMG-I/Y, a new c-Myc target gene and potential oncogene. Molec. Cell Biol. 20:5490-5502, 2000; and Munshi, N.; Agalioti, T.; Lomvardas, S.; Merika, M.; Chen, G.; Thanos, D.: Coordination of a transcriptional switch by HMGI(Y) acetylation. Science 293:1133-1136, 2001.

Further studies establishing the function and utilities of HMGA1 are found in John Hopkins OMIM database record ID 600701, and in cited publications listed in Table 5, which are hereby incorporated by reference. High mobility group at-hook 1 (HMGA1, Accession NP_002122.1) is another GAM139 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:11875, to the nucleotide sequence of GAM139 RNA, herein designated GAM RNA, also designated SEQ ID:327.

Another function of GAM139 is therefore inhibition of High mobility group at-hook 1 (HMGA1, Accession NP_002122.1), a gene which orchestrates the assembly of a virus-induced enhanceosome by mediating a network of protein-DNA and protein-protein interactions. Accordingly, utilities of GAM139 include diagnosis, prevention and treatment of diseases and clinical conditions associated with HMGA1.

The function of HMGA1 has been established by previous studies. Aberrant expression of MYC (OMIM Ref. No. 190080) plays an important role in the pathogenesis of several human malignancies, most notably Burkitt lymphoma (OMIM Ref. No. 113970). MYC functions as a transcription factor that works in conjunction with a partner protein, MAX (OMIM Ref. No. 154950). There are numerous target genes of My, including CAD (OMIM Ref. No. 114010), which is required for DNA synthesis, and ODC (OMIM Ref. No. 165640) and telomerase (see OMIM Ref. No. TERT; 187270), which are involved in neoplastic transformation. By mutagenesis analysis of the HMGIY promoter, Wood et al. (2000) identified a MYC-MAX consensus DNA-binding site, an E box at nucleotide -1337. Northern blot analysis detected enhanced expression of HMGIY after stimulation by hydroxytamoxifen in a cell line expressing a MYC-estradiol receptor fusion protein. MYC-deficient fibroblasts had reduced expression of HMGIY. Western blot analysis detected increased expression of HMGIY protein in Burkitt lymphoma cell lines compared with Epstein-Barr virus-transformed B lymphocytes from a normal individual. An antisense construct decreased HMGIY protein expression, abrogated transformation of Burkitt lymphoma cells, and decreased the cell growth rate. Rat and human cell lines overexpressing HMGIY formed colonies in soft agar, and the rat cell line was tumorigenic in athymic nude mice. The results suggested that HMGIY is a potential oncogene. HMGIY orchestrates the assembly of a virus-induced enhanceosome, which consists of nuclear factor kappa-B (NFKB; 164011), interferon regulatory factors (e.g., IRF1; 147575), and ATF2 (OMIM Ref. No. 123811)/JUN (see OMIM Ref. No. 165160), by mediating a network of protein-DNA and protein-protein interactions (Thanos and Maniatis, 1995). The enhanceosome, which is assembled in a nucleosome-free enhancer region, activates transcription of beta- interferon (IFNB; 147640) through a program of chromatin-modifying activities that target a strategically positioned nucleosome that masks the TATA box and start site of transcription (Agalioti et al., 2000). Enhanceosome-activated transcription requires the recruitment of histone acetyltransferase proteins that modify histones and acetylate HMGIY. Munshi et al. (2001) showed that the accurate execution of the IFNB transcriptional switch depends on the ordered acetylation of HMGIY by CREB-binding protein (CBP; 600140) and p300/CBP-associated factor (PCAF; 602303)/GCN5 (OMIM Ref. No. 602301). Acetylation of HMGIY by CBP at lys65 destabilizes the enhanceosome, whereas acetylation by PCAF/GCN5 at lys71, which lies in a critical protein-protein interaction domain, potentiates transcription by stabilizing the enhanceosome and by preventing acetylation by CBP.

Full details of the abovementioned studies are described in the following publications, the disclosure of which are hereby incorporated by reference:

Wood, L. J.; Mukherjee, M.; Dolde, C. E.; Xu, Y.; Maher, J. F.; Bunton, T. E.; Williams, J. B.; Resar, L. M. S.: HMG-I/Y, a new c-Myc target gene and potential oncogene. Molec. Cell Biol. 20:5490-5502, 2000; and Munshi, N.; Agalioti, T.; Lomvardas, S.; Merika, M.; Chen, G.; Thanos, D.: Coordination of a transcriptional switch by HMGI(Y) acetylation. Science 293:1133-1136, 2001.

Further studies establishing the function and utilities of HMGA1 are found in John Hopkins OMIM database record ID 600701, and in cited publications listed in Table 5, which are hereby incorporated by reference. High mobility group at-hook 1 (HMGA1, Accession NP_665909.1) is another GAM139 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:11875, to the nucleotide sequence of GAM139 RNA, herein designated GAM RNA, also designated SEQ ID:327.

Another function of GAM139 is therefore inhibition of High mobility group at-hook 1 (HMGA1, Accession NP_665909.1), a gene which orchestrates the assembly of a virus-induced enhanceosome by mediating a network of protein-DNA and protein-protein interactions. Accordingly, utilities of GAM139 include diagnosis, prevention and treatment of diseases and clinical conditions associated with HMGA1.

The function of HMGA1 has been established by previous studies. Aberrant expression of MYC (OMIM Ref. No. 190080) plays an important role in the pathogenesis of several human malignancies, most notably Burkitt lymphoma (OMIM Ref. No. 113970). MYC functions as a transcription factor that works in conjunction with a partner protein, MAX (OMIM Ref. No. 154950). There are numerous target genes of My, including CAD (OMIM Ref. No. 114010), which is required for DNA synthesis, and ODC (OMIM Ref. No. 165640) and telomerase (see OMIM Ref. No. TERT; 187270), which are involved in neoplastic transformation. By mutagenesis analysis of the HMGIY promoter, Wood et al. (2000) identified a MYC-MAX consensus DNA-binding site, an E box at nucleotide -1337. Northern blot analysis detected enhanced expression of HMGIY after stimulation by hydroxytamoxifen in a cell line expressing a MYC-estradiol receptor fusion protein. MYC-deficient fibroblasts had reduced expression of HMGIY. Western blot analysis detected increased expression of HMGIY protein in Burkitt lymphoma cell lines compared with Epstein-Barr virus-transformed B lymphocytes from a normal individual. An antisense construct decreased HMGIY protein expression, abrogated transformation of Burkitt lymphoma cells, and decreased the cell growth rate. Rat and human cell lines overexpressing HMGIY formed colonies in soft agar, and the rat cell line was tumorigenic in athymic nude mice. The results suggested that HMGIY is a potential oncogene. HMGIY orchestrates the assembly of a virus-induced enhanceosome, which consists of nuclear factor kappa-B (NFKB; 164011), interferon regulatory factors (e.g., IRF1; 147575), and ATF2 (OMIM Ref. No. 123811)/JUN (see OMIM Ref. No. 165160), by mediating a network of protein-DNA and protein-protein interactions (Thanos and Maniatis, 1995). The enhanceosome, which is assembled in a nucleosome-free enhancer region, activates transcription of beta- interferon (IFNB; 147640) through a program of chromatin-modifying activities that target a strategically positioned nucleosome that masks the TATA box and start site of transcription (Agalioti et al., 2000). Enhanceosome-activated transcription requires the recruitment of histone acetyltransferase proteins that modify histones and acetylate HMGIY. Munshi et al. (2001) showed that the accurate execution of the IFNB transcriptional switch depends on the ordered acetylation of HMGIY by CREB-binding protein (CBP; 600140) and p300/CBP-associated factor (PCAF; 602303)/GCN5 (OMIM Ref. No. 602301). Acetylation of HMGIY by CBP at lys65 destabilizes the enhanceosome, whereas acetylation by PCAF/GCN5 at lys71, which lies in a critical protein-protein interaction domain, potentiates transcription by stabilizing the enhanceosome and by preventing acetylation by CBP.

Full details of the abovementioned studies are described in the following publications, the disclosure of which are hereby incorporated by reference:

Wood, L. J.; Mukherjee, M.; Dolde, C. E.; Xu, Y.; Maher, J. F.; Bunton, T. E.; Williams, J. B.; Resar, L. M. S.: HMG-I/Y, a new c-Myc target gene and potential oncogene. Molec. Cell Biol. 20:5490-5502, 2000; and Munshi, N.; Agalioti, T.; Lomvardas, S.; Merika, M.; Chen, G.; Thanos, D.: Coordination of a transcriptional switch by HMGI(Y) acetylation. Science 293:1133-1136, 2001.

Further studies establishing the function and utilities of HMGA1 are found in John Hopkins OMIM database record ID 600701, and in cited publications listed in Table 5, which are hereby incorporated by reference. High mobility group at-hook 1 (HMGA1, Accession NP_665912.1) is another GAM139 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:11875, to the nucleotide sequence of GAM139 RNA, herein designated GAM RNA, also designated SEQ ID:327.

Another function of GAM139 is therefore inhibition of High mobility group at-hook 1 (HMGA1, Accession NP_665912.1), a gene which orchestrates the assembly of a virus-induced enhanceosome by mediating a network of protein-DNA and protein-protein interactions. Accordingly, utilities of GAM139 include diagnosis, prevention and treatment of diseases and clinical conditions associated with HMGA1.

The function of HMGA1 has been established by previous studies. Aberrant expression of MYC (OMIM Ref. No. 190080) plays an important role in the pathogenesis of several human malignancies, most notably Burkitt lymphoma (OMIM Ref. No. 113970). MYC functions as a transcription factor that works in conjunction with a partner protein, MAX (OMIM Ref. No. 154950). There are numerous target genes of My, including CAD (OMIM Ref. No. 114010), which is required for DNA synthesis, and ODC (OMIM Ref. No. 165640) and telomerase (see OMIM Ref. No. TERT; 187270), which are involved in neoplastic transformation. By mutagenesis analysis of the HMGIY promoter, Wood et al. (2000) identified a MYC-MAX consensus DNA-binding site, an E box at nucleotide -1337. Northern blot analysis detected enhanced expression of HMGIY after stimulation by hydroxytamoxifen in a cell line expressing a MYC-estradiol receptor fusion protein. MYC-deficient fibroblasts had reduced expression of HMGIY. Western blot analysis detected increased expression of HMGIY protein in Burkitt lymphoma cell lines compared with Epstein-Barr virus-transformed B lymphocytes from a normal individual. An antisense construct decreased HMGIY protein expression, abrogated transformation of Burkitt lymphoma cells, and decreased the cell growth rate. Rat and human cell lines overexpressing HMGIY formed colonies in soft agar, and the rat cell line was tumorigenic in athymic nude mice. The results suggested that HMGIY is a potential oncogene. HMGIY orchestrates the assembly of a virus-induced enhanceosome, which consists of nuclear factor kappa-B (NFKB; 164011), interferon regulatory factors (e.g., IRF1; 147575), and ATF2 (OMIM Ref. No. 123811)/JUN (see OMIM Ref. No. 165160), by mediating a network of protein-DNA and protein-protein interactions (Thanos and Maniatis, 1995). The enhanceosome, which is assembled in a nucleosome-free enhancer region, activates transcription of beta- interferon (IFNB; 147640) through a program of chromatin-modifying activities that target a strategically positioned nucleosome that masks the TATA box and start site of transcription (Agalioti et al., 2000). Enhanceosome-activated transcription requires the recruitment of histone acetyltransferase proteins that modify histones and acetylate HMGIY. Munshi et al. (2001) showed that the accurate execution of the IFNB transcriptional switch depends on the ordered acetylation of HMGIY by CREB-binding protein (CBP; 600140) and p300/CBP-associated factor (PCAF; 602303)/GCN5 (OMIM Ref. No. 602301). Acetylation of HMGIY by CBP at lys65 destabilizes the enhanceosome, whereas acetylation by PCAF/GCN5 at lys71, which lies in a critical protein-protein interaction domain, potentiates transcription by stabilizing the enhanceosome and by preventing acetylation by CBP.

Full details of the abovementioned studies are described in the following publications, the disclosure of which are hereby incorporated by reference:

Wood, L. J.; Mukherjee, M.; Dolde, C. E.; Xu, Y.; Maher, J. F.; Bunton, T. E.; Williams, J. B.; Resar, L. M. S.: HMG-I/Y, a new c-Myc target gene and potential oncogene. Molec. Cell Biol. 20:5490-5502, 2000; and Munshi, N.; Agalioti, T.; Lomvardas, S.; Merika, M.; Chen, G.; Thanos, D.: Coordination of a transcriptional switch by HMGI(Y) acetylation. Science 293:1133-1136, 2001.

Further studies establishing the function and utilities of HMGA1 are found in John Hopkins OMIM database record ID 600701, and in cited publications listed in Table 5, which are hereby incorporated by reference. HP43.8KD (Accession NP_115946.2) is another GAM139 target gene, herein designated TARGET GENE. HP43.8KD BINDING SITE1 and HP43.8KD BINDING SITE2 are target binding sites found in untranslated regions of mRNA encoded by HP43.8KD, corresponding to target binding sites such as BINDING SITE I, BINDING SITE II or BINDING SITE III of FIG. 8. Table 4 illustrates the complementarity of the nucleotide sequences of HP43.8KD BINDING SITE1 and HP43.8KD BINDING SITE2, designated SEQ ID:13643 and SEQ ID:11596 respectively, to the nucleotide sequence of GAM139 RNA, herein designated GAM RNA, also designated SEQ ID:327.

Another function of GAM139 is therefore inhibition of HP43.8KD (Accession NP_115946.2). Accordingly, utilities of GAM139 include diagnosis, prevention and treatment of diseases and clinical conditions associated with HP43.8KD.

Hippocalcin-like 1 (HPCAL1, Accession NP_602293.1) is another GAM139 target gene, herein designated TARGET GENE. HPCAL1 BINDING SITE is a target binding site found in the 5' untranslated region of multiple transcripts of mRNA encoded by HPCAL1, corresponding to a target binding site such as BINDING SITE I, BINDING SITE II or BINDING SITE III of FIG. 8. Table 4 illustrates the complementarity of the nucleotide sequences of HPCAL1 BINDING SITE, designated SEQ ID:15809, to the nucleotide sequence of GAM139 RNA, herein designated GAM RNA, also designated SEQ ID:327.

Another function of GAM139 is therefore inhibition of Hippocalcin-like 1 (HPCAL1, Accession NP_602293.1). Accordingly, utilities of GAM139 include diagnosis, prevention and treatment of diseases and clinical conditions associated with HPCAL1.

Hermansky-pudlak syndrome 4 (HPS4, Accession NP_690053.1) is another GAM139 target gene, herein designated TARGET GENE. HPS4 BINDING SITE is a target binding site found in the 3' untranslated region of multiple transcripts of mRNA encoded by HPS4, corresponding to a target binding site such as BINDING SITE I, BINDING SITE II or BINDING SITE III of FIG. 8. Table 4 illustrates the complementarity of the nucleotide sequences of HPS4 BINDING SITE, designated SEQ ID:14923, to the nucleotide sequence of GAM139 RNA, herein designated GAM RNA, also designated SEQ ID:327.

Another function of GAM139 is therefore inhibition of Hermansky-pudlak syndrome 4 (HPS4, Accession NP_690053.1). Accordingly, utilities of GAM139 include diagnosis, prevention and treatment of diseases and clinical conditions associated with HPS4.

Hermansky-pudlak syndrome 4 (HPS4, Accession NP_690054.1) is another GAM139 target gene, herein designated TARGET GENE. HPS4 BINDING SITE is a target binding site found in the 3' untranslated region of multiple transcripts of mRNA encoded by HPS4, corresponding to a target binding site such as BINDING SITE I, BINDING SITE II or BINDING SITE III of FIG. 8. Table 4 illustrates the complementarity of the nucleotide sequences of HPS4 BINDING SITE, designated SEQ ID:14923, to the nucleotide sequence of GAM139 RNA, herein designated GAM RNA, also designated SEQ ID:327.

Another function of GAM139 is therefore inhibition of Hermansky-pudlak syndrome 4 (HPS4, Accession NP_690054.1). Accordingly, utilities of GAM139 include diagnosis, prevention and treatment of diseases and clinical conditions associated with HPS4.

Hermansky-pudlak syndrome 4 (HPS4, Accession NP_690055.1) is another GAM139 target gene, herein designated TARGET GENE. HPS4 BINDING SITE is a target binding site found in the 3' untranslated region of multiple transcripts of mRNA encoded by HPS4, corresponding to a target binding site such as BINDING SITE I, BINDING SITE II or BINDING SITE III of FIG. 8. Table 4 illustrates the complementarity of the nucleotide sequences of HPS4 BINDING SITE, designated SEQ ID:14923, to the nucleotide sequence of GAM139 RNA, herein designated GAM RNA, also designated SEQ ID:327.

Another function of GAM139 is therefore inhibition of Hermansky-pudlak syndrome 4 (HPS4, Accession NP_690055.1). Accordingly, utilities of GAM139 include diagnosis, prevention and treatment of diseases and clinical conditions associated with HPS4.

Hermansky-pudlak syndrome 4 (HPS4, Accession NP_071364.4) is another GAM139 target gene, herein designated TARGET GENE. HPS4 BINDING SITE is a target binding site found in the 3' untranslated region of multiple transcripts of mRNA encoded by HPS4, corresponding to a target binding site such as BINDING SITE I, BINDING SITE II or BINDING SITE III of FIG. 8. Table 4 illustrates the complementarity of the nucleotide sequences of HPS4 BINDING SITE, designated SEQ ID:14923, to the nucleotide sequence of GAM139 RNA, herein designated GAM RNA, also designated SEQ ID:327.

Another function of GAM139 is therefore inhibition of Hermansky-pudlak syndrome 4 (HPS4, Accession NP_071364.4). Accordingly, utilities of GAM139 include diagnosis, prevention and treatment of diseases and clinical conditions associated with HPS4.

Hermansky-pudlak syndrome 4 (HPS4, Accession NP_690056.1) is another GAM139 target gene, herein designated TARGET GENE. HPS4 BINDING SITE is a target binding site found in the 3' untranslated region of multiple transcripts of mRNA encoded by HPS4, corresponding to a target binding site such as BINDING SITE I, BINDING SITE II or BINDING SITE III of FIG. 8. Table 4 illustrates the complementarity of the nucleotide sequences of HPS4 BINDING SITE, designated SEQ ID:14923, to the nucleotide sequence of GAM139 RNA, herein designated GAM RNA, also designated SEQ ID:327.

Another function of GAM139 is therefore inhibition of Hermansky-pudlak syndrome 4 (HPS4, Accession NP_690056.1). Accordingly, utilities of GAM139 include diagnosis, prevention and treatment of diseases and clinical conditions associated with HPS4.

HSA250839 (Accession NP_060871.1) is another GAM139 target gene, herein designated TARGET GENE. HSA250839 BINDING SITE is a target binding site found in the 3' untranslated region of mRNA encoded by HSA250839, corresponding to a target binding site such as BINDING SITE I, BINDING SITE II or BINDING SITE III of FIG. 8. Table 4 illustrates the complementarity of the nucleotide sequences of HSA250839 BINDING SITE, designated SEQ ID:15722, to the nucleotide sequence of GAM139 RNA, herein designated GAM RNA, also designated SEQ ID:327.

Another function of GAM139 is therefore inhibition of HSA250839 (Accession NP_060871.1). Accordingly, utilities of GAM139 include diagnosis, prevention and treatment of diseases and clinical conditions associated with HSA250839.

HUMAGCGB (Accession XP_291083.2) is another GAM139 target gene, herein designated TARGET GENE. HUMAGCGB BINDING SITE is a target binding site found in the 3' untranslated region of multiple transcripts of mRNA encoded by HUMAGCGB, corresponding to a target binding site such as BINDING SITE I, BINDING SITE II or BINDING SITE III of FIG. 8. Table 4 illustrates the complementarity of the nucleotide sequences of HUMAGCGB BINDING SITE, designated SEQ ID:10384, to the nucleotide sequence of GAM139 RNA, herein designated GAM RNA, also designated SEQ ID:327.

Another function of GAM139 is therefore inhibition of HUMAGCGB (Accession XP_291083.2). Accordingly, utilities of GAM139 include diagnosis, prevention and treatment of diseases and clinical conditions associated with HUMAGCGB.

HUMAGCGB (Accession NP_037418.2) is another GAM139 target gene, herein designated TARGET GENE. HUMAGCGB BINDING SITE is a target binding site found in the 3' untranslated region of multiple transcripts of mRNA encoded by HUMAGCGB, corresponding to a target binding site such as BINDING SITE I, BINDING SITE II or BINDING SITE III of FIG. 8. Table 4 illustrates the complementarity of the nucleotide sequences of HUMAGCGB BINDING SITE, designated SEQ ID:10384, to the nucleotide sequence of GAM139 RNA, herein designated GAM RNA, also designated SEQ ID:327.

Another function of GAM139 is therefore inhibition of HUMAGCGB (Accession NP_037418.2). Accordingly, utilities of GAM139 include diagnosis, prevention and treatment of diseases and clinical conditions associated with HUMAGCGB.

Hypoxia up-regulated 1 (HYOU1, Accession NP_006380.1) is another GAM139 target gene, herein designated TARGET GENE. HYOU1 BINDING SITE1 and HYOU1 BINDING SITE2 are target binding sites found in untranslated regions of mRNA encoded by HYOU1, corresponding to target binding sites such as BINDING SITE I, BINDING SITE II or BINDING SITE III of FIG. 8. Table 4 illustrates the complementarity of the nucleotide sequences of HYOU1 BINDING SITE1 and HYOU1 BINDING SITE2, designated SEQ ID:3370 and SEQ ID:5055 respectively, to the nucleotide sequence of GAM139 RNA, herein designated GAM RNA, also designated SEQ ID:327.

Another function of GAM139 is therefore inhibition of Hypoxia up-regulated 1 (HYOU1, Accession NP_006380.1). Accordingly, utilities of GAM139 include diagnosis, prevention and treatment of diseases and clinical conditions associated with HYOU1.

Isoprenylcysteine carboxyl methyltransferase (ICMT, Accession NP_733806.1) is another GAM139 target gene, herein designated TARGET GENE. ICMT BINDING SITE1 and ICMT BINDING SITE2 are target binding sites found in untranslated regions of multiple transcripts of mRNA encoded by ICMT, corresponding to target binding sites such as BINDING SITE I, BINDING SITE II or BINDING SITE III of FIG. 8. Table 4 illustrates the complementarity of the nucleotide sequences of ICMT BINDING SITE1 and ICMT BINDING SITE2, designated SEQ ID:8391 and SEQ ID:6960 respectively, to the nucleotide sequence of GAM139 RNA, herein designated GAM RNA, also designated SEQ ID:327.

Another function of GAM139 is therefore inhibition of Isoprenylcysteine carboxyl methyltransferase (ICMT, Accession NP_733806.1). Accordingly, utilities of GAM139 include diagnosis, prevention and treatment of diseases and clinical conditions associated with ICMT.

Immunoglobulin superfamily, member 4 (IGSF4, Accession NP_055148.2) is another GAM139 target gene, herein designated TARGET GENE. IGSF4 BINDING SITE is a target binding site found in the 3' untranslated region of mRNA encoded by IGSF4, corresponding to a target binding site such as BINDING SITE I, BINDING SITE II or BINDING SITE III of FIG. 8. Table 4 illustrates the complementarity of the nucleotide sequences of IGSF4 BINDING SITE, designated SEQ ID:15663, to the nucleotide sequence of GAM139 RNA, herein designated GAM RNA, also designated SEQ ID:327.

Another function of GAM139 is therefore inhibition of Immunoglobulin superfamily, member 4 (IGSF4, Accession NP_055148.2), a gene which Low similarity to viral receptors and adhesion molecules and contains immunoglobulin domains. Accordingly, utilities of GAM139 include diagnosis, prevention and treatment of diseases and clinical conditions associated with IGSF4.

The function of IGSF4 has been established by previous studies. Loss of genetic material at the cytogenetic level and loss of heterozygosity (LOH) are frequently observed in tumors. The 11q22-q24 region has deletions or LOH in a variety of tumor types. Replacement of the missing copy of chromosome 11 in the A549 adenocarcinoma cell line with a normal chromosome 11 reversed tumorigenicity in nude mice, suggesting the existence of a tumor suppressor gene (Satoh et al., 1993). By constructing a BAC, PAC, and P1 contig map covering a YAC clone of part of chromosome 11q, EST mapping, exon trapping, and cDNA library screening, Gomyo et al. (1999) isolated a cDNA encoding IGSF4. The predicted 442-amino acid protein contains a signal peptide and a transmembrane domain. IGSF4 shares 65% identity with neural cell adhesion molecule-1 (NCAM1; 116930) and NCAM2 (OMIM Ref. No. 602040) within their Ig-like C2-type domains. Northern blot analysis revealed expression of a 4.4-kb transcript in all tissues tested except leukocytes. Genomic sequence analysis determined that the IGSF4 gene contains 10 exons and spans 300 kb. SSCP analysis showed that all breast cancer and neuroblastoma tissues tested possessed a deletion of 1 allele of the IGSF4 gene. Gomyo et al. (1999), however, were unable to conclude that IGSF4 is a tumor suppressor Biederer et al. (2002) identified SynCAM by searching sequence databanks for vertebrate proteins with extracellular immunoglobulin domains and an intracellular PDZ- domain protein-interaction sequence. Although SynCAM mRNA is widely distributed, antibodies against the protein reacted with multiple bands that were detected only in brain. The multiple SynCAM bands are due to complex N-glycosylation, because enzymatic removal of N-linked carbohydrates converted these bands into a single species of approximately 45 kD, whereas no O-glycosylation of SynCAM was observed. Biederer et al. (2002) showed that SynCAM functions as a homophilic cell adhesion molecule at the synapse. Expression of the isolated cytoplasmic tail of SynCAM in neurons inhibited synapse assembly. Conversely, expression of full-length SynCAM in nonneuronal cells induced synapse formation by cocultured hippocampal neurons with normal release properties. Glutamatergic synaptic transmission was reconstituted in these nonneuronal cells by coexpressing glutamate receptors with SynCAM, which suggests that a single type of adhesion molecule and glutamate receptor are sufficient for a functional postsynaptic response Full details of the abovementioned studies are described in the following publications, the disclosure of which are hereby incorporated by reference:

Biederer, T.; Sara, Y.; Mozhayeva, M.; Atasoy, D.; Liu, X.; Kavalali, E. T.; Sudhof, T. C.: SynCAM, a synaptic adhesion molecule that drives synapse assembly. Science 297:1525-1531, 2002; and Gomy, H.; Arai, Y.; Tanigami, A.; Murakami, Y.; Hattori, M.; Hosoda, F.; Arai, K.; Aikawa, Y.; Tsuda, H.; Hirohashi, S.; Asakawa, S.; Shimizu, N.; Soeda, E.; Sakaki, Y.; Ohki, M.: A.

Further studies establishing the function and utilities of IGSF4 are found in John Hopkins OMIM database record ID 605686, and in cited publications listed in Table 5, which are hereby incorporated by reference. IL-17RE (Accession NP_653241.1) is another GAM139 target gene, herein designated TARGET GENE. IL-17RE BINDING SITE1 through IL-17RE BINDING SITE3 are target binding sites found in untranslated regions of multiple transcripts of mRNA encoded by IL-17RE, corresponding to target binding sites such as BINDING SITE I, BINDING SITE II or BINDING SITE III of FIG. 8. Table 4 illustrates the complementarity of the nucleotide sequences of IL-17RE BINDING SITE1 through IL-17RE BINDING SITE3, designated SEQ ID:1468, SEQ ID:1468 and SEQ ID:19627 respectively, to the nucleotide sequence of GAM139 RNA, herein designated GAM RNA, also designated SEQ ID:327.

Another function of GAM139 is therefore inhibition of IL-17RE (Accession NP_653241.1). Accordingly, utilities of GAM139 include diagnosis, prevention and treatment of diseases and clinical conditions associated with IL-17RE.

IL-17RE (Accession NP_653241.1) is another GAM139 target gene, herein designated TARGET GENE. IL-17RE BINDING SITE1 through IL-17RE BINDING SITE3 are target binding sites found in untranslated regions of multiple transcripts of mRNA encoded by IL-17RE, corresponding to target binding sites such as BINDING SITE I, BINDING SITE II or BINDING SITE III of FIG. 8. Table 4 illustrates the complementarity of the nucleotide sequences of IL-17RE BINDING SITE1 through IL-17RE BINDING SITE3, designated SEQ ID:19627, SEQ ID:14593 and SEQ ID:14593 respectively, to the nucleotide sequence of GAM139 RNA, herein designated GAM RNA, also designated SEQ ID:327.

Another function of GAM139 is therefore inhibition of IL-17RE (Accession NP_653241.1). Accordingly, utilities of GAM139 include diagnosis, prevention and treatment of diseases and clinical conditions associated with IL-17RE.

Integrin-linked kinase-associated serine/threonine phosphatase 2c (ILKAP, Accession NP_789769.1) is another GAM139 target gene, herein designated TARGET GENE. ILKAP BINDING SITE is a target binding site found in the 5' untranslated region of multiple transcripts of mRNA encoded by ILKAP, corresponding to a target binding site such as BINDING SITE I, BINDING SITE II or BINDING SITE III of FIG. 8. Table 4 illustrates the complementarity of the nucleotide sequences of ILKAP BINDING SITE, designated SEQ ID:9889, to the nucleotide sequence of GAM139 RNA, herein designated GAM RNA, also designated SEQ ID:327.

Another function of GAM139 is therefore inhibition of Integrin-linked kinase-associated serine/threonine phosphatase 2c (ILKAP, Accession NP_789769.1). Accordingly, utilities of GAM139 include diagnosis, prevention and treatment of diseases and clinical conditions associated with ILKAP.

Integrin-linked kinase-associated serine/threonine phosphatase 2c (ILKAP, Accession NP_110395.1) is another GAM139 target gene, herein designated TARGET GENE. ILKAP BINDING SITE is a target binding site found in the 5' untranslated region of multiple transcripts of mRNA encoded by ILKAP, corresponding to a target binding site such as BINDING SITE I, BINDING SITE II or BINDING SITE III of FIG. 8. Table 4 illustrates the complementarity of the nucleotide sequences of ILKAP BINDING SITE, designated SEQ ID:9889, to the nucleotide sequence of GAM139 RNA, herein designated GAM RNA, also designated SEQ ID:327.

Another function of GAM139 is therefore inhibition of Integrin-linked kinase-associated serine/threonine phosphatase 2c (ILKAP, Accession NP_110395.1). Accordingly, utilities of GAM139 include diagnosis, prevention and treatment of diseases and clinical conditions associated with ILKAP.

Potassium large conductance calcium-activated channel, subfamily m, beta member 1 (KCNMB1, Accession NP_004128.1) is another GAM139 target gene, herein designated TARGET GENE. KCNMB1 BINDING SITE is a target binding site found in the 5' untranslated region of mRNA encoded by KCNMB1, corresponding to a target binding site such as BINDING SITE I, BINDING SITE II or BINDING SITE III of FIG. 8. Table 4 illustrates the complementarity of the nucleotide sequences of KCNMB1 BINDING SITE, designated SEQ ID:8103, to the nucleotide sequence of GAM139 RNA, herein designated GAM RNA, also designated SEQ ID:327.

Another function of GAM139 is therefore inhibition of Potassium large conductance calcium-activated channel, subfamily m, beta member 1 (KCNMB1, Accession NP_004128.1), a gene which is a potassium channel protein which may modulate the properties of the pore-forming alpha subunit. Accordingly, utilities of GAM139 include diagnosis, prevention and treatment of diseases and clinical conditions associated with KCNMB1.

The function of KCNMB1 has been established by previous studies. Large conductance, voltage- and calcium-sensitive potassium (MaxiK) channels are fundamental in the control of smooth muscle tone and neuronal excitability. MaxiK channels can be formed by 2 subunits: the pore-forming alpha subunit (HSLO; 600150) and the modulatory beta subunit. MaxiK channels are sensitive to external application of several peptidyl toxins, such as charybdotoxin (ChTX), which bind with high affinity to a receptor site located in the external vestibule of the channel and prevent potassium flux by physical occlusion of the pore. Knaus et al. (1994) demonstrated that ChTX is specifically bound to the 31-kD beta subunit of the bovine tracheal smooth muscle MaxiK channel. They cloned cDNAs encoding the bovine beta subunit and found that the predicted protein contains 2 putative transmembrane domains. Under nondenaturing conditions, antibodies against the beta subunit immunoprecipitated both the alpha and beta subunits of the channel, demonstrating that, in vivo, the MaxiK channel exists as a multimer containing both alpha and beta subunits. Knaus et al. (1994) noted that the beta subunit must be in close proximity to the pore since ChTX, which blocks the pore on the alpha-subunit, is covalently incorporated into the beta subunit. Calcium regulation of gene expression is critical for the long lasting activity-dependent changes in cellular electrical properties that underlie important physiologic functions such as learning and memory. Cellular electrical properties are diversified through the extensive alternative splicing of ion channel pre-mRNAs. The STREX exon of Slo confers higher calcium sensitivity on the channel. Xie and Black (2001) demonstrated that the depolarization of rat pituitary cells represses splicing of the STREX exon in BK potassium channel transcripts through the activation of calcium/calmodulin-dependent protein kinases. Overexpressing constitutively active CAMK4 (OMIM Ref. No. 114080), but not CAMK1 (OMIM Ref. No. 604998) or CAMK2 (OMIM Ref. No. 114078), specifically decreases STREX inclusion in the mRNA. This decrease is prevented by mutations in particular RNA repressor sequences. Transferring 54 nucleotides from the 3-prime splice site upstream of STREX to a heterologous gene is sufficient to confer CAMK4 repression on an otherwise constitutive exon. Xie and Black (2001) concluded that their experiments define a CAMK4-responsive RNA element (CaRRE), which mediates the alternative splicing of ion channel pre-mRNAs. The CaRRE presents a unique molecular target for inducing long-term adaptive changes in cellular electrical properties. It also provides a model system for dissecting the effect of signal transduction pathways on alternative splicing Animal model experiments lend further support to the function of KCNMB1. Small arteries exhibit tone, a partially contracted state that is an important determinant of blood pressure. In arterial smooth muscle cells, intracellular calcium paradoxically controls both contraction and relaxation. Calcium-dependent relaxation is mediated by local calcium release from the sarcoplasmic reticulum. These 'calcium sparks' activate calcium-dependent potassium (BK) channels comprised of alpha- and beta-1 subunits. Brenner et al. (2000) showed that targeted deletion of the gene for the beta-1 subunit leads to a decrease in the calcium sensitivity of BK channels, a reduction in functional coupling of calcium sparks to BK channel activation, and increases in arterial tone and blood pressure. The beta-1 subunit of the BK channel, by tuning the channel's calcium sensitivity, is a key molecular component in translating calcium signals to the central physiologic function of vasoregulation.

It is appreciated that the abovementioned animal model for KCNMB1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Xie, J.; Black, D. L.: A CaMK IV responsive RNA element mediates depolarization- induced alternative splicing of ion channels. Nature 410:936-439, 2001; and Brenner, R.; Perez, G. J.; Bonev, A. D.; Eckman, D. M.; Kosek, J. C.; Wiler, S. W.; Patterson, A. J.; Nelson, M. T.; Aldrich, R. W.: Vasoregulation by the beta-1 subunit of the calcium.

Further studies establishing the function and utilities of KCNMB1 are found in John Hopkins OMIM database record ID 603951, and in cited publications listed in Table 5, which are hereby incorporated by reference. Potassium intermediate/small conductance calcium-activated channel, subfamily n, member 2 (KCNN2, Accession NP_067627.2) is another GAM139 target gene, herein designated TARGET GENE. KCNN2 BINDING SITE is a target binding site found in the 5' untranslated region of multiple transcripts of mRNA encoded by KCNN2, corresponding to a target binding site such as BINDING SITE I, BINDING SITE II or BINDING SITE III of FIG. 8. Table 4 illustrates the complementarity of the nucleotide sequences of KCNN2 BINDING SITE, designated SEQ ID:3750, to the nucleotide sequence of GAM139 RNA, herein designated GAM RNA, also designated SEQ ID:327.

Another function of GAM139 is therefore inhibition of Potassium intermediate/small conductance calcium-activated channel, subfamily n, member 2 (KCNN2, Accession NP_067627.2), a gene which forms a voltage-independent potassium channel activated by intracellular calcium. Accordingly, utilities of GAM139 include diagnosis, prevention and treatment of diseases and clinical conditions associated with KCNN2.

The function of KCNN2 and its association with various diseases and clinical conditions, has been established by previous studies, as described hereinabove with reference to GAM47.1. KIAA0182 (Accession XP_050495.4) is another GAM139 target gene, herein designated TARGET GENE. KIAA0182 BINDING SITE is a target binding site found in the 3' untranslated region of mRNA encoded by KIAA0182, corresponding to a target binding site such as BINDING SITE I, BINDING SITE II or BINDING SITE III of FIG. 8. Table 4 illustrates the complementarity of the nucleotide sequences of KIAA0182 BINDING SITE, designated SEQ ID:6545, to the nucleotide sequence of GAM139 RNA, herein designated GAM RNA, also designated SEQ ID:327.

Another function of GAM139 is therefore inhibition of KIAA0182 (Accession XP_050495.4). Accordingly, utilities of GAM139 include diagnosis, prevention and treatment of diseases and clinical conditions associated with KIAA0182.

KIAA0247 (Accession NP_055549.1) is another GAM139 target gene, herein designated TARGET GENE. KIAA0247 BINDING SITE is a target binding site found in the 3' untranslated region of mRNA encoded by KIAA0247, corresponding to a target binding site such as BINDING SITE I, BINDING SITE II or BINDING SITE III of FIG. 8. Table 4 illustrates the complementarity of the nucleotide sequences of KIAA0247 BINDING SITE, designated SEQ ID:18761, to the nucleotide sequence of GAM139 RNA, herein designated GAM RNA, also designated SEQ ID:327.

Another function of GAM139 is therefore inhibition of KIAA0247 (Accession NP_055549.1). Accordingly, utilities of GAM139 include diagnosis, prevention and treatment of diseases and clinical conditions associated with KIAA0247.

KIAA0290 (Accession NP_055937.1) is another GAM139 target gene, herein designated TARGET GENE. KIAA0290 BINDING SITE is a target binding site found in the 3' untranslated region of mRNA encoded by KIAA0290, corresponding to a target binding site such as BINDING SITE I, BINDING SITE II or BINDING SITE III of FIG. 8. Table 4 illustrates the complementarity of the nucleotide sequences of KIAA0290 BINDING SITE, designated SEQ ID:8089, to the nucleotide sequence of GAM139 RNA, herein designated GAM RNA, also designated SEQ ID:327.

Another function of GAM139 is therefore inhibition of KIAA0290 (Accession NP_055937.1). Accordingly, utilities of GAM139 include diagnosis, prevention and treatment of diseases and clinical conditions associated with KIAA0290.

KIAA0459 (Accession XP_027862.1) is another GAM139 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:9393, to the nucleotide sequence of GAM139 RNA, herein designated GAM RNA, also designated SEQ ID:327.

Another function of GAM139 is therefore inhibition of KIAA0459 (Accession XP_027862.1). Accordingly, utilities of GAM139 include diagnosis, prevention and treatment of diseases and clinical conditions associated with KIAA0459.

KIAA0475 (Accession NP_055679.1) is another GAM139 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:14521, to the nucleotide sequence of GAM139 RNA, herein designated GAM RNA, also designated SEQ ID:327.

Another function of GAM139 is therefore inhibition of KIAA0475 (Accession NP_055679.1). Accordingly, utilities of GAM139 include diagnosis, prevention and treatment of diseases and clinical conditions associated with KIAA0475.

KIAA0514 (Accession NP_055511.1) is another GAM139 target gene, herein designated TARGET GENE. KIAA0514 BINDING SITE1 and KIAA0514 BINDING SITE2 are target binding sites found in untranslated regions of mRNA encoded by KIAA0514, corresponding to target binding sites such as BINDING SITE I, BINDING SITE II or BINDING SITE III of FIG. 8. Table 4 illustrates the complementarity of the nucleotide sequences of KIAA0514 BINDING SITE1 and KIAA0514 BINDING SITE2, designated SEQ ID:14213 and SEQ ID:11461 respectively, to the nucleotide sequence of GAM139 RNA, herein designated GAM RNA, also designated SEQ ID:327.

Another function of GAM139 is therefore inhibition of KIAA0514 (Accession NP_055511.1). Accordingly, utilities of GAM139 include diagnosis, prevention and treatment of diseases and clinical conditions associated with KIAA0514.

KIAA0570 (Accession XP_291018.1) is another GAM139 target gene, herein designated TARGET GENE. KIAA0570 BINDING SITE is a target binding site found in the 3' untranslated region of mRNA encoded by KIAA0570, corresponding to a target binding site such as BINDING SITE I, BINDING SITE II or BINDING SITE III of FIG. 8. Table 4 illustrates the complementarity of the nucleotide sequences of KIAA0570 BINDING SITE, designated SEQ ID:7196, to the nucleotide sequence of GAM139 RNA, herein designated GAM RNA, also designated SEQ ID:327.

Another function of GAM139 is therefore inhibition of KIAA0570 (Accession XP_291018.1). Accordingly, utilities of GAM139 include diagnosis, prevention and treatment of diseases and clinical conditions associated with KIAA0570.

KIAA0652 (Accession NP_055556.1) is another GAM139 target gene, herein designated TARGET GENE. KIAA0652 BINDING SITE is a target binding site found in the 3' untranslated region of mRNA encoded by KIAA0652, corresponding to a target binding site such as BINDING SITE I, BINDING SITE II or BINDING SITE III of FIG. 8. Table 4 illustrates the complementarity of the nucleotide sequences of KIAA0652 BINDING SITE, designated SEQ ID:7082, to the nucleotide sequence of GAM139 RNA, herein designated GAM RNA, also designated SEQ ID:327.

Another function of GAM139 is therefore inhibition of KIAA0652 (Accession NP_055556.1). Accordingly, utilities of GAM139 include diagnosis, prevention and treatment of diseases and clinical conditions associated with KIAA0652.

KIAA0683 (Accession NP_057195.1) is another GAM139 target gene, herein designated TARGET GENE. KIAA0683 BINDING SITE is a target binding site found in the 3' untranslated region of mRNA encoded by KIAA0683, corresponding to a target binding site such as BINDING SITE I, BINDING SITE II or BINDING SITE III of FIG. 8. Table 4 illustrates the complementarity of the nucleotide sequences of KIAA0683 BINDING SITE, designated SEQ ID:17564, to the nucleotide sequence of GAM139 RNA, herein designated GAM RNA, also designated SEQ ID:327.

Another function of GAM139 is therefore inhibition of KIAA0683 (Accession NP_057195.1). Accordingly, utilities of GAM139 include diagnosis, prevention and treatment of diseases and clinical conditions associated with KIAA0683.

KIAA0863 (Accession NP_055728.1) is another GAM139 target gene, herein designated TARGET GENE. KIAA0863 BINDING SITE is a target binding site found in the 3' untranslated region of mRNA encoded by KIAA0863, corresponding to a target binding site such as BINDING SITE I, BINDING SITE II or BINDING SITE III of FIG. 8. Table 4 illustrates the complementarity of the nucleotide sequences of KIAA0863 BINDING SITE, designated SEQ ID:4169, to the nucleotide sequence of GAM139 RNA, herein designated GAM RNA, also designated SEQ ID:327.

Another function of GAM139 is therefore inhibition of KIAA0863 (Accession NP_055728.1). Accordingly, utilities of GAM139 include diagnosis, prevention and treatment of diseases and clinical conditions associated with KIAA0863.

KIAA0962 (Accession XP_290942.1) is another GAM139 target gene, herein designated TARGET GENE. KIAA0962 BINDING SITE is a target binding site found in the 3' untranslated region of mRNA encoded by KIAA0962, corresponding to a target binding site such as BINDING SITE I, BINDING SITE II or BINDING SITE III of FIG. 8. Table 4 illustrates the complementarity of the nucleotide sequences of KIAA0962 BINDING SITE, designated SEQ ID:19480, to the nucleotide sequence of GAM139 RNA, herein designated GAM RNA, also designated SEQ ID:327.

Another function of GAM139 is therefore inhibition of KIAA0962 (Accession XP_290942.1). Accordingly, utilities of GAM139 include diagnosis, prevention and treatment of diseases and clinical conditions associated with KIAA0962.

KIAA1223 (Accession XP_048747.2) is another GAM139 target gene, herein designated TARGET GENE. KIAA1223 BINDING SITE is a target binding site found in the 3' untranslated region of mRNA encoded by KIAA1223, corresponding to a target binding site such as BINDING SITE I, BINDING SITE II or BINDING SITE III of FIG. 8. Table 4 illustrates the complementarity of the nucleotide sequences of KIAA1223 BINDING SITE, designated SEQ ID:15273, to the nucleotide sequence of GAM139 RNA, herein designated GAM RNA, also designated SEQ ID:327.

Another function of GAM139 is therefore inhibition of KIAA1223 (Accession XP_048747.2). Accordingly, utilities of GAM139 include diagnosis, prevention and treatment of diseases and clinical conditions associated with KIAA1223.

KIAA1399 (Accession XP_046685.4) is another GAM139 target gene, herein designated TARGET GENE. KIAA1399 BINDING SITE1 and KIAA1399 BINDING SITE2 are target binding sites found in untranslated regions of mRNA encoded by KIAA1399, corresponding to target binding sites such as BINDING SITE I, BINDING SITE II or BINDING SITE III of FIG. 8. Table 4 illustrates the complementarity of the nucleotide sequences of KIAA1399 BINDING SITE1 and KIAA1399 BINDING SITE2, designated SEQ ID:17214 and SEQ ID:12571 respectively, to the nucleotide sequence of GAM139 RNA, herein designated GAM RNA, also designated SEQ ID:327.

Another function of GAM139 is therefore inhibition of KIAA1399 (Accession XP_046685.4). Accordingly, utilities of GAM139 include diagnosis, prevention and treatment of diseases and clinical conditions associated with KIAA1399.

KIAA1442 (Accession XP_044921.4) is another GAM139 target gene, herein designated TARGET GENE. KIAA1442 BINDING SITE1 and KIAA1442 BINDING SITE2 are target binding sites found in untranslated regions of mRNA encoded by KIAA1442, corresponding to target binding sites such as BINDING SITE I, BINDING SITE II or BINDING SITE III of FIG. 8. Table 4 illustrates the complementarity of the nucleotide sequences of KIAA1442 BINDING SITE1 and KIAA1442 BINDING SITE2, designated SEQ ID:15532 and SEQ ID:14694 respectively, to the nucleotide sequence of GAM139 RNA, herein designated GAM RNA, also designated SEQ ID:327.

Another function of GAM139 is therefore inhibition of KIAA1442 (Accession XP_044921.4). Accordingly, utilities of GAM139 include diagnosis, prevention and treatment of diseases and clinical conditions associated with KIAA1442.

KIAA1509 (Accession XP_029353.1) is another GAM139 target gene, herein designated TARGET GENE. KIAA1509 BINDING SITE is a target binding site found in the 3' untranslated region of mRNA encoded by KIAA1509, corresponding to a target binding site such as BINDING SITE I, BINDING SITE II or BINDING SITE III of FIG. 8. Table 4 illustrates the complementarity of the nucleotide sequences of KIAA1509 BINDING SITE, designated SEQ ID:9747, to the nucleotide sequence of GAM139 RNA, herein designated GAM RNA, also designated SEQ ID:327.

Another function of GAM139 is therefore inhibition of KIAA1509 (Accession XP_029353.1). Accordingly, utilities of GAM139 include diagnosis, prevention and treatment of diseases and clinical conditions associated with KIAA1509.

KIAA1843 (Accession XP_030838.3) is another GAM139 target gene, herein designated TARGET GENE. KIAA1843 BINDING SITE is a target binding site found in the 3' untranslated region of mRNA encoded by KIAA1843, corresponding to a target binding site such as BINDING SITE I, BINDING SITE II or BINDING SITE III of FIG. 8. Table 4 illustrates the complementarity of the nucleotide sequences of KIAA1843 BINDING SITE, designated SEQ ID:14729, to the nucleotide sequence of GAM139 RNA, herein designated GAM RNA, also designated SEQ ID:327.

Another function of GAM139 is therefore inhibition of KIAA1843 (Accession XP_030838.3). Accordingly, utilities of GAM139 include diagnosis, prevention and treatment of diseases and clinical conditions associated with KIAA1843.

KIAA1881 (Accession XP_170901.1) is another GAM139 target gene, herein designated TARGET GENE. KIAA1881 BINDING SITE is a target binding site found in the 3' untranslated region of mRNA encoded by KIAA1881, corresponding to a target binding site such as BINDING SITE I, BINDING SITE II or BINDING SITE III of FIG. 8. Table 4 illustrates the complementarity of the nucleotide sequences of KIAA1881 BINDING SITE, designated SEQ ID:12647, to the nucleotide sequence of GAM139 RNA, herein designated GAM RNA, also designated SEQ ID:327.

Another function of GAM139 is therefore inhibition of KIAA1881 (Accession XP_170901.1). Accordingly, utilities of GAM139 include diagnosis, prevention and treatment of diseases and clinical conditions associated with KIAA1881.

KIAA1920 (Accession XP_085210.1) is another GAM139 target gene, herein designated TARGET GENE. KIAA1920 BINDING SITE is a target binding site found in the 3' untranslated region of mRNA encoded by KIAA1920, corresponding to a target binding site such as BINDING SITE I, BINDING SITE II or BINDING SITE III of FIG. 8. Table 4 illustrates the complementarity of the nucleotide sequences of KIAA1920 BINDING SITE, designated SEQ ID:17408, to the nucleotide sequence of GAM139 RNA, herein designated GAM RNA, also designated SEQ ID:327.

Another function of GAM139 is therefore inhibition of KIAA1920 (Accession XP_085210.1). Accordingly, utilities of GAM139 include diagnosis, prevention and treatment of diseases and clinical conditions associated with KIAA1920.

Kinesin family member 1b (KIF1B, Accession NP_055889.1) is another GAM139 target gene, herein designated TARGET GENE. KIF1B BINDING SITE is a target binding site found in the 3' untranslated region of mRNA encoded by KIF1B, corresponding to a target binding site such as BINDING SITE I, BINDING SITE II or BINDING SITE III of FIG. 8. Table 4 illustrates the complementarity of the nucleotide sequences of KIF1B BINDING SITE, designated SEQ ID:2509, to the nucleotide sequence of GAM139 RNA, herein designated GAM RNA, also designated SEQ ID:327.

Another function of GAM139 is therefore inhibition of Kinesin family member 1b (KIF1B, Accession NP_055889.1), a gene which motor for anterograde transport of mitochondria. has a microtubule plus end-directed motility. and therefore is associated with Charcot-marie-tooth disease, neuronal type, a. Accordingly, utilities of GAM139 include diagnosis, prevention and treatment of Charcot-marie- tooth disease, neuronal type, a, and of other diseases and clinical conditions associated with KIF1B.

The function of KIF1B and its association with various diseases and clinical conditions, has been established by previous studies, as described hereinabove with reference to GAM72.1. Kringle containing transmembrane protein 2 (KREMEN2, Accession NP_663323.1) is another GAM139 target gene, herein designated TARGET GENE. KREMEN2 BINDING SITE1 and KREMEN2 BINDING SITE2 are target binding sites found in untranslated regions of multiple transcripts of mRNA encoded by KREMEN2, corresponding to target binding sites such as BINDING SITE I, BINDING SITE II or BINDING SITE III of FIG. 8. Table 4 illustrates the complementarity of the nucleotide sequences of KREMEN2 BINDING SITE1 and KREMEN2 BINDING SITE2, designated SEQ ID:10367 and SEQ ID:17585 respectively, to the nucleotide sequence of GAM139 RNA, herein designated GAM RNA, also designated SEQ ID:327.

Another function of GAM139 is therefore inhibition of Kringle containing transmembrane protein 2 (KREMEN2, Accession NP_663323.1). Accordingly, utilities of GAM139 include diagnosis, prevention and treatment of diseases and clinical conditions associated with KREMEN2.

Keratin associated protein 4-13 (KRTAP4-13, Accession NP_149442.1) is another GAM139 target gene, herein designated TARGET GENE. KRTAP4-13 BINDING SITE is a target binding site found in the 3' untranslated region of mRNA encoded by KRTAP4-13, corresponding to a target binding site such as BINDING SITE I, BINDING SITE II or BINDING SITE III of FIG. 8. Table 4 illustrates the complementarity of the nucleotide sequences of KRTAP4-13 BINDING SITE, designated SEQ ID:2298, to the nucleotide sequence of GAM139 RNA, herein designated GAM RNA, also designated SEQ ID:327.

Another function of GAM139 is therefore inhibition of Keratin associated protein 4-13 (KRTAP4-13, Accession NP_149442.1). Accordingly, utilities of GAM139 include diagnosis, prevention and treatment of diseases and clinical conditions associated with KRTAP4-13.

Keratin associated protein 4-4 (KRTAP4-4, Accession NP_115913.1) is another GAM139 target gene, herein designated TARGET GENE. KRTAP4-4 BINDING SITE is a target binding site found in the 3' untranslated region of mRNA encoded by KRTAP4-4, corresponding to a target binding site such as BINDING SITE I, BINDING SITE II or BINDING SITE III of FIG. 8. Table 4 illustrates the complementarity of the nucleotide sequences of KRTAP4-4 BIND- ING SITE, designated SEQ ID:2298, to the nucleotide sequence of GAM139 RNA, herein designated GAM RNA, also designated SEQ ID:327.

Another function of GAM139 is therefore inhibition of Keratin associated protein 4-4 (KRTAP4-4, Accession NP_115913.1). Accordingly, utilities of GAM139 include diagnosis, prevention and treatment of diseases and clinical conditions associated with KRTAP4-4.

Keratin associated protein 9-2 (KRTAP9-2, Accession NP_114167.2) is another GAM139 target gene, herein designated TARGET GENE. KRTAP9-2 BINDING SITE is a target binding site found in the 3' untranslated region of mRNA encoded by KRTAP9-2, corresponding to a target binding site such as BINDING SITE I, BINDING SITE II or BINDING SITE III of FIG. 8. Table 4 illustrates the complementarity of the nucleotide sequences of KRTAP9-2 BINDING SITE, designated SEQ ID:19929, to the nucleotide sequence of GAM139 RNA, herein designated GAM RNA, also designated SEQ ID:327.

Another function of GAM139 is therefore inhibition of Keratin associated protein 9-2 (KRTAP9-2, Accession NP_114167.2). Accordingly, utilities of GAM139 include diagnosis, prevention and treatment of diseases and clinical conditions associated with KRTAP9-2.

LARP (Accession NP_056130.1) is another GAM139 target gene, herein designated TARGET GENE. LARP BINDING SITE is a target binding site found in the 5' untranslated region of mRNA encoded by LARP, corresponding to a target binding site such as BINDING SITE I, BINDING SITE II or BINDING SITE III of FIG. 8. Table 4 illustrates the complementarity of the nucleotide sequences of LARP BINDING SITE, designated SEQ ID:12149, to the nucleotide sequence of GAM139 RNA, herein designated GAM RNA, also designated SEQ ID:327.

Another function of GAM139 is therefore inhibition of LARP (Accession NP_056130.1). Accordingly, utilities of GAM139 include diagnosis, prevention and treatment of diseases and clinical conditions associated with LARP.

Lim domain binding 1 (LDB1, Accession NP_003884.1) is another GAM139 target gene, herein designated TARGET GENE. LDB1 BINDING SITE is a target binding site found in the 3' untranslated region of mRNA encoded by LDB1, corresponding to a target binding site such as BINDING SITE I, BINDING SITE II or BINDING SITE III of FIG. 8. Table 4 illustrates the complementarity of the nucleotide sequences of LDB1 BINDING SITE, designated SEQ ID:19322, to the nucleotide sequence of GAM139 RNA, herein designated GAM RNA, also designated SEQ ID:327.

Another function of GAM139 is therefore inhibition of Lim domain binding 1 (LDB1, Accession NP_003884.1), a gene which binds to the lim domain of a wide variety of lim domain-containing transcription factors. Accordingly, utilities of GAM139 include diagnosis, prevention and treatment of diseases and clinical conditions associated with LDB1.

The function of LDB1 has been established by previous studies. For general information on LIM domain-binding factors, see CLIM1 (OMIM Ref. No. 603450). Semina et al. (1998) isolated 2 human genes encoding LIM domain-binding factors, CLIM1 and CLIM2. The 2 genes have a very high level of identity to each other and to the homologs in other species. CLIM2 encodes a 375-amino acid protein. By PCR analysis of a Genebridge 4 radiation hybrid panel, Semina et al. (1998) mapped the CLIM2 gene to 10q24-q25. Yamashita et al. (1998) mapped the mouse Lbd1 gene to a region of conserved homology in distal chromosome 19.

Full details of the abovementioned studies are described in the following publications, the disclosure of which are hereby incorporated by reference:

Semina, E. V.; Altherr, M. R.; Murray, J. C.: Cloning and chromosomal localization of two novel human genes encoding LIM-domain binding factors CLIM1 and CLIM2/LDB1/NL1. Mammalian Genome 9:921-924, 1998; and Yamashita, T.; Agulnick, A. D.; Copeland, N. G.; Gilbert, D. J.; Jenkins, N. A.; Westphal, H.: Genomic structure and chromosomal localization of the mouse LIM domain- binding protein 1 g.

Further studies establishing the function and utilities of LDB1 are found in John Hopkins OMIM database record ID 603451, and in cited publications listed in Table 5, which are hereby incorporated by reference. Lectin, mannose-binding, 1 like (LMAN1L, Accession NP_078971.2) is another GAM139 target gene, herein designated TARGET GENE. LMAN1L BINDING SITE is a target binding site found in the 3' untranslated region of multiple transcripts of mRNA encoded by LMAN1L, corresponding to a target binding site such as BINDING SITE I, BINDING SITE II or BINDING SITE III of FIG. 8. Table 4 illustrates the complementarity of the nucleotide sequences of LMAN1L BINDING SITE, designated SEQ ID:11471, to the nucleotide sequence of GAM139 RNA, herein designated GAM RNA, also designated SEQ ID:327.

Another function of GAM139 is therefore inhibition of Lectin, mannose-binding, 1 like (LMAN1L, Accession NP_078971.2). Accordingly, utilities of GAM139 include diagnosis, prevention and treatment of diseases and clinical conditions associated with LMAN1L.

LOC115207 (Accession NP_612453.1) is another GAM139 target gene, herein designated TARGET GENE. LOC115207 BINDING SITE is a target binding site found in the 3' untranslated region of mRNA encoded by LOC115207, corresponding to a target binding site such as BINDING SITE I, BINDING SITE II or BINDING SITE III of FIG. 8. Table 4 illustrates the complementarity of the nucleotide sequences of LOC115207 BINDING SITE, designated SEQ ID:8746, to the nucleotide sequence of GAM139 RNA, herein designated GAM RNA, also designated SEQ ID:327.

Another function of GAM139 is therefore inhibition of LOC115207 (Accession NP_612453.1). Accordingly, utilities of GAM139 include diagnosis, prevention and treatment of diseases and clinical conditions associated with LOC115207.

LOC121456 (Accession XP_062645.2) is another GAM139 target gene, herein designated TARGET GENE. LOC121456 BINDING SITE is a target binding site found in the 5' untranslated region of mRNA encoded by LOC121456, corresponding to a target binding site such as BINDING SITE I, BINDING SITE II or BINDING SITE III of FIG. 8. Table 4 illustrates the complementarity of the nucleotide sequences of LOC121456 BINDING SITE, designated SEQ ID:2311, to the nucleotide sequence of GAM139 RNA, herein designated GAM RNA, also designated SEQ ID:327.

Another function of GAM139 is therefore inhibition of LOC121456 (Accession XP_062645.2). Accordingly, utilities of GAM139 include diagnosis, prevention and treatment of diseases and clinical conditions associated with LOC121456.

LOC130589 (Accession NP_620156.1) is another GAM139 target gene, herein designated TARGET GENE. LOC130589 BINDING SITE is a target binding site found in the 3' untranslated region of mRNA encoded by LOC130589, corresponding to a target binding site such as BINDING SITE I, BINDING SITE II or BINDING SITE III of FIG. 8. Table 4 illustrates the complementarity of the nucleotide sequences of LOC130589 BINDING SITE, designated SEQ ID:11004, to the nucleotide sequence of GAM139 RNA, herein designated GAM RNA, also designated SEQ ID:327.

Another function of GAM139 is therefore inhibition of LOC130589 (Accession NP_620156.1). Accordingly, utilities of GAM139 include diagnosis, prevention and treatment of diseases and clinical conditions associated with LOC130589.

LOC134111 (Accession XP_059689.2) is another GAM139 target gene, herein designated TARGET GENE. LOC134111 BINDING SITE is a target binding site found in the 3' untranslated region of mRNA encoded by LOC134111, corresponding to a target binding site such as BINDING SITE I, BINDING SITE II or BINDING SITE III of FIG. 8. Table 4 illustrates the complementarity of the nucleotide sequences of LOC134111 BINDING SITE, designated SEQ ID:7606, to the nucleotide sequence of GAM139 RNA, herein designated GAM RNA, also designated SEQ ID:327.

Another function of GAM139 is therefore inhibition of LOC134111 (Accession XP_059689.2). Accordingly, utilities of GAM139 include diagnosis, prevention and treatment of diseases and clinical conditions associated with LOC134111.

LOC134637 (Accession XP_059727.3) is another GAM139 target gene, herein designated TARGET GENE. LOC134637 BINDING SITE is a target binding site found in the 3' untranslated region of mRNA encoded by LOC134637, corresponding to a target binding site such as BINDING SITE I, BINDING SITE II or BINDING SITE III of FIG. 8. Table 4 illustrates the complementarity of the nucleotide sequences of LOC134637 BINDING SITE, designated SEQ ID:12967, to the nucleotide sequence of GAM139 RNA, herein designated GAM RNA, also designated SEQ ID:327.

Another function of GAM139 is therefore inhibition of LOC134637 (Accession XP_059727.3). Accordingly, utilities of GAM139 include diagnosis, prevention and treatment of diseases and clinical conditions associated with LOC134637.

LOC136015 (Accession XP_072440.1) is another GAM139 target gene, herein designated TARGET GENE. LOC136015 BINDING SITE is a target binding site found in the 5' untranslated region of mRNA encoded by LOC136015, corresponding to a target binding site such as BINDING SITE I, BINDING SITE II or BINDING SITE III of FIG. 8. Table 4 illustrates the complementarity of the nucleotide sequences of LOC136015 BINDING SITE, designated SEQ ID:15587, to the nucleotide sequence of GAM139 RNA, herein designated GAM RNA, also designated SEQ ID:327.

Another function of GAM139 is therefore inhibition of LOC136015 (Accession XP_072440.1). Accordingly, utilities of GAM139 include diagnosis, prevention and treatment of diseases and clinical conditions associated with LOC136015.

LOC142955 (Accession XP_084389.1) is another GAM139 target gene, herein designated TARGET GENE. LOC142955 BINDING SITE is a target binding site found in the 3' untranslated region of mRNA encoded by LOC142955, corresponding to a target binding site such as BINDING SITE I, BINDING SITE II or BINDING SITE III of FIG. 8. Table 4 illustrates the complementarity of the nucleotide sequences of LOC142955 BINDING SITE, designated SEQ ID:13772, to the nucleotide sequence of GAM139 RNA, herein designated GAM RNA, also designated SEQ ID:327.

Another function of GAM139 is therefore inhibition of LOC142955 (Accession XP_084389.1). Accordingly, utilities of GAM139 include diagnosis, prevention and treatment of diseases and clinical conditions associated with LOC142955.

LOC143903 (Accession NP_849156.1) is another GAM139 target gene, herein designated TARGET GENE. LOC143903 BINDING SITE is a target binding site found in the 5' untranslated region of multiple transcripts of mRNA encoded by LOC143903, corresponding to a target binding site such as BINDING SITE I, BINDING SITE II or BINDING SITE III of FIG. 8. Table 4 illustrates the complementarity of the nucleotide sequences of LOC143903 BINDING SITE, designated SEQ ID:5549, to the nucleotide sequence of GAM139 RNA, herein designated GAM RNA, also designated SEQ ID:327.

Another function of GAM139 is therefore inhibition of LOC143903 (Accession NP_849156.1). Accordingly, utilities of GAM139 include diagnosis, prevention and treatment of diseases and clinical conditions associated with LOC143903.

LOC143903 (Accession XP_084655.1) is another GAM139 target gene, herein designated TARGET GENE. LOC143903 BINDING SITE is a target binding site found in the 5' untranslated region of multiple transcripts of mRNA encoded by LOC143903, corresponding to a target binding site such as BINDING SITE I, BINDING SITE II or BINDING SITE III of FIG. 8. Table 4 illustrates the complementarity of the nucleotide sequences of LOC143903 BINDING SITE, designated SEQ ID:5549, to the nucleotide sequence of GAM139 RNA, herein designated GAM RNA, also designated SEQ ID:327.

Another function of GAM139 is therefore inhibition of LOC143903 (Accession XP_084655.1). Accordingly, utilities of GAM139 include diagnosis, prevention and treatment of diseases and clinical conditions associated with LOC143903.

LOC145384 (Accession XP_085128.1) is another GAM139 target gene, herein designated TARGET GENE. LOC145384 BINDING SITE is a target binding site found in the 5' untranslated region of mRNA encoded by LOC145384, corresponding to a target binding site such as BINDING SITE I, BINDING SITE II or BINDING SITE III of FIG. 8. Table 4 illustrates the complementarity of the nucleotide sequences of LOC145384 BINDING SITE, designated SEQ ID:10022, to the nucleotide sequence of GAM139 RNA, herein designated GAM RNA, also designated SEQ ID:327.

Another function of GAM139 is therefore inhibition of LOC145384 (Accession XP_085128.1). Accordingly, utilities of GAM139 include diagnosis, prevention and treatment of diseases and clinical conditions associated with LOC145384.

LOC145828 (Accession XP_096879.1) is another GAM139 target gene, herein designated TARGET GENE. LOC145828 BINDING SITE1 and LOC145828 BINDING SITE2 are target binding sites found in untranslated regions of mRNA encoded by LOC145828, corresponding to target binding sites such as BINDING SITE I, BINDING SITE II or BINDING SITE III of FIG. 8. Table 4 illustrates the complementarity of the nucleotide sequences of LOC145828 BINDING SITE1 and LOC145828 BINDING SITE2, designated SEQ ID:17903 and SEQ ID:13581 respectively, to the nucleotide sequence of GAM139 RNA, herein designated GAM RNA, also designated SEQ ID:327.

Another function of GAM139 is therefore inhibition of LOC145828 (Accession XP_096879.1). Accordingly, utilities of GAM139 include diagnosis, prevention and treatment of diseases and clinical conditions associated with LOC145828.

LOC146336 (Accession XP_085421.2) is another GAM139 target gene, herein designated TARGET GENE. LOC146336 BINDING SITE is a target binding site found in the 5' untranslated region of mRNA encoded by LOC146336, corresponding to a target binding site such as BINDING SITE I, BINDING SITE II or BINDING SITE III of FIG. 8. Table 4 illustrates the complementarity of the nucleotide sequences of LOC146336 BINDING SITE, designated SEQ ID:6404, to the nucleotide sequence of GAM139 RNA, herein designated GAM RNA, also designated SEQ ID:327.

Another function of GAM139 is therefore inhibition of LOC146336 (Accession XP_085421.2). Accordingly, utilities of GAM139 include diagnosis, prevention and treatment of diseases and clinical conditions associated with LOC146336.

LOC146784 (Accession XP_085588.1) is another GAM139 target gene, herein designated TARGET GENE. LOC146784 BINDING SITE is a target binding site found in the 5' untranslated region of mRNA encoded by LOC146784, corresponding to a target binding site such as BINDING SITE I, BINDING SITE II or BINDING SITE III of FIG. 8. Table 4 illustrates the complementarity of the nucleotide sequences of LOC146784 BINDING SITE, designated SEQ ID:10927, to the nucleotide sequence of GAM139 RNA, herein designated GAM RNA, also designated SEQ ID:327.

Another function of GAM139 is therefore inhibition of LOC146784 (Accession XP_085588.1). Accordingly, utilities of GAM139 include diagnosis, prevention and treatment of diseases and clinical conditions associated with LOC146784.

LOC146795 (Accession XP_085593.1) is another GAM139 target gene, herein designated TARGET GENE. LOC146795 BINDING SITE1 and LOC146795 BINDING SITE2 are target binding sites found in untranslated regions of mRNA encoded by LOC146795, corresponding to target binding sites such as BINDING SITE I, BINDING SITE II or BINDING SITE III of FIG. 8. Table 4 illustrates the complementarity of the nucleotide sequences of LOC146795 BINDING SITE1 and LOC146795 BINDING SITE2, designated SEQ ID:4648 and SEQ ID:11983 respectively, to the nucleotide sequence of GAM139 RNA, herein designated GAM RNA, also designated SEQ ID:327.

Another function of GAM139 is therefore inhibition of LOC146795 (Accession XP_085593.1). Accordingly, utilities of GAM139 include diagnosis, prevention and treatment of diseases and clinical conditions associated with LOC146795.

LOC146958 (Accession XP_097142.1) is another GAM139 target gene, herein designated TARGET GENE. LOC146958 BINDING SITE is a target binding site found in the 5' untranslated region of mRNA encoded by LOC146958, corresponding to a target binding site such as BINDING SITE I, BINDING SITE II or BINDING SITE III of FIG. 8. Table 4 illustrates the complementarity of the nucleotide sequences of LOC146958 BINDING SITE, designated SEQ ID:4941, to the nucleotide sequence of GAM139 RNA, herein designated GAM RNA, also designated SEQ ID:327.

Another function of GAM139 is therefore inhibition of LOC146958 (Accession XP_097142.1). Accordingly, utilities of GAM139 include diagnosis, prevention and treatment of diseases and clinical conditions associated with LOC146958.

LOC149837 (Accession XP_097747.1) is another GAM139 target gene, herein designated TARGET GENE. LOC149837 BINDING SITE1 and LOC149837 BINDING SITE2 are target binding sites found in untranslated regions of mRNA encoded by LOC149837, corresponding to target binding sites such as BINDING SITE I, BINDING SITE II or BINDING SITE III of FIG. 8. Table 4 illustrates the complementarity of the nucleotide sequences of LOC149837 BINDING SITE1 and LOC149837 BINDING SITE2, designated SEQ ID:13423 and SEQ ID:16008 respectively, to the nucleotide sequence of GAM139 RNA, herein designated GAM RNA, also designated SEQ ID:327.

Another function of GAM139 is therefore inhibition of LOC149837 (Accession XP_097747.1). Accordingly, utilities of GAM139 include diagnosis, prevention and treatment of diseases and clinical conditions associated with LOC149837.

LOC150933 (Accession XP_097971.1) is another GAM139 target gene, herein designated TARGET GENE. LOC150933 BINDING SITE is a target binding site found in the 3' untranslated region of mRNA encoded by LOC150933, corresponding to a target binding site such as BINDING SITE I, BINDING SITE II or BINDING SITE III of FIG. 8. Table 4 illustrates the complementarity of the nucleotide sequences of LOC150933 BINDING SITE, designated SEQ ID:18977, to the nucleotide sequence of GAM139 RNA, herein designated GAM RNA, also designated SEQ ID:327.

Another function of GAM139 is therefore inhibition of LOC150933 (Accession XP_097971.1). Accordingly, utilities of GAM139 include diagnosis, prevention and treatment of diseases and clinical conditions associated with LOC150933.

LOC153027 (Accession XP_041221.1) is another GAM139 target gene, herein designated TARGET GENE. LOC153027 BINDING SITE is a target binding site found in the 3' untranslated region of mRNA encoded by LOC153027, corresponding to a target binding site such as BINDING SITE I, BINDING SITE II or BINDING SITE III of FIG. 8. Table 4 illustrates the complementarity of the nucleotide sequences of LOC153027 BINDING SITE, designated SEQ ID:12321, to the nucleotide sequence of GAM139 RNA, herein designated GAM RNA, also designated SEQ ID:327.

Another function of GAM139 is therefore inhibition of LOC153027 (Accession XP_041221.1). Accordingly, utilities of GAM139 include diagnosis, prevention and treatment of diseases and clinical conditions associated with LOC153027.

LOC154092 (Accession XP_098466.1) is another GAM139 target gene, herein designated TARGET GENE. LOC154092 BINDING SITE is a target binding site found in the 3' untranslated region of mRNA encoded by LOC154092, corresponding to a target binding site such as BINDING SITE I, BINDING SITE II or BINDING SITE III of FIG. 8. Table 4 illustrates the complementarity of the nucleotide sequences of LOC154092 BINDING SITE, designated SEQ ID:8503, to the nucleotide sequence of GAM139 RNA, herein designated GAM RNA, also designated SEQ ID:327.

Another function of GAM139 is therefore inhibition of LOC154092 (Accession XP_098466.1). Accordingly, utilities of GAM139 include diagnosis, prevention and treatment of diseases and clinical conditions associated with LOC154092.

LOC165622 (Accession XP_093333.6) is another GAM139 target gene, herein designated TARGET GENE. LOC165622 BINDING SITE is a target binding site found in the 5' untranslated region of mRNA encoded by LOC165622, corresponding to a target binding site such as BINDING SITE I, BINDING SITE II or BINDING SITE III of FIG. 8. Table 4 illustrates the complementarity of the nucleotide sequences of LOC165622 BINDING SITE, designated SEQ ID:8963, to the nucleotide sequence of GAM139 RNA, herein designated GAM RNA, also designated SEQ ID:327.

Another function of GAM139 is therefore inhibition of LOC165622 (Accession XP_093333.6). Accordingly, utilities of GAM139 include diagnosis, prevention and treatment of diseases and clinical conditions associated with LOC165622.

LOC168667 (Accession XP_166592.1) is another GAM139 target gene, herein designated TARGET GENE. LOC168667 BINDING SITE is a target binding site found in the 5' untranslated region of mRNA encoded by LOC168667, corresponding to a target binding site such as BINDING SITE I, BINDING SITE II or BINDING SITE III of FIG. 8. Table 4 illustrates the complementarity of the nucleotide sequences of LOC168667 BINDING SITE, designated SEQ ID:8774, to the nucleotide sequence of GAM139 RNA, herein designated GAM RNA, also designated SEQ ID:327.

Another function of GAM139 is therefore inhibition of LOC168667 (Accession XP_166592.1). Accordingly, utilities of GAM139 include diagnosis, prevention and treatment of diseases and clinical conditions associated with LOC168667.

LOC200230 (Accession XP_114166.1) is another GAM139 target gene, herein designated TARGET GENE. LOC200230 BINDING SITE is a target binding site found in the 5' untranslated region of mRNA encoded by LOC200230, corresponding to a target binding site such as BINDING SITE I, BINDING SITE II or BINDING SITE III of FIG. 8. Table 4 illustrates the complementarity of the nucleotide sequences of LOC200230 BINDING SITE, designated SEQ ID:5316, to the nucleotide sequence of GAM139 RNA, herein designated GAM RNA, also designated SEQ ID:327.

Another function of GAM139 is therefore inhibition of LOC200230 (Accession XP_114166.1). Accordingly, utilities of GAM139 include diagnosis, prevention and treatment of diseases and clinical conditions associated with LOC200230.

LOC200583 (Accession XP_114265.1) is another GAM139 target gene, herein designated TARGET GENE. LOC200583 BINDING SITE1 through LOC200583 BINDING SITE3 are target binding sites found in untranslated regions of mRNA encoded by LOC200583, corresponding to target binding sites such as BINDING SITE I, BINDING SITE II or BINDING SITE III of FIG. 8. Table 4 illustrates the complementarity of the nucleotide sequences of LOC200583 BINDING SITE1 through LOC200583 BINDING SITE3, designated SEQ ID:8208, SEQ ID:19716 and SEQ ID:2414 respectively, to the nucleotide sequence of GAM139 RNA, herein designated GAM RNA, also designated SEQ ID:327.

Another function of GAM139 is therefore inhibition of LOC200583 (Accession XP_114265.1). Accordingly, utilities of GAM139 include diagnosis, prevention and treatment of diseases and clinical conditions associated with LOC200583.

LOC201181 (Accession XP_113916.1) is another GAM139 target gene, herein designated TARGET GENE. LOC201181 BINDING SITE is a target binding site found in the 5' untranslated region of mRNA encoded by LOC201181, corresponding to a target binding site such as BINDING SITE I, BINDING SITE II or BINDING SITE III of FIG. 8. Table 4 illustrates the complementarity of the nucleotide sequences of LOC201181 BINDING SITE, designated SEQ ID:18447, to the nucleotide sequence of GAM139 RNA, herein designated GAM RNA, also designated SEQ ID:327.

Another function of GAM139 is therefore inhibition of LOC201181 (Accession XP_113916.1). Accordingly, utilities of GAM139 include diagnosis, prevention and treatment of diseases and clinical conditions associated with LOC201181.

LOC220739 (Accession XP_167548.3) is another GAM139 target gene, herein designated TARGET GENE. LOC220739 BINDING SITE is a target binding site found in the 5' untranslated region of mRNA encoded by LOC220739, corresponding to a target binding site such as BINDING SITE I, BINDING SITE II or BINDING SITE III of FIG. 8. Table 4 illustrates the complementarity of the nucleotide sequences of LOC220739 BINDING SITE, designated SEQ ID:15658, to the nucleotide sequence of GAM139 RNA, herein designated GAM RNA, also designated SEQ ID:327.

Another function of GAM139 is therefore inhibition of LOC220739 (Accession XP_167548.3). Accordingly, utilities of GAM139 include diagnosis, prevention and treatment of diseases and clinical conditions associated with LOC220739.

LOC221933 (Accession XP_166530.2) is another GAM139 target gene, herein designated TARGET GENE. LOC221933 BINDING SITE is a target binding site found in the 5' untranslated region of mRNA encoded by LOC221933, corresponding to a target binding site such as BINDING SITE I, BINDING SITE II or BINDING SITE III of FIG. 8. Table 4 illustrates the complementarity of the nucleotide sequences of LOC221933 BINDING SITE, designated SEQ ID:15096, to the nucleotide sequence of GAM139 RNA, herein designated GAM RNA, also designated SEQ ID:327.

Another function of GAM139 is therefore inhibition of LOC221933 (Accession XP_166530.2). Accordingly, utilities of GAM139 include diagnosis, prevention and treatment of diseases and clinical conditions associated with LOC221933.

LOC255290 (Accession XP_170990.1) is another GAM139 target gene, herein designated TARGET GENE. LOC255290 BINDING SITE is a target binding site found in the 5' untranslated region of mRNA encoded by LOC255290, corresponding to a target binding site such as BINDING SITE I, BINDING SITE II or BINDING SITE III of FIG. 8. Table 4 illustrates the complementarity of the nucleotide sequences of LOC255290 BINDING SITE, designated SEQ ID:1320, to the nucleotide sequence of GAM139 RNA, herein designated GAM RNA, also designated SEQ ID:327.

Another function of GAM139 is therefore inhibition of LOC255290 (Accession XP_170990.1). Accordingly, utilities of GAM139 include diagnosis, prevention and treatment of diseases and clinical conditions associated with LOC255290.

LOC257122 (Accession XP_171239.1) is another GAM139 target gene, herein designated TARGET GENE. LOC257122 BINDING SITE is a target binding site found in the 5' untranslated region of mRNA encoded by LOC257122, corresponding to a target binding site such as BINDING SITE I, BINDING SITE II or BINDING SITE III of FIG. 8. Table 4 illustrates the complementarity of the nucleotide sequences of LOC257122 BINDING SITE, designated SEQ ID:7890, to the nucleotide sequence of GAM139 RNA, herein designated GAM RNA, also designated SEQ ID:327.

Another function of GAM139 is therefore inhibition of LOC257122 (Accession XP_171239.1). Accordingly, utilities of GAM139 include diagnosis, prevention and treatment of diseases and clinical conditions associated with LOC257122.

LOC283033 (Accession XP_210857.1) is another GAM139 target gene, herein designated TARGET GENE. LOC283033 BINDING SITE is a target binding site found in the 5' untranslated region of mRNA encoded by LOC283033, corresponding to a target binding site such as BINDING SITE I, BINDING SITE II or BINDING SITE III of FIG. 8. Table 4 illustrates the complementarity of the nucleotide sequences of LOC283033 BINDING SITE, designated SEQ ID:4301, to the nucleotide sequence of GAM139 RNA, herein designated GAM RNA, also designated SEQ ID:327.

Another function of GAM139 is therefore inhibition of LOC283033 (Accession XP_210857.1). Accordingly, utilities of GAM139 include diagnosis, prevention and treatment of diseases and clinical conditions associated with LOC283033.

LOC283062 (Accession XP_210877.1) is another GAM139 target gene, herein designated TARGET GENE. LOC283062 BINDING SITE is a target binding site found in the 5' untranslated region of mRNA encoded by LOC283062, corresponding to a target binding site such as BINDING SITE I, BINDING SITE II or BINDING SITE III of FIG. 8. Table 4 illustrates the complementarity of the nucleotide sequences of LOC283062 BINDING SITE, designated SEQ ID:9388, to the nucleotide sequence of GAM139 RNA, herein designated GAM RNA, also designated SEQ ID:327.

Another function of GAM139 is therefore inhibition of LOC283062 (Accession XP_210877.1). Accordingly, utilities of GAM139 include diagnosis, prevention and treatment of diseases and clinical conditions associated with LOC283062.

LOC283114 (Accession XP_208042.1) is another GAM139 target gene, herein designated TARGET GENE. LOC283114 BINDING SITE1 and LOC283114 BINDING SITE2 are target binding sites found in untranslated regions of mRNA encoded by LOC283114, corresponding to target binding sites such as BINDING SITE I, BINDING SITE II or BINDING SITE III of FIG. 8. Table 4 illustrates the complementarity of the nucleotide sequences of LOC283114 BINDING SITE1 and LOC283114 BINDING SITE2, designated SEQ ID:14489 and SEQ ID:17069 respectively, to the nucleotide sequence of GAM139 RNA, herein designated GAM RNA, also designated SEQ ID:327.

Another function of GAM139 is therefore inhibition of LOC283114 (Accession XP_208042.1). Accordingly, utilities of GAM139 include diagnosis, prevention and treatment of diseases and clinical conditions associated with LOC283114.

LOC283198 (Accession XP_208550.1) is another GAM139 target gene, herein designated TARGET GENE. LOC283198 BINDING SITE is a target binding site found in the 5' untranslated region of mRNA encoded by LOC283198, corresponding to a target binding site such as BINDING SITE I, BINDING SITE II or BINDING SITE III of FIG. 8. Table 4 illustrates the complementarity of the nucleotide sequences of LOC283198 BINDING SITE, designated SEQ ID:12328, to the nucleotide sequence of GAM139 RNA, herein designated GAM RNA, also designated SEQ ID:327.

Another function of GAM139 is therefore inhibition of LOC283198 (Accession XP_208550.1). Accordingly, utilities of GAM139 include diagnosis, prevention and treatment of diseases and clinical conditions associated with LOC283198.

LOC283270 (Accession XP_210956.1) is another GAM139 target gene, herein designated TARGET GENE. LOC283270 BINDING SITE is a target binding site found in the 5' untranslated region of mRNA encoded by LOC283270, corresponding to a target binding site such as BINDING SITE I, BINDING SITE II or BINDING SITE III of FIG. 8. Table 4 illustrates the complementarity of the nucleotide sequences of LOC283270 BINDING SITE, designated SEQ ID:17363, to the nucleotide sequence of GAM139 RNA, herein designated GAM RNA, also designated SEQ ID:327.

Another function of GAM139 is therefore inhibition of LOC283270 (Accession XP_210956.1). Accordingly, utilities of GAM139 include diagnosis, prevention and treatment of diseases and clinical conditions associated with LOC283270.

LOC283364 (Accession XP_211003.1) is another GAM139 target gene, herein designated TARGET GENE. LOC283364 BINDING SITE is a target binding site found in the 3' untranslated region of mRNA encoded by LOC283364, corresponding to a target binding site such as BINDING SITE I, BINDING SITE II or BINDING SITE III of FIG. 8. Table 4 illustrates the complementarity of the nucleotide sequences of LOC283364 BINDING SITE, designated SEQ ID:18990, to the nucleotide sequence of GAM139 RNA, herein designated GAM RNA, also designated SEQ ID:327.

Another function of GAM139 is therefore inhibition of LOC283364 (Accession XP_211003.1). Accordingly, utilities of GAM139 include diagnosis, prevention and treatment of diseases and clinical conditions associated with LOC283364.

LOC283386 (Accession XP_208656.1) is another GAM139 target gene, herein designated TARGET GENE. LOC283386 BINDING SITE is a target binding site found in the 3' untranslated region of mRNA encoded by LOC283386, corresponding to a target binding site such as BINDING SITE I, BINDING SITE II or BINDING SITE III of FIG. 8. Table 4 illustrates the complementarity of the nucleotide sequences of LOC283386 BINDING SITE, designated SEQ ID:3288, to the nucleotide sequence of GAM139 RNA, herein designated GAM RNA, also designated SEQ ID:327.

Another function of GAM139 is therefore inhibition of LOC283386 (Accession XP_208656.1). Accordingly, utilities of GAM139 include diagnosis, prevention and treatment of diseases and clinical conditions associated with LOC283386.

LOC283435 (Accession XP_211035.1) is another GAM139 target gene, herein designated TARGET GENE. LOC283435 BINDING SITE is a target binding site found in the 3' untranslated region of mRNA encoded by LOC283435, corresponding to a target binding site such as BINDING SITE I, BINDING SITE II or BINDING SITE III of FIG. 8. Table 4 illustrates the complementarity of the nucleotide sequences of LOC283435 BINDING SITE, designated SEQ ID:15472, to the nucleotide sequence of GAM139 RNA, herein designated GAM RNA, also designated SEQ ID:327.

Another function of GAM139 is therefore inhibition of LOC283435 (Accession XP_211035.1). Accordingly, utilities of GAM139 include diagnosis, prevention and treatment of diseases and clinical conditions associated with LOC283435.

LOC283582 (Accession XP_211119.1) is another GAM139 target gene, herein designated TARGET GENE. LOC283582 BINDING SITE is a target binding site found in the 5' untranslated region of mRNA encoded by LOC283582, corresponding to a target binding site such as BINDING SITE I, BINDING SITE II or BINDING SITE III of FIG. 8. Table 4 illustrates the complementarity of the nucleotide sequences of LOC283582 BINDING SITE, designated SEQ ID:6596, to the nucleotide sequence of GAM139 RNA, herein designated GAM RNA, also designated SEQ ID:327.

Another function of GAM139 is therefore inhibition of LOC283582 (Accession XP_211119.1). Accordingly, utilities of GAM139 include diagnosis, prevention and treatment of diseases and clinical conditions associated with LOC283582.

LOC283637 (Accession XP_211134.1) is another GAM139 target gene, herein designated TARGET GENE. LOC283637 BINDING SITE is a target binding site found in the 3' untranslated region of mRNA encoded by LOC283637, corresponding to a target binding site such as BINDING SITE I, BINDING SITE II or BINDING SITE III of FIG. 8. Table 4 illustrates the complementarity of the nucleotide sequences of LOC283637 BINDING SITE, designated SEQ ID:1923, to the nucleotide sequence of GAM139 RNA, herein designated GAM RNA, also designated SEQ ID:327.

Another function of GAM139 is therefore inhibition of LOC283637 (Accession XP_211134.1). Accordingly, utilities of GAM139 include diagnosis, prevention and treatment of diseases and clinical conditions associated with LOC283637.

LOC283723 (Accession XP_211176.1) is another GAM139 target gene, herein designated TARGET GENE. LOC283723 BINDING SITE is a target binding site found in the 5' untranslated region of mRNA encoded by LOC283723, corresponding to a target binding site such as BINDING SITE I, BINDING SITE II or BINDING SITE III of FIG. 8. Table 4 illustrates the complementarity of the nucleotide sequences of LOC283723 BINDING SITE, designated SEQ ID:14435, to the nucleotide sequence of GAM139 RNA, herein designated GAM RNA, also designated SEQ ID:327.

Another function of GAM139 is therefore inhibition of LOC283723 (Accession XP_211176.1). Accordingly, utilities of GAM139 include diagnosis, prevention and treatment of diseases and clinical conditions associated with LOC283723.

LOC283789 (Accession XP_208120.1) is another GAM139 target gene, herein designated TARGET GENE. LOC283789 BINDING SITE is a target binding site found in the 5' untranslated region of mRNA encoded by LOC283789, corresponding to a target binding site such as BINDING SITE I, BINDING SITE II or BINDING SITE III of FIG. 8. Table 4 illustrates the complementarity of the nucleotide sequences of LOC283789 BINDING SITE, designated SEQ ID:15242, to the nucleotide sequence of GAM139 RNA, herein designated GAM RNA, also designated SEQ ID:327.

Another function of GAM139 is therefore inhibition of LOC283789 (Accession XP_208120.1). Accordingly, utilities of GAM139 include diagnosis, prevention and treatment of diseases and clinical conditions associated with LOC283789.

LOC283807 (Accession XP_211207.1) is another GAM139 target gene, herein designated TARGET GENE. LOC283807 BINDING SITE is a target binding site found in the 5' untranslated region of mRNA encoded by LOC283807, corresponding to a target binding site such as BINDING SITE I, BINDING SITE II or BINDING SITE III of FIG. 8. Table 4 illustrates the complementarity of the nucleotide sequences of LOC283807 BINDING SITE, designated SEQ ID:8994, to the nucleotide sequence of GAM139 RNA, herein designated GAM RNA, also designated SEQ ID:327.

Another function of GAM139 is therefore inhibition of LOC283807 (Accession XP_211207.1). Accordingly, utilities of GAM139 include diagnosis, prevention and treatment of diseases and clinical conditions associated with LOC283807.

LOC283852 (Accession XP_211228.1) is another GAM139 target gene, herein designated TARGET GENE. LOC283852 BINDING SITE1 through LOC283852 BINDING SITE3 are target binding sites found in untranslated regions of mRNA encoded by LOC283852, corresponding to target binding sites such as BINDING SITE I, BINDING SITE II or BINDING SITE III of FIG. 8. Table 4 illustrates the complementarity of the nucleotide sequences of LOC283852 BINDING SITE1 through LOC283852 BINDING SITE3, designated SEQ ID:12663, SEQ ID:12405 and SEQ ID:16600 respectively, to the nucleotide sequence of GAM139 RNA, herein designated GAM RNA, also designated SEQ ID:327.

Another function of GAM139 is therefore inhibition of LOC283852 (Accession XP_211228.1). Accordingly, utilities of GAM139 include diagnosis, prevention and treatment of diseases and clinical conditions associated with LOC283852.

LOC283911 (Accession XP_211259.2) is another GAM139 target gene, herein designated TARGET GENE. LOC283911 BINDING SITE is a target binding site found in the 5' untranslated region of mRNA encoded by LOC283911, corresponding to a target binding site such as BINDING SITE I, BINDING SITE II or BINDING SITE III of FIG. 8. Table 4 illustrates the complementarity of the nucleotide sequences of LOC283911 BINDING SITE, designated SEQ ID:18967, to the nucleotide sequence of GAM139 RNA, herein designated GAM RNA, also designated SEQ ID:327.

Another function of GAM139 is therefore inhibition of LOC283911 (Accession XP_211259.2). Accordingly, utilities of GAM139 include diagnosis, prevention and treatment of diseases and clinical conditions associated with LOC283911.

LOC284015 (Accession XP_210324.1) is another GAM139 target gene, herein designated TARGET GENE. LOC284015 BINDING SITE is a target binding site found in the 5' untranslated region of mRNA encoded by LOC284015, corresponding to a target binding site such as BINDING SITE I, BINDING SITE II or BINDING SITE III of FIG. 8. Table 4 illustrates the complementarity of the nucleotide sequences of LOC284015 BINDING SITE, designated SEQ ID:12620, to the nucleotide sequence of GAM139 RNA, herein designated GAM RNA, also designated SEQ ID:327.

Another function of GAM139 is therefore inhibition of LOC284015 (Accession XP_210324.1). Accordingly, utilities of GAM139 include diagnosis, prevention and treatment of diseases and clinical conditions associated with LOC284015.

LOC284037 (Accession XP_208153.1) is another GAM139 target gene, herein designated TARGET GENE. LOC284037 BINDING SITE is a target binding site found in the 5' untranslated region of mRNA encoded by LOC284037, corresponding to a target binding site such as BINDING SITE I, BINDING SITE II or BINDING SITE III of FIG. 8. Table 4 illustrates the complementarity of the nucleotide sequences of LOC284037 BINDING SITE, designated SEQ ID:15556, to the nucleotide sequence of GAM139 RNA, herein designated GAM RNA, also designated SEQ ID:327.

Another function of GAM139 is therefore inhibition of LOC284037 (Accession XP_208153.1). Accordingly, utilities of GAM139 include diagnosis, prevention and treatment of diseases and clinical conditions associated with LOC284037.

LOC284130 (Accession XP_209031.1) is another GAM139 target gene, herein designated TARGET GENE. LOC284130 BINDING SITE is a target binding site found in the 5' untranslated region of mRNA encoded by LOC284130, corresponding to a target binding site such as BINDING SITE I, BINDING SITE II or BINDING SITE III of FIG. 8. Table 4 illustrates the complementarity of the nucleotide sequences of LOC284130 BINDING SITE, designated SEQ ID:8262, to the nucleotide sequence of GAM139 RNA, herein designated GAM RNA, also designated SEQ ID:327.

Another function of GAM139 is therefore inhibition of LOC284130 (Accession XP_209031.1). Accordingly, utilities of GAM139 include diagnosis, prevention and treatment of diseases and clinical conditions associated with LOC284130.

LOC284167 (Accession XP_208171.1) is another GAM139 target gene, herein designated TARGET GENE. LOC284167 BINDING SITE is a target binding site found in the 5' untranslated region of mRNA encoded by LOC284167, corresponding to a target binding site such as BINDING SITE I, BINDING SITE II or BINDING SITE III of FIG. 8. Table 4 illustrates the complementarity of the nucleotide sequences of LOC284167 BINDING SITE, designated SEQ ID:20016, to the nucleotide sequence of GAM139 RNA, herein designated GAM RNA, also designated SEQ ID:327.

Another function of GAM139 is therefore inhibition of LOC284167 (Accession XP_208171.1). Accordingly, utilities of GAM139 include diagnosis, prevention and treatment of diseases and clinical conditions associated with LOC284167.

LOC284186 (Accession XP_209060.2) is another GAM139 target gene, herein designated TARGET GENE. LOC284186 BINDING SITE1 and LOC284186 BINDING SITE2 are target binding sites found in untranslated regions of mRNA encoded by LOC284186, corresponding to target binding sites such as BINDING SITE I, BINDING SITE II or BINDING SITE III of FIG. 8. Table 4 illustrates the complementarity of the nucleotide sequences of LOC284186 BINDING SITE1 and LOC284186 BINDING SITE2, designated SEQ ID:6257 and SEQ ID:9676 respectively, to the nucleotide sequence of GAM139 RNA, herein designated GAM RNA, also designated SEQ ID:327.

Another function of GAM139 is therefore inhibition of LOC284186 (Accession XP_209060.2). Accordingly, utilities of GAM139 include diagnosis, prevention and treatment of diseases and clinical conditions associated with LOC284186.

LOC284231 (Accession XP_208184.1) is another GAM139 target gene, herein designated TARGET GENE. LOC284231 BINDING SITE1 and LOC284231 BINDING SITE2 are target binding sites found in untranslated regions of mRNA encoded by LOC284231, corresponding to target binding sites such as BINDING SITE I, BINDING SITE II or BINDING SITE III of FIG. 8. Table 4 illustrates the complementarity of the nucleotide sequences of LOC284231 BINDING SITE1 and LOC284231 BINDING SITE2, designated SEQ ID:5381 and SEQ ID:10934 respectively, to the nucleotide sequence of GAM139 RNA, herein designated GAM RNA, also designated SEQ ID:327.

Another function of GAM139 is therefore inhibition of LOC284231 (Accession XP_208184.1). Accordingly, utilities of GAM139 include diagnosis, prevention and treatment of diseases and clinical conditions associated with LOC284231.

LOC284434 (Accession XP_211460.1) is another GAM139 target gene, herein designated TARGET GENE. LOC284434 BINDING SITE is a target binding site found in the 3' untranslated region of mRNA encoded by LOC284434, corresponding to a target binding site such as BINDING SITE I, BINDING SITE II or BINDING SITE III of FIG. 8. Table 4 illustrates the complementarity of the nucleotide sequences of LOC284434 BINDING SITE, designated SEQ ID:8357, to the nucleotide sequence of GAM139 RNA, herein designated GAM RNA, also designated SEQ ID:327.

Another function of GAM139 is therefore inhibition of LOC284434 (Accession XP_211460.1). Accordingly, utilities of GAM139 include diagnosis, prevention and treatment of diseases and clinical conditions associated with LOC284434.

LOC284615 (Accession XP_211553.1) is another GAM139 target gene, herein designated TARGET GENE. LOC284615 BINDING SITE is a target binding site found in the 3' untranslated region of mRNA encoded by LOC284615, corresponding to a target binding site such as BINDING SITE I, BINDING SITE II or BINDING SITE III of FIG. 8. Table 4 illustrates the complementarity of the nucleotide sequences of LOC284615 BINDING SITE, designated SEQ ID:9828, to the nucleotide sequence of GAM139 RNA, herein designated GAM RNA, also designated SEQ ID:327.

Another function of GAM139 is therefore inhibition of LOC284615 (Accession XP_211553.1). Accordingly, utilities of GAM139 include diagnosis, prevention and treatment of diseases and clinical conditions associated with LOC284615.

LOC284687 (Accession XP_211587.1) is another GAM139 target gene, herein designated TARGET GENE. LOC284687 BINDING SITE is a target binding site found in the 3' untranslated region of mRNA encoded by LOC284687, corresponding to a target binding site such as BINDING SITE I, BINDING SITE II or BINDING SITE III of FIG. 8. Table 4 illustrates the complementarity of the nucleotide sequences of LOC284687 BINDING SITE, designated SEQ ID:2504, to the nucleotide sequence of GAM139 RNA, herein designated GAM RNA, also designated SEQ ID:327.

Another function of GAM139 is therefore inhibition of LOC284687 (Accession XP_211587.1). Accordingly, utilities of GAM139 include diagnosis, prevention and treatment of diseases and clinical conditions associated with LOC284687.

LOC284719 (Accession XP_211601.1) is another GAM139 target gene, herein designated TARGET GENE. LOC284719 BINDING SITE1 and LOC284719 BINDING SITE2 are target binding sites found in untranslated regions of mRNA encoded by LOC284719, corresponding to target binding sites such as BINDING SITE I, BINDING SITE II or BINDING SITE III of FIG. 8. Table 4 illustrates the complementarity of the nucleotide sequences of LOC284719 BINDING SITE1 and LOC284719 BINDING SITE2, designated SEQ ID:15624 and SEQ ID:1476 respectively, to the nucleotide sequence of GAM139 RNA, herein designated GAM RNA, also designated SEQ ID:327.

Another function of GAM139 is therefore inhibition of LOC284719 (Accession XP_211601.1). Accordingly, utilities of GAM139 include diagnosis, prevention and treatment of diseases and clinical conditions associated with LOC284719.

LOC284739 (Accession XP_211609.1) is another GAM139 target gene, herein designated TARGET GENE. LOC284739 BINDING SITE is a target binding site found in the 3' untranslated region of mRNA encoded by LOC284739, corresponding to a target binding site such as BINDING SITE I, BINDING SITE II or BINDING SITE III of FIG. 8. Table 4 illustrates the complementarity of the nucleotide sequences of LOC284739 BINDING SITE, designated SEQ ID:13956, to the nucleotide sequence of GAM139 RNA, herein designated GAM RNA, also designated SEQ ID:327.

Another function of GAM139 is therefore inhibition of LOC284739 (Accession XP_211609.1). Accordingly, utilities of GAM139 include diagnosis, prevention and treatment of diseases and clinical conditions associated with LOC284739.

LOC284874 (Accession XP_209394.1) is another GAM139 target gene, herein designated TARGET GENE. LOC284874 BINDING SITE1 and LOC284874 BINDING SITE2 are target binding sites found in untranslated regions of mRNA encoded by LOC284874, corresponding to target binding sites such as BINDING SITE I, BINDING SITE II or BINDING SITE III of FIG. 8. Table 4 illustrates the complementarity of the nucleotide sequences of LOC284874 BINDING SITE1 and LOC284874 BINDING SITE2, designated SEQ ID:19517 and SEQ ID:4696 respectively, to the nucleotide sequence of GAM139 RNA, herein designated GAM RNA, also designated SEQ ID:327.

Another function of GAM139 is therefore inhibition of LOC284874 (Accession XP_209394.1). Accordingly, utilities of GAM139 include diagnosis, prevention and treatment of diseases and clinical conditions associated with LOC284874.

LOC284922 (Accession XP_209409.1) is another GAM139 target gene, herein designated TARGET GENE. LOC284922 BINDING SITE is a target binding site found in the 3' untranslated region of mRNA encoded by LOC284922, corresponding to a target binding site such as BINDING SITE I, BINDING SITE II or BINDING SITE III of FIG. 8. Table 4 illustrates the complementarity of the nucleotide sequences of LOC284922 BINDING SITE, designated SEQ ID:19183, to the nucleotide sequence of GAM139 RNA, herein designated GAM RNA, also designated SEQ ID:327.

Another function of GAM139 is therefore inhibition of LOC284922 (Accession XP_209409.1). Accordingly, utilities of GAM139 include diagnosis, prevention and treatment of diseases and clinical conditions associated with LOC284922.

LOC285036 (Accession XP_210798.1) is another GAM139 target gene, herein designated TARGET GENE. LOC285036 BINDING SITE1 and LOC285036 BINDING SITE2 are target binding sites found in untranslated regions of mRNA encoded by LOC285036, corresponding to target binding sites such as BINDING SITE I, BINDING SITE II or BINDING SITE III of FIG. 8. Table 4 illustrates the complementarity of the nucleotide sequences of LOC285036 BINDING SITE1 and LOC285036 BINDING SITE2, designated SEQ ID:5723 and SEQ ID:16269 respectively, to the nucleotide sequence of GAM139 RNA, herein designated GAM RNA, also designated SEQ ID:327.

Another function of GAM139 is therefore inhibition of LOC285036 (Accession XP_210798.1). Accordingly, utilities of GAM139 include diagnosis, prevention and treatment of diseases and clinical conditions associated with LOC285036.

LOC285084 (Accession XP_211758.1) is another GAM139 target gene, herein designated TARGET GENE. LOC285084 BINDING SITE is a target binding site found in the 5' untranslated region of mRNA encoded by LOC285084, corresponding to a target binding site such as BINDING SITE I, BINDING SITE II or BINDING SITE III of FIG. 8. Table 4 illustrates the complementarity of the nucleotide sequences of LOC285084 BINDING SITE, designated SEQ ID:5269, to the nucleotide sequence of GAM139 RNA, herein designated GAM RNA, also designated SEQ ID:327.

Another function of GAM139 is therefore inhibition of LOC285084 (Accession XP_211758.1). Accordingly, utilities of GAM139 include diagnosis, prevention and treatment of diseases and clinical conditions associated with LOC285084.

LOC285103 (Accession XP_211766.1) is another GAM139 target gene, herein designated TARGET GENE. LOC285103 BINDING SITE is a target binding site found in the 5' untranslated region of mRNA encoded by LOC285103, corresponding to a target binding site such as BINDING SITE I, BINDING SITE II or BINDING SITE III of FIG. 8. Table 4 illustrates the complementarity of the nucleotide sequences of LOC285103 BINDING SITE, designated SEQ ID:16353, to the nucleotide sequence of GAM139 RNA, herein designated GAM RNA, also designated SEQ ID:327.

Another function of GAM139 is therefore inhibition of LOC285103 (Accession XP_211766.1). Accordingly, utilities of GAM139 include diagnosis, prevention and treatment of diseases and clinical conditions associated with LOC285103.

LOC285112 (Accession XP_209475.3) is another GAM139 target gene, herein designated TARGET GENE. LOC285112 BINDING SITE is a target binding site found in the 5' untranslated region of mRNA encoded by LOC285112, corresponding to a target binding site such as BINDING SITE I, BINDING SITE II or BINDING SITE III of FIG. 8. Table 4 illustrates the complementarity of the nucleotide sequences of LOC285112 BINDING SITE, designated SEQ ID:8814, to the nucleotide sequence of GAM139 RNA, herein designated GAM RNA, also designated SEQ ID:327.

Another function of GAM139 is therefore inhibition of LOC285112 (Accession XP_209475.3). Accordingly, utilities of GAM139 include diagnosis, prevention and treatment of diseases and clinical conditions associated with LOC285112.

LOC285152 (Accession XP_211783.1) is another GAM139 target gene, herein designated TARGET GENE. LOC285152 BINDING SITE is a target binding site found in the 5' untranslated region of mRNA encoded by LOC285152, corresponding to a target binding site such as BINDING SITE I, BINDING SITE II or BINDING SITE III of FIG. 8. Table 4 illustrates the complementarity of the nucleotide sequences of LOC285152 BINDING SITE, designated SEQ ID:11345, to the nucleotide sequence of GAM139 RNA, herein designated GAM RNA, also designated SEQ ID:327.

Another function of GAM139 is therefore inhibition of LOC285152 (Accession XP_211783.1). Accordingly, utilities of GAM139 include diagnosis, prevention and treatment of diseases and clinical conditions associated with LOC285152.

LOC285592 (Accession XP_209669.1) is another GAM139 target gene, herein designated TARGET GENE. LOC285592 BINDING SITE is a target binding site found in the 3' untranslated region of mRNA encoded by LOC285592, corresponding to a target binding site such as BINDING SITE I, BINDING SITE II or BINDING SITE III of FIG. 8. Table 4 illustrates the complementarity of the nucleotide sequences of LOC285592 BINDING SITE, designated SEQ ID:2468, to the nucleotide sequence of GAM139 RNA, herein designated GAM RNA, also designated SEQ ID:327.

Another function of GAM139 is therefore inhibition of LOC285592 (Accession XP_209669.1). Accordingly, utilities of GAM139 include diagnosis, prevention and treatment of diseases and clinical conditions associated with LOC285592.

LOC285624 (Accession XP_209685.1) is another GAM139 target gene, herein designated TARGET GENE. LOC285624 BINDING SITE is a target binding site found in the 5' untranslated region of mRNA encoded by LOC285624, corresponding to a target binding site such as BINDING SITE I, BINDING SITE II or BINDING SITE III of FIG. 8. Table 4 illustrates the complementarity of the nucleotide sequences of LOC285624 BINDING SITE, designated SEQ ID:12598, to the nucleotide sequence of GAM139 RNA, herein designated GAM RNA, also designated SEQ ID:327.

Another function of GAM139 is therefore inhibition of LOC285624 (Accession XP_209685.1). Accordingly, utilities of GAM139 include diagnosis, prevention and treatment of diseases and clinical conditions associated with LOC285624.

LOC285625 (Accession XP_209684.1) is another GAM139 target gene, herein designated TARGET GENE. LOC285625 BINDING SITE is a target binding site found in the 5' untranslated region of mRNA encoded by LOC285625, corresponding to a target binding site such as BINDING SITE I, BINDING SITE II or BINDING SITE III of FIG. 8. Table 4 illustrates the complementarity of the nucleotide sequences of LOC285625 BINDING SITE, designated SEQ ID:19717, to the nucleotide sequence of GAM139 RNA, herein designated GAM RNA, also designated SEQ ID:327.

Another function of GAM139 is therefore inhibition of LOC285625 (Accession XP_209684.1). Accordingly, utilities of GAM139 include diagnosis, prevention and treatment of diseases and clinical conditions associated with LOC285625.

LOC285651 (Accession XP_211974.1) is another GAM139 target gene, herein designated TARGET GENE. LOC285651 BINDING SITE is a target binding site found in the 5' untranslated region of mRNA encoded by LOC285651, corresponding to a target binding site such as BINDING SITE I, BINDING SITE II or BINDING SITE III of FIG. 8. Table 4 illustrates the complementarity of the nucleotide sequences of LOC285651 BINDING SITE, designated SEQ ID:4365, to the nucleotide sequence of GAM139 RNA, herein designated GAM RNA, also designated SEQ ID:327.

Another function of GAM139 is therefore inhibition of LOC285651 (Accession XP_211974.1). Accordingly, utilities of GAM139 include diagnosis, prevention and treatment of diseases and clinical conditions associated with LOC285651.

LOC285748 (Accession XP_209738.1) is another GAM139 target gene, herein designated TARGET GENE. LOC285748 BINDING SITE is a target binding site found in the 5' untranslated region of mRNA encoded by LOC285748, corresponding to a target binding site such as BINDING SITE I, BINDING SITE II or BINDING SITE III of FIG. 8. Table 4 illustrates the complementarity of the nucleotide sequences of LOC285748 BINDING SITE, designated SEQ ID:17272, to the nucleotide sequence of GAM139 RNA, herein designated GAM RNA, also designated SEQ ID:327.

Another function of GAM139 is therefore inhibition of LOC285748 (Accession XP_209738.1). Accordingly, utilities of GAM139 include diagnosis, prevention and treatment of diseases and clinical conditions associated with LOC285748.

LOC285801 (Accession XP_209767.1) is another GAM139 target gene, herein designated TARGET GENE. LOC285801 BINDING SITE is a target binding site found in the 5' untranslated region of mRNA encoded by LOC285801, corresponding to a target binding site such as BINDING SITE I, BINDING SITE II or BINDING SITE III of FIG. 8. Table 4 illustrates the complementarity of the nucleotide sequences of LOC285801 BINDING SITE, designated SEQ ID:15998, to the nucleotide sequence of GAM139 RNA, herein designated GAM RNA, also designated SEQ ID:327.

Another function of GAM139 is therefore inhibition of LOC285801 (Accession XP_209767.1). Accordingly, utilities of GAM139 include diagnosis, prevention and treatment of diseases and clinical conditions associated with LOC285801.

LOC285928 (Accession XP_212087.1) is another GAM139 target gene, herein designated TARGET GENE. LOC285928 BINDING SITE is a target binding site found in the 5' untranslated region of mRNA encoded by LOC285928, corresponding to a target binding site such as BINDING SITE I, BINDING SITE II or BINDING SITE III of FIG. 8. Table 4 illustrates the complementarity of the nucleotide sequences of LOC285928 BINDING SITE, designated SEQ ID:12928, to the nucleotide sequence of GAM139 RNA, herein designated GAM RNA, also designated SEQ ID:327.

Another function of GAM139 is therefore inhibition of LOC285928 (Accession XP_212087.1). Accordingly, utilities of GAM139 include diagnosis, prevention and treatment of diseases and clinical conditions associated with LOC285928.

LOC285968 (Accession XP_212107.1) is another GAM139 target gene, herein designated TARGET GENE. LOC285968 BINDING SITE is a target binding site found in the 5' untranslated region of mRNA encoded by LOC285968, corresponding to a target binding site such as BINDING SITE I, BINDING SITE II or BINDING SITE III of FIG. 8. Table 4 illustrates the complementarity of the nucleotide sequences of LOC285968 BINDING SITE, designated SEQ ID:17285, to the nucleotide sequence of GAM139 RNA, herein designated GAM RNA, also designated SEQ ID:327.

Another function of GAM139 is therefore inhibition of LOC285968 (Accession XP_212107.1). Accordingly, utilities of GAM139 include diagnosis, prevention and treatment of diseases and clinical conditions associated with LOC285968.

LOC285992 (Accession XP_212126.1) is another GAM139 target gene, herein designated TARGET GENE. LOC285992 BINDING SITE1 and LOC285992 BINDING SITE2 are target binding sites found in untranslated regions of mRNA encoded by LOC285992, corresponding to target binding sites such as BINDING SITE I, BINDING SITE II or BINDING SITE III of FIG. 8. Table 4 illustrates the complementarity of the nucleotide sequences of LOC285992 BINDING SITE1 and LOC285992 BINDING SITE2, designated SEQ ID:7305 and SEQ ID:1701 respectively, to the nucleotide sequence of GAM139 RNA, herein designated GAM RNA, also designated SEQ ID:327.

Another function of GAM139 is therefore inhibition of LOC285992 (Accession XP_212126.1). Accordingly, utilities of GAM139 include diagnosis, prevention and treatment of diseases and clinical conditions associated with LOC285992.

LOC286078 (Accession XP_212163.1) is another GAM139 target gene, herein designated TARGET GENE. LOC286078 BINDING SITE is a target binding site found in the 5' untranslated region of mRNA encoded by LOC286078, corresponding to a target binding site such as BINDING SITE I, BINDING SITE II or BINDING SITE III of FIG. 8. Table 4 illustrates the complementarity of the nucleotide sequences of LOC286078 BINDING SITE, designated SEQ ID:943, to the nucleotide sequence of GAM139 RNA, herein designated GAM RNA, also designated SEQ ID:327.

Another function of GAM139 is therefore inhibition of LOC286078 (Accession XP_212163.1). Accordingly, utilities of GAM139 include diagnosis, prevention and treatment of diseases and clinical conditions associated with LOC286078.

LOC286218 (Accession XP_212235.1) is another GAM139 target gene, herein designated TARGET GENE. LOC286218 BINDING SITE is a target binding site found in the 3' untranslated region of mRNA encoded by LOC286218, corresponding to a target binding site such as BINDING SITE I, BINDING SITE II or BINDING SITE III of FIG. 8. Table 4 illustrates the complementarity of the nucleotide sequences of LOC286218 BINDING SITE, designated SEQ ID:4239, to the nucleotide sequence of GAM139 RNA, herein designated GAM RNA, also designated SEQ ID:327.

Another function of GAM139 is therefore inhibition of LOC286218 (Accession XP_212235.1). Accordingly, utilities of GAM139 include diagnosis, prevention and treatment of diseases and clinical conditions associated with LOC286218.

LOC286520 (Accession XP_212330.2) is another GAM139 target gene, herein designated TARGET GENE. LOC286520 BINDING SITE is a target binding site found in the 3' untranslated region of mRNA encoded by LOC286520, corresponding to a target binding site such as BINDING SITE I, BINDING SITE II or BINDING SITE III of FIG. 8. Table 4 illustrates the complementarity of the nucleotide sequences of LOC286520 BINDING SITE, designated SEQ ID:9346, to the nucleotide sequence of GAM139 RNA, herein designated GAM RNA, also designated SEQ ID:327.

Another function of GAM139 is therefore inhibition of LOC286520 (Accession XP_212330.2). Accordingly, utilities of GAM139 include diagnosis, prevention and treatment of diseases and clinical conditions associated with LOC286520.

LOC338558 (Accession XP_290465.1) is another GAM139 target gene, herein designated TARGET GENE. LOC338558 BINDING SITE is a target binding site found in the 5' untranslated region of mRNA encoded by LOC338558, corresponding to a target binding site such as BINDING SITE I, BINDING SITE II or BINDING SITE III of FIG. 8. Table 4 illustrates the complementarity of the nucleotide sequences of LOC338558 BINDING SITE, designated SEQ ID:858, to the nucleotide sequence of GAM139 RNA, herein designated GAM RNA, also designated SEQ ID:327.

Another function of GAM139 is therefore inhibition of LOC338558 (Accession XP_290465.1). Accordingly, utilities of GAM139 include diagnosis, prevention and treatment of diseases and clinical conditions associated with LOC338558.

LOC339122 (Accession XP_290714.1) is another GAM139 target gene, herein designated TARGET GENE. LOC339122 BINDING SITE is a target binding site found in the 3' untranslated region of mRNA encoded by LOC339122, corresponding to a target binding site such as BINDING SITE I, BINDING SITE II or BINDING SITE III of FIG. 8. Table 4 illustrates the complementarity of the nucleotide sequences of LOC339122 BINDING SITE, designated SEQ ID:15658, to the nucleotide sequence of GAM139 RNA, herein designated GAM RNA, also designated SEQ ID:327.

Another function of GAM139 is therefore inhibition of LOC339122 (Accession XP_290714.1). Accordingly, utilities of GAM139 include diagnosis, prevention and treatment of diseases and clinical conditions associated with LOC339122.

LOC339166 (Accession XP_294837.1) is another GAM139 target gene, herein designated TARGET GENE. LOC339166 BINDING SITE is a target binding site found in the 5' untranslated region of mRNA encoded by LOC339166, corresponding to a target binding site such as BINDING SITE I, BINDING SITE II or BINDING SITE III of FIG. 8. Table 4 illustrates the complementarity of the nucleotide sequences of LOC339166 BINDING SITE, designated SEQ ID:12464, to the nucleotide sequence of GAM139 RNA, herein designated GAM RNA, also designated SEQ ID:327.

Another function of GAM139 is therefore inhibition of LOC339166 (Accession XP_294837.1). Accordingly, utilities of GAM139 include diagnosis, prevention and treatment of diseases and clinical conditions associated with LOC339166.

LOC339172 (Accession XP_290740.1) is another GAM139 target gene, herein designated TARGET GENE. LOC339172 BINDING SITE is a target binding site found in the 3' untranslated region of mRNA encoded by LOC339172, corresponding to a target binding site such as BINDING SITE I, BINDING SITE II or BINDING SITE III of FIG. 8. Table 4 illustrates the complementarity of the nucleotide sequences of LOC339172 BINDING SITE, designated SEQ ID:2113, to the nucleotide sequence of GAM139 RNA, herein designated GAM RNA, also designated SEQ ID:327.

Another function of GAM139 is therefore inhibition of LOC339172 (Accession XP_290740.1). Accordingly, utilities of GAM139 include diagnosis, prevention and treatment of diseases and clinical conditions associated with LOC339172.

LOC339230 (Accession XP_290771.1) is another GAM139 target gene, herein designated TARGET GENE. LOC339230 BINDING SITE is a target binding site found in the 3' untranslated region of mRNA encoded by LOC339230, corresponding to a target binding site such as BINDING SITE I, BINDING SITE II or BINDING SITE III of FIG. 8. Table 4 illustrates the complementarity of the nucleotide sequences of LOC339230 BINDING SITE, designated SEQ ID:12801, to the nucleotide sequence of GAM139 RNA, herein designated GAM RNA, also designated SEQ ID:327.

Another function of GAM139 is therefore inhibition of LOC339230 (Accession XP_290771.1). Accordingly, utilities of GAM139 include diagnosis, prevention and treatment of diseases and clinical conditions associated with LOC339230.

LOC339305 (Accession XP_297112.1) is another GAM139 target gene, herein designated TARGET GENE. LOC339305 BINDING SITE is a target binding site found in the 5' untranslated region of mRNA encoded by LOC339305, corresponding to a target binding site such as BINDING SITE I, BINDING SITE II or BINDING SITE III of FIG. 8. Table 4 illustrates the complementarity of the nucleotide sequences of LOC339305 BINDING SITE, designated SEQ ID:6942, to the nucleotide sequence of GAM139 RNA, herein designated GAM RNA, also designated SEQ ID:327.

Another function of GAM139 is therefore inhibition of LOC339305 (Accession XP_297112.1). Accordingly, utilities of GAM139 include diagnosis, prevention and treatment of diseases and clinical conditions associated with LOC339305.

LOC339914 (Accession XP_295099.1) is another GAM139 target gene, herein designated TARGET GENE. LOC339914 BINDING SITE is a target binding site found in the 5' untranslated region of mRNA encoded by LOC339914, corresponding to a target binding site such as BINDING SITE I, BINDING SITE II or BINDING SITE III of FIG. 8. Table 4 illustrates the complementarity of the nucleotide sequences of LOC339914 BINDING SITE, designated SEQ ID:19354, to the nucleotide sequence of GAM139 RNA, herein designated GAM RNA, also designated SEQ ID:327.

Another function of GAM139 is therefore inhibition of LOC339914 (Accession XP_295099.1). Accordingly, utilities of GAM139 include diagnosis, prevention and treatment of diseases and clinical conditions associated with LOC339914.

LOC339942 (Accession XP_295107.1) is another GAM139 target gene, herein designated TARGET GENE. LOC339942 BINDING SITE is a target binding site found in the 5' untranslated region of mRNA encoded by LOC339942, corresponding to a target binding site such as BINDING SITE I, BINDING SITE II or BINDING SITE III of FIG. 8. Table 4 illustrates the complementarity of the nucleotide sequences of LOC339942 BINDING SITE, designated SEQ ID:13382, to the nucleotide sequence of GAM139 RNA, herein designated GAM RNA, also designated SEQ ID:327.

Another function of GAM139 is therefore inhibition of LOC339942 (Accession XP_295107.1). Accordingly, utilities of GAM139 include diagnosis, prevention and treatment of diseases and clinical conditions associated with LOC339942.

LOC340223 (Accession XP_290385.1) is another GAM139 target gene, herein designated TARGET GENE. LOC340223 BINDING SITE is a target binding site found in the 3' untranslated region of mRNA encoded by LOC340223, corresponding to a target binding site such as BINDING SITE I, BINDING SITE II or BINDING SITE III of FIG. 8. Table 4 illustrates the complementarity of the nucleotide sequences of LOC340223 BINDING SITE, designated SEQ ID:5180, to the nucleotide sequence of GAM139 RNA, herein designated GAM RNA, also designated SEQ ID:327.

Another function of GAM139 is therefore inhibition of LOC340223 (Accession XP_290385.1). Accordingly, utilities of GAM139 include diagnosis, prevention and treatment of diseases and clinical conditions associated with LOC340223.

LOC340239 (Accession XP_295192.1) is another GAM139 target gene, herein designated TARGET GENE. LOC340239 BINDING SITE is a target binding site found in the 5' untranslated region of mRNA encoded by LOC340239, corresponding to a target binding site such as BINDING SITE I, BINDING SITE II or BINDING SITE III of FIG. 8. Table 4 illustrates the complementarity of the nucleotide sequences of LOC340239 BINDING SITE, designated SEQ ID:3128, to the nucleotide sequence of GAM139 RNA, herein designated GAM RNA, also designated SEQ ID:327.

Another function of GAM139 is therefore inhibition of LOC340239 (Accession XP_295192.1). Accordingly, utilities of GAM139 include diagnosis, prevention and treatment of diseases and clinical conditions associated with LOC340239.

LOC340240 (Accession XP_295189.1) is another GAM139 target gene, herein designated TARGET GENE. LOC340240 BINDING SITE is a target binding site found in the 5' untranslated region of mRNA encoded by LOC340240, corresponding to a target binding site such as BINDING SITE I, BINDING SITE II or BINDING SITE III of FIG. 8. Table 4 illustrates the complementarity of the nucleotide sequences of LOC340240 BINDING SITE, designated SEQ ID:3128, to the nucleotide sequence of GAM139 RNA, herein designated GAM RNA, also designated SEQ ID:327.

Another function of GAM139 is therefore inhibition of LOC340240 (Accession XP_295189.1). Accordingly, utilities of GAM139 include diagnosis, prevention and treatment of diseases and clinical conditions associated with LOC340240.

LOC340243 (Accession XP_290389.1) is another GAM139 target gene, herein designated TARGET GENE. LOC340243 BINDING SITE is a target binding site found in the 3' untranslated region of mRNA encoded by LOC340243, corresponding to a target binding site such as BINDING SITE I, BINDING SITE II or BINDING SITE III of FIG. 8. Table 4 illustrates the complementarity of the nucleotide sequences of LOC340243 BINDING SITE, designated SEQ ID:1105, to the nucleotide sequence of GAM139 RNA, herein designated GAM RNA, also designated SEQ ID:327.

Another function of GAM139 is therefore inhibition of LOC340243 (Accession XP_290389.1). Accordingly, utilities of GAM139 include diagnosis, prevention and treatment of diseases and clinical conditions associated with LOC340243.

LOC340390 (Accession XP_291269.1) is another GAM139 target gene, herein designated TARGET GENE. LOC340390 BINDING SITE is a target binding site found in the 5' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:8372, to the nucleotide sequence of GAM139 RNA, herein designated GAM RNA, also designated SEQ ID:327.

Another function of GAM139 is therefore inhibition of LOC340390 (Accession XP_291269.1). Accordingly, utilities of GAM139 include diagnosis, prevention and treatment of diseases and clinical conditions associated with LOC340390.

LOC340581 (Accession XP_295270.1) is another GAM139 target gene, herein designated TARGET GENE. LOC340581 BINDING SITE is a target binding site found in the 3' untranslated region of mRNA encoded by LOC340581, corresponding to a target binding site such as BINDING SITE I, BINDING SITE II or BINDING SITE III of FIG. 8. Table 4 illustrates the complementarity of the nucleotide sequences of LOC340581 BINDING SITE, designated SEQ ID:17000, to the nucleotide sequence of GAM139 RNA, herein designated GAM RNA, also designated SEQ ID:327.

Another function of GAM139 is therefore inhibition of LOC340581 (Accession XP_295270.1). Accordingly, utilities of GAM139 include diagnosis, prevention and treatment of diseases and clinical conditions associated with LOC340581.

LOC342195 (Accession XP_292413.1) is another GAM139 target gene, herein designated TARGET GENE. LOC342195 BINDING SITE is a target binding site found in the 5' untranslated region of mRNA encoded by LOC342195, corresponding to a target binding site such as BINDING SITE I, BINDING SITE II or BINDING SITE III of FIG. 8. Table 4 illustrates the complementarity of the nucleotide sequences of LOC342195 BINDING SITE, designated SEQ ID:12881, to the nucleotide sequence of GAM139 RNA, herein designated GAM RNA, also designated SEQ ID:327.

Another function of GAM139 is therefore inhibition of LOC342195 (Accession XP_292413.1). Accordingly, utilities of GAM139 include diagnosis, prevention and treatment of diseases and clinical conditions associated with LOC342195.

LOC342346 (Accession XP_296817.2) is another GAM139 target gene, herein designated TARGET GENE. LOC342346 BINDING SITE is a target binding site found in the 3' untranslated region of mRNA encoded by LOC342346, corresponding to a target binding site such as BINDING SITE I, BINDING SITE II or BINDING SITE III of FIG. 8. Table 4 illustrates the complementarity of the nucleotide sequences of LOC342346 BINDING SITE, designated SEQ ID:16656, to the nucleotide sequence of GAM139 RNA, herein designated GAM RNA, also designated SEQ ID:327.

Another function of GAM139 is therefore inhibition of LOC342346 (Accession XP_296817.2). Accordingly, utilities of GAM139 include diagnosis, prevention and treatment of diseases and clinical conditions associated with LOC342346.

LOC342487 (Accession XP_296893.1) is another GAM139 target gene, herein designated TARGET GENE. LOC342487 BINDING SITE is a target binding site found in the 5' untranslated region of mRNA encoded by LOC342487, corresponding to a target binding site such as BINDING SITE I, BINDING SITE II or BINDING SITE III of FIG. 8. Table 4 illustrates the complementarity of the nucleotide sequences of LOC342487 BINDING SITE, designated SEQ ID:1758, to the nucleotide sequence of GAM139 RNA, herein designated GAM RNA, also designated SEQ ID:327.

Another function of GAM139 is therefore inhibition of LOC342487 (Accession XP_296893.1). Accordingly, utilities of GAM139 include diagnosis, prevention and treatment of diseases and clinical conditions associated with LOC342487.

LOC344563 (Accession XP_297716.1) is another GAM139 target gene, herein designated TARGET GENE. LOC344563 BINDING SITE is a target binding site found in the 5' untranslated region of mRNA encoded by LOC344563, corresponding to a target binding site such as BINDING SITE I, BINDING SITE II or BINDING SITE III of FIG. 8. Table 4 illustrates the complementarity of the nucleotide sequences of LOC344563 BINDING SITE, designated SEQ ID:13365, to the nucleotide sequence of GAM139 RNA, herein designated GAM RNA, also designated SEQ ID:327.

Another function of GAM139 is therefore inhibition of LOC344563 (Accession XP_297716.1). Accordingly, utilities of GAM139 include diagnosis, prevention and treatment of diseases and clinical conditions associated with LOC344563.

LOC344992 (Accession XP_298469.1) is another GAM139 target gene, herein designated TARGET GENE. LOC344992 BINDING SITE is a target binding site found in the 5' untranslated region of mRNA encoded by LOC344992, corresponding to a target binding site such as BINDING SITE I, BINDING SITE II or BINDING SITE III of FIG. 8. Table 4 illustrates the complementarity of the nucleotide sequences of LOC344992 BINDING SITE, designated SEQ ID:17064, to the nucleotide sequence of GAM139 RNA, herein designated GAM RNA, also designated SEQ ID:327.

Another function of GAM139 is therefore inhibition of LOC344992 (Accession XP_298469.1). Accordingly, utilities of GAM139 include diagnosis, prevention and treatment of diseases and clinical conditions associated with LOC344992.

LOC347959 (Accession XP_302635.1) is another GAM139 target gene, herein designated TARGET GENE. LOC347959 BINDING SITE is a target binding site found in the 3' untranslated region of mRNA encoded by LOC347959, corresponding to a target binding site such as BINDING SITE I, BINDING SITE II or BINDING SITE III of FIG. 8. Table 4 illustrates the complementarity of the nucleotide sequences of LOC347959 BINDING SITE, designated SEQ ID:9115, to the nucleotide sequence of GAM139 RNA, herein designated GAM RNA, also designated SEQ ID:327.

Another function of GAM139 is therefore inhibition of LOC347959 (Accession XP_302635.1). Accordingly, utilities of GAM139 include diagnosis, prevention and treatment of diseases and clinical conditions associated with LOC347959.

LOC348118 (Accession XP_300289.1) is another GAM139 target gene, herein designated TARGET GENE. LOC348118 BINDING SITE is a target binding site found in the 5' untranslated region of mRNA encoded by LOC348118, corresponding to a target binding site such as BINDING SITE I, BINDING SITE II or BINDING SITE III of FIG. 8. Table 4 illustrates the complementarity of the nucleotide sequences of LOC348118 BINDING SITE, designated SEQ ID:15242, to the nucleotide sequence of GAM139 RNA, herein designated GAM RNA, also designated SEQ ID:327.

Another function of GAM139 is therefore inhibition of LOC348118 (Accession XP_300289.1). Accordingly, utilities of GAM139 include diagnosis, prevention and treatment of diseases and clinical conditions associated with LOC348118.

LOC348488 (Accession XP_300352.1) is another GAM139 target gene, herein designated TARGET GENE. LOC348488 BINDING SITE is a target binding site found in the 3' untranslated region of mRNA encoded by LOC348488, corresponding to a target binding site such as BINDING SITE I, BINDING SITE II or BINDING SITE III of FIG. 8. Table 4 illustrates the complementarity of the nucleotide sequences of LOC348488 BINDING SITE, designated SEQ ID:18044, to the nucleotide sequence of GAM139 RNA, herein designated GAM RNA, also designated SEQ ID:327.

Another function of GAM139 is therefore inhibition of LOC348488 (Accession XP_300352.1). Accordingly, utilities of GAM139 include diagnosis, prevention and treatment of diseases and clinical conditions associated with LOC348488.

LOC348509 (Accession XP_300770.1) is another GAM139 target gene, herein designated TARGET GENE. LOC348509 BINDING SITE is a target binding site found in the 5' untranslated region of mRNA encoded by LOC348509, corresponding to a target binding site such as BINDING SITE I, BINDING SITE II or BINDING SITE III of FIG. 8. Table 4 illustrates the complementarity of the nucleotide sequences of LOC348509 BINDING SITE, designated SEQ ID:8733, to the nucleotide sequence of GAM139 RNA, herein designated GAM RNA, also designated SEQ ID:327.

Another function of GAM139 is therefore inhibition of LOC348509 (Accession XP_300770.1). Accordingly, utilities of GAM139 include diagnosis, prevention and treatment of diseases and clinical conditions associated with LOC348509.

LOC348549 (Accession XP_211637.1) is another GAM139 target gene, herein designated TARGET GENE. LOC348549 BINDING SITE is a target binding site found in the 5' untranslated region of mRNA encoded by LOC348549, corresponding to a target binding site such as BINDING SITE I, BINDING SITE II or BINDING SITE III of FIG. 8. Table 4 illustrates the complementarity of the nucleotide sequences of LOC348549 BINDING SITE, designated SEQ ID:19450, to the nucleotide sequence of GAM139 RNA, herein designated GAM RNA, also designated SEQ ID:327.

Another function of GAM139 is therefore inhibition of LOC348549 (Accession XP_211637.1). Accordingly, utilities of GAM139 include diagnosis, prevention and treatment of diseases and clinical conditions associated with LOC348549.

LOC348552 (Accession XP_209362.1) is another GAM139 target gene, herein designated TARGET GENE. LOC348552 BINDING SITE is a target binding site found in the 3' untranslated region of mRNA encoded by LOC348552, corresponding to a target binding site such as BINDING SITE I, BINDING SITE II or BINDING SITE III of FIG. 8. Table 4 illustrates the complementarity of the nucleotide sequences of LOC348552 BINDING SITE, designated SEQ ID:13423, to the nucleotide sequence of GAM139 RNA, herein designated GAM RNA, also designated SEQ ID:327.

Another function of GAM139 is therefore inhibition of LOC348552 (Accession XP_209362.1). Accordingly, utilities of GAM139 include diagnosis, prevention and treatment of diseases and clinical conditions associated with LOC348552.

LOC348599 (Accession XP_300383.1) is another GAM139 target gene, herein designated TARGET GENE. LOC348599 BINDING SITE1 and LOC348599 BINDING SITE2 are target binding sites found in untranslated regions of mRNA encoded by LOC348599, corresponding to target binding sites such as BINDING SITE I, BINDING SITE II or BINDING SITE III of FIG. 8. Table 4 illustrates the complementarity of the nucleotide sequences of LOC348599 BINDING SITE1 and LOC348599 BINDING SITE2, designated SEQ ID:19517 and SEQ ID:4696 respectively, to the nucleotide sequence of GAM139 RNA, herein designated GAM RNA, also designated SEQ ID:327.

Another function of GAM139 is therefore inhibition of LOC348599 (Accession XP_300383.1). Accordingly, utilities of GAM139 include diagnosis, prevention and treatment of diseases and clinical conditions associated with LOC348599.

LOC348909 (Accession XP_300875.1) is another GAM139 target gene, herein designated TARGET GENE. LOC348909 BINDING SITE is a target binding site found in the 5' untranslated region of mRNA encoded by LOC348909, corresponding to a target binding site such as BINDING SITE I, BINDING SITE II or BINDING SITE III of FIG. 8. Table 4 illustrates the complementarity of the nucleotide sequences of LOC348909 BINDING SITE, designated SEQ ID:14383, to the nucleotide sequence of GAM139 RNA, herein designated GAM RNA, also designated SEQ ID:327.

Another function of GAM139 is therefore inhibition of LOC348909 (Accession XP_300875.1). Accordingly, utilities of GAM139 include diagnosis, prevention and treatment of diseases and clinical conditions associated with LOC348909.

LOC349061 (Accession XP_300923.1) is another GAM139 target gene, herein designated TARGET GENE. LOC349061 BINDING SITE is a target binding site found in the 5' untranslated region of mRNA encoded by LOC349061, corresponding to a target binding site such as BINDING SITE I, BINDING SITE II or BINDING SITE III of FIG. 8. Table 4 illustrates the complementarity of the nucleotide sequences of LOC349061 BINDING SITE, designated SEQ ID:17272, to the nucleotide sequence of GAM139 RNA, herein designated GAM RNA, also designated SEQ ID:327.

Another function of GAM139 is therefore inhibition of LOC349061 (Accession XP_300923.1). Accordingly, utilities of GAM139 include diagnosis, prevention and treatment of diseases and clinical conditions associated with LOC349061.

LOC349066 (Accession XP_300926.1) is another GAM139 target gene, herein designated TARGET GENE. LOC349066 BINDING SITE is a target binding site found in the 5' untranslated region of mRNA encoded by LOC349066, corresponding to a target binding site such as BINDING SITE I, BINDING SITE II or BINDING SITE III of FIG. 8. Table 4 illustrates the complementarity of the nucleotide sequences of LOC349066 BINDING SITE, designated SEQ ID:17272, to the nucleotide sequence of GAM139 RNA, herein designated GAM RNA, also designated SEQ ID:327.

Another function of GAM139 is therefore inhibition of LOC349066 (Accession XP_300926.1). Accordingly, utilities of GAM139 include diagnosis, prevention and treatment of diseases and clinical conditions associated with LOC349066.

LOC349092 (Accession XP_302959.1) is another GAM139 target gene, herein designated TARGET GENE. LOC349092 BINDING SITE is a target binding site found in the 5' untranslated region of mRNA encoded by LOC349092, corresponding to a target binding site such as BINDING SITE I, BINDING SITE II or BINDING SITE III of FIG. 8. Table 4 illustrates the complementarity of the nucleotide sequences of LOC349092 BINDING SITE, designated SEQ ID:6029, to the nucleotide sequence of GAM139 RNA, herein designated GAM RNA, also designated SEQ ID:327.

Another function of GAM139 is therefore inhibition of LOC349092 (Accession XP_302959.1). Accordingly, utilities of GAM139 include diagnosis, prevention and treatment of diseases and clinical conditions associated with LOC349092.

LOC349151 (Accession XP_302967.1) is another GAM139 target gene, herein designated TARGET GENE. LOC349151 BINDING SITE is a target binding site found in the 3' untranslated region of mRNA encoded by LOC349151, corresponding to a target binding site such as BINDING SITE I, BINDING SITE II or BINDING SITE III of FIG. 8. Table 4 illustrates the complementarity of the nucleotide sequences of LOC349151 BINDING SITE, designated SEQ ID:1431, to the nucleotide sequence of GAM139 RNA, herein designated GAM RNA, also designated SEQ ID:327.

Another function of GAM139 is therefore inhibition of LOC349151 (Accession XP_302967.1). Accordingly, utilities of GAM139 include diagnosis, prevention and treatment of diseases and clinical conditions associated with LOC349151.

LOC349710 (Accession XP_303482.1) is another GAM139 target gene, herein designated TARGET GENE. LOC349710 BINDING SITE is a target binding site found in the 5' untranslated region of mRNA encoded by LOC349710, corresponding to a target binding site such as BINDING SITE I, BINDING SITE II or BINDING SITE III of FIG. 8. Table 4 illustrates the complementarity of the nucleotide sequences of LOC349710 BINDING SITE, designated SEQ ID:18662, to the nucleotide sequence of GAM139 RNA, herein designated GAM RNA, also designated SEQ ID:327.

Another function of GAM139 is therefore inhibition of LOC349710 (Accession XP_303482.1). Accordingly, utilities of GAM139 include diagnosis, prevention and treatment of diseases and clinical conditions associated with LOC349710.

LOC90120 (Accession XP_291299.1) is another GAM139 target gene, herein designated TARGET GENE. LOC90120 BINDING SITE is a target binding site found in the 5' untranslated region of mRNA encoded by LOC90120, corresponding to a target binding site such as BINDING SITE I, BINDING SITE II or BINDING SITE III of FIG. 8. Table 4 illustrates the complementarity of the nucleotide sequences of LOC90120 BINDING SITE, designated SEQ ID:3855, to the nucleotide sequence of GAM139 RNA, herein designated GAM RNA, also designated SEQ ID:327.

Another function of GAM139 is therefore inhibition of LOC90120 (Accession XP_291299.1). Accordingly, utilities of GAM139 include diagnosis, prevention and treatment of diseases and clinical conditions associated with LOC90120.

LOC90906 (Accession XP_034809.1) is another GAM139 target gene, herein designated TARGET GENE. LOC90906 BINDING SITE is a target binding site found in the 3' untranslated region of mRNA encoded by LOC90906, corresponding to a target binding site such as BINDING SITE I, BINDING SITE II or BINDING SITE III of FIG. 8. Table 4 illustrates the complementarity of the nucleotide sequences of LOC90906 BINDING SITE, designated SEQ ID:7354, to the nucleotide sequence of GAM139 RNA, herein designated GAM RNA, also designated SEQ ID:327.

Another function of GAM139 is therefore inhibition of LOC90906 (Accession XP_034809.1). Accordingly, utilities of GAM139 include diagnosis, prevention and treatment of diseases and clinical conditions associated with LOC90906.

LOC91661 (Accession NP_612381.1) is another GAM139 target gene, herein designated TARGET GENE. LOC91661 BINDING SITE is a target binding site found in the 3' untranslated region of mRNA encoded by LOC91661, corresponding to a target binding site such as BINDING SITE I, BINDING SITE II or BINDING SITE III of FIG. 8. Table 4 illustrates the complementarity of the nucleotide sequences of LOC91661 BINDING SITE, designated SEQ ID:19944, to the nucleotide sequence of GAM139 RNA, herein designated GAM RNA, also designated SEQ ID:327.

Another function of GAM139 is therefore inhibition of LOC91661 (Accession NP_612381.1). Accordingly, utilities of GAM139 include diagnosis, prevention and treatment of diseases and clinical conditions associated with LOC91661.

LOC91947 (Accession XP_041721.2) is another GAM139 target gene, herein designated TARGET GENE. LOC91947 BINDING SITE is a target binding site found in the 3' untranslated region of mRNA encoded by LOC91947, corresponding to a target binding site such as BINDING SITE I, BINDING SITE II or BINDING SITE III of FIG. 8. Table 4 illustrates the complementarity of the nucleotide sequences of LOC91947 BINDING SITE, designated SEQ ID:13563, to the nucleotide sequence of GAM139 RNA, herein designated GAM RNA, also designated SEQ ID:327.

Another function of GAM139 is therefore inhibition of LOC91947 (Accession XP_041721.2). Accordingly, utilities of GAM139 include diagnosis, prevention and treatment of diseases and clinical conditions associated with LOC91947.

LOC91974 (Accession XP_041974.2) is another GAM139 target gene, herein designated TARGET GENE. LOC91974 BINDING SITE is a target binding site found in the 5' untranslated region of mRNA encoded by LOC91974, corresponding to a target binding site such as BINDING SITE I, BINDING SITE II or BINDING SITE III of FIG. 8. Table 4 illustrates the complementarity of the nucleotide sequences of LOC91974 BINDING SITE, designated SEQ ID:706, to the nucleotide sequence of GAM139 RNA, herein designated GAM RNA, also designated SEQ ID:327.

Another function of GAM139 is therefore inhibition of LOC91974 (Accession XP_041974.2). Accordingly, utilities of GAM139 include diagnosis, prevention and treatment of diseases and clinical conditions associated with LOC91974.

LOC93273 (Accession XP_050184.1) is another GAM139 target gene, herein designated TARGET GENE. LOC93273 BINDING SITE1 and LOC93273 BINDING SITE2 are target binding sites found in untranslated regions of mRNA encoded by LOC93273, corresponding to target binding sites such as BINDING SITE I, BINDING SITE II or BINDING SITE III of FIG. 8. Table 4 illustrates the complementarity of the nucleotide sequences of LOC93273 BINDING SITE1 and LOC93273 BINDING SITE2, designated SEQ ID:18095 and SEQ ID:2415 respectively, to the nucleotide sequence of GAM139 RNA, herein designated GAM RNA, also designated SEQ ID:327.

Another function of GAM139 is therefore inhibition of LOC93273 (Accession XP_050184.1). Accordingly, utilities of GAM139 include diagnosis, prevention and treatment of diseases and clinical conditions associated with LOC93273.

LW-1 (Accession NP_057237.1) is another GAM139 target gene, herein designated TARGET GENE. LW-1 BINDING SITE is a target binding site found in the 5' untranslated region of mRNA encoded by LW-1, corresponding to a target binding site such as BINDING SITE I, BINDING SITE II or BINDING SITE III of FIG. 8. Table 4 illustrates the complementarity of the nucleotide sequences of LW-1 BINDING SITE, designated SEQ ID:11543, to the nucleotide sequence of GAM139 RNA, herein designated GAM RNA, also designated SEQ ID:327.

Another function of GAM139 is therefore inhibition of LW-1 (Accession NP_057237.1). Accordingly, utilities of GAM139 include diagnosis, prevention and treatment of diseases and clinical conditions associated with LW-1.

Microtubule-associated protein, rp/eb family, member 1 (MAPRE1, Accession NP_036457.1) is another GAM139 target gene, herein designated TARGET GENE. MAPRE1 BINDING SITE is a target binding site found in the 3' untranslated region of mRNA encoded by MAPRE1, corresponding to a target binding site such as BINDING SITE I, BINDING SITE II or BINDING SITE III of FIG. 8. Table 4 illustrates the complementarity of the nucleotide sequences of MAPRE1 BINDING SITE, designated SEQ ID:19788, to the nucleotide sequence of GAM139 RNA, herein designated GAM RNA, also designated SEQ ID:327.

Another function of GAM139 is therefore inhibition of Microtubule-associated protein, rp/eb family, member 1 (MAPRE1, Accession NP_036457.1). Accordingly, utilities of GAM139 include diagnosis, prevention and treatment of diseases and clinical conditions associated with MAPRE1.

Microtubule-associated protein, rp/eb family, member 3 (MAPRE3, Accession NP_036458.2) is another GAM139 target gene, herein designated TARGET GENE. MAPRE3 BINDING SITE is a target binding site found in the 3' untranslated region of mRNA encoded by MAPRE3, corresponding to a target binding site such as BINDING SITE I, BINDING SITE II or BINDING SITE III of FIG. 8. Table 4 illustrates the complementarity of the nucleotide sequences of MAPRE3 BINDING SITE, designated SEQ ID:12646, to the nucleotide sequence of GAM139 RNA, herein designated GAM RNA, also designated SEQ ID:327.

Another function of GAM139 is therefore inhibition of Microtubule-associated protein, rp/eb family, member 3 (MAPRE3, Accession NP_036458.2), a gene which interact with cytoplasmic microtubules,and with the adenomatous polyposis coli. Accordingly, utilities of GAM139 include diagnosis, prevention and treatment of diseases and clinical conditions associated with MAPRE3.

The function of MAPRE3 and its association with various diseases and clinical conditions, has been established by previous studies, as described hereinabove with reference to GAM117.1. Methyl-cpg binding domain protein 1 (MBD1, Accession NP_056723.2) is another GAM139 target gene, herein designated TARGET GENE. MBD1 BINDING SITE is a target binding site found in the 3' untranslated region of multiple transcripts of mRNA encoded by MBD1, corresponding to a target binding site such as BINDING SITE I, BINDING SITE II or BINDING SITE III of FIG. 8. Table 4 illustrates the complementarity of the nucleotide sequences of MBD1 BINDING SITE, designated SEQ ID:14525, to the nucleotide sequence of GAM139 RNA, herein designated GAM RNA, also designated SEQ ID:327.

Another function of GAM139 is therefore inhibition of Methyl-cpg binding domain protein 1 (MBD1, Accession NP_056723.2), a gene which bind specifically to methylated DNA via a methyl-CpG-binding domain (MBD). Accordingly, utilities of GAM139 include diagnosis, prevention and treatment of diseases and clinical conditions associated with MBD1.

The function of MBD1 has been established by previous studies. Attempts to understand how DNA methylation prevents transcription have centered on 2 alternative mechanisms: direct interference of site-specific methylation with the binding of essential transcription factors, and indirect interference of promoter-proximal methylation with transcription via a protein that binds to methylated DNA. Methyl-CpG-binding protein-1 (MECP1) binds to a variety of methylated sequences in vitro, provided they contain at least 12 symmetrically methylated CpGs. MECP1 has been detected in crude nuclear extracts. Boyes and Bird (1991) and Levine et al. (1991) presented evidence suggesting that the MECP1 protein is a mediator of repression. Methylation of cytosines within the sequence CpG is essential for mouse development and has been linked to transcriptional suppression in vertebrate systems. Methyl-CpG-binding proteins MECP1 and MECP2 (OMIM Ref. No. 300005) bind preferentially to methylated DNA and can inhibit transcription. The rat Mecp2 gene was cloned by Nan et al. (1993) and its methyl-CpG-binding domain (MBD) defined. By searching DNA sequence databases with the MBD sequence, Cross et al. (1997) identified a human cDNA with potential to encode an MBD-like region. Sequencing of the complete cDNA revealed that the open reading frame also encodes 2 cysteine-rich domains that were found in animal DNA methyltransferases (see OMIM Ref. No. DNMT; 126375) and in the mammalian HRX protein, also known as MLL and ALL-1 (OMIM Ref. No. 159555). They designated the protein PCM1 for 'protein containing MBD.' Expressed in bacteria, it showed specific binding to methylated DNA. PCM1 also repressed transcription in vitro in a methylation-dependent manner. A polyclonal antibody raised against the protein was able to bind the native MECP1 complex from HeLa cells, indicating that PCM1 is a component of mammalian MECP1. Using PCR on a hybrid panel and FISH, Hendrich et al. (1999) mapped the MBD1 gene to chromosome 18q21, 2.1 cM distal to MBD2 (OMIM Ref. No. 603547). They mapped the murine gene to chromosome 18.

Full details of the abovementioned studies are described in the following publications, the disclosure of which are hereby incorporated by reference:

Boyes, J.; Bird, A.: DNA methylation inhibits transcription indirectly via a methyl-CpG binding protein. Cell 64:1123-1134, 1991; and Levine, A.; Cantoni, G. L.; Razin, A.: Inhibition of promoter activity by methylation: possible involvement of protein mediators. Proc. Nat. Acad. Sci. 88:6515-6518, 1991.

Further studies establishing the function and utilities of MBD1 are found in John Hopkins OMIM database record ID 156535, and in cited publications listed in Table 5, which are hereby incorporated by reference. Methyl-cpg binding domain protein 1 (MBD1, Accession NP_056669.1) is another GAM139 target gene, herein designated TARGET GENE. MBD1 BINDING SITE is a target binding site found in the 3' untranslated region of multiple transcripts of mRNA encoded by MBD1, corresponding to a target binding site such as BINDING SITE I, BINDING SITE II or BINDING SITE III of FIG. 8. Table 4 illustrates the complementarity of the nucleotide sequences of MBD1 BINDING SITE, designated SEQ ID:14525, to the nucleotide sequence of GAM139 RNA, herein designated GAM RNA, also designated SEQ ID:327.

Another function of GAM139 is therefore inhibition of Methyl-cpg binding domain protein 1 (MBD1, Accession NP_056669.1), a gene which bind specifically to methylated DNA via a methyl-CpG-binding domain (MBD). Accordingly, utilities of GAM139 include diagnosis, prevention and treatment of diseases and clinical conditions associated with MBD1.

The function of MBD1 has been established by previous studies. Attempts to understand how DNA methylation prevents transcription have centered on 2 alternative mechanisms: direct interference of site-specific methylation with the binding of essential transcription factors, and indirect interference of promoter-proximal methylation with transcription via a protein that binds to methylated DNA. Methyl-CpG-binding protein-1 (MECP1) binds to a variety of methylated sequences in vitro, provided they contain at least 12 symmetrically methylated CpGs. MECP1 has been detected in crude nuclear extracts. Boyes and Bird (1991) and Levine et al. (1991) presented evidence suggesting that the MECP1 protein is a mediator of repression. Methylation of cytosines within the sequence CpG is essential for mouse development and has been linked to transcriptional suppression in vertebrate systems. Methyl-CpG-binding proteins MECP1 and MECP2 (OMIM Ref. No. 300005) bind preferentially to methylated DNA and can inhibit transcription. The rat Mecp2 gene was cloned by Nan et al. (1993) and its methyl-CpG-binding domain (MBD) defined. By searching DNA sequence databases with the MBD sequence, Cross et al. (1997) identified a human cDNA with potential to encode an MBD-like region. Sequencing of the complete cDNA revealed that the open reading frame also encodes 2 cysteine-rich domains that were found in animal DNA methyltransferases (see OMIM Ref. No. DNMT; 126375) and in the mammalian HRX protein, also known as MLL and ALL-1 (OMIM Ref. No. 159555). They designated the protein PCM1 for 'protein containing MBD.' Expressed in bacteria, it showed specific binding to methylated DNA. PCM1 also repressed transcription in vitro in a methylation-dependent manner. A polyclonal antibody raised against the protein was able to bind the native MECP1 complex from HeLa cells, indicating that PCM1 is a component of mammalian MECP1. Using PCR on a hybrid panel and FISH, Hendrich et al. (1999) mapped the MBD1 gene to chromosome 18q21, 2.1 cM distal to MBD2 (OMIM Ref. No. 603547). They mapped the murine gene to chromosome 18.

Full details of the abovementioned studies are described in the following publications, the disclosure of which are hereby incorporated by reference:

Boyes, J.; Bird, A.: DNA methylation inhibits transcription indirectly via a methyl-CpG binding protein. Cell 64:1123-1134, 1991; and Levine, A.; Cantoni, G. L.; Razin, A.: Inhibition of promoter activity by methylation: possible involvement of protein mediators. Proc. Nat. Acad. Sci. 88:6515-6518, 1991.

Further studies establishing the function and utilities of MBD1 are found in John Hopkins OMIM database record ID 156535, and in cited publications listed in Table 5, which are hereby incorporated by reference. Methyl-cpg binding domain protein 1 (MBD1, Accession NP_002375.1) is another GAM139 target gene, herein designated TARGET GENE. MBD1 BINDING SITE is a target binding site found in the 3' untranslated region of multiple transcripts of mRNA encoded by MBD1, corresponding to a target binding site such as BINDING SITE I, BINDING SITE II or BINDING SITE III of FIG. 8. Table 4 illustrates the complementarity of the nucleotide sequences of MBD1 BINDING SITE, designated SEQ ID:14525, to the nucleotide sequence of GAM139 RNA, herein designated GAM RNA, also designated SEQ ID:327.

Another function of GAM139 is therefore inhibition of Methyl-cpg binding domain protein 1 (MBD1, Accession NP_002375.1), a gene which bind specifically to methylated DNA via a methyl-CpG-binding domain (MBD). Accordingly, utilities of GAM139 include diagnosis, prevention and treatment of diseases and clinical conditions associated with MBD1.

The function of MBD1 has been established by previous studies. Attempts to understand how DNA methylation prevents transcription have centered on 2 alternative mechanisms: direct interference of site-specific methylation with the binding of essential transcription factors, and indirect interference of promoter- proximal methylation with transcription via a protein that binds to methylated DNA. Methyl-CpG-binding protein-1 (MECP1) binds to a variety of methylated sequences in vitro, provided they contain at least 12 symmetrically methylated CpGs. MECP1 has been detected in crude nuclear extracts. Boyes and Bird (1991) and Levine et al. (1991) presented evidence suggesting that the MECP1 protein is a mediator of repression. Methylation of cytosines within the sequence CpG is essential for mouse development and has been linked to transcriptional suppression in vertebrate systems. Methyl-CpG-binding proteins MECP1 and MECP2 (OMIM Ref. No. 300005) bind preferentially to methylated DNA and can inhibit transcription. The rat Mecp2 gene was cloned by Nan et al. (1993) and its methyl-CpG-binding domain (MBD) defined. By searching DNA sequence databases with the MBD sequence, Cross et al. (1997) identified a human cDNA with potential to encode an MBD-like region. Sequencing of the complete cDNA revealed that the open reading frame also encodes 2 cysteine-rich domains that were found in animal DNA methyltransferases (see OMIM Ref. No. DNMT; 126375) and in the mammalian HRX protein, also known as MLL and ALL-1 (OMIM Ref. No. 159555). They designated the protein PCM1 for 'protein containing MBD.' Expressed in bacteria, it showed specific binding to methylated DNA. PCM1 also repressed transcription in vitro in a methylation-dependent manner. A polyclonal antibody raised against the protein was able to bind the native MECP1 complex from HeLa cells, indicating that PCM1 is a component of mammalian MECP1. Using PCR on a hybrid panel and FISH, Hendrich et al. (1999) mapped the MBD1 gene to chromosome 18q21, 2.1 cM distal to MBD2 (OMIM Ref. No. 603547). They mapped the murine gene to chromosome 18.

Full details of the abovementioned studies are described in the following publications, the disclosure of which are hereby incorporated by reference:

Boyes, J.; Bird, A.: DNA methylation inhibits transcription indirectly via a methyl- CpG binding protein. Cell 64:1123-1134, 1991; and Levine, A.; Cantoni, G. L.; Razin, A.: Inhibition of promoter activity by methylation: possible involvement of protein mediators. Proc. Nat. Acad. Sci. 88:6515-6518, 1991.

Further studies establishing the function and utilities of MBD1 are found in John Hopkins OMIM database record ID 156535, and in cited publications listed in Table 5, which are hereby incorporated by reference. Methyl-cpg binding domain protein 1 (MBD1, Accession NP_056671.2) is another GAM139 target gene, herein designated TARGET GENE. MBD1 BINDING SITE is a target binding site found in the 3' untranslated region of multiple transcripts of mRNA encoded by MBD1, corresponding to a target binding site such as BINDING SITE I, BINDING SITE II or BINDING SITE III of FIG. 8. Table 4 illustrates the complementarity of the nucleotide sequences of MBD1 BINDING SITE, designated SEQ ID:14525, to the nucleotide sequence of GAM139 RNA, herein designated GAM RNA, also designated SEQ ID:327.

Another function of GAM139 is therefore inhibition of Methyl-cpg binding domain protein 1 (MBD1, Accession NP_056671.2), a gene which bind specifically to methylated DNA via a methyl-CpG-binding domain (MBD). Accordingly, utilities of GAM139 include diagnosis, prevention and treatment of diseases and clinical conditions associated with MBD1.

The function of MBD1 has been established by previous studies. Attempts to understand how DNA methylation prevents transcription have centered on 2 alternative mechanisms: direct interference of site-specific methylation with the binding of essential transcription factors, and indirect interference of promoter- proximal methylation with transcription via a protein that binds to methylated DNA. Methyl-CpG-binding protein-1 (MECP1) binds to a variety of methylated sequences in vitro, provided they contain at least 12 symmetrically methylated CpGs. MECP1 has been detected in crude nuclear extracts. Boyes and Bird (1991) and Levine et al. (1991) presented evidence suggesting that the MECP1 protein is a mediator of repression. Methylation of cytosines within the sequence CpG is essential for mouse development and has been linked to transcriptional suppression in vertebrate systems. Methyl-CpG-binding proteins MECP1 and MECP2 (OMIM Ref. No. 300005) bind preferentially to methylated DNA and can inhibit transcription. The rat Mecp2 gene was cloned by Nan et al. (1993) and its methyl-CpG-binding domain (MBD) defined. By searching DNA sequence databases with the MBD sequence, Cross et al. (1997) identified a human cDNA with potential to encode an MBD-like region. Sequencing of the complete cDNA revealed that the open reading frame also encodes 2 cysteine-rich domains that were found in animal DNA methyltransferases (see OMIM Ref. No. DNMT; 126375) and in the mammalian HRX protein, also known as MLL and ALL-1 (OMIM Ref. No. 159555). They designated the protein PCM1 for 'protein containing MBD.' Expressed in bacteria, it showed specific binding to methylated DNA. PCM1 also repressed transcription in vitro in a methylation-dependent manner. A polyclonal antibody raised against the protein was able to bind the native MECP1 complex from HeLa cells, indicating that PCM1 is a component of mammalian MECP1. Using PCR on a hybrid panel and FISH, Hendrich et al. (1999) mapped the MBD1 gene to chromosome 18q21, 2.1 cM distal to MBD2 (OMIM Ref. No. 603547). They mapped the murine gene to chromosome 18.

Full details of the abovementioned studies are described in the following publications, the disclosure of which are hereby incorporated by reference:

Boyes, J.; Bird, A.: DNA methylation inhibits transcription indirectly via a methyl- CpG binding protein. Cell 64:1123-1134, 1991; and Levine, A.; Cantoni, G. L.; Razin, A.: Inhibition of promoter activity by methylation: possible involvement of protein mediators. Proc. Nat. Acad. Sci. 88:6515-6518, 1991.

Further studies establishing the function and utilities of MBD1 are found in John Hopkins OMIM database record ID 156535, and in cited publications listed in Table 5, which are hereby incorporated by reference. MGC10715 (Accession NP_077301.4) is another GAM139 target gene, herein designated TARGET GENE. MGC10715 BINDING SITE is a target binding site found in the 3' untranslated region of mRNA encoded by MGC10715, corresponding to a target binding site such as BINDING SITE I, BINDING SITE II or BINDING SITE III of FIG. 8. Table 4 illustrates the complementarity of the nucleotide sequences of MGC10715 BINDING SITE, designated SEQ ID:17990, to the nucleotide sequence of GAM139 RNA, herein designated GAM RNA, also designated SEQ ID:327.

Another function of GAM139 is therefore inhibition of MGC10715 (Accession NP_077301.4). Accordingly, utilities of GAM139 include diagnosis, prevention and treatment of diseases and clinical conditions associated with MGC10715.

MGC12518 (Accession NP_291026.1) is another GAM139 target gene, herein designated TARGET GENE. MGC12518 BINDING SITE is a target binding site found in the 5' untranslated region of mRNA encoded by MGC12518, corresponding to a target binding site such as BINDING SITE I, BINDING SITE II or BINDING SITE III of FIG. 8. Table 4 illustrates the complementarity of the nucleotide sequences of MGC12518 BINDING SITE, designated SEQ ID:18236, to the nucleotide sequence of GAM139 RNA, herein designated GAM RNA, also designated SEQ ID:327.

Another function of GAM139 is therefore inhibition of MGC12518 (Accession NP_291026.1). Accordingly, utilities of GAM139 include diagnosis, prevention and treatment of diseases and clinical conditions associated with MGC12518.

MGC13071 (Accession NP_116078.2) is another GAM139 target gene, herein designated TARGET GENE. MGC13071 BINDING SITE is a target binding site found in the 3' untranslated region of mRNA encoded by MGC13071, corresponding to a target binding site such as BINDING SITE I, BINDING SITE II or BINDING SITE III of FIG. 8. Table 4 illustrates the complementarity of the nucleotide sequences of MGC13071 BINDING SITE, designated SEQ ID:12254, to the nucleotide sequence of GAM139 RNA, herein designated GAM RNA, also designated SEQ ID:327.

Another function of GAM139 is therefore inhibition of MGC13071 (Accession NP_116078.2). Accordingly, utilities of GAM139 include diagnosis, prevention and treatment of diseases and clinical conditions associated with MGC13071.

MGC15396 (Accession NP_443087.1) is another GAM139 target gene, herein designated TARGET GENE. MGC15396 BINDING SITE is a target binding site found in the 3' untranslated region of mRNA encoded by MGC15396, corresponding to a target binding site such as BINDING SITE I, BINDING SITE II or BINDING SITE III of FIG. 8. Table 4 illustrates the complementarity of the nucleotide sequences of MGC15396 BINDING SITE, designated SEQ ID:11393, to the nucleotide sequence of GAM139 RNA, herein designated GAM RNA, also designated SEQ ID:327.

Another function of GAM139 is therefore inhibition of MGC15396 (Accession NP_443087.1). Accordingly, utilities of GAM139 include diagnosis, prevention and treatment of diseases and clinical conditions associated with MGC15396.

MGC16142 (Accession NP_116152.1) is another GAM139 target gene, herein designated TARGET GENE. MGC16142 BINDING SITE is a target binding site found in the 3' untranslated region of mRNA encoded by MGC16142, corresponding to a target binding site such as BINDING SITE I, BINDING SITE II or BINDING SITE III of FIG. 8. Table 4 illustrates the complementarity of the nucleotide sequences of MGC16142 BINDING SITE, designated SEQ ID:6403, to the nucleotide sequence of GAM139 RNA, herein designated GAM RNA, also designated SEQ ID:327.

Another function of GAM139 is therefore inhibition of MGC16142 (Accession NP_116152.1). Accordingly, utilities of GAM139 include diagnosis, prevention and treatment of diseases and clinical conditions associated with MGC16142.

MGC16638 (Accession NP_777593.1) is another GAM139 target gene, herein designated TARGET GENE. MGC16638 BINDING SITE is a target binding site found in the 5' untranslated region of mRNA encoded by MGC16638, corresponding to a target binding site such as BINDING SITE I, BINDING SITE II or BINDING SITE III of FIG. 8. Table 4 illustrates the complementarity of the nucleotide sequences of MGC16638 BINDING SITE, designated SEQ ID:18557, to the nucleotide sequence of GAM139 RNA, herein designated GAM RNA, also designated SEQ ID:327.

Another function of GAM139 is therefore inhibition of MGC16638 (Accession NP_777593.1). Accordingly, utilities of GAM139 include diagnosis, prevention and treatment of diseases and clinical conditions associated with MGC16638.

MGC17330 (Accession NP_443112.1) is another GAM139 target gene, herein designated TARGET GENE. MGC17330 BINDING SITE is a target binding site found in the 3' untranslated region of mRNA encoded by MGC17330, corresponding to a target binding site such as BINDING SITE I, BINDING SITE II or BINDING SITE III of FIG. 8. Table 4 illustrates the complementarity of the nucleotide sequences of MGC17330 BINDING SITE, designated SEQ ID:13961, to the nucleotide sequence of GAM139 RNA, herein designated GAM RNA, also designated SEQ ID:327.

Another function of GAM139 is therefore inhibition of MGC17330 (Accession NP_443112.1). Accordingly, utilities of GAM139 include diagnosis, prevention and treatment of diseases and clinical conditions associated with MGC17330.

MGC24995 (Accession NP_714914.1) is another GAM139 target gene, herein designated TARGET GENE. MGC24995 BINDING SITE1 and MGC24995 BINDING SITE2 are target binding sites found in untranslated regions of mRNA encoded by MGC24995, corresponding to target binding sites such as BINDING SITE I, BINDING SITE II or BINDING SITE III of FIG. 8. Table 4 illustrates the complementarity of the nucleotide sequences of MGC24995 BINDING SITE1 and MGC24995 BINDING SITE2, designated SEQ ID:16446 and SEQ ID:2593 respectively, to the nucleotide sequence of GAM139 RNA, herein designated GAM RNA, also designated SEQ ID:327.

Another function of GAM139 is therefore inhibition of MGC24995 (Accession NP_714914.1). Accordingly, utilities of GAM139 include diagnosis, prevention and treatment of diseases and clinical conditions associated with MGC24995.

MGC30156 (Accession NP_689852.1) is another GAM139 target gene, herein designated TARGET GENE. MGC30156 BINDING SITE is a target binding site found in the 3' untranslated region of mRNA encoded by MGC30156, corresponding to a target binding site such as BINDING SITE I, BINDING SITE II or BINDING SITE III of FIG. 8. Table 4 illustrates the complementarity of the nucleotide sequences of MGC30156 BINDING SITE, designated SEQ ID:14918, to the nucleotide sequence of GAM139 RNA, herein designated GAM RNA, also designated SEQ ID:327.

Another function of GAM139 is therefore inhibition of MGC30156 (Accession NP_689852.1). Accordingly, utilities of GAM139 include diagnosis, prevention and treatment of diseases and clinical conditions associated with MGC30156.

MGC3222 (Accession NP_077310.1) is another GAM139 target gene, herein designated TARGET GENE. MGC3222 BINDING SITE is a target binding site found in the 3' untranslated region of mRNA encoded by MGC3222, corresponding to a target binding site such as BINDING SITE I, BINDING SITE II or BINDING SITE III of FIG. 8. Table 4 illustrates the complementarity of the nucleotide sequences of MGC3222 BINDING SITE, designated SEQ ID:3878, to the nucleotide sequence of GAM139 RNA, herein designated GAM RNA, also designated SEQ ID:327.

Another function of GAM139 is therefore inhibition of MGC3222 (Accession NP_077310.1). Accordingly, utilities of GAM139 include diagnosis, prevention and treatment of diseases and clinical conditions associated with MGC3222.

MGC3248 (Accession NP_115875.1) is another GAM139 target gene, herein designated TARGET GENE. MGC3248 BINDING SITE is a target binding site found in the 3' untranslated region of mRNA encoded by MGC3248, corresponding to a target binding site such as BINDING SITE I, BINDING SITE II or BINDING SITE III of FIG. 8. Table 4 illustrates the complementarity of the nucleotide sequences of MGC3248 BINDING SITE, designated SEQ ID:10750, to the nucleotide sequence of GAM139 RNA, herein designated GAM RNA, also designated SEQ ID:327.

Another function of GAM139 is therefore inhibition of MGC3248 (Accession NP_115875.1). Accordingly, utilities of GAM139 include diagnosis, prevention and treatment of diseases and clinical conditions associated with MGC3248.

MGC35023 (Accession NP_787073.1) is another GAM139 target gene, herein designated TARGET GENE. MGC35023 BINDING SITE is a target binding site found in the 3' untranslated region of multiple transcripts of mRNA encoded by MGC35023, corresponding to a target binding site such as BINDING SITE I, BINDING SITE II or BINDING SITE III of FIG. 8. Table 4 illustrates the complementarity of the nucleotide sequences of MGC35023 BINDING SITE, designated SEQ ID:16655, to the nucleotide sequence of GAM139 RNA, herein designated GAM RNA, also designated SEQ ID:327.

Another function of GAM139 is therefore inhibition of MGC35023 (Accession NP_787073.1). Accordingly, utilities of GAM139 include diagnosis, prevention and treatment of diseases and clinical conditions associated with MGC35023.

MGC35023 (Accession XP_086685.1) is another GAM139 target gene, herein designated TARGET GENE. MGC35023 BINDING SITE is a target binding site found in the 3' untranslated region of multiple transcripts of mRNA encoded by MGC35023, corresponding to a target binding site such as BINDING SITE I, BINDING SITE II or BINDING SITE III of FIG. 8. Table 4 illustrates the complementarity of the nucleotide sequences of MGC35023 BINDING SITE, designated SEQ ID:16655, to the nucleotide sequence of GAM139 RNA, herein designated GAM RNA, also designated SEQ ID:327.

Another function of GAM139 is therefore inhibition of MGC35023 (Accession XP_086685.1). Accordingly, utilities of GAM139 include diagnosis, prevention and treatment of diseases and clinical conditions associated with MGC35023.

MGC39520 (Accession NP_699195.1) is another GAM139 target gene, herein designated TARGET GENE. MGC39520 BINDING SITE is a target binding site found in the 5' untranslated region of mRNA encoded by MGC39520, corresponding to a target binding site such as BINDING SITE I, BINDING SITE II or BINDING SITE III of FIG. 8. Table 4 illustrates the complementarity of the nucleotide sequences of MGC39520 BINDING SITE, designated SEQ ID:7717, to the nucleotide sequence of GAM139 RNA, herein designated GAM RNA, also designated SEQ ID:327.

Another function of GAM139 is therefore inhibition of MGC39520 (Accession NP_699195.1). Accordingly, utilities of GAM139 include diagnosis, prevention and treatment of diseases and clinical conditions associated with MGC39520.

MGC4504 (Accession NP_077016.1) is another GAM139 target gene, herein designated TARGET GENE. MGC4504 BINDING SITE is a target binding site found in the 3' untranslated region of mRNA encoded by MGC4504, corresponding to a target binding site such as BINDING SITE I, BINDING SITE II or BINDING SITE III of FIG. 8. Table 4 illustrates the complementarity of the nucleotide sequences of MGC4504 BINDING SITE, designated SEQ ID:10242, to the nucleotide sequence of GAM139 RNA, herein designated GAM RNA, also designated SEQ ID:327.

Another function of GAM139 is therefore inhibition of MGC4504 (Accession NP_077016.1). Accordingly, utilities of GAM139 include diagnosis, prevention and treatment of diseases and clinical conditions associated with MGC4504.

MGC48986 (Accession NP_787077.1) is another GAM139 target gene, herein designated TARGET GENE. MGC48986 BINDING SITE is a target binding site found in the 5' untranslated region of mRNA encoded by MGC48986, corresponding to a target binding site such as BINDING SITE I, BINDING SITE II or BINDING SITE III of FIG. 8. Table 4 illustrates the complementarity of the nucleotide sequences of MGC48986 BINDING SITE, designated SEQ ID:11203, to the nucleotide sequence of GAM139 RNA, herein designated GAM RNA, also designated SEQ ID:327.

Another function of GAM139 is therefore inhibition of MGC48986 (Accession NP_787077.1). Accordingly, utilities of GAM139 include diagnosis, prevention and treatment of diseases and clinical conditions associated with MGC48986.

MGRN1 (Accession XP_048119.4) is another GAM139 target gene, herein designated TARGET GENE. MGRN1 BINDING SITE is a target binding site found in the 3' untranslated region of mRNA encoded by MGRN1, corresponding to a target binding site such as BINDING SITE I, BINDING SITE II or BINDING SITE III of FIG. 8. Table 4 illustrates the complementarity of the nucleotide sequences of MGRN1 BINDING SITE, designated SEQ ID:14631, to the nucleotide sequence of GAM139 RNA, herein designated GAM RNA, also designated SEQ ID:327.

Another function of GAM139 is therefore inhibition of MGRN1 (Accession XP_048119.4). Accordingly, utilities of GAM139 include diagnosis, prevention and treatment of diseases and clinical conditions associated with MGRN1.

Membrane metallo-endopeptidase (neutral endopeptidase, enkephalinase, calla, cd10) (MME, Accession NP_009220.1) is another GAM139 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:2426, to the nucleotide sequence of GAM139 RNA, herein designated GAM RNA, also designated SEQ ID:327.

Another function of GAM139 is therefore inhibition of Membrane metallo-endopeptidase (neutral endopeptidase, enkephalinase, calla, cd10) (MME, Accession NP_009220.1), a gene which is thermolysin-like specificity. and therefore is associated with Acute lymphocytic leukemia. Accordingly, utilities of GAM139 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_000893.1) is another GAM139 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:2426, to the nucleotide sequence of GAM139 RNA, herein designated GAM RNA, also designated SEQ ID:327.

Another function of GAM139 is therefore inhibition of Membrane metallo-endopeptidase (neutral endopeptidase, enkephalinase, calla, cd10) (MME, Accession NP_000893.1), a gene which is thermolysin-like specificity. and therefore is associated with Acute lymphocytic leukemia. Accordingly, utilities of GAM139 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_009218.1) is another GAM139 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:2426, to the nucleotide sequence of GAM139 RNA, herein designated GAM RNA, also designated SEQ ID:327.

Another function of GAM139 is therefore inhibition of Membrane metallo-endopeptidase (neutral endopeptidase, enkephalinase, calla, cd10) (MME, Accession NP_009218.1), a gene which is thermolysin-like specificity. and therefore is associated with Acute lymphocytic leukemia. Accordingly, utilities of GAM139 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_009219.1) is another GAM139 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:2426, to the nucleotide sequence of GAM139 RNA, herein designated GAM RNA, also designated SEQ ID:327.

Another function of GAM139 is therefore inhibition of Membrane metallo-endopeptidase (neutral endopeptidase, enkephalinase, calla, cd10) (MME, Accession NP_009219.1), a gene which is thermolysin-like specificity. and therefore is associated with Acute lymphocytic leukemia. Accordingly, utilities of GAM139 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Max binding protein (MNT, Accession NP_064706.1) is another GAM139 target gene, herein designated TARGET GENE. MNT BINDING SITE is a target binding site found in the 3' untranslated region of mRNA encoded by MNT, corresponding to a target binding site such as BINDING SITE I, BINDING SITE II or BINDING SITE III of FIG. 8. Table 4 illustrates the complementarity of the nucleotide sequences of MNT BINDING SITE, designated SEQ ID:2618, to the nucleotide sequence of GAM139 RNA, herein designated GAM RNA, also designated SEQ ID:327.

Another function of GAM139 is therefore inhibition of Max binding protein (MNT, Accession NP_064706.1). Accordingly, utilities of GAM139 include diagnosis, prevention and treatment of diseases and clinical conditions associated with MNT.

MOST2 (Accession NP_064635.1) is another GAM139 target gene, herein designated TARGET GENE. MOST2 BINDING SITE is a target binding site found in the 5' untranslated region of mRNA encoded by MOST2, corresponding to a target binding site such as BINDING SITE I, BINDING SITE II or BINDING SITE III of FIG. 8. Table 4 illustrates the complementarity of the nucleotide sequences of MOST2 BINDING SITE, designated SEQ ID:4257, to the nucleotide sequence of GAM139 RNA, herein designated GAM RNA, also designated SEQ ID:327.

Another function of GAM139 is therefore inhibition of MOST2 (Accession NP_064635.1). Accordingly, utilities of GAM139 include diagnosis, prevention and treatment of diseases and clinical conditions associated with MOST2.

Membrane protein, palmitoylated 2 (maguk p55 subfamily member 2) (MPP2, Accession NP_005365.2) is another GAM139 target gene, herein designated TARGET GENE. MPP2 BINDING SITE is a target binding site found in the 3' untranslated region of mRNA encoded by MPP2, corresponding to a target binding site such as BINDING SITE I, BINDING SITE II or BINDING SITE III of FIG. 8. Table 4 illustrates the complementarity of the nucleotide sequences of MPP2 BINDING SITE, designated SEQ ID:5243, to the nucleotide sequence of GAM139 RNA, herein designated GAM RNA, also designated SEQ ID:327.

Another function of GAM139 is therefore inhibition of Membrane protein, palmitoylated 2 (maguk p55 subfamily member 2) (MPP2, Accession NP_005365.2). Accordingly, utilities of GAM139 include diagnosis, prevention and treatment of diseases and clinical conditions associated with MPP2.

MSP (Accession NP_114435.1) is another GAM139 target gene, herein designated TARGET GENE. MSP BINDING SITE is a target binding site found in the 3' untranslated region of mRNA encoded by MSP, corresponding to a target binding site such as BINDING SITE I, BINDING SITE II or BINDING SITE III of FIG. 8. Table 4 illustrates the complementarity of the nucleotide sequences of MSP BINDING SITE, designated SEQ ID:13067, to the nucleotide sequence of GAM139 RNA, herein designated GAM RNA, also designated SEQ ID:327.

Another function of GAM139 is therefore inhibition of MSP (Accession NP_114435.1). Accordingly, utilities of GAM139 include diagnosis, prevention and treatment of diseases and clinical conditions associated with MSP.

Mucin and cadherin-like (MUCDHL, Accession NP_112555.1) is another GAM139 target gene, herein designated TARGET GENE. MUCDHL BINDING SITE1 and MUCDHL BINDING SITE2 are target binding sites found in untranslated regions of multiple transcripts of mRNA encoded by MUCDHL, corresponding to target binding sites such as BINDING SITE I, BINDING SITE II or BINDING SITE III of FIG. 8. Table 4 illustrates the complementarity of the nucleotide sequences of MUCDHL BINDING SITE1 and MUCDHL BINDING SITE2, designated SEQ ID:1008 and SEQ ID:8074 respectively, to the nucleotide sequence of GAM139 RNA, herein designated GAM RNA, also designated SEQ ID:327.

Another function of GAM139 is therefore inhibition of Mucin and cadherin-like (MUCDHL, Accession NP_112555.1). Accordingly, utilities of GAM139 include diagnosis, prevention and treatment of diseases and clinical conditions associated with MUCDHL.

Myeloid differentiation primary response gene (88) (MYD88, Accession NP_002459.1) is another GAM139 target gene, herein designated TARGET GENE. MYD88 BINDING SITE is a target binding site found in the 3' untranslated region of mRNA encoded by MYD88, corresponding to a target binding site such as BINDING SITE I, BINDING SITE II or BINDING SITE III of FIG. 8. Table 4 illustrates the complementarity of the nucleotide sequences of MYD88 BINDING SITE, designated SEQ ID:13413, to the nucleotide sequence of GAM139 RNA, herein designated GAM RNA, also designated SEQ ID:327.

Another function of GAM139 is therefore inhibition of Myeloid differentiation primary response gene (88) (MYD88, Accession NP_002459.1), a gene which is involved in the toll-like receptor and il-1 receptor signaling pathway in the innate immune response. Accordingly, utilities of GAM139 include diagnosis, prevention and treatment of diseases and clinical conditions associated with MYD88.

The function of MYD88 has been established by previous studies. The myeloid differentiation (MyD) marker MyD88 was first characterized during a study of the early genetic responses of murine myeloid cells to various differentiation and growth inhibitory stimuli (Lord et al., 1990). Myeloid differentiation primary response genes are activated in M1 myeloleukemic cells in response to interleukin-6 (IL6; 147620), which induces both growth arrest and terminal differentiation. Hardiman et al. (1997) described the cloning and gene structure of the mouse MyD88 gene. The complete coding sequence spans 5 exons, with the first exon encoding a complete 'death domain' similar to the intracellular segment of TNF receptor-1 (OMIM Ref. No. 191190). Zoo blot analysis demonstrated that it is an evolutionarily conserved gene. Northern blot analysis revealed widespread expression of the gene in many adult mouse tissues, and RT-PCR detected MyD88 mRNA in T- and B-cell lines and differentiating embryonic stem cells. The broad expression pattern demonstrated that mouse Myd88 expression is not restricted to cells of myeloid lineage as was originally believed.

Animal model experiments lend further support to the function of MYD88. Adachi et al. (1998) observed that mice with a targeted disruption of the Myd88 gene were unable to respond to IL1 (e.g., 147760), as determined by defective T-cell proliferation and the production of cytokines. Likewise, Myd88-deficient mice were unable to produce gamma-interferon (IFNG; 147570) and mediate natural killer cell activity in response to IL18 (OMIM Ref. No. 600953). NFKB activation in response to IL1 or IL18 was also impaired. These results indicated that MYD88 is a critical component in the IL1R and IL18R (OMIM Ref. No. 604494) signaling cascades. Kawai et al. (1999) extended these studies to show that responses to lipopolysaccharide, mediated by TLR4 and CD14 (OMIM Ref. No. 158120), were lost or delayed in Myd88-deficient mice, establishing that MYD88 is part of the TLR signaling cascade as well, acting just upstream of IRAK.

It is appreciated that the abovementioned animal model for MYD88 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Adachi, O.; Kawai, T.; Takeda, K.; Matsumoto, M.; Tsutsui, H.; Sakagami, M.; Nakanishi, K.; Akira, S.: Targeted disruption of the MyD88 gene results in loss of IL-1- and IL-18-mediated function. Immunity 143-150, 1998; and Hardiman, G.; Jenkins, N. A.; Copeland, N. G.; Gilbert, D. J.; Garcia, D. K.; Naylor, S. L.; Kastelein, R. A.; Bazan, J. F.: Genetic structure and chromosomal mapping of MyD88. Genomics.

Further studies establishing the function and utilities of MYD88 are found in John Hopkins OMIM database record ID 602170, and in cited publications listed in Table 5, which are hereby incorporated by reference. NESH (Accession NP_057512.1) is another GAM139 target gene, herein designated TARGET GENE. NESH BINDING SITE is a target binding site found in the 3' untranslated region of mRNA encoded by NESH, corresponding to a target binding site such as BINDING SITE I, BINDING SITE II or BINDING SITE III of FIG. 8. Table 4 illustrates the complementarity of the nucleotide sequences of NESH BINDING SITE, designated SEQ ID:6776, to the nucleotide sequence of GAM139 RNA, herein designated GAM RNA, also designated SEQ ID:327.

Another function of GAM139 is therefore inhibition of NESH (Accession NP_057512.1), a gene which plays a role in cell growth signalling. Accordingly, utilities of GAM139 include diagnosis, prevention and treatment of diseases and clinical conditions associated with NESH.

The function of NESH has been established by previous studies. By screening a hepatocellular cDNA library using PCR with degenerate primers corresponding to p53 (OMIM Ref. No. 191170)/p73 (OMIM Ref. No. 601990) exon domains, followed by probing a placenta cDNA library, Miyazaki et al. (2000) obtained a cDNA encoding an SH3-containing protein they designated NESH (new molecule including SH3). SH3 domains contain about 50 amino acids that bind to proline-rich sequences and often play a role in cell growth signalling. Sequence analysis predicted that the 366-amino acid NESH protein, which is most homologous to SSH3BP1 (OMIM Ref. No. 603050), has a central serine-rich region followed by a proline-rich region and a C-terminal SH3 domain. RT-PCR analysis detected variable expression of NESH in all tissues tested. Miyazaki et al. (2000) suggested that the similarity of NESH to SSH3BP1, an EPS8 (OMIM Ref. No. 600206)-binding protein, indicates that its SH3 domain may interact with other proteins in signal transduction. GENE FUNCTION Using the yeast 2-hybrid system, Matsuda et al. (2001) identified TARSH (OMIM Ref. No. 606279) as a binding partner of NESH.

Full details of the abovementioned studies are described in the following publications, the disclosure of which are hereby incorporated by reference:

Matsuda, S.; Iriyama, C.; Yokozaki, S.; Ichigotani, Y.; Shirafuji, N.; Yamaki, K.; Hayakawa, T.; Hamaguchi, M.: Cloning and sequencing of a novel human gene that encodes a putative target protein of Nesh-SH3. J. Hum. Genet. 46:483-486, 2001; and Miyazaki, K.; Matsuda, S.; Ichigotani, Y.; Takenouchi, Y.; Hayashi, K.; Fukuda, Y.; Nimura, Y.; Hamaguchi, M.: Isolation and characterization of a novel human gene (NESH) which encode.

Further studies establishing the function and utilities of NESH are found in John Hopkins OMIM database record ID 606363, and in cited publications listed in Table 5, which are hereby incorporated by reference. Nfs1 nitrogen fixation 1 (s. cerevisiae) (NFS1, Accession NP_066923.2) is another GAM139 target gene, herein designated TARGET GENE. NFS1 BINDING SITE is a target binding site found in the 3' untranslated region of mRNA encoded by NFS1, corresponding to a target binding site such as BINDING SITE I, BINDING SITE II or BINDING SITE III of FIG. 8. Table 4 illustrates the complementarity of the nucleotide sequences of NFS1 BINDING SITE, designated SEQ ID:14605, to the nucleotide sequence of GAM139 RNA, herein designated GAM RNA, also designated SEQ ID:327.

Another function of GAM139 is therefore inhibition of Nfs1 nitrogen fixation 1 (s. cerevisiae) (NFS1, Accession NP_066923.2). Accordingly, utilities of GAM139 include diagnosis, prevention and treatment of diseases and clinical conditions associated with NFS1.

Nipsnap homolog 1 (c. elegans) (NIPSNAP1, Accession NP_003625.1) is another GAM139 target gene, herein designated TARGET GENE. NIPSNAP1 BINDING SITE is a target binding site found in the 3' untranslated region of mRNA encoded by NIPSNAP1, corresponding to a target binding site such as BINDING SITE I, BINDING SITE II or BINDING SITE III of FIG. 8. Table 4 illustrates the complementarity of the nucleotide sequences of NIPSNAP1 BINDING SITE, designated SEQ ID:16274, to the nucleotide sequence of GAM139 RNA, herein designated GAM RNA, also designated SEQ ID:327.

Another function of GAM139 is therefore inhibition of Nipsnap homolog 1 (c. elegans) (NIPSNAP1, Accession NP_003625.1). Accordingly, utilities of GAM139 include diagnosis, prevention and treatment of diseases and clinical conditions associated with NIPSNAP1.

Aminopeptidase-like 1 (NPEPL1, Accession NP_078939.2) is another GAM139 target gene, herein designated TARGET GENE. NPEPL1 BINDING SITE1 and NPEPL1 BINDING SITE2 are target binding sites found in untranslated regions of mRNA encoded by NPEPL1, corresponding to target binding sites such as BINDING SITE I, BINDING SITE II or BINDING SITE III of FIG. 8. Table 4 illustrates the complementarity of the nucleotide sequences of NPEPL1 BINDING SITE1 and NPEPL1 BINDING SITE2, designated SEQ ID:7568 and SEQ ID:2446 respectively, to the nucleotide sequence of GAM139 RNA, herein designated GAM RNA, also designated SEQ ID:327.

Another function of GAM139 is therefore inhibition of Aminopeptidase-like 1 (NPEPL1, Accession NP_078939.2). Accordingly, utilities of GAM139 include diagnosis, prevention and treatment of diseases and clinical conditions associated with NPEPL1.

Aminopeptidase puromycin sensitive (NPEPPS, Accession NP_006301.2) is another GAM139 target gene, herein designated TARGET GENE. NPEPPS BINDING SITE is a target binding site found in the 3' untranslated region of mRNA encoded by NPEPPS, corresponding to a target binding site such as BINDING SITE I, BINDING SITE II or BINDING SITE III of FIG. 8. Table 4 illustrates the complementarity of the nucleotide sequences of NPEPPS BINDING SITE, designated SEQ ID:2285, to the nucleotide sequence of GAM139 RNA, herein designated GAM RNA, also designated SEQ ID:327.

Another function of GAM139 is therefore inhibition of Aminopeptidase puromycin sensitive (NPEPPS, Accession NP_006301.2), a gene which is puromycin-sensitive aminopeptidase and has metallopeptidase activity. Accordingly, utilities of GAM139 include diagnosis, prevention and treatment of diseases and clinical conditions associated with NPEPPS.

The function of NPEPPS has been established by previous studies. Tobler et al. (1997) cloned PSA from a human fetal brain cDNA library using the mouse PSA cDNA as probe. They established that translation is initiated at the second of 2 possible start codons, resulting in a deduced 875-amino acid protein with a molecular mass of 99 kD by SDS-PAGE. PSA contains a zinc-binding motif conserved among gluzincin aminopeptidases and shares 98% sequence identity with the mouse protein. Northern blot analysis detected ubiquitous expression of a 4.8-kb transcript, with highest expression in brain. By in situ hybridization of adult human brain sections, expression was localized to the perikaryon of neurons of the cortex and cerebellum. Using immunofluorescence localization of transfected HeLa cells, Tobler et al. (1997) found that PSA localizes to the perinuclear cytoplasm and shows a filamentous staining pattern. Bauer et al. (2001) cloned PSA cDNA from a human skeletal muscle library. Northern blot analysis detected major and minor transcripts of 4.8 and 4.2 kb, respectively. Huber et al. (1999) determined that PSA is identical to the matalloprotease MP100 that was originally isolated as a beta-secretase candidate from human brain by Schonlein et al. (1994). Huber et al. (1999) were able to colocalize and coimmunoprecipitate PSA with beta- amyloid precursor protein (OMIM Ref. No. 104760); however, PSA did not increase production of the amyloid-beta peptide in cotransfected cells. By RT-PCR, but not by Northern blot analysis, Bauer et al. (2001) found that PSA was upregulated in human leukemic cells following vitamin D stimulation.

Full details of the abovementioned studies are described in the following publications, the disclosure of which are hereby incorporated by reference:

Huber, G.; Thompson, A.; Gruninger, F.; Mechler, H.; Hochstrasser, R.; Hauri, H.- P.; Malherbe, P.: cDNA cloning and molecular characterization of human brain metalloprotease MP100: a beta-secretase candidate? J. Neurochem. 72:1215-1223, 1999; and Tobler, A. R.; Constam, D. B.; Schmitt-Graff, A.; Malipiero, U.; Schlapbach, R.; Fontana, A.: Cloning of the human puromycin-sensitive aminopeptidase and evidence for expression in neu.

Further studies establishing the function and utilities of NPEPPS are found in John Hopkins OMIM database record ID 606793, and in cited publications listed in Table 5, which are hereby incorporated by reference. Nucleoporin 133 kda (NUP133, Accession NP_060700.2) is another GAM139 target gene, herein designated TARGET GENE. NUP133 BINDING SITE is a target binding site found in the 3' untranslated region of mRNA encoded by NUP133, corresponding to a target binding site such as BINDING SITE I, BINDING SITE II or BINDING SITE III of FIG. 8. Table 4 illustrates the complementarity of the nucleotide sequences of NUP133 BINDING SITE, designated SEQ ID:2638, to the nucleotide sequence of GAM139 RNA, herein designated GAM RNA, also designated SEQ ID:327.

Another function of GAM139 is therefore inhibition of Nucleoporin 133 kda (NUP133, Accession NP_060700.2). Accordingly, utilities of GAM139 include diagnosis, prevention and treatment of diseases and clinical conditions associated with NUP133.

Opioid receptor, delta 1 (OPRD1, Accession NP_000902.2) is another GAM139 target gene, herein designated TARGET GENE. OPRD1 BINDING SITE is a target binding site found in the 5' untranslated region of mRNA encoded by OPRD1, corresponding to a target binding site such as BINDING SITE I, BINDING SITE II or BINDING SITE III of FIG. 8. Table 4 illustrates the complementarity of the nucleotide sequences of OPRD1 BINDING SITE, designated SEQ ID:15006, to the nucleotide sequence of GAM139 RNA, herein designated GAM RNA, also designated SEQ ID:327.

Another function of GAM139 is therefore inhibition of Opioid receptor, delta 1 (OPRD1, Accession NP_000902.2), a gene which inhibits neurotransmitter release by reducing calcium ion currents and increasing potassium ion conductance. Accordingly, utilities of GAM139 include diagnosis, prevention and treatment of diseases and clinical conditions associated with OPRD1.

The function of OPRD1 has been established by previous studies. Bzdega et al. (1993) cloned the delta opiate receptor gene from a mouse neuroblastoma-rat glioma hybrid cell line. The clone they isolated was apparently identical to those reported by others (e.g., Evans et al., 1992). They found full-length transcripts of the gene in mouse brain but in no other tissues examined. Within the brain the gene was expressed at low levels in many regions, but transcripts were found in particularly large amounts in the anterior pituitary and pineal glands. Since these tissues are located outside the blood-brain barrier, opioid peptides easily can reach receptors in these areas from the blood. The gene, which was present in single copy and was symbolized Nbor for 'neuroblastoma opiate receptor,' was mapped to the distal region of mouse chromosome 4 by linkage studies. It was found to lie between Lck and Gnb-1. The human homologs of these 2 genes, LCK (OMIM Ref. No. 153390) and GNB1 (OMIM Ref. No. 139380), are located on human chromosome 1p; thus, the human gene for delta-opiate receptor is probably in this region. (GNB1 is mapped to 1pter-p31.2; LCK is mapped to 1p35-p32.) Kaufman et al. (1994) reported linkage relationships of Oprd1 on mouse chromosome 4 and stated that the human homolog had been mapped to 1p by in situ hybridization. Befort et al. (1994) assigned the OPRD1 gene to 1p36.1-p34.3 by isotopic in situ hybridization and the homologous gene to mouse chromosome 4 by the same method.

Animal model experiments lend further support to the function of OPRD1. Filliol et al. (2000) generated Oprd1-deficient mice and compared the behavioral responses of mice lacking Oprd1, Oprm, and Oprk1 in several models of anxiety and depression. Their data showed no detectable phenotype in Oprk1 -/- mutants, suggesting that kappa-receptors do not have a role in this aspect of opioid function. Opposing phenotypes in Oprm -/- and Oprd1 -/- mutants contrasted with the classic notion of similar activities of mu- and delta-receptors. Anxiogenic- and depressive-like responses in Oprd1 -/- mice indicated that delta-receptor activity contributes to improvement of mood states. Filliol et al. (2000) concluded that the Oprd1-encoded receptor, which has been proposed to be a promising target for the clinical management of pain, should also be considered in the treatment of drug addiction and other mood-related disorders.

It is appreciated that the abovementioned animal model for OPRD1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bzdega, T.; Chin, H.; Kim, H.; Jung, H. H.; Kozak, C. A.; Klee, W. A.: Regional expression and chromosomal localization of the delta opiate receptor gene. Proc. Nat. Acad. Sci. 90:9305-9309, 1993; and Filliol, D.; Ghozland, S.; Chluba, J.; Martin, M.; Matthes, H. W. D.; Simonin, F.; Befort, K.; Gaveriaux-Ruff, C.; Dierich, A.; LeMeur, M.; Valverde, O.; Maldonado, R.; Kieffer, B. L..

Further studies establishing the function and utilities of OPRD1 are found in John Hopkins OMIM database record ID 165195, and in cited publications listed in Table 5, which are hereby incorporated by reference. P5326 (Accession NP_113638.1) is another GAM139 target gene, herein designated TARGET GENE. P5326 BINDING SITE is a target binding site found in the 3' untranslated region of mRNA encoded by P5326, corresponding to a target binding site such as BINDING SITE I, BINDING SITE II or BINDING SITE III of FIG. 8. Table 4 illustrates the complementarity of the nucleotide sequences of P5326 BINDING SITE, designated SEQ ID:20183, to the nucleotide sequence of GAM139 RNA, herein designated GAM RNA, also designated SEQ ID:327.

Another function of GAM139 is therefore inhibition of P5326 (Accession NP_113638.1). Accordingly, utilities of GAM139 include diagnosis, prevention and treatment of diseases and clinical conditions associated with P5326.

P21(cdkn1a)-activated kinase 6 (PAK6, Accession NP_064553.1) is another GAM139 target gene, herein designated TARGET GENE. PAK6 BINDING SITE is a target binding site found in the 3' untranslated region of mRNA encoded by PAK6, corresponding to a target binding site such as BINDING SITE I, BINDING SITE II or BINDING SITE III of FIG. 8. Table 4 illustrates the complementarity of the nucleotide sequences of PAK6 BINDING SITE, designated SEQ ID:718, to the nucleotide sequence of GAM139 RNA, herein designated GAM RNA, also designated SEQ ID:327.

Another function of GAM139 is therefore inhibition of P21(cdkn1a)-activated kinase 6 (PAK6, Accession NP_064553.1). Accordingly, utilities of GAM139 include diagnosis, prevention and treatment of diseases and clinical conditions associated with PAK6.

Programmed cell death 1 (PDCD1, Accession NP_005009.1) is another GAM139 target gene, herein designated TARGET GENE. PDCD1 BINDING SITE is a target binding site found in the 3' untranslated region of mRNA encoded by PDCD1, corresponding to a target binding site such as BINDING SITE I, BINDING SITE II or BINDING SITE III of FIG. 8. Table 4 illustrates the complementarity of the nucleotide sequences of PDCD1 BINDING SITE, designated SEQ ID:9612, to the nucleotide sequence of GAM139 RNA, herein designated GAM RNA, also designated SEQ ID:327.

Another function of GAM139 is therefore inhibition of Programmed cell death 1 (PDCD1, Accession NP_005009.1). Accordingly, utilities of GAM139 include diagnosis, prevention and treatment of diseases and clinical conditions associated with PDCD1.

Phosphatidylethanolamine n-methyltransferase (PEMT, Accession NP_009100.2) is another GAM139 target gene, herein designated TARGET GENE. PEMT BINDING SITE is a target binding site found in the 3' untranslated region of multiple transcripts of mRNA encoded by PEMT, corresponding to a target binding site such as BINDING SITE I, BINDING SITE II or BINDING SITE III of FIG. 8. Table 4 illustrates the complementarity of the nucleotide sequences of PEMT BINDING SITE, designated SEQ ID:3100, to the nucleotide sequence of GAM139 RNA, herein designated GAM RNA, also designated SEQ ID:327.

Another function of GAM139 is therefore inhibition of Phosphatidylethanolamine n-methyltransferase (PEMT, Accession NP_009100.2). Accordingly, utilities of GAM139 include diagnosis, prevention and treatment of diseases and clinical conditions associated with PEMT.

Phosphatidylethanolamine n-methyltransferase (PEMT, Accession NP_680478.1) is another GAM139 target gene, herein designated TARGET GENE. PEMT BINDING SITE is a target binding site found in the 3' untranslated region of multiple transcripts of mRNA encoded by PEMT, corresponding to a target binding site such as BINDING SITE I, BINDING SITE II or BINDING SITE III of FIG. 8. Table 4 illustrates the complementarity of the nucleotide sequences of PEMT BINDING SITE, designated SEQ ID:3100, to the nucleotide sequence of GAM139 RNA, herein designated GAM RNA, also designated SEQ ID:327.

Another function of GAM139 is therefore inhibition of Phosphatidylethanolamine n-methyltransferase (PEMT, Accession NP_680478.1). Accordingly, utilities of GAM139 include diagnosis, prevention and treatment of diseases and clinical conditions associated with PEMT.

Phosphatidylethanolamine n-methyltransferase (PEMT, Accession NP_680477.1) is another GAM139 target gene, herein designated TARGET GENE. PEMT BINDING SITE is a target binding site found in the 3' untranslated region of multiple transcripts of mRNA encoded by PEMT, corresponding to a target binding site such as BINDING SITE I, BINDING SITE II or BINDING SITE III of FIG. 8. Table 4 illustrates the complementarity of the nucleotide sequences of PEMT BINDING SITE, designated SEQ ID:3100, to the nucleotide sequence of GAM139 RNA, herein designated GAM RNA, also designated SEQ ID:327.

Another function of GAM139 is therefore inhibition of Phosphatidylethanolamine n-methyltransferase (PEMT, Accession NP_680477.1). Accordingly, utilities of GAM139 include diagnosis, prevention and treatment of diseases and clinical conditions associated with PEMT.

6-phosphogluconolactonase (PGLS, Accession NP_036220.1) is another GAM139 target gene, herein designated TARGET GENE. PGLS BINDING SITE1 and PGLS BINDING SITE2 are target binding sites found in untranslated regions of mRNA encoded by PGLS, corresponding to target binding sites such as BINDING SITE I, BINDING SITE II or BINDING SITE III of FIG. 8. Table 4 illustrates the complementarity of the nucleotide sequences of PGLS BINDING SITE1 and PGLS BINDING SITE2, designated SEQ ID:11405 and SEQ ID:16901 respectively, to the nucleotide sequence of GAM139 RNA, herein designated GAM RNA, also designated SEQ ID:327.

Another function of GAM139 is therefore inhibition of 6-phosphogluconolactonase (PGLS, Accession NP_036220.1). Accordingly, utilities of GAM139 include diagnosis, prevention and treatment of diseases and clinical conditions associated with PGLS.

Putative homeodomain transcription factor 2 (PHTF2, Accession NP_065165.1) is another GAM139 target gene, herein designated TARGET GENE. PHTF2 BINDING SITE is a target binding site found in the 3' untranslated region of mRNA encoded by PHTF2, corresponding to a target binding site such as BINDING SITE I, BINDING SITE II or BINDING SITE III of FIG. 8. Table 4 illustrates the complementarity of the nucleotide sequences of PHTF2 BINDING SITE, designated SEQ ID:13764, to the nucleotide sequence of GAM139 RNA, herein designated GAM RNA, also designated SEQ ID:327.

Another function of GAM139 is therefore inhibition of Putative homeodomain transcription factor 2 (PHTF2, Accession NP_065165.1) . Accordingly, utilities of GAM139 include diagnosis, prevention and treatment of diseases and clinical conditions associated with PHTF2.

Phosphatidylinositol (4,5) bisphosphate 5-phosphatase, a (PIB5PA, Accession NP_055237.1) is another GAM139 target gene, herein designated TARGET GENE. PIB5PA BINDING SITE is a target binding site found in the 3' untranslated region of mRNA encoded by PIB5PA, corresponding to a target binding site such as BINDING SITE I, BINDING SITE II or BINDING SITE III of FIG. 8. Table 4 illustrates the complementarity of the nucleotide sequences of PIB5PA BINDING SITE, designated SEQ ID:19904, to the nucleotide sequence of GAM139 RNA, herein designated GAM RNA, also designated SEQ ID:327.

Another function of GAM139 is therefore inhibition of Phosphatidylinositol (4,5) bisphosphate 5-phosphatase, a (PIB5PA, Accession NP_055237.1). Accordingly, utilities of GAM139 include diagnosis, prevention and treatment of diseases and clinical conditions associated with PIB5PA.

Phosphatidylinositol 4-kinase, catalytic, beta polypeptide (PIK4CB, Accession NP_002642.1) is another GAM139 target gene, herein designated TARGET GENE. PIK4CB BINDING SITE is a target binding site found in the 3' untranslated region of mRNA encoded by PIK4CB, corresponding to a target binding site such as BINDING SITE I, BINDING SITE II or BINDING SITE III of FIG. 8. Table 4 illustrates the complementarity of the nucleotide sequences of PIK4CB BINDING SITE, designated SEQ ID:7503, to the nucleotide sequence of GAM139 RNA, herein designated GAM RNA, also designated SEQ ID:327.

Another function of GAM139 is therefore inhibition of Phosphatidylinositol 4-kinase, catalytic, beta polypeptide (PIK4CB, Accession NP_002642.1), a gene which phosphorylates the 4-OH position of phosphatidyl inositol. Accordingly, utilities of GAM139 include diagnosis, prevention and treatment of diseases and clinical conditions associated with PIK4CB.

The function of PIK4CB has been established by previous studies. By degenerate PCR, library screening, and 5-prime-RACE, Meyers and Cantley (1997) cloned human placenta and heart cDNAs encoding a novel PI 4-kinase, which they called PI4K-beta. The predicted 801-amino acid PI4K-beta protein contains an N-terminal lipid kinase unique domain, which is shared by members of both the PI 3-kinase (e.g., 171834) and PI 4-kinase families, and a C-terminal catalytic domain, which defines this protein as a member of a much larger protein/lipid kinase family. PI4K-beta shares significant amino acid sequence similarity with yeast PIK1. Western blot analysis of mammalian cell lysates using an antibody against PI4K-beta detected a 110-kD protein. Northern blot analysis showed that PI4K-beta is ubiquitously expressed as an approximately 4-kb transcript, with highest expression in heart, pancreas, and skeletal muscle. Biochemical analyses indicated that PI4K-beta is a type III enzyme that is sensitive to wortmannin. Meyers and Cantley (1997) stated that PI4K-beta is likely the wortmannin-sensitive PI 4-kinase described by Nakanishi et al. (1995) that is responsible for regulating the synthesis of agonist-sensitive pools of polyphosphoinositides. Saito et al. (1997) isolated a PI 4-kinase cDNA from a human adult brain cDNA library. The sequence of the cDNA was highly identical to that of the PI4K-beta cDNA (Meyers and Cantley, 1997), and Saito et al. (1997) suggested that they represented alternative products of the same gene. Suzuki et al. (1997) cloned 3 forms of cDNAs encoding human PIK4CB, which they named NPIK for 'novel putative phosphatidylinositol kinase;' 2 of the cDNAs had different 5-prime open reading frame sequences, and the third contained a 45-bp insertion within the coding sequence. The authors suggested that these cDNAs resulted from alternative transcription initiation sites and alternative splicing. By Northern blot analysis, they detected 4.8- and 3.6-kb transcripts whose relative levels varied in different tissues. Using the green fluorescent protein system, they demonstrated that PIK4CB is localized in the cytoplasm.

Full details of the abovementioned studies are described in the following publications, the disclosure of which are hereby incorporated by reference:

Saito, T.; Seki, N.; Ishii, H.; Ohira, M.; Hayashi, A.; Kozuma, S.; Hori, T.: Complementary DNA cloning and chromosomal mapping of a novel phosphatidylinositol kinase gene. DNA Res. 4:301-305, 1997; and Suzuki, K.; Hirano, H.; Okutomi, K.; Suzuki, M.; Kuga, Y.; Fujiwara, T.; Kanemoto, N.; Isono, K.; Horie, M.: Identification and characterization of a novel human phosphatidylinositol 4.

Further studies establishing the function and utilities of PIK4CB are found in John Hopkins OMIM database record ID 602758, and in cited publications listed in Table 5, which are hereby incorporated by reference. Perilipin (PLIN, Accession NP_002657.1) is another GAM139 target gene, herein designated TARGET GENE. PLIN BINDING SITE is a target binding site found in the 3' untranslated region of mRNA encoded by PLIN, corresponding to a target binding site such as BINDING SITE I, BINDING SITE II or BINDING SITE III of FIG. 8. Table 4 illustrates the complementarity of the nucleotide sequences of PLIN BINDING SITE, designated SEQ ID:5398, to the nucleotide sequence of GAM139 RNA, herein designated GAM RNA, also designated SEQ ID:327.

Another function of GAM139 is therefore inhibition of Perilipin (PLIN, Accession NP_002657.1). Accordingly, utilities of GAM139 include diagnosis, prevention and treatment of diseases and clinical conditions associated with PLIN.

PNPLA1 (Accession NP_775947.1) is another GAM139 target gene, herein designated TARGET GENE. PNPLA1 BINDING SITE is a target binding site found in the 3' untranslated region of mRNA encoded by PNPLA1, corresponding to a target binding site such as BINDING SITE I, BINDING SITE II or BINDING SITE III of FIG. 8. Table 4 illustrates the complementarity of the nucleotide sequences of PNPLA1 BINDING SITE, designated SEQ ID:15703, to the nucleotide sequence of GAM139 RNA, herein designated GAM RNA, also designated SEQ ID:327.

Another function of GAM139 is therefore inhibition of PNPLA1 (Accession NP_775947.1). Accordingly, utilities of GAM139 include diagnosis, prevention and treatment of diseases and clinical conditions associated with PNPLA1.

PP1665 (Accession NP_110419.3) is another GAM139 target gene, herein designated TARGET GENE. PP1665 BINDING SITE is a target binding site found in the 5' untranslated region of mRNA encoded by PP1665, corresponding to a target binding site such as BINDING SITE I, BINDING SITE II or BINDING SITE III of FIG. 8. Table 4 illustrates the complementarity of the nucleotide sequences of PP1665 BINDING SITE, designated SEQ ID:463, to the nucleotide sequence of GAM139 RNA, herein designated GAM RNA, also designated SEQ ID:327.

Another function of GAM139 is therefore inhibition of PP1665 (Accession NP_110419.3). Accordingly, utilities of GAM139 include diagnosis, prevention and treatment of diseases and clinical conditions associated with PP1665.

Peptidylprolyl isomerase (cyclophilin)-like 2 (PPIL2, Accession NP_055152.1) is another GAM139 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:4077, to the nucleotide sequence of GAM139 RNA, herein designated GAM RNA, also designated SEQ ID:327.

Another function of GAM139 is therefore inhibition of Peptidylprolyl isomerase (cyclophilin)-like 2 (PPIL2, Accession NP_055152.1). Accordingly, utilities of GAM139 include diagnosis, prevention and treatment of diseases and clinical conditions associated with PPIL2.

Periplakin (PPL, Accession NP_002696.2) is another GAM139 target gene, herein designated TARGET GENE. PPL BINDING SITE is a target binding site found in the 3' untranslated region of mRNA encoded by PPL, corresponding to a target binding site such as BINDING SITE I, BINDING SITE II or BINDING SITE III of FIG. 8. Table 4 illustrates the complementarity of the nucleotide sequences of PPL BINDING SITE, designated SEQ ID:3926, to the nucleotide sequence of GAM139 RNA, herein designated GAM RNA, also designated SEQ ID:327.

Another function of GAM139 is therefore inhibition of Periplakin (PPL, Accession NP_002696.2). Accordingly, utilities of GAM139 include diagnosis, prevention and treatment of diseases and clinical conditions associated with PPL.

Protein phosphatase 3 (formerly 2b), regulatory subunit b, 19 kda, beta isoform (calcineurin b, type ii) (PPP3R2, Accession NP_671709.1) is another GAM139 target gene, herein designated TARGET GENE. PPP3R2 BINDING SITE is a target binding site found in the 3' untranslated region of mRNA encoded by PPP3R2, corresponding to a target binding site such as BINDING SITE I, BINDING SITE II or BINDING SITE III of FIG. 8. Table 4 illustrates the complementarity of the nucleotide sequences of PPP3R2 BINDING SITE, designated SEQ ID:14639, to the nucleotide sequence of GAM139 RNA, herein designated GAM RNA, also designated SEQ ID:327.

Another function of GAM139 is therefore inhibition of Protein phosphatase 3 (formerly 2b), regulatory subunit b, 19 kda, beta isoform (calcineurin b, type ii) (PPP3R2, Accession NP_671709.1). Accordingly, utilities of GAM139 include diagnosis, prevention and treatment of diseases and clinical conditions associated with PPP3R2.

PRO1580 (Accession NP_060972.2) is another GAM139 target gene, herein designated TARGET GENE. PRO1580 BINDING SITE is a target binding site found in the 5' untranslated region of mRNA encoded by PRO1580, corresponding to a target binding site such as BINDING SITE I, BINDING SITE II or BINDING SITE III of FIG. 8. Table 4 illustrates the complementarity of the nucleotide sequences of PRO1580 BINDING SITE, designated SEQ ID:1379, to the nucleotide sequence of GAM139 RNA, herein designated GAM RNA, also designated SEQ ID:327.

Another function of GAM139 is therefore inhibition of PRO1580 (Accession NP_060972.2). Accordingly, utilities of GAM139 include diagnosis, prevention and treatment of diseases and clinical conditions associated with PRO1580.

Prostein (Accession NP_149093.1) is another GAM139 target gene, herein designated TARGET GENE. Prostein BINDING SITE is a target binding site found in the 3' untranslated region of mRNA encoded by Prostein, corresponding to a target binding site such as BINDING SITE I, BINDING SITE II or BINDING SITE III of FIG. 8. Table 4 illustrates the complementarity of the nucleotide sequences of Prostein BINDING SITE, designated SEQ ID:16057, to the nucleotide sequence of GAM139 RNA, herein designated GAM RNA, also designated SEQ ID:327.

Another function of GAM139 is therefore inhibition of Prostein (Accession NP_149093.1). Accordingly, utilities of GAM139 include diagnosis, prevention and treatment of diseases and clinical conditions associated with Prostein.

Proline-rich gla (g-carboxyglutamic acid) polypeptide 1 (PRRG1, Accession NP_000941.1) is another GAM139 target gene, herein designated TARGET GENE. PRRG1 BINDING SITE is a target binding site found in the 3' untranslated region of mRNA encoded by PRRG1, corresponding to a target binding site such as BINDING SITE I, BINDING SITE II or BINDING SITE III of FIG. 8. Table 4 illustrates the complementarity of the nucleotide sequences of PRRG1 BINDING SITE, designated SEQ ID:18891, to the nucleotide sequence of GAM139 RNA, herein designated GAM RNA, also designated SEQ ID:327.

Another function of GAM139 is therefore inhibition of Proline-rich gla (g-carboxyglutamic acid) polypeptide 1 (PRRG1, Accession NP_000941.1). Accordingly, utilities of GAM139 include diagnosis, prevention and treatment of diseases and clinical conditions associated with PRRG1.

Prostate stem cell antigen (PSCA, Accession NP_005663.1) is another GAM139 target gene, herein designated TARGET GENE. PSCA BINDING SITE1 and PSCA BINDING SITE2 are target binding sites found in untranslated regions of multiple transcripts of mRNA encoded by PSCA, corresponding to target binding sites such as BINDING SITE I, BINDING SITE II or BINDING SITE III of FIG. 8. Table 4 illustrates the complementarity of the nucleotide sequences of PSCA BINDING SITE1 and PSCA BINDING SITE2, designated SEQ ID:3633 and SEQ ID:6007 respectively, to the nucleotide sequence of GAM139 RNA, herein designated GAM RNA, also designated SEQ ID:327.

Another function of GAM139 is therefore inhibition of Prostate stem cell antigen (PSCA, Accession NP_005663.1). Accordingly, utilities of GAM139 include diagnosis, prevention and treatment of diseases and clinical conditions associated with PSCA.

Proline-serine-threonine phosphatase interacting protein 1 (PSTPIP1, Accession NP_003969.2) is another GAM139 target gene, herein designated TARGET GENE. PSTPIP1 BINDING SITE is a target binding site found in the 5' untranslated region of mRNA encoded by PSTPIP1, corresponding to a target binding site such as BINDING SITE I, BINDING SITE II or BINDING SITE III of FIG. 8. Table 4 illustrates the complementarity of the nucleotide sequences of PSTPIP1 BINDING SITE, designated SEQ ID:12408, to the nucleotide sequence of GAM139 RNA, herein designated GAM RNA, also designated SEQ ID:327.

Another function of GAM139 is therefore inhibition of Proline-serine-threonine phosphatase interacting protein 1 (PSTPIP1, Accession NP_003969.2). Accordingly, utilities of GAM139 include diagnosis, prevention and treatment of diseases and clinical conditions associated with PSTPIP1.

Rab11-FIP3 (Accession NP_055515.1) is another GAM139 target gene, herein designated TARGET GENE. Rab11-FIP3 BINDING SITE is a target binding site found in the 3' untranslated region of mRNA encoded by Rab11-FIP3, corresponding to a target binding site such as BINDING SITE I, BINDING SITE II or BINDING SITE III of FIG. 8. Table 4 illustrates the complementarity of the nucleotide sequences of Rab11-FIP3 BINDING SITE, designated SEQ ID:6083, to the nucleotide sequence of GAM139 RNA, herein designated GAM RNA, also designated SEQ ID:327.

Another function of GAM139 is therefore inhibition of Rab11-FIP3 (Accession NP_055515.1). Accordingly, utilities of GAM139 include diagnosis, prevention and treatment of diseases and clinical conditions associated with Rab11-FIP3.

Rab6 interacting protein 1 (RAB6IP1, Accession XP_290550.1) is another GAM139 target gene, herein designated TARGET GENE. RAB6IP1 BINDING SITE is a target binding site found in the 3' untranslated region of mRNA encoded by RAB6IP1, corresponding to a target binding site such as BINDING SITE I, BINDING SITE II or BINDING SITE III of FIG. 8. Table 4 illustrates the complementarity of the nucleotide sequences of RAB6IP1 BINDING SITE, designated SEQ ID:6028, to the nucleotide sequence of GAM139 RNA, herein designated GAM RNA, also designated SEQ ID:327.

Another function of GAM139 is therefore inhibition of Rab6 interacting protein 1 (RAB6IP1, Accession XP_290550.1). Accordingly, utilities of GAM139 include diagnosis, prevention and treatment of diseases and clinical conditions associated with RAB6IP1.

Rab7, member ras oncogene family-like 1 (RAB7L1, Accession NP_003920.1) is another GAM139 target gene, herein designated TARGET GENE. RAB7L1 BINDING SITE is a target binding site found in the 3' untranslated region of mRNA encoded by RAB7L1, corresponding to a target binding site such as BINDING SITE I, BINDING SITE II or BINDING SITE III of FIG. 8. Table 4 illustrates the complementarity of the nucleotide sequences of RAB7L1 BINDING SITE, designated SEQ ID:6106, to the nucleotide sequence of GAM139 RNA, herein designated GAM RNA, also designated SEQ ID:327.

Another function of GAM139 is therefore inhibition of Rab7, member ras oncogene family-like 1 (RAB7L1, Accession NP_003920.1). Accordingly, utilities of GAM139 include diagnosis, prevention and treatment of diseases and clinical conditions associated with RAB7L1.

RHPN2 (Accession NP_149094.2) is another GAM139 target gene, herein designated TARGET GENE. RHPN2 BINDING SITE is a target binding site found in the 3' untranslated region of mRNA encoded by RHPN2, corresponding to a target binding site such as BINDING SITE I, BINDING SITE II or BINDING SITE III of FIG. 8. Table 4 illustrates the complementarity of the nucleotide sequences of RHPN2 BINDING SITE, designated SEQ ID:11438, to the nucleotide sequence of GAM139 RNA, herein designated GAM RNA, also designated SEQ ID:327.

Another function of GAM139 is therefore inhibition of RHPN2 (Accession NP_149094.2). Accordingly, utilities of GAM139 include diagnosis, prevention and treatment of diseases and clinical conditions associated with RHPN2.

RIS1 (Accession NP_056259.1) is another GAM139 target gene, herein designated TARGET GENE. RIS1 BINDING SITE is a target binding site found in the 3' untranslated region of mRNA encoded by RIS1, corresponding to a target binding site such as BINDING SITE I, BINDING SITE II or BINDING SITE III of FIG. 8. Table 4 illustrates the complementarity of the nucleotide sequences of RIS1 BINDING SITE, designated SEQ ID:13282, to the nucleotide sequence of GAM139 RNA, herein designated GAM RNA, also designated SEQ ID:327.

Another function of GAM139 is therefore inhibition of RIS1 (Accession NP_056259.1). Accordingly, utilities of GAM139 include diagnosis, prevention and treatment of diseases and clinical conditions associated with RIS1.

RNF144 (Accession NP_055561.1) is another GAM139 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:1841, to the nucleotide sequence of GAM139 RNA, herein designated GAM RNA, also designated SEQ ID:327.

Another function of GAM139 is therefore inhibition of RNF144 (Accession NP_055561.1). Accordingly, utilities of GAM139 include diagnosis, prevention and treatment of diseases and clinical conditions associated with RNF144.

Ribosomal protein l13 (RPL13, Accession NP_000968.2) is another GAM139 target gene, herein designated TARGET GENE. RPL13 BINDING SITE is a target binding site found in the 3' untranslated region of multiple transcripts of mRNA encoded by RPL13, corresponding to a target binding site such as BINDING SITE I, BINDING SITE II or BINDING SITE III of FIG. 8. Table 4 illustrates the complementarity of the nucleotide sequences of RPL13 BINDING SITE, designated SEQ ID:4471, to the nucleotide sequence of GAM139 RNA, herein designated GAM RNA, also designated SEQ ID:327.

Another function of GAM139 is therefore inhibition of Ribosomal protein l13 (RPL13, Accession NP_000968.2). Accordingly, utilities of GAM139 include diagnosis, prevention and treatment of diseases and clinical conditions associated with RPL13.

Ribosomal protein l13 (RPL13, Accession NP_150254.1) is another GAM139 target gene, herein designated TARGET GENE. RPL13 BINDING SITE is a target binding site found in the 3' untranslated region of multiple transcripts of mRNA encoded by RPL13, corresponding to a target binding site such as BINDING SITE I, BINDING SITE II or BINDING SITE III of FIG. 8. Table 4 illustrates the complementarity of the nucleotide sequences of RPL13 BINDING SITE, designated SEQ ID:4471, to the nucleotide sequence of GAM139 RNA, herein designated GAM RNA, also designated SEQ ID:327.

Another function of GAM139 is therefore inhibition of Ribosomal protein l13 (RPL13, Accession NP_150254.1). Accordingly, utilities of GAM139 include diagnosis, prevention and treatment of diseases and clinical conditions associated with RPL13.

Ribosomal protein s18 (RPS18, Accession NP_072045.1) is another GAM139 target gene, herein designated TARGET GENE. RPS18 BINDING SITE is a target binding site found in the 5' untranslated region of mRNA encoded by RPS18, corresponding to a target binding site such as BINDING SITE I, BINDING SITE II or BINDING SITE III of FIG. 8. Table 4 illustrates the complementarity of the nucleotide sequences of RPS18 BINDING SITE, designated SEQ ID:14400, to the nucleotide sequence of GAM139 RNA, herein designated GAM RNA, also designated SEQ ID:327.

Another function of GAM139 is therefore inhibition of Ribosomal protein s18 (RPS18, Accession NP_072045.1). Accordingly, utilities of GAM139 include diagnosis, prevention and treatment of diseases and clinical conditions associated with RPS18.

Run and fyve domain containing 2 (RUFY2, Accession NP_060457.2) is another GAM139 target gene, herein designated TARGET GENE. RUFY2 BINDING SITE is a target binding site found in the 3' untranslated region of mRNA encoded by RUFY2, corresponding to a target binding site such as BINDING SITE I, BINDING SITE II or BINDING SITE III of FIG. 8. Table 4 illustrates the complementarity of the nucleotide sequences of RUFY2 BINDING SITE, designated SEQ ID:15232, to the nucleotide sequence of GAM139 RNA, herein designated GAM RNA, also designated SEQ ID:327.

Another function of GAM139 is therefore inhibition of Run and fyve domain containing 2 (RUFY2, Accession NP_060457.2). Accordingly, utilities of GAM139 include diagnosis, prevention and treatment of diseases and clinical conditions associated with RUFY2.

Runt-related transcription factor 1 (acute myeloid leukemia 1; aml1 oncogene) (RUNX1, Accession NP_001745.2) is another GAM139 target gene, herein designated TARGET GENE. RUNX1 BINDING SITE is a target binding site found in the 3' untranslated region of mRNA encoded by RUNX1, corresponding to a target binding site such as BINDING SITE I, BINDING SITE II or BINDING SITE III of FIG. 8. Table 4 illustrates the complementarity of the nucleotide sequences of RUNX1 BINDING SITE, designated SEQ ID:16964, to the nucleotide sequence of GAM139 RNA, herein designated GAM RNA, also designated SEQ ID:327.

Another function of GAM139 is therefore inhibition of Runt-related transcription factor 1 (acute myeloid leukemia 1; aml1 oncogene) (RUNX1, Accession NP_001745.2). Accordingly, utilities of GAM139 include diagnosis, prevention and treatment of diseases and clinical conditions associated with RUNX1.

Seryl-trna synthetase 2 (SARS2, Accession NP_060297.1) is another GAM139 target gene, herein designated TARGET GENE. SARS2 BINDING SITE is a target binding site found in the 3' untranslated region of mRNA encoded by SARS2, corresponding to a target binding site such as BINDING SITE I, BINDING SITE II or BINDING SITE III of FIG. 8. Table 4 illustrates the complementarity of the nucleotide sequences of SARS2 BINDING SITE, designated SEQ ID:10983, to the nucleotide sequence of GAM139 RNA, herein designated GAM RNA, also designated SEQ ID:327.

Another function of GAM139 is therefore inhibition of Seryl-trna synthetase 2 (SARS2, Accession NP_060297.1). Accordingly, utilities of GAM139 include diagnosis, prevention and treatment of diseases and clinical conditions associated with SARS2.

Squamous cell carcinoma antigen recognised by t cells 3 (SART3, Accession NP_055521.1) is another GAM139 target gene, herein designated TARGET GENE. SART3 BINDING SITE is a target binding site found in the 3' untranslated region of mRNA encoded by SART3, corresponding to a target binding site such as BINDING SITE I, BINDING SITE II or BINDING SITE III of FIG. 8. Table 4 illustrates the complementarity of the nucleotide sequences of SART3 BINDING SITE, designated SEQ ID:14542, to the nucleotide sequence of GAM139 RNA, herein designated GAM RNA, also designated SEQ ID:327.

Another function of GAM139 is therefore inhibition of Squamous cell carcinoma antigen recognised by t cells 3 (SART3, Accession NP_055521.1). Accordingly, utilities of GAM139 include diagnosis, prevention and treatment of diseases and clinical conditions associated with SART3.

SCMH1 (Accession NP_036368.1) is another GAM139 target gene, herein designated TARGET GENE. SCMH1 BINDING SITE is a target binding site found in the 3' untranslated region of mRNA encoded by SCMH1, corresponding to a target binding site such as BINDING SITE I, BINDING SITE II or BINDING SITE III of FIG. 8. Table 4 illustrates the complementarity of the nucleotide sequences of SCMH1 BINDING SITE, designated SEQ ID:18639, to the nucleotide sequence of GAM139 RNA, herein designated GAM RNA, also designated SEQ ID:327.

Another function of GAM139 is therefore inhibition of SCMH1 (Accession NP_036368.1). Accordingly, utilities of GAM139 include diagnosis, prevention and treatment of diseases and clinical conditions associated with SCMH1.

Sco cytochrome oxidase deficient homolog 2 (yeast) (SCO2, Accession NP_005129.1) is another GAM139 target gene, herein designated TARGET GENE. SCO2 BINDING SITE1 and SCO2 BINDING SITE2 are target binding sites found in untranslated regions of mRNA encoded by SCO2, corresponding to target binding sites such as BINDING SITE I, BINDING SITE II or BINDING SITE III of FIG. 8. Table 4 illustrates the complementarity of the nucleotide sequences of SCO2 BINDING SITE1 and SCO2 BINDING SITE2, designated SEQ ID:18670 and SEQ ID:3615 respectively, to the nucleotide sequence of GAM139 RNA, herein designated GAM RNA, also designated SEQ ID:327.

Another function of GAM139 is therefore inhibition of Sco cytochrome oxidase deficient homolog 2 (yeast) (SCO2, Accession NP_005129.1). Accordingly, utilities of GAM139 include diagnosis, prevention and treatment of diseases and clinical conditions associated with SCO2.

SDNSF (Accession NP_644808.1) is another GAM139 target gene, herein designated TARGET GENE. SDNSF BINDING SITE is a target binding site found in the 3' untranslated region of mRNA encoded by SDNSF, corresponding to a target binding site such as BINDING SITE I, BINDING SITE II or BINDING SITE III of FIG. 8. Table 4 illustrates the complementarity of the nucleotide sequences of SDNSF BINDING SITE, designated SEQ ID:13351, to the nucleotide sequence of GAM139 RNA, herein designated GAM RNA, also designated SEQ ID:327.

Another function of GAM139 is therefore inhibition of SDNSF (Accession NP_644808.1). Accordingly, utilities of GAM139 include diagnosis, prevention and treatment of diseases and clinical conditions associated with SDNSF.

Swi/snf related, matrix associated, actin dependent regulator of chromatin, subfamily d, member 1 (SMARCD1, Accession NP_620710.1) is another GAM139 target gene, herein designated TARGET GENE. SMARCD1 BINDING SITE is a target binding site found in the 3' untranslated region of multiple transcripts of mRNA encoded by SMARCD1, corresponding to a target binding site such as BINDING SITE I, BINDING SITE II or BINDING SITE III of FIG. 8. Table 4 illustrates the complementarity of the nucleotide sequences of SMARCD1 BINDING SITE, designated SEQ ID:10765, to the nucleotide sequence of GAM139 RNA, herein designated GAM RNA, also designated SEQ ID:327.

Another function of GAM139 is therefore inhibition of Swi/snf related, matrix associated, actin dependent regulator of chromatin, subfamily d, member 1 (SMARCD1, Accession NP_620710.1), a gene which is involved in chromatin assembly and remodeling. Accordingly, utilities of GAM139 include diagnosis, prevention and treatment of diseases and clinical conditions associated with SMARCD1.

The function of SMARCD1 and its association with various diseases and clinical conditions, has been established by previous studies, as described hereinabove with reference to GAM42.1. Swi/snf related, matrix associated, actin dependent regulator of chromatin, subfamily d, member 1 (SMARCD1, Accession NP_003067.2) is another GAM139 target gene, herein designated TARGET GENE. SMARCD1 BINDING SITE is a target binding site found in the 3' untranslated region of multiple transcripts of mRNA encoded by SMARCD1, corresponding to a target binding site such as BINDING SITE I, BINDING SITE II or BINDING SITE III of FIG. 8. Table 4 illustrates the complementarity of the nucleotide sequences of SMARCD1 BINDING SITE, designated SEQ ID:10765, to the nucleotide sequence of GAM139 RNA, herein designated GAM RNA, also designated SEQ ID:327.

Another function of GAM139 is therefore inhibition of Swi/snf related, matrix associated, actin dependent regulator of chromatin, subfamily d, member 1 (SMARCD1, Accession NP_003067.2), a gene which is involved in chromatin assembly and remodeling. Accordingly, utilities of GAM139 include diagnosis, prevention and treatment of diseases and clinical conditions associated with SMARCD1.

The function of SMARCD1 and its association with various diseases and clinical conditions, has been established by previous studies, as described hereinabove with reference to GAM42.1. Synuclein, gamma (breast cancer-specific protein 1) (SNCG, Accession NP_003078.1) is another GAM139 target gene, herein designated TARGET GENE. SNCG BINDING SITE is a target binding site found in the 3' untranslated region of mRNA encoded by SNCG, corresponding to a target binding site such as BINDING SITE I, BINDING SITE II or BINDING SITE III of FIG. 8. Table 4 illustrates the complementarity of the nucleotide sequences of SNCG BINDING SITE, designated SEQ ID:5579, to the nucleotide sequence of GAM139 RNA, herein designated GAM RNA, also designated SEQ ID:327.

Another function of GAM139 is therefore inhibition of Synuclein, gamma (breast cancer-specific protein 1) (SNCG, Accession NP_003078.1), a gene which plays a role in neurofilament network integrity and therefore may be associated with Breast cancer. Accordingly, utilities of GAM139 include diagnosis, prevention and treatment of Breast cancer, and of other diseases and clinical conditions associated with SNCG.

The function of SNCG has been established by previous studies. The synuclein gene family comprises genes that are highly conserved between species. Lavedan et al. (1998) identified and characterized a novel member of the human synuclein gene family, gamma-synuclein (SNCG). The SNCG gene contains 5 exons and encodes a 127-amino acid protein that is highly homologous to alpha-synuclein (SNCA; 163890) and beta-synuclein (SNCB; 602569). Northern blot analysis showed that the gene is principally expressed in the brain, particularly in the substantia nigra. Through a survey of an EST database, Lavedan et al. (1998) found that the SNCG gene may also be overexpressed in ovarian tumors. Ji et al. (1997) used a high-throughput direct-differential cDNA sequencing approach to identify genes differentially expressed in normal breast as compared with breast cancer. Of many putative differentially expressed genes, a breast cancer-specific gene, BCSG1, which was expressed in high abundance in a breast cancer cDNA library but scarcely at all in a normal breast cDNA library, was identified as a putative breast cancer marker. In situ hybridization analysis demonstrated stage-specific BCSG1 expression as follows: BCSG1 was undetectable in normal or benign breast lesions, showing partial expression in ductal carcinoma in situ, but was expressed at an extremely high level in advanced infiltrating breast cancer. The predicted amino acid sequence of the BCSG1 gene product had a significant homology to the non-amyloid beta protein fragment of Alzheimer disease amyloid protein (OMIM Ref. No. 163890). BCSG1 overexpression may indicate breast cancer malignant progression from benign or in situ carcinoma.

Full details of the abovementioned studies are described in the following publications, the disclosure of which are hereby incorporated by reference:

Ji, H.; Liu, Y. E.; Jia, T.; Wang, M.; Liu, J.; Xiao, G.; Joseph, B. K.; Rosen, C.; Shi, Y. E.: Identification of a breast cancer-specific gene, BCSG1, by direct differential cDNA sequencing. Cancer Res. 57:759-764, 1997. ; and Lavedan, C.; Buchholtz, S.; Auburger, G.; Albin, R. L.; Athanassiadou, A.; Blancato, J.; Burguera, J. A.; Ferrell, R. E.; Kostic, V.; Leroy, E.; Leube, B.; Mota-Vieira, L.; and 9 others.

Further studies establishing the function and utilities of SNCG are found in John Hopkins OMIM database record ID 602998, and in cited publications listed in Table 5, which are hereby incorporated by reference. Syntaphilin (SNPH, Accession NP_055538.1) is another GAM139 target gene, herein designated TARGET GENE. SNPH BINDING SITE is a target binding site found in the 3' untranslated region of mRNA encoded by SNPH, corresponding to a target binding site such as BINDING SITE I, BINDING SITE II or BINDING SITE III of FIG. 8. Table 4 illustrates the complementarity of the nucleotide sequences of SNPH BINDING SITE, designated SEQ ID:2804, to the nucleotide sequence of GAM139 RNA, herein designated GAM RNA, also designated SEQ ID:327.

Another function of GAM139 is therefore inhibition of Syntaphilin (SNPH, Accession NP_055538.1). Accordingly, utilities of GAM139 include diagnosis, prevention and treatment of diseases and clinical conditions associated with SNPH.

SSH2 (Accession XP_290798.1) is another GAM139 target gene, herein designated TARGET GENE. SSH2 BINDING SITE is a target binding site found in the 3' untranslated region of multiple transcripts of mRNA encoded by SSH2, corresponding to a target binding site such as BINDING SITE I, BINDING SITE II or BINDING SITE III of FIG. 8. Table 4 illustrates the complementarity of the nucleotide sequences of SSH2 BINDING SITE, designated SEQ ID:15268, to the nucleotide sequence of GAM139 RNA, herein designated GAM RNA, also designated SEQ ID:327.

Another function of GAM139 is therefore inhibition of SSH2 (Accession XP_290798.1). Accordingly, utilities of GAM139 include diagnosis, prevention and treatment of diseases and clinical conditions associated with SSH2.

Stromal interaction molecule 1 (STIM1, Accession NP_003147.2) is another GAM139 target gene, herein designated TARGET GENE. STIM1 BINDING SITE1 through STIM1 BINDING SITE3 are target binding sites found in untranslated regions of mRNA encoded by STIM1, corresponding to target binding sites such as BINDING SITE I, BINDING SITE II or BINDING SITE III of FIG. 8. Table 4 illustrates the complementarity of the nucleotide sequences of STIM1 BINDING SITE1 through STIM1 BINDING SITE3, designated SEQ ID:7760, SEQ ID:19353 and SEQ ID:13882 respectively, to the nucleotide sequence of GAM139 RNA, herein designated GAM RNA, also designated SEQ ID:327.

Another function of GAM139 is therefore inhibition of Stromal interaction molecule 1 (STIM1, Accession NP_003147.2), a gene which is very strongly similar to murine Stim1 and may be a transmembrane stromal cell protein. and therefore may be associated with The beckwith-wiedemann syndrome and wilms tumor. Accordingly, utilities of GAM139 include diagnosis, prevention and treatment of The beckwith-wiedemann syndrome and wilms tumor, and of other diseases and clinical conditions associated with STIM1.

The function of STIM1 has been established by previous studies. Using sequences identified by database searching with a transcript from human chromosome 11p15.5, Parker et al. (1996) screened placental and fetal liver cDNA libraries and cloned a novel cDNA, STIM1, which they called GOK. The deduced 746-amino acid protein contains a predicted signal peptide and transmembrane helix. Parker et al. (1996) also cloned a partial mouse Stim1 genomic clone and found that the human and mouse proteins share 90% sequence identity. Restriction mapping by pulsed field electrophoresis placed the STIM1 gene 1.7 kb telomeric of the RRM1 gene (OMIM Ref. No. 180410) on 11p15.5 (Parker et al., 1996). Sabbioni et al. (1999) determined that the STIM1 gene contains 12 exons that span more than 250 kb between the RRM1 and NUP98 (OMIM Ref. No. 601021) genes.

Full details of the abovementioned studies are described in the following publications, the disclosure of which are hereby incorporated by reference:

Parker, N. J.; Begley, C. G.; Smith, P. J.; Fox, R. M.: Molecular cloning of a novel human gene (D11S4896E) at chromosomal region 11p15.5. Genomics 37:253-256, 1996; and Sabbioni, S.; Veronese, A.; Trubia, M.; Taramelli, R.; Barbanti-Brodano, G.; Croce, C. M.; Negrini, M.: Exon structure and promoter identification of STIM1 (alias GOK), a human gene ca.

Further studies establishing the function and utilities of STIM1 are found in John Hopkins OMIM database record ID 605921, and in cited publications listed in Table 5, which are hereby incorporated by reference. Serine/threonine kinase 38 like (STK38L, Accession NP_055815.1) is another GAM139 target gene, herein designated TARGET GENE. STK38L BINDING SITE is a target binding site found in the 3' untranslated region of mRNA encoded by STK38L, corresponding to a target binding site such as BINDING SITE I, BINDING SITE II or BINDING SITE III of FIG. 8. Table 4 illustrates the complementarity of the nucleotide sequences of STK38L BINDING SITE, designated SEQ ID:4238, to the nucleotide sequence of GAM139 RNA, herein designated GAM RNA, also designated SEQ ID:327.

Another function of GAM139 is therefore inhibition of Serine/threonine kinase 38 like (STK38L, Accession NP_055815.1). Accordingly, utilities of GAM139 include diagnosis, prevention and treatment of diseases and clinical conditions associated with STK38L.

TARSH (Accession NP_079077.1) is another GAM139 target gene, herein designated TARGET GENE. TARSH BINDING SITE is a target binding site found in the 3' untranslated region of multiple transcripts of mRNA encoded by TARSH, corresponding to a target binding site such as BINDING SITE I, BINDING SITE II or BINDING SITE III of FIG. 8. Table 4 illustrates the complementarity of the nucleotide sequences of TARSH BINDING SITE, designated SEQ ID:6078, to the nucleotide sequence of GAM139 RNA, herein designated GAM RNA, also designated SEQ ID:327.

Another function of GAM139 is therefore inhibition of TARSH (Accession NP_079077.1). Accordingly, utilities of GAM139 include diagnosis, prevention and treatment of diseases and clinical conditions associated with TARSH.

T-box 1 (TBX1, Accession NP_005983.1) is another GAM139 target gene, herein designated TARGET GENE. TBX1 BINDING SITE is a target binding site found in the 3' untranslated region of multiple transcripts of mRNA encoded by TBX1, corresponding to a target binding site such as BINDING SITE I, BINDING SITE II or BINDING SITE III of FIG. 8. Table 4 illustrates the complementarity of the nucleotide sequences of TBX1 BINDING SITE, designated SEQ ID:4869, to the nucleotide sequence of GAM139 RNA, herein designated GAM RNA, also designated SEQ ID:327.

Another function of GAM139 is therefore inhibition of T-box 1 (TBX1, Accession NP_005983.1), a gene which may act as a transcription factor and contains a T-box DNA binding domain. Accordingly, utilities of GAM139 include diagnosis, prevention and treatment of diseases and clinical conditions associated with TBX1.

The function of TBX1 has been established by previous studies. Chieffo et al. (1997) described the identification, cloning, and characterization of the human TBX1 gene, which maps to the center of the DiGeorge syndrome (OMIM Ref. No. 188400) chromosomal region on 22q11.2. TBX1 is a member of a phylogenetically conserved family of genes that share a common DNA-binding domain, the T-box. T-box genes are transcription factors involved in the regulation of developmental processes (see OMIM Ref. No. TBX2; 600747). Human and mouse TBX1 proteins share 98% amino acid identity overall and are identical except for 2 residues within the T-box domain. Expression of human TBX1 in adult and fetal tissues, as determined by Northern blot analysis, was similar to that found in the mouse. Additionally, using 3-prime RACE, Chieffo et al. (1997) demonstrated a differentially spliced message in adult skeletal muscle. Mouse Tbx1 had previously been shown to be expressed during early embryogenesis in the pharyngeal arches, pouches, and otic vesicle. Later in development, expression was seen in the vertebral column and tooth bud. Thus, the authors concluded that TBX1 is a candidate for some of the features seen in the 22q11 deletion syndrome.

Animal model experiments lend further support to the function of TBX1. The DiGeorge syndrome (DGS)/velocardiofacial syndrome (VCFS; 192430) is a relatively common human disorder, usually associated with deletions of 22q11. The genetic basis for the wide range of developmental anomalies in the heart, thymus, endocrine glands, and facial structures has been elusive. Jerome and Papaioannou (2001) investigated the potential role of TBX1 in DGS/VCFS by producing a null mutation in mice. They found that mice heterozygous for the mutation had a high incidence of cardiac outflow tract anomalies, thus modeling one of the major abnormalities of the human syndrome. Moreover, Tbx1 -/- mice displayed a wide range of developmental anomalies encompassing almost all of the common DGS/VCFS features, including hypoplasia of thymus and parathyroid glands, cardiac outflow tract abnormalities, abnormal facial structures, abnormal vertebrae, and cleft palate. On the basis of this phenotype in mice, they proposed that TBX1 in humans is a key gene in the etiology of DGS/VCFS.

It is appreciated that the abovementioned animal model for TBX1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chieffo, C.; Garvey, N.; Gong, W.; Roe, B.; Zhang, G.; Silver, L.; Emanuel, B. S.; Budarf, M. L.: Isolation and characterization of a gene from the DiGeorge chromosomal region homologous to the mouse Tbx1 gene. Genomics 43:267-277, 1997; and Jerome, L. A.; Papaioannou, V. E.: DiGeorge syndrome phenotype in mice mutant for the T-box gene, Tbx1. Nature Genet. 27:286-291, 2001.

Further studies establishing the function and utilities of TBX1 are found in John Hopkins OMIM database record ID 602054, and in cited publications listed in Table 5, which are hereby incorporated by reference. Telomeric repeat binding factor 2, interacting protein (TERF2IP, Accession NP_061848.1) is another GAM139 target gene, herein designated TARGET GENE. TERF2IP BINDING SITE1 and TERF2IP BINDING SITE2 are target binding sites found in untranslated regions of mRNA encoded by TERF2IP, corresponding to target binding sites such as BINDING SITE I, BINDING SITE II or BINDING SITE III of FIG. 8. Table 4 illustrates the complementarity of the nucleotide sequences of TERF2IP BINDING SITE1 and TERF2IP BINDING SITE2, designated SEQ ID:16058 and SEQ ID:15403 respectively, to the nucleotide sequence of GAM139 RNA, herein designated GAM RNA, also designated SEQ ID:327.

Another function of GAM139 is therefore inhibition of Telomeric repeat binding factor 2, interacting protein (TERF2IP, Accession NP_061848.1). Accordingly, utilities of GAM139 include diagnosis, prevention and treatment of diseases and clinical conditions associated with TERF2IP.

Transferrin (TF, Accession NP_001054.1) is another GAM139 target gene, herein designated TARGET GENE. TF BINDING SITE is a target binding site found in the 5' untranslated region of mRNA encoded by TF, corresponding to a target binding site such as BINDING SITE I, BINDING SITE II or BINDING SITE III of FIG. 8. Table 4 illustrates the complementarity of the nucleotide sequences of TF BINDING SITE, designated SEQ ID:11063, to the nucleotide sequence of GAM139 RNA, herein designated GAM RNA, also designated SEQ ID:327.

Another function of GAM139 is therefore inhibition of Transferrin (TF, Accession NP_001054.1). Accordingly, utilities of GAM139 include diagnosis, prevention and treatment of diseases and clinical conditions associated with TF.

Tgfb-induced factor 2 (tale family homeobox) (TGIF2, Accession NP_068581.1) is another GAM139 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:10404, to the nucleotide sequence of GAM139 RNA, herein designated GAM RNA, also designated SEQ ID:327.

Another function of GAM139 is therefore inhibition of Tgfb-induced factor 2 (tale family homeobox) (TGIF2, Accession NP_068581.1). Accordingly, utilities of GAM139 include diagnosis, prevention and treatment of diseases and clinical conditions associated with TGIF2.

Trans-golgi network protein 2 (TGOLN2, Accession NP_006455.1) is another GAM139 target gene, herein designated TARGET GENE. TGOLN2 BINDING SITE1 and TGOLN2 BINDING SITE2 are target binding sites found in untranslated regions of mRNA encoded by TGOLN2, corresponding to target binding sites such as BINDING SITE I, BINDING SITE II or BINDING SITE III of FIG. 8. Table 4 illustrates the complementarity of the nucleotide sequences of TGOLN2 BINDING SITE1 and TGOLN2 BINDING SITE2, designated SEQ ID:18006 and SEQ ID:11996 respectively, to the nucleotide sequence of GAM139 RNA, herein designated GAM RNA, also designated SEQ ID:327.

Another function of GAM139 is therefore inhibition of Trans-golgi network protein 2 (TGOLN2, Accession NP_006455.1). Accordingly, utilities of GAM139 include diagnosis, prevention and treatment of diseases and clinical conditions associated with TGOLN2.

Translocase of inner mitochondrial membrane 13 homolog (yeast) (TIMM13, Accession NP_036590.1) is another GAM139 target gene, herein designated TARGET GENE. TIMM13 BINDING SITE is a target binding site found in the 3' untranslated region of mRNA encoded by TIMM13, corresponding to a target binding site such as BINDING SITE I, BINDING SITE II or BINDING SITE III of FIG. 8. Table 4 illustrates the complementarity of the nucleotide sequences of TIMM13 BINDING SITE, designated SEQ ID:1880, to the nucleotide sequence of GAM139 RNA, herein designated GAM RNA, also designated SEQ ID:327.

Another function of GAM139 is therefore inhibition of Translocase of inner mitochondrial membrane 13 homolog (yeast) (TIMM13, Accession NP_036590.1). Accordingly, utilities of GAM139 include diagnosis, prevention and treatment of diseases and clinical conditions associated with TIMM13.

Tumor necrosis factor receptor superfamily, member 13b (TNFRSF13B, Accession NP_036584.1) is another GAM139 target gene, herein designated TARGET GENE. TNFRSF13B BINDING SITE is a target binding site found in the 3' untranslated region of mRNA encoded by TNFRSF13B, corresponding to a target binding site such as BINDING SITE I, BINDING SITE II or BINDING SITE III of FIG. 8. Table 4 illustrates the complementarity of the nucleotide sequences of TNFRSF13B BINDING SITE, designated SEQ ID:9446, to the nucleotide sequence of GAM139 RNA, herein designated GAM RNA, also designated SEQ ID:327.

Another function of GAM139 is therefore inhibition of Tumor necrosis factor receptor superfamily, member 13b (TNFRSF13B, Accession NP_036584.1). Accordingly, utilities of GAM139 include diagnosis, prevention and treatment of diseases and clinical conditions associated with TNFRSF13B.

Tnf receptor-associated factor 5 (TRAF5, Accession NP_665702.1) is another GAM139 target gene, herein designated TARGET GENE. TRAF5 BINDING SITE is a target binding site found in the 5' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:5242, to the nucleotide sequence of GAM139 RNA, herein designated GAM RNA, also designated SEQ ID:327.

Another function of GAM139 is therefore inhibition of Tnf receptor-associated factor 5 (TRAF5, Accession NP_665702.1), a gene which Member of a family of proteins that interact with TNF receptors; binds the lymphotoxin beta receptor (LTBR). Accordingly, utilities of GAM139 include diagnosis, prevention and treatment of diseases and clinical conditions associated with TRAF5.

The function of TRAF5 and its association with various diseases and clinical conditions, has been established by previous studies, as described hereinabove with reference to GAM69.2. Three prime repair exonuclease 1 (TREX1, Accession NP_338598.1) is another GAM139 target gene, herein designated TARGET GENE. TREX1 BINDING SITE1 and TREX1 BINDING SITE2 are target binding sites found in untranslated regions of multiple transcripts of mRNA encoded by TREX1, corresponding to target binding sites such as BINDING SITE I, BINDING SITE II or BINDING SITE III of FIG. 8. Table 4 illustrates the complementarity of the nucleotide sequences of TREX1 BINDING SITE1 and TREX1 BINDING SITE2, designated SEQ ID:10243 and SEQ ID:9722 respectively, to the nucleotide sequence of GAM139 RNA, herein designated GAM RNA, also designated SEQ ID:327.

Another function of GAM139 is therefore inhibition of Three prime repair exonuclease 1 (TREX1, Accession NP_338598.1). Accordingly, utilities of GAM139 include diagnosis, prevention and treatment of diseases and clinical conditions associated with TREX1.

Three prime repair exonuclease 1 (TREX1, Accession NP_338597.1) is another GAM139 target gene, herein designated TARGET GENE. TREX1 BINDING SITE1 and TREX1 BINDING SITE2 are target binding sites found in untranslated regions of multiple transcripts of mRNA encoded by TREX1, corresponding to target binding sites such as BINDING SITE I, BINDING SITE II or BINDING SITE III of FIG. 8. Table 4 illustrates the complementarity of the nucleotide sequences of TREX1 BINDING SITE1 and TREX1 BINDING SITE2, designated SEQ ID:10243 and SEQ ID:9722 respectively, to the nucleotide sequence of GAM139 RNA, herein designated GAM RNA, also designated SEQ ID:327.

Another function of GAM139 is therefore inhibition of Three prime repair exonuclease 1 (TREX1, Accession NP_338597.1). Accordingly, utilities of GAM139 include diagnosis, prevention and treatment of diseases and clinical conditions associated with TREX1.

Trichorhinophalangeal syndrome i (TRPS1, Accession NP_054831.1) is another GAM139 target gene, herein designated TARGET GENE. TRPS1 BINDING SITE is a target binding site found in the 5' untranslated region of mRNA encoded by TRPS1, corresponding to a target binding site such as BINDING SITE I, BINDING SITE II or BINDING SITE III of FIG. 8. Table 4 illustrates the complementarity of the nucleotide sequences of TRPS1 BINDING SITE, designated SEQ ID:12768, to the nucleotide sequence of GAM139 RNA, herein designated GAM RNA, also designated SEQ ID:327.

Another function of GAM139 is therefore inhibition of Trichorhinophalangeal syndrome i (TRPS1, Accession NP_054831.1), a gene which may function as a transcriptional activator protein and therefore is associated with Trichorhinophalangeal syndrome type i, type iii. Accordingly, utilities of GAM139 include diagnosis, prevention and treatment of Trichorhinophalangeal syndrome type i, type iii, and of other diseases and clinical conditions associated with TRPS1.

The function of TRPS1 has been established by previous studies. Trichorhinophalangeal syndrome type I (OMIM Ref. No. 190350) is a malformation syndrome characterized by distinctive craniofacial and skeletal abnormalities and is inherited as an autosomal dominant. TRPS I patients have sparse scalp hair, bulbous tip of the nose, long flat philtrum, thin upper vermilion border, and protruding ears. Skeletal abnormalities include cone-shaped epiphyses at the phalanges, hip malformations, and short stature. Ludecke et al. (1995) and Hou et al. (1995) assigned the TRPS1 gene to 8q24. It maps centromeric to the gene that is mutant in multiple exostoses type I (EXT1; 133700); EXT1 is deleted in all patients with TRPS type II, or Langer-Giedion syndrome (OMIM Ref. No. 150230), which combines features of TRPS I and multiple exostoses. Momeni et al. (2000) positionally cloned a gene that spanned the chromosomal breakpoint in 2 patients with TRPS I and was deleted in 5 patients with TRPS I associated with an interstitial deletion. Northern blot analyses revealed transcripts of 7 and 10.5 kb. The gene, designated TRPS1, has 7 exons and encodes a polypeptide of 1,281 amino acids. The predicted protein sequence has 2 potential nuclear localization signals and an unusual combination of different zinc finger motifs, including IKAROS-like (see OMIM Ref. No. 603023) and GATA-binding (see OMIM Ref. No. 600576) sequences. Momeni et al. (2000) identified 6 different nonsense mutations in 10 unrelated patients. The findings suggested that haploinsufficiency for this putative transcription factor causes TRPS I. To investigate whether trichorhinophalangeal syndrome type III (OMIM Ref. No.

190351) is caused by TRPS1 mutations and to establish a genotype-phenotype correlation in TRPS, Ludecke et al. (2001) performed extensive mutation analysis and evaluated height and degree of brachydactyly in patients with TRPS I or TRPS III. They found 35 different mutations in 44 of 51 unrelated patients. The detection rate (86%) indicated that TRPS1 is the major locus for TRPS I and TRPS III. They found no mutation in the parents of sporadic patients or in apparently healthy relatives of familial patients, indicating complete penetrance of TRPS1 mutations. Evaluation of skeletal abnormalities of patients with TRPS1 mutations revealed a wide clinical spectrum. The phenotype was variable in unrelated, age- and sex-matched patients with identical mutations, as well as in families. Four of the 5 missense mutations altered the GATA DNA-binding zinc finger, and 6 of the 7 unrelated patients with these mutations could be classified as having TRPS III, because they had severe bradycardia, due to short metacarpals, and severe short stature. The data indicated that TRPS III is at the severe end of the TRPS spectrum and that it is most often caused by a specific class of mutations in exon 6 the TRPS1 gene. In the study of Ludecke et al. (2001), 5 mutations were recurrent, and 4 of these were identified in patients of different ethnicities:1 in patients of Norwegian, Turkish, and Belgian extraction, and another in patients of Belgian, Turkish, and Japanese extraction, for example.

Full details of the abovementioned studies are described in the following publications, the disclosure of which are hereby incorporated by reference:

Momeni, P.; Glockner, G.; Schmidt, O.; von Holtum, D.; Albrecht, B.; Gillessen-Kaesbach, G.; Hennekam, R.; Meinecke, P.; Zabel, B.; Rosenthal, A.; Horsthemke, B.; Ludecke, H.-J.: Mutations in a new gene, encoding a zinc-finger protein, cause tricho-rhino-phalangeal syndrome type I. Nature Genet. 24:71-74, 2000; and Ludecke, H.-J.; Schaper, J.; Meinecke, P.; Momeni, P.; Gross, S.; von Holtum, D.; Hirche, H.; Abramowicz, M. J.; Albrecht, B.; Apacik, C.; Christen, H.-J.; Claussen, U.; and 28 others: G.

Further studies establishing the function and utilities of TRPS1 are found in John Hopkins OMIM database record ID 604386, and in cited publications listed in Table 5, which are hereby incorporated by reference. Tetratricopeptide repeat domain 7 (TTC7, Accession XP_031626.4) is another GAM139 target gene, herein designated TARGET GENE. TTC7 BINDING SITE is a target binding site found in the 5' untranslated region of mRNA encoded by TTC7, corresponding to a target binding site such as BINDING SITE I, BINDING SITE II or BINDING SITE III of FIG. 8. Table 4 illustrates the complementarity of the nucleotide sequences of TTC7 BINDING SITE, designated SEQ ID:8625, to the nucleotide sequence of GAM139 RNA, herein designated GAM RNA, also designated SEQ ID:327.

Another function of GAM139 is therefore inhibition of Tetratricopeptide repeat domain 7 (TTC7, Accession XP_031626.4). Accordingly, utilities of GAM139 include diagnosis, prevention and treatment of diseases and clinical conditions associated with TTC7.

Testis-specific transcript, y-linked 13 (TTTY13, Accession NP_114137.1) is another GAM139 target gene, herein designated TARGET GENE. TTTY13 BINDING SITE is a target binding site found in the 3' untranslated region of mRNA encoded by TTTY13, corresponding to a target binding site such as BINDING SITE I, BINDING SITE II or BINDING SITE III of FIG. 8. Table 4 illustrates the complementarity of the nucleotide sequences of TTTY13 BINDING SITE, designated SEQ ID:18081, to the nucleotide sequence of GAM139 RNA, herein designated GAM RNA, also designated SEQ ID:327.

Another function of GAM139 is therefore inhibition of Testis-specific transcript, y-linked 13 (TTTY13, Accession NP_114137.1). Accordingly, utilities of GAM139 include diagnosis, prevention and treatment of diseases and clinical conditions associated with TTTY13.

U5-200KD (Accession NP_054733.1) is another GAM139 target gene, herein designated TARGET GENE. U5-200KD BINDING SITE is a target binding site found in the 5' untranslated region of mRNA encoded by U5-200KD, corresponding to a target binding site such as BINDING SITE I, BINDING SITE II or BINDING SITE III of FIG. 8. Table 4 illustrates the complementarity of the nucleotide sequences of U5-200KD BINDING SITE, designated SEQ ID:10933, to the nucleotide sequence of GAM139 RNA, herein designated GAM RNA, also designated SEQ ID:327.

Another function of GAM139 is therefore inhibition of U5-200KD (Accession NP_054733.1). Accordingly, utilities of GAM139 include diagnosis, prevention and treatment of diseases and clinical conditions associated with U5-200KD.

UCK1 (Accession NP_113620.1) is another GAM139 target gene, herein designated TARGET GENE. UCK1 BINDING SITE is a target binding site found in the 3' untranslated region of mRNA encoded by UCK1, corresponding to a target binding site such as BINDING SITE I, BINDING SITE II or BINDING SITE III of FIG. 8. Table 4 illustrates the complementarity of the nucleotide sequences of UCK1 BINDING SITE, designated SEQ ID:7394, to the nucleotide sequence of GAM139 RNA, herein designated GAM RNA, also designated SEQ ID:327.

Another function of GAM139 is therefore inhibition of UCK1 (Accession NP_113620.1). Accordingly, utilities of GAM139 include diagnosis, prevention and treatment of diseases and clinical conditions associated with UCK1.

Ubiquitin specific protease 20 (USP20, Accession NP_006667.2) is another GAM139 target gene, herein designated TARGET GENE. USP20 BINDING SITE is a target binding site found in the 3' untranslated region of mRNA encoded by USP20, corresponding to a target binding site such as BINDING SITE I, BINDING SITE II or BINDING SITE III of FIG. 8. Table 4 illustrates the complementarity of the nucleotide sequences of USP20 BINDING SITE, designated SEQ ID:3865, to the nucleotide sequence of GAM139 RNA, herein designated GAM RNA, also designated SEQ ID:327.

Another function of GAM139 is therefore inhibition of Ubiquitin specific protease 20 (USP20, Accession NP_006667.2). Accordingly, utilities of GAM139 include diagnosis, prevention and treatment of diseases and clinical conditions associated with USP20.

Wd repeat domain 5b (WDR5B, Accession NP_061942.2) is another GAM139 target gene, herein designated TARGET GENE. WDR5B BINDING SITE is a target binding site found in the 5' untranslated region of mRNA encoded by WDR5B, corresponding to a target binding site such as BINDING SITE I, BINDING SITE II or BINDING SITE III of FIG. 8. Table 4 illustrates the complementarity of the nucleotide sequences of WDR5B BINDING SITE, designated SEQ ID:6229, to the nucleotide sequence of GAM139 RNA, herein designated GAM RNA, also designated SEQ ID:327.

Another function of GAM139 is therefore inhibition of Wd repeat domain 5b (WDR5B, Accession NP_061942.2).

Accordingly, utilities of GAM139 include diagnosis, prevention and treatment of diseases and clinical conditions associated with WDR5B.

Wingless-type mmtv integration site family, member 3a (WNT3A, Accession NP_149122.1) is another GAM139 target gene, herein designated TARGET GENE. WNT3A BINDING SITE1 and WNT3A BINDING SITE2 are target binding sites found in untranslated regions of mRNA encoded by WNT3A, corresponding to target binding sites such as BINDING SITE I, BINDING SITE II or BINDING SITE III of FIG. 8. Table 4 illustrates the complementarity of the nucleotide sequences of WNT3A BINDING SITE1 and WNT3A BINDING SITE2, designated SEQ ID:11109 and SEQ ID:18055 respectively, to the nucleotide sequence of GAM139 RNA, herein designated GAM RNA, also designated SEQ ID:327.

Another function of GAM139 is therefore inhibition of Wingless-type mmtv integration site family, member 3a (WNT3A, Accession NP_149122.1). Accordingly, utilities of GAM139 include diagnosis, prevention and treatment of diseases and clinical conditions associated with WNT3A.

Wingless-type mmtv integration site family, member 5b (WNT5B, Accession NP_110402.2) is another GAM139 target gene, herein designated TARGET GENE. WNT5B BINDING SITE is a target binding site found in the 3' untranslated region of multiple transcripts of mRNA encoded by WNT5B, corresponding to a target binding site such as BINDING SITE I, BINDING SITE II or BINDING SITE III of FIG. 8. Table 4 illustrates the complementarity of the nucleotide sequences of WNT5B BINDING SITE, designated SEQ ID:9907, to the nucleotide sequence of GAM139 RNA, herein designated GAM RNA, also designated SEQ ID:327.

Another function of GAM139 is therefore inhibition of Wingless-type mmtv integration site family, member 5b (WNT5B, Accession NP_110402.2), a gene which is the ligand for members of the frizzled family of seven transmembrane receptors and may be a signaling molecule. Accordingly, utilities of GAM139 include diagnosis, prevention and treatment of diseases and clinical conditions associated with WNT5B.

The function of WNT5B has been established by previous studies. The WNT gene family consists of structurally related genes encoding secreted signaling molecules that have been implicated in oncogenesis and in several developmental processes, including regulation of cell fate and patterning during embryogenesis. For general information about WNT genes, see WNT1 (OMIM Ref. No. 164820). Using degenerate PCR and cDNA library screening to search for new members of the mouse Wnt family, Gavin et al. (1990) identified Wnt5b. Northern blot analysis detected expression of Wnt5b in all tissues tested, with the exception of adult spleen. In situ hybridization, detected expression of Wnt5b at low levels throughout the embryo and fetus from 6.5 to 14.5 days postcoitum. By searching human genome draft sequence for mouse Wnt5a homologs, Saitoh and Katoh (2001) identified WNT5B. Using database searches and PCR techniques, they assembled a WNT5B cDNA sequence. WNT5B encodes a deduced 359-amino acid protein with an N- terminal signal peptide, 4 N-linked glycosylation sites, and conserved residues of the WNT family. The WNT5B protein shares 80% sequence identity with WNT5A (OMIM Ref. No. 164975). Using Northern blot analysis, Saitoh and Katoh (2001) detected expression of 2.8- and 2.4-kb WNT5B transcripts at moderate levels in adult prostate and fetal brain and at low levels in fetal lung, kidney, adult liver, ovary, and small intestine. Using cDNA-PCR, the authors also detected WNT5B in gastric cancer and teratocarcinoma cell lines. Saitoh and Katoh (2001) determined that the WNT5B gene contains 4 exons and spans about 16 kb of genomic DNA. Exon-intron boundaries are conserved between WNT5B and WNT5A, suggesting that the 2 genes may have been generated by duplication of an ancestral gene.

Full details of the abovementioned studies are described in the following publications, the disclosure of which are hereby incorporated by reference:

Gavin, B. J.; McMahon, J. A.; McMahon, A. P.: Expression of multiple novel Wnt-1/int-1-related genes during fetal and adult mouse development. Genes Dev. 4:2319-2332, 1990; and Saitoh, T.; Katoh, M.: Molecular cloning and characterization of human WNT5B on chromosome 12p13.3 region. Int. J. Oncol. 19:347-351, 2001.

Further studies establishing the function and utilities of WNT5B are found in John Hopkins OMIM database record ID 606361, and in cited publications listed in Table 5, which are hereby incorporated by reference. Wingless-type mmtv integration site family, member 5b (WNT5B, Accession NP_116031.1) is another GAM139 target gene, herein designated TARGET GENE. WNT5B BINDING SITE is a target binding site found in the 3' untranslated region of multiple transcripts of mRNA encoded by WNT5B, corresponding to a target binding site such as BINDING SITE I, BINDING SITE II or BINDING SITE III of FIG. 8. Table 4 illustrates the complementarity of the nucleotide sequences of WNT5B BINDING SITE, designated SEQ ID:9907, to the nucleotide sequence of GAM139 RNA, herein designated GAM RNA, also designated SEQ ID:327.

Another function of GAM139 is therefore inhibition of Wingless-type mmtv integration site family, member 5b (WNT5B, Accession NP_116031.1), a gene which is the ligand for members of the frizzled family of seven transmembrane receptors and may be a signaling molecule. Accordingly, utilities of GAM139 include diagnosis, prevention and treatment of diseases and clinical conditions associated with WNT5B.

The function of WNT5B has been established by previous studies. The WNT gene family consists of structurally related genes encoding secreted signaling molecules that have been implicated in oncogenesis and in several developmental processes, including regulation of cell fate and patterning during embryogenesis. For general information about WNT genes, see WNT1 (OMIM Ref. No. 164820). Using degenerate PCR and cDNA library screening to search for new members of the mouse Wnt family, Gavin et al. (1990) identified Wnt5b. Northern blot analysis detected expression of Wnt5b in all tissues tested, with the exception of adult spleen. In situ hybridization, detected expression of Wnt5b at low levels throughout the embryo and fetus from 6.5 to 14.5 days postcoitum. By searching human genome draft sequence for mouse Wnt5a homologs, Saitoh and Katoh (2001) identified WNT5B. Using database searches and PCR techniques, they assembled a WNT5B cDNA sequence. WNT5B encodes a deduced 359-amino acid protein with an N- terminal signal peptide, 4 N-linked glycosylation sites, and conserved residues of the WNT family. The WNT5B protein shares 80% sequence identity with WNT5A (OMIM Ref. No. 164975). Using Northern blot analysis, Saitoh and Katoh (2001) detected expression of 2.8- and 2.4-kb WNT5B transcripts at moderate levels in adult prostate and fetal brain and at low levels in fetal lung, kidney, adult liver, ovary, and small intestine. Using cDNA-PCR, the authors also detected WNT5B in gastric cancer and teratocarcinoma cell lines. Saitoh and Katoh (2001) determined that the WNT5B gene contains 4 exons and spans about 16 kb of genomic DNA. Exon-intron boundaries are conserved between WNT5B and WNT5A, suggesting that the 2 genes may have been generated by duplication of an ancestral gene.

Full details of the abovementioned studies are described in the following publications, the disclosure of which are hereby incorporated by reference:

Gavin, B. J.; McMahon, J. A.; McMahon, A. P.: Expression of multiple novel Wnt-1/int-1-related genes during fetal and adult mouse development. Genes Dev. 4:2319-2332, 1990; and Saitoh, T.; Katoh, M.: Molecular cloning and characterization of human WNT5B on chromosome 12p13.3 region. Int. J. Oncol. 19:347-351, 2001.

Further studies establishing the function and utilities of WNT5B are found in John Hopkins OMIM database record ID 606361, and in cited publications listed in Table 5, which are hereby incorporated by reference. XPO6 (Accession XP_055195.3) is another GAM139 target gene, herein designated TARGET GENE. XPO6 BINDING SITE1 and XPO6 BINDING SITE2 are target binding sites found in untranslated regions of mRNA encoded by XPO6, corresponding to target binding sites such as BINDING SITE I, BINDING SITE II or BINDING SITE III of FIG. 8. Table 4 illustrates the complementarity of the nucleotide sequences of XPO6 BINDING SITE1 and XPO6 BINDING SITE2, designated SEQ ID:14323 and SEQ ID:1450 respectively, to the nucleotide sequence of GAM139 RNA, herein designated GAM RNA, also designated SEQ ID:327.

Another function of GAM139 is therefore inhibition of XPO6 (Accession XP_055195.3). Accordingly, utilities of GAM139 include diagnosis, prevention and treatment of diseases and clinical conditions associated with XPO6.

Tyrosine 3-monooxygenase/tryptophan 5-monooxygenase activation protein, theta polypeptide (YWHAQ, Accession NP_006817.1) is another GAM139 target gene, herein designated TARGET GENE. YWHAQ BINDING SITE is a target binding site found in the 3' untranslated region of mRNA encoded by YWHAQ, corresponding to a target binding site such as BINDING SITE I, BINDING SITE II or BINDING SITE III of FIG. 8. Table 4 illustrates the complementarity of the nucleotide sequences of YWHAQ BINDING SITE, designated SEQ ID:15153, to the nucleotide sequence of GAM139 RNA, herein designated GAM RNA, also designated SEQ ID:327.

Another function of GAM139 is therefore inhibition of Tyrosine 3-monooxygenase/tryptophan 5-monooxygenase activation protein, theta polypeptide (YWHAQ, Accession NP_006817.1). Accordingly, utilities of GAM139 include diagnosis, prevention and treatment of diseases and clinical conditions associated with YWHAQ.

ZNF408 (Accession NP_079017.1) is another GAM139 target gene, herein designated TARGET GENE. ZNF408 BINDING SITE is a target binding site found in the 3' untranslated region of mRNA encoded by ZNF408, corresponding to a target binding site such as BINDING SITE I, BINDING SITE II or BINDING SITE III of FIG. 8. Table 4 illustrates the complementarity of the nucleotide sequences of ZNF408 BINDING SITE, designated SEQ ID:3799, to the nucleotide sequence of GAM139 RNA, herein designated GAM RNA, also designated SEQ ID:327.

Another function of GAM139 is therefore inhibition of ZNF408 (Accession NP_079017.1). Accordingly, utilities of GAM139 include diagnosis, prevention and treatment of diseases and clinical conditions associated with ZNF408.

Zyxin (Zy, Accession NP_003452.1) is another GAM139 target gene, herein designated TARGET GENE. ZYX BINDING SITE is a target binding site found in the 3' untranslated region of mRNA encoded by Zy, corresponding to a target binding site such as BINDING SITE I, BINDING SITE II or BINDING SITE III of FIG. 8. Table 4 illustrates the complementarity of the nucleotide sequences of ZYX BINDING SITE, designated SEQ ID:1825, to the nucleotide sequence of GAM139 RNA, herein designated GAM RNA, also designated SEQ ID:327.

Another function of GAM139 is therefore inhibition of Zyxin (Zy, Accession NP_003452.1). Accordingly, utilities of GAM139 include diagnosis, prevention and treatment of diseases and clinical conditions associated with ZYX.

FIG. 8 further provides a conceptual description of a novel bioinformatically detected of the present invention, referred to here as Genomic Address Messenger 140 (GAM140), which modulates expression of respective target genes thereof, the function and utility of which target genes is known in the art.

GAM140 is a novel bioinformatically detected regulatory, non protein coding, micro RNA (miRNA) gene. The method by which GAM140 was detected is described hereinabove with reference to FIGS. 8-15.

GAM140 gene, herein designated GAM GENE, and GAM140 target gene, herein designated TARGET GENE, are human genes contained in the human genome.

GAM140 gene encodes a GAM140 precursor RNA, herein designated GAM PRECURSOR RNA. Similar to other miRNA genes, and unlike most ordinary genes, GAM140 precursor RNA does not encode a protein. A nucleotide sequence identical or highly similar to the nucleotide sequence of GAM140 precursor RNA is designated SEQ ID:51, and is provided hereinbelow with reference to the sequence listing part.

GAM140 precursor RNA folds onto itself, forming GAM140 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM140 precursor RNA folds onto itself, forming GAM140 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM140 precursor RNA, designated SEQ-ID:51, and a schematic representation of a predicted secondary folding of GAM140 folded precursor RNA are further described with reference to Table 2, hereby incorporated by reference.

An enzyme complex designated DICER COMPLEX, 'dices' the GAM140 folded precursor RNA into GAM140 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM140 RNA is designated SEQ ID:295, and is provided hereinbelow with references to the sequence listing part and Table 3, hereby incorporated by reference.

GAM140 target gene, herein designated TARGET GENE, encodes a corresponding messenger RNA, GAM140 target RNA, herein designated GAM TARGET RNA. GAM140 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM140 RNA, herein designated GAM RNA, binds complementarily to one or more target binding sites located in untranslated regions of GAM140 target RNA, herein designated GAM TARGET RNA. This complementary binding is due to the fact that the nucleotide sequence of GAM140 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM140 RNA may have a different number of target binding sites in untranslated regions of a GAM140 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM140 RNA, herein designated GAM RNA, to target binding sites on GAM140 target RNA, herein designated GAM TARGET RNA, such as BINDING SITE I, BINDING SITE II and BINDING SITE III, inhibits translation of GAM140 target RNA into GAM140 target protein, herein designated GAM TARGET PROTEIN. GAM target protein is therefore outlined by a broken line.

It is appreciated that GAM140 target gene, herein designated TARGET GENE, in fact represents a plurality of GAM140 target genes. The mRNA of each one of this plurality of GAM140 target genes comprises one or more target binding sites, each having a nucleotide sequence which is at least partly complementary to GAM140 RNA, herein designated GAM RNA, and which when bound by GAM140 RNA causes inhibition of translation of respective one or more GAM140 target proteins.

It is further appreciated by one skilled in the art that the mode of translational inhibition illustrated by FIG. 8 with specific reference to translational inhibition exerted by GAM140 gene, herein designated GAM GENE, on one or more GAM140 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM140 correlate with, and may be deduced from, the identity of the target genes which GAM140 binds and inhibits, and the function of these target genes, as elaborated hereinbelow.

Brf1 homolog, subunit of rna polymerase iii transcription initiation factor iiib (s. cerevisiae) (BRF1, Accession NM_001519.2) is a GAM140 target gene, herein designated TARGET GENE. BRF1 BINDING SITE is a target binding site found in the 3' untranslated region of multiple transcripts of mRNA encoded by BRF1, corresponding to a target binding site such as BINDING SITE I, BINDING SITE II or BINDING SITE III of FIG. 8. Table 4 illustrates the complementarity of the nucleotide sequences of BRF1 BINDING SITE, designated SEQ ID:17247, to the nucleotide sequence of GAM140 RNA, herein designated GAM RNA, also designated SEQ ID:295.

A function of GAM140 is therefore inhibition of Brf1 homolog, subunit of rna polymerase iii transcription initiation factor iiib (s. cerevisiae) (BRF1, Accession NM_001519.2), a gene which is a general activator of RNA polymerase III. Accordingly, utilities of GAM140 include diagnosis, prevention and treatment of diseases and clinical conditions associated with BRF1.

The function of BRF1 has been established by previous studies. By screening a Burkitt lymphoma and other human cDNA cell libraries using degenerate PCR primers corresponding to peptide sequences of the 90-kD subunit of GTF3B, Wang and Roeder (1995) obtained a cDNA encoding TAF3B2, which they called TFIIIB90. Sequence analysis revealed that the 675-amino acid TAF3B2 protein contains a high mobility group protein-2 (HMG2; 163906)-related region in the highly charged C-terminal half of the protein and a sequence related to GTF2B (OMIM Ref. No. 189963) in the N terminus. Western blot analysis showed that TAF3B2 is expressed as a 92-kD protein, the C terminus of which binds TBP. Recombinant TAF3B2 together with TBP, but neither alone, could replace purified natural GTF3B. Deletion of either the N-terminal GTF2B-related or the C-terminal HMG2-related half of the protein abolished activity. Mital et al. (1996) cloned a cDNA identical to the TAF3B2 cDNA obtained by Wang and Roeder (1995) except for scattered nucleotide differences and the presence of 6 additional nucleotides. These last differences change the open reading frame, predicting a different sequence over 67 amino acids of the TAF3B2 protein, which Mital et al. (1996) called BRF due to its homology with the S. cerevisiae BRF protein. Mital et al. (1996) confirmed the association of TAF3B2 with TBP reported by Wang and Roeder (1995).

Full details of the abovementioned studies are described in the following publications, the disclosure of which are hereby incorporated by reference:

Wang, Z.; Roeder, R. G.: Structure and function of a human transcription factor TFIIIB subunit that is evolutionarily conserved and contains both TFIIB- and high- mobility-group protein 2-related domains. Proc. Nat. Acad. Sci. 92:7026-7030, 1995; and Mital, R.; Kobayashi, R.; Hernandez, N.: RNA polymerase III transcription from the human U6 and adenovirus type 2 VAI promoters has different requirements for human BRF, a subunit of hu.

Further studies establishing the function and utilities of BRF1 are found in John Hopkins OMIM database record ID 604902, and in cited publications listed in Table 5, which are hereby incorporated by reference. DKFZP434K028 (Accession XM_167745.1) is another GAM140 target gene, herein designated TARGET GENE. DKFZP434K028 BINDING SITE is a target binding site found in the 3' untranslated region of mRNA encoded by DKFZP434K028, corresponding to a target binding site such as BINDING SITE I, BINDING SITE II or BINDING SITE III of FIG. 8. Table 4 illustrates the complementarity of the nucleotide sequences of DKFZP434K028 BINDING SITE, designated SEQ ID:7407, to the nucleotide sequence of GAM140 RNA, herein designated GAM RNA, also designated SEQ ID:295.

Another function of GAM140 is therefore inhibition of DKFZP434K028 (Accession XM_167745.1). Accordingly, utilities of GAM140 include diagnosis, prevention and treatment of diseases and clinical conditions associated with DKFZP434K028.

DKFZP564K1964 (Accession NM_015544.1) is another GAM140 target gene, herein designated TARGET GENE. DKFZP564K1964 BINDING SITE is a target binding site found in the 3' untranslated region of mRNA encoded by DKFZP564K1964, corresponding to a target binding site such as BINDING SITE I, BINDING SITE II or BINDING SITE III of FIG. 8. Table 4 illustrates the complementarity of the nucleotide sequences of DKFZP564K1964 BINDING SITE, designated SEQ ID:10329, to the nucleotide sequence of GAM140 RNA, herein designated GAM RNA, also designated SEQ ID:295.

Another function of GAM140 is therefore inhibition of DKFZP564K1964 (Accession NM_015544.1). Accordingly, utilities of GAM140 include diagnosis, prevention and treatment of diseases and clinical conditions associated with DKFZP564K1964.

Deoxyribonuclease i-like 1 (DNASE1L1, Accession NM_006730.1) is another GAM140 target gene, herein designated TARGET GENE. DNASE1L1 BINDING SITE is a target binding site found in the 5' untranslated region of mRNA encoded by DNASE1L1, corresponding to a target binding site such as BINDING SITE I, BINDING SITE II or BINDING SITE III of FIG. 8. Table 4 illustrates the complementarity of the nucleotide sequences of DNASE1L1 BINDING SITE, designated SEQ ID:13997, to the nucleotide sequence of GAM140 RNA, herein designated GAM RNA, also designated SEQ ID:295.

Another function of GAM140 is therefore inhibition of Deoxyribonuclease i-like 1 (DNASE1L1, Accession NM_006730.1), a gene which seems to be involved in cell death. Accordingly, utilities of GAM140 include diagnosis, prevention and treatment of diseases and clinical conditions associated with DNASE1L1.

The function of DNASE1L1 has been established by previous studies. Parrish et al. (1995) isolated a novel cDNA from the region of Xq28 between QM (OMIM Ref. No. 312173) and DXS1010E. Sequence similarity to DNase I (OMIM Ref. No. 125505) was high at the DNA and peptide sequence levels. The transcript was present at highest levels in skeletal and cardiac muscle, with lower expression in other tissues. Mutation analysis was performed using DNA samples from 2 unrelated patients with Barth syndrome (OMIM Ref. No. 302060) and from 11 unrelated patients with Emery-Dreifuss muscular dystrophy (OMIM Ref. No. 310300), 2 genetic disorders involving muscle and with joint linkage to Xq28. No disease-associated mutations were detected in the coding region of the gene; however, Parrish et al. (1995) found a novel 190-bp insertion/deletion polymorphism in the 3-prime untranslated region. Translation of the long open reading frame found in the cDNA yielded a putative 302-amino acid protein with 37.6% identity to human DNase I. The protein was predicted to contain a signal sequence at the amino terminus, a transmembrane domain near the carboxyl terminus, and a helix-loop-helix domain. Pergolizzi et al. (1996) screened cDNA libraries with a cosmid that had been mapped to Xq28 in the region between RCP/GCP (303900; 303800) and G6PD (OMIM Ref. No. 305900). They obtained a 2.1-kb cDNA and showed that it encodes a putative 302-amino acid protein with 44% sequence identity to pig DNase I and 39% identity to human DNase I. Northern blots showed a single 2.0-kb transcript in adult heart and skeletal muscle and an additional transcript of 2.5 kb in some fetal tissues. (The sequence of Pergolizzi et al. (1996) was identical to that reported by Parrish et al. (1995)).

Full details of the abovementioned studies are described in the following publications, the disclosure of which are hereby incorporated by reference:

Parrish, J. E.; Ciccodicola, A.; Wehnert, M.; Cox, G. F.; Chen, E.; Nelson, D. L. : A muscle-specific DNase I-like gene in human Xq28. Hum. Molec. Genet. 4:1557-1564, 1995; and Pergolizzi, R.; Appierto, V.; Bosetti, A.; DeBellis, G. L.; Rovida, E.; Biunno, I. : Cloning of a gene encoding a DNase I-like endonuclease in the human Xq28 region. Gene 168: 267-270.

Further studies establishing the function and utilities of DNASE1L1 are found in John Hopkins OMIM database record ID 300081, and in cited publications listed in Table 5, which are hereby incorporated by reference. FLJ11078 (Accession NM_018316.1) is another GAM140 target gene, herein designated TARGET GENE. FLJ11078 BINDING SITE is a target binding site found in the 3' untranslated region of mRNA encoded by FLJ11078, corresponding to a target binding site such as BINDING SITE I, BINDING SITE II or BINDING SITE III of FIG. 8. Table 4 illustrates the complementarity of the nucleotide sequences of FLJ11078 BINDING SITE, designated SEQ ID:8946, to the nucleotide sequence of GAM140 RNA, herein designated GAM RNA, also designated SEQ ID:295.

Another function of GAM140 is therefore inhibition of FLJ11078 (Accession NM_018316.1). Accordingly, utilities of GAM140 include diagnosis, prevention and treatment of diseases and clinical conditions associated with FLJ11078.

FLJ14166 (Accession NM_024565.2) is another GAM140 target gene, herein designated TARGET GENE. FLJ14166 BINDING SITE is a target binding site found in the 5' untranslated region of mRNA encoded by FLJ14166, corresponding to a target binding site such as BINDING SITE I, BINDING SITE II or BINDING SITE III of FIG. 8. Table 4 illustrates the complementarity of the nucleotide sequences of FLJ14166 BINDING SITE, designated SEQ ID:17286, to the nucleotide sequence of GAM140 RNA, herein designated GAM RNA, also designated SEQ ID:295.

Another function of GAM140 is therefore inhibition of FLJ14166 (Accession NM_024565.2). Accordingly, utilities of GAM140 include diagnosis, prevention and treatment of diseases and clinical conditions associated with FLJ14166.

Hemoglobin, alpha 2 (HBA2, Accession NM_000517.3) is another GAM140 target gene, herein designated TARGET GENE. HBA2 BINDING SITE is a target binding site found in the 3' untranslated region of mRNA encoded by HBA2, corresponding to a target binding site such as BINDING SITE I, BINDING SITE II or BINDING SITE III of FIG. 8. Table 4 illustrates the complementarity of the nucleotide sequences of HBA2 BINDING SITE, designated SEQ ID:14247, to the nucleotide sequence of GAM140 RNA, herein designated GAM RNA, also designated SEQ ID:295.

Another function of GAM140 is therefore inhibition of Hemoglobin, alpha 2 (HBA2, Accession NM_000517.3). Accordingly, utilities of GAM140 include diagnosis, prevention and treatment of diseases and clinical conditions associated with HBA2.

KIAA0721 (Accession NM_021648.3) is another GAM140 target gene, herein designated TARGET GENE. KIAA0721 BINDING SITE is a target binding site found in the 3' untranslated region of mRNA encoded by KIAA0721, corresponding to a target binding site such as BINDING SITE I, BINDING SITE II or BINDING SITE III of FIG. 8. Table 4 illustrates the complementarity of the nucleotide sequences of KIAA0721 BINDING SITE, designated SEQ ID:17774, to the nucleotide sequence of GAM140 RNA, herein designated GAM RNA, also designated SEQ ID:295.

Another function of GAM140 is therefore inhibition of KIAA0721 (Accession NM_021648.3). Accordingly, utilities of GAM140 include diagnosis, prevention and treatment of diseases and clinical conditions associated with KIAA0721.

KIAA0937 (Accession XM_166213.1) is another GAM140 target gene, herein designated TARGET GENE. KIAA0937 BINDING SITE is a target binding site found in the 3' untranslated region of mRNA encoded by KIAA0937, corresponding to a target binding site such as BINDING SITE I, BINDING SITE II or BINDING SITE III of FIG. 8. Table 4 illustrates the complementarity of the nucleotide sequences of KIAA0937 BINDING SITE, designated SEQ ID:13222, to the nucleotide sequence of GAM140 RNA, herein designated GAM RNA, also designated SEQ ID:295.

Another function of GAM140 is therefore inhibition of KIAA0937 (Accession XM_166213.1). Accordingly, utilities of GAM140 include diagnosis, prevention and treatment of diseases and clinical conditions associated with KIAA0937.

KIAA1655 (Accession) is another GAM140 target gene, herein designated TARGET GENE. KIAA1655 BINDING SITE is a target binding site found in the 5' untranslated region of mRNA encoded by KIAA1655, corresponding to a target binding site such as BINDING SITE I, BINDING SITE II or BINDING SITE III of FIG. 8. Table 4 illustrates the complementarity of the nucleotide sequences of KIAA1655 BINDING SITE, designated SEQ ID:15383, to the nucleotide sequence of GAM140 RNA, herein designated GAM RNA, also designated SEQ ID:295.

Another function of GAM140 is therefore inhibition of KIAA1655 (Accession). Accordingly, utilities of GAM140 include diagnosis, prevention and treatment of diseases and clinical conditions associated with KIAA1655.

KIAA1695 (Accession NM_025135.1) is another GAM140 target gene, herein designated TARGET GENE. KIAA1695 BINDING SITE is a target binding site found in the 3' untranslated region of mRNA encoded by KIAA1695, corresponding to a target binding site such as BINDING SITE I, BINDING SITE II or BINDING SITE III of FIG. 8. Table 4 illustrates the complementarity of the nucleotide sequences of KIAA1695 BINDING SITE, designated SEQ ID:3626, to the nucleotide sequence of GAM140 RNA, herein designated GAM RNA, also designated SEQ ID:295.

Another function of GAM140 is therefore inhibition of KIAA1695 (Accession NM_025135.1). Accordingly, utilities of GAM140 include diagnosis, prevention and treatment of diseases and clinical conditions associated with KIAA1695.

LOC199692 (Accession NM_145295.1) is another GAM140 target gene, herein designated TARGET GENE. LOC199692 BINDING SITE is a target binding site found in the 3' untranslated region of mRNA encoded by LOC199692, corresponding to a target binding site such as BINDING SITE I, BINDING SITE II or BINDING SITE III of FIG. 8. Table 4 illustrates the complementarity of the nucleotide sequences of LOC199692 BINDING SITE, designated SEQ ID:5475, to the nucleotide sequence of GAM140 RNA, herein designated GAM RNA, also designated SEQ ID:295.

Another function of GAM140 is therefore inhibition of LOC199692 (Accession NM_145295.1). Accordingly, utilities of GAM140 include diagnosis, prevention and treatment of diseases and clinical conditions associated with LOC199692.

LOC200138 (Accession) is another GAM140 target gene, herein designated TARGET GENE. LOC200138 BINDING SITE is a target binding site found in the 5' untranslated region of mRNA encoded by LOC200138, corresponding to a target binding site such as BINDING SITE I, BINDING SITE II or BINDING SITE III of FIG. 8. Table 4 illustrates the complementarity of the nucleotide sequences of LOC200138 BINDING SITE, designated SEQ ID:3123, to the nucleotide sequence of GAM140 RNA, herein designated GAM RNA, also designated SEQ ID:295.

Another function of GAM140 is therefore inhibition of LOC200138 (Accession). Accordingly, utilities of GAM140 include diagnosis, prevention and treatment of diseases and clinical conditions associated with LOC200138.

LOC256369 (Accession) is another GAM140 target gene, herein designated TARGET GENE. LOC256369 BINDING SITE is a target binding site found in the 5' untranslated region of mRNA encoded by LOC256369, corresponding to a target binding site such as BINDING SITE I, BINDING SITE II or BINDING SITE III of FIG. 8. Table 4 illustrates the complementarity of the nucleotide sequences of LOC256369 BINDING SITE, designated SEQ ID:16565, to the nucleotide sequence of GAM140 RNA, herein designated GAM RNA, also designated SEQ ID:295.

Another function of GAM140 is therefore inhibition of LOC256369 (Accession). Accordingly, utilities of GAM140 include diagnosis, prevention and treatment of diseases and clinical conditions associated with LOC256369.

MGC15827 (Accession NM_032882.1) is another GAM140 target gene, herein designated TARGET GENE. MGC15827 BINDING SITE is a target binding site found in the 3' untranslated region of mRNA encoded by MGC15827, corresponding to a target binding site such as BINDING SITE I, BINDING SITE II or BINDING SITE III of FIG. 8. Table 4 illustrates the complementarity of the nucleotide sequences of MGC15827 BINDING SITE, designated SEQ ID:12150, to the nucleotide sequence of GAM140 RNA, herein designated GAM RNA, also designated SEQ ID:295.

Another function of GAM140 is therefore inhibition of MGC15827 (Accession NM_032882.1). Accordingly, utilities of GAM140 include diagnosis, prevention and treatment of diseases and clinical conditions associated with MGC15827.

Protein tyrosine phosphatase, receptor type, t (PTPRT, Accession NM_007050.3) is another GAM140 target gene, herein designated TARGET GENE. PTPRT BINDING SITE is a target binding site found in the 3' untranslated region of multiple transcripts of mRNA encoded by PTPRT, corresponding to a target binding site such as BINDING SITE I, BINDING SITE II or BINDING SITE III of FIG. 8. Table 4 illustrates the complementarity of the nucleotide sequences of PTPRT BINDING SITE, designated SEQ ID:3450, to the nucleotide sequence of GAM140 RNA, herein designated GAM RNA, also designated SEQ ID:295.

Another function of GAM140 is therefore inhibition of Protein tyrosine phosphatase, receptor type, t (PTPRT, Accession NM_007050.3). Accordingly, utilities of GAM140 include diagnosis, prevention and treatment of diseases and clinical conditions associated with PTPRT.

Retinoic acid receptor, alpha (RARA, Accession NM_000964.1) is another GAM140 target gene, herein designated TARGET GENE. RARA BINDING SITE is a target binding site found in the 3' untranslated region of mRNA encoded by RARA, corresponding to a target binding site such as BINDING SITE I, BINDING SITE II or BINDING SITE III of FIG. 8. Table 4 illustrates the complementarity of the nucleotide sequences of RARA BINDING SITE, designated SEQ ID:3866, to the nucleotide sequence of GAM140 RNA, herein designated GAM RNA, also designated SEQ ID:295.

Another function of GAM140 is therefore inhibition of Retinoic acid receptor, alpha (RARA, Accession NM_000964.1). Accordingly, utilities of GAM140 include diagnosis, prevention and treatment of diseases and clinical conditions associated with RARA.

Retinoblastoma binding protein 7 (RBBP7, Accession NM_002893.2) is another GAM140 target gene, herein designated TARGET GENE. RBBP7 BINDING SITE is a target binding site found in the 3' untranslated region of mRNA encoded by RBBP7, corresponding to a target binding site such as BINDING SITE I, BINDING SITE II or BINDING SITE III of FIG. 8. Table 4 illustrates the complementarity of the nucleotide sequences of RBBP7 BINDING SITE, designated SEQ ID:6024, to the nucleotide sequence of GAM140 RNA, herein designated GAM RNA, also designated SEQ ID:295.

Another function of GAM140 is therefore inhibition of Retinoblastoma binding protein 7 (RBBP7, Accession NM_002893.2). Accordingly, utilities of GAM140 include diagnosis, prevention and treatment of diseases and clinical conditions associated with RBBP7.

Serine/threonine kinase 38 (STK38, Accession NM_007271.1) is another GAM140 target gene, herein designated TARGET GENE. STK38 BINDING SITE is a target binding site found in the 3' untranslated region of mRNA encoded by STK38, corresponding to a target binding site such as BINDING SITE I, BINDING SITE II or BINDING SITE III of FIG. 8. Table 4 illustrates the complementarity of the nucleotide sequences of STK38 BINDING SITE, designated SEQ ID:2689, to the nucleotide sequence of GAM140 RNA, herein designated GAM RNA, also designated SEQ ID:295.

Another function of GAM140 is therefore inhibition of Serine/threonine kinase 38 (STK38, Accession NM_007271.1). Accordingly, utilities of GAM140 include diagnosis, prevention and treatment of diseases and clinical conditions associated with STK38.

Zinc finger protein 287 (ZNF287, Accession NM_020653.1) is another GAM140 target gene, herein designated TARGET GENE. ZNF287 BINDING SITE is a target binding site found in the 5' untranslated region of mRNA encoded by ZNF287, corresponding to a target binding site such as BINDING SITE I, BINDING SITE II or BINDING SITE III of FIG. 8. Table 4 illustrates the complementarity of the nucleotide sequences of ZNF287 BINDING SITE, designated SEQ ID:3540, to the nucleotide sequence of GAM140 RNA, herein designated GAM RNA, also designated SEQ ID:295.

Another function of GAM140 is therefore inhibition of Zinc finger protein 287 (ZNF287, Accession NM_020653.1). Accordingly, utilities of GAM140 include diagnosis, prevention and treatment of diseases and clinical conditions associated with ZNF287.

FIG. 8 further provides a conceptual description of a novel bioinformatically detected of the present invention, referred to here as Genomic Address Messenger 141 (GAM141), which modulates expression of respective target genes thereof, the function and utility of which target genes is known in the art.

GAM141 is a novel bioinformatically detected regulatory, non protein coding, micro RNA (miRNA) gene. The method by which GAM141 was detected is described hereinabove with reference to FIGS. 8-15.

GAM141 gene, herein designated GAM GENE, and GAM141 target gene, herein designated TARGET GENE, are human genes contained in the human genome.

GAM141 gene encodes a GAM141 precursor RNA, herein designated GAM PRECURSOR RNA. Similar to other miRNA genes, and unlike most ordinary genes, GAM141 precursor RNA does not encode a protein. A nucleotide sequence identical or highly similar to the nucleotide sequence of GAM141 precursor RNA is designated SEQ ID:94, and is provided hereinbelow with reference to the sequence listing part.

GAM141 precursor RNA folds onto itself, forming GAM141 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM141 precursor RNA folds onto itself, forming GAM141 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM141 precursor RNA, designated SEQ-ID:94, and a schematic representation of a predicted secondary folding of GAM141 folded precursor RNA are further described with reference to Table 2, hereby incorporated by reference.

An enzyme complex designated DICER COMPLEX, 'dices' the GAM141 folded precursor RNA into GAM141 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM141 RNA is designated SEQ ID:357, and is provided hereinbelow with references to the sequence listing part and Table 3, hereby incorporated by reference.

GAM141 target gene, herein designated TARGET GENE, encodes a corresponding messenger RNA, GAM141 target RNA, herein designated GAM TARGET RNA. GAM141 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM141 RNA, herein designated GAM RNA, binds complementarily to one or more target binding sites located in untranslated regions of GAM141 target RNA, herein designated GAM TARGET RNA. This complementary binding is due to the fact that the nucleotide sequence of GAM141 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM141 RNA may have a different number of target binding sites in untranslated regions of a GAM141 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM141 RNA, herein designated GAM RNA, to target binding sites on GAM141 target RNA, herein designated GAM TARGET RNA, such as BINDING SITE I, BINDING SITE II and BINDING SITE III, inhibits translation of GAM141 target RNA into GAM141 target protein, herein designated GAM TARGET PROTEIN. GAM target protein is therefore outlined by a broken line.

It is appreciated that GAM141 target gene, herein designated TARGET GENE, in fact represents a plurality of GAM141 target genes. The mRNA of each one of this plurality of GAM141 target genes comprises one or more target binding sites, each having a nucleotide sequence which is at least partly complementary to GAM141 RNA, herein designated GAM RNA, and which when bound by GAM141 RNA causes inhibition of translation of respective one or more GAM141 target proteins.

It is further appreciated by one skilled in the art that the mode of translational inhibition illustrated by FIG. 8 with specific reference to translational inhibition exerted by GAM141 gene, herein designated GAM GENE, on one or more GAM141 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM141 correlate with, and may be deduced from, the identity of the target genes which GAM141 binds and inhibits, and the function of these target genes, as elaborated hereinbelow.

FLJ21156 (Accession NM_024602.1) is a GAM141 target gene, herein designated TARGET GENE. FLJ21156 BINDING SITE is a target binding site found in the 3' untranslated region of mRNA encoded by FLJ21156, corresponding to a target binding site such as BINDING SITE I, BINDING SITE II or BINDING SITE III of FIG. 8. Table 4 illustrates the complementarity of the nucleotide sequences of FLJ21156 BINDING SITE, designated SEQ ID:12599, to the nucleotide sequence of GAM141 RNA, herein designated GAM RNA, also designated SEQ ID:357.

A function of GAM141 is therefore inhibition of FLJ21156 (Accession NM_024602.1). Accordingly, utilities of GAM141 include diagnosis, prevention and treatment of diseases and clinical conditions associated with FLJ21156.

LOC116437 (Accession XM_058185.2) is another GAM141 target gene, herein designated TARGET GENE. LOC116437 BINDING SITE is a target binding site found in the 5' untranslated region of mRNA encoded by LOC116437, corresponding to a target binding site such as BINDING SITE I, BINDING SITE II or BINDING SITE III of FIG. 8. Table 4 illustrates the complementarity of the nucleotide sequences of LOC116437 BINDING SITE, designated SEQ ID:16557, to the nucleotide sequence of GAM141 RNA, herein designated GAM RNA, also designated SEQ ID:357.

Another function of GAM141 is therefore inhibition of LOC116437 (Accession XM_058185.2). Accordingly, utilities of GAM141 include diagnosis, prevention and treatment of diseases and clinical conditions associated with LOC116437.

Zinc finger protein 236 (ZNF236, Accession NM_007345.1) is another GAM141 target gene, herein designated TARGET GENE. ZNF236 BINDING SITE is a target binding site found in the 3' untranslated region of mRNA encoded by ZNF236, corresponding to a target binding site such as BINDING SITE I, BINDING SITE II or BINDING SITE III of FIG. 8. Table 4 illustrates the complementarity of the nucleotide sequences of ZNF236 BINDING SITE, designated SEQ ID:9704, to the nucleotide sequence of GAM141 RNA, herein designated GAM RNA, also designated SEQ ID:357.

Another function of GAM141 is therefore inhibition of Zinc finger protein 236 (ZNF236, Accession NM_007345.1). Accordingly, utilities of GAM141 include diagnosis, prevention and treatment of diseases and clinical conditions associated with ZNF236.

FIG. 8 further provides a conceptual description of a novel bioinformatically detected of the present invention, referred to here as Genomic Address Messenger 142 (GAM142), which modulates expression of respective target genes thereof, the function and utility of which target genes is known in the art.

GAM142 is a novel bioinformatically detected regulatory, non protein coding, micro RNA (miRNA) gene. The method by which GAM142 was detected is described hereinabove with reference to FIGS. 8-15.

GAM142 gene, herein designated GAM GENE, and GAM142 target gene, herein designated TARGET GENE, are human genes contained in the human genome.

GAM142 gene encodes a GAM142 precursor RNA, herein designated GAM PRECURSOR RNA. Similar to other miRNA genes, and unlike most ordinary genes, GAM142 precursor RNA does not encode a protein. A nucleotide sequence identical or highly similar to the nucleotide sequence of GAM142 precursor RNA is designated SEQ ID:92, and is provided hereinbelow with reference to the sequence listing part. Nucleotide sequence SEQ ID:92 is located at position 70918040 relative to chromosome 1.

GAM142 precursor RNA folds onto itself, forming GAM142 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM142 precursor RNA folds onto itself, forming GAM142 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM142 precursor RNA, designated SEQ-ID:92, and a schematic representation of a predicted secondary folding of GAM142 folded precursor RNA are further described with reference to Table 2, hereby incorporated by reference.

An enzyme complex designated DICER COMPLEX, 'dices' the GAM142 folded precursor RNA into GAM142 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM142 RNA is designated SEQ ID:219, and is provided hereinbelow with references to the sequence listing part and Table 3, hereby incorporated by reference.

GAM142 target gene, herein designated TARGET GENE, encodes a corresponding messenger RNA, GAM142 target RNA, herein designated GAM TARGET RNA. GAM142 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM142 RNA, herein designated GAM RNA, binds complementarily to one or more target binding sites located in untranslated regions of GAM142 target RNA, herein designated GAM TARGET RNA. This complementary binding is due to the fact that the nucleotide sequence of GAM142 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM142 RNA may have a different number of target binding sites in untranslated regions of a GAM142 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM142 RNA, herein designated GAM RNA, to target binding sites on GAM142 target RNA, herein designated GAM TARGET RNA, such as BINDING SITE I, BINDING SITE II and BINDING SITE III, inhibits translation of GAM142 target RNA into GAM142 target protein, herein designated GAM TARGET PROTEIN. GAM target protein is therefore outlined by a broken line.

It is appreciated that GAM142 target gene, herein designated TARGET GENE, in fact represents a plurality of GAM142 target genes. The mRNA of each one of this plurality of GAM142 target genes comprises one or more target binding sites, each having a nucleotide sequence which is at least partly complementary to GAM142 RNA, herein designated GAM RNA, and which when bound by GAM142 RNA causes inhibition of translation of respective one or more GAM142 target proteins.

It is further appreciated by one skilled in the art that the mode of translational inhibition illustrated by FIG. 8 with specific reference to translational inhibition exerted by GAM142 gene, herein designated GAM GENE, on one or more GAM142 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM142 correlate with, and may be deduced from, the identity of the target genes which GAM142 binds and inhibits, and the function of these target genes, as elaborated hereinbelow.

ARGBP2 (Accession NP_003594.1) is a GAM142 target gene, herein designated TARGET GENE. ARGBP2 BINDING SITE is a target binding site found in the 5' untranslated region of multiple transcripts of mRNA encoded by ARGBP2, corresponding to a target binding site such as BINDING SITE I, BINDING SITE II or BINDING SITE III of FIG. 8. Table 4 illustrates the complementarity of the nucleotide sequences of ARGBP2 BINDING SITE, designated SEQ ID:16171, to the nucleotide sequence of GAM142 RNA, herein designated GAM RNA, also designated SEQ ID:219.

A function of GAM142 is therefore inhibition of ARGBP2 (Accession NP_003594.1). Accordingly, utilities of GAM142 include diagnosis, prevention and treatment of diseases and clinical conditions associated with ARGBP2.

Atpase, h+transporting, lysosomal 31 kda, v1 subunit e isoform 1 (ATP6V1E1, Accession NP_001687.1) is another GAM142 target gene, herein designated TARGET GENE. ATP6V1E1 BINDING SITE is a target binding site found in the 3' untranslated region of mRNA encoded by ATP6V1E1, corresponding to a target binding site such as BINDING SITE I, BINDING SITE II or BINDING SITE III of FIG. 8. Table 4 illustrates the complementarity of the nucleotide sequences of ATP6V1E1 BINDING SITE, designated SEQ ID:15473, to the nucleotide sequence of GAM142 RNA, herein designated GAM RNA, also designated SEQ ID:219.

Another function of GAM142 is therefore inhibition of Atpase, h+ transporting, lysosomal 31 kda, v1 subunit e isoform 1 (ATP6V1E1, Accession NP_001687.1). Accordingly, utilities of GAM142 include diagnosis, prevention and treatment of diseases and clinical conditions associated with ATP6V1E1.

Chromosome 14 open reading frame 37 (C14orf37, Accession XP_085124.2) is another GAM142 target gene, herein designated TARGET GENE. C14orf37 BINDING SITE is a target binding site found in the 3' untranslated region of mRNA encoded by C14orf37, corresponding to a target binding site such as BINDING SITE I, BINDING SITE II or BINDING SITE III of FIG. 8. Table 4 illustrates the complementarity of the nucleotide sequences of C14orf37 BINDING SITE, designated SEQ ID:4925, to the nucleotide sequence of GAM142 RNA, herein designated GAM RNA, also designated SEQ ID:219.

Another function of GAM142 is therefore inhibition of Chromosome 14 open reading frame 37 (C14orf37, Accession XP_085124.2). Accordingly, utilities of GAM142 include diagnosis, prevention and treatment of diseases and clinical conditions associated with C14orf37.

DKFZp434H2111 (Accession XP_058513.6) is another GAM142 target gene, herein designated TARGET GENE. DKFZp434H2111 BINDING SITE is a target binding site found in the 5' untranslated region of mRNA encoded by DKFZp434H2111, corresponding to a target binding site such as BINDING SITE I, BINDING SITE II or BINDING SITE III of FIG. 8. Table 4 illustrates the complementarity of the nucleotide sequences of DKFZp434H2111 BINDING SITE, designated SEQ ID:3751, to the nucleotide sequence of GAM142 RNA, herein designated GAM RNA, also designated SEQ ID:219.

Another function of GAM142 is therefore inhibition of DKFZp434H2111 (Accession XP_058513.6). Accordingly, utilities of GAM142 include diagnosis, prevention and treatment of diseases and clinical conditions associated with DKFZp434H2111.

DKFZp586C0721 (Accession XP_098416.1) is another GAM142 target gene, herein designated TARGET GENE. DKFZp586C0721 BINDING SITE is a target binding site found in the 3' untranslated region of mRNA encoded by DKFZp586C0721, corresponding to a target binding site such as BINDING SITE I, BINDING SITE II or BINDING SITE III of FIG. 8. Table 4 illustrates the complementarity of the nucleotide sequences of DKFZp586C0721 BINDING SITE, designated SEQ ID:881, to the nucleotide sequence of GAM142 RNA, herein designated GAM RNA, also designated SEQ ID:219.

Another function of GAM142 is therefore inhibition of DKFZp586C0721 (Accession XP_098416.1). Accordingly, utilities of GAM142 include diagnosis, prevention and treatment of diseases and clinical conditions associated with DKFZp586C0721.

Dual specificity phosphatase 16 (DUSP16, Accession XP_039106.1) is another GAM142 target gene, herein designated TARGET GENE. DUSP16 BINDING SITE is a target binding site found in the 3' untranslated region of mRNA encoded by DUSP16, corresponding to a target binding site such as BINDING SITE I, BINDING SITE II or BINDING SITE III of FIG. 8. Table 4 illustrates the complementarity of the nucleotide sequences of DUSP16 BINDING SITE, designated SEQ ID:14144, to the nucleotide sequence of GAM142 RNA, herein designated GAM RNA, also designated SEQ ID:219.

Another function of GAM142 is therefore inhibition of Dual specificity phosphatase 16 (DUSP16, Accession XP_039106.1). Accordingly, utilities of GAM142 include diagnosis, prevention and treatment of diseases and clinical conditions associated with DUSP16.

FLJ22557 (Accession NP_078989.1) is another GAM142 target gene, herein designated TARGET GENE. FLJ22557 BINDING SITE is a target binding site found in the 3' untranslated region of mRNA encoded by FLJ22557, corresponding to a target binding site such as BINDING SITE I, BINDING SITE II or BINDING SITE III of FIG. 8. Table 4 illustrates the complementarity of the nucleotide sequences of FLJ22557 BINDING SITE, designated SEQ ID:15012, to the nucleotide sequence of GAM142 RNA, herein designated GAM RNA, also designated SEQ ID:219.

Another function of GAM142 is therefore inhibition of FLJ22557 (Accession NP_078989.1). Accordingly, utilities of GAM142 include diagnosis, prevention and treatment of diseases and clinical conditions associated with FLJ22557.

FLJ38426 (Accession NP_775882.1) is another GAM142 target gene, herein designated TARGET GENE. FLJ38426 BINDING SITE is a target binding site found in the 3' untranslated region of mRNA encoded by FLJ38426, corresponding to a target binding site such as BINDING SITE I, BINDING SITE II or BINDING SITE III of FIG. 8. Table 4 illustrates the complementarity of the nucleotide sequences of FLJ38426 BINDING SITE, designated SEQ ID:4649, to the nucleotide sequence of GAM142 RNA, herein designated GAM RNA, also designated SEQ ID:219.

Another function of GAM142 is therefore inhibition of FLJ38426 (Accession NP_775882.1). Accordingly, utilities of GAM142 include diagnosis, prevention and treatment of diseases and clinical conditions associated with FLJ38426.

FLJ39426 (Accession NP_775880.1) is another GAM142 target gene, herein designated TARGET GENE. FLJ39426 BINDING SITE is a target binding site found in the 5' untranslated region of mRNA encoded by FLJ39426, corresponding to a target binding site such as BINDING SITE I, BINDING SITE II or BINDING SITE III of FIG. 8. Table 4 illustrates the complementarity of the nucleotide sequences of FLJ39426 BINDING SITE, designated SEQ ID:2533, to the nucleotide sequence of GAM142 RNA, herein designated GAM RNA, also designated SEQ ID:219.

Another function of GAM142 is therefore inhibition of FLJ39426 (Accession NP_775880.1). Accordingly, utilities of GAM142 include diagnosis, prevention and treatment of diseases and clinical conditions associated with FLJ39426.

HRIHFB2122 (Accession NP_619538.1) is another GAM142 target gene, herein designated TARGET GENE. HRIHFB2122 BINDING SITE is a target binding site found in the 3' untranslated region of multiple transcripts of mRNA encoded by HRIHFB2122, corresponding to a target binding site such as BINDING SITE I, BINDING SITE II or BINDING SITE III of FIG. 8. Table 4 illustrates the complementarity of the nucleotide sequences of HRIHFB2122 BINDING SITE, designated SEQ ID:2665, to the nucleotide sequence of GAM142 RNA, herein designated GAM RNA, also designated SEQ ID:219.

Another function of GAM142 is therefore inhibition of HRIHFB2122 (Accession NP_619538.1). Accordingly, utilities of GAM142 include diagnosis, prevention and treatment of diseases and clinical conditions associated with HRIHFB2122.

Interleukin 13 receptor, alpha 1 (IL13RA1, Accession NP_001551.1) is another GAM142 target gene, herein designated TARGET GENE. IL13RA1 BINDING SITE is a target binding site found in the 3' untranslated region of mRNA encoded by IL13RA1, corresponding to a target binding site such as BINDING SITE I, BINDING SITE II or BINDING SITE III of FIG. 8. Table 4 illustrates the complementarity of the nucleotide sequences of IL13RA1 BINDING SITE, designated SEQ ID:10120, to the nucleotide sequence of GAM142 RNA, herein designated GAM RNA, also designated SEQ ID:219.

Another function of GAM142 is therefore inhibition of Interleukin 13 receptor, alpha 1 (IL13RA1, Accession NP_001551.1), a gene which binds il-13 with a low affinity. together with il-4r-alpha can form a functional receptor for il-13 and therefore may be associated with Asthma and athopy. Accordingly, utilities of GAM142 include diagnosis, prevention and treatment of Asthma and athopy, and of other diseases and clinical conditions associated with IL13RA1.

The function of IL13RA1 and its association with various diseases and clinical conditions, has been established by previous studies, as described hereinabove with reference to GAM72.1. KIAA1954 (Accession XP_085375.4) is another GAM142 target gene, herein designated TARGET GENE. KIAA1954 BINDING SITE is a target binding site found in the 3' untranslated region of mRNA encoded by KIAA1954, corresponding to a target binding site such as BINDING SITE I, BINDING SITE II or BINDING SITE III of FIG. 8. Table 4 illustrates the complementarity of the nucleotide sequences of KIAA1954 BINDING SITE, designated SEQ ID:15822, to the nucleotide sequence of GAM142 RNA, herein designated GAM RNA, also designated SEQ ID:219.

Another function of GAM142 is therefore inhibition of KIAA1954 (Accession XP_085375.4). Accordingly, utilities of GAM142 include diagnosis, prevention and treatment of diseases and clinical conditions associated with KIAA1954.

LOC116068 (Accession XP_057302.2) is another GAM142 target gene, herein designated TARGET GENE. LOC116068 BINDING SITE is a target binding site found in the 3' untranslated region of mRNA encoded by LOC116068, corresponding to a target binding site such as BINDING SITE I, BINDING SITE II or BINDING SITE III of FIG. 8. Table 4 illustrates the complementarity of the nucleotide sequences of LOC116068 BINDING SITE, designated SEQ ID:11647, to the nucleotide sequence of GAM142 RNA, herein designated GAM RNA, also designated SEQ ID:219.

Another function of GAM142 is therefore inhibition of LOC116068 (Accession XP_057302.2). Accordingly, utilities of GAM142 include diagnosis, prevention and treatment of diseases and clinical conditions associated with LOC116068.

LOC124411 (Accession XP_058804.4) is another GAM142 target gene, herein designated TARGET GENE. LOC124411 BINDING SITE is a target binding site found in the 3' untranslated region of mRNA encoded by LOC124411, corresponding to a target binding site such as BINDING SITE I, BINDING SITE II or BINDING SITE III of FIG. 8. Table 4 illustrates the complementarity of the nucleotide sequences of LOC124411 BINDING SITE, designated SEQ ID:12342, to the nucleotide sequence of GAM142 RNA, herein designated GAM RNA, also designated SEQ ID:219.

Another function of GAM142 is therefore inhibition of LOC124411 (Accession XP_058804.4). Accordingly, utilities of GAM142 include diagnosis, prevention and treatment of diseases and clinical conditions associated with LOC124411.

LOC145053 (Accession XP_096714.1) is another GAM142 target gene, herein designated TARGET GENE. LOC145053 BINDING SITE is a target binding site found in the 3' untranslated region of mRNA encoded by LOC145053, corresponding to a target binding site such as BINDING SITE I, BINDING SITE II or BINDING SITE III of FIG. 8. Table 4 illustrates the complementarity of the nucleotide sequences of LOC145053 BINDING SITE, designated SEQ ID:6065, to the nucleotide sequence of GAM142 RNA, herein designated GAM RNA, also designated SEQ ID:219.

Another function of GAM142 is therefore inhibition of LOC145053 (Accession XP_096714.1). Accordingly, utilities of GAM142 include diagnosis, prevention and treatment of diseases and clinical conditions associated with LOC145053.

LOC149837 (Accession XP_097747.1) is another GAM142 target gene, herein designated TARGET GENE. LOC149837 BINDING SITE is a target binding site found in the 5' untranslated region of mRNA encoded by LOC149837, corresponding to a target binding site such as BINDING SITE I, BINDING SITE II or BINDING SITE III of FIG. 8. Table 4 illustrates the complementarity of the nucleotide sequences of LOC149837 BINDING SITE, designated SEQ ID:8167, to the nucleotide sequence of GAM142 RNA, herein designated GAM RNA, also designated SEQ ID:219.

Another function of GAM142 is therefore inhibition of LOC149837 (Accession XP_097747.1). Accordingly, utilities of GAM142 include diagnosis, prevention and treatment of diseases and clinical conditions associated with LOC149837.

LOC152519 (Accession XP_087483.3) is another GAM142 target gene, herein designated TARGET GENE. LOC152519 BINDING SITE is a target binding site found in the 3' untranslated region of mRNA encoded by LOC152519, corresponding to a target binding site such as BINDING SITE I, BINDING SITE II or BINDING SITE III of FIG. 8. Table 4 illustrates the complementarity of the nucleotide sequences of LOC152519 BINDING SITE, designated SEQ ID:719, to the nucleotide sequence of GAM142 RNA, herein designated GAM RNA, also designated SEQ ID:219.

Another function of GAM142 is therefore inhibition of LOC152519 (Accession XP_087483.3). Accordingly, utilities of GAM142 include diagnosis, prevention and treatment of diseases and clinical conditions associated with LOC152519.

LOC158709 (Accession XP_088648.1) is another GAM142 target gene, herein designated TARGET GENE. LOC158709 BINDING SITE is a target binding site found in the 3' untranslated region of mRNA encoded by LOC158709, corresponding to a target binding site such as BINDING SITE I, BINDING SITE II or BINDING SITE III of FIG. 8. Table 4 illustrates the complementarity of the nucleotide sequences of LOC158709 BINDING SITE, designated SEQ ID:9175, to the nucleotide sequence of GAM142 RNA, herein designated GAM RNA, also designated SEQ ID:219.

Another function of GAM142 is therefore inhibition of LOC158709 (Accession XP_088648.1). Accordingly, utilities of GAM142 include diagnosis, prevention and treatment of diseases and clinical conditions associated with LOC158709.

LOC283714 (Accession XP_208803.1) is another GAM142 target gene, herein designated TARGET GENE. LOC283714 BINDING SITE is a target binding site found in the 5' untranslated region of mRNA encoded by LOC283714, corresponding to a target binding site such as BINDING SITE I, BINDING SITE II or BINDING SITE III of FIG. 8. Table 4 illustrates the complementarity of the nucleotide sequences of LOC283714 BINDING SITE, designated SEQ ID:15741, to the nucleotide sequence of GAM142 RNA, herein designated GAM RNA, also designated SEQ ID:219.

Another function of GAM142 is therefore inhibition of LOC283714 (Accession XP_208803.1). Accordingly, utilities of GAM142 include diagnosis, prevention and treatment of diseases and clinical conditions associated with LOC283714.

LOC284175 (Accession XP_211364.1) is another GAM142 target gene, herein designated TARGET GENE. LOC284175 BINDING SITE is a target binding site found in the 5' untranslated region of mRNA encoded by LOC284175, corresponding to a target binding site such as BINDING SITE I, BINDING SITE II or BINDING SITE III of FIG. 8. Table 4 illustrates the complementarity of the nucleotide sequences of LOC284175 BINDING SITE, designated SEQ ID:1851, to the nucleotide sequence of GAM142 RNA, herein designated GAM RNA, also designated SEQ ID:219.

Another function of GAM142 is therefore inhibition of LOC284175 (Accession XP_211364.1). Accordingly, utilities of GAM142 include diagnosis, prevention and treatment of diseases and clinical conditions associated with LOC284175.

LOC286434 (Accession XP_301085.1) is another GAM142 target gene, herein designated TARGET GENE. LOC286434 BINDING SITE is a target binding site found in the 3' untranslated region of mRNA encoded by LOC286434, corresponding to a target binding site such as BINDING SITE I, BINDING SITE II or BINDING SITE III of FIG. 8. Table 4 illustrates the complementarity of the nucleotide sequences of LOC286434 BINDING SITE, designated SEQ ID:9175, to the nucleotide sequence of GAM142 RNA, herein designated GAM RNA, also designated SEQ ID:219.

Another function of GAM142 is therefore inhibition of LOC286434 (Accession XP_301085.1). Accordingly, utilities of GAM142 include diagnosis, prevention and treatment of diseases and clinical conditions associated with LOC286434.

LOC339186 (Accession XP_294845.1) is another GAM142 target gene, herein designated TARGET GENE. LOC339186 BINDING SITE is a target binding site found in the 5' untranslated region of mRNA encoded by LOC339186, corresponding to a target binding site such as BINDING SITE I, BINDING SITE II or BINDING SITE III of FIG. 8. Table 4 illustrates the complementarity of the nucleotide sequences of LOC339186 BINDING SITE, designated SEQ ID:4620, to the nucleotide sequence of GAM142 RNA, herein designated GAM RNA, also designated SEQ ID:219.

Another function of GAM142 is therefore inhibition of LOC339186 (Accession XP_294845.1). Accordingly, utilities of GAM142 include diagnosis, prevention and treatment of diseases and clinical conditions associated with LOC339186.

LOC339240 (Accession XP_294880.1) is another GAM142 target gene, herein designated TARGET GENE. LOC339240 BINDING SITE is a target binding site found in the 5' untranslated region of mRNA encoded by LOC339240, corresponding to a target binding site such as BINDING SITE I, BINDING SITE II or BINDING SITE III of FIG. 8. Table 4 illustrates the complementarity of the nucleotide sequences of LOC339240 BINDING SITE, designated SEQ ID:19571, to the nucleotide sequence of GAM142 RNA, herein designated GAM RNA, also designated SEQ ID:219.

Another function of GAM142 is therefore inhibition of LOC339240 (Accession XP_294880.1). Accordingly, utilities of GAM142 include diagnosis, prevention and treatment of diseases and clinical conditions associated with LOC339240.

LOC339258 (Accession XP_294886.1) is another GAM142 target gene, herein designated TARGET GENE. LOC339258 BINDING SITE is a target binding site found in the 5' untranslated region of mRNA encoded by LOC339258, corresponding to a target binding site such as BINDING SITE I, BINDING SITE II or BINDING SITE III of FIG. 8. Table 4 illustrates the complementarity of the nucleotide sequences of LOC339258 BINDING SITE, designated SEQ ID:19571, to the nucleotide sequence of GAM142 RNA, herein designated GAM RNA, also designated SEQ ID:219.

Another function of GAM142 is therefore inhibition of LOC339258 (Accession XP_294886.1). Accordingly, utilities of GAM142 include diagnosis, prevention and treatment of diseases and clinical conditions associated with LOC339258.

LOC349429 (Accession XP_301083.1) is another GAM142 target gene, herein designated TARGET GENE. LOC349429 BINDING SITE is a target binding site found in the 3' untranslated region of mRNA encoded by LOC349429, corresponding to a target binding site such as BINDING SITE I, BINDING SITE II or BINDING SITE III of FIG. 8. Table 4 illustrates the complementarity of the nucleotide sequences of LOC349429 BINDING SITE, designated SEQ ID:9175, to the nucleotide sequence of GAM142 RNA, herein designated GAM RNA, also designated SEQ ID:219.

Another function of GAM142 is therefore inhibition of LOC349429 (Accession XP_301083.1). Accordingly, utilities of GAM142 include diagnosis, prevention and treatment of diseases and clinical conditions associated with LOC349429.

LOC93380 (Accession NP_775741.1) is another GAM142 target gene, herein designated TARGET GENE. LOC93380 BINDING SITE is a target binding site found in the 3' untranslated region of mRNA encoded by LOC93380, corresponding to a target binding site such as BINDING SITE I, BINDING SITE II or BINDING SITE III of FIG. 8. Table 4 illustrates the complementarity of the nucleotide sequences of LOC93380 BINDING SITE, designated SEQ ID:14314, to the nucleotide sequence of GAM142 RNA, herein designated GAM RNA, also designated SEQ ID:219.

Another function of GAM142 is therefore inhibition of LOC93380 (Accession NP_775741.1). Accordingly, utilities of GAM142 include diagnosis, prevention and treatment of diseases and clinical conditions associated with LOC93380.

N-ethylmaleimide-sensitive factor attachment protein, beta (NAPB, Accession XP_046652.2) is another GAM142 target gene, herein designated TARGET GENE. NAPB BINDING SITE is a target binding site found in the 3' untranslated region of mRNA encoded by NAPB, corresponding to a target binding site such as BINDING SITE I, BINDING SITE II or BINDING SITE III of FIG. 8. Table 4 illustrates the complementarity of the nucleotide sequences of NAPB BINDING SITE, designated SEQ ID:19771, to the nucleotide sequence of GAM142 RNA, herein designated GAM RNA, also designated SEQ ID:219.

Another function of GAM142 is therefore inhibition of N-ethylmaleimide-sensitive factor attachment protein, beta (NAPB, Accession XP_046652.2). Accordingly, utilities of GAM142 include diagnosis, prevention and treatment of diseases and clinical conditions associated with NAPB.

Nudix (nucleoside diphosphate linked moiety x)-type motif 4 (NUDT4, Accession NP_061967.2) is another GAM142 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:4920, to the nucleotide sequence of GAM142 RNA, herein designated GAM RNA, also designated SEQ ID:219.

Another function of GAM142 is therefore inhibition of Nudix (nucleoside diphosphate linked moiety x)-type motif 4 (NUDT4, Accession NP_061967.2). Accordingly, utilities of GAM142 include diagnosis, prevention and treatment of diseases and clinical conditions associated with NUDT4.

Platelet-derived growth factor receptor, alpha polypeptide (PDGFRA, Accession NP_006197.1) is another GAM142 target gene, herein designated TARGET GENE. PDGFRA BINDING SITE is a target binding site found in the 3' untranslated region of mRNA encoded by PDGFRA, corresponding to a target binding site such as BINDING SITE I, BINDING SITE II or BINDING SITE III of FIG. 8. Table 4 illustrates the complementarity of the nucleotide sequences of PDGFRA BINDING SITE, designated SEQ ID:1956, to the nucleotide sequence of GAM142 RNA, herein designated GAM RNA, also designated SEQ ID:219.

Another function of GAM142 is therefore inhibition of Platelet-derived growth factor receptor, alpha polypeptide (PDGFRA, Accession NP_006197.1), a gene which this receptor binds platelet-derived growth factor and has a tyrosine-protein kinase activity. and therefore may be associated with Basal cell carcinomas. Accordingly, utilities of GAM142 include diagnosis, prevention and treatment of Basal cell carcinomas, and of other diseases and clinical conditions associated with PDGFRA.

The function of PDGFRA has been established by previous studies. Considerable insight into the role of the sonic hedgehog (OMIM Ref. No. 600725) pathway in vertebrate development and human cancers came from the discovery that mutations in 'patched' (PTCH; 601309) are associated with basal cell nevus syndrome (BCNS; 109400), an autosomal dominant disorder combining developmental anomalies and tumors, particularly basal cell carcinomas (BCCs). Sporadic BCCs, the most common human cancer, consistently have abnormalities in the hedgehog pathway, and often mutations in PTCH. In addition, somatic mutations in 'smoothened' (SMOH; 601500), another protein in the hedgehog pathway, occur in sporadic BCCs. The downstream molecule GLI1 (OMIM Ref. No. 165220) is known to mediate the biologic effect of the hedgehog pathway and is itself upregulated in all BCCs. Gli1 can drive the production of BCCs in the mouse when overexpressed in the epidermis. Xie et al. (2001) showed that GLI1 can activate PDGFR-alpha and that functional upregulation of PDGFR-alpha by GLI1 is accompanied by activation of the Ras-ERK pathway, which is associated with cell proliferation. The relevance of this mechanism in vivo is supported by a high level of expression of PDGFR-alpha in BCCs in mice and humans. From these and other observations, Xie et al. (2001) concluded that increased expression of the PDGFR-alpha gene may be an important mechanism by which mutations in the hedgehog pathway cause BCCs.

Animal model experiments lend further support to the function of PDGFRA. Klinghoffer et al. (2001) created 2 complementary lines of knockin mice in which the intracellular signaling domains of one PDGFR had been removed and replaced by those of the other PDGFR. While both lines demonstrated substantial rescue of normal development, substitution of the Pdgfrb signaling domains with those of Pdgfra resulted in varying degrees of vascular disease.

It is appreciated that the abovementioned animal model for PDGFRA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Xie, J.; Aszterbaum, M.; Zhang, X.; Bonifas, J. M.; Zachary, C.; Epstein, E.; McCormick, F.: A role of PDGFR-alpha in basal cell carcinoma proliferation. Proc. Nat. Acad. Sci. 98:9255-9259, 2001; and Klinghoffer, R. A.; Mueting-Nelsen, P. F.; Faerman, A.; Shani, M.; Soriano, P.: The two PDGF receptors maintain conserved signaling in vivo despite divergent embryological functions.

Further studies establishing the function and utilities of PDGFRA are found in John Hopkins OMIM database record ID 173490, and in cited publications listed in Table 5, which are hereby incorporated by reference. Phd finger protein 3 (PHF3, Accession NP_055968.1) is another GAM142 target gene, herein designated TARGET GENE. PHF3 BINDING SITE is a target binding site found in the 3' untranslated region of mRNA encoded by PHF3, corresponding to a target binding site such as BINDING SITE I, BINDING SITE II or BINDING SITE III of FIG. 8. Table 4 illustrates the complementarity of the nucleotide sequences of PHF3 BINDING SITE, designated SEQ ID:2904, to the nucleotide sequence of GAM142 RNA, herein designated GAM RNA, also designated SEQ ID:219.

Another function of GAM142 is therefore inhibition of Phd finger protein 3 (PHF3, Accession NP_055968.1). Accordingly, utilities of GAM142 include diagnosis, prevention and treatment of diseases and clinical conditions associated with PHF3.

Recq protein-like 5 (RECQL5, Accession NP_004250.1) is another GAM142 target gene, herein designated TARGET GENE. RECQL5 BINDING SITE is a target binding site found in the 3' untranslated region of mRNA encoded by RECQL5, corresponding to a target binding site such as BINDING SITE I, BINDING SITE II or BINDING SITE III of FIG. 8. Table 4 illustrates the complementarity of the nucleotide sequences of RECQL5 BINDING SITE, designated SEQ ID:8712, to the nucleotide sequence of GAM142 RNA, herein designated GAM RNA, also designated SEQ ID:219.

Another function of GAM142 is therefore inhibition of Recq protein-like 5 (RECQL5, Accession NP_004250.1). Accordingly, utilities of GAM142 include diagnosis, prevention and treatment of diseases and clinical conditions associated with RECQL5.

Solute carrier family 12, (potassium-chloride transporter) member 5 (SLC12A5, Accession NP_065759.1) is another GAM142 target gene, herein designated TARGET GENE. SLC12A5 BINDING SITE is a target binding site found in the 3' untranslated region of mRNA encoded by SLC12A5, corresponding to a target binding site such as BINDING SITE I, BINDING SITE II or BINDING SITE III of FIG. 8. Table 4 illustrates the complementarity of the nucleotide sequences of SLC12A5 BINDING SITE, designated SEQ ID:3990, to the nucleotide sequence of GAM142 RNA, herein designated GAM RNA, also designated SEQ ID:219.

Another function of GAM142 is therefore inhibition of Solute carrier family 12, (potassium-chloride transporter) member 5 (SLC12A5, Accession NP_065759.1). Accordingly, utilities of GAM142 include diagnosis, prevention and treatment of diseases and clinical conditions associated with SLC12A5.

SV2A (Accession NP_055664.1) is another GAM142 target gene, herein designated TARGET GENE. SV2A BINDING SITE is a target binding site found in the 3' untranslated region of mRNA encoded by SV2A, corresponding to a target binding site such as BINDING SITE I, BINDING SITE II or BINDING SITE III of FIG. 8. Table 4 illustrates the complementarity of the nucleotide sequences of SV2A BINDING SITE, designated SEQ ID:17235, to the nucleotide sequence of GAM142 RNA, herein designated GAM RNA, also designated SEQ ID:219.

Another function of GAM142 is therefore inhibition of SV2A (Accession NP_055664.1). Accordingly, utilities of GAM142 include diagnosis, prevention and treatment of diseases and clinical conditions associated with SV2A.

Synaptotagmin-like 4 (granuphilin-a) (SYTL4, Accession NP_542775.1) is another GAM142 target gene, herein designated TARGET GENE. SYTL4 BINDING SITE is a target binding site found in the 3' untranslated region of mRNA encoded by SYTL4, corresponding to a target binding site such as BINDING SITE I, BINDING SITE II or BINDING SITE III of FIG. 8. Table 4 illustrates the complementarity of the nucleotide sequences of SYTL4 BINDING SITE, designated SEQ ID:10244, to the nucleotide sequence of GAM142 RNA, herein designated GAM RNA, also designated SEQ ID:219.

Another function of GAM142 is therefore inhibition of Synaptotagmin-like 4 (granuphilin-a) (SYTL4, Accession NP_542775.1). Accordingly, utilities of GAM142 include diagnosis, prevention and treatment of diseases and clinical conditions associated with SYTL4.

YKT6 (Accession NP_006546.1) is another GAM142 target gene, herein designated TARGET GENE. YKT6 BINDING SITE is a target binding site found in the 3' untranslated region of mRNA encoded by YKT6, corresponding to a target binding site such as BINDING SITE I, BINDING SITE II or BINDING SITE III of FIG. 8. Table 4 illustrates the complementarity of the nucleotide sequences of YKT6 BINDING SITE, designated SEQ ID:13499, to the nucleotide sequence of GAM142 RNA, herein designated GAM RNA, also designated SEQ ID:219.

Another function of GAM142 is therefore inhibition of YKT6 (Accession NP_006546.1). Accordingly, utilities of GAM142 include diagnosis, prevention and treatment of diseases and clinical conditions associated with YKT6.

FIG. 8 further provides a conceptual description of a novel bioinformatically detected of the present invention, referred to here as Genomic Address Messenger 143 (GAM143), which modulates expression of respective target genes thereof, the function and utility of which target genes is known in the art.

GAM143 is a novel bioinformatically detected regulatory, non protein coding, micro RNA (miRNA) gene. The method by which GAM143 was detected is described hereinabove with reference to FIGS. 8-15.

GAM143 gene, herein designated GAM GENE, and GAM143 target gene, herein designated TARGET GENE, are human genes contained in the human genome.

GAM143 gene encodes a GAM143 precursor RNA, herein designated GAM PRECURSOR RNA. Similar to other miRNA genes, and unlike most ordinary genes, GAM143 precursor RNA does not encode a protein. A nucleotide sequence identical or highly similar to the nucleotide sequence of GAM143 precursor RNA is designated SEQ ID:21, and is provided hereinbelow with reference to the sequence listing part.

GAM143 precursor RNA folds onto itself, forming GAM143 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM143 precursor RNA folds onto itself, forming GAM143 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM143 precursor RNA, designated SEQ-ID:21, and a schematic representation of a predicted secondary folding of GAM143 folded precursor RNA are further described with reference to Table 2, hereby incorporated by reference.

An enzyme complex designated DICER COMPLEX, 'dices' the GAM143 folded precursor RNA into GAM143 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM143 RNA is designated SEQ ID:325, and is provided hereinbelow with references to the sequence listing part and Table 3, hereby incorporated by reference.

GAM143 target gene, herein designated TARGET GENE, encodes a corresponding messenger RNA, GAM143 target RNA, herein designated GAM TARGET RNA. GAM143 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM143 RNA, herein designated GAM RNA, binds complementarily to one or more target binding sites located in untranslated regions of GAM143 target RNA, herein designated GAM TARGET RNA. This complementary binding is due to the fact that the nucleotide sequence of GAM143 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM143 RNA may have a different number of target binding sites in untranslated regions of a GAM143 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM143 RNA, herein designated GAM RNA, to target binding sites on GAM143 target RNA, herein designated GAM TARGET RNA, such as BINDING SITE I, BINDING SITE II and BINDING SITE III, inhibits translation of GAM143 target RNA into GAM143 target protein, herein designated GAM TARGET PROTEIN. GAM target protein is therefore outlined by a broken line.

It is appreciated that GAM143 target gene, herein designated TARGET GENE, in fact represents a plurality of GAM143 target genes. The mRNA of each one of this plurality of GAM143 target genes comprises one or more target binding sites, each having a nucleotide sequence which is at least partly complementary to GAM143 RNA, herein designated GAM RNA, and which when bound by GAM143 RNA causes inhibition of translation of respective one or more GAM143 target proteins.

It is further appreciated by one skilled in the art that the mode of translational inhibition illustrated by FIG. 8 with specific reference to translational inhibition exerted by GAM143 gene, herein designated GAM GENE, on one or more GAM143 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM143 correlate with, and may be deduced from, the identity of the target genes which GAM143 binds and inhibits, and the function of these target genes, as elaborated hereinbelow.

FLJ14442 (Accession NM_032785.1) is a GAM143 target gene, herein designated TARGET GENE. FLJ14442 BINDING SITE is a target binding site found in the 3' untranslated region of mRNA encoded by FLJ14442, corresponding to a target binding site such as BINDING SITE I, BINDING SITE II or BINDING SITE III of FIG. 8. Table 4 illustrates the complementarity of the nucleotide sequences of FLJ14442 BINDING SITE, designated SEQ ID:8620, to the nucleotide sequence of GAM143 RNA, herein designated GAM RNA, also designated SEQ ID:325.

A function of GAM143 is therefore inhibition of FLJ14442 (Accession NM_032785.1). Accordingly, utilities of GAM143 include diagnosis, prevention and treatment of diseases and clinical conditions associated with FLJ14442.

KIAA0182 (Accession XM_050495.6) is another GAM143 target gene, herein designated TARGET GENE. KIAA0182 BINDING SITE is a target binding site found in the 3' untranslated region of mRNA encoded by KIAA0182, corresponding to a target binding site such as BINDING SITE I, BINDING SITE II or BINDING SITE III of FIG. 8. Table 4 illustrates the complementarity of the nucleotide sequences of KIAA0182 BINDING SITE, designated SEQ ID:8498, to the nucleotide sequence of GAM143 RNA, herein designated GAM RNA, also designated SEQ ID:325.

Another function of GAM143 is therefore inhibition of KIAA0182 (Accession XM_050495.6). Accordingly, utilities of GAM143 include diagnosis, prevention and treatment of diseases and clinical conditions associated with KIAA0182.

LOC145231 (Accession XM_096740.1) is another GAM143 target gene, herein designated TARGET GENE. LOC145231 BINDING SITE is a target binding site found in the 3' untranslated region of mRNA encoded by LOC145231, corresponding to a target binding site such as BINDING SITE I, BINDING SITE II or BINDING SITE III of FIG. 8. Table 4 illustrates the complementarity of the nucleotide sequences of LOC145231 BINDING SITE, designated SEQ ID:10431, to the nucleotide sequence of GAM143 RNA, herein designated GAM RNA, also designated SEQ ID:325.

Another function of GAM143 is therefore inhibition of LOC145231 (Accession XM_096740.1). Accordingly, utilities of GAM143 include diagnosis, prevention and treatment of diseases and clinical conditions associated with LOC145231.

LOC149296 (Accession) is another GAM143 target gene, herein designated TARGET GENE. LOC149296 BINDING SITE is a target binding site found in the 5' untranslated region of mRNA encoded by LOC149296, corresponding to a target binding site such as BINDING SITE I, BINDING SITE II or BINDING SITE III of FIG. 8. Table 4 illustrates the complementarity of the nucleotide sequences of LOC149296 BINDING SITE, designated SEQ ID:10413, to the nucleotide sequence of GAM143 RNA, herein designated GAM RNA, also designated SEQ ID:325.

Another function of GAM143 is therefore inhibition of LOC149296 (Accession). Accordingly, utilities of GAM143 include diagnosis, prevention and treatment of diseases and clinical conditions associated with LOC149296.

LOC90139 (Accession NM_130783.1) is another GAM143 target gene, herein designated TARGET GENE. LOC90139 BINDING SITE is a target binding site found in the 3' untranslated region of mRNA encoded by LOC90139, corresponding to a target binding site such as BINDING SITE I, BINDING SITE II or BINDING SITE III of FIG. 8. Table 4 illustrates the complementarity of the nucleotide sequences of LOC90139 BINDING SITE, designated SEQ ID:4815, to the nucleotide sequence of GAM143 RNA, herein designated GAM RNA, also designated SEQ ID:325.

Another function of GAM143 is therefore inhibition of LOC90139 (Accession NM_130783.1). Accordingly, utilities of GAM143 include diagnosis, prevention and treatment of diseases and clinical conditions associated with LOC90139.

Mucin 3b (MUC3B, Accession XM_168578.2) is another GAM143 target gene, herein designated TARGET GENE. MUC3B BINDING SITE is a target binding site found in the 3' untranslated region of mRNA encoded by MUC3B, corresponding to a target binding site such as BINDING SITE I, BINDING SITE II or BINDING SITE III of FIG. 8. Table 4 illustrates the complementarity of the nucleotide sequences of MUC3B BINDING SITE, designated SEQ ID:9337, to the nucleotide sequence of GAM143 RNA, herein designated GAM RNA, also designated SEQ ID:325.

Another function of GAM143 is therefore inhibition of Mucin 3b (MUC3B, Accession XM_168578.2), a gene which provides a protective, lubricating barrier against particles and infectious agents at mucosal surfaces. Accordingly, utilities of GAM143 include diagnosis, prevention and treatment of diseases and clinical conditions associated with MUC3B.

The function of MUC3B and its association with various diseases and clinical conditions, has been established by previous studies, as described hereinabove with reference to GAM63.1.6-phosphofructo -2-kinase/fructose-2,6-biphosphatase 4 (PFKFB4, Accession NM_004567.2) is another GAM143 target gene, herein designated TARGET GENE. PFKFB4 BINDING SITE is a target binding site found in the 3' untranslated region of mRNA encoded by PFKFB4, corresponding to a target binding site such as BINDING SITE I, BINDING SITE II or BINDING SITE III of FIG. 8. Table 4 illustrates the complementarity of the nucleotide sequences of PFKFB4 BINDING SITE, designated SEQ ID:7569, to the nucleotide sequence of GAM143 RNA, herein designated GAM RNA, also designated SEQ ID:325.

Another function of GAM143 is therefore inhibition of 6-phosphofructo -2-kinase/fructose-2,6-biphosphatase 4 (PFKFB4, Accession NM_004567.2), a gene which catalizes synthesis and degradation of fructose 2,6-bisphosphate. Accordingly, utilities of GAM143 include diagnosis, prevention and treatment of diseases and clinical conditions associated with PFKFB4.

The function of PFKFB4 and its association with various diseases and clinical conditions, has been established by previous studies, as described hereinabove with reference to GAM47.1.

FIG. 8 further provides a conceptual description of a novel bioinformatically detected of the present invention, referred to here as Genomic Address Messenger 144 (GAM144), which modulates expression of respective target genes thereof, the function and utility of which target genes is known in the art.

GAM144 is a novel bioinformatically detected regulatory, non protein coding, micro RNA (miRNA) gene. The method by which GAM144 was detected is described hereinabove with reference to FIGS. 8-15.

GAM144 gene, herein designated GAM GENE, and GAM144 target gene, herein designated TARGET GENE, are human genes contained in the human genome.

GAM144 gene encodes a GAM144 precursor RNA, herein designated GAM PRECURSOR RNA. Similar to other miRNA genes, and unlike most ordinary genes, GAM144 precursor RNA does not encode a protein. A nucleotide sequence identical or highly similar to the nucleotide sequence of GAM144 precursor RNA is designated SEQ ID:143, and is provided hereinbelow with reference to the sequence listing part. Nucleotide sequence SEQ ID:143 is located at position 29007723 relative to chromosome 22.

GAM144 precursor RNA folds onto itself, forming GAM144 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM144 precursor RNA folds onto itself, forming GAM144 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM144 precursor RNA, designated SEQ-ID:143, and a schematic representation of a predicted secondary folding of GAM144 folded precursor RNA are further described with reference to Table 2, hereby incorporated by reference.

An enzyme complex designated DICER COMPLEX, 'dices' the GAM144 folded precursor RNA into GAM144 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM144 RNA is designated SEQ ID:361, and is provided hereinbelow with references to the sequence listing part and Table 3, hereby incorporated by reference.

GAM144 target gene, herein designated TARGET GENE, encodes a corresponding messenger RNA, GAM144 target RNA, herein designated GAM TARGET RNA. GAM144 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM144 RNA, herein designated GAM RNA, binds complementarily to one or more target binding sites located in untranslated regions of GAM144 target RNA, herein designated GAM TARGET RNA. This complementary binding is due to the fact that the nucleotide sequence of GAM144 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM144 RNA may have a different number of target binding sites in untranslated regions of a GAM144 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM144 RNA, herein designated GAM RNA, to target binding sites on GAM144 target RNA, herein designated GAM TARGET RNA, such as BINDING SITE I, BINDING SITE II and BINDING SITE III, inhibits translation of GAM144 target RNA into GAM144 target protein, herein designated GAM TARGET PROTEIN. GAM target protein is therefore outlined by a broken line.

It is appreciated that GAM144 target gene, herein designated TARGET GENE, in fact represents a plurality of GAM144 target genes. The mRNA of each one of this plurality of GAM144 target genes comprises one or more target binding sites, each having a nucleotide sequence which is at least partly complementary to GAM144 RNA, herein designated GAM RNA, and which when bound by GAM144 RNA causes inhibition of translation of respective one or more GAM144 target proteins.

It is further appreciated by one skilled in the art that the mode of translational inhibition illustrated by FIG. 8 with specific reference to translational inhibition exerted by GAM144 gene, herein designated GAM GENE, on one or more GAM144 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM144 correlate with, and may be deduced from, the identity of the target genes which GAM144 binds and inhibits, and the function of these target genes, as elaborated hereinbelow.

AACS (Accession NP_076417.1) is a GAM144 target gene, herein designated TARGET GENE. AACS BINDING SITE is a target binding site found in the 5' untranslated region of mRNA encoded by AACS, corresponding to a target binding site such as BINDING SITE I, BINDING SITE II or BINDING SITE III of FIG. 8. Table 4 illustrates the complementarity of the nucleotide sequences of AACS BINDING SITE, designated SEQ ID:18383, to the nucleotide sequence of GAM144 RNA, herein designated GAM RNA, also designated SEQ ID:361.

A function of GAM144 is therefore inhibition of AACS (Accession NP_076417.1). Accordingly, utilities of GAM144 include diagnosis, prevention and treatment of diseases and clinical conditions associated with AACS.

Atp-binding cassette, sub-family c (cftr/mrp), member 13 (ABCC13, Accession NP_742021.1) is another GAM144 target gene, herein designated TARGET GENE. ABCC13 BINDING SITE is a target binding site found in the 3' untranslated region of multiple transcripts of mRNA encoded by ABCC13, corresponding to a target binding site such as BINDING SITE I, BINDING SITE II or BINDING SITE III of FIG. 8. Table 4 illustrates the complementarity of the nucleotide sequences of ABCC13 BINDING SITE, designated SEQ ID:6955, to the nucleotide sequence of GAM144 RNA, herein designated GAM RNA, also designated SEQ ID:361.

Another function of GAM144 is therefore inhibition of Atp-binding cassette, sub-family c (cftr/mrp), member 13 (ABCC13, Accession NP_742021.1). Accordingly, utilities of GAM144 include diagnosis, prevention and treatment of diseases and clinical conditions associated with ABCC13.

Adenylate cyclase 1 (brain) (ADCY1, Accession NP_066939.1) is another GAM144 target gene, herein designated TARGET GENE. ADCY1 BINDING SITE is a target binding site found in the 3' untranslated region of multiple transcripts of mRNA encoded by ADCY1, corresponding to a target binding site such as BINDING SITE I, BINDING SITE II or BINDING SITE III of FIG. 8. Table 4 illustrates the complementarity of the nucleotide sequences of ADCY1 BINDING SITE, designated SEQ ID:8386, to the nucleotide sequence of GAM144 RNA, herein designated GAM RNA, also designated SEQ ID:361.

Another function of GAM144 is therefore inhibition of Adenylate cyclase 1 (brain) (ADCY1, Accession NP_066939.1), a gene which a calmodulin-sensitive adenylyl cyclase. it may play a role in memory acquisition and learning. Accordingly, utilities of GAM144 include diagnosis, prevention and treatment of diseases and clinical conditions associated with ADCY1.

The function of ADCY1 has been established by previous studies. The neural- specific, calmodulin-sensitive adenylyl cyclase (OMIM Ref. No. type I), which was first cloned from bovine brain, has been implicated in learning and memory. Villacres et al. (1993) cloned the gene for human fetal brain type I adenylyl cyclase and showed by in situ hybridization that the gene lies in the region 7p13-p12. See 103070 and 103071 for genes encoding other forms of brain adenylyl cyclase. Gaudin et al. (1994) likewise mapped the ADCY1 gene to chromosome 7 by Southern blot analysis of somatic cell hybrid DNAs. By fluorescence in situ hybridization, Edelhoff et al. (1995) mapped the mouse homolog to chromosome 11 in the A2 region. The somatosensory cortex of mice displays a patterned, nonuniform distribution of neurons in layer IV called the 'barrelfield.' Thalamocortical afferents (TCAs) that terminate in layer IV are segregated such that each barrel, a readily visible cylindrical array of neurons surrounding a cell-sparse center, represents a distinct receptive field. TCA arbors are confined to the barrel hollow and synapse on barrel-wall neurons whose dendrites are oriented toward the center of the barrel. Mice homozygous for the 'barrelless' (brl) mutation, which occurred spontaneously in Switzerland, failed to develop this patterned distribution of neurons, but still displayed normal topologic organization of the somatosensory cortex (Welker et al., 1996). Despite the absence of barrels and the overlapping zones of TCA arborization, the size of individual whisker representations, as judged by 2-deoxyglucose uptake, was similar to that of wildtype mice. Abdel-Majid et al. (1998) identified Adcy1 as the gene disrupted in brl mutant mice by fine mapping of proximal chromosome 11, enzyme assay, mutation analysis, and examination of mice homozygous for a targeted disruption of Adcy1. These results provided the first evidence for involvement of cAMP signaling pathways in pattern formation of the brain.

Full details of the abovementioned studies are described in the following publications, the disclosure of which are hereby incorporated by reference:

Edelhoff, S.; Villacres, E. C.; Storm, D. R.; Disteche, C. M.: Mapping of adenylyl cyclase genes type I, II, III, IV, V, and VI in mouse. Mammalian Genome 6:111-113, 1995; and Abdel-Majid, R. M.; Leong, W. L.; Schalkwy, L. C.; Smallman, D. S.; Wong, S. T.; Storm, D. R.; Fine, A.; Dobson, M. J.; Guernsey, D. L.; Neumann, P. E.: Loss of adenylyl cyclase I acti.

Further studies establishing the function and utilities of ADCY1 are found in John Hopkins OMIM database record ID 103072, and in cited publications listed in Table 5, which are hereby incorporated by reference. Adenylate cyclase 1 (brain) (ADCY1, Accession XP_166593.2) is another GAM144 target gene, herein designated TARGET GENE. ADCY1 BINDING SITE is a target binding site found in the 3' untranslated region of multiple transcripts of mRNA encoded by ADCY1, corresponding to a target binding site such as BINDING SITE I, BINDING SITE II or BINDING SITE III of FIG. 8. Table 4 illustrates the complementarity of the nucleotide sequences of ADCY1 BINDING SITE, designated SEQ ID:8386, to the nucleotide sequence of GAM144 RNA, herein designated GAM RNA, also designated SEQ ID:361.

Another function of GAM144 is therefore inhibition of Adenylate cyclase 1 (brain) (ADCY1, Accession XP_166593.2), a gene which a calmodulin-sensitive adenylyl cyclase. it may play a role in memory acquisition and learning. Accordingly, utilities of GAM144 include diagnosis, prevention and treatment of diseases and clinical conditions associated with ADCY1.

The function of ADCY1 has been established by previous studies. The neural- specific, calmodulin-sensitive adenylyl cyclase (OMIM Ref. No. type I), which was first cloned from bovine brain, has been implicated in learning and memory. Villacres et al. (1993) cloned the gene for human fetal brain type I adenylyl cyclase and showed by in situ hybridization that the gene lies in the region 7p13-p12. See 103070 and 103071 for genes encoding other forms of brain adenylyl cyclase. Gaudin et al. (1994) likewise mapped the ADCY1 gene to chromosome 7 by Southern blot analysis of somatic cell hybrid DNAs. By fluorescence in situ hybridization, Edelhoff et al. (1995) mapped the mouse homolog to chromosome 11 in the A2 region. The somatosensory cortex of mice displays a patterned, nonuniform distribution of neurons in layer IV called the 'barrelfield.' Thalamocortical afferents (TCAs) that terminate in layer IV are segregated such that each barrel, a readily visible cylindrical array of neurons surrounding a cell-sparse center, represents a distinct receptive field. TCA arbors are confined to the barrel hollow and synapse on barrel-wall neurons whose dendrites are oriented toward the center of the barrel. Mice homozygous for the 'barrelless' (brl) mutation, which occurred spontaneously in Switzerland, failed to develop this patterned distribution of neurons, but still displayed normal topologic organization of the somatosensory cortex (Welker et al., 1996). Despite the absence of barrels and the overlapping zones of TCA arborization, the size of individual whisker representations, as judged by 2-deoxyglucose uptake, was similar to that of wildtype mice. Abdel-Majid et al. (1998) identified Adcy1 as the gene disrupted in brl mutant mice by fine mapping of proximal chromosome 11, enzyme assay, mutation analysis, and examination of mice homozygous for a targeted disruption of Adcy1. These results provided the first evidence for involvement of cAMP signaling pathways in pattern formation of the brain.

Full details of the abovementioned studies are described in the following publications, the disclosure of which are hereby incorporated by reference:

Edelhoff, S.; Villacres, E. C.; Storm, D. R.; Disteche, C. M.: Mapping of adenylyl cyclase genes type I, II, III, IV, V, and VI in mouse. Mammalian Genome 6:111-113, 1995; and Abdel-Majid, R. M.; Leong, W. L.; Schalkwy, L. C.; Smallman, D. S.; Wong, S. T.; Storm, D. R.; Fine, A.; Dobson, M. J.; Guernsey, D. L.; Neumann, P. E.: Loss of adenylyl cyclase I acti.

Further studies establishing the function and utilities of ADCY1 are found in John Hopkins OMIM database record ID 103072, and in cited publications listed in Table 5, which are hereby incorporated by reference. Aldehyde dehydrogenase 3 family, member b2 (ALDH3B2, Accession NP_000686.1) is another GAM144 target gene, herein designated TARGET GENE. ALDH3B2 BINDING SITE is a target binding site found in the 3' untranslated region of mRNA encoded by ALDH3B2, corresponding to a target binding site such as BINDING SITE I, BINDING SITE II or BINDING SITE III of FIG. 8. Table 4 illustrates the complementarity of the nucleotide sequences of ALDH3B2 BINDING SITE, designated SEQ ID:3474, to the nucleotide sequence of GAM144 RNA, herein designated GAM RNA, also designated SEQ ID:361.

Another function of GAM144 is therefore inhibition of Aldehyde dehydrogenase 3 family, member b2 (ALDH3B2, Accession NP_000686.1), a gene which may play a role in alcohol detoxitation. Accordingly, utilities of GAM144 include diagnosis, prevention and treatment of diseases and clinical conditions associated with ALDH3B2.

The function of ALDH3B2 has been established by previous studies. See ALDH1 (OMIM Ref. No. 100640). Hsu et al. (1995) and Hsu and Chang (1996) reported the cloning, sequencing and expression of the human ALDH8 gene. Hsu et al. (1997) determined the structure of the ALDH7 (OMIM Ref. No. 600466) and ALDH8 genes. The ALDH7 gene spans about 20 kb of genomic DNA and contains 9 coding exons. The ALDH8 gene is over 10 kb long and contains at least 10 exons. The ALDH8 gene contains an in-frame stop codon at the seventeenth codon position from the first initiator methionine. The coding region of the ALDH7 gene shows about 86% nucleotide identity with the corresponding region of the ALDH8 gene. The numbers and positions of the introns of the 2 genes are conserved, suggesting that gene duplication is involved in the expansion of the ALDH gene family. The human ALDH7 and ALDH8 genes have a close evolutionary relationship with human ALDH3 (OMIM Ref. No. 100660). The International Radiation Hybrid Mapping Consortium mapped the ALDH8 gene to chromosome 11 (OMIM Ref. No. U37519).

Full details of the abovementioned studies are described in the following publications, the disclosure of which are hereby incorporated by reference:

Hsu, L. C.; Chang, W.-C.: Sequencing and expression of the human ALDH8 encoding a new member of the aldehyde dehydrogenase family. Gene 174:319-322, 1996; and Hsu, L. C.; Chang, W.-C.; Lin, S. W.; Yoshida, A.: Cloning and characterization of genes encoding four additional human aldehyde dehydrogenase isozymes. Adv. Exp. Med. Biol. 372:159-1.

Further studies establishing the function and utilities of ALDH3B2 are found in John Hopkins OMIM database record ID 601917, and in cited publications listed in Table 5, which are hereby incorporated by reference. APM1 (Accession NP_004788.1) is another GAM144 target gene, herein designated TARGET GENE. APM1 BINDING SITE is a target binding site found in the 3' untranslated region of mRNA encoded by APM1, corresponding to a target binding site such as BINDING SITE I, BINDING SITE II or BINDING SITE III of FIG. 8. Table 4 illustrates the complementarity of the nucleotide sequences of APM1 BINDING SITE, designated SEQ ID:2427, to the nucleotide sequence of GAM144 RNA, herein designated GAM RNA, also designated SEQ ID:361.

Another function of GAM144 is therefore inhibition of APM1 (Accession NP_004788.1). Accordingly, utilities of GAM144 include diagnosis, prevention and treatment of diseases and clinical conditions associated with APM1.

Branched chain aminotransferase 2, mitochondrial (BCAT2, Accession NP_001181.1) is another GAM144 target gene, herein designated TARGET GENE. BCAT2 BINDING SITE is a target binding site found in the 3' untranslated region of mRNA encoded by BCAT2, corresponding to a target binding site such as BINDING SITE I, BINDING SITE II or BINDING SITE III of FIG. 8. Table 4 illustrates the complementarity of the nucleotide sequences of BCAT2 BINDING SITE, designated SEQ ID:14160, to the nucleotide sequence of GAM144 RNA, herein designated GAM RNA, also designated SEQ ID:361.

Another function of GAM144 is therefore inhibition of Branched chain aminotransferase 2, mitochondrial (BCAT2, Accession NP_001181.1), a gene which catalyzes of the essential branched chain amino acids leucine, isoleucine, and valine and therefore may be associated with Hypervalinemia, hyperleucine- isoleucinemia. Accordingly, utilities of GAM144 include diagnosis, prevention and treatment of Hypervalinemia, hyperleucine-isoleucinemia, and of other diseases and clinical conditions associated with BCAT2.

The function of BCAT2 has been established by previous studies. Jones and Moore (1979) provisionally assigned the BCT1 gene to 12pter-q12. Naylor and Shows (1979, 1980) also assigned BCT1 to chromosome 12 and BCT2 (OMIM Ref. No. 113530) to chromosome 19. There may be 2 different clinical disorders due to defect of branched- chain amino acid transamination, hypervalinemia (OMIM Ref. No. 277100) and hyperleucine-isoleucinemia (OMIM Ref. No. 238340). Since there are 2 distinct BCATs (see OMIM Ref. No. 113530), it is possible that one is mutant in each of these 2 conditions.

Full details of the abovementioned studies are described in the following publications, the disclosure of which are hereby incorporated by reference:

Naylor, S. L.; Shows, T. B.: Branched-chain aminotransferase deficiency in Chinese hamster cells complemented by two independent genes on human chromosomes 12 and 19. Somat. Cell Genet. 6:641-652, 1980; and Ben-Yosef, T.; Eden, A.; Benvenisty, N.: Characterization of murine BCAT genes: Bcat1, a c-Myc target, and its homolog, Bcat2. Mammalian Genome 9: 595-597, 1998.

Further studies establishing the function and utilities of BCAT2 are found in John Hopkins OMIM database record ID 113530, and in cited publications listed in Table 5, which are hereby incorporated by reference. BCLG (Accession NP_620048.1) is another GAM144 target gene, herein designated TARGET GENE. BCLG BINDING SITE is a target binding site found in the 5' untranslated region of multiple transcripts of mRNA encoded by BCLG, corresponding to a target binding site such as BINDING SITE I, BINDING SITE II or BINDING SITE III of FIG. 8. Table 4 illustrates the complementarity of the nucleotide sequences of BCLG BINDING SITE, designated SEQ ID:16807, to the nucleotide sequence of GAM144 RNA, herein designated GAM RNA, also designated SEQ ID:361.

Another function of GAM144 is therefore inhibition of BCLG (Accession NP_620048.1). Accordingly, utilities of GAM144 include diagnosis, prevention and treatment of diseases and clinical conditions associated with BCLG.

BCLG (Accession NP_110393.1) is another GAM144 target gene, herein designated TARGET GENE. BCLG BINDING SITE is a target binding site found in the 5' untranslated region of multiple transcripts of mRNA encoded by BCLG, corresponding to a target binding site such as BINDING SITE I, BINDING SITE II or BINDING SITE III of FIG. 8. Table 4 illustrates the complementarity of the nucleotide sequences of BCLG BINDING SITE, designated SEQ ID:16807, to the nucleotide sequence of GAM144 RNA, herein designated GAM RNA, also designated SEQ ID:361.

Another function of GAM144 is therefore inhibition of BCLG (Accession NP_110393.1). Accordingly, utilities of GAM144 include diagnosis, prevention and treatment of diseases and clinical conditions associated with BCLG.

BMF (Accession NP_277038.1) is another GAM144 target gene, herein designated TARGET GENE. BMF BINDING SITE is a target binding site found in the 3' untranslated region of mRNA encoded by BMF, corresponding to a target binding site such as BINDING SITE I, BINDING SITE II or BINDING SITE III of FIG. 8. Table 4 illustrates the complementarity of the nucleotide sequences of BMF BINDING SITE, designated SEQ ID:9278, to the nucleotide sequence of GAM144 RNA, herein designated GAM RNA, also designated SEQ ID:361.

Another function of GAM144 is therefore inhibition of BMF (Accession NP_277038.1). Accordingly, utilities of GAM144 include diagnosis, prevention and treatment of diseases and clinical conditions associated with BMF.

BTF (Accession NP_055554.1) is another GAM144 target gene, herein designated TARGET GENE. BTF BINDING SITE is a target binding site found in the 3' untranslated region of mRNA encoded by BTF, corresponding to a target binding site such as BINDING SITE I, BINDING SITE II or BINDING SITE III of FIG. 8. Table 4 illustrates the complementarity of the nucleotide sequences of BTF BINDING SITE, designated SEQ ID:6208, to the nucleotide sequence of GAM144 RNA, herein designated GAM RNA, also designated SEQ ID:361.

Another function of GAM144 is therefore inhibition of BTF (Accession NP_055554.1). Accordingly, utilities of GAM144 include diagnosis, prevention and treatment of diseases and clinical conditions associated with BTF.

BY55 (Accession NP_008984.1) is another GAM144 target gene, herein designated TARGET GENE. BY55 BINDING SITE is a target binding site found in the 3' untranslated region of mRNA encoded by BY55, corresponding to a target binding site such as BINDING SITE I, BINDING SITE II or BINDING SITE III of FIG. 8. Table 4 illustrates the complementarity of the nucleotide sequences of BY55 BINDING SITE, designated SEQ ID:9405, to the nucleotide sequence of GAM144 RNA, herein designated GAM RNA, also designated SEQ ID:361.

Another function of GAM144 is therefore inhibition of BY55 (Accession NP_008984.1). Accordingly, utilities of GAM144 include diagnosis, prevention and treatment of diseases and clinical conditions associated with BY55.

C14orf69 (Accession NP_689546.1) is another GAM144 target gene, herein designated TARGET GENE. C14orf69 BINDING SITE1 and C14orf69 BINDING SITE2 are target binding sites found in untranslated regions of mRNA encoded by C14orf69, corresponding to target binding sites such as BINDING SITE I, BINDING SITE II or BINDING SITE III of FIG. 8. Table 4 illustrates the complementarity of the nucleotide sequences of C14orf69 BINDING SITE1 and C14orf69 BINDING SITE2, designated SEQ ID:15823 and SEQ ID:17914 respectively, to the nucleotide sequence of GAM144 RNA, herein designated GAM RNA, also designated SEQ ID:361.

Another function of GAM144 is therefore inhibition of C14orf69 (Accession NP_689546.1). Accordingly, utilities of GAM144 include diagnosis, prevention and treatment of diseases and clinical conditions associated with C14orf69.

Chromosome 1 open reading frame 19 (C1orf19, Accession NP_443197.1) is another GAM144 target gene, herein designated TARGET GENE. C1orf19 BINDING SITE is a target binding site found in the 3' untranslated region of mRNA encoded by C1orf19, corresponding to a target binding site such as BINDING SITE I, BINDING SITE II or BINDING SITE III of FIG. 8. Table 4 illustrates the complementarity of the nucleotide sequences of C1orf19 BINDING SITE, designated SEQ ID:9890, to the nucleotide sequence of GAM144 RNA, herein designated GAM RNA, also designated SEQ ID:361.

Another function of GAM144 is therefore inhibition of Chromosome 1 open reading frame 19 (C1orf19, Accession NP_443197.1). Accordingly, utilities of GAM144 include diagnosis, prevention and treatment of diseases and clinical conditions associated with C1orf19.

Chromosome 1 open reading frame 2 (C1orf2, Accession NP_006580.1) is another GAM144 target gene, herein designated TARGET GENE. C1orf2 BINDING SITE is a target binding site found in the 3' untranslated region of mRNA encoded by C1orf2, corresponding to a target binding site such as BINDING SITE I, BINDING SITE II or BINDING SITE III of FIG. 8. Table 4 illustrates the complementarity of the nucleotide sequences of C1orf2 BINDING SITE, designated SEQ ID:6438, to the nucleotide sequence of GAM144 RNA, herein designated GAM RNA, also designated SEQ ID:361.

Another function of GAM144 is therefore inhibition of Chromosome 1 open reading frame 2 (C1orf2, Accession NP_006580.1). Accordingly, utilities of GAM144 include diagnosis, prevention and treatment of diseases and clinical conditions associated with C1orf2.

Chromosome 21 open reading frame 29 (C21orf29, Accession NP_659428.2) is another GAM144 target gene, herein designated TARGET GENE. C21orf29 BINDING SITE is a target binding site found in the 3' untranslated region of mRNA encoded by C21orf29, corresponding to a target binding site such as BINDING SITE I, BINDING SITE II or BINDING SITE III of FIG. 8. Table 4 illustrates the complementarity of the nucleotide sequences of C21orf29 BINDING SITE, designated SEQ ID:14016, to the nucleotide sequence of GAM144 RNA, herein designated GAM RNA, also designated SEQ ID:361.

Another function of GAM144 is therefore inhibition of Chromosome 21 open reading frame 29 (C21orf29, Accession NP_659428.2). Accordingly, utilities of GAM144 include diagnosis, prevention and treatment of diseases and clinical conditions associated with C21orf29.

Chromosome 6 open reading frame 33 (C6orf33, Accession NP_588608.1) is another GAM144 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:4721, to the nucleotide sequence of GAM144 RNA, herein designated GAM RNA, also designated SEQ ID:361.

Another function of GAM144 is therefore inhibition of Chromosome 6 open reading frame 33 (C6orf33, Accession NP_588608.1). Accordingly, utilities of GAM144 include diagnosis, prevention and treatment of diseases and clinical conditions associated with C6orf33.

C6orf59 (Accession NP_079205.1) is another GAM144 target gene, herein designated TARGET GENE. C6orf59 BINDING SITE is a target binding site found in the 5' untranslated region of mRNA encoded by C6orf59, corresponding to a target binding site such as BINDING SITE I, BINDING SITE II or BINDING SITE III of FIG. 8. Table 4 illustrates the complementarity of the nucleotide sequences of C6orf59 BINDING SITE, designated SEQ ID:1948, to the nucleotide sequence of GAM144 RNA, herein designated GAM RNA, also designated SEQ ID:361.

Another function of GAM144 is therefore inhibition of C6orf59 (Accession NP_079205.1). Accordingly, utilities of GAM144 include diagnosis, prevention and treatment of diseases and clinical conditions associated with C6orf59.

C6orf64 (Accession NP_060792.1) is another GAM144 target gene, herein designated TARGET GENE. C6orf64 BINDING SITE is a target binding site found in the 3' untranslated region of mRNA encoded by C6orf64, corresponding to a target binding site such as BINDING SITE I, BINDING SITE II or BINDING SITE III of FIG. 8. Table 4 illustrates the complementarity of the nucleotide sequences of C6orf64 BINDING SITE, designated SEQ ID:3256, to the nucleotide sequence of GAM144 RNA, herein designated GAM RNA, also designated SEQ ID:361.

Another function of GAM144 is therefore inhibition of C6orf64 (Accession NP_060792.1). Accordingly, utilities of GAM144 include diagnosis, prevention and treatment of diseases and clinical conditions associated with C6orf64.

Chaperone, abc1 activity of bc1 complex like (s. pombe) (CABC1, Accession NP_064632.1) is another GAM144 target gene, herein designated TARGET GENE. CABC1 BINDING SITE is a target binding site found in the 3' untranslated region of mRNA encoded by CABC1, corresponding to a target binding site such as BINDING SITE I, BINDING SITE II or BINDING SITE III of FIG. 8. Table 4 illustrates the complementarity of the nucleotide sequences of CABC1 BINDING SITE, designated SEQ ID:5724, to the nucleotide sequence of GAM144 RNA, herein designated GAM RNA, also designated SEQ ID:361.

Another function of GAM144 is therefore inhibition of Chaperone, abc1 activity of bc1 complex like (s. pombe) (CABC1, Accession NP_064632.1). Accordingly, utilities of GAM144 include diagnosis, prevention and treatment of diseases and clinical conditions associated with CABC1.

Cd86 antigen (cd28 antigen ligand 2, b7-2 antigen) (CD86, Accession NP_787058.2) is another GAM144 target gene, herein designated TARGET GENE. CD86 BINDING SITE is a target binding site found in the 3' untranslated region of multiple transcripts of mRNA encoded by CD86, corresponding to a target binding site such as BINDING SITE I, BINDING SITE II or BINDING SITE III of FIG. 8. Table 4 illustrates the complementarity of the nucleotide sequences of CD86 BINDING SITE, designated SEQ ID:8499, to the nucleotide sequence of GAM144 RNA, herein designated GAM RNA, also designated SEQ ID:361.

Another function of GAM144 is therefore inhibition of Cd86 antigen (cd28 antigen ligand 2, b7-2 antigen) (CD86, Accession NP_787058.2), a gene which is a type I membrane protein of the immunoglobin superfamily and induces proliferation of T cells to antigens. Accordingly, utilities of GAM144 include diagnosis, prevention and treatment of diseases and clinical conditions associated with CD86.

The function of CD86 has been established by previous studies. Induction of an immune response requires that T cells receive 2 sets of signals from antigen-presenting cells. The first signal is delivered through the T-cell receptor complex, while the second is provided by the B-cell activation antigens B7-1, or CD80 (OMIM Ref. No. 112203), and B7-2, or CD86, by interaction with the T-cell surface molecules, CD28 (OMIM Ref. No. 186760) and CTLA4 (OMIM Ref. No. 123890). A cDNA for B7-2 was obtained by Freeman et al. (1993). B7-2 mRNA is constitutively expressed in unstimulated B cells. The predicted protein is a type I membrane protein of the immunoglobin superfamily Resting eosinophils express neither MHC class II proteins or costimulatory B7 molecules and fail to induce proliferation of T cells to antigens. Celestin et al. (2001) reported that IL3 (OMIM Ref. No. 147740) induces expression of HLA-DR and B7.2 on eosinophils, but, unlike IL5 (OMIM Ref. No. 147580) and GMCSF (CSF2; 138960), it does not induce expression of B7.1. IL3-treated eosinophils supported modest T-cell proliferation in response to superantigen toxic shock syndrome-1 antigen, as well as proliferation of HLA-DR-restricted T- cell clones to tetanus toxoid (TT) and influenza virus antigenic peptides. The response was blocked by anti-B7.2 monoclonal antibody. IL3-treated eosinophils were unable to present native TT antigen to either resting or TT-specific cloned T cells. Parallel experiments established that IL5 and GMCSF induce T-cell proliferation to peptides but not to native TT antigen. Celestin et al. (2001) suggested that eosinophils activated by IL3 may contribute to T-cell activation in allergic and parasitic diseases by presenting superantigens and peptides to T cells Full details of the abovementioned studies are described in the following publications, the disclosure of which are hereby incorporated by reference:

Freeman, G. J.; Gribben, J. G.; Boussiotis, V. A.; Ng, J. W.; Restivo, V. A.; Lombard, L. A.; Gray, G. S.; Nadler, L. M.: Cloning of B7-2: a CTLA-4 counter-receptor that costimulates human T cell proliferation. Science 262:909-911, 1993; and Celestin, J.; Rotschke, O.; Falk, K.; Ramesh, N.; Jabara, H.; Strominger, J.; Geha, R. S.: IL-3 induces B7.2 (CD86) expression and costimulatory activity in human eosinophils. J. Immun.

Further studies establishing the function and utilities of CD86 are found in John Hopkins OMIM database record ID 601020, and in cited publications listed in Table 5, which are hereby incorporated by reference. Cd86 antigen (cd28 antigen ligand 2, b7-2 antigen) (CD86, Accession NP_008820.1) is another GAM144 target gene, herein designated TARGET GENE. CD86 BINDING SITE is a target binding site found in the 3' untranslated region of multiple transcripts of mRNA encoded by CD86, corresponding to a target binding site such as BINDING SITE I, BINDING SITE II or BINDING SITE III of FIG. 8. Table 4 illustrates the complementarity of the nucleotide sequences of CD86 BINDING SITE, designated SEQ ID:8499, to the nucleotide sequence of GAM144 RNA, herein designated GAM RNA, also designated SEQ ID:361.

Another function of GAM144 is therefore inhibition of Cd86 antigen (cd28 antigen ligand 2, b7-2 antigen) (CD86, Accession NP_008820.1), a gene which is a type I membrane protein of the immunoglobin superfamily and induces proliferation of T cells to antigens. Accordingly, utilities of GAM144 include diagnosis, prevention and treatment of diseases and clinical conditions associated with CD86.

The function of CD86 has been established by previous studies. Induction of an immune response requires that T cells receive 2 sets of signals from antigen-presenting cells. The first signal is delivered through the T-cell receptor complex, while the second is provided by the B-cell activation antigens B7-1, or CD80 (OMIM Ref. No. 112203), and B7-2, or CD86, by interaction with the T-cell surface molecules, CD28 (OMIM Ref. No. 186760) and CTLA4 (OMIM Ref. No. 123890). A cDNA for B7-2 was obtained by Freeman et al. (1993). B7-2 mRNA is constitutively expressed in unstimulated B cells. The predicted protein is a type I membrane protein of the immunoglobin superfamily Resting eosinophils express neither MHC class II proteins or costimulatory B7 molecules and fail to induce proliferation of T cells to antigens. Celestin et al. (2001) reported that IL3 (OMIM Ref. No. 147740) induces expression of HLA-DR and B7.2 on eosinophils, but, unlike IL5 (OMIM Ref. No. 147580) and GMCSF (CSF2; 138960), it does not induce expression of B7.1. IL3-treated eosinophils supported modest T-cell proliferation in response to superantigen toxic shock syndrome-1 antigen, as well as proliferation of HLA-DR-restricted T- cell clones to tetanus toxoid (TT) and influenza virus antigenic peptides. The response was blocked by anti-B7.2 monoclonal antibody. IL3-treated eosinophils were unable to present native TT antigen to either resting or TT-specific cloned T cells. Parallel experiments established that IL5 and GMCSF induce T-cell proliferation to peptides but not to native TT antigen. Celestin et al. (2001) suggested that eosinophils activated by IL3 may contribute to T-cell activation in allergic and parasitic diseases by presenting superantigens and peptides to T cells Full details of the abovementioned studies are described in the following publications, the disclosure of which are hereby incorporated by reference:

Freeman, G. J.; Gribben, J. G.; Boussiotis, V. A.; Ng, J. W.; Restivo, V. A.; Lombard, L. A.; Gray, G. S.; Nadler, L. M.: Cloning of B7-2: a CTLA-4 counter-receptor that costimulates human T cell proliferation. Science 262:909-911, 1993; and Celestin, J.; Rotschke, O.; Falk, K.; Ramesh, N.; Jabara, H.; Strominger, J.; Geha, R. S.: IL-3 induces B7.2 (CD86) expression and costimulatory activity in human eosinophils. J. Immun.

Further studies establishing the function and utilities of CD86 are found in John Hopkins OMIM database record ID 601020, and in cited publications listed in Table 5, which are hereby incorporated by reference. Cdc42 effector protein (rho gtpase binding) 3 (CDC42EP3, Accession NP_006440.2) is another GAM144 target gene, herein designated TARGET GENE. CDC42EP3 BINDING SITE is a target binding site found in the 3' untranslated region of mRNA encoded by CDC42EP3, corresponding to a target binding site such as BINDING SITE I, BINDING SITE II or BINDING SITE III of FIG. 8. Table 4 illustrates the complementarity of the nucleotide sequences of CDC42EP3 BINDING SITE, designated SEQ ID:12629, to the nucleotide sequence of GAM144 RNA, herein designated GAM RNA, also designated SEQ ID:361.

Another function of GAM144 is therefore inhibition of Cdc42 effector protein (rho gtpase binding) 3 (CDC42EP3, Accession NP_006440.2). Accordingly, utilities of GAM144 include diagnosis, prevention and treatment of diseases and clinical conditions associated with CDC42EP3.

Cadherin 5, type 2, ve-cadherin (vascular epithelium) (CDH5, Accession NP_001786.1) is another GAM144 target gene, herein designated TARGET GENE. CDH5 BINDING SITE1 and CDH5 BINDING SITE2 are target binding sites found in untranslated regions of mRNA encoded by CDH5, corresponding to target binding sites such as BINDING SITE I, BINDING SITE II or BINDING SITE III of FIG. 8. Table 4 illustrates the complementarity of the nucleotide sequences of CDH5 BINDING SITE1 and CDH5 BINDING SITE2, designated SEQ ID:11221 and SEQ ID:19978 respectively, to the nucleotide sequence of GAM144 RNA, herein designated GAM RNA, also designated SEQ ID:361.

Another function of GAM144 is therefore inhibition of Cadherin 5, type 2, ve-cadherin (vascular epithelium) (CDH5, Accession NP_001786.1), a gene which associates with alpha-catenin forming a link to the cytoskeleton. Accordingly, utilities of GAM144 include diagnosis, prevention and treatment of diseases and clinical conditions associated with CDH5.

The function of CDH5 has been established by previous studies. Cadherins are calcium-dependent adhesive proteins that mediate cell- to - cell interaction. Huber et al. (1996) noted that they constitute an expanding family of receptors involved in the structural and functional organization of cells in various tissues. Members of the family include epithelial cadherin (E-cadherin; 192090), neural cadherin (N-cadherin; 114020), placental cadherin (P-cadherin; 114021), muscle cadherin (M-cadherin; 114019), and vascular endothelial cadherin (VE-cadherin, or CDH5). They share a common domain structure and primary sequence homologies. Each cadherin type has a unique tissue-distribution pattern. In most of them, expression is not restricted to 1 cell type, and more than 1 cadherin type may be found at the surface of a particular cell. The authors stated that endothelial cells have been shown to express N-cadherin, VE-cadherin, and to a lesser extent, P-cadherin. Among these, only VE-cadherin is expressed specifically in endothelial cells (Salomon et al., 1992). Furthermore, VE-cadherin is associated consistently with intercellular junctions, whereas N-cadherin remains diffuse on the cell membrane. In order to define the role of CDH5 and of its binding to beta-catenin (see OMIM Ref. No. 116806) in intracellular signaling, Carmeliet et al. (1999) generated mice that lacked a functional Cdh5 gene, that expressed a mutant Cdh5 gene lacking the beta-catenin-binding cytoplasmic tail, or that did not express detectable Cdh5 levels because of an intronic neomycin phosphotransferase (neo) gene. They found in all of these mice that deletion or truncation of the Cdh5 gene did not affect assembly of endothelial cells in vascular plexi, but did impair their subsequent remodeling and maturation, causing lethality at 9.5 days of gestation. Deficiency or truncation of Cdh5 induced endothelial apoptosis and abolished transmission of the endothelial survival signal by vascular endothelial growth factor A (VEGF; 192240) to AKT kinase (OMIM Ref. No. 164730) and BCL2 (OMIM Ref. No. 151430) via reduced complex formation with VEGF receptor-2 (OMIM Ref. No. 191306), beta-catenin, and phosphoinositide-3 kinase (see OMIM Ref. No. 171833). Thus, Carmeliet et al. (1999) concluded that CDH5/beta-catenin signaling controls endothelial survival.

Full details of the abovementioned studies are described in the following publications, the disclosure of which are hereby incorporated by reference:

Carmeliet, P.; Lampugnani, M.-G.; Moons, L.; Breviario, F.; Compernolle, V.; Bono, F.; Balconi, G.; Spagnuolo, R.; Oosthuyse, B.; Dewerchin, M.; Zanetti, A.; Angellilo, A.; and 11 others: Targeted deficiency of cytosolic truncation of the VE- cadherin gene in mice impairs VEGF-mediated endothelial survival and angiogenesis. Cell 98:147-157, 1999; and Huber, P.; Dalmon, J.; Engiles, J.; Breviario, F.; Gory, S.; Siracusa, L. D.; Buchberg, A. M.; Dejana, E.: Genomic structure and chromosomal mapping of the mouse VE-cadherin gene Cdh5.

Further studies establishing the function and utilities of CDH5 are found in John Hopkins OMIM database record ID 601120, and in cited publications listed in Table 5, which are hereby incorporated by reference. Cat eye syndrome chromosome region, candidate 7 (CECR7, Accession XP_086803.1) is another GAM144 target gene, herein designated TARGET GENE. CECR7 BINDING SITE is a target binding site found in the 5' untranslated region of mRNA encoded by CECR7, corresponding to a target binding site such as BINDING SITE I, BINDING SITE II or BINDING SITE III of FIG. 8. Table 4 illustrates the complementarity of the nucleotide sequences of CECR7 BINDING SITE, designated SEQ ID:8985, to the nucleotide sequence of GAM144 RNA, herein designated GAM RNA, also designated SEQ ID:361.

Another function of GAM144 is therefore inhibition of Cat eye syndrome chromosome region, candidate 7 (CECR7, Accession XP_086803.1). Accordingly, utilities of GAM144 include diagnosis, prevention and treatment of diseases and clinical conditions associated with CECR7.

Carbohydrate (chondroitin 6) sulfotransferase 3 (CHST3, Accession NP_004264.2) is another GAM144 target gene, herein designated TARGET GENE. CHST3 BINDING SITE1 and CHST3 BINDING SITE2 are target binding sites found in untranslated regions of mRNA encoded by CHST3, corresponding to target binding sites such as BINDING SITE I, BINDING SITE II or BINDING SITE III of FIG. 8. Table 4 illustrates the complementarity of the nucleotide sequences of CHST3 BINDING SITE1 and CHST3 BINDING SITE2, designated SEQ ID:16447 and SEQ ID:18607 respectively, to the nucleotide sequence of GAM144 RNA, herein designated GAM RNA, also designated SEQ ID:361.

Another function of GAM144 is therefore inhibition of Carbohydrate (chondroitin 6) sulfotransferase 3 (CHST3, Accession NP_004264.2). Accordingly, utilities of GAM144 include diagnosis, prevention and treatment of diseases and clinical conditions associated with CHST3.

Carbohydrate (n-acetylglucosamine 6-o) sulfotransferase 6 (CHST6, Accession NP_067628.1) is another GAM144 target gene, herein designated TARGET GENE. CHST6 BINDING SITE is a target binding site found in the 3' untranslated region of mRNA encoded by CHST6, corresponding to a target binding site such as BINDING SITE I, BINDING SITE II or BINDING SITE III of FIG. 8. Table 4 illustrates the complementarity of the nucleotide sequences of CHST6 BINDING SITE, designated SEQ ID:3167, to the nucleotide sequence of GAM144 RNA, herein designated GAM RNA, also designated SEQ ID:361.

Another function of GAM144 is therefore inhibition of Carbohydrate (n-acetylglucosamine 6-o) sulfotransferase 6 (CHST6, Accession NP_067628.1). Accordingly, utilities of GAM144 include diagnosis, prevention and treatment of diseases and clinical conditions associated with CHST6.

CLIPR-59 (Accession NP_056341.1) is another GAM144 target gene, herein designated TARGET GENE. CLIPR-59 BINDING SITE is a target binding site found in the 3' untranslated region of mRNA encoded by CLIPR-59, corresponding to a target binding site such as BINDING SITE I, BINDING SITE II or BINDING SITE III of FIG. 8. Table 4 illustrates the complementarity of the nucleotide sequences of CLIPR-59 BINDING SITE, designated SEQ ID:2842, to the nucleotide sequence of GAM144 RNA, herein designated GAM RNA, also designated SEQ ID:361.

Another function of GAM144 is therefore inhibition of CLIPR-59 (Accession NP_056341.1). Accordingly, utilities of GAM144 include diagnosis, prevention and treatment of diseases and clinical conditions associated with CLIPR-59.

Collagen, type xix, alpha 1 (COL19A1, Accession NP_001849.1) is another GAM144 target gene, herein designated TARGET GENE. COL19A1 BINDING SITE is a target binding site found in the 3' untranslated region of mRNA encoded by COL19A1, corresponding to a target binding site such as BINDING SITE I, BINDING SITE II or BINDING SITE III of FIG. 8. Table 4 illustrates the complementarity of the nucleotide sequences of COL19A1 BINDING SITE, designated SEQ ID:15138, to the nucleotide sequence of GAM144 RNA, herein designated GAM RNA, also designated SEQ ID:361.

Another function of GAM144 is therefore inhibition of Collagen, type xix, alpha 1 (COL19A1, Accession NP_001849.1), a gene which may act as a cross-bridge between fibrils and other extracellular matrix molecules. Accordingly, utilities of GAM144 include diagnosis, prevention and treatment of diseases and clinical conditions associated with COL19A1.

The function of COL19A1 and its association with various diseases and clinical conditions, has been established by previous studies, as described hereinabove with reference to GAM94.1. Collagen, type i, alpha 1 (COL1A1, Accession NP_000079.1) is another GAM144 target gene, herein designated TARGET GENE. COL1A1 BINDING SITE is a target binding site found in the 3' untranslated region of mRNA encoded by COL1A1, corresponding to a target binding site such as BINDING SITE I, BINDING SITE II or BINDING SITE III of FIG. 8. Table 4 illustrates the complementarity of the nucleotide sequences of COL1A1 BINDING SITE, designated SEQ ID:6641, to the nucleotide sequence of GAM144 RNA, herein designated GAM RNA, also designated SEQ ID:361.

Another function of GAM144 is therefore inhibition of Collagen, type i, alpha 1 (COL1A1, Accession NP_000079.1). Accordingly, utilities of GAM144 include diagnosis, prevention and treatment of diseases and clinical conditions associated with COL1A1.

D2S448 (Accession XP_056455.2) is another GAM144 target gene, herein designated TARGET GENE. D2S448 BINDING SITE is a target binding site found in the 3' untranslated region of mRNA encoded by D2S448, corresponding to a target binding site such as BINDING SITE I, BINDING SITE II or BINDING SITE III of FIG. 8. Table 4 illustrates the complementarity of the nucleotide sequences of D2S448 BINDING SITE, designated SEQ ID:9361, to the nucleotide sequence of GAM144 RNA, herein designated GAM RNA, also designated SEQ ID:361.

Another function of GAM144 is therefore inhibition of D2S448 (Accession XP_056455.2). Accordingly, utilities of GAM144 include diagnosis, prevention and treatment of diseases and clinical conditions associated with D2S448.

Deleted in colorectal carcinoma (DCC, Accession NP_005206.1) is another GAM144 target gene, herein designated TARGET GENE. DCC BINDING SITE is a target binding site found in the 3' untranslated region of mRNA encoded by DCC, corresponding to a target binding site such as BINDING SITE I, BINDING SITE II or BINDING SITE III of FIG. 8. Table 4 illustrates the complementarity of the nucleotide sequences of DCC BINDING SITE, designated SEQ ID:1702, to the nucleotide sequence of GAM144 RNA, herein designated GAM RNA, also designated SEQ ID:361.

Another function of GAM144 is therefore inhibition of Deleted in colorectal carcinoma (DCC, Accession NP_005206.1), a gene which may participate with other proteins in cell-cell and cell-matrix interactions. and therefore may be associated with Colorectal carcinomas. Accordingly, utilities of GAM144 include diagnosis, prevention and treatment of Colorectal carcinomas, and of other diseases and clinical conditions associated with DCC.

The function of DCC has been established by previous studies. Gotley et al. (1996) examined the expression of the DCC gene in colorectal cancers and metastases. Using RT-PCR, they detected DCC mRNA in all colonic tissue specimens through all stages of tumor development. Using monoclonal antibodies against DCC, they found DCC protein is abundant in normal human bladder and is detectable in colon, pancreas and kidney, but not in liver. DCC protein could be detected in varying abundance in all specimens of normal colonic mucosa analyzed as well as in all specimens of adenomatous polyps, colorectal carcinoma and colorectal liver metastases. In some patients, tumor tissue contained less DCC protein than the adjacent normal mucosa. Gotley et al.

(1996) found no cases of complete loss of DCC mRNA or protein in colon cancers or metastases. Axonal growth cones that cross the nervous system midline change their responsiveness to midline guidance cues: they become repelled by the repellent Slit (OMIM Ref. No. 603746) and simultaneously lose responsiveness to the attractant netrin. These mutually reinforcing changes help to expel growth cones from the midline by making a once-attractive environment appear repulsive. Stein and Tessier-Lavigne (2001) provided evidence that these 2 changes are causally linked: in the growth cones of embryonic Xenopus spinal axons, activation of the Slit receptor Roundabout (Robo; 602430) silences the attractive effect of netrin-1, but not its growth-stimulatory effect, through direct binding of the cytoplasmic domain of Robo to that of the netrin receptor DCC. Biologically, this hierarchical silencing mechanism helps to prevent a tug of war between attractive and repulsive signals in the growth cone that might cause confusion. Molecularly, silencing is enabled by a modular and interlocking design of the cytoplasmic domains of these potentially antagonistic receptors that predetermines the outcome of their simultaneous activation Full details of the abovementioned studies are described in the following publications, the disclosure of which are hereby incorporated by reference:

Stein, E.; Tessier-Lavigne, M.: Hierarchical organization of guidance receptors: silencing of netrin attraction by Slit through a Robo/DCC receptor complex. Science 291:1928-1938, 2001; and Jen, J.; Kim, H.; Piantadosi, S.; Liu, Z.-F.; Levitt, R. C.; Sistonen, P.; Kinzler, K. W.; Vogelstein, B.; Hamilton, S. R.: Allelic loss of chromosome 18q and prognosis in colorectal.

Further studies establishing the function and utilities of DCC are found in John Hopkins OMIM database record ID 120470, and in cited publications listed in Table 5, which are hereby incorporated by reference. DDX54 (Accession NP_076977.2) is another GAM144 target gene, herein designated TARGET GENE. DDX54 BINDING SITE is a target binding site found in the 3' untranslated region of mRNA encoded by DDX54, corresponding to a target binding site such as BINDING SITE I, BINDING SITE II or BINDING SITE III of FIG. 8. Table 4 illustrates the complementarity of the nucleotide sequences of DDX54 BINDING SITE, designated SEQ ID:11738, to the nucleotide sequence of GAM144 RNA, herein designated GAM RNA, also designated SEQ ID:361.

Another function of GAM144 is therefore inhibition of DDX54 (Accession NP_076977.2). Accordingly, utilities of GAM144 include diagnosis, prevention and treatment of diseases and clinical conditions associated with DDX54.

dJ55C23.6 (Accession NP_439896.1) is another GAM144 target gene, herein designated TARGET GENE. dJ55C23.6 BINDING SITE is a target binding site found in the 3' untranslated region of mRNA encoded by dJ55C23.6, corresponding to a target binding site such as BINDING SITE I, BINDING SITE II or BINDING SITE III of FIG. 8. Table 4 illustrates the complementarity of the nucleotide sequences of dJ55C23.6 BINDING SITE, designated SEQ ID:5224, to the nucleotide sequence of GAM144 RNA, herein designated GAM RNA, also designated SEQ ID:361.

Another function of GAM144 is therefore inhibition of dJ55C23.6 (Accession NP_439896.1). Accordingly, utilities of GAM144 include diagnosis, prevention and treatment of diseases and clinical conditions associated with dJ55C23.6.

DKFZP434C171 (Accession NP_056436.1) is another GAM144 target gene, herein designated TARGET GENE. DKFZP434C171 BINDING SITE1 and DKFZP434C171 BINDING SITE2 are target binding sites found in untranslated regions of mRNA encoded by DKFZP434C171, corresponding to target binding sites such as BINDING SITE I, BINDING SITE II or BINDING SITE III of FIG. 8. Table 4 illustrates the complementarity of the nucleotide sequences of DKFZP434C171 BINDING SITE1 and DKFZP434C171 BINDING SITE2, designated SEQ ID:4768 and SEQ ID:16009 respectively, to the nucleotide sequence of GAM144 RNA, herein designated GAM RNA, also designated SEQ ID:361.

Another function of GAM144 is therefore inhibition of DKFZP434C171 (Accession NP_056436.1). Accordingly, utilities of GAM144 include diagnosis, prevention and treatment of diseases and clinical conditions associated with DKFZP434C171.

DKFZP434D193 (Accession XP_114297.2) is another GAM144 target gene, herein designated TARGET GENE. DKFZP434D193 BINDING SITE is a target binding site found in the 3' untranslated region of mRNA encoded by DKFZP434D193, corresponding to a target binding site such as BINDING SITE I, BINDING SITE II or BINDING SITE III of FIG. 8. Table 4 illustrates the complementarity of the nucleotide sequences of DKFZP434D193 BINDING SITE, designated SEQ ID:19475, to the nucleotide sequence of GAM144 RNA, herein designated GAM RNA, also designated SEQ ID:361.

Another function of GAM144 is therefore inhibition of DKFZP434D193 (Accession XP_114297.2). Accordingly, utilities of GAM144 include diagnosis, prevention and treatment of diseases and clinical conditions associated with DKFZP434D193.

DKFZP586M0622 (Accession NP_056398.1) is another GAM144 target gene, herein designated TARGET GENE. DKFZP586M0622 BINDING SITE is a target binding site found in the 3' untranslated region of mRNA encoded by DKFZP586M0622, corresponding to a target binding site such as BINDING SITE I, BINDING SITE II or BINDING SITE III of FIG. 8. Table 4 illustrates the complementarity of the nucleotide sequences of DKFZP586M0622 BINDING SITE, designated SEQ ID:12078, to the nucleotide sequence of GAM144 RNA, herein designated GAM RNA, also designated SEQ ID:361.

Another function of GAM144 is therefore inhibition of DKFZP586M0622 (Accession NP_056398.1). Accordingly, utilities of GAM144 include diagnosis, prevention and treatment of diseases and clinical conditions associated with DKFZP586M0622.

DKFZp761P1010 (Accession NP_060893.1) is another GAM144 target gene, herein designated TARGET GENE. DKFZp761P1010 BINDING SITE is a target binding site found in the 3' untranslated region of mRNA encoded by DKFZp761P1010, corresponding to a target binding site such as BINDING SITE I, BINDING SITE II or BINDING SITE III of FIG. 8. Table 4 illustrates the complementarity of the nucleotide sequences of DKFZp761P1010 BINDING SITE, designated SEQ ID:14315, to the nucleotide sequence of GAM144 RNA, herein designated GAM RNA, also designated SEQ ID:361.

Another function of GAM144 is therefore inhibition of DKFZp761P1010 (Accession NP_060893.1). Accordingly, utilities of GAM144 include diagnosis, prevention and treatment of diseases and clinical conditions associated with DKFZp761P1010.

Dnaj (hsp40) homolog, subfamily c, member 8 (DNAJC8, Accession NP_055095.1) is another GAM144 target gene, herein designated TARGET GENE. DNAJC8 BINDING SITE is a target binding site found in the 3' untranslated region of mRNA encoded by DNAJC8, corresponding to a target binding site such as BINDING SITE I, BINDING SITE II or BINDING SITE III of FIG. 8. Table 4 illustrates the complementarity of the nucleotide sequences of DNAJC8 BINDING SITE, designated SEQ ID:20028, to the nucleotide sequence of GAM144 RNA, herein designated GAM RNA, also designated SEQ ID:361.

Another function of GAM144 is therefore inhibition of Dnaj (hsp40) homolog, subfamily c, member 8 (DNAJC8, Accession NP_055095.1). Accordingly, utilities of GAM144 include diagnosis, prevention and treatment of diseases and clinical conditions associated with DNAJC8.

Dna (cytosine-5-)-methyltransferase 3-like (DNMT3L, Accession NP_787063.1) is another GAM144 target gene, herein designated TARGET GENE. DNMT3L BINDING SITE is a target binding site found in the 5' untranslated region of multiple transcripts of mRNA encoded by DNMT3L, corresponding to a target binding site such as BINDING SITE I, BINDING SITE II or BINDING SITE III of FIG. 8. Table 4 illustrates the complementarity of the nucleotide sequences of DNMT3L BINDING SITE, designated SEQ ID:11497, to the nucleotide sequence of GAM144 RNA, herein designated GAM RNA, also designated SEQ ID:361.

Another function of GAM144 is therefore inhibition of Dna (cytosine-5-)-methyltransferase 3-like (DNMT3L, Accession NP_787063.1), a gene which plays a role in de novo methylation of CpG islands. Accordingly, utilities of GAM144 include diagnosis, prevention and treatment of diseases and clinical conditions associated with DNMT3L.

The function of DNMT3L has been established by previous studies. By database analysis, PCR with specific primers based on predicted and trapped exon sequences, and screening of testis, fetal liver, placenta, and thymus mRNA and cDNA libraries, Aapola et al. (2000) isolated a cDNA encoding DNMT3L. Sequence analysis predicted that the 387-amino acid protein contains a cysteine-rich region with a novel ADD (for ATRX (OMIM Ref. No. 300032), DNMT3, and DNMT3L) C2-C2 zinc finger motif near an imperfect PHD zinc finger with C4-C4. RT-PCR analysis detected highest expression of DNMT3L in testis, followed by ovary, thymus, and fetal thymus. Northern blot analysis failed to detected expression of DNMT3L. By genomic sequence analysis, Aapola et al. (2000) determined that the DNMT3L gene contains 12 exons and spans 16 kb. The translation initiation codon is in exon 2. The authors detected a splice variant lacking exon 8.

Animal model experiments lend further support to the function of DNMT3L. By disrupting homologous recombination in mouse embryonic stem cells, Bourc'his et al. (2001) generated viable but sterile mice with mutated Dnmt3l (termed Dnmt3lG) in which male testes had severe hypogonadism and a Sertoli cell-only phenotype. The heterozygous offspring of females with Dnmt3lG failed to develop past 9.5 days postcoitum due to embryonic rather than uterine defects. Bisulfite genomic sequence analysis of the differentially methylated region (DMR) of imprinted and maternally repressed genes such as Snrpn (OMIM Ref. No. 182279) detected undermethylation of oocytes from Dnmt3lG homozygous females, showing that Dnmt3l is required for the establishment of maternal methylation imprints. Heterozygous embryos from Dnmt3lG homozygotes displayed biallelic expression of genes that are normally expressed only from the allele of paternal origin. Bourc'his et al. (2001) concluded that DNMT3L is required specifically for the establishment of genomic imprints but is dispensable for their propagation, and it is essential for the de novo methylation of single-copy DNA sequences. The authors proposed that DNMT3L is likely to function as a regulator of methylation at imprinted loci rather than a DNA cytosine methyltransferase because of a lack of catalytic motifs in its sequence.

It is appreciated that the abovementioned animal model for DNMT3L is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aapola, U.; Shibuy, K.; Scott, H. S.; Ollila, J.; Vihinen, M.; Heino, M.; Shintani, A.; Kawasaki, K.; Minoshima, S.; Krohn, K.; Antonarakis, S. E.; Shimizu, N.; Kudoh, J.; Peterson, P.: Isolation and initial characterization of a novel zinc finger gene, DNMT3L, on 21q22.3, related to the cysteine-5-methyltransferase 3 gene family. Genomics 65:293-298, 2000; and Bourc'his, D.; Xu, G.-L.; Lin, C.-S.; Bollman, B.; Bestor, T. H.: Dnmt3L and the establishment of maternal genomic imprints. Science 294:2536-2539, 2001.

Further studies establishing the function and utilities of DNMT3L are found in John Hopkins OMIM database record ID 606588, and in cited publications listed in Table 5, which are hereby incorporated by reference. Dna (cytosine-5-)-methyltransferase 3-like (DNMT3L, Accession NP_037501.2) is another GAM144 target gene, herein designated TARGET GENE. DNMT3L BINDING SITE is a target binding site found in the 5' untranslated region of multiple transcripts of mRNA encoded by DNMT3L, corresponding to a target binding site such as BINDING SITE I, BINDING SITE II or BINDING SITE III of FIG. 8. Table 4 illustrates the complementarity of the nucleotide sequences of DNMT3L BINDING SITE, designated SEQ ID:11497, to the nucleotide sequence of GAM144 RNA, herein designated GAM RNA, also designated SEQ ID:361.

Another function of GAM144 is therefore inhibition of Dna (cytosine-5-)-methyltransferase 3-like (DNMT3L, Accession NP_037501.2), a gene which plays a role in de novo methylation of CpG islands. Accordingly, utilities of GAM144 include diagnosis, prevention and treatment of diseases and clinical conditions associated with DNMT3L.

The function of DNMT3L has been established by previous studies. By database analysis, PCR with specific primers based on predicted and trapped exon sequences, and screening of testis, fetal liver, placenta, and thymus mRNA and cDNA libraries, Aapola et al. (2000) isolated a cDNA encoding DNMT3L. Sequence analysis predicted that the 387-amino acid protein contains a cysteine-rich region with a novel ADD (for ATRX (OMIM Ref. No. 300032), DNMT3, and DNMT3L) C2-C2 zinc finger motif near an imperfect PHD zinc finger with C4-C4. RT-PCR analysis detected highest expression of DNMT3L in testis, followed by ovary, thymus, and fetal thymus. Northern blot analysis failed to detected expression of DNMT3L. By genomic sequence analysis, Aapola et al. (2000) determined that the DNMT3L gene contains 12 exons and spans 16 kb. The translation initiation codon is in exon 2. The authors detected a splice variant lacking exon 8.

Animal model experiments lend further support to the function of DNMT3L. By disrupting homologous recombination in mouse embryonic stem cells, Bourc'his et al. (2001) generated viable but sterile mice with mutated Dnmt3l (termed Dnmt3lG) in which male testes had severe hypogonadism and a Sertoli cell-only phenotype. The heterozygous offspring of females with Dnmt3lG failed to develop past 9.5 days postcoitum due to embryonic rather than uterine defects. Bisulfite genomic sequence analysis of the differentially methylated region (DMR) of imprinted and maternally repressed genes such as Snrpn (OMIM Ref. No. 182279) detected undermethylation of oocytes from Dnmt3lG homozygous females, showing that Dnmt3l is required for the establishment of maternal methylation imprints. Heterozygous embryos from Dnmt3lG homozygotes displayed biallelic expression of genes that are normally expressed only from the allele of paternal origin. Bourc'his et al. (2001) concluded that DNMT3L is required specifically for the establishment of genomic imprints but is dispensable for their propagation, and it is essential for the de novo methylation of single-copy DNA sequences. The authors proposed that DNMT3L is likely to function as a regulator of methylation at imprinted loci rather than a DNA cytosine methyltransferase because of a lack of catalytic motifs in its sequence.

It is appreciated that the abovementioned animal model for DNMT3L is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aapola, U.; Shibuy, K.; Scott, H. S.; Ollila, J.; Vihinen, M.; Heino, M.; Shintani, A.; Kawasaki, K.; Minoshima, S.; Krohn, K.; Antonarakis, S. E.; Shimizu, N.; Kudoh, J.; Peterson, P.: Isolation and initial characterization of a novel zinc finger gene, DNMT3L, on 21q22.3, related to the cysteine-5-methyltransferase 3 gene family. Genomics 65:293-298, 2000; and Bourc'his, D.; Xu, G.-L.; Lin, C.-S.; Bollman, B.; Bestor, T. H.: Dnmt3L and the establishment of maternal genomic imprints. Science 294:2536- 2539, 2001.

Further studies establishing the function and utilities of DNMT3L are found in John Hopkins OMIM database record ID 606588, and in cited publications listed in Table 5, which are hereby incorporated by reference. Dolichyl-phosphate mannosyltransferase polypeptide 2, regulatory subunit (DPM2, Accession NP_003854.1) is another GAM144 target gene, herein designated TARGET GENE. DPM2 BINDING SITE is a target binding site found in the 3' untranslated region of multiple transcripts of mRNA encoded by DPM2, corresponding to a target binding site such as BINDING SITE I, BINDING SITE II or BINDING SITE III of FIG. 8. Table 4 illustrates the complementarity of the nucleotide sequences of DPM2 BINDING SITE, designated SEQ ID:5244, to the nucleotide sequence of GAM144 RNA, herein designated GAM RNA, also designated SEQ ID:361.

Another function of GAM144 is therefore inhibition of Dolichyl-phosphate mannosyltransferase polypeptide 2, regulatory subunit (DPM2, Accession NP_003854.1). Accordingly, utilities of GAM144 include diagnosis, prevention and treatment of diseases and clinical conditions associated with DPM2.

Dolichyl-phosphate mannosyltransferase polypeptide 2, regulatory subunit (DPM2, Accession NP_689903.1) is another GAM144 target gene, herein designated TARGET GENE. DPM2 BINDING SITE is a target binding site found in the 3' untranslated region of multiple transcripts of mRNA encoded by DPM2, corresponding to a target binding site such as BINDING SITE I, BINDING SITE II or BINDING SITE III of FIG. 8. Table 4 illustrates the complementarity of the nucleotide sequences of DPM2 BINDING SITE, designated SEQ ID:5244, to the nucleotide sequence of GAM144 RNA, herein designated GAM RNA, also designated SEQ ID:361.

Another function of GAM144 is therefore inhibition of Dolichyl-phosphate mannosyltransferase polypeptide 2, regulatory subunit (DPM2, Accession NP_689903.1). Accordingly, utilities of GAM144 include diagnosis, prevention and treatment of diseases and clinical conditions associated with DPM2.

Egf-like-domain, multiple 4 (EGFL4, Accession XP_290821.1) is another GAM144 target gene, herein designated TARGET GENE. EGFL4 BINDING SITE is a target binding site found in the 3' untranslated region of mRNA encoded by EGFL4, corresponding to a target binding site such as BINDING SITE I, BINDING SITE II or BINDING SITE III of FIG. 8. Table 4 illustrates the complementarity of the nucleotide sequences of EGFL4 BINDING SITE, designated SEQ ID:2374, to the nucleotide sequence of GAM144 RNA, herein designated GAM RNA, also designated SEQ ID:361.

Another function of GAM144 is therefore inhibition of Egf-like-domain, multiple 4 (EGFL4, Accession XP_290821.1). Accordingly, utilities of GAM144 include diagnosis, prevention and treatment of diseases and clinical conditions associated with EGFL4.

EGFL7 (Accession NP_057299.1) is another GAM144 target gene, herein designated TARGET GENE. EGFL7 BINDING SITE is a target binding site found in the 5' untranslated region of mRNA encoded by EGFL7, corresponding to a target binding site such as BINDING SITE I, BINDING SITE II or BINDING SITE III of FIG. 8. Table 4 illustrates the complementarity of the nucleotide sequences of EGFL7 BINDING SITE, designated SEQ ID:12268, to the nucleotide sequence of GAM144 RNA, herein designated GAM RNA, also designated SEQ ID:361.

Another function of GAM144 is therefore inhibition of EGFL7 (Accession NP_057299.1). Accordingly, utilities of GAM144 include diagnosis, prevention and treatment of diseases and clinical conditions associated with EGFL7.

Eukaryotic translation initiation factor 4e binding protein 2 (EIF4EBP2, Accession NP_004087.1) is another GAM144 target gene, herein designated TARGET GENE. EIF4EBP2 BINDING SITE is a target binding site found in the 5' untranslated region of mRNA encoded by EIF4EBP2, corresponding to a target binding site such as BINDING SITE I, BINDING SITE II or BINDING SITE III of FIG. 8. Table 4 illustrates the complementarity of the nucleotide sequences of EIF4EBP2 BINDING SITE, designated SEQ ID:5134, to the nucleotide sequence of GAM144 RNA, herein designated GAM RNA, also designated SEQ ID:361.

Another function of GAM144 is therefore inhibition of Eukaryotic translation initiation factor 4e binding protein 2 (EIF4EBP2, Accession NP_004087.1), a gene which binds EIF4E and negatively regulates initiation of translation. and therefore may be associated with Cancers. Accordingly, utilities of GAM144 include diagnosis, prevention and treatment of Cancers, and of other diseases and clinical conditions associated with EIF4EBP2.

The function of EIF4EBP2 has been established by previous studies. Pause et al. (1994) reported that the 4EBP2 gene encodes a 120-amino acid polypeptide that is 56% identical to that of 4EBP1 (OMIM Ref. No. 602223). By Northern blot analysis, Tsukiyama-Kohara et al. (1996) showed that a major 3.5-kb transcript of 4EBP2 is expressed ubiquitously. Tsukiyama-Kohara et al. (1996) analyzed the genomic structure of the mouse EIF4EBP2 gene and showed that it consists of 3 exons and spans 20 kb. Its intron/exon structure is identical to that of EIF4EBP1. Using fluorescence in situ hybridization, Tsukiyama-Kohara et al. (1996) mapped the EIF4EBP2 gene to human chromosome 10q21-q22. They noted that chromosomal alterations in this region have been found in some human cancers. Tsukiyama-Kohara et al. (1996) mapped the mouse 4EBP2 gene to chromosome 10B4-B5.

Full details of the abovementioned studies are described in the following publications, the disclosure of which are hereby incorporated by reference:

Pause, A.; Belsham, G. J.; Gingras, A.-C.; Donze, O.; Lin, T.-A.; Lawrence, J. C., Jr.; Sonenberg, N.: Insulin-dependent stimulation of protein synthesis by phosphorylation of a regulator of 5-prime-cap function. Nature 371:762-767, 1994; and Tsukiyama-Kohara, K.; Vidal, S. M.; Gingras, A.-C.; Glover, T. W.; Hanash, S. M.; Heng, H.; Sonenberg, N.: Tissue distribution, genomic structure, and chromosome mapping of mouse and h.

Further studies establishing the function and utilities of EIF4EBP2 are found in John Hopkins OMIM database record ID 602224, and in cited publications listed in Table 5, which are hereby incorporated by reference. Eukaryotic translation initiation factor 5 (EIF5, Accession NP_001960.2) is another GAM144 target gene, herein designated TARGET GENE. EIF5 BINDING SITE is a target binding site found in the 5' untranslated region of mRNA encoded by EIF5, corresponding to a target binding site such as BINDING SITE I, BINDING SITE II or BINDING SITE III of FIG. 8. Table 4 illustrates the complementarity of the nucleotide sequences of EIF5 BINDING SITE, designated SEQ ID:4078, to the nucleotide sequence of GAM144 RNA, herein designated GAM RNA, also designated SEQ ID:361.

Another function of GAM144 is therefore inhibition of Eukaryotic translation initiation factor 5 (EIF5, Accession NP_001960.2). Accordingly, utilities of GAM144 include diagnosis, prevention and treatment of diseases and clinical conditions associated with EIF5.

Epithelial stromal interaction 1 (breast) (EPSTI1, Accession NP_150280.1) is another GAM144 target gene, herein designated TARGET GENE. EPSTI1 BINDING SITE is a target binding site found in the 5' untranslated region of mRNA encoded by EPSTI1, corresponding to a target binding site such as BINDING SITE I, BINDING SITE II or BINDING SITE III of FIG. 8. Table 4 illustrates the complementarity of the nucleotide sequences of EPSTI1 BINDING SITE, designated SEQ ID:846, to the nucleotide sequence of GAM144 RNA, herein designated GAM RNA, also designated SEQ ID:361.

Another function of GAM144 is therefore inhibition of Epithelial stromal interaction 1 (breast) (EPSTI1, Accession NP_150280.1). Accordingly, utilities of GAM144 include diagnosis, prevention and treatment of diseases and clinical conditions associated with EPSTI1.

Eyes absent homolog 4 (drosophila) (EYA4, Accession NP_004091.2) is another GAM144 target gene, herein designated TARGET GENE. EYA4 BINDING SITE is a target binding site found in the 5' untranslated region of multiple transcripts of mRNA encoded by EYA4, corresponding to a target binding site such as BINDING SITE I, BINDING SITE II or BINDING SITE III of FIG. 8. Table 4 illustrates the complementarity of the nucleotide sequences of EYA4 BINDING SITE, designated SEQ ID:5938, to the nucleotide sequence of GAM144 RNA, herein designated GAM RNA, also designated SEQ ID:361.

Another function of GAM144 is therefore inhibition of Eyes absent homolog 4 (drosophila) (EYA4, Accession NP_004091.2), a gene which may be involved in development of the eye (by similarity). and therefore is associated with Deafness, autosomal dominant nonsyndromic sensorineural 10. Accordingly, utilities of GAM144 include diagnosis, prevention and treatment of Deafness, autosomal dominant nonsyndromic sensorineural 10, and of other diseases and clinical conditions associated with EYA4.

The function of EYA4 has been established by previous studies. Borsani et al. (1999) presented the detailed characterization of a fourth vertebrate gene, designated EYA4, that is homologous to 'eyes absent' (eya), a key regulator of ocular development in Drosophila. See also EYA1 (OMIM Ref. No. 601653), EYA2 (OMIM Ref. No. 601654), and EYA3 (OMIM Ref. No. 601655). The authors found that EYA4 encodes a 640-amino acid protein containing a highly conserved C-terminal domain of 271 amino acids. In Drosophila, eya is known to mediate developmentally important protein-protein interactions. By radiation hybrid analysis and fluorescence in situ hybridization, Borsani et al. (1999) mapped the human EYA4 gene to 6q23. They also detected linkage, with a lod score of greater than 3, to previously mapped reference markers. They genetically mapped the mouse Eya4 gene to chromosome 10 in the vicinity of Aco2 (OMIM Ref. No. 100850), in a region homologous to human chromosome 6q22-q23. In the developing mouse embry, Eya4 was expressed primarily in the craniofacial mesenchyme, the dermamyotome, and the limb. On the basis of map position and expression pattern, EYA4 was considered a candidate for oculodentodigital dysplasia (OMIM Ref. No. 164200), but Borsani et al. (1999) found no EYA4 mutations in a panel of patients with this disorder. Wayne et al. (2001) identified mutations in the EYA4 gene that were responsible for postlingual, progressive, autosomal dominant hearing loss at the DFNA10 locus (OMIM Ref. No. 601316). Just as EYA proteins interact with members of the SIX (OMIM Ref. No. 601205) and DACH (OMIM Ref. No. 603803) protein families during early embryonic development, the authors suggested that EYA4 is also important postdevelopmentally for continued function of the mature organ of Corti.

Full details of the abovementioned studies are described in the following publications, the disclosure of which are hereby incorporated by reference:

Borsani, G.; DeGrandi, A.; Ballabio, A.; Bulfone, A.; Bernard, L.; Banfi, S.; Gattuso, C.; Mariani, M.; Dixon, M.; Donnai, D.; Metcalfe, K.; Winter, R.; Robertson, M.; Axton, R.; Brown, A.; van Heyningen, V.; Hanson, I.: EYA4, a novel vertebrate gene related to Drosophila eyes absent. Hum. Molec. Genet. 8:11-23, 1999; and Wayne, S.; Robertson, N. G.; DeClau, F.; Chen, N.; Verhoeven, K.; Prasad, S.; Tranebjarg, L.; Morton, C. C.; Ryan, A. F.; Van Camp, G.; Smith, R. J. H.: Mutations in the transcriptiona.

Further studies establishing the function and utilities of EYA4 are found in John Hopkins OMIM database record ID 603550, and in cited publications listed in Table 5, which are hereby incorporated by reference. Eyes absent homolog 4 (drosophila) (EYA4, Accession NP_742101.1) is another GAM144 target gene, herein designated TARGET GENE. EYA4 BINDING SITE is a target binding site found in the 5' untranslated region of multiple transcripts of mRNA encoded by EYA4, corresponding to a target binding site such as BINDING SITE I, BINDING SITE II or BINDING SITE III of FIG. 8. Table 4 illustrates the complementarity of the nucleotide sequences of EYA4 BINDING SITE, designated SEQ ID:5938, to the nucleotide sequence of GAM144 RNA, herein designated GAM RNA, also designated SEQ ID:361.

Another function of GAM144 is therefore inhibition of Eyes absent homolog 4 (drosophila) (EYA4, Accession NP_742101.1), a gene which may be involved in development of the eye (by similarity). and therefore is associated with Deafness, autosomal dominant nonsyndromic sensorineural 10. Accordingly, utilities of GAM144 include diagnosis, prevention and treatment of Deafness, autosomal dominant nonsyndromic sensorineural 10, and of other diseases and clinical conditions associated with EYA4.

The function of EYA4 has been established by previous studies. Borsani et al. (1999) presented the detailed characterization of a fourth vertebrate gene, designated EYA4, that is homologous to 'eyes absent' (eya), a key regulator of ocular development in Drosophila. See also EYA1 (OMIM Ref. No. 601653), EYA2 (OMIM Ref. No. 601654), and EYA3 (OMIM Ref. No. 601655). The authors found that EYA4 encodes a 640-amino acid protein containing a highly conserved C-terminal domain of 271 amino acids. In Drosophila, eya is known to mediate developmentally important protein-protein interactions. By radiation hybrid analysis and fluorescence in situ hybridization, Borsani et al. (1999) mapped the human EYA4 gene to 6q23. They also detected linkage, with a lod score of greater than 3, to previously mapped reference markers. They genetically mapped the mouse Eya4 gene to chromosome 10 in the vicinity of Aco2 (OMIM Ref. No. 100850), in a region homologous to human chromosome 6q22-q23. In the developing mouse embry, Eya4 was expressed primarily in the craniofacial mesenchyme, the dermamyotome, and the limb. On the basis of map position and expression pattern, EYA4 was considered a candidate for oculodentodigital dysplasia (OMIM Ref. No. 164200), but Borsani et al. (1999) found no EYA4 mutations in a panel of patients with this disorder. Wayne et al. (2001) identified mutations in the EYA4 gene that were responsible for postlingual, progressive, autosomal dominant hearing loss at the DFNA10 locus (OMIM Ref. No. 601316). Just as EYA proteins interact with members of the SIX (OMIM Ref. No. 601205) and DACH (OMIM Ref. No. 603803) protein families during early embryonic development, the authors suggested that EYA4 is also important postdevelopmentally for continued function of the mature organ of Corti.

Full details of the abovementioned studies are described in the following publications, the disclosure of which are hereby incorporated by reference:

Borsani, G.; DeGrandi, A.; Ballabio, A.; Bulfone, A.; Bernard, L.; Banfi, S.; Gattuso, C.; Mariani, M.; Dixon, M.; Donnai, D.; Metcalfe, K.; Winter, R.; Robertson, M.; Axton, R.; Brown, A.; van Heyningen, V.; Hanson, I.: EYA4, a novel vertebrate gene related to Drosophila eyes absent. Hum. Molec. Genet. 8:11-23, 1999; and Wayne, S.; Robertson, N. G.; DeClau, F.; Chen, N.; Verhoeven, K.; Prasad, S.; Tranebjarg, L.; Morton, C. C.; Ryan, A. F.; Van Camp, G.; Smith, R. J. H.: Mutations in the transcriptiona.

Further studies establishing the function and utilities of EYA4 are found in John Hopkins OMIM database record ID 603550, and in cited publications listed in Table 5, which are hereby incorporated by reference. Eyes absent homolog 4 (drosophila) (EYA4, Accession NP_742102.1) is another GAM144 target gene, herein designated TARGET GENE. EYA4 BINDING SITE is a target binding site found in the 5' untranslated region of multiple transcripts of mRNA encoded by EYA4, corresponding to a target binding site such as BINDING SITE I, BINDING SITE II or BINDING SITE III of FIG. 8. Table 4 illustrates the complementarity of the nucleotide sequences of EYA4 BINDING SITE, designated SEQ ID:5938, to the nucleotide sequence of GAM144 RNA, herein designated GAM RNA, also designated SEQ ID:361.

Another function of GAM144 is therefore inhibition of Eyes absent homolog 4 (drosophila) (EYA4, Accession NP_742102.1), a gene which may be involved in development of the eye (by similarity). and therefore is associated with Deafness, autosomal dominant nonsyndromic sensorineural 10. Accordingly, utilities of GAM144 include diagnosis, prevention and treatment of Deafness, autosomal dominant nonsyndromic sensorineural 10, and of other diseases and clinical conditions associated with EYA4.

The function of EYA4 has been established by previous studies. Borsani et al. (1999) presented the detailed characterization of a fourth vertebrate gene, designated EYA4, that is homologous to 'eyes absent' (eya), a key regulator of ocular development in Drosophila. See also EYA1 (OMIM Ref. No. 601653), EYA2 (OMIM Ref. No. 601654), and EYA3 (OMIM Ref. No. 601655). The authors found that EYA4 encodes a 640-amino acid protein containing a highly conserved C-terminal domain of 271 amino acids. In Drosophila, eya is known to mediate developmentally important protein-protein interactions. By radiation hybrid analysis and fluorescence in situ hybridization, Borsani et al. (1999) mapped the human EYA4 gene to 6q23. They also detected linkage, with a lod score of greater than 3, to previously mapped reference markers. They genetically mapped the mouse Eya4 gene to chromosome 10 in the vicinity of Aco2 (OMIM Ref. No. 100850), in a region homologous to human chromosome 6q22-q23. In the developing mouse embry, Eya4 was expressed primarily in the craniofacial mesenchyme, the dermamyotome, and the limb. On the basis of map position and expression pattern, EYA4 was considered a candidate for oculodentodigital dysplasia (OMIM Ref. No. 164200), but Borsani et al. (1999) found no EYA4 mutations in a panel of patients with this disorder. Wayne et al. (2001) identified mutations in the EYA4 gene that were responsible for postlingual, progressive, autosomal dominant hearing loss at the DFNA10 locus (OMIM Ref. No. 601316). Just as EYA proteins interact with members of the SIX (OMIM Ref. No. 601205) and DACH (OMIM Ref. No. 603803) protein families during early embryonic development, the authors suggested that EYA4 is also important postdevelopmentally for continued function of the mature organ of Corti.

Full details of the abovementioned studies are described in the following publications, the disclosure of which are hereby incorporated by reference:

Borsani, G.; DeGrandi, A.; Ballabio, A.; Bulfone, A.; Bernard, L.; Banfi, S.; Gattuso, C.; Mariani, M.; Dixon, M.; Donnai, D.; Metcalfe, K.; Winter, R.; Robertson, M.; Axton, R.; Brown, A.; van Heyningen, V.; Hanson, I.: EYA4, a novel vertebrate gene related to Drosophila eyes absent. Hum. Molec. Genet. 8:11-23, 1999; and Wayne, S.; Robertson, N. G.; DeClau, F.; Chen, N.; Verhoeven, K.; Prasad, S.; Tranebjarg, L.; Morton, C. C.; Ryan, A. F.; Van Camp, G.; Smith, R. J. H.: Mutations in the transcriptiona.

Further studies establishing the function and utilities of EYA4 are found in John Hopkins OMIM database record ID 603550, and in cited publications listed in Table 5, which are hereby incorporated by reference. Eyes absent homolog 4 (drosophila) (EYA4, Accession NP_742103.1) is another GAM144 target gene, herein designated TARGET GENE. EYA4 BINDING SITE is a target binding site found in the 5' untranslated region of multiple transcripts of mRNA encoded by EYA4, corresponding to a target binding site such as BINDING SITE I, BINDING SITE II or BINDING SITE III of FIG. 8. Table 4 illustrates the complementarity of the nucleotide sequences of EYA4 BINDING SITE, designated SEQ ID:5938, to the nucleotide sequence of GAM144 RNA, herein designated GAM RNA, also designated SEQ ID:361.

Another function of GAM144 is therefore inhibition of Eyes absent homolog 4 (drosophila) (EYA4, Accession NP_742103.1), a gene which may be involved in development of the eye (by similarity). and therefore is associated with Deafness, autosomal dominant nonsyndromic sensorineural 10. Accordingly, utilities of GAM144 include diagnosis, prevention and treatment of Deafness, autosomal dominant nonsyndromic sensorineural 10, and of other diseases and clinical conditions associated with EYA4.

The function of EYA4 has been established by previous studies. Borsani et al. (1999) presented the detailed characterization of a fourth vertebrate gene, designated EYA4, that is homologous to 'eyes absent' (eya), a key regulator of ocular development in Drosophila. See also EYA1 (OMIM Ref. No. 601653), EYA2 (OMIM Ref. No. 601654), and EYA3 (OMIM Ref. No. 601655). The authors found that EYA4 encodes a 640-amino acid protein containing a highly conserved C-terminal domain of 271 amino acids. In Drosophila, eya is known to mediate developmentally important protein-protein interactions. By radiation hybrid analysis and fluorescence in situ hybridization, Borsani et al. (1999) mapped the human EYA4 gene to 6q23. They also detected linkage, with a lod score of greater than 3, to previously mapped reference markers. They genetically mapped the mouse Eya4 gene to chromosome 10 in the vicinity of Aco2 (OMIM Ref. No. 100850), in a region homologous to human chromosome 6q22-q23. In the developing mouse embry, Eya4 was expressed primarily in the craniofacial mesenchyme, the dermamyotome, and the limb. On the basis of map position and expression pattern, EYA4 was considered a candidate for oculodentodigital dysplasia (OMIM Ref. No. 164200), but Borsani et al. (1999) found no EYA4 mutations in a panel of patients with this disorder. Wayne et al. (2001) identified mutations in the EYA4 gene that were responsible for postlingual, progressive, autosomal dominant hearing loss at the DFNA10 locus (OMIM Ref. No. 601316). Just as EYA proteins interact with members of the SIX (OMIM Ref. No. 601205) and DACH (OMIM Ref. No. 603803) protein families during early embryonic development, the authors suggested that EYA4 is also important postdevelopmentally for continued function of the mature organ of Corti.

Full details of the abovementioned studies are described in the following publications, the disclosure of which are hereby incorporated by reference:

Borsani, G.; DeGrandi, A.; Ballabio, A.; Bulfone, A.; Bernard, L.; Banfi, S.; Gattuso, C.; Mariani, M.; Dixon, M.; Donnai, D.; Metcalfe, K.; Winter, R.; Robertson, M.; Axton, R.; Brown, A.; van Heyningen, V.; Hanson, I.: EYA4, a novel vertebrate gene related to Drosophila eyes absent. Hum. Molec. Genet. 8:11-23, 1999; and Wayne, S.; Robertson, N. G.; DeClau, F.; Chen, N.; Verhoeven, K.; Prasad, S.; Tranebjarg, L.; Morton, C. C.; Ryan, A. F.; Van Camp, G.; Smith, R. J. H.: Mutations in the transcriptiona.

Further studies establishing the function and utilities of EYA4 are found in John Hopkins OMIM database record ID 603550, and in cited publications listed in Table 5, which are hereby incorporated by reference. Fatty-acid-coenzyme a ligase, long-chain 1 (FACL1, Accession NP_001986.1) is another GAM144 target gene, herein designated TARGET GENE. FACL1 BINDING SITE is a target binding site found in the 3' untranslated region of mRNA encoded by FACL1, corresponding to a target binding site such as BINDING SITE I, BINDING SITE II or BINDING SITE III of FIG. 8. Table 4 illustrates the complementarity of the nucleotide sequences of FACL1 BINDING SITE, designated SEQ ID:7139, to the nucleotide sequence of GAM144 RNA, herein designated GAM RNA, also designated SEQ ID:361.

Another function of GAM144 is therefore inhibition of Fatty-acid-coenzyme a ligase, long-chain 1 (FACL1, Accession NP_001986.1) . Accordingly, utilities of GAM144 include diagnosis, prevention and treatment of diseases and clinical conditions associated with FACL1.

Fatty-acid-coenzyme a ligase, long-chain 2 (FACL2, Accession NP_066945.1) is another GAM144 target gene, herein designated TARGET GENE. FACL2 BINDING SITE is a target binding site found in the 3' untranslated region of mRNA encoded by FACL2, corresponding to a target binding site such as BINDING SITE I, BINDING SITE II or BINDING SITE III of FIG. 8. Table 4 illustrates the complementarity of the nucleotide sequences of FACL2 BINDING SITE, designated SEQ ID:7139, to the nucleotide sequence of GAM144 RNA, herein designated GAM RNA, also designated SEQ ID:361.

Another function of GAM144 is therefore inhibition of Fatty-acid-coenzyme a ligase, long-chain 2 (FACL2, Accession NP_066945.1), a gene which activates long-chain fatty acids for both synthesis of cellular lipids. Accordingly, utilities of GAM144 include diagnosis, prevention and treatment of diseases and clinical conditions associated with FACL2.

The function of FACL2 has been established by previous studies. See 152425. Minoshima et al. (1991) isolated a human cDNA for a long-chain acyl- CoA synthetase from a human liver cDNA library using the rat cDNA as a probe. Using flow- sorted human chromosomes, they demonstrated that the gene, now designated FACL2, is located on human chromosome 4. Cantu et al. (1995) mapped FACL2 to 4q34-q35 by fluorescence in situ hybridization.

Full details of the abovementioned studies are described in the following publications, the disclosure of which are hereby incorporated by reference:

Cantu, E. S.; Sprinkle, T. J.; Ghosh, B.; Singh, I.: The human palmitoyl-CoA ligase (FACL2) gene maps to the chromosome 4q34-q35 region by fluorescence in situ hybridization (FISH) and somatic cell hybrid panels. Genomics 28:600-602, 1995; and Minoshima, S.; Fukuyama, R.; Yamamoto, T.; Shimizu, N.: Mapping of human long-chain acyl-CoA synthetase to chromosome 4. (Abstract) Cytogenet. Cell Genet. 58:1888 only, 1991.

Further studies establishing the function and utilities of FACL2 are found in John Hopkins OMIM database record ID 152426, and in cited publications listed in Table 5, which are hereby incorporated by reference. Fanconi anemia, complementation group a (FANCA, Accession NP_000126.1) is another GAM144 target gene, herein designated TARGET GENE. FANCA BINDING SITE is a target binding site found in the 3' untranslated region of mRNA encoded by FANCA, corresponding to a target binding site such as BINDING SITE I, BINDING SITE II or BINDING SITE III of FIG. 8. Table 4 illustrates the complementarity of the nucleotide sequences of FANCA BINDING SITE, designated SEQ ID:5437, to the nucleotide sequence of GAM144 RNA, herein designated GAM RNA, also designated SEQ ID:361.

Another function of GAM144 is therefore inhibition of Fanconi anemia, complementation group a (FANCA, Accession NP_000126.1). Accordingly, utilities of GAM144 include diagnosis, prevention and treatment of diseases and clinical conditions associated with FANCA.

Fibroblast growth factor 23 (FGF23, Accession NP_065689.1) is another GAM144 target gene, herein designated TARGET GENE. FGF23 BINDING SITE is a target binding site found in the 3' untranslated region of mRNA encoded by FGF23, corresponding to a target binding site such as BINDING SITE I, BINDING SITE II or BINDING SITE III of FIG. 8. Table 4 illustrates the complementarity of the nucleotide sequences of FGF23 BINDING SITE, designated SEQ ID:15801, to the nucleotide sequence of GAM144 RNA, herein designated GAM RNA, also designated SEQ ID:361.

Another function of GAM144 is therefore inhibition of Fibroblast growth factor 23 (FGF23, Accession NP_065689.1), a gene which a member of the fibroblast growth factor family. And therefore is associated with Autosomal dominant hypophosphatemic rickets. Accordingly, utilities of GAM144 include diagnosis, prevention and treatment of Autosomal dominant hypophosphatemic rickets, and of other diseases and clinical conditions associated with FGF23.

The function of FGF23 and its association with various diseases and clinical conditions, has been established by previous studies, as described hereinabove with reference to GAM47.1. FLJ00001 (Accession XP_088525.2) is another GAM144 target gene, herein designated TARGET GENE. FLJ00001 BINDING SITE is a target binding site found in the 3' untranslated region of mRNA encoded by FLJ00001, corresponding to a target binding site such as BINDING SITE I, BINDING SITE II or BINDING SITE III of FIG. 8. Table 4 illustrates the complementarity of the nucleotide sequences of FLJ00001 BINDING SITE, designated SEQ ID:6835, to the nucleotide sequence of GAM144 RNA, herein designated GAM RNA, also designated SEQ ID:361.

Another function of GAM144 is therefore inhibition of FLJ00001 (Accession XP_088525.2). Accordingly, utilities of GAM144 include diagnosis, prevention and treatment of diseases and clinical conditions associated with FLJ00001.

FLJ00024 (Accession NP_203745.1) is another GAM144 target gene, herein designated TARGET GENE. FLJ00024 BINDING SITE is a target binding site found in the 5' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:18861, to the nucleotide sequence of GAM144 RNA, herein designated GAM RNA, also designated SEQ ID:361.

Another function of GAM144 is therefore inhibition of FLJ00024 (Accession NP_203745.1). Accordingly, utilities of GAM144 include diagnosis, prevention and treatment of diseases and clinical conditions associated with FLJ00024.

FLJ00024 (Accession XP_033361.2) is another GAM144 target gene, herein designated TARGET GENE. FLJ00024 BINDING SITE is a target binding site found in the 5' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:18861, to the nucleotide sequence of GAM144 RNA, herein designated GAM RNA, also designated SEQ ID:361.

Another function of GAM144 is therefore inhibition of FLJ00024 (Accession XP_033361.2). Accordingly, utilities of GAM144 include diagnosis, prevention and treatment of diseases and clinical conditions associated with FLJ00024.

FLJ10450 (Accession NP_060565.2) is another GAM144 target gene, herein designated TARGET GENE. FLJ10450 BINDING SITE is a target binding site found in the 3' untranslated region of mRNA encoded by FLJ10450, corresponding to a target binding site such as BINDING SITE I, BINDING SITE II or BINDING SITE III of FIG. 8. Table 4 illustrates the complementarity of the nucleotide sequences of FLJ10450 BINDING SITE, designated SEQ ID:11597, to the nucleotide sequence of GAM144 RNA, herein designated GAM RNA, also designated SEQ ID:361.

Another function of GAM144 is therefore inhibition of FLJ10450 (Accession NP_060565.2). Accordingly, utilities of GAM144 include diagnosis, prevention and treatment of diseases and clinical conditions associated with FLJ10450.

FLJ11036 (Accession NP_060776.2) is another GAM144 target gene, herein designated TARGET GENE. FLJ11036 BINDING SITE is a target binding site found in the 5' untranslated region of mRNA encoded by FLJ11036, corresponding to a target binding site such as BINDING SITE I, BINDING SITE II or BINDING SITE III of FIG. 8. Table 4 illustrates the complementarity of the nucleotide sequences of FLJ11036 BINDING SITE, designated SEQ ID:14811, to the nucleotide sequence of GAM144 RNA, herein designated GAM RNA, also designated SEQ ID:361.

Another function of GAM144 is therefore inhibition of FLJ11036 (Accession NP_060776.2). Accordingly, utilities of GAM144 include diagnosis, prevention and treatment of diseases and clinical conditions associated with FLJ11036.

FLJ12488 (Accession NP_112495.1) is another GAM144 target gene, herein designated TARGET GENE. FLJ12488 BINDING SITE is a target binding site found in the 3' untranslated region of mRNA encoded by FLJ12488, corresponding to a target binding site such as BINDING SITE I, BINDING SITE II or BINDING SITE III of FIG. 8. Table 4 illustrates the complementarity of the nucleotide sequences of FLJ12488 BINDING SITE, designated SEQ ID:17886, to the nucleotide sequence of GAM144 RNA, herein designated GAM RNA, also designated SEQ ID:361.

Another function of GAM144 is therefore inhibition of FLJ12488 (Accession NP_112495.1). Accordingly, utilities of GAM144 include diagnosis, prevention and treatment of diseases and clinical conditions associated with FLJ12488.

FLJ12552 (Accession NP_073743.2) is another GAM144 target gene, herein designated TARGET GENE. FLJ12552 BINDING SITE is a target binding site found in the 3' untranslated region of mRNA encoded by FLJ12552, corresponding to a target binding site such as BINDING SITE I, BINDING SITE II or BINDING SITE III of FIG. 8. Table 4 illustrates the complementarity of the nucleotide sequences of FLJ12552 BINDING SITE, designated SEQ ID:9222, to the nucleotide sequence of GAM144 RNA, herein designated GAM RNA, also designated SEQ ID:361.

Another function of GAM144 is therefore inhibition of FLJ12552 (Accession NP_073743.2). Accordingly, utilities of GAM144 include diagnosis, prevention and treatment of diseases and clinical conditions associated with FLJ12552.

FLJ13204 (Accession NP_079037.2) is another GAM144 target gene, herein designated TARGET GENE. FLJ13204 BINDING SITE is a target binding site found in the 3' untranslated region of mRNA encoded by FLJ13204, corresponding to a target binding site such as BINDING SITE I, BINDING SITE II or BINDING SITE III of FIG. 8. Table 4 illustrates the complementarity of the nucleotide sequences of FLJ13204 BINDING SITE, designated SEQ ID:4763, to the nucleotide sequence of GAM144 RNA, herein designated GAM RNA, also designated SEQ ID:361.

Another function of GAM144 is therefore inhibition of FLJ13204 (Accession NP_079037.2). Accordingly, utilities of GAM144 include diagnosis, prevention and treatment of diseases and clinical conditions associated with FLJ13204.

FLJ13441 (Accession NP_076413.1) is another GAM144 target gene, herein designated TARGET GENE. FLJ13441 BINDING SITE is a target binding site found in the 3' untranslated region of mRNA encoded by FLJ13441, corresponding to a target binding site such as BINDING SITE I, BINDING SITE II or BINDING SITE III of FIG. 8. Table 4 illustrates the complementarity of the nucleotide sequences of FLJ13441 BINDING SITE, designated SEQ ID:7854, to the nucleotide sequence of GAM144 RNA, herein designated GAM RNA, also designated SEQ ID:361.

Another function of GAM144 is therefore inhibition of FLJ13441 (Accession NP_076413.1). Accordingly, utilities of GAM144 include diagnosis, prevention and treatment of diseases and clinical conditions associated with FLJ13441.

FLJ13848 (Accession NP_079047.1) is another GAM144 target gene, herein designated TARGET GENE. FLJ13848 BINDING SITE is a target binding site found in the 3' untranslated region of mRNA encoded by FLJ13848, corresponding to a target binding site such as BINDING SITE I, BINDING SITE II or BINDING SITE III of FIG. 8. Table 4 illustrates the complementarity of the nucleotide sequences of FLJ13848 BINDING SITE, designated SEQ ID:1687, to the nucleotide sequence of GAM144 RNA, herein designated GAM RNA, also designated SEQ ID:361.

Another function of GAM144 is therefore inhibition of FLJ13848 (Accession NP_079047.1). Accordingly, utilities of GAM144 include diagnosis, prevention and treatment of diseases and clinical conditions associated with FLJ13848.

FLJ14106 (Accession NP_079343.1) is another GAM144 target gene, herein designated TARGET GENE. FLJ14106 BINDING SITE is a target binding site found in the 5' untranslated region of mRNA encoded by FLJ14106, corresponding to a target binding site such as BINDING SITE I, BINDING SITE II or BINDING SITE III of FIG. 8. Table 4 illustrates the complementarity of the nucleotide sequences of FLJ14106 BINDING SITE, designated SEQ ID:589, to the nucleotide sequence of GAM144 RNA, herein designated GAM RNA, also designated SEQ ID:361.

Another function of GAM144 is therefore inhibition of FLJ14106 (Accession NP_079343.1). Accordingly, utilities of GAM144 include diagnosis, prevention and treatment of diseases and clinical conditions associated with FLJ14106.

FLJ14457 (Accession NP_116177.1) is another GAM144 target gene, herein designated TARGET GENE. FLJ14457 BINDING SITE is a target binding site found in the 3' untranslated region of mRNA encoded by FLJ14457, corresponding to a target binding site such as BINDING SITE I, BINDING SITE II or BINDING SITE III of FIG. 8. Table 4 illustrates the complementarity of the nucleotide sequences of FLJ14457 BINDING SITE, designated SEQ ID:11171, to the nucleotide sequence of GAM144 RNA, herein designated GAM RNA, also designated SEQ ID:361.

Another function of GAM144 is therefore inhibition of FLJ14457 (Accession NP_116177.1). Accordingly, utilities of GAM144 include diagnosis, prevention and treatment of diseases and clinical conditions associated with FLJ14457.

FLJ20413 (Accession NP_060278.1) is another GAM144 target gene, herein designated TARGET GENE. FLJ20413 BINDING SITE is a target binding site found in the 3' untranslated region of mRNA encoded by FLJ20413, corresponding to a target binding site such as BINDING SITE I, BINDING SITE II or BINDING SITE III of FIG. 8. Table 4 illustrates the complementarity of the nucleotide sequences of FLJ20413 BINDING SITE, designated SEQ ID:4973, to the nucleotide sequence of GAM144 RNA, herein designated GAM RNA, also designated SEQ ID:361.

Another function of GAM144 is therefore inhibition of FLJ20413 (Accession NP_060278.1). Accordingly, utilities of GAM144 include diagnosis, prevention and treatment of diseases and clinical conditions associated with FLJ20413.

FLJ20436 (Accession NP_060292.1) is another GAM144 target gene, herein designated TARGET GENE. FLJ20436 BINDING SITE1 and FLJ20436 BINDING SITE2 are target binding sites found in untranslated regions of mRNA encoded by FLJ20436, corresponding to target binding sites such as BINDING SITE I, BINDING SITE II or BINDING SITE III of FIG. 8. Table 4 illustrates the complementarity of the nucleotide sequences of FLJ20436 BINDING SITE1 and FLJ20436 BINDING SITE2, designated SEQ ID:12137 and SEQ ID:15533 respectively, to the nucleotide sequence of GAM144 RNA, herein designated GAM RNA, also designated SEQ ID:361.

Another function of GAM144 is therefore inhibition of FLJ20436 (Accession NP_060292.1). Accordingly, utilities of GAM144 include diagnosis, prevention and treatment of diseases and clinical conditions associated with FLJ20436.

FLJ20487 (Accession NP_060311.1) is another GAM144 target gene, herein designated TARGET GENE. FLJ20487 BINDING SITE is a target binding site found in the 3' untranslated region of mRNA encoded by FLJ20487, corresponding to a target binding site such as BINDING SITE I, BINDING SITE II or BINDING SITE III of FIG. 8. Table 4 illustrates the complementarity of the nucleotide sequences of FLJ20487 BINDING SITE, designated SEQ ID:13148, to the nucleotide sequence of GAM144 RNA, herein designated GAM RNA, also designated SEQ ID:361.

Another function of GAM144 is therefore inhibition of FLJ20487 (Accession NP_060311.1). Accordingly, utilities of GAM144 include diagnosis, prevention and treatment of diseases and clinical conditions associated with FLJ20487.

FLJ20489 (Accession NP_060312.1) is another GAM144 target gene, herein designated TARGET GENE. FLJ20489 BINDING SITE is a target binding site found in the 3' untranslated region of mRNA encoded by FLJ20489, corresponding to a target binding site such as BINDING SITE I, BINDING SITE II or BINDING SITE III of FIG. 8. Table 4 illustrates the complementarity of the nucleotide sequences of FLJ20489 BINDING SITE, designated SEQ ID:14840, to the nucleotide sequence of GAM144 RNA, herein designated GAM RNA, also designated SEQ ID:361.

Another function of GAM144 is therefore inhibition of FLJ20489 (Accession NP_060312.1). Accordingly, utilities of GAM144 include diagnosis, prevention and treatment of diseases and clinical conditions associated with FLJ20489.

FLJ20626 (Accession NP_060378.1) is another GAM144 target gene, herein designated TARGET GENE. FLJ20626 BINDING SITE is a target binding site found in the 5' untranslated region of mRNA encoded by FLJ20626, corresponding to a target binding site such as BINDING SITE I, BINDING SITE II or BINDING SITE III of FIG. 8. Table 4 illustrates the complementarity of the nucleotide sequences of FLJ20626 BINDING SITE, designated SEQ ID:17489, to the nucleotide sequence of GAM144 RNA, herein designated GAM RNA, also designated SEQ ID:361.

Another function of GAM144 is therefore inhibition of FLJ20626 (Accession NP_060378.1). Accordingly, utilities of GAM144 include diagnosis, prevention and treatment of diseases and clinical conditions associated with FLJ20626.

FLJ21135 (Accession NP_079142.1) is another GAM144 target gene, herein designated TARGET GENE. FLJ21135 BINDING SITE is a target binding site found in the 5' untranslated region of mRNA encoded by FLJ21135, corresponding to a target binding site such as BINDING SITE I, BINDING SITE II or BINDING SITE III of FIG. 8. Table 4 illustrates the complementarity of the nucleotide sequences of FLJ21135 BINDING SITE, designated SEQ ID:7806, to the nucleotide sequence of GAM144 RNA, herein designated GAM RNA, also designated SEQ ID:361.

Another function of GAM144 is therefore inhibition of FLJ21135 (Accession NP_079142.1). Accordingly, utilities of GAM144 include diagnosis, prevention and treatment of diseases and clinical conditions associated with FLJ21135.

FLJ22059 (Accession NP_073589.1) is another GAM144 target gene, herein designated TARGET GENE. FLJ22059 BINDING SITE is a target binding site found in the 5' untranslated region of mRNA encoded by FLJ22059, corresponding to a target binding site such as BINDING SITE I, BINDING SITE II or BINDING SITE III of FIG. 8. Table 4 illustrates the complementarity of the nucleotide sequences of FLJ22059 BINDING SITE, designated SEQ ID:12358, to the nucleotide sequence of GAM144 RNA, herein designated GAM RNA, also designated SEQ ID:361.

Another function of GAM144 is therefore inhibition of FLJ22059 (Accession NP_073589.1). Accordingly, utilities of GAM144 include diagnosis, prevention and treatment of diseases and clinical conditions associated with FLJ22059.

FLJ22419 (Accession NP_078973.1) is another GAM144 target gene, herein designated TARGET GENE. FLJ22419 BINDING SITE is a target binding site found in the 5' untranslated region of mRNA encoded by FLJ22419, corresponding to a target binding site such as BINDING SITE I, BINDING SITE II or BINDING SITE III of FIG. 8. Table 4 illustrates the complementarity of the nucleotide sequences of FLJ22419 BINDING SITE, designated SEQ ID:13241, to the nucleotide sequence of GAM144 RNA, herein designated GAM RNA, also designated SEQ ID:361.

Another function of GAM144 is therefore inhibition of FLJ22419 (Accession NP_078973.1). Accordingly, utilities of GAM144 include diagnosis, prevention and treatment of diseases and clinical conditions associated with FLJ22419.

FLJ31657 (Accession NP_689971.1) is another GAM144 target gene, herein designated TARGET GENE. FLJ31657 BINDING SITE is a target binding site found in the 3' untranslated region of mRNA encoded by FLJ31657, corresponding to a target binding site such as BINDING SITE I, BINDING SITE II or BINDING SITE III of FIG. 8. Table 4 illustrates the complementarity of the nucleotide sequences of FLJ31657 BINDING SITE, designated SEQ ID:19250, to the nucleotide sequence of GAM144 RNA, herein designated GAM RNA, also designated SEQ ID:361.

Another function of GAM144 is therefore inhibition of FLJ31657 (Accession NP_689971.1). Accordingly, utilities of GAM144 include diagnosis, prevention and treatment of diseases and clinical conditions associated with FLJ31657.

FLJ33790 (Accession NP_775854.1) is another GAM144 target gene, herein designated TARGET GENE. FLJ33790 BINDING SITE is a target binding site found in the 3' untranslated region of mRNA encoded by FLJ33790, corresponding to a target binding site such as BINDING SITE I, BINDING SITE II or BINDING SITE III of FIG. 8. Table 4 illustrates the complementarity of the nucleotide sequences of FLJ33790 BINDING SITE, designated SEQ ID:8915, to the nucleotide sequence of GAM144 RNA, herein designated GAM RNA, also designated SEQ ID:361.

Another function of GAM144 is therefore inhibition of FLJ33790 (Accession NP_775854.1). Accordingly, utilities of GAM144 include diagnosis, prevention and treatment of diseases and clinical conditions associated with FLJ33790.

FLJ33996 (Accession NP_787090.1) is another GAM144 target gene, herein designated TARGET GENE. FLJ33996 BINDING SITE is a target binding site found in the 3' untranslated region of mRNA encoded by FLJ33996, corresponding to a target binding site such as BINDING SITE I, BINDING SITE II or BINDING SITE III of FIG. 8. Table 4 illustrates the complementarity of the nucleotide sequences of FLJ33996 BINDING SITE, designated SEQ ID:639, to the nucleotide sequence of GAM144 RNA, herein designated GAM RNA, also designated SEQ ID:361.

Another function of GAM144 is therefore inhibition of FLJ33996 (Accession NP_787090.1). Accordingly, utilities of GAM144 include diagnosis, prevention and treatment of diseases and clinical conditions associated with FLJ33996.

FLJ36674 (Accession NP_775893.1) is another GAM144 target gene, herein designated TARGET GENE. FLJ36674 BINDING SITE is a target binding site found in the 3' untranslated region of mRNA encoded by FLJ36674, corresponding to a target binding site such as BINDING SITE I, BINDING SITE II or BINDING SITE III of FIG. 8. Table 4 illustrates the complementarity of the nucleotide sequences of FLJ36674 BINDING SITE, designated SEQ ID:18877, to the nucleotide sequence of GAM144 RNA, herein designated GAM RNA, also designated SEQ ID:361.

Another function of GAM144 is therefore inhibition of FLJ36674 (Accession NP_775893.1). Accordingly, utilities of GAM144 include diagnosis, prevention and treatment of diseases and clinical conditions associated with FLJ36674.

FLJ37078 (Accession NP_694588.1) is another GAM144 target gene, herein designated TARGET GENE. FLJ37078 BINDING SITE is a target binding site found in the 3' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:18330, to the nucleotide sequence of GAM144 RNA, herein designated GAM RNA, also designated SEQ ID:361.

Another function of GAM144 is therefore inhibition of FLJ37078 (Accession NP_694588.1). Accordingly, utilities of GAM144 include diagnosis, prevention and treatment of diseases and clinical conditions associated with FLJ37078.

FLJ38984 (Accession NP_689587.1) is another GAM144 target gene, herein designated TARGET GENE. FLJ38984 BINDING SITE is a target binding site found in the 3' untranslated region of mRNA encoded by FLJ38984, corresponding to a target binding site such as BINDING SITE I, BINDING SITE II or BINDING SITE III of FIG. 8. Table 4 illustrates the complementarity of the nucleotide sequences of FLJ38984 BINDING SITE, designated SEQ ID:3780, to the nucleotide sequence of GAM144 RNA, herein designated GAM RNA, also designated SEQ ID:361.

Another function of GAM144 is therefore inhibition of FLJ38984 (Accession NP_689587.1). Accordingly, utilities of GAM144 include diagnosis, prevention and treatment of diseases and clinical conditions associated with FLJ38984.

Fucosyltransferase 7 (alpha (1,3) fucosyltransferase) (FUT7, Accession NP_004470.1) is another GAM144 target gene, herein designated TARGET GENE. FUT7 BINDING SITE is a target binding site found in the 3' untranslated region of mRNA encoded by FUT7, corresponding to a target binding site such as BINDING SITE I, BINDING SITE II or BINDING SITE III of FIG. 8. Table 4 illustrates the complementarity of the nucleotide sequences of FUT7 BINDING SITE, designated SEQ ID:7584, to the nucleotide sequence of GAM144 RNA, herein designated GAM RNA, also designated SEQ ID:361.

Another function of GAM144 is therefore inhibition of Fucosyltransferase 7 (alpha (1,3) fucosyltransferase) (FUT7, Accession NP_004470.1), a gene which may catalyze alpha-1,3 glycosidic linkages involved in the expression of sialyl lewis x antigens. and therefore may be associated with Ulcer disease. Accordingly, utilities of GAM144 include diagnosis, prevention and treatment of Ulcer disease, and of other diseases and clinical conditions associated with FUT7.

The function of FUT7 has been established by previous studies. The sialyl Lewis x oligosaccharide determinant is an essential component of leukocyte counterreceptors for E-selectin-(OMIM Ref. No. 131210) and P-selectin-(OMIM Ref. No. 173610) mediated adhesions of leukocytes. This oligosaccharide molecule is displayed on the surfaces of granulocytes, monocytes, and natural killer cells. Formation of leukocyte adhesions to these selectins is an early and important step in the process that ultimately allows leukocytes to leave the vascular tree and become recruited into lymphoid tissues and sites of inflammation. Bengtson et al. (2001) identified 3 individuals who were heterozygous for a 326G-A point mutation (arg110 to gln) in the FUT7 gene. Screening of family members revealed a homozygote for the mutation. Neutrophils isolated from individuals carrying the mutation showed lowered expression of SLeX and elevated expression of CD65 compared to controls. The homozygous individual was found to have ulcer disease, noninsulin-dependent diabetes, osteoporosis, spondyloarthrosis, and Sjogren syndrome, but the relationship between disease and the mutation was not clear. Bengtson et al. (2001) determined that the mutation causes loss of function. Biochemical analysis of lysates obtained from COS-7 cells transiently transfected with the mutated FUT7 construct revealed no FUT7 activity, and immunocytochemical visualization revealed no SLeX on the surface of these cells.

Full details of the abovementioned studies are described in the following publications, the disclosure of which are hereby incorporated by reference:

Bengtson, P.; Larson, C.; Lundblad, A.; Larson, G.; Pahlsson, P.: Identification of a missense mutation (G329A; arg110- to - gln) in the human FUT7 gene. J. Biol. Chem. 276:31575-31582, 2001; and Mahdavi, J.; Sonden, B.; Hurtig, M.; Olfat, F. O.; Forsberg, L.; Roche, N.; Angstrom, J.; Larsson, T.; Teneberg, S.; Karlsson, K.-A.; Altraja, S.; Wadstrom, T.; and 11 others: Helicob.

Further studies establishing the function and utilities of FUT7 are found in John Hopkins OMIM database record ID 602030, and in cited publications listed in Table 5, which are hereby incorporated by reference. Growth hormone inducible transmembrane protein (GHITM, Accession NP_055209.1) is another GAM144 target gene, herein designated TARGET GENE. GHITM BINDING SITE is a target binding site found in the 3' untranslated region of mRNA encoded by GHITM, corresponding to a target binding site such as BINDING SITE I, BINDING SITE II or BINDING SITE III of FIG. 8. Table 4 illustrates the complementarity of the nucleotide sequences of GHITM BINDING SITE, designated SEQ ID:18194, to the nucleotide sequence of GAM144 RNA, herein designated GAM RNA, also designated SEQ ID:361.

Another function of GAM144 is therefore inhibition of Growth hormone inducible transmembrane protein (GHITM, Accession NP_055209.1). Accordingly, utilities of GAM144 include diagnosis, prevention and treatment of diseases and clinical conditions associated with GHITM.

GIOT-2 (Accession NP_057348.1) is another GAM144 target gene, herein designated TARGET GENE. GIOT-2 BINDING SITE1 and GIOT-2 BINDING SITE2 are target binding sites found in untranslated regions of mRNA encoded by GIOT-2, corresponding to target binding sites such as BINDING SITE I, BINDING SITE II or BINDING SITE III of FIG. 8. Table 4 illustrates the complementarity of the nucleotide sequences of GIOT-2 BINDING SITE1 and GIOT-2 BINDING SITE2, designated SEQ ID:6079 and SEQ ID:11250 respectively, to the nucleotide sequence of GAM144 RNA, herein designated GAM RNA, also designated SEQ ID:361.

Another function of GAM144 is therefore inhibition of GIOT-2 (Accession NP_057348.1). Accordingly, utilities of GAM144 include diagnosis, prevention and treatment of diseases and clinical conditions associated with GIOT-2.

Golgi autoantigen, golgin subfamily a, 1 (GOLGA1, Accession NP_002068.1) is another GAM144 target gene, herein designated TARGET GENE. GOLGA1 BINDING SITE is a target binding site found in the 5' untranslated region of mRNA encoded by GOLGA1, corresponding to a target binding site such as BINDING SITE I, BINDING SITE II or BINDING SITE III of FIG. 8. Table 4 illustrates the complementarity of the nucleotide sequences of GOLGA1 BINDING SITE, designated SEQ ID:11331, to the nucleotide sequence of GAM144 RNA, herein designated GAM RNA, also designated SEQ ID:361.

Another function of GAM144 is therefore inhibition of Golgi autoantigen, golgin subfamily a, 1 (GOLGA1, Accession NP_002068.1) . Accordingly, utilities of GAM144 include diagnosis, prevention and treatment of diseases and clinical conditions associated with GOLGA1.

GOR (Accession NP_758439.1) is another GAM144 target gene, herein designated TARGET GENE. GOR BINDING SITE is a target binding site found in the 5' untranslated region of mRNA encoded by GOR, corresponding to a target binding site such as BINDING SITE I, BINDING SITE II or BINDING SITE III of FIG. 8. Table 4 illustrates the complementarity of the nucleotide sequences of GOR BINDING SITE, designated SEQ ID:13612, to the nucleotide sequence of GAM144 RNA, herein designated GAM RNA, also designated SEQ ID:361.

Another function of GAM144 is therefore inhibition of GOR (Accession NP_758439.1). Accordingly, utilities of GAM144 include diagnosis, prevention and treatment of diseases and clinical conditions associated with GOR.

GREB1 (Accession NP_683701.1) is another GAM144 target gene, herein designated TARGET GENE. GREB1 BINDING SITE is a target binding site found in the 5' untranslated region of multiple transcripts of mRNA encoded by GREB1, corresponding to a target binding site such as BINDING SITE I, BINDING SITE II or BINDING SITE III of FIG. 8. Table 4 illustrates the complementarity of the nucleotide sequences of GREB1 BINDING SITE, designated SEQ ID:8571, to the nucleotide sequence of GAM144 RNA, herein designated GAM RNA, also designated SEQ ID:361.

Another function of GAM144 is therefore inhibition of GREB1 (Accession NP_683701.1). Accordingly, utilities of GAM144 include diagnosis, prevention and treatment of diseases and clinical conditions associated with GREB1.

Glutamate receptor, ionotropic, n-methyl d-asparate-associated protein 1 (glutamate binding) (GRINA, Accession XP_291268.1) is another GAM144 target gene, herein designated TARGET GENE. GRINA BINDING SITE is a target binding site found in the 3' untranslated region of mRNA encoded by GRINA, corresponding to a target binding site such as BINDING SITE I, BINDING SITE II or BINDING SITE III of FIG. 8. Table 4 illustrates the complementarity of the nucleotide sequences of GRINA BINDING SITE, designated SEQ ID:12280, to the nucleotide sequence of GAM144 RNA, herein designated GAM RNA, also designated SEQ ID:361.

Another function of GAM144 is therefore inhibition of Glutamate receptor, ionotropic, n-methyl d-asparate-associated protein 1 (glutamate binding) (GRINA, Accession XP_291268.1). Accordingly, utilities of GAM144 include diagnosis, prevention and treatment of diseases and clinical conditions associated with GRINA.

GRTP1 (Accession NP_078995.1) is another GAM144 target gene, herein designated TARGET GENE. GRTP1 BINDING SITE is a target binding site found in the 3' untranslated region of mRNA encoded by GRTP1, corresponding to a target binding site such as BINDING SITE I, BINDING SITE II or BINDING SITE III of FIG. 8. Table 4 illustrates the complementarity of the nucleotide sequences of GRTP1 BINDING SITE, designated SEQ ID:11191, to the nucleotide sequence of GAM144 RNA, herein designated GAM RNA, also designated SEQ ID:361.

Another function of GAM144 is therefore inhibition of GRTP1 (Accession NP_078995.1). Accordingly, utilities of GAM144 include diagnosis, prevention and treatment of diseases and clinical conditions associated with GRTP1.

HES2 (Accession XP_290879.1) is another GAM144 target gene, herein designated TARGET GENE. HES2 BINDING SITE is a target binding site found in the 3' untranslated region of mRNA encoded by HES2, corresponding to a target binding site such as BINDING SITE I, BINDING SITE II or BINDING SITE III of FIG. 8. Table 4 illustrates the complementarity of the nucleotide sequences of HES2 BINDING SITE, designated SEQ ID:17870, to the nucleotide sequence of GAM144 RNA, herein designated GAM RNA, also designated SEQ ID:361.

Another function of GAM144 is therefore inhibition of HES2 (Accession XP_290879.1). Accordingly, utilities of GAM144 include diagnosis, prevention and treatment of diseases and clinical conditions associated with HES2.

Holocarboxylase synthetase (biotin-[proprionyl-coenzyme a-carboxylase (atp-hydrolysing)] ligase) (HLCS, Accession NP_000402.2) is another GAM144 target gene, herein designated TARGET GENE. HLCS BINDING SITE is a target binding site found in the 3' untranslated region of mRNA encoded by HLCS, corresponding to a target binding site such as BINDING SITE I, BINDING SITE II or BINDING SITE III of FIG. 8. Table 4 illustrates the complementarity of the nucleotide sequences of HLCS BINDING SITE, designated SEQ ID:13731, to the nucleotide sequence of GAM144 RNA, herein designated GAM RNA, also designated SEQ ID:361.

Another function of GAM144 is therefore inhibition of Holocarboxylase synthetase (biotin-[proprionyl-coenzyme a-carboxylase (atp-hydrolysing)] ligase) (HLCS, Accession NP_000402.2). Accordingly, utilities of GAM144 include diagnosis, prevention and treatment of diseases and clinical conditions associated with HLCS.

Homeo box c9 (HOXC9, Accession NP_008828.1) is another GAM144 target gene, herein designated TARGET GENE. HOXC9 BINDING SITE is a target binding site found in the 3' untranslated region of mRNA encoded by HOXC9, corresponding to a target binding site such as BINDING SITE I, BINDING SITE II or BINDING SITE III of FIG. 8. Table 4 illustrates the complementarity of the nucleotide sequences of HOXC9 BINDING SITE, designated SEQ ID:18430, to the nucleotide sequence of GAM144 RNA, herein designated GAM RNA, also designated SEQ ID:361.

Another function of GAM144 is therefore inhibition of Homeo box c9 (HOXC9, Accession NP_008828.1). Accordingly, utilities of GAM144 include diagnosis, prevention and treatment of diseases and clinical conditions associated with HOXC9.

HSPC129 (Accession NP_057480.1) is another GAM144 target gene, herein designated TARGET GENE. HSPC129 BINDING SITE is a target binding site found in the 3' untranslated region of mRNA encoded by HSPC129, corresponding to a target binding site such as BINDING SITE I, BINDING SITE II or BINDING SITE III of FIG. 8. Table 4 illustrates the complementarity of the nucleotide sequences of HSPC129 BINDING SITE, designated SEQ ID:14145, to the nucleotide sequence of GAM144 RNA, herein designated GAM RNA, also designated SEQ ID:361.

Another function of GAM144 is therefore inhibition of HSPC129 (Accession NP_057480.1). Accordingly, utilities of GAM144 include diagnosis, prevention and treatment of diseases and clinical conditions associated with HSPC129.

Insulin-like growth factor 2, antisense (IGF2AS, Accession NP_057496.1) is another GAM144 target gene, herein designated TARGET GENE. IGF2AS BINDING SITE is a target binding site found in the 3' untranslated region of mRNA encoded by IGF2AS, corresponding to a target binding site such as BINDING SITE I, BINDING SITE II or BINDING SITE III of FIG. 8. Table 4 illustrates the complementarity of the nucleotide sequences of IGF2AS BINDING SITE, designated SEQ ID:16566, to the nucleotide sequence of GAM144 RNA, herein designated GAM RNA, also designated SEQ ID:361.

Another function of GAM144 is therefore inhibition of Insulin-like growth factor 2, antisense (IGF2AS, Accession NP_057496.1). Accordingly, utilities of GAM144 include diagnosis, prevention and treatment of diseases and clinical conditions associated with IGF2AS.

Inositol hexaphosphate kinase 2 (IHPK2, Accession NP_057375.1) is another GAM144 target gene, herein designated TARGET GENE. IHPK2 BINDING SITE is a target binding site found in the 3' untranslated region of mRNA encoded by IHPK2, corresponding to a target binding site such as BINDING SITE I, BINDING SITE II or BINDING SITE III of FIG. 8. Table 4 illustrates the complementarity of the nucleotide sequences of IHPK2 BINDING SITE, designated SEQ ID:9050, to the nucleotide sequence of GAM144 RNA, herein designated GAM RNA, also designated SEQ ID:361.

Another function of GAM144 is therefore inhibition of Inositol hexaphosphate kinase 2 (IHPK2, Accession NP_057375.1), a gene which may act as energy reserves in selected intracellular sites. Accordingly, utilities of GAM144 include diagnosis, prevention and treatment of diseases and clinical conditions associated with IHPK2.

The function of IHPK2 has been established by previous studies. Inositol trisphosphate is a messenger molecule that releases calcium from intracellular stores. Homologs with multiple phosphates, including pyrophosphates, have also been identified. Inositol pyrophosphates are formed by several enzymes, including IHPK2. By database screening for homologs of rat Ihpk1 (OMIM Ref. No. 606991), Saiardi et al. (1999) obtained a cDNA encoding IHPK2, which had been called PiUS because it stimulates the uptake of inorganic phosphate but lacks transporter features. The deduced 426-amino acid protein is 98% identical to the rabbit protein and 48% identical to mouse Ihpk1. It contains a 25-residue conserved sequence also found in ITPKA (OMIM Ref. No. 147521), ITPKB (OMIM Ref. No. 147522), and 2 yeast proteins. Western blot analysis showed expression of a 49-kD protein. Northern blot analysis revealed high-level expression of a 1.9-kb transcript in mouse brain and lung, with lower levels in liver, kidney, and testis. Using confocal microscopy, Saiardi et al. (2001) demonstrated that mouse Ihpk1 is present in both the nucleus and the cytoplasm, whereas IHPK2 is almost exclusively nuclear and IHPK3 (OMIM Ref. No. 606993) is predominantly cytoplasmic. Saiardi et al. (1999) showed that cells expressing IHPK2 displayed robust InsP6 kinase activity. They proposed that IHPK1 and IHPK2 may act as energy reserves in selected intracellular sites. Morrison et al. (2002) showed that IHPK2 expression leads to a reduction of colony-forming cells, while overexpression causes increased radiosensitivity. Exposure to beta-interferon (IFNB; 147640) or radiation induced caspase-8 (CASP8; 601763), but only IFNB induced TRAIL (TNFSF10; 603598), and only radiation induced DR4 (TNFRSF10A; 603611). The apoptotic effects of these treatments could be blocked by a dominant-negative mutant of the TRAIL receptor DR5 (TNFRSF10B; 603612) or by BCL2 (OMIM Ref. No. 151430). Morrison et al. (2002) concluded that IHPK2 expression enhances sensitivity of some ovarian carcinomas to interferon and radiation treatment. Furthermore, they proposed that IHPK2 functions to enhance the expression of CASP8 through different extrinsic receptor-mediated pathways.

Full details of the abovementioned studies are described in the following publications, the disclosure of which are hereby incorporated by reference:

Morrison, B. H.; Bauer, J. A.; Hu, J.; Grane, R. W.; Ozdemir, A. M.; Chawla-Sarkar, M.; Gong, B.; Almasan, A.; Kalvakolanu, D. V.; Lindner, D. J.: Inositol hexakisphosphate kinase 2 sensitizes ovarian carcinoma cells to multiple cancer therapeutics. Oncogene 21:1882-1889, 2002; and Saiardi, A.; Erdjument-Bromage, H.; Snowman, A. M.; Tempst, P.; Snyder, S. H.: Synthesis of diphosphoinositol pentakisphosphate by a newly identified family of higher inositol polypho.

Further studies establishing the function and utilities of IHPK2 are found in John Hopkins OMIM database record ID 606992, and in cited publications listed in Table 5, which are hereby incorporated by reference. Inositol 1,4,5-trisphosphate 3-kinase b (ITPKB, Accession NP_002212.1) is another GAM144 target gene, herein designated TARGET GENE. ITPKB BINDING SITE is a target binding site found in the 3' untranslated region of mRNA encoded by ITPKB, corresponding to a target binding site such as BINDING SITE I, BINDING SITE II or BINDING SITE III of FIG. 8. Table 4 illustrates the complementarity of the nucleotide sequences of ITPKB BINDING SITE, designated SEQ ID:2633, to the nucleotide sequence of GAM144 RNA, herein designated GAM RNA, also designated SEQ ID:361.

Another function of GAM144 is therefore inhibition of Inositol 1,4,5-trisphosphate 3-kinase b (ITPKB, Accession NP_002212.1), a gene which is a type B inositol 1,4,5-triphosphate 3 kinase. Accordingly, utilities of GAM144 include diagnosis, prevention and treatment of diseases and clinical conditions associated with ITPKB.

The function of ITPKB and its association with various diseases and clinical conditions, has been established by previous studies, as described hereinabove with reference to GAM63.1. Potassium large conductance calcium-activated channel, subfamily m, beta member 4 (KCNMB4, Accession NP_055320.4) is another GAM144 target gene, herein designated TARGET GENE. KCNMB4 BINDING SITE is a target binding site found in the 3' untranslated region of mRNA encoded by KCNMB4, corresponding to a target binding site such as BINDING SITE I, BINDING SITE II or BINDING SITE III of FIG. 8. Table 4 illustrates the complementarity of the nucleotide sequences of KCNMB4 BINDING SITE, designated SEQ ID:13644, to the nucleotide sequence of GAM144 RNA, herein designated GAM RNA, also designated SEQ ID:361.

Another function of GAM144 is therefore inhibition of Potassium large conductance calcium-activated channel, subfamily m, beta member 4 (KCNMB4, Accession NP_055320.4), a gene which regulates gating kinetics of slow K channels in a Ca-sensitive manner. Accordingly, utilities of GAM144 include diagnosis, prevention and treatment of diseases and clinical conditions associated with KCNMB4.

The function of KCNMB4 has been established by previous studies. The large conductance, calcium-activated potassium (BK) channel is a member of the Shaker-related 6-transmembrane domain potassium channel superfamily that is sensitive to voltage and calcium. BK channels are composed of a pore-forming alpha subunit (KCNMA1, or HSLO; 600150) and, in some tissues, a beta subunit. The beta-1 subunit (KCNMB1; 603951) is expressed predominantly in smooth muscle cells, whereas the beta-2 subunit (KCNMB2; 605214) is expressed in endocrine tissue, such as adrenal chromaffin cells. By searching EST databases, Behrens et al. (2000) and Brenner et al. (2000) identified cDNAs encoding KCNMB4. Sequence analysis predicted that the 210-amino acid KCNMB4 protein contains 2 conserved transmembrane domains and an extracellular domain containing an N-glycosylation site and 4 cys residues; however, like KCNMB3 (OMIM Ref. No. 605222), KCNMB4 lacks the putative charybdotoxin/iberiotoxin-binding site. RNA dot blot analysis by Behrens et al. (2000) revealed high and specific expression of KCNMB4 in central nervous system tissue, with no expression in nonneuronal tissue. Northern blot analysis by Behrens et al. (2000) and Brenner et al. (2000) detected major 1.9- and minor 3.0- and 6.1-kb KCNMB4 transcripts in all brain tissues. Functional analysis of the effects of KCNMB4 on KCNMA1 showed that KCNMB4 slows activation kinetics, leads to steeper calcium sensitivity, and shifts the voltage range of BK current activation to more negative potentials than does KCNMB1. KCNMA1/KCNMB4 channels were not blocked by charybdotoxin or iberiotoxin and were activated by 17-beta-estradiol (Behrens et al., 2000). By electronic PCR, Behrens et al. (2000) mapped the KCNMB4 gene to 12q14.1-q15

Full details of the abovementioned studies are described in the following publications, the disclosure of which are hereby incorporated by reference:

Behrens, R.; Nolting, A.; Reimann, F.; Schwarz, M.; Waldschutz, R.; Pongs, O.: hKCNMB3 and hKCNMB4, cloning and characterization of two members of the large-conductance calcium-activated potassium channel beta subunit family. FEBS Lett. 474:99-106, 2000; and Brenner, R.; Jegla, T. J.; Wickenden, A.; Liu, Y.; Aldrich, R. W.: Cloning and functional characterization of novel large conductance calcium-activated potassium channel beta subunits.

Further studies establishing the function and utilities of KCNMB4 are found in John Hopkins OMIM database record ID 605223, and in cited publications listed in Table 5, which are hereby incorporated by reference. KIAA0194 (Accession XP_038362.3) is another GAM144 target gene, herein designated TARGET GENE. KIAA0194 BINDING SITE is a target binding site found in the 5' untranslated region of mRNA encoded by KIAA0194, corresponding to a target binding site such as BINDING SITE I, BINDING SITE II or BINDING SITE III of FIG. 8. Table 4 illustrates the complementarity of the nucleotide sequences of KIAA0194 BINDING SITE, designated SEQ ID:12459, to the nucleotide sequence of GAM144 RNA, herein designated GAM RNA, also designated SEQ ID:361.

Another function of GAM144 is therefore inhibition of KIAA0194 (Accession XP_038362.3). Accordingly, utilities of GAM144 include diagnosis, prevention and treatment of diseases and clinical conditions associated with KIAA0194.

KIAA0196 (Accession NP_055661.1) is another GAM144 target gene, herein designated TARGET GENE. KIAA0196 BINDING SITE is a target binding site found in the 5' untranslated region of mRNA encoded by KIAA0196, corresponding to a target binding site such as BINDING SITE I, BINDING SITE II or BINDING SITE III of FIG. 8. Table 4 illustrates the complementarity of the nucleotide sequences of KIAA0196 BINDING SITE, designated SEQ ID:8741, to the nucleotide sequence of GAM144 RNA, herein designated GAM RNA, also designated SEQ ID:361.

Another function of GAM144 is therefore inhibition of KIAA0196 (Accession NP_055661.1). Accordingly, utilities of GAM144 include diagnosis, prevention and treatment of diseases and clinical conditions associated with KIAA0196.

KIAA0258 (Accession NP_055600.1) is another GAM144 target gene, herein designated TARGET GENE. KIAA0258 BINDING SITE is a target binding site found in the 3' untranslated region of mRNA encoded by KIAA0258, corresponding to a target binding site such as BINDING SITE I, BINDING SITE II or BINDING SITE III of FIG. 8. Table 4 illustrates the complementarity of the nucleotide sequences of KIAA0258 BINDING SITE, designated SEQ ID:7237, to the nucleotide sequence of GAM144 RNA, herein designated GAM RNA, also designated SEQ ID:361.

Another function of GAM144 is therefore inhibition of KIAA0258 (Accession NP_055600.1). Accordingly, utilities of GAM144 include diagnosis, prevention and treatment of diseases and clinical conditions associated with KIAA0258.

KIAA0469 (Accession NP_055666.1) is another GAM144 target gene, herein designated TARGET GENE. KIAA0469 BINDING SITE is a target binding site found in the 3' untranslated region of mRNA encoded by KIAA0469, corresponding to a target binding site such as BINDING SITE I, BINDING SITE II or BINDING SITE III of FIG. 8. Table 4 illustrates the complementarity of the nucleotide sequences of KIAA0469 BINDING SITE, designated SEQ ID:18243, to the nucleotide sequence of GAM144 RNA, herein designated GAM RNA, also designated SEQ ID:361.

Another function of GAM144 is therefore inhibition of KIAA0469 (Accession NP_055666.1). Accordingly, utilities of GAM144 include diagnosis, prevention and treatment of diseases and clinical conditions associated with KIAA0469.

KIAA0557 (Accession XP_085507.1) is another GAM144 target gene, herein designated TARGET GENE. KIAA0557 BINDING SITE is a target binding site found in the 3' untranslated region of mRNA encoded by KIAA0557, corresponding to a target binding site such as BINDING SITE I, BINDING SITE II or BINDING SITE III of FIG. 8. Table 4 illustrates the complementarity of the nucleotide sequences of KIAA0557 BINDING SITE, designated SEQ ID:15943, to the nucleotide sequence of GAM144 RNA, herein designated GAM RNA, also designated SEQ ID:361.

Another function of GAM144 is therefore inhibition of KIAA0557 (Accession XP_085507.1). Accordingly, utilities of GAM144 include diagnosis, prevention and treatment of diseases and clinical conditions associated with KIAA0557.

KIAA0773 (Accession NP_055505.1) is another GAM144 target gene, herein designated TARGET GENE. KIAA0773 BINDING SITE is a target binding site found in the 3' untranslated region of mRNA encoded by KIAA0773, corresponding to a target binding site such as BINDING SITE I, BINDING SITE II or BINDING SITE III of FIG. 8. Table 4 illustrates the complementarity of the nucleotide sequences of KIAA0773 BINDING SITE, designated SEQ ID:7991, to the nucleotide sequence of GAM144 RNA, herein designated GAM RNA, also designated SEQ ID:361.

Another function of GAM144 is therefore inhibition of KIAA0773 (Accession NP_055505.1). Accordingly, utilities of GAM144 include diagnosis, prevention and treatment of diseases and clinical conditions associated with KIAA0773.

KIAA0971 (Accession NP_055744.1) is another GAM144 target gene, herein designated TARGET GENE. KIAA0971 BINDING SITE is a target binding site found in the 3' untranslated region of mRNA encoded by KIAA0971, corresponding to a target binding site such as BINDING SITE I, BINDING SITE II or BINDING SITE III of FIG. 8. Table 4 illustrates the complementarity of the nucleotide sequences of KIAA0971 BINDING SITE, designated SEQ ID:4116, to the nucleotide sequence of GAM144 RNA, herein designated GAM RNA, also designated SEQ ID:361.

Another function of GAM144 is therefore inhibition of KIAA0971 (Accession NP_055744.1). Accordingly, utilities of GAM144 include diagnosis, prevention and treatment of diseases and clinical conditions associated with KIAA0971.

KIAA0987 (Accession NP_036439.1) is another GAM144 target gene, herein designated TARGET GENE. KIAA0987 BINDING SITE is a target binding site found in the 3' untranslated region of mRNA encoded by KIAA0987, corresponding to a target binding site such as BINDING SITE I, BINDING SITE II or BINDING SITE III of FIG. 8. Table 4 illustrates the complementarity of the nucleotide sequences of KIAA0987 BINDING SITE, designated SEQ ID:19005, to the nucleotide sequence of GAM144 RNA, herein designated GAM RNA, also designated SEQ ID:361.

Another function of GAM144 is therefore inhibition of KIAA0987 (Accession NP_036439.1). Accordingly, utilities of GAM144 include diagnosis, prevention and treatment of diseases and clinical conditions associated with KIAA0987.

KIAA1054 (Accession XP_043493.5) is another GAM144 target gene, herein designated TARGET GENE. KIAA1054 BINDING SITE is a target binding site found in the 3' untranslated region of mRNA encoded by KIAA1054, corresponding to a target binding site such as BINDING SITE I, BINDING SITE II or BINDING SITE III of FIG. 8. Table 4 illustrates the complementarity of the nucleotide sequences of KIAA1054 BINDING SITE, designated SEQ ID:19444, to the nucleotide sequence of GAM144 RNA, herein designated GAM RNA, also designated SEQ ID:361.

Another function of GAM144 is therefore inhibition of KIAA1054 (Accession XP_043493.5). Accordingly, utilities of GAM144 include diagnosis, prevention and treatment of diseases and clinical conditions associated with KIAA1054.

KIAA1210 (Accession XP_172801.1) is another GAM144 target gene, herein designated TARGET GENE. KIAA1210 BINDING SITE is a target binding site found in the 3' untranslated region of mRNA encoded by KIAA1210, corresponding to a target binding site such as BINDING SITE I, BINDING SITE II or BINDING SITE III of FIG. 8. Table 4 illustrates the complementarity of the nucleotide sequences of KIAA1210 BINDING SITE, designated SEQ ID:3392, to the nucleotide sequence of GAM144 RNA, herein designated GAM RNA, also designated SEQ ID:361.

Another function of GAM144 is therefore inhibition of KIAA1210 (Accession XP_172801.1). Accordingly, utilities of GAM144 include diagnosis, prevention and treatment of diseases and clinical conditions associated with KIAA1210.

KIAA1317 (Accession XP_098368.2) is another GAM144 target gene, herein designated TARGET GENE. KIAA1317 BINDING SITE is a target binding site found in the 3' untranslated region of mRNA encoded by KIAA1317, corresponding to a target binding site such as BINDING SITE I, BINDING SITE II or BINDING SITE III of FIG. 8. Table 4 illustrates the complementarity of the nucleotide sequences of KIAA1317 BINDING SITE, designated SEQ ID:15868, to the nucleotide sequence of GAM144 RNA, herein designated GAM RNA, also designated SEQ ID:361.

Another function of GAM144 is therefore inhibition of KIAA1317 (Accession XP_098368.2). Accordingly, utilities of GAM144 include diagnosis, prevention and treatment of diseases and clinical conditions associated with KIAA1317.

KIAA1340 (Accession XP_044836.2) is another GAM144 target gene, herein designated TARGET GENE. KIAA1340 BINDING SITE is a target binding site found in the 5' untranslated region of mRNA encoded by KIAA1340, corresponding to a target binding site such as BINDING SITE I, BINDING SITE II or BINDING SITE III of FIG. 8. Table 4 illustrates the complementarity of the nucleotide sequences of KIAA1340 BINDING SITE, designated SEQ ID:10596, to the nucleotide sequence of GAM144 RNA, herein designated GAM RNA, also designated SEQ ID:361.

Another function of GAM144 is therefore inhibition of KIAA1340 (Accession XP_044836.2). Accordingly, utilities of GAM144 include diagnosis, prevention and treatment of diseases and clinical conditions associated with KIAA1340.

KIAA1377 (Accession XP_040708.2) is another GAM144 target gene, herein designated TARGET GENE. KIAA1377 BINDING SITE is a target binding site found in the 5' untranslated region of mRNA encoded by KIAA1377, corresponding to a target binding site such as BINDING SITE I, BINDING SITE II or BINDING SITE III of FIG. 8. Table 4 illustrates the complementarity of the nucleotide sequences of KIAA1377 BINDING SITE, designated SEQ ID:2469, to the nucleotide sequence of GAM144 RNA, herein designated GAM RNA, also designated SEQ ID:361.

Another function of GAM144 is therefore inhibition of KIAA1377 (Accession XP_040708.2). Accordingly, utilities of GAM144 include diagnosis, prevention and treatment of diseases and clinical conditions associated with KIAA1377.

KIAA1822 (Accession XP_041566.2) is another GAM144 target gene, herein designated TARGET GENE. KIAA1822 BINDING SITE is a target binding site found in the 3' untranslated region of mRNA encoded by KIAA1822, corresponding to a target binding site such as BINDING SITE I, BINDING SITE II or BINDING SITE III of FIG. 8. Table 4 illustrates the complementarity of the nucleotide sequences of KIAA1822 BINDING SITE, designated SEQ ID:4193, to the nucleotide sequence of GAM144 RNA, herein designated GAM RNA, also designated SEQ ID:361.

Another function of GAM144 is therefore inhibition of KIAA1822 (Accession XP_041566.2). Accordingly, utilities of GAM144 include diagnosis, prevention and treatment of diseases and clinical conditions associated with KIAA1822.

KIAA1908 (Accession XP_055834.1) is another GAM144 target gene, herein designated TARGET GENE. KIAA1908 BINDING SITE is a target binding site found in the 5' untranslated region of mRNA encoded by KIAA1908, corresponding to a target binding site such as BINDING SITE I, BINDING SITE II or BINDING SITE III of FIG. 8. Table 4 illustrates the complementarity of the nucleotide sequences of KIAA1908 BINDING SITE, designated SEQ ID:12359, to the nucleotide sequence of GAM144 RNA, herein designated GAM RNA, also designated SEQ ID:361.

Another function of GAM144 is therefore inhibition of KIAA1908 (Accession XP_055834.1). Accordingly, utilities of GAM144 include diagnosis, prevention and treatment of diseases and clinical conditions associated with KIAA1908.

KIAA1920 (Accession XP_085210.1) is another GAM144 target gene, herein designated TARGET GENE. KIAA1920 BINDING SITE is a target binding site found in the 5' untranslated region of mRNA encoded by KIAA1920, corresponding to a target binding site such as BINDING SITE I, BINDING SITE II or BINDING SITE III of FIG. 8. Table 4 illustrates the complementarity of the nucleotide sequences of KIAA1920 BINDING SITE, designated SEQ ID:8934, to the nucleotide sequence of GAM144 RNA, herein designated GAM RNA, also designated SEQ ID:361.

Another function of GAM144 is therefore inhibition of KIAA1920 (Accession XP_085210.1). Accordingly, utilities of GAM144 include diagnosis, prevention and treatment of diseases and clinical conditions associated with KIAA1920.

Ladinin 1 (LAD1, Accession NP_005549.2) is another GAM144 target gene, herein designated TARGET GENE. LAD1 BINDING SITE is a target binding site found in the 3' untranslated region of mRNA encoded by LAD1, corresponding to a target binding site such as BINDING SITE I, BINDING SITE II or BINDING SITE III of FIG. 8. Table 4 illustrates the complementarity of the nucleotide sequences of LAD1 BINDING SITE, designated SEQ ID:13558, to the nucleotide sequence of GAM144 RNA, herein designated GAM RNA, also designated SEQ ID:361.

Another function of GAM144 is therefore inhibition of Ladinin 1 (LAD1, Accession NP_005549.2). Accordingly, utilities of GAM144 include diagnosis, prevention and treatment of diseases and clinical conditions associated with LAD1.

Lim domain binding 2 (LDB2, Accession NP_001281.1) is another GAM144 target gene, herein designated TARGET GENE. LDB2 BINDING SITE is a target binding site found in the 3' untranslated region of mRNA encoded by LDB2, corresponding to a target binding site such as BINDING SITE I, BINDING SITE II or BINDING SITE III of FIG. 8. Table 4 illustrates the complementarity of the nucleotide sequences of LDB2 BINDING SITE, designated SEQ ID:8958, to the nucleotide sequence of GAM144 RNA, herein designated GAM RNA, also designated SEQ ID:361.

Another function of GAM144 is therefore inhibition of Lim domain binding 2 (LDB2, Accession NP_001281.1), a gene which physically interacts with the LIM domains of nuclear proteins. Accordingly, utilities of GAM144 include diagnosis, prevention and treatment of diseases and clinical conditions associated with LDB2.

The function of LDB2 has been established by previous studies. Genes encoding LIM domain-binding factors were initially isolated in a screen for proteins that physically interact with the LIM domains of nuclear proteins. These proteins are capable of binding to a variety of transcription factors and are likely to function at enhancers to bring together diverse transcription factors and form higher order activation complexes or to block formation of such complexes (Jurata and Gill, 1997). The family of genes encoding LIM domain-binding factors includes 2 members isolated from the mouse, Clim1 (Bach et al., 1997) and Clim2/Lbd1/Nli (Agulnick et al., 1996; Jurata et al., 1996; Bach et al., 1997) and their homologs cloned from the frog, chicken, and fly. The fact that LIM domain-binding factors are likely to be involved in the coordination of the transcriptional activity of many diverse factors might implicate them in human phenotypes characterized by multiple affected sites. Semina et al. (1998) cloned the human genes CLIM1 and CLIM2 (OMIM Ref. No. 603451). They identified human sequences homologous to the mouse gene encoding Nli/Lbd1 in the EST database. Human sequences homologous to both Clim1 and Clim2 proteins were found. To obtain full-length cDNA clones for both genes, they screened a human craniofacial cDNA library with the corresponding human clones. The CLIM1 composite cDNA was found to be 2,351 bp long; the CLIM2 composite cDNA was found to be 1,953 bp long. The genes encode proteins of similar size, 373 and 375 amino acids, respectively. The proteins show a very high degree of identity with their homologs from other species as well as with each other. Using the Genebridge 4 radiation hybrid panel, Semina et al. (1998) mapped the CLIM1 and CLIM2 genes. CLIM1 was localized to 4p16-p15 and the map position was refined to 4p15 with a regional mapping panel for human chromosome 4. CLIM2 was localized to 10q24-q25; this region shares homology with the distal region of mouse chromosome 19, where the mouse gene Lbd1 was mapped by Yamashita et al. (1998).

Full details of the abovementioned studies are described in the following publications, the disclosure of which are hereby incorporated by reference:

Semina, E. V.; Altherr, M. R.; Murray, J. C.: Cloning and chromosomal localization of two novel human genes encoding LIM-domain binding factors CLIM1 and CLIM2/LDB1/NL1. Mammalian Genome 9:921-924, 1998; and Yamashita, T.; Agulnick, A. D.; Copeland, N. G.; Gilbert, D. J.; Jenkins, N. A.; Westphal, H.: Genomic structure and chromosomal localization of the mouse LIM domain- binding protein 1 g.

Further studies establishing the function and utilities of LDB2 are found in John Hopkins OMIM database record ID 603450, and in cited publications listed in Table 5, which are hereby incorporated by reference. Lectin, galactoside-binding, soluble, 9 (galectin 9) (LGALS9, Accession NP_002299.1) is another GAM144 target gene, herein designated TARGET GENE. LGALS9 BINDING SITE is a target binding site found in the 3' untranslated region of multiple transcripts of mRNA encoded by LGALS9, corresponding to a target binding site such as BINDING SITE I, BINDING SITE II or BINDING SITE III of FIG. 8. Table 4 illustrates the complementarity of the nucleotide sequences of LGALS9 BINDING SITE, designated SEQ ID:13678, to the nucleotide sequence of GAM144 RNA, herein designated GAM RNA, also designated SEQ ID:361.

Another function of GAM144 is therefore inhibition of Lectin, galactoside-binding, soluble, 9 (galectin 9) (LGALS9, Accession NP_002299.1). Accordingly, utilities of GAM144 include diagnosis, prevention and treatment of diseases and clinical conditions associated with LGALS9.

Lectin, galactoside-binding, soluble, 9 (galectin 9) (LGALS9, Accession NP_033665.1) is another GAM144 target gene, herein designated TARGET GENE. LGALS9 BINDING SITE is a target binding site found in the 3' untranslated region of multiple transcripts of mRNA encoded by LGALS9, corresponding to a target binding site such as BINDING SITE I, BINDING SITE II or BINDING SITE III of FIG. 8. Table 4 illustrates the complementarity of the nucleotide sequences of LGALS9 BINDING SITE, designated SEQ ID:13678, to the nucleotide sequence of GAM144 RNA, herein designated GAM RNA, also designated SEQ ID:361.

Another function of GAM144 is therefore inhibition of Lectin, galactoside-binding, soluble, 9 (galectin 9) (LGALS9, Accession NP_033665.1). Accordingly, utilities of GAM144 include diagnosis, prevention and treatment of diseases and clinical conditions associated with LGALS9.

Leukocyte immunoglobulin-like receptor, subfamily b (with tm and itim domains), member 3 (LILRB3, Accession NP_006855.1) is another GAM144 target gene, herein designated TARGET GENE. LILRB3 BINDING SITE is a target binding site found in the 5' untranslated region of mRNA encoded by LILRB3, corresponding to a target binding site such as BINDING SITE I, BINDING SITE II or BINDING SITE III of FIG. 8. Table 4 illustrates the complementarity of the nucleotide sequences of LILRB3 BINDING SITE, designated SEQ ID:19524, to the nucleotide sequence of GAM144 RNA, herein designated GAM RNA, also designated SEQ ID:361.

Another function of GAM144 is therefore inhibition of Leukocyte immunoglobulin-like receptor, subfamily b (with tm and itim domains), member 3 (LILRB3, Accession NP_006855.1). Accordingly, utilities of GAM144 include diagnosis, prevention and treatment of diseases and clinical conditions associated with LILRB3.

Lectin, mannose-binding, 1 like (LMAN1L, Accession NP_078971.2) is another GAM144 target gene, herein designated TARGET GENE. LMAN1L BINDING SITE is a target binding site found in the 3' untranslated region of multiple transcripts of mRNA encoded by LMAN1L, corresponding to a target binding site such as BINDING SITE I, BINDING SITE II or BINDING SITE III of FIG. 8. Table 4 illustrates the complementarity of the nucleotide sequences of LMAN1L BINDING SITE, designated SEQ ID:13160, to the nucleotide sequence of GAM144 RNA, herein designated GAM RNA, also designated SEQ ID:361.

Another function of GAM144 is therefore inhibition of Lectin, mannose-binding, 1 like (LMAN1L, Accession NP_078971.2). Accordingly, utilities of GAM144 include diagnosis, prevention and treatment of diseases and clinical conditions associated with LMAN1L.

LOC125058 (Accession XP_008617.5) is another GAM144 target gene, herein designated TARGET GENE. LOC125058 BINDING SITE is a target binding site found in the 3' untranslated region of mRNA encoded by LOC125058, corresponding to a target binding site such as BINDING SITE I, BINDING SITE II or BINDING SITE III of FIG. 8. Table 4 illustrates the complementarity of the nucleotide sequences of LOC125058 BINDING SITE, designated SEQ ID:17192, to the nucleotide sequence of GAM144 RNA, herein designated GAM RNA, also designated SEQ ID:361.

Another function of GAM144 is therefore inhibition of LOC125058 (Accession XP_008617.5). Accordingly, utilities of GAM144 include diagnosis, prevention and treatment of diseases and clinical conditions associated with LOC125058.

LOC126661 (Accession XP_059061.2) is another GAM144 target gene, herein designated TARGET GENE. LOC126661 BINDING SITE is a target binding site found in the 5' untranslated region of mRNA encoded by LOC126661, corresponding to a target binding site such as BINDING SITE I, BINDING SITE II or BINDING SITE III of FIG. 8. Table 4 illustrates the complementarity of the nucleotide sequences of LOC126661 BINDING SITE, designated SEQ ID:12608, to the nucleotide sequence of GAM144 RNA, herein designated GAM RNA, also designated SEQ ID:361.

Another function of GAM144 is therefore inhibition of LOC126661 (Accession XP_059061.2). Accordingly, utilities of GAM144 include diagnosis, prevention and treatment of diseases and clinical conditions associated with LOC126661.

LOC130672 (Accession XP_059465.1) is another GAM144 target gene, herein designated TARGET GENE. LOC130672 BINDING SITE is a target binding site found in the 3' untranslated region of mRNA encoded by LOC130672, corresponding to a target binding site such as BINDING SITE I, BINDING SITE II or BINDING SITE III of FIG. 8. Table 4 illustrates the complementarity of the nucleotide sequences of LOC130672 BINDING SITE, designated SEQ ID:18606, to the nucleotide sequence of GAM144 RNA, herein designated GAM RNA, also designated SEQ ID:361.

Another function of GAM144 is therefore inhibition of LOC130672 (Accession XP_059465.1). Accordingly, utilities of GAM144 include diagnosis, prevention and treatment of diseases and clinical conditions associated with LOC130672.

LOC132205 (Accession XP_067736.5) is another GAM144 target gene, herein designated TARGET GENE. LOC132205 BINDING SITE is a target binding site found in the 3' untranslated region of mRNA encoded by LOC132205, corresponding to a target binding site such as BINDING SITE I, BINDING SITE II or BINDING SITE III of FIG. 8. Table 4 illustrates the complementarity of the nucleotide sequences of LOC132205 BINDING SITE, designated SEQ ID:3634, to the nucleotide sequence of GAM144 RNA, herein designated GAM RNA, also designated SEQ ID:361.

Another function of GAM144 is therefore inhibition of LOC132205 (Accession XP_067736.5). Accordingly, utilities of GAM144 include diagnosis, prevention and treatment of diseases and clinical conditions associated with LOC132205.

LOC133491 (Accession XP_059655.2) is another GAM144 target gene, herein designated TARGET GENE. LOC133491 BINDING SITE is a target binding site found in the 5' untranslated region of mRNA encoded by LOC133491, corresponding to a target binding site such as BINDING SITE I, BINDING SITE II or BINDING SITE III of FIG. 8. Table 4 illustrates the complementarity of the nucleotide sequences of LOC133491 BINDING SITE, designated SEQ ID:19600, to the nucleotide sequence of GAM144 RNA, herein designated GAM RNA, also designated SEQ ID:361.

Another function of GAM144 is therefore inhibition of LOC133491 (Accession XP_059655.2). Accordingly, utilities of GAM144 include diagnosis, prevention and treatment of diseases and clinical conditions associated with LOC133491.

LOC139547 (Accession XP_066756.4) is another GAM144 target gene, herein designated TARGET GENE. LOC139547 BINDING SITE is a target binding site found in the 3' untranslated region of mRNA encoded by LOC139547, corresponding to a target binding site such as BINDING SITE I, BINDING SITE II or BINDING SITE III of FIG. 8. Table 4 illustrates the complementarity of the nucleotide sequences of LOC139547 BINDING SITE, designated SEQ ID:7462, to the nucleotide sequence of GAM144 RNA, herein designated GAM RNA, also designated SEQ ID:361.

Another function of GAM144 is therefore inhibition of LOC139547 (Accession XP_066756.4). Accordingly, utilities of GAM144 include diagnosis, prevention and treatment of diseases and clinical conditions associated with LOC139547.

LOC143425 (Accession NP_783860.1) is another GAM144 target gene, herein designated TARGET GENE. LOC143425 BINDING SITE1 and LOC143425 BINDING SITE2 are target binding sites found in untranslated regions of mRNA encoded by LOC143425, corresponding to target binding sites such as BINDING SITE I, BINDING SITE II or BINDING SITE III of FIG. 8. Table 4 illustrates the complementarity of the nucleotide sequences of LOC143425 BINDING SITE1 and LOC143425 BINDING SITE2, designated SEQ ID:15557 and SEQ ID:15233 respectively, to the nucleotide sequence of GAM144 RNA, herein designated GAM RNA, also designated SEQ ID:361.

Another function of GAM144 is therefore inhibition of LOC143425 (Accession NP_783860.1). Accordingly, utilities of GAM144 include diagnosis, prevention and treatment of diseases and clinical conditions associated with LOC143425.

LOC144266 (Accession XP_084795.1) is another GAM144 target gene, herein designated TARGET GENE. LOC144266 BINDING SITE is a target binding site found in the 5' untranslated region of mRNA encoded by LOC144266, corresponding to a target binding site such as BINDING SITE I, BINDING SITE II or BINDING SITE III of FIG. 8. Table 4 illustrates the complementarity of the nucleotide sequences of LOC144266 BINDING SITE, designated SEQ ID:6620, to the nucleotide sequence of GAM144 RNA, herein designated GAM RNA, also designated SEQ ID:361.

Another function of GAM144 is therefore inhibition of LOC144266 (Accession XP_084795.1). Accordingly, utilities of GAM144 include diagnosis, prevention and treatment of diseases and clinical conditions associated with LOC144266.

LOC144742 (Accession XP_084949.1) is another GAM144 target gene, herein designated TARGET GENE. LOC144742 BINDING SITE is a target binding site found in the 5' untranslated region of mRNA encoded by LOC144742, corresponding to a target binding site such as BINDING SITE I, BINDING SITE II or BINDING SITE III of FIG. 8. Table 4 illustrates the complementarity of the nucleotide sequences of LOC144742 BINDING SITE, designated SEQ ID:3867, to the nucleotide sequence of GAM144 RNA, herein designated GAM RNA, also designated SEQ ID:361.

Another function of GAM144 is therefore inhibition of LOC144742 (Accession XP_084949.1). Accordingly, utilities of GAM144 include diagnosis, prevention and treatment of diseases and clinical conditions associated with LOC144742.

LOC145601 (Accession XP_096816.1) is another GAM144 target gene, herein designated TARGET GENE. LOC145601 BINDING SITE is a target binding site found in the 3' untranslated region of mRNA encoded by LOC145601, corresponding to a target binding site such as BINDING SITE I, BINDING SITE II or BINDING SITE III of FIG. 8. Table 4 illustrates the complementarity of the nucleotide sequences of LOC145601 BINDING SITE, designated SEQ ID:5208, to the nucleotide sequence of GAM144 RNA, herein designated GAM RNA, also designated SEQ ID:361.

Another function of GAM144 is therefore inhibition of LOC145601 (Accession XP_096816.1). Accordingly, utilities of GAM144 include diagnosis, prevention and treatment of diseases and clinical conditions associated with LOC145601.

LOC146177 (Accession NP_778229.1) is another GAM144 target gene, herein designated TARGET GENE. LOC146177 BINDING SITE is a target binding site found in the 3' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:8484, to the nucleotide sequence of GAM144 RNA, herein designated GAM RNA, also designated SEQ ID:361.

Another function of GAM144 is therefore inhibition of LOC146177 (Accession NP_778229.1). Accordingly, utilities of GAM144 include diagnosis, prevention and treatment of diseases and clinical conditions associated with LOC146177.

LOC148640 (Accession XP_086257.1) is another GAM144 target gene, herein designated TARGET GENE. LOC148640 BINDING SITE is a target binding site found in the 3' untranslated region of mRNA encoded by LOC148640, corresponding to a target binding site such as BINDING SITE I, BINDING SITE II or BINDING SITE III of FIG. 8. Table 4 illustrates the complementarity of the nucleotide sequences of LOC148640 BINDING SITE, designated SEQ ID:12242, to the nucleotide sequence of GAM144 RNA, herein designated GAM RNA, also designated SEQ ID:361.

Another function of GAM144 is therefore inhibition of LOC148640 (Accession XP_086257.1). Accordingly, utilities of GAM144 include diagnosis, prevention and treatment of diseases and clinical conditions associated with LOC148640.

LOC149018 (Accession XP_086402.1) is another GAM144 target gene, herein designated TARGET GENE. LOC149018 BINDING SITE is a target binding site found in the 5' untranslated region of mRNA encoded by LOC149018, corresponding to a target binding site such as BINDING SITE I, BINDING SITE II or BINDING SITE III of FIG. 8. Table 4 illustrates the complementarity of the nucleotide sequences of LOC149018 BINDING SITE, designated SEQ ID:1158, to the nucleotide sequence of GAM144 RNA, herein designated GAM RNA, also designated SEQ ID:361.

Another function of GAM144 is therefore inhibition of LOC149018 (Accession XP_086402.1). Accordingly, utilities of GAM144 include diagnosis, prevention and treatment of diseases and clinical conditions associated with LOC149018.

LOC152225 (Accession XP_098181.1) is another GAM144 target gene, herein designated TARGET GENE. LOC152225 BINDING SITE is a target binding site found in the 3' untranslated region of mRNA encoded by LOC152225, corresponding to a target binding site such as BINDING SITE I, BINDING SITE II or BINDING SITE III of FIG. 8. Table 4 illustrates the complementarity of the nucleotide sequences of LOC152225 BINDING SITE, designated SEQ ID:20184, to the nucleotide sequence of GAM144 RNA, herein designated GAM RNA, also designated SEQ ID:361.

Another function of GAM144 is therefore inhibition of LOC152225 (Accession XP_098181.1). Accordingly, utilities of GAM144 include diagnosis, prevention and treatment of diseases and clinical conditions associated with LOC152225.

LOC153516 (Accession NP_612500.1) is another GAM144 target gene, herein designated TARGET GENE. LOC153516 BINDING SITE is a target binding site found in the 3' untranslated region of mRNA encoded by LOC153516, corresponding to a target binding site such as BINDING SITE I, BINDING SITE II or BINDING SITE III of FIG. 8. Table 4 illustrates the complementarity of the nucleotide sequences of LOC153516 BINDING SITE, designated SEQ ID:11300, to the nucleotide sequence of GAM144 RNA, herein designated GAM RNA, also designated SEQ ID:361.

Another function of GAM144 is therefore inhibition of LOC153516 (Accession NP_612500.1). Accordingly, utilities of GAM144 include diagnosis, prevention and treatment of diseases and clinical conditions associated with LOC153516.

LOC154877 (Accession XP_098626.1) is another GAM144 target gene, herein designated TARGET GENE. LOC154877 BINDING SITE is a target binding site found in the 3' untranslated region of mRNA encoded by LOC154877, corresponding to a target binding site such as BINDING SITE I, BINDING SITE II or BINDING SITE III of FIG. 8. Table 4 illustrates the complementarity of the nucleotide sequences of LOC154877 BINDING SITE, designated SEQ ID:771, to the nucleotide sequence of GAM144 RNA, herein designated GAM RNA, also designated SEQ ID:361.

Another function of GAM144 is therefore inhibition of LOC154877 (Accession XP_098626.1). Accordingly, utilities of GAM144 include diagnosis, prevention and treatment of diseases and clinical conditions associated with LOC154877.

LOC155032 (Accession XP_098647.1) is another GAM144 target gene, herein designated TARGET GENE. LOC155032 BINDING SITE is a target binding site found in the 3' untranslated region of mRNA encoded by LOC155032, corresponding to a target binding site such as BINDING SITE I, BINDING SITE II or BINDING SITE III of FIG. 8. Table 4 illustrates the complementarity of the nucleotide sequences of LOC155032 BINDING SITE, designated SEQ ID:14193, to the nucleotide sequence of GAM144 RNA, herein designated GAM RNA, also designated SEQ ID:361.

Another function of GAM144 is therefore inhibition of LOC155032 (Accession XP_098647.1). Accordingly, utilities of GAM144 include diagnosis, prevention and treatment of diseases and clinical conditions associated with LOC155032.

LOC164118 (Accession XP_089384.5) is another GAM144 target gene, herein designated TARGET GENE. LOC164118 BINDING SITE is a target binding site found in the 3' untranslated region of mRNA encoded by LOC164118, corresponding to a target binding site such as BINDING SITE I, BINDING SITE II or BINDING SITE III of FIG. 8. Table 4 illustrates the complementarity of the nucleotide sequences of LOC164118 BINDING SITE, designated SEQ ID:9005, to the nucleotide sequence of GAM144 RNA, herein designated GAM RNA, also designated SEQ ID:361.

Another function of GAM144 is therefore inhibition of LOC164118 (Accession XP_089384.5). Accordingly, utilities of GAM144 include diagnosis, prevention and treatment of diseases and clinical conditions associated with LOC164118.

LOC169981 (Accession XP_093024.3) is another GAM144 target gene, herein designated TARGET GENE. LOC169981 BINDING SITE is a target binding site found in the 3' untranslated region of mRNA encoded by LOC169981, corresponding to a target binding site such as BINDING SITE I, BINDING SITE II or BINDING SITE III of FIG. 8. Table 4 illustrates the complementarity of the nucleotide sequences of LOC169981 BINDING SITE, designated SEQ ID:18817, to the nucleotide sequence of GAM144 RNA, herein designated GAM RNA, also designated SEQ ID:361.

Another function of GAM144 is therefore inhibition of LOC169981 (Accession XP_093024.3). Accordingly, utilities of GAM144 include diagnosis, prevention and treatment of diseases and clinical conditions associated with LOC169981.

LOC197342 (Accession XP_113869.1) is another GAM144 target gene, herein designated TARGET GENE. LOC197342 BINDING SITE is a target binding site found in the 3' untranslated region of mRNA encoded by LOC197342, corresponding to a target binding site such as BINDING SITE I, BINDING SITE II or BINDING SITE III of FIG. 8. Table 4 illustrates the complementarity of the nucleotide sequences of LOC197342 BINDING SITE, designated SEQ ID:6172, to the nucleotide sequence of GAM144 RNA, herein designated GAM RNA, also designated SEQ ID:361.

Another function of GAM144 is therefore inhibition of LOC197342 (Accession XP_113869.1). Accordingly, utilities of GAM144 include diagnosis, prevention and treatment of diseases and clinical conditions associated with LOC197342.

LOC221749 (Accession XP_166341.3) is another GAM144 target gene, herein designated TARGET GENE. LOC221749 BINDING SITE is a target binding site found in the 3' untranslated region of mRNA encoded by LOC221749, corresponding to a target binding site such as BINDING SITE I, BINDING SITE II or BINDING SITE III of FIG. 8. Table 4 illustrates the complementarity of the nucleotide sequences of LOC221749 BINDING SITE, designated SEQ ID:3541, to the nucleotide sequence of GAM144 RNA, herein designated GAM RNA, also designated SEQ ID:361.

Another function of GAM144 is therefore inhibition of LOC221749 (Accession XP_166341.3). Accordingly, utilities of GAM144 include diagnosis, prevention and treatment of diseases and clinical conditions associated with LOC221749.

LOC221938 (Accession XP_166542.2) is another GAM144 target gene, herein designated TARGET GENE. LOC221938 BINDING SITE is a target binding site found in the 3' untranslated region of mRNA encoded by LOC221938, corresponding to a target binding site such as BINDING SITE I, BINDING SITE II or BINDING SITE III of FIG. 8. Table 4 illustrates the complementarity of the nucleotide sequences of LOC221938 BINDING SITE, designated SEQ ID:5317, to the nucleotide sequence of GAM144 RNA, herein designated GAM RNA, also designated SEQ ID:361.

Another function of GAM144 is therefore inhibition of LOC221938 (Accession XP_166542.2). Accordingly, utilities of GAM144 include diagnosis, prevention and treatment of diseases and clinical conditions associated with LOC221938.

LOC255330 (Accession NP_777595.1) is another GAM144 target gene, herein designated TARGET GENE. LOC255330 BINDING SITE is a target binding site found in the 3' untranslated region of mRNA encoded by LOC255330, corresponding to a target binding site such as BINDING SITE I, BINDING SITE II or BINDING SITE III of FIG. 8. Table 4 illustrates the complementarity of the nucleotide sequences of LOC255330 BINDING SITE, designated SEQ ID:1604, to the nucleotide sequence of GAM144 RNA, herein designated GAM RNA, also designated SEQ ID:361.

Another function of GAM144 is therefore inhibition of LOC255330 (Accession NP_777595.1). Accordingly, utilities of GAM144 include diagnosis, prevention and treatment of diseases and clinical conditions associated with LOC255330.

LOC255926 (Accession XP_171190.3) is another GAM144 target gene, herein designated TARGET GENE. LOC255926 BINDING SITE is a target binding site found in the 3' untranslated region of mRNA encoded by LOC255926, corresponding to a target binding site such as BINDING SITE I, BINDING SITE II or BINDING SITE III of FIG. 8. Table 4 illustrates the complementarity of the nucleotide sequences of LOC255926 BINDING SITE, designated SEQ ID:448, to the nucleotide sequence of GAM144 RNA, herein designated GAM RNA, also designated SEQ ID:361.

Another function of GAM144 is therefore inhibition of LOC255926 (Accession XP_171190.3). Accordingly, utilities of GAM144 include diagnosis, prevention and treatment of diseases and clinical conditions associated with LOC255926.

LOC255975 (Accession XP_171083.2) is another GAM144 target gene, herein designated TARGET GENE. LOC255975 BINDING SITE1 and LOC255975 BINDING SITE2 are target binding sites found in untranslated regions of mRNA encoded by LOC255975, corresponding to target binding sites such as BINDING SITE I, BINDING SITE II or BINDING SITE III of FIG. 8. Table 4 illustrates the complementarity of the nucleotide sequences of LOC255975 BINDING SITE1 and LOC255975 BINDING SITE2, designated SEQ ID:7649 and SEQ ID:10185 respectively, to the nucleotide sequence of GAM144 RNA, herein designated GAM RNA, also designated SEQ ID:361.

Another function of GAM144 is therefore inhibition of LOC255975 (Accession XP_171083.2). Accordingly, utilities of GAM144 include diagnosis, prevention and treatment of diseases and clinical conditions associated with LOC255975.

LOC255992 (Accession XP_172605.1) is another GAM144 target gene, herein designated TARGET GENE. LOC255992 BINDING SITE is a target binding site found in the 5' untranslated region of mRNA encoded by LOC255992, corresponding to a target binding site such as BINDING SITE I, BINDING SITE II or BINDING SITE III of FIG. 8. Table 4 illustrates the complementarity of the nucleotide sequences of LOC255992 BINDING SITE, designated SEQ ID:11034, to the nucleotide sequence of GAM144 RNA, herein designated GAM RNA, also designated SEQ ID:361.

Another function of GAM144 is therefore inhibition of LOC255992 (Accession XP_172605.1). Accordingly, utilities of GAM144 include diagnosis, prevention and treatment of diseases and clinical conditions associated with LOC255992.

LOC283045 (Accession XP_210866.1) is another GAM144 target gene, herein designated TARGET GENE. LOC283045 BINDING SITE is a target binding site found in the 3' untranslated region of mRNA encoded by LOC283045, corresponding to a target binding site such as BINDING SITE I, BINDING SITE II or BINDING SITE III of FIG. 8. Table 4 illustrates the complementarity of the nucleotide sequences of LOC283045 BINDING SITE, designated SEQ ID:15659, to the nucleotide sequence of GAM144 RNA, herein designated GAM RNA, also designated SEQ ID:361.

Another function of GAM144 is therefore inhibition of LOC283045 (Accession XP_210866.1). Accordingly, utilities of GAM144 include diagnosis, prevention and treatment of diseases and clinical conditions associated with LOC283045.

LOC283048 (Accession XP_210867.1) is another GAM144 target gene, herein designated TARGET GENE. LOC283048 BINDING SITE is a target binding site found in the 5' untranslated region of mRNA encoded by LOC283048, corresponding to a target binding site such as BINDING SITE I, BINDING SITE II or BINDING SITE III of FIG. 8. Table 4 illustrates the complementarity of the nucleotide sequences of LOC283048 BINDING SITE, designated SEQ ID:3775, to the nucleotide sequence of GAM144 RNA, herein designated GAM RNA, also designated SEQ ID:361.

Another function of GAM144 is therefore inhibition of LOC283048 (Accession XP_210867.1). Accordingly, utilities of GAM144 include diagnosis, prevention and treatment of diseases and clinical conditions associated with LOC283048.

LOC283125 (Accession XP_210897.1) is another GAM144 target gene, herein designated TARGET GENE. LOC283125 BINDING SITE is a target binding site found in the 3' untranslated region of mRNA encoded by LOC283125, corresponding to a target binding site such as BINDING SITE I, BINDING SITE II or BINDING SITE III of FIG. 8. Table 4 illustrates the complementarity of the nucleotide sequences of LOC283125 BINDING SITE, designated SEQ ID:16750, to the nucleotide sequence of GAM144 RNA, herein designated GAM RNA, also designated SEQ ID:361.

Another function of GAM144 is therefore inhibition of LOC283125 (Accession XP_210897.1). Accordingly, utilities of GAM144 include diagnosis, prevention and treatment of diseases and clinical conditions associated with LOC283125.

LOC283232 (Accession NP_777600.1) is another GAM144 target gene, herein designated TARGET GENE. LOC283232 BINDING SITE is a target binding site found in the 3' untranslated region of mRNA encoded by LOC283232, corresponding to a target binding site such as BINDING SITE I, BINDING SITE II or BINDING SITE III of FIG. 8. Table 4 illustrates the complementarity of the nucleotide sequences of LOC283232 BINDING SITE, designated SEQ ID:6314, to the nucleotide sequence of GAM144 RNA, herein designated GAM RNA, also designated SEQ ID:361.

Another function of GAM144 is therefore inhibition of LOC283232 (Accession NP_777600.1). Accordingly, utilities of GAM144 include diagnosis, prevention and treatment of diseases and clinical conditions associated with LOC283232.

LOC283382 (Accession XP_211005.1) is another GAM144 target gene, herein designated TARGET GENE. LOC283382 BINDING SITE is a target binding site found in the 3' untranslated region of mRNA encoded by LOC283382, corresponding to a target binding site such as BINDING SITE I, BINDING SITE II or BINDING SITE III of FIG. 8. Table 4 illustrates the complementarity of the nucleotide sequences of LOC283382 BINDING SITE, designated SEQ ID:13039, to the nucleotide sequence of GAM144 RNA, herein designated GAM RNA, also designated SEQ ID:361.

Another function of GAM144 is therefore inhibition of LOC283382 (Accession XP_211005.1). Accordingly, utilities of GAM144 include diagnosis, prevention and treatment of diseases and clinical conditions associated with LOC283382.

LOC283505 (Accession XP_208702.1) is another GAM144 target gene, herein designated TARGET GENE. LOC283505 BINDING SITE is a target binding site found in the 5' untranslated region of mRNA encoded by LOC283505, corresponding to a target binding site such as BINDING SITE I, BINDING SITE II or BINDING SITE III of FIG. 8. Table 4 illustrates the complementarity of the nucleotide sequences of LOC283505 BINDING SITE, designated SEQ ID:5605, to the nucleotide sequence of GAM144 RNA, herein designated GAM RNA, also designated SEQ ID:361.

Another function of GAM144 is therefore inhibition of LOC283505 (Accession XP_208702.1). Accordingly, utilities of GAM144 include diagnosis, prevention and treatment of diseases and clinical conditions associated with LOC283505.

LOC283806 (Accession XP_208846.1) is another GAM144 target gene, herein designated TARGET GENE. LOC283806 BINDING SITE is a target binding site found in the 5' untranslated region of mRNA encoded by LOC283806, corresponding to a target binding site such as BINDING SITE I, BINDING SITE II or BINDING SITE III of FIG. 8. Table 4 illustrates the complementarity of the nucleotide sequences of LOC283806 BINDING SITE, designated SEQ ID:707, to the nucleotide sequence of GAM144 RNA, herein designated GAM RNA, also designated SEQ ID:361.

Another function of GAM144 is therefore inhibition of LOC283806 (Accession XP_208846.1). Accordingly, utilities of GAM144 include diagnosis, prevention and treatment of diseases and clinical conditions associated with LOC283806.

LOC284065 (Accession XP_208995.1) is another GAM144 target gene, herein designated TARGET GENE. LOC284065 BINDING SITE is a target binding site found in the 3' untranslated region of mRNA encoded by LOC284065, corresponding to a target binding site such as BINDING SITE I, BINDING SITE II or BINDING SITE III of FIG. 8. Table 4 illustrates the complementarity of the nucleotide sequences of LOC284065 BINDING SITE, designated SEQ ID:12322, to the nucleotide sequence of GAM144 RNA, herein designated GAM RNA, also designated SEQ ID:361.

Another function of GAM144 is therefore inhibition of LOC284065 (Accession XP_208995.1). Accordingly, utilities of GAM144 include diagnosis, prevention and treatment of diseases and clinical conditions associated with LOC284065.

LOC284133 (Accession XP_211346.1) is another GAM144 target gene, herein designated TARGET GENE. LOC284133 BINDING SITE is a target binding site found in the 3' untranslated region of mRNA encoded by LOC284133, corresponding to a target binding site such as BINDING SITE I, BINDING SITE II or BINDING SITE III of FIG. 8. Table 4 illustrates the complementarity of the nucleotide sequences of LOC284133 BINDING SITE, designated SEQ ID:12882, to the nucleotide sequence of GAM144 RNA, herein designated GAM RNA, also designated SEQ ID:361.

Another function of GAM144 is therefore inhibition of LOC284133 (Accession XP_211346.1). Accordingly, utilities of GAM144 include diagnosis, prevention and treatment of diseases and clinical conditions associated with LOC284133.

LOC284175 (Accession XP_211364.1) is another GAM144 target gene, herein designated TARGET GENE. LOC284175 BINDING SITE is a target binding site found in the 5' untranslated region of mRNA encoded by LOC284175, corresponding to a target binding site such as BINDING SITE I, BINDING SITE II or BINDING SITE III of FIG. 8. Table 4 illustrates the complementarity of the nucleotide sequences of LOC284175 BINDING SITE, designated SEQ ID:8090, to the nucleotide sequence of GAM144 RNA, herein designated GAM RNA, also designated SEQ ID:361.

Another function of GAM144 is therefore inhibition of LOC284175 (Accession XP_211364.1). Accordingly, utilities of GAM144 include diagnosis, prevention and treatment of diseases and clinical conditions associated with LOC284175.

LOC284202 (Accession XP_208174.2) is another GAM144 target gene, herein designated TARGET GENE. LOC284202 BINDING SITE is a target binding site found in the 3' untranslated region of mRNA encoded by LOC284202, corresponding to a target binding site such as BINDING SITE I, BINDING SITE II or BINDING SITE III of FIG. 8. Table 4 illustrates the complementarity of the nucleotide sequences of LOC284202 BINDING SITE, designated SEQ ID:10595, to the nucleotide sequence of GAM144 RNA, herein designated GAM RNA, also designated SEQ ID:361.

Another function of GAM144 is therefore inhibition of LOC284202 (Accession XP_208174.2). Accordingly, utilities of GAM144 include diagnosis, prevention and treatment of diseases and clinical conditions associated with LOC284202.

LOC284242 (Accession XP_211398.1) is another GAM144 target gene, herein designated TARGET GENE. LOC284242 BINDING SITE is a target binding site found in the 5' untranslated region of mRNA encoded by LOC284242, corresponding to a target binding site such as BINDING SITE I, BINDING SITE II or BINDING SITE III of FIG. 8. Table 4 illustrates the complementarity of the nucleotide sequences of LOC284242 BINDING SITE, designated SEQ ID:16270, to the nucleotide sequence of GAM144 RNA, herein designated GAM RNA, also designated SEQ ID:361.

Another function of GAM144 is therefore inhibition of LOC284242 (Accession XP_211398.1). Accordingly, utilities of GAM144 include diagnosis, prevention and treatment of diseases and clinical conditions associated with LOC284242.

LOC284265 (Accession XP_209096.1) is another GAM144 target gene, herein designated TARGET GENE. LOC284265 BINDING SITE is a target binding site found in the 3' untranslated region of mRNA encoded by LOC284265, corresponding to a target binding site such as BINDING SITE I, BINDING SITE II or BINDING SITE III of FIG. 8. Table 4 illustrates the complementarity of the nucleotide sequences of LOC284265 BINDING SITE, designated SEQ ID:12953, to the nucleotide sequence of GAM144 RNA, herein designated GAM RNA, also designated SEQ ID:361.

Another function of GAM144 is therefore inhibition of LOC284265 (Accession XP_209096.1). Accordingly, utilities of GAM144 include diagnosis, prevention and treatment of diseases and clinical conditions associated with LOC284265.

LOC284600 (Accession XP_211548.1) is another GAM144 target gene, herein designated TARGET GENE. LOC284600 BINDING SITE is a target binding site found in the 3' untranslated region of mRNA encoded by LOC284600, corresponding to a target binding site such as BINDING SITE I, BINDING SITE II or BINDING SITE III of FIG. 8. Table 4 illustrates the complementarity of the nucleotide sequences of LOC284600 BINDING SITE, designated SEQ ID:7901, to the nucleotide sequence of GAM144 RNA, herein designated GAM RNA, also designated SEQ ID:361.

Another function of GAM144 is therefore inhibition of LOC284600 (Accession XP_211548.1). Accordingly, utilities of GAM144 include diagnosis, prevention and treatment of diseases and clinical conditions associated with LOC284600.

LOC284811 (Accession XP_211643.1) is another GAM144 target gene, herein designated TARGET GENE. LOC284811 BINDING SITE is a target binding site found in the 5' untranslated region of mRNA encoded by LOC284811, corresponding to a target binding site such as BINDING SITE I, BINDING SITE II or BINDING SITE III of FIG. 8. Table 4 illustrates the complementarity of the nucleotide sequences of LOC284811 BINDING SITE, designated SEQ ID:4644, to the nucleotide sequence of GAM144 RNA, herein designated GAM RNA, also designated SEQ ID:361.

Another function of GAM144 is therefore inhibition of LOC284811 (Accession XP_211643.1). Accordingly, utilities of GAM144 include diagnosis, prevention and treatment of diseases and clinical conditions associated with LOC284811.

LOC284836 (Accession XP_211654.1) is another GAM144 target gene, herein designated TARGET GENE. LOC284836 BINDING SITE is a target binding site found in the 5' untranslated region of mRNA encoded by LOC284836, corresponding to a target binding site such as BINDING SITE I, BINDING SITE II or BINDING SITE III of FIG. 8. Table 4 illustrates the complementarity of the nucleotide sequences of LOC284836 BINDING SITE, designated SEQ ID:6675, to the nucleotide sequence of GAM144 RNA, herein designated GAM RNA, also designated SEQ ID:361.

Another function of GAM144 is therefore inhibition of LOC284836 (Accession XP_211654.1). Accordingly, utilities of GAM144 include diagnosis, prevention and treatment of diseases and clinical conditions associated with LOC284836.

LOC284952 (Accession XP_211706.1) is another GAM144 target gene, herein designated TARGET GENE. LOC284952 BINDING SITE is a target binding site found in the 5' untranslated region of mRNA encoded by LOC284952, corresponding to a target binding site such as BINDING SITE I, BINDING SITE II or BINDING SITE III of FIG. 8. Table 4 illustrates the complementarity of the nucleotide sequences of LOC284952 BINDING SITE, designated SEQ ID:4865, to the nucleotide sequence of GAM144 RNA, herein designated GAM RNA, also designated SEQ ID:361.

Another function of GAM144 is therefore inhibition of LOC284952 (Accession XP_211706.1). Accordingly, utilities of GAM144 include diagnosis, prevention and treatment of diseases and clinical conditions associated with LOC284952.

LOC284981 (Accession XP_211720.1) is another GAM144 target gene, herein designated TARGET GENE. LOC284981 BINDING SITE is a target binding site found in the 3' untranslated region of mRNA encoded by LOC284981, corresponding to a target binding site such as BINDING SITE I, BINDING SITE II or BINDING SITE III of FIG. 8. Table 4 illustrates the complementarity of the nucleotide sequences of LOC284981 BINDING SITE, designated SEQ ID:9447, to the nucleotide sequence of GAM144 RNA, herein designated GAM RNA, also designated SEQ ID:361.

Another function of GAM144 is therefore inhibition of LOC284981 (Accession XP_211720.1). Accordingly, utilities of GAM144 include diagnosis, prevention and treatment of diseases and clinical conditions associated with LOC284981.

LOC285092 (Accession XP_210410.3) is another GAM144 target gene, herein designated TARGET GENE. LOC285092 BINDING SITE is a target binding site found in the 5' untranslated region of mRNA encoded by LOC285092, corresponding to a target binding site such as BINDING SITE I, BINDING SITE II or BINDING SITE III of FIG. 8. Table 4 illustrates the complementarity of the nucleotide sequences of LOC285092 BINDING SITE, designated SEQ ID:4645, to the nucleotide sequence of GAM144 RNA, herein designated GAM RNA, also designated SEQ ID:361.

Another function of GAM144 is therefore inhibition of LOC285092 (Accession XP_210410.3). Accordingly, utilities of GAM144 include diagnosis, prevention and treatment of diseases and clinical conditions associated with LOC285092.

LOC285633 (Accession XP_211965.1) is another GAM144 target gene, herein designated TARGET GENE. LOC285633 BINDING SITE is a target binding site found in the 5' untranslated region of mRNA encoded by LOC285633, corresponding to a target binding site such as BINDING SITE I, BINDING SITE II or BINDING SITE III of FIG. 8. Table 4 illustrates the complementarity of the nucleotide sequences of LOC285633 BINDING SITE, designated SEQ ID:7854, to the nucleotide sequence of GAM144 RNA, herein designated GAM RNA, also designated SEQ ID:361.

Another function of GAM144 is therefore inhibition of LOC285633 (Accession XP_211965.1). Accordingly, utilities of GAM144 include diagnosis, prevention and treatment of diseases and clinical conditions associated with LOC285633.

LOC285673 (Accession XP_209720.1) is another GAM144 target gene, herein designated TARGET GENE. LOC285673 BINDING SITE is a target binding site found in the 5' untranslated region of mRNA encoded by LOC285673, corresponding to a target binding site such as BINDING SITE I, BINDING SITE II or BINDING SITE III of FIG. 8. Table 4 illustrates the complementarity of the nucleotide sequences of LOC285673 BINDING SITE, designated SEQ ID:7761, to the nucleotide sequence of GAM144 RNA, herein designated GAM RNA, also designated SEQ ID:361.

Another function of GAM144 is therefore inhibition of LOC285673 (Accession XP_209720.1). Accordingly, utilities of GAM144 include diagnosis, prevention and treatment of diseases and clinical conditions associated with LOC285673.

LOC285678 (Accession XP_209717.1) is another GAM144 target gene, herein designated TARGET GENE. LOC285678 BINDING SITE is a target binding site found in the 5' untranslated region of mRNA encoded by LOC285678, corresponding to a target binding site such as BINDING SITE I, BINDING SITE II or BINDING SITE III of FIG. 8. Table 4 illustrates the complementarity of the nucleotide sequences of LOC285678 BINDING SITE, designated SEQ ID:7718, to the nucleotide sequence of GAM144 RNA, herein designated GAM RNA, also designated SEQ ID:361.

Another function of GAM144 is therefore inhibition of LOC285678 (Accession XP_209717.1). Accordingly, utilities of GAM144 include diagnosis, prevention and treatment of diseases and clinical conditions associated with LOC285678.

LOC285812 (Accession XP_212055.1) is another GAM144 target gene, herein designated TARGET GENE. LOC285812 BINDING SITE is a target binding site found in the 3' untranslated region of mRNA encoded by LOC285812, corresponding to a target binding site such as BINDING SITE I, BINDING SITE II or BINDING SITE III of FIG. 8. Table 4 illustrates the complementarity of the nucleotide sequences of LOC285812 BINDING SITE, designated SEQ ID:9156, to the nucleotide sequence of GAM144 RNA, herein designated GAM RNA, also designated SEQ ID:361.

Another function of GAM144 is therefore inhibition of LOC285812 (Accession XP_212055.1). Accordingly, utilities of GAM144 include diagnosis, prevention and treatment of diseases and clinical conditions associated with LOC285812.

LOC285853 (Accession XP_209779.1) is another GAM144 target gene, herein designated TARGET GENE. LOC285853 BINDING SITE is a target binding site found in the 5' untranslated region of mRNA encoded by LOC285853, corresponding to a target binding site such as BINDING SITE I, BINDING SITE II or BINDING SITE III of FIG. 8. Table 4 illustrates the complementarity of the nucleotide sequences of LOC285853 BINDING SITE, designated SEQ ID:14829, to the nucleotide sequence of GAM144 RNA, herein designated GAM RNA, also designated SEQ ID:361.

Another function of GAM144 is therefore inhibition of LOC285853 (Accession XP_209779.1). Accordingly, utilities of GAM144 include diagnosis, prevention and treatment of diseases and clinical conditions associated with LOC285853.

LOC285950 (Accession XP_212089.1) is another GAM144 target gene, herein designated TARGET GENE. LOC285950 BINDING SITE is a target binding site found in the 5' untranslated region of mRNA encoded by LOC285950, corresponding to a target binding site such as BINDING SITE I, BINDING SITE II or BINDING SITE III of FIG. 8. Table 4 illustrates the complementarity of the nucleotide sequences of LOC285950 BINDING SITE, designated SEQ ID:8104, to the nucleotide sequence of GAM144 RNA, herein designated GAM RNA, also designated SEQ ID:361.

Another function of GAM144 is therefore inhibition of LOC285950 (Accession XP_212089.1). Accordingly, utilities of GAM144 include diagnosis, prevention and treatment of diseases and clinical conditions associated with LOC285950.

LOC286044 (Accession XP_212150.1) is another GAM144 target gene, herein designated TARGET GENE. LOC286044 BINDING SITE is a target binding site found in the 3' untranslated region of mRNA encoded by LOC286044, corresponding to a target binding site such as BINDING SITE I, BINDING SITE II or BINDING SITE III of FIG. 8. Table 4 illustrates the complementarity of the nucleotide sequences of LOC286044 BINDING SITE, designated SEQ ID:19106, to the nucleotide sequence of GAM144 RNA, herein designated GAM RNA, also designated SEQ ID:361.

Another function of GAM144 is therefore inhibition of LOC286044 (Accession XP_212150.1). Accordingly, utilities of GAM144 include diagnosis, prevention and treatment of diseases and clinical conditions associated with LOC286044.

LOC286166 (Accession XP_209925.1) is another GAM144 target gene, herein designated TARGET GENE. LOC286166 BINDING SITE is a target binding site found in the 5' untranslated region of mRNA encoded by LOC286166, corresponding to a target binding site such as BINDING SITE I, BINDING SITE II or BINDING SITE III of FIG. 8. Table 4 illustrates the complementarity of the nucleotide sequences of LOC286166 BINDING SITE, designated SEQ ID:6568, to the nucleotide sequence of GAM144 RNA, herein designated GAM RNA, also designated SEQ ID:361.

Another function of GAM144 is therefore inhibition of LOC286166 (Accession XP_209925.1). Accordingly, utilities of GAM144 include diagnosis, prevention and treatment of diseases and clinical conditions associated with LOC286166.

LOC286425 (Accession XP_208420.1) is another GAM144 target gene, herein designated TARGET GENE. LOC286425 BINDING SITE is a target binding site found in the 3' untranslated region of mRNA encoded by LOC286425, corresponding to a target binding site such as BINDING SITE I, BINDING SITE II or BINDING SITE III of FIG. 8. Table 4 illustrates the complementarity of the nucleotide sequences of LOC286425 BINDING SITE, designated SEQ ID:13002, to the nucleotide sequence of GAM144 RNA, herein designated GAM RNA, also designated SEQ ID:361.

Another function of GAM144 is therefore inhibition of LOC286425 (Accession XP_208420.1). Accordingly, utilities of GAM144 include diagnosis, prevention and treatment of diseases and clinical conditions associated with LOC286425.

LOC286528 (Accession XP_210501.1) is another GAM144 target gene, herein designated TARGET GENE. LOC286528 BINDING SITE is a target binding site found in the 5' untranslated region of mRNA encoded by LOC286528, corresponding to a target binding site such as BINDING SITE I, BINDING SITE II or BINDING SITE III of FIG. 8. Table 4 illustrates the complementarity of the nucleotide sequences of LOC286528 BINDING SITE, designated SEQ ID:9313, to the nucleotide sequence of GAM144 RNA, herein designated GAM RNA, also designated SEQ ID:361.

Another function of GAM144 is therefore inhibition of LOC286528 (Accession XP_210501.1). Accordingly, utilities of GAM144 include diagnosis, prevention and treatment of diseases and clinical conditions associated with LOC286528.

LOC338585 (Accession XP_294658.1) is another GAM144 target gene, herein designated TARGET GENE. LOC338585 BINDING SITE is a target binding site found in the 5' untranslated region of mRNA encoded by LOC338585, corresponding to a target binding site such as BINDING SITE I, BINDING SITE II or BINDING SITE III of FIG. 8. Table 4 illustrates the complementarity of the nucleotide sequences of LOC338585 BINDING SITE, designated SEQ ID:513, to the nucleotide sequence of GAM144 RNA, herein designated GAM RNA, also designated SEQ ID:361.

Another function of GAM144 is therefore inhibition of LOC338585 (Accession XP_294658.1). Accordingly, utilities of GAM144 include diagnosis, prevention and treatment of diseases and clinical conditions associated with LOC338585.

LOC338609 (Accession XP_294664.1) is another GAM144 target gene, herein designated TARGET GENE. LOC338609 BINDING SITE is a target binding site found in the 3' untranslated region of mRNA encoded by LOC338609, corresponding to a target binding site such as BINDING SITE I, BINDING SITE II or BINDING SITE III of FIG. 8. Table 4 illustrates the complementarity of the nucleotide sequences of LOC338609 BINDING SITE, designated SEQ ID:17348, to the nucleotide sequence of GAM144 RNA, herein designated GAM RNA, also designated SEQ ID:361.

Another function of GAM144 is therefore inhibition of LOC338609 (Accession XP_294664.1). Accordingly, utilities of GAM144 include diagnosis, prevention and treatment of diseases and clinical conditions associated with LOC338609.

LOC338842 (Accession XP_294729.1) is another GAM144 target gene, herein designated TARGET GENE. LOC338842 BINDING SITE is a target binding site found in the 5' untranslated region of mRNA encoded by LOC338842, corresponding to a target binding site such as BINDING SITE I, BINDING SITE II or BINDING SITE III of FIG. 8. Table 4 illustrates the complementarity of the nucleotide sequences of LOC338842 BINDING SITE, designated SEQ ID:16575, to the nucleotide sequence of GAM144 RNA, herein designated GAM RNA, also designated SEQ ID:361.

Another function of GAM144 is therefore inhibition of LOC338842 (Accession XP_294729.1). Accordingly, utilities of GAM144 include diagnosis, prevention and treatment of diseases and clinical conditions associated with LOC338842.

LOC339159 (Accession XP_294834.2) is another GAM144 target gene, herein designated TARGET GENE. LOC339159 BINDING SITE is a target binding site found in the 5' untranslated region of mRNA encoded by LOC339159, corresponding to a target binding site such as BINDING SITE I, BINDING SITE II or BINDING SITE III of FIG. 8. Table 4 illustrates the complementarity of the nucleotide sequences of LOC339159 BINDING SITE, designated SEQ ID:16086, to the nucleotide sequence of GAM144 RNA, herein designated GAM RNA, also designated SEQ ID:361.

Another function of GAM144 is therefore inhibition of LOC339159 (Accession XP_294834.2). Accordingly, utilities of GAM144 include diagnosis, prevention and treatment of diseases and clinical conditions associated with LOC339159.

LOC339354 (Accession XP_290289.1) is another GAM144 target gene, herein designated TARGET GENE. LOC339354 BINDING SITE is a target binding site found in the 3' untranslated region of mRNA encoded by LOC339354, corresponding to a target binding site such as BINDING SITE I, BINDING SITE II or BINDING SITE III of FIG. 8. Table 4 illustrates the complementarity of the nucleotide sequences of LOC339354 BINDING SITE, designated SEQ ID:17438, to the nucleotide sequence of GAM144 RNA, herein designated GAM RNA, also designated SEQ ID:361.

Another function of GAM144 is therefore inhibition of LOC339354 (Accession XP_290289.1). Accordingly, utilities of GAM144 include diagnosis, prevention and treatment of diseases and clinical conditions associated with LOC339354.

LOC339381 (Accession XP_086070.2) is another GAM144 target gene, herein designated TARGET GENE. LOC339381 BINDING SITE is a target binding site found in the 3' untranslated region of mRNA encoded by LOC339381, corresponding to a target binding site such as BINDING SITE I, BINDING SITE II or BINDING SITE III of FIG. 8. Table 4 illustrates the complementarity of the nucleotide sequences of LOC339381 BINDING SITE, designated SEQ ID:17886, to the nucleotide sequence of GAM144 RNA, herein designated GAM RNA, also designated SEQ ID:361.

Another function of GAM144 is therefore inhibition of LOC339381 (Accession XP_086070.2). Accordingly, utilities of GAM144 include diagnosis, prevention and treatment of diseases and clinical conditions associated with LOC339381.

LOC339385 (Accession XP_290863.1) is another GAM144 target gene, herein designated TARGET GENE. LOC339385 BINDING SITE is a target binding site found in the 5' untranslated region of mRNA encoded by LOC339385, corresponding to a target binding site such as BINDING SITE I, BINDING SITE II or BINDING SITE III of FIG. 8. Table 4 illustrates the complementarity of the nucleotide sequences of LOC339385 BINDING SITE, designated SEQ ID:11261, to the nucleotide sequence of GAM144 RNA, herein designated GAM RNA, also designated SEQ ID:361.

Another function of GAM144 is therefore inhibition of LOC339385 (Accession XP_290863.1). Accordingly, utilities of GAM144 include diagnosis, prevention and treatment of diseases and clinical conditions associated with LOC339385.

LOC339711 (Accession XP_295038.1) is another GAM144 target gene, herein designated TARGET GENE. LOC339711 BINDING SITE is a target binding site found in the 3' untranslated region of mRNA encoded by LOC339711, corresponding to a target binding site such as BINDING SITE I, BINDING SITE II or BINDING SITE III of FIG. 8. Table 4 illustrates the complementarity of the nucleotide sequences of LOC339711 BINDING SITE, designated SEQ ID:12948, to the nucleotide sequence of GAM144 RNA, herein designated GAM RNA, also designated SEQ ID:361.

Another function of GAM144 is therefore inhibition of LOC339711 (Accession XP_295038.1). Accordingly, utilities of GAM144 include diagnosis, prevention and treatment of diseases and clinical conditions associated with LOC339711.

LOC339717 (Accession XP_295040.1) is another GAM144 target gene, herein designated TARGET GENE. LOC339717 BINDING SITE is a target binding site found in the 5' untranslated region of mRNA encoded by LOC339717, corresponding to a target binding site such as BINDING SITE I, BINDING SITE II or BINDING SITE III of FIG. 8. Table 4 illustrates the complementarity of the nucleotide sequences of LOC339717 BINDING SITE, designated SEQ ID:18301, to the nucleotide sequence of GAM144 RNA, herein designated GAM RNA, also designated SEQ ID:361.

Another function of GAM144 is therefore inhibition of LOC339717 (Accession XP_295040.1). Accordingly, utilities of GAM144 include diagnosis, prevention and treatment of diseases and clinical conditions associated with LOC339717.

LOC340449 (Accession XP_290424.2) is another GAM144 target gene, herein designated TARGET GENE. LOC340449 BINDING SITE is a target binding site found in the 5' untranslated region of mRNA encoded by LOC340449, corresponding to a target binding site such as BINDING SITE I, BINDING SITE II or BINDING SITE III of FIG. 8. Table 4 illustrates the complementarity of the nucleotide sequences of LOC340449 BINDING SITE, designated SEQ ID:13612, to the nucleotide sequence of GAM144 RNA, herein designated GAM RNA, also designated SEQ ID:361.

Another function of GAM144 is therefore inhibition of LOC340449 (Accession XP_290424.2). Accordingly, utilities of GAM144 include diagnosis, prevention and treatment of diseases and clinical conditions associated with LOC340449.

LOC340895 (Accession XP_295865.1) is another GAM144 target gene, herein designated TARGET GENE. LOC340895 BINDING SITE is a target binding site found in the 3' untranslated region of mRNA encoded by LOC340895, corresponding to a target binding site such as BINDING SITE I, BINDING SITE II or BINDING SITE III of FIG. 8. Table 4 illustrates the complementarity of the nucleotide sequences of LOC340895 BINDING SITE, designated SEQ ID:1020, to the nucleotide sequence of GAM144 RNA, herein designated GAM RNA, also designated SEQ ID:361.

Another function of GAM144 is therefore inhibition of LOC340895 (Accession XP_295865.1). Accordingly, utilities of GAM144 include diagnosis, prevention and treatment of diseases and clinical conditions associated with LOC340895.

LOC347546 (Accession XP_298101.2) is another GAM144 target gene, herein designated TARGET GENE. LOC347546 BINDING SITE is a target binding site found in the 3' untranslated region of mRNA encoded by LOC347546, corresponding to a target binding site such as BINDING SITE I, BINDING SITE II or BINDING SITE III of FIG. 8. Table 4 illustrates the complementarity of the nucleotide sequences of LOC347546 BINDING SITE, designated SEQ ID:1558, to the nucleotide sequence of GAM144 RNA, herein designated GAM RNA, also designated SEQ ID:361.

Another function of GAM144 is therefore inhibition of LOC347546 (Accession XP_298101.2). Accordingly, utilities of GAM144 include diagnosis, prevention and treatment of diseases and clinical conditions associated with LOC347546.

LOC348099 (Accession XP_302654.1) is another GAM144 target gene, herein designated TARGET GENE. LOC348099 BINDING SITE is a target binding site found in the 3' untranslated region of mRNA encoded by LOC348099, corresponding to a target binding site such as BINDING SITE I, BINDING SITE II or BINDING SITE III of FIG. 8. Table 4 illustrates the complementarity of the nucleotide sequences of LOC348099 BINDING SITE, designated SEQ ID:1075, to the nucleotide sequence of GAM144 RNA, herein designated GAM RNA, also designated SEQ ID:361.

Another function of GAM144 is therefore inhibition of LOC348099 (Accession XP_302654.1). Accordingly, utilities of GAM144 include diagnosis, prevention and treatment of diseases and clinical conditions associated with LOC348099.

LOC348144 (Accession XP_300638.1) is another GAM144 target gene, herein designated TARGET GENE. LOC348144 BINDING SITE is a target binding site found in the 5' untranslated region of mRNA encoded by LOC348144, corresponding to a target binding site such as BINDING SITE I, BINDING SITE II or BINDING SITE III of FIG. 8. Table 4 illustrates the complementarity of the nucleotide sequences of LOC348144 BINDING SITE, designated SEQ ID:9665, to the nucleotide sequence of GAM144 RNA, herein designated GAM RNA, also designated SEQ ID:361.

Another function of GAM144 is therefore inhibition of LOC348144 (Accession XP_300638.1). Accordingly, utilities of GAM144 include diagnosis, prevention and treatment of diseases and clinical conditions associated with LOC348144.

LOC348406 (Accession XP_302746.1) is another GAM144 target gene, herein designated TARGET GENE. LOC348406 BINDING SITE is a target binding site found in the 3' untranslated region of mRNA encoded by LOC348406, corresponding to a target binding site such as BINDING SITE I, BINDING SITE II or BINDING SITE III of FIG. 8. Table 4 illustrates the complementarity of the nucleotide sequences of LOC348406 BINDING SITE, designated SEQ ID:5817, to the nucleotide sequence of GAM144 RNA, herein designated GAM RNA, also designated SEQ ID:361.

Another function of GAM144 is therefore inhibition of LOC348406 (Accession XP_302746.1). Accordingly, utilities of GAM144 include diagnosis, prevention and treatment of diseases and clinical conditions associated with LOC348406.

LOC348461 (Accession XP_302764.1) is another GAM144 target gene, herein designated TARGET GENE. LOC348461 BINDING SITE is a target binding site found in the 3' untranslated region of mRNA encoded by LOC348461, corresponding to a target binding site such as BINDING SITE I, BINDING SITE II or BINDING SITE III of FIG. 8. Table 4 illustrates the complementarity of the nucleotide sequences of LOC348461 BINDING SITE, designated SEQ ID:4302, to the nucleotide sequence of GAM144 RNA, herein designated GAM RNA, also designated SEQ ID:361.

Another function of GAM144 is therefore inhibition of LOC348461 (Accession XP_302764.1). Accordingly, utilities of GAM144 include diagnosis, prevention and treatment of diseases and clinical conditions associated with LOC348461.

LOC348527 (Accession XP_300779.1) is another GAM144 target gene, herein designated TARGET GENE. LOC348527 BINDING SITE1 and LOC348527 BINDING SITE2 are target binding sites found in untranslated regions of mRNA encoded by LOC348527, corresponding to target binding sites such as BINDING SITE I, BINDING SITE II or BINDING SITE III of FIG. 8. Table 4 illustrates the complementarity of the nucleotide sequences of LOC348527 BINDING SITE1 and LOC348527 BINDING SITE2, designated SEQ ID:14241 and SEQ ID:8859 respectively, to the nucleotide sequence of GAM144 RNA, herein designated GAM RNA, also designated SEQ ID:361.

Another function of GAM144 is therefore inhibition of LOC348527 (Accession XP_300779.1). Accordingly, utilities of GAM144 include diagnosis, prevention and treatment of diseases and clinical conditions associated with LOC348527.

LOC348768 (Accession XP_302883.1) is another GAM144 target gene, herein designated TARGET GENE.

LOC348768 BINDING SITE is a target binding site found in the 3' untranslated region of mRNA encoded by LOC348768, corresponding to a target binding site such as BINDING SITE I, BINDING SITE II or BINDING SITE III of FIG. 8. Table 4 illustrates the complementarity of the nucleotide sequences of LOC348768 BINDING SITE, designated SEQ ID:10838, to the nucleotide sequence of GAM144 RNA, herein designated GAM RNA, also designated SEQ ID:361.

Another function of GAM144 is therefore inhibition of LOC348768 (Accession XP_302883.1). Accordingly, utilities of GAM144 include diagnosis, prevention and treatment of diseases and clinical conditions associated with LOC348768.

LOC348842 (Accession XP_300861.1) is another GAM144 target gene, herein designated TARGET GENE. LOC348842 BINDING SITE is a target binding site found in the 5' untranslated region of mRNA encoded by LOC348842, corresponding to a target binding site such as BINDING SITE I, BINDING SITE II or BINDING SITE III of FIG. 8. Table 4 illustrates the complementarity of the nucleotide sequences of LOC348842 BINDING SITE, designated SEQ ID:7649, to the nucleotide sequence of GAM144 RNA, herein designated GAM RNA, also designated SEQ ID:361.

Another function of GAM144 is therefore inhibition of LOC348842 (Accession XP_300861.1). Accordingly, utilities of GAM144 include diagnosis, prevention and treatment of diseases and clinical conditions associated with LOC348842.

LOC349234 (Accession XP_300987.1) is another GAM144 target gene, herein designated TARGET GENE. LOC349234 BINDING SITE is a target binding site found in the 3' untranslated region of mRNA encoded by LOC349234, corresponding to a target binding site such as BINDING SITE I, BINDING SITE II or BINDING SITE III of FIG. 8. Table 4 illustrates the complementarity of the nucleotide sequences of LOC349234 BINDING SITE, designated SEQ ID:10784, to the nucleotide sequence of GAM144 RNA, herein designated GAM RNA, also designated SEQ ID:361.

Another function of GAM144 is therefore inhibition of LOC349234 (Accession XP_300987.1). Accordingly, utilities of GAM144 include diagnosis, prevention and treatment of diseases and clinical conditions associated with LOC349234.

LOC349323 (Accession XP_301029.1) is another GAM144 target gene, herein designated TARGET GENE. LOC349323 BINDING SITE is a target binding site found in the 5' untranslated region of mRNA encoded by LOC349323, corresponding to a target binding site such as BINDING SITE I, BINDING SITE II or BINDING SITE III of FIG. 8. Table 4 illustrates the complementarity of the nucleotide sequences of LOC349323 BINDING SITE, designated SEQ ID:6731, to the nucleotide sequence of GAM144 RNA, herein designated GAM RNA, also designated SEQ ID:361.

Another function of GAM144 is therefore inhibition of LOC349323 (Accession XP_301029.1). Accordingly, utilities of GAM144 include diagnosis, prevention and treatment of diseases and clinical conditions associated with LOC349323.

LOC351983 (Accession XP_305307.1) is another GAM144 target gene, herein designated TARGET GENE. LOC351983 BINDING SITE is a target binding site found in the 5' untranslated region of mRNA encoded by LOC351983, corresponding to a target binding site such as BINDING SITE I, BINDING SITE II or BINDING SITE III of FIG. 8. Table 4 illustrates the complementarity of the nucleotide sequences of LOC351983 BINDING SITE, designated SEQ ID:9902, to the nucleotide sequence of GAM144 RNA, herein designated GAM RNA, also designated SEQ ID:361.

Another function of GAM144 is therefore inhibition of LOC351983 (Accession XP_305307.1). Accordingly, utilities of GAM144 include diagnosis, prevention and treatment of diseases and clinical conditions associated with LOC351983.

LOC90529 (Accession NP_835223.1) is another GAM144 target gene, herein designated TARGET GENE. LOC90529 BINDING SITE is a target binding site found in the 3' untranslated region of mRNA encoded by LOC90529, corresponding to a target binding site such as BINDING SITE I, BINDING SITE II or BINDING SITE III of FIG. 8. Table 4 illustrates the complementarity of the nucleotide sequences of LOC90529 BINDING SITE, designated SEQ ID:10023, to the nucleotide sequence of GAM144 RNA, herein designated GAM RNA, also designated SEQ ID:361.

Another function of GAM144 is therefore inhibition of LOC90529 (Accession NP_835223.1). Accordingly, utilities of GAM144 include diagnosis, prevention and treatment of diseases and clinical conditions associated with LOC90529.

LOC91661 (Accession NP_612381.1) is another GAM144 target gene, herein designated TARGET GENE. LOC91661 BINDING SITE is a target binding site found in the 3' untranslated region of mRNA encoded by LOC91661, corresponding to a target binding site such as BINDING SITE I, BINDING SITE II or BINDING SITE III of FIG. 8. Table 4 illustrates the complementarity of the nucleotide sequences of LOC91661 BINDING SITE, designated SEQ ID:17439, to the nucleotide sequence of GAM144 RNA, herein designated GAM RNA, also designated SEQ ID:361.

Another function of GAM144 is therefore inhibition of LOC91661 (Accession NP_612381.1). Accordingly, utilities of GAM144 include diagnosis, prevention and treatment of diseases and clinical conditions associated with LOC91661.

LOC91664 (Accession XP_039908.2) is another GAM144 target gene, herein designated TARGET GENE. LOC91664 BINDING SITE1 and LOC91664 BINDING SITE2 are target binding sites found in untranslated regions of mRNA encoded by LOC91664, corresponding to target binding sites such as BINDING SITE I, BINDING SITE II or BINDING SITE III of FIG. 8. Table 4 illustrates the complementarity of the nucleotide sequences of LOC91664 BINDING SITE1 and LOC91664 BINDING SITE2, designated SEQ ID:16097 and SEQ ID:20155 respectively, to the nucleotide sequence of GAM144 RNA, herein designated GAM RNA, also designated SEQ ID:361.

Another function of GAM144 is therefore inhibition of LOC91664 (Accession XP_039908.2). Accordingly, utilities of GAM144 include diagnosis, prevention and treatment of diseases and clinical conditions associated with LOC91664.

LOC93097 (Accession XP_049221.1) is another GAM144 target gene, herein designated TARGET GENE. LOC93097 BINDING SITE is a target binding site found in the 5' untranslated region of mRNA encoded by LOC93097, corresponding to a target binding site such as BINDING SITE I, BINDING SITE II or BINDING SITE III of FIG. 8. Table 4 illustrates the complementarity of the nucleotide sequences of LOC93097 BINDING SITE, designated SEQ ID:7213, to the nucleotide sequence of GAM144 RNA, herein designated GAM RNA, also designated SEQ ID:361.

Another function of GAM144 is therefore inhibition of LOC93097 (Accession XP_049221.1). Accordingly, utilities of GAM144 include diagnosis, prevention and treatment of diseases and clinical conditions associated with LOC93097.

LOC96597 (Accession XP_039922.1) is another GAM144 target gene, herein designated TARGET GENE. LOC96597 BINDING SITE is a target binding site found in the 5' untranslated region of mRNA encoded by LOC96597, corresponding to a target binding site such as BINDING SITE I, BINDING SITE II or BINDING SITE III of FIG. 8. Table 4 illustrates the complementarity of the nucleotide sequences of LOC96597 BINDING SITE, designated SEQ ID:16552, to the nucleotide sequence of GAM144 RNA, herein designated GAM RNA, also designated SEQ ID:361.

Another function of GAM144 is therefore inhibition of LOC96597 (Accession XP_039922.1). Accordingly, utilities of GAM144 include diagnosis, prevention and treatment of diseases and clinical conditions associated with LOC96597.

Lysyl oxidase-like 1 (LOXL1, Accession NP_005567.1) is another GAM144 target gene, herein designated TARGET GENE. LOXL1 BINDING SITE is a target binding site found in the 3' untranslated region of mRNA encoded by LOXL1, corresponding to a target binding site such as BINDING SITE I, BINDING SITE II or BINDING SITE III of FIG. 8. Table 4 illustrates the complementarity of the nucleotide sequences of LOXL1 BINDING SITE, designated SEQ ID:14029, to the nucleotide sequence of GAM144 RNA, herein designated GAM RNA, also designated SEQ ID:361.

Another function of GAM144 is therefore inhibition of Lysyl oxidase-like 1 (LOXL1, Accession NP_005567.1), a gene which is Involved in collagen and elastin crosslinking. Accordingly, utilities of GAM144 include diagnosis, prevention and treatment of diseases and clinical conditions associated with LOXL1.

The function of LOXL1 has been established by previous studies. Kenyon et al. (1993) isolated a novel human cDNA with a predicted protein homologous to the carboxyl end of lysyl oxidase (LOX; 153455). The homology to lysyl oxidase began exactly at the position of the exon 1/exon 2 boundary in the mouse gene. The lysyl oxidase-like gene, which appeared to be no larger than 22.1 kb, coded for a single polyadenylated RNA species of 2.48 kb By fluorescence in situ hybridization, Kenyon et al. (1993) mapped the human LOXL gene to 15q24-q25. Using interspecific backcross analysis, Wydner et al. (1997) mapped the mouse Loxl gene to chromosome 9, in a region that shows conservation of synteny with human 15q24. Goy et al. (2000) presented physical mapping data demonstrating linkage of the LOXL1 gene to the PML gene (OMIM Ref. No. 102578) on human chromosome 15q22.

Full details of the abovementioned studies are described in the following publications, the disclosure of which are hereby incorporated by reference:

Kenyon, K.; Modi, W. S.; Contente, S.; Friedman, R. M.: A novel human cDNA with a predicted protein similar to lysyl oxidase maps to chromosome 15q24-q25. J. Biol. Chem. 268:18435-18437, 1993; and Kim, Y.; Boy, C. D.; Csiszar, K.: A new gene with sequence and structural similarity to the gene encoding human lysyl oxidase. J. Biol. Chem. 270:7176-7182, 1995.

Further studies establishing the function and utilities of LOXL1 are found in John Hopkins OMIM database record ID 153456, and in cited publications listed in Table 5, which are hereby incorporated by reference. Mucosal vascular addressin cell adhesion molecule 1 (MADCAM1, Accession NP_570117.1) is another GAM144 target gene, herein designated TARGET GENE. MADCAM1 BINDING SITE is a target binding site found in the 3' untranslated region of multiple transcripts of mRNA encoded by MADCAM1, corresponding to a target binding site such as BINDING SITE I, BINDING SITE II or BINDING SITE III of FIG. 8. Table 4 illustrates the complementarity of the nucleotide sequences of MADCAM1 BINDING SITE, designated SEQ ID:13746, to the nucleotide sequence of GAM144 RNA, herein designated GAM RNA, also designated SEQ ID:361.

Another function of GAM144 is therefore inhibition of Mucosal vascular addressin cell adhesion molecule 1 (MADCAM1, Accession NP_570117.1). Accordingly, utilities of GAM144 include diagnosis, prevention and treatment of diseases and clinical conditions associated with MADCAM1.

Mucosal vascular addressin cell adhesion molecule 1 (MADCAM1, Accession NP_570116.1) is another GAM144 target gene, herein designated TARGET GENE. MADCAM1 BINDING SITE is a target binding site found in the 3' untranslated region of multiple transcripts of mRNA encoded by MADCAM1, corresponding to a target binding site such as BINDING SITE I, BINDING SITE II or BINDING SITE III of FIG. 8. Table 4 illustrates the complementarity of the nucleotide sequences of MADCAM1 BINDING SITE, designated SEQ ID:13746, to the nucleotide sequence of GAM144 RNA, herein designated GAM RNA, also designated SEQ ID:361.

Another function of GAM144 is therefore inhibition of Mucosal vascular addressin cell adhesion molecule 1 (MADCAM1, Accession NP_570116.1). Accordingly, utilities of GAM144 include diagnosis, prevention and treatment of diseases and clinical conditions associated with MADCAM1.

Mucosal vascular addressin cell adhesion molecule 1 (MADCAM1, Accession NP_570118.1) is another GAM144 target gene, herein designated TARGET GENE. MADCAM1 BINDING SITE is a target binding site found in the 3' untranslated region of multiple transcripts of mRNA encoded by MADCAM1, corresponding to a target binding site such as BINDING SITE I, BINDING SITE II or BINDING SITE III of FIG. 8. Table 4 illustrates the complementarity of the nucleotide sequences of MADCAM1 BINDING SITE, designated SEQ ID:13746, to the nucleotide sequence of GAM144 RNA, herein designated GAM RNA, also designated SEQ ID:361.

Another function of GAM144 is therefore inhibition of Mucosal vascular addressin cell adhesion molecule 1 (MADCAM1, Accession NP_570118.1). Accordingly, utilities of GAM144 include diagnosis, prevention and treatment of diseases and clinical conditions associated with MADCAM1.

MGC10702 (Accession NP_116052.1) is another GAM144 target gene, herein designated TARGET GENE. MGC10702 BINDING SITE is a target binding site found in the 5' untranslated region of mRNA encoded by MGC10702, corresponding to a target binding site such as BINDING SITE I, BINDING SITE II or BINDING SITE III of FIG. 8. Table 4 illustrates the complementarity of the nucleotide sequences of MGC10702 BINDING SITE, designated SEQ ID:17096, to the nucleotide sequence of GAM144 RNA, herein designated GAM RNA, also designated SEQ ID:361.

Another function of GAM144 is therefore inhibition of MGC10702 (Accession NP_116052.1). Accordingly, utilities of GAM144 include diagnosis, prevention and treatment of diseases and clinical conditions associated with MGC10702.

MGC16638 (Accession NP_777593.1) is another GAM144 target gene, herein designated TARGET GENE. MGC16638 BINDING SITE is a target binding site found in the 5' untranslated region of mRNA encoded by MGC16638, corresponding to a target binding site such as BINDING SITE I, BINDING SITE II or BINDING SITE III of FIG. 8. Table 4 illustrates the complementarity of the nucleotide sequences of MGC16638 BINDING SITE, designated SEQ ID:14522, to the nucleotide sequence of GAM144 RNA, herein designated GAM RNA, also designated SEQ ID:361.

Another function of GAM144 is therefore inhibition of MGC16638 (Accession NP_777593.1). Accordingly, utilities of GAM144 include diagnosis, prevention and treatment of diseases and clinical conditions associated with MGC16638.

MGC17791 (Accession NP_689575.1) is another GAM144 target gene, herein designated TARGET GENE. MGC17791 BINDING SITE is a target binding site found in the 3' untranslated region of mRNA encoded by MGC17791, corresponding to a target binding site such as BINDING SITE I, BINDING SITE II or BINDING SITE III of FIG. 8. Table 4 illustrates the complementarity of the nucleotide sequences of MGC17791 BINDING SITE, designated SEQ ID:1463, to the nucleotide sequence of GAM144 RNA, herein designated GAM RNA, also designated SEQ ID:361.

Another function of GAM144 is therefore inhibition of MGC17791 (Accession NP_689575.1). Accordingly, utilities of GAM144 include diagnosis, prevention and treatment of diseases and clinical conditions associated with MGC17791.

MGC23270 (Accession NP_689859.1) is another GAM144 target gene, herein designated TARGET GENE. MGC23270 BINDING SITE is a target binding site found in the 3' untranslated region of mRNA encoded by MGC23270, corresponding to a target binding site such as BINDING SITE I, BINDING SITE II or BINDING SITE III of FIG. 8. Table 4 illustrates the complementarity of the nucleotide sequences of MGC23270 BINDING SITE, designated SEQ ID:9116, to the nucleotide sequence of GAM144 RNA, herein designated GAM RNA, also designated SEQ ID:361.

Another function of GAM144 is therefore inhibition of MGC23270 (Accession NP_689859.1). Accordingly, utilities of GAM144 include diagnosis, prevention and treatment of diseases and clinical conditions associated with MGC23270.

MGC29761 (Accession NP_653255.1) is another GAM144 target gene, herein designated TARGET GENE. MGC29761 BINDING SITE is a target binding site found in the 3' untranslated region of mRNA encoded by MGC29761, corresponding to a target binding site such as BINDING SITE I, BINDING SITE II or BINDING SITE III of FIG. 8. Table 4 illustrates the complementarity of the nucleotide sequences of MGC29761 BINDING SITE, designated SEQ ID:8792, to the nucleotide sequence of GAM144 RNA, herein designated GAM RNA, also designated SEQ ID:361.

Another function of GAM144 is therefore inhibition of MGC29761 (Accession NP_653255.1). Accordingly, utilities of GAM144 include diagnosis, prevention and treatment of diseases and clinical conditions associated with MGC29761.

MGC3169 (Accession NP_076979.1) is another GAM144 target gene, herein designated TARGET GENE. MGC3169 BINDING SITE is a target binding site found in the 3' untranslated region of mRNA encoded by MGC3169, corresponding to a target binding site such as BINDING SITE I, BINDING SITE II or BINDING SITE III of FIG. 8. Table 4 illustrates the complementarity of the nucleotide sequences of MGC3169 BINDING SITE, designated SEQ ID:19412, to the nucleotide sequence of GAM144 RNA, herein designated GAM RNA, also designated SEQ ID:361.

Another function of GAM144 is therefore inhibition of MGC3169 (Accession NP_076979.1). Accordingly, utilities of GAM144 include diagnosis, prevention and treatment of diseases and clinical conditions associated with MGC3169.

MGC35366 (Accession NP_689648.1) is another GAM144 target gene, herein designated TARGET GENE. MGC35366 BINDING SITE is a target binding site found in the 3' untranslated region of mRNA encoded by MGC35366, corresponding to a target binding site such as BINDING SITE I, BINDING SITE II or BINDING SITE III of FIG. 8. Table 4 illustrates the complementarity of the nucleotide sequences of MGC35366 BINDING SITE, designated SEQ ID:13055, to the nucleotide sequence of GAM144 RNA, herein designated GAM RNA, also designated SEQ ID:361.

Another function of GAM144 is therefore inhibition of MGC35366 (Accession NP_689648.1). Accordingly, utilities of GAM144 include diagnosis, prevention and treatment of diseases and clinical conditions associated with MGC35366.

MGC4368 (Accession NP_078786.2) is another GAM144 target gene, herein designated TARGET GENE. MGC4368 BINDING SITE is a target binding site found in the 3' untranslated region of mRNA encoded by MGC4368, corresponding to a target binding site such as BINDING SITE I, BINDING SITE II or BINDING SITE III of FIG. 8. Table 4 illustrates the complementarity of the nucleotide sequences of MGC4368 BINDING SITE, designated SEQ ID:10795, to the nucleotide sequence of GAM144 RNA, herein designated GAM RNA, also designated SEQ ID:361.

Another function of GAM144 is therefore inhibition of MGC4368 (Accession NP_078786.2). Accordingly, utilities of GAM144 include diagnosis, prevention and treatment of diseases and clinical conditions associated with MGC4368.

MGC45380 (Accession NP_597723.1) is another GAM144 target gene, herein designated TARGET GENE. MGC45380 BINDING SITE is a target binding site found in the 3' untranslated region of mRNA encoded by MGC45380, corresponding to a target binding site such as BINDING SITE I, BINDING SITE II or BINDING SITE III of FIG. 8. Table 4 illustrates the complementarity of the nucleotide sequences of MGC45380 BINDING SITE, designated SEQ ID:1218, to the nucleotide sequence of GAM144 RNA, herein designated GAM RNA, also designated SEQ ID:361.

Another function of GAM144 is therefore inhibition of MGC45380 (Accession NP_597723.1). Accordingly, utilities of GAM144 include diagnosis, prevention and treatment of diseases and clinical conditions associated with MGC45380.

MIRAB13 (Accession NP_203744.1) is another GAM144 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:10121, to the nucleotide sequence of GAM144 RNA, herein designated GAM RNA, also designated SEQ ID:361.

Another function of GAM144 is therefore inhibition of MIRAB13 (Accession NP_203744.1). Accordingly, utilities of GAM144 include diagnosis, prevention and treatment of diseases and clinical conditions associated with MIRAB13.

MIRAB13 (Accession XP_039236.6) is another GAM144 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:10121, to the nucleotide sequence of GAM144 RNA, herein designated GAM RNA, also designated SEQ ID:361.

Another function of GAM144 is therefore inhibition of MIRAB13 (Accession XP_039236.6). Accordingly, utilities of GAM144 include diagnosis, prevention and treatment of diseases and clinical conditions associated with MIRAB13.

Makorin, ring finger protein, 1 (MKRN1, Accession NP_038474.1) is another GAM144 target gene, herein designated TARGET GENE. MKRN1 BINDING SITE is a target binding site found in the 3' untranslated region of mRNA encoded by MKRN1, corresponding to a target binding site such as BINDING SITE I, BINDING SITE II or BINDING SITE III of FIG. 8. Table 4 illustrates the complementarity of the nucleotide sequences of MKRN1 BINDING SITE, designated SEQ ID:5351, to the nucleotide sequence of GAM144 RNA, herein designated GAM RNA, also designated SEQ ID:361.

Another function of GAM144 is therefore inhibition of Makorin, ring finger protein, 1 (MKRN1, Accession NP_038474.1). Accordingly, utilities of GAM144 include diagnosis, prevention and treatment of diseases and clinical conditions associated with MKRN1.

Membrane protein, palmitoylated 2 (maguk p55 subfamily member 2) (MPP2, Accession NP_005365.2) is another GAM144 target gene, herein designated TARGET GENE. MPP2 BINDING SITE is a target binding site found in the 3' untranslated region of mRNA encoded by MPP2, corresponding to a target binding site such as BINDING SITE I, BINDING SITE II or BINDING SITE III of FIG. 8. Table 4 illustrates the complementarity of the nucleotide sequences of MPP2 BINDING SITE, designated SEQ ID:15648, to the nucleotide sequence of GAM144 RNA, herein designated GAM RNA, also designated SEQ ID:361.

Another function of GAM144 is therefore inhibition of Membrane protein, palmitoylated 2 (maguk p55 subfamily member 2) (MPP2, Accession NP_005365.2). Accordingly, utilities of GAM144 include diagnosis, prevention and treatment of diseases and clinical conditions associated with MPP2.

Mucin 6, gastric (MUC6, Accession XP_290540.1) is another GAM144 target gene, herein designated TARGET GENE. MUC6 BINDING SITE is a target binding site found in the 5' untranslated region of mRNA encoded by MUC6, corresponding to a target binding site such as BINDING SITE I, BINDING SITE II or BINDING SITE III of FIG. 8. Table 4 illustrates the complementarity of the nucleotide sequences of MUC6 BINDING SITE, designated SEQ ID:19534, to the nucleotide sequence of GAM144 RNA, herein designated GAM RNA, also designated SEQ ID:361.

Another function of GAM144 is therefore inhibition of Mucin 6, gastric (MUC6, Accession XP_290540.1). Accordingly, utilities of GAM144 include diagnosis, prevention and treatment of diseases and clinical conditions associated with MUC6.

Neuron navigator 1 (NAV1, Accession NP_065176.2) is another GAM144 target gene, herein designated TARGET GENE. NAV1 BINDING SITE is a target binding site found in the 3' untranslated region of mRNA encoded by NAV1, corresponding to a target binding site such as BINDING SITE I, BINDING SITE II or BINDING SITE III of FIG. 8. Table 4 illustrates the complementarity of the nucleotide sequences of NAV1 BINDING SITE, designated SEQ ID:1396, to the nucleotide sequence of GAM144 RNA, herein designated GAM RNA, also designated SEQ ID:361.

Another function of GAM144 is therefore inhibition of Neuron navigator 1 (NAV1, Accession NP_065176.2). Accordingly, utilities of GAM144 include diagnosis, prevention and treatment of diseases and clinical conditions associated with NAV1.

Ndrg family member 4 (NDRG4, Accession NP_075061.1) is another GAM144 target gene, herein designated TARGET GENE. NDRG4 BINDING SITE is a target binding site found in the 3' untranslated region of multiple transcripts of mRNA encoded by NDRG4, corresponding to a target binding site such as BINDING SITE I, BINDING SITE II or BINDING SITE III of FIG. 8. Table 4 illustrates the complementarity of the nucleotide sequences of NDRG4 BINDING SITE, designated SEQ ID:19945, to the nucleotide sequence of GAM144 RNA, herein designated GAM RNA, also designated SEQ ID:361.

Another function of GAM144 is therefore inhibition of Ndrg family member 4 (NDRG4, Accession NP_075061.1). Accordingly, utilities of GAM144 include diagnosis, prevention and treatment of diseases and clinical conditions associated with NDRG4.

Ndrg family member 4 (NDRG4, Accession NP_065198.1) is another GAM144 target gene, herein designated TARGET GENE. NDRG4 BINDING SITE is a target binding site found in the 3' untranslated region of multiple transcripts of mRNA encoded by NDRG4, corresponding to a target binding site such as BINDING SITE I, BINDING SITE II or BINDING SITE III of FIG. 8. Table 4 illustrates the complementarity of the nucleotide sequences of NDRG4 BINDING SITE, designated SEQ ID:19945, to the nucleotide sequence of GAM144 RNA, herein designated GAM RNA, also designated SEQ ID:361.

Another function of GAM144 is therefore inhibition of Ndrg family member 4 (NDRG4, Accession NP_065198.1). Accordingly, utilities of GAM144 include diagnosis, prevention and treatment of diseases and clinical conditions associated with NDRG4.

Sialidase 3 (membrane sialidase) (NEU3, Accession NP_006647.2) is another GAM144 target gene, herein designated TARGET GENE. NEU3 BINDING SITE is a target binding site found in the 3' untranslated region of mRNA encoded by NEU3, corresponding to a target binding site such as BINDING SITE I, BINDING SITE II or BINDING SITE III of FIG. 8. Table 4 illustrates the complementarity of the nucleotide sequences of NEU3 BINDING SITE, designated SEQ ID:4466, to the nucleotide sequence of GAM144 RNA, herein designated GAM RNA, also designated SEQ ID:361.

Another function of GAM144 is therefore inhibition of Sialidase 3 (membrane sialidase) (NEU3, Accession NP_006647.2). Accordingly, utilities of GAM144 include diagnosis, prevention and treatment of diseases and clinical conditions associated with NEU3.

Nuclear factor (erythroid-derived 2)-like 1 (NFE2L1, Accession NP_003195.1) is another GAM144 target gene, herein designated TARGET GENE. NFE2L1 BINDING SITE is a target binding site found in the 5' untranslated region of mRNA encoded by NFE2L1, corresponding to a target binding site such as BINDING SITE I, BINDING SITE II or BINDING SITE III of FIG. 8. Table 4 illustrates the complementarity of the nucleotide sequences of NFE2L1 BINDING SITE, designated SEQ ID:1538, to the nucleotide sequence of GAM144 RNA, herein designated GAM RNA, also designated SEQ ID:361.

Another function of GAM144 is therefore inhibition of Nuclear factor (erythroid-derived 2)-like 1 (NFE2L1, Accession NP_003195.1), a gene which may regulate expression of ferritin genes. Accordingly, utilities of GAM144 include diagnosis, prevention and treatment of diseases and clinical conditions associated with NFE2L1.

The function of NFE2L1 and its association with various diseases and clinical conditions, has been established by previous studies, as described hereinabove with reference to GAM90.1. Nipsnap homolog 1 (c. elegans) (NIPSNAP1, Accession NP_003625.1) is another GAM144 target gene, herein designated TARGET GENE. NIPSNAP1 BINDING SITE is a target binding site found in the 3' untranslated region of mRNA encoded by NIPSNAP1, corresponding to a target binding site such as BINDING SITE I, BINDING SITE II or BINDING SITE III of FIG. 8. Table 4 illustrates the complementarity of the nucleotide sequences of NIPSNAP1 BINDING SITE, designated SEQ ID:8413, to the nucleotide sequence of GAM144 RNA, herein designated GAM RNA, also designated SEQ ID:361.

Another function of GAM144 is therefore inhibition of Nipsnap homolog 1 (c. elegans) (NIPSNAP1, Accession NP_003625.1). Accordingly, utilities of GAM144 include diagnosis, prevention and treatment of diseases and clinical conditions associated with NIPSNAP1.

Nuclear receptor subfamily 2, group e, member 3 (NR2E3, Accession NP_057430.1) is another GAM144 target gene, herein designated TARGET GENE. NR2E3 BINDING SITE is a target binding site found in the 3' untranslated region of multiple transcripts of mRNA encoded by NR2E3, corresponding to a target binding site such as BINDING SITE I, BINDING SITE II or BINDING SITE III of FIG. 8. Table 4 illustrates the complementarity of the nucleotide sequences of NR2E3 BINDING SITE, designated SEQ ID:3895, to the nucleotide sequence of GAM144 RNA, herein designated GAM RNA, also designated SEQ ID:361.

Another function of GAM144 is therefore inhibition of Nuclear receptor subfamily 2, group e, member 3 (NR2E3, Accession NP_057430.1). Accordingly, utilities of GAM144 include diagnosis, prevention and treatment of diseases and clinical conditions associated with NR2E3.

Neurotensin receptor 1 (high affinity) (NTSR1, Accession NP_002522.1) is another GAM144 target gene, herein designated TARGET GENE. NTSR1 BINDING SITE is a target binding site found in the 3' untranslated region of mRNA encoded by NTSR1, corresponding to a target binding site such as BINDING SITE I, BINDING SITE II or BINDING SITE III of FIG. 8. Table 4 illustrates the complementarity of the nucleotide sequences of NTSR1 BINDING SITE, designated SEQ ID:19566, to the nucleotide sequence of GAM144 RNA, herein designated GAM RNA, also designated SEQ ID:361.

Another function of GAM144 is therefore inhibition of Neurotensin receptor 1 (high affinity) (NTSR1, Accession NP_002522.1), a gene which is associated with g proteins that activate a phosphatidylinositol-calcium second messenger system. Accordingly, utilities of GAM144 include diagnosis, prevention and treatment of diseases and clinical conditions associated with NTSR1.

The function of NTSR1 and its association with various diseases and clinical conditions, has been established by previous studies, as described hereinabove with reference to GAM133.1. Nudix (nucleoside diphosphate linked moiety x)-type motif 11 (NUDT11, Accession NP_060629.1) is another GAM144 target gene, herein designated TARGET GENE. NUDT11 BINDING SITE is a target binding site found in the 3' untranslated region of mRNA encoded by NUDT11, corresponding to a target binding site such as BINDING SITE I, BINDING SITE II or BINDING SITE III of FIG. 8. Table 4 illustrates the complementarity of the nucleotide sequences of NUDT11 BINDING SITE, designated SEQ ID:3712, to the nucleotide sequence of GAM144 RNA, herein designated GAM RNA, also designated SEQ ID:361.

Another function of GAM144 is therefore inhibition of Nudix (nucleoside diphosphate linked moiety x)-type motif 11 (NUDT11, Accession NP_060629.1). Accordingly, utilities of GAM144 include diagnosis, prevention and treatment of diseases and clinical conditions associated with NUDT11.

Olfactory receptor, family 2, subfamily h, member 1 (OR2H1, Accession NP_112145.1) is another GAM144 target gene, herein designated TARGET GENE. OR2H1 BINDING SITE is a target binding site found in the 5' untranslated region of mRNA encoded by OR2H1, corresponding to a target binding site such as BINDING SITE I, BINDING SITE II or BINDING SITE III of FIG. 8. Table 4 illustrates the complementarity of the nucleotide sequences of OR2H1 BINDING SITE, designated SEQ ID:7630, to the nucleotide sequence of GAM144 RNA, herein designated GAM RNA, also designated SEQ ID:361.

Another function of GAM144 is therefore inhibition of Olfactory receptor, family 2, subfamily h, member 1 (OR2H1, Accession NP_112145.1). Accordingly, utilities of GAM144 include diagnosis, prevention and treatment of diseases and clinical conditions associated with OR2H1.

Oxytocin receptor (OXTR, Accession NP_000907.1) is another GAM144 target gene, herein designated TARGET GENE. OXTR BINDING SITE is a target binding site found in the 5' untranslated region of mRNA encoded by OXTR, corresponding to a target binding site such as BINDING SITE I, BINDING SITE II or BINDING SITE III of FIG. 8. Table 4 illustrates the complementarity of the nucleotide sequences of OXTR BINDING SITE, designated SEQ ID:15896, to the nucleotide sequence of GAM144 RNA, herein designated GAM RNA, also designated SEQ ID:361.

Another function of GAM144 is therefore inhibition of Oxytocin receptor (OXTR, Accession NP_000907.1), a gene which induces inward ion currents. Accordingly, utilities of GAM144 include diagnosis, prevention and treatment of diseases and clinical conditions associated with OXTR.

The function of OXTR has been established by previous studies. Just before the onset of labor, uterine muscle becomes exceedingly sensitive to oxytocin, for which it is a primary target tissue, because of a dramatic increase in the number of oxytocin receptors. Kimura et al. (1992) reported the structure and expression of the human oxytocin receptor cDNA isolated by expression cloning. The encoded receptor was a 388-amino acid polypeptide with 7 transmembrane domains typical of G protein-coupled receptors. The oxytocin receptor, expressed in Xenopus oocytes, specifically responded to oxytocin and induced an inward membrane current. Messenger RNAs for the receptor were of 2 sizes, 3.6 kb in breast and 4.4 kb in ovary, endometrium, and myometrium. The mRNA level in myometrium was very high at term. Yang et al. (2002) found that mutation of lysine-270 (K270) in wildtype OTR completely abolished the ability of the receptor to stimulate phosphatidylinositide turnover, with only a small reduction in ligand affinity. These data demonstrated that OTR K270 is critically important in the stimulation by OTR of phosphatidylinositide turnover. Mutation of K270 also adversely affected the ability of OTR to stimulate ERK1/2 (601795, 176948) phosphorylation. Therefore, this residue plays an important role in the specificity of OTR/G-alpha-q (OMIM Ref. No. 600998)/PLC (see OMIM Ref. No. 602142) coupling.

Full details of the abovementioned studies are described in the following publications, the disclosure of which are hereby incorporated by reference:

Kimura, T.; Tanizawa, O.; Mori, K.; Brownstein, M. J.; Okayama, H.: Structure and expression of a human oxytocin receptor. Nature 356:526-529, 1992; and Yang, M.; Wang, W.; Zhong, M.; Philippi, A.; Lichtarge, O.; Sanborn, B. M.: Lysine 270 in the third intracellular domain of the oxytocin receptor is an important determinant for G-alph.

Further studies establishing the function and utilities of OXTR are found in John Hopkins OMIM database record ID 167055, and in cited publications listed in Table 5, which are hereby incorporated by reference. PACAP (Accession NP_057543.1) is another GAM144 target gene, herein designated TARGET GENE. PACAP BINDING SITE is a target binding site found in the 5' untranslated region of mRNA encoded by PACAP, corresponding to a target binding site such as BINDING SITE I, BINDING SITE II or BINDING SITE III of FIG. 8. Table 4 illustrates the complementarity of the nucleotide sequences of PACAP BINDING SITE, designated SEQ ID:6514, to the nucleotide sequence of GAM144 RNA, herein designated GAM RNA, also designated SEQ ID:361.

Another function of GAM144 is therefore inhibition of PACAP (Accession NP_057543.1). Accordingly, utilities of GAM144 include diagnosis, prevention and treatment of diseases and clinical conditions associated with PACAP.

Phosphatidylcholine transfer protein (PCTP, Accession NP_067036.1) is another GAM144 target gene, herein designated TARGET GENE. PCTP BINDING SITE is a target binding site found in the 3' untranslated region of mRNA encoded by PCTP, corresponding to a target binding site such as BINDING SITE I, BINDING SITE II or BINDING SITE III of FIG. 8. Table 4 illustrates the complementarity of the nucleotide sequences of PCTP BINDING SITE, designated SEQ ID:5135, to the nucleotide sequence of GAM144 RNA, herein designated GAM RNA, also designated SEQ ID:361.

Another function of GAM144 is therefore inhibition of Phosphatidylcholine transfer protein (PCTP, Accession NP_067036.1), a gene which catalyzes the transfer of phosphatidylcholine between membranes (by similarity). Accordingly, utilities of GAM144 include diagnosis, prevention and treatment of diseases and clinical conditions associated with PCTP.

The function of PCTP has been established by previous studies. Phosphatidylcholine (PC) transfer protein (PCTP) is a cytosolic protein first purified from bovine and rat liver that catalyzes intermembrane transfer of PC. By searching an EST database for homologs of bovine Pctp, followed by 5-prime RACE and PCR of a kidney cDNA library, Cohen et al. (1999) obtained a cDNA encoding human PCTP. The deduced 214-amino acid human protein is 76% and 80% identical to bovine and rat Pctp, respectively. Northern blot analysis revealed wide expression of an approximately 2.3-kb PCTP transcript in all tissues tested except thymus. Highest expression was detected in liver, placenta, testis, kidney, and heart, and lowest levels were found in brain and lung.

Animal model experiments lend further support to the function of PCTP. Van Helvoort et al. (1999) disrupted the Pctp gene in mice. Pctp knockout mice showed no defects in the secretion of PC into bile or lung surfactant, and the lipid content and composition of bile and surfactant was normal. The authors concluded that PCTP does not play a major role in transporting PC from the endoplasmic reticulum, where it is synthesized, to the hepatocyte canalicular membrane.

It is appreciated that the abovementioned animal model for PCTP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Cohen, D. E.; Green, R. M.; Wu, M. K.; Beier, D. R.: Cloning, tissue-specific expression, gene structure and chromosomal localization of human phosphatidylcholine transfer protein. Biochim. Biophys. Acta 1447:265-270, 1999; and van Helvoort, A.; de Brouwer, A.; Ottenhoff, R.; Brouwers, J. F. H. M.; Wijnholds, J.; Beijnen, J. H.; Rijneveld, A.; van der Valk, M. A.; Majoor, D.; Voorhout, W.; Wirtz, K. W. A.; El.

Further studies establishing the function and utilities of PCTP are found in John Hopkins OMIM database record ID 606055, and in cited publications listed in Table 5, which are hereby incorporated by reference. Pdz and lim domain 2 (mystique) (PDLIM2, Accession NP_789847.1) is another GAM144 target gene, herein designated TARGET GENE. PDLIM2 BINDING SITE is a target binding site found in the 3' untranslated region of multiple transcripts of mRNA encoded by PDLIM2, corresponding to a target binding site such as BINDING SITE I, BINDING SITE II or BINDING SITE III of FIG. 8. Table 4 illustrates the complementarity of the nucleotide sequences of PDLIM2 BINDING SITE, designated SEQ ID:3034, to the nucleotide sequence of GAM144 RNA, herein designated GAM RNA, also designated SEQ ID:361.

Another function of GAM144 is therefore inhibition of Pdz and lim domain 2 (mystique) (PDLIM2, Accession NP_789847.1). Accordingly, utilities of GAM144 include diagnosis, prevention and treatment of diseases and clinical conditions associated with PDLIM2.

PIF1 (Accession XP_290643.1) is another GAM144 target gene, herein designated TARGET GENE. PIF1 BINDING SITE is a target binding site found in the 3' untranslated region of mRNA encoded by PIF1, corresponding to a target binding site such as BINDING SITE I, BINDING SITE II or BINDING SITE III of FIG. 8. Table 4 illustrates the complementarity of the nucleotide sequences of PIF1 BINDING SITE, designated SEQ ID:19368, to the nucleotide sequence of GAM144 RNA, herein designated GAM RNA, also designated SEQ ID:361.

Another function of GAM144 is therefore inhibition of PIF1 (Accession XP_290643.1). Accordingly, utilities of GAM144 include diagnosis, prevention and treatment of diseases and clinical conditions associated with PIF1.

Polycystic kidney disease 2-like 1 (PKD2L1, Accession NP_057196.1) is another GAM144 target gene, herein designated TARGET GENE. PKD2L1 BINDING SITE is a target binding site found in the 5' untranslated region of mRNA encoded by PKD2L1, corresponding to a target binding site such as BINDING SITE I, BINDING SITE II or BINDING SITE III of FIG. 8. Table 4 illustrates the complementarity of the nucleotide sequences of PKD2L1 BINDING SITE, designated SEQ ID:7698, to the nucleotide sequence of GAM144 RNA, herein designated GAM RNA, also designated SEQ ID:361.

Another function of GAM144 is therefore inhibition of Polycystic kidney disease 2-like 1 (PKD2L1, Accession NP_057196.1). Accordingly, utilities of GAM144 include diagnosis, prevention and treatment of diseases and clinical conditions associated with PKD2L1.

Procollagen-lysine, 2-oxoglutarate 5-dioxygenase (lysine hydroxylase, ehlers-danlos syndrome type vi) (PLOD, Accession NP_000293.1) is another GAM144 target gene, herein designated TARGET GENE. PLOD BINDING SITE is a target binding site found in the 3' untranslated region of mRNA encoded by PLOD, corresponding to a target binding site such as BINDING SITE I, BINDING SITE II or BIND- ING SITE III of FIG. 8. Table 4 illustrates the complementarity of the nucleotide sequences of PLOD BINDING SITE, designated SEQ ID:2035, to the nucleotide sequence of GAM144 RNA, herein designated GAM RNA, also designated SEQ ID:361.

Another function of GAM144 is therefore inhibition of Procollagen-lysine, 2-oxoglutarate 5-dioxygenase (lysine hydroxylase, ehlers-danlos syndrome type vi) (PLOD, Accession NP_000293.1). Accordingly, utilities of GAM144 include diagnosis, prevention and treatment of diseases and clinical conditions associated with PLOD.

Polymerase (dna directed), eta (POLH, Accession NP_006493.1) is another GAM144 target gene, herein designated TARGET GENE. POLH BINDING SITE is a target binding site found in the 3' untranslated region of mRNA encoded by POLH, corresponding to a target binding site such as BINDING SITE I, BINDING SITE II or BINDING SITE III of FIG. 8. Table 4 illustrates the complementarity of the nucleotide sequences of POLH BINDING SITE, designated SEQ ID:6619, to the nucleotide sequence of GAM144 RNA, herein designated GAM RNA, also designated SEQ ID:361.

Another function of GAM144 is therefore inhibition of Polymerase (dna directed), eta (POLH, Accession NP_006493.1). Accordingly, utilities of GAM144 include diagnosis, prevention and treatment of diseases and clinical conditions associated with POLH.

POMT2 (Accession NP_037514.1) is another GAM144 target gene, herein designated TARGET GENE. POMT2 BINDING SITE is a target binding site found in the 3' untranslated region of mRNA encoded by POMT2, corresponding to a target binding site such as BINDING SITE I, BINDING SITE II or BINDING SITE III of FIG. 8. Table 4 illustrates the complementarity of the nucleotide sequences of POMT2 BINDING SITE, designated SEQ ID:15796, to the nucleotide sequence of GAM144 RNA, herein designated GAM RNA, also designated SEQ ID:361.

Another function of GAM144 is therefore inhibition of POMT2 (Accession NP_037514.1). Accordingly, utilities of GAM144 include diagnosis, prevention and treatment of diseases and clinical conditions associated with POMT2.

Pou domain, class 2, associating factor 1 (POU2AF1, Accession NP_006226.1) is another GAM144 target gene, herein designated TARGET GENE. POU2AF1 BINDING SITE is a target binding site found in the 5' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:892, to the nucleotide sequence of GAM144 RNA, herein designated GAM RNA, also designated SEQ ID:361.

Another function of GAM144 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM144 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. Peptidylprolyl isomerase b (cyclophilin b) (PPIB, Accession NP_000933.1) is another GAM144 target gene, herein designated TARGET GENE. PPIB BINDING SITE is a target binding site found in the 3' untranslated region of mRNA encoded by PPIB, corresponding to a target binding site such as BINDING SITE I, BINDING SITE II or BINDING SITE III of FIG. 8. Table 4 illustrates the complementarity of the nucleotide sequences of PPIB BINDING SITE, designated SEQ ID:8556, to the nucleotide sequence of GAM144 RNA, herein designated GAM RNA, also designated SEQ ID:361.

Another function of GAM144 is therefore inhibition of Peptidylprolyl isomerase b (cyclophilin b) (PPIB, Accession NP_000933.1). Accordingly, utilities of GAM144 include diagnosis, prevention and treatment of diseases and clinical conditions associated with PPIB.

Peptidylprolyl isomerase e (cyclophilin e) (PPIE, Accession NP_006103.1) is another GAM144 target gene, herein designated TARGET GENE. PPIE BINDING SITE1 and PPIE BINDING SITE2 are target binding sites found in untranslated regions of mRNA encoded by PPIE, corresponding to target binding sites such as BINDING SITE I, BINDING SITE II or BINDING SITE III of FIG. 8. Table 4 illustrates the complementarity of the nucleotide sequences of PPIE BINDING SITE1 and PPIE BINDING SITE2, designated SEQ ID:11142 and SEQ ID:18340 respectively, to the nucleotide sequence of GAM144 RNA, herein designated GAM RNA, also designated SEQ ID:361.

Another function of GAM144 is therefore inhibition of Peptidylprolyl isomerase e (cyclophilin e) (PPIE, Accession NP_006103.1). Accordingly, utilities of GAM144 include diagnosis, prevention and treatment of diseases and clinical conditions associated with PPIE.

Protein phosphatase 1, regulatory (inhibitor) subunit 16b (PPP1R16B, Accession NP_056383.1) is another GAM144 target gene, herein designated TARGET GENE. PPP1R16B BINDING SITE is a target binding site found in the 3' untranslated region of mRNA encoded by PPP1R16B, corresponding to a target binding site such as BINDING SITE I, BINDING SITE II or BINDING SITE III of FIG. 8. Table 4 illustrates the complementarity of the nucleotide sequences of PPP1R16B BINDING SITE, designated SEQ ID:14705, to the nucleotide sequence of GAM144 RNA, herein designated GAM RNA, also designated SEQ ID:361.

Another function of GAM144 is therefore inhibition of Protein phosphatase 1, regulatory (inhibitor) subunit 16b (PPP1R16B, Accession NP_056383.1). Accordingly, utilities of GAM144 include diagnosis, prevention and treatment of diseases and clinical conditions associated with PPP1R16B.

Protein phosphatase 1, regulatory (inhibitor) subunit 3c (PPP1R3C, Accession NP_005389.1) is another GAM144 target gene, herein designated TARGET GENE. PPP1R3C BINDING SITE is a target binding site found in the 3' untranslated region of mRNA encoded by PPP1R3C, corresponding to a target binding site such as BINDING SITE I, BINDING SITE II or BINDING SITE III of FIG. 8. Table 4 illustrates the complementarity of the nucleotide sequences of PPP1R3C BINDING SITE, designated SEQ ID:19147, to the nucleotide sequence of GAM144 RNA, herein designated GAM RNA, also designated SEQ ID:361.

Another function of GAM144 is therefore inhibition of Protein phosphatase 1, regulatory (inhibitor) subunit 3c (PPP1R3C, Accession NP_005389.1). Accordingly, utilities of GAM144 include diagnosis, prevention and treatment of diseases and clinical conditions associated with PPP1R3C.

Rab11-FIP3 (Accession NP_055515.1) is another GAM144 target gene, herein designated TARGET GENE. Rab11-FIP3 BINDING SITE is a target binding site found in the 5' untranslated region of mRNA encoded by Rab11-FIP3, corresponding to a target binding site such as BINDING SITE I, BINDING SITE II or BINDING SITE III of FIG. 8. Table 4 illustrates the complementarity of the nucleotide sequences of Rab11-FIP3 BINDING SITE, designated SEQ ID:14310, to the nucleotide sequence of GAM144 RNA, herein designated GAM RNA, also designated SEQ ID:361.

Another function of GAM144 is therefore inhibition of Rab11-FIP3 (Accession NP_055515.1). Accordingly, utilities of GAM144 include diagnosis, prevention and treatment of diseases and clinical conditions associated with Rab11-FIP3.

Retinoic acid induced 17 (RAI17, Accession NP_065071.1) is another GAM144 target gene, herein designated TARGET GENE. RAI17 BINDING SITE is a target binding site found in the 3' untranslated region of multiple transcripts of mRNA encoded by RAI17, corresponding to a target binding site such as BINDING SITE I, BINDING SITE II or BINDING SITE III of FIG. 8. Table 4 illustrates the complementarity of the nucleotide sequences of RAI17 BINDING SITE, designated SEQ ID:513, to the nucleotide sequence of GAM144 RNA, herein designated GAM RNA, also designated SEQ ID:361.

Another function of GAM144 is therefore inhibition of Retinoic acid induced 17 (RAI17, Accession NP_065071.1). Accordingly, utilities of GAM144 include diagnosis, prevention and treatment of diseases and clinical conditions associated with RAI17.

Ras guanyl releasing protein 4 (RASGRP4, Accession NP_443181.2) is another GAM144 target gene, herein designated TARGET GENE. RASGRP4 BINDING SITE is a target binding site found in the 3' untranslated region of multiple transcripts of mRNA encoded by RASGRP4, corresponding to a target binding site such as BINDING SITE I, BINDING SITE II or BINDING SITE III of FIG. 8. Table 4 illustrates the complementarity of the nucleotide sequences of RASGRP4 BINDING SITE, designated SEQ ID:10432, to the nucleotide sequence of GAM144 RNA, herein designated GAM RNA, also designated SEQ ID:361.

Another function of GAM144 is therefore inhibition of Ras guanyl releasing protein 4 (RASGRP4, Accession NP_443181.2). Accordingly, utilities of GAM144 include diagnosis, prevention and treatment of diseases and clinical conditions associated with RASGRP4.

Recq protein-like 5 (RECQL5, Accession NP_004250.1) is another GAM144 target gene, herein designated TARGET GENE. RECQL5 BINDING SITE is a target binding site found in the 3' untranslated region of mRNA encoded by RECQL5, corresponding to a target binding site such as BINDING SITE I, BINDING SITE II or BINDING SITE III of FIG. 8. Table 4 illustrates the complementarity of the nucleotide sequences of RECQL5 BINDING SITE, designated SEQ ID:15459, to the nucleotide sequence of GAM144 RNA, herein designated GAM RNA, also designated SEQ ID:361.

Another function of GAM144 is therefore inhibition of Recq protein-like 5 (RECQL5, Accession NP_004250.1). Accordingly, utilities of GAM144 include diagnosis, prevention and treatment of diseases and clinical conditions associated with RECQL5.

Regulator of g-protein signalling 6 (RGS6, Accession NP_004287.3) is another GAM144 target gene, herein designated TARGET GENE. RGS6 BINDING SITE is a target binding site found in the 3' untranslated region of mRNA encoded by RGS6, corresponding to a target binding site such as BINDING SITE I, BINDING SITE II or BINDING SITE III of FIG. 8. Table 4 illustrates the complementarity of the nucleotide sequences of RGS6 BINDING SITE, designated SEQ ID:5092, to the nucleotide sequence of GAM144 RNA, herein designated GAM RNA, also designated SEQ ID:361.

Another function of GAM144 is therefore inhibition of Regulator of g-protein signalling 6 (RGS6, Accession NP_004287.3). Accordingly, utilities of GAM144 include diagnosis, prevention and treatment of diseases and clinical conditions associated with RGS6.

RNF144 (Accession NP_055561.1) is another GAM144 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:7933, to the nucleotide sequence of GAM144 RNA, herein designated GAM RNA, also designated SEQ ID:361.

Another function of GAM144 is therefore inhibition of RNF144 (Accession NP_055561.1). Accordingly, utilities of GAM144 include diagnosis, prevention and treatment of diseases and clinical conditions associated with RNF144.

Rar-related orphan receptor b (RORB, Accession NP_008845.2) is another GAM144 target gene, herein designated TARGET GENE. RORB BINDING SITE is a target binding site found in the 5' untranslated region of mRNA encoded by RORB, corresponding to a target binding site such as BINDING SITE I, BINDING SITE II or BINDING SITE III of FIG. 8. Table 4 illustrates the complementarity of the nucleotide sequences of RORB BINDING SITE, designated SEQ ID:8536, to the nucleotide sequence of GAM144 RNA, herein designated GAM RNA, also designated SEQ ID:361.

Another function of GAM144 is therefore inhibition of Rar-related orphan receptor b (RORB, Accession NP_008845.2), a gene which is an orphan nuclear receptor. Accordingly, utilities of GAM144 include diagnosis, prevention and treatment of diseases and clinical conditions associated with RORB.

The function of RORB has been established by previous studies. ROR-beta is a transcription factor and belongs to the nuclear receptor family (Carlberg et al., 1994). Members of this superfamily share a common modular structure composed of a transactivation domain, a DNA-binding domain, and a ligand-binding domain (Evans, 1988). Typically, their transcriptional transactivation function is regulated by small lipophilic molecules, such as steroid hormones, vitamin D, retinoic acids, and thyroid hormone. These molecules are synthesized in the organism and pass readily through the plasma membrane to reach the corresponding receptors inside the cell. In addition to the classic hormone receptors, a growing number of nuclear receptors for which no ligands are known have been identified by homology cloning. These nuclear receptors are referred to as 'orphan' nuclear receptors. ROR-beta is such an orphan nuclear receptor, forming a subfamily with the closely related nuclear receptors ROR-alpha (RORA; 600825) and ROR-gamma (RORC; 602943

Animal model experiments lend further support to the function of RORB. ROR- beta is expressed in areas of the central nervous system that are involved in the processing of sensory information, including spinal cord, thalamus, and sensory cerebellar cortices. Additionally, ROR-beta localizes to the 3 principal anatomic components of the mammalian timing system: the suprachiasmatic nuclei, the retina, and the pineal gland. Andre et al. (1998) showed that RORB mRNA levels oscillate in retina and pineal gland with a circadian rhythm that persists in constant darkness. They generated RORB-deficient mice by gene targeting in embryonic stem cells and analyzed their phenotypic behavior. Rorb -/- mice display a duck-like gait, transient male incapability to reproduce sexually, and a severely disorganized retina that suffers from postnatal degeneration. Consequently, adult Rorb -/- mice are blind, yet their circadian activity rhythm is still entrained by light-dark cycles. Under conditions of constant darkness, Rorb -/- mice display an extended period of free-running rhythmicity. The overall behavioral phenotype of Rorb -/- mice, together with the chromosomal localization of the gene on mouse chromosome 4, suggested a close relationship to the spontaneous mouse mutation 'vacillans' described by Sirlin (1956) and now thought to be extinct It is appreciated that the abovementioned animal model for RORB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Evans, R. M.: The steroid and thyroid hormone receptor superfamily. Science 240:889-895, 1988; and Andre, E.; Conquet, F.; Steinmay, M.; Stratton, S. C.; Porciatti, V.; Becker- andre, M.: Disruption of retinoid-related orphan receptor beta changes circadian behavior, causes retinal deg.

Further studies establishing the function and utilities of RORB are found in John Hopkins OMIM database record ID 601972, and in cited publications listed in Table 5, which are hereby incorporated by reference. Ribosomal protein s15 (RPS15, Accession NP_001009.1) is another GAM144 target gene, herein designated TARGET GENE. RPS15 BINDING SITE is a target binding site found in the 3' untranslated region of mRNA encoded by RPS15, corresponding to a target binding site such as BINDING SITE I, BINDING SITE II or BINDING SITE III of FIG. 8. Table 4 illustrates the complementarity of the nucleotide sequences of RPS15 BINDING SITE, designated SEQ ID:18606, to the nucleotide sequence of GAM144 RNA, herein designated GAM RNA, also designated SEQ ID:361.

Another function of GAM144 is therefore inhibition of Ribosomal protein s15 (RPS15, Accession NP_001009.1), a gene which is a component of the small 40S ribosomal subunit. Accordingly, utilities of GAM144 include diagnosis, prevention and treatment of diseases and clinical conditions associated with RPS15.

The function of RPS15 has been established by previous studies. The gene called Rig (rat insulinoma gene) was first isolated from a cDNA library of rat insulinomas. Its cognate gene has been found to be activated in various human tumors such as insulinomas, esophageal cancers, and colon cancers. Inoue et al. (1987) isolated a human insulinoma cDNA encoding the human homolog of Rig. Structural analysis indicated that the predicted 145-amino acid RIG protein may be a DNA-binding protein. Shiga et al. (1990) isolated the genomic sequence of human RIG from a genomic DNA library constructed from a human esophageal carcinoma and determined its complete nucleotide sequence. The gene is composed of about 3,000 nucleotides and divided into 4 exons separated by 3 introns. The transcription initiation site was located -46 bp upstream from the first ATG codon. Because of CpG islands in the 5-prime region and regions with a high GC content and because of the wide expression of RIG in tissues and cells, Shiga et al. (1990) suggested that RIG may belong to the class of 'housekeeping' genes, whose products are necessary for the growth of all cell types. The human genome contains at least 6 copies of RIG pseudogenes, 4 of which have the characteristics of processed pseudogenes. Kitagawa et al. (1991) demonstrated the normal function of Rig. They showed that the immunoreactivity to a monoclonal antibody against the deduced Rig protein and the translation product of Rig mRNA comigrated with ribosomal protein S15. The amino acid sequence of ribosomal protein S15 purified from rat liver coincided with that deduced from the nucleotide sequence of Rig mRNA, but there were indications that the initiator methionine was removed and the succeeding alanyl residue was monoacetylated. The authors concluded that the product of the Rig gene is ribosomal protein S15. By somatic cell hybrid and radiation hybrid mapping analyses, Kenmochi et al. (1998) mapped the human RPS15 gene to 19p.

Full details of the abovementioned studies are described in the following publications, the disclosure of which are hereby incorporated by reference:

Kitagawa, M.; Takasawa, S.; Kikuchi, N.; Itoh, T.; Teraoka, H.; Yamamoto, H.; Okamoto, H.: Rig encodes ribosomal protein S15: the primary structure of mammalian ribosomal protein S15. FEBS Lett. 283:210-214, 1991. ; and Kenmochi, N.; Kawaguchi, T.; Rozen, S.; Davis, E.; Goodman, N.; Hudson, T. J.; Tanaka, T.; Page, D. C.: A map of 75 human ribosomal protein genes. Genome Res. 8:509-523, 1998.

Further studies establishing the function and utilities of RPS15 are found in John Hopkins OMIM database record ID 180535, and in cited publications listed in Table 5, which are hereby incorporated by reference. SCAM-1 (Accession NP_005766.2) is another GAM144 target gene, herein designated TARGET GENE. SCAM-1 BINDING SITE is a target binding site found in the 3' untranslated region of mRNA encoded by SCAM-1, corresponding to a target binding site such as BINDING SITE I, BINDING SITE II or BINDING SITE III of FIG. 8. Table 4 illustrates the complementarity of the nucleotide sequences of SCAM-1 BINDING SITE, designated SEQ ID:8414, to the nucleotide sequence of GAM144 RNA, herein designated GAM RNA, also designated SEQ ID:361.

Another function of GAM144 is therefore inhibition of SCAM-1 (Accession NP_005766.2). Accordingly, utilities of GAM144 include diagnosis, prevention and treatment of diseases and clinical conditions associated with SCAM-1.

Stearoyl-coa desaturase (delta-9-desaturase) (SCD, Accession NP_005054.2) is another GAM144 target gene, herein designated TARGET GENE. SCD BINDING SITE is a target binding site found in the 3' untranslated region of mRNA encoded by SCD, corresponding to a target binding site such as BINDING SITE I, BINDING SITE II or BINDING SITE III of FIG. 8. Table 4 illustrates the complementarity of the nucleotide sequences of SCD BINDING SITE, designated SEQ ID:10595, to the nucleotide sequence of GAM144 RNA, herein designated GAM RNA, also designated SEQ ID:361.

Another function of GAM144 is therefore inhibition of Stearoyl-coa desaturase (delta-9-desaturase) (SCD, Accession NP_005054.2), a gene which functions in the synthesis of unsaturated fatty acids. Accordingly, utilities of GAM144 include diagnosis, prevention and treatment of diseases and clinical conditions associated with SCD.

The function of SCD has been established by previous studies. Stearoyl-CoA desaturase (SCD; EC 1.14.99.5) is an iron-containing enzyme that catalyzes a rate-limiting step in the synthesis of unsaturated fatty acids. The principal product of SCD is oleic acid, which is formed by desaturation of stearic acid. The ratio of stearic acid to oleic acid has been implicated in the regulation of cell growth and differentiation through effects on cell-membrane fluidity and signal transduction (Zhang et al. (1999)). Thiede et al. (1986) isolated cDNAs encoding rat SCD. By RT-PCR of adipose tissue RNA with primers based on the sequence of rat SCD, Li et al. (1994) isolated a partial human SCD cDNA. Using RNase protection assay, the authors found that human SCD was expressed at higher levels in colon and esophageal carcinomas than in the counterpart normal tissues.

Animal model experiments lend further support to the function of SCD. SCD is a central lipogenic enzyme catalyzing the synthesis of monounsaturated fatty acids, mainly oleate (C18:1) and palmitoleate (C16:1), which are components of membrane phospholipids, triglycerides, wax esters, and cholesterol esters. Several SCD isoforms (SCD1, -2, and -3) exist in the mouse. Ntambi et al. (2002) showed that mice with a targeted disruption of the SCD1 isoform had reduced body adiposity, increased insulin (OMIM Ref. No. 176730) sensitivity, and resistance to diet-induced weight gain. The protection from obesity involved increased energy expenditure and increased oxygen consumption. Compared with wildtype mice, the SCD1-/- mice had increased levels of plasma ketone bodies but reduced levels of plasma insulin and leptin. In these homozygous null mice, the expression of several genes of lipid oxidation was upregulated, whereas lipid synthesis genes were downregulated. These observations suggested that a consequence of SCD1 deficiency is an activation of lipid oxidation in addition to reduced triglyceride synthesis and storage.

It is appreciated that the abovementioned animal model for SCD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ntambi, J. M.; Miyazaki, M.; Stoehr, J. P.; Lan, H.; Kendziorski, C. M.; Yandell, B. S.; Song, Y.; Cohen, P.; Friedman, J. M.; Attie, A. D.: Loss of stearoyl-CoA desaturase-1 function protects mice against adiposity. Proc. Nat. Acad. Sci. 99:11482-11486, 2002; and Zhang, L.; Ge, L.; Parimoo, S.; Stenn, K.; Prouty, S. M.: Human stearoyl-CoA desaturase: alternative transcripts generated from a single gene by usage of tandem polyadenylation sites.

Further studies establishing the function and utilities of SCD are found in John Hopkins OMIM database record ID 604031, and in cited publications listed in Table 5, which are hereby incorporated by reference. Sialic acid binding ig-like lectin 10 (SIGLEC10, Accession NP_149121.2) is another GAM144 target gene, herein designated TARGET GENE. SIGLEC10 BINDING SITE is a target binding site found in the 3' untranslated region of mRNA encoded by SIGLEC10, corresponding to a target binding site such as BINDING SITE I, BINDING SITE II or BINDING SITE III of FIG. 8. Table 4 illustrates the complementarity of the nucleotide sequences of SIGLEC10 BINDING SITE, designated SEQ ID:17706, to the nucleotide sequence of GAM144 RNA, herein designated GAM RNA, also designated SEQ ID:361.

Another function of GAM144 is therefore inhibition of Sialic acid binding ig-like lectin 10 (SIGLEC10, Accession NP_149121.2). Accordingly, utilities of GAM144 include diagnosis, prevention and treatment of diseases and clinical conditions associated with SIGLEC10.

SIT (Accession NP_055265.1) is another GAM144 target gene, herein designated TARGET GENE. SIT BINDING SITE is a target binding site found in the 3' untranslated region of mRNA encoded by SIT, corresponding to a target binding site such as BINDING SITE I, BINDING SITE II or BINDING SITE III of FIG. 8. Table 4 illustrates the complementarity of the nucleotide sequences of SIT BINDING SITE, designated SEQ ID:3507, to the nucleotide sequence of GAM144 RNA, herein designated GAM RNA, also designated SEQ ID:361.

Another function of GAM144 is therefore inhibition of SIT (Accession NP_055265.1), a gene which recruits tyrosine phosphatase SHP2 to the cell membrane. Accordingly, utilities of GAM144 include diagnosis, prevention and treatment of diseases and clinical conditions associated with SIT.

The function of SIT has been established by previous studies. By tryptic peptide sequence analysis of a 30/40-kD disulfide-linked homodimeric glycoprotein that had been copurified with TRIM, followed by searching an EST database, Marie-Cardine et al. (1999) identified a cDNA encoding a deduced 196-amino acid protein that they designated SIT. Sequence analysis predicted that SIT has a putative 22-amino acid hydrophobic leader peptide, an 18-amino acid extracellular domain containing a potential N-glycosylation site and a cys residue that may be involved in an interchain disulfide bond, a 20-amino acid transmembrane domain, and a 136-amino acid intracellular portion containing several potential phosphorylation sites. SIT also contains 6 tyrosine residues, 5 of which may be involved in Src (OMIM Ref. No. 190090) homology-2 (SH2) domain-mediated protein-protein interactions after phosphorylation. The cytoplasmic portion of SIT possesses a potential immunoreceptor tyrosine-based inhibitory motif, or ITIM, suggesting the potential for interactions with SHP1 (PTPN6; 176883) or SHP2 (PTPN11; 176876). Western blot analysis demonstrated that SIT is expressed as an approximately 40-kD protein that is reduced to approximately 20 kD by endoglycosidase treatment. Northern blot analysis detected strong expression of an approximately 1.6-kb SIT transcript in thymus, with lower expression detected in spleen and lymph nodes. Weak expression was detected in peripheral blood leukocytes, bone marrow, and T cell lines, but no expression was detected in monocytic cell lines. Immunofluorescence microscopy and immunoprecipitation analysis localized overexpressed SIT in cell membranes. Western blot analysis showed that SIT is a substrate for the Src protein kinases FYN (OMIM Ref. No. 137025) and LCK (OMIM Ref. No. 153390), as well as for ZAP70 (OMIM Ref. No. 176947). Overexpressed SIT was shown to act as a negative regulator for transcriptional activity of the nuclear factor of activated T cells (NFAT; OMIM Ref. No. 600489) via a mechanism upstream of phospholipase C (see OMIM Ref. No. PLCG1; 172420), and SIT recruits SHP2 but not SHP1 to the cell membrane via the ITIM. Hubener et al. (2001) determined that the SIT gene contains 5 exons and spans 1.8 kb of genomic DNA. The SIT promoter demonstrated strong transcriptional activity and potential binding sites for both ubiquitous and lymphoid-specific transcription factors Full details of the abovementioned studies are described in the following publications, the disclosure of which are hereby incorporated by reference:

Hubener, C.; Mincheva, A.; Lichter, P.; Schraven, B.; Bruyns, E.: Complete sequence, genomic organization, and chromosomal localization of the human gene encoding the SHP2-interacting transmembrane adaptor protein (SIT). Immunogenetics 53:337-341, 2001; and Marie-Cardine, A.; Kirchgessner, H.; Bruyns, E.; Shevchenko, A.; Mann, M.; Autschbach, F.; Ratnofsky, S.; Meuer, S.; Schraven, B.: SHP2-interacting transmembrane adaptor protein (SIT).

Further studies establishing the function and utilities of SIT are found in John Hopkins OMIM database record ID 604964, and in cited publications listed in Table 5, which are hereby incorporated by reference. Solute carrier family 12

(potassium/chloride transporters), member 7 (SLC12A7, Accession NP_006589.1) is another GAM144 target gene, herein designated TARGET GENE. SLC12A7 BINDING SITE is a target binding site found in the 3' untranslated region of mRNA encoded by SLC12A7, corresponding to a target binding site such as BINDING SITE I, BINDING SITE II or BINDING SITE III of FIG. 8. Table 4 illustrates the complementarity of the nucleotide sequences of SLC12A7 BINDING SITE, designated SEQ ID:8621, to the nucleotide sequence of GAM144 RNA, herein designated GAM RNA, also designated SEQ ID:361.

Another function of GAM144 is therefore inhibition of Solute carrier family 12 (potassium/chloride transporters), member 7 (SLC12A7, Accession NP_006589.1), a gene which is a potassium/chloride- cotransporter. Accordingly, utilities of GAM144 include diagnosis, prevention and treatment of diseases and clinical conditions associated with SLC12A7.

The function of SLC12A7 and its association with various diseases and clinical conditions, has been established by previous studies, as described hereinabove with reference to GAM105.1. Solute carrier family 26 (sulfate transporter), member 2 (SLC26A2, Accession NP_000103.1) is another GAM144 target gene, herein designated TARGET GENE. SLC26A2 BINDING SITE is a target binding site found in the 3' untranslated region of mRNA encoded by SLC26A2, corresponding to a target binding site such as BINDING SITE I, BINDING SITE II or BINDING SITE III of FIG. 8. Table 4 illustrates the complementarity of the nucleotide sequences of SLC26A2 BINDING SITE, designated SEQ ID:5087, to the nucleotide sequence of GAM144 RNA, herein designated GAM RNA, also designated SEQ ID:361.

Another function of GAM144 is therefore inhibition of Solute carrier family 26 (sulfate transporter), member 2 (SLC26A2, Accession NP_000103.1). Accordingly, utilities of GAM144 include diagnosis, prevention and treatment of diseases and clinical conditions associated with SLC26A2.

Solute carrier family 2 (facilitated glucose transporter), member 6 (SLC2A6, Accession NP_060055.1) is another GAM144 target gene, herein designated TARGET GENE. SLC2A6 BINDING SITE is a target binding site found in the 3' untranslated region of mRNA encoded by SLC2A6, corresponding to a target binding site such as BINDING SITE I, BINDING SITE II or BINDING SITE III of FIG. 8. Table 4 illustrates the complementarity of the nucleotide sequences of SLC2A6 BINDING SITE, designated SEQ ID:8775, to the nucleotide sequence of GAM144 RNA, herein designated GAM RNA, also designated SEQ ID:361.

Another function of GAM144 is therefore inhibition of Solute carrier family 2 (facilitated glucose transporter), member 6 (SLC2A6, Accession NP_060055.1). Accordingly, utilities of GAM144 include diagnosis, prevention and treatment of diseases and clinical conditions associated with SLC2A6.

Solute carrier family 4, sodium bicarbonate transporter-like, member 11 (SLC4A11, Accession NP_114423.1) is another GAM144 target gene, herein designated TARGET GENE. SLC4A11 BINDING SITE is a target binding site found in the 5' untranslated region of mRNA encoded by SLC4A11, corresponding to a target binding site such as BINDING SITE I, BINDING SITE II or BINDING SITE III of FIG. 8. Table 4 illustrates the complementarity of the nucleotide sequences of SLC4A11 BINDING SITE, designated SEQ ID:6573, to the nucleotide sequence of GAM144 RNA, herein designated GAM RNA, also designated SEQ ID:361.

Another function of GAM144 is therefore inhibition of Solute carrier family 4, sodium bicarbonate transporter-like, member 11 (SLC4A11, Accession NP_114423.1). Accordingly, utilities of GAM144 include diagnosis, prevention and treatment of diseases and clinical conditions associated with SLC4A11.

Solute carrier family 7 (cationic amino acid transporter, y+ system), member 5 (SLC7A5, Accession NP_003477.3) is another GAM144 target gene, herein designated TARGET GENE. SLC7A5 BINDING SITE is a target binding site found in the 3' untranslated region of mRNA encoded by SLC7A5, corresponding to a target binding site such as BINDING SITE I, BINDING SITE II or BINDING SITE III of FIG. 8. Table 4 illustrates the complementarity of the nucleotide sequences of SLC7A5 BINDING SITE, designated SEQ ID:17430, to the nucleotide sequence of GAM144 RNA, herein designated GAM RNA, also designated SEQ ID:361.

Another function of GAM144 is therefore inhibition of Solute carrier family 7 (cationic amino acid transporter, y+ system), member 5 (SLC7A5, Accession NP_003477.3), a gene which mediates transport of large and small neutral amino acids. Accordingly, utilities of GAM144 include diagnosis, prevention and treatment of diseases and clinical conditions associated with SLC7A5.

The function of SLC7A5 and its association with various diseases and clinical conditions, has been established by previous studies, as described hereinabove with reference to GAM98.1. SMP3 (Accession NP_079439.2) is another GAM144 target gene, herein designated TARGET GENE. SMP3 BINDING SITE is a target binding site found in the 3' untranslated region of mRNA encoded by SMP3, corresponding to a target binding site such as BINDING SITE I, BINDING SITE II or BINDING SITE III of FIG. 8. Table 4 illustrates the complementarity of the nucleotide sequences of SMP3 BINDING SITE, designated SEQ ID:7660, to the nucleotide sequence of GAM144 RNA, herein designated GAM RNA, also designated SEQ ID:361.

Another function of GAM144 is therefore inhibition of SMP3 (Accession NP_079439.2). Accordingly, utilities of GAM144 include diagnosis, prevention and treatment of diseases and clinical conditions associated with SMP3.

Smt3 suppressor of mif two 3 homolog 1 (yeast) (SMT3H1, Accession NP_008867.1) is another GAM144 target gene, herein designated TARGET GENE. SMT3H1 BINDING SITE is a target binding site found in the 3' untranslated region of mRNA encoded by SMT3H1, corresponding to a target binding site such as BINDING SITE I, BINDING SITE II or BINDING SITE III of FIG. 8. Table 4 illustrates the complementarity of the nucleotide sequences of SMT3H1 BINDING SITE, designated SEQ ID:11346, to the nucleotide sequence of GAM144 RNA, herein designated GAM RNA, also designated SEQ ID:361.

Another function of GAM144 is therefore inhibition of Smt3 suppressor of mif two 3 homolog 1 (yeast) (SMT3H1, Accession NP_008867.1), a gene which is involved in the function and/or structure of the eukaryotic kinetochore. Accordingly, utilities of GAM144 include diagnosis, prevention and treatment of diseases and clinical conditions associated with SMT3H1.

The function of SMT3H1 has been established by previous studies. TEXT Lapenta et al. (1997) used cDNA selection to isolate coding sequences from cosmids mapping to the gene-rich telomeric region of human chromosome 21q. A cDNA, which the authors termed SMT3A, was isolated and mapped between the loci PFKL and D21S171 on 21q22.3, about 2.2 Mb proximal to the telomere. The predicted protein of 103 amino acids was found to be a homolog of the S. cerevisiae SMT3 protein, whose gene was previously isolated as a suppressor of mutations in the MIF2 gene (Meluh and Koshland, 1995). The yeast MIF2 gene encodes an essential centromeric protein and shows homology to mammalian CENPC (see OMIM Ref. No. 117141), an integral component of active kinetochores (Meluh and Koshland, 1995). The proposed role of yeast SMT3 as a centromeric protein and the strong evolutionary conservation of the human SMT3A gene suggested to Lapenta et al. (1997) that the encoded protein is involved in the function and/or structure of the eukaryotic kinetochore. SMT3A is also highly homologous to ubiquitin (OMIM Ref. No. 191320). Lapenta et al. (1997) identified 2 additional human SMT3-like sequences, named SMT3B (OMIM Ref. No. 603042) and SMT3C (OMIM Ref. No. 601912), as expressed sequence tags; SMT3A shares 87% amino acid identity with SMT3B and 47% identity with SMT3C.

Full details of the abovementioned studies are described in the following publications, the disclosure of which are hereby incorporated by reference:

Lapenta, V.; Chiurazzi, P.; van der Spek, P.; Pizzuti, A.; Hanaoka, F.; Brahe, C. : SMT3A, a human homologue of the S. cerevisiae SMT3 gene, maps to chromosome 21qter and defines a novel gene family. Genomics 40:362-366, 1997; and Meluh, P. B.; Koshland, D.: Suppressors of MIF2, a putative centromere protein gene in Saccharomyces cerevisiae. (Abstract) Molec. Biol. Cell 6 (supp.):360a only, 1995.

Further studies establishing the function and utilities of SMT3H1 are found in John Hopkins OMIM database record ID 602231, and in cited publications listed in Table 5, which are hereby incorporated by reference. Serum response factor (c-fos serum response element-binding transcription factor) (SRF, Accession NP_003122.1) is another GAM144 target gene, herein designated TARGET GENE. SRF BINDING SITE is a target binding site found in the 3' untranslated region of mRNA encoded by SRF, corresponding to a target binding site such as BINDING SITE I, BINDING SITE II or BINDING SITE III of FIG. 8. Table 4 illustrates the complementarity of the nucleotide sequences of SRF BINDING SITE, designated SEQ ID:7478, to the nucleotide sequence of GAM144 RNA, herein designated GAM RNA, also designated SEQ ID:361.

Another function of GAM144 is therefore inhibition of Serum response factor (c-fos serum response element-binding transcription factor) (SRF, Accession NP_003122.1). Accordingly, utilities of GAM144 include diagnosis, prevention and treatment of diseases and clinical conditions associated with SRF.

Synaptotagmin iii (SYT3, Accession NP_115674.1) is another GAM144 target gene, herein designated TARGET GENE. SYT3 BINDING SITE is a target binding site found in the 5' untranslated region of mRNA encoded by SYT3, corresponding to a target binding site such as BINDING SITE I, BINDING SITE II or BINDING SITE III of FIG. 8. Table 4 illustrates the complementarity of the nucleotide sequences of SYT3 BINDING SITE, designated SEQ ID:20170, to the nucleotide sequence of GAM144 RNA, herein designated GAM RNA, also designated SEQ ID:361.

Another function of GAM144 is therefore inhibition of Synaptotagmin iii (SYT3, Accession NP_115674.1). Accordingly, utilities of GAM144 include diagnosis, prevention and treatment of diseases and clinical conditions associated with SYT3.

Transcription factor 2, hepatic; lf-b3; variant hepatic nuclear factor (TCF2, Accession NP_006472.1) is another GAM144 target gene, herein designated TARGET GENE. TCF2 BINDING SITE is a target binding site found in the 3' untranslated region of multiple transcripts of mRNA encoded by TCF2, corresponding to a target binding site such as BINDING SITE I, BINDING SITE II or BINDING SITE III of FIG. 8. Table 4 illustrates the complementarity of the nucleotide sequences of TCF2 BINDING SITE, designated SEQ ID:15301, to the nucleotide sequence of GAM144 RNA, herein designated GAM RNA, also designated SEQ ID:361.

Another function of GAM144 is therefore inhibition of Transcription factor 2, hepatic; lf-b3; variant hepatic nuclear factor (TCF2, Accession NP_006472.1), a gene which probably binds to the inverted palindrome 5'-gttaatnattaac-3'. and therefore is associated with Maturity-onset diabetes of the young type 5 (mody5), familial hypoplastic glomerulocystic kidney disease (gckd). Accordingly, utilities of GAM144 include diagnosis, prevention and treatment of Maturity-onset diabetes of the young type 5 (mody5), familial hypoplastic glomerulocystic kidney disease (gckd), and of other diseases and clinical conditions associated with TCF2.

The function of TCF2 has been established by previous studies. Abbott et al. (1990) isolated and partially sequenced a human clone corresponding to the gene for liver-specific transcription factor LFB3. Furthermore, they designed oligonucleotide primers for TCF2 (also called HNF1B) and used them to amplify specifically the human gene in human/rodent somatic cell hybrids by the polymerase chain reaction. They showed that TCF2 maps to 17q between the centromere and the breakpoint of acute promyelocytic leukemia, i.e., proximal to 17q22. Hepatocyte nuclear factor-1 (HNF1A, or TCF1; 142410) is a homeodomain-containing transcriptional activator required for the liver-specific expression of a variety of genes. Bach et al. (1991) isolated a cDNA clone from a human liver library encoding a protein, designated HNF1B, that is highly homologous to HNF1A (also called TCF1) in 3 regions, including the homeo domain and the dimerization domain. They showed that this protein can heterodimerize with human HNF1A in vitro. Sequence comparison with a rat variant HNF1A identified the cDNA as the human homolog. HNF1B is a nuclear protein recognizing the same binding site as HNF1A. By Northern blot analysis, Bach et al. (1991) showed that the HNF1B transcripts are present in differentiated human HepG2 hepatoma cells as well as in rat liver and that this transcript level is 10- to 20-fold lower than that of HNF1A. They assigned the HNF1B gene to human chromosome 17 and mouse chromosome 11. The HNF1A gene maps to human chromosome 12 and mouse chromosome 5.

Full details of the abovementioned studies are described in the following publications, the disclosure of which are hereby incorporated by reference:

Abbott, C.; Piaggio, G.; Ammendola, R.; Solomon, E.; Povey, S.; Gounari, F.; De Simone, V.; Cortese, R.: Mapping of the gene TCF2 for the transcription factor LFB3 to human chromosome 17 by polymerase chain reaction. Genomics 8:165-167, 1990; and Bach, I.; Mattei, M.-G.; Cereghini, S.; Yaniv, M.: Two members of an HNF1 homeoprotein family are expressed in human liver. Nucleic Acids Res. 19:3553-3559, 1991.

Further studies establishing the function and utilities of TCF2 are found in John Hopkins OMIM database record ID 189907, and in cited publications listed in Table 5, which are hereby incorporated by reference. T-cell leukemia/lymphoma 6 (TCL6, Accession NP_065575.1) is another GAM144 target gene, herein designated TARGET GENE. TCL6 BINDING SITE is a target binding site found in the 3' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:13217, to the nucleotide sequence of GAM144 RNA, herein designated GAM RNA, also designated SEQ ID:361.

Another function of GAM144 is therefore inhibition of T-cell leukemia/lymphoma 6 (TCL6, Accession NP_065575.1). Accordingly, utilities of GAM144 include diagnosis, prevention and treatment of diseases and clinical conditions associated with TCL6.

T-cell leukemia/lymphoma 6 (TCL6, Accession NP_055233.1) is another GAM144 target gene, herein designated TARGET GENE. TCL6 BINDING SITE is a target binding site found in the 3' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:13217, to the nucleotide sequence of GAM144 RNA, herein designated GAM RNA, also designated SEQ ID:361.

Another function of GAM144 is therefore inhibition of T-cell leukemia/lymphoma 6 (TCL6, Accession NP_055233.1). Accordingly, utilities of GAM144 include diagnosis, prevention and treatment of diseases and clinical conditions associated with TCL6.

Tgfb-induced factor 2 (tale family homeobox) (TGIF2, Accession NP_068581.1) is another GAM144 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:15336, to the nucleotide sequence of GAM144 RNA, herein designated GAM RNA, also designated SEQ ID:361.

Another function of GAM144 is therefore inhibition of Tgfb-induced factor 2 (tale family homeobox) (TGIF2, Accession NP_068581.1). Accordingly, utilities of GAM144 include diagnosis, prevention and treatment of diseases and clinical conditions associated with TGIF2.

Tigger transposable element derived 6 (TIGD6, Accession NP_112215.1) is another GAM144 target gene, herein designated TARGET GENE. TIGD6 BINDING SITE is a target binding site found in the 3' untranslated region of mRNA encoded by TIGD6, corresponding to a target binding site such as BINDING SITE I, BINDING SITE II or BINDING SITE III of FIG. 8. Table 4 illustrates the complementarity of the nucleotide sequences of TIGD6 BINDING SITE, designated SEQ ID:7598, to the nucleotide sequence of GAM144 RNA, herein designated GAM RNA, also designated SEQ ID:361.

Another function of GAM144 is therefore inhibition of Tigger transposable element derived 6 (TIGD6, Accession NP_112215.1). Accordingly, utilities of GAM144 include diagnosis, prevention and treatment of diseases and clinical conditions associated with TIGD6.

Triple homeobox 1 (TIX1, Accession NP_055850.1) is another GAM144 target gene, herein designated TARGET GENE. TIX1 BINDING SITE is a target binding site found in the 3' untranslated region of mRNA encoded by TIX1, corresponding to a target binding site such as BINDING SITE I, BINDING SITE II or BINDING SITE III of FIG. 8. Table 4 illustrates the complementarity of the nucleotide sequences of TIX1 BINDING SITE, designated SEQ ID:720, to the nucleotide sequence of GAM144 RNA, herein designated GAM RNA, also designated SEQ ID:361.

Another function of GAM144 is therefore inhibition of Triple homeobox 1 (TIX1, Accession NP_055850.1). Accordingly, utilities of GAM144 include diagnosis, prevention and treatment of diseases and clinical conditions associated with TIX1.

Transmembrane 4 superfamily member 6 (TM4SF6, Accession NP_003261.1) is another GAM144 target gene, herein designated TARGET GENE. TM4SF6 BINDING SITE is a target binding site found in the 3' untranslated region of mRNA encoded by TM4SF6, corresponding to a target binding site such as BINDING SITE I, BINDING SITE II or BINDING SITE III of FIG. 8. Table 4 illustrates the complementarity of the nucleotide sequences of TM4SF6 BINDING SITE, designated SEQ ID:6282, to the nucleotide sequence of GAM144 RNA, herein designated GAM RNA, also designated SEQ ID:361.

Another function of GAM144 is therefore inhibition of Transmembrane 4 superfamily member 6 (TM4SF6, Accession NP_003261.1), a gene which plays a role in the regulation of cell development, activation, growth and motility. Accordingly, utilities of GAM144 include diagnosis, prevention and treatment of diseases and clinical conditions associated with TM4SF6.

The function of TM4SF6 has been established by previous studies. Members of the transmembrane 4 (or tetraspanin) superfamily (TM4SF) contain 4 hydrophobic, presumably membrane-spanning sequences and a major presumed extracellular loop between the third and fourth hydrophobic domains. Several TM4SF proteins have been shown to stimulate or modulate cell growth, and some may associate with integrin and control cell adhesion and movement. Maeda et al. (1998) isolated a human glioma cDNA that has sequence similarity to the TM4SF member TM4SF2 (OMIM Ref. No. 300096). By screening a human fetal lung cDNA library with a probe corresponding to the combined sequences of this cDNA and of an overlapping EST, they isolated cDNAs with an open reading frame encoding a deduced 245-amino acid protein termed TM4SF6. The TM4SF6 protein contains 4 putative transmembrane domains, several short cysteine motifs characteristic of TM4SF proteins, and a potential N-glycosylation site. The TM4SF6 and TM4SF2 proteins are 58% homologous. TM4SF6 was expressed as 1.9- and 1.3-kb transcripts in all human tissues examined.

Full details of the abovementioned studies are described in the following publications, the disclosure of which are hereby incorporated by reference:

Maeda, K.; Matsuhashi, S.; Hori, K.; Xin, Z.; Mukai, T.; Tabuchi, K.; Egashira, M.; Niikawa, N.: Cloning and characterization of a novel human gene, TM4SF6, encoding a protein belonging to the transmembrane 4 superfamily, and mapped to Xq22. Genomics 52:240-242, 1998; and Todd, S. C.; Doctor, V. S.; Levy, S.: Sequences and expression of six new members of the tetraspanin/TM4SF family. Biochim. Biophys. Acta 1399:101-104, 1998.

Further studies establishing the function and utilities of TM4SF6 are found in John Hopkins OMIM database record ID 300191, and in cited publications listed in Table 5, which are hereby incorporated by reference. TRAM2 (Accession NP_036420.1) is another GAM144 target gene, herein designated TARGET GENE. TRAM2 BINDING SITE is a target binding site found in the 3' untranslated region of mRNA encoded by TRAM2, corresponding to a target binding site such as BINDING SITE I, BINDING SITE II or BINDING SITE III of FIG. 8. Table 4 illustrates the complementarity of the nucleotide sequences of TRAM2 BINDING SITE, designated SEQ ID:12299, to the nucleotide sequence of GAM144 RNA, herein designated GAM RNA, also designated SEQ ID:361.

Another function of GAM144 is therefore inhibition of TRAM2 (Accession NP_036420.1). Accordingly, utilities of GAM144 include diagnosis, prevention and treatment of diseases and clinical conditions associated with TRAM2.

Tripartite motif-containing 14 (TRIM14, Accession NP_150090.1) is another GAM144 target gene, herein designated TARGET GENE. TRIM14 BINDING SITE is a target binding site found in the 3' untranslated region of multiple transcripts of mRNA encoded by TRIM14, corresponding to a target binding site such as BINDING SITE I, BINDING SITE II or BINDING SITE III of FIG. 8. Table 4 illustrates the complementarity of the nucleotide sequences of TRIM14 BINDING SITE, designated SEQ ID:3991, to the nucleotide sequence of GAM144 RNA, herein designated GAM RNA, also designated SEQ ID:361.

Another function of GAM144 is therefore inhibition of Tripartite motif-containing 14 (TRIM14, Accession NP_150090.1), a gene which is composed of 3 zinc-binding domains and is involved in development and cell growth. Accordingly, utilities of GAM144 include diagnosis, prevention and treatment of diseases and clinical conditions associated with TRIM14.

The function of TRIM14 has been established by previous studies. TRIM proteins are composed of 3 zinc-binding domains, a RING, a B-box type 1, and a B-box type 2, followed by a coiled-coil region. They are involved in development and cell growth. By sequencing cDNAs randomly selected from a cDNA library derived from the human immature myeloid cell line KG-1, Nagase et al. (1995) identified a partial cDNA encoding TRIM14, which they called KIAA0129. The deduced 406-amino acid protein is 25% identical to RFP (OMIM Ref. No. 602165). Northern blot analysis revealed wide expression of KIAA0129 that was highest in liver but undetectable in skeletal muscle.

Full details of the abovementioned studies are described in the following publications, the disclosure of which are hereby incorporated by reference:

Nagase, T.; Seki, N.; Tanaka, A.; Ishikawa, K.; Nomura, N.: Prediction of the coding sequences of unidentified human genes. IV. The coding sequences of 40 new genes (KIAA0121-KIAA0160) deduced by analysis of cDNA clones from human cell line KG-1. DNA Res. 2:167-174, 1995; and Reymond, A.; Meroni, G.; Fantozzi, A.; Merla, G.; Cairo, S.; Luzi, L.; Riganelli, D.; Zanaria, E.; Messali, S.; Cainarca, S.; Guffanti, A.; Minucci, S.; Pelicci, P. G.; Ballabio, A.: T.

Further studies establishing the function and utilities of TRIM14 are found in John Hopkins OMIM database record ID 606556, and in cited publications listed in Table 5, which are hereby incorporated by reference. Tripartite motif-containing 14 (TRIM14, Accession NP_055603.2) is another GAM144 target gene, herein designated TARGET GENE. TRIM14 BINDING SITE is a target binding site found in the 3' untranslated region of multiple transcripts of mRNA encoded by TRIM14, corresponding to a target binding site such as BINDING SITE I, BINDING SITE II or BINDING SITE III of FIG. 8. Table 4 illustrates the complementarity of the nucleotide sequences of TRIM14 BINDING SITE, designated SEQ ID:3991, to the nucleotide sequence of GAM144 RNA, herein designated GAM RNA, also designated SEQ ID:361.

Another function of GAM144 is therefore inhibition of Tripartite motif-containing 14 (TRIM14, Accession NP_055603.2), a gene which is composed of 3 zinc-binding domains and is involved in development and cell growth. Accordingly, utilities of GAM144 include diagnosis, prevention and treatment of diseases and clinical conditions associated with TRIM14.

The function of TRIM14 has been established by previous studies. TRIM proteins are composed of 3 zinc-binding domains, a RING, a B-box type 1, and a B-box type 2, followed by a coiled-coil region. They are involved in development and cell growth. By sequencing cDNAs randomly selected from a cDNA library derived from the human immature myeloid cell line KG-1, Nagase et al. (1995) identified a partial cDNA encoding TRIM14, which they called KIAA0129. The deduced 406-amino acid protein is 25% identical to RFP (OMIM Ref. No. 602165). Northern blot analysis revealed wide expression of KIAA0129 that was highest in liver but undetectable in skeletal muscle.

Full details of the abovementioned studies are described in the following publications, the disclosure of which are hereby incorporated by reference:

Nagase, T.; Seki, N.; Tanaka, A.; Ishikawa, K.; Nomura, N.: Prediction of the coding sequences of unidentified human genes. IV. The coding sequences of 40 new genes (KIAA0121-KIAA0160) deduced by analysis of cDNA clones from human cell line KG-1. DNA Res. 2:167-174, 1995; and Reymond, A.; Meroni, G.; Fantozzi, A.; Merla, G.; Cairo, S.; Luzi, L.; Riganelli, D.; Zanaria, E.; Messali, S.; Cainarca, S.; Guffanti, A.; Minucci, S.; Pelicci, P. G.; Ballabio, A.: T.

Further studies establishing the function and utilities of TRIM14 are found in John Hopkins OMIM database record ID 606556, and in cited publications listed in Table 5, which are hereby incorporated by reference. TSARG1 (Accession NP_620712.2) is another GAM144 target gene, herein designated TARGET GENE. TSARG1 BINDING SITE is a target binding site found in the 3' untranslated region of mRNA encoded by TSARG1, corresponding to a target binding site such as BINDING SITE I, BINDING SITE II or BINDING SITE III of FIG. 8. Table 4 illustrates the complementarity of the nucleotide sequences of TSARG1 BINDING SITE, designated SEQ ID:9635, to the nucleotide sequence of GAM144 RNA, herein designated GAM RNA, also designated SEQ ID:361.

Another function of GAM144 is therefore inhibition of TSARG1 (Accession NP_620712.2). Accordingly, utilities of GAM144 include diagnosis, prevention and treatment of diseases and clinical conditions associated with TSARG1.

Uridine monophosphate kinase (UMPK, Accession NP_036606.2) is another GAM144 target gene, herein designated TARGET GENE. UMPK BINDING SITE is a target binding site found in the 5' untranslated region of mRNA encoded by UMPK, corresponding to a target binding site such as BINDING SITE I, BINDING SITE II or BINDING SITE III of FIG. 8. Table 4 illustrates the complementarity of the nucleotide sequences of UMPK BINDING SITE, designated SEQ ID:2776, to the nucleotide sequence of GAM144 RNA, herein designated GAM RNA, also designated SEQ ID:361.

Another function of GAM144 is therefore inhibition of Uridine monophosphate kinase (UMPK, Accession NP_036606.2), a gene which catalyzes the phosphorylation of uridine monophosphate to uridine diphosphate. and therefore may be associated with Hemophilus influenzae type b. Accordingly, utilities of GAM144 include diagnosis, prevention and treatment of Hemophilus influenzae type b, and of other diseases and clinical conditions associated with UMPK.

The function of UMPK has been established by previous studies. This enzyme (EC 2.7.4.4) catalyzes the first step in the production of the pyrimidine nucleoside triphosphates required for RNA and DNA synthesis, namely the phosphorylation of uridine monophosphate to uridine diphosphate. Giblett et al. (1974) found genetic polymorphism of UMPK by means of starch gel electrophoresis. Family studies provided evidence for 3 alleles-UMPK1, UMPK2, and UMPK3- at an autosomal locus. The UMPK1 allele was associated with about 3 times the catalytic activity of the UMPK2 allele, so that UMPK2 homozygotes are relatively deficient of the enzyme. Two of 3 UMPK2 homozygotes were children with prolonged respiratory infection. This suggested to Giblett et al. (1974) that the ability of immunocompetent lymphocytes to respond to appropriate stimuli is impaired in the UMPK2 homozygote in a manner similar to the immune defect resulting from adenosine deaminase deficiency. Alaskan Eskimos have the highest known prevalence of invasive Hemophilus influenzae type B disease, primarily meningitis: in 1 to 5% of all children in the first 2 years of life. In this population a polymorphic variant of UMPK, UMPK-3, is positively associated with invasive HIB disease (relative risk 3.3). No difference in levels of naturally acquired HIB anticapsular antibodies between persons with HIB disease and health controls was found. Thus, the UMPK-3 allele may have a role in mediating nonhumoral immunity to HIB (Petersen et al., 1985). Giblett et al. (1975) showed that UMPK and Rh (OMIM Ref. No. 111700) are linked (lod score of 2.313 at theta 0.05 on the basis of 4 families). (Rh is located on 1p36.2-p34. Cook and Hamerton (1979) gave 1p32 as the SRO of UMPK.) Satlin et al. (1975) assigned UMPK to chromosome 1 by study of somatic cell hybrids. Using somatic cell hybrids between a mouse cell line deficient in uridine kinase and human cells (Medrano and Green, 1974), Ruddle and Creagan (1975) provisionally assigned UK to chromosome 1. The Goss-Harris method of mapping combined features of recombinational study in families and synteny tests in hybrid cells. As applied to chromosome 1, the method showed that AK2 and UMPK are distal to PGM1 and that the order of the loci is PGM1: UMPK: (AK2, alpha-FUC): ENO1 (Goss and Harris, 1977). Data on gene frequencies of allelic variants were tabulated by Roychoudhury and Nei (1988).

Full details of the abovementioned studies are described in the following publications, the disclosure of which are hereby incorporated by reference:

Giblett, E. R.; Anderson, J. E.; Chen, S.-H.; Teng, Y.-S.; Cohen, F.: Uridine monophosphate kinase: a new genetic polymorphism with possible clinical implications. Am. J. Hum. Genet. 26:627-635, 1974; and Roychoudhury, A. K.; Nei, M.: Human Polymorphic Genes: World Distribution. New York: Oxford Univ. Press (pub.) 1988.

Further studies establishing the function and utilities of UMPK are found in John Hopkins OMIM database record ID 191710, and in cited publications listed in Table 5, which are hereby incorporated by reference. Ubiquitin specific protease 14 (trna-guanine transglycosylase) (USP14, Accession NP_005142.1) is another GAM144 target gene, herein designated TARGET GENE. USP14 BINDING SITE is a target binding site found in the 5' untranslated region of mRNA encoded by USP14, corresponding to a target binding site such as BINDING SITE I, BINDING SITE II or BINDING SITE III of FIG. 8. Table 4 illustrates the complementarity of the nucleotide sequences of USP14 BINDING SITE, designated SEQ ID:11260, to the nucleotide sequence of GAM144 RNA, herein designated GAM RNA, also designated SEQ ID:361.

Another function of GAM144 is therefore inhibition of Ubiquitin specific protease 14 (trna-guanine transglycosylase) (USP14, Accession NP_005142.1), a gene which is similar to ubiquitin-specific cysteine (thiol) proteases and tRNA-guanine transglycosylase. Accordingly, utilities of GAM144 include diagnosis, prevention and treatment of diseases and clinical conditions associated with USP14.

The function of USP14 and its association with various diseases and clinical conditions, has been established by previous studies, as described hereinabove with reference to GAM94.1. Ubiquitin specific protease 22 (USP22, Accession XP_042698.2) is another GAM144 target gene, herein designated TARGET GENE. USP22 BINDING SITE is a target binding site found in the 3' untranslated region of mRNA encoded by USP22, corresponding to a target binding site such as BINDING SITE I, BINDING SITE II or BINDING SITE III of FIG. 8. Table 4 illustrates the complementarity of the nucleotide sequences of USP22 BINDING SITE, designated SEQ ID:7093, to the nucleotide sequence of GAM144 RNA, herein designated GAM RNA, also designated SEQ ID:361.

Another function of GAM144 is therefore inhibition of Ubiquitin specific protease 22 (USP22, Accession XP_042698.2). Accordingly, utilities of GAM144 include diagnosis, prevention and treatment of diseases and clinical conditions associated with USP22.

Wap four-disulfide core domain 1 (WFDC1, Accession NP_067020.2) is another GAM144 target gene, herein designated TARGET GENE. WFDC1 BINDING SITE is a target binding site found in the 5' untranslated region of mRNA encoded by WFDC1, corresponding to a target binding site such as BINDING SITE I, BINDING SITE II or BINDING SITE III of FIG. 8. Table 4 illustrates the complementarity of the nucleotide sequences of WFDC1 BINDING SITE, designated SEQ ID:7098, to the nucleotide sequence of GAM144 RNA, herein designated GAM RNA, also designated SEQ ID:361.

Another function of GAM144 is therefore inhibition of Wap four-disulfide core domain 1 (WFDC1, Accession NP_067020.2), a gene which is a secretory protein and functions as a growth inhibitor. Accordingly, utilities of GAM144 include diagnosis, prevention and treatment of diseases and clinical conditions associated with WFDC1.

The function of WFDC1 has been established by previous studies. The rat ps20 protein was originally identified as a secreted growth inhibitor (Rowley, 1992; Rowley and Tindall, 1987) and purified to homogeneity from a fetal rat urogenital sinus mesenchymal cell line (Rowley et al., 1995). Larsen et al. (1998) cloned the rat cDNA and found that it contains a WAP-type four-disulfide core motif, indicating it may function as a protease inhibitor. By screening a human prostate cDNA library with a partial rat ps20 cDNA clone as probe, Larsen et al. (2000) cloned a full-length WFDC1 cDNA encoding a deduced 220-amino acid protein containing a WAP-type four-disulfide core motif. They also cloned the mouse homolog and found that the human WFDC1 protein shares approximately 86% and 88% identity with the rat and mouse proteins, respectively. Both the mouse and human WFDC1 genes contain 7 exons. By fluorescence in situ hybridization (FISH), Larsen et al. (2000) mapped the WFDC1 gene to chromosome 16q24, an area of frequent loss of heterozygosity (LOH) in cancers, including prostate, breast and hepatocellular cancers and Wilms tumor. The LOH, combined with the growth inhibitory properties of the gene product (ps20), suggested that WFDC1 is a tumor suppressor gene. By cohybridizing telomeric and WFDC1 probes in their FISH analyses, Larsen et al. (2000) found that WFDC1 is located in subband 16q24.3, less that 2 Mb from the telomere.

Full details of the abovementioned studies are described in the following publications, the disclosure of which are hereby incorporated by reference:

Rowley, D. R.; Dang, T. D.; Larsen, M.; Gerdes, M. J.; McBride, L.; Lu, B.: Purification of a novel protein (ps20) from urogenital sinus mesenchymal cells with growth inhibitory properties in vitro. J. Biol. Chem. 270:22058-22065, 1995; and Larsen, M.; Ressler, S. J.; Gerdes, M. J.; Lu, B.; Byron, M.; Lawrence, J. B.; Rowley, D. R.: The WFDC1 gene encoding ps20 localizes to 16q24, a region of LOH in multiple cancers. Mammali.

Further studies establishing the function and utilities of WFDC1 are found in John Hopkins OMIM database record ID 605322, and in cited publications listed in Table 5, which are hereby incorporated by reference. WFDC13 (Accession NP_742002.1) is another GAM144 target gene, herein designated TARGET GENE. WFDC13 BINDING SITE is a target binding site found in the 3' untranslated region of mRNA encoded by WFDC13, corresponding to a target binding site such as BINDING SITE I, BINDING SITE II or BINDING SITE III of FIG. 8. Table 4 illustrates the complementarity of the nucleotide sequences of WFDC13 BINDING SITE, designated SEQ ID:5225, to the nucleotide sequence of GAM144 RNA, herein designated GAM RNA, also designated SEQ ID:361.

Another function of GAM144 is therefore inhibition of WFDC13 (Accession NP_742002.1). Accordingly, utilities of GAM144 include diagnosis, prevention and treatment of diseases and clinical conditions associated with WFDC13.

X-ray repair complementing defective repair in chinese hamster cells 2 (XRCC2, Accession NP_005422.1) is another GAM144 target gene, herein designated TARGET GENE. XRCC2 BINDING SITE1 and XRCC2 BINDING SITE2 are target binding sites found in untranslated regions of mRNA encoded by XRCC2, corresponding to target binding sites such as BINDING SITE I, BINDING SITE II or BINDING SITE III of FIG. 8. Table 4 illustrates the complementarity of the nucleotide sequences of XRCC2 BINDING SITE1 and XRCC2 BINDING SITE2, designated SEQ ID:11760 and SEQ ID:18231 respectively, to the nucleotide sequence of GAM144 RNA, herein designated GAM RNA, also designated SEQ ID:361.

Another function of GAM144 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM144 include diagnosis, prevention and treatment of diseases and clinical conditions associated with XRCC2.

The function of XRCC2 and its association with various diseases and clinical conditions, has been established by previous studies, as described hereinabove with reference to GAM72.1. ZD52F10 (Accession NP_201574.1) is another GAM144 target gene, herein designated TARGET GENE. ZD52F10 BINDING SITE is a target binding site found in the 3' untranslated region of mRNA encoded by ZD52F10, corresponding to a target binding site such as BINDING SITE I, BINDING SITE II or BINDING SITE III of FIG. 8. Table 4 illustrates the complementarity of the nucleotide sequences of ZD52F10 BINDING SITE, designated SEQ ID:10953, to the nucleotide sequence of GAM144 RNA, herein designated GAM RNA, also designated SEQ ID:361.

Another function of GAM144 is therefore inhibition of ZD52F10 (Accession NP_201574.1). Accordingly, utilities of GAM144 include diagnosis, prevention and treatment of diseases and clinical conditions associated with ZD52F10.

Zinc finger protein 64 homolog (mouse) (ZFP64, Accession NP_071371.2) is another GAM144 target gene, herein designated TARGET GENE. ZFP64 BINDING SITE is a target binding site found in the 5' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:10150, to the nucleotide sequence of GAM144 RNA, herein designated GAM RNA, also designated SEQ ID:361.

Another function of GAM144 is therefore inhibition of Zinc finger protein 64 homolog (mouse) (ZFP64, Accession NP_071371.2). Accordingly, utilities of GAM144 include diagnosis, prevention and treatment of diseases and clinical conditions associated with ZFP64.

Zinc finger protein, multitype 2 (ZFPM2, Accession NP_036214.1) is another GAM144 target gene, herein designated TARGET GENE. ZFPM2 BINDING SITE is a target binding site found in the 3' untranslated region of mRNA encoded by ZFPM2, corresponding to a target binding site such as BINDING SITE I, BINDING SITE II or BINDING SITE III of FIG. 8. Table 4 illustrates the complementarity of the nucleotide sequences of ZFPM2 BINDING SITE, designated SEQ ID:10564, to the nucleotide sequence of GAM144 RNA, herein designated GAM RNA, also designated SEQ ID:361.

Another function of GAM144 is therefore inhibition of Zinc finger protein, multitype 2 (ZFPM2, Accession NP_036214.1). Accordingly, utilities of GAM144 include diagnosis, prevention and treatment of diseases and clinical conditions associated with ZFPM2.

Zinc finger protein 19 (kox 12) (ZNF19, Accession NP_690871.1) is another GAM144 target gene, herein designated TARGET GENE. ZNF19 BINDING SITE is a target binding site found in the 3' untranslated region of multiple transcripts of mRNA encoded by ZNF19, corresponding to a target binding site such as BINDING SITE I, BINDING SITE II or BINDING SITE III of FIG. 8. Table 4 illustrates the complementarity of the nucleotide sequences of ZNF19 BINDING SITE, designated SEQ ID:5130, to the nucleotide sequence of GAM144 RNA, herein designated GAM RNA, also designated SEQ ID:361.

Another function of GAM144 is therefore inhibition of Zinc finger protein 19 (kox 12) (ZNF19, Accession NP_690871.1). Accordingly, utilities of GAM144 include diagnosis, prevention and treatment of diseases and clinical conditions associated with ZNF19.

Zinc finger protein 19 (kox 12) (ZNF19, Accession NP_008892.1) is another GAM144 target gene, herein designated TARGET GENE. ZNF19 BINDING SITE is a target binding site found in the 3' untranslated region of multiple transcripts of mRNA encoded by ZNF19, corresponding to a target binding site such as BINDING SITE I, BINDING SITE II or BINDING SITE III of FIG. 8. Table 4 illustrates the complementarity of the nucleotide sequences of ZNF19 BINDING SITE, designated SEQ ID:5130, to the nucleotide sequence of GAM144 RNA, herein designated GAM RNA, also designated SEQ ID:361.

Another function of GAM144 is therefore inhibition of Zinc finger protein 19 (kox 12) (ZNF19, Accession NP_008892.1). Accordingly, utilities of GAM144 include diagnosis, prevention and treatment of diseases and clinical conditions associated with ZNF19.

Zinc finger protein 297 (ZNF297, Accession NP_005444.3) is another GAM144 target gene, herein designated TARGET GENE. ZNF297 BINDING SITE is a target binding site found in the 3' untranslated region of mRNA encoded by ZNF297, corresponding to a target binding site such as BINDING SITE I, BINDING SITE II or BINDING SITE III of FIG. 8. Table 4 illustrates the complementarity of the nucleotide sequences of ZNF297 BINDING SITE, designated SEQ ID:408, to the nucleotide sequence of GAM144 RNA, herein designated GAM RNA, also designated SEQ ID:361.

Another function of GAM144 is therefore inhibition of Zinc finger protein 297 (ZNF297, Accession NP_005444.3). Accordingly, utilities of GAM144 include diagnosis, prevention and treatment of diseases and clinical conditions associated with ZNF297.

Zinc finger protein 313 (ZNF313, Accession NP_061153.1) is another GAM144 target gene, herein designated TARGET GENE. ZNF313 BINDING SITE is a target binding site found in the 3' untranslated region of mRNA encoded by ZNF313, corresponding to a target binding site such as BINDING SITE I, BINDING SITE II or BINDING SITE III of FIG. 8. Table 4 illustrates the complementarity of the nucleotide sequences of ZNF313 BINDING SITE, designated SEQ ID:8636, to the nucleotide sequence of GAM144 RNA, herein designated GAM RNA, also designated SEQ ID:361.

Another function of GAM144 is therefore inhibition of Zinc finger protein 313 (ZNF313, Accession NP_061153.1). Accordingly, utilities of GAM144 include diagnosis, prevention and treatment of diseases and clinical conditions associated with ZNF313.

FIG. 8 further provides a conceptual description of a novel bioinformatically detected of the present invention, referred to here as Genomic Address Messenger 145 (GAM145), which modulates expression of respective target genes thereof, the function and utility of which target genes is known in the art.

GAM145 is a novel bioinformatically detected regulatory, non protein coding, micro RNA (miRNA) gene. The method by which GAM145 was detected is described hereinabove with reference to FIGS. 8-15.

GAM145 gene, herein designated GAM GENE, and GAM145 target gene, herein designated TARGET GENE, are human genes contained in the human genome.

GAM145 gene encodes a GAM145 precursor RNA, herein designated GAM PRECURSOR RNA. Similar to other miRNA genes, and unlike most ordinary genes, GAM145 precursor RNA does not encode a protein. A nucleotide sequence identical or highly similar to the nucleotide sequence of GAM145 precursor RNA is designated SEQ ID:82, and is provided hereinbelow with reference to the sequence listing part.

GAM145 precursor RNA folds onto itself, forming GAM145 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM145 precursor RNA folds onto itself, forming GAM145 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM145 precursor RNA, designated SEQ-ID:82, and a schematic representation of a predicted secondary folding of GAM145 folded precursor RNA are further described with reference to Table 2, hereby incorporated by reference.

An enzyme complex designated DICER COMPLEX, 'dices' the GAM145 folded precursor RNA into GAM145 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM145 RNA is designated SEQ ID:335, and is provided hereinbelow with references to the sequence listing part and Table 3, hereby incorporated by reference.

GAM145 target gene, herein designated TARGET GENE, encodes a corresponding messenger RNA, GAM145 target RNA, herein designated GAM TARGET RNA. GAM145 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM145 RNA, herein designated GAM RNA, binds complementarily to one or more target binding sites located in untranslated regions of GAM145 target RNA, herein designated GAM TARGET RNA. This complementary binding is due to the fact that the nucleotide sequence of GAM145 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM145 RNA may have a different number of target binding sites in untranslated regions of a GAM145 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM145 RNA, herein designated GAM RNA, to target binding sites on GAM145 target RNA, herein designated GAM TARGET RNA, such as BINDING SITE I, BINDING SITE II and BINDING SITE III, inhibits translation of GAM145 target RNA into GAM145 target protein, herein designated GAM TARGET PROTEIN. GAM target protein is therefore outlined by a broken line.

It is appreciated that GAM145 target gene, herein designated TARGET GENE, in fact represents a plurality of GAM145 target genes. The mRNA of each one of this plurality of GAM145 target genes comprises one or more target binding sites, each having a nucleotide sequence which is at least partly complementary to GAM145 RNA, herein designated GAM RNA, and which when bound by GAM145 RNA causes inhibition of translation of respective one or more GAM145 target proteins.

It is further appreciated by one skilled in the art that the mode of translational inhibition illustrated by FIG. 8 with specific reference to translational inhibition exerted by GAM145 gene, herein designated GAM GENE, on one or more GAM145 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM145 correlate with, and may be deduced from, the identity of the target genes which GAM145 binds and inhibits, and the function of these target genes, as elaborated hereinbelow.

DRIL2 (Accession NM_006465.1) is a GAM145 target gene, herein designated TARGET GENE. DRIL2 BINDING SITE is a target binding site found in the 3' untranslated region of mRNA encoded by DRIL2, corresponding to a target binding site such as BINDING SITE I, BINDING SITE II or BINDING SITE III of FIG. 8. Table 4 illustrates the complementarity of the nucleotide sequences of DRIL2 BINDING SITE, designated SEQ ID:6283, to the nucleotide sequence of GAM145 RNA, herein designated GAM RNA, also designated SEQ ID:335.

A function of GAM145 is therefore inhibition of DRIL2 (Accession NM_006465.1). Accordingly, utilities of GAM145 include diagnosis, prevention and treatment of diseases and clinical conditions associated with DRIL2.

FLJ10737 (Accession NM_018198.1) is another GAM145 target gene, herein designated TARGET GENE. FLJ10737 BINDING SITE is a target binding site found in the 3' untranslated region of mRNA encoded by FLJ10737, corresponding to a target binding site such as BINDING SITE I, BINDING SITE II or BINDING SITE III of FIG. 8. Table 4 illustrates the complementarity of the nucleotide sequences of FLJ10737 BINDING SITE, designated SEQ ID:15643, to the nucleotide sequence of GAM145 RNA, herein designated GAM RNA, also designated SEQ ID:335.

Another function of GAM145 is therefore inhibition of FLJ10737 (Accession NM_018198.1). Accordingly, utilities of GAM145 include diagnosis, prevention and treatment of diseases and clinical conditions associated with FLJ10737.

FLJ14129 (Accession NM_030895.1) is another GAM145 target gene, herein designated TARGET GENE. FLJ14129 BINDING SITE is a target binding site found in the 3' untranslated region of mRNA encoded by FLJ14129, corresponding to a target binding site such as BINDING SITE I, BINDING SITE II or BINDING SITE III of FIG. 8. Table 4 illustrates the complementarity of the nucleotide sequences of FLJ14129 BINDING SITE, designated SEQ ID:9578, to the nucleotide sequence of GAM145 RNA, herein designated GAM RNA, also designated SEQ ID:335.

Another function of GAM145 is therefore inhibition of FLJ14129 (Accession NM_030895.1). Accordingly, utilities of GAM145 include diagnosis, prevention and treatment of diseases and clinical conditions associated with FLJ14129.

G protein-coupled receptor kinase 7 (GPRK7, Accession NM_139209.1) is another GAM145 target gene, herein designated TARGET GENE. GPRK7 BINDING SITE is a target binding site found in the 3' untranslated region of mRNA encoded by GPRK7, corresponding to a target binding site such as BINDING SITE I, BINDING SITE II or BINDING SITE III of FIG. 8. Table 4 illustrates the complementarity of the nucleotide sequences of GPRK7 BINDING SITE, designated SEQ ID:19163, to the nucleotide sequence of GAM145 RNA, herein designated GAM RNA, also designated SEQ ID:335.

Another function of GAM145 is therefore inhibition of G protein-coupled receptor kinase 7 (GPRK7, Accession NM_139209.1), a gene which regulates the G protein-coupled receptors. Accordingly, utilities of GAM145 include diagnosis, prevention and treatment of diseases and clinical conditions associated with GPRK7.

The function of GPRK7 and its association with various diseases and clinical conditions, has been established by previous studies, as described hereinabove with reference to GAM72.1. KIAA1266 (Accession) is another GAM145 target gene, herein designated TARGET GENE. KIAA1266 BINDING SITE is a target binding site found in the 3' untranslated region of mRNA encoded by KIAA1266, corresponding to a target binding site such as BINDING SITE I, BINDING SITE II or BINDING SITE III of FIG. 8. Table 4 illustrates the complementarity of the nucleotide sequences of KIAA1266 BINDING SITE, designated SEQ ID:4524, to the nucleotide sequence of GAM145 RNA, herein designated GAM RNA, also designated SEQ ID:335.

Another function of GAM145 is therefore inhibition of KIAA1266 (Accession). Accordingly, utilities of GAM145 include diagnosis, prevention and treatment of diseases and clinical conditions associated with KIAA1266.

KIAA1715 (Accession XM_042834.2) is another GAM145 target gene, herein designated TARGET GENE. KIAA1715 BINDING SITE is a target binding site found in the 3' untranslated region of mRNA encoded by KIAA1715, corresponding to a target binding site such as BINDING SITE I, BINDING SITE II or BINDING SITE III of FIG. 8. Table 4 illustrates the complementarity of the nucleotide sequences of KIAA1715 BINDING SITE, designated SEQ ID:11841, to the nucleotide sequence of GAM145 RNA, herein designated GAM RNA, also designated SEQ ID:335.

Another function of GAM145 is therefore inhibition of KIAA1715 (Accession XM_042834.2). Accordingly, utilities of GAM145 include diagnosis, prevention and treatment of diseases and clinical conditions associated with KIAA1715.

LOC122726 (Accession) is another GAM145 target gene, herein designated TARGET GENE. LOC122726 BINDING SITE is a target binding site found in the 5' untranslated region of mRNA encoded by LOC122726, corresponding to a target binding site such as BINDING SITE I, BINDING SITE II or BINDING SITE III of FIG. 8. Table 4 illustrates the complementarity of the nucleotide sequences of LOC122726 BINDING SITE, designated SEQ ID:1477, to the nucleotide sequence of GAM145 RNA, herein designated GAM RNA, also designated SEQ ID:335.

Another function of GAM145 is therefore inhibition of LOC122726 (Accession). Accordingly, utilities of GAM145 include diagnosis, prevention and treatment of diseases and clinical conditions associated with LOC122726.

LOC129303 (Accession) is another GAM145 target gene, herein designated TARGET GENE. LOC129303 BINDING SITE is a target binding site found in the 3' untranslated region of mRNA encoded by LOC129303, corresponding to a target binding site such as BINDING SITE I, BINDING SITE II or BINDING SITE III of FIG. 8. Table 4 illustrates the complementarity of the nucleotide sequences of LOC129303 BINDING SITE, designated SEQ ID:10922, to the nucleotide sequence of GAM145 RNA, herein designated GAM RNA, also designated SEQ ID:335.

Another function of GAM145 is therefore inhibition of LOC129303 (Accession). Accordingly, utilities of GAM145 include diagnosis, prevention and treatment of diseases and clinical conditions associated with LOC129303.

LOC132617 (Accession) is another GAM145 target gene, herein designated TARGET GENE. LOC132617 BINDING SITE is a target binding site found in the 5' untranslated region of mRNA encoded by LOC132617, corresponding to a target binding site such as BINDING SITE I, BINDING SITE II or BINDING SITE III of FIG. 8. Table 4 illustrates the complementarity of the nucleotide sequences of LOC132617 BINDING SITE, designated SEQ ID:847, to the nucleotide sequence of GAM145 RNA, herein designated GAM RNA, also designated SEQ ID:335.

Another function of GAM145 is therefore inhibition of LOC132617 (Accession). Accordingly, utilities of GAM145 include diagnosis, prevention and treatment of diseases and clinical conditions associated with LOC132617.

LOC146332 (Accession) is another GAM145 target gene, herein designated TARGET GENE. LOC146332 BINDING SITE is a target binding site found in the 3' untranslated region of mRNA encoded by LOC146332, corresponding to a target binding site such as BINDING SITE I, BINDING SITE II or BINDING SITE III of FIG. 8. Table 4 illustrates the complementarity of the nucleotide sequences of LOC146332 BINDING SITE, designated SEQ ID:14632, to the nucleotide sequence of GAM145 RNA, herein designated GAM RNA, also designated SEQ ID:335.

Another function of GAM145 is therefore inhibition of LOC146332 (Accession). Accordingly, utilities of GAM145 include diagnosis, prevention and treatment of diseases and clinical conditions associated with LOC146332.

LOC149501 (Accession XM_059930.8) is another GAM145 target gene, herein designated TARGET GENE. LOC149501 BINDING SITE is a target binding site found in the 3' untranslated region of mRNA encoded by LOC149501, corresponding to a target binding site such as BINDING SITE I, BINDING SITE II or BINDING SITE III of FIG. 8. Table 4 illustrates the complementarity of the nucleotide sequences of LOC149501 BINDING SITE, designated SEQ ID:20044, to the nucleotide sequence of GAM145 RNA, herein designated GAM RNA, also designated SEQ ID:335.

Another function of GAM145 is therefore inhibition of LOC149501 (Accession XM_059930.8). Accordingly, utilities of GAM145 include diagnosis, prevention and treatment of diseases and clinical conditions associated with LOC149501.

LOC150397 (Accession XM_086907.1) is another GAM145 target gene, herein designated TARGET GENE. LOC150397 BINDING SITE is a target binding site found in the 3' untranslated region of mRNA encoded by LOC150397, corresponding to a target binding site such as BINDING SITE I, BINDING SITE II or BINDING SITE III of FIG. 8. Table 4 illustrates the complementarity of the nucleotide sequences of LOC150397 BINDING SITE, designated SEQ ID:5916, to the nucleotide sequence of GAM145 RNA, herein designated GAM RNA, also designated SEQ ID:335.

Another function of GAM145 is therefore inhibition of LOC150397 (Accession XM_086907.1). Accordingly, utilities of GAM145 include diagnosis, prevention and treatment of diseases and clinical conditions associated with LOC150397.

LOC219654 (Accession) is another GAM145 target gene, herein designated TARGET GENE. LOC219654 BINDING SITE is a target binding site found in the 3' untranslated region of mRNA encoded by LOC219654, corresponding to a target binding site such as BINDING SITE I, BINDING SITE II or BINDING SITE III of FIG. 8. Table 4 illustrates the complementarity of the nucleotide sequences of LOC219654 BINDING SITE, designated SEQ ID:17991, to the nucleotide sequence of GAM145 RNA, herein designated GAM RNA, also designated SEQ ID:335.

Another function of GAM145 is therefore inhibition of LOC219654 (Accession). Accordingly, utilities of GAM145 include diagnosis, prevention and treatment of diseases and clinical conditions associated with LOC219654.

LOC255042 (Accession) is another GAM145 target gene, herein designated TARGET GENE. LOC255042 BINDING SITE is a target binding site found in the 3' untranslated region of mRNA encoded by LOC255042, corresponding to a target binding site such as BINDING SITE I, BINDING SITE II or BINDING SITE III of FIG. 8. Table 4 illustrates the complementarity of the nucleotide sequences of LOC255042 BINDING SITE, designated SEQ ID:13776, to the nucleotide sequence of GAM145 RNA, herein designated GAM RNA, also designated SEQ ID:335.

Another function of GAM145 is therefore inhibition of LOC255042 (Accession). Accordingly, utilities of GAM145 include diagnosis, prevention and treatment of diseases and clinical conditions associated with LOC255042.

Mitochondrial ribosomal protein s24 (MRPS24, Accession NM_032014.1) is another GAM145 target gene, herein designated TARGET GENE. MRPS24 BINDING SITE is a target binding site found in the 3' untranslated region of mRNA encoded by MRPS24, corresponding to a target binding site such as BINDING SITE I, BINDING SITE II or BINDING SITE III of FIG. 8. Table 4 illustrates the complementarity of the nucleotide sequences of MRPS24 BINDING SITE, designated SEQ ID:17157, to the nucleotide sequence of GAM145 RNA, herein designated GAM RNA, also designated SEQ ID:335.

Another function of GAM145 is therefore inhibition of Mitochondrial ribosomal protein s24 (MRPS24, Accession NM_032014.1). Accordingly, utilities of GAM145 include diagnosis, prevention and treatment of diseases and clinical conditions associated with MRPS24.

Rab31, member ras oncogene family (RAB31, Accession NM_006868.1) is another GAM145 target gene, herein designated TARGET GENE. RAB31 BINDING SITE is a target binding site found in the 3' untranslated region of mRNA encoded by RAB31, corresponding to a target binding site such as BINDING SITE I, BINDING SITE II or BINDING SITE III of FIG. 8. Table 4 illustrates the complementarity of the nucleotide sequences of RAB31 BINDING SITE, designated SEQ ID:3423, to the nucleotide sequence of GAM145 RNA, herein designated GAM RNA, also designated SEQ ID:335.

Another function of GAM145 is therefore inhibition of Rab31, member ras oncogene family (RAB31, Accession NM_006868.1), a gene which is an GTP-binding protein of the RAB family. Accordingly, utilities of GAM145 include diagnosis, prevention and treatment of diseases and clinical conditions associated with RAB31.

The function of RAB31 has been established by previous studies. Chen et al. (1996) isolated a cDNA encoding RAB31, a small GTP-binding protein of the RAB family, from a human melanocyte cDNA library and from melanoma cells. The deduced 194-amino acid RAB31 protein, which the authors referred to as RAB22B, appeared to be an isoform of the human homolog of canine Rab22. Northern blot analysis detected a major transcript of 4.0 kb in all tissues tested and a minor transcript of 1.0 kb in tissues with relatively high expression, such as testis, ovary, lung, and leukocytes. By somatic cell hybrid analysis, Chen et al. (1996) mapped the RAB31 gene to chromosomes 18. Scott (2001) localized the RAB31 gene to 18p11.3 based on sequence similarity between the RAB31 sequence (GenBank U57091) and a chromosome 18 clone (GenBank AP000876).

Full details of the abovementioned studies are described in the following publications, the disclosure of which are hereby incorporated by reference:

Chen, D.; Guo, J.; Miki, T.; Tachibana, M.; Gahl, W. A.: Molecular cloning of two novel rab genes from human melanocytes. Gene 174:129-134, 1996; and Scott, A. F.: Personal Communication. Baltimore, Md., 2/26/2001.

Further studies establishing the function and utilities of RAB31 are found in John Hopkins OMIM database record ID 605694, and in cited publications listed in Table 5, which are hereby incorporated by reference. Wolf-hirschhorn syndrome candidate 1 (WHSC1, Accession NM_133332.1) is another GAM145 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:6879, to the nucleotide sequence of GAM145 RNA, herein designated GAM RNA, also designated SEQ ID:335.

Another function of GAM145 is therefore inhibition of Wolf-hirschhorn syndrome candidate 1 (WHSC1, Accession NM_133332.1), a gene which binds covalently to and repairs g/t mismatches. and therefore may be associated with Wolf-hirschhorn syndrome. Accordingly, utilities of GAM145 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1.

FIG. 8 further provides a conceptual description of a novel bioinformatically detected of the present invention, referred to here as Genomic Address Messenger 146 (GAM146), which modulates expression of respective target genes thereof, the function and utility of which target genes is known in the art.

GAM146 is a novel bioinformatically detected regulatory, non protein coding, micro RNA (miRNA) gene. The method by which GAM146 was detected is described hereinabove with reference to FIGS. 8-15.

GAM146 gene, herein designated GAM GENE, and GAM146 target gene, herein designated TARGET GENE, are human genes contained in the human genome.

GAM146 gene encodes a GAM146 precursor RNA, herein designated GAM PRECURSOR RNA. Similar to other miRNA genes, and unlike most ordinary genes, GAM146 precursor RNA does not encode a protein. A nucleotide sequence identical or highly similar to the nucleotide sequence of GAM146 precursor RNA is designated SEQ ID:20, and is provided hereinbelow with reference to the sequence listing part.

GAM146 precursor RNA folds onto itself, forming GAM146 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM146 precursor RNA folds onto itself, forming GAM146 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM146 precursor RNA, designated SEQ-ID:20, and a schematic representation of a predicted secondary folding of GAM146 folded precursor RNA are further described with reference to Table 2, hereby incorporated by reference.

An enzyme complex designated DICER COMPLEX, 'dices' the GAM146 folded precursor RNA into GAM146 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM146 RNA is designated SEQ ID:370, and is provided hereinbelow with references to the sequence listing part and Table 3, hereby incorporated by reference.

GAM146 target gene, herein designated TARGET GENE, encodes a corresponding messenger RNA, GAM146 target RNA, herein designated GAM TARGET RNA. GAM146 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM146 RNA, herein designated GAM RNA, binds complementarily to one or more target binding sites located in untranslated regions of GAM146 target RNA, herein designated GAM TARGET RNA. This complementary binding is due to the fact that the nucleotide sequence of GAM146 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM146 RNA may have a different number of target binding sites in untranslated regions of a GAM146 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM146 RNA, herein designated GAM RNA, to target binding sites on GAM146 target RNA, herein designated GAM TARGET RNA, such as BINDING SITE I, BINDING SITE II and BINDING SITE III, inhibits translation of GAM146 target RNA into GAM146 target protein, herein designated GAM TARGET PROTEIN. GAM target protein is therefore outlined by a broken line.

It is appreciated that GAM146 target gene, herein designated TARGET GENE, in fact represents a plurality of GAM146 target genes. The mRNA of each one of this plurality of GAM146 target genes comprises one or more target binding sites, each having a nucleotide sequence which is at least partly complementary to GAM146 RNA, herein designated GAM RNA, and which when bound by GAM146 RNA causes inhibition of translation of respective one or more GAM146 target proteins.

It is further appreciated by one skilled in the art that the mode of translational inhibition illustrated by FIG. 8 with specific reference to translational inhibition exerted by GAM146 gene, herein designated GAM GENE, on one or more GAM146 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM146 correlate with, and may be deduced from, the identity of the target genes which GAM146 binds and inhibits, and the function of these target genes, as elaborated hereinbelow.

ASIC4 (Accession NM_018674.2) is a GAM146 target gene, herein designated TARGET GENE. ASIC4 BINDING SITE is a target binding site found in the 5' untranslated region of mRNA encoded by ASIC4, corresponding to a target binding site such as BINDING SITE I, BINDING SITE II or BINDING SITE III of FIG. 8. Table 4 illustrates the complementarity of the nucleotide sequences of ASIC4 BINDING SITE, designated SEQ ID:15460, to the nucleotide sequence of GAM146 RNA, herein designated GAM RNA, also designated SEQ ID:370.

A function of GAM146 is therefore inhibition of ASIC4 (Accession NM_018674.2), a gene which is a proton-gated, amiloride-sensitive sodium channel. Accordingly, utilities of GAM146 include diagnosis, prevention and treatment of diseases and clinical conditions associated with ASIC4.

The function of ASIC4 has been established by previous studies. Grunder et al. (2000) isolated a cDNA corresponding to the human ASIC4 gene from a pituitary gland-specific cDNA library. Human ASIC4 protein shares 97% identity with its rat homolog. Dot-blot analysis and abundance of ASIC4 cDNAs in the pituitary cDNA library indicated strong expression in pituitary gland. By RT- PCR, Grunder et al. (2000) demonstrated expression in vestibular system and very faint expression in organ of Corti. ASIC4 could not be activated by a drop in extracellular pH in Xenopus oocytes, suggesting association with other subunits or activation by a ligand other than protons As the ASIC4 gene mapped in close proximity to the locus for paroxysmal dystonic choreoathetosis (PDC; 118800) on chromosome 2q, Grunder et al. (2001) sequenced the entire coding region and adjacent intronic sequences in an affected member of a large PDC family in which the disorder had been shown to be linked to the PDC locus on chromosome 2. Although 3 amino acid substitution polymorphisms were identified, none was disease- specific.

Full details of the abovementioned studies are described in the following publications, the disclosure of which are hereby incorporated by reference:

Grunder, S.; Geisler, H.-S.; Rainer, S.; Fink, J. K.: Acid-sensing ion channel (ASIC) 4 gene: physical mapping, genomic organisation, and evaluation as a candidate for paroxysmal dystonia. Europ. J. Hum. Genet. 9:672-676, 2001; and Grunder, S.; Geissler, H.-S.; Bassler, E.-L.; Ruppersberg, J. P.: A new member of acid-sensing ion channels from pituitary gland. Neuroreport 11:1607-1611, 2000.

Further studies establishing the function and utilities of ASIC4 are found in John Hopkins OMIM database record ID 606715, and in cited publications listed in Table 5, which are hereby incorporated by reference. Atpase, class v, type 10d (ATP10D, Accession NM_020453.2) is another GAM146 target gene, herein designated TARGET GENE. ATP10D BINDING SITE is a target binding site found in the 3' untranslated region of mRNA encoded by ATP10D, corresponding to a target binding site such as BINDING SITE I, BINDING SITE II or BINDING SITE III of FIG. 8. Table 4 illustrates the complementarity of the nucleotide sequences of ATP10D BINDING SITE, designated SEQ ID:19772, to the nucleotide sequence of GAM146 RNA, herein designated GAM RNA, also designated SEQ ID:370.

Another function of GAM146 is therefore inhibition of Atpase, class v, type 10d (ATP10D, Accession NM_020453.2). Accordingly, utilities of GAM146 include diagnosis, prevention and treatment of diseases and clinical conditions associated with ATP10D.

Beta-site app-cleaving enzyme (BACE, Accession NM_138973.1) is another GAM146 target gene, herein designated TARGET GENE. BACE BINDING SITE is a target binding site found in the 5' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:4746, to the nucleotide sequence of GAM146 RNA, herein designated GAM RNA, also designated SEQ ID:370.

Another function of GAM146 is therefore inhibition of Beta-site app-cleaving enzyme (BACE, Accession NM_138973.1), a gene which is responsible for the proteolytic processing of the amyloid precursor protein and therefore may be associated with Alzheimer disease. Accordingly, utilities of GAM146 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Bcl2-like 1 (BCL2L1, Accession NM_001191.2) is another GAM146 target gene, herein designated TARGET GENE. BCL2L1 BINDING SITE is a target binding site found in the 3' untranslated region of multiple transcripts of mRNA encoded by BCL2L1, corresponding to a target binding site such as BINDING SITE I, BINDING SITE II or BINDING SITE III of FIG. 8. Table 4 illustrates the complementarity of the nucleotide sequences of BCL2L1 BINDING SITE, designated SEQ ID:4366, to the nucleotide sequence of GAM146 RNA, herein designated GAM RNA, also designated SEQ ID:370.

Another function of GAM146 is therefore inhibition of Bcl2-like 1 (BCL2L1, Accession NM_001191.2). Accordingly, utilities of GAM146 include diagnosis, prevention and treatment of diseases and clinical conditions associated with BCL2L1.

B double prime 1, subunit of rna polymerase iii transcription initiation factor iiib (BDP1, Accession NM_018429.1) is another GAM146 target gene, herein designated TARGET GENE. BDP1 BINDING SITE is a target binding site found in the 3' untranslated region of mRNA encoded by BDP1, corresponding to a target binding site such as BINDING SITE I, BINDING SITE II or BINDING SITE III of FIG. 8. Table 4 illustrates the complementarity of the nucleotide sequences of BDP1 BINDING SITE, designated SEQ ID:15772, to the nucleotide sequence of GAM146 RNA, herein designated GAM RNA, also designated SEQ ID:370.

Another function of GAM146 is therefore inhibition of B double prime 1, subunit of rna polymerase iii transcription initiation factor iiib (BDP1, Accession NM_018429.1), a gene which activates RNA polymerase III transcription. Accordingly, utilities of GAM146 include diagnosis, prevention and treatment of diseases and clinical conditions associated with BDP1.

The function of BDP1 has been established by previous studies. Using a cDNA walking strategy, Kelter et al. (2000) cloned overlapping partial sequences of TFNR from fetal brain and spinal cord libraries. The deduced 2,254-amino acid protein has a calculated molecular mass of 250 kD. All cDNAs isolated from one fetal brain cDNA library lacked exon 15 resulting in a truncated protein of 796 amino acids. The TFNR protein is highly hydrophilic. It contains a 55-amino acid motif that is repeated as 6 highly conserved and 3 less well-conserved copies encoded by exon 17. It also contains a bipartite nuclear localization signal, a DNA-ligase A1 ATP-dependent (OMIM Ref. No. 126391) binding site, and a second bipartite nuclear localization signal in the C terminus. Sequence comparison with the first 11 exons of mouse Tfnr, encoding 545 amino acids, indicated 77% identity to the human TFNR protein. A stretch of over 300 amino acids of human TFNR showed 29% identity with the yeast TFC5 protein, a component of the TFIIIB transcription initiation complex. Northern blot analysis detected weak expression of 9.5-, 3.1-, and 1.6-kb transcripts in all tissues examined, and a 1.9-kb transcript expressed only in brain. Analysis of mRNAs from several brain areas showed a strong signal at 9.5 and 1.9 kb in cerebellum, and a weak signal in all other brain areas. Western blot analysis of fetal and adult human tissues showed 5 bands ranging from 55 to 250 kD. Immunofluorescent localization of TFNR in HeLa cells revealed a punctate nuclear staining pattern. With use of anti-BDP1 antibodies in in vitro transcription reactions, Schramm et al. (2000) determined that BPD1 is required for transcription from the Ad2 VAI and human U6 RNA polymerase III promoters. By chromatin immunoprecipitation assay, they also found that BDP1 binds the U6 promoter region in vivo, further suggesting that BDP1 is part of the U6 initiation complex Full details of the abovementioned studies are described in the following publications, the disclosure of which are hereby incorporated by reference:

Kelter, A.-R.; Herchenbach, J.; Wirth, B.: The transcription factor-like nuclear regulator (TFNR) contains a novel 55-amino-acid motif repeated nine times and maps closely to SMN1. Genomics 70:315-326, 2000; and Schramm, L.; Pendergrast, P. S.; Sun, Y.; Hernandez, N.: Different human TFIIB activities direct RNA polymerase III transcription from TATA-containing and TATA-less promoters. Genes De.

Further studies establishing the function and utilities of BDP1 are found in John Hopkins OMIM database record ID 607012, and in cited publications listed in Table 5, which are hereby incorporated by reference. Bassoon (presynaptic cytomatrix protein) (BSN, Accession NM_003458.1) is another GAM146 target gene, herein designated TARGET GENE. BSN BINDING SITE is a target binding site found in the 3' untranslated region of mRNA encoded by BSN, corresponding to a target binding site such as BINDING SITE I, BINDING SITE II or BINDING SITE III of FIG. 8. Table 4 illustrates the complementarity of the nucleotide sequences of BSN BINDING SITE, designated SEQ ID:7928, to the nucleotide sequence of GAM146 RNA, herein designated GAM RNA, also designated SEQ ID:370.

Another function of GAM146 is therefore inhibition of Bassoon (presynaptic cytomatrix protein) (BSN, Accession NM_003458.1), a gene which may be involved in cytomatrix organization at the site of neurotransmitter release and therefore may be associated with Multiple system atrophy (msa). Accordingly, utilities of GAM146 include diagnosis, prevention and treatment of Multiple system atrophy (msa), and of other diseases and clinical conditions associated with BSN.

The function of BSN has been established by previous studies. Both the presynaptic terminal and the postsynaptic compartment of neuronal synapses comprise a highly specialized cytoskeleton underlying the synaptic membranes. The presynaptic nerve terminal is the principal site of regulated neurotransmitter release. The active zone is the region of the presynaptic plasmalemma over which synaptic vesicles dock, fuse, and release neurotransmitter. Piccolo (PCLO; 604918), a 420-kD protein, is 1 component of the presynaptic cytomatrix. Tom Dieck et al. (1998) isolated a large (greater than 400 kD) protein in mouse that is also found in the presynaptic compartments of rat brain synapses. They designated the protein Bassoon because it, along with Piccolo, is part of the ensemble of presynaptic proteins that are involved in orchestrating events at the nerve terminal. Bassoon is found in axon terminals of hippocampal neurons where it is highly concentrated in the vicinity of the active zone. Piccolo has a similar distribution and colocalizes with Bassoon in cultured hippocampal cells. Tom Dieck et al. (1998) suggested that Bassoon may be involved in cytomatrix organization at the site of neurotransmitter release Multiple system atrophy (MSA) is a sporadic progressive neurodegenerative disease. By differential hybridization to high-density cDNA filters, Hashida et al. (1998) identified human frontal lobe cDNAs with altered expression patterns in MSA patients. One partial cDNA whose expression was elevated 2-fold in MSA cerebella encoded a protein that the authors designated ZNF231 (zinc finger protein-231). By screening additional libraries with the partial cDNA, they assembled a full-length ZNF231 cDNA. The predicted 3,926-amino acid protein contains 2 glycine-proline dipeptide repeats, a pair of homologous C8 double zinc finger motifs, a leucine zipper motif, an SH3 domain-binding motif, 2 nuclear targeting sequences, 2 glutamine-rich domains, and a histidine-rich domain. Northern blot analysis of rat tissues indicated that the ZNF231 gene was expressed as a 16-kb mRNA specifically in brain. By RT-PCR of human brain cell lines and tissue, Hashida et al. (1998) determined that ZNF231 was expressed in the cerebellum and in a neuroblastoma cell line, but not in the white matter. Ishikawa et al. (1997) recovered a ZNF231 cDNA, designated KIAA0434, as 1 of 78 brain cDNAs that may encode large proteins. Gundelfinger (1999) stated that ZNF231 is the human homolog of Bassoon Full details of the abovementioned studies are described in the following publications, the disclosure of which are hereby incorporated by reference:

tom Dieck, S.; Sanmarti-Vila, L.; Langnaese, K.; Richter, K.; Kindler, S.; Soyke, A.; Wex, H.; Smalla, K.-H.; Kampf, U.; Franzer, J.-T.; Stumm, M.; Garner, C. C.; Gundelfinger, E. D.: Bassoon, a novel zinc-finger CAG/glutamine-repeat protein selectively localized at the active zone of presynaptic nerve terminals. J. Cell Biol. 142:499-509, 1998; and Hashida, H.; Goto, J.; Zhao, N.; Takahashi, N.; Hirai, M.; Kanazawa, I.; Sakaki, Y.: Cloning and mapping of ZNF231, a novel brain-specific gene encoding neuronal double zinc finger prot.

Further studies establishing the function and utilities of BSN are found in John Hopkins OMIM database record ID 604020, and in cited publications listed in Table 5, which are hereby incorporated by reference. Chromosome 17 open reading frame 31 (C17orf31, Accession NM_017575.2) is another GAM146 target gene, herein designated TARGET GENE. C17orf31 BINDING SITE is a target binding site found in the 3' untranslated region of mRNA encoded by C17orf31, corresponding to a target binding site such as BINDING SITE I, BINDING SITE II or BINDING SITE III of FIG. 8. Table 4 illustrates the complementarity of the nucleotide sequences of C17orf31 BINDING SITE, designated SEQ ID:17622, to the nucleotide sequence of GAM146 RNA, herein designated GAM RNA, also designated SEQ ID:370.

Another function of GAM146 is therefore inhibition of Chromosome 17 open reading frame 31 (C17orf31, Accession NM_017575.2). Accordingly, utilities of GAM146 include diagnosis, prevention and treatment of diseases and clinical conditions associated with C17orf31.

Chromosome 20 open reading frame 150 (C20orf150, Accession XM_037265.3) is another GAM146 target gene, herein designated TARGET GENE. C20orf150 BINDING SITE is a target binding site found in the 3' untranslated region of mRNA encoded by C20orf150, corresponding to a target binding site such as BINDING SITE I, BINDING SITE II or BINDING SITE III of FIG. 8. Table 4 illustrates the complementarity of the nucleotide sequences of C20orf150 BINDING SITE, designated SEQ ID:13347, to the nucleotide sequence of GAM146 RNA, herein designated GAM RNA, also designated SEQ ID:370.

Another function of GAM146 is therefore inhibition of Chromosome 20 open reading frame 150 (C20orf150, Accession XM_037265.3). Accordingly, utilities of GAM146 include diagnosis, prevention and treatment of diseases and clinical conditions associated with C20orf150.

C20orf180 (Accession) is another GAM146 target gene, herein designated TARGET GENE. C20orf180 BINDING SITE is a target binding site found in the 3' untranslated region of mRNA encoded by C20orf180, corresponding to a target binding site such as BINDING SITE I, BINDING SITE II or BINDING SITE III of FIG. 8. Table 4 illustrates the complementarity of the nucleotide sequences of C20orf180 BINDING SITE, designated SEQ ID:3334, to the nucleotide sequence of GAM146 RNA, herein designated GAM RNA, also designated SEQ ID:370.

Another function of GAM146 is therefore inhibition of C20orf180 (Accession). Accordingly, utilities of GAM146 include diagnosis, prevention and treatment of diseases and clinical conditions associated with C20orf180.

Chromosome 20 open reading frame 188 (C20orf188, Accession NM_015638.1) is another GAM146 target gene, herein designated TARGET GENE. C20orf188 BINDING SITE is a target binding site found in the 3' untranslated region of mRNA encoded by C20orf188, corresponding to a target binding site such as BINDING SITE I, BINDING SITE II or BINDING SITE III of FIG. 8. Table 4 illustrates the complementarity of the nucleotide sequences of C20orf188 BINDING SITE, designated SEQ ID:5330, to the nucleotide sequence of GAM146 RNA, herein designated GAM RNA, also designated SEQ ID:370.

Another function of GAM146 is therefore inhibition of Chromosome 20 open reading frame 188 (C20orf188, Accession NM_015638.1). Accordingly, utilities of GAM146 include diagnosis, prevention and treatment of diseases and clinical conditions associated with C20orf188.

Chromosome 6 open reading frame 31 (C6orf31, Accession NM_030651.2) is another GAM146 target gene, herein designated TARGET GENE. C6orf31 BINDING SITE is a target binding site found in the 5' untranslated region of mRNA encoded by C6orf31, corresponding to a target binding site such as BINDING SITE I, BINDING SITE II or BINDING SITE III of FIG. 8. Table 4 illustrates the complementarity of the nucleotide sequences of C6orf31 BINDING SITE, designated SEQ ID:9476, to the nucleotide sequence of GAM146 RNA, herein designated GAM RNA, also designated SEQ ID:370.

Another function of GAM146 is therefore inhibition of Chromosome 6 open reading frame 31 (C6orf31, Accession NM_030651.2). Accordingly, utilities of GAM146 include diagnosis, prevention and treatment of diseases and clinical conditions associated with C6orf31.

CG012 (Accession XM_096710.2) is another GAM146 target gene, herein designated TARGET GENE. CG012 BINDING SITE is a target binding site found in the 3' untranslated region of mRNA encoded by CG012, corresponding to a target binding site such as BINDING SITE I, BINDING SITE II or BINDING SITE III of FIG. 8. Table 4 illustrates the complementarity of the nucleotide sequences of CG012 BINDING SITE, designated SEQ ID:19685, to the nucleotide sequence of GAM146 RNA, herein designated GAM RNA, also designated SEQ ID:370.

Another function of GAM146 is therefore inhibition of CG012 (Accession XM_096710.2). Accordingly, utilities of GAM146 include diagnosis, prevention and treatment of diseases and clinical conditions associated with CG012.

Chromatin accessibility complex 1 (CHRAC1, Accession NM_017444.3) is another GAM146 target gene, herein designated TARGET GENE. CHRAC1 BINDING SITE is a target binding site found in the 3' untranslated region of mRNA encoded by CHRAC1, corresponding to a target binding site such as BINDING SITE I, BINDING SITE II or BINDING SITE III of FIG. 8. Table 4 illustrates the complementarity of the nucleotide sequences of CHRAC1 BINDING SITE, designated SEQ ID:19743, to the nucleotide sequence of GAM146 RNA, herein designated GAM RNA, also designated SEQ ID:370.

Another function of GAM146 is therefore inhibition of Chromatin accessibility complex 1 (CHRAC1, Accession NM_017444.3). Accordingly, utilities of GAM146 include diagnosis, prevention and treatment of diseases and clinical conditions associated with CHRAC1.

CLIPR-59 (Accession NM_015526.1) is another GAM146 target gene, herein designated TARGET GENE. CLIPR-59 BINDING SITE is a target binding site found in the 3' untranslated region of mRNA encoded by CLIPR-59, corresponding to a target binding site such as BINDING SITE I, BINDING SITE II or BINDING SITE III of FIG. 8. Table 4 illustrates the complementarity of the nucleotide sequences of CLIPR-59 BINDING SITE, designated SEQ ID:1749, to the nucleotide sequence of GAM146 RNA, herein designated GAM RNA, also designated SEQ ID:370.

Another function of GAM146 is therefore inhibition of CLIPR-59 (Accession NM_015526.1). Accordingly, utilities of GAM146 include diagnosis, prevention and treatment of diseases and clinical conditions associated with CLIPR-59.

Colony stimulating factor 1 receptor, formerly mcdonough feline sarcoma viral (v-fms) oncogene homolog (CSF1R, Accession NM_005211.2) is another GAM146 target gene, herein designated TARGET GENE. CSF1R BINDING SITE is a target binding site found in the 3' untranslated region of mRNA encoded by CSF1R, corresponding to a target binding site such as BINDING SITE I, BINDING SITE II or BINDING SITE III of FIG. 8. Table 4 illustrates the complementarity of the nucleotide sequences of CSF1R BINDING SITE, designated SEQ ID:8995, to the nucleotide sequence of GAM146 RNA, herein designated GAM RNA, also designated SEQ ID:370.

Another function of GAM146 is therefore inhibition of Colony stimulating factor 1 receptor, formerly mcdonough feline sarcoma viral (v-fms) oncogene homolog (CSF1R, Accession NM_005211.2), a gene which is involved in regulation of growth and differentiation of myeloid cells and therefore may be associated with Myeloid malignancy, predisposition to. Accordingly, utilities of GAM146 include diagnosis, prevention and treatment of Myeloid malignancy, predisposition to, and of other diseases and clinical conditions associated with CSF1R.

The function of CSF1R and its association with various diseases and clinical conditions, has been established by previous studies, as described hereinabove with reference to GAM94.1. Deiodinase, iodothyronine, type ii (DIO2, Accession NM_000793.2) is another GAM146 target gene, herein designated TARGET GENE. DIO2 BINDING SITE is a target binding site found in the 3' untranslated region of multiple transcripts of mRNA encoded by DIO2, corresponding to a target binding site such as BINDING SITE I, BINDING SITE II or BINDING SITE III of FIG. 8. Table 4 illustrates the complementarity of the nucleotide sequences of DIO2 BINDING SITE, designated SEQ ID:18574, to the nucleotide sequence of GAM146 RNA, herein designated GAM RNA, also designated SEQ ID:370.

Another function of GAM146 is therefore inhibition of Deiodinase, iodothyronine, type ii (DIO2, Accession NM_000793.2). Accordingly, utilities of GAM146 include diagnosis, prevention and treatment of diseases and clinical conditions associated with DIO2.

DKFZP564C1940 (Accession) is another GAM146 target gene, herein designated TARGET GENE. DKFZP564C1940 BINDING SITE is a target binding site found in the 5' untranslated region of mRNA encoded by DKFZP564C1940, corresponding to a target binding site such as BINDING SITE I, BINDING SITE II or BINDING SITE III of FIG. 8. Table 4 illustrates the complementarity of the nucleotide sequences of DKFZP564C1940 BINDING SITE, designated SEQ ID:7189, to the nucleotide sequence of GAM146 RNA, herein designated GAM RNA, also designated SEQ ID:370.

Another function of GAM146 is therefore inhibition of DKFZP564C1940 (Accession). Accordingly, utilities of GAM146 include diagnosis, prevention and treatment of diseases and clinical conditions associated with DKFZP564C1940.

DKFZP586P0123 (Accession XM_170681.3) is another GAM146 target gene, herein designated TARGET GENE. DKFZP586P0123 BINDING SITE is a target binding site found in the 5' untranslated region of mRNA encoded by DKFZP586P0123, corresponding to a target binding site such as BINDING SITE I, BINDING SITE II or BINDING SITE III of FIG. 8. Table 4 illustrates the complementarity of the nucleotide sequences of DKFZP586P0123 BINDING SITE, designated SEQ ID:18201, to the nucleotide sequence of GAM146 RNA, herein designated GAM RNA, also designated SEQ ID:370.

Another function of GAM146 is therefore inhibition of DKFZP586P0123 (Accession XM_170681.3). Accordingly, utilities of GAM146 include diagnosis, prevention and treatment of diseases and clinical conditions associated with DKFZP586P0123.

Eukaryotic translation initiation factor 1a, y chromosome (EIF1AY, Accession NM_004681.1) is another GAM146 target gene, herein designated TARGET GENE. EIF1AY BINDING SITE is a target binding site found in the 3' untranslated region of mRNA encoded by EIF1AY, corresponding to a target binding site such as BINDING SITE I, BINDING SITE II or BINDING SITE III of FIG. 8. Table 4 illustrates the complementarity of the nucleotide sequences of EIF1AY BINDING SITE, designated SEQ ID:741, to the nucleotide sequence of GAM146 RNA, herein designated GAM RNA, also designated SEQ ID:370.

Another function of GAM146 is therefore inhibition of Eukaryotic translation initiation factor 1a, y chromosome (EIF1AY, Accession NM_004681.1). Accordingly, utilities of GAM146 include diagnosis, prevention and treatment of diseases and clinical conditions associated with EIF1AY.

Erythrocyte membrane protein band 4.1-like 1 (EPB41L1, Accession NM_012156.1) is another GAM146 target gene, herein designated TARGET GENE. EPB41L1 BINDING SITE is a target binding site found in the 3' untranslated region of multiple transcripts of mRNA encoded by EPB41L1, corresponding to a target binding site such as BINDING SITE I, BINDING SITE II or BINDING SITE III of FIG. 8. Table 4 illustrates the complementarity of the nucleotide sequences of EPB41L1 BINDING SITE, designated SEQ ID:7094, to the nucleotide sequence of GAM146 RNA, herein designated GAM RNA, also designated SEQ ID:370.

Another function of GAM146 is therefore inhibition of Erythrocyte membrane protein band 4.1-like 1 (EPB41L1, Accession NM_012156.1). Accordingly, utilities of GAM146 include diagnosis, prevention and treatment of diseases and clinical conditions associated with EPB41L1.

F-box and wd-40 domain protein 1b (FBXW1B, Accession NM_033644.1) is another GAM146 target gene, herein designated TARGET GENE. FBXW1B BINDING SITE is a target binding site found in the 3' untranslated region of multiple transcripts of mRNA encoded by FBXW1B, corresponding to a target binding site such as BINDING SITE I, BINDING SITE II or BINDING SITE III of FIG. 8. Table 4 illustrates the complementarity of the nucleotide sequences of FBXW1B BINDING SITE, designated SEQ ID:13218, to the nucleotide sequence of GAM146 RNA, herein designated GAM RNA, also designated SEQ ID:370.

Another function of GAM146 is therefore inhibition of F-box and wd-40 domain protein 1b (FBXW1B, Accession NM_033644.1), a gene which somehow is involved in the process of neuronal cell differentiation or brain development. Accordingly, utilities of GAM146 include diagnosis, prevention and treatment of diseases and clinical conditions associated with FBXW1B.

The function of FBXW1B has been established by previous studies. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). By searching an EST database for homologs of BTRCP, followed by RT-PCR on gastric cancer cell lines and screening fetal brain and fetal lung cDNA libraries, Koike et al. (2000) obtained cDNAs encoding 3 isoforms of FBXW1B, which they termed BTRCP2A, BTRCP2B, and BTRCP2C. Sequence analysis predicted that the 3 isoforms share the same N-terminal 15 amino acids, F box, and 7 C-terminal WD repeats. The 525-amino acid BTRCP2B protein has a 21-amino acid insert after met15 of the 508-amino acid BTRCP2A protein, and BTRCP2C has a 34-amino acid insert after met15 of BTRCP2A. BTRCP2A is 86% identical to BTRCP. BTRCP2C is nearly identical to the KIAA0696 protein identified by Ishikawa et al. (1998). By genomic sequence analysis, Koike et al. (2000) determined that the FBXW1B gene contains at least 14 exons, with BTRCP2A lacking exons 2 and 3, BTRCP2B lacking exon 2, and BTRCP2C lacking exon 3. Northern blot analysis revealed near ubiquitous expression of a 4.5-kb transcript. By RT-PCR analysis, Ishikawa et al. (1998) detected expression in all tissues tested except spleen.

Full details of the abovementioned studies are described in the following publications, the disclosure of which are hereby incorporated by reference:

Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequences of 100 new cDNA clones from brain which can code for large proteins in vitro. DNA Res. 5:169-176, 1998; and Koike, J.; Sagara, N.; Kirikoshi, H.; Takagi, A.; Miwa, T.; Hirai, M.; Katoh, M.: Molecular cloning and genomic structure of the beta-TRCP2 gene on chromosome 5q35.1. Biochem. Biophys.

Further studies establishing the function and utilities of FBXW1B are found in John Hopkins OMIM database record ID 605651, and in cited publications listed in Table 5, which are hereby incorporated by reference. FLJ00026 (Accession XM_036307.7) is another GAM146 target gene, herein designated TARGET GENE. FLJ00026 BINDING SITE is a target binding site found in the 3' untranslated region of mRNA encoded by FLJ00026, corresponding to a target binding site such as BINDING SITE I, BINDING SITE II or BINDING SITE III of FIG. 8. Table 4 illustrates the complementarity of the nucleotide sequences of FLJ00026 BINDING SITE, designated SEQ ID:8652, to the nucleotide sequence of GAM146 RNA, herein designated GAM RNA, also designated SEQ ID:370.

Another function of GAM146 is therefore inhibition of FLJ00026 (Accession XM_036307.7). Accordingly, utilities of GAM146 include diagnosis, prevention and treatment of diseases and clinical conditions associated with FLJ00026.

FLJ10057 (Accession NM_017984.2) is another GAM146 target gene, herein designated TARGET GENE. FLJ10057 BINDING SITE is a target binding site found in the 3' untranslated region of mRNA encoded by FLJ10057, corresponding to a target binding site such as BINDING SITE I, BINDING SITE II or BINDING SITE III of FIG. 8. Table 4 illustrates the complementarity of the nucleotide sequences of FLJ10057 BINDING SITE, designated SEQ ID:3965, to the nucleotide sequence of GAM146 RNA, herein designated GAM RNA, also designated SEQ ID:370.

Another function of GAM146 is therefore inhibition of FLJ10057 (Accession NM_017984.2). Accordingly, utilities of GAM146 include diagnosis, prevention and treatment of diseases and clinical conditions associated with FLJ10057.

FLJ12221 (Accession XM_031342.1) is another GAM146 target gene, herein designated TARGET GENE. FLJ12221 BINDING SITE is a target binding site found in the 3' untranslated region of mRNA encoded by FLJ12221, corresponding to a target binding site such as BINDING SITE I, BINDING SITE II or BINDING SITE III of FIG. 8. Table 4 illustrates the complementarity of the nucleotide sequences of FLJ12221 BINDING SITE, designated SEQ ID:5264, to the nucleotide sequence of GAM146 RNA, herein designated GAM RNA, also designated SEQ ID:370.

Another function of GAM146 is therefore inhibition of FLJ12221 (Accession XM_031342.1). Accordingly, utilities of GAM146 include diagnosis, prevention and treatment of diseases and clinical conditions associated with FLJ12221.

FLJ14346 (Accession NM_025029.1) is another GAM146 target gene, herein designated TARGET GENE. FLJ14346 BINDING SITE is a target binding site found in the 3' untranslated region of mRNA encoded by FLJ14346, corresponding to a target binding site such as BINDING SITE I, BINDING SITE II or BINDING SITE III of FIG. 8. Table 4 illustrates the complementarity of the nucleotide sequences of FLJ14346 BINDING SITE, designated SEQ ID:9772, to the nucleotide sequence of GAM146 RNA, herein designated GAM RNA, also designated SEQ ID:370.

Another function of GAM146 is therefore inhibition of FLJ14346 (Accession NM_025029.1). Accordingly, utilities of GAM146 include diagnosis, prevention and treatment of diseases and clinical conditions associated with FLJ14346.

FLJ20489 (Accession NM_017842.1) is another GAM146 target gene, herein designated TARGET GENE. FLJ20489 BINDING SITE is a target binding site found in the 5' untranslated region of mRNA encoded by FLJ20489, corresponding to a target binding site such as BINDING SITE I, BINDING SITE II or BINDING SITE III of FIG. 8. Table 4 illustrates the complementarity of the nucleotide sequences of FLJ20489 BINDING SITE, designated SEQ ID:579, to the nucleotide sequence of GAM146 RNA, herein designated GAM RNA, also designated SEQ ID:370.

Another function of GAM146 is therefore inhibition of FLJ20489 (Accession NM_017842.1). Accordingly, utilities of GAM146 include diagnosis, prevention and treatment of diseases and clinical conditions associated with FLJ20489.

FLJ20509 (Accession NM_017851.1) is another GAM146 target gene, herein designated TARGET GENE. FLJ20509 BINDING SITE is a target binding site found in the 3' untranslated region of mRNA encoded by FLJ20509, corresponding to a target binding site such as BINDING SITE I, BINDING SITE II or BINDING SITE III of FIG. 8. Table 4 illustrates the complementarity of the nucleotide sequences of FLJ20509 BINDING SITE, designated SEQ ID:14324, to the nucleotide sequence of GAM146 RNA, herein designated GAM RNA, also designated SEQ ID:370.

Another function of GAM146 is therefore inhibition of FLJ20509 (Accession NM_017851.1). Accordingly, utilities of GAM146 include diagnosis, prevention and treatment of diseases and clinical conditions associated with FLJ20509.

FLJ20546 (Accession NM_017872.2) is another GAM146 target gene, herein designated TARGET GENE. FLJ20546 BINDING SITE is a target binding site found in the 3' untranslated region of mRNA encoded by FLJ20546, corresponding to a target binding site such as BINDING SITE I, BINDING SITE II or BINDING SITE III of FIG. 8. Table 4 illustrates the complementarity of the nucleotide sequences of FLJ20546 BINDING SITE, designated SEQ ID:502, to the nucleotide sequence of GAM146 RNA, herein designated GAM RNA, also designated SEQ ID:370.

Another function of GAM146 is therefore inhibition of FLJ20546 (Accession NM_017872.2). Accordingly, utilities of GAM146 include diagnosis, prevention and treatment of diseases and clinical conditions associated with FLJ20546.

FLJ21791 (Accession) is another GAM146 target gene, herein designated TARGET GENE. FLJ21791 BINDING SITE is a target binding site found in the 3' untranslated region of mRNA encoded by FLJ21791, corresponding to a target binding site such as BINDING SITE I, BINDING SITE II or BINDING SITE III of FIG. 8. Table 4 illustrates the complementarity of the nucleotide sequences of FLJ21791

BINDING SITE, designated SEQ ID:5000, to the nucleotide sequence of GAM146 RNA, herein designated GAM RNA, also designated SEQ ID:370.

Another function of GAM146 is therefore inhibition of FLJ21791 (Accession). Accordingly, utilities of GAM146 include diagnosis, prevention and treatment of diseases and clinical conditions associated with FLJ21791.

FLJ22865 (Accession NM_025109.2) is another GAM146 target gene, herein designated TARGET GENE. FLJ22865 BINDING SITE is a target binding site found in the 5' untranslated region of mRNA encoded by FLJ22865, corresponding to a target binding site such as BINDING SITE I, BINDING SITE II or BINDING SITE III of FIG. 8. Table 4 illustrates the complementarity of the nucleotide sequences of FLJ22865 BINDING SITE, designated SEQ ID:18657, to the nucleotide sequence of GAM146 RNA, herein designated GAM RNA, also designated SEQ ID:370.

Another function of GAM146 is therefore inhibition of FLJ22865 (Accession NM_025109.2). Accordingly, utilities of GAM146 include diagnosis, prevention and treatment of diseases and clinical conditions associated with FLJ22865.

Flavin containing monooxygenase 2 (FMO2, Accession NM_001460.1) is another GAM146 target gene, herein designated TARGET GENE. FMO2 BINDING SITE is a target binding site found in the 3' untranslated region of mRNA encoded by FMO2, corresponding to a target binding site such as BINDING SITE I, BINDING SITE II or BINDING SITE III of FIG. 8. Table 4 illustrates the complementarity of the nucleotide sequences of FMO2 BINDING SITE, designated SEQ ID:2634, to the nucleotide sequence of GAM146 RNA, herein designated GAM RNA, also designated SEQ ID:370.

Another function of GAM146 is therefore inhibition of Flavin containing monooxygenase 2 (FMO2, Accession NM_001460.1), a gene which catalyzes the n-oxidation of primary alkylamines to their oximes via an n- hydroxylamine intermediate. Accordingly, utilities of GAM146 include diagnosis, prevention and treatment of diseases and clinical conditions associated with FMO2.

The function of FMO2 has been established by previous studies. The flavin- containing monooxygenases (FMOs; EC 1.14.13.8) are NADPH-dependent flavoenzymes that catalyze the oxidation of heteroatom centers in numerous drugs and xenobiotics. See FMO1 (OMIM Ref. No. 136130). FMO2, or pulmonary FMO, is 1 of 5 forms of the enzyme identified in mammals. It is expressed predominantly in lung and differs from other FMOs in that it can catalyze the N-oxidation of certain primary alkylamines. By screening a human lung library with a rabbit FMO2 cDNA, Dolphin et al. (1998) isolated human FMO2 cDNAs. The human FMO2 transcript contains a premature stop codon and thus encodes a predicted 471-amino acid protein that is 64 residues shorter than the FMO2 proteins of other mammals such as rabbit, guinea pig, and macaque monkey. The nonsense mutation that leads to production of the truncated human protein is not present in the FMO2 gene of closely related primates, and must therefore have arisen in the human lineage after the divergence of humans from their closest relative, the chimpanzee. RNase protection assays indicated that the human FMO2 gene was expressed predominantly in lung. However, Dolphin et al. (1998) noted that a previous study had shown that FMO2 protein was undetectable in all but 1 of 29 human lung samples (Williams et al., 1990). They suggested that the truncated human FMO2 protein is unable to fold correctly and is rapidly degraded. Heterologous expression studies demonstrated that human FMO2 is catalytically inactive. Thus, this situation is similar to those of the urate oxidase (UOX; 191540), gulonolactone oxidase (GULOP; 240400), and cytidine monophospho-n-acetylneuraminic acid hydroxylase (CMAH; 603209) gene products, which are active in most mammals but are nonfunctional in the human. By PCR analysis of somatic cell hybrids, McCombie et al. (1996) mapped the FMO2 gene to 1q, a region containing the FMO1, FMO3 (OMIM Ref. No. 136132), and FMO4 (OMIM Ref. No. 136131) genes.

Full details of the abovementioned studies are described in the following publications, the disclosure of which are hereby incorporated by reference:

Dolphin, C. T.; Beckett, D. J.; Janmohamed, A.; Cullingford, T. E.; Smith, R. L.; Shephard, E. A.; Phillips, I. R.: The flavin-containing monooxygenase 2 gene (FMO2) of humans, but not of other primates, encodes a truncated, nonfunctional protein. J. Biol. Chem. 273:30599-30607, 1998; and McCombie, R. R.; Dolphin, C. T.; Povey, S.; Phillips, I. R.; Shephard, E. A.: Localization of human flavin-containing monooxygenase genes FMO2 and FMO5 to chromosome 1q. Genomics 34:4.

Further studies establishing the function and utilities of FMO2 are found in John Hopkins OMIM database record ID 603955, and in cited publications listed in Table 5, which are hereby incorporated by reference. Gonadotropin-releasing hormone 1 (leutinizing-releasing hormone) (GNRH1, Accession NM_000825.2) is another GAM146 target gene, herein designated TARGET GENE. GNRH1 BINDING SITE is a target binding site found in the 5' untranslated region of mRNA encoded by GNRH1, corresponding to a target binding site such as BINDING SITE I, BINDING SITE II or BINDING SITE III of FIG. 8. Table 4 illustrates the complementarity of the nucleotide sequences of GNRH1 BINDING SITE, designated SEQ ID:2156, to the nucleotide sequence of GAM146 RNA, herein designated GAM RNA, also designated SEQ ID:370.

Another function of GAM146 is therefore inhibition of Gonadotropin-releasing hormone 1 (leutinizing-releasing hormone) (GNRH1, Accession NM_000825.2). Accordingly, utilities of GAM146 include diagnosis, prevention and treatment of diseases and clinical conditions associated with GNRH1.

Histone deacetylase 6 (HDAC6, Accession NM_006044.2) is another GAM146 target gene, herein designated TARGET GENE. HDAC6 BINDING SITE is a target binding site found in the 3' untranslated region of mRNA encoded by HDAC6, corresponding to a target binding site such as BINDING SITE I, BINDING SITE II or BINDING SITE III of FIG. 8. Table 4 illustrates the complementarity of the nucleotide sequences of HDAC6 BINDING SITE, designated SEQ ID:7208, to the nucleotide sequence of GAM146 RNA, herein designated GAM RNA, also designated SEQ ID:370.

Another function of GAM146 is therefore inhibition of Histone deacetylase 6 (HDAC6, Accession NM_006044.2), a gene which plays an important role in transcriptional regulation, cell cycle progression and developmental events (by similarity). Accordingly, utilities of GAM146 include diagnosis, prevention and treatment of diseases and clinical conditions associated with HDAC6.

The function of HDAC6 has been established by previous studies. By searching an EST database for sequences similar to yeast Hda1, followed by screening a cDNA library and PCR, Grozinger et al. (1999) identified cDNAs encoding the class II HDACs HDAC4, HDAC5 (OMIM Ref. No. 605315), and HDAC6. Sequence analysis predicted that the 1,216-amino acid HDAC6 protein consists of an apparent internal dimer containing 2 highly homologous catalytic domains, the first beginning at residue 215 and the second at residue 610. Northern blot analysis detected expression of a 5.0-kb HDAC6 transcript that was highest in heart, liver, kidney, and pancreas. Functional analysis confirmed that HDAC6 possesses deacetylation activity against all 4 core histones and that the 2 catalytic domains function independently. Western blot analysis showed that HDAC6 is expressed as a 131-kD protein that does not coimmunoprecipitate with other HDACs or transcription factors. Grozinger et al. (1999) speculated that HDAC6 may not interact with histones in vivo but may deacetylate other substrates. Hubbert et al. (2002) demonstrated that HDAC6 functions as a tubulin deacetylase. HDAC6 is localized exclusively in the cytoplasm, where it associates with microtubules and localizes with the microtubule motor complex (see OMIM Ref. No. 601143). In vivo the overexpression of HDAC6 led to a global deacetylation of alpha-tubulin, whereas a decrease in HDAC6 increased alpha-tubulin acetylation. In vitro, purified HDAC6 potently deacetylated alpha-tubulin in assembled microtubules. Furthermore, overexpression of HDAC6 promoted chemotactic cell movement, supporting the idea that HDAC6-mediated deacetylation regulates microtubule-dependent cell motility. Hubbert et al. (2002) concluded that HDAC6 is the tubulin deacetylase, and provided evidence that reversible acetylation regulates important biologic processes beyond histone metabolism and gene transcription.

Full details of the abovementioned studies are described in the following publications, the disclosure of which are hereby incorporated by reference:

Grozinger, C. M.; Hassig, C. A.; Schreiber, S. L.: Three proteins define a class of human histone deacetylases related to yeast Hda1p. Proc. Nat. Acad. Sci. 96:4868-4873, 1999; and Hubbert, C.; Guardiola, A.; Shao, R.; Kawaguchi, Y.; Ito, A.; Nixon, A.; Yoshida, M.; Wang, X.-F.; Yao, T.-P.: HDAC6 is a microtubule-associated deacetylase. Nature 417:455-458, 2002.

Further studies establishing the function and utilities of HDAC6 are found in John Hopkins OMIM database record ID 300272, and in cited publications listed in Table 5, which are hereby incorporated by reference. HIP-55 (Accession NM_014063.3) is another GAM146 target gene, herein designated TARGET GENE. HIP-55 BINDING SITE is a target binding site found in the 3' untranslated region of mRNA encoded by HIP-55, corresponding to a target binding site such as BINDING SITE I, BINDING SITE II or BINDING SITE III of FIG. 8. Table 4 illustrates the complementarity of the nucleotide sequences of HIP-55 BINDING SITE, designated SEQ ID:8753, to the nucleotide sequence of GAM146 RNA, herein designated GAM RNA, also designated SEQ ID:370.

Another function of GAM146 is therefore inhibition of HIP-55 (Accession NM_014063.3). Accordingly, utilities of GAM146 include diagnosis, prevention and treatment of diseases and clinical conditions associated with HIP-55.

Insulin-like growth factor binding protein 1 (IGFBP1, Accession NM_000596.1) is another GAM146 target gene, herein designated TARGET GENE. IGFBP1 BINDING SITE is a target binding site found in the 5' untranslated region of mRNA encoded by IGFBP1, corresponding to a target binding site such as BINDING SITE I, BINDING SITE II or BINDING SITE III of FIG. 8. Table 4 illustrates the complementarity of the nucleotide sequences of IGFBP1 BINDING SITE, designated SEQ ID:11301, to the nucleotide sequence of GAM146 RNA, herein designated GAM RNA, also designated SEQ ID:370.

Another function of GAM146 is therefore inhibition of Insulin-like growth factor binding protein 1 (IGFBP1, Accession NM_000596.1), a gene which prolongs the half-life of the igfs and inhibit or stimulate their growth promoting effects on cell culture. Accordingly, utilities of GAM146 include diagnosis, prevention and treatment of diseases and clinical conditions associated with IGFBP1.

The function of IGFBP1 has been established by previous studies. Unlike insulin, both IGF-I (OMIM Ref. No. 147440) and IGF-II (OMIM Ref. No. 147470) circulate in plasma tightly bound to specific binding proteins. Two major forms of IGF-binding proteins have been identified in human plasma, a low molecular weight form and a high molecular weight form. The low molecular weight IGF-binding protein is also known as IGF-BP25 and is synthesized in liver, secretory endometrium and decidua. It binds both IGF-I and IGF-II with high affinity. It may act as a paracrine regulator of cell growth. Brinkman et al. (1988) cloned and sequenced a cDNA encoding a low molecular weight IGF-binding protein from a human placenta cDNA library. Expression of the cDNA encoding what they termed 'IBP-1' in monkey COS cells resulted in the synthesis of a 30-kD protein that binds IGF-I and is immunologically indistinguishable from the IGF-binding protein isolated from amniotic fluid or human serum. Northern blotting analysis demonstrated that expression of the IBP1 gene is limited to placental membranes and fetal liver. The gene was assigned to chromosome 7 by Southern analysis of genomic DNA isolated from human-rodent somatic cell hybrids. Brewer et al. (1988) purified an insulin-like growth factor binding protein from human amniotic fluid and showed that it potentiates the effects of IGF-I in vitro. They used a polyclonal antibody to this protein to isolate a cDNA clone from a human decidua library. They found that the clone encodes a polypeptide of 28,832 daltons that includes sequences of 9 tryptic peptides that had been prepared from the purified protein. The protein has 15 cysteines clustered at the amino and carboxy ends of the molecule. Near its C-terminus the protein has an RGD sequence (arginine-glycine-aspartic acid) which may account for its ability to attach to cells and to potentiate the biologic actions of IGF-I. Brinkman et al. (1988) found that the IBP1 gene has 4 exons and spans 5.9 kb. Alitalo et al. (1989) localized the IBP1 gene to 7p13-p12 by in situ hybridization. Alitalo et al. (1989) described a 2-allele RFLP with allele frequencies that made it useful as a genetic marker for the proximal short arm of chromosome 7. Ekstrand et al. (1990) confirmed this assignment by Southern analysis of somatic hybrid cell DNA and by in situ hybridization. According to Ballard et al. (1990), IGFBP1 is also known as amniotic fluid binding protein (AFBP), placental protein 12, alpha-pregnancy- associated endometrial globulin, growth hormone independent binding protein, binding protein 28, binding protein 26, and binding protein 25. IGFBP1 is elevated in the fetal circulation of human and animal pregnancies complicated by intrauterine growth retardation (IUGR) caused by placental insufficiency and in utero hypoxia and is believed to restrict fetal growth by sequestering IGFs. Popovici et al. (2001) established highly pure primary cultures of human fetal hepatocytes in vitro and investigated the expression of IGFBP1 and the effects of hypoxia on expression of IGFBP1 mRNA and protein. Hepatocytes were cultured in defined medium, and Northern blot analysis revealed expression of a 1.5-kb IGFBP1 mRNA transcript in hepatocytes cultured under normoxic conditions for 24 hours that did not increase in steady-state levels after 48 hours in culture. Under hypoxic conditions, IGFBP1 mRNA expression increased 3- to 4-fold compared with normoxic controls. Western blot analysis of conditioned medium revealed the presence of IGFBP1, IGFBP2 (OMIM Ref. No. 146731), IGFBP3 (OMIM Ref. No. 146732), and IGFBP4 (OMIM Ref. No. 146733). IGFBP1 was the most abundant IGFBP in conditioned medium, and densitometric analysis revealed a 2.5-fold increase in IGFBP1 under hypoxic, compared with normoxic, conditions, supporting the immunoradiometric assay results. A 3-fold increase in IGFBP3 mRNA, but not other IGFBPs, was noted under hypoxic, compared with normoxic, conditions. The authors concluded that hypoxia upregulates fetal hepatocyte IGFBP1 mRNA steady-state levels and protein, with this being the major IGFBP derived from the fetal hepatocyte. These data also supported a role for the fetal liver as a source of elevated circulating levels of IGFBP1 in fetuses with in utero hypoxia and IUGR.

Full details of the abovementioned studies are described in the following publications, the disclosure of which are hereby incorporated by reference:

Alitalo, T.; Kontula, K.; Koistinen, R.; Aalto - Setala, K.; Julkunen, M.; Janne, O. A.; Seppala, M.; de la Chapelle, A.: The gene encoding human low-molecular weight insulin-like growth-factor binding protein (IGF-BP25): regional localization to 7p12-p13 and description of a DNA polymorphism. Hum. Genet. 83:335-338, 1989; and Ballard, F. J.; Baxter, R. C.; Binoux, M.; Clemmons, D. R.; Drop, S. L. S.; Hall, K.; Hintz, R. L.; Rechler, M. M.; Rutanen, E. M.; Schwander, J. C.: Report on the nomenclature of the I.

Further studies establishing the function and utilities of IGFBP1 are found in John Hopkins OMIM database record ID 146730, and in cited publications listed in Table 5, which are hereby incorporated by reference. IL-17RC (Accession NM__153461.1) is another GAM146 target gene, herein designated TARGET GENE. IL-17RC BINDING SITE is a target binding site found in the 5' untranslated region of multiple transcripts of mRNA encoded by IL-17RC, corresponding to a target binding site such as BINDING SITE I, BINDING SITE II or BINDING SITE III of FIG. 8. Table 4 illustrates the complementarity of the nucleotide sequences of IL-17RC BINDING SITE, designated SEQ ID:14135, to the nucleotide sequence of GAM146 RNA, herein designated GAM RNA, also designated SEQ ID:370.

Another function of GAM146 is therefore inhibition of IL-17RC (Accession NM__153461.1). Accordingly, utilities of GAM146 include diagnosis, prevention and treatment of diseases and clinical conditions associated with IL-17RC.

Potassium channel, subfamily k, member 10 (KCNK10, Accession NM__021161.3) is another GAM146 target gene, herein designated TARGET GENE. KCNK10 BINDING SITE is a target binding site found in the 5' untranslated region of multiple transcripts of mRNA encoded by KCNK10, corresponding to a target binding site such as BINDING SITE I, BINDING SITE II or BINDING SITE III of FIG. 8. Table 4 illustrates the complementarity of the nucleotide sequences of KCNK10 BINDING SITE, designated SEQ ID:4467, to the nucleotide sequence of GAM146 RNA, herein designated GAM RNA, also designated SEQ ID:370.

Another function of GAM146 is therefore inhibition of Potassium channel, subfamily k, member 10 (KCNK10, Accession NM__021161.3) . Accordingly, utilities of GAM146 include diagnosis, prevention and treatment of diseases and clinical conditions associated with KCNK10.

KIAA0125 (Accession NM__014792.2) is another GAM146 target gene, herein designated TARGET GENE. KIAA0125 BINDING SITE is a target binding site found in the 5' untranslated region of mRNA encoded by KIAA0125, corresponding to a target binding site such as BINDING SITE I, BINDING SITE II or BINDING SITE III of FIG. 8. Table 4 illustrates the complementarity of the nucleotide sequences of KIAA0125 BINDING SITE, designated SEQ ID:19077, to the nucleotide sequence of GAM146 RNA, herein designated GAM RNA, also designated SEQ ID:370.

Another function of GAM146 is therefore inhibition of KIAA0125 (Accession NM__014792.2). Accordingly, utilities of GAM146 include diagnosis, prevention and treatment of diseases and clinical conditions associated with KIAA0125.

KIAA0232 (Accession XM__291106.1) is another GAM146 target gene, herein designated TARGET GENE. KIAA0232 BINDING SITE is a target binding site found in the 3' untranslated region of mRNA encoded by KIAA0232, corresponding to a target binding site such as BINDING SITE I, BINDING SITE II or BINDING SITE III of FIG. 8. Table 4 illustrates the complementarity of the nucleotide sequences of KIAA0232 BINDING SITE, designated SEQ ID:12123, to the nucleotide sequence of GAM146 RNA, herein designated GAM RNA, also designated SEQ ID:370.

Another function of GAM146 is therefore inhibition of KIAA0232 (Accession XM__291106.1). Accordingly, utilities of GAM146 include diagnosis, prevention and treatment of diseases and clinical conditions associated with KIAA0232.

KIAA0310 (Accession XM__088459.6) is another GAM146 target gene, herein designated TARGET GENE. KIAA0310 BINDING SITE is a target binding site found in the 3' untranslated region of mRNA encoded by KIAA0310, corresponding to a target binding site such as BINDING SITE I, BINDING SITE II or BINDING SITE III of FIG. 8. Table 4 illustrates the complementarity of the nucleotide sequences of KIAA0310 BINDING SITE, designated SEQ ID:9879, to the nucleotide sequence of GAM146 RNA, herein designated GAM RNA, also designated SEQ ID:370.

Another function of GAM146 is therefore inhibition of KIAA0310 (Accession XM__088459.6). Accordingly, utilities of GAM146 include diagnosis, prevention and treatment of diseases and clinical conditions associated with KIAA0310.

KIAA0514 (Accession NM__014696.1) is another GAM146 target gene, herein designated TARGET GENE. KIAA0514 BINDING SITE is a target binding site found in the 3' untranslated region of mRNA encoded by KIAA0514, corresponding to a target binding site such as BINDING SITE I, BINDING SITE II or BINDING SITE III of FIG. 8. Table 4 illustrates the complementarity of the nucleotide sequences of KIAA0514 BINDING SITE, designated SEQ ID:8846, to the nucleotide sequence of GAM146 RNA, herein designated GAM RNA, also designated SEQ ID:370.

Another function of GAM146 is therefore inhibition of KIAA0514 (Accession NM__014696.1). Accordingly, utilities of GAM146 include diagnosis, prevention and treatment of diseases and clinical conditions associated with KIAA0514.

KIAA0561 (Accession XM__038150.2) is another GAM146 target gene, herein designated TARGET GENE. KIAA0561 BINDING SITE is a target binding site found in the 3' untranslated region of mRNA encoded by KIAA0561, corresponding to a target binding site such as BINDING SITE I, BINDING SITE II or BINDING SITE III of FIG. 8. Table 4 illustrates the complementarity of the nucleotide sequences of KIAA0561 BINDING SITE, designated SEQ ID:17026, to the nucleotide sequence of GAM146 RNA, herein designated GAM RNA, also designated SEQ ID:370.

Another function of GAM146 is therefore inhibition of KIAA0561 (Accession XM__038150.2). Accordingly, utilities of GAM146 include diagnosis, prevention and treatment of diseases and clinical conditions associated with KIAA0561.

KIAA0633 (Accession) is another GAM146 target gene, herein designated TARGET GENE. KIAA0633 BINDING SITE is a target binding site found in the 3' untranslated region of mRNA encoded by KIAA0633, corresponding to a target binding site such as BINDING SITE I, BINDING SITE II or BINDING SITE III of FIG. 8. Table 4 illustrates the complementarity of the nucleotide sequences of KIAA0633 BINDING SITE, designated SEQ ID:12019, to the nucleotide sequence of GAM146 RNA, herein designated GAM RNA, also designated SEQ ID:370.

Another function of GAM146 is therefore inhibition of KIAA0633 (Accession). Accordingly, utilities of GAM146 include diagnosis, prevention and treatment of diseases and clinical conditions associated with KIAA0633.

KIAA0800 (Accession NM_014703.1) is another GAM146 target gene, herein designated TARGET GENE. KIAA0800 BINDING SITE is a target binding site found in the 3' untranslated region of mRNA encoded by KIAA0800, corresponding to a target binding site such as BINDING SITE I, BINDING SITE II or BINDING SITE III of FIG. 8. Table 4 illustrates the complementarity of the nucleotide sequences of KIAA0800 BINDING SITE, designated SEQ ID:6315, to the nucleotide sequence of GAM146 RNA, herein designated GAM RNA, also designated SEQ ID:370.

Another function of GAM146 is therefore inhibition of KIAA0800 (Accession NM_014703.1). Accordingly, utilities of GAM146 include diagnosis, prevention and treatment of diseases and clinical conditions associated with KIAA0800.

KIAA1164 (Accession XM_045358.2) is another GAM146 target gene, herein designated TARGET GENE. KIAA1164 BINDING SITE is a target binding site found in the 5' untranslated region of mRNA encoded by KIAA1164, corresponding to a target binding site such as BINDING SITE I, BINDING SITE II or BINDING SITE III of FIG. 8. Table 4 illustrates the complementarity of the nucleotide sequences of KIAA1164 BINDING SITE, designated SEQ ID:11204, to the nucleotide sequence of GAM146 RNA, herein designated GAM RNA, also designated SEQ ID:370.

Another function of GAM146 is therefore inhibition of KIAA1164 (Accession XM_045358.2). Accordingly, utilities of GAM146 include diagnosis, prevention and treatment of diseases and clinical conditions associated with KIAA1164.

KIAA1200 (Accession XM_031054.5) is another GAM146 target gene, herein designated TARGET GENE. KIAA1200 BINDING SITE is a target binding site found in the 3' untranslated region of mRNA encoded by KIAA1200, corresponding to a target binding site such as BINDING SITE I, BINDING SITE II or BINDING SITE III of FIG. 8. Table 4 illustrates the complementarity of the nucleotide sequences of KIAA1200 BINDING SITE, designated SEQ ID:5977, to the nucleotide sequence of GAM146 RNA, herein designated GAM RNA, also designated SEQ ID:370.

Another function of GAM146 is therefore inhibition of KIAA1200 (Accession XM_031054.5). Accordingly, utilities of GAM146 include diagnosis, prevention and treatment of diseases and clinical conditions associated with KIAA1200.

KIAA1530 (Accession XM_042661.5) is another GAM146 target gene, herein designated TARGET GENE. KIAA1530 BINDING SITE is a target binding site found in the 3' untranslated region of mRNA encoded by KIAA1530, corresponding to a target binding site such as BINDING SITE I, BINDING SITE II or BINDING SITE III of FIG. 8. Table 4 illustrates the complementarity of the nucleotide sequences of KIAA1530 BINDING SITE, designated SEQ ID:5181, to the nucleotide sequence of GAM146 RNA, herein designated GAM RNA, also designated SEQ ID:370.

Another function of GAM146 is therefore inhibition of KIAA1530 (Accession XM_042661.5). Accordingly, utilities of GAM146 include diagnosis, prevention and treatment of diseases and clinical conditions associated with KIAA1530.

Legumain (LGMN, Accession NM_005606.3) is another GAM146 target gene, herein designated TARGET GENE. LGMN BINDING SITE is a target binding site found in the 5' untranslated region of mRNA encoded by LGMN, corresponding to a target binding site such as BINDING SITE I, BINDING SITE II or BINDING SITE III of FIG. 8. Table 4 illustrates the complementarity of the nucleotide sequences of LGMN BINDING SITE, designated SEQ ID:12719, to the nucleotide sequence of GAM146 RNA, herein designated GAM RNA, also designated SEQ ID:370.

Another function of GAM146 is therefore inhibition of Legumain (LGMN, Accession NM_005606.3). Accordingly, utilities of GAM146 include diagnosis, prevention and treatment of diseases and clinical conditions associated with LGMN.

LGP1 (Accession NM_032484.2) is another GAM146 target gene, herein designated TARGET GENE. LGP1 BINDING SITE is a target binding site found in the 3' untranslated region of mRNA encoded by LGP1, corresponding to a target binding site such as BINDING SITE I, BINDING SITE II or BINDING SITE III of FIG. 8. Table 4 illustrates the complementarity of the nucleotide sequences of LGP1 BINDING SITE, designated SEQ ID:15097, to the nucleotide sequence of GAM146 RNA, herein designated GAM RNA, also designated SEQ ID:370.

Another function of GAM146 is therefore inhibition of LGP1 (Accession NM_032484.2). Accordingly, utilities of GAM146 include diagnosis, prevention and treatment of diseases and clinical conditions associated with LGP1.

LOC115265 (Accession NM_145244.1) is another GAM146 target gene, herein designated TARGET GENE. LOC115265 BINDING SITE is a target binding site found in the 3' untranslated region of mRNA encoded by LOC115265, corresponding to a target binding site such as BINDING SITE I, BINDING SITE II or BINDING SITE III of FIG. 8. Table 4 illustrates the complementarity of the nucleotide sequences of LOC115265 BINDING SITE, designated SEQ ID:18602, to the nucleotide sequence of GAM146 RNA, herein designated GAM RNA, also designated SEQ ID:370.

Another function of GAM146 is therefore inhibition of LOC115265 (Accession NM_145244.1). Accordingly, utilities of GAM146 include diagnosis, prevention and treatment of diseases and clinical conditions associated with LOC115265.

LOC118786 (Accession) is another GAM146 target gene, herein designated TARGET GENE. LOC118786 BINDING SITE is a target binding site found in the 5' untranslated region of mRNA encoded by LOC118786, corresponding to a target binding site such as BINDING SITE I, BINDING SITE II or BINDING SITE III of FIG. 8. Table 4 illustrates the complementarity of the nucleotide sequences of LOC118786 BINDING SITE, designated SEQ ID:9073, to the nucleotide sequence of GAM146 RNA, herein designated GAM RNA, also designated SEQ ID:370.

Another function of GAM146 is therefore inhibition of LOC118786 (Accession). Accordingly, utilities of GAM146 include diagnosis, prevention and treatment of diseases and clinical conditions associated with LOC118786.

LOC123792 (Accession) is another GAM146 target gene, herein designated TARGET GENE. LOC123792 BINDING SITE is a target binding site found in the 3' untranslated region of mRNA encoded by LOC123792, corresponding to a target binding site such as BINDING SITE I, BINDING SITE II or BINDING SITE III of FIG. 8. Table 4 illustrates the complementarity of the nucleotide sequences of LOC123792 BINDING SITE, designated SEQ ID:13791, to the nucleotide sequence of GAM146 RNA, herein designated GAM RNA, also designated SEQ ID:370.

Another function of GAM146 is therefore inhibition of LOC123792 (Accession). Accordingly, utilities of GAM146 include diagnosis, prevention and treatment of diseases and clinical conditions associated with LOC123792.

LOC126755 (Accession XM_059074.1) is another GAM146 target gene, herein designated TARGET GENE. LOC126755 BINDING SITE is a target binding site found in the 3' untranslated region of mRNA encoded by LOC126755, corresponding to a target binding site such as BINDING SITE I, BINDING SITE II or BINDING SITE III of FIG. 8. Table 4 illustrates the complementarity of the nucleotide sequences of LOC126755 BINDING SITE, designated SEQ ID:3954, to the nucleotide sequence of GAM146 RNA, herein designated GAM RNA, also designated SEQ ID:370.

Another function of GAM146 is therefore inhibition of LOC126755 (Accession XM_059074.1). Accordingly, utilities of GAM146 include diagnosis, prevention and treatment of diseases and clinical conditions associated with LOC126755.

LOC131827 (Accession) is another GAM146 target gene, herein designated TARGET GENE. LOC131827 BINDING SITE is a target binding site found in the 3' untranslated region of mRNA encoded by LOC131827, corresponding to a target binding site such as BINDING SITE I, BINDING SITE II or BINDING SITE III of FIG. 8. Table 4 illustrates the complementarity of the nucleotide sequences of LOC131827 BINDING SITE, designated SEQ ID:15001, to the nucleotide sequence of GAM146 RNA, herein designated GAM RNA, also designated SEQ ID:370.

Another function of GAM146 is therefore inhibition of LOC131827 (Accession). Accordingly, utilities of GAM146 include diagnosis, prevention and treatment of diseases and clinical conditions associated with LOC131827.

LOC136337 (Accession XM_072456.3) is another GAM146 target gene, herein designated TARGET GENE. LOC136337 BINDING SITE is a target binding site found in the 3' untranslated region of mRNA encoded by LOC136337, corresponding to a target binding site such as BINDING SITE I, BINDING SITE II or BINDING SITE III of FIG. 8. Table 4 illustrates the complementarity of the nucleotide sequences of LOC136337 BINDING SITE, designated SEQ ID:8085, to the nucleotide sequence of GAM146 RNA, herein designated GAM RNA, also designated SEQ ID:370.

Another function of GAM146 is therefore inhibition of LOC136337 (Accession XM_072456.3). Accordingly, utilities of GAM146 include diagnosis, prevention and treatment of diseases and clinical conditions associated with LOC136337.

LOC145813 (Accession XM_096873.2) is another GAM146 target gene, herein designated TARGET GENE. LOC145813 BINDING SITE is a target binding site found in the 3' untranslated region of mRNA encoded by LOC145813, corresponding to a target binding site such as BINDING SITE I, BINDING SITE II or BINDING SITE III of FIG. 8. Table 4 illustrates the complementarity of the nucleotide sequences of LOC145813 BINDING SITE, designated SEQ ID:2375, to the nucleotide sequence of GAM146 RNA, herein designated GAM RNA, also designated SEQ ID:370.

Another function of GAM146 is therefore inhibition of LOC145813 (Accession XM_096873.2). Accordingly, utilities of GAM146 include diagnosis, prevention and treatment of diseases and clinical conditions associated with LOC145813.

LOC146506 (Accession XM_085489.1) is another GAM146 target gene, herein designated TARGET GENE. LOC146506 BINDING SITE is a target binding site found in the 3' untranslated region of mRNA encoded by LOC146506, corresponding to a target binding site such as BINDING SITE I, BINDING SITE II or BINDING SITE III of FIG. 8. Table 4 illustrates the complementarity of the nucleotide sequences of LOC146506 BINDING SITE, designated SEQ ID:13559, to the nucleotide sequence of GAM146 RNA, herein designated GAM RNA, also designated SEQ ID:370.

Another function of GAM146 is therefore inhibition of LOC146506 (Accession XM_085489.1). Accordingly, utilities of GAM146 include diagnosis, prevention and treatment of diseases and clinical conditions associated with LOC146506.

LOC146953 (Accession XM_085659.3) is another GAM146 target gene, herein designated TARGET GENE. LOC146953 BINDING SITE is a target binding site found in the 5' untranslated region of mRNA encoded by LOC146953, corresponding to a target binding site such as BINDING SITE I, BINDING SITE II or BINDING SITE III of FIG. 8. Table 4 illustrates the complementarity of the nucleotide sequences of LOC146953 BINDING SITE, designated SEQ ID:3124, to the nucleotide sequence of GAM146 RNA, herein designated GAM RNA, also designated SEQ ID:370.

Another function of GAM146 is therefore inhibition of LOC146953 (Accession XM_085659.3). Accordingly, utilities of GAM146 include diagnosis, prevention and treatment of diseases and clinical conditions associated with LOC146953.

LOC147990 (Accession) is another GAM146 target gene, herein designated TARGET GENE. LOC147990 BINDING SITE is a target binding site found in the 3' untranslated region of mRNA encoded by LOC147990, corresponding to a target binding site such as BINDING SITE I, BINDING SITE II or BINDING SITE III of FIG. 8. Table 4 illustrates the complementarity of the nucleotide sequences of LOC147990 BINDING SITE, designated SEQ ID:12124, to the nucleotide sequence of GAM146 RNA, herein designated GAM RNA, also designated SEQ ID:370.

Another function of GAM146 is therefore inhibition of LOC147990 (Accession). Accordingly, utilities of GAM146 include diagnosis, prevention and treatment of diseases and clinical conditions associated with LOC147990.

LOC148870 (Accession) is another GAM146 target gene, herein designated TARGET GENE. LOC148870 BINDING SITE is a target binding site found in the 5' untranslated region of mRNA encoded by LOC148870, corresponding to a target binding site such as BINDING SITE I, BINDING SITE II or BINDING SITE III of FIG. 8. Table 4 illustrates the complementarity of the nucleotide sequences of LOC148870 BINDING SITE, designated SEQ ID:10650, to the nucleotide sequence of GAM146 RNA, herein designated GAM RNA, also designated SEQ ID:370.

Another function of GAM146 is therefore inhibition of LOC148870 (Accession). Accordingly, utilities of GAM146 include diagnosis, prevention and treatment of diseases and clinical conditions associated with LOC148870.

LOC149606 (Accession XM_086600.1) is another GAM146 target gene, herein designated TARGET GENE. LOC149606 BINDING SITE is a target binding site found in the 3' untranslated region of mRNA encoded by LOC149606, corresponding to a target binding site such as BINDING SITE I, BINDING SITE II or BINDING SITE III of FIG. 8. Table 4 illustrates the complementarity of the nucleotide sequences of LOC149606 BINDING SITE, designated SEQ ID:17892, to the nucleotide sequence of GAM146 RNA, herein designated GAM RNA, also designated SEQ ID:370.

Another function of GAM146 is therefore inhibition of LOC149606 (Accession XM_086600.1). Accordingly, utilities of GAM146 include diagnosis, prevention and treatment of diseases and clinical conditions associated with LOC149606.

LOC150279 (Accession XM_086820.2) is another GAM146 target gene, herein designated TARGET GENE. LOC150279 BINDING SITE is a target binding site found in the 3' untranslated region of mRNA encoded by LOC150279, corresponding to a target binding site such as BINDING SITE I, BINDING SITE II or BINDING SITE III of FIG. 8. Table 4 illustrates the complementarity of the nucleotide sequences of LOC150279 BINDING SITE, designated SEQ ID:1553, to the nucleotide sequence of GAM146 RNA, herein designated GAM RNA, also designated SEQ ID:370.

Another function of GAM146 is therefore inhibition of LOC150279 (Accession XM_086820.2). Accordingly, utilities of GAM146 include diagnosis, prevention and treatment of diseases and clinical conditions associated with LOC150279.

LOC151438 (Accession XM_098060.1) is another GAM146 target gene, herein designated TARGET GENE. LOC151438 BINDING SITE is a target binding site found in the 3' untranslated region of mRNA encoded by LOC151438, corresponding to a target binding site such as BINDING SITE I, BINDING SITE II or BINDING SITE III of FIG. 8. Table 4 illustrates the complementarity of the nucleotide sequences of LOC151438 BINDING SITE, designated SEQ ID:10705, to the nucleotide sequence of GAM146 RNA, herein designated GAM RNA, also designated SEQ ID:370.

Another function of GAM146 is therefore inhibition of LOC151438 (Accession XM_098060.1). Accordingly, utilities of GAM146 include diagnosis, prevention and treatment of diseases and clinical conditions associated with LOC151438.

LOC151657 (Accession XM_098100.6) is another GAM146 target gene, herein designated TARGET GENE. LOC151657 BINDING SITE is a target binding site found in the 3' untranslated region of mRNA encoded by LOC151657, corresponding to a target binding site such as BINDING SITE I, BINDING SITE II or BINDING SITE III of FIG. 8. Table 4 illustrates the complementarity of the nucleotide sequences of LOC151657 BINDING SITE, designated SEQ ID:8780, to the nucleotide sequence of GAM146 RNA, herein designated GAM RNA, also designated SEQ ID:370.

Another function of GAM146 is therefore inhibition of LOC151657 (Accession XM_098100.6). Accordingly, utilities of GAM146 include diagnosis, prevention and treatment of diseases and clinical conditions associated with LOC151657.

LOC152845 (Accession XM_016366.2) is another GAM146 target gene, herein designated TARGET GENE. LOC152845 BINDING SITE is a target binding site found in the 5' untranslated region of mRNA encoded by LOC152845, corresponding to a target binding site such as BINDING SITE I, BINDING SITE II or BINDING SITE III of FIG. 8. Table 4 illustrates the complementarity of the nucleotide sequences of LOC152845 BINDING SITE, designated SEQ ID:2714, to the nucleotide sequence of GAM146 RNA, herein designated GAM RNA, also designated SEQ ID:370.

Another function of GAM146 is therefore inhibition of LOC152845 (Accession XM_016366.2). Accordingly, utilities of GAM146 include diagnosis, prevention and treatment of diseases and clinical conditions associated with LOC152845.

LOC157507 (Accession) is another GAM146 target gene, herein designated TARGET GENE. LOC157507 BINDING SITE is a target binding site found in the 5' untranslated region of mRNA encoded by LOC157507, corresponding to a target binding site such as BINDING SITE I, BINDING SITE II or BINDING SITE III of FIG. 8. Table 4 illustrates the complementarity of the nucleotide sequences of LOC157507 BINDING SITE, designated SEQ ID:17300, to the nucleotide sequence of GAM146 RNA, herein designated GAM RNA, also designated SEQ ID:370.

Another function of GAM146 is therefore inhibition of LOC157507 (Accession). Accordingly, utilities of GAM146 include diagnosis, prevention and treatment of diseases and clinical conditions associated with LOC157507.

LOC158056 (Accession) is another GAM146 target gene, herein designated TARGET GENE. LOC158056 BINDING SITE is a target binding site found in the 5' untranslated region of mRNA encoded by LOC158056, corresponding to a target binding site such as BINDING SITE I, BINDING SITE II or BINDING SITE III of FIG. 8. Table 4 illustrates the complementarity of the nucleotide sequences of LOC158056 BINDING SITE, designated SEQ ID:10700, to the nucleotide sequence of GAM146 RNA, herein designated GAM RNA, also designated SEQ ID:370.

Another function of GAM146 is therefore inhibition of LOC158056 (Accession). Accordingly, utilities of GAM146 include diagnosis, prevention and treatment of diseases and clinical conditions associated with LOC158056.

LOC158295 (Accession) is another GAM146 target gene, herein designated TARGET GENE. LOC158295 BINDING SITE is a target binding site found in the 5' untranslated region of mRNA encoded by LOC158295, corresponding to a target binding site such as BINDING SITE I, BINDING SITE II or BINDING SITE III of FIG. 8. Table 4 illustrates the complementarity of the nucleotide sequences of LOC158295 BINDING SITE, designated SEQ ID:5627, to the nucleotide sequence of GAM146 RNA, herein designated GAM RNA, also designated SEQ ID:370.

Another function of GAM146 is therefore inhibition of LOC158295 (Accession). Accordingly, utilities of GAM146 include diagnosis, prevention and treatment of diseases and clinical conditions associated with LOC158295.

LOC166206 (Accession) is another GAM146 target gene, herein designated TARGET GENE. LOC166206 BINDING SITE is a target binding site found in the 3' untranslated region of mRNA encoded by LOC166206, corresponding to a target binding site such as BINDING SITE I, BINDING SITE II or BINDING SITE III of FIG. 8. Table 4 illustrates the complementarity of the nucleotide sequences of LOC166206 BINDING SITE, designated SEQ ID:4968, to the nucleotide sequence of GAM146 RNA, herein designated GAM RNA, also designated SEQ ID:370.

Another function of GAM146 is therefore inhibition of LOC166206 (Accession). Accordingly, utilities of GAM146 include diagnosis, prevention and treatment of diseases and clinical conditions associated with LOC166206.

LOC196047 (Accession) is another GAM146 target gene, herein designated TARGET GENE. LOC196047 BINDING SITE is a target binding site found in the 3' untranslated region of mRNA encoded by LOC196047, corresponding to a target binding site such as BINDING SITE I, BINDING SITE II or BINDING SITE III of FIG. 8. Table 4 illustrates the complementarity of the nucleotide sequences of LOC196047 BINDING SITE, designated SEQ ID:10514, to the nucleotide sequence of GAM146 RNA, herein designated GAM RNA, also designated SEQ ID:370.

Another function of GAM146 is therefore inhibition of LOC196047 (Accession). Accordingly, utilities of GAM146 include diagnosis, prevention and treatment of diseases and clinical conditions associated with LOC196047.

LOC204084 (Accession) is another GAM146 target gene, herein designated TARGET GENE. LOC204084 BINDING SITE is a target binding site found in the 5' untranslated region of mRNA encoded by LOC204084, corresponding to a target binding site such as BINDING SITE I, BINDING SITE II or BINDING SITE III of FIG. 8. Table 4 illustrates the complementarity of the nucleotide sequences of LOC204084 BINDING SITE, designated SEQ ID:15967, to the nucleotide sequence of GAM146 RNA, herein designated GAM RNA, also designated SEQ ID:370.

Another function of GAM146 is therefore inhibition of LOC204084 (Accession). Accordingly, utilities of GAM146 include diagnosis, prevention and treatment of diseases and clinical conditions associated with LOC204084.

LOC204275 (Accession XM_115290.3) is another GAM146 target gene, herein designated TARGET GENE. LOC204275 BINDING SITE is a target binding site found in the 3' untranslated region of mRNA encoded by LOC204275, corresponding to a target binding site such as BINDING SITE I, BINDING SITE II or BINDING SITE III of FIG. 8. Table 4 illustrates the complementarity of the nucleotide sequences of LOC204275 BINDING SITE, designated SEQ ID:2816, to the nucleotide sequence of GAM146 RNA, herein designated GAM RNA, also designated SEQ ID:370.

Another function of GAM146 is therefore inhibition of LOC204275 (Accession XM_115290.3). Accordingly, utilities of GAM146 include diagnosis, prevention and treatment of diseases and clinical conditions associated with LOC204275.

LOC221486 (Accession) is another GAM146 target gene, herein designated TARGET GENE. LOC221486 BINDING SITE is a target binding site found in the 3' untranslated region of mRNA encoded by LOC221486, corresponding to a target binding site such as BINDING SITE I, BINDING SITE II or BINDING SITE III of FIG. 8. Table 4 illustrates the complementarity of the nucleotide sequences of LOC221486 BINDING SITE, designated SEQ ID:10719, to the nucleotide sequence of GAM146 RNA, herein designated GAM RNA, also designated SEQ ID:370.

Another function of GAM146 is therefore inhibition of LOC221486 (Accession). Accordingly, utilities of GAM146 include diagnosis, prevention and treatment of diseases and clinical conditions associated with LOC221486.

LOC254808 (Accession XM_173100.1) is another GAM146 target gene, herein designated TARGET GENE. LOC254808 BINDING SITE is a target binding site found in the 5' untranslated region of mRNA encoded by LOC254808, corresponding to a target binding site such as BINDING SITE I, BINDING SITE II or BINDING SITE III of FIG. 8. Table 4 illustrates the complementarity of the nucleotide sequences of LOC254808 BINDING SITE, designated SEQ ID:19184, to the nucleotide sequence of GAM146 RNA, herein designated GAM RNA, also designated SEQ ID:370.

Another function of GAM146 is therefore inhibition of LOC254808 (Accession XM_173100.1). Accordingly, utilities of GAM146 include diagnosis, prevention and treatment of diseases and clinical conditions associated with LOC254808.

LOC257109 (Accession) is another GAM146 target gene, herein designated TARGET GENE. LOC257109 BINDING SITE is a target binding site found in the 3' untranslated region of mRNA encoded by LOC257109, corresponding to a target binding site such as BINDING SITE I, BINDING SITE II or BINDING SITE III of FIG. 8. Table 4 illustrates the complementarity of the nucleotide sequences of LOC257109 BINDING SITE, designated SEQ ID:7095, to the nucleotide sequence of GAM146 RNA, herein designated GAM RNA, also designated SEQ ID:370.

Another function of GAM146 is therefore inhibition of LOC257109 (Accession). Accordingly, utilities of GAM146 include diagnosis, prevention and treatment of diseases and clinical conditions associated with LOC257109.

LOC257235 (Accession XM_173124.1) is another GAM146 target gene, herein designated TARGET GENE. LOC257235 BINDING SITE is a target binding site found in the 3' untranslated region of mRNA encoded by LOC257235, corresponding to a target binding site such as BINDING SITE I, BINDING SITE II or BINDING SITE III of FIG. 8. Table 4 illustrates the complementarity of the nucleotide sequences of LOC257235 BINDING SITE, designated SEQ ID:1513, to the nucleotide sequence of GAM146 RNA, herein designated GAM RNA, also designated SEQ ID:370.

Another function of GAM146 is therefore inhibition of LOC257235 (Accession XM_173124.1). Accordingly, utilities of GAM146 include diagnosis, prevention and treatment of diseases and clinical conditions associated with LOC257235.

LOC90701 (Accession NM_033280.1) is another GAM146 target gene, herein designated TARGET GENE. LOC90701 BINDING SITE is a target binding site found in the 5' untranslated region of mRNA encoded by LOC90701, corresponding to a target binding site such as BINDING SITE I, BINDING SITE II or BINDING SITE III of FIG. 8. Table 4 illustrates the complementarity of the nucleotide sequences of LOC90701 BINDING SITE, designated SEQ ID:17610, to the nucleotide sequence of GAM146 RNA, herein designated GAM RNA, also designated SEQ ID:370.

Another function of GAM146 is therefore inhibition of LOC90701 (Accession NM_033280.1). Accordingly, utilities of GAM146 include diagnosis, prevention and treatment of diseases and clinical conditions associated with LOC90701.

LOC92249 (Accession XM_043814.2) is another GAM146 target gene, herein designated TARGET GENE. LOC92249 BINDING SITE is a target binding site found in the 5' untranslated region of mRNA encoded by LOC92249, corresponding to a target binding site such as BINDING SITE I, BINDING SITE II or BINDING SITE III of FIG. 8. Table 4 illustrates the complementarity of the nucleotide sequences of LOC92249 BINDING SITE, designated SEQ ID:19858, to the nucleotide sequence of GAM146 RNA, herein designated GAM RNA, also designated SEQ ID:370.

Another function of GAM146 is therefore inhibition of LOC92249 (Accession XM_043814.2). Accordingly, utilities of GAM146 include diagnosis, prevention and treatment of diseases and clinical conditions associated with LOC92249.

MGC10500 (Accession NM_031477.2) is another GAM146 target gene, herein designated TARGET GENE. MGC10500 BINDING SITE is a target binding site found in the 3' untranslated region of mRNA encoded by MGC10500, corresponding to a target binding site such as BINDING SITE I, BINDING SITE II or BINDING SITE III of FIG. 8. Table 4 illustrates the complementarity of the nucleotide sequences of MGC10500 BINDING SITE, designated SEQ ID:17215, to the nucleotide sequence of GAM146 RNA, herein designated GAM RNA, also designated SEQ ID:370.

Another function of GAM146 is therefore inhibition of MGC10500 (Accession NM_031477.2). Accordingly, utilities of GAM146 include diagnosis, prevention and treatment of diseases and clinical conditions associated with MGC10500.

moblak (Accession NM_130807.1) is another GAM146 target gene, herein designated TARGET GENE. moblak BINDING SITE is a target binding site found in the 3' untranslated region of mRNA encoded by moblak, corresponding to a target binding site such as BINDING SITE I, BINDING SITE II or BINDING SITE III of FIG. 8. Table 4 illustrates the complementarity of the nucleotide sequences of moblak BINDING SITE, designated SEQ ID:11256, to the nucleotide sequence of GAM146 RNA, herein designated GAM RNA, also designated SEQ ID:370.

Another function of GAM146 is therefore inhibition of moblak (Accession NM_130807.1). Accordingly, utilities of GAM146 include diagnosis, prevention and treatment of diseases and clinical conditions associated with moblak.

Npc1 (niemann-pick disease, type c1, gene)-like 1 (NPC1L1, Accession NM_013389.1) is another GAM146 target gene, herein designated TARGET GENE. NPC1L1 BINDING SITE is a target binding site found in the 3' untranslated region of mRNA encoded by NPC1L1, corresponding to a target binding site such as BINDING SITE I, BINDING SITE II or BINDING SITE III of FIG. 8. Table 4 illustrates the complementarity of the nucleotide sequences of NPC1L1 BINDING SITE, designated SEQ ID:13102, to the nucleotide sequence of GAM146 RNA, herein designated GAM RNA, also designated SEQ ID:370.

Another function of GAM146 is therefore inhibition of Npc1 (niemann-pick disease, type c1, gene)-like 1 (NPC1L1, Accession NM_013389.1). Accordingly, utilities of GAM146 include diagnosis, prevention and treatment of diseases and clinical conditions associated with NPC1L1.

Protein disulfide isomerase, pancreatic (PDIP, Accession NM_006849.1) is another GAM146 target gene, herein designated TARGET GENE. PDIP BINDING SITE is a target binding site found in the 3' untranslated region of mRNA encoded by PDIP, corresponding to a target binding site such as BINDING SITE I, BINDING SITE II or BINDING SITE III of FIG. 8. Table 4 illustrates the complementarity of the nucleotide sequences of PDIP BINDING SITE, designated SEQ ID:13937, to the nucleotide sequence of GAM146 RNA, herein designated GAM RNA, also designated SEQ ID:370.

Another function of GAM146 is therefore inhibition of Protein disulfide isomerase, pancreatic (PDIP, Accession NM_006849.1). Accordingly, utilities of GAM146 include diagnosis, prevention and treatment of diseases and clinical conditions associated with PDIP.

Pdz domain containing 2 (PDZD2, Accession) is another GAM146 target gene, herein designated TARGET GENE. PDZD2 BINDING SITE is a target binding site found in the 5' untranslated region of mRNA encoded by PDZD2, corresponding to a target binding site such as BINDING SITE I, BINDING SITE II or BINDING SITE III of FIG. 8. Table 4 illustrates the complementarity of the nucleotide sequences of PDZD2 BINDING SITE, designated SEQ ID:18141, to the nucleotide sequence of GAM146 RNA, herein designated GAM RNA, also designated SEQ ID:370.

Another function of GAM146 is therefore inhibition of Pdz domain containing 2 (PDZD2, Accession). Accordingly, utilities of GAM146 include diagnosis, prevention and treatment of diseases and clinical conditions associated with PDZD2.

Pleiomorphic adenoma gene 1 (PLAG1, Accession NM_002655.1) is another GAM146 target gene, herein designated TARGET GENE. PLAG1 BINDING SITE is a target binding site found in the 5' untranslated region of mRNA encoded by PLAG1, corresponding to a target binding site such as BINDING SITE I, BINDING SITE II or BINDING SITE III of FIG. 8. Table 4 illustrates the complementarity of the nucleotide sequences of PLAG1 BINDING SITE, designated SEQ ID:18558, to the nucleotide sequence of GAM146 RNA, herein designated GAM RNA, also designated SEQ ID:370.

Another function of GAM146 is therefore inhibition of Pleiomorphic adenoma gene 1 (PLAG1, Accession NM_002655.1), a gene which contains a zinc finger domain. Accordingly, utilities of GAM146 include diagnosis, prevention and treatment of diseases and clinical conditions associated with PLAG1.

The function of PLAG1 and its association with various diseases and clinical conditions, has been established by previous studies, as described hereinabove with reference to GAM47.1. Protein phosphatase 1, regulatory (inhibitor) subunit 13b (PPP1R13B, Accession NM_015316.1) is another GAM146 target gene, herein designated TARGET GENE. PPP1R13B BINDING SITE is a target binding site found in the 3' untranslated region of mRNA encoded by PPP1R13B, corresponding to a target binding site such as BINDING SITE I, BINDING SITE II or BINDING SITE III of FIG. 8. Table 4 illustrates the complementarity of the nucleotide sequences of PPP1R13B BINDING SITE, designated SEQ ID:4491, to the nucleotide sequence of GAM146 RNA, herein designated GAM RNA, also designated SEQ ID:370.

Another function of GAM146 is therefore inhibition of Protein phosphatase 1, regulatory (inhibitor) subunit 13b (PPP1R13B, Accession NM_015316.1). Accordingly, utilities of GAM146 include diagnosis, prevention and treatment of diseases and clinical conditions associated with PPP1R13B.

Regulator of g-protein signalling 3 (RGS3, Accession NM_144488.1) is another GAM146 target gene, herein designated TARGET GENE. RGS3 BINDING SITE is a target binding site found in the 5' untranslated region of multiple transcripts of mRNA encoded by RGS3, corresponding to a target binding site such as BINDING SITE I, BINDING SITE II or BINDING SITE III of FIG. 8. Table 4 illustrates the complementarity of the nucleotide sequences of RGS3 BINDING SITE, designated SEQ ID:18411, to the nucleotide sequence of GAM146 RNA, herein designated GAM RNA, also designated SEQ ID:370.

Another function of GAM146 is therefore inhibition of Regulator of g-protein signalling 3 (RGS3, Accession NM_144488.1), a gene which negatively regulates G protein-coupled receptor signalling. Accordingly, utilities of GAM146 include diagnosis, prevention and treatment of diseases and clinical conditions associated with RGS3.

The function of RGS3 has been established by previous studies. Chatterjee et al. (1997) stated that 17 mammalian RGS members had been identified by cloning or by comparison to expressed sequence tags (ESTs). They studied RGS3, the largest member of the RGS family to date. They found that the coding region of the human RGS3 gene spans 14.7 kb and contains 6 exons; the 5-prime untranslated region spans 3.2 kb and contains 2 exons. The RGS domain, conserved among all RGS proteins, is encoded by 3 exons, while the unique N-terminal domain of RGS3 is encoded by a single exon.

Comparison of the locations of the intron-exon boundaries of the human RGS3 gene to those of the human RGS2 gene revealed a remarkable similarity. Using 5-prime- RACE analysis, they mapped the transcription start site 517 bp upstream of the translation start site. Many potential regulatory elements were identified in the 5-prime flanking region. By screening a mouse embryonic cDNA library using the yeast 2-hybrid system with the cytoplasmic domain of ephrin-B2 (EFNB2; 600527) as bait, Lu et al. (2001) isolated cDNAs encoding a cytoplasmic protein they designated Pdz-Rgs3. Pdz-Rgs3 binds ephrin-B2 through a PDZ domain, and it has an RGS domain. The human homolog of Pdz-Rgs3, RGS3, had been described as a shorter sequence (Druey et al., 1996). Pdz- Rgs3 can mediate signaling from the ephrin-B cytoplasmic tail. The authors showed that SDF1 (OMIM Ref. No. 600835), a chemokine with a G protein- coupled receptor, and BDNF (OMIM Ref. No. 113505) are chemoattractants for cerebellar granule cells, and that SDF1 chemoattraction is selectively inhibited by soluble ephrin-B receptor (see OMIM Ref. No. 602757). This inhibition could be blocked by a truncated Pdz-Rgs3 protein lacking the RGS domain.

Full details of the abovementioned studies are described in the following publications, the disclosure of which are hereby incorporated by reference:

Druey, K. M.; Blumer, K. J.; Kang, V. H.; Kehrl, J. H.: Inhibition of G-protein- mediated MAP kinase activation by a new mammalian gene family. Nature 379:742-746, 1996; and Chatterjee, T. K.; Eapen, A.; Kanis, A. B.; Fisher, R. A.: Genomic organization, 5-prime-flanking region, and chromosomal localization of the human RGS3 gene. Genomics 45:429-433, 1997.

Further studies establishing the function and utilities of RGS3 are found in John Hopkins OMIM database record ID 602189, and in cited publications listed in Table 5, which are hereby incorporated by reference. Ring finger protein 2 (RNF2, Accession NM_007212.1) is another GAM146 target gene, herein designated TARGET GENE. RNF2 BINDING SITE is a target binding site found in the 3' untranslated region of mRNA encoded by RNF2, corresponding to a target binding site such as BINDING SITE I, BINDING SITE II or BINDING SITE III of FIG. 8. Table 4 illustrates the complementarity of the nucleotide sequences of RNF2 BINDING SITE, designated SEQ ID:16379, to the nucleotide sequence of GAM146 RNA, herein designated GAM RNA, also designated SEQ ID:370.

Another function of GAM146 is therefore inhibition of Ring finger protein 2 (RNF2, Accession NM_007212.1). Accordingly, utilities of GAM146 include diagnosis, prevention and treatment of diseases and clinical conditions associated with RNF2.

Retinoid x receptor, alpha (RXRA, Accession NM_002957.3) is another GAM146 target gene, herein designated TARGET GENE. RXRA BINDING SITE is a target binding site found in the 3' untranslated region of mRNA encoded by RXRA, corresponding to a target binding site such as BINDING SITE I, BINDING SITE II or BINDING SITE III of FIG. 8. Table 4 illustrates the complementarity of the nucleotide sequences of RXRA BINDING SITE, designated SEQ ID:11770, to the nucleotide sequence of GAM146 RNA, herein designated GAM RNA, also designated SEQ ID:370.

Another function of GAM146 is therefore inhibition of Retinoid x receptor, alpha (RXRA, Accession NM_002957.3), a gene which activates genes required for vitamin A metabolism, binds 9-cis retinoic acid. Accordingly, utilities of GAM146 include diagnosis, prevention and treatment of diseases and clinical conditions associated with RXRA.

The function of RXRA has been established by previous studies. Retinoic acid has been implicated in many aspects of vertebrate development and homeostasis. Its effects are mediated by specific nuclear receptor proteins that are members of the steroid and thyroid hormone receptor superfamily of transcriptional regulators. In addition to the high affinity retinoic acid receptors termed alpha (RARA; 180240), beta (RARB; 180220), and gamma (RARG; 180190), Mangelsdorf et al. (1990, 1991) identified a distinct nuclear receptor referred to as retinoid X receptor alpha. This receptor differs from the other 3 RARs within the ligand-binding domain and is incapable of high affinity binding of retinoic acid itself. The retinoic acid, thyroid hormone, and vitamin D receptors, as well as the retinoid X receptor, activate transcription from response elements containing 2 or more degenerate copies of the consensus motif AGGTCA. Heyman et al. (1992) presented evidence that 9-cis retinoic acid is a high affinity ligand for RXRA. McNamara et al. (2001) reported a hormone-dependent interaction of the nuclear receptors RARA and RXRA with CLOCK (OMIM Ref. No. 601851) and MOP4 (OMIM Ref. No. 603347). They found that these interactions negatively regulate CLOCK-BMAL1 (OMIM Ref. No. 602550) and MOP4-BMAL1 heterodimer-mediated transcriptional activation of clock gene expression in vascular cells. MOP4 exhibited a robust rhythm in the vasculature, and retinoic acid could phase shift PER2 (OMIM Ref. No. 603426) mRNA rhythmicity in vivo and in serum-induced smooth muscle cells in vitro, providing a molecular mechanism for hormonal control of clock gene expression. McNamara et al. (2001) proposed that circadian or periodic availability of nuclear hormones may play a critical role in resetting a peripheral vascular clock. Using RFLVs in interspecific backcross mice, Hoopes et al. (1992) mapped mouse genomic loci Rxra, Rxrb, and Rxrg to chromosome 2 near the centromere, to the H-2 region of chromosome 17, and to distal chromosome 1 in tight linkage with the Pbx (OMIM Ref. No. 176310) gene, respectively. Jones et al. (1993) mapped the RXRA gene to chromosome 9 by using PCR on a panel of somatic cell hybrids. A cosmid clone was isolated using the RXRA PCR product, and this was used to localize the gene further by fluorescence in situ hybridization to 9q34, distal to the dopamine beta-hydroxylase gene (DBH; 223360). The mapping position was confirmed by PCR on a panel of translocation hybrids. By pairwise hybridization of an RXRA cosmid and reference markers in fluorescence in situ hybridization, Almasan et al. (1994) refined the localization to 9q34.3. Fusion of PML (OMIM Ref. No. 102578) and TIF1A (OMIM Ref. No. 603406) to RARA and BRAF (OMIM Ref. No. 164757), respectively, results in the production of PML-RAR-alpha and TIF1-alpha-B-RAF (T18) oncoproteins. Zhong et al. (1999) showed that PML, TIF1-alpha, and RXR-alpha/RAR-alpha function together in a retinoic acid-dependent transcription complex. Zhong et al. (1999) found that PML acts as a ligand-dependent coactivator of RXR-alpha/RARA-alpha. T18, similar to PML- RAR-alpha, disrupts the retinoic acid-dependent activity of this complex in a dominant- negative manner, resulting in a growth advantage. PML-RAR-alpha was the first example of an oncoprotein generated by the fusion of 2 molecules participating in the same pathway, specifically the fusion of a transcription factor to one of its own cofactors. Since the PML and RAR-alpha pathways converge at the transcriptional level, there is no need for a double-dominant-negative product to explain the pathogenesis of acute promyelocytic leukemia, or APL. Germain et al.

(2002) showed that RXR can bind ligand and recruit coactivators as a heterodimer with apo-retinoic acid receptor (apo-RAR). However, in the usual cellular environment corepressors do not dissociate and they prohibit coactivator access because coregulator binding is mutually exclusive Animal model experiments lend further support to the function of RXRA. Li et al. (2000) developed an efficient technique to create spatiotemporally controlled somatic mutations of the Rxr-alpha gene in the mouse. Li et al. (2000) used tamoxifen-inducible Cre-ER(T) recombinases to ablate RXR-alpha selectively in adult mouse keratinocytes. In 6 to 7 weeks after the first tamoxifen treatment, alopecia developed in the ventral region of pro-mutant mice. At 12 to 16 weeks after treatment, large regions of ventral skin and smaller regions of dorsal skin were hairless. Cysts became visible under the skin surface and these enlarged and spread all over the body with time. At 16 weeks after treatment, hairless regions showed hair follicle degeneration, resulting in utriculi and dermal cysts. Keratin 6 (OMIM Ref. No. 148041), which is usually expressed only in hair follicle outer root sheath, was also expressed in hyperproliferative interfollicular epidermis, indicating abnormal keratinocyte terminal differentiation. All abnormalities were less severe, and/or appeared later, in males than in females. Li et al. (2000) found that RXR-beta (OMIM Ref. No. 180246) expression in adult skin is several-fold higher in males than in females. Study of tamoxifen-treated RXR-alpha/RXR-beta compound mutants demonstrated that RXR-beta can partially compensate for a loss of RXR-alpha function. Also, in accordance with a larger amount of RXR-beta in adult male skin, the functional redundancy was more pronounced in males than in females, as RXR-alpha/beta double mutant males and females were similarly affected, unlike the single mutants. De Urquiza et al. (2000) identified docosahexaenoic acid (DHA), a long-chain polyunsaturated fatty acid that is highly enriched in the adult mammalian brain, as the natural ligand for the retinoic X receptor in mouse brain. Claudel et al. (2001) analyzed the effects of activation of RXR and some of its heterodimers in apolipoprotein E -/- mice, a well-established animal model of atherosclerosis. An RXR agonist drastically reduced the development of atherosclerosis. In addition, a ligand for the peroxisome proliferator-activated receptor PPAR-gamma and a dual agonist of both PPAR-alpha and PPAR-gamma had moderate inhibitory effects. Both RXR and LXR agonists induced ATP-binding cassette protein- 1 (ABC1) expression and stimulated ABC1-mediated cholesterol efflux from macrophages from wildtype, but not from LXRA or LXRB (OMIM Ref. No. 600380), double -/- mice. Hence, activation of ABC1-mediated cholesterol efflux by the RXR/LXR heterodimer may contribute to the beneficial effects of rexinoids on atherosclerosis and warrant further evaluation of RXR/LXR agonists in prevention and treatment of atherosclerosis.

It is appreciated that the abovementioned animal model for RXRA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Claudel, T.; Leibowitz, M. D.; Fievet, C.; Tailleux, A.; Wagner, B.; Repa, J. J.; Torpier, G.; Lobaccaro, J.-M.; Paterniti, J. R.; Mangelsdorf, D. J.; Heyman, R. A.; Auwerx, J.: Reduction of atherosclerosis in apolipoprotein E knockout mice by activation of the retinoid X receptor. Proc. Nat. Acad. Sci. 98:2610-2615, 2001; and Germain, P.; Iyer, J.; Zechel, C.; Gronemeyer, H.: Co-regulator recruitment and the mechanism of retinoic acid receptor synergy. Nature 415:187-192, 2002.

Further studies establishing the function and utilities of RXRA are found in John Hopkins OMIM database record ID 180245, and in cited publications listed in Table 5, which are hereby incorporated by reference. SCYA28 (Accession) is another GAM146 target gene, herein designated TARGET GENE. SCYA28 BINDING SITE is a target binding site found in the 3' untranslated region of mRNA encoded by SCYA28, corresponding to a target binding site such as BINDING SITE I, BINDING SITE II or BINDING SITE III of FIG. 8. Table 4 illustrates the complementarity of the nucleotide sequences of SCYA28 BINDING SITE, designated SEQ ID:3241, to the nucleotide sequence of GAM146 RNA, herein designated GAM RNA, also designated SEQ ID:370.

Another function of GAM146 is therefore inhibition of SCYA28 (Accession). Accordingly, utilities of GAM146 include diagnosis, prevention and treatment of diseases and clinical conditions associated with SCYA28.

Solute carrier family 39 (zinc transporter), member 4 (SLC39A4, Accession NM_130849.1) is another GAM146 target gene, herein designated TARGET GENE. SLC39A4 BINDING SITE is a target binding site found in the 5' untranslated region of multiple transcripts of mRNA encoded by SLC39A4, corresponding to a target binding site such as BINDING SITE I, BINDING SITE II or BINDING SITE III of FIG. 8. Table 4 illustrates the complementarity of the nucleotide sequences of SLC39A4 BINDING SITE, designated SEQ ID:13352, to the nucleotide sequence of GAM146 RNA, herein designated GAM RNA, also designated SEQ ID:370.

Another function of GAM146 is therefore inhibition of Solute carrier family 39 (zinc transporter), member 4 (SLC39A4, Accession NM_130849.1), a gene which is a zinc transporter and therefore may be associated with Acrodermatitis enteropathica. Accordingly, utilities of GAM146 include diagnosis, prevention and treatment of Acrodermatitis enteropathica, and of other diseases and clinical conditions associated with SLC39A4.

The function of SLC39A4 and its association with various diseases and clinical conditions, has been established by previous studies, as described hereinabove with reference to GAM63.1. Smcx homolog, x chromosome (mouse) (SMCX, Accession NM_004187.1) is another GAM146 target gene, herein designated TARGET GENE. SMCX BINDING SITE is a target binding site found in the 3' untranslated region of mRNA encoded by SMCX, corresponding to a target binding site such as BINDING SITE I, BINDING SITE II or BINDING SITE III of FIG. 8. Table 4 illustrates the complementarity of the nucleotide sequences of SMCX BINDING SITE, designated SEQ ID:17633, to the nucleotide sequence of GAM146 RNA, herein designated GAM RNA, also designated SEQ ID:370.

Another function of GAM146 is therefore inhibition of Smcx homolog, x chromosome (mouse) (SMCX, Accession NM_004187.1), a gene which escapes X inactivation. Accordingly, utilities of GAM146 include diagnosis, prevention and treatment of diseases and clinical conditions associated with SMCX.

The function of SMCX and its association with various diseases and clinical conditions, has been established by previous studies, as described hereinabove with reference to GAM63.1. Spermidine synthase (SRM, Accession NM_003132.1) is another GAM146 target gene, herein designated TARGET GENE. SRM BINDING SITE is a target binding site found in the 3' untranslated region of mRNA encoded by SRM, corresponding to a target binding site such as BINDING SITE I, BINDING SITE II or BINDING SITE III of FIG. 8. Table 4 illustrates the complementarity of the nucleotide sequences of SRM BINDING SITE, designated SEQ ID:14242, to the nucleotide sequence of GAM146 RNA, herein designated GAM RNA, also designated SEQ ID:370.

Another function of GAM146 is therefore inhibition of Spermidine synthase (SRM, Accession NM_003132.1). Accordingly, utilities of GAM146 include diagnosis, prevention and treatment of diseases and clinical conditions associated with SRM.

TCF-3 (Accession) is another GAM146 target gene, herein designated TARGET GENE. TCF-3 BINDING SITE is a target binding site found in the 3' untranslated region of mRNA encoded by TCF-3, corresponding to a target binding site such as BINDING SITE I, BINDING SITE II or BINDING SITE III of FIG. 8. Table 4 illustrates the complementarity of the nucleotide sequences of TCF-3 BINDING SITE, designated SEQ ID:16528, to the nucleotide sequence of GAM146 RNA, herein designated GAM RNA, also designated SEQ ID:370.

Another function of GAM146 is therefore inhibition of TCF-3 (Accession). Accordingly, utilities of GAM146 include diagnosis, prevention and treatment of diseases and clinical conditions associated with TCF-3.

Transmembrane protease, serine 3 (TMPRSS3, Accession NM_024022.1) is another GAM146 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:11876, to the nucleotide sequence of GAM146 RNA, herein designated GAM RNA, also designated SEQ ID:370.

Another function of GAM146 is therefore inhibition of Transmembrane protease, serine 3 (TMPRSS3, Accession NM_024022.1). Accordingly, utilities of GAM146 include diagnosis, prevention and treatment of diseases and clinical conditions associated with TMPRSS3.

Wolf-hirschhorn syndrome candidate 1 (WHSC1, Accession NM_133332.1) is another GAM146 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:12138, to the nucleotide sequence of GAM146 RNA, herein designated GAM RNA, also designated SEQ ID:370.

Another function of GAM146 is therefore inhibition of Wolf-hirschhorn syndrome candidate 1 (WHSC1, Accession NM_133332.1), a gene which binds covalently to and repairs g/t mismatches. and therefore may be associated with Wolf-hirschhorn syndrome. Accordingly, utilities of GAM146 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Z39IG (Accession NM_007268.1) is another GAM146 target gene, herein designated TARGET GENE. Z39IG BINDING SITE is a target binding site found in the 3' untranslated region of mRNA encoded by Z39IG, corresponding to a target binding site such as BINDING SITE I, BINDING SITE II or BINDING SITE III of FIG. 8. Table 4 illustrates the complementarity of the nucleotide sequences of Z39IG BINDING SITE, designated SEQ ID:10116, to the nucleotide sequence of GAM146 RNA, herein designated GAM RNA, also designated SEQ ID:370.

Another function of GAM146 is therefore inhibition of Z39IG (Accession NM_007268.1). Accordingly, utilities of GAM146 include diagnosis, prevention and treatment of diseases and clinical conditions associated with Z39IG.

Zinc finger protein 17 (hpf3, kox 10) (ZNF17, Accession XM_091895.5) is another GAM146 target gene, herein designated TARGET GENE. ZNF17 BINDING SITE is a target binding site found in the 5' untranslated region of mRNA encoded by ZNF17, corresponding to a target binding site such as BINDING SITE I, BINDING SITE II or BINDING SITE III of FIG. 8. Table 4 illustrates the complementarity of the nucleotide sequences of ZNF17 BINDING SITE, designated SEQ ID:12073, to the nucleotide sequence of GAM146 RNA, herein designated GAM RNA, also designated SEQ ID:370.

Another function of GAM146 is therefore inhibition of Zinc finger protein 17 (hpf3, kox 10) (ZNF17, Accession XM_091895.5). Accordingly, utilities of GAM146 include diagnosis, prevention and treatment of diseases and clinical conditions associated with ZNF17.

FIG. 8 further provides a conceptual description of a novel bioinformatically detected of the present invention, referred to here as Genomic Address Messenger 147 (GAM147), which modulates expression of respective target genes thereof, the function and utility of which target genes is known in the art.

GAM147 is a novel bioinformatically detected regulatory, non protein coding, micro RNA (miRNA) gene. The method by which GAM147 was detected is described hereinabove with reference to FIGS. 8-15.

GAM147 gene, herein designated GAM GENE, and GAM147 target gene, herein designated TARGET GENE, are human genes contained in the human genome.

GAM147 gene encodes a GAM147 precursor RNA, herein designated GAM PRECURSOR RNA. Similar to other miRNA genes, and unlike most ordinary genes, GAM147 precursor RNA does not encode a protein. A nucleotide sequence identical or highly similar to the nucleotide sequence of GAM147 precursor RNA is designated SEQ ID:196, and is provided hereinbelow with reference to the sequence listing part.

GAM147 precursor RNA folds onto itself, forming GAM147 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM147 precursor RNA folds onto itself, forming GAM147 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM147 precursor RNA, designated SEQ-ID:196, and a schematic representation of a predicted secondary folding of GAM147 folded precursor RNA are further described with reference to Table 2, hereby incorporated by reference.

An enzyme complex designated DICER COMPLEX, 'dices' the GAM147 folded precursor RNA into GAM147 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM147 RNA is designated SEQ ID:298, and is provided hereinbelow with references to the sequence listing part and Table 3, hereby incorporated by reference.

GAM147 target gene, herein designated TARGET GENE, encodes a corresponding messenger RNA, GAM147 target RNA, herein designated GAM TARGET RNA. GAM147 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM147 RNA, herein designated GAM RNA, binds complementarily to one or more target binding sites located in untranslated regions of GAM147 target RNA, herein designated GAM TARGET RNA. This complementary binding is due to the fact that the nucleotide sequence of GAM147 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM147 RNA may have a different number of target binding sites in untranslated regions of a GAM147 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM147 RNA, herein designated GAM RNA, to target binding sites on GAM147 target RNA, herein designated GAM TARGET RNA, such as BINDING SITE I, BINDING SITE II and BINDING SITE III, inhibits translation of GAM147 target RNA into GAM147 target protein, herein designated GAM TARGET PROTEIN. GAM target protein is therefore outlined by a broken line.

It is appreciated that GAM147 target gene, herein designated TARGET GENE, in fact represents a plurality of GAM147 target genes. The mRNA of each one of this plurality of GAM147 target genes comprises one or more target binding sites, each having a nucleotide sequence which is at least partly complementary to GAM147 RNA, herein designated GAM RNA, and which when bound by GAM147 RNA causes inhibition of translation of respective one or more GAM147 target proteins.

It is further appreciated by one skilled in the art that the mode of translational inhibition illustrated by FIG. 8 with specific reference to translational inhibition exerted by GAM147 gene, herein designated GAM GENE, on one or more GAM147 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM147 correlate with, and may be deduced from, the identity of the target genes which GAM147 binds and inhibits, and the function of these target genes, as elaborated hereinbelow.

FLJ21276 (Accession) is a GAM147 target gene, herein designated TARGET GENE. FLJ21276 BINDING SITE is a target binding site found in the 3' untranslated region of mRNA encoded by FLJ21276, corresponding to a target binding site such as BINDING SITE I, BINDING SITE II or BINDING SITE III of FIG. 8. Table 4 illustrates the complementarity of the nucleotide sequences of FLJ21276 BINDING SITE, designated SEQ ID:532, to the nucleotide sequence of GAM147 RNA, herein designated GAM RNA, also designated SEQ ID:298.

A function of GAM147 is therefore inhibition of FLJ21276 (Accession). Accordingly, utilities of GAM147 include diagnosis, prevention and treatment of diseases and clinical conditions associated with FLJ21276.

Forkhead box e1 (thyroid transcription factor 2) (FOXE1, Accession NM_004473.3) is another GAM147 target gene, herein designated TARGET GENE. FOXE1 BINDING SITE is a target binding site found in the 3' untranslated region of mRNA encoded by FOXE1, corresponding to a target binding site such as BINDING SITE I, BINDING SITE II or BINDING SITE III of FIG. 8. Table 4 illustrates the complementarity of the nucleotide sequences of FOXE1 BINDING SITE, designated SEQ ID:9989, to the nucleotide sequence of GAM147 RNA, herein designated GAM RNA, also designated SEQ ID:298.

Another function of GAM147 is therefore inhibition of Forkhead box e1 (thyroid transcription factor 2) (FOXE1, Accession NM_004473.3). Accordingly, utilities of GAM147 include diagnosis, prevention and treatment of diseases and clinical conditions associated with FOXE1.

Protein kinase (camp-dependent, catalytic) inhibitor gamma (PKIG, Accession NM_007066.2) is another GAM147 target gene, herein designated TARGET GENE. PKIG BINDING SITE is a target binding site found in the 3' untranslated region of mRNA encoded by PKIG, corresponding to a target binding site such as BINDING SITE I, BINDING SITE II or BINDING SITE III of FIG. 8. Table 4 illustrates the complementarity of the nucleotide sequences of PKIG BINDING SITE, designated SEQ ID:15790, to the nucleotide sequence of GAM147 RNA, herein designated GAM RNA, also designated SEQ ID:298.

Another function of GAM147 is therefore inhibition of Protein kinase (camp-dependent, catalytic) inhibitor gamma (PKIG, Accession NM_007066.2). Accordingly, utilities of GAM147 include diagnosis, prevention and treatment of diseases and clinical conditions associated with PKIG.

FIG. 8 further provides a conceptual description of a novel bioinformatically detected of the present invention, referred to here as Genomic Address Messenger 148 (GAM148), which modulates expression of respective target genes thereof, the function and utility of which target genes is known in the art.

GAM148 is a novel bioinformatically detected regulatory, non protein coding, micro RNA (miRNA) gene. The method by which GAM148 was detected is described hereinabove with reference to FIGS. 8-15.

GAM148 gene, herein designated GAM GENE, and GAM148 target gene, herein designated TARGET GENE, are human genes contained in the human genome.

GAM148 gene encodes a GAM148 precursor RNA, herein designated GAM PRECURSOR RNA. Similar to other miRNA genes, and unlike most ordinary genes, GAM148 precursor RNA does not encode a protein. A nucleotide sequence identical or highly similar to the nucleotide sequence of GAM148 precursor RNA is designated SEQ ID:65, and is provided hereinbelow with reference to the sequence listing part.

GAM148 precursor RNA folds onto itself, forming GAM148 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM148 precursor RNA folds onto itself, forming GAM148 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM148 precursor RNA, designated SEQ-ID:65, and a schematic representation of a predicted secondary folding of GAM148 folded precursor RNA are further described with reference to Table 2, hereby incorporated by reference.

An enzyme complex designated DICER COMPLEX, 'dices' the GAM148 folded precursor RNA into GAM148 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM148 RNA is designated SEQ ID:280, and is provided hereinbelow with references to the sequence listing part and Table 3, hereby incorporated by reference.

GAM148 target gene, herein designated TARGET GENE, encodes a corresponding messenger RNA, GAM148 target RNA, herein designated GAM TARGET RNA. GAM148 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM148 RNA, herein designated GAM RNA, binds complementarily to one or more target binding sites located in untranslated regions of GAM148 target RNA, herein designated GAM TARGET RNA. This complementary binding is due to the fact that the nucleotide sequence of GAM148 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM148 RNA may have a different number of target binding sites in untranslated regions of a GAM148 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM148 RNA, herein designated GAM RNA, to target binding sites on GAM148 target RNA, herein designated GAM TARGET RNA, such as BINDING SITE I, BINDING SITE II and BINDING SITE III, inhibits translation of GAM148 target RNA into GAM148 target protein, herein designated GAM TARGET PROTEIN. GAM target protein is therefore outlined by a broken line.

It is appreciated that GAM148 target gene, herein designated TARGET GENE, in fact represents a plurality of GAM148 target genes. The mRNA of each one of this plurality of GAM148 target genes comprises one or more target binding sites, each having a nucleotide sequence which is at least partly complementary to GAM148 RNA, herein designated GAM RNA, and which when bound by GAM148 RNA causes inhibition of translation of respective one or more GAM148 target proteins.

It is further appreciated by one skilled in the art that the mode of translational inhibition illustrated by FIG. 8 with specific reference to translational inhibition exerted by GAM148 gene, herein designated GAM GENE, on one or more GAM148 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM148 correlate with, and may be deduced from, the identity of the target genes which GAM148 binds and inhibits, and the function of these target genes, as elaborated hereinbelow.

Adenosine a1 receptor (ADORA1, Accession NP_000665.1) is a GAM148 target gene, herein designated TARGET GENE. ADORA1 BINDING SITE is a target binding site found in the 3' untranslated region of mRNA encoded by ADORA1, corresponding to a target binding site such as BINDING SITE I, BINDING SITE II or BINDING SITE III of FIG. 8. Table 4 illustrates the complementarity of the nucleotide sequences of ADORA1 BINDING SITE, designated SEQ ID:3384, to the nucleotide sequence of GAM148 RNA, herein designated GAM RNA, also designated SEQ ID:280.

A function of GAM148 is therefore inhibition of Adenosine a1 receptor (ADORA1, Accession NP_000665.1), a gene which the activity of this receptor is mediated by g proteins which inhibit adenylyl cyclase. Accordingly, utilities of GAM148 include diagnosis, prevention and treatment of diseases and clinical conditions associated with ADORA1.

The function of ADORA1 has been established by previous studies. Diverse physiologic effects of adenosine were recognized as early as the 1920s (Drury and Szent-Gyorgy, 1929; Berne, 1963). Once released, adenosine activates adenosine receptors, which in turn regulate a diverse set of physiologic functions including cardiac rate and contractility, smooth muscle tone, sedation, release of neurotransmitters, platelet function, lipolysis, renal function, and white blood cell function. Stiles (1992) reviewed the structure and function of adenosine receptors important in the mediation of these multiple effects. Also see adenosine A2 receptor (ADORA2A; 102776). Libert et al. (1991) obtained cDNA clones for 4 receptors of the G protein-coupled receptor family by selective amplification of cloning from thyroid cDNA and termed them RDC1 (VIPR1; 192321), RDC4 (HTR1D; 182133), RDC7, and RDC8 (ADORA2A). RDC7 and RDC8 were identified as A1 and A2 adenosine receptors, respectively. By in situ hybridization, Libert et al. (1991) assigned the RDC7 gene to 22q11.2-q13.1. However, using fluorescence in situ hybridization, Townsend-Nicholson et al. (1995) demonstrated that the ADORA1 gene is located on 1q32.1.

Animal model experiments lend further support to the function of ADORA1. Sun et al. (2001) used homologous recombination to generate viable mice without gross behavioral or anatomic defects that were deficient in the 2-exon A1ar gene, which encodes a protein 87% identical to the human protein.

It is appreciated that the abovementioned animal model for ADORA1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Stiles, G. L.: Adenosine receptors. J. Biol. Chem. 267: 6451-6454, 1992; and

Sun, D.; Samuelson, L. C.; Yang, T.; Huang, Y.; Paliege, A.; Saunders, T.; Briggs, J.; Schnermann, J.: Mediation of tubuloglomerular feedback by adenosine: evidence from mice lacking ad.

Further studies establishing the function and utilities of ADORA1 are found in John Hopkins OMIM database record ID 102775, and in cited publications listed in Table 5, which are hereby incorporated by reference. Adrenergic, alpha-1a-, receptor (ADRA1A, Accession NP_000671.1) is another GAM148 target gene, herein designated TARGET GENE. ADRA1A BINDING SITE is a target binding site found in the 3' untranslated region of multiple transcripts of mRNA encoded by ADRA1A, corresponding to a target binding site such as BINDING SITE I, BINDING SITE II or BINDING SITE III of FIG. 8. Table 4 illustrates the complementarity of the nucleotide sequences of ADRA1A BINDING SITE, designated SEQ ID:1241, to the nucleotide sequence of GAM148 RNA, herein designated GAM RNA, also designated SEQ ID:280.

Another function of GAM148 is therefore inhibition of Adrenergic, alpha-1a-, receptor (ADRA1A, Accession NP_000671.1). Accordingly, utilities of GAM148 include diagnosis, prevention and treatment of diseases and clinical conditions associated with ADRA1A.

Aldehyde dehydrogenase 9 family, member a1 (ALDH9A1, Accession NP_000687.2) is another GAM148 target gene, herein designated TARGET GENE. ALDH9A1 BINDING SITE is a target binding site found in the 5' untranslated region of mRNA encoded by ALDH9A1, corresponding to a target binding site such as BINDING SITE I, BINDING SITE II or BINDING SITE III of FIG. 8. Table 4 illustrates the complementarity of the nucleotide sequences of ALDH9A1 BINDING SITE, designated SEQ ID:5663, to the nucleotide sequence of GAM148 RNA, herein designated GAM RNA, also designated SEQ ID:280.

Another function of GAM148 is therefore inhibition of Aldehyde dehydrogenase 9 family, member a1 (ALDH9A1, Accession NP_000687.2). Accordingly, utilities of GAM148 include diagnosis, prevention and treatment of diseases and clinical conditions associated with ALDH9A1.

Amine oxidase, copper containing 3 (vascular adhesion protein 1) (AOC3, Accession NP_003725.1) is another GAM148 target gene, herein designated TARGET GENE. AOC3 BINDING SITE is a target binding site found in the 3' untranslated region of mRNA encoded by AOC3, corresponding to a target binding site such as BINDING SITE I, BINDING SITE II or BINDING SITE III of FIG. 8. Table 4 illustrates the complementarity of the nucleotide sequences of AOC3 BINDING SITE, designated SEQ ID:10641, to the nucleotide sequence of GAM148 RNA, herein designated GAM RNA, also designated SEQ ID:280.

Another function of GAM148 is therefore inhibition of Amine oxidase, copper containing 3 (vascular adhesion protein 1) (AOC3, Accession NP_003725.1), a gene which catalyze the oxidative conversion of amines to aldehydes in the presence of copper and quinone cofactor. Accordingly, utilities of GAM148 include diagnosis, prevention and treatment of diseases and clinical conditions associated with AOC3.

The function of AOC3 and its association with various diseases and clinical conditions, has been established by previous studies, as described hereinabove with reference to GAM47.1. Amyloid beta (a4) precursor protein-binding, family a, member 1 (x11) (APBA1, Accession NP_001154.2) is another GAM148 target gene, herein designated TARGET GENE. APBA1 BINDING SITE is a target binding site found in the 3' untranslated region of mRNA encoded by APBA1, corresponding to a target binding site such as BINDING SITE I, BINDING SITE II or BINDING SITE III of FIG. 8. Table 4 illustrates the complementarity of the nucleotide sequences of APBA1 BINDING SITE, designated SEQ ID:6310, to the nucleotide sequence of GAM148 RNA, herein designated GAM RNA, also designated SEQ ID:280.

Another function of GAM148 is therefore inhibition of Amyloid beta (a4) precursor protein-binding, family a, member 1 (x11) (APBA1, Accession NP_001154.2), a gene which stabilises APP and inhibits production of proteolytic APP fragments. and therefore may be associated with Alzheimer disease. Accordingly, utilities of GAM148 include diagnosis, prevention and treatment of Alzheimer disease, and of other diseases and clinical conditions associated with APBA1.

The function of APBA1 and its association with various diseases and clinical conditions, has been established by previous studies, as described hereinabove with reference to GAM55.2. Arylsulfatase a (ARSA, Accession NP_000478.2) is another GAM148 target gene, herein designated TARGET GENE. ARSA BINDING SITE is a target binding site found in the 5' untranslated region of mRNA encoded by ARSA, corresponding to a target binding site such as BINDING SITE I, BINDING SITE II or BINDING SITE III of FIG. 8. Table 4 illustrates the complementarity of the nucleotide sequences of ARSA BINDING SITE, designated SEQ ID:10346, to the nucleotide sequence of GAM148 RNA, herein designated GAM RNA, also designated SEQ ID:280.

Another function of GAM148 is therefore inhibition of Arylsulfatase a (ARSA, Accession NP_000478.2). Accordingly, utilities of GAM148 include diagnosis, prevention and treatment of diseases and clinical conditions associated with ARSA.

Chromosome 10 open reading frame 3 (C10orf3, Accession NP_060601.2) is another GAM148 target gene, herein designated TARGET GENE. C10orf3 BINDING SITE is a target binding site found in the 3' untranslated region of mRNA encoded by C10orf3, corresponding to a target binding site such as BINDING SITE I, BINDING SITE II or BINDING SITE III of FIG. 8. Table 4 illustrates the complementarity of the nucleotide sequences of C10orf3 BINDING SITE, designated SEQ ID:10591, to the nucleotide sequence of GAM148 RNA, herein designated GAM RNA, also designated SEQ ID:280.

Another function of GAM148 is therefore inhibition of Chromosome 10 open reading frame 3 (C10orf3, Accession NP_060601.2). Accordingly, utilities of GAM148 include diagnosis, prevention and treatment of diseases and clinical conditions associated with C10orf3.

Chromosome 11 open reading frame 21 (C11orf21, Accession NP_054863.1) is another GAM148 target gene, herein designated TARGET GENE. C11orf21 BINDING SITE is a target binding site found in the 3' untranslated region of mRNA encoded by C11orf21, corresponding to a target binding site such as BINDING SITE I, BINDING SITE II or BINDING SITE III of FIG. 8. Table 4 illustrates the complementarity of the nucleotide sequences of C11orf21 BINDING SITE, designated SEQ ID:13424, to the nucleotide sequence of GAM148 RNA, herein designated GAM RNA, also designated SEQ ID:280.

Another function of GAM148 is therefore inhibition of Chromosome 11 open reading frame 21 (C11orf21, Accession NP_054863.1). Accordingly, utilities of GAM148 include diagnosis, prevention and treatment of diseases and clinical conditions associated with C11orf21.

Chromosome 20 open reading frame 54 (C20orf54, Accession NP_212134.1) is another GAM148 target gene, herein designated TARGET GENE. C20orf54 BINDING SITE is a target binding site found in the 3' untranslated region of mRNA encoded by C20orf54, corresponding to a target binding site such as BINDING SITE I, BINDING SITE II or BINDING SITE III of FIG. 8. Table 4 illustrates the complementarity of the nucleotide sequences of C20orf54 BINDING SITE, designated SEQ ID:12151, to the nucleotide sequence of GAM148 RNA, herein designated GAM RNA, also designated SEQ ID:280.

Another function of GAM148 is therefore inhibition of Chromosome 20 open reading frame 54 (C20orf54, Accession NP_212134.1). Accordingly, utilities of GAM148 include diagnosis, prevention and treatment of diseases and clinical conditions associated with C20orf54.

Chromosome 5 open reading frame 4 (C5orf4, Accession NP_057432.1) is another GAM148 target gene, herein designated TARGET GENE. C5orf4 BINDING SITE is a target binding site found in the 3' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:19712, to the nucleotide sequence of GAM148 RNA, herein designated GAM RNA, also designated SEQ ID:280.

Another function of GAM148 is therefore inhibition of Chromosome 5 open reading frame 4 (C5orf4, Accession NP_057432.1). Accordingly, utilities of GAM148 include diagnosis, prevention and treatment of diseases and clinical conditions associated with C5orf4.

Chromosome 5 open reading frame 4 (C5orf4, Accession NP_115761.1) is another GAM148 target gene, herein designated TARGET GENE. C5orf4 BINDING SITE is a target binding site found in the 3' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:19712, to the nucleotide sequence of GAM148 RNA, herein designated GAM RNA, also designated SEQ ID:280.

Another function of GAM148 is therefore inhibition of Chromosome 5 open reading frame 4 (C5orf4, Accession NP_115761.1). Accordingly, utilities of GAM148 include diagnosis, prevention and treatment of diseases and clinical conditions associated with C5orf4.

Cadherin 16, ksp-cadherin (CDH16, Accession NP_004053.1) is another GAM148 target gene, herein designated TARGET GENE. CDH16 BINDING SITE is a target binding site found in the 5' untranslated region of mRNA encoded by CDH16, corresponding to a target binding site such as BINDING SITE I, BINDING SITE II or BINDING SITE III of FIG. 8. Table 4 illustrates the complementarity of the nucleotide sequences of CDH16 BINDING SITE, designated SEQ ID:10351, to the nucleotide sequence of GAM148 RNA, herein designated GAM RNA, also designated SEQ ID:280.

Another function of GAM148 is therefore inhibition of Cadherin 16, ksp-cadherin (CDH16, Accession NP_004053.1), a gene which is a calcium dependent cell adhesion protein. Accordingly, utilities of GAM148 include diagnosis, prevention and treatment of diseases and clinical conditions associated with CDH16.

The function of CDH16 has been established by previous studies. Cadherins are calcium-dependent, membrane-associated glycoproteins. Members of this group are the principal mediators of homotypic cellular recognition and play a role in the morphogenic direction of tissue development. Thomson et al. (1995) identified rabbit Ksp-cadherin, a novel kidney-specific member of the cadherin family. Sequence analysis demonstrated that Ksp-cadherin, like LI-cadherin (CDH17; 603017), lacks the prosequence and tripeptide HAV adhesion recognition sequence typical of most classical cadherins, and possesses a truncated cytoplasmic domain. Northern blot analysis and immunolocalization studies in rabbit indicate that Ksp-cadherin expression is kidney-specific and limited to the basolateral membranes of renal tubular epithelial cells. By screening kidney libraries with rabbit Ksp-cadherin cDNAs, Thomson et al. (1998) isolated cDNAs encoding mouse and human Ksp-cadherin. The predicted 829-amino acid human protein shares 77% and 79% sequence identity with those of mouse and rabbit, respectively. Northern blot analysis revealed that Ksp- cadherin is expressed exclusively in kidney as a 3-kb mRNA in both human and mouse. By fluorescence in situ hybridization, Thomson et al. (1998) mapped the Ksp-cadherin gene to human chromosome 16q21-q22. By analysis of an interspecific backcross, they mapped the mouse homolog to a region of mouse chromosome 8 showing homology of synteny to 16q21-proximal 16q22. In both human and mouse, the Ksp-cadherin gene is located within a cluster of several other cadherin genes, including CDH1 (OMIM Ref. No. 192090), CDH3 (OMIM Ref. No. 114021), CDH5 (OMIM Ref. No. 601120), and CDH15 (OMIM Ref. No. 114019).

Full details of the abovementioned studies are described in the following publications, the disclosure of which are hereby incorporated by reference:

Thomson, R. B.; Igarashi, P.; Biemesderfer, D.; Kim, R.; Abu-Alfa, A.; Soleimani, M.; Aronson, P. S.: Isolation and cDNA cloning of Ksp-cadherin, a novel kidney-specific member of the cadherin multigene family. J. Biol. Chem. 270:17594-17601, 1995; and Thomson, R. B.; Ward, D. C.; Quaggin, S. E.; Igarashi, P.; Muckler, Z. E.; Aronson, P. S.: cDNA cloning and chromosomal localization of the human and mouse isoforms of Ksp-cadherin. Ge.

Further studies establishing the function and utilities of CDH16 are found in John Hopkins OMIM database record ID 603118, and in cited publications listed in Table 5, which are hereby incorporated by reference. Choline kinase-like (CHKL, Accession NP_689466.1) is another GAM148 target gene, herein designated TARGET GENE. CHKL BINDING SITE is a target binding site found in the 3' untranslated region of multiple transcripts of mRNA encoded by CHKL, corresponding to a target binding site such as BINDING SITE I, BINDING SITE II or BINDING SITE III of FIG. 8. Table 4 illustrates the complementarity of the nucleotide sequences of CHKL BINDING SITE, designated SEQ ID:18892, to the nucleotide sequence of GAM148 RNA, herein designated GAM RNA, also designated SEQ ID:280.

Another function of GAM148 is therefore inhibition of Choline kinase-like (CHKL, Accession NP_689466.1). Accordingly, utilities of GAM148 include diagnosis, prevention and treatment of diseases and clinical conditions associated with CHKL.

Carbohydrate (chondroitin) synthase 1 (CHSY1, Accession NP_055733.2) is another GAM148 target gene, herein designated TARGET GENE. CHSY1 BINDING SITE is a target binding site found in the 3' untranslated region of mRNA encoded by CHSY1, corresponding to a target binding site such as BINDING SITE I, BINDING SITE II or BINDING SITE III of FIG. 8. Table 4 illustrates the complementarity of the nucleotide sequences of CHSY1 BINDING SITE, designated SEQ ID:9095, to the nucleotide sequence of GAM148 RNA, herein designated GAM RNA, also designated SEQ ID:280.

Another function of GAM148 is therefore inhibition of Carbohydrate (chondroitin) synthase 1 (CHSY1, Accession NP_055733.2). Accordingly, utilities of GAM148 include diagnosis, prevention and treatment of diseases and clinical conditions associated with CHSY1.

Ciliary neurotrophic factor (CNTF, Accession NP_000605.1) is another GAM148 target gene, herein designated TARGET GENE. CNTF BINDING SITE is a target binding site found in the 3' untranslated region of mRNA encoded by CNTF, corresponding to a target binding site such as BINDING SITE I, BINDING SITE II or BINDING SITE III of FIG. 8. Table 4 illustrates the complementarity of the nucleotide sequences of CNTF BINDING SITE, designated SEQ ID:15418, to the nucleotide sequence of GAM148 RNA, herein designated GAM RNA, also designated SEQ ID:280.

Another function of GAM148 is therefore inhibition of Ciliary neurotrophic factor (CNTF, Accession NP_000605.1), a gene which is a survival factor for various neuronal cell types. and therefore may be associated with Ciliary neurotrophic factor polymorphism. Accordingly, utilities of GAM148 include diagnosis, prevention and treatment of Ciliary neurotrophic factor polymorphism, and of other diseases and clinical conditions associated with CNTF.

The function of CNTF has been established by previous studies. Takahashi et al. (1994) identified an apparent polymorphism of the CNTF gene. An acceptor splice site mutation caused aberrant mRNA splicing and abolished expression of CNTF protein. The specific change was a G- to - A transition at position -6 of the acceptor splice site leading to insertion of 4 additional ribonucleotides at the beginning of the next exon. This caused a frameshift from amino acid 39, resulting in a stop codon 24 amino acids downstream. (The normal open reading frame codes for 200 amino acids.) The aberrant mRNA was predicted to code for a truncated protein of 62 amino acids. Analysis of tissue samples and transfection of CNTF minigenes into cultured cells demonstrated to Takahashi et al. (1994) that the mutated allele expressed only the mutated mRNA species. Studies with an antiserum that recognized both the normal and mutated CNTF showed complete lack of CNTF immunoreactivity in peripheral nerve tissue from a homozygous mutant subject. In 391 Japanese people tested, 61.9% were normal homozygotes, 39.8% heterozygotes, and 2.3% mutant homozygotes. The distribution of the 3 genotypes were similar in healthy and neurologic disease subjects, indicating that human CNTF deficiency is not causally related to neurologic diseases In 7 of 288 patients with multiple sclerosis (OMIM Ref. No. 126200), Giess et al. (2002) identified homozygosity for the CNTF null mutation. The 7 patients demonstrated a significantly earlier age of onset of disease (17 years) compared to patients carrying at least 1 functional CNTF allele (27 years). Six of the 7 patients with the null allele (85%) had marked motor or brainstem symptoms and incomplete remission, which was detected in only 21% of the other patients with MS. Giess et al. (2002) noted that the null allele is very rare, and that the frequency of the homozygous null allele in this group is the same as in control groups, thus indicating that the genotype itself is not a risk factor for development of MS. However, they suggested that trophic support of neurons and oligodendrocytes by CNTF may be critical to reduce early damage caused by inflammatory mediators, and that lack of functional CNTF may lead to earlier onset of clinical symptoms in MS Full details of the abovementioned studies are described in the following publications, the disclosure of which are hereby incorporated by reference:

Barbin, G.; Manthorpe, M.; Varon, S.: Purification of the chick eye ciliary neuronotrophic factor. J. Neurochem. 43:1468-1478, 1984; and Takahashi, R.; Yokoji, H.; Misawa, H.; Hayashi, M.; Hu, J.; Deguchi, T.: A null mutation in the human CNTF gene is not causally related to neurological diseases. Nature Genet. 7:79-84.

Further studies establishing the function and utilities of CNTF are found in John Hopkins OMIM database record ID 118945, and in cited publications listed in Table 5, which are hereby incorporated by reference. Contactin 3 (plasmacytoma associated) (CNTN3, Accession XP_039627.7) is another GAM148 target gene, herein designated TARGET GENE. CNTN3 BINDING SITE is a target binding site found in the 3' untranslated region of mRNA encoded by CNTN3, corresponding to a target binding site such as BINDING SITE I, BINDING SITE II or BINDING SITE III of FIG. 8. Table 4 illustrates the complementarity of the nucleotide sequences of CNTN3 BINDING SITE, designated SEQ ID:13470, to the nucleotide sequence of GAM148 RNA, herein designated GAM RNA, also designated SEQ ID:280.

Another function of GAM148 is therefore inhibition of Contactin 3 (plasmacytoma associated) (CNTN3, Accession XP_039627.7), a gene which may play a role in the initial growth and guidance of axons. and therefore may be associated with Plasmacytomas. Accordingly, utilities of GAM148 include diagnosis, prevention and treatment of Plasmacytomas, and of other diseases and clinical conditions associated with CNTN3.

The function of CNTN3 and its association with various diseases and clinical conditions, has been established by previous studies, as described hereinabove with reference to GAM55.2. Carboxypeptidase a4 (CPA4, Accession NP_057436.1) is another GAM148 target gene, herein designated TARGET GENE. CPA4 BINDING SITE is a target binding site found in the 3' untranslated region of mRNA encoded by CPA4, corresponding to a target binding site such as BINDING SITE I, BINDING SITE II or BINDING SITE III of FIG. 8. Table 4 illustrates the complementarity of the nucleotide sequences of CPA4 BINDING SITE, designated SEQ ID:869, to the nucleotide sequence of GAM148 RNA, herein designated GAM RNA, also designated SEQ ID:280.

Another function of GAM148 is therefore inhibition of Carboxypeptidase a4 (CPA4, Accession NP_057436.1). Accordingly, utilities of GAM148 include diagnosis, prevention and treatment of diseases and clinical conditions associated with CPA4.

Carboxypeptidase a6 (CPA6, Accession NP_065094.2) is another GAM148 target gene, herein designated TARGET GENE. CPA6 BINDING SITE is a target binding site found in the 5' untranslated region of mRNA encoded by CPA6, corresponding to a target binding site such as BINDING SITE I, BINDING SITE II or BINDING SITE III of FIG. 8. Table 4 illustrates the complementarity of the nucleotide sequences of CPA6 BINDING SITE, designated SEQ ID:5035, to the nucleotide sequence of GAM148 RNA, herein designated GAM RNA, also designated SEQ ID:280.

Another function of GAM148 is therefore inhibition of Carboxypeptidase a6 (CPA6, Accession NP_065094.2). Accordingly, utilities of GAM148 include diagnosis, prevention and treatment of diseases and clinical conditions associated with CPA6.

Deoxycytidine kinase (DCK, Accession NP_000779.1) is another GAM148 target gene, herein designated TARGET GENE. DCK BINDING SITE is a target binding site found in the 5' untranslated region of mRNA encoded by DCK, corresponding to a target binding site such as BINDING SITE I, BINDING SITE II or BINDING SITE III of FIG. 8. Table 4 illustrates the complementarity of the nucleotide sequences of DCK BINDING SITE, designated SEQ ID:18281, to the nucleotide sequence of GAM148 RNA, herein designated GAM RNA, also designated SEQ ID:280.

Another function of GAM148 is therefore inhibition of Deoxycytidine kinase (DCK, Accession NP_000779.1), a gene which mediates the phosphorylation of several deoxyribonucleosides and their analogs. Accordingly, utilities of GAM148 include diagnosis, prevention and treatment of diseases and clinical conditions associated with DCK.

The function of DCK has been established by previous studies. Deoxycytidine kinase (EC 2.7.1.74) is responsible for the phosphorylation of several deoxyribonucleosides and their analogs. Deficiency of this enzyme activity is associated with resistance to antiviral and anticancer chemotherapeutic agents, whereas increased enzyme activity is associated with increased activation of these compounds to cytotoxic nucleoside triphosphate derivatives. It is clinically important because of its relationship to drug resistance and sensitivity. It is the rate limiting enzyme in the activation of many important anticancer and retroviral drugs and its activity is often decreased in cells that are resistant to cytosine arabinoside. Huang et al. (1989) cloned the DCK gene. Similarities to previously studied proteins such as the beta subunit of prolyl-4-hydroxylase (OMIM Ref. No. 176790) were revealed. Chottiner et al. (1991) also cloned human deoxycytidine kinase from a T-lymphoblast DNA library. The cDNA sequence encoded a 30.5-kD protein corresponding to the subunit molecular mass of the purified protein. The authors of Huang et al. (1989) subsequently discovered that the sequence they had thought to represent DCK is in fact the human homolog of ERp72, the function of which is not yet known, and published a correction; the gene studied by Chottiner et al. (1991) is the true deoxycytidine kinase. Human deoxyribonucleoside kinases are required for the pharmacologic activity of several clinically important anticancer and antiviral nucleoside analogs. Human deoxycytidine kinase and thymidine kinase 1 (OMIM Ref. No. 188300) had been described as cytosolic enzymes, whereas human deoxyguanosine kinase (OMIM Ref. No. 601465) and thymidine kinase 2 (OMIM Ref. No. 188250) were believed to be located in the mitochondria. Johansson et al. (1997) expressed 4 human deoxyribonucleoside kinases as fusion proteins with the green fluorescent protein to study their intracellular locations in vivo. They found that the human deoxycytidine kinase is located in the cell nucleus, and the human deoxyguanosine kinase in mitochondria. The fusion proteins between green fluorescent protein and thymidine kinases 1 and 2 were both predominantly located in the cytosol. Site-directed mutagenesis of a putative nuclear targeting signal, identified in the primary structure of deoxycytidine kinase, completely abolished nuclear import of the protein. Reconstitution of a deoxycytidine kinase- deficient cell line with the wildtype nuclear or the mutant cytosolic enzymes restored sensitivity toward anticancer nucleoside analogs.

Full details of the abovementioned studies are described in the following publications, the disclosure of which are hereby incorporated by reference:

Chottiner, E. G.; Shewach, D. S.; Datta, N. S.; Ashcraft, E.; Gribbin, D.; Ginsburg, D.; Fox, I. H.; Mitchell, B. S.: Cloning and expression of human deoxycytidine kinase cDNA. Proc. Nat. Acad. Sci. 88:1531-1535, 1991; and Johansson, M.; Brismar, S.; Karlsson, A.: Human deoxycytidine kinase is located in the cell nucleus. Proc. Nat. Acad. Sci. 94:11941-11945, 1997.

Further studies establishing the function and utilities of DCK are found in John Hopkins OMIM database record ID 125450, and in cited publications listed in Table 5, which are hereby incorporated by reference. DKFZp434E2321 (Accession XP_038298.1) is another GAM148 target gene, herein designated TARGET GENE. DKFZp434E2321 BINDING SITE is a target binding site found in the 3' untranslated region of mRNA encoded by DKFZp434E2321, corresponding to a target binding site such as BINDING SITE I, BINDING SITE II or BINDING SITE III of FIG. 8. Table 4 illustrates the complementarity of the nucleotide sequences of DKFZp434E2321 BINDING SITE, designated SEQ ID:15968, to the nucleotide sequence of GAM148 RNA, herein designated GAM RNA, also designated SEQ ID:280.

Another function of GAM148 is therefore inhibition of DKFZp434E2321 (Accession XP_038298.1). Accordingly, utilities of GAM148 include diagnosis, prevention and treatment of diseases and clinical conditions associated with DKFZp434E2321.

DKFZp434H247 (Accession XP_290829.1) is another GAM148 target gene, herein designated TARGET GENE. DKFZp434H247 BINDING SITE is a target binding site found in the 3' untranslated region of mRNA encoded by DKFZp434H247, corresponding to a target binding site such as BINDING SITE I, BINDING SITE II or BINDING SITE III of FIG. 8. Table 4 illustrates the complementarity of the nucleotide sequences of DKFZp434H247 BINDING SITE, designated SEQ ID:13849, to the nucleotide sequence of GAM148 RNA, herein designated GAM RNA, also designated SEQ ID:280.

Another function of GAM148 is therefore inhibition of DKFZp434H247 (Accession XP_290829.1). Accordingly, utilities of GAM148 include diagnosis, prevention and treatment of diseases and clinical conditions associated with DKFZp434H247.

DKFZP434P0111 (Accession XP_041116.1) is another GAM148 target gene, herein designated TARGET GENE. DKFZP434P0111 BINDING SITE is a target binding site found in the 3' untranslated region of mRNA encoded by DKFZP434P0111, corresponding to a target binding site such as BINDING SITE I, BINDING SITE II or BINDING SITE III of FIG. 8. Table 4 illustrates the complementarity of the nucleotide sequences of DKFZP434P0111 BINDING SITE, designated SEQ ID:7184, to the nucleotide sequence of GAM148 RNA, herein designated GAM RNA, also designated SEQ ID:280.

Another function of GAM148 is therefore inhibition of DKFZP434P0111 (Accession XP_041116.1). Accordingly, utilities of GAM148 include diagnosis, prevention and treatment of diseases and clinical conditions associated with DKFZP434P0111.

DKFZP434P0316 (Accession NP_115510.1) is another GAM148 target gene, herein designated TARGET GENE. DKFZP434P0316 BINDING SITE is a target binding site found in the 3' untranslated region of mRNA encoded by DKFZP434P0316, corresponding to a target binding site such as BINDING SITE I, BINDING SITE II or BINDING SITE III of FIG. 8. Table 4 illustrates the complementarity of the nucleotide sequences of DKFZP434P0316 BINDING SITE, designated SEQ ID:5600, to the nucleotide sequence of GAM148 RNA, herein designated GAM RNA, also designated SEQ ID:280.

Another function of GAM148 is therefore inhibition of DKFZP434P0316 (Accession NP_115510.1). Accordingly, utilities of GAM148 include diagnosis, prevention and treatment of diseases and clinical conditions associated with DKFZP434P0316.

DKFZP586M1523 (Accession NP_056291.1) is another GAM148 target gene, herein designated TARGET GENE. DKFZP586M1523 BINDING SITE is a target binding site found in the 3' untranslated region of mRNA encoded by DKFZP586M1523, corresponding to a target binding site such as BINDING SITE I, BINDING SITE II or BINDING SITE III of FIG. 8. Table 4 illustrates the complementarity of the nucleotide sequences of DKFZP586M1523 BINDING SITE, designated SEQ ID:7790, to the nucleotide sequence of GAM148 RNA, herein designated GAM RNA, also designated SEQ ID:280.

Another function of GAM148 is therefore inhibition of DKFZP586M1523 (Accession NP_056291.1). Accordingly, utilities of GAM148 include diagnosis, prevention and treatment of diseases and clinical conditions associated with DKFZP586M1523.

Dopamine receptor d1 (DRD1, Accession NP_000785.1) is another GAM148 target gene, herein designated TARGET GENE. DRD1 BINDING SITE is a target binding site found in the 3' untranslated region of mRNA encoded by DRD1, corresponding to a target binding site such as BINDING SITE I, BINDING SITE II or BINDING SITE III of FIG. 8. Table 4 illustrates the complementarity of the nucleotide sequences of DRD1 BINDING SITE, designated SEQ ID:2684, to the nucleotide sequence of GAM148 RNA, herein designated GAM RNA, also designated SEQ ID:280.

Another function of GAM148 is therefore inhibition of Dopamine receptor d1 (DRD1, Accession NP_000785.1), a gene which is mediated by g proteins which activate adenylyl cyclase. Accordingly, utilities of GAM148 include diagnosis, prevention and treatment of diseases and clinical conditions associated with DRD1.

The function of DRD1 has been established by previous studies. The diverse physiologic actions of dopamine are mediated by its interaction with 2 types of G protein-coupled receptor, D1 and D2 (OMIM Ref. No. 126450), which stimulate and inhibit, respectively, the enzyme adenylyl cyclase. Three groups reported the cloning of the D1 dopamine receptor gene (Dearry et al., 1990; Zhou et al., 1990; Sunahara et al., 1990). The gene encodes a protein of 446 amino acids having a predicted relative molecular mass of 49,300 and a transmembrane topology similar to that of other G protein-coupled receptors. Northern blot analysis and in situ hybridization showed that the mRNA for this receptor is most abundant in caudate, nucleus accumbens, and olfactory tubercle, with little or no mRNA detectable in substantia nigra, liver, kidney, or heart (Dearry et al., 1990).

Animal model experiments lend further support to the function of DRD1. The brain dopaminergic system is a critical modulator of basal ganglion function and plasticity. To investigate the contribution of the dopamine D1 receptor to this modulation, Xu et al. (1994) used gene targeting technology to generate D1 receptor mutant mice. Although histologic analyses suggested no major changes in the anatomy of mutant mouse brains, the expression of dynorphin (OMIM Ref. No. 131340) was greatly reduced in the striatum and related regions of the basal ganglia. The mutant mice did not respond to the stimulant and suppressive effects of D1 receptor agonists and antagonists, respectively, and they exhibited locomotor hyperactivity.

It is appreciated that the abovementioned animal model for DRD1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Dearry, A.; Gingrich, J. A.; Falardeau, P.; Fremeau, R. T., Jr.; Bates, M. D.; Caron, M. G.: Molecular cloning and expression of the gene for a human D(1) dopamine receptor. Nature 347:72-76, 1990; and Xu, M.; Moratalla, R.; Gold, L. H.; Hiroi, N.; Koob, G. F.; Graybiel, A. M.; Tonegawa, S.: Dopamine D1 receptor mutant mice are deficient in striatal expression of dynorphin and in do.

Further studies establishing the function and utilities of DRD1 are found in John Hopkins OMIM database record ID 126449, and in cited publications listed in Table 5, which are hereby incorporated by reference. Dopamine receptor d2 (DRD2, Accession NP_000786.1) is another GAM148 target gene, herein designated TARGET GENE. DRD2 BINDING SITE is a target binding site found in the 3' untranslated region of multiple transcripts of mRNA encoded by DRD2, corresponding to a target binding site such as BINDING SITE I, BINDING SITE II or BINDING SITE III of FIG. 8. Table 4 illustrates the complementarity of the nucleotide sequences of DRD2 BINDING SITE, designated SEQ ID:2357, to the nucleotide sequence of GAM148 RNA, herein designated GAM RNA, also designated SEQ ID:280.

Another function of GAM148 is therefore inhibition of Dopamine receptor d2 (DRD2, Accession NP_000786.1), a gene which has a key role in the control of movement. and therefore may be associated with Hereditary autosomal dominant myoclonus dystonia. Accordingly, utilities of GAM148 include diagnosis, prevention and treatment of Hereditary autosomal dominant myoclonus dystonia, and of other diseases and clinical conditions associated with DRD2.

The function of DRD2 has been established by previous studies. Bunzow et al. (1988) cloned the rat gene for D2 dopamine receptor. Grandy et al. (1989) cloned the human gene from a pituitary cDNA library. The deduced protein sequence is 96% identical to that of the rat receptor with 1 major difference: the human receptor contains an additional 29 amino acids in its putative third cytoplasmic loop. Southern blot analysis demonstrated the presence of only 1 human DRD2 gene. The coding sequence is interrupted by 6 introns. The additional amino acids present in the human pituitary receptor are encoded by a single exon of 87 basepairs. Eubanks et al. (1992) found that the DRD2 gene extends over 270 kb and includes an intron of approximately 250 kb separating the putative first exon from the exons encoding the receptor protein. They prepared a physical map spanning more than 1.5 Mb of chromosome 11q23, which demonstrated that the neural cell adhesion molecule gene (NCAM; 116930) is located 150 kb 3-prime of the DRD2 gene and is transcribed from the same DNA strand. High resolution fluorescence in situ suppression hybridization using cosmid and YAC clones localized these genes between the APOA1 and STMY genes at the interface of 11q22.3 and 11q23.1. In situ hybridization studies showed, furthermore, that the DRD2/NCAM complex resides telomeric to the STMY1 gene and centromeric of the APOA1 gene.

Animal model experiments lend further support to the function of DRD2. Balk et al. (1995) used homologous recombination to generate D2-receptor-deficient mice. Absence of D2 receptors led to animals that were akinetic and bradykinetic in behavioral tests and showed significantly reduced spontaneous movements. The phenotype resembled Parkinson disease. Maldonado et al. (1997) studied the behavior of DRD2 knockout mice and showed that there was a total suppression of rewarding behavior with morphine. In contrast, these animals showed normal responses when food was used as a reward.

It is appreciated that the abovementioned animal model for DRD2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Eubanks, J. H.; Djabali, M.; Selleri, L.; Grandy, D. K.; Civelli, O.; McElligott, D. L.; Evans, G. A.: Structure and linkage of the D2 dopamine receptor and neural cell adhesion molecule genes on human chromosome 11q23. Genomics 14:1010-1018, 1992; and Maldonado, R.; Salardi, A.; Valverde, O.; Samad, T. A.; Roques, B. P.; Borrelli, E.: Absence of opiate rewarding effects in mice lacking dopamine D2 receptors. Nature 388: 586-589, 19.

Further studies establishing the function and utilities of DRD2 are found in John Hopkins OMIM database record ID 126450, and in cited publications listed in Table 5, which are hereby incorporated by reference. Dopamine receptor d2 (DRD2, Accession NP_057658.2) is another GAM148 target gene, herein designated TARGET GENE. DRD2 BINDING SITE is a target binding site found in the 3' untranslated region of multiple transcripts of mRNA encoded by DRD2, corresponding to a target binding site such as BINDING SITE I, BINDING SITE II or BINDING SITE III of FIG. 8. Table 4 illustrates the complementarity of the nucleotide sequences of DRD2 BINDING SITE, designated SEQ ID:2357, to the nucleotide sequence of GAM148 RNA, herein designated GAM RNA, also designated SEQ ID:280.

Another function of GAM148 is therefore inhibition of Dopamine receptor d2 (DRD2, Accession NP_057658.2), a gene which has a key role in the control of movement. and therefore may be associated with Hereditary autosomal dominant myoclonus dystonia. Accordingly, utilities of GAM148 include diagnosis, prevention and treatment of Hereditary autosomal dominant myoclonus dystonia, and of other diseases and clinical conditions associated with DRD2.

The function of DRD2 has been established by previous studies. Bunzow et al. (1988) cloned the rat gene for D2 dopamine receptor. Grandy et al. (1989) cloned the human gene from a pituitary cDNA library. The deduced protein sequence is 96% identical to that of the rat receptor with 1 major difference: the human receptor contains an additional 29 amino acids in its putative third cytoplasmic loop. Southern blot analysis demonstrated the presence of only 1 human DRD2 gene. The coding sequence is interrupted by 6 introns. The additional amino acids present in the human pituitary receptor are encoded by a single exon of 87 basepairs. Eubanks et al. (1992) found that the DRD2 gene extends over 270 kb and includes an intron of approximately 250 kb separating the putative first exon from the exons encoding the receptor protein. They prepared a physical map spanning more than 1.5 Mb of chromosome 11q23, which demonstrated that the neural cell adhesion molecule gene (NCAM; 116930) is located 150 kb 3-prime of the DRD2 gene and is transcribed from the same DNA strand. High resolution fluorescence in situ suppression hybridization using cosmid and YAC clones localized these genes between the APOA1 and STMY genes at the interface of 11q22.3 and 11q23.1. In situ hybridization studies showed, furthermore, that the DRD2/NCAM complex resides telomeric to the STMY1 gene and centromeric of the APOA1 gene.

Animal model experiments lend further support to the function of DRD2. Balk et al. (1995) used homologous recombination to generate D2-receptor- deficient mice. Absence of D2 receptors led to animals that were akinetic and bradykinetic in behavioral tests and showed significantly reduced spontaneous movements. The phenotype resembled Parkinson disease. Maldonado et al. (1997) studied the behavior of DRD2 knockout mice and showed that there was a total suppression of rewarding behavior with morphine. In contrast, these animals showed normal responses when food was used as a reward.

It is appreciated that the abovementioned animal model for DRD2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Eubanks, J. H.; Djabali, M.; Selleri, L.; Grandy, D. K.; Civelli, O.; McElligott, D. L.; Evans, G. A.: Structure and linkage of the D2 dopamine receptor and neural cell adhesion molecule genes on human chromosome 11q23. Genomics 14:1010-1018, 1992; and Maldonado, R.; Salardi, A.; Valverde, O.; Samad, T. A.; Roques, B. P.; Borrelli, E. : Absence of opiate rewarding effects in mice lacking dopamine D2 receptors. Nature 388: 586-589, 19.

Further studies establishing the function and utilities of DRD2 are found in John Hopkins OMIM database record ID 126450, and in cited publications listed in Table 5, which are hereby incorporated by reference. Egf-like-domain, multiple 4 (EGFL4, Accession XP_290821.1) is another GAM148 target gene, herein designated TARGET GENE. EGFL4 BINDING SITE is a target binding site found in the 3' untranslated region of mRNA encoded by EGFL4, corresponding to a target binding site such as BINDING SITE I, BINDING SITE II or BINDING SITE III of FIG. 8. Table 4 illustrates the complementarity of the nucleotide sequences of EGFL4 BINDING SITE, designated SEQ ID:14622, to the nucleotide sequence of GAM148 RNA, herein designated GAM RNA, also designated SEQ ID:280.

Another function of GAM148 is therefore inhibition of Egf-like-domain, multiple 4 (EGFL4, Accession XP_290821.1). Accordingly, utilities of GAM148 include diagnosis, prevention and treatment of diseases and clinical conditions associated with EGFL4.

Egl nine homolog 2 (c. elegans) (EGLN2, Accession NP_060025.1) is another GAM148 target gene, herein designated TARGET GENE. EGLN2 BINDING SITE is a target binding site found in the 5' untranslated region of multiple transcripts of mRNA encoded by EGLN2, corresponding to a target binding site such as BINDING SITE I, BINDING SITE II or BINDING SITE III of FIG. 8. Table 4 illustrates the complementarity of the nucleotide sequences of EGLN2 BINDING SITE, designated SEQ ID:15451, to the nucleotide sequence of GAM148 RNA, herein designated GAM RNA, also designated SEQ ID:280.

Another function of GAM148 is therefore inhibition of Egl nine homolog 2 (c. elegans) (EGLN2, Accession NP_060025.1), a gene which is an essential component of the pathway. Accordingly, utilities of GAM148 include diagnosis, prevention and treatment of diseases and clinical conditions associated with EGLN2.

The function of EGLN2 and its association with various diseases and clinical conditions, has been established by previous studies, as described hereinabove with reference to GAM71.1. Early growth response 2 (krox-20 homolog, drosophila) (EGR2, Accession NP_000390.2) is another GAM148 target gene, herein designated TARGET GENE. EGR2 BINDING SITE is a target binding site found in the 3' untranslated region of mRNA encoded by EGR2, corresponding to a target binding site such as BINDING SITE I, BINDING SITE II or BINDING SITE III of FIG. 8. Table 4 illustrates the complementarity of the nucleotide sequences of EGR2 BINDING SITE, designated SEQ ID:791, to the nucleotide sequence of GAM148 RNA, herein designated GAM RNA, also designated SEQ ID:280.

Another function of GAM148 is therefore inhibition of Early growth response 2 (krox-20 homolog, drosophila) (EGR2, Accession NP_000390.2), a gene which binds to two specific dna sites located in the promoter region of hox-1.4. and therefore is associated with Congenital hypomyelination, charcot-marie- tooth desease type 1, dejerine-sottas syndrome. Accordingly, utilities of GAM148 include diagnosis, prevention and treatment of Congenital hypomyelination, charcot-marie- tooth desease type 1, dejerine-sottas syndrome, and of other diseases and clinical conditions associated with EGR2.

The function of EGR2 has been established by previous studies. Timmerman et al. (1999) screened 170 unrelated neuropathy patients and identified 2 with Dejerine-Sottas neuropathy (DSN; 145900) who had a heterozygous R359W mutation (129010.0004) in the alpha-helix domain of the first zinc finger of EGR2. Boerkoel et al. (2001) reported 2 additional DSN patients with the R359W mutation and suggested that it is the most common neuropathy-associated EGR2 mutation and consistently causes DSN. The expressivity ranged from that typical for DSN to a more rapidly progressive neuropathy that can cause death by age 6 years. Furthermore, in contrast to patients with typical DSN, patients with the EGR2 R359W mutation had more respiratory compromise and cranial nerve involvement.

Animal model experiments lend further support to the function of EGR2. Congenital hypomyelinating neuropathy (CHN; 605253) is characterized clinically by early onset of hypotonia, areflexia, distal muscle weakness, and very slow nerve conduction velocities. Warner et al. (1997, 1998) noted that pathologic findings on sural nerve biopsies show hypomyelination of most or all fibers. Based on these findings, CHN is considered to be a result of congenital impairment in myelin formation. The disorder is inherited as an autosomal recessive. The EGR2 gene attracted the attention of Warner et al. (1997, 1998) as a potential candidate for CHN because of the expression and knockout phenotype of its mouse homolog, Krox20. Krox20, a member of a multigene family of zinc finger proteins, is thought to function as an immediate early protein with basal expression in selected neuronal populations of the central and peripheral nervous systems. Krox20 knockout mice showed disrupted hindbrain segmentation and development and a block of Schwann cells at an early stage of differentiation as evidenced by the fact that the expression of early myelin genes, such as myelin-associated glycoprotein (OMIM Ref. No. 159460), are barely affected while the expression of the late myelin genes, myelin basic protein (OMIM Ref. No. 159430) and myelin protein zero (MPZ; 159440), are decreased or absent.

It is appreciated that the abovementioned animal model for EGR2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Timmerman, V.; De Jonghe, P.; Ceuterick, C.; De Vriendt, E.; Lofgren, A.; Nelis, E.; Warner, L. E.; Lupski, J. R.; Martin, J.-J.; Van Broeckhoven, C.: Novel missense mutation in the early growth response 2 gene associated with Dejerine-Sottas syndrome phenotype. Neurology 52:1827-1832, 1999; and Warner, L. E.; Mancias, P.; Butler, I. J.; McDonald, C. M.; Keppen, L.; Koob, K. G.; Lupski, J. R.: Mutations in the early growth response 2 (EGR2) gene are associated with hereditary.

Further studies establishing the function and utilities of EGR2 are found in John Hopkins OMIM database record ID 129010, and in cited publications listed in Table 5, which are hereby incorporated by reference. Elongation of very long chain fatty acids (fen1/elo2, sur4/elo3, yeast)-like 3 (ELOVL3, Accession NP_689523.1) is another GAM148 target gene, herein designated TARGET GENE. ELOVL3 BINDING SITE is a target binding site found in the 3' untranslated region of mRNA encoded by ELOVL3, corresponding to a target binding site such as BINDING SITE I, BINDING SITE II or BINDING SITE III of FIG. 8. Table 4 illustrates the complementarity of the nucleotide sequences of ELOVL3 BINDING SITE, designated SEQ ID:14478, to the nucleotide sequence of GAM148 RNA, herein designated GAM RNA, also designated SEQ ID:280.

Another function of GAM148 is therefore inhibition of Elongation of very long chain fatty acids (fen1/elo2, sur4/elo3, yeast)-like 3 (ELOVL3, Accession NP_689523.1). Accordingly, utilities of GAM148 include diagnosis, prevention and treatment of diseases and clinical conditions associated with ELOVL3.

Eyes absent homolog 2 (drosophila) (EYA2, Accession NP_742109.1) is another GAM148 target gene, herein designated TARGET GENE. EYA2 BINDING SITE is a target binding site found in the 5' untranslated region of multiple transcripts of mRNA encoded by EYA2, corresponding to a target binding site such as BINDING SITE I, BINDING SITE II or BINDING SITE III of FIG. 8. Table 4 illustrates the complementarity of the nucleotide sequences of EYA2

BINDING SITE, designated SEQ ID:15962, to the nucleotide sequence of GAM148 RNA, herein designated GAM RNA, also designated SEQ ID:280.

Another function of GAM148 is therefore inhibition of Eyes absent homolog 2 (drosophila) (EYA2, Accession NP_742109.1), a gene which may be involved in development of the eye. Accordingly, utilities of GAM148 include diagnosis, prevention and treatment of diseases and clinical conditions associated with EYA2.

The function of EYA2 has been established by previous studies. Abdelhak et al. (1997) identified, by positional cloning, a gene at 8q13.3, which contains mutations in patients with branchiootorenal dysplasia (BOR; 113650). The gene is a human homolog of the Drosophila 'eyes absent' (eya), and was therefore called EYA1 (OMIM Ref. No. 601653). A highly conserved 271-amino acid C-terminal region was also found in the products of 2 other human genes that were subsequently called EYA2 and EYA3 (OMIM Ref. No. 601655), demonstrating the existence of a novel gene family. Some of these other members of the EYA gene family may underlie developmental defects because Abdelhak et al. (1997) demonstrated that all 3 of these genes are expressed in the ninth week of human development. Gene identification strategies that rely on cross-species comparison are based on the observation that functionally significant regions of the genome are highly conserved during evolution. Banfi et al. (1996) applied the power of Drosophila genetics to the vast resource of human cDNAs represented in the expressed sequence tag (EST) database to identify novel human genes of biologic interest. One human cDNA (GenBank H07988) showing significant homology to the gene causing the Drosophila mutant phenotype 'clift' ('eyes absent') was reported by Abdelhak et al. (1997) to be the EYA2 gene. Banfi et al. (1996) mapped the human gene to 20q13.1 using both fluorescence in situ hybridization and radiation hybrid mapping. Zimmerman et al. (1997) mapped the mouse Eya2 gene to chromosome 2 in a region syntenic with human 20q13. Duncan et al. (1997) likewise mapped EYA2 to human 20q13.1 and Eya2 to mouse chromosome 2. Duncan et al. (1997) found that Eya2 shows a dynamic pattern of expression during mouse development. Its expression was first detected in 8.5-day embryos in the region of head ectoderm fated to become the forebrain. At later stages of development, Eya2 was expressed in the olfactory placode and in a variety of neural crest derivatives. In the ey, expression of Eya2 was first detected after formation of the lens vesicle. At day 17.5, the highest level of Eya2 mRNA was observed in primary lens fibers. Low levels of Eya2 expression were detected in retina, sclera, and cornea. Duncan et al. (1997) stated that, although Eya2 is expressed relatively late in eye development, it belongs to a growing list of factors that may be essential for eye development among metazoan phyla. Like members of the PAX6 gene family (see OMIM Ref. No. 607108), 'eyes absent' gene family members were probably first involved in functions not related to vision, with recruitment for visual system formation and function occurring later. Xu et al. (1997) showed that in the limbs of 10.5-day mouse embryos, Eya1 expression was largely restricted to the flexor tendons, whereas Eya2 was expressed in the extensor tendons and probably also in the ligaments of the phalanges. They demonstrated that the proline/serine/threonine-rich N-terminal regions of the protein products of the Eya1, Eya2, and Eya3 genes have transcriptional activator activity. These results supported a role for the Eya genes in connective tissue patterning in the limbs.

Full details of the abovementioned studies are described in the following publications, the disclosure of which are hereby incorporated by reference:

Abdelhak, S.; Kalatzis, V.; Heilig, R.; Compain, S.; Samson, D.; Vincent, C.; Weil, D.; Cruaud, C.; Sahly, I.; Leibovici, M.; Bitner-Glindzicz, M.; Francis, M.; Lacombe, D.; Vigneron, J.; Charachon, R.; Boven, K.; Bedbeder, P.; Van Regemorter, N.; Weissenbach, J.; Petit, C.: A human homologue of the Drosophila eyes absent gene underlies branchio-oto-renal (BOR) syndrome and identifies a novel gene family. Nature Genet. 15:157-164, 1997; and Xu, P.-X.; Cheng, J.; Epstein, J. A.; Maas, R. L.: Mouse Eya genes are expressed during limb tendon development and encode a transcriptional activation function. Proc. Nat. Acad. Sci. 9.

Further studies establishing the function and utilities of EYA2 are found in John Hopkins OMIM database record ID 601654, and in cited publications listed in Table 5, which are hereby incorporated by reference. FLJ00024 (Accession NP_203745.1) is another GAM148 target gene, herein designated TARGET GENE. FLJ00024 BINDING SITE is a target binding site found in the 3' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:5939, to the nucleotide sequence of GAM148 RNA, herein designated GAM RNA, also designated SEQ ID:280.

Another function of GAM148 is therefore inhibition of FLJ00024 (Accession NP_203745.1). Accordingly, utilities of GAM148 include diagnosis, prevention and treatment of diseases and clinical conditions associated with FLJ00024.

FLJ00024 (Accession XP_033361.2) is another GAM148 target gene, herein designated TARGET GENE. FLJ00024 BINDING SITE is a target binding site found in the 3' untranslated region of multiple transcripts of mRNA encoded by FLJ00024, corresponding to a target binding site such as BINDING SITE I, BINDING SITE II or BINDING SITE III of FIG. 8. Table 4 illustrates the complementarity of the nucleotide sequences of FLJ00024 BINDING SITE, designated SEQ ID:5939, to the nucleotide sequence of GAM148 RNA, herein designated GAM RNA, also designated SEQ ID:280.

Another function of GAM148 is therefore inhibition of FLJ00024 (Accession XP_033361.2). Accordingly, utilities of GAM148 include diagnosis, prevention and treatment of diseases and clinical conditions associated with FLJ00024.

FLJ10035 (Accession NP_110430.4) is another GAM148 target gene, herein designated TARGET GENE. FLJ10035 BINDING SITE is a target binding site found in the 3' untranslated region of multiple transcripts of mRNA encoded by FLJ10035, corresponding to a target binding site such as BINDING SITE I, BINDING SITE II or BINDING SITE III of FIG. 8. Table 4 illustrates the complementarity of the nucleotide sequences of FLJ10035 BINDING SITE, designated SEQ ID:7021, to the nucleotide sequence of GAM148 RNA, herein designated GAM RNA, also designated SEQ ID:280.

Another function of GAM148 is therefore inhibition of FLJ10035 (Accession NP_110430.4). Accordingly, utilities of GAM148 include diagnosis, prevention and treatment of diseases and clinical conditions associated with FLJ10035.

FLJ10496 (Accession NP_060584.2) is another GAM148 target gene, herein designated TARGET GENE. FLJ10496 BINDING SITE is a target binding site found in the 3' untranslated region of mRNA encoded by FLJ10496, corresponding to a target binding site such as BINDING SITE I, BINDING SITE II or BINDING SITE III of FIG. 8. Table 4 illustrates the complementarity of the nucleotide sequences of FLJ10496 BINDING SITE, designated SEQ ID:11635, to the nucleotide sequence of GAM148 RNA, herein designated GAM RNA, also designated SEQ ID:280.

Another function of GAM148 is therefore inhibition of FLJ10496 (Accession NP_060584.2). Accordingly, utilities of GAM148 include diagnosis, prevention and treatment of diseases and clinical conditions associated with FLJ10496.

FLJ14451 (Accession NP_116175.1) is another GAM148 target gene, herein designated TARGET GENE. FLJ14451 BINDING SITE is a target binding site found in the 3' untranslated region of mRNA encoded by FLJ14451, corresponding to a target binding site such as BINDING SITE I, BINDING SITE II or BINDING SITE III of FIG. 8. Table 4 illustrates the complementarity of the nucleotide sequences of FLJ14451 BINDING SITE, designated SEQ ID:19096, to the nucleotide sequence of GAM148 RNA, herein designated GAM RNA, also designated SEQ ID:280.

Another function of GAM148 is therefore inhibition of FLJ14451 (Accession NP_116175.1). Accordingly, utilities of GAM148 include diagnosis, prevention and treatment of diseases and clinical conditions associated with FLJ14451.

FLJ14775 (Accession NP_116226.1) is another GAM148 target gene, herein designated TARGET GENE. FLJ14775 BINDING SITE is a target binding site found in the 5' untranslated region of mRNA encoded by FLJ14775, corresponding to a target binding site such as BINDING SITE I, BINDING SITE II or BINDING SITE III of FIG. 8. Table 4 illustrates the complementarity of the nucleotide sequences of FLJ14775 BINDING SITE, designated SEQ ID:18575, to the nucleotide sequence of GAM148 RNA, herein designated GAM RNA, also designated SEQ ID:280.

Another function of GAM148 is therefore inhibition of FLJ14775 (Accession NP_116226.1). Accordingly, utilities of GAM148 include diagnosis, prevention and treatment of diseases and clinical conditions associated with FLJ14775.

FLJ20273 (Accession NP_061900.1) is another GAM148 target gene, herein designated TARGET GENE. FLJ20273 BINDING SITE is a target binding site found in the 3' untranslated region of mRNA encoded by FLJ20273, corresponding to a target binding site such as BINDING SITE I, BINDING SITE II or BINDING SITE III of FIG. 8. Table 4 illustrates the complementarity of the nucleotide sequences of FLJ20273 BINDING SITE, designated SEQ ID:9599, to the nucleotide sequence of GAM148 RNA, herein designated GAM RNA, also designated SEQ ID:280.

Another function of GAM148 is therefore inhibition of FLJ20273 (Accession NP_061900.1). Accordingly, utilities of GAM148 include diagnosis, prevention and treatment of diseases and clinical conditions associated with FLJ20273.

FLJ21919 (Accession NP_075391.2) is another GAM148 target gene, herein designated TARGET GENE. FLJ21919 BINDING SITE is a target binding site found in the 3' untranslated region of mRNA encoded by FLJ21919, corresponding to a target binding site such as BINDING SITE I, BINDING SITE II or BINDING SITE III of FIG. 8. Table 4 illustrates the complementarity of the nucleotide sequences of FLJ21919 BINDING SITE, designated SEQ ID:19653, to the nucleotide sequence of GAM148 RNA, herein designated GAM RNA, also designated SEQ ID:280.

Another function of GAM148 is therefore inhibition of FLJ21919 (Accession NP_075391.2). Accordingly, utilities of GAM148 include diagnosis, prevention and treatment of diseases and clinical conditions associated with FLJ21919.

FLJ23033 (Accession NP_078962.2) is another GAM148 target gene, herein designated TARGET GENE. FLJ23033 BINDING SITE is a target binding site found in the 3' untranslated region of mRNA encoded by FLJ23033, corresponding to a target binding site such as BINDING SITE I, BINDING SITE II or BINDING SITE III of FIG. 8. Table 4 illustrates the complementarity of the nucleotide sequences of FLJ23033 BINDING SITE, designated SEQ ID:496, to the nucleotide sequence of GAM148 RNA, herein designated GAM RNA, also designated SEQ ID:280.

Another function of GAM148 is therefore inhibition of FLJ23033 (Accession NP_078962.2). Accordingly, utilities of GAM148 include diagnosis, prevention and treatment of diseases and clinical conditions associated with FLJ23033.

FLJ31100 (Accession NP_775902.1) is another GAM148 target gene, herein designated TARGET GENE. FLJ31100 BINDING SITE is a target binding site found in the 5' untranslated region of mRNA encoded by FLJ31100, corresponding to a target binding site such as BINDING SITE I, BINDING SITE II or BINDING SITE III of FIG. 8. Table 4 illustrates the complementarity of the nucleotide sequences of FLJ31100 BINDING SITE, designated SEQ ID:17843, to the nucleotide sequence of GAM148 RNA, herein designated GAM RNA, also designated SEQ ID:280.

Another function of GAM148 is therefore inhibition of FLJ31100 (Accession NP_775902.1). Accordingly, utilities of GAM148 include diagnosis, prevention and treatment of diseases and clinical conditions associated with FLJ31100.

FLJ32468 (Accession NP_660090.1) is another GAM148 target gene, herein designated TARGET GENE. FLJ32468 BINDING SITE is a target binding site found in the 3' untranslated region of mRNA encoded by FLJ32468, corresponding to a target binding site such as BINDING SITE I, BINDING SITE II or BINDING SITE III of FIG. 8. Table 4 illustrates the complementarity of the nucleotide sequences of FLJ32468 BINDING SITE, designated SEQ ID:3196, to the nucleotide sequence of GAM148 RNA, herein designated GAM RNA, also designated SEQ ID:280.

Another function of GAM148 is therefore inhibition of FLJ32468 (Accession NP_660090.1). Accordingly, utilities of GAM148 include diagnosis, prevention and treatment of diseases and clinical conditions associated with FLJ32468.

FLJ32780 (Accession NP_659402.1) is another GAM148 target gene, herein designated TARGET GENE. FLJ32780 BINDING SITE is a target binding site found in the 3' untranslated region of mRNA encoded by FLJ32780, corresponding to a target binding site such as BINDING SITE I, BINDING SITE II or BINDING SITE III of FIG. 8. Table 4 illustrates the complementarity of the nucleotide sequences of FLJ32780 BINDING SITE, designated SEQ ID:20150, to the nucleotide sequence of GAM148 RNA, herein designated GAM RNA, also designated SEQ ID:280.

Another function of GAM148 is therefore inhibition of FLJ32780 (Accession NP_659402.1). Accordingly, utilities of GAM148 include diagnosis, prevention and treatment of diseases and clinical conditions associated with FLJ32780.

FLJ35487 (Accession NP_776181.1) is another GAM148 target gene, herein designated TARGET GENE. FLJ35487 BINDING SITE is a target binding site found in the 3' untranslated region of mRNA encoded by FLJ35487, corresponding to a target binding site such as BINDING SITE I, BINDING SITE II or BINDING SITE III of FIG. 8. Table 4 illustrates the complementarity of the nucleotide sequences of FLJ35487 BINDING SITE, designated SEQ ID:18431, to the nucleotide sequence of GAM148 RNA, herein designated GAM RNA, also designated SEQ ID:280.

Another function of GAM148 is therefore inhibition of FLJ35487 (Accession NP_776181.1). Accordingly, utilities of GAM148 include diagnosis, prevention and treatment of diseases and clinical conditions associated with FLJ35487.

FLJ40584 (Accession XP_069189.2) is another GAM148 target gene, herein designated TARGET GENE. FLJ40584 BINDING SITE is a target binding site found in the 3' untranslated region of mRNA encoded by FLJ40584, corresponding to a target binding site such as BINDING SITE I, BINDING SITE II or BINDING SITE III of FIG. 8. Table 4 illustrates the complementarity of the nucleotide sequences of FLJ40584 BINDING SITE, designated SEQ ID:10385, to the nucleotide sequence of GAM148 RNA, herein designated GAM RNA, also designated SEQ ID:280.

Another function of GAM148 is therefore inhibition of FLJ40584 (Accession XP_069189.2). Accordingly, utilities of GAM148 include diagnosis, prevention and treatment of diseases and clinical conditions associated with FLJ40584.

Glutamic pyruvate transaminase (alanine aminotransferase) 2 (GPT2, Accession NP_597700.1) is another GAM148 target gene, herein designated TARGET GENE. GPT2 BINDING SITE is a target binding site found in the 3' untranslated region of mRNA encoded by GPT2, corresponding to a target binding site such as BINDING SITE I, BINDING SITE II or BINDING SITE III of FIG. 8. Table 4 illustrates the complementarity of the nucleotide sequences of GPT2 BINDING SITE, designated SEQ ID:580, to the nucleotide sequence of GAM148 RNA, herein designated GAM RNA, also designated SEQ ID:280.

Another function of GAM148 is therefore inhibition of Glutamic pyruvate transaminase (alanine aminotransferase) 2 (GPT2, Accession NP_597700.1). Accordingly, utilities of GAM148 include diagnosis, prevention and treatment of diseases and clinical conditions associated with GPT2.

GRTP1 (Accession NP_078995.1) is another GAM148 target gene, herein designated TARGET GENE. GRTP1 BINDING SITE is a target binding site found in the 3' untranslated region of mRNA encoded by GRTP1, corresponding to a target binding site such as BINDING SITE I, BINDING SITE II or BINDING SITE III of FIG. 8. Table 4 illustrates the complementarity of the nucleotide sequences of GRTP1 BINDING SITE, designated SEQ ID:6509, to the nucleotide sequence of GAM148 RNA, herein designated GAM RNA, also designated SEQ ID:280.

Another function of GAM148 is therefore inhibition of GRTP1 (Accession NP_078995.1). Accordingly, utilities of GAM148 include diagnosis, prevention and treatment of diseases and clinical conditions associated with GRTP1.

Huntingtin interacting protein 2 (HIP2, Accession NP_005330.1) is another GAM148 target gene, herein designated TARGET GENE. HIP2 BINDING SITE is a target binding site found in the 3' untranslated region of mRNA encoded by HIP2, corresponding to a target binding site such as BINDING SITE I, BINDING SITE II or BINDING SITE III of FIG. 8. Table 4 illustrates the complementarity of the nucleotide sequences of HIP2 BINDING SITE, designated SEQ ID:8300, to the nucleotide sequence of GAM148 RNA, herein designated GAM RNA, also designated SEQ ID:280.

Another function of GAM148 is therefore inhibition of Huntingtin interacting protein 2 (HIP2, Accession NP_005330.1). Accordingly, utilities of GAM148 include diagnosis, prevention and treatment of diseases and clinical conditions associated with HIP2.

Homeo box a7 (HOXA7, Accession NP_008827.2) is another GAM148 target gene, herein designated TARGET GENE. HOXA7 BINDING SITE is a target binding site found in the 3' untranslated region of mRNA encoded by HOXA7, corresponding to a target binding site such as BINDING SITE I, BINDING SITE II or BINDING SITE III of FIG. 8. Table 4 illustrates the complementarity of the nucleotide sequences of HOXA7 BINDING SITE, designated SEQ ID:6135, to the nucleotide sequence of GAM148 RNA, herein designated GAM RNA, also designated SEQ ID:280.

Another function of GAM148 is therefore inhibition of Homeo box a7 (HOXA7, Accession NP_008827.2), a gene which provides cells with specific positional identities on the anterior-posterior axis. Accordingly, utilities of GAM148 include diagnosis, prevention and treatment of diseases and clinical conditions associated with HOXA7.

The function of HOXA7 has been established by previous studies. The homeotic genes, whose products serve as determinants of embryonic cell fate, are expressed in a series of different but partially overlapping domains that extend along the anterior- posterior (A-P) axis of the embryo. The Hox genes share a 180-bp homeo box, which encodes a 60-amino acid homeodomain that binds specifically to DNA. There are 4 Hox gene clusters: HOXA (formerly HOX1) on chromosome 7, HOXB (formerly HOX2) on chromosome 17, HOXC (formerly HOX3) on chromosome 12, and HOXD (formerly HOX4) on chromosome 2. By sequence comparison, the genes of each cluster are assigned to 1 of 13 groups. The order of the HOX genes along the chromosome reflects where they are expressed along the body axis. This principle is followed in homeo box gene nomenclature. For a review of homeo box gene nomenclature, see Scott (1992). The homeo box is a 180-bp DNA sequence conserved in Drosophila homeotic genes which regulate early development (review by Gehring, 1985). These DNA sequences are present in open reading frames and have been identified in Drosophila and Xenopus embryos. They share structural features with genes encoding some DNA-binding proteins. Homologous homeo box sequences have been detected in species ranging from insects and annelids to vertebrates. The high degree of sequence conservation (70 to 90%) suggests a common role in embryonic development. Schughart et al. (1989) pointed to evidence of duplication of large genomic regions during evolution of the mouse homeo box genes. The findings were considered consistent with the hypothesis of Ohno (1970) that during vertebrate evolution duplications of the entire genome occurred. Such are likely to be less deleterious than duplications of individual chromosomes. Ferguson-Smith et al. (1989) showed that the sequence of the HOX1 gene has 100% identity to the deduced amino acid sequence of the mouse HOX1.4 homeo box. They detected no RFLPs with the 14-kD clone, which was devoid of any moderately repetitive DNA sequences. This implied an inability of this region to tolerate change in sequence, consistent with a function highly conserved throughout evolution Animal model experiments lend further support to the function of HOXA7. As reviewed by Gaunt and Singh (1990), in both the mouse and Drosophila, Antennapedia-like homeo box-containing genes (homeogenes) display a strict correspondence between the order of genes (3-prime to 5-prime) along the chromosome and the order of their expression domains (anterior to posterior) in the developing embryo. Gaunt and Singh (1990) suggested that this and other points of similarity indicate that the 2 species use a common mechanism of chromosomal imprinting in order to retain cellular memory of homeogene expression patterns throughout embryonic development. The 'open for transcription' model suggests that imprinting is a matter of open and closed chromatin, the molecular nature of which is not clear. It is possible that a clue to the mechanism of memory used within the homeogene complex, at least in Drosophila, is provided by the Drosophila mutant 'Polycomb' (Pc). The product of the Pc gene, which presumably has a homolog in man, appears to act as a repressor of 'posterior' genes in anterior segments. Thus, it may be involved in restricting the state of 'openness' of the homeotic gene complex.

It is appreciated that the abovementioned animal model for HOXA7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schughart, K.; Kappen, C.; Ruddle, F. H.: Duplication of large genomic regions during the evolution of vertebrate homeobox genes. Proc. Nat. Acad. Sci. 86:7067-7071, 1989; and Scott, M. P.: Vertebrate homeobox gene nomenclature. (Letter) Cell 71:551-553, 1992.

Further studies establishing the function and utilities of HOXA7 are found in John Hopkins OMIM database record ID 142950, and in cited publications listed in Table 5, which are hereby incorporated by reference. Histamine receptor h3 (HRH3, Accession NP_009163.1) is another GAM148 target gene, herein designated TARGET GENE. HRH3 BINDING SITE is a target binding site found in the 3' untranslated region of mRNA encoded by HRH3, corresponding to a target binding site such as BINDING SITE I, BINDING SITE II or BINDING SITE III of FIG. 8. Table 4 illustrates the complementarity of the nucleotide sequences of HRH3 BINDING SITE, designated SEQ ID:6908, to the nucleotide sequence of GAM148 RNA, herein designated GAM RNA, also designated SEQ ID:280.

Another function of GAM148 is therefore inhibition of Histamine receptor h3 (HRH3, Accession NP_009163.1). Accordingly, utilities of GAM148 include diagnosis, prevention and treatment of diseases and clinical conditions associated with HRH3.

Insulin-like growth factor 2 (somatomedin a) (IGF2, Accession NP_000603.1) is another GAM148 target gene, herein designated TARGET GENE. IGF2 BINDING SITE is a target binding site found in the 5' untranslated region of mRNA encoded by IGF2, corresponding to a target binding site such as BINDING SITE I, BINDING SITE II or BINDING SITE III of FIG. 8. Table 4 illustrates the complementarity of the nucleotide sequences of IGF2 BINDING SITE, designated SEQ ID:12962, to the nucleotide sequence of GAM148 RNA, herein designated GAM RNA, also designated SEQ ID:280.

Another function of GAM148 is therefore inhibition of Insulin-like growth factor 2 (somatomedin a) (IGF2, Accession NP_000603.1) . Accordingly, utilities of GAM148 include diagnosis, prevention and treatment of diseases and clinical conditions associated with IGF2.

Integrin, alpha l (antigen cd11a (p180), lymphocyte function-associated antigen 1; alpha polypeptide) (ITGAL, Accession NP_002200.1) is another GAM148 target gene, herein designated TARGET GENE. ITGAL BINDING SITE is a target binding site found in the 3' untranslated region of mRNA encoded by ITGAL, corresponding to a target binding site such as BINDING SITE I, BINDING SITE II or BINDING SITE III of FIG. 8. Table 4 illustrates the complementarity of the nucleotide sequences of ITGAL BINDING SITE, designated SEQ ID:15602, to the nucleotide sequence of GAM148 RNA, herein designated GAM RNA, also designated SEQ ID:280.

Another function of GAM148 is therefore inhibition of Integrin, alpha l (antigen cd11a (p180), lymphocyte function-associated antigen 1; alpha polypeptide) (ITGAL, Accession NP_002200.1), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of GAM148 include diagnosis, prevention and treatment of diseases and clinical conditions associated with ITGAL.

The function of ITGAL has been established by previous studies. See 120980 and 151510. Lymphocyte function-associated antigen-1 (LFA-1) shares a beta subunit (see OMIM Ref. No. 116920) with other members of a family of leukocyte surface membrane antigens but has a unique alpha subunit (Sanchez-Madrid et al., 1983). LFA-1 is expressed on lymphocytes and phagocytic cells. The LFA-1 molecule is involved in the adhesion of cytotoxic T cells to their target cells. Patients with LFA-1 immunodeficiency disease (see OMIM Ref. No. 116920) have recurrent life-threatening infections, show deficiency of the beta chain of all 3 molecules, LFA-1, Mac-1 (macrophage antigen- 1), and p150,95, and display profound defects in adhesion-dependent granulocyte, monocyte, and B- and T-lymphocyte functions. The alpha subunits were designated by Marlin et al. (1986) as alpha-L for LFA-1, alpha-M for Mac- 1, and alpha-X for p150,95. Lu and Cyster (2002) studied the mechanisms that control localization of marginal zone B cells. They demonstrated that marginal zone B cells express elevated levels of the integrins LFA-1 and alpha- 4-beta-1 (see OMIM Ref. No. 192975 and 135630) and that the marginal zone B cells bind to the ligands ICAM1 (OMIM Ref. No. 147840) and VCAM1 (OMIM Ref. No. 192225). These ligands are expressed within the marginal zone in a lymphotoxin-dependent manner. Combined inhibition of LFA-1 and alpha-4-beta-1 causes a rapid and selective release of B cells from the marginal zone. Furthermore, lipopolysaccharide-triggered marginal zone B cell relocalization involves downregulation of integrin-mediated adhesion. Lu and Cyster (2002) concluded that their studies identified key requirements for marginal zone B cell localization and established a role for integrins in peripheral lymphoid tissue compartmentalization Full details of the abovementioned studies are described in the following publications, the disclosure of which are hereby incorporated by reference:

Lu, T. T.; Cyster, J. G.: Integrin-mediated long-term B cell retention in the splenic marginal zone. Science 297:409-412, 2002; and Marlin, S. D.; Morton, C. C.; Anderson, D. C.; Springer, T. A.: LFA-1 immunodeficiency disease: definition of the genetic defect and chromosomal mapping of alpha and beta subunits of t.

Further studies establishing the function and utilities of ITGAL are found in John Hopkins OMIM database record ID 153370, and in cited publications listed in Table 5, which are hereby incorporated by reference. KIAA0062 (Accession XP_046677.3) is another GAM148 target gene, herein designated TARGET GENE. KIAA0062 BINDING SITE is a target binding site found in the 3' untranslated region of mRNA encoded by KIAA0062, corresponding to a target binding site such as BINDING SITE I, BINDING SITE II or BINDING SITE III of FIG. 8. Table 4 illustrates the complementarity of the nucleotide sequences of KIAA0062 BINDING SITE, designated SEQ ID:17664, to the nucleotide sequence of GAM148 RNA, herein designated GAM RNA, also designated SEQ ID:280.

Another function of GAM148 is therefore inhibition of KIAA0062 (Accession XP_046677.3). Accordingly, utilities of GAM148 include diagnosis, prevention and treatment of diseases and clinical conditions associated with KIAA0062.

KIAA0101 (Accession NP_055551.1) is another GAM148 target gene, herein designated TARGET GENE. KIAA0101 BINDING SITE is a target binding site found in the 5' untranslated region of mRNA encoded by KIAA0101, corresponding to a target binding site such as BINDING SITE I, BINDING SITE II or BINDING SITE III of FIG. 8. Table 4 illustrates the complementarity of the nucleotide sequences of KIAA0101 BINDING SITE, designated SEQ ID:11332, to the nucleotide sequence of GAM148 RNA, herein designated GAM RNA, also designated SEQ ID:280.

Another function of GAM148 is therefore inhibition of KIAA0101 (Accession NP_055551.1). Accordingly, utilities of GAM148 include diagnosis, prevention and treatment of diseases and clinical conditions associated with KIAA0101.

KIAA0522 (Accession XP_291345.1) is another GAM148 target gene, herein designated TARGET GENE. KIAA0522 BINDING SITE is a target binding site found in the 3' untranslated region of mRNA encoded by KIAA0522, corresponding to a target binding site such as BINDING SITE I, BINDING SITE II or BINDING SITE III of FIG. 8. Table 4 illustrates the complementarity of the nucleotide sequences of KIAA0522 BINDING SITE, designated SEQ ID:9466, to the nucleotide sequence of GAM148 RNA, herein designated GAM RNA, also designated SEQ ID:280.

Another function of GAM148 is therefore inhibition of KIAA0522 (Accession XP_291345.1). Accordingly, utilities of GAM148 include diagnosis, prevention and treatment of diseases and clinical conditions associated with KIAA0522.

KIAA1458 (Accession XP_044434.1) is another GAM148 target gene, herein designated TARGET GENE. KIAA1458 BINDING SITE is a target binding site found in the 3' untranslated region of mRNA encoded by KIAA1458, corresponding to a target binding site such as BINDING SITE I, BINDING SITE II or BINDING SITE III of FIG. 8. Table 4 illustrates the complementarity of the nucleotide sequences of KIAA1458 BINDING SITE, designated SEQ ID:9176, to the nucleotide sequence of GAM148 RNA, herein designated GAM RNA, also designated SEQ ID:280.

Another function of GAM148 is therefore inhibition of KIAA1458 (Accession XP_044434.1). Accordingly, utilities of GAM148 include diagnosis, prevention and treatment of diseases and clinical conditions associated with KIAA1458.

KIAA1656 (Accession XP_038022.1) is another GAM148 target gene, herein designated TARGET GENE. KIAA1656 BINDING SITE is a target binding site found in the 3' untranslated region of mRNA encoded by KIAA1656, corresponding to a target binding site such as BINDING SITE I, BINDING SITE II or BINDING SITE III of FIG. 8. Table 4 illustrates the complementarity of the nucleotide sequences of KIAA1656 BINDING SITE, designated SEQ ID:7823, to the nucleotide sequence of GAM148 RNA, herein designated GAM RNA, also designated SEQ ID:280.

Another function of GAM148 is therefore inhibition of KIAA1656 (Accession XP_038022.1). Accordingly, utilities of GAM148 include diagnosis, prevention and treatment of diseases and clinical conditions associated with KIAA1656.

KIAA1909 (Accession XP_291137.1) is another GAM148 target gene, herein designated TARGET GENE. KIAA1909 BINDING SITE is a target binding site found in the 5' untranslated region of mRNA encoded by KIAA1909, corresponding to a target binding site such as BINDING SITE I, BINDING SITE II or BINDING SITE III of FIG. 8. Table 4 illustrates the complementarity of the nucleotide sequences of KIAA1909 BINDING SITE, designated SEQ ID:6342, to the nucleotide sequence of GAM148 RNA, herein designated GAM RNA, also designated SEQ ID:280.

Another function of GAM148 is therefore inhibition of KIAA1909 (Accession XP_291137.1). Accordingly, utilities of GAM148 include diagnosis, prevention and treatment of diseases and clinical conditions associated with KIAA1909.

Kinesin family member 5a (KIF5A, Accession NP_004975.1) is another GAM148 target gene, herein designated TARGET GENE. KIF5A BINDING SITE is a target binding site found in the 5' untranslated region of mRNA encoded by KIF5A, corresponding to a target binding site such as BINDING SITE I, BINDING SITE II or BINDING SITE III of FIG. 8. Table 4 illustrates the complementarity of the nucleotide sequences of KIF5A BINDING SITE, designated SEQ ID:5352, to the nucleotide sequence of GAM148 RNA, herein designated GAM RNA, also designated SEQ ID:280.

Another function of GAM148 is therefore inhibition of Kinesin family member 5a (KIF5A, Accession NP_004975.1), a gene which is a microtubule-associated force-producing protein that may play a role in organelle transport. Accordingly, utilities of GAM148 include diagnosis, prevention and treatment of diseases and clinical conditions associated with KIF5A.

The function of KIF5A and its association with various diseases and clinical conditions, has been established by previous studies, as described hereinabove with reference to GAM47.1. LCX (Accession XP_167612.2) is another GAM148 target gene, herein designated TARGET GENE. LCX BINDING SITE is a target binding site found in the 3' untranslated region of mRNA encoded by LCX, corresponding to a target binding site such as BINDING SITE I, BINDING SITE II or BINDING SITE III of FIG. 8. Table 4 illustrates the complementarity of the nucleotide sequences of LCX BINDING SITE, designated SEQ ID:12109, to the nucleotide sequence of GAM148 RNA, herein designated GAM RNA, also designated SEQ ID:280.

Another function of GAM148 is therefore inhibition of LCX (Accession XP_167612.2). Accordingly, utilities of GAM148 include diagnosis, prevention and treatment of diseases and clinical conditions associated with LCX.

LOC122183 (Accession XP_062994.2) is another GAM148 target gene, herein designated TARGET GENE. LOC122183 BINDING SITE is a target binding site found in the 5' untranslated region of mRNA encoded by LOC122183, corresponding to a target binding site such as BINDING SITE I, BINDING SITE II or BINDING SITE III of FIG. 8. Table 4 illustrates the complementarity of the nucleotide sequences of LOC122183 BINDING SITE, designated SEQ ID:5819, to the nucleotide sequence of GAM148 RNA, herein designated GAM RNA, also designated SEQ ID:280.

Another function of GAM148 is therefore inhibition of LOC122183 (Accession XP_062994.2). Accordingly, utilities of GAM148 include diagnosis, prevention and treatment of diseases and clinical conditions associated with LOC122183.

LOC126299 (Accession XP_059019.2) is another GAM148 target gene, herein designated TARGET GENE. LOC126299 BINDING SITE is a target binding site found in the 5' untranslated region of mRNA encoded by LOC126299, corresponding to a target binding site such as BINDING SITE I, BINDING SITE II or BINDING SITE III of FIG. 8. Table 4 illustrates the complementarity of the nucleotide sequences of LOC126299 BINDING SITE, designated SEQ ID:3713, to the nucleotide sequence of GAM148 RNA, herein designated GAM RNA, also designated SEQ ID:280.

Another function of GAM148 is therefore inhibition of LOC126299 (Accession XP_059019.2). Accordingly, utilities of GAM148 include diagnosis, prevention and treatment of diseases and clinical conditions associated with LOC126299.

LOC145268 (Accession XP_085072.1) is another GAM148 target gene, herein designated TARGET GENE. LOC145268 BINDING SITE is a target binding site found in the 5' untranslated region of mRNA encoded by LOC145268, corresponding to a target binding site such as BINDING SITE I, BINDING SITE II or BINDING SITE III of FIG. 8. Table 4 illustrates the complementarity of the nucleotide sequences of LOC145268 BINDING SITE, designated SEQ ID:10503, to the nucleotide sequence of GAM148 RNA, herein designated GAM RNA, also designated SEQ ID:280.

Another function of GAM148 is therefore inhibition of LOC145268 (Accession XP_085072.1). Accordingly, utilities of GAM148 include diagnosis, prevention and treatment of diseases and clinical conditions associated with LOC145268.

LOC150095 (Accession XP_097805.1) is another GAM148 target gene, herein designated TARGET GENE. LOC150095 BINDING SITE is a target binding site found in the 5' untranslated region of mRNA encoded by LOC150095, corresponding to a target binding site such as BINDING SITE I, BINDING SITE II or BINDING SITE III of FIG. 8. Table 4 illustrates the complementarity of the nucleotide sequences of LOC150095 BINDING SITE, designated SEQ ID:553, to the nucleotide sequence of GAM148 RNA, herein designated GAM RNA, also designated SEQ ID:280.

Another function of GAM148 is therefore inhibition of LOC150095 (Accession XP_097805.1). Accordingly, utilities of GAM148 include diagnosis, prevention and treatment of diseases and clinical conditions associated with LOC150095.

LOC150297 (Accession XP_086894.2) is another GAM148 target gene, herein designated TARGET GENE. LOC150297 BINDING SITE is a target binding site found in the 3' untranslated region of mRNA encoded by LOC150297, corresponding to a target binding site such as BINDING SITE I, BINDING SITE II or BINDING SITE III of FIG. 8. Table 4 illustrates the complementarity of the nucleotide sequences of LOC150297 BINDING SITE, designated SEQ ID:14830, to the nucleotide sequence of GAM148 RNA, herein designated GAM RNA, also designated SEQ ID:280.

Another function of GAM148 is therefore inhibition of LOC150297 (Accession XP_086894.2). Accordingly, utilities of GAM148 include diagnosis, prevention and treatment of diseases and clinical conditions associated with LOC150297.

LOC196337 (Accession XP_113696.1) is another GAM148 target gene, herein designated TARGET GENE. LOC196337 BINDING SITE is a target binding site found in the 3' untranslated region of mRNA encoded by LOC196337, corresponding to a target binding site such as BINDING SITE I, BINDING SITE II or BINDING SITE III of FIG. 8. Table 4 illustrates the complementarity of the nucleotide sequences of LOC196337 BINDING SITE, designated SEQ ID:18591, to the nucleotide sequence of GAM148 RNA, herein designated GAM RNA, also designated SEQ ID:280.

Another function of GAM148 is therefore inhibition of LOC196337 (Accession XP_113696.1). Accordingly, utilities of GAM148 include diagnosis, prevention and treatment of diseases and clinical conditions associated with LOC196337.

LOC199906 (Accession XP_114052.1) is another GAM148 target gene, herein designated TARGET GENE. LOC199906 BINDING SITE is a target binding site found in the 3' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:1048, to the nucleotide sequence of GAM148 RNA, herein designated GAM RNA, also designated SEQ ID:280.

Another function of GAM148 is therefore inhibition of LOC199906 (Accession XP_114052.1). Accordingly, utilities of GAM148 include diagnosis, prevention and treatment of diseases and clinical conditions associated with LOC199906.

LOC219649 (Accession XP_167562.1) is another GAM148 target gene, herein designated TARGET GENE. LOC219649 BINDING SITE is a target binding site found in the 5' untranslated region of mRNA encoded by LOC219649, corresponding to a target binding site such as BINDING SITE I, BINDING SITE II or BINDING SITE III of FIG. 8. Table 4 illustrates the complementarity of the nucleotide sequences of LOC219649 BINDING SITE, designated SEQ ID:1391, to the nucleotide sequence of GAM148 RNA, herein designated GAM RNA, also designated SEQ ID:280.

Another function of GAM148 is therefore inhibition of LOC219649 (Accession XP_167562.1). Accordingly, utilities of GAM148 include diagnosis, prevention and treatment of diseases and clinical conditions associated with LOC219649.

LOC283007 (Accession XP_210849.1) is another GAM148 target gene, herein designated TARGET GENE. LOC283007 BINDING SITE is a target binding site found in the 5' untranslated region of mRNA encoded by LOC283007, corresponding to a target binding site such as BINDING SITE I, BINDING SITE II or BINDING SITE III of FIG. 8. Table 4 illustrates the complementarity of the nucleotide sequences of LOC283007 BINDING SITE, designated SEQ ID:3635, to the nucleotide sequence of GAM148 RNA, herein designated GAM RNA, also designated SEQ ID:280.

Another function of GAM148 is therefore inhibition of LOC283007 (Accession XP_210849.1). Accordingly, utilities of GAM148 include diagnosis, prevention and treatment of diseases and clinical conditions associated with LOC283007.

LOC283511 (Accession XP_211077.1) is another GAM148 target gene, herein designated TARGET GENE. LOC283511 BINDING SITE is a target binding site found in the 3' untranslated region of mRNA encoded by LOC283511, corresponding to a target binding site such as BINDING SITE I, BINDING SITE II or BINDING SITE III of FIG. 8. Table 4 illustrates the complementarity of the nucleotide sequences of LOC283511 BINDING SITE, designated SEQ ID:9199, to the nucleotide sequence of GAM148 RNA, herein designated GAM RNA, also designated SEQ ID:280.

Another function of GAM148 is therefore inhibition of LOC283511 (Accession XP_211077.1). Accordingly, utilities of GAM148 include diagnosis, prevention and treatment of diseases and clinical conditions associated with LOC283511.

LOC283767 (Accession XP_208835.1) is another GAM148 target gene, herein designated TARGET GENE.

LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:640, to the nucleotide sequence of GAM148 RNA, herein designated GAM RNA, also designated SEQ ID:280.

Another function of GAM148 is therefore inhibition of LOC283767 (Accession XP_208835.1). Accordingly, utilities of GAM148 include diagnosis, prevention and treatment of diseases and clinical conditions associated with LOC283767.

LOC283868 (Accession XP_211243.1) is another GAM148 target gene, herein designated TARGET GENE. LOC283868 BINDING SITE is a target binding site found in the 3' untranslated region of mRNA encoded by LOC283868, corresponding to a target binding site such as BINDING SITE I, BINDING SITE II or BINDING SITE III of FIG. 8. Table 4 illustrates the complementarity of the nucleotide sequences of LOC283868 BINDING SITE, designated SEQ ID:7128, to the nucleotide sequence of GAM148 RNA, herein designated GAM RNA, also designated SEQ ID:280.

Another function of GAM148 is therefore inhibition of LOC283868 (Accession XP_211243.1). Accordingly, utilities of GAM148 include diagnosis, prevention and treatment of diseases and clinical conditions associated with LOC283868.

LOC284169 (Accession XP_211360.1) is another GAM148 target gene, herein designated TARGET GENE. LOC284169 BINDING SITE is a target binding site found in the 5' untranslated region of mRNA encoded by LOC284169, corresponding to a target binding site such as BINDING SITE I, BINDING SITE II or BINDING SITE III of FIG. 8. Table 4 illustrates the complementarity of the nucleotide sequences of LOC284169 BINDING SITE, designated SEQ ID:18426, to the nucleotide sequence of GAM148 RNA, herein designated GAM RNA, also designated SEQ ID:280.

Another function of GAM148 is therefore inhibition of LOC284169 (Accession XP_211360.1). Accordingly, utilities of GAM148 include diagnosis, prevention and treatment of diseases and clinical conditions associated with LOC284169.

LOC284175 (Accession XP_211364.1) is another GAM148 target gene, herein designated TARGET GENE. LOC284175 BINDING SITE is a target binding site found in the 5' untranslated region of mRNA encoded by LOC284175, corresponding to a target binding site such as BINDING SITE I, BINDING SITE II or BINDING SITE III of FIG. 8. Table 4 illustrates the complementarity of the nucleotide sequences of LOC284175 BINDING SITE, designated SEQ ID:1975, to the nucleotide sequence of GAM148 RNA, herein designated GAM RNA, also designated SEQ ID:280.

Another function of GAM148 is therefore inhibition of LOC284175 (Accession XP_211364.1). Accordingly, utilities of GAM148 include diagnosis, prevention and treatment of diseases and clinical conditions associated with LOC284175.

LOC284927 (Accession XP_211689.1) is another GAM148 target gene, herein designated TARGET GENE. LOC284927 BINDING SITE is a target binding site found in the 3' untranslated region of mRNA encoded by LOC284927, corresponding to a target binding site such as BINDING SITE I, BINDING SITE II or BINDING SITE III of FIG. 8. Table 4 illustrates the complementarity of the nucleotide sequences of LOC284927 BINDING SITE, designated SEQ ID:5418, to the nucleotide sequence of GAM148 RNA, herein designated GAM RNA, also designated SEQ ID:280.

Another function of GAM148 is therefore inhibition of LOC284927 (Accession XP_211689.1). Accordingly, utilities of GAM148 include diagnosis, prevention and treatment of diseases and clinical conditions associated with LOC284927.

LOC285194 (Accession XP_211803.1) is another GAM148 target gene, herein designated TARGET GENE. LOC285194 BINDING SITE is a target binding site found in the 3' untranslated region of mRNA encoded by LOC285194, corresponding to a target binding site such as BINDING SITE I, BINDING SITE II or BINDING SITE III of FIG. 8. Table 4 illustrates the complementarity of the nucleotide sequences of LOC285194 BINDING SITE, designated SEQ ID:16431, to the nucleotide sequence of GAM148 RNA, herein designated GAM RNA, also designated SEQ ID:280.

Another function of GAM148 is therefore inhibition of LOC285194 (Accession XP_211803.1). Accordingly, utilities of GAM148 include diagnosis, prevention and treatment of diseases and clinical conditions associated with LOC285194.

LOC285587 (Accession XP_211947.1) is another GAM148 target gene, herein designated TARGET GENE. LOC285587 BINDING SITE is a target binding site found in the 3' untranslated region of mRNA encoded by LOC285587, corresponding to a target binding site such as BINDING SITE I, BINDING SITE II or BINDING SITE III of FIG. 8. Table 4 illustrates the complementarity of the nucleotide sequences of LOC285587 BINDING SITE, designated SEQ ID:5312, to the nucleotide sequence of GAM148 RNA, herein designated GAM RNA, also designated SEQ ID:280.

Another function of GAM148 is therefore inhibition of LOC285587 (Accession XP_211947.1). Accordingly, utilities of GAM148 include diagnosis, prevention and treatment of diseases and clinical conditions associated with LOC285587.

LOC285594 (Accession XP_211946.2) is another GAM148 target gene, herein designated TARGET GENE. LOC285594 BINDING SITE is a target binding site found in the 3' untranslated region of mRNA encoded by LOC285594, corresponding to a target binding site such as BINDING SITE I, BINDING SITE II or BINDING SITE III of FIG. 8. Table 4 illustrates the complementarity of the nucleotide sequences of LOC285594 BINDING SITE, designated SEQ ID:2211, to the nucleotide sequence of GAM148 RNA, herein designated GAM RNA, also designated SEQ ID:280.

Another function of GAM148 is therefore inhibition of LOC285594 (Accession XP_211946.2). Accordingly, utilities of GAM148 include diagnosis, prevention and treatment of diseases and clinical conditions associated with LOC285594.

LOC285843 (Accession XP_212034.1) is another GAM148 target gene, herein designated TARGET GENE. LOC285843 BINDING SITE is a target binding site found in the 5' untranslated region of mRNA encoded by LOC285843, corresponding to a target binding site such as BINDING SITE I, BINDING SITE II or BINDING SITE III of FIG. 8. Table 4 illustrates the complementarity of the nucleotide sequences of LOC285843 BINDING SITE, designated SEQ ID:14325, to the nucleotide sequence of GAM148 RNA, herein designated GAM RNA, also designated SEQ ID:280.

Another function of GAM148 is therefore inhibition of LOC285843 (Accession XP_212034.1). Accordingly, utilities of GAM148 include diagnosis, prevention and treatment of diseases and clinical conditions associated with LOC285843.

LOC286058 (Accession XP_212158.1) is another GAM148 target gene, herein designated TARGET GENE. LOC286058 BINDING SITE is a target binding site found in the 3' untranslated region of mRNA encoded by LOC286058, corresponding to a target binding site such as BINDING SITE I, BINDING SITE II or BINDING SITE III of FIG. 8. Table 4 illustrates the complementarity of the nucleotide sequences of LOC286058 BINDING SITE, designated SEQ ID:15183, to the nucleotide sequence of GAM148 RNA, herein designated GAM RNA, also designated SEQ ID:280.

Another function of GAM148 is therefore inhibition of LOC286058 (Accession XP_212158.1). Accordingly, utilities of GAM148 include diagnosis, prevention and treatment of diseases and clinical conditions associated with LOC286058.

LOC286063 (Accession XP_212159.1) is another GAM148 target gene, herein designated TARGET GENE. LOC286063 BINDING SITE is a target binding site found in the 3' untranslated region of mRNA encoded by LOC286063, corresponding to a target binding site such as BINDING SITE I, BINDING SITE II or BINDING SITE III of FIG. 8. Table 4 illustrates the complementarity of the nucleotide sequences of LOC286063 BINDING SITE, designated SEQ ID:1688, to the nucleotide sequence of GAM148 RNA, herein designated GAM RNA, also designated SEQ ID:280.

Another function of GAM148 is therefore inhibition of LOC286063 (Accession XP_212159.1). Accordingly, utilities of GAM148 include diagnosis, prevention and treatment of diseases and clinical conditions associated with LOC286063.

LOC338817 (Accession XP_290588.1) is another GAM148 target gene, herein designated TARGET GENE. LOC338817 BINDING SITE is a target binding site found in the 3' untranslated region of mRNA encoded by LOC338817, corresponding to a target binding site such as BINDING SITE I, BINDING SITE II or BINDING SITE III of FIG. 8. Table 4 illustrates the complementarity of the nucleotide sequences of LOC338817 BINDING SITE, designated SEQ ID:15148, to the nucleotide sequence of GAM148 RNA, herein designated GAM RNA, also designated SEQ ID:280.

Another function of GAM148 is therefore inhibition of LOC338817 (Accession XP_290588.1). Accordingly, utilities of GAM148 include diagnosis, prevention and treatment of diseases and clinical conditions associated with LOC338817.

LOC338991 (Accession XP_290663.1) is another GAM148 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:640, to the nucleotide sequence of GAM148 RNA, herein designated GAM RNA, also designated SEQ ID:280.

Another function of GAM148 is therefore inhibition of LOC338991 (Accession XP_290663.1). Accordingly, utilities of GAM148 include diagnosis, prevention and treatment of diseases and clinical conditions associated with LOC338991.

LOC338999 (Accession XP_290659.1) is another GAM148 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:640, to the nucleotide sequence of GAM148 RNA, herein designated GAM RNA, also designated SEQ ID:280.

Another function of GAM148 is therefore inhibition of LOC338999 (Accession XP_290659.1). Accordingly, utilities of GAM148 include diagnosis, prevention and treatment of diseases and clinical conditions associated with LOC338999.

LOC339717 (Accession XP_295040.1) is another GAM148 target gene, herein designated TARGET GENE. LOC339717 BINDING SITE is a target binding site found in the 5' untranslated region of mRNA encoded by LOC339717, corresponding to a target binding site such as BINDING SITE I, BINDING SITE II or BINDING SITE III of FIG. 8. Table 4 illustrates the complementarity of the nucleotide sequences of LOC339717 BINDING SITE, designated SEQ ID:7535, to the nucleotide sequence of GAM148 RNA, herein designated GAM RNA, also designated SEQ ID:280.

Another function of GAM148 is therefore inhibition of LOC339717 (Accession XP_295040.1). Accordingly, utilities of GAM148 include diagnosis, prevention and treatment of diseases and clinical conditions associated with LOC339717.

LOC340150 (Accession XP_295167.1) is another GAM148 target gene, herein designated TARGET GENE. LOC340150 BINDING SITE is a target binding site found in the 3' untranslated region of mRNA encoded by LOC340150, corresponding to a target binding site such as BINDING SITE I, BINDING SITE II or BINDING SITE III of FIG. 8. Table 4 illustrates the complementarity of the nucleotide sequences of LOC340150 BINDING SITE, designated SEQ ID:5873, to the nucleotide sequence of GAM148 RNA, herein designated GAM RNA, also designated SEQ ID:280.

Another function of GAM148 is therefore inhibition of LOC340150 (Accession XP_295167.1). Accordingly, utilities of GAM148 include diagnosis, prevention and treatment of diseases and clinical conditions associated with LOC340150.

LOC340385 (Accession XP_291261.1) is another GAM148 target gene, herein designated TARGET GENE. LOC340385 BINDING SITE is a target binding site found in the 5' untranslated region of mRNA encoded by LOC340385, corresponding to a target binding site such as BINDING SITE I, BINDING SITE II or BINDING SITE III of FIG. 8. Table 4 illustrates the complementarity of the nucleotide sequences of LOC340385 BINDING SITE, designated SEQ ID:12963, to the nucleotide sequence of GAM148 RNA, herein designated GAM RNA, also designated SEQ ID:280.

Another function of GAM148 is therefore inhibition of LOC340385 (Accession XP_291261.1). Accordingly, utilities of GAM148 include diagnosis, prevention and treatment of diseases and clinical conditions associated with LOC340385.

LOC343095 (Accession XP_291404.1) is another GAM148 target gene, herein designated TARGET GENE. LOC343095 BINDING SITE is a target binding site found in the 5' untranslated region of mRNA encoded by LOC343095, corresponding to a target binding site such as BINDING SITE I, BINDING SITE II or BINDING SITE III of FIG. 8. Table 4 illustrates the complementarity of the nucleotide sequences of LOC343095 BINDING SITE, designated SEQ ID:5934, to the nucleotide sequence of GAM148 RNA, herein designated GAM RNA, also designated SEQ ID:280.

Another function of GAM148 is therefore inhibition of LOC343095 (Accession XP_291404.1). Accordingly, utilities of GAM148 include diagnosis, prevention and treatment of diseases and clinical conditions associated with LOC343095.

LOC348113 (Accession XP_300623.1) is another GAM148 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:640, to the nucleotide sequence of GAM148 RNA, herein designated GAM RNA, also designated SEQ ID:280.

Another function of GAM148 is therefore inhibition of LOC348113 (Accession XP_300623.1). Accordingly, utilities of GAM148 include diagnosis, prevention and treatment of diseases and clinical conditions associated with LOC348113.

LOC348137 (Accession XP_300635.1) is another GAM148 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:640, to the nucleotide sequence of GAM148 RNA, herein designated GAM RNA, also designated SEQ ID:280.

Another function of GAM148 is therefore inhibition of LOC348137 (Accession XP_300635.1). Accordingly, utilities of GAM148 include diagnosis, prevention and treatment of diseases and clinical conditions associated with LOC348137.

LOC348142 (Accession XP_300636.1) is another GAM148 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:640, to the nucleotide sequence of GAM148 RNA, herein designated GAM RNA, also designated SEQ ID:280.

Another function of GAM148 is therefore inhibition of LOC348142 (Accession XP_300636.1). Accordingly, utilities of GAM148 include diagnosis, prevention and treatment of diseases and clinical conditions associated with LOC348142.

LOC348180 (Accession XP_300650.1) is another GAM148 target gene, herein designated TARGET GENE. LOC348180 BINDING SITE is a target binding site found in the 3' untranslated region of mRNA encoded by LOC348180, corresponding to a target binding site such as BINDING SITE I, BINDING SITE II or BINDING SITE III of FIG. 8. Table 4 illustrates the complementarity of the nucleotide sequences of LOC348180 BINDING SITE, designated SEQ ID:12165, to the nucleotide sequence of GAM148 RNA, herein designated GAM RNA, also designated SEQ ID:280.

Another function of GAM148 is therefore inhibition of LOC348180 (Accession XP_300650.1). Accordingly, utilities of GAM148 include diagnosis, prevention and treatment of diseases and clinical conditions associated with LOC348180.

LOC348361 (Accession XP_302730.1) is another GAM148 target gene, herein designated TARGET GENE. LOC348361 BINDING SITE is a target binding site found in the 3' untranslated region of mRNA encoded by LOC348361, corresponding to a target binding site such as BINDING SITE I, BINDING SITE II or BINDING SITE III of FIG. 8. Table 4 illustrates the complementarity of the nucleotide sequences of LOC348361 BINDING SITE, designated SEQ ID:624, to the nucleotide sequence of GAM148 RNA, herein designated GAM RNA, also designated SEQ ID:280.

Another function of GAM148 is therefore inhibition of LOC348361 (Accession XP_302730.1). Accordingly, utilities of GAM148 include diagnosis, prevention and treatment of diseases and clinical conditions associated with LOC348361.

LOC348369 (Accession XP_302732.1) is another GAM148 target gene, herein designated TARGET GENE. LOC348369 BINDING SITE is a target binding site found in the 5' untranslated region of mRNA encoded by LOC348369, corresponding to a target binding site such as BINDING SITE I, BINDING SITE II or BINDING SITE III of FIG. 8. Table 4 illustrates the complementarity of the nucleotide sequences of LOC348369 BINDING SITE, designated SEQ ID:15542, to the nucleotide sequence of GAM148 RNA, herein designated GAM RNA, also designated SEQ ID:280.

Another function of GAM148 is therefore inhibition of LOC348369 (Accession XP_302732.1). Accordingly, utilities of GAM148 include diagnosis, prevention and treatment of diseases and clinical conditions associated with LOC348369.

LOC348911 (Accession XP_302915.1) is another GAM148 target gene, herein designated TARGET GENE. LOC348911 BINDING SITE is a target binding site found in the 5' untranslated region of mRNA encoded by LOC348911, corresponding to a target binding site such as BINDING SITE I, BINDING SITE II or BINDING SITE III of FIG. 8. Table 4 illustrates the complementarity of the nucleotide sequences of LOC348911 BINDING SITE, designated SEQ ID:15228, to the nucleotide sequence of GAM148 RNA, herein designated GAM RNA, also designated SEQ ID:280.

Another function of GAM148 is therefore inhibition of LOC348911 (Accession XP_302915.1). Accordingly, utilities of GAM148 include diagnosis, prevention and treatment of diseases and clinical conditions associated with LOC348911.

LOC349251 (Accession XP_300251.1) is another GAM148 target gene, herein designated TARGET GENE. LOC349251 BINDING SITE is a target binding site found in the 3' untranslated region of mRNA encoded by LOC349251, corresponding to a target binding site such as BINDING SITE I, BINDING SITE II or BINDING SITE III of FIG. 8. Table 4 illustrates the complementarity of the nucleotide sequences of LOC349251 BINDING SITE, designated SEQ ID:4297, to the nucleotide sequence of GAM148 RNA, herein designated GAM RNA, also designated SEQ ID:280.

Another function of GAM148 is therefore inhibition of LOC349251 (Accession XP_300251.1). Accordingly, utilities of GAM148 include diagnosis, prevention and treatment of diseases and clinical conditions associated with LOC349251.

LOC55924 (Accession NP_061972.1) is another GAM148 target gene, herein designated TARGET GENE. LOC55924 BINDING SITE is a target binding site found in the 5' untranslated region of mRNA encoded by LOC55924, corresponding to a target binding site such as BINDING SITE I, BINDING SITE II or BINDING SITE III of FIG. 8. Table 4 illustrates the complementarity of the nucleotide sequences of LOC55924 BINDING SITE, designated SEQ ID:3949, to the nucleotide sequence of GAM148 RNA, herein designated GAM RNA, also designated SEQ ID:280.

Another function of GAM148 is therefore inhibition of LOC55924 (Accession NP_061972.1). Accordingly, utilities of GAM148 include diagnosis, prevention and treatment of diseases and clinical conditions associated with LOC55924.

Mitogen-activated protein kinase kinase kinase 13 (MAP3K13, Accession NP_004712.1) is another GAM148 target gene, herein designated TARGET GENE. MAP3K13 BINDING SITE is a target binding site found in the 5' untranslated region of mRNA encoded by MAP3K13, corresponding to a target binding site such as BINDING SITE I, BINDING SITE II or BINDING SITE III of FIG. 8. Table 4 illustrates the complementarity of the nucleotide sequences of MAP3K13 BINDING SITE, designated SEQ ID:16657, to the nucleotide sequence of GAM148 RNA, herein designated GAM RNA, also designated SEQ ID:280.

Another function of GAM148 is therefore inhibition of Mitogen-activated protein kinase kinase kinase 13 (MAP3K13, Accession NP_004712.1). Accordingly, utilities of GAM148 include diagnosis, prevention and treatment of diseases and clinical conditions associated with MAP3K13.

Membrane-bound transcription factor protease, site 1 (MBTPS1, Accession NP_003782.1) is another GAM148 target gene, herein designated TARGET GENE. MBTPS1 BINDING SITE is a target binding site found in the 5' untranslated region of mRNA encoded by MBTPS1, corresponding to a target binding site such as BINDING SITE I, BINDING SITE II or BINDING SITE III of FIG. 8. Table 4 illustrates the complementarity of the nucleotide sequences of MBTPS1 BINDING SITE, designated SEQ ID:10515, to the nucleotide sequence of GAM148 RNA, herein designated GAM RNA, also designated SEQ ID:280.

Another function of GAM148 is therefore inhibition of Membrane-bound transcription factor protease, site 1 (MBTPS1, Accession NP_003782.1), a gene which catalyzes the first step in the proteolytic activation of the sterol regulatory element-binding proteins (srebps). Accordingly, utilities of GAM148 include diagnosis, prevention and treatment of diseases and clinical conditions associated with MBTPS1.

The function of MBTPS1 has been established by previous studies. The lipid composition of animal cells is controlled by sterol regulatory element binding proteins (SREBPs; OMIM Ref. No. 184756), transcription factors released from membranes by sterol-regulated proteolysis (Brown and Goldstein, 1997). Release is initiated by site-1 protease (S1P), which cleaves SREBPs in the endoplasmic reticulum (ER) luminal loop between 2 membrane-spanning regions (Sakai et al., 1996). The cleavage recognition sequence of S1P is the pentapeptide RSVLS (Duncan et al., 1997). To clone S1P, Sakai et al. (1998) prepared pCMV- PLAP-BP2, which encodes a fusion protein that contains placental alkaline phosphatase (PLAP; 171800) in the ER lumen flanked by cleavage sites for signal peptidase and S1P. In sterol-deprived cells, cleavage by both proteases leads to PLAP secretion. PLAP is not secreted by SRD-12B cells, cholesterol auxotrophs that lack S1P. Sakai et al. (1998) transfected SRD-12B cells with pCMV-PLAP-BP2 plus pools of CHO cDNAs and identified a cDNA that restored site-1 cleavage and PLAP secretion. The cDNA encodes S1P, an intraluminal 1,052-amino acid membrane-bound subtilisin-like protease. The authors proposed that S1P is the sterol-regulated protease that controls lipid metabolism in animal cells. Nakajima et al. (2000) localized the human S1P gene to 16q24 by FISH and radiation hybrid mapping. They showed that the gene is more than 60 kb long and contains 23 exons. Its transcription initiation site within exon 1 is separate from the initiation codon in exon 2. Analysis of the exon/intron structure showed that the S1P gene consists of a mosaic of functional units: exon 1 encodes the 5-prime untranslated region; exon 2 encodes the NH2-terminal signal sequence; and exons 2 and 3 encode the propeptide sequence that is released when S1P is self-activated by intramolecular cleavage. Exons 5-10 encode the subtilisin-homology domain that is critical for catalytic activity, and exon 23 encodes the transmembrane region. Analysis of the putative promoter region revealed a highly GC-rich region containing a binding site for SREBP1, as well as Sp1 (OMIM Ref. No. 189906) and AP2 (OMIM Ref. No. 107580) sites. Therefore, expression of the S1P gene may be under the control of SREBP1, a key regulator of the expression of genes essential for intracellular lipid metabolism.

Full details of the abovementioned studies are described in the following publications, the disclosure of which are hereby incorporated by reference:

Sakai, J.; Rawson, R. B.; Espenshade, P. J.; Cheng, D.; Seegmiller, A. C.; Goldstein, J. L.; Brown, M. S.: Molecular identification of the sterol-regulated luminal protease that cleaves SREBPs and controls lipid composition of animal cells. Molec. Cell 2:505-514, 1998; and Nakajima, T.; Iwaki, K.; Kodama, T.; Inazawa, J.; Emi, M.: Genomic structure and chromosomal mapping of the human site-1 protease (S1P) gene. J. Hum. Genet. 45:212-217, 2000.

Further studies establishing the function and utilities of MBTPS1 are found in John Hopkins OMIM database record ID 603355, and in cited publications listed in Table 5, which are hereby incorporated by reference. MEP50 (Accession NP_077007.1) is another GAM148 target gene, herein designated TARGET GENE. MEP50 BINDING SITE is a target binding site found in the 3' untranslated region of mRNA encoded by MEP50, corresponding to a target binding site such as BINDING SITE I, BINDING SITE II or BINDING SITE III of FIG. 8. Table 4 illustrates the complementarity of the nucleotide sequences of MEP50 BINDING SITE, designated SEQ ID:13864, to the nucleotide sequence of GAM148 RNA, herein designated GAM RNA, also designated SEQ ID:280.

Another function of GAM148 is therefore inhibition of MEP50 (Accession NP_077007.1). Accordingly, utilities of GAM148 include diagnosis, prevention and treatment of diseases and clinical conditions associated with MEP50.

MGC13017 (Accession NP_542387.1) is another GAM148 target gene, herein designated TARGET GENE. MGC13017 BINDING SITE is a target binding site found in the 3' untranslated region of mRNA encoded by MGC13017, corresponding to a target binding site such as BINDING SITE I, BINDING SITE II or BINDING SITE III of FIG. 8. Table 4 illustrates the complementarity of the nucleotide sequences of MGC13017 BINDING SITE, designated SEQ ID:18039, to the nucleotide sequence of GAM148 RNA, herein designated GAM RNA, also designated SEQ ID:280.

Another function of GAM148 is therefore inhibition of MGC13017 (Accession NP_542387.1). Accordingly, utilities of GAM148 include diagnosis, prevention and treatment of diseases and clinical conditions associated with MGC13017.

MGC17403 (Accession NP_689847.1) is another GAM148 target gene, herein designated TARGET GENE. MGC17403 BINDING SITE is a target binding site found in the 3' untranslated region of mRNA encoded by MGC17403, corresponding to a target binding site such as BINDING SITE I, BINDING SITE II or BINDING SITE III of FIG. 8. Table 4 illustrates the complementarity of the nucleotide sequences of MGC17403 BINDING SITE, designated SEQ ID:2263, to the nucleotide sequence of GAM148 RNA, herein designated GAM RNA, also designated SEQ ID:280.

Another function of GAM148 is therefore inhibition of MGC17403 (Accession NP_689847.1). Accordingly, utilities of GAM148 include diagnosis, prevention and treatment of diseases and clinical conditions associated with MGC17403.

MGC35136 (Accession NP_689640.1) is another GAM148 target gene, herein designated TARGET GENE. MGC35136 BINDING SITE is a target binding site found in the 3' untranslated region of mRNA encoded by MGC35136, corresponding to a target binding site such as BINDING SITE I, BINDING SITE II or BINDING SITE III of FIG. 8. Table 4 illustrates the complementarity of the nucleotide sequences of MGC35136 BINDING SITE, designated SEQ ID:13560, to the nucleotide sequence of GAM148 RNA, herein designated GAM RNA, also designated SEQ ID:280.

Another function of GAM148 is therefore inhibition of MGC35136 (Accession NP_689640.1). Accordingly, utilities of GAM148 include diagnosis, prevention and treatment of diseases and clinical conditions associated with MGC35136.

Myotubularin related protein 3 (MTMR3, Accession NP_694691.1) is another GAM148 target gene, herein designated TARGET GENE. MTMR3 BINDING SITE is a target binding site found in the 3' untranslated region of multiple transcripts of mRNA encoded by MTMR3, corresponding to a target binding site such as BINDING SITE I, BINDING SITE II or BINDING SITE III of FIG. 8. Table 4 illustrates the complementarity of the nucleotide sequences of MTMR3 BINDING SITE, designated SEQ ID:17072, to the nucleotide sequence of GAM148 RNA, herein designated GAM RNA, also designated SEQ ID:280.

Another function of GAM148 is therefore inhibition of Myotubularin related protein 3 (MTMR3, Accession NP_694691.1), a gene which could be a tyrosine-phosphatase. Accordingly, utilities of GAM148 include diagnosis, prevention and treatment of diseases and clinical conditions associated with MTMR3.

The function of MTMR3 has been established by previous studies. Zhao et al. (2001) showed that an isoform of MTMR3, missing exon 17, dephosphorylates para-nitrophenylphosphate and phosphatidylinositol 3-phosphate.

Full details of the abovementioned studies are described in the following publications, the disclosure of which are hereby incorporated by reference:

Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4:141-150, 1997; and Zhao, R.; Qi, Y.; Chen, J.; Zhao, Z. J.: FYVE-DSP2, a FYVE domain-containing dual specificity protein phosphatase that dephosphorylates phosphotidylinositol (sic) 3-phosphate. Exp. Cel.

Further studies establishing the function and utilities of MTMR3 are found in John Hopkins OMIM database record ID 603558, and in cited publications listed in Table 5, which are hereby incorporated by reference. Myotubularin related protein 3 (MTMR3, Accession NP_066576.1) is another GAM148 target gene, herein designated TARGET GENE. MTMR3 BINDING SITE is a target binding site found in the 3' untranslated region of multiple transcripts of mRNA encoded by MTMR3, corresponding to a target binding site such as BINDING SITE I, BINDING SITE II or BINDING SITE III of FIG. 8. Table 4 illustrates the complementarity of the nucleotide sequences of MTMR3 BINDING SITE, designated SEQ ID:17072, to the nucleotide sequence of GAM148 RNA, herein designated GAM RNA, also designated SEQ ID:280.

Another function of GAM148 is therefore inhibition of Myotubularin related protein 3 (MTMR3, Accession NP_066576.1), a gene which could be a tyrosine-phosphatase. Accordingly, utilities of GAM148 include diagnosis, prevention and treatment of diseases and clinical conditions associated with MTMR3.

The function of MTMR3 has been established by previous studies. Zhao et al. (2001) showed that an isoform of MTMR3, missing exon 17, dephosphorylates para-nitrophenylphosphate and phosphatidylinositol 3-phosphate.

Full details of the abovementioned studies are described in the following publications, the disclosure of which are hereby incorporated by reference:

Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4:141-150, 1997; and Zhao, R.; Qi, Y.; Chen, J.; Zhao, Z. J.: FYVE-DSP2, a FYVE domain-containing dual specificity protein phosphatase that dephosphorylates phosphotidylinositol (sic) 3-phosphate. Exp. Cel.

Further studies establishing the function and utilities of MTMR3 are found in John Hopkins OMIM database record ID 603558, and in cited publications listed in Table 5, which are hereby incorporated by reference. Myeloid differentiation primary response gene (88) (MYD88, Accession NP_002459.1) is another GAM148 target gene, herein designated TARGET GENE. MYD88 BINDING SITE is a target binding site found in the 3' untranslated region of mRNA encoded by MYD88, corresponding to a target binding site such as BINDING SITE I, BINDING SITE II or BINDING SITE III of FIG. 8. Table 4 illustrates the complementarity of the nucleotide sequences of MYD88 BINDING SITE, designated SEQ ID:10785, to the nucleotide sequence of GAM148 RNA, herein designated GAM RNA, also designated SEQ ID:280.

Another function of GAM148 is therefore inhibition of Myeloid differentiation primary response gene (88) (MYD88, Accession NP_002459.1), a gene which is involved in the toll-like receptor and il-1 receptor signaling pathway in the innate immune response. Accordingly, utilities of GAM148 include diagnosis, prevention and treatment of diseases and clinical conditions associated with MYD88.

The function of MYD88 and its association with various diseases and clinical conditions, has been established by previous studies, as described hereinabove with reference to GAM139.1. NECAB2 (Accession NP_061938.1) is another GAM148 target gene, herein designated TARGET GENE. NECAB2 BINDING SITE is a target binding site found in the 3' untranslated region of mRNA encoded by NECAB2, corresponding to a target binding site such as BINDING SITE I, BINDING SITE II or BINDING SITE III of FIG. 8. Table 4 illustrates the complementarity of the nucleotide sequences of NECAB2 BINDING SITE, designated SEQ ID:5818, to the nucleotide sequence of GAM148 RNA, herein designated GAM RNA, also designated SEQ ID:280.

Another function of GAM148 is therefore inhibition of NECAB2 (Accession NP_061938.1). Accordingly, utilities of GAM148 include diagnosis, prevention and treatment of diseases and clinical conditions associated with NECAB2.

Neuronal cell adhesion molecule (NRCAM, Accession NP_005001.1) is another GAM148 target gene, herein designated TARGET GENE. NRCAM BINDING SITE is a target binding site found in the 3' untranslated region of mRNA encoded by NRCAM, corresponding to a target binding site such as BINDING SITE I, BINDING SITE II or BINDING SITE III of FIG. 8. Table 4 illustrates the complementarity of the nucleotide sequences of NRCAM BINDING SITE, designated SEQ ID:12857, to the nucleotide sequence of GAM148 RNA, herein designated GAM RNA, also designated SEQ ID:280.

Another function of GAM148 is therefore inhibition of Neuronal cell adhesion molecule (NRCAM, Accession NP_005001.1), a gene which functions as a cell surface protein and belongs to the immunoglobulin superfamily. Accordingly, utilities of GAM148 include diagnosis, prevention and treatment of diseases and clinical conditions associated with NRCAM.

The function of NRCAM has been established by previous studies. The cell adhesion molecules (CAMs) are a subset of the immunoglobin (Ig) superfamily found in the nervous systems of both vertebrates and invertebrates. They are usually surface membrane proteins with multiple Ig domains at their N termini followed by several fibronectin type III repeats and either a transmembrane intracellular domain or a glycophosphatidylinositol- linked membrane anchor at the C terminus (Lane et al., 1996). The chicken Bravo/Nr- CAM was described by Grumet et al. (1991) and Kayyem et al. (1992) and shown to play a role in nervous system development. The protein interacts with other cell surface molecules of the Ig superfamily and appears to be necessary for specific pathfinding by axonal growth cones during development (Lane et al., 1996). Lane et al. (1996) cloned the human homolog (NR-CAM) of the chicken gene from a fetal brain library. Like its chicken counterpart, the predicted 1,275-amino acid protein has 6 V-like Ig domains and 5 fibronectin type III repeats. The transmembrane and intracellular domains of human and chicken NRCAM are entirely conserved and the proteins are 82% identical overall. Alternative splice variants were observed involving sequence around the fifth fibronectin repeat. Northern blots showed an approximately 7-kb transcript in all tissues of adult human brain examined.

Full details of the abovementioned studies are described in the following publications, the disclosure of which are hereby incorporated by reference:

Kayyem, J. F.; Roman, J. M.; de la Rosa, E. J.; Schwarz, U.; Dreyer, W. J.: Bravo/Nr- CAM is closely related to the cell adhesion molecules L1 and Ng-CAM and has a similar heterodimer structure. J. Cell. Biol. 118:1259-1270, 1992; and Lane, R. P.; Chen, X.-N.; Yamakawa, K.; Vielmetter, J.; Korenberg, J. R.; Dreyer, W. J.: Characterization of a highly conserved human homolog to the chicken neural cell surface protein.

Further studies establishing the function and utilities of NRCAM are found in John Hopkins OMIM database record ID 601581, and in cited publications listed in Table 5, which are hereby incorporated by reference. Nucleoporin 50 kda (NUP50, Accession NP_009103.2) is another GAM148 target gene, herein designated TARGET GENE. NUP50 BINDING SITE is a target binding site found in the 5' untranslated region of multiple transcripts of mRNA encoded by NUP50, corresponding to a target binding site such as BINDING SITE I, BINDING SITE II or BINDING SITE III of FIG. 8. Table 4 illustrates the complementarity of the nucleotide sequences of NUP50 BINDING SITE, designated SEQ ID:7777, to the nucleotide sequence of GAM148 RNA, herein designated GAM RNA, also designated SEQ ID:280.

Another function of GAM148 is therefore inhibition of Nucleoporin 50 kda (NUP50, Accession NP_009103.2), a gene which is transported through the nuclear pore complex (NPC) by the importin-alpha:beta receptor. Accordingly, utilities of GAM148 include diagnosis, prevention and treatment of diseases and clinical conditions associated with NUP50.

The function of NUP50 has been established by previous studies. Using exon trapping and genomic sequence analysis to identify genes within 22q13.3, Trichet et al. (1999) identified NUP50, a human homolog of rat Npap60, is distantly related to the yeast Nup2 protein and belongs to the FG (phegly) nucleoporin family. The authors isolated a cDNA corresponding to the entire NUP50 coding sequence. The deduced 468-amino acid NUP50 protein contains 5 FG repeats. NUP50 shares 70% sequence identity with rat Npap60. However, the C-terminal end of NUP50 is 87 amino acids longer than that of Npap60. Northern blot analysis of various human tissues detected several NUP50 transcripts with different tissue specificities: a 2-kb transcript expressed at low levels in all tissues tested, but with considerably higher expression in testis, peripheral blood leukocytes, and fetal liver; a 2.8-kb transcript expressed in all tissues tested, but with highest expression in testis; a 4-kb transcript expressed only in peripheral blood leukocytes; a 5-kb transcript expressed at similar levels in all tissues tested; and an 8-kb transcript weakly expressed in spleen, testis, ovary, and blood leukocytes. In addition, RT-PCR detected the 8-kb transcript in fetal brain. Trichet et al. (1999) found that NUP50 transcripts use at least 3 alternative polyadenylation sites and possibly have alternative 5-prime ends; they did not detect alternative splicing. Many nuclear-targeted proteins are transported through the NPC by the importin-alpha:importin-beta heterodimer (see OMIM Ref. No. 602738). Lindsay et al. (2002) showed that NUP50, a protein previously believed to be a structural component of the NPC, is a RAN (OMIM Ref. No. 601179)-binding protein and a cofactor for importin-alpha:importin-beta-mediated import. NUP50 is a tristable switch that alternates between binding modes. The C terminus binds importin-beta through RAN-GTP. The N terminus binds the C terminus of importin-alpha, while a central domain binds importin-beta. NUP50:importin-alpha:importin-beta binds cargo and can stimulate nuclear import. Endogenous NUP50 can shuttle and is accessible from the cytoplasmic side of the nuclear envelope. These findings identified NUP50 as a cofactor for importin-alpha:importin-beta nuclear import and as a subunit of the importin complex.

Full details of the abovementioned studies are described in the following publications, the disclosure of which are hereby incorporated by reference:

Lindsay, M. E.; Plafker, K.; Smith, A. E.; Clurman, B. E.; Macara, I. G.: Npap60/Nup50 is a tri-stable switch that stimulates importin-alpha:beta- mediated nuclear protein import. Cell 110:349-360, 2002; and Trichet, V.; Shkolny, D.; Dunham, I.; Beare, D.; McDermid, H. E.: Mapping and complex expression pattern of the human NPAP60L nucleoporin gene. Cytogenet. Cell Genet. 85:221-226, 199.

Further studies establishing the function and utilities of NUP50 are found in John Hopkins OMIM database record ID 604646, and in cited publications listed in Table 5, which are hereby incorporated by reference. Nucleoporin 50 kda (NUP50, Accession NP_710151.1) is another GAM148 target gene, herein designated TARGET GENE. NUP50 BINDING SITE is a target binding site found in the 5' untranslated region of multiple transcripts of mRNA encoded by NUP50, corresponding to a target binding site such as BINDING SITE I, BINDING SITE II or BINDING SITE III of FIG. 8. Table 4 illustrates the complementarity of the nucleotide sequences of NUP50 BINDING SITE, designated SEQ ID:7777, to the nucleotide sequence of GAM148 RNA, herein designated GAM RNA, also designated SEQ ID:280.

Another function of GAM148 is therefore inhibition of Nucleoporin 50 kda (NUP50, Accession NP_710151.1), a gene which is transported through the nuclear pore complex (NPC) by the importin-alpha:beta receptor. Accordingly, utilities of GAM148 include diagnosis, prevention and treatment of diseases and clinical conditions associated with NUP50.

The function of NUP50 has been established by previous studies. Using exon trapping and genomic sequence analysis to identify genes within 22q13.3, Trichet et al. (1999) identified NUP50, a human homolog of rat Npap60, is distantly related to the yeast Nup2 protein and belongs to the FG (phe-gly) nucleoporin family. The authors isolated a cDNA corresponding to the entire NUP50 coding sequence. The deduced 468-amino acid NUP50 protein contains 5 FG repeats. NUP50 shares 70% sequence identity with rat Npap60. However, the C-terminal end of NUP50 is 87 amino acids longer than that of Npap60. Northern blot analysis of various human tissues detected several NUP50 transcripts with different tissue specificities: a 2-kb transcript expressed at low levels in all tissues tested, but with considerably higher expression in testis, peripheral blood leukocytes, and fetal liver; a 2.8-kb transcript expressed in all tissues tested, but with highest expression in testis; a 4-kb transcript expressed only in peripheral blood leukocytes; a 5-kb transcript expressed at similar levels in all tissues tested; and an 8-kb transcript weakly expressed in spleen, testis, ovary, and blood leukocytes. In addition, RT-PCR detected the 8-kb transcript in fetal brain. Trichet et al. (1999) found that NUP50 transcripts use at least 3 alternative polyadenylation sites and possibly have alternative 5-prime ends; they did not detect alternative splicing. Many nuclear-targeted proteins are transported through the NPC by the importin-alpha:importin-beta heterodimer (see OMIM Ref. No. 602738). Lindsay et al. (2002) showed that NUP50, a protein previously believed to be a structural component of the NPC, is a RAN (OMIM Ref. No. 601179)-binding protein and a cofactor for importin-alpha:importin-beta-mediated import. NUP50 is a tristable switch that alternates between binding modes. The C terminus binds importin-beta through RAN-GTP. The N terminus binds the C terminus of importin-alpha, while a central domain binds importin-beta. NUP50:importin-alpha:importin-beta binds cargo and can stimulate nuclear import. Endogenous NUP50 can shuttle and is accessible from the cytoplasmic side of the nuclear envelope. These findings identified NUP50 as a cofactor for importin-alpha:importin-beta nuclear import and as a subunit of the importin complex.

Full details of the abovementioned studies are described in the following publications, the disclosure of which are hereby incorporated by reference:

Lindsay, M. E.; Plafker, K.; Smith, A. E.; Clurman, B. E.; Macara, I. G.: Npap60/Nup50 is a tri-stable switch that stimulates importin-alpha:beta- mediated nuclear protein import. Cell 110:349-360, 2002; and Trichet, V.; Shkolny, D.; Dunham, I.; Beare, D.; McDermid, H. E.: Mapping and complex expression pattern of the human NPAP60L nucleoporin gene. Cytogenet. Cell Genet. 85:221-226, 199.

Further studies establishing the function and utilities of NUP50 are found in John Hopkins OMIM database record ID 604646, and in cited publications listed in Table 5, which are hereby incorporated by reference. Orthopedia homolog (drosophila) (OTP, Accession NP_115485.1) is another GAM148 target gene, herein designated TARGET GENE. OTP BINDING SITE is a target binding site found in the 3' untranslated region of mRNA encoded by OTP, corresponding to a target binding site such as BINDING SITE I, BINDING SITE II or BINDING SITE III of FIG. 8. Table 4 illustrates the complementarity of the nucleotide sequences of OTP BINDING SITE, designated SEQ ID:2151, to the nucleotide sequence of GAM148 RNA, herein designated GAM RNA, also designated SEQ ID:280.

Another function of GAM148 is therefore inhibition of Orthopedia homolog (drosophila) (OTP, Accession NP_115485.1), a gene which involves in the development of the forebrain and spinal cord. Accordingly, utilities of GAM148 include diagnosis, prevention and treatment of diseases and clinical conditions associated with OTP.

The function of OTP has been established by previous studies. Homeodomain genes are helix-turn-helix transcription factors that play key roles in the specification of cell fates. In the central nervous system, homeodomain genes not only position cells along an axis, but also specify cell migration patterns and may influence axonal connectivity. In an effort to identify novel homeodomain genes involved in the development of the human central nervous system, Lin et al. (1999) cloned, characterized, and mapped the human homolog of the murine homeodomain gene Orthopedia (Otp), whose product is found in multiple cell groups within the mouse hypothalamus, amygdala, and brain stem. The human OTP cDNA encodes a protein of 325 amino acids. The deduced amino acid sequence is 99% homologous to mouse Otp and demonstrated a high degree of conservation when compared to sea urchin and Drosophila Otp proteins. A single putative OTP gene product was found in 17-week human fetal brain tissue by Western blot analysis using a novel polyclonal antibody raised against a conserved 13-amino acid sequence in the C terminus of the OTP protein. Expression in the developing human hypothalamus was confirmed by immunohistochemistry. Lin et al. (1999) mapped the human OTP gene to chromosome 5q13.3 using analysis of a radiation hybrid panel and by fluorescence in situ hybridization.

Animal model experiments lend further support to the function of OTP. Acampora et al. (1999) generated mice deficient in Otp by homologous recombination. Homozygous Otp -/- mice died soon after birth and displayed progressive impairment of crucial neuroendocrine developmental events such as reduced cell proliferation, abnormal cell migration, and failure in terminal differentiation of the parvocellular and magnocellular neurons of the anterior periventricular, paraventricular, supraoptic, and arcuate nuclei. Acampora et al. (1999) suggested that Otp and Sim1 (OMIM Ref. No. 603128) are required to maintain Brn2 (OMIM Ref. No. 600494) expression which, in turn, is required for neuronal cell lineages secreting oxytocin (OMIM Ref. No. 167050), arginine vasopressin (OMIM Ref. No. 192340), and corticotropin-releasing (OMIM Ref. No. 122560) hormones.

It is appreciated that the abovementioned animal model for OTP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Acampora, D.; Postiglione, M. P.; Avantaggiato, V.; Di Bonito, M.; Vaccarino, F. M.; Michaud, J.; Simeone, A.: Progressive impairment of developing neuroendocrine cell lineages in the hypothalamus of mice lacking the Orthopedia gene. Genes Dev. 13:2787-2800, 1999; and Lin, X.; State, M. W.; Vaccarino, F. M.; Greally, J.; Hass, M.; Leckman, J. F.: Identification, chromosomal assignment, and expression analysis of the human homeodomain- containing gene.

Further studies establishing the function and utilities of OTP are found in John Hopkins OMIM database record ID 604529, and in cited publications listed in Table 5, which are hereby incorporated by reference. Procollagen c-endopeptidase enhancer (PCOLCE, Accession NP_002584.1) is another GAM148 target gene, herein designated TARGET GENE. PCOLCE BINDING SITE is a target binding site found in the 3' untranslated region of mRNA encoded by PCOLCE, corresponding to a target binding site such as BINDING SITE I, BINDING SITE II or BINDING SITE III of FIG. 8. Table 4 illustrates the complementarity of the nucleotide sequences of PCOLCE BINDING SITE, designated SEQ ID:4646, to the nucleotide sequence of GAM148 RNA, herein designated GAM RNA, also designated SEQ ID:280.

Another function of GAM148 is therefore inhibition of Procollagen c-endopeptidase enhancer (PCOLCE, Accession NP_002584.1), a gene which binds to the cooh-terminal propeptide of type i procollagen and enhances procollagen c-proteinase activity. Accordingly, utilities of GAM148 include diagnosis, prevention and treatment of diseases and clinical conditions associated with PCOLCE.

The function of PCOLCE has been established by previous studies. Fibrillar collagen types I-III are synthesized as precursor molecules known as procollagens. These precursors contain amino- and carboxyl-terminal peptide extensions known as N- and C-propeptides, respectively, which are cleaved, upon secretion of procollagen from the cell, to yield the mature triple helical, highly structured fibrils. In the mouse, procollagen C-proteinase depends for full expression upon the presence of either a 55-kD glycoprotein or smaller 36- and 34-kD proteolytically processed forms of the same protein. None of the 3 enhancer proteins exhibits intrinsic procollagen processing activity, but all are capable of enhancing the activity of the C-proteinase by approximately one order of magnitude. Takahara et al. (1994) purified type I procollagen COOH-terminal proteinase enhancer, a glycoprotein that binds to the COOH-terminal propeptide of type I procollagen and enhances C-proteinase activity, from mouse fibroblast culture medium. Sequences of mouse enhancer cDNA predicted a protein of approximately 50 kD and 468 amino acids. Human cDNAs encoded an enhancer of 449 amino acids. Mouse enhancer RNA was shown to be at highest levels in collagen-rich tissues, especially tendon. By Southern analysis of genomic DNA from panels of human/mouse cell hybrids and by fluorescence in situ hybridization, Takahara et al. (1994) localized the PCOLCE gene to 7q21.3-q22, the same region containing the type I collagen alpha-2 chain gene (COL1A2; 120160). Takahara et al. (1996) investigated further the apparent proximity of the 2 genes by the study of somatic cell hybrids, cosmid contigs, and interspecific backcross mice. They found that PCOLCE and COL1A2 are separated by at least 6 Mb and that Pcolce and Col1a2 are located on separate chromosomes in the mouse, chromosomes 5 and 6, respectively.

Full details of the abovementioned studies are described in the following publications, the disclosure of which are hereby incorporated by reference:

Takahara, K.; Kessler, E.; Biniaminov, L.; Brusel, M.; Eddy, R. L.; Jani-Sait, S.; Shows, T. B.; Greenspan, D. S.: Type I procollagen COOH-terminal proteinase enhancer protein: identification, primary structure, and chromosomal localization of the cognate human gene (PCOLCE). J. Biol. Chem. 269:26280-26285, 1994. ; and Takahara, K.; Osborne, L.; Elliott, R. W.; Tsui, L.-C.; Scherer, S. W.; Greenspan, D. S.: Fine mapping of the human and mouse genes for the type I procollagen COOH- terminal proteinase.

Further studies establishing the function and utilities of PCOLCE are found in John Hopkins OMIM database record ID 600270, and in cited publications listed in Table 5, which are hereby incorporated by reference. Phospholipase c, delta 1 (PLCD1, Accession NP_006216.1) is another GAM148 target gene, herein designated TARGET GENE. PLCD1 BINDING SITE is a target binding site found in the 3' untranslated region of mRNA encoded by PLCD1, corresponding to a target binding site such as BINDING SITE I, BINDING SITE II or BINDING SITE III of FIG. 8. Table 4 illustrates the complementarity of the nucleotide sequences of PLCD1 BINDING SITE, designated SEQ ID:8152, to the nucleotide sequence of GAM148 RNA, herein designated GAM RNA, also designated SEQ ID:280.

Another function of GAM148 is therefore inhibition of Phospholipase c, delta 1 (PLCD1, Accession NP_006216.1), a gene which acts as a signal transducer that generates 2 messengers, diacylglycerol and inositol 1,4,5-trisphosphate and therefore may be associated with Alzheimer disease. Accordingly, utilities of GAM148 include diagnosis, prevention and treatment of Alzheimer disease, and of other diseases and clinical conditions associated with PLCD1.

The function of PLCD1 has been established by previous studies. Phosphoinositide-specific phospholipase C acts as a signal transducer that generates 2 messengers, diacylglycerol and inositol 1,4,5-trisphosphate, by hydrolyzing inositol phospholipids. Molecules belonging to the PLC family are divided into subfamilies, PLC-beta (see OMIM Ref. No. 600810), PLC-gamma (see OMIM Ref. No. 172420), and PLC-delta, whose amino acid sequences are highly conserved in 2 distinct regions designated X and Y. PLC-delta-1 is distinguished from PLC-gamma by lack of the SH2 and SH3 domains that are essential for activation of PLC-gamma by tyrosine protein kinases, and from PLC-beta by lack of the C-terminal region of PLC-beta that is responsible for binding and activation by G proteins. Cheng et al. (1995) cloned cDNA for human PLC-delta-1 and localized the gene to chromosome 3 by means of a human/rodent somatic cell panel (Lyu et al., 1996). In the course of a large-scale sequencing analysis of genomic DNA in the vicinity of the homozygous deletion on chromosome 3p found in a lung cancer cell line, Ishikawa et al. (1997) found that the gene encoding phospholipase C, delta-1 (PLCD1) is located just distal to the region removed by the deletion. They found that the gene consists of 15 exons and spans about 22 kb. By fluorescence in situ hybridization, they localized the PLCD1 gene to 3p22-p21.3. Shimohama et al. (1998) examined the entire sequences corresponding to protein-coding exons 2-15 of the hamster PLC-delta-1 gene in genomic DNA derived from the leukocytes of 13 unrelated patients with early-onset sporadic Alzheimer disease (OMIM Ref. No. 104300). In 1 of these patients whose clinical features and course did not differ from those of the other 12 cases, they found a change of codon CGC (arg) to CAC (his), located in the pleckstrin homology domain of the PLCD1 gene. They stated that this was the first mutation found in the human PLC genes. Site-directed mutagenesis of the glutathione-S-transferase (GST/PLCD1) fusion protein changing arg105 to his resulted in a 4-fold decrease in the affinity of specific binding and a reduction in hydrolyzing activity to about 40% of that of the wildtype enzyme. This remarkable loss of function could be interpreted in terms of a conformational change in the pleckstrin homology domain. Shimohama et al. (1998) found that the arg105- to - his mutation was present in heterozygous state in the patient with AD. The mutation was not found in DNA extracted from leukocytes of 23 unrelated patients with familial AD, 23 unrelated patients with early- onset sporadic AD, 46 unrelated patients with late-onset sporadic AD, and 456 nondemented control subjects. Thus the change did not appear to be a common polymorphism. However, determination of the possible pathologic role required transgenic studies of the mutant gene to determine the role of the enzyme and the mutation and a search for other mutations in the pleckstrin homology domain of PLC genes in human subjects with genetic disorders. They pointed out that mutations in the pleckstrin homology domain of the BTK gene occur in patients with Bruton agammaglobulinemia (OMIM Ref. No. 300300).

Full details of the abovementioned studies are described in the following publications, the disclosure of which are hereby incorporated by reference:

Cheng, H. F.; Jiang, M. J.; Chen, C. L.; Liu, S. M.; Wong, L. P.; Lomasney, J. W.; King, K.: Cloning and identification of amino acid residues of human phospholipase C delta 1 essential for catalysis. J. Biol. Chem. 270:5495-5505, 1995; and Ishikawa, S.; Takahashi, T.; Ogawa, M.; Nakamura, Y.: Genomic structure of the human PLCD1 (phospholipase C delta 1) locus on 3p22-p21.3. Cytogenet. Cell Genet. 78:58-60, 1997.

Further studies establishing the function and utilities of PLCD1 are found in John Hopkins OMIM database record ID 602142, and in cited publications listed in Table 5, which are hereby incorporated by reference. PP2447 (Accession NP_079480.1) is another GAM148 target gene, herein designated TARGET GENE. PP2447 BINDING SITE is a target binding site found in the 5' untranslated region of mRNA encoded by PP2447, corresponding to a target binding site such as BINDING SITE I, BINDING SITE II or BINDING SITE III of FIG. 8. Table 4 illustrates the complementarity of the nucleotide sequences of PP2447 BINDING SITE, designated SEQ ID:10796, to the nucleotide sequence of GAM148 RNA, herein designated GAM RNA, also designated SEQ ID:280.

Another function of GAM148 is therefore inhibition of PP2447 (Accession NP_079480.1). Accordingly, utilities of GAM148 include diagnosis, prevention and treatment of diseases and clinical conditions associated with PP2447.

Protein phosphatase 1, regulatory (inhibitor) subunit 11 (PPP1R11, Accession NP_740751.1) is another GAM148 target gene, herein designated TARGET GENE. PPP1R11 BINDING SITE is a target binding site found in the 3' untranslated region of multiple transcripts of mRNA encoded by PPP1R11, corresponding to a target binding site such as BINDING SITE I, BINDING SITE II or BINDING SITE III of FIG. 8. Table 4 illustrates the complementarity of the nucleotide sequences of PPP1R11 BINDING SITE, designated SEQ ID:15269, to the nucleotide sequence of GAM148 RNA, herein designated GAM RNA, also designated SEQ ID:280.

Another function of GAM148 is therefore inhibition of Protein phosphatase 1, regulatory (inhibitor) subunit 11 (PPP1R11, Accession NP_740751.1), a gene which inhibits rabbit muscle protein phosphatase-1 in vitro. Accordingly, utilities of GAM148 include diagnosis, prevention and treatment of diseases and clinical conditions associated with PPP1R11.

The function of PPP1R11 and its association with various diseases and clinical conditions, has been established by previous studies, as described hereinabove with reference to GAM94.1. Protein phosphatase 1, regulatory (inhibitor) subunit 11 (PPP1R11, Accession NP_068778.1) is another GAM148 target gene, herein designated TARGET GENE. PPP1R11 BINDING SITE is a target binding site found in the 3' untranslated region of multiple transcripts of mRNA encoded by PPP1R11, corresponding to a target binding site such as BINDING SITE I, BINDING SITE II or BINDING SITE III of FIG. 8. Table 4 illustrates the complementarity of the nucleotide sequences of PPP1R11 BINDING SITE, designated SEQ ID:15269, to the nucleotide sequence of GAM148 RNA, herein designated GAM RNA, also designated SEQ ID:280.

Another function of GAM148 is therefore inhibition of Protein phosphatase 1, regulatory (inhibitor) subunit 11 (PPP1R11, Accession NP_068778.1), a gene which inhibits rabbit muscle protein phosphatase-1 in vitro. Accordingly, utilities of GAM148 include diagnosis, prevention and treatment of diseases and clinical conditions associated with PPP1R11.

The function of PPP1R11 and its association with various diseases and clinical conditions, has been established by previous studies, as described hereinabove with reference to GAM94.1. Protein phosphatase 2a, regulatory subunit b' (pr 53) (PPP2R4, Accession NP_821069.1) is another GAM148 target gene, herein designated TARGET GENE. PPP2R4 BINDING SITE is a target binding site found in the 5' untranslated region of multiple transcripts of mRNA encoded by PPP2R4, corresponding to a target binding site such as BINDING SITE I, BINDING SITE II or BINDING SITE III of FIG. 8. Table 4 illustrates the complementarity of the nucleotide sequences of PPP2R4 BINDING SITE, designated SEQ ID:14893, to the nucleotide sequence of GAM148 RNA, herein designated GAM RNA, also designated SEQ ID:280.

Another function of GAM148 is therefore inhibition of Protein phosphatase 2a, regulatory subunit b' (pr 53) (PPP2R4, Accession NP_821069.1), a gene which is a regulatory subunit of protein phosphatase 2A. Accordingly, utilities of GAM148 include diagnosis, prevention and treatment of diseases and clinical conditions associated with PPP2R4.

The function of PPP2R4 has been established by previous studies. McCright et al. (1996) stated that PP2A contains a 36-kD catalytic C subunit (OMIM Ref. No. 176915) and a 65-kD structural/regulatory A subunit. Association of this dimeric core of PP2A with a third regulatory subunit (PR54, PR55, PR72, PR74, PR130, etc.) results in the formation of a specific trimeric holoenzyme. The PPP2R4 gene (which the authors symbolized PTPA) encodes a specific phosphotyrosyl phosphatase activator of the dimeric form of protein phosphatase 2A. Van Hoof et al. (1995) demonstrated that human PTPA is encoded by a single-copy gene composed of 10 exons and 9 introns with a total length of about 60 kb. The 5-prime flanking sequence of the transcription start site was analyzed for its potential as a promoter. This region lacks a TATA sequence in the appropriate position relative to the transcription start. However, this region is very GC-rich and contains four Sp1 sites (SP1; 189906) upstream of the transcription start site, a feature common to many TATA-less promoters. Based on homology with DNA-binding consensus sequences of transcription factors, Van Hoof et al. (1995) identified several additional putative transcription factor binding sites in the promoter region. Transfection experiments with a construct containing the PTPA promoter region inserted 5-prime of a luciferase reporter gene demonstrated that the 5-prime flanking sequence of the PTPA gene indeed has promoter activity that seems to be cell- line dependent. By fluorescence in situ hybridization, Van Hoof et al. (1995) mapped the PTPA gene to 9q34. Fluorescence in situ analysis of metaphase chromosomes of patients bearing the Philadelphia chromosome indicated that PTPA is positioned centromeric of ABL1 (OMIM Ref. No. 189980) and probably is not involved in chronic myeloid leukemia.

Full details of the abovementioned studies are described in the following publications, the disclosure of which are hereby incorporated by reference:

McCright, B.; Rivers, A. M.; Audlin, S.; Virshup, D. M.: The B56 family of protein phosphatase 2A (PP2A) regulatory subunits encodes differentiation- induced phosphoproteins that target PP2A to both nucleus and cytoplasm. J. Biol. Chem. 271:22081-22089, 1996; and Van Hoof, C.; Aly, M. S.; Garcia, A.; Cayla, X.; Cassiman, J. J.; Merlevede, W.; Goris, J.: Structure and chromosomal localization of the human gene of the phosphotyrosyl phosphatase a.

Further studies establishing the function and utilities of PPP2R4 are found in John Hopkins OMIM database record ID 600756, and in cited publications listed in Table 5, which are hereby incorporated by reference. Proline rich 2 (PROL2, Accession NP_006804.1) is another GAM148 target gene, herein designated TARGET GENE. PROL2 BINDING SITE is a target binding site found in the 5' untranslated region of mRNA encoded by PROL2, corresponding to a target binding site such as BINDING SITE I, BINDING SITE II or BINDING SITE III of FIG. 8. Table 4 illustrates the complementarity of the nucleotide sequences of PROL2 BINDING SITE, designated SEQ ID:17200, to the nucleotide sequence of GAM148 RNA, herein designated GAM RNA, also designated SEQ ID:280.

Another function of GAM148 is therefore inhibition of Proline rich 2 (PROL2, Accession NP_006804.1). Accordingly, utilities of GAM148 include diagnosis, prevention and treatment of diseases and clinical conditions associated with PROL2.

Prostaglandin f2 receptor negative regulator (PTGFRN, Accession XP_040709.3) is another GAM148 target gene, herein designated TARGET GENE. PTGFRN BINDING SITE is a target binding site found in the 3' untranslated region of mRNA encoded by PTGFRN, corresponding to a target binding site such as BINDING SITE I, BINDING SITE II or BINDING SITE III of FIG. 8. Table 4 illustrates the complementarity of the nucleotide sequences of PTGFRN BINDING SITE, designated SEQ ID:14508, to the nucleotide sequence of GAM148 RNA, herein designated GAM RNA, also designated SEQ ID:280.

Another function of GAM148 is therefore inhibition of Prostaglandin f2 receptor negative regulator (PTGFRN, Accession XP_040709.3), a gene which inhibits the binding of prostaglandin f2-alpha (pgf2-alpha) to its specific fp receptor. Accordingly, utilities of GAM148 include diagnosis, prevention and treatment of diseases and clinical conditions associated with PTGFRN.

The function of PTGFRN and its association with various diseases and clinical conditions, has been established by previous studies, as described hereinabove with reference to GAM94.1. Prostaglandin i2 (prostacyclin) synthase (PTGIS, Accession NP_000952.1) is another GAM148 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:15201, to the nucleotide sequence of GAM148 RNA, herein designated GAM RNA, also designated SEQ ID:280.

Another function of GAM148 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM148 include diagnosis, prevention and treatment of diseases and clinical conditions associated with PTGIS.

The function of PTGIS and its association with various diseases and clinical conditions, has been established by previous studies, as described hereinabove with reference to GAM30.1. Protein tyrosine phosphatase, non-receptor type substrate 1 (PTPNS1, Accession NP_542970.1) is another GAM148 target gene, herein designated TARGET GENE. PTPNS1 BINDING SITE is a target binding site found in the 3' untranslated region of mRNA encoded by PTPNS1, corresponding to a target binding site such as BINDING SITE I, BINDING SITE II or BINDING SITE III of FIG. 8. Table 4 illustrates the complementarity of the nucleotide sequences of PTPNS1 BINDING SITE, designated SEQ ID:9261, to the nucleotide sequence of GAM148 RNA, herein designated GAM RNA, also designated SEQ ID:280.

Another function of GAM148 is therefore inhibition of Protein tyrosine phosphatase, non-receptor type substrate 1 (PTPNS1, Accession NP_542970.1). Accordingly, utilities of GAM148 include diagnosis, prevention and treatment of diseases and clinical conditions associated with PTPNS1.

Rad52 homolog (s. cerevisiae) (RAD52, Accession NP_602295.1) is another GAM148 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52 BINDING SITE, designated SEQ ID:9644, to the nucleotide sequence of GAM148 RNA, herein designated GAM RNA, also designated SEQ ID:280.

Another function of GAM148 is therefore inhibition of Rad52 homolog (s. cerevisiae) (RAD52, Accession NP_602295.1). Accordingly, utilities of GAM148 include diagnosis, prevention and treatment of diseases and clinical conditions associated with RAD52.

SBLF (Accession NP_006864.2) is another GAM148 target gene, herein designated TARGET GENE. SBLF BINDING SITE is a target binding site found in the 3' untranslated region of mRNA encoded by SBLF, corresponding to a target binding site such as BINDING SITE I, BINDING SITE II or BINDING SITE III of FIG. 8. Table 4 illustrates the complementarity of the nucleotide sequences of SBLF BINDING SITE, designated SEQ ID:5432, to the nucleotide sequence of GAM148 RNA, herein designated GAM RNA, also designated SEQ ID:280.

Another function of GAM148 is therefore inhibition of SBLF (Accession NP_006864.2). Accordingly, utilities of GAM148 include diagnosis, prevention and treatment of diseases and clinical conditions associated with SBLF.

Src family associated phosphoprotein 1 (SCAP1, Accession NP_003717.2) is another GAM148 target gene, herein designated TARGET GENE. SCAP1 BINDING SITE is a target binding site found in the 3' untranslated region of mRNA encoded by SCAP1, corresponding to a target binding site such as BINDING SITE I, BINDING SITE II or BINDING SITE III of FIG. 8. Table 4 illustrates the complementarity of the nucleotide sequences of SCAP1 BINDING SITE, designated SEQ ID:13627, to the nucleotide sequence of GAM148 RNA, herein designated GAM RNA, also designated SEQ ID:280.

Another function of GAM148 is therefore inhibition of Src family associated phosphoprotein 1 (SCAP1, Accession NP_003717.2). Accordingly, utilities of GAM148 include diagnosis, prevention and treatment of diseases and clinical conditions associated with SCAP1.

Sidekick homolog 1 (chicken) (SDK1, Accession NP_689957.1) is another GAM148 target gene, herein designated TARGET GENE. SDK1 BINDING SITE is a target binding site found in the 3' untranslated region of mRNA encoded by SDK1, corresponding to a target binding site such as BINDING SITE I, BINDING SITE II or BINDING SITE III of FIG. 8. Table 4 illustrates the complementarity of the nucleotide sequences of SDK1 BINDING SITE, designated SEQ ID:16745, to the nucleotide sequence of GAM148 RNA, herein designated GAM RNA, also designated SEQ ID:280.

Another function of GAM148 is therefore inhibition of Sidekick homolog 1 (chicken) (SDK1, Accession NP_689957.1). Accordingly, utilities of GAM148 include diagnosis, prevention and treatment of diseases and clinical conditions associated with SDK1.

Solute carrier family 21 (prostaglandin transporter), member 2 (SLC21A2, Accession NP_005621.1) is another GAM148 target gene, herein designated TARGET GENE. SLC21A2 BINDING SITE is a target binding site found in the 3' untranslated region of mRNA encoded by SLC21A2, corresponding to a target binding site such as BINDING SITE I, BINDING SITE II or BINDING SITE III of FIG. 8. Table 4 illustrates the complementarity of the nucleotide sequences of SLC21A2 BINDING SITE, designated SEQ ID:10394, to the nucleotide sequence of GAM148 RNA, herein designated GAM RNA, also designated SEQ ID:280.

Another function of GAM148 is therefore inhibition of Solute carrier family 21 (prostaglandin transporter), member 2 (SLC21A2, Accession NP_005621.1), a gene which is a Prostaglandin transporter. Accordingly, utilities of GAM148 include diagnosis, prevention and treatment of diseases and clinical conditions associated with SLC21A2.

The function of SLC21A2 has been established by previous studies. At physiologic pH, prostaglandins (PGs) traverse biologic membranes poorly. Accordingly, PG transport is carrier-mediated in many tissues, including the lung, choroid plexus, liver, anterior chamber of the ey, vagina and uterus, and placenta. Kanai et al. (1995) cloned the rat prostaglandin transporter (symbolized PGT by them) and postulated 3 possible roles for the transporter. First, PGT might mediate the efflux of newly synthesized PGs from cells. Second, PGT might mediate epithelial PG transport. A third possible role of PGT is that of mediating PG clearance and degradation. Lu et al. (1996) favored the clearance role for PGT. Using a rat PGT probe on Northern blots of human kidney mRNA, they found evidence for the presence of a human PGT homolog. They screened a human kidney cDNA library and isolated human PGT. The gene encodes a 643-amino acid polypeptide with 82% identity to the rat protein. They expressed a full-length human cDNA clone in cultured cells and reported that both rat and human PGT transport PGD2, as well as PGE1, PGE2, and PGF2a. Although human PGT has cDNA and deduced amino acid sequences similar to those of the rat, the tissue distribution of mRNA transcripts is substantially broader in human. Additionally, the diversity of human PGT transcripts is greater and the affinity for thromboxane-2 is greater. Lu et al. (1996) found strong PGT mRNA expression in the human fetus. By PCR-based monochromosomal somatic cell hybrid mapping and fluorescence in situ hybridization, Lu and Schuster (1998) mapped the PGT gene to 3q21.

Full details of the abovementioned studies are described in the following publications, the disclosure of which are hereby incorporated by reference:

Kanai, N.; Lu, R.; Satriano, J. A.; Bao, Y.; Wolkoff, A. W.; Schuster, V. L.: Identification and characterization of a prostaglandin transporter. Science 268:866-869, 1995; and Lu, R.; Kanai, N.; Bao, Y.; Schuster, V. L.: Cloning, in vitro expression, and tissue distribution of a human prostaglandin transporter cDNA (hPGT). J. Clin. Invest. 98:1142-1149, 1996.

Further studies establishing the function and utilities of SLC21A2 are found in John Hopkins OMIM database record ID 601460, and in cited publications listed in Table 5, which are hereby incorporated by reference. Solute carrier family 25 (mitochondrial carrier; citrate transporter), member 1 (SLC25A1, Accession NP_005975.1) is another GAM148 target gene, herein designated TARGET GENE. SLC25A1 BINDING SITE is a target binding site found in the 3' untranslated region of mRNA encoded by SLC25A1, corresponding to a target binding site such as BINDING SITE I, BINDING SITE II or BINDING SITE III of FIG. 8. Table 4 illustrates the complementarity of the nucleotide sequences of SLC25A1 BINDING SITE, designated SEQ ID:16041, to the nucleotide sequence of GAM148 RNA, herein designated GAM RNA, also designated SEQ ID:280.

Another function of GAM148 is therefore inhibition of Solute carrier family 25 (mitochondrial carrier; citrate transporter), member 1 (SLC25A1, Accession NP_005975.1). Accordingly, utilities of GAM148 include diagnosis, prevention and treatment of diseases and clinical conditions associated with SLC25A1.

SMO (Accession NP_005622.1) is another GAM148 target gene, herein designated TARGET GENE. SMO BINDING SITE is a target binding site found in the 3' untranslated region of mRNA encoded by SMO, corresponding to a target binding site such as BINDING SITE I, BINDING SITE II or BINDING SITE III of FIG. 8. Table 4 illustrates the complementarity of the nucleotide sequences of SMO BINDING SITE, designated SEQ ID:19323, to the nucleotide sequence of GAM148 RNA, herein designated GAM RNA, also designated SEQ ID:280.

Another function of GAM148 is therefore inhibition of SMO (Accession NP_005622.1). Accordingly, utilities of GAM148 include diagnosis, prevention and treatment of diseases and clinical conditions associated with SMO.

Small nuclear ribonucleoprotein d3 polypeptide 18 kda (SNRPD3, Accession NP_004166.1) is another GAM148 target gene, herein designated TARGET GENE. SNRPD3 BINDING SITE is a target binding site found in the 5' untranslated region of mRNA encoded by SNRPD3, corresponding to a target binding site such as BINDING SITE I, BINDING SITE II or BINDING SITE III of FIG. 8. Table 4 illustrates the complementarity of the nucleotide sequences of SNRPD3 BINDING SITE, designated SEQ ID:2958, to the nucleotide sequence of GAM148 RNA, herein designated GAM RNA, also designated SEQ ID:280.

Another function of GAM148 is therefore inhibition of Small nuclear ribonucleoprotein d3 polypeptide 18 kda (SNRPD3, Accession NP_004166.1). Accordingly, utilities of GAM148 include diagnosis, prevention and treatment of diseases and clinical conditions associated with SNRPD3.

SNX27 (Accession NP_112180.4) is another GAM148 target gene, herein designated TARGET GENE. SNX27 BINDING SITE is a target binding site found in the 3' untranslated region of mRNA encoded by SNX27, corresponding to a target binding site such as BINDING SITE I, BINDING SITE II or BINDING SITE III of FIG. 8. Table 4 illustrates the complementarity of the nucleotide sequences of SNX27 BINDING SITE, designated SEQ ID:19179, to the nucleotide sequence of GAM148 RNA, herein designated GAM RNA, also designated SEQ ID:280.

Another function of GAM148 is therefore inhibition of SNX27 (Accession NP_112180.4). Accordingly, utilities of GAM148 include diagnosis, prevention and treatment of diseases and clinical conditions associated with SNX27.

Spondin 1, (f-spondin) extracellular matrix protein (SPON1, Accession NP_006099.1) is another GAM148 target gene, herein designated TARGET GENE. SPON1 BINDING SITE is a target binding site found in the 3' untranslated region of mRNA encoded by SPON1, corresponding to a target binding site such as BINDING SITE I, BINDING SITE II or BINDING SITE III of FIG. 8. Table 4 illustrates the complementarity of the nucleotide sequences of SPON1 BINDING SITE, designated SEQ ID:2566, to the nucleotide sequence of GAM148 RNA, herein designated GAM RNA, also designated SEQ ID:280.

Another function of GAM148 is therefore inhibition of Spondin 1, (f-spondin) extracellular matrix protein (SPON1, Accession NP_006099.1). Accordingly, utilities of GAM148 include diagnosis, prevention and treatment of diseases and clinical conditions associated with SPON1.

Sprouty homolog 4 (drosophila) (SPRY4, Accession NP_112226.2) is another GAM148 target gene, herein designated TARGET GENE. SPRY4 BINDING SITE is a target binding site found in the 3' untranslated region of mRNA encoded by SPRY4, corresponding to a target binding site such as BINDING SITE I, BINDING SITE II or BINDING SITE III of FIG. 8. Table 4 illustrates the complementarity of the nucleotide sequences of SPRY4 BINDING SITE, designated SEQ ID:18907, to the nucleotide sequence of GAM148 RNA, herein designated GAM RNA, also designated SEQ ID:280.

Another function of GAM148 is therefore inhibition of Sprouty homolog 4 (drosophila) (SPRY4, Accession NP_112226.2). Accordingly, utilities of GAM148 include diagnosis, prevention and treatment of diseases and clinical conditions associated with SPRY4.

Spectrin, beta, non-erythrocytic 2 (SPTBN2, Accession NP_008877.1) is another GAM148 target gene, herein designated TARGET GENE. SPTBN2 BINDING SITE is a target binding site found in the 3' untranslated region of mRNA encoded by SPTBN2, corresponding to a target binding site such as BINDING SITE I, BINDING SITE II or BINDING SITE III of FIG. 8. Table 4 illustrates the complementarity of the nucleotide sequences of SPTBN2 BINDING SITE, designated SEQ ID:11121, to the nucleotide sequence of GAM148 RNA, herein designated GAM RNA, also designated SEQ ID:280.

Another function of GAM148 is therefore inhibition of Spectrin, beta, non-erythrocytic 2 (SPTBN2, Accession NP_008877.1). Accordingly, utilities of GAM148 include diagnosis, prevention and treatment of diseases and clinical conditions associated with SPTBN2.

Steroid-5-alpha-reductase, alpha polypeptide 2 (3-oxo-5 alpha-steroid delta 4-dehydrogenase alpha 2) (SRD5A2, Accession NP_000339.1) is another GAM148 target gene, herein designated TARGET GENE. SRD5A2 BINDING SITE is a target binding site found in the 5' untranslated region of mRNA encoded by SRD5A2, corresponding to a target binding site such as BINDING SITE I, BINDING SITE II or BINDING SITE III of FIG. 8. Table 4 illustrates the complementarity of the nucleotide sequences of SRD5A2 BINDING SITE, designated SEQ ID:13219, to the nucleotide sequence of GAM148 RNA, herein designated GAM RNA, also designated SEQ ID:280.

Another function of GAM148 is therefore inhibition of Steroid-5-alpha-reductase, alpha polypeptide 2 (3-oxo-5 alpha-steroid delta 4-dehydrogenase alpha 2) (SRD5A2, Accession NP_000339.1). Accordingly, utilities of GAM148 include diagnosis, prevention and treatment of diseases and clinical conditions associated with SRD5A2.

Steroidogenic acute regulatory protein (STAR, Accession NP_000340.1) is another GAM148 target gene, herein designated TARGET GENE. STAR BINDING SITE is a target binding site found in the 3' untranslated region of mRNA encoded by STAR, corresponding to a target binding site such as BINDING SITE I, BINDING SITE II or BINDING SITE III of FIG. 8. Table 4 illustrates the complementarity of the nucleotide sequences of STAR BINDING SITE, designated SEQ ID:10859, to the nucleotide sequence of GAM148 RNA, herein designated GAM RNA, also designated SEQ ID:280.

Another function of GAM148 is therefore inhibition of Steroidogenic acute regulatory protein (STAR, Accession NP_000340.1). Accordingly, utilities of GAM148 include diagnosis, prevention and treatment of diseases and clinical conditions associated with STAR.

Synaptotagmin xiii (SYT13, Accession NP_065877.1) is another GAM148 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:9376, to the nucleotide sequence of GAM148 RNA, herein designated GAM RNA, also designated SEQ ID:280.

Another function of GAM148 is therefore inhibition of Synaptotagmin xiii (SYT13, Accession NP_065877.1). Accordingly, utilities of GAM148 include diagnosis, prevention and treatment of diseases and clinical conditions associated with SYT13.

Tolloid-like 1 (TLL1, Accession NP_036596.3) is another GAM148 target gene, herein designated TARGET GENE. TLL1 BINDING SITE is a target binding site found in the 5' untranslated region of mRNA encoded by TLL1, corresponding to a target binding site such as BINDING SITE I, BINDING SITE II or BINDING SITE III of FIG. 8. Table 4 illustrates the complementarity of the nucleotide sequences of TLL1 BINDING SITE, designated SEQ ID:13124, to the nucleotide sequence of GAM148 RNA, herein designated GAM RNA, also designated SEQ ID:280.

Another function of GAM148 is therefore inhibition of Tolloid-like 1 (TLL1, Accession NP_036596.3), a gene which is involved in bone morphogenesis. Accordingly, utilities of GAM148 include diagnosis, prevention and treatment of diseases and clinical conditions associated with TLL1.

The function of TLL1 and its association with various diseases and clinical conditions, has been established by previous studies, as described hereinabove with reference to GAM106.1. Transmembrane 7 superfamily member 2 (TM7SF2, Accession NP_003264.1) is another GAM148 target gene, herein designated TARGET GENE. TM7SF2 BINDING SITE is a target binding site found in the 5' untranslated region of mRNA encoded by TM7SF2, corresponding to a target binding site such as BINDING SITE I, BINDING SITE II or BINDING SITE III of FIG. 8. Table 4 illustrates the complementarity of the nucleotide sequences of TM7SF2 BINDING SITE, designated SEQ ID:11046, to the nucleotide sequence of GAM148 RNA, herein designated GAM RNA, also designated SEQ ID:280.

Another function of GAM148 is therefore inhibition of Transmembrane 7 superfamily member 2 (TM7SF2, Accession NP_003264.1). Accordingly, utilities of GAM148 include diagnosis, prevention and treatment of diseases and clinical conditions associated with TM7SF2.

Tumor necrosis factor receptor superfamily, member 14 (herpesvirus entry mediator) (TNFRSF14, Accession NP_003811.2) is another GAM148 target gene, herein designated TARGET GENE. TNFRSF14 BINDING SITE is a target binding site found in the 5' untranslated region of mRNA encoded by TNFRSF14, corresponding to a target binding site such as BINDING SITE I, BINDING SITE II or BINDING SITE III of FIG. 8. Table 4 illustrates the complementarity of the nucleotide sequences of TNFRSF14 BINDING SITE, designated SEQ ID:5580, to the nucleotide sequence of GAM148 RNA, herein designated GAM RNA, also designated SEQ ID:280.

Another function of GAM148 is therefore inhibition of Tumor necrosis factor receptor superfamily, member 14 (herpesvirus entry mediator) (TNFRSF14, Accession NP_003811.2), a gene which mediates entry of herpes simplex virus (HSV). Accordingly, utilities of GAM148 include diagnosis, prevention and treatment of diseases and clinical conditions associated with TNFRSF14.

The function of TNFRSF14 has been established by previous studies. Members of the tumor necrosis factor receptor (TNFR) family play a key role in regulating the immune response to infection (see OMIM Ref. No. TNFR1, 191190). By screening for genes that mediate the entry of herpes simplex virus (HSV) into Chinese hamster ovary (CHO) cells, Montgomery et al. (1996) identified cDNAs encoding a member of the TNFR family. They designated the gene HVEM (herpesvirus entry mediator). The predicted 283-amino acid protein had characteristics of a type I membrane glycoprotein, with an N-terminal signal peptide, 2 potential sites for addition of N-linked glycans, and a putative membrane-spanning domain. Sequence analysis revealed that HVEM contained a cysteine-rich repeat region characteristic of TNFR family members, and shared 17 to 25% amino acid identity with other TNFRs. Montgomery et al. (1996) suggested that HVEM plays an important role in HSV pathogenesis because it enhanced the entry of several wildtype HSV strains of both serotypes into CHO cells, and mediated HSV entry into activated human T cells. Independently, Kwon et al. (1997) cloned cDNAs encoding HVEM, which they designated TR2. Northern blot analysis revealed that HVEM is expressed as a 1.7-kb mRNA in several tissues, with the highest expression in lung, spleen, and thymus. Several additional larger mRNAs were observed in some tissues and several of the cDNAs contained insertions in the coding region, leading Kwon et al. (1997) to suggest that HVEM is regulated at the level of mRNA maturation. These authors reported that the in vitro translation product was 32 kD by SDS-PAGE. HSV infection requires binding of the viral envelope glycoprotein D (gD) to cell surface receptors. Carfi et al. (2001) reported the x-ray structures of a soluble, truncated ectodomain of gD both alone and in complex with the ectodomain of its cellular receptor, TNFRSF14, which they called HVEA. Two bound anions suggested possible binding sites for another gD receptor, a 3-O-sulfonated heparan sulfate. The structures revealed a V-like immunoglobulin fold at the core of gD that is closely related to cellular adhesion molecules and flanked by large N- and C-terminal extensions. The receptor-binding segment of gD, an N-terminal hairpin, appeared conformationally flexible, suggesting that a conformational change accompanying binding might be part of the viral entry mechanism.

Full details of the abovementioned studies are described in the following publications, the disclosure of which are hereby incorporated by reference:

Kwon, B. S.; Tan, K. B.; Ni, J.; Oh, K.-O.; Lee, Z. H.; Kim, K. K.; Kim, Y.-J.; Wang, S.; Gentz, R.; y, G.-L.; Harrop, J.; Ly, S. D.; Silverman, C.; Porter, T. G.; Truneh, A.; Young, P. R.: A newly identified member of the tumor necrosis factor receptor superfamily with a wide tissue distribution and involvement in lymphocyte activation. J. Biol. Chem. 272:14272-14276, 1997; and Carfi, A.; Willis, S. H.; Whitbeck, J. C.; Krummenacher, C.; Cohen, G. H.; Eisenberg, R. J.; Wiley, D. C.: Herpes simplex virus glycoprotein D bound to the human receptor HveA. Molec.

Further studies establishing the function and utilities of TNFRSF14 are found in John Hopkins OMIM database record ID 602746, and in cited publications listed in Table 5, which are hereby incorporated by reference. Tankyrase 1 binding protein 1, 182 kda (TNKS1BP1, Accession NP_203754.1) is another GAM148 target gene, herein designated TARGET GENE. TNKS1BP1 BINDING SITE is a target binding site found in the 5' untranslated region of mRNA encoded by TNKS1BP1, corresponding to a target binding site such as BINDING SITE I, BINDING SITE II or BINDING SITE III of FIG. 8. Table 4 illustrates the complementarity of the nucleotide sequences of TNKS1BP1 BINDING SITE, designated SEQ ID:5658, to the nucleotide sequence of GAM148 RNA, herein designated GAM RNA, also designated SEQ ID:280.

Another function of GAM148 is therefore inhibition of Tankyrase 1 binding protein 1, 182 kda (TNKS1BP1, Accession NP_203754.1). Accordingly, utilities of GAM148 include diagnosis, prevention and treatment of diseases and clinical conditions associated with TNKS1BP1.

TPCN1 (Accession NP_060371.2) is another GAM148 target gene, herein designated TARGET GENE. TPCN1 BINDING SITE is a target binding site found in the 3' untranslated region of mRNA encoded by TPCN1, corresponding to a target binding site such as BINDING SITE I, BINDING SITE II or BINDING SITE III of FIG. 8. Table 4 illustrates the complementarity of the nucleotide sequences of TPCN1 BINDING SITE, designated SEQ ID:3418, to the nucleotide sequence of GAM148 RNA, herein designated GAM RNA, also designated SEQ ID:280.

Another function of GAM148 is therefore inhibition of TPCN1 (Accession NP_060371.2). Accordingly, utilities of GAM148 include diagnosis, prevention and treatment of diseases and clinical conditions associated with TPCN1.

Tnfrsf1a-associated via death domain (TRADD, Accession NP_700474.1) is another GAM148 target gene, herein designated TARGET GENE. TRADD BINDING SITE1 and TRADD BINDING SITE2 are target binding sites found in untranslated regions of multiple transcripts of mRNA encoded by TRADD, corresponding to target binding sites such as BINDING SITE I, BINDING SITE II or BINDING SITE III of FIG. 8. Table 4 illustrates the complementarity of the nucleotide sequences of TRADD BINDING SITE1 and TRADD BINDING SITE2, designated SEQ ID:3225 and SEQ ID:605 respectively, to the nucleotide sequence of GAM148 RNA, herein designated GAM RNA, also designated SEQ ID:280.

Another function of GAM148 is therefore inhibition of Tnfrsf1a-associated via death domain (TRADD, Accession NP_700474.1), a gene which specifically interacts with the cytoplasmic domain of activated tnfr1. interacts with trafs (traf1 and traf2), fadd and rip. acts as an adaptor molecule for tnfr1 mediating its interaction with fadd. overexpression of tradd leads to two major tnf-induced responses, apoptosis and activation of nf-kappa b. Accordingly, utilities of GAM148 include diagnosis, prevention and treatment of diseases and clinical conditions associated with TRADD.

The function of TRADD and its association with various diseases and clinical conditions, has been established by previous studies, as described hereinabove with reference to GAM40.1. TRAP240 (Accession NP_005112.1) is another GAM148 target gene, herein designated TARGET GENE. TRAP240 BINDING SITE is a target binding site found in the 5' untranslated region of mRNA encoded by TRAP240, corresponding to a target binding site such as BINDING SITE I, BINDING SITE II or BINDING SITE III of FIG. 8. Table 4 illustrates the complementarity of the nucleotide sequences of TRAP240 BINDING SITE, designated SEQ ID:596, to the nucleotide sequence of GAM148 RNA, herein designated GAM RNA, also designated SEQ ID:280.

Another function of GAM148 is therefore inhibition of TRAP240 (Accession NP_005112.1), a gene which Subunit of TRAP thyroid hormone receptor-associated protein complex; coactivator for nuclear receptors. Accordingly, utilities of GAM148 include diagnosis, prevention and treatment of diseases and clinical conditions associated with TRAP240.

The function of TRAP240 has been established by previous studies. For background information on thyroid hormone receptor-associated proteins (TRAPs), see 300182. Using a HeLa cell line, Ito et al. (1999) cloned TRAP240, the gene encoding the 240-kD subunit of the TRAP complex. The TRAP240 cDNA encodes a 2,174-amino acid protein that shows a regional identity of 29% and a similarity of 46% with a hypothetical C. elegans protein (CEK08F8 and CEF07H5). It shows no obvious relationship with known consensus sequences, other than 2 ligand-dependent nuclear hormone receptor signature recognition motifs (LXXLL sequences) at positions 1188-1192 and 1279-1283, and a short leucine zipper at position 1331-1352. Northern blot analysis of multiple human tissues showed that the TRAP240 gene is ubiquitously expressed as an approximately 11.5-kb transcript. Nagase et al. (1998) also cloned the cDNA encoding TRAP240, which they referred to as KIAA0593, from a human brain cDNA library. By analysis of a human-rodent hybrid panel, Nagase et al. (1998) mapped the TRAP240 gene to chromosome 17

Full details of the abovementioned studies are described in the following publications, the disclosure of which are hereby incorporated by reference:

Ito, M.; Yuan, C.-X.; Malik, S.; Gu, W.; Fondell, J. D.; Yamamura, S.; Fu, Z.-Y.; Zhang, X.; Qin, J.; Roeder, R. G.: Identity between TRAP and SMCC complexes indicates novel pathways for the function of nuclear receptors and diverse mammalian activators. Molec. Cell 3:361-370, 1999; and Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 100.

Further studies establishing the function and utilities of TRAP240 are found in John Hopkins OMIM database record ID 603808, and in cited publications listed in Table 5, which are hereby incorporated by reference. Three prime repair exonuclease 1 (TREX1, Accession NP_338598.1) is another GAM148 target gene, herein designated TARGET GENE. TREX1 BINDING SITE is a target binding site found in the 5' untranslated region of multiple transcripts of mRNA encoded by TREX1, corresponding to a target binding site such as BINDING SITE I, BINDING SITE II or BINDING SITE III of FIG. 8. Table 4 illustrates the complementarity of the nucleotide sequences of TREX1 BINDING SITE, designated SEQ ID:6080, to the nucleotide sequence of GAM148 RNA, herein designated GAM RNA, also designated SEQ ID:280.

Another function of GAM148 is therefore inhibition of Three prime repair exonuclease 1 (TREX1, Accession NP_338598.1). Accordingly, utilities of GAM148 include diagnosis, prevention and treatment of diseases and clinical conditions associated with TREX1.

Translin (TSN, Accession NP_004613.1) is another GAM148 target gene, herein designated TARGET GENE. TSN BINDING SITE is a target binding site found in the 3' untranslated region of mRNA encoded by TSN, corresponding to a target binding site such as BINDING SITE I, BINDING SITE II or BINDING SITE III of FIG. 8. Table 4 illustrates the complementarity of the nucleotide sequences of TSN BINDING SITE, designated SEQ ID:15704, to the nucleotide sequence of GAM148 RNA, herein designated GAM RNA, also designated SEQ ID:280.

Another function of GAM148 is therefore inhibition of Translin (TSN, Accession NP_004613.1), a gene which is a DNA binding protein and involved in DNA repair, replication, or recombination. Accordingly, utilities of GAM148 include diagnosis, prevention and treatment of diseases and clinical conditions associated with TSN.

The function of TSN and its association with various diseases and clinical conditions, has been established by previous studies, as described hereinabove with reference to GAM72.1. Ubiquitin associated protein 2 (UBAP2, Accession NP_680476.1) is another GAM148 target gene, herein designated TARGET GENE. UBAP2 BINDING SITE1 and UBAP2 BINDING SITE2 are target binding sites found in untranslated regions of multiple transcripts of mRNA encoded by UBAP2, corresponding to target binding sites such as BINDING SITE I, BINDING SITE II or BINDING SITE III of FIG. 8. Table 4 illustrates the complementarity of the nucleotide sequences of UBAP2 BINDING SITE1 and UBAP2 BINDING SITE2, designated SEQ ID:3406 and SEQ ID:6591 respectively, to the nucleotide sequence of GAM148 RNA, herein designated GAM RNA, also designated SEQ ID:280.

Another function of GAM148 is therefore inhibition of Ubiquitin associated protein 2 (UBAP2, Accession NP_680476.1). Accordingly, utilities of GAM148 include diagnosis, prevention and treatment of diseases and clinical conditions associated with UBAP2.

Udp glycosyltransferase 2 family, polypeptide b4 (UGT2B4, Accession NP_066962.1) is another GAM148 target gene, herein designated TARGET GENE. UGT2B4 BINDING SITE is a target binding site found in the 3' untranslated region of mRNA encoded by UGT2B4, corresponding to a target binding site such as BINDING SITE I, BINDING SITE II or BINDING SITE III of FIG. 8. Table 4 illustrates the complementarity of the nucleotide sequences of UGT2B4 BINDING SITE, designated SEQ ID:8980, to the nucleotide sequence of GAM148 RNA, herein designated GAM RNA, also designated SEQ ID:280.

Another function of GAM148 is therefore inhibition of Udp glycosyltransferase 2 family, polypeptide b4 (UGT2B4, Accession NP_066962.1), a gene which is of major importance in the conjugation and subsequent elimination of potentially toxic xenobiotics and endogenous compounds. Accordingly, utilities of GAM148 include diagnosis, prevention and treatment of diseases and clinical conditions associated with UGT2B4.

The function of UGT2B4 has been established by previous studies. The UDP-glucuronosyltransferases, a group of isoenzymes located primarily in hepatic endoplasmic reticulum and nuclear envelope, are encoded by a large multigene family that has evolved to produce catalysts with differing but overlapping substrate specificities. Two subfamilies are recognized by sequence identities (Burchell et al., 1991). UGT1 consists of at least 4 isoenzymes that catalyze the glucuronidation of phenols and bilirubin. All 4 map to chromosome 2 and probably derive from the same gene (UGT1; 191740). The UGT2 family contains at least 5 members catalyzing steroid or bile acid glucuronidation. Members of the subfamily share 65 to 90% amino acid sequence identity. However, unlike the phenol UGT cDNAs, where the high degree of identity is concentrated in the 3-prime region of the cDNA, the steroid UGTs have a high degree of sequence homology throughout the cDNA. Riedy et al. (2000) examined a genomic map spanning approximately 500 to 1000 kb in the 4q13 region. They placed UGT2B4 between UGT2B7 and UGT2B15. Also, access to a large reference DNA bank allowed them to calculate the allele frequencies for a single nucleotide polymorphism (SNP), Q458D, in UGT2B4 among 803 unrelated individuals representing 5 ethnic populations. The findings suggested a recent evolutionary history of gene duplication, mutation, and rearrangement.

Full details of the abovementioned studies are described in the following publications, the disclosure of which are hereby incorporated by reference:

Burchell, B.; Nebert, D. W.; Nelson, D. R.; Bock, K. W.; Iyanagi, T.; Jansen, P. L. M.; Lancet, T.; Mulder, G. J.; Chowdhury, J. R.; Siest, G.; Tephly, T. R.; Mackenzie, P. I.: The UDP-glucuronosyltransferase gene superfamily: suggested nomenclature based on evolutionary divergence. DNA Cell Biol. 10:487-494, 1991; and Riedy, M.; Wang, J. Y.; Miller, A. P.; Buckler, A.; Hall, J.; Guida, M.: Genomic organization of the UGT2b gene cluster on human chromosome 4q13. Pharmacogenetics 10:251-260, 2000.

Further studies establishing the function and utilities of UGT2B4 are found in John Hopkins OMIM database record ID 600067, and in cited publications listed in Table 5, which are hereby incorporated by reference. X-prolyl aminopeptidase (aminopeptidase p) 2, membrane-bound (XPNPEP2, Accession NP_003390.2) is another GAM148 target gene, herein designated TARGET GENE. XPNPEP2 BINDING SITE is a target binding site found in the 3' untranslated region of mRNA encoded by XPNPEP2, corresponding to a target binding site such as BINDING SITE I, BINDING SITE II or BINDING SITE III of FIG. 8. Table 4 illustrates the complementarity of the nucleotide sequences of XPNPEP2 BINDING SITE, designated SEQ ID:966, to the nucleotide sequence of GAM148 RNA, herein designated GAM RNA, also designated SEQ ID:280.

Another function of GAM148 is therefore inhibition of X-prolyl aminopeptidase (aminopeptidase p) 2, membrane-bound (XPNPEP2, Accession NP_003390.2), a gene which is a membrane-associated X-prolyl metallopeptidase. Accordingly, utilities of GAM148 include diagnosis, prevention and treatment of diseases and clinical conditions associated with XPNPEP2.

The function of XPNPEP2 has been established by previous studies. Aminopeptidase P is a widely distributed hydrolase that is specific for N-terminal imido bonds, which are common to several collagen degradation products, neuropeptides, vasoactive peptides, and cytokines. Structurally, the enzyme is a member of the 'pita bread fold' family and occurs in mammalian tissues in both soluble and GPI-anchored membrane-bound forms. By RT-PCR using degenerate oligonucleotides based on the pig aminopeptidase P amino acid sequence, and by 5-prime and 3-prime RACE, Venema et al. (1997) isolated human kidney and lung cDNAs encoding XPNPEP2. The deduced XPNPEP2 protein has 673 amino acids and an estimated molecular mass of 75,490 Da. The authors stated that the human and pig XPNPEP2 amino acid sequences show significant evolutionary divergence, with 83% identity; 5 of 6 potential N-glycosylation sites, and 5 of 6 cysteine residues that are potentially involved in disulfide bond formation, are conserved. Northern blot analysis detected a 3.5-kb XPNPEP2 transcript in human kidney, lung, heart, placenta, liver, small intestine, and colon, but not in brain, skeletal muscle, pancreas, spleen, thymus, prostate, testis, ovary, or leukocytes. Based on these results and on RT-PCR studies, Venema et al. (1997) suggested that the membrane-bound form and the soluble form, which is found in brain and leukocytes, are the products of 2 different genes or of alternative splicing of a single primary transcript. Women with balanced translocations between the long arm of the X chromosome and an autosome frequently suffer premature ovarian failure (POF; 311360). Two critical regions for POF which extend from Xq13 to Xq22 and from Xq22 to Xq26 have been identified by cytogenetic studies. To gain insight into the mechanism(s) responsible for ovarian failure in women with X/autosome translocations, Prueitt et al. (2000) molecularly characterized the translocation breakpoints of 9 X chromosomes. They mapped the breakpoints using somatic cell hybrids retaining the derivative autosome and densely spaced markers from the X-chromosome physical map. One of the POF-associated breakpoints in a critical region (Xq25) mapped to a sequenced PAC clone. The translocation disrupts XPNPEP2. XPNPEP2 mRNA was detected in fibroblasts that carried the translocation, suggesting that this gene at least partially escapes X inactivation. Although the physiologic substrates for the enzyme were not known, Prueitt et al. (2000) suggested that XPNPEP2 is a candidate gene for POF.

Full details of the abovementioned studies are described in the following publications, the disclosure of which are hereby incorporated by reference:

Venema, R. C.; Ju, H.; Zou, R.; Venema, V. J.; Ryan, J. W.: Cloning and tissue distribution of human membrane-bound aminopeptidase P. Biochim. Biophys. Acta 1354:45-48, 1997; and Prueitt, R. L.; Ross, J. L.; Zinn, A. R.: Physical mapping of nine Xq translocation breakpoints and identification of XPNPEP2 as a premature ovarian failure candidate gene. Cytogenet.

Further studies establishing the function and utilities of XPNPEP2 are found in John Hopkins OMIM database record ID 300145, and in cited publications listed in Table 5, which are hereby incorporated by reference. Zinc finger protein 91 homolog (mouse) (ZFP91, Accession NP_739574.1) is another GAM148 target gene, herein designated TARGET GENE. ZFP91 BINDING SITE is a target binding site found in the 3' untranslated region of multiple transcripts of mRNA encoded by ZFP91, corresponding to a target binding site such as BINDING SITE I, BINDING SITE II or BINDING SITE III of FIG. 8. Table 4 illustrates the complementarity of the nucleotide sequences of ZFP91 BINDING SITE, designated SEQ ID:15418, to the nucleotide sequence of GAM148 RNA, herein designated GAM RNA, also designated SEQ ID:280.

Another function of GAM148 is therefore inhibition of Zinc finger protein 91 homolog (mouse) (ZFP91, Accession NP_739574.1). Accordingly, utilities of GAM148 include diagnosis, prevention and treatment of diseases and clinical conditions associated with ZFP91.

FIG. 8 further provides a conceptual description of a novel bioinformatically detected of the present invention, referred to here as Genomic Address Messenger 149 (GAM149), which modulates expression of respective target genes thereof, the function and utility of which target genes is known in the art.

GAM149 is a novel bioinformatically detected regulatory, non protein coding, micro RNA (miRNA) gene. The method by which GAM149 was detected is described hereinabove with reference to FIGS. 8-15.

GAM149 gene, herein designated GAM GENE, and GAM149 target gene, herein designated TARGET GENE, are human genes contained in the human genome.

GAM149 gene encodes a GAM149 precursor RNA, herein designated GAM PRECURSOR RNA. Similar to other miRNA genes, and unlike most ordinary genes, GAM149 precursor RNA does not encode a protein. A nucleotide sequence identical or highly similar to the nucleotide sequence of GAM149 precursor RNA is designated SEQ ID:146, and is provided hereinbelow with reference to the sequence listing part.

GAM149 precursor RNA folds onto itself, forming GAM149 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM149 precursor RNA folds onto itself, forming GAM149 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM149 precursor RNA, designated SEQ-ID:146, and a schematic representation of a predicted secondary folding of GAM149 folded precursor RNA are further described with reference to Table 2, hereby incorporated by reference.

An enzyme complex designated DICER COMPLEX, 'dices' the GAM149 folded precursor RNA into GAM149 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM149 RNA is designated SEQ ID:237, and is provided hereinbelow with references to the sequence listing part and Table 3, hereby incorporated by reference.

GAM149 target gene, herein designated TARGET GENE, encodes a corresponding messenger RNA, GAM149 target RNA, herein designated GAM TARGET RNA. GAM149 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM149 RNA, herein designated GAM RNA, binds complementarily to one or more target binding sites located in untranslated regions of GAM149 target RNA, herein designated GAM TARGET RNA. This complementary binding is due to the fact that the nucleotide sequence of GAM149 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM149 RNA may have a different number of target binding sites in untranslated regions of a GAM149 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM149 RNA, herein designated GAM RNA, to target binding sites on GAM149 target RNA, herein designated GAM TARGET RNA, such as BINDING SITE I, BINDING SITE II and BINDING SITE III, inhibits translation of GAM149 target RNA into GAM149 target protein, herein designated GAM TARGET PROTEIN. GAM target protein is therefore outlined by a broken line.

It is appreciated that GAM149 target gene, herein designated TARGET GENE, in fact represents a plurality of GAM149 target genes. The mRNA of each one of this plurality of GAM149 target genes comprises one or more target binding sites, each having a nucleotide sequence which is at least partly complementary to GAM149 RNA, herein designated GAM RNA, and which when bound by GAM149 RNA causes inhibition of translation of respective one or more GAM149 target proteins.

It is further appreciated by one skilled in the art that the mode of translational inhibition illustrated by FIG. 8 with specific reference to translational inhibition exerted by GAM149 gene, herein designated GAM GENE, on one or more GAM149 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM149 correlate with, and may be deduced from, the identity of the target genes which GAM149 binds and inhibits, and the function of these target genes, as elaborated hereinbelow.

Centaurin, gamma 1 (CENTG1, Accession NM_014770.1) is a GAM149 target gene, herein designated TARGET GENE. CENTG1 BINDING SITE is a target binding site found in the 3' untranslated region of mRNA encoded by CENTG1, corresponding to a target binding site such as BINDING SITE I, BINDING SITE II or BINDING SITE III of FIG. 8. Table 4 illustrates the complementarity of the nucleotide sequences of CENTG1 BINDING SITE, designated SEQ ID:18082, to the nucleotide sequence of GAM149 RNA, herein designated GAM RNA, also designated SEQ ID:237.

A function of GAM149 is therefore inhibition of Centaurin, gamma 1 (CENTG1, Accession NM_014770.1). Accordingly, utilities of GAM149 include diagnosis, prevention and treatment of diseases and clinical conditions associated with CENTG1.

LCHN (Accession XM_098615.2) is another GAM149 target gene, herein designated TARGET GENE. LCHN BINDING SITE is a target binding site found in the 3' untranslated region of mRNA encoded by LCHN, corresponding to a target binding site such as BINDING SITE I, BINDING SITE II or BINDING SITE III of FIG. 8. Table 4 illustrates the complementarity of the nucleotide sequences of LCHN BINDING SITE, designated SEQ ID:6008, to the nucleotide sequence of GAM149 RNA, herein designated GAM RNA, also designated SEQ ID:237.

Another function of GAM149 is therefore inhibition of LCHN (Accession XM_098615.2). Accordingly, utilities of GAM149 include diagnosis, prevention and treatment of diseases and clinical conditions associated with LCHN.

Leptin receptor overlapping transcript-like 1 (LEPROTL1, Accession NM_015344.1) is another GAM149 target gene, herein designated TARGET GENE. LEPROTL1 BINDING SITE is a target binding site found in the 3' untranslated region of mRNA encoded by LEPROTL1, corresponding to a target binding site such as BINDING SITE I, BINDING SITE II or BINDING SITE III of FIG. 8. Table 4 illustrates the complementarity of the nucleotide sequences of LEPROTL1 BINDING SITE, designated SEQ ID:8728, to the nucleotide sequence of GAM149 RNA, herein designated GAM RNA, also designated SEQ ID:237.

Another function of GAM149 is therefore inhibition of Leptin receptor overlapping transcript-like 1 (LEPROTL1, Accession NM_015344.1). Accordingly, utilities of GAM149 include diagnosis, prevention and treatment of diseases and clinical conditions associated with LEPROTL1.

LOC203286 (Accession) is another GAM149 target gene, herein designated TARGET GENE. LOC203286 BINDING SITE is a target binding site found in the 5' untranslated region of mRNA encoded by LOC203286, corresponding to a target binding site such as BINDING SITE I, BINDING SITE II or BINDING SITE III of FIG. 8. Table 4 illustrates the complementarity of the nucleotide sequences of LOC203286 BINDING SITE, designated SEQ ID:5131, to the nucleotide sequence of GAM149 RNA, herein designated GAM RNA, also designated SEQ ID:237.

Another function of GAM149 is therefore inhibition of LOC203286 (Accession). Accordingly, utilities of GAM149 include diagnosis, prevention and treatment of diseases and clinical conditions associated with LOC203286.

FIG. 8 further provides a conceptual description of a novel bioinformatically detected of the present invention, referred to here as Genomic Address Messenger 150 (GAM150), which modulates expression of respective target genes thereof, the function and utility of which target genes is known in the art.

GAM150 is a novel bioinformatically detected regulatory, non protein coding, micro RNA (miRNA) gene. The method by which GAM150 was detected is described hereinabove with reference to FIGS. 8-15.

GAM150 gene, herein designated GAM GENE, and GAM150 target gene, herein designated TARGET GENE, are human genes contained in the human genome.

GAM150 gene encodes a GAM150 precursor RNA, herein designated GAM PRECURSOR RNA. Similar to other miRNA genes, and unlike most ordinary genes, GAM150 precursor RNA does not encode a protein. A nucleotide sequence identical or highly similar to the nucleotide sequence of GAM150 precursor RNA is designated SEQ ID:6, and is provided hereinbelow with reference to the sequence listing part.

GAM150 precursor RNA folds onto itself, forming GAM150 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM150 precursor RNA folds onto itself, forming GAM150 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM150 precursor RNA, designated SEQ-ID:6, and a schematic representation of a predicted secondary folding of GAM150 folded precursor RNA are further described with reference to Table 2, hereby incorporated by reference.

An enzyme complex designated DICER COMPLEX, 'dices' the GAM150 folded precursor RNA into GAM150 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM150 RNA is designated SEQ ID:261, and is provided hereinbelow with references to the sequence listing part and Table 3, hereby incorporated by reference.

GAM150 target gene, herein designated TARGET GENE, encodes a corresponding messenger RNA, GAM150 target RNA, herein designated GAM TARGET RNA. GAM150 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM150 RNA, herein designated GAM RNA, binds complementarily to one or more target binding sites located in untranslated regions of GAM150 target RNA, herein designated GAM TARGET RNA. This complementary binding is due to the fact that the nucleotide sequence of GAM150 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM150 RNA may have a different number of target binding sites in untranslated regions of a GAM150 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM150 RNA, herein designated GAM RNA, to target binding sites on GAM150 target RNA, herein designated GAM TARGET RNA, such as BINDING SITE I, BINDING SITE II and BINDING SITE III, inhibits translation of GAM150 target RNA into GAM150 target protein, herein designated GAM TARGET PROTEIN. GAM target protein is therefore outlined by a broken line.

It is appreciated that GAM150 target gene, herein designated TARGET GENE, in fact represents a plurality of GAM150 target genes. The mRNA of each one of this plurality of GAM150 target genes comprises one or more target binding sites, each having a nucleotide sequence which is at least partly complementary to GAM150 RNA, herein designated GAM RNA, and which when bound by GAM150 RNA causes inhibition of translation of respective one or more GAM150 target proteins.

It is further appreciated by one skilled in the art that the mode of translational inhibition illustrated by FIG. 8 with specific reference to translational inhibition exerted by GAM150 gene, herein designated GAM GENE, on one or more GAM150 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM150 correlate with, and may be deduced from, the identity of the target genes which GAM150 binds and inhibits, and the function of these target genes, as elaborated hereinbelow.

Death-associated protein kinase 1 (DAPK1, Accession NM_004938.1) is a GAM150 target gene, herein designated TARGET GENE. DAPK1 BINDING SITE is a target binding site found in the 3' untranslated region of mRNA encoded by DAPK1, corresponding to a target binding site such as BINDING SITE I, BINDING SITE II or BINDING SITE III of FIG. 8. Table 4 illustrates the complementarity of the nucleotide sequences of DAPK1 BINDING SITE, designated SEQ ID:11771, to the nucleotide sequence of GAM150 RNA, herein designated GAM RNA, also designated SEQ ID:261.

A function of GAM150 is therefore inhibition of Death-associated protein kinase 1 (DAPK1, Accession NM_004938.1). Accordingly, utilities of GAM150 include diagnosis, prevention and treatment of diseases and clinical conditions associated with DAPK1.

LOC128008 (Accession) is another GAM150 target gene, herein designated TARGET GENE. LOC128008 BINDING SITE is a target binding site found in the 5' untranslated region of mRNA encoded by LOC128008, corresponding to a target binding site such as BINDING SITE I, BINDING SITE II or BINDING SITE III of FIG. 8. Table 4 illustrates the complementarity of the nucleotide sequences of LOC128008 BINDING SITE, designated SEQ ID:16098, to the nucleotide sequence of GAM150 RNA, herein designated GAM RNA, also designated SEQ ID:261.

Another function of GAM150 is therefore inhibition of LOC128008 (Accession). Accordingly, utilities of GAM150 include diagnosis, prevention and treatment of diseases and clinical conditions associated with LOC128008.

LOC221399 (Accession XM_168134.1) is another GAM150 target gene, herein designated TARGET GENE. LOC221399 BINDING SITE is a target binding site found in the 5' untranslated region of mRNA encoded by LOC221399, corresponding to a target binding site such as BINDING SITE I, BINDING SITE II or BINDING SITE III of FIG. 8. Table 4 illustrates the complementarity of the nucleotide sequences of LOC221399 BINDING SITE, designated SEQ ID:14194, to the nucleotide sequence of GAM150 RNA, herein designated GAM RNA, also designated SEQ ID:261.

Another function of GAM150 is therefore inhibition of LOC221399 (Accession XM_168134.1). Accordingly, utilities of GAM150 include diagnosis, prevention and treatment of diseases and clinical conditions associated with LOC221399.

LOC253216 (Accession XM_170765.2) is another GAM150 target gene, herein designated TARGET GENE. LOC253216 BINDING SITE is a target binding site found in the 3' untranslated region of mRNA encoded by LOC253216, corresponding to a target binding site such as BINDING SITE I, BINDING SITE II or BINDING SITE III of FIG. 8. Table 4 illustrates the complementarity of the nucleotide sequences of LOC253216 BINDING SITE, designated SEQ ID:10298, to the nucleotide sequence of GAM150 RNA, herein designated GAM RNA, also designated SEQ ID:261.

Another function of GAM150 is therefore inhibition of LOC253216 (Accession XM_170765.2). Accordingly, utilities of GAM150 include diagnosis, prevention and treatment of diseases and clinical conditions associated with LOC253216.

Solute carrier family 2 (facilitated glucose transporter), member 10 (SLC2A10, Accession NM_030777.2) is another GAM150 target gene, herein designated TARGET GENE. SLC2A10 BINDING SITE is a target binding site found in the 3' untranslated region of mRNA encoded by SLC2A10, corresponding to a target binding site such as BINDING SITE I, BINDING SITE II or BINDING SITE III of FIG. 8. Table 4 illustrates the complementarity of the nucleotide sequences of SLC2A10 BINDING SITE, designated SEQ ID:1592, to the nucleotide sequence of GAM150 RNA, herein designated GAM RNA, also designated SEQ ID:261.

Another function of GAM150 is therefore inhibition of Solute carrier family 2 (facilitated glucose transporter), member 10 (SLC2A10, Accession NM_030777.2). Accordingly, utilities of GAM150 include diagnosis, prevention and treatment of diseases and clinical conditions associated with SLC2A10.

FIG. 8 further provides a conceptual description of a novel bioinformatically detected of the present invention, referred to here as Genomic Address Messenger 151 (GAM151), which modulates expression of respective target genes thereof, the function and utility of which target genes is known in the art.

GAM151 is a novel bioinformatically detected regulatory, non protein coding, micro RNA (miRNA) gene. The method by which GAM151 was detected is described hereinabove with reference to FIGS. 8-15.

GAM151 gene, herein designated GAM GENE, and GAM151 target gene, herein designated TARGET GENE, are human genes contained in the human genome.

GAM151 gene encodes a GAM151 precursor RNA, herein designated GAM PRECURSOR RNA. Similar to other miRNA genes, and unlike most ordinary genes, GAM151 precursor RNA does not encode a protein. A nucleotide sequence identical or highly similar to the nucleotide sequence of GAM151 precursor RNA is designated SEQ ID:71, and is provided hereinbelow with reference to the sequence listing part.

GAM151 precursor RNA folds onto itself, forming GAM151 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM151 precursor RNA folds onto itself, forming GAM151 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM151 precursor RNA, designated SEQ-ID:71, and a schematic representation of a predicted secondary folding of GAM151 folded precursor RNA are further described with reference to Table 2, hereby incorporated by reference.

An enzyme complex designated DICER COMPLEX, 'dices' the GAM151 folded precursor RNA into GAM151 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM151 RNA is designated SEQ ID:205, and is provided hereinbelow with references to the sequence listing part and Table 3, hereby incorporated by reference.

GAM151 target gene, herein designated TARGET GENE, encodes a corresponding messenger RNA, GAM151 target RNA, herein designated GAM TARGET RNA. GAM151 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM151 RNA, herein designated GAM RNA, binds complementarily to one or more target binding sites located in untranslated regions of GAM151 target RNA, herein designated GAM TARGET RNA. This complementary binding is due to the fact that the nucleotide sequence of GAM151 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM151 RNA may have a different number of target binding sites in untranslated regions of a GAM151 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM151 RNA, herein designated GAM RNA, to target binding sites on GAM151 target RNA, herein designated GAM TARGET RNA, such as BINDING SITE I, BINDING SITE II and BINDING SITE III, inhibits translation of GAM151 target RNA into GAM151 target protein, herein designated GAM TARGET PROTEIN. GAM target protein is therefore outlined by a broken line.

It is appreciated that GAM151 target gene, herein designated TARGET GENE, in fact represents a plurality of GAM151 target genes. The mRNA of each one of this plurality of GAM151 target genes comprises one or more target binding sites, each having a nucleotide sequence which is at least partly complementary to GAM151 RNA, herein designated GAM RNA, and which when bound by GAM151 RNA causes inhibition of translation of respective one or more GAM151 target proteins.

It is further appreciated by one skilled in the art that the mode of translational inhibition illustrated by FIG. 8 with specific reference to translational inhibition exerted by GAM151 gene, herein designated GAM GENE, on one or more GAM151 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM151 correlate with, and may be deduced from, the identity of the target genes which GAM151 binds and inhibits, and the function of these target genes, as elaborated hereinbelow.

LOC151816 (Accession) is a GAM151 target gene, herein designated TARGET GENE. LOC151816 BINDING SITE is a target binding site found in the 5' untranslated region of mRNA encoded by LOC151816, corresponding to a target binding site such as BINDING SITE I, BINDING SITE II or BINDING SITE III of FIG. 8. Table 4 illustrates the complementarity of the nucleotide sequences of LOC151816 BINDING SITE, designated SEQ ID:12621, to the nucleotide sequence of GAM151 RNA, herein designated GAM RNA, also designated SEQ ID:205.

A function of GAM151 is therefore inhibition of LOC151816 (Accession). Accordingly, utilities of GAM151 include diagnosis, prevention and treatment of diseases and clinical conditions associated with LOC151816.

FIG. 8 further provides a conceptual description of a novel bioinformatically detected of the present invention, referred to here as Genomic Address Messenger 152 (GAM152), which modulates expression of respective target genes thereof, the function and utility of which target genes is known in the art.

GAM152 is a novel bioinformatically detected regulatory, non protein coding, micro RNA (miRNA) gene. The method by which GAM152 was detected is described hereinabove with reference to FIGS. 8-15.

GAM152 gene, herein designated GAM GENE, and GAM152 target gene, herein designated TARGET GENE, are human genes contained in the human genome.

GAM152 gene encodes a GAM152 precursor RNA, herein designated GAM PRECURSOR RNA. Similar to other miRNA genes, and unlike most ordinary genes, GAM152 precursor RNA does not encode a protein. A nucleotide sequence identical or highly similar to the nucleotide sequence of GAM152 precursor RNA is designated SEQ ID:52, and is provided hereinbelow with reference to the sequence listing part.

GAM152 precursor RNA folds onto itself, forming GAM152 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM152 precursor RNA folds onto itself, forming GAM152 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM152 precursor RNA, designated SEQ-ID:52, and a schematic representation of a predicted secondary folding of GAM152 folded precursor RNA are further described with reference to Table 2, hereby incorporated by reference.

An enzyme complex designated DICER COMPLEX, 'dices' the GAM152 folded precursor RNA into GAM152 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM152 RNA is designated SEQ ID:378, and is provided hereinbelow with references to the sequence listing part and Table 3, hereby incorporated by reference.

GAM152 target gene, herein designated TARGET GENE, encodes a corresponding messenger RNA, GAM152 target RNA, herein designated GAM TARGET RNA. GAM152 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM152 RNA, herein designated GAM RNA, binds complementarily to one or more target binding sites located in untranslated regions of GAM152 target RNA, herein designated GAM TARGET RNA. This complementary binding is due to the fact that the nucleotide sequence of GAM152 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM152 RNA may have a different number of target binding sites in untranslated regions of a GAM152 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM152 RNA, herein designated GAM RNA, to target binding sites on GAM152 target RNA, herein designated GAM TARGET RNA, such as BINDING SITE I, BINDING SITE II and BINDING SITE III, inhibits translation of GAM152 target RNA into GAM152 target protein, herein designated GAM TARGET PROTEIN. GAM target protein is therefore outlined by a broken line.

It is appreciated that GAM152 target gene, herein designated TARGET GENE, in fact represents a plurality of GAM152 target genes. The mRNA of each one of this plurality of GAM152 target genes comprises one or more target binding sites, each having a nucleotide sequence which is at least partly complementary to GAM152 RNA, herein designated GAM RNA, and which when bound by GAM152 RNA causes inhibition of translation of respective one or more GAM152 target proteins.

It is further appreciated by one skilled in the art that the mode of translational inhibition illustrated by FIG. 8 with specific reference to translational inhibition exerted by GAM152 gene, herein designated GAM GENE, on one or more GAM152 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM152 correlate with, and may be deduced from, the identity of the target genes which GAM152 binds and inhibits, and the function of these target genes, as elaborated hereinbelow.

Annexin a7 (ANXA7, Accession NM_001156.2) is a GAM152 target gene, herein designated TARGET GENE. ANXA7 BINDING SITE is a target binding site found in the 3' untranslated region of multiple transcripts of mRNA encoded by ANXA7, corresponding to a target binding site such as BINDING SITE I, BINDING SITE II or BINDING SITE III of FIG. 8. Table 4 illustrates the complementarity of the nucleotide sequences of ANXA7 BINDING SITE, designated SEQ ID:7738, to the nucleotide sequence of GAM152 RNA, herein designated GAM RNA, also designated SEQ ID:378.

A function of GAM152 is therefore inhibition of Annexin a7 (ANXA7, Accession NM_001156.2), a gene which promotes membrane fusion and is involved in exocytosis. and therefore may be associated with Prostate cancer. Accordingly, utilities of GAM152 include diagnosis, prevention and treatment of Prostate cancer, and of other diseases and clinical conditions associated with ANXA7.

The function of ANXA7 has been established by previous studies. The ANX7 gene is located on chromosome 10q21, a site long hypothesized to harbor a tumor suppressor gene or genes associated with prostate and other cancers. To test this hypothesis, Srivastava et al. (2001) analyzed the action of the ANX7 gene on colony formation by human tumor cell lines. They also examined the expression of the ANX7 protein in a large number of prostate cancers using tumor tissue microarray technology. Finally, they tested a panel of primary and metastatic prostate cancers for evidence of loss of heterozygosity (LOH). They found that human tumor cell proliferation and colony formation were markedly reduced when the wildtype ANX7 gene was transfected into 2 prostate tumor cell lines. Consistently, analysis of ANX7 protein expression in human prostate tumor microarrays revealed a significantly higher rate of loss of ANX7 expression in metastatic and local recurrences of hormone refractory prostate cancer as compared with primary tumors (P =0.0001). Using 4 microsatellite markers at or near the ANX7 locus and laser capture microdissected tumor cells, 35% of 20 primary prostate tumors showed LOH. The microsatellite marker closest to the ANX7 locus showed the highest rate of LOH, including 1 homozygous deletion. Srivastava et al. (2001) concluded that the ANX7 gene exhibits many biologic and genetic properties expected of a tumor suppressor gene and may play a role in prostate cancer progression.

Animal model experiments lend further support to the function of ANXA7. By gene targeting, Srivastava et al. (1999) developed Anxa7-null mice. The null phenotype was lethal at embryonic day 10. Heterozygous mice were viable and fertile, but showed a defect in insulin secretion and an increased insulin content within isolated pancreatic islets. Electrooptical recordings suggested that the mutation altered Ca(2+) release by agonists of inositol trisphosphate. Using mice with a different genetic background and an alternate strategy to introduce the null mutation, Herr et al. (2001) developed Anxa7 -/- mice that were viable, fertile, and showed no obvious defects. Analysis of insulin secretion from isolated islets revealed no evidence for the involvement of Anxa7 in Ca(2+)-dependent or cAMP-mediated exocytosis. In cardiomyocytes, however, they found a functional role for Anxa7 in electromechanical coupling. Cardiomyocytes from embryonic Anxa7-null mice displayed intact Ca(2+) homeostasis and unremarkable excitation- contraction coupling; however, adult Anxa7 -/- mice exhibited a decrease in frequency-induced cell shortening.

It is appreciated that the abovementioned animal model for ANXA7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Srivastava, M.; Atwater, I.; Glasman, M.; Leighton, X.; Goping, G.; Caohuy, H.; Miller, G.; Pichel, J.; Westphal, H.; Mears, D.; Rojas, E.; Pollard, H. B.: Defects in inositol 1,4, 5-trisphosphate receptor expression, Ca(2+) signaling, and insulin secretion in the anx7(+/-) knockout mouse. Proc. Nat. Acad. Sci. 96:13783-13788, 1999; and Srivastava, M.; Bubendorf, L.; Srikantan, V.; Fossom, L.; Nolan, L.; Glasman, M.; Leighton, X.; Fehrle, W.; Pittaluga, S.; Raffeld, M.; Koivisto, P.; Willi, N.; Gasser, T. C.; Kononen.

Further studies establishing the function and utilities of ANXA7 are found in John Hopkins OMIM database record ID 186360, and in cited publications listed in Table 5, which are hereby incorporated by reference. Calsenilin, presenilin binding protein, ef hand transcription factor (CSEN, Accession NM_013434.3) is another GAM152 target gene, herein designated TARGET GENE. CSEN BINDING SITE is a target binding site found in the 3' untranslated region of mRNA encoded by CSEN, corresponding to a target binding site such as BINDING SITE I, BINDING SITE II or BINDING SITE III of FIG. 8. Table 4 illustrates the complementarity of the nucleotide sequences of CSEN BINDING SITE, designated SEQ ID:13661, to the nucleotide sequence of GAM152 RNA, herein designated GAM RNA, also designated SEQ ID:378.

Another function of GAM152 is therefore inhibition of Calsenilin, presenilin binding protein, ef hand transcription factor (CSEN, Accession NM_013434.3). Accordingly, utilities of GAM152 include diagnosis, prevention and treatment of diseases and clinical conditions associated with CSEN.

Neuroligin 1 (NLGN1, Accession NM_014932.1) is another GAM152 target gene, herein designated TARGET GENE. NLGN1 BINDING SITE is a target binding site found in the 3' untranslated region of mRNA encoded by NLGN1, corresponding to a target binding site such as BINDING SITE I, BINDING SITE II or BINDING SITE III of FIG. 8. Table 4 illustrates the complementarity of the nucleotide sequences of NLGN1 BINDING SITE, designated SEQ ID:6771, to the nucleotide sequence of GAM152 RNA, herein designated GAM RNA, also designated SEQ ID:378.

Another function of GAM152 is therefore inhibition of Neuroligin 1 (NLGN1, Accession NM_014932.1), a gene which may trigger the de novo formation of presynaptic structure. Accordingly, utilities of GAM152 include diagnosis, prevention and treatment of diseases and clinical conditions associated with NLGN1.

The function of NLGN1 and its association with various diseases and clinical conditions, has been established by previous studies, as described hereinabove with reference to GAM90.1.

FIG. 8 further provides a conceptual description of a novel bioinformatically detected of the present invention, referred to here as Genomic Address Messenger 153 (GAM153), which modulates expression of respective target genes thereof, the function and utility of which target genes is known in the art.

GAM153 is a novel bioinformatically detected regulatory, non protein coding, micro RNA (miRNA) gene. The method by which GAM153 was detected is described hereinabove with reference to FIGS. 8-15.

GAM153 gene, herein designated GAM GENE, and GAM153 target gene, herein designated TARGET GENE, are human genes contained in the human genome.

GAM153 gene encodes a GAM153 precursor RNA, herein designated GAM PRECURSOR RNA. Similar to other miRNA genes, and unlike most ordinary genes, GAM153 precursor RNA does not encode a protein. A nucleotide sequence identical or highly similar to the nucleotide sequence of GAM153 precursor RNA is designated SEQ ID:186, and is provided hereinbelow with reference to the sequence listing part.

GAM153 precursor RNA folds onto itself, forming GAM153 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM153 precursor RNA folds onto itself, forming GAM153 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM153 precursor RNA, designated SEQ-ID:186, and a schematic representation of a predicted secondary folding of GAM153 folded precursor RNA are further described with reference to Table 2, hereby incorporated by reference.

An enzyme complex designated DICER COMPLEX, 'dices' the GAM153 folded precursor RNA into GAM153 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM153 RNA is designated SEQ ID:244, and is provided hereinbelow with references to the sequence listing part and Table 3, hereby incorporated by reference.

GAM153 target gene, herein designated TARGET GENE, encodes a corresponding messenger RNA, GAM153 target RNA, herein designated GAM TARGET RNA. GAM153 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM153 RNA, herein designated GAM RNA, binds complementarily to one or more target binding sites located in untranslated regions of GAM153 target RNA, herein designated GAM TARGET RNA. This complementary binding is due to the fact that the nucleotide sequence of GAM153 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM153 RNA may have a different number of target binding sites in untranslated regions of a GAM153 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM153 RNA, herein designated GAM RNA, to target binding sites on GAM153 target RNA, herein designated GAM TARGET RNA, such as BINDING SITE I, BINDING SITE II and BINDING SITE III, inhibits translation of GAM153 target RNA into GAM153 target protein, herein designated GAM TARGET PROTEIN. GAM target protein is therefore outlined by a broken line.

It is appreciated that GAM153 target gene, herein designated TARGET GENE, in fact represents a plurality of GAM153 target genes. The mRNA of each one of this plurality of GAM153 target genes comprises one or more target binding sites, each having a nucleotide sequence which is at least partly complementary to GAM153 RNA, herein designated GAM RNA, and which when bound by GAM153 RNA causes inhibition of translation of respective one or more GAM153 target proteins.

It is further appreciated by one skilled in the art that the mode of translational inhibition illustrated by FIG. 8 with specific reference to translational inhibition exerted by GAM153 gene, herein designated GAM GENE, on one or more GAM153 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM153 correlate with, and may be deduced from, the identity of the target genes which GAM153 binds and inhibits, and the function of these target genes, as elaborated hereinbelow.

Dna-damage-inducible transcript 3 (DDIT3, Accession NM_004083.2) is a GAM153 target gene, herein designated TARGET GENE. DDIT3 BINDING SITE is a target binding site found in the 5' untranslated region of mRNA encoded by DDIT3, corresponding to a target binding site such as BINDING SITE I, BINDING SITE II or BINDING SITE III of FIG. 8. Table 4 illustrates the complementarity of the nucleotide sequences of DDIT3 BINDING SITE, designated SEQ ID:6855, to the nucleotide sequence of GAM153 RNA, herein designated GAM RNA, also designated SEQ ID:244.

A function of GAM153 is therefore inhibition of Dna-damage-inducible transcript 3 (DDIT3, Accession NM_004083.2), a gene which May be a transcription factor and inhibits the DNA-binding activity of C/EBP and LAP and therefore may be associated with Myxoid liposarcoma. Accordingly, utilities of GAM153 include diagnosis, prevention and treatment of Myxoid liposarcoma, and of other diseases and clinical conditions associated with DDIT3.

The function of DDIT3 has been established by previous studies. CHOP is consistently rearranged in myxoid liposarcomas (Aman et al., 1992). In the characteristic chromosomal translocation t(12;16)(q13;p11), Crozat et al. (1993) showed that the CHOP gene is fused with a gene on chromosome 16 provisionally designated TLS (for 'translocated in liposarcoma'). The same gene was called FUS by Rabbitts et al. (1993); see 137070. The TLS gene was found to be a novel nuclear RNA-binding protein with extensive sequence similarity to EWS (OMIM Ref. No. 133450), the product of a gene commonly translocated in Ewing sarcoma. In TLS-CHOP, the RNA-binding domain of TLS is replaced by the DNA-binding and leucine zipper dimerization domain of CHOP. Targeting of a conserved effector domain of RNA-binding proteins to DNA may play a role in tumor formation. In an analysis of peripheral blood samples from 19 patients with myxoid liposarcoma due to t(12;16) and in 1 patient with myxoid liposarcoma due to t(12;22;20), resulting in the fusion of the CHOP and EWS genes, Panagopoulos et al. (1996) found FUS/CHOP hybrid fragments in 3 patients with t(12;16) and a EWS/CHOP hybrid in the patient with the latter translocation.

Full details of the abovementioned studies are described in the following publications, the disclosure of which are hereby incorporated by reference:

Crozat, A.; Aman, P.; Mandahl, N.; Ron, D.: Fusion of CHOP to a novel RNA-binding protein in human myxoid liposarcoma. Nature 363:640-644, 1993; and Panagopoulos, I.; Aman, P.; Mertens, F.; Mandahl, N.; Rydholm, A.; Bauer, H. F. C.; Mitelman, F.: Genomic PCR detects tumor cells in peripheral blood from patients with myxoid liposarco.

Further studies establishing the function and utilities of DDIT3 are found in John Hopkins OMIM database record ID 126337, and in cited publications listed in Table 5, which are hereby incorporated by reference.

FIG. 8 further provides a conceptual description of a novel bioinformatically detected of the present invention, referred to here as Genomic Address Messenger 154 (GAM154), which modulates expression of respective target genes thereof, the function and utility of which target genes is known in the art.

GAM154 is a novel bioinformatically detected regulatory, non protein coding, micro RNA (miRNA) gene. The method by which GAM154 was detected is described hereinabove with reference to FIGS. 8-15.

GAM154 gene, herein designated GAM GENE, and GAM154 target gene, herein designated TARGET GENE, are human genes contained in the human genome.

GAM154 gene encodes a GAM154 precursor RNA, herein designated GAM PRECURSOR RNA. Similar to other miRNA genes, and unlike most ordinary genes, GAM154 precursor RNA does not encode a protein. A nucleotide sequence identical or highly similar to the nucleotide sequence of GAM154 precursor RNA is designated SEQ ID:176, and is provided hereinbelow with reference to the sequence listing part.

GAM154 precursor RNA folds onto itself, forming GAM154 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM154 precursor RNA folds onto itself, forming GAM154 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM154 precursor RNA, designated SEQ-ID:176, and a schematic representation of a predicted secondary folding of GAM154 folded precursor RNA are further described with reference to Table 2, hereby incorporated by reference.

An enzyme complex designated DICER COMPLEX, 'dices' the GAM154 folded precursor RNA into GAM154 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM154 RNA is designated SEQ ID:228, and is provided hereinbelow with references to the sequence listing part and Table 3, hereby incorporated by reference.

GAM154 target gene, herein designated TARGET GENE, encodes a corresponding messenger RNA, GAM154 target RNA, herein designated GAM TARGET RNA. GAM154 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM154 RNA, herein designated GAM RNA, binds complementarily to one or more target binding sites located in untranslated regions of GAM154 target RNA, herein designated GAM TARGET RNA. This complementary binding is due to the fact that the nucleotide sequence of GAM154 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM154 RNA may have a different number of target binding sites in untranslated regions of a GAM154 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM154 RNA, herein designated GAM RNA, to target binding sites on GAM154 target RNA, herein designated GAM TARGET RNA, such as BINDING SITE I, BINDING SITE II and BINDING SITE III, inhibits translation of GAM154 target RNA into GAM154 target protein, herein designated GAM TARGET PROTEIN. GAM target protein is therefore outlined by a broken line.

It is appreciated that GAM154 target gene, herein designated TARGET GENE, in fact represents a plurality of GAM154 target genes. The mRNA of each one of this plurality of GAM154 target genes comprises one or more target binding sites, each having a nucleotide sequence which is at least partly complementary to GAM154 RNA, herein designated GAM RNA, and which when bound by GAM154 RNA causes inhibition of translation of respective one or more GAM154 target proteins.

It is further appreciated by one skilled in the art that the mode of translational inhibition illustrated by FIG. 8 with specific reference to translational inhibition exerted by GAM154 gene, herein designated GAM GENE, on one or more GAM154 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM154 correlate with, and may be deduced from, the identity of the target genes which GAM154 binds and inhibits, and the function of these target genes, as elaborated hereinbelow.

HSZFP36 (Accession XM_290868.1) is a GAM154 target gene, herein designated TARGET GENE. HSZFP36 BINDING SITE is a target binding site found in the 5' untranslated region of mRNA encoded by HSZFP36, corresponding to a target binding site such as BINDING SITE I, BINDING SITE II or BINDING SITE III of FIG. 8. Table 4 illustrates the complementarity of the nucleotide sequences of HSZFP36 BINDING SITE, designated SEQ ID:3168, to the nucleotide sequence of GAM154 RNA, herein designated GAM RNA, also designated SEQ ID:228.

A function of GAM154 is therefore inhibition of HSZFP36 (Accession XM_290868.1). Accordingly, utilities of GAM154 include diagnosis, prevention and treatment of diseases and clinical conditions associated with HSZFP36.

LOC257541 (Accession) is another GAM154 target gene, herein designated TARGET GENE. LOC257541 BINDING SITE is a target binding site found in the 5' untranslated region of mRNA encoded by LOC257541, corresponding to a target binding site such as BINDING SITE I, BINDING SITE II or BINDING SITE III of FIG. 8. Table 4 illustrates the complementarity of the nucleotide sequences of LOC257541 BINDING SITE, designated SEQ ID:9823, to the nucleotide sequence of GAM154 RNA, herein designated GAM RNA, also designated SEQ ID:228.

Another function of GAM154 is therefore inhibition of LOC257541 (Accession). Accordingly, utilities of GAM154 include diagnosis, prevention and treatment of diseases and clinical conditions associated with LOC257541.

FIG. 8 further provides a conceptual description of a novel bioinformatically detected of the present invention, referred to here as Genomic Address Messenger 155 (GAM155), which modulates expression of respective target genes thereof, the function and utility of which target genes is known in the art.

GAM155 is a novel bioinformatically detected regulatory, non protein coding, micro RNA (miRNA) gene. The method by which GAM155 was detected is described hereinabove with reference to FIGS. 8-15.

GAM155 gene, herein designated GAM GENE, and GAM155 target gene, herein designated TARGET GENE, are human genes contained in the human genome.

GAM155 gene encodes a GAM155 precursor RNA, herein designated GAM PRECURSOR RNA. Similar to other miRNA genes, and unlike most ordinary genes, GAM155 precursor RNA does not encode a protein. A nucleotide sequence identical or highly similar to the nucleotide sequence of GAM155 precursor RNA is designated SEQ ID:26, and is provided hereinbelow with reference to the sequence listing part.

GAM155 precursor RNA folds onto itself, forming GAM155 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM155 precursor RNA folds onto itself, forming GAM155 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM155 precursor RNA, designated SEQ-ID:26, and a schematic representation of a predicted secondary folding of GAM155 folded precursor RNA are further described with reference to Table 2, hereby incorporated by reference.

An enzyme complex designated DICER COMPLEX, 'dices' the GAM155 folded precursor RNA into GAM155 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM155 RNA is designated SEQ ID:207, and is provided hereinbelow with references to the sequence listing part and Table 3, hereby incorporated by reference.

GAM155 target gene, herein designated TARGET GENE, encodes a corresponding messenger RNA, GAM155 target RNA, herein designated GAM TARGET RNA. GAM155 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM155 RNA, herein designated GAM RNA, binds complementarily to one or more target binding sites located in untranslated regions of GAM155 target RNA, herein designated GAM TARGET RNA. This complementary binding is due to the fact that the nucleotide sequence of GAM155 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM155 RNA may have a different number of target binding sites in untranslated regions of a GAM155 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM155 RNA, herein designated GAM RNA, to target binding sites on GAM155 target RNA, herein designated GAM TARGET RNA, such as BINDING SITE I, BINDING SITE II and BINDING SITE III, inhibits translation of GAM155 target RNA into GAM155 target protein, herein designated GAM TARGET PROTEIN. GAM target protein is therefore outlined by a broken line.

It is appreciated that GAM155 target gene, herein designated TARGET GENE, in fact represents a plurality of GAM155 target genes. The mRNA of each one of this plurality of GAM155 target genes comprises one or more target binding sites, each having a nucleotide sequence which is at least partly complementary to GAM155 RNA, herein designated GAM RNA, and which when bound by GAM155 RNA causes inhibition of translation of respective one or more GAM155 target proteins.

It is further appreciated by one skilled in the art that the mode of translational inhibition illustrated by FIG. 8 with specific reference to translational inhibition exerted by GAM155 gene, herein designated GAM GENE, on one or more GAM155 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM155 correlate with, and may be deduced from, the identity of the target genes which GAM155 binds and inhibits, and the function of these target genes, as elaborated hereinbelow.

DKFZp761O17121 (Accession) is a GAM155 target gene, herein designated TARGET GENE. DKFZp761O17121 BINDING SITE is a target binding site found in the 3' untranslated region of mRNA encoded by DKFZp761O17121, corresponding to a target binding site such as BINDING SITE I, BINDING SITE II or BINDING SITE III of FIG. 8. Table 4 illustrates the complementarity of the nucleotide sequences of DKFZp761O17121 BINDING SITE, designated SEQ ID:18570, to the nucleotide sequence of GAM155 RNA, herein designated GAM RNA, also designated SEQ ID:207.

A function of GAM155 is therefore inhibition of DKFZp761O17121 (Accession). Accordingly, utilities of GAM155 include diagnosis, prevention and treatment of diseases and clinical conditions associated with DKFZp761O17121.

KIAA0564 (Accession XM_038664.6) is another GAM155 target gene, herein designated TARGET GENE. KIAA0564 BINDING SITE is a target binding site found in the 3' untranslated region of mRNA encoded by KIAA0564, corresponding to a target binding site such as BINDING SITE I, BINDING SITE II or BINDING SITE III of FIG. 8. Table 4 illustrates the complementarity of the nucleotide sequences of KIAA0564 BINDING SITE, designated SEQ ID:18220, to the nucleotide sequence of GAM155 RNA, herein designated GAM RNA, also designated SEQ ID:207.

Another function of GAM155 is therefore inhibition of KIAA0564 (Accession XM_038664.6). Accordingly, utilities of GAM155 include diagnosis, prevention and treatment of diseases and clinical conditions associated with KIAA0564.

LOC152941 (Accession) is another GAM155 target gene, herein designated TARGET GENE. LOC152941 BINDING SITE is a target binding site found in the 3' untranslated region of mRNA encoded by LOC152941, corresponding to a target binding site such as BINDING SITE I, BINDING SITE II or BINDING SITE III of FIG. 8. Table 4 illustrates the complementarity of the nucleotide sequences of LOC152941 BINDING SITE, designated SEQ ID:8587, to the nucleotide sequence of GAM155 RNA, herein designated GAM RNA, also designated SEQ ID:207.

Another function of GAM155 is therefore inhibition of LOC152941 (Accession). Accordingly, utilities of GAM155 include diagnosis, prevention and treatment of diseases and clinical conditions associated with LOC152941.

Prostaglandin-endoperoxide synthase 1 (prostaglandin g/h synthase and cyclooxygenase) (PTGS1, Accession NM_000962.2) is another GAM155 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:19654, to the nucleotide sequence of GAM155 RNA, herein designated GAM RNA, also designated SEQ ID:207.

Another function of GAM155 is therefore inhibition of Prostaglandin-endoperoxide synthase 1 (prostaglandin g/h synthase and cyclooxygenase) (PTGS1, Accession NM_000962.2), a gene which may play an important role in regulating or promoting cell proliferation in some normal and neoplastically transformed cells. Accordingly, utilities of GAM155 include diagnosis, prevention and treatment of diseases and clinical conditions associated with PTGS1.

The function of PTGS1 and its association with various diseases and clinical conditions, has been established by previous studies, as described hereinabove with reference to GAM40.1.

FIG. 8 further provides a conceptual description of a novel bioinformatically detected of the present invention, referred to here as Genomic Address Messenger 156 (GAM156), which modulates expression of respective target genes thereof, the function and utility of which target genes is known in the art.

GAM156 is a novel bioinformatically detected regulatory, non protein coding, micro RNA (miRNA) gene. The method by which GAM156 was detected is described hereinabove with reference to FIGS. 8-15.

GAM156 gene, herein designated GAM GENE, and GAM156 target gene, herein designated TARGET GENE, are human genes contained in the human genome.

GAM156 gene encodes a GAM156 precursor RNA, herein designated GAM PRECURSOR RNA. Similar to other miRNA genes, and unlike most ordinary genes, GAM156 precursor RNA does not encode a protein. A nucleotide sequence identical or highly similar to the nucleotide sequence of GAM156 precursor RNA is designated SEQ ID:54, and is provided hereinbelow with reference to the sequence listing part.

GAM156 precursor RNA folds onto itself, forming GAM156 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM156 precursor RNA folds onto itself, forming GAM156 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM156 precursor RNA, designated SEQ-ID:54, and a schematic representation of a predicted secondary folding of GAM156 folded precursor RNA are further described with reference to Table 2, hereby incorporated by reference.

An enzyme complex designated DICER COMPLEX, 'dices' the GAM156 folded precursor RNA into GAM156 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM156 RNA is designated SEQ ID:262, and is provided hereinbelow with references to the sequence listing part and Table 3, hereby incorporated by reference.

GAM156 target gene, herein designated TARGET GENE, encodes a corresponding messenger RNA, GAM156 target RNA, herein designated GAM TARGET RNA. GAM156 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM156 RNA, herein designated GAM RNA, binds complementarily to one or more target binding sites located in untranslated regions of GAM156 target RNA, herein designated GAM TARGET RNA. This complementary binding is due to the fact that the nucleotide sequence of GAM156 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM156 RNA may have a different number of target binding sites in untranslated regions of a GAM156 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM156 RNA, herein designated GAM RNA, to target binding sites on GAM156 target RNA, herein designated GAM TARGET RNA, such as BINDING SITE I, BINDING SITE II and BINDING SITE III, inhibits translation of GAM156 target RNA into GAM156 target protein, herein designated GAM TARGET PROTEIN. GAM target protein is therefore outlined by a broken line.

It is appreciated that GAM156 target gene, herein designated TARGET GENE, in fact represents a plurality of GAM156 target genes. The mRNA of each one of this plurality of GAM156 target genes comprises one or more target binding sites, each having a nucleotide sequence which is at least partly complementary to GAM156 RNA, herein designated GAM RNA, and which when bound by GAM156 RNA causes inhibition of translation of respective one or more GAM156 target proteins.

It is further appreciated by one skilled in the art that the mode of translational inhibition illustrated by FIG. 8 with specific reference to translational inhibition exerted by GAM156 gene, herein designated GAM GENE, on one or more GAM156 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM156 correlate with, and may be deduced from, the identity of the target genes which GAM156 binds and inhibits, and the function of these target genes, as elaborated hereinbelow.

Clathrin, heavy polypeptide-like 1 (CLTCL1, Accession NM_001835.1) is a GAM156 target gene, herein designated TARGET GENE. CLTCL1 BINDING SITE is a target binding site found in the 3' untranslated region of multiple transcripts of mRNA encoded by CLTCL1, corresponding to a target binding site such as BINDING SITE I, BINDING SITE II or BINDING SITE III of FIG. 8. Table 4 illustrates the complementarity of the nucleotide sequences of CLTCL1 BINDING SITE, designated SEQ ID:6732, to the nucleotide sequence of GAM156 RNA, herein designated GAM RNA, also designated SEQ ID:262.

A function of GAM156 is therefore inhibition of Clathrin, heavy polypeptide-like 1 (CLTCL1, Accession NM_001835.1), a gene which is involved in vesicle budding. and therefore may be associated with The velocardiofacial syndrome. Accordingly, utilities of GAM156 include diagnosis, prevention and treatment of The velocardiofacial syndrome, and of other diseases and clinical conditions associated with CLTCL1.

The function of CLTCL1 has been established by previous studies. Clathrin is the main structural component of the lattice covering the cytoplasmic face of the coated pits and coated vesicles in which specific macromolecules are entrapped in the process of receptor-mediated endocytosis. Clathrin is a large, soluble protein composed of heavy chains (molecular size, about 192 kD) and light chains (molecular size, about 32-38 kD). Two major classes of clathrin light chains, referred to as LCA and LCB, have been identified. (The gene is also symbolized CLTA.) The structure of these light chains was studied by Kirchhausen et al. (1987). The clathrin unit that assembles into coats had 3 extended legs, 500 angstroms in length, splayed out in a pinwheel-like structure (triskelion). Each of the legs is built from a single heavy chain, with a light chain bound to each proximal segment. At least 4 distinct forms of clathrin light chains are found in mammalian cells. This molecular variability derives from tissue-specific patterns of expression of LCA and LCB genes (Jackson et al., 1987). Brodsky et al. (1987) identified that part of the light-chain sequence that mediates heavy-chain binding and is the region of strongest homology with intermediate filament proteins. Sequence analysis shows an overall homology of 60% between LCA and LCB and the presence of brain-specific insertion sequences. LCA and LCB (OMIM Ref. No. 118970) are coded by distinct genes. Jackson and Parham (1988) compared cDNAs encoding the brain and nonbrain forms of human LCA and LCB with their homologs in cow and rat. The significant differences that distinguish LCA from LCB and the brain from the nonbrain forms show remarkable preservation in all 3 species. Each clathrin triskelion consists of 3 heavy chains and 3 light chains. In the brain, tissue-specific mRNA splicing yields larger forms of LCA and LCB, containing additional insertion sequences of 30 and 18 amino acids, respectively By Southern blot analysis on genomic DNA extracted from a panel of mouse-human somatic cell hybrids and by isotopic in situ hybridization, Ponnambalam et al. (1994) assigned the CLTA gene to human 12q23-q24

Full details of the abovementioned studies are described in the following publications, the disclosure of which are hereby incorporated by reference:

Sirotkin, H.; Morrow, B.; DasGupta, R.; Goldberg, R.; Patanjali, S. R.; Shi, G.; Cannizzaro, L.; Shprintzen, R.; Weissman, S. M.; Kucherlapati, R.: Isolation of a new clathrin heavy chain gene with muscle-specific expression from the region commonly deleted in velo-cardio-facial syndrome. Hum. Molec. Genet. 5:617-624, 1996; and Long, K. R.; Trofatter, J. A.; Ramesh, V.; McCormick, M. K.; Buckler, A. J.: Cloning and characterization of a novel human clathrin heavy chain gene (CLTCL). Genomics 35:466-472, 1996.

Further studies establishing the function and utilities of CLTCL1 are found in John Hopkins OMIM database record ID 601273, and in cited publications listed in Table 5, which are hereby incorporated by reference. Dishevelled associated activator of morphogenesis 2 (DAAM2, Accession XM_166434.3) is another GAM156 target gene, herein designated TARGET GENE. DAAM2 BINDING SITE is a target binding site found in the 5' untranslated region of mRNA encoded by DAAM2, corresponding to a target binding site such as BINDING SITE I, BINDING SITE II or BINDING SITE III of FIG. 8. Table 4 illustrates the complementarity of the nucleotide sequences of DAAM2 BINDING SITE, designated SEQ ID:4578, to the nucleotide sequence of GAM156 RNA, herein designated GAM RNA, also designated SEQ ID:262.

Another function of GAM156 is therefore inhibition of Dishevelled associated activator of morphogenesis 2 (DAAM2, Accession XM_166434.3), a gene which controls cell polarity and movement during development. Accordingly, utilities of GAM156 include diagnosis, prevention and treatment of diseases and clinical conditions associated with DAAM2.

The function of DAAM2 and its association with various diseases and clinical conditions, has been established by previous studies, as described hereinabove with reference to GAM47.1. DKFZP434P0111 (Accession XM_041116.4) is another GAM156 target gene, herein designated TARGET GENE. DKFZP434P0111 BINDING SITE is a target binding site found in the 3' untranslated region of mRNA encoded by DKFZP434P0111, corresponding to a target binding site such as BINDING SITE I, BINDING SITE II or BINDING SITE III of FIG. 8. Table 4 illustrates the complementarity of the nucleotide sequences of DKFZP434P0111 BINDING SITE, designated SEQ ID:16713, to the nucleotide sequence of GAM156 RNA, herein designated GAM RNA, also designated SEQ ID:262.

Another function of GAM156 is therefore inhibition of DKFZP434P0111 (Accession XM_041116.4). Accordingly, utilities of GAM156 include diagnosis, prevention and treatment of diseases and clinical conditions associated with DKFZP434P0111.

FLJ10759 (Accession NM_018207.1) is another GAM156 target gene, herein designated TARGET GENE. FLJ10759 BINDING SITE is a target binding site found in the 3' untranslated region of mRNA encoded by FLJ10759, corresponding to a target binding site such as BINDING SITE I, BINDING SITE II or BINDING SITE III of FIG. 8. Table 4 illustrates the complementarity of the nucleotide sequences of FLJ10759 BINDING SITE, designated SEQ ID:6060, to the nucleotide sequence of GAM156 RNA, herein designated GAM RNA, also designated SEQ ID:262.

Another function of GAM156 is therefore inhibition of FLJ10759 (Accession NM_018207.1). Accordingly, utilities of GAM156 include diagnosis, prevention and treatment of diseases and clinical conditions associated with FLJ10759.

KIAA0802 (Accession XM_031357.4) is another GAM156 target gene, herein designated TARGET GENE. KIAA0802 BINDING SITE is a target binding site found in the 3' untranslated region of mRNA encoded by KIAA0802, corresponding to a target binding site such as BINDING SITE I, BINDING SITE II or BINDING SITE III of FIG. 8. Table 4 illustrates the complementarity of the nucleotide sequences of KIAA0802 BINDING SITE, designated SEQ ID:15745, to the nucleotide sequence of GAM156 RNA, herein designated GAM RNA, also designated SEQ ID:262.

Another function of GAM156 is therefore inhibition of KIAA0802 (Accession XM_031357.4). Accordingly, utilities of GAM156 include diagnosis, prevention and treatment of diseases and clinical conditions associated with KIAA0802.

LOC148894 (Accession XM_097542.2) is another GAM156 target gene, herein designated TARGET GENE. LOC148894 BINDING SITE is a target binding site found in the 5' untranslated region of mRNA encoded by LOC148894, corresponding to a target binding site such as BINDING SITE I, BINDING SITE II or BINDING SITE III of FIG. 8. Table 4 illustrates the complementarity of the nucleotide sequences of LOC148894 BINDING SITE, designated SEQ ID:8056, to the nucleotide sequence of GAM156 RNA, herein designated GAM RNA, also designated SEQ ID:262.

Another function of GAM156 is therefore inhibition of LOC148894 (Accession XM_097542.2). Accordingly, utilities of GAM156 include diagnosis, prevention and treatment of diseases and clinical conditions associated with LOC148894.

LOC199988 (Accession XM_117166.1) is another GAM156 target gene, herein designated TARGET GENE. LOC199988 BINDING SITE is a target binding site found in the 5' untranslated region of mRNA encoded by LOC199988, corresponding to a target binding site such as BINDING SITE I, BINDING SITE II or BINDING SITE III of FIG. 8. Table 4 illustrates the complementarity of the nucleotide sequences of LOC199988 BINDING SITE, designated SEQ ID:3088, to the nucleotide sequence of GAM156 RNA, herein designated GAM RNA, also designated SEQ ID:262.

Another function of GAM156 is therefore inhibition of LOC199988 (Accession XM_117166.1). Accordingly, utilities of GAM156 include diagnosis, prevention and treatment of diseases and clinical conditions associated with LOC199988.

Signal-regulatory protein beta 1 (SIRPB1, Accession NM_006065.1) is another GAM156 target gene, herein designated TARGET GENE. SIRPB1 BINDING SITE is a target binding site found in the 3' untranslated region of mRNA encoded by SIRPB1, corresponding to a target binding site such as BINDING SITE I, BINDING SITE II or BINDING SITE III of FIG. 8. Table 4 illustrates the complementarity of the nucleotide sequences of SIRPB1 BINDING SITE, designated SEQ ID:16696, to the nucleotide sequence of GAM156 RNA, herein designated GAM RNA, also designated SEQ ID:262.

Another function of GAM156 is therefore inhibition of Signal-regulatory protein beta 1 (SIRPB1, Accession NM_006065.1). Accordingly, utilities of GAM156 include diagnosis, prevention and treatment of diseases and clinical conditions associated with SIRPB1.

Tripartite motif-containing 37 (TRIM37, Accession NM_015294.1) is another GAM156 target gene, herein designated TARGET GENE. TRIM37 BINDING SITE is a target binding site found in the 3' untranslated region of mRNA encoded by TRIM37, corresponding to a target binding site such as BINDING SITE I, BINDING SITE II or BINDING SITE III of FIG. 8. Table 4 illustrates the complementarity of the nucleotide sequences of TRIM37 BINDING SITE, designated SEQ ID:19960, to the nucleotide sequence of GAM156 RNA, herein designated GAM RNA, also designated SEQ ID:262.

Another function of GAM156 is therefore inhibition of Tripartite motif-containing 37 (TRIM37, Accession NM_015294.1). Accordingly, utilities of GAM156 include diagnosis, prevention and treatment of diseases and clinical conditions associated with TRIM37.

FIG. 8 further provides a conceptual description of a novel bioinformatically detected of the present invention, referred to here as Genomic Address Messenger 157 (GAM157), which modulates expression of respective target genes thereof, the function and utility of which target genes is known in the art.

GAM157 is a novel bioinformatically detected regulatory, non protein coding, micro RNA (miRNA) gene. The method by which GAM157 was detected is described hereinabove with reference to FIGS. 8-15.

GAM157 gene, herein designated GAM GENE, and GAM157 target gene, herein designated TARGET GENE, are human genes contained in the human genome.

GAM157 gene encodes a GAM157 precursor RNA, herein designated GAM PRECURSOR RNA. Similar to other miRNA genes, and unlike most ordinary genes, GAM157 precursor RNA does not encode a protein. A nucleotide sequence identical or highly similar to the nucleotide sequence of GAM157 precursor RNA is designated SEQ ID:193, and is provided hereinbelow with reference to the sequence listing part.

GAM157 precursor RNA folds onto itself, forming GAM157 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM157 precursor RNA folds onto itself, forming GAM157 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM157 precursor RNA, designated SEQ-ID:193, and a schematic representation of a predicted secondary folding of GAM157 folded precursor RNA are further described with reference to Table 2, hereby incorporated by reference.

An enzyme complex designated DICER COMPLEX, 'dices' the GAM157 folded precursor RNA into GAM157 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM157 RNA is designated SEQ ID:225, and is provided hereinbelow with references to the sequence listing part and Table 3, hereby incorporated by reference.

GAM157 target gene, herein designated TARGET GENE, encodes a corresponding messenger RNA, GAM157 target RNA, herein designated GAM TARGET RNA. GAM157 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM157 RNA, herein designated GAM RNA, binds complementarily to one or more target binding sites located in untranslated regions of GAM157 target RNA, herein designated GAM TARGET RNA. This complementary binding is due to the fact that the nucleotide sequence of GAM157 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM157 RNA may have a different number of target binding sites in untranslated regions of a GAM157 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM157 RNA, herein designated GAM RNA, to target binding sites on GAM157 target RNA, herein designated GAM TARGET RNA, such as BINDING SITE I, BINDING SITE II and BINDING SITE III, inhibits translation of GAM157 target RNA into GAM157 target protein, herein designated GAM TARGET PROTEIN. GAM target protein is therefore outlined by a broken line.

It is appreciated that GAM157 target gene, herein designated TARGET GENE, in fact represents a plurality of GAM157 target genes. The mRNA of each one of this plurality of GAM157 target genes comprises one or more target binding sites, each having a nucleotide sequence which is at least partly complementary to GAM157 RNA, herein designated GAM RNA, and which when bound by GAM157 RNA causes inhibition of translation of respective one or more GAM157 target proteins.

It is further appreciated by one skilled in the art that the mode of translational inhibition illustrated by FIG. 8 with specific reference to translational inhibition exerted by GAM157 gene, herein designated GAM GENE, on one or more GAM157 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM157 correlate with, and may be deduced from, the identity of the target genes which GAM157 binds and inhibits, and the function of these target genes, as elaborated hereinbelow.

Angiomotin (AMOT, Accession NM_133265.1) is a GAM157 target gene, herein designated TARGET GENE. AMOT BINDING SITE is a target binding site found in the 3' untranslated region of mRNA encoded by AMOT, corresponding to a target binding site such as BINDING SITE I, BINDING SITE II or BINDING SITE III of FIG. 8. Table 4 illustrates the complementarity of the nucleotide sequences of AMOT BINDING SITE, designated SEQ ID:1662, to the nucleotide sequence of GAM157 RNA, herein designated GAM RNA, also designated SEQ ID:225.

A function of GAM157 is therefore inhibition of Angiomotin (AMOT, Accession NM_133265.1). Accordingly, utilities of GAM157 include diagnosis, prevention and treatment of diseases and clinical conditions associated with AMOT.

Chromatin assembly factor 1, subunit b (p60) (CHAF1B, Accession NM_005441.1) is another GAM157 target gene, herein designated TARGET GENE. CHAF1B BINDING SITE is a target binding site found in the 3' untranslated region of mRNA encoded by CHAF1B, corresponding to a target binding site such as BINDING SITE I, BINDING SITE II or BINDING SITE III of FIG. 8. Table 4 illustrates the complementarity of the nucleotide sequences of CHAF1B BINDING SITE, designated SEQ ID:17720, to the nucleotide sequence of GAM157 RNA, herein designated GAM RNA, also designated SEQ ID:225.

Another function of GAM157 is therefore inhibition of Chromatin assembly factor 1, subunit b (p60) (CHAF1B, Accession NM_005441.1). Accordingly, utilities of GAM157 include diagnosis, prevention and treatment of diseases and clinical conditions associated with CHAF1B.

D123 (Accession) is another GAM157 target gene, herein designated TARGET GENE. D123 BINDING SITE is a target binding site found in the 3' untranslated region of mRNA encoded by D123, corresponding to a target binding site such as BINDING SITE I, BINDING SITE II or BINDING SITE III of FIG. 8. Table 4 illustrates the complementarity of the nucleotide sequences of D123 BINDING SITE, designated SEQ ID:2735, to the nucleotide sequence of GAM157 RNA, herein designated GAM RNA, also designated SEQ ID:225.

Another function of GAM157 is therefore inhibition of D123 (Accession). Accordingly, utilities of GAM157 include diagnosis, prevention and treatment of diseases and clinical conditions associated with D123.

LOC149935 (Accession) is another GAM157 target gene, herein designated TARGET GENE. LOC149935 BINDING SITE is a target binding site found in the 3' untranslated region of mRNA encoded by LOC149935, corresponding to a target binding site such as BINDING SITE I, BINDING SITE II or BINDING SITE III of FIG. 8. Table 4 illustrates the complementarity of the nucleotide sequences of LOC149935 BINDING SITE, designated SEQ ID:1436, to the nucleotide sequence of GAM157 RNA, herein designated GAM RNA, also designated SEQ ID:225.

Another function of GAM157 is therefore inhibition of LOC149935 (Accession). Accordingly, utilities of GAM157 include diagnosis, prevention and treatment of diseases and clinical conditions associated with LOC149935.

LOC221491 (Accession XM_166344.3) is another GAM157 target gene, herein designated TARGET GENE. LOC221491 BINDING SITE is a target binding site found in the 5' untranslated region of mRNA encoded by LOC221491, corresponding to a target binding site such as BINDING SITE I, BINDING SITE II or BINDING SITE III of FIG. 8. Table 4 illustrates the complementarity of the nucleotide sequences of LOC221491 BINDING SITE, designated SEQ ID:9737, to the nucleotide sequence of GAM157 RNA, herein designated GAM RNA, also designated SEQ ID:225.

Another function of GAM157 is therefore inhibition of LOC221491 (Accession XM_166344.3). Accordingly, utilities of GAM157 include diagnosis, prevention and treatment of diseases and clinical conditions associated with LOC221491.

FIG. 8 further provides a conceptual description of a novel bioinformatically detected of the present invention, referred to here as Genomic Address Messenger 158 (GAM158), which modulates expression of respective target genes thereof, the function and utility of which target genes is known in the art.

GAM158 is a novel bioinformatically detected regulatory, non protein coding, micro RNA (miRNA) gene. The method by which GAM158 was detected is described hereinabove with reference to FIGS. 8-15.

GAM158 gene, herein designated GAM GENE, and GAM158 target gene, herein designated TARGET GENE, are human genes contained in the human genome.

GAM158 gene encodes a GAM158 precursor RNA, herein designated GAM PRECURSOR RNA. Similar to other miRNA genes, and unlike most ordinary genes, GAM158 precursor RNA does not encode a protein. A nucleotide sequence identical or highly similar to the nucleotide sequence of GAM158 precursor RNA is designated SEQ ID:47, and is provided hereinbelow with reference to the sequence listing part. Nucleotide sequence SEQ ID:47 is located at position 112174058 relative to chromosome 1.

GAM158 precursor RNA folds onto itself, forming GAM158 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM158 precursor RNA folds onto itself, forming GAM158 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM158 precursor RNA, designated SEQ-ID:47, and a schematic representation of a predicted secondary folding of GAM158 folded precursor RNA are further described with reference to Table 2, hereby incorporated by reference.

An enzyme complex designated DICER COMPLEX, 'dices' the GAM158 folded precursor RNA into GAM158 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM158 RNA is designated SEQ ID:383, and is provided hereinbelow with references to the sequence listing part and Table 3, hereby incorporated by reference.

GAM158 target gene, herein designated TARGET GENE, encodes a corresponding messenger RNA, GAM158 target RNA, herein designated GAM TARGET RNA. GAM158 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM158 RNA, herein designated GAM RNA, binds complementarily to one or more target binding sites located in untranslated regions of GAM158 target RNA, herein designated GAM TARGET RNA. This complementary binding is due to the fact that the nucleotide sequence of GAM158 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM158 RNA may have a different number of target binding sites in untranslated regions of a GAM158 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM158 RNA, herein designated GAM RNA, to target binding sites on GAM158 target RNA, herein designated GAM TARGET RNA, such as BINDING SITE I, BINDING SITE II and BINDING SITE III, inhibits translation of GAM158 target RNA into GAM158 target protein, herein designated GAM TARGET PROTEIN. GAM target protein is therefore outlined by a broken line.

It is appreciated that GAM158 target gene, herein designated TARGET GENE, in fact represents a plurality of GAM158 target genes. The mRNA of each one of this plurality of GAM158 target genes comprises one or more target binding sites, each having a nucleotide sequence which is at least partly complementary to GAM158 RNA, herein designated GAM RNA, and which when bound by GAM158 RNA causes inhibition of translation of respective one or more GAM158 target proteins.

It is further appreciated by one skilled in the art that the mode of translational inhibition illustrated by FIG. 8 with specific reference to translational inhibition exerted by GAM158 gene, herein designated GAM GENE, on one or more GAM158 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM158 correlate with, and may be deduced from, the identity of the target genes which GAM158 binds and inhibits, and the function of these target genes, as elaborated hereinbelow.

KIAA0237 (Accession NM_014747.1) is a GAM158 target gene, herein designated TARGET GENE. KIAA0237 BINDING SITE is a target binding site found in the 5' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:13040, to the nucleotide sequence of GAM158 RNA, herein designated GAM RNA, also designated SEQ ID:383.

A function of GAM158 is therefore inhibition of KIAA0237 (Accession NM_014747.1). Accordingly, utilities of GAM158 include diagnosis, prevention and treatment of diseases and clinical conditions associated with KIAA0237.

KIAA1045 (Accession XM_048592.2) is another GAM158 target gene, herein designated TARGET GENE. KIAA1045 BINDING SITE is a target binding site found in the 3' untranslated region of mRNA encoded by KIAA1045, corresponding to a target binding site such as BINDING SITE I, BINDING SITE II or BINDING SITE III of FIG. 8. Table 4 illustrates the complementarity of the nucleotide sequences of KIAA1045 BINDING SITE, designated SEQ ID:19310, to the nucleotide sequence of GAM158 RNA, herein designated GAM RNA, also designated SEQ ID:383.

Another function of GAM158 is therefore inhibition of KIAA1045 (Accession XM_048592.2). Accordingly, utilities of GAM158 include diagnosis, prevention and treatment of diseases and clinical conditions associated with KIAA1045.

KIAA1110 (Accession) is another GAM158 target gene, herein designated TARGET GENE. KIAA1110 BINDING SITE is a target binding site found in the 3' untranslated region of mRNA encoded by KIAA1110, corresponding to a target binding site such as BINDING SITE I, BINDING SITE II or BINDING SITE III of FIG. 8. Table 4 illustrates the complementarity of the nucleotide sequences of KIAA1110 BINDING SITE, designated SEQ ID:1213, to the nucleotide sequence of GAM158 RNA, herein designated GAM RNA, also designated SEQ ID:383.

Another function of GAM158 is therefore inhibition of KIAA1110 (Accession). Accordingly, utilities of GAM158 include diagnosis, prevention and treatment of diseases and clinical conditions associated with KIAA1110.

LOC124602 (Accession) is another GAM158 target gene, herein designated TARGET GENE. LOC124602 BINDING SITE is a target binding site found in the 3' untranslated region of mRNA encoded by LOC124602, corresponding to a target binding site such as BINDING SITE I, BINDING SITE II or BINDING SITE III of FIG. 8. Table 4 illustrates the complementarity of the nucleotide sequences of LOC124602 BINDING SITE, designated SEQ ID:1663, to the nucleotide sequence of GAM158 RNA, herein designated GAM RNA, also designated SEQ ID:383.

Another function of GAM158 is therefore inhibition of LOC124602 (Accession). Accordingly, utilities of GAM158 include diagnosis, prevention and treatment of diseases and clinical conditions associated with LOC124602.

LOC253866 (Accession) is another GAM158 target gene, herein designated TARGET GENE. LOC253866 BINDING SITE is a target binding site found in the 5' untranslated region of mRNA encoded by LOC253866, corresponding to a target binding site such as BINDING SITE I, BINDING SITE II or BINDING SITE III of FIG. 8. Table 4 illustrates the complementarity of the nucleotide sequences of LOC253866 BINDING SITE, designated SEQ ID:11918, to the nucleotide sequence of GAM158 RNA, herein designated GAM RNA, also designated SEQ ID:383.

Another function of GAM158 is therefore inhibition of LOC253866 (Accession). Accordingly, utilities of GAM158 include diagnosis, prevention and treatment of diseases and clinical conditions associated with LOC253866.

LOC92305 (Accession NM_138385.1) is another GAM158 target gene, herein designated TARGET GENE.

LOC92305 BINDING SITE is a target binding site found in the 3' untranslated region of mRNA encoded by LOC92305, corresponding to a target binding site such as BINDING SITE I, BINDING SITE II or BINDING SITE III of FIG. 8. Table 4 illustrates the complementarity of the nucleotide sequences of LOC92305 BINDING SITE, designated SEQ ID:16687, to the nucleotide sequence of GAM158 RNA, herein designated GAM RNA, also designated SEQ ID:383.

Another function of GAM158 is therefore inhibition of LOC92305 (Accession NM_138385.1). Accordingly, utilities of GAM158 include diagnosis, prevention and treatment of diseases and clinical conditions associated with LOC92305.

Rab9b, member ras oncogene family (RAB9B, Accession NM_016370.1) is another GAM158 target gene, herein designated TARGET GENE. RAB9B BINDING SITE is a target binding site found in the 5' untranslated region of mRNA encoded by RAB9B, corresponding to a target binding site such as BINDING SITE I, BINDING SITE II or BINDING SITE III of FIG. 8. Table 4 illustrates the complementarity of the nucleotide sequences of RAB9B BINDING SITE, designated SEQ ID:12877, to the nucleotide sequence of GAM158 RNA, herein designated GAM RNA, also designated SEQ ID:383.

Another function of GAM158 is therefore inhibition of Rab9b, member ras oncogene family (RAB9B, Accession NM_016370.1). Accordingly, utilities of GAM158 include diagnosis, prevention and treatment of diseases and clinical conditions associated with RAB9B.

Syntaxin 1a (brain) (STX1A, Accession NM_004603.1) is another GAM158 target gene, herein designated TARGET GENE. STX1A BINDING SITE is a target binding site found in the 3' untranslated region of mRNA encoded by STX1A, corresponding to a target binding site such as BINDING SITE I, BINDING SITE II or BINDING SITE III of FIG. 8. Table 4 illustrates the complementarity of the nucleotide sequences of STX1A BINDING SITE, designated SEQ ID:18630, to the nucleotide sequence of GAM158 RNA, herein designated GAM RNA, also designated SEQ ID:383.

Another function of GAM158 is therefore inhibition of Syntaxin 1a (brain) (STX1A, Accession NM_004603.1), a gene which may play a critical role in neurotransmitter exocytosis. Accordingly, utilities of GAM158 include diagnosis, prevention and treatment of diseases and clinical conditions associated with STX1A.

The function of STX1A has been established by previous studies. Synaptic vesicles store neurotransmitters that are released during calcium-regulated exocytosis. The specificity of neurotransmitter release requires the localization of both synaptic vesicles and calcium channels to the presynaptic active zone. Syntaxins function in this vesicle fusion process. Syntaxins also serve as a substrate for botulinum neurotoxin type C, a metalloprotease that blocks exocytosis and has high affinity for a molecular complex that includes the alpha-latrotoxin receptor (OMIM Ref. No. 600565) which produces explosive exocytosis (Zhang et al., 1995). Bennett et al. (1992) identified two 35-kD proteins (p35 or syntaxins) that interact with synaptic vesicle protein p65 (synaptotagmin; 185605). The p35 proteins are expressed only in the nervous system. The 2 proteins are 84% identical, include C-terminal membrane anchors, and are concentrated on the plasma membrane at synaptic sites. The authors speculated that the p35 proteins may function in docking synaptic vesicles near calcium channels at presynaptic active zones.

Full details of the abovementioned studies are described in the following publications, the disclosure of which are hereby incorporated by reference:

Bennett, M. K.; Calakos, N.; Scheller, R. H.: Syntaxin: a synaptic protein implicated in docking of synaptic vesicles at presynaptic active zones. Science 257:255-259, 1992; and Zhang, R.; Maksymowych, A. B.; Simpson, L. L.: Cloning and sequence analysis of a cDNA encoding human syntaxin 1A, a polypeptide essential for exocytosis. Gene 159:293-294, 1995.

Further studies establishing the function and utilities of STX1A are found in John Hopkins OMIM database record ID 186590, and in cited publications listed in Table 5, which are hereby incorporated by reference. SUN1 (Accession) is another GAM158 target gene, herein designated TARGET GENE. SUN1 BINDING SITE is a target binding site found in the 3' untranslated region of mRNA encoded by SUN1, corresponding to a target binding site such as BINDING SITE I, BINDING SITE II or BINDING SITE III of FIG. 8. Table 4 illustrates the complementarity of the nucleotide sequences of SUN1 BINDING SITE, designated SEQ ID:9645, to the nucleotide sequence of GAM158 RNA, herein designated GAM RNA, also designated SEQ ID:383.

Another function of GAM158 is therefore inhibition of SUN1 (Accession). Accordingly, utilities of GAM158 include diagnosis, prevention and treatment of diseases and clinical conditions associated with SUN1.

FIG. 8 further provides a conceptual description of a novel bioinformatically detected of the present invention, referred to here as Genomic Address Messenger 159 (GAM159), which modulates expression of respective target genes thereof, the function and utility of which target genes is known in the art.

GAM159 is a novel bioinformatically detected regulatory, non protein coding, micro RNA (miRNA) gene. The method by which GAM159 was detected is described hereinabove with reference to FIGS. 8-15.

GAM159 gene, herein designated GAM GENE, and GAM159 target gene, herein designated TARGET GENE, are human genes contained in the human genome.

GAM159 gene encodes a GAM159 precursor RNA, herein designated GAM PRECURSOR RNA. Similar to other miRNA genes, and unlike most ordinary genes, GAM159 precursor RNA does not encode a protein. A nucleotide sequence identical or highly similar to the nucleotide sequence of GAM159 precursor RNA is designated SEQ ID:109, and is provided hereinbelow with reference to the sequence listing part. Nucleotide sequence SEQ ID:109 is located at position 125133292 relative to chromosome 9.

GAM159 precursor RNA folds onto itself, forming GAM159 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM159 precursor RNA folds onto itself, forming GAM159 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM159 precursor RNA, designated SEQ-ID:109, and a schematic representation of a predicted secondary folding of GAM159 folded precursor RNA are further described with reference to Table 2, hereby incorporated by reference.

An enzyme complex designated DICER COMPLEX, 'dices' the GAM159 folded precursor RNA into GAM159 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM159 RNA is designated SEQ ID:230, and is provided hereinbelow with references to the sequence listing part and Table 3, hereby incorporated by reference.

GAM159 target gene, herein designated TARGET GENE, encodes a corresponding messenger RNA, GAM159 target RNA, herein designated GAM TARGET RNA. GAM159 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM159 RNA, herein designated GAM RNA, binds complementarily to one or more target binding sites located in untranslated regions of GAM159 target RNA, herein designated GAM TARGET RNA. This complementary binding is due to the fact that the nucleotide sequence of GAM159 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM159 RNA may have a different number of target binding sites in untranslated regions of a GAM159 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM159 RNA, herein designated GAM RNA, to target binding sites on GAM159 target RNA, herein designated GAM TARGET RNA, such as BINDING SITE I, BINDING SITE II and BINDING SITE III, inhibits translation of GAM159 target RNA into GAM159 target protein, herein designated GAM TARGET PROTEIN. GAM target protein is therefore outlined by a broken line.

It is appreciated that GAM159 target gene, herein designated TARGET GENE, in fact represents a plurality of GAM159 target genes. The mRNA of each one of this plurality of GAM159 target genes comprises one or more target binding sites, each having a nucleotide sequence which is at least partly complementary to GAM159 RNA, herein designated GAM RNA, and which when bound by GAM159 RNA causes inhibition of translation of respective one or more GAM159 target proteins.

It is further appreciated by one skilled in the art that the mode of translational inhibition illustrated by FIG. 8 with specific reference to translational inhibition exerted by GAM159 gene, herein designated GAM GENE, on one or more GAM159 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM159 correlate with, and may be deduced from, the identity of the target genes which GAM159 binds and inhibits, and the function of these target genes, as elaborated hereinbelow.

AF5Q31 (Accession NM_014423.1) is a GAM159 target gene, herein designated TARGET GENE. AF5Q31 BINDING SITE is a target binding site found in the 5' untranslated region of mRNA encoded by AF5Q31, corresponding to a target binding site such as BINDING SITE I, BINDING SITE II or BINDING SITE III of FIG. 8. Table 4 illustrates the complementarity of the nucleotide sequences of AF5Q31 BINDING SITE, designated SEQ ID:13598, to the nucleotide sequence of GAM159 RNA, herein designated GAM RNA, also designated SEQ ID:230.

A function of GAM159 is therefore inhibition of AF5Q31 (Accession NM_014423.1). Accordingly, utilities of GAM159 include diagnosis, prevention and treatment of diseases and clinical conditions associated with AF5Q31.

APPD (Accession) is another GAM159 target gene, herein designated TARGET GENE. APPD BINDING SITE is a target binding site found in the 3' untranslated region of mRNA encoded by APPD, corresponding to a target binding site such as BINDING SITE I, BINDING SITE II or BINDING SITE III of FIG. 8. Table 4 illustrates the complementarity of the nucleotide sequences of APPD BINDING SITE, designated SEQ ID:14424, to the nucleotide sequence of GAM159 RNA, herein designated GAM RNA, also designated SEQ ID:230.

Another function of GAM159 is therefore inhibition of APPD (Accession). Accordingly, utilities of GAM159 include diagnosis, prevention and treatment of diseases and clinical conditions associated with APPD.

Digeorge syndrome critical region gene 6 (DGCR6, Accession NM_005675.2) is another GAM159 target gene, herein designated TARGET GENE. DGCR6 BINDING SITE is a target binding site found in the 3' untranslated region of mRNA encoded by DGCR6, corresponding to a target binding site such as BINDING SITE I, BINDING SITE II or BINDING SITE III of FIG. 8. Table 4 illustrates the complementarity of the nucleotide sequences of DGCR6 BINDING SITE, designated SEQ ID:10368, to the nucleotide sequence of GAM159 RNA, herein designated GAM RNA, also designated SEQ ID:230.

Another function of GAM159 is therefore inhibition of Digeorge syndrome critical region gene 6 (DGCR6, Accession NM_005675.2) . Accordingly, utilities of GAM159 include diagnosis, prevention and treatment of diseases and clinical conditions associated with DGCR6.

FLJ13710 (Accession NM_024817.1) is another GAM159 target gene, herein designated TARGET GENE. FLJ13710 BINDING SITE is a target binding site found in the 3' untranslated region of mRNA encoded by FLJ13710, corresponding to a target binding site such as BINDING SITE I, BINDING SITE II or BINDING SITE III of FIG. 8. Table 4 illustrates the complementarity of the nucleotide sequences of FLJ13710 BINDING SITE, designated SEQ ID:19395, to the nucleotide sequence of GAM159 RNA, herein designated GAM RNA, also designated SEQ ID:230.

Another function of GAM159 is therefore inhibition of FLJ13710 (Accession NM_024817.1). Accordingly, utilities of GAM159 include diagnosis, prevention and treatment of diseases and clinical conditions associated with FLJ13710.

Gata binding protein 2 (GATA2, Accession) is another GAM159 target gene, herein designated TARGET GENE. GATA2 BINDING SITE is a target binding site found in the 3' untranslated region of mRNA encoded by GATA2, corresponding to a target binding site such as BINDING SITE I, BINDING SITE II or BINDING SITE III of FIG. 8. Table 4 illustrates the complementarity of the nucleotide sequences of GATA2 BINDING SITE, designated SEQ ID:13334, to the nucleotide sequence of GAM159 RNA, herein designated GAM RNA, also designated SEQ ID:230.

Another function of GAM159 is therefore inhibition of Gata binding protein 2 (GATA2, Accession). Accordingly, utilities of GAM159 include diagnosis, prevention and treatment of diseases and clinical conditions associated with GATA2.

Huntingtin (huntington disease) (HD, Accession NM_002111.3) is another GAM159 target gene, herein designated TARGET GENE. HD BINDING SITE is a target binding site found in the 3' untranslated region of mRNA encoded by HD, corresponding to a target binding site such as BINDING SITE I, BINDING SITE II or BINDING SITE III of FIG. 8. Table 4 illustrates the complementarity of the nucleotide sequences of HD BINDING SITE, designated SEQ ID:15165, to the nucleotide sequence of GAM159 RNA, herein designated GAM RNA, also designated SEQ ID:230.

Another function of GAM159 is therefore inhibition of Huntingtin (huntington disease) (HD, Accession NM_002111.3). Accordingly, utilities of GAM159 include diagnosis, prevention and treatment of diseases and clinical conditions associated with HD.

KIAA0953 (Accession XM_039733.2) is another GAM159 target gene, herein designated TARGET GENE. KIAA0953 BINDING SITE is a target binding site found in the 3' untranslated region of mRNA encoded by KIAA0953, corresponding to a target binding site such as BINDING SITE I, BINDING SITE II or BINDING SITE III of FIG. 8. Table 4 illustrates the complementarity of the nucleotide sequences of KIAA0953 BINDING SITE, designated SEQ ID:11636, to the nucleotide sequence of GAM159 RNA, herein designated GAM RNA, also designated SEQ ID:230.

Another function of GAM159 is therefore inhibition of KIAA0953 (Accession XM_039733.2). Accordingly, utilities of GAM159 include diagnosis, prevention and treatment of diseases and clinical conditions associated with KIAA0953.

LOC151438 (Accession XM_098060.1) is another GAM159 target gene, herein designated TARGET GENE. LOC151438 BINDING SITE is a target binding site found in the 5' untranslated region of mRNA encoded by LOC151438, corresponding to a target binding site such as BINDING SITE I, BINDING SITE II or BINDING SITE III of FIG. 8. Table 4 illustrates the complementarity of the nucleotide sequences of LOC151438 BINDING SITE, designated SEQ ID:18291, to the nucleotide sequence of GAM159 RNA, herein designated GAM RNA, also designated SEQ ID:230.

Another function of GAM159 is therefore inhibition of LOC151438 (Accession XM_098060.1). Accordingly, utilities of GAM159 include diagnosis, prevention and treatment of diseases and clinical conditions associated with LOC151438.

LOC91748 (Accession) is another GAM159 target gene, herein designated TARGET GENE. LOC91748 BINDING SITE is a target binding site found in the 3' untranslated region of mRNA encoded by LOC91748, corresponding to a target binding site such as BINDING SITE I, BINDING SITE II or BINDING SITE III of FIG. 8. Table 4 illustrates the complementarity of the nucleotide sequences of LOC91748 BINDING SITE, designated SEQ ID:1274, to the nucleotide sequence of GAM159 RNA, herein designated GAM RNA, also designated SEQ ID:230.

Another function of GAM159 is therefore inhibition of LOC91748 (Accession). Accordingly, utilities of GAM159 include diagnosis, prevention and treatment of diseases and clinical conditions associated with LOC91748.

SDR1 (Accession NM_004753.1) is another GAM159 target gene, herein designated TARGET GENE. SDR1 BINDING SITE is a target binding site found in the 3' untranslated region of mRNA encoded by SDR1, corresponding to a target binding site such as BINDING SITE I, BINDING SITE II or BINDING SITE III of FIG. 8. Table 4 illustrates the complementarity of the nucleotide sequences of SDR1 BINDING SITE, designated SEQ ID:19713, to the nucleotide sequence of GAM159 RNA, herein designated GAM RNA, also designated SEQ ID:230.

Another function of GAM159 is therefore inhibition of SDR1 (Accession NM_004753.1). Accordingly, utilities of GAM159 include diagnosis, prevention and treatment of diseases and clinical conditions associated with SDR1.

FIG. 8 further provides a conceptual description of a novel bioinformatically detected of the present invention, referred to here as Genomic Address Messenger 160 (GAM160), which modulates expression of respective target genes thereof, the function and utility of which target genes is known in the art.

GAM160 is a novel bioinformatically detected regulatory, non protein coding, micro RNA (miRNA) gene. The method by which GAM160 was detected is described hereinabove with reference to FIGS. 8-15.

GAM160 gene, herein designated GAM GENE, and GAM160 target gene, herein designated TARGET GENE, are human genes contained in the human genome.

GAM160 gene encodes a GAM160 precursor RNA, herein designated GAM PRECURSOR RNA. Similar to other miRNA genes, and unlike most ordinary genes, GAM160 precursor RNA does not encode a protein. A nucleotide sequence identical or highly similar to the nucleotide sequence of GAM160 precursor RNA is designated SEQ ID:174, and is provided hereinbelow with reference to the sequence listing part. Nucleotide sequence SEQ ID:174 is located at position 150162171 relative to chromosome 3.

GAM160 precursor RNA folds onto itself, forming GAM160 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM160 precursor RNA folds onto itself, forming GAM160 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM160 precursor RNA, designated SEQ-ID:174, and a schematic representation of a predicted secondary folding of GAM160 folded precursor RNA are further described with reference to Table 2, hereby incorporated by reference.

An enzyme complex designated DICER COMPLEX, 'dices' the GAM160 folded precursor RNA into GAM160 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM160 RNA is designated SEQ ID:343, and is provided hereinbelow with references to the sequence listing part and Table 3, hereby incorporated by reference.

GAM160 target gene, herein designated TARGET GENE, encodes a corresponding messenger RNA, GAM160 target RNA, herein designated GAM TARGET RNA. GAM160 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM160 RNA, herein designated GAM RNA, binds complementarily to one or more target binding sites located in untranslated regions of GAM160 target RNA, herein designated GAM TARGET RNA. This complementary binding is due to the fact that the nucleotide sequence of GAM160 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM160 RNA may have a different number of target binding sites in untranslated regions of a GAM160 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM160 RNA, herein designated GAM RNA, to target binding sites on GAM160 target RNA, herein designated GAM TARGET RNA, such as BINDING SITE I, BINDING SITE II and BINDING SITE III, inhibits translation of GAM160 target RNA into GAM160 target protein, herein designated GAM TARGET PROTEIN. GAM target protein is therefore outlined by a broken line.

It is appreciated that GAM160 target gene, herein designated TARGET GENE, in fact represents a plurality of GAM160 target genes. The mRNA of each one of this plurality of GAM160 target genes comprises one or more target binding sites, each having a nucleotide sequence which is at least partly complementary to GAM160 RNA, herein designated GAM RNA, and which when bound by GAM160 RNA causes inhibition of translation of respective one or more GAM160 target proteins.

It is further appreciated by one skilled in the art that the mode of translational inhibition illustrated by FIG. 8 with specific reference to translational inhibition exerted by GAM160 gene, herein designated GAM GENE, on one or more GAM160target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM160 correlate with, and may be deduced from, the identity of the target genes which GAM160 binds and inhibits, and the function of these target genes, as elaborated hereinbelow.

LOC132235 (Accession XM_072302.2) is a GAM160 target gene, herein designated TARGET GENE. LOC132235 BINDING SITE is a target binding site found in the 3' untranslated region of mRNA encoded by LOC132235, corresponding to a target binding site such as BINDING SITE I, BINDING SITE II or BINDING SITE III of FIG. 8. Table 4 illustrates the complementarity of the nucleotide sequences of LOC132235 BINDING SITE, designated SEQ ID:13188, to the nucleotide sequence of GAM160 RNA, herein designated GAM RNA, also designated SEQ ID:343.

A function of GAM160 is therefore inhibition of LOC132235 (Accession XM_072302.2). Accordingly, utilities of GAM160 include diagnosis, prevention and treatment of diseases and clinical conditions associated with LOC132235.

Tnf receptor-associated factor 3 (TRAF3, Accession NM_145725.1) is another GAM160 target gene, herein designated TARGET GENE. TRAF3 BINDING SITE is a target binding site found in the 5' untranslated region of multiple transcripts of mRNA encoded by TRAF3, corresponding to a target binding site such as BINDING SITE I, BINDING SITE II or BINDING SITE III of FIG. 8. Table 4 illustrates the complementarity of the nucleotide sequences of TRAF3 BINDING SITE, designated SEQ ID:9111, to the nucleotide sequence of GAM160 RNA, herein designated GAM RNA, also designated SEQ ID:343.

Another function of GAM160 is therefore inhibition of Tnf receptor-associated factor 3 (TRAF3, Accession NM_145725.1). Accordingly, utilities of GAM160 include diagnosis, prevention and treatment of diseases and clinical conditions associated with TRAF3.

FIG. 8 further provides a conceptual description of a novel bioinformatically detected gene of the present invention, referred to here as Genomic Address Messenger 161 (GAM161), which modulates expression of respective target genes thereof, the function and utility of which target genes is known in the art.

GAM161 is a novel bioinformatically detected regulatory, non protein coding, micro RNA (miRNA) gene. The method by which GAM161 was detected is described hereinabove with reference to FIGS. 8-15.

GAM161 gene, herein designated GAM GENE, and GAM161 target gene, herein designated TARGET GENE, are human genes contained in the human genome.

GAM161 gene encodes a GAM161 precursor RNA, herein designated GAM PRECURSOR RNA. Similar to other miRNA genes, and unlike most ordinary genes, GAM161 precursor RNA does not encode a protein. A nucleotide sequence identical or highly similar to the nucleotide sequence of GAM161 precursor RNA is designated SEQ ID:24, and is provided hereinbelow with reference to the sequence listing part. Nucleotide sequence SEQ ID:24 is located at position 3119977 relative to chromosome 1.

GAM161 precursor RNA folds onto itself, forming GAM161 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM161 precursor RNA folds onto itself, forming GAM161 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM161 precursor RNA, designated SEQ-ID:24, and a schematic representation of a predicted secondary folding of GAM161 folded precursor RNA are further described with reference to Table 2, hereby incorporated by reference.

An enzyme complex designated DICER COMPLEX, 'dices' the GAM161 folded precursor RNA into GAM161 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM161 RNA is designated SEQ ID:304, and is provided hereinbelow with references to the sequence listing part and Table 3, hereby incorporated by reference.

GAM161 target gene, herein designated TARGET GENE, encodes a corresponding messenger RNA, GAM161 target RNA, herein designated GAM TARGET RNA. GAM161 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM161 RNA, herein designated GAM RNA, binds complementarily to one or more target binding sites located in untranslated regions of GAM161 target RNA, herein designated GAM TARGET RNA. This complementary binding is due to the fact that the nucleotide sequence of GAM161 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM161 RNA may have a different number of target binding sites in untranslated regions of a GAM161 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM161 RNA, herein designated GAM RNA, to target binding sites on GAM161 target RNA, herein designated GAM TARGET RNA, such as BINDING SITE I, BINDING SITE II and BINDING SITE III, inhibits translation of GAM161 target RNA into GAM161 target protein, herein designated GAM TARGET PROTEIN. GAM target protein is therefore outlined by a broken line.

It is appreciated that GAM161 target gene, herein designated TARGET GENE, in fact represents a plurality of GAM161 target genes. The mRNA of each one of this plurality of GAM161 target genes comprises one or more target binding sites, each having a nucleotide sequence which is at least partly complementary to GAM161 RNA, herein designated GAM RNA, and which when bound by GAM161 RNA causes inhibition of translation of respective one or more GAM161 target proteins.

It is further appreciated by one skilled in the art that the mode of translational inhibition illustrated by FIG. 8 with specific reference to translational inhibition exerted by GAM161 gene, herein designated GAM GENE, on one or more GAM161 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM161 correlate with, and may be deduced from, the identity of the target genes which GAM161 binds and inhibits, and the function of these target genes, as elaborated hereinbelow.

APM1 (Accession NM_004797.1) is a GAM161 target gene, herein designated TARGET GENE. APM1 BINDING SITE is a target binding site found in the 3' untranslated region of mRNA encoded by APM1, corresponding to a target binding site such as BINDING SITE I, BINDING SITE II or BINDING SITE III of FIG. 8. Table 4 illustrates the complementarity of the nucleotide sequences of APM1 BINDING SITE, designated SEQ ID:9908, to the nucleotide sequence of GAM161 RNA, herein designated GAM RNA, also designated SEQ ID:304.

A function of GAM161 is therefore inhibition of APM1 (Accession NM_004797.1). Accordingly, utilities of GAM161 include diagnosis, prevention and treatment of diseases and clinical conditions associated with APM1.

B-cell cll/lymphoma 10 (BCL10, Accession NM_003921.2) is another GAM161 target gene, herein designated TARGET GENE. BCL10 BINDING SITE is a target binding site found in the 3' untranslated region of mRNA encoded by BCL10, corresponding to a target binding site such as BINDING SITE I, BINDING SITE II or BINDING SITE III of FIG. 8. Table 4 illustrates the complementarity of the nucleotide sequences of BCL10 BINDING SITE, designated SEQ ID:8318, to the nucleotide sequence of GAM161 RNA, herein designated GAM RNA, also designated SEQ ID:304.

Another function of GAM161 is therefore inhibition of B-cell cll/lymphoma 10 (BCL10, Accession NM_003921.2), a gene which is a positive regulator of lymphocyte proliferation, NF-kappaB activator. and therefore may be associated with Malt lymphoma, follicular lymphoma. Accordingly, utilities of GAM161 include diagnosis, prevention and treatment of Malt lymphoma, follicular lymphoma, and of other diseases and clinical conditions associated with BCL10.

The function of BCL10 and its association with various diseases and clinical conditions, has been established by previous studies, as described hereinabove with reference to GAM136.1. Chromosome 13 open reading frame 1 (C13orf1, Accession NM_020456.1) is another GAM161 target gene, herein designated TARGET GENE. C13orf1 BINDING SITE is a target binding site found in the 3' untranslated region of mRNA encoded by C13orf1, corresponding to a target binding site such as BINDING SITE I, BINDING SITE II or BINDING SITE III of FIG. 8. Table 4 illustrates the complementarity of the nucleotide sequences of C13orf1 BINDING SITE, designated SEQ ID:12864, to the nucleotide sequence of GAM161 RNA, herein designated GAM RNA, also designated SEQ ID:304.

Another function of GAM161 is therefore inhibition of Chromosome 13 open reading frame 1 (C13orf1, Accession NM_020456.1). Accordingly, utilities of GAM161 include diagnosis, prevention and treatment of diseases and clinical conditions associated with C13orf1.

Chromosome 21 open reading frame 67 (C21orf67, Accession NM_058188.1) is another GAM161 target gene, herein designated TARGET GENE. C21orf67 BINDING SITE is a target binding site found in the 5' untranslated region of mRNA encoded by C21orf67, corresponding to a target binding site such as BINDING SITE I, BINDING SITE II or BINDING SITE III of FIG. 8. Table 4 illustrates the complementarity of the nucleotide sequences of C21orf67 BINDING SITE, designated SEQ ID:12444, to the nucleotide sequence of GAM161 RNA, herein designated GAM RNA, also designated SEQ ID:304.

Another function of GAM161 is therefore inhibition of Chromosome 21 open reading frame 67 (C21orf67, Accession NM_058188.1). Accordingly, utilities of GAM161 include diagnosis, prevention and treatment of diseases and clinical conditions associated with C21orf67.

Chromosome 6 open reading frame 33 (C6orf33, Accession NM_133367.1) is another GAM161 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:14623, to the nucleotide sequence of GAM161 RNA, herein designated GAM RNA, also designated SEQ ID:304.

Another function of GAM161 is therefore inhibition of Chromosome 6 open reading frame 33 (C6orf33, Accession NM_133367.1). Accordingly, utilities of GAM161 include diagnosis, prevention and treatment of diseases and clinical conditions associated with C6orf33.

Chromosome 9 open reading frame 9 (C9orf9, Accession NM_018956.2) is another GAM161 target gene, herein designated TARGET GENE. C9orf9 BINDING SITE is a target binding site found in the 5' untranslated region of mRNA encoded by C9orf9, corresponding to a target binding site such as BINDING SITE I, BINDING SITE II or BINDING SITE III of FIG. 8. Table 4 illustrates the complementarity of the nucleotide sequences of C9orf9 BINDING SITE, designated SEQ ID:10257, to the nucleotide sequence of GAM161 RNA, herein designated GAM RNA, also designated SEQ ID:304.

Another function of GAM161 is therefore inhibition of Chromosome 9 open reading frame 9 (C9orf9, Accession NM_018956.2). Accordingly, utilities of GAM161 include diagnosis, prevention and treatment of diseases and clinical conditions associated with C9orf9.

Cadherin 17, li cadherin (liver-intestine) (CDH17, Accession NM_004063.2) is another GAM161 target gene, herein designated TARGET GENE. CDH17 BINDING SITE is a target binding site found in the 3' untranslated region of mRNA encoded by CDH17, corresponding to a target binding site such as BINDING SITE I, BINDING SITE II or BINDING SITE III of FIG. 8. Table 4 illustrates the complementarity of the nucleotide sequences of CDH17 BINDING SITE, designated SEQ ID:1297, to the nucleotide sequence of GAM161 RNA, herein designated GAM RNA, also designated SEQ ID:304.

Another function of GAM161 is therefore inhibition of Cadherin 17, li cadherin (liver-intestine) (CDH17, Accession NM_004063.2), a gene which may have a role in the morphological organization of liver and intestine and involved in intestinal peptide transport. Accordingly, utilities of GAM161 include diagnosis, prevention and treatment of diseases and clinical conditions associated with CDH17.

The function of CDH17 has been established by previous studies. The first step in oral absorption of many medically important peptide-based drugs, such as beta-lactam antibiotics, is mediated by an intestinal proton-dependent peptide transporter. Dantzig et al. (1994) identified a monoclonal antibody that blocked uptake of the beta-lactam cephalexin by human cells. By screening an expression library with this antibody, the authors isolated cDNAs encoding a protein that they designated 'human peptide transporter-1,' or HPT1. Sequence analysis revealed that the predicted 832-amino acid protein shares several structural features with the cadherin superfamily of calcium-dependent cell-cell adhesion proteins. See 603006. Like the cadherins, HPT1 contains an extracellular region with conserved motifs and a transmembrane domain. However, HPT1 lacks the cytoplasmic domain found in other cadherins. Using immunohistochemical staining, Dantzig et al. (1994) localized HPT1 along the gastrointestinal tract and the pancreatic ducts, but not in kidney, lung, or several other tissues. Mammalian cells expressing HPT1 showed consistently higher cephalexin uptake activity than controls. Uptake was dependent on an inwardly directed proton gradient.

Full details of the abovementioned studies are described in the following publications, the disclosure of which are hereby incorporated by reference:

Dantzig, A. H.; Hoskins, J.; Tabas, L. B.; Bright, S.; Shepard, R. L.; Jenkins, I. L.; Duckworth, D. C.; Sportsman, J. R.; Mackensen, D.; Rosteck, P. R., Jr.; Skatrud, P. L.: Association of intestinal peptide transport with a protein related to the cadherin superfamily. Science 264:430-433, 1994; and Kremmidiotis, G.; Baker, E.; Crawford, J.; Eyre, H. J.; Nahmias, J.; Callen, D. F. : Localization of human cadherin genes to chromosome regions exhibiting cancer-related loss of heteroz.

Further studies establishing the function and utilities of CDH17 are found in John Hopkins OMIM database record ID 603017, and in cited publications listed in Table 5, which are hereby incorporated by reference. Fc fragment of iga, receptor for (FCAR, Accession NM_002000.2) is another GAM161 target gene, herein designated TARGET GENE. FCAR BINDING SITE is a target binding site found in the 3' untranslated region of multiple transcripts of mRNA encoded by FCAR, corresponding to a target binding site such as BINDING SITE I, BINDING SITE II or BINDING SITE III of FIG. 8. Table 4 illustrates the complementarity of the nucleotide sequences of FCAR BINDING SITE, designated SEQ ID:8313, to the nucleotide sequence of GAM161 RNA, herein designated GAM RNA, also designated SEQ ID:304.

Another function of GAM161 is therefore inhibition of Fc fragment of iga, receptor for (FCAR, Accession NM_002000.2), a gene which binds to the fc region of immunoglobulins alpha and mediates several functions including cytokine production. and therefore may be associated with Iga nephropathy. Accordingly, utilities of GAM161 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fasciculation and elongation protein zeta 1 (zygin i) (FEZ1, Accession NM_005103.3) is another GAM161 target gene, herein designated TARGET GENE. FEZ1 BINDING SITE is a target binding site found in the 3' untranslated region of multiple transcripts of mRNA encoded by FEZ1, corresponding to a target binding site such as BINDING SITE I, BINDING SITE II or BINDING SITE III of FIG. 8. Table 4 illustrates the complementarity of the nucleotide sequences of FEZ1 BINDING SITE, designated SEQ ID:8241, to the nucleotide sequence of GAM161 RNA, herein designated GAM RNA, also designated SEQ ID:304.

Another function of GAM161 is therefore inhibition of Fasciculation and elongation protein zeta 1 (zygin i) (FEZ1, Accession NM_005103.3), a gene which Zygin 1; may have a role in axonal outgrowth; has similarity to C. elegans UNC-76. Accordingly, utilities of GAM161 include diagnosis, prevention and treatment of diseases and clinical conditions associated with FEZ1.

The function of FEZ1 and its association with various diseases and clinical conditions, has been established by previous studies, as described hereinabove with reference to GAM30.1. FLJ10232 (Accession NM_018033.1) is another GAM161 target gene, herein designated TARGET GENE. FLJ10232 BINDING SITE is a target binding site found in the 3' untranslated region of mRNA encoded by FLJ10232, corresponding to a target binding site such as BINDING SITE I, BINDING SITE II or BINDING SITE III of FIG. 8. Table 4 illustrates the complementarity of the nucleotide sequences of FLJ10232 BINDING SITE, designated SEQ ID:12255, to the nucleotide sequence of GAM161 RNA, herein designated GAM RNA, also designated SEQ ID:304.

Another function of GAM161 is therefore inhibition of FLJ10232 (Accession NM_018033.1). Accordingly, utilities of GAM161 include diagnosis, prevention and treatment of diseases and clinical conditions associated with FLJ10232.

FLJ12787 (Accession NM_032175.1) is another GAM161 target gene, herein designated TARGET GENE. FLJ12787 BINDING SITE is a target binding site found in the 3' untranslated region of mRNA encoded by FLJ12787, corresponding to a target binding site such as BINDING SITE I, BINDING SITE II or BINDING SITE III of FIG. 8. Table 4 illustrates the complementarity of the nucleotide sequences of FLJ12787 BINDING SITE, designated SEQ ID:7408, to the nucleotide sequence of GAM161 RNA, herein designated GAM RNA, also designated SEQ ID:304.

Another function of GAM161 is therefore inhibition of FLJ12787 (Accession NM_032175.1). Accordingly, utilities of GAM161 include diagnosis, prevention and treatment of diseases and clinical conditions associated with FLJ12787.

FLJ13114 (Accession NM_024541.1) is another GAM161 target gene, herein designated TARGET GENE. FLJ13114 BINDING SITE is a target binding site found in the 5' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:930, to the nucleotide sequence of GAM161 RNA, herein designated GAM RNA, also designated SEQ ID:304.

Another function of GAM161 is therefore inhibition of FLJ13114 (Accession NM_024541.1). Accordingly, utilities of GAM161 include diagnosis, prevention and treatment of diseases and clinical conditions associated with FLJ13114.

FLJ13188 (Accession NM_022063.1) is another GAM161 target gene, herein designated TARGET GENE. FLJ13188 BINDING SITE is a target binding site found in the 3' untranslated region of mRNA encoded by FLJ13188, corresponding to a target binding site such as BINDING SITE I, BINDING SITE II or BINDING SITE III of FIG. 8. Table 4 illustrates the complementarity of the nucleotide sequences of FLJ13188 BINDING SITE, designated SEQ ID:3353, to the nucleotide sequence of GAM161 RNA, herein designated GAM RNA, also designated SEQ ID:304.

Another function of GAM161 is therefore inhibition of FLJ13188 (Accession NM_022063.1). Accordingly, utilities of GAM161 include diagnosis, prevention and treatment of diseases and clinical conditions associated with FLJ13188.

FLJ13456 (Accession XM_038291.5) is another GAM161 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:12949, to the nucleotide sequence of GAM161 RNA, herein designated GAM RNA, also designated SEQ ID:304.

Another function of GAM161 is therefore inhibition of FLJ13456 (Accession XM_038291.5). Accordingly, utilities of GAM161 include diagnosis, prevention and treatment of diseases and clinical conditions associated with FLJ13456.

FLJ20136 (Accession NM_017684.1) is another GAM161 target gene, herein designated TARGET GENE. FLJ20136 BINDING SITE is a target binding site found in the 3' untranslated region of mRNA encoded by FLJ20136, corresponding to a target binding site such as BINDING SITE I, BINDING SITE II or BINDING SITE III of FIG. 8. Table 4 illustrates the complementarity of the nucleotide sequences of FLJ20136 BINDING SITE, designated SEQ ID:8713, to the nucleotide sequence of GAM161 RNA, herein designated GAM RNA, also designated SEQ ID:304.

Another function of GAM161 is therefore inhibition of FLJ20136 (Accession NM_017684.1). Accordingly, utilities of GAM161 include diagnosis, prevention and treatment of diseases and clinical conditions associated with FLJ20136.

FLJ20507 (Accession NM_017849.1) is another GAM161 target gene, herein designated TARGET GENE. FLJ20507 BINDING SITE is a target binding site found in the 3' untranslated region of mRNA encoded by FLJ20507, corresponding to a target binding site such as BINDING SITE I, BINDING SITE II or BINDING SITE III of FIG. 8. Table 4 illustrates the complementarity of the nucleotide sequences of FLJ20507 BINDING SITE, designated SEQ ID:19171, to the nucleotide sequence of GAM161 RNA, herein designated GAM RNA, also designated SEQ ID:304.

Another function of GAM161 is therefore inhibition of FLJ20507 (Accession NM_017849.1). Accordingly, utilities of GAM161 include diagnosis, prevention and treatment of diseases and clinical conditions associated with FLJ20507.

FLJ31153 (Accession NM_144600.1) is another GAM161 target gene, herein designated TARGET GENE. FLJ31153 BINDING SITE is a target binding site found in the 5' untranslated region of mRNA encoded by FLJ31153, corresponding to a target binding site such as BINDING SITE I, BINDING SITE II or BINDING SITE III of FIG. 8. Table 4 illustrates the complementarity of the nucleotide sequences of FLJ31153 BINDING SITE, designated SEQ ID:1064, to the nucleotide sequence of GAM161 RNA, herein designated GAM RNA, also designated SEQ ID:304.

Another function of GAM161 is therefore inhibition of FLJ31153 (Accession NM_144600.1). Accordingly, utilities of GAM161 include diagnosis, prevention and treatment of diseases and clinical conditions associated with FLJ31153.

FLJ32865 (Accession NM_144613.1) is another GAM161 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:15270, to the nucleotide sequence of GAM161 RNA, herein designated GAM RNA, also designated SEQ ID:304.

Another function of GAM161 is therefore inhibition of FLJ32865 (Accession NM_144613.1). Accordingly, utilities of GAM161 include diagnosis, prevention and treatment of diseases and clinical conditions associated with FLJ32865.

GR6 (Accession NM_007354.1) is another GAM161 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:11991, to the nucleotide sequence of GAM161 RNA, herein designated GAM RNA, also designated SEQ ID:304.

Another function of GAM161 is therefore inhibition of GR6 (Accession NM_007354.1). Accordingly, utilities of GAM161 include diagnosis, prevention and treatment of diseases and clinical conditions associated with GR6.

H2AV (Accession NM_138635.1) is another GAM161 target gene, herein designated TARGET GENE. H2AV BINDING SITE is a target binding site found in the 3' untranslated region of multiple transcripts of mRNA encoded by H2AV, corresponding to a target binding site such as BINDING SITE I, BINDING SITE II or BINDING SITE III of FIG. 8. Table 4 illustrates the complementarity of the nucleotide sequences of H2AV BINDING SITE, designated SEQ ID:4146, to the nucleotide sequence of GAM161 RNA, herein designated GAM RNA, also designated SEQ ID:304.

Another function of GAM161 is therefore inhibition of H2AV (Accession NM_138635.1). Accordingly, utilities of GAM161 include diagnosis, prevention and treatment of diseases and clinical conditions associated with H2AV.

HCA4 (Accession) is another GAM161 target gene, herein designated TARGET GENE. HCA4 BINDING SITE is a target binding site found in the 3' untranslated region of mRNA encoded by HCA4, corresponding to a target binding site such as BINDING SITE I, BINDING SITE II or BINDING SITE III of FIG. 8. Table 4 illustrates the complementarity of the nucleotide sequences of HCA4 BINDING SITE, designated SEQ ID:18806, to the nucleotide sequence of GAM161 RNA, herein designated GAM RNA, also designated SEQ ID:304.

Another function of GAM161 is therefore inhibition of HCA4 (Accession). Accordingly, utilities of GAM161 include diagnosis, prevention and treatment of diseases and clinical conditions associated with HCA4.

Histamine receptor h4 (HRH4, Accession NM_021624.2) is another GAM161 target gene, herein designated TARGET GENE. HRH4 BINDING SITE is a target binding site found in the 3' untranslated region of mRNA encoded by HRH4, corresponding to a target binding site such as BINDING SITE I, BINDING SITE II or BINDING SITE III of FIG. 8. Table 4 illustrates the complementarity of the nucleotide sequences of HRH4 BINDING SITE, designated SEQ ID:18713, to the nucleotide sequence of GAM161 RNA, herein designated GAM RNA, also designated SEQ ID:304.

Another function of GAM161 is therefore inhibition of Histamine receptor h4 (HRH4, Accession NM_021624.2). Accordingly, utilities of GAM161 include diagnosis, prevention and treatment of diseases and clinical conditions associated with HRH4.

5-hydroxytryptamine (serotonin) receptor 1e (HTR1E, Accession NM_000865.1) is another GAM161 target gene, herein designated TARGET GENE. HTR1E BINDING SITE is a target binding site found in the 5' untranslated region of mRNA encoded by HTR1E, corresponding to a target binding site such as BINDING SITE I, BINDING SITE II or BINDING SITE III of FIG. 8. Table 4 illustrates the complementarity of the nucleotide sequences of HTR1E BINDING SITE, designated SEQ ID:3407, to the nucleotide sequence of GAM161 RNA, herein designated GAM RNA, also designated SEQ ID:304.

Another function of GAM161 is therefore inhibition of 5-hydroxytryptamine (serotonin) receptor 1e (HTR1E, Accession NM_000865.1), a gene which belongs to g-protein coupled receptors. Accordingly, utilities of GAM161 include diagnosis, prevention and treatment of diseases and clinical conditions associated with HTR1E.

The function of HTR1E has been established by previous studies. Serotonin (5-hydroxytryptamine; 5-HT) is a neurotransmitter thought to play a role in various cognitive and behavioral functions including feeding, sleep, pain, depression, and learning. Serotonin receptors have been divided into 4 classes designated 5-HT-1-like, 5-HT-2 (OMIM Ref. No. 182135), 5-HT-3 (OMIM Ref. No. 182139), and 5-HT-4 (OMIM Ref. No. 602128), depending on their ligand binding and effector-coupling properties. McAllister et al. (1992) stated the 5-HT-1 receptor family can be further subdivided into 4 subtypes, 5-HT-1A to 5-HT-1D. McAllister et al. (1992) described the cloning and characterization of a 5-HT-1E receptor. The excellent correlation observed between the pharmacology of the expressed receptor and the human brain 5-HT-1E binding site confirmed that their clone encodes a 5-HT-1E receptor and establishes a fifth 5-HT-1-like receptor subtype. Using 2 independent polymerase chain reactions on a panel of human-hamster somatic cell hybrid genomic DNA, Levy et al. (1994) showed that the 5-hydroxytryptamine-1E serotonin receptor gene is located on human chromosome 6. Furthermore, by means of in situ hybridization to human metaphase chromosomes using the cloned gene as a probe (Levy et al., 1992), they demonstrated that the gene is located on 6q14-q15. HTR1E is found mainly in cerebral cortex, and the precise chromosomal assignment of the gene may help evaluate this locus as a candidate for mutations in neurologic and psychiatric diseases.

Full details of the abovementioned studies are described in the following publications, the disclosure of which are hereby incorporated by reference:

Levy, F. O.; Holtgreve-Grez, H.; Tasken, K.; Solberg, R.; Ried, T.; Gudermann, T. : Assignment of the gene encoding the 5-HT-1E serotonin receptor (S31) (locus HTR1E) to human chromosome 6q14-q15. Genomics 22:637-640, 1994; and McAllister, G.; Charlesworth, A.; Snodin, C.; Beer, M. S.; Noble, A. J.; Middlemiss, D. N.; Iversen, L. L.; Whiting, P.: Molecular cloning of a serotonin receptor from human brain (5HT.

Further studies establishing the function and utilities of HTR1E are found in John Hopkins OMIM database record ID 182132, and in cited publications listed in Table 5, which are hereby incorporated by reference. Interferon (alpha, beta and omega) receptor 2 (IFNAR2, Accession NM_000874.2) is another GAM161 target gene, herein designated TARGET GENE. IFNAR2 BINDING SITE is a target binding site found in the 3' untranslated region of mRNA encoded by IFNAR2, corresponding to a target binding site such as BINDING SITE I, BINDING SITE II or BINDING SITE III of FIG. 8. Table 4 illustrates the complementarity of the nucleotide sequences of IFNAR2 BINDING SITE, designated SEQ ID:8000, to the nucleotide sequence of GAM161 RNA, herein designated GAM RNA, also designated SEQ ID:304.

Another function of GAM161 is therefore inhibition of Interferon (alpha, beta and omega) receptor 2 (IFNAR2, Accession NM_000874.2), a gene which is a receptor for interferons alpha and beta. Accordingly, utilities of GAM161 include diagnosis, prevention and treatment of diseases and clinical conditions associated with IFNAR2.

The function of IFNAR2 and its association with various diseases and clinical conditions, has been established by previous studies, as described hereinabove with reference to GAM30.1. KIAA0161 (Accession) is another GAM161 target gene, herein designated TARGET GENE. KIAA0161 BINDING SITE is a target binding site found in the 3' untranslated region of mRNA encoded by KIAA0161, corresponding to a target binding site such as BINDING SITE I, BINDING SITE II or BINDING SITE III of FIG. 8. Table 4 illustrates the complementarity of the nucleotide sequences of KIAA0161 BINDING SITE, designated SEQ ID:17542, to the nucleotide sequence of GAM161 RNA, herein designated GAM RNA, also designated SEQ ID:304.

Another function of GAM161 is therefore inhibition of KIAA0161 (Accession). Accordingly, utilities of GAM161 include diagnosis, prevention and treatment of diseases and clinical conditions associated with KIAA0161.

KIAA0599 (Accession XM_085127.6) is another GAM161 target gene, herein designated TARGET GENE. KIAA0599 BINDING SITE is a target binding site found in the 3' untranslated region of mRNA encoded by KIAA0599, corresponding to a target binding site such as BINDING SITE I, BINDING SITE II or BINDING SITE III of FIG. 8. Table 4 illustrates the complementarity of the nucleotide sequences of KIAA0599 BINDING SITE, designated SEQ ID:6311, to the nucleotide sequence of GAM161 RNA, herein designated GAM RNA, also designated SEQ ID:304.

Another function of GAM161 is therefore inhibition of KIAA0599 (Accession XM_085127.6). Accordingly, utilities of GAM161 include diagnosis, prevention and treatment of diseases and clinical conditions associated with KIAA0599.

KIAA1028 (Accession) is another GAM161 target gene, herein designated TARGET GENE. KIAA1028 BINDING SITE is a target binding site found in the 3' untranslated region of mRNA encoded by KIAA1028, corresponding to a target binding site such as BINDING SITE I, BINDING SITE II or BINDING SITE III of FIG. 8. Table 4 illustrates the complementarity of the nucleotide sequences of KIAA1028 BINDING SITE, designated SEQ ID:4329, to the nucleotide sequence of GAM161 RNA, herein designated GAM RNA, also designated SEQ ID:304.

Another function of GAM161 is therefore inhibition of KIAA1028 (Accession). Accordingly, utilities of GAM161 include diagnosis, prevention and treatment of diseases and clinical conditions associated with KIAA1028.

KIAA1456 (Accession XM_040100.4) is another GAM161 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:6378, to the nucleotide sequence of GAM161 RNA, herein designated GAM RNA, also designated SEQ ID:304.

Another function of GAM161 is therefore inhibition of KIAA1456 (Accession XM_040100.4). Accordingly, utilities of GAM161 include diagnosis, prevention and treatment of diseases and clinical conditions associated with KIAA1456.

KIAA1508 (Accession XM_290952.1) is another GAM161 target gene, herein designated TARGET GENE. KIAA1508 BINDING SITE is a target binding site found in the 3' untranslated region of mRNA encoded by KIAA1508, corresponding to a target binding site such as BINDING SITE I, BINDING SITE II or BINDING SITE III of FIG. 8. Table 4 illustrates the complementarity of the nucleotide sequences of KIAA1508 BINDING SITE, designated SEQ ID:2567, to the nucleotide sequence of GAM161 RNA, herein designated GAM RNA, also designated SEQ ID:304.

Another function of GAM161 is therefore inhibition of KIAA1508 (Accession XM_290952.1). Accordingly, utilities of GAM161 include diagnosis, prevention and treatment of diseases and clinical conditions associated with KIAA1508.

KIAA1655 (Accession) is another GAM161 target gene, herein designated TARGET GENE. KIAA1655 BINDING SITE is a target binding site found in the 3' untranslated region of mRNA encoded by KIAA1655, corresponding to a target binding site such as BINDING SITE I, BINDING SITE II or BINDING SITE III of FIG. 8. Table 4 illustrates the complementarity of the nucleotide sequences of KIAA1655 BINDING SITE, designated SEQ ID:19930, to the nucleotide sequence of GAM161 RNA, herein designated GAM RNA, also designated SEQ ID:304.

Another function of GAM161 is therefore inhibition of KIAA1655 (Accession). Accordingly, utilities of GAM161 include diagnosis, prevention and treatment of diseases and clinical conditions associated with KIAA1655.

KIAA1877 (Accession) is another GAM161 target gene, herein designated TARGET GENE. KIAA1877 BINDING SITE is a target binding site found in the 3' untranslated region of mRNA encoded by KIAA1877, corresponding to a target binding site such as BINDING SITE I, BINDING SITE II or BINDING SITE III of FIG. 8. Table 4 illustrates the complementarity of the nucleotide sequences of KIAA1877 BINDING SITE, designated SEQ ID:4810, to the nucleotide sequence of GAM161 RNA, herein designated GAM RNA, also designated SEQ ID:304.

Another function of GAM161 is therefore inhibition of KIAA1877 (Accession). Accordingly, utilities of GAM161 include diagnosis, prevention and treatment of diseases and clinical conditions associated with KIAA1877.

LOC126133 (Accession) is another GAM161 target gene, herein designated TARGET GENE. LOC126133 BINDING SITE is a target binding site found in the 3' untranslated region of mRNA encoded by LOC126133, corresponding to a target binding site such as BINDING SITE I, BINDING SITE II or BINDING SITE III of FIG. 8. Table 4 illustrates the complementarity of the nucleotide sequences of LOC126133 BINDING SITE, designated SEQ ID:13929, to the nucleotide sequence of GAM161 RNA, herein designated GAM RNA, also designated SEQ ID:304.

Another function of GAM161 is therefore inhibition of LOC126133 (Accession). Accordingly, utilities of GAM161 include diagnosis, prevention and treatment of diseases and clinical conditions associated with LOC126133.

LOC128077 (Accession) is another GAM161 target gene, herein designated TARGET GENE. LOC128077 BINDING SITE is a target binding site found in the 3' untranslated region of mRNA encoded by LOC128077, corresponding to a target binding site such as BINDING SITE I, BINDING SITE II or BINDING SITE III of FIG. 8. Table 4 illustrates the complementarity of the nucleotide sequences of LOC128077 BINDING SITE, designated SEQ ID:12251, to the nucleotide sequence of GAM161 RNA, herein designated GAM RNA, also designated SEQ ID:304.

Another function of GAM161 is therefore inhibition of LOC128077 (Accession). Accordingly, utilities of GAM161 include diagnosis, prevention and treatment of diseases and clinical conditions associated with LOC128077.

LOC130813 (Accession XM_065904.2) is another GAM161 target gene, herein designated TARGET GENE. LOC130813 BINDING SITE is a target binding site found in the 3' untranslated region of mRNA encoded by LOC130813, corresponding to a target binding site such as BINDING SITE I, BINDING SITE II or BINDING SITE III of FIG. 8. Table 4 illustrates the complementarity of the nucleotide sequences of LOC130813 BINDING SITE, designated SEQ ID:18432, to the nucleotide sequence of GAM161 RNA, herein designated GAM RNA, also designated SEQ ID:304.

Another function of GAM161 is therefore inhibition of LOC130813 (Accession XM_065904.2). Accordingly, utilities of GAM161 include diagnosis, prevention and treatment of diseases and clinical conditions associated with LOC130813.

LOC144317 (Accession XM_084813.4) is another GAM161 target gene, herein designated TARGET GENE. LOC144317 BINDING SITE is a target binding site found in the 5' untranslated region of mRNA encoded by LOC144317, corresponding to a target binding site such as BINDING SITE I, BINDING SITE II or BINDING SITE III of FIG. 8. Table 4 illustrates the complementarity of the nucleotide sequences of LOC144317 BINDING SITE, designated SEQ ID:12865, to the nucleotide sequence of GAM161 RNA, herein designated GAM RNA, also designated SEQ ID:304.

Another function of GAM161 is therefore inhibition of LOC144317 (Accession XM_084813.4). Accordingly, utilities of GAM161 include diagnosis, prevention and treatment of diseases and clinical conditions associated with LOC144317.

LOC146455 (Accession) is another GAM161 target gene, herein designated TARGET GENE. LOC146455 BINDING SITE is a target binding site found in the 3' untranslated region of mRNA encoded by LOC146455, corresponding to a target binding site such as BINDING SITE I, BINDING SITE II or BINDING SITE III of FIG. 8. Table 4 illustrates the complementarity of the nucleotide sequences of LOC146455 BINDING SITE, designated SEQ ID:12181, to the nucleotide sequence of GAM161 RNA, herein designated GAM RNA, also designated SEQ ID:304.

Another function of GAM161 is therefore inhibition of LOC146455 (Accession). Accordingly, utilities of GAM161 include diagnosis, prevention and treatment of diseases and clinical conditions associated with LOC146455.

LOC148137 (Accession NM_144692.1) is another GAM161 target gene, herein designated TARGET GENE. LOC148137 BINDING SITE is a target binding site found in the 3' untranslated region of mRNA encoded by LOC148137, corresponding to a target binding site such as BINDING SITE I, BINDING SITE II or BINDING SITE III of FIG. 8. Table 4 illustrates the complementarity of the nucleotide sequences of LOC148137 BINDING SITE, designated SEQ ID:14101, to the nucleotide sequence of GAM161 RNA, herein designated GAM RNA, also designated SEQ ID:304.

Another function of GAM161 is therefore inhibition of LOC148137 (Accession NM_144692.1). Accordingly, utilities of GAM161 include diagnosis, prevention and treatment of diseases and clinical conditions associated with LOC148137.

LOC151201 (Accession XM_098021.1) is another GAM161 target gene, herein designated TARGET GENE. LOC151201 BINDING SITE is a target binding site found in the 3' untranslated region of mRNA encoded by LOC151201, corresponding to a target binding site such as BINDING SITE I, BINDING SITE II or BINDING SITE III of FIG. 8. Table 4 illustrates the complementarity of the nucleotide sequences of LOC151201 BINDING SITE, designated SEQ ID:19905, to the nucleotide sequence of GAM161 RNA, herein designated GAM RNA, also designated SEQ ID:304.

Another function of GAM161 is therefore inhibition of LOC151201 (Accession XM_098021.1). Accordingly, utilities of GAM161 include diagnosis, prevention and treatment of diseases and clinical conditions associated with LOC151201.

LOC151701 (Accession) is another GAM161 target gene, herein designated TARGET GENE. LOC151701 BINDING SITE is a target binding site found in the 3' untranslated region of mRNA encoded by LOC151701, corresponding to a target binding site such as BINDING SITE I, BINDING SITE II or BINDING SITE III of FIG. 8. Table 4 illustrates the complementarity of the nucleotide sequences of LOC151701 BINDING SITE, designated SEQ ID:2777, to the nucleotide sequence of GAM161 RNA, herein designated GAM RNA, also designated SEQ ID:304.

Another function of GAM161 is therefore inhibition of LOC151701 (Accession). Accordingly, utilities of GAM161 include diagnosis, prevention and treatment of diseases and clinical conditions associated with LOC151701.

LOC152245 (Accession XM_098182.1) is another GAM161 target gene, herein designated TARGET GENE. LOC152245 BINDING SITE is a target binding site found in the 3' untranslated region of mRNA encoded by LOC152245, corresponding to a target binding site such as BINDING SITE I, BINDING SITE II or BINDING SITE III of FIG. 8. Table 4 illustrates the complementarity of the nucleotide sequences of LOC152245 BINDING SITE, designated SEQ ID:6203, to the nucleotide sequence of GAM161 RNA, herein designated GAM RNA, also designated SEQ ID:304.

Another function of GAM161 is therefore inhibition of LOC152245 (Accession XM_098182.1). Accordingly, utilities of GAM161 include diagnosis, prevention and treatment of diseases and clinical conditions associated with LOC152245.

LOC153077 (Accession XM_098307.1) is another GAM161 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:11568, to the nucleotide sequence of GAM161 RNA, herein designated GAM RNA, also designated SEQ ID:304.

Another function of GAM161 is therefore inhibition of LOC153077 (Accession XM_098307.1). Accordingly, utilities of GAM161 include diagnosis, prevention and treatment of diseases and clinical conditions associated with LOC153077.

LOC153688 (Accession) is another GAM161 target gene, herein designated TARGET GENE. LOC153688 BINDING SITE is a target binding site found in the 5' untranslated region of mRNA encoded by LOC153688, corresponding to a target binding site such as BINDING SITE I, BINDING SITE II or BINDING SITE III of FIG. 8. Table 4 illustrates the complementarity of the nucleotide sequences of LOC153688 BINDING SITE, designated SEQ ID:12866, to the nucleotide sequence of GAM161 RNA, herein designated GAM RNA, also designated SEQ ID:304.

Another function of GAM161 is therefore inhibition of LOC153688 (Accession). Accordingly, utilities of GAM161 include diagnosis, prevention and treatment of diseases and clinical conditions associated with LOC153688.

LOC153811 (Accession XM_087779.2) is another GAM161 target gene, herein designated TARGET GENE. LOC153811 BINDING SITE is a target binding site found in the 3' untranslated region of mRNA encoded by LOC153811, corresponding to a target binding site such as BINDING SITE I, BINDING SITE II or BINDING SITE III of FIG. 8. Table 4 illustrates the complementarity of the nucleotide sequences of LOC153811 BINDING SITE, designated SEQ ID:16081, to the nucleotide sequence of GAM161 RNA, herein designated GAM RNA, also designated SEQ ID:304.

Another function of GAM161 is therefore inhibition of LOC153811 (Accession XM_087779.2). Accordingly, utilities of GAM161 include diagnosis, prevention and treatment of diseases and clinical conditions associated with LOC153811.

LOC158310 (Accession XM_098919.1) is another GAM161 target gene, herein designated TARGET GENE. LOC158310 BINDING SITE is a target binding site found in the 5' untranslated region of mRNA encoded by LOC158310, corresponding to a target binding site such as BINDING SITE I, BINDING SITE II or BINDING SITE III of FIG. 8. Table 4 illustrates the complementarity of the nucleotide sequences of LOC158310 BINDING SITE, designated SEQ ID:8794, to the nucleotide sequence of GAM161 RNA, herein designated GAM RNA, also designated SEQ ID:304.

Another function of GAM161 is therefore inhibition of LOC158310 (Accession XM_098919.1). Accordingly, utilities of GAM161 include diagnosis, prevention and treatment of diseases and clinical conditions associated with LOC158310.

LOC196047 (Accession) is another GAM161 target gene, herein designated TARGET GENE. LOC196047 BINDING SITE is a target binding site found in the 5' untranslated region of mRNA encoded by LOC196047, corresponding to a target binding site such as BINDING SITE I, BINDING SITE II or BINDING SITE III of FIG. 8. Table 4 illustrates the complementarity of the nucleotide sequences of LOC196047 BINDING SITE, designated SEQ ID:1349, to the nucleotide sequence of GAM161 RNA, herein designated GAM RNA, also designated SEQ ID:304.

Another function of GAM161 is therefore inhibition of LOC196047 (Accession). Accordingly, utilities of GAM161 include diagnosis, prevention and treatment of diseases and clinical conditions associated with LOC196047.

LOC199786 (Accession) is another GAM161 target gene, herein designated TARGET GENE. LOC199786 BINDING SITE is a target binding site found in the 3' untranslated region of mRNA encoded by LOC199786, corresponding to a target binding site such as BINDING SITE I, BINDING SITE II or BINDING SITE III of FIG. 8. Table 4 illustrates the complementarity of the nucleotide sequences of LOC199786 BINDING SITE, designated SEQ ID:11992, to the nucleotide sequence of GAM161 RNA, herein designated GAM RNA, also designated SEQ ID:304.

Another function of GAM161 is therefore inhibition of LOC199786 (Accession). Accordingly, utilities of GAM161 include diagnosis, prevention and treatment of diseases and clinical conditions associated with LOC199786.

LOC200301 (Accession) is another GAM161 target gene, herein designated TARGET GENE. LOC200301 BINDING SITE is a target binding site found in the 5' untranslated region of mRNA encoded by LOC200301, corresponding to a target binding site such as BINDING SITE I, BINDING SITE II or BINDING SITE III of FIG. 8. Table 4 illustrates the complementarity of the nucleotide sequences of LOC200301 BINDING SITE, designated SEQ ID:15098, to the nucleotide sequence of GAM161 RNA, herein designated GAM RNA, also designated SEQ ID:304.

Another function of GAM161 is therefore inhibition of LOC200301 (Accession). Accordingly, utilities of GAM161 include diagnosis, prevention and treatment of diseases and clinical conditions associated with LOC200301.

LOC200316 (Accession) is another GAM161 target gene, herein designated TARGET GENE. LOC200316 BINDING SITE is a target binding site found in the 3' untranslated region of mRNA encoded by LOC200316, corresponding to a target binding site such as BINDING SITE I, BINDING SITE II or BINDING SITE III of FIG. 8. Table 4 illustrates the complementarity of the nucleotide sequences of LOC200316 BINDING SITE, designated SEQ ID:19042, to the nucleotide sequence of GAM161 RNA, herein designated GAM RNA, also designated SEQ ID:304.

Another function of GAM161 is therefore inhibition of LOC200316 (Accession). Accordingly, utilities of GAM161 include diagnosis, prevention and treatment of diseases and clinical conditions associated with LOC200316.

LOC220575 (Accession) is another GAM161 target gene, herein designated TARGET GENE. LOC220575 BINDING SITE is a target binding site found in the 3' untranslated region of mRNA encoded by LOC220575, corresponding to a target binding site such as BINDING SITE I, BINDING SITE II or BINDING SITE III of FIG. 8. Table 4 illustrates the complementarity of the nucleotide sequences of LOC220575 BINDING SITE, designated SEQ ID:18968, to the nucleotide sequence of GAM161 RNA, herein designated GAM RNA, also designated SEQ ID:304.

Another function of GAM161 is therefore inhibition of LOC220575 (Accession). Accordingly, utilities of GAM161 include diagnosis, prevention and treatment of diseases and clinical conditions associated with LOC220575.

LOC221271 (Accession) is another GAM161 target gene, herein designated TARGET GENE. LOC221271 BINDING SITE is a target binding site found in the 3' untranslated region of mRNA encoded by LOC221271, corresponding to a target binding site such as BINDING SITE I, BINDING SITE II or BINDING SITE III of FIG. 8. Table 4 illustrates the complementarity of the nucleotide sequences of LOC221271 BINDING SITE, designated SEQ ID:6488, to the nucleotide sequence of GAM161 RNA, herein designated GAM RNA, also designated SEQ ID:304.

Another function of GAM161 is therefore inhibition of LOC221271 (Accession). Accordingly, utilities of GAM161 include diagnosis, prevention and treatment of diseases and clinical conditions associated with LOC221271.

LOC245771 (Accession) is another GAM161 target gene, herein designated TARGET GENE. LOC245771 BINDING SITE is a target binding site found in the 5' untranslated region of mRNA encoded by LOC245771, corresponding to a target binding site such as BINDING SITE I, BINDING SITE II or BINDING SITE III of FIG. 8. Table 4 illustrates the complementarity of the nucleotide sequences of LOC245771 BINDING SITE, designated SEQ ID:14795, to the nucleotide sequence of GAM161 RNA, herein designated GAM RNA, also designated SEQ ID:304.

Another function of GAM161 is therefore inhibition of LOC245771 (Accession). Accordingly, utilities of GAM161 include diagnosis, prevention and treatment of diseases and clinical conditions associated with LOC245771.

LOC254082 (Accession) is another GAM161 target gene, herein designated TARGET GENE. LOC254082 BINDING SITE is a target binding site found in the 5' untranslated region of mRNA encoded by LOC254082, corresponding to a target binding site such as BINDING SITE I, BINDING SITE II or BINDING SITE III of FIG. 8. Table 4 illustrates the complementarity of the nucleotide sequences of LOC254082 BINDING SITE, designated SEQ ID:2709, to the nucleotide sequence of GAM161 RNA, herein designated GAM RNA, also designated SEQ ID:304.

Another function of GAM161 is therefore inhibition of LOC254082 (Accession). Accordingly, utilities of GAM161 include diagnosis, prevention and treatment of diseases and clinical conditions associated with LOC254082.

LOC256306 (Accession) is another GAM161 target gene, herein designated TARGET GENE. LOC256306 BINDING SITE is a target binding site found in the 3' untranslated region of mRNA encoded by LOC256306, corresponding to a target binding site such as BINDING SITE I, BINDING SITE II or BINDING SITE III of FIG. 8. Table 4 illustrates the complementarity of the nucleotide sequences of LOC256306 BINDING SITE, designated SEQ ID:19369, to the nucleotide sequence of GAM161 RNA, herein designated GAM RNA, also designated SEQ ID:304.

Another function of GAM161 is therefore inhibition of LOC256306 (Accession). Accordingly, utilities of GAM161 include diagnosis, prevention and treatment of diseases and clinical conditions associated with LOC256306.

LOC51696 (Accession) is another GAM161 target gene, herein designated TARGET GENE. LOC51696 BINDING SITE is a target binding site found in the 3' untranslated region of mRNA encoded by LOC51696, corresponding to a target binding site such as BINDING SITE I, BINDING SITE II or BINDING SITE III of FIG. 8. Table 4 illustrates the complementarity of the nucleotide sequences of LOC51696 BINDING SITE, designated SEQ ID:6670, to the nucleotide sequence of GAM161 RNA, herein designated GAM RNA, also designated SEQ ID:304.

Another function of GAM161 is therefore inhibition of LOC51696 (Accession). Accordingly, utilities of GAM161 include diagnosis, prevention and treatment of diseases and clinical conditions associated with LOC51696.

Mediterranean fever (MEFV, Accession NM_000243.1) is another GAM161 target gene, herein designated TARGET GENE. MEFV BINDING SITE is a target binding site found in the 5' untranslated region of mRNA encoded by MEFV, corresponding to a target binding site such as BINDING SITE I, BINDING SITE II or BINDING SITE III of FIG. 8. Table 4 illustrates the complementarity of the nucleotide sequences of MEFV BINDING SITE, designated SEQ ID:8754, to the nucleotide sequence of GAM161 RNA, herein designated GAM RNA, also designated SEQ ID:304.

Another function of GAM161 is therefore inhibition of Mediterranean fever (MEFV, Accession NM_000243.1). Accordingly, utilities of GAM161 include diagnosis, prevention and treatment of diseases and clinical conditions associated with MEFV.

MGC10818 (Accession NM_030568.2) is another GAM161 target gene, herein designated TARGET GENE. MGC10818 BINDING SITE is a target binding site found in the 3' untranslated region of mRNA encoded by MGC10818, corresponding to a target binding site such as BINDING SITE I, BINDING SITE II or BINDING SITE III of FIG. 8. Table 4 illustrates the complementarity of the nucleotide sequences of MGC10818 BINDING SITE, designated SEQ ID:4141, to the nucleotide sequence of GAM161 RNA, herein designated GAM RNA, also designated SEQ ID:304.

Another function of GAM161 is therefore inhibition of MGC10818 (Accession NM_030568.2). Accordingly, utilities of GAM161 include diagnosis, prevention and treatment of diseases and clinical conditions associated with MGC10818.

MGC13138 (Accession NM_033410.1) is another GAM161 target gene, herein designated TARGET GENE. MGC13138 BINDING SITE is a target binding site found in the 3' untranslated region of mRNA encoded by MGC13138, corresponding to a target binding site such as BINDING SITE I, BINDING SITE II or BINDING SITE III of FIG. 8. Table 4 illustrates the complementarity of the nucleotide sequences of MGC13138 BINDING SITE, designated SEQ ID:5265, to the nucleotide sequence of GAM161 RNA, herein designated GAM RNA, also designated SEQ ID:304.

Another function of GAM161 is therefore inhibition of MGC13138 (Accession NM_033410.1). Accordingly, utilities of GAM161 include diagnosis, prevention and treatment of diseases and clinical conditions associated with MGC13138.

MGC29891 (Accession NM_144618.1) is another GAM161 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:19764, to the nucleotide sequence of GAM161 RNA, herein designated GAM RNA, also designated SEQ ID:304.

Another function of GAM161 is therefore inhibition of MGC29891 (Accession NM_144618.1). Accordingly, utilities of GAM161 include diagnosis, prevention and treatment of diseases and clinical conditions associated with MGC29891.

Matrix metalloproteinase-like 1 (MMPL1, Accession) is another GAM161 target gene, herein designated TARGET GENE. MMPL1 BINDING SITE is a target binding site found in the 3' untranslated region of mRNA encoded by MMPL1, corresponding to a target binding site such as BINDING SITE I, BINDING SITE II or BINDING SITE III of FIG. 8. Table 4 illustrates the complementarity of the nucleotide sequences of MMPL1 BINDING SITE, designated SEQ ID:11792, to the nucleotide sequence of GAM161 RNA, herein designated GAM RNA, also designated SEQ ID:304.

Another function of GAM161 is therefore inhibition of Matrix metalloproteinase-like 1 (MMPL1, Accession). Accordingly, utilities of GAM161 include diagnosis, prevention and treatment of diseases and clinical conditions associated with MMPL1.

Mitochondrial ribosomal protein l44 (MRPL44, Accession NM_022915.2) is another GAM161 target gene, herein designated TARGET GENE. MRPL44 BINDING SITE is a target binding site found in the 3' untranslated region of mRNA encoded by MRPL44, corresponding to a target binding site such as BINDING SITE I, BINDING SITE II or BINDING SITE III of FIG. 8. Table 4 illustrates the complementarity of the nucleotide sequences of MRPL44 BINDING SITE, designated SEQ ID:17368, to the nucleotide sequence of GAM161 RNA, herein designated GAM RNA, also designated SEQ ID:304.

Another function of GAM161 is therefore inhibition of Mitochondrial ribosomal protein l44 (MRPL44, Accession NM_022915.2). Accordingly, utilities of GAM161 include diagnosis, prevention and treatment of diseases and clinical conditions associated with MRPL44.

V-myc myelocytomatosis viral oncogene homolog 2 (avian) (MYCL2, Accession NM_005377.1) is another GAM161 target gene, herein designated TARGET GENE. MYCL2 BINDING SITE is a target binding site found in the 3' untranslated region of mRNA encoded by MYCL2, corresponding to a target binding site such as BINDING SITE I, BINDING SITE II or BINDING SITE III of FIG. 8. Table 4 illustrates the complementarity of the nucleotide sequences of MYCL2 BINDING SITE, designated SEQ ID:8793, to the nucleotide sequence of GAM161 RNA, herein designated GAM RNA, also designated SEQ ID:304.

Another function of GAM161 is therefore inhibition of V-myc myelocytomatosis viral oncogene homolog 2 (avian) (MYCL2, Accession NM_005377.1). Accordingly, utilities of GAM161 include diagnosis, prevention and treatment of diseases and clinical conditions associated with MYCL2.

Nuclear receptor coactivator 6 (NCOA6, Accession NM_014071.1) is another GAM161 target gene, herein designated TARGET GENE. NCOA6 BINDING SITE is a target binding site found in the 5' untranslated region of mRNA encoded by NCOA6, corresponding to a target binding site such as BINDING SITE I, BINDING SITE II or BINDING SITE III of FIG. 8. Table 4 illustrates the complementarity of the nucleotide sequences of NCOA6 BINDING SITE, designated SEQ ID:19170, to the nucleotide sequence of GAM161 RNA, herein designated GAM RNA, also designated SEQ ID:304.

Another function of GAM161 is therefore inhibition of Nuclear receptor coactivator 6 (NCOA6, Accession NM_014071.1), a gene which activates gene transcription through ligand-dependent association with coactivators. and therefore may be associated with Breast cancer. Accordingly, utilities of GAM161 include diagnosis, prevention and treatment of Breast cancer, and of other diseases and clinical conditions associated with NCOA6.

The function of NCOA6 has been established by previous studies. Using the ligand-binding domain of the retinoid X receptor as bait in a yeast 2-hybrid screen to identify potential transcriptional coactivators of nuclear receptors, Lee et al. (1999) isolated a cDNA encoding a nuclear protein-activating signal cointegrator, which they designated ASC2. Sequence analysis of the 2,063 amino acid protein predicted an N-terminal acidic domain, 2 glutamine-rich domains, and a C-terminal serine/threonine-rich domain as well as 2 separate basic potential nuclear localization signal domains and 2 copies of LXXLL motifs that function in ligand-dependent interaction with the AF2 domain of nuclear receptors. Analyzing tissue microarrays by FISH, Lee et al. (1999) found increased ASC2 copy number in 10% of breast cancer specimens and in all breast cancer cell lines. SDS-PAGE analysis showed that amino acids 586-860, which do not include the LXXLL motifs, are the minimum interaction domain with the AF2 domain of numerous nuclear receptors. N-terminal subregions of ASC2, either alone or in conjunction with CBP (OMIM Ref. No. 600140) and SRC1 (NCOA1; 602691), stimulate ligand-dependent transactivation by wildtype nuclear receptors. Microinjection of anti-ASC2 into cells demonstrated abrogation of the transactivation function. Caira et al. (2000) and Mahajan and Samuels (2000) isolated cDNAs encoding a protein identical to ASC2, which they termed nuclear receptor-activating protein 250 kD (OMIM Ref. No. RAP250) and nuclear receptor coregulator (NRC), respectively. Northern blot analysis revealed widespread expression of an approximately 7.5-kb transcript, with a 4.5-kb splice variant detected in testis. Analysis of the testis sequence indicated that it encodes a 1,070 amino acid protein that lacks residues 972-1964 of the full-length sequence (Caira et al., 2000). ASC2 was also found to be widely expressed during ontogeny in rat embryos. Using GST pull-down assay, Caira et al. (2000) determined that the first LXXLL motif (LVNLL, contained in residues 819-1096) but not the second (LSQLL, residues 1491-1495) interacted strongly with nuclear receptors. Mahajan and Samuels (2000) also found that only the first LXXLL domain is functional and that mutation of this sequence abolished transcriptional enhancement.

Full details of the abovementioned studies are described in the following publications, the disclosure of which are hereby incorporated by reference:

Lee, S.-K.; Anzick, S. L.; Choi, J.-E.; Bubendorf, L.; Guan, X.-Y.; Jung, Y.-K.; Kallioniemi, O. P.; Kononen, J.; Trent, J. M.; Azorsa, D.; Jhun, B.-H.; Cheong, J. H.; Lee, Y. C.; Meltzer, P. S.; Lee, J. W.: A nuclear factor, ASC-2, as a cancer-amplified transcriptional coactivator essential for ligand-dependent transactivation by nuclear receptors in vivo. J. Biol. Chem. 274:34283-34293, 1999; and Mahajan, M. A.; Samuels, H. H: A new family of nuclear receptor coregulators that integrate nuclear receptor signaling through CREB-binding protein. Molec. Cell. Biol. 20:5048-5063.

Further studies establishing the function and utilities of NCOA6 are found in John Hopkins OMIM database record ID 605299, and in cited publications listed in Table 5, which are hereby incorporated by reference. Nuclear receptor coactivator 6 interacting protein (NCOA6IP, Accession NM_024831.5) is another GAM161 target gene, herein designated TARGET GENE. NCOA6IP BINDING SITE is a target binding site found in the 3' untranslated region of mRNA encoded by NCOA6IP, corresponding to a target binding site such as BINDING SITE I, BINDING SITE II or BINDING SITE III of FIG. 8. Table 4 illustrates the complementarity of the nucleotide sequences of NCOA6IP BINDING SITE, designated SEQ ID:4013, to the nucleotide sequence of GAM161 RNA, herein designated GAM RNA, also designated SEQ ID:304.

Another function of GAM161 is therefore inhibition of Nuclear receptor coactivator 6 interacting protein (NCOA6IP, Accession NM_024831.5). Accordingly, utilities of GAM161 include diagnosis, prevention and treatment of diseases and clinical conditions associated with NCOA6IP.

Oral-facial-digital syndrome 1 (OFD1, Accession NM_003611.1) is another GAM161 target gene, herein designated TARGET GENE. OFD1 BINDING SITE is a target binding site found in the 5' untranslated region of mRNA encoded by OFD1, corresponding to a target binding site such as BINDING SITE I, BINDING SITE II or BINDING SITE III of FIG. 8. Table 4 illustrates the complementarity of the nucleotide sequences of OFD1 BINDING SITE, designated SEQ ID:10775, to the nucleotide sequence of GAM161 RNA, herein designated GAM RNA, also designated SEQ ID:304.

Another function of GAM161 is therefore inhibition of Oral-facial-digital syndrome 1 (OFD1, Accession NM_003611.1). Accordingly, utilities of GAM161 include diagnosis, prevention and treatment of diseases and clinical conditions associated with OFD1.

Phosducin-like (PDCL, Accession NM_005388.2) is another GAM161 target gene, herein designated TARGET GENE. PDCL BINDING SITE is a target binding site found in the 3' untranslated region of mRNA encoded by PDCL, corresponding to a target binding site such as BINDING SITE I, BINDING SITE II or BINDING SITE III of FIG. 8. Table 4 illustrates the complementarity of the nucleotide sequences of PDCL BINDING SITE, designated SEQ ID:848, to the nucleotide sequence of GAM161 RNA, herein designated GAM RNA, also designated SEQ ID:304.

Another function of GAM161 is therefore inhibition of Phosducin-like (PDCL, Accession NM_005388.2), a gene which may regulate G-protein signaling and similar to phosducins. Accordingly, utilities of GAM161 include diagnosis, prevention and treatment of diseases and clinical conditions associated with PDCL.

The function of PDCL and its association with various diseases and clinical conditions, has been established by previous studies, as described hereinabove with reference to GAM30.1. Phosphodiesterase 6b, cgmp-specific, rod, beta (congenital stationary night blindness 3, autosomal dominant) (PDE6B, Accession NM_000283.1) is another GAM161 target gene, herein designated TARGET GENE. PDE6B BINDING SITE is a target binding site found in the 3' untranslated region of mRNA encoded by PDE6B, corresponding to a target binding site such as BINDING SITE I, BINDING SITE II or BINDING SITE III of FIG. 8. Table 4 illustrates the complementarity of the nucleotide sequences of PDE6B BINDING SITE, designated SEQ ID:16553, to the nucleotide sequence of GAM161 RNA, herein designated GAM RNA, also designated SEQ ID:304.

Another function of GAM161 is therefore inhibition of Phosphodiesterase 6b, cgmp-specific, rod, beta (congenital stationary night blindness 3, autosomal dominant) (PDE6B, Accession NM_000283.1). Accordingly, utilities of GAM161 include diagnosis, prevention and treatment of diseases and clinical conditions associated with PDE6B.

Polymeric immunoglobulin receptor (PIGR, Accession NM_002644.1) is another GAM161 target gene, herein designated TARGET GENE. PIGR BINDING SITE is a target binding site found in the 3' untranslated region of mRNA encoded by PIGR, corresponding to a target binding site such as BINDING SITE I, BINDING SITE II or BINDING SITE III of FIG. 8. Table 4 illustrates the complementarity of the nucleotide sequences of PIGR BINDING SITE, designated SEQ ID:3992, to the nucleotide sequence of GAM161 RNA, herein designated GAM RNA, also designated SEQ ID:304.

Another function of GAM161 is therefore inhibition of Polymeric immunoglobulin receptor (PIGR, Accession NM_002644.1). Accordingly, utilities of GAM161 include diagnosis, prevention and treatment of diseases and clinical conditions associated with PIGR.

Peptidylprolyl isomerase d (cyclophilin d) (PPID, Accession NM_005038.1) is another GAM161 target gene, herein designated TARGET GENE. PPID BINDING SITE is a target binding site found in the 5' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:9646, to the nucleotide sequence of GAM161 RNA, herein designated GAM RNA, also designated SEQ ID:304.

Another function of GAM161 is therefore inhibition of Peptidylprolyl isomerase d (cyclophilin d) (PPID, Accession NM_005038.1), a gene which catalyzes the cis-trans isomerization of proline imidic peptide bonds in oligopeptides. Accordingly, utilities of GAM161 include diagnosis, prevention and treatment of diseases and clinical conditions associated with PPID.

The function of PPID and its association with various diseases and clinical conditions, has been established by previous studies, as described hereinabove with reference to GAM136.1. Protein kinase, interferon-inducible double stranded rna dependent (PRKR, Accession NM_002759.1) is another GAM161 target gene, herein designated TARGET GENE. PRKR BINDING SITE is a target binding site found in the 3' untranslated region of mRNA encoded by PRKR, corresponding to a target binding site such as BINDING SITE I, BINDING SITE II or BINDING SITE III of FIG. 8. Table 4 illustrates the complementarity of the nucleotide sequences of PRKR BINDING SITE, designated SEQ ID:5680, to the nucleotide sequence of GAM161 RNA, herein designated GAM RNA, also designated SEQ ID:304.

Another function of GAM161 is therefore inhibition of Protein kinase, interferon-inducible double stranded rna dependent (PRKR, Accession NM_002759.1), a gene which catalyze the phosphorylation of the alpha subunit of eif2. and therefore may be associated with Huntington's disease. Accordingly, utilities of GAM161 include diagnosis, prevention and treatment of Huntington's disease, and of other diseases and clinical conditions associated with PRKR.

The function of PRKR and its association with various diseases and clinical conditions, has been established by previous studies, as described hereinabove with reference to GAM136.1. PRO0902 (Accession NM_053057.2) is another GAM161 target gene, herein designated TARGET GENE. PRO0902 BINDING SITE is a target binding site found in the 5' untranslated region of mRNA encoded by PRO0902, corresponding to a target binding site such as BINDING SITE I, BINDING SITE II or BINDING SITE III of FIG. 8. Table 4 illustrates the complementarity of the nucleotide sequences of PRO0902 BINDING SITE, designated SEQ ID:6546, to the nucleotide sequence of GAM161 RNA, herein designated GAM RNA, also designated SEQ ID:304.

Another function of GAM161 is therefore inhibition of PRO0902 (Accession NM_053057.2). Accordingly, utilities of GAM161 include diagnosis, prevention and treatment of diseases and clinical conditions associated with PRO0902.

Rab39, member ras oncogene family (RAB39, Accession XM_084662.2) is another GAM161 target gene, herein designated TARGET GENE. RAB39 BINDING SITE is a target binding site found in the 5' untranslated region of mRNA encoded by RAB39, corresponding to a target binding site such as BINDING SITE I, BINDING SITE II or BINDING SITE III of FIG. 8. Table 4 illustrates the complementarity of the nucleotide sequences of RAB39 BINDING SITE, designated SEQ ID:10258, to the nucleotide sequence of GAM161 RNA, herein designated GAM RNA, also designated SEQ ID:304.

Another function of GAM161 is therefore inhibition of Rab39, member ras oncogene family (RAB39, Accession XM_084662.2). Accordingly, utilities of GAM161 include diagnosis, prevention and treatment of diseases and clinical conditions associated with RAB39.

RAP140 (Accession NM_015224.1) is another GAM161 target gene, herein designated TARGET GENE. RAP140

BINDING SITE is a target binding site found in the 3' untranslated region of mRNA encoded by RAP140, corresponding to a target binding site such as BINDING SITE I, BINDING SITE II or BINDING SITE III of FIG. 8. Table 4 illustrates the complementarity of the nucleotide sequences of RAP140 BINDING SITE, designated SEQ ID:2756, to the nucleotide sequence of GAM161 RNA, herein designated GAM RNA, also designated SEQ ID:304.

Another function of GAM161 is therefore inhibition of RAP140 (Accession NM_015224.1). Accordingly, utilities of GAM161 include diagnosis, prevention and treatment of diseases and clinical conditions associated with RAP140.

Rhesus blood group, d antigen (RHD, Accession NM_016225.2) is another GAM161 target gene, herein designated TARGET GENE. RHD BINDING SITE is a target binding site found in the 3' untranslated region of multiple transcripts of mRNA encoded by RHD, corresponding to a target binding site such as BINDING SITE I, BINDING SITE II or BINDING SITE III of FIG. 8. Table 4 illustrates the complementarity of the nucleotide sequences of RHD BINDING SITE, designated SEQ ID:10256, to the nucleotide sequence of GAM161 RNA, herein designated GAM RNA, also designated SEQ ID:304.

Another function of GAM161 is therefore inhibition of Rhesus blood group, d antigen (RHD, Accession NM_016225.2), a gene which Major antigen of the RH system. Accordingly, utilities of GAM161 include diagnosis, prevention and treatment of diseases and clinical conditions associated with RHD.

The function of RHD has been established by previous studies. Bennett et al. (1993) demonstrated that DNA testing can be used to determine RhD type in chorionic villus samples or amniotic cells. An RhD-negative woman whose partner is heterozygous may have preexisting anti-RhD antibodies that may or may not affect a subsequent fetus, depending on whether it is heterozygous. A safe method of determining fetal RhD type early in pregnancy would eliminate the risks to an RhD-negative fetus of fetal blood sampling or Ser. amnioceteses. Levine et al. (1941) showed that hemolytic disease of the fetus occurs in an RhD-positive fetus carried by an RhD-negative woman who has been immunized by transplacental passage of RhD-positive red cells during a previous pregnancy. When the father of the fetus being carried by a sensitized RhD- negative woman is heterozygous for RhD, as more than 50% of people are, half the fetuses will be RhD-negative and therefore require no treatment to avoid erythroblastosis fetalis. The others will be RhD-positive and require sophisticated investigative measures and treatments. Lo et al. (1998) described a noninvasive method of determining fetal RhD status by analyzing maternal plasma. Using a fluorescent- based PCR assay that was sensitive enough to detect the amount of RhD DNA found in a single cell, they determined the RhD status of singleton fetuses from 57 RhD- negative women whose partners were heterozygous for the RhD gene. This method correctly identified the RhD status of 10 of 12 fetuses whose mothers were in their first trimester of pregnancy, that of all 30 fetuses whose mothers were in their second trimester, and that of all 15 fetuses whose mothers were in their third trimester. The method they described was rapid, providing results within 1 day, and represented a major advance in RhD genotyping.

Full details of the abovementioned studies are described in the following publications, the disclosure of which are hereby incorporated by reference:

Bennett, P. R.; Le Van Kim, C.; Colin, Y.; Warwick, R. M.; Cherif-Zahar, B.; Fisk, N. M.; Cartron, J.-P.: Prenatal determination of fetal RhD type by DNA amplification. New Eng. J. Med. 329:607-610, 1993; and Lo, Y. M. D.; Hjelm, N. M.; Fidler, C.; Sargent, I. L.; Murphy, M. F.; Chamberlain, P. F.; Poon, P. M. K.; Redman, C. W. G.; Wainscoat, J. S.: Prenatal diagnosis of fetal RhD status by mol.

Further studies establishing the function and utilities of RHD are found in John Hopkins OMIM database record ID 111680, and in cited publications listed in Table 5, which are hereby incorporated by reference. Sh3-domain binding protein 2 (SH3BP2, Accession NM_003023.2) is another GAM161 target gene, herein designated TARGET GENE. SH3BP2 BINDING SITE is a target binding site found in the 5' untranslated region of mRNA encoded by SH3BP2, corresponding to a target binding site such as BINDING SITE I, BINDING SITE II or BINDING SITE III of FIG. 8. Table 4 illustrates the complementarity of the nucleotide sequences of SH3BP2 BINDING SITE, designated SEQ ID:12256, to the nucleotide sequence of GAM161 RNA, herein designated GAM RNA, also designated SEQ ID:304.

Another function of GAM161 is therefore inhibition of Sh3-domain binding protein 2 (SH3BP2, Accession NM_003023.2). Accordingly, utilities of GAM161 include diagnosis, prevention and treatment of diseases and clinical conditions associated with SH3BP2.

Short stature homeobox (SHOX, Accession) is another GAM161 target gene, herein designated TARGET GENE. SHOX BINDING SITE is a target binding site found in the 3' untranslated region of multiple transcripts of mRNA encoded by SHOX, corresponding to a target binding site such as BINDING SITE I, BINDING SITE II or BINDING SITE III of FIG. 8. Table 4 illustrates the complementarity of the nucleotide sequences of SHOX BINDING SITE, designated SEQ ID:4418, to the nucleotide sequence of GAM161 RNA, herein designated GAM RNA, also designated SEQ ID:304.

Another function of GAM161 is therefore inhibition of Short stature homeobox (SHOX, Accession). Accordingly, utilities of GAM161 include diagnosis, prevention and treatment of diseases and clinical conditions associated with SHOX.

Synaptosomal-associated protein, 23 kda (SNAP23, Accession NM_003825.2) is another GAM161 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:5601, to the nucleotide sequence of GAM161 RNA, herein designated GAM RNA, also designated SEQ ID:304.

Another function of GAM161 is therefore inhibition of Synaptosomal-associated protein, 23 kda (SNAP23, Accession NM_003825.2), a gene which is essential component of the high affinity receptor for the general membrane fusion machinery. Accordingly, utilities of GAM161 include diagnosis, prevention and treatment of diseases and clinical conditions associated with SNAP23.

The function of SNAP23 and its association with various diseases and clinical conditions, has been established by previous studies, as described hereinabove with reference to GAM30.1. Sorting nexin 15 (SNX15, Accession NM_013306.2) is another GAM161 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:19041, to the nucleotide sequence of GAM161 RNA, herein designated GAM RNA, also designated SEQ ID:304.

Another function of GAM161 is therefore inhibition of Sorting nexin 15 (SNX15, Accession NM_013306.2). Accordingly, utilities of GAM161 include diagnosis, prevention and treatment of diseases and clinical conditions associated with SNX15.

STAF65(gamma) (Accession NM_014860.1) is another GAM161 target gene, herein designated TARGET GENE. STAF65(gamma) BINDING SITE is a target binding site found in the 3' untranslated region of mRNA encoded by STAF65(gamma), corresponding to a target binding site such as BINDING SITE I, BINDING SITE II or BINDING SITE III of FIG. 8. Table 4 illustrates the complementarity of the nucleotide sequences of STAF65(gamma) BINDING SITE, designated SEQ ID:18839, to the nucleotide sequence of GAM161 RNA, herein designated GAM RNA, also designated SEQ ID:304.

Another function of GAM161 is therefore inhibition of STAF65(gamma) (Accession NM_014860.1). Accordingly, utilities of GAM161 include diagnosis, prevention and treatment of diseases and clinical conditions associated with STAF65(gamma).

Tap binding protein (tapasin) (TAPBP, Accession NM_003190.3) is another GAM161 target gene, herein designated TARGET GENE. TAPBP BINDING SITE is a target binding site found in the 5' untranslated region of multiple transcripts of mRNA encoded by TAPBP, corresponding to a target binding site such as BINDING SITE I, BINDING SITE II or BINDING SITE III of FIG. 8. Table 4 illustrates the complementarity of the nucleotide sequences of TAPBP BINDING SITE, designated SEQ ID:9641, to the nucleotide sequence of GAM161 RNA, herein designated GAM RNA, also designated SEQ ID:304.

Another function of GAM161 is therefore inhibition of Tap binding protein (tapasin) (TAPBP, Accession NM_003190.3), a gene which is involved in MHC class I-restricted antigen processing. Accordingly, utilities of GAM161 include diagnosis, prevention and treatment of diseases and clinical conditions associated with TAPBP.

The function of TAPBP and its association with various diseases and clinical conditions, has been established by previous studies, as described hereinabove with reference to GAM136.1. Transcription factor 2, hepatic; lf-b3; variant hepatic nuclear factor (TCF2, Accession NM_000458.1) is another GAM161 target gene, herein designated TARGET GENE. TCF2 BINDING SITE is a target binding site found in the 3' untranslated region of multiple transcripts of mRNA encoded by TCF2, corresponding to a target binding site such as BINDING SITE I, BINDING SITE II or BINDING SITE III of FIG. 8. Table 4 illustrates the complementarity of the nucleotide sequences of TCF2 BINDING SITE, designated SEQ ID:4621, to the nucleotide sequence of GAM161 RNA, herein designated GAM RNA, also designated SEQ ID:304.

Another function of GAM161 is therefore inhibition of Transcription factor 2, hepatic; lf-b3; variant hepatic nuclear factor (TCF2, Accession NM_000458.1), a gene which probably binds to the inverted palindrome 5'-gttaatnattaac-3'. and therefore is associated with Maturity-onset diabetes of the young type 5 (mody5), familial hypoplastic glomerulocystic kidney disease (gckd). Accordingly, utilities of GAM161 include diagnosis, prevention and treatment of Maturity-onset diabetes of the young type 5 (mody5), familial hypoplastic glomerulocystic kidney disease (gckd), and of other diseases and clinical conditions associated with TCF2.

The function of TCF2 and its association with various diseases and clinical conditions, has been established by previous studies, as described hereinabove with reference to GAM144.1. Teratocarcinoma-derived growth factor 1 (TDGF1, Accession NM_003212.1) is another GAM161 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:2312, to the nucleotide sequence of GAM161 RNA, herein designated GAM RNA, also designated SEQ ID:304.

Another function of GAM161 is therefore inhibition of Teratocarcinoma-derived growth factor 1 (TDGF1, Accession NM_003212.1), a gene which can play a role in the determination of the epiblastic cells that subsequently give rise to the mesoderm. and therefore may be associated with Forebrain defects. Accordingly, utilities of GAM161 include diagnosis, prevention and treatment of Forebrain defects, and of other diseases and clinical conditions associated with TDGF1.

The function of TDGF1 and its association with various diseases and clinical conditions, has been established by previous studies, as described hereinabove with reference to GAM30.1. Tgfb-induced factor 2 (tale family homeobox) (TGIF2, Accession NM_021809.2) is another GAM161 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:14237, to the nucleotide sequence of GAM161 RNA, herein designated GAM RNA, also designated SEQ ID:304.

Another function of GAM161 is therefore inhibition of Tgfb-induced factor 2 (tale family homeobox) (TGIF2, Accession NM_021809.2). Accordingly, utilities of GAM161 include diagnosis, prevention and treatment of diseases and clinical conditions associated with TGIF2.

Tnf receptor-associated factor 5 (TRAF5, Accession NM_004619.2) is another GAM161 target gene, herein designated TARGET GENE. TRAF5 BINDING SITE is a target binding site found in the 5' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:1063, to the nucleotide sequence of GAM161 RNA, herein designated GAM RNA, also designated SEQ ID:304.

Another function of GAM161 is therefore inhibition of Tnf receptor-associated factor 5 (TRAF5, Accession NM_004619.2), a gene which Member of a family of proteins that interact with TNF receptors; binds the lymphotoxin beta receptor (LTBR). Accordingly, utilities of GAM161 include diagnosis, prevention and treatment of diseases and clinical conditions associated with TRAF5.

The function of TRAF5 and its association with various diseases and clinical conditions, has been established by previous studies, as described hereinabove with reference to GAM69.2. Transient receptor potential cation channel, subfamily m, member 6 (TRPM6, Accession NM_017662.3) is another GAM161 target gene, herein designated TARGET GENE. TRPM6 BINDING SITE is a target binding site found in the 3' untranslated region of mRNA encoded by TRPM6, corresponding to a target binding site such as BINDING SITE I, BINDING SITE II or BINDING SITE III of FIG. 8. Table 4 illustrates the complementarity of the nucleotide sequences of TRPM6 BINDING SITE, designated SEQ ID:12681, to the nucleotide sequence of GAM161 RNA, herein designated GAM RNA, also designated SEQ ID:304.

Another function of GAM161 is therefore inhibition of Transient receptor potential cation channel, subfamily m, member 6 (TRPM6, Accession NM_017662.3), a gene which contains a predicted ion channel domain and a protein kinase domain. and therefore is associated with Hypomagnesemia with secondary hypocalcemia. Accordingly, utilities of GAM161 include diagnosis, prevention and treatment of Hypomagnesemia with secondary hypocalcemia, and of other diseases and clinical conditions associated with TRPM6.

The function of TRPM6 and its association with various diseases and clinical conditions, has been established by previous studies, as described hereinabove with reference to GAM130.1. Vent-like homeobox 2 (VENTX2, Accession NM_014468.1) is another GAM161 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:17401, to the nucleotide sequence of GAM161 RNA, herein designated GAM RNA, also designated SEQ ID:304.

Another function of GAM161 is therefore inhibition of Vent-like homeobox 2 (VENTX2, Accession NM_014468.1). Accordingly, utilities of GAM161 include diagnosis, prevention and treatment of diseases and clinical conditions associated with VENTX2.

Wolf-hirschhorn syndrome candidate 1 (WHSC1, Accession NM_133332.1) is another GAM161 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:18202, to the nucleotide sequence of GAM161 RNA, herein designated GAM RNA, also designated SEQ ID:304.

Another function of GAM161 is therefore inhibition of Wolf-hirschhorn syndrome candidate 1 (WHSC1, Accession NM_133332.1), a gene which binds covalently to and repairs g/t mismatches. and therefore may be associated with Wolf-hirschhorn syndrome. Accordingly, utilities of GAM161 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Zinc finger protein 253 (ZNF253, Accession NM_021047.1) is another GAM161 target gene, herein designated TARGET GENE. ZNF253 BINDING SITE is a target binding site found in the 3' untranslated region of mRNA encoded by ZNF253, corresponding to a target binding site such as BINDING SITE I, BINDING SITE II or BINDING SITE III of FIG. 8. Table 4 illustrates the complementarity of the nucleotide sequences of ZNF253 BINDING SITE, designated SEQ ID:12566, to the nucleotide sequence of GAM161 RNA, herein designated GAM RNA, also designated SEQ ID:304.

Another function of GAM161 is therefore inhibition of Zinc finger protein 253 (ZNF253, Accession NM_021047.1). Accordingly, utilities of GAM161 include diagnosis, prevention and treatment of diseases and clinical conditions associated with ZNF253.

FIG. 8 further provides a conceptual description of a novel bioinformatically detected of the present invention, referred to here as Genomic Address Messenger 162 (GAM162), which modulates expression of respective target genes thereof, the function and utility of which target genes is known in the art.

GAM162 is a novel bioinformatically detected regulatory, non protein coding, micro RNA (miRNA) gene. The method by which GAM162 was detected is described hereinabove with reference to FIGS. 8-15.

GAM162 gene, herein designated GAM GENE, and GAM162 target gene, herein designated TARGET GENE, are human genes contained in the human genome.

GAM162 gene encodes a GAM162 precursor RNA, herein designated GAM PRECURSOR RNA. Similar to other miRNA genes, and unlike most ordinary genes, GAM162 precursor RNA does not encode a protein. A nucleotide sequence identical or highly similar to the nucleotide sequence of GAM162 precursor RNA is designated SEQ ID:58, and is provided hereinbelow with reference to the sequence listing part. Nucleotide sequence SEQ ID:58 is located at position 76562126 relative to chromosome 17.

GAM162 precursor RNA folds onto itself, forming GAM162 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM162 precursor RNA folds onto itself, forming GAM162 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM162 precursor RNA, designated SEQ-ID:58, and a schematic representation of a predicted secondary folding of GAM162 folded precursor RNA are further described with reference to Table 2, hereby incorporated by reference.

An enzyme complex designated DICER COMPLEX, 'dices' the GAM162 folded precursor RNA into GAM162 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM162 RNA is designated SEQ ID:376, and is provided hereinbelow with references to the sequence listing part and Table 3, hereby incorporated by reference.

GAM162 target gene, herein designated TARGET GENE, encodes a corresponding messenger RNA, GAM162 target RNA, herein designated GAM TARGET RNA. GAM162 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM162 RNA, herein designated GAM RNA, binds complementarily to one or more target binding sites located in untranslated regions of GAM162 target RNA, herein designated GAM TARGET RNA. This complementary binding is due to the fact that the nucleotide sequence of GAM162 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM162 RNA may have a different number of target binding sites in untranslated regions of a GAM162 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM162 RNA, herein designated GAM RNA, to target binding sites on GAM162 target RNA, herein designated GAM TARGET RNA, such as BINDING SITE I, BINDING SITE II and BINDING SITE III, inhibits translation of GAM162 target RNA into GAM162 target protein, herein designated GAM TARGET PROTEIN. GAM target protein is therefore outlined by a broken line.

It is appreciated that GAM162 target gene, herein designated TARGET GENE, in fact represents a plurality of GAM162 target genes. The mRNA of each one of this plurality of GAM162 target genes comprises one or more target binding sites, each having a nucleotide sequence which is at least partly complementary to GAM162 RNA, herein designated GAM RNA, and which when bound by GAM162 RNA causes inhibition of translation of respective one or more GAM162 target proteins.

It is further appreciated by one skilled in the art that the mode of translational inhibition illustrated by FIG. 8 with specific reference to translational inhibition exerted by GAM162 gene, herein designated GAM GENE, on one or more GAM162 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM162 correlate with, and may be deduced from, the identity of the target genes which GAM162 binds and inhibits, and the function of these target genes, as elaborated hereinbelow.

KIAA1582 (Accession XM_037262.4) is a GAM162 target gene, herein designated TARGET GENE. KIAA1582 BINDING SITE is a target binding site found in the 5' untranslated region of mRNA encoded by KIAA1582, corresponding to a target binding site such as BINDING SITE I, BINDING SITE II or BINDING SITE III of FIG. 8. Table 4 illustrates the complementarity of the nucleotide sequences of KIAA1582 BINDING SITE, designated SEQ ID:12216, to the nucleotide sequence of GAM162 RNA, herein designated GAM RNA, also designated SEQ ID:376.

A function of GAM162 is therefore inhibition of KIAA1582 (Accession XM_037262.4). Accordingly, utilities of GAM162 include diagnosis, prevention and treatment of diseases and clinical conditions associated with KIAA1582.

VRP (Accession NM_007063.1) is another GAM162 target gene, herein designated TARGET GENE. VRP BINDING SITE is a target binding site found in the 3' untranslated region of mRNA encoded by VRP, corresponding to a target binding site such as BINDING SITE I, BINDING SITE II or BINDING SITE III of FIG. 8. Table 4 illustrates the complementarity of the nucleotide sequences of VRP BINDING SITE, designated SEQ ID:11972, to the nucleotide sequence of GAM162 RNA, herein designated GAM RNA, also designated SEQ ID:376.

Another function of GAM162 is therefore inhibition of VRP (Accession NM_007063.1). Accordingly, utilities of GAM162 include diagnosis, prevention and treatment of diseases and clinical conditions associated with VRP.

FIG. 8 further provides a conceptual description of a novel bioinformatically detected of the present invention, referred to here as Genomic Address Messenger 163 (GAM163), which modulates expression of respective target genes thereof, the function and utility of which target genes is known in the art.

GAM163 is a novel bioinformatically detected regulatory, non protein coding, micro RNA (miRNA) gene. The method by which GAM163 was detected is described hereinabove with reference to FIGS. 8-15.

GAM163 gene, herein designated GAM GENE, and GAM163 target gene, herein designated TARGET GENE, are human genes contained in the human genome.

GAM163 gene encodes a GAM163 precursor RNA, herein designated GAM PRECURSOR RNA. Similar to other miRNA genes, and unlike most ordinary genes, GAM163 precursor RNA does not encode a protein. A nucleotide sequence identical or highly similar to the nucleotide sequence of GAM163 precursor RNA is designated SEQ ID:84, and is provided hereinbelow with reference to the sequence listing part.

GAM163 precursor RNA folds onto itself, forming GAM163 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM163 precursor RNA folds onto itself, forming GAM163 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM163 precursor RNA, designated SEQ-ID:84, and a schematic representation of a predicted secondary folding of GAM163 folded precursor RNA are further described with reference to Table 2, hereby incorporated by reference.

An enzyme complex designated DICER COMPLEX, 'dices' the GAM163 folded precursor RNA into GAM163 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM163 RNA is designated SEQ ID:249, and is provided hereinbelow with references to the sequence listing part and Table 3, hereby incorporated by reference.

GAM163 target gene, herein designated TARGET GENE, encodes a corresponding messenger RNA, GAM163 target RNA, herein designated GAM TARGET RNA. GAM163 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM163 RNA, herein designated GAM RNA, binds complementarily to one or more target binding sites located in untranslated regions of GAM163 target RNA, herein designated GAM TARGET RNA. This complementary binding is due to the fact that the nucleotide sequence of GAM163 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM163 RNA may have a different number of target binding sites in untranslated regions of a GAM163 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM163 RNA, herein designated GAM RNA, to target binding sites on GAM163 target RNA, herein designated GAM TARGET RNA, such as BINDING SITE I, BINDING SITE II and BINDING SITE III, inhibits translation of GAM163 target RNA into GAM163 target protein, herein designated GAM TARGET PROTEIN. GAM target protein is therefore outlined by a broken line.

It is appreciated that GAM163 target gene, herein designated TARGET GENE, in fact represents a plurality of GAM163 target genes. The mRNA of each one of this plurality of GAM163 target genes comprises one or more target binding sites, each having a nucleotide sequence which is at least partly complementary to GAM163 RNA, herein designated GAM RNA, and which when bound by GAM163 RNA causes inhibition of translation of respective one or more GAM163 target proteins.

It is further appreciated by one skilled in the art that the mode of translational inhibition illustrated by FIG. 8 with specific reference to translational inhibition exerted by GAM163 gene, herein designated GAM GENE, on one or more GAM163 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM163 correlate with, and may be deduced from, the identity of the target genes which GAM163 binds and inhibits, and the function of these target genes, as elaborated hereinbelow.

Endothelial differentiation, g-protein-coupled receptor 6 (EDG6, Accession NM_003775.1) is a GAM163 target gene, herein designated TARGET GENE. EDG6 BINDING SITE is a target binding site found in the 3' untranslated region of mRNA encoded by EDG6, corresponding to a target binding site such as BINDING SITE I, BINDING SITE II or BINDING SITE III of FIG. 8. Table 4 illustrates the complementarity of the nucleotide sequences of EDG6 BINDING SITE, designated SEQ ID:859, to the nucleotide sequence of GAM163 RNA, herein designated GAM RNA, also designated SEQ ID:249.

A function of GAM163 is therefore inhibition of Endothelial differentiation, g-protein-coupled receptor 6 (EDG6, Accession NM_003775.1), a gene which may act as a receptor for a trophic factor and is involved in the survival of brain cells. Accordingly, utilities of GAM163 include diagnosis, prevention and treatment of diseases and clinical conditions associated with EDG6.

The function of EDG6 has been established by previous studies. By PCR with degenerate oligonucleotides derived from regions conserved among GPCRs, Graler et al. (1998) cloned differentiated dendritic cell cDNAs encoding EDG6. The predicted 384-amino acid EDG6 protein has 7 transmembrane domains. The EDG6 protein shares 82% sequence identity with mouse Edg6, 46% identity with human EDG3 (OMIM Ref. No. 601965), 44% identity with human EDG1, 39% identity with human EDG4 (OMIM Ref. No. 605110), and 37% identity with human EDG2. Northern blot analysis indicated that EDG6 is expressed as a 1.7-kb transcript in fetal and adult lymphoid and hematopoietic tissues, lung, and Burkitt lymphoma cell lines. Graler et al. (1998) noted that the 3-prime end of their EDG6 cDNA is identical to a short sequence encompassing the dinucleotide repeat polymorphism D19S120 (GenBank X65642), which was assigned to 19p13.3 by Jedlicka et al. (1994). By PCR of human genomic DNA using a gene-specific primer to EDG6 and a primer to the D19S120 amplicon, Graler et al. (1998) localized the EDG6 gene to 19p13.3.

Full details of the abovementioned studies are described in the following publications, the disclosure of which are hereby incorporated by reference:

Graler, M. H.; Bernhardt, G.; Lipp, M.: EDG6, a novel G-protein-coupled receptor related to receptors for bioactive lysophospholipids, is specifically expressed in lymphoid tissue. Genomics 53:164-169, 1998; and Jedlicka, A. E.; Taylor, E. W.; Meyers, D. A.; Liu, Z.; Levitt, R. C.: Localization of the highly polymorphic locus D19S120 to 19p13.3 by linkage. Cytogenet. Cell. Genet. 65:140 only.

Further studies establishing the function and utilities of EDG6 are found in John Hopkins OMIM database record ID 603751, and in cited publications listed in Table 5, which are hereby incorporated by reference. LOC112868 (Accession XM_053402.4) is another GAM163 target gene, herein designated TARGET GENE. LOC112868 BINDING SITE is a target binding site found in the 3' untranslated region of mRNA encoded by LOC112868, corresponding to a target binding site such as BINDING SITE I, BINDING SITE II or BINDING SITE III of FIG. 8. Table 4 illustrates the complementarity of the nucleotide sequences of LOC112868 BINDING SITE, designated SEQ ID:17580, to the nucleotide sequence of GAM163 RNA, herein designated GAM RNA, also designated SEQ ID:249.

Another function of GAM163 is therefore inhibition of LOC112868 (Accession XM_053402.4). Accordingly, utilities of GAM163 include diagnosis, prevention and treatment of diseases and clinical conditions associated with LOC112868.

Oligodendrocyte lineage transcription factor 2 (OLIG2, Accession NM_005806.1) is another GAM163 target gene, herein designated TARGET GENE. OLIG2 BINDING SITE is a target binding site found in the 3' untranslated region of mRNA encoded by OLIG2, corresponding to a target binding site such as BINDING SITE I, BINDING SITE II or BINDING SITE III of FIG. 8. Table 4 illustrates the complementarity of the nucleotide sequences of OLIG2 BINDING SITE, designated SEQ ID:18460, to the nucleotide sequence of GAM163 RNA, herein designated GAM RNA, also designated SEQ ID:249.

Another function of GAM163 is therefore inhibition of Oligodendrocyte lineage transcription factor 2 (OLIG2, Accession NM_005806.1), a gene which may bind DNA and contains a helix-loop-helix DNA-binding domain. Accordingly, utilities of GAM163 include diagnosis, prevention and treatment of diseases and clinical conditions associated with OLIG2.

The function of OLIG2 has been established by previous studies. The oligodendrocyte lineage transcription factors OLIG1 (OMIM Ref. No. 606385) and OLIG2, originally identified in rodents, encode basic helix-loop-helix transcription factors. In the rodent central nervous system, they are expressed exclusively in oligodendrocytes and oligodendrocyte precursors (Lu et al., 2000; Zhou et al., 2000). Pursuing the suggestion that novel molecular markers might be found among factors that have roles in glial development (Raff et al., 1983), Lu et al. (2001) found that the human OLIG1/2 genes are expressed strongly in oligodendroglioma, contrasting absent or low expression in astrocytoma. Their study provided evidence that neoplastic cells of oligodendroglioma resemble oligodendrocytes or their progenitor cells and may derive from cells of this lineage.

Animal model experiments lend further support to the function of OLIG2. In Olig1/2 double-mutant mice, Zhou and Anderson (2002) found that motoneurons were largely eliminated, and oligodendrocyte differentiation was abolished. Lineage tracing data suggested that Olig1/2 -/-pMN progenitors instead generated V2 interneurons and then astrocytes. This apparent conversion likely reflects independent roles for OLIG1/2 in specifying motoneuron and oligodendrocyte fates. OLIG genes therefore couple neuronal and glial subtype specification, unlike proneural bHLH factors that control the neuron versus glia decision. The authors concluded that, in the spinal cord, OLIG and proneural genes comprise a combinatorial code for the specification of neurons, astrocytes, and oligodendrocytes, the 3 fundamental cell types of the central nervous system.

It is appreciated that the abovementioned animal model for OLIG2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lu, Q. R.; Park, J. K.; Noll, E.; Chan, J. A.; Alberta, J.; Yuk, D.; Alzamora, M. G.; Louis, D. N.; Stiles, C. D.; Rowitch, D. H.; Black, P. M.: Oligodendrocyte lineage genes (OLIG) as molecular markers for human glial brain tumors. Proc. Nat. Acad. Sci. 98:10851-10856, 2001; and Zhou, Q.; Anderson, D. J.: The bHLH transcription factors OLIG2 and OLIG1 couple neuronal and glial subtype specification. Cell 109:61-73, 2002.

Further studies establishing the function and utilities of OLIG2 are found in John Hopkins OMIM database record ID 606386, and in cited publications listed in Table 5, which are hereby incorporated by reference. Phosphatase and tensin homolog (mutated in multiple advanced cancers 1) (PTEN, Accession NM_000314.1) is another GAM163 target gene, herein designated TARGET GENE. PTEN BINDING SITE is a target binding site found in the 3' untranslated region of mRNA encoded by PTEN, corresponding to a target binding site such as BINDING SITE I, BINDING SITE II or BINDING SITE III of FIG. 8. Table 4 illustrates the complementarity of the nucleotide sequences of PTEN BINDING SITE, designated SEQ ID:2919, to the nucleotide sequence of GAM163 RNA, herein designated GAM RNA, also designated SEQ ID:249.

Another function of GAM163 is therefore inhibition of Phosphatase and tensin homolog (mutated in multiple advanced cancers 1) (PTEN, Accession NM_000314.1). Accordingly, utilities of GAM163 include diagnosis, prevention and treatment of diseases and clinical conditions associated with PTEN.

FIG. 8 further provides a conceptual description of a novel bioinformatically detected of the present invention, referred to here as Genomic Address Messenger 164 (GAM164), which modulates expression of respective target genes thereof, the function and utility of which target genes is known in the art.

GAM164 is a novel bioinformatically detected regulatory, non protein coding, micro RNA (miRNA) gene. The method by which GAM164 was detected is described hereinabove with reference to FIGS. 8-15.

GAM164 gene, herein designated GAM GENE, and GAM164 target gene, herein designated TARGET GENE, are human genes contained in the human genome.

GAM164 gene encodes a GAM164 precursor RNA, herein designated GAM PRECURSOR RNA. Similar to other miRNA genes, and unlike most ordinary genes, GAM164 precursor RNA does not encode a protein. A nucleotide sequence identical or highly similar to the nucleotide sequence of GAM164 precursor RNA is designated SEQ ID:66, and is provided hereinbelow with reference to the sequence listing part.

GAM164 precursor RNA folds onto itself, forming GAM164 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM164 precursor RNA folds onto itself, forming GAM164 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM164 precursor RNA, designated SEQ-ID:66, and a schematic representation of a predicted secondary folding of GAM164 folded precursor RNA are further described with reference to Table 2, hereby incorporated by reference.

An enzyme complex designated DICER COMPLEX, 'dices' the GAM164 folded precursor RNA into GAM164 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM164 RNA is designated SEQ ID:322, and is provided hereinbelow with references to the sequence listing part and Table 3, hereby incorporated by reference.

GAM164 target gene, herein designated TARGET GENE, encodes a corresponding messenger RNA, GAM164 target RNA, herein designated GAM TARGET RNA. GAM164 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM164 RNA, herein designated GAM RNA, binds complementarily to one or more target binding sites located in untranslated regions of GAM164 target RNA, herein designated GAM TARGET RNA. This complementary binding is due to the fact that the nucleotide sequence of GAM164 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM164 RNA may have a different number of target binding sites in untranslated regions of a GAM164 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM164 RNA, herein designated GAM RNA, to target binding sites on GAM164 target RNA, herein designated GAM TARGET RNA, such as BINDING SITE I, BINDING SITE II and BINDING SITE III, inhibits translation of GAM164 target RNA into GAM164 target protein, herein designated GAM TARGET PROTEIN. GAM target protein is therefore outlined by a broken line.

It is appreciated that GAM164 target gene, herein designated TARGET GENE, in fact represents a plurality of GAM164 target genes. The mRNA of each one of this plurality of GAM164 target genes comprises one or more target binding sites, each having a nucleotide sequence which is at least partly complementary to GAM164 RNA, herein designated GAM RNA, and which when bound by GAM164 RNA causes inhibition of translation of respective one or more GAM164 target proteins.

It is further appreciated by one skilled in the art that the mode of translational inhibition illustrated by FIG. 8 with specific reference to translational inhibition exerted by GAM164 gene, herein designated GAM GENE, on one or more GAM164 target genes, herein collectively designated TARGET GENE, is common to other known miRNA genes.

As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM164 correlate with, and may be deduced from, the identity of the target genes which GAM164 binds and inhibits, and the function of these target genes, as elaborated hereinbelow.

FLJ21986 (Accession NM_024913.1) is a GAM164 target gene, herein designated TARGET GENE. FLJ21986 BINDING SITE is a target binding site found in the 5' untranslated region of mRNA encoded by FLJ21986, corresponding to a target binding site such as BINDING SITE I, BINDING SITE II or BINDING SITE III of FIG. 8. Table 4 illustrates the complementarity of the nucleotide sequences of FLJ21986 BINDING SITE, designated SEQ ID:11076, to the nucleotide sequence of GAM164 RNA, herein designated GAM RNA, also designated SEQ ID:322.

A function of GAM164 is therefore inhibition of FLJ21986 (Accession NM_024913.1). Accordingly, utilities of GAM164 include diagnosis, prevention and treatment of diseases and clinical conditions associated with FLJ21986.

Lipase, member i (LIPI, Accession) is another GAM164 target gene, herein designated TARGET GENE. LIPI BINDING SITE is a target binding site found in the 3' untranslated region of mRNA encoded by LIPI, corresponding to a target binding site such as BINDING SITE I, BINDING SITE II or BINDING SITE III of FIG. 8. Table 4 illustrates the complementarity of the nucleotide sequences of LIPI BINDING SITE, designated SEQ ID:15797, to the nucleotide sequence of GAM164 RNA, herein designated GAM RNA, also designated SEQ ID:322.

Another function of GAM164 is therefore inhibition of Lipase, member i (LIPI, Accession). Accordingly, utilities of GAM164 include diagnosis, prevention and treatment of diseases and clinical conditions associated with LIPI.

FIG. 8 further provides a conceptual description of a novel bioinformatically detected gene of the present invention, referred to here as Genomic Address Messenger 165 (GAM165), which modulates expression of respective target genes thereof, the function and utility of which target genes is known in the art.

GAM165 is a novel bioinformatically detected regulatory, non protein coding, micro RNA (miRNA) gene. The method by which GAM165 was detected is described hereinabove with reference to FIGS. 8-15.

GAM165 gene, herein designated GAM GENE, and GAM165 target gene, herein designated TARGET GENE, are human genes contained in the human genome.

GAM165 gene encodes a GAM165 precursor RNA, herein designated GAM PRECURSOR RNA. Similar to other miRNA genes, and unlike most ordinary genes, GAM165 precursor RNA does not encode a protein. A nucleotide sequence identical or highly similar to the nucleotide sequence of GAM165 precursor RNA is designated SEQ ID:134, and is provided hereinbelow with reference to the sequence listing part.

GAM165 precursor RNA folds onto itself, forming GAM165 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM165 precursor RNA folds onto itself, forming GAM165 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM165 precursor RNA, designated SEQ-ID:134, and a schematic representation of a predicted secondary folding of GAM165 folded precursor RNA are further described with reference to Table 2, hereby incorporated by reference.

An enzyme complex designated DICER COMPLEX, 'dices' the GAM165 folded precursor RNA into GAM165 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM165 RNA is designated SEQ ID:270, and is provided hereinbelow with references to the sequence listing part and Table 3, hereby incorporated by reference.

GAM165 target gene, herein designated TARGET GENE, encodes a corresponding messenger RNA, GAM165 target RNA, herein designated GAM TARGET RNA. GAM165 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM165 RNA, herein designated GAM RNA, binds complementarily to one or more target binding sites located in untranslated regions of GAM165 target RNA, herein designated GAM TARGET RNA. This complementary binding is due to the fact that the nucleotide sequence of GAM165 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM165 RNA may have a different number of target binding sites in untranslated regions of a GAM165 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM165 RNA, herein designated GAM RNA, to target binding sites on GAM165 target RNA, herein designated GAM TARGET RNA, such as BINDING SITE I, BINDING SITE II and BINDING SITE III, inhibits translation of GAM165 target RNA into GAM165 target protein, herein designated GAM TARGET PROTEIN. GAM target protein is therefore outlined by a broken line.

It is appreciated that GAM165 target gene, herein designated TARGET GENE, in fact represents a plurality of GAM165 target genes. The mRNA of each one of this plurality of GAM165 target genes comprises one or more target binding sites, each having a nucleotide sequence which is at least partly complementary to GAM165 RNA, herein designated GAM RNA, and which when bound by GAM165 RNA causes inhibition of translation of respective one or more GAM165 target proteins.

It is further appreciated by one skilled in the art that the mode of translational inhibition illustrated by FIG. 8 with specific reference to translational inhibition exerted by GAM165 gene, herein designated GAM GENE, on one or more GAM165 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM165 correlate with, and may be deduced from, the identity of the target genes which GAM165 binds and inhibits, and the function of these target genes, as elaborated hereinbelow.

Ras homolog gene family, member c (ARHC, Accession NM__175744.1) is a GAM165 target gene, herein designated TARGET GENE. ARHC BINDING SITE is a target binding site found in the 5' untranslated region of mRNA encoded by ARHC, corresponding to a target binding site such as BINDING SITE I, BINDING SITE II or BINDING SITE III of FIG. 8. Table 4 illustrates the complementarity of the nucleotide sequences of ARHC BINDING SITE, designated SEQ ID:15644, to the nucleotide sequence of GAM165 RNA, herein designated GAM RNA, also designated SEQ ID:270.

A function of GAM165 is therefore inhibition of Ras homolog gene family, member c (ARHC, Accession NM__175744.1), a gene which remodels of the actin cytoskeleton during cell morphogenesis and motility. and therefore may be associated with Metastatic melanoma. Accordingly, utilities of GAM165 include diagnosis, prevention and treatment of Metastatic melanoma, and of other diseases and clinical conditions associated with ARHC.

The function of ARHC has been established by previous studies. The small guanosine triphosphatase Rho regulates remodeling of the actin cytoskeleton during cell morphogenesis and motility. In their *Figure* 3C, Maekawa et al. (1999) diagrammed proposed signaling pathways for Rho-induced remodeling of the actin cytoskeleton. They demonstrated that active Rho signals to its downstream effector ROCK (OMIM Ref. No. 601702), which phosphorylates and activates LIM kinase (see OMIM Ref. No. 601329). LIM kinase, in turn, phosphorylates cofilin (OMIM Ref. No. 601442), inhibiting its actin-depolymerizing activity. Clark et al. (2000) used an in vivo selection scheme to select highly metastatic melanoma cells. By analyzing these cells on DNA array, they defined a pattern of gene expression that correlates with progression to a metastatic phenotype. In particular, Clark et al. (2000) showed enhanced expression of several genes involved in extracellular matrix assembly and of a second set of genes that regulate, either directly or indirectly, the actin-based cytoskeleton. Clark et al. (2000) found that RhoC enhances metastasis when overexpressed, whereas a dominant-negative Rho inhibits metastasis. Analysis of the phenotype of cells expressing dominant-negative Rho or RhoC indicates that RhoC is important in tumor cell invasion. The genomic approach allowed Clark et al. (2000) to identify families of genes involved in a process, not just single genes, and could indicate which molecular and cellular events might be important in complex biologic processes such as metastasis.

Full details of the abovementioned studies are described in the following publications, the disclosure of which are hereby incorporated by reference:

Clark, E. A.; Golub, T. R.; Lander, E. S.; Hynes, R. O.: Genomic analysis of metastasis reveals an essential role for RhoC. Nature 406:532-535, 2000; and Maekawa, M.; Ishizaki, T.; Boku, S.; Watanabe, N.; Fujita, A.; Iwamatsu, A.; Obinata, T.; Ohashi, K.; Mizuno, K.; Narumiy, S.: Signaling from Rho to the actin cytoskeleton through pro.

Further studies establishing the function and utilities of ARHC are found in John Hopkins OMIM database record ID 165380, and in cited publications listed in Table 5, which are hereby incorporated by reference. BNIP-S (Accession NM_138278.1) is another GAM165 target gene, herein designated TARGET GENE. BNIP-S BINDING SITE is a target binding site found in the 5' untranslated region of multiple transcripts of mRNA encoded by BNIP-S, corresponding to a target binding site such as BINDING SITE I, BINDING SITE II or BINDING SITE III of FIG. 8. Table 4 illustrates the complementarity of the nucleotide sequences of BNIP-S BINDING SITE, designated SEQ ID:1814, to the nucleotide sequence of GAM165 RNA, herein designated GAM RNA, also designated SEQ ID:270.

Another function of GAM165 is therefore inhibition of BNIP-S (Accession NM_138278.1). Accordingly, utilities of GAM165 include diagnosis, prevention and treatment of diseases and clinical conditions associated with BNIP-S.

DKFZp434M0331 (Accession NM_017600.1) is another GAM165 target gene, herein designated TARGET GENE. DKFZp434M0331 BINDING SITE is a target binding site found in the 5' untranslated region of mRNA encoded by DKFZp434M0331, corresponding to a target binding site such as BINDING SITE I, BINDING SITE II or BINDING SITE III of FIG. 8. Table 4 illustrates the complementarity of the nucleotide sequences of DKFZp434M0331 BINDING SITE, designated SEQ ID:8421, to the nucleotide sequence of GAM165 RNA, herein designated GAM RNA, also designated SEQ ID:270.

Another function of GAM165 is therefore inhibition of DKFZp434M0331 (Accession NM_017600.1). Accordingly, utilities of GAM165 include diagnosis, prevention and treatment of diseases and clinical conditions associated with DKFZp434M0331.

FLJ14728 (Accession) is another GAM165 target gene, herein designated TARGET GENE. FLJ14728 BINDING SITE is a target binding site found in the 5' untranslated region of mRNA encoded by FLJ14728, corresponding to a target binding site such as BINDING SITE I, BINDING SITE II or BINDING SITE III of FIG. 8. Table 4 illustrates the complementarity of the nucleotide sequences of FLJ14728 BINDING SITE, designated SEQ ID:9157, to the nucleotide sequence of GAM165 RNA, herein designated GAM RNA, also designated SEQ ID:270.

Another function of GAM165 is therefore inhibition of FLJ14728 (Accession). Accordingly, utilities of GAM165 include diagnosis, prevention and treatment of diseases and clinical conditions associated with FLJ14728.

KIAA1969 (Accession) is another GAM165 target gene, herein designated TARGET GENE. KIAA1969 BINDING SITE is a target binding site found in the 5' untranslated region of mRNA encoded by KIAA1969, corresponding to a target binding site such as BINDING SITE I, BINDING SITE II or BINDING SITE III of FIG. 8. Table 4 illustrates the complementarity of the nucleotide sequences of KIAA1969 BINDING SITE, designated SEQ ID:12294, to the nucleotide sequence of GAM165 RNA, herein designated GAM RNA, also designated SEQ ID:270.

Another function of GAM165 is therefore inhibition of KIAA1969 (Accession). Accordingly, utilities of GAM165 include diagnosis, prevention and treatment of diseases and clinical conditions associated with KIAA1969.

LOC199777 (Accession NM_145297.1) is another GAM165 target gene, herein designated TARGET GENE. LOC199777 BINDING SITE is a target binding site found in the 5' untranslated region of mRNA encoded by LOC199777, corresponding to a target binding site such as BINDING SITE I, BINDING SITE II or BINDING SITE III of FIG. 8. Table 4 illustrates the complementarity of the nucleotide sequences of LOC199777 BINDING SITE, designated SEQ ID:16714, to the nucleotide sequence of GAM165 RNA, herein designated GAM RNA, also designated SEQ ID:270.

Another function of GAM165 is therefore inhibition of LOC199777 (Accession NM_145297.1). Accordingly, utilities of GAM165 include diagnosis, prevention and treatment of diseases and clinical conditions associated with LOC199777.

LOC199906 (Accession XM_114052.1) is another GAM165 target gene, herein designated TARGET GENE. LOC199906 BINDING SITE is a target binding site found in the 5' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:18302, to the nucleotide sequence of GAM165 RNA, herein designated GAM RNA, also designated SEQ ID:270.

Another function of GAM165 is therefore inhibition of LOC199906 (Accession XM_114052.1). Accordingly, utilities of GAM165 include diagnosis, prevention and treatment of diseases and clinical conditions associated with LOC199906.

MGC20460 (Accession NM_053043.1) is another GAM165 target gene, herein designated TARGET GENE. MGC20460 BINDING SITE is a target binding site found in the 5' untranslated region of mRNA encoded by MGC20460, corresponding to a target binding site such as BINDING SITE I, BINDING SITE II or BINDING SITE III of FIG. 8. Table 4 illustrates the complementarity of the nucleotide sequences of MGC20460 BINDING SITE, designated SEQ ID:17732, to the nucleotide sequence of GAM165 RNA, herein designated GAM RNA, also designated SEQ ID:270.

Another function of GAM165 is therefore inhibition of MGC20460 (Accession NM_053043.1). Accordingly, utilities of GAM165 include diagnosis, prevention and treatment of diseases and clinical conditions associated with MGC20460.

Transducin (beta)-like 1x-linked (TBL1X, Accession NM_005647.2) is another GAM165 target gene, herein designated TARGET GENE. TBL1X BINDING SITE is a target binding site found in the 5' untranslated region of mRNA encoded by TBL1X, corresponding to a target binding site such as BINDING SITE I, BINDING SITE II or BINDING SITE III of FIG. 8. Table 4 illustrates the complementarity of the nucleotide sequences of TBL1X BINDING SITE, designated SEQ ID:11582, to the nucleotide sequence of GAM165 RNA, herein designated GAM RNA, also designated SEQ ID:270.

Another function of GAM165 is therefore inhibition of Transducin (beta)-like 1x-linked (TBL1X, Accession NM_005647.2), a gene which activates latent HDAC3 activity. Accordingly, utilities of GAM165 include diagnosis, prevention and treatment of diseases and clinical conditions associated with TBL1X.

The function of TBL1X and its association with various diseases and clinical conditions, has been established by previous studies, as described hereinabove with reference to GAM28.1.

FIG. 8 further provides a conceptual description of a novel bioinformatically detected of the present invention, referred to here as Genomic Address Messenger 166 (GAM166), which modulates expression of respective target genes thereof, the function and utility of which target genes is known in the art.

GAM166 is a novel bioinformatically detected regulatory, non protein coding, micro RNA (miRNA) gene. The method by which GAM166 was detected is described hereinabove with reference to FIGS. 8-15.

GAM166 gene, herein designated GAM GENE, and GAM166 target gene, herein designated TARGET GENE, are human genes contained in the human genome.

GAM166 gene encodes a GAM166 precursor RNA, herein designated GAM PRECURSOR RNA. Similar to other miRNA genes, and unlike most ordinary genes, GAM166 precursor RNA does not encode a protein. A nucleotide sequence identical or highly similar to the nucleotide sequence of GAM166 precursor RNA is designated SEQ ID:161, and is provided hereinbelow with reference to the sequence listing part.

GAM166 precursor RNA folds onto itself, forming GAM166 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM166 precursor RNA folds onto itself, forming GAM166 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM166 precursor RNA, designated SEQ-ID:161, and a schematic representation of a predicted secondary folding of GAM166 folded precursor RNA are further described with reference to Table 2, hereby incorporated by reference.

An enzyme complex designated DICER COMPLEX, 'dices' the GAM166 folded precursor RNA into GAM166 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM166 RNA is designated SEQ ID:232, and is provided hereinbelow with references to the sequence listing part and Table 3, hereby incorporated by reference.

GAM166 target gene, herein designated TARGET GENE, encodes a corresponding messenger RNA, GAM166 target RNA, herein designated GAM TARGET RNA. GAM166 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM166 RNA, herein designated GAM RNA, binds complementarily to one or more target binding sites located in untranslated regions of GAM166 target RNA, herein designated GAM TARGET RNA. This complementary binding is due to the fact that the nucleotide sequence of GAM166 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM166 RNA may have a different number of target binding sites in untranslated regions of a GAM166 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM166 RNA, herein designated GAM RNA, to target binding sites on GAM166 target RNA, herein designated GAM TARGET RNA, such as BINDING SITE I, BINDING SITE II and BINDING SITE III, inhibits translation of GAM166 target RNA into GAM166 target protein, herein designated GAM TARGET PROTEIN. GAM target protein is therefore outlined by a broken line.

It is appreciated that GAM166 target gene, herein designated TARGET GENE, in fact represents a plurality of GAM166 target genes. The mRNA of each one of this plurality of GAM166 target genes comprises one or more target binding sites, each having a nucleotide sequence which is at least partly complementary to GAM166 RNA, herein designated GAM RNA, and which when bound by GAM166 RNA causes inhibition of translation of respective one or more GAM166 target proteins.

It is further appreciated by one skilled in the art that the mode of translational inhibition illustrated by FIG. 8 with specific reference to translational inhibition exerted by GAM166 gene, herein designated GAM GENE, on one or more GAM166 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM166 correlate with, and may be deduced from, the identity of the target genes which GAM166 binds and inhibits, and the function of these target genes, as elaborated hereinbelow.

MGC13198 (Accession) is a GAM166 target gene, herein designated TARGET GENE. MGC13198 BINDING SITE is a target binding site found in the 3' untranslated region of mRNA encoded by MGC13198, corresponding to a target binding site such as BINDING SITE I, BINDING SITE II or BINDING SITE III of FIG. 8. Table 4 illustrates the complementarity of the nucleotide sequences of MGC13198 BINDING SITE, designated SEQ ID:1875, to the nucleotide sequence of GAM166 RNA, herein designated GAM RNA, also designated SEQ ID:232.

A function of GAM166 is therefore inhibition of MGC13198 (Accession). Accordingly, utilities of GAM166 include diagnosis, prevention and treatment of diseases and clinical conditions associated with MGC13198.

NEBL (Accession NM_006393.1) is another GAM166 target gene, herein designated TARGET GENE. NEBL BINDING SITE is a target binding site found in the 3' untranslated region of mRNA encoded by NEBL, corresponding to a target binding site such as BINDING SITE I, BINDING SITE II or BINDING SITE III of FIG. 8. Table 4 illustrates the complementarity of the nucleotide sequences of NEBL BINDING SITE, designated SEQ ID:6830, to the nucleotide sequence of GAM166 RNA, herein designated GAM RNA, also designated SEQ ID:232.

Another function of GAM166 is therefore inhibition of NEBL (Accession NM_006393.1). Accordingly, utilities of GAM166 include diagnosis, prevention and treatment of diseases and clinical conditions associated with NEBL.

FIG. 8 further provides a conceptual description of a novel bioinformatically detected of the present invention, referred to here as Genomic Address Messenger 167 (GAM167), which modulates expression of respective target genes thereof, the function and utility of which target genes is known in the art.

GAM167 is a novel bioinformatically detected regulatory, non protein coding, micro RNA (miRNA) gene. The method by which GAM167 was detected is described hereinabove with reference to FIGS. 8-15.

GAM167 gene, herein designated GAM GENE, and GAM167 target gene, herein designated TARGET GENE, are human genes contained in the human genome.

GAM167 gene encodes a GAM167 precursor RNA, herein designated GAM PRECURSOR RNA. Similar to other miRNA genes, and unlike most ordinary genes, GAM167 precursor RNA does not encode a protein. A nucleotide sequence identical or highly similar to the nucleotide sequence of GAM167 precursor RNA is designated SEQ ID:140, and is provided hereinbelow with reference to the sequence listing part.

GAM167 precursor RNA folds onto itself, forming GAM167 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM167 precursor RNA folds onto itself, forming GAM167 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM167 precursor RNA, designated SEQ-ID:140, and a schematic representation of a predicted secondary folding of GAM167 folded precursor RNA are further described with reference to Table 2, hereby incorporated by reference.

An enzyme complex designated DICER COMPLEX, 'dices' the GAM167 folded precursor RNA into GAM167 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM167 RNA is designated SEQ ID:236, and is provided hereinbelow with references to the sequence listing part and Table 3, hereby incorporated by reference.

GAM167 target gene, herein designated TARGET GENE, encodes a corresponding messenger RNA, GAM167 target RNA, herein designated GAM TARGET RNA. GAM167 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM167 RNA, herein designated GAM RNA, binds complementarily to one or more target binding sites located in untranslated regions of GAM167 target RNA, herein designated GAM TARGET RNA. This complementary binding is due to the fact that the nucleotide sequence of GAM167 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM167 RNA may have a different number of target binding sites in untranslated regions of a GAM167 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM167 RNA, herein designated GAM RNA, to target binding sites on GAM167 target RNA, herein designated GAM TARGET RNA, such as BINDING SITE I, BINDING SITE II and BINDING SITE III, inhibits translation of GAM167 target RNA into GAM167 target protein, herein designated GAM TARGET PROTEIN. GAM target protein is therefore outlined by a broken line.

It is appreciated that GAM167 target gene, herein designated TARGET GENE, in fact represents a plurality of GAM167 target genes. The mRNA of each one of this plurality of GAM167 target genes comprises one or more target binding sites, each having a nucleotide sequence which is at least partly complementary to GAM167 RNA, herein designated GAM RNA, and which when bound by GAM167 RNA causes inhibition of translation of respective one or more GAM167 target proteins.

It is further appreciated by one skilled in the art that the mode of translational inhibition illustrated by FIG. 8 with specific reference to translational inhibition exerted by GAM167 gene, herein designated GAM GENE, on one or more GAM167 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM167 correlate with, and may be deduced from, the identity of the target genes which GAM167 binds and inhibits, and the function of these target genes, as elaborated hereinbelow.

Kruppel-like factor 12 (KLF12, Accession NM_007249.3) is a GAM167 target gene, herein designated TARGET GENE. KLF12 BINDING SITE is a target binding site found in the 3' untranslated region of multiple transcripts of mRNA encoded by KLF12, corresponding to a target binding site such as BINDING SITE I, BINDING SITE II or BINDING SITE III of FIG. 8. Table 4 illustrates the complementarity of the nucleotide sequences of KLF12 BINDING SITE, designated SEQ ID:14666, to the nucleotide sequence of GAM167 RNA, herein designated GAM RNA, also designated SEQ ID:236.

A function of GAM167 is therefore inhibition of Kruppel-like factor 12 (KLF12, Accession NM_007249.3). Accordingly, utilities of GAM167 include diagnosis, prevention and treatment of diseases and clinical conditions associated with KLF12.

LOC131873 (Accession XM_067585.7) is another GAM167 target gene, herein designated TARGET GENE. LOC131873 BINDING SITE is a target binding site found in the 3' untranslated region of mRNA encoded by LOC131873, corresponding to a target binding site such as BINDING SITE I, BINDING SITE II or BINDING SITE III of FIG. 8. Table 4 illustrates the complementarity of the nucleotide sequences of LOC131873 BINDING SITE, designated SEQ ID:11445, to the nucleotide sequence of GAM167 RNA, herein designated GAM RNA, also designated SEQ ID:236.

Another function of GAM167 is therefore inhibition of LOC131873 (Accession XM_067585.7). Accordingly, utilities of GAM167 include diagnosis, prevention and treatment of diseases and clinical conditions associated with LOC131873.

LOC63929 (Accession NM_022098.1) is another GAM167 target gene, herein designated TARGET GENE. LOC63929 BINDING SITE is a target binding site found in the 3' untranslated region of mRNA encoded by LOC63929, corresponding to a target binding site such as BINDING SITE I, BINDING SITE II or BINDING SITE III of FIG. 8. Table 4 illustrates the complementarity of the nucleotide sequences of LOC63929 BINDING SITE, designated SEQ ID:17904, to the nucleotide sequence of GAM167 RNA, herein designated GAM RNA, also designated SEQ ID:236.

Another function of GAM167 is therefore inhibition of LOC63929 (Accession NM_022098.1). Accordingly, utilities of GAM167 include diagnosis, prevention and treatment of diseases and clinical conditions associated with LOC63929.

VIT1 (Accession) is another GAM167 target gene, herein designated TARGET GENE. VIT1 BINDING SITE is a target binding site found in the 3' untranslated region of mRNA encoded by VIT1, corresponding to a target binding site such as BINDING SITE I, BINDING SITE II or BINDING SITE III of FIG. 8. Table 4 illustrates the complementarity of the nucleotide sequences of VIT1 BINDING SITE, designated SEQ ID:16317, to the nucleotide sequence of GAM167 RNA, herein designated GAM RNA, also designated SEQ ID:236.

Another function of GAM167 is therefore inhibition of VIT1 (Accession). Accordingly, utilities of GAM167 include diagnosis, prevention and treatment of diseases and clinical conditions associated with VIT1.

FIG. 8 further provides a conceptual description of a novel bioinformatically detected of the present invention, referred to here as Genomic Address Messenger 168 (GAM168), which modulates expression of respective target genes thereof, the function and utility of which target genes is known in the art.

GAM168 is a novel bioinformatically detected regulatory, non protein coding, micro RNA (miRNA) gene. The method by which GAM168 was detected is described hereinabove with reference to FIGS. 8-15.

GAM168 gene, herein designated GAM GENE, and GAM168 target gene, herein designated TARGET GENE, are human genes contained in the human genome.

GAM168 gene encodes a GAM168 precursor RNA, herein designated GAM PRECURSOR RNA. Similar to other miRNA genes, and unlike most ordinary genes, GAM168 precursor RNA does not encode a protein. A nucleotide sequence identical or highly similar to the nucleotide sequence of GAM168 precursor RNA is designated SEQ ID:97, and is provided hereinbelow with reference to the sequence listing part. Nucleotide sequence SEQ ID:97 is located at position 48046908 relative to chromosome 19.

GAM168 precursor RNA folds onto itself, forming GAM168 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM168 precursor RNA folds onto itself, forming GAM168 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM168 precursor RNA, designated SEQ-ID:97, and a schematic representation of a predicted secondary folding of GAM168 folded precursor RNA are further described with reference to Table 2, hereby incorporated by reference.

An enzyme complex designated DICER COMPLEX, 'dices' the GAM168 folded precursor RNA into GAM168 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM168 RNA is designated SEQ ID:217, and is provided hereinbelow with references to the sequence listing part and Table 3, hereby incorporated by reference.

GAM168 target gene, herein designated TARGET GENE, encodes a corresponding messenger RNA, GAM168 target RNA, herein designated GAM TARGET RNA. GAM168 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM168 RNA, herein designated GAM RNA, binds complementarily to one or more target binding sites located in untranslated regions of GAM168 target RNA, herein designated GAM TARGET RNA. This complementary binding is due to the fact that the nucleotide sequence of GAM168 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM168 RNA may have a different number of target binding sites in untranslated regions of a GAM168 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM168 RNA, herein designated GAM RNA, to target binding sites on GAM168 target RNA, herein designated GAM TARGET RNA, such as BINDING SITE I, BINDING SITE II and BINDING SITE III, inhibits translation of GAM168 target RNA into GAM168 target protein, herein designated GAM TARGET PROTEIN. GAM target protein is therefore outlined by a broken line.

It is appreciated that GAM168 target gene, herein designated TARGET GENE, in fact represents a plurality of GAM168 target genes. The mRNA of each one of this plurality of GAM168 target genes comprises one or more target binding sites, each having a nucleotide sequence which is at least partly complementary to GAM168 RNA, herein designated GAM RNA, and which when bound by GAM168 RNA causes inhibition of translation of respective one or more GAM168 target proteins.

It is further appreciated by one skilled in the art that the mode of translational inhibition illustrated by FIG. 8 with specific reference to translational inhibition exerted by GAM168 gene, herein designated GAM GENE, on one or more GAM168 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM168 correlate with, and may be deduced from, the identity of the target genes which GAM168 binds and inhibits, and the function of these target genes, as elaborated hereinbelow.

LOC220930 (Accession XM_167624.3) is a GAM168 target gene, herein designated TARGET GENE. LOC220930 BINDING SITE is a target binding site found in the 3' untranslated region of mRNA encoded by LOC220930, corresponding to a target binding site such as BINDING SITE I, BINDING SITE II or BINDING SITE III of FIG. 8. Table 4 illustrates the complementarity of the nucleotide sequences of LOC220930 BINDING SITE, designated SEQ ID:3451, to the nucleotide sequence of GAM168 RNA, herein designated GAM RNA, also designated SEQ ID:217.

A function of GAM168 is therefore inhibition of LOC220930 (Accession XM_167624.3). Accordingly, utilities of GAM168 include diagnosis, prevention and treatment of diseases and clinical conditions associated with LOC220930.

PIR51 (Accession NM_006479.2) is another GAM168 target gene, herein designated TARGET GENE. PIR51 BINDING SITE is a target binding site found in the 3' untranslated region of mRNA encoded by PIR51, corresponding to a target binding site such as BINDING SITE I, BINDING SITE II or BINDING SITE III of FIG. 8. Table 4 illustrates the complementarity of the nucleotide sequences of PIR51 BINDING SITE, designated SEQ ID:14378, to the nucleotide sequence of GAM168 RNA, herein designated GAM RNA, also designated SEQ ID:217.

Another function of GAM168 is therefore inhibition of PIR51 (Accession NM_006479.2), a gene which interacts with the RAD51 recombinase protein and is involved in DNA recombination and repair. Accordingly, utilities of GAM168 include diagnosis, prevention and treatment of diseases and clinical conditions associated with PIR51.

The function of PIR51 has been established by previous studies. RAD51 (OMIM Ref. No. 179617), a eukaryotic homolog of the bacterial RecA recombinase, plays a role in a variety of recombination events in the eukaryotic cell. Using a yeast 2-hybrid screen with human RAD51 as the bait, Mizuta et al. (1997) isolated mouse cDNAs corresponding to a gene that they designated Rab22. The Rab22 protein interacted with RAD51 in vitro and colocalized with RAD51 in large nuclear foci in hamster cells. Kovalenko et al. (1997) also used a yeast 2-hybrid screen with RAD51 as the bait and isolated a HeLa cell cDNA encoding a protein that they called PIR51 for 'protein interacting with Rad51'. The predicted PIR51 protein has 335 amino acids and a calculated pI of 9.95. The authors suggested that PIR51 is the human homolog of mouse Rab22 since the 2 proteins share 63% sequence identity. Northern blot analysis revealed that PIR51 is expressed as a 2.4-kb mRNA in human testis and thymus, and at lower levels, in colon and small intestine. Recombinant PIR51 bound RNA and single- and double-stranded DNA, and was capable of aggregating DNA. Kovalenko et al. (1997) stated that PIR51 may represent a new member of the multiprotein complexes thought to carry out homologous recombination and DNA repair in mammalian cells. By analysis of an interspecific backcross, Mizuta et al. (1997) mapped the Rab22 gene to the distal region of mouse chromosome 6. Using fluorescence in situ hybridization, Kovalenko et al. (1997) mapped the PIR51 gene to 12p13.2-p13.1, a region that shows homology of synteny with the mouse chromosome 6 segment containing the Rab22 gene.

Full details of the abovementioned studies are described in the following publications, the disclosure of which are hereby incorporated by reference:

Kovalenko, O. V.; Golub, E. I.; Bray-Ward, P.; Ward, D. C.; Radding, C. M.: A novel nucleic acid-binding protein that interacts with human Rad51 recombinase. Nucleic Acids Res. 25:4946-4953, 1997; and Mizuta, R.; LaSalle, J. M.; Cheng, H.-L.; Shinohara, A.; Ogawa, H.; Copeland, N.; Jenkins, N. A.; Lalande, M.; Alt, F. W.: RAB22 and RAB163/mouse BRCA2: proteins that specifically inte.

Further studies establishing the function and utilities of PIR51 are found in John Hopkins OMIM database record ID 603070, and in cited publications listed in Table 5, which are hereby incorporated by reference. Pregnancy specific beta-1- glycoprotein 4 (PSG4, Accession NM_002780.1) is another GAM168 target gene, herein designated TARGET GENE. PSG4 BINDING SITE is a target binding site found in the 3' untranslated region of mRNA encoded by PSG4, corresponding to a target binding site such as BINDING SITE I, BINDING SITE II or BINDING SITE III of FIG. 8. Table 4 illustrates the complementarity of the nucleotide sequences of PSG4 BINDING SITE, designated SEQ ID:12119, to the nucleotide sequence of GAM168 RNA, herein designated GAM RNA, also designated SEQ ID:217.

Another function of GAM168 is therefore inhibition of Pregnancy specific beta-1-glycoprotein 4 (PSG4, Accession NM_002780.1), a gene which is a member of the pregnancy-specific glycoprotein (PSG) and CEA families. Accordingly, utilities of GAM168 include diagnosis, prevention and treatment of diseases and clinical conditions associated with PSG4.

The function of PSG4 and its association with various diseases and clinical conditions, has been established by previous studies, as described hereinabove with reference to GAM99.1. Pregnancy specific beta-1-glycoprotein 7 (PSG7, Accession NM_002783.1) is another GAM168 target gene, herein designated TARGET GENE. PSG7 BINDING SITE is a target binding site found in the 3' untranslated region of mRNA encoded by PSG7, corresponding to a target binding site such as BINDING SITE I, BINDING SITE II or BINDING SITE III of FIG. 8. Table 4 illustrates the complementarity of the nucleotide sequences of PSG7 BINDING SITE, designated SEQ ID:2562, to the nucleotide sequence of GAM168 RNA, herein designated GAM RNA, also designated SEQ ID:217.

Another function of GAM168 is therefore inhibition of Pregnancy specific beta-1-glycoprotein 7 (PSG7, Accession NM_002783.1), a gene which function still unknown. Accordingly, utilities of GAM168 include diagnosis, prevention and treatment of diseases and clinical conditions associated with PSG7.

The function of PSG7 and its association with various diseases and clinical conditions, has been established by previous studies, as described hereinabove with reference to GAM63.1.

FIG. 8 further provides a conceptual description of a novel bioinformatically detected of the present invention, referred to here as Genomic Address Messenger 169 (GAM169), which modulates expression of respective target genes thereof, the function and utility of which target genes is known in the art.

GAM169 is a novel bioinformatically detected regulatory, non protein coding, micro RNA (miRNA) gene. The method by which GAM169 was detected is described hereinabove with reference to FIGS. 8-15.

GAM169 gene, herein designated GAM GENE, and GAM169 target gene, herein designated TARGET GENE, are human genes contained in the human genome.

GAM169 gene encodes a GAM169 precursor RNA, herein designated GAM PRECURSOR RNA. Similar to other miRNA genes, and unlike most ordinary genes, GAM169 precursor RNA does not encode a protein. A nucleotide sequence identical or highly similar to the nucleotide sequence of GAM169 precursor RNA is designated SEQ ID:55, and is provided hereinbelow with reference to the sequence listing part.

GAM169 precursor RNA folds onto itself, forming GAM169 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM169 precursor RNA folds onto itself, forming GAM169 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM169 precursor RNA, designated SEQ-ID:55, and a schematic representation of a predicted secondary folding of GAM169 folded precursor RNA are further described with reference to Table 2, hereby incorporated by reference.

An enzyme complex designated DICER COMPLEX, 'dices' the GAM169 folded precursor RNA into GAM169 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM169 RNA is designated SEQ ID:365, and is provided hereinbelow with references to the sequence listing part and Table 3, hereby incorporated by reference.

GAM169 target gene, herein designated TARGET GENE, encodes a corresponding messenger RNA, GAM169 target RNA, herein designated GAM TARGET RNA. GAM169 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM169 RNA, herein designated GAM RNA, binds complementarily to one or more target binding sites located in untranslated regions of GAM169 target RNA, herein designated GAM TARGET RNA. This complementary binding is due to the fact that the nucleotide sequence of GAM169 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM169 RNA may have a different number of target binding sites in untranslated regions of a GAM169 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM169 RNA, herein designated GAM RNA, to target binding sites on GAM169 target RNA, herein designated GAM TARGET RNA, such as BINDING SITE I, BINDING SITE II and BINDING SITE III, inhibits translation of GAM169 target RNA into GAM169 target protein, herein designated GAM TARGET PROTEIN. GAM target protein is therefore outlined by a broken line.

It is appreciated that GAM169 target gene, herein designated TARGET GENE, in fact represents a plurality of GAM169 target genes. The mRNA of each one of this plurality of GAM169 target genes comprises one or more target binding sites, each having a nucleotide sequence which is at least partly complementary to GAM169 RNA, herein designated GAM RNA, and which when bound by GAM169 RNA causes inhibition of translation of respective one or more GAM169 target proteins.

It is further appreciated by one skilled in the art that the mode of translational inhibition illustrated by FIG. 8 with specific reference to translational inhibition exerted by GAM169 gene, herein designated GAM GENE, on one or more GAM169 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM169 correlate with, and may be deduced from, the identity of the target genes which GAM169 binds and inhibits, and the function of these target genes, as elaborated hereinbelow.

B29 (Accession NM_031939.2) is a GAM169 target gene, herein designated TARGET GENE. B29 BINDING SITE is a target binding site found in the 3' untranslated region of mRNA encoded by B29, corresponding to a target binding site such as BINDING SITE I, BINDING SITE II or BINDING SITE III of FIG. 8. Table 4 illustrates the complementarity of the nucleotide sequences of B29 BINDING SITE, designated SEQ ID:9748, to the nucleotide sequence of GAM169 RNA, herein designated GAM RNA, also designated SEQ ID:365.

A function of GAM169 is therefore inhibition of B29 (Accession NM_031939.2). Accordingly, utilities of GAM169 include diagnosis, prevention and treatment of diseases and clinical conditions associated with B29.

BCMP1 (Accession NM_031442.1) is another GAM169 target gene, herein designated TARGET GENE. BCMP1 BINDING SITE is a target binding site found in the 3' untranslated region of mRNA encoded by BCMP1, corresponding to a target binding site such as BINDING SITE I, BINDING SITE II or BINDING SITE III of FIG. 8. Table 4 illustrates the complementarity of the nucleotide sequences of BCMP1 BINDING SITE, designated SEQ ID:8815, to the nucleotide sequence of GAM169 RNA, herein designated GAM RNA, also designated SEQ ID:365.

Another function of GAM169 is therefore inhibition of BCMP1 (Accession NM_031442.1). Accordingly, utilities of GAM169 include diagnosis, prevention and treatment of diseases and clinical conditions associated with BCMP1.

Cyclin m4 (CNNM4, Accession NM_020184.1) is another GAM169 target gene, herein designated TARGET GENE. CNNM4 BINDING SITE is a target binding site found in the 3' untranslated region of mRNA encoded by CNNM4, corresponding to a target binding site such as BINDING SITE I, BINDING SITE II or BINDING SITE III of FIG. 8. Table 4 illustrates the complementarity of the nucleotide sequences of CNNM4 BINDING SITE, designated SEQ ID:18090, to the nucleotide sequence of GAM169 RNA, herein designated GAM RNA, also designated SEQ ID:365.

Another function of GAM169 is therefore inhibition of Cyclin m4 (CNNM4, Accession NM_020184.1). Accordingly, utilities of GAM169 include diagnosis, prevention and treatment of diseases and clinical conditions associated with CNNM4.

Collagen, type i, alpha 1 (COL1A1, Accession NM_000088.2) is another GAM169 target gene, herein designated TARGET GENE. COL1A1 BINDING SITE is a target binding site found in the 3' untranslated region of mRNA encoded by COL1A1, corresponding to a target binding site such as BINDING SITE I, BINDING SITE II or BINDING SITE III of FIG. 8. Table 4 illustrates the complementarity of the nucleotide sequences of COL1A1 BINDING SITE, designated SEQ ID:16271, to the nucleotide sequence of GAM169 RNA, herein designated GAM RNA, also designated SEQ ID:365.

Another function of GAM169 is therefore inhibition of Collagen, type i, alpha 1 (COL1A1, Accession NM_000088.2). Accordingly, utilities of GAM169 include diagnosis, prevention and treatment of diseases and clinical conditions associated with COL1A1.

Ferrochelatase (protoporphyria) (FECH, Accession NM_000140.1) is another GAM169 target gene, herein designated TARGET GENE. FECH BINDING SITE is a target binding site found in the 3' untranslated region of mRNA encoded by FECH, corresponding to a target binding site such as BINDING SITE I, BINDING SITE II or BINDING SITE III of FIG. 8. Table 4 illustrates the complementarity of the nucleotide sequences of FECH BINDING SITE, designated SEQ ID:2667, to the nucleotide sequence of GAM169 RNA, herein designated GAM RNA, also designated SEQ ID:365.

Another function of GAM169 is therefore inhibition of Ferrochelatase (protoporphyria) (FECH, Accession NM_000140.1). Accordingly, utilities of GAM169 include diagnosis, prevention and treatment of diseases and clinical conditions associated with FECH.

FLJ11160 (Accession) is another GAM169 target gene, herein designated TARGET GENE. FLJ11160 BINDING SITE is a target binding site found in the 3' untranslated region of mRNA encoded by FLJ11160, corresponding to a target binding site such as BINDING SITE I, BINDING SITE II or BINDING SITE III of FIG. 8. Table 4 illustrates the complementarity of the nucleotide sequences of FLJ11160 BINDING SITE, designated SEQ ID:409, to the nucleotide sequence of GAM169 RNA, herein designated GAM RNA, also designated SEQ ID:365.

Another function of GAM169 is therefore inhibition of FLJ11160 (Accession). Accordingly, utilities of GAM169 include diagnosis, prevention and treatment of diseases and clinical conditions associated with FLJ11160.

FLJ14950 (Accession) is another GAM169 target gene, herein designated TARGET GENE. FLJ14950 BINDING SITE is a target binding site found in the 3' untranslated region of mRNA encoded by FLJ14950, corresponding to a target binding site such as BINDING SITE I, BINDING SITE II or BINDING SITE III of FIG. 8. Table 4 illustrates the complementarity of the nucleotide sequences of FLJ14950 BINDING SITE, designated SEQ ID:12773, to the nucleotide sequence of GAM169 RNA, herein designated GAM RNA, also designated SEQ ID:365.

Another function of GAM169 is therefore inhibition of FLJ14950 (Accession). Accordingly, utilities of GAM169 include diagnosis, prevention and treatment of diseases and clinical conditions associated with FLJ14950.

Glucose-6-phosphatase, catalytic (glycogen storage disease type i, von gierke disease) (G6PC, Accession NM_000151.1) is another GAM169 target gene, herein designated TARGET GENE. G6PC BINDING SITE is a target binding site found in the 3' untranslated region of mRNA encoded by G6PC, corresponding to a target binding site such as BINDING SITE I, BINDING SITE II or BINDING SITE III of FIG. 8. Table 4 illustrates the complementarity of the nucleotide sequences of G6PC BINDING SITE, designated SEQ ID:19886, to the nucleotide sequence of GAM169 RNA, herein designated GAM RNA, also designated SEQ ID:365.

Another function of GAM169 is therefore inhibition of Glucose-6-phosphatase, catalytic (glycogen storage disease type i, von gierke disease) (G6PC, Accession NM_000151.1). Accordingly, utilities of GAM169 include diagnosis, prevention and treatment of diseases and clinical conditions associated with G6PC.

HRLP5 (Accession NM_054108.1) is another GAM169 target gene, herein designated TARGET GENE. HRLP5 BINDING SITE is a target binding site found in the 3' untranslated region of mRNA encoded by HRLP5, corresponding to a target binding site such as BINDING SITE I, BINDING SITE II or BINDING SITE III of FIG. 8. Table 4 illustrates the complementarity of the nucleotide sequences of HRLP5 BINDING SITE, designated SEQ ID:7902, to the nucleotide sequence of GAM169 RNA, herein designated GAM RNA, also designated SEQ ID:365.

Another function of GAM169 is therefore inhibition of HRLP5 (Accession NM_054108.1). Accordingly, utilities of GAM169 include diagnosis, prevention and treatment of diseases and clinical conditions associated with HRLP5.

5-hydroxytryptamine (serotonin) receptor 3a (HTR3A, Accession NM_000869.1) is another GAM169 target gene, herein designated TARGET GENE. HTR3A BINDING SITE is a target binding site found in the 3' untranslated region of mRNA encoded by HTR3A, corresponding to a target binding site such as BINDING SITE I, BINDING SITE II or BINDING SITE III of FIG. 8. Table 4 illustrates the complementarity of the nucleotide sequences of HTR3A BINDING SITE, designated SEQ ID:7644, to the nucleotide sequence of GAM169 RNA, herein designated GAM RNA, also designated SEQ ID:365.

Another function of GAM169 is therefore inhibition of 5-hydroxytryptamine (serotonin) receptor 3a (HTR3A, Accession NM_000869.1). Accordingly, utilities of GAM169 include diagnosis, prevention and treatment of diseases and clinical conditions associated with HTR3A.

Iduronate 2-sulfatase (hunter syndrome) (IDS, Accession NM_000202.2) is another GAM169 target gene, herein designated TARGET GENE. IDS BINDING SITE is a target binding site found in the 3' untranslated region of multiple transcripts of mRNA encoded by IDS, corresponding to a target binding site such as BINDING SITE I, BINDING SITE II or BINDING SITE III of FIG. 8. Table 4 illustrates the complementarity of the nucleotide sequences of IDS BINDING SITE, designated SEQ ID:2619, to the nucleotide sequence of GAM169 RNA, herein designated GAM RNA, also designated SEQ ID:365.

Another function of GAM169 is therefore inhibition of Iduronate 2-sulfatase (hunter syndrome) (IDS, Accession NM_000202.2). Accordingly, utilities of GAM169 include diagnosis, prevention and treatment of diseases and clinical conditions associated with IDS.

Potassium channel, subfamily k, member 7 (KCNK7, Accession NM_033347.1) is another GAM169 target gene, herein designated TARGET GENE. KCNK7 BINDING SITE is a target binding site found in the 5' untranslated region of multiple transcripts of mRNA encoded by KCNK7, corresponding to a target binding site such as BINDING SITE I, BINDING SITE II or BINDING SITE III of FIG. 8. Table 4 illustrates the complementarity of the nucleotide sequences of KCNK7 BINDING SITE, designated SEQ ID:10339, to the nucleotide sequence of GAM169 RNA, herein designated GAM RNA, also designated SEQ ID:365.

Another function of GAM169 is therefore inhibition of Potassium channel, subfamily k, member 7 (KCNK7, Accession NM_033347.1). Accordingly, utilities of GAM169 include diagnosis, prevention and treatment of diseases and clinical conditions associated with KCNK7.

KIAA0630 (Accession) is another GAM169 target gene, herein designated TARGET GENE. KIAA0630 BINDING SITE is a target binding site found in the 3' untranslated region of mRNA encoded by KIAA0630, corresponding to a target binding site such as BINDING SITE I, BINDING SITE II or BINDING SITE III of FIG. 8. Table 4 illustrates the complementarity of the nucleotide sequences of KIAA0630 BINDING SITE, designated SEQ ID:19492, to the nucleotide sequence of GAM169 RNA, herein designated GAM RNA, also designated SEQ ID:365.

Another function of GAM169 is therefore inhibition of KIAA0630 (Accession). Accordingly, utilities of GAM169 include diagnosis, prevention and treatment of diseases and clinical conditions associated with KIAA0630.

KIAA1061 (Accession XM_048786.5) is another GAM169 target gene, herein designated TARGET GENE. KIAA1061 BINDING SITE is a target binding site found in the 3' untranslated region of mRNA encoded by KIAA1061, corresponding to a target binding site such as BINDING SITE I, BINDING SITE II or BINDING SITE III of FIG. 8. Table 4 illustrates the complementarity of the nucleotide sequences of KIAA1061 BINDING SITE, designated SEQ ID:14654, to the nucleotide sequence of GAM169 RNA, herein designated GAM RNA, also designated SEQ ID:365.

Another function of GAM169 is therefore inhibition of KIAA1061 (Accession XM_048786.5). Accordingly, utilities of GAM169 include diagnosis, prevention and treatment of diseases and clinical conditions associated with KIAA1061.

KIAA1577 (Accession XM_035299.2) is another GAM169 target gene, herein designated TARGET GENE. KIAA1577 BINDING SITE is a target binding site found in the 3' untranslated region of mRNA encoded by KIAA1577, corresponding to a target binding site such as BINDING SITE I, BINDING SITE II or BINDING SITE III of FIG. 8. Table 4 illustrates the complementarity of the nucleotide sequences of KIAA1577 BINDING SITE, designated SEQ ID:4142, to the nucleotide sequence of GAM169 RNA, herein designated GAM RNA, also designated SEQ ID:365.

Another function of GAM169 is therefore inhibition of KIAA1577 (Accession XM_035299.2). Accordingly, utilities of GAM169 include diagnosis, prevention and treatment of diseases and clinical conditions associated with KIAA1577.

Kynurenine 3-monooxygenase (kynurenine 3-hydroxylase) (KMO, Accession NM_003679.1) is another GAM169 target gene, herein designated TARGET GENE. KMO BINDING SITE is a target binding site found in the 3' untranslated region of mRNA encoded by KMO, corresponding to a target binding site such as BINDING SITE I, BINDING SITE II or BINDING SITE III of FIG. 8. Table 4 illustrates the complementarity of the nucleotide sequences of KMO BINDING SITE, designated SEQ ID:6772, to the nucleotide sequence of GAM169 RNA, herein designated GAM RNA, also designated SEQ ID:365.

Another function of GAM169 is therefore inhibition of Kynurenine 3-monooxygenase (kynurenine 3-hydroxylase) (KMO, Accession NM_003679.1), a gene which may play a role in encephalic photoreception. Accordingly, utilities of GAM169 include diagnosis, prevention and treatment of diseases and clinical conditions associated with KMO.

The function of KMO and its association with various diseases and clinical conditions, has been established by previous studies, as described hereinabove with reference to GAM30.1. Left-right determination, factor b (LEFTB, Accession NM_020997.2) is another GAM169 target gene, herein designated TARGET GENE. LEFTB BINDING SITE is a target binding site found in the 3' untranslated region of mRNA encoded by LEFTB, corresponding to a target binding site such as BINDING SITE I, BINDING SITE II or BINDING SITE III of FIG. 8. Table 4 illustrates the complementarity of the nucleotide sequences of LEFTB BINDING SITE, designated SEQ ID:1639, to the nucleotide sequence of GAM169 RNA, herein designated GAM RNA, also designated SEQ ID:365.

Another function of GAM169 is therefore inhibition of Left-right determination, factor b (LEFTB, Accession NM_020997.2). Accordingly, utilities of GAM169 include diagnosis, prevention and treatment of diseases and clinical conditions associated with LEFTB.

LOC116211 (Accession NM_138461.1) is another GAM169 target gene, herein designated TARGET GENE. LOC116211 BINDING SITE is a target binding site found in the 3' untranslated region of mRNA encoded by LOC116211, corresponding to a target binding site such as BINDING SITE I, BINDING SITE II or BINDING SITE III of FIG. 8. Table 4 illustrates the complementarity of the nucleotide sequences of LOC116211 BINDING SITE, designated SEQ ID:18253, to the nucleotide sequence of GAM169 RNA, herein designated GAM RNA, also designated SEQ ID:365.

Another function of GAM169 is therefore inhibition of LOC116211 (Accession NM_138461.1). Accordingly, utilities of GAM169 include diagnosis, prevention and treatment of diseases and clinical conditions associated with LOC116211.

LOC145757 (Accession XM_085227.1) is another GAM169 target gene, herein designated TARGET GENE. LOC145757 BINDING SITE is a target binding site found in the 3' untranslated region of mRNA encoded by LOC145757, corresponding to a target binding site such as BINDING SITE I, BINDING SITE II or BINDING SITE III of FIG. 8. Table 4 illustrates the complementarity of the nucleotide sequences of LOC145757 BINDING SITE, designated SEQ ID:897, to the nucleotide sequence of GAM169 RNA, herein designated GAM RNA, also designated SEQ ID:365.

Another function of GAM169 is therefore inhibition of LOC145757 (Accession XM_085227.1). Accordingly, utilities of GAM169 include diagnosis, prevention and treatment of diseases and clinical conditions associated with LOC145757.

LOC146512 (Accession) is another GAM169 target gene, herein designated TARGET GENE. LOC146512 BINDING SITE is a target binding site found in the 3' untranslated region of mRNA encoded by LOC146512, corresponding to a target binding site such as BINDING SITE I, BINDING SITE II or BINDING SITE III of FIG. 8. Table 4 illustrates the complementarity of the nucleotide sequences of LOC146512 BINDING SITE, designated SEQ ID:9963, to the nucleotide sequence of GAM169 RNA, herein designated GAM RNA, also designated SEQ ID:365.

Another function of GAM169 is therefore inhibition of LOC146512 (Accession). Accordingly, utilities of GAM169 include diagnosis, prevention and treatment of diseases and clinical conditions associated with LOC146512.

LOC151124 (Accession XM_098006.2) is another GAM169 target gene, herein designated TARGET GENE. LOC151124 BINDING SITE is a target binding site found in the 5' untranslated region of mRNA encoded by LOC151124, corresponding to a target binding site such as BINDING SITE I, BINDING SITE II or BINDING SITE III of FIG. 8. Table 4 illustrates the complementarity of the nucleotide sequences of LOC151124 BINDING SITE, designated SEQ ID:13174, to the nucleotide sequence of GAM169 RNA, herein designated GAM RNA, also designated SEQ ID:365.

Another function of GAM169 is therefore inhibition of LOC151124 (Accession XM_098006.2). Accordingly, utilities of GAM169 include diagnosis, prevention and treatment of diseases and clinical conditions associated with LOC151124.

LOC151723 (Accession XM_093395.6) is another GAM169 target gene, herein designated TARGET GENE. LOC151723 BINDING SITE is a target binding site found in the 5' untranslated region of mRNA encoded by LOC151723, corresponding to a target binding site such as BINDING SITE I, BINDING SITE II or BINDING SITE III of FIG. 8. Table 4 illustrates the complementarity of the nucleotide sequences of LOC151723 BINDING SITE, designated SEQ ID:11154, to the nucleotide sequence of GAM169 RNA, herein designated GAM RNA, also designated SEQ ID:365.

Another function of GAM169 is therefore inhibition of LOC151723 (Accession XM_093395.6). Accordingly, utilities of GAM169 include diagnosis, prevention and treatment of diseases and clinical conditions associated with LOC151723.

LOC157931 (Accession XM_098845.1) is another GAM169 target gene, herein designated TARGET GENE. LOC157931 BINDING SITE is a target binding site found in the 3' untranslated region of mRNA encoded by LOC157931, corresponding to a target binding site such as BINDING SITE I, BINDING SITE II or BINDING SITE III of FIG. 8. Table 4 illustrates the complementarity of the nucleotide sequences of LOC157931 BINDING SITE, designated SEQ ID:8404, to the nucleotide sequence of GAM169 RNA, herein designated GAM RNA, also designated SEQ ID:365.

Another function of GAM169 is therefore inhibition of LOC157931 (Accession XM_098845.1). Accordingly, utilities of GAM169 include diagnosis, prevention and treatment of diseases and clinical conditions associated with LOC157931.

LOC197259 (Accession) is another GAM169 target gene, herein designated TARGET GENE. LOC197259 BINDING SITE is a target binding site found in the 3' untranslated region of mRNA encoded by LOC197259, corresponding to a target binding site such as BINDING SITE I, BINDING SITE II or BINDING SITE III of FIG. 8. Table 4 illustrates the complementarity of the nucleotide sequences of LOC197259 BINDING SITE, designated SEQ ID:18112, to the nucleotide sequence of GAM169 RNA, herein designated GAM RNA, also designated SEQ ID:365.

Another function of GAM169 is therefore inhibition of LOC197259 (Accession). Accordingly, utilities of GAM169 include diagnosis, prevention and treatment of diseases and clinical conditions associated with LOC197259.

LOC220763 (Accession XM_055551.4) is another GAM169 target gene, herein designated TARGET GENE. LOC220763 BINDING SITE is a target binding site found in the 5' untranslated region of mRNA encoded by LOC220763, corresponding to a target binding site such as BINDING SITE I, BINDING SITE II or BINDING SITE III of FIG. 8. Table 4 illustrates the complementarity of the nucleotide sequences of LOC220763 BINDING SITE, designated SEQ ID:7258, to the nucleotide sequence of GAM169 RNA, herein designated GAM RNA, also designated SEQ ID:365.

Another function of GAM169 is therefore inhibition of LOC220763 (Accession XM_055551.4). Accordingly, utilities of GAM169 include diagnosis, prevention and treatment of diseases and clinical conditions associated with LOC220763.

LOC222068 (Accession XM_166556.3) is another GAM169 target gene, herein designated TARGET GENE. LOC222068 BINDING SITE is a target binding site found in the 3' untranslated region of mRNA encoded by LOC222068, corresponding to a target binding site such as BINDING SITE I, BINDING SITE II or BINDING SITE III of FIG. 8. Table 4 illustrates the complementarity of the nucleotide sequences of LOC222068 BINDING SITE, designated SEQ ID:15325, to the nucleotide sequence of GAM169 RNA, herein designated GAM RNA, also designated SEQ ID:365.

Another function of GAM169 is therefore inhibition of LOC222068 (Accession XM_166556.3). Accordingly, utilities of GAM169 include diagnosis, prevention and treatment of diseases and clinical conditions associated with LOC222068.

LOC257486 (Accession) is another GAM169 target gene, herein designated TARGET GENE. LOC257486 BINDING SITE is a target binding site found in the 3' untranslated region of mRNA encoded by LOC257486, corresponding to a target binding site such as BINDING SITE I, BINDING SITE II or BINDING SITE III of FIG. 8. Table 4 illustrates the complementarity of the nucleotide sequences of LOC257486 BINDING SITE, designated SEQ ID:10209, to the nucleotide sequence of GAM169 RNA, herein designated GAM RNA, also designated SEQ ID:365.

Another function of GAM169 is therefore inhibition of LOC257486 (Accession). Accordingly, utilities of GAM169 include diagnosis, prevention and treatment of diseases and clinical conditions associated with LOC257486.

Leucine-rich repeat protein, neuronal 3 (LRRN3, Accession) is another GAM169 target gene, herein designated TARGET GENE. LRRN3 BINDING SITE is a target binding site found in the 5' untranslated region of mRNA encoded by LRRN3, corresponding to a target binding site such as BINDING SITE I, BINDING SITE II or BINDING SITE III of FIG. 8. Table 4 illustrates the complementarity of the nucleotide sequences of LRRN3 BINDING SITE, designated SEQ ID:11257, to the nucleotide sequence of GAM169 RNA, herein designated GAM RNA, also designated SEQ ID:365.

Another function of GAM169 is therefore inhibition of Leucine-rich repeat protein, neuronal 3 (LRRN3, Accession). Accordingly, utilities of GAM169 include diagnosis, prevention and treatment of diseases and clinical conditions associated with LRRN3.

MGC5466 (Accession NM_030922.1) is another GAM169 target gene, herein designated TARGET GENE. MGC5466 BINDING SITE is a target binding site found in the 5' untranslated region of mRNA encoded by MGC5466, corresponding to a target binding site such as BINDING SITE I, BINDING SITE II or BINDING SITE III of FIG. 8. Table 4 illustrates the complementarity of the nucleotide sequences of MGC5466 BINDING SITE, designated SEQ ID:9839, to the nucleotide sequence of GAM169 RNA, herein designated GAM RNA, also designated SEQ ID:365.

Another function of GAM169 is therefore inhibition of MGC5466 (Accession NM_030922.1). Accordingly, utilities of GAM169 include diagnosis, prevention and treatment of diseases and clinical conditions associated with MGC5466.

MTCH1 (Accession NM_014341.1) is another GAM169 target gene, herein designated TARGET GENE. MTCH1 BINDING SITE is a target binding site found in the 3' untranslated region of mRNA encoded by MTCH1, corresponding to a target binding site such as BINDING SITE I, BINDING SITE II or BINDING SITE III of FIG. 8. Table 4 illustrates the complementarity of the nucleotide sequences of MTCH1 BINDING SITE, designated SEQ ID:5849, to the nucleotide sequence of GAM169 RNA, herein designated GAM RNA, also designated SEQ ID:365.

Another function of GAM169 is therefore inhibition of MTCH1 (Accession NM_014341.1). Accordingly, utilities of GAM169 include diagnosis, prevention and treatment of diseases and clinical conditions associated with MTCH1.

Natriuretic peptide receptor a/guanylate cyclase a (atrionatriuretic peptide receptor a) (NPR1, Accession NM_000906.1) is another GAM169 target gene, herein designated TARGET GENE. NPR1 BINDING SITE is a target binding site found in the 3' untranslated region of mRNA encoded by NPR1, corresponding to a target binding site such as BINDING SITE I, BINDING SITE II or BINDING SITE III of FIG. 8. Table 4 illustrates the complementarity of the nucleotide sequences of NPR1 BINDING SITE, designated SEQ ID:2666, to the nucleotide sequence of GAM169 RNA, herein designated GAM RNA, also designated SEQ ID:365.

Another function of GAM169 is therefore inhibition of Natriuretic peptide receptor a/guanylate cyclase a (atrionatriuretic peptide receptor a) (NPR1, Accession NM_000906.1), a gene which has guanylate cyclase activity on binding of anf. Accordingly, utilities of GAM169 include diagnosis, prevention and treatment of diseases and clinical conditions associated with NPR1.

The function of NPR1 has been established by previous studies. The precursor of atrial natriuretic peptide (ANP; 108780) is produced and stored mainly in the right atrium of the heart (see OMIM Ref. No. Oliver et al., 1997). ANP formed from this precursor is released in response to atrial stretch. Once in the circulation, ANP binds to the natriuretic peptide receptor A (ANPRA, or NPR1), also known as guanylate cyclase A (or GC-A), mainly in the kidney, vascular tissue, and adrenal gland. This binding induces an increase in intracellular cGMP and initiates natriuresis, diuresis, and vasodilation, all of which contribute to lowering blood pressure. 'B- type' natriuretic peptide, a structurally related peptide formed mainly in the cardiac ventricles, also acts through ANPRA and has effects similar to ANP. Lowe et al. (1990) assigned the ANPRA gene to 1q12-qter by PCR analysis of genomic DNA from somatic cell hybrids. By in situ hybridization, the gene was further localized to 1q21-q22.

Animal model experiments lend further support to the function of NPR1. To study the role of NPRA in the regulation of blood pressure and in the cardiovascular response to sustained hypertension, Oliver et al. (1997) made mice completely lacking this receptor. They found that mice lacking a functional Npr1 gene coding for NPRA had elevated blood pressures and heart exhibiting marked hypertrophy with interstitial fibrosis resembling that seen in human hypertensive heart disease. Echocardiographic evaluation of the mice demonstrated a compensated state of systemic hypertension in which cardiac hypertrophy and dilatation were evident but with no reduction in ventricular performance. Nevertheless, sudden death, with morphologic evidence indicative in some animals of congestive heart failure and in others of aortic dissection, occurred in all 15 male mice lacking Npr1 before 6 months of age, and in 1 of 16 females in this study.

It is appreciated that the abovementioned animal model for NPR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lowe, D. G.; Klisak, I.; Sparkes, R. S.; Mohandas, T.; Goeddel, D. V.: Chromosomal distribution of three members of the human natriuretic peptide receptor/guanylyl cyclase gene family. Genomics 8:304-312, 1990; and Oliver, P. M.; Fox, J. E.; Kim, R.; Rockman, H. A.; Kim, H.-S.; Reddick, R. L.; Pandey, K. N.; Milgram, S. L.; Smithies, O.; Maeda, N.: Hypertension, cardiac hypertrophy, and sudden dea.

Further studies establishing the function and utilities of NPR1 are found in John Hopkins OMIM database record ID 108960, and in cited publications listed in Table 5, which are hereby incorporated by reference.phorbolin-1 (Accession) is another GAM169 target gene, herein designated TARGET GENE. phorbolin-1 BINDING SITE is a target binding site found in the 3' untranslated region of mRNA encoded by phorbolin-1, corresponding to a target binding site such as BINDING SITE I, BINDING SITE II or BINDING SITE III of FIG. 8. Table 4 illustrates the complementarity of the nucleotide sequences of phorbolin-1 BINDING SITE, designated SEQ ID:1815, to the nucleotide sequence of GAM169 RNA, herein designated GAM RNA, also designated SEQ ID:365.

Another function of GAM169 is therefore inhibition of phorbolin-1 (Accession). Accordingly, utilities of GAM169 include diagnosis, prevention and treatment of diseases and clinical conditions associated with phorbolin-1.

PP1665 (Accession NM_030792.2) is another GAM169 target gene, herein designated TARGET GENE. PP1665 BINDING SITE is a target binding site found in the 5' untranslated region of mRNA encoded by PP1665, corresponding to a target binding site such as BINDING SITE I, BINDING SITE II or BINDING SITE III of FIG. 8. Table 4 illustrates the complementarity of the nucleotide sequences of PP1665 BINDING SITE, designated SEQ ID:5088, to the nucleotide sequence of GAM169 RNA, herein designated GAM RNA, also designated SEQ ID:365.

Another function of GAM169 is therefore inhibition of PP1665 (Accession NM_030792.2). Accordingly, utilities of GAM169 include diagnosis, prevention and treatment of diseases and clinical conditions associated with PP1665.

Peroxisome proliferative activated receptor, gamma, coactivator 1 (PPARGC1, Accession NM_013261.2) is another GAM169 target gene, herein designated TARGET GENE. PPARGC1 BINDING SITE is a target binding site found in the 3' untranslated region of mRNA encoded by PPARGC1, corresponding to a target binding site such as BINDING SITE I, BINDING SITE II or BINDING SITE III of FIG. 8. Table 4 illustrates the complementarity of the nucleotide sequences of PPARGC1 BINDING SITE, designated SEQ ID:16406, to the nucleotide sequence of GAM169 RNA, herein designated GAM RNA, also designated SEQ ID:365.

Another function of GAM169 is therefore inhibition of Peroxisome proliferative activated receptor, gamma, coactivator 1 (PPARGC1, Accession NM_013261.2), a gene which may play a role in insulin sensitivity and thermogenesis and therefore may be associated with Familial partial lipodystrophy and type ii diabetes. Accordingly, utilities of GAM169 include diagnosis, prevention and treatment of Familial partial lipodystrophy and type ii diabetes, and of other diseases and clinical conditions associated with PPARGC1.

The function of PPARGC1 has been established by previous studies. Adaptive thermogenesis is an important component of energy homeostasis and a metabolic defense against obesity, which is characterized by a chronic imbalance between energy intake and expenditure. Part of energy expenditure results from a leaking of protons across the mitochondrial inner membrane which leads to energy dissipation because of uncoupling of oxygen consumption to ATP synthesis. Three mitochondrial uncoupling proteins, UCP1 (OMIM Ref. No. 113730), UCP2 (OMIM Ref. No. 601693), and UCP3 (OMIM Ref. No. 602044), are candidates to explain the proton leak. The most compelling evidence for a direct role of uncoupling proteins in the proton leak comes from data on brown fat-specific UCP1. During cold exposure, energy dissipation is increased through brown adipose tissue (BAT) hypertrophy, biogenesis of mitochondria, and increased expression and activation of UCP1. Data pointed to peroxisome proliferator-activated receptor-gamma (PPARG; 601487) as a transcriptional regulator of uncoupling protein expression. PPAR-gamma is a nuclear receptor activated by fatty acids and eicosanoids which plays a major role in adipocyte differentiation. In brown fat cells, PPARG activates an enhancer of the UCP1 gene promoter. Puigserver et al. (1998) cloned a novel transcription coactivator of nuclear receptors, termed Pgc1, from a mouse brown fat cDNA library. Pgc1 mRNA expression was dramatically elevated upon cold exposure of mice in both brown fat and skeletal muscle, key thermogenic tissues. Pgc1 greatly increased the transcriptional activity of Ppar-gamma (OMIM Ref. No. 601487) and thyroid hormone receptor (see OMIM Ref. No. 190120) on the uncoupling protein Ucp1 (OMIM Ref. No. 113730) promoter. Ectopic expression of Pgc1 in white adipose cells activated expression of Ucp1 and key mitochondrial enzymes of the respiratory chain, and increased the cellular content of mitochondrial DNA. Puigserver et al. (1998) suggested that PGC1 plays a key role in linking nuclear receptors to the transcriptional program of adaptive thermogenesis.

Animal model experiments lend further support to the function of PPARGC1. Herzig et al. (2001) demonstrated that mice carrying a targeted disruption of the cAMP response element-binding (CREB) protein gene (OMIM Ref. No. 123810), or overexpressing a dominant-negative CREB inhibitor, exhibit fasting hyperglycemia and reduced expression of gluconeogenic enzymes. CREB was found to induce expression of the gluconeogenic program through the nuclear receptor coactivator PGC1, which was demonstrated to be a direct target for CREB regulation in vivo. Overexpression of PGC1 in CREB-deficient mice restored glucose homeostasis and rescued the expression of gluconeogenic genes. In transient assay, PGC1 potentiated glucocorticoid induction of the gene for PEPCK, the rate-limiting enzyme in gluconeogenesis. PGC1 promotes cooperativity between cAMP and glucocorticoid signaling pathways during hepatic gluconeogenesis. Fasting hyperglycemia is strongly correlated with type II diabetes (OMIM Ref. No. 125853), so Herzig et al. (2001) concluded that the activation of PGC1 by CREB in liver contributes importantly to the pathogenesis of this disease.

It is appreciated that the abovementioned animal model for PPARGC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Puigserver, P.; Wu, Z.; Park, C. W.; Graves, R.; Wright, M.; Spiegelman, B. M.: A cold-inducible coactivator of nuclear receptors linked to adaptive thermogenesis. Cell 92:829-839, 1998; and Herzig, S.; Long, F.; Jhala, U.S.; Hedrick, S.; Quinn, R.; Bauer, A.; Rudolph, D.; Schutz, G.; Yoon, C.; Puigserver, P.; Spiegelman, B.; Montminy, M.: CREB regulates hepatic gluconeoge.

Further studies establishing the function and utilities of PPARGC1 are found in John Hopkins OMIM database record ID 604517, and in cited publications listed in Table 5, which are hereby incorporated by reference. Regulator of g-protein signalling 19 interacting protein 1 (RGS19IP1, Accession NM_005716.1) is another GAM169 target gene, herein designated TARGET GENE. RGS19IP1 BINDING SITE is a target binding site found in the 3' untranslated region of mRNA encoded by RGS19IP1, corresponding to a target binding site such as BINDING SITE I, BINDING SITE II or BINDING SITE III of FIG. 8. Table 4 illustrates the complementarity of the nucleotide sequences of RGS19IP1 BINDING SITE, designated SEQ ID:5745, to the nucleotide sequence of GAM169 RNA, herein designated GAM RNA, also designated SEQ ID:365.

Another function of GAM169 is therefore inhibition of Regulator of g-protein signalling 19 interacting protein 1 (RGS19IP1, Accession NM_005716.1), a gene which is involved in g protein-linked signaling. Accordingly, utilities of GAM169 include diagnosis, prevention and treatment of diseases and clinical conditions associated with RGS19IP1.

The function of RGS19IP1 and its association with various diseases and clinical conditions, has been established by previous studies, as described hereinabove with reference to GAM129.1. RPF-1 (Accession NM_007252.1) is another GAM169 target gene, herein designated TARGET GENE. RPF-1 BINDING SITE is a target binding site found in the 5' untranslated region of mRNA encoded by RPF-1, corresponding to a target binding site such as BINDING SITE I, BINDING SITE II or BINDING SITE III of FIG. 8. Table 4 illustrates the complementarity of the nucleotide sequences of RPF-1 BINDING SITE, designated SEQ ID:12622, to the nucleotide sequence of GAM169 RNA, herein designated GAM RNA, also designated SEQ ID:365.

Another function of GAM169 is therefore inhibition of RPF-1 (Accession NM_007252.1). Accordingly, utilities of GAM169 include diagnosis, prevention and treatment of diseases and clinical conditions associated with RPF-1.

Src-like-adaptor (SLA, Accession NM_006748.1) is another GAM169 target gene, herein designated TARGET GENE. SLA BINDING SITE is a target binding site found in the 3' untranslated region of mRNA encoded by SLA, corresponding to a target binding site such as BINDING SITE I, BINDING SITE II or BINDING SITE III of FIG. 8. Table 4 illustrates the complementarity of the nucleotide sequences of SLA BINDING SITE, designated SEQ ID:4672, to the nucleotide sequence of GAM169 RNA, herein designated GAM RNA, also designated SEQ ID:365.

Another function of GAM169 is therefore inhibition of Src-like-adaptor (SLA, Accession NM_006748.1), a gene which is a negative regulator of T-cell receptor signaling. Accordingly, utilities of GAM169 include diagnosis, prevention and treatment of diseases and clinical conditions associated with SLA.

The function of SLA and its association with various diseases and clinical conditions, has been established by previous studies, as described hereinabove with reference to GAM63.1. Sparc/osteonectin, cwcv and kazal-like domains proteoglycan (testican) (SPOCK, Accession NM_004598.2) is another GAM169 target gene, herein designated TARGET GENE. SPOCK BINDING SITE is a target binding site found in the 3' untranslated region of mRNA encoded by SPOCK, corresponding to a target binding site such as BINDING SITE I, BINDING SITE II or BINDING SITE III of FIG. 8. Table 4 illustrates the complementarity of the nucleotide sequences of SPOCK BINDING SITE, designated SEQ ID:16266, to the nucleotide sequence of GAM169 RNA, herein designated GAM RNA, also designated SEQ ID:365.

Another function of GAM169 is therefore inhibition of Sparc/osteonectin, cwcv and kazal-like domains proteoglycan (testican) (SPOCK, Accession NM_004598.2). Accordingly, utilities of GAM169 include diagnosis, prevention and treatment of diseases and clinical conditions associated with SPOCK.

Ubiquitin-conjugating enzyme e2l 3 (UBE2L3, Accession NM_003347.1) is another GAM169 target gene, herein designated TARGET GENE. UBE2L3 BINDING SITE is a target binding site found in the 3' untranslated region of mRNA encoded by UBE2L3, corresponding to a target binding site such as BINDING SITE I, BINDING SITE II or BINDING SITE III of FIG. 8. Table 4 illustrates the complementarity of the nucleotide sequences of UBE2L3 BINDING SITE, designated SEQ ID:9338, to the nucleotide sequence of GAM169 RNA, herein designated GAM RNA, also designated SEQ ID:365.

Another function of GAM169 is therefore inhibition of Ubiquitin-conjugating enzyme e2l 3 (UBE2L3, Accession NM_003347.1), a gene which catalyzes the covalent attachment of ubiquitin to other proteins. and therefore may be associated with Parkinson disease. Accordingly, utilities of GAM169 include diagnosis, prevention and treatment of Parkinson disease, and of other diseases and clinical conditions associated with UBE2L3.

The function of UBE2L3 has been established by previous studies. Shimura et al. (2001) hypothesized that alpha-synuclein (OMIM Ref. No. 163890) and parkin (OMIM Ref. No. 602544) interact functionally, namely, that parkin ubiquitinates alpha-synuclein normally and that this process is altered in autosomal recessive Parkinson disease (OMIM Ref. No. 600116). Shimura et al. (2001) identified a protein complex in normal human brain that includes parkin as the E3 ubiquitin ligase, UBCH7 as its associated E2 ubiquitin-conjugating enzyme, and a novel 22-kD glycosylated form of alpha-synuclein (alpha-Sp22) as its substrate. In contrast to normal parkin, mutant parkin associated with autosomal recessive Parkinson disease failed to bind alpha-Sp22. In an in vitro ubiquitination assay, alpha-Sp22 was modified by normal, but not mutant, parkin into polyubiquitinated, high molecular weight species. Accordingly, alpha-Sp22 accumulated in a nonubiquitinated form in parkin-deficient Parkinson disease brains. Shimura et al. (2001) concluded that alpha-Sp22 is a substrate for parkin's ubiquitin ligase activity in normal human brain and that loss of parkin function causes pathologic accumulation of alpha-Sp22. These findings demonstrated a critical biochemical reaction between the 2 Parkinson disease-linked gene products and suggested that this reaction underlies the accumulation of ubiquitinated alpha-synuclein in conventional Parkinson disease. By RT-PCR, Moynihan et al. (1998) determined that UBE2L3 is expressed as 4 mRNAs that differ in the length of the 3-prime untranslated region (UTR). Sequence comparisons revealed that the human and mouse UBE2L3 cDNAs share 97% DNA sequence identity in the coding region and 93% identity for 287 nucleotides extending into the 3-prime UTR. The predicted mouse and human UBE2L3 proteins are identical.

Full details of the abovementioned studies are described in the following publications, the disclosure of which are hereby incorporated by reference:

Moynihan, T. P.; Cole, C. G.; Dunham, I.; O'Neil, L.; Markham, A. F.; Robinson, P. A.: Fine-mapping, genomic organization, and transcript analysis of the human ubiquitin-conjugating enzyme gene UBE2L3. Genomics 51:124-127, 1998; and Shimura, H.; Schlossmacher, M. G.; Hattori, N.; Frosch, M. P.; Trockenbacher, A.; Schneider, R.; Mizuno, Y.; Kosik, K. S.; Selkoe, D. J.: Ubiquitination of a new form of alpha-synuclei.

Further studies establishing the function and utilities of UBE2L3 are found in John Hopkins OMIM database record ID 603721, and in cited publications listed in Table 5, which are hereby incorporated by reference. Wd repeat domain 7 (WDR7, Accession NM_015285.1) is another GAM169 target gene, herein designated TARGET GENE. WDR7 BINDING SITE is a target binding site found in the 3' untranslated region of multiple transcripts of mRNA encoded by WDR7, corresponding to a target binding site such as BINDING SITE I, BINDING SITE II or BINDING SITE III of FIG. 8. Table 4 illustrates the complementarity of the nucleotide sequences of WDR7 BINDING SITE, designated SEQ ID:18603, to the nucleotide sequence of GAM169 RNA, herein designated GAM RNA, also designated SEQ ID:365.

Another function of GAM169 is therefore inhibition of Wd repeat domain 7 (WDR7, Accession NM_015285.1). Accordingly, utilities of GAM169 include diagnosis, prevention and treatment of diseases and clinical conditions associated with WDR7.

FIG. 8 further provides a conceptual description of a novel bioinformatically detected of the present invention, referred to here as Genomic Address Messenger 170 (GAM170), which modulates expression of respective target genes thereof, the function and utility of which target genes is known in the art.

GAM170 is a novel bioinformatically detected regulatory, non protein coding, micro RNA (miRNA) gene. The method by which GAM170 was detected is described hereinabove with reference to FIGS. 8-15.

GAM170 gene, herein designated GAM GENE, and GAM170 target gene, herein designated TARGET GENE, are human genes contained in the human genome.

GAM170 gene encodes a GAM170 precursor RNA, herein designated GAM PRECURSOR RNA. Similar to other miRNA genes, and unlike most ordinary genes, GAM170 precursor RNA does not encode a protein. A nucleotide sequence identical or highly similar to the nucleotide sequence of GAM170 precursor RNA is designated SEQ ID:72, and is provided hereinbelow with reference to the sequence listing part.

GAM170 precursor RNA folds onto itself, forming GAM170 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM170 precursor RNA folds onto itself, forming GAM170 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM170 precursor RNA, designated SEQ-ID:72, and a schematic representation of a predicted secondary folding of GAM170 folded precursor RNA are further described with reference to Table 2, hereby incorporated by reference.

An enzyme complex designated DICER COMPLEX, 'dices' the GAM170 folded precursor RNA into GAM170 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM170 RNA is designated SEQ ID:283, and is provided hereinbelow with references to the sequence listing part and Table 3, hereby incorporated by reference.

GAM170 target gene, herein designated TARGET GENE, encodes a corresponding messenger RNA, GAM170 target RNA, herein designated GAM TARGET RNA. GAM170 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM170 RNA, herein designated GAM RNA, binds complementarily to one or more target binding sites located in untranslated regions of GAM170 target RNA, herein designated GAM TARGET RNA. This complementary binding is due to the fact that the nucleotide sequence of GAM170 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM170 RNA may have a different number of target binding sites in untranslated regions of a GAM170 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM170 RNA, herein designated GAM RNA, to target binding sites on GAM170 target RNA, herein designated GAM TARGET RNA, such as BINDING SITE I, BINDING SITE II and BINDING SITE III, inhibits translation of GAM170 target RNA into GAM170 target protein, herein designated GAM TARGET PROTEIN. GAM target protein is therefore outlined by a broken line.

It is appreciated that GAM170 target gene, herein designated TARGET GENE, in fact represents a plurality of GAM170 target genes. The mRNA of each one of this plurality of GAM170 target genes comprises one or more target binding sites, each having a nucleotide sequence which is at least partly complementary to GAM170 RNA, herein designated GAM RNA, and which when bound by GAM170 RNA causes inhibition of translation of respective one or more GAM170 target proteins.

It is further appreciated by one skilled in the art that the mode of translational inhibition illustrated by FIG. 8 with specific reference to translational inhibition exerted by GAM170 gene, herein designated GAM GENE, on one or more GAM170 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM170 correlate with, and may be deduced from, the identity of the target genes which GAM170 binds and inhibits, and the function of these target genes, as elaborated hereinbelow.

LOC121457 (Accession) is a GAM170 target gene, herein designated TARGET GENE. LOC121457 BINDING SITE is a target binding site found in the 3' untranslated region of mRNA encoded by LOC121457, corresponding to a target binding site such as BINDING SITE I, BINDING SITE II or BINDING SITE III of FIG. 8. Table 4 illustrates the complementarity of the nucleotide sequences of LOC121457 BINDING SITE, designated SEQ ID:4519, to the nucleotide sequence of GAM170 RNA, herein designated GAM RNA, also designated SEQ ID:283.

A function of GAM170 is therefore inhibition of LOC121457 (Accession). Accordingly, utilities of GAM170 include diagnosis, prevention and treatment of diseases and clinical conditions associated with LOC121457.

LOC145483 (Accession) is another GAM170 target gene, herein designated TARGET GENE. LOC145483 BINDING SITE is a target binding site found in the 3' untranslated region of mRNA encoded by LOC145483, corresponding to a target binding site such as BINDING SITE I, BINDING SITE II or BINDING SITE III of FIG. 8. Table 4 illustrates the complementarity of the nucleotide sequences of LOC145483 BINDING SITE, designated SEQ ID:5675, to the nucleotide sequence of GAM170 RNA, herein designated GAM RNA, also designated SEQ ID:283.

Another function of GAM170 is therefore inhibition of LOC145483 (Accession). Accordingly, utilities of GAM170 include diagnosis, prevention and treatment of diseases and clinical conditions associated with LOC145483.

LOC150113 (Accession) is another GAM170 target gene, herein designated TARGET GENE. LOC150113 BINDING SITE is a target binding site found in the 5' untranslated region of mRNA encoded by LOC150113, corresponding to a target binding site such as BINDING SITE I, BINDING SITE II or BINDING SITE III of FIG. 8. Table 4 illustrates the complementarity of the nucleotide sequences of LOC150113 BINDING SITE, designated SEQ ID:16990, to the nucleotide sequence of GAM170 RNA, herein designated GAM RNA, also designated SEQ ID:283.

Another function of GAM170 is therefore inhibition of LOC150113 (Accession). Accordingly, utilities of GAM170 include diagnosis, prevention and treatment of diseases and clinical conditions associated with LOC150113.

Pyrimidinergic receptor p2y, g-protein coupled, 6 (P2RY6, Accession NM_176796.1) is another GAM170 target gene, herein designated TARGET GENE. P2RY6 BINDING SITE is a target binding site found in the 3' untranslated region of multiple transcripts of mRNA encoded by P2RY6, corresponding to a target binding site such as BINDING SITE I, BINDING SITE II or BINDING SITE III of FIG. 8. Table 4 illustrates the complementarity of the nucleotide sequences of P2RY6 BINDING SITE, designated SEQ ID:2447, to the nucleotide sequence of GAM170 RNA, herein designated GAM RNA, also designated SEQ ID:283.

Another function of GAM170 is therefore inhibition of Pyrimidinergic receptor p2y, g-protein coupled, 6 (P2RY6, Accession NM_176796.1), a gene which mediates cellular responses to nucleotides. Accordingly, utilities of GAM170 include diagnosis, prevention and treatment of diseases and clinical conditions associated with P2RY6.

The function of P2RY6 and its association with various diseases and clinical conditions, has been established by previous studies, as described hereinabove with reference to GAM72.1. SRp25 (Accession) is another GAM170 target gene, herein designated TARGET GENE. SRp25 BINDING SITE is a target binding site found in the 3' untranslated region of mRNA encoded by SRp25, corresponding to a target binding site such as BINDING SITE I, BINDING SITE II or BINDING SITE III of FIG. 8. Table 4 illustrates the complementarity of the nucleotide sequences of SRp25 BINDING SITE, designated SEQ ID:1331, to the nucleotide sequence of GAM170 RNA, herein designated GAM RNA, also designated SEQ ID:283.

Another function of GAM170 is therefore inhibition of SRp25 (Accession). Accordingly, utilities of GAM170 include diagnosis, prevention and treatment of diseases and clinical conditions associated with SRp25.

FIG. 8 further provides a conceptual description of a novel bioinformatically detected of the present invention, referred to here as Genomic Address Messenger 171 (GAM171), which modulates expression of respective target genes thereof, the function and utility of which target genes is known in the art.

GAM171 is a novel bioinformatically detected regulatory, non protein coding, micro RNA (miRNA) gene. The method by which GAM171 was detected is described hereinabove with reference to FIGS. 8-15.

GAM171 gene, herein designated GAM GENE, and GAM171 target gene, herein designated TARGET GENE, are human genes contained in the human genome.

GAM171 gene encodes a GAM171 precursor RNA, herein designated GAM PRECURSOR RNA. Similar to other miRNA genes, and unlike most ordinary genes, GAM171 precursor RNA does not encode a protein. A nucleotide sequence identical or highly similar to the nucleotide sequence of GAM171 precursor RNA is designated SEQ ID:17, and is provided hereinbelow with reference to the sequence listing part. Nucleotide sequence SEQ ID:17 is located at position 242532302 relative to chromosome 2.

GAM171 precursor RNA folds onto itself, forming GAM171 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM171 precursor RNA folds onto itself, forming GAM171 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM171 precursor RNA, designated SEQ-ID:17, and a schematic representation of a predicted secondary folding of GAM171 folded precursor RNA are further described with reference to Table 2, hereby incorporated by reference.

An enzyme complex designated DICER COMPLEX, 'dices' the GAM171 folded precursor RNA into GAM171

RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM171 RNA is designated SEQ ID:392, and is provided hereinbelow with references to the sequence listing part and Table 3, hereby incorporated by reference.

GAM171 target gene, herein designated TARGET GENE, encodes a corresponding messenger RNA, GAM171 target RNA, herein designated GAM TARGET RNA. GAM171 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM171 RNA, herein designated GAM RNA, binds complementarily to one or more target binding sites located in untranslated regions of GAM171 target RNA, herein designated GAM TARGET RNA. This complementary binding is due to the fact that the nucleotide sequence of GAM171 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM171 RNA may have a different number of target binding sites in untranslated regions of a GAM171 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM171 RNA, herein designated GAM RNA, to target binding sites on GAM171 target RNA, herein designated GAM TARGET RNA, such as BINDING SITE I, BINDING SITE II and BINDING SITE III, inhibits translation of GAM171 target RNA into GAM171 target protein, herein designated GAM TARGET PROTEIN. GAM target protein is therefore outlined by a broken line.

It is appreciated that GAM171 target gene, herein designated TARGET GENE, in fact represents a plurality of GAM171 target genes. The mRNA of each one of this plurality of GAM171 target genes comprises one or more target binding sites, each having a nucleotide sequence which is at least partly complementary to GAM171 RNA, herein designated GAM RNA, and which when bound by GAM171 RNA causes inhibition of translation of respective one or more GAM171 target proteins.

It is further appreciated by one skilled in the art that the mode of translational inhibition illustrated by FIG. 8 with specific reference to translational inhibition exerted by GAM171 gene, herein designated GAM GENE, on one or more GAM171 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM171 correlate with, and may be deduced from, the identity of the target genes which GAM171 binds and inhibits, and the function of these target genes, as elaborated hereinbelow.

Dead/h (asp-glu-ala-asp/his) box polypeptide 6 (rna helicase, 54 kda) (DDX6, Accession NM_004397.3) is a GAM171 target gene, herein designated TARGET GENE. DDX6 BINDING SITE is a target binding site found in the 3' untranslated region of mRNA encoded by DDX6, corresponding to a target binding site such as BINDING SITE I, BINDING SITE II or BINDING SITE III of FIG. 8. Table 4 illustrates the complementarity of the nucleotide sequences of DDX6 BINDING SITE, designated SEQ ID:12093, to the nucleotide sequence of GAM171 RNA, herein designated GAM RNA, also designated SEQ ID:392.

A function of GAM171 is therefore inhibition of Dead/h (asp-glu-ala-asp/his) box polypeptide 6 (rna helicase, 54 kda) (DDX6, Accession NM_004397.3), a gene which is putative RNA helicases and therefore may be associated with Hematopoietic tumors. Accordingly, utilities of GAM171 include diagnosis, prevention and treatment of Hematopoietic tumors, and of other diseases and clinical conditions associated with DDX6.

The function of DDX6 has been established by previous studies. DEAD box proteins are putative RNA helicases that have a characteristic Asp-Glu-Ala-Asp (DEAD) box as 1 of 8 highly conserved sequence motifs. Akao et al. (1991) cloned the breakpoint of the t(11;14)(q23;q32) in B-cell lymphoma, as represented in the RC-K8 cell line, and named the locus RCK. By pulsed field gel electrophoresis, RCK was shown to be centromeric to the gene for porphobilinogen deaminase (OMIM Ref. No. 176000), while the breakpoints of t(11;19) (q23;p13) were detected by the CD3D gene probe (OMIM Ref. No. 186790), which is centromeric to RCK. Akao et al. (1992) did long- range mapping from the CD3 genes to the PBGD gene on 11q23 to determine the relationship between RCK and MLL-ALL1 (OMIM Ref. No. 159555). They showed that RCK and MLL are on different NotI fragments, indicating that 2 different genes are associated with 11q23 translocations in hematopoietic tumors. Seto et al. (1995) found that the RCK/P54 gene, which had been found to encode a 472 to 483 amino acid-peptide belonging to the RNA helicase/translation initiation factor family, is highly conserved in the mouse. The mouse cDNA showed 93.7% nucleotide identity and 97.7% predicted amino acid identity with human RCK. Lu and Yunis (1992) cloned a putative human RNA helicase, p54, from a lymphoid cell line with chromosomal breakpoint 11q23.3. The predicted amino acid sequence shared 75% identity with the female germline-specific RNA helicase ME31B gene of Drosophila. Unlike ME31B, however, the new gene expressed an abundant transcript in a large number of adult tissues and its 5-prime noncoding region was found to be split in a t(11;14)(q23.3; q32.3) cell line from a diffuse large B-cell lymphoma. Tunnacliffe et al. (1993) assigned the HLR2 gene more precisely using a panel of sequence tagged sites (STSs) representing 30 markers previously assigned to 11q23. Using fluorescence in situ hybridization, Akao and Matsuda (1996) mapped the Ddx6 gene to mouse chromosome 9.

Full details of the abovementioned studies are described in the following publications, the disclosure of which are hereby incorporated by reference:

Akao, Y.; Seto, M.; Yamamoto, K.; Iida, S.; Nakazawa, S.; Inazawa, J.; Abe, T.; Takahashi, T.; Ueda, R.: The RCK gene associated with t(11;14) translocation is distinct from the MLL/ALL-1 gene with t(4;11) and t(11;19) translocations. Cancer Res. 52:6083-6087, 1992. ; and Akao, Y.; Tsujimoto, Y.; Finan, J.; Nowell, P. C.; Croce, C. M.: Molecular characterization of a t(11;14)(q23;q32) chromosome translocation in a B-cell lymphoma. Cancer Res. 50:4856-4.

Further studies establishing the function and utilities of DDX6 are found in John Hopkins OMIM database record ID 600326, and in cited publications listed in Table 5, which are hereby incorporated by reference. Glucokinase (hexokinase 4) regulatory protein (GCKR, Accession NM_001486.1) is another GAM171 target gene, herein designated TARGET GENE. GCKR BINDING SITE is a target binding site found in the 3' untranslated region of mRNA encoded by GCKR, corresponding to a target binding site such as BINDING SITE I, BINDING SITE II or BINDING SITE III of FIG. 8. Table 4 illustrates the complementarity of the nucleotide sequences of GCKR BINDING SITE, designated SEQ ID:12938, to the nucleotide sequence of GAM171 RNA, herein designated GAM RNA, also designated SEQ ID:392.

Another function of GAM171 is therefore inhibition of Glucokinase (hexokinase 4) regulatory protein (GCKR, Accession NM_001486.1), a gene which inhibits glucokinase by forming an inactive complex with this enzyme. and therefore may be associated with Maturity-onset diabetes of the young (mody) type ii. Accordingly, utilities of GAM171 include diagnosis, prevention and treatment of Maturity-onset diabetes of the young (mody) type ii., and of other diseases and clinical conditions associated with GCKR.

The function of GCKR has been established by previous studies. Glucokinase (GCK; 138079) in the liver and pancreatic beta cells is subject to inhibition by a regulatory protein, GCKR. The inhibitory effect of GCKR depends on the presence of fructose-6-phosphate and is antagonized by fructose-1-phosphate. Warner et al. (1995) noted that mutations in GCKR might be diabetogenic if they resulted in the synthesis of proteins with increased inhibitory activity, perhaps reflecting increased sensitivity to fructose-6-phosphate or reduced susceptibility to antagonism by fructose-1-phosphate. Warner et al. (1995) determined the complete sequence of human GCKR cDNA, isolated YAC clones containing human GCKR, and localized them to 2p23 by fluorescence in situ hybridization. The GCKR cDNA encodes a protein of 625 amino acids. Vaxillaire et al. (1994) had previously assigned the GCKR gene to 2p23-p22.3. Given the role of glucokinase in the causation of maturity-onset diabetes of the young (MODY) type II (OMIM Ref. No. 125851), GCKR had been considered a candidate gene for a form of MODY. To further understand the role of glucokinase regulatory protein, which they symbolized GKRP, Farrelly et al. (1999) inactivated the mouse homolog. With the knockout of the mouse gene, there was a parallel loss of glucokinase protein and activity in mutant mouse liver. The loss was primarily because of post-transcriptional regulation of glucokinase, indicating a positive regulatory role for GKRP in maintaining glucokinase levels and activity. As in rat hepatocytes, both glucokinase and GKRP were localized in the nuclei of mouse hepatocytes cultured in low glucose-containing medium. In the presence of fructose or high concentrations of glucose, conditions known to relieve glucokinase inhibition by GKRP in vitro, only glucokinase was translocated into the cytoplasm. In the GKRP-mutant hepatocytes, glucokinase was not found in the nucleus under any tested conditions. Farrelly et al. (1999) proposed that GKRP functions as an anchor to sequester and inhibit glucokinase in the hepatocyte nucleus, where it is protected from degradation. This ensures that glucose phosphorylation is minimal when the liver is in the fasting, glucose-producing phase. This also enables the hepatocytes rapidly to mobilize glucokinase into the cytoplasm to phosphorylate and store or metabolize glucose after the ingestion of dietary glucose. In GKRP-mutant mice, the disruption of this regulation and the subsequent decrease in GK activity led to altered glucose metabolism and impaired glycemic control.

Full details of the abovementioned studies are described in the following publications, the disclosure of which are hereby incorporated by reference:

Farrelly, D.; Brown, K. S.; Tieman, A.; Ren, J.; Lira, S. A.; Hagan, D.; Gregg, R.; Mookhtiar, K. A.; Hariharan, N.: Mice mutant for glucokinase regulatory protein exhibit decreased liver glucokinase: a sequestration mechanism in metabolic regulation. Proc. Nat. Acad. Sci. 96:14511-14516, 1999; and Vaxillaire, M.; Vionnet, N.; Vigouroux, C.; Sun, F.; Espinosa, R., III; LeBeau, M. M.; Stoffel, M.; Lehto, M.; Beckmann, J. S.; Detheux, M.; Passa, P.; Cohen, D.; Van Schaftingen, E.; V.

Further studies establishing the function and utilities of GCKR are found in John Hopkins OMIM database record ID 600842, and in cited publications listed in Table 5, which are hereby incorporated by reference. KIAA0042 (Accession) is another GAM171 target gene, herein designated TARGET GENE. KIAA0042 BINDING SITE is a target binding site found in the 3' untranslated region of mRNA encoded by KIAA0042, corresponding to a target binding site such as BINDING SITE I, BINDING SITE II or BINDING SITE III of FIG. 8. Table 4 illustrates the complementarity of the nucleotide sequences of KIAA0042 BINDING SITE, designated SEQ ID:5935, to the nucleotide sequence of GAM171 RNA, herein designated GAM RNA, also designated SEQ ID:392.

Another function of GAM171 is therefore inhibition of KIAA0042 (Accession). Accordingly, utilities of GAM171 include diagnosis, prevention and treatment of diseases and clinical conditions associated with KIAA0042.

KIAA1030 (Accession XM_290502.1) is another GAM171 target gene, herein designated TARGET GENE. KIAA1030 BINDING SITE is a target binding site found in the 3' untranslated region of mRNA encoded by KIAA1030, corresponding to a target binding site such as BINDING SITE I, BINDING SITE II or BINDING SITE III of FIG. 8. Table 4 illustrates the complementarity of the nucleotide sequences of KIAA1030 BINDING SITE, designated SEQ ID:8929, to the nucleotide sequence of GAM171 RNA, herein designated GAM RNA, also designated SEQ ID:392.

Another function of GAM171 is therefore inhibition of KIAA1030 (Accession XM_290502.1). Accordingly, utilities of GAM171 include diagnosis, prevention and treatment of diseases and clinical conditions associated with KIAA1030.

KIAA1036 (Accession NM_014909.1) is another GAM171 target gene, herein designated TARGET GENE. KIAA1036 BINDING SITE is a target binding site found in the 3' untranslated region of mRNA encoded by KIAA1036, corresponding to a target binding site such as BINDING SITE I, BINDING SITE II or BINDING SITE III of FIG. 8. Table 4 illustrates the complementarity of the nucleotide sequences of KIAA1036 BINDING SITE, designated SEQ ID:13086, to the nucleotide sequence of GAM171 RNA, herein designated GAM RNA, also designated SEQ ID:392.

Another function of GAM171 is therefore inhibition of KIAA1036 (Accession NM_014909.1). Accordingly, utilities of GAM171 include diagnosis, prevention and treatment of diseases and clinical conditions associated with KIAA1036.

LOC148113 (Accession) is another GAM171 target gene, herein designated TARGET GENE. LOC148113 BINDING SITE is a target binding site found in the 3' untranslated region of mRNA encoded by LOC148113, corresponding to a target binding site such as BINDING SITE I, BINDING SITE II or BINDING SITE III of FIG. 8. Table 4 illustrates the complementarity of the nucleotide sequences of LOC148113 BINDING SITE, designated SEQ ID:8770, to the nucleotide sequence of GAM171 RNA, herein designated GAM RNA, also designated SEQ ID:392.

Another function of GAM171 is therefore inhibition of LOC148113 (Accession). Accordingly, utilities of GAM171 include diagnosis, prevention and treatment of diseases and clinical conditions associated with LOC148113.

FIG. 8 further provides a conceptual description of a novel bioinformatically detected of the present invention, referred to here as Genomic Address Messenger 172 (GAM172), which modulates expression of respective target genes thereof, the function and utility of which target genes is known in the art.

GAM172 is a novel bioinformatically detected regulatory, non protein coding, micro RNA (miRNA) gene. The method by which GAM172 was detected is described hereinabove with reference to FIGS. 8-15.

GAM172 gene, herein designated GAM GENE, and GAM172 target gene, herein designated TARGET GENE, are human genes contained in the human genome.

GAM172 gene encodes a GAM172 precursor RNA, herein designated GAM PRECURSOR RNA. Similar to other miRNA genes, and unlike most ordinary genes, GAM172 precursor RNA does not encode a protein. A nucleotide sequence identical or highly similar to the nucleotide sequence of GAM172 precursor RNA is designated SEQ ID:86, and is provided hereinbelow with reference to the sequence listing part. Nucleotide sequence SEQ ID:86 is located at position 195192414 relative to chromosome 1.

GAM172 precursor RNA folds onto itself, forming GAM172 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM172 precursor RNA folds onto itself, forming GAM172 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM172 precursor RNA, designated SEQ-ID:86, and a schematic representation of a predicted secondary folding of GAM172 folded precursor RNA are further described with reference to Table 2, hereby incorporated by reference.

An enzyme complex designated DICER COMPLEX, 'dices' the GAM172 folded precursor RNA into GAM172 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM172 RNA is designated SEQ ID:253, and is provided hereinbelow with references to the sequence listing part and Table 3, hereby incorporated by reference.

GAM172 target gene, herein designated TARGET GENE, encodes a corresponding messenger RNA, GAM172 target RNA, herein designated GAM TARGET RNA. GAM172 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM172 RNA, herein designated GAM RNA, binds complementarily to one or more target binding sites located in untranslated regions of GAM172 target RNA, herein designated GAM TARGET RNA. This complementary binding is due to the fact that the nucleotide sequence of GAM172 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM172 RNA may have a different number of target binding sites in untranslated regions of a GAM172 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM172 RNA, herein designated GAM RNA, to target binding sites on GAM172 target RNA, herein designated GAM TARGET RNA, such as BINDING SITE I, BINDING SITE II and BINDING SITE III, inhibits translation of GAM172 target RNA into GAM172 target protein, herein designated GAM TARGET PROTEIN. GAM target protein is therefore outlined by a broken line.

It is appreciated that GAM172 target gene, herein designated TARGET GENE, in fact represents a plurality of GAM172 target genes. The mRNA of each one of this plurality of GAM172 target genes comprises one or more target binding sites, each having a nucleotide sequence which is at least partly complementary to GAM172 RNA, herein designated GAM RNA, and which when bound by GAM172 RNA causes inhibition of translation of respective one or more GAM172 target proteins.

It is further appreciated by one skilled in the art that the mode of translational inhibition illustrated by FIG. 8 with specific reference to translational inhibition exerted by GAM172 gene, herein designated GAM GENE, on one or more GAM172 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM172 correlate with, and may be deduced from, the identity of the target genes which GAM172 binds and inhibits, and the function of these target genes, as elaborated hereinbelow.

Deiodinase, iodothyronine, type ii (DIO2, Accession NM_000793.2) is a GAM172 target gene, herein designated TARGET GENE. DIO2 BINDING SITE is a target binding site found in the 3' untranslated region of multiple transcripts of mRNA encoded by DIO2, corresponding to a target binding site such as BINDING SITE I, BINDING SITE II or BINDING SITE III of FIG. 8. Table 4 illustrates the complementarity of the nucleotide sequences of DIO2 BINDING SITE, designated SEQ ID:4073, to the nucleotide sequence of GAM172 RNA, herein designated GAM RNA, also designated SEQ ID:253.

A function of GAM172 is therefore inhibition of Deiodinase, iodothyronine, type ii (DIO2, Accession NM_000793.2). Accordingly, utilities of GAM172 include diagnosis, prevention and treatment of diseases and clinical conditions associated with DIO2.

Protein tyrosine phosphatase, receptor type, c (PTPRC, Accession NM_002838.2) is another GAM172 target gene, herein designated TARGET GENE. PTPRC BINDING SITE is a target binding site found in the 3' untranslated region of multiple transcripts of mRNA encoded by PTPRC, corresponding to a target binding site such as BINDING SITE I, BINDING SITE II or BINDING SITE III of FIG. 8. Table 4 illustrates the complementarity of the nucleotide sequences of PTPRC BINDING SITE, designated SEQ ID:11527, to the nucleotide sequence of GAM172 RNA, herein designated GAM RNA, also designated SEQ ID:253.

Another function of GAM172 is therefore inhibition of Protein tyrosine phosphatase, receptor type, c (PTPRC, Accession NM_002838.2). Accordingly, utilities of GAM172 include diagnosis, prevention and treatment of diseases and clinical conditions associated with PTPRC.

Transcription factor-like 5 (basic helix-loop-helix) (TCFL5, Accession NM_006602.1) is another GAM172 target gene, herein designated TARGET GENE. TCFL5 BINDING SITE is a target binding site found in the 3' untranslated region of mRNA encoded by TCFL5, corresponding to a target binding site such as BINDING SITE I, BINDING SITE II or BINDING SITE III of FIG. 8. Table 4 illustrates the complementarity of the nucleotide sequences of TCFL5 BINDING SITE, designated SEQ ID:11818, to the nucleotide sequence of GAM172 RNA, herein designated GAM RNA, also designated SEQ ID:253.

Another function of GAM172 is therefore inhibition of Transcription factor-like 5 (basic helix-loop-helix) (TCFL5, Accession NM_006602.1). Accordingly, utilities of GAM172 include diagnosis, prevention and treatment of diseases and clinical conditions associated with TCFL5.

FIG. 8 further provides a conceptual description of a novel bioinformatically detected of the present invention, referred to here as Genomic Address Messenger 173 (GAM173), which modulates expression of respective target genes thereof, the function and utility of which target genes is known in the art.

GAM173 is a novel bioinformatically detected regulatory, non protein coding, micro RNA (miRNA) gene. The method by which GAM173 was detected is described hereinabove with reference to FIGS. 8-15.

GAM173 gene, herein designated GAM GENE, and GAM173 target gene, herein designated TARGET GENE, are human genes contained in the human genome.

GAM173 gene encodes a GAM173 precursor RNA, herein designated GAM PRECURSOR RNA. Similar to other miRNA genes, and unlike most ordinary genes, GAM173 precursor RNA does not encode a protein. A nucleotide sequence identical or highly similar to the nucleotide sequence of GAM173 precursor RNA is designated SEQ ID:124, and is provided hereinbelow with reference to the sequence listing part.

GAM173 precursor RNA folds onto itself, forming GAM173 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM173 precursor RNA folds onto itself, forming GAM173 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM173 precursor RNA, designated SEQ-ID:124, and a schematic representation of a predicted secondary folding of GAM173 folded precursor RNA are further described with reference to Table 2, hereby incorporated by reference.

An enzyme complex designated DICER COMPLEX, 'dices' the GAM173 folded precursor RNA into GAM173 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM173 RNA is designated SEQ ID:208, and is provided hereinbelow with references to the sequence listing part and Table 3, hereby incorporated by reference.

GAM173 target gene, herein designated TARGET GENE, encodes a corresponding messenger RNA, GAM173 target RNA, herein designated GAM TARGET RNA. GAM173 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM173 RNA, herein designated GAM RNA, binds complementarily to one or more target binding sites located in untranslated regions of GAM173 target RNA, herein designated GAM TARGET RNA. This complementary binding is due to the fact that the nucleotide sequence of GAM173 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM173 RNA may have a different number of target binding sites in untranslated regions of a GAM173 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM173 RNA, herein designated GAM RNA, to target binding sites on GAM173 target RNA, herein designated GAM TARGET RNA, such as BINDING SITE I, BINDING SITE II and BINDING SITE III, inhibits translation of GAM173 target RNA into GAM173 target protein, herein designated GAM TARGET PROTEIN. GAM target protein is therefore outlined by a broken line.

It is appreciated that GAM173 target gene, herein designated TARGET GENE, in fact represents a plurality of GAM173 target genes. The mRNA of each one of this plurality of GAM173 target genes comprises one or more target binding sites, each having a nucleotide sequence which is at least partly complementary to GAM173 RNA, herein designated GAM RNA, and which when bound by GAM173 RNA causes inhibition of translation of respective one or more GAM173 target proteins.

It is further appreciated by one skilled in the art that the mode of translational inhibition illustrated by FIG. 8 with specific reference to translational inhibition exerted by GAM173 gene, herein designated GAM GENE, on one or more GAM173 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM173 correlate with, and may be deduced from, the identity of the target genes which GAM173 binds and inhibits, and the function of these target genes, as elaborated hereinbelow.

LOC149157 (Accession XM_086442.1) is a GAM173 target gene, herein designated TARGET GENE. LOC149157 BINDING SITE is a target binding site found in the 3' untranslated region of mRNA encoded by LOC149157, corresponding to a target binding site such as BINDING SITE I, BINDING SITE II or BINDING SITE III of FIG. 8. Table 4 illustrates the complementarity of the nucleotide sequences of LOC149157 BINDING SITE, designated SEQ ID:18849, to the nucleotide sequence of GAM173 RNA, herein designated GAM RNA, also designated SEQ ID:208.

A function of GAM173 is therefore inhibition of LOC149157 (Accession XM_086442.1). Accordingly, utilities of GAM173 include diagnosis, prevention and treatment of diseases and clinical conditions associated with LOC149157.

Spondin 1, (f-spondin) extracellular matrix protein (SPON1, Accession NM_006108.1) is another GAM173 target gene, herein designated TARGET GENE. SPON1 BINDING SITE is a target binding site found in the 3' untranslated region of mRNA encoded by SPON1, corresponding to a target binding site such as BINDING SITE I, BINDING SITE II or BINDING SITE III of FIG. 8. Table 4 illustrates the complementarity of the nucleotide sequences of SPON1 BINDING SITE, designated SEQ ID:15969, to the nucleotide sequence of GAM173 RNA, herein designated GAM RNA, also designated SEQ ID:208.

Another function of GAM173 is therefore inhibition of Spondin 1, (f-spondin) extracellular matrix protein (SPON1, Accession NM_006108.1). Accordingly, utilities of GAM173 include diagnosis, prevention and treatment of diseases and clinical conditions associated with SPON1.

FIG. 8 further provides a conceptual description of a novel bioinformatically detected of the present invention, referred to here as Genomic Address Messenger 174 (GAM174), which modulates expression of respective target genes thereof, the function and utility of which target genes is known in the art.

GAM174 is a novel bioinformatically detected regulatory, non protein coding, micro RNA (miRNA) gene. The method by which GAM174 was detected is described hereinabove with reference to FIGS. 8-15.

GAM174 gene, herein designated GAM GENE, and GAM174 target gene, herein designated TARGET GENE, are human genes contained in the human genome.

GAM174 gene encodes a GAM174 precursor RNA, herein designated GAM PRECURSOR RNA. Similar to other miRNA genes, and unlike most ordinary genes, GAM174 precursor RNA does not encode a protein. A nucleotide sequence identical or highly similar to the nucleotide sequence of GAM174 precursor RNA is designated SEQ ID:16, and is provided hereinbelow with reference to the sequence listing part.

GAM174 precursor RNA folds onto itself, forming GAM174 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM174 precursor RNA folds onto itself, forming GAM174 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM174 precursor RNA, designated SEQ-ID:16, and a schematic representation of a predicted secondary folding of GAM174 folded precursor RNA are further described with reference to Table 2, hereby incorporated by reference.

An enzyme complex designated DICER COMPLEX, 'dices' the GAM174 folded precursor RNA into GAM174 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM174 RNA is designated SEQ ID:252, and is provided hereinbelow with references to the sequence listing part and Table 3, hereby incorporated by reference.

GAM174 target gene, herein designated TARGET GENE, encodes a corresponding messenger RNA, GAM174 target RNA, herein designated GAM TARGET RNA. GAM174 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM174 RNA, herein designated GAM RNA, binds complementarily to one or more target binding sites located in untranslated regions of GAM174 target RNA, herein designated GAM TARGET RNA. This complementary binding is due to the fact that the nucleotide sequence of GAM174 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM174 RNA may have a different number of target binding sites in untranslated regions of a GAM174 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM174 RNA, herein designated GAM RNA, to target binding sites on GAM174 target RNA, herein designated GAM TARGET RNA, such as BINDING SITE I, BINDING SITE II and BINDING SITE III, inhibits translation of GAM174 target RNA into GAM174 target protein, herein designated GAM TARGET PROTEIN. GAM target protein is therefore outlined by a broken line.

It is appreciated that GAM174 target gene, herein designated TARGET GENE, in fact represents a plurality of GAM174 target genes. The mRNA of each one of this plurality of GAM174 target genes comprises one or more target binding sites, each having a nucleotide sequence which is at least partly complementary to GAM174 RNA, herein designated GAM RNA, and which when bound by GAM174 RNA causes inhibition of translation of respective one or more GAM174 target proteins.

It is further appreciated by one skilled in the art that the mode of translational inhibition illustrated by FIG. 8 with specific reference to translational inhibition exerted by GAM174 gene, herein designated GAM GENE, on one or more GAM174 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM174 correlate with, and may be deduced from, the identity of the target genes which GAM174 binds and inhibits, and the function of these target genes, as elaborated hereinbelow.

A kinase (prka) anchor protein 13 (AKAP13, Accession NM_007200.2) is a GAM174 target gene, herein designated TARGET GENE. AKAP13 BINDING SITE is a target binding site found in the 3' untranslated region of multiple transcripts of mRNA encoded by AKAP13, corresponding to a target binding site such as BINDING SITE I, BINDING SITE II or BINDING SITE III of FIG. 8. Table 4 illustrates the complementarity of the nucleotide sequences of AKAP13 BINDING SITE, designated SEQ ID:2878, to the nucleotide sequence of GAM174 RNA, herein designated GAM RNA, also designated SEQ ID:252.

A function of GAM174 is therefore inhibition of A kinase (prka) anchor protein 13 (AKAP13, Accession NM_007200.2), a gene which regulates subcellular localization of type II cAMP-dependent PKA. Accordingly, utilities of GAM174 include diagnosis, prevention and treatment of diseases and clinical conditions associated with AKAP13.

The function of AKAP13 and its association with various diseases and clinical conditions, has been established by previous studies, as described hereinabove with reference to GAM54.1. D21S2056E (Accession NM_003683.2) is another GAM174 target gene, herein designated TARGET GENE. D21S2056E BINDING SITE is a target binding site found in the 3' untranslated region of mRNA encoded by D21S2056E, corresponding to a target binding site such as BINDING SITE I, BINDING SITE II or BINDING SITE III of FIG. 8. Table 4 illustrates the complementarity of the nucleotide sequences of D21S2056E BINDING SITE, designated SEQ ID:3842, to the nucleotide sequence of GAM174 RNA, herein designated GAM RNA, also designated SEQ ID:252.

Another function of GAM174 is therefore inhibition of D21S2056E (Accession NM_003683.2). Accordingly, utilities of GAM174 include diagnosis, prevention and treatment of diseases and clinical conditions associated with D21S2056E.

DKFZP434O047 (Accession NM_015594.1) is another GAM174 target gene, herein designated TARGET GENE. DKFZP434O047 BINDING SITE is a target binding site found in the 5' untranslated region of mRNA encoded by DKFZP434O047, corresponding to a target binding site such as BINDING SITE I, BINDING SITE II or BINDING SITE III of FIG. 8. Table 4 illustrates the complementarity of the nucleotide sequences of DKFZP434O047 BINDING SITE, designated SEQ ID:7607, to the nucleotide sequence of GAM174 RNA, herein designated GAM RNA, also designated SEQ ID:252.

Another function of GAM174 is therefore inhibition of DKFZP434O047 (Accession NM_015594.1). Accordingly, utilities of GAM174 include diagnosis, prevention and treatment of diseases and clinical conditions associated with DKFZP434O047.

Inhibin, beta b (activin ab beta polypeptide) (INHBB, Accession NM_002193.1) is another GAM174 target gene, herein designated TARGET GENE. INHBB BINDING SITE is a target binding site found in the 5' untranslated region of mRNA encoded by INHBB, corresponding to a target binding site such as BINDING SITE I, BINDING SITE II or BINDING SITE III of FIG. 8. Table 4 illustrates the complementarity of the nucleotide sequences of INHBB BINDING SITE, designated SEQ ID:4697, to the nucleotide sequence of GAM174 RNA, herein designated GAM RNA, also designated SEQ ID:252.

Another function of GAM174 is therefore inhibition of Inhibin, beta b (activin ab beta polypeptide) (INHBB, Accession NM_002193.1), a gene which inhibins inhibit the secretion of follitropin by the pituitary gland. and therefore may be associated with Tumors. Accordingly, utilities of GAM174 include diagnosis, prevention and treatment of Tumors, and of other diseases and clinical conditions associated with INHBB.

The function of INHBB has been established by previous studies. The activins, dimers of beta-A or beta-B subunits encoded by the genes Inhba (OMIM Ref. No. 147290) and Inhbb, respectively, are TGF-beta (see OMIM Ref. No. 190180) superfamily members that have roles in reproduction and development (Brown et al., 2000). Activin ligands act as growth and differentiation factors in many cells and tissues. Mellor et al. (2000) examined the localization of and dimerization among activin subunits. The results demonstrated that activin beta-C (see OMIM Ref. No. 601233) can form dimers with activin beta-A and beta-B in vitro, but not with the inhibin alpha subunit (OMIM Ref. No. 147380). Using a specific antibody, activin beta-C protein was localized to human liver and prostate and colocalized with beta-A and beta-B subunits to specific cell types in benign and malignant prostate tissues. The capacity to form novel activin heterodimers (but not inhibin C) appears to reside in the human liver and prostate. The authors concluded that formation of activin AC or BC heterodimers may have significant implications in the regulation of levels and/or biologic activity of other activins in these tissues. Malignancy of pheochromocytomas is difficult to estimate on the basis of histopathologic features. In a search for new markers to differentiate malignant pheochromocytomas from benign ones, Salmenkivi et al. (2001) tested the value of inhibin/activin subunit expression. Inhibins are heterodimeric glycoproteins consisting of an alpha subunit and either a beta-A or a beta-B subunit. Activins are composed of beta subunits only. Immunohistochemically, inhibin/activin beta-B subunit was strongly positive in the normal adrenal medulla, but the cortex was negative. A striking difference was found in inhibin/activin beta- B expression between benign and malignant pheochromocytomas. The majority of benign adrenal tumors (27 of 30) showed strong or moderate immunoreactivity, whereas all 7 malignant tumors were negative or only weakly positive for inhibin/activin beta-B subunit. Salmenkivi et al. (2001) suggested that inhibin/activin beta-B subunit is expressed in normal adrenal medullary cells. Strong staining was found in most benign adrenal pheochromocytomas, whereas malignant tumors were almost negative. They concluded that loss of inhibin/activin beta-B subunit expression in pheochromocytomas may be used as an indicator of malignant potential.

Animal model experiments lend further support to the function of INHBB. Whereas mice homozygous for the Inhba-null allele demonstrate disruption of whisker, palate, and tooth development leading to neonatal lethality, homozygous Inhbb-null mice are viable, fertile, and have eye defects. To determine if these phenotypes were due to spatiotemporal expression differences of the ligands or disruption of specific ligand- receptor interactions, Brown et al. (2000) replaced the region of Inhba encoding the mature protein with Inhbb, creating the allele designated Inhba(BK). Although the craniofacial phenotypes of the Inhba-null mutation were rescued by the Inhba(BK) allele, somatic, testicular, genital, and hair growth were grossly affected and influenced by the dosage and bioactivity of the allele. Thus, Brown et al. (2000) concluded that functional compensation within the TGF-beta superfamily can occur if the replacement gene is expressed appropriately. The novel phenotypes in these mice further illustrate the usefulness of insertion strategies for defining protein function. The structural organization of the testes of adult Inhba(BK/BK) mice was normal; however, the differentiation of the seminiferous tubules of Inhba(BK/-) mice was delayed. The testicular volumes of both Inhba(BK/BK) and Inhba(BK/-) mice were less than those of controls, and the dosage of the Inhba(BK) allele correlated positively with testicular size. Inhba(+/BK) males had normal onset of fertility, whereas Inhba(BK/BK) males had delayed onset of fertility similar to Acvr2 (OMIM Ref. No. 102581) -/- mice. Only 1 in 6 Inhba(BK/BK) females produced litters, whereas Inhba(+/BK) females were normally fertile. The ovaries of Inhba(BK/-) mice were smaller and contained fewer large preantral follicles than those of controls. Inhba(BK/BK) and Inhba(BK/-) mice were identified by their smaller size, slower hair growth, the rough appearance of their fur, and sunken eyes. Approximately 50% of Inhba(BK/BK) mice died by 26 weeks, whereas Inhba(BK/-) mice invariably became cachectic and died between 3 and 4 weeks. The summary of phenotypic findings of Inhba(BK/-) mice includes short whiskers, normal tooth development, no cleft palate, symmetric growth deficiency (OMIM Ref. No. severe), enlargement of external genitalia, hypogonadism (OMIM Ref. No. severe), delayed hair growth (moderate), hypoglycemia (mild), decreased life expectancy (OMIM Ref. No. severe), and anemia It is appreciated that the abovementioned animal model for INHBB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Salmenkivi, K.; Arola, J.; Voutilainen, R.; Ilvesmaki, V.; Haglund, C.; Kahri, A. I.; Heikkila, P.; Liu, J.: Inhibin/activin beta-B-subunit expression in pheochromocytomas favors benign diagnosis. J. Clin. Endocr. Metab. 86:2231-2235, 2001; and Brown, C. W.; Houston-Hawkins, D. E.; Woodruff, T. K.; Matzuk, M. M.: Insertion of Inhbb into the Inhba locus rescues the Inhba-null phenotype and reveals new activin functions. Nature.

Further studies establishing the function and utilities of INHBB are found in John Hopkins OMIM database record ID 147390, and in cited publications listed in Table 5, which are hereby incorporated by reference. LOC147165 (Accession XM_294884.1) is another GAM174 target gene, herein designated TARGET GENE. LOC147165 BINDING SITE is a target binding site found in the 5' untranslated region of mRNA encoded by LOC147165, corresponding to a target binding site such as BINDING SITE I, BINDING SITE II or BINDING SITE III of FIG. 8. Table 4 illustrates the complementarity of the nucleotide sequences of LOC147165 BINDING SITE, designated SEQ ID:15184, to the nucleotide sequence of GAM174 RNA, herein designated GAM RNA, also designated SEQ ID:252.

Another function of GAM174 is therefore inhibition of LOC147165 (Accession XM_294884.1). Accordingly, utilities of GAM174 include diagnosis, prevention and treatment of diseases and clinical conditions associated with LOC147165.

LOC162417 (Accession) is another GAM174 target gene, herein designated TARGET GENE. LOC162417 BINDING SITE is a target binding site found in the 5' untranslated region of mRNA encoded by LOC162417, corresponding to a target binding site such as BINDING SITE I, BINDING SITE II or BINDING SITE III of FIG. 8. Table 4 illustrates the complementarity of the nucleotide sequences of LOC162417 BINDING SITE, designated SEQ ID:13555, to the nucleotide sequence of GAM174 RNA, herein designated GAM RNA, also designated SEQ ID:252.

Another function of GAM174 is therefore inhibition of LOC162417 (Accession). Accordingly, utilities of GAM174 include diagnosis, prevention and treatment of diseases and clinical conditions associated with LOC162417.

MGC12921 (Accession NM_032728.1) is another GAM174 target gene, herein designated TARGET GENE. MGC12921 BINDING SITE is a target binding site found in the 5' untranslated region of mRNA encoded by MGC12921, corresponding to a target binding site such as BINDING SITE I, BINDING SITE II or BINDING SITE III of FIG. 8. Table 4 illustrates the complementarity of the nucleotide sequences of MGC12921 BINDING SITE, designated SEQ ID:2736, to the nucleotide sequence of GAM174 RNA, herein designated GAM RNA, also designated SEQ ID:252.

Another function of GAM174 is therefore inhibition of MGC12921 (Accession NM_032728.1). Accordingly, utilities of GAM174 include diagnosis, prevention and treatment of diseases and clinical conditions associated with MGC12921.

MGC15504 (Accession NM_032751.1) is another GAM174 target gene, herein designated TARGET GENE. MGC15504 BINDING SITE is a target binding site found in the 5' untranslated region of mRNA encoded by MGC15504, corresponding to a target binding site such as BINDING SITE I, BINDING SITE II or BINDING SITE III of FIG. 8. Table 4 illustrates the complementarity of the nucleotide sequences of MGC15504 BINDING SITE, designated SEQ ID:8930, to the nucleotide sequence of GAM174 RNA, herein designated GAM RNA, also designated SEQ ID:252.

Another function of GAM174 is therefore inhibition of MGC15504 (Accession NM_032751.1). Accordingly, utilities of GAM174 include diagnosis, prevention and treatment of diseases and clinical conditions associated with MGC15504.

Protein kinase, lysine deficient 2 (PRKWNK2, Accession) is another GAM174 target gene, herein designated TARGET GENE. PRKWNK2 BINDING SITE is a target binding site found in the 5' untranslated region of mRNA encoded by PRKWNK2, corresponding to a target binding site such as BINDING SITE I, BINDING SITE II or BINDING SITE III of FIG. 8. Table 4 illustrates the complementarity of the nucleotide sequences of PRKWNK2 BINDING SITE, designated SEQ ID:20003, to the nucleotide sequence of GAM174 RNA, herein designated GAM RNA, also designated SEQ ID:252.

Another function of GAM174 is therefore inhibition of Protein kinase, lysine deficient 2 (PRKWNK2, Accession). Accordingly, utilities of GAM174 include diagnosis, prevention and treatment of diseases and clinical conditions associated with PRKWNK2.

Tumor protein d52-like 2 (TPD52L2, Accession NM_003288.1) is another GAM174 target gene, herein designated TARGET GENE. TPD52L2 BINDING SITE is a target binding site found in the 5' untranslated region of mRNA encoded by TPD52L2, corresponding to a target binding site such as BINDING SITE I, BINDING SITE II or BINDING SITE III of FIG. 8. Table 4 illustrates the complementarity of the nucleotide sequences of TPD52L2 BINDING SITE, designated SEQ ID:18571, to the nucleotide sequence of GAM174 RNA, herein designated GAM RNA, also designated SEQ ID:252.

Another function of GAM174 is therefore inhibition of Tumor protein d52-like 2 (TPD52L2, Accession NM_003288.1). Accordingly, utilities of GAM174 include diagnosis, prevention and treatment of diseases and clinical conditions associated with TPD52L2.

Ubiquitin specific protease 20 (USP20, Accession NM_006676.1) is another GAM174 target gene, herein designated TARGET GENE. USP20 BINDING SITE is a target binding site found in the 3' untranslated region of mRNA encoded by USP20, corresponding to a target binding site such as BINDING SITE I, BINDING SITE II or BINDING SITE III of FIG. 8. Table 4 illustrates the complementarity of the nucleotide sequences of USP20 BINDING SITE, designated SEQ ID:554, to the nucleotide sequence of GAM174 RNA, herein designated GAM RNA, also designated SEQ ID:252.

Another function of GAM174 is therefore inhibition of Ubiquitin specific protease 20 (USP20, Accession NM_006676.1). Accordingly, utilities of GAM174 include diagnosis, prevention and treatment of diseases and clinical conditions associated with USP20.

FIG. 8 further provides a conceptual description of a novel bioinformatically detected of the present invention, referred to here as Genomic Address Messenger 175 (GAM175), which modulates expression of respective target genes thereof, the function and utility of which target genes is known in the art.

GAM175 is a novel bioinformatically detected regulatory, non protein coding, micro RNA (miRNA) gene. The method by which GAM175 was detected is described hereinabove with reference to FIGS. 8-15.

GAM175 gene, herein designated GAM GENE, and GAM175 target gene, herein designated TARGET GENE, are human genes contained in the human genome.

GAM175 gene encodes a GAM175 precursor RNA, herein designated GAM PRECURSOR RNA. Similar to other miRNA genes, and unlike most ordinary genes, GAM175 precursor RNA does not encode a protein. A nucleotide sequence identical or highly similar to the nucleotide sequence of GAM175 precursor RNA is designated SEQ ID:28, and is provided hereinbelow with reference to the sequence listing part. Nucleotide sequence SEQ ID:28 is located at position 557 relative to chromosome X.

GAM175 precursor RNA folds onto itself, forming GAM175 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM175 precursor RNA folds onto itself, forming GAM175 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM175 precursor RNA, designated SEQ-ID:28, and a schematic representation of a predicted secondary folding of GAM175 folded precursor RNA are further described with reference to Table 2, hereby incorporated by reference.

An enzyme complex designated DICER COMPLEX, 'dices' the GAM175 folded precursor RNA into GAM175 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM175 RNA is designated SEQ ID:265, and is provided hereinbelow with references to the sequence listing part and Table 3, hereby incorporated by reference.

GAM175 target gene, herein designated TARGET GENE, encodes a corresponding messenger RNA, GAM175 target RNA, herein designated GAM TARGET RNA. GAM175 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM175 RNA, herein designated GAM RNA, binds complementarily to one or more target binding sites located in untranslated regions of GAM175 target RNA, herein designated GAM TARGET RNA. This complementary binding is due to the fact that the nucleotide sequence of GAM175 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM175 RNA may have a different number of target binding sites in untranslated regions of a GAM175 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM175 RNA, herein designated GAM RNA, to target binding sites on GAM175 target RNA, herein designated GAM TARGET RNA, such as BINDING SITE I, BINDING SITE II and BINDING SITE III, inhibits translation of GAM175 target RNA into GAM175 target protein, herein designated GAM TARGET PROTEIN. GAM target protein is therefore outlined by a broken line.

It is appreciated that GAM175 target gene, herein designated TARGET GENE, in fact represents a plurality of GAM175 target genes. The mRNA of each one of this plurality of GAM175 target genes comprises one or more target binding sites, each having a nucleotide sequence which is at least partly complementary to GAM175 RNA, herein designated GAM RNA, and which when bound by GAM175 RNA causes inhibition of translation of respective one or more GAM175 target proteins.

It is further appreciated by one skilled in the art that the mode of translational inhibition illustrated by FIG. 8 with specific reference to translational inhibition exerted by GAM175 gene, herein designated GAM GENE, on one or more GAM175 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM175 correlate with, and may be deduced from, the identity of the target genes which GAM175 binds and inhibits, and the function of these target genes, as elaborated hereinbelow.

Aminoadipate-semialdehyde dehydrogenase-phosphopantetheinyl transferase (AASDHPPT, Accession NP_056238.2) is a GAM175 target gene, herein designated TARGET GENE. AASDHPPT BINDING SITE is a target binding site found in the 3' untranslated region of mRNA encoded by AASDHPPT, corresponding to a target binding site such as BINDING SITE I, BINDING SITE II or BINDING SITE III of FIG. 8. Table 4 illustrates the complementarity of the nucleotide sequences of AASDHPPT BINDING SITE, designated SEQ ID:16747, to the nucleotide sequence of GAM175 RNA, herein designated GAM RNA, also designated SEQ ID:265.

A function of GAM175 is therefore inhibition of Aminoadipate-semialdehyde dehydrogenase-phosphopantetheinyl transferase (AASDHPPT, Accession NP_056238.2). Accordingly, utilities of GAM175 include diagnosis, prevention and treatment of diseases and clinical conditions associated with AASDHPPT.

Adenosine deaminase, rna-specific (ADAR, Accession NP_056655.1) is another GAM175 target gene, herein designated TARGET GENE. ADAR BINDING SITE is a target binding site found in the 3' untranslated region of multiple transcripts of mRNA encoded by ADAR, corresponding to a target binding site such as BINDING SITE I, BINDING SITE II or BINDING SITE III of FIG. 8. Table 4 illustrates the complementarity of the nucleotide sequences of ADAR BINDING SITE, designated SEQ ID:13257, to the nucleotide sequence of GAM175 RNA, herein designated GAM RNA, also designated SEQ ID:265.

Another function of GAM175 is therefore inhibition of Adenosine deaminase, rna-specific (ADAR, Accession NP_056655.1), a gene which converts adenosine to inosine in double-stranded RNA. Accordingly, utilities of GAM175 include diagnosis, prevention and treatment of diseases and clinical conditions associated with ADAR.

The function of ADAR has been established by previous studies. Double-stranded RNA- specific adenosine deaminase (DSRAD) was identified as a developmentally regulated dsRNA unwinding activity in early antisense experiments with Xenopus oocytes (Bass and Weintraub, 1988). The enzyme converts adenosine to inosine in dsRNA, which destabilizes the dsRNA helix. The RNA modifying activity of DSRAD is important for various functions. Among these are site-specific RNA editing of transcripts of the glutamate receptors (see OMIM Ref. No. 138248), which are channels for the neurotransmitter L-glutamate in the brain. DSRAD also functions to modify viral RNA genomes and may be responsible for hypermutation of certain negative-stranded viruses, such as measles, which may result in lethal measles inclusion body encephalitis (Weier et al., 1995). By fluorescence in situ hybridization, Weier et al. (1995) mapped the DSRAD gene to 1q21.1-q21.2, centromeric to the marker D1S1705. Wang et al. (1995) mapped the DRADA gene to 1q21 by fluorescence in situ hybridization. By FISH, Weier et al. (2000) mapped the mouse homolog (Adar) to chromosome 3F2.

Animal model experiments lend further support to the function of ADAR. Wang et al. (2000) knocked out the Adar1 gene in mice by targeted disruption and found that heterozygosity for the Adar1 knockout causes embryonic lethality.

It is appreciated that the abovementioned animal model for ADAR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weier, H.-U. G.; George, C. X.; Greulich, K. M.; Samuel, C. E.: The interferon- inducible, double-stranded RNA-specific adenosine deaminase gene (DSRAD) maps to human chromosome 1q21.1-21.2. Genomics 30:372-375, 1995; and Wang, Q.; Khillan, J.; Gadue, P.; Nishikura, K.: Requirement of the RNA editing deaminase ADAR1 gene for embryonic erythropoiesis. Science 290:1765-1768, 2000.

Further studies establishing the function and utilities of ADAR are found in John Hopkins OMIM database record ID 601059, and in cited publications listed in Table 5, which are hereby incorporated by reference. Adenosine deaminase, rna-specific (ADAR, Accession NP_001102.1) is another GAM175 target gene, herein designated TARGET GENE. ADAR BINDING SITE is a target binding site found in the 3' untranslated region of multiple transcripts of mRNA encoded by ADAR, corresponding to a target binding site such as BINDING SITE I, BINDING SITE II or BINDING SITE III of FIG. 8. Table 4 illustrates the complementarity of the nucleotide sequences of ADAR BINDING SITE, designated SEQ ID:13257, to the nucleotide sequence of GAM175 RNA, herein designated GAM RNA, also designated SEQ ID:265.

Another function of GAM175 is therefore inhibition of Adenosine deaminase, rna-specific (ADAR, Accession NP_001102.1), a gene which converts adenosine to inosine in double-stranded RNA. Accordingly, utilities of GAM175 include diagnosis, prevention and treatment of diseases and clinical conditions associated with ADAR.

The function of ADAR has been established by previous studies. Double-stranded RNA- specific adenosine deaminase (DSRAD) was identified as a developmentally regulated dsRNA unwinding activity in early antisense experiments with Xenopus oocytes (Bass and Weintraub, 1988). The enzyme converts adenosine to inosine in dsRNA, which destabilizes the dsRNA helix. The RNA modifying activity of DSRAD is important for various functions. Among these are site-specific RNA editing of transcripts of the glutamate receptors (see OMIM Ref. No. 138248), which are channels for the neurotransmitter L-glutamate in the brain. DSRAD also functions to modify viral RNA genomes and may be responsible for hypermutation of certain negative-stranded viruses, such as measles, which may result in lethal measles inclusion body encephalitis (Weier et al., 1995). By fluorescence in situ hybridization, Weier et al. (1995) mapped the DSRAD gene to 1q21.1-q21.2, centromeric to the marker D1S1705. Wang et al. (1995) mapped the DRADA gene to 1q21 by fluorescence in situ hybridization. By FISH, Weier et al. (2000) mapped the mouse homolog (Adar) to chromosome 3F2.

Animal model experiments lend further support to the function of ADAR. Wang et al. (2000) knocked out the Adar1 gene in mice by targeted disruption and found that heterozygosity for the Adar1 knockout causes embryonic lethality.

It is appreciated that the abovementioned animal model for ADAR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weier, H.-U. G.; George, C. X.; Greulich, K. M.; Samuel, C. E.: The interferon- inducible, double-stranded RNA-specific adenosine deaminase gene (DSRAD) maps to human chromosome 1q21.1-21.2. Genomics 30:372-375, 1995; and Wang, Q.; Khillan, J.; Gadue, P.; Nishikura, K.: Requirement of the RNA editing deaminase ADAR1 gene for embryonic erythropoiesis. Science 290:1765-1768, 2000.

Further studies establishing the function and utilities of ADAR are found in John Hopkins OMIM database record ID 601059, and in cited publications listed in Table 5, which are hereby incorporated by reference. Adenosine deaminase, rna-specific (ADAR, Accession NP_056656.1) is another GAM175 target gene, herein designated TARGET GENE. ADAR BINDING SITE is a target binding site found in the 3' untranslated region of multiple transcripts of mRNA encoded by ADAR, corresponding to a target binding site such as BINDING SITE I, BINDING SITE II or BINDING SITE III of FIG. 8. Table 4 illustrates the complementarity of the nucleotide sequences of ADAR BINDING SITE, designated SEQ ID:13257, to the nucleotide sequence of GAM175 RNA, herein designated GAM RNA, also designated SEQ ID:265.

Another function of GAM175 is therefore inhibition of Adenosine deaminase, rna-specific (ADAR, Accession NP_056656.1), a gene which converts adenosine to inosine in double-stranded RNA. Accordingly, utilities of GAM175 include diagnosis, prevention and treatment of diseases and clinical conditions associated with ADAR.

The function of ADAR has been established by previous studies. Double-stranded RNA- specific adenosine deaminase (DSRAD) was identified as a developmentally regulated dsRNA unwinding activity in early antisense experiments with Xenopus oocytes (Bass and Weintraub, 1988). The enzyme converts adenosine to inosine in dsRNA, which destabilizes the dsRNA helix. The RNA modifying activity of DSRAD is important for various functions. Among these are site-specific RNA editing of transcripts of the glutamate receptors (see OMIM Ref. No. 138248), which are channels for the neurotransmitter L-glutamate in the brain. DSRAD also functions to modify viral RNA genomes and may be responsible for hypermutation of certain negative-stranded viruses, such as measles, which may result in lethal measles inclusion body encephalitis (Weier et al., 1995). By fluorescence in situ hybridization, Weier et al. (1995) mapped the DSRAD gene to 1q21.1-q21.2, centromeric to the marker D1S1705. Wang et al. (1995) mapped the DRADA gene to 1q21 by fluorescence in situ hybridization. By FISH, Weier et al. (2000) mapped the mouse homolog (Adar) to chromosome 3F2.

Animal model experiments lend further support to the function of ADAR. Wang et al. (2000) knocked out the Adar1 gene in mice by targeted disruption and found that heterozygosity for the Adar1 knockout causes embryonic lethality.

It is appreciated that the abovementioned animal model for ADAR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weier, H.-U. G.; George, C. X.; Greulich, K. M.; Samuel, C. E.: The interferon- inducible, double-stranded RNA-specific adenosine deaminase gene (DSRAD) maps to human chromosome 1q21.1-21.2. Genomics 30:372-375, 1995; and Wang, Q.; Khillan, J.; Gadue, P.; Nishikura, K.: Requirement of the RNA editing deaminase ADAR1 gene for embryonic erythropoiesis. Science 290:1765-1768, 2000.

Further studies establishing the function and utilities of ADAR are found in John Hopkins OMIM database record ID 601059, and in cited publications listed in Table 5, which are hereby incorporated by reference. AFAP (Accession NP_067651.1) is another GAM175 target gene, herein designated TARGET GENE. AFAP BINDING SITE is a target binding site found in the 3' untranslated region of mRNA encoded by AFAP, corresponding to a target binding site such as BINDING SITE I, BINDING SITE II or BINDING SITE III of FIG. 8. Table 4 illustrates the complementarity of the nucleotide sequences of AFAP BINDING SITE, designated SEQ ID:7185, to the nucleotide sequence of GAM175 RNA, herein designated GAM RNA, also designated SEQ ID:265.

Another function of GAM175 is therefore inhibition of AFAP (Accession NP_067651.1). Accordingly, utilities of GAM175 include diagnosis, prevention and treatment of diseases and clinical conditions associated with AFAP.

Annexin a8 (ANXA8, Accession NP_001621.1) is another GAM175 target gene, herein designated TARGET GENE. ANXA8 BINDING SITE is a target binding site found in the 3' untranslated region of mRNA encoded by ANXA8, corresponding to a target binding site such as BINDING SITE I, BINDING SITE II or BINDING SITE III of FIG. 8. Table 4 illustrates the complementarity of the nucleotide sequences of ANXA8 BINDING SITE, designated SEQ ID:15378, to the nucleotide sequence of GAM175 RNA, herein designated GAM RNA, also designated SEQ ID:265.

Another function of GAM175 is therefore inhibition of Annexin a8 (ANXA8, Accession NP_001621.1), a gene which acts as an indirect inhibitor of the thromboplastin-specific complex, which is involved in the blood coagulation cascade. and therefore may be associated with Promyelocytic leukemia locus (pml). Accordingly, utilities of GAM175 include diagnosis, prevention and treatment of Promyelocytic leukemia locus (pml), and of other diseases and clinical conditions associated with ANXA8.

The function of ANXA8 and its association with various diseases and clinical conditions, has been established by previous studies, as described hereinabove with reference to GAM55.2. Apoptotic protease activating factor (APAF1, Accession NP_037361.1) is another GAM175 target gene, herein designated TARGET GENE. APAF1 BINDING SITE is a target binding site found in the 3' untranslated region of multiple transcripts of mRNA encoded by APAF1, corresponding to a target binding site such as BINDING SITE I, BINDING SITE II or BINDING SITE III of FIG. 8. Table 4 illustrates the complementarity of the nucleotide sequences of APAF1 BINDING SITE, designated SEQ ID:12211, to the nucleotide sequence of GAM175 RNA, herein designated GAM RNA, also designated SEQ ID:265.

Another function of GAM175 is therefore inhibition of Apoptotic protease activating factor (APAF1, Accession NP_037361.1), a gene which functions in the mitochondrial apoptotic pathway that leads to caspase 9 dependent activation of caspase 3 and therefore may be associated with Cancer. Accordingly, utilities of GAM175 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apoptotic protease activating factor (APAF1, Accession NP_001151.1) is another GAM175 target gene, herein designated TARGET GENE. APAF1 BINDING SITE is a target binding site found in the 3' untranslated region of multiple transcripts of mRNA encoded by APAF1, corresponding to a target binding site such as BINDING SITE I, BINDING SITE II or BINDING SITE III of FIG. 8. Table 4 illustrates the complementarity of the nucleotide sequences of APAF1 BINDING SITE, designated SEQ ID:12211, to the nucleotide sequence of GAM175 RNA, herein designated GAM RNA, also designated SEQ ID:265.

Another function of GAM175 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM175 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apolipoprotein l, 1 (APOL1, Accession NP_003652.2) is another GAM175 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:10954, to the nucleotide sequence of GAM175 RNA, herein designated GAM RNA, also designated SEQ ID:265.

Another function of GAM175 is therefore inhibition of Apolipoprotein l, 1 (APOL1, Accession NP_003652.2), a gene which may participate in reverse cholesterol transport from peripheral cells to the liver. and therefore may be associated with Schizophrenia. Accordingly, utilities of GAM175 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Apolipoprotein l, 1 (APOL1, Accession NP_663319.1) is another GAM175 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:10954, to the nucleotide sequence of GAM175 RNA, herein designated GAM RNA, also designated SEQ ID:265.

Another function of GAM175 is therefore inhibition of Apolipoprotein l, 1 (APOL1, Accession NP_663319.1), a gene which may participate in reverse cholesterol transport from peripheral cells to the liver. and therefore may be associated with Schizophrenia. Accordingly, utilities of GAM175 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Apolipoprotein l, 1 (APOL1, Accession NP_663318.1) is another GAM175 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:10954, to the nucleotide sequence of GAM175 RNA, herein designated GAM RNA, also designated SEQ ID:265.

Another function of GAM175 is therefore inhibition of Apolipoprotein l, 1 (APOL1, Accession NP_663318.1), a gene which may participate in reverse cholesterol transport from peripheral cells to the liver. and therefore may be associated with Schizophrenia. Accordingly, utilities of GAM175 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Adp-ribosylation factor 4 (ARF4, Accession NP_001651.1) is another GAM175 target gene, herein designated TARGET GENE. ARF4 BINDING SITE is a target binding site found in the 3' untranslated region of mRNA encoded by ARF4, corresponding to a target binding site such as BINDING SITE I, BINDING SITE II or BINDING SITE III of FIG. 8. Table 4 illustrates the complementarity of the nucleotide sequences of ARF4 BINDING SITE, designated SEQ ID:16305, to the nucleotide sequence of GAM175 RNA, herein designated GAM RNA, also designated SEQ ID:265.

Another function of GAM175 is therefore inhibition of Adp-ribosylation factor 4 (ARF4, Accession NP_001651.1). Accordingly, utilities of GAM175 include diagnosis, prevention and treatment of diseases and clinical conditions associated with ARF4.

Rho/rac guanine nucleotide exchange factor (gef) 2 (ARHGEF2, Accession NP_004714.2) is another GAM175 target gene, herein designated TARGET GENE. ARHGEF2 BINDING SITE is a target binding site found in the 3' untranslated region of mRNA encoded by ARHGEF2, corresponding to a target binding site such as BINDING SITE I, BINDING SITE II or BINDING SITE III of FIG. 8. Table 4 illustrates the complementarity of the nucleotide sequences of ARHGEF2 BINDING SITE, designated SEQ ID:10786, to the nucleotide sequence of GAM175 RNA, herein designated GAM RNA, also designated SEQ ID:265.

Another function of GAM175 is therefore inhibition of Rho/rac guanine nucleotide exchange factor (gef) 2 (ARHGEF2, Accession NP_004714.2). Accordingly, utilities of GAM175 include diagnosis, prevention and treatment of diseases and clinical conditions associated with ARHGEF2.

Cdc42 guanine nucleotide exchange factor (gef) 9 (ARHGEF9, Accession NP_056000.1) is another GAM175 target gene, herein designated TARGET GENE. ARHGEF9 BINDING SITE is a target binding site found in the 3' untranslated region of mRNA encoded by ARHGEF9, corresponding to a target binding site such as BINDING SITE I, BINDING SITE II or BINDING SITE III of FIG. 8. Table 4 illustrates the complementarity of the nucleotide sequences of ARHGEF9 BINDING SITE, designated SEQ ID:527, to the nucleotide sequence of GAM175 RNA, herein designated GAM RNA, also designated SEQ ID:265.

Another function of GAM175 is therefore inhibition of Cdc42 guanine nucleotide exchange factor (gef) 9 (ARHGEF9, Accession NP_056000.1). Accordingly, utilities of GAM175 include diagnosis, prevention and treatment of diseases and clinical conditions associated with ARHGEF9.

Aryl-hydrocarbon receptor nuclear translocator 2 (ARNT2, Accession NP_055677.1) is another GAM175 target gene, herein designated TARGET GENE. ARNT2 BINDING SITE is a target binding site found in the 3' untranslated region of mRNA encoded by ARNT2, corresponding to a target binding site such as BINDING SITE I, BINDING SITE II or BINDING SITE III of FIG. 8. Table 4 illustrates the complementarity of the nucleotide sequences of ARNT2 BINDING SITE, designated SEQ ID:16746, to the nucleotide sequence of GAM175 RNA, herein designated GAM RNA, also designated SEQ ID:265.

Another function of GAM175 is therefore inhibition of Aryl-hydrocarbon receptor nuclear translocator 2 (ARNT2, Accession NP_055677.1), a gene which specifically recognizes the xenobiotic response element (xre). Accordingly, utilities of GAM175 include diagnosis, prevention and treatment of diseases and clinical conditions associated with ARNT2.

The function of ARNT2 and its association with various diseases and clinical conditions, has been established by previous studies, as described hereinabove with reference to GAM67.1. ART5 (Accession NP_443750.2) is another GAM175 target gene, herein designated TARGET GENE. ART5 BINDING SITE is a target binding site found in the 5' untranslated region of mRNA encoded by ART5, corresponding to a target binding site such as BINDING SITE I, BINDING SITE II or BINDING SITE III of FIG. 8. Table 4 illustrates the complementarity of the nucleotide sequences of ART5 BINDING SITE, designated SEQ ID:13679, to the nucleotide sequence of GAM175 RNA, herein designated GAM RNA, also designated SEQ ID:265.

Another function of GAM175 is therefore inhibition of ART5 (Accession NP_443750.2). Accordingly, utilities of GAM175 include diagnosis, prevention and treatment of diseases and clinical conditions associated with ART5.

Chromosome 10 open reading frame 2 (C10orf2, Accession NP_068602.1) is another GAM175 target gene, herein designated TARGET GENE. C10orf2 BINDING SITE is a target binding site found in the 3' untranslated region of mRNA encoded by C10orf2, corresponding to a target binding site such as BINDING SITE I, BINDING SITE II or BINDING SITE III of FIG. 8. Table 4 illustrates the complementarity of the nucleotide sequences of C10orf2 BINDING SITE, designated SEQ ID:3494, to the nucleotide sequence of GAM175 RNA, herein designated GAM RNA, also designated SEQ ID:265.

Another function of GAM175 is therefore inhibition of Chromosome 10 open reading frame 2 (C10orf2, Accession NP_068602.1). Accordingly, utilities of GAM175 include diagnosis, prevention and treatment of diseases and clinical conditions associated with C10orf2.

Chromosome 14 open reading frame 37 (C14orf37, Accession XP_085124.2) is another GAM175 target gene, herein designated TARGET GENE. C14orf37 BINDING SITE is a target binding site found in the 3' untranslated region of mRNA encoded by C14orf37, corresponding to a target binding site such as BINDING SITE I, BINDING SITE II or BINDING SITE III of FIG. 8. Table 4 illustrates the complementarity of the nucleotide sequences of C14orf37 BINDING SITE, designated SEQ ID:18001, to the nucleotide sequence of GAM175 RNA, herein designated GAM RNA, also designated SEQ ID:265.

Another function of GAM175 is therefore inhibition of Chromosome 14 open reading frame 37 (C14orf37, Accession XP_085124.2). Accordingly, utilities of GAM175 include diagnosis, prevention and treatment of diseases and clinical conditions associated with C14orf37.

Chromosome 1 open reading frame 34 (C1orf34, Accession XP_027172.1) is another GAM175 target gene, herein designated TARGET GENE. C1orf34 BINDING SITE is a target binding site found in the 3' untranslated region of mRNA encoded by C1orf34, corresponding to a target binding site such as BINDING SITE I, BINDING SITE II or BINDING SITE III of FIG. 8. Table 4 illustrates the complementarity of the nucleotide sequences of C1orf34 BINDING SITE, designated SEQ ID:10527, to the nucleotide sequence of GAM175 RNA, herein designated GAM RNA, also designated SEQ ID:265.

Another function of GAM175 is therefore inhibition of Chromosome 1 open reading frame 34 (C1orf34, Accession XP_027172.1). Accordingly, utilities of GAM175 include diagnosis, prevention and treatment of diseases and clinical conditions associated with C1orf34.

Chromosome 5 open reading frame 7 (C5orf7, Accession NP_057688.1) is another GAM175 target gene, herein designated TARGET GENE. C5orf7 BINDING SITE is a target binding site found in the 5' untranslated region of mRNA encoded by C5orf7, corresponding to a target binding site such as BINDING SITE I, BINDING SITE II or BINDING SITE III of FIG. 8. Table 4 illustrates the complementarity of the nucleotide sequences of C5orf7 BINDING SITE, designated SEQ ID:449, to the nucleotide sequence of GAM175 RNA, herein designated GAM RNA, also designated SEQ ID:265.

Another function of GAM175 is therefore inhibition of Chromosome 5 open reading frame 7 (C5orf7, Accession NP_057688.1). Accordingly, utilities of GAM175 include diagnosis, prevention and treatment of diseases and clinical conditions associated with C5orf7.

Chemokine (c-c motif) receptor 2 (CCR2, Accession NP_000639.1) is another GAM175 target gene, herein designated TARGET GENE. CCR2 BINDING SITE is a target binding site found in the 3' untranslated region of multiple transcripts of mRNA encoded by CCR2, corresponding to a target binding site such as BINDING SITE I, BINDING SITE II or BINDING SITE III of FIG. 8. Table 4 illustrates the complementarity of the nucleotide sequences of CCR2 BINDING SITE, designated SEQ ID:13143, to the nucleotide sequence of GAM175 RNA, herein designated GAM RNA, also designated SEQ ID:265.

Another function of GAM175 is therefore inhibition of Chemokine (c-c motif) receptor 2 (CCR2, Accession NP_000639.1), a gene which binds chemokines and transduces a signal by increasing the intracellular calcium ions level. and therefore may be associated with Hiv-1 infection. Accordingly, utilities of GAM175 include diagnosis, prevention and treatment of Hiv-1 infection, and of other diseases and clinical conditions associated with CCR2.

The function of CCR2 has been established by previous studies. Charo et al. (1994) isolated 2 cDNAs by degenerate PCR using primers for a conserved region in the second and third transmembrane domains of the MIP-1-alpha/RANTES receptor (OMIM Ref. No. 601159) and IL-8 receptors (146928, 146929). They then used PCR products to screen a human monocytic leukemia-cell library. The 2 cDNAs encoded putative chemokine receptors (termed A and B) that are identical except for their C termini and thus appear to result from alternative splicing. The 347-amino acid predicted protein from the A isoform, designated MCP1RA (and later termed CC CKR2A by Combadiere et al., 1995), is 51% identical to the MIP-1-alpha/RANTES receptor. As are the other members of this receptor family, MCP1RA is a 7-transmembrane G protein-coupled receptor. Combadiere et al. (1995) demonstrated that the predominant agonist for CC CKR2A is MCP1, while both MCP1 and MCP3 (OMIM Ref. No. 158106) are ligands for the CC CKR2B isoform (Combadiere et al., 1995).

Animal model experiments lend further support to the function of CCR2. Peters et al. (2000) observed that after immunization with Th1-inducing agents, Ccr2 -/- mice produced markedly less gamma-interferon (IFNG; 147570) after antigen-specific stimulation than did wildtype mice. In contrast, IL5 (OMIM Ref. No. 147850), IL10 (OMIM Ref. No. 124092), and IL13 (OMIM Ref. No. 147683) production was not impaired in Ccr2 -/- mice. Flow cytometric analysis showed that fewer antigen-presenting cells migrated to the immunization site or draining lymph nodes in the Ccr2 -/- mice. Peters et al. (2000) concluded that CCR2 is required for proper trafficking of antigen-presenting cells capable of inducing IFNG production by T cells.

It is appreciated that the abovementioned animal model for CCR2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Combadiere, C.; Ahuja, S. K.; Van Damme, J.; Tiffany, H. L.; Gao, J.-L.; Murphy, P. M.: Monocyte chemoattractant protein-3 is a functional ligand for CC chemokine receptors 1 and 2B. J. Biol. Chem. 270:29671-29675, 1995; and Peters, W.; Dupuis, M.; Charo, I. F.: A mechanism for the impaired IFN-gamma production in C-C chemokine receptor 2 (CCR2) knockout mice: role of CCR2 in linking the innate and adaptive.

Further studies establishing the function and utilities of CCR2 are found in John Hopkins OMIM database record ID 601267, and in cited publications listed in Table 5, which are hereby incorporated by reference. Ccr4 carbon catabolite repression 4-like (s. cerevisiae) (CCRN4L, Accession NP_036250.2) is another GAM175 target gene, herein designated TARGET GENE. CCRN4L BINDING SITE is a target binding site found in the 3' untranslated region of mRNA encoded by CCRN4L, corresponding to a target binding site such as BINDING SITE I, BINDING SITE II or BINDING SITE III of FIG. 8. Table 4 illustrates the complementarity of the nucleotide sequences of CCRN4L BINDING SITE, designated SEQ ID:708, to the nucleotide sequence of GAM175 RNA, herein designated GAM RNA, also designated SEQ ID:265.

Another function of GAM175 is therefore inhibition of Ccr4 carbon catabolite repression 4-like (s. cerevisiae) (CCRN4L, Accession NP_036250.2). Accordingly, utilities of GAM175 include diagnosis, prevention and treatment of diseases and clinical conditions associated with CCRN4L.

CHDC1 (Accession XP_166260.1) is another GAM175 target gene, herein designated TARGET GENE. CHDC1 BINDING SITE is a target binding site found in the 5' untranslated region of mRNA encoded by CHDC1, corresponding to a target binding site such as BINDING SITE I, BINDING SITE II or BINDING SITE III of FIG. 8. Table 4 illustrates the complementarity of the nucleotide sequences of CHDC1 BINDING SITE, designated SEQ ID:13850, to the nucleotide sequence of GAM175 RNA, herein designated GAM RNA, also designated SEQ ID:265.

Another function of GAM175 is therefore inhibition of CHDC1 (Accession XP_166260.1). Accordingly, utilities of GAM175 include diagnosis, prevention and treatment of diseases and clinical conditions associated with CHDC1.

Carbohydrate (n-acetylglucosamine 6-o) sulfotransferase 5 (CHST5, Accession NP_036258.1) is another GAM175 target gene, herein designated TARGET GENE. CHST5 BINDING SITE is a target binding site found in the 5' untranslated region of mRNA encoded by CHST5, corresponding to a target binding site such as BINDING SITE I, BINDING SITE II or BINDING SITE III of FIG. 8. Table 4 illustrates the complementarity of the nucleotide sequences of CHST5 BINDING SITE, designated SEQ ID:1259, to the nucleotide sequence of GAM175 RNA, herein designated GAM RNA, also designated SEQ ID:265.

Another function of GAM175 is therefore inhibition of Carbohydrate (n-acetylglucosamine 6-o) sulfotransferase 5 (CHST5, Accession NP_036258.1), a gene which may be involved in sulfation of glycoproteins and proteoglycans. Accordingly, utilities of GAM175 include diagnosis, prevention and treatment of diseases and clinical conditions associated with CHST5.

The function of CHST5 has been established by previous studies. The carbohydrates of glycoconjugates are highly diverse structures with variation in monosaccharide composition, glycosidic linkage positions, and branching of chains.

Further diversity is added by the covalent addition of sulfate moieties to particular hydroxyl groups and amino groups of saccharides. The sulfate modifications of glycoproteins can be extensive in amount and frequently occur at high density. They can have a profound effect on the physiochemical properties of the glycoconjugates, at least in part through the addition of negative charge. Carbohydrate sulfation plays a critical role in many biologic processes. The GST family of sulfotransferases includes CHST1 (OMIM Ref. No. 603797), CHST2 (OMIM Ref. No. 603798), CHST3 (OMIM Ref. No. 603799), and LSST. These enzymes are 6-O- sulfotransferases, which add sulfate to C6 of galactose (Gal), N- acetylgalactosamine (OMIM Ref. No. GalNAc), or N-acetylglucosamine (OMIM Ref. No. GlcNAc). By searching an EST database with the sequences of CHST1 and LSST, Lee et al. (1999) identified nonoverlapping ESTs encoding CHST5, which they called IGlcNAc6ST. They isolated additional CHST5 ESTs and assembled a complete CHST5 coding sequence. The deduced 390-amino acid CHST5 protein is predicted to be a type II transmembrane protein, with an N-terminal cytoplasmic tail of 9 residues and a single transmembrane domain. The extracellular domain contains 3 potential N-glycosylation sites. CHST5 shares 55% amino acid sequence identity with LSST, 35.8% identity with CHST1, and 76% identity with mouse Chst5, whose cDNA Lee et al. (1999) also cloned. Recombinant CHST5 expressed in mammalian cells catalyzed the addition of sulfate to C6 of GlcNAc. Lee et al. (1999) isolated the CHST5 genomic sequence. The CHST5 gene is intronless. Northern blot analysis of a variety of normal human tissues showed a major 2.8-kb CHST5 transcript at relatively high levels in colon and small intestine and at lower levels in fetal liver. Minor transcripts of 3.5, 4, 5, and 8 kb were also found in colon and small intestine. CHST5 expression was not detected in any of the other tissues tested. CHST5, encoding an intestinal sulfotransferase, is situated close to CHST6 (OMIM Ref. No. 605294), which encodes a corneal sulfotransferase and is mutant in cases of macular corneal dystrophy (OMIM Ref. No. 217800). By radiation hybrid analysis, Akama et al. (2000) mapped the CHST5 and CHST6 genes to 16q22, between markers D16S3326 and D16S3016

Full details of the abovementioned studies are described in the following publications, the disclosure of which are hereby incorporated by reference:

Akama, T. O.; Nishida, K.; Nakayama, J.; Watanabe, H.; Ozaki, K.; Nakamura, T.; Dota, A.; Kawasaki, S.; Inoue, Y.; Maeda, N.; Yamamoto, S.; Fujiwara, T.; Thonar, E. J.-M. A.; Shimomura, Y.; Kinoshita, S.; Tanigami, A.; Fukuda, M. N.: Macular corneal dystrophy type I and type II are caused by distinct mutations in a new sulphotransferase gene. Nature Genet. 26:237-241, 2000; and Lee, J. K.; Bhakta, S.; Rosen, S. D.; Hemmerich, S.: Cloning and characterization of a mammalian N-acetylglucosamine-6-sulfotransferase that is highly restricted to intestinal tissue.

Further studies establishing the function and utilities of CHST5 are found in John Hopkins OMIM database record ID 604817, and in cited publications listed in Table 5, which are hereby incorporated by reference. Cop9 constitutive photomorphogenic homolog subunit 7a (arabidopsis) (COPS7A, Accession NP_057403.1) is another GAM175 target gene, herein designated TARGET GENE. COPS7A BINDING SITE is a target binding site found in the 3' untranslated region of mRNA encoded by COPS7A, corresponding to a target binding site such as BINDING SITE I, BINDING SITE II or BINDING SITE III of FIG. 8. Table 4 illustrates the complementarity of the nucleotide sequences of COPS7A BINDING SITE, designated SEQ ID:15229, to the nucleotide sequence of GAM175 RNA, herein designated GAM RNA, also designated SEQ ID:265.

Another function of GAM175 is therefore inhibition of Cop9 constitutive photomorphogenic homolog subunit 7a (arabidopsis) (COPS7A, Accession NP_057403.1). Accordingly, utilities of GAM175 include diagnosis, prevention and treatment of diseases and clinical conditions associated with COPS7A.

Cse1 chromosome segregation 1-like (yeast) (CSE1L, Accession NP_803185.1) is another GAM175 target gene, herein designated TARGET GENE. CSE1L BINDING SITE is a target binding site found in the 3' untranslated region of multiple transcripts of mRNA encoded by CSE1L, corresponding to a target binding site such as BINDING SITE I, BINDING SITE II or BINDING SITE III of FIG. 8. Table 4 illustrates the complementarity of the nucleotide sequences of CSE1L BINDING SITE, designated SEQ ID:17881, to the nucleotide sequence of GAM175 RNA, herein designated GAM RNA, also designated SEQ ID:265.

Another function of GAM175 is therefore inhibition of Cse1 chromosome segregation 1-like (yeast) (CSE1L, Accession NP_803185.1). Accordingly, utilities of GAM175 include diagnosis, prevention and treatment of diseases and clinical conditions associated with CSE1L.

Cse1 chromosome segregation 1-like (yeast) (CSE1L, Accession NP_001307.2) is another GAM175 target gene, herein designated TARGET GENE. CSE1L BINDING SITE is a target binding site found in the 3' untranslated region of multiple transcripts of mRNA encoded by CSE1L, corresponding to a target binding site such as BINDING SITE I, BINDING SITE II or BINDING SITE III of FIG. 8. Table 4 illustrates the complementarity of the nucleotide sequences of CSE1L BINDING SITE, designated SEQ ID:17881, to the nucleotide sequence of GAM175 RNA, herein designated GAM RNA, also designated SEQ ID:265.

Another function of GAM175 is therefore inhibition of Cse1 chromosome segregation 1-like (yeast) (CSE1L, Accession NP_001307.2). Accordingly, utilities of GAM175 include diagnosis, prevention and treatment of diseases and clinical conditions associated with CSE1L.

Catenin (cadherin-associated protein), alpha 2 (CTNNA2, Accession NP_004380.1) is another GAM175 target gene, herein designated TARGET GENE. CTNNA2 BINDING SITE is a target binding site found in the 3' untranslated region of mRNA encoded by CTNNA2, corresponding to a target binding site such as BINDING SITE I, BINDING SITE II or BINDING SITE III of FIG. 8. Table 4 illustrates the complementarity of the nucleotide sequences of CTNNA2 BINDING SITE, designated SEQ ID:1392, to the nucleotide sequence of GAM175 RNA, herein designated GAM RNA, also designated SEQ ID:265.

Another function of GAM175 is therefore inhibition of Catenin (cadherin-associated protein), alpha 2 (CTNNA2, Accession NP_004380.1), a gene which is involved in the cytoplasmic anchorage of cell-cell and cell-substrate adhesion molecules. Accordingly, utilities of GAM175 include diagnosis, prevention and treatment of diseases and clinical conditions associated with CTNNA2.

The function of CTNNA2 has been established by previous studies. Cell-cell and cell-matrix adhesions involve transmembrane glycoproteins such as cell adhesion molecules and integrins, which are thought to function via interactions of their cytoplasmic domains with proteins associated with the cytoskeleton. Vinculin (OMIM Ref. No. 193065) and talin (OMIM Ref. No. 186745) are examples. The activity of cadherins (e.g., 114020), which mediate homophilic cell-cell Ca(2+)-dependent association, depends on their anchorage to cytoskeleton via proteins termed catenins (Herrenknecht et al., 1991).

Animal model experiments lend further support to the function of CTNNA2. Mice homozygous for the 'cerebellar-deficient folia' (cdf) mutation are ataxic and have cerebellar hypoplasia and abnormal lobulation of the cerebellum (Cook et al., 1997). In the cerebella of cdf/cdf homozygous mice, approximately 40% of Purkinje cells are located ectopically in the white matter and inner granule-cell layer. Many hippocampal pyramidal cells are scattered in the plexiform layers, and those that are correctly positioned are less densely packed than are cells in wildtype mice. Park et al. (2002) showed that fear conditioning and prepulse inhibition of the startle response are also disrupted in cdf/cdf mice. They identified a deletion on mouse chromosome 6 that removed approximately 150 kb of the cdf region. The deletion included part of Catna2, encoding alpha-N-catenin, a protein that links the classic cadherins to the neuronal cytoskeleton. Expression of a Catna2 transgene in cdf/cdf mice restored normal cerebellar and hippocampal morphology, prepulse inhibition, and fear conditioning. The findings suggested that catenin-cadherin cell-adhesion complexes are important in cerebellar and hippocampal lamination and in the control of startle modulation.

It is appreciated that the abovementioned animal model for CTNNA2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Claverie, J.-M.; Hardelin, J.-P.; Legouis, R.; Levilliers, J.; Bougueleret, L.; Mattei, M.-G.; Petit, C.: Characterization and chromosomal assignment of a human cDNA encoding a protein related to the murine 102-kDa cadherin-associated protein (alpha-catenin). Genomics 15:13-20, 1993; and Park, C.; Falls, W.; Finger, J. H.; Longo-Guess, C. M.; Ackerman, S. L.: Deletion in Catna2, encoding alpha-N-catenin, causes cerebellar and hippocampal lamination defects and impaired.

Further studies establishing the function and utilities of CTNNA2 are found in John Hopkins OMIM database record ID 114025, and in cited publications listed in Table 5, which are hereby incorporated by reference. Catenin, beta interacting protein 1 (CTNNBIP1, Accession NP_064633.1) is another GAM175 target gene, herein designated TARGET GENE. CTNNBIP1 BINDING SITE is a target binding site found in the 3' untranslated region of mRNA encoded by CTNNBIP1, corresponding to a target binding site such as BINDING SITE I, BINDING SITE II or BINDING SITE III of FIG. 8. Table 4 illustrates the complementarity of the nucleotide sequences of CTNNBIP1 BINDING SITE, designated SEQ ID:17490, to the nucleotide sequence of GAM175 RNA, herein designated GAM RNA, also designated SEQ ID:265.

Another function of GAM175 is therefore inhibition of Catenin, beta interacting protein 1 (CTNNBIP1, Accession NP_064633.1). Accordingly, utilities of GAM175 include diagnosis, prevention and treatment of diseases and clinical conditions associated with CTNNBIP1.

Catenin (cadherin-associated protein), delta 1 (CTNND1, Accession NP_001322.1) is another GAM175 target gene, herein designated TARGET GENE. CTNND1 BINDING SITE is a target binding site found in the 3' untranslated region of mRNA encoded by CTNND1, corresponding to a target binding site such as BINDING SITE I, BINDING SITE II or BINDING SITE III of FIG. 8. Table 4 illustrates the complementarity of the nucleotide sequences of CTNND1 BINDING SITE, designated SEQ ID:18658, to the nucleotide sequence of GAM175 RNA, herein designated GAM RNA, also designated SEQ ID:265.

Another function of GAM175 is therefore inhibition of Catenin (cadherin-associated protein), delta 1 (CTNND1, Accession NP_001322.1). Accordingly, utilities of GAM175 include diagnosis, prevention and treatment of diseases and clinical conditions associated with CTNND1.

Death-associated protein kinase 1 (DAPK1, Accession NP_004929.1) is another GAM175 target gene, herein designated TARGET GENE. DAPK1 BINDING SITE is a target binding site found in the 3' untranslated region of mRNA encoded by DAPK1, corresponding to a target binding site such as BINDING SITE I, BINDING SITE II or BINDING SITE III of FIG. 8. Table 4 illustrates the complementarity of the nucleotide sequences of DAPK1 BINDING SITE, designated SEQ ID:10219, to the nucleotide sequence of GAM175 RNA, herein designated GAM RNA, also designated SEQ ID:265.

Another function of GAM175 is therefore inhibition of Death-associated protein kinase 1 (DAPK1, Accession NP_004929.1). Accordingly, utilities of GAM175 include diagnosis, prevention and treatment of diseases and clinical conditions associated with DAPK1.

Dna cross-link repair 1c (pso2 homolog, s. cerevisiae) (DCLRE1C, Accession NP_071932.1) is another GAM175 target gene, herein designated TARGET GENE. DCLRE1C BINDING SITE is a target binding site found in the 5' untranslated region of mRNA encoded by DCLRE1C, corresponding to a target binding site such as BINDING SITE I, BINDING SITE II or BINDING SITE III of FIG. 8. Table 4 illustrates the complementarity of the nucleotide sequences of DCLRE1C BINDING SITE, designated SEQ ID:8700, to the nucleotide sequence of GAM175 RNA, herein designated GAM RNA, also designated SEQ ID:265.

Another function of GAM175 is therefore inhibition of Dna cross-link repair 1c (pso2 homolog, s. cerevisiae) (DCLRE1C, Accession NP_071932.1), a gene which intervenes in V(D)J recombination/DNA repair. and therefore may be associated with Severe combined immunodeficiency with sensitivity to ionizing radiation . Accordingly, utilities of GAM175 include diagnosis, prevention and treatment of Severe combined immunodeficiency with sensitivity to ionizing radiation ., and of other diseases and clinical conditions associated with DCLRE1C.

The function of DCLRE1C and its association with various diseases and clinical conditions, has been established by previous studies, as described hereinabove with reference to GAM72.1. Diaphanous homolog 2 (drosophila) (DIAPH2, Accession NP_006720.1) is another GAM175 target gene, herein designated TARGET GENE. DIAPH2 BINDING SITE is a target binding site found in the 3' untranslated region of multiple transcripts of mRNA encoded by DIAPH2, corresponding to a target binding site such as BINDING SITE I, BINDING SITE II or BINDING SITE III of FIG. 8. Table 4 illustrates the complementarity of the nucleotide sequences of DIAPH2 BINDING SITE, designated SEQ ID:5513, to the nucleotide sequence of GAM175 RNA, herein designated GAM RNA, also designated SEQ ID:265.

Another function of GAM175 is therefore inhibition of Diaphanous homolog 2 (drosophila) (DIAPH2, Accession NP_006720.1), a gene which may affect in oogenesis and therefore may be associated with Premature ovarian failure. Accordingly, utilities of GAM175 include diagnosis, prevention and treatment of Premature ovarian failure., and of other diseases and clinical conditions associated with DIAPH2.

The function of DIAPH2 and its association with various diseases and clinical conditions, has been established by previous studies, as described hereinabove with reference to GAM66.1. DKFZp434G179 (Accession XP_087065.1) is another GAM175 target gene, herein designated TARGET GENE. DKFZp434G179 BINDING SITE is a target binding site found in the 3' untranslated region of mRNA encoded by DKFZp434G179, corresponding to a target binding site such as BINDING SITE I, BINDING SITE II or BINDING SITE III of FIG. 8. Table 4 illustrates the complementarity of the nucleotide sequences of DKFZp434G179 BINDING SITE, designated SEQ ID:15093, to the nucleotide sequence of GAM175 RNA, herein designated GAM RNA, also designated SEQ ID:265.

Another function of GAM175 is therefore inhibition of DKFZp434G179 (Accession XP_087065.1). Accordingly, utilities of GAM175 include diagnosis, prevention and treatment of diseases and clinical conditions associated with DKFZp434G179.

DKFZP434H132 (Accession NP_056307.1) is another GAM175 target gene, herein designated TARGET GENE. DKFZP434H132 BINDING SITE is a target binding site found in the 3' untranslated region of mRNA encoded by DKFZP434H132, corresponding to a target binding site such as BINDING SITE I, BINDING SITE II or BINDING SITE III of FIG. 8. Table 4 illustrates the complementarity of the nucleotide sequences of DKFZP434H132 BINDING SITE, designated SEQ ID:10923, to the nucleotide sequence of GAM175 RNA, herein designated GAM RNA, also designated SEQ ID:265.

Another function of GAM175 is therefore inhibition of DKFZP434H132 (Accession NP_056307.1). Accordingly, utilities of GAM175 include diagnosis, prevention and treatment of diseases and clinical conditions associated with DKFZP434H132.

DKFZP434H2010 (Accession NP_115505.1) is another GAM175 target gene, herein designated TARGET GENE. DKFZP434H2010 BINDING SITE is a target binding site found in the 3' untranslated region of mRNA encoded by DKFZP434H2010, corresponding to a target binding site such as BINDING SITE I, BINDING SITE II or BINDING SITE III of FIG. 8. Table 4 illustrates the complementarity of the nucleotide sequences of DKFZP434H2010 BINDING SITE, designated SEQ ID:2795, to the nucleotide sequence of GAM175 RNA, herein designated GAM RNA, also designated SEQ ID:265.

Another function of GAM175 is therefore inhibition of DKFZP434H2010 (Accession NP_115505.1). Accordingly, utilities of GAM175 include diagnosis, prevention and treatment of diseases and clinical conditions associated with DKFZP434H2010.

DKFZp434K2435 (Accession NP_115632.1) is another GAM175 target gene, herein designated TARGET GENE. DKFZp434K2435 BINDING SITE is a target binding site found in the 3' untranslated region of mRNA encoded by DKFZp434K2435, corresponding to a target binding site such as BINDING SITE I, BINDING SITE II or BINDING SITE III of FIG. 8. Table 4 illustrates the complementarity of the nucleotide sequences of DKFZp434K2435 BINDING SITE, designated SEQ ID:6806, to the nucleotide sequence of GAM175 RNA, herein designated GAM RNA, also designated SEQ ID:265.

Another function of GAM175 is therefore inhibition of DKFZp434K2435 (Accession NP_115632.1). Accordingly, utilities of GAM175 include diagnosis, prevention and treatment of diseases and clinical conditions associated with DKFZp434K2435.

DKFZp761G0122 (Accession NP_689874.1) is another GAM175 target gene, herein designated TARGET GENE. DKFZp761G0122 BINDING SITE is a target binding site found in the 3' untranslated region of mRNA encoded by DKFZp761G0122, corresponding to a target binding site such as BINDING SITE I, BINDING SITE II or BINDING SITE III of FIG. 8. Table 4 illustrates the complementarity of the nucleotide sequences of DKFZp761G0122 BINDING SITE, designated SEQ ID:10041, to the nucleotide sequence of GAM175 RNA, herein designated GAM RNA, also designated SEQ ID:265.

Another function of GAM175 is therefore inhibition of DKFZp761G0122 (Accession NP_689874.1). Accordingly, utilities of GAM175 include diagnosis, prevention and treatment of diseases and clinical conditions associated with DKFZp761G0122.

Ectodermal dysplasia 1, anhidrotic (ED1, Accession NP_001390.1) is another GAM175 target gene, herein designated TARGET GENE. ED1 BINDING SITE is a target binding site found in the 3' untranslated region of mRNA encoded by ED1, corresponding to a target binding site such as BINDING SITE I, BINDING SITE II or BINDING SITE III of FIG. 8. Table 4 illustrates the complementarity of the nucleotide sequences of ED1 BINDING SITE, designated SEQ ID:3738, to the nucleotide sequence of GAM175 RNA, herein designated GAM RNA, also designated SEQ ID:265.

Another function of GAM175 is therefore inhibition of Ectodermal dysplasia 1, anhidrotic (ED1, Accession NP_001390.1). Accordingly, utilities of GAM175 include diagnosis, prevention and treatment of diseases and clinical conditions associated with ED1.

Endothelial differentiation, sphingolipid g-protein-coupled receptor, 1 (EDG1, Accession NP_001391.2) is another GAM175 target gene, herein designated TARGET GENE. EDG1 BINDING SITE is a target binding site found in the 5' untranslated region of mRNA encoded by EDG1, corresponding to a target binding site such as BINDING SITE I, BINDING SITE II or BINDING SITE III of FIG. 8. Table 4 illustrates the complementarity of the nucleotide sequences of EDG1 BINDING SITE, designated SEQ ID:5089, to the nucleotide sequence of GAM175 RNA, herein designated GAM RNA, also designated SEQ ID:265.

Another function of GAM175 is therefore inhibition of Endothelial differentiation, sphingolipid g-protein-coupled receptor, 1 (EDG1, Accession NP_001391.2). Accordingly, utilities of GAM175 include diagnosis, prevention and treatment of diseases and clinical conditions associated with EDG1.

Epsin 2 (EPN2, Accession NP_055779.1) is another GAM175 target gene, herein designated TARGET GENE. EPN2 BINDING SITE is a target binding site found in the 3' untranslated region of multiple transcripts of mRNA encoded by EPN2, corresponding to a target binding site such as BINDING SITE I, BINDING SITE II or BINDING SITE III of FIG. 8. Table 4 illustrates the complementarity of the nucleotide sequences of EPN2 BINDING SITE, designated SEQ ID:3856, to the nucleotide sequence of GAM175 RNA, herein designated GAM RNA, also designated SEQ ID:265.

Another function of GAM175 is therefore inhibition of Epsin 2 (EPN2, Accession NP_055779.1). Accordingly, utilities of GAM175 include diagnosis, prevention and treatment of diseases and clinical conditions associated with EPN2.

Epsin 2 (EPN2, Accession NP_683723.1) is another GAM175 target gene, herein designated TARGET GENE. EPN2 BINDING SITE is a target binding site found in the 3' untranslated region of multiple transcripts of mRNA encoded by EPN2, corresponding to a target binding site such as BINDING SITE I, BINDING SITE II or BINDING SITE III of FIG. 8. Table 4 illustrates the complementarity of the nucleotide sequences of EPN2 BINDING SITE, designated SEQ ID:3856, to the nucleotide sequence of GAM175 RNA, herein designated GAM RNA, also designated SEQ ID:265.

Another function of GAM175 is therefore inhibition of Epsin 2 (EPN2, Accession NP_683723.1). Accordingly, utilities of GAM175 include diagnosis, prevention and treatment of diseases and clinical conditions associated with EPN2.

Fem-1 homolog a (c.elegans) (FEM1A, Accession NP_061178.1) is another GAM175 target gene, herein designated TARGET GENE. FEM1A BINDING SITE is a target binding site found in the 3' untranslated region of mRNA encoded by FEM1A, corresponding to a target binding site such as BINDING SITE I, BINDING SITE II or BINDING SITE III of FIG. 8. Table 4 illustrates the complementarity of the nucleotide sequences of FEM1A BINDING SITE, designated SEQ ID:18114, to the nucleotide sequence of GAM175 RNA, herein designated GAM RNA, also designated SEQ ID:265.

Another function of GAM175 is therefore inhibition of Fem-1 homolog a (c.elegans) (FEM1A, Accession NP_061178.1). Accordingly, utilities of GAM175 include diagnosis, prevention and treatment of diseases and clinical conditions associated with FEM1A.

FLJ10520 (Accession NP_060594.2) is another GAM175 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:2136, to the nucleotide sequence of GAM175 RNA, herein designated GAM RNA, also designated SEQ ID:265.

Another function of GAM175 is therefore inhibition of FLJ10520 (Accession NP_060594.2). Accordingly, utilities of GAM175 include diagnosis, prevention and treatment of diseases and clinical conditions associated with FLJ10520.

FLJ11286 (Accession NP_060851.1) is another GAM175 target gene, herein designated TARGET GENE. FLJ11286 BINDING SITE is a target binding site found in the 3' untranslated region of mRNA encoded by FLJ11286, corresponding to a target binding site such as BINDING SITE I, BINDING SITE II or BINDING SITE III of FIG. 8. Table 4 illustrates the complementarity of the nucleotide sequences of FLJ11286 BINDING SITE, designated SEQ ID:5419, to the nucleotide sequence of GAM175 RNA, herein designated GAM RNA, also designated SEQ ID:265.

Another function of GAM175 is therefore inhibition of FLJ11286 (Accession NP_060851.1). Accordingly, utilities of GAM175 include diagnosis, prevention and treatment of diseases and clinical conditions associated with FLJ11286.

FLJ11700 (Accession NP_079168.1) is another GAM175 target gene, herein designated TARGET GENE. FLJ11700 BINDING SITE is a target binding site found in the 3' untranslated region of mRNA encoded by FLJ11700, corresponding to a target binding site such as BINDING SITE I, BINDING SITE II or BINDING SITE III of FIG. 8. Table 4 illustrates the complementarity of the nucleotide sequences of FLJ11700 BINDING SITE, designated SEQ ID:12317, to the nucleotide sequence of GAM175 RNA, herein designated GAM RNA, also designated SEQ ID:265.

Another function of GAM175 is therefore inhibition of FLJ11700 (Accession NP_079168.1). Accordingly, utilities of GAM175 include diagnosis, prevention and treatment of diseases and clinical conditions associated with FLJ11700.

FLJ12242 (Accession NP_078957.1) is another GAM175 target gene, herein designated TARGET GENE. FLJ12242 BINDING SITE is a target binding site found in the 3' untranslated region of mRNA encoded by FLJ12242, corresponding to a target binding site such as BINDING SITE I, BINDING SITE II or BINDING SITE III of FIG. 8. Table 4 illustrates the complementarity of the nucleotide sequences of FLJ12242 BINDING SITE, designated SEQ ID:6997, to the nucleotide sequence of GAM175 RNA, herein designated GAM RNA, also designated SEQ ID:265.

Another function of GAM175 is therefore inhibition of FLJ12242 (Accession NP_078957.1). Accordingly, utilities of GAM175 include diagnosis, prevention and treatment of diseases and clinical conditions associated with FLJ12242.

FLJ13081 (Accession NP_079110.1) is another GAM175 target gene, herein designated TARGET GENE. FLJ13081 BINDING SITE is a target binding site found in the 3' untranslated region of mRNA encoded by FLJ13081, corresponding to a target binding site such as BINDING SITE I, BINDING SITE II or BINDING SITE III of FIG. 8. Table 4 illustrates the complementarity of the nucleotide sequences of FLJ13081 BINDING SITE, designated SEQ ID:16448, to the nucleotide sequence of GAM175 RNA, herein designated GAM RNA, also designated SEQ ID:265.

Another function of GAM175 is therefore inhibition of FLJ13081 (Accession NP_079110.1). Accordingly, utilities of GAM175 include diagnosis, prevention and treatment of diseases and clinical conditions associated with FLJ13081.

FLJ13241 (Accession NP_079364.1) is another GAM175 target gene, herein designated TARGET GENE. FLJ13241 BINDING SITE is a target binding site found in the 3' untranslated region of mRNA encoded by FLJ13241, corresponding to a target binding site such as BINDING SITE I, BINDING SITE II or BINDING SITE III of FIG. 8. Table 4 illustrates the complementarity of the nucleotide sequences of FLJ13241 BINDING SITE, designated SEQ ID:14121, to the nucleotide sequence of GAM175 RNA, herein designated GAM RNA, also designated SEQ ID:265.

Another function of GAM175 is therefore inhibition of FLJ13241 (Accession NP_079364.1). Accordingly, utilities of GAM175 include diagnosis, prevention and treatment of diseases and clinical conditions associated with FLJ13241.

FLJ13544 (Accession NP_079284.1) is another GAM175 target gene, herein designated TARGET GENE. FLJ13544 BINDING SITE is a target binding site found in the 5' untranslated region of mRNA encoded by FLJ13544, corresponding to a target binding site such as BINDING SITE I, BINDING SITE II or BINDING SITE III of FIG. 8. Table 4 illustrates the complementarity of the nucleotide sequences of FLJ13544 BINDING SITE, designated SEQ ID:9579, to the nucleotide sequence of GAM175 RNA, herein designated GAM RNA, also designated SEQ ID:265.

Another function of GAM175 is therefore inhibition of FLJ13544 (Accession NP_079284.1). Accordingly, utilities of GAM175 include diagnosis, prevention and treatment of diseases and clinical conditions associated with FLJ13544.

FLJ21868 (Accession NP_073606.1) is another GAM175 target gene, herein designated TARGET GENE. FLJ21868 BINDING SITE is a target binding site found in the 5' untranslated region of mRNA encoded by FLJ21868, corresponding to a target binding site such as BINDING SITE I, BINDING SITE II or BINDING SITE III of FIG. 8. Table 4 illustrates the complementarity of the nucleotide sequences of FLJ21868 BINDING SITE, designated SEQ ID:10496, to the nucleotide sequence of GAM175 RNA, herein designated GAM RNA, also designated SEQ ID:265.

Another function of GAM175 is therefore inhibition of FLJ21868 (Accession NP_073606.1). Accordingly, utilities of GAM175 include diagnosis, prevention and treatment of diseases and clinical conditions associated with FLJ21868.

FLJ22167 (Accession NP_078809.2) is another GAM175 target gene, herein designated TARGET GENE. FLJ22167 BINDING SITE is a target binding site found in the 5' untranslated region of mRNA encoded by FLJ22167, corresponding to a target binding site such as BINDING SITE I, BINDING SITE II or BINDING SITE III of FIG. 8. Table 4 illustrates the complementarity of the nucleotide sequences of FLJ22167 BINDING SITE, designated SEQ ID:1259, to the nucleotide sequence of GAM175 RNA, herein designated GAM RNA, also designated SEQ ID:265.

Another function of GAM175 is therefore inhibition of FLJ22167 (Accession NP_078809.2). Accordingly, utilities of GAM175 include diagnosis, prevention and treatment of diseases and clinical conditions associated with FLJ22167.

FLJ22578 (Accession NP_079140.1) is another GAM175 target gene, herein designated TARGET GENE. FLJ22578 BINDING SITE is a target binding site found in the 3' untranslated region of mRNA encoded by FLJ22578, corresponding to a target binding site such as BINDING SITE I, BINDING SITE II or BINDING SITE III of FIG. 8. Table 4 illustrates the complementarity of the nucleotide sequences of FLJ22578 BINDING SITE, designated SEQ ID:15094, to the nucleotide sequence of GAM175 RNA, herein designated GAM RNA, also designated SEQ ID:265.

Another function of GAM175 is therefore inhibition of FLJ22578 (Accession NP_079140.1). Accordingly, utilities of GAM175 include diagnosis, prevention and treatment of diseases and clinical conditions associated with FLJ22578.

FLJ23754 (Accession NP_689888.1) is another GAM175 target gene, herein designated TARGET GENE. FLJ23754 BINDING SITE is a target binding site found in the 3' untranslated region of mRNA encoded by FLJ23754, corresponding to a target binding site such as BINDING SITE I, BINDING SITE II or BINDING SITE III of FIG. 8. Table 4 illustrates the complementarity of the nucleotide sequences of FLJ23754 BINDING SITE, designated SEQ ID:543, to the nucleotide sequence of GAM175 RNA, herein designated GAM RNA, also designated SEQ ID:265.

Another function of GAM175 is therefore inhibition of FLJ23754 (Accession NP_689888.1). Accordingly, utilities of GAM175 include diagnosis, prevention and treatment of diseases and clinical conditions associated with FLJ23754.

FLJ36928 (Accession NP_775822.1) is another GAM175 target gene, herein designated TARGET GENE. FLJ36928 BINDING SITE is a target binding site found in the 3' untranslated region of mRNA encoded by FLJ36928, corresponding to a target binding site such as BINDING SITE I, BINDING SITE II or BINDING SITE III of FIG. 8. Table 4 illustrates the complementarity of the nucleotide sequences of FLJ36928 BINDING SITE, designated SEQ ID:15645, to the nucleotide sequence of GAM175 RNA, herein designated GAM RNA, also designated SEQ ID:265.

Another function of GAM175 is therefore inhibition of FLJ36928 (Accession NP_775822.1). Accordingly, utilities of GAM175 include diagnosis, prevention and treatment of diseases and clinical conditions associated with FLJ36928.

FLJ39058 (Accession NP_775851.1) is another GAM175 target gene, herein designated TARGET GENE. FLJ39058 BINDING SITE is a target binding site found in the 3' untranslated region of mRNA encoded by FLJ39058, corresponding to a target binding site such as BINDING SITE I, BINDING SITE II or BINDING SITE III of FIG. 8. Table 4 illustrates the complementarity of the nucleotide sequences of FLJ39058 BINDING SITE, designated SEQ ID:1228, to the nucleotide sequence of GAM175 RNA, herein designated GAM RNA, also designated SEQ ID:265.

Another function of GAM175 is therefore inhibition of FLJ39058 (Accession NP_775851.1). Accordingly, utilities of GAM175 include diagnosis, prevention and treatment of diseases and clinical conditions associated with FLJ39058.

FLJ39501 (Accession NP_775754.1) is another GAM175 target gene, herein designated TARGET GENE. FLJ39501 BINDING SITE is a target binding site found in the 3' untranslated region of mRNA encoded by FLJ39501, corresponding to a target binding site such as BINDING SITE I, BINDING SITE II or BINDING SITE III of FIG. 8. Table 4 illustrates the complementarity of the nucleotide sequences of FLJ39501 BINDING SITE, designated SEQ ID:7439, to the nucleotide sequence of GAM175 RNA, herein designated GAM RNA, also designated SEQ ID:265.

Another function of GAM175 is therefore inhibition of FLJ39501 (Accession NP_775754.1). Accordingly, utilities of GAM175 include diagnosis, prevention and treatment of diseases and clinical conditions associated with FLJ39501.

Folylpolyglutamate synthase (FPGS, Accession NP_004948.2) is another GAM175 target gene, herein designated TARGET GENE. FPGS BINDING SITE is a target binding site found in the 3' untranslated region of mRNA encoded by FPGS, corresponding to a target binding site such as BINDING SITE I, BINDING SITE II or BINDING SITE III of FIG. 8. Table 4 illustrates the complementarity of the nucleotide sequences of FPGS BINDING SITE, designated SEQ ID:7959, to the nucleotide sequence of GAM175 RNA, herein designated GAM RNA, also designated SEQ ID:265.

Another function of GAM175 is therefore inhibition of Folylpolyglutamate synthase (FPGS, Accession NP_004948.2), a gene which is involved in conversion of folates to polyglutamate derivatives. Accordingly, utilities of GAM175 include diagnosis, prevention and treatment of diseases and clinical conditions associated with FPGS.

The function of FPGS and its association with various diseases and clinical conditions, has been established by previous studies, as described hereinabove with reference to GAM120.1. Galactose-4-epimerase, udp-(GALE, Accession NP_000394.1) is another GAM175 target gene, herein designated TARGET GENE. GALE BINDING SITE is a target binding site found in the 3' untranslated region of mRNA encoded by GALE, corresponding to a target binding site such as BINDING SITE I, BINDING SITE II or BINDING SITE III of FIG. 8. Table 4 illustrates the complementarity of the nucleotide sequences of GALE BINDING SITE, designated SEQ ID:6061, to the nucleotide sequence of GAM175 RNA, herein designated GAM RNA, also designated SEQ ID:265.

Another function of GAM175 is therefore inhibition of Galactose-4-epimerase, udp-(GALE, Accession NP_000394.1). Accordingly, utilities of GAM175 include diagnosis, prevention and treatment of diseases and clinical conditions associated with GALE.

Glial fibrillary acidic protein (GFAP, Accession NP_002046.1) is another GAM175 target gene, herein designated TARGET GENE. GFAP BINDING SITE is a target binding site found in the 3' untranslated region of mRNA encoded by GFAP, corresponding to a target binding site such as BINDING SITE I, BINDING SITE II or BINDING SITE III of FIG. 8. Table 4 illustrates the complementarity of the nucleotide sequences of GFAP BINDING SITE, designated SEQ ID:3851, to the nucleotide sequence of GAM175 RNA, herein designated GAM RNA, also designated SEQ ID:265.

Another function of GAM175 is therefore inhibition of Glial fibrillary acidic protein (GFAP, Accession NP_002046.1). Accordingly, utilities of GAM175 include diagnosis, prevention and treatment of diseases and clinical conditions associated with GFAP.

G protein-coupled receptor 44 (GPR44, Accession NP_004769.1) is another GAM175 target gene, herein designated TARGET GENE. GPR44 BINDING SITE is a target binding site found in the 3' untranslated region of mRNA encoded by GPR44, corresponding to a target binding site such as BINDING SITE I, BINDING SITE II or BINDING SITE III of FIG. 8. Table 4 illustrates the complementarity of the nucleotide sequences of GPR44 BINDING SITE, designated SEQ ID:5220, to the nucleotide sequence of GAM175 RNA, herein designated GAM RNA, also designated SEQ ID:265.

Another function of GAM175 is therefore inhibition of G protein-coupled receptor 44 (GPR44, Accession NP_004769.1), a gene which mediates signals to the interior of the cell via activation of heterotrimeric G proteins. Accordingly, utilities of GAM175 include diagnosis, prevention and treatment of diseases and clinical conditions associated with GPR44.

The function of GPR44 has been established by previous studies. By PCR amplification of human genomic DNA using degenerate oligonucleotides corresponding to transmembrane domains 3 and 7 of the mouse delta-opioid receptor and somatostatin receptors, Marchese et al. (1999) isolated a partial cDNA for a novel G protein-coupled receptor, which they designated GPR44. They obtained a full-length clone by screening a lambda human genomic library. GPR44 encodes a 472-amino acid protein that is closely related to chemoattractant receptors. Northern blot analysis revealed a 3.5-kb GPR44 transcript primarily in thalamus, frontal cortex, pons, and hippocampus and at lower levels in hypothalamus and caudate/putamen. A 3.4-kb transcript was detected in fetal liver, leukocytes, and thymus. Prostaglandin D2 (PGD2; OMIM Ref. No. 176803) and other prostanoids are synthesized by the constitutive cyclooxygenase COX1 (PTGS1; 176805) and its inducible isoform, COX2 (PTGS2; 600262). PGD2, which is implicated in allergic disease, elicits its biologic function through interaction with the DP receptor (PTGDR; 604687). Hirai et al. (2001) showed that PGD2 produced by activated mast cells uses CRTH2 to induce intracellular calcium mobilization and chemotaxis in Th2 cells in a G-alpha(i) (GNAI1; 139310)-dependent manner. In addition, they found that CRTH2 rather than DP mediates PGD2-dependent migration of blood eosinophils and basophils. Functional analysis indicated that PGD2 signaling through DP is coupled to G-alpha(s) (GNAS; 139320) and does not induce chemotaxis.

Full details of the abovementioned studies are described in the following publications, the disclosure of which are hereby incorporated by reference:

Hirai, H.; Tanaka, K.; Yoshie, O.; Ogawa, K.; Kenmotsu, K.; Takamori, Y.; Ichimasa, M.; Sugamura, K.; Nakamura, M.; Takano, S.; Nagata, K.: Prostaglandin D2 selectively induces chemotaxis in T helper type 2 cells, eosinophils, and basophils via seven-transmembrane receptor CRTH2. J. Exp. Med. 193:255-261, 2001; and Marchese, A.; Sawzdargo, M.; Nguyen, T.; Cheng, R.; Heng, H. H. Q.; Nowak, T.; Im, D-S.; Lynch, K. R.; George, S. R.; O'Dowd, B. F.: Discovery of three novel orphan G-protein-coupled r.

Further studies establishing the function and utilities of GPR44 are found in John Hopkins OMIM database record ID 604837, and in cited publications listed in Table 5, which are hereby incorporated by reference. Germ cell associated 1 (GSG1, Accession NP_722545.1) is another GAM175 target gene, herein designated TARGET GENE. GSG1 BINDING SITE is a target binding site found in the 3' untranslated region of multiple transcripts of mRNA encoded by GSG1, corresponding to a target binding site such as BINDING SITE I, BINDING SITE II or BINDING SITE III of FIG. 8. Table 4 illustrates the complementarity of the nucleotide sequences of GSG1 BINDING SITE, designated SEQ ID:8755, to the nucleotide sequence of GAM175 RNA, herein designated GAM RNA, also designated SEQ ID:265.

Another function of GAM175 is therefore inhibition of Germ cell associated 1 (GSG1, Accession NP_722545.1). Accordingly, utilities of GAM175 include diagnosis, prevention and treatment of diseases and clinical conditions associated with GSG1.

HCNGP (Accession NP_037392.1) is another GAM175 target gene, herein designated TARGET GENE. HCNGP BINDING SITE is a target binding site found in the 3' untranslated region of mRNA encoded by HCNGP, corresponding to a target binding site such as BINDING SITE I, BINDING SITE II or BINDING SITE III of FIG. 8. Table 4 illustrates the complementarity of the nucleotide sequences of HCNGP BINDING SITE, designated SEQ ID:12212, to the nucleotide sequence of GAM175 RNA, herein designated GAM RNA, also designated SEQ ID:265.

Another function of GAM175 is therefore inhibition of HCNGP (Accession NP_037392.1). Accordingly, utilities of GAM175 include diagnosis, prevention and treatment of diseases and clinical conditions associated with HCNGP.

Heparan sulfate 6-o-sulfotransferase 2 (HS6ST2, Accession NP_671704.2) is another GAM175 target gene, herein designated TARGET GENE. HS6ST2 BINDING SITE is a target binding site found in the 3' untranslated region of multiple transcripts of mRNA encoded by HS6ST2, corresponding to a target binding site such as BINDING SITE I, BINDING SITE II or BINDING SITE III of FIG. 8. Table 4 illustrates the complementarity of the nucleotide sequences of HS6ST2 BINDING SITE, designated SEQ ID:12074, to the nucleotide sequence of GAM175 RNA, herein designated GAM RNA, also designated SEQ ID:265.

Another function of GAM175 is therefore inhibition of Heparan sulfate 6-o-sulfotransferase 2 (HS6ST2, Accession NP_671704.2). Accordingly, utilities of GAM175 include diagnosis, prevention and treatment of diseases and clinical conditions associated with HS6ST2.

Interleukin 18 binding protein (IL18BP, Accession NP_766630.1) is another GAM175 target gene, herein designated TARGET GENE. IL18BP BINDING SITE is a target binding site found in the 3' untranslated region of multiple transcripts of mRNA encoded by IL18BP, corresponding to a target binding site such as BINDING SITE I, BINDING SITE II or BINDING SITE III of FIG. 8. Table 4 illustrates the complementarity of the nucleotide sequences of IL18BP BINDING SITE, designated SEQ ID:17825, to the nucleotide sequence of GAM175 RNA, herein designated GAM RNA, also designated SEQ ID:265.

Another function of GAM175 is therefore inhibition of Interleukin 18 binding protein (IL18BP, Accession NP_766630.1). Accordingly, utilities of GAM175 include diagnosis, prevention and treatment of diseases and clinical conditions associated with IL18BP.

Interleukin 18 binding protein (IL18BP, Accession NP_005690.1) is another GAM175 target gene, herein designated TARGET GENE. IL18BP BINDING SITE is a target binding site found in the 3' untranslated region of multiple transcripts of mRNA encoded by IL18BP, corresponding to a target binding site such as BINDING SITE I, BINDING SITE II or BINDING SITE III of FIG. 8. Table 4 illustrates the complementarity of the nucleotide sequences of IL18BP BINDING SITE, designated SEQ ID:17825, to the nucleotide sequence of GAM175 RNA, herein designated GAM RNA, also designated SEQ ID:265.

Another function of GAM175 is therefore inhibition of Interleukin 18 binding protein (IL18BP, Accession NP_005690.1). Accordingly, utilities of GAM175 include diagnosis, prevention and treatment of diseases and clinical conditions associated with IL18BP.

KIAA0193 (Accession NP_055581.2) is another GAM175 target gene, herein designated TARGET GENE. KIAA0193 BINDING SITE is a target binding site found in the 3' untranslated region of mRNA encoded by KIAA0193, corresponding to a target binding site such as BINDING SITE I, BINDING SITE II or BINDING SITE III of FIG. 8. Table 4 illustrates the complementarity of the nucleotide sequences of KIAA0193 BINDING SITE, designated SEQ ID:7054, to the nucleotide sequence of GAM175 RNA, herein designated GAM RNA, also designated SEQ ID:265.

Another function of GAM175 is therefore inhibition of KIAA0193 (Accession NP_055581.2). Accordingly, utilities of GAM175 include diagnosis, prevention and treatment of diseases and clinical conditions associated with KIAA0193.

KIAA0354 (Accession NP_055687.1) is another GAM175 target gene, herein designated TARGET GENE. KIAA0354 BINDING SITE is a target binding site found in the 3' untranslated region of mRNA encoded by KIAA0354, corresponding to a target binding site such as BINDING SITE I, BINDING SITE II or BINDING SITE III of FIG. 8. Table 4 illustrates the complementarity of the nucleotide sequences of KIAA0354 BINDING SITE, designated SEQ ID:6463, to the nucleotide sequence of GAM175 RNA, herein designated GAM RNA, also designated SEQ ID:265.

Another function of GAM175 is therefore inhibition of KIAA0354 (Accession NP_055687.1). Accordingly, utilities of GAM175 include diagnosis, prevention and treatment of diseases and clinical conditions associated with KIAA0354.

KIAA0478 (Accession NP_055685.1) is another GAM175 target gene, herein designated TARGET GENE. KIAA0478 BINDING SITE is a target binding site found in the 3' untranslated region of mRNA encoded by KIAA0478, corresponding to a target binding site such as BINDING SITE I, BINDING SITE II or BINDING SITE III of FIG. 8. Table 4 illustrates the complementarity of the nucleotide sequences of KIAA0478 BINDING SITE, designated SEQ ID:4764, to the nucleotide sequence of GAM175 RNA, herein designated GAM RNA, also designated SEQ ID:265.

Another function of GAM175 is therefore inhibition of KIAA0478 (Accession NP_055685.1). Accordingly, utilities of GAM175 include diagnosis, prevention and treatment of diseases and clinical conditions associated with KIAA0478.

KIAA0493 (Accession XP_034717.1) is another GAM175 target gene, herein designated TARGET GENE. KIAA0493 BINDING SITE is a target binding site found in the 3' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:11550, to the nucleotide sequence of GAM175 RNA, herein designated GAM RNA, also designated SEQ ID:265.

Another function of GAM175 is therefore inhibition of KIAA0493 (Accession XP_034717.1). Accordingly, utilities of GAM175 include diagnosis, prevention and treatment of diseases and clinical conditions associated with KIAA0493.

KIAA0605 (Accession NP_055509.1) is another GAM175 target gene, herein designated TARGET GENE. KIAA0605 BINDING SITE is a target binding site found in the 5' untranslated region of mRNA encoded by KIAA0605, corresponding to a target binding site such as BINDING SITE I, BINDING SITE II or BINDING SITE III of FIG. 8. Table 4 illustrates the complementarity of the nucleotide sequences of KIAA0605 BINDING SITE, designated SEQ ID:9931, to the nucleotide sequence of GAM175 RNA, herein designated GAM RNA, also designated SEQ ID:265.

Another function of GAM175 is therefore inhibition of KIAA0605 (Accession NP_055509.1). Accordingly, utilities of GAM175 include diagnosis, prevention and treatment of diseases and clinical conditions associated with KIAA0605.

KIAA1671 (Accession XP_037809.1) is another GAM175 target gene, herein designated TARGET GENE. KIAA1671 BINDING SITE is a target binding site found in the 3' untranslated region of mRNA encoded by KIAA1671, corresponding to a target binding site such as BINDING SITE I, BINDING SITE II or BINDING SITE III of FIG. 8. Table 4 illustrates the complementarity of the nucleotide sequences of KIAA1671 BINDING SITE, designated SEQ ID:6252, to the nucleotide sequence of GAM175 RNA, herein designated GAM RNA, also designated SEQ ID:265.

Another function of GAM175 is therefore inhibition of KIAA1671 (Accession XP_037809.1). Accordingly, utilities of GAM175 include diagnosis, prevention and treatment of diseases and clinical conditions associated with KIAA1671.

KIAA1727 (Accession XP_034262.4) is another GAM175 target gene, herein designated TARGET GENE. KIAA1727 BINDING SITE is a target binding site found in the 3' untranslated region of mRNA encoded by KIAA1727, corresponding to a target binding site such as BINDING SITE I, BINDING SITE II or BINDING SITE III of FIG. 8. Table 4 illustrates the complementarity of the nucleotide sequences of KIAA1727 BINDING SITE, designated SEQ ID:15320, to the nucleotide sequence of GAM175 RNA, herein designated GAM RNA, also designated SEQ ID:265.

Another function of GAM175 is therefore inhibition of KIAA1727 (Accession XP_034262.4). Accordingly, utilities of GAM175 include diagnosis, prevention and treatment of diseases and clinical conditions associated with KIAA1727.

KIAA1804 (Accession NP_115811.1) is another GAM175 target gene, herein designated TARGET GENE. KIAA1804 BINDING SITE is a target binding site found in the 3' untranslated region of mRNA encoded by KIAA1804, corresponding to a target binding site such as BINDING SITE I, BINDING SITE II or BINDING SITE III of FIG. 8. Table 4 illustrates the complementarity of the nucleotide sequences of KIAA1804 BINDING SITE, designated SEQ ID:13721, to the nucleotide sequence of GAM175 RNA, herein designated GAM RNA, also designated SEQ ID:265.

Another function of GAM175 is therefore inhibition of KIAA1804 (Accession NP_115811.1). Accordingly, utilities of GAM175 include diagnosis, prevention and treatment of diseases and clinical conditions associated with KIAA1804.

KIAA1858 (Accession XP_040592.3) is another GAM175 target gene, herein designated TARGET GENE. KIAA1858 BINDING SITE1 and KIAA1858 BINDING SITE2 are target binding sites found in untranslated regions of mRNA encoded by KIAA1858, corresponding to target binding sites such as BINDING SITE I, BINDING SITE II or BINDING SITE III of FIG. 8. Table 4 illustrates the complementarity of the nucleotide sequences of KIAA1858 BINDING SITE1 and KIAA1858 BINDING SITE2, designated SEQ ID:7750 and SEQ ID:4361 respectively, to the nucleotide sequence of GAM175 RNA, herein designated GAM RNA, also designated SEQ ID:265.

Another function of GAM175 is therefore inhibition of KIAA1858 (Accession XP_040592.3). Accordingly, utilities of GAM175 include diagnosis, prevention and treatment of diseases and clinical conditions associated with KIAA1858.

Klotho (KL, Accession NP_710150.1) is another GAM175 target gene, herein designated TARGET GENE. KL BINDING SITE is a target binding site found in the 3' untranslated region of multiple transcripts of mRNA encoded by KL, corresponding to a target binding site such as BINDING SITE I, BINDING SITE II or BINDING SITE III of FIG. 8. Table 4 illustrates the complementarity of the nucleotide sequences of KL BINDING SITE, designated SEQ ID:5056, to the nucleotide sequence of GAM175 RNA, herein designated GAM RNA, also designated SEQ ID:265.

Another function of GAM175 is therefore inhibition of Klotho (KL, Accession NP_710150.1), a gene which has similarity to beta-glucosidases. Accordingly, utilities of GAM175 include diagnosis, prevention and treatment of diseases and clinical conditions associated with KL.

The function of KL and its association with various diseases and clinical conditions, has been established by previous studies, as described hereinabove with reference to GAM48.2. Klotho (KL, Accession NP_004786.2) is another GAM175 target gene, herein designated TARGET GENE. KL BINDING SITE is a target binding site found in the 3' untranslated region of multiple transcripts of mRNA encoded by KL, corresponding to a target binding site such as BINDING SITE I, BINDING SITE II or BINDING SITE III of FIG. 8. Table 4 illustrates the complementarity of the nucleotide sequences of KL BINDING SITE, designated SEQ ID:5056, to the nucleotide sequence of GAM175 RNA, herein designated GAM RNA, also designated SEQ ID:265.

Another function of GAM175 is therefore inhibition of Klotho (KL, Accession NP_004786.2), a gene which has similarity to beta-glucosidases. Accordingly, utilities of GAM175 include diagnosis, prevention and treatment of diseases and clinical conditions associated with KL.

The function of KL and its association with various diseases and clinical conditions, has been established by previous studies, as described hereinabove with reference to GAM48.2. Kelch-like 3 (drosophila) (KLHL3, Accession NP_059111.1) is another GAM175 target gene, herein designated TARGET GENE. KLHL3 BINDING SITE is a target binding site found in the 3' untranslated region of mRNA encoded by KLHL3, corresponding to a target binding site such as BINDING SITE I, BINDING SITE II or BINDING SITE III of FIG. 8. Table 4 illustrates the complementarity of the nucleotide sequences of KLHL3 BINDING SITE, designated SEQ ID:2953, to the nucleotide sequence of GAM175 RNA, herein designated GAM RNA, also designated SEQ ID:265.

Another function of GAM175 is therefore inhibition of Kelch-like 3 (drosophila) (KLHL3, Accession NP_059111.1). Accordingly, utilities of GAM175 include diagnosis, prevention and treatment of diseases and clinical conditions associated with KLHL3.

Keratin associated protein 4-12 (KRTAP4-12, Accession NP_114060.1) is another GAM175 target gene, herein designated TARGET GENE. KRTAP4-12 BINDING SITE is a target binding site found in the 3' untranslated region of mRNA encoded by KRTAP4-12, corresponding to a target binding site such as BINDING SITE I, BINDING SITE II or BINDING SITE III of FIG. 8. Table 4 illustrates the complementarity of the nucleotide sequences of KRTAP4-12 BINDING SITE, designated SEQ ID:7123, to the nucleotide sequence of GAM175 RNA, herein designated GAM RNA, also designated SEQ ID:265.

Another function of GAM175 is therefore inhibition of Keratin associated protein 4-12 (KRTAP4-12, Accession NP_114060.1). Accordingly, utilities of GAM175 include diagnosis, prevention and treatment of diseases and clinical conditions associated with KRTAP4-12.

Laminin, alpha 4 (LAMA4, Accession NP_002281.1) is another GAM175 target gene, herein designated TARGET GENE. LAMA4 BINDING SITE is a target binding site found in the 3' untranslated region of mRNA encoded by LAMA4, corresponding to a target binding site such as BINDING SITE I, BINDING SITE II or BINDING SITE III of FIG. 8. Table 4 illustrates the complementarity of the nucleotide sequences of LAMA4 BINDING SITE, designated SEQ ID:11842, to the nucleotide sequence of GAM175 RNA, herein designated GAM RNA, also designated SEQ ID:265.

Another function of GAM175 is therefore inhibition of Laminin, alpha 4 (LAMA4, Accession NP_002281.1), a gene which mediates the attachment, migration and organization of cells into tissues. Accordingly, utilities of GAM175 include diagnosis, prevention and treatment of diseases and clinical conditions associated with LAMA4.

The function of LAMA4 has been established by previous studies. Laminin, a multidomain glycoprotein, is the major noncollagenous constituent of basement membranes. It is composed of 3 nonidentical chains: A (OMIM Ref. No. 150320), B1 (OMIM Ref. No. 150240), and B2 (OMIM Ref. No. 150290). The laminins form a cruciform structure consisting of 3 short arms, each of which is formed from different chains, and a long arm composed of all 3 chains. By screening a human keratinocyte cDNA library for type VII collagen sequences, Richards et al. (1994) isolated a new laminin alpha chain variant gene, LAMA4 (formerly called LAMA3). Northern blot analysis indicated that a cDNA encoding LAMA4 hybridized to a 6.45-kb mRNA, significantly smaller than the 9.5- to 10-kb mRNA of laminin A (Haaparanta et al., 1991). Using PCR on genomic DNA, flow-sorted chromosomes, and fluorescence in situ hybridization, Richards et al. (1994) localized the LAMA4 gene to human chromosome 6q21. In this abstract, the authors referred to the gene as LAMA3; in the related article, Richards et al. (1994) used the corrected symbol, LAMA4. Iivanainen et al. (1995) cloned the laminin alpha-4 cDNA by screening a fetal lung library with a PCR product generated from primers based on a partial laminin-like sequence reported by GenBank. The complete cDNA is approximately 6.2 kb long and encodes a predicted protein of 1,816 amino acids. The domain structure of the protein is similar to the alpha-3 chain (LAMA3, also called BM600), both of which resemble truncated versions of alpha-1 and alpha-2 in which approximately 1,200 residues at the amino end have been lost. Northern blots showed strong expression of the mRNA in adult heart, lung, ovary, small and large intestines, liver, and placenta.

Full details of the abovementioned studies are described in the following publications, the disclosure of which are hereby incorporated by reference:

Iivanainen, A.; Sainio, K.; Sariola, H.; Tryggvason, K.: Primary structure and expression of a novel human laminin alpha-4 chain. FEBS Lett. 365:183-188, 1995; and Richards, A. J.; Al-Imara, L.; Carter, N. P.; Lloy, J. C.; Leversha, M. A.; Pope, F. M.: Localization of the gene (LAMA4) to chromosome 6q21 and isolation of a partial cDNA encoding a.

Further studies establishing the function and utilities of LAMA4 are found in John Hopkins OMIM database record ID 600133, and in cited publications listed in Table 5, which are hereby incorporated by reference. Laminin, gamma 1 (formerly lamb2) (LAMC1, Accession NP_002284.2) is another GAM175 target gene, herein designated TARGET GENE. LAMC1 BINDING SITE is a target binding site found in the 3' untranslated region of mRNA encoded by LAMC1, corresponding to a target binding site such as BINDING SITE I, BINDING SITE II or BINDING SITE III of FIG. 8. Table 4 illustrates the complementarity of the nucleotide sequences of LAMC1 BINDING SITE, designated SEQ ID:18303, to the nucleotide sequence of GAM175 RNA, herein designated GAM RNA, also designated SEQ ID:265.

Another function of GAM175 is therefore inhibition of Laminin, gamma 1 (formerly lamb2) (LAMC1, Accession NP_002284.2), a gene which may mediate the attachment, migration, and organization of cells into tissues. Accordingly, utilities of GAM175 include diagnosis, prevention and treatment of diseases and clinical conditions associated with LAMC1.

The function of LAMC1 has been established by previous studies. Laminin is a heterotrimeric extracellular matrix protein consisting of 3 chains: alpha (LAMA1; 150320), beta (LAMB1; 150240), and gamma (formerly A, B1, and B2, respectively). Several isoforms of each chain have been identified. Laminin gamma-1 is the most ubiquitously expressed laminin subunit (Burgeson et al., 1994; Miner et al., 1997). In mouse, the laminin subunits alpha-1, beta-1, and gamma-1 are expressed in the preimplantation embryo before the appearance of the first basement membrane of the trophectodermal epithelium. Smyth et al. (1999) targeted the LAMC1 gene by homologous recombination in mouse embryonic stem (ES) cells. Mice heterozygous for the mutation had a normal phenotype and were fertile, whereas homozygous mutant embryos did not survive beyond day 5.5 postcoitum. These embryos lacked basement membranes, and although the blastocysts had expanded, primitive endoderm cells remained in the inner mass, and the parietal yolk sac did not develop. Cultured ES cells appeared normal after targeting both LAMC1 genes, but the embryoid bodies derived from them also lacked basement membranes, having disorganized extracellular deposits of the basement membrane proteins collagen IV and perlecan, and the cells failed to differentiate into stable myotubes. Nomenclature: Burgeson et al. (1994), a group of 14 leading researchers in the field of connective tissue proteins, adopted a new nomenclature for the laminins. They were numbered with arabic numerals in the order discovered. The previous A, B1, and B2 chains, and their isoforms, are alpha, beta, and gamma, respectively, followed by an arabic numeral to identify the isoform. For example, the first laminin identified from the Engelbreth-Holm-Swarm tumor (EHS) was designated laminin-1 with the chain composition alpha-1/beta-1/gamma-1. The genes for these 3 chains are LAMA1, LAMB1 (OMIM Ref. No. 150240), and LAMC1.

Full details of the abovementioned studies are described in the following publications, the disclosure of which are hereby incorporated by reference:

Smyth, N.; Vatansever, H. S.; Murray, P.; Meyer, M.; Frie, C.; Paulsson, M.; Edgar, D.: Absence of basement membranes after targeting the LAMC1 gene results in embryonic lethality due to failure of endoderm differentiation. J. Cell Biol. 144:151-160, 1999; and Burgeson, R. E.; Chiquet, M.; Deutzmann, R.; Ekblom, P.; Engel, J.; Kleinman, H.; Martin, G. R.; Meneguzzi, G.; Paulsson, M.; Sanes, J.; Timpl, R.; Tryggvason, K.; Yamada, Y.; Yurchenco.

Further studies establishing the function and utilities of LAMC1 are found in John Hopkins OMIM database record ID 150290, and in cited publications listed in Table 5, which are hereby incorporated by reference. Lymphocyte cytosolic protein 2 (sh2 domain containing leukocyte protein of 76 kda) (LCP2, Accession NP_005556.1) is another GAM175 target gene, herein designated TARGET GENE. LCP2 BINDING SITE is a target binding site found in the 3' untranslated region of mRNA encoded by LCP2, corresponding to a target binding site such as BINDING SITE I, BINDING SITE II or BINDING SITE III of FIG. 8. Table 4 illustrates the complementarity of the nucleotide sequences of LCP2 BINDING SITE, designated SEQ ID:2817, to the nucleotide sequence of GAM175 RNA, herein designated GAM RNA, also designated SEQ ID:265.

Another function of GAM175 is therefore inhibition of Lymphocyte cytosolic protein 2 (sh2 domain containing leukocyte protein of 76 kda) (LCP2, Accession NP_005556.1), a gene which involved in t cell antigen receptor mediated signaling. and therefore may be associated with Fetal hemorrhage and platelet dysfunction. Accordingly, utilities of GAM175 include diagnosis, prevention and treatment of Fetal hemorrhage and platelet dysfunction, and of other diseases and clinical conditions associated with LCP2.

The function of LCP2 has been established by previous studies. Activation of tyrosine kinases of the src and syk family is required for T-cell receptor-mediated signaling. Jackman et al. (1995) identified a 76-kD protein that associates with the Grb2 adaptor protein (OMIM Ref. No. 108355) and is a substrate for tyrosine kinase in the activation pathway. The SLP76 (SH2 domain- containing leukocyte protein of 76 kD) cDNA encodes a predicted 533-amino acid protein with a single C-terminal Src homology 2 (SH2) domain, a proline-rich region with a binding site for Grb2, and an acidic N-terminal region with tyrosines that are phosphorylated after T-cell receptor engagement (Sunden et al., 1996). The human and mouse amino acid sequences are 84% identical. Northern blots demonstrated expression in peripheral blood leukocytes, thymus, and spleen and in human T-cell, B-cell, and monocytic cell lines. Recombinantly expressed SLP76 was shown to associate with a GST/Grb2 fusion protein. Overexpression of SLP76 has also been shown to enhance the activity of the promoter for the IL2 gene (Motto et al., 1996). Sunden et al. (1996) used a monochromosomal somatic cell hybrid panel to map the gene, designated LCP2, to chromosome 5. A 2-allele polymorphism within the gene was then used to map the locus genetically near the marker D5S429, which has been assigned to 5q33.1-qter Animal model experiments lend further support to the function of LCP2. Clements et al. (1999) described fetal hemorrhage and perinatal mortality in mice deficient in SLP76. Although megakaryocyte and platelet development proceeded normally in the absence of SLP76, collagen-induced platelet aggregation and granule release were markedly impaired. Furthermore, treatment of SLP76-deficient platelets with collagen failed to elicit tyrosine phosphorylation of phospholipase C-gamma-2, suggesting that SLP76 functions upstream of PLC-gamma-2 activation. The data provided a potential mechanism for the fetal hemorrhage observed in the SLP76-deficient mice and showed that SLP76 expression is required for optimal receptor-mediated signal transduction in platelets as well as in T lymphocytes.

It is appreciated that the abovementioned animal model for LCP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Clements, J. L.; Lee, J. R.; Gross, B.; Yang, B.; Olson, J. D.; Sandra, A.; Watson, S. P.; Lentz, S. R.; Koretzky, G. A.: Fetal hemorrhage and platelet dysfunction in SLP-76-deficient mice. J. Clin. Invest. 103:19-25, 1999. ; and Sunden, S. L. F.; Carr, L. L.; Clements, J. L.; Motto, D. G.; Koretzky, G. A.: Polymorphism in and localization of the gene LCP2 (SLP-76) to chromosome 5q33.1-qter. Genomics 35:269-270.

Further studies establishing the function and utilities of LCP2 are found in John Hopkins OMIM database record ID 601603, and in cited publications listed in Table 5, which are hereby incorporated by reference. LOC118461 (Accession XP_060969.2) is another GAM175 target gene, herein designated TARGET GENE. LOC118461 BINDING SITE is a target binding site found in the 5' untranslated region of mRNA encoded by LOC118461, corresponding to a target binding site such as BINDING SITE I, BINDING SITE II or BINDING SITE III of FIG. 8. Table 4 illustrates the complementarity of the nucleotide sequences of LOC118461 BINDING SITE, designated SEQ ID:9284, to the nucleotide sequence of GAM175 RNA, herein designated GAM RNA, also designated SEQ ID:265.

Another function of GAM175 is therefore inhibition of LOC118461 (Accession XP_060969.2). Accordingly, utilities of GAM175 include diagnosis, prevention and treatment of diseases and clinical conditions associated with LOC118461.

LOC122282 (Accession XP_063046.4) is another GAM175 target gene, herein designated TARGET GENE. LOC122282 BINDING SITE is a target binding site found in the 3' untranslated region of mRNA encoded by LOC122282, corresponding to a target binding site such as BINDING SITE I, BINDING SITE II or BINDING SITE III of FIG. 8. Table 4 illustrates the complementarity of the nucleotide sequences of LOC122282 BINDING SITE, designated SEQ ID:13483, to the nucleotide sequence of GAM175 RNA, herein designated GAM RNA, also designated SEQ ID:265.

Another function of GAM175 is therefore inhibition of LOC122282 (Accession XP_063046.4). Accordingly, utilities of GAM175 include diagnosis, prevention and treatment of diseases and clinical conditions associated with LOC122282.

LOC125115 (Accession XP_064442.3) is another GAM175 target gene, herein designated TARGET GENE. LOC125115 BINDING SITE is a target binding site found in the 3' untranslated region of mRNA encoded by LOC125115, corresponding to a target binding site such as BINDING SITE I, BINDING SITE II or BINDING SITE III of FIG. 8. Table 4 illustrates the complementarity of the nucleotide sequences of LOC125115 BINDING SITE, designated SEQ ID:16189, to the nucleotide sequence of GAM175 RNA, herein designated GAM RNA, also designated SEQ ID:265.

Another function of GAM175 is therefore inhibition of LOC125115 (Accession XP_064442.3). Accordingly, utilities of GAM175 include diagnosis, prevention and treatment of diseases and clinical conditions associated with LOC125115.

LOC145609 (Accession XP_096817.1) is another GAM175 target gene, herein designated TARGET GENE. LOC145609 BINDING SITE is a target binding site found in the 3' untranslated region of mRNA encoded by LOC145609, corresponding to a target binding site such as BINDING SITE I, BINDING SITE II or BINDING SITE III of FIG. 8. Table 4 illustrates the complementarity of the nucleotide sequences of LOC145609 BINDING SITE, designated SEQ ID:4216, to the nucleotide sequence of GAM175 RNA, herein designated GAM RNA, also designated SEQ ID:265.

Another function of GAM175 is therefore inhibition of LOC145609 (Accession XP_096817.1). Accordingly, utilities of GAM175 include diagnosis, prevention and treatment of diseases and clinical conditions associated with LOC145609.

LOC147381 (Accession XP_097230.2) is another GAM175 target gene, herein designated TARGET GENE. LOC147381 BINDING SITE is a target binding site found in the 5' untranslated region of mRNA encoded by LOC147381, corresponding to a target binding site such as BINDING SITE I, BINDING SITE II or BINDING SITE III of FIG. 8. Table 4 illustrates the complementarity of the nucleotide sequences of LOC147381 BINDING SITE, designated SEQ ID:3191, to the nucleotide sequence of GAM175 RNA, herein designated GAM RNA, also designated SEQ ID:265.

Another function of GAM175 is therefore inhibition of LOC147381 (Accession XP_097230.2). Accordingly, utilities of GAM175 include diagnosis, prevention and treatment of diseases and clinical conditions associated with LOC147381.

LOC150933 (Accession XP_097971.1) is another GAM175 target gene, herein designated TARGET GENE. LOC150933 BINDING SITE is a target binding site found in the 3' untranslated region of mRNA encoded by LOC150933, corresponding to a target binding site such as BINDING SITE I, BINDING SITE II or BINDING SITE III of FIG. 8. Table 4 illustrates the complementarity of the nucleotide sequences of LOC150933 BINDING SITE, designated SEQ ID:17201, to the nucleotide sequence of GAM175 RNA, herein designated GAM RNA, also designated SEQ ID:265.

Another function of GAM175 is therefore inhibition of LOC150933 (Accession XP_097971.1). Accordingly, utilities of GAM175 include diagnosis, prevention and treatment of diseases and clinical conditions associated with LOC150933.

LOC151201 (Accession XP_098021.1) is another GAM175 target gene, herein designated TARGET GENE. LOC151201 BINDING SITE is a target binding site found in the 3' untranslated region of mRNA encoded by LOC151201, corresponding to a target binding site such as BINDING SITE I, BINDING SITE II or BINDING SITE III of FIG. 8. Table 4 illustrates the complementarity of the nucleotide sequences of LOC151201 BINDING SITE, designated SEQ ID:4667, to the nucleotide sequence of GAM175 RNA, herein designated GAM RNA, also designated SEQ ID:265.

Another function of GAM175 is therefore inhibition of LOC151201 (Accession XP_098021.1). Accordingly, utilities of GAM175 include diagnosis, prevention and treatment of diseases and clinical conditions associated with LOC151201.

LOC153077 (Accession XP_098307.1) is another GAM175 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:2394, to the nucleotide sequence of GAM175 RNA, herein designated GAM RNA, also designated SEQ ID:265.

Another function of GAM175 is therefore inhibition of LOC153077 (Accession XP_098307.1). Accordingly, utilities of GAM175 include diagnosis, prevention and treatment of diseases and clinical conditions associated with LOC153077.

LOC153346 (Accession XP_098364.1) is another GAM175 target gene, herein designated TARGET GENE. LOC153346 BINDING SITE is a target binding site found in the 3' untranslated region of mRNA encoded by LOC153346, corresponding to a target binding site such as BINDING SITE I, BINDING SITE II or BINDING SITE III of FIG. 8. Table 4 illustrates the complementarity of the nucleotide sequences of LOC153346 BINDING SITE, designated SEQ ID:19725, to the nucleotide sequence of GAM175 RNA, herein designated GAM RNA, also designated SEQ ID:265.

Another function of GAM175 is therefore inhibition of LOC153346 (Accession XP_098364.1). Accordingly, utilities of GAM175 include diagnosis, prevention and treatment of diseases and clinical conditions associated with LOC153346.

LOC157858 (Accession XP_098833.2) is another GAM175 target gene, herein designated TARGET GENE. LOC157858 BINDING SITE is a target binding site found in the 3' untranslated region of mRNA encoded by LOC157858, corresponding to a target binding site such as BINDING SITE I, BINDING SITE II or BINDING SITE III of FIG. 8. Table 4 illustrates the complementarity of the nucleotide sequences of LOC157858 BINDING SITE, designated SEQ ID:11755, to the nucleotide sequence of GAM175 RNA, herein designated GAM RNA, also designated SEQ ID:265.

Another function of GAM175 is therefore inhibition of LOC157858 (Accession XP_098833.2). Accordingly, utilities of GAM175 include diagnosis, prevention and treatment of diseases and clinical conditions associated with LOC157858.

LOC158563 (Accession XP_088606.1) is another GAM175 target gene, herein designated TARGET GENE. LOC158563 BINDING SITE is a target binding site found in the 3' untranslated region of mRNA encoded by LOC158563, corresponding to a target binding site such as BINDING SITE I, BINDING SITE II or BINDING SITE III of FIG. 8. Table 4 illustrates the complementarity of the nucleotide sequences of LOC158563 BINDING SITE, designated SEQ ID:3708, to the nucleotide sequence of GAM175 RNA, herein designated GAM RNA, also designated SEQ ID:265.

Another function of GAM175 is therefore inhibition of LOC158563 (Accession XP_088606.1). Accordingly, utilities of GAM175 include diagnosis, prevention and treatment of diseases and clinical conditions associated with LOC158563.

LOC158833 (Accession XP_088691.1) is another GAM175 target gene, herein designated TARGET GENE. LOC158833 BINDING SITE is a target binding site found in the 3' untranslated region of mRNA encoded by LOC158833, corresponding to a target binding site such as BINDING SITE I, BINDING SITE II or BINDING SITE III of FIG. 8. Table 4 illustrates the complementarity of the nucleotide sequences of LOC158833 BINDING SITE, designated SEQ ID:4444, to the nucleotide sequence of GAM175 RNA, herein designated GAM RNA, also designated SEQ ID:265.

Another function of GAM175 is therefore inhibition of LOC158833 (Accession XP_088691.1). Accordingly, utilities of GAM175 include diagnosis, prevention and treatment of diseases and clinical conditions associated with LOC158833.

LOC162083 (Accession XP_091339.2) is another GAM175 target gene, herein designated TARGET GENE. LOC162083 BINDING SITE is a target binding site found in the 5' untranslated region of mRNA encoded by LOC162083, corresponding to a target binding site such as BINDING SITE I, BINDING SITE II or BINDING SITE III of FIG. 8. Table 4 illustrates the complementarity of the nucleotide sequences of LOC162083 BINDING SITE, designated SEQ ID:9512, to the nucleotide sequence of GAM175 RNA, herein designated GAM RNA, also designated SEQ ID:265.

Another function of GAM175 is therefore inhibition of LOC162083 (Accession XP_091339.2). Accordingly, utilities of GAM175 include diagnosis, prevention and treatment of diseases and clinical conditions associated with LOC162083.

LOC197342 (Accession XP_113869.1) is another GAM175 target gene, herein designated TARGET GENE. LOC197342 BINDING SITE is a target binding site found in the 3' untranslated region of mRNA encoded by LOC197342, corresponding to a target binding site such as BINDING SITE I, BINDING SITE II or BINDING SITE III of FIG. 8. Table 4 illustrates the complementarity of the nucleotide sequences of LOC197342 BINDING SITE, designated SEQ ID:14413, to the nucleotide sequence of GAM175 RNA, herein designated GAM RNA, also designated SEQ ID:265.

Another function of GAM175 is therefore inhibition of LOC197342 (Accession XP_113869.1). Accordingly, utilities of GAM175 include diagnosis, prevention and treatment of diseases and clinical conditions associated with LOC197342.

LOC200197 (Accession XP_114148.1) is another GAM175 target gene, herein designated TARGET GENE. LOC200197 BINDING SITE is a target binding site found in the 3' untranslated region of mRNA encoded by LOC200197, corresponding to a target binding site such as BINDING SITE I, BINDING SITE II or BINDING SITE III of FIG. 8. Table 4 illustrates the complementarity of the nucleotide sequences of LOC200197 BINDING SITE, designated SEQ ID:4520, to the nucleotide sequence of GAM175 RNA, herein designated GAM RNA, also designated SEQ ID:265.

Another function of GAM175 is therefore inhibition of LOC200197 (Accession XP_114148.1). Accordingly, utilities of GAM175 include diagnosis, prevention and treatment of diseases and clinical conditions associated with LOC200197.

LOC201725 (Accession XP_114370.1) is another GAM175 target gene, herein designated TARGET GENE. LOC201725 BINDING SITE is a target binding site found in the 3' untranslated region of mRNA encoded by LOC201725, corresponding to a target binding site such as BINDING SITE I, BINDING SITE II or BINDING SITE III of FIG. 8. Table 4 illustrates the complementarity of the nucleotide sequences of LOC201725 BINDING SITE, designated SEQ ID:3083, to the nucleotide sequence of GAM175 RNA, herein designated GAM RNA, also designated SEQ ID:265.

Another function of GAM175 is therefore inhibition of LOC201725 (Accession XP_114370.1). Accordingly, utilities of GAM175 include diagnosis, prevention and treatment of diseases and clinical conditions associated with LOC201725.

LOC219700 (Accession XP_167570.1) is another GAM175 target gene, herein designated TARGET GENE. LOC219700 BINDING SITE is a target binding site found in the 3' untranslated region of mRNA encoded by LOC219700, corresponding to a target binding site such as BINDING SITE I, BINDING SITE II or BINDING SITE III of FIG. 8. Table 4 illustrates the complementarity of the nucleotide sequences of LOC219700 BINDING SITE, designated SEQ ID:7954, to the nucleotide sequence of GAM175 RNA, herein designated GAM RNA, also designated SEQ ID:265.

Another function of GAM175 is therefore inhibition of LOC219700 (Accession XP_167570.1). Accordingly, utilities of GAM175 include diagnosis, prevention and treatment of diseases and clinical conditions associated with LOC219700.

LOC253142 (Accession XP_173229.1) is another GAM175 target gene, herein designated TARGET GENE. LOC253142 BINDING SITE is a target binding site found in the 5' untranslated region of mRNA encoded by LOC253142, corresponding to a target binding site such as BINDING SITE I, BINDING SITE II or BINDING SITE III of FIG. 8. Table 4 illustrates the complementarity of the nucleotide sequences of LOC253142 BINDING SITE, designated SEQ ID:6541, to the nucleotide sequence of GAM175 RNA, herein designated GAM RNA, also designated SEQ ID:265.

Another function of GAM175 is therefore inhibition of LOC253142 (Accession XP_173229.1). Accordingly, utilities of GAM175 include diagnosis, prevention and treatment of diseases and clinical conditions associated with LOC253142.

LOC282915 (Accession XP_212579.1) is another GAM175 target gene, herein designated TARGET GENE. LOC282915 BINDING SITE is a target binding site found in the 3' untranslated region of mRNA encoded by LOC282915, corresponding to a target binding site such as BINDING SITE I, BINDING SITE II or BINDING SITE III of FIG. 8. Table 4 illustrates the complementarity of the nucleotide sequences of LOC282915 BINDING SITE, designated SEQ ID:11235, to the nucleotide sequence of GAM175 RNA, herein designated GAM RNA, also designated SEQ ID:265.

Another function of GAM175 is therefore inhibition of LOC282915 (Accession XP_212579.1). Accordingly, utilities of GAM175 include diagnosis, prevention and treatment of diseases and clinical conditions associated with LOC282915.

LOC282951 (Accession XP_212627.1) is another GAM175 target gene, herein designated TARGET GENE. LOC282951 BINDING SITE is a target binding site found in the 3' untranslated region of mRNA encoded by LOC282951, corresponding to a target binding site such as BINDING SITE I, BINDING SITE II or BINDING SITE III of FIG. 8. Table 4 illustrates the complementarity of the nucleotide sequences of LOC282951 BINDING SITE, designated SEQ ID:11235, to the nucleotide sequence of GAM175 RNA, herein designated GAM RNA, also designated SEQ ID:265.

Another function of GAM175 is therefore inhibition of LOC282951 (Accession XP_212627.1). Accordingly, utilities of GAM175 include diagnosis, prevention and treatment of diseases and clinical conditions associated with LOC282951.

LOC282976 (Accession XP_210838.1) is another GAM175 target gene, herein designated TARGET GENE. LOC282976 BINDING SITE is a target binding site found in the 3' untranslated region of mRNA encoded by LOC282976, corresponding to a target binding site such as BINDING SITE I, BINDING SITE II or BINDING SITE III of FIG. 8. Table 4 illustrates the complementarity of the nucleotide sequences of LOC282976 BINDING SITE, designated SEQ ID:4866, to the nucleotide sequence of GAM175 RNA, herein designated GAM RNA, also designated SEQ ID:265.

Another function of GAM175 is therefore inhibition of LOC282976 (Accession XP_210838.1). Accordingly, utilities of GAM175 include diagnosis, prevention and treatment of diseases and clinical conditions associated with LOC282976.

LOC283126 (Accession XP_210900.1) is another GAM175 target gene, herein designated TARGET GENE. LOC283126 BINDING SITE is a target binding site found in the 3' untranslated region of mRNA encoded by LOC283126, corresponding to a target binding site such as BINDING SITE I, BINDING SITE II or BINDING SITE III of FIG. 8. Table 4 illustrates the complementarity of the nucleotide sequences of LOC283126 BINDING SITE, designated SEQ ID:17440, to the nucleotide sequence of GAM175 RNA, herein designated GAM RNA, also designated SEQ ID:265.

Another function of GAM175 is therefore inhibition of LOC283126 (Accession XP_210900.1). Accordingly, utilities of GAM175 include diagnosis, prevention and treatment of diseases and clinical conditions associated with LOC283126.

LOC283142 (Accession XP_210925.1) is another GAM175 target gene, herein designated TARGET GENE. LOC283142 BINDING SITE is a target binding site found in the 5' untranslated region of mRNA encoded by LOC283142, corresponding to a target binding site such as BINDING SITE I, BINDING SITE II or BINDING SITE III of FIG. 8. Table 4 illustrates the complementarity of the nucleotide sequences of LOC283142 BINDING SITE, designated SEQ ID:2594, to the nucleotide sequence of GAM175 RNA, herein designated GAM RNA, also designated SEQ ID:265.

Another function of GAM175 is therefore inhibition of LOC283142 (Accession XP_210925.1). Accordingly, utilities of GAM175 include diagnosis, prevention and treatment of diseases and clinical conditions associated with LOC283142.

LOC283482 (Accession XP_211061.1) is another GAM175 target gene, herein designated TARGET GENE. LOC283482 BINDING SITE is a target binding site found in the 3' untranslated region of mRNA encoded by LOC283482, corresponding to a target binding site such as BINDING SITE I, BINDING SITE II or BINDING SITE III of FIG. 8. Table 4 illustrates the complementarity of the nucleotide sequences of LOC283482 BINDING SITE, designated SEQ ID:15588, to the nucleotide sequence of GAM175 RNA, herein designated GAM RNA, also designated SEQ ID:265.

Another function of GAM175 is therefore inhibition of LOC283482 (Accession XP_211061.1). Accordingly, utilities of GAM175 include diagnosis, prevention and treatment of diseases and clinical conditions associated with LOC283482.

LOC283672 (Accession XP_211152.1) is another GAM175 target gene, herein designated TARGET GENE. LOC283672 BINDING SITE is a target binding site found in the 3' untranslated region of mRNA encoded by LOC283672, corresponding to a target binding site such as BINDING SITE I, BINDING SITE II or BINDING SITE III of FIG. 8. Table 4 illustrates the complementarity of the nucleotide sequences of LOC283672 BINDING SITE, designated SEQ ID:11064, to the nucleotide sequence of GAM175 RNA, herein designated GAM RNA, also designated SEQ ID:265.

Another function of GAM175 is therefore inhibition of LOC283672 (Accession XP_211152.1). Accordingly, utilities of GAM175 include diagnosis, prevention and treatment of diseases and clinical conditions associated with LOC283672.

LOC283859 (Accession XP_211235.1) is another GAM175 target gene, herein designated TARGET GENE. LOC283859 BINDING SITE is a target binding site found in the 3' untranslated region of mRNA encoded by LOC283859, corresponding to a target binding site such as BINDING SITE I, BINDING SITE II or BINDING SITE III of FIG. 8. Table 4 illustrates the complementarity of the nucleotide sequences of LOC283859 BINDING SITE, designated SEQ ID:15537, to the nucleotide sequence of GAM175 RNA, herein designated GAM RNA, also designated SEQ ID:265.

Another function of GAM175 is therefore inhibition of LOC283859 (Accession XP_211235.1). Accordingly, utilities of GAM175 include diagnosis, prevention and treatment of diseases and clinical conditions associated with LOC283859.

LOC284080 (Accession XP_211322.1) is another GAM175 target gene, herein designated TARGET GENE. LOC284080 BINDING SITE is a target binding site found in the 3' untranslated region of mRNA encoded by LOC284080, corresponding to a target binding site such as BINDING SITE I, BINDING SITE II or BINDING SITE III of FIG. 8. Table 4 illustrates the complementarity of the nucleotide sequences of LOC284080 BINDING SITE, designated SEQ ID:17268, to the nucleotide sequence of GAM175 RNA, herein designated GAM RNA, also designated SEQ ID:265.

Another function of GAM175 is therefore inhibition of LOC284080 (Accession XP_211322.1). Accordingly, utilities of GAM175 include diagnosis, prevention and treatment of diseases and clinical conditions associated with LOC284080.

LOC284116 (Accession XP_211338.2) is another GAM175 target gene, herein designated TARGET GENE. LOC284116 BINDING SITE is a target binding site found in the 5' untranslated region of mRNA encoded by LOC284116, corresponding to a target binding site such as BINDING SITE I, BINDING SITE II or BINDING SITE III of FIG. 8. Table 4 illustrates the complementarity of the nucleotide sequences of LOC284116 BINDING SITE, designated SEQ ID:9262, to the nucleotide sequence of GAM175 RNA, herein designated GAM RNA, also designated SEQ ID:265.

Another function of GAM175 is therefore inhibition of LOC284116 (Accession XP_211338.2). Accordingly, utilities of GAM175 include diagnosis, prevention and treatment of diseases and clinical conditions associated with LOC284116.

LOC284296 (Accession NP_787104.1) is another GAM175 target gene, herein designated TARGET GENE. LOC284296 BINDING SITE is a target binding site found in the 3' untranslated region of mRNA encoded by LOC284296, corresponding to a target binding site such as BINDING SITE I, BINDING SITE II or BINDING SITE III of FIG. 8. Table 4 illustrates the complementarity of the nucleotide sequences of LOC284296 BINDING SITE, designated SEQ ID:17027, to the nucleotide sequence of GAM175 RNA, herein designated GAM RNA, also designated SEQ ID:265.

Another function of GAM175 is therefore inhibition of LOC284296 (Accession NP_787104.1). Accordingly, utilities of GAM175 include diagnosis, prevention and treatment of diseases and clinical conditions associated with LOC284296.

LOC284462 (Accession XP_211475.1) is another GAM175 target gene, herein designated TARGET GENE. LOC284462 BINDING SITE is a target binding site found in the 3' untranslated region of mRNA encoded by LOC284462, corresponding to a target binding site such as BINDING SITE I, BINDING SITE II or BINDING SITE III of FIG. 8. Table 4 illustrates the complementarity of the nucleotide sequences of LOC284462 BINDING SITE, designated SEQ ID:5767, to the nucleotide sequence of GAM175 RNA, herein designated GAM RNA, also designated SEQ ID:265.

Another function of GAM175 is therefore inhibition of LOC284462 (Accession XP_211475.1). Accordingly, utilities of GAM175 include diagnosis, prevention and treatment of diseases and clinical conditions associated with LOC284462.

LOC284568 (Accession XP_209263.1) is another GAM175 target gene, herein designated TARGET GENE. LOC284568 BINDING SITE is a target binding site found in the 3' untranslated region of mRNA encoded by LOC284568, corresponding to a target binding site such as BINDING SITE I, BINDING SITE II or BINDING SITE III of FIG. 8. Table 4 illustrates the complementarity of the nucleotide sequences of LOC284568 BINDING SITE, designated SEQ ID:11550, to the nucleotide sequence of GAM175 RNA, herein designated GAM RNA, also designated SEQ ID:265.

Another function of GAM175 is therefore inhibition of LOC284568 (Accession XP_209263.1). Accordingly, utilities of GAM175 include diagnosis, prevention and treatment of diseases and clinical conditions associated with LOC284568.

LOC284865 (Accession XP_211672.1) is another GAM175 target gene, herein designated TARGET GENE. LOC284865 BINDING SITE is a target binding site found in the 5' untranslated region of mRNA encoded by LOC284865, corresponding to a target binding site such as BINDING SITE I, BINDING SITE II or BINDING SITE III of FIG. 8. Table 4 illustrates the complementarity of the nucleotide sequences of LOC284865 BINDING SITE, designated SEQ ID:8040, to the nucleotide sequence of GAM175 RNA, herein designated GAM RNA, also designated SEQ ID:265.

Another function of GAM175 is therefore inhibition of LOC284865 (Accession XP_211672.1). Accordingly, utilities of GAM175 include diagnosis, prevention and treatment of diseases and clinical conditions associated with LOC284865.

LOC284982 (Accession XP_211721.1) is another GAM175 target gene, herein designated TARGET GENE. LOC284982 BINDING SITE is a target binding site found in the 3' untranslated region of mRNA encoded by LOC284982, corresponding to a target binding site such as BINDING SITE I, BINDING SITE II or BINDING SITE III of FIG. 8. Table 4 illustrates the complementarity of the nucleotide sequences of LOC284982 BINDING SITE, designated SEQ ID:17065, to the nucleotide sequence of GAM175 RNA, herein designated GAM RNA, also designated SEQ ID:265.

Another function of GAM175 is therefore inhibition of LOC284982 (Accession XP_211721.1). Accordingly, utilities of GAM175 include diagnosis, prevention and treatment of diseases and clinical conditions associated with LOC284982.

LOC284993 (Accession XP_211722.1) is another GAM175 target gene, herein designated TARGET GENE. LOC284993 BINDING SITE is a target binding site found in the 3' untranslated region of mRNA encoded by LOC284993, corresponding to a target binding site such as BINDING SITE I, BINDING SITE II or BINDING SITE III of FIG. 8. Table 4 illustrates the complementarity of the nucleotide sequences of LOC284993 BINDING SITE, designated SEQ ID:10924, to the nucleotide sequence of GAM175 RNA, herein designated GAM RNA, also designated SEQ ID:265.

Another function of GAM175 is therefore inhibition of LOC284993 (Accession XP_211722.1). Accordingly, utilities of GAM175 include diagnosis, prevention and treatment of diseases and clinical conditions associated with LOC284993.

LOC285026 (Accession XP_209440.1) is another GAM175 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:19445, to the nucleotide sequence of GAM175 RNA, herein designated GAM RNA, also designated SEQ ID:265.

Another function of GAM175 is therefore inhibition of LOC285026 (Accession XP_209440.1). Accordingly, utilities of GAM175 include diagnosis, prevention and treatment of diseases and clinical conditions associated with LOC285026.

LOC285222 (Accession XP_211809.1) is another GAM175 target gene, herein designated TARGET GENE. LOC285222 BINDING SITE is a target binding site found in the 3' untranslated region of mRNA encoded by LOC285222, corresponding to a target binding site such as BINDING SITE I, BINDING SITE II or BINDING SITE III of FIG. 8. Table 4 illustrates the complementarity of the nucleotide sequences of LOC285222 BINDING SITE, designated SEQ ID:17158, to the nucleotide sequence of GAM175 RNA, herein designated GAM RNA, also designated SEQ ID:265.

Another function of GAM175 is therefore inhibition of LOC285222 (Accession XP_211809.1). Accordingly, utilities of GAM175 include diagnosis, prevention and treatment of diseases and clinical conditions associated with LOC285222.

LOC285229 (Accession XP_211812.1) is another GAM175 target gene, herein designated TARGET GENE. LOC285229 BINDING SITE is a target binding site found in the 5' untranslated region of mRNA encoded by LOC285229, corresponding to a target binding site such as BINDING SITE I, BINDING SITE II or BINDING SITE III of FIG. 8. Table 4 illustrates the complementarity of the nucleotide sequences of LOC285229 BINDING SITE, designated SEQ ID:6284, to the nucleotide sequence of GAM175 RNA, herein designated GAM RNA, also designated SEQ ID:265.

Another function of GAM175 is therefore inhibition of LOC285229 (Accession XP_211812.1). Accordingly, utilities of GAM175 include diagnosis, prevention and treatment of diseases and clinical conditions associated with LOC285229.

LOC285231 (Accession XP_211813.1) is another GAM175 target gene, herein designated TARGET GENE. LOC285231 BINDING SITE is a target binding site found in the 3' untranslated region of mRNA encoded by LOC285231, corresponding to a target binding site such as BINDING SITE I, BINDING SITE II or BINDING SITE III of FIG. 8. Table 4 illustrates the complementarity of the nucleotide sequences of LOC285231 BINDING SITE, designated SEQ ID:2395, to the nucleotide sequence of GAM175 RNA, herein designated GAM RNA, also designated SEQ ID:265.

Another function of GAM175 is therefore inhibition of LOC285231 (Accession XP_211813.1). Accordingly, utilities of GAM175 include diagnosis, prevention and treatment of diseases and clinical conditions associated with LOC285231.

LOC285246 (Accession XP_208303.1) is another GAM175 target gene, herein designated TARGET GENE. LOC285246 BINDING SITE is a target binding site found in the 3' untranslated region of mRNA encoded by LOC285246, corresponding to a target binding site such as BINDING SITE I, BINDING SITE II or BINDING SITE III of FIG. 8. Table 4 illustrates the complementarity of the nucleotide sequences of LOC285246 BINDING SITE, designated SEQ ID:1260, to the nucleotide sequence of GAM175 RNA, herein designated GAM RNA, also designated SEQ ID:265.

Another function of GAM175 is therefore inhibition of LOC285246 (Accession XP_208303.1). Accordingly, utilities of GAM175 include diagnosis, prevention and treatment of diseases and clinical conditions associated with LOC285246.

LOC285388 (Accession XP_208316.1) is another GAM175 target gene, herein designated TARGET GENE. LOC285388 BINDING SITE is a target binding site found in the 5' untranslated region of mRNA encoded by LOC285388, corresponding to a target binding site such as BINDING SITE I, BINDING SITE II or BINDING SITE III of FIG. 8. Table 4 illustrates the complementarity of the nucleotide sequences of LOC285388 BINDING SITE, designated SEQ ID:8111, to the nucleotide sequence of GAM175 RNA, herein designated GAM RNA, also designated SEQ ID:265.

Another function of GAM175 is therefore inhibition of LOC285388 (Accession XP_208316.1). Accordingly, utilities of GAM175 include diagnosis, prevention and treatment of diseases and clinical conditions associated with LOC285388.

LOC285438 (Accession XP_209613.1) is another GAM175 target gene, herein designated TARGET GENE. LOC285438 BINDING SITE is a target binding site found in the 3' untranslated region of mRNA encoded by LOC285438, corresponding to a target binding site such as BINDING SITE I, BINDING SITE II or BINDING SITE III of FIG. 8. Table 4 illustrates the complementarity of the nucleotide sequences of LOC285438 BINDING SITE, designated SEQ ID:10871, to the nucleotide sequence of GAM175 RNA, herein designated GAM RNA, also designated SEQ ID:265.

Another function of GAM175 is therefore inhibition of LOC285438 (Accession XP_209613.1). Accordingly, utilities of GAM175 include diagnosis, prevention and treatment of diseases and clinical conditions associated with LOC285438.

LOC285486 (Accession XP_209633.1) is another GAM175 target gene, herein designated TARGET GENE. LOC285486 BINDING SITE is a target binding site found in the 5' untranslated region of mRNA encoded by LOC285486, corresponding to a target binding site such as BINDING SITE I, BINDING SITE II or BINDING SITE III of FIG. 8. Table 4 illustrates the complementarity of the nucleotide sequences of LOC285486 BINDING SITE, designated SEQ ID:8485, to the nucleotide sequence of GAM175 RNA, herein designated GAM RNA, also designated SEQ ID:265.

Another function of GAM175 is therefore inhibition of LOC285486 (Accession XP_209633.1). Accordingly, utilities of GAM175 include diagnosis, prevention and treatment of diseases and clinical conditions associated with LOC285486.

LOC285602 (Accession XP_209676.1) is another GAM175 target gene, herein designated TARGET GENE. LOC285602 BINDING SITE is a target binding site found in the 5' untranslated region of mRNA encoded by LOC285602, corresponding to a target binding site such as BINDING SITE I, BINDING SITE II or BINDING SITE III of FIG. 8. Table 4 illustrates the complementarity of the nucleotide sequences of LOC285602 BINDING SITE, designated SEQ ID:12446, to the nucleotide sequence of GAM175 RNA, herein designated GAM RNA, also designated SEQ ID:265.

Another function of GAM175 is therefore inhibition of LOC285602 (Accession XP_209676.1). Accordingly, utilities of GAM175 include diagnosis, prevention and treatment of diseases and clinical conditions associated with LOC285602.

LOC285745 (Accession XP_212007.1) is another GAM175 target gene, herein designated TARGET GENE. LOC285745 BINDING SITE is a target binding site found in the 3' untranslated region of mRNA encoded by LOC285745, corresponding to a target binding site such as BINDING SITE I, BINDING SITE II or BINDING SITE III of FIG. 8. Table 4 illustrates the complementarity of the nucleotide sequences of LOC285745 BINDING SITE, designated SEQ ID:19064, to the nucleotide sequence of GAM175 RNA, herein designated GAM RNA, also designated SEQ ID:265.

Another function of GAM175 is therefore inhibition of LOC285745 (Accession XP_212007.1). Accordingly, utilities of GAM175 include diagnosis, prevention and treatment of diseases and clinical conditions associated with LOC285745.

LOC285747 (Accession XP_209742.1) is another GAM175 target gene, herein designated TARGET GENE. LOC285747 BINDING SITE is a target binding site found in the 5' untranslated region of mRNA encoded by LOC285747, corresponding to a target binding site such as BINDING SITE I, BINDING SITE II or BINDING SITE III of FIG. 8. Table 4 illustrates the complementarity of the nucleotide sequences of LOC285747 BINDING SITE, designated SEQ ID:1009, to the nucleotide sequence of GAM175 RNA, herein designated GAM RNA, also designated SEQ ID:265.

Another function of GAM175 is therefore inhibition of LOC285747 (Accession XP_209742.1). Accordingly, utilities of GAM175 include diagnosis, prevention and treatment of diseases and clinical conditions associated with LOC285747.

LOC285786 (Accession XP_208349.1) is another GAM175 target gene, herein designated TARGET GENE. LOC285786 BINDING SITE is a target binding site found in the 3' untranslated region of mRNA encoded by LOC285786, corresponding to a target binding site such as BINDING SITE I, BINDING SITE II or BINDING SITE III of FIG. 8. Table 4 illustrates the complementarity of the nucleotide sequences of LOC285786 BINDING SITE, designated SEQ ID:19355, to the nucleotide sequence of GAM175 RNA, herein designated GAM RNA, also designated SEQ ID:265.

Another function of GAM175 is therefore inhibition of LOC285786 (Accession XP_208349.1). Accordingly, utilities of GAM175 include diagnosis, prevention and treatment of diseases and clinical conditions associated with LOC285786.

LOC285805 (Accession XP_212027.1) is another GAM175 target gene, herein designated TARGET GENE. LOC285805 BINDING SITE is a target binding site found in the 5' untranslated region of mRNA encoded by LOC285805, corresponding to a target binding site such as BINDING SITE I, BINDING SITE II or BINDING SITE III of FIG. 8. Table 4 illustrates the complementarity of the nucleotide sequences of LOC285805 BINDING SITE, designated SEQ ID:6025, to the nucleotide sequence of GAM175 RNA, herein designated GAM RNA, also designated SEQ ID:265.

Another function of GAM175 is therefore inhibition of LOC285805 (Accession XP_212027.1). Accordingly, utilities of GAM175 include diagnosis, prevention and treatment of diseases and clinical conditions associated with LOC285805.

LOC285833 (Accession XP_209790.1) is another GAM175 target gene, herein designated TARGET GENE. LOC285833 BINDING SITE is a target binding site found in the 3' untranslated region of mRNA encoded by LOC285833, corresponding to a target binding site such as BINDING SITE I, BINDING SITE II or BINDING SITE III of FIG. 8. Table 4 illustrates the complementarity of the nucleotide sequences of LOC285833 BINDING SITE, designated SEQ ID:11235, to the nucleotide sequence of GAM175 RNA, herein designated GAM RNA, also designated SEQ ID:265.

Another function of GAM175 is therefore inhibition of LOC285833 (Accession XP_209790.1). Accordingly, utilities of GAM175 include diagnosis, prevention and treatment of diseases and clinical conditions associated with LOC285833.

LOC285945 (Accession XP_212092.1) is another GAM175 target gene, herein designated TARGET GENE. LOC285945 BINDING SITE is a target binding site found in the 5' untranslated region of mRNA encoded by LOC285945, corresponding to a target binding site such as BINDING SITE I, BINDING SITE II or BINDING SITE III of FIG. 8. Table 4 illustrates the complementarity of the nucleotide sequences of LOC285945 BINDING SITE, designated SEQ ID:20077, to the nucleotide sequence of GAM175 RNA, herein designated GAM RNA, also designated SEQ ID:265.

Another function of GAM175 is therefore inhibition of LOC285945 (Accession XP_212092.1). Accordingly, utilities of GAM175 include diagnosis, prevention and treatment of diseases and clinical conditions associated with LOC285945.

LOC285992 (Accession XP_212126.1) is another GAM175 target gene, herein designated TARGET GENE. LOC285992 BINDING SITE is a target binding site found in the 5' untranslated region of mRNA encoded by LOC285992, corresponding to a target binding site such as BINDING SITE I, BINDING SITE II or BINDING SITE III of FIG. 8. Table 4 illustrates the complementarity of the nucleotide sequences of LOC285992 BINDING SITE, designated SEQ ID:9866, to the nucleotide sequence of GAM175 RNA, herein designated GAM RNA, also designated SEQ ID:265.

Another function of GAM175 is therefore inhibition of LOC285992 (Accession XP_212126.1). Accordingly, utilities of GAM175 include diagnosis, prevention and treatment of diseases and clinical conditions associated with LOC285992.

LOC286002 (Accession XP_212132.1) is another GAM175 target gene, herein designated TARGET GENE. LOC286002 BINDING SITE is a target binding site found in the 5' untranslated region of mRNA encoded by LOC286002, corresponding to a target binding site such as BINDING SITE I, BINDING SITE II or BINDING SITE III of FIG. 8. Table 4 illustrates the complementarity of the nucleotide sequences of LOC286002 BINDING SITE, designated SEQ ID:12015, to the nucleotide sequence of GAM175 RNA, herein designated GAM RNA, also designated SEQ ID:265.

Another function of GAM175 is therefore inhibition of LOC286002 (Accession XP_212132.1). Accordingly, utilities of GAM175 include diagnosis, prevention and treatment of diseases and clinical conditions associated with LOC286002.

LOC286132 (Accession XP_212194.1) is another GAM175 target gene, herein designated TARGET GENE.

LOC286132 BINDING SITE is a target binding site found in the 5' untranslated region of mRNA encoded by LOC286132, corresponding to a target binding site such as BINDING SITE I, BINDING SITE II or BINDING SITE III of FIG. 8. Table 4 illustrates the complementarity of the nucleotide sequences of LOC286132 BINDING SITE, designated SEQ ID:4900, to the nucleotide sequence of GAM175 RNA, herein designated GAM RNA, also designated SEQ ID:265.

Another function of GAM175 is therefore inhibition of LOC286132 (Accession XP_212194.1). Accordingly, utilities of GAM175 include diagnosis, prevention and treatment of diseases and clinical conditions associated with LOC286132.

LOC286214 (Accession XP_212231.1) is another GAM175 target gene, herein designated TARGET GENE. LOC286214 BINDING SITE is a target binding site found in the 5' untranslated region of mRNA encoded by LOC286214, corresponding to a target binding site such as BINDING SITE I, BINDING SITE II or BINDING SITE III of FIG. 8. Table 4 illustrates the complementarity of the nucleotide sequences of LOC286214 BINDING SITE, designated SEQ ID:2319, to the nucleotide sequence of GAM175 RNA, herein designated GAM RNA, also designated SEQ ID:265.

Another function of GAM175 is therefore inhibition of LOC286214 (Accession XP_212231.1). Accordingly, utilities of GAM175 include diagnosis, prevention and treatment of diseases and clinical conditions associated with LOC286214.

LOC286471 (Accession XP_210061.1) is another GAM175 target gene, herein designated TARGET GENE. LOC286471 BINDING SITE is a target binding site found in the 3' untranslated region of mRNA encoded by LOC286471, corresponding to a target binding site such as BINDING SITE I, BINDING SITE II or BINDING SITE III of FIG. 8. Table 4 illustrates the complementarity of the nucleotide sequences of LOC286471 BINDING SITE, designated SEQ ID:5576, to the nucleotide sequence of GAM175 RNA, herein designated GAM RNA, also designated SEQ ID:265.

Another function of GAM175 is therefore inhibition of LOC286471 (Accession XP_210061.1). Accordingly, utilities of GAM175 include diagnosis, prevention and treatment of diseases and clinical conditions associated with LOC286471.

LOC338565 (Accession XP_294653.1) is another GAM175 target gene, herein designated TARGET GENE. LOC338565 BINDING SITE is a target binding site found in the 5' untranslated region of mRNA encoded by LOC338565, corresponding to a target binding site such as BINDING SITE I, BINDING SITE II or BINDING SITE III of FIG. 8. Table 4 illustrates the complementarity of the nucleotide sequences of LOC338565 BINDING SITE, designated SEQ ID:10504, to the nucleotide sequence of GAM175 RNA, herein designated GAM RNA, also designated SEQ ID:265.

Another function of GAM175 is therefore inhibition of LOC338565 (Accession XP_294653.1). Accordingly, utilities of GAM175 include diagnosis, prevention and treatment of diseases and clinical conditions associated with LOC338565.

LOC338585 (Accession XP_294658.1) is another GAM175 target gene, herein designated TARGET GENE. LOC338585 BINDING SITE is a target binding site found in the 3' untranslated region of mRNA encoded by LOC338585, corresponding to a target binding site such as BINDING SITE I, BINDING SITE II or BINDING SITE III of FIG. 8. Table 4 illustrates the complementarity of the nucleotide sequences of LOC338585 BINDING SITE, designated SEQ ID:9293, to the nucleotide sequence of GAM175 RNA, herein designated GAM RNA, also designated SEQ ID:265.

Another function of GAM175 is therefore inhibition of LOC338585 (Accession XP_294658.1). Accordingly, utilities of GAM175 include diagnosis, prevention and treatment of diseases and clinical conditions associated with LOC338585.

LOC339071 (Accession XP_294800.1) is another GAM175 target gene, herein designated TARGET GENE. LOC339071 BINDING SITE is a target binding site found in the 5' untranslated region of mRNA encoded by LOC339071, corresponding to a target binding site such as BINDING SITE I, BINDING SITE II or BINDING SITE III of FIG. 8. Table 4 illustrates the complementarity of the nucleotide sequences of LOC339071 BINDING SITE, designated SEQ ID:11684, to the nucleotide sequence of GAM175 RNA, herein designated GAM RNA, also designated SEQ ID:265.

Another function of GAM175 is therefore inhibition of LOC339071 (Accession XP_294800.1). Accordingly, utilities of GAM175 include diagnosis, prevention and treatment of diseases and clinical conditions associated with LOC339071.

LOC339152 (Accession XP_294829.1) is another GAM175 target gene, herein designated TARGET GENE. LOC339152 BINDING SITE is a target binding site found in the 3' untranslated region of mRNA encoded by LOC339152, corresponding to a target binding site such as BINDING SITE I, BINDING SITE II or BINDING SITE III of FIG. 8. Table 4 illustrates the complementarity of the nucleotide sequences of LOC339152 BINDING SITE, designated SEQ ID:18348, to the nucleotide sequence of GAM175 RNA, herein designated GAM RNA, also designated SEQ ID:265.

Another function of GAM175 is therefore inhibition of LOC339152 (Accession XP_294829.1). Accordingly, utilities of GAM175 include diagnosis, prevention and treatment of diseases and clinical conditions associated with LOC339152.

LOC339666 (Accession XP_295024.1) is another GAM175 target gene, herein designated TARGET GENE. LOC339666 BINDING SITE is a target binding site found in the 5' untranslated region of mRNA encoded by LOC339666, corresponding to a target binding site such as BINDING SITE I, BINDING SITE II or BINDING SITE III of FIG. 8. Table 4 illustrates the complementarity of the nucleotide sequences of LOC339666 BINDING SITE, designated SEQ ID:4270, to the nucleotide sequence of GAM175 RNA, herein designated GAM RNA, also designated SEQ ID:265.

Another function of GAM175 is therefore inhibition of LOC339666 (Accession XP_295024.1). Accordingly, utilities of GAM175 include diagnosis, prevention and treatment of diseases and clinical conditions associated with LOC339666.

LOC339831 (Accession XP_295080.1) is another GAM175 target gene, herein designated TARGET GENE. LOC339831 BINDING SITE is a target binding site found in the 5' untranslated region of mRNA encoded by LOC339831, corresponding to a target binding site such as BINDING SITE I, BINDING SITE II or BINDING SITE III of FIG. 8. Table 4 illustrates the complementarity of the nucleotide sequences of LOC339831 BINDING SITE, designated SEQ ID:7585, to the nucleotide sequence of GAM175 RNA, herein designated GAM RNA, also designated SEQ ID:265.

Another function of GAM175 is therefore inhibition of LOC339831 (Accession XP_295080.1). Accordingly, utilities of GAM175 include diagnosis, prevention and treatment of diseases and clinical conditions associated with LOC339831.

LOC339834 (Accession NP_835467.1) is another GAM175 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:14967, to the nucleotide sequence of GAM175 RNA, herein designated GAM RNA, also designated SEQ ID:265.

Another function of GAM175 is therefore inhibition of LOC339834 (Accession NP_835467.1). Accordingly, utilities of GAM175 include diagnosis, prevention and treatment of diseases and clinical conditions associated with LOC339834.

LOC339834 (Accession XP_291033.1) is another GAM175 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:14967, to the nucleotide sequence of GAM175 RNA, herein designated GAM RNA, also designated SEQ ID:265.

Another function of GAM175 is therefore inhibition of LOC339834 (Accession XP_291033.1). Accordingly, utilities of GAM175 include diagnosis, prevention and treatment of diseases and clinical conditions associated with LOC339834.

LOC339872 (Accession XP_291050.1) is another GAM175 target gene, herein designated TARGET GENE. LOC339872 BINDING SITE is a target binding site found in the 3' untranslated region of mRNA encoded by LOC339872, corresponding to a target binding site such as BINDING SITE I, BINDING SITE II or BINDING SITE III of FIG. 8. Table 4 illustrates the complementarity of the nucleotide sequences of LOC339872 BINDING SITE, designated SEQ ID:5152, to the nucleotide sequence of GAM175 RNA, herein designated GAM RNA, also designated SEQ ID:265.

Another function of GAM175 is therefore inhibition of LOC339872 (Accession XP_291050.1). Accordingly, utilities of GAM175 include diagnosis, prevention and treatment of diseases and clinical conditions associated with LOC339872.

LOC340090 (Accession XP_295154.1) is another GAM175 target gene, herein designated TARGET GENE. LOC340090 BINDING SITE is a target binding site found in the 5' untranslated region of mRNA encoded by LOC340090, corresponding to a target binding site such as BINDING SITE I, BINDING SITE II or BINDING SITE III of FIG. 8. Table 4 illustrates the complementarity of the nucleotide sequences of LOC340090 BINDING SITE, designated SEQ ID:10984, to the nucleotide sequence of GAM175 RNA, herein designated GAM RNA, also designated SEQ ID:265.

Another function of GAM175 is therefore inhibition of LOC340090 (Accession XP_295154.1). Accordingly, utilities of GAM175 include diagnosis, prevention and treatment of diseases and clinical conditions associated with LOC340090.

LOC340397 (Accession XP_295237.1) is another GAM175 target gene, herein designated TARGET GENE. LOC340397 BINDING SITE is a target binding site found in the 5' untranslated region of mRNA encoded by LOC340397, corresponding to a target binding site such as BINDING SITE I, BINDING SITE II or BINDING SITE III of FIG. 8. Table 4 illustrates the complementarity of the nucleotide sequences of LOC340397 BINDING SITE, designated SEQ ID:11433, to the nucleotide sequence of GAM175 RNA, herein designated GAM RNA, also designated SEQ ID:265.

Another function of GAM175 is therefore inhibition of LOC340397 (Accession XP_295237.1). Accordingly, utilities of GAM175 include diagnosis, prevention and treatment of diseases and clinical conditions associated with LOC340397.

LOC340408 (Accession XP_291274.1) is another GAM175 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:14607, to the nucleotide sequence of GAM175 RNA, herein designated GAM RNA, also designated SEQ ID:265.

Another function of GAM175 is therefore inhibition of LOC340408 (Accession XP_291274.1). Accordingly, utilities of GAM175 include diagnosis, prevention and treatment of diseases and clinical conditions associated with LOC340408.

LOC340895 (Accession XP_295865.1) is another GAM175 target gene, herein designated TARGET GENE. LOC340895 BINDING SITE is a target binding site found in the 5' untranslated region of mRNA encoded by LOC340895, corresponding to a target binding site such as BINDING SITE I, BINDING SITE II or BINDING SITE III of FIG. 8. Table 4 illustrates the complementarity of the nucleotide sequences of LOC340895 BINDING SITE, designated SEQ ID:10036, to the nucleotide sequence of GAM175 RNA, herein designated GAM RNA, also designated SEQ ID:265.

Another function of GAM175 is therefore inhibition of LOC340895 (Accession XP_295865.1). Accordingly, utilities of GAM175 include diagnosis, prevention and treatment of diseases and clinical conditions associated with LOC340895.

LOC342125 (Accession XP_292375.1) is another GAM175 target gene, herein designated TARGET GENE. LOC342125 BINDING SITE is a target binding site found in the 3' untranslated region of mRNA encoded by LOC342125, corresponding to a target binding site such as BINDING SITE I, BINDING SITE II or BINDING SITE III of FIG. 8. Table 4 illustrates the complementarity of the nucleotide sequences of LOC342125 BINDING SITE, designated SEQ ID:12487, to the nucleotide sequence of GAM175 RNA, herein designated GAM RNA, also designated SEQ ID:265.

Another function of GAM175 is therefore inhibition of LOC342125 (Accession XP_292375.1). Accordingly, utilities of GAM175 include diagnosis, prevention and treatment of diseases and clinical conditions associated with LOC342125.

LOC347240 (Accession XP_294563.2) is another GAM175 target gene, herein designated TARGET GENE. LOC347240 BINDING SITE is a target binding site found in the 5' untranslated region of mRNA encoded by LOC347240, corresponding to a target binding site such as BINDING SITE I, BINDING SITE II or BINDING SITE III of FIG. 8. Table 4 illustrates the complementarity of the nucleotide sequences of LOC347240 BINDING SITE, designated SEQ ID:8399, to the nucleotide sequence of GAM175 RNA, herein designated GAM RNA, also designated SEQ ID:265.

Another function of GAM175 is therefore inhibition of LOC347240 (Accession XP_294563.2). Accordingly, utilities of GAM175 include diagnosis, prevention and treatment of diseases and clinical conditions associated with LOC347240.

LOC347759 (Accession XP_084325.1) is another GAM175 target gene, herein designated TARGET GENE. LOC347759 BINDING SITE is a target binding site found in the 3' untranslated region of mRNA encoded by LOC347759, corresponding to a target binding site such as BINDING SITE I, BINDING SITE II or BINDING SITE III of FIG. 8. Table 4 illustrates the complementarity of the nucleotide sequences of LOC347759 BINDING SITE, designated SEQ ID:5676, to the nucleotide sequence of GAM175 RNA, herein designated GAM RNA, also designated SEQ ID:265.

Another function of GAM175 is therefore inhibition of LOC347759 (Accession XP_084325.1). Accordingly, utilities of GAM175 include diagnosis, prevention and treatment of diseases and clinical conditions associated with LOC347759.

LOC348158 (Accession XP_300646.1) is another GAM175 target gene, herein designated TARGET GENE. LOC348158 BINDING SITE1 and LOC348158 BINDING SITE2 are target binding sites found in untranslated regions of mRNA encoded by LOC348158, corresponding to target binding sites such as BINDING SITE I, BINDING SITE II or BINDING SITE III of FIG. 8. Table 4 illustrates the complementarity of the nucleotide sequences of LOC348158 BINDING SITE1 and LOC348158 BINDING SITE2, designated SEQ ID:17028 and SEQ ID:9642 respectively, to the nucleotide sequence of GAM175 RNA, herein designated GAM RNA, also designated SEQ ID:265.

Another function of GAM175 is therefore inhibition of LOC348158 (Accession XP_300646.1). Accordingly, utilities of GAM175 include diagnosis, prevention and treatment of diseases and clinical conditions associated with LOC348158.

LOC348370 (Accession XP_300721.1) is another GAM175 target gene, herein designated TARGET GENE. LOC348370 BINDING SITE is a target binding site found in the 3' untranslated region of mRNA encoded by LOC348370, corresponding to a target binding site such as BINDING SITE I, BINDING SITE II or BINDING SITE III of FIG. 8. Table 4 illustrates the complementarity of the nucleotide sequences of LOC348370 BINDING SITE, designated SEQ ID:11550, to the nucleotide sequence of GAM175 RNA, herein designated GAM RNA, also designated SEQ ID:265.

Another function of GAM175 is therefore inhibition of LOC348370 (Accession XP_300721.1). Accordingly, utilities of GAM175 include diagnosis, prevention and treatment of diseases and clinical conditions associated with LOC348370.

LOC348378 (Accession XP_300723.1) is another GAM175 target gene, herein designated TARGET GENE. LOC348378 BINDING SITE is a target binding site found in the 3' untranslated region of mRNA encoded by LOC348378, corresponding to a target binding site such as BINDING SITE I, BINDING SITE II or BINDING SITE III of FIG. 8. Table 4 illustrates the complementarity of the nucleotide sequences of LOC348378 BINDING SITE, designated SEQ ID:15891, to the nucleotide sequence of GAM175 RNA, herein designated GAM RNA, also designated SEQ ID:265.

Another function of GAM175 is therefore inhibition of LOC348378 (Accession XP_300723.1). Accordingly, utilities of GAM175 include diagnosis, prevention and treatment of diseases and clinical conditions associated with LOC348378.

LOC348383 (Accession XP_300726.1) is another GAM175 target gene, herein designated TARGET GENE. LOC348383 BINDING SITE is a target binding site found in the 3' untranslated region of mRNA encoded by LOC348383, corresponding to a target binding site such as BINDING SITE I, BINDING SITE II or BINDING SITE III of FIG. 8. Table 4 illustrates the complementarity of the nucleotide sequences of LOC348383 BINDING SITE, designated SEQ ID:11550, to the nucleotide sequence of GAM175 RNA, herein designated GAM RNA, also designated SEQ ID:265.

Another function of GAM175 is therefore inhibition of LOC348383 (Accession XP_300726.1). Accordingly, utilities of GAM175 include diagnosis, prevention and treatment of diseases and clinical conditions associated with LOC348383.

LOC351256 (Accession XP_301805.1) is another GAM175 target gene, herein designated TARGET GENE. LOC351256 BINDING SITE is a target binding site found in the 5' untranslated region of mRNA encoded by LOC351256, corresponding to a target binding site such as BINDING SITE I, BINDING SITE II or BINDING SITE III of FIG. 8. Table 4 illustrates the complementarity of the nucleotide sequences of LOC351256 BINDING SITE, designated SEQ ID:6773, to the nucleotide sequence of GAM175 RNA, herein designated GAM RNA, also designated SEQ ID:265.

Another function of GAM175 is therefore inhibition of LOC351256 (Accession XP_301805.1). Accordingly, utilities of GAM175 include diagnosis, prevention and treatment of diseases and clinical conditions associated with LOC351256.

LOC92078 (Accession XP_042684.1) is another GAM175 target gene, herein designated TARGET GENE. LOC92078 BINDING SITE is a target binding site found in the 5' untranslated region of mRNA encoded by LOC92078, corresponding to a target binding site such as BINDING SITE I, BINDING SITE II or BINDING SITE III of FIG. 8. Table 4 illustrates the complementarity of the nucleotide sequences of LOC92078 BINDING SITE, designated SEQ ID:4921, to the nucleotide sequence of GAM175 RNA, herein designated GAM RNA, also designated SEQ ID:265.

Another function of GAM175 is therefore inhibition of LOC92078 (Accession XP_042684.1). Accordingly, utilities of GAM175 include diagnosis, prevention and treatment of diseases and clinical conditions associated with LOC92078.

LOC96597 (Accession XP_039922.1) is another GAM175 target gene, herein designated TARGET GENE. LOC96597 BINDING SITE is a target binding site found in the 5' untranslated region of mRNA encoded by LOC96597, corresponding to a target binding site such as BINDING SITE I, BINDING SITE II or BINDING SITE III of FIG. 8. Table 4 illustrates the complementarity of the nucleotide sequences of LOC96597 BINDING SITE, designated SEQ ID:1106, to the nucleotide sequence of GAM175 RNA, herein designated GAM RNA, also designated SEQ ID:265.

Another function of GAM175 is therefore inhibition of LOC96597 (Accession XP_039922.1). Accordingly, utilities of GAM175 include diagnosis, prevention and treatment of diseases and clinical conditions associated with LOC96597.

LPHN2 (Accession NP_036434.1) is another GAM175 target gene, herein designated TARGET GENE. LPHN2 BINDING SITE is a target binding site found in the 3' untranslated region of mRNA encoded by LPHN2, corresponding to a target binding site such as BINDING SITE I, BINDING SITE II or BINDING SITE III of FIG. 8. Table 4 illustrates the complementarity of the nucleotide sequences of LPHN2 BINDING SITE, designated SEQ ID:9096, to the nucleotide sequence of GAM175 RNA, herein designated GAM RNA, also designated SEQ ID:265.

Another function of GAM175 is therefore inhibition of LPHN2 (Accession NP_036434.1). Accordingly, utilities of GAM175 include diagnosis, prevention and treatment of diseases and clinical conditions associated with LPHN2.

MGC11242 (Accession NP_077296.1) is another GAM175 target gene, herein designated TARGET GENE. MGC11242 BINDING SITE is a target binding site found in the 3' untranslated region of mRNA encoded by MGC11242, corresponding to a target binding site such as BINDING SITE I, BINDING SITE II or BINDING SITE III of FIG. 8. Table 4 illustrates the complementarity of the nucleotide sequences of MGC11242 BINDING SITE, designated SEQ ID:8334, to the nucleotide sequence of GAM175 RNA, herein designated GAM RNA, also designated SEQ ID:265.

Another function of GAM175 is therefore inhibition of MGC11242 (Accession NP_077296.1). Accordingly, utilities of GAM175 include diagnosis, prevention and treatment of diseases and clinical conditions associated with MGC11242.

MGC20785 (Accession NP_689934.1) is another GAM175 target gene, herein designated TARGET GENE. MGC20785 BINDING SITE is a target binding site found in the 3' untranslated region of mRNA encoded by MGC20785, corresponding to a target binding site such as BINDING SITE I, BINDING SITE II or BINDING SITE III of FIG. 8. Table 4 illustrates the complementarity of the nucleotide sequences of MGC20785 BINDING SITE, designated SEQ ID:14606, to the nucleotide sequence of GAM175 RNA, herein designated GAM RNA, also designated SEQ ID:265.

Another function of GAM175 is therefore inhibition of MGC20785 (Accession NP_689934.1). Accordingly, utilities of GAM175 include diagnosis, prevention and treatment of diseases and clinical conditions associated with MGC20785.

MGC22014 (Accession XP_035307.1) is another GAM175 target gene, herein designated TARGET GENE. MGC22014 BINDING SITE is a target binding site found in the 3' untranslated region of mRNA encoded by MGC22014, corresponding to a target binding site such as BINDING SITE I, BINDING SITE II or BINDING SITE III of FIG. 8. Table 4 illustrates the complementarity of the nucleotide sequences of MGC22014 BINDING SITE, designated SEQ ID:6173, to the nucleotide sequence of GAM175 RNA, herein designated GAM RNA, also designated SEQ ID:265.

Another function of GAM175 is therefore inhibition of MGC22014 (Accession XP_035307.1). Accordingly, utilities of GAM175 include diagnosis, prevention and treatment of diseases and clinical conditions associated with MGC22014.

MGC23908 (Accession XP_038290.2) is another GAM175 target gene, herein designated TARGET GENE. MGC23908 BINDING SITE is a target binding site found in the 3' untranslated region of mRNA encoded by MGC23908, corresponding to a target binding site such as BINDING SITE I, BINDING SITE II or BINDING SITE III of FIG. 8. Table 4 illustrates the complementarity of the nucleotide sequences of MGC23908 BINDING SITE, designated SEQ ID:2079, to the nucleotide sequence of GAM175 RNA, herein designated GAM RNA, also designated SEQ ID:265.

Another function of GAM175 is therefore inhibition of MGC23908 (Accession XP_038290.2). Accordingly, utilities of GAM175 include diagnosis, prevention and treatment of diseases and clinical conditions associated with MGC23908.

MGC2848 (Accession NP_116306.1) is another GAM175 target gene, herein designated TARGET GENE. MGC2848 BINDING SITE is a target binding site found in the 3' untranslated region of mRNA encoded by MGC2848, corresponding to a target binding site such as BINDING SITE I, BINDING SITE II or BINDING SITE III of FIG. 8. Table 4 illustrates the complementarity of the nucleotide sequences of MGC2848 BINDING SITE, designated SEQ ID:12200, to the nucleotide sequence of GAM175 RNA, herein designated GAM RNA, also designated SEQ ID:265.

Another function of GAM175 is therefore inhibition of MGC2848 (Accession NP_116306.1). Accordingly, utilities of GAM175 include diagnosis, prevention and treatment of diseases and clinical conditions associated with MGC2848.

MGC33971 (Accession NP_699174.1) is another GAM175 target gene, herein designated TARGET GENE. MGC33971 BINDING SITE is a target binding site found in the 3' untranslated region of mRNA encoded by MGC33971, corresponding to a target binding site such as BINDING SITE I, BINDING SITE II or BINDING SITE III of FIG. 8. Table 4 illustrates the complementarity of the nucleotide sequences of MGC33971 BINDING SITE, designated SEQ ID:10456, to the nucleotide sequence of GAM175 RNA, herein designated GAM RNA, also designated SEQ ID:265.

Another function of GAM175 is therefore inhibition of MGC33971 (Accession NP_699174.1). Accordingly, utilities of GAM175 include diagnosis, prevention and treatment of diseases and clinical conditions associated with MGC33971.

MGC34728 (Accession NP_689746.1) is another GAM175 target gene, herein designated TARGET GENE. MGC34728 BINDING SITE is a target binding site found in the 5' untranslated region of mRNA encoded by MGC34728, corresponding to a target binding site such as BINDING SITE I, BINDING SITE II or BINDING SITE III of FIG. 8. Table 4 illustrates the complementarity of the nucleotide sequences of MGC34728 BINDING SITE, designated SEQ ID:14010, to the nucleotide sequence of GAM175 RNA, herein designated GAM RNA, also designated SEQ ID:265.

Another function of GAM175 is therefore inhibition of MGC34728 (Accession NP_689746.1). Accordingly, utilities of GAM175 include diagnosis, prevention and treatment of diseases and clinical conditions associated with MGC34728.

MGC39320 (Accession NP_689642.2) is another GAM175 target gene, herein designated TARGET GENE. MGC39320 BINDING SITE is a target binding site found in the 3' untranslated region of mRNA encoded by MGC39320, corresponding to a target binding site such as BINDING SITE I, BINDING SITE II or BINDING SITE III of FIG. 8. Table 4 illustrates the complementarity of the nucleotide sequences of MGC39320 BINDING SITE, designated SEQ ID:18878, to the nucleotide sequence of GAM175 RNA, herein designated GAM RNA, also designated SEQ ID:265.

Another function of GAM175 is therefore inhibition of MGC39320 (Accession NP_689642.2). Accordingly, utilities of GAM175 include diagnosis, prevention and treatment of diseases and clinical conditions associated with MGC39320.

MGC40053 (Accession NP_689796.1) is another GAM175 target gene, herein designated TARGET GENE. MGC40053 BINDING SITE is a target binding site found in the 3' untranslated region of mRNA encoded by MGC40053, corresponding to a target binding site such as BINDING SITE I, BINDING SITE II or BINDING SITE III of FIG. 8. Table 4 illustrates the complementarity of the nucleotide sequences of MGC40053 BINDING SITE, designated SEQ ID:1339, to the nucleotide sequence of GAM175 RNA, herein designated GAM RNA, also designated SEQ ID:265.

Another function of GAM175 is therefore inhibition of MGC40053 (Accession NP_689796.1). Accordingly, utilities of GAM175 include diagnosis, prevention and treatment of diseases and clinical conditions associated with MGC40053.

MGC4368 (Accession NP_078786.2) is another GAM175 target gene, herein designated TARGET GENE. MGC4368 BINDING SITE is a target binding site found in the 3' untranslated region of mRNA encoded by MGC4368, corresponding to a target binding site such as BINDING SITE I, BINDING SITE II or BINDING SITE III of FIG. 8. Table 4 illustrates the complementarity of the nucleotide sequences of MGC4368 BINDING SITE, designated SEQ ID:5575, to the nucleotide sequence of GAM175 RNA, herein designated GAM RNA, also designated SEQ ID:265.

Another function of GAM175 is therefore inhibition of MGC4368 (Accession NP_078786.2). Accordingly, utilities of GAM175 include diagnosis, prevention and treatment of diseases and clinical conditions associated with MGC4368.

MIG-6 (Accession NP_061821.1) is another GAM175 target gene, herein designated TARGET GENE. MIG-6 BINDING SITE is a target binding site found in the 3' untranslated region of mRNA encoded by MIG-6, corresponding to a target binding site such as BINDING SITE I, BINDING SITE II or BINDING SITE III of FIG. 8. Table 4 illustrates the complementarity of the nucleotide sequences of MIG-6 BINDING SITE, designated SEQ ID:11440, to the nucleotide sequence of GAM175 RNA, herein designated GAM RNA, also designated SEQ ID:265.

Another function of GAM175 is therefore inhibition of MIG-6 (Accession NP_061821.1). Accordingly, utilities of GAM175 include diagnosis, prevention and treatment of diseases and clinical conditions associated with MIG-6.

Mitochondrial ribosomal protein s12 (MRPS12, Accession NP_066930.1) is another GAM175 target gene, herein designated TARGET GENE. MRPS12 BINDING SITE is a target binding site found in the 3' untranslated region of multiple transcripts of mRNA encoded by MRPS12, corresponding to a target binding site such as BINDING SITE I, BINDING SITE II or BINDING SITE III of FIG. 8. Table 4 illustrates the complementarity of the nucleotide sequences of MRPS12 BINDING SITE, designated SEQ ID:18531, to the nucleotide sequence of GAM175 RNA, herein designated GAM RNA, also designated SEQ ID:265.

Another function of GAM175 is therefore inhibition of Mitochondrial ribosomal protein s12 (MRPS12, Accession NP_066930.1), a gene which is a component of the mitochondrial ribosome. Accordingly, utilities of GAM175 include diagnosis, prevention and treatment of diseases and clinical conditions associated with MRPS12.

The function of MRPS12 and its association with various diseases and clinical conditions, has been established by previous studies, as described hereinabove with reference to GAM96.1. Mitochondrial ribosomal protein s12 (MRPS12, Accession NP_203527.1) is another GAM175 target gene, herein designated TARGET GENE. MRPS12 BINDING SITE is a target binding site found in the 3' untranslated region of multiple transcripts of mRNA encoded by MRPS12, corresponding to a target binding site such as BINDING SITE I, BINDING SITE II or BINDING SITE III of FIG. 8. Table 4 illustrates the complementarity of the nucleotide sequences of MRPS12 BINDING SITE, designated SEQ ID:18531, to the nucleotide sequence of GAM175 RNA, herein designated GAM RNA, also designated SEQ ID:265.

Another function of GAM175 is therefore inhibition of Mitochondrial ribosomal protein s12 (MRPS12, Accession NP_203527.1), a gene which is a component of the mitochondrial ribosome. Accordingly, utilities of GAM175 include diagnosis, prevention and treatment of diseases and clinical conditions associated with MRPS12.

The function of MRPS12 and its association with various diseases and clinical conditions, has been established by previous studies, as described hereinabove with reference to GAM96.1. Mitochondrial ribosomal protein s12 (MRPS12, Accession NP_203526.1) is another GAM175 target gene, herein designated TARGET GENE. MRPS12 BINDING SITE is a target binding site found in the 3' untranslated region of multiple transcripts of mRNA encoded by MRPS12, corresponding to a target binding site such as BINDING SITE I, BINDING SITE II or BINDING SITE III of FIG. 8. Table 4 illustrates the complementarity of the nucleotide sequences of MRPS12 BINDING SITE, designated SEQ ID:18531, to the nucleotide sequence of GAM175 RNA, herein designated GAM RNA, also designated SEQ ID:265.

Another function of GAM175 is therefore inhibition of Mitochondrial ribosomal protein s12 (MRPS12, Accession NP_203526.1), a gene which is a component of the mitochondrial ribosome. Accordingly, utilities of GAM175 include diagnosis, prevention and treatment of diseases and clinical conditions associated with MRPS12.

The function of MRPS12 and its association with various diseases and clinical conditions, has been established by previous studies, as described hereinabove with reference to GAM96.1. MTA3 (Accession XP_038567.5) is another GAM175 target gene, herein designated TARGET GENE. MTA3 BINDING SITE is a target binding site found in the 3' untranslated region of mRNA encoded by MTA3, corresponding to a target binding site such as BINDING SITE I, BINDING SITE II or BINDING SITE III of FIG. 8. Table 4 illustrates the complementarity of the nucleotide sequences of MTA3 BINDING SITE, designated SEQ ID:5772, to the nucleotide sequence of GAM175 RNA, herein designated GAM RNA, also designated SEQ ID:265.

Another function of GAM175 is therefore inhibition of MTA3 (Accession XP_038567.5). Accordingly, utilities of GAM175 include diagnosis, prevention and treatment of diseases and clinical conditions associated with MTA3.

MUM-1 (Accession XP_300238.1) is another GAM175 target gene, herein designated TARGET GENE. MUM-1 BINDING SITE is a target binding site found in the 5' untranslated region of multiple transcripts of mRNA encoded by MUM-1, corresponding to a target binding site such as BINDING SITE I, BINDING SITE II or BINDING SITE III of FIG. 8. Table 4 illustrates the complementarity of the nucleotide sequences of MUM-1 BINDING SITE, designated SEQ ID:17769, to the nucleotide sequence of GAM175 RNA, herein designated GAM RNA, also designated SEQ ID:265.

Another function of GAM175 is therefore inhibition of MUM-1 (Accession XP_300238.1). Accordingly, utilities of GAM175 include diagnosis, prevention and treatment of diseases and clinical conditions associated with MUM-1.

Max interacting protein 1 (MXI1, Accession NP_569157.1) is another GAM175 target gene, herein designated TARGET GENE. MXI1 BINDING SITE is a target binding site found in the 3' untranslated region of multiple transcripts of mRNA encoded by MXI1, corresponding to a target binding site such as BINDING SITE I, BINDING SITE II or BINDING SITE III of FIG. 8. Table 4 illustrates the complementarity of the nucleotide sequences of MXI1

BINDING SITE, designated SEQ ID:14939, to the nucleotide sequence of GAM175 RNA, herein designated GAM RNA, also designated SEQ ID:265.

Another function of GAM175 is therefore inhibition of Max interacting protein 1 (MXI1, Accession NP_569157.1), a gene which acts as a tumor suppressor in vivo, engages the MYC network in a functionally relevant manner and therefore may be associated with Prostate cancer, neurofibrosarcoma. Accordingly, utilities of GAM175 include diagnosis, prevention and treatment of Prostate cancer, neurofibrosarcoma, and of other diseases and clinical conditions associated with MXI1.

The function of MXI1 and its association with various diseases and clinical conditions, has been established by previous studies, as described hereinabove with reference to GAM94.1. Max interacting protein 1 (MXI1, Accession NP_005953.2) is another GAM175 target gene, herein designated TARGET GENE. MXI1 BINDING SITE is a target binding site found in the 3' untranslated region of multiple transcripts of mRNA encoded by MXI1, corresponding to a target binding site such as BINDING SITE I, BINDING SITE II or BINDING SITE III of FIG. 8. Table 4 illustrates the complementarity of the nucleotide sequences of MXI1 BINDING SITE, designated SEQ ID:14939, to the nucleotide sequence of GAM175 RNA, herein designated GAM RNA, also designated SEQ ID:265.

Another function of GAM175 is therefore inhibition of Max interacting protein 1 (MXI1, Accession NP_005953.2), a gene which acts as a tumor suppressor in vivo, engages the MYC network in a functionally relevant manner and therefore may be associated with Prostate cancer, neurofibrosarcoma. Accordingly, utilities of GAM175 include diagnosis, prevention and treatment of Prostate cancer, neurofibrosarcoma, and of other diseases and clinical conditions associated with MXI1.

The function of MXI1 and its association with various diseases and clinical conditions, has been established by previous studies, as described hereinabove with reference to GAM94.1. N4BP3 (Accession XP_038920.2) is another GAM175 target gene, herein designated TARGET GENE. N4BP3 BINDING SITE is a target binding site found in the 3' untranslated region of mRNA encoded by N4BP3, corresponding to a target binding site such as BINDING SITE I, BINDING SITE II or BINDING SITE III of FIG. 8. Table 4 illustrates the complementarity of the nucleotide sequences of N4BP3 BINDING SITE, designated SEQ ID:18724, to the nucleotide sequence of GAM175 RNA, herein designated GAM RNA, also designated SEQ ID:265.

Another function of GAM175 is therefore inhibition of N4BP3 (Accession XP_038920.2). Accordingly, utilities of GAM175 include diagnosis, prevention and treatment of diseases and clinical conditions associated with N4BP3.

Nucleosome assembly protein 1-like 1 (NAP1L1, Accession NP_631946.1) is another GAM175 target gene, herein designated TARGET GENE. NAP1L1 BINDING SITE is a target binding site found in the 3' untranslated region of multiple transcripts of mRNA encoded by NAP1L1, corresponding to a target binding site such as BINDING SITE I, BINDING SITE II or BINDING SITE III of FIG. 8. Table 4 illustrates the complementarity of the nucleotide sequences of NAP1L1 BINDING SITE, designated SEQ ID:12445, to the nucleotide sequence of GAM175 RNA, herein designated GAM RNA, also designated SEQ ID:265.

Another function of GAM175 is therefore inhibition of Nucleosome assembly protein 1-like 1 (NAP1L1, Accession NP_631946.1). Accordingly, utilities of GAM175 include diagnosis, prevention and treatment of diseases and clinical conditions associated with NAP1L1.

Nucleosome assembly protein 1-like 1 (NAP1L1, Accession NP_004528.1) is another GAM175 target gene, herein designated TARGET GENE. NAP1L1 BINDING SITE is a target binding site found in the 3' untranslated region of multiple transcripts of mRNA encoded by NAP1L1, corresponding to a target binding site such as BINDING SITE I, BINDING SITE II or BINDING SITE III of FIG. 8. Table 4 illustrates the complementarity of the nucleotide sequences of NAP1L1 BINDING SITE, designated SEQ ID:12445, to the nucleotide sequence of GAM175 RNA, herein designated GAM RNA, also designated SEQ ID:265.

Another function of GAM175 is therefore inhibition of Nucleosome assembly protein 1-like 1 (NAP1L1, Accession NP_004528.1). Accordingly, utilities of GAM175 include diagnosis, prevention and treatment of diseases and clinical conditions associated with NAP1L1.

NCE2 (Accession NP_057594.2) is another GAM175 target gene, herein designated TARGET GENE. NCE2 BINDING SITE is a target binding site found in the 3' untranslated region of multiple transcripts of mRNA encoded by NCE2, corresponding to a target binding site such as BINDING SITE I, BINDING SITE II or BINDING SITE III of FIG. 8. Table 4 illustrates the complementarity of the nucleotide sequences of NCE2 BINDING SITE, designated SEQ ID:5057, to the nucleotide sequence of GAM175 RNA, herein designated GAM RNA, also designated SEQ ID:265.

Another function of GAM175 is therefore inhibition of NCE2 (Accession NP_057594.2). Accordingly, utilities of GAM175 include diagnosis, prevention and treatment of diseases and clinical conditions associated with NCE2.

N-myc downstream regulated gene 1 (NDRG1, Accession NP_006087.1) is another GAM175 target gene, herein designated TARGET GENE. NDRG1 BINDING SITE is a target binding site found in the 3' untranslated region of mRNA encoded by NDRG1, corresponding to a target binding site such as BINDING SITE I, BINDING SITE II or BINDING SITE III of FIG. 8. Table 4 illustrates the complementarity of the nucleotide sequences of NDRG1 BINDING SITE, designated SEQ ID:5659, to the nucleotide sequence of GAM175 RNA, herein designated GAM RNA, also designated SEQ ID:265.

Another function of GAM175 is therefore inhibition of N-myc downstream regulated gene 1 (NDRG1, Accession NP_006087.1), a gene which may have a growth inhibitory role. and therefore may be associated with Hereditary motor and sensory neuropathy, lom type. Accordingly, utilities of GAM175 include diagnosis, prevention and treatment of Hereditary motor and sensory neuropathy, lom type, and of other diseases and clinical conditions associated with NDRG1.

The function of NDRG1 and its association with various diseases and clinical conditions, has been established by previous studies, as described hereinabove with reference to GAM47.1. NUPL1 (Accession NP_055593.1) is another GAM175 target gene, herein designated TARGET GENE. NUPL1 BINDING SITE is a target binding site found in the 5' untranslated region of multiple transcripts of mRNA encoded by NUPL1, corresponding to a target binding site such as BINDING SITE I, BINDING SITE II or BINDING SITE III of FIG. 8. Table 4 illustrates the complementarity of the nucleotide sequences of NUPL1 BINDING SITE, designated SEQ ID:14772, to the nucleotide sequence of GAM175 RNA, herein designated GAM RNA, also designated SEQ ID:265.

Another function of GAM175 is therefore inhibition of NUPL1 (Accession NP_055593.1). Accordingly, utilities of GAM175 include diagnosis, prevention and treatment of diseases and clinical conditions associated with NUPL1.

NUPL1 (Accession NP_054808.1) is another GAM175 target gene, herein designated TARGET GENE. NUPL1 BINDING SITE is a target binding site found in the 5' untranslated region of multiple transcripts of mRNA encoded by NUPL1, corresponding to a target binding site such as BINDING SITE I, BINDING SITE II or BINDING SITE III of FIG. 8. Table 4 illustrates the complementarity of the nucleotide sequences of NUPL1 BINDING SITE, designated SEQ ID:14772, to the nucleotide sequence of GAM175 RNA, herein designated GAM RNA, also designated SEQ ID:265.

Another function of GAM175 is therefore inhibition of NUPL1 (Accession NP_054808.1). Accordingly, utilities of GAM175 include diagnosis, prevention and treatment of diseases and clinical conditions associated with NUPL1.

Nuclear transport factor 2-like export factor 2 (NXT2, Accession NP_061168.2) is another GAM175 target gene, herein designated TARGET GENE. NXT2 BINDING SITE1 and NXT2 BINDING SITE2 are target binding sites found in untranslated regions of mRNA encoded by NXT2, corresponding to target binding sites such as BINDING SITE I, BINDING SITE II or BINDING SITE III of FIG. 8. Table 4 illustrates the complementarity of the nucleotide sequences of NXT2 BINDING SITE1 and NXT2 BINDING SITE2, designated SEQ ID:9223 and SEQ ID:5917 respectively, to the nucleotide sequence of GAM175 RNA, herein designated GAM RNA, also designated SEQ ID:265.

Another function of GAM175 is therefore inhibition of Nuclear transport factor 2-like export factor 2 (NXT2, Accession NP_061168.2). Accordingly, utilities of GAM175 include diagnosis, prevention and treatment of diseases and clinical conditions associated with NXT2.

Pas domain containing serine/threonine kinase (PASK, Accession NP_055963.1) is another GAM175 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:7891, to the nucleotide sequence of GAM175 RNA, herein designated GAM RNA, also designated SEQ ID:265.

Another function of GAM175 is therefore inhibition of Pas domain containing serine/threonine kinase (PASK, Accession NP_055963.1). Accordingly, utilities of GAM175 include diagnosis, prevention and treatment of diseases and clinical conditions associated with PASK.

Phosphodiesterase 11a (PDE11A, Accession NP_058649.2) is another GAM175 target gene, herein designated TARGET GENE. PDE11A BINDING SITE is a target binding site found in the 3' untranslated region of mRNA encoded by PDE11A, corresponding to a target binding site such as BINDING SITE I, BINDING SITE II or BINDING SITE III of FIG. 8. Table 4 illustrates the complementarity of the nucleotide sequences of PDE11A BINDING SITE, designated SEQ ID:16840, to the nucleotide sequence of GAM175 RNA, herein designated GAM RNA, also designated SEQ ID:265.

Another function of GAM175 is therefore inhibition of Phosphodiesterase 11a (PDE11A, Accession NP_058649.2). Accordingly, utilities of GAM175 include diagnosis, prevention and treatment of diseases and clinical conditions associated with PDE11A.

Period homolog 3 (drosophila) (PER3, Accession NP_058515.1) is another GAM175 target gene, herein designated TARGET GENE. PER3 BINDING SITE1 and PER3 BINDING SITE2 are target binding sites found in untranslated regions of mRNA encoded by PER3, corresponding to target binding sites such as BINDING SITE I, BINDING SITE II or BINDING SITE III of FIG. 8. Table 4 illustrates the complementarity of the nucleotide sequences of PER3 BINDING SITE1 and PER3 BINDING SITE2, designated SEQ ID:2006 and SEQ ID:3046 respectively, to the nucleotide sequence of GAM175 RNA, herein designated GAM RNA, also designated SEQ ID:265.

Another function of GAM175 is therefore inhibition of Period homolog 3 (drosophila) (PER3, Accession NP_058515.1). Accordingly, utilities of GAM175 include diagnosis, prevention and treatment of diseases and clinical conditions associated with PER3.

Phospholipase a2, group iii (PLA2G3, Accession NP_056530.1) is another GAM175 target gene, herein designated TARGET GENE. PLA2G3 BINDING SITE is a target binding site found in the 3' untranslated region of mRNA encoded by PLA2G3, corresponding to a target binding site such as BINDING SITE I, BINDING SITE II or BINDING SITE III of FIG. 8. Table 4 illustrates the complementarity of the nucleotide sequences of PLA2G3 BINDING SITE, designated SEQ ID:14052, to the nucleotide sequence of GAM175 RNA, herein designated GAM RNA, also designated SEQ ID:265.

Another function of GAM175 is therefore inhibition of Phospholipase a2, group iii (PLA2G3, Accession NP_056530.1). Accordingly, utilities of GAM175 include diagnosis, prevention and treatment of diseases and clinical conditions associated with PLA2G3.

Paired mesoderm homeo box 1 (PMX1, Accession NP_073207.1) is another GAM175 target gene, herein designated TARGET GENE. PMX1 BINDING SITE is a target binding site found in the 5' untranslated region of multiple transcripts of mRNA encoded by PMX1, corresponding to a target binding site such as BINDING SITE I, BINDING SITE II or BINDING SITE III of FIG. 8. Table 4 illustrates the complementarity of the nucleotide sequences of PMX1 BINDING SITE, designated SEQ ID:10080, to the nucleotide sequence of GAM175 RNA, herein designated GAM RNA, also designated SEQ ID:265.

Another function of GAM175 is therefore inhibition of Paired mesoderm homeo box 1 (PMX1, Accession NP_073207.1), a gene which acts as a transcriptional regulator of muscle creatine kinase. Accordingly, utilities of GAM175 include diagnosis, prevention and treatment of diseases and clinical conditions associated with PMX1.

The function of PMX1 and its association with various diseases and clinical conditions, has been established by previous studies, as described hereinabove with reference to GAM96.1. Paired mesoderm homeo box 1 (PMX1, Accession NP_008833.1) is another GAM175 target gene, herein designated TARGET GENE. PMX1 BINDING SITE is a target binding site found in the 5' untranslated region of multiple transcripts of mRNA encoded by PMX1, corresponding to a target binding site such as BINDING SITE I, BINDING SITE II or BINDING SITE III of FIG. 8. Table 4 illustrates the complementarity of the nucleotide sequences of PMX1 BINDING SITE, designated SEQ ID:10080, to the nucleotide sequence of GAM175 RNA, herein designated GAM RNA, also designated SEQ ID:265.

Another function of GAM175 is therefore inhibition of Paired mesoderm homeo box 1 (PMX1, Accession NP_008833.1), a gene which acts as a transcriptional regulator of muscle creatine kinase. Accordingly, utilities of GAM175 include diagnosis, prevention and treatment of diseases and clinical conditions associated with PMX1.

The function of PMX1 and its association with various diseases and clinical conditions, has been established by previous studies, as described hereinabove with reference to GAM96.1. Polymerase (dna directed), eta (POLH, Accession NP_006493.1) is another GAM175 target gene, herein designated TARGET GENE. POLH BINDING SITE is a target binding site found in the 3' untranslated region of mRNA encoded by POLH, corresponding to a target binding site such as BINDING SITE I, BINDING SITE II or BINDING SITE III of FIG. 8. Table 4 illustrates the complementarity of the nucleotide sequences of POLH BINDING SITE, designated SEQ ID:9909, to the nucleotide sequence of GAM175 RNA, herein designated GAM RNA, also designated SEQ ID:265.

Another function of GAM175 is therefore inhibition of Polymerase (dna directed), eta (POLH, Accession NP_006493.1). Accordingly, utilities of GAM175 include diagnosis, prevention and treatment of diseases and clinical conditions associated with POLH.

Ppar binding protein (PPARBP, Accession NP_004765.2) is another GAM175 target gene, herein designated TARGET GENE. PPARBP BINDING SITE is a target binding site found in the 3' untranslated region of mRNA encoded by PPARBP, corresponding to a target binding site such as BINDING SITE I, BINDING SITE II or BINDING SITE III of FIG. 8. Table 4 illustrates the complementarity of the nucleotide sequences of PPARBP BINDING SITE, designated SEQ ID:18113, to the nucleotide sequence of GAM175 RNA, herein designated GAM RNA, also designated SEQ ID:265.

Another function of GAM175 is therefore inhibition of Ppar binding protein (PPARBP, Accession NP_004765.2), a gene which interacts with thyroid hormone receptors to regulate nuclear receptor-mediated transcription; binds dna and p53 protein. and therefore may be associated with Breast cancer. Accordingly, utilities of GAM175 include diagnosis, prevention and treatment of Breast cancer, and of other diseases and clinical conditions associated with PPARBP.

The function of PPARBP has been established by previous studies. By immunoscreening a human B-lymphoma cell cDNA expression library with the anti-p53 (see OMIM Ref. No. TP53; 191170) monoclonal antibody PAb1801, Drane et al. (1997) identified PPARBP, which they called RB18A for 'recognized by PAb1801 monoclonal antibody.' The predicted 1,566-amino acid RB18A protein contains several potential nuclear localization signals, 13 potential N-glycosylation sites, and a high number of potential phosphorylation sites. Despite sharing common antigenic determinants with p53, RB18A does not show significant nucleotide or amino acid sequence similarity with p53. Whereas the calculated molecular mass of RB18A is 166 kD, the apparent mass of recombinant RB18A was 205 kD by SDS-PAGE analysis. Drane et al. (1997) demonstrated that RB18A shares functional properties with p53, including DNA binding, p53 binding, and self-oligomerization. Furthermore, RB18A was able to activate the sequence-specific binding of p53 to DNA, which was induced through an unstable interaction between both proteins. Northern blot analysis of human tissues detected an 8.5-kb RB18A transcript in all tissues examined except kidney, with highest expression in heart.

Animal model experiments lend further support to the function of PPARBP. Ito et al. (2000) generated mouse mutants with targeted disruption of the Trap220 gene. The null mutants died during an early gestational stage with heart failure and exhibited impaired neuronal development with extensive apoptosis. Primary embryonic fibroblasts derived from null mutants showed impaired cell cycle regulation and a prominent decrease of thyroid hormone receptor (see OMIM Ref. No. 190160) function that was restored by ectopic Trap220; no defect in activation by Gal4-RARA, Gal4-RXRA, p53, or Gal4-VP16 (see OMIM Ref. No. 300019) was detected. Haploinsufficient mice showed growth retardation, pituitary hypothyroidism, and widely impaired transcription in certain organs. The results indicated that TRAP220 is essential for a wide range of physiologic processes and that it also has gene- and activator-selective functions.

It is appreciated that the abovementioned animal model for PPARBP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Drane, P.; Barel, M.; Balbo, M.; Frade, R.: Identification of RB18A, a 205 kDa new p53 regulatory protein which shares antigenic and functional properties with p53. Oncogene 15:3013-3024, 1997; and Ito, M.; Yuan, C.-X.; Okano, H. J.; Darnell, R. B.; Roeder, R. G.: Involvement of the TRAP220 component of the TRAP/SMCC coactivator complex in embryonic development and thyroid hormone.

Further studies establishing the function and utilities of PPARBP are found in John Hopkins OMIM database record ID 604311, and in cited publications listed in Table 5, which are hereby incorporated by reference. Peptidylprolyl isomerase (cyclophilin)-like 2 (PPIL2, Accession NP_055152.1) is another GAM175 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:19201, to the nucleotide sequence of GAM175 RNA, herein designated GAM RNA, also designated SEQ ID:265.

Another function of GAM175 is therefore inhibition of Peptidylprolyl isomerase (cyclophilin)-like 2 (PPIL2, Accession NP_055152.1). Accordingly, utilities of GAM175 include diagnosis, prevention and treatment of diseases and clinical conditions associated with PPIL2.

Phosphatase and tensin homolog (mutated in multiple advanced cancers 1) (PTEN, Accession NP_000305.1) is another GAM175 target gene, herein designated TARGET GENE. PTEN BINDING SITE is a target binding site found in the 3' untranslated region of mRNA encoded by PTEN, corresponding to a target binding site such as BINDING SITE I, BINDING SITE II or BINDING SITE III of FIG. 8. Table 4 illustrates the complementarity of the nucleotide sequences of PTEN BINDING SITE, designated SEQ ID:17273, to the nucleotide sequence of GAM175 RNA, herein designated GAM RNA, also designated SEQ ID:265.

Another function of GAM175 is therefore inhibition of Phosphatase and tensin homolog (mutated in multiple advanced cancers 1) (PTEN, Accession NP_000305.1). Accordingly, utilities of GAM175 include diagnosis, prevention and treatment of diseases and clinical conditions associated with PTEN.

Prostaglandin e synthase 2 (PTGES2, Accession NP_079348.1) is another GAM175 target gene, herein designated TARGET GENE. PTGES2 BINDING SITE is a target binding site found in the 3' untranslated region of mRNA encoded by PTGES2, corresponding to a target binding site such as BINDING SITE I, BINDING SITE II or BINDING SITE III of FIG. 8. Table 4 illustrates the complementarity of the nucleotide sequences of PTGES2 BINDING SITE, designated SEQ ID:10220, to the nucleotide sequence of GAM175 RNA, herein designated GAM RNA, also designated SEQ ID:265.

Another function of GAM175 is therefore inhibition of Prostaglandin e synthase 2 (PTGES2, Accession NP_079348.1). Accordingly, utilities of GAM175 include diagnosis, prevention and treatment of diseases and clinical conditions associated with PTGES2.

RAB11-FIP4 (Accession NP_116321.2) is another GAM175 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:12040, to the nucleotide sequence of GAM175 RNA, herein designated GAM RNA, also designated SEQ ID:265.

Another function of GAM175 is therefore inhibition of RAB11-FIP4 (Accession NP_116321.2). Accordingly, utilities of GAM175 include diagnosis, prevention and treatment of diseases and clinical conditions associated with RAB11-FIP4.

Retinoic acid induced 17 (RAI17, Accession NP_065071.1) is another GAM175 target gene, herein designated TARGET GENE. RAI17 BINDING SITE is a target binding site found in the 3' untranslated region of multiple transcripts of mRNA encoded by RAI17, corresponding to a target binding site such as BINDING SITE I, BINDING SITE II or BINDING SITE III of FIG. 8. Table 4 illustrates the complementarity of the nucleotide sequences of RAI17 BINDING SITE, designated SEQ ID:9293, to the nucleotide sequence of GAM175 RNA, herein designated GAM RNA, also designated SEQ ID:265.

Another function of GAM175 is therefore inhibition of Retinoic acid induced 17 (RAI17, Accession NP_065071.1). Accordingly, utilities of GAM175 include diagnosis, prevention and treatment of diseases and clinical conditions associated with RAI17.

Ribonuclease, rnase a family, k6 (RNASE6, Accession NP_005606.1) is another GAM175 target gene, herein designated TARGET GENE. RNASE6 BINDING SITE is a target binding site found in the 5' untranslated region of mRNA encoded by RNASE6, corresponding to a target binding site such as BINDING SITE I, BINDING SITE II or BINDING SITE III of FIG. 8. Table 4 illustrates the complementarity of the nucleotide sequences of RNASE6 BINDING SITE, designated SEQ ID:15669, to the nucleotide sequence of GAM175 RNA, herein designated GAM RNA, also designated SEQ ID:265.

Another function of GAM175 is therefore inhibition of Ribonuclease, rnase a family, k6 (RNASE6, Accession NP_005606.1). Accordingly, utilities of GAM175 include diagnosis, prevention and treatment of diseases and clinical conditions associated with RNASE6.

Ribosomal protein s6 kinase, 90 kda, polypeptide 2 (RPS6KA2, Accession NP_066958.2) is another GAM175 target gene, herein designated TARGET GENE. RPS6KA2 BINDING SITE is a target binding site found in the 3' untranslated region of mRNA encoded by RPS6KA2, corresponding to a target binding site such as BINDING SITE I, BINDING SITE II or BINDING SITE III of FIG. 8. Table 4 illustrates the complementarity of the nucleotide sequences of RPS6KA2 BINDING SITE, designated SEQ ID:4835, to the nucleotide sequence of GAM175 RNA, herein designated GAM RNA, also designated SEQ ID:265.

Another function of GAM175 is therefore inhibition of Ribosomal protein s6 kinase, 90 kda, polypeptide 2 (RPS6KA2, Accession NP_066958.2), a gene which phosphorylates a wide range of substrates including ribosomal protein s6. Accordingly, utilities of GAM175 include diagnosis, prevention and treatment of diseases and clinical conditions associated with RPS6KA2.

The function of RPS6KA2 has been established by previous studies. Serine/threonine protein kinases in the ribosomal S6 kinase (RSK) family have been implicated as signaling intermediates in the cellular response to several growth factors. Moller et al. (1994) described the cloning and characterization of 3 genes encoding 3 isoforms of ribosomal protein S6 kinase, which they called HU1 (RPS6KA1; 601684), HU2 (RPS6KA2), and HU3 (RPS6KA3; 300075). The partial HU2 cDNA (GenBank L07598) encodes a predicted protein containing 2 distinct consensus ATP-binding site sequences. Northern blot and RNase protection analyses detected major 7.5-kb and minor 3.5-kb HU2 transcripts in fibroblasts, skeletal muscle, lymphocytes, and placenta. Zhao et al. (1995) cloned a full-length cDNA encoding the RPS6KA2 isoform of ribosomal protein S6 kinase, which they designated RSK3. The deduced 733- amino acid RSK3 protein has 84% and 75% sequence identity with RSK2 (RPS6KA3) and RSK1 (RPS6KA1), respectively. RSK3 has a unique N-terminal sequence which contains a putative bipartite nuclear localization signal. Immunoblot analysis of human cell lysates detected an 83-kD RSK protein. The authors demonstrated serum-stimulated nuclear translocation of endogenous RSK3 in HeLa cells. RSK3 exhibited growth-stimulated autophosphorylation and kinase activity; however, its relative activity toward several known RSK substrates differed from the activities of other RSKs. Unlike RSK1, RSK3 was not activated by ERK2 (PRKM1; 176948) in vitro. Northern blot analysis detected a single 6.5-kb RSK3 transcript in all tissues examined, with the highest expression in lung and skeletal muscle.

Full details of the abovementioned studies are described in the following publications, the disclosure of which are hereby incorporated by reference:

Moller, D. E.; Xia, C. H.; Tang, W.; Zhu, A. X.; Jakubowski, M.: Human rsk isoforms: cloning and characterization of tissue-specific expression. Am. J. Physiol. 266: C351-C359, 1994; and Zhao, Y.; Bjorbaek, C.; Weremowicz, S.; Morton, C. C.; Moller, D. E.: RSK3 encodes a novel pp90rsk isoform with a unique N-terminal sequence: growth factor- stimulated kinase function and n.

Further studies establishing the function and utilities of RPS6KA2 are found in John Hopkins OMIM database record ID 601685, and in cited publications listed in Table 5, which are hereby incorporated by reference. Stearoyl-coa desaturase (delta-9-desaturase) (SCD, Accession NP_005054.2) is another GAM175 target gene, herein designated TARGET GENE. SCD BINDING SITE is a target binding site found in the 3' untranslated region of mRNA encoded by SCD, corresponding to a target binding site such as BINDING SITE I, BINDING SITE II or BINDING SITE III of FIG. 8. Table 4 illustrates the complementarity of the nucleotide sequences of SCD BINDING SITE, designated SEQ ID:15911, to the nucleotide sequence of GAM175 RNA, herein designated GAM RNA, also designated SEQ ID:265.

Another function of GAM175 is therefore inhibition of Stearoyl-coa desaturase (delta-9-desaturase) (SCD, Accession NP_005054.2), a gene which functions in the synthesis of unsaturated fatty acids. Accordingly, utilities of GAM175 include diagnosis, prevention and treatment of diseases and clinical conditions associated with SCD.

The function of SCD and its association with various diseases and clinical conditions, has been established by previous studies, as described hereinabove with reference to GAM144.1. Sidekick homolog 1 (chicken) (SDK1, Accession NP_689957.1) is another GAM175 target gene, herein designated TARGET GENE. SDK1 BINDING SITE is a target binding site found in the 3' untranslated region of mRNA encoded by SDK1, corresponding to a target binding site such as BINDING SITE I, BINDING SITE II or BINDING SITE III of FIG. 8. Table 4 illustrates the complementarity of the nucleotide sequences of SDK1 BINDING SITE, designated SEQ ID:6489, to the nucleotide sequence of GAM175 RNA, herein designated GAM RNA, also designated SEQ ID:265.

Another function of GAM175 is therefore inhibition of Sidekick homolog 1 (chicken) (SDK1, Accession NP_689957.1). Accordingly, utilities of GAM175 include diagnosis, prevention and treatment of diseases and clinical conditions associated with SDK1.

SEI1 (Accession NP_037508.1) is another GAM175 target gene, herein designated TARGET GENE. SEI1 BINDING SITE is a target binding site found in the 3' untranslated region of mRNA encoded by SEI1, corresponding to a target binding site such as BINDING SITE I, BINDING SITE II or BINDING SITE III of FIG. 8. Table 4 illustrates the complementarity of the nucleotide sequences of SEI1 BINDING SITE, designated SEQ ID:3289, to the nucleotide sequence of GAM175 RNA, herein designated GAM RNA, also designated SEQ ID:265.

Another function of GAM175 is therefore inhibition of SEI1 (Accession NP_037508.1). Accordingly, utilities of GAM175 include diagnosis, prevention and treatment of diseases and clinical conditions associated with SEI1.

Selenoprotein n, 1 (SEPN1, Accession NP_065184.1) is another GAM175 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:12396, to the nucleotide sequence of GAM175 RNA, herein designated GAM RNA, also designated SEQ ID:265.

Another function of GAM175 is therefore inhibition of Selenoprotein n, 1 (SEPN1, Accession NP_065184.1). Accordingly, utilities of GAM175 include diagnosis, prevention and treatment of diseases and clinical conditions associated with SEPN1.

SERP1 (Accession NP_055260.1) is another GAM175 target gene, herein designated TARGET GENE. SERP1 BINDING SITE is a target binding site found in the 3' untranslated region of mRNA encoded by SERP1, corresponding to a target binding site such as BINDING SITE I, BINDING SITE II or BINDING SITE III of FIG. 8. Table 4 illustrates the complementarity of the nucleotide sequences of SERP1 BINDING SITE, designated SEQ ID:14919, to the nucleotide sequence of GAM175 RNA, herein designated GAM RNA, also designated SEQ ID:265.

Another function of GAM175 is therefore inhibition of SERP1 (Accession NP_055260.1). Accordingly, utilities of GAM175 include diagnosis, prevention and treatment of diseases and clinical conditions associated with SERP1.

Sh3 domain binding glutamic acid-rich protein like 3 (SH3BGRL3, Accession NP_112576.1) is another GAM175 target gene, herein designated TARGET GENE. SH3BGRL3 BINDING SITE is a target binding site found in the 3' untranslated region of mRNA encoded by SH3BGRL3, corresponding to a target binding site such as BINDING SITE I, BINDING SITE II or BINDING SITE III of FIG. 8. Table 4 illustrates the complementarity of the nucleotide sequences of SH3BGRL3 BINDING SITE, designated SEQ ID:9406, to the nucleotide sequence of GAM175 RNA, herein designated GAM RNA, also designated SEQ ID:265.

Another function of GAM175 is therefore inhibition of Sh3 domain binding glutamic acid-rich protein like 3 (SH3BGRL3, Accession NP_112576.1). Accordingly, utilities of GAM175 include diagnosis, prevention and treatment of diseases and clinical conditions associated with SH3BGRL3.

Sh3 and multiple ankyrin repeat domains 3 (SHANK3, Accession XP_037493.1) is another GAM175 target gene, herein designated TARGET GENE. SHANK3 BINDING SITE is a target binding site found in the 3' untranslated region of mRNA encoded by SHANK3, corresponding to a target binding site such as BINDING SITE I, BINDING SITE II or BINDING SITE III of FIG. 8. Table 4 illustrates the complementarity of the nucleotide sequences of SHANK3 BINDING SITE, designated SEQ ID:2299, to the nucleotide sequence of GAM175 RNA, herein designated GAM RNA, also designated SEQ ID:265.

Another function of GAM175 is therefore inhibition of Sh3 and multiple ankyrin repeat domains 3 (SHANK3, Accession XP_037493.1). Accordingly, utilities of GAM175 include diagnosis, prevention and treatment of diseases and clinical conditions associated with SHANK3.

Solute carrier family 11 (proton-coupled divalent metal ion transporters), member 2 (SLC11A2, Accession NP_000608.1) is another GAM175 target gene, herein designated TARGET GENE. SLC11A2 BINDING SITE is a target binding site found in the 3' untranslated region of mRNA encoded by SLC11A2, corresponding to a target binding site such as BINDING SITE I, BINDING SITE II or BINDING SITE III of FIG. 8. Table 4 illustrates the complementarity of the nucleotide sequences of SLC11A2 BINDING SITE, designated SEQ ID:17770, to the nucleotide sequence of GAM175 RNA, herein designated GAM RNA, also designated SEQ ID:265.

Another function of GAM175 is therefore inhibition of Solute carrier family 11 (proton-coupled divalent metal ion transporters), member 2 (SLC11A2, Accession NP_000608.1). Accordingly, utilities of GAM175 include diagnosis, prevention and treatment of diseases and clinical conditions associated with SLC11A2.

Solute carrier family 16 (monocarboxylic acid transporters), member 6 (SLC16A6, Accession NP_004685.1) is another GAM175 target gene, herein designated TARGET GENE. SLC16A6 BINDING SITE is a target binding site found in the 5' untranslated region of mRNA encoded by SLC16A6, corresponding to a target binding site such as BINDING SITE I, BINDING SITE II or BINDING SITE III of FIG. 8. Table 4 illustrates the complementarity of the nucleotide sequences of SLC16A6 BINDING SITE, designated SEQ ID:12166, to the nucleotide sequence of GAM175 RNA, herein designated GAM RNA, also designated SEQ ID:265.

Another function of GAM175 is therefore inhibition of Solute carrier family 16 (monocarboxylic acid transporters), member 6 (SLC16A6, Accession NP_004685.1). Accordingly, utilities of GAM175 include diagnosis, prevention and treatment of diseases and clinical conditions associated with SLC16A6.

Solute carrier family 1 (glutamate/neutral amino acid transporter), member 4 (SLC1A4, Accession NP_003029.2) is another GAM175 target gene, herein designated TARGET GENE. SLC1A4 BINDING SITE is a target binding site found in the 3' untranslated region of mRNA encoded by SLC1A4, corresponding to a target binding site such as BINDING SITE I, BINDING SITE II or BINDING SITE III of FIG. 8. Table 4 illustrates the complementarity of the nucleotide sequences of SLC1A4 BINDING SITE, designated SEQ ID:15625, to the nucleotide sequence of GAM175 RNA, herein designated GAM RNA, also designated SEQ ID:265.

Another function of GAM175 is therefore inhibition of Solute carrier family 1 (glutamate/neutral amino acid transporter), member 4 (SLC1A4, Accession NP_003029.2), a gene which transports alanine, serine, cysteine, and threonine. exhibits sodium dependence. Accordingly, utilities of GAM175 include diagnosis, prevention and treatment of diseases and clinical conditions associated with SLC1A4.

The function of SLC1A4 has been established by previous studies. In a screening for cDNAs encoding proteins similar to the sodium-coupled glutamate transporter GLAST1, Hofmann et al. (1994) isolated a cDNA clone encoding a protein that turned out to be identical to the neutral amino acid transporter ASCT1 (Arriza et al., 1993; Shafqat et al., 1993). The new member of the GLAST-related transporter family did not transport glutamate or aspartate but alanine, serine, cysteine, and threonine instead. The open reading frame of 1,572 basepairs encodes 524 amino acid residues distributed over 8 exons spanning at least 40 kb of genomic DNA. The gene for ASCT1, designated SLC1A4, was assigned to 2p15-p13 by fluorescence in situ hybridization. The gene structure was not related to any previously characterized transporter gene. Zerangue and Kavanaugh (1996) found that the ASCT1 transporter functions primarily as an amino acid exchanger. Transport is associated with a chloride channel activity that is thermodynamically uncoupled from amino acid transport.

Full details of the abovementioned studies are described in the following publications, the disclosure of which are hereby incorporated by reference:

Arriza, J. L.; Kavanaugh, M. P.; Fairman, W. A.; Wu, Y.-N.; Murdoch, G. H.; North, R. A.; Amara, S. G.: Cloning and expression of a human neutral amino acid transporter with structural similarity to the glutamate transporter gene family. J. Biol. Chem. 268:15329-15332, 1993; and Zerangue, N.; Kavanaugh, M. P.: ASCT-1 is a neutral amino acid exchanger with chloride channel activity. J. Biol. Chem. 271:27991-27994, 1996.

Further studies establishing the function and utilities of SLC1A4 are found in John Hopkins OMIM database record ID 600229, and in cited publications listed in Table 5, which are hereby incorporated by reference. Solute carrier family 39 (zinc transporter), member 1 (SLC39A1, Accession NP_055252.2) is another GAM175 target gene, herein designated TARGET GENE. SLC39A1 BINDING SITE is a target binding site found in the 5' untranslated region of mRNA encoded by SLC39A1, corresponding to a target binding site such as BINDING SITE I, BINDING SITE II or BINDING SITE III of FIG. 8. Table 4 illustrates the complementarity of the nucleotide sequences of SLC39A1 BINDING SITE, designated SEQ ID:12020, to the nucleotide sequence of GAM175 RNA, herein designated GAM RNA, also designated SEQ ID:265.

Another function of GAM175 is therefore inhibition of Solute carrier family 39 (zinc transporter), member 1 (SLC39A1, Accession NP_055252.2), a gene which is a divalent (zinc/iron) metal ion transporter. Accordingly, utilities of GAM175 include diagnosis, prevention and treatment of diseases and clinical conditions associated with SLC39A1.

The function of SLC39A1 has been established by previous studies. The ZRT- and IRT-related protein (ZIP) family is composed of divalent metal ion transporters, including A. thaliana IRT1 (iron-regulated transporter-1), which appears to play a role in iron uptake, and S. cerevisiae ZRT1 (zinc-regulated transporter-1) and ZRT2, and A. thaliana ZIP1 to ZIP4, all of which are probably zinc transporters (reviewed by Eng et al., 1998). The human growth arrest-inducible gene product (GAIP) is also a ZIP family member based on sequence similarity. Lioumi et al. (1998) generated a transcript map of the region within and in the proximity of the epidermal differentiation complex (EDC; 601588), which is located in 1q21. They identified a partial ZIRTL cDNA as mapping to the distal end of the EDC, 200 kb from the S100A1 gene (OMIM Ref. No. 176940). Lioumi et al. (1998) found that a portion of the ZIRTL cDNA encodes a polypeptide with significant sequence similarity to the ZIP family of iron and zinc transporters from plants and yeast. By screening a human keratinocyte cDNA library with the partial ZIRTL cDNA, Lioumi et al. (1999) isolated a full-length ZIRTL cDNA. The predicted 324-amino acid ZIRTL protein contains 8 transmembrane domains, 9 possible N-myristylation sites, a potential protein kinase C phosphorylation site, and 4 potential protein kinase II phosphorylation sites. Human ZIRTL shares 21 to 22% amino acid sequence identity with A. thaliana IRT1 and ZIP1 to ZIP4, Pisum sativum Rit1, and S. cerevisiae ZRT1 and ZRT2. ZIRTL also shares 34% amino acid sequence identity with GAIP. The human and mouse Zirtl proteins are 90% similar. The ZIRTL gene contains 4 exons. Northern blot analysis detected a 2.1-kb ZIRTL transcript in all human tissues tested, namely adult heart, lung, brain, liver, pancreas, small intestine, colon, kidney, spleen, thymus, peripheral blood leukocytes, skeletal muscle, testis, ovary, placenta, prostate, and keratinocytes, and fetal heart, kidney, small intestine, and skin. In situ hybridization showed that mouse Zirtl is developmentally regulated in the skin, where it was expressed in the epidermal layer, excluding the dermis, at E17.5, but not in embryonic days 10.5 and 15.5 or P21. In the small intestine, Zirtl was found toward the base of the intestinal villi from E17.5. In the pancreas, Zirtl expression was found from E17.5. Zirtl expression was not detected in the liver. Zirtl was expressed in osteoblasts of developing bone from E15.5 and in ameloblasts and odontoblasts at late stages of tooth development at P21. Moderate expression of Zirtl was observed in brain in the hippocampus Full details of the abovementioned studies are described in the following publications, the disclosure of which are hereby incorporated by reference:

Lioumi, M.; Ferguson, C. A.; Sharpe, P. T.; Freeman, T.; Marenholz, I.; Mischke, D.; Heizmann, C.; Ragoussis, J.: Isolation and characterization of human and mouse ZIRTL, a member of the IRT1 family of transporters, mapping within the epidermal differentiation complex. Genomics 62:272-280, 1999; and Lioumi, M.; Olavesen, M. G.; Nizetic, D.; Ragoussis, J.: High-resolution YAC fragmentation map of 1q21. Genomics 49:200-208, 1998.

Further studies establishing the function and utilities of SLC39A1 are found in John Hopkins OMIM database record ID 604740, and in cited publications listed in Table 5, which are hereby incorporated by reference. SMURF1 (Accession XP__166483.1) is another GAM175 target gene, herein designated TARGET GENE. SMURF1 BINDING SITE is a target binding site found in the 5' untranslated region of multiple transcripts of mRNA encoded by SMURF1, corresponding to a target binding site such as BINDING SITE I, BINDING SITE II or BINDING SITE III of FIG. 8. Table 4 illustrates the complementarity of the nucleotide sequences of SMURF1 BINDING SITE, designated SEQ ID:17695, to the nucleotide sequence of GAM175 RNA, herein designated GAM RNA, also designated SEQ ID:265.

Another function of GAM175 is therefore inhibition of SMURF1 (Accession XP__166483.1). Accordingly, utilities of GAM175 include diagnosis, prevention and treatment of diseases and clinical conditions associated with SMURF1.

SMURF1 (Accession NP__065162.1) is another GAM175 target gene, herein designated TARGET GENE. SMURF1 BINDING SITE is a target binding site found in the 5' untranslated region of multiple transcripts of mRNA encoded by SMURF1, corresponding to a target binding site such as BINDING SITE I, BINDING SITE II or BINDING SITE III of FIG. 8. Table 4 illustrates the complementarity of the nucleotide sequences of SMURF1 BINDING SITE, designated SEQ ID:17695, to the nucleotide sequence of GAM175 RNA, herein designated GAM RNA, also designated SEQ ID:265.

Another function of GAM175 is therefore inhibition of SMURF1 (Accession NP__065162.1). Accordingly, utilities of GAM175 include diagnosis, prevention and treatment of diseases and clinical conditions associated with SMURF1.

SMURF1 (Accession NP__851994.1) is another GAM175 target gene, herein designated TARGET GENE. SMURF1 BINDING SITE is a target binding site found in the 5' untranslated region of multiple transcripts of mRNA encoded by SMURF1, corresponding to a target binding site such as BINDING SITE I, BINDING SITE II or BINDING SITE III of FIG. 8. Table 4 illustrates the complementarity of the nucleotide sequences of SMURF1 BINDING SITE, designated SEQ ID:17695, to the nucleotide sequence of GAM175 RNA, herein designated GAM RNA, also designated SEQ ID:265.

Another function of GAM175 is therefore inhibition of SMURF1 (Accession NP__851994.1). Accordingly, utilities of GAM175 include diagnosis, prevention and treatment of diseases and clinical conditions associated with SMURF1.

Sry (sex determining region y)-box 13 (SOX13, Accession NP__005677.1) is another GAM175 target gene, herein designated TARGET GENE. SOX13 BINDING SITE is a target binding site found in the 3' untranslated region of mRNA encoded by SOX13, corresponding to a target binding site such as BINDING SITE I, BINDING SITE II or BINDING SITE III of FIG. 8. Table 4 illustrates the complementarity of the nucleotide sequences of SOX13 BINDING SITE, designated SEQ ID:17045, to the nucleotide sequence of GAM175 RNA, herein designated GAM RNA, also designated SEQ ID:265.

Another function of GAM175 is therefore inhibition of Sry (sex determining region y)-box 13 (SOX13, Accession NP__005677.1). Accordingly, utilities of GAM175 include diagnosis, prevention and treatment of diseases and clinical conditions associated with SOX13.

Serine racemase (SRR, Accession NP__068766.1) is another GAM175 target gene, herein designated TARGET GENE. SRR BINDING SITE is a target binding site found in the 3' untranslated region of mRNA encoded by SRR, corresponding to a target binding site such as BINDING SITE I, BINDING SITE II or BINDING SITE III of FIG. 8. Table 4 illustrates the complementarity of the nucleotide sequences of SRR BINDING SITE, designated SEQ ID:14627, to the nucleotide sequence of GAM175 RNA, herein designated GAM RNA, also designated SEQ ID:265.

Another function of GAM175 is therefore inhibition of Serine racemase (SRR, Accession NP__068766.1). Accordingly, utilities of GAM175 include diagnosis, prevention and treatment of diseases and clinical conditions associated with SRR.

Suppression of tumorigenicity 7 like (ST7L, Accession NP_620056.1) is another GAM175 target gene, herein designated TARGET GENE. ST7L BINDING SITE is a target binding site found in the 3' untranslated region of multiple transcripts of mRNA encoded by ST7L, corresponding to a target binding site such as BINDING SITE I, BINDING SITE II or BINDING SITE III of FIG. 8. Table 4 illustrates the complementarity of the nucleotide sequences of ST7L BINDING SITE, designated SEQ ID:19906, to the nucleotide sequence of GAM175 RNA, herein designated GAM RNA, also designated SEQ ID:265.

Another function of GAM175 is therefore inhibition of Suppression of tumorigenicity 7 like (ST7L, Accession NP__620056.1). Accordingly, utilities of GAM175 include diagnosis, prevention and treatment of diseases and clinical conditions associated with ST7L.

Suppression of tumorigenicity 7 like (ST7L, Accession NP_620055.1) is another GAM175 target gene, herein designated TARGET GENE. ST7L BINDING SITE is a target binding site found in the 3' untranslated region of multiple transcripts of mRNA encoded by ST7L, corresponding to a target binding site such as BINDING SITE I, BINDING SITE II or BINDING SITE III of FIG. 8. Table 4 illustrates the complementarity of the nucleotide sequences of ST7L BINDING SITE, designated SEQ ID:19906, to the nucleotide sequence of GAM175 RNA, herein designated GAM RNA, also designated SEQ ID:265.

Another function of GAM175 is therefore inhibition of Suppression of tumorigenicity 7 like (ST7L, Accession NP__620055.1). Accordingly, utilities of GAM175 include diagnosis, prevention and treatment of diseases and clinical conditions associated with ST7L.

Suppression of tumorigenicity 7 like (ST7L, Accession NP_060214.2) is another GAM175 target gene, herein designated TARGET GENE. ST7L BINDING SITE is a target binding site found in the 3' untranslated region of multiple transcripts of mRNA encoded by ST7L, corresponding to a target binding site such as BINDING SITE I, BINDING SITE II or BINDING SITE III of FIG. 8. Table 4 illustrates the complementarity of the nucleotide sequences of ST7L BINDING SITE, designated SEQ ID:19906, to the nucleotide sequence of GAM175 RNA, herein designated GAM RNA, also designated SEQ ID:265.

Another function of GAM175 is therefore inhibition of Suppression of tumorigenicity 7 like (ST7L, Accession NP__060214.2). Accordingly, utilities of GAM175 include diagnosis, prevention and treatment of diseases and clinical conditions associated with ST7L.

Thrombomodulin (THBD, Accession NP__000352.1) is another GAM175 target gene, herein designated TARGET GENE. THBD BINDING SITE is a target binding site found in the 3' untranslated region of mRNA encoded by THBD, corresponding to a target binding site such as BINDING SITE I, BINDING SITE II or BINDING SITE III of FIG. 8. Table 4 illustrates the complementarity of the nucleotide sequences of THBD BINDING SITE, designated SEQ ID:6439, to the nucleotide sequence of GAM175 RNA, herein designated GAM RNA, also designated SEQ ID:265.

Another function of GAM175 is therefore inhibition of Thrombomodulin (THBD, Accession NP_000352.1). Accordingly, utilities of GAM175 include diagnosis, prevention and treatment of diseases and clinical conditions associated with THBD.

Thy-1 cell surface antigen (THY1, Accession NP_006279.2) is another GAM175 target gene, herein designated TARGET GENE. THY1 BINDING SITE is a target binding site found in the 3' untranslated region of mRNA encoded by THY1, corresponding to a target binding site such as BINDING SITE I, BINDING SITE II or BINDING SITE III of FIG. 8. Table 4 illustrates the complementarity of the nucleotide sequences of THY1 BINDING SITE, designated SEQ ID:15926, to the nucleotide sequence of GAM175 RNA, herein designated GAM RNA, also designated SEQ ID:265.

Another function of GAM175 is therefore inhibition of Thy-1 cell surface antigen (THY1, Accession NP_006279.2), a gene which plays a role in cell-cell or cell-ligand interactions during synaptogenesis. Accordingly, utilities of GAM175 include diagnosis, prevention and treatment of diseases and clinical conditions associated with THY1.

The function of THY1 and its association with various diseases and clinical conditions, has been established by previous studies, as described hereinabove with reference to GAM74.1. Transmembrane protease, serine 2 (TMPRSS2, Accession NP_005647.2) is another GAM175 target gene, herein designated TARGET GENE. TMPRSS2 BINDING SITE is a target binding site found in the 3' untranslated region of mRNA encoded by TMPRSS2, corresponding to a target binding site such as BINDING SITE I, BINDING SITE II or BINDING SITE III of FIG. 8. Table 4 illustrates the complementarity of the nucleotide sequences of TMPRSS2 BINDING SITE, designated SEQ ID:3601, to the nucleotide sequence of GAM175 RNA, herein designated GAM RNA, also designated SEQ ID:265.

Another function of GAM175 is therefore inhibition of Transmembrane protease, serine 2 (TMPRSS2, Accession NP_005647.2). Accordingly, utilities of GAM175 include diagnosis, prevention and treatment of diseases and clinical conditions associated with TMPRSS2.

TU12B1-TY (Accession NP_057659.1) is another GAM175 target gene, herein designated TARGET GENE. TU12B1-TY BINDING SITE is a target binding site found in the 3' untranslated region of mRNA encoded by TU12B1-TY, corresponding to a target binding site such as BINDING SITE I, BINDING SITE II or BINDING SITE III of FIG. 8. Table 4 illustrates the complementarity of the nucleotide sequences of TU12B1-TY BINDING SITE, designated SEQ ID:9561, to the nucleotide sequence of GAM175 RNA, herein designated GAM RNA, also designated SEQ ID:265.

Another function of GAM175 is therefore inhibition of TU12B1-TY (Accession NP_057659.1). Accordingly, utilities of GAM175 include diagnosis, prevention and treatment of diseases and clinical conditions associated with TU12B1-TY.

TULP4 (Accession NP_064630.1) is another GAM175 target gene, herein designated TARGET GENE. TULP4 BINDING SITE is a target binding site found in the 3' untranslated region of mRNA encoded by TULP4, corresponding to a target binding site such as BINDING SITE I, BINDING SITE II or BINDING SITE III of FIG. 8. Table 4 illustrates the complementarity of the nucleotide sequences of TULP4 BINDING SITE, designated SEQ ID:10089, to the nucleotide sequence of GAM175 RNA, herein designated GAM RNA, also designated SEQ ID:265.

Another function of GAM175 is therefore inhibition of TULP4 (Accession NP_064630.1). Accordingly, utilities of GAM175 include diagnosis, prevention and treatment of diseases and clinical conditions associated with TULP4.

UMP-CMPK (Accession NP_057392.1) is another GAM175 target gene, herein designated TARGET GENE. UMP-CMPK BINDING SITE is a target binding site found in the 3' untranslated region of mRNA encoded by UMP-CMPK, corresponding to a target binding site such as BINDING SITE I, BINDING SITE II or BINDING SITE III of FIG. 8. Table 4 illustrates the complementarity of the nucleotide sequences of UMP-CMPK BINDING SITE, designated SEQ ID:5399, to the nucleotide sequence of GAM175 RNA, herein designated GAM RNA, also designated SEQ ID:265.

Another function of GAM175 is therefore inhibition of UMP-CMPK (Accession NP_057392.1). Accordingly, utilities of GAM175 include diagnosis, prevention and treatment of diseases and clinical conditions associated with UMP-CMPK.

Unc-84 homolog a (c. elegans) (UNC84B, Accession XP_039332.1) is another GAM175 target gene, herein designated TARGET GENE. UNC84B BINDING SITE is a target binding site found in the 3' untranslated region of multiple transcripts of mRNA encoded by UNC84B, corresponding to a target binding site such as BINDING SITE I, BINDING SITE II or BINDING SITE III of FIG. 8. Table 4 illustrates the complementarity of the nucleotide sequences of UNC84B BINDING SITE, designated SEQ ID:8301, to the nucleotide sequence of GAM175 RNA, herein designated GAM RNA, also designated SEQ ID:265.

Another function of GAM175 is therefore inhibition of Unc-84 homolog a (c. elegans) (UNC84B, Accession XP_039332.1). Accordingly, utilities of GAM175 include diagnosis, prevention and treatment of diseases and clinical conditions associated with UNC84B.

Unc-84 homolog a (c. elegans) (UNC84B, Accession NP_056189.1) is another GAM175 target gene, herein designated TARGET GENE. UNC84B BINDING SITE is a target binding site found in the 3' untranslated region of multiple transcripts of mRNA encoded by UNC84B, corresponding to a target binding site such as BINDING SITE I, BINDING SITE II or BINDING SITE III of FIG. 8. Table 4 illustrates the complementarity of the nucleotide sequences of UNC84B BINDING SITE, designated SEQ ID:8301, to the nucleotide sequence of GAM175 RNA, herein designated GAM RNA, also designated SEQ ID:265.

Another function of GAM175 is therefore inhibition of Unc-84 homolog a (c. elegans) (UNC84B, Accession NP_056189.1). Accordingly, utilities of GAM175 include diagnosis, prevention and treatment of diseases and clinical conditions associated with UNC84B.

Ubiquitin specific protease 25 (USP25, Accession NP_037528.2) is another GAM175 target gene, herein designated TARGET GENE. USP25 BINDING SITE is a target binding site found in the 3' untranslated region of mRNA encoded by USP25, corresponding to a target binding site such as BINDING SITE I, BINDING SITE II or BINDING SITE III of FIG. 8. Table 4 illustrates the complementarity of the nucleotide sequences of USP25 BINDING SITE, designated SEQ ID:3776, to the nucleotide sequence of GAM175 RNA, herein designated GAM RNA, also designated SEQ ID:265.

Another function of GAM175 is therefore inhibition of Ubiquitin specific protease 25 (USP25, Accession NP_037528.2). Accordingly, utilities of GAM175 include diagnosis, prevention and treatment of diseases and clinical conditions associated with USP25.

Zinc finger protein 313 (ZNF313, Accession NP_061153.1) is another GAM175 target gene, herein designated TARGET GENE. ZNF313 BINDING SITE is a target binding site found in the 3' untranslated region of mRNA encoded by ZNF313, corresponding to a target binding site such as BINDING SITE I, BINDING SITE II or BINDING SITE III of FIG. 8. Table 4 illustrates the complementarity of the nucleotide sequences of ZNF313 BINDING SITE, designated SEQ ID:1924, to the nucleotide sequence of GAM175 RNA, herein designated GAM RNA, also designated SEQ ID:265.

Another function of GAM175 is therefore inhibition of Zinc finger protein 313 (ZNF313, Accession NP_061153.1). Accordingly, utilities of GAM175 include diagnosis, prevention and treatment of diseases and clinical conditions associated with ZNF313.

FIG. 8 further provides a conceptual description of a novel bioinformatically detected of the present invention, referred to here as Genomic Address Messenger 176 (GAM176), which modulates expression of respective target genes thereof, the function and utility of which target genes is known in the art.

GAM176 is a novel bioinformatically detected regulatory, non protein coding, micro RNA (miRNA) gene. The method by which GAM176 was detected is described hereinabove with reference to FIGS. 8-15.

GAM176 gene, herein designated GAM GENE, and GAM176 target gene, herein designated TARGET GENE, are human genes contained in the human genome.

GAM176 gene encodes a GAM176 precursor RNA, herein designated GAM PRECURSOR RNA. Similar to other miRNA genes, and unlike most ordinary genes, GAM176 precursor RNA does not encode a protein. A nucleotide sequence identical or highly similar to the nucleotide sequence of GAM176 precursor RNA is designated SEQ ID:73, and is provided hereinbelow with reference to the sequence listing part.

GAM176 precursor RNA folds onto itself, forming GAM176 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM176 precursor RNA folds onto itself, forming GAM176 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM176 precursor RNA, designated SEQ-ID:73, and a schematic representation of a predicted secondary folding of GAM176 folded precursor RNA are further described with reference to Table 2, hereby incorporated by reference.

An enzyme complex designated DICER COMPLEX, 'dices' the GAM176 folded precursor RNA into GAM176 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM176 RNA is designated SEQ ID:345, and is provided hereinbelow with references to the sequence listing part and Table 3, hereby incorporated by reference.

GAM176 target gene, herein designated TARGET GENE, encodes a corresponding messenger RNA, GAM176 target RNA, herein designated GAM TARGET RNA. GAM176 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM176 RNA, herein designated GAM RNA, binds complementarily to one or more target binding sites located in untranslated regions of GAM176 target RNA, herein designated GAM TARGET RNA. This complementary binding is due to the fact that the nucleotide sequence of GAM176 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM176 RNA may have a different number of target binding sites in untranslated regions of a GAM176 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM176 RNA, herein designated GAM RNA, to target binding sites on GAM176 target RNA, herein designated GAM TARGET RNA, such as BINDING SITE I, BINDING SITE II and BINDING SITE III, inhibits translation of GAM176 target RNA into GAM176 target protein, herein designated GAM TARGET PROTEIN. GAM target protein is therefore outlined by a broken line.

It is appreciated that GAM176 target gene, herein designated TARGET GENE, in fact represents a plurality of GAM176 target genes. The mRNA of each one of this plurality of GAM176 target genes comprises one or more target binding sites, each having a nucleotide sequence which is at least partly complementary to GAM176 RNA, herein designated GAM RNA, and which when bound by GAM176 RNA causes inhibition of translation of respective one or more GAM176 target proteins.

It is further appreciated by one skilled in the art that the mode of translational inhibition illustrated by FIG. 8 with specific reference to translational inhibition exerted by GAM176 gene, herein designated GAM GENE, on one or more GAM176 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM176 correlate with, and may be deduced from, the identity of the target genes which GAM176 binds and inhibits, and the function of these target genes, as elaborated hereinbelow.

V-myb myeloblastosis viral oncogene homolog (avian)-like 1 (MYBL1, Accession XM_034274.10) is a GAM176 target gene, herein designated TARGET GENE. MYBL1 BINDING SITE is a target binding site found in the 3' untranslated region of mRNA encoded by MYBL1, corresponding to a target binding site such as BINDING SITE I, BINDING SITE II or BINDING SITE III of FIG. 8. Table 4 illustrates the complementarity of the nucleotide sequences of MYBL1 BINDING SITE, designated SEQ ID:18625, to the nucleotide sequence of GAM176 RNA, herein designated GAM RNA, also designated SEQ ID:345.

A function of GAM176 is therefore inhibition of V-myb myeloblastosis viral oncogene homolog (avian)-like 1 (MYBL1, Accession XM_034274.10), a gene which could have a role in the proliferation and/or differentiation of neurogenic, spermatogenic and b-lymphoid cells. Accordingly, utilities of GAM176 include diagnosis, prevention and treatment of diseases and clinical conditions associated with MYBL1.

The function of MYBL1 has been established by previous studies. Nomura et al. (1988) isolated and characterized cDNA clones for 2 human MYB-related genes, AMYB and BMYB (OMIM Ref. No. 601415). Using probes in Southern blot analysis of rodent-human hybrid DNAs, Barletta et al. (1991) localized the MYBL1 locus to 8cen-q22 and refined the localization to 8q22- q23 by in situ hybridization. Takahashi et al. (1995) found that MYBL1 mRNA is expressed mainly in testis and peripheral blood leukocytes. AMYB could activate transcription from the promoter-containing MYB-binding sites in all cells examined. In addition to the 2 domains (a DNA-binding domain and a transcriptional activation domain), 2 negative regulatory domains were identified in the MYBL1 gene. These results indicated that the gene functions as a transcriptional activator and that the regulatory mechanism of gene activity is similar to that of the MYB (OMIM Ref. No. 189990) gene.

Full details of the abovementioned studies are described in the following publications, the disclosure of which are hereby incorporated by reference:

Nomura, N.; Takahashi, M.; Matsui, M.; Ishii, S.; Date, T.; Sasamoto, S.; Ishizaki, R.: Isolation of human cDNA clones of MYB-related genes, A-MYB and B-MYB. Nucleic Acids Res. 16:11075-11089, 1988; and Takahashi, T.; Nakagoshi, H.; Sarai, A.; Nomura, N.; Yamamoto, T.; Ishii, S.: Human A-myb gene encodes a transcriptional activator containing the negative regulatory domains. FEBS Lett.

Further studies establishing the function and utilities of MYBL1 are found in John Hopkins OMIM database record ID 159405, and in cited publications listed in Table 5, which are hereby incorporated by reference.

FIG. 8 further provides a conceptual description of a novel bioinformatically detected of the present invention, referred to here as Genomic Address Messenger 177 (GAM177), which modulates expression of respective target genes thereof, the function and utility of which target genes is known in the art.

GAM177 is a novel bioinformatically detected regulatory, non protein coding, micro RNA (miRNA) gene. The method by which GAM177 was detected is described hereinabove with reference to FIGS. 8-15.

GAM177 gene, herein designated GAM GENE, and GAM177 target gene, herein designated TARGET GENE, are human genes contained in the human genome.

GAM177 gene encodes a GAM177 precursor RNA, herein designated GAM PRECURSOR RNA. Similar to other miRNA genes, and unlike most ordinary genes, GAM177 precursor RNA does not encode a protein. A nucleotide sequence identical or highly similar to the nucleotide sequence of GAM177 precursor RNA is designated SEQ ID:133, and is provided hereinbelow with reference to the sequence listing part.

GAM177 precursor RNA folds onto itself, forming GAM177 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM177 precursor RNA folds onto itself, forming GAM177 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM177 precursor RNA, designated SEQ-ID:133, and a schematic representation of a predicted secondary folding of GAM177 folded precursor RNA are further described with reference to Table 2, hereby incorporated by reference.

An enzyme complex designated DICER COMPLEX, 'dices' the GAM177 folded precursor RNA into GAM177 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM177 RNA is designated SEQ ID:385, and is provided hereinbelow with references to the sequence listing part and Table 3, hereby incorporated by reference.

GAM177 target gene, herein designated TARGET GENE, encodes a corresponding messenger RNA, GAM177 target RNA, herein designated GAM TARGET RNA. GAM177 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM177 RNA, herein designated GAM RNA, binds complementarily to one or more target binding sites located in untranslated regions of GAM177 target RNA, herein designated GAM TARGET RNA. This complementary binding is due to the fact that the nucleotide sequence of GAM177 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM177 RNA may have a different number of target binding sites in untranslated regions of a GAM177 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM177 RNA, herein designated GAM RNA, to target binding sites on GAM177 target RNA, herein designated GAM TARGET RNA, such as BINDING SITE I, BINDING SITE II and BINDING SITE III, inhibits translation of GAM177 target RNA into GAM177 target protein, herein designated GAM TARGET PROTEIN. GAM target protein is therefore outlined by a broken line.

It is appreciated that GAM177 target gene, herein designated TARGET GENE, in fact represents a plurality of GAM177 target genes. The mRNA of each one of this plurality of GAM177 target genes comprises one or more target binding sites, each having a nucleotide sequence which is at least partly complementary to GAM177 RNA, herein designated GAM RNA, and which when bound by GAM177 RNA causes inhibition of translation of respective one or more GAM177 target proteins.

It is further appreciated by one skilled in the art that the mode of translational inhibition illustrated by FIG. 8 with specific reference to translational inhibition exerted by GAM177 gene, herein designated GAM GENE, on one or more GAM177 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM177 correlate with, and may be deduced from, the identity of the target genes which GAM177 binds and inhibits, and the function of these target genes, as elaborated hereinbelow.

B-cell cll/lymphoma 7a (BCL7A, Accession NM_020993.2) is a GAM177 target gene, herein designated TARGET GENE. BCL7A BINDING SITE is a target binding site found in the 5' untranslated region of mRNA encoded by BCL7A, corresponding to a target binding site such as BINDING SITE I, BINDING SITE II or BINDING SITE III of FIG. 8. Table 4 illustrates the complementarity of the nucleotide sequences of BCL7A BINDING SITE, designated SEQ ID:9800, to the nucleotide sequence of GAM177 RNA, herein designated GAM RNA, also designated SEQ ID:385.

A function of GAM177 is therefore inhibition of B-cell cll/lymphoma 7a (BCL7A, Accession NM_020993.2). Accordingly, utilities of GAM177 include diagnosis, prevention and treatment of diseases and clinical conditions associated with BCL7A.

CLONE24945 (Accession NM_015683.1) is another GAM177 target gene, herein designated TARGET GENE. CLONE24945 BINDING SITE is a target binding site found in the 3' untranslated region of mRNA encoded by CLONE24945, corresponding to a target binding site such as BINDING SITE I, BINDING SITE II or BINDING SITE III of FIG. 8. Table 4 illustrates the complementarity of the nucleotide sequences of CLONE24945 BINDING SITE, designated SEQ ID:4969, to the nucleotide sequence of GAM177 RNA, herein designated GAM RNA, also designated SEQ ID:385.

Another function of GAM177 is therefore inhibition of CLONE24945 (Accession NM_015683.1). Accordingly, utilities of GAM177 include diagnosis, prevention and treatment of diseases and clinical conditions associated with CLONE24945.

Protein tyrosine phosphatase, non-receptor type 3 (PTPN3, Accession NM_002829.2) is another GAM177 target gene, herein designated TARGET GENE. PTPN3 BINDING SITE is a target binding site found in the 3' untranslated region of mRNA encoded by PTPN3, corresponding to a target binding site such as BINDING SITE I, BINDING SITE II or BINDING SITE III of FIG. 8. Table 4 illustrates the complementarity of the nucleotide sequences of PTPN3 BINDING SITE, designated SEQ ID:12354, to the nucleotide sequence of GAM177 RNA, herein designated GAM RNA, also designated SEQ ID:385.

Another function of GAM177 is therefore inhibition of Protein tyrosine phosphatase, non-receptor type 3 (PTPN3, Accession NM_002829.2). Accordingly, utilities of GAM177 include diagnosis, prevention and treatment of diseases and clinical conditions associated with PTPN3.

FIG. 8 further provides a conceptual description of a novel bioinformatically detected of the present invention, referred to here as Genomic Address Messenger 178 (GAM178), which modulates expression of respective target genes thereof, the function and utility of which target genes is known in the art.

GAM178 is a novel bioinformatically detected regulatory, non protein coding, micro RNA (miRNA) gene. The method by which GAM178 was detected is described hereinabove with reference to FIGS. 8-15.

GAM178 gene, herein designated GAM GENE, and GAM178 target gene, herein designated TARGET GENE, are human genes contained in the human genome.

GAM178 gene encodes a GAM178 precursor RNA, herein designated GAM PRECURSOR RNA. Similar to other miRNA genes, and unlike most ordinary genes, GAM178 precursor RNA does not encode a protein. A nucleotide sequence identical or highly similar to the nucleotide sequence of GAM178 precursor RNA is designated SEQ ID:32, and is provided hereinbelow with reference to the sequence listing part.

GAM178 precursor RNA folds onto itself, forming GAM178 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM178 precursor RNA folds onto itself, forming GAM178 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM178 precursor RNA, designated SEQ-ID:32, and a schematic representation of a predicted secondary folding of GAM178 folded precursor RNA are further described with reference to Table 2, hereby incorporated by reference.

An enzyme complex designated DICER COMPLEX, 'dices' the GAM178 folded precursor RNA into GAM178

RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM178 RNA is designated SEQ ID:223, and is provided hereinbelow with references to the sequence listing part and Table 3, hereby incorporated by reference.

GAM178 target gene, herein designated TARGET GENE, encodes a corresponding messenger RNA, GAM178 target RNA, herein designated GAM TARGET RNA. GAM178 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM178 RNA, herein designated GAM RNA, binds complementarily to one or more target binding sites located in untranslated regions of GAM178 target RNA, herein designated GAM TARGET RNA. This complementary binding is due to the fact that the nucleotide sequence of GAM178 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM178 RNA may have a different number of target binding sites in untranslated regions of a GAM178 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM178 RNA, herein designated GAM RNA, to target binding sites on GAM178 target RNA, herein designated GAM TARGET RNA, such as BINDING SITE I, BINDING SITE II and BINDING SITE III, inhibits translation of GAM178 target RNA into GAM178 target protein, herein designated GAM TARGET PROTEIN. GAM target protein is therefore outlined by a broken line.

It is appreciated that GAM178 target gene, herein designated TARGET GENE, in fact represents a plurality of GAM178 target genes. The mRNA of each one of this plurality of GAM178 target genes comprises one or more target binding sites, each having a nucleotide sequence which is at least partly complementary to GAM178 RNA, herein designated GAM RNA, and which when bound by GAM178 RNA causes inhibition of translation of respective one or more GAM178 target proteins.

It is further appreciated by one skilled in the art that the mode of translational inhibition illustrated by FIG. 8 with specific reference to translational inhibition exerted by GAM178 gene, herein designated GAM GENE, on one or more GAM178 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM178 correlate with, and may be deduced from, the identity of the target genes which GAM178 binds and inhibits, and the function of these target genes, as elaborated hereinbelow.

Digeorge syndrome critical region gene 2 (DGCR2, Accession NM_005137.1) is a GAM178 target gene, herein designated TARGET GENE. DGCR2 BINDING SITE is a target binding site found in the 3' untranslated region of mRNA encoded by DGCR2, corresponding to a target binding site such as BINDING SITE I, BINDING SITE II or BINDING SITE III of FIG. 8. Table 4 illustrates the complementarity of the nucleotide sequences of DGCR2 BINDING SITE, designated SEQ ID:17601, to the nucleotide sequence of GAM178 RNA, herein designated GAM RNA, also designated SEQ ID:223.

A function of GAM178 is therefore inhibition of Digeorge syndrome critical region gene 2 (DGCR2, Accession NM_005137.1), a gene which is putative adhesion receptor and intervenes in cell-cell or cell-matrix interactions and therefore may be associated with Digeorge syndrome. Accordingly, utilities of GAM178 include diagnosis, prevention and treatment of Digeorge syndrome, and of other diseases and clinical conditions associated with DGCR2.

The function of DGCR2 and its association with various diseases and clinical conditions, has been established by previous studies, as described hereinabove with reference to GAM84.1. Dual-specificity tyrosine-(y)-phosphorylation regulated kinase 1a (DYRK1A, Accession NM_130436.1) is another GAM178 target gene, herein designated TARGET GENE. DYRK1A BINDING SITE is a target binding site found in the 3' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:7463, to the nucleotide sequence of GAM178 RNA, herein designated GAM RNA, also designated SEQ ID:223.

Another function of GAM178 is therefore inhibition of Dual-specificity tyrosine-(y)-phosphorylation regulated kinase 1a (DYRK1A, Accession NM_130436.1), a gene which regulates cell proliferation and may be involved in brain development . and therefore may be associated with Down syndrome. Accordingly, utilities of GAM178 include diagnosis, prevention and treatment of Down syndrome, and of other diseases and clinical conditions associated with DYRK1A.

The function of DYRK1A and its association with various diseases and clinical conditions, has been established by previous studies, as described hereinabove with reference to GAM63.1. FLJ11795 (Accession NM_024669.1) is another GAM178 target gene, herein designated TARGET GENE. FLJ11795 BINDING SITE is a target binding site found in the 3' untranslated region of mRNA encoded by FLJ11795, corresponding to a target binding site such as BINDING SITE I, BINDING SITE II or BINDING SITE III of FIG. 8. Table 4 illustrates the complementarity of the nucleotide sequences of FLJ11795 BINDING SITE, designated SEQ ID:8358, to the nucleotide sequence of GAM178 RNA, herein designated GAM RNA, also designated SEQ ID:223.

Another function of GAM178 is therefore inhibition of FLJ11795 (Accession NM_024669.1). Accordingly, utilities of GAM178 include diagnosis, prevention and treatment of diseases and clinical conditions associated with FLJ11795.

Junctional adhesion molecule 1 (JAM1, Accession) is another GAM178 target gene, herein designated TARGET GENE. JAM1 BINDING SITE is a target binding site found in the 3' untranslated region of mRNA encoded by JAM1, corresponding to a target binding site such as BINDING SITE I, BINDING SITE II or BINDING SITE III of FIG. 8. Table 4 illustrates the complementarity of the nucleotide sequences of JAM1 BINDING SITE, designated SEQ ID:7807, to the nucleotide sequence of GAM178 RNA, herein designated GAM RNA, also designated SEQ ID:223.

Another function of GAM178 is therefore inhibition of Junctional adhesion molecule 1 (JAM1, Accession). Accordingly, utilities of GAM178 include diagnosis, prevention and treatment of diseases and clinical conditions associated with JAM1.

Kelch-like 3 (drosophila) (KLHL3, Accession NM_017415.1) is another GAM178 target gene, herein designated TARGET GENE. KLHL3 BINDING SITE is a target binding site found in the 5' untranslated region of mRNA encoded by KLHL3, corresponding to a target binding site such as BINDING SITE I, BINDING SITE II or BINDING SITE III of FIG. 8. Table 4 illustrates the complementarity of the nucleotide sequences of KLHL3 BINDING SITE, designated SEQ ID:5694, to the nucleotide sequence of GAM178 RNA, herein designated GAM RNA, also designated SEQ ID:223.

Another function of GAM178 is therefore inhibition of Kelch-like 3 (drosophila) (KLHL3, Accession NM_017415.1). Accordingly, utilities of GAM178 include diagnosis, prevention and treatment of diseases and clinical conditions associated with KLHL3.

LOC221596 (Accession) is another GAM178 target gene, herein designated TARGET GENE. LOC221596 BINDING SITE is a target binding site found in the 5' untranslated region of mRNA encoded by LOC221596, corresponding to a target binding site such as BINDING SITE I, BINDING SITE II or BINDING SITE III of FIG. 8. Table 4 illustrates the complementarity of the nucleotide sequences of LOC221596 BINDING SITE, designated SEQ ID:13446, to the nucleotide sequence of GAM178 RNA, herein designated GAM RNA, also designated SEQ ID:223.

Another function of GAM178 is therefore inhibition of LOC221596 (Accession). Accordingly, utilities of GAM178 include diagnosis, prevention and treatment of diseases and clinical conditions associated with LOC221596.

O-linked n-acetylglucosamine (glcnac) transferase (udp-n-acetylglucosamine:polypeptide-n-acetylglucosaminyl transferase) (OGT, Accession NM_003605.2) is another GAM178 target gene, herein designated TARGET GENE. OGT BINDING SITE is a target binding site found in the 3' untranslated region of mRNA encoded by OGT, corresponding to a target binding site such as BINDING SITE I, BINDING SITE II or BINDING SITE III of FIG. 8. Table 4 illustrates the complementarity of the nucleotide sequences of OGT BINDING SITE, designated SEQ ID:16443, to the nucleotide sequence of GAM178 RNA, herein designated GAM RNA, also designated SEQ ID:223.

Another function of GAM178 is therefore inhibition of O-linked n-acetylglucosamine (glcnac) transferase (udp-n-acetylglucosamine:polypeptide-n-acetylglucosaminyl transferase) (OGT, Accession NM_003605.2), a gene which has a role in the glycosylation of nuclear and cytoplasmic proteins. Accordingly, utilities of GAM178 include diagnosis, prevention and treatment of diseases and clinical conditions associated with OGT.

The function of OGT and its association with various diseases and clinical conditions, has been established by previous studies, as described hereinabove with reference to GAM100.1. Protein tyrosine phosphatase, receptor type, u (PTPRU, Accession NM_005704.2) is another GAM178 target gene, herein designated TARGET GENE. PTPRU BINDING SITE is a target binding site found in the 3' untranslated region of multiple transcripts of mRNA encoded by PTPRU, corresponding to a target binding site such as BINDING SITE I, BINDING SITE II or BINDING SITE III of FIG. 8. Table 4 illustrates the complementarity of the nucleotide sequences of PTPRU BINDING SITE, designated SEQ ID:17915, to the nucleotide sequence of GAM178 RNA, herein designated GAM RNA, also designated SEQ ID:223.

Another function of GAM178 is therefore inhibition of Protein tyrosine phosphatase, receptor type, u (PTPRU, Accession NM_005704.2). Accordingly, utilities of GAM178 include diagnosis, prevention and treatment of diseases and clinical conditions associated with PTPRU.

FIG. 8 further provides a conceptual description of a novel bioinformatically detected of the present invention, referred to here as Genomic Address Messenger 179 (GAM179), which modulates expression of respective target genes thereof, the function and utility of which target genes is known in the art.

GAM179 is a novel bioinformatically detected regulatory, non protein coding, micro RNA (miRNA) gene. The method by which GAM179 was detected is described hereinabove with reference to FIGS. 8-15.

GAM179 gene, herein designated GAM GENE, and GAM179 target gene, herein designated TARGET GENE, are human genes contained in the human genome.

GAM179 gene encodes a GAM179 precursor RNA, herein designated GAM PRECURSOR RNA. Similar to other miRNA genes, and unlike most ordinary genes, GAM179 precursor RNA does not encode a protein. A nucleotide sequence identical or highly similar to the nucleotide sequence of GAM179 precursor RNA is designated SEQ ID:19, and is provided hereinbelow with reference to the sequence listing part. Nucleotide sequence SEQ ID:19 is located at position 33981297 relative to chromosome 15.

GAM179 precursor RNA folds onto itself, forming GAM179 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM179 precursor RNA folds onto itself, forming GAM179 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM179 precursor RNA, designated SEQ-ID:19, and a schematic representation of a predicted secondary folding of GAM179 folded precursor RNA are further described with reference to Table 2, hereby incorporated by reference.

An enzyme complex designated DICER COMPLEX, 'dices' the GAM179 folded precursor RNA into GAM179 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM179 RNA is designated SEQ ID:300, and is provided hereinbelow with references to the sequence listing part and Table 3, hereby incorporated by reference.

GAM179 target gene, herein designated TARGET GENE, encodes a corresponding messenger RNA, GAM179 target RNA, herein designated GAM TARGET RNA. GAM179 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM179 RNA, herein designated GAM RNA, binds complementarily to one or more target binding sites located in untranslated regions of GAM179 target RNA, herein designated GAM TARGET RNA. This complementary binding is due to the fact that the nucleotide sequence of GAM179 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM179 RNA may have a different number of target binding sites in untranslated regions of a GAM179 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM179 RNA, herein designated GAM RNA, to target binding sites on GAM179 target RNA, herein designated GAM TARGET RNA, such as BINDING SITE I, BINDING SITE II and BINDING SITE III, inhibits translation of GAM179 target RNA into GAM179 target protein, herein designated GAM TARGET PROTEIN. GAM target protein is therefore outlined by a broken line.

It is appreciated that GAM179 target gene, herein designated TARGET GENE, in fact represents a plurality of GAM179 target genes. The mRNA of each one of this plurality of GAM179 target genes comprises one or more target binding sites, each having a nucleotide sequence which is at least partly complementary to GAM179 RNA, herein designated GAM RNA, and which when bound by GAM179 RNA causes inhibition of translation of respective one or more GAM179 target proteins.

It is further appreciated by one skilled in the art that the mode of translational inhibition illustrated by FIG. 8 with specific reference to translational inhibition exerted by GAM179 gene, herein designated GAM GENE, on one or more GAM179 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM179 correlate with, and may be deduced from, the identity of the target genes which GAM179 binds and inhibits, and the function of these target genes, as elaborated hereinbelow.

7h3 (Accession NP_149014.2) is a GAM179 target gene, herein designated TARGET GENE. 7h3 BINDING SITE is a target binding site found in the 3' untranslated region of mRNA encoded by 7h3, corresponding to a target binding site such as BINDING SITE I, BINDING SITE II or BINDING SITE III of FIG. 8. Table 4 illustrates the complementarity of the nucleotide sequences of 7h3 BINDING SITE, designated SEQ ID:1101, to the nucleotide sequence of GAM179 RNA, herein designated GAM RNA, also designated SEQ ID:300.

A function of GAM179 is therefore inhibition of 7h3 (Accession NP_149014.2). Accordingly, utilities of GAM179 include diagnosis, prevention and treatment of diseases and clinical conditions associated with 7h3.

Active bcr-related gene (ABR, Accession NP_068781.1) is another GAM179 target gene, herein designated TARGET GENE. ABR BINDING SITE is a target binding site found in the 3' untranslated region of multiple transcripts of mRNA encoded by ABR, corresponding to a target binding site such as BINDING SITE I, BINDING SITE II or BINDING SITE III of FIG. 8. Table 4 illustrates the complementarity of the nucleotide sequences of ABR BINDING SITE, designated SEQ ID:16042, to the nucleotide sequence of GAM179 RNA, herein designated GAM RNA, also designated SEQ ID:300.

Another function of GAM179 is therefore inhibition of Active bcr-related gene (ABR, Accession NP_068781.1), a gene which gtpase-activating protein for rac and cdc42. and therefore may be associated with Medulloblastoma. Accordingly, utilities of GAM179 include diagnosis, prevention and treatment of Medulloblastoma, and of other diseases and clinical conditions associated with ABR.

The function of ABR and its association with various diseases and clinical conditions, has been established by previous studies, as described hereinabove with reference to GAM94.1. Active bcr-related gene (ABR, Accession NP_001083.1) is another GAM179 target gene, herein designated TARGET GENE. ABR BINDING SITE is a target binding site found in the 3' untranslated region of multiple transcripts of mRNA encoded by ABR, corresponding to a target binding site such as BINDING SITE I, BINDING SITE II or BINDING SITE III of FIG. 8. Table 4 illustrates the complementarity of the nucleotide sequences of ABR BINDING SITE, designated SEQ ID:16042, to the nucleotide sequence of GAM179 RNA, herein designated GAM RNA, also designated SEQ ID:300.

Another function of GAM179 is therefore inhibition of Active bcr-related gene (ABR, Accession NP_001083.1), a gene which gtpase-activating protein for rac and cdc42. and therefore may be associated with Medulloblastoma. Accordingly, utilities of GAM179 include diagnosis, prevention and treatment of Medulloblastoma, and of other diseases and clinical conditions associated with ABR.

The function of ABR and its association with various diseases and clinical conditions, has been established by previous studies, as described hereinabove with reference to GAM94.1. Ap1 gamma subunit binding protein 1 (AP1GBP1, Accession NP_542118.1) is another GAM179 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:16827, to the nucleotide sequence of GAM179 RNA, herein designated GAM RNA, also designated SEQ ID:300.

Another function of GAM179 is therefore inhibition of Ap1 gamma subunit binding protein 1 (AP1GBP1, Accession NP_542118.1). Accordingly, utilities of GAM179 include diagnosis, prevention and treatment of diseases and clinical conditions associated with AP1GBP1.

Ap1 gamma subunit binding protein 1 (AP1GBP1, Accession NP_542117.1) is another GAM179 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:16827, to the nucleotide sequence of GAM179 RNA, herein designated GAM RNA, also designated SEQ ID:300.

Another function of GAM179 is therefore inhibition of Ap1 gamma subunit binding protein 1 (AP1GBP1, Accession NP_542117.1). Accordingly, utilities of GAM179 include diagnosis, prevention and treatment of diseases and clinical conditions associated with AP1GBP1.

Ap1 gamma subunit binding protein 1 (AP1GBP1, Accession NP_009178.2) is another GAM179 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:16827, to the nucleotide sequence of GAM179 RNA, herein designated GAM RNA, also designated SEQ ID:300.

Another function of GAM179 is therefore inhibition of Ap1 gamma subunit binding protein 1 (AP1GBP1, Accession NP_009178.2). Accordingly, utilities of GAM179 include diagnosis, prevention and treatment of diseases and clinical conditions associated with AP1GBP1.

APRG1 (Accession NP_848031.1) is another GAM179 target gene, herein designated TARGET GENE. APRG1 BINDING SITE is a target binding site found in the 5' untranslated region of multiple transcripts of mRNA encoded by APRG1, corresponding to a target binding site such as BINDING SITE I, BINDING SITE II or BINDING SITE III of FIG. 8. Table 4 illustrates the complementarity of the nucleotide sequences of APRG1 BINDING SITE, designated SEQ ID:15841, to the nucleotide sequence of GAM179 RNA, herein designated GAM RNA, also designated SEQ ID:300.

Another function of GAM179 is therefore inhibition of APRG1 (Accession NP_848031.1). Accordingly, utilities of GAM179 include diagnosis, prevention and treatment of diseases and clinical conditions associated with APRG1.

Atpase, class vi, type 11b (ATP11B, Accession XP_087254.2) is another GAM179 target gene, herein designated TARGET GENE. ATP11B BINDING SITE is a target binding site found in the 3' untranslated region of mRNA encoded by ATP11B, corresponding to a target binding site such as BINDING SITE I, BINDING SITE II or BINDING SITE III of FIG. 8. Table 4 illustrates the complementarity of the nucleotide sequences of ATP11B BINDING SITE, designated SEQ ID:4094, to the nucleotide sequence of GAM179 RNA, herein designated GAM RNA, also designated SEQ ID:300.

Another function of GAM179 is therefore inhibition of Atpase, class vi, type 11b (ATP11B, Accession XP_087254.2), a gene which is phosphorylated in their intermediate state, drives uphill transport of ions across membranes. Accordingly, utilities of GAM179 include diagnosis, prevention and treatment of diseases and clinical conditions associated with ATP11B.

The function of ATP11B and its association with various diseases and clinical conditions, has been established by previous studies, as described hereinabove with reference to GAM66.2Bactericidal/permeability-increasing protein (BPI, Accession NP_001716.1) is another GAM179 target gene, herein designated TARGET GENE. BPI BINDING SITE is a target binding site found in the 3' untranslated region of mRNA encoded by BPI, corresponding to a target binding site such as BINDING SITE I, BINDING SITE II or BINDING SITE III of FIG. 8. Table 4 illustrates the complementarity of the nucleotide sequences of BPI BINDING SITE, designated SEQ ID:12380, to the nucleotide sequence of GAM179 RNA, herein designated GAM RNA, also designated SEQ ID:300.

Another function of GAM179 is therefore inhibition of Bactericidal/permeability-increasing protein (BPI, Accession NP_001716.1), a gene which is associated with human neutrophil granules and has bactericidal activity on gram-negative organisms. Accordingly, utilities of GAM179 include diagnosis, prevention and treatment of diseases and clinical conditions associated with BPI.

The function of BPI has been established by previous studies. Using oligonucleotides derived from the human BPI protein sequence to screen a human genomic library, Gray et al. (1989) isolated BPI genomic sequence. They screened a dimethyl sulfoxide- induced HL-60 cell cDNA library with oligonucleotides based on the genomic sequence and isolated a full-length human BPI cDNA. The cDNA predicts a 31-amino acid signal peptide followed by a 456-amino acid mature protein. The N-terminal half of the protein, which exhibits the antimicrobial activity, is basic and hydrophilic, whereas the C-terminal half is slightly acidic and contains several potential transmembrane regions. The difference between the calculated molecular mass of 50.6 kD and the experimental mass of approximately 58 kD may reflect the usage of 2 potential N-linked glycosylation sites. Northern blot analysis detected a 2-kb BPI transcript in mRNA prepared from the spleen of a patient with CML (OMIM Ref. No. 151410); a lower level of BPI expression was found in normal spleen, but no BPI expression was detected in normal liver, placenta, or brain. Hubacek et al. (1997) found that the BPI gene spans approximately 31.5 kb of DNA and contains 15 exons. Comparison of the genomic structures of BPI, LBP, PLTP (OMIM Ref. No. 172425), and CETP (OMIM Ref. No. 118470), which constitute a family of functionally related proteins, revealed a remarkable conservation of exon/intron junctions and exon size.

Full details of the abovementioned studies are described in the following publications, the disclosure of which are hereby incorporated by reference:

Gray, P. W.; Flaggs, G.; Leong, S. R.; Gumina, R. J.; Weiss, J.; Ooi, C. E.; Elsbach, P.: Cloning of the cDNA of a human neutrophil bactericidal protein: structural and functional correlations. J. Biol. Chem. 264:9505-9509, 1989; and Hubacek, J. A.; Buchler, C.; Aslanidis, C.; Schmitz, G.: The genomic organization of the genes for human lipopolysaccharide binding protein (LBP) and bactericidal permeability increasin.

Further studies establishing the function and utilities of BPI are found in John Hopkins OMIM database record ID 109195, and in cited publications listed in Table 5, which are hereby incorporated by reference. C14orf92 (Accession NP_055643.1) is another GAM179 target gene, herein designated TARGET GENE. C14orf92 BINDING SITE is a target binding site found in the 3' untranslated region of mRNA encoded by C14orf92, corresponding to a target binding site such as BINDING SITE I, BINDING SITE II or BINDING SITE III of FIG. 8. Table 4 illustrates the complementarity of the nucleotide sequences of C14orf92 BINDING SITE, designated SEQ ID:4439, to the nucleotide sequence of GAM179 RNA, herein designated GAM RNA, also designated SEQ ID:300.

Another function of GAM179 is therefore inhibition of C14orf92 (Accession NP_055643.1). Accordingly, utilities of GAM179 include diagnosis, prevention and treatment of diseases and clinical conditions associated with C14orf92.

Chromosome 20 open reading frame 175 (C20orf175, Accession NP_543019.1) is another GAM179 target gene, herein designated TARGET GENE. C20orf175 BINDING SITE is a target binding site found in the 3' untranslated region of mRNA encoded by C20orf175, corresponding to a target binding site such as BINDING SITE I, BINDING SITE II or BINDING SITE III of FIG. 8. Table 4 illustrates the complementarity of the nucleotide sequences of C20orf175 BINDING SITE, designated SEQ ID:6704, to the nucleotide sequence of GAM179 RNA, herein designated GAM RNA, also designated SEQ ID:300.

Another function of GAM179 is therefore inhibition of Chromosome 20 open reading frame 175 (C20orf175, Accession NP_543019.1). Accordingly, utilities of GAM179 include diagnosis, prevention and treatment of diseases and clinical conditions associated with C20orf175.

C4ST3 (Accession NP_690849.1) is another GAM179 target gene, herein designated TARGET GENE. C4ST3 BINDING SITE is a target binding site found in the 3' untranslated region of mRNA encoded by C4ST3, corresponding to a target binding site such as BINDING SITE I, BINDING SITE II or BINDING SITE III of FIG. 8. Table 4 illustrates the complementarity of the nucleotide sequences of C4ST3 BINDING SITE, designated SEQ ID:3672, to the nucleotide sequence of GAM179 RNA, herein designated GAM RNA, also designated SEQ ID:300.

Another function of GAM179 is therefore inhibition of C4ST3 (Accession NP_690849.1). Accordingly, utilities of GAM179 include diagnosis, prevention and treatment of diseases and clinical conditions associated with C4ST3.

Cyclin t2 (CCNT2, Accession NP_001232.1) is another GAM179 target gene, herein designated TARGET GENE. CCNT2 BINDING SITE is a target binding site found in the 3' untranslated region of multiple transcripts of mRNA encoded by CCNT2, corresponding to a target binding site such as BINDING SITE I, BINDING SITE II or BINDING SITE III of FIG. 8. Table 4 illustrates the complementarity of the nucleotide sequences of CCNT2 BINDING SITE, designated SEQ ID:12201, to the nucleotide sequence of GAM179 RNA, herein designated GAM RNA, also designated SEQ ID:300.

Another function of GAM179 is therefore inhibition of Cyclin t2 (CCNT2, Accession NP_001232.1), a gene which is a regulatory subunit of the cyclin-dependent kinase pair (cdk9/cyclin t) complex. Accordingly, utilities of GAM179 include diagnosis, prevention and treatment of diseases and clinical conditions associated with CCNT2.

The function of CCNT2 has been established by previous studies. Positive transcription elongation factor b (OMIM Ref. No. P-TEFb) is thought to facilitate the transition from abortive to productive elongation by phosphorylating the C-terminal domain (CTD) of the largest subunit of RNA polymerase II (POLR2A; 180660). Drosophila P-TEFb is composed of CDK9 (OMIM Ref. No. 603251) and cyclin T. By searching an EST database for homologs of Drosophila cyclin T, Peng et al. (1998) identified cDNAs encoding human cyclins T1 (OMIM Ref. No. 602506) and T2. Alternative splicing of the primary T2 transcript results in 2 isoforms termed T2a and T2b. The predicted 663-amino acid T2a and 730-amino acid T2b isoforms have different C-termini. Within the conserved N-terminal cyclin box region, cyclin T2 shares 64% and 81% identity with Drosophila cyclin T and human cyclin T1, respectively. Immunoprecipitation studies demonstrated that CDK9 is complexed with the cyclins T1 and T2 in HeLa cell nuclear extracts. Approximately 80% of CDK9 is complexed with cyclin T1, 10% with cyclin T2a and 10% with T2b. Each complex is an active P-TEFb molecule that can phosphorylate the CTD of RNA polymerase II and cause the transition from abortive elongation into productive elongation. When expressed in mammalian cells, all 3 CDK9/cyclin T combinations strongly activated a CMV promoter. Northern blot analysis revealed that cyclin T2 was expressed as multiple mRNAs in all human tissues tested. Yang et al. (2001) identified 7SK snRNA (OMIM Ref. No. 606515) as a specific P-TEFb-associated factor. 7SK inhibits general and HIV-1 Tat-specific transcriptional activities of P-TEFb in vivo and in vitro by inhibiting the kinase activity of CDK9 and preventing recruitment of P-TEFb to the HIV-1 promoter. 7SK is efficiently dissociated from P-TEFb (the CDK9/cyclin T1 heterodimer) by treatment of cells with ultraviolet irradiation and actinomycin D. As these 2 agents have been shown to enhance significantly HIV-1 transcription and phosphorylation of Pol-II, Yang et al. (2001) concluded that their data provide a mechanistic explanation for this stimulatory effect. Yang et al. (2001) further suggested that the 7SK/P- TEFb interaction may serve as a principal control point for the induction of cellular and HIV-1 viral gene expression during stress-related responses. The study demonstrated the involvement of an snRNA in controlling the activity of CDK/cyclin kinase.

Full details of the abovementioned studies are described in the following publications, the disclosure of which are hereby incorporated by reference:

Peng, J.; Zhu, Y.; Milton, J. T.; Price, D. H.: Identification of multiple cyclin subunits of human P-TEFb. Genes Dev. 12:755-762, 1998; and Yang, Z.; Zhu, Q.; Luo, K.; Zhou, Q.: The 7SK small nuclear RNA inhibits the CDK9/cyclin T1 kinase to control transcription. Nature 414:317-322, 2001.

Further studies establishing the function and utilities of CCNT2 are found in John Hopkins OMIM database record ID 603862, and in cited publications listed in Table 5, which are hereby incorporated by reference. Cyclin t2 (CCNT2, Accession NP_490595.1) is another GAM179 target gene, herein designated TARGET GENE. CCNT2 BINDING SITE is a target binding site found in the 3' untranslated region of multiple transcripts of mRNA encoded by CCNT2, corresponding to a target binding site such as BINDING SITE I, BINDING SITE II or BINDING SITE III of FIG. 8. Table 4 illustrates the complementarity of the nucleotide sequences of CCNT2 BINDING SITE, designated SEQ ID:12201, to the nucleotide sequence of GAM179 RNA, herein designated GAM RNA, also designated SEQ ID:300.

Another function of GAM179 is therefore inhibition of Cyclin t2 (CCNT2, Accession NP_490595.1), a gene which is a regulatory subunit of the cyclin-dependent kinase pair (cdk9/cyclin t) complex. Accordingly, utilities of GAM179 include diagnosis, prevention and treatment of diseases and clinical conditions associated with CCNT2.

The function of CCNT2 has been established by previous studies. Positive transcription elongation factor b (OMIM Ref. No. P-TEFb) is thought to facilitate the transition from abortive to productive elongation by phosphorylating the C-terminal domain (CTD) of the largest subunit of RNA polymerase II (POLR2A; 180660). Drosophila P-TEFb is composed of CDK9 (OMIM Ref. No. 603251) and cyclin T. By searching an EST database for homologs of Drosophila cyclin T, Peng et al. (1998) identified cDNAs encoding human cyclins T1 (OMIM Ref. No. 602506) and T2. Alternative splicing of the primary T2 transcript results in 2 isoforms termed T2a and T2b. The predicted 663-amino acid T2a and 730-amino acid T2b isoforms have different C-termini. Within the conserved N-terminal cyclin box region, cyclin T2 shares 64% and 81% identity with Drosophila cyclin T and human cyclin T1, respectively. Immunoprecipitation studies demonstrated that CDK9 is complexed with the cyclins T1 and T2 in HeLa cell nuclear extracts. Approximately 80% of CDK9 is complexed with cyclin T1, 10% with cyclin T2a and 10% with T2b. Each complex is an active P-TEFb molecule that can phosphorylate the CTD of RNA polymerase II and cause the transition from abortive elongation into productive elongation. When expressed in mammalian cells, all 3 CDK9/cyclin T combinations strongly activated a CMV promoter. Northern blot analysis revealed that cyclin T2 was expressed as multiple mRNAs in all human tissues tested. Yang et al. (2001) identified 7SK snRNA (OMIM Ref. No. 606515) as a specific P-TEFb-associated factor. 7SK inhibits general and HIV-1 Tat-specific transcriptional activities of P-TEFb in vivo and in vitro by inhibiting the kinase activity of CDK9 and preventing recruitment of P-TEFb to the HIV-1 promoter. 7SK is efficiently dissociated from P-TEFb (the CDK9/cyclin T1 heterodimer) by treatment of cells with ultraviolet irradiation and actinomycin D. As these 2 agents have been shown to enhance significantly HIV-1 transcription and phosphorylation of Pol-II, Yang et al. (2001) concluded that their data provide a mechanistic explanation for this stimulatory effect. Yang et al. (2001) further suggested that the 7SK/P-TEFb interaction may serve as a principal control point for the induction of cellular and HIV-1 viral gene expression during stress-related responses. The study demonstrated the involvement of an snRNA in controlling the activity of CDK/cyclin kinase.

Full details of the abovementioned studies are described in the following publications, the disclosure of which are hereby incorporated by reference:

Peng, J.; Zhu, Y.; Milton, J. T.; Price, D. H.: Identification of multiple cyclin subunits of human P-TEFb. Genes Dev. 12:755-762, 1998; and Yang, Z.; Zhu, Q.; Luo, K.; Zhou, Q.: The 7SK small nuclear RNA inhibits the CDK9/cyclin T1 kinase to control transcription. Nature 414:317-322, 2001.

Further studies establishing the function and utilities of CCNT2 are found in John Hopkins OMIM database record ID 603862, and in cited publications listed in Table 5, which are hereby incorporated by reference. Cytidine deaminase (CDA, Accession NP_001776.1) is another GAM179 target gene, herein designated TARGET GENE. CDA BINDING SITE is a target binding site found in the 3' untranslated region of mRNA encoded by CDA, corresponding to a target binding site such as BINDING SITE I, BINDING SITE II or BINDING SITE III of FIG. 8. Table 4 illustrates the complementarity of the nucleotide sequences of CDA BINDING SITE, designated SEQ ID:17937, to the nucleotide sequence of GAM179 RNA, herein designated GAM RNA, also designated SEQ ID:300.

Another function of GAM179 is therefore inhibition of Cytidine deaminase (CDA, Accession NP_001776.1). Accordingly, utilities of GAM179 include diagnosis, prevention and treatment of diseases and clinical conditions associated with CDA.

Cysteine-rich protein 1 (intestinal) (CRIP1, Accession NP_001302.1) is another GAM179 target gene, herein designated TARGET GENE. CRIP1 BINDING SITE is a target binding site found in the 3' untranslated region of mRNA encoded by CRIP1, corresponding to a target binding site such as BINDING SITE I, BINDING SITE II or BINDING SITE III of FIG. 8. Table 4 illustrates the complementarity of the nucleotide sequences of CRIP1 BINDING SITE, designated SEQ ID:12094, to the nucleotide sequence of GAM179 RNA, herein designated GAM RNA, also designated SEQ ID:300.

Another function of GAM179 is therefore inhibition of Cysteine-rich protein 1 (intestinal) (CRIP1, Accession NP_001302.1). Accordingly, utilities of GAM179 include diagnosis, prevention and treatment of diseases and clinical conditions associated with CRIP1.

DKFZP434P211 (Accession NP_055364.1) is another GAM179 target gene, herein designated TARGET GENE. DKFZP434P211 BINDING SITE is a target binding site found in the 3' untranslated region of mRNA encoded by DKFZP434P211, corresponding to a target binding site such as BINDING SITE I, BINDING SITE II or BINDING SITE III of FIG. 8. Table 4 illustrates the complementarity of the nucleotide sequences of DKFZP434P211 BINDING SITE, designated SEQ ID:12743, to the nucleotide sequence of GAM179 RNA, herein designated GAM RNA, also designated SEQ ID:300.

Another function of GAM179 is therefore inhibition of DKFZP434P211 (Accession NP_055364.1). Accordingly, utilities of GAM179 include diagnosis, prevention and treatment of diseases and clinical conditions associated with DKFZP434P211.

DKFZp762E1312 (Accession NP_060880.2) is another GAM179 target gene, herein designated TARGET GENE. DKFZp762E1312 BINDING SITE is a target binding site found in the 5' untranslated region of mRNA encoded by DKFZp762E1312, corresponding to a target binding site such as BINDING SITE I, BINDING SITE II or BINDING SITE III of FIG. 8. Table 4 illustrates the complementarity of the nucleotide sequences of DKFZp762E1312 BINDING SITE, designated SEQ ID:9021, to the nucleotide sequence of GAM179 RNA, herein designated GAM RNA, also designated SEQ ID:300.

Another function of GAM179 is therefore inhibition of DKFZp762E1312 (Accession NP_060880.2). Accordingly, utilities of GAM179 include diagnosis, prevention and treatment of diseases and clinical conditions associated with DKFZp762E1312.

DKFZP762N2316 (Accession XP_040560.4) is another GAM179 target gene, herein designated TARGET GENE. DKFZP762N2316 BINDING SITE is a target binding site found in the 3' untranslated region of multiple transcripts of mRNA encoded by DKFZP762N2316, corresponding to a target binding site such as BINDING SITE I, BINDING SITE II or BINDING SITE III of FIG. 8. Table 4 illustrates the complementarity of the nucleotide sequences of DKFZP762N2316 BINDING SITE, designated SEQ ID:10781, to the nucleotide sequence of GAM179 RNA, herein designated GAM RNA, also designated SEQ ID:300.

Another function of GAM179 is therefore inhibition of DKFZP762N2316 (Accession XP_040560.4). Accordingly, utilities of GAM179 include diagnosis, prevention and treatment of diseases and clinical conditions associated with DKFZP762N2316.

Dynein, axonemal, light polypeptide 4 (DNAL4, Accession NP_005731.1) is another GAM179 target gene, herein designated TARGET GENE. DNAL4 BINDING SITE is a target binding site found in the 3' untranslated region of mRNA encoded by DNAL4, corresponding to a target binding site such as BINDING SITE I, BINDING SITE II or BINDING SITE III of FIG. 8. Table 4 illustrates the complementarity of the nucleotide sequences of DNAL4 BINDING SITE, designated SEQ ID:2920, to the nucleotide sequence of GAM179 RNA, herein designated GAM RNA, also designated SEQ ID:300.

Another function of GAM179 is therefore inhibition of Dynein, axonemal, light polypeptide 4 (DNAL4, Accession NP_005731.1). Accordingly, utilities of GAM179 include diagnosis, prevention and treatment of diseases and clinical conditions associated with DNAL4.

Deoxynucleotidyltransferase, terminal (DNTT, Accession NP_004079.2) is another GAM179 target gene, herein designated TARGET GENE. DNTT BINDING SITE is a target binding site found in the 5' untranslated region of mRNA encoded by DNTT, corresponding to a target binding site such as BINDING SITE I, BINDING SITE II or BINDING SITE III of FIG. 8. Table 4 illustrates the complementarity of the nucleotide sequences of DNTT BINDING SITE, designated SEQ ID:13119, to the nucleotide sequence of GAM179 RNA, herein designated GAM RNA, also designated SEQ ID:300.

Another function of GAM179 is therefore inhibition of Deoxynucleotidyltransferase, terminal (DNTT, Accession NP_004079.2), a gene which is terminal deoxynucleotidyl transferase. Accordingly, utilities of GAM179 include diagnosis, prevention and treatment of diseases and clinical conditions associated with DNTT.

The function of DNTT and its association with various diseases and clinical conditions, has been established by previous studies, as described hereinabove with reference to GAM129.1. Docking protein 4 (DOK4, Accession NP_060580.2) is another GAM179 target gene, herein designated TARGET GENE. DOK4 BINDING SITE is a target binding site found in the 3' untranslated region of mRNA encoded by DOK4, corresponding to a target binding site such as BINDING SITE I, BINDING SITE II or BINDING SITE III of FIG. 8. Table 4 illustrates the complementarity of the nucleotide sequences of DOK4 BINDING SITE, designated SEQ ID:15066, to the nucleotide sequence of GAM179 RNA, herein designated GAM RNA, also designated SEQ ID:300.

Another function of GAM179 is therefore inhibition of Docking protein 4 (DOK4, Accession NP_060580.2). Accordingly, utilities of GAM179 include diagnosis, prevention and treatment of diseases and clinical conditions associated with DOK4.

Down syndrome critical region gene 1 (DSCR1, Accession NP_004405.2) is another GAM179 target gene, herein designated TARGET GENE. DSCR1 BINDING SITE is a target binding site found in the 3' untranslated region of mRNA encoded by DSCR1, corresponding to a target binding site such as BINDING SITE I, BINDING SITE II or BINDING SITE III of FIG. 8. Table 4 illustrates the complementarity of the nucleotide sequences of DSCR1 BINDING SITE, designated SEQ ID:18056, to the nucleotide sequence of GAM179 RNA, herein designated GAM RNA, also designated SEQ ID:300.

Another function of GAM179 is therefore inhibition of Down syndrome critical region gene 1 (DSCR1, Accession NP_004405.2), a gene which inhibits calcineurin-dependent transcriptional responses. Accordingly, utilities of GAM179 include diagnosis, prevention and treatment of diseases and clinical conditions associated with DSCR1.

The function of DSCR1 and its association with various diseases and clinical conditions, has been established by previous studies, as described hereinabove with reference to GAM96.1. Ectodermal dysplasia 1, anhidrotic (ED1, Accession NP_001390.1) is another GAM179 target gene, herein designated TARGET GENE. ED1 BINDING SITE is a target binding site found in the 3' untranslated region of mRNA encoded by ED1, corresponding to a target binding site such as BINDING SITE I, BINDING SITE II or BINDING SITE III of FIG. 8. Table 4 illustrates the complementarity of the nucleotide sequences of ED1 BINDING SITE, designated SEQ ID:7504, to the nucleotide sequence of GAM179 RNA, herein designated GAM RNA, also designated SEQ ID:300.

Another function of GAM179 is therefore inhibition of Ectodermal dysplasia 1, anhidrotic (ED1, Accession NP_001390.1). Accordingly, utilities of GAM179 include diagnosis, prevention and treatment of diseases and clinical conditions associated with ED1.

Fibulin 1 (FBLN1, Accession NP_006476.1) is another GAM179 target gene, herein designated TARGET GENE. FBLN1 BINDING SITE is a target binding site found in the 3' untranslated region of multiple transcripts of mRNA encoded by FBLN1, corresponding to a target binding site such as BINDING SITE I, BINDING SITE II or BINDING SITE III of FIG. 8. Table 4 illustrates the complementarity of the nucleotide sequences of FBLN1 BINDING SITE, designated SEQ ID:9477, to the nucleotide sequence of GAM179 RNA, herein designated GAM RNA, also designated SEQ ID:300.

Another function of GAM179 is therefore inhibition of Fibulin 1 (FBLN1, Accession NP_006476.1), a gene which secreted glycoprotein; has EGF-like repeats, similar to anaphylatoxins C3a, C4a, and C5a. Accordingly, utilities of GAM179 include diagnosis, prevention and treatment of diseases and clinical conditions associated with FBLN1.

The function of FBLN1 has been established by previous studies. Fibulin-1 was first described as an integrin-binding fibulin from human placenta by Argraves et al. (1989), who found that it is a secreted glycoprotein that becomes incorporated into a fibrillar extracellular matrix when expressed in cultured cells or added exogenously to cell monolayers. Preliminary electron microscopic data suggested a rod-like structure for fibulin-1, consistent with the sequence predictions. Calcium-binding to fibulin-1 is apparently required to mediate its binding to laminin and nidogen (OMIM Ref. No. 131390). By in situ hybridization of tritium- labeled cDNA probes, Mattei et al. (1994) assigned the human FBLN1 gene to 22q13.2-q13.3 and assigned its counterpart in mouse to the E- F band of chromosome 15. Korenberg et al. (1995) assigned the FBLN1 gene to 22q13.3 by fluorescence in situ hybridization.

Full details of the abovementioned studies are described in the following publications, the disclosure of which are hereby incorporated by reference:

Korenberg, J. R.; Chen, X.-N.; Tran, H.; Argraves, W. S.: Localization of the human gene for fibulin-1 (FBLN1) to chromosome band 22q13.3. Cytogenet. Cell Genet. 68:192-193, 1995; and Mattei, M.-G.; Pan, T.-C.; Zhang, R.-Z.; Timpl, R.; Chu, M.-L.: The fibulin- 1 gene (FBLN1) is located on human chromosome 22 and on mouse chromosome 15. Genomics 22:437-438, 1994.

Further studies establishing the function and utilities of FBLN1 are found in John Hopkins OMIM database record ID 135820, and in cited publications listed in Table 5, which are hereby incorporated by reference. FLJ10116 (Accession NP_060470.1) is another GAM179 target gene, herein designated TARGET GENE. FLJ10116 BINDING SITE is a target binding site found in the 3' untranslated region of mRNA encoded by FLJ10116, corresponding to a target binding site such as BINDING SITE I, BINDING SITE II or BINDING SITE III of FIG. 8. Table 4 illustrates the complementarity of the nucleotide sequences of FLJ10116 BINDING SITE, designated SEQ ID:18159, to the nucleotide sequence of GAM179 RNA, herein designated GAM RNA, also designated SEQ ID:300.

Another function of GAM179 is therefore inhibition of FLJ10116 (Accession NP_060470.1). Accordingly, utilities of GAM179 include diagnosis, prevention and treatment of diseases and clinical conditions associated with FLJ10116.

FLJ10307 (Accession NP_060523.2) is another GAM179 target gene, herein designated TARGET GENE. FLJ10307 BINDING SITE is a target binding site found in the 3' untranslated region of mRNA encoded by FLJ10307, corresponding to a target binding site such as BINDING SITE I, BINDING SITE II or BINDING SITE III of FIG. 8. Table 4 illustrates the complementarity of the nucleotide sequences of FLJ10307 BINDING SITE, designated SEQ ID:16190, to the nucleotide sequence of GAM179 RNA, herein designated GAM RNA, also designated SEQ ID:300.

Another function of GAM179 is therefore inhibition of FLJ10307 (Accession NP_060523.2). Accordingly, utilities of GAM179 include diagnosis, prevention and treatment of diseases and clinical conditions associated with FLJ10307.

FLJ10462 (Accession NP_060569.3) is another GAM179 target gene, herein designated TARGET GENE. FLJ10462 BINDING SITE is a target binding site found in the 5' untranslated region of mRNA encoded by FLJ10462, corresponding to a target binding site such as BINDING SITE I, BINDING SITE II or BINDING SITE III of FIG. 8. Table 4 illustrates the complementarity of the nucleotide sequences of FLJ10462 BINDING SITE, designated SEQ ID:9026, to the nucleotide sequence of GAM179 RNA, herein designated GAM RNA, also designated SEQ ID:300.

Another function of GAM179 is therefore inhibition of FLJ10462 (Accession NP_060569.3). Accordingly, utilities of GAM179 include diagnosis, prevention and treatment of diseases and clinical conditions associated with FLJ10462.

FLJ13215 (Accession NP_079280.1) is another GAM179 target gene, herein designated TARGET GENE. FLJ13215 BINDING SITE is a target binding site found in the 3' untranslated region of mRNA encoded by FLJ13215, corresponding to a target binding site such as BINDING SITE I, BINDING SITE II or BINDING SITE III of FIG. 8. Table 4 illustrates the complementarity of the nucleotide sequences of FLJ13215 BINDING SITE, designated SEQ ID:11648, to the nucleotide sequence of GAM179 RNA, herein designated GAM RNA, also designated SEQ ID:300.

Another function of GAM179 is therefore inhibition of FLJ13215 (Accession NP_079280.1). Accordingly, utilities of GAM179 include diagnosis, prevention and treatment of diseases and clinical conditions associated with FLJ13215.

FLJ13615 (Accession NP_079390.1) is another GAM179 target gene, herein designated TARGET GENE. FLJ13615 BINDING SITE is a target binding site found in the 3' untranslated region of mRNA encoded by FLJ13615, corresponding to a target binding site such as BINDING SITE I, BINDING SITE II or BINDING SITE III of FIG. 8. Table 4 illustrates the complementarity of the nucleotide sequences of FLJ13615 BINDING SITE, designated SEQ ID:10037, to the nucleotide sequence of GAM179 RNA, herein designated GAM RNA, also designated SEQ ID:300.

Another function of GAM179 is therefore inhibition of FLJ13615 (Accession NP_079390.1). Accordingly, utilities of GAM179 include diagnosis, prevention and treatment of diseases and clinical conditions associated with FLJ13615.

FLJ13782 (Accession NP_079191.1) is another GAM179 target gene, herein designated TARGET GENE. FLJ13782 BINDING SITE is a target binding site found in the 3' untranslated region of mRNA encoded by FLJ13782, corresponding to a target binding site such as BINDING SITE I, BINDING SITE II or BINDING SITE III of FIG. 8. Table 4 illustrates the complementarity of the nucleotide sequences of FLJ13782 BINDING SITE, designated SEQ ID:9784, to the nucleotide sequence of GAM179 RNA, herein designated GAM RNA, also designated SEQ ID:300.

Another function of GAM179 is therefore inhibition of FLJ13782 (Accession NP_079191.1). Accordingly, utilities of GAM179 include diagnosis, prevention and treatment of diseases and clinical conditions associated with FLJ13782.

FLJ13841 (Accession NP_078978.1) is another GAM179 target gene, herein designated TARGET GENE. FLJ13841 BINDING SITE is a target binding site found in the 5' untranslated region of mRNA encoded by FLJ13841, corresponding to a target binding site such as BINDING SITE I, BINDING SITE II or BINDING SITE III of FIG. 8. Table 4 illustrates the complementarity of the nucleotide sequences of FLJ13841 BINDING SITE, designated SEQ ID:15474, to the nucleotide sequence of GAM179 RNA, herein designated GAM RNA, also designated SEQ ID:300.

Another function of GAM179 is therefore inhibition of FLJ13841 (Accession NP_078978.1). Accordingly, utilities of GAM179 include diagnosis, prevention and treatment of diseases and clinical conditions associated with FLJ13841.

FLJ20574 (Accession NP_060356.1) is another GAM179 target gene, herein designated TARGET GENE. FLJ20574 BINDING SITE is a target binding site found in the 3' untranslated region of mRNA encoded by FLJ20574, corresponding to a target binding site such as BINDING SITE I, BINDING SITE II or BINDING SITE III of FIG. 8. Table 4 illustrates the complementarity of the nucleotide sequences of FLJ20574 BINDING SITE, designated SEQ ID:6230, to the nucleotide sequence of GAM179 RNA, herein designated GAM RNA, also designated SEQ ID:300.

Another function of GAM179 is therefore inhibition of FLJ20574 (Accession NP_060356.1). Accordingly, utilities of GAM179 include diagnosis, prevention and treatment of diseases and clinical conditions associated with FLJ20574.

FLJ21870 (Accession NP_075392.1) is another GAM179 target gene, herein designated TARGET GENE. FLJ21870 BINDING SITE is a target binding site found in the 3' untranslated region of mRNA encoded by FLJ21870, corresponding to a target binding site such as BINDING SITE I, BINDING SITE II or BINDING SITE III of FIG. 8. Table 4 illustrates the complementarity of the nucleotide sequences of FLJ21870 BINDING SITE, designated SEQ ID:4419, to the nucleotide sequence of GAM179 RNA, herein designated GAM RNA, also designated SEQ ID:300.

Another function of GAM179 is therefore inhibition of FLJ21870 (Accession NP_075392.1). Accordingly, utilities of GAM179 include diagnosis, prevention and treatment of diseases and clinical conditions associated with FLJ21870.

FLJ31300 (Accession NP_653240.1) is another GAM179 target gene, herein designated TARGET GENE. FLJ31300 BINDING SITE is a target binding site found in the 3' untranslated region of mRNA encoded by FLJ31300, corresponding to a target binding site such as BINDING SITE I, BINDING SITE II or BINDING SITE III of FIG. 8. Table 4 illustrates the complementarity of the nucleotide sequences of FLJ31300 BINDING SITE, designated SEQ ID:792, to the nucleotide sequence of GAM179 RNA, herein designated GAM RNA, also designated SEQ ID:300.

Another function of GAM179 is therefore inhibition of FLJ31300 (Accession NP_653240.1). Accordingly, utilities of GAM179 include diagnosis, prevention and treatment of diseases and clinical conditions associated with FLJ31300.

FLJ32934 (Accession NP_653223.1) is another GAM179 target gene, herein designated TARGET GENE. FLJ32934 BINDING SITE is a target binding site found in the 3' untranslated region of mRNA encoded by FLJ32934, corresponding to a target binding site such as BINDING SITE I, BINDING SITE II or BINDING SITE III of FIG. 8. Table 4 illustrates the complementarity of the nucleotide sequences of FLJ32934 BINDING SITE, designated SEQ ID:19512, to the nucleotide sequence of GAM179 RNA, herein designated GAM RNA, also designated SEQ ID:300.

Another function of GAM179 is therefore inhibition of FLJ32934 (Accession NP_653223.1). Accordingly, utilities of GAM179 include diagnosis, prevention and treatment of diseases and clinical conditions associated with FLJ32934.

FLJ36000 (Accession NP_787101.1) is another GAM179 target gene, herein designated TARGET GENE. FLJ36000 BINDING SITE is a target binding site found in the 3' untranslated region of mRNA encoded by FLJ36000, corresponding to a target binding site such as BINDING SITE I, BINDING SITE II or BINDING SITE III of FIG. 8. Table 4 illustrates the complementarity of the nucleotide sequences of FLJ36000 BINDING SITE, designated SEQ ID:6917, to the nucleotide sequence of GAM179 RNA, herein designated GAM RNA, also designated SEQ ID:300.

Another function of GAM179 is therefore inhibition of FLJ36000 (Accession NP_787101.1). Accordingly, utilities of GAM179 include diagnosis, prevention and treatment of diseases and clinical conditions associated with FLJ36000.

FLJ38607 (Accession NP_689867.1) is another GAM179 target gene, herein designated TARGET GENE. FLJ38607 BINDING SITE is a target binding site found in the 3' untranslated region of mRNA encoded by FLJ38607, corresponding to a target binding site such as BINDING SITE I, BINDING SITE II or BINDING SITE III of FIG. 8. Table 4 illustrates the complementarity of the nucleotide sequences of FLJ38607 BINDING SITE, designated SEQ ID:8910, to the nucleotide sequence of GAM179 RNA, herein designated GAM RNA, also designated SEQ ID:300.

Another function of GAM179 is therefore inhibition of FLJ38607 (Accession NP_689867.1). Accordingly, utilities of GAM179 include diagnosis, prevention and treatment of diseases and clinical conditions associated with FLJ38607.

FLJ39005 (Accession NP_848616.1) is another GAM179 target gene, herein designated TARGET GENE. FLJ39005 BINDING SITE is a target binding site found in the 3' untranslated region of mRNA encoded by FLJ39005, corresponding to a target binding site such as BINDING SITE I, BINDING SITE II or BINDING SITE III of FIG. 8. Table 4 illustrates the complementarity of the nucleotide sequences of FLJ39005 BINDING SITE, designated SEQ ID:11931, to the nucleotide sequence of GAM179 RNA, herein designated GAM RNA, also designated SEQ ID:300.

Another function of GAM179 is therefore inhibition of FLJ39005 (Accession NP_848616.1). Accordingly, utilities of GAM179 include diagnosis, prevention and treatment of diseases and clinical conditions associated with FLJ39005.

FLJ90798 (Accession NP_699198.1) is another GAM179 target gene, herein designated TARGET GENE. FLJ90798 BINDING SITE is a target binding site found in the 3' untranslated region of mRNA encoded by FLJ90798, corresponding to a target binding site such as BINDING SITE I, BINDING SITE II or BINDING SITE III of FIG. 8. Table 4 illustrates the complementarity of the nucleotide sequences of FLJ90798 BINDING SITE, designated SEQ ID:660, to the nucleotide sequence of GAM179 RNA, herein designated GAM RNA, also designated SEQ ID:300.

Another function of GAM179 is therefore inhibition of FLJ90798 (Accession NP_699198.1). Accordingly, utilities of GAM179 include diagnosis, prevention and treatment of diseases and clinical conditions associated with FLJ90798.

G protein-coupled receptor 48 (GPR48, Accession NP_060960.1) is another GAM179 target gene, herein designated TARGET GENE. GPR48 BINDING SITE is a target binding site found in the 3' untranslated region of mRNA encoded by GPR48, corresponding to a target binding site such as BINDING SITE I, BINDING SITE II or BINDING SITE III of FIG. 8. Table 4 illustrates the complementarity of the nucleotide sequences of GPR48 BINDING SITE, designated SEQ ID:14773, to the nucleotide sequence of GAM179 RNA, herein designated GAM RNA, also designated SEQ ID:300.

Another function of GAM179 is therefore inhibition of G protein-coupled receptor 48 (GPR48, Accession NP_060960.1), a gene which binds to follicle-stimulating hormone and thyroid-stimulating hormone. Accordingly, utilities of GAM179 include diagnosis, prevention and treatment of diseases and clinical conditions associated with GPR48.

The function of GPR48 has been established by previous studies. By EST database searching with known GPCRs as queries, Hsu et al. (1998) identified ESTs encoding transmembrane domains 4 and 5 of human GPR48, which they called LGR4. By RT-PCR and repeated screening of a rat ovary cDNA library, they isolated a full-length cDNA encoding rat Lgr4. Sequence analysis predicted that the 951-amino acid rat Lgr4 protein contains a signal peptide; N- and C-flanking cysteine-rich sequences separated by 17 LRRs; 5 potential N-glycosylation sites; a transmembrane region; and a 145-residue cytoplasmic tail with multiple phosphorylation sites and a conserved potential protein kinase A (see OMIM Ref. No. 176911) phosphorylation site. Northern blot analysis of human tissues detected a 5.5-kb LGR4 transcript in multiple steroidogenic tissues and in a number of other tissues. Functional analysis showed that expression of a chimeric receptor composed of the extracellular domain of luteinizing hormone receptor (OMIM Ref. No. 152790) with the transmembrane and cytoplasmic domains of Lgr4 resulted in binding of hCG (OMIM Ref. No. 118860) but no increase in basal production of cAMP, suggesting that LGR4 may signal through another mechanism. Loh et al. (2001) cloned human GPR48. Like rat Lgr4, the deduced human GPR48 protein has 951 amino acids and a similar structure. Northern blot analysis detected wide expression of GPR48 that was highest in pancreas. Within brain, highest expression of GPR48 was in hippocampus and amygdala. Expression of Gpr48 in mouse embryos occurred as early as embryonic day 7 and peaked at day 15.

Full details of the abovementioned studies are described in the following publications, the disclosure of which are hereby incorporated by reference:

Hsu, S. Y.; Liang, S.-G.; Hsueh, A. J. W.: Characterization of two LGR genes homologous to gonadotropin and thyrotropin receptors with extracellular leucine-rich repeats and a G protein-coupled, seven-transmembrane region. Molec. Endocr. 12:1830-1845, 1998; and Loh, E. D.; Broussard, S. R.; Kolakowski, L. F.: Molecular characterization of a novel glycoprotein hormone G-protein-coupled receptor. Biochem. Biophys. Res. Commun. 282: 757-764, 2001.

Further studies establishing the function and utilities of GPR48 are found in John Hopkins OMIM database record ID 606666, and in cited publications listed in Table 5, which are hereby incorporated by reference. Grip1 associated protein 1 (GRIPAP1, Accession NP_064522.2) is another GAM179 target gene, herein designated TARGET GENE. GRIPAP1 BINDING SITE is a target binding site found in the 3' untranslated region of mRNA encoded by GRIPAP1, corresponding to a target binding site such as BINDING SITE I, BINDING SITE II or BINDING SITE III of FIG. 8. Table 4 illustrates the complementarity of the nucleotide sequences of GRIPAP1 BINDING SITE, designated SEQ ID:19328, to the nucleotide sequence of GAM179 RNA, herein designated GAM RNA, also designated SEQ ID:300.

Another function of GAM179 is therefore inhibition of Grip1 associated protein 1 (GRIPAP1, Accession NP_064522.2). Accordingly, utilities of GAM179 include diagnosis, prevention and treatment of diseases and clinical conditions associated with GRIPAP1.

Hyaluronan binding protein 2 (HABP2, Accession NP_004123.1) is another GAM179 target gene, herein designated TARGET GENE. HABP2 BINDING SITE is a target binding site found in the 3' untranslated region of mRNA encoded by HABP2, corresponding to a target binding site such as BINDING SITE I, BINDING SITE II or BINDING SITE III of FIG. 8. Table 4 illustrates the complementarity of the nucleotide sequences of HABP2 BINDING SITE, designated SEQ ID:17826, to the nucleotide sequence of GAM179 RNA, herein designated GAM RNA, also designated SEQ ID:300.

Another function of GAM179 is therefore inhibition of Hyaluronan binding protein 2 (HABP2, Accession NP_004123.1). Accordingly, utilities of GAM179 include diagnosis, prevention and treatment of diseases and clinical conditions associated with HABP2.

Interleukin 16 (lymphocyte chemoattractant factor) (IL16, Accession NP_004504.3) is another GAM179 target gene, herein designated TARGET GENE. IL16 BINDING SITE is a target binding site found in the 3' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:9723, to the nucleotide sequence of GAM179 RNA, herein designated GAM RNA, also designated SEQ ID:300.

Another function of GAM179 is therefore inhibition of Interleukin 16 (lymphocyte chemoattractant factor) (IL16, Accession NP_004504.3), a gene which modulates T-cell activation. Accordingly, utilities of GAM179 include diagnosis, prevention and treatment of diseases and clinical conditions associated with IL16.

The function of IL16 and its association with various diseases and clinical conditions, has been established by previous studies, as described hereinabove with reference to GAM66.1. Interleukin 16 (lymphocyte chemoattractant factor) (IL16, Accession NP_757366.1) is another GAM179 target gene, herein designated TARGET GENE. IL16 BINDING SITE is a target binding site found in the 3' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:9723, to the nucleotide sequence of GAM179 RNA, herein designated GAM RNA, also designated SEQ ID:300.

Another function of GAM179 is therefore inhibition of Interleukin 16 (lymphocyte chemoattractant factor) (IL16, Accession NP_757366.1), a gene which modulates T-cell activation. Accordingly, utilities of GAM179 include diagnosis, prevention and treatment of diseases and clinical conditions associated with IL16.

The function of IL16 and its association with various diseases and clinical conditions, has been established by previous studies, as described hereinabove with reference to GAM66.1. Interleukin 1, beta (IL1B, Accession NP_000567.1) is another GAM179 target gene, herein designated TARGET GENE. IL1B BINDING SITE is a target binding site found in the 3' untranslated region of mRNA encoded by IL1B, corresponding to a target binding site such as BINDING SITE I, BINDING SITE II or BINDING SITE III of FIG. 8. Table 4 illustrates the complementarity of the nucleotide sequences of IL1B BINDING SITE, designated SEQ ID:4722, to the nucleotide sequence of GAM179 RNA, herein designated GAM RNA, also designated SEQ ID:300.

Another function of GAM179 is therefore inhibition of Interleukin 1, beta (IL1B, Accession NP_000567.1), a gene which stimulates thymocyte proliferation. and therefore may be associated with Gastric cancer risk after h. pylori infection. Accordingly, utilities of GAM179 include diagnosis, prevention and treatment of Gastric cancer risk after h. pylori infection, and of other diseases and clinical conditions associated with IL1B.

The function of IL1B has been established by previous studies. Interleukin-1, produced mainly by blood monocytes, mediates the panoply of host reactions collectively known as acute phase response. It is identical to endogenous pyrogen. The multiple biologic activities that define IL1 are properties of a 15- to 18-kD protein that is derived from a 30- to 35-kD precursor. El- Omar et al. (2000) reported that interleukin-1 gene cluster polymorphisms suspected of enhancing production of interleukin-1-beta are associated with an increased risk of both hypochlorhydria induced by Helicobacter pylori and gastric cancer. Two of these polymorphisms are in near-complete linkage disequilibrium, and 1 is a TATA-box polymorphism that markedly affects DNA-protein interactions in vitro. The association with disease may be explained by the biologic properties of interleukin-1-beta, which is an important proinflammatory cytokine and a powerful inhibitor of gastric acid secretion. Host genetic factors that affect interleukin-1-beta may determine why some individuals infected with H. pylori develop gastric cancer while others do not. IL1-beta is upregulated in the presence of H. pylori and is important in initiating and amplifying the inflammatory response to this infection. Three diallelic polymorphisms in IL1B have been reported, all representing C- to - T base transitions, at positions -511, -31, and +3954 basepairs from the transcriptional start site. To determine whether these polymorphisms are important with respect to different outcomes of H. pylori infections, El-Omar et al. (2000) studied their effects on gastric physiology in healthy subjects. Carriers of the ILB -31T allele (147720.0001) had an age-adjusted odds ratio of 9.1 (95% confidence interval, 2.2-37) for low acid secretion, and there was little difference between homozygous and heterozygous carriers. The IL1B +3954 genotype was not associated with the risk of hypochlorhydria. Carriers of IL1B -31T had an increased gastric cancer risk at an odds ratio of 1.9 (95% confidence interval, 1.5-2.6), with no significant difference between homozygotes and heterozygotes Hamajima et al. (2001) determined that the C- to - T transition at position -31, creating a TATA box, is associated with vulnerability to persistent H. pylori infection, and that the susceptibility is modified by smoking Animal model experiments lend further support to the function of IL1B. Mature IL1-beta levels are a sensitive and specific indicator of caspase-1 (OMIM Ref. No. 147678) activation. Ona et al. (1999) studied the effect of inhibition of caspase-1 on the progression of Huntington disease (OMIM Ref. No. 143100) in the mouse model developed by Mangiarini et al. (1996), which they called R6/2 mice. Ona et al. (1999) crossed R6/2 mice with a well-characterized transgenic mouse strain expressing a dominant-negative mutant of caspase-1 in the brain (NSE M17Z). Double mutant mice showed extended survival and delayed appearance of neuronal inclusions, neurotransmitter receptor alterations, and onset of symptoms, indicating that caspase-1 is important in the pathogenesis of Huntington disease. Mature IL1-beta levels in R6/2 mice were elevated to 268% of those in wildtype controls. This increase was significantly inhibited in the R6/2-NSE M17Z mice. IL1-beta levels in the brains of human patients also exhibited significant increases, to 213% of those in normal controls It is appreciated that the abovementioned animal model for IL1B is acknowledged by those skilled in the art as a scientifically valid animal model, as can be further appreciated from the publications sited hereinbelow.

Full details of the abovementioned studies are described in the following publications, the disclosure of which are hereby incorporated by reference:

El-Omar, E. M.; Carrington, M.; Chow, W.-H.; McColl, K. E. L.; Bream, J. H.; Young, H. A.; Herrera, J.; Lissowska, J.; Yuan, C.-C.; Rothman, N.; Lanyon, G.; Martin, M.; Fraumeni, J. F., Jr.; Rabkin, C. S.: Interleukin-1 polymorphisms associated with increased risk of gastric cancer. Nature 404: 398-402, 2000. Note: Erratum: Nature 412:99 only, 2001; and Ona, V. O.; Li, M.; Vonsattel, J. P. G.; Andrews, L. J.; Khan, S. Q.; Chung, W. M.; Frey, A. S.; Menon, A. S.; Li, X.-J.; Stieg, P. E.; Yuan, J.; Penney, J. B.; Young, A. B.; Cha, J.-H.

Further studies establishing the function and utilities of IL1B are found in John Hopkins OMIM database record ID 147720, and in cited publications listed in Table 5, which are hereby incorporated by reference. Iq motif containing gtpase activating protein 1 (IQGAP1, Accession NP_003861.1) is another GAM179 target gene, herein designated TARGET GENE. IQGAP1 BINDING SITE is a target binding site found in the 5' untranslated region of mRNA encoded by IQGAP1, corresponding to a target binding site such as BINDING SITE I, BINDING SITE II or BINDING SITE III of FIG. 8. Table 4 illustrates the complementarity of the nucleotide sequences of IQGAP1 BINDING SITE, designated SEQ ID:17358, to the nucleotide sequence of GAM179 RNA, herein designated GAM RNA, also designated SEQ ID:300.

Another function of GAM179 is therefore inhibition of Iq motif containing gtpase activating protein 1 (IQGAP1, Accession NP_003861.1), a gene which inhibits GTPase activity of ras family of GTP binding proteins Cdc42Hs and rac. Accordingly, utilities of GAM179 include diagnosis, prevention and treatment of diseases and clinical conditions associated with IQGAP1.

The function of IQGAP1 has been established by previous studies. Sugimoto et al. (2001) demonstrated that IQGAP1, a negative regulator of cell-cell adhesion, is upregulated by gene amplification at 15q26 in 2 gastric cancer cell lines. Amplification at 15q26 had been found in various malignancies, including breast cancers, and FES (OMIM Ref. No. 190030) and/or IGF1R (OMIM Ref. No. 147370) had been identified as targets for gene amplification in breast cancer, melanoma, and pancreatic adenocarcinoma. In contrast, Sugimoto et al. (2001) found that both genes are located telomeric to the amplicon at 15q26 in the 2 gastric cancer cell lines they studied. Fukata et al. (2002) found that IQGAP1, an effector of RAC1 (OMIM Ref. No. 602048) and CDC42, interacts with CLIP170 (RSN; 179838). In Vero fibroblasts, IQGAP1 localized at the polarized leading edge. Expression of a C-terminal fragment of IQGAP1 that included the CLIP170-binding region delocalized GFP-CLIP170 from the tips of microtubules and altered the microtubule array. The authors found that activated RAC1/CDC42, IQGAP1, and CLIP170 form a tripartite complex. Furthermore, expression of an IQGAP1 mutant defective in RAC1/CDC42 binding induced multiple leading edges. These results indicated that RAC1/CDC42 marks special cortical spots where the IQGAP1 and CLIP170 complex is targeted, leading to a polarized microtubule array and cell polarization Full details of the abovementioned studies are described in the following publications, the disclosure of which are hereby incorporated by reference:

Fukata, M.; Watanabe, T.; Noritake, J.; Nakagawa, M.; Yamaga, M.; Kuroda, S.; Matsuura, Y.; Iwamatsu, A.; Perez, F.; Kaibuchi, K.: Rac1 and Cdc42 capture microtubules through IQGAP1 and CLIP-170. Cell 109:873-885, 2002; and Hart, M. J.; Callow, M. G.; Souza, B.; Polakis, P.: IQGAP1, a calmodulin-binding protein with a rasGAP-related domain, is a potential effector for cdc42Hs. EMBO J. 15:2997-3005, 1996.

Further studies establishing the function and utilities of IQGAP1 are found in John Hopkins OMIM database record ID 603379, and in cited publications listed in Table 5, which are hereby incorporated by reference. Potassium channel, subfamily k, member 4 (KCNK4, Accession NP_201567.1) is another GAM179 target gene, herein designated TARGET GENE. KCNK4 BINDING SITE is a target binding site found in the 3' untranslated region of multiple transcripts of mRNA encoded by KCNK4, corresponding to a target binding site such as BINDING SITE I, BINDING SITE II or BINDING SITE III of FIG. 8. Table 4 illustrates the complementarity of the nucleotide sequences of KCNK4 BINDING SITE, designated SEQ ID:3257, to the nucleotide sequence of GAM179 RNA, herein designated GAM RNA, also designated SEQ ID:300.

Another function of GAM179 is therefore inhibition of Potassium channel, subfamily k, member 4 (KCNK4, Accession NP_201567.1). Accordingly, utilities of GAM179 include diagnosis, prevention and treatment of diseases and clinical conditions associated with KCNK4.

Potassium channel, subfamily k, member 4 (KCNK4, Accession NP_057695.2) is another GAM179 target gene, herein designated TARGET GENE. KCNK4 BINDING SITE is a target binding site found in the 3' untranslated region of multiple transcripts of mRNA encoded by KCNK4, corresponding to a target binding site such as BINDING SITE I, BINDING SITE II or BINDING SITE III of FIG. 8. Table 4 illustrates the complementarity of the nucleotide sequences of KCNK4 BINDING SITE, designated SEQ ID:3257, to the nucleotide sequence of GAM179 RNA, herein designated GAM RNA, also designated SEQ ID:300.

Another function of GAM179 is therefore inhibition of Potassium channel, subfamily k, member 4 (KCNK4, Accession NP_057695.2). Accordingly, utilities of GAM179 include diagnosis, prevention and treatment of diseases and clinical conditions associated with KCNK4.

Potassium channel, subfamily k, member 4 (KCNK4, Accession NP_201568.1) is another GAM179 target gene, herein designated TARGET GENE. KCNK4 BINDING SITE is a target binding site found in the 3' untranslated region of multiple transcripts of mRNA encoded by KCNK4, corresponding to a target binding site such as BINDING SITE I, BINDING SITE II or BINDING SITE III of FIG. 8. Table 4 illustrates the complementarity of the nucleotide sequences of KCNK4 BINDING SITE, designated SEQ ID:3257, to the nucleotide sequence of GAM179 RNA, herein designated GAM RNA, also designated SEQ ID:300.

Another function of GAM179 is therefore inhibition of Potassium channel, subfamily k, member 4 (KCNK4, Accession NP_201568.1). Accordingly, utilities of GAM179 include diagnosis, prevention and treatment of diseases and clinical conditions associated with KCNK4.

KIAA0286 (Accession XP_043118.3) is another GAM179 target gene, herein designated TARGET GENE. KIAA0286 BINDING SITE is a target binding site found in the 3' untranslated region of mRNA encoded by KIAA0286, corresponding to a target binding site such as BINDING SITE I, BINDING SITE II or BINDING SITE III of FIG. 8. Table 4 illustrates the complementarity of the nucleotide sequences of KIAA0286 BINDING SITE, designated SEQ ID:12582, to the nucleotide sequence of GAM179 RNA, herein designated GAM RNA, also designated SEQ ID:300.

Another function of GAM179 is therefore inhibition of KIAA0286 (Accession XP_043118.3). Accordingly, utilities of GAM179 include diagnosis, prevention and treatment of diseases and clinical conditions associated with KIAA0286.

KIAA1170 (Accession XP_045907.2) is another GAM179 target gene, herein designated TARGET GENE. KIAA1170 BINDING SITE is a target binding site found in the 3' untranslated region of mRNA encoded by KIAA1170, corresponding to a target binding site such as BINDING SITE I, BINDING SITE II or BINDING SITE III of FIG. 8. Table 4 illustrates the complementarity of the nucleotide sequences of KIAA1170 BINDING SITE, designated SEQ ID:14096, to the nucleotide sequence of GAM179 RNA, herein designated GAM RNA, also designated SEQ ID:300.

Another function of GAM179 is therefore inhibition of KIAA1170 (Accession XP_045907.2). Accordingly, utilities of GAM179 include diagnosis, prevention and treatment of diseases and clinical conditions associated with KIAA1170.

LAK (Accession NP_079420.2) is another GAM179 target gene, herein designated TARGET GENE. LAK BINDING SITE is a target binding site found in the 3' untranslated region of mRNA encoded by LAK, corresponding to a target binding site such as BINDING SITE I, BINDING SITE II or BINDING SITE III of FIG. 8. Table 4 illustrates the complementarity of the nucleotide sequences of LAK BINDING SITE, designated SEQ ID:9362, to the nucleotide sequence of GAM179 RNA, herein designated GAM RNA, also designated SEQ ID:300.

Another function of GAM179 is therefore inhibition of LAK (Accession NP_079420.2). Accordingly, utilities of GAM179 include diagnosis, prevention and treatment of diseases and clinical conditions associated with LAK.

LOC120105 (Accession XP_061864.2) is another GAM179 target gene, herein designated TARGET GENE. LOC120105 BINDING SITE is a target binding site found in the 5' untranslated region of mRNA encoded by LOC120105, corresponding to a target binding site such as BINDING SITE I, BINDING SITE II or BINDING SITE III of FIG. 8. Table 4 illustrates the complementarity of the nucleotide sequences of LOC120105 BINDING SITE, designated SEQ ID:12997, to the nucleotide sequence of GAM179 RNA, herein designated GAM RNA, also designated SEQ ID:300.

Another function of GAM179 is therefore inhibition of LOC120105 (Accession XP_061864.2). Accordingly, utilities of GAM179 include diagnosis, prevention and treatment of diseases and clinical conditions associated with LOC120105.

LOC125058 (Accession XP_008617.5) is another GAM179 target gene, herein designated TARGET GENE. LOC125058 BINDING SITE is a target binding site found in the 3' untranslated region of mRNA encoded by LOC125058, corresponding to a target binding site such as BINDING SITE I, BINDING SITE II or BINDING SITE III of FIG. 8. Table 4 illustrates the complementarity of the nucleotide sequences of LOC125058 BINDING SITE, designated SEQ ID:10141, to the nucleotide sequence of GAM179 RNA, herein designated GAM RNA, also designated SEQ ID:300.

Another function of GAM179 is therefore inhibition of LOC125058 (Accession XP_008617.5). Accordingly, utilities of GAM179 include diagnosis, prevention and treatment of diseases and clinical conditions associated with LOC125058.

LOC133926 (Accession XP_059674.1) is another GAM179 target gene, herein designated TARGET GENE. LOC133926 BINDING SITE is a target binding site found in the 3' untranslated region of mRNA encoded by LOC133926, corresponding to a target binding site such as BINDING SITE I, BINDING SITE II or BINDING SITE III of FIG. 8. Table 4 illustrates the complementarity of the nucleotide sequences of LOC133926 BINDING SITE, designated SEQ ID:16799, to the nucleotide sequence of GAM179 RNA, herein designated GAM RNA, also designated SEQ ID:300.

Another function of GAM179 is therefore inhibition of LOC133926 (Accession XP_059674.1). Accordingly, utilities of GAM179 include diagnosis, prevention and treatment of diseases and clinical conditions associated with LOC133926.

LOC143188 (Accession XP_096387.1) is another GAM179 target gene, herein designated TARGET GENE. LOC143188 BINDING SITE is a target binding site found in the 5' untranslated region of mRNA encoded by LOC143188, corresponding to a target binding site such as BINDING SITE I, BINDING SITE II or BINDING SITE III of FIG. 8. Table 4 illustrates the complementarity of the nucleotide sequences of LOC143188 BINDING SITE, designated SEQ ID:8192, to the nucleotide sequence of GAM179 RNA, herein designated GAM RNA, also designated SEQ ID:300.

Another function of GAM179 is therefore inhibition of LOC143188 (Accession XP_096387.1). Accordingly, utilities of GAM179 include diagnosis, prevention and treatment of diseases and clinical conditions associated with LOC143188.

LOC145098 (Accession XP_085022.1) is another GAM179 target gene, herein designated TARGET GENE. LOC145098 BINDING SITE is a target binding site found in the 5' untranslated region of mRNA encoded by LOC145098, corresponding to a target binding site such as BINDING SITE I, BINDING SITE II or BINDING SITE III of FIG. 8. Table 4 illustrates the complementarity of the nucleotide sequences of LOC145098 BINDING SITE, designated SEQ ID:13315, to the nucleotide sequence of GAM179 RNA, herein designated GAM RNA, also designated SEQ ID:300.

Another function of GAM179 is therefore inhibition of LOC145098 (Accession XP_085022.1). Accordingly, utilities of GAM179 include diagnosis, prevention and treatment of diseases and clinical conditions associated with LOC145098.

LOC148894 (Accession XP_097542.1) is another GAM179 target gene, herein designated TARGET GENE. LOC148894 BINDING SITE is a target binding site found in the 5' untranslated region of mRNA encoded by LOC148894, corresponding to a target binding site such as BINDING SITE I, BINDING SITE II or BINDING SITE III of FIG. 8. Table 4 illustrates the complementarity of the nucleotide sequences of LOC148894 BINDING SITE, designated SEQ ID:3771, to the nucleotide sequence of GAM179 RNA, herein designated GAM RNA, also designated SEQ ID:300.

Another function of GAM179 is therefore inhibition of LOC148894 (Accession XP_097542.1). Accordingly, utilities of GAM179 include diagnosis, prevention and treatment of diseases and clinical conditions associated with LOC148894.

LOC149837 (Accession XP_097747.1) is another GAM179 target gene, herein designated TARGET GENE. LOC149837 BINDING SITE is a target binding site found in the 3' untranslated region of mRNA encoded by LOC149837, corresponding to a target binding site such as BINDING SITE I, BINDING SITE II or BINDING SITE III of FIG. 8. Table 4 illustrates the complementarity of the nucleotide sequences of LOC149837 BINDING SITE, designated SEQ ID:4055, to the nucleotide sequence of GAM179 RNA, herein designated GAM RNA, also designated SEQ ID:300.

Another function of GAM179 is therefore inhibition of LOC149837 (Accession XP_097747.1). Accordingly, utilities of GAM179 include diagnosis, prevention and treatment of diseases and clinical conditions associated with LOC149837.

LOC150174 (Accession XP_086802.2) is another GAM179 target gene, herein designated TARGET GENE. LOC150174 BINDING SITE is a target binding site found in the 3' untranslated region of mRNA encoded by LOC150174, corresponding to a target binding site such as BINDING SITE I, BINDING SITE II or BINDING SITE III of FIG. 8. Table 4 illustrates the complementarity of the nucleotide sequences of LOC150174 BINDING SITE, designated SEQ ID:12743, to the nucleotide sequence of GAM179 RNA, herein designated GAM RNA, also designated SEQ ID:300.

Another function of GAM179 is therefore inhibition of LOC150174 (Accession XP_086802.2). Accordingly, utilities of GAM179 include diagnosis, prevention and treatment of diseases and clinical conditions associated with LOC150174.

LOC150213 (Accession XP_059324.1) is another GAM179 target gene, herein designated TARGET GENE. LOC150213 BINDING SITE is a target binding site found in the 3' untranslated region of mRNA encoded by LOC150213, corresponding to a target binding site such as BINDING SITE I, BINDING SITE II or BINDING SITE III of FIG. 8. Table 4 illustrates the complementarity of the nucleotide sequences of LOC150213 BINDING SITE, designated SEQ ID:12743, to the nucleotide sequence of GAM179 RNA, herein designated GAM RNA, also designated SEQ ID:300.

Another function of GAM179 is therefore inhibition of LOC150213 (Accession XP_059324.1). Accordingly, utilities of GAM179 include diagnosis, prevention and treatment of diseases and clinical conditions associated with LOC150213.

LOC151171 (Accession XP_087116.1) is another GAM179 target gene, herein designated TARGET GENE. LOC151171 BINDING SITE is a target binding site found in the 5' untranslated region of mRNA encoded by LOC151171, corresponding to a target binding site such as BINDING SITE I, BINDING SITE II or BINDING SITE III of FIG. 8. Table 4 illustrates the complementarity of the nucleotide sequences of LOC151171 BINDING SITE, designated SEQ ID:7338, to the nucleotide sequence of GAM179 RNA, herein designated GAM RNA, also designated SEQ ID:300.

Another function of GAM179 is therefore inhibition of LOC151171 (Accession XP_087116.1). Accordingly, utilities of GAM179 include diagnosis, prevention and treatment of diseases and clinical conditions associated with LOC151171.

LOC157556 (Accession XP_098783.1) is another GAM179 target gene, herein designated TARGET GENE. LOC157556 BINDING SITE is a target binding site found in the 5' untranslated region of mRNA encoded by LOC157556, corresponding to a target binding site such as BINDING SITE I, BINDING SITE II or BINDING SITE III of FIG. 8. Table 4 illustrates the complementarity of the nucleotide sequences of LOC157556 BINDING SITE, designated SEQ ID:18978, to the nucleotide sequence of GAM179 RNA, herein designated GAM RNA, also designated SEQ ID:300.

Another function of GAM179 is therefore inhibition of LOC157556 (Accession XP_098783.1). Accordingly, utilities of GAM179 include diagnosis, prevention and treatment of diseases and clinical conditions associated with LOC157556.

LOC220980 (Accession XP_167629.1) is another GAM179 target gene, herein designated TARGET GENE. LOC220980 BINDING SITE is a target binding site found in the 5' untranslated region of mRNA encoded by LOC220980, corresponding to a target binding site such as BINDING SITE I, BINDING SITE II or BINDING SITE III of FIG. 8. Table 4 illustrates the complementarity of the nucleotide sequences of LOC220980 BINDING SITE, designated SEQ ID:3721, to the nucleotide sequence of GAM179 RNA, herein designated GAM RNA, also designated SEQ ID:300.

Another function of GAM179 is therefore inhibition of LOC220980 (Accession XP_167629.1). Accordingly, utilities of GAM179 include diagnosis, prevention and treatment of diseases and clinical conditions associated with LOC220980.

LOC221140 (Accession XP_167908.1) is another GAM179 target gene, herein designated TARGET GENE. LOC221140 BINDING SITE is a target binding site found in the 5' untranslated region of mRNA encoded by LOC221140, corresponding to a target binding site such as BINDING SITE I, BINDING SITE II or BINDING SITE III of FIG. 8. Table 4 illustrates the complementarity of the nucleotide sequences of LOC221140 BINDING SITE, designated SEQ ID:3664, to the nucleotide sequence of GAM179 RNA, herein designated GAM RNA, also designated SEQ ID:300.

Another function of GAM179 is therefore inhibition of LOC221140 (Accession XP_167908.1). Accordingly, utilities of GAM179 include diagnosis, prevention and treatment of diseases and clinical conditions associated with LOC221140.

LOC255736 (Accession XP_170898.2) is another GAM179 target gene, herein designated TARGET GENE. LOC255736 BINDING SITE is a target binding site found in the 5' untranslated region of mRNA encoded by LOC255736, corresponding to a target binding site such as BINDING SITE I, BINDING SITE II or BINDING SITE III of FIG. 8. Table 4 illustrates the complementarity of the nucleotide sequences of LOC255736 BINDING SITE, designated SEQ ID:14351, to the nucleotide sequence of GAM179 RNA, herein designated GAM RNA, also designated SEQ ID:300.

Another function of GAM179 is therefore inhibition of LOC255736 (Accession XP_170898.2). Accordingly, utilities of GAM179 include diagnosis, prevention and treatment of diseases and clinical conditions associated with LOC255736.

LOC283016 (Accession XP_208024.1) is another GAM179 target gene, herein designated TARGET GENE. LOC283016 BINDING SITE is a target binding site found in the 5' untranslated region of mRNA encoded by LOC283016, corresponding to a target binding site such as BINDING SITE I, BINDING SITE II or BINDING SITE III of FIG. 8. Table 4 illustrates the complementarity of the nucleotide sequences of LOC283016 BINDING SITE, designated SEQ ID:758, to the nucleotide sequence of GAM179 RNA, herein designated GAM RNA, also designated SEQ ID:300.

Another function of GAM179 is therefore inhibition of LOC283016 (Accession XP_208024.1). Accordingly, utilities of GAM179 include diagnosis, prevention and treatment of diseases and clinical conditions associated with LOC283016.

LOC283048 (Accession XP_210867.1) is another GAM179 target gene, herein designated TARGET GENE. LOC283048 BINDING SITE is a target binding site found in the 5' untranslated region of mRNA encoded by LOC283048, corresponding to a target binding site such as BINDING SITE I, BINDING SITE II or BINDING SITE III of FIG. 8. Table 4 illustrates the complementarity of the nucleotide sequences of LOC283048 BINDING SITE, designated SEQ ID:15999, to the nucleotide sequence of GAM179 RNA, herein designated GAM RNA, also designated SEQ ID:300.

Another function of GAM179 is therefore inhibition of LOC283048 (Accession XP_210867.1). Accordingly, utilities of GAM179 include diagnosis, prevention and treatment of diseases and clinical conditions associated with LOC283048.

LOC283168 (Accession XP_210910.1) is another GAM179 target gene, herein designated TARGET GENE. LOC283168 BINDING SITE is a target binding site found in the 3' untranslated region of mRNA encoded by LOC283168, corresponding to a target binding site such as BINDING SITE I, BINDING SITE II or BINDING SITE III of FIG. 8. Table 4 illustrates the complementarity of the nucleotide sequences of LOC283168 BINDING SITE, designated SEQ ID:5476, to the nucleotide sequence of GAM179 RNA, herein designated GAM RNA, also designated SEQ ID:300.

Another function of GAM179 is therefore inhibition of LOC283168 (Accession XP_210910.1). Accordingly, utilities of GAM179 include diagnosis, prevention and treatment of diseases and clinical conditions associated with LOC283168.

LOC283177 (Accession XP_210903.1) is another GAM179 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:2829, to the nucleotide sequence of GAM179 RNA, herein designated GAM RNA, also designated SEQ ID:300.

Another function of GAM179 is therefore inhibition of LOC283177 (Accession XP_210903.1). Accordingly, utilities of GAM179 include diagnosis, prevention and treatment of diseases and clinical conditions associated with LOC283177.

LOC284124 (Accession XP_294862.1) is another GAM179 target gene, herein designated TARGET GENE. LOC284124 BINDING SITE is a target binding site found in the 3' untranslated region of mRNA encoded by LOC284124, corresponding to a target binding site such as BINDING SITE I, BINDING SITE II or BINDING SITE III of FIG. 8. Table 4 illustrates the complementarity of the nucleotide sequences of LOC284124 BINDING SITE, designated SEQ ID:6917, to the nucleotide sequence of GAM179 RNA, herein designated GAM RNA, also designated SEQ ID:300.

Another function of GAM179 is therefore inhibition of LOC284124 (Accession XP_294862.1). Accordingly, utilities of GAM179 include diagnosis, prevention and treatment of diseases and clinical conditions associated with LOC284124.

LOC284313 (Accession XP_209116.1) is another GAM179 target gene, herein designated TARGET GENE. LOC284313 BINDING SITE is a target binding site found in the 3' untranslated region of mRNA encoded by LOC284313, corresponding to a target binding site such as BINDING SITE I, BINDING SITE II or BINDING SITE III of FIG. 8. Table 4 illustrates the complementarity of the nucleotide sequences of LOC284313 BINDING SITE, designated SEQ ID:11931, to the nucleotide sequence of GAM179 RNA, herein designated GAM RNA, also designated SEQ ID:300.

Another function of GAM179 is therefore inhibition of LOC284313 (Accession XP_209116.1). Accordingly, utilities of GAM179 include diagnosis, prevention and treatment of diseases and clinical conditions associated with LOC284313.

LOC284911 (Accession XP_211684.1) is another GAM179 target gene, herein designated TARGET GENE. LOC284911 BINDING SITE is a target binding site found in the 3' untranslated region of mRNA encoded by LOC284911, corresponding to a target binding site such as BINDING SITE I, BINDING SITE II or BINDING SITE III of FIG. 8. Table 4 illustrates the complementarity of the nucleotide sequences of LOC284911 BINDING SITE, designated SEQ ID:9507, to the nucleotide sequence of GAM179 RNA, herein designated GAM RNA, also designated SEQ ID:300.

Another function of GAM179 is therefore inhibition of LOC284911 (Accession XP_211684.1). Accordingly, utilities of GAM179 include diagnosis, prevention and treatment of diseases and clinical conditions associated with LOC284911.

LOC285193 (Accession XP_209509.1) is another GAM179 target gene, herein designated TARGET GENE. LOC285193 BINDING SITE is a target binding site found in the 3' untranslated region of mRNA encoded by LOC285193, corresponding to a target binding site such as BINDING SITE I, BINDING SITE II or BINDING SITE III of FIG. 8. Table 4 illustrates the complementarity of the nucleotide sequences of LOC285193 BINDING SITE, designated SEQ ID:4970, to the nucleotide sequence of GAM179 RNA, herein designated GAM RNA, also designated SEQ ID:300.

Another function of GAM179 is therefore inhibition of LOC285193 (Accession XP_209509.1). Accordingly, utilities of GAM179 include diagnosis, prevention and treatment of diseases and clinical conditions associated with LOC285193.

LOC285334 (Accession XP_211844.1) is another GAM179 target gene, herein designated TARGET GENE. LOC285334 BINDING SITE is a target binding site found in the 3' untranslated region of mRNA encoded by LOC285334, corresponding to a target binding site such as BINDING SITE I, BINDING SITE II or BINDING SITE III of FIG. 8. Table 4 illustrates the complementarity of the nucleotide sequences of LOC285334 BINDING SITE, designated SEQ ID:800, to the nucleotide sequence of GAM179 RNA, herein designated GAM RNA, also designated SEQ ID:300.

Another function of GAM179 is therefore inhibition of LOC285334 (Accession XP_211844.1). Accordingly, utilities of GAM179 include diagnosis, prevention and treatment of diseases and clinical conditions associated with LOC285334.

LOC285412 (Accession XP_208319.1) is another GAM179 target gene, herein designated TARGET GENE. LOC285412 BINDING SITE is a target binding site found in the 3' untranslated region of mRNA encoded by LOC285412, corresponding to a target binding site such as BINDING SITE I, BINDING SITE II or BINDING SITE III of FIG. 8. Table 4 illustrates the complementarity of the nucleotide sequences of LOC285412 BINDING SITE, designated SEQ ID:17899, to the nucleotide sequence of GAM179 RNA, herein designated GAM RNA, also designated SEQ ID:300.

Another function of GAM179 is therefore inhibition of LOC285412 (Accession XP_208319.1). Accordingly, utilities of GAM179 include diagnosis, prevention and treatment of diseases and clinical conditions associated with LOC285412.

LOC285431 (Accession XP_211898.1) is another GAM179 target gene, herein designated TARGET GENE. LOC285431 BINDING SITE is a target binding site found in the 3' untranslated region of mRNA encoded by LOC285431, corresponding to a target binding site such as BINDING SITE I, BINDING SITE II or BINDING SITE III of FIG. 8. Table 4 illustrates the complementarity of the nucleotide sequences of LOC285431 BINDING SITE, designated SEQ ID:7608, to the nucleotide sequence of GAM179 RNA, herein designated GAM RNA, also designated SEQ ID:300.

Another function of GAM179 is therefore inhibition of LOC285431 (Accession XP_211898.1). Accordingly, utilities of GAM179 include diagnosis, prevention and treatment of diseases and clinical conditions associated with LOC285431.

LOC285735 (Accession XP_212002.1) is another GAM179 target gene, herein designated TARGET GENE. LOC285735 BINDING SITE is a target binding site found in the 5' untranslated region of mRNA encoded by LOC285735, corresponding to a target binding site such as BINDING SITE I, BINDING SITE II or BINDING SITE III of FIG. 8. Table 4 illustrates the complementarity of the nucleotide sequences of LOC285735 BINDING SITE, designated SEQ ID:5912, to the nucleotide sequence of GAM179 RNA, herein designated GAM RNA, also designated SEQ ID:300.

Another function of GAM179 is therefore inhibition of LOC285735 (Accession XP_212002.1). Accordingly, utilities of GAM179 include diagnosis, prevention and treatment of diseases and clinical conditions associated with LOC285735.

LOC285827 (Accession XP_212038.1) is another GAM179 target gene, herein designated TARGET GENE. LOC285827 BINDING SITE is a target binding site found in the 5' untranslated region of multiple transcripts of mRNA encoded by LOC285827, corresponding to a target binding site such as BINDING SITE I, BINDING SITE II or BINDING SITE III of FIG. 8. Table 4 illustrates the complementarity of the nucleotide sequences of LOC285827 BINDING SITE, designated SEQ ID:13258, to the nucleotide sequence of GAM179 RNA, herein designated GAM RNA, also designated SEQ ID:300.

Another function of GAM179 is therefore inhibition of LOC285827 (Accession XP_212038.1). Accordingly, utilities of GAM179 include diagnosis, prevention and treatment of diseases and clinical conditions associated with LOC285827.

LOC285827 (Accession XP_212645.1) is another GAM179 target gene, herein designated TARGET GENE. LOC285827 BINDING SITE is a target binding site found in the 5' untranslated region of multiple transcripts of mRNA encoded by LOC285827, corresponding to a target binding site such as BINDING SITE I, BINDING SITE II or BINDING SITE III of FIG. 8. Table 4 illustrates the complementarity of the nucleotide sequences of LOC285827 BINDING SITE, designated SEQ ID:13258, to the nucleotide sequence of GAM179 RNA, herein designated GAM RNA, also designated SEQ ID:300.

Another function of GAM179 is therefore inhibition of LOC285827 (Accession XP_212645.1). Accordingly, utilities of GAM179 include diagnosis, prevention and treatment of diseases and clinical conditions associated with LOC285827.

LOC285827 (Accession XP_212604.1) is another GAM179 target gene, herein designated TARGET GENE. LOC285827 BINDING SITE is a target binding site found in the 5' untranslated region of multiple transcripts of mRNA encoded by LOC285827, corresponding to a target binding site such as BINDING SITE I, BINDING SITE II or BINDING SITE III of FIG. 8. Table 4 illustrates the complementarity of the nucleotide sequences of LOC285827 BINDING SITE, designated SEQ ID:13258, to the nucleotide sequence of GAM179 RNA, herein designated GAM RNA, also designated SEQ ID:300.

Another function of GAM179 is therefore inhibition of LOC285827 (Accession XP_212604.1). Accordingly, utilities of GAM179 include diagnosis, prevention and treatment of diseases and clinical conditions associated with LOC285827.

LOC285931 (Accession NP_777609.1) is another GAM179 target gene, herein designated TARGET GENE. LOC285931 BINDING SITE is a target binding site found in the 3' untranslated region of mRNA encoded by LOC285931, corresponding to a target binding site such as BINDING SITE I, BINDING SITE II or BINDING SITE III of FIG. 8. Table 4 illustrates the complementarity of the nucleotide sequences of LOC285931 BINDING SITE, designated SEQ ID:17124, to the nucleotide sequence of GAM179 RNA, herein designated GAM RNA, also designated SEQ ID:300.

Another function of GAM179 is therefore inhibition of LOC285931 (Accession NP_777609.1). Accordingly, utilities of GAM179 include diagnosis, prevention and treatment of diseases and clinical conditions associated with LOC285931.

LOC286058 (Accession XP_212158.1) is another GAM179 target gene, herein designated TARGET GENE. LOC286058 BINDING SITE is a target binding site found in the 3' untranslated region of mRNA encoded by LOC286058, corresponding to a target binding site such as BINDING SITE I, BINDING SITE II or BINDING SITE III of FIG. 8. Table 4 illustrates the complementarity of the nucleotide sequences of LOC286058 BINDING SITE, designated SEQ ID:17023, to the nucleotide sequence of GAM179 RNA, herein designated GAM RNA, also designated SEQ ID:300.

Another function of GAM179 is therefore inhibition of LOC286058 (Accession XP_212158.1). Accordingly, utilities of GAM179 include diagnosis, prevention and treatment of diseases and clinical conditions associated with LOC286058.

LOC339808 (Accession XP_295071.1) is another GAM179 target gene, herein designated TARGET GENE.

LOC339808 BINDING SITE is a target binding site found in the 3' untranslated region of mRNA encoded by LOC339808, corresponding to a target binding site such as BINDING SITE I, BINDING SITE II or BINDING SITE III of FIG. 8. Table 4 illustrates the complementarity of the nucleotide sequences of LOC339808 BINDING SITE, designated SEQ ID:12230, to the nucleotide sequence of GAM179 RNA, herein designated GAM RNA, also designated SEQ ID:300.

Another function of GAM179 is therefore inhibition of LOC339808 (Accession XP_295071.1). Accordingly, utilities of GAM179 include diagnosis, prevention and treatment of diseases and clinical conditions associated with LOC339808.

LOC346259 (Accession XP_299387.1) is another GAM179 target gene, herein designated TARGET GENE. LOC346259 BINDING SITE is a target binding site found in the 5' untranslated region of mRNA encoded by LOC346259, corresponding to a target binding site such as BINDING SITE I, BINDING SITE II or BINDING SITE III of FIG. 8. Table 4 illustrates the complementarity of the nucleotide sequences of LOC346259 BINDING SITE, designated SEQ ID:16628, to the nucleotide sequence of GAM179 RNA, herein designated GAM RNA, also designated SEQ ID:300.

Another function of GAM179 is therefore inhibition of LOC346259 (Accession XP_299387.1). Accordingly, utilities of GAM179 include diagnosis, prevention and treatment of diseases and clinical conditions associated with LOC346259.

LOC347767 (Accession XP_300531.1) is another GAM179 target gene, herein designated TARGET GENE. LOC347767 BINDING SITE is a target binding site found in the 3' untranslated region of mRNA encoded by LOC347767, corresponding to a target binding site such as BINDING SITE I, BINDING SITE II or BINDING SITE III of FIG. 8. Table 4 illustrates the complementarity of the nucleotide sequences of LOC347767 BINDING SITE, designated SEQ ID:13207, to the nucleotide sequence of GAM179 RNA, herein designated GAM RNA, also designated SEQ ID:300.

Another function of GAM179 is therefore inhibition of LOC347767 (Accession XP_300531.1). Accordingly, utilities of GAM179 include diagnosis, prevention and treatment of diseases and clinical conditions associated with LOC347767.

LOC348155 (Accession XP_211219.1) is another GAM179 target gene, herein designated TARGET GENE. LOC348155 BINDING SITE is a target binding site found in the 5' untranslated region of mRNA encoded by LOC348155, corresponding to a target binding site such as BINDING SITE I, BINDING SITE II or BINDING SITE III of FIG. 8. Table 4 illustrates the complementarity of the nucleotide sequences of LOC348155 BINDING SITE, designated SEQ ID:12472, to the nucleotide sequence of GAM179 RNA, herein designated GAM RNA, also designated SEQ ID:300.

Another function of GAM179 is therefore inhibition of LOC348155 (Accession XP_211219.1). Accordingly, utilities of GAM179 include diagnosis, prevention and treatment of diseases and clinical conditions associated with LOC348155.

LOC348182 (Accession XP_302676.1) is another GAM179 target gene, herein designated TARGET GENE. LOC348182 BINDING SITE is a target binding site found in the 3' untranslated region of mRNA encoded by LOC348182, corresponding to a target binding site such as BINDING SITE I, BINDING SITE II or BINDING SITE III of FIG. 8. Table 4 illustrates the complementarity of the nucleotide sequences of LOC348182 BINDING SITE, designated SEQ ID:15435, to the nucleotide sequence of GAM179 RNA, herein designated GAM RNA, also designated SEQ ID:300.

Another function of GAM179 is therefore inhibition of LOC348182 (Accession XP_302676.1). Accordingly, utilities of GAM179 include diagnosis, prevention and treatment of diseases and clinical conditions associated with LOC348182.

LOC348371 (Accession XP_300722.1) is another GAM179 target gene, herein designated TARGET GENE. LOC348371 BINDING SITE is a target binding site found in the 3' untranslated region of mRNA encoded by LOC348371, corresponding to a target binding site such as BINDING SITE I, BINDING SITE II or BINDING SITE III of FIG. 8. Table 4 illustrates the complementarity of the nucleotide sequences of LOC348371 BINDING SITE, designated SEQ ID:3641, to the nucleotide sequence of GAM179 RNA, herein designated GAM RNA, also designated SEQ ID:300.

Another function of GAM179 is therefore inhibition of LOC348371 (Accession XP_300722.1). Accordingly, utilities of GAM179 include diagnosis, prevention and treatment of diseases and clinical conditions associated with LOC348371.

LOC348488 (Accession XP_300352.1) is another GAM179 target gene, herein designated TARGET GENE. LOC348488 BINDING SITE is a target binding site found in the 3' untranslated region of mRNA encoded by LOC348488, corresponding to a target binding site such as BINDING SITE I, BINDING SITE II or BINDING SITE III of FIG. 8. Table 4 illustrates the complementarity of the nucleotide sequences of LOC348488 BINDING SITE, designated SEQ ID:8278, to the nucleotide sequence of GAM179 RNA, herein designated GAM RNA, also designated SEQ ID:300.

Another function of GAM179 is therefore inhibition of LOC348488 (Accession XP_300352.1). Accordingly, utilities of GAM179 include diagnosis, prevention and treatment of diseases and clinical conditions associated with LOC348488.

LOC349384 (Accession XP_301935.1) is another GAM179 target gene, herein designated TARGET GENE. LOC349384 BINDING SITE is a target binding site found in the 5' untranslated region of mRNA encoded by LOC349384, corresponding to a target binding site such as BINDING SITE I, BINDING SITE II or BINDING SITE III of FIG. 8. Table 4 illustrates the complementarity of the nucleotide sequences of LOC349384 BINDING SITE, designated SEQ ID:10985, to the nucleotide sequence of GAM179 RNA, herein designated GAM RNA, also designated SEQ ID:300.

Another function of GAM179 is therefore inhibition of LOC349384 (Accession XP_301935.1). Accordingly, utilities of GAM179 include diagnosis, prevention and treatment of diseases and clinical conditions associated with LOC349384.

Mitogen-activated protein kinase 4 (MAPK4, Accession NP_002738.1) is another GAM179 target gene, herein designated TARGET GENE. MAPK4 BINDING SITE is a target binding site found in the 5' untranslated region of mRNA encoded by MAPK4, corresponding to a target binding site such as BINDING SITE I, BINDING SITE II or BINDING SITE III of FIG. 8. Table 4 illustrates the complementarity of the nucleotide sequences of MAPK4 BINDING SITE, designated SEQ ID:11406, to the nucleotide sequence of GAM179 RNA, herein designated GAM RNA, also designated SEQ ID:300.

Another function of GAM179 is therefore inhibition of Mitogen-activated protein kinase 4 (MAPK4, Accession NP_002738.1), a gene which phosphorylates microtubule-associated protein-2 may promote entry into the cell cycle.

Accordingly, utilities of GAM179 include diagnosis, prevention and treatment of diseases and clinical conditions associated with MAPK4.

The function of MAPK4 has been established by previous studies. See MAPK1 (OMIM Ref. No. 176948). Gonzalez et al. (1992) reported the molecular cloning of genes for 4 human proteins with high homology to members of the mitogen-activated protein kinase group of enzymes. Of the 4, 2 probably resulted from alternative processing of transcripts from a single gene. Zhu et al. (1994) stated that p63MAPK, which had been known as ERK3, shares only 73% protein sequence identity with rat ERK3. They suggested that p97MAPK (MAPK6; 602904) is the true ERK3 homolog, and that p63MAPK is a member of the ERK3 subfamily. Garcia et al. (1996) reported that a gene they referred to as MNK2 is the rat homolog of p63MAPK. The 2 protein sequences are 95% identical. Li et al. (1994) used Southern blotting of DNA from a panel of human hamster cell hybrids and fluorescence in situ hybridization to map the MAPK4 gene to 18q12-q21

Full details of the abovementioned studies are described in the following publications, the disclosure of which are hereby incorporated by reference:

Garcia, J. I.; Zalba, G.; Detera-Wadleigh, S. D.; de Miguel, C.: Isolation of a cDNA encoding the rat MAP-kinase homolog of human p63mapk. Mammalian Genome 7:810-814, 1996; and Li, L.; Wysk, M.; Gonzalez, F. A.; Davis, R. J.: Genomic loci of human mitogen- activated protein kinases. Oncogene 9:647-649, 1994.

Further studies establishing the function and utilities of MAPK4 are found in John Hopkins OMIM database record ID 176949, and in cited publications listed in Table 5, which are hereby incorporated by reference. MBNL1 (Accession NP_066368.1) is another GAM179 target gene, herein designated TARGET GENE. MBNL1 BINDING SITE is a target binding site found in the 5' untranslated region of mRNA encoded by MBNL1, corresponding to a target binding site such as BINDING SITE I, BINDING SITE II or BINDING SITE III of FIG. 8. Table 4 illustrates the complementarity of the nucleotide sequences of MBNL1 BINDING SITE, designated SEQ ID:12912, to the nucleotide sequence of GAM179 RNA, herein designated GAM RNA, also designated SEQ ID:300.

Another function of GAM179 is therefore inhibition of MBNL1 (Accession NP_066368.1). Accordingly, utilities of GAM179 include diagnosis, prevention and treatment of diseases and clinical conditions associated with MBNL1.

Membrane cofactor protein (cd46, trophoblast-lymphocyte cross-reactive antigen) (MCP, Accession NP_758866.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758866.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_722548.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_722548.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758868.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758868.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758865.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758865.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758867.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758867.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758860.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758860.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758871.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758871.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758870.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758870.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758864.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758864.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758861.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758861.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758863.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758863.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758862.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758862.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_002380.3) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_002380.3), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. Membrane cofactor protein (cd46, trophoblast-lymphocyte cross-reactive antigen) (MCP, Accession NP_758869.1) is another GAM179 target gene, herein designated TARGET GENE. MCP BINDING SITE is a target binding site found in the 3' untranslated region of multiple transcripts of mRNA encoded by MCP, corresponding to a target binding site such as BINDING SITE I, BINDING SITE II or BINDING SITE III of FIG. 8. Table 4 illustrates the complementarity of the nucleotide sequences of MCP BINDING SITE, designated SEQ ID:17253, to the nucleotide sequence of GAM179 RNA, herein designated GAM RNA, also designated SEQ ID:300.

Another function of GAM179 is therefore inhibition of Membrane cofactor protein (cd46, trophoblast-lymphocyte cross-reactive antigen) (MCP, Accession NP_758869.1), a gene which may be involved in the regulation of complement activation. Accordingly, utilities of GAM179 include diagnosis, prevention and treatment of diseases and clinical conditions associated with MCP.

The function of MCP and its association with various diseases and clinical conditions, has been established by previous studies, as described hereinabove with reference to GAM63.1. MGC10986 (Accession NP_085053.1) is another GAM179 target gene, herein designated TARGET GENE. MGC10986 BINDING SITE is a target binding site found in the 3' untranslated region of mRNA encoded by MGC10986, corresponding to a target binding site such as BINDING SITE I, BINDING SITE II or BINDING SITE III of FIG. 8. Table 4 illustrates the complementarity of the nucleotide sequences of MGC10986 BINDING SITE, designated SEQ ID:4521, to the nucleotide sequence of GAM179 RNA, herein designated GAM RNA, also designated SEQ ID:300.

Another function of GAM179 is therefore inhibition of MGC10986 (Accession NP_085053.1). Accordingly, utilities of GAM179 include diagnosis, prevention and treatment of diseases and clinical conditions associated with MGC10986.

MGC21874 (Accession XP_291105.1) is another GAM179 target gene, herein designated TARGET GENE. MGC21874 BINDING SITE is a target binding site found in the 3' untranslated region of mRNA encoded by MGC21874, corresponding to a target binding site such as BINDING SITE I, BINDING SITE II or BINDING SITE III of FIG. 8. Table 4 illustrates the complementarity of the nucleotide sequences of MGC21874 BINDING SITE, designated SEQ ID:2320, to the nucleotide sequence of GAM179 RNA, herein designated GAM RNA, also designated SEQ ID:300.

Another function of GAM179 is therefore inhibition of MGC21874 (Accession XP_291105.1). Accordingly, utilities of GAM179 include diagnosis, prevention and treatment of diseases and clinical conditions associated with MGC21874.

MGC26733 (Accession NP_659429.2) is another GAM179 target gene, herein designated TARGET GENE. MGC26733 BINDING SITE is a target binding site found in the 3' untranslated region of mRNA encoded by MGC26733, corresponding to a target binding site such as BINDING SITE I, BINDING SITE II or BINDING SITE III of FIG. 8. Table 4 illustrates the complementarity of the nucleotide sequences of MGC26733 BINDING SITE, designated SEQ ID:16246, to the nucleotide sequence of GAM179 RNA, herein designated GAM RNA, also designated SEQ ID:300.

Another function of GAM179 is therefore inhibition of MGC26733 (Accession NP_659429.2). Accordingly, utilities of GAM179 include diagnosis, prevention and treatment of diseases and clinical conditions associated with MGC26733.

MGC33371 (Accession NP_653265.1) is another GAM179 target gene, herein designated TARGET GENE. MGC33371 BINDING SITE is a target binding site found in the 3' untranslated region of mRNA encoded by MGC33371, corresponding to a target binding site such as BINDING SITE I, BINDING SITE II or BINDING SITE III of FIG. 8. Table 4 illustrates the complementarity of the nucleotide sequences of MGC33371 BINDING SITE, designated SEQ ID:12923, to the nucleotide sequence of GAM179 RNA, herein designated GAM RNA, also designated SEQ ID:300.

Another function of GAM179 is therefore inhibition of MGC33371 (Accession NP_653265.1). Accordingly, utilities of GAM179 include diagnosis, prevention and treatment of diseases and clinical conditions associated with MGC33371.

Molybdenum cofactor synthesis 2 (MOCS2, Accession NP_004522.1) is another GAM179 target gene, herein designated TARGET GENE. MOCS2 BINDING SITE is a target binding site found in the 5' untranslated region of multiple transcripts of mRNA encoded by MOCS2, corresponding to a target binding site such as BINDING SITE I, BINDING SITE II or BINDING SITE III of FIG. 8. Table 4 illustrates the complementarity of the nucleotide sequences of MOCS2 BINDING SITE, designated SEQ ID:19765, to the nucleotide sequence of GAM179 RNA, herein designated GAM RNA, also designated SEQ ID:300.

Another function of GAM179 is therefore inhibition of Molybdenum cofactor synthesis 2 (MOCS2, Accession NP_004522.1). Accordingly, utilities of GAM179 include diagnosis, prevention and treatment of diseases and clinical conditions associated with MOCS2.

Membrane-spanning 4-domains, subfamily a, member 4 (MS4A4A, Accession NP_683876.1) is another GAM179 target gene, herein designated TARGET GENE. MS4A4A BINDING SITE is a target binding site found in the 3' untranslated region of multiple transcripts of mRNA encoded by MS4A4A, corresponding to a target binding site such as BINDING SITE I, BINDING SITE II or BINDING SITE III of FIG. 8. Table 4 illustrates the complementarity of the nucleotide sequences of MS4A4A BINDING SITE, designated SEQ ID:19413, to the nucleotide sequence of GAM179 RNA, herein designated GAM RNA, also designated SEQ ID:300.

Another function of GAM179 is therefore inhibition of Membrane-spanning 4-domains, subfamily a, member 4 (MS4A4A, Accession NP_683876.1), a gene which binds to the fc region of immunoglobulins epsilon. high affinity receptor. initiating the allergic response. Accordingly, utilities of GAM179 include diagnosis, prevention and treatment of diseases and clinical conditions associated with MS4A4A.

The function of MS4A4A has been established by previous studies. By EST database searching for homologs of CD20 (MS4A1; 112210), Ishibashi et al. (2001) isolated a cDNA encoding MS4A4A, which they called MS4A4. The deduced 205-amino acid protein has a conserved phosphorylation site at the intracellular loop. Northern blot analysis revealed weak expression in mouse colon and intestine but detected no expression in human tissues. Liang and Tedder (2001) also obtained a cDNA encoding MS4A4A. The predicted 220-amino acid protein is more than 40% identical to its mouse homologs. PCR analysis detected variable expression of MS4A4A in cDNA from multiple hemopoietic cell lines.

Full details of the abovementioned studies are described in the following publications, the disclosure of which are hereby incorporated by reference:

Ishibashi, K.; Suzuki, M.; Sasaki, S.; Imai, M.: Identification of a new multigene four-transmembrane family (MS4A) related to CD20, HTm4 and beta subunit of the high-affinity IgE receptor. Gene 264:87-93, 2001; and Liang, Y.; Tedder, T. F.: Identification of a CD20-, Fc-epsilon-RI-beta-related gene family: sixteen new MS4A family members expressed in human and mouse. Genomics 72:119-127, 2001.

Further studies establishing the function and utilities of MS4A4A are found in John Hopkins OMIM database record ID 606547, and in cited publications listed in Table 5, which are hereby incorporated by reference. Membrane-spanning 4-domains, subfamily a, member 4 (MS4A4A, Accession NP_076926.2) is another GAM179 target gene, herein designated TARGET GENE. MS4A4A BINDING SITE is a target binding site found in the 3' untranslated region of multiple transcripts of mRNA encoded by MS4A4A, corresponding to a target binding site such as BINDING SITE I, BINDING SITE II or BINDING SITE III of FIG. 8. Table 4 illustrates the complementarity of the nucleotide sequences of MS4A4A BINDING SITE, designated SEQ ID:19413, to the nucleotide sequence of GAM179 RNA, herein designated GAM RNA, also designated SEQ ID:300.

Another function of GAM179 is therefore inhibition of Membrane-spanning 4-domains, subfamily a, member 4 (MS4A4A, Accession NP_076926.2), a gene which binds to the fc region of immunoglobulins epsilon. high affinity receptor. initiating the allergic response. Accordingly, utilities of GAM179 include diagnosis, prevention and treatment of diseases and clinical conditions associated with MS4A4A.

The function of MS4A4A has been established by previous studies. By EST database searching for homologs of CD20 (MS4A1; 112210), Ishibashi et al. (2001) isolated a cDNA encoding MS4A4A, which they called MS4A4. The deduced 205-amino acid protein has a conserved phosphorylation site at the intracellular loop. Northern blot analysis revealed weak expression in mouse colon and intestine but detected no expression in human tissues. Liang and Tedder (2001) also obtained a cDNA encoding MS4A4A. The predicted 220-amino acid protein is more than 40% identical to its mouse homologs. PCR analysis detected variable expression of MS4A4A in cDNA from multiple hemopoietic cell lines.

Full details of the abovementioned studies are described in the following publications, the disclosure of which are hereby incorporated by reference:

Ishibashi, K.; Suzuki, M.; Sasaki, S.; Imai, M.: Identification of a new multigene four-transmembrane family (MS4A) related to CD20, HTm4 and beta subunit of the high-affinity IgE receptor. Gene 264:87-93, 2001; and Liang, Y.; Tedder, T. F.: Identification of a CD20-, Fc-epsilon-RI-beta-related gene family: sixteen new MS4A family members expressed in human and mouse. Genomics 72:119-127, 2001.

Further studies establishing the function and utilities of MS4A4A are found in John Hopkins OMIM database record ID 606547, and in cited publications listed in Table 5, which are hereby incorporated by reference. MTH2 (Accession NP_060753.1) is another GAM179 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:19548, to the nucleotide sequence of GAM179 RNA, herein designated GAM RNA, also designated SEQ ID:300.

Another function of GAM179 is therefore inhibition of MTH2 (Accession NP_060753.1). Accordingly, utilities of GAM179 include diagnosis, prevention and treatment of diseases and clinical conditions associated with MTH2.

Myosin ie (MYO1E, Accession NP_004989.1) is another GAM179 target gene, herein designated TARGET GENE. MYO1E BINDING SITE is a target binding site found in the 3' untranslated region of mRNA encoded by MYO1E, corresponding to a target binding site such as BINDING SITE I, BINDING SITE II or BINDING SITE III of FIG. 8. Table 4 illustrates the complementarity of the nucleotide sequences of MYO1E BINDING SITE, designated SEQ ID:3663, to the nucleotide sequence of GAM179 RNA, herein designated GAM RNA, also designated SEQ ID:300.

Another function of GAM179 is therefore inhibition of Myosin ie (MYO1E, Accession NP_004989.1), a gene which is an unconventional myosin. Accordingly, utilities of GAM179 include diagnosis, prevention and treatment of diseases and clinical conditions associated with MYO1E.

The function of MYO1E has been established by previous studies. Bement et al. (1994) cloned a human unconventional myosin gene, MYO1E, encoding a predicted 127-kD polypeptide of 1,109 amino acids. The gene, which they designated myosin IC, contains a characteristic N-terminal myosin head, a single 'IQ motif' predicted to bind a single myosin light chain, and a C-terminal tail with a putative membrane-binding site. They also noted the presence of a C-terminal src-homology domain, reminiscent of 'long-tailed' myosins I from amoeboid organisms. By Northern analysis, Bement et al. (1994) detected ubiquitous expression of MYO1E. Hasson et al. (1996) used fluorescence in situ hybridization to map the loci for 4 unconventional myosin loci in humans: MYO1E (formerly MYO1C), MYO1A (OMIM Ref. No. 601478), MYO1F (OMIM Ref. No. 601480), and MYO10 (OMIM Ref. No. 601481). The MYO1E gene was found to be located on 15q21-q22 in the precise location predicted from its location on chromosome 9 of the mouse.

Full details of the abovementioned studies are described in the following publications, the disclosure of which are hereby incorporated by reference:

Bement, W. M.; Wirth, J. A.; Mooseker, M. S.: Cloning and mRNA expression of human unconventional myosin-IC: a homologue of amoeboid myosins-I with a single IQ motif and an SH3 domain. J. Molec. Biol. 243:356-363, 1994; and Hasson, T.; Skowron, J. F.; Gilbert, D. J.; Avraham, K. B.; Perry, W. L.; Bement, W. M.; Anderson, B. L.; Sherr, E. H.; Chen, Z.-Y.; Greene, L. A.; Ward, D. C.; Corey, D. P.; Mooseker.

Further studies establishing the function and utilities of MYO1E are found in John Hopkins OMIM database record ID 601479, and in cited publications listed in Table 5, which are hereby incorporated by reference. Nuclear receptor coactivator 1 (NCOA1, Accession NP_671756.1) is another GAM179 target gene, herein designated TARGET GENE. NCOA1 BINDING SITE is a target binding site found in the 3' untranslated region of multiple transcripts of mRNA encoded by NCOA1, corresponding to a target binding site such as BINDING SITE I, BINDING SITE II or BINDING SITE III of FIG. 8. Table 4 illustrates the complementarity of the nucleotide sequences of NCOA1 BINDING SITE, designated SEQ ID:13930, to the nucleotide sequence of GAM179 RNA, herein designated GAM RNA, also designated SEQ ID:300.

Another function of GAM179 is therefore inhibition of Nuclear receptor coactivator 1 (NCOA1, Accession NP_671756.1), a gene which acts as a transcriptional coactivator for steroid and nuclear hormone receptors. Accordingly, utilities of GAM179 include diagnosis, prevention and treatment of diseases and clinical conditions associated with NCOA1.

The function of NCOA1 has been established by previous studies. Onate et al. (1995) identified steroid receptor coactivator-1 (SRC1), a coactivator that is required for full transcriptional activity of the steroid receptor superfamily. They isolated a cDNA encoding SRC1 using the yeast 2-hybrid system to identify proteins that interact with the human progesterone receptor (PGR; 607311). The SRC1 protein has a glutamine-rich region and a serine/threonine-rich region. SRC1 enhances the transcriptional activity of ligand-bound PGR but does not alter the basal activity of the target promoter. SRC1 also enhances estrogen receptor (ESR; 133430), glucocorticoid receptor (GRL; 138040), thyroid hormone receptor (e.g., 190120), and retinoid X receptor (e.g., RXRA; 180245) transcriptional activities through their cognate DNA response elements in the presence of hormone. Studies of the effects of SRC1 on unrelated transactivators showed that SRC1 can enhance the transcriptional activities of SP1 (OMIM Ref. No. 189906) and the chimeric Gal4-VP16 protein, but not those of E2F (e.g., 189971), E47 (OMIM Ref. No. 147141), or CREB (OMIM Ref. No. 123810). Coexpression of SRC1 with PGR and ESR reversed the ability of ESR to squelch activation by PGR, suggesting that SRC1 is a limiting factor necessary for efficient PGR and ESR transactivation. A C-terminal form of SRC1 containing the receptor-binding region acted as a dominant-negative repressor of endogenous SRC1 function. SRC1 is expressed as 2 mRNAs of approximately 5.5 and 7.5 kb in a variety of human tissues and cell lines. Using a far-Western-based approach to screen a HeLa cell cDNA expression library with bacterially expressed rat thyroid hormone receptor (THRB; 190160), Takeshita et al. (1996) identified a partial SRC1 cDNA. They isolated the remaining sequence by 5-prime RACE. The full-length cDNA encodes a 1,440-amino acid protein with a mass of approximately 160 kD. In vitro binding studies showed that SRC1 can bind to TBP (OMIM Ref. No. 600075) and to TFIIB (OMIM Ref. No. 189963), in addition to a variety of nuclear hormone receptors in a ligand-dependent manner, suggesting that SRC1 may play a role as a bridging molecule between nuclear hormone receptors and general transcription factors. The conserved AF-2 region of nuclear hormone receptors was not required for receptor-SRC1 binding Full details of the abovementioned studies are described in the following publications, the disclosure of which are hereby incorporated by reference:

Onate, S. A.; Tsai, S. Y.; Tsai, M.-J.; O'Malley, B. W.: Sequence and characterization of a coactivator for the steroid hormone receptor superfamily. Science 270:1354-1357, 1995; and Takeshita, A.; Yen, P. M.; Misiti, S.; Cardona, G. R.; Liu, Y.; Chin, W. W.: Molecular cloning and properties of a full-length putative thyroid hormone receptor coactivator. Endocrinol.

Further studies establishing the function and utilities of NCOA1 are found in John Hopkins OMIM database record ID 602691, and in cited publications listed in Table 5, which are hereby incorporated by reference. NESG1 (Accession NP_036469.1) is another GAM179 target gene, herein designated TARGET GENE. NESG1 BINDING SITE is a target binding site found in the 5' untranslated region of mRNA encoded by NESG1, corresponding to a target binding site such as BINDING SITE I, BINDING SITE II or BINDING SITE III of FIG. 8. Table 4 illustrates the complementarity of the nucleotide sequences of NESG1 BINDING SITE, designated SEQ ID:3220, to the nucleotide sequence of GAM179 RNA, herein designated GAM RNA, also designated SEQ ID:300.

Another function of GAM179 is therefore inhibition of NESG1 (Accession NP_036469.1). Accordingly, utilities of GAM179 include diagnosis, prevention and treatment of diseases and clinical conditions associated with NESG1.

NLG1 (Accession NP_115499.1) is another GAM179 target gene, herein designated TARGET GENE. NLG1 BINDING SITE is a target binding site found in the 3' untranslated region of mRNA encoded by NLG1, corresponding to a target binding site such as BINDING SITE I, BINDING SITE II or BINDING SITE III of FIG. 8. Table 4 illustrates the complementarity of the nucleotide sequences of NLG1 BINDING SITE, designated SEQ ID:19329, to the nucleotide sequence of GAM179 RNA, herein designated GAM RNA, also designated SEQ ID:300.

Another function of GAM179 is therefore inhibition of NLG1 (Accession NP_115499.1). Accordingly, utilities of GAM179 include diagnosis, prevention and treatment of diseases and clinical conditions associated with NLG1.

Phosphoinositide-3-kinase, regulatory subunit, polypeptide 3 (p55, gamma) (PIK3R3, Accession NP_003620.1) is another GAM179 target gene, herein designated TARGET GENE. PIK3R3 BINDING SITE is a target binding site found in the 3' untranslated region of mRNA encoded by PIK3R3, corresponding to a target binding site such as BINDING SITE I, BINDING SITE II or BINDING SITE III of FIG. 8. Table 4 illustrates the complementarity of the nucleotide sequences of PIK3R3 BINDING SITE, designated SEQ ID:16643, to the nucleotide sequence of GAM179 RNA, herein designated GAM RNA, also designated SEQ ID:300.

Another function of GAM179 is therefore inhibition of Phosphoinositide-3-kinase, regulatory subunit, polypeptide 3 (p55, gamma) (PIK3R3, Accession NP_003620.1). Accordingly, utilities of GAM179 include diagnosis, prevention and treatment of diseases and clinical conditions associated with PIK3R3.

PILRB (Accession NP_038468.3) is another GAM179 target gene, herein designated TARGET GENE. PILRB BINDING SITE is a target binding site found in the 3' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:17335, to the nucleotide sequence of GAM179 RNA, herein designated GAM RNA, also designated SEQ ID:300.

Another function of GAM179 is therefore inhibition of PILRB (Accession NP_038468.3). Accordingly, utilities of GAM179 include diagnosis, prevention and treatment of diseases and clinical conditions associated with PILRB.

PILRB (Accession NP_839956.1) is another GAM179 target gene, herein designated TARGET GENE. PILRB BINDING SITE is a target binding site found in the 3' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:17335, to the nucleotide sequence of GAM179 RNA, herein designated GAM RNA, also designated SEQ ID:300.

Another function of GAM179 is therefore inhibition of PILRB (Accession NP_839956.1). Accordingly, utilities of GAM179 include diagnosis, prevention and treatment of diseases and clinical conditions associated with PILRB.

PILRB (Accession NP_778212.2) is another GAM179 target gene, herein designated TARGET GENE. PILRB BINDING SITE is a target binding site found in the 3' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:17335, to the nucleotide sequence of GAM179 RNA, herein designated GAM RNA, also designated SEQ ID:300.

Another function of GAM179 is therefore inhibition of PILRB (Accession NP_778212.2). Accordingly, utilities of GAM179 include diagnosis, prevention and treatment of diseases and clinical conditions associated with PILRB.

Phosphatidylinositol-4-phosphate 5-kinase, type i, beta (PIP5K1B, Accession NP_003549.1) is another GAM179 target gene, herein designated TARGET GENE. PIP5K1B BINDING SITE is a target binding site found in the 3' untranslated region of mRNA encoded by PIP5K1B, corresponding to a target binding site such as BINDING SITE I, BINDING SITE II or BINDING SITE III of FIG. 8. Table 4 illustrates the complementarity of the nucleotide sequences of PIP5K1B BINDING SITE, designated SEQ ID:11230, to the nucleotide sequence of GAM179 RNA, herein designated GAM RNA, also designated SEQ ID:300.

Another function of GAM179 is therefore inhibition of Phosphatidylinositol-4-phosphate 5-kinase, type i, beta (PIP5K1B, Accession NP_003549.1), a gene which catalyses the phosphorylation of phosphatidylinositol-4-phosphate to form phosphatidylinositol-4,5-biphosphate. and therefore may be associated with Friedreich ataxia. Accordingly, utilities of GAM179 include diagnosis, prevention and treatment of Friedreich ataxia, and of other diseases and clinical conditions associated with PIP5K1B.

The function of PIP5K1B and its association with various diseases and clinical conditions, has been established by previous studies, as described hereinabove with reference to GAM94.1. Plexin c1 (PLXNC1, Accession NP_005752.1) is another GAM179 target gene, herein designated TARGET GENE. PLXNC1 BINDING SITE is a target binding site found in the 3' untranslated region of mRNA encoded by PLXNC1, corresponding to a target binding site such as BINDING SITE I, BINDING SITE II or BINDING SITE III of FIG. 8. Table 4 illustrates the complementarity of the nucleotide sequences of PLXNC1 BINDING SITE, designated SEQ ID:17920, to the nucleotide sequence of GAM179 RNA, herein designated GAM RNA, also designated SEQ ID:300.

Another function of GAM179 is therefore inhibition of Plexin c1 (PLXNC1, Accession NP_005752.1). Accordingly, utilities of GAM179 include diagnosis, prevention and treatment of diseases and clinical conditions associated with PLXNC1.

PP1628 (Accession NP_079477.1) is another GAM179 target gene, herein designated TARGET GENE. PP1628 BINDING SITE is a target binding site found in the 5' untranslated region of mRNA encoded by PP1628, corresponding to a target binding site such as BINDING SITE I, BINDING SITE II or BINDING SITE III of FIG. 8. Table 4 illustrates the complementarity of the nucleotide sequences of PP1628 BINDING SITE, designated SEQ ID:5602, to the nucleotide sequence of GAM179 RNA, herein designated GAM RNA, also designated SEQ ID:300.

Another function of GAM179 is therefore inhibition of PP1628 (Accession NP_079477.1). Accordingly, utilities of GAM179 include diagnosis, prevention and treatment of diseases and clinical conditions associated with PP1628.

Palmitoyl-protein thioesterase 2 (PPT2, Accession NP_619731.1) is another GAM179 target gene, herein designated TARGET GENE. PPT2 BINDING SITE is a target binding site found in the 3' untranslated region of multiple transcripts of mRNA encoded by PPT2, corresponding to a target binding site such as BINDING SITE I, BINDING SITE II or BINDING SITE III of FIG. 8. Table 4 illustrates the complementarity of the nucleotide sequences of PPT2 BINDING SITE, designated SEQ ID:5462, to the nucleotide sequence of GAM179 RNA, herein designated GAM RNA, also designated SEQ ID:300.

Another function of GAM179 is therefore inhibition of Palmitoyl-protein thioesterase 2 (PPT2, Accession NP_619731.1), a gene which is a palmitoyl-protein thioesterase 2 which possesses a different substrate specificity than PPT1. Accordingly, utilities of GAM179 include diagnosis, prevention and treatment of diseases and clinical conditions associated with PPT2.

The function of PPT2 and its association with various diseases and clinical conditions, has been established by previous studies, as described hereinabove with reference to GAM63.1. Palmitoyl-protein thioesterase 2 (PPT2, Accession NP_005146.3) is another GAM179 target gene, herein designated TARGET GENE. PPT2 BINDING SITE is a target binding site found in the 3' untranslated region of multiple transcripts of mRNA encoded by PPT2, corresponding to a target binding site such as BINDING SITE I, BINDING SITE II or BINDING SITE III of FIG. 8. Table 4 illustrates the complementarity of the nucleotide sequences of PPT2 BINDING SITE, designated SEQ ID:5462, to the nucleotide sequence of GAM179 RNA, herein designated GAM RNA, also designated SEQ ID:300.

Another function of GAM179 is therefore inhibition of Palmitoyl-protein thioesterase 2 (PPT2, Accession NP_005146.3), a gene which is a palmitoyl-protein thioesterase 2 which possesses a different substrate specificity than PPT1. Accordingly, utilities of GAM179 include diagnosis, prevention and treatment of diseases and clinical conditions associated with PPT2.

The function of PPT2 and its association with various diseases and clinical conditions, has been established by previous studies, as described hereinabove with reference to GAM63.1. Proline-rich protein bstni subfamily 3 (PRB3, Accession NP_006240.2) is another GAM179 target gene, herein designated TARGET GENE. PRB3 BINDING SITE is a target binding site found in the 5' untranslated region of mRNA encoded by PRB3, corresponding to a target binding site such as BINDING SITE I, BINDING SITE II or BINDING SITE III of FIG. 8. Table 4 illustrates the complementarity of the nucleotide sequences of PRB3 BINDING SITE, designated SEQ ID:6636, to the nucleotide sequence of GAM179 RNA, herein designated GAM RNA, also designated SEQ ID:300.

Another function of GAM179 is therefore inhibition of Proline-rich protein bstni subfamily 3 (PRB3, Accession NP_006240.2), a gene which is a salivary proline-rich protein and subunit of the splicing factor sf3a. Accordingly, utilities of GAM179 include diagnosis, prevention and treatment of diseases and clinical conditions associated with PRB3.

The function of PRB3 has been established by previous studies. Azen et al. (1978) found 5 alleles. Linkage with Pr, Db, and Pa was indicated by linkage disequilibrium. These genes presumably arose by gene duplication, in view of the structural similarity of the gene products. They play an important role in inhibiting calcium phosphate precipitation from saliva and the glycoprotein forms part of the acquired dental pellicle and plaque. On the basis of relative degrees of linkage disequilibrium, Azen and Denniston (1980) favored positioning of G1 'outside' Db, to give suggested gene order Pa-Pr-Db-G1. Ikemoto et al. (1979) delineated a polymorphic salivary glycoprotein they symbolized Ph (salivary parotid heavy protein). The relation to G1 of Azen et al. (1978) was not known. According to the hypothesis of Maeda (1985), as outlined in 168730, 6 loci constituting 2 gene subfamilies code the salivary proline- rich proteins. One subfamily, with 2 genes, codes the acidic proteins; the genes are rich in HaeIII restriction sites and are designated PRH1 and PRH2. The other subfamily, with 4 loci, codes the basic proteins; the genes are rich in BstNI restriction sites and are designated PRB1, PRB2, PRB3, and PRB4. Maeda (1985) concluded that the gene she designated PRB3 probably codes G1. Which ones of the other basic proline-rich proteins are coded by PRB1, 2 and 4 is not yet certain. Sequencing and restriction mapping indicate that the PRP cluster is in a segment of DNA about 500 kb long (Maeda, 1985). There is no information on the order and linkage relationships of the 6 genes. The 2 genes PRH1 (OMIM Ref. No. 168730) and PRH2 (OMIM Ref. No. 168790) have been completely sequenced (Kim and Maeda, 1986). The sequence information confirms the allelic relationship of Db, Pa, and PIF.

Full details of the abovementioned studies are described in the following publications, the disclosure of which are hereby incorporated by reference:

Kim, H.-S.; Maeda, N.: Structures of two HaeIII-type genes in the human salivary proline-rich protein multigene family. J. Biol. Chem. 261:6712-6718, 1986; and Maeda, N.: Inheritance of the human salivary proline-rich proteins: a reinterpretation in terms of six loci forming two subfamilies. Biochem. Genet. 23:455-464, 1985.

Further studies establishing the function and utilities of PRB3 are found in John Hopkins OMIM database record ID 168840, and in cited publications listed in Table 5, which are hereby incorporated by reference. PRO0461 (Accession NP_112558.1) is another GAM179 target gene, herein designated TARGET GENE. PRO0461 BINDING SITE is a target binding site found in the 5' untranslated region of mRNA encoded by PRO0461, corresponding to a target binding site such as BINDING SITE I, BINDING SITE II or BINDING SITE III of FIG. 8. Table 4 illustrates the complementarity of the nucleotide sequences of PRO0461 BINDING SITE, designated SEQ ID:14706, to the nucleotide sequence of GAM179 RNA, herein designated GAM RNA, also designated SEQ ID:300.

Another function of GAM179 is therefore inhibition of PRO0461 (Accession NP_112558.1). Accordingly, utilities of GAM179 include diagnosis, prevention and treatment of diseases and clinical conditions associated with PRO0461.

Rab5c, member ras oncogene family (RAB5C, Accession NP_004574.1) is another GAM179 target gene, herein designated TARGET GENE. RAB5C BINDING SITE is a target binding site found in the 5' untranslated region of mRNA encoded by RAB5C, corresponding to a target binding site such as BINDING SITE I, BINDING SITE II or BINDING SITE III of FIG. 8. Table 4 illustrates the complementarity of the nucleotide sequences of RAB5C BINDING SITE, designated SEQ ID:590, to the nucleotide sequence of GAM179 RNA, herein designated GAM RNA, also designated SEQ ID:300.

Another function of GAM179 is therefore inhibition of Rab5c, member ras oncogene family (RAB5C, Accession NP_004574.1), a gene which is involved in the process of docking and/or fusion of vesicles with their correct acceptor compartment. Accordingly, utilities of GAM179 include diagnosis, prevention and treatment of diseases and clinical conditions associated with RAB5C.

The function of RAB5C has been established by previous studies. Members of the Rab protein family are small GTPases of the Ras superfamily that are thought to ensure fidelity in the process of docking and/or fusion of vesicles with their correct acceptor compartment. Han et al. (1996) isolated fetal lung cDNAs encoding a RAB protein that they designated RABL (RAB5-like). The predicted 216-amino acid RABL protein shares 86% identity with RAB5A (OMIM Ref. No. 179512) and RAB5B (OMIM Ref. No. 179514) and contains the conserved GTP-binding site characteristic of RAS proteins. RT-PCR analysis revealed that RABL is expressed ubiquitously. By analysis of cloned segments, Albertsen et al. (1994) determined that the RABL gene, which they called BC1-16, is located in the BRCA1 (OMIM Ref. No. 113705) gene region on chromosome 17q12-q21. Han et al. (1996) refined the map position to 17q21.2 using FISH.

Full details of the abovementioned studies are described in the following publications, the disclosure of which are hereby incorporated by reference:

Albertsen, H. M.; Smith, S. A.; Mazoyer, S.; Fujimoto, E.; Stevens, J.; Williams, B.; Rodriguez, P.; Cropp, C. S.; Slijepcevic, P.; Carlson, M.; Robertson, M.; Bradley, P.; and 9 others: A physical map and candidate genes in the BRCA1 region on chromosome 17q12-21. Nature Genet. 7:472-479, 1994; and Han, H.-J.; Sudo, K.; Inazawa, J.; Nakamura, Y.: Isolation and mapping of a human gene (RABL) encoding a small GTP-binding protein homologous to the Ras-related RAB gene. Cytogenet. Cel.

Further studies establishing the function and utilities of RAB5C are found in John Hopkins OMIM database record ID 604037, and in cited publications listed in Table 5, which are hereby incorporated by reference. Rad9 homolog (s. pombe) (RAD9, Accession NP_004575.1) is another GAM179 target gene, herein designated TARGET GENE. RAD9 BINDING SITE is a target binding site found in the 3' untranslated region of mRNA encoded by RAD9, corresponding to a target binding site such as BINDING SITE I, BINDING SITE II or BINDING SITE III of FIG. 8. Table 4 illustrates the complementarity of the nucleotide sequences of RAD9 BINDING SITE, designated SEQ ID:16284, to the nucleotide sequence of GAM179 RNA, herein designated GAM RNA, also designated SEQ ID:300.

Another function of GAM179 is therefore inhibition of Rad9 homolog (s. pombe) (RAD9, Accession NP_004575.1), a gene which may function as a cell cycle checkpoint protein. Accordingly, utilities of GAM179 include diagnosis, prevention and treatment of diseases and clinical conditions associated with RAD9.

The function of RAD9 has been established by previous studies. In S. pombe, rad9 is one of 6 genes essential for both the incomplete DNA replication (S-M) and DNA damage checkpoints. See HUS1 (OMIM Ref. No. 603760). By searching an EST database, Lieberman et al. (1996) identified a partial cDNA encoding HRAD9, a human rad9 homolog. The authors used the partial cDNA to recover additional human RAD9 cDNAs corresponding to the entire coding region. The predicted 391-amino acid human protein is 25% identical to S. pombe rad9. The human RAD9 gene partially complemented the hydroxyurea sensitivity, radiosensitivity, and checkpoint defects of rad9-null mutant cells. On immunoblots of mammalian cell extracts, Volkmer and Karnitz (1999) found that human RAD9 migrated at 70 kD, even though it has a predicted molecular mass of 45 kD. The authors attributed this discrepancy to complex posttranslational modifications. In vivo, the human RAD9 protein was phosphorylated in response to DNA damage, suggesting that it participates in a DNA damage-inducible signaling pathway. Immunoprecipitation studies demonstrated that the fully modified form of RAD9 interacts selectively with RAD1 (OMIM Ref. No. 603153) and HUS1 in a stable complex. Volkmer and Karnitz (1999) concluded that these 3 proteins are central components of a DNA damage-responsive protein complex in human cells.

Full details of the abovementioned studies are described in the following publications, the disclosure of which are hereby incorporated by reference:

Lieberman, H. B.; Hopkins, K. M.; Nass, M.; Demetrick, D.; Davey, S.: A human homolog of the Schizosaccharomyces pombe rad9+checkpoint control gene. Proc. Nat. Acad. Sci. 93:13890-13895, 1996; and Volkmer, E.; Karnitz, L. M.: Human homologs of Schizosaccharomyces pombe Rad1, Hus1, and Rad9 form a DNA damage-responsive protein complex. J. Biol. Chem. 274:567-570, 1999.

Further studies establishing the function and utilities of RAD9 are found in John Hopkins OMIM database record ID 603761, and in cited publications listed in Table 5, which are hereby incorporated by reference. Retinoblastoma binding protein 2 (RBBP2, Accession NP_005047.1) is another GAM179 target gene, herein designated TARGET GENE. RBBP2 BINDING SITE is a target binding site found in the 3' untranslated region of mRNA encoded by RBBP2, corresponding to a target binding site such as BINDING SITE I, BINDING SITE II or BINDING SITE III of FIG. 8. Table 4 illustrates the complementarity of the nucleotide sequences of RBBP2 BINDING SITE, designated SEQ ID:19420, to the nucleotide sequence of GAM179 RNA, herein designated GAM RNA, also designated SEQ ID:300.

Another function of GAM179 is therefore inhibition of Retinoblastoma binding protein 2 (RBBP2, Accession NP_005047.1), a gene which interacts with the vital protein-binding domain of the retinoblastoma protein. Accordingly, utilities of GAM179 include diagnosis, prevention and treatment of diseases and clinical conditions associated with RBBP2.

The function of RBBP2 has been established by previous studies. Baens et al. (1995) characterized 117 cDNAs isolated by direct cDNA selection using pools of human chromosome 12p cosmids. Of these, 3 matched previously determined cDNA sequences, including the retinoblastoma-binding protein-2 (RBBP2) gene. STSs were developed for all cosmids. Regional assignment of the STSs by PCR analysis with somatic cell hybrids and fluorescence in situ hybridization showed that the loci mapped to 12p11. To identify proteins that may modulate the activity of RBTN2 (LMO2; 180385), Mao et al. (1997) employed the yeast 2-hybrid assay to screen a human lymphocyte cDNA library using the RBTN2 LIM domain region as bait. They isolated a cDNA encoding the C-terminal region of RBBP2. The authors confirmed the interaction between RBTN2 and RBBP2 using in vitro binding assays and by coimmunoprecipitation of the 2 proteins. Deletion analysis showed that the second LIM domain of RBTN2 was necessary and sufficient for binding to the last 69 amino acids of RBBP2. The interaction between RBTN2 and RBBP2 had a functional consequence: the combination of RBBP2 and RBTN2 resulted in a higher level of transcription than RBTN2 alone in an in vitro assay. Mao et al. (1997) stated that the interaction of RBTN2 with RBBP2 suggests that RBTN2 may directly affect the activity of RBBP2 and/or RBTN2 may indirectly modulate the functions of the retinoblastoma protein (RB1; 180200) by binding to RBBP2.

Full details of the abovementioned studies are described in the following publications, the disclosure of which are hereby incorporated by reference:

Baens, M.; Aerssens, J.; Van Zand, K.; Van den Berghe, H.; Marynen, P.: Isolation and regional assignment of human chromosome 12p cDNAs. Genomics 29:44-52, 1995; and Mao, S.; Neale, G. A. M.; Goorha, R. M.: T-cell oncogene rhombotin-2 interacts with retinoblastoma-binding protein 2. Oncogene 14:1531-1539, 1997.

Further studies establishing the function and utilities of RBBP2 are found in John Hopkins OMIM database record ID 180202, and in cited publications listed in Table 5, which are hereby incorporated by reference. Regenerating islet-derived-like, pancreatic stone protein-like, pancreatic thread protein-like (rat) (REGL, Accession NP_006499.1) is another GAM179 target gene, herein designated TARGET GENE. REGL BINDING SITE is a target binding site found in the 3' untranslated region of mRNA encoded by REGL, corresponding to a target binding site such as BINDING SITE I, BINDING SITE II or BINDING SITE III of FIG. 8. Table 4 illustrates the complementarity of the nucleotide sequences of REGL BINDING SITE, designated SEQ ID:12552, to the nucleotide sequence of GAM179 RNA, herein designated GAM RNA, also designated SEQ ID:300.

Another function of GAM179 is therefore inhibition of Regenerating islet-derived-like, pancreatic stone protein-like, pancreatic thread protein-like (rat) (REGL, Accession NP_006499.1), a gene which is a member of REG family with unknown function. Accordingly, utilities of GAM179 include diagnosis, prevention and treatment of diseases and clinical conditions associated with REGL.

The function of REGL and its association with various diseases and clinical conditions, has been established by previous studies, as described hereinabove with reference to GAM63.1. SAE1 (Accession NP_005491.1) is another GAM179 target gene, herein designated TARGET GENE. SAE1 BINDING SITE is a target binding site found in the 3' untranslated region of mRNA encoded by SAE1, corresponding to a target binding site such as BINDING SITE I, BINDING SITE II or BINDING SITE III of FIG. 8. Table 4 illustrates the complementarity of the nucleotide sequences of SAE1 BINDING SITE, designated SEQ ID:17602, to the nucleotide sequence of GAM179 RNA, herein designated GAM RNA, also designated SEQ ID:300.

Another function of GAM179 is therefore inhibition of SAE1 (Accession NP_005491.1). Accordingly, utilities of GAM179 include diagnosis, prevention and treatment of diseases and clinical conditions associated with SAE1.

Sh3-domain binding protein 1 (SH3BP1, Accession NP_061830.2) is another GAM179 target gene, herein designated TARGET GENE. SH3BP1 BINDING SITE is a target binding site found in the 3' untranslated region of mRNA encoded by SH3BP1, corresponding to a target binding site such as BINDING SITE I, BINDING SITE II or BINDING SITE III of FIG. 8. Table 4 illustrates the complementarity of the nucleotide sequences of SH3BP1 BINDING SITE, designated SEQ ID:14730, to the nucleotide sequence of GAM179 RNA, herein designated GAM RNA, also designated SEQ ID:300.

Another function of GAM179 is therefore inhibition of Sh3-domain binding protein 1 (SH3BP1, Accession NP_061830.2). Accordingly, utilities of GAM179 include diagnosis, prevention and treatment of diseases and clinical conditions associated with SH3BP1.

Sialyltransferase 1 (beta-galactoside alpha-2,6-sialytransferase) (SIAT1, Accession NP_775323.1) is another GAM179 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:10204, to the nucleotide sequence of GAM179 RNA, herein designated GAM RNA, also designated SEQ ID:300.

Another function of GAM179 is therefore inhibition of Sialyltransferase 1 (beta-galactoside alpha-2,6-sialytransferase) (SIAT1, Accession NP_775323.1), a gene which transfers sialic acid from the donor of substrate cmp-sialic acid to galactose containing acceptor substrates. Accordingly, utilities of GAM179 include diagnosis, prevention and treatment of diseases and clinical conditions associated with SIAT1.

The function of SIAT1 and its association with various diseases and clinical conditions, has been established by previous studies, as described hereinabove with reference to GAM40.2. Sialyltransferase 1 (beta-galactoside alpha-2,6-sialytransferase) (SIAT1, Accession NP_003023.1) is another GAM179 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:10204, to the nucleotide sequence of GAM179 RNA, herein designated GAM RNA, also designated SEQ ID:300.

Another function of GAM179 is therefore inhibition of Sialyltransferase 1 (beta-galactoside alpha-2,6-sialytransferase) (SIAT1, Accession NP_003023.1), a gene which transfers sialic acid from the donor of substrate cmp-sialic acid to galactose containing acceptor substrates. Accordingly, utilities of GAM179 include diagnosis, prevention and treatment of diseases and clinical conditions associated with SIAT1.

The function of SIAT1 and its association with various diseases and clinical conditions, has been established by previous studies, as described hereinabove with reference to GAM40.2. Sialyltransferase 1 (beta-galactoside alpha-2,6-sialytransferase) (SIAT1, Accession NP_775324.1) is another GAM179 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:10204, to the nucleotide sequence of GAM179 RNA, herein designated GAM RNA, also designated SEQ ID:300.

Another function of GAM179 is therefore inhibition of Sialyltransferase 1 (beta-galactoside alpha-2,6-sialytransferase) (SIAT1, Accession NP_775324.1), a gene which transfers sialic acid from the donor of substrate cmp-sialic acid to galactose containing acceptor substrates. Accordingly, utilities of GAM179 include diagnosis, prevention and treatment of diseases and clinical conditions associated with SIAT1.

The function of SIAT1 and its association with various diseases and clinical conditions, has been established by previous studies, as described hereinabove with reference to GAM40.2. Solute carrier family 12 (potassium/chloride transporters), member 7 (SLC12A7, Accession NP_006589.1) is another GAM179 target gene, herein designated TARGET GENE. SLC12A7 BINDING SITE is a target binding site found in the 3' untranslated region of mRNA encoded by SLC12A7, corresponding to a target binding site such as BINDING SITE I, BINDING SITE II or BINDING SITE III of FIG. 8. Table 4 illustrates the complementarity of the nucleotide sequences of SLC12A7 BINDING SITE, designated SEQ ID:15230, to the nucleotide sequence of GAM179 RNA, herein designated GAM RNA, also designated SEQ ID:300.

Another function of GAM179 is therefore inhibition of Solute carrier family 12 (potassium/chloride transporters), member 7 (SLC12A7, Accession NP_006589.1), a gene which is a potassium/chloride- cotransporter. Accordingly, utilities of GAM179 include diagnosis, prevention and treatment of diseases and clinical conditions associated with SLC12A7.

The function of SLC12A7 and its association with various diseases and clinical conditions, has been established by previous studies, as described hereinabove with reference to GAM105.1. SLC37A3 (Accession NP_115671.1) is another GAM179 target gene, herein designated TARGET GENE. SLC37A3 BINDING SITE is a target binding site found in the 3' untranslated region of mRNA encoded by SLC37A3, corresponding to a target binding site such as BINDING SITE I, BINDING SITE II or BINDING SITE III of FIG. 8. Table 4 illustrates the complementarity of the nucleotide sequences of SLC37A3 BINDING SITE, designated SEQ ID:14888, to the nucleotide sequence of GAM179 RNA, herein designated GAM RNA, also designated SEQ ID:300.

Another function of GAM179 is therefore inhibition of SLC37A3 (Accession NP_115671.1). Accordingly, utilities of GAM179 include diagnosis, prevention and treatment of diseases and clinical conditions associated with SLC37A3.

Smcx homolog, x chromosome (mouse) (SMCX, Accession NP_004178.1) is another GAM179 target gene, herein designated TARGET GENE. SMCX BINDING SITE is a target binding site found in the 3' untranslated region of mRNA encoded by SMCX, corresponding to a target binding site such as BINDING SITE I, BINDING SITE II or BINDING SITE III of FIG. 8. Table 4 illustrates the complementarity of the nucleotide sequences of SMCX BINDING SITE, designated SEQ ID:8263, to the nucleotide sequence of GAM179 RNA, herein designated GAM RNA, also designated SEQ ID:300.

Another function of GAM179 is therefore inhibition of Smcx homolog, x chromosome (mouse) (SMCX, Accession NP_004178.1), a gene which escapes X inactivation. Accordingly, utilities of GAM179 include diagnosis, prevention and treatment of diseases and clinical conditions associated with SMCX.

The function of SMCX and its association with various diseases and clinical conditions, has been established by previous studies, as described hereinabove with reference to GAM63.1. Spondin 1, (f-spondin) extracellular matrix protein (SPON1, Accession NP_006099.1) is another GAM179 target gene, herein designated TARGET GENE. SPON1 BINDING SITE is a target binding site found in the 3' untranslated region of mRNA encoded by SPON1, corresponding to a target binding site such as BINDING SITE I, BINDING SITE II or BINDING SITE III of FIG. 8. Table 4 illustrates the complementarity of the nucleotide sequences of SPON1 BINDING SITE, designated SEQ ID:16909, to the nucleotide sequence of GAM179 RNA, herein designated GAM RNA, also designated SEQ ID:300.

Another function of GAM179 is therefore inhibition of Spondin 1, (f-spondin) extracellular matrix protein (SPON1, Accession NP_006099.1). Accordingly, utilities of GAM179 include diagnosis, prevention and treatment of diseases and clinical conditions associated with SPON1.

Serine palmitoyltransferase, long chain base subunit 2 (SPTLC2, Accession NP_004854.1) is another GAM179 target gene, herein designated TARGET GENE. SPTLC2 BINDING SITE is a target binding site found in the 3' untranslated region of mRNA encoded by SPTLC2, corresponding to a target binding site such as BINDING SITE I, BINDING SITE II or BINDING SITE III of FIG. 8. Table 4 illustrates the complementarity of the nucleotide sequences of SPTLC2 BINDING SITE, designated SEQ ID:16724, to the nucleotide sequence of GAM179 RNA, herein designated GAM RNA, also designated SEQ ID:300.

Another function of GAM179 is therefore inhibition of Serine palmitoyltransferase, long chain base subunit 2 (SPTLC2, Accession NP_004854.1). Accordingly, utilities of GAM179 include diagnosis, prevention and treatment of diseases and clinical conditions associated with SPTLC2.

Stromal antigen 3 (STAG3, Accession NP_076975.1) is another GAM179 target gene, herein designated TARGET GENE. STAG3 BINDING SITE is a target binding site found in the 3' untranslated region of multiple transcripts of mRNA encoded by STAG3, corresponding to a target binding site such as BINDING SITE I, BINDING SITE II or BINDING SITE III of FIG. 8. Table 4 illustrates the complementarity of the nucleotide sequences of STAG3 BINDING SITE, designated SEQ ID:5382, to the nucleotide sequence of GAM179 RNA, herein designated GAM RNA, also designated SEQ ID:300.

Another function of GAM179 is therefore inhibition of Stromal antigen 3 (STAG3, Accession NP_076975.1). Accordingly, utilities of GAM179 include diagnosis, prevention and treatment of diseases and clinical conditions associated with STAG3.

Synaptotagmin-like 2 (SYTL2, Accession NP_116561.1) is another GAM179 target gene, herein designated TARGET GENE. SYTL2 BINDING SITE is a target binding site found in the 5' untranslated region of multiple transcripts of mRNA encoded by SYTL2, corresponding to a target binding site such as BINDING SITE I, BINDING SITE II or BINDING SITE III of FIG. 8. Table 4 illustrates the complementarity of the nucleotide sequences of SYTL2 BINDING SITE, designated SEQ ID:7702, to the nucleotide sequence of GAM179 RNA, herein designated GAM RNA, also designated SEQ ID:300.

Another function of GAM179 is therefore inhibition of Synaptotagmin-like 2 (SYTL2, Accession NP_116561.1). Accordingly, utilities of GAM179 include diagnosis, prevention and treatment of diseases and clinical conditions associated with SYTL2.

Tenascin r (restrictin, janusin) (TNR, Accession NP_003276.2) is another GAM179 target gene, herein designated TARGET GENE. TNR BINDING SITE is a target binding site found in the 3' untranslated region of mRNA encoded by TNR, corresponding to a target binding site such as BINDING SITE I, BINDING SITE II or BINDING SITE III of FIG. 8. Table 4 illustrates the complementarity of the nucleotide sequences of TNR BINDING SITE, designated SEQ ID:19266, to the nucleotide sequence of GAM179 RNA, herein designated GAM RNA, also designated SEQ ID:300.

Another function of GAM179 is therefore inhibition of Tenascin r (restrictin, janusin) (TNR, Accession NP_003276.2), a gene which has a role in axonal path finding during embryonic development. Accordingly, utilities of GAM179 include diagnosis, prevention and treatment of diseases and clinical conditions associated with TNR.

The function of TNR has been established by previous studies. The tenascin (TN) gene family includes at least 3 genes in mammals: TN-C (or hexabrachion; 187380), TN-X (TNXA; 600261), and TN-R (Erickson, 1993). The genes are expressed in distinct tissues at different times during embryonic development and are present in adult tissues. Carnemolla et al. (1996) and Leprini et al. (1996) stated that TN-R has been detected predominantly in the central nervous system and is localized around motor neurons and on motor axons in the spinal cord, cerebellum, hippocampus, and olfactory bulb. It is detectable at embryonic days 6 to 16, but is barely detectable in the adult. This time-restricted distribution suggests an involvement of TN-R in central nervous system development Erickson (1997) provided a diagram of the individual members of the tenascin family, including TN-Y, a new member discovered in chicken. Each tenascin subunit has an N-terminal segment that connects into trimers or hexamers, a series of EGF domains, a series of FN-III domains, and a fibrinogen-like domain at the C terminus; see FIG. 1 of Erickson (1997).

Full details of the abovementioned studies are described in the following publications, the disclosure of which are hereby incorporated by reference:

Carnemolla, B.; Leprini, A.; Borsi, L.; Querze, G.; Urbini, S.; Zardi, L.: Human tenascin-R: complete primary structure, pre-mRNA alternative splicing and gene localization on chromosome 1q23-q24. J. Biol. Chem. 271:8157-8160, 1996; and Erickson, H. P.: A tenascin knockout with a phenotype. Nature Genet. 17:5-7, 1997.

Further studies establishing the function and utilities of TNR are found in John Hopkins OMIM database record ID 601995, and in cited publications listed in Table 5, which are hereby incorporated by reference. Tyro protein tyrosine kinase binding protein (TYROBP, Accession NP_003323.1) is another GAM179 target gene, herein designated TARGET GENE. TYROBP BINDING SITE is a target binding site found in the 3' untranslated region of mRNA encoded by TYROBP, corresponding to a target binding site such as BINDING SITE I, BINDING SITE II or BINDING SITE III of FIG. 8. Table 4 illustrates the complementarity of the nucleotide sequences of TYROBP BINDING SITE, designated SEQ ID:12609, to the nucleotide sequence of GAM179 RNA, herein designated GAM RNA, also designated SEQ ID:300.

Another function of GAM179 is therefore inhibition of Tyro protein tyrosine kinase binding protein (TYROBP, Accession NP_003323.1). Accordingly, utilities of GAM179 include diagnosis, prevention and treatment of diseases and clinical conditions associated with TYROBP.

Upstream binding protein 1 (lbp-1a) (UBP1, Accession NP_055332.2) is another GAM179 target gene, herein designated TARGET GENE. UBP1 BINDING SITE is a target binding site found in the 3' untranslated region of mRNA encoded by UBP1, corresponding to a target binding site such as BINDING SITE I, BINDING SITE II or BINDING SITE III of FIG. 8. Table 4 illustrates the complementarity of the nucleotide sequences of UBP1 BINDING SITE, designated SEQ ID:17947, to the nucleotide sequence of GAM179 RNA, herein designated GAM RNA, also designated SEQ ID:300.

Another function of GAM179 is therefore inhibition of Upstream binding protein 1 (lbp-1a) (UBP1, Accession NP_055332.2). Accordingly, utilities of GAM179 include diagnosis, prevention and treatment of diseases and clinical conditions associated with UBP1.

WBP3 (Accession NP_783863.2) is another GAM179 target gene, herein designated TARGET GENE. WBP3 BINDING SITE is a target binding site found in the 3' untranslated region of mRNA encoded by WBP3, corresponding to a target binding site such as BINDING SITE I, BINDING SITE II or BINDING SITE III of FIG. 8. Table 4 illustrates the complementarity of the nucleotide sequences of WBP3 BINDING SITE, designated SEQ ID:18927, to the nucleotide sequence of GAM179 RNA, herein designated GAM RNA, also designated SEQ ID:300.

Another function of GAM179 is therefore inhibition of WBP3 (Accession NP_783863.2). Accordingly, utilities of GAM179 include diagnosis, prevention and treatment of diseases and clinical conditions associated with WBP3.

FIG. 8 further provides a conceptual description of a novel bioinformatically detected of the present invention, referred to here as Genomic Address Messenger 180 (GAM180), which modulates expression of respective target genes thereof, the function and utility of which target genes is known in the art.

GAM180 is a novel bioinformatically detected regulatory, non protein coding, micro RNA (miRNA) gene. The method by which GAM180 was detected is described hereinabove with reference to FIGS. 8-15.

GAM180 gene, herein designated GAM GENE, and GAM180 target gene, herein designated TARGET GENE, are human genes contained in the human genome.

GAM180 gene encodes a GAM180 precursor RNA, herein designated GAM PRECURSOR RNA. Similar to other miRNA genes, and unlike most ordinary genes, GAM180 precursor RNA does not encode a protein. A nucleotide sequence identical or highly similar to the nucleotide sequence of GAM180 precursor RNA is designated SEQ ID:107, and is provided hereinbelow with reference to the sequence listing part. Nucleotide sequence SEQ ID:107 is located at position 128815436 relative to chromosome 11.

GAM180 precursor RNA folds onto itself, forming GAM180 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM180 precursor RNA folds onto itself, forming GAM180 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM180 precursor RNA, designated SEQ-ID:107, and a schematic representation of a predicted secondary folding of GAM180 folded precursor RNA are further described with reference to Table 2, hereby incorporated by reference.

An enzyme complex designated DICER COMPLEX, 'dices' the GAM180 folded precursor RNA into GAM180 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM180 RNA is designated SEQ ID:214, and is provided hereinbelow with references to the sequence listing part and Table 3, hereby incorporated by reference.

GAM180 target gene, herein designated TARGET GENE, encodes a corresponding messenger RNA, GAM180 target RNA, herein designated GAM TARGET RNA. GAM180 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM180 RNA, herein designated GAM RNA, binds complementarily to one or more target binding sites located in untranslated regions of GAM180 target RNA, herein designated GAM TARGET RNA. This complementary binding is due to the fact that the nucleotide sequence of GAM180 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM180 RNA may have a different number of target binding sites in untranslated regions of a GAM180 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM180 RNA, herein designated GAM RNA, to target binding sites on GAM180 target RNA, herein designated GAM TARGET RNA, such as BINDING SITE I, BINDING SITE II and BINDING SITE III, inhibits translation of GAM180 target RNA into GAM180 target protein, herein designated GAM TARGET PROTEIN. GAM target protein is therefore outlined by a broken line.

It is appreciated that GAM180 target gene, herein designated TARGET GENE, in fact represents a plurality of GAM180 target genes. The mRNA of each one of this plurality of GAM180 target genes comprises one or more target binding sites, each having a nucleotide sequence which is at least partly complementary to GAM180 RNA, herein designated GAM RNA, and which when bound by GAM180 RNA causes inhibition of translation of respective one or more GAM180 target proteins.

It is further appreciated by one skilled in the art that the mode of translational inhibition illustrated by FIG. 8 with specific reference to translational inhibition exerted by GAM180 gene, herein designated GAM GENE, on one or more GAM180 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM180 correlate with, and may be deduced from, the identity of the target genes which GAM180 binds and inhibits, and the function of these target genes, as elaborated hereinbelow.

3PAP (Accession NP_061934.2) is a GAM180 target gene, herein designated TARGET GENE. 3PAP BINDING SITE is a target binding site found in the 3' untranslated region of mRNA encoded by 3PAP, corresponding to a target binding site such as BINDING SITE I, BINDING SITE II or BINDING SITE III of FIG. 8. Table 4 illustrates the complementarity of the nucleotide sequences of 3PAP BINDING SITE, designated SEQ ID:9183, to the nucleotide sequence of GAM180 RNA, herein designated GAM RNA, also designated SEQ ID:214.

A function of GAM180 is therefore inhibition of 3PAP (Accession NP_061934.2). Accordingly, utilities of GAM180 include diagnosis, prevention and treatment of diseases and clinical conditions associated with 3PAP.

ACK1 (Accession NP_005772.2) is another GAM180 target gene, herein designated TARGET GENE. ACK1 BINDING SITE is a target binding site found in the 3' untranslated region of mRNA encoded by ACK1, corresponding to a target binding site such as BINDING SITE I, BINDING SITE II or BINDING SITE III of FIG. 8. Table 4 illustrates the complementarity of the nucleotide sequences of ACK1 BINDING SITE, designated SEQ ID:18640, to the nucleotide sequence of GAM180 RNA, herein designated GAM RNA, also designated SEQ ID:214.

Another function of GAM180 is therefore inhibition of ACK1 (Accession NP_005772.2). Accordingly, utilities of GAM180 include diagnosis, prevention and treatment of diseases and clinical conditions associated with ACK1.

Acid phosphatase 2, lysosomal (ACP2, Accession NP_001601.1) is another GAM180 target gene, herein designated TARGET GENE. ACP2 BINDING SITE is a target binding site found in the 3' untranslated region of mRNA encoded by ACP2, corresponding to a target binding site such as BINDING SITE I, BINDING SITE II or BINDING SITE III of FIG. 8. Table 4 illustrates the complementarity of the nucleotide sequences of ACP2 BINDING SITE, designated SEQ ID:16613, to the nucleotide sequence of GAM180 RNA, herein designated GAM RNA, also designated SEQ ID:214.

Another function of GAM180 is therefore inhibition of Acid phosphatase 2, lysosomal (ACP2, Accession NP_001601.1). Accordingly, utilities of GAM180 include diagnosis, prevention and treatment of diseases and clinical conditions associated with ACP2.

A disintegrin and metalloproteinase domain 8 (ADAM8, Accession NP_001100.1) is another GAM180 target gene, herein designated TARGET GENE. ADAM8 BINDING SITE is a target binding site found in the 3' untranslated region of mRNA encoded by ADAM8, corresponding to a target binding site such as BINDING SITE I, BINDING SITE II or BINDING SITE III of FIG. 8. Table 4 illustrates the complementarity of the nucleotide sequences of ADAM8 BINDING SITE, designated SEQ ID:19901, to the nucleotide sequence of GAM180 RNA, herein designated GAM RNA, also designated SEQ ID:214.

Another function of GAM180 is therefore inhibition of A disintegrin and metalloproteinase domain 8 (ADAM8, Accession NP_001100.1). Accordingly, utilities of GAM180 include diagnosis, prevention and treatment of diseases and clinical conditions associated with ADAM8.

Adenylate cyclase 5 (ADCY5, Accession XP_171048.2) is another GAM180 target gene, herein designated TARGET GENE. ADCY5 BINDING SITE is a target binding site found in the 5' untranslated region of mRNA encoded by ADCY5, corresponding to a target binding site such as BINDING SITE I, BINDING SITE II or BINDING SITE III of FIG. 8. Table 4 illustrates the complementarity of the nucleotide sequences of ADCY5 BINDING SITE, designated SEQ ID:9867, to the nucleotide sequence of GAM180 RNA, herein designated GAM RNA, also designated SEQ ID:214.

Another function of GAM180 is therefore inhibition of Adenylate cyclase 5 (ADCY5, Accession XP_171048.2). Accordingly, utilities of GAM180 include diagnosis, prevention and treatment of diseases and clinical conditions associated with ADCY5.

A kinase (prka) anchor protein 7 (AKAP7, Accession NP_619539.1) is another GAM180 target gene, herein designated TARGET GENE. AKAP7 BINDING SITE is a target binding site found in the 3' untranslated region of multiple transcripts of mRNA encoded by AKAP7, corresponding to a target binding site such as BINDING SITE I, BINDING SITE II or BINDING SITE III of FIG. 8. Table 4 illustrates the complementarity of the nucleotide sequences of AKAP7 BINDING SITE, designated SEQ ID:662, to the nucleotide sequence of GAM180 RNA, herein designated GAM RNA, also designated SEQ ID:214.

Another function of GAM180 is therefore inhibition of A kinase (prka) anchor protein 7 (AKAP7, Accession NP_619539.1). Accordingly, utilities of GAM180 include diagnosis, prevention and treatment of diseases and clinical conditions associated with AKAP7.

A kinase (prka) anchor protein 7 (AKAP7, Accession NP_057461.1) is another GAM180 target gene, herein designated TARGET GENE. AKAP7 BINDING SITE is a target binding site found in the 3' untranslated region of multiple transcripts of mRNA encoded by AKAP7, corresponding to a target binding site such as BINDING SITE I, BINDING SITE II or BINDING SITE III of FIG. 8. Table 4 illustrates the complementarity of the nucleotide sequences of AKAP7 BINDING SITE, designated SEQ ID:662, to the nucleotide sequence of GAM180 RNA, herein designated GAM RNA, also designated SEQ ID:214.

Another function of GAM180 is therefore inhibition of A kinase (prka) anchor protein 7 (AKAP7, Accession NP_057461.1). Accordingly, utilities of GAM180 include diagnosis, prevention and treatment of diseases and clinical conditions associated with AKAP7.

A kinase (prka) anchor protein 7 (AKAP7, Accession NP_004833.1) is another GAM180 target gene, herein designated TARGET GENE. AKAP7 BINDING SITE is a target binding site found in the 3' untranslated region of multiple transcripts of mRNA encoded by AKAP7, corresponding to a target binding site such as BINDING SITE I, BINDING SITE II or BINDING SITE III of FIG. 8. Table 4 illustrates the complementarity of the nucleotide sequences of AKAP7 BINDING SITE, designated SEQ ID:662, to the nucleotide sequence of GAM180 RNA, herein designated GAM RNA, also designated SEQ ID:214.

Another function of GAM180 is therefore inhibition of A kinase (prka) anchor protein 7 (AKAP7, Accession NP_004833.1). Accordingly, utilities of GAM180 include diagnosis, prevention and treatment of diseases and clinical conditions associated with AKAP7.

ALK7 (Accession NP_660302.1) is another GAM180 target gene, herein designated TARGET GENE. ALK7 BINDING SITE is a target binding site found in the 3' untranslated region of mRNA encoded by ALK7, corresponding to a target binding site such as BINDING SITE I, BINDING SITE II or BINDING SITE III of FIG. 8. Table 4 illustrates the complementarity of the nucleotide sequences of ALK7 BINDING SITE, designated SEQ ID:4668, to the nucleotide sequence of GAM180 RNA, herein designated GAM RNA, also designated SEQ ID:214.

Another function of GAM180 is therefore inhibition of ALK7 (Accession NP_660302.1). Accordingly, utilities of GAM180 include diagnosis, prevention and treatment of diseases and clinical conditions associated with ALK7.

ANKFY1 (Accession NP_057460.2) is another GAM180 target gene, herein designated TARGET GENE. ANKFY1 BINDING SITE is a target binding site found in the 3' untranslated region of multiple transcripts of mRNA encoded by ANKFY1, corresponding to a target binding site such as BINDING SITE I, BINDING SITE II or BINDING SITE III of FIG. 8. Table 4 illustrates the complementarity of the nucleotide sequences of ANKFY1 BINDING SITE, designated SEQ ID:13680, to the nucleotide sequence of GAM180 RNA, herein designated GAM RNA, also designated SEQ ID:214.

Another function of GAM180 is therefore inhibition of ANKFY1 (Accession NP_057460.2). Accordingly, utilities of GAM180 include diagnosis, prevention and treatment of diseases and clinical conditions associated with ANKFY1.

AP1S3 (Accession NP_848929.1) is another GAM180 target gene, herein designated TARGET GENE. AP1S3 BINDING SITE is a target binding site found in the 3' untranslated region of multiple transcripts of mRNA encoded by AP1S3, corresponding to a target binding site such as BINDING SITE I, BINDING SITE II or BINDING SITE III of FIG. 8. Table 4 illustrates the complementarity of the nucleotide sequences of AP1S3 BINDING SITE, designated SEQ ID:10369, to the nucleotide sequence of GAM180 RNA, herein designated GAM RNA, also designated SEQ ID:214.

Another function of GAM180 is therefore inhibition of AP1S3 (Accession NP_848929.1). Accordingly, utilities of GAM180 include diagnosis, prevention and treatment of diseases and clinical conditions associated with AP1S3.

Ariadne homolog 2 (drosophila) (ARIH2, Accession NP_006312.1) is another GAM180 target gene, herein designated TARGET GENE. ARIH2 BINDING SITE is a target binding site found in the 5' untranslated region of mRNA encoded by ARIH2, corresponding to a target binding site such as BINDING SITE I, BINDING SITE II or BINDING SITE III of FIG. 8. Table 4 illustrates the complementarity of the nucleotide sequences of ARIH2 BINDING SITE, designated SEQ ID:6107, to the nucleotide sequence of GAM180 RNA, herein designated GAM RNA, also designated SEQ ID:214.

Another function of GAM180 is therefore inhibition of Ariadne homolog 2 (drosophila) (ARIH2, Accession NP_006312.1). Accordingly, utilities of GAM180 include diagnosis, prevention and treatment of diseases and clinical conditions associated with ARIH2.

Additional sex combs like 1 (drosophila) (ASXL1, Accession NP_056153.2) is another GAM180 target gene, herein designated TARGET GENE. ASXL1 BINDING SITE is a target binding site found in the 3' untranslated region of mRNA encoded by ASXL1, corresponding to a target binding site such as BINDING SITE I, BINDING SITE II or BINDING SITE III of FIG. 8. Table 4 illustrates the complementarity of the nucleotide sequences of ASXL1 BINDING SITE, designated SEQ ID:6136, to the nucleotide sequence of GAM180 RNA, herein designated GAM RNA, also designated SEQ ID:214.

Another function of GAM180 is therefore inhibition of Additional sex combs like 1 (drosophila) (ASXL1, Accession NP_056153.2). Accordingly, utilities of GAM180 include diagnosis, prevention and treatment of diseases and clinical conditions associated with ASXL1.

Arginine vasopressin receptor 1b (AVPR1B, Accession NP_000698.1) is another GAM180 target gene, herein designated TARGET GENE. AVPR1B BINDING SITE is a target binding site found in the 5' untranslated region of mRNA encoded by AVPR1B, corresponding to a target binding site such as BINDING SITE I, BINDING SITE II or BINDING SITE III of FIG. 8. Table 4 illustrates the complementarity of the nucleotide sequences of AVPR1B BINDING SITE, designated SEQ ID:10287, to the nucleotide sequence of GAM180 RNA, herein designated GAM RNA, also designated SEQ ID:214.

Another function of GAM180 is therefore inhibition of Arginine vasopressin receptor 1b (AVPR1B, Accession NP_000698.1). Accordingly, utilities of GAM180 include diagnosis, prevention and treatment of diseases and clinical conditions associated with AVPR1B.

Btb and cnc homology 1, basic leucine zipper transcription factor 2 (BACH2, Accession NP_068585.1) is another GAM180 target gene, herein designated TARGET GENE. BACH2 BINDING SITE is a target binding site found in the 3' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:9027, to the nucleotide sequence of GAM180 RNA, herein designated GAM RNA, also designated SEQ ID:214.

Another function of GAM180 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM180 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. Blood vessel epicardial substance (BVES, Accession NP_671488.1) is another GAM180 target gene, herein designated TARGET GENE. BVES BINDING SITE is a target binding site found in the 5' untranslated region of multiple transcripts of mRNA encoded by BVES, corresponding to a target binding site such as BINDING SITE I, BINDING SITE II or BINDING SITE III of FIG. 8. Table 4 illustrates the complementarity of the nucleotide sequences of BVES BINDING SITE, designated SEQ ID:12682, to the nucleotide sequence of GAM180 RNA, herein designated GAM RNA, also designated SEQ ID:214.

Another function of GAM180 is therefore inhibition of Blood vessel epicardial substance (BVES, Accession NP_671488.1), a gene which plays an important role in vertebrate heart development. Accordingly, utilities of GAM180 include diagnosis, prevention and treatment of diseases and clinical conditions associated with BVES.

The function of BVES has been established by previous studies. Reese et al. (1999) cloned chick and mouse bves and showed by immunolocalization that bves protein is expressed in the progenitors of coronary artery smooth muscle cells as well as in differentiated smooth muscle cells. Using a probe obtained by low stringency PCR with mouse bves to screen a human heart cDNA library, Reese and Bader (1999) identified a cDNA for human BVES. BVES encodes a deduced 334-amino acid protein that is 75% identical to the 357-amino acid chick bves. Sequence analysis predicts 3 transmembrane helices with an extracellular C terminus. Northern blot analysis revealed that expression of an approximately 5.5-kb BVES transcript is restricted to skeletal muscle and adult and fetal heart. In an independent search for transcripts preferentially expressed during chick heart development, Andree et al. (2000) isolated chick, mouse, and human BVES, which they called Popeye protein-1 (POP1). They found that BVES encodes a deduced 41-kD, 359-amino acid protein that shares sequence homology with the Popeye genes POP2 (OMIM Ref. No. 605823) and POP3 (OMIM Ref. No. 605824). By screening heart and total embryo cDNA libraries, Andree et al. (2000) isolated 4 different transcripts of BVES, which differ in their tissue specificity. Using in situ hybridization, they detected BVES expression in the developing heart of both chicken and mouse. After transfection of BVES into COS-7 cells, Andree et al. (2000) observed perinuclear distribution of BVES protein and concluded that POP proteins are associated with membranes. Based on the conservation and expression pattern of the 3 Popeye genes in mouse, chicken, and human, Andree et al. (2000) concluded that POP genes play an important role in vertebrate heart development.

Full details of the abovementioned studies are described in the following publications, the disclosure of which are hereby incorporated by reference:

Reese, D. E.; Zavaljevski, M.; Streiff, N. L.; Bader, D.: Bves: a novel gene expressed during coronary blood vessel development. Dev. Biol. 209:159- 171, 1999; and Andree, B.; Hillemann, T.; Kessler-Ieckson, G.; Schmitt-John, T.; Jockusch, H.; Arnold, H.-H.; Brand, T.: Isolation and characterization of the novel Popeye gene family expressed in s.

Further studies establishing the function and utilities of BVES are found in John Hopkins OMIM database record ID 604577, and in cited publications listed in Table 5, which are hereby incorporated by reference. Chromosome 1 open reading frame 16 (C1orf16, Accession NP_055652.2) is another GAM180 target gene, herein designated TARGET GENE. C1orf16 BINDING SITE is a target binding site found in the 5' untranslated region of mRNA encoded by C1orf16, corresponding to a target binding site such as BINDING SITE I, BINDING SITE II or BINDING SITE III of FIG. 8. Table 4 illustrates the complementarity of the nucleotide sequences of C1orf16 BINDING SITE, designated SEQ ID:9607, to the nucleotide sequence of GAM180 RNA, herein designated GAM RNA, also designated SEQ ID:214.

Another function of GAM180 is therefore inhibition of Chromosome 1 open reading frame 16 (C1orf16, Accession NP_055652.2). Accordingly, utilities of GAM180 include diagnosis, prevention and treatment of diseases and clinical conditions associated with C1orf16.

Chromosome 1 open reading frame 24 (C1orf24, Accession NP_443198.1) is another GAM180 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:9821, to the nucleotide sequence of GAM180 RNA, herein designated GAM RNA, also designated SEQ ID:214.

Another function of GAM180 is therefore inhibition of Chromosome 1 open reading frame 24 (C1orf24, Accession NP_443198.1). Accordingly, utilities of GAM180 include diagnosis, prevention and treatment of diseases and clinical conditions associated with C1orf24.

Chromosome 1 open reading frame 24 (C1orf24, Accession NP_071366.1) is another GAM180 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:9821, to the nucleotide sequence of GAM180 RNA, herein designated GAM RNA, also designated SEQ ID:214.

Another function of GAM180 is therefore inhibition of Chromosome 1 open reading frame 24 (C1orf24, Accession NP_071366.1). Accordingly, utilities of GAM180 include diagnosis, prevention and treatment of diseases and clinical conditions associated with C1orf24.

Complement component 1, q subcomponent, receptor 1 (C1QR1, Accession NP_036204.1) is another GAM180 target gene, herein designated TARGET GENE. C1QR1 BINDING SITE is a target binding site found in the 3' untranslated region of mRNA encoded by C1QR1, corresponding to a target binding site such as BINDING SITE I, BINDING SITE II or BINDING SITE III of FIG. 8. Table 4 illustrates the complementarity of the nucleotide sequences of C1QR1 BINDING SITE, designated SEQ ID:6733, to the nucleotide sequence of GAM180 RNA, herein designated GAM RNA, also designated SEQ ID:214.

Another function of GAM180 is therefore inhibition of Complement component 1, q subcomponent, receptor 1 (C1QR1, Accession NP_036204.1). Accordingly, utilities of GAM180 include diagnosis, prevention and treatment of diseases and clinical conditions associated with C1QR1.

Chromosome 20 open reading frame 28 (C20orf28, Accession NP_056232.1) is another GAM180 target gene, herein designated TARGET GENE. C20orf28 BINDING SITE is a target binding site found in the 3' untranslated region of mRNA encoded by C20orf28, corresponding to a target binding site such as BINDING SITE I, BINDING SITE II or BINDING SITE III of FIG. 8. Table 4 illustrates the complementarity of the nucleotide sequences of C20orf28 BINDING SITE, designated SEQ ID:15921, to the nucleotide sequence of GAM180 RNA, herein designated GAM RNA, also designated SEQ ID:214.

Another function of GAM180 is therefore inhibition of Chromosome 20 open reading frame 28 (C20orf28, Accession NP_056232.1). Accordingly, utilities of GAM180 include diagnosis, prevention and treatment of diseases and clinical conditions associated with C20orf28.

Chromosome 20 open reading frame 70 (C20orf70, Accession XP_114180.1) is another GAM180 target gene, herein designated TARGET GENE. C20orf70 BINDING SITE is a target binding site found in the 3' untranslated region of mRNA encoded by C20orf70, corresponding to a target binding site such as BINDING SITE I, BINDING SITE II or BINDING SITE III of FIG. 8. Table 4 illustrates the complementarity of the nucleotide sequences of C20orf70 BINDING SITE, designated SEQ ID:9329, to the nucleotide sequence of GAM180 RNA, herein designated GAM RNA, also designated SEQ ID:214.

Another function of GAM180 is therefore inhibition of Chromosome 20 open reading frame 70 (C20orf70, Accession XP_114180.1). Accordingly, utilities of GAM180 include diagnosis, prevention and treatment of diseases and clinical conditions associated with C20orf70.

Carbonic anhydrase xiv (CA14, Accession NP_036245.1) is another GAM180 target gene, herein designated TARGET GENE. CA14 BINDING SITE is a target binding site found in the 3' untranslated region of mRNA encoded by CA14, corresponding to a target binding site such as BINDING SITE I, BINDING SITE II or BINDING SITE III of FIG. 8. Table 4 illustrates the complementarity of the nucleotide sequences of CA14 BINDING SITE, designated SEQ ID:11029, to the nucleotide sequence of GAM180 RNA, herein designated GAM RNA, also designated SEQ ID:214.

Another function of GAM180 is therefore inhibition of Carbonic anhydrase xiv (CA14, Accession NP_036245.1). Accordingly, utilities of GAM180 include diagnosis, prevention and treatment of diseases and clinical conditions associated with CA14.

Calmodulin 1 (phosphorylase kinase, delta) (CALM1, Accession NP_008819.1) is another GAM180 target gene, herein designated TARGET GENE. CALM1 BINDING SITE is a target binding site found in the 3' untranslated region of mRNA encoded by CALM1, corresponding to a target binding site such as BINDING SITE I, BINDING SITE II or BINDING SITE III of FIG. 8. Table 4 illustrates the complementarity of the nucleotide sequences of CALM1 BINDING SITE, designated SEQ ID:13087, to the nucleotide sequence of GAM180 RNA, herein designated GAM RNA, also designated SEQ ID:214.

Another function of GAM180 is therefore inhibition of Calmodulin 1 (phosphorylase kinase, delta) (CALM1, Accession NP_008819.1), a gene which plays roles in growth and the cell cycle as well as in signal transduction and the synthesis and release of neurotransmitters. Accordingly, utilities of GAM180 include diagnosis, prevention and treatment of diseases and clinical conditions associated with CALM1.

The function of CALM1 has been established by previous studies. Calmodulin is the archetype of the family of calcium-modulated proteins of which nearly 20 members have been found. They are identified by their occurrence in the cytosol or on membranes facing the cytosol and by a high affinity for calcium. Calmodulin contains 149 amino acids and has 4 calcium-binding domains. Its functions include roles in growth and the cell cycle as well as in signal transduction and the synthesis and release of neurotransmitters. To determine how calcium/calmodulin activates calcium/calmodulin-dependent protein kinase I (CAMK1; 604998), Chin et al. (1997) characterized CAMK1 activation by calmodulin mutants with substitutions at hydrophobic residues. They found that CAMK1 activity is dependent on met124 within the C-terminal domain of calmodulin as well as on N-terminal hydrophobic residues of calmodulin.

Full details of the abovementioned studies are described in the following publications, the disclosure of which are hereby incorporated by reference:

Rhyner, J. A.; Ottiger, M.; Wicki, R.; Greenwood, T. M.; Strehler, E. E.: Structure of the human CALM1 calmodulin gene and identification of two CALM1- related pseudogenes CALM1P1 and CALM1P2. Europ. J. Biochem. 225:71-82, 1994; and Chin, D.; Winkler, K. E.; Means, A. R.: Characterization of substrate phosphorylation and use of calmodulin mutants to address implications from the enzyme crystal structure of calmodul.

Further studies establishing the function and utilities of CALM1 are found in John Hopkins OMIM database record ID 114180, and in cited publications listed in Table 5, which are hereby incorporated by reference. Calumenin (CALU, Accession NP_001210.1) is another GAM180 target gene, herein designated TARGET GENE. CALU BINDING SITE is a target binding site found in the 3' untranslated region of mRNA encoded by CALU, corresponding to a target binding site such as BINDING SITE I, BINDING SITE II or BINDING SITE III of FIG. 8. Table 4 illustrates the complementarity of the nucleotide sequences of CALU BINDING SITE, designated SEQ ID:544, to the nucleotide sequence of GAM180 RNA, herein designated GAM RNA, also designated SEQ ID:214.

Another function of GAM180 is therefore inhibition of Calumenin (CALU, Accession NP_001210.1), a gene which binds 7 calcium ions with a low affinity with unidtified function. Accordingly, utilities of GAM180 include diagnosis, prevention and treatment of diseases and clinical conditions associated with CALU.

The function of CALU has been established by previous studies. Many calcium-binding proteins are reported to be localized in the endoplasmic reticulum (ER) and involved in such ER functions as protein folding and sorting. Among these are RCN1 (OMIM Ref. No. 602735), RCN2 (OMIM Ref. No. 602584), and calumenin (CALU), which form a novel family of calcium-binding proteins in the ER and Golgi apparatus. By searching sequence databases with a mouse Calu cDNA sequence (Yabe et al., 1997), Yabe et al. (1998) identified a human CALU EST, which they used to clone a full-length CALU cDNA. The cDNA encodes a deduced 315-amino acid protein containing 6 EF-hand motifs, 1 potential N-glycosylation site, and a C-terminal ER retention signal. The human and mouse CALU proteins are 98% identical. Northern blot analysis demonstrated that the 3.4-kb CALU mRNA is ubiquitously expressed in human tissues. Southern blot analysis using a human CALU cDNA probe detected bands in a variety of species. Yabe et al. (1997) mapped the mouse Calu gene to the proximal portion of chromosome 7. By fluorescence in situ hybridization, Yabe et al. (1998) localized the human CALU gene to 7q32, which was an unexpected result due to the homology of synteny between proximal mouse chromosome 7 and human 19q13.2-q13.3.

Full details of the abovementioned studies are described in the following publications, the disclosure of which are hereby incorporated by reference:

Yabe, D.; Nakamura, T.; Kanazawa, N.; Tashiro, K.; Honjo, T.: Calumenin, a Ca(2+)-binding protein retained in the endoplasmic reticulum with a novel carboxyl- terminal sequence, HDEF. J. Biol. Chem. 272:18232-18239, 1997; and Yabe, D.; Taniwaki, M.; Nakamura, T.; Kanazawa, N.; Tashiro, K.; Honjo, T.: Human calumenin gene (CALU): cDNA isolation and chromosomal mapping to 7q32. Genomics 49:331-333, 1998.

Further studies establishing the function and utilities of CALU are found in John Hopkins OMIM database record ID 603420, and in cited publications listed in Table 5, which are hereby incorporated by reference. Caspase recruitment domain family, member 9 (CARD9, Accession NP_434700.1) is another GAM180 target gene, herein designated TARGET GENE. CARD9 BINDING SITE is a target binding site found in the 5' untranslated region of multiple transcripts of mRNA encoded by CARD9, corresponding to a target binding site such as BINDING SITE I, BINDING SITE II or BINDING SITE III of FIG. 8. Table 4 illustrates the complementarity of the nucleotide sequences of CARD9 BINDING SITE, designated SEQ ID:11302, to the nucleotide sequence of GAM180 RNA, herein designated GAM RNA, also designated SEQ ID:214.

Another function of GAM180 is therefore inhibition of Caspase recruitment domain family, member 9 (CARD9, Accession NP_434700.1) . Accordingly, utilities of GAM180 include diagnosis, prevention and treatment of diseases and clinical conditions associated with CARD9.

Caspase recruitment domain family, member 9 (CARD9, Accession NP_071747.2) is another GAM180 target gene, herein designated TARGET GENE. CARD9 BINDING SITE is a target binding site found in the 5' untranslated region of multiple transcripts of mRNA encoded by CARD9, corresponding to a target binding site such as BINDING SITE I, BINDING SITE II or BINDING SITE III of FIG. 8. Table 4 illustrates the complementarity of the nucleotide sequences of CARD9 BINDING SITE, designated SEQ ID:11302, to the nucleotide sequence of GAM180 RNA, herein designated GAM RNA, also designated SEQ ID:214.

Another function of GAM180 is therefore inhibition of Caspase recruitment domain family, member 9 (CARD9, Accession NP_071747.2) . Accordingly, utilities of GAM180 include diagnosis, prevention and treatment of diseases and clinical conditions associated with CARD9.

Caspase recruitment domain family, member 9 (CARD9, Accession NP_434701.1) is another GAM180 target gene, herein designated TARGET GENE. CARD9 BINDING SITE is a target binding site found in the 5' untranslated region of multiple transcripts of mRNA encoded by CARD9, corresponding to a target binding site such as BINDING SITE I, BINDING SITE II or BINDING SITE III of FIG. 8. Table 4 illustrates the complementarity of the nucleotide sequences of CARD9 BINDING SITE, designated SEQ ID:11302, to the nucleotide sequence of GAM180 RNA, herein designated GAM RNA, also designated SEQ ID:214.

Another function of GAM180 is therefore inhibition of Caspase recruitment domain family, member 9 (CARD9, Accession NP_434701.1) . Accordingly, utilities of GAM180 include diagnosis, prevention and treatment of diseases and clinical conditions associated with CARD9.

Chemokine (c-c motif) ligand 11 (CCL11, Accession NP_002977.1) is another GAM180 target gene, herein designated TARGET GENE. CCL11 BINDING SITE is a target binding site found in the 5' untranslated region of mRNA encoded by CCL11, corresponding to a target binding site such as BINDING SITE I, BINDING SITE II or BINDING SITE III of FIG. 8. Table 4 illustrates the complementarity of the nucleotide sequences of CCL11 BINDING SITE, designated SEQ ID:4942, to the nucleotide sequence of GAM180 RNA, herein designated GAM RNA, also designated SEQ ID:214.

Another function of GAM180 is therefore inhibition of Chemokine (c-c motif) ligand 11 (CCL11, Accession NP_002977.1). Accordingly, utilities of GAM180 include diagnosis, prevention and treatment of diseases and clinical conditions associated with CCL11.

Chemokine (c-c motif) ligand 8 (CCL8, Accession NP_005614.2) is another GAM180 target gene, herein designated TARGET GENE. CCL8 BINDING SITE is a target binding site found in the 5' untranslated region of mRNA encoded by CCL8, corresponding to a target binding site such as BINDING SITE I, BINDING SITE II or BINDING SITE III of FIG. 8. Table 4 illustrates the complementarity of the nucleotide sequences of CCL8 BINDING SITE, designated SEQ ID:6343, to the nucleotide sequence of GAM180 RNA, herein designated GAM RNA, also designated SEQ ID:214.

Another function of GAM180 is therefore inhibition of Chemokine (c-c motif) ligand 8 (CCL8, Accession NP_005614.2). Accordingly, utilities of GAM180 include diagnosis, prevention and treatment of diseases and clinical conditions associated with CCL8.

Cd22 antigen (CD22, Accession NP_001762.1) is another GAM180 target gene, herein designated TARGET GENE.

CD22 BINDING SITE is a target binding site found in the 3' untranslated region of mRNA encoded by CD22, corresponding to a target binding site such as BINDING SITE I, BINDING SITE II or BINDING SITE III of FIG. 8. Table 4 illustrates the complementarity of the nucleotide sequences of CD22 BINDING SITE, designated SEQ ID:5550, to the nucleotide sequence of GAM180 RNA, herein designated GAM RNA, also designated SEQ ID:214.

Another function of GAM180 is therefore inhibition of Cd22 antigen (CD22, Accession NP_001762.1), a gene which is an antigen expressed specifically in B lymphocytes (Cd22 antigen) and may act in cell-cell interactions. Accordingly, utilities of GAM180 include diagnosis, prevention and treatment of diseases and clinical conditions associated with CD22.

The function of CD22 has been established by previous studies. Nonhuman mammalian cells express N-acetylneuraminic acid (OMIM Ref. No. Neu5Ac) and N- glycolylneuraminic acid (OMIM Ref. No. Neu5Gc). Human cells contain only Neu5Ac because of an exon deletion/frameshift mutation in cytidine monophospho-sialic acid hydroxylase (CMAH; 603209), which converts Neu5Ac to Neu5Gc. Sialic acid-binding immunoglobulin-like lectins, or SIGLECs, such as CD22 (SIGLEC2), recognize sialic acids. Brinkman-Van der Linden et al. (2000) showed that human SIGLEC1 (SN; 600751) strongly prefers Neu5Ac over Neu5Gc. Sequence analysis of SIGLEC2 cDNA found that while the chimpanzee sequence is 97% homologous to human, bonobo and gorilla are only 96% homologous, and the orangutan is only 93% homologous. Using regions of SIGLEC2 proteins from mouse, chimpanzee, orangutan, and human fused to the Fc region of human IgG, and flow cytometry analysis, Brinkman-Van der Linden et al. (2000) showed that all bound well to chimpanzee Epstein-Barr virus (EBV)-transformed B cells, which expressed high levels of Neu5Gc. Except for mouse, all bound well to human EBV-transformed B cells, which expressed high levels of Neu5Ac.

Animal model experiments lend further support to the function of CD22. O'Keefe et al. (1996) made observations in mice with a targeted disruption of the CD22 gene indicating that CD22 is a negative regulator of antigen receptor signaling whose onset of expression at the mature B cell stage may serve to raise the antigen concentration threshold required for B cell triggering. Splenic B cells from CD22 knockout mice were found to be hyperresponsive to receptor signaling. Heightened calcium fluxes and cell proliferation were obtained at lower ligand concentrations. The mice gave augmented immune response, had an expanded peritoneal B-1 cell population, and contained increased serum titers of autoantibody.

It is appreciated that the abovementioned animal model for CD22 is acknowledged by those skilled in the art as a scientifically valid animal model, as can be further appreciated from the publications sited hereinbelow.

Full details of the abovementioned studies are described in the following publications, the disclosure of which are hereby incorporated by reference:

O'Keefe, T. L.; Williams, G. T.; Davies, S. L.; Neuberger, M. S.: Hyperresponsive B cells in CD22-deficient mice. Science 274:798-801, 1996; and Brinkman-Van der Linden, E. C. M.; Sjoberg, E. R.; Juneja, L. R.; Crocker, P. R.; Varki, N.; Varki, A.: Loss of N-glycolylneuraminic acid in human evolution: implications for sialic aci.

Further studies establishing the function and utilities of CD22 are found in John Hopkins OMIM database record ID 107266, and in cited publications listed in Table 5, which are hereby incorporated by reference. Cdk5 regulatory subunit associated protein 3 (CDK5RAP3, Accession NP_079473.2) is another GAM180 target gene, herein designated TARGET GENE. CDK5RAP3 BINDING SITE is a target binding site found in the 3' untranslated region of multiple transcripts of mRNA encoded by CDK5RAP3, corresponding to a target binding site such as BINDING SITE I, BINDING SITE II or BINDING SITE III of FIG. 8. Table 4 illustrates the complementarity of the nucleotide sequences of CDK5RAP3 BINDING SITE, designated SEQ ID:3530, to the nucleotide sequence of GAM180 RNA, herein designated GAM RNA, also designated SEQ ID:214.

Another function of GAM180 is therefore inhibition of Cdk5 regulatory subunit associated protein 3 (CDK5RAP3, Accession NP_079473.2). Accordingly, utilities of GAM180 include diagnosis, prevention and treatment of diseases and clinical conditions associated with CDK5RAP3.

Cdk5 regulatory subunit associated protein 3 (CDK5RAP3, Accession NP_788275.1) is another GAM180 target gene, herein designated TARGET GENE. CDK5RAP3 BINDING SITE is a target binding site found in the 3' untranslated region of multiple transcripts of mRNA encoded by CDK5RAP3, corresponding to a target binding site such as BINDING SITE I, BINDING SITE II or BINDING SITE III of FIG. 8. Table 4 illustrates the complementarity of the nucleotide sequences of CDK5RAP3 BINDING SITE, designated SEQ ID:3530, to the nucleotide sequence of GAM180 RNA, herein designated GAM RNA, also designated SEQ ID:214.

Another function of GAM180 is therefore inhibition of Cdk5 regulatory subunit associated protein 3 (CDK5RAP3, Accession NP_788275.1). Accordingly, utilities of GAM180 include diagnosis, prevention and treatment of diseases and clinical conditions associated with CDK5RAP3.

Chitinase 3-like 2 (CHI3L2, Accession NP_003991.1) is another GAM180 target gene, herein designated TARGET GENE. CHI3L2 BINDING SITE is a target binding site found in the 3' untranslated region of mRNA encoded by CHI3L2, corresponding to a target binding site such as BINDING SITE I, BINDING SITE II or BINDING SITE III of FIG. 8. Table 4 illustrates the complementarity of the nucleotide sequences of CHI3L2 BINDING SITE, designated SEQ ID:13391, to the nucleotide sequence of GAM180 RNA, herein designated GAM RNA, also designated SEQ ID:214.

Another function of GAM180 is therefore inhibition of Chitinase 3-like 2 (CHI3L2, Accession NP_003991.1). Accordingly, utilities of GAM180 include diagnosis, prevention and treatment of diseases and clinical conditions associated with CHI3L2.

Carbohydrate (chondroitin 6) sulfotransferase 3 (CHST3, Accession NP_004264.2) is another GAM180 target gene, herein designated TARGET GENE. CHST3 BINDING SITE is a target binding site found in the 3' untranslated region of mRNA encoded by CHST3, corresponding to a target binding site such as BINDING SITE I, BINDING SITE II or BINDING SITE III of FIG. 8. Table 4 illustrates the complementarity of the nucleotide sequences of CHST3 BINDING SITE, designated SEQ ID:19995, to the nucleotide sequence of GAM180 RNA, herein designated GAM RNA, also designated SEQ ID:214.

Another function of GAM180 is therefore inhibition of Carbohydrate (chondroitin 6) sulfotransferase 3 (CHST3, Accession NP_004264.2). Accordingly, utilities of GAM180 include diagnosis, prevention and treatment of diseases and clinical conditions associated with CHST3.

Carbohydrate (n-acetylglucosamine 6-o) sulfotransferase 5 (CHST5, Accession NP_036258.1) is another GAM180 target gene, herein designated TARGET GENE. CHST5 BINDING SITE is a target binding site found in the 5' untranslated region of mRNA encoded by CHST5, corresponding to a target binding site such as BINDING SITE I, BINDING SITE II or BINDING SITE III of FIG. 8. Table 4 illustrates the complementarity of the nucleotide sequences of CHST5 BINDING SITE, designated SEQ ID:6807, to the nucleotide sequence of GAM180 RNA, herein designated GAM RNA, also designated SEQ ID:214.

Another function of GAM180 is therefore inhibition of Carbohydrate (n-acetylglucosamine 6-o) sulfotransferase 5 (CHST5, Accession NP_036258.1), a gene which may be involved in sulfation of glycoproteins and proteoglycans. Accordingly, utilities of GAM180 include diagnosis, prevention and treatment of diseases and clinical conditions associated with CHST5.

The function of CHST5 and its association with various diseases and clinical conditions, has been established by previous studies, as described hereinabove with reference to GAM175.1. Collagen, type iv, alpha 4 (COL4A4, Accession NP_000083.1) is another GAM180 target gene, herein designated TARGET GENE. COL4A4 BINDING SITE is a target binding site found in the 3' untranslated region of mRNA encoded by COL4A4, corresponding to a target binding site such as BINDING SITE I, BINDING SITE II or BINDING SITE III of FIG. 8. Table 4 illustrates the complementarity of the nucleotide sequences of COL4A4 BINDING SITE, designated SEQ ID:5844, to the nucleotide sequence of GAM180 RNA, herein designated GAM RNA, also designated SEQ ID:214.

Another function of GAM180 is therefore inhibition of Collagen, type iv, alpha 4 (COL4A4, Accession NP_000083.1). Accordingly, utilities of GAM180 include diagnosis, prevention and treatment of diseases and clinical conditions associated with COL4A4.

Doublecortin and cam kinase-like 1 (DCAMKL1, Accession NP_004725.1) is another GAM180 target gene, herein designated TARGET GENE. DCAMKL1 BINDING SITE is a target binding site found in the 3' untranslated region of mRNA encoded by DCAMKL1, corresponding to a target binding site such as BINDING SITE I, BINDING SITE II or BINDING SITE III of FIG. 8. Table 4 illustrates the complementarity of the nucleotide sequences of DCAMKL1 BINDING SITE, designated SEQ ID:2905, to the nucleotide sequence of GAM180 RNA, herein designated GAM RNA, also designated SEQ ID:214.

Another function of GAM180 is therefore inhibition of Doublecortin and cam kinase-like 1 (DCAMKL1, Accession NP_004725.1). Accordingly, utilities of GAM180 include diagnosis, prevention and treatment of diseases and clinical conditions associated with DCAMKL1.

DKFZP434F011 (Accession XP_291159.1) is another GAM180 target gene, herein designated TARGET GENE. DKFZP434F011 BINDING SITE is a target binding site found in the 3' untranslated region of mRNA encoded by DKFZP434F011, corresponding to a target binding site such as BINDING SITE I, BINDING SITE II or BINDING SITE III of FIG. 8. Table 4 illustrates the complementarity of the nucleotide sequences of DKFZP434F011 BINDING SITE, designated SEQ ID:7730, to the nucleotide sequence of GAM180 RNA, herein designated GAM RNA, also designated SEQ ID:214.

Another function of GAM180 is therefore inhibition of DKFZP434F011 (Accession XP_291159.1). Accordingly, utilities of GAM180 include diagnosis, prevention and treatment of diseases and clinical conditions associated with DKFZP434F011.

DKFZP564O0423 (Accession XP_166254.2) is another GAM180 target gene, herein designated TARGET GENE. DKFZP564O0423 BINDING SITE is a target binding site found in the 3' untranslated region of mRNA encoded by DKFZP564O0423, corresponding to a target binding site such as BINDING SITE I, BINDING SITE II or BINDING SITE III of FIG. 8. Table 4 illustrates the complementarity of the nucleotide sequences of DKFZP564O0423 BINDING SITE, designated SEQ ID:8990, to the nucleotide sequence of GAM180 RNA, herein designated GAM RNA, also designated SEQ ID:214.

Another function of GAM180 is therefore inhibition of DKFZP564O0423 (Accession XP_166254.2). Accordingly, utilities of GAM180 include diagnosis, prevention and treatment of diseases and clinical conditions associated with DKFZP564O0423.

DKFZP586I2223 (Accession NP_542768.1) is another GAM180 target gene, herein designated TARGET GENE. DKFZP586I2223 BINDING SITE is a target binding site found in the 5' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:11679, to the nucleotide sequence of GAM180 RNA, herein designated GAM RNA, also designated SEQ ID:214.

Another function of GAM180 is therefore inhibition of DKFZP586I2223 (Accession NP_542768.1). Accordingly, utilities of GAM180 include diagnosis, prevention and treatment of diseases and clinical conditions associated with DKFZP586I2223.

DKFZP586I2223 (Accession NP_056253.2) is another GAM180 target gene, herein designated TARGET GENE. DKFZP586I2223 BINDING SITE is a target binding site found in the 5' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:11679, to the nucleotide sequence of GAM180 RNA, herein designated GAM RNA, also designated SEQ ID:214.

Another function of GAM180 is therefore inhibition of DKFZP586I2223 (Accession NP_056253.2). Accordingly, utilities of GAM180 include diagnosis, prevention and treatment of diseases and clinical conditions associated with DKFZP586I2223.

DKFZp761K1423 (Accession NP_060892.1) is another GAM180 target gene, herein designated TARGET GENE. DKFZp761K1423 BINDING SITE is a target binding site found in the 5' untranslated region of mRNA encoded by DKFZp761K1423, corresponding to a target binding site such as BINDING SITE I, BINDING SITE II or BINDING SITE III of FIG. 8. Table 4 illustrates the complementarity of the nucleotide sequences of DKFZp761K1423 BINDING SITE, designated SEQ ID:10603, to the nucleotide sequence of GAM180 RNA, herein designated GAM RNA, also designated SEQ ID:214.

Another function of GAM180 is therefore inhibition of DKFZp761K1423 (Accession NP_060892.1). Accordingly, utilities of GAM180 include diagnosis, prevention and treatment of diseases and clinical conditions associated with DKFZp761K1423.

DKFZP761M1511 (Accession XP_295135.1) is another GAM180 target gene, herein designated TARGET GENE. DKFZP761M1511 BINDING SITE is a target binding site found in the 3' untranslated region of mRNA encoded by DKFZP761M1511, corresponding to a target binding site such as BINDING SITE I, BINDING SITE II or BINDING SITE III of FIG. 8. Table 4 illustrates the complementarity of the nucleotide sequences of DKFZP761M1511 BINDING SITE, designated SEQ ID:898, to the nucleotide sequence of GAM180 RNA, herein designated GAM RNA, also designated SEQ ID:214.

Another function of GAM180 is therefore inhibition of DKFZP761M1511 (Accession XP_295135.1). Accordingly, utilities of GAM180 include diagnosis, prevention and treatment of diseases and clinical conditions associated with DKFZP761M1511.

DKFZp762E1312 (Accession NP_060880.2) is another GAM180 target gene, herein designated TARGET GENE. DKFZp762E1312 BINDING SITE is a target binding site found in the 5' untranslated region of mRNA encoded by DKFZp762E1312, corresponding to a target binding site such as BINDING SITE I, BINDING SITE II or BINDING SITE III of FIG. 8. Table 4 illustrates the complementarity of the nucleotide sequences of DKFZp762E1312 BINDING SITE, designated SEQ ID:19364, to the nucleotide sequence of GAM180 RNA, herein designated GAM RNA, also designated SEQ ID:214.

Another function of GAM180 is therefore inhibition of DKFZp762E1312 (Accession NP_060880.2). Accordingly, utilities of GAM180 include diagnosis, prevention and treatment of diseases and clinical conditions associated with DKFZp762E1312.

Dopamine receptor d2 (DRD2, Accession NP_000786.1) is another GAM180 target gene, herein designated TARGET GENE. DRD2 BINDING SITE is a target binding site found in the 3' untranslated region of multiple transcripts of mRNA encoded by DRD2, corresponding to a target binding site such as BINDING SITE I, BINDING SITE II or BINDING SITE III of FIG. 8. Table 4 illustrates the complementarity of the nucleotide sequences of DRD2 BINDING SITE, designated SEQ ID:8911, to the nucleotide sequence of GAM180 RNA, herein designated GAM RNA, also designated SEQ ID:214.

Another function of GAM180 is therefore inhibition of Dopamine receptor d2 (DRD2, Accession NP_000786.1), a gene which has a key role in the control of movement. and therefore may be associated with Hereditary autosomal dominant myoclonus dystonia. Accordingly, utilities of GAM180 include diagnosis, prevention and treatment of Hereditary autosomal dominant myoclonus dystonia, and of other diseases and clinical conditions associated with DRD2.

The function of DRD2 and its association with various diseases and clinical conditions, has been established by previous studies, as described hereinabove with reference to GAM148.1. Dopamine receptor d2 (DRD2, Accession NP_057658.2) is another GAM180 target gene, herein designated TARGET GENE. DRD2 BINDING SITE is a target binding site found in the 3' untranslated region of multiple transcripts of mRNA encoded by DRD2, corresponding to a target binding site such as BINDING SITE I, BINDING SITE II or BINDING SITE III of FIG. 8. Table 4 illustrates the complementarity of the nucleotide sequences of DRD2 BINDING SITE, designated SEQ ID:8911, to the nucleotide sequence of GAM180 RNA, herein designated GAM RNA, also designated SEQ ID:214.

Another function of GAM180 is therefore inhibition of Dopamine receptor d2 (DRD2, Accession NP_057658.2), a gene which has a key role in the control of movement. and therefore may be associated with Hereditary autosomal dominant myoclonus dystonia. Accordingly, utilities of GAM180 include diagnosis, prevention and treatment of Hereditary autosomal dominant myoclonus dystonia, and of other diseases and clinical conditions associated with DRD2.

The function of DRD2 and its association with various diseases and clinical conditions, has been established by previous studies, as described hereinabove with reference to GAM148.1. Dual specificity phosphatase 2 (DUSP2, Accession NP_004409.1) is another GAM180 target gene, herein designated TARGET GENE. DUSP2 BINDING SITE is a target binding site found in the 3' untranslated region of mRNA encoded by DUSP2, corresponding to a target binding site such as BINDING SITE I, BINDING SITE II or BINDING SITE III of FIG. 8. Table 4 illustrates the complementarity of the nucleotide sequences of DUSP2 BINDING SITE, designated SEQ ID:13525, to the nucleotide sequence of GAM180 RNA, herein designated GAM RNA, also designated SEQ ID:214.

Another function of GAM180 is therefore inhibition of Dual specificity phosphatase 2 (DUSP2, Accession NP_004409.1), a gene which regulates mitogenic signal transduction. Accordingly, utilities of GAM180 include diagnosis, prevention and treatment of diseases and clinical conditions associated with DUSP2.

The function of DUSP2 has been established by previous studies. Mitogenic stimulation of quiescent cells leads to the rapid and reversible activation of mitogen- activated protein (MAP) kinases via dual phosphorylation within a thr-glu-tyr motif. Following activation, MAP kinases translocate into the nucleus where they phosphorylate several signal transduction targets. The dual-specificity phosphatases can reverse MAP kinase activation by dephosphorylating phosphotyrosine and phosphothreonine residues. Rohan et al. (1993) isolated mouse and human cDNAs encoding PAC1, a mitogen-induced 32-kD protein that contains a sequence that is associated with enzymatic activity in previously identified protein phosphotyrosine phosphatases. The predicted human PAC1 protein has 314 amino acids. Northern blot analysis of human cell lines and mouse tissues revealed that PAC1 is expressed predominantly in hematopoietic tissues. By immunofluorescence of transfected cells and mitogen-stimulated T cells, Rohan et al. (1993) localized PAC1 to the nucleus. Ward et al. (1994) demonstrated that PAC1 is a dual-specific thr/tyr phosphatase that is a physiologically relevant MAP kinase phosphatase. Yi et al. (1995) determined that the PAC1, or DUSP2, gene contains 4 exons that span approximately 2.3 kb. By somatic cell hybrid analysis, linkage analysis, and in situ hybridization, Yi et al. (1995) mapped the PAC1 gene to 2p11.2-q11. Using fluorescence in situ hybridization, Martell et al. (1994) refined the localization of the PAC1 gene to 2q11.

Full details of the abovementioned studies are described in the following publications, the disclosure of which are hereby incorporated by reference:

Rohan, P. J.; Davis, P.; Moskaluk, C. A.; Kearns, M.; Krutzsch, H.; Siebenlist, U.; Kelly, K.: PAC-1: a mitogen-induced nuclear protein tyrosine phosphatase. Science 259: 1763-1766, 1993; and y, H.; Morton, C. C.; Weremowicz, S.; McBride, O. W.; Kelly, K.: Genomic organization and chromosomal localization of the DUSP2 gene, encoding a MAP kinase phosphatase, to human 2p11.

Further studies establishing the function and utilities of DUSP2 are found in John Hopkins OMIM database record ID 603068, and in cited publications listed in Table 5, which are hereby incorporated by reference. Ephrin-a3 (EFNA3, Accession NP_004943.1) is another GAM180 target gene, herein designated TARGET GENE. EFNA3 BINDING SITE is a target binding site found in the 3' untranslated region of mRNA encoded by EFNA3, corresponding to a target binding site such as BINDING SITE I, BINDING SITE II or BINDING SITE III of FIG. 8. Table 4 illustrates the complementarity of the nucleotide sequences of EFNA3 BINDING SITE, designated SEQ ID:19601, to the nucleotide sequence of GAM180 RNA, herein designated GAM RNA, also designated SEQ ID:214.

Another function of GAM180 is therefore inhibition of Ephrin-a3 (EFNA3, Accession NP_004943.1), a gene which is a ligand of Eph- related receptor tyrosine kinases. Accordingly, utilities of GAM180 include diagnosis, prevention and treatment of diseases and clinical conditions associated with EFNA3.

The function of EFNA3 has been established by previous studies. Proteins in the LERK subfamily of ligands, called ephrins, bind to members of the EPH group of receptor tyrosine kinases. The various ephrins are characterized by sequence similarities and the fact that they are attached to the cell membrane by glycosylphosphatidylinositol (GPI) anchors or by a single transmembrane domain. See 179610 for additional information on ephrins and the Eph receptor family. By fluorescence in situ hybridization, Cerretti et al. (1996) mapped the EPLG3 gene to a cluster on chromosome 1q21-q22, together with EPLG1 (EFNA1; 191164) and EPLG4 (EFNA4; 601380). By interspecific backcross analysis, they mapped the mouse EPLG3 homolog (Epl3) to the central region of mouse chromosome 3. Cerretti and Nelson (1998) reported that the mouse Efna3 gene has 5 exons. The gene structures of human EFNA2 (OMIM Ref. No. 602756) and mouse Efna3, Efna4 (OMIM Ref. No. 601380), and Efnb1 (OMIM Ref. No. 300035) are conserved through the first 3 exons.

Full details of the abovementioned studies are described in the following publications, the disclosure of which are hereby incorporated by reference:

Cerretti, D. P.; Lyman, S. D.; Kozlosky, C. J.; Copeland, N. G.; Gilbert, D. J.; Jenkins, N. A.; Valentine, V.; Kirstein, M. N.; Shapiro, D. N.; Morris, S. W.: The genes encoding the Eph-related receptor tyrosine kinase ligands LERK-1 (EPLG1, Epl1), LERK-3 (EPLG3, Epl3), and LERK-4 (EPLG4, Epl4) are clustered on human chromosome 1 and mouse chromosome 3. Genomics 33:277-282, 1996; and Cerretti, D. P.; Nelson, N.: Characterization of the genes for mouse LERK-3/Ephrin-A3 (Epl3), mouse LERK-4/Ephrin-A4 (Epl4), and human LERK-6/Ephrin-A2 (EPLG6): conservation of intron/e.

Further studies establishing the function and utilities of EFNA3 are found in John Hopkins OMIM database record ID 601381, and in cited publications listed in Table 5, which are hereby incorporated by reference. ELKS (Accession NP_055879.1) is another GAM180 target gene, herein designated TARGET GENE. ELKS BINDING SITE is a target binding site found in the 3' untranslated region of mRNA encoded by ELKS, corresponding to a target binding site such as BINDING SITE I, BINDING SITE II or BINDING SITE III of FIG. 8. Table 4 illustrates the complementarity of the nucleotide sequences of ELKS BINDING SITE, designated SEQ ID:787, to the nucleotide sequence of GAM180 RNA, herein designated GAM RNA, also designated SEQ ID:214.

Another function of GAM180 is therefore inhibition of ELKS (Accession NP_055879.1). Accordingly, utilities of GAM180 include diagnosis, prevention and treatment of diseases and clinical conditions associated with ELKS.

Ellis van creveld syndrome (EVC, Accession NP_055371.1) is another GAM180 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:5644, to the nucleotide sequence of GAM180 RNA, herein designated GAM RNA, also designated SEQ ID:214.

Another function of GAM180 is therefore inhibition of Ellis van creveld syndrome (EVC, Accession NP_055371.1). Accordingly, utilities of GAM180 include diagnosis, prevention and treatment of diseases and clinical conditions associated with EVC.

Fibroblast growth factor receptor 1 (fms-related tyrosine kinase 2, pfeiffer syndrome) (FGFR1, Accession NP_075598.1) is another GAM180 target gene, herein designated TARGET GENE. FGFR1 BINDING SITE is a target binding site found in the 3' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:5084, to the nucleotide sequence of GAM180 RNA, herein designated GAM RNA, also designated SEQ ID:214.

Another function of GAM180 is therefore inhibition of Fibroblast growth factor receptor 1 (fms-related tyrosine kinase 2, pfeiffer syndrome) (FGFR1, Accession NP_075598.1). Accordingly, utilities of GAM180 include diagnosis, prevention and treatment of diseases and clinical conditions associated with FGFR1.

FHX (Accession NP_060886.1) is another GAM180 target gene, herein designated TARGET GENE. FHX BINDING SITE is a target binding site found in the 3' untranslated region of mRNA encoded by FHX, corresponding to a target binding site such as BINDING SITE I, BINDING SITE II or BINDING SITE III of FIG. 8. Table 4 illustrates the complementarity of the nucleotide sequences of FHX BINDING SITE, designated SEQ ID:12381, to the nucleotide sequence of GAM180 RNA, herein designated GAM RNA, also designated SEQ ID:214.

Another function of GAM180 is therefore inhibition of FHX (Accession NP_060886.1). Accordingly, utilities of GAM180 include diagnosis, prevention and treatment of diseases and clinical conditions associated with FHX.

FKSG42 (Accession NP_114421.1) is another GAM180 target gene, herein designated TARGET GENE. FKSG42 BINDING SITE is a target binding site found in the 3' untranslated region of mRNA encoded by FKSG42, corresponding to a target binding site such as BINDING SITE I, BINDING SITE II or BINDING SITE III of FIG. 8. Table 4 illustrates the complementarity of the nucleotide sequences of FKSG42 BINDING SITE, designated SEQ ID:17992, to the nucleotide sequence of GAM180 RNA, herein designated GAM RNA, also designated SEQ ID:214.

Another function of GAM180 is therefore inhibition of FKSG42 (Accession NP_114421.1). Accordingly, utilities of GAM180 include diagnosis, prevention and treatment of diseases and clinical conditions associated with FKSG42.

FLJ10648 (Accession NP_060637.1) is another GAM180 target gene, herein designated TARGET GENE. FLJ10648 BINDING SITE is a target binding site found in the 5' untranslated region of mRNA encoded by FLJ10648, corresponding to a target binding site such as BINDING SITE I, BINDING SITE II or BINDING SITE III of FIG. 8. Table 4 illustrates the complementarity of the nucleotide sequences of FLJ10648 BINDING SITE, designated SEQ ID:4717, to the nucleotide sequence of GAM180 RNA, herein designated GAM RNA, also designated SEQ ID:214.

Another function of GAM180 is therefore inhibition of FLJ10648 (Accession NP_060637.1). Accordingly, utilities of GAM180 include diagnosis, prevention and treatment of diseases and clinical conditions associated with FLJ10648.

FLJ10970 (Accession NP_060756.1) is another GAM180 target gene, herein designated TARGET GENE. FLJ10970 BINDING SITE is a target binding site found in the 5' untranslated region of mRNA encoded by FLJ10970, corresponding to a target binding site such as BINDING SITE I, BINDING SITE II or BINDING SITE III of FIG. 8. Table 4 illustrates the complementarity of the nucleotide sequences of FLJ10970 BINDING SITE, designated SEQ ID:13268, to the nucleotide sequence of GAM180 RNA, herein designated GAM RNA, also designated SEQ ID:214.

Another function of GAM180 is therefore inhibition of FLJ10970 (Accession NP_060756.1). Accordingly, utilities of GAM180 include diagnosis, prevention and treatment of diseases and clinical conditions associated with FLJ10970.

FLJ11700 (Accession NP_079168.1) is another GAM180 target gene, herein designated TARGET GENE. FLJ11700 BINDING SITE is a target binding site found in the 3' untranslated region of mRNA encoded by FLJ11700, corresponding to a target binding site such as BINDING SITE I, BINDING SITE II or BINDING SITE III of FIG. 8. Table 4 illustrates the complementarity of the nucleotide sequences of FLJ11700 BINDING SITE, designated SEQ ID:3258, to the nucleotide sequence of GAM180 RNA, herein designated GAM RNA, also designated SEQ ID:214.

Another function of GAM180 is therefore inhibition of FLJ11700 (Accession NP_079168.1). Accordingly, utilities of GAM180 include diagnosis, prevention and treatment of diseases and clinical conditions associated with FLJ11700.

FLJ12577 (Accession NP_112187.1) is another GAM180 target gene, herein designated TARGET GENE. FLJ12577 BINDING SITE is a target binding site found in the 3' untranslated region of mRNA encoded by FLJ12577, corresponding to a target binding site such as BINDING SITE I, BINDING SITE II or BINDING SITE III of FIG. 8. Table 4 illustrates the complementarity of the nucleotide sequences of FLJ12577 BINDING SITE, designated SEQ ID:7536, to the nucleotide sequence of GAM180 RNA, herein designated GAM RNA, also designated SEQ ID:214.

Another function of GAM180 is therefore inhibition of FLJ12577 (Accession NP_112187.1). Accordingly, utilities of GAM180 include diagnosis, prevention and treatment of diseases and clinical conditions associated with FLJ12577.

FLJ12587 (Accession NP_071925.2) is another GAM180 target gene, herein designated TARGET GENE. FLJ12587 BINDING SITE is a target binding site found in the 3' untranslated region of mRNA encoded by FLJ12587, corresponding to a target binding site such as BINDING SITE I, BINDING SITE II or BINDING SITE III of FIG. 8. Table 4 illustrates the complementarity of the nucleotide sequences of FLJ12587 BINDING SITE, designated SEQ ID:1658, to the nucleotide sequence of GAM180 RNA, herein designated GAM RNA, also designated SEQ ID:214.

Another function of GAM180 is therefore inhibition of FLJ12587 (Accession NP_071925.2). Accordingly, utilities of GAM180 include diagnosis, prevention and treatment of diseases and clinical conditions associated with FLJ12587.

FLJ13902 (Accession NP_078929.1) is another GAM180 target gene, herein designated TARGET GENE. FLJ13902 BINDING SITE is a target binding site found in the 3' untranslated region of mRNA encoded by FLJ13902, corresponding to a target binding site such as BINDING SITE I, BINDING SITE II or BINDING SITE III of FIG. 8. Table 4 illustrates the complementarity of the nucleotide sequences of FLJ13902 BINDING SITE, designated SEQ ID:19221, to the nucleotide sequence of GAM180 RNA, herein designated GAM RNA, also designated SEQ ID:214.

Another function of GAM180 is therefore inhibition of FLJ13902 (Accession NP_078929.1). Accordingly, utilities of GAM180 include diagnosis, prevention and treatment of diseases and clinical conditions associated with FLJ13902.

FLJ14166 (Accession NP_078841.1) is another GAM180 target gene, herein designated TARGET GENE. FLJ14166 BINDING SITE is a target binding site found in the 3' untranslated region of mRNA encoded by FLJ14166, corresponding to a target binding site such as BINDING SITE I, BINDING SITE II or BINDING SITE III of FIG. 8. Table 4 illustrates the complementarity of the nucleotide sequences of FLJ14166 BINDING SITE, designated SEQ ID:3589, to the nucleotide sequence of GAM180 RNA, herein designated GAM RNA, also designated SEQ ID:214.

Another function of GAM180 is therefore inhibition of FLJ14166 (Accession NP_078841.1). Accordingly, utilities of GAM180 include diagnosis, prevention and treatment of diseases and clinical conditions associated with FLJ14166.

FLJ14249 (Accession NP_567825.1) is another GAM180 target gene, herein designated TARGET GENE. FLJ14249 BINDING SITE is a target binding site found in the 3' untranslated region of multiple transcripts of mRNA encoded by FLJ14249, corresponding to a target binding site such as BINDING SITE I, BINDING SITE II or BINDING SITE III of FIG. 8. Table 4 illustrates the complementarity of the nucleotide sequences of FLJ14249 BINDING SITE, designated SEQ ID:14831, to the nucleotide sequence of GAM180 RNA, herein designated GAM RNA, also designated SEQ ID:214.

Another function of GAM180 is therefore inhibition of FLJ14249 (Accession NP_567825.1). Accordingly, utilities of GAM180 include diagnosis, prevention and treatment of diseases and clinical conditions associated with FLJ14249.

FLJ14249 (Accession NP_071905.2) is another GAM180 target gene, herein designated TARGET GENE. FLJ14249 BINDING SITE is a target binding site found in the 3' untranslated region of multiple transcripts of mRNA encoded by FLJ14249, corresponding to a target binding site such as BINDING SITE I, BINDING SITE II or BINDING SITE III of FIG. 8. Table 4 illustrates the complementarity of the nucleotide sequences of FLJ14249 BINDING SITE, designated SEQ ID:14831, to the nucleotide sequence of GAM180 RNA, herein designated GAM RNA, also designated SEQ ID:214.

Another function of GAM180 is therefore inhibition of FLJ14249 (Accession NP_071905.2). Accordingly, utilities of GAM180 include diagnosis, prevention and treatment of diseases and clinical conditions associated with FLJ14249.

FLJ14936 (Accession NP_115660.1) is another GAM180 target gene, herein designated TARGET GENE. FLJ14936 BINDING SITE is a target binding site found in the 3' untranslated region of multiple transcripts of mRNA encoded by FLJ14936, corresponding to a target binding site such as BINDING SITE I, BINDING SITE II or BINDING SITE III of FIG. 8. Table 4 illustrates the complementarity of the nucleotide sequences of FLJ14936 BINDING SITE, designated SEQ ID:6933, to the nucleotide sequence of GAM180 RNA, herein designated GAM RNA, also designated SEQ ID:214.

Another function of GAM180 is therefore inhibition of FLJ14936 (Accession NP_115660.1). Accordingly, utilities of GAM180 include diagnosis, prevention and treatment of diseases and clinical conditions associated with FLJ14936.

FLJ20174 (Accession NP_060169.1) is another GAM180 target gene, herein designated TARGET GENE. FLJ20174 BINDING SITE is a target binding site found in the 3' untranslated region of mRNA encoded by FLJ20174, corresponding to a target binding site such as BINDING SITE I, BINDING SITE II or BINDING SITE III of FIG. 8. Table 4 illustrates the complementarity of the nucleotide sequences of FLJ20174 BINDING SITE, designated SEQ ID:4747, to the nucleotide sequence of GAM180 RNA, herein designated GAM RNA, also designated SEQ ID:214.

Another function of GAM180 is therefore inhibition of FLJ20174 (Accession NP_060169.1). Accordingly, utilities of GAM180 include diagnosis, prevention and treatment of diseases and clinical conditions associated with FLJ20174.

FLJ20297 (Accession NP_060421.1) is another GAM180 target gene, herein designated TARGET GENE. FLJ20297 BINDING SITE is a target binding site found in the 3' untranslated region of multiple transcripts of mRNA encoded by FLJ20297, corresponding to a target binding site such as BINDING SITE I, BINDING SITE II or BINDING SITE III of FIG. 8. Table 4 illustrates the complementarity of the nucleotide sequences of FLJ20297 BINDING SITE, designated SEQ ID:1321, to the nucleotide sequence of GAM180 RNA, herein designated GAM RNA, also designated SEQ ID:214.

Another function of GAM180 is therefore inhibition of FLJ20297 (Accession NP_060421.1). Accordingly, utilities of GAM180 include diagnosis, prevention and treatment of diseases and clinical conditions associated with FLJ20297.

FLJ20297 (Accession NP_060221.1) is another GAM180 target gene, herein designated TARGET GENE. FLJ20297 BINDING SITE is a target binding site found in the 3' untranslated region of multiple transcripts of mRNA encoded by FLJ20297, corresponding to a target binding site such as BINDING SITE I, BINDING SITE II or BINDING SITE III of FIG. 8. Table 4 illustrates the complementarity of the nucleotide sequences of FLJ20297 BINDING SITE, designated SEQ ID:1321, to the nucleotide sequence of GAM180 RNA, herein designated GAM RNA, also designated SEQ ID:214.

Another function of GAM180 is therefore inhibition of FLJ20297 (Accession NP_060221.1). Accordingly, utilities of GAM180 include diagnosis, prevention and treatment of diseases and clinical conditions associated with FLJ20297.

FLJ20298 (Accession NP_060222.1) is another GAM180 target gene, herein designated TARGET GENE. FLJ20298 BINDING SITE is a target binding site found in the 3' untranslated region of mRNA encoded by FLJ20298, corresponding to a target binding site such as BINDING SITE I, BINDING SITE II or BINDING SITE III of FIG. 8. Table 4 illustrates the complementarity of the nucleotide sequences of FLJ20298 BINDING SITE, designated SEQ ID:11216, to the nucleotide sequence of GAM180 RNA, herein designated GAM RNA, also designated SEQ ID:214.

Another function of GAM180 is therefore inhibition of FLJ20298 (Accession NP_060222.1). Accordingly, utilities of GAM180 include diagnosis, prevention and treatment of diseases and clinical conditions associated with FLJ20298.

FLJ20511 (Accession NP_060323.1) is another GAM180 target gene, herein designated TARGET GENE. FLJ20511 BINDING SITE is a target binding site found in the 3' untranslated region of mRNA encoded by FLJ20511, corresponding to a target binding site such as BINDING SITE I, BINDING SITE II or BINDING SITE III of FIG. 8. Table 4 illustrates the complementarity of the nucleotide sequences of FLJ20511 BINDING SITE, designated SEQ ID:14414, to the nucleotide sequence of GAM180 RNA, herein designated GAM RNA, also designated SEQ ID:214.

Another function of GAM180 is therefore inhibition of FLJ20511 (Accession NP_060323.1). Accordingly, utilities of GAM180 include diagnosis, prevention and treatment of diseases and clinical conditions associated with FLJ20511.

FLJ20573 (Accession XP_033853.2) is another GAM180 target gene, herein designated TARGET GENE. FLJ20573 BINDING SITE is a target binding site found in the 5' untranslated region of mRNA encoded by FLJ20573, corresponding to a target binding site such as BINDING SITE I, BINDING SITE II or BINDING SITE III of FIG. 8. Table 4 illustrates the complementarity of the nucleotide sequences of FLJ20573 BINDING SITE, designated SEQ ID:11877, to the nucleotide sequence of GAM180 RNA, herein designated GAM RNA, also designated SEQ ID:214.

Another function of GAM180 is therefore inhibition of FLJ20573 (Accession XP_033853.2). Accordingly, utilities of GAM180 include diagnosis, prevention and treatment of diseases and clinical conditions associated with FLJ20573.

FLJ20666 (Accession NP_060392.1) is another GAM180 target gene, herein designated TARGET GENE. FLJ20666 BINDING SITE is a target binding site found in the 3' untranslated region of multiple transcripts of mRNA encoded by FLJ20666, corresponding to a target binding site such as BINDING SITE I, BINDING SITE II or BINDING SITE III of FIG. 8. Table 4 illustrates the complementarity of the nucleotide sequences of FLJ20666 BINDING SITE, designated SEQ ID:8314, to the nucleotide sequence of GAM180 RNA, herein designated GAM RNA, also designated SEQ ID:214.

Another function of GAM180 is therefore inhibition of FLJ20666 (Accession NP_060392.1). Accordingly, utilities of GAM180 include diagnosis, prevention and treatment of diseases and clinical conditions associated with FLJ20666.

FLJ22167 (Accession NP_078809.2) is another GAM180 target gene, herein designated TARGET GENE. FLJ22167 BINDING SITE is a target binding site found in the 5' untranslated region of mRNA encoded by FLJ22167, corresponding to a target binding site such as BINDING SITE I, BINDING SITE II or BINDING SITE III of FIG. 8. Table 4 illustrates the complementarity of the nucleotide sequences of FLJ22167 BINDING SITE, designated SEQ ID:6807, to the nucleotide sequence of GAM180 RNA, herein designated GAM RNA, also designated SEQ ID:214.

Another function of GAM180 is therefore inhibition of FLJ22167 (Accession NP_078809.2). Accordingly, utilities of GAM180 include diagnosis, prevention and treatment of diseases and clinical conditions associated with FLJ22167.

FLJ22578 (Accession NP_079140.1) is another GAM180 target gene, herein designated TARGET GENE. FLJ22578 BINDING SITE is a target binding site found in the 3' untranslated region of mRNA encoded by FLJ22578, corresponding to a target binding site such as BINDING SITE I, BINDING SITE II or BINDING SITE III of FIG. 8. Table 4 illustrates the complementarity of the nucleotide sequences of FLJ22578 BINDING SITE, designated SEQ ID:8608, to the nucleotide sequence of GAM180 RNA, herein designated GAM RNA, also designated SEQ ID:214.

Another function of GAM180 is therefore inhibition of FLJ22578 (Accession NP_079140.1). Accordingly, utilities of GAM180 include diagnosis, prevention and treatment of diseases and clinical conditions associated with FLJ22578.

FLJ23074 (Accession NP_079328.1) is another GAM180 target gene, herein designated TARGET GENE. FLJ23074 BINDING SITE is a target binding site found in the 3' untranslated region of mRNA encoded by FLJ23074, corresponding to a target binding site such as BINDING SITE I, BINDING SITE II or BINDING SITE III of FIG. 8. Table 4 illustrates the complementarity of the nucleotide sequences of FLJ23074 BINDING SITE, designated SEQ ID:16835, to the nucleotide sequence of GAM180 RNA, herein designated GAM RNA, also designated SEQ ID:214.

Another function of GAM180 is therefore inhibition of FLJ23074 (Accession NP_079328.1). Accordingly, utilities of GAM180 include diagnosis, prevention and treatment of diseases and clinical conditions associated with FLJ23074.

FLJ23462 (Accession NP_079119.2) is another GAM180 target gene, herein designated TARGET GENE. FLJ23462 BINDING SITE is a target binding site found in the 3' untranslated region of mRNA encoded by FLJ23462, corresponding to a target binding site such as BINDING SITE I, BINDING SITE II or BINDING SITE III of FIG. 8. Table 4 illustrates the complementarity of the nucleotide sequences of FLJ23462 BINDING SITE, designated SEQ ID:7500, to the nucleotide sequence of GAM180 RNA, herein designated GAM RNA, also designated SEQ ID:214.

Another function of GAM180 is therefore inhibition of FLJ23462 (Accession NP_079119.2). Accordingly, utilities of GAM180 include diagnosis, prevention and treatment of diseases and clinical conditions associated with FLJ23462.

FLJ30679 (Accession NP_694562.1) is another GAM180 target gene, herein designated TARGET GENE. FLJ30679 BINDING SITE is a target binding site found in the 3' untranslated region of mRNA encoded by FLJ30679, corresponding to a target binding site such as BINDING SITE I, BINDING SITE II or BINDING SITE III of FIG. 8. Table 4 illustrates the complementarity of the nucleotide sequences of FLJ30679 BINDING SITE, designated SEQ ID:2972, to the nucleotide sequence of GAM180 RNA, herein designated GAM RNA, also designated SEQ ID:214.

Another function of GAM180 is therefore inhibition of FLJ30679 (Accession NP_694562.1). Accordingly, utilities of GAM180 include diagnosis, prevention and treatment of diseases and clinical conditions associated with FLJ30679.

FLJ32452 (Accession NP_653177.2) is another GAM180 target gene, herein designated TARGET GENE. FLJ32452 BINDING SITE is a target binding site found in the 3' untranslated region of mRNA encoded by FLJ32452, corresponding to a target binding site such as BINDING SITE I, BINDING SITE II or BINDING SITE III of FIG. 8. Table 4 illustrates the complementarity of the nucleotide sequences of FLJ32452 BINDING SITE, designated SEQ ID:2212, to the nucleotide sequence of GAM180 RNA, herein designated GAM RNA, also designated SEQ ID:214.

Another function of GAM180 is therefore inhibition of FLJ32452 (Accession NP_653177.2). Accordingly, utilities of GAM180 include diagnosis, prevention and treatment of diseases and clinical conditions associated with FLJ32452.

FLJ34658 (Accession NP_689617.2) is another GAM180 target gene, herein designated TARGET GENE. FLJ34658 BINDING SITE is a target binding site found in the 3' untranslated region of mRNA encoded by FLJ34658, corresponding to a target binding site such as BINDING SITE I, BINDING SITE II or BINDING SITE III of FIG. 8. Table 4 illustrates the complementarity of the nucleotide sequences of FLJ34658 BINDING SITE, designated SEQ ID:4616, to the nucleotide sequence of GAM180 RNA, herein designated GAM RNA, also designated SEQ ID:214.

Another function of GAM180 is therefore inhibition of FLJ34658 (Accession NP_689617.2). Accordingly, utilities of GAM180 include diagnosis, prevention and treatment of diseases and clinical conditions associated with FLJ34658.

FLJ34817 (Accession NP_689516.1) is another GAM180 target gene, herein designated TARGET GENE. FLJ34817 BINDING SITE is a target binding site found in the 5' untranslated region of mRNA encoded by FLJ34817, corresponding to a target binding site such as BINDING SITE I, BINDING SITE II or BINDING SITE III of FIG. 8. Table 4 illustrates the complementarity of the nucleotide sequences of FLJ34817 BINDING SITE, designated SEQ ID:1005, to the nucleotide sequence of GAM180 RNA, herein designated GAM RNA, also designated SEQ ID:214.

Another function of GAM180 is therefore inhibition of FLJ34817 (Accession NP_689516.1). Accordingly, utilities of GAM180 include diagnosis, prevention and treatment of diseases and clinical conditions associated with FLJ34817.

FLJ39957 (Accession NP_689749.1) is another GAM180 target gene, herein designated TARGET GENE. FLJ39957 BINDING SITE1 and FLJ39957 BINDING SITE2 are target binding sites found in untranslated regions of mRNA encoded by FLJ39957, corresponding to target binding sites such as BINDING SITE I, BINDING SITE II or BINDING SITE III of FIG. 8. Table 4 illustrates the complementarity of the nucleotide sequences of FLJ39957 BINDING SITE1 and FLJ39957 BINDING SITE2, designated SEQ ID:12852 and SEQ ID:2358 respectively, to the nucleotide sequence of GAM180 RNA, herein designated GAM RNA, also designated SEQ ID:214.

Another function of GAM180 is therefore inhibition of FLJ39957 (Accession NP_689749.1). Accordingly, utilities of GAM180 include diagnosis, prevention and treatment of diseases and clinical conditions associated with FLJ39957.

FLJ40235 (Accession NP_775906.1) is another GAM180 target gene, herein designated TARGET GENE. FLJ40235 BINDING SITE is a target binding site found in the 3' untranslated region of mRNA encoded by FLJ40235, corresponding to a target binding site such as BINDING SITE I, BINDING SITE II or BINDING SITE III of FIG. 8. Table 4 illustrates the complementarity of the nucleotide sequences of FLJ40235 BINDING SITE, designated SEQ ID:4486, to the nucleotide sequence of GAM180 RNA, herein designated GAM RNA, also designated SEQ ID:214.

Another function of GAM180 is therefore inhibition of FLJ40235 (Accession NP_775906.1). Accordingly, utilities of GAM180 include diagnosis, prevention and treatment of diseases and clinical conditions associated with FLJ40235.

FLJ90798 (Accession NP_699198.1) is another GAM180 target gene, herein designated TARGET GENE. FLJ90798 BINDING SITE is a target binding site found in the 3' untranslated region of mRNA encoded by FLJ90798, corresponding to a target binding site such as BINDING SITE I, BINDING SITE II or BINDING SITE III of FIG. 8. Table 4 illustrates the complementarity of the nucleotide sequences of FLJ90798 BINDING SITE, designated SEQ ID:14320, to the nucleotide sequence of GAM180 RNA, herein designated GAM RNA, also designated SEQ ID:214.

Another function of GAM180 is therefore inhibition of FLJ90798 (Accession NP_699198.1). Accordingly, utilities of GAM180 include diagnosis, prevention and treatment of diseases and clinical conditions associated with FLJ90798.

Forkhead box p1 (FOXP1, Accession NP_116071.2) is another GAM180 target gene, herein designated TARGET GENE. FOXP1 BINDING SITE is a target binding site found in the 5' untranslated region of mRNA encoded by FOXP1, corresponding to a target binding site such as BINDING SITE I, BINDING SITE II or BINDING SITE III of FIG. 8. Table 4 illustrates the complementarity of the nucleotide sequences of FOXP1 BINDING SITE, designated SEQ ID:19853, to the nucleotide sequence of GAM180 RNA, herein designated GAM RNA, also designated SEQ ID:214.

Another function of GAM180 is therefore inhibition of Forkhead box p1 (FOXP1, Accession NP_116071.2). Accordingly, utilities of GAM180 include diagnosis, prevention and treatment of diseases and clinical conditions associated with FOXP1.

Formyl peptide receptor 1 (FPR1, Accession NP_002020.1) is another GAM180 target gene, herein designated TARGET GENE. FPR1 BINDING SITE is a target binding site found in the 5' untranslated region of mRNA encoded by FPR1, corresponding to a target binding site such as BINDING SITE I, BINDING SITE II or BINDING SITE III of FIG. 8. Table 4 illustrates the complementarity of the nucleotide sequences of FPR1 BINDING SITE, designated SEQ ID:2325, to the nucleotide sequence of GAM180 RNA, herein designated GAM RNA, also designated SEQ ID:214.

Another function of GAM180 is therefore inhibition of Formyl peptide receptor 1 (FPR1, Accession NP_002020.1). Accordingly, utilities of GAM180 include diagnosis, prevention and treatment of diseases and clinical conditions associated with FPR1.

Formyl peptide receptor-like 2 (FPRL2, Accession NP_002021.2) is another GAM180 target gene, herein designated TARGET GENE. FPRL2 BINDING SITE is a target binding site found in the 5' untranslated region of mRNA encoded by FPRL2, corresponding to a target binding site such as BINDING SITE I, BINDING SITE II or BINDING SITE III of FIG. 8. Table 4 illustrates the complementarity of the nucleotide sequences of FPRL2 BINDING SITE, designated SEQ ID:13294, to the nucleotide sequence of GAM180 RNA, herein designated GAM RNA, also designated SEQ ID:214.

Another function of GAM180 is therefore inhibition of Formyl peptide receptor-like 2 (FPRL2, Accession NP_002021.2). Accordingly, utilities of GAM180 include diagnosis, prevention and treatment of diseases and clinical conditions associated with FPRL2.

Fucosyltransferase 3 (galactoside 3(4)-l-fucosyltransferase, lewis blood group included) (FUT3, Accession NP_000140.1) is another GAM180 target gene, herein designated TARGET GENE. FUT3 BINDING SITE is a target binding site found in the 3' untranslated region of mRNA encoded by FUT3, corresponding to a target binding site such as BINDING SITE I, BINDING SITE II or BINDING SITE III of FIG. 8. Table 4 illustrates the complementarity of the nucleotide sequences of FUT3 BINDING SITE, designated SEQ ID:2915, to the nucleotide sequence of GAM180 RNA, herein designated GAM RNA, also designated SEQ ID:214.

Another function of GAM180 is therefore inhibition of Fucosyltransferase 3 (galactoside 3(4)-l-fucosyltransferase, lewis blood group included) (FUT3, Accession NP_000140.1), a gene which may catalyze alpha-1,3 and alpha-1,4 glycosidic linkages involved in the expression of vim-2, lewis a, lewis b, sialyl lewis x and lewis x/ssea-1 antigens. and therefore may be associated with Lewis-negative disease. Accordingly, utilities of GAM180 include diagnosis, prevention and treatment of Lewis-negative disease, and of other diseases and clinical conditions associated with FUT3.

The function of FUT3 has been established by previous studies. The Lewis system involves genetically variable antigens in the body fluids and only secondarily are the antigens absorbed to red cells. Grollman et al. (1969) showed that Lewis- negative women lack a specific fucosyltransferase which is present in the milk of Lewis-positive women. The enzyme is apparently required for synthesis of the structural determinants of both Lewis (a) and Lewis (b) specificity. The same enzyme is involved in the synthesis of milk oligosaccharides, because 2 oligosaccharides containing the relevant linkage were absent from the milk of Lewis-negative women. Grubb (1953) provided the ingenious interpretation of the interactions between the Les locus determining presence/absence of Lewis substance in the saliva and on red cells and the Se locus (OMIM Ref. No. 182100) determining secretion of ABH blood group substances in the saliva and Le(a) or Le(b) expression in red cells. In transfusion medicine, it has been found that some individuals who type as Lewis-positive on erythrocytes can change their erythrocyte phenotype to Lewis-negative during diseases or during pregnancy. Orntoft et al. (1996) noted that these patients have been named nongenuine Lewis-negative individuals as they have alpha-1-4 fucosyltransferase activity in saliva. Due to this phenomenon, the Lewis-negative phenotype is more common among cancer patients (approximately 20%) than among healthy individuals (approximately 8%). Orntoft et al. (1996) examined the mutational spectrum of the Lewis gene in Denmark and found 6 different mutations. Five, 59T-G (L20R; 111100.0001), 202T-C (W68R), 314C-T (T105M), 508G-A (G170S; 111100.0001), and 1067T-A (I356K), were frequent, and 1, 445C-A (L146M), was only detected in 1 of 40 individuals. The authors demonstrated that the nucleotide 202 and 314 mutations were located on the same allele. COS-7 cells transfected with an allele having the 202/314 mutations lacked enzyme activity. Lewis-negative patients, whose erythrocytes converted from Lewis-positive to Lewis-negative during their disease, showed FUT3 heterozygosity significantly more often than did others (p less than 0.05). Pang et al. (1998) identified 5 novel missense mutations in the FUT3 gene in African (Xhosa) and Caucasian subjects in South Africa.

Full details of the abovementioned studies are described in the following publications, the disclosure of which are hereby incorporated by reference:

Grollman, E. F.; Kobata, A.; Ginsburg, V.: An enzymatic basis for Lewis blood types in man. J. Clin. Invest. 48:1489-1494, 1969; and Orntoft, T. F.; Vestergaard, E. M.; Holmes, E.; Jakobsen, J. S.; Grunnet, N.; Mortensen, M.; Johnson, P.; Bross, P.; Gregersen, N.; Skorstengaard, K.; Jensen, U. B.; Bolund, L.; Wolf, H.

Further studies establishing the function and utilities of FUT3 are found in John Hopkins OMIM database record ID 111100, and in cited publications listed in Table 5, which are hereby incorporated by reference. Fucosyltransferase 5 (alpha (1,3) fucosyltransferase) (FUT5, Accession NP_002025.1) is another GAM180 target gene, herein designated TARGET GENE. FUT5 BINDING SITE is a target binding site found in the 3' untranslated region of mRNA encoded by FUT5, corresponding to a target binding site such as BINDING SITE I, BINDING SITE II or BINDING SITE III of FIG. 8. Table 4 illustrates the complementarity of the nucleotide sequences of FUT5 BINDING SITE, designated SEQ ID:2915, to the nucleotide sequence of GAM180 RNA, herein designated GAM RNA, also designated SEQ ID:214.

Another function of GAM180 is therefore inhibition of Fucosyltransferase 5 (alpha (1,3) fucosyltransferase) (FUT5, Accession NP_002025.1), a gene which may catalyse alpha-1,3 glycosidic linkages involved in the expression of vim-2, lewis x/ssea-1 and sialyl lewis x antigens. Accordingly, utilities of GAM180 include diagnosis, prevention and treatment of diseases and clinical conditions associated with FUT5.

The function of FUT5 has been established by previous studies. Weston et al. (1992) isolated a human alpha-3-fucosyltransferase gene homologous to but distinct from 2 previously reported fucosyltransferase genes: alpha- 3,4-fucosyltransferase, thought to represent the human Lewis blood group locus (FUT3; 111100), and an alpha-3-fucosyltransferase expressed in the myeloid lineage (FUT4; 104230). The new enzyme shared 91% amino acid sequence identity with the Lewis blood group fucosyltransferase, yet exhibited only trace amounts of alpha-4-fucosyltransferase activity. By PCR analysis of somatic cell hybrid DNAs, Weston et al. (1992) demonstrated that the gene is located on chromosome 19. They concluded that the gene encodes a 'plasma type' of alpha- 3-fucosyltransferase. McCurley et al. (1995) mapped FUT5 to 19p13.3 by fluorescence in situ hybridization using cosmids containing FUT6 (OMIM Ref. No. 136836) and FUT5. The results indicated that FUT6 lies approximately 70 kb telomeric of FUT5. McCurley et al. (1995) used conventional and pulsed field gel electrophoresis mapping to total genomic DNA and large genomic clones in order to generate a fine map of the cluster of 19p FUT genes. A P1 clone indicated the gene order: cen-FUT5-FUT3-FUT6-tel. FUT5 and FUT3 are separated by 23 kb and FUT3 and FUT6 are separated by 14 kb; these data placed FUT5 and FUT6 closer together than was estimated by fluorescence in situ hybridization. The close proximity and tandem orientation of the 3 genes suggests coordinate regulation. The direction of transcription is toward the telomere in the case of all 3 genes Full details of the abovementioned studies are described in the following publications, the disclosure of which are hereby incorporated by reference:

McCurley, R. S.; Recinos, A., III; Olsen, A. S.; Gingrich, J. C.; Szczepaniak, D.; Cameron, H. S.; Krauss, R.; Weston, B. W.: Physical maps of human alpha(1,3)fucosyltransferase genes FUT3-FUT6 on chromosomes 19p13.3 and 11q21. Genomics 26:142-146, 1995; and Weston, B. W.; Nair, R. P.; Larsen, R. D.; Lowe, J. B.: Isolation of a novel human alpha(1,3)fucosyltransferase gene and molecular comparison to the human Lewis blood group alpha(1,3/1.

Further studies establishing the function and utilities of FUT5 are found in John Hopkins OMIM database record ID 136835, and in cited publications listed in Table 5, which are hereby incorporated by reference. Fucosyltransferase 6 (alpha (1,3) fucosyltransferase) (FUT6, Accession NP_000141.1) is another GAM180 target gene, herein designated TARGET GENE. FUT6 BINDING SITE1 and FUT6 BINDING SITE2 are target binding sites found in untranslated regions of mRNA encoded by FUT6, corresponding to target binding sites such as BINDING SITE I, BINDING SITE II or BINDING SITE III of FIG. 8. Table 4 illustrates the complementarity of the nucleotide sequences of FUT6 BINDING SITE1 and FUT6 BINDING SITE2, designated SEQ ID:5353 and SEQ ID:7499 respectively, to the nucleotide sequence of GAM180 RNA, herein designated GAM RNA, also designated SEQ ID:214.

Another function of GAM180 is therefore inhibition of Fucosyltransferase 6 (alpha (1,3) fucosyltransferase) (FUT6, Accession NP_000141.1), a gene which is involved in the biosynthesis of the e-selectin ligand, sialyl-lewis x. catalyzes the transfer of fucose from gdp-beta-fucose to alpha-2,3 sialylated substrates. Accordingly, utilities of GAM180 include diagnosis, prevention and treatment of diseases and clinical conditions associated with FUT6.

The function of FUT6 and its association with various diseases and clinical conditions, has been established by previous studies, as described hereinabove with reference to GAM47.1. Fxyd domain containing ion transport regulator 3 (FXYD3, Accession NP_005962.1) is another GAM180 target gene, herein designated TARGET GENE. FXYD3 BINDING SITE is a target binding site found in the 3' untranslated region of multiple transcripts of mRNA encoded by FXYD3, corresponding to a target binding site such as BINDING SITE I, BINDING SITE II or BINDING SITE III of FIG. 8. Table 4 illustrates the complementarity of the nucleotide sequences of FXYD3 BINDING SITE, designated SEQ ID:3047, to the nucleotide sequence of GAM180 RNA, herein designated GAM RNA, also designated SEQ ID:214.

Another function of GAM180 is therefore inhibition of Fxyd domain containing ion transport regulator 3 (FXYD3, Accession NP_005962.1). Accordingly, utilities of GAM180 include diagnosis, prevention and treatment of diseases and clinical conditions associated with FXYD3.

Fxyd domain containing ion transport regulator 3 (FXYD3, Accession NP_068710.1) is another GAM180 target gene, herein designated TARGET GENE. FXYD3 BINDING SITE is a target binding site found in the 3' untranslated region of multiple transcripts of mRNA encoded by FXYD3, corresponding to a target binding site such as BINDING SITE I, BINDING SITE II or BINDING SITE III of FIG. 8. Table 4 illustrates the complementarity of the nucleotide sequences of FXYD3 BINDING SITE, designated SEQ ID:3047, to the nucleotide sequence of GAM180 RNA, herein designated GAM RNA, also designated SEQ ID:214.

Another function of GAM180 is therefore inhibition of Fxyd domain containing ion transport regulator 3 (FXYD3, Accession NP_068710.1). Accordingly, utilities of GAM180 include diagnosis, prevention and treatment of diseases and clinical conditions associated with FXYD3.

Gamma-aminobutyric acid (gaba) b receptor, 1 (GABBR1, Accession NP_068705.1) is another GAM180 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:7008, to the nucleotide sequence of GAM180 RNA, herein designated GAM RNA, also designated SEQ ID:214.

Another function of GAM180 is therefore inhibition of Gamma-aminobutyric acid (gaba) b receptor, 1 (GABBR1, Accession NP_068705.1). Accordingly, utilities of GAM180 include diagnosis, prevention and treatment of diseases and clinical conditions associated with GABBR1.

GAC1 (Accession NP_006329.1) is another GAM180 target gene, herein designated TARGET GENE. GAC1 BINDING SITE is a target binding site found in the 3' untranslated region of mRNA encoded by GAC1, corresponding to a target binding site such as BINDING SITE I, BINDING SITE II or BINDING SITE III of FIG. 8. Table 4 illustrates the complementarity of the nucleotide sequences of GAC1 BINDING SITE, designated SEQ ID:7458, to the nucleotide sequence of GAM180 RNA, herein designated GAM RNA, also designated SEQ ID:214.

Another function of GAM180 is therefore inhibition of GAC1 (Accession NP_006329.1). Accordingly, utilities of GAM180 include diagnosis, prevention and treatment of diseases and clinical conditions associated with GAC1.

Glycoprotein a repetitions predominant (GARP, Accession NP_005503.1) is another GAM180 target gene, herein designated TARGET GENE. GARP BINDING SITE is a target binding site found in the 3' untranslated region of mRNA encoded by GARP, corresponding to a target binding site such as BINDING SITE I, BINDING SITE II or BINDING SITE III of FIG. 8. Table 4 illustrates the complementarity of the nucleotide sequences of GARP BINDING SITE, designated SEQ ID:10909, to the nucleotide sequence of GAM180 RNA, herein designated GAM RNA, also designated SEQ ID:214.

Another function of GAM180 is therefore inhibition of Glycoprotein a repetitions predominant (GARP, Accession NP_005503.1). Accordingly, utilities of GAM180 include diagnosis, prevention and treatment of diseases and clinical conditions associated with GARP.

Glucocorticoid induced transcript 1 (GLCCI1, Accession XP_166529.2) is another GAM180 target gene, herein designated TARGET GENE. GLCCI1 BINDING SITE is a target binding site found in the 3' untranslated region of mRNA encoded by GLCCI1, corresponding to a target binding site such as BINDING SITE I, BINDING SITE II or BINDING SITE III of FIG. 8. Table 4 illustrates the complementarity of the nucleotide sequences of GLCCI1 BINDING SITE, designated SEQ ID:14024, to the nucleotide sequence of GAM180 RNA, herein designated GAM RNA, also designated SEQ ID:214.

Another function of GAM180 is therefore inhibition of Glucocorticoid induced transcript 1 (GLCCI1, Accession XP_166529.2). Accordingly, utilities of GAM180 include diagnosis, prevention and treatment of diseases and clinical conditions associated with GLCCI1.

Glutamate-ammonia ligase (glutamine synthase) (GLUL, Accession NP_002056.2) is another GAM180 target gene, herein designated TARGET GENE. GLUL BINDING SITE is a target binding site found in the 5' untranslated region of mRNA encoded by GLUL, corresponding to a target binding site such as BINDING SITE I, BINDING SITE II or BINDING SITE III of FIG. 8. Table 4 illustrates the complementarity of the nucleotide sequences of GLUL BINDING SITE, designated SEQ ID:661, to the nucleotide sequence of GAM180 RNA, herein designated GAM RNA, also designated SEQ ID:214.

Another function of GAM180 is therefore inhibition of Glutamate-ammonia ligase (glutamine synthase) (GLUL, Accession NP_002056.2), a gene which catalyzes the condensation of glutamate and ammonia to form glutamine. Accordingly, utilities of GAM180 include diagnosis, prevention and treatment of diseases and clinical conditions associated with GLUL.

The function of GLUL has been established by previous studies. Glutamine synthetase (EC 6.3.1.2), also called glutamate-ammonia ligase (GLUL), is expressed throughout the body and plays an important role in controlling body pH and in removing ammonia from the circulation. The enzyme clears L-glutamate, the major neurotransmitter in the central nervous system, from neuronal synapses (see OMIM Ref. No. references in Clancy et al., 1996). Gibbs et al. (1987) reported the complete 1,119-bp coding sequence of glutamine synthetase, which they determined from a liver-derived cDNA. Pesole et al. (1991) suggested that glutamine synthetase is a good molecular clock for determining times of divergence even as great as that which occurred between eukaryotes and prokaryotes. One conclusion reached by Pesole et al. (1991) was that organelle-specific enzymes, such as those of the mitochondria, may have originated from a duplication of nuclear genes. The endosymbiotic hypothesis suggests that a transfer of prokaryotic genes to nuclei occurred during the evolution of the primitive eukaryotic cell. In some cases, it is likely that the old prokaryotic gene could not be active in the new nuclear genome environment and was totally lost because its function in the organelle could be dispensed with. Subsequently, a new organelle-specific enzyme could have originated to serve specialized metabolic functions. The presence of glutamine synthetase in mitochondria is linked to the nitrogen metabolism of the species, and in particular to the need for glutamine as a source of ammonia and for particular biochemical pathways for ammonia detoxification.

Full details of the abovementioned studies are described in the following publications, the disclosure of which are hereby incorporated by reference:

Gibbs, C. S.; Campbell, K. E.; Wilson, R. H.: Sequence of a human glutamine synthetase cDNA. Nucleic Acids Res. 15:6293 only, 1987; and Pesole, G.; Bozzetti, M. P.; Lanave, C.; Preparata, G.; Saccone, C.: Glutamine synthetase gene evolution: a good molecular clock. Proc. Nat. Acad. Sci. 88:522-526, 1991.

Further studies establishing the function and utilities of GLUL are found in John Hopkins OMIM database record ID 138290, and in cited publications listed in Table 5, which are hereby incorporated by reference.gm117 (Accession XP_086187.1) is another GAM180 target gene, herein designated TARGET GENE. gm117 BINDING SITE is a target binding site found in the 3' untranslated region of mRNA encoded by gm117, corresponding to a target binding site such as BINDING SITE I, BINDING SITE II or BINDING SITE III of FIG. 8. Table 4 illustrates the complementarity of the nucleotide sequences of gm117 BINDING SITE, designated SEQ ID:1842, to the nucleotide sequence of GAM180 RNA, herein designated GAM RNA, also designated SEQ ID:214.

Another function of GAM180 is therefore inhibition of gm117 (Accession XP_086187.1). Accordingly, utilities of GAM180 include diagnosis, prevention and treatment of diseases and clinical conditions associated with gm117.

GPR124 (Accession NP_116166.6) is another GAM180 target gene, herein designated TARGET GENE. GPR124 BINDING SITE is a target binding site found in the 3' untranslated region of mRNA encoded by GPR124, corresponding to a target binding site such as BINDING SITE I, BINDING SITE II or BINDING SITE III of FIG. 8. Table 4 illustrates the complementarity of the nucleotide sequences of GPR124 BINDING SITE, designated SEQ ID:14853, to the nucleotide sequence of GAM180 RNA, herein designated GAM RNA, also designated SEQ ID:214.

Another function of GAM180 is therefore inhibition of GPR124 (Accession NP_116166.6). Accordingly, utilities of GAM180 include diagnosis, prevention and treatment of diseases and clinical conditions associated with GPR124.

Hyaluronan synthase 3 (HAS3, Accession NP_005320.2) is another GAM180 target gene, herein designated TARGET GENE. HAS3 BINDING SITE is a target binding site found in the 3' untranslated region of multiple transcripts of mRNA encoded by HAS3, corresponding to a target binding site such as BINDING SITE I, BINDING SITE II or BINDING SITE III of FIG. 8. Table 4 illustrates the complementarity of the nucleotide sequences of HAS3 BINDING SITE, designated SEQ ID:17871, to the nucleotide sequence of GAM180 RNA, herein designated GAM RNA, also designated SEQ ID:214.

Another function of GAM180 is therefore inhibition of Hyaluronan synthase 3 (HAS3, Accession NP_005320.2), a gene which plays a role in hyaluronan/hyaluronic acid (ha) synthesis. Accordingly, utilities of GAM180 include diagnosis, prevention and treatment of diseases and clinical conditions associated with HAS3.

The function of HAS3 has been established by previous studies. Hyaluronan (HA) is an unbranched glycosaminoglycan composed of repeating disaccharide units. It is a major constituent of the extracellular matrix and has been implicated in development, tumorigenesis, and several diseases. HA is synthesized at the inner face of the plasma membrane and is subsequently extruded to the outside of the cell. By degenerate PCR, Spicer et al. (1997) isolated a genomic fragment of human HA synthase-3 (HAS3) and genomic and cDNA clones of mouse Has3. The amino acid sequences encoded by the partial HAS3 fragment and the corresponding region of Has3 are 99% conserved. The authors noted that the high degree of sequence conservation between specific human and mouse HASs contrasts with the lower level of identity between HASs within a species, suggesting an evolutionary conservation of functionally important residues and differences in the mode of action of the various HASs. The predicted 554-amino acid Has3 has several consensus HA-binding motifs and multiple transmembrane domains, with 2 at the N terminus and a cluster at the C terminus. Expression of Has3 in COS-1 cells led to high levels of HA biosynthesis. Northern blot analysis of the mouse embryo showed that Has3 is predominantly expressed at late gestation as a major, approximately 6.0- to 6.5-kb transcript and a minor, approximately 4.0-kb transcript. By PCR screening somatic cell hybrid DNAs and a YAC contig, Spicer et al. (1997) localized the human HAS3 gene to 16q22.1. By interspecific backcross analysis, they mapped the mouse Has3 gene to chromosome 8. Since HAS1 (OMIM Ref. No. 601463), HAS2 (OMIM Ref. No. 601636), and HAS3 are located on different autosomes, Spicer et al. (1997) suggested that the HAS gene family arose comparatively early in vertebrate evolution by sequential duplication of an ancestral HAS gene.

Full details of the abovementioned studies are described in the following publications, the disclosure of which are hereby incorporated by reference:

Spicer, A. P.; Olson, J. S.; McDonald, J. A.: Molecular cloning and characterization of a cDNA encoding the third putative mammalian hyaluronan synthase. J. Biol. Chem. 272:8957-8961, 1997; and Spicer, A. P.; Seldin, M. F.; Olsen, A. S.; Brown, N.; Wells, D. E.; Doggett, N. A.; Itano, N.; Kimata, K.; Inazawa, J.; McDonald, J. A.: Chromosomal localization of the human and mous.

Further studies establishing the function and utilities of HAS3 are found in John Hopkins OMIM database record ID 602428, and in cited publications listed in Table 5, which are hereby incorporated by reference. Huntingtin (huntington disease) (HD, Accession NP_002102.2) is another GAM180 target gene, herein designated TARGET GENE. HD BINDING SITE is a target binding site found in the 3' untranslated region of mRNA encoded by HD, corresponding to a target binding site such as BINDING SITE I, BINDING SITE II or BINDING SITE III of FIG. 8. Table 4 illustrates the complementarity of the nucleotide sequences of HD BINDING SITE, designated SEQ ID:4516, to the nucleotide sequence of GAM180 RNA, herein designated GAM RNA, also designated SEQ ID:214.

Another function of GAM180 is therefore inhibition of Huntingtin (huntington disease) (HD, Accession NP_002102.2). Accordingly, utilities of GAM180 include diagnosis, prevention and treatment of diseases and clinical conditions associated with HD.

Huntington interacting protein 1 (HIP1, Accession NP_005329.2) is another GAM180 target gene, herein designated TARGET GENE. HIP1 BINDING SITE is a target binding site found in the 3' untranslated region of mRNA encoded by HIP1, corresponding to a target binding site such as BINDING SITE I, BINDING SITE II or BINDING SITE III of FIG. 8. Table 4 illustrates the complementarity of the nucleotide sequences of HIP1 BINDING SITE, designated SEQ ID:17634, to the nucleotide sequence of GAM180 RNA, herein designated GAM RNA, also designated SEQ ID:214.

Another function of GAM180 is therefore inhibition of Huntingtin interacting protein 1 (HIP1, Accession NP_005329.2), a gene which is a membrane protein and interacts with huntingtin. and therefore may be associated with Huntington disease. Accordingly, utilities of GAM180 include diagnosis, prevention and treatment of Huntington disease, and of other diseases and clinical conditions associated with HIP1.

The function of HIP1 and its association with various diseases and clinical conditions, has been established by previous studies, as described hereinabove with reference to GAM72.1. Hiv-1 tat interactive protein, 60 kda (HTATIP, Accession NP_006379.1) is another GAM180 target gene, herein designated TARGET GENE. HTATIP BINDING SITE is a target binding site found in the 5' untranslated region of mRNA encoded by HTATIP, corresponding to a target binding site such as BINDING SITE I, BINDING SITE II or BINDING SITE III of FIG. 8. Table 4 illustrates the complementarity of the nucleotide sequences of HTATIP BINDING SITE, designated SEQ ID:20106, to the nucleotide sequence of GAM180 RNA, herein designated GAM RNA, also designated SEQ ID:214.

Another function of GAM180 is therefore inhibition of Hiv-1 tat interactive protein, 60 kda (HTATIP, Accession NP_006379.1). Accordingly, utilities of GAM180 include diagnosis, prevention and treatment of diseases and clinical conditions associated with HTATIP.

Interleukin 4 induced 1 (IL4I1, Accession NP_690863.1) is another GAM180 target gene, herein designated TARGET GENE. IL4I1 BINDING SITE is a target binding site found in the 5' untranslated region of multiple transcripts of mRNA encoded by IL4I1, corresponding to a target binding site such as BINDING SITE I, BINDING SITE II or BINDING SITE III of FIG. 8. Table 4 illustrates the complementarity of the nucleotide sequences of IL4I1 BINDING SITE, designated SEQ ID:17359, to the nucleotide sequence of GAM180 RNA, herein designated GAM RNA, also designated SEQ ID:214.

Another function of GAM180 is therefore inhibition of Interleukin 4 induced 1 (IL4I1, Accession NP_690863.1). Accordingly, utilities of GAM180 include diagnosis, prevention and treatment of diseases and clinical conditions associated with IL4I1.

KIAA0258 (Accession NP_055600.1) is another GAM180 target gene, herein designated TARGET GENE. KIAA0258 BINDING SITE is a target binding site found in the 3' untranslated region of mRNA encoded by KIAA0258, corresponding to a target binding site such as BINDING SITE I, BINDING SITE II or BINDING SITE III of FIG. 8. Table 4 illustrates the complementarity of the nucleotide sequences of KIAA0258 BINDING SITE, designated SEQ ID:10239, to the nucleotide sequence of GAM180 RNA, herein designated GAM RNA, also designated SEQ ID:214.

Another function of GAM180 is therefore inhibition of KIAA0258 (Accession NP_055600.1). Accordingly, utilities of GAM180 include diagnosis, prevention and treatment of diseases and clinical conditions associated with KIAA0258.

KIAA0513 (Accession NP_055547.1) is another GAM180 target gene, herein designated TARGET GENE. KIAA0513 BINDING SITE is a target binding site found in the 3' untranslated region of mRNA encoded by KIAA0513, corresponding to a target binding site such as BINDING SITE I, BINDING SITE II or BINDING SITE III of FIG. 8. Table 4 illustrates the complementarity of the nucleotide sequences of KIAA0513 BINDING SITE, designated SEQ ID:931, to the nucleotide sequence of GAM180 RNA, herein designated GAM RNA, also designated SEQ ID:214.

Another function of GAM180 is therefore inhibition of KIAA0513 (Accession NP_055547.1). Accordingly, utilities of GAM180 include diagnosis, prevention and treatment of diseases and clinical conditions associated with KIAA0513.

KIAA0682 (Accession NP_055667.1) is another GAM180 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:12275, to the nucleotide sequence of GAM180 RNA, herein designated GAM RNA, also designated SEQ ID:214.

Another function of GAM180 is therefore inhibition of KIAA0682 (Accession NP_055667.1). Accordingly, utilities of GAM180 include diagnosis, prevention and treatment of diseases and clinical conditions associated with KIAA0682.

KIAA0753 (Accession NP_055619.1) is another GAM180 target gene, herein designated TARGET GENE. KIAA0753 BINDING SITE is a target binding site found in the 3' untranslated region of mRNA encoded by KIAA0753, corresponding to a target binding site such as BINDING SITE I, BINDING SITE II or BINDING SITE III of FIG. 8. Table 4 illustrates the complementarity of the nucleotide sequences of KIAA0753 BINDING SITE, designated SEQ ID:10688, to the nucleotide sequence of GAM180 RNA, herein designated GAM RNA, also designated SEQ ID:214.

Another function of GAM180 is therefore inhibition of KIAA0753 (Accession NP_055619.1). Accordingly, utilities of GAM180 include diagnosis, prevention and treatment of diseases and clinical conditions associated with KIAA0753.

KIAA0935 (Accession XP_052620.6) is another GAM180 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:17230, to the nucleotide sequence of GAM180 RNA, herein designated GAM RNA, also designated SEQ ID:214.

Another function of GAM180 is therefore inhibition of KIAA0935 (Accession XP_052620.6). Accordingly, utilities of GAM180 include diagnosis, prevention and treatment of diseases and clinical conditions associated with KIAA0935.

KIAA1111 (Accession XP_171233.1) is another GAM180 target gene, herein designated TARGET GENE. KIAA1111 BINDING SITE is a target binding site found in the 3' untranslated region of mRNA encoded by KIAA1111, corresponding to a target binding site such as BINDING SITE I, BINDING SITE II or BINDING SITE III of FIG. 8. Table 4 illustrates the complementarity of the nucleotide sequences of KIAA1111 BINDING SITE, designated SEQ ID:15309, to the nucleotide sequence of GAM180 RNA, herein designated GAM RNA, also designated SEQ ID:214.

Another function of GAM180 is therefore inhibition of KIAA1111 (Accession XP_171233.1). Accordingly, utilities of GAM180 include diagnosis, prevention and treatment of diseases and clinical conditions associated with KIAA1111.

KIAA1194 (Accession NP_056270.2) is another GAM180 target gene, herein designated TARGET GENE. KIAA1194 BINDING SITE is a target binding site found in the 3' untranslated region of mRNA encoded by KIAA1194, corresponding to a target binding site such as BINDING SITE I, BINDING SITE II or BINDING SITE III of FIG. 8. Table 4 illustrates the complementarity of the nucleotide sequences of KIAA1194 BINDING SITE, designated SEQ ID:5209, to the nucleotide sequence of GAM180 RNA, herein designated GAM RNA, also designated SEQ ID:214.

Another function of GAM180 is therefore inhibition of KIAA1194 (Accession NP_056270.2). Accordingly, utilities of GAM180 include diagnosis, prevention and treatment of diseases and clinical conditions associated with KIAA1194.

KIAA1268 (Accession XP_291055.1) is another GAM180 target gene, herein designated TARGET GENE. KIAA1268 BINDING SITE is a target binding site found in the 3' untranslated region of mRNA encoded by KIAA1268, corresponding to a target binding site such as BINDING SITE I, BINDING SITE II or BINDING SITE III of FIG. 8. Table 4 illustrates the complementarity of the nucleotide sequences of KIAA1268 BINDING SITE, designated SEQ ID:16742, to the nucleotide sequence of GAM180 RNA, herein designated GAM RNA, also designated SEQ ID:214.

Another function of GAM180 is therefore inhibition of KIAA1268 (Accession XP_291055.1). Accordingly, utilities of GAM180 include diagnosis, prevention and treatment of diseases and clinical conditions associated with KIAA1268.

KIAA1765 (Accession XP_047355.1) is another GAM180 target gene, herein designated TARGET GENE. KIAA1765 BINDING SITE is a target binding site found in the 3' untranslated region of mRNA encoded by KIAA1765, corresponding to a target binding site such as BINDING SITE I, BINDING SITE II or BINDING SITE III of FIG. 8. Table 4 illustrates the complementarity of the nucleotide sequences of KIAA1765 BINDING SITE, designated SEQ ID:15863, to the nucleotide sequence of GAM180 RNA, herein designated GAM RNA, also designated SEQ ID:214.

Another function of GAM180 is therefore inhibition of KIAA1765 (Accession XP_047355.1). Accordingly, utilities of GAM180 include diagnosis, prevention and treatment of diseases and clinical conditions associated with KIAA1765.

KIAA2001 (Accession XP_291322.1) is another GAM180 target gene, herein designated TARGET GENE. KIAA2001 BINDING SITE is a target binding site found in the 3' untranslated region of mRNA encoded by KIAA2001, corresponding to a target binding site such as BINDING SITE I, BINDING SITE II or BINDING SITE III of FIG. 8. Table 4 illustrates the complementarity of the nucleotide sequences of KIAA2001 BINDING SITE, designated SEQ ID:16865, to the nucleotide sequence of GAM180 RNA, herein designated GAM RNA, also designated SEQ ID:214.

Another function of GAM180 is therefore inhibition of KIAA2001 (Accession XP_291322.1). Accordingly, utilities of GAM180 include diagnosis, prevention and treatment of diseases and clinical conditions associated with KIAA2001.

KIAA2024 (Accession NP_742067.1) is another GAM180 target gene, herein designated TARGET GENE.

KIAA2024 BINDING SITE is a target binding site found in the 3' untranslated region of mRNA encoded by KIAA2024, corresponding to a target binding site such as BINDING SITE I, BINDING SITE II or BINDING SITE III of FIG. 8. Table 4 illustrates the complementarity of the nucleotide sequences of KIAA2024 BINDING SITE, designated SEQ ID:9621, to the nucleotide sequence of GAM180 RNA, herein designated GAM RNA, also designated SEQ ID:214.

Another function of GAM180 is therefore inhibition of KIAA2024 (Accession NP_742067.1). Accordingly, utilities of GAM180 include diagnosis, prevention and treatment of diseases and clinical conditions associated with KIAA2024.

Karyopherin (importin) beta 1 (KPNB1, Accession NP_002256.2) is another GAM180 target gene, herein designated TARGET GENE. KPNB1 BINDING SITE is a target binding site found in the 3' untranslated region of mRNA encoded by KPNB1, corresponding to a target binding site such as BINDING SITE I, BINDING SITE II or BINDING SITE III of FIG. 8. Table 4 illustrates the complementarity of the nucleotide sequences of KPNB1 BINDING SITE, designated SEQ ID:15603, to the nucleotide sequence of GAM180 RNA, herein designated GAM RNA, also designated SEQ ID:214.

Another function of GAM180 is therefore inhibition of Karyopherin (importin) beta 1 (KPNB1, Accession NP_002256.2), a gene which is required for nuclear protein import and mediates docking of import substrate to distinct nucleoporins. Accordingly, utilities of GAM180 include diagnosis, prevention and treatment of diseases and clinical conditions associated with KPNB1.

The function of KPNB1 has been established by previous studies. The import of proteins into the nucleus proceeds through the nuclear pore complex. Cytoplasmic proteins with a nuclear localization signal (NLS) bind to an importin-alpha/importin- beta heterodimer. The trimeric complex docks to the cytoplasmic periphery of the nuclear pore complex and is subsequently translocated through as a single entity. The import reaction is terminated by the direct binding of RAN (OMIM Ref. No. 601179) to KPNB, which dissociates the importin heterodimer. Gorlich et al. (1995) purified a 90-kD subunit of importin (importin-90) from Xenopus egg extracts and obtained a 188-amino acid partial protein sequence from internal peptides. Using the partial amino acid sequence, they isolated cDNAs encoding human importin-90, or KPNB1, from a HeLa cell cDNA library. The sequence of the predicted 876-amino acid human KPNB1 protein is 93% identical to the 188-amino acid partial sequence of Xenopus importin-90. Gorlich et al. (1995) showed that Xenopus importin-60 and importin-90 cooperate to form an import receptor that distinguishes functional NLSs from nonfunctional ones and selectively binds import substrates to the nuclear envelope. Independently, Chi et al. (1995) identified cDNAs encoding human KPNB1. Based on the 97-kD product of in vitro translation, they designated the protein p97. Using a monoclonal antibody against bovine p97, Chi et al. (1995) localized p97 to the cytoplasm and nuclear envelope of bovine kidney cells. These authors found that recombinant human p97 binds zinc and that a bound metal ion is required for nuclear envelope-binding activity. Kutay et al. (1997) identified the regions of KPNB1 that interact with RAN, importin-alpha, and the nuclear pore complex. Bayliss et al. (2000) described the crystal structure of a complex between KPNB1 residues 1 to 442 and 5 tandem FxFG nucleoporin repeats from yeast Nsp1. By fluorescence in situ hybridization, Ayala-Madrigal et al. (2000) mapped the KPNB1 gene to chromosome 17q21. By FISH, Matsuda et al. (1996) mapped the mouse Kpnb1 gene to the proximal end of chromosome 11D.

Full details of the abovementioned studies are described in the following publications, the disclosure of which are hereby incorporated by reference:

Ayala-Madrigal, M. L.; Doerr, S.; Ramirez-Duenas, M. L.; Hansmann, I.: Assignment of KPNA4 and KPNB1 encoding karyopherin alpha 4 and beta 1 to human chromosome bands 11q22 and 17q21 respectively, by in situ hybridization. Cytogenet. Cell Genet. 89:258-259, 2000; and Bayliss, R.; Littlewood, T.; Stewart, M.: Structural basis for the interaction between FxFG nucleoporin repeats and importin-beta in nuclear trafficking. Cell 102:99-108, 2000.

Further studies establishing the function and utilities of KPNB1 are found in John Hopkins OMIM database record ID 602738, and in cited publications listed in Table 5, which are hereby incorporated by reference. LOC114987 (Accession NP_660284.1) is another GAM180 target gene, herein designated TARGET GENE. LOC114987 BINDING SITE is a target binding site found in the 3' untranslated region of mRNA encoded by LOC114987, corresponding to a target binding site such as BINDING SITE I, BINDING SITE II or BINDING SITE III of FIG. 8. Table 4 illustrates the complementarity of the nucleotide sequences of LOC114987 BINDING SITE, designated SEQ ID:1173, to the nucleotide sequence of GAM180 RNA, herein designated GAM RNA, also designated SEQ ID:214.

Another function of GAM180 is therefore inhibition of LOC114987 (Accession NP_660284.1). Accordingly, utilities of GAM180 include diagnosis, prevention and treatment of diseases and clinical conditions associated with LOC114987.

LOC116437 (Accession XP_058185.1) is another GAM180 target gene, herein designated TARGET GENE. LOC116437 BINDING SITE is a target binding site found in the 3' untranslated region of mRNA encoded by LOC116437, corresponding to a target binding site such as BINDING SITE I, BINDING SITE II or BINDING SITE III of FIG. 8. Table 4 illustrates the complementarity of the nucleotide sequences of LOC116437 BINDING SITE, designated SEQ ID:1933, to the nucleotide sequence of GAM180 RNA, herein designated GAM RNA, also designated SEQ ID:214.

Another function of GAM180 is therefore inhibition of LOC116437 (Accession XP_058185.1). Accordingly, utilities of GAM180 include diagnosis, prevention and treatment of diseases and clinical conditions associated with LOC116437.

LOC126162 (Accession XP_064964.5) is another GAM180 target gene, herein designated TARGET GENE. LOC126162 BINDING SITE is a target binding site found in the 3' untranslated region of mRNA encoded by LOC126162, corresponding to a target binding site such as BINDING SITE I, BINDING SITE II or BINDING SITE III of FIG. 8. Table 4 illustrates the complementarity of the nucleotide sequences of LOC126162 BINDING SITE, designated SEQ ID:16559, to the nucleotide sequence of GAM180 RNA, herein designated GAM RNA, also designated SEQ ID:214.

Another function of GAM180 is therefore inhibition of LOC126162 (Accession XP_064964.5). Accordingly, utilities of GAM180 include diagnosis, prevention and treatment of diseases and clinical conditions associated with LOC126162.

LOC126767 (Accession XP_060167.4) is another GAM180 target gene, herein designated TARGET GENE. LOC126767 BINDING SITE is a target binding site found in the 5' untranslated region of mRNA encoded by LOC126767, corresponding to a target binding site such as BINDING SITE I, BINDING SITE II or BINDING SITE III of FIG. 8. Table 4 illustrates the complementarity of the nucleotide sequences of LOC126767 BINDING SITE, designated SEQ ID:8959, to the nucleotide sequence of GAM180 RNA, herein designated GAM RNA, also designated SEQ ID:214.

Another function of GAM180 is therefore inhibition of LOC126767 (Accession XP_060167.4). Accordingly, utilities of GAM180 include diagnosis, prevention and treatment of diseases and clinical conditions associated with LOC126767.

LOC129198 (Accession XP_072197.3) is another GAM180 target gene, herein designated TARGET GENE. LOC129198 BINDING SITE is a target binding site found in the 5' untranslated region of mRNA encoded by LOC129198, corresponding to a target binding site such as BINDING SITE I, BINDING SITE II or BINDING SITE III of FIG. 8. Table 4 illustrates the complementarity of the nucleotide sequences of LOC129198 BINDING SITE, designated SEQ ID:13916, to the nucleotide sequence of GAM180 RNA, herein designated GAM RNA, also designated SEQ ID:214.

Another function of GAM180 is therefore inhibition of LOC129198 (Accession XP_072197.3). Accordingly, utilities of GAM180 include diagnosis, prevention and treatment of diseases and clinical conditions associated with LOC129198.

LOC142941 (Accession XP_096363.1) is another GAM180 target gene, herein designated TARGET GENE. LOC142941 BINDING SITE is a target binding site found in the 3' untranslated region of mRNA encoded by LOC142941, corresponding to a target binding site such as BINDING SITE I, BINDING SITE II or BINDING SITE III of FIG. 8. Table 4 illustrates the complementarity of the nucleotide sequences of LOC142941 BINDING SITE, designated SEQ ID:788, to the nucleotide sequence of GAM180 RNA, herein designated GAM RNA, also designated SEQ ID:214.

Another function of GAM180 is therefore inhibition of LOC142941 (Accession XP_096363.1). Accordingly, utilities of GAM180 include diagnosis, prevention and treatment of diseases and clinical conditions associated with LOC142941.

LOC143310 (Accession XP_084485.1) is another GAM180 target gene, herein designated TARGET GENE. LOC143310 BINDING SITE is a target binding site found in the 5' untranslated region of mRNA encoded by LOC143310, corresponding to a target binding site such as BINDING SITE I, BINDING SITE II or BINDING SITE III of FIG. 8. Table 4 illustrates the complementarity of the nucleotide sequences of LOC143310 BINDING SITE, designated SEQ ID:10414, to the nucleotide sequence of GAM180 RNA, herein designated GAM RNA, also designated SEQ ID:214.

Another function of GAM180 is therefore inhibition of LOC143310 (Accession XP_084485.1). Accordingly, utilities of GAM180 include diagnosis, prevention and treatment of diseases and clinical conditions associated with LOC143310.

LOC143916 (Accession XP_084664.1) is another GAM180 target gene, herein designated TARGET GENE. LOC143916 BINDING SITE is a target binding site found in the 5' untranslated region of mRNA encoded by LOC143916, corresponding to a target binding site such as BINDING SITE I, BINDING SITE II or BINDING SITE III of FIG. 8. Table 4 illustrates the complementarity of the nucleotide sequences of LOC143916 BINDING SITE, designated SEQ ID:7055, to the nucleotide sequence of GAM180 RNA, herein designated GAM RNA, also designated SEQ ID:214.

Another function of GAM180 is therefore inhibition of LOC143916 (Accession XP_084664.1). Accordingly, utilities of GAM180 include diagnosis, prevention and treatment of diseases and clinical conditions associated with LOC143916.

LOC144017 (Accession XP_096520.1) is another GAM180 target gene, herein designated TARGET GENE. LOC144017 BINDING SITE is a target binding site found in the 3' untranslated region of mRNA encoded by LOC144017, corresponding to a target binding site such as BINDING SITE I, BINDING SITE II or BINDING SITE III of FIG. 8. Table 4 illustrates the complementarity of the nucleotide sequences of LOC144017 BINDING SITE, designated SEQ ID:2879, to the nucleotide sequence of GAM180 RNA, herein designated GAM RNA, also designated SEQ ID:214.

Another function of GAM180 is therefore inhibition of LOC144017 (Accession XP_096520.1). Accordingly, utilities of GAM180 include diagnosis, prevention and treatment of diseases and clinical conditions associated with LOC144017.

LOC147804 (Accession XP_085901.1) is another GAM180 target gene, herein designated TARGET GENE. LOC147804 BINDING SITE is a target binding site found in the 3' untranslated region of mRNA encoded by LOC147804, corresponding to a target binding site such as BINDING SITE I, BINDING SITE II or BINDING SITE III of FIG. 8. Table 4 illustrates the complementarity of the nucleotide sequences of LOC147804 BINDING SITE, designated SEQ ID:1554, to the nucleotide sequence of GAM180 RNA, herein designated GAM RNA, also designated SEQ ID:214.

Another function of GAM180 is therefore inhibition of LOC147804 (Accession XP_085901.1). Accordingly, utilities of GAM180 include diagnosis, prevention and treatment of diseases and clinical conditions associated with LOC147804.

LOC147975 (Accession XP_097351.2) is another GAM180 target gene, herein designated TARGET GENE. LOC147975 BINDING SITE is a target binding site found in the 5' untranslated region of mRNA encoded by LOC147975, corresponding to a target binding site such as BINDING SITE I, BINDING SITE II or BINDING SITE III of FIG. 8. Table 4 illustrates the complementarity of the nucleotide sequences of LOC147975 BINDING SITE, designated SEQ ID:19458, to the nucleotide sequence of GAM180 RNA, herein designated GAM RNA, also designated SEQ ID:214.

Another function of GAM180 is therefore inhibition of LOC147975 (Accession XP_097351.2). Accordingly, utilities of GAM180 include diagnosis, prevention and treatment of diseases and clinical conditions associated with LOC147975.

LOC148490 (Accession XP_086210.2) is another GAM180 target gene, herein designated TARGET GENE. LOC148490 BINDING SITE is a target binding site found in the 5' untranslated region of mRNA encoded by LOC148490, corresponding to a target binding site such as BINDING SITE I, BINDING SITE II or BINDING SITE III of FIG. 8. Table 4 illustrates the complementarity of the nucleotide sequences of LOC148490 BINDING SITE, designated SEQ ID:16289, to the nucleotide sequence of GAM180 RNA, herein designated GAM RNA, also designated SEQ ID:214.

Another function of GAM180 is therefore inhibition of LOC148490 (Accession XP_086210.2). Accordingly, utilities of GAM180 include diagnosis, prevention and treatment of diseases and clinical conditions associated with LOC148490.

LOC150225 (Accession XP_097870.1) is another GAM180 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:18952, to the nucleotide sequence of GAM180 RNA, herein designated GAM RNA, also designated SEQ ID:214.

Another function of GAM180 is therefore inhibition of LOC150225 (Accession XP_097870.1). Accordingly, utilities of GAM180 include diagnosis, prevention and treatment of diseases and clinical conditions associated with LOC150225.

LOC150776 (Accession XP_032542.1) is another GAM180 target gene, herein designated TARGET GENE. LOC150776 BINDING SITE is a target binding site found in the 3' untranslated region of mRNA encoded by LOC150776, corresponding to a target binding site such as BINDING SITE I, BINDING SITE II or BINDING SITE III of FIG. 8. Table 4 illustrates the complementarity of the nucleotide sequences of LOC150776 BINDING SITE, designated SEQ ID:1321, to the nucleotide sequence of GAM180 RNA, herein designated GAM RNA, also designated SEQ ID:214.

Another function of GAM180 is therefore inhibition of LOC150776 (Accession XP_032542.1). Accordingly, utilities of GAM180 include diagnosis, prevention and treatment of diseases and clinical conditions associated with LOC150776.

LOC151568 (Accession NP_612492.1) is another GAM180 target gene, herein designated TARGET GENE. LOC151568 BINDING SITE1 and LOC151568 BINDING SITE2 are target binding sites found in untranslated regions of mRNA encoded by LOC151568, corresponding to target binding sites such as BINDING SITE I, BINDING SITE II or BINDING SITE III of FIG. 8. Table 4 illustrates the complementarity of the nucleotide sequences of LOC151568 BINDING SITE1 and LOC151568 BINDING SITE2, designated SEQ ID:15467 and SEQ ID:5239 respectively, to the nucleotide sequence of GAM180 RNA, herein designated GAM RNA, also designated SEQ ID:214.

Another function of GAM180 is therefore inhibition of LOC151568 (Accession NP_612492.1). Accordingly, utilities of GAM180 include diagnosis, prevention and treatment of diseases and clinical conditions associated with LOC151568.

LOC152445 (Accession XP_098231.1) is another GAM180 target gene, herein designated TARGET GENE. LOC152445 BINDING SITE is a target binding site found in the 5' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:10081, to the nucleotide sequence of GAM180 RNA, herein designated GAM RNA, also designated SEQ ID:214.

Another function of GAM180 is therefore inhibition of LOC152445 (Accession XP_098231.1). Accordingly, utilities of GAM180 include diagnosis, prevention and treatment of diseases and clinical conditions associated with LOC152445.

LOC162083 (Accession XP_091339.2) is another GAM180 target gene, herein designated TARGET GENE. LOC162083 BINDING SITE is a target binding site found in the 5' untranslated region of mRNA encoded by LOC162083, corresponding to a target binding site such as BINDING SITE I, BINDING SITE II or BINDING SITE III of FIG. 8. Table 4 illustrates the complementarity of the nucleotide sequences of LOC162083 BINDING SITE, designated SEQ ID:9824, to the nucleotide sequence of GAM180 RNA, herein designated GAM RNA, also designated SEQ ID:214.

Another function of GAM180 is therefore inhibition of LOC162083 (Accession XP_091339.2). Accordingly, utilities of GAM180 include diagnosis, prevention and treatment of diseases and clinical conditions associated with LOC162083.

LOC164091 (Accession XP_089356.1) is another GAM180 target gene, herein designated TARGET GENE. LOC164091 BINDING SITE is a target binding site found in the 5' untranslated region of mRNA encoded by LOC164091, corresponding to a target binding site such as BINDING SITE I, BINDING SITE II or BINDING SITE III of FIG. 8. Table 4 illustrates the complementarity of the nucleotide sequences of LOC164091 BINDING SITE, designated SEQ ID:7693, to the nucleotide sequence of GAM180 RNA, herein designated GAM RNA, also designated SEQ ID:214.

Another function of GAM180 is therefore inhibition of LOC164091 (Accession XP_089356.1). Accordingly, utilities of GAM180 include diagnosis, prevention and treatment of diseases and clinical conditions associated with LOC164091.

LOC165257 (Accession XP_092478.3) is another GAM180 target gene, herein designated TARGET GENE. LOC165257 BINDING SITE is a target binding site found in the 3' untranslated region of mRNA encoded by LOC165257, corresponding to a target binding site such as BINDING SITE I, BINDING SITE II or BINDING SITE III of FIG. 8. Table 4 illustrates the complementarity of the nucleotide sequences of LOC165257 BINDING SITE, designated SEQ ID:1432, to the nucleotide sequence of GAM180 RNA, herein designated GAM RNA, also designated SEQ ID:214.

Another function of GAM180 is therefore inhibition of LOC165257 (Accession XP_092478.3). Accordingly, utilities of GAM180 include diagnosis, prevention and treatment of diseases and clinical conditions associated with LOC165257.

LOC200609 (Accession XP_117256.1) is another GAM180 target gene, herein designated TARGET GENE. LOC200609 BINDING SITE is a target binding site found in the 5' untranslated region of mRNA encoded by LOC200609, corresponding to a target binding site such as BINDING SITE I, BINDING SITE II or BINDING SITE III of FIG. 8. Table 4 illustrates the complementarity of the nucleotide sequences of LOC200609 BINDING SITE, designated SEQ ID:1876, to the nucleotide sequence of GAM180 RNA, herein designated GAM RNA, also designated SEQ ID:214.

Another function of GAM180 is therefore inhibition of LOC200609 (Accession XP_117256.1). Accordingly, utilities of GAM180 include diagnosis, prevention and treatment of diseases and clinical conditions associated with LOC200609.

LOC201562 (Accession XP_114343.2) is another GAM180 target gene, herein designated TARGET GENE. LOC201562 BINDING SITE is a target binding site found in the 3' untranslated region of mRNA encoded by LOC201562, corresponding to a target binding site such as BINDING SITE I, BINDING SITE II or BINDING SITE III of FIG. 8. Table 4 illustrates the complementarity of the nucleotide sequences of LOC201562 BINDING SITE, designated SEQ ID:12642, to the nucleotide sequence of GAM180 RNA, herein designated GAM RNA, also designated SEQ ID:214.

Another function of GAM180 is therefore inhibition of LOC201562 (Accession XP_114343.2). Accordingly, utilities of GAM180 include diagnosis, prevention and treatment of diseases and clinical conditions associated with LOC201562.

LOC219918 (Accession XP_166197.1) is another GAM180 target gene, herein designated TARGET GENE. LOC219918 BINDING SITE is a target binding site found in the 5' untranslated region of mRNA encoded by LOC219918, corresponding to a target binding site such as BINDING SITE I, BINDING SITE II or BINDING SITE III of FIG. 8. Table 4 illustrates the complementarity of the nucleotide sequences of LOC219918 BINDING SITE, designated SEQ ID:5660, to the nucleotide sequence of GAM180 RNA, herein designated GAM RNA, also designated SEQ ID:214.

Another function of GAM180 is therefore inhibition of LOC219918 (Accession XP_166197.1). Accordingly, utilities of GAM180 include diagnosis, prevention and treatment of diseases and clinical conditions associated with LOC219918.

LOC220071 (Accession XP_167848.1) is another GAM180 target gene, herein designated TARGET GENE. LOC220071 BINDING SITE is a target binding site found in the 5' untranslated region of mRNA encoded by LOC220071, corresponding to a target binding site such as BINDING SITE I, BINDING SITE II or BINDING SITE III of FIG. 8. Table 4 illustrates the complementarity of the nucleotide sequences of LOC220071 BINDING SITE, designated SEQ ID:5660, to the nucleotide sequence of GAM180 RNA, herein designated GAM RNA, also designated SEQ ID:214.

Another function of GAM180 is therefore inhibition of LOC220071 (Accession XP_167848.1). Accordingly, utilities of GAM180 include diagnosis, prevention and treatment of diseases and clinical conditions associated with LOC220071.

LOC220758 (Accession XP_165466.1) is another GAM180 target gene, herein designated TARGET GENE. LOC220758 BINDING SITE is a target binding site found in the 5' untranslated region of mRNA encoded by LOC220758, corresponding to a target binding site such as BINDING SITE I, BINDING SITE II or BINDING SITE III of FIG. 8. Table 4 illustrates the complementarity of the nucleotide sequences of LOC220758 BINDING SITE, designated SEQ ID:1949, to the nucleotide sequence of GAM180 RNA, herein designated GAM RNA, also designated SEQ ID:214.

Another function of GAM180 is therefore inhibition of LOC220758 (Accession XP_165466.1). Accordingly, utilities of GAM180 include diagnosis, prevention and treatment of diseases and clinical conditions associated with LOC220758.

LOC220763 (Accession XP_055551.1) is another GAM180 target gene, herein designated TARGET GENE. LOC220763 BINDING SITE is a target binding site found in the 5' untranslated region of mRNA encoded by LOC220763, corresponding to a target binding site such as BINDING SITE I, BINDING SITE II or BINDING SITE III of FIG. 8. Table 4 illustrates the complementarity of the nucleotide sequences of LOC220763 BINDING SITE, designated SEQ ID:5457, to the nucleotide sequence of GAM180 RNA, herein designated GAM RNA, also designated SEQ ID:214.

Another function of GAM180 is therefore inhibition of LOC220763 (Accession XP_055551.1). Accordingly, utilities of GAM180 include diagnosis, prevention and treatment of diseases and clinical conditions associated with LOC220763.

LOC221584 (Accession XP_168132.1) is another GAM180 target gene, herein designated TARGET GENE. LOC221584 BINDING SITE is a target binding site found in the 5' untranslated region of mRNA encoded by LOC221584, corresponding to a target binding site such as BINDING SITE I, BINDING SITE II or BINDING SITE III of FIG. 8. Table 4 illustrates the complementarity of the nucleotide sequences of LOC221584 BINDING SITE, designated SEQ ID:13096, to the nucleotide sequence of GAM180 RNA, herein designated GAM RNA, also designated SEQ ID:214.

Another function of GAM180 is therefore inhibition of LOC221584 (Accession XP_168132.1). Accordingly, utilities of GAM180 include diagnosis, prevention and treatment of diseases and clinical conditions associated with LOC221584.

LOC253044 (Accession XP_172924.2) is another GAM180 target gene, herein designated TARGET GENE. LOC253044 BINDING SITE is a target binding site found in the 5' untranslated region of mRNA encoded by LOC253044, corresponding to a target binding site such as BINDING SITE I, BINDING SITE II or BINDING SITE III of FIG. 8. Table 4 illustrates the complementarity of the nucleotide sequences of LOC253044 BINDING SITE, designated SEQ ID:11944, to the nucleotide sequence of GAM180 RNA, herein designated GAM RNA, also designated SEQ ID:214.

Another function of GAM180 is therefore inhibition of LOC253044 (Accession XP_172924.2). Accordingly, utilities of GAM180 include diagnosis, prevention and treatment of diseases and clinical conditions associated with LOC253044.

LOC253263 (Accession XP_173102.1) is another GAM180 target gene, herein designated TARGET GENE. LOC253263 BINDING SITE is a target binding site found in the 3' untranslated region of mRNA encoded by LOC253263, corresponding to a target binding site such as BINDING SITE I, BINDING SITE II or BINDING SITE III of FIG. 8. Table 4 illustrates the complementarity of the nucleotide sequences of LOC253263 BINDING SITE, designated SEQ ID:12769, to the nucleotide sequence of GAM180 RNA, herein designated GAM RNA, also designated SEQ ID:214.

Another function of GAM180 is therefore inhibition of LOC253263 (Accession XP_173102.1). Accordingly, utilities of GAM180 include diagnosis, prevention and treatment of diseases and clinical conditions associated with LOC253263.

LOC283038 (Accession XP_302599.1) is another GAM180 target gene, herein designated TARGET GENE. LOC283038 BINDING SITE is a target binding site found in the 5' untranslated region of mRNA encoded by LOC283038, corresponding to a target binding site such as BINDING SITE I, BINDING SITE II or BINDING SITE III of FIG. 8. Table 4 illustrates the complementarity of the nucleotide sequences of LOC283038 BINDING SITE, designated SEQ ID:4836, to the nucleotide sequence of GAM180 RNA, herein designated GAM RNA, also designated SEQ ID:214.

Another function of GAM180 is therefore inhibition of LOC283038 (Accession XP_302599.1). Accordingly, utilities of GAM180 include diagnosis, prevention and treatment of diseases and clinical conditions associated with LOC283038.

LOC283087 (Accession XP_208509.1) is another GAM180 target gene, herein designated TARGET GENE. LOC283087 BINDING SITE is a target binding site found in the 3' untranslated region of mRNA encoded by LOC283087, corresponding to a target binding site such as BINDING SITE I, BINDING SITE II or BINDING SITE III of FIG. 8. Table 4 illustrates the complementarity of the nucleotide sequences of LOC283087 BINDING SITE, designated SEQ ID:7112, to the nucleotide sequence of GAM180 RNA, herein designated GAM RNA, also designated SEQ ID:214.

Another function of GAM180 is therefore inhibition of LOC283087 (Accession XP_208509.1). Accordingly, utilities of GAM180 include diagnosis, prevention and treatment of diseases and clinical conditions associated with LOC283087.

LOC283140 (Accession XP_210911.1) is another GAM180 target gene, herein designated TARGET GENE. LOC283140 BINDING SITE is a target binding site found in the 3' untranslated region of mRNA encoded by LOC283140, corresponding to a target binding site such as BINDING SITE I, BINDING SITE II or BINDING SITE III of FIG. 8. Table 4 illustrates the complementarity of the nucleotide sequences of LOC283140 BINDING SITE, designated SEQ ID:11320, to the nucleotide sequence of GAM180 RNA, herein designated GAM RNA, also designated SEQ ID:214.

Another function of GAM180 is therefore inhibition of LOC283140 (Accession XP_210911.1). Accordingly, utilities of GAM180 include diagnosis, prevention and treatment of diseases and clinical conditions associated with LOC283140.

LOC283298 (Accession XP_208606.1) is another GAM180 target gene, herein designated TARGET GENE. LOC283298 BINDING SITE is a target binding site found in the 5' untranslated region of mRNA encoded by LOC283298, corresponding to a target binding site such as BINDING SITE I, BINDING SITE II or BINDING SITE III of FIG. 8. Table 4 illustrates the complementarity of the nucleotide sequences of LOC283298 BINDING SITE, designated SEQ ID:11643, to the nucleotide sequence of GAM180 RNA, herein designated GAM RNA, also designated SEQ ID:214.

Another function of GAM180 is therefore inhibition of LOC283298 (Accession XP_208606.1). Accordingly, utilities of GAM180 include diagnosis, prevention and treatment of diseases and clinical conditions associated with LOC283298.

LOC283337 (Accession XP_300560.1) is another GAM180 target gene, herein designated TARGET GENE. LOC283337 BINDING SITE is a target binding site found in the 3' untranslated region of mRNA encoded by LOC283337, corresponding to a target binding site such as BINDING SITE I, BINDING SITE II or BINDING SITE III of FIG. 8. Table 4 illustrates the complementarity of the nucleotide sequences of LOC283337 BINDING SITE, designated SEQ ID:8912, to the nucleotide sequence of GAM180 RNA, herein designated GAM RNA, also designated SEQ ID:214.

Another function of GAM180 is therefore inhibition of LOC283337 (Accession XP_300560.1). Accordingly, utilities of GAM180 include diagnosis, prevention and treatment of diseases and clinical conditions associated with LOC283337.

LOC283570 (Accession XP_211118.1) is another GAM180 target gene, herein designated TARGET GENE. LOC283570 BINDING SITE is a target binding site found in the 3' untranslated region of mRNA encoded by LOC283570, corresponding to a target binding site such as BINDING SITE I, BINDING SITE II or BINDING SITE III of FIG. 8. Table 4 illustrates the complementarity of the nucleotide sequences of LOC283570 BINDING SITE, designated SEQ ID:12808, to the nucleotide sequence of GAM180 RNA, herein designated GAM RNA, also designated SEQ ID:214.

Another function of GAM180 is therefore inhibition of LOC283570 (Accession XP_211118.1). Accordingly, utilities of GAM180 include diagnosis, prevention and treatment of diseases and clinical conditions associated with LOC283570.

LOC283574 (Accession XP_211099.1) is another GAM180 target gene, herein designated TARGET GENE. LOC283574 BINDING SITE is a target binding site found in the 5' untranslated region of mRNA encoded by LOC283574, corresponding to a target binding site such as BINDING SITE I, BINDING SITE II or BINDING SITE III of FIG. 8. Table 4 illustrates the complementarity of the nucleotide sequences of LOC283574 BINDING SITE, designated SEQ ID:1593, to the nucleotide sequence of GAM180 RNA, herein designated GAM RNA, also designated SEQ ID:214.

Another function of GAM180 is therefore inhibition of LOC283574 (Accession XP_211099.1). Accordingly, utilities of GAM180 include diagnosis, prevention and treatment of diseases and clinical conditions associated with LOC283574.

LOC283810 (Accession XP_208853.1) is another GAM180 target gene, herein designated TARGET GENE. LOC283810 BINDING SITE is a target binding site found in the 3' untranslated region of mRNA encoded by LOC283810, corresponding to a target binding site such as BINDING SITE I, BINDING SITE II or BINDING SITE III of FIG. 8. Table 4 illustrates the complementarity of the nucleotide sequences of LOC283810 BINDING SITE, designated SEQ ID:3590, to the nucleotide sequence of GAM180 RNA, herein designated GAM RNA, also designated SEQ ID:214.

Another function of GAM180 is therefore inhibition of LOC283810 (Accession XP_208853.1). Accordingly, utilities of GAM180 include diagnosis, prevention and treatment of diseases and clinical conditions associated with LOC283810.

LOC283831 (Accession XP_211224.1) is another GAM180 target gene, herein designated TARGET GENE. LOC283831 BINDING SITE is a target binding site found in the 5' untranslated region of mRNA encoded by LOC283831, corresponding to a target binding site such as BINDING SITE I, BINDING SITE II or BINDING SITE III of FIG. 8. Table 4 illustrates the complementarity of the nucleotide sequences of LOC283831 BINDING SITE, designated SEQ ID:4669, to the nucleotide sequence of GAM180 RNA, herein designated GAM RNA, also designated SEQ ID:214.

Another function of GAM180 is therefore inhibition of LOC283831 (Accession XP_211224.1). Accordingly, utilities of GAM180 include diagnosis, prevention and treatment of diseases and clinical conditions associated with LOC283831.

LOC283911 (Accession XP_211259.2) is another GAM180 target gene, herein designated TARGET GENE. LOC283911 BINDING SITE is a target binding site found in the 5' untranslated region of mRNA encoded by LOC283911, corresponding to a target binding site such as BINDING SITE I, BINDING SITE II or BINDING SITE III of FIG. 8. Table 4 illustrates the complementarity of the nucleotide sequences of LOC283911 BINDING SITE, designated SEQ ID:11417, to the nucleotide sequence of GAM180 RNA, herein designated GAM RNA, also designated SEQ ID:214.

Another function of GAM180 is therefore inhibition of LOC283911 (Accession XP_211259.2). Accordingly, utilities of GAM180 include diagnosis, prevention and treatment of diseases and clinical conditions associated with LOC283911.

LOC283922 (Accession XP_208908.1) is another GAM180 target gene, herein designated TARGET GENE. LOC283922 BINDING SITE is a target binding site found in the 5' untranslated region of mRNA encoded by LOC283922, corresponding to a target binding site such as BINDING SITE I, BINDING SITE II or BINDING SITE III of FIG. 8. Table 4 illustrates the complementarity of the nucleotide sequences of LOC283922 BINDING SITE, designated SEQ ID:15803, to the nucleotide sequence of GAM180 RNA, herein designated GAM RNA, also designated SEQ ID:214.

Another function of GAM180 is therefore inhibition of LOC283922 (Accession XP_208908.1). Accordingly, utilities of GAM180 include diagnosis, prevention and treatment of diseases and clinical conditions associated with LOC283922.

LOC283929 (Accession XP_208905.2) is another GAM180 target gene, herein designated TARGET GENE. LOC283929 BINDING SITE is a target binding site found in the 5' untranslated region of mRNA encoded by LOC283929, corresponding to a target binding site such as BINDING SITE I, BINDING SITE II or BINDING SITE III of FIG. 8. Table 4 illustrates the complementarity of the nucleotide sequences of LOC283929 BINDING SITE, designated SEQ ID:10481, to the nucleotide sequence of GAM180 RNA, herein designated GAM RNA, also designated SEQ ID:214.

Another function of GAM180 is therefore inhibition of LOC283929 (Accession XP_208905.2). Accordingly, utilities of GAM180 include diagnosis, prevention and treatment of diseases and clinical conditions associated with LOC283929.

LOC283982 (Accession XP_208954.1) is another GAM180 target gene, herein designated TARGET GENE. LOC283982 BINDING SITE is a target binding site found in the 3' untranslated region of mRNA encoded by LOC283982, corresponding to a target binding site such as BINDING SITE I, BINDING SITE II or BINDING SITE III of FIG. 8. Table 4 illustrates the complementarity of the nucleotide sequences of LOC283982 BINDING SITE, designated SEQ ID:6204, to the nucleotide sequence of GAM180 RNA, herein designated GAM RNA, also designated SEQ ID:214.

Another function of GAM180 is therefore inhibition of LOC283982 (Accession XP_208954.1). Accordingly, utilities of GAM180 include diagnosis, prevention and treatment of diseases and clinical conditions associated with LOC283982.

LOC284045 (Accession XP_210776.1) is another GAM180 target gene, herein designated TARGET GENE. LOC284045 BINDING SITE is a target binding site found in the 5' untranslated region of mRNA encoded by LOC284045, corresponding to a target binding site such as BINDING SITE I, BINDING SITE II or BINDING SITE III of FIG. 8. Table 4 illustrates the complementarity of the nucleotide sequences of LOC284045 BINDING SITE, designated SEQ ID:15106, to the nucleotide sequence of GAM180 RNA, herein designated GAM RNA, also designated SEQ ID:214.

Another function of GAM180 is therefore inhibition of LOC284045 (Accession XP_210776.1). Accordingly, utilities of GAM180 include diagnosis, prevention and treatment of diseases and clinical conditions associated with LOC284045.

LOC284220 (Accession XP_211391.1) is another GAM180 target gene, herein designated TARGET GENE. LOC284220 BINDING SITE is a target binding site found in the 3' untranslated region of mRNA encoded by LOC284220, corresponding to a target binding site such as BINDING SITE I, BINDING SITE II or BINDING SITE III of FIG. 8. Table 4 illustrates the complementarity of the nucleotide sequences of LOC284220 BINDING SITE, designated SEQ ID:16999, to the nucleotide sequence of GAM180 RNA, herein designated GAM RNA, also designated SEQ ID:214.

Another function of GAM180 is therefore inhibition of LOC284220 (Accession XP_211391.1). Accordingly, utilities of GAM180 include diagnosis, prevention and treatment of diseases and clinical conditions associated with LOC284220.

LOC284360 (Accession XP_211433.1) is another GAM180 target gene, herein designated TARGET GENE. LOC284360 BINDING SITE is a target binding site found in the 5' untranslated region of mRNA encoded by LOC284360, corresponding to a target binding site such as BINDING SITE I, BINDING SITE II or BINDING SITE III of FIG. 8. Table 4 illustrates the complementarity of the nucleotide sequences of LOC284360 BINDING SITE, designated SEQ ID:1154, to the nucleotide sequence of GAM180 RNA, herein designated GAM RNA, also designated SEQ ID:214.

Another function of GAM180 is therefore inhibition of LOC284360 (Accession XP_211433.1). Accordingly, utilities of GAM180 include diagnosis, prevention and treatment of diseases and clinical conditions associated with LOC284360.

LOC284549 (Accession XP_211514.1) is another GAM180 target gene, herein designated TARGET GENE. LOC284549 BINDING SITE is a target binding site found in the 3' untranslated region of mRNA encoded by LOC284549, corresponding to a target binding site such as BINDING SITE I, BINDING SITE II or BINDING SITE III of FIG. 8. Table 4 illustrates the complementarity of the nucleotide sequences of LOC284549 BINDING SITE, designated SEQ ID:2382, to the nucleotide sequence of GAM180 RNA, herein designated GAM RNA, also designated SEQ ID:214.

Another function of GAM180 is therefore inhibition of LOC284549 (Accession XP_211514.1). Accordingly, utilities of GAM180 include diagnosis, prevention and treatment of diseases and clinical conditions associated with LOC284549.

LOC284585 (Accession XP_209277.2) is another GAM180 target gene, herein designated TARGET GENE. LOC284585 BINDING SITE is a target binding site found in the 5' untranslated region of mRNA encoded by LOC284585, corresponding to a target binding site such as BINDING SITE I, BINDING SITE II or BINDING SITE III of FIG. 8. Table 4 illustrates the complementarity of the nucleotide sequences of LOC284585 BINDING SITE, designated SEQ ID:1916, to the nucleotide sequence of GAM180 RNA, herein designated GAM RNA, also designated SEQ ID:214.

Another function of GAM180 is therefore inhibition of LOC284585 (Accession XP_209277.2). Accordingly, utilities of GAM180 include diagnosis, prevention and treatment of diseases and clinical conditions associated with LOC284585.

LOC284773 (Accession XP_209353.1) is another GAM180 target gene, herein designated TARGET GENE. LOC284773 BINDING SITE is a target binding site found in the 3' untranslated region of mRNA encoded by LOC284773, corresponding to a target binding site such as BINDING SITE I, BINDING SITE II or BINDING SITE III of FIG. 8. Table 4 illustrates the complementarity of the nucleotide sequences of LOC284773 BINDING SITE, designated SEQ ID:16000, to the nucleotide sequence of GAM180 RNA, herein designated GAM RNA, also designated SEQ ID:214.

Another function of GAM180 is therefore inhibition of LOC284773 (Accession XP_209353.1). Accordingly, utilities of GAM180 include diagnosis, prevention and treatment of diseases and clinical conditions associated with LOC284773.

LOC284947 (Accession XP_211705.1) is another GAM180 target gene, herein designated TARGET GENE. LOC284947 BINDING SITE is a target binding site found in the 3' untranslated region of mRNA encoded by LOC284947, corresponding to a target binding site such as BINDING SITE I, BINDING SITE II or BINDING SITE III of FIG. 8. Table 4 illustrates the complementarity of the nucleotide sequences of LOC284947 BINDING SITE, designated SEQ ID:11231, to the nucleotide sequence of GAM180 RNA, herein designated GAM RNA, also designated SEQ ID:214.

Another function of GAM180 is therefore inhibition of LOC284947 (Accession XP_211705.1). Accordingly, utilities of GAM180 include diagnosis, prevention and treatment of diseases and clinical conditions associated with LOC284947.

LOC285026 (Accession XP_209440.1) is another GAM180 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:6831, to the nucleotide sequence of GAM180 RNA, herein designated GAM RNA, also designated SEQ ID:214.

Another function of GAM180 is therefore inhibition of LOC285026 (Accession XP_209440.1). Accordingly, utilities of GAM180 include diagnosis, prevention and treatment of diseases and clinical conditions associated with LOC285026.

LOC285029 (Accession XP_211741.1) is another GAM180 target gene, herein designated TARGET GENE. LOC285029 BINDING SITE is a target binding site found in the 5' untranslated region of mRNA encoded by LOC285029, corresponding to a target binding site such as BINDING SITE I, BINDING SITE II or BINDING SITE III of FIG. 8. Table 4 illustrates the complementarity of the nucleotide sequences of LOC285029 BINDING SITE, designated SEQ ID:12677, to the nucleotide sequence of GAM180 RNA, herein designated GAM RNA, also designated SEQ ID:214.

Another function of GAM180 is therefore inhibition of LOC285029 (Accession XP_211741.1). Accordingly, utilities of GAM180 include diagnosis, prevention and treatment of diseases and clinical conditions associated with LOC285029.

LOC285056 (Accession XP_208283.1) is another GAM180 target gene, herein designated TARGET GENE. LOC285056 BINDING SITE is a target binding site found in the 5' untranslated region of mRNA encoded by LOC285056, corresponding to a target binding site such as BINDING SITE I, BINDING SITE II or BINDING SITE III of FIG. 8. Table 4 illustrates the complementarity of the nucleotide sequences of LOC285056 BINDING SITE, designated SEQ ID:10528, to the nucleotide sequence of GAM180 RNA, herein designated GAM RNA, also designated SEQ ID:214.

Another function of GAM180 is therefore inhibition of LOC285056 (Accession XP_208283.1). Accordingly, utilities of GAM180 include diagnosis, prevention and treatment of diseases and clinical conditions associated with LOC285056.

LOC285286 (Accession XP_211834.1) is another GAM180 target gene, herein designated TARGET GENE. LOC285286 BINDING SITE is a target binding site found in the 3' untranslated region of mRNA encoded by LOC285286, corresponding to a target binding site such as BINDING SITE I, BINDING SITE II or BINDING SITE III of FIG. 8. Table 4 illustrates the complementarity of the nucleotide sequences of LOC285286 BINDING SITE, designated SEQ ID:555, to the nucleotide sequence of GAM180 RNA, herein designated GAM RNA, also designated SEQ ID:214.

Another function of GAM180 is therefore inhibition of LOC285286 (Accession XP_211834.1). Accordingly, utilities of GAM180 include diagnosis, prevention and treatment of diseases and clinical conditions associated with LOC285286.

LOC285376 (Accession XP_211864.1) is another GAM180 target gene, herein designated TARGET GENE. LOC285376 BINDING SITE1 and LOC285376 BINDING SITE2 are target binding sites found in untranslated regions of mRNA encoded by LOC285376, corresponding to target binding sites such as BINDING SITE I, BINDING SITE II or BINDING SITE III of FIG. 8. Table 4 illustrates the complementarity of the nucleotide sequences of LOC285376 BINDING SITE1 and LOC285376 BINDING SITE2, designated SEQ ID:15389 and SEQ ID:1613 respectively, to the nucleotide sequence of GAM180 RNA, herein designated GAM RNA, also designated SEQ ID:214.

Another function of GAM180 is therefore inhibition of LOC285376 (Accession XP_211864.1). Accordingly, utilities of GAM180 include diagnosis, prevention and treatment of diseases and clinical conditions associated with LOC285376.

LOC285786 (Accession XP_208349.1) is another GAM180 target gene, herein designated TARGET GENE. LOC285786 BINDING SITE is a target binding site found in the 3' untranslated region of mRNA encoded by LOC285786, corresponding to a target binding site such as BINDING SITE I, BINDING SITE II or BINDING SITE III of FIG. 8. Table 4 illustrates the complementarity of the nucleotide sequences of LOC285786 BINDING SITE, designated SEQ ID:7150, to the nucleotide sequence of GAM180 RNA, herein designated GAM RNA, also designated SEQ ID:214.

Another function of GAM180 is therefore inhibition of LOC285786 (Accession XP_208349.1). Accordingly, utilities of GAM180 include diagnosis, prevention and treatment of diseases and clinical conditions associated with LOC285786.

LOC285999 (Accession XP_212120.1) is another GAM180 target gene, herein designated TARGET GENE. LOC285999 BINDING SITE is a target binding site found in the 3' untranslated region of mRNA encoded by LOC285999, corresponding to a target binding site such as BINDING SITE I, BINDING SITE II or BINDING SITE III of FIG. 8. Table 4 illustrates the complementarity of the nucleotide sequences of LOC285999 BINDING SITE, designated SEQ ID:8264, to the nucleotide sequence of GAM180 RNA, herein designated GAM RNA, also designated SEQ ID:214.

Another function of GAM180 is therefore inhibition of LOC285999 (Accession XP_212120.1). Accordingly, utilities of GAM180 include diagnosis, prevention and treatment of diseases and clinical conditions associated with LOC285999.

LOC338708 (Accession XP_294683.1) is another GAM180 target gene, herein designated TARGET GENE. LOC338708 BINDING SITE is a target binding site found in the 3' untranslated region of mRNA encoded by LOC338708, corresponding to a target binding site such as BINDING SITE I, BINDING SITE II or BINDING SITE III of FIG. 8. Table 4 illustrates the complementarity of the nucleotide sequences of LOC338708 BINDING SITE, designated SEQ ID:17540, to the nucleotide sequence of GAM180 RNA, herein designated GAM RNA, also designated SEQ ID:214.

Another function of GAM180 is therefore inhibition of LOC338708 (Accession XP_294683.1). Accordingly, utilities of GAM180 include diagnosis, prevention and treatment of diseases and clinical conditions associated with LOC338708.

LOC338987 (Accession XP_290664.1) is another GAM180 target gene, herein designated TARGET GENE. LOC338987 BINDING SITE is a target binding site found in the 3' untranslated region of mRNA encoded by LOC338987, corresponding to a target binding site such as BINDING SITE I, BINDING SITE II or BINDING SITE III of FIG. 8. Table 4 illustrates the complementarity of the nucleotide sequences of LOC338987 BINDING SITE, designated SEQ ID:5719, to the nucleotide sequence of GAM180 RNA, herein designated GAM RNA, also designated SEQ ID:214.

Another function of GAM180 is therefore inhibition of LOC338987 (Accession XP_290664.1). Accordingly, utilities of GAM180 include diagnosis, prevention and treatment of diseases and clinical conditions associated with LOC338987.

LOC339186 (Accession XP_294845.1) is another GAM180 target gene, herein designated TARGET GENE. LOC339186 BINDING SITE is a target binding site found in the 5' untranslated region of mRNA encoded by LOC339186, corresponding to a target binding site such as BINDING SITE I, BINDING SITE II or BINDING SITE III of FIG. 8. Table 4 illustrates the complementarity of the nucleotide sequences of LOC339186 BINDING SITE, designated SEQ ID:11297, to the nucleotide sequence of GAM180 RNA, herein designated GAM RNA, also designated SEQ ID:214.

Another function of GAM180 is therefore inhibition of LOC339186 (Accession XP_294845.1). Accordingly, utilities of GAM180 include diagnosis, prevention and treatment of diseases and clinical conditions associated with LOC339186.

LOC339240 (Accession XP_294880.1) is another GAM180 target gene, herein designated TARGET GENE. LOC339240 BINDING SITE is a target binding site found in the 5' untranslated region of mRNA encoded by LOC339240, corresponding to a target binding site such as BINDING SITE I, BINDING SITE II or BINDING SITE III of FIG. 8. Table 4 illustrates the complementarity of the nucleotide sequences of LOC339240 BINDING SITE, designated SEQ ID:11297, to the nucleotide sequence of GAM180 RNA, herein designated GAM RNA, also designated SEQ ID:214.

Another function of GAM180 is therefore inhibition of LOC339240 (Accession XP_294880.1). Accordingly, utilities of GAM180 include diagnosis, prevention and treatment of diseases and clinical conditions associated with LOC339240.

LOC339258 (Accession XP_294886.1) is another GAM180 target gene, herein designated TARGET GENE. LOC339258 BINDING SITE is a target binding site found in the 5' untranslated region of mRNA encoded by LOC339258, corresponding to a target binding site such as BINDING SITE I, BINDING SITE II or BINDING SITE III of FIG. 8. Table 4 illustrates the complementarity of the nucleotide sequences of LOC339258 BINDING SITE, designated SEQ ID:11297, to the nucleotide sequence of GAM180 RNA, herein designated GAM RNA, also designated SEQ ID:214.

Another function of GAM180 is therefore inhibition of LOC339258 (Accession XP_294886.1). Accordingly, utilities of GAM180 include diagnosis, prevention and treatment of diseases and clinical conditions associated with LOC339258.

LOC339751 (Accession XP_295053.1) is another GAM180 target gene, herein designated TARGET GENE. LOC339751 BINDING SITE is a target binding site found in the 3' untranslated region of mRNA encoded by LOC339751, corresponding to a target binding site such as BINDING SITE I, BINDING SITE II or BINDING SITE III of FIG. 8. Table 4 illustrates the complementarity of the nucleotide sequences of LOC339751 BINDING SITE, designated SEQ ID:9131, to the nucleotide sequence of GAM180 RNA, herein designated GAM RNA, also designated SEQ ID:214.

Another function of GAM180 is therefore inhibition of LOC339751 (Accession XP_295053.1). Accordingly, utilities of GAM180 include diagnosis, prevention and treatment of diseases and clinical conditions associated with LOC339751.

LOC339899 (Accession XP_295096.1) is another GAM180 target gene, herein designated TARGET GENE. LOC339899 BINDING SITE is a target binding site found in the 3' untranslated region of mRNA encoded by LOC339899, corresponding to a target binding site such as BINDING SITE I, BINDING SITE II or BINDING SITE III of FIG. 8. Table 4 illustrates the complementarity of the nucleotide sequences of LOC339899 BINDING SITE, designated SEQ ID:2376, to the nucleotide sequence of GAM180 RNA, herein designated GAM RNA, also designated SEQ ID:214.

Another function of GAM180 is therefore inhibition of LOC339899 (Accession XP_295096.1). Accordingly, utilities of GAM180 include diagnosis, prevention and treatment of diseases and clinical conditions associated with LOC339899.

LOC340090 (Accession XP_295154.1) is another GAM180 target gene, herein designated TARGET GENE. LOC340090 BINDING SITE is a target binding site found in the 5' untranslated region of mRNA encoded by LOC340090, corresponding to a target binding site such as BINDING SITE I, BINDING SITE II or BINDING SITE III of FIG. 8. Table 4 illustrates the complementarity of the nucleotide sequences of LOC340090 BINDING SITE, designated SEQ ID:13639, to the nucleotide sequence of GAM180 RNA, herein designated GAM RNA, also designated SEQ ID:214.

Another function of GAM180 is therefore inhibition of LOC340090 (Accession XP_295154.1). Accordingly, utilities of GAM180 include diagnosis, prevention and treatment of diseases and clinical conditions associated with LOC340090.

LOC342346 (Accession XP_296817.2) is another GAM180 target gene, herein designated TARGET GENE. LOC342346 BINDING SITE is a target binding site found in the 5' untranslated region of mRNA encoded by LOC342346, corresponding to a target binding site such as BINDING SITE I, BINDING SITE II or BINDING SITE III of FIG. 8. Table 4 illustrates the complementarity of the nucleotide sequences of LOC342346 BINDING SITE, designated SEQ ID:11373, to the nucleotide sequence of GAM180 RNA, herein designated GAM RNA, also designated SEQ ID:214.

Another function of GAM180 is therefore inhibition of LOC342346 (Accession XP_296817.2). Accordingly, utilities of GAM180 include diagnosis, prevention and treatment of diseases and clinical conditions associated with LOC342346.

LOC347546 (Accession XP_298101.2) is another GAM180 target gene, herein designated TARGET GENE. LOC347546 BINDING SITE is a target binding site found in the 5' untranslated region of mRNA encoded by LOC347546, corresponding to a target binding site such as BINDING SITE I, BINDING SITE II or BINDING SITE III of FIG. 8. Table 4 illustrates the complementarity of the nucleotide sequences of LOC347546 BINDING SITE, designated SEQ ID:3508, to the nucleotide sequence of GAM180 RNA, herein designated GAM RNA, also designated SEQ ID:214.

Another function of GAM180 is therefore inhibition of LOC347546 (Accession XP_298101.2). Accordingly, utilities of GAM180 include diagnosis, prevention and treatment of diseases and clinical conditions associated with LOC347546.

LOC347648 (Accession XP_300226.1) is another GAM180 target gene, herein designated TARGET GENE. LOC347648 BINDING SITE is a target binding site found in the 3' untranslated region of mRNA encoded by LOC347648, corresponding to a target binding site such as BINDING SITE I, BINDING SITE II or BINDING SITE III of FIG. 8. Table 4 illustrates the complementarity of the nucleotide sequences of LOC347648 BINDING SITE, designated SEQ ID:2916, to the nucleotide sequence of GAM180 RNA, herein designated GAM RNA, also designated SEQ ID:214.

Another function of GAM180 is therefore inhibition of LOC347648 (Accession XP_300226.1). Accordingly, utilities of GAM180 include diagnosis, prevention and treatment of diseases and clinical conditions associated with LOC347648.

LOC347884 (Accession XP_302617.1) is another GAM180 target gene, herein designated TARGET GENE. LOC347884 BINDING SITE is a target binding site found in the 3' untranslated region of mRNA encoded by LOC347884, corresponding to a target binding site such as BINDING SITE I, BINDING SITE II or BINDING SITE III of FIG. 8. Table 4 illustrates the complementarity of the nucleotide sequences of LOC347884 BINDING SITE, designated SEQ ID:5296, to the nucleotide sequence of GAM180 RNA, herein designated GAM RNA, also designated SEQ ID:214.

Another function of GAM180 is therefore inhibition of LOC347884 (Accession XP_302617.1). Accordingly, utilities of GAM180 include diagnosis, prevention and treatment of diseases and clinical conditions associated with LOC347884.

LOC348112 (Accession XP_302657.1) is another GAM180 target gene, herein designated TARGET GENE. LOC348112 BINDING SITE is a target binding site found in the 3' untranslated region of mRNA encoded by LOC348112, corresponding to a target binding site such as BINDING SITE I, BINDING SITE II or BINDING SITE III of FIG. 8. Table 4 illustrates the complementarity of the nucleotide sequences of LOC348112 BINDING SITE, designated SEQ ID:14248, to the nucleotide sequence of GAM180 RNA, herein designated GAM RNA, also designated SEQ ID:214.

Another function of GAM180 is therefore inhibition of LOC348112 (Accession XP_302657.1). Accordingly, utilities of GAM180 include diagnosis, prevention and treatment of diseases and clinical conditions associated with LOC348112.

LOC348452 (Accession XP_300742.1) is another GAM180 target gene, herein designated TARGET GENE. LOC348452 BINDING SITE is a target binding site found in the 5' untranslated region of mRNA encoded by LOC348452, corresponding to a target binding site such as BINDING SITE I, BINDING SITE II or BINDING SITE III of FIG. 8. Table 4 illustrates the complementarity of the nucleotide sequences of LOC348452 BINDING SITE, designated SEQ ID:1711, to the nucleotide sequence of GAM180 RNA, herein designated GAM RNA, also designated SEQ ID:214.

Another function of GAM180 is therefore inhibition of LOC348452 (Accession XP_300742.1). Accordingly, utilities of GAM180 include diagnosis, prevention and treatment of diseases and clinical conditions associated with LOC348452.

LOC349094 (Accession XP_300945.1) is another GAM180 target gene, herein designated TARGET GENE. LOC349094 BINDING SITE is a target binding site found in the 5' untranslated region of mRNA encoded by LOC349094, corresponding to a target binding site such as BINDING SITE I, BINDING SITE II or BINDING SITE III of FIG. 8. Table 4 illustrates the complementarity of the nucleotide sequences of LOC349094 BINDING SITE, designated SEQ ID:7090, to the nucleotide sequence of GAM180 RNA, herein designated GAM RNA, also designated SEQ ID:214.

Another function of GAM180 is therefore inhibition of LOC349094 (Accession XP_300945.1). Accordingly, utilities of GAM180 include diagnosis, prevention and treatment of diseases and clinical conditions associated with LOC349094.

LOC349097 (Accession XP_300940.1) is another GAM180 target gene, herein designated TARGET GENE. LOC349097 BINDING SITE is a target binding site found in the 5' untranslated region of mRNA encoded by LOC349097, corresponding to a target binding site such as BINDING SITE I, BINDING SITE II or BINDING SITE III of FIG. 8. Table 4 illustrates the complementarity of the nucleotide sequences of LOC349097 BINDING SITE, designated SEQ ID:7090, to the nucleotide sequence of GAM180 RNA, herein designated GAM RNA, also designated SEQ ID:214.

Another function of GAM180 is therefore inhibition of LOC349097 (Accession XP_300940.1). Accordingly, utilities of GAM180 include diagnosis, prevention and treatment of diseases and clinical conditions associated with LOC349097.

LOC349138 (Accession XP_300960.1) is another GAM180 target gene, herein designated TARGET GENE. LOC349138 BINDING SITE is a target binding site found in the 5' untranslated region of mRNA encoded by LOC349138, corresponding to a target binding site such as BINDING SITE I, BINDING SITE II or BINDING SITE III of FIG. 8. Table 4 illustrates the complementarity of the nucleotide sequences of LOC349138 BINDING SITE, designated SEQ ID:7090, to the nucleotide sequence of GAM180 RNA, herein designated GAM RNA, also designated SEQ ID:214.

Another function of GAM180 is therefore inhibition of LOC349138 (Accession XP_300960.1). Accordingly, utilities of GAM180 include diagnosis, prevention and treatment of diseases and clinical conditions associated with LOC349138.

LOC349305 (Accession XP_301019.1) is another GAM180 target gene, herein designated TARGET GENE. LOC349305 BINDING SITE is a target binding site found in the 5' untranslated region of mRNA encoded by LOC349305, corresponding to a target binding site such as BINDING SITE I, BINDING SITE II or BINDING SITE III of FIG. 8. Table 4 illustrates the complementarity of the nucleotide sequences of LOC349305 BINDING SITE, designated SEQ ID:1916, to the nucleotide sequence of GAM180 RNA, herein designated GAM RNA, also designated SEQ ID:214.

Another function of GAM180 is therefore inhibition of LOC349305 (Accession XP_301019.1). Accordingly, utilities of GAM180 include diagnosis, prevention and treatment of diseases and clinical conditions associated with LOC349305.

LOC351228 (Accession XP_304390.1) is another GAM180 target gene, herein designated TARGET GENE. LOC351228 BINDING SITE1 through LOC351228 BINDING SITE3 are target binding sites found in untranslated regions of mRNA encoded by LOC351228, corresponding to target binding sites such as BINDING SITE I, BINDING SITE II or BINDING SITE III of FIG. 8. Table 4 illustrates the complementarity of the nucleotide sequences of LOC351228 BINDING SITE1 through LOC351228 BINDING SITE3, designated SEQ ID:1629, SEQ ID:17782 and SEQ ID:5030 respectively, to the nucleotide sequence of GAM180 RNA, herein designated GAM RNA, also designated SEQ ID:214.

Another function of GAM180 is therefore inhibition of LOC351228 (Accession XP_304390.1). Accordingly, utilities of GAM180 include diagnosis, prevention and treatment of diseases and clinical conditions associated with LOC351228.

LOC92235 (Accession XP_043739.2) is another GAM180 target gene, herein designated TARGET GENE. LOC92235 BINDING SITE is a target binding site found in the 3' untranslated region of mRNA encoded by LOC92235, corresponding to a target binding site such as BINDING SITE I, BINDING SITE II or BINDING SITE III of FIG. 8. Table 4 illustrates the complementarity of the nucleotide sequences of LOC92235 BINDING SITE, designated SEQ ID:11492, to the nucleotide sequence of GAM180 RNA, herein designated GAM RNA, also designated SEQ ID:214.

Another function of GAM180 is therefore inhibition of LOC92235 (Accession XP_043739.2). Accordingly, utilities of GAM180 include diagnosis, prevention and treatment of diseases and clinical conditions associated with LOC92235.

LOC92710 (Accession XP_046811.2) is another GAM180 target gene, herein designated TARGET GENE. LOC92710 BINDING SITE is a target binding site found in the 3' untranslated region of mRNA encoded by LOC92710, corresponding to a target binding site such as BINDING SITE I, BINDING SITE II or BINDING SITE III of FIG. 8. Table 4 illustrates the complementarity of the nucleotide sequences of LOC92710 BINDING SITE, designated SEQ ID:17389, to the nucleotide sequence of GAM180 RNA, herein designated GAM RNA, also designated SEQ ID:214.

Another function of GAM180 is therefore inhibition of LOC92710 (Accession XP_046811.2). Accordingly, utilities of GAM180 include diagnosis, prevention and treatment of diseases and clinical conditions associated with LOC92710.

Lymphocyte antigen 6 complex, locus h (LY6H, Accession NP_002338.1) is another GAM180 target gene, herein designated TARGET GENE. LY6H BINDING SITE is a target binding site found in the 3' untranslated region of mRNA encoded by LY6H, corresponding to a target binding site such as BINDING SITE I, BINDING SITE II or BINDING SITE III of FIG. 8. Table 4 illustrates the complementarity of the nucleotide sequences of LY6H BINDING SITE, designated SEQ ID:16930, to the nucleotide sequence of GAM180 RNA, herein designated GAM RNA, also designated SEQ ID:214.

Another function of GAM180 is therefore inhibition of Lymphocyte antigen 6 complex, locus h (LY6H, Accession NP_002338.1). Accordingly, utilities of GAM180 include diagnosis, prevention and treatment of diseases and clinical conditions associated with LY6H.

Lysophospholipase 3 (lysosomal phospholipase a2) (LYPLA3, Accession NP_036452.1) is another GAM180 target gene, herein designated TARGET GENE. LYPLA3 BINDING SITE is a target binding site found in the 3' untranslated region of mRNA encoded by LYPLA3, corresponding to a target binding site such as BINDING SITE I, BINDING SITE II or BINDING SITE III of FIG. 8. Table 4 illustrates the complementarity of the nucleotide sequences of LYPLA3 BINDING SITE, designated SEQ ID:10576, to the nucleotide sequence of GAM180 RNA, herein designated GAM RNA, also designated SEQ ID:214.

Another function of GAM180 is therefore inhibition of Lysophospholipase 3 (lysosomal phospholipase a2) (LYPLA3, Accession NP_036452.1). Accordingly, utilities of GAM180 include diagnosis, prevention and treatment of diseases and clinical conditions associated with LYPLA3.

MGC10334 (Accession XP_300761.1) is another GAM180 target gene, herein designated TARGET GENE. MGC10334 BINDING SITE is a target binding site found in the 5' untranslated region of multiple transcripts of mRNA encoded by MGC10334, corresponding to a target binding site such as BINDING SITE I, BINDING SITE II or BINDING SITE III of FIG. 8. Table 4 illustrates the complementarity of the nucleotide sequences of MGC10334 BINDING SITE, designated SEQ ID:1711, to the nucleotide sequence of GAM180 RNA, herein designated GAM RNA, also designated SEQ ID:214.

Another function of GAM180 is therefore inhibition of MGC10334 (Accession XP_300761.1). Accordingly, utilities of GAM180 include diagnosis, prevention and treatment of diseases and clinical conditions associated with MGC10334.

MGC10334 (Accession NP_085052.1) is another GAM180 target gene, herein designated TARGET GENE. MGC10334 BINDING SITE is a target binding site found in the 5' untranslated region of multiple transcripts of mRNA encoded by MGC10334, corresponding to a target binding site such as BINDING SITE I, BINDING SITE II or BINDING SITE III of FIG. 8. Table 4 illustrates the complementarity of the nucleotide sequences of MGC10334 BINDING SITE, designated SEQ ID:1711, to the nucleotide sequence of GAM180 RNA, herein designated GAM RNA, also designated SEQ ID:214.

Another function of GAM180 is therefore inhibition of MGC10334 (Accession NP_085052.1). Accordingly, utilities of GAM180 include diagnosis, prevention and treatment of diseases and clinical conditions associated with MGC10334.

MGC34680 (Accession NP_689559.1) is another GAM180 target gene, herein designated TARGET GENE. MGC34680 BINDING SITE is a target binding site found in the 3' untranslated region of mRNA encoded by MGC34680, corresponding to a target binding site such as BINDING SITE I, BINDING SITE II or BINDING SITE III of FIG. 8. Table 4 illustrates the complementarity of the nucleotide sequences of MGC34680 BINDING SITE, designated SEQ ID:4811, to the nucleotide sequence of GAM180 RNA, herein designated GAM RNA, also designated SEQ ID:214.

Another function of GAM180 is therefore inhibition of MGC34680 (Accession NP_689559.1). Accordingly, utilities of GAM180 include diagnosis, prevention and treatment of diseases and clinical conditions associated with MGC34680.

MGC40042 (Accession NP_689726.2) is another GAM180 target gene, herein designated TARGET GENE. MGC40042 BINDING SITE is a target binding site found in the 5' untranslated region of mRNA encoded by MGC40042, corresponding to a target binding site such as BINDING SITE I, BINDING SITE II or BINDING SITE III of FIG. 8. Table 4 illustrates the complementarity of the nucleotide sequences of MGC40042 BINDING SITE, designated SEQ ID:15660, to the nucleotide sequence of GAM180 RNA, herein designated GAM RNA, also designated SEQ ID:214.

Another function of GAM180 is therefore inhibition of MGC40042 (Accession NP_689726.2). Accordingly, utilities of GAM180 include diagnosis, prevention and treatment of diseases and clinical conditions associated with MGC40042.

MGC41906 (Accession NP_689687.1) is another GAM180 target gene, herein designated TARGET GENE. MGC41906 BINDING SITE is a target binding site found in the 3' untranslated region of mRNA encoded by MGC41906, corresponding to a target binding site such as BINDING SITE I, BINDING SITE II or BINDING SITE III of FIG. 8. Table 4 illustrates the complementarity of the nucleotide sequences of MGC41906 BINDING SITE, designated SEQ ID:5085, to the nucleotide sequence of GAM180 RNA, herein designated GAM RNA, also designated SEQ ID:214.

Another function of GAM180 is therefore inhibition of MGC41906 (Accession NP_689687.1). Accordingly, utilities of GAM180 include diagnosis, prevention and treatment of diseases and clinical conditions associated with MGC41906.

MGC4767 (Accession NP_115690.1) is another GAM180 target gene, herein designated TARGET GENE. MGC4767 BINDING SITE is a target binding site found in the 3' untranslated region of mRNA encoded by MGC4767, corresponding to a target binding site such as BINDING SITE I, BINDING SITE II or BINDING SITE III of FIG. 8. Table 4 illustrates the complementarity of the nucleotide sequences of MGC4767 BINDING SITE, designated SEQ ID:8947, to the nucleotide sequence of GAM180 RNA, herein designated GAM RNA, also designated SEQ ID:214.

Another function of GAM180 is therefore inhibition of MGC4767 (Accession NP_115690.1). Accordingly, utilities of GAM180 include diagnosis, prevention and treatment of diseases and clinical conditions associated with MGC4767.

MPRA (Accession NP_848509.1) is another GAM180 target gene, herein designated TARGET GENE. MPRA BINDING SITE is a target binding site found in the 5' untranslated region of mRNA encoded by MPRA, corresponding to a target binding site such as BINDING SITE I, BINDING SITE II or BINDING SITE III of FIG. 8. Table 4 illustrates the complementarity of the nucleotide sequences of MPRA BINDING SITE, designated SEQ ID:7693, to the nucleotide sequence of GAM180 RNA, herein designated GAM RNA, also designated SEQ ID:214.

Another function of GAM180 is therefore inhibition of MPRA (Accession NP_848509.1). Accordingly, utilities of GAM180 include diagnosis, prevention and treatment of diseases and clinical conditions associated with MPRA.

Membrane-spanning 4-domains, subfamily a, member 6a (MS4A6A, Accession NP_690590.1) is another GAM180 target gene, herein designated TARGET GENE. MS4A6A BINDING SITE is a target binding site found in the 3' untranslated region of multiple transcripts of mRNA encoded by MS4A6A, corresponding to a target binding site such as BINDING SITE I, BINDING SITE II or BINDING SITE III of FIG. 8. Table 4 illustrates the complementarity of the nucleotide sequences of MS4A6A BINDING SITE, designated SEQ ID:14166, to the nucleotide sequence of GAM180 RNA, herein designated GAM RNA, also designated SEQ ID:214.

Another function of GAM180 is therefore inhibition of Membrane-spanning 4-domains, subfamily a, member 6a (MS4A6A, Accession NP_690590.1), a gene which binds to the fc region of immunoglobulins epsilon. Accordingly, utilities of GAM180 include diagnosis, prevention and treatment of diseases and clinical conditions associated with MS4A6A.

The function of MS4A6A has been established by previous studies. By EST database searching for homologs of CD20 (MS4A1; 112210), Ishibashi et al. (2001) isolated a cDNA encoding MS4A6A, which they termed MS4A6. The deduced 178-amino acid protein has 4 potential phosphorylation sites, including 1 at the intracellular loop, and a non-hydrophilic C terminus. Northern blot analysis revealed low-level expression of a 1.3-kb transcript in mouse kidney and small intestine and a 1.0-kb transcript in mouse heart; no expression was detected in human tissues. Liang and Tedder (2001) also obtained a cDNA encoding MS4A6A. The predicted 248-amino acid protein is more than 50% identical to its mouse homologs. PCR analysis detected variable expression of MS4A6A in cDNA from some B-cell, myelomonocytic, and erythroleukemia cell lines. The authors identified likely polymorphisms in the MS4A6A gene.

Full details of the abovementioned studies are described in the following publications, the disclosure of which are hereby incorporated by reference:

Ishibashi, K.; Suzuki, M.; Sasaki, S.; Imai, M.: Identification of a new multigene four-transmembrane family (MS4A) related to CD20, HTm4 and beta subunit of the high-affinity IgE receptor. Gene 264:87-93, 2001; and Liang, Y.; Tedder, T. F.: Identification of a CD20-, Fc-epsilon-RI-beta-related gene family: sixteen new MS4A family members expressed in human and mouse. Genomics 72:119-127, 2001.

Further studies establishing the function and utilities of MS4A6A are found in John Hopkins OMIM database record ID 606548, and in cited publications listed in Table 5, which are hereby incorporated by reference. Membrane-spanning 4-domains, subfamily a, member 6a (MS4A6A, Accession NP_690591.1) is another GAM180 target gene, herein designated TARGET GENE. MS4A6A BINDING SITE is a target binding site found in the 3' untranslated region of multiple transcripts of mRNA encoded by MS4A6A, corresponding to a target binding site such as BINDING SITE I, BINDING SITE II or BINDING SITE III of FIG. 8. Table 4 illustrates the complementarity of the nucleotide sequences of MS4A6A BINDING SITE, designated SEQ ID:14166, to the nucleotide sequence of GAM180 RNA, herein designated GAM RNA, also designated SEQ ID:214.

Another function of GAM180 is therefore inhibition of Membrane-spanning 4-domains, subfamily a, member 6a (MS4A6A, Accession NP_690591.1), a gene which binds to the fc region of immunoglobulins epsilon. Accordingly, utilities of GAM180 include diagnosis, prevention and treatment of diseases and clinical conditions associated with MS4A6A.

The function of MS4A6A has been established by previous studies. By EST database searching for homologs of CD20 (MS4A1; 112210), Ishibashi et al. (2001) isolated a cDNA encoding MS4A6A, which they termed MS4A6. The deduced 178-amino acid protein has 4 potential phosphorylation sites, including 1 at the intracellular loop, and a non-hydrophilic C terminus. Northern blot analysis revealed low-level expression of a 1.3-kb transcript in mouse kidney and small intestine and a 1.0-kb transcript in mouse heart; no expression was detected in human tissues. Liang and Tedder (2001) also obtained a cDNA encoding MS4A6A. The predicted 248-amino acid protein is more than 50% identical to its mouse homologs. PCR analysis detected variable expression of MS4A6A in cDNA from some B-cell, myelomonocytic, and erythroleukemia cell lines. The authors identified likely polymorphisms in the MS4A6A gene.

Full details of the abovementioned studies are described in the following publications, the disclosure of which are hereby incorporated by reference:

Ishibashi, K.; Suzuki, M.; Sasaki, S.; Imai, M.: Identification of a new multigene four-transmembrane family (MS4A) related to CD20, HTm4 and beta subunit of the high-affinity IgE receptor. Gene 264:87-93, 2001; and Liang, Y.; Tedder, T. F.: Identification of a CD20-, Fc-epsilon-RI-beta-related gene family: sixteen new MS4A family members expressed in human and mouse. Genomics 72:119-127, 2001.

Further studies establishing the function and utilities of MS4A6A are found in John Hopkins OMIM database record ID 606548, and in cited publications listed in Table 5, which are hereby incorporated by reference. NCAG1 (Accession NP_115536.1) is another GAM180 target gene, herein designated TARGET GENE. NCAG1 BINDING SITE is a target binding site found in the 3' untranslated region of mRNA encoded by NCAG1, corresponding to a target binding site such as BINDING SITE I, BINDING SITE II or BINDING SITE III of FIG. 8. Table 4 illustrates the complementarity of the nucleotide sequences of NCAG1 BINDING SITE, designated SEQ ID:18626, to the nucleotide sequence of GAM180 RNA, herein designated GAM RNA, also designated SEQ ID:214.

Another function of GAM180 is therefore inhibition of NCAG1 (Accession NP_115536.1). Accordingly, utilities of GAM180 include diagnosis, prevention and treatment of diseases and clinical conditions associated with NCAG1.

NET-7 (Accession NP_036471.1) is another GAM180 target gene, herein designated TARGET GENE. NET-7 BINDING SITE is a target binding site found in the 3' untranslated region of mRNA encoded by NET-7, corresponding to a target binding site such as BINDING SITE I, BINDING SITE II or BINDING SITE III of FIG. 8. Table 4 illustrates the complementarity of the nucleotide sequences of NET-7 BINDING SITE, designated SEQ ID:11703, to the nucleotide sequence of GAM180 RNA, herein designated GAM RNA, also designated SEQ ID:214.

Another function of GAM180 is therefore inhibition of NET-7 (Accession NP_036471.1). Accordingly, utilities of GAM180 include diagnosis, prevention and treatment of diseases and clinical conditions associated with NET-7.

Nuclear factor i/b (NFIB, Accession NP_005587.1) is another GAM180 target gene, herein designated TARGET GENE. NFIB BINDING SITE is a target binding site found in the 5' untranslated region of mRNA encoded by NFIB, corresponding to a target binding site such as BINDING SITE I, BINDING SITE II or BINDING SITE III of FIG. 8. Table 4 illustrates the complementarity of the nucleotide sequences of NFIB BINDING SITE, designated SEQ ID:13925, to the nucleotide sequence of GAM180 RNA, herein designated GAM RNA, also designated SEQ ID:214.

Another function of GAM180 is therefore inhibition of Nuclear factor i/b (NFIB, Accession NP_005587.1), a gene which recognizes and binds the palindromic sequence 5'-ttg-gcnnnnngccaa-3' present in viral and cellular promoters. Accordingly, utilities of GAM180 include diagnosis, prevention and treatment of diseases and clinical conditions associated with NFIB.

The function of NFIB and its association with various diseases and clinical conditions, has been established by previous studies, as described hereinabove with reference to GAM94.1. NMNAT2 (Accession NP_055854.1) is another GAM180 target gene, herein designated TARGET GENE. NMNAT2 BINDING SITE is a target binding site found in the 3' untranslated region of multiple transcripts of mRNA encoded by NMNAT2, corresponding to a target binding site such as BINDING SITE I, BINDING SITE II or BINDING SITE III of FIG. 8. Table 4 illustrates the complementarity of the nucleotide sequences of NMNAT2 BINDING SITE, designated SEQ ID:8057, to the nucleotide sequence of GAM180 RNA, herein designated GAM RNA, also designated SEQ ID:214.

Another function of GAM180 is therefore inhibition of NMNAT2 (Accession NP_055854.1). Accordingly, utilities of GAM180 include diagnosis, prevention and treatment of diseases and clinical conditions associated with NMNAT2.

Nitric oxide synthase 1 (neuronal) (NOS1, Accession NP_000611.1) is another GAM180 target gene, herein designated TARGET GENE. NOS1 BINDING SITE is a target binding site found in the 3' untranslated region of mRNA encoded by NOS1, corresponding to a target binding site such as BINDING SITE I, BINDING SITE II or BINDING SITE III of FIG. 8. Table 4 illustrates the complementarity of the nucleotide sequences of NOS1 BINDING SITE, designated SEQ ID:17856, to the nucleotide sequence of GAM180 RNA, herein designated GAM RNA, also designated SEQ ID:214.

Another function of GAM180 is therefore inhibition of Nitric oxide synthase 1 (neuronal) (NOS1, Accession NP_000611.1), a gene which produces nitric oxide (no) which is a messenger molecule with diverse functions throughout the body. Accordingly, utilities of GAM180 include diagnosis, prevention and treatment of diseases and clinical conditions associated with NOS1.

The function of NOS1 has been established by previous studies. Bredt et al. (1991) cloned a cDNA for the neuronal form of nitric oxide (NO) synthase and studied its expression. The only mammalian protein with close sequence similarity was cytochrome P450 reductase. Magee et al. (1996) used PCR to clone a novel form of neuronal NOS from rat penile RNA. This NOS cDNA was termed PnNOS for 'penile neuronal NOS.' Sequencing revealed that the PnNOS cDNA was identical to rat cerebellar neuronal NOS1 except for a 102-bp insertion in PnNOS, indicating that PnNOS is a novel isoform. PCR of a human penile cDNA library confirmed that this insert is present in human DNA at the same location. Repetition of RT-PCR showed PnNOS to be the only form of NOS1 expressed in rat penis, urethra, prostate, and skeletal muscle. The PnNOS form was also present in rat cerebellum, liver, and pelvic plexus, although less abundantly than the shorter isoform. The authors postulated that PnNOS may be responsible for the synthesis of nitric oxide during penile erection and may be involved in control of the tone of the urethra, prostate, and bladder.

Animal model experiments lend further support to the function of NOS1. Mice with targeted disruption of neuronal NO synthase display grossly normal appearance, locomotor activity, breeding, long-term potentiation, and long-term depression. NOS1-deficient mice are resistant to neural stroke damage following middle cerebral artery ligation. Nelson et al. (1995) reported a large increase in aggressive behavior and excessive, inappropriate sexual behavior in NOS1 'knockout' mice. Initial observations indicated that male NOS1-deficient mice engaged in chronic aggressive behavior, not apparent among NOS1-deficient female mice or wild-type male or female mice housed together. Relevance of the observations to human behavior was suggested.

It is appreciated that the abovementioned animal model for NOS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Magee, T.; Fuentes, A. M.; Garban, H.; Rajavashisth, T.; Marquez, D.; Rodriguez, J. A.; Rajfer, J.; Gonzalez-Cadavid, N. F.: Cloning of a novel neuronal nitric oxide synthase expressed in penis and lower urinary tract. Biochem. Biophys. Res. Commun. 226:145-151, 1996; and Nelson, R. J.; Demas, G. E.; Huang, P. L.; Fishman, M. C.; Dawson, V. L.; Dawson, T. M.; Snyder, S. H.: Behavioural abnormalities in male mice lacking neuronal nitric oxide synthase. N.

Further studies establishing the function and utilities of NOS1 are found in John Hopkins OMIM database record ID 163731, and in cited publications listed in Table 5, which are hereby incorporated by reference. Natriuretic peptide receptor c/guanylate cyclase c (atrionatriuretic peptide receptor c) (NPR3, Accession NP_000899.1) is another GAM180 target gene, herein designated TARGET GENE. NPR3 BINDING SITE is a target binding site found in the 3' untranslated region of mRNA encoded by NPR3, corresponding to a target binding site such as BINDING SITE I, BINDING SITE II or BINDING SITE III of FIG. 8. Table 4 illustrates the complementarity of the nucleotide sequences of NPR3 BINDING SITE, designated SEQ ID:9247, to the nucleotide sequence of GAM180 RNA, herein designated GAM RNA, also designated SEQ ID:214.

Another function of GAM180 is therefore inhibition of Natriuretic peptide receptor c/guanylate cyclase c (atrionatriuretic peptide receptor c) (NPR3, Accession NP_000899.1), a gene which is required for timing of endochondral ossification. Accordingly, utilities of GAM180 include diagnosis, prevention and treatment of diseases and clinical conditions associated with NPR3.

The function of NPR3 has been established by previous studies. Using a bovine ANP C-type receptor cDNA as a hybridization probe, Porter et al. (1990) cloned cDNA encoding the human atrial natriuretic peptide clearance receptor (ANPRC; gene symbol =NPR3) from human placental and kidney cDNA libraries. The ANPC receptor mediates the internalization and metabolic clearance of ANP. The human sequence was shown to be highly homologous to the bovine sequence. Corresponding mRNA was expressed in human placenta, adult and fetal kidney, and fetal heart. Lowe et al. (1990) reported the sequence of the cDNA.

Animal model experiments lend further support to the function of NPR3. It is thought that atrial natriuretic peptide released from the heart in response to atrial stretch binds to a guanylyl cyclase-coupled receptor, which Lopez et al. (1995) symbolized GC-A, in the kidney to mediate natriuresis and diuresis, and to the same receptor in the vasculature to mediate relaxation. Lopez et al. (1995) reported that disruption of the GC-A gene by transfection of mouse embryonic stem cells resulted in mice with chronic elevations of blood pressure on a normal salt diet. Pressure was elevated by 27.4 mm Hg in homozygotes and 10.5 mm Hg in heterozygotes. Unexpectedly, the blood pressure remained elevated and unchanged in response to either minimal salt diet or high salt diet. Aldosterone and ANP concentrations were not affected by the genotype. Thus, the authors speculated that mutations in the receptor gene could explain some salt-resistant forms of essential hypertension in humans. Coupled with other work, this also suggested that the GC-A signaling pathway dominates at the level of peripheral resistance, where it can operate independently of ANP.

It is appreciated that the abovementioned animal model for NPR3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lopez, M. J.; Wong, S. K.-F.; Kishimoto, I.; Dubois, S.; Mach, V.; Friesen, J.; Garbers, D. L.; Beuve, A.: Salt-resistant hypertension in mice lacking the guanylyl cyclase-A receptor for atrial natriuretic peptide. Nature 378:65-68, 1995; and Porter, J. G.; Arfsten, A.; Fuller, F.; Miller, J. A.; Gregory, L. C.; Lewicki, J. A.: Isolation and functional expression of the human atrial natriuretic peptide clearance receptor c.

Further studies establishing the function and utilities of NPR3 are found in John Hopkins OMIM database record ID 108962, and in cited publications listed in Table 5, which are hereby incorporated by reference. NRLN1 (Accession NP_660277.1) is another GAM180 target gene, herein designated TARGET GENE. NRLN1 BINDING SITE is a target binding site found in the 3' untranslated region of mRNA encoded by NRLN1, corresponding to a target binding site such as BINDING SITE I, BINDING SITE II or BINDING SITE III of FIG. 8. Table 4 illustrates the complementarity of the nucleotide sequences of NRLN1 BINDING SITE, designated SEQ ID:15259, to the nucleotide sequence of GAM180 RNA, herein designated GAM RNA, also designated SEQ ID:214.

Another function of GAM180 is therefore inhibition of NRLN1 (Accession NP_660277.1). Accordingly, utilities of GAM180 include diagnosis, prevention and treatment of diseases and clinical conditions associated with NRLN1.

Oxidative-stress responsive 1 (OSR1, Accession NP_660303.1) is another GAM180 target gene, herein designated TARGET GENE. OSR1 BINDING SITE is a target binding site found in the 3' untranslated region of multiple transcripts of mRNA encoded by OSR1, corresponding to a target binding site such as BINDING SITE I, BINDING SITE II or BINDING SITE III of FIG. 8. Table 4 illustrates the complementarity of the nucleotide sequences of OSR1 BINDING SITE, designated SEQ ID:18887, to the nucleotide sequence of GAM180 RNA, herein designated GAM RNA, also designated SEQ ID:214.

Another function of GAM180 is therefore inhibition of Oxidative-stress responsive 1 (OSR1, Accession NP_660303.1), a gene which mediats stress-activated signals. Accordingly, utilities of GAM180 include diagnosis, prevention and treatment of diseases and clinical conditions associated with OSR1.

The function of OSR1 and its association with various diseases and clinical conditions, has been established by previous studies, as described hereinabove with reference to GAM133.1. P8 (Accession NP_036517.1) is another GAM180 target gene, herein designated TARGET GENE. P8 BINDING SITE is a target binding site found in the 3' untranslated region of mRNA encoded by P8, corresponding to a target binding site such as BINDING SITE I, BINDING SITE II or BINDING SITE III of FIG. 8. Table 4 illustrates the complementarity of the nucleotide sequences of P8 BINDING SITE, designated SEQ ID:9958, to the nucleotide sequence of GAM180 RNA, herein designated GAM RNA, also designated SEQ ID:214.

Another function of GAM180 is therefore inhibition of P8 (Accession NP_036517.1). Accordingly, utilities of GAM180 include diagnosis, prevention and treatment of diseases and clinical conditions associated with P8.

Phosphodiesterase 8b (PDE8B, Accession NP_003710.1) is another GAM180 target gene, herein designated TARGET GENE. PDE8B BINDING SITE is a target binding site found in the 3' untranslated region of mRNA encoded by PDE8B, corresponding to a target binding site such as BINDING SITE I, BINDING SITE II or BINDING SITE III of FIG. 8. Table 4 illustrates the complementarity of the nucleotide sequences of PDE8B BINDING SITE, designated SEQ ID:17979, to the nucleotide sequence of GAM180 RNA, herein designated GAM RNA, also designated SEQ ID:214.

Another function of GAM180 is therefore inhibition of Phosphodiesterase 8b (PDE8B, Accession NP_003710.1). Accordingly, utilities of GAM180 include diagnosis, prevention and treatment of diseases and clinical conditions associated with PDE8B.

Peroxisome biogenesis factor 10 (PEX10, Accession NP_722540.1) is another GAM180 target gene, herein designated TARGET GENE. PEX10 BINDING SITE is a target binding site found in the 3' untranslated region of multiple transcripts of mRNA encoded by PEX10, corresponding to a target binding site such as BINDING SITE I, BINDING SITE II or BINDING SITE III of FIG. 8. Table 4 illustrates the complementarity of the nucleotide sequences of PEX10 BINDING SITE, designated SEQ ID:13341, to the nucleotide sequence of GAM180 RNA, herein designated GAM RNA, also designated SEQ ID:214.

Another function of GAM180 is therefore inhibition of Peroxisome biogenesis factor 10 (PEX10, Accession NP_722540.1). Accordingly, utilities of GAM180 include diagnosis, prevention and treatment of diseases and clinical conditions associated with PEX10.

Peroxisome biogenesis factor 10 (PEX10, Accession NP_002608.1) is another GAM180 target gene, herein designated TARGET GENE. PEX10 BINDING SITE is a target binding site found in the 3' untranslated region of multiple transcripts of mRNA encoded by PEX10, corresponding to a target binding site such as BINDING SITE I, BINDING SITE II or BINDING SITE III of FIG. 8. Table 4 illustrates the complementarity of the nucleotide sequences of PEX10 BINDING SITE, designated SEQ ID:13341, to the nucleotide sequence of GAM180 RNA, herein designated GAM RNA, also designated SEQ ID:214.

Another function of GAM180 is therefore inhibition of Peroxisome biogenesis factor 10 (PEX10, Accession NP_002608.1). Accordingly, utilities of GAM180 include diagnosis, prevention and treatment of diseases and clinical conditions associated with PEX10.

Prefoldin 5 (PFDN5, Accession NP_665903.1) is another GAM180 target gene, herein designated TARGET GENE. PFDN5 BINDING SITE is a target binding site found in the 3' untranslated region of multiple transcripts of mRNA encoded by PFDN5, corresponding to a target binding site such as BINDING SITE I, BINDING SITE II or BINDING SITE III of FIG. 8. Table 4 illustrates the complementarity of the nucleotide sequences of PFDN5 BINDING SITE, designated SEQ ID:11809, to the nucleotide sequence of GAM180 RNA, herein designated GAM RNA, also designated SEQ ID:214.

Another function of GAM180 is therefore inhibition of Prefoldin 5 (PFDN5, Accession NP_665903.1). Accordingly, utilities of GAM180 include diagnosis, prevention and treatment of diseases and clinical conditions associated with PFDN5.

Paraneoplastic antigen ma2 (PNMA2, Accession NP_009188.1) is another GAM180 target gene, herein designated TARGET GENE. PNMA2 BINDING SITE is a target binding site found in the 3' untranslated region of mRNA encoded by PNMA2, corresponding to a target binding site such as BINDING SITE I, BINDING SITE II or BINDING SITE III of FIG. 8. Table 4 illustrates the complementarity of the nucleotide sequences of PNMA2 BINDING SITE, designated SEQ ID:10910, to the nucleotide sequence of GAM180 RNA, herein designated GAM RNA, also designated SEQ ID:214.

Another function of GAM180 is therefore inhibition of Paraneoplastic antigen ma2 (PNMA2, Accession NP_009188.1). Accordingly, utilities of GAM180 include diagnosis, prevention and treatment of diseases and clinical conditions associated with PNMA2.

Protein phosphatase 1f (pp2c domain containing) (PPM1F, Accession NP_055449.1) is another GAM180 target gene, herein designated TARGET GENE. PPM1F BINDING SITE is a target binding site found in the 3' untranslated region of mRNA encoded by PPM1F, corresponding to a target binding site such as BINDING SITE I, BINDING SITE II or BINDING SITE III of FIG. 8. Table 4 illustrates the complementarity of the nucleotide sequences of PPM1F BINDING SITE, designated SEQ ID:5913, to the nucleotide sequence of GAM180 RNA, herein designated GAM RNA, also designated SEQ ID:214.

Another function of GAM180 is therefore inhibition of Protein phosphatase 1f (pp2c domain containing) (PPM1F, Accession NP_055449.1). Accordingly, utilities of GAM180 include diagnosis, prevention and treatment of diseases and clinical conditions associated with PPM1F.

Protein phosphatase 1, regulatory (inhibitor) subunit 1b (dopamine and camp regulated phosphoprotein, darpp-32) (PPP1R1B, Accession NP_852606.1) is another GAM180 target gene, herein designated TARGET GENE. PPP1R1B BINDING SITE is a target binding site found in the 3' untranslated region of multiple transcripts of mRNA encoded by PPP1R1B, corresponding to a target binding site such as BINDING SITE I, BINDING SITE II or BINDING SITE III of FIG. 8. Table 4 illustrates the complementarity of the nucleotide sequences of PPP1R1B BINDING SITE, designated SEQ ID:8599, to the nucleotide sequence of GAM180 RNA, herein designated GAM RNA, also designated SEQ ID:214.

Another function of GAM180 is therefore inhibition of Protein phosphatase 1, regulatory (inhibitor) subunit 1b (dopamine and camp regulated phosphoprotein, darpp-32) (PPP1R1B, Accession NP_852606.1). Accordingly, utilities of GAM180 include diagnosis, prevention and treatment of diseases and clinical conditions associated with PPP1R1B.

Protein phosphatase 1, regulatory (inhibitor) subunit 1b (dopamine and camp regulated phosphoprotein, darpp-32) (PPP1R1B, Accession NP_115568.2) is another GAM180 target gene, herein designated TARGET GENE. PPP1R1B BINDING SITE is a target binding site found in the 3' untranslated region of multiple transcripts of mRNA encoded by PPP1R1B, corresponding to a target binding site such as BINDING SITE I, BINDING SITE II or BINDING SITE III of FIG. 8. Table 4 illustrates the complementarity of the nucleotide sequences of PPP1R1B BINDING SITE, designated SEQ ID:8599, to the nucleotide sequence of GAM180 RNA, herein designated GAM RNA, also designated SEQ ID:214.

Another function of GAM180 is therefore inhibition of Protein phosphatase 1, regulatory (inhibitor) subunit 1b (dopamine and camp regulated phosphoprotein, darpp-32) (PPP1R1B, Accession NP_115568.2). Accordingly, utilities of GAM180 include diagnosis, prevention and treatment of diseases and clinical conditions associated with PPP1R1B.

PRO2086 (Accession NP_054830.1) is another GAM180 target gene, herein designated TARGET GENE. PRO2086 BINDING SITE is a target binding site found in the 5' untranslated region of mRNA encoded by PRO2086, corresponding to a target binding site such as BINDING SITE I, BINDING SITE II or BINDING SITE III of FIG. 8. Table 4 illustrates the complementarity of the nucleotide sequences of PRO2086 BINDING SITE, designated SEQ ID:15425, to the nucleotide sequence of GAM180 RNA, herein designated GAM RNA, also designated SEQ ID:214.

Another function of GAM180 is therefore inhibition of PRO2086 (Accession NP_054830.1). Accordingly, utilities of GAM180 include diagnosis, prevention and treatment of diseases and clinical conditions associated with PRO2086.

Periaxin (PRX, Accession NP_066007.1) is another GAM180 target gene, herein designated TARGET GENE. PRX BINDING SITE is a target binding site found in the 3' untranslated region of mRNA encoded by PRX, corresponding to a target binding site such as BINDING SITE I, BINDING SITE II or BINDING SITE III of FIG. 8. Table 4 illustrates the complementarity of the nucleotide sequences of PRX BINDING SITE, designated SEQ ID:15552, to the nucleotide sequence of GAM180 RNA, herein designated GAM RNA, also designated SEQ ID:214.

Another function of GAM180 is therefore inhibition of Periaxin (PRX, Accession NP_066007.1), a gene which seems to be required for maintenance of peripheral nerve myelin sheath. may have a role in axon-glial interactions, possibly by interacting with the cytoplasmic domains of integral membrane proteins such as myelin- associated glycoprotein in the periaxonal regions of the schwann cell plasma membrane. may have a role in the early phases of myelin deposition and therefore is associated with Dejerine-sottas neuropathy, autosomal recessive. Accordingly, utilities of GAM180 include diagnosis, prevention and treatment of Dejerine-sottas neuropathy, autosomal recessive, and of other diseases and clinical conditions associated with PRX.

The function of PRX and its association with various diseases and clinical conditions, has been established by previous studies, as described hereinabove with reference to GAM30.1. Proline-serine-threonine phosphatase interacting protein 1 (PSTPIP1, Accession NP_003969.2) is another GAM180 target gene, herein designated TARGET GENE. PSTPIP1 BINDING SITE is a target binding site found in the 3' untranslated region of mRNA encoded by PSTPIP1, corresponding to a target binding site such as BINDING SITE I, BINDING SITE II or BINDING SITE III of FIG. 8. Table 4 illustrates the complementarity of the nucleotide sequences of PSTPIP1 BINDING SITE, designated SEQ ID:1021, to the nucleotide sequence of GAM180 RNA, herein designated GAM RNA, also designated SEQ ID:214.

Another function of GAM180 is therefore inhibition of Proline-serine-threonine phosphatase interacting protein 1 (PSTPIP1, Accession NP_003969.2). Accordingly, utilities of GAM180 include diagnosis, prevention and treatment of diseases and clinical conditions associated with PSTPIP1.

Rab17, member ras oncogene family (RAB17, Accession NP_071894.1) is another GAM180 target gene, herein designated TARGET GENE. RAB17 BINDING SITE is a target binding site found in the 3' untranslated region of mRNA encoded by RAB17, corresponding to a target binding site such as BINDING SITE I, BINDING SITE II or BINDING SITE III of FIG. 8. Table 4 illustrates the complementarity of the nucleotide sequences of RAB17 BINDING SITE, designated SEQ ID:17352, to the nucleotide sequence of GAM180 RNA, herein designated GAM RNA, also designated SEQ ID:214.

Another function of GAM180 is therefore inhibition of Rab17, member ras oncogene family (RAB17, Accession NP_071894.1). Accordingly, utilities of GAM180 include diagnosis, prevention and treatment of diseases and clinical conditions associated with RAB17.

Retinoic acid induced 14 (RAI14, Accession NP_056392.1) is another GAM180 target gene, herein designated TARGET GENE. RAI14 BINDING SITE is a target binding site found in the 3' untranslated region of mRNA encoded by RAI14, corresponding to a target binding site such as BINDING SITE I, BINDING SITE II or BINDING SITE III of FIG. 8. Table 4 illustrates the complementarity of the nucleotide sequences of RAI14 BINDING SITE, designated SEQ ID:15321, to the nucleotide sequence of GAM180 RNA, herein designated GAM RNA, also designated SEQ ID:214.

Another function of GAM180 is therefore inhibition of Retinoic acid induced 14 (RAI14, Accession NP_056392.1), a gene which is required for protein transport from the er to the golgi complex. Accordingly, utilities of GAM180 include diagnosis, prevention and treatment of diseases and clinical conditions associated with RAI14.

The function of RAI14 and its association with various diseases and clinical conditions, has been established by previous studies, as described hereinabove with reference to GAM63.1. Retinal degeneration, slow (retinitis pigmentosa 7) (RDS, Accession NP_000313.1) is another GAM180 target gene, herein designated TARGET GENE. RDS BINDING SITE is a target binding site found in the 3' untranslated region of mRNA encoded by RDS, corresponding to a target binding site such as BINDING SITE I, BINDING SITE II or BINDING SITE III of FIG. 8. Table 4 illustrates the complementarity of the nucleotide sequences of RDS BINDING SITE, designated SEQ ID:14017, to the nucleotide sequence of GAM180 RNA, herein designated GAM RNA, also designated SEQ ID:214.

Another function of GAM180 is therefore inhibition of Retinal degeneration, slow (retinitis pigmentosa 7) (RDS, Accession NP_000313.1), a gene which may function as an adhesion molecule involved in stabilization and compaction of outer segment disks or in the maintenance of the curvature of the rim and therefore is associated with Autosomal dominant retinitis pigmentosa. Accordingly, utilities of GAM180 include diagnosis, prevention and treatment of Autosomal dominant retinitis pigmentosa, and of other diseases and clinical conditions associated with RDS.

The function of RDS has been established by previous studies. Kohl et al. (1997) screened 76 independent families with various forms of mostly central retinal dystrophies for mutations in the RDS gene. Two nonsense mutations, 5 missense mutations, and 1 single base insertion were detected. All of these were in heterozygous state. Kohl et al. (1997) commented on the remarkable variation in phenotype and disease expression between and within families.

Animal model experiments lend further support to the function of RDS. A common feature of peripherin-related retinitis pigmentosa and macular dystrophy in the human and the rds mutation in mouse is the loss of photoreceptor function. It is characterized by complete failure to develop photoreceptor discs and outer segments, downregulation of rhodopsin (OMIM Ref. No. 180380), and apoptotic loss of photoreceptor cells. Ali et al. (2000) demonstrated that subretinal injection of recombinant adeno- associated virus encoding a Prph2 transgene resulted in stable generation of outer segment structures and formation of new stacks of discs containing both peripherin- 2 and rhodopsin, which in many cases were morphologically similar to normal outer segments. Moreover, the reestablishment of the structural integrity of the photoreceptor layer resulted in electrophysiologic correction. These studies demonstrated for the first time that a complex ultrastructural cell defect can be corrected both morphologically and functionally by in vivo gene transfer. Sarra et al. (2001) extended the analysis and demonstrated that the potential for ultrastructural improvement is dependent upon the age at which animals are treated, but the effect of a single injection on photoreceptor ultrastructure may be long-term. However, there was no significant effect on photoreceptor cell loss, irrespective of the date of administration, despite the improvements in morphology and function. These findings suggested that successful gene therapy in patients with photoreceptor defects may ultimately depend upon intervention in early stages of disease and upon accurate control of transgene expression.

It is appreciated that the abovementioned animal model for RDS is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kohl, S.; Christ-Adler, M.; Apfelstedt-Sylla, E.; Kellner, U.; Eckstein, A.; Zrenner, E.; Wissinger, B.: RDS/peripherin gene mutations are frequent causes of central retinal dystrophies. J. Med. Genet. 34:620-626, 1997; and Sarra, G.-M.; Stephens, C.; de Alwis, M.; Bainbridge, J. W. B.; Smith, A. J.; Thrasher, A. J.; Ali, R. R.: Gene replacement therapy in the retinal degeneration slow (rds) mouse: the ef.

Further studies establishing the function and utilities of RDS are found in John Hopkins OMIM database record ID 179605, and in cited publications listed in Table 5, which are hereby incorporated by reference. Arginine-glutamic acid dipeptide (re) repeats (RERE, Accession NP_036234.2) is another GAM180 target gene, herein designated TARGET GENE. RERE BINDING SITE is a target binding site found in the 3' untranslated region of mRNA encoded by RERE, corresponding to a target binding site such as BINDING SITE I, BINDING SITE II or BINDING SITE III of FIG. 8. Table 4 illustrates the complementarity of the nucleotide sequences of RERE BINDING SITE, designated SEQ ID:1004, to the nucleotide sequence of GAM180 RNA, herein designated GAM RNA, also designated SEQ ID:214.

Another function of GAM180 is therefore inhibition of Arginine-glutamic acid dipeptide (re) repeats (RERE, Accession NP_036234.2), a gene which binds DRPLA and locates in the nucleus and therefore may be associated with Dentatorubral- pallidoluysian atrophy. Accordingly, utilities of GAM180 include diagnosis, prevention and treatment of Dentatorubral-pallidoluysian atrophy, and of other diseases and clinical conditions associated with RERE.

The function of RERE and its association with various diseases and clinical conditions, has been established by previous studies, as described hereinabove with reference to GAM47.1. Rhesus blood group, c glycoprotein (RHCG, Accession NP_057405.1) is another GAM180 target gene, herein designated TARGET GENE. RHCG BINDING SITE is a target binding site found in the 3' untranslated region of mRNA encoded by RHCG, corresponding to a target binding site such as BINDING SITE I, BINDING SITE II or BINDING SITE III of FIG. 8. Table 4 illustrates the complementarity of the nucleotide sequences of RHCG BINDING SITE, designated SEQ ID:9363, to the nucleotide sequence of GAM180 RNA, herein designated GAM RNA, also designated SEQ ID:214.

Another function of GAM180 is therefore inhibition of Rhesus blood group, c glycoprotein (RHCG, Accession NP_057405.1). Accordingly, utilities of GAM180 include diagnosis, prevention and treatment of diseases and clinical conditions associated with RHCG.

RNAHP (Accession NP_031398.1) is another GAM180 target gene, herein designated TARGET GENE. RNAHP BINDING SITE is a target binding site found in the 3' untranslated region of mRNA encoded by RNAHP, corresponding to a target binding site such as BINDING SITE I, BINDING SITE II or BINDING SITE III of FIG. 8. Table 4 illustrates the complementarity of the nucleotide sequences of RNAHP BINDING SITE, designated SEQ ID:13198, to the nucleotide sequence of GAM180 RNA, herein designated GAM RNA, also designated SEQ ID:214.

Another function of GAM180 is therefore inhibition of RNAHP (Accession NP_031398.1). Accordingly, utilities of GAM180 include diagnosis, prevention and treatment of diseases and clinical conditions associated with RNAHP.

RODH-4 (Accession NP_003699.2) is another GAM180 target gene, herein designated TARGET GENE. RODH-4 BINDING SITE is a target binding site found in the 3' untranslated region of mRNA encoded by RODH-4, corresponding to a target binding site such as BINDING SITE I, BINDING SITE II or BINDING SITE III of FIG. 8. Table 4 illustrates the complementarity of the nucleotide sequences of RODH-4 BINDING SITE, designated SEQ ID:8216, to the nucleotide sequence of GAM180 RNA, herein designated GAM RNA, also designated SEQ ID:214.

Another function of GAM180 is therefore inhibition of RODH-4 (Accession NP_003699.2). Accordingly, utilities of GAM180 include diagnosis, prevention and treatment of diseases and clinical conditions associated with RODH-4.

Sal-like 2 (drosophila) (SALL2, Accession XP_300608.1) is another GAM180 target gene, herein designated TARGET GENE. SALL2 BINDING SITE is a target binding site found in the 3' untranslated region of mRNA encoded by SALL2, corresponding to a target binding site such as BINDING SITE I, BINDING SITE II or BINDING SITE III of FIG. 8. Table 4 illustrates the complementarity of the nucleotide sequences of SALL2 BINDING SITE, designated SEQ ID:12473, to the nucleotide sequence of GAM180 RNA, herein designated GAM RNA, also designated SEQ ID:214.

Another function of GAM180 is therefore inhibition of Sal-like 2 (drosophila) (SALL2, Accession XP_300608.1). Accordingly, utilities of GAM180 include diagnosis, prevention and treatment of diseases and clinical conditions associated with SALL2.

SBP1 (Accession NP_835222.1) is another GAM180 target gene, herein designated TARGET GENE. SBP1 BINDING SITE is a target binding site found in the 5' untranslated region of mRNA encoded by SBP1, corresponding to a target binding site such as BINDING SITE I, BINDING SITE II or BINDING SITE III of FIG. 8. Table 4 illustrates the complementarity of the nucleotide sequences of SBP1 BINDING SITE, designated SEQ ID:19335, to the nucleotide sequence of GAM180 RNA, herein designated GAM RNA, also designated SEQ ID:214.

Another function of GAM180 is therefore inhibition of SBP1 (Accession NP_835222.1). Accordingly, utilities of GAM180 include diagnosis, prevention and treatment of diseases and clinical conditions associated with SBP1.

SDNSF (Accession NP_644808.1) is another GAM180 target gene, herein designated TARGET GENE. SDNSF BINDING SITE is a target binding site found in the 3' untranslated region of mRNA encoded by SDNSF, corresponding to a target binding site such as BINDING SITE I, BINDING SITE II or BINDING SITE III of FIG. 8. Table 4 illustrates the complementarity of the nucleotide sequences of SDNSF BINDING SITE, designated SEQ ID:5177, to the nucleotide sequence of GAM180 RNA, herein designated GAM RNA, also designated SEQ ID:214.

Another function of GAM180 is therefore inhibition of SDNSF (Accession NP_644808.1). Accordingly, utilities of GAM180 include diagnosis, prevention and treatment of diseases and clinical conditions associated with SDNSF.

Serum deprivation response (phosphatidylserine binding protein) (SDPR, Accession NP_004648.1) is another GAM180 target gene, herein designated TARGET GENE. SDPR BINDING SITE is a target binding site found in the 5' untranslated region of mRNA encoded by SDPR, corresponding to a target binding site such as BINDING SITE I, BINDING SITE II or BINDING SITE III of FIG. 8. Table 4 illustrates the complementarity of the nucleotide sequences of SDPR BINDING SITE, designated SEQ ID:5176, to the nucleotide sequence of GAM180 RNA, herein designated GAM RNA, also designated SEQ ID:214.

Another function of GAM180 is therefore inhibition of Serum deprivation response (phosphatidylserine binding protein) (SDPR, Accession NP_004648.1), a gene which substrate for protein_kinase_C (assists in localizing PKC to invaginations of the plasma membrane. Accordingly, utilities of GAM180 include diagnosis, prevention and treatment of diseases and clinical conditions associated with SDPR.

The function of SDPR has been established by previous studies. Gustincich et al. (1999) cloned SDPR from a human liver cDNA library using the murine homolog cloned by Gustincich and Schneider (1993) as probe. The SDPR cDNA encodes a deduced 425-amino acid peptide with a calculated molecular mass of 47.2 kD. The human and mouse proteins share 84% sequence identity; both contain a leucine zipper-like domain with 7 repeats and 2 putative protein kinase C phosphorylation sites. Northern blot analysis of various human tissues showed nearly ubiquitous expression of a 3.1-kb transcript, which was always coexpressed with a shorter transcript. Highest expression was detected in heart and lung. Gustincich et al. (1999) also found that SDPR mRNA was detectable in asynchronously growing human fibroblast cells and was significantly upregulated after serum deprivation but not after density-dependent growth inhibition. Gustincich et al. (1999) determined that SDPR is the same as PS-p68, a phosphatidylserine-binding protein purified from human platelets by Burgener et al. (1990). SDPR localizes to the cytoplasm (Burgener et al., 1990; Gustincich et al., 1999). Using in vitro translation of histidine-tagged recombinant SDPR, Gustincich et al. (1999) found that SDPR is able to bind PS liposomes in a calcium-independent manner. Burgener et al. (1990) identified SDPR as the major PS-binding protein in platelets. They also found that SDPR was able to bind PKC in a cell-free assay in the presence of PS and calcium, resulting in SDPR phosphorylation.

Full details of the abovementioned studies are described in the following publications, the disclosure of which are hereby incorporated by reference:

Burgener, R.; Wolf, M.; Ganz, T.; Baggiolini, M.: Purification and characterization of a major phosphatidylserine-binding phosphoprotein from human platelets. Biochem. J. 269:729-734, 1990; and Gustincich, S.; Vatta, P.; Goruppi, S.; Wolf, M.; Saccone, S.; Della Valle, G.; Baggiolini, M.; Schneider, C.: The human serum deprivation response gene (SDPR) maps to 2q32-q33 and cod.

Further studies establishing the function and utilities of SDPR are found in John Hopkins OMIM database record ID 606728, and in cited publications listed in Table 5, which are hereby incorporated by reference. Solute carrier family 16 (monocarboxylic acid transporters), member 10 (SLC16A10, Accession NP_061063.2) is another GAM180 target gene, herein designated TARGET GENE. SLC16A10 BINDING SITE is a target binding site found in the 5' untranslated region of mRNA encoded by SLC16A10, corresponding to a target binding site such as BINDING SITE I, BINDING SITE II or BINDING SITE III of FIG. 8. Table 4 illustrates the complementarity of the nucleotide sequences of SLC16A10 BINDING SITE, designated SEQ ID:2213, to the nucleotide sequence of GAM180 RNA, herein designated GAM RNA, also designated SEQ ID:214.

Another function of GAM180 is therefore inhibition of Solute carrier family 16 (monocarboxylic acid transporters), member 10 (SLC16A10, Accession NP_061063.2). Accordingly, utilities of GAM180 include diagnosis, prevention and treatment of diseases and clinical conditions associated with SLC16A10.

Solute carrier family 4, sodium bicarbonate transporter-like, member 10 (SLC4A10, Accession NP_071341.1) is another GAM180 target gene, herein designated TARGET GENE. SLC4A10 BINDING SITE is a target binding site found in the 3' untranslated region of mRNA encoded by SLC4A10, corresponding to a target binding site such as BINDING SITE I, BINDING SITE II or BINDING SITE III of FIG. 8. Table 4 illustrates the complementarity of the nucleotide sequences of SLC4A10 BINDING SITE, designated SEQ ID:7776, to the nucleotide sequence of GAM180 RNA, herein designated GAM RNA, also designated SEQ ID:214.

Another function of GAM180 is therefore inhibition of Solute carrier family 4, sodium bicarbonate transporter-like, member 10 (SLC4A10, Accession NP_071341.1). Accordingly, utilities of GAM180 include diagnosis, prevention and treatment of diseases and clinical conditions associated with SLC4A10.

Solute carrier family 4, sodium bicarbonate cotransporter, member 5 (SLC4A5, Accession NP_201580.2) is another GAM180 target gene, herein designated TARGET GENE. SLC4A5 BINDING SITE is a target binding site found in the 3' untranslated region of multiple transcripts of mRNA encoded by SLC4A5, corresponding to a target binding site such as BINDING SITE I, BINDING SITE II or BINDING SITE III of FIG. 8. Table 4 illustrates the complementarity of the nucleotide sequences of SLC4A5 BINDING SITE, designated SEQ ID:15696, to the nucleotide sequence of GAM180 RNA, herein designated GAM RNA, also designated SEQ ID:214.

Another function of GAM180 is therefore inhibition of Solute carrier family 4, sodium bicarbonate cotransporter, member 5 (SLC4A5, Accession NP_201580.2). Accordingly, utilities of GAM180 include diagnosis, prevention and treatment of diseases and clinical conditions associated with SLC4A5.

Solute carrier family 5 (sodium/glucose cotransporter), member 2 (SLC5A2, Accession NP_003032.1) is another GAM180 target gene, herein designated TARGET GENE. SLC5A2 BINDING SITE is a target binding site found in the 3' untranslated region of mRNA encoded by SLC5A2, corresponding to a target binding site such as BINDING SITE I, BINDING SITE II or BINDING SITE III of FIG. 8. Table 4 illustrates the complementarity of the nucleotide sequences of SLC5A2 BINDING SITE, designated SEQ ID:3698, to the nucleotide sequence of GAM180 RNA, herein designated GAM RNA, also designated SEQ ID:214.

Another function of GAM180 is therefore inhibition of Solute carrier family 5 (sodium/glucose cotransporter), member 2 (SLC5A2, Accession NP_003032.1), a gene which is a sodium -glucose cotransporter. Accordingly, utilities of GAM180 include diagnosis, prevention and treatment of diseases and clinical conditions associated with SLC5A2.

The function of SLC5A2 has been established by previous studies. Wells et al. (1992) isolated from a human kidney library a cDNA with 59% amino acid similarity to intestinal Na+/glucose cotransporter (OMIM Ref. No. 182380) and with significant similarity to other members of the Na+/cotransporter family. Uptake experiments using cRNA-injected Xenopus oocytes showed specific uptake of glucose and alpha-methyl glucopyranoside at up to three times background. This uptake was saturable, suggesting that the cDNA corresponds to a low-affinity kidney sodium-glucose transporter. It was therefore referred to as sodium-glucose cotransporter 2, or SGLT2. By Southern blot analysis of genomic DNA from 16 somatic cell hybrids, Wells et al. (1993) localized the SGLT2 gene to chromosome 16. Analysis of 3 additional hybrids that selectively retained all or part of human chromosome 16 demonstrated localization of the gene to 16p11.2. Kanai et al. (1994) characterized the previously cloned (Wells et al., 1992) human kidney cDNA that codes for a protein with 59% identity to the high affinity Na(+)/glucose cotransporter (SGLT1; 182380). Using expression studies with Xenopus laevis oocytes, they demonstrated that SGLT2 mediates saturable Na(+)-dependent and phlorizin-sensitive transport with K(m) values consistent with low affinity Na(+)/ glucose cotransport. In contrast to SGLT1, SGLT2 does not transport D-galactose. Using combined in situ hybridization and immunocytochemistry with tubule segment specific marker antibodies, Kanai et al. (1994) demonstrated an extremely high level of SGLT2 message in proximal tubule S1 segments. This level of expression was also evident on Northern blots and likely confers the high capacity of this glucose transport system. Kanai et al. (1994) suggested that the defect in renal glycosuria (OMIM Ref. No. 233100) may reside in the SGLT2 gene.

Full details of the abovementioned studies are described in the following publications, the disclosure of which are hereby incorporated by reference:

Wells, R. G.; Mohandas, T. K.; Hediger, M. A.: Localization of the Na+/glucose cotransporter gene SGLT2 to human chromosome 16 close to the centromere. Genomics 17:787-789, 1993; and Kanai, Y.; Lee, W.-S.; You, G.; Brown, D.; Hediger, M. A.: The human kidney low affinity Na(+)/glucose cotransporter SGLT2: delineation of the major renal reabsorptive mechanism for D-gluc.

Further studies establishing the function and utilities of SLC5A2 are found in John Hopkins OMIM database record ID 182381, and in cited publications listed in Table 5, which are hereby incorporated by reference. Smith-magenis syndrome chromosome region, candidate 7 (SMCR7, Accession NP_631901.2) is another GAM180 target gene, herein designated TARGET GENE. SMCR7 BINDING SITE is a target binding site found in the 5' untranslated region of multiple transcripts of mRNA encoded by SMCR7, corresponding to a target binding site such as BINDING SITE I, BINDING SITE II or BINDING SITE III of FIG. 8. Table 4 illustrates the complementarity of the nucleotide sequences of SMCR7 BINDING SITE, designated SEQ ID:15179, to the nucleotide sequence of GAM180 RNA, herein designated GAM RNA, also designated SEQ ID:214.

Another function of GAM180 is therefore inhibition of Smith-magenis syndrome chromosome region, candidate 7 (SMCR7, Accession NP_631901.2). Accordingly, utilities of GAM180 include diagnosis, prevention and treatment of diseases and clinical conditions associated with SMCR7.

Smith-magenis syndrome chromosome region, candidate 7 (SMCR7, Accession NP_683684.1) is another GAM180 target gene, herein designated TARGET GENE. SMCR7 BINDING SITE is a target binding site found in the 5' untranslated region of multiple transcripts of mRNA encoded by SMCR7, corresponding to a target binding site such as BINDING SITE I, BINDING SITE II or BINDING SITE III of FIG. 8. Table 4 illustrates the complementarity of the nucleotide sequences of SMCR7 BINDING SITE, designated SEQ ID:15179, to the nucleotide sequence of GAM180 RNA, herein designated GAM RNA, also designated SEQ ID:214.

Another function of GAM180 is therefore inhibition of Smith-magenis syndrome chromosome region, candidate 7 (SMCR7, Accession NP_683684.1). Accordingly, utilities of GAM180 include diagnosis, prevention and treatment of diseases and clinical conditions associated with SMCR7.

Small muscle protein, x-linked (SMPX, Accession NP_055147.1) is another GAM180 target gene, herein designated TARGET GENE. SMPX BINDING SITE is a target binding site found in the 3' untranslated region of mRNA encoded by SMPX, corresponding to a target binding site such as BINDING SITE I, BINDING SITE II or BINDING SITE III of FIG. 8. Table 4 illustrates the complementarity of the nucleotide sequences of SMPX BINDING SITE, designated SEQ ID:15935, to the nucleotide sequence of GAM180 RNA, herein designated GAM RNA, also designated SEQ ID:214.

Another function of GAM180 is therefore inhibition of Small muscle protein, x-linked (SMPX, Accession NP_055147.1), a gene which is a novel X-chromosomal human gene. Accordingly, utilities of GAM180 include diagnosis, prevention and treatment of diseases and clinical conditions associated with SMPX.

The function of SMPX has been established by previous studies. A wide range of techniques, including differential display, the 2-hybrid system, exon trapping, and reciprocal probing, have been applied to isolate human genes for basic functional analysis or as candidates for genetic disorders. In more recent times, large scale sequencing of both the human genome and a growing number of EST libraries has provided tools to improve gene identification. Patzak et al. (1999) studied a partial cDNA clone previously identified by reciprocal probing by Lee et al. (1995). By searching expressed and genomic databases, Patzak et al. (1999) identified 21 ESTs that allowed the assignment of a human extended consensus sequence of 887 bp, suggesting a completely expressed gene termed SMPX. By using the human consensus sequence, the orthologous mouse and rat Smpx genes could be aligned and confirmed by complete sequencing of additional SMPX-related clones obtained by library screening. The human and rodent SMPX genes encode proteins of 88 to 86 and 85 amino acids, respectively. The authors found that the SMPX gene consists of 5 exons and 4 introns, comprising together 52.1 kb. Northern blot analysis revealed that SMPX is preferentially and abundantly expressed in heart and skeletal muscle. By FISH, Patzak et al. (1999) mapped the SMPX gene close to marker DXS7101, 31.9 cM from the short arm telomere of the X chromosome at Xp22.1. They confirmed this assignment by PCR on monochromosomal and subchromosomal mapping panels and by using the CEPH YAC library. The authors concluded that the expression and mapping data made SMPX a candidate for X-linked cardiac or muscle muscular disorders.

Full details of the abovementioned studies are described in the following publications, the disclosure of which are hereby incorporated by reference:

Patzak, D.; Zhuchenko, O.; Lee, C.-C.; Wehnert, M.: Identification, mapping, and genomic structure of a novel X-chromosomal human gene (SMPX) encoding a small muscular protein. Hum. Genet. 105:506-512, 1999; and Lee, C. C.; Yazdani, A.; Wehnert, M.; Zhao, Z. Y.; Lindsay, E. A.; Bailey, J.; Coolbaugh, M. I.; Couch, L.; Xiong, M.; Chinault, A. C.; Baldini, A.; Caskey, C. T.: Isolation of chromo.

Further studies establishing the function and utilities of SMPX are found in John Hopkins OMIM database record ID 300226, and in cited publications listed in Table 5, which are hereby incorporated by reference. Sclerosteosis (SOST, Accession NP_079513.1) is another GAM180 target gene, herein designated TARGET GENE. SOST BINDING SITE is a target binding site found in the 3' untranslated region of mRNA encoded by SOST, corresponding to a target binding site such as BINDING SITE I, BINDING SITE II or BINDING SITE III of FIG. 8. Table 4 illustrates the complementarity of the nucleotide sequences of SOST BINDING SITE, designated SEQ ID:5377, to the nucleotide sequence of GAM180 RNA, herein designated GAM RNA, also designated SEQ ID:214.

Another function of GAM180 is therefore inhibition of Sclerosteosis (SOST, Accession NP_079513.1). Accordingly, utilities of GAM180 include diagnosis, prevention and treatment of diseases and clinical conditions associated with SOST.

SPEC1 (Accession NP_064624.1) is another GAM180 target gene, herein designated TARGET GENE. SPEC1 BINDING SITE is a target binding site found in the 3' untranslated region of mRNA encoded by SPEC1, corresponding to a target binding site such as BINDING SITE I, BINDING SITE II or BINDING SITE III of FIG. 8. Table 4 illustrates the complementarity of the nucleotide sequences of SPEC1 BINDING SITE, designated SEQ ID:8847, to the nucleotide sequence of GAM180 RNA, herein designated GAM RNA, also designated SEQ ID:214.

Another function of GAM180 is therefore inhibition of SPEC1 (Accession NP_064624.1). Accordingly, utilities of GAM180 include diagnosis, prevention and treatment of diseases and clinical conditions associated with SPEC1.

Syntaxin 16 (STX16, Accession NP_003754.1) is another GAM180 target gene, herein designated TARGET GENE. STX16 BINDING SITE is a target binding site found in the 5' untranslated region of mRNA encoded by STX16, corresponding to a target binding site such as BINDING SITE I, BINDING SITE II or BINDING SITE III of FIG. 8. Table 4 illustrates the complementarity of the nucleotide sequences of STX16 BINDING SITE, designated SEQ ID:8099, to the nucleotide sequence of GAM180 RNA, herein designated GAM RNA, also designated SEQ ID:214.

Another function of GAM180 is therefore inhibition of Syntaxin 16 (STX16, Accession NP_003754.1). Accordingly, utilities of GAM180 include diagnosis, prevention and treatment of diseases and clinical conditions associated with STX16.

Syntaxin 3a (STX3A, Accession NP_004168.1) is another GAM180 target gene, herein designated TARGET GENE. STX3A BINDING SITE is a target binding site found in the 3' untranslated region of mRNA encoded by STX3A, corresponding to a target binding site such as BINDING SITE I, BINDING SITE II or BINDING SITE III of FIG. 8. Table 4 illustrates the complementarity of the nucleotide sequences of STX3A BINDING SITE, designated SEQ ID:15455, to the nucleotide sequence of GAM180 RNA, herein designated GAM RNA, also designated SEQ ID:214.

Another function of GAM180 is therefore inhibition of Syntaxin 3a (STX3A, Accession NP_004168.1). Accordingly, utilities of GAM180 include diagnosis, prevention and treatment of diseases and clinical conditions associated with STX3A.

Surfeit 5 (SURF5, Accession NP_852468.1) is another GAM180 target gene, herein designated TARGET GENE. SURF5 BINDING SITE is a target binding site found in the 3' untranslated region of multiple transcripts of mRNA encoded by SURF5, corresponding to a target binding site such as BINDING SITE I, BINDING SITE II or BINDING SITE III of FIG. 8. Table 4 illustrates the complementarity of the nucleotide sequences of SURF5 BINDING SITE, designated SEQ ID:4742, to the nucleotide sequence of GAM180 RNA, herein designated GAM RNA, also designated SEQ ID:214.

Another function of GAM180 is therefore inhibition of Surfeit 5 (SURF5, Accession NP_852468.1). Accordingly, utilities of GAM180 include diagnosis, prevention and treatment of diseases and clinical conditions associated with SURF5.

Transcription factor 4 (TCF4, Accession NP_003190.1) is another GAM180 target gene, herein designated TARGET GENE. TCF4 BINDING SITE is a target binding site found in the 3' untranslated region of mRNA encoded by TCF4, corresponding to a target binding site such as BINDING SITE I, BINDING SITE II or BINDING SITE III of FIG. 8. Table 4 illustrates the complementarity of the nucleotide sequences of TCF4 BINDING SITE, designated SEQ ID:12785, to the nucleotide sequence of GAM180 RNA, herein designated GAM RNA, also designated SEQ ID:214.

Another function of GAM180 is therefore inhibition of Transcription factor 4 (TCF4, Accession NP_003190.1), a gene which is a transcriptional activator; interacts with ITF1 (TCF3); and contains basic helix-loop-helix domain. Accordingly, utilities of GAM180 include diagnosis, prevention and treatment of diseases and clinical conditions associated with TCF4.

The function of TCF4 has been established by previous studies. The high mobility group (HMG) box is a DNA-binding domain. TCF7 (OMIM Ref. No. 189908), also called TCF1, and LEF1 (OMIM Ref. No. 153245), also called TCF1-alpha, are human lymphoid transcription factors that contain a virtually identical HMG box. By PCR of human genomic DNA using degenerate oligonucleotides based on the HMG boxes of TCF7 and LEF1, Castrop et al. (1992) identified the TCF7L1 (OMIM Ref. No. 604652) and TCF7L2 genes, which they called TCF3 and TCF4, respectively. TCF7L1 and TCF7L2 were not expressed in cells of the lymphoid lineage. The deduced amino acid sequences of the HMG boxes of TCF7L1, TCF7L2, and TCF7 show striking homology. The authors suggested the existence of a subfamily of TCF7-like HMG box-containing transcription factors.

Animal model experiments lend further support to the function of TCF4. To study the physiologic role of Tcf4 (which is encoded by the Tcf7l2 gene), Korinek et al. (1998) disrupted Tcf7l2 by homologous recombination. The homozygous null mice died shortly after birth. A single histopathologic abnormality was observed. An apparently normal transition of intestinal endoderm into epithelium occurred at approximately embryonic day (E) 14.5. However, no proliferative compartments were maintained in the prospective crypt regions between the villi. As a consequence, the neonatal epithelium was composed entirely of differentiated, nondividing villus cells. Korinek et al. (1998) concluded that the genetic program controlled by Tcf7l2 maintains the crypt stem cells of the small intestine. The constitutive activity of Tcf4 in APC-deficient epithelial cells may contribute to their malignant transformation by maintaining stem cell characteristics.

It is appreciated that the abovementioned animal model for TCF4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Castrop, J.; van Norren, K.; Clevers, H.: A gene family of HMG-box transcription factors with homology to TCF-1. Nucleic Acids Res. 20:611 only, 1992; and Korinek, V.; Barker, N.; Moerer, P.; van Donselaar, E.; Huls, G.; Peters, P. J.; Clevers, H.: Depletion of epithelial stem-cell compartments in the small intestine of mice lacking Tcf-4.

Further studies establishing the function and utilities of TCF4 are found in John Hopkins OMIM database record ID 602228, and in cited publications listed in Table 5, which are hereby incorporated by reference. Tgfb1-induced anti-apoptotic factor 1 (TIAF1, Accession NP_510880.2) is another GAM180 target gene, herein designated TARGET GENE. TIAF1 BINDING SITE is a target binding site found in the 3' untranslated region of multiple transcripts of mRNA encoded by TIAF1, corresponding to a target binding site such as BINDING SITE I, BINDING SITE II or BINDING SITE III of FIG. 8. Table 4 illustrates the complementarity of the nucleotide sequences of TIAF1 BINDING SITE, designated SEQ ID:16174, to the nucleotide sequence of GAM180 RNA, herein designated GAM RNA, also designated SEQ ID:214.

Another function of GAM180 is therefore inhibition of Tgfb1-induced anti-apoptotic factor 1 (TIAF1, Accession NP_510880.2). Accordingly, utilities of GAM180 include diagnosis, prevention and treatment of diseases and clinical conditions associated with TIAF1.

Transmembrane, prostate androgen induced rna (TMEPAI, Accession NP_064567.2) is another GAM180 target gene, herein designated TARGET GENE. TMEPAI BINDING SITE is a target binding site found in the 3' untranslated region of mRNA encoded by TMEPAI, corresponding to a target binding site such as BINDING SITE I, BINDING SITE II or BINDING SITE III of FIG. 8. Table 4 illustrates the complementarity of the nucleotide sequences of TMEPAI BINDING SITE, designated SEQ ID:10288, to the nucleotide sequence of GAM180 RNA, herein designated GAM RNA, also designated SEQ ID:214.

Another function of GAM180 is therefore inhibition of Transmembrane, prostate androgen induced rna (TMEPAI, Accession NP_064567.2). Accordingly, utilities of GAM180 include diagnosis, prevention and treatment of diseases and clinical conditions associated with TMEPAI.

Trinucleotide repeat containing 5 (TNRC5, Accession NP_006577.1) is another GAM180 target gene, herein designated TARGET GENE. TNRC5 BINDING SITE is a target binding site found in the 5' untranslated region of mRNA encoded by TNRC5, corresponding to a target binding site such as BINDING SITE I, BINDING SITE II or BINDING SITE III of FIG. 8. Table 4 illustrates the complementarity of the nucleotide sequences of TNRC5 BINDING SITE, designated SEQ ID:1159, to the nucleotide sequence of GAM180 RNA, herein designated GAM RNA, also designated SEQ ID:214.

Another function of GAM180 is therefore inhibition of Trinucleotide repeat containing 5 (TNRC5, Accession NP_006577.1). Accordingly, utilities of GAM180 include diagnosis, prevention and treatment of diseases and clinical conditions associated with TNRC5.

Topoisomerase (dna) ii alpha 170 kda (TOP2A, Accession NP_001058.2) is another GAM180 target gene, herein designated TARGET GENE. TOP2A BINDING SITE is a target binding site found in the 3' untranslated region of mRNA encoded by TOP2A, corresponding to a target binding site such as BINDING SITE I, BINDING SITE II or BINDING SITE III of FIG. 8. Table 4 illustrates the complementarity of the nucleotide sequences of TOP2A BINDING SITE, designated SEQ ID:12252, to the nucleotide sequence of GAM180 RNA, herein designated GAM RNA, also designated SEQ ID:214.

Another function of GAM180 is therefore inhibition of Topoisomerase (dna) ii alpha 170 kda (TOP2A, Accession NP_001058.2). Accordingly, utilities of GAM180 include diagnosis, prevention and treatment of diseases and clinical conditions associated with TOP2A.

TP53I11 (Accession XP_029347.6) is another GAM180 target gene, herein designated TARGET GENE. TP53I11 BINDING SITE is a target binding site found in the 3' untranslated region of multiple transcripts of mRNA encoded by TP53I11, corresponding to a target binding site such as BINDING SITE I, BINDING SITE II or BINDING SITE III of FIG. 8. Table 4 illustrates the complementarity of the nucleotide sequences of TP53I11 BINDING SITE, designated SEQ ID:9520, to the nucleotide sequence of GAM180 RNA, herein designated GAM RNA, also designated SEQ ID:214.

Another function of GAM180 is therefore inhibition of TP53I11 (Accession XP_029347.6). Accordingly, utilities of GAM180 include diagnosis, prevention and treatment of diseases and clinical conditions associated with TP53I11.

TRIAD3 (Accession NP_061884.2) is another GAM180 target gene, herein designated TARGET GENE. TRIAD3 BINDING SITE is a target binding site found in the 3' untranslated region of mRNA encoded by TRIAD3, corresponding to a target binding site such as BINDING SITE I, BINDING SITE II or BINDING SITE III of FIG. 8. Table 4 illustrates the complementarity of the nucleotide sequences of TRIAD3 BINDING SITE, designated SEQ ID:18793, to the nucleotide sequence of GAM180 RNA, herein designated GAM RNA, also designated SEQ ID:214.

Another function of GAM180 is therefore inhibition of TRIAD3 (Accession NP_061884.2). Accordingly, utilities of GAM180 include diagnosis, prevention and treatment of diseases and clinical conditions associated with TRIAD3.

Upstream binding protein 1 (lbp-1a) (UBP1, Accession NP_055332.2) is another GAM180 target gene, herein designated TARGET GENE. UBP1 BINDING SITE is a target binding site found in the 3' untranslated region of mRNA encoded by UBP1, corresponding to a target binding site such as BINDING SITE I, BINDING SITE II or BINDING SITE III of FIG. 8. Table 4 illustrates the complementarity of the nucleotide sequences of UBP1 BINDING SITE, designated SEQ ID:3862, to the nucleotide sequence of GAM180 RNA, herein designated GAM RNA, also designated SEQ ID:214.

Another function of GAM180 is therefore inhibition of Upstream binding protein 1 (lbp-1a) (UBP1, Accession NP_055332.2). Accordingly, utilities of GAM180 include diagnosis, prevention and treatment of diseases and clinical conditions associated with UBP1.

UNC5H2 (Accession NP_734465.1) is another GAM180 target gene, herein designated TARGET GENE. UNC5H2 BINDING SITE is a target binding site found in the 3' untranslated region of mRNA encoded by UNC5H2, corresponding to a target binding site such as BINDING SITE I, BINDING SITE II or BINDING SITE III of FIG. 8. Table 4 illustrates the complementarity of the nucleotide sequences of UNC5H2 BINDING SITE, designated SEQ ID:7676, to the nucleotide sequence of GAM180 RNA, herein designated GAM RNA, also designated SEQ ID:214.

Another function of GAM180 is therefore inhibition of UNC5H2 (Accession NP_734465.1). Accordingly, utilities of GAM180 include diagnosis, prevention and treatment of diseases and clinical conditions associated with UNC5H2.

VPS39 (Accession XP_031720.2) is another GAM180 target gene, herein designated TARGET GENE. VPS39 BINDING SITE is a target binding site found in the 3' untranslated region of mRNA encoded by VPS39, corresponding to a target binding site such as BINDING SITE I, BINDING SITE II or BINDING SITE III of FIG. 8. Table 4 illustrates the complementarity of the nucleotide sequences of VPS39 BINDING SITE, designated SEQ ID:1316, to the nucleotide sequence of GAM180 RNA, herein designated GAM RNA, also designated SEQ ID:214.

Another function of GAM180 is therefore inhibition of VPS39 (Accession XP_031720.2). Accordingly, utilities of GAM180 include diagnosis, prevention and treatment of diseases and clinical conditions associated with VPS39.

WDFY2 (Accession NP_443182.1) is another GAM180 target gene, herein designated TARGET GENE. WDFY2 BINDING SITE is a target binding site found in the 3' untranslated region of mRNA encoded by WDFY2, corresponding to a target binding site such as BINDING SITE I, BINDING SITE II or BINDING SITE III of FIG. 8. Table 4 illustrates the complementarity of the nucleotide sequences of WDFY2 BINDING SITE, designated SEQ ID:575, to the nucleotide sequence of GAM180 RNA, herein designated GAM RNA, also designated SEQ ID:214.

Another function of GAM180 is therefore inhibition of WDFY2 (Accession NP_443182.1). Accordingly, utilities of GAM180 include diagnosis, prevention and treatment of diseases and clinical conditions associated with WDFY2.

XT3 (Accession NP_071800.1) is another GAM180 target gene, herein designated TARGET GENE. XT3 BINDING SITE is a target binding site found in the 3' untranslated region of multiple transcripts of mRNA encoded by XT3, corresponding to a target binding site such as BINDING SITE I, BINDING SITE II or BINDING SITE III of FIG. 8. Table 4 illustrates the complementarity of the nucleotide sequences of XT3 BINDING SITE, designated SEQ ID:1554, to the nucleotide sequence of GAM180 RNA, herein designated GAM RNA, also designated SEQ ID:214.

Another function of GAM180 is therefore inhibition of XT3 (Accession NP_071800.1), a gene which is a Kidney-specific orphan transporter. Accordingly, utilities of GAM180 include diagnosis, prevention and treatment of diseases and clinical conditions associated with XT3.

The function of XT3 and its association with various diseases and clinical conditions, has been established by previous studies, as described hereinabove with reference to GAM66.1. XT3 (Accession NP_064593.1) is another GAM180 target gene, herein designated TARGET GENE. XT3 BINDING SITE is a target binding site found in the 3' untranslated region of multiple transcripts of mRNA encoded by XT3, corresponding to a target binding site such as BINDING SITE I, BINDING SITE II or BINDING SITE III of FIG. 8. Table 4 illustrates the complementarity of the nucleotide sequences of XT3 BINDING SITE, designated SEQ ID:1554, to the nucleotide sequence of GAM180 RNA, herein designated GAM RNA, also designated SEQ ID:214.

Another function of GAM180 is therefore inhibition of XT3 (Accession NP_064593.1), a gene which is a Kidney-specific orphan transporter. Accordingly, utilities of GAM180 include diagnosis, prevention and treatment of diseases and clinical conditions associated with XT3.

The function of XT3 and its association with various diseases and clinical conditions, has been established by previous studies, as described hereinabove with reference to GAM66.1. Zonadhesin (ZAN, Accession NP_775078.1) is another GAM180 target gene, herein designated TARGET GENE. ZAN BINDING SITE is a target binding site found in the 3' untranslated region of multiple transcripts of mRNA encoded by ZAN, corresponding to a target binding site such as BINDING SITE I, BINDING SITE II or BINDING SITE III of FIG. 8. Table 4 illustrates the complementarity of the nucleotide sequences of ZAN BINDING SITE, designated SEQ ID:17735, to the nucleotide sequence of GAM180 RNA, herein designated GAM RNA, also designated SEQ ID:214.

Another function of GAM180 is therefore inhibition of Zonadhesin (ZAN, Accession NP_775078.1). Accordingly, utilities of GAM180 include diagnosis, prevention and treatment of diseases and clinical conditions associated with ZAN.

Zonadhesin (ZAN, Accession NP_775079.1) is another GAM180 target gene, herein designated TARGET GENE. ZAN BINDING SITE is a target binding site found in the 3' untranslated region of multiple transcripts of mRNA encoded by ZAN, corresponding to a target binding site such as BINDING SITE I, BINDING SITE II or BINDING SITE III of FIG. 8. Table 4 illustrates the complementarity of the nucleotide sequences of ZAN BINDING SITE, designated SEQ ID:17735, to the nucleotide sequence of GAM180 RNA, herein designated GAM RNA, also designated SEQ ID:214.

Another function of GAM180 is therefore inhibition of Zonadhesin (ZAN, Accession NP_775079.1). Accordingly, utilities of GAM180 include diagnosis, prevention and treatment of diseases and clinical conditions associated with ZAN.

Zonadhesin (ZAN, Accession NP_775080.1) is another GAM180 target gene, herein designated TARGET GENE. ZAN BINDING SITE is a target binding site found in the 3' untranslated region of multiple transcripts of mRNA encoded by ZAN, corresponding to a target binding site such as BINDING SITE I, BINDING SITE II or BINDING SITE III of FIG. 8. Table 4 illustrates the complementarity of the nucleotide sequences of ZAN BINDING SITE, designated SEQ ID:17735, to the nucleotide sequence of GAM180 RNA, herein designated GAM RNA, also designated SEQ ID:214.

Another function of GAM180 is therefore inhibition of Zonadhesin (ZAN, Accession NP_775080.1). Accordingly, utilities of GAM180 include diagnosis, prevention and treatment of diseases and clinical conditions associated with ZAN.

Zonadhesin (ZAN, Accession NP_775081.1) is another GAM180 target gene, herein designated TARGET GENE. ZAN BINDING SITE is a target binding site found in the 3' untranslated region of multiple transcripts of mRNA encoded by ZAN, corresponding to a target binding site such as BINDING SITE I, BINDING SITE II or BINDING SITE III of FIG. 8. Table 4 illustrates the complementarity of the nucleotide sequences of ZAN BINDING SITE, designated SEQ ID:17735, to the nucleotide sequence of GAM180 RNA, herein designated GAM RNA, also designated SEQ ID:214.

Another function of GAM180 is therefore inhibition of Zonadhesin (ZAN, Accession NP_775081.1). Accordingly, utilities of GAM180 include diagnosis, prevention and treatment of diseases and clinical conditions associated with ZAN.

Zinc finger protein 235 (ZNF235, Accession NP_004225.2) is another GAM180 target gene, herein designated TARGET GENE. ZNF235 BINDING SITE is a target binding site found in the 5' untranslated region of mRNA encoded by ZNF235, corresponding to a target binding site such as BINDING SITE I, BINDING SITE II or BINDING SITE III of FIG. 8. Table 4 illustrates the complementarity of the nucleotide sequences of ZNF235 BINDING SITE, designated SEQ ID:12391, to the nucleotide sequence of GAM180 RNA, herein designated GAM RNA, also designated SEQ ID:214.

Another function of GAM180 is therefore inhibition of Zinc finger protein 235 (ZNF235, Accession NP_004225.2). Accordingly, utilities of GAM180 include diagnosis, prevention and treatment of diseases and clinical conditions associated with ZNF235.

Zinc finger protein 258 (ZNF258, Accession NP_009098.1) is another GAM180 target gene, herein designated TARGET GENE. ZNF258 BINDING SITE is a target binding site found in the 5' untranslated region of multiple transcripts of mRNA encoded by ZNF258, corresponding to a target binding site such as BINDING SITE I, BINDING SITE II or BINDING SITE III of FIG. 8. Table 4 illustrates the complementarity of the nucleotide sequences of ZNF258 BINDING SITE, designated SEQ ID:8831, to the nucleotide sequence of GAM180 RNA, herein designated GAM RNA, also designated SEQ ID:214.

Another function of GAM180 is therefore inhibition of Zinc finger protein 258 (ZNF258, Accession NP_009098.1). Accordingly, utilities of GAM180 include diagnosis, prevention and treatment of diseases and clinical conditions associated with ZNF258.

Zinc finger protein 258 (ZNF258, Accession NP_660353.1) is another GAM180 target gene, herein designated TARGET GENE. ZNF258 BINDING SITE is a target binding site found in the 5' untranslated region of multiple transcripts of mRNA encoded by ZNF258, corresponding to a target binding site such as BINDING SITE I, BINDING SITE II or BINDING SITE III of FIG. 8. Table 4 illustrates the complementarity of the nucleotide sequences of ZNF258 BINDING SITE, designated SEQ ID:8831, to the nucleotide sequence of GAM180 RNA, herein designated GAM RNA, also designated SEQ ID:214.

Another function of GAM180 is therefore inhibition of Zinc finger protein 258 (ZNF258, Accession NP_660353.1). Accordingly, utilities of GAM180 include diagnosis, prevention and treatment of diseases and clinical conditions associated with ZNF258.

Zinc finger protein 347 (ZNF347, Accession NP_115973.1) is another GAM180 target gene, herein designated TARGET GENE. ZNF347 BINDING SITE is a target binding site found in the 3' untranslated region of mRNA encoded by ZNF347, corresponding to a target binding site such as BINDING SITE I, BINDING SITE II or BINDING SITE III of FIG. 8. Table 4 illustrates the complementarity of the nucleotide sequences of ZNF347 BINDING SITE, designated SEQ ID:7083, to the nucleotide sequence of GAM180 RNA, herein designated GAM RNA, also designated SEQ ID:214.

Another function of GAM180 is therefore inhibition of Zinc finger protein 347 (ZNF347, Accession NP_115973.1). Accordingly, utilities of GAM180 include diagnosis, prevention and treatment of diseases and clinical conditions associated with ZNF347.

FIG. 8 further provides a conceptual description of a novel bioinformatically detected of the present invention, referred to here as Genomic Address Messenger 181 (GAM181), which modulates expression of respective target genes thereof, the function and utility of which target genes is known in the art.

GAM181 is a novel bioinformatically detected regulatory, non protein coding, micro RNA (miRNA) gene. The method by which GAM181 was detected is described hereinabove with reference to FIGS. 8-15.

GAM181 gene, herein designated GAM GENE, and GAM181 target gene, herein designated TARGET GENE, are human genes contained in the human genome.

GAM181 gene encodes a GAM181 precursor RNA, herein designated GAM PRECURSOR RNA. Similar to other miRNA genes, and unlike most ordinary genes, GAM181 precursor RNA does not encode a protein. A nucleotide sequence identical or highly similar to the nucleotide sequence of GAM181 precursor RNA is designated SEQ ID:35, and is provided hereinbelow with reference to the sequence listing part.

GAM181 precursor RNA folds onto itself, forming GAM181 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM181 precursor RNA folds onto itself, forming GAM181 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM181 precursor RNA, designated SEQ-ID:35, and a schematic representation of a predicted secondary folding of GAM181 folded precursor RNA are further described with reference to Table 2, hereby incorporated by reference.

An enzyme complex designated DICER COMPLEX, 'dices' the GAM181 folded precursor RNA into GAM181 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM181 RNA is designated SEQ ID:395, and is provided hereinbelow with references to the sequence listing part and Table 3, hereby incorporated by reference.

GAM181 target gene, herein designated TARGET GENE, encodes a corresponding messenger RNA, GAM181 target RNA, herein designated GAM TARGET RNA. GAM181 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM181 RNA, herein designated GAM RNA, binds complementarily to one or more target binding sites located in untranslated regions of GAM181 target RNA, herein designated GAM TARGET RNA. This complementary binding is due to the fact that the nucleotide sequence of GAM181 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM181 RNA may have a different number of target binding sites in untranslated regions of a GAM181 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM181 RNA, herein designated GAM RNA, to target binding sites on GAM181 target RNA, herein designated GAM TARGET RNA, such as BINDING SITE I, BINDING SITE II and BINDING SITE III, inhibits translation of GAM181 target RNA into GAM181 target protein, herein designated GAM TARGET PROTEIN. GAM target protein is therefore outlined by a broken line.

It is appreciated that GAM181 target gene, herein designated TARGET GENE, in fact represents a plurality of GAM181 target genes. The mRNA of each one of this plurality of GAM181 target genes comprises one or more target binding sites, each having a nucleotide sequence which is at least partly complementary to GAM181 RNA, herein designated GAM RNA, and which when bound by GAM181 RNA causes inhibition of translation of respective one or more GAM181 target proteins.

It is further appreciated by one skilled in the art that the mode of translational inhibition illustrated by FIG. 8 with specific reference to translational inhibition exerted by GAM181 gene, herein designated GAM GENE, on one or more GAM181 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM181 correlate with, and may be deduced from, the identity of the target genes which GAM181 binds and inhibits, and the function of these target genes, as elaborated hereinbelow.

LOC200197 (Accession XM_114148.1) is a GAM181 target gene, herein designated TARGET GENE. LOC200197 BINDING SITE is a target binding site found in the 3' untranslated region of mRNA encoded by LOC200197, corresponding to a target binding site such as BINDING SITE I, BINDING SITE II or BINDING SITE III of FIG. 8. Table 4 illustrates the complementarity of the nucleotide sequences of LOC200197 BINDING SITE, designated SEQ ID:17783, to the nucleotide sequence of GAM181 RNA, herein designated GAM RNA, also designated SEQ ID:395.

A function of GAM181 is therefore inhibition of LOC200197 (Accession XM_114148.1). Accordingly, utilities of GAM181 include diagnosis, prevention and treatment of diseases and clinical conditions associated with LOC200197.

LOC90906 (Accession XM_034809.1) is another GAM181 target gene, herein designated TARGET GENE. LOC90906 BINDING SITE is a target binding site found in the 3' untranslated region of mRNA encoded by LOC90906, corresponding to a target binding site such as BINDING SITE I, BINDING SITE II or BINDING SITE III of FIG. 8. Table 4 illustrates the complementarity of the nucleotide sequences of LOC90906 BINDING SITE, designated SEQ ID:2635, to the nucleotide sequence of GAM181 RNA, herein designated GAM RNA, also designated SEQ ID:395.

Another function of GAM181 is therefore inhibition of LOC90906 (Accession XM_034809.1). Accordingly, utilities of GAM181 include diagnosis, prevention and treatment of diseases and clinical conditions associated with LOC90906.

LOC91137 (Accession NM_138773.1) is another GAM181 target gene, herein designated TARGET GENE. LOC91137 BINDING SITE is a target binding site found in the 3' untranslated region of mRNA encoded by LOC91137, corresponding to a target binding site such as BINDING SITE I, BINDING SITE II or BINDING SITE III of FIG. 8. Table 4 illustrates the complementarity of the nucleotide sequences of LOC91137 BINDING SITE, designated SEQ ID:17149, to the nucleotide sequence of GAM181 RNA, herein designated GAM RNA, also designated SEQ ID:395.

Another function of GAM181 is therefore inhibition of LOC91137 (Accession NM_138773.1). Accordingly, utilities of GAM181 include diagnosis, prevention and treatment of diseases and clinical conditions associated with LOC91137.

NET-5 (Accession NM_006675.2) is another GAM181 target gene, herein designated TARGET GENE. NET-5 BINDING SITE is a target binding site found in the 3' untranslated region of mRNA encoded by NET-5, corresponding to a target binding site such as BINDING SITE I, BINDING SITE II or BINDING SITE III of FIG. 8. Table 4 illustrates the complementarity of the nucleotide sequences of NET-5 BINDING SITE, designated SEQ ID:464, to the nucleotide sequence of GAM181 RNA, herein designated GAM RNA, also designated SEQ ID:395.

Another function of GAM181 is therefore inhibition of NET-5 (Accession NM_006675.2). Accordingly, utilities of GAM181 include diagnosis, prevention and treatment of diseases and clinical conditions associated with NET-5.

SIMRP7 (Accession) is another GAM181 target gene, herein designated TARGET GENE. SIMRP7 BINDING SITE is a target binding site found in the 3' untranslated region of mRNA encoded by SIMRP7, corresponding to a target binding site such as BINDING SITE I, BINDING SITE II or BINDING SITE III of FIG. 8. Table 4 illustrates the complementarity of the nucleotide sequences of SIMRP7 BINDING SITE, designated SEQ ID:9314, to the nucleotide sequence of GAM181 RNA, herein designated GAM RNA, also designated SEQ ID:395.

Another function of GAM181 is therefore inhibition of SIMRP7 (Accession). Accordingly, utilities of GAM181 include diagnosis, prevention and treatment of diseases and clinical conditions associated with SIMRP7.

FIG. 8 further provides a conceptual description of a novel bioinformatically detected of the present invention, referred to here as Genomic Address Messenger 182 (GAM182), which modulates expression of respective target genes thereof, the function and utility of which target genes is known in the art.

GAM182 is a novel bioinformatically detected regulatory, non protein coding, micro RNA (miRNA) gene. The method by which GAM182 was detected is described hereinabove with reference to FIGS. 8-15.

GAM182 gene, herein designated GAM GENE, and GAM182 target gene, herein designated TARGET GENE, are human genes contained in the human genome.

GAM182 gene encodes a GAM182 precursor RNA, herein designated GAM PRECURSOR RNA. Similar to other miRNA genes, and unlike most ordinary genes, GAM182 precursor RNA does not encode a protein. A nucleotide sequence identical or highly similar to the nucleotide sequence of GAM182 precursor RNA is designated SEQ ID:144, and is provided hereinbelow with reference to the sequence listing part. Nucleotide sequence SEQ ID:144 is located at position 1427020 relative to chromosome 16.

GAM182 precursor RNA folds onto itself, forming GAM182 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM182 precursor RNA folds onto itself, forming GAM182 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM182 precursor RNA, designated SEQ-ID:144, and a schematic representation of a predicted secondary folding of GAM182 folded precursor RNA are further described with reference to Table 2, hereby incorporated by reference.

An enzyme complex designated DICER COMPLEX, 'dices' the GAM182 folded precursor RNA into GAM182 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM182 RNA is designated SEQ ID:307, and is provided hereinbelow with references to the sequence listing part and Table 3, hereby incorporated by reference.

GAM182 target gene, herein designated TARGET GENE, encodes a corresponding messenger RNA, GAM182 target RNA, herein designated GAM TARGET RNA. GAM182 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM182 RNA, herein designated GAM RNA, binds complementarily to one or more target binding sites located in untranslated regions of GAM182 target RNA, herein designated GAM TARGET RNA. This complementary binding is due to the fact that the nucleotide sequence of GAM182 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM182 RNA may have a different number of target binding sites in untranslated regions of a GAM182 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM182 RNA, herein designated GAM RNA, to target binding sites on GAM182 target RNA, herein designated GAM TARGET RNA, such as BINDING SITE I, BINDING SITE II and BINDING SITE III, inhibits translation of GAM182 target RNA into GAM182 target protein, herein designated GAM TARGET PROTEIN. GAM target protein is therefore outlined by a broken line.

It is appreciated that GAM182 target gene, herein designated TARGET GENE, in fact represents a plurality of GAM182 target genes. The mRNA of each one of this plurality of GAM182 target genes comprises one or more target binding sites, each having a nucleotide sequence which is at least partly complementary to GAM182 RNA, herein designated GAM RNA, and which when bound by GAM182 RNA causes inhibition of translation of respective one or more GAM182 target proteins.

It is further appreciated by one skilled in the art that the mode of translational inhibition illustrated by FIG. 8 with specific reference to translational inhibition exerted by GAM182 gene, herein designated GAM GENE, on one or more GAM182 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM182 correlate with, and may be deduced from, the identity of the target genes which GAM182 binds and inhibits, and the function of these target genes, as elaborated hereinbelow.

AF020591 (Accession NM_014480.1) is a GAM182 target gene, herein designated TARGET GENE. AF020591 BINDING SITE is a target binding site found in the 3' untranslated region of mRNA encoded by AF020591, corresponding to a target binding site such as BINDING SITE I, BINDING SITE II or BINDING SITE III of FIG. 8. Table 4 illustrates the complementarity of the nucleotide sequences of AF020591 BINDING SITE, designated SEQ ID:19423, to the nucleotide sequence of GAM182 RNA, herein designated GAM RNA, also designated SEQ ID:307.

A function of GAM182 is therefore inhibition of AF020591 (Accession NM_014480.1). Accordingly, utilities of GAM182 include diagnosis, prevention and treatment of diseases and clinical conditions associated with AF020591.

CASKIN1 (Accession NM_020764.1) is another GAM182 target gene, herein designated TARGET GENE. CASKIN1 BINDING SITE is a target binding site found in the 3' untranslated region of mRNA encoded by CASKIN1, corresponding to a target binding site such as BINDING SITE I, BINDING SITE II or BINDING SITE III of FIG. 8. Table 4 illustrates the complementarity of the nucleotide sequences of CASKIN1 BINDING SITE, designated SEQ ID:7419, to the nucleotide sequence of GAM182 RNA, herein designated GAM RNA, also designated SEQ ID:307.

Another function of GAM182 is therefore inhibition of CASKIN1 (Accession NM_020764.1). Accordingly, utilities of GAM182 include diagnosis, prevention and treatment of diseases and clinical conditions associated with CASKIN1.

KIAA0565 (Accession XM_039912.4) is another GAM182 target gene, herein designated TARGET GENE. KIAA0565 BINDING SITE is a target binding site found in the 3' untranslated region of mRNA encoded by KIAA0565, corresponding to a target binding site such as BINDING SITE I, BINDING SITE II or BINDING SITE III of FIG. 8. Table 4 illustrates the complementarity of the nucleotide sequences of KIAA0565 BINDING SITE, designated SEQ ID:19085, to the nucleotide sequence of GAM182 RNA, herein designated GAM RNA, also designated SEQ ID:307.

Another function of GAM182 is therefore inhibition of KIAA0565 (Accession XM_039912.4). Accordingly, utilities of GAM182 include diagnosis, prevention and treatment of diseases and clinical conditions associated with KIAA0565.

Lim domain binding 3 (LDB3, Accession XM_084376.6) is another GAM182 target gene, herein designated TARGET GENE. LDB3 BINDING SITE is a target binding site found in the 3' untranslated region of mRNA encoded by LDB3, corresponding to a target binding site such as BINDING SITE I, BINDING SITE II or BINDING SITE III of FIG. 8. Table 4 illustrates the complementarity of the nucleotide sequences of LDB3 BINDING SITE, designated SEQ ID:3284, to the nucleotide sequence of GAM182 RNA, herein designated GAM RNA, also designated SEQ ID:307.

Another function of GAM182 is therefore inhibition of Lim domain binding 3 (LDB3, Accession XM_084376.6), a gene which could play a role during mating. Accordingly, utilities of GAM182 include diagnosis, prevention and treatment of diseases and clinical conditions associated with LDB3.

The function of LDB3 and its association with various diseases and clinical conditions, has been established by previous studies, as described hereinabove with reference to GAM40.1. LOC124470 (Accession) is another GAM182 target gene, herein designated TARGET GENE. LOC124470 BINDING SITE is a target binding site found in the 3' untranslated region of mRNA encoded by LOC124470, corresponding to a target binding site such as BINDING SITE I, BINDING SITE II or BINDING SITE III of FIG. 8. Table 4 illustrates the complementarity of the nucleotide sequences of LOC124470 BINDING SITE, designated SEQ ID:12795, to the nucleotide sequence of GAM182 RNA, herein designated GAM RNA, also designated SEQ ID:307.

Another function of GAM182 is therefore inhibition of LOC124470 (Accession). Accordingly, utilities of GAM182 include diagnosis, prevention and treatment of diseases and clinical conditions associated with LOC124470.

LOC256207 (Accession) is another GAM182 target gene, herein designated TARGET GENE. LOC256207 BINDING SITE is a target binding site found in the 3' untranslated region of mRNA encoded by LOC256207, corresponding to a target binding site such as BINDING SITE I, BINDING SITE II or BINDING SITE III of FIG. 8. Table 4 illustrates the complementarity of the nucleotide sequences of LOC256207 BINDING SITE, designated SEQ ID:2860, to the nucleotide sequence of GAM182 RNA, herein designated GAM RNA, also designated SEQ ID:307.

Another function of GAM182 is therefore inhibition of LOC256207 (Accession). Accordingly, utilities of GAM182 include diagnosis, prevention and treatment of diseases and clinical conditions associated with LOC256207.

SCYA19 (Accession) is another GAM182 target gene, herein designated TARGET GENE. SCYA19 BINDING SITE is a target binding site found in the 3' untranslated region of mRNA encoded by SCYA19, corresponding to a target binding site such as BINDING SITE I, BINDING SITE II or BINDING SITE III of FIG. 8. Table 4 illustrates the complementarity of the nucleotide sequences of SCYA19 BINDING SITE, designated SEQ ID:10974, to the nucleotide sequence of GAM182 RNA, herein designated GAM RNA, also designated SEQ ID:307.

Another function of GAM182 is therefore inhibition of SCYA19 (Accession). Accordingly, utilities of GAM182 include diagnosis, prevention and treatment of diseases and clinical conditions associated with SCYA19.

Transforming growth factor, alpha (TGFA, Accession NM_003236.1) is another GAM182 target gene, herein designated TARGET GENE. TGFA BINDING SITE is a target binding site found in the 3' untranslated region of mRNA encoded by TGFA, corresponding to a target binding site such as BINDING SITE I, BINDING SITE II or BINDING SITE III of FIG. 8. Table 4 illustrates the complementarity of the nucleotide sequences of TGFA BINDING SITE, designated SEQ ID:9112, to the nucleotide sequence of GAM182 RNA, herein designated GAM RNA, also designated SEQ ID:307.

Another function of GAM182 is therefore inhibition of Transforming growth factor, alpha (TGFA, Accession NM_003236.1), a gene which is able to bind to the egf receptor and to act synergistically with tgf beta to promote anchorage-independent cell proliferation in soft agar. Accordingly, utilities of GAM182 include diagnosis, prevention and treatment of diseases and clinical conditions associated with TGFA.

The function of TGFA and its association with various diseases and clinical conditions, has been established by previous studies, as described hereinabove with reference to GAM94.1.

FIG. 8 further provides a conceptual description of a novel bioinformatically detected of the present invention, referred to here as Genomic Address Messenger 183 (GAM183), which modulates expression of respective target genes thereof, the function and utility of which target genes is known in the art.

GAM183 is a novel bioinformatically detected regulatory, non protein coding, micro RNA (miRNA) gene. The method by which GAM183 was detected is described hereinabove with reference to FIGS. 8-15.

GAM183 gene, herein designated GAM GENE, and GAM183 target gene, herein designated TARGET GENE, are human genes contained in the human genome.

GAM183 gene encodes a GAM183 precursor RNA, herein designated GAM PRECURSOR RNA. Similar to other miRNA genes, and unlike most ordinary genes, GAM183 precursor RNA does not encode a protein. A nucleotide sequence identical or highly similar to the nucleotide sequence of GAM183 precursor RNA is designated SEQ ID:7, and is provided hereinbelow with reference to the sequence listing part.

GAM183 precursor RNA folds onto itself, forming GAM183 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM183 precursor RNA folds onto itself, forming GAM183 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM183 precursor RNA, designated SEQ-ID:7, and a schematic representation of a predicted secondary folding of GAM183 folded precursor RNA are further described with reference to Table 2, hereby incorporated by reference.

An enzyme complex designated DICER COMPLEX, 'dices' the GAM183 folded precursor RNA into GAM183 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM183 RNA is designated SEQ ID:240, and is provided hereinbelow with references to the sequence listing part and Table 3, hereby incorporated by reference.

GAM183 target gene, herein designated TARGET GENE, encodes a corresponding messenger RNA, GAM183 target RNA, herein designated GAM TARGET RNA. GAM183 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM183 RNA, herein designated GAM RNA, binds complementarily to one or more target binding sites located in untranslated regions of GAM183 target RNA, herein designated GAM TARGET RNA. This complementary binding is due to the fact that the nucleotide sequence of GAM183 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM183 RNA may have a different number of target binding sites in untranslated regions of a GAM183 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM183 RNA, herein designated GAM RNA, to target binding sites on GAM183 target RNA, herein designated GAM TARGET RNA, such as BINDING SITE I, BINDING SITE II and BINDING SITE III, inhibits translation of GAM183 target RNA into GAM183 target protein, herein designated GAM TARGET PROTEIN. GAM target protein is therefore outlined by a broken line.

It is appreciated that GAM183 target gene, herein designated TARGET GENE, in fact represents a plurality of GAM183 target genes. The mRNA of each one of this plurality of GAM183 target genes comprises one or more target binding sites, each having a nucleotide sequence which is at least partly complementary to GAM183 RNA, herein designated GAM RNA, and which when bound by GAM183 RNA causes inhibition of translation of respective one or more GAM183 target proteins.

It is further appreciated by one skilled in the art that the mode of translational inhibition illustrated by FIG. 8 with specific reference to translational inhibition exerted by GAM183 gene, herein designated GAM GENE, on one or more GAM183 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM183 correlate with, and may be deduced from, the identity of the target genes which GAM183 binds and inhibits, and the function of these target genes, as elaborated hereinbelow.

DKFZP434J1813 (Accession) is a GAM183 target gene, herein designated TARGET GENE. DKFZP434J1813 BINDING SITE is a target binding site found in the 3' untranslated region of mRNA encoded by DKFZP434J1813, corresponding to a target binding site such as BINDING SITE I, BINDING SITE II or BINDING SITE III of FIG. 8. Table 4 illustrates the complementarity of the nucleotide sequences of DKFZP434J1813 BINDING SITE, designated SEQ ID:16705, to the nucleotide sequence of GAM183 RNA, herein designated GAM RNA, also designated SEQ ID:240.

A function of GAM183 is therefore inhibition of DKFZP434J1813 (Accession). Accordingly, utilities of GAM183 include diagnosis, prevention and treatment of diseases and clinical conditions associated with DKFZP434J1813.

KIAA1025 (Accession XM_034056.6) is another GAM183 target gene, herein designated TARGET GENE. KIAA1025 BINDING SITE is a target binding site found in the 3' untranslated region of mRNA encoded by KIAA1025, corresponding to a target binding site such as BINDING SITE I, BINDING SITE II or BINDING SITE III of FIG. 8. Table 4 illustrates the complementarity of the nucleotide sequences of KIAA1025 BINDING SITE, designated SEQ ID:5814, to the nucleotide sequence of GAM183 RNA, herein designated GAM RNA, also designated SEQ ID:240.

Another function of GAM183 is therefore inhibition of KIAA1025 (Accession XM_034056.6). Accordingly, utilities of GAM183 include diagnosis, prevention and treatment of diseases and clinical conditions associated with KIAA1025.

MGC22805 (Accession NM_144590.1) is another GAM183 target gene, herein designated TARGET GENE. MGC22805 BINDING SITE is a target binding site found in the 3' untranslated region of mRNA encoded by MGC22805, corresponding to a target binding site such as BINDING SITE I, BINDING SITE II or BINDING SITE III of FIG. 8. Table 4 illustrates the complementarity of the nucleotide sequences of MGC22805 BINDING SITE, designated SEQ ID:15928, to the nucleotide sequence of GAM183 RNA, herein designated GAM RNA, also designated SEQ ID:240.

Another function of GAM183 is therefore inhibition of MGC22805 (Accession NM_144590.1). Accordingly, utilities of GAM183 include diagnosis, prevention and treatment of diseases and clinical conditions associated with MGC22805.

Prostaglandin-endoperoxide synthase 2 (prostaglandin g/h synthase and cyclooxygenase) (PTGS2, Accession NM_000963.1) is another GAM183 target gene, herein designated TARGET GENE. PTGS2 BINDING SITE is a target binding site found in the 3' untranslated region of mRNA encoded by PTGS2, corresponding to a target binding site such as BINDING SITE I, BINDING SITE II or BINDING SITE III of FIG. 8. Table 4 illustrates the complementarity of the nucleotide sequences of PTGS2 BINDING SITE, designated SEQ ID:14372, to the nucleotide sequence of GAM183 RNA, herein designated GAM RNA, also designated SEQ ID:240.

Another function of GAM183 is therefore inhibition of Prostaglandin-endoperoxide synthase 2 (prostaglandin g/h synthase and cyclooxygenase) (PTGS2, Accession NM_000963.1), a gene which may have a role as a major mediator of inflammation and/or a role for prostanoid signaling in activity-dependent plasticity. and therefore may be associated with Inflammatory diseases such as rheumatoid arthritis. Accordingly, utilities of GAM183 include diagnosis, prevention and treatment of Inflammatory diseases such as rheumatoid arthritis, and of other diseases and clinical conditions associated with PTGS2.

The function of PTGS2 and its association with various diseases and clinical conditions, has been established by previous studies, as described hereinabove with reference to GAM100.1.

FIG. 8 further provides a conceptual description of a novel bioinformatically detected of the present invention, referred to here as Genomic Address Messenger 184 (GAM184), which modulates expression of respective target genes thereof, the function and utility of which target genes is known in the art.

GAM184 is a novel bioinformatically detected regulatory, non protein coding, micro RNA (miRNA) gene. The method by which GAM184 was detected is described hereinabove with reference to FIGS. 8-15.

GAM184 gene, herein designated GAM GENE, and GAM184 target gene, herein designated TARGET GENE, are human genes contained in the human genome.

GAM184 gene encodes a GAM184 precursor RNA, herein designated GAM PRECURSOR RNA. Similar to other miRNA genes, and unlike most ordinary genes, GAM184 precursor RNA does not encode a protein. A nucleotide sequence identical or highly similar to the nucleotide sequence of GAM184 precursor RNA is designated SEQ ID:50, and is provided hereinbelow with reference to the sequence listing part.

GAM184 precursor RNA folds onto itself, forming GAM184 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM184 precursor RNA folds onto itself, forming GAM184 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM184 precursor RNA, designated SEQ-ID:50, and a schematic representation of a predicted secondary folding of GAM184 folded precursor RNA are further described with reference to Table 2, hereby incorporated by reference.

An enzyme complex designated DICER COMPLEX, 'dices' the GAM184 folded precursor RNA into GAM184 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM184 RNA is designated SEQ ID:284, and is provided hereinbelow with references to the sequence listing part and Table 3, hereby incorporated by reference.

GAM184 target gene, herein designated TARGET GENE, encodes a corresponding messenger RNA, GAM184 target RNA, herein designated GAM TARGET RNA. GAM184 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM184 RNA, herein designated GAM RNA, binds complementarily to one or more target binding sites located in untranslated regions of GAM184 target RNA, herein designated GAM TARGET RNA. This complementary binding is due to the fact that the nucleotide sequence of GAM184 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM184 RNA may have a different number of target binding sites in untranslated regions of a GAM184 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM184 RNA, herein designated GAM RNA, to target binding sites on GAM184 target RNA, herein designated GAM TARGET RNA, such as BINDING SITE I, BINDING SITE II and BINDING SITE III, inhibits translation of GAM184 target RNA into GAM184 target protein, herein designated GAM TARGET PROTEIN. GAM target protein is therefore outlined by a broken line.

It is appreciated that GAM184 target gene, herein designated TARGET GENE, in fact represents a plurality of GAM184 target genes. The mRNA of each one of this plurality of GAM184 target genes comprises one or more target binding sites, each having a nucleotide sequence which is at least partly complementary to GAM184 RNA, herein designated GAM RNA, and which when bound by GAM184 RNA causes inhibition of translation of respective one or more GAM184 target proteins.

It is further appreciated by one skilled in the art that the mode of translational inhibition illustrated by FIG. 8 with specific reference to translational inhibition exerted by GAM184 gene, herein designated GAM GENE, on one or more GAM184 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM184 correlate with, and may be deduced from, the identity of the target genes which GAM184 binds and inhibits, and the function of these target genes, as elaborated hereinbelow.

Transforming growth factor, beta receptor ii (70/80 kda) (TGFBR2, Accession NM_003242.3) is a GAM184 target gene, herein designated TARGET GENE. TGFBR2 BINDING SITE is a target binding site found in the 3' untranslated region of mRNA encoded by TGFBR2, corresponding to a target binding site such as BINDING SITE I, BINDING SITE II or BINDING SITE III of FIG. 8. Table 4 illustrates the complementarity of the nucleotide sequences of TGFBR2

BINDING SITE, designated SEQ ID:9885, to the nucleotide sequence of GAM184 RNA, herein designated GAM RNA, also designated SEQ ID:284.

A function of GAM184 is therefore inhibition of Transforming growth factor, beta receptor ii (70/80 kda) (TGFBR2, Accession NM_003242.3). Accordingly, utilities of GAM184 include diagnosis, prevention and treatment of diseases and clinical conditions associated with TGFBR2.

FIG. 8 further provides a conceptual description of a novel bioinformatically detected of the present invention, referred to here as Genomic Address Messenger 185 (GAM185), which modulates expression of respective target genes thereof, the function and utility of which target genes is known in the art.

GAM185 is a novel bioinformatically detected regulatory, non protein coding, micro RNA (miRNA) gene. The method by which GAM185 was detected is described hereinabove with reference to FIGS. 8-15.

GAM185 gene, herein designated GAM GENE, and GAM185 target gene, herein designated TARGET GENE, are human genes contained in the human genome.

GAM185 gene encodes a GAM185 precursor RNA, herein designated GAM PRECURSOR RNA. Similar to other miRNA genes, and unlike most ordinary genes, GAM185 precursor RNA does not encode a protein. A nucleotide sequence identical or highly similar to the nucleotide sequence of GAM185 precursor RNA is designated SEQ ID:78, and is provided hereinbelow with reference to the sequence listing part.

GAM185 precursor RNA folds onto itself, forming GAM185 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM185 precursor RNA folds onto itself, forming GAM185 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM185 precursor RNA, designated SEQ-ID:78, and a schematic representation of a predicted secondary folding of GAM185 folded precursor RNA are further described with reference to Table 2, hereby incorporated by reference.

An enzyme complex designated DICER COMPLEX, 'dices' the GAM185 folded precursor RNA into GAM185 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM185 RNA is designated SEQ ID:372, and is provided hereinbelow with references to the sequence listing part and Table 3, hereby incorporated by reference.

GAM185 target gene, herein designated TARGET GENE, encodes a corresponding messenger RNA, GAM185 target RNA, herein designated GAM TARGET RNA. GAM185 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM185 RNA, herein designated GAM RNA, binds complementarily to one or more target binding sites located in untranslated regions of GAM185 target RNA, herein designated GAM TARGET RNA. This complementary binding is due to the fact that the nucleotide sequence of GAM185 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM185 RNA may have a different number of target binding sites in untranslated regions of a GAM185 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM185 RNA, herein designated GAM RNA, to target binding sites on GAM185 target RNA, herein designated GAM TARGET RNA, such as BINDING SITE I, BINDING SITE II and BINDING SITE III, inhibits translation of GAM185 target RNA into GAM185 target protein, herein designated GAM TARGET PROTEIN. GAM target protein is therefore outlined by a broken line.

It is appreciated that GAM185 target gene, herein designated TARGET GENE, in fact represents a plurality of GAM185 target genes. The mRNA of each one of this plurality of GAM185 target genes comprises one or more target binding sites, each having a nucleotide sequence which is at least partly complementary to GAM185 RNA, herein designated GAM RNA, and which when bound by GAM185 RNA causes inhibition of translation of respective one or more GAM185 target proteins.

It is further appreciated by one skilled in the art that the mode of translational inhibition illustrated by FIG. 8 with specific reference to translational inhibition exerted by GAM185 gene, herein designated GAM GENE, on one or more GAM185 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM185 correlate with, and may be deduced from, the identity of the target genes which GAM185 binds and inhibits, and the function of these target genes, as elaborated hereinbelow.

Grb2-associated binding protein 2 (GAB2, Accession NM_080491.1) is a GAM185 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:18059, to the nucleotide sequence of GAM185 RNA, herein designated GAM RNA, also designated SEQ ID:372.

A function of GAM185 is therefore inhibition of Grb2-associated binding protein 2 (GAB2, Accession NM_080491.1), a gene which act as adapters for transmitting various signals. Accordingly, utilities of GAM185 include diagnosis, prevention and treatment of diseases and clinical conditions associated with GAB2.

The function of GAB2 and its association with various diseases and clinical conditions, has been established by previous studies, as described hereinabove with reference to GAM63.1. Growth arrest and dna-damage-inducible, beta (GADD45B, Accession NM_015675.1) is another GAM185 target gene, herein designated TARGET GENE. GADD45B BINDING SITE is a target binding site found in the 3' untranslated region of mRNA encoded by GADD45B, corresponding to a target binding site such as BINDING SITE I, BINDING SITE II or BINDING SITE III of FIG. 8. Table 4 illustrates the complementarity of the nucleotide sequences of GADD45B BINDING SITE, designated SEQ ID:9982, to the nucleotide sequence of GAM185 RNA, herein designated GAM RNA, also designated SEQ ID:372.

Another function of GAM185 is therefore inhibition of Growth arrest and dna-damage-inducible, beta (GADD45B, Accession NM_015675.1), a gene which activates MTK1 kinase activity and maybe involved in stress response. Accordingly, utilities of GAM185 include diagnosis, prevention and treatment of diseases and clinical conditions associated with GADD45B.

The function of GADD45B has been established by previous studies. The stress- responsive p38 (see OMIM Ref. No. MAPK14; 600289) and JNK (see OMIM Ref. No. MAPK8; 601158) mitogen-activated protein kinase (MAPK) pathways regulate cell cycle and apoptosis. A human MAP3K, MTK1 (MAP3K4; 602425), mediates activation of both p38 and JNK in response to environmental stresses. By screening a placenta cDNA library using a yeast 2- hybrid method, Takekawa and Saito (1998) isolated cDNAs encoding 3 related proteins, GADD45-alpha (GADD45A; 126335), GADD45-beta (GADD45B), and GADD45-gamma (GADD45G; 604949), that bound to an N- terminal domain of MTK1. The deduced GADD45B protein contains 160 amino acids. GADD45A, GADD45B, and GADD45G share 55 to 58% amino acid identity. These proteins activated MTK1 kinase activity, both in vivo and in vitro. All 3 GADD45-like genes were induced by environmental stresses, including methyl methanesulfonate, UV, and gamma irradiation. Expression of the GADD45-like genes induced p38/JNK activation and apoptosis, which could be partially suppressed by coexpression of a dominant inhibitory MTK1 mutant protein. Northern blot analysis detected strong expression of a 1.4-kb GADD45B transcript in heart and liver, with moderate expression in placenta, lung, skeletal muscle, kidney, and pancreas, and little or no expression in brain. Takekawa and Saito (1998) proposed that the GADD45-like proteins mediate activation of the p38/JNK pathway, via MTK1, in response to environmental stresses.

Full details of the abovementioned studies are described in the following publications, the disclosure of which are hereby incorporated by reference:

De Smaele, E.; Zazzeroni, F.; Papa, S.; Nguyen, D. U.; Jin, R.; Jones, J.; Cong, R.; Franzoso, G.: Induction of gadd45-beta by NF-kappa-B downregulates pro- apoptotic JNK signaling. Nature 414:308-313, 2001; and Takekawa, M.; Saito, H.: A family of stress-inducible GADD45-like proteins mediate activation of the stress-responsive MTK1/MEKK4 MAPKKK. Cell 95:521-530, 1998.

Further studies establishing the function and utilities of GADD45B are found in John Hopkins OMIM database record ID 604948, and in cited publications listed in Table 5, which are hereby incorporated by reference.

FIG. 8 further provides a conceptual description of a novel bioinformatically detected of the present invention, referred to here as Genomic Address Messenger 186 (GAM186), which modulates expression of respective target genes thereof, the function and utility of which target genes is known in the art.

GAM186 is a novel bioinformatically detected regulatory, non protein coding, micro RNA (miRNA) gene. The method by which GAM186 was detected is described hereinabove with reference to FIGS. 8-15.

GAM186 gene, herein designated GAM GENE, and GAM186 target gene, herein designated TARGET GENE, are human genes contained in the human genome.

GAM186 gene encodes a GAM186 precursor RNA, herein designated GAM PRECURSOR RNA. Similar to other miRNA genes, and unlike most ordinary genes, GAM186 precursor RNA does not encode a protein. A nucleotide sequence identical or highly similar to the nucleotide sequence of GAM186 precursor RNA is designated SEQ ID:57, and is provided hereinbelow with reference to the sequence listing part.

GAM186 precursor RNA folds onto itself, forming GAM186 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM186 precursor RNA folds onto itself, forming GAM186 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM186 precursor RNA, designated SEQ-ID:57, and a schematic representation of a predicted secondary folding of GAM186 folded precursor RNA are further described with reference to Table 2, hereby incorporated by reference.

An enzyme complex designated DICER COMPLEX, 'dices' the GAM186 folded precursor RNA into GAM186 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM186 RNA is designated SEQ ID:353, and is provided hereinbelow with references to the sequence listing part and Table 3, hereby incorporated by reference.

GAM186 target gene, herein designated TARGET GENE, encodes a corresponding messenger RNA, GAM186 target RNA, herein designated GAM TARGET RNA. GAM186 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM186 RNA, herein designated GAM RNA, binds complementarily to one or more target binding sites located in untranslated regions of GAM186 target RNA, herein designated GAM TARGET RNA. This complementary binding is due to the fact that the nucleotide sequence of GAM186 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM186 RNA may have a different number of target binding sites in untranslated regions of a GAM186 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM186 RNA, herein designated GAM RNA, to target binding sites on GAM186 target RNA, herein designated GAM TARGET RNA, such as BINDING SITE I, BINDING SITE II and BINDING SITE III, inhibits translation of GAM186 target RNA into GAM186 target protein, herein designated GAM TARGET PROTEIN. GAM target protein is therefore outlined by a broken line.

It is appreciated that GAM186 target gene, herein designated TARGET GENE, in fact represents a plurality of GAM186 target genes. The mRNA of each one of this plurality of GAM186 target genes comprises one or more target binding sites, each having a nucleotide sequence which is at least partly complementary to GAM186 RNA, herein designated GAM RNA, and which when bound by GAM186 RNA causes inhibition of translation of respective one or more GAM186 target proteins.

It is further appreciated by one skilled in the art that the mode of translational inhibition illustrated by FIG. 8 with specific reference to translational inhibition exerted by GAM186 gene, herein designated GAM GENE, on one or more GAM186 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM186 correlate with, and may be deduced from, the identity of the target genes which GAM186 binds and inhibits, and the function of these target genes, as elaborated hereinbelow.

LOC147671 (Accession XM_085844.2) is a GAM186 target gene, herein designated TARGET GENE. LOC147671 BINDING SITE is a target binding site found in the 3' untranslated region of mRNA encoded by LOC147671, corresponding to a target binding site such as BINDING SITE I, BINDING SITE II or BINDING SITE III of FIG. 8. Table 4 illustrates the complementarity of the nucleotide sequences of LOC147671 BINDING SITE, designated SEQ ID:2416, to the nucleotide sequence of GAM186 RNA, herein designated GAM RNA, also designated SEQ ID:353.

A function of GAM186 is therefore inhibition of LOC147671 (Accession XM_085844.2). Accordingly, utilities of GAM186 include diagnosis, prevention and treatment of diseases and clinical conditions associated with LOC147671.

MGC4093 (Accession NM_030578.1) is another GAM186 target gene, herein designated TARGET GENE. MGC4093 BINDING SITE is a target binding site found in the 3' untranslated region of mRNA encoded by MGC4093, corresponding to a target binding site such as BINDING SITE I, BINDING SITE II or BINDING SITE III of FIG. 8. Table 4 illustrates the complementarity of the nucleotide sequences of MGC4093 BINDING SITE, designated SEQ ID:15121, to the nucleotide sequence of GAM186 RNA, herein designated GAM RNA, also designated SEQ ID:353.

Another function of GAM186 is therefore inhibition of MGC4093 (Accession NM_030578.1). Accordingly, utilities of GAM186 include diagnosis, prevention and treatment of diseases and clinical conditions associated with MGC4093.

SMAC (Accession NM_138929.1) is another GAM186 target gene, herein designated TARGET GENE. SMAC BINDING SITE is a target binding site found in the 5' untranslated region of multiple transcripts of mRNA encoded by SMAC, corresponding to a target binding site such as BINDING SITE I, BINDING SITE II or BINDING SITE III of FIG. 8. Table 4 illustrates the complementarity of the nucleotide sequences of SMAC BINDING SITE, designated SEQ ID:450, to the nucleotide sequence of GAM186 RNA, herein designated GAM RNA, also designated SEQ ID:353.

Another function of GAM186 is therefore inhibition of SMAC (Accession NM_138929.1), a gene which promotes apoptosis via caspase activation. Accordingly, utilities of GAM186 include diagnosis, prevention and treatment of diseases and clinical conditions associated with SMAC.

The function of SMAC and its association with various diseases and clinical conditions, has been established by previous studies, as described hereinabove with reference to GAM136.1. Zuotin related factor 1 (ZRF1, Accession XM_168590.3) is another GAM186 target gene, herein designated TARGET GENE. ZRF1 BINDING SITE is a target binding site found in the 5' untranslated region of mRNA encoded by ZRF1, corresponding to a target binding site such as BINDING SITE I, BINDING SITE II or BINDING SITE III of FIG. 8. Table 4 illustrates the complementarity of the nucleotide sequences of ZRF1 BINDING SITE, designated SEQ ID:12343, to the nucleotide sequence of GAM186 RNA, herein designated GAM RNA, also designated SEQ ID:353.

Another function of GAM186 is therefore inhibition of Zuotin related factor 1 (ZRF1, Accession XM_168590.3). Accordingly, utilities of GAM186 include diagnosis, prevention and treatment of diseases and clinical conditions associated with ZRF1.

FIG. 8 further provides a conceptual description of a novel bioinformatically detected of the present invention, referred to here as Genomic Address Messenger 187 (GAM187), which modulates expression of respective target genes thereof, the function and utility of which target genes is known in the art.

GAM187 is a novel bioinformatically detected regulatory, non protein coding, micro RNA (miRNA) gene. The method by which GAM187 was detected is described hereinabove with reference to FIGS. 8-15.

GAM187 gene, herein designated GAM GENE, and GAM187 target gene, herein designated TARGET GENE, are human genes contained in the human genome.

GAM187 gene encodes a GAM187 precursor RNA, herein designated GAM PRECURSOR RNA. Similar to other miRNA genes, and unlike most ordinary genes, GAM187 precursor RNA does not encode a protein. A nucleotide sequence identical or highly similar to the nucleotide sequence of GAM187 precursor RNA is designated SEQ ID:83, and is provided hereinbelow with reference to the sequence listing part. Nucleotide sequence SEQ ID:83 is located at position 48266940 relative to chromosome 17.

GAM187 precursor RNA folds onto itself, forming GAM187 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM187 precursor RNA folds onto itself, forming GAM187 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM187 precursor RNA, designated SEQ-ID:83, and a schematic representation of a predicted secondary folding of GAM187 folded precursor RNA are further described with reference to Table 2, hereby incorporated by reference.

An enzyme complex designated DICER COMPLEX, 'dices' the GAM187 folded precursor RNA into GAM187 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM187 RNA is designated SEQ ID:294, and is provided hereinbelow with references to the sequence listing part and Table 3, hereby incorporated by reference.

GAM187 target gene, herein designated TARGET GENE, encodes a corresponding messenger RNA, GAM187 target RNA, herein designated GAM TARGET RNA. GAM187 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM187 RNA, herein designated GAM RNA, binds complementarily to one or more target binding sites located in untranslated regions of GAM187 target RNA, herein designated GAM TARGET RNA. This complementary binding is due to the fact that the nucleotide sequence of GAM187 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM187 RNA may have a different number of target binding sites in untranslated regions of a GAM187 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM187 RNA, herein designated GAM RNA, to target binding sites on GAM187 target RNA, herein designated GAM TARGET RNA, such as BINDING SITE I, BINDING SITE II and BINDING SITE III, inhibits translation of GAM187 target RNA into GAM187 target protein, herein designated GAM TARGET PROTEIN. GAM target protein is therefore outlined by a broken line.

It is appreciated that GAM187 target gene, herein designated TARGET GENE, in fact represents a plurality of GAM187 target genes. The mRNA of each one of this plurality of GAM187 target genes comprises one or more target binding sites, each having a nucleotide sequence which is at least partly complementary to GAM187 RNA, herein designated GAM RNA, and which when bound by GAM187 RNA causes inhibition of translation of respective one or more GAM187 target proteins.

It is further appreciated by one skilled in the art that the mode of translational inhibition illustrated by FIG. 8 with specific reference to translational inhibition exerted by GAM187 gene, herein designated GAM GENE, on one or more GAM187 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM187 correlate with, and may be deduced from, the identity of the target genes which GAM187 binds and inhibits, and the function of these target genes, as elaborated hereinbelow.

Eukaryotic translation initiation factor 4e binding protein 2 (EIF4EBP2, Accession NM_004096.2) is a GAM187 target gene, herein designated TARGET GENE. EIF4EBP2 BINDING SITE is a target binding site found in the 3' untranslated region of mRNA encoded by EIF4EBP2, corresponding to a target binding site such as BINDING SITE I, BINDING SITE II or BINDING SITE III of FIG. 8. Table 4 illustrates the complementarity of the nucleotide sequences of EIF4EBP2 BINDING SITE, designated SEQ ID:13732, to the nucleotide sequence of GAM187 RNA, herein designated GAM RNA, also designated SEQ ID:294.

A function of GAM187 is therefore inhibition of Eukaryotic translation initiation factor 4e binding protein 2 (EIF4EBP2, Accession NM_004096.2), a gene which binds EIF4E and negatively regulates initiation of translation. and therefore may be associated with Cancers. Accordingly, utilities of GAM187 include diagnosis, prevention and treatment of Cancers, and of other diseases and clinical conditions associated with EIF4EBP2.

The function of EIF4EBP2 and its association with various diseases and clinical conditions, has been established by previous studies, as described hereinabove with reference to GAM144.1. FLJ20487 (Accession NM_017841.1) is another GAM187 target gene, herein designated TARGET GENE.

FLJ20487 BINDING SITE is a target binding site found in the 3' untranslated region of mRNA encoded by FLJ20487, corresponding to a target binding site such as BINDING SITE I, BINDING SITE II or BINDING SITE III of FIG. 8. Table 4 illustrates the complementarity of the nucleotide sequences of FLJ20487 BINDING SITE, designated SEQ ID:6750, to the nucleotide sequence of GAM187 RNA, herein designated GAM RNA, also designated SEQ ID:294.

Another function of GAM187 is therefore inhibition of FLJ20487 (Accession NM_017841.1). Accordingly, utilities of GAM187 include diagnosis, prevention and treatment of diseases and clinical conditions associated with FLJ20487.

LOC93259 (Accession XM_050105.2) is another GAM187 target gene, herein designated TARGET GENE. LOC93259 BINDING SITE is a target binding site found in the 5' untranslated region of mRNA encoded by LOC93259, corresponding to a target binding site such as BINDING SITE I, BINDING SITE II or BINDING SITE III of FIG. 8. Table 4 illustrates the complementarity of the nucleotide sequences of LOC93259 BINDING SITE, designated SEQ ID:7403, to the nucleotide sequence of GAM187 RNA, herein designated GAM RNA, also designated SEQ ID:294.

Another function of GAM187 is therefore inhibition of LOC93259 (Accession XM_050105.2). Accordingly, utilities of GAM187 include diagnosis, prevention and treatment of diseases and clinical conditions associated with LOC93259.

Prostaglandin f2 receptor negative regulator (PTGFRN, Accession XM_040709.3) is another GAM187 target gene, herein designated TARGET GENE. PTGFRN BINDING SITE is a target binding site found in the 3' untranslated region of mRNA encoded by PTGFRN, corresponding to a target binding site such as BINDING SITE I, BINDING SITE II or BINDING SITE III of FIG. 8. Table 4 illustrates the complementarity of the nucleotide sequences of PTGFRN BINDING SITE, designated SEQ ID:7229, to the nucleotide sequence of GAM187 RNA, herein designated GAM RNA, also designated SEQ ID:294.

Another function of GAM187 is therefore inhibition of Prostaglandin f2 receptor negative regulator (PTGFRN, Accession XM_040709.3), a gene which inhibits the binding of prostaglandin f2-alpha (pgf2-alpha) to its specific fp receptor. Accordingly, utilities of GAM187 include diagnosis, prevention and treatment of diseases and clinical conditions associated with PTGFRN.

The function of PTGFRN and its association with various diseases and clinical conditions, has been established by previous studies, as described hereinabove with reference to GAM94.1.

FIG. 8 further provides a conceptual description of a novel bioinformatically detected of the present invention, referred to here as Genomic Address Messenger 188 (GAM188), which modulates expression of respective target genes thereof, the function and utility of which target genes is known in the art.

GAM188 is a novel bioinformatically detected regulatory, non protein coding, micro RNA (miRNA) gene. The method by which GAM188 was detected is described hereinabove with reference to FIGS. 8-15.

GAM188 gene, herein designated GAM GENE, and GAM188 target gene, herein designated TARGET GENE, are human genes contained in the human genome.

GAM188 gene encodes a GAM188 precursor RNA, herein designated GAM PRECURSOR RNA. Similar to other miRNA genes, and unlike most ordinary genes, GAM188 precursor RNA does not encode a protein. A nucleotide sequence identical or highly similar to the nucleotide sequence of GAM188 precursor RNA is designated SEQ ID:12, and is provided hereinbelow with reference to the sequence listing part.

GAM188 precursor RNA folds onto itself, forming GAM188 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM188 precursor RNA folds onto itself, forming GAM188 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM188 precursor RNA, designated SEQ-ID:12, and a schematic representation of a predicted secondary folding of GAM188 folded precursor RNA are further described with reference to Table 2, hereby incorporated by reference.

An enzyme complex designated DICER COMPLEX, 'dices' the GAM188 folded precursor RNA into GAM188 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM188 RNA is designated SEQ ID:286, and is provided hereinbelow with references to the sequence listing part and Table 3, hereby incorporated by reference.

GAM188 target gene, herein designated TARGET GENE, encodes a corresponding messenger RNA, GAM188 target RNA, herein designated GAM TARGET RNA. GAM188 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM188 RNA, herein designated GAM RNA, binds complementarily to one or more target binding sites located in untranslated regions of GAM188 target RNA, herein designated GAM TARGET RNA. This complementary binding is due to the fact that the nucleotide sequence of GAM188 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM188 RNA may have a different number of target binding sites in untranslated regions of a GAM188 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM188 RNA, herein designated GAM RNA, to target binding sites on GAM188 target RNA, herein designated GAM TARGET RNA, such as BINDING SITE I, BINDING SITE II and BINDING SITE III, inhibits translation of GAM188 target RNA into GAM188 target protein, herein designated GAM TARGET PROTEIN. GAM target protein is therefore outlined by a broken line.

It is appreciated that GAM188 target gene, herein designated TARGET GENE, in fact represents a plurality of GAM188 target genes. The mRNA of each one of this plurality of GAM188 target genes comprises one or more target binding sites, each having a nucleotide sequence which is at least partly complementary to GAM188 RNA, herein designated GAM RNA, and which when bound by GAM188 RNA causes inhibition of translation of respective one or more GAM188 target proteins.

It is further appreciated by one skilled in the art that the mode of translational inhibition illustrated by FIG. 8 with specific reference to translational inhibition exerted by GAM188 gene, herein designated GAM GENE, on one or more GAM188 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM188 correlate with, and may be deduced from, the identity of the target genes which GAM188 binds and inhibits, and the function of these target genes, as elaborated hereinbelow.

DKFZp434M0331 (Accession NM_017600.1) is a GAM188 target gene, herein designated TARGET GENE. DKFZp434M0331 BINDING SITE is a target binding site found in the 5' untranslated region of mRNA encoded by DKFZp434M0331, corresponding to a target binding site such as BINDING SITE I, BINDING SITE II or BINDING SITE III of FIG. 8. Table 4 illustrates the complementarity of the nucleotide sequences of DKFZp434M0331 BINDING SITE, designated SEQ ID:4117, to the nucleotide sequence of GAM188 RNA, herein designated GAM RNA, also designated SEQ ID:286.

A function of GAM188 is therefore inhibition of DKFZp434M0331 (Accession NM_017600.1). Accordingly, utilities of GAM188 include diagnosis, prevention and treatment of diseases and clinical conditions associated with DKFZp434M0331.

Grb2-associated binding protein 3 (GAB3, Accession NM_080612.1) is another GAM188 target gene, herein designated TARGET GENE. GAB3 BINDING SITE is a target binding site found in the 3' untranslated region of mRNA encoded by GAB3, corresponding to a target binding site such as BINDING SITE I, BINDING SITE II or BINDING SITE III of FIG. 8. Table 4 illustrates the complementarity of the nucleotide sequences of GAB3 BINDING SITE, designated SEQ ID:5720, to the nucleotide sequence of GAM188 RNA, herein designated GAM RNA, also designated SEQ ID:286.

Another function of GAM188 is therefore inhibition of Grb2-associated binding protein 3 (GAB3, Accession NM_080612.1). Accordingly, utilities of GAM188 include diagnosis, prevention and treatment of diseases and clinical conditions associated with GAB3.

LOC142955 (Accession XM_084389.4) is another GAM188 target gene, herein designated TARGET GENE. LOC142955 BINDING SITE is a target binding site found in the 5' untranslated region of mRNA encoded by LOC142955, corresponding to a target binding site such as BINDING SITE I, BINDING SITE II or BINDING SITE III of FIG. 8. Table 4 illustrates the complementarity of the nucleotide sequences of LOC142955 BINDING SITE, designated SEQ ID:12714, to the nucleotide sequence of GAM188 RNA, herein designated GAM RNA, also designated SEQ ID:286.

Another function of GAM188 is therefore inhibition of LOC142955 (Accession XM_084389.4). Accordingly, utilities of GAM188 include diagnosis, prevention and treatment of diseases and clinical conditions associated with LOC142955.

FIG. 8 further provides a conceptual description of a novel bioinformatically detected of the present invention, referred to here as Genomic Address Messenger 189 (GAM189), which modulates expression of respective target genes thereof, the function and utility of which target genes is known in the art.

GAM189 is a novel bioinformatically detected regulatory, non protein coding, micro RNA (miRNA) gene. The method by which GAM189 was detected is described hereinabove with reference to FIGS. 8-15.

GAM189 gene, herein designated GAM GENE, and GAM189 target gene, herein designated TARGET GENE, are human genes contained in the human genome.

GAM189 gene encodes a GAM189 precursor RNA, herein designated GAM PRECURSOR RNA. Similar to other miRNA genes, and unlike most ordinary genes, GAM189 precursor RNA does not encode a protein. A nucleotide sequence identical or highly similar to the nucleotide sequence of GAM189 precursor RNA is designated SEQ ID:9, and is provided hereinbelow with reference to the sequence listing part. Nucleotide sequence SEQ ID:9 is located at position 95450006 relative to chromosome 4.

GAM189 precursor RNA folds onto itself, forming GAM189 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM189 precursor RNA folds onto itself, forming GAM189 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM189 precursor RNA, designated SEQ-ID:9, and a schematic representation of a predicted secondary folding of GAM189 folded precursor RNA are further described with reference to Table 2, hereby incorporated by reference.

An enzyme complex designated DICER COMPLEX, 'dices' the GAM189 folded precursor RNA into GAM189 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM189 RNA is designated SEQ ID:246, and is provided hereinbelow with references to the sequence listing part and Table 3, hereby incorporated by reference.

GAM189 target gene, herein designated TARGET GENE, encodes a corresponding messenger RNA, GAM189 target RNA, herein designated GAM TARGET RNA. GAM189 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM189 RNA, herein designated GAM RNA, binds complementarily to one or more target binding sites located in untranslated regions of GAM189 target RNA, herein designated GAM TARGET RNA. This complementary binding is due to the fact that the nucleotide sequence of GAM189 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM189 RNA may have a different number of target binding sites in untranslated regions of a GAM189 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM189 RNA, herein designated GAM RNA, to target binding sites on GAM189 target RNA, herein designated GAM TARGET RNA, such as BINDING SITE I, BINDING SITE II and BINDING SITE III, inhibits translation of GAM189 target RNA into GAM189 target protein, herein designated GAM TARGET PROTEIN. GAM target protein is therefore outlined by a broken line.

It is appreciated that GAM189 target gene, herein designated TARGET GENE, in fact represents a plurality of GAM189 target genes. The mRNA of each one of this plurality of GAM189 target genes comprises one or more target binding sites, each having a nucleotide sequence which is at least partly complementary to GAM189 RNA, herein designated GAM RNA, and which when bound by GAM189 RNA causes inhibition of translation of respective one or more GAM189 target proteins.

It is further appreciated by one skilled in the art that the mode of translational inhibition illustrated by FIG. 8 with specific reference to translational inhibition exerted by GAM189 gene, herein designated GAM GENE, on one or more GAM189 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM189 correlate with, and may be deduced from, the identity of the target genes which GAM189 binds and inhibits, and the function of these target genes, as elaborated hereinbelow.

15E1.2 (Accession XP_290596.1) is a GAM189 target gene, herein designated TARGET GENE. 15E1.2 BINDING SITE is a target binding site found in the 3' untranslated region of mRNA encoded by 15E1.2, corresponding to a target binding site such as BINDING SITE I, BINDING SITE II or BINDING SITE III of FIG. 8. Table 4 illustrates the complementarity of the nucleotide sequences of 15E1.2 BINDING SITE, designated SEQ ID:12868, to the nucleotide sequence of GAM189 RNA, herein designated GAM RNA, also designated SEQ ID:246.

A function of GAM189 is therefore inhibition of 15E1.2 (Accession XP_290596.1). Accordingly, utilities of GAM189 include diagnosis, prevention and treatment of diseases and clinical conditions associated with 15E1.2.

Alpha-1-b glycoprotein (A1BG, Accession NP_570602.2) is another GAM189 target gene, herein designated TARGET GENE. A1BG BINDING SITE1 and A1BG BINDING SITE2 are target binding sites found in untranslated regions of mRNA encoded by A1BG, corresponding to target binding sites such as BINDING SITE I, BINDING SITE II or BINDING SITE III of FIG. 8. Table 4 illustrates the complementarity of the nucleotide sequences of A1BG BINDING SITE1 and A1BG BINDING SITE2, designated SEQ ID:18868 and SEQ ID:2534 respectively, to the nucleotide sequence of GAM189 RNA, herein designated GAM RNA, also designated SEQ ID:246.

Another function of GAM189 is therefore inhibition of Alpha-1-b glycoprotein (A1BG, Accession NP_570602.2), a gene which a plasma protein of unknown function. Accordingly, utilities of GAM189 include diagnosis, prevention and treatment of diseases and clinical conditions associated with A1BG.

The function of A1BG and its association with various diseases and clinical conditions, has been established by previous studies, as described hereinabove with reference to GAM130.1. Aminoadipate-semialdehyde synthase (AASS, Accession NP_005754.2) is another GAM189 target gene, herein designated TARGET GENE. AASS BINDING SITE is a target binding site found in the 3' untranslated region of mRNA encoded by AASS, corresponding to a target binding site such as BINDING SITE I, BINDING SITE II or BINDING SITE III of FIG. 8. Table 4 illustrates the complementarity of the nucleotide sequences of AASS BINDING SITE, designated SEQ ID:6339, to the nucleotide sequence of GAM189 RNA, herein designated GAM RNA, also designated SEQ ID:246.

Another function of GAM189 is therefore inhibition of Aminoadipate-semialdehyde synthase (AASS, Accession NP_005754.2). Accordingly, utilities of GAM189 include diagnosis, prevention and treatment of diseases and clinical conditions associated with AASS.

ABCA13 (Accession NP_689914.2) is another GAM189 target gene, herein designated TARGET GENE. ABCA13 BINDING SITE is a target binding site found in the 3' untranslated region of mRNA encoded by ABCA13, corresponding to a target binding site such as BINDING SITE I, BINDING SITE II or BINDING SITE III of FIG. 8. Table 4 illustrates the complementarity of the nucleotide sequences of ABCA13 BINDING SITE, designated SEQ ID:7385, to the nucleotide sequence of GAM189 RNA, herein designated GAM RNA, also designated SEQ ID:246.

Another function of GAM189 is therefore inhibition of ABCA13 (Accession NP_689914.2). Accordingly, utilities of GAM189 include diagnosis, prevention and treatment of diseases and clinical conditions associated with ABCA13.

Atp-binding cassette, sub-family c (cftr/mrp), member 11 (ABCC11, Accession NP_149163.2) is another GAM189 target gene, herein designated TARGET GENE. ABCC11 BINDING SITE is a target binding site found in the 5' untranslated region of multiple transcripts of mRNA encoded by ABCC11, corresponding to a target binding site such as BINDING SITE I, BINDING SITE II or BINDING SITE III of FIG. 8. Table 4 illustrates the complementarity of the nucleotide sequences of ABCC11 BINDING SITE, designated SEQ ID:7022, to the nucleotide sequence of GAM189 RNA, herein designated GAM RNA, also designated SEQ ID:246.

Another function of GAM189 is therefore inhibition of Atp-binding cassette, sub-family c (cftr/mrp), member 11 (ABCC11, Accession NP_149163.2), a gene which acts as a multispecific organic anion pump which can transport nucleotide analogs (by similarity). Accordingly, utilities of GAM189 include diagnosis, prevention and treatment of diseases and clinical conditions associated with ABCC11.

The function of ABCC11 has been established by previous studies. Tammur et al. (2001) identified ABCC11 and ABCC12 (OMIM Ref. No. 607041) by database analysis using ABC transporter sequences as queries. The deduced 1,382-amino acid ABCC11 protein contains 2 ATP-binding domains and 2 transmembrane regions. It shares 40%, 33%, 32%, and 32% amino acid sequence identity with ABCC5 (OMIM Ref. No. 605251), ABCC4 (OMIM Ref. No. 605250), ABCC2 (OMIM Ref. No. 601107), and ABCC3 (OMIM Ref. No. 604323), respectively. PCR of a 16- tissue panel revealed expression in all tissues examined except kidney, spleen, and colon. The author determined that a second PCR product identified in lung was a splice variant lacking exon 9. Tammur et al. (2001) mapped the ABCC11 gene to chromosome 16q12.1 by radiation hybrid analysis. They noted that the ABCC11 and ABCC12 genes are contained within a BAC clone mapping to 16q12.1. Tammur et al. (2001) stated that the chromosomal localization, potential function, and expression profiles of the ABCC11 and ABCC12 genes make them promising candidates for paroxysmal kinesigenic choreoathetosis (PKC; 128200) and infantile convulsions with paroxysmal choreoathetosis (ICCA; 602066).

Full details of the abovementioned studies are described in the following publications, the disclosure of which are hereby incorporated by reference:

Tammur, J.; Prades, C.; Arnould, I.; Rzhetsky, A.; Hutchinson, A.; Adachi, M.; Schuetz, J. D.; Swoboda, K. J.; Ptacek, L. J.; Rosier, M.; Dean, M.; Allikmets, R.: Two new genes from the human ATP-binding cassette transporter superfamily, ABCC11 and ABCC12, tandemly duplicated on chromosome 16q12. Gene 273:89-96, 2001; and Bera, T. K.; Lee, S.; Salvatore, G.; Lee, B.; Pastan, I.: MRP8, a new member of ABC transporter superfamily, identified by EST database mining and gene prediction program, is highly ex.

Further studies establishing the function and utilities of ABCC11 are found in John Hopkins OMIM database record ID 607040, and in cited publications listed in Table 5, which are hereby incorporated by reference. Atp-binding cassette, sub-family d (ald), member 3 (ABCD3, Accession NP_002849.1) is another GAM189 target gene, herein designated TARGET GENE. ABCD3 BINDING SITE is a target binding site found in the 3' untranslated region of mRNA encoded by ABCD3, corresponding to a target binding site such as BINDING SITE I, BINDING SITE II or BINDING SITE III of FIG. 8. Table 4 illustrates the complementarity of the nucleotide sequences of ABCD3 BINDING SITE, designated SEQ ID:14444, to the nucleotide sequence of GAM189 RNA, herein designated GAM RNA, also designated SEQ ID:246.

Another function of GAM189 is therefore inhibition of Atp-binding cassette, sub-family d (ald), member 3 (ABCD3, Accession NP_002849.1), a gene which a probable transporter. and therefore is associated with Zellweger syndrome-2 (zws-2). Accordingly, utilities of GAM189 include diagnosis, prevention and treatment of Zellweger syndrome-2 (zws-2), and of other diseases and clinical conditions associated with ABCD3.

The function of ABCD3 has been established by previous studies. Peroxisomes are single, membrane-bound, spheroid organelles present in virtually all eukaryotic cells. The polypeptide composition of the peroxisomal membrane is distinct from that of other organelles and comprises 2 quantitatively major (22K and 70K) and several minor peroxisomal membrane proteins. The peroxisome matrix contains more than 40 enzymes which are involved in a variety of metabolic processes including peroxide-based respiration, synthesis of plasmalogen and bile acids, beta-oxidation of very long chain fatty acids, and glyoxylate transamination. Biogenesis of peroxisomes appears to proceed by import of newly synthesized proteins into existing peroxisomes which enlarge and divide. Most matrix enzymes use an SKL (ser-lys-leu) tripeptide at the C-terminus as a targeting sequence, and the import of at least one, acyl-CoA oxidase, is ATP-dependent. Peroxisomal membrane proteins (PMP), as well as the peroxisomal matrix enzymes, are synthesized on free cytoplasmic polysomes at their mature size. Disorders with defective peroxisome biogenesis include Zellweger syndrome (ZWS1; 214100) and neonatal adrenoleukodystrophy (OMIM Ref. No. 202370). In these disorders, many peroxisomal matrix proteins are mislocated in the cytosol, whereas others, such as PMP70, PMP22 (OMIM Ref. No. 601097), and thiolase precursor, are associated with irregularly shaped vesicles which may be defective peroxisomes or peroxisome precursors. These observations led to the hypothesis that the peroxisome biogenesis defects are due to defective import mechanisms for peroxisomal matrix enzymes. Somatic cell fusion studies indicated the existence of at least 11 complementation groups for ZS and related phenotypes (Moser et al., 1995). PMP70 was mapped to chromosome 1 by analysis of somatic cell hybrid DNAs (Gartner et al., 1992) and regionalized to 1p22-p21 by fluorescence in situ hybridization (1,2: Gartner et al., 1992, 1993). The gene encoding the mouse homolog of PMP70 (Pmp1) was located on chromosome 3 by interspecific backcross analysis.

Full details of the abovementioned studies are described in the following publications, the disclosure of which are hereby incorporated by reference:

Moser, A. B.; Rasmussen, M.; Naidu, S.; Watkins, P. A.; McGuinness, M.; Hajra, A. K.; Chen, G.; Raymond, G.; Liu, A.; Gordon, D.; Garnaas, K.; Walton, D. S.; Skjedal, O. H.; Guggenheim, M. A.; Jackson, L. G.; Elias, E. R.; Moser, H. W.: Phenotype of patients with peroxisomal disorders subdivided into sixteen complementation groups. J. Pediat. 127: 13-22, 1995; and Gartner, J.; Kearns, W.; Pearson, P.; Valle, D.: Characterization and localization of the human 70-kD peroxisomal membrane protein (PMP70) gene. (Abstract) Am. J. Hum. Genet. 51 (suppl.

Further studies establishing the function and utilities of ABCD3 are found in John Hopkins OMIM database record ID 170995, and in cited publications listed in Table 5, which are hereby incorporated by reference. Acyl-coenzyme a dehydrogenase, short/branched chain (ACADSB, Accession NP_001600.1) is another GAM189 target gene, herein designated TARGET GENE. ACADSB BINDING SITE is a target binding site found in the 3' untranslated region of mRNA encoded by ACADSB, corresponding to a target binding site such as BINDING SITE I, BINDING SITE II or BINDING SITE III of FIG. 8. Table 4 illustrates the complementarity of the nucleotide sequences of ACADSB BINDING SITE, designated SEQ ID:16689, to the nucleotide sequence of GAM189 RNA, herein designated GAM RNA, also designated SEQ ID:246.

Another function of GAM189 is therefore inhibition of Acyl-coenzyme a dehydrogenase, short/branched chain (ACADSB, Accession NP_001600.1). Accordingly, utilities of GAM189 include diagnosis, prevention and treatment of diseases and clinical conditions associated with ACADSB.

Acid phosphatase 5, tartrate resistant (ACP5, Accession NP_001602.1) is another GAM189 target gene, herein designated TARGET GENE. ACP5 BINDING SITE is a target binding site found in the 3' untranslated region of mRNA encoded by ACP5, corresponding to a target binding site such as BINDING SITE I, BINDING SITE II or BINDING SITE III of FIG. 8. Table 4 illustrates the complementarity of the nucleotide sequences of ACP5 BINDING SITE, designated SEQ ID:6638, to the nucleotide sequence of GAM189 RNA, herein designated GAM RNA, also designated SEQ ID:246.

Another function of GAM189 is therefore inhibition of Acid phosphatase 5, tartrate resistant (ACP5, Accession NP_001602.1). Accordingly, utilities of GAM189 include diagnosis, prevention and treatment of diseases and clinical conditions associated with ACP5.

A disintegrin-like and metalloprotease (reprolysin type) with thrombospondin type 1 motif, 4 (ADAMTS4, Accession NP_005090.1) is another GAM189 target gene, herein designated TARGET GENE. ADAMTS4 BINDING SITE1 and ADAMTS4 BINDING SITE2 are target binding sites found in untranslated regions of mRNA encoded by ADAMTS4, corresponding to target binding sites such as BINDING SITE I, BINDING SITE II or BINDING SITE III of FIG. 8. Table 4 illustrates the complementarity of the nucleotide sequences of ADAMTS4 BINDING SITE1 and ADAMTS4 BINDING SITE2, designated SEQ ID:1651 and SEQ ID:13757 respectively, to the nucleotide sequence of GAM189 RNA, herein designated GAM RNA, also designated SEQ ID:246.

Another function of GAM189 is therefore inhibition of A disintegrin-like and metalloprotease (reprolysin type) with thrombospondin type 1 motif, 4 (ADAMTS4, Accession NP_005090.1), a gene which cleaves aggrecan, a cartilage proteoglycan, and may be involved in its turnover. Accordingly, utilities of GAM189 include diagnosis, prevention and treatment of diseases and clinical conditions associated with ADAMTS4.

The function of ADAMTS4 has been established by previous studies. Aggrecan degradation is an important factor in the erosion of articular cartilage in arthritic diseases. This degradation involves proteolysis of the aggrecan core protein near the N terminus, where 2 major cleavage sites have been identified. Matrix metalloproteinases (MMPs) cleave aggrecan between asn341 and phe342. Aggrecanase cleaves aggrecan between glu373 and ala374. Tortorella et al. (1999) purified and partially sequenced bovine aggrecanase-1. By PCR with primers designed from a highly homologous murine EST, they cloned sequences from the homologous human cDNA. They assembled a full-length open reading frame from this initial human PCR product and from another human EST. The human aggrecanase-1 (ADAMTS4) open reading frame encodes an 837-amino acid protein with a signal sequence, a propeptide domain, a catalytic domain, a disintegrin-like domain, and a C-terminal domain with a thrombospondin (TSP) type 1 motif. There is a conserved zinc-binding domain and a furin-sensitive sequence. The presence of a probable cysteine switch sequence in aggrecanase-1 suggested that, like the MMPs, it is synthesized as a zymogen and is cleaved to remove the propeptide domain and generate the mature active enzyme. A cloned portion of the bovine aggrecanase-1 cDNA was 94% homologous to the human cDNA. Human aggrecanase-1 cleaved bovine aggrecan between the glu373-ala374, but not the asn341-phe342, bond. Tortorella et al. (1999) stated that ADAMTS4 mRNA is present in brain, lung, and heart, and at very low levels in placenta and muscle tissues. By RT-PCR, Tortorella et al. (1999) observed upregulation of the aggrecanase-1 message in stimulated human fetal chondrocytes and in joint tissues from adjuvant arthritic rats. Using a GeneBridge 4 radiation hybrid panel, Ishikawa et al. (1998) mapped the ADAMTS4 gene to chromosome 1. Hurskainen et al. (1999) mapped the human ADAMTS4 gene to chromosome 1 by somatic cell hybrid analysis. They mapped the mouse Adamts4 gene to chromosome 1.

Full details of the abovementioned studies are described in the following publications, the disclosure of which are hereby incorporated by reference:

Tortorella, M. D.; Burn, T. C.; Pratta, M. A.; Abbaszade, I.; Hollis, J. M.; Liu, R.; Rosenfeld, S. A.; Copeland, R. A.; Decicco, C. P.; Wynn, R.; Rockwell, A.; Yang, F.; and 16 others: Purification and cloning of aggrecanase-1: a member of the ADAMTS family of proteins. Science 284:1664-1666, 1999; and Hurskainen, T. L.; Hirohata, S.; Seldin, M. F.; Apte, S. S.: ADAM-TS5, ADAM-TS6, and ADAM-TS7, novel members of a new family of zinc metalloproteases: general features and genomic dist.

Further studies establishing the function and utilities of ADAMTS4 are found in John Hopkins OMIM database record ID 603876, and in cited publications listed in Table 5, which are hereby incorporated by reference. Adenylate cyclase 6 (ADCY6, Accession NP_066193.1) is another GAM189 target gene, herein designated TARGET GENE. ADCY6 BINDING SITE1 and ADCY6 BINDING SITE2 are target binding sites found in untranslated regions of multiple transcripts of mRNA encoded by ADCY6, corresponding to target binding sites such as BINDING SITE I, BINDING SITE II or BINDING SITE III of FIG. 8. Table 4 illustrates the complementarity of the nucleotide sequences of ADCY6 BINDING SITE1 and ADCY6 BINDING SITE2, designated SEQ ID:15161 and SEQ ID:16688 respectively, to the nucleotide sequence of GAM189 RNA, herein designated GAM RNA, also designated SEQ ID:246.

Another function of GAM189 is therefore inhibition of Adenylate cyclase 6 (ADCY6, Accession NP_066193.1), a gene which this a membrane-bound, ca(2+)-inhibitable adenylyl cyclase (by similarity). Accordingly, utilities of GAM189 include diagnosis, prevention and treatment of diseases and clinical conditions associated with ADCY6.

The function of ADCY6 and its association with various diseases and clinical conditions, has been established by previous studies, as described hereinabove with reference to GAM67.2. Adenylate cyclase 6 (ADCY6, Accession NP_056085.1) is another GAM189 target gene, herein designated TARGET GENE. ADCY6 BINDING SITE1 and ADCY6 BINDING SITE2 are target binding sites found in untranslated regions of multiple transcripts of mRNA encoded by ADCY6, corresponding to target binding sites such as BINDING SITE I, BINDING SITE II or BINDING SITE III of FIG. 8. Table 4 illustrates the complementarity of the nucleotide sequences of ADCY6 BINDING SITE1 and ADCY6 BINDING SITE2, designated SEQ ID:15161 and SEQ ID:19456 respectively, to the nucleotide sequence of GAM189 RNA, herein designated GAM RNA, also designated SEQ ID:246.

Another function of GAM189 is therefore inhibition of Adenylate cyclase 6 (ADCY6, Accession NP_056085.1), a gene which this a membrane-bound, ca(2+)-inhibitable adenylyl cyclase (by similarity). Accordingly, utilities of GAM189 include diagnosis, prevention and treatment of diseases and clinical conditions associated with ADCY6.

The function of ADCY6 and its association with various diseases and clinical conditions, has been established by previous studies, as described hereinabove with reference to GAM67.2. Agmatine ureohydrolase (agmatinase) (AGMAT, Accession NP_079034.2) is another GAM189 target gene, herein designated TARGET GENE. AGMAT BINDING SITE is a target binding site found in the 3' untranslated region of mRNA encoded by AGMAT, corresponding to a target binding site such as BINDING SITE I, BINDING SITE II or BINDING SITE III of FIG. 8. Table 4 illustrates the complementarity of the nucleotide sequences of AGMAT BINDING SITE, designated SEQ ID:9193, to the nucleotide sequence of GAM189 RNA, herein designated GAM RNA, also designated SEQ ID:246.

Another function of GAM189 is therefore inhibition of Agmatine ureohydrolase (agmatinase) (AGMAT, Accession NP_079034.2). Accordingly, utilities of GAM189 include diagnosis, prevention and treatment of diseases and clinical conditions associated with AGMAT.

Aryl hydrocarbon receptor (AHR, Accession NP_001612.1) is another GAM189 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:8217, to the nucleotide sequence of GAM189 RNA, herein designated GAM RNA, also designated SEQ ID:246.

Another function of GAM189 is therefore inhibition of Aryl hydrocarbon receptor (AHR, Accession NP_001612.1), a gene which plays a role in modulating carcinogenesis through the induction of xenobiotic-metabolizing enzymes and therefore may be associated with Stomach tumors. Accordingly, utilities of GAM189 include diagnosis, prevention and treatment of Stomach tumors, and of other diseases and clinical conditions associated with AHR.

The function of AHR and its association with various diseases and clinical conditions, has been established by previous studies, as described hereinabove with reference to GAM30.1. Absent in melanoma 1 (AIM1, Accession XP_166300.1) is another GAM189 target gene, herein designated TARGET GENE. AIM1 BINDING SITE is a target binding site found in the 3' untranslated region of mRNA encoded by AIM1, corresponding to a target binding site such as BINDING SITE I, BINDING SITE II or BINDING SITE III of FIG. 8. Table 4 illustrates the complementarity of the nucleotide sequences of AIM1 BINDING SITE, designated SEQ ID:16864, to the nucleotide sequence of GAM189 RNA, herein designated GAM RNA, also designated SEQ ID:246.

Another function of GAM189 is therefore inhibition of Absent in melanoma 1 (AIM1, Accession XP_166300.1), a gene which is altered in association with tumor suppression in a model of human melanoma and therefore may be associated with Malignant melanoma. Accordingly, utilities of GAM189 include diagnosis, prevention and treatment of Malignant melanoma, and of other diseases and clinical conditions associated with AIM1.

The function of AIM1 and its association with various diseases and clinical conditions, has been established by previous studies, as described hereinabove with reference to GAM136.1. Aldo-keto reductase family 1, member d1 (delta 4-3-ketosteroid-5-beta-reductase) (AKR1D1, Accession NP_005980.1) is another GAM189 target gene, herein designated TARGET GENE. AKR1D1 BINDING SITE is a target binding site found in the 3' untranslated region of mRNA encoded by AKR1D1, corresponding to a target binding site such as BINDING SITE I, BINDING SITE II or BINDING SITE III of FIG. 8. Table 4 illustrates the complementarity of the nucleotide sequences of AKR1D1 BINDING SITE, designated SEQ ID:8063, to the nucleotide sequence of GAM189 RNA, herein designated GAM RNA, also designated SEQ ID:246.

Another function of GAM189 is therefore inhibition of Aldo-keto reductase family 1, member d1 (delta 4-3-ketosteroid-5-beta-reductase) (AKR1D1, Accession NP_005980.1). Accordingly, utilities of GAM189 include diagnosis, prevention and treatment of diseases and clinical conditions associated with AKR1D1.

Aldehyde dehydrogenase 1 family, member b1 (ALDH1B1, Accession NP_000683.3) is another GAM189 target gene, herein designated TARGET GENE. ALDH1B1 BINDING SITE is a target binding site found in the 3' untranslated region of mRNA encoded by ALDH1B1, corresponding to a target binding site such as BINDING SITE I, BINDING SITE II or BINDING SITE III of FIG. 8. Table 4 illustrates the complementarity of the nucleotide sequences of ALDH1B1 BINDING SITE, designated SEQ ID:2153, to the nucleotide sequence of GAM189 RNA, herein designated GAM RNA, also designated SEQ ID:246.

Another function of GAM189 is therefore inhibition of Aldehyde dehydrogenase 1 family, member b1 (ALDH1B1, Accession NP_000683.3). Accordingly, utilities of GAM189 include diagnosis, prevention and treatment of diseases and clinical conditions associated with ALDH1B1.

Arachidonate 15-lipoxygenase (ALOX15, Accession NP_001131.1) is another GAM189 target gene, herein designated TARGET GENE. ALOX15 BINDING SITE is a target binding site found in the 3' untranslated region of mRNA encoded by ALOX15, corresponding to a target binding site such as BINDING SITE I, BINDING SITE II or BINDING SITE III of FIG. 8. Table 4 illustrates the complementarity of the nucleotide sequences of ALOX15 BINDING SITE, designated SEQ ID:19939, to the nucleotide sequence of GAM189 RNA, herein designated GAM RNA, also designated SEQ ID:246.

Another function of GAM189 is therefore inhibition of Arachidonate 15-lipoxygenase (ALOX15, Accession NP_001131.1), a gene which converts arachidonic acid to 15s-hydroperoxyeicosatetraenoic acid. Accordingly, utilities of GAM189 include diagnosis, prevention and treatment of diseases and clinical conditions associated with ALOX15.

The function of ALOX15 has been established by previous studies. Yoshimoto et al. (1990) found that the amino acid sequence of human reticulocyte 15-lipoxygenase (Sigal et al., 1988) showed 86% identity with that of porcine leukocyte 12-lipoxygenase (OMIM Ref. No. 152391). Sigal et al. (1988) found 61% sequence similarity between 15-lipoxygenase and 5-lipoxygenase (OMIM Ref. No. 152390). This suggests that in the human 12-lipoxygenase is more closely related evolutionarily to 15-lipoxygenase than to 5-lipoxygenase, even though the comparisons are made between human and porcine enzymes. By PCR analysis of a human-hamster somatic hybrid DNA panel, Funk et al. (1992) demonstrated that genes for 12-lipoxygenase and 15-lipoxygenase are located on human chromosome 17, whereas the most unrelated lipoxygenase (5-lipoxygenase) was mapped to chromosome 10. Kelavkar and Badr (1999) stated that the ALOX15 gene maps to 17p13.3 in close proximity to the tumor-suppressor gene TP53 (OMIM Ref. No. 191170). The ALOX15 gene product is implicated in antiinflammation, membrane remodeling, and cancer development/metastasis. Kelavkar and Badr (1999) described experiments yielding data that supported the hypothesis that loss of the TP53 gene, or gain-of- function activities resulting from the expression of its mutant forms, regulates ALOX15 promoter activity in human and in mouse, albeit in directionally opposite manners. These studies defined a direct link between ALOX15 gene activity and an established tumor-suppressor gene located in close chromosomal proximity. Kelavkar and Badr (1999) referred to this as evidence that 15-lipoxygenase is a mutator gene.

Full details of the abovementioned studies are described in the following publications, the disclosure of which are hereby incorporated by reference:

Kelavkar, U. P.; Badr, K. F.: Effects of mutant p53 expression on human 15-lipoxygenase-promoter activity and murine 12/15-lipoxygenase gene expression: evidence that 15-lipoxygenase is a mutator gene. Proc. Nat. Acad. Sci. 96:4378-4383, 1999; and Yoshimoto, T.; Suzuki, H.; Yamamoto, S.; Takai, T.; Yokoyama, C.; Tanabe, T.: Cloning and sequence analysis of the cDNA for arachidonate 12-lipoxygenase of porcine leukocytes. Proc. Na.

Further studies establishing the function and utilities of ALOX15 are found in John Hopkins OMIM database record ID 152392, and in cited publications listed in Table 5, which are hereby incorporated by reference. AMID (Accession NP_116186.1) is another GAM189 target gene, herein designated TARGET GENE. AMID BINDING SITE is a target binding site found in the 3' untranslated region of mRNA encoded by AMID, corresponding to a target binding site such as BINDING SITE I, BINDING SITE II or BINDING SITE III of FIG. 8. Table 4 illustrates the complementarity of the nucleotide sequences of AMID BINDING SITE, designated SEQ ID:5895, to the nucleotide sequence of GAM189 RNA, herein designated GAM RNA, also designated SEQ ID:246.

Another function of GAM189 is therefore inhibition of AMID (Accession NP_116186.1). Accordingly, utilities of GAM189 include diagnosis, prevention and treatment of diseases and clinical conditions associated with AMID.

Ankyrin repeat domain 6 (ANKRD6, Accession NP_055757.1) is another GAM189 target gene, herein designated TARGET GENE. ANKRD6 BINDING SITE is a target binding site found in the 3' untranslated region of mRNA encoded by ANKRD6, corresponding to a target binding site such as BINDING SITE I, BINDING SITE II or BINDING SITE III of FIG. 8. Table 4 illustrates the complementarity of the nucleotide sequences of ANKRD6 BINDING SITE, designated SEQ ID:1746, to the nucleotide sequence of GAM189 RNA, herein designated GAM RNA, also designated SEQ ID:246.

Another function of GAM189 is therefore inhibition of Ankyrin repeat domain 6 (ANKRD6, Accession NP_055757.1). Accordingly, utilities of GAM189 include diagnosis, prevention and treatment of diseases and clinical conditions associated with ANKRD6.

Adaptor-related protein complex 3, sigma 2 subunit (AP3S2, Accession NP_005820.1) is another GAM189 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:19874, to the nucleotide sequence of GAM189 RNA, herein designated GAM RNA, also designated SEQ ID:246.

Another function of GAM189 is therefore inhibition of Adaptor-related protein complex 3, sigma 2 subunit (AP3S2, Accession NP_005820.1). Accordingly, utilities of GAM189 include diagnosis, prevention and treatment of diseases and clinical conditions associated with AP3S2.

Apoptotic protease activating factor (APAF1, Accession NP_001151.1) is another GAM189 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:16578 and SEQ ID:19360 respectively, to the nucleotide sequence of GAM189 RNA, herein designated GAM RNA, also designated SEQ ID:246.

Another function of GAM189 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM189 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apoptotic protease activating factor (APAF1, Accession NP_037361.1) is another GAM189 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:19360 and SEQ ID:16578 respectively, to the nucleotide sequence of GAM189 RNA, herein designated GAM RNA, also designated SEQ ID:246.

Another function of GAM189 is therefore inhibition of Apoptotic protease activating factor (APAF1, Accession NP_037361.1), a gene which functions in the mitochondrial apoptotic pathway that leads to caspase 9 dependent activation of caspase 3 and therefore may be associated with Cancer. Accordingly, utilities of GAM189 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. APM1 (Accession NP_004788.1) is another GAM189 target gene, herein designated TARGET GENE. APM1 BINDING SITE1 and APM1 BINDING SITE2 are target binding sites found in untranslated regions of mRNA encoded by APM1, corresponding to target binding sites such as BINDING SITE I, BINDING SITE II or BINDING SITE III of FIG. 8. Table 4 illustrates the complementarity of the nucleotide sequences of APM1 BINDING SITE1 and APM1 BINDING SITE2, designated SEQ ID:20035 and SEQ ID:5598 respectively, to the nucleotide sequence of GAM189 RNA, herein designated GAM RNA, also designated SEQ ID:246.

Another function of GAM189 is therefore inhibition of APM1 (Accession NP_004788.1). Accordingly, utilities of GAM189 include diagnosis, prevention and treatment of diseases and clinical conditions associated with APM1.

Apolipoprotein b mrna editing enzyme, catalytic polypeptide-like 3f (APOBEC3F, Accession NP_660341.2) is another GAM189 target gene, herein designated TARGET GENE. APOBEC3F BINDING SITE is a target binding site found in the 3' untranslated region of mRNA encoded by APOBEC3F, corresponding to a target binding site such as BINDING SITE I, BINDING SITE II or BINDING SITE III of FIG. 8. Table 4 illustrates the complementarity of the nucleotide sequences of APOBEC3F BINDING SITE, designated SEQ ID:5622, to the nucleotide sequence of GAM189 RNA, herein designated GAM RNA, also designated SEQ ID:246.

Another function of GAM189 is therefore inhibition of Apolipoprotein b mrna editing enzyme, catalytic polypeptide-like 3f (APOBEC3F, Accession NP_660341.2). Accordingly, utilities of GAM189 include diagnosis, prevention and treatment of diseases and clinical conditions associated with APOBEC3F.

Apolipoprotein l, 1 (APOL1, Accession NP_663318.1) is another GAM189 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:9574, to the nucleotide sequence of GAM189 RNA, herein designated GAM RNA, also designated SEQ ID:246.

Another function of GAM189 is therefore inhibition of Apolipoprotein l, 1 (APOL1, Accession NP_663318.1), a gene which may participate in reverse cholesterol transport from peripheral cells to the liver. and therefore may be associated with Schizophrenia. Accordingly, utilities of GAM189 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Apolipoprotein l, 1 (APOL1, Accession NP_003652.2) is another GAM189 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:9574, to the nucleotide sequence of GAM189 RNA, herein designated GAM RNA, also designated SEQ ID:246.

Another function of GAM189 is therefore inhibition of Apolipoprotein l, 1 (APOL1, Accession NP_003652.2), a gene which may participate in reverse cholesterol transport from peripheral cells to the liver. and therefore may be associated with Schizophrenia. Accordingly, utilities of GAM189 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Apolipoprotein l, 2 (APOL2, Accession NP_663612.1) is another GAM189 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:8064, to the nucleotide sequence of GAM189 RNA, herein designated GAM RNA, also designated SEQ ID:246.

Another function of GAM189 is therefore inhibition of Apolipoprotein l, 2 (APOL2, Accession NP_663612.1). Accordingly, utilities of GAM189 include diagnosis, prevention and treatment of diseases and clinical conditions associated with APOL2.

Apolipoprotein l, 2 (APOL2, Accession NP_112092.1) is another GAM189 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:8064, to the nucleotide sequence of GAM189 RNA, herein designated GAM RNA, also designated SEQ ID:246.

Another function of GAM189 is therefore inhibition of Apolipoprotein l, 2 (APOL2, Accession NP_112092.1). Accordingly, utilities of GAM189 include diagnosis, prevention and treatment of diseases and clinical conditions associated with APOL2.

Amyloid beta precursor protein (cytoplasmic tail) binding protein 2 (APPBP2, Accession NP_006371.2) is another GAM189 target gene, herein designated TARGET GENE. APPBP2 BINDING SITE is a target binding site found in the 3' untranslated region of mRNA encoded by APPBP2, corresponding to a target binding site such as BINDING SITE I, BINDING SITE II or BINDING SITE III of FIG. 8. Table 4 illustrates the complementarity of the nucleotide sequences of APPBP2 BINDING SITE, designated SEQ ID:4095, to the nucleotide sequence of GAM189 RNA, herein designated GAM RNA, also designated SEQ ID:246.

Another function of GAM189 is therefore inhibition of Amyloid beta precursor protein (cytoplasmic tail) binding protein 2 (APPBP2, Accession NP_006371.2), a gene which interacts with the basolateral sorting signal of amyloid precursor protein. and therefore may be associated with Alzheimer's disease. Accordingly, utilities of GAM189 include diagnosis, prevention and treatment of Alzheimer's disease, and of other diseases and clinical conditions associated with APPBP2.

The function of APPBP2 and its association with various diseases and clinical conditions, has been established by previous studies, as described hereinabove with reference to GAM130.1. APPL (Accession NP_036228.1) is another GAM189 target gene, herein designated TARGET GENE. APPL BINDING SITE is a target binding site found in the 3' untranslated region of mRNA encoded by APPL, corresponding to a target binding site such as BINDING SITE I, BINDING SITE II or BINDING SITE III of FIG. 8. Table 4 illustrates the complementarity of the nucleotide sequences of APPL BINDING SITE, designated SEQ ID:12068, to the nucleotide sequence of GAM189 RNA, herein designated GAM RNA, also designated SEQ ID:246.

Another function of GAM189 is therefore inhibition of APPL (Accession NP_036228.1). Accordingly, utilities of GAM189 include diagnosis, prevention and treatment of diseases and clinical conditions associated with APPL.

Aquaporin 2 (collecting duct) (AQP2, Accession NP_000477.1) is another GAM189 target gene, herein designated TARGET GENE. AQP2 BINDING SITE is a target binding site found in the 3' untranslated region of mRNA encoded by AQP2, corresponding to a target binding site such as BINDING SITE I, BINDING SITE II or BINDING SITE III of FIG. 8. Table 4 illustrates the complementarity of the nucleotide sequences of AQP2 BINDING SITE, designated SEQ ID:18318, to the nucleotide sequence of GAM189 RNA, herein designated GAM RNA, also designated SEQ ID:246.

Another function of GAM189 is therefore inhibition of Aquaporin 2 (collecting duct) (AQP2, Accession NP_000477.1). Accordingly, utilities of GAM189 include diagnosis, prevention and treatment of diseases and clinical conditions associated with AQP2.

Aquaporin 6, kidney specific (AQP6, Accession NP_445738.1) is another GAM189 target gene, herein designated TARGET GENE. AQP6 BINDING SITE1 through AQP6 BINDING SITE3 are target binding sites found in untranslated regions of multiple transcripts of mRNA encoded by AQP6, corresponding to target binding sites such as BINDING SITE I, BINDING SITE II or BINDING SITE III of FIG. 8. Table 4 illustrates the complementarity of the nucleotide sequences of AQP6 BINDING SITE1 through AQP6 BINDING SITE3, designated SEQ ID:3169, SEQ ID:3169 and SEQ ID:7869 respectively, to the nucleotide sequence of GAM189 RNA, herein designated GAM RNA, also designated SEQ ID:246.

Another function of GAM189 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM189 include diagnosis, prevention and treatment of diseases and clinical conditions associated with AQP6.

The function of AQP6 and its association with various diseases and clinical conditions, has been established by previous studies, as described hereinabove with reference to GAM51.1. Aquaporin 6, kidney specific (AQP6, Accession NP_001643.1) is another GAM189 target gene, herein designated TARGET GENE. AQP6 BINDING SITE1 through AQP6 BINDING SITE3 are target binding sites found in untranslated regions of multiple transcripts of mRNA encoded by AQP6, corresponding to target binding sites such as BINDING SITE I, BINDING SITE II or BINDING SITE III of FIG. 8. Table 4 illustrates the complementarity of the nucleotide sequences of AQP6 BINDING SITE1 through AQP6 BINDING SITE3, designated SEQ ID:8069, SEQ ID:13747 and SEQ ID:6901 respectively, to the nucleotide sequence of GAM189 RNA, herein designated GAM RNA, also designated SEQ ID:246.

Another function of GAM189 is therefore inhibition of Aquaporin 6, kidney specific (AQP6, Accession NP_001643.1), a gene which participates in distinct physiologic function such as glomerular filtration, tubular endocytosis, and acid-base-metabolism. Accordingly, utilities of GAM189 include diagnosis, prevention and treatment of diseases and clinical conditions associated with AQP6.

The function of AQP6 and its association with various diseases and clinical conditions, has been established by previous studies, as described hereinabove with reference to GAM51.1. Rho gtpase activating protein 1 (ARHGAP1, Accession NP_004299.1) is another GAM189 target gene, herein designated TARGET GENE. ARHGAP1 BINDING SITE is a target binding site found in the 3' untranslated region of mRNA encoded by ARHGAP1, corresponding to a target binding site such as BINDING SITE I, BINDING SITE II or BINDING SITE III of FIG. 8. Table 4 illustrates the complementarity of the nucleotide sequences of ARHGAP1 BINDING SITE, designated SEQ ID:4096, to the nucleotide sequence of GAM189 RNA, herein designated GAM RNA, also designated SEQ ID:246.

Another function of GAM189 is therefore inhibition of Rho gtpase activating protein 1 (ARHGAP1, Accession NP_004299.1). Accordingly, utilities of GAM189 include diagnosis, prevention and treatment of diseases and clinical conditions associated with ARHGAP1.

ARHGAP11A (Accession NP_055598.1) is another GAM189 target gene, herein designated TARGET GENE. ARHGAP11A BINDING SITE is a target binding site found in the 3' untranslated region of mRNA encoded by ARHGAP11A, corresponding to a target binding site such as BINDING SITE I, BINDING SITE II or BINDING SITE III of FIG. 8. Table 4 illustrates the complementarity of the nucleotide sequences of ARHGAP11A BINDING SITE, designated SEQ ID:17742, to the nucleotide sequence of GAM189 RNA, herein designated GAM RNA, also designated SEQ ID:246.

Another function of GAM189 is therefore inhibition of ARHGAP11A (Accession NP_055598.1). Accordingly, utilities of GAM189 include diagnosis, prevention and treatment of diseases and clinical conditions associated with ARHGAP11A.

ARK5 (Accession NP_055655.1) is another GAM189 target gene, herein designated TARGET GENE. ARK5 BINDING SITE is a target binding site found in the 3' untranslated region of mRNA encoded by ARK5, corresponding to a target binding site such as BINDING SITE I, BINDING SITE II or BINDING SITE III of FIG. 8. Table 4 illustrates the complementarity of the nucleotide sequences of ARK5 BINDING SITE, designated SEQ ID:17859, to the nucleotide sequence of GAM189 RNA, herein designated GAM RNA, also designated SEQ ID:246.

Another function of GAM189 is therefore inhibition of ARK5 (Accession NP_055655.1). Accordingly, utilities of GAM189 include diagnosis, prevention and treatment of diseases and clinical conditions associated with ARK5.

ARPP-19 (Accession NP_006619.1) is another GAM189 target gene, herein designated TARGET GENE. ARPP-19 BINDING SITE is a target binding site found in the 3' untranslated region of mRNA encoded by ARPP-19, corresponding to a target binding site such as BINDING SITE I, BINDING SITE II or BINDING SITE III of FIG. 8. Table 4 illustrates the complementarity of the nucleotide sequences of ARPP-19 BINDING SITE, designated SEQ ID:944, to the nucleotide sequence of GAM189 RNA, herein designated GAM RNA, also designated SEQ ID:246.

Another function of GAM189 is therefore inhibition of ARPP-19 (Accession NP_006619.1). Accordingly, utilities of GAM189 include diagnosis, prevention and treatment of diseases and clinical conditions associated with ARPP-19.

Ankyrin repeat and socs box-containing 16 (ASB16, Accession NP_543139.4) is another GAM189 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:14722, to the nucleotide sequence of GAM189 RNA, herein designated GAM RNA, also designated SEQ ID:246.

Another function of GAM189 is therefore inhibition of Ankyrin repeat and socs box-containing 16 (ASB16, Accession NP_543139.4) . Accordingly, utilities of GAM189 include diagnosis, prevention and treatment of diseases and clinical conditions associated with ASB16.

Ankyrin repeat and socs box-containing 6 (ASB6, Accession NP_821066.1) is another GAM189 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:2196 and SEQ ID:10305 respectively, to the nucleotide sequence of GAM189 RNA, herein designated GAM RNA, also designated SEQ ID:246.

Another function of GAM189 is therefore inhibition of Ankyrin repeat and socs box-containing 6 (ASB6, Accession NP_821066.1). Accordingly, utilities of GAM189 include diagnosis, prevention and treatment of diseases and clinical conditions associated with ASB6.

Ankyrin repeat and socs box-containing 6 (ASB6, Accession NP_060343.1) is another GAM189 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:10305 and SEQ ID:2196 respectively, to the nucleotide sequence of GAM189 RNA, herein designated GAM RNA, also designated SEQ ID:246.

Another function of GAM189 is therefore inhibition of Ankyrin repeat and socs box-containing 6 (ASB6, Accession NP_060343.1). Accordingly, utilities of GAM189 include diagnosis, prevention and treatment of diseases and clinical conditions associated with ASB6.

ASE-1 (Accession NP_036231.1) is another GAM189 target gene, herein designated TARGET GENE. ASE-1 BINDING SITE1 and ASE-1 BINDING SITE2 are target binding sites found in untranslated regions of mRNA encoded by ASE-1, corresponding to target binding sites such as BINDING SITE I, BINDING SITE II or BINDING SITE III of FIG. 8. Table 4 illustrates the complementarity of the nucleotide sequences of ASE-1 BINDING SITE1 and ASE-1 BINDING SITE2, designated SEQ ID:1741 and SEQ ID:3101 respectively, to the nucleotide sequence of GAM189 RNA, herein designated GAM RNA, also designated SEQ ID:246.

Another function of GAM189 is therefore inhibition of ASE-1 (Accession NP_036231.1). Accordingly, utilities of GAM189 include diagnosis, prevention and treatment of diseases and clinical conditions associated with ASE-1.

ATF7IP2 (Accession NP_079273.1) is another GAM189 target gene, herein designated TARGET GENE. ATF7IP2 BINDING SITE is a target binding site found in the 3' untranslated region of mRNA encoded by ATF7IP2, corresponding to a target binding site such as BINDING SITE I, BINDING SITE II or BINDING SITE III of FIG. 8. Table 4 illustrates the complementarity of the nucleotide sequences of ATF7IP2 BINDING SITE, designated SEQ ID:9602, to the nucleotide sequence of GAM189 RNA, herein designated GAM RNA, also designated SEQ ID:246.

Another function of GAM189 is therefore inhibition of ATF7IP2 (Accession NP_079273.1). Accordingly, utilities of GAM189 include diagnosis, prevention and treatment of diseases and clinical conditions associated with ATF7IP2.

Ataxia telangiectasia mutated (includes complementation groups a, c and d) (ATM, Accession NP_612150.1) is another GAM189 target gene, herein designated TARGET GENE. ATM BINDING SITE is a target binding site found in the 3' untranslated region of multiple transcripts of mRNA encoded by ATM, corresponding to a target binding site such as BINDING SITE I, BINDING SITE II or BINDING SITE III of FIG. 8. Table 4 illustrates the complementarity of the nucleotide sequences of ATM BINDING SITE, designated SEQ ID:1837, to the nucleotide sequence of GAM189 RNA, herein designated GAM RNA, also designated SEQ ID:246.

Another function of GAM189 is therefore inhibition of Ataxia telangiectasia mutated (includes complementation groups a, c and d) (ATM, Accession NP_612150.1). Accordingly, utilities of GAM189 include diagnosis, prevention and treatment of diseases and clinical conditions associated with ATM.

Atpase, na+/k+ transporting, beta 2 polypeptide (ATP1B2, Accession NP_001669.1) is another GAM189 target gene, herein designated TARGET GENE. ATP1B2 BINDING SITE is a target binding site found in the 3' untranslated region of mRNA encoded by ATP1B2, corresponding to a target binding site such as BINDING SITE I, BINDING SITE II or BINDING SITE III of FIG. 8. Table 4 illustrates the complementarity of the nucleotide sequences of ATP1B2 BINDING SITE, designated SEQ ID:16916, to the nucleotide sequence of GAM189 RNA, herein designated GAM RNA, also designated SEQ ID:246.

Another function of GAM189 is therefore inhibition of Atpase, na+/k+ transporting, beta 2 polypeptide (ATP1B2, Accession NP_001669.1), a gene which catalyzes the hydrolysis of ATP coupled with the exchange of Na+/K+ ions across the plasma membrane. Accordingly, utilities of GAM189 include diagnosis, prevention and treatment of diseases and clinical conditions associated with ATP1B2.

The function of ATP1B2 and its association with various diseases and clinical conditions, has been established by previous studies, as described hereinabove with reference to GAM130.1. Atpase, (na+)/k+ transporting, beta 4 polypeptide (ATP1B4, Accession NP_036201.1) is another GAM189 target gene, herein designated TARGET GENE. ATP1B4 BINDING SITE is a target binding site found in the 3' untranslated region of mRNA encoded by ATP1B4, corresponding to a target binding site such as BINDING SITE I, BINDING SITE II or BINDING SITE III of FIG. 8. Table 4 illustrates the complementarity of the nucleotide sequences of ATP1B4 BINDING SITE, designated SEQ ID:13042, to the nucleotide sequence of GAM189 RNA, herein designated GAM RNA, also designated SEQ ID:246.

Another function of GAM189 is therefore inhibition of Atpase, (na+)/k+ transporting, beta 4 polypeptide (ATP1B4, Accession NP_036201.1). Accordingly, utilities of GAM189 include diagnosis, prevention and treatment of diseases and clinical conditions associated with ATP1B4.

Atpase, h+transporting, lysosomal 38 kda, v0 subunit d isoform 2 (ATP6V0D2, Accession NP_689778.1) is another GAM189 target gene, herein designated TARGET GENE. ATP6V0D2 BINDING SITE is a target binding site found in the 3' untranslated region of mRNA encoded by ATP6V0D2, corresponding to a target binding site such as BINDING SITE I, BINDING SITE II or BINDING SITE III of FIG. 8. Table 4 illustrates the complementarity of the nucleotide sequences of ATP6V0D2 BINDING SITE, designated SEQ ID:15039, to the nucleotide sequence of GAM189 RNA, herein designated GAM RNA, also designated SEQ ID:246.

Another function of GAM189 is therefore inhibition of Atpase, h+transporting, lysosomal 38 kda, v0 subunit d isoform 2 (ATP6V0D2, Accession NP_689778.1). Accordingly, utilities of GAM189 include diagnosis, prevention and treatment of diseases and clinical conditions associated with ATP6V0D2.

ATP6V1A (Accession NP_001681.2) is another GAM189 target gene, herein designated TARGET GENE. ATP6V1A BINDING SITE is a target binding site found in the 3' untranslated region of mRNA encoded by ATP6V1A, corresponding to a target binding site such as BINDING SITE I, BINDING SITE II or BINDING SITE III of FIG. 8. Table 4 illustrates the complementarity of the nucleotide sequences of ATP6V1A BINDING SITE, designated SEQ ID:18868, to the nucleotide sequence of GAM189 RNA, herein designated GAM RNA, also designated SEQ ID:246.

Another function of GAM189 is therefore inhibition of ATP6V1A (Accession NP_001681.2). Accordingly, utilities of GAM189 include diagnosis, prevention and treatment of diseases and clinical conditions associated with ATP6V1A.

Atpase, cu++transporting, alpha polypeptide (menkes syndrome) (ATP7A, Accession NP_000043.1) is another GAM189 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:4112, to the nucleotide sequence of GAM189 RNA, herein designated GAM RNA, also designated SEQ ID:246.

Another function of GAM189 is therefore inhibition of Atpase, cu++ transporting, alpha polypeptide (menkes syndrome) (ATP7A, Accession NP_000043.1). Accordingly, utilities of GAM189 include diagnosis, prevention and treatment of diseases and clinical conditions associated with ATP7A.

Atpase, class i, type 8b, member 2 (ATP8B2, Accession XP_290875.1) is another GAM189 target gene, herein designated TARGET GENE. ATP8B2 BINDING SITE is a target binding site found in the 3' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:8634, to the nucleotide sequence of GAM189 RNA, herein designated GAM RNA, also designated SEQ ID:246.

Another function of GAM189 is therefore inhibition of Atpase, class i, type 8b, member 2 (ATP8B2, Accession XP_290875.1). Accordingly, utilities of GAM189 include diagnosis, prevention and treatment of diseases and clinical conditions associated with ATP8B2.

Axl receptor tyrosine kinase (AXL, Accession NP_068713.2) is another GAM189 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:11802, to the nucleotide sequence of GAM189 RNA, herein designated GAM RNA, also designated SEQ ID:246.

Another function of GAM189 is therefore inhibition of Axl receptor tyrosine kinase (AXL, Accession NP_068713.2). Accordingly, utilities of GAM189 include diagnosis, prevention and treatment of diseases and clinical conditions associated with AXL.

Axl receptor tyrosine kinase (AXL, Accession NP_001690.2) is another GAM189 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:11802, to the nucleotide sequence of GAM189 RNA, herein designated GAM RNA, also designated SEQ ID:246.

Another function of GAM189 is therefore inhibition of Axl receptor tyrosine kinase (AXL, Accession NP_001690.2). Accordingly, utilities of GAM189 include diagnosis, prevention and treatment of diseases and clinical conditions associated with AXL.

Udp-gal:betaglcnac beta 1,4-galactosyltransferase, polypeptide 4 (B4GALT4, Accession NP_003769.1) is another GAM189 target gene, herein designated TARGET GENE. B4GALT4 BINDING SITE is a target binding site found in the 3' untranslated region of mRNA encoded by B4GALT4, corresponding to a target binding site such as BINDING SITE I, BINDING SITE II or BINDING SITE III of FIG. 8. Table 4 illustrates the complementarity of the nucleotide sequences of B4GALT4 BINDING SITE, designated SEQ ID:11028, to the nucleotide sequence of GAM189 RNA, herein designated GAM RNA, also designated SEQ ID:246.

Another function of GAM189 is therefore inhibition of Udp-gal:betaglcnac beta 1,4-galactosyltransferase, polypeptide 4 (B4GALT4, Accession NP_003769.1). Accordingly, utilities of GAM189 include diagnosis, prevention and treatment of diseases and clinical conditions associated with B4GALT4.

Xylosylprotein beta 1,4-galactosyltransferase, polypeptide 7 (galactosyltransferase i) (B4GALT7, Accession NP_009186.1) is another GAM189 target gene, herein designated TARGET GENE. B4GALT7 BINDING SITE is a target binding site found in the 3' untranslated region of mRNA encoded by B4GALT7, corresponding to a target binding site such as BINDING SITE I, BINDING SITE II or BINDING SITE III of FIG. 8. Table 4 illustrates the complementarity of the nucleotide sequences of B4GALT7 BINDING SITE, designated SEQ ID:18475, to the nucleotide sequence of GAM189 RNA, herein designated GAM RNA, also designated SEQ ID:246.

Another function of GAM189 is therefore inhibition of Xylosylprotein beta 1,4-galactosyltransferase, polypeptide 7 (galactosyltransferase i) (B4GALT7, Accession NP_009186.1). Accordingly, utilities of GAM189 include diagnosis, prevention and treatment of diseases and clinical conditions associated with B4GALT7.

BA108L7.2 (Accession NP_112233.2) is another GAM189 target gene, herein designated TARGET GENE. BA108L7.2 BINDING SITE is a target binding site found in the 3' untranslated region of mRNA encoded by BA108L7.2, corresponding to a target binding site such as BINDING SITE I, BINDING SITE II or BINDING SITE III of FIG. 8. Table 4 illustrates the complementarity of the nucleotide sequences of BA108L7.2 BINDING SITE, designated SEQ ID:10888, to the nucleotide sequence of GAM189 RNA, herein designated GAM RNA, also designated SEQ ID:246.

Another function of GAM189 is therefore inhibition of BA108L7.2 (Accession NP_112233.2). Accordingly, utilities of GAM189 include diagnosis, prevention and treatment of diseases and clinical conditions associated with BA108L7.2.

Beta-site app-cleaving enzyme 2 (BACE2, Accession NP_036237.2) is another GAM189 target gene, herein designated TARGET GENE. BACE2 BINDING SITE is a target binding site found in the 3' untranslated region of multiple transcripts of mRNA encoded by BACE2, corresponding to a target binding site such as BINDING SITE I, BINDING SITE II or BINDING SITE III of FIG. 8. Table 4 illustrates the complementarity of the nucleotide sequences of BACE2 BINDING SITE, designated SEQ ID:11052, to the nucleotide sequence of GAM189 RNA, herein designated GAM RNA, also designated SEQ ID:246.

Another function of GAM189 is therefore inhibition of Beta-site app-cleaving enzyme 2 (BACE2, Accession NP_036237.2), a gene which cleaves intracellularly the b-secretase site of amyloid precursor protein and therefore may be associated with Alzheimer's disease and down syndrome. Accordingly, utilities of GAM189 include diagnosis, prevention and treatment of Alzheimer's disease and down syndrome, and of other diseases and clinical conditions associated with BACE2.

The function of BACE2 and its association with various diseases and clinical conditions, has been established by previous studies, as described hereinabove with reference to GAM139.1. Beta-site app-cleaving enzyme 2 (BACE2, Accession NP_620476.1) is another GAM189 target gene, herein designated TARGET GENE. BACE2 BINDING SITE is a target binding site found in the 3' untranslated region of multiple transcripts of mRNA encoded by BACE2, corresponding to a target binding site such as BINDING SITE I, BINDING SITE II or BINDING SITE III of FIG. 8. Table 4 illustrates the complementarity of the nucleotide sequences of BACE2 BINDING SITE, designated SEQ ID:11052, to the nucleotide sequence of GAM189 RNA, herein designated GAM RNA, also designated SEQ ID:246.

Another function of GAM189 is therefore inhibition of Beta-site app-cleaving enzyme 2 (BACE2, Accession NP_620476.1), a gene which cleaves intracellularly the b-secretase site of amyloid precursor protein and therefore may be associated with Alzheimer's disease and down syndrome. Accordingly, utilities of GAM189 include diagnosis, prevention and treatment of Alzheimer's disease and down syndrome, and of other diseases and clinical conditions associated with BACE2.

The function of BACE2 and its association with various diseases and clinical conditions, has been established by previous studies, as described hereinabove with reference to GAM139.1. Beta-site app-cleaving enzyme 2 (BACE2, Accession NP_620477.1) is another GAM189 target gene, herein designated TARGET GENE. BACE2 BINDING SITE is a target binding site found in the 3' untranslated region of multiple transcripts of mRNA encoded by BACE2, corresponding to a target binding site such as BINDING SITE I, BINDING SITE II or BINDING SITE III of FIG. 8. Table 4 illustrates the complementarity of the nucleotide sequences of BACE2 BINDING SITE, designated SEQ ID:11052, to the nucleotide sequence of GAM189 RNA, herein designated GAM RNA, also designated SEQ ID:246.

Another function of GAM189 is therefore inhibition of Beta-site app-cleaving enzyme 2 (BACE2, Accession NP_620477.1), a gene which cleaves intracellularly the b-secretase site of amyloid precursor protein and therefore may be associated with Alzheimer's disease and down syndrome. Accordingly, utilities of GAM189 include diagnosis, prevention and treatment of Alzheimer's disease and down syndrome, and of other diseases and clinical conditions associated with BACE2.

The function of BACE2 and its association with various diseases and clinical conditions, has been established by previous studies, as described hereinabove with reference to GAM139.1. Bcl2-associated athanogene 5 (BAG5, Accession NP_004864.1) is another GAM189 target gene, herein designated TARGET GENE. BAG5 BINDING SITE is a target binding site found in the 3' untranslated region of mRNA encoded by BAG5, corresponding to a target binding site such as BINDING SITE I, BINDING SITE II or BINDING SITE III of FIG. 8. Table 4 illustrates the complementarity of the nucleotide sequences of BAG5 BINDING SITE, designated SEQ ID:5695, to the nucleotide sequence of GAM189 RNA, herein designated GAM RNA, also designated SEQ ID:246.

Another function of GAM189 is therefore inhibition of Bcl2-associated athanogene 5 (BAG5, Accession NP_004864.1). Accordingly, utilities of GAM189 include diagnosis, prevention and treatment of diseases and clinical conditions associated with BAG5.

BART1 (Accession NP_036238.1) is another GAM189 target gene, herein designated TARGET GENE. BART1 BINDING SITE is a target binding site found in the 3' untranslated region of mRNA encoded by BART1, corresponding to a target binding site such as BINDING SITE I, BINDING SITE II or BINDING SITE III of FIG. 8. Table 4 illustrates the complementarity of the nucleotide sequences of BART1 BINDING SITE, designated SEQ ID:16830, to the nucleotide sequence of GAM189 RNA, herein designated GAM RNA, also designated SEQ ID:246.

Another function of GAM189 is therefore inhibition of BART1 (Accession NP_036238.1). Accordingly, utilities of GAM189 include diagnosis, prevention and treatment of diseases and clinical conditions associated with BART1.

Bromodomain adjacent to zinc finger domain, 2a (BAZ2A, Accession NP_038477.1) is another GAM189 target gene, herein designated TARGET GENE. BAZ2A BINDING SITE is a target binding site found in the 5' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:8852, to the nucleotide sequence of GAM189 RNA, herein designated GAM RNA, also designated SEQ ID:246.

Another function of GAM189 is therefore inhibition of Bromodomain adjacent to zinc finger domain, 2a (BAZ2A, Accession NP_038477.1) . Accordingly, utilities of GAM189 include diagnosis, prevention and treatment of diseases and clinical conditions associated with BAZ2A.

BCAP31 (Accession NP_005736.2) is another GAM189 target gene, herein designated TARGET GENE. BCAP31 BINDING SITE is a target binding site found in the 3' untranslated region of mRNA encoded by BCAP31, corresponding to a target binding site such as BINDING SITE I, BINDING SITE II or BINDING SITE III of FIG. 8. Table 4 illustrates the complementarity of the nucleotide sequences of BCAP31 BINDING SITE, designated SEQ ID:4861, to the nucleotide sequence of GAM189 RNA, herein designated GAM RNA, also designated SEQ ID:246.

Another function of GAM189 is therefore inhibition of BCAP31 (Accession NP_005736.2). Accordingly, utilities of GAM189 include diagnosis, prevention and treatment of diseases and clinical conditions associated with BCAP31.

B-cell cll/lymphoma 10 (BCL10, Accession NP_003912.1) is another GAM189 target gene, herein designated TARGET GENE. BCL10 BINDING SITE is a target binding site found in the 3' untranslated region of mRNA encoded by BCL10, corresponding to a target binding site such as BINDING SITE I, BINDING SITE II or BINDING SITE III of FIG. 8. Table 4 illustrates the complementarity of the nucleotide sequences of BCL10 BINDING SITE, designated SEQ ID:19576, to the nucleotide sequence of GAM189 RNA, herein designated GAM RNA, also designated SEQ ID:246.

Another function of GAM189 is therefore inhibition of B-cell cll/lymphoma 10 (BCL10, Accession NP_003912.1), a gene which is a positive regulator of lymphocyte proliferation, NF-kappaB activator. and therefore may be associated with Malt lymphoma, follicular lymphoma. Accordingly, utilities of GAM189 include diagnosis, prevention and treatment of Malt lymphoma, follicular lymphoma, and of other diseases and clinical conditions associated with BCL10.

The function of BCL10 and its association with various diseases and clinical conditions, has been established by previous studies, as described hereinabove with reference to GAM136.1. B double prime 1, subunit of rna polymerase iii transcription initiation factor iiib (BDP1, Accession NP_060899.1) is another GAM189 target gene, herein designated TARGET GENE. BDP1 BINDING SITE is a target binding site found in the 3' untranslated region of mRNA encoded by BDP1, corresponding to a target binding site such as BINDING SITE I, BINDING SITE II or BINDING SITE III of FIG. 8. Table 4 illustrates the complementarity of the nucleotide sequences of BDP1 BINDING SITE, designated SEQ ID:19556, to the nucleotide sequence of GAM189 RNA, herein designated GAM RNA, also designated SEQ ID:246.

Another function of GAM189 is therefore inhibition of B double prime 1, subunit of rna polymerase iii transcription initiation factor iiib (BDP1, Accession NP_060899.1), a gene which activates RNA polymerase III transcription. Accordingly, utilities of GAM189 include diagnosis, prevention and treatment of diseases and clinical conditions associated with BDP1.

The function of BDP1 and its association with various diseases and clinical conditions, has been established by previous studies, as described hereinabove with reference to GAM146.1. BENE (Accession NP_005425.1) is another GAM189 target gene, herein designated TARGET GENE. BENE BINDING SITE is a target binding site found in the 3' untranslated region of mRNA encoded by BENE, corresponding to a target binding site such as BINDING SITE I, BINDING SITE II or BINDING SITE III of FIG. 8. Table 4 illustrates the complementarity of the nucleotide sequences of BENE BINDING SITE, designated SEQ ID:6009, to the nucleotide sequence of GAM189 RNA, herein designated GAM RNA, also designated SEQ ID:246.

Another function of GAM189 is therefore inhibition of BENE (Accession NP_005425.1). Accordingly, utilities of GAM189 include diagnosis, prevention and treatment of diseases and clinical conditions associated with BENE.

BHD (Accession NP_659434.2) is another GAM189 target gene, herein designated TARGET GENE. BHD BINDING SITE is a target binding site found in the 3' untranslated region of multiple transcripts of mRNA encoded by BHD, corresponding to a target binding site such as BINDING SITE I, BINDING SITE II or BINDING SITE III of FIG. 8. Table 4 illustrates the complementarity of the nucleotide sequences of BHD BINDING SITE, designated SEQ ID:9036, to the nucleotide sequence of GAM189 RNA, herein designated GAM RNA, also designated SEQ ID:246.

Another function of GAM189 is therefore inhibition of BHD (Accession NP_659434.2). Accordingly, utilities of GAM189 include diagnosis, prevention and treatment of diseases and clinical conditions associated with BHD.

BMF (Accession NP_277038.1) is another GAM189 target gene, herein designated TARGET GENE. BMF BINDING SITE is a target binding site found in the 3' untranslated region of mRNA encoded by BMF, corresponding to a target binding site such as BINDING SITE I, BINDING SITE II or BINDING SITE III of FIG. 8. Table 4 illustrates the complementarity of the nucleotide sequences of BMF BINDING SITE, designated SEQ ID:759, to the nucleotide sequence of GAM189 RNA, herein designated GAM RNA, also designated SEQ ID:246.

Another function of GAM189 is therefore inhibition of BMF (Accession NP_277038.1). Accordingly, utilities of GAM189 include diagnosis, prevention and treatment of diseases and clinical conditions associated with BMF.

BNIP-S (Accession NP_612122.1) is another GAM189 target gene, herein designated TARGET GENE. BNIP-S BINDING SITE is a target binding site found in the 3' untranslated region of multiple transcripts of mRNA encoded by BNIP-S, corresponding to a target binding site such as BINDING SITE I, BINDING SITE II or BINDING SITE III of FIG. 8. Table 4 illustrates the complementarity of the nucleotide sequences of BNIP-S BINDING SITE, designated SEQ ID:5845, to the nucleotide sequence of GAM189 RNA, herein designated GAM RNA, also designated SEQ ID:246.

Another function of GAM189 is therefore inhibition of BNIP-S (Accession NP_612122.1). Accordingly, utilities of GAM189 include diagnosis, prevention and treatment of diseases and clinical conditions associated with BNIP-S.

BRIP1 (Accession NP_114432.1) is another GAM189 target gene, herein designated TARGET GENE. BRIP1 BINDING SITE is a target binding site found in the 3' untranslated region of mRNA encoded by BRIP1, corresponding to a target binding site such as BINDING SITE I, BINDING SITE II or BINDING SITE III of FIG. 8. Table 4 illustrates the complementarity of the nucleotide sequences of BRIP1 BINDING SITE, designated SEQ ID:13904, to the nucleotide sequence of GAM189 RNA, herein designated GAM RNA, also designated SEQ ID:246.

Another function of GAM189 is therefore inhibition of BRIP1 (Accession NP_114432.1). Accordingly, utilities of GAM189 include diagnosis, prevention and treatment of diseases and clinical conditions associated with BRIP1.

Butyrophilin, subfamily 3, member a1 (BTN3A1, Accession NP_008979.2) is another GAM189 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:2067, to the nucleotide sequence of GAM189 RNA, herein designated GAM RNA, also designated SEQ ID:246.

Another function of GAM189 is therefore inhibition of Butyrophilin, subfamily 3, member a1 (BTN3A1, Accession NP_008979.2). Accordingly, utilities of GAM189 include diagnosis, prevention and treatment of diseases and clinical conditions associated with BTN3A1.

BXDC1 (Accession XP__166303.1) is another GAM189 target gene, herein designated TARGET GENE. BXDC1 BINDING SITE1 and BXDC1 BINDING SITE2 are target binding sites found in untranslated regions of mRNA encoded by BXDC1, corresponding to target binding sites such as BINDING SITE I, BINDING SITE II or BINDING SITE III of FIG. 8. Table 4 illustrates the complementarity of the nucleotide sequences of BXDC1 BINDING SITE1 and BXDC1 BINDING SITE2, designated SEQ ID:4549 and SEQ ID:12129 respectively, to the nucleotide sequence of GAM189 RNA, herein designated GAM RNA, also designated SEQ ID:246.

Another function of GAM189 is therefore inhibition of BXDC1 (Accession XP__166303.1). Accordingly, utilities of GAM189 include diagnosis, prevention and treatment of diseases and clinical conditions associated with BXDC1.

Chromosome 11 open reading frame 17 (C11orf17, Accession NP__065693.2) is another GAM189 target gene, herein designated TARGET GENE. C11orf17 BINDING SITE is a target binding site found in the 3' untranslated region of mRNA encoded by C11orf17, corresponding to a target binding site such as BINDING SITE I, BINDING SITE II or BINDING SITE III of FIG. 8. Table 4 illustrates the complementarity of the nucleotide sequences of C11orf17 BINDING SITE, designated SEQ ID:11525, to the nucleotide sequence of GAM189 RNA, herein designated GAM RNA, also designated SEQ ID:246.

Another function of GAM189 is therefore inhibition of Chromosome 11 open reading frame 17 (C11orf17, Accession NP__065693.2). Accordingly, utilities of GAM189 include diagnosis, prevention and treatment of diseases and clinical conditions associated with C11orf17.

Chromosome 13 open reading frame 1 (C13orf1, Accession NP__065189.1) is another GAM189 target gene, herein designated TARGET GENE. C13orf1 BINDING SITE is a target binding site found in the 3' untranslated region of mRNA encoded by C13orf1, corresponding to a target binding site such as BINDING SITE I, BINDING SITE II or BINDING SITE III of FIG. 8. Table 4 illustrates the complementarity of the nucleotide sequences of C13orf1 BINDING SITE, designated SEQ ID:5746, to the nucleotide sequence of GAM189 RNA, herein designated GAM RNA, also designated SEQ ID:246.

Another function of GAM189 is therefore inhibition of Chromosome 13 open reading frame 1 (C13orf1, Accession NP__065189.1). Accordingly, utilities of GAM189 include diagnosis, prevention and treatment of diseases and clinical conditions associated with C13orf1.

Chromosome 14 open reading frame 1 (C14orf1, Accession NP__009107.1) is another GAM189 target gene, herein designated TARGET GENE. C14orf1 BINDING SITE is a target binding site found in the 3' untranslated region of mRNA encoded by C14orf1, corresponding to a target binding site such as BINDING SITE I, BINDING SITE II or BINDING SITE III of FIG. 8. Table 4 illustrates the complementarity of the nucleotide sequences of C14orf1 BINDING SITE, designated SEQ ID:12744, to the nucleotide sequence of GAM189 RNA, herein designated GAM RNA, also designated SEQ ID:246.

Another function of GAM189 is therefore inhibition of Chromosome 14 open reading frame 1 (C14orf1, Accession NP__009107.1). Accordingly, utilities of GAM189 include diagnosis, prevention and treatment of diseases and clinical conditions associated with C14orf1.

C14orf113 (Accession NP__060100.1) is another GAM189 target gene, herein designated TARGET GENE. C14orf113 BINDING SITE1 and C14orf113 BINDING SITE2 are target binding sites found in untranslated regions of mRNA encoded by C14orf113, corresponding to target binding sites such as BINDING SITE I, BINDING SITE II or BINDING SITE III of FIG. 8. Table 4 illustrates the complementarity of the nucleotide sequences of C14orf113 BINDING SITE1 and C14orf113 BINDING SITE2, designated SEQ ID:18863 and SEQ ID:5052 respectively, to the nucleotide sequence of GAM189 RNA, herein designated GAM RNA, also designated SEQ ID:246.

Another function of GAM189 is therefore inhibition of C14orf113 (Accession NP__060100.1). Accordingly, utilities of GAM189 include diagnosis, prevention and treatment of diseases and clinical conditions associated with C14orf113.

C14orf143 (Accession NP__660274.1) is another GAM189 target gene, herein designated TARGET GENE. C14orf143 BINDING SITE is a target binding site found in the 3' untranslated region of mRNA encoded by C14orf143, corresponding to a target binding site such as BINDING SITE I, BINDING SITE II or BINDING SITE III of FIG. 8. Table 4 illustrates the complementarity of the nucleotide sequences of C14orf143 BINDING SITE, designated SEQ ID:17955, to the nucleotide sequence of GAM189 RNA, herein designated GAM RNA, also designated SEQ ID:246.

Another function of GAM189 is therefore inhibition of C14orf143 (Accession NP__660274.1). Accordingly, utilities of GAM189 include diagnosis, prevention and treatment of diseases and clinical conditions associated with C14orf143.

C14orf92 (Accession NP__055643.1) is another GAM189 target gene, herein designated TARGET GENE. C14orf92 BINDING SITE is a target binding site found in the 3' untranslated region of mRNA encoded by C14orf92, corresponding to a target binding site such as BINDING SITE I, BINDING SITE II or BINDING SITE III of FIG. 8. Table 4 illustrates the complementarity of the nucleotide sequences of C14orf92 BINDING SITE, designated SEQ ID:14861, to the nucleotide sequence of GAM189 RNA, herein designated GAM RNA, also designated SEQ ID:246.

Another function of GAM189 is therefore inhibition of C14orf92 (Accession NP__055643.1). Accordingly, utilities of GAM189 include diagnosis, prevention and treatment of diseases and clinical conditions associated with C14orf92.

Chromosome 1 open reading frame 24 (C1orf24, Accession NP__443198.1) is another GAM189 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:19538, to the nucleotide sequence of GAM189 RNA, herein designated GAM RNA, also designated SEQ ID:246.

Another function of GAM189 is therefore inhibition of Chromosome 1 open reading frame 24 (C1orf24, Accession NP__443198.1). Accordingly, utilities of GAM189 include diagnosis, prevention and treatment of diseases and clinical conditions associated with C1orf24.

C1q and tumor necrosis factor related protein 6 (C1QTNF6, Accession NP__114116.2) is another GAM189 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:14882, to the nucleotide sequence of GAM189 RNA, herein designated GAM RNA, also designated SEQ ID:246.

Another function of GAM189 is therefore inhibition of C1q and tumor necrosis factor related protein 6 (C1QTNF6, Accession NP_114116.2). Accordingly, utilities of GAM189 include diagnosis, prevention and treatment of diseases and clinical conditions associated with C1QTNF6.

Chromosome 20 open reading frame 147 (C20orf147, Accession NP_689880.1) is another GAM189 target gene, herein designated TARGET GENE. C20orf147 BINDING SITE is a target binding site found in the 3' untranslated region of mRNA encoded by C20orf147, corresponding to a target binding site such as BINDING SITE I, BINDING SITE II or BINDING SITE III of FIG. 8. Table 4 illustrates the complementarity of the nucleotide sequences of C20orf147 BINDING SITE, designated SEQ ID:16257, to the nucleotide sequence of GAM189 RNA, herein designated GAM RNA, also designated SEQ ID:246.

Another function of GAM189 is therefore inhibition of Chromosome 20 open reading frame 147 (C20orf147, Accession NP_689880.1). Accordingly, utilities of GAM189 include diagnosis, prevention and treatment of diseases and clinical conditions associated with C20orf147.

Chromosome 21 open reading frame 67 (C21orf67, Accession NP_478068.1) is another GAM189 target gene, herein designated TARGET GENE. C21orf67 BINDING SITE is a target binding site found in the 5' untranslated region of mRNA encoded by C21orf67, corresponding to a target binding site such as BINDING SITE I, BINDING SITE II or BINDING SITE III of FIG. 8. Table 4 illustrates the complementarity of the nucleotide sequences of C21orf67 BINDING SITE, designated SEQ ID:6569, to the nucleotide sequence of GAM189 RNA, herein designated GAM RNA, also designated SEQ ID:246.

Another function of GAM189 is therefore inhibition of Chromosome 21 open reading frame 67 (C21orf67, Accession NP_478068.1). Accordingly, utilities of GAM189 include diagnosis, prevention and treatment of diseases and clinical conditions associated with C21orf67.

Chromosome 22 open reading frame 19 (C22orf19, Accession NP_003669.2) is another GAM189 target gene, herein designated TARGET GENE. C22orf19 BINDING SITE is a target binding site found in the 3' untranslated region of mRNA encoded by C22orf19, corresponding to a target binding site such as BINDING SITE I, BINDING SITE II or BINDING SITE III of FIG. 8. Table 4 illustrates the complementarity of the nucleotide sequences of C22orf19 BINDING SITE, designated SEQ ID:18897, to the nucleotide sequence of GAM189 RNA, herein designated GAM RNA, also designated SEQ ID:246.

Another function of GAM189 is therefore inhibition of Chromosome 22 open reading frame 19 (C22orf19, Accession NP_003669.2). Accordingly, utilities of GAM189 include diagnosis, prevention and treatment of diseases and clinical conditions associated with C22orf19.

C4orf9 (Accession XP_035572.1) is another GAM189 target gene, herein designated TARGET GENE. C4orf9 BINDING SITE is a target binding site found in the 3' untranslated region of mRNA encoded by C4orf9, corresponding to a target binding site such as BINDING SITE I, BINDING SITE II or BINDING SITE III of FIG. 8. Table 4 illustrates the complementarity of the nucleotide sequences of C4orf9 BINDING SITE, designated SEQ ID:15574, to the nucleotide sequence of GAM189 RNA, herein designated GAM RNA, also designated SEQ ID:246.

Another function of GAM189 is therefore inhibition of C4orf9 (Accession XP_035572.1). Accordingly, utilities of GAM189 include diagnosis, prevention and treatment of diseases and clinical conditions associated with C4orf9.

Chromosome 6 open reading frame 33 (C6orf33, Accession NP_588608.1) is another GAM189 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:6896, to the nucleotide sequence of GAM189 RNA, herein designated GAM RNA, also designated SEQ ID:246.

Another function of GAM189 is therefore inhibition of Chromosome 6 open reading frame 33 (C6orf33, Accession NP_588608.1). Accordingly, utilities of GAM189 include diagnosis, prevention and treatment of diseases and clinical conditions associated with C6orf33.

C6orf5 (Accession NP_056339.2) is another GAM189 target gene, herein designated TARGET GENE. C6orf5 BINDING SITE1 and C6orf5 BINDING SITE2 are target binding sites found in untranslated regions of mRNA encoded by C6orf5, corresponding to target binding sites such as BINDING SITE I, BINDING SITE II or BINDING SITE III of FIG. 8. Table 4 illustrates the complementarity of the nucleotide sequences of C6orf5 BINDING SITE1 and C6orf5 BINDING SITE2, designated SEQ ID:10099 and SEQ ID:12805 respectively, to the nucleotide sequence of GAM189 RNA, herein designated GAM RNA, also designated SEQ ID:246.

Another function of GAM189 is therefore inhibition of C6orf5 (Accession NP_056339.2). Accordingly, utilities of GAM189 include diagnosis, prevention and treatment of diseases and clinical conditions associated with C6orf5.

C6orf57 (Accession NP_660310.1) is another GAM189 target gene, herein designated TARGET GENE. C6orf57 BINDING SITE is a target binding site found in the 3' untranslated region of mRNA encoded by C6orf57, corresponding to a target binding site such as BINDING SITE I, BINDING SITE II or BINDING SITE III of FIG. 8. Table 4 illustrates the complementarity of the nucleotide sequences of C6orf57 BINDING SITE, designated SEQ ID:2114, to the nucleotide sequence of GAM189 RNA, herein designated GAM RNA, also designated SEQ ID:246.

Another function of GAM189 is therefore inhibition of C6orf57 (Accession NP_660310.1). Accordingly, utilities of GAM189 include diagnosis, prevention and treatment of diseases and clinical conditions associated with C6orf57.

Complement component 7 (C7, Accession NP_000578.1) is another GAM189 target gene, herein designated TARGET GENE. C7 BINDING SITE is a target binding site found in the 3' untranslated region of mRNA encoded by C7, corresponding to a target binding site such as BINDING SITE I, BINDING SITE II or BINDING SITE III of FIG. 8. Table 4 illustrates the complementarity of the nucleotide sequences of C7 BINDING SITE, designated SEQ ID:17778, to the nucleotide sequence of GAM189 RNA, herein designated GAM RNA, also designated SEQ ID:246.

Another function of GAM189 is therefore inhibition of Complement component 7 (C7, Accession NP_000578.1). Accordingly, utilities of GAM189 include diagnosis, prevention and treatment of diseases and clinical conditions associated with C7.

Chromosome 9 open reading frame 5 (C9orf5, Accession NP_114401.1) is another GAM189 target gene, herein designated TARGET GENE. C9orf5 BINDING SITE is a target binding site found in the 3' untranslated region of mRNA encoded by C9orf5, corresponding to a target binding site such as BINDING SITE I, BINDING SITE II or BINDING SITE III of FIG. 8. Table 4 illustrates the complementarity of the nucleotide sequences of C9orf5 BINDING SITE, designated SEQ ID:14258, to the nucleotide sequence of GAM189 RNA, herein designated GAM RNA, also designated SEQ ID:246.

Another function of GAM189 is therefore inhibition of Chromosome 9 open reading frame 5 (C9orf5, Accession NP_114401.1). Accordingly, utilities of GAM189 include diagnosis, prevention and treatment of diseases and clinical conditions associated with C9orf5.

Chromosome 9 open reading frame 9 (C9orf9, Accession NP_061829.2) is another GAM189 target gene, herein designated TARGET GENE. C9orf9 BINDING SITE1 and C9orf9 BINDING SITE2 are target binding sites found in untranslated regions of mRNA encoded by C9orf9, corresponding to target binding sites such as BINDING SITE I, BINDING SITE II or BINDING SITE III of FIG. 8. Table 4 illustrates the complementarity of the nucleotide sequences of C9orf9 BINDING SITE1 and C9orf9 BINDING SITE2, designated SEQ ID:11520 and SEQ ID:5477 respectively, to the nucleotide sequence of GAM189 RNA, herein designated GAM RNA, also designated SEQ ID:246.

Another function of GAM189 is therefore inhibition of Chromosome 9 open reading frame 9 (C9orf9, Accession NP_061829.2). Accordingly, utilities of GAM189 include diagnosis, prevention and treatment of diseases and clinical conditions associated with C9orf9.

CAB2 (Accession NP_219487.2) is another GAM189 target gene, herein designated TARGET GENE. CAB2 BINDING SITE is a target binding site found in the 3' untranslated region of mRNA encoded by CAB2, corresponding to a target binding site such as BINDING SITE I, BINDING SITE II or BINDING SITE III of FIG. 8. Table 4 illustrates the complementarity of the nucleotide sequences of CAB2 BINDING SITE, designated SEQ ID:9181, to the nucleotide sequence of GAM189 RNA, herein designated GAM RNA, also designated SEQ ID:246.

Another function of GAM189 is therefore inhibition of CAB2 (Accession NP_219487.2). Accordingly, utilities of GAM189 include diagnosis, prevention and treatment of diseases and clinical conditions associated with CAB2.

Calcium binding protein 4 (CABP4, Accession NP_660201.1) is another GAM189 target gene, herein designated TARGET GENE. CABP4 BINDING SITE is a target binding site found in the 5' untranslated region of mRNA encoded by CABP4, corresponding to a target binding site such as BINDING SITE I, BINDING SITE II or BINDING SITE III of FIG. 8. Table 4 illustrates the complementarity of the nucleotide sequences of CABP4 BINDING SITE, designated SEQ ID:7624, to the nucleotide sequence of GAM189 RNA, herein designated GAM RNA, also designated SEQ ID:246.

Another function of GAM189 is therefore inhibition of Calcium binding protein 4 (CABP4, Accession NP_660201.1). Accordingly, utilities of GAM189 include diagnosis, prevention and treatment of diseases and clinical conditions associated with CABP4.

Calneuron 1 (CALN1, Accession NP_113656.1) is another GAM189 target gene, herein designated TARGET GENE. CALN1 BINDING SITE is a target binding site found in the 3' untranslated region of mRNA encoded by CALN1, corresponding to a target binding site such as BINDING SITE I, BINDING SITE II or BINDING SITE III of FIG. 8. Table 4 illustrates the complementarity of the nucleotide sequences of CALN1 BINDING SITE, designated SEQ ID:17850, to the nucleotide sequence of GAM189 RNA, herein designated GAM RNA, also designated SEQ ID:246.

Another function of GAM189 is therefore inhibition of Calneuron 1 (CALN1, Accession NP_113656.1). Accordingly, utilities of GAM189 include diagnosis, prevention and treatment of diseases and clinical conditions associated with CALN1.

Calcium modulating ligand (CAMLG, Accession NP_001736.1) is another GAM189 target gene, herein designated TARGET GENE. CAMLG BINDING SITE is a target binding site found in the 3' untranslated region of mRNA encoded by CAMLG, corresponding to a target binding site such as BINDING SITE I, BINDING SITE II or BINDING SITE III of FIG. 8. Table 4 illustrates the complementarity of the nucleotide sequences of CAMLG BINDING SITE, designated SEQ ID:18944, to the nucleotide sequence of GAM189 RNA, herein designated GAM RNA, also designated SEQ ID:246.

Another function of GAM189 is therefore inhibition of Calcium modulating ligand (CAMLG, Accession NP_001736.1), a gene which is likely involved in the mobilization of calcium as a result of the tcr/cd3 complex interaction. Accordingly, utilities of GAM189 include diagnosis, prevention and treatment of diseases and clinical conditions associated with CAMLG.

The function of CAMLG and its association with various diseases and clinical conditions, has been established by previous studies, as described hereinabove with reference to GAM130.1. Calpain 6 (CAPN6, Accession NP_055104.2) is another GAM189 target gene, herein designated TARGET GENE. CAPN6 BINDING SITE is a target binding site found in the 3' untranslated region of mRNA encoded by CAPN6, corresponding to a target binding site such as BINDING SITE I, BINDING SITE II or BINDING SITE III of FIG. 8. Table 4 illustrates the complementarity of the nucleotide sequences of CAPN6 BINDING SITE, designated SEQ ID:2208, to the nucleotide sequence of GAM189 RNA, herein designated GAM RNA, also designated SEQ ID:246.

Another function of GAM189 is therefore inhibition of Calpain 6 (CAPN6, Accession NP_055104.2). Accordingly, utilities of GAM189 include diagnosis, prevention and treatment of diseases and clinical conditions associated with CAPN6.

CAPRI (Accession NP_008920.3) is another GAM189 target gene, herein designated TARGET GENE. CAPRI BINDING SITE is a target binding site found in the 3' untranslated region of mRNA encoded by CAPRI, corresponding to a target binding site such as BINDING SITE I, BINDING SITE II or BINDING SITE III of FIG. 8. Table 4 illustrates the complementarity of the nucleotide sequences of CAPRI BINDING SITE, designated SEQ ID:4271, to the nucleotide sequence of GAM189 RNA, herein designated GAM RNA, also designated SEQ ID:246.

Another function of GAM189 is therefore inhibition of CAPRI (Accession NP_008920.3). Accordingly, utilities of GAM189 include diagnosis, prevention and treatment of diseases and clinical conditions associated with CAPRI.

Caspase recruitment domain family, member 6 (CARD6, Accession NP_115976.2) is another GAM189 target gene, herein designated TARGET GENE. CARD6 BINDING SITE is a target binding site found in the 3' untranslated region of mRNA encoded by CARD6, corresponding to a target binding site such as BINDING SITE I, BINDING SITE II or BINDING SITE III of FIG. 8. Table 4 illustrates the complementarity of the nucleotide sequences of CARD6

BINDING SITE, designated SEQ ID:9036, to the nucleotide sequence of GAM189 RNA, herein designated GAM RNA, also designated SEQ ID:246.

Another function of GAM189 is therefore inhibition of Caspase recruitment domain family, member 6 (CARD6, Accession NP_115976.2) . Accordingly, utilities of GAM189 include diagnosis, prevention and treatment of diseases and clinical conditions associated with CARD6.

Caspase 2, apoptosis-related cysteine protease (neural precursor cell expressed, developmentally down-regulated 2) (CASP2, Accession NP_001215.1) is another GAM189 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM189 RNA, herein designated GAM RNA, also designated SEQ ID:246.

Another function of GAM189 is therefore inhibition of Caspase 2, apoptosis-related cysteine protease (neural precursor cell expressed, developmentally down-regulated 2) (CASP2, Accession NP_001215.1), a gene which involves in the activation cascade of caspases responsible for apoptosis execution. Accordingly, utilities of GAM189 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116765.1) is another GAM189 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM189 RNA, herein designated GAM RNA, also designated SEQ ID:246.

Another function of GAM189 is therefore inhibition of Caspase 2, apoptosis-related cysteine protease (neural precursor cell expressed, developmentally down-regulated 2) (CASP2, Accession NP_116765.1), a gene which involves in the activation cascade of caspases responsible for apoptosis execution. Accordingly, utilities of GAM189 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116764.1) is another GAM189 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM189 RNA, herein designated GAM RNA, also designated SEQ ID:246.

Another function of GAM189 is therefore inhibition of Caspase 2, apoptosis-related cysteine protease (neural precursor cell expressed, developmentally down-regulated 2) (CASP2, Accession NP_116764.1), a gene which involves in the activation cascade of caspases responsible for apoptosis execution. Accordingly, utilities of GAM189 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116766.1) is another GAM189 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM189 RNA, herein designated GAM RNA, also designated SEQ ID:246.

Another function of GAM189 is therefore inhibition of Caspase 2, apoptosis-related cysteine protease (neural precursor cell expressed, developmentally down-regulated 2) (CASP2, Accession NP_116766.1), a gene which involves in the activation cascade of caspases responsible for apoptosis execution. Accordingly, utilities of GAM189 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 8, apoptosis-related cysteine protease (CASP8, Accession NP_203520.1) is another GAM189 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM189 RNA, herein designated GAM RNA, also designated SEQ ID:246.

Another function of GAM189 is therefore inhibition of Caspase 8, apoptosis-related cysteine protease (CASP8, Accession NP_203520.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM189 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203519.1) is another GAM189 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM189 RNA, herein designated GAM RNA, also designated SEQ ID:246.

Another function of GAM189 is therefore inhibition of Caspase 8, apoptosis-related cysteine protease (CASP8, Accession NP_203519.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM189 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_001219.2) is another GAM189 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM189 RNA, herein designated GAM RNA, also designated SEQ ID:246.

Another function of GAM189 is therefore inhibition of Caspase 8, apoptosis-related cysteine protease (CASP8, Accession NP_001219.2), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM189 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203521.1) is another GAM189 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM189 RNA, herein designated GAM RNA, also designated SEQ ID:246.

Another function of GAM189 is therefore inhibition of Caspase 8, apoptosis-related cysteine protease (CASP8, Accession NP_203521.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM189 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. CASPR4 (Accession NP_620481.1) is another GAM189 target gene, herein designated TARGET GENE. CASPR4 BINDING SITE is a target binding site found in the 3' untranslated region of multiple transcripts of mRNA encoded by CASPR4, corresponding to a target binding site such as BINDING SITE I, BINDING SITE II or BINDING SITE III of FIG. 8. Table 4 illustrates the complementarity of the nucleotide sequences of CASPR4 BINDING SITE, designated SEQ ID:13634, to the nucleotide sequence of GAM189 RNA, herein designated GAM RNA, also designated SEQ ID:246.

Another function of GAM189 is therefore inhibition of CASPR4 (Accession NP_620481.1). Accordingly, utilities of GAM189 include diagnosis, prevention and treatment of diseases and clinical conditions associated with CASPR4.

Core-binding factor, runt domain, alpha subunit 2; translocated to, 2 (CBFA2T2, Accession NP_787060.1) is another GAM189 target gene, herein designated TARGET GENE. CBFA2T2 BINDING SITE1 and CBFA2T2 BINDING SITE2 are target binding sites found in untranslated regions of multiple transcripts of mRNA encoded by CBFA2T2, corresponding to target binding sites such as BINDING SITE I, BINDING SITE II or BINDING SITE III of FIG. 8. Table 4 illustrates the complementarity of the nucleotide sequences of CBFA2T2 BINDING SITE1 and CBFA2T2 BINDING SITE2, designated SEQ ID:8572 and SEQ ID:8572 respectively, to the nucleotide sequence of GAM189 RNA, herein designated GAM RNA, also designated SEQ ID:246.

Another function of GAM189 is therefore inhibition of Core-binding factor, runt domain, alpha subunit 2; translocated to, 2 (CBFA2T2, Accession NP_787060.1), a gene which is a putative transcription factor. Accordingly, utilities of GAM189 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Core-binding factor, runt domain, alpha subunit 2; translocated to, 2 (CBFA2T2, Accession NP_787060.1) is another GAM189 target gene, herein designated TARGET GENE. CBFA2T2 BINDING SITE1 and CBFA2T2 BINDING SITE2 are target binding sites found in untranslated regions of multiple transcripts of mRNA encoded by CBFA2T2, corresponding to target binding sites such as BINDING SITE I, BINDING SITE II or BINDING SITE III of FIG. 8. Table 4 illustrates the complementarity of the nucleotide sequences of CBFA2T2 BINDING SITE1 and CBFA2T2 BINDING SITE2, designated SEQ ID:8242 and SEQ ID:9543 respectively, to the nucleotide sequence of GAM189 RNA, herein designated GAM RNA, also designated SEQ ID:246.

Another function of GAM189 is therefore inhibition of Core-binding factor, runt domain, alpha subunit 2; translocated to, 2 (CBFA2T2, Accession NP_787060.1), a gene which is a putative transcription factor. Accordingly, utilities of GAM189 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Chemokine (c-c motif) ligand 22 (CCL22, Accession NP_002981.2) is another GAM189 target gene, herein designated TARGET GENE. CCL22 BINDING SITE1 and CCL22 BINDING SITE2 are target binding sites found in untranslated regions of mRNA encoded by CCL22, corresponding to target binding sites such as BINDING SITE I, BINDING SITE II or BINDING SITE III of FIG. 8. Table 4 illustrates the complementarity of the nucleotide sequences of CCL22 BINDING SITE1 and CCL22 BINDING SITE2, designated SEQ ID:15049 and SEQ ID:1679 respectively, to the nucleotide sequence of GAM189 RNA, herein designated GAM RNA, also designated SEQ ID:246.

Another function of GAM189 is therefore inhibition of Chemokine (c-c motif) ligand 22 (CCL22, Accession NP_002981.2). Accordingly, utilities of GAM189 include diagnosis, prevention and treatment of diseases and clinical conditions associated with CCL22.

Cyclin f (CCNF, Accession NP_001752.1) is another GAM189 target gene, herein designated TARGET GENE. CCNF BINDING SITE is a target binding site found in the 3' untranslated region of mRNA encoded by CCNF, corresponding to a target binding site such as BINDING SITE I, BINDING SITE II or BINDING SITE III of FIG. 8. Table 4 illustrates the complementarity of the nucleotide sequences of CCNF BINDING SITE, designated SEQ ID:17624, to the nucleotide sequence of GAM189 RNA, herein designated GAM RNA, also designated SEQ ID:246.

Another function of GAM189 is therefore inhibition of Cyclin f (CCNF, Accession NP_001752.1), a gene which likely to be involved in the control of the cell cycle during s phase and g2. Accordingly, utilities of GAM189 include diagnosis, prevention and treatment of diseases and clinical conditions associated with CCNF.

The function of CCNF and its association with various diseases and clinical conditions, has been established by previous studies, as described hereinabove with reference to GAM130.1. Ccr4 carbon catabolite repression 4-like (s. cerevisiae) (CCRN4L, Accession NP_036250.2) is another GAM189 target gene, herein designated TARGET GENE. CCRN4L BINDING SITE is a target binding site found in the 3' untranslated region of mRNA encoded by CCRN4L, corresponding to a target binding site such as BINDING SITE I, BINDING SITE II or BINDING SITE III of FIG. 8. Table 4 illustrates the complementarity of the nucleotide sequences of CCRN4L BINDING SITE, designated SEQ ID:4698, to the nucleotide sequence of GAM189 RNA, herein designated GAM RNA, also designated SEQ ID:246.

Another function of GAM189 is therefore inhibition of Ccr4 carbon catabolite repression 4-like (s. cerevisiae) (CCRN4L, Accession NP_036250.2). Accordingly, utilities of GAM189 include diagnosis, prevention and treatment of diseases and clinical conditions associated with CCRN4L.

Cd209 antigen (CD209, Accession NP_066978.1) is another GAM189 target gene, herein designated TARGET GENE. CD209 BINDING SITE1 and CD209 BINDING SITE2 are target binding sites found in untranslated regions of mRNA encoded by CD209, corresponding to target binding sites such as BINDING SITE I, BINDING SITE II or BINDING SITE III of FIG. 8. Table 4 illustrates the complementarity of the nucleotide sequences of CD209 BINDING SITE1 and CD209 BINDING SITE2, designated SEQ ID:17051 and SEQ ID:4298 respectively, to the nucleotide sequence of GAM189 RNA, herein designated GAM RNA, also designated SEQ ID:246.

Another function of GAM189 is therefore inhibition of Cd209 antigen (CD209, Accession NP_066978.1), a gene which may play an important role in the CD4-independent association of HIV with cells. Accordingly, utilities of GAM189 include diagnosis, prevention and treatment of diseases and clinical conditions associated with CD209.

The function of CD209 and its association with various diseases and clinical conditions, has been established by previous studies, as described hereinabove with reference to GAM96.1. Cd24 antigen (small cell lung carcinoma cluster 4 antigen) (CD24, Accession NP_037362.1) is another GAM189 target gene, herein designated TARGET GENE. CD24 BINDING SITE is a target binding site found in the 3' untranslated region of mRNA encoded by CD24, corresponding to a target binding site such as BINDING SITE I, BINDING SITE II or BINDING SITE III of FIG. 8. Table 4 illustrates the complementarity of the nucleotide sequences of CD24 BINDING SITE, designated SEQ ID:19572, to the nucleotide sequence of GAM189 RNA, herein designated GAM RNA, also designated SEQ ID:246.

Another function of GAM189 is therefore inhibition of Cd24 antigen (small cell lung carcinoma cluster 4 antigen) (CD24, Accession NP_037362.1). Accordingly, utilities of GAM189 include diagnosis, prevention and treatment of diseases and clinical conditions associated with CD24.

Cd5 antigen (p56-62) (CD5, Accession NP_055022.1) is another GAM189 target gene, herein designated TARGET GENE. CD5 BINDING SITE is a target binding site found in the 5' untranslated region of mRNA encoded by CD5, corresponding to a target binding site such as BINDING SITE I, BINDING SITE II or BINDING SITE III of FIG. 8. Table 4 illustrates the complementarity of the nucleotide sequences of CD5 BINDING SITE, designated SEQ ID:1049, to the nucleotide sequence of GAM189 RNA, herein designated GAM RNA, also designated SEQ ID:246.

Another function of GAM189 is therefore inhibition of Cd5 antigen (p56-62) (CD5, Accession NP_055022.1). Accordingly, utilities of GAM189 include diagnosis, prevention and treatment of diseases and clinical conditions associated with CD5.

Cd84 antigen (leukocyte antigen) (CD84, Accession NP_003865.1) is another GAM189 target gene, herein designated TARGET GENE. CD84 BINDING SITE is a target binding site found in the 3' untranslated region of mRNA encoded by CD84, corresponding to a target binding site such as BINDING SITE I, BINDING SITE II or BINDING SITE III of FIG. 8. Table 4 illustrates the complementarity of the nucleotide sequences of CD84 BINDING SITE, designated SEQ ID:514, to the nucleotide sequence of GAM189 RNA, herein designated GAM RNA, also designated SEQ ID:246.

Another function of GAM189 is therefore inhibition of Cd84 antigen (leukocyte antigen) (CD84, Accession NP_003865.1). Accordingly, utilities of GAM189 include diagnosis, prevention and treatment of diseases and clinical conditions associated with CD84.

Cdc14 cell division cycle 14 homolog b (s. cerevisiae) (CDC14B, Accession NP_201589.1) is another GAM189 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:17127, to the nucleotide sequence of GAM189 RNA, herein designated GAM RNA, also designated SEQ ID:246.

Another function of GAM189 is therefore inhibition of Cdc14 cell division cycle 14 homolog b (s. cerevisiae) (CDC14B, Accession NP_201589.1). Accordingly, utilities of GAM189 include diagnosis, prevention and treatment of diseases and clinical conditions associated with CDC14B.

Cell division cycle 2-like 2 (CDC2L2, Accession NP_296370.1) is another GAM189 target gene, herein designated TARGET GENE. CDC2L2 BINDING SITE is a target binding site found in the 5' untranslated region of multiple transcripts of mRNA encoded by CDC2L2, corresponding to a target binding site such as BINDING SITE I, BINDING SITE II or BINDING SITE III of FIG. 8. Table 4 illustrates the complementarity of the nucleotide sequences of CDC2L2

BINDING SITE, designated SEQ ID:15084, to the nucleotide sequence of GAM189 RNA, herein designated GAM RNA, also designated SEQ ID:246.

Another function of GAM189 is therefore inhibition of Cell division cycle 2-like 2 (CDC2L2, Accession NP_296370.1). Accordingly, utilities of GAM189 include diagnosis, prevention and treatment of diseases and clinical conditions associated with CDC2L2.

Cdc6 cell division cycle 6 homolog (s. cerevisiae) (CDC6, Accession NP_001245.1) is another GAM189 target gene, herein designated TARGET GENE. CDC6 BINDING SITE is a target binding site found in the 3' untranslated region of mRNA encoded by CDC6, corresponding to a target binding site such as BINDING SITE I, BINDING SITE II or BINDING SITE III of FIG. 8. Table 4 illustrates the complementarity of the nucleotide sequences of CDC6 BINDING SITE, designated SEQ ID:9211, to the nucleotide sequence of GAM189 RNA, herein designated GAM RNA, also designated SEQ ID:246.

Another function of GAM189 is therefore inhibition of Cdc6 cell division cycle 6 homolog (s. cerevisiae) (CDC6, Accession NP_001245.1), a gene which is a component of the origin recognition complex (orc) that binds origins of replication. Accordingly, utilities of GAM189 include diagnosis, prevention and treatment of diseases and clinical conditions associated with CDC6.

The function of CDC6 has been established by previous studies. In yeasts, Cdc6 (Saccharomyces cerevisiae) and Cdc18 (Schizosaccharomyces pombe) associate with the origin recognition complex (ORC) proteins to render cells competent for DNA replication. Thus, Cdc6 has a critical regulatory role in the initiation of DNA replication in yeast. Williams et al. (1997) isolated cDNAs encoding Xenopus and human homologs of yeast CDC6. They designated the human and Xenopus proteins p62(cdc6). Independently, in a yeast 2-hybrid assay using PCNA (OMIM Ref. No. 176740) as bait, Saha et al. (1998) isolated cDNAs encoding the human CDC6/Cdc18 homolog. These authors reported that the predicted 560-amino acid human protein shares approximately 33% sequence identity with the 2 yeast proteins. On Western blots of HeLa cell extracts, human CDC6/cdc18 migrates as a 66-kD protein. Although Northern blots indicated that CDC6/Cdc18 mRNA levels peak at the onset of S phase and diminish at the onset of mitosis in HeLa cells, the authors found that total CDC6/Cdc18 protein level is unchanged throughout the cell cycle. Immunofluorescent analysis of epitope-tagged protein revealed that human CDC6/Cdc18 is nuclear in G1- and cytoplasmic in S-phase cells, suggesting that DNA replication may be regulated by either the translocation of this protein between the nucleus and cytoplasm or by selective degradation of the protein in the nucleus. Immunoprecipitation studies showed that human CDC6/Cdc18 associates in vivo with cyclin A (OMIM Ref. No. 123835), CDK2 (OMIM Ref. No. 116953), and ORC1 (OMIM Ref. No. 601902). The association of cyclin-CDK2 with CDC6/Cdc18 was specifically inhibited by a factor present in mitotic cell extracts. Saha et al. (1998) suggested that if the interaction between CDC6/Cdc18 with the S phase-promoting factor cyclin-CDK2 is essential for the initiation of DNA replication, the mitotic inhibitor of this interaction could prevent a premature interaction until the appropriate time in G1.

Full details of the abovementioned studies are described in the following publications, the disclosure of which are hereby incorporated by reference:

Williams, R. S.; Shohet, R. V.; Stillman, B.: A human protein related to yeast Cdc6p. Proc. Nat. Acad. Sci. 94:142-147, 1997; and Saha, P.; Chen, J.; Thome, K. C.; Lawlis, S. J.; Hou, Z.-H.; Hendricks, M.; Parvin, J. D.; Dutta, A.: Human CDC6/Cdc18 associates with Orc1 and cyclin-cdk and is selectively eliminated.

Further studies establishing the function and utilities of CDC6 are found in John Hopkins OMIM database record ID 602627, and in cited publications listed in Table 5, which are hereby incorporated by reference. CDCP1 (Accession NP_073753.3) is another GAM189 target gene, herein designated TARGET GENE. CDCP1 BINDING SITE is a target binding site found in the 3' untranslated region of multiple transcripts of mRNA encoded by CDCP1, corresponding to a target binding site such as BINDING SITE I, BINDING SITE II or BINDING SITE III of FIG. 8. Table 4 illustrates the complementarity of the nucleotide sequences of CDCP1 BINDING SITE, designated SEQ ID:12091, to the nucleotide sequence of GAM189 RNA, herein designated GAM RNA, also designated SEQ ID:246.

Another function of GAM189 is therefore inhibition of CDCP1 (Accession NP_073753.3). Accordingly, utilities of GAM189 include diagnosis, prevention and treatment of diseases and clinical conditions associated with CDCP1.

Cadherin 1, type 1, e-cadherin (epithelial) (CDH1, Accession NP_004351.1) is another GAM189 target gene, herein designated TARGET GENE. CDH1 BINDING SITE1 and CDH1 BINDING SITE2 are target binding sites found in untranslated regions of mRNA encoded by CDH1, corresponding to target binding sites such as BINDING SITE I, BINDING SITE II or BINDING SITE III of FIG. 8. Table 4 illustrates the complementarity of the nucleotide sequences of CDH1 BINDING SITE1 and CDH1 BINDING SITE2, designated SEQ ID:12580 and SEQ ID:5514 respectively, to the nucleotide sequence of GAM189 RNA, herein designated GAM RNA, also designated SEQ ID:246.

Another function of GAM189 is therefore inhibition of Cadherin 1, type 1, e-cadherin (epithelial) (CDH1, Accession NP_004351.1) . Accordingly, utilities of GAM189 include diagnosis, prevention and treatment of diseases and clinical conditions associated with CDH1.

Cadherin 17, li cadherin (liver-intestine) (CDH17, Accession NP_004054.2) is another GAM189 target gene, herein designated TARGET GENE. CDH17 BINDING SITE is a target binding site found in the 3' untranslated region of mRNA encoded by CDH17, corresponding to a target binding site such as BINDING SITE I, BINDING SITE II or BINDING SITE III of FIG. 8. Table 4 illustrates the complementarity of the nucleotide sequences of CDH17 BINDING SITE, designated SEQ ID:13851, to the nucleotide sequence of GAM189 RNA, herein designated GAM RNA, also designated SEQ ID:246.

Another function of GAM189 is therefore inhibition of Cadherin 17, li cadherin (liver-intestine) (CDH17, Accession NP_004054.2), a gene which may have a role in the morphological organization of liver and intestine and involved in intestinal peptide transport. Accordingly, utilities of GAM189 include diagnosis, prevention and treatment of diseases and clinical conditions associated with CDH17.

The function of CDH17 and its association with various diseases and clinical conditions, has been established by previous studies, as described hereinabove with reference to GAM161.1. CDK11 (Accession XP_166324.1) is another GAM189 target gene, herein designated TARGET GENE. CDK11 BINDING SITE is a target binding site found in the 3' untranslated region of multiple transcripts of mRNA encoded by CDK11, corresponding to a target binding site such as BINDING SITE I, BINDING SITE II or BINDING SITE III of FIG. 8. Table 4 illustrates the complementarity of the nucleotide sequences of CDK11 BINDING SITE, designated SEQ ID:8162, to the nucleotide sequence of GAM189 RNA, herein designated GAM RNA, also designated SEQ ID:246.

Another function of GAM189 is therefore inhibition of CDK11 (Accession XP_166324.1). Accordingly, utilities of GAM189 include diagnosis, prevention and treatment of diseases and clinical conditions associated with CDK11.

CDKAL1 (Accession NP_060244.1) is another GAM189 target gene, herein designated TARGET GENE. CDKAL1 BINDING SITE is a target binding site found in the 3' untranslated region of mRNA encoded by CDKAL1, corresponding to a target binding site such as BINDING SITE I, BINDING SITE II or BINDING SITE III of FIG. 8. Table 4 illustrates the complementarity of the nucleotide sequences of CDKAL1 BINDING SITE, designated SEQ ID:1255, to the nucleotide sequence of GAM189 RNA, herein designated GAM RNA, also designated SEQ ID:246.

Another function of GAM189 is therefore inhibition of CDKAL1 (Accession NP_060244.1). Accordingly, utilities of GAM189 include diagnosis, prevention and treatment of diseases and clinical conditions associated with CDKAL1.

Carcinoembryonic antigen-related cell adhesion molecule 8 (CEACAM8, Accession NP_001807.2) is another GAM189 target gene, herein designated TARGET GENE. CEACAM8 BINDING SITE is a target binding site found in the 3' untranslated region of mRNA encoded by CEACAM8, corresponding to a target binding site such as BINDING SITE I, BINDING SITE II or BINDING SITE III of FIG. 8. Table 4 illustrates the complementarity of the nucleotide sequences of CEACAM8 BINDING SITE, designated SEQ ID:17969, to the nucleotide sequence of GAM189 RNA, herein designated GAM RNA, also designated SEQ ID:246.

Another function of GAM189 is therefore inhibition of Carcinoembryonic antigen-related cell adhesion molecule 8 (CEACAM8, Accession NP_001807.2). Accordingly, utilities of GAM189 include diagnosis, prevention and treatment of diseases and clinical conditions associated with CEACAM8.

Cat eye syndrome chromosome region, candidate 1 (CECR1, Accession NP_059120.2) is another GAM189 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:4574 and SEQ ID:9037 respectively, to the nucleotide sequence of GAM189 RNA, herein designated GAM RNA, also designated SEQ ID:246.

Another function of GAM189 is therefore inhibition of Cat eye syndrome chromosome region, candidate 1 (CECR1, Accession NP_059120.2). Accordingly, utilities of GAM189 include diagnosis, prevention and treatment of diseases and clinical conditions associated with CECR1.

Cat eye syndrome chromosome region, candidate 1 (CECR1, Accession NP_803124.1) is another GAM189 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:9037 and SEQ ID:4574 respectively, to the nucleotide sequence of GAM189 RNA, herein designated GAM RNA, also designated SEQ ID:246.

Another function of GAM189 is therefore inhibition of Cat eye syndrome chromosome region, candidate 1 (CECR1, Accession NP_803124.1). Accordingly, utilities of GAM189 include diagnosis, prevention and treatment of diseases and clinical conditions associated with CECR1.

Centromere protein h (CENPH, Accession NP_075060.1) is another GAM189 target gene, herein designated TARGET GENE. CENPH BINDING SITE is a target binding site found in the 3' untranslated region of mRNA encoded by CENPH, corresponding to a target binding site such as BINDING SITE I, BINDING SITE II or BINDING SITE III of FIG. 8. Table 4 illustrates the complementarity of the nucleotide sequences of CENPH BINDING SITE, designated SEQ ID:19549, to the nucleotide sequence of GAM189 RNA, herein designated GAM RNA, also designated SEQ ID:246.

Another function of GAM189 is therefore inhibition of Centromere protein h (CENPH, Accession NP_075060.1). Accordingly, utilities of GAM189 include diagnosis, prevention and treatment of diseases and clinical conditions associated with CENPH.

Centromere protein j (CENPJ, Accession NP_060921.2) is another GAM189 target gene, herein designated TARGET GENE. CENPJ BINDING SITE is a target binding site found in the 5' untranslated region of mRNA encoded by CENPJ, corresponding to a target binding site such as BINDING SITE I, BINDING SITE II or BINDING SITE III of FIG. 8. Table 4 illustrates the complementarity of the nucleotide sequences of CENPJ BINDING SITE, designated SEQ ID:13565, to the nucleotide sequence of GAM189 RNA, herein designated GAM RNA, also designated SEQ ID:246.

Another function of GAM189 is therefore inhibition of Centromere protein j (CENPJ, Accession NP_060921.2). Accordingly, utilities of GAM189 include diagnosis, prevention and treatment of diseases and clinical conditions associated with CENPJ.

CGI-150 (Accession NP_057164.1) is another GAM189 target gene, herein designated TARGET GENE. CGI-150 BINDING SITE is a target binding site found in the 5' untranslated region of mRNA encoded by CGI-150, corresponding to a target binding site such as BINDING SITE I, BINDING SITE II or BINDING SITE III of FIG. 8. Table 4 illustrates the complementarity of the nucleotide sequences of CGI-150 BINDING SITE, designated SEQ ID:2191, to the nucleotide sequence of GAM189 RNA, herein designated GAM RNA, also designated SEQ ID:246.

Another function of GAM189 is therefore inhibition of CGI-150 (Accession NP_057164.1). Accordingly, utilities of GAM189 include diagnosis, prevention and treatment of diseases and clinical conditions associated with CGI-150.

CGI-18 (Accession NP_057031.1) is another GAM189 target gene, herein designated TARGET GENE. CGI-18 BINDING SITE is a target binding site found in the 5' untranslated region of mRNA encoded by CGI-18, corresponding to a target binding site such as BINDING SITE I, BINDING SITE II or BINDING SITE III of FIG. 8. Table 4 illustrates the complementarity of the nucleotide sequences of CGI-18 BINDING SITE, designated SEQ ID:18313, to the nucleotide sequence of GAM189 RNA, herein designated GAM RNA, also designated SEQ ID:246.

Another function of GAM189 is therefore inhibition of CGI-18 (Accession NP_057031.1). Accordingly, utilities of GAM189 include diagnosis, prevention and treatment of diseases and clinical conditions associated with CGI-18.

CGI-43 (Accession NP_056437.1) is another GAM189 target gene, herein designated TARGET GENE. CGI-43 BINDING SITE is a target binding site found in the 3' untranslated region of mRNA encoded by CGI-43, corresponding to a target binding site such as BINDING SITE I, BINDING SITE II or BINDING SITE III of FIG. 8. Table 4 illustrates the complementarity of the nucleotide sequences of CGI-43 BINDING SITE, designated SEQ ID:14860, to the nucleotide sequence of GAM189 RNA, herein designated GAM RNA, also designated SEQ ID:246.

Another function of GAM189 is therefore inhibition of CGI-43 (Accession NP_056437.1). Accordingly, utilities of GAM189 include diagnosis, prevention and treatment of diseases and clinical conditions associated with CGI-43.

Chromosome condensation 1-like (CHC1L, Accession NP_001259.1) is another GAM189 target gene, herein designated TARGET GENE. CHC1L BINDING SITE is a target binding site found in the 5' untranslated region of mRNA encoded by CHC1L, corresponding to a target binding site such as BINDING SITE I, BINDING SITE II or BINDING SITE III of FIG. 8. Table 4 illustrates the complementarity of the nucleotide sequences of CHC1L BINDING SITE, designated SEQ ID:15582, to the nucleotide sequence of GAM189 RNA, herein designated GAM RNA, also designated SEQ ID:246.

Another function of GAM189 is therefore inhibition of Chromosome condensation 1-like (CHC1L, Accession NP_001259.1). Accordingly, utilities of GAM189 include diagnosis, prevention and treatment of diseases and clinical conditions associated with CHC1L.

Chromatin accessibility complex 1 (CHRAC1, Accession NP_059140.1) is another GAM189 target gene, herein designated TARGET GENE. CHRAC1 BINDING SITE is a target binding site found in the 3' untranslated region of mRNA encoded by CHRAC1, corresponding to a target binding site such as BINDING SITE I, BINDING SITE II or BINDING SITE III of FIG. 8. Table 4 illustrates the complementarity of the nucleotide sequences of CHRAC1 BINDING SITE, designated SEQ ID:9475, to the nucleotide sequence of GAM189 RNA, herein designated GAM RNA, also designated SEQ ID:246.

Another function of GAM189 is therefore inhibition of Chromatin accessibility complex 1 (CHRAC1, Accession NP_059140.1). Accordingly, utilities of GAM189 include diagnosis, prevention and treatment of diseases and clinical conditions associated with CHRAC1.

Carbohydrate (chondroitin) synthase 1 (CHSY1, Accession NP_055733.2) is another GAM189 target gene, herein designated TARGET GENE. CHSY1 BINDING SITE is a target binding site found in the 3' untranslated region of mRNA encoded by CHSY1, corresponding to a target binding site such as BINDING SITE I, BINDING SITE II or BINDING SITE III of FIG. 8. Table 4 illustrates the complementarity of the nucleotide sequences of CHSY1 BINDING SITE, designated SEQ ID:11924, to the nucleotide sequence of GAM189 RNA, herein designated GAM RNA, also designated SEQ ID:246.

Another function of GAM189 is therefore inhibition of Carbohydrate (chondroitin) synthase 1 (CHSY1, Accession NP_055733.2). Accordingly, utilities of GAM189 include diagnosis, prevention and treatment of diseases and clinical conditions associated with CHSY1.

Cold autoinflammatory syndrome 1 (CIAS1, Accession NP_004886.2) is another GAM189 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:13461, to the nucleotide sequence of GAM189 RNA, herein designated GAM RNA, also designated SEQ ID:246.

Another function of GAM189 is therefore inhibition of Cold autoinflammatory syndrome 1 (CIAS1, Accession NP_004886.2), a gene which may mediate protein-protein interactions; contains a leucine rich repeat and therefore may be associated with Familial cold autoinflammatory syndrome, muckle-wells syndrome. Accordingly, utilities of GAM189 include diagnosis, prevention and treatment of Familial cold autoinflammatory syndrome, muckle-wells syndrome, and of other diseases and clinical conditions associated with CIAS1.

The function of CIAS1 and its association with various diseases and clinical conditions, has been established by previous studies, as described hereinabove with reference to GAM90.1. CIP29 (Accession NP_115740.3) is another GAM189 target gene, herein designated TARGET GENE. CIP29 BINDING SITE1 and CIP29 BINDING SITE2 are target binding sites found in untranslated regions of mRNA encoded by CIP29, corresponding to target binding sites such as BINDING SITE I, BINDING SITE II or BINDING SITE III of FIG. 8. Table 4 illustrates the complementarity of the nucleotide sequences of CIP29 BINDING SITE1 and CIP29 BINDING SITE2, designated SEQ ID:3509 and SEQ ID:20120 respectively, to the nucleotide sequence of GAM189 RNA, herein designated GAM RNA, also designated SEQ ID:246.

Another function of GAM189 is therefore inhibition of CIP29 (Accession NP_115740.3). Accordingly, utilities of GAM189 include diagnosis, prevention and treatment of diseases and clinical conditions associated with CIP29.

Claudin 19 (CLDN19, Accession NP_683763.1) is another GAM189 target gene, herein designated TARGET GENE. CLDN19 BINDING SITE is a target binding site found in the 3' untranslated region of mRNA encoded by CLDN19, corresponding to a target binding site such as BINDING SITE I, BINDING SITE II or BINDING SITE III of FIG. 8. Table 4 illustrates the complementarity of the nucleotide sequences of CLDN19 BINDING SITE, designated SEQ ID:5914, to the nucleotide sequence of GAM189 RNA, herein designated GAM RNA, also designated SEQ ID:246.

Another function of GAM189 is therefore inhibition of Claudin 19 (CLDN19, Accession NP_683763.1). Accordingly, utilities of GAM189 include diagnosis, prevention and treatment of diseases and clinical conditions associated with CLDN19.

C-type (calcium dependent, carbohydrate-recognition domain) lectin, superfamily member 12 (CLECSF12, Accession NP_072092.2) is another GAM189 target gene, herein designated TARGET GENE. CLECSF12 BINDING SITE1 and CLECSF12 BINDING SITE2 are target binding sites found in untranslated regions of mRNA encoded by CLECSF12, corresponding to target binding sites such as BINDING SITE I, BINDING SITE II or BINDING SITE III of FIG. 8. Table 4 illustrates the complementarity of the nucleotide sequences of CLECSF12 BINDING SITE1 and CLECSF12 BINDING SITE2, designated SEQ ID:16192 and SEQ ID:15296 respectively, to the nucleotide sequence of GAM189 RNA, herein designated GAM RNA, also designated SEQ ID:246.

Another function of GAM189 is therefore inhibition of C-type (calcium dependent, carbohydrate-recognition domain) lectin, superfamily member 12 (CLECSF12, Accession NP_072092.2), a gene which is a pattern-recognition receptor. Accordingly, utilities of GAM189 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. Chloride intracellular channel 5 (CLIC5, Accession NP_058625.1) is another GAM189 target gene, herein designated TARGET GENE. CLIC5 BINDING SITE is a target binding site found in the 5' untranslated region of mRNA encoded by CLIC5, corresponding to a target binding site such as BINDING SITE I, BINDING SITE II or BINDING SITE III of FIG. 8. Table 4 illustrates the complementarity of the nucleotide sequences of CLIC5 BINDING SITE, designated SEQ ID:19116, to the nucleotide sequence of GAM189 RNA, herein designated GAM RNA, also designated SEQ ID:246.

Another function of GAM189 is therefore inhibition of Chloride intracellular channel 5 (CLIC5, Accession NP_058625.1). Accordingly, utilities of GAM189 include diagnosis, prevention and treatment of diseases and clinical conditions associated with CLIC5.

Ceroid-lipofuscinosis, neuronal 8 (epilepsy, progressive with mental retardation) (CLN8, Accession NP_061764.2) is another GAM189 target gene, herein designated TARGET GENE. CLN8 BINDING SITE is a target binding site found in the 3' untranslated region of mRNA encoded by CLN8, corresponding to a target binding site such as BINDING SITE I, BINDING SITE II or BINDING SITE III of FIG. 8. Table 4 illustrates the complementarity of the nucleotide sequences of CLN8 BINDING SITE, designated SEQ ID:515, to the nucleotide sequence of GAM189 RNA, herein designated GAM RNA, also designated SEQ ID:246.

Another function of GAM189 is therefore inhibition of Ceroid-lipofuscinosis, neuronal 8 (epilepsy, progressive with mental retardation) (CLN8, Accession NP_061764.2). Accordingly, utilities of GAM189 include diagnosis, prevention and treatment of diseases and clinical conditions associated with CLN8.

Chloride channel, nucleotide-sensitive, 1a (CLNS1A, Accession NP_001284.1) is another GAM189 target gene, herein designated TARGET GENE. CLNS1A BINDING SITE is a target binding site found in the 3' untranslated region of mRNA encoded by CLNS1A, corresponding to a target binding site such as BINDING SITE I, BINDING SITE II or BINDING SITE III of FIG. 8. Table 4 illustrates the complementarity of the nucleotide sequences of CLNS1A BINDING SITE, designated SEQ ID:18823, to the nucleotide sequence of GAM189 RNA, herein designated GAM RNA, also designated SEQ ID:246.

Another function of GAM189 is therefore inhibition of Chloride channel, nucleotide-sensitive, 1a (CLNS1A, Accession NP_001284.1), a gene which may participate in cellular volume control. Accordingly, utilities of GAM189 include diagnosis, prevention and treatment of diseases and clinical conditions associated with CLNS1A.

The function of CLNS1A and its association with various diseases and clinical conditions, has been established by previous studies, as described hereinabove with reference to GAM96.1. Cell matrix adhesion regulator (CMAR, Accession NP_005191.2) is another GAM189 target gene, herein designated TARGET GENE. CMAR BINDING SITE1 and CMAR BINDING SITE2 are target binding sites found in untranslated regions of mRNA encoded by CMAR, corresponding to target binding sites such as BINDING SITE I, BINDING SITE II or BINDING SITE III of FIG. 8. Table 4 illustrates the complementarity of the nucleotide sequences of CMAR BINDING SITE1 and CMAR BINDING SITE2, designated SEQ ID:5053 and SEQ ID:18767 respectively, to the nucleotide sequence of GAM189 RNA, herein designated GAM RNA, also designated SEQ ID:246.

Another function of GAM189 is therefore inhibition of Cell matrix adhesion regulator (CMAR, Accession NP_005191.2). Accordingly, utilities of GAM189 include diagnosis, prevention and treatment of diseases and clinical conditions associated with CMAR.

Calponin 2 (CNN2, Accession NP_004359.1) is another GAM189 target gene, herein designated TARGET GENE. CNN2 BINDING SITE is a target binding site found in the 3' untranslated region of mRNA encoded by CNN2, corresponding to a target binding site such as BINDING SITE I, BINDING SITE II or BINDING SITE III of FIG. 8. Table 4 illustrates the complementarity of the nucleotide sequences of CNN2 BINDING SITE, designated SEQ ID:9959, to the nucleotide sequence of GAM189 RNA, herein designated GAM RNA, also designated SEQ ID:246.

Another function of GAM189 is therefore inhibition of Calponin 2 (CNN2, Accession NP_004359.1), a gene which may be involved in the structural organization and/or anchorage of actin filaments. Accordingly, utilities of GAM189 include diagnosis, prevention and treatment of diseases and clinical conditions associated with CNN2.

The function of CNN2 and its association with various diseases and clinical conditions, has been established by previous studies, as described hereinabove with reference to GAM136.1.2',3'-cyclic nucleotide 3' phosphodiesterase (CNP, Accession NP_149124.1) is another GAM189 target gene, herein designated TARGET GENE. CNP BINDING SITE is a target binding site found in the 3' untranslated region of mRNA encoded by CNP, corresponding to a target binding site such as BINDING SITE I, BINDING SITE II or BINDING SITE III of FIG. 8. Table 4 illustrates the complementarity of the nucleotide sequences of CNP BINDING SITE, designated SEQ ID:606, to the nucleotide sequence of GAM189 RNA, herein designated GAM RNA, also designated SEQ ID:246.

Another function of GAM189 is therefore inhibition of 2',3'-cyclic nucleotide 3' phosphodiesterase (CNP, Accession NP_149124.1), a gene which can link tubulin to membranes and may regulate cytoplasmic microtubule distribution. Accordingly, utilities of GAM189 include diagnosis, prevention and treatment of diseases and clinical conditions associated with CNP.

The function of CNP has been established by previous studies. Cyclic nucleotide phosphodiesterase is a useful marker of myelin. CNPase is a membrane-bound enzyme found at high concentrations in central nervous system myelin and in the outer segments of photoreceptors in the retina (Vogel and Thompson, 1988). Two proteins with CNP activity are known to exist in brain and lymphoid tissues. They appear to be the products of distinct but related mRNA species. Kurihara et al. (1990) showed that the 2 gene products can arise by translation of 2 mRNAs alternatively spliced from a single transcript. In bovine and human brain, there appears to be a single species of mRNA (Vogel and Thompson, 1988), and the bovine brain and retinal forms of the enzyme appear to be identical in sequence Bifulco et al. (2002) demonstrated that CNP is firmly associated with tubulin (OMIM Ref. No. 602529) from brain tissue and thyroid cells. They showed that CNP acts as a microtubule-associated protein in promoting microtubule assembly. This activity was found to reside in the C terminus of the enzyme. The authors concluded that CNP is a membrane-bound microtubule-associated protein that can link tubulin to membranes and may regulate cytoplasmic microtubule distribution Full details of the abovementioned studies are described in the following publications, the disclosure of which are hereby incorporated by reference:

Vogel, U.S.; Thompson, R. J.: Molecular structure, localization, and possible functions of the myelin-associated enzyme 2-prime,3-prime-cyclic nucleotide 3-prime-phosphodiesterase. J. Neurochem. 50:1667-1677, 1988; and Bifulco, M.; Laezza, C.; Stingo, S.; Wolff, J.:.: 2-prime,3-prime-cyclic nucleotide 3-prime-phosphodiesterase: a membrane-bound, microtubule-associated protein and membrane anchor for tub.

Further studies establishing the function and utilities of CNP are found in John Hopkins OMIM database record ID 123830, and in cited publications listed in Table 5, which are hereby incorporated by reference. Collectin sub-family member 12 (COLEC12, Accession NP_110408.2) is another GAM189 target gene, herein designated TARGET GENE. COLEC12 BINDING SITE is a target binding site found in the 3' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:11525, to the nucleotide sequence of GAM189 RNA, herein designated GAM RNA, also designated SEQ ID:246.

Another function of GAM189 is therefore inhibition of Collectin sub-family member 12 (COLEC12, Accession NP_110408.2). Accordingly, utilities of GAM189 include diagnosis, prevention and treatment of diseases and clinical conditions associated with COLEC12.

Coronin, actin binding protein, 1c (CORO1C, Accession NP_055140.1) is another GAM189 target gene, herein designated TARGET GENE. CORO1C BINDING SITE is a target binding site found in the 3' untranslated region of mRNA encoded by CORO1C, corresponding to a target binding site such as BINDING SITE I, BINDING SITE II or BINDING SITE III of FIG. 8. Table 4 illustrates the complementarity of the nucleotide sequences of CORO1C BINDING SITE, designated SEQ ID:13595, to the nucleotide sequence of GAM189 RNA, herein designated GAM RNA, also designated SEQ ID:246.

Another function of GAM189 is therefore inhibition of Coronin, actin binding protein, 1c (CORO1C, Accession NP_055140.1). Accordingly, utilities of GAM189 include diagnosis, prevention and treatment of diseases and clinical conditions associated with CORO1C.

Cox15 homolog, cytochrome c oxidase assembly protein (yeast) (COX15, Accession NP_510870.1) is another GAM189 target gene, herein designated TARGET GENE. COX15 BINDING SITE is a target binding site found in the 3' untranslated region of multiple transcripts of mRNA encoded by COX15, corresponding to a target binding site such as BINDING SITE I, BINDING SITE II or BINDING SITE III of FIG. 8. Table 4 illustrates the complementarity of the nucleotide sequences of COX15 BINDING SITE, designated SEQ ID:7552, to the nucleotide sequence of GAM189 RNA, herein designated GAM RNA, also designated SEQ ID:246.

Another function of GAM189 is therefore inhibition of Cox15 homolog, cytochrome c oxidase assembly protein (yeast) (COX15, Accession NP_510870.1). Accordingly, utilities of GAM189 include diagnosis, prevention and treatment of diseases and clinical conditions associated with COX15.

Carboxypeptidase a4 (CPA4, Accession NP_057436.1) is another GAM189 target gene, herein designated TARGET GENE. CPA4 BINDING SITE is a target binding site found in the 3' untranslated region of mRNA encoded by CPA4, corresponding to a target binding site such as BINDING SITE I, BINDING SITE II or BINDING SITE III of FIG. 8. Table 4 illustrates the complementarity of the nucleotide sequences of CPA4 BINDING SITE, designated SEQ ID:8942, to the nucleotide sequence of GAM189 RNA, herein designated GAM RNA, also designated SEQ ID:246.

Another function of GAM189 is therefore inhibition of Carboxypeptidase a4 (CPA4, Accession NP_057436.1). Accordingly, utilities of GAM189 include diagnosis, prevention and treatment of diseases and clinical conditions associated with CPA4.

CPR8 (Accession NP_065790.1) is another GAM189 target gene, herein designated TARGET GENE. CPR8 BINDING SITE is a target binding site found in the 3' untranslated region of multiple transcripts of mRNA encoded by CPR8, corresponding to a target binding site such as BINDING SITE I, BINDING SITE II or BINDING SITE III of FIG. 8. Table 4 illustrates the complementarity of the nucleotide sequences of CPR8 BINDING SITE, designated SEQ ID:13999, to the nucleotide sequence of GAM189 RNA, herein designated GAM RNA, also designated SEQ ID:246.

Another function of GAM189 is therefore inhibition of CPR8 (Accession NP_065790.1). Accordingly, utilities of GAM189 include diagnosis, prevention and treatment of diseases and clinical conditions associated with CPR8.

Carbamoyl-phosphate synthetase 1, mitochondrial (CPS1, Accession NP_001866.2) is another GAM189 target gene, herein designated TARGET GENE. CPS1 BINDING SITE is a target binding site found in the 3' untranslated region of mRNA encoded by CPS1, corresponding to a target binding site such as BINDING SITE I, BINDING SITE II or BINDING SITE III of FIG. 8. Table 4 illustrates the complementarity of the nucleotide sequences of CPS1 BINDING SITE, designated SEQ ID:14493, to the nucleotide sequence of GAM189 RNA, herein designated GAM RNA, also designated SEQ ID:246.

Another function of GAM189 is therefore inhibition of Carbamoyl-phosphate synthetase 1, mitochondrial (CPS1, Accession NP_001866.2) . Accordingly, utilities of GAM189 include diagnosis, prevention and treatment of diseases and clinical conditions associated with CPS1.

Cleavage and polyadenylation specific factor 2, 100 kda (CPSF2, Accession XP_029311.2) is another GAM189 target gene, herein designated TARGET GENE. CPSF2 BINDING SITE1 and CPSF2 BINDING SITE2 are target binding sites found in untranslated regions of mRNA encoded by CPSF2, corresponding to target binding sites such as BINDING SITE I, BINDING SITE II or BINDING SITE III of FIG. 8. Table 4 illustrates the complementarity of the nucleotide sequences of CPSF2 BINDING SITE1 and CPSF2 BINDING SITE2, designated SEQ ID:1877 and SEQ ID:591 respectively, to the nucleotide sequence of GAM189 RNA, herein designated GAM RNA, also designated SEQ ID:246.

Another function of GAM189 is therefore inhibition of Cleavage and polyadenylation specific factor 2, 100 kda (CPSF2, Accession XP_029311.2). Accordingly, utilities of GAM189 include diagnosis, prevention and treatment of diseases and clinical conditions associated with CPSF2.

Complement component (3b/4b) receptor 1, including knops blood group system (CR1, Accession NP_000642.2)

is another GAM189 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:17292, to the nucleotide sequence of GAM189 RNA, herein designated GAM RNA, also designated SEQ ID:246.

Another function of GAM189 is therefore inhibition of Complement component (3b/4b) receptor 1, including knops blood group system (CR1, Accession NP_000642.2). Accordingly, utilities of GAM189 include diagnosis, prevention and treatment of diseases and clinical conditions associated with CR1.

Complement component (3b/4b) receptor 1, including knops blood group system (CR1, Accession NP_000564.1) is another GAM189 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:17292, to the nucleotide sequence of GAM189 RNA, herein designated GAM RNA, also designated SEQ ID:246.

Another function of GAM189 is therefore inhibition of Complement component (3b/4b) receptor 1, including knops blood group system (CR1, Accession NP_000564.1). Accordingly, utilities of GAM189 include diagnosis, prevention and treatment of diseases and clinical conditions associated with CR1.

Cytokine receptor-like factor 3 (CRLF3, Accession NP_057070.2) is another GAM189 target gene, herein designated TARGET GENE. CRLF3 BINDING SITE is a target binding site found in the 3' untranslated region of mRNA encoded by CRLF3, corresponding to a target binding site such as BINDING SITE I, BINDING SITE II or BINDING SITE III of FIG. 8. Table 4 illustrates the complementarity of the nucleotide sequences of CRLF3 BINDING SITE, designated SEQ ID:7105, to the nucleotide sequence of GAM189 RNA, herein designated GAM RNA, also designated SEQ ID:246.

Another function of GAM189 is therefore inhibition of Cytokine receptor-like factor 3 (CRLF3, Accession NP_057070.2). Accordingly, utilities of GAM189 include diagnosis, prevention and treatment of diseases and clinical conditions associated with CRLF3.

Cofactor required for sp1 transcriptional activation, subunit 6, 77 kda (CRSP6, Accession NP_004259.3) is another GAM189 target gene, herein designated TARGET GENE. CRSP6 BINDING SITE is a target binding site found in the 3' untranslated region of mRNA encoded by CRSP6, corresponding to a target binding site such as BINDING SITE I, BINDING SITE II or BINDING SITE III of FIG. 8. Table 4 illustrates the complementarity of the nucleotide sequences of CRSP6 BINDING SITE, designated SEQ ID:7661, to the nucleotide sequence of GAM189 RNA, herein designated GAM RNA, also designated SEQ ID:246.

Another function of GAM189 is therefore inhibition of Cofactor required for sp1 transcriptional activation, subunit 6, 77 kda (CRSP6, Accession NP_004259.3), a gene which is required for Sp1 mediated transcriptional activation with TAF (II)s. Accordingly, utilities of GAM189 include diagnosis, prevention and treatment of diseases and clinical conditions associated with CRSP6.

The function of CRSP6 has been established by previous studies. Using a HeLa cell line, Ito et al. (1999) cloned TRAP80, the gene encoding the 80-kD subunit of the TRAP complex. (For background information on thyroid hormone receptor-associated proteins (TRAPs), see 300182). The TRAP80 cDNA encodes a 717-amino acid protein that has no obvious motifs other than a short leucine zipper in the middle of the sequence. The TRAP80 cDNA appears to be equivalent to the p78 component of the mouse Mediator (Jiang et al., 1998). Northern blot analysis of multiple human tissues showed that the TRAP80 gene is ubiquitously expressed as an approximately 3.0-kb transcript Gene transcription requires factors that recognize transcriptional enhancer sites in DNA. These factors work with coactivators to direct transcriptional initiation by the RNA polymerase II apparatus (see OMIM Ref. No. POLR2A, 180660). Transcriptional activation by enhancer-binding factors such as SP1 (OMIM Ref. No. 189906) requires interaction with the TFIID complex (see OMIM Ref. No. TAF2A, 313650). To identify other potential SP1 cofactors, Ryu et al. (1999) developed an in vitro transcription assay consisting of TFIIA (GTF2A1; 600520), RNA polII, and the basal transcription factors GTF2B (OMIM Ref. No. 189963), GTF2E (OMIM Ref. No. 189962), GTF2F (OMIM Ref. No. 189968), and GTF2H (OMIM Ref. No. 189972), supplemented with TFIID or TBP (OMIM Ref. No. 600075). By sequential chromatography, they excluded PC4 (OMIM Ref. No. 600503) as an SP1 cofactor and identified a multisubunit cofactor, CRSP (cofactor required for SP1 activation), which, along with TFIID, is required for efficient activation by SP1. CRSP behaves as a single complex of approximately 700 kD. Ryu et al. (1999) tentatively identified 9 polypeptides as CRSP subunits (see OMIM Ref. No. also PPARBP, 604311). Using microsequence peptide analysis, they cloned a CRSP cDNA encoding a 77-kD protein, CRSP6, which they termed CRSP77

Full details of the abovementioned studies are described in the following publications, the disclosure of which are hereby incorporated by reference:

Ito, M.; Yuan, C.-X.; Malik, S.; Gu, W.; Fondell, J. D.; Yamamura, S.; Fu, Z.-Y.; Zhang, X.; Qin, J.; Roeder, R. G.: Identity between TRAP and SMCC complexes indicates novel pathways for the function of nuclear receptors and diverse mammalian activators. Molec. Cell 3:361-370, 1999; and Ry, S.; Zhou, S.; Ladurner, A. G.; Tjian, R.: The transcriptional cofactor complex CRSP is required for activity of the enhancer-binding protein Sp1. Nature 397:446-450, 1999.

Further studies establishing the function and utilities of CRSP6 are found in John Hopkins OMIM database record ID 603810, and in cited publications listed in Table 5, which are hereby incorporated by reference. Cartilage associated protein (CRTAP, Accession NP_006362.1) is another GAM189 target gene, herein designated TARGET GENE. CRTAP BINDING SITE is a target binding site found in the 3' untranslated region of mRNA encoded by CRTAP, corresponding to a target binding site such as BINDING SITE I, BINDING SITE II or BINDING SITE III of FIG. 8. Table 4 illustrates the complementarity of the nucleotide sequences of CRTAP BINDING SITE, designated SEQ ID:7107, to the nucleotide sequence of GAM189 RNA, herein designated GAM RNA, also designated SEQ ID:246.

Another function of GAM189 is therefore inhibition of Cartilage associated protein (CRTAP, Accession NP_006362.1), a gene which is a novel developmentally regulated chick embryo protein. Accordingly, utilities of GAM189 include diagnosis, prevention and treatment of diseases and clinical conditions associated with CRTAP.

The function of CRTAP and its association with various diseases and clinical conditions, has been established by previous studies, as described hereinabove with reference to GAM136.1. CSE-C (Accession NP_061851.1) is another GAM189 target gene, herein designated TARGET GENE. CSE-C BINDING SITE is a target binding site found in the 5' untranslated region of multiple transcripts of mRNA encoded by CSE-C, corresponding to a target binding site such as BINDING SITE I, BINDING SITE II or BINDING SITE III of FIG. 8. Table 4 illustrates the complementarity of the nucleotide sequences of CSE-C BINDING SITE, designated SEQ ID:2336, to the nucleotide sequence of GAM189 RNA, herein designated GAM RNA, also designated SEQ ID:246.

Another function of GAM189 is therefore inhibition of CSE-C (Accession NP_061851.1). Accordingly, utilities of GAM189 include diagnosis, prevention and treatment of diseases and clinical conditions associated with CSE-C.

Cse1 chromosome segregation 1-like (yeast) (CSE1L, Accession NP_803185.1) is another GAM189 target gene, herein designated TARGET GENE. CSE1L BINDING SITE is a target binding site found in the 3' untranslated region of multiple transcripts of mRNA encoded by CSE1L, corresponding to a target binding site such as BINDING SITE I, BINDING SITE II or BINDING SITE III of FIG. 8. Table 4 illustrates the complementarity of the nucleotide sequences of CSE1L BINDING SITE, designated SEQ ID:6312, to the nucleotide sequence of GAM189 RNA, herein designated GAM RNA, also designated SEQ ID:246.

Another function of GAM189 is therefore inhibition of Cse1 chromosome segregation 1-like (yeast) (CSE1L, Accession NP_803185.1). Accordingly, utilities of GAM189 include diagnosis, prevention and treatment of diseases and clinical conditions associated with CSE1L.

Casein kinase 2, alpha prime polypeptide (CSNK2A2, Accession NP_001887.1) is another GAM189 target gene, herein designated TARGET GENE. CSNK2A2 BINDING SITE is a target binding site found in the 5' untranslated region of mRNA encoded by CSNK2A2, corresponding to a target binding site such as BINDING SITE I, BINDING SITE II or BINDING SITE III of FIG. 8. Table 4 illustrates the complementarity of the nucleotide sequences of CSNK2A2 BINDING SITE, designated SEQ ID:15382, to the nucleotide sequence of GAM189 RNA, herein designated GAM RNA, also designated SEQ ID:246.

Another function of GAM189 is therefore inhibition of Casein kinase 2, alpha prime polypeptide (CSNK2A2, Accession NP_001887.1), a gene which catalyzes the phosphorylation of serine or threonine residues in proteins. Accordingly, utilities of GAM189 include diagnosis, prevention and treatment of diseases and clinical conditions associated with CSNK2A2.

The function of CSNK2A2 has been established by previous studies. Phosphorylation of the human p53 protein (OMIM Ref. No. 191170) at ser392 is responsive to ultraviolet (UV) but not gamma irradiation. Keller et al. (2001) identified and purified a mammalian UV-activated protein kinase complex that phosphorylates ser392 in vitro. This kinase complex contains CK2 and the chromatin transcriptional elongation factor FACT, a heterodimer of SPT16 (OMIM Ref. No. 605012) and SSRP1 (OMIM Ref. No. 604328). In vitro studies showed that FACT alters the specificity of CK2 in the complex such that it selectively phosphorylates p53 over other substrates, including casein. In addition, phosphorylation by the kinase complex was found to enhance p53 activity. These results provided a potential mechanism for p53 activation by UV irradiation Doray et al. (2002) demonstrated that the Golgi-localized, gamma-ear-containing adenosine diphosphate ribosylation factor-binding proteins (GGA1, 606004 and GGA3, 606006) and the coat protein adaptor protein-1 (AP-1) complex (see OMIM Ref. No. AP1G2, 603534) colocalize in clathrin-coated buds of the trans-Golgi networks of mouse L cells and human HeLa cells. Binding studies revealed a direct interaction between the hinge domains of the GGAs and the gamma-ear domain of AP-1. Further, AP-1 contained bound casein kinase-2 that phosphorylated GGA1 and GGA3, thereby causing autoinhibition. Doray et al. (2002) demonstrated that this autoinhibition could induce the directed transfer of mannose 6-phosphate receptors (see OMIM Ref. No. 154540) from the GGAs to AP-1. Mannose 6-phosphate receptors that were defective in binding to GGAs were poorly incorporated into adaptor protein complex containing clathrin coated vesicles. Thus, Doray et al. (2002) concluded that GGAs and the AP-1 complex interact to package mannose 6-phosphate receptors into AP-1-containing coated vesicles Animal model experiments lend further support to the function of CSNK2A2. To determine the functional and developmental role of protein kinase casein kinase II, Xu et al. (1999) used homologous recombination to disrupt the gene encoding Csnk2a2 in transgenic mice. They found that Csnk2a2 is preferentially expressed in late stages of spermatogenesis, and male mice in which Csnk2a2 has been disrupted are infertile, with oligospermia and globozoospermia ('round-headed spermatozoa'). This was the first demonstration of the unique role for a Ck2 isoform in development. The primary spermatogenic defect in the Csnk2a2 -/-testis is a specific abnormality of anterior head shaping of elongating spermatids; this is the first defined gene that regulates sperm head morphogenesis. As the germ cells differentiate, they are capable of undergoing chromatin condensation, although many abnormal cells are deleted through apoptosis or Sertoli cell phagocytosis. The few that survived to populate the epididymis exhibited head abnormalities similar to those described in human globozoospermia; thus, Csnk2a2 may be a candidate gene for inherited abnormalities of sperm morphogenesis It is appreciated that the abovementioned animal model for CSNK2A2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002; and Xu, X.; Toselli, P. A.; Russell, L. D.; Seldin, D. C.: Globozoospermia in mice lacking the casein kinase II alpha-prime catalytic subunit. Nature Genet. 23: 118-121, 1999.

Further studies establishing the function and utilities of CSNK2A2 are found in John Hopkins OMIM database record ID 115442, and in cited publications listed in Table 5, which are hereby incorporated by reference. CTEN (Accession NP_116254.3) is another GAM189 target gene, herein designated TARGET GENE. CTEN BINDING SITE is a target binding site found in the 3' untranslated region of mRNA encoded by CTEN, corresponding to a target binding site such as BINDING SITE I, BINDING SITE II or BINDING SITE III of FIG. 8. Table 4 illustrates the complementarity of the nucleotide sequences of CTEN BINDING SITE, designated SEQ ID:14746, to the nucleotide sequence of GAM189 RNA, herein designated GAM RNA, also designated SEQ ID:246.

Another function of GAM189 is therefore inhibition of CTEN (Accession NP_116254.3). Accordingly, utilities of GAM189 include diagnosis, prevention and treatment of diseases and clinical conditions associated with CTEN.

Cardiotrophin 1 (CTF1, Accession NP_001321.1) is another GAM189 target gene, herein designated TARGET GENE. CTF1 BINDING SITE is a target binding site found in the 3' untranslated region of mRNA encoded by CTF1, corresponding to a target binding site such as BINDING SITE I, BINDING SITE II or BINDING SITE III of FIG. 8. Table 4 illustrates the complementarity of the nucleotide sequences of CTF1 BINDING SITE, designated SEQ ID:13287, to the nucleotide sequence of GAM189 RNA, herein designated GAM RNA, also designated SEQ ID:246.

Another function of GAM189 is therefore inhibition of Cardiotrophin 1 (CTF1, Accession NP_001321.1), a gene which may play a role in cardiac hypertrophy. and therefore may be associated with Cardiac hypertrophy. Accordingly, utilities of GAM189 include diagnosis, prevention and treatment of Cardiac hypertrophy, and of other diseases and clinical conditions associated with CTF1.

The function of CTF1 has been established by previous studies. Heart failure is a leading cause of mortality worldwide. A hallmark of the disease is dilated cardiac hypertrophy, which is accompanied by a reactivation of genes expressed in fetal heart development. Reasoning that fetal or embryonic growth factors may mediate the onset of cardiac hypertrophy, Pennica et al. (1995) coupled expression cloning with an embryonic stem cell-based model of cardiogenesis to isolate a 21.5-kD protein, cardiotrophin 1, that potently induces cardiac myocyte hypertrophy in vitro. Amino acid similarity data indicated that CT1 is a member of the family of cytokines that includes leukemia inhibitory factor (LIF; 159540), ciliary neurotrophic factor (CNTF; 118945), oncostatin M (OSM; 165095), interleukin 6 (IL6; 147620), and interleukin 11 (IL11; 147681). Several members of this family that are known to signal through the transmembrane protein gp130 (OMIM Ref. No. 162820) stimulate cardiac myocyte hypertrophy, like cardiotrophin 1, suggesting that the gp130 signaling pathway may play a role in cardiac hypertrophy. The 1.4-kb CT1 mRNA is present in the heart and several other mouse tissues Amyotrophic lateral sclerosis (ALS; 105400) is mainly a sporadic neurodegenerative disorder characterized by loss of cortical and spinal motoneurons. Some familial ALS (FALS) cases have been linked to dominant mutations in the gene encoding Cu/Zn superoxide dismutase (SOD1; 147450). Transgenic mice overexpressing a mutated form of human SOD1 with a gly93- to - ala substitution (147450.0008) develop progressive muscle wasting and paralysis as a result of spinal motoneuron loss and die at 5 to 6 months. Bordet et al. (2001) investigated the effects of neurotrophic factor gene delivery in this FALS model. Intramuscular injection of an adenoviral vector encoding CTF1 in SOD1(G93A) newborn mice delayed the onset of motor impairment as assessed in the rotarod test. By CTF1 treatment, axonal degeneration was slowed, skeletal muscle atrophy was largely reduced, and the time-course of motor impairment was significantly decreased Full details of the abovementioned studies are described in the following publications, the disclosure of which are hereby incorporated by reference:

Pennica, D.; King, K. L.; Shaw, K. J.; Luis, E.; Rullamas, J.; Luoh, S.-M.; Darbonne, W. C.; Knutzon, D. S.; Yen, R.; Chien, K. R.; Baker, J. B.; Wood, W. I.: Expression cloning of cardiotrophin 1, a cytokine that induces cardiac myocyte hypertrophy. Proc. Nat. Acad. Sci. 92:1142-1146, 1995; and Bordet, T.; Lesbordes, J.-C.; Rouhani, S.; Castelnau-Ptakhine, L.; Schmalbruch, H.; Haase, G.; Kahn, A.: Protective effects of cardiotrophin-1 adenoviral gene transfer on neuromuscular.

Further studies establishing the function and utilities of CTF1 are found in John Hopkins OMIM database record ID 600435, and in cited publications listed in Table 5, which are hereby incorporated by reference. Cathepsin s (CTSS, Accession NP_004070.3) is another GAM189 target gene, herein designated TARGET GENE. CTSS BINDING SITE is a target binding site found in the 3' untranslated region of mRNA encoded by CTSS, corresponding to a target binding site such as BINDING SITE I, BINDING SITE II or BINDING SITE III of FIG. 8. Table 4 illustrates the complementarity of the nucleotide sequences of CTSS BINDING SITE, designated SEQ ID:4517, to the nucleotide sequence of GAM189 RNA, herein designated GAM RNA, also designated SEQ ID:246.

Another function of GAM189 is therefore inhibition of Cathepsin s (CTSS, Accession NP_004070.3), a gene which is a lysosomal cysteine (thiol) protease that cleaves elastin. Accordingly, utilities of GAM189 include diagnosis, prevention and treatment of diseases and clinical conditions associated with CTSS.

The function of CTSS and its association with various diseases and clinical conditions, has been established by previous studies, as described hereinabove with reference to GAM72.1. Chemokine (c-x-c motif) ligand 16 (CXCL16, Accession NP_071342.1) is another GAM189 target gene, herein designated TARGET GENE. CXCL16 BINDING SITE is a target binding site found in the 3' untranslated region of mRNA encoded by CXCL16, corresponding to a target binding site such as BINDING SITE I, BINDING SITE II or BINDING SITE III of FIG. 8. Table 4 illustrates the complementarity of the nucleotide sequences of CXCL16 BINDING SITE, designated SEQ ID:17688, to the nucleotide sequence of GAM189 RNA, herein designated GAM RNA, also designated SEQ ID:246.

Another function of GAM189 is therefore inhibition of Chemokine (c-x-c motif) ligand 16 (CXCL16, Accession NP_071342.1), a gene which induces calcium mobilization. Accordingly, utilities of GAM189 include diagnosis, prevention and treatment of diseases and clinical conditions associated with CXCL16.

The function of CXCL16 has been established by previous studies. Using a 2-step EST database search in which putative transcripts were scanned for the occurrence of functional patterns, Matloubian et al. (2000) identified a cDNA encoding a CXC chemokine that they termed CXCL16. The predicted 273-amino acid CXCL16 protein, which is 49% identical to the 246-amino acid mouse sequence, contains a non-glu/leu/arg (ELR) motif-containing CXC chemokine domain, a mucin-like spacer region, a transmembrane domain, and a cytoplasmic tail with a potential tyrosine phosphorylation and SH2 protein-binding site. CXCL16 was the first transmembrane CXC chemokine identified; CX3CL1 (SCYD1; 601880), which also has a mucin-like spacer region, was the only other known transmembrane chemokine. Northern blot analysis of mouse and human tissues detected a 2.2-kb CXCL16 transcript in spleen, lymph nodes, Peyer patches, lung, kidney, small intestine, and thymus, with weak expression in heart and liver and no expression in brain and bone marrow. Flow cytometry and Western blot analysis demonstrated expression of an approximately 60-kD glycosylated cell-surface protein as well as a cell supernatant 35-kD soluble protein. Flow cytometry of cells from mouse tissues indicated that CXCL16 is found on CD11C (ITGAX;

151510)-positive splenic and lymph node dendritic cells; this expression was increased after injection with lipopolysaccharide. Immunohistochemical analysis showed that CXCL16 is expressed in T-cell areas of the splenic white pulp, lymph nodes, the thymus medulla, and, interestingly, in the splenic red pulp. No staining was observed in B-cell areas. After injection of inflammatory mediators, expression was enhanced in T-cell zones and, more prominently, in splenic red pulp. Chemotaxis assays found that CXCL16 induced a strong chemotactic response in activated CD8 T cells. In addition, CXCL16 induced calcium mobilization. Expression cloning of mouse Cxcl16 identified a protein with 71% amino acid identity to human BONZO (OMIM Ref. No. 605163), which Matloubian et al. (2000) renamed CXCR6. Human and mouse cells expressing CXCR6 showed a strong chemotactic response to CXCL16 but not to other chemokines. The authors concluded that CXCL16 and CXCR6 probably function in interactions between dendritic cells and T cells and in regulating T-cell migration in the splenic red pulp. Macrophages endocytose oxidized low density lipoprotein (OxLDL) by a receptor-mediated mechanism. By expression cloning from a phorbol ester-stimulated THP-1 cell library, Shimaoka et al. (2000) isolated a cDNA encoding SRPSOX (scavenger receptor that binds phophatidylserine and oxidized lipoprotein). The deduced 254-amino acid type I transmembrane protein is identical to the CXCL16 protein reported by Matloubian et al. (2000) except that SRPSOX differs by 2 residues and lacks the N-terminal 19 amino acids. Cells expressing SRPSOX bound to phophatidylserine-coated plates; this binding could be inhibited by OxLDL. Scatchard analysis confirmed that SRPSOX is a specific receptor for OxLDL but not LDL or acetyl- LDL. Fluorescence microscopy demonstrated OxLDL uptake in SRPSOX-expressing cells. Immunoblot analysis showed that SRPSOX is expressed as a 30-kD protein in human and mouse macrophages. Northern blot analysis revealed differentiation-inducible expression of 1.8- and 2.5-kb transcripts in macrophages.

Full details of the abovementioned studies are described in the following publications, the disclosure of which are hereby incorporated by reference:

Matloubian, M.; David, A.; Engel, S.; Ryan, J. E.; Cyster, J. G.: A transmembrane CXC chemokine is a ligand for HIV-coreceptor Bonzo. Nature Immun. 1:298-304, 2000; and Shimaoka, T.; Kume, N.; Minami, M.; Hayashida, K.; Kataoka, H.; Kita, T.; Yonehara, S.: Molecular cloning of a novel scavenger receptor for oxidized low density lipoprotein, SR-PSOX.

Further studies establishing the function and utilities of CXCL16 are found in John Hopkins OMIM database record ID 605398, and in cited publications listed in Table 5, which are hereby incorporated by reference. CYCS (Accession NP_061820.1) is another GAM189 target gene, herein designated TARGET GENE. CYCS BINDING SITE1 through CYCS BINDING SITE3 are target binding sites found in untranslated regions of mRNA encoded by CYCS, corresponding to target binding sites such as BINDING SITE I, BINDING SITE II or BINDING SITE III of FIG. 8. Table 4 illustrates the complementarity of the nucleotide sequences of CYCS BINDING SITE1 through CYCS BINDING SITE3, designated SEQ ID:9339, SEQ ID:18991 and SEQ ID:18868 respectively, to the nucleotide sequence of GAM189 RNA, herein designated GAM RNA, also designated SEQ ID:246.

Another function of GAM189 is therefore inhibition of CYCS (Accession NP_061820.1). Accordingly, utilities of GAM189 include diagnosis, prevention and treatment of diseases and clinical conditions associated with CYCS.

Cylicin, basic protein of sperm head cytoskeleton 2 (CYLC2, Accession NP_001331.1) is another GAM189 target gene, herein designated TARGET GENE. CYLC2 BINDING SITE is a target binding site found in the 3' untranslated region of mRNA encoded by CYLC2, corresponding to a target binding site such as BINDING SITE I, BINDING SITE II or BINDING SITE III of FIG. 8. Table 4 illustrates the complementarity of the nucleotide sequences of CYLC2 BINDING SITE, designated SEQ ID:15540, to the nucleotide sequence of GAM189 RNA, herein designated GAM RNA, also designated SEQ ID:246.

Another function of GAM189 is therefore inhibition of Cylicin, basic protein of sperm head cytoskeleton 2 (CYLC2, Accession NP_001331.1). Accordingly, utilities of GAM189 include diagnosis, prevention and treatment of diseases and clinical conditions associated with CYLC2.

Cytochrome p450, subfamily i (aromatic compound-inducible), polypeptide 2 (CYP1A2, Accession NP_000752.1) is another GAM189 target gene, herein designated TARGET GENE. CYP1A2 BINDING SITE1 through CYP1A2 BINDING SITE3 are target binding sites found in untranslated regions of mRNA encoded by CYP1A2, corresponding to target binding sites such as BINDING SITE I, BINDING SITE II or BINDING SITE III of FIG. 8. Table 4 illustrates the complementarity of the nucleotide sequences of CYP1A2 BINDING SITE1 through CYP1A2 BINDING SITE3, designated SEQ ID:6637, SEQ ID:13576 and SEQ ID:18279 respectively, to the nucleotide sequence of GAM189 RNA, herein designated GAM RNA, also designated SEQ ID:246.

Another function of GAM189 is therefore inhibition of Cytochrome p450, subfamily i (aromatic compound-inducible), polypeptide 2 (CYP1A2, Accession NP_000752.1), a gene which intervenes in an NADPH-dependent electron transport pathway. and therefore may be associated with Porphyria cutanea tarda. Accordingly, utilities of GAM189 include diagnosis, prevention and treatment of Porphyria cutanea tarda, and of other diseases and clinical conditions associated with CYP1A2.

The function of CYP1A2 and its association with various diseases and clinical conditions, has been established by previous studies, as described hereinabove with reference to GAM30.1. Cytochrome p450, subfamily iib (phenobarbital-inducible), polypeptide 6 (CYP2B6, Accession NP_000758.1) is another GAM189 target gene, herein designated TARGET GENE. CYP2B6 BINDING SITE1 and CYP2B6 BINDING SITE2 are target binding sites found in untranslated regions of mRNA encoded by CYP2B6, corresponding to target binding sites such as BINDING SITE I, BINDING SITE II or BINDING SITE III of FIG. 8. Table 4 illustrates the complementarity of the nucleotide sequences of CYP2B6 BINDING SITE1 and CYP2B6 BINDING SITE2, designated SEQ ID:2194 and SEQ ID:10618 respectively, to the nucleotide sequence of GAM189 RNA, herein designated GAM RNA, also designated SEQ ID:246.

Another function of GAM189 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM189 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. Cytochrome p450, subfamily ivf, polypeptide 3 (leukotriene b4 omega hydroxylase) (CYP4F3, Accession NP_000887.1) is another GAM189 target gene, herein designated TARGET GENE. CYP4F3 BINDING SITE is a target binding site found in the 3' untranslated region of mRNA encoded by CYP4F3, corresponding to a target binding site such as BINDING SITE I, BINDING SITE II or BINDING SITE III of FIG. 8. Table 4 illustrates the complementarity of the nucleotide sequences of CYP4F3 BINDING SITE, designated SEQ ID:9158, to the nucleotide sequence of GAM189 RNA, herein designated GAM RNA, also designated SEQ ID:246.

Another function of GAM189 is therefore inhibition of Cytochrome p450, subfamily ivf, polypeptide 3 (leukotriene b4 omega hydroxylase) (CYP4F3, Accession NP_000887.1), a gene which converts leukotriene B4 into the less active 20-hydroxy-leukotriene B4. Accordingly, utilities of GAM189 include diagnosis, prevention and treatment of diseases and clinical conditions associated with CYP4F3.

The function of CYP4F3 and its association with various diseases and clinical conditions, has been established by previous studies, as described hereinabove with reference to GAM67.1. CYP51A1 (Accession NP_000777.1) is another GAM189 target gene, herein designated TARGET GENE. CYP51A1 BINDING SITE is a target binding site found in the 3' untranslated region of mRNA encoded by CYP51A1, corresponding to a target binding site such as BINDING SITE I, BINDING SITE II or BINDING SITE III of FIG. 8. Table 4 illustrates the complementarity of the nucleotide sequences of CYP51A1 BINDING SITE, designated SEQ ID:2152, to the nucleotide sequence of GAM189 RNA, herein designated GAM RNA, also designated SEQ ID:246.

Another function of GAM189 is therefore inhibition of CYP51A1 (Accession NP_000777.1). Accordingly, utilities of GAM189 include diagnosis, prevention and treatment of diseases and clinical conditions associated with CYP51A1.

Cytochrome p450, subfamily viiib (sterol 12-alpha-hydroxylase), polypeptide 1 (CYP8B1, Accession NP_004382.1) is another GAM189 target gene, herein designated TARGET GENE. CYP8B1 BINDING SITE is a target binding site found in the 3' untranslated region of mRNA encoded by CYP8B1, corresponding to a target binding site such as BINDING SITE I, BINDING SITE II or BINDING SITE III of FIG. 8. Table 4 illustrates the complementarity of the nucleotide sequences of CYP8B1 BINDING SITE, designated SEQ ID:5978, to the nucleotide sequence of GAM189 RNA, herein designated GAM RNA, also designated SEQ ID:246.

Another function of GAM189 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM189 include diagnosis, prevention and treatment of diseases and clinical conditions associated with CYP8B1.

The function of CYP8B1 and its association with various diseases and clinical conditions, has been established by previous studies, as described hereinabove with reference to GAM47.1. Debranching enzyme homolog 1 (s. cerevisiae) (DBR1, Accession NP_057300.1) is another GAM189 target gene, herein designated TARGET GENE. DBR1 BINDING SITE is a target binding site found in the 3' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:7961, to the nucleotide sequence of GAM189 RNA, herein designated GAM RNA, also designated SEQ ID:246.

Another function of GAM189 is therefore inhibition of Debranching enzyme homolog 1 (s. cerevisiae) (DBR1, Accession NP_057300.1). Accordingly, utilities of GAM189 include diagnosis, prevention and treatment of diseases and clinical conditions associated with DBR1.

Doublecortex; lissencephaly, x-linked (doublecortin) (DCX, Accession NP_835365.1) is another GAM189 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM189 RNA, herein designated GAM RNA, also designated SEQ ID:246.

Another function of GAM189 is therefore inhibition of Doublecortex; lissencephaly, x-linked (doublecortin) (DCX, Accession NP_835365.1). Accordingly, utilities of GAM189 include diagnosis, prevention and treatment of diseases and clinical conditions associated with DCX.

Doublecortex; lissencephaly, x-linked (doublecortin) (DCX, Accession NP_835364.1) is another GAM189 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM189 RNA, herein designated GAM RNA, also designated SEQ ID:246.

Another function of GAM189 is therefore inhibition of Doublecortex; lissencephaly, x-linked (doublecortin) (DCX, Accession NP_835364.1). Accordingly, utilities of GAM189 include diagnosis, prevention and treatment of diseases and clinical conditions associated with DCX.

Doublecortex; lissencephaly, x-linked (doublecortin) (DCX, Accession NP_000546.2) is another GAM189 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM189 RNA, herein designated GAM RNA, also designated SEQ ID:246.

Another function of GAM189 is therefore inhibition of Doublecortex; lissencephaly, x-linked (doublecortin) (DCX, Accession NP_000546.2). Accordingly, utilities of GAM189 include diagnosis, prevention and treatment of diseases and clinical conditions associated with DCX.

Doublecortex; lissencephaly, x-linked (doublecortin) (DCX, Accession NP_835366.1) is another GAM189 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM189 RNA, herein designated GAM RNA, also designated SEQ ID:246.

Another function of GAM189 is therefore inhibition of Doublecortex; lissencephaly, x-linked (doublecortin) (DCX, Accession NP_835366.1). Accordingly, utilities of GAM189 include diagnosis, prevention and treatment of diseases and clinical conditions associated with DCX.

Desmin (DES, Accession NP_001918.2) is another GAM189 target gene, herein designated TARGET GENE. DES BINDING SITE is a target binding site found in the 3' untranslated region of mRNA encoded by DES, corresponding to a target binding site such as BINDING SITE I, BINDING SITE II or BINDING SITE III of FIG. 8. Table 4 illustrates the complementarity of the nucleotide sequences of DES BINDING SITE, designated SEQ ID:14498, to the nucleotide sequence of GAM189 RNA, herein designated GAM RNA, also designated SEQ ID:246.

Another function of GAM189 is therefore inhibition of Desmin (DES, Accession NP_001918.2). Accordingly, utilities of GAM189 include diagnosis, prevention and treatment of diseases and clinical conditions associated with DES.

Dna fragmentation factor, 40 kda, beta polypeptide (caspase-activated dnase) (DFFB, Accession NP_004393.1) is another GAM189 target gene, herein designated TARGET GENE. DFFB BINDING SITE1 and DFFB BINDING SITE2 are target binding sites found in untranslated regions of mRNA encoded by DFFB, corresponding to target binding sites such as BINDING SITE I, BINDING SITE II or BINDING SITE III of FIG. 8. Table 4 illustrates the complementarity of the nucleotide sequences of DFFB BINDING SITE1 and DFFB BINDING SITE2, designated SEQ ID:9091 and SEQ ID:2019 respectively, to the nucleotide sequence of GAM189 RNA, herein designated GAM RNA, also designated SEQ ID:246.

Another function of GAM189 is therefore inhibition of Dna fragmentation factor, 40 kda, beta polypeptide (caspase-activated dnase) (DFFB, Accession NP_004393.1), a gene which induces DNA fragmentation and chromatin condensation during apoptosis. Accordingly, utilities of GAM189 include diagnosis, prevention and treatment of diseases and clinical conditions associated with DFFB.

The function of DFFB and its association with various diseases and clinical conditions, has been established by previous studies, as described hereinabove with reference to GAM130.1. Dihydrofolate reductase (DHFR, Accession NP_000782.1) is another GAM189 target gene, herein designated TARGET GENE. DHFR BINDING SITE is a target binding site found in the 3' untranslated region of mRNA encoded by DHFR, corresponding to a target binding site such as BINDING SITE I, BINDING SITE II or BINDING SITE III of FIG. 8. Table 4 illustrates the complementarity of the nucleotide sequences of DHFR BINDING SITE, designated SEQ ID:8052, to the nucleotide sequence of GAM189 RNA, herein designated GAM RNA, also designated SEQ ID:246.

Another function of GAM189 is therefore inhibition of Dihydrofolate reductase (DHFR, Accession NP_000782.1), a gene which converts dihydrofolate into tetrahydrofolate. Accordingly, utilities of GAM189 include diagnosis, prevention and treatment of diseases and clinical conditions associated with DHFR.

The function of DHFR and its association with various diseases and clinical conditions, has been established by previous studies, as described hereinabove with reference to GAM64.1. Diaphanous homolog 2 (drosophila) (DIAPH2, Accession NP_006720.1) is another GAM189 target gene, herein designated TARGET GENE. DIAPH2 BINDING SITE is a target binding site found in the 3' untranslated region of multiple transcripts of mRNA encoded by DIAPH2, corresponding to a target binding site such as BINDING SITE I, BINDING SITE II or BINDING SITE III of FIG. 8. Table 4 illustrates the complementarity of the nucleotide sequences of DIAPH2 BINDING SITE, designated SEQ ID:14492, to the nucleotide sequence of GAM189 RNA, herein designated GAM RNA, also designated SEQ ID:246.

Another function of GAM189 is therefore inhibition of Diaphanous homolog 2 (drosophila) (DIAPH2, Accession NP_006720.1), a gene which may affect in oogenesis and therefore may be associated with Premature ovarian failure. Accordingly, utilities of GAM189 include diagnosis, prevention and treatment of Premature ovarian failure., and of other diseases and clinical conditions associated with DIAPH2.

The function of DIAPH2 and its association with various diseases and clinical conditions, has been established by previous studies, as described hereinabove with reference to GAM66.1. Disrupted in schizophrenia 1 (DISC1, Accession NP_061132.1) is another GAM189 target gene, herein designated TARGET GENE. DISC1 BINDING SITE is a target binding site found in the 3' untranslated region of mRNA encoded by DISC1, corresponding to a target binding site such as BINDING SITE I, BINDING SITE II or BINDING SITE III of FIG. 8. Table 4 illustrates the complementarity of the nucleotide sequences of DISC1 BINDING SITE, designated SEQ ID:1298, to the nucleotide sequence of GAM189 RNA, herein designated GAM RNA, also designated SEQ ID:246.

Another function of GAM189 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM189 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. DKFZP434B1727 (Accession NP_115519.1) is another GAM189 target gene, herein designated TARGET GENE. DKFZP434B1727 BINDING SITE is a target binding site found in the 3' untranslated region of mRNA encoded by DKFZP434B1727, corresponding to a target binding site such as BINDING SITE I, BINDING SITE II or BINDING SITE III of FIG. 8. Table 4 illustrates the complementarity of the nucleotide sequences of DKFZP434B1727 BINDING SITE, designated SEQ ID:4014, to the nucleotide sequence of GAM189 RNA, herein designated GAM RNA, also designated SEQ ID:246.

Another function of GAM189 is therefore inhibition of DKFZP434B1727 (Accession NP_115519.1). Accordingly, utilities of GAM189 include diagnosis, prevention and treatment of diseases and clinical conditions associated with DKFZP434B1727.

DKFZp434C0923 (Accession NP_060068.1) is another GAM189 target gene, herein designated TARGET GENE. DKFZp434C0923 BINDING SITE is a target binding site found in the 3' untranslated region of mRNA encoded by DKFZp434C0923, corresponding to a target binding site such as BINDING SITE I, BINDING SITE II or BINDING SITE III of FIG. 8. Table 4 illustrates the complementarity of the nucleotide sequences of DKFZp434C0923 BINDING SITE, designated SEQ ID:8235, to the nucleotide sequence of GAM189 RNA, herein designated GAM RNA, also designated SEQ ID:246.

Another function of GAM189 is therefore inhibition of DKFZp434C0923 (Accession NP_060068.1). Accordingly, utilities of GAM189 include diagnosis, prevention and treatment of diseases and clinical conditions associated with DKFzp434C0923.

DKFZP434C212 (Accession XP_044196.3) is another GAM189 target gene, herein designated TARGET GENE. DKFZP434C212 BINDING SITE is a target binding site found in the 3' untranslated region of mRNA encoded by DKFZP434C212, corresponding to a target binding site such as BINDING SITE I, BINDING SITE II or BINDING SITE III of FIG. 8. Table 4 illustrates the complementarity of the nucleotide sequences of DKFZP434C212 BINDING SITE, designated SEQ ID:8661, to the nucleotide sequence of GAM189 RNA, herein designated GAM RNA, also designated SEQ ID:246.

Another function of GAM189 is therefore inhibition of DKFZP434C212 (Accession XP_044196.3). Accordingly, utilities of GAM189 include diagnosis, prevention and treatment of diseases and clinical conditions associated with DKFZP434C212.

DKFZP434D146 (Accession NP_056410.2) is another GAM189 target gene, herein designated TARGET GENE. DKFZP434D146 BINDING SITE is a target binding site found in the 3' untranslated region of mRNA encoded by DKFZP434D146, corresponding to a target binding site such as BINDING SITE I, BINDING SITE II or BINDING SITE III of FIG. 8. Table 4 illustrates the complementarity of the nucleotide sequences of DKFZP434D146 BINDING SITE, designated SEQ ID:2209, to the nucleotide sequence of GAM189 RNA, herein designated GAM RNA, also designated SEQ ID:246.

Another function of GAM189 is therefore inhibition of DKFZP434D146 (Accession NP_056410.2). Accordingly, utilities of GAM189 include diagnosis, prevention and treatment of diseases and clinical conditions associated with DKFZP434D146.

DKFZp434E2220 (Accession NP_060082.1) is another GAM189 target gene, herein designated TARGET GENE. DKFZp434E2220 BINDING SITE is a target binding site found in the 5' untranslated region of mRNA encoded by DKFZp434E2220, corresponding to a target binding site such as BINDING SITE I, BINDING SITE II or BINDING SITE III of FIG. 8. Table 4 illustrates the complementarity of the nucleotide sequences of DKFZp434E2220 BINDING SITE, designated SEQ ID:11326, to the nucleotide sequence of GAM189 RNA, herein designated GAM RNA, also designated SEQ ID:246.

Another function of GAM189 is therefore inhibition of DKFZp434E2220 (Accession NP_060082.1). Accordingly, utilities of GAM189 include diagnosis, prevention and treatment of diseases and clinical conditions associated with DKFZp434E2220.

DKFZP434F0318 (Accession NP_110444.1) is another GAM189 target gene, herein designated TARGET GENE. DKFZP434F0318 BINDING SITE is a target binding site found in the 3' untranslated region of mRNA encoded by DKFZP434F0318, corresponding to a target binding site such as BINDING SITE I, BINDING SITE II or BINDING SITE III of FIG. 8. Table 4 illustrates the complementarity of the nucleotide sequences of DKFZP434F0318 BINDING SITE, designated SEQ ID:16771, to the nucleotide sequence of GAM189 RNA, herein designated GAM RNA, also designated SEQ ID:246.

Another function of GAM189 is therefore inhibition of DKFZP434F0318 (Accession NP_110444.1). Accordingly, utilities of GAM189 include diagnosis, prevention and treatment of diseases and clinical conditions associated with DKFZP434F0318.

DKFZp434F1719 (Accession NP_115624.1) is another GAM189 target gene, herein designated TARGET GENE. DKFZp434F1719 BINDING SITE is a target binding site found in the 3' untranslated region of mRNA encoded by DKFZp434F1719, corresponding to a target binding site such as BINDING SITE I, BINDING SITE II or BINDING SITE III of FIG. 8. Table 4 illustrates the complementarity of the nucleotide sequences of DKFZp434F1719 BINDING SITE, designated SEQ ID:3951, to the nucleotide sequence of GAM189 RNA, herein designated GAM RNA, also designated SEQ ID:246.

Another function of GAM189 is therefore inhibition of DKFZp434F1719 (Accession NP_115624.1). Accordingly, utilities of GAM189 include diagnosis, prevention and treatment of diseases and clinical conditions associated with DKFZp434F1719.

DKFZp434K1210 (Accession NP_060076.1) is another GAM189 target gene, herein designated TARGET GENE. DKFZp434K1210 BINDING SITE is a target binding site found in the 3' untranslated region of mRNA encoded by DKFZp434K1210, corresponding to a target binding site such as BINDING SITE I, BINDING SITE II or BINDING SITE III of FIG. 8. Table 4 illustrates the complementarity of the nucleotide sequences of DKFZp434K1210 BINDING SITE, designated SEQ ID:4195, to the nucleotide sequence of GAM189 RNA, herein designated GAM RNA, also designated SEQ ID:246.

Another function of GAM189 is therefore inhibition of DKFZp434K1210 (Accession NP_060076.1). Accordingly, utilities of GAM189 include diagnosis, prevention and treatment of diseases and clinical conditions associated with DKFZp434K1210.

DKFZp547H025 (Accession NP_064546.1) is another GAM189 target gene, herein designated TARGET GENE. DKFZp547H025 BINDING SITE is a target binding site found in the 3' untranslated region of mRNA encoded by DKFZp547H025, corresponding to a target binding site such as BINDING SITE I, BINDING SITE II or BINDING SITE III of FIG. 8. Table 4 illustrates the complementarity of the nucleotide sequences of DKFZp547H025 BINDING SITE, designated SEQ ID:14246, to the nucleotide sequence of GAM189 RNA, herein designated GAM RNA, also designated SEQ ID:246.

Another function of GAM189 is therefore inhibition of DKFZp547H025 (Accession NP_064546.1). Accordingly, utilities of GAM189 include diagnosis, prevention and treatment of diseases and clinical conditions associated with DKFZp547H025.

DKFZp547P234 (Accession NP_694590.1) is another GAM189 target gene, herein designated TARGET GENE. DKFZp547P234 BINDING SITE is a target binding site found in the 3' untranslated region of mRNA encoded by DKFZp547P234, corresponding to a target binding site such as BINDING SITE I, BINDING SITE II or BINDING SITE III of FIG. 8. Table 4 illustrates the complementarity of the nucleotide sequences of DKFZp547P234 BINDING SITE, designated SEQ ID:11057, to the nucleotide sequence of GAM189 RNA, herein designated GAM RNA, also designated SEQ ID:246.

Another function of GAM189 is therefore inhibition of DKFZp547P234 (Accession NP_694590.1). Accordingly, utilities of GAM189 include diagnosis, prevention and treatment of diseases and clinical conditions associated with DKFZp547P234.

DKFZP564G092 (Accession NP_056416.1) is another GAM189 target gene, herein designated TARGET GENE. DKFZP564G092 BINDING SITE is a target binding site found in the 5' untranslated region of mRNA encoded by DKFZP564G092, corresponding to a target binding site such as BINDING SITE I, BINDING SITE II or BINDING SITE III of FIG. 8. Table 4 illustrates the complementarity of the nucleotide sequences of DKFZP564G092 BINDING SITE, designated SEQ ID:2662, to the nucleotide sequence of GAM189 RNA, herein designated GAM RNA, also designated SEQ ID:246.

Another function of GAM189 is therefore inhibition of DKFZP564G092 (Accession NP_056416.1). Accordingly, utilities of GAM189 include diagnosis, prevention and treatment of diseases and clinical conditions associated with DKFZP564G092.

DKFZP564I122 (Accession XP_032397.1) is another GAM189 target gene, herein designated TARGET GENE. DKFZP564I122 BINDING SITE is a target binding site found in the 3' untranslated region of mRNA encoded by DKFZP564I122, corresponding to a target binding site such as BINDING SITE I, BINDING SITE II or BINDING SITE III of FIG. 8. Table 4 illustrates the complementarity of the nucleotide sequences of DKFZP564I122 BINDING SITE, designated SEQ ID:16590, to the nucleotide sequence of GAM189 RNA, herein designated GAM RNA, also designated SEQ ID:246.

Another function of GAM189 is therefore inhibition of DKFZP564I122 (Accession XP_032397.1). Accordingly, utilities of GAM189 include diagnosis, prevention and treatment of diseases and clinical conditions associated with DKFZP564I122.

DKFZP564K0322 (Accession NP_114429.1) is another GAM189 target gene, herein designated TARGET GENE. DKFZP564K0322 BINDING SITE is a target binding site found in the 3' untranslated region of mRNA encoded by DKFZP564K0322, corresponding to a target binding site such as BINDING SITE I, BINDING SITE II or BINDING SITE III of FIG. 8. Table 4 illustrates the complementarity of the nucleotide sequences of DKFZP564K0322 BINDING SITE, designated SEQ ID:17964, to the nucleotide sequence of GAM189 RNA, herein designated GAM RNA, also designated SEQ ID:246.

Another function of GAM189 is therefore inhibition of DKFZP564K0322 (Accession NP_114429.1). Accordingly, utilities of GAM189 include diagnosis, prevention and treatment of diseases and clinical conditions associated with DKFZP564K0322.

DKFZp564K142 (Accession NP_115497.2) is another GAM189 target gene, herein designated TARGET GENE. DKFZp564K142 BINDING SITE is a target binding site found in the 3' untranslated region of mRNA encoded by DKFZp564K142, corresponding to a target binding site such as BINDING SITE I, BINDING SITE II or BINDING SITE III of FIG. 8. Table 4 illustrates the complementarity of the nucleotide sequences of DKFZp564K142 BINDING SITE, designated SEQ ID:2663, to the nucleotide sequence of GAM189 RNA, herein designated GAM RNA, also designated SEQ ID:246.

Another function of GAM189 is therefore inhibition of DKFZp564K142 (Accession NP_115497.2). Accordingly, utilities of GAM189 include diagnosis, prevention and treatment of diseases and clinical conditions associated with DKFZp564K142.

DKFZP564O0523 (Accession NP_115496.1) is another GAM189 target gene, herein designated TARGET GENE. DKFZP564O0523 BINDING SITE is a target binding site found in the 3' untranslated region of mRNA encoded by DKFZP564O0523, corresponding to a target binding site such as BINDING SITE I, BINDING SITE II or BINDING SITE III of FIG. 8. Table 4 illustrates the complementarity of the nucleotide sequences of DKFZP564O0523 BINDING SITE, designated SEQ ID:3686, to the nucleotide sequence of GAM189 RNA, herein designated GAM RNA, also designated SEQ ID:246.

Another function of GAM189 is therefore inhibition of DKFZP564O0523 (Accession NP_115496.1). Accordingly, utilities of GAM189 include diagnosis, prevention and treatment of diseases and clinical conditions associated with DKFZP564O0523.

DKFZP566D1346 (Accession NP_110443.1) is another GAM189 target gene, herein designated TARGET GENE. DKFZP566D1346 BINDING SITE is a target binding site found in the 5' untranslated region of mRNA encoded by DKFZP566D1346, corresponding to a target binding site such as BINDING SITE I, BINDING SITE II or BINDING SITE III of FIG. 8. Table 4 illustrates the complementarity of the nucleotide sequences of DKFZP566D1346 BINDING SITE, designated SEQ ID:10539, to the nucleotide sequence of GAM189 RNA, herein designated GAM RNA, also designated SEQ ID:246.

Another function of GAM189 is therefore inhibition of DKFZP566D1346 (Accession NP_110443.1). Accordingly, utilities of GAM189 include diagnosis, prevention and treatment of diseases and clinical conditions associated with DKFZP566D1346.

DKFZP566I1024 (Accession NP_056226.1) is another GAM189 target gene, herein designated TARGET GENE. DKFZP566I1024 BINDING SITE is a target binding site found in the 3' untranslated region of mRNA encoded by DKFZP566I1024, corresponding to a target binding site such as BINDING SITE I, BINDING SITE II or BINDING SITE III of FIG. 8. Table 4 illustrates the complementarity of the nucleotide sequences of DKFZP566I1024 BINDING SITE, designated SEQ ID:12353, to the nucleotide sequence of GAM189 RNA, herein designated GAM RNA, also designated SEQ ID:246.

Another function of GAM189 is therefore inhibition of DKFZP566I1024 (Accession NP_056226.1). Accordingly, utilities of GAM189 include diagnosis, prevention and treatment of diseases and clinical conditions associated with DKFZP566I1024.

DKFZp586C0721 (Accession XP_098416.1) is another GAM189 target gene, herein designated TARGET GENE. DKFZp586C0721 BINDING SITE is a target binding site found in the 3' untranslated region of mRNA encoded by DKFZp586C0721, corresponding to a target binding site such as BINDING SITE I, BINDING SITE II or BINDING SITE III of FIG. 8. Table 4 illustrates the complementarity of the nucleotide sequences of DKFZp586C0721 BINDING SITE, designated SEQ ID:12173, to the nucleotide sequence of GAM189 RNA, herein designated GAM RNA, also designated SEQ ID:246.

Another function of GAM189 is therefore inhibition of DKFZp586C0721 (Accession XP_098416.1). Accordingly, utilities of GAM189 include diagnosis, prevention and treatment of diseases and clinical conditions associated with DKFZp586C0721.

DKFZP586D0919 (Accession NP_056248.1) is another GAM189 target gene, herein designated TARGET GENE. DKFZP586D0919 BINDING SITE is a target binding site found in the 3' untranslated region of mRNA encoded by DKFZP586D0919, corresponding to a target binding site such as BINDING SITE I, BINDING SITE II or BINDING SITE III of FIG. 8. Table 4 illustrates the complementarity of the nucleotide sequences of DKFZP586D0919 BINDING SITE, designated SEQ ID:11134, to the nucleotide sequence of GAM189 RNA, herein designated GAM RNA, also designated SEQ ID:246.

Another function of GAM189 is therefore inhibition of DKFZP586D0919 (Accession NP_056248.1). Accordingly, utilities of GAM189 include diagnosis, prevention and treatment of diseases and clinical conditions associated with DKFZP586D0919.

DKFZp667B1218 (Accession NP_808881.1) is another GAM189 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:15574, to the nucleotide sequence of GAM189 RNA, herein designated GAM RNA, also designated SEQ ID:246.

Another function of GAM189 is therefore inhibition of DKFZp667B1218 (Accession NP_808881.1). Accordingly, utilities of GAM189 include diagnosis, prevention and treatment of diseases and clinical conditions associated with DKFZp667B1218.

DKFZp667E0512 (Accession XP_117353.1) is another GAM189 target gene, herein designated TARGET GENE. DKFZp667E0512 BINDING SITE is a target binding site found in the 3' untranslated region of mRNA encoded by DKFZp667E0512, corresponding to a target binding site such as BINDING SITE I, BINDING SITE II or BINDING SITE III of FIG. 8. Table 4 illustrates the complementarity of the nucleotide sequences of DKFZp667E0512 BINDING SITE, designated SEQ ID:8492, to the nucleotide sequence of GAM189 RNA, herein designated GAM RNA, also designated SEQ ID:246.

Another function of GAM189 is therefore inhibition of DKFZp667E0512 (Accession XP_117353.1). Accordingly, utilities of GAM189 include diagnosis, prevention and treatment of diseases and clinical conditions associated with DKFZp667E0512.

DKFZp761B107 (Accession NP_775734.1) is another GAM189 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:13571, to the nucleotide sequence of GAM189 RNA, herein designated GAM RNA, also designated SEQ ID:246.

Another function of GAM189 is therefore inhibition of DKFZp761B107 (Accession NP_775734.1). Accordingly, utilities of GAM189 include diagnosis, prevention and treatment of diseases and clinical conditions associated with DKFZp761B107.

DKFZp761B128 (Accession NP_689650.1) is another GAM189 target gene, herein designated TARGET GENE. DKFZp761B128 BINDING SITE is a target binding site found in the 5' untranslated region of mRNA encoded by DKFZp761B128, corresponding to a target binding site such as BINDING SITE I, BINDING SITE II or BINDING SITE III of FIG. 8. Table 4 illustrates the complementarity of the nucleotide sequences of DKFZp761B128 BINDING SITE, designated SEQ ID:17969, to the nucleotide sequence of GAM189 RNA, herein designated GAM RNA, also designated SEQ ID:246.

Another function of GAM189 is therefore inhibition of DKFZp761B128 (Accession NP_689650.1). Accordingly, utilities of GAM189 include diagnosis, prevention and treatment of diseases and clinical conditions associated with DKFZp761B128.

DKFZp761G2113 (Accession XP_046017.3) is another GAM189 target gene, herein designated TARGET GENE. DKFZp761G2113 BINDING SITE is a target binding site found in the 3' untranslated region of mRNA encoded by DKFZp761G2113, corresponding to a target binding site such as BINDING SITE I, BINDING SITE II or BINDING SITE III of FIG. 8. Table 4 illustrates the complementarity of the nucleotide sequences of DKFZp761G2113 BINDING SITE, designated SEQ ID:7769, to the nucleotide sequence of GAM189 RNA, herein designated GAM RNA, also designated SEQ ID:246.

Another function of GAM189 is therefore inhibition of DKFZp761G2113 (Accession XP_046017.3). Accordingly, utilities of GAM189 include diagnosis, prevention and treatment of diseases and clinical conditions associated with DKFZp761G2113.

DKFZp761H039 (Accession NP_061181.1) is another GAM189 target gene, herein designated TARGET GENE. DKFZp761H039 BINDING SITE is a target binding site found in the 3' untranslated region of mRNA encoded by DKFZp761H039, corresponding to a target binding site such as BINDING SITE I, BINDING SITE II or BINDING SITE III of FIG. 8. Table 4 illustrates the complementarity of the nucleotide sequences of DKFZp761H039 BINDING SITE, designated SEQ ID:15190, to the nucleotide sequence of GAM189 RNA, herein designated GAM RNA, also designated SEQ ID:246.

Another function of GAM189 is therefore inhibition of DKFZp761H039 (Accession NP_061181.1). Accordingly, utilities of GAM189 include diagnosis, prevention and treatment of diseases and clinical conditions associated with DKFZp761H039.

DKFZp761J139 (Accession NP_115656.1) is another GAM189 target gene, herein designated TARGET GENE. DKFZp761J139 BINDING SITE is a target binding site found in the 5' untranslated region of mRNA encoded by DKFZp761J139, corresponding to a target binding site such as BINDING SITE I, BINDING SITE II or BINDING SITE III of FIG. 8. Table 4 illustrates the complementarity of the nucleotide sequences of DKFZp761J139 BINDING SITE, designated SEQ ID:5768, to the nucleotide sequence of GAM189 RNA, herein designated GAM RNA, also designated SEQ ID:246.

Another function of GAM189 is therefore inhibition of DKFZp761J139 (Accession NP_115656.1). Accordingly, utilities of GAM189 include diagnosis, prevention and treatment of diseases and clinical conditions associated with DKFZp761J139.

DKFZp761K1423 (Accession NP_060892.1) is another GAM189 target gene, herein designated TARGET GENE. DKFZp761K1423 BINDING SITE is a target binding site found in the 5' untranslated region of mRNA encoded by DKFZp761K1423, corresponding to a target binding site such as BINDING SITE I, BINDING SITE II or BINDING SITE III of FIG. 8. Table 4 illustrates the complementarity of the nucleotide sequences of DKFZp761K1423 BINDING SITE, designated SEQ ID:1317, to the nucleotide sequence of GAM189 RNA, herein designated GAM RNA, also designated SEQ ID:246.

Another function of GAM189 is therefore inhibition of DKFZp761K1423 (Accession NP_060892.1). Accordingly, utilities of GAM189 include diagnosis, prevention and treatment of diseases and clinical conditions associated with DKFZp761K1423.

DKFZp761N1114 (Accession XP_086327.6) is another GAM189 target gene, herein designated TARGET GENE. DKFZp761N1114 BINDING SITE is a target binding site found in the 3' untranslated region of mRNA encoded by DKFZp761N1114, corresponding to a target binding site such as BINDING SITE I, BINDING SITE II or BINDING SITE III of FIG. 8. Table 4 illustrates the complementarity of the nucleotide sequences of DKFZp761N1114 BINDING SITE, designated SEQ ID:13529, to the nucleotide sequence of GAM189 RNA, herein designated GAM RNA, also designated SEQ ID:246.

Another function of GAM189 is therefore inhibition of DKFZp761N1114 (Accession XP_086327.6). Accordingly, utilities of GAM189 include diagnosis, prevention and treatment of diseases and clinical conditions associated with DKFZp761N1114.

DKFZp761O0113 (Accession NP_060879.1) is another GAM189 target gene, herein designated TARGET GENE. DKFZp761O0113 BINDING SITE is a target binding site found in the 5' untranslated region of mRNA encoded by DKFZp761O0113, corresponding to a target binding site such as BINDING SITE I, BINDING SITE II or BINDING SITE III of FIG. 8. Table 4 illustrates the complementarity of the nucleotide sequences of DKFZp761O0113 BINDING SITE, designated SEQ ID:7699, to the nucleotide sequence of GAM189 RNA, herein designated GAM RNA, also designated SEQ ID:246.

Another function of GAM189 is therefore inhibition of DKFZp761O0113 (Accession NP_060879.1). Accordingly, utilities of GAM189 include diagnosis, prevention and treatment of diseases and clinical conditions associated with DKFZp761O0113.

DKFZp761P1121 (Accession NP_690870.1) is another GAM189 target gene, herein designated TARGET GENE. DKFZp761P1121 BINDING SITE is a target binding site found in the 3' untranslated region of mRNA encoded by DKFZp761P1121, corresponding to a target binding site such as BINDING SITE I, BINDING SITE II or BINDING SITE III of FIG. 8. Table 4 illustrates the complementarity of the nucleotide sequences of DKFZp761P1121 BINDING SITE, designated SEQ ID:9147, to the nucleotide sequence of GAM189 RNA, herein designated GAM RNA, also designated SEQ ID:246.

Another function of GAM189 is therefore inhibition of DKFZp761P1121 (Accession NP_690870.1). Accordingly, utilities of GAM189 include diagnosis, prevention and treatment of diseases and clinical conditions associated with DKFZp761P1121.

DKFZp762C2414 (Accession NP_848637.1) is another GAM189 target gene, herein designated TARGET GENE. DKFZp762C2414 BINDING SITE is a target binding site found in the 3' untranslated region of mRNA encoded by DKFZp762C2414, corresponding to a target binding site such as BINDING SITE I, BINDING SITE II or BINDING SITE III of FIG. 8. Table 4 illustrates the complementarity of the nucleotide sequences of DKFZp762C2414 BINDING SITE, designated SEQ ID:4056, to the nucleotide sequence of GAM189 RNA, herein designated GAM RNA, also designated SEQ ID:246.

Another function of GAM189 is therefore inhibition of DKFZp762C2414 (Accession NP_848637.1). Accordingly, utilities of GAM189 include diagnosis, prevention and treatment of diseases and clinical conditions associated with DKFZp762C2414.

DKFZp762I137 (Accession NP_689624.1) is another GAM189 target gene, herein designated TARGET GENE. DKFZp762I137 BINDING SITE is a target binding site found in the 3' untranslated region of mRNA encoded by DKFZp762I137, corresponding to a target binding site such as BINDING SITE I, BINDING SITE II or BINDING SITE III of FIG. 8. Table 4 illustrates the complementarity of the nucleotide sequences of DKFZp762I137 BINDING SITE, designated SEQ ID:1744, to the nucleotide sequence of GAM189 RNA, herein designated GAM RNA, also designated SEQ ID:246.

Another function of GAM189 is therefore inhibition of DKFZp762I137 (Accession NP_689624.1). Accordingly, utilities of GAM189 include diagnosis, prevention and treatment of diseases and clinical conditions associated with DKFZp762I137.

DKFZp762I194 (Accession NP_689597.1) is another GAM189 target gene, herein designated TARGET GENE. DKFZp762I194 BINDING SITE is a target binding site found in the 3' untranslated region of mRNA encoded by DKFZp762I194, corresponding to a target binding site such as BINDING SITE I, BINDING SITE II or BINDING SITE III of FIG. 8. Table 4 illustrates the complementarity of the nucleotide sequences of DKFZp762I194 BINDING SITE, designated SEQ ID:6884, to the nucleotide sequence of GAM189 RNA, herein designated GAM RNA, also designated SEQ ID:246.

Another function of GAM189 is therefore inhibition of DKFZp762I194 (Accession NP_689597.1). Accordingly, utilities of GAM189 include diagnosis, prevention and treatment of diseases and clinical conditions associated with DKFZp762I194.

DKFZp762L0311 (Accession NP_061189.2) is another GAM189 target gene, herein designated TARGET GENE. DKFZp762L0311 BINDING SITE is a target binding site found in the 3' untranslated region of mRNA encoded by DKFZp762L0311, corresponding to a target binding site such as BINDING SITE I, BINDING SITE II or BINDING SITE III of FIG. 8. Table 4 illustrates the complementarity of the nucleotide sequences of DKFZp762L0311 BINDING SITE, designated SEQ ID:9194, to the nucleotide sequence of GAM189 RNA, herein designated GAM RNA, also designated SEQ ID:246.

Another function of GAM189 is therefore inhibition of DKFZp762L0311 (Accession NP_061189.2). Accordingly, utilities of GAM189 include diagnosis, prevention and treatment of diseases and clinical conditions associated with DKFZp762L0311.

Dickkopf homolog 3 (xenopus laevis) (DKK3, Accession NP_037385.1) is another GAM189 target gene, herein designated TARGET GENE. DKK3 BINDING SITE is a target binding site found in the 3' untranslated region of multiple transcripts of mRNA encoded by DKK3, corresponding to a target binding site such as BINDING SITE I, BINDING SITE II or BINDING SITE III of FIG. 8. Table 4 illustrates the complementarity of the nucleotide sequences of DKK3 BINDING SITE, designated SEQ ID:20069, to the nucleotide sequence of GAM189 RNA, herein designated GAM RNA, also designated SEQ ID:246.

Another function of GAM189 is therefore inhibition of Dickkopf homolog 3 (xenopus laevis) (DKK3, Accession NP_037385.1). Accordingly, utilities of GAM189 include diagnosis, prevention and treatment of diseases and clinical conditions associated with DKK3.

Dickkopf homolog 3 (xenopus laevis) (DKK3, Accession NP_056965.2) is another GAM189 target gene, herein designated TARGET GENE. DKK3 BINDING SITE is a target binding site found in the 3' untranslated region of multiple transcripts of mRNA encoded by DKK3, corresponding to a target binding site such as BINDING SITE I, BINDING SITE II or BINDING SITE III of FIG. 8. Table 4 illustrates the complementarity of the nucleotide sequences of DKK3 BINDING SITE, designated SEQ ID:20069, to the nucleotide sequence of GAM189 RNA, herein designated GAM RNA, also designated SEQ ID:246.

Another function of GAM189 is therefore inhibition of Dickkopf homolog 3 (xenopus laevis) (DKK3, Accession NP_056965.2). Accordingly, utilities of GAM189 include diagnosis, prevention and treatment of diseases and clinical conditions associated with DKK3.

Dynein, axonemal, heavy polypeptide 11 (DNAH11, Accession NP_003768.1) is another GAM189 target gene, herein designated TARGET GENE. DNAH11 BINDING SITE is a target binding site found in the 3' untranslated region of mRNA encoded by DNAH11, corresponding to a target binding site such as BINDING SITE I, BINDING SITE II or BINDING SITE III of FIG. 8. Table 4 illustrates the complementarity of the nucleotide sequences of DNAH11 BINDING SITE, designated SEQ ID:1214, to the nucleotide sequence of GAM189 RNA, herein designated GAM RNA, also designated SEQ ID:246.

Another function of GAM189 is therefore inhibition of Dynein, axonemal, heavy polypeptide 11 (DNAH11, Accession NP_003768.1), a gene which may function as a motor protein. Accordingly, utilities of GAM189 include diagnosis, prevention and treatment of diseases and clinical conditions associated with DNAH11.

The function of DNAH11 has been established by previous studies. Inversus viscerum (iv/iv) mice exhibit randomized left-right patterning; half of iv/iv homozygotes develop situs inversus (Okada et al., 1999; Supp et al., 1999). To examine how flow affects left-right patterning, Nonaka et al. (2002) developed a system in which mouse embryos are cultured under an artificial fluid flow. This artificial flow was able to direct the situs of mutant mouse embryos with immotile cilia. Nonaka et al. (2002) concluded that their results provided the first evidence for the role of mechanical fluid flow in left-right patterning.

Animal model experiments lend further support to the function of DNAH11. Inversus viscerum (iv/iv) mice exhibit randomized left-right patterning; half of iv/iv homozygotes develop situs inversus (Okada et al., 1999; Supp et al., 1999). To examine how flow affects left-right patterning, Nonaka et al. (2002) developed a system in which mouse embryos are cultured under an artificial fluid flow. This artificial flow was able to direct the situs of mutant mouse embryos with immotile cilia. Nonaka et al. (2002) concluded that their results provided the first evidence for the role of mechanical fluid flow in left-right patterning.

It is appreciated that the abovementioned animal model for DNAH11 is acknowledged by those skilled in the art as a scientifically valid animal model, as can be further appreciated from the publications sited hereinbelow.

Full details of the abovementioned studies are described in the following publications, the disclosure of which are hereby incorporated by reference:

McGrath, J.; Horwich, A. L.; Brueckner, M.: Duplication/deficiency mapping of situs inversus viscerum (iv), a gene that determines left-right asymmetry in the mouse. Genomics 14:643-648, 1992; and Nonaka, S.; Shiratori, H.; Saijoh, Y.; Hamada, H.: Determination of left-right patterning of the mouse embryo by artificial nodal flow. Nature 418:96- 99, 2002.

Further studies establishing the function and utilities of DNAH11 are found in John Hopkins OMIM database record ID 603339, and in cited publications listed in Table 5, which are hereby incorporated by reference. Dnaj (hsp40) homolog, subfamily b, member 5 (DNAJB5, Accession NP_036398.2) is another GAM189 target gene, herein designated TARGET GENE. DNAJB5 BINDING SITE is a target binding site found in the 3' untranslated region of mRNA encoded by DNAJB5, corresponding to a target binding site such as BINDING SITE I, BINDING SITE II or BINDING SITE III of FIG. 8. Table 4 illustrates the complementarity of the nucleotide sequences of DNAJB5 BINDING SITE, designated SEQ ID:5815, to the nucleotide sequence of GAM189 RNA, herein designated GAM RNA, also designated SEQ ID:246.

Another function of GAM189 is therefore inhibition of Dnaj (hsp40) homolog, subfamily b, member 5 (DNAJB5, Accession NP_036398.2). Accordingly, utilities of GAM189 include diagnosis, prevention and treatment of diseases and clinical conditions associated with DNAJB5.

DRIM (Accession NP_055318.1) is another GAM189 target gene, herein designated TARGET GENE. DRIM BINDING SITE is a target binding site found in the 3' untranslated region of mRNA encoded by DRIM, corresponding to a target binding site such as BINDING SITE I, BINDING SITE II or BINDING SITE III of FIG. 8. Table 4 illustrates the complementarity of the nucleotide sequences of DRIM BINDING SITE, designated SEQ ID:6633, to the nucleotide sequence of GAM189 RNA, herein designated GAM RNA, also designated SEQ ID:246.

Another function of GAM189 is therefore inhibition of DRIM (Accession NP_055318.1). Accordingly, utilities of GAM189 include diagnosis, prevention and treatment of diseases and clinical conditions associated with DRIM.

Dentatorubral-pallidoluysian atrophy (atrophin-1) (DRPLA, Accession NP_001931.1) is another GAM189 target gene, herein designated TARGET GENE. DRPLA BINDING SITE is a target binding site found in the 5' untranslated region of mRNA encoded by DRPLA, corresponding to a target binding site such as BINDING SITE I, BINDING SITE II or BINDING SITE III of FIG. 8. Table 4 illustrates the complementarity of the nucleotide sequences of DRPLA BINDING SITE, designated SEQ ID:9796, to the nucleotide sequence of GAM189 RNA, herein designated GAM RNA, also designated SEQ ID:246.

Another function of GAM189 is therefore inhibition of Dentatorubral-pallidoluysian atrophy (atrophin-1) (DRPLA, Accession NP_001931.1). Accordingly, utilities of GAM189 include diagnosis, prevention and treatment of diseases and clinical conditions associated with DRPLA.

Desmocollin 3 (DSC3, Accession NP_001932.1) is another GAM189 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:7559, to the nucleotide sequence of GAM189 RNA, herein designated GAM RNA, also designated SEQ ID:246.

Another function of GAM189 is therefore inhibition of Desmocollin 3 (DSC3, Accession NP_001932.1), a gene which is a component of intercellular desmosome junctions. Accordingly, utilities of GAM189 include diagnosis, prevention and treatment of diseases and clinical conditions associated with DSC3.

The function of DSC3 and its association with various diseases and clinical conditions, has been established by previous studies, as described hereinabove with reference to GAM30.1. Desmocollin 3 (DSC3, Accession NP_077741.1) is another GAM189 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:7559, to the nucleotide sequence of GAM189 RNA, herein designated GAM RNA, also designated SEQ ID:246.

Another function of GAM189 is therefore inhibition of Desmocollin 3 (DSC3, Accession NP_077741.1), a gene which is a component of intercellular desmosome junctions. Accordingly, utilities of GAM189 include diagnosis, prevention and treatment of diseases and clinical conditions associated with DSC3.

The function of DSC3 and its association with various diseases and clinical conditions, has been established by previous studies, as described hereinabove with reference to GAM30.1. Down syndrome critical region gene 6 (DSCR6, Accession NP_061835.1) is another GAM189 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:14954, to the nucleotide sequence of GAM189 RNA, herein designated GAM RNA, also designated SEQ ID:246.

Another function of GAM189 is therefore inhibition of Down syndrome critical region gene 6 (DSCR6, Accession NP_061835.1). Accordingly, utilities of GAM189 include diagnosis, prevention and treatment of diseases and clinical conditions associated with DSCR6.

Dual specificity phosphatase 19 (DUSP19, Accession NP_543152.1) is another GAM189 target gene, herein designated TARGET GENE. DUSP19 BINDING SITE1 and DUSP19 BINDING SITE2 are target binding sites found in untranslated regions of mRNA encoded by DUSP19, corresponding to target binding sites such as BINDING SITE I, BINDING SITE II or BINDING SITE III of FIG. 8. Table 4 illustrates the complementarity of the nucleotide sequences of DUSP19 BINDING SITE1 and DUSP19 BINDING SITE2, designated SEQ ID:5768 and SEQ ID:15367 respectively, to the nucleotide sequence of GAM189 RNA, herein designated GAM RNA, also designated SEQ ID:246.

Another function of GAM189 is therefore inhibition of Dual specificity phosphatase 19 (DUSP19, Accession NP_543152.1). Accordingly, utilities of GAM189 include diagnosis, prevention and treatment of diseases and clinical conditions associated with DUSP19.

Endometrial bleeding associated factor (left-right determination, factor a; transforming growth factor beta superfamily) (EBAF, Accession NP_003231.2) is another GAM189 target gene, herein designated TARGET GENE. EBAF BINDING SITE is a target binding site found in the 3' untranslated region of mRNA encoded by EBAF, corresponding to a target binding site such as BINDING SITE I, BINDING SITE II or BINDING SITE III of FIG. 8. Table 4 illustrates the complementarity of the nucleotide sequences of EBAF BINDING SITE, designated SEQ ID:18275, to the nucleotide sequence of GAM189 RNA, herein designated GAM RNA, also designated SEQ ID:246.

Another function of GAM189 is therefore inhibition of Endometrial bleeding associated factor (left-right determination, factor a; transforming growth factor beta superfamily) (EBAF, Accession NP_003231.2), a gene which LEFT-RIGHT AXIS MALFORMATIONS and therefore is associated with Left-right axis malformations. Accordingly, utilities of GAM189 include diagnosis, prevention and treatment of Left-right axis malformations, and of other diseases and clinical conditions associated with EBAF.

The function of EBAF has been established by previous studies. Because of the possibility that Lefty mutations may be associated with human L-R axis malformations, Kosaki et al. (1999) characterized 2 human homologs, LEFTY A and LEFTY B (OMIM Ref. No. 603037). PCR screening of a PAC genomic library identified a clone that contained both LEFTY A and LEFTY B genes. Restriction mapping showed that the genes are separated by approximately 50 kb and are oriented in tandem. The 2 genes were localized by FISH to 1q42, a region syntenic to the location to which the mouse Lefty genes have been mapped at 1H5 (Meno et al., 1997). Both LEFTY A and LEFTY B contain 4 exons which are spliced at identical positions, and both genes encode proteins with 366 amino acids. LEFTY A was found to be identical to EBAF, the cDNA previously identified by Kothapalli et al. (1997). The deduced amino acid sequences of LEFTY A and LEFTY B are more similar to each other than to Lefty-1 or Lefty-2 of the mouse. Analysis of 126 human cases of L-R axis malformation showed 1 nonsense and 1 missense mutation in the LEFTY A gene. Both mutations lay in the cysteine- knot region of the LEFTY A protein, and the phenotype of affected individuals was very similar to that typically seen in Lefty-1 -/- mice with L-R axis malformations. Because of the possibility that Lefty mutations may be associated with human L-R axis malformations, Kosaki et al. (1999) characterized 2 human homologs, LEFTY A and LEFTY B (OMIM Ref. No. 603037). PCR screening of a PAC genomic library identified a clone that contained both LEFTY A and LEFTY B genes. Restriction mapping showed that the genes are separated by approximately 50 kb and are oriented in tandem. The 2 genes were localized by FISH to 1q42, a region syntenic to the location to which the mouse Lefty genes have been mapped at 1H5 (Meno et al., 1997). Both LEFTY A and LEFTY B contain 4 exons which are spliced at identical positions, and both genes encode proteins with 366 amino acids. LEFTY A was found to be identical to EBAF, the cDNA previously identified by Kothapalli et al. (1997). The deduced amino acid sequences of LEFTY A and LEFTY B are more similar to each other than to Lefty-1 or Lefty- 2 of the mouse. Analysis of 126 human cases of L-R axis malformation showed 1 nonsense and 1 missense mutation in the LEFTY A gene. Both mutations lay in the cysteine-knot region of the LEFTY A protein, and the phenotype of affected individuals was very similar to that typically seen in Lefty-1 -/- mice with L-R axis malformations.

Animal model experiments lend further support to the function of EBAF. Lefty- 1, lefty-2, and nodal (OMIM Ref. No. 601265) are expressed on the left side of developing mouse embryos and are implicated in L-R determination. Meno et al. (1998) examined the role of lefty-1 by analyzing mutant mice lacking this gene. The lefty-1-deficient mice showed a variety of L-R positional defects in visceral organs. The most common feature of lefty-1 -/- mice was thoracic left isomerism (rather than right isomerism). The lack of lefty-1 resulted in bilateral expression of nodal, lefty-2, and Pitx2 (OMIM Ref. No. 601542), a homeo box gene normally expressed on the left side. These observations suggested that the role of lefty-1 is to restrict the expression of lefty-2 and nodal to the left side, and that lefty-2 or nodal encode a signal for 'leftness.'

It is appreciated that the abovementioned animal model for EBAF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kosaki, K.; Bassi, M. T.; Kosaki, R.; Lewin, M.; Belmont, J.; Schauer, G.; Casey, B.: Characterization and mutation analysis of human LEFTY A and LEFTY B, homologues of murine genes implicated in left-right axis development. Am. J. Hum. Genet. 64:712-721, 1999; and Meno, C.; Shimono, A.; Saijoh, Y.; Yashiro, K.; Mochida, K.; Ohishi, S.; Noji, S.; Kondoh, H.; Hamada, H.: Lefty-1 is required for left-right determination as a regulator of lefty-2 an.

Further studies establishing the function and utilities of EBAF are found in John Hopkins OMIM database record ID 601877, and in cited publications listed in Table 5, which are hereby incorporated by reference. Endothelial differentiation, sphingolipid g-protein-coupled receptor, 8 (EDG8, Accession NP_110387.1) is another GAM189 target gene, herein designated TARGET GENE. EDG8 BINDING SITE is a target binding site found in the 3' untranslated region of mRNA encoded by EDG8, corresponding to a target binding site such as BINDING SITE I, BINDING SITE II or BINDING SITE III of FIG. 8. Table 4 illustrates the complementarity of the nucleotide sequences of EDG8 BINDING SITE, designated SEQ ID:12263, to the nucleotide sequence of GAM189 RNA, herein designated GAM RNA, also designated SEQ ID:246.

Another function of GAM189 is therefore inhibition of Endothelial differentiation, sphingolipid g-protein-coupled receptor, 8 (EDG8, Accession NP_110387.1). Accordingly, utilities of GAM189 include diagnosis, prevention and treatment of diseases and clinical conditions associated with EDG8.

EEF2K (Accession NP_037434.1) is another GAM189 target gene, herein designated TARGET GENE. EEF2K BINDING SITE is a target binding site found in the 3' untranslated region of mRNA encoded by EEF2K, corresponding to a target binding site such as BINDING SITE I, BINDING SITE II or BINDING SITE III of FIG. 8. Table 4 illustrates the complementarity of the nucleotide sequences of EEF2K BINDING SITE, designated SEQ ID:2595, to the nucleotide sequence of GAM189 RNA, herein designated GAM RNA, also designated SEQ ID:246.

Another function of GAM189 is therefore inhibition of EEF2K (Accession NP_037434.1), a gene which phosphorylates serine or threonine on the eukaryotic elongation factor-2 and therefore may be associated with Systemic lupus erythematosus and cancer. Accordingly, utilities of GAM189 include diagnosis, prevention and treatment of Systemic lupus erythematosus and cancer, and of other diseases and clinical conditions associated with EEF2K.

The function of EEF2K has been established by previous studies. Using degenerate PCR primers based on worm and rabbit peptide sequences for Eef2k, followed by 5-prime and 3-prime RACE and RT-PCR on a glioma cell line, Ryazanov et al. (1997) obtained cDNAs encoding rodent and human EEF2K. The deduced 725-amino acid human protein is 90% identical to the rodent proteins. EEF2K lacks homology to other serine/threonine kinases or to other calmodulin-dependent kinases, apart from a glycine-rich loop that is part of the ATP-binding site. All EEF2K sequences contain a highly-conserved 200-residue catalytic domain. There is also a conserved C-terminal coiled-coil region. SDS-PAGE and functional analysis showed expression of a 100-kD protein whose activity was strictly calmodulin- dependent. Northern blot analysis revealed ubiquitous expression of a major 3.1-kb transcript and minor 6.1- and 2.5-kb transcripts. Expression was particularly abundant in heart and skeletal muscle, suggesting that EEF2 phosphorylation may be particularly important in muscle. Arora et al. (2002) found that a majority of patients with systemic lupus erythematosus (SLE; 152700) have high titer anti-EEF2K antibodies capable of immuno-precipitating functional enzyme.

Full details of the abovementioned studies are described in the following publications, the disclosure of which are hereby incorporated by reference:

Ryazanov, A. G.; Ward, M. D.; Mendola, C. E.; Pavur, K. S.; Dorovkov, M. V.; Wiedmann, M.; Erdjument-Bromage, H.; Tempst, P.; Parmer, T. G.; Prostko, C. R.; Germino, F. J.; Hait, W. N.: Identification of a new class of protein kinases represented by eukaryotic elongation factor-2 kinase. Proc. Nat. Acad. Sci. 94:4884-4889, 1997; and Arora, S.; Yang, J.-M.; Craft, J.; Hait, W.: Detection of anti-elongation factor 2 kinase (calmodulin-dependent protein kinase III) antibodies in patients with systemic lupus erythemato.

Further studies establishing the function and utilities of EEF2K are found in John Hopkins OMIM database record ID 606968, and in cited publications listed in Table 5, which are hereby incorporated by reference. Eh-domain containing 1 (EHD1, Accession NP_006786.2) is another GAM189 target gene, herein designated TARGET GENE. EHD1 BINDING SITE is a target binding site found in the 3' untranslated region of mRNA encoded by EHD1, corresponding to a target binding site such as BINDING SITE I, BINDING SITE II or BINDING SITE III of FIG. 8. Table 4 illustrates the complementarity of the nucleotide sequences of EHD1 BINDING SITE, designated SEQ ID:7065, to the nucleotide sequence of GAM189 RNA, herein designated GAM RNA, also designated SEQ ID:246.

Another function of GAM189 is therefore inhibition of Eh-domain containing 1 (EHD1, Accession NP_006786.2), a gene which may be involved in ligand-initiated endocytosis. Accordingly, utilities of GAM189 include diagnosis, prevention and treatment of diseases and clinical conditions associated with EHD1.

The function of EHD1 and its association with various diseases and clinical conditions, has been established by previous studies, as described hereinabove with reference to GAM65.1. Eh-domain containing 2 (EHD2, Accession NP_055416.2) is another GAM189 target gene, herein designated TARGET GENE. EHD2 BINDING SITE is a target binding site found in the 3' untranslated region of mRNA encoded by EHD2, corresponding to a target binding site such as BINDING SITE I, BINDING SITE II or BINDING SITE III of FIG. 8. Table 4 illustrates the complementarity of the nucleotide sequences of EHD2 BINDING SITE, designated SEQ ID:4837, to the nucleotide sequence of GAM189 RNA, herein designated GAM RNA, also designated SEQ ID:246.

Another function of GAM189 is therefore inhibition of Eh-domain containing 2 (EHD2, Accession NP_055416.2). Accordingly, utilities of GAM189 include diagnosis, prevention and treatment of diseases and clinical conditions associated with EHD2.

Eukaryotic translation initiation factor 2, subunit 3 gamma, 52 kda (EIF2S3, Accession NP_001406.1) is another GAM189 target gene, herein designated TARGET GENE.

EIF2S3 BINDING SITE is a target binding site found in the 3' untranslated region of mRNA encoded by EIF2S3, corresponding to a target binding site such as BINDING SITE I, BINDING SITE II or BINDING SITE III of FIG. 8. Table 4 illustrates the complementarity of the nucleotide sequences of EIF2S3 BINDING SITE, designated SEQ ID:1744, to the nucleotide sequence of GAM189 RNA, herein designated GAM RNA, also designated SEQ ID:246.

Another function of GAM189 is therefore inhibition of Eukaryotic translation initiation factor 2, subunit 3 gamma, 52 kda (EIF2S3, Accession NP_001406.1), a gene which functions in the early steps of protein synthesis. Accordingly, utilities of GAM189 include diagnosis, prevention and treatment of diseases and clinical conditions associated with EIF2S3.

The function of EIF2S3 has been established by previous studies. Translation initiation factor eIF-2 is a heterotrimeric GTP-binding protein involved in the recruitment of methionyl-tRNA(i) to the 40 S ribosomal subunit. Gasper et al. (1994) cloned a human cDNA encoding the largest subunit of eIF-2, EIF2G. The EIF2G cDNA encodes a 472-amino acid protein with a molecular mass of 51.8 kD and contains 3 consensus GTP-binding elements. Human EIF2G is highly related to the yeast homolog, GCD11, exhibiting 71% sequence identity and an additional 13% similarity. Genes controlling the functions of spermatogenesis, Spy, and expression of the male-specific minor transplantation antigen H-Y, Hya (OMIM Ref. No. 426000), map to a region of the short arm of the mouse Y chromosome, delta-Sxr(b), that lies between the zinc finger genes Zfy1 and Zfy2 (OMIM Ref. No. 490000) and is deleted in Sxr(b) mutant mice. These Sxr(b) mice arose from an original sex-reversed mutation, Sxr(a), that carries a duplication of most of the Y chromosome short arm translocated to the telomeric end of the pseudoautosomal region of the Y chromosome. Several genes were mapped to that interval of the mouse Y chromosome and each was found to have a homolog on the X chromosome. Four of them, Zfy1 and Zfy2 (OMIM Ref. No. 490000), Ube1y (OMIM Ref. No. 489000), and Dffry (OMIM Ref. No. 400005), are expressed specifically in the testis and their X homologs (Zfx, 314980; Ube1x, 314370; Dffrx, 300072) are not transcribed from the inactive X chromosome. A further 2, Smyc (OMIM Ref. No. 426000) and Uty (OMIM Ref. No. 400009), are ubiquitously expressed and their X homologs (Smcx, 314690; Utx, 300128) escape X inactivation. Ehrmann et al. (1998) identified another gene from this region of the mouse Y chromosome. It was found to encode the highly conserved eukaryotic translation initiation factor eIF-2-gamma. In the mouse this gene was found to be ubiquitously expressed, to have an X chromosome homolog that maps close to Dmd (OMIM Ref. No. 300377), and to escape X inactivation. The coding regions of the X and Y genes show 86% nucleotide identity and encode the putative products with 98% amino acid identity. Ehrmann et al. (1998) found that the human homolog is located on Xp21 and also escapes X inactivation. No evidence of a Y copy of this gene was found in humans, however. In both humans and mice, Ehrmann et al. (1998) identified autosomal retroposons of EIF2G in both humans and mice and an additional retroposon on the X chromosome in some mouse strains. Ark blot analysis of eutherian and metatherian genomic DNA indicated that X-Y homologs are present in all species tested except in simian primates and kangaroo and that retroposons are common to a wide range of mammals. ('Zoo blots' are Southern blots of genomic DNA from multiple species without regard to gender; 'ark blots' are Southern blots used to compare male and female from multiple species.)

Full details of the abovementioned studies are described in the following publications, the disclosure of which are hereby incorporated by reference:

Ehrmann, I. E.; Ellis, P. S.; Mazeyrat, S.; Duthie, S.; Brockdorff, N.; Mattei, M. G.; Gavin, M. A.; Affara, N. A.; Brown, G. M.; Simpson, E.; Mitchell, M. J.; Scott, D. M.: Characterization of genes encoding translation initiation factor eIF-2-gamma in mouse and human: sex chromosome localization, escape from X-inactivation and evolution. Hum. Molec. Genet. 7:1725-1737, 1998; and Gasper, N. J.; Kinzy, T. G.; Scherer, B. J.; Humbelin, M.; Hershey, J. W. B.; Merrick, W. C.: Translation initiation factor eIF-2: cloning and expression of the human cDNA encoding the.

Further studies establishing the function and utilities of EIF2S3 are found in John Hopkins OMIM database record ID 300161, and in cited publications listed in Table 5, which are hereby incorporated by reference. Eukaryotic translation initiation factor 5a2 (EIF5A2, Accession NP_065123.1) is another GAM189 target gene, herein designated TARGET GENE. EIF5A2 BINDING SITE is a target binding site found in the 3' untranslated region of mRNA encoded by EIF5A2, corresponding to a target binding site such as BINDING SITE I, BINDING SITE II or BINDING SITE III of FIG. 8. Table 4 illustrates the complementarity of the nucleotide sequences of EIF5A2 BINDING SITE, designated SEQ ID:8340, to the nucleotide sequence of GAM189 RNA, herein designated GAM RNA, also designated SEQ ID:246.

Another function of GAM189 is therefore inhibition of Eukaryotic translation initiation factor 5a2 (EIF5A2, Accession NP_065123.1). Accordingly, utilities of GAM189 include diagnosis, prevention and treatment of diseases and clinical conditions associated with EIF5A2.

ELP3 (Accession NP_060561.3) is another GAM189 target gene, herein designated TARGET GENE. ELP3 BINDING SITE is a target binding site found in the 3' untranslated region of mRNA encoded by ELP3, corresponding to a target binding site such as BINDING SITE I, BINDING SITE II or BINDING SITE III of FIG. 8. Table 4 illustrates the complementarity of the nucleotide sequences of ELP3 BINDING SITE, designated SEQ ID:14236, to the nucleotide sequence of GAM189 RNA, herein designated GAM RNA, also designated SEQ ID:246.

Another function of GAM189 is therefore inhibition of ELP3 (Accession NP_060561.3). Accordingly, utilities of GAM189 include diagnosis, prevention and treatment of diseases and clinical conditions associated with ELP3.

Egf-like module containing, mucin-like, hormone receptor-like sequence 2 (EMR2, Accession NP_690884.1) is another GAM189 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:13462 and SEQ ID:17743 respectively, to the nucleotide sequence of GAM189 RNA, herein designated GAM RNA, also designated SEQ ID:246.

Another function of GAM189 is therefore inhibition of Egf-like module containing, mucin-like, hormone receptor-like sequence 2 (EMR2, Accession NP_690884.1). Accordingly, utilities of GAM189 include diagnosis, prevention and treatment of diseases and clinical conditions associated with EMR2.

Egf-like module containing, mucin-like, hormone receptor-like sequence 2 (EMR2, Accession NP_690884.1) is another GAM189 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:17743 and SEQ ID:13462 respectively, to the nucleotide sequence of GAM189 RNA, herein designated GAM RNA, also designated SEQ ID:246.

Another function of GAM189 is therefore inhibition of Egf-like module containing, mucin-like, hormone receptor-like sequence 2 (EMR2, Accession NP_690884.1). Accordingly, utilities of GAM189 include diagnosis, prevention and treatment of diseases and clinical conditions associated with EMR2.

Egf-like module containing, mucin-like, hormone receptor-like sequence 2 (EMR2, Accession NP_690885.1) is another GAM189 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:17743 and SEQ ID:13462 respectively, to the nucleotide sequence of GAM189 RNA, herein designated GAM RNA, also designated SEQ ID:246.

Another function of GAM189 is therefore inhibition of Egf-like module containing, mucin-like, hormone receptor-like sequence 2 (EMR2, Accession NP_690885.1). Accordingly, utilities of GAM189 include diagnosis, prevention and treatment of diseases and clinical conditions associated with EMR2.

Egf-like module containing, mucin-like, hormone receptor-like sequence 2 (EMR2, Accession NP_690880.1) is another GAM189 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:13462 and SEQ ID:17743 respectively, to the nucleotide sequence of GAM189 RNA, herein designated GAM RNA, also designated SEQ ID:246.

Another function of GAM189 is therefore inhibition of Egf-like module containing, mucin-like, hormone receptor-like sequence 2 (EMR2, Accession NP_690880.1). Accordingly, utilities of GAM189 include diagnosis, prevention and treatment of diseases and clinical conditions associated with EMR2.

Egf-like module containing, mucin-like, hormone receptor-like sequence 2 (EMR2, Accession NP_690883.1) is another GAM189 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:17743 and SEQ ID:17743 respectively, to the nucleotide sequence of GAM189 RNA, herein designated GAM RNA, also designated SEQ ID:246.

Another function of GAM189 is therefore inhibition of Egf-like module containing, mucin-like, hormone receptor-like sequence 2 (EMR2, Accession NP_690883.1). Accordingly, utilities of GAM189 include diagnosis, prevention and treatment of diseases and clinical conditions associated with EMR2.

Egf-like module containing, mucin-like, hormone receptor-like sequence 2 (EMR2, Accession NP_690885.1) is another GAM189 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:13462 and SEQ ID:13462 respectively, to the nucleotide sequence of GAM189 RNA, herein designated GAM RNA, also designated SEQ ID:246.

Another function of GAM189 is therefore inhibition of Egf-like module containing, mucin-like, hormone receptor-like sequence 2 (EMR2, Accession NP_690885.1). Accordingly, utilities of GAM189 include diagnosis, prevention and treatment of diseases and clinical conditions associated with EMR2.

Egf-like module containing, mucin-like, hormone receptor-like sequence 2 (EMR2, Accession NP_038475.2) is another GAM189 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:17743 and SEQ ID:13462 respectively, to the nucleotide sequence of GAM189 RNA, herein designated GAM RNA, also designated SEQ ID:246.

Another function of GAM189 is therefore inhibition of Egf-like module containing, mucin-like, hormone receptor-like sequence 2 (EMR2, Accession NP_038475.2). Accordingly, utilities of GAM189 include diagnosis, prevention and treatment of diseases and clinical conditions associated with EMR2.

Endonuclease g-like 1 (ENDOGL1, Accession NP_005098.1) is another GAM189 target gene, herein designated TARGET GENE. ENDOGL1 BINDING SITE is a target binding site found in the 3' untranslated region of mRNA encoded by ENDOGL1, corresponding to a target binding site such as BINDING SITE I, BINDING SITE II or BINDING SITE III of FIG. 8. Table 4 illustrates the complementarity of the nucleotide sequences of ENDOGL1 BINDING SITE, designated SEQ ID:5031, to the nucleotide sequence of GAM189 RNA, herein designated GAM RNA, also designated SEQ ID:246.

Another function of GAM189 is therefore inhibition of Endonuclease g-like 1 (ENDOGL1, Accession NP_005098.1). Accordingly, utilities of GAM189 include diagnosis, prevention and treatment of diseases and clinical conditions associated with ENDOGL1.

Epha8 (EPHA8, Accession NP_065387.1) is another GAM189 target gene, herein designated TARGET GENE. EPHA8 BINDING SITE is a target binding site found in the 3' untranslated region of mRNA encoded by EPHA8, corresponding to a target binding site such as BINDING SITE I, BINDING SITE II or BINDING SITE III of FIG. 8. Table 4 illustrates the complementarity of the nucleotide sequences of EPHA8 BINDING SITE, designated SEQ ID:1229, to the nucleotide sequence of GAM189 RNA, herein designated GAM RNA, also designated SEQ ID:246.

Another function of GAM189 is therefore inhibition of Epha8 (EPHA8, Accession NP_065387.1), a gene which Eph-related receptor tyrosine kinase A8. Accordingly, utilities of GAM189 include diagnosis, prevention and treatment of diseases and clinical conditions associated with EPHA8.

The function of EPHA8 has been established by previous studies. See EPH (EPHA1; 179610) for background on Eph receptors and their ligands, the ephrins. Chan and Watt (1991) identified human and rat DNAs encoding 2 novel members of the EPH subclass of putative receptor protein-tyrosine kinases. Rat cDNA clones encoding EEK (EPH- and ELK-related kinase) were isolated from a brain cDNA library probed with DNA encoding the kinase region of the insulin receptor-related receptor (INSRR; 147671). The EEK protein was predicted to contain all the amino acid residues conserved in the catalytic domains of protein-tyrosine kinases and was most similar to 2 putative receptor protein-tyrosine kinases of the EPH subclass, ELK (EPHB1; 600600) and EPH, showing 69 and 57% identity, respectively. Human genomic DNAs, encoding part of EEK as well as another putative protein tyrosine kinase most similar to ELK (90%) and symbolized ERK (EPHB2; 600997) for ELK-related kinase, were isolated and partially characterized. The novel identity of these 2 EPH-family genes was further supported by Southern blot analysis and localization to human chromosome 1. In Northern blot analysis of rat RNA, DNAs encoding rat EEK and human ERK hybridized to transcripts most abundant in brain and lung, respectively. These 2 new members of the EPH subclass of receptor protein-tyrosine kinases, EEK and ERK, may therefore have tissue-specific functions distinct from those of the other EPH family members.

Animal model experiments lend further support to the function of EPHA8. Park et al. (1997) generated mice homozygous for a mutation that disrupts the gene encoding EPHA8, a member of the Eph family of tyrosine proteinase receptors. EphA8 -/- mice developed to term, were fertile, and did not display obvious anatomical or physiologic defects.

It is appreciated that the abovementioned animal model for EPHA8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chan, J.; Watt, V. M.: Eek and erk, new members of the eph subclass of receptor protein-tyrosine kinases. Oncogene 6:1057-1061, 1991; and Park, S.; Frisen, J.; Barbacid, M.: Aberrant axonal projections in mice lacking EphA8 (Eek) tyrosine protein kinase receptors. EMBO J. 16:3106-3114, 1997.

Further studies establishing the function and utilities of EPHA8 are found in John Hopkins OMIM database record ID 176945, and in cited publications listed in Table 5, which are hereby incorporated by reference. Epiregulin (EREG, Accession NP_001423.1) is another GAM189 target gene, herein designated TARGET GENE. EREG BINDING SITE is a target binding site found in the 3' untranslated region of mRNA encoded by EREG, corresponding to a target binding site such as BINDING SITE I, BINDING SITE II or BINDING SITE III of FIG. 8. Table 4 illustrates the complementarity of the nucleotide sequences of EREG BINDING SITE, designated SEQ ID:17956, to the nucleotide sequence of GAM189 RNA, herein designated GAM RNA, also designated SEQ ID:246.

Another function of GAM189 is therefore inhibition of Epiregulin (EREG, Accession NP_001423.1). Accordingly, utilities of GAM189 include diagnosis, prevention and treatment of diseases and clinical conditions associated with EREG.

Ellis van creveld syndrome (EVC, Accession NP_714928.1) is another GAM189 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:18115, to the nucleotide sequence of GAM189 RNA, herein designated GAM RNA, also designated SEQ ID:246.

Another function of GAM189 is therefore inhibition of Ellis van creveld syndrome (EVC, Accession NP_714928.1). Accordingly, utilities of GAM189 include diagnosis, prevention and treatment of diseases and clinical conditions associated with EVC.

Ellis van creveld syndrome (EVC, Accession NP_055371.1) is another GAM189 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:18115, to the nucleotide sequence of GAM189 RNA, herein designated GAM RNA, also designated SEQ ID:246.

Another function of GAM189 is therefore inhibition of Ellis van creveld syndrome (EVC, Accession NP_055371.1). Accordingly, utilities of GAM189 include diagnosis, prevention and treatment of diseases and clinical conditions associated with EVC.

Ecotropic viral integration site 5 (EVI5, Accession NP_005656.2) is another GAM189 target gene, herein designated TARGET GENE. EVI5 BINDING SITE1 and EVI5 BINDING SITE2 are target binding sites found in untranslated regions of mRNA encoded by EVI5, corresponding to target binding sites such as BINDING SITE I, BINDING SITE II or BINDING SITE III of FIG. 8. Table 4 illustrates the complementarity of the nucleotide sequences of EVI5 BINDING SITE1 and EVI5 BINDING SITE2, designated SEQ ID:7219 and SEQ ID:11607 respectively, to the nucleotide sequence of GAM189 RNA, herein designated GAM RNA, also designated SEQ ID:246.

Another function of GAM189 is therefore inhibition of Ecotropic viral integration site 5 (EVI5, Accession NP_005656.2). Accordingly, utilities of GAM189 include diagnosis, prevention and treatment of diseases and clinical conditions associated with EVI5.

Enhancer of zeste homolog 1 (drosophila) (EZH1, Accession NP_001982.2) is another GAM189 target gene, herein designated TARGET GENE. EZH1 BINDING SITE is a target binding site found in the 3' untranslated region of mRNA encoded by EZH1, corresponding to a target binding site such as BINDING SITE I, BINDING SITE II or BINDING SITE III of FIG. 8. Table 4 illustrates the complementarity of the nucleotide sequences of EZH1 BINDING SITE, designated SEQ ID:14083, to the nucleotide sequence of GAM189 RNA, herein designated GAM RNA, also designated SEQ ID:246.

Another function of GAM189 is therefore inhibition of Enhancer of zeste homolog 1 (drosophila) (EZH1, Accession NP_001982.2), a gene which may act in transcriptional regulation and heterochromatin maintenance. Accordingly, utilities of GAM189 include diagnosis, prevention and treatment of diseases and clinical conditions associated with EZH1.

The function of EZH1 has been established by previous studies. Transcription mapping efforts within chromosome 17q21 identified a human homolog of the Drosophila gene 'enhancer of zeste' E(z). In Drosophila, the gene acts as a negative regulator of segment identity genes of the Antennapedia and Bithorax complexes. Abel et al. (1996) reported the full-length protein coding sequence of the human homolog, EZH1, and compared the respective protein sequences in human and Drosophila. EZH1 encodes a protein of 747 amino acids that displays 55% amino acid identity overall (70% similarity) with the Drosophila protein. The strong sequence conservation suggested potential roles for EZH1 in human development as a transcriptional regulator and as a component of protein complexes that stably maintain heterochromatin. EZH1 is expressed as 2 major transcripts in all adult and fetal human tissues surveyed; comparison of cloned cDNAs suggested that alternative splicing may account for at least part of the transcript size differences. Analysis of an EZH1 cDNA revealed an unusual splicing event involving EZH1 and a tandemly linked gene GPR2 (OMIM Ref. No. 600240) and suggested a potential mechanism for modifying the EZH1 protein in the conserved C-terminal domain. The GPR2 gene maps to 17q21.1-q21.3 in the vicinity of the BRCA1 gene (OMIM Ref. No. 113705). See also EZH2 (OMIM Ref. No. 601573). By FISH, Laible et al. (1999) mapped the mouse Ezh1 gene to chromosome 11.

Full details of the abovementioned studies are described in the following publications, the disclosure of which are hereby incorporated by reference:

Abel, K. J.; Brody, L. C.; Valdes, J. M.; Erdos, M. R.; McKinley, D. R.; Castilla, L. H.; Merajver, S. D.; Couch, F. J.; Friedman, L. S.; Ostermeyer, E. A.; Lynch, E. D.; King, M.-C.; Welcsh, P. L.; Osborne-Lawrence, S.; Spillman, M.; Bowcock, A. M.; Collins, F. S.; Weber, B. L.: Characterization of EZH1, a human homolog of Drosophila enhancer of zeste near BRCA1. Genomics 37:161-171, 1996; and Laible, G.; Haynes, A. R.; Lebersorger, A.; O'Carroll, D.; Mattei, M.-G.; Denny, P.; Brown, S. D. M.; Jenuwein, T.: The murine polycomb-group genes Ezh1 and Ezh2 map close to Hox gene.

Further studies establishing the function and utilities of EZH1 are found in John Hopkins OMIM database record ID 601674, and in cited publications listed in Table 5, which are hereby incorporated by reference. F11R (Accession NP_653087.1) is another GAM189 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM189 RNA, herein designated GAM RNA, also designated SEQ ID:246.

Another function of GAM189 is therefore inhibition of F11R (Accession NP_653087.1). Accordingly, utilities of GAM189 include diagnosis, prevention and treatment of diseases and clinical conditions associated with F11R.

F11R (Accession NP_653085.1) is another GAM189 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM189 RNA, herein designated GAM RNA, also designated SEQ ID:246.

Another function of GAM189 is therefore inhibition of F11R (Accession NP_653085.1). Accordingly, utilities of GAM189 include diagnosis, prevention and treatment of diseases and clinical conditions associated with F11R.

F11R (Accession NP_653086.1) is another GAM189 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM189 RNA, herein designated GAM RNA, also designated SEQ ID:246.

Another function of GAM189 is therefore inhibition of F11R (Accession NP_653086.1). Accordingly, utilities of GAM189 include diagnosis, prevention and treatment of diseases and clinical conditions associated with F11R.

F11R (Accession NP_058642.1) is another GAM189 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM189 RNA, herein designated GAM RNA, also designated SEQ ID:246.

Another function of GAM189 is therefore inhibition of F11R (Accession NP_058642.1). Accordingly, utilities of GAM189 include diagnosis, prevention and treatment of diseases and clinical conditions associated with F11R.

Coagulation factor ii (thrombin) receptor-like 3 (F2RL3, Accession NP_003941.1) is another GAM189 target gene, herein designated TARGET GENE. F2RL3 BINDING SITE is a target binding site found in the 3' untranslated region of mRNA encoded by F2RL3, corresponding to a target binding site such as BINDING SITE I, BINDING SITE II or BINDING SITE III of FIG. 8. Table 4 illustrates the complementarity of the nucleotide sequences of F2RL3 BINDING SITE, designated SEQ ID:4234, to the nucleotide sequence of GAM189 RNA, herein designated GAM RNA, also designated SEQ ID:246.

Another function of GAM189 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM189 include diagnosis, prevention and treatment of diseases and clinical conditions associated with F2RL3.

The function of F2RL3 and its association with various diseases and clinical conditions, has been established by previous studies, as described hereinabove with reference to GAM72.1. Coagulation factor iii (thromboplastin, tissue factor) (F3, Accession NP_001984.1) is another GAM189 target gene, herein designated TARGET GENE. F3 BINDING SITE is a target binding site found in the 3' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:18492, to the nucleotide sequence of GAM189 RNA, herein designated GAM RNA, also designated SEQ ID:246.

Another function of GAM189 is therefore inhibition of Coagulation factor iii (thromboplastin, tissue factor) (F3, Accession NP_001984.1), a gene which functions in normal hemostasis. Accordingly, utilities of GAM189 include diagnosis, prevention and treatment of diseases and clinical conditions associated with F3.

The function of F3 and its association with various diseases and clinical conditions, has been established by previous studies, as described hereinabove with reference to GAM136.1. Coagulation factor v (proaccelerin, labile factor) (F5, Accession NP_000121.1) is another GAM189 target gene, herein designated TARGET GENE. F5 BINDING SITE is a target binding site found in the 5' untranslated region of mRNA encoded by F5, corresponding to a target binding site such as BINDING SITE I, BINDING SITE II or BINDING SITE III of FIG. 8. Table 4 illustrates the complementarity of the nucleotide sequences of F5 BINDING SITE, designated SEQ ID:7269, to the nucleotide sequence of GAM189 RNA, herein designated GAM RNA, also designated SEQ ID:246.

Another function of GAM189 is therefore inhibition of Coagulation factor v (proaccelerin, labile factor) (F5, Accession NP_000121.1). Accordingly, utilities of GAM189 include diagnosis, prevention and treatment of diseases and clinical conditions associated with F5.

Fatty acid binding protein 2, intestinal (FABP2, Accession NP_000125.1) is another GAM189 target gene, herein designated TARGET GENE. FABP2 BINDING SITE is a target binding site found in the 3' untranslated region of mRNA encoded by FABP2, corresponding to a target binding site such as BINDING SITE I, BINDING SITE II or BINDING SITE III of FIG. 8. Table 4 illustrates the complementarity of the nucleotide sequences of FABP2 BINDING SITE, designated SEQ ID:2195, to the nucleotide sequence of GAM189 RNA, herein designated GAM RNA, also designated SEQ ID:246.

Another function of GAM189 is therefore inhibition of Fatty acid binding protein 2, intestinal (FABP2, Accession NP_000125.1), a gene which may have a role in dietary fat uptake or processing. and therefore may be associated with Cardiovascular disease and type 2 diabetes. Accordingly, utilities of GAM189 include diagnosis, prevention and treatment of Cardiovascular disease and type 2 diabetes, and of other diseases and clinical conditions associated with FABP2.

The function of FABP2 has been established by previous studies. To test the hypothesis that the A54T FABP2 polymorphism is associated with impaired lipid metabolism and cardiovascular disease, Carlsson et al. (2000) compared clinical characteristics and a parental history of cardiovascular disease between 213 sib pairs discordant for the polymorphism. Sibs with an excess of the thr54 allele had higher triglyceride and cholesterol concentrations than sibs with the ala54 allele. Parents of offspring with the thr/thr and thr/ala genotypes reported an increased prevalence of stroke compared to parents of offspring with the ala/ala genotype. The authors confirmed the association of the FABP2 thr54 allele with increased concentrations of cholesterol and triglycerides in genotype-discordant sib pairs. They also presented novel evidence that genetic variation in the FABP2 gene may increase susceptibility to stroke. To assess whether increased intestinal triglyceride input leads to elevated fasting and postprandial triglycerides in type 2 diabetes (NIDDM), Georgopoulos et al. (2000) studied the ala54- to - thr polymorphism of FABP2, which is associated with increased intestinal input of triglyceride. Of the 287 diabetic patients screened, 108 (37.6%) were heterozygous and 31 (10.8%) were homozygous for the thr54 allele. Mean fasting plasma triglyceride levels in patients with the wild-type (OMIM Ref. No. n =80), those heterozygous for the thr54 allele (OMIM Ref. No. n =57), and those homozygous for it (OMIM Ref. No. n =18) were 2.0 +/-0.09, 2.7 +/-0.20, and 3.8 +/-0.43 mmol/L, respectively. A linear relationship of mean fasting plasma triglyceride levels between the 3 groups was found. After fat ingestion, the postprandial area under the curve of plasma triglyceride and chylomicrons was higher in the thr54/thr54 (n =6) than in the wild-type (n =9). The authors concluded that their results support the hypothesis that, in type 2 diabetes, increased intestinal input of triglyceride can lead to elevated fasting and postprandial plasma triglycerides. triglyceride.

Full details of the abovementioned studies are described in the following publications, the disclosure of which are hereby incorporated by reference:

Carlsson, M.; Orho-Melander, M.; Hedenbro, J.; Almgren, P.; Groop, L. C.: The T54 allele of the intestinal fatty acid-binding protein 2 is associated with a parental history of stroke. J. Clin. Endocr. Metab. 85:2801-2804, 2000; and Georgopoulos, A.; Aras, O.; Tsai, M. Y.: Codon-54 polymorphism of the fatty acid-binding protein 2 gene is associated with elevation of fasting and postprandial triglyceride in type 2.

Further studies establishing the function and utilities of FABP2 are found in John Hopkins OMIM database record ID 134640, and in cited publications listed in Table 5, which are hereby incorporated by reference. Fanconi anemia, complementation group e (FANCE, Accession NP_068741.1) is another GAM189 target gene, herein designated TARGET GENE. FANCE BINDING SITE is a target binding site found in the 3' untranslated region of mRNA encoded by FANCE, corresponding to a target binding site such as BINDING SITE I, BINDING SITE II or BINDING SITE III of FIG. 8. Table 4 illustrates the complementarity of the nucleotide sequences of FANCE BINDING SITE, designated SEQ ID:5597, to the nucleotide sequence of GAM189 RNA, herein designated GAM RNA, also designated SEQ ID:246.

Another function of GAM189 is therefore inhibition of Fanconi anemia, complementation group e (FANCE, Accession NP_068741.1), a gene which is a possible regulator of lymphocyte and platelet function. and therefore is associated with Fanconi anemia, complementation group e. Accordingly, utilities of GAM189 include diagnosis, prevention and treatment of Fanconi anemia, complementation group e., and of other diseases and clinical conditions associated with FANCE.

The function of FANCE has been established by previous studies. A number sign (#) is used with this entry because Fanconi anemia is caused by mutation in 1 of the Fanconi anemia complementation group genes: FANCA (OMIM Ref. No. 607139), FANCB (OMIM Ref. No. 227660), FANCC (OMIM Ref. No. 227645), FANCD1 (OMIM Ref. No. 605724), FANCD2 (OMIM Ref. No. 227646), FANCE (OMIM Ref. No. 600901), FANCF (OMIM Ref. No. 603467), FANCG (OMIM Ref. No. 602956). The previously designated FANCH complementation group (Joenje et al., 1997) was found by Joenje et al. (2000) to be the same as FANCA. Joenje et al. (1995) presented evidence for a fifth subtype of Fanconi anemia, designated group E. Buchwald (1995) stated that 6 of 31 patients (12.7%) could be classified as group E. The FACE group is defined as being different from groups A (OMIM Ref. No. 227650), B (OMIM Ref. No. 227660), C (OMIM Ref. No. 227645), and D (OMIM Ref. No. 227646) and may itself be heterogeneous.

Full details of the abovementioned studies are described in the following publications, the disclosure of which are hereby incorporated by reference:

Joenje, H.; Lo Ten Foe, J. R.; Oostra, A. B.; van Berkel, C. G. M.; Rooimans, M. A.; Schroeder-Kurth, T.; Wegner, R.-D.; Gille, J. J. P.; Buchwald, M.; Arwert, F.: Classification of Fanconi anemia patients by complementation analysis: evidence for a fifth genetic subtype. Blood 86:2156-2160, 1995; and Buchwald, M.: Complementation groups: one or more per gene? Nature Genet. 11:228-230, 1995.

Further studies establishing the function and utilities of FANCE are found in John Hopkins OMIM database record ID 600901, and in cited publications listed in Table 5, which are hereby incorporated by reference. Fanconi anemia, complementation group f (FANCF, Accession NP_073562.1) is another GAM189 target gene, herein designated TARGET GENE. FANCF BINDING SITE is a target binding site found in the 3' untranslated region of mRNA encoded by FANCF, corresponding to a target binding site such as BINDING SITE I, BINDING SITE II or BINDING SITE III of FIG. 8. Table 4 illustrates the complementarity of the nucleotide sequences of FANCF BINDING SITE, designated SEQ ID:5816, to the nucleotide sequence of GAM189 RNA, herein designated GAM RNA, also designated SEQ ID:246.

Another function of GAM189 is therefore inhibition of Fanconi anemia, complementation group f (FANCF, Accession NP_073562.1). Accordingly, utilities of GAM189 include diagnosis, prevention and treatment of diseases and clinical conditions associated with FANCF.

FAT3 (Accession XP_061871.5) is another GAM189 target gene, herein designated TARGET GENE. FAT3 BINDING SITE is a target binding site found in the 3' untranslated region of mRNA encoded by FAT3, corresponding to a target binding site such as BINDING SITE I, BINDING SITE II or BINDING SITE III of FIG. 8. Table 4 illustrates the complementarity of the nucleotide sequences of FAT3 BINDING SITE, designated SEQ ID:8236, to the nucleotide sequence of GAM189 RNA, herein designated GAM RNA, also designated SEQ ID:246.

Another function of GAM189 is therefore inhibition of FAT3 (Accession XP_061871.5). Accordingly, utilities of GAM189 include diagnosis, prevention and treatment of diseases and clinical conditions associated with FAT3.

FBXW8 (Accession NP_036306.1) is another GAM189 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:11845, to the nucleotide sequence of GAM189 RNA, herein designated GAM RNA, also designated SEQ ID:246.

Another function of GAM189 is therefore inhibition of FBXW8 (Accession NP_036306.1). Accordingly, utilities of GAM189 include diagnosis, prevention and treatment of diseases and clinical conditions associated with FBXW8.

FBXW8 (Accession NP_699179.2) is another GAM189 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:11845, to the nucleotide sequence of GAM189 RNA, herein designated GAM RNA, also designated SEQ ID:246.

Another function of GAM189 is therefore inhibition of FBXW8 (Accession NP_699179.2). Accordingly, utilities of GAM189 include diagnosis, prevention and treatment of diseases and clinical conditions associated with FBXW8.

Fc fragment of iga, receptor for (FCAR, Accession NP_579813.1) is another GAM189 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:17643, SEQ ID:10448 and SEQ ID:10448 respectively, to the nucleotide sequence of GAM189 RNA, herein designated GAM RNA, also designated SEQ ID:246.

Another function of GAM189 is therefore inhibition of Fc fragment of iga, receptor for (FCAR, Accession NP_579813.1), a gene which binds to the fc region of immunoglobulins alpha and mediates several functions including cytokine production. and therefore may be associated with Iga nephropathy. Accordingly, utilities of GAM189 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579811.1) is another GAM189 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10448, SEQ ID:10448 and SEQ ID:10448 respectively, to the nucleotide sequence of GAM189 RNA, herein designated GAM RNA, also designated SEQ ID:246.

Another function of GAM189 is therefore inhibition of Fc fragment of iga, receptor for (FCAR, Accession NP_579811.1), a gene which binds to the fc region of immunoglobulins alpha and mediates several functions including cytokine production. and therefore may be associated with Iga nephropathy. Accordingly, utilities of GAM189 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579807.1) is another GAM189 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10448, SEQ ID:3819 and SEQ ID:10448 respectively, to the nucleotide sequence of GAM189 RNA, herein designated GAM RNA, also designated SEQ ID:246.

Another function of GAM189 is therefore inhibition of Fc fragment of iga, receptor for (FCAR, Accession NP_579807.1), a gene which binds to the fc region of immunoglobulins alpha and mediates several functions including cytokine production. and therefore may be associated with Iga nephropathy. Accordingly, utilities of GAM189 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579814.1) is another GAM189 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:17643, SEQ ID:497 and SEQ ID:11291 respectively, to the nucleotide sequence of GAM189 RNA, herein designated GAM RNA, also designated SEQ ID:246.

Another function of GAM189 is therefore inhibition of Fc fragment of iga, receptor for (FCAR, Accession NP_579814.1), a gene which binds to the fc region of immunoglobulins alpha and mediates several functions including cytokine production. and therefore may be associated with Iga nephropathy. Accordingly, utilities of GAM189 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fer-1-like 4 (c. elegans) (FER1L4, Accession XP_300246.1) is another GAM189 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:11291, to the nucleotide sequence of GAM189 RNA, herein designated GAM RNA, also designated SEQ ID:246.

Another function of GAM189 is therefore inhibition of Fer-1-like 4 (c. elegans) (FER1L4, Accession XP_300246.1). Accordingly, utilities of GAM189 include diagnosis, prevention and treatment of diseases and clinical conditions associated with FER1L4.

Fasciculation and elongation protein zeta 1 (zygin i) (FEZ1, Accession NP_072043.1) is another GAM189 target gene, herein designated TARGET GENE. FEZ1 BINDING SITE is a target binding site found in the 3' untranslated region of multiple transcripts of mRNA encoded by FEZ1, corresponding to a target binding site such as BINDING SITE I, BINDING SITE II or BINDING SITE III of FIG. 8. Table 4 illustrates the complementarity of the nucleotide sequences of FEZ1 BINDING SITE, designated SEQ ID:5204, to the nucleotide sequence of GAM189 RNA, herein designated GAM RNA, also designated SEQ ID:246.

Another function of GAM189 is therefore inhibition of Fasciculation and elongation protein zeta 1 (zygin 1) (FEZ1, Accession NP_072043.1), a gene which Zygin 1; may have a role in axonal outgrowth; has similarity to C. elegans UNC-76. Accordingly, utilities of GAM189 include diagnosis, prevention and treatment of diseases and clinical conditions associated with FEZ1.

The function of FEZ1 and its association with various diseases and clinical conditions, has been established by previous studies, as described hereinabove with reference to GAM30.1. Fibroblast growth factor 5 (FGF5, Accession NP_004455.1) is another GAM189 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:14382, to the nucleotide sequence of GAM189 RNA, herein designated GAM RNA, also designated SEQ ID:246.

Another function of GAM189 is therefore inhibition of Fibroblast growth factor 5 (FGF5, Accession NP_004455.1), a gene which induces transformation and may regulate neuronal differentiation. Accordingly, utilities of GAM189 include diagnosis, prevention and treatment of diseases and clinical conditions associated with FGF5.

The function of FGF5 and its association with various diseases and clinical conditions, has been established by previous studies, as described hereinabove with reference to GAM106.1. Fibroblast growth factor 5 (FGF5, Accession NP_149134.1) is another GAM189 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:14382, to the nucleotide sequence of GAM189 RNA, herein designated GAM RNA, also designated SEQ ID:246.

Another function of GAM189 is therefore inhibition of Fibroblast growth factor 5 (FGF5, Accession NP_149134.1), a gene which induces transformation and may regulate neuronal differentiation. Accordingly, utilities of GAM189 include diagnosis, prevention and treatment of diseases and clinical conditions associated with FGF5.

The function of FGF5 and its association with various diseases and clinical conditions, has been established by previous studies, as described hereinabove with reference to GAM106.1. Four and a half lim domains 2 (FHL2, Accession NP_001441.2) is another GAM189 target gene, herein designated TARGET GENE. FHL2 BINDING SITE is a target binding site found in the 5' untranslated region of mRNA encoded by FHL2, corresponding to a target binding site such as BINDING SITE I, BINDING SITE II or BINDING SITE III of FIG. 8. Table 4 illustrates the complementarity of the nucleotide sequences of FHL2 BINDING SITE, designated SEQ ID:16589, to the nucleotide sequence of GAM189 RNA, herein designated GAM RNA, also designated SEQ ID:246.

Another function of GAM189 is therefore inhibition of Four and a half lim domains 2 (FHL2, Accession NP_001441.2), a gene which Contains four LIM domains and an additional zinc finger. Accordingly, utilities of GAM189 include diagnosis, prevention and treatment of diseases and clinical conditions associated with FHL2.

The function of FHL2 has been established by previous studies. LIM proteins contain a highly conserved double zinc finger motif called the LIM domain. By searching sequence databases with a partial human SLIM1 (FHL1; 300163) cDNA, Morgan and Madgwick (1996) identified partial SLIM3 cDNAs. Genini et al. (1997) used subtractive cloning to isolate a gene that is downregulated during transformation of normal myoblasts to rhabdomyosarcoma cells. The gene, termed DRAL for 'down-regulated in rhabdomyosarcoma LIM protein,' encodes a 279-amino acid polypeptide with an observed mass of 32 kD. The protein sequence contains 4 complete LIM domains and the second half of a fifth LIM domain. DRAL appears to be a member of the LIM-only class of proteins, which consist primarily of LIM domains and little else. Southern blotting revealed a single-copy gene that is conserved among vertebrates. Northern blotting revealed that the DRAL gene is expressed at highest levels in heart and ovary, and at lower levels in skeletal muscle, prostate, testis, small intestine, and colon. Results of Northern blotting of tumor cell lines suggested to Genini et al. (1997) that this gene may be downregulated during transformation of a variety of cell types. Genini et al. (1997) used in situ hybridization to map the human FHL2 gene to 2q12-q14. By fluorescence in situ hybridization, Chan et al. (1998) mapped the FHL2 gene to 2q12-q13. Using the yeast 2-hybrid system, Tanahashi and Tabira (2000) screened for proteins interacting with an Alzheimer disease gene, presenilin-2 (OMIM Ref. No. 600759), and cloned DRAL. DRAL interacted with a hydrophilic loop region (amino acids 269-298) in the endoproteolytic N-terminal fragment of PS2, but not that of PS1 (OMIM Ref. No. 104311), although residues 269 to 298 of PS2 and the corresponding PS1 sequence differ by only 3 amino acids. Each of 9 PS2 point mutations within a region from residues 275 to 296 abolished the binding. The in vitro interaction was confirmed by affinity column assay and the physiologic interactions between endogenous PS2 and DRAL by coimmunoprecipitation from human lung fibroblast MRC5 cells. The authors suggested that DRAL functions as a link between PS2 and an intracellular signaling pathway.

Full details of the abovementioned studies are described in the following publications, the disclosure of which are hereby incorporated by reference:

Genini, M.; Schwalbe, P.; Scholl, F. A.; Remppis, A.; Mattei, M.-G.; Schafer, B. W.: Subtractive cloning and characterization of DRAL, a novel LIM-domain protein down- regulated in rhabdomyosarcoma. DNA Cell Biol. 16:433-442, 1997; and Tanahashi, H.; Tabira, T.: Alzheimer's disease-associated presenilin 2 interacts with DRAL, an LIM-domain protein. Hum. Molec. Genet. 9:2281- 2289, 2000.

Further studies establishing the function and utilities of FHL2 are found in John Hopkins OMIM database record ID 602633, and in cited publications listed in Table 5, which are hereby incorporated by reference. FISH (Accession NP_055446.1) is another GAM189 target gene, herein designated TARGET GENE. FISH BINDING SITE is a target binding site found in the 5' untranslated region of mRNA encoded by FISH, corresponding to a target binding site such as BINDING SITE I, BINDING SITE II or BINDING SITE III of FIG. 8. Table 4 illustrates the complementarity of the nucleotide sequences of FISH BINDING SITE, designated SEQ ID:13261, to the nucleotide sequence of GAM189 RNA, herein designated GAM RNA, also designated SEQ ID:246.

Another function of GAM189 is therefore inhibition of FISH (Accession NP_055446.1). Accordingly, utilities of GAM189 include diagnosis, prevention and treatment of diseases and clinical conditions associated with FISH.

Fk506 binding protein 9, 63 kda (FKBP9, Accession NP_009201.1) is another GAM189 target gene, herein designated TARGET GENE. FKBP9 BINDING SITE is a target binding site found in the 3' untranslated region of mRNA encoded by FKBP9, corresponding to a target binding site such as BINDING SITE I, BINDING SITE II or BINDING SITE III of FIG. 8. Table 4 illustrates the complementarity of the nucleotide sequences of FKBP9 BINDING SITE, designated SEQ ID:7851, to the nucleotide sequence of GAM189 RNA, herein designated GAM RNA, also designated SEQ ID:246.

Another function of GAM189 is therefore inhibition of Fk506 binding protein 9, 63 kda (FKBP9, Accession NP_009201.1). Accordingly, utilities of GAM189 include diagnosis, prevention and treatment of diseases and clinical conditions associated with FKBP9.

FLJ00001 (Accession XP_088525.2) is another GAM189 target gene, herein designated TARGET GENE. FLJ00001 BINDING SITE is a target binding site found in the 3' untranslated region of mRNA encoded by FLJ00001, corresponding to a target binding site such as BINDING SITE I, BINDING SITE II or BINDING SITE III of FIG. 8. Table 4 illustrates the complementarity of the nucleotide sequences of FLJ00001 BINDING SITE, designated SEQ ID:14844, to the nucleotide sequence of GAM189 RNA, herein designated GAM RNA, also designated SEQ ID:246.

Another function of GAM189 is therefore inhibition of FLJ00001 (Accession XP_088525.2). Accordingly, utilities of GAM189 include diagnosis, prevention and treatment of diseases and clinical conditions associated with FLJ00001.

FLJ00060 (Accession XP_028154.1) is another GAM189 target gene, herein designated TARGET GENE. FLJ00060 BINDING SITE is a target binding site found in the 5' untranslated region of mRNA encoded by FLJ00060, corresponding to a target binding site such as BINDING SITE I, BINDING SITE II or BINDING SITE III of FIG. 8. Table 4 illustrates the complementarity of the nucleotide sequences of FLJ00060 BINDING SITE, designated SEQ ID:11528, to the nucleotide sequence of GAM189 RNA, herein designated GAM RNA, also designated SEQ ID:246.

Another function of GAM189 is therefore inhibition of FLJ00060 (Accession XP_028154.1). Accordingly, utilities of GAM189 include diagnosis, prevention and treatment of diseases and clinical conditions associated with FLJ00060.

FLJ10101 (Accession NP_078994.1) is another GAM189 target gene, herein designated TARGET GENE. FLJ10101 BINDING SITE is a target binding site found in the 3' untranslated region of mRNA encoded by FLJ10101, corresponding to a target binding site such as BINDING SITE I, BINDING SITE II or BINDING SITE III of FIG. 8. Table 4 illustrates the complementarity of the nucleotide sequences of FLJ10101 BINDING SITE, designated SEQ ID:9189, to the nucleotide sequence of GAM189 RNA, herein designated GAM RNA, also designated SEQ ID:246.

Another function of GAM189 is therefore inhibition of FLJ10101 (Accession NP_078994.1). Accordingly, utilities of GAM189 include diagnosis, prevention and treatment of diseases and clinical conditions associated with FLJ10101.

FLJ10232 (Accession NP_060503.1) is another GAM189 target gene, herein designated TARGET GENE. FLJ10232

BINDING SITE is a target binding site found in the 3' untranslated region of mRNA encoded by FLJ10232, corresponding to a target binding site such as BINDING SITE I, BINDING SITE II or BINDING SITE III of FIG. 8. Table 4 illustrates the complementarity of the nucleotide sequences of FLJ10232 BINDING SITE, designated SEQ ID:19236, to the nucleotide sequence of GAM189 RNA, herein designated GAM RNA, also designated SEQ ID:246.

Another function of GAM189 is therefore inhibition of FLJ10232 (Accession NP_060503.1). Accordingly, utilities of GAM189 include diagnosis, prevention and treatment of diseases and clinical conditions associated with FLJ10232.

FLJ10298 (Accession NP_060520.2) is another GAM189 target gene, herein designated TARGET GENE. FLJ10298 BINDING SITE is a target binding site found in the 3' untranslated region of mRNA encoded by FLJ10298, corresponding to a target binding site such as BINDING SITE I, BINDING SITE II or BINDING SITE III of FIG. 8. Table 4 illustrates the complementarity of the nucleotide sequences of FLJ10298 BINDING SITE, designated SEQ ID:2615, to the nucleotide sequence of GAM189 RNA, herein designated GAM RNA, also designated SEQ ID:246.

Another function of GAM189 is therefore inhibition of FLJ10298 (Accession NP_060520.2). Accordingly, utilities of GAM189 include diagnosis, prevention and treatment of diseases and clinical conditions associated with FLJ10298.

FLJ10346 (Accession NP_060535.1) is another GAM189 target gene, herein designated TARGET GENE. FLJ10346 BINDING SITE is a target binding site found in the 5' untranslated region of mRNA encoded by FLJ10346, corresponding to a target binding site such as BINDING SITE I, BINDING SITE II or BINDING SITE III of FIG. 8. Table 4 illustrates the complementarity of the nucleotide sequences of FLJ10346 BINDING SITE, designated SEQ ID:19219, to the nucleotide sequence of GAM189 RNA, herein designated GAM RNA, also designated SEQ ID:246.

Another function of GAM189 is therefore inhibition of FLJ10346 (Accession NP_060535.1). Accordingly, utilities of GAM189 include diagnosis, prevention and treatment of diseases and clinical conditions associated with FLJ10346.

FLJ10520 (Accession NP_060594.2) is another GAM189 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:4272, to the nucleotide sequence of GAM189 RNA, herein designated GAM RNA, also designated SEQ ID:246.

Another function of GAM189 is therefore inhibition of FLJ10520 (Accession NP_060594.2). Accordingly, utilities of GAM189 include diagnosis, prevention and treatment of diseases and clinical conditions associated with FLJ10520.

FLJ10535 (Accession NP_060599.1) is another GAM189 target gene, herein designated TARGET GENE. FLJ10535 BINDING SITE is a target binding site found in the 3' untranslated region of mRNA encoded by FLJ10535, corresponding to a target binding site such as BINDING SITE I, BINDING SITE II or BINDING SITE III of FIG. 8. Table 4 illustrates the complementarity of the nucleotide sequences of FLJ10535 BINDING SITE, designated SEQ ID:9543, to the nucleotide sequence of GAM189 RNA, herein designated GAM RNA, also designated SEQ ID:246.

Another function of GAM189 is therefore inhibition of FLJ10535 (Accession NP_060599.1). Accordingly, utilities of GAM189 include diagnosis, prevention and treatment of diseases and clinical conditions associated with FLJ10535.

FLJ10560 (Accession NP_060608.1) is another GAM189 target gene, herein designated TARGET GENE. FLJ10560 BINDING SITE is a target binding site found in the 3' untranslated region of mRNA encoded by FLJ10560, corresponding to a target binding site such as BINDING SITE I, BINDING SITE II or BINDING SITE III of FIG. 8. Table 4 illustrates the complementarity of the nucleotide sequences of FLJ10560 BINDING SITE, designated SEQ ID:15591, to the nucleotide sequence of GAM189 RNA, herein designated GAM RNA, also designated SEQ ID:246.

Another function of GAM189 is therefore inhibition of FLJ10560 (Accession NP_060608.1). Accordingly, utilities of GAM189 include diagnosis, prevention and treatment of diseases and clinical conditions associated with FLJ10560.

FLJ10713 (Accession NP_060659.1) is another GAM189 target gene, herein designated TARGET GENE. FLJ10713 BINDING SITE is a target binding site found in the 3' untranslated region of mRNA encoded by FLJ10713, corresponding to a target binding site such as BINDING SITE I, BINDING SITE II or BINDING SITE III of FIG. 8. Table 4 illustrates the complementarity of the nucleotide sequences of FLJ10713 BINDING SITE, designated SEQ ID:7909, to the nucleotide sequence of GAM189 RNA, herein designated GAM RNA, also designated SEQ ID:246.

Another function of GAM189 is therefore inhibition of FLJ10713 (Accession NP_060659.1). Accordingly, utilities of GAM189 include diagnosis, prevention and treatment of diseases and clinical conditions associated with FLJ10713.

FLJ10846 (Accession NP_060711.1) is another GAM189 target gene, herein designated TARGET GENE. FLJ10846 BINDING SITE is a target binding site found in the 3' untranslated region of mRNA encoded by FLJ10846, corresponding to a target binding site such as BINDING SITE I, BINDING SITE II or BINDING SITE III of FIG. 8. Table 4 illustrates the complementarity of the nucleotide sequences of FLJ10846 BINDING SITE, designated SEQ ID:11528, to the nucleotide sequence of GAM189 RNA, herein designated GAM RNA, also designated SEQ ID:246.

Another function of GAM189 is therefore inhibition of FLJ10846 (Accession NP_060711.1). Accordingly, utilities of GAM189 include diagnosis, prevention and treatment of diseases and clinical conditions associated with FLJ10846.

FLJ10847 (Accession NP_060712.2) is another GAM189 target gene, herein designated TARGET GENE. FLJ10847 BINDING SITE is a target binding site found in the 3' untranslated region of mRNA encoded by FLJ10847, corresponding to a target binding site such as BINDING SITE I, BINDING SITE II or BINDING SITE III of FIG. 8. Table 4 illustrates the complementarity of the nucleotide sequences of FLJ10847 BINDING SITE, designated SEQ ID:19357, to the nucleotide sequence of GAM189 RNA, herein designated GAM RNA, also designated SEQ ID:246.

Another function of GAM189 is therefore inhibition of FLJ10847 (Accession NP_060712.2). Accordingly, utilities of GAM189 include diagnosis, prevention and treatment of diseases and clinical conditions associated with FLJ10847.

FLJ10922 (Accession NP_060743.1) is another GAM189 target gene, herein designated TARGET GENE. FLJ10922 BINDING SITE is a target binding site found in the 3' untranslated region of mRNA encoded by FLJ10922, corresponding to a target binding site such as BINDING SITE I, BINDING SITE II or BINDING SITE III of FIG. 8. Table 4 illustrates the complementarity of the nucleotide sequences of FLJ10922 BINDING SITE, designated SEQ ID:18818, to the nucleotide sequence of GAM189 RNA, herein designated GAM RNA, also designated SEQ ID:246.

Another function of GAM189 is therefore inhibition of FLJ10922 (Accession NP_060743.1). Accordingly, utilities of GAM189 include diagnosis, prevention and treatment of diseases and clinical conditions associated with FLJ10922.

FLJ11323 (Accession NP_060860.1) is another GAM189 target gene, herein designated TARGET GENE. FLJ11323 BINDING SITE is a target binding site found in the 3' untranslated region of multiple transcripts of mRNA encoded by FLJ11323, corresponding to a target binding site such as BINDING SITE I, BINDING SITE II or BINDING SITE III of FIG. 8. Table 4 illustrates the complementarity of the nucleotide sequences of FLJ11323 BINDING SITE, designated SEQ ID:2044, to the nucleotide sequence of GAM189 RNA, herein designated GAM RNA, also designated SEQ ID:246.

Another function of GAM189 is therefore inhibition of FLJ11323 (Accession NP_060860.1). Accordingly, utilities of GAM189 include diagnosis, prevention and treatment of diseases and clinical conditions associated with FLJ11323.

FLJ11467 (Accession NP_079239.2) is another GAM189 target gene, herein designated TARGET GENE. FLJ11467 BINDING SITE is a target binding site found in the 3' untranslated region of mRNA encoded by FLJ11467, corresponding to a target binding site such as BINDING SITE I, BINDING SITE II or BINDING SITE III of FIG. 8. Table 4 illustrates the complementarity of the nucleotide sequences of FLJ11467 BINDING SITE, designated SEQ ID:834, to the nucleotide sequence of GAM189 RNA, herein designated GAM RNA, also designated SEQ ID:246.

Another function of GAM189 is therefore inhibition of FLJ11467 (Accession NP_079239.2). Accordingly, utilities of GAM189 include diagnosis, prevention and treatment of diseases and clinical conditions associated with FLJ11467.

FLJ11710 (Accession NP_079122.1) is another GAM189 target gene, herein designated TARGET GENE. FLJ11710 BINDING SITE is a target binding site found in the 3' untranslated region of mRNA encoded by FLJ11710, corresponding to a target binding site such as BINDING SITE I, BINDING SITE II or BINDING SITE III of FIG. 8. Table 4 illustrates the complementarity of the nucleotide sequences of FLJ11710 BINDING SITE, designated SEQ ID:9688, to the nucleotide sequence of GAM189 RNA, herein designated GAM RNA, also designated SEQ ID:246.

Another function of GAM189 is therefore inhibition of FLJ11710 (Accession NP_079122.1). Accordingly, utilities of GAM189 include diagnosis, prevention and treatment of diseases and clinical conditions associated with FLJ11710.

FLJ11715 (Accession NP_078840.1) is another GAM189 target gene, herein designated TARGET GENE. FLJ11715 BINDING SITE is a target binding site found in the 3' untranslated region of mRNA encoded by FLJ11715, corresponding to a target binding site such as BINDING SITE I, BINDING SITE II or BINDING SITE III of FIG. 8. Table 4 illustrates the complementarity of the nucleotide sequences of FLJ11715 BINDING SITE, designated SEQ ID:3305, to the nucleotide sequence of GAM189 RNA, herein designated GAM RNA, also designated SEQ ID:246.

Another function of GAM189 is therefore inhibition of FLJ11715 (Accession NP_078840.1). Accordingly, utilities of GAM189 include diagnosis, prevention and treatment of diseases and clinical conditions associated with FLJ11715.

FLJ11800 (Accession NP_079250.1) is another GAM189 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:10847, to the nucleotide sequence of GAM189 RNA, herein designated GAM RNA, also designated SEQ ID:246.

Another function of GAM189 is therefore inhibition of FLJ11800 (Accession NP_079250.1). Accordingly, utilities of GAM189 include diagnosis, prevention and treatment of diseases and clinical conditions associated with FLJ11800.

FLJ12076 (Accession NP_079463.2) is another GAM189 target gene, herein designated TARGET GENE. FLJ12076 BINDING SITE is a target binding site found in the 3' untranslated region of mRNA encoded by FLJ12076, corresponding to a target binding site such as BINDING SITE I, BINDING SITE II or BINDING SITE III of FIG. 8. Table 4 illustrates the complementarity of the nucleotide sequences of FLJ12076 BINDING SITE, designated SEQ ID:8886, to the nucleotide sequence of GAM189 RNA, herein designated GAM RNA, also designated SEQ ID:246.

Another function of GAM189 is therefore inhibition of FLJ12076 (Accession NP_079463.2). Accordingly, utilities of GAM189 include diagnosis, prevention and treatment of diseases and clinical conditions associated with FLJ12076.

FLJ12363 (Accession NP_115543.1) is another GAM189 target gene, herein designated TARGET GENE. FLJ12363 BINDING SITE is a target binding site found in the 3' untranslated region of mRNA encoded by FLJ12363, corresponding to a target binding site such as BINDING SITE I, BINDING SITE II or BINDING SITE III of FIG. 8. Table 4 illustrates the complementarity of the nucleotide sequences of FLJ12363 BINDING SITE, designated SEQ ID:17722, to the nucleotide sequence of GAM189 RNA, herein designated GAM RNA, also designated SEQ ID:246.

Another function of GAM189 is therefore inhibition of FLJ12363 (Accession NP_115543.1). Accordingly, utilities of GAM189 include diagnosis, prevention and treatment of diseases and clinical conditions associated with FLJ12363.

FLJ12572 (Accession NP_075056.2) is another GAM189 target gene, herein designated TARGET GENE. FLJ12572 BINDING SITE is a target binding site found in the 5' untranslated region of mRNA encoded by FLJ12572, corresponding to a target binding site such as BINDING SITE I, BINDING SITE II or BINDING SITE III of FIG. 8. Table 4 illustrates the complementarity of the nucleotide sequences of FLJ12572 BINDING SITE, designated SEQ ID:17515, to the nucleotide sequence of GAM189 RNA, herein designated GAM RNA, also designated SEQ ID:246.

Another function of GAM189 is therefore inhibition of FLJ12572 (Accession NP_075056.2). Accordingly, utilities of GAM189 include diagnosis, prevention and treatment of diseases and clinical conditions associated with FLJ12572.

FLJ12586 (Accession NP_078896.2) is another GAM189 target gene, herein designated TARGET GENE. FLJ12586 BINDING SITE is a target binding site found in the 5' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:10410, to the nucleotide sequence of GAM189 RNA, herein designated GAM RNA, also designated SEQ ID:246.

Another function of GAM189 is therefore inhibition of FLJ12586 (Accession NP_078896.2). Accordingly, utilities of GAM189 include diagnosis, prevention and treatment of diseases and clinical conditions associated with FLJ12586.

FLJ12649 (Accession XP_291344.1) is another GAM189 target gene, herein designated TARGET GENE. FLJ12649 BINDING SITE is a target binding site found in the 3' untranslated region of mRNA encoded by FLJ12649, corresponding to a target binding site such as BINDING SITE I, BINDING SITE II or BINDING SITE III of FIG. 8. Table 4 illustrates the complementarity of the nucleotide sequences of FLJ12649 BINDING SITE, designated SEQ ID:3686, to the nucleotide sequence of GAM189 RNA, herein designated GAM RNA, also designated SEQ ID:246.

Another function of GAM189 is therefore inhibition of FLJ12649 (Accession XP_291344.1). Accordingly, utilities of GAM189 include diagnosis, prevention and treatment of diseases and clinical conditions associated with FLJ12649.

FLJ12687 (Accession NP_079193.2) is another GAM189 target gene, herein designated TARGET GENE. FLJ12687 BINDING SITE is a target binding site found in the 3' untranslated region of mRNA encoded by FLJ12687, corresponding to a target binding site such as BINDING SITE I, BINDING SITE II or BINDING SITE III of FIG. 8. Table 4 illustrates the complementarity of the nucleotide sequences of FLJ12687 BINDING SITE, designated SEQ ID:3324, to the nucleotide sequence of GAM189 RNA, herein designated GAM RNA, also designated SEQ ID:246.

Another function of GAM189 is therefore inhibition of FLJ12687 (Accession NP_079193.2). Accordingly, utilities of GAM189 include diagnosis, prevention and treatment of diseases and clinical conditions associated with FLJ12687.

FLJ12747 (Accession XP_290972.1) is another GAM189 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:10683, to the nucleotide sequence of GAM189 RNA, herein designated GAM RNA, also designated SEQ ID:246.

Another function of GAM189 is therefore inhibition of FLJ12747 (Accession XP_290972.1). Accordingly, utilities of GAM189 include diagnosis, prevention and treatment of diseases and clinical conditions associated with FLJ12747.

FLJ12787 (Accession NP_115551.1) is another GAM189 target gene, herein designated TARGET GENE. FLJ12787 BINDING SITE is a target binding site found in the 3' untranslated region of mRNA encoded by FLJ12787, corresponding to a target binding site such as BINDING SITE I, BINDING SITE II or BINDING SITE III of FIG. 8. Table 4 illustrates the complementarity of the nucleotide sequences of FLJ12787 BINDING SITE, designated SEQ ID:14839, to the nucleotide sequence of GAM189 RNA, herein designated GAM RNA, also designated SEQ ID:246.

Another function of GAM189 is therefore inhibition of FLJ12787 (Accession NP_115551.1). Accordingly, utilities of GAM189 include diagnosis, prevention and treatment of diseases and clinical conditions associated with FLJ12787.

FLJ12800 (Accession NP_075054.1) is another GAM189 target gene, herein designated TARGET GENE. FLJ12800 BINDING SITE is a target binding site found in the 3' untranslated region of mRNA encoded by FLJ12800, corresponding to a target binding site such as BINDING SITE I, BINDING SITE II or BINDING SITE III of FIG. 8. Table 4 illustrates the complementarity of the nucleotide sequences of FLJ12800 BINDING SITE, designated SEQ ID:4261, to the nucleotide sequence of GAM189 RNA, herein designated GAM RNA, also designated SEQ ID:246.

Another function of GAM189 is therefore inhibition of FLJ12800 (Accession NP_075054.1). Accordingly, utilities of GAM189 include diagnosis, prevention and treatment of diseases and clinical conditions associated with FLJ12800.

FLJ12888 (Accession NP_079221.1) is another GAM189 target gene, herein designated TARGET GENE. FLJ12888 BINDING SITE is a target binding site found in the 3' untranslated region of mRNA encoded by FLJ12888, corresponding to a target binding site such as BINDING SITE I, BINDING SITE II or BINDING SITE III of FIG. 8. Table 4 illustrates the complementarity of the nucleotide sequences of FLJ12888 BINDING SITE, designated SEQ ID:17723, to the nucleotide sequence of GAM189 RNA, herein designated GAM RNA, also designated SEQ ID:246.

Another function of GAM189 is therefore inhibition of FLJ12888 (Accession NP_079221.1). Accordingly, utilities of GAM189 include diagnosis, prevention and treatment of diseases and clinical conditions associated with FLJ12888.

FLJ12903 (Accession NP_073590.1) is another GAM189 target gene, herein designated TARGET GENE. FLJ12903 BINDING SITE is a target binding site found in the 3' untranslated region of mRNA encoded by FLJ12903, corresponding to a target binding site such as BINDING SITE I, BINDING SITE II or BINDING SITE III of FIG. 8. Table 4 illustrates the complementarity of the nucleotide sequences of FLJ12903 BINDING SITE, designated SEQ ID:10224, to the nucleotide sequence of GAM189 RNA, herein designated GAM RNA, also designated SEQ ID:246.

Another function of GAM189 is therefore inhibition of FLJ12903 (Accession NP_073590.1). Accordingly, utilities of GAM189 include diagnosis, prevention and treatment of diseases and clinical conditions associated with FLJ12903.

FLJ12960 (Accession NP_078914.1) is another GAM189 target gene, herein designated TARGET GENE. FLJ12960 BINDING SITE is a target binding site found in the 3' untranslated region of mRNA encoded by FLJ12960, corresponding to a target binding site such as BINDING SITE I, BINDING SITE II or BINDING SITE III of FIG. 8. Table 4 illustrates the complementarity of the nucleotide sequences of FLJ12960 BINDING SITE, designated SEQ ID:11523, to the nucleotide sequence of GAM189 RNA, herein designated GAM RNA, also designated SEQ ID:246.

Another function of GAM189 is therefore inhibition of FLJ12960 (Accession NP_078914.1). Accordingly, utilities of GAM189 include diagnosis, prevention and treatment of diseases and clinical conditions associated with FLJ12960.

FLJ12973 (Accession NP_079184.1) is another GAM189 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:5230, to the nucleotide sequence of GAM189 RNA, herein designated GAM RNA, also designated SEQ ID:246.

Another function of GAM189 is therefore inhibition of FLJ12973 (Accession NP_079184.1). Accordingly, utilities of GAM189 include diagnosis, prevention and treatment of diseases and clinical conditions associated with FLJ12973.

FLJ12975 (Accession NP_079085.2) is another GAM189 target gene, herein designated TARGET GENE. FLJ12975 BINDING SITE is a target binding site found in the 3' untranslated region of mRNA encoded by FLJ12975, corresponding to a target binding site such as BINDING SITE I, BINDING SITE II or BINDING SITE III of FIG. 8. Table 4 illustrates the complementarity of the nucleotide sequences of FLJ12975 BINDING SITE, designated SEQ ID:2409, to the nucleotide sequence of GAM189 RNA, herein designated GAM RNA, also designated SEQ ID:246.

Another function of GAM189 is therefore inhibition of FLJ12975 (Accession NP_079085.2). Accordingly, utilities of GAM189 include diagnosis, prevention and treatment of diseases and clinical conditions associated with FLJ12975.

FLJ12986 (Accession XP_290685.1) is another GAM189 target gene, herein designated TARGET GENE. FLJ12986 BINDING SITE is a target binding site found in the 3' untranslated region of mRNA encoded by FLJ12986, corresponding to a target binding site such as BINDING SITE I, BINDING SITE II or BINDING SITE III of FIG. 8. Table 4 illustrates the complementarity of the nucleotide sequences of FLJ12986 BINDING SITE, designated SEQ ID:6037, to the nucleotide sequence of GAM189 RNA, herein designated GAM RNA, also designated SEQ ID:246.

Another function of GAM189 is therefore inhibition of FLJ12986 (Accession XP_290685.1). Accordingly, utilities of GAM189 include diagnosis, prevention and treatment of diseases and clinical conditions associated with FLJ12986.

FLJ13072 (Accession XP_117117.2) is another GAM189 target gene, herein designated TARGET GENE. FLJ13072 BINDING SITE1 and FLJ13072 BINDING SITE2 are target binding sites found in untranslated regions of mRNA encoded by FLJ13072, corresponding to target binding sites such as BINDING SITE I, BINDING SITE II or BINDING SITE III of FIG. 8. Table 4 illustrates the complementarity of the nucleotide sequences of FLJ13072 BINDING SITE1 and FLJ13072 BINDING SITE2, designated SEQ ID:13729 and SEQ ID:2223 respectively, to the nucleotide sequence of GAM189 RNA, herein designated GAM RNA, also designated SEQ ID:246.

Another function of GAM189 is therefore inhibition of FLJ13072 (Accession XP_117117.2). Accordingly, utilities of GAM189 include diagnosis, prevention and treatment of diseases and clinical conditions associated with FLJ13072.

FLJ13114 (Accession NP_078817.1) is another GAM189 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:11919, to the nucleotide sequence of GAM189 RNA, herein designated GAM RNA, also designated SEQ ID:246.

Another function of GAM189 is therefore inhibition of FLJ13114 (Accession NP_078817.1). Accordingly, utilities of GAM189 include diagnosis, prevention and treatment of diseases and clinical conditions associated with FLJ13114.

FLJ13197 (Accession NP_078890.1) is another GAM189 target gene, herein designated TARGET GENE. FLJ13197 BINDING SITE is a target binding site found in the 3' untranslated region of mRNA encoded by FLJ13197, corresponding to a target binding site such as BINDING SITE I, BINDING SITE II or BINDING SITE III of FIG. 8. Table 4 illustrates the complementarity of the nucleotide sequences of FLJ13197 BINDING SITE, designated SEQ ID:8231, to the nucleotide sequence of GAM189 RNA, herein designated GAM RNA, also designated SEQ ID:246.

Another function of GAM189 is therefore inhibition of FLJ13197 (Accession NP_078890.1). Accordingly, utilities of GAM189 include diagnosis, prevention and treatment of diseases and clinical conditions associated with FLJ13197.

FLJ13352 (Accession NP_078868.1) is another GAM189 target gene, herein designated TARGET GENE. FLJ13352 BINDING SITE1 and FLJ13352 BINDING SITE2 are target binding sites found in untranslated regions of mRNA encoded by FLJ13352, corresponding to target binding sites such as BINDING SITE I, BINDING SITE II or BINDING SITE III of FIG. 8. Table 4 illustrates the complementarity of the nucleotide sequences of FLJ13352 BINDING SITE1 and FLJ13352 BINDING SITE2, designated SEQ ID:13318 and SEQ ID:10493 respectively, to the nucleotide sequence of GAM189 RNA, herein designated GAM RNA, also designated SEQ ID:246.

Another function of GAM189 is therefore inhibition of FLJ13352 (Accession NP_078868.1). Accordingly, utilities of GAM189 include diagnosis, prevention and treatment of diseases and clinical conditions associated with FLJ13352.

FLJ13456 (Accession XP_038291.5) is another GAM189 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:8163, to the nucleotide sequence of GAM189 RNA, herein designated GAM RNA, also designated SEQ ID:246.

Another function of GAM189 is therefore inhibition of FLJ13456 (Accession XP_038291.5). Accordingly, utilities of GAM189 include diagnosis, prevention and treatment of diseases and clinical conditions associated with FLJ13456.

FLJ13910 (Accession NP_073617.1) is another GAM189 target gene, herein designated TARGET GENE. FLJ13910 BINDING SITE is a target binding site found in the 3' untranslated region of mRNA encoded by FLJ13910, corresponding to a target binding site such as BINDING SITE I, BINDING SITE II or BINDING SITE III of FIG. 8. Table 4 illustrates the complementarity of the nucleotide sequences of FLJ13910 BINDING SITE, designated SEQ ID:7691, to the nucleotide sequence of GAM189 RNA, herein designated GAM RNA, also designated SEQ ID:246.

Another function of GAM189 is therefore inhibition of FLJ13910 (Accession NP_073617.1). Accordingly, utilities of GAM189 include diagnosis, prevention and treatment of diseases and clinical conditions associated with FLJ13910.

FLJ13984 (Accession NP_079046.1) is another GAM189 target gene, herein designated TARGET GENE. FLJ13984 BINDING SITE1 and FLJ13984 BINDING SITE2 are target binding sites found in untranslated regions of mRNA encoded by FLJ13984, corresponding to target binding sites such as BINDING SITE I, BINDING SITE II or BINDING SITE III of FIG. 8. Table 4 illustrates the complementarity of the nucleotide sequences of FLJ13984 BINDING SITE1 and FLJ13984 BINDING SITE2, designated SEQ ID:10809 and SEQ ID:4819 respectively, to the nucleotide sequence of GAM189 RNA, herein designated GAM RNA, also designated SEQ ID:246.

Another function of GAM189 is therefore inhibition of FLJ13984 (Accession NP_079046.1). Accordingly, utilities of GAM189 include diagnosis, prevention and treatment of diseases and clinical conditions associated with FLJ13984.

FLJ14100 (Accession NP_079301.1) is another GAM189 target gene, herein designated TARGET GENE. FLJ14100 BINDING SITE is a target binding site found in the 3' untranslated region of mRNA encoded by FLJ14100, corresponding to a target binding site such as BINDING SITE I, BINDING SITE II or BINDING SITE III of FIG. 8. Table 4 illustrates the complementarity of the nucleotide sequences of FLJ14100 BINDING SITE, designated SEQ ID:12143, to the nucleotide sequence of GAM189 RNA, herein designated GAM RNA, also designated SEQ ID:246.

Another function of GAM189 is therefore inhibition of FLJ14100 (Accession NP_079301.1). Accordingly, utilities of GAM189 include diagnosis, prevention and treatment of diseases and clinical conditions associated with FLJ14100.

FLJ14260 (Accession NP_079303.2) is another GAM189 target gene, herein designated TARGET GENE. FLJ14260 BINDING SITE is a target binding site found in the 3' untranslated region of mRNA encoded by FLJ14260, corresponding to a target binding site such as BINDING SITE I, BINDING SITE II or BINDING SITE III of FIG. 8. Table 4 illustrates the complementarity of the nucleotide sequences of FLJ14260 BINDING SITE, designated SEQ ID:921, to the nucleotide sequence of GAM189 RNA, herein designated GAM RNA, also designated SEQ ID:246.

Another function of GAM189 is therefore inhibition of FLJ14260 (Accession NP_079303.2). Accordingly, utilities of GAM189 include diagnosis, prevention and treatment of diseases and clinical conditions associated with FLJ14260.

FLJ14351 (Accession NP_079008.1) is another GAM189 target gene, herein designated TARGET GENE. FLJ14351 BINDING SITE is a target binding site found in the 3' untranslated region of mRNA encoded by FLJ14351, corresponding to a target binding site such as BINDING SITE I, BINDING SITE II or BINDING SITE III of FIG. 8. Table 4 illustrates the complementarity of the nucleotide sequences of FLJ14351 BINDING SITE, designated SEQ ID:8586, to the nucleotide sequence of GAM189 RNA, herein designated GAM RNA, also designated SEQ ID:246.

Another function of GAM189 is therefore inhibition of FLJ14351 (Accession NP_079008.1). Accordingly, utilities of GAM189 include diagnosis, prevention and treatment of diseases and clinical conditions associated with FLJ14351.

FLJ14442 (Accession NP_116174.1) is another GAM189 target gene, herein designated TARGET GENE. FLJ14442 BINDING SITE is a target binding site found in the 3' untranslated region of mRNA encoded by FLJ14442, corresponding to a target binding site such as BINDING SITE I, BINDING SITE II or BINDING SITE III of FIG. 8. Table 4 illustrates the complementarity of the nucleotide sequences of FLJ14442 BINDING SITE, designated SEQ ID:16259, to the nucleotide sequence of GAM189 RNA, herein designated GAM RNA, also designated SEQ ID:246.

Another function of GAM189 is therefore inhibition of FLJ14442 (Accession NP_116174.1). Accordingly, utilities of GAM189 include diagnosis, prevention and treatment of diseases and clinical conditions associated with FLJ14442.

FLJ14803 (Accession NP_116231.1) is another GAM189 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:939, to the nucleotide sequence of GAM189 RNA, herein designated GAM RNA, also designated SEQ ID:246.

Another function of GAM189 is therefore inhibition of FLJ14803 (Accession NP_116231.1). Accordingly, utilities of GAM189 include diagnosis, prevention and treatment of diseases and clinical conditions associated with FLJ14803.

FLJ14957 (Accession NP_116255.1) is another GAM189 target gene, herein designated TARGET GENE. FLJ14957 BINDING SITE is a target binding site found in the 3' untranslated region of mRNA encoded by FLJ14957, corresponding to a target binding site such as BINDING SITE I, BINDING SITE II or BINDING SITE III of FIG. 8. Table 4 illustrates the complementarity of the nucleotide sequences of FLJ14957 BINDING SITE, designated SEQ ID:13527, to the nucleotide sequence of GAM189 RNA, herein designated GAM RNA, also designated SEQ ID:246.

Another function of GAM189 is therefore inhibition of FLJ14957 (Accession NP_116255.1). Accordingly, utilities of GAM189 include diagnosis, prevention and treatment of diseases and clinical conditions associated with FLJ14957.

FLJ20045 (Accession NP_060108.1) is another GAM189 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:12557, to the nucleotide sequence of GAM189 RNA, herein designated GAM RNA, also designated SEQ ID:246.

Another function of GAM189 is therefore inhibition of FLJ20045 (Accession NP_060108.1). Accordingly, utilities of GAM189 include diagnosis, prevention and treatment of diseases and clinical conditions associated with FLJ20045.

FLJ20070 (Accession NP_060122.1) is another GAM189 target gene, herein designated TARGET GENE. FLJ20070 BINDING SITE is a target binding site found in the 3' untranslated region of mRNA encoded by FLJ20070, corresponding to a target binding site such as BINDING SITE I, BINDING SITE II or BINDING SITE III of FIG. 8. Table 4 illustrates the complementarity of the nucleotide sequences of FLJ20070 BINDING SITE, designated SEQ ID:7530, to the nucleotide sequence of GAM189 RNA, herein designated GAM RNA, also designated SEQ ID:246.

Another function of GAM189 is therefore inhibition of FLJ20070 (Accession NP_060122.1). Accordingly, utilities of GAM189 include diagnosis, prevention and treatment of diseases and clinical conditions associated with FLJ20070.

FLJ20079 (Accession NP_060126.1) is another GAM189 target gene, herein designated TARGET GENE. FLJ20079 BINDING SITE is a target binding site found in the 3' untranslated region of mRNA encoded by FLJ20079, corresponding to a target binding site such as BINDING SITE I, BINDING SITE II or BINDING SITE III of FIG. 8. Table 4 illustrates the complementarity of the nucleotide sequences of FLJ20079 BINDING SITE, designated SEQ ID:14265, to the nucleotide sequence of GAM189 RNA, herein designated GAM RNA, also designated SEQ ID:246.

Another function of GAM189 is therefore inhibition of FLJ20079 (Accession NP_060126.1). Accordingly, utilities of GAM189 include diagnosis, prevention and treatment of diseases and clinical conditions associated with FLJ20079.

FLJ20095 (Accession NP_060136.1) is another GAM189 target gene, herein designated TARGET GENE. FLJ20095 BINDING SITE is a target binding site found in the 3' untranslated region of mRNA encoded by FLJ20095, corresponding to a target binding site such as BINDING SITE I, BINDING SITE II or BINDING SITE III of FIG. 8. Table 4 illustrates the complementarity of the nucleotide sequences of FLJ20095 BINDING SITE, designated SEQ ID:7385, to the nucleotide sequence of GAM189 RNA, herein designated GAM RNA, also designated SEQ ID:246.

Another function of GAM189 is therefore inhibition of FLJ20095 (Accession NP_060136.1). Accordingly, utilities of GAM189 include diagnosis, prevention and treatment of diseases and clinical conditions associated with FLJ20095.

FLJ20136 (Accession NP_060154.1) is another GAM189 target gene, herein designated TARGET GENE. FLJ20136

BINDING SITE is a target binding site found in the 3' untranslated region of mRNA encoded by FLJ20136, corresponding to a target binding site such as BINDING SITE I, BINDING SITE II or BINDING SITE III of FIG. 8. Table 4 illustrates the complementarity of the nucleotide sequences of FLJ20136 BINDING SITE, designated SEQ ID:4536, to the nucleotide sequence of GAM189 RNA, herein designated GAM RNA, also designated SEQ ID:246.

Another function of GAM189 is therefore inhibition of FLJ20136 (Accession NP_060154.1). Accordingly, utilities of GAM189 include diagnosis, prevention and treatment of diseases and clinical conditions associated with FLJ20136.

FLJ20147 (Accession NP_060157.1) is another GAM189 target gene, herein designated TARGET GENE. FLJ20147 BINDING SITE is a target binding site found in the 3' untranslated region of mRNA encoded by FLJ20147, corresponding to a target binding site such as BINDING SITE I, BINDING SITE II or BINDING SITE III of FIG. 8. Table 4 illustrates the complementarity of the nucleotide sequences of FLJ20147 BINDING SITE, designated SEQ ID:2624, to the nucleotide sequence of GAM189 RNA, herein designated GAM RNA, also designated SEQ ID:246.

Another function of GAM189 is therefore inhibition of FLJ20147 (Accession NP_060157.1). Accordingly, utilities of GAM189 include diagnosis, prevention and treatment of diseases and clinical conditions associated with FLJ20147.

FLJ20245 (Accession NP_060193.1) is another GAM189 target gene, herein designated TARGET GENE. FLJ20245 BINDING SITE1 and FLJ20245 BINDING SITE2 are target binding sites found in untranslated regions of mRNA encoded by FLJ20245, corresponding to target binding sites such as BINDING SITE I, BINDING SITE II or BINDING SITE III of FIG. 8. Table 4 illustrates the complementarity of the nucleotide sequences of FLJ20245 BINDING SITE1 and FLJ20245 BINDING SITE2, designated SEQ ID:5275 and SEQ ID:8581 respectively, to the nucleotide sequence of GAM189 RNA, herein designated GAM RNA, also designated SEQ ID:246.

Another function of GAM189 is therefore inhibition of FLJ20245 (Accession NP_060193.1). Accordingly, utilities of GAM189 include diagnosis, prevention and treatment of diseases and clinical conditions associated with FLJ20245.

FLJ20257 (Accession NP_062552.1) is another GAM189 target gene, herein designated TARGET GENE. FLJ20257 BINDING SITE is a target binding site found in the 3' untranslated region of mRNA encoded by FLJ20257, corresponding to a target binding site such as BINDING SITE I, BINDING SITE II or BINDING SITE III of FIG. 8. Table 4 illustrates the complementarity of the nucleotide sequences of FLJ20257 BINDING SITE, designated SEQ ID:7206, to the nucleotide sequence of GAM189 RNA, herein designated GAM RNA, also designated SEQ ID:246.

Another function of GAM189 is therefore inhibition of FLJ20257 (Accession NP_062552.1). Accordingly, utilities of GAM189 include diagnosis, prevention and treatment of diseases and clinical conditions associated with FLJ20257.

FLJ20344 (Accession NP_060246.1) is another GAM189 target gene, herein designated TARGET GENE. FLJ20344 BINDING SITE is a target binding site found in the 3' untranslated region of mRNA encoded by FLJ20344, corresponding to a target binding site such as BINDING SITE I, BINDING SITE II or BINDING SITE III of FIG. 8. Table 4 illustrates the complementarity of the nucleotide sequences of FLJ20344 BINDING SITE, designated SEQ ID:4079, to the nucleotide sequence of GAM189 RNA, herein designated GAM RNA, also designated SEQ ID:246.

Another function of GAM189 is therefore inhibition of FLJ20344 (Accession NP_060246.1). Accordingly, utilities of GAM189 include diagnosis, prevention and treatment of diseases and clinical conditions associated with FLJ20344.

FLJ20359 (Accession NP_060251.1) is another GAM189 target gene, herein designated TARGET GENE. FLJ20359 BINDING SITE is a target binding site found in the 3' untranslated region of mRNA encoded by FLJ20359, corresponding to a target binding site such as BINDING SITE I, BINDING SITE II or BINDING SITE III of FIG. 8. Table 4 illustrates the complementarity of the nucleotide sequences of FLJ20359 BINDING SITE, designated SEQ ID:11024, to the nucleotide sequence of GAM189 RNA, herein designated GAM RNA, also designated SEQ ID:246.

Another function of GAM189 is therefore inhibition of FLJ20359 (Accession NP_060251.1). Accordingly, utilities of GAM189 include diagnosis, prevention and treatment of diseases and clinical conditions associated with FLJ20359.

FLJ20375 (Accession NP_060264.2) is another GAM189 target gene, herein designated TARGET GENE. FLJ20375 BINDING SITE is a target binding site found in the 3' untranslated region of mRNA encoded by FLJ20375, corresponding to a target binding site such as BINDING SITE I, BINDING SITE II or BINDING SITE III of FIG. 8. Table 4 illustrates the complementarity of the nucleotide sequences of FLJ20375 BINDING SITE, designated SEQ ID:9357, to the nucleotide sequence of GAM189 RNA, herein designated GAM RNA, also designated SEQ ID:246.

Another function of GAM189 is therefore inhibition of FLJ20375 (Accession NP_060264.2). Accordingly, utilities of GAM189 include diagnosis, prevention and treatment of diseases and clinical conditions associated with FLJ20375.

FLJ20511 (Accession NP_060323.1) is another GAM189 target gene, herein designated TARGET GENE. FLJ20511 BINDING SITE is a target binding site found in the 3' untranslated region of mRNA encoded by FLJ20511, corresponding to a target binding site such as BINDING SITE I, BINDING SITE II or BINDING SITE III of FIG. 8. Table 4 illustrates the complementarity of the nucleotide sequences of FLJ20511 BINDING SITE, designated SEQ ID:17759, to the nucleotide sequence of GAM189 RNA, herein designated GAM RNA, also designated SEQ ID:246.

Another function of GAM189 is therefore inhibition of FLJ20511 (Accession NP_060323.1). Accordingly, utilities of GAM189 include diagnosis, prevention and treatment of diseases and clinical conditions associated with FLJ20511.

FLJ20527 (Accession NP_060333.1) is another GAM189 target gene, herein designated TARGET GENE. FLJ20527 BINDING SITE is a target binding site found in the 5' untranslated region of mRNA encoded by FLJ20527, corresponding to a target binding site such as BINDING SITE I, BINDING SITE II or BINDING SITE III of FIG. 8. Table 4 illustrates the complementarity of the nucleotide sequences of FLJ20527 BINDING SITE, designated SEQ ID:17075, to the nucleotide sequence of GAM189 RNA, herein designated GAM RNA, also designated SEQ ID:246.

Another function of GAM189 is therefore inhibition of FLJ20527 (Accession NP_060333.1). Accordingly, utilities of GAM189 include diagnosis, prevention and treatment of diseases and clinical conditions associated with FLJ20527.

FLJ20671 (Accession NP_060394.1) is another GAM189 target gene, herein designated TARGET GENE. FLJ20671 BINDING SITE1 and FLJ20671 BINDING SITE2 are target binding sites found in untranslated regions of mRNA encoded by FLJ20671, corresponding to target binding sites such as BINDING SITE I, BINDING SITE II or BINDING SITE III of FIG. 8. Table 4 illustrates the complementarity of the nucleotide sequences of FLJ20671 BINDING SITE1 and FLJ20671 BINDING SITE2, designated SEQ ID:16491 and SEQ ID:13041 respectively, to the nucleotide sequence of GAM189 RNA, herein designated GAM RNA, also designated SEQ ID:246.

Another function of GAM189 is therefore inhibition of FLJ20671 (Accession NP_060394.1). Accordingly, utilities of GAM189 include diagnosis, prevention and treatment of diseases and clinical conditions associated with FLJ20671.

FLJ20700 (Accession NP_060402.1) is another GAM189 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:18943, to the nucleotide sequence of GAM189 RNA, herein designated GAM RNA, also designated SEQ ID:246.

Another function of GAM189 is therefore inhibition of FLJ20700 (Accession NP_060402.1). Accordingly, utilities of GAM189 include diagnosis, prevention and treatment of diseases and clinical conditions associated with FLJ20700.

FLJ20813 (Accession NP_060431.1) is another GAM189 target gene, herein designated TARGET GENE. FLJ20813 BINDING SITE is a target binding site found in the 3' untranslated region of mRNA encoded by FLJ20813, corresponding to a target binding site such as BINDING SITE I, BINDING SITE II or BINDING SITE III of FIG. 8. Table 4 illustrates the complementarity of the nucleotide sequences of FLJ20813 BINDING SITE, designated SEQ ID:10574, to the nucleotide sequence of GAM189 RNA, herein designated GAM RNA, also designated SEQ ID:246.

Another function of GAM189 is therefore inhibition of FLJ20813 (Accession NP_060431.1). Accordingly, utilities of GAM189 include diagnosis, prevention and treatment of diseases and clinical conditions associated with FLJ20813.

FLJ21128 (Accession NP_079359.2) is another GAM189 target gene, herein designated TARGET GENE. FLJ21128 BINDING SITE is a target binding site found in the 3' untranslated region of mRNA encoded by FLJ21128, corresponding to a target binding site such as BINDING SITE I, BINDING SITE II or BINDING SITE III of FIG. 8. Table 4 illustrates the complementarity of the nucleotide sequences of FLJ21128 BINDING SITE, designated SEQ ID:17516, to the nucleotide sequence of GAM189 RNA, herein designated GAM RNA, also designated SEQ ID:246.

Another function of GAM189 is therefore inhibition of FLJ21128 (Accession NP_079359.2). Accordingly, utilities of GAM189 include diagnosis, prevention and treatment of diseases and clinical conditions associated with FLJ21128.

FLJ21603 (Accession NP_079038.1) is another GAM189 target gene, herein designated TARGET GENE. FLJ21603 BINDING SITE is a target binding site found in the 3' untranslated region of mRNA encoded by FLJ21603, corresponding to a target binding site such as BINDING SITE I, BINDING SITE II or BINDING SITE III of FIG. 8. Table 4 illustrates the complementarity of the nucleotide sequences of FLJ21603 BINDING SITE, designated SEQ ID:15047, to the nucleotide sequence of GAM189 RNA, herein designated GAM RNA, also designated SEQ ID:246.

Another function of GAM189 is therefore inhibition of FLJ21603 (Accession NP_079038.1). Accordingly, utilities of GAM189 include diagnosis, prevention and treatment of diseases and clinical conditions associated with FLJ21603.

FLJ21673 (Accession NP_112160.1) is another GAM189 target gene, herein designated TARGET GENE. FLJ21673 BINDING SITE is a target binding site found in the 5' untranslated region of mRNA encoded by FLJ21673, corresponding to a target binding site such as BINDING SITE I, BINDING SITE II or BINDING SITE III of FIG. 8. Table 4 illustrates the complementarity of the nucleotide sequences of FLJ21673 BINDING SITE, designated SEQ ID:1435, to the nucleotide sequence of GAM189 RNA, herein designated GAM RNA, also designated SEQ ID:246.

Another function of GAM189 is therefore inhibition of FLJ21673 (Accession NP_112160.1). Accordingly, utilities of GAM189 include diagnosis, prevention and treatment of diseases and clinical conditions associated with FLJ21673.

FLJ21777 (Accession NP_115585.1) is another GAM189 target gene, herein designated TARGET GENE. FLJ21777 BINDING SITE is a target binding site found in the 3' untranslated region of mRNA encoded by FLJ21777, corresponding to a target binding site such as BINDING SITE I, BINDING SITE II or BINDING SITE III of FIG. 8. Table 4 illustrates the complementarity of the nucleotide sequences of FLJ21777 BINDING SITE, designated SEQ ID:4203, to the nucleotide sequence of GAM189 RNA, herein designated GAM RNA, also designated SEQ ID:246.

Another function of GAM189 is therefore inhibition of FLJ21777 (Accession NP_115585.1). Accordingly, utilities of GAM189 include diagnosis, prevention and treatment of diseases and clinical conditions associated with FLJ21777.

FLJ22329 (Accession NP_078932.2) is another GAM189 target gene, herein designated TARGET GENE. FLJ22329 BINDING SITE is a target binding site found in the 3' untranslated region of mRNA encoded by FLJ22329, corresponding to a target binding site such as BINDING SITE I, BINDING SITE II or BINDING SITE III of FIG. 8. Table 4 illustrates the complementarity of the nucleotide sequences of FLJ22329 BINDING SITE, designated SEQ ID:9543, to the nucleotide sequence of GAM189 RNA, herein designated GAM RNA, also designated SEQ ID:246.

Another function of GAM189 is therefore inhibition of FLJ22329 (Accession NP_078932.2). Accordingly, utilities of GAM189 include diagnosis, prevention and treatment of diseases and clinical conditions associated with FLJ22329.

FLJ22531 (Accession NP_078926.2) is another GAM189 target gene, herein designated TARGET GENE. FLJ22531 BINDING SITE is a target binding site found in the 5' untranslated region of mRNA encoded by FLJ22531, corresponding to a target binding site such as BINDING SITE I, BINDING SITE II or BINDING SITE III of FIG. 8. Table 4 illustrates the complementarity of the nucleotide sequences of FLJ22531 BINDING SITE, designated SEQ ID:5636, to the nucleotide sequence of GAM189 RNA, herein designated GAM RNA, also designated SEQ ID:246.

Another function of GAM189 is therefore inhibition of FLJ22531 (Accession NP_078926.2). Accordingly, utilities of GAM189 include diagnosis, prevention and treatment of diseases and clinical conditions associated with FLJ22531.

FLJ22794 (Accession NP_071357.1) is another GAM189 target gene, herein designated TARGET GENE. FLJ22794 BINDING SITE is a target binding site found in the 3' untranslated region of mRNA encoded by FLJ22794, corresponding to a target binding site such as BINDING SITE I, BINDING SITE II or BINDING SITE III of FIG. 8. Table 4 illustrates the complementarity of the nucleotide sequences of FLJ22794 BINDING SITE, designated SEQ ID:5559, to the nucleotide sequence of GAM189 RNA, herein designated GAM RNA, also designated SEQ ID:246.

Another function of GAM189 is therefore inhibition of FLJ22794 (Accession NP_071357.1). Accordingly, utilities of GAM189 include diagnosis, prevention and treatment of diseases and clinical conditions associated with FLJ22794.

FLJ22965 (Accession NP_071384.1) is another GAM189 target gene, herein designated TARGET GENE. FLJ22965 BINDING SITE is a target binding site found in the 3' untranslated region of mRNA encoded by FLJ22965, corresponding to a target binding site such as BINDING SITE I, BINDING SITE II or BINDING SITE III of FIG. 8. Table 4 illustrates the complementarity of the nucleotide sequences of FLJ22965 BINDING SITE, designated SEQ ID:2808, to the nucleotide sequence of GAM189 RNA, herein designated GAM RNA, also designated SEQ ID:246.

Another function of GAM189 is therefore inhibition of FLJ22965 (Accession NP_071384.1). Accordingly, utilities of GAM189 include diagnosis, prevention and treatment of diseases and clinical conditions associated with FLJ22965.

FLJ23024 (Accession NP_079212.1) is another GAM189 target gene, herein designated TARGET GENE. FLJ23024 BINDING SITE is a target binding site found in the 3' untranslated region of mRNA encoded by FLJ23024, corresponding to a target binding site such as BINDING SITE I, BINDING SITE II or BINDING SITE III of FIG. 8. Table 4 illustrates the complementarity of the nucleotide sequences of FLJ23024 BINDING SITE, designated SEQ ID:9682, to the nucleotide sequence of GAM189 RNA, herein designated GAM RNA, also designated SEQ ID:246.

Another function of GAM189 is therefore inhibition of FLJ23024 (Accession NP_079212.1). Accordingly, utilities of GAM189 include diagnosis, prevention and treatment of diseases and clinical conditions associated with FLJ23024.

FLJ23053 (Accession NP_075058.1) is another GAM189 target gene, herein designated TARGET GENE. FLJ23053 BINDING SITE is a target binding site found in the 3' untranslated region of mRNA encoded by FLJ23053, corresponding to a target binding site such as BINDING SITE I, BINDING SITE II or BINDING SITE III of FIG. 8. Table 4 illustrates the complementarity of the nucleotide sequences of FLJ23053 BINDING SITE, designated SEQ ID:8693, to the nucleotide sequence of GAM189 RNA, herein designated GAM RNA, also designated SEQ ID:246.

Another function of GAM189 is therefore inhibition of FLJ23053 (Accession NP_075058.1). Accordingly, utilities of GAM189 include diagnosis, prevention and treatment of diseases and clinical conditions associated with FLJ23053.

FLJ23186 (Accession NP_078892.1) is another GAM189 target gene, herein designated TARGET GENE. FLJ23186 BINDING SITE is a target binding site found in the 3' untranslated region of mRNA encoded by FLJ23186, corresponding to a target binding site such as BINDING SITE I, BINDING SITE II or BINDING SITE III of FIG. 8. Table 4 illustrates the complementarity of the nucleotide sequences of FLJ23186 BINDING SITE, designated SEQ ID:1340, to the nucleotide sequence of GAM189 RNA, herein designated GAM RNA, also designated SEQ ID:246.

Another function of GAM189 is therefore inhibition of FLJ23186 (Accession NP_078892.1). Accordingly, utilities of GAM189 include diagnosis, prevention and treatment of diseases and clinical conditions associated with FLJ23186.

FLJ23263 (Accession NP_079391.1) is another GAM189 target gene, herein designated TARGET GENE. FLJ23263 BINDING SITE is a target binding site found in the 5' untranslated region of mRNA encoded by FLJ23263, corresponding to a target binding site such as BINDING SITE I, BINDING SITE II or BINDING SITE III of FIG. 8. Table 4 illustrates the complementarity of the nucleotide sequences of FLJ23263 BINDING SITE, designated SEQ ID:11523, to the nucleotide sequence of GAM189 RNA, herein designated GAM RNA, also designated SEQ ID:246.

Another function of GAM189 is therefore inhibition of FLJ23263 (Accession NP_079391.1). Accordingly, utilities of GAM189 include diagnosis, prevention and treatment of diseases and clinical conditions associated with FLJ23263.

FLJ23356 (Accession NP_115613.1) is another GAM189 target gene, herein designated TARGET GENE. FLJ23356 BINDING SITE is a target binding site found in the 3' untranslated region of mRNA encoded by FLJ23356, corresponding to a target binding site such as BINDING SITE I, BINDING SITE II or BINDING SITE III of FIG. 8. Table 4 illustrates the complementarity of the nucleotide sequences of FLJ23356 BINDING SITE, designated SEQ ID:12273, to the nucleotide sequence of GAM189 RNA, herein designated GAM RNA, also designated SEQ ID:246.

Another function of GAM189 is therefore inhibition of FLJ23356 (Accession NP_115613.1). Accordingly, utilities of GAM189 include diagnosis, prevention and treatment of diseases and clinical conditions associated with FLJ23356.

FLJ23392 (Accession NP_079060.1) is another GAM189 target gene, herein designated TARGET GENE. FLJ23392 BINDING SITE1 through FLJ23392 BINDING SITE3 are target binding sites found in untranslated regions of mRNA encoded by FLJ23392, corresponding to target binding sites such as BINDING SITE I, BINDING SITE II or BINDING SITE III of FIG. 8. Table 4 illustrates the complementarity of the nucleotide sequences of FLJ23392 BINDING SITE1 through FLJ23392 BINDING SITE3, designated SEQ ID:5554, SEQ ID:9148 and SEQ ID:20052 respectively, to the nucleotide sequence of GAM189 RNA, herein designated GAM RNA, also designated SEQ ID:246.

Another function of GAM189 is therefore inhibition of FLJ23392 (Accession NP_079060.1). Accordingly, utilities of GAM189 include diagnosis, prevention and treatment of diseases and clinical conditions associated with FLJ23392.

FLJ23416 (Accession NP_115614.1) is another GAM189 target gene, herein designated TARGET GENE. FLJ23416 BINDING SITE is a target binding site found in the 3' untranslated region of mRNA encoded by FLJ23416, corresponding to a target binding site such as BINDING SITE I, BINDING SITE II or BINDING SITE III of FIG. 8. Table 4 illustrates the complementarity of the nucleotide sequences of FLJ23416 BINDING SITE, designated SEQ ID:2152, to the nucleotide sequence of GAM189 RNA, herein designated GAM RNA, also designated SEQ ID:246.

Another function of GAM189 is therefore inhibition of FLJ23416 (Accession NP_115614.1). Accordingly, utilities of GAM189 include diagnosis, prevention and treatment of diseases and clinical conditions associated with FLJ23416.

FLJ23556 (Accession NP_079156.1) is another GAM189 target gene, herein designated TARGET GENE. FLJ23556 BINDING SITE is a target binding site found in the 3' untranslated region of mRNA encoded by FLJ23556, corresponding to a target binding site such as BINDING SITE I, BINDING SITE II or BINDING SITE III of FIG. 8. Table 4 illustrates the complementarity of the nucleotide sequences of FLJ23556 BINDING SITE, designated SEQ ID:17969, to the nucleotide sequence of GAM189 RNA, herein designated GAM RNA, also designated SEQ ID:246.

Another function of GAM189 is therefore inhibition of FLJ23556 (Accession NP_079156.1). Accordingly, utilities of GAM189 include diagnosis, prevention and treatment of diseases and clinical conditions associated with FLJ23556.

FLJ23563 (Accession XP_041701.4) is another GAM189 target gene, herein designated TARGET GENE. FLJ23563 BINDING SITE is a target binding site found in the 3' untranslated region of mRNA encoded by FLJ23563, corresponding to a target binding site such as BINDING SITE I, BINDING SITE II or BINDING SITE III of FIG. 8. Table 4 illustrates the complementarity of the nucleotide sequences of FLJ23563 BINDING SITE, designated SEQ ID:15048, to the nucleotide sequence of GAM189 RNA, herein designated GAM RNA, also designated SEQ ID:246.

Another function of GAM189 is therefore inhibition of FLJ23563 (Accession XP_041701.4). Accordingly, utilities of GAM189 include diagnosis, prevention and treatment of diseases and clinical conditions associated with FLJ23563.

FLJ23867 (Accession NP_689875.1) is another GAM189 target gene, herein designated TARGET GENE. FLJ23867 BINDING SITE is a target binding site found in the 3' untranslated region of mRNA encoded by FLJ23867, corresponding to a target binding site such as BINDING SITE I, BINDING SITE II or BINDING SITE III of FIG. 8. Table 4 illustrates the complementarity of the nucleotide sequences of FLJ23867 BINDING SITE, designated SEQ ID:1374, to the nucleotide sequence of GAM189 RNA, herein designated GAM RNA, also designated SEQ ID:246.

Another function of GAM189 is therefore inhibition of FLJ23867 (Accession NP_689875.1). Accordingly, utilities of GAM189 include diagnosis, prevention and treatment of diseases and clinical conditions associated with FLJ23867.

FLJ25416 (Accession NP_659455.2) is another GAM189 target gene, herein designated TARGET GENE. FLJ25416 BINDING SITE is a target binding site found in the 5' untranslated region of mRNA encoded by FLJ25416, corresponding to a target binding site such as BINDING SITE I, BINDING SITE II or BINDING SITE III of FIG. 8. Table 4 illustrates the complementarity of the nucleotide sequences of FLJ25416 BINDING SITE, designated SEQ ID:16915, to the nucleotide sequence of GAM189 RNA, herein designated GAM RNA, also designated SEQ ID:246.

Another function of GAM189 is therefore inhibition of FLJ25416 (Accession NP_659455.2). Accordingly, utilities of GAM189 include diagnosis, prevention and treatment of diseases and clinical conditions associated with FLJ25416.

FLJ25795 (Accession NP_689633.1) is another GAM189 target gene, herein designated TARGET GENE. FLJ25795 BINDING SITE is a target binding site found in the 3' untranslated region of mRNA encoded by FLJ25795, corresponding to a target binding site such as BINDING SITE I, BINDING SITE II or BINDING SITE III of FIG. 8. Table 4 illustrates the complementarity of the nucleotide sequences of FLJ25795 BINDING SITE, designated SEQ ID:934, to the nucleotide sequence of GAM189 RNA, herein designated GAM RNA, also designated SEQ ID:246.

Another function of GAM189 is therefore inhibition of FLJ25795 (Accession NP_689633.1). Accordingly, utilities of GAM189 include diagnosis, prevention and treatment of diseases and clinical conditions associated with FLJ25795.

FLJ30507 (Accession NP_694555.1) is another GAM189 target gene, herein designated TARGET GENE. FLJ30507 BINDING SITE is a target binding site found in the 5' untranslated region of mRNA encoded by FLJ30507, corresponding to a target binding site such as BINDING SITE I, BINDING SITE II or BINDING SITE III of FIG. 8. Table 4 illustrates the complementarity of the nucleotide sequences of FLJ30507 BINDING SITE, designated SEQ ID:17957, to the nucleotide sequence of GAM189 RNA, herein designated GAM RNA, also designated SEQ ID:246.

Another function of GAM189 is therefore inhibition of FLJ30507 (Accession NP_694555.1). Accordingly, utilities of GAM189 include diagnosis, prevention and treatment of diseases and clinical conditions associated with FLJ30507.

FLJ30532 (Accession NP_653325.1) is another GAM189 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:19834, to the nucleotide sequence of GAM189 RNA, herein designated GAM RNA, also designated SEQ ID:246.

Another function of GAM189 is therefore inhibition of FLJ30532 (Accession NP_653325.1). Accordingly, utilities of GAM189 include diagnosis, prevention and treatment of diseases and clinical conditions associated with FLJ30532.

FLJ31139 (Accession NP_775928.1) is another GAM189 target gene, herein designated TARGET GENE. FLJ31139 BINDING SITE1 through FLJ31139 BINDING SITE3 are target binding sites found in untranslated regions of mRNA encoded by FLJ31139, corresponding to target binding sites such as BINDING SITE I, BINDING SITE II or BINDING SITE III of FIG. 8. Table 4 illustrates the complementarity of the nucleotide sequences of FLJ31139 BINDING SITE1 through FLJ31139 BINDING SITE3, designated SEQ ID:18868, SEQ ID:15200 and SEQ ID:3952 respectively, to the nucleotide sequence of GAM189 RNA, herein designated GAM RNA, also designated SEQ ID:246.

Another function of GAM189 is therefore inhibition of FLJ31139 (Accession NP_775928.1). Accordingly, utilities of GAM189 include diagnosis, prevention and treatment of diseases and clinical conditions associated with FLJ31139.

FLJ31153 (Accession NP_653201.1) is another GAM189 target gene, herein designated TARGET GENE. FLJ31153 BINDING SITE is a target binding site found in the 3' untranslated region of mRNA encoded by FLJ31153, corresponding to a target binding site such as BINDING SITE I, BINDING SITE II or BINDING SITE III of FIG. 8. Table 4 illustrates the complementarity of the nucleotide sequences of FLJ31153 BINDING SITE, designated SEQ ID:7373, to the nucleotide sequence of GAM189 RNA, herein designated GAM RNA, also designated SEQ ID:246.

Another function of GAM189 is therefore inhibition of FLJ31153 (Accession NP_653201.1). Accordingly, utilities of GAM189 include diagnosis, prevention and treatment of diseases and clinical conditions associated with FLJ31153.

FLJ31166 (Accession NP_694567.1) is another GAM189 target gene, herein designated TARGET GENE. FLJ31166 BINDING SITE is a target binding site found in the 3' untranslated region of mRNA encoded by FLJ31166, corresponding to a target binding site such as BINDING SITE I, BINDING SITE II or BINDING SITE III of FIG. 8. Table 4 illustrates the complementarity of the nucleotide sequences of FLJ31166 BINDING SITE, designated SEQ ID:19301, to the nucleotide sequence of GAM189 RNA, herein designated GAM RNA, also designated SEQ ID:246.

Another function of GAM189 is therefore inhibition of FLJ31166 (Accession NP_694567.1). Accordingly, utilities of GAM189 include diagnosis, prevention and treatment of diseases and clinical conditions associated with FLJ31166.

FLJ31338 (Accession NP_689682.1) is another GAM189 target gene, herein designated TARGET GENE. FLJ31338 BINDING SITE is a target binding site found in the 3' untranslated region of mRNA encoded by FLJ31338, corresponding to a target binding site such as BINDING SITE I, BINDING SITE II or BINDING SITE III of FIG. 8. Table 4 illustrates the complementarity of the nucleotide sequences of FLJ31338 BINDING SITE, designated SEQ ID:1672, to the nucleotide sequence of GAM189 RNA, herein designated GAM RNA, also designated SEQ ID:246.

Another function of GAM189 is therefore inhibition of FLJ31338 (Accession NP_689682.1). Accordingly, utilities of GAM189 include diagnosis, prevention and treatment of diseases and clinical conditions associated with FLJ31338.

FLJ31384 (Accession NP_689685.1) is another GAM189 target gene, herein designated TARGET GENE. FLJ31384 BINDING SITE is a target binding site found in the 3' untranslated region of mRNA encoded by FLJ31384, corresponding to a target binding site such as BINDING SITE I, BINDING SITE II or BINDING SITE III of FIG. 8. Table 4 illustrates the complementarity of the nucleotide sequences of FLJ31384 BINDING SITE, designated SEQ ID:14326, to the nucleotide sequence of GAM189 RNA, herein designated GAM RNA, also designated SEQ ID:246.

Another function of GAM189 is therefore inhibition of FLJ31384 (Accession NP_689685.1). Accordingly, utilities of GAM189 include diagnosis, prevention and treatment of diseases and clinical conditions associated with FLJ31384.

FLJ31393 (Accession NP_694569.1) is another GAM189 target gene, herein designated TARGET GENE. FLJ31393 BINDING SITE is a target binding site found in the 5' untranslated region of mRNA encoded by FLJ31393, corresponding to a target binding site such as BINDING SITE I, BINDING SITE II or BINDING SITE III of FIG. 8. Table 4 illustrates the complementarity of the nucleotide sequences of FLJ31393 BINDING SITE, designated SEQ ID:9670, to the nucleotide sequence of GAM189 RNA, herein designated GAM RNA, also designated SEQ ID:246.

Another function of GAM189 is therefore inhibition of FLJ31393 (Accession NP_694569.1). Accordingly, utilities of GAM189 include diagnosis, prevention and treatment of diseases and clinical conditions associated with FLJ31393.

FLJ31401 (Accession NP_689877.1) is another GAM189 target gene, herein designated TARGET GENE. FLJ31401 BINDING SITE is a target binding site found in the 3' untranslated region of mRNA encoded by FLJ31401, corresponding to a target binding site such as BINDING SITE I, BINDING SITE II or BINDING SITE III of FIG. 8. Table 4 illustrates the complementarity of the nucleotide sequences of FLJ31401 BINDING SITE, designated SEQ ID:16543, to the nucleotide sequence of GAM189 RNA, herein designated GAM RNA, also designated SEQ ID:246.

Another function of GAM189 is therefore inhibition of FLJ31401 (Accession NP_689877.1). Accordingly, utilities of GAM189 include diagnosis, prevention and treatment of diseases and clinical conditions associated with FLJ31401.

FLJ32096 (Accession NP_776156.1) is another GAM189 target gene, herein designated TARGET GENE. FLJ32096 BINDING SITE1 and FLJ32096 BINDING SITE2 are target binding sites found in untranslated regions of mRNA encoded by FLJ32096, corresponding to target binding sites such as BINDING SITE I, BINDING SITE II or BINDING SITE III of FIG. 8. Table 4 illustrates the complementarity of the nucleotide sequences of FLJ32096 BINDING SITE1 and FLJ32096 BINDING SITE2, designated SEQ ID:1025 and SEQ ID:16043 respectively, to the nucleotide sequence of GAM189 RNA, herein designated GAM RNA, also designated SEQ ID:246.

Another function of GAM189 is therefore inhibition of FLJ32096 (Accession NP_776156.1). Accordingly, utilities of GAM189 include diagnosis, prevention and treatment of diseases and clinical conditions associated with FLJ32096.

FLJ32130 (Accession NP_689671.2) is another GAM189 target gene, herein designated TARGET GENE. FLJ32130 BINDING SITE1 through FLJ32130 BINDING SITE3 are target binding sites found in untranslated regions of mRNA encoded by FLJ32130, corresponding to target binding sites such as BINDING SITE I, BINDING SITE II or BINDING SITE III of FIG. 8. Table 4 illustrates the complementarity of the nucleotide sequences of FLJ32130 BINDING SITE1 through FLJ32130 BINDING SITE3, designated SEQ ID:4630, SEQ ID:15049 and SEQ ID:2061 respectively, to the nucleotide sequence of GAM189 RNA, herein designated GAM RNA, also designated SEQ ID:246.

Another function of GAM189 is therefore inhibition of FLJ32130 (Accession NP_689671.2). Accordingly, utilities of GAM189 include diagnosis, prevention and treatment of diseases and clinical conditions associated with FLJ32130.

FLJ32206 (Accession NP_689710.1) is another GAM189 target gene, herein designated TARGET GENE. FLJ32206 BINDING SITE is a target binding site found in the 3' untranslated region of mRNA encoded by FLJ32206, corresponding to a target binding site such as BINDING SITE I, BINDING SITE II or BINDING SITE III of FIG. 8. Table 4 illustrates the complementarity of the nucleotide sequences of FLJ32206 BINDING SITE, designated SEQ ID:3860, to the nucleotide sequence of GAM189 RNA, herein designated GAM RNA, also designated SEQ ID:246.

Another function of GAM189 is therefore inhibition of FLJ32206 (Accession NP_689710.1). Accordingly, utilities of GAM189 include diagnosis, prevention and treatment of diseases and clinical conditions associated with FLJ32206.

FLJ32334 (Accession NP_653166.1) is another GAM189 target gene, herein designated TARGET GENE. FLJ32334 BINDING SITE is a target binding site found in the 3' untranslated region of mRNA encoded by FLJ32334, corresponding to a target binding site such as BINDING SITE I, BINDING SITE II or BINDING SITE III of FIG. 8. Table 4 illustrates the complementarity of the nucleotide sequences of FLJ32334 BINDING SITE, designated SEQ ID:8493, to the nucleotide sequence of GAM189 RNA, herein designated GAM RNA, also designated SEQ ID:246.

Another function of GAM189 is therefore inhibition of FLJ32334 (Accession NP_653166.1). Accordingly, utilities of GAM189 include diagnosis, prevention and treatment of diseases and clinical conditions associated with FLJ32334.

FLJ32499 (Accession NP_653208.1) is another GAM189 target gene, herein designated TARGET GENE. FLJ32499 BINDING SITE is a target binding site found in the 3' untranslated region of mRNA encoded by FLJ32499, corresponding to a target binding site such as BINDING SITE I, BINDING SITE II or BINDING SITE III of FIG. 8. Table 4 illustrates the complementarity of the nucleotide sequences of FLJ32499 BINDING SITE, designated SEQ ID:4681, to the nucleotide sequence of GAM189 RNA, herein designated GAM RNA, also designated SEQ ID:246.

Another function of GAM189 is therefore inhibition of FLJ32499 (Accession NP_653208.1). Accordingly, utilities of GAM189 include diagnosis, prevention and treatment of diseases and clinical conditions associated with FLJ32499.

FLJ32731 (Accession NP_689632.1) is another GAM189 target gene, herein designated TARGET GENE. FLJ32731 BINDING SITE is a target binding site found in the 3' untranslated region of mRNA encoded by FLJ32731, corresponding to a target binding site such as BINDING SITE I, BINDING SITE II or BINDING SITE III of FIG. 8. Table 4 illustrates the complementarity of the nucleotide sequences of FLJ32731 BINDING SITE, designated SEQ ID:16099, to the nucleotide sequence of GAM189 RNA, herein designated GAM RNA, also designated SEQ ID:246.

Another function of GAM189 is therefore inhibition of FLJ32731 (Accession NP_689632.1). Accordingly, utilities of GAM189 include diagnosis, prevention and treatment of diseases and clinical conditions associated with FLJ32731.

FLJ32803 (Accession NP_694584.1) is another GAM189 target gene, herein designated TARGET GENE. FLJ32803 BINDING SITE is a target binding site found in the 3' untranslated region of mRNA encoded by FLJ32803, corresponding to a target binding site such as BINDING SITE I, BINDING SITE II or BINDING SITE III of FIG. 8. Table 4 illustrates the complementarity of the nucleotide sequences of FLJ32803 BINDING SITE, designated SEQ ID:1856, to the nucleotide sequence of GAM189 RNA, herein designated GAM RNA, also designated SEQ ID:246.

Another function of GAM189 is therefore inhibition of FLJ32803 (Accession NP_694584.1). Accordingly, utilities of GAM189 include diagnosis, prevention and treatment of diseases and clinical conditions associated with FLJ32803.

FLJ32865 (Accession NP_653214.1) is another GAM189 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:2146, to the nucleotide sequence of GAM189 RNA, herein designated GAM RNA, also designated SEQ ID:246.

Another function of GAM189 is therefore inhibition of FLJ32865 (Accession NP_653214.1). Accordingly, utilities of GAM189 include diagnosis, prevention and treatment of diseases and clinical conditions associated with FLJ32865.

FLJ32894 (Accession NP_653268.1) is another GAM189 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:7467, to the nucleotide sequence of GAM189 RNA, herein designated GAM RNA, also designated SEQ ID:246.

Another function of GAM189 is therefore inhibition of FLJ32894 (Accession NP_653268.1). Accordingly, utilities of GAM189 include diagnosis, prevention and treatment of diseases and clinical conditions associated with FLJ32894.

FLJ32932 (Accession NP_690873.1) is another GAM189 target gene, herein designated TARGET GENE. FLJ32932 BINDING SITE is a target binding site found in the 3' untranslated region of mRNA encoded by FLJ32932, corresponding to a target binding site such as BINDING SITE I, BINDING SITE II or BINDING SITE III of FIG. 8. Table 4 illustrates the complementarity of the nucleotide sequences of FLJ32932 BINDING SITE, designated SEQ ID:9555, to the nucleotide sequence of GAM189 RNA, herein designated GAM RNA, also designated SEQ ID:246.

Another function of GAM189 is therefore inhibition of FLJ32932 (Accession NP_690873.1). Accordingly, utilities of GAM189 include diagnosis, prevention and treatment of diseases and clinical conditions associated with FLJ32932.

FLJ33505 (Accession NP_689530.1) is another GAM189 target gene, herein designated TARGET GENE. FLJ33505 BINDING SITE is a target binding site found in the 3' untranslated region of mRNA encoded by FLJ33505, corresponding to a target binding site such as BINDING SITE I, BINDING SITE II or BINDING SITE III of FIG. 8. Table 4 illustrates the complementarity of the nucleotide sequences of FLJ33505 BINDING SITE, designated SEQ ID:13693, to the nucleotide sequence of GAM189 RNA, herein designated GAM RNA, also designated SEQ ID:246.

Another function of GAM189 is therefore inhibition of FLJ33505 (Accession NP_689530.1). Accordingly, utilities of GAM189 include diagnosis, prevention and treatment of diseases and clinical conditions associated with FLJ33505.

FLJ33655 (Accession NP_775912.1) is another GAM189 target gene, herein designated TARGET GENE. FLJ33655 BINDING SITE is a target binding site found in the 3' untranslated region of mRNA encoded by FLJ33655, corresponding to a target binding site such as BINDING SITE I, BINDING SITE II or BINDING SITE III of FIG. 8. Table 4 illustrates the complementarity of the nucleotide sequences of FLJ33655 BINDING SITE, designated SEQ ID:16113, to the nucleotide sequence of GAM189 RNA, herein designated GAM RNA, also designated SEQ ID:246.

Another function of GAM189 is therefore inhibition of FLJ33655 (Accession NP_775912.1). Accordingly, utilities of GAM189 include diagnosis, prevention and treatment of diseases and clinical conditions associated with FLJ33655.

FLJ34817 (Accession NP_689516.1) is another GAM189 target gene, herein designated TARGET GENE. FLJ34817 BINDING SITE1 and FLJ34817 BINDING SITE2 are target binding sites found in untranslated regions of mRNA encoded by FLJ34817, corresponding to target binding sites such as BINDING SITE I, BINDING SITE II or BINDING SITE III of FIG. 8. Table 4 illustrates the complementarity of the nucleotide sequences of FLJ34817 BINDING SITE1 and FLJ34817 BINDING SITE2, designated SEQ ID:4004 and SEQ ID:7075 respectively, to the nucleotide sequence of GAM189 RNA, herein designated GAM RNA, also designated SEQ ID:246.

Another function of GAM189 is therefore inhibition of FLJ34817 (Accession NP_689516.1). Accordingly, utilities of GAM189 include diagnosis, prevention and treatment of diseases and clinical conditions associated with FLJ34817.

FLJ34922 (Accession NP_689483.1) is another GAM189 target gene, herein designated TARGET GENE. FLJ34922 BINDING SITE is a target binding site found in the 5' untranslated region of mRNA encoded by FLJ34922, corresponding to a target binding site such as BINDING SITE I, BINDING SITE II or BINDING SITE III of FIG. 8. Table 4 illustrates the complementarity of the nucleotide sequences of FLJ34922 BINDING SITE, designated SEQ ID:18132, to the nucleotide sequence of GAM189 RNA, herein designated GAM RNA, also designated SEQ ID:246.

Another function of GAM189 is therefore inhibition of FLJ34922 (Accession NP_689483.1). Accordingly, utilities of GAM189 include diagnosis, prevention and treatment of diseases and clinical conditions associated with FLJ34922.

FLJ34969 (Accession XP_114353.1) is another GAM189 target gene, herein designated TARGET GENE. FLJ34969 BINDING SITE is a target binding site found in the 3' untranslated region of mRNA encoded by FLJ34969, corresponding to a target binding site such as BINDING SITE I, BINDING SITE II or BINDING SITE III of FIG. 8. Table 4 illustrates the complementarity of the nucleotide sequences of FLJ34969 BINDING SITE, designated SEQ ID:581, to the nucleotide sequence of GAM189 RNA, herein designated GAM RNA, also designated SEQ ID:246.

Another function of GAM189 is therefore inhibition of FLJ34969 (Accession XP_114353.1). Accordingly, utilities of GAM189 include diagnosis, prevention and treatment of diseases and clinical conditions associated with FLJ34969.

FLJ35105 (Accession NP_689890.1) is another GAM189 target gene, herein designated TARGET GENE. FLJ35105 BINDING SITE is a target binding site found in the 5' untranslated region of mRNA encoded by FLJ35105, corresponding to a target binding site such as BINDING SITE I, BINDING SITE II or BINDING SITE III of FIG. 8. Table 4 illustrates the complementarity of the nucleotide sequences of FLJ35105 BINDING SITE, designated SEQ ID:18938, to the nucleotide sequence of GAM189 RNA, herein designated GAM RNA, also designated SEQ ID:246.

Another function of GAM189 is therefore inhibition of FLJ35105 (Accession NP_689890.1). Accordingly, utilities of GAM189 include diagnosis, prevention and treatment of diseases and clinical conditions associated with FLJ35105.

FLJ35681 (Accession NP_787096.1) is another GAM189 target gene, herein designated TARGET GENE. FLJ35681 BINDING SITE1 and FLJ35681 BINDING SITE2 are target binding sites found in untranslated regions of mRNA encoded by FLJ35681, corresponding to target binding sites such as BINDING SITE I, BINDING SITE II or BINDING SITE III of FIG. 8. Table 4 illustrates the complementarity of the nucleotide sequences of FLJ35681 BINDING SITE1 and FLJ35681 BINDING SITE2, designated SEQ ID:1653 and SEQ ID:11521 respectively, to the nucleotide sequence of GAM189 RNA, herein designated GAM RNA, also designated SEQ ID:246.

Another function of GAM189 is therefore inhibition of FLJ35681 (Accession NP_787096.1). Accordingly, utilities of GAM189 include diagnosis, prevention and treatment of diseases and clinical conditions associated with FLJ35681.

FLJ35848 (Accession XP_290755.1) is another GAM189 target gene, herein designated TARGET GENE. FLJ35848 BINDING SITE is a target binding site found in the 3' untranslated region of mRNA encoded by FLJ35848, corresponding to a target binding site such as BINDING SITE I, BINDING SITE II or BINDING SITE III of FIG. 8. Table 4 illustrates the complementarity of the nucleotide sequences of FLJ35848 BINDING SITE, designated SEQ ID:14986, to the nucleotide sequence of GAM189 RNA, herein designated GAM RNA, also designated SEQ ID:246.

Another function of GAM189 is therefore inhibition of FLJ35848 (Accession XP_290755.1). Accordingly, utilities of GAM189 include diagnosis, prevention and treatment of diseases and clinical conditions associated with FLJ35848.

FLJ36445 (Accession NP_694965.1) is another GAM189 target gene, herein designated TARGET GENE. FLJ36445 BINDING SITE is a target binding site found in the 3' untranslated region of mRNA encoded by FLJ36445, corresponding to a target binding site such as BINDING SITE I, BINDING SITE II or BINDING SITE III of FIG. 8. Table 4 illustrates the complementarity of the nucleotide sequences of FLJ36445 BINDING SITE, designated SEQ ID:2147, to the nucleotide sequence of GAM189 RNA, herein designated GAM RNA, also designated SEQ ID:246.

Another function of GAM189 is therefore inhibition of FLJ36445 (Accession NP_694965.1). Accordingly, utilities of GAM189 include diagnosis, prevention and treatment of diseases and clinical conditions associated with FLJ36445.

FLJ37045 (Accession NP_787085.1) is another GAM189 target gene, herein designated TARGET GENE. FLJ37045 BINDING SITE is a target binding site found in the 3' untranslated region of mRNA encoded by FLJ37045, corresponding to a target binding site such as BINDING SITE I, BINDING SITE II or BINDING SITE III of FIG. 8. Table 4 illustrates the complementarity of the nucleotide sequences of FLJ37045 BINDING SITE, designated SEQ ID:9497, to the nucleotide sequence of GAM189 RNA, herein designated GAM RNA, also designated SEQ ID:246.

Another function of GAM189 is therefore inhibition of FLJ37045 (Accession NP_787085.1). Accordingly, utilities of GAM189 include diagnosis, prevention and treatment of diseases and clinical conditions associated with FLJ37045.

FLJ37078 (Accession NP_694588.1) is another GAM189 target gene, herein designated TARGET GENE. FLJ37078 BINDING SITE is a target binding site found in the 5' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:11528, to the nucleotide sequence of GAM189 RNA, herein designated GAM RNA, also designated SEQ ID:246.

Another function of GAM189 is therefore inhibition of FLJ37078 (Accession NP_694588.1). Accordingly, utilities of GAM189 include diagnosis, prevention and treatment of diseases and clinical conditions associated with FLJ37078.

FLJ37433 (Accession NP_848612.1) is another GAM189 target gene, herein designated TARGET GENE. FLJ37433 BINDING SITE is a target binding site found in the 3' untranslated region of mRNA encoded by FLJ37433, corresponding to a target binding site such as BINDING SITE I, BINDING SITE II or BINDING SITE III of FIG. 8. Table 4 illustrates the complementarity of the nucleotide sequences of FLJ37433 BINDING SITE, designated SEQ ID:8582, to the nucleotide sequence of GAM189 RNA, herein designated GAM RNA, also designated SEQ ID:246.

Another function of GAM189 is therefore inhibition of FLJ37433 (Accession NP_848612.1). Accordingly, utilities of GAM189 include diagnosis, prevention and treatment of diseases and clinical conditions associated with FLJ37433.

FLJ37543 (Accession NP_775938.1) is another GAM189 target gene, herein designated TARGET GENE. FLJ37543 BINDING SITE is a target binding site found in the 3' untranslated region of mRNA encoded by FLJ37543, corresponding to a target binding site such as BINDING SITE I, BINDING SITE II or BINDING SITE III of FIG. 8. Table 4 illustrates the complementarity of the nucleotide sequences of FLJ37543 BINDING SITE, designated SEQ ID:5495, to the nucleotide sequence of GAM189 RNA, herein designated GAM RNA, also designated SEQ ID:246.

Another function of GAM189 is therefore inhibition of FLJ37543 (Accession NP_775938.1). Accordingly, utilities of GAM189 include diagnosis, prevention and treatment of diseases and clinical conditions associated with FLJ37543.

FLJ38101 (Accession NP_694993.2) is another GAM189 target gene, herein designated TARGET GENE. FLJ38101 BINDING SITE is a target binding site found in the 3' untranslated region of mRNA encoded by FLJ38101, corresponding to a target binding site such as BINDING SITE I, BINDING SITE II or BINDING SITE III of FIG. 8. Table 4 illustrates the complementarity of the nucleotide sequences of FLJ38101 BINDING SITE, designated SEQ ID:5589, to the nucleotide sequence of GAM189 RNA, herein designated GAM RNA, also designated SEQ ID:246.

Another function of GAM189 is therefore inhibition of FLJ38101 (Accession NP_694993.2). Accordingly, utilities of GAM189 include diagnosis, prevention and treatment of diseases and clinical conditions associated with FLJ38101.

FLJ38149 (Accession XP_091919.5) is another GAM189 target gene, herein designated TARGET GENE. FLJ38149 BINDING SITE1 through FLJ38149 BINDING SITE3 are target binding sites found in untranslated regions of mRNA encoded by FLJ38149, corresponding to target binding sites such as BINDING SITE I, BINDING SITE II or BINDING SITE III of FIG. 8. Table 4 illustrates the complementarity of the nucleotide sequences of FLJ38149 BINDING SITE1 through FLJ38149 BINDING SITE3, designated SEQ ID:18971, SEQ ID:9373 and SEQ ID:15044 respectively, to the nucleotide sequence of GAM189 RNA, herein designated GAM RNA, also designated SEQ ID:246.

Another function of GAM189 is therefore inhibition of FLJ38149 (Accession XP_091919.5). Accordingly, utilities of GAM189 include diagnosis, prevention and treatment of diseases and clinical conditions associated with FLJ38149.

FLJ38281 (Accession NP_689814.1) is another GAM189 target gene, herein designated TARGET GENE. FLJ38281 BINDING SITE1 and FLJ38281 BINDING SITE2 are target binding sites found in untranslated regions of mRNA encoded by FLJ38281, corresponding to target binding sites such as BINDING SITE I, BINDING SITE II or BINDING SITE III of FIG. 8. Table 4 illustrates the complementarity of the nucleotide sequences of FLJ38281 BINDING SITE1 and FLJ38281 BINDING SITE2, designated SEQ ID:6885 and SEQ ID:9492 respectively, to the nucleotide sequence of GAM189 RNA, herein designated GAM RNA, also designated SEQ ID:246.

Another function of GAM189 is therefore inhibition of FLJ38281 (Accession NP_689814.1). Accordingly, utilities of GAM189 include diagnosis, prevention and treatment of diseases and clinical conditions associated with FLJ38281.

FLJ38607 (Accession NP_689867.1) is another GAM189 target gene, herein designated TARGET GENE. FLJ38607 BINDING SITE1 and FLJ38607 BINDING SITE2 are target binding sites found in untranslated regions of mRNA encoded by FLJ38607, corresponding to target binding sites such as BINDING SITE I, BINDING SITE II or BINDING SITE III of FIG. 8. Table 4 illustrates the complementarity of the nucleotide sequences of FLJ38607 BINDING SITE1 and FLJ38607 BINDING SITE2, designated SEQ ID:16688 and SEQ ID:7382 respectively, to the nucleotide sequence of GAM189 RNA, herein designated GAM RNA, also designated SEQ ID:246.

Another function of GAM189 is therefore inhibition of FLJ38607 (Accession NP_689867.1). Accordingly, utilities of GAM189 include diagnosis, prevention and treatment of diseases and clinical conditions associated with FLJ38607.

FLJ38792 (Accession NP_848615.1) is another GAM189 target gene, herein designated TARGET GENE. FLJ38792 BINDING SITE is a target binding site found in the 3' untranslated region of mRNA encoded by FLJ38792, corresponding to a target binding site such as BINDING SITE I, BINDING SITE II or BINDING SITE III of FIG. 8. Table 4 illustrates the complementarity of the nucleotide sequences of FLJ38792 BINDING SITE, designated SEQ ID:14861, to the nucleotide sequence of GAM189 RNA, herein designated GAM RNA, also designated SEQ ID:246.

Another function of GAM189 is therefore inhibition of FLJ38792 (Accession NP_848615.1). Accordingly, utilities of GAM189 include diagnosis, prevention and treatment of diseases and clinical conditions associated with FLJ38792.

FLJ38819 (Accession NP_665872.1) is another GAM189 target gene, herein designated TARGET GENE. FLJ38819 BINDING SITE1 and FLJ38819 BINDING SITE2 are target binding sites found in untranslated regions of mRNA encoded by FLJ38819, corresponding to target binding sites such as BINDING SITE I, BINDING SITE II or BINDING SITE III of FIG. 8. Table 4 illustrates the complementarity of the nucleotide sequences of FLJ38819 BINDING SITE1 and FLJ38819 BINDING SITE2, designated SEQ ID:18642 and SEQ ID:9791 respectively, to the nucleotide sequence of GAM189 RNA, herein designated GAM RNA, also designated SEQ ID:246.

Another function of GAM189 is therefore inhibition of FLJ38819 (Accession NP_665872.1). Accordingly, utilities of GAM189 include diagnosis, prevention and treatment of diseases and clinical conditions associated with FLJ38819.

FLJ38991 (Accession NP_776188.1) is another GAM189 target gene, herein designated TARGET GENE. FLJ38991 BINDING SITE1 and FLJ38991 BINDING SITE2 are target binding sites found in untranslated regions of mRNA encoded by FLJ38991, corresponding to target binding sites such as BINDING SITE I, BINDING SITE II or BINDING SITE III of FIG. 8. Table 4 illustrates the complementarity of the nucleotide sequences of FLJ38991 BINDING SITE1 and FLJ38991 BINDING SITE2, designated SEQ ID:10356 and SEQ ID:14236 respectively, to the nucleotide sequence of GAM189 RNA, herein designated GAM RNA, also designated SEQ ID:246.

Another function of GAM189 is therefore inhibition of FLJ38991 (Accession NP_776188.1). Accordingly, utilities of GAM189 include diagnosis, prevention and treatment of diseases and clinical conditions associated with FLJ38991.

FLJ39415 (Accession NP_775952.1) is another GAM189 target gene, herein designated TARGET GENE. FLJ39415 BINDING SITE is a target binding site found in the 3' untranslated region of mRNA encoded by FLJ39415, corresponding to a target binding site such as BINDING SITE I, BINDING SITE II or BINDING SITE III of FIG. 8. Table 4 illustrates the complementarity of the nucleotide sequences of FLJ39415 BINDING SITE, designated SEQ ID:11673, to the nucleotide sequence of GAM189 RNA, herein designated GAM RNA, also designated SEQ ID:246.

Another function of GAM189 is therefore inhibition of FLJ39415 (Accession NP_775952.1). Accordingly, utilities of GAM189 include diagnosis, prevention and treatment of diseases and clinical conditions associated with FLJ39415.

FLJ39599 (Accession NP_776164.1) is another GAM189 target gene, herein designated TARGET GENE. FLJ39599 BINDING SITE1 and FLJ39599 BINDING SITE2 are target binding sites found in untranslated regions of mRNA encoded by FLJ39599, corresponding to target binding sites such as BINDING SITE I, BINDING SITE II or BINDING SITE III of FIG. 8. Table 4 illustrates the complementarity of the nucleotide sequences of FLJ39599 BINDING SITE1 and FLJ39599 BINDING SITE2, designated SEQ ID:16001 and SEQ ID:8232 respectively, to the nucleotide sequence of GAM189 RNA, herein designated GAM RNA, also designated SEQ ID:246.

Another function of GAM189 is therefore inhibition of FLJ39599 (Accession NP_776164.1). Accordingly, utilities of GAM189 include diagnosis, prevention and treatment of diseases and clinical conditions associated with FLJ39599.

FLJ39639 (Accession XP_290687.1) is another GAM189 target gene, herein designated TARGET GENE. FLJ39639 BINDING SITE is a target binding site found in the 3' untranslated region of mRNA encoded by FLJ39639, corresponding to a target binding site such as BINDING SITE I, BINDING SITE II or BINDING SITE III of FIG. 8. Table 4 illustrates the complementarity of the nucleotide sequences of FLJ39639 BINDING SITE, designated SEQ ID:9190, to the nucleotide sequence of GAM189 RNA, herein designated GAM RNA, also designated SEQ ID:246.

Another function of GAM189 is therefore inhibition of FLJ39639 (Accession XP_290687.1). Accordingly, utilities of GAM189 include diagnosis, prevention and treatment of diseases and clinical conditions associated with FLJ39639.

FLJ90231 (Accession NP_775852.1) is another GAM189 target gene, herein designated TARGET GENE. FLJ90231 BINDING SITE is a target binding site found in the 3' untranslated region of mRNA encoded by FLJ90231, corresponding to a target binding site such as BINDING SITE I, BINDING SITE II or BINDING SITE III of FIG. 8. Table 4 illustrates the complementarity of the nucleotide sequences of FLJ90231 BINDING SITE, designated SEQ ID:10357, to the nucleotide sequence of GAM189 RNA, herein designated GAM RNA, also designated SEQ ID:246.

Another function of GAM189 is therefore inhibition of FLJ90231 (Accession NP_775852.1). Accordingly, utilities of GAM189 include diagnosis, prevention and treatment of diseases and clinical conditions associated with FLJ90231.

FLJ90723 (Accession NP_787115.1) is another GAM189 target gene, herein designated TARGET GENE. FLJ90723 BINDING SITE is a target binding site found in the 3' untranslated region of mRNA encoded by FLJ90723, corresponding to a target binding site such as BINDING SITE I, BINDING SITE II or BINDING SITE III of FIG. 8. Table 4 illustrates the complementarity of the nucleotide sequences of FLJ90723 BINDING SITE, designated SEQ ID:19889, to the nucleotide sequence of GAM189 RNA, herein designated GAM RNA, also designated SEQ ID:246.

Another function of GAM189 is therefore inhibition of FLJ90723 (Accession NP_787115.1). Accordingly, utilities of GAM189 include diagnosis, prevention and treatment of diseases and clinical conditions associated with FLJ90723.

Formin binding protein 1 (FNBP1, Accession XP_052666.3) is another GAM189 target gene, herein designated TARGET GENE. FNBP1 BINDING SITE is a target binding site found in the 3' untranslated region of mRNA encoded by FNBP1, corresponding to a target binding site such as BINDING SITE I, BINDING SITE II or BINDING SITE III of FIG. 8. Table 4 illustrates the complementarity of the nucleotide sequences of FNBP1 BINDING SITE, designated SEQ ID:16354, to the nucleotide sequence of GAM189 RNA, herein designated GAM RNA, also designated SEQ ID:246.

Another function of GAM189 is therefore inhibition of Formin binding protein 1 (FNBP1, Accession XP_052666.3). Accordingly, utilities of GAM189 include diagnosis, prevention and treatment of diseases and clinical conditions associated with FNBP1.

Forkhead box e2 (FOXE2, Accession NP_036317.1) is another GAM189 target gene, herein designated TARGET GENE. FOXE2 BINDING SITE is a target binding site found in the 5' untranslated region of mRNA encoded by FOXE2, corresponding to a target binding site such as BINDING SITE I, BINDING SITE II or BINDING SITE III of FIG. 8. Table 4 illustrates the complementarity of the nucleotide sequences of FOXE2 BINDING SITE, designated SEQ ID:15626, to the nucleotide sequence of GAM189 RNA, herein designated GAM RNA, also designated SEQ ID:246.

Another function of GAM189 is therefore inhibition of Forkhead box e2 (FOXE2, Accession NP_036317.1). Accordingly, utilities of GAM189 include diagnosis, prevention and treatment of diseases and clinical conditions associated with FOXE2.

Forkhead box o1a (rhabdomyosarcoma) (FOXO1A, Accession NP_002006.2) is another GAM189 target gene, herein designated TARGET GENE. FOXO1A BINDING SITE is a target binding site found in the 3' untranslated region of mRNA encoded by FOXO1A, corresponding to a target binding site such as BINDING SITE I, BINDING SITE II or BINDING SITE III of FIG. 8. Table 4 illustrates the complementarity of the nucleotide sequences of FOXO1A BINDING SITE, designated SEQ ID:736, to the nucleotide sequence of GAM189 RNA, herein designated GAM RNA, also designated SEQ ID:246.

Another function of GAM189 is therefore inhibition of Forkhead box o1a (rhabdomyosarcoma) (FOXO1A, Accession NP_002006.2), a gene which is a probable transcription factor. and therefore may be associated with Alveolar rhabdomyosarcoma-2. Accordingly, utilities of GAM189 include diagnosis, prevention and treatment of Alveolar rhabdomyosarcoma-2., and of other diseases and clinical conditions associated with FOXO1A.

The function of FOXO1A has been established by previous studies. In alveolar rhabdomyosarcoma, the translocation t(2;13)(q35;q14) is frequently found. Barr et al. (1993) determined that PAX3 (OMIM Ref. No. 606597), which had previously been found to be mutated in Waardenburg syndrome (OMIM Ref. No. 193500), was affected by this t(2;13) in alveolar rhabdomyosarcoma (OMIM Ref. No. 268220). Galili et al. (1993) isolated the chromosome 13 gene that is fused with PAX3. The rearrangement breakpoints occurred within an intron downstream of the paired box and homeodomain-encoding regions. and identified it as a member of the forkhead domain family, which encodes transcription factors containing a conserved DNA-binding motif related to the Drosophila region-specific homeotic gene 'forkhead.' The distal half of the forkhead and the C-terminal region of the FKHR gene are involved in the chimeric transcript and fusion protein. (Because of the homology to 'forkhead,' the gene was symbolized FKHR, for 'forkhead' in rhabdomyosarcoma.) See human T-cell leukemia virus enhancer factor (OMIM Ref. No. 143089) and interleukin enhancer binding factor (OMIM Ref. No. 147685) for other members of the forkhead domain family of transcription factors. Fredericks et al. (1995) demonstrated expression of a 97-kD PAX3/FKHR fusion protein in a t(2;13)-positive rhabdomyosarcoma cell line and verified that a single polypeptide contained epitopes derived from each protein. The fusion protein was localized to the nucleus in these cells, as was wildtype PAX3 in cells lacking the translocation. They found that DNA binding of the fusion protein was significantly impaired relative to that of PAX3 despite the fact that the 2 proteins had identical PAX DNA-binding domains. However, the fusion protein was a much more potent transcriptional activator than PAX3. Thus, the fusion protein may function as an oncogenic transcription factor by enhancing activation of normal PAX3 target genes.

Full details of the abovementioned studies are described in the following publications, the disclosure of which are hereby incorporated by reference:

Barr, F. G.; Galili, N.; Holick, J.; Biegel, J. A.; Rovera, G.; Emanuel, B. S.: Rearrangement of the PAX3 paired box gene in the paediatric solid tumor alveolar rhabdomyosarcoma. Nature Genet. 3:113-117, 1993; and Fredericks, W. J.; Galili, N.; Mukhopadhyay, S.; Rovera, G.; Bennicelli, J.; Barr, F. G.; Rauscher, F. J., III: The PAX3-FKHR fusion protein created by the t(2;13) translocation in alve.

Further studies establishing the function and utilities of FOXO1A are found in John Hopkins OMIM database record ID 136533, and in cited publications listed in Table 5, which are hereby incorporated by reference. Fsh primary response (lrpr1 homolog, rat) 1 (FSHPRH1, Accession NP_006724.1) is another GAM189 target gene, herein designated TARGET GENE. FSHPRH1 BINDING SITE is a target binding site found in the 5' untranslated region of mRNA encoded by FSHPRH1, corresponding to a target binding site such as BINDING SITE I, BINDING SITE II or BINDING SITE III of FIG. 8. Table 4 illustrates the complementarity of the nucleotide sequences of FSHPRH1 BINDING SITE, designated SEQ ID:11528, to the nucleotide sequence of GAM189 RNA, herein designated GAM RNA, also designated SEQ ID:246.

Another function of GAM189 is therefore inhibition of Fsh primary response (lrpr1 homolog, rat) 1 (FSHPRH1, Accession NP_006724.1), a gene which is involved in the response of gonadal tissues to follicle- stimulating hormone. and therefore may be associated with Hypergonadotropic ovarian dysgenesis (odg), x-linked disorders of gonadal development. Accordingly, utilities of GAM189 include diagnosis, prevention and treatment of Hypergonadotropic ovarian dysgenesis (odg), x-linked disorders of gonadal development, and of other diseases and clinical conditions associated with FSH-PRH1.

The function of FSHPRH1 has been established by previous studies. Follicle- stimulating hormone (FSH; 136530), a gonadotropic hormone secreted by both the male and the female mammalian anterior pituitary gland, is responsible, with luteinizing hormone (OMIM Ref. No. 152780), for the regulation of follicular maturation and ovulation in females. Loss-of-function mutations in the FSH receptor gene (OMIM Ref. No. 136435) are associated with hypergonadotropic ovarian dysgenesis (ODG) in which inability of the gonads to respond to FSH results in failure of ovarian development with consequent primary amenorrhea; lack of negative feedback to the pituitary leads to the observed high levels of gonadotropins. Mutation of the gene for the beta subunit of FSH (136530.0001) has also been described in a patient with primary amenorrhea who was able to conceive after administration of FSH. Although there may be a role for FSH also in male gonadal development at puberty, fertility appears not to be compromised in known homozygous male relatives of ODG females (Aittomaki et al., 1995). Roberts et al. (1996) hypothesized that mutations in genes encoding other components of the FSH signaling pathway might be responsible for other cases of female or even male disorders of gonadal development. The rat gene called leucine-rich primary response gene 1 (LRPR1) is rapidly transcriptionally activated in response to FSH stimulation of rat testicular Sertoli cells, both in vitro and in vivo (Slegtenhorst- Eegdeman et al., 1995). Roberts et al. (1996) characterized a human transcript that probably encodes the ortholog of the rat protein. The gene encodes a 756-amino acid polypeptide with 72% identity to rat LRPR1 at the amino acid level. The gene maps to human chromosome Xq22 and therefore is a potential candidate for human X-linked disorders of gonadal development. The human LRPR1 gene (also symbolized FSHPRH1) was isolated during characterization of a gene encoding dystrophin-related protein 2 (DRP2; 300052); searches of sequence databases using the BLAST program revealed the similarities to rat LRPR1. Other evidence indicated that LRPR1 and DRP2, which maps to Xq22, are closely situated. Roberts et al. (1996) found by hybridization to YACs and to cosmids isolated from that region that LRPR1 is transcribed in a proximal- to - distal direction and lies approximately 40 kb proximal to DRP2, while BTK (OMIM Ref. No. 300300), the gene that is mutant and X-linked agammaglobulinemia, lies approximately 300 kb distal.

Full details of the abovementioned studies are described in the following publications, the disclosure of which are hereby incorporated by reference:

Aittomaki, K.; Lucena, J. L. D.; Pakarinen, P.; Sistonen, P.; Tapanainen, J.; Gromoll, J.; Kaskikari, R.; Sankila, E.-M.; Lehvaslaiho, H.; Engel, A. R.; Nieschlag, E.; Huhtaniemi, I.; de la Chapelle, A.: Mutation in the follicle-stimulating hormone receptor gene causes hereditary hypergonadotropic ovarian failure. Cell 82:959-968, 1995; and Roberts, R. G.; Kendall, E.; Vetrie, D.; Bobrow, M.: Sequence and chromosomal location of a human homologue of LRPR1, an FSH primary response gene. Genomics 37:122-124, 1996.

Further studies establishing the function and utilities of FSHPRH1 are found in John Hopkins OMIM database record ID 300065, and in cited publications listed in Table 5, which are hereby incorporated by reference. Fucosyltransferase 1 (galactoside 2-alpha-l-fucosyltransferase, bombay phenotype included) (FUT1, Accession NP_000139.1) is another GAM189 target gene, herein designated TARGET GENE. FUT1 BINDING SITE1 and FUT1 BINDING SITE2 are target binding sites found in untranslated regions of mRNA encoded by FUT1, corresponding to target binding sites such as BINDING SITE I, BINDING SITE II or BINDING SITE III of FIG. 8. Table 4 illustrates the complementarity of the nucleotide sequences of FUT1 BINDING SITE1 and FUT1 BINDING SITE2, designated SEQ ID:16365 and SEQ ID:11525 respectively, to the nucleotide sequence of GAM189 RNA, herein designated GAM RNA, also designated SEQ ID:246.

Another function of GAM189 is therefore inhibition of Fucosyltransferase 1 (galactoside 2-alpha-l-fucosyltransferase, bombay phenotype included) (FUT1, Accession NP_000139.1). Accordingly, utilities of GAM189 include diagnosis, prevention and treatment of diseases and clinical conditions associated with FUT1.

Frizzled homolog 4 (drosophila) (FZD4, Accession NP_036325.2) is another GAM189 target gene, herein designated TARGET GENE. FZD4 BINDING SITE is a target binding site found in the 3' untranslated region of mRNA encoded by FZD4, corresponding to a target binding site such as BINDING SITE I, BINDING SITE II or BINDING SITE III of FIG. 8. Table 4 illustrates the complementarity of the nucleotide sequences of FZD4 BINDING SITE, designated SEQ ID:4487, to the nucleotide sequence of GAM189 RNA, herein designated GAM RNA, also designated SEQ ID:246.

Another function of GAM189 is therefore inhibition of Frizzled homolog 4 (drosophila) (FZD4, Accession NP_036325.2), a gene which may function in cell polarity, cell fate specification and cancer; similar to frizzled receptor family, has seven transmembrane domains and therefore may be associated with Familial exudative vitreoretinopathy. Accordingly, utilities of GAM189 include diagnosis, prevention and treatment of Familial exudative vitreoretinopathy, and of other diseases and clinical conditions associated with FZD4.

The function of FZD4 and its association with various diseases and clinical conditions, has been established by previous studies, as described hereinabove with reference to GAM67.1. G2A (Accession NP_037477.1) is another GAM189 target gene, herein designated TARGET GENE. G2A BINDING SITE is a target binding site found in the 3' untranslated region of mRNA encoded by G2A, corresponding to a target binding site such as BINDING SITE I, BINDING SITE II or BINDING SITE III of FIG. 8. Table 4 illustrates the complementarity of the nucleotide sequences of G2A BINDING SITE, designated SEQ ID:8714, to the nucleotide sequence of GAM189 RNA, herein designated GAM RNA, also designated SEQ ID:246.

Another function of GAM189 is therefore inhibition of G2A (Accession NP_037477.1), a gene which may mediate some of the effects of extracellular atp on insulin secretion. and therefore may be associated with Autoimmune disease. Accordingly, utilities of GAM189 include diagnosis, prevention and treatment of Autoimmune disease, and of other diseases and clinical conditions associated with G2A.

The function of G2A has been established by previous studies. G2A belongs to a subfamily of GPCRs that bind to various glycolipids. Kabarowski et al. (2001) determined that expression of G2A induces signaling responses after exposure to lysophosphatidylcholine (LPC) and to sphingosylphosphorylcholine (SPC), a high- affinity ligand for OGR1 (GPR68; 601404). Scatchard analysis indicated that G2A binds LPC with high affinity and SPC with low affinity. Western blot analysis showed that both LPC and SPC activated ERK mitogen-activated protein kinase (see OMIM Ref. No. MAP3K4; 602425) in G2A-expressing CHO cells. LPC, but not SPC, stimulated transmigration of G2A-expressing T lymphocytes. The authors proposed that G2A may act as a sensor of LPC levels at sites of inflammation to limit the expansion of tissue-infiltrating cells promoting overt autoimmune disease.

Animal model experiments lend further support to the function of G2A. Le et al. (2001) showed that mice with a targeted disruption of G2a, apart from enhanced in vitro T-cell proliferative responses, initially appeared normal. With age, however, they developed a progressive secondary lymphoid organ enlargement associated with an abnormal polyclonal lymphocyte expansion. Older animals succumbed to a late-onset autoimmune wasting syndrome It is appreciated that the abovementioned animal model for G2A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kabarowski, J. H. S.; Zhu, K.; Le, L. Q.; Witte, O. N.; Xu, Y.: Lysophosphatidylcholine as a ligand for the immunoregulatory receptor G2A. Science 293:702-705, 2001; and Le, L. Q.; Kabarowski, J. H. S.; Weng, Z.; Satterthwaite, A. B.; Harvill, E. T.; Jensen, E. R.; Miller, J. F.; Witte, O. N.: Mice lacking the orphan G protein-coupled receptor G2A de.

Further studies establishing the function and utilities of G2A are found in John Hopkins OMIM database record ID 606167, and in cited publications listed in Table 5, which are hereby incorporated by reference. Glucose-6-phosphatase, catalytic (glycogen storage disease type i, von gierke disease) (G6PC, Accession NP_000142.1) is another GAM189 target gene, herein designated TARGET GENE. G6PC BINDING SITE is a target binding site found in the 3' untranslated region of mRNA encoded by G6PC, corresponding to a target binding site such as BINDING SITE I, BINDING SITE II or BINDING SITE III of FIG. 8. Table 4 illustrates the complementarity of the nucleotide sequences of G6PC BINDING SITE, designated SEQ ID:4204, to the nucleotide sequence of GAM189 RNA, herein designated GAM RNA, also designated SEQ ID:246.

Another function of GAM189 is therefore inhibition of Glucose-6-phosphatase, catalytic (glycogen storage disease type i, von gierke disease) (G6PC, Accession NP_000142.1). Accordingly, utilities of GAM189 include diagnosis, prevention and treatment of diseases and clinical conditions associated with G6PC.

GAL3ST-4 (Accession NP_078913.3) is another GAM189 target gene, herein designated TARGET GENE. GAL3ST-4 BINDING SITE is a target binding site found in the 3' untranslated region of mRNA encoded by GAL3ST-4, corresponding to a target binding site such as BINDING SITE I, BINDING SITE II or BINDING SITE III of FIG. 8. Table 4 illustrates the complementarity of the nucleotide sequences of GAL3ST-4 BINDING SITE, designated SEQ ID:4518, to the nucleotide sequence of GAM189 RNA, herein designated GAM RNA, also designated SEQ ID:246.

Another function of GAM189 is therefore inhibition of GAL3ST-4 (Accession NP_078913.3). Accordingly, utilities of GAM189 include diagnosis, prevention and treatment of diseases and clinical conditions associated with GAL3ST-4.

Gata binding protein 2 (GATA2, Accession NP_116027.2) is another GAM189 target gene, herein designated TARGET GENE. GATA2 BINDING SITE is a target binding site found in the 3' untranslated region of mRNA encoded by GATA2, corresponding to a target binding site such as BINDING SITE I, BINDING SITE II or BINDING SITE III of FIG. 8. Table 4 illustrates the complementarity of the nucleotide sequences of GATA2 BINDING SITE, designated SEQ ID:16014, to the nucleotide sequence of GAM189 RNA, herein designated GAM RNA, also designated SEQ ID:246.

Another function of GAM189 is therefore inhibition of Gata binding protein 2 (GATA2, Accession NP_116027.2). Accordingly, utilities of GAM189 include diagnosis, prevention and treatment of diseases and clinical conditions associated with GATA2.

Golgi associated, gamma adaptin ear containing, arf binding protein 2 (GGA2, Accession NP_619581.1) is another GAM189 target gene, herein designated TARGET GENE. GGA2 BINDING SITE1 and GGA2 BINDING SITE2 are target binding sites found in untranslated regions of multiple transcripts of mRNA encoded by GGA2, corresponding to target binding sites such as BINDING SITE I, BINDING SITE II or BINDING SITE III of FIG. 8. Table 4 illustrates the complementarity of the nucleotide sequences of GGA2 BINDING SITE1 and GGA2 BINDING SITE2, designated SEQ ID:5631 and SEQ ID:5631 respectively, to the nucleotide sequence of GAM189 RNA, herein designated GAM RNA, also designated SEQ ID:246.

Another function of GAM189 is therefore inhibition of Golgi associated, gamma adaptin ear containing, arf binding protein 2 (GGA2, Accession NP_619581.1). Accordingly, utilities of GAM189 include diagnosis, prevention and treatment of diseases and clinical conditions associated with GGA2.

Golgi associated, gamma adaptin ear containing, arf binding protein 2 (GGA2, Accession NP_055859.1) is another GAM189 target gene, herein designated TARGET GENE. GGA2 BINDING SITE1 and GGA2 BINDING SITE2 are target binding sites found in untranslated regions of multiple transcripts of mRNA encoded by GGA2, corresponding to target binding sites such as BINDING SITE I, BINDING SITE II or BINDING SITE III of FIG. 8. Table 4 illustrates the complementarity of the nucleotide sequences of GGA2 BINDING SITE1 and GGA2 BINDING SITE2, designated SEQ ID:6391 and SEQ ID:6391 respectively, to the nucleotide sequence of GAM189 RNA, herein designated GAM RNA, also designated SEQ ID:246.

Another function of GAM189 is therefore inhibition of Golgi associated, gamma adaptin ear containing, arf binding protein 2 (GGA2, Accession NP_055859.1). Accordingly, utilities of GAM189 include diagnosis, prevention and treatment of diseases and clinical conditions associated with GGA2.

Gm2 ganglioside activator protein (GM2A, Accession NP_000396.1) is another GAM189 target gene, herein designated TARGET GENE. GM2A BINDING SITE is a target binding site found in the 3' untranslated region of mRNA encoded by GM2A, corresponding to a target binding site such as BINDING SITE I, BINDING SITE II or BINDING SITE III of FIG. 8. Table 4 illustrates the complementarity of the nucleotide sequences of GM2A BINDING SITE, designated SEQ ID:11286, to the nucleotide sequence of GAM189 RNA, herein designated GAM RNA, also designated SEQ ID:246.

Another function of GAM189 is therefore inhibition of Gm2 ganglioside activator protein (GM2A, Accession NP_000396.1). Accordingly, utilities of GAM189 include diagnosis, prevention and treatment of diseases and clinical conditions associated with GM2A.

GNE (Accession NP_005467.1) is another GAM189 target gene, herein designated TARGET GENE. GNE BINDING SITE is a target binding site found in the 3' untranslated region of mRNA encoded by GNE, corresponding to a target binding site such as BINDING SITE I, BINDING SITE II or BINDING SITE III of FIG. 8. Table 4 illustrates the complementarity of the nucleotide sequences of GNE BINDING SITE, designated SEQ ID:8367, to the nucleotide sequence of GAM189 RNA, herein designated GAM RNA, also designated SEQ ID:246.

Another function of GAM189 is therefore inhibition of GNE (Accession NP_005467.1), a gene which has roles in sialic acid biosynthesis and regulates cell surface sialylation. Accordingly, utilities of GAM189 include diagnosis, prevention and treatment of diseases and clinical conditions associated with GNE.

The function of GNE has been established by previous studies. Keppler et al. (1999) determined that UDP-GlcNAc 2-epimerase activity is rate-limiting for the biosynthesis of sialic acid and is required for sialylation in hematopoietic cells. The activity of the enzyme can be controlled at the transcriptional level and can affect the sialylation and function of specific cell surface molecules expressed on B cells and myeloid cells. In a Genbank submission (AJ238764), these authors reported the sequence of a human UDP-GlcNAc 2-epimerase cDNA.

Animal model experiments lend further support to the function of GNE. Schwarzkopf et al. (2002) reported that inactivation of GNE (which is bifunctional and is the key enzyme of sialic acid biosynthesis) by gene targeting in mice caused early embryonic lethality, thereby emphasizing the fundamental role of the enzyme and sialylation during development. The need of the enzyme for a defined sialylation process is exemplified by the polysialylation of the neural cell adhesion molecule in embyronic stem cells.

It is appreciated that the abovementioned animal model for GNE is acknowledged by those skilled in the art as a scientifically valid animal model, as can be further appreciated from the publications sited hereinbelow.

Full details of the abovementioned studies are described in the following publications, the disclosure of which are hereby incorporated by reference:

Keppler, O. T.; Hinderlich, S.; Langner, J.; Schwartz-Albiez, R.; Reutter, W.; Pawlita, M.: UDP-GlcNAc 2-epimerase: a regulator of cell surface sialylation. Science 284:1372-1376, 1999; and Schwarzkopf, M.; Knobeloch, K.-P.; Rohde, E.; Hinderlich, S.; Wiechens, N.; Lucka, L.; Horak, I.; Reutter, W.; Horstkorte, R.: Sialylation is essential for early development in mice.

Further studies establishing the function and utilities of GNE are found in John Hopkins OMIM database record ID 603824, and in cited publications listed in Table 5, which are hereby incorporated by reference. Guanine nucleotide binding protein (g protein), gamma 4 (GNG4, Accession NP_004476.1) is another GAM189 target gene, herein designated TARGET GENE. GNG4 BINDING SITE is a target binding site found in the 3' untranslated region of mRNA encoded by GNG4, corresponding to a target binding site such as BINDING SITE I, BINDING SITE II or BINDING SITE III of FIG. 8. Table 4 illustrates the complementarity of the nucleotide sequences of GNG4 BINDING SITE, designated SEQ ID:559, to the nucleotide sequence of GAM189 RNA, herein designated GAM RNA, also designated SEQ ID:246.

Another function of GAM189 is therefore inhibition of Guanine nucleotide binding protein (g protein), gamma 4 (GNG4, Accession NP_004476.1). Accordingly, utilities of GAM189 include diagnosis, prevention and treatment of diseases and clinical conditions associated with GNG4.

GNPNAT1 (Accession XP_085119.1) is another GAM189 target gene, herein designated TARGET GENE. GNPNAT1 BINDING SITE is a target binding site found in the 3' untranslated region of mRNA encoded by GNPNAT1, corresponding to a target binding site such as BINDING SITE I, BINDING SITE II or BINDING SITE III of FIG. 8. Table 4 illustrates the complementarity of the nucleotide sequences of GNPNAT1 BINDING SITE, designated SEQ ID:8464, to the nucleotide sequence of GAM189 RNA, herein designated GAM RNA, also designated SEQ ID:246.

Another function of GAM189 is therefore inhibition of GNPNAT1 (Accession XP_085119.1). Accordingly, utilities of GAM189 include diagnosis, prevention and treatment of diseases and clinical conditions associated with GNPNAT1.

GNRPX (Accession NP_060519.1) is another GAM189 target gene, herein designated TARGET GENE. GNRPX BINDING SITE is a target binding site found in the 3' untranslated region of mRNA encoded by GNRPX, corresponding to a target binding site such as BINDING SITE I, BINDING SITE II or BINDING SITE III of FIG. 8. Table 4 illustrates the complementarity of the nucleotide sequences of GNRPX BINDING SITE, designated SEQ ID:12243, to the nucleotide sequence of GAM189 RNA, herein designated GAM RNA, also designated SEQ ID:246.

Another function of GAM189 is therefore inhibition of GNRPX (Accession NP_060519.1). Accordingly, utilities of GAM189 include diagnosis, prevention and treatment of diseases and clinical conditions associated with GNRPX.

Golgi autoantigen, golgin subfamily a, 3 (GOLGA3, Accession NP_005886.2) is another GAM189 target gene, herein designated TARGET GENE. GOLGA3 BINDING SITE is a target binding site found in the 3' untranslated region of multiple transcripts of mRNA encoded by GOLGA3, corresponding to a target binding site such as BINDING SITE I, BINDING SITE II or BINDING SITE III of FIG. 8. Table 4 illustrates the complementarity of the nucleotide sequences of GOLGA3 BINDING SITE, designated SEQ ID:15049, to the nucleotide sequence of GAM189 RNA, herein designated GAM RNA, also designated SEQ ID:246.

Another function of GAM189 is therefore inhibition of Golgi autoantigen, golgin subfamily a, 3 (GOLGA3, Accession NP_005886.2). Accordingly, utilities of GAM189 include diagnosis, prevention and treatment of diseases and clinical conditions associated with GOLGA3.

Glycoprotein v (platelet) (GP5, Accession NP_004479.1) is another GAM189 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:5681, to the nucleotide sequence of GAM189 RNA, herein designated GAM RNA, also designated SEQ ID:246.

Another function of GAM189 is therefore inhibition of Glycoprotein v (platelet) (GP5, Accession NP_004479.1). Accordingly, utilities of GAM189 include diagnosis, prevention and treatment of diseases and clinical conditions associated with GP5.

GPP34R (Accession NP_060648.2) is another GAM189 target gene, herein designated TARGET GENE. GPP34R BINDING SITE is a target binding site found in the 3' untranslated region of mRNA encoded by GPP34R, corresponding to a target binding site such as BINDING SITE I, BINDING SITE II or BINDING SITE III of FIG. 8. Table 4 illustrates the complementarity of the nucleotide sequences of GPP34R BINDING SITE, designated SEQ ID:14203, to the nucleotide sequence of GAM189 RNA, herein designated GAM RNA, also designated SEQ ID:246.

Another function of GAM189 is therefore inhibition of GPP34R (Accession NP_060648.2). Accordingly, utilities of GAM189 include diagnosis, prevention and treatment of diseases and clinical conditions associated with GPP34R.

G protein-coupled receptor 26 (GPR26, Accession NP_703143.1) is another GAM189 target gene, herein designated TARGET GENE. GPR26 BINDING SITE is a target binding site found in the 3' untranslated region of mRNA encoded by GPR26, corresponding to a target binding site such as BINDING SITE I, BINDING SITE II or BINDING SITE III of FIG. 8. Table 4 illustrates the complementarity of the nucleotide sequences of GPR26 BINDING SITE, designated SEQ ID:3010, to the nucleotide sequence of GAM189 RNA, herein designated GAM RNA, also designated SEQ ID:246.

Another function of GAM189 is therefore inhibition of G protein-coupled receptor 26 (GPR26, Accession NP_703143.1). Accordingly, utilities of GAM189 include diagnosis, prevention and treatment of diseases and clinical conditions associated with GPR26.

G protein-coupled receptor 4 (GPR4, Accession NP_005273.1) is another GAM189 target gene, herein designated TARGET GENE. GPR4 BINDING SITE is a target binding site found in the 3' untranslated region of mRNA encoded by GPR4, corresponding to a target binding site such as BINDING SITE I, BINDING SITE II or BINDING SITE III of FIG. 8. Table 4 illustrates the complementarity of the nucleotide sequences of GPR4 BINDING SITE, designated SEQ ID:4965, to the nucleotide sequence of GAM189 RNA, herein designated GAM RNA, also designated SEQ ID:246.

Another function of GAM189 is therefore inhibition of G protein-coupled receptor 4 (GPR4, Accession NP_005273.1), a gene which stimulates to produce increased calcium by both SPC and LPC. Accordingly, utilities of GAM189 include diagnosis, prevention and treatment of diseases and clinical conditions associated with GPR4.

The function of GPR4 has been established by previous studies. Many cell membrane receptors are members of the G protein-coupled receptor (GPR) family. GPRs are characterized by the presence of 7 transmembrane domains and numerous conserved amino acids. Using degenerate PCR, Heiber et al. (1995) identified additional members of this family. Among these was GPR4, which encodes a putative 355-amino acid protein and was selected from a genomic DNA library using the PCR- derived product as a probe. GPR4 shares the greatest sequence similarity with the human platelet-activating factor receptor (Ye et al., 1991). GPR4 is more than 50% identical to OGR1 (GPR68; 601404), a high- affinity receptor for the sphingosylphosphorylcholine (SPC) signaling molecule. Zhu et al. (2001) showed that cells expressing GPR4 are stimulated to produce increased calcium by both SPC and LPC (lysophosphatidylcholine), a ligand for G2A (OMIM Ref. No. 606167). RNA dot blot analysis revealed highest expression of GPR4 in ovary, liver, lung, kidney, lymph node, and subthalamic nucleus; in contrast, OGR1 is most highly expressed in lung, placenta, spleen, testis, small intestine, and peripheral blood leukocytes. Binding analysis determined that GPR4 interacts with SPC with high affinity and with LPC with lower affinity. Both ligands enhanced proliferation and ERK mitogen-activated protein kinase (see OMIM Ref. No. MAP3K4; 602425) activation in a GPR4-dependent and pertussis toxin (PTX)-sensitive manner, whereas ERK activation is PTX-insensitive in OGR1-mediated signaling. Cell migration analysis suggested that both LPC and SPC enhance chemotaxis, but not chemokinesis, through GPR4.

Full details of the abovementioned studies are described in the following publications, the disclosure of which are hereby incorporated by reference:

Heiber, M.; Docherty, J. M.; Shah, G.; Nguyen, T.; Cheng, R.; Heng, H. H. Q.; Marchese, A.; Tsui, L.-C.; Shi, X.; George, S. R.; O'Dowd, B. F.: Isolation of three novel human genes encoding G protein-coupled receptors. DNA Cell Biol. 14:25-35, 1995; and Zhu, K.; Baudhuin, L. M.; Hong, G.; Williams, F. S.; Cristina, K. L.; Kabarowski, J. H. S.; Witte, O. N.; Xu, Y.: Sphingosylphosphorylcholine and lysophosphatidylcholine are ligands f.

Further studies establishing the function and utilities of GPR4 are found in John Hopkins OMIM database record ID 600551, and in cited publications listed in Table 5, which are hereby incorporated by reference. G protein-coupled receptor 56 (GPR56, Accession NP_005673.2) is another GAM189 target gene, herein designated TARGET GENE. GPR56 BINDING SITE is a target binding site found in the 5' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:8622, to the nucleotide sequence of GAM189 RNA, herein designated GAM RNA, also designated SEQ ID:246.

Another function of GAM189 is therefore inhibition of G protein-coupled receptor 56 (GPR56, Accession NP_005673.2), a gene which transduces extracellular signals through heterotrimeric G proteins. Accordingly, utilities of GAM189 include diagnosis, prevention and treatment of diseases and clinical conditions associated with GPR56.

The function of GPR56 and its association with various diseases and clinical conditions, has been established by previous studies, as described hereinabove with reference to GAM63.1. G protein-coupled receptor 66 (GPR66, Accession NP_006047.2) is another GAM189 target gene, herein designated TARGET GENE. GPR66 BINDING SITE is a target binding site found in the 3' untranslated region of mRNA encoded by GPR66, corresponding to a target binding site such as BINDING SITE I, BINDING SITE II or BINDING SITE III of FIG. 8. Table 4 illustrates the complementarity of the nucleotide sequences of GPR66 BINDING SITE, designated SEQ ID:19237, to the nucleotide sequence of GAM189 RNA, herein designated GAM RNA, also designated SEQ ID:246.

Another function of GAM189 is therefore inhibition of G protein-coupled receptor 66 (GPR66, Accession NP_006047.2). Accordingly, utilities of GAM189 include diagnosis, prevention and treatment of diseases and clinical conditions associated with GPR66.

G protein-coupled receptor 81 (GPR81, Accession NP_115943.1) is another GAM189 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:13260, to the nucleotide sequence of GAM189 RNA, herein designated GAM RNA, also designated SEQ ID:246.

Another function of GAM189 is therefore inhibition of G protein-coupled receptor 81 (GPR81, Accession NP_115943.1). Accordingly, utilities of GAM189 include diagnosis, prevention and treatment of diseases and clinical conditions associated with GPR81.

GR6 (Accession NP_031380.1) is another GAM189 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:2604, to the nucleotide sequence of GAM189 RNA, herein designated GAM RNA, also designated SEQ ID:246.

Another function of GAM189 is therefore inhibition of GR6 (Accession NP_031380.1). Accordingly, utilities of GAM189 include diagnosis, prevention and treatment of diseases and clinical conditions associated with GR6.

GRAF (Accession NP_055886.1) is another GAM189 target gene, herein designated TARGET GENE. GRAF BINDING SITE is a target binding site found in the 3' untranslated region of mRNA encoded by GRAF, corresponding to a target binding site such as BINDING SITE I, BINDING SITE II or BINDING SITE III of FIG. 8. Table 4 illustrates the complementarity of the nucleotide sequences of GRAF BINDING SITE, designated SEQ ID:4362, to the nucleotide sequence of GAM189 RNA, herein designated GAM RNA, also designated SEQ ID:246.

Another function of GAM189 is therefore inhibition of GRAF (Accession NP_055886.1), a gene which ia a GTPase activating protein for p21-rac and therefore may be associated with Juvenile myelomonocytic leukemia. Accordingly, utilities of GAM189 include diagnosis, prevention and treatment of Juvenile myelomonocytic leukemia, and of other diseases and clinical conditions associated with GRAF.

The function of GRAF has been established by previous studies. Borkhardt et al. (2000) stated that mutual translocations involving 11q23 in acute leukemias had been demonstrated to show fusion between the mixed lineage leukemia (MLL; 159555) gene and a variety of different partner genes to a total of 23. The detection of a unique t(5;11)(q31;q23) in an infant with juvenile myelomonocytic leukemia and an MLL gene rearrangement provided an opportunity to clone another MLL fusion partner gene. By cloning the breakpoints in this translocation, Borkhardt et al. (2000) recovered a member of the GTPase-activating protein (GAP) family, which they identified as the human homolog of the avian GRAF gene (Hildebrand et al., 1996). Ishikawa et al. (1998) cloned a GRAF cDNA, which they designated KIAA0621, from a human brain cDNA library and found that it encodes a deduced 753-amino acid protein with a molecular mass of 87 kD. Hildebrand et al. (1996) determined that the GRAF gene is highly homologous to the BCR gene (OMIM Ref. No. 151410), which is also involved in a leukemia- associated translocation. The avian GRAF protein binds to the C-terminal domain of pp125(FAK), one of the tyrosine kinases predicted to be a critical component of the integrin signaling transduction pathway, in an SH3 domain-dependent manner and stimulates the GTPase activity of the GTP-binding protein RhoA. Thus, GRAF acts as a negative regulator of RhoA.

Full details of the abovementioned studies are described in the following publications, the disclosure of which are hereby incorporated by reference:

Borkhardt, A.; Bojesen, S.; Haas, O. A.; Fuchs, U.; Bartelheimer, D.; Loncarevic, I. F.; Bohle, R. M.; Harbott, J.; Repp, R.; Jaeger, U.; Viehmann, S.; Henn, T.; Korth, P.; Scharr, D.; Lampert, F.: The human GRAF gene is fused to MLL in a unique t(5;11)(q31;q23) and both alleles are disrupted in three cases of myelodysplastic syndrome/acute myeloid leukemia with a deletion 5q. Proc. Nat. Acad. Sci. 97:9168-9173, 2000; and Hildebrand, J. D.; Taylor, J. M.; Parsons, T. J.: An SH3 domain-containing GTPase-activating protein for Rho and Cdc42 associates with focal adhesion kinase. Molec. Cell. Biol. 16:31.

Further studies establishing the function and utilities of GRAF are found in John Hopkins OMIM database record ID 605370, and in cited publications listed in Table 5, which are hereby incorporated by reference. GREB1 (Accession NP_055483.2) is another GAM189 target gene, herein designated TARGET GENE. GREB1 BINDING SITE1 through GREB1 BINDING SITE3 are target binding sites found in untranslated regions of multiple transcripts of mRNA encoded by GREB1, corresponding to target binding sites such as BINDING SITE I, BINDING SITE II or BINDING SITE III of FIG. 8. Table 4 illustrates the complementarity of the nucleotide sequences of GREB1 BINDING SITE1 through GREB1 BINDING SITE3, designated SEQ ID:11815, SEQ ID:14861 and SEQ ID:9792 respectively, to the nucleotide sequence of GAM189 RNA, herein designated GAM RNA, also designated SEQ ID:246.

Another function of GAM189 is therefore inhibition of GREB1 (Accession NP_055483.2). Accordingly, utilities of GAM189 include diagnosis, prevention and treatment of diseases and clinical conditions associated with GREB1.

Glutamate receptor, ionotropic, delta 1 (GRID1, Accession XP_043613.8) is another GAM189 target gene, herein designated TARGET GENE. GRID1 BINDING SITE is a target binding site found in the 3' untranslated region of mRNA encoded by GRID1, corresponding to a target binding site such as BINDING SITE I, BINDING SITE II or BINDING SITE III of FIG. 8. Table 4 illustrates the complementarity of the nucleotide sequences of GRID1 BINDING SITE, designated SEQ ID:17390, to the nucleotide sequence of GAM189 RNA, herein designated GAM RNA, also designated SEQ ID:246.

Another function of GAM189 is therefore inhibition of Glutamate receptor, ionotropic, delta 1 (GRID1, Accession XP_043613.8). Accordingly, utilities of GAM189 include diagnosis, prevention and treatment of diseases and clinical conditions associated with GRID1.

Glutamate receptor, ionotropic, n-methyl d-aspartate-like 1a (GRINL1A, Accession NP_056347.1) is another GAM189 target gene, herein designated TARGET GENE. GRINL1A BINDING SITE is a target binding site found in the 3' untranslated region of mRNA encoded by GRINL1A, corresponding to a target binding site such as BINDING SITE I, BINDING SITE II or BINDING SITE III of FIG. 8. Table 4 illustrates the complementarity of the nucleotide sequences of GRINL1A BINDING SITE, designated SEQ ID:5433, to the nucleotide sequence of GAM189 RNA, herein designated GAM RNA, also designated SEQ ID:246.

Another function of GAM189 is therefore inhibition of Glutamate receptor, ionotropic, n-methyl d-aspartate-like 1a (GRINL1A, Accession NP_056347.1), a gene which plays a role in the development and function of the mammalian brain. Accordingly, utilities of GAM189 include diagnosis, prevention and treatment of diseases and clinical conditions associated with GRINL1A.

The function of GRINL1A has been established by previous studies. The ionotropic glutamate receptors (e.g., GRIN1; 138249) play roles in the development and function of the mammalian brain. Roginski et al. (2001) isolated rat GRINL1 cDNA from a size-fractionated, directional rat brain cDNA library. They obtained human GRINL1A genomic DNA sequences by amplification with primers designed from the rat sequences. By fluorescence in situ hybridization, Roginski et al. (2001) mapped the GRINL1A gene to chromosome 15q22.1. By interspecific backcross analysis, Wydner et al. (2001) mapped the mouse Grinl1a gene to chromosome 9 in a region that shares linkage conservation with human chromosome 15q21-q22.

Full details of the abovementioned studies are described in the following publications, the disclosure of which are hereby incorporated by reference:

Roginski, R. S.; Mohan Raj, B. K.; Finkernagel, S. W.; Sciorra, L. J.: Assignment of an ionotropic glutamate receptor-like gene (GRINL1A) to human chromosome 15q22.1 by in situ hybridization. Cytogenet. Cell Genet. 93:143-144, 2001; and Wydner, K. S.; Mohan Raj, B. K.; Sciorra, L. J.; Roginski, R. S.: The mouse orthologue of the human ionotropic glutamate receptor-like gene (GRINL1A) maps to mouse chromosome 9. Cytog.

Further studies establishing the function and utilities of GRINL1A are found in John Hopkins OMIM database record ID 606485, and in cited publications listed in Table 5, which are hereby incorporated by reference. Glutamate receptor, metabotropic 6 (GRM6, Accession NP_000834.1) is another GAM189 target gene, herein designated TARGET GENE. GRM6 BINDING SITE is a target binding site found in the 3' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:10398, to the nucleotide sequence of GAM189 RNA, herein designated GAM RNA, also designated SEQ ID:246.

Another function of GAM189 is therefore inhibition of Glutamate receptor, metabotropic 6 (GRM6, Accession NP_000834.1). Accordingly, utilities of GAM189 include diagnosis, prevention and treatment of diseases and clinical conditions associated with GRM6.

GRWD (Accession NP_113673.2) is another GAM189 target gene, herein designated TARGET GENE. GRWD BINDING SITE is a target binding site found in the 3' untranslated region of mRNA encoded by GRWD, corresponding to a target binding site such as BINDING SITE I, BINDING SITE II or BINDING SITE III of FIG. 8. Table 4 illustrates the complementarity of the nucleotide sequences of GRWD BINDING SITE, designated SEQ ID:7996, to the nucleotide sequence of GAM189 RNA, herein designated GAM RNA, also designated SEQ ID:246.

Another function of GAM189 is therefore inhibition of GRWD (Accession NP_113673.2). Accordingly, utilities of GAM189 include diagnosis, prevention and treatment of diseases and clinical conditions associated with GRWD.

GSDM (Accession NP_835465.1) is another GAM189 target gene, herein designated TARGET GENE. GSDM BINDING SITE is a target binding site found in the 3' untranslated region of multiple transcripts of mRNA encoded by GSDM, corresponding to a target binding site such as BINDING SITE I, BINDING SITE II or BINDING SITE III of FIG. 8. Table 4 illustrates the complementarity of the nucleotide sequences of GSDM BINDING SITE, designated SEQ ID:3199, to the nucleotide sequence of GAM189 RNA, herein designated GAM RNA, also designated SEQ ID:246.

Another function of GAM189 is therefore inhibition of GSDM (Accession NP_835465.1). Accordingly, utilities of GAM189 include diagnosis, prevention and treatment of diseases and clinical conditions associated with GSDM.

GSDM (Accession XP_209009.1) is another GAM189 target gene, herein designated TARGET GENE. GSDM BINDING SITE is a target binding site found in the 3' untranslated region of multiple transcripts of mRNA encoded by GSDM, corresponding to a target binding site such as BINDING SITE I, BINDING SITE II or BINDING SITE III of FIG. 8. Table 4 illustrates the complementarity of the nucleotide sequences of GSDM BINDING SITE, designated SEQ ID:3199, to the nucleotide sequence of GAM189 RNA, herein designated GAM RNA, also designated SEQ ID:246.

Another function of GAM189 is therefore inhibition of GSDM (Accession XP_209009.1). Accordingly, utilities of GAM189 include diagnosis, prevention and treatment of diseases and clinical conditions associated with GSDM.

Glutathione s-transferase m1 (GSTM1, Accession NP_666533.1) is another GAM189 target gene, herein designated TARGET GENE. GSTM1 BINDING SITE is a target binding site found in the 3' untranslated region of multiple transcripts of mRNA encoded by GSTM1, corresponding to a target binding site such as BINDING SITE I, BINDING SITE II or BINDING SITE III of FIG. 8. Table 4 illustrates the complementarity of the nucleotide sequences of GSTM1 BINDING SITE, designated SEQ ID:12752, to the nucleotide sequence of GAM189 RNA, herein designated GAM RNA, also designated SEQ ID:246.

Another function of GAM189 is therefore inhibition of Glutathione s-transferase m1 (GSTM1, Accession NP_666533.1), a gene which is conjugation of reduced glutathione to a wide number of exogenous and endogenous hydrophobic electrophiles. and therefore may be associated with Aplastic anemia and cancer. Accordingly, utilities of GAM189 include diagnosis, prevention and treatment of Aplastic anemia and cancer, and of other diseases and clinical conditions associated with GSTM1.

The function of GSTM1 has been established by previous studies. The mu class glutathione transferase GSTM1 is absent from more than 50% of some populations (Board et al., 1990). This deficiency appears to be caused by the deletion of the GSTM1 gene (18,16:Seidegard et al., 1988, 1990); a null allele at the GSTM1 locus is found in 40 to 45% of Caucasians. GSTM1 deficiency may be a risk factor for cancer by providing increased sensitivity to particular chemical carcinogens (Strange et al., 1991; van Poppel et al., 1992). Seidegard et al. (1986, 1990) found an association between the GSTM1 null phenotype and susceptibility to lung cancer. Zhong et al. (1993) found a significant excess of 'nulled' individuals among cases of colorectal cancer:56.1% compared with the control group value of 41.8%. More than 70% of individuals with a tumor in the proximal colon were GSTM1 nulled, in their terminology. Patients with reduced ability to metabolize environmental carcinogens or toxins may be at risk of developing aplastic anemia. GST has been implicated in detoxifying mutagenic electrophilic compounds. Lee et al. (2001) investigated whether homozygous deletions of GSTM1 and GSTT1 affect the likelihood of developing aplastic anemia. They found that the incidence of GSTM1 and GSTT1 gene deletions was significantly higher for aplastic anemia patients than for healthy controls (odds ratio =3.1, P =0.01, and odds ratio =3.1, P =0.004, respectively). Among the aplastic anemia patients, 17.5% had chromosomal abnormalities at the time of diagnosis, and all aplastic anemia patients with chromosomal abnormalities showed GSTT1 gene deletions.

Full details of the abovementioned studies are described in the following publications, the disclosure of which are hereby incorporated by reference:

van Poppel, G.; de Vogel, N.; van Bladeren, P. J.; Kok, F. J.: Increased cytogenetic damage in smokers deficient in glutathione S-transferase isozyme mu. Carcinogenesis 13:303-305, 1992; and Lee, K. A.; Kim, S. H.; Woo, H. Y.; Hong, Y. J.; Cho, H. C.: Increased frequencies of glutathione S-transferase (GSTM1 and GSTT1) gene deletions in Korean patients with acquired aplasti.

Further studies establishing the function and utilities of GSTM1 are found in John Hopkins OMIM database record ID 138350, and in cited publications listed in Table 5, which are hereby incorporated by reference. Glutathione s-transferase m1 (GSTM1, Accession NP_000552.2) is another GAM189 target gene, herein designated TARGET GENE. GSTM1 BINDING SITE is a target binding site found in the 3' untranslated region of multiple transcripts of mRNA encoded by GSTM1, corresponding to a target binding site such as BINDING SITE I, BINDING SITE II or BINDING SITE III of FIG. 8. Table 4 illustrates the complementarity of the nucleotide sequences of GSTM1 BINDING SITE, designated SEQ ID:12752, to the nucleotide sequence of GAM189 RNA, herein designated GAM RNA, also designated SEQ ID:246.

Another function of GAM189 is therefore inhibition of Glutathione s-transferase m1 (GSTM1, Accession NP_000552.2), a gene which is conjugation of reduced glutathione to a wide number of exogenous and endogenous hydrophobic electrophiles. and therefore may be associated with Aplastic anemia and cancer. Accordingly, utilities of GAM189 include diagnosis, prevention and treatment of Aplastic anemia and cancer, and of other diseases and clinical conditions associated with GSTM1.

The function of GSTM1 has been established by previous studies. The mu class glutathione transferase GSTM1 is absent from more than 50% of some populations (Board et al., 1990). This deficiency appears to be caused by the deletion of the GSTM1 gene (18,16:Seidegard et al., 1988, 1990); a null allele at the GSTM1 locus is found in 40 to 45% of Caucasians. GSTM1 deficiency may be a risk factor for cancer by providing increased sensitivity to particular chemical carcinogens (Strange et al., 1991; van Poppel et al., 1992). Seidegard et al. (1986, 1990) found an association between the GSTM1 null phenotype and susceptibility to lung cancer. Zhong et al. (1993) found a significant excess of 'nulled' individuals among cases of colorectal cancer:56.1% compared with the control group value of 41.8%. More than 70% of individuals with a tumor in the proximal colon were GSTM1 nulled, in their terminology. Patients with reduced ability to metabolize environmental carcinogens or toxins may be at risk of developing aplastic anemia. GST has been implicated in detoxifying mutagenic electrophilic compounds. Lee et al. (2001) investigated whether homozygous deletions of GSTM1 and GSTT1 affect the likelihood of developing aplastic anemia. They found that the incidence of GSTM1 and GSTT1 gene deletions was significantly higher for aplastic anemia patients than for healthy controls (odds ratio =3.1, P =0.01, and odds ratio =3.1, P =0.004, respectively). Among the aplastic anemia patients, 17.5% had chromosomal abnormalities at the time of diagnosis, and all aplastic anemia patients with chromosomal abnormalities showed GSTT1 gene deletions.

Full details of the abovementioned studies are described in the following publications, the disclosure of which are hereby incorporated by reference:

van Poppel, G.; de Vogel, N.; van Bladeren, P. J.; Kok, F. J.: Increased cytogenetic damage in smokers deficient in glutathione S-transferase isozyme mu. Carcinogenesis 13:303-305, 1992; and Lee, K. A.; Kim, S. H.; Woo, H. Y.; Hong, Y. J.; Cho, H. C.: Increased frequencies of glutathione S-transferase (GSTM1 and GSTT1) gene deletions in Korean patients with acquired aplasti.

Further studies establishing the function and utilities of GSTM1 are found in John Hopkins OMIM database record ID 138350, and in cited publications listed in Table 5, which are hereby incorporated by reference. Glutathione s-transferase m2 (muscle) (GSTM2, Accession NP_000839.1) is another GAM189 target gene, herein designated TARGET GENE. GSTM2 BINDING SITE is a target binding site found in the 3' untranslated region of mRNA encoded by GSTM2, corresponding to a target binding site such as BINDING SITE I, BINDING SITE II or BINDING SITE III of FIG. 8. Table 4 illustrates the complementarity of the nucleotide sequences of GSTM2 BINDING SITE, designated SEQ ID:12752, to the nucleotide sequence of GAM189 RNA, herein designated GAM RNA, also designated SEQ ID:246.

Another function of GAM189 is therefore inhibition of Glutathione s-transferase m2 (muscle) (GSTM2, Accession NP_000839.1). Accordingly, utilities of GAM189 include diagnosis, prevention and treatment of diseases and clinical conditions associated with GSTM2.

Glutathione s-transferase m4 (GSTM4, Accession NP_671490.1) is another GAM189 target gene, herein designated TARGET GENE. GSTM4 BINDING SITE is a target binding site found in the 3' untranslated region of multiple transcripts of mRNA encoded by GSTM4, corresponding to a target binding site such as BINDING SITE I, BINDING SITE II or BINDING SITE III of FIG. 8. Table 4 illustrates the complementarity of the nucleotide sequences of GSTM4 BINDING SITE, designated SEQ ID:12752, to the nucleotide sequence of GAM189 RNA, herein designated GAM RNA, also designated SEQ ID:246.

Another function of GAM189 is therefore inhibition of Glutathione s-transferase m4 (GSTM4, Accession NP_671490.1), a gene which conjugates reduced glutathione to a wide number of exogenous and endogenous hydrophobic electrophiles. Accordingly, utilities of GAM189 include diagnosis, prevention and treatment of diseases and clinical conditions associated with GSTM4.

The function of GSTM4 has been established by previous studies. Glutathione S-transferases (GSTs) are a complex family of multifunctional enzymes thought to play a significant role in cellular detoxification. Cytosolic GSTs have been subdivided into 4 classes: alpha, mu, pi, and theta. Four isoenzymes of the mu class have been identified: GSTM1 (OMIM Ref. No. 138350), GSTM2 (OMIM Ref. No. 138380), GSTM3 (OMIM Ref. No. 138390), and GSTM4. Ross and Board (1993) cloned and characterized GSTM4. Ross et al. (1993) reported that a probe derived from GSTM4 cross-hybridizes with the other 3 known human mu class GST genes. In situ hybridization with the GSTM4 probe localized a major region of hybridization on 1p13. An identical pattern of hybridization was observed in individuals with or without the GSTM1 gene. Taylor et al. (1991) found that GSTM4 and GSTM2 were located in the same cosmid. Comstock et al. (1993) reported the complete gene sequence and cDNA sequence of GSTM4. The deduced amino acid sequence of GSTM4 was 87% identical to GSTM1, 83% identical to GSTM2, and 70% identical to GSTM3. Using PCR amplification of a unique region of the GSTM4 gene from a panel of rodent-human somatic cell hybrid DNAs, Comstock et al. (1993) determined that the GSTM4 gene is located on chromosome 1.

Full details of the abovementioned studies are described in the following publications, the disclosure of which are hereby incorporated by reference:

Ross, V. L.; Board, P. G.: Molecular cloning and heterologous expression of an alternatively spliced human mu class glutathione S-transferase transcript. Biochem. J. 294:373-380, 1993; and Comstock, K. E.; Johnson, K. J.; Rifenbery, D.; Henner, W. D.: Isolation and analysis of the gene and cDNA for a human mu class glutathione S-transferase, GSTM4. J. Biol. Chem. 268:169.

Further studies establishing the function and utilities of GSTM4 are found in John Hopkins OMIM database record ID 138333, and in cited publications listed in Table 5, which are hereby incorporated by reference. Glutathione s-transferase m4 (GSTM4, Accession NP_000841.1) is another GAM189 target gene, herein designated TARGET GENE. GSTM4 BINDING SITE is a target binding site found in the 3' untranslated region of multiple transcripts of mRNA encoded by GSTM4, corresponding to a target binding site such as BINDING SITE I, BINDING SITE II or BINDING SITE III of FIG. 8. Table 4 illustrates the complementarity of the nucleotide sequences of GSTM4 BINDING SITE, designated SEQ ID:12752, to the nucleotide sequence of GAM189 RNA, herein designated GAM RNA, also designated SEQ ID:246.

Another function of GAM189 is therefore inhibition of Glutathione s-transferase m4 (GSTM4, Accession NP_000841.1), a gene which conjugates reduced glutathione to a wide number of exogenous and endogenous hydrophobic electrophiles. Accordingly, utilities of GAM189 include diagnosis, prevention and treatment of diseases and clinical conditions associated with GSTM4.

The function of GSTM4 has been established by previous studies. Glutathione S-transferases (GSTs) are a complex family of multifunctional enzymes thought to play a significant role in cellular detoxification. Cytosolic GSTs have been subdivided into 4 classes: alpha, mu, pi, and theta. Four isoenzymes of the mu class have been identified: GSTM1 (OMIM Ref. No. 138350), GSTM2 (OMIM Ref. No. 138380), GSTM3 (OMIM Ref. No. 138390), and GSTM4. Ross and Board (1993) cloned and characterized GSTM4. Ross et al. (1993) reported that a probe derived from GSTM4 cross-hybridizes with the other 3 known human mu class GST genes. In situ hybridization with the GSTM4 probe localized a major region of hybridization on 1p13. An identical pattern of hybridization was observed in individuals with or without the GSTM1 gene. Taylor et al. (1991) found that GSTM4 and GSTM2 were located in the same cosmid. Comstock et al. (1993) reported the complete gene sequence and cDNA sequence of GSTM4. The deduced amino acid sequence of GSTM4 was 87% identical to GSTM1, 83% identical to GSTM2, and 70% identical to GSTM3. Using PCR amplification of a unique region of the GSTM4 gene from a panel of rodent-human somatic cell hybrid DNAs, Comstock et al. (1993) determined that the GSTM4 gene is located on chromosome 1.

Full details of the abovementioned studies are described in the following publications, the disclosure of which are hereby incorporated by reference:

Ross, V. L.; Board, P. G.: Molecular cloning and heterologous expression of an alternatively spliced human mu class glutathione S-transferase transcript. Biochem. J. 294:373-380, 1993; and Comstock, K. E.; Johnson, K. J.; Rifenbery, D.; Henner, W. D.: Isolation and analysis of the gene and cDNA for a human mu class glutathione S-transferase, GSTM4. J. Biol. Chem. 268:169.

Further studies establishing the function and utilities of GSTM4 are found in John Hopkins OMIM database record ID 138333, and in cited publications listed in Table 5, which are hereby incorporated by reference. General transcription factor iie, polypeptide 1, alpha 56 kda (GTF2E1, Accession NP_005504.1) is another GAM189 target gene, herein designated TARGET GENE. GTF2E1 BINDING SITE is a target binding site found in the 3' untranslated region of mRNA encoded by GTF2E1, corresponding to a target binding site such as BINDING SITE I, BINDING SITE II or BINDING SITE III of FIG. 8. Table 4 illustrates the complementarity of the nucleotide sequences of GTF2E1 BINDING SITE, designated SEQ ID:15661, to the nucleotide sequence of GAM189 RNA, herein designated GAM RNA, also designated SEQ ID:246.

Another function of GAM189 is therefore inhibition of General transcription factor iie, polypeptide 1, alpha 56 kda (GTF2E1, Accession NP_005504.1). Accordingly, utilities of GAM189 include diagnosis, prevention and treatment of diseases and clinical conditions associated with GTF2E1.

GTF2IRD2 (Accession NP_115579.3) is another GAM189 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:11522, to the nucleotide sequence of GAM189 RNA, herein designated GAM RNA, also designated SEQ ID:246.

Another function of GAM189 is therefore inhibition of GTF2IRD2 (Accession NP_115579.3). Accordingly, utilities of GAM189 include diagnosis, prevention and treatment of diseases and clinical conditions associated with GTF2IRD2.

GTF2IRD2 (Accession NP_775808.1) is another GAM189 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:11522, to the nucleotide sequence of GAM189 RNA, herein designated GAM RNA, also designated SEQ ID:246.

Another function of GAM189 is therefore inhibition of GTF2IRD2 (Accession NP_775808.1). Accordingly, utilities of GAM189 include diagnosis, prevention and treatment of diseases and clinical conditions associated with GTF2IRD2.

GTPBG3 (Accession NP_116009.1) is another GAM189 target gene, herein designated TARGET GENE. GTPBG3 BINDING SITE1 and GTPBG3 BINDING SITE2 are target binding sites found in untranslated regions of mRNA encoded by GTPBG3, corresponding to target binding sites such as BINDING SITE I, BINDING SITE II or BINDING SITE III of FIG. 8. Table 4 illustrates the complementarity of the nucleotide sequences of GTPBG3 BINDING SITE1 and GTPBG3 BINDING SITE2, designated SEQ ID:7812 and SEQ ID:10292 respectively, to the nucleotide sequence of GAM189 RNA, herein designated GAM RNA, also designated SEQ ID:246.

Another function of GAM189 is therefore inhibition of GTPBG3 (Accession NP_116009.1). Accordingly, utilities of GAM189 include diagnosis, prevention and treatment of diseases and clinical conditions associated with GTPBG3.

Glycogenin (Gy, Accession NP_004121.2) is another GAM189 target gene, herein designated TARGET GENE. GYG BINDING SITE is a target binding site found in the 3' untranslated region of mRNA encoded by Gy, corresponding to a target binding site such as BINDING SITE I, BINDING SITE II or BINDING SITE III of FIG. 8. Table 4 illustrates the complementarity of the nucleotide sequences of GYG BINDING SITE, designated SEQ ID:4258, to the nucleotide sequence of GAM189 RNA, herein designated GAM RNA, also designated SEQ ID:246.

Another function of GAM189 is therefore inhibition of Glycogenin (Gy, Accession NP_004121.2), a gene which primes de novo glycogen synthesis. Accordingly, utilities of GAM189 include diagnosis, prevention and treatment of diseases and clinical conditions associated with GYG.

The function of GYG has been established by previous studies. Glycogenin is a self- glucosylating protein involved in the initiation reactions of glycogen synthesis. During initiation, the covalent attachment of a glucose residue to glycogenin is followed by elongation to form an oligosaccharide chain. Viskupic et al. (1992) isolated cDNAs encoding glycogenin from rabbit muscle, rat, and cow. Recombinant mammalian glycogenin was enzymatically active and capable of self-glucosylation. After incubation with UDP- glucose, the recombinant protein was able to serve as a substrate for glycogen synthase, leading to the production of high M(r) polysaccharide. Barbetti et al. (1996) identified a human glycogenin cDNA. The predicted 333-amino acid human protein shares 93% identity with rabbit muscle glycogenin. Northern blot analysis revealed that the 2.4-kb glycogenin mRNA was expressed prominently in human skeletal muscle and heart, and to a lesser extent in several other tissues. Mu et al. (1997) isolated cDNAs encoding a related protein, which they designated glycogenin-2 (OMIM Ref. No. 300198). They suggested that muscle glycogenin be referred to as glycogenin-1.

Full details of the abovementioned studies are described in the following publications, the disclosure of which are hereby incorporated by reference:

Barbetti, F.; Rocchi, M.; Bossolasco, M.; Cordera, R.; Sbraccia, P.; Finelli, P.; Consalez, G. G.: The human skeletal muscle glycogenin gene: cDNA, tissue expression, and chromosomal localization. Biochem. Biophys. Res. Commun. 220:72-77, 1996; and Mu, J.; Skurat, A. V.; Roach, P. J.: Glycogenin-2, a novel self-glucosylating protein involved in liver glycogen biosynthesis. J. Biol. Chem. 272:27589-27597, 1997.

Further studies establishing the function and utilities of GYG are found in John Hopkins OMIM database record ID 603942, and in cited publications listed in Table 5, which are hereby incorporated by reference. H-plk (Accession NP_056936.1) is another GAM189 target gene, herein designated TARGET GENE. H-plk BINDING SITE is a target binding site found in the 5' untranslated region of mRNA encoded by H-plk, corresponding to a target binding site such as BINDING SITE I, BINDING SITE II or BINDING SITE III of FIG. 8. Table 4 illustrates the complementarity of the nucleotide sequences of H-plk BINDING SITE, designated SEQ ID:12753, to the nucleotide sequence of GAM189 RNA, herein designated GAM RNA, also designated SEQ ID:246.

Another function of GAM189 is therefore inhibition of H-plk (Accession NP_056936.1). Accordingly, utilities of GAM189 include diagnosis, prevention and treatment of diseases and clinical conditions associated with H-plk.

H2AV (Accession NP_619541.1) is another GAM189 target gene, herein designated TARGET GENE. H2AV BINDING SITE is a target binding site found in the 3' untranslated region of multiple transcripts of mRNA encoded by H2AV, corresponding to a target binding site such as BINDING SITE I, BINDING SITE II or BINDING SITE III of FIG. 8. Table 4 illustrates the complementarity of the nucleotide sequences of H2AV BINDING SITE, designated SEQ ID:18864, to the nucleotide sequence of GAM189 RNA, herein designated GAM RNA, also designated SEQ ID:246.

Another function of GAM189 is therefore inhibition of H2AV (Accession NP_619541.1). Accordingly, utilities of GAM189 include diagnosis, prevention and treatment of diseases and clinical conditions associated with H2AV.

H63 (Accession NP_816929.1) is another GAM189 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:4554, to the nucleotide sequence of GAM189 RNA, herein designated GAM RNA, also designated SEQ ID:246.

Another function of GAM189 is therefore inhibition of H63 (Accession NP_816929.1). Accordingly, utilities of GAM189 include diagnosis, prevention and treatment of diseases and clinical conditions associated with H63.

H63 (Accession NP_612432.2) is another GAM189 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:4554, to the nucleotide sequence of GAM189 RNA, herein designated GAM RNA, also designated SEQ ID:246.

Another function of GAM189 is therefore inhibition of H63 (Accession NP_612432.2). Accordingly, utilities of GAM189 include diagnosis, prevention and treatment of diseases and clinical conditions associated with H63.

Hepatitis a virus cellular receptor 2 (HAVCR2, Accession NP_116171.2) is another GAM189 target gene, herein designated TARGET GENE. HAVCR2 BINDING SITE is a target binding site found in the 3' untranslated region of mRNA encoded by HAVCR2, corresponding to a target binding site such as BINDING SITE I, BINDING SITE II or BINDING SITE III of FIG. 8. Table 4 illustrates the complementarity of the nucleotide sequences of HAVCR2 BINDING SITE, designated SEQ ID:16260, to the nucleotide sequence of GAM189 RNA, herein designated GAM RNA, also designated SEQ ID:246.

Another function of GAM189 is therefore inhibition of Hepatitis a virus cellular receptor 2 (HAVCR2, Accession NP_116171.2). Accordingly, utilities of GAM189 include diagnosis, prevention and treatment of diseases and clinical conditions associated with HAVCR2.

HE9 (Accession NP_741997.1) is another GAM189 target gene, herein designated TARGET GENE. HE9 BINDING SITE is a target binding site found in the 3' untranslated region of mRNA encoded by HE9, corresponding to a target binding site such as BINDING SITE I, BINDING SITE II or BINDING SITE III of FIG. 8. Table 4 illustrates the complementarity of the nucleotide sequences of HE9 BINDING SITE, designated SEQ ID:7942, to the nucleotide sequence of GAM189 RNA, herein designated GAM RNA, also designated SEQ ID:246.

Another function of GAM189 is therefore inhibition of HE9 (Accession NP_741997.1). Accordingly, utilities of GAM189 include diagnosis, prevention and treatment of diseases and clinical conditions associated with HE9.

Hephaestin (HEPH, Accession NP_055614.1) is another GAM189 target gene, herein designated TARGET GENE. HEPH BINDING SITE is a target binding site found in the 5' untranslated region of multiple transcripts of mRNA encoded by HEPH, corresponding to a target binding site such as BINDING SITE I, BINDING SITE II or BINDING SITE III of FIG. 8. Table 4 illustrates the complementarity of the nucleotide sequences of HEPH BINDING SITE, designated SEQ ID:15338, to the nucleotide sequence of GAM189 RNA, herein designated GAM RNA, also designated SEQ ID:246.

Another function of GAM189 is therefore inhibition of Hephaestin (HEPH, Accession NP_055614.1), a gene which is thought to be a membrane-bound protein responsible for transport of dietary iron from epithelial cells of the intestinal lumen into the circulatory system. Accordingly, utilities of GAM189 include diagnosis, prevention and treatment of diseases and clinical conditions associated with HEPH.

The function of HEPH has been established by previous studies. Vulpe et al. (1999) found that Heph expression contrasts that of Cp, which is highly expressed in liver and expressed to a lesser extent in other tissues, including brain and lung, but is not expressed in intestine, where the highest expression of Heph is found. In situ hybridization studies indicated that intestinal expression of Heph is limited to villi, with almost no signal observed in crypt cells. Iron absorption occurs in villi. Vulpe et al. (1999) found that sla mice have a deletion of 582 nucleotides from the Heph gene, predicting an in-frame omission of 194 amino acids in the gene product. On the basis of its homology with ceruloplasmin, Vulpe et al. (1999) proposed that hephaestin is a ferroxidase necessary for iron release from intestinal epithelial cells. Since it contains only 1 putative membrane-spanning domain, it is unlikely to be a transmembrane iron carrier itself; hephaestin may interact with an iron-transport protein to facilitate the movement of iron across the membrane. Hephaestin represents a link between copper and iron metabolism in mammals and offers a basis for the iron-deficiency anemia associated with copper deficiency. Copper deficiency results in the decreased absorption of dietary iron, which enters intestinal epithelium normally but cannot exit into the circulation. Indeed, intestinal iron accumulation in copper-deficient swine is similar to the iron accumulation seen in sla mice (Lee et al., 1968). The administration of copper, but not iron, to copper- deficient pigs alleviates the anemia and facilitates the egress of iron from tissues, including intestine.

Full details of the abovementioned studies are described in the following publications, the disclosure of which are hereby incorporated by reference:

Vulpe, C. D.; Kuo, Y.-M.; Murphy, T. L.; Cowley, L.; Askwith, C.; Libina, N.; Gitschier, J.; Anderson, G. J.: Hephaestin, a ceruloplasmin homologue implicated in intestinal iron transport, is defective in the sla mouse. Nature Genet. 21:195-199, 1999; and Lee, G. R.; Nacht, S.; Lukens, J. N.; Cartwright, G. E.: Iron metabolism in copper- deficient swine. J. Clin. Invest. 47:2058-2069, 1968.

Further studies establishing the function and utilities of HEPH are found in John Hopkins OMIM database record ID 300167, and in cited publications listed in Table 5, which are hereby incorporated by reference. Hexosaminidase a (alpha polypeptide) (HEXA, Accession NP_000511.1) is another GAM189 target gene, herein designated TARGET GENE. HEXA BINDING SITE is a target binding site found in the 3' untranslated region of mRNA encoded by HEXA, corresponding to a target binding site such as BINDING SITE I, BINDING SITE II or BINDING SITE III of FIG. 8. Table 4 illustrates the complementarity of the nucleotide sequences of HEXA BINDING SITE, designated SEQ ID:14035, to the nucleotide sequence of GAM189 RNA, herein designated GAM RNA, also designated SEQ ID:246.

Another function of GAM189 is therefore inhibition of Hexosaminidase a (alpha polypeptide) (HEXA, Accession NP_000511.1). Accordingly, utilities of GAM189 include diagnosis, prevention and treatment of diseases and clinical conditions associated with HEXA.

Holocarboxylase synthetase (biotin-[proprionyl-coenzyme a-carboxylase (atp-hydrolysing)] ligase) (HLCS, Accession NP_000402.2) is another GAM189 target gene, herein designated TARGET GENE. HLCS BINDING SITE is a target binding site found in the 5' untranslated region of mRNA encoded by HLCS, corresponding to a target binding site such as BINDING SITE I, BINDING SITE II or BINDING SITE III of FIG. 8. Table 4 illustrates the complementarity of the nucleotide sequences of HLCS BINDING SITE, designated SEQ ID:2142, to the nucleotide sequence of GAM189 RNA, herein designated GAM RNA, also designated SEQ ID:246.

Another function of GAM189 is therefore inhibition of Holocarboxylase synthetase (biotin-[proprionyl-coenzyme a-carboxylase (atp-hydrolysing)] ligase) (HLCS, Accession NP_000402.2). Accordingly, utilities of GAM189 include diagnosis, prevention and treatment of diseases and clinical conditions associated with HLCS.

High-mobility group 20a (HMG20A, Accession NP_060670.1) is another GAM189 target gene, herein designated TARGET GENE. HMG20A BINDING SITE is a target binding site found in the 3' untranslated region of mRNA encoded by HMG20A, corresponding to a target binding site such as BINDING SITE I, BINDING SITE II or BINDING SITE III of FIG. 8. Table 4 illustrates the complementarity of the nucleotide sequences of HMG20A BINDING SITE, designated SEQ ID:5040, to the nucleotide sequence of GAM189 RNA, herein designated GAM RNA, also designated SEQ ID:246.

Another function of GAM189 is therefore inhibition of High-mobility group 20a (HMG20A, Accession NP_060670.1). Accordingly, utilities of GAM189 include diagnosis, prevention and treatment of diseases and clinical conditions associated with HMG20A.

HPRN (Accession NP_071938.1) is another GAM189 target gene, herein designated TARGET GENE. HPRN BINDING SITE is a target binding site found in the 3' untranslated region of mRNA encoded by HPRN, corresponding to a target binding site such as BINDING SITE I, BINDING SITE II or BINDING SITE III of FIG. 8. Table 4 illustrates the complementarity of the nucleotide sequences of HPRN BINDING SITE, designated SEQ ID:12916, to the nucleotide sequence of GAM189 RNA, herein designated GAM RNA, also designated SEQ ID:246.

Another function of GAM189 is therefore inhibition of HPRN (Accession NP_071938.1). Accordingly, utilities of GAM189 include diagnosis, prevention and treatment of diseases and clinical conditions associated with HPRN.

Histamine receptor h4 (HRH4, Accession NP_067637.2) is another GAM189 target gene, herein designated TARGET GENE. HRH4 BINDING SITE1 and HRH4 BINDING SITE2 are target binding sites found in untranslated regions of mRNA encoded by HRH4, corresponding to target binding sites such as BINDING SITE I, BINDING SITE II or BINDING SITE III of FIG. 8. Table 4 illustrates the complementarity of the nucleotide sequences of HRH4 BINDING SITE1 and HRH4 BINDING SITE2, designated SEQ ID:3116 and SEQ ID:18211 respectively, to the nucleotide sequence of GAM189 RNA, herein designated GAM RNA, also designated SEQ ID:246.

Another function of GAM189 is therefore inhibition of Histamine receptor h4 (HRH4, Accession NP_067637.2). Accordingly, utilities of GAM189 include diagnosis, prevention and treatment of diseases and clinical conditions associated with HRH4.

Hmt1 hnrnp methyltransferase-like 3 (s. cerevisiae) (HRMT1L3, Accession NP_062828.2) is another GAM189 target gene, herein designated TARGET GENE. HRMT1L3 BINDING SITE is a target binding site found in the 5' untranslated region of mRNA encoded by HRMT1L3, corresponding to a target binding site such as BINDING SITE I, BINDING SITE II or BINDING SITE III of FIG. 8. Table 4 illustrates the complementarity of the nucleotide sequences of HRMT1L3 BINDING SITE, designated SEQ ID:18437, to the nucleotide sequence of GAM189 RNA, herein designated GAM RNA, also designated SEQ ID:246.

Another function of GAM189 is therefore inhibition of Hmt1 hnrnp methyltransferase-like 3 (s. cerevisiae) (HRMT1L3, Accession NP_062828.2). Accordingly, utilities of GAM189 include diagnosis, prevention and treatment of diseases and clinical conditions associated with HRMT1L3.

HSD3B7 (Accession NP_079469.2) is another GAM189 target gene, herein designated TARGET GENE. HSD3B7 BINDING SITE is a target binding site found in the 3' untranslated region of mRNA encoded by HSD3B7, corresponding to a target binding site such as BINDING SITE I, BINDING SITE II or BINDING SITE III of FIG. 8. Table 4 illustrates the complementarity of the nucleotide sequences of HSD3B7 BINDING SITE, designated SEQ ID:2674, to the nucleotide sequence of GAM189 RNA, herein designated GAM RNA, also designated SEQ ID:246.

Another function of GAM189 is therefore inhibition of HSD3B7 (Accession NP_079469.2). Accordingly, utilities of GAM189 include diagnosis, prevention and treatment of diseases and clinical conditions associated with HSD3B7.

HSMPP8 (Accession XP_167894.1) is another GAM189 target gene, herein designated TARGET GENE. HSMPP8 BINDING SITE is a target binding site found in the 3' untranslated region of mRNA encoded by HSMPP8, corresponding to a target binding site such as BINDING SITE I, BINDING SITE II or BINDING SITE III of FIG. 8. Table 4 illustrates the complementarity of the nucleotide sequences of HSMPP8 BINDING SITE, designated SEQ ID:7797, to the nucleotide sequence of GAM189 RNA, herein designated GAM RNA, also designated SEQ ID:246.

Another function of GAM189 is therefore inhibition of HSMPP8 (Accession XP_167894.1). Accordingly, utilities of GAM189 include diagnosis, prevention and treatment of diseases and clinical conditions associated with HSMPP8.

Heat shock 70 kda protein 4 (HSPA4, Accession XP_114482.1) is another GAM189 target gene, herein designated TARGET GENE. HSPA4 BINDING SITE is a target binding site found in the 3' untranslated region of mRNA encoded by HSPA4, corresponding to a target binding site such as BINDING SITE I, BINDING SITE II or BINDING SITE III of FIG. 8. Table 4 illustrates the complementarity of the nucleotide sequences of HSPA4 BINDING SITE, designated SEQ ID:15189, to the nucleotide sequence of GAM189 RNA, herein designated GAM RNA, also designated SEQ ID:246.

Another function of GAM189 is therefore inhibition of Heat shock 70 kda protein 4 (HSPA4, Accession XP_114482.1). Accordingly, utilities of GAM189 include diagnosis, prevention and treatment of diseases and clinical conditions associated with HSPA4.

HSPC065 (Accession NP_054876.2) is another GAM189 target gene, herein designated TARGET GENE. HSPC065 BINDING SITE1 and HSPC065 BINDING SITE2 are target binding sites found in untranslated regions of mRNA encoded by HSPC065, corresponding to target binding sites such as BINDING SITE I, BINDING SITE II or BINDING SITE III of FIG. 8. Table 4 illustrates the complementarity of the nucleotide sequences of HSPC065 BINDING SITE1 and HSPC065 BINDING SITE2, designated SEQ ID:4676 and SEQ ID:713 respectively, to the nucleotide sequence of GAM189 RNA, herein designated GAM RNA, also designated SEQ ID:246.

Another function of GAM189 is therefore inhibition of HSPC065 (Accession NP_054876.2). Accordingly, utilities of GAM189 include diagnosis, prevention and treatment of diseases and clinical conditions associated with HSPC065.

5-hydroxytryptamine (serotonin) receptor 1d (HTR1D, Accession NP_000855.1) is another GAM189 target gene, herein designated TARGET GENE. HTR1D BINDING SITE is a target binding site found in the 3' untranslated region of mRNA encoded by HTR1D, corresponding to a target binding site such as BINDING SITE I, BINDING SITE II or BINDING SITE III of FIG. 8. Table 4 illustrates the complementarity of the nucleotide sequences of HTR1D BINDING SITE, designated SEQ ID:2563, to the nucleotide sequence of GAM189 RNA, herein designated GAM RNA, also designated SEQ ID:246.

Another function of GAM189 is therefore inhibition of 5-hydroxytryptamine (serotonin) receptor 1d (HTR1D, Accession NP_000855.1), a gene which belongs to g-protein coupled receptor. Accordingly, utilities of GAM189 include diagnosis, prevention and treatment of diseases and clinical conditions associated with HTR1D.

The function of HTR1D has been established by previous studies. The serotonin 1D receptor was initially characterized by radioligand binding procedures using membranes derived from bovine caudate nucleus. The 5-HT-1D receptor is known to be a G protein-coupled receptor. Sumatriptan, an agent effective in the treatment of acute migraine, is the only ligand yet identified that is selective for the 5-HT-1D receptor. Weinshank et al. (1992) reported the cloning, deduced amino acid sequences, pharmacologic properties, and second-messenger coupling of a pair of human 5-HT-1D receptor genes, which they designated alpha and beta due to their strong similarities. Both genes have no introns in their coding regions, are expressed in the human cerebral cortex, and can couple to inhibition of adenylate cyclase activity. Their pharmacologic binding properties match closely those of human, bovine, and guinea pig 5-HT-1D sites. Libert et al. (1991) obtained cDNA clones encoding 4 receptors of the G protein-coupled receptor family by selective amplification and cloning from thyroid cDNA. One of these clones, termed RDC4 by them, showed close structural similarity with the serotonin 5HT1A receptor (OMIM Ref. No. 109760). By in situ hybridization, they demonstrated that the gene (HTR1D) is located on chromosome 1 at 1p36.3-p34.3. By Southern blot analysis of a hybrid cell panel, Jin et al. (1992) showed that the HTR1D gene is located on chromosome 1. Wilkie et al. (1993) showed that the homologous gene in the mouse is located on chromosome 4.

Full details of the abovementioned studies are described in the following publications, the disclosure of which are hereby incorporated by reference:

Weinshank, R. L.; Zgombick, J. M.; Macchi, M. J.; Branchek, T. A.; Hartig, P. R.: Human serotonin 1D receptor is encoded by a subfamily of two distinct genes:5-HT(1D-alpha) and 5-HT(1D-beta). Proc. Nat. Acad. Sci. 89:3630-3634, 1992; and Wilkie, T. M.; Chen, Y.; Gilbert, D. J.; Moore, K. J.; y, L.; Simon, M. I.; Copeland, N. G.; Jenkins, N. A.: Identification, chromosomal location, and genome organization of mammalian.

Further studies establishing the function and utilities of HTR1D are found in John Hopkins OMIM database record ID 182133, and in cited publications listed in Table 5, which are hereby incorporated by reference. Hormonally upregulated neu-associated kinase (HUNK, Accession NP_055401.1) is another GAM189 target gene, herein designated TARGET GENE. HUNK BINDING SITE is a target binding site found in the 3' untranslated region of mRNA encoded by HUNK, corresponding to a target binding site such as BINDING SITE I, BINDING SITE II or BINDING SITE III of FIG. 8. Table 4 illustrates the complementarity of the nucleotide sequences of HUNK BINDING SITE, designated SEQ ID:17952, to the nucleotide sequence of GAM189 RNA, herein designated GAM RNA, also designated SEQ ID:246.

Another function of GAM189 is therefore inhibition of Hormonally upregulated neu-associated kinase (HUNK, Accession NP_055401.1). Accordingly, utilities of GAM189 include diagnosis, prevention and treatment of diseases and clinical conditions associated with HUNK.

Hus1 checkpoint homolog (s. pombe) (HUS1, Accession NP_004498.1) is another GAM189 target gene, herein designated TARGET GENE. HUS1 BINDING SITE is a target binding site found in the 3' untranslated region of mRNA encoded by HUS1, corresponding to a target binding site such as BINDING SITE I, BINDING SITE II or BINDING SITE III of FIG. 8. Table 4 illustrates the complementarity of the nucleotide sequences of HUS1 BINDING SITE, designated SEQ ID:14238, to the nucleotide sequence of GAM189 RNA, herein designated GAM RNA, also designated SEQ ID:246.

Another function of GAM189 is therefore inhibition of Hus1 checkpoint homolog (s. pombe) (HUS1, Accession NP_004498.1), a gene which May form DNA damage-responsive protein complex. Accordingly, utilities of GAM189 include diagnosis, prevention and treatment of diseases and clinical conditions associated with HUS1.

The function of HUS1 has been established by previous studies. The S. pombe 'checkpoint rad' genes hus1, rad1 (OMIM Ref. No. 603153), rad3, rad9 (OMIM Ref. No. 603761), rad17 (OMIM Ref. No. 603139), and rad26 are essential for both the incomplete DNA replication (S-M) and DNA damage checkpoints. An early step in the DNA damage checkpoint response appears to involve activation of the rad3 phosphatidylinositol 3-kinase-related (PIK-R) checkpoint kinase (see OMIM Ref. No. AT; 208900) by the other 5 checkpoint rad gene products. Kostrub et al. (1998) found that the fission yeast hus1 and rad1 proteins form a stable complex, and that the formation of this complex is dependent on rad9, suggesting that these 3 proteins may exist in a discrete complex in the absence of checkpoint activation. Hus1 is phosphorylated in response to DNA damage, and this phosphorylation requires rad3 and the other checkpoint rad genes. By searching EST databases, Kostrub et al. (1998) and Dean et al. (1998) each identified mouse and human cDNAs encoding hus1 homologs. Kostrub et al. (1998) reported that the predicted 281-amino acid human protein shares 30% and 86% identity with S. pombe hus1 and mouse Hus1, respectively. However, neither mammalian gene complemented a fission yeast hus1 mutation. Volkmer and Karnitz (1999) demonstrated that the human RAD1 and HUS1 proteins associate in a complex that interacts with a highly modified form of RAD9. They concluded that these 3 proteins are central components of a DNA damage- responsive protein complex in human cells. AU-rich elements (AREs) are cis-acting sequences typically found in 3-prime untranslated regions of many labile mRNAs. AREs either mediate rapid degradation of mRNA or inhibit its translation. Dominguez et al. (1998) identified EE2-16C, a HUS1 cDNA, among a collection of ARE-containing mRNAs.

Full details of the abovementioned studies are described in the following publications, the disclosure of which are hereby incorporated by reference:

Kostrub, C. F.; Knudsen, K.; Subramani, S.; Enoch, T.: Hus1p, a conserved fission yeast checkpoint protein, interacts with Rad1p and is phosphorylated in response to DNA damage. EMBO J. 17:2055-2066, 1998; and Volkmer, E.; Karnitz, L. M.: Human homologs of Schizosaccharomyces pombe Rad1, Hus1, and Rad9 form a DNA damage-responsive protein complex. J. Biol. Chem. 274:567-570, 1999.

Further studies establishing the function and utilities of HUS1 are found in John Hopkins OMIM database record ID 603760, and in cited publications listed in Table 5, which are hereby incorporated by reference. Hyaluronoglucosaminidase 4 (HYAL4, Accession NP_036401.1) is another GAM189 target gene, herein designated TARGET GENE. HYAL4 BINDING SITE is a target binding site found in the 5' untranslated region of mRNA encoded by HYAL4, corresponding to a target binding site such as BINDING SITE I, BINDING SITE II or BINDING SITE III of FIG. 8. Table 4 illustrates the complementarity of the nucleotide sequences of HYAL4 BINDING SITE, designated SEQ ID:2143, to the nucleotide sequence of GAM189 RNA, herein designated GAM RNA, also designated SEQ ID:246.

Another function of GAM189 is therefore inhibition of Hyaluronoglucosaminidase 4 (HYAL4, Accession NP_036401.1). Accordingly, utilities of GAM189 include diagnosis, prevention and treatment of diseases and clinical conditions associated with HYAL4.

HYPB (Accession NP_036403.1) is another GAM189 target gene, herein designated TARGET GENE. HYPB BINDING SITE is a target binding site found in the 3' untranslated region of multiple transcripts of mRNA encoded by HYPB, corresponding to a target binding site such as BINDING SITE I, BINDING SITE II or BINDING SITE III of FIG. 8. Table 4 illustrates the complementarity of the nucleotide sequences of HYPB BINDING SITE, designated SEQ ID:14422, to the nucleotide sequence of GAM189 RNA, herein designated GAM RNA, also designated SEQ ID:246.

Another function of GAM189 is therefore inhibition of HYPB (Accession NP_036403.1). Accordingly, utilities of GAM189 include diagnosis, prevention and treatment of diseases and clinical conditions associated with HYPB.

Intercellular adhesion molecule 1 (cd54), human rhinovirus receptor (ICAM1, Accession NP_000192.1) is another GAM189 target gene, herein designated TARGET GENE. ICAM1 BINDING SITE is a target binding site found in the 3' untranslated region of mRNA encoded by ICAM1, corresponding to a target binding site such as BINDING SITE I, BINDING SITE II or BINDING SITE III of FIG. 8. Table 4 illustrates the complementarity of the nucleotide sequences of ICAM1 BINDING SITE, designated SEQ ID:12075, to the nucleotide sequence of GAM189 RNA, herein designated GAM RNA, also designated SEQ ID:246.

Another function of GAM189 is therefore inhibition of Intercellular adhesion molecule 1 (cd54), human rhinovirus receptor (ICAM1, Accession NP_000192.1), a gene which binds the integrin LFA-1 (ITGB2) and promotes adhesion; member of the immunoglobulin superfamily and therefore may be associated with Malaria, cerebral, susceptibility to. Accordingly, utilities of GAM189 include diagnosis, prevention and treatment of Malaria, cerebral, susceptibility to, and of other diseases and clinical conditions associated with ICAM1.

The function of ICAM1 has been established by previous studies. Intercellular adhesion molecule-1 (ICAM1) is a ligand for lymphocyte-function associated (LFA) antigens (see OMIM Ref. No. 116920). Simmons et al. (1988) analyzed a cDNA clone of the ICAM1 gene and found that it showed homology to the neural cell adhesion molecule NCAM (OMIM Ref. No. 116930). Greve et al. (1989) demonstrated that the ICAM1 protein is the major human rhinovirus receptor. Bella et al. (1998) analyzed the structural features of the ICAM1 molecule that underlie its function as a receptor for the major group of human rhinoviruses and as a ligand for LFA-1. Expression of HLA-DR antigen (see OMIM Ref. No. 142860) and ICAM1 in human conjunctival epithelium is upregulated in patients with dry eyes associated with Sjogren syndrome (OMIM Ref. No. 270150). Tsubota et al. (1999) reported that this upregulation in Sjogren syndrome patients may be controlled by interferon-gamma (OMIM Ref. No. 147570) through the activation of transcription factor NFKB (nuclear OMIM Ref. No. 164011). Pisella et al. (2000) reported that a significant increase of HLA-DR and ICAM1 expression by epithelial cells was consistently found in patients with keratoconjunctivitis sicca (Sjogren syndrome) compared with expression in normal eyes. These 2 markers were well correlated with each other and correlated inversely with tear break-up time and tear production as measured by the Schirmer test. The percentage of conjunctival goblet cells was significantly decreased in dry eye patients with a significant negative correlation with both HLA-DR and ICAM1 markers. Lu and Cyster (2002) studied the mechanisms that control localization of marginal zone B cells. They demonstrated that marginal zone B cells express elevated levels of the integrins LFA-1 (see OMIM Ref. No. 153370) and alpha-4-beta-1 (see OMIM Ref. No. 192975 and 135630), and that the marginal zone B cells bind to the ligands ICAM1 and VCAM1 (OMIM Ref. No. 192225). These ligands are expressed within the marginal zone in a lymphotoxin- dependent manner. Combined inhibition of LFA-1 and alpha-4-beta-1 causes a rapid and selective release of B cells from the marginal zone. Furthermore, lipopolysaccharide-triggered marginal zone B cell relocalization involves downregulation of integrin-mediated adhesion. Lu and Cyster (2002) concluded that their studies identified key requirements for marginal zone B cell localization and established a role for integrins in peripheral lymphoid tissue compartmentalization.

Animal model experiments lend further support to the function of ICAM1. To test the role of Icam1 in intact animals, Sligh et al. (1993) disrupted the gene in murine embryonic stem cells by gene targeting. Homozygous deficient animals developed normally, were fertile, and had a moderate granulocytosis. Studies were consistent with complete loss of surface expression of the protein. Deficient mice exhibited prominent abnormalities of inflammatory responses including impaired neutrophil emigration in response to chemical peritonitis and decreased contact hypersensitivity to 2,4-dinitrofluorobenzene. Mutant cells provided negligible stimulation in the mixed lymphocyte reaction, although they proliferated normally as responder cells It is appreciated that the abovementioned animal model for ICAM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sligh, J. E., Jr.; Ballantyne, C. M.; Rich, S. S.; Hawkins, H. K.; Smith, C. W.; Bradley, A.; Beaudet, A. L.: Inflammatory and immune responses are impaired in mice deficient in intercellular adhesion molecule 1. Proc. Nat. Acad. Sci. 90: 8529-8533, 1993; and Lu, T. T.; Cyster, J. G.: Integrin-mediated long-term B cell retention in the splenic marginal zone. Science 297:409-412, 2002.

Further studies establishing the function and utilities of ICAM1 are found in John Hopkins OMIM database record ID 147840, and in cited publications listed in Table 5, which are hereby incorporated by reference. ICK (Accession NP_055735.1) is another GAM189 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:7385, to the nucleotide sequence of GAM189 RNA, herein designated GAM RNA, also designated SEQ ID:246.

Another function of GAM189 is therefore inhibition of ICK (Accession NP_055735.1). Accordingly, utilities of GAM189 include diagnosis, prevention and treatment of diseases and clinical conditions associated with ICK.

ICK (Accession NP_057597.2) is another GAM189 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:7385, to the nucleotide sequence of GAM189 RNA, herein designated GAM RNA, also designated SEQ ID:246.

Another function of GAM189 is therefore inhibition of ICK (Accession NP_057597.2). Accordingly, utilities of GAM189 include diagnosis, prevention and treatment of diseases and clinical conditions associated with ICK.

Insulin-like growth factor 1 (somatomedin c) (IGF1, Accession NP_000609.1) is another GAM189 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:6279, to the nucleotide sequence of GAM189 RNA, herein designated GAM RNA, also designated SEQ ID:246.

Another function of GAM189 is therefore inhibition of Insulin-like growth factor 1 (somatomedin c) (IGF1, Accession NP_000609.1), a gene which are structurally and functionally related to insulin but have a much higher growth-promoting activity and therefore may be associated with Growth retardation with sensorineural deafness and mental retardation. Accordingly, utilities of GAM189 include diagnosis, prevention and treatment of Growth retardation with sensorineural deafness and mental retardation, and of other diseases and clinical conditions associated with IGF1.

The function of IGF1 and its association with various diseases and clinical conditions, has been established by previous studies, as described hereinabove with reference to GAM66.2. Immunoglobulin mu binding protein 2 (IGHMBP2, Accession NP_002171.1) is another GAM189 target gene, herein designated TARGET GENE. IGHMBP2 BINDING SITE is a target binding site found in the 5' untranslated region of mRNA encoded by IGHMBP2, corresponding to a target binding site such as BINDING SITE I, BINDING SITE II or BINDING SITE III of FIG. 8. Table 4 illustrates the complementarity of the nucleotide sequences of IGHMBP2 BINDING SITE, designated SEQ ID:17385, to the nucleotide sequence of GAM189 RNA, herein designated GAM RNA, also designated SEQ ID:246.

Another function of GAM189 is therefore inhibition of Immunoglobulin mu binding protein 2 (IGHMBP2, Accession NP_002171.1). Accordingly, utilities of GAM189 include diagnosis, prevention and treatment of diseases and clinical conditions associated with IGHMBP2.

Immunoglobulin lambda-like polypeptide 1 (IGLL1, Accession NP_690594.1) is another GAM189 target gene, herein designated TARGET GENE. IGLL1 BINDING SITE is a target binding site found in the 5' untranslated region of multiple transcripts of mRNA encoded by IGLL1, corresponding to a target binding site such as BINDING SITE I, BINDING SITE II or BINDING SITE III of FIG. 8. Table 4 illustrates the complementarity of the nucleotide sequences of IGLL1 BINDING SITE, designated SEQ ID:4573, to the nucleotide sequence of GAM189 RNA, herein designated GAM RNA, also designated SEQ ID:246.

Another function of GAM189 is therefore inhibition of Immunoglobulin lambda-like polypeptide 1 (IGLL1, Accession NP_690594.1), a gene which expressed only in pre-b-cells and a special b-cell line (which is surface ig negative). and therefore may be associated with Agammaglobulinemia, autosomal recessive. Accordingly, utilities of GAM189 include diagnosis, prevention and treatment of Agammaglobulinemia, autosomal recessive, and of other diseases and clinical conditions associated with IGLL1.

The function of IGLL1 has been established by previous studies. The VpreB (OMIM Ref. No. 605141) and lambda-5 genes encode the iota and omega polypeptide chains, respectively (Pillai and Baltimore, 1988), which associate with the immunoglobulin (Ig) mu chain to form a molecular complex that is expressed on the surface of pre-B cells. This complex presumably regulates Ig gene rearrangements in the early steps of B-cell differentiation. In the mouse the 2 genes are simultaneously expressed in pre-B cells, are only 4.6 kb apart, and belong to the same transcription unit. A primary transcript is synthesized from which the pre- B and lambda-5 mRNAs are derived by alternative splicing. In the human, however, Mattei et al. (1991) concluded that the 2 genes, designated VPREB1 and IGLL1, are separate. Schiff et al. (1989) isolated from a human fetal liver cDNA library clones that were only 85% homologous to the functional C-lambda genes (IGLC; 147220) and showed that they represent additional nonallelic members of a C-lambda-like family. Using pulsed field gel electrophoresis, the genes were shown to be present on a 200-kb DNA fragment, distinct from the C-lambda cluster. A splicing event accounted for differences between the 2 cDNAs. By in situ hybridization, Mattei et al. (1991) demonstrated that the pre- B-specific lambda-like cluster is located in the 22q11.2-q12.3 region, distal to the IgC lambda locus. B-cell precursors transiently express a pre-B cell receptor complex consisting of a rearranged mu heavy chain, a surrogate light chain composed of lambda-5/14.1 and VpreB, and the immunoglobulin-associated signal transducing chains, Ig-alpha and Ig-beta. Mutations in the mu heavy chain are associated with complete failure of B-cell development in both humans and mice. In humans, the picture is that of autosomal recessive agammaglobulinemia (147020.0001 ff). Mutations in murine lambda-5 result in a 'leaky' phenotype with detectable humoral responses. In evaluating patients with agammaglobulinemia and markedly reduced numbers of B cells, Minegishi et al. (1998) identified a boy with mutations on both alleles of the gene encoding lambda-5/14.1. The maternal allele carried a premature stop codon in the first exon of the gene and the paternal allele demonstrated 3-bp substitutions in a 33-bp sequence in exon 3. The 3 substitutions corresponded to the sequence in the lambda-5/14.1 pseudogene 16.1 and resulted in an amino acid substitution at an invariant proline. When expressed in COS cells, the allele carrying the pseudogene sequence resulted in defective folding and secretion of mutant lambda-5/14.1. These findings indicated that expression of the functional lambda-5/14.1 is critical for B-cell development in the human Full details of the abovementioned studies are described in the following publications, the disclosure of which are hereby incorporated by reference:

Kudo, A.; Melchers, F.: A second gene, Vpre-B in the lambda 5 locus of the mouse, which appears to be selectively expressed in pre-B lymphocytes. EMBO J. 6:2267-2272, 1987; and Mattei, M.-G.; Fumoux, F.; Roeckel, N.; Fougereau, M.; Schiff, C.: The human pre- B-specific lambda-like cluster is located in the 22q11.2-22q12.3 region, distal to the IgC-lambda locus.

Further studies establishing the function and utilities of IGLL1 are found in John Hopkins OMIM database record ID 146770, and in cited publications listed in Table 5, which are hereby incorporated by reference. Immunoglobulin lambda-like polypeptide 1 (IGLL1, Accession NP_064455.1) is another GAM189 target gene, herein designated TARGET GENE. IGLL1 BINDING SITE is a target binding site found in the 5' untranslated region of multiple transcripts of mRNA encoded by IGLL1, corresponding to a target binding site such as BINDING SITE I, BINDING SITE II or BINDING SITE III of FIG. 8. Table 4 illustrates the complementarity of the nucleotide sequences of IGLL1 BINDING SITE, designated SEQ ID:4573, to the nucleotide sequence of GAM189 RNA, herein designated GAM RNA, also designated SEQ ID:246.

Another function of GAM189 is therefore inhibition of Immunoglobulin lambda-like polypeptide 1 (IGLL1, Accession NP_064455.1), a gene which expressed only in pre-b-cells and a special b-cell line (which is surface ig negative). and therefore may be associated with Agammaglobulinemia, autosomal recessive. Accordingly, utilities of GAM189 include diagnosis, prevention and treatment of Agammaglobulinemia, autosomal recessive, and of other diseases and clinical conditions associated with IGLL1.

The function of IGLL1 has been established by previous studies. The VpreB (OMIM Ref. No. 605141) and lambda-5 genes encode the iota and omega polypeptide chains, respectively (Pillai and Baltimore, 1988), which associate with the immunoglobulin (Ig) mu chain to form a molecular complex that is expressed on the surface of pre-B cells. This complex presumably regulates Ig gene rearrangements in the early steps of B-cell differentiation. In the mouse the 2 genes are simultaneously expressed in pre-B cells, are only 4.6 kb apart, and belong to the same transcription unit. A primary transcript is synthesized from which the pre- B and lambda-5 mRNAs are derived by alternative splicing. In the human, however, Mattei et al. (1991) concluded that the 2 genes, designated VPREB1 and IGLL1, are separate. Schiff et al. (1989) isolated from a human fetal liver cDNA library clones that were only 85% homologous to the functional C-lambda genes (IGLC; 147220) and showed that they represent additional nonallelic members of a C-lambda-like family. Using pulsed field gel electrophoresis, the genes were shown to be present on a 200-kb DNA fragment, distinct from the C-lambda cluster. A splicing event accounted for differences between the 2 cDNAs. By in situ hybridization, Mattei et al. (1991) demonstrated that the pre- B-specific lambda-like cluster is located in the 22q11.2-q12.3 region, distal to the IgC lambda locus. B-cell precursors transiently express a pre-B cell receptor complex consisting of a rearranged mu heavy chain, a surrogate light chain composed of lambda-5/14.1 and VpreB, and the immunoglobulin-associated signal transducing chains, Ig-alpha and Ig-beta. Mutations in the mu heavy chain are associated with complete failure of B-cell development in both humans and mice. In humans, the picture is that of autosomal recessive agammaglobulinemia (147020.0001 ff). Mutations in murine lambda-5 result in a 'leaky' phenotype with detectable humoral responses. In evaluating patients with agammaglobulinemia and markedly reduced numbers of B cells, Minegishi et al. (1998) identified a boy with mutations on both alleles of the gene encoding lambda-5/14.1. The maternal allele carried a premature stop codon in the first exon of the gene and the paternal allele demonstrated 3-bp substitutions in a 33-bp sequence in exon 3. The 3 substitutions corresponded to the sequence in the lambda-5/14.1 pseudogene 16.1 and resulted in an amino acid substitution at an invariant proline. When expressed in COS cells, the allele carrying the pseudogene sequence resulted in defective folding and secretion of mutant lambda-5/14.1. These findings indicated that expression of the functional lambda-5/14.1 is critical for B-cell development in the human Full details of the abovementioned studies are described in the following publications, the disclosure of which are hereby incorporated by reference:

Kudo, A.; Melchers, F.: A second gene, Vpre-B in the lambda 5 locus of the mouse, which appears to be selectively expressed in pre-B lymphocytes. EMBO J. 6:2267-2272, 1987; and Mattei, M.-G.; Fumoux, F.; Roeckel, N.; Fougereau, M.; Schiff, C.: The human pre- B-specific lambda-like cluster is located in the 22q11.2-22q12.3 region, distal to the IgC-lambda locus.

Further studies establishing the function and utilities of IGLL1 are found in John Hopkins OMIM database record ID 146770, and in cited publications listed in Table 5, which are hereby incorporated by reference. Interleukin 11 (IL11, Accession NP_000632.1) is another GAM189 target gene, herein designated TARGET GENE. IL11 BINDING SITE is a target binding site found in the 3' untranslated region of mRNA encoded by IL11, corresponding to a target binding site such as BINDING SITE I, BINDING SITE II or BINDING SITE III of FIG. 8. Table 4 illustrates the complementarity of the nucleotide sequences of IL11 BINDING SITE, designated SEQ ID:11544, to the nucleotide sequence of GAM189 RNA, herein designated GAM RNA, also designated SEQ ID:246.

Another function of GAM189 is therefore inhibition of Interleukin 11 (IL11, Accession NP_000632.1), a gene which stimulates the proliferation of hematopoietic stem cells and megakaryocyte progenitor cells and induces megakaryocyte maturation. Accordingly, utilities of GAM189 include diagnosis, prevention and treatment of diseases and clinical conditions associated with IL11.

The function of IL11 and its association with various diseases and clinical conditions, has been established by previous studies, as described hereinabove with reference to GAM41.1. Interleukin 12 receptor, beta 1 (IL12RB1, Accession NP_714912.1) is another GAM189 target gene, herein designated TARGET GENE. IL12RB1 BINDING SITE is a target binding site found in the 3' untranslated region of multiple transcripts of mRNA encoded by IL12RB1, corresponding to a target binding site such as BINDING SITE I, BINDING SITE II or BINDING SITE III of FIG. 8. Table 4 illustrates the complementarity of the nucleotide sequences of IL12RB1 BINDING SITE, designated SEQ ID:10756, to the nucleotide sequence of GAM189 RNA, herein designated GAM RNA, also designated SEQ ID:246.

Another function of GAM189 is therefore inhibition of Interleukin 12 receptor, beta 1 (IL12RB1, Accession NP_714912.1). Accordingly, utilities of GAM189 include diagnosis, prevention and treatment of diseases and clinical conditions associated with IL12RB1.

Interleukin 16 (lymphocyte chemoattractant factor) (IL16, Accession NP_757366.1) is another GAM189 target gene, herein designated TARGET GENE. IL16 BINDING SITE is a target binding site found in the 5' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:19554, to the nucleotide sequence of GAM189 RNA, herein designated GAM RNA, also designated SEQ ID:246.

Another function of GAM189 is therefore inhibition of Interleukin 16 (lymphocyte chemoattractant factor) (IL16, Accession NP_757366.1), a gene which modulates T-cell activation. Accordingly, utilities of GAM189 include diagnosis, prevention and treatment of diseases and clinical conditions associated with IL16.

The function of IL16 and its association with various diseases and clinical conditions, has been established by previous studies, as described hereinabove with reference to GAM66.1. Interleukin 21 receptor (IL21R, Accession NP_851564.1) is another GAM189 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM189 RNA, herein designated GAM RNA, also designated SEQ ID:246.

Another function of GAM189 is therefore inhibition of Interleukin 21 receptor (IL21R, Accession NP_851564.1), a gene which is involved in receptor mediated endocytosis and transduces the mitogenic signals of il- 2. Accordingly, utilities of GAM189 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 21 receptor (IL21R, Accession NP_851565.1) is another GAM189 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM189 RNA, herein designated GAM RNA, also designated SEQ ID:246.

Another function of GAM189 is therefore inhibition of Interleukin 21 receptor (IL21R, Accession NP_851565.1), a gene which is involved in receptor mediated endocytosis and transduces the mitogenic signals of il- 2. Accordingly, utilities of GAM189 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 21 receptor (IL21R, Accession NP_068570.1) is another GAM189 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM189 RNA, herein designated GAM RNA, also designated SEQ ID:246.

Another function of GAM189 is therefore inhibition of Interleukin 21 receptor (IL21R, Accession NP_068570.1), a gene which is involved in receptor mediated endocytosis and transduces the mitogenic signals of il- 2. Accordingly, utilities of GAM189 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 28 receptor, alpha (IL28RA, Accession NP_775087.1) is another GAM189 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM189 RNA, herein designated GAM RNA, also designated SEQ ID:246.

Another function of GAM189 is therefore inhibition of Interleukin 28 receptor, alpha (IL28RA, Accession NP_775087.1). Accordingly, utilities of GAM189 include diagnosis, prevention and treatment of diseases and clinical conditions associated with IL28RA.

Interleukin 28 receptor, alpha (IL28RA, Accession NP_734464.1) is another GAM189 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM189 RNA, herein designated GAM RNA, also designated SEQ ID:246.

Another function of GAM189 is therefore inhibition of Interleukin 28 receptor, alpha (IL28RA, Accession NP_734464.1). Accordingly, utilities of GAM189 include diagnosis, prevention and treatment of diseases and clinical conditions associated with IL28RA.

Interleukin 28 receptor, alpha (IL28RA, Accession NP_775088.1) is another GAM189 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM189 RNA, herein designated GAM RNA, also designated SEQ ID:246.

Another function of GAM189 is therefore inhibition of Interleukin 28 receptor, alpha (IL28RA, Accession NP_775088.1). Accordingly, utilities of GAM189 include diagnosis, prevention and treatment of diseases and clinical conditions associated with IL28RA.

Interleukin 5 receptor, alpha (IL5RA, Accession NP_783853.1) is another GAM189 target gene, herein designated TARGET GENE. IL5RA BINDING SITE is a target binding site found in the 3' untranslated region of multiple transcripts of mRNA encoded by IL5RA, corresponding to a target binding site such as BINDING SITE I, BINDING SITE II or BINDING SITE III of FIG. 8. Table 4 illustrates the complementarity of the nucleotide sequences of IL5RA BINDING SITE, designated SEQ ID:8557, to the nucleotide sequence of GAM189 RNA, herein designated GAM RNA, also designated SEQ ID:246.

Another function of GAM189 is therefore inhibition of Interleukin 5 receptor, alpha (IL5RA, Accession NP_783853.1), a gene which is the receptor for interleukin- 5. the alpha chain binds to il-5. Accordingly, utilities of GAM189 include diagnosis, prevention and treatment of diseases and clinical conditions associated with IL5RA.

The function of IL5RA has been established by previous studies. Tavernier et al. (1991) isolated cDNA clones encoding 2 receptor proteins involved in the binding of human interleukin-5 (IL5; 147850). The major transcript of this receptor gene, as analyzed in both eosinophilic sublines of human promyelocytic cells and in eosinophilic myelocytes grown from cord blood, encodes a secreted form of this receptor. A second component of the receptor was found to be identical to the beta chain of the human granulocyte-macrophage colony-stimulating factor high affinity receptor (CSF2RB; 138981). The finding that IL5 and CSF2 share a receptor subunit provides a molecular basis for the observation that these cytokines can partially interfere with each other's binding and have highly overlapping biologic activities on eosinophils. The common use of the same receptor component is reminiscent of the structural relatedness of IL3 (OMIM Ref. No. 147740), IL5, and GM-CSF (CSF2; 138960). The homology at the C terminus may indicate a related binding domain. The common origin of all 3 cytokines is also suggested by their clustered chromosomal localization and by the structure of their genes. Using a yeast 2-hybrid screen of a granulocyte cDNA library with the cytoplasmic domain of IL5RA as bait, Geijsen et al. (2001) identified an interaction of IL5RA with syntenin (SDCBP; 602217). GST pull-down, BIAcore, coimmunoprecipitation, and deletion mutant analyses confirmed an association of syntenin with the last 15 C-terminal residues of IL5RA; syntenin did not interact with CFS2RB. Within this 15-residue stretch of IL5RA, the C-terminal phenylalanine is critical. Deletion of either of the 2 tandem PDZ domains of syntenin, which are known to interact with C-terminal peptide sequences, abrogated the IL5RA-syntenin interaction. A second 2-hybrid screen identified the mouse transcriptional factor Sox4 (OMIM Ref. No. 184430) as a binding partner for syntenin but not for IL5RA. The syntenin-Sox4 interaction occurs outside of the PDZ domains of syntenin. Luciferase reporter analysis and fluorescence microscopy showed that IL5, but not IL3, induces cytoplasmic and nuclear expression of syntenin and, in a syntenin- and cytoplasmic IL5RA-dependent manner, of Sox4. Geijsen et al. (2001) concluded that syntenin acts as an adaptor molecule in the IL5RA-mediated activation of SOX4. They also noted that mice lacking either Il5ra or Sox4 have defects in B-cell development Full details of the abovementioned studies are described in the following publications, the disclosure of which are hereby incorporated by reference:

Tavernier, J.; Devos, R.; Cornelis, S.; Tuypens, T.; Van der Heyden, J.; Fiers, W.; Plaetinck, G.: A human high affinity interleukin-5 receptor (IL5R) is composed of an IL5-specific alpha chain and a beta chain shared with the receptor for GM-CSF. Cell 66:1175-1184, 1991; and Geijsen, N.; Uings, I. J.; Pals, C.; Armstrong, J.; McKinnon, M.; Raaijmakers, J. A. M.; Lammers, J.-W. J.; Koenderman, L.; Coffer, P. J.: Cytokine-specific transcriptional regulation t.

Further studies establishing the function and utilities of IL5RA are found in John Hopkins OMIM database record ID 147851, and in cited publications listed in Table 5, which are hereby incorporated by reference. Interleukin 5 receptor, alpha (IL5RA, Accession NP_000555.2) is another GAM189 target gene, herein designated TARGET GENE. IL5RA BINDING SITE is a target binding site found in the 3' untranslated region of multiple transcripts of mRNA encoded by IL5RA, corresponding to a target binding site such as BINDING SITE I, BINDING SITE II or BINDING SITE III of FIG. 8. Table 4 illustrates the complementarity of the nucleotide sequences of IL5RA BINDING SITE, designated SEQ ID:8557, to the nucleotide sequence of GAM189 RNA, herein designated GAM RNA, also designated SEQ ID:246.

Another function of GAM189 is therefore inhibition of Interleukin 5 receptor, alpha (IL5RA, Accession NP_000555.2), a gene which is the receptor for interleukin-5. the alpha chain binds to il-5. Accordingly, utilities of GAM189 include diagnosis, prevention and treatment of diseases and clinical conditions associated with IL5RA.

The function of IL5RA has been established by previous studies. Tavernier et al. (1991) isolated cDNA clones encoding 2 receptor proteins involved in the binding of human interleukin-5 (IL5; 147850). The major transcript of this receptor gene, as analyzed in both eosinophilic sublines of human promyelocytic cells and in eosinophilic myelocytes grown from cord blood, encodes a secreted form of this receptor. A second component of the receptor was found to be identical to the beta chain of the human granulocyte-macrophage colony-stimulating factor high affinity receptor (CSF2RB; 138981). The finding that IL5 and CSF2 share a receptor subunit provides a molecular basis for the observation that these cytokines can partially interfere with each other's binding and have highly overlapping biologic activities on eosinophils. The common use of the same receptor component is reminiscent of the structural relatedness of IL3 (OMIM Ref. No. 147740), IL5, and GM-CSF (CSF2; 138960). The homology at the C terminus may indicate a related binding domain. The common origin of all 3 cytokines is also suggested by their clustered chromosomal localization and by the structure of their genes. Using a yeast 2-hybrid screen of a granulocyte cDNA library with the cytoplasmic domain of IL5RA as bait, Geijsen et al. (2001) identified an interaction of IL5RA with syntenin (SDCBP; 602217). GST pull-down, BIAcore, coimmunoprecipitation, and deletion mutant analyses confirmed an association of syntenin with the last 15 C-terminal residues of IL5RA; syntenin did not interact with CFS2RB. Within this 15-residue stretch of IL5RA, the C-terminal phenylalanine is critical. Deletion of either of the 2 tandem PDZ domains of syntenin, which are known to interact with C-terminal peptide sequences, abrogated the IL5RA-syntenin interaction. A second 2-hybrid screen identified the mouse transcriptional factor Sox4 (OMIM Ref. No. 184430) as a binding partner for syntenin but not for IL5RA. The syntenin-Sox4 interaction occurs outside of the PDZ domains of syntenin. Luciferase reporter analysis and fluorescence microscopy showed that IL5, but not IL3, induces cytoplasmic and nuclear expression of syntenin and, in a syntenin- and cytoplasmic IL5RA-dependent manner, of Sox4. Geijsen et al. (2001) concluded that syntenin acts as an adaptor molecule in the IL5RA-mediated activation of SOX4. They also noted that mice lacking either Il5ra or Sox4 have defects in B-cell development Full details of the abovementioned studies are described in the following publications, the disclosure of which are hereby incorporated by reference:

Tavernier, J.; Devos, R.; Cornelis, S.; Tuypens, T.; Van der Heyden, J.; Fiers, W.; Plaetinck, G.: A human high affinity interleukin-5 receptor (IL5R) is composed of an IL5-specific alpha chain and a beta chain shared with the receptor for GM-CSF. Cell 66:1175-1184, 1991; and Geijsen, N.; Uings, I. J.; Pals, C.; Armstrong, J.; McKinnon, M.; Raaijmakers, J. A. M.; Lammers, J.-W. J.; Koenderman, L.; Coffer, P. J.: Cytokine-specific transcriptional regulation t.

Further studies establishing the function and utilities of IL5RA are found in John Hopkins OMIM database record ID 147851, and in cited publications listed in Table 5, which are hereby incorporated by reference. Interleukin enhancer binding factor 3, 90 kda (ILF3, Accession NP_036350.2) is another GAM189 target gene, herein designated TARGET GENE. ILF3 BINDING SITE is a target binding site found in the 3' untranslated region of multiple transcripts of mRNA encoded by ILF3, corresponding to a target binding site such as BINDING SITE I, BINDING SITE II or BINDING SITE III of FIG. 8. Table 4 illustrates the complementarity of the nucleotide sequences of ILF3 BINDING SITE, designated SEQ ID:17287, to the nucleotide sequence of GAM189 RNA, herein designated GAM RNA, also designated SEQ ID:246.

Another function of GAM189 is therefore inhibition of Interleukin enhancer binding factor 3, 90 kda (ILF3, Accession NP_036350.2). Accordingly, utilities of GAM189 include diagnosis, prevention and treatment of diseases and clinical conditions associated with ILF3.

IMPACT (Accession NP_060909.1) is another GAM189 target gene, herein designated TARGET GENE. IMPACT BINDING SITE is a target binding site found in the 3' untranslated region of mRNA encoded by IMPACT, corresponding to a target binding site such as BINDING SITE I, BINDING SITE II or BINDING SITE III of FIG. 8. Table 4 illustrates the complementarity of the nucleotide sequences of IMPACT BINDING SITE, designated SEQ ID:8975, to the nucleotide sequence of GAM189 RNA, herein designated GAM RNA, also designated SEQ ID:246.

Another function of GAM189 is therefore inhibition of IMPACT (Accession NP_060909.1). Accordingly, utilities of GAM189 include diagnosis, prevention and treatment of diseases and clinical conditions associated with IMPACT.

INHBE (Accession NP_113667.1) is another GAM189 target gene, herein designated TARGET GENE. INHBE BINDING SITE is a target binding site found in the 3' untranslated region of mRNA encoded by INHBE, corresponding to a target binding site such as BINDING SITE I, BINDING SITE II or BINDING SITE III of FIG. 8. Table 4 illustrates the complementarity of the nucleotide sequences of INHBE BINDING SITE, designated SEQ ID:16283, to the nucleotide sequence of GAM189 RNA, herein designated GAM RNA, also designated SEQ ID:246.

Another function of GAM189 is therefore inhibition of INHBE (Accession NP_113667.1). Accordingly, utilities of GAM189 include diagnosis, prevention and treatment of diseases and clinical conditions associated with INHBE.

Indolethylamine n-methyltransferase (INMT, Accession NP_006765.3) is another GAM189 target gene, herein designated TARGET GENE. INMT BINDING SITE1 and INMT BINDING SITE2 are target binding sites found in untranslated regions of mRNA encoded by INMT, corresponding to target binding sites such as BINDING SITE I, BINDING SITE II or BINDING SITE III of FIG. 8. Table 4 illustrates the complementarity of the nucleotide sequences of INMT BINDING SITE1 and INMT BINDING SITE2, designated SEQ ID:9149 and SEQ ID:11523 respectively, to the nucleotide sequence of GAM189 RNA, herein designated GAM RNA, also designated SEQ ID:246.

Another function of GAM189 is therefore inhibition of Indolethylamine n-methyltransferase (INMT, Accession NP_006765.3). Accordingly, utilities of GAM189 include diagnosis, prevention and treatment of diseases and clinical conditions associated with INMT.

Interferon regulatory factor 4 (IRF4, Accession NP_002451.1) is another GAM189 target gene, herein designated TARGET GENE. IRF4 BINDING SITE1 and IRF4 BINDING SITE2 are target binding sites found in untranslated regions of mRNA encoded by IRF4, corresponding to target binding sites such as BINDING SITE I, BINDING SITE II or BINDING SITE III of FIG. 8. Table 4 illustrates the complementarity of the nucleotide sequences of IRF4 BINDING SITE1 and IRF4 BINDING SITE2, designated SEQ ID:2698 and SEQ ID:1517 respectively, to the nucleotide sequence of GAM189 RNA, herein designated GAM RNA, also designated SEQ ID:246.

Another function of GAM189 is therefore inhibition of Interferon regulatory factor 4 (IRF4, Accession NP_002451.1). Accordingly, utilities of GAM189 include diagnosis, prevention and treatment of diseases and clinical conditions associated with IRF4.

Integrin, alpha x (antigen cd11c (p150), alpha polypeptide) (ITGAX, Accession NP_000878.1) is another GAM189 target gene, herein designated TARGET GENE. ITGAX BINDING SITE is a target binding site found in the 3' untranslated region of mRNA encoded by ITGAX, corresponding to a target binding site such as BINDING SITE I, BINDING SITE II or BINDING SITE III of FIG. 8. Table 4 illustrates the complementarity of the nucleotide sequences of ITGAX BINDING SITE, designated SEQ ID:559, to the nucleotide sequence of GAM189 RNA, herein designated GAM RNA, also designated SEQ ID:246.

Another function of GAM189 is therefore inhibition of Integrin, alpha x (antigen cd11c (p150), alpha polypeptide) (ITGAX, Accession NP_000878.1). Accordingly, utilities of GAM189 include diagnosis, prevention and treatment of diseases and clinical conditions associated with ITGAX.

Janus kinase 3 (a protein tyrosine kinase, leukocyte) (JAK3, Accession NP_000206.1) is another GAM189 target gene, herein designated TARGET GENE. JAK3 BINDING SITE is a target binding site found in the 3' untranslated region of mRNA encoded by JAK3, corresponding to a target binding site such as BINDING SITE I, BINDING SITE II or BINDING SITE III of FIG. 8. Table 4 illustrates the complementarity of the nucleotide sequences of JAK3 BINDING SITE, designated SEQ ID:18060, to the nucleotide sequence of GAM189 RNA, herein designated GAM RNA, also designated SEQ ID:246.

Another function of GAM189 is therefore inhibition of Janus kinase 3 (a protein tyrosine kinase, leukocyte) (JAK3, Accession NP_000206.1). Accordingly, utilities of GAM189 include diagnosis, prevention and treatment of diseases and clinical conditions associated with JAK3.

JM11 (Accession NP_296375.1) is another GAM189 target gene, herein designated TARGET GENE. JM11 BINDING SITE is a target binding site found in the 3' untranslated region of mRNA encoded by JM11, corresponding to a target binding site such as BINDING SITE I, BINDING SITE II or BINDING SITE III of FIG. 8. Table 4 illustrates the complementarity of the nucleotide sequences of JM11 BINDING SITE, designated SEQ ID:10197, to the nucleotide sequence of GAM189 RNA, herein designated GAM RNA, also designated SEQ ID:246.

Another function of GAM189 is therefore inhibition of JM11 (Accession NP_296375.1). Accordingly, utilities of GAM189 include diagnosis, prevention and treatment of diseases and clinical conditions associated with JM11.

Jerky homolog (mouse) (JRK, Accession NP_003715.1) is another GAM189 target gene, herein designated TARGET GENE. JRK BINDING SITE is a target binding site found in the 3' untranslated region of mRNA encoded by JRK, corresponding to a target binding site such as BINDING SITE I, BINDING SITE II or BINDING SITE III of FIG. 8. Table 4 illustrates the complementarity of the nucleotide sequences of JRK BINDING SITE, designated SEQ ID:3927, to the nucleotide sequence of GAM189 RNA, herein designated GAM RNA, also designated SEQ ID:246.

Another function of GAM189 is therefore inhibition of Jerky homolog (mouse) (JRK, Accession NP_003715.1), a gene which might function as a DNA- binding protein. and therefore may be associated with Absence epilepsy. Accordingly, utilities of GAM189 include diagnosis, prevention and treatment of Absence epilepsy, and of other diseases and clinical conditions associated with JRK.

The function of JRK and its association with various diseases and clinical conditions, has been established by previous studies, as described hereinabove with reference to GAM65.2. Potassium inwardly-rectifying channel, subfamily j, member 11 (KCNJ11, Accession NP_000516.2) is another GAM189 target gene, herein designated TARGET GENE. KCNJ11 BINDING SITE is a target binding site found in the 5' untranslated region of mRNA encoded by KCNJ11, corresponding to a target binding site such as BINDING SITE I, BINDING SITE II or BINDING SITE III of FIG. 8. Table 4 illustrates the complementarity of the nucleotide sequences of KCNJ11 BINDING SITE, designated SEQ ID:15049, to the nucleotide sequence of GAM189 RNA, herein designated GAM RNA, also designated SEQ ID:246.

Another function of GAM189 is therefore inhibition of Potassium inwardly-rectifying channel, subfamily j, member 11 (KCNJ11, Accession NP_000516.2), a gene which is controlled by g proteins. inward rectifier k+ channels are characterized by a greater tendency to allow potassium to flow into the cell rather than out of it. and therefore is associated with Persistent hyperinsulinemic hypoglycemia of infancy. Accordingly, utilities of GAM189 include diagnosis, prevention and treatment of Persistent hyperinsulinemic hypoglycemia of infancy, and of other diseases and clinical conditions associated with KCNJ11.

The function of KCNJ11 has been established by previous studies. ATP- sensitive potassium currents, I(KATP), were discovered in cardiac muscle and later found in pancreatic beta cells, pituitary tissue, skeletal muscle, brain, and vascular and nonvascular smooth muscle. I(KATP) functions in secretion and muscle contraction by coupling metabolic activity to membrane potential. In pancreatic beta cells, ATP-potassium channels are crucial for the regulation of glucose-induced insulin secretion and are the target for the sulfonylureas, oral hypoglycemic agents widely used in the treatment of noninsulin-dependent diabetes mellitus (NIDDM; 125853), and for diazoxide, a potassium channel opener. The sulfonylurea receptor SUR (OMIM Ref. No. 600509) is a member of the ATP-binding cassette superfamily with multiple transmembrane-spanning domains and 2 potential nucleotide-binding folds. Truncation of SUR that removes the second nucleotide-binding fold causes familial persistent hyperinsulinemic hypoglycemia of infancy (see, OMIM Ref. No., for example, 600509.0001), a rare disorder of glucose homeostasis characterized by unregulated insulin secretion despite severe hypoglycemia. Although these observations imply that SUR is closely associated with, or even a subunit of, K(ATP) channels, expression of SUR alone had not produced a measurable I(KATP). Inagaki et al. (1995) cloned a member of the inwardly rectifying potassium channel family, which they called BIR or Kir6.2, in the nomenclature of Chandy and Gutman (1993). The channel was expressed in large amounts in rat pancreatic islets and glucose-responsive insulin- secreting cell lines. The sequence showed a single open reading frame encoding a 390-amino acid protein with 2 putative transmembrane segments. The mouse homolog also had a single open reading frame encoding a 390-amino acid protein with 96% amino acid identity with human BIR, thus confirming that the gene encoding human BIR is intronless in the protein-coding region. Several other genes encoding inward rectifiers lack introns. This gene is also symbolized KCNJ11.

Animal model experiments lend further support to the function of KCNJ11. ATP-sensitive potassium channels are activated by various metabolic stresses, including hypoxia. The substantia nigra pars reticulata, the area with the highest expression of ATP-sensitive potassium channels in the brain, plays a pivotal role in the control of seizures. Yamada et al. (2001) studied mutant mice lacking the Kir6.2 subunit of ATP-sensitive potassium channels and found that they were susceptible to generalized seizures after brief hypoxia. In normal mice, the substantia nigra pars reticulata neuron activity was inactivated during hypoxia by the opening of the postsynaptic ATP-sensitive potassium channels, whereas in knockout mice, the activity of these neurons was enhanced. ATP-sensitive potassium channels exert a depressant effect on substantia nigra pars reticulata neuronal activity during hypoxia and may be involved in the nigral protection mechanism against generalized seizures It is appreciated that the abovementioned animal model for KCNJ11 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Thomas, P. M.; Cote, G. J.; Hallman, D. M.; Mathew, P. M.: Homozygosity mapping, to chromosome 11p, of the gene for familial persistent hyperinsulinemic hypoglycemia of infancy. Am. J. Hum. Genet. 56:416-421, 1995; and Yamada, K.; Ji, J. J.; Yuan, H.; Miki, T.; Sata, S.; Horimoto, N.; Shimizu, T.; Seino, S.; Inagaki, N.: Protective role of ATP-sensitive potassium channels in hypoxia- induced generalize.

Further studies establishing the function and utilities of KCNJ11 are found in John Hopkins OMIM database record ID 600937, and in cited publications listed in Table 5, which are hereby incorporated by reference. Potassium inwardly-rectifying channel, subfamily j, member 16 (KCNJ16, Accession NP_061128.1) is another GAM189 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM189 RNA, herein designated GAM RNA, also designated SEQ ID:246.

Another function of GAM189 is therefore inhibition of Potassium inwardly-rectifying channel, subfamily j, member 16 (KCNJ16, Accession NP_061128.1). Accordingly, utilities of GAM189 include diagnosis, prevention and treatment of diseases and clinical conditions associated with KCNJ16.

Potassium inwardly-rectifying channel, subfamily j, member 16 (KCNJ16, Accession NP_733937.1) is another GAM189 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM189 RNA, herein designated GAM RNA, also designated SEQ ID:246.

Another function of GAM189 is therefore inhibition of Potassium inwardly-rectifying channel, subfamily j, member 16 (KCNJ16, Accession NP_733937.1). Accordingly, utilities of GAM189 include diagnosis, prevention and treatment of diseases and clinical conditions associated with KCNJ16.

Potassium inwardly-rectifying channel, subfamily j, member 16 (KCNJ16, Accession NP_733938.1) is another GAM189 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM189 RNA, herein designated GAM RNA, also designated SEQ ID:246.

Another function of GAM189 is therefore inhibition of Potassium inwardly-rectifying channel, subfamily j, member 16 (KCNJ16, Accession NP_733938.1). Accordingly, utilities of GAM189 include diagnosis, prevention and treatment of diseases and clinical conditions associated with KCNJ16.

KENAE (Accession NP_789786.1) is another GAM189 target gene, herein designated TARGET GENE. KENAE BINDING SITE is a target binding site found in the 3' untranslated region of mRNA encoded by KENAE, corresponding to a target binding site such as BINDING SITE I, BINDING SITE II or BINDING SITE III of FIG. 8. Table 4 illustrates the complementarity of the nucleotide sequences of KENAE BINDING SITE, designated SEQ ID:14862, to the nucleotide sequence of GAM189 RNA, herein designated GAM RNA, also designated SEQ ID:246.

Another function of GAM189 is therefore inhibition of KENAE (Accession NP_789786.1). Accordingly, utilities of GAM189 include diagnosis, prevention and treatment of diseases and clinical conditions associated with KENAE.

KIAA0063 (Accession NP_055691.1) is another GAM189 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:5884, to the nucleotide sequence of GAM189 RNA, herein designated GAM RNA, also designated SEQ ID:246.

Another function of GAM189 is therefore inhibition of KIAA0063 (Accession NP_055691.1). Accordingly, utilities of GAM189 include diagnosis, prevention and treatment of diseases and clinical conditions associated with KIAA0063.

KIAA0082 (Accession NP_055865.1) is another GAM189 target gene, herein designated TARGET GENE. KIAA0082 BINDING SITE is a target binding site found in the 3' untranslated region of mRNA encoded by KIAA0082, corresponding to a target binding site such as BINDING SITE I, BINDING SITE II or BINDING SITE III of FIG. 8. Table 4 illustrates the complementarity of the nucleotide sequences of KIAA0082 BINDING SITE, designated SEQ ID:18751, to the nucleotide sequence of GAM189 RNA, herein designated GAM RNA, also designated SEQ ID:246.

Another function of GAM189 is therefore inhibition of KIAA0082 (Accession NP_055865.1). Accordingly, utilities of GAM189 include diagnosis, prevention and treatment of diseases and clinical conditions associated with KIAA0082.

KIAA0087 (Accession NP_055584.1) is another GAM189 target gene, herein designated TARGET GENE. KIAA0087 BINDING SITE1 and KIAA0087 BINDING SITE2 are target binding sites found in untranslated regions of mRNA encoded by KIAA0087, corresponding to target binding sites such as BINDING SITE I, BINDING SITE II or BINDING SITE III of FIG. 8. Table 4 illustrates the complementarity of the nucleotide sequences of KIAA0087 BINDING SITE1 and KIAA0087 BINDING SITE2, designated SEQ ID:10179 and SEQ ID:7956 respectively, to the nucleotide sequence of GAM189 RNA, herein designated GAM RNA, also designated SEQ ID:246.

Another function of GAM189 is therefore inhibition of KIAA0087 (Accession NP_055584.1). Accordingly, utilities of GAM189 include diagnosis, prevention and treatment of diseases and clinical conditions associated with KIAA0087.

KIAA0117 (Accession XP_290939.1) is another GAM189 target gene, herein designated TARGET GENE. KIAA0117 BINDING SITE is a target binding site found in the 3' untranslated region of mRNA encoded by KIAA0117, corresponding to a target binding site such as BINDING SITE I, BINDING SITE II or BINDING SITE III of FIG. 8. Table 4 illustrates the complementarity of the nucleotide sequences of KIAA0117 BINDING SITE, designated SEQ ID:9255, to the nucleotide sequence of GAM189 RNA, herein designated GAM RNA, also designated SEQ ID:246.

Another function of GAM189 is therefore inhibition of KIAA0117 (Accession XP_290939.1). Accordingly, utilities of GAM189 include diagnosis, prevention and treatment of diseases and clinical conditions associated with KIAA0117.

KIAA0182 (Accession XP_050495.4) is another GAM189 target gene, herein designated TARGET GENE. KIAA0182 BINDING SITE is a target binding site found in the 3' untranslated region of mRNA encoded by KIAA0182, corresponding to a target binding site such as BINDING SITE I, BINDING SITE II or BINDING SITE III of FIG. 8. Table 4 illustrates the complementarity of the nucleotide sequences of KIAA0182 BINDING SITE, designated SEQ ID:2218, to the nucleotide sequence of GAM189 RNA, herein designated GAM RNA, also designated SEQ ID:246.

Another function of GAM189 is therefore inhibition of KIAA0182 (Accession XP_050495.4). Accordingly, utilities of GAM189 include diagnosis, prevention and treatment of diseases and clinical conditions associated with KIAA0182.

KIAA0186 (Accession NP_066545.1) is another GAM189 target gene, herein designated TARGET GENE. KIAA0186 BINDING SITE is a target binding site found in the 3' untranslated region of mRNA encoded by KIAA0186, corresponding to a target binding site such as BINDING SITE I, BINDING SITE II or BINDING SITE III of FIG. 8. Table 4 illustrates the complementarity of the nucleotide sequences of KIAA0186 BINDING SITE, designated SEQ ID:2625, to the nucleotide sequence of GAM189 RNA, herein designated GAM RNA, also designated SEQ ID:246.

Another function of GAM189 is therefore inhibition of KIAA0186 (Accession NP_066545.1). Accordingly, utilities of GAM189 include diagnosis, prevention and treatment of diseases and clinical conditions associated with KIAA0186.

KIAA0205 (Accession NP_055688.1) is another GAM189 target gene, herein designated TARGET GENE. KIAA0205 BINDING SITE is a target binding site found in the 3' untranslated region of mRNA encoded by KIAA0205, corresponding to a target binding site such as BINDING SITE I, BINDING SITE II or BINDING SITE III of FIG. 8. Table 4 illustrates the complementarity of the nucleotide sequences of KIAA0205 BINDING SITE, designated SEQ ID:3429, to the nucleotide sequence of GAM189 RNA, herein designated GAM RNA, also designated SEQ ID:246.

Another function of GAM189 is therefore inhibition of KIAA0205 (Accession NP_055688.1). Accordingly, utilities of GAM189 include diagnosis, prevention and treatment of diseases and clinical conditions associated with KIAA0205.

KIAA0237 (Accession NP_055562.1) is another GAM189 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:17386, to the nucleotide sequence of GAM189 RNA, herein designated GAM RNA, also designated SEQ ID:246.

Another function of GAM189 is therefore inhibition of KIAA0237 (Accession NP_055562.1). Accordingly, utilities of GAM189 include diagnosis, prevention and treatment of diseases and clinical conditions associated with KIAA0237.

KIAA0295 (Accession XP_042833.2) is another GAM189 target gene, herein designated TARGET GENE. KIAA0295 BINDING SITE is a target binding site found in the 3' untranslated region of mRNA encoded by KIAA0295, corresponding to a target binding site such as BINDING SITE I, BINDING SITE II or BINDING SITE III of FIG. 8. Table 4 illustrates the complementarity of the nucleotide sequences of KIAA0295 BINDING SITE, designated SEQ ID:10742, to the nucleotide sequence of GAM189 RNA, herein designated GAM RNA, also designated SEQ ID:246.

Another function of GAM189 is therefore inhibition of KIAA0295 (Accession XP_042833.2). Accordingly, utilities of GAM189 include diagnosis, prevention and treatment of diseases and clinical conditions associated with KIAA0295.

KIAA0435 (Accession NP_055616.1) is another GAM189 target gene, herein designated TARGET GENE. KIAA0435 BINDING SITE is a target binding site found in the 5' untranslated region of mRNA encoded by KIAA0435, corresponding to a target binding site such as BINDING SITE I, BINDING SITE II or BINDING SITE III of FIG. 8. Table 4 illustrates the complementarity of the nucleotide sequences of KIAA0435 BINDING SITE, designated SEQ ID:5041, to the nucleotide sequence of GAM189 RNA, herein designated GAM RNA, also designated SEQ ID:246.

Another function of GAM189 is therefore inhibition of KIAA0435 (Accession NP_055616.1). Accordingly, utilities of GAM189 include diagnosis, prevention and treatment of diseases and clinical conditions associated with KIAA0435.

KIAA0446 (Accession XP_044155.1) is another GAM189 target gene, herein designated TARGET GENE. KIAA0446 BINDING SITE is a target binding site found in the 5' untranslated region of mRNA encoded by KIAA0446, corresponding to a target binding site such as BINDING SITE I, BINDING SITE II or BINDING SITE III of FIG. 8. Table 4 illustrates the complementarity of the nucleotide sequences of KIAA0446 BINDING SITE, designated SEQ ID:1475, to the nucleotide sequence of GAM189 RNA, herein designated GAM RNA, also designated SEQ ID:246.

Another function of GAM189 is therefore inhibition of KIAA0446 (Accession XP_044155.1). Accordingly, utilities of GAM189 include diagnosis, prevention and treatment of diseases and clinical conditions associated with KIAA0446.

KIAA0459 (Accession XP_027862.1) is another GAM189 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:4531, to the nucleotide sequence of GAM189 RNA, herein designated GAM RNA, also designated SEQ ID:246.

Another function of GAM189 is therefore inhibition of KIAA0459 (Accession XP_027862.1). Accordingly, utilities of GAM189 include diagnosis, prevention and treatment of diseases and clinical conditions associated with KIAA0459.

KIAA0469 (Accession NP_055666.1) is another GAM189 target gene, herein designated TARGET GENE. KIAA0469 BINDING SITE1 and KIAA0469 BINDING SITE2 are target binding sites found in untranslated regions of mRNA encoded by KIAA0469, corresponding to target binding sites such as BINDING SITE I, BINDING SITE II or BINDING SITE III of FIG. 8. Table 4 illustrates the complementarity of the nucleotide sequences of KIAA0469 BINDING SITE1 and KIAA0469 BINDING SITE2, designated SEQ ID:9147 and SEQ ID:9493 respectively, to the nucleotide sequence of GAM189 RNA, herein designated GAM RNA, also designated SEQ ID:246.

Another function of GAM189 is therefore inhibition of KIAA0469 (Accession NP_055666.1). Accordingly, utilities of GAM189 include diagnosis, prevention and treatment of diseases and clinical conditions associated with KIAA0469.

KIAA0475 (Accession NP_055679.1) is another GAM189 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:16940, to the nucleotide sequence of GAM189 RNA, herein designated GAM RNA, also designated SEQ ID:246.

Another function of GAM189 is therefore inhibition of KIAA0475 (Accession NP_055679.1). Accordingly, utilities of GAM189 include diagnosis, prevention and treatment of diseases and clinical conditions associated with KIAA0475.

KIAA0493 (Accession XP_034717.1) is another GAM189 target gene, herein designated TARGET GENE. KIAA0493 BINDING SITE is a target binding site found in the 5' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:17206, to the nucleotide sequence of GAM189 RNA, herein designated GAM RNA, also designated SEQ ID:246.

Another function of GAM189 is therefore inhibition of KIAA0493 (Accession XP_034717.1). Accordingly, utilities of GAM189 include diagnosis, prevention and treatment of diseases and clinical conditions associated with KIAA0493.

KIAA0495 (Accession XP_031397.1) is another GAM189 target gene, herein designated TARGET GENE. KIAA0495 BINDING SITE1 and KIAA0495 BINDING SITE2 are target binding sites found in untranslated regions of mRNA encoded by KIAA0495, corresponding to target binding sites such as BINDING SITE I, BINDING SITE II or BINDING SITE III of FIG. 8. Table 4 illustrates the complementarity of the nucleotide sequences of KIAA0495 BINDING SITE1 and KIAA0495 BINDING SITE2, designated SEQ ID:14759 and SEQ ID:5442 respectively, to the nucleotide sequence of GAM189 RNA, herein designated GAM RNA, also designated SEQ ID:246.

Another function of GAM189 is therefore inhibition of KIAA0495 (Accession XP_031397.1). Accordingly, utilities of GAM189 include diagnosis, prevention and treatment of diseases and clinical conditions associated with KIAA0495.

KIAA0513 (Accession NP_055547.1) is another GAM189 target gene, herein designated TARGET GENE. KIAA0513 BINDING SITE is a target binding site found in the 3' untranslated region of mRNA encoded by KIAA0513, corresponding to a target binding site such as BINDING SITE I, BINDING SITE II or BINDING SITE III of FIG. 8. Table 4 illustrates the complementarity of the nucleotide sequences of KIAA0513 BINDING SITE, designated SEQ ID:3931, to the nucleotide sequence of GAM189 RNA, herein designated GAM RNA, also designated SEQ ID:246.

Another function of GAM189 is therefore inhibition of KIAA0513 (Accession NP_055547.1). Accordingly, utilities of GAM189 include diagnosis, prevention and treatment of diseases and clinical conditions associated with KIAA0513.

KIAA0527 (Accession XP_171054.1) is another GAM189 target gene, herein designated TARGET GENE. KIAA0527 BINDING SITE is a target binding site found in the 3' untranslated region of mRNA encoded by KIAA0527, corresponding to a target binding site such as BINDING SITE I, BINDING SITE II or BINDING SITE III of FIG. 8. Table 4 illustrates the complementarity of the nucleotide sequences of KIAA0527 BINDING SITE, designated SEQ ID:19745, to the nucleotide sequence of GAM189 RNA, herein designated GAM RNA, also designated SEQ ID:246.

Another function of GAM189 is therefore inhibition of KIAA0527 (Accession XP_171054.1). Accordingly, utilities of GAM189 include diagnosis, prevention and treatment of diseases and clinical conditions associated with KIAA0527.

KIAA0532 (Accession XP_047659.6) is another GAM189 target gene, herein designated TARGET GENE. KIAA0532 BINDING SITE is a target binding site found in the 3' untranslated region of mRNA encoded by KIAA0532, corresponding to a target binding site such as BINDING SITE I, BINDING SITE II or BINDING SITE III of FIG. 8. Table 4 illustrates the complementarity of the nucleotide sequences of KIAA0532 BINDING SITE, designated SEQ ID:12455, to the nucleotide sequence of GAM189 RNA, herein designated GAM RNA, also designated SEQ ID:246.

Another function of GAM189 is therefore inhibition of KIAA0532 (Accession XP_047659.6). Accordingly, utilities of GAM189 include diagnosis, prevention and treatment of diseases and clinical conditions associated with KIAA0532.

KIAA0555 (Accession NP_055605.1) is another GAM189 target gene, herein designated TARGET GENE. KIAA0555 BINDING SITE is a target binding site found in the 3' untranslated region of mRNA encoded by KIAA0555, corresponding to a target binding site such as BINDING SITE I, BINDING SITE II or BINDING SITE III of FIG. 8. Table 4 illustrates the complementarity of the nucleotide sequences of KIAA0555 BINDING SITE, designated SEQ ID:5555, to the nucleotide sequence of GAM189 RNA, herein designated GAM RNA, also designated SEQ ID:246.

Another function of GAM189 is therefore inhibition of KIAA0555 (Accession NP_055605.1). Accordingly, utilities of GAM189 include diagnosis, prevention and treatment of diseases and clinical conditions associated with KIAA0555.

KIAA0561 (Accession XP_038150.2) is another GAM189 target gene, herein designated TARGET GENE. KIAA0561 BINDING SITE is a target binding site found in the 3' untranslated region of mRNA encoded by KIAA0561, corresponding to a target binding site such as BINDING SITE I, BINDING SITE II or BINDING SITE III of FIG. 8. Table 4 illustrates the complementarity of the nucleotide sequences of KIAA0561 BINDING SITE, designated SEQ ID:9629, to the nucleotide sequence of GAM189 RNA, herein designated GAM RNA, also designated SEQ ID:246.

Another function of GAM189 is therefore inhibition of KIAA0561 (Accession XP_038150.2). Accordingly, utilities of GAM189 include diagnosis, prevention and treatment of diseases and clinical conditions associated with KIAA0561.

KIAA0562 (Accession NP_055519.1) is another GAM189 target gene, herein designated TARGET GENE. KIAA0562 BINDING SITE is a target binding site found in the 3' untranslated region of mRNA encoded by KIAA0562, corresponding to a target binding site such as BINDING SITE I, BINDING SITE II or BINDING SITE III of FIG. 8. Table 4 illustrates the complementarity of the nucleotide sequences of KIAA0562 BINDING SITE, designated SEQ ID:16544, to the nucleotide sequence of GAM189 RNA, herein designated GAM RNA, also designated SEQ ID:246.

Another function of GAM189 is therefore inhibition of KIAA0562 (Accession NP_055519.1). Accordingly, utilities of GAM189 include diagnosis, prevention and treatment of diseases and clinical conditions associated with KIAA0562.

KIAA0563 (Accession NP_055649.1) is another GAM189 target gene, herein designated TARGET GENE. KIAA0563 BINDING SITE is a target binding site found in the 5' untranslated region of mRNA encoded by KIAA0563, corresponding to a target binding site such as BINDING SITE I, BINDING SITE II or BINDING SITE III of FIG. 8. Table 4 illustrates the complementarity of the nucleotide sequences of KIAA0563 BINDING SITE, designated SEQ ID:16377, to the nucleotide sequence of GAM189 RNA, herein designated GAM RNA, also designated SEQ ID:246.

Another function of GAM189 is therefore inhibition of KIAA0563 (Accession NP_055649.1). Accordingly, utilities of GAM189 include diagnosis, prevention and treatment of diseases and clinical conditions associated with KIAA0563.

KIAA0682 (Accession NP_055667.1) is another GAM189 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:6522, to the nucleotide sequence of GAM189 RNA, herein designated GAM RNA, also designated SEQ ID:246.

Another function of GAM189 is therefore inhibition of KIAA0682 (Accession NP_055667.1). Accordingly, utilities of GAM189 include diagnosis, prevention and treatment of diseases and clinical conditions associated with KIAA0682.

KIAA0804 (Accession XP_291080.1) is another GAM189 target gene, herein designated TARGET GENE. KIAA0804 BINDING SITE is a target binding site found in the 3' untranslated region of mRNA encoded by KIAA0804, corresponding to a target binding site such as BINDING SITE I, BINDING SITE II or BINDING SITE III of FIG. 8. Table 4 illustrates the complementarity of the nucleotide sequences of KIAA0804 BINDING SITE, designated SEQ ID:14656, to the nucleotide sequence of GAM189 RNA, herein designated GAM RNA, also designated SEQ ID:246.

Another function of GAM189 is therefore inhibition of KIAA0804 (Accession XP_291080.1). Accordingly, utilities of GAM189 include diagnosis, prevention and treatment of diseases and clinical conditions associated with KIAA0804.

KIAA0831 (Accession NP_055739.1) is another GAM189 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:3260, to the nucleotide sequence of GAM189 RNA, herein designated GAM RNA, also designated SEQ ID:246.

Another function of GAM189 is therefore inhibition of KIAA0831 (Accession NP_055739.1). Accordingly, utilities of GAM189 include diagnosis, prevention and treatment of diseases and clinical conditions associated with KIAA0831.

KIAA0841 (Accession XP_049237.1) is another GAM189 target gene, herein designated TARGET GENE. KIAA0841 BINDING SITE1 and KIAA0841 BINDING SITE2 are target binding sites found in untranslated regions of mRNA encoded by KIAA0841, corresponding to target binding sites such as BINDING SITE I, BINDING SITE II or BINDING SITE III of FIG. 8. Table 4 illustrates the complementarity of the nucleotide sequences of KIAA0841 BINDING SITE1 and KIAA0841 BINDING SITE2, designated SEQ ID:8185 and SEQ ID:5490 respectively, to the nucleotide sequence of GAM189 RNA, herein designated GAM RNA, also designated SEQ ID:246.

Another function of GAM189 is therefore inhibition of KIAA0841 (Accession XP_049237.1). Accordingly, utilities of GAM189 include diagnosis, prevention and treatment of diseases and clinical conditions associated with KIAA0841.

KIAA0861 (Accession NP_055893.2) is another GAM189 target gene, herein designated TARGET GENE. KIAA0861 BINDING SITE is a target binding site found in the 3' untranslated region of mRNA encoded by KIAA0861, corresponding to a target binding site such as BINDING SITE I, BINDING SITE II or BINDING SITE III of FIG. 8. Table 4 illustrates the complementarity of the nucleotide sequences of KIAA0861 BINDING SITE, designated SEQ ID:2153, to the nucleotide sequence of GAM189 RNA, herein designated GAM RNA, also designated SEQ ID:246.

Another function of GAM189 is therefore inhibition of KIAA0861 (Accession NP_055893.2). Accordingly, utilities of GAM189 include diagnosis, prevention and treatment of diseases and clinical conditions associated with KIAA0861.

KIAA0889 (Accession NP_056192.1) is another GAM189 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:13271, to the nucleotide sequence of GAM189 RNA, herein designated GAM RNA, also designated SEQ ID:246.

Another function of GAM189 is therefore inhibition of KIAA0889 (Accession NP_056192.1). Accordingly, utilities of GAM189 include diagnosis, prevention and treatment of diseases and clinical conditions associated with KIAA0889.

KIAA0924 (Accession NP_055712.1) is another GAM189 target gene, herein designated TARGET GENE. KIAA0924 BINDING SITE1 and KIAA0924 BINDING SITE2 are target binding sites found in untranslated regions of mRNA encoded by KIAA0924, corresponding to target binding sites such as BINDING SITE I, BINDING SITE II or BINDING SITE III of FIG. 8. Table 4 illustrates the complementarity of the nucleotide sequences of KIAA0924 BINDING SITE1 and KIAA0924 BINDING SITE2, designated SEQ ID:13297 and SEQ ID:7655 respectively, to the nucleotide sequence of GAM189 RNA, herein designated GAM RNA, also designated SEQ ID:246.

Another function of GAM189 is therefore inhibition of KIAA0924 (Accession NP_055712.1). Accordingly, utilities of GAM189 include diagnosis, prevention and treatment of diseases and clinical conditions associated with KIAA0924.

KIAA0931 (Accession XP_041191.2) is another GAM189 target gene, herein designated TARGET GENE. KIAA0931 BINDING SITE is a target binding site found in the 3' untranslated region of mRNA encoded by KIAA0931, corresponding to a target binding site such as BINDING SITE I, BINDING SITE II or BINDING SITE III of FIG. 8. Table 4 illustrates the complementarity of the nucleotide sequences of KIAA0931 BINDING SITE, designated SEQ ID:14272, to the nucleotide sequence of GAM189 RNA, herein designated GAM RNA, also designated SEQ ID:246.

Another function of GAM189 is therefore inhibition of KIAA0931 (Accession XP_041191.2). Accordingly, utilities of GAM189 include diagnosis, prevention and treatment of diseases and clinical conditions associated with KIAA0931.

KIAA0935 (Accession XP_052620.6) is another GAM189 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:11958, to the nucleotide sequence of GAM189 RNA, herein designated GAM RNA, also designated SEQ ID:246.

Another function of GAM189 is therefore inhibition of KIAA0935 (Accession XP_052620.6). Accordingly, utilities of GAM189 include diagnosis, prevention and treatment of diseases and clinical conditions associated with KIAA0935.

KIAA0962 (Accession XP_290942.1) is another GAM189 target gene, herein designated TARGET GENE. KIAA0962 BINDING SITE is a target binding site found in the 3' untranslated region of mRNA encoded by KIAA0962, corresponding to a target binding site such as BINDING SITE I, BINDING SITE II or BINDING SITE III of FIG. 8. Table 4 illustrates the complementarity of the nucleotide sequences of KIAA0962 BINDING SITE, designated SEQ ID:8976, to the nucleotide sequence of GAM189 RNA, herein designated GAM RNA, also designated SEQ ID:246.

Another function of GAM189 is therefore inhibition of KIAA0962 (Accession XP_290942.1). Accordingly, utilities of GAM189 include diagnosis, prevention and treatment of diseases and clinical conditions associated with KIAA0962.

KIAA1002 (Accession XP_290584.1) is another GAM189 target gene, herein designated TARGET GENE. KIAA1002 BINDING SITE is a target binding site found in the 5' untranslated region of mRNA encoded by KIAA1002, corresponding to a target binding site such as BINDING SITE I, BINDING SITE II or BINDING SITE III of FIG. 8. Table 4 illustrates the complementarity of the nucleotide sequences of KIAA1002 BINDING SITE, designated SEQ ID:12518, to the nucleotide sequence of GAM189 RNA, herein designated GAM RNA, also designated SEQ ID:246.

Another function of GAM189 is therefore inhibition of KIAA1002 (Accession XP_290584.1). Accordingly, utilities of GAM189 include diagnosis, prevention and treatment of diseases and clinical conditions associated with KIAA1002.

KIAA1040 (Accession XP_051091.3) is another GAM189 target gene, herein designated TARGET GENE.

KIAA1040 BINDING SITE is a target binding site found in the 3' untranslated region of mRNA encoded by KIAA1040, corresponding to a target binding site such as BINDING SITE I, BINDING SITE II or BINDING SITE III of FIG. 8. Table 4 illustrates the complementarity of the nucleotide sequences of KIAA1040 BINDING SITE, designated SEQ ID:11846, to the nucleotide sequence of GAM189 RNA, herein designated GAM RNA, also designated SEQ ID:246.

Another function of GAM189 is therefore inhibition of KIAA1040 (Accession XP_051091.3). Accordingly, utilities of GAM189 include diagnosis, prevention and treatment of diseases and clinical conditions associated with KIAA1040.

KIAA1041 (Accession NP_055762.1) is another GAM189 target gene, herein designated TARGET GENE. KIAA1041 BINDING SITE is a target binding site found in the 3' untranslated region of mRNA encoded by KIAA1041, corresponding to a target binding site such as BINDING SITE I, BINDING SITE II or BINDING SITE III of FIG. 8. Table 4 illustrates the complementarity of the nucleotide sequences of KIAA1041 BINDING SITE, designated SEQ ID:3653, to the nucleotide sequence of GAM189 RNA, herein designated GAM RNA, also designated SEQ ID:246.

Another function of GAM189 is therefore inhibition of KIAA1041 (Accession NP_055762.1). Accordingly, utilities of GAM189 include diagnosis, prevention and treatment of diseases and clinical conditions associated with KIAA1041.

KIAA1054 (Accession XP_043493.5) is another GAM189 target gene, herein designated TARGET GENE. KIAA1054 BINDING SITE is a target binding site found in the 3' untranslated region of mRNA encoded by KIAA1054, corresponding to a target binding site such as BINDING SITE I, BINDING SITE II or BINDING SITE III of FIG. 8. Table 4 illustrates the complementarity of the nucleotide sequences of KIAA1054 BINDING SITE, designated SEQ ID:14832, to the nucleotide sequence of GAM189 RNA, herein designated GAM RNA, also designated SEQ ID:246.

Another function of GAM189 is therefore inhibition of KIAA1054 (Accession XP_043493.5). Accordingly, utilities of GAM189 include diagnosis, prevention and treatment of diseases and clinical conditions associated with KIAA1054.

KIAA1115 (Accession NP_055746.1) is another GAM189 target gene, herein designated TARGET GENE. KIAA1115 BINDING SITE is a target binding site found in the 3' untranslated region of mRNA encoded by KIAA1115, corresponding to a target binding site such as BINDING SITE I, BINDING SITE II or BINDING SITE III of FIG. 8. Table 4 illustrates the complementarity of the nucleotide sequences of KIAA1115 BINDING SITE, designated SEQ ID:9842, to the nucleotide sequence of GAM189 RNA, herein designated GAM RNA, also designated SEQ ID:246.

Another function of GAM189 is therefore inhibition of KIAA1115 (Accession NP_055746.1). Accordingly, utilities of GAM189 include diagnosis, prevention and treatment of diseases and clinical conditions associated with KIAA1115.

KIAA1128 (Accession NP_061872.1) is another GAM189 target gene, herein designated TARGET GENE. KIAA1128 BINDING SITE is a target binding site found in the 3' untranslated region of mRNA encoded by KIAA1128, corresponding to a target binding site such as BINDING SITE I, BINDING SITE II or BINDING SITE III of FIG. 8. Table 4 illustrates the complementarity of the nucleotide sequences of KIAA1128 BINDING SITE, designated SEQ ID:5783, to the nucleotide sequence of GAM189 RNA, herein designated GAM RNA, also designated SEQ ID:246.

Another function of GAM189 is therefore inhibition of KIAA1128 (Accession NP_061872.1). Accordingly, utilities of GAM189 include diagnosis, prevention and treatment of diseases and clinical conditions associated with KIAA1128.

KIAA1143 (Accession XP_044014.1) is another GAM189 target gene, herein designated TARGET GENE. KIAA1143 BINDING SITE is a target binding site found in the 3' untranslated region of mRNA encoded by KIAA1143, corresponding to a target binding site such as BINDING SITE I, BINDING SITE II or BINDING SITE III of FIG. 8. Table 4 illustrates the complementarity of the nucleotide sequences of KIAA1143 BINDING SITE, designated SEQ ID:7385, to the nucleotide sequence of GAM189 RNA, herein designated GAM RNA, also designated SEQ ID:246.

Another function of GAM189 is therefore inhibition of KIAA1143 (Accession XP_044014.1). Accordingly, utilities of GAM189 include diagnosis, prevention and treatment of diseases and clinical conditions associated with KIAA1143.

KIAA1145 (Accession NP_065749.1) is another GAM189 target gene, herein designated TARGET GENE. KIAA1145 BINDING SITE is a target binding site found in the 3' untranslated region of mRNA encoded by KIAA1145, corresponding to a target binding site such as BINDING SITE I, BINDING SITE II or BINDING SITE III of FIG. 8. Table 4 illustrates the complementarity of the nucleotide sequences of KIAA1145 BINDING SITE, designated SEQ ID:17532, to the nucleotide sequence of GAM189 RNA, herein designated GAM RNA, also designated SEQ ID:246.

Another function of GAM189 is therefore inhibition of KIAA1145 (Accession NP_065749.1). Accordingly, utilities of GAM189 include diagnosis, prevention and treatment of diseases and clinical conditions associated with KIAA1145.

KIAA1155 (Accession XP_030864.2) is another GAM189 target gene, herein designated TARGET GENE. KIAA1155 BINDING SITE is a target binding site found in the 3' untranslated region of mRNA encoded by KIAA1155, corresponding to a target binding site such as BINDING SITE I, BINDING SITE II or BINDING SITE III of FIG. 8. Table 4 illustrates the complementarity of the nucleotide sequences of KIAA1155 BINDING SITE, designated SEQ ID:2664, to the nucleotide sequence of GAM189 RNA, herein designated GAM RNA, also designated SEQ ID:246.

Another function of GAM189 is therefore inhibition of KIAA1155 (Accession XP_030864.2). Accordingly, utilities of GAM189 include diagnosis, prevention and treatment of diseases and clinical conditions associated with KIAA1155.

KIAA1170 (Accession XP_045907.2) is another GAM189 target gene, herein designated TARGET GENE. KIAA1170 BINDING SITE is a target binding site found in the 3' untranslated region of mRNA encoded by KIAA1170, corresponding to a target binding site such as BINDING SITE I, BINDING SITE II or BINDING SITE III of FIG. 8. Table 4 illustrates the complementarity of the nucleotide sequences of KIAA1170 BINDING SITE, designated SEQ ID:10162, to the nucleotide sequence of GAM189 RNA, herein designated GAM RNA, also designated SEQ ID:246.

Another function of GAM189 is therefore inhibition of KIAA1170 (Accession XP_045907.2). Accordingly, utilities of GAM189 include diagnosis, prevention and treatment of diseases and clinical conditions associated with KIAA1170.

KIAA1185 (Accession NP_065761.1) is another GAM189 target gene, herein designated TARGET GENE. KIAA1185 BINDING SITE is a target binding site found in the 3' untranslated region of mRNA encoded by KIAA1185, corresponding to a target binding site such as BINDING SITE I, BINDING SITE II or BINDING SITE III of FIG. 8. Table 4 illustrates the complementarity of the nucleotide sequences of KIAA1185 BINDING SITE, designated SEQ ID:5755, to the nucleotide sequence of GAM189 RNA, herein designated GAM RNA, also designated SEQ ID:246.

Another function of GAM189 is therefore inhibition of KIAA1185 (Accession NP_065761.1). Accordingly, utilities of GAM189 include diagnosis, prevention and treatment of diseases and clinical conditions associated with KIAA1185.

KIAA1193 (Accession XP_041843.1) is another GAM189 target gene, herein designated TARGET GENE. KIAA1193 BINDING SITE is a target binding site found in the 3' untranslated region of mRNA encoded by KIAA1193, corresponding to a target binding site such as BINDING SITE I, BINDING SITE II or BINDING SITE III of FIG. 8. Table 4 illustrates the complementarity of the nucleotide sequences of KIAA1193 BINDING SITE, designated SEQ ID:17517, to the nucleotide sequence of GAM189 RNA, herein designated GAM RNA, also designated SEQ ID:246.

Another function of GAM189 is therefore inhibition of KIAA1193 (Accession XP_041843.1). Accordingly, utilities of GAM189 include diagnosis, prevention and treatment of diseases and clinical conditions associated with KIAA1193.

KIAA1198 (Accession NP_065765.1) is another GAM189 target gene, herein designated TARGET GENE. KIAA1198 BINDING SITE1 through KIAA1198 BINDING SITE5 are target binding sites found in untranslated regions of mRNA encoded by KIAA1198, corresponding to target binding sites such as BINDING SITE I, BINDING SITE II or BINDING SITE III of FIG. 8. Table 4 illustrates the complementarity of the nucleotide sequences of KIAA1198 BINDING SITE1 through KIAA1198 BINDING SITE5, designated SEQ ID:13749, SEQ ID:16471, SEQ ID:12389, SEQ ID:16088 and SEQ ID:12478 respectively, to the nucleotide sequence of GAM189 RNA, herein designated GAM RNA, also designated SEQ ID:246.

Another function of GAM189 is therefore inhibition of KIAA1198 (Accession NP_065765.1). Accordingly, utilities of GAM189 include diagnosis, prevention and treatment of diseases and clinical conditions associated with KIAA1198.

KIAA1209 (Accession XP_027307.2) is another GAM189 target gene, herein designated TARGET GENE. KIAA1209 BINDING SITE is a target binding site found in the 3' untranslated region of mRNA encoded by KIAA1209, corresponding to a target binding site such as BINDING SITE I, BINDING SITE II or BINDING SITE III of FIG. 8. Table 4 illustrates the complementarity of the nucleotide sequences of KIAA1209 BINDING SITE, designated SEQ ID:8271, to the nucleotide sequence of GAM189 RNA, herein designated GAM RNA, also designated SEQ ID:246.

Another function of GAM189 is therefore inhibition of KIAA1209 (Accession XP_027307.2). Accordingly, utilities of GAM189 include diagnosis, prevention and treatment of diseases and clinical conditions associated with KIAA1209.

KIAA1210 (Accession XP_172801.1) is another GAM189 target gene, herein designated TARGET GENE. KIAA1210 BINDING SITE is a target binding site found in the 3' untranslated region of mRNA encoded by KIAA1210, corresponding to a target binding site such as BINDING SITE I, BINDING SITE II or BINDING SITE III of FIG. 8. Table 4 illustrates the complementarity of the nucleotide sequences of KIAA1210 BINDING SITE, designated SEQ ID:9144, to the nucleotide sequence of GAM189 RNA, herein designated GAM RNA, also designated SEQ ID:246.

Another function of GAM189 is therefore inhibition of KIAA1210 (Accession XP_172801.1). Accordingly, utilities of GAM189 include diagnosis, prevention and treatment of diseases and clinical conditions associated with KIAA1210.

KIAA1257 (Accession XP_031577.2) is another GAM189 target gene, herein designated TARGET GENE. KIAA1257 BINDING SITE1 and KIAA1257 BINDING SITE2 are target binding sites found in untranslated regions of mRNA encoded by KIAA1257, corresponding to target binding sites such as BINDING SITE I, BINDING SITE II or BINDING SITE III of FIG. 8. Table 4 illustrates the complementarity of the nucleotide sequences of KIAA1257 BINDING SITE1 and KIAA1257 BINDING SITE2, designated SEQ ID:11523 and SEQ ID:9032 respectively, to the nucleotide sequence of GAM189 RNA, herein designated GAM RNA, also designated SEQ ID:246.

Another function of GAM189 is therefore inhibition of KIAA1257 (Accession XP_031577.2). Accordingly, utilities of GAM189 include diagnosis, prevention and treatment of diseases and clinical conditions associated with KIAA1257.

KIAA1268 (Accession XP_291055.1) is another GAM189 target gene, herein designated TARGET GENE. KIAA1268 BINDING SITE is a target binding site found in the 3' untranslated region of mRNA encoded by KIAA1268, corresponding to a target binding site such as BINDING SITE I, BINDING SITE II or BINDING SITE III of FIG. 8. Table 4 illustrates the complementarity of the nucleotide sequences of KIAA1268 BINDING SITE, designated SEQ ID:3236, to the nucleotide sequence of GAM189 RNA, herein designated GAM RNA, also designated SEQ ID:246.

Another function of GAM189 is therefore inhibition of KIAA1268 (Accession XP_291055.1). Accordingly, utilities of GAM189 include diagnosis, prevention and treatment of diseases and clinical conditions associated with KIAA1268.

KIAA1273 (Accession XP_300760.1) is another GAM189 target gene, herein designated TARGET GENE. KIAA1273 BINDING SITE1 and KIAA1273 BINDING SITE2 are target binding sites found in untranslated regions of mRNA encoded by KIAA1273, corresponding to target binding sites such as BINDING SITE I, BINDING SITE II or BINDING SITE III of FIG. 8. Table 4 illustrates the complementarity of the nucleotide sequences of KIAA1273 BINDING SITE1 and KIAA1273 BINDING SITE2, designated SEQ ID:7374 and SEQ ID:4555 respectively, to the nucleotide sequence of GAM189 RNA, herein designated GAM RNA, also designated SEQ ID:246.

Another function of GAM189 is therefore inhibition of KIAA1273 (Accession XP_300760.1). Accordingly, utilities of GAM189 include diagnosis, prevention and treatment of diseases and clinical conditions associated with KIAA1273.

KIAA1276 (Accession XP_039169.1) is another GAM189 target gene, herein designated TARGET GENE. KIAA1276 BINDING SITE is a target binding site found in the 5' untranslated region of mRNA encoded by KIAA1276, corresponding to a target binding site such as BINDING SITE I, BINDING SITE II or BINDING SITE III of FIG. 8. Table 4 illustrates the complementarity of the nucleotide sequences of KIAA1276 BINDING SITE, designated SEQ ID:1905, to the nucleotide sequence of GAM189 RNA, herein designated GAM RNA, also designated SEQ ID:246.

Another function of GAM189 is therefore inhibition of KIAA1276 (Accession XP_039169.1). Accordingly, utilities of GAM189 include diagnosis, prevention and treatment of diseases and clinical conditions associated with KIAA1276.

KIAA1287 (Accession NP_065799.1) is another GAM189 target gene, herein designated TARGET GENE. KIAA1287 BINDING SITE is a target binding site found in the 3' untranslated region of mRNA encoded by KIAA1287, corresponding to a target binding site such as BINDING SITE I, BINDING SITE II or BINDING SITE III of FIG. 8. Table 4 illustrates the complementarity of the nucleotide sequences of KIAA1287 BINDING SITE, designated SEQ ID:9573, to the nucleotide sequence of GAM189 RNA, herein designated GAM RNA, also designated SEQ ID:246.

Another function of GAM189 is therefore inhibition of KIAA1287 (Accession NP_065799.1). Accordingly, utilities of GAM189 include diagnosis, prevention and treatment of diseases and clinical conditions associated with KIAA1287.

KIAA1393 (Accession XP_050793.2) is another GAM189 target gene, herein designated TARGET GENE. KIAA1393 BINDING SITE is a target binding site found in the 3' untranslated region of mRNA encoded by KIAA1393, corresponding to a target binding site such as BINDING SITE I, BINDING SITE II or BINDING SITE III of FIG. 8. Table 4 illustrates the complementarity of the nucleotide sequences of KIAA1393 BINDING SITE, designated SEQ ID:10123, to the nucleotide sequence of GAM189 RNA, herein designated GAM RNA, also designated SEQ ID:246.

Another function of GAM189 is therefore inhibition of KIAA1393 (Accession XP_050793.2). Accordingly, utilities of GAM189 include diagnosis, prevention and treatment of diseases and clinical conditions associated with KIAA1393.

KIAA1443 (Accession NP_065885.1) is another GAM189 target gene, herein designated TARGET GENE. KIAA1443 BINDING SITE is a target binding site found in the 3' untranslated region of mRNA encoded by KIAA1443, corresponding to a target binding site such as BINDING SITE I, BINDING SITE II or BINDING SITE III of FIG. 8. Table 4 illustrates the complementarity of the nucleotide sequences of KIAA1443 BINDING SITE, designated SEQ ID:15171, to the nucleotide sequence of GAM189 RNA, herein designated GAM RNA, also designated SEQ ID:246.

Another function of GAM189 is therefore inhibition of KIAA1443 (Accession NP_065885.1). Accordingly, utilities of GAM189 include diagnosis, prevention and treatment of diseases and clinical conditions associated with KIAA1443.

KIAA1456 (Accession XP_040100.3) is another GAM189 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:5529, to the nucleotide sequence of GAM189 RNA, herein designated GAM RNA, also designated SEQ ID:246.

Another function of GAM189 is therefore inhibition of KIAA1456 (Accession XP_040100.3). Accordingly, utilities of GAM189 include diagnosis, prevention and treatment of diseases and clinical conditions associated with KIAA1456.

KIAA1463 (Accession XP_051160.2) is another GAM189 target gene, herein designated TARGET GENE. KIAA1463 BINDING SITE is a target binding site found in the 3' untranslated region of mRNA encoded by KIAA1463, corresponding to a target binding site such as BINDING SITE I, BINDING SITE II or BINDING SITE III of FIG. 8. Table 4 illustrates the complementarity of the nucleotide sequences of KIAA1463 BINDING SITE, designated SEQ ID:1667, to the nucleotide sequence of GAM189 RNA, herein designated GAM RNA, also designated SEQ ID:246.

Another function of GAM189 is therefore inhibition of KIAA1463 (Accession XP_051160.2). Accordingly, utilities of GAM189 include diagnosis, prevention and treatment of diseases and clinical conditions associated with KIAA1463.

KIAA1465 (Accession XP_027396.4) is another GAM189 target gene, herein designated TARGET GENE. KIAA1465 BINDING SITE1 and KIAA1465 BINDING SITE2 are target binding sites found in untranslated regions of mRNA encoded by KIAA1465, corresponding to target binding sites such as BINDING SITE I, BINDING SITE II or BINDING SITE III of FIG. 8. Table 4 illustrates the complementarity of the nucleotide sequences of KIAA1465 BINDING SITE1 and KIAA1465 BINDING SITE2, designated SEQ ID:18838 and SEQ ID:18992 respectively, to the nucleotide sequence of GAM189 RNA, herein designated GAM RNA, also designated SEQ ID:246.

Another function of GAM189 is therefore inhibition of KIAA1465 (Accession XP_027396.4). Accordingly, utilities of GAM189 include diagnosis, prevention and treatment of diseases and clinical conditions associated with KIAA1465.

KIAA1493 (Accession XP_034415.1) is another GAM189 target gene, herein designated TARGET GENE. KIAA1493 BINDING SITE is a target binding site found in the 3' untranslated region of mRNA encoded by KIAA1493, corresponding to a target binding site such as BINDING SITE I, BINDING SITE II or BINDING SITE III of FIG. 8. Table 4 illustrates the complementarity of the nucleotide sequences of KIAA1493 BINDING SITE, designated SEQ ID:15045, to the nucleotide sequence of GAM189 RNA, herein designated GAM RNA, also designated SEQ ID:246.

Another function of GAM189 is therefore inhibition of KIAA1493 (Accession XP_034415.1). Accordingly, utilities of GAM189 include diagnosis, prevention and treatment of diseases and clinical conditions associated with KIAA1493.

KIAA1508 (Accession XP_290952.1) is another GAM189 target gene, herein designated TARGET GENE. KIAA1508 BINDING SITE is a target binding site found in the 3' untranslated region of mRNA encoded by KIAA1508, corresponding to a target binding site such as BINDING SITE I, BINDING SITE II or BINDING SITE III of FIG. 8. Table 4 illustrates the complementarity of the nucleotide sequences of KIAA1508 BINDING SITE, designated SEQ ID:8820, to the nucleotide sequence of GAM189 RNA, herein designated GAM RNA, also designated SEQ ID:246.

Another function of GAM189 is therefore inhibition of KIAA1508 (Accession XP_290952.1). Accordingly, utilities of GAM189 include diagnosis, prevention and treatment of diseases and clinical conditions associated with KIAA1508.

KIAA1518 (Accession XP_170889.1) is another GAM189 target gene, herein designated TARGET GENE.

KIAA1518 BINDING SITE is a target binding site found in the 3' untranslated region of multiple transcripts of mRNA encoded by KIAA1518, corresponding to a target binding site such as BINDING SITE I, BINDING SITE II or BINDING SITE III of FIG. 8. Table 4 illustrates the complementarity of the nucleotide sequences of KIAA1518 BINDING SITE, designated SEQ ID:13383, to the nucleotide sequence of GAM189 RNA, herein designated GAM RNA, also designated SEQ ID:246.

Another function of GAM189 is therefore inhibition of KIAA1518 (Accession XP_170889.1). Accordingly, utilities of GAM189 include diagnosis, prevention and treatment of diseases and clinical conditions associated with KIAA1518.

KIAA1530 (Accession XP_042661.5) is another GAM189 target gene, herein designated TARGET GENE. KIAA1530 BINDING SITE1 and KIAA1530 BINDING SITE2 are target binding sites found in untranslated regions of mRNA encoded by KIAA1530, corresponding to target binding sites such as BINDING SITE I, BINDING SITE II or BINDING SITE III of FIG. 8. Table 4 illustrates the complementarity of the nucleotide sequences of KIAA1530 BINDING SITE1 and KIAA1530 BINDING SITE2, designated SEQ ID:4028 and SEQ ID:15284 respectively, to the nucleotide sequence of GAM189 RNA, herein designated GAM RNA, also designated SEQ ID:246.

Another function of GAM189 is therefore inhibition of KIAA1530 (Accession XP_042661.5). Accordingly, utilities of GAM189 include diagnosis, prevention and treatment of diseases and clinical conditions associated with KIAA1530.

KIAA1550 (Accession XP_039393.3) is another GAM189 target gene, herein designated TARGET GENE. KIAA1550 BINDING SITE is a target binding site found in the 3' untranslated region of mRNA encoded by KIAA1550, corresponding to a target binding site such as BINDING SITE I, BINDING SITE II or BINDING SITE III of FIG. 8. Table 4 illustrates the complementarity of the nucleotide sequences of KIAA1550 BINDING SITE, designated SEQ ID:3790, to the nucleotide sequence of GAM189 RNA, herein designated GAM RNA, also designated SEQ ID:246.

Another function of GAM189 is therefore inhibition of KIAA1550 (Accession XP_039393.3). Accordingly, utilities of GAM189 include diagnosis, prevention and treatment of diseases and clinical conditions associated with KIAA1550.

KIAA1559 (Accession XP_054472.2) is another GAM189 target gene, herein designated TARGET GENE. KIAA1559 BINDING SITE is a target binding site found in the 3' untranslated region of mRNA encoded by KIAA1559, corresponding to a target binding site such as BINDING SITE I, BINDING SITE II or BINDING SITE III of FIG. 8. Table 4 illustrates the complementarity of the nucleotide sequences of KIAA1559 BINDING SITE, designated SEQ ID:4029, to the nucleotide sequence of GAM189 RNA, herein designated GAM RNA, also designated SEQ ID:246.

Another function of GAM189 is therefore inhibition of KIAA1559 (Accession XP_054472.2). Accordingly, utilities of GAM189 include diagnosis, prevention and treatment of diseases and clinical conditions associated with KIAA1559.

KIAA1571 (Accession XP_027744.1) is another GAM189 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:14154, to the nucleotide sequence of GAM189 RNA, herein designated GAM RNA, also designated SEQ ID:246.

Another function of GAM189 is therefore inhibition of KIAA1571 (Accession XP_027744.1). Accordingly, utilities of GAM189 include diagnosis, prevention and treatment of diseases and clinical conditions associated with KIAA1571.

KIAA1615 (Accession NP_066002.1) is another GAM189 target gene, herein designated TARGET GENE. KIAA1615 BINDING SITE1 and KIAA1615 BINDING SITE2 are target binding sites found in untranslated regions of mRNA encoded by KIAA1615, corresponding to target binding sites such as BINDING SITE I, BINDING SITE II or BINDING SITE III of FIG. 8. Table 4 illustrates the complementarity of the nucleotide sequences of KIAA1615 BINDING SITE1 and KIAA1615 BINDING SITE2, designated SEQ ID:10111 and SEQ ID:8549 respectively, to the nucleotide sequence of GAM189 RNA, herein designated GAM RNA, also designated SEQ ID:246.

Another function of GAM189 is therefore inhibition of KIAA1615 (Accession NP_066002.1). Accordingly, utilities of GAM189 include diagnosis, prevention and treatment of diseases and clinical conditions associated with KIAA1615.

KIAA1671 (Accession XP_037809.1) is another GAM189 target gene, herein designated TARGET GENE. KIAA1671 BINDING SITE1 and KIAA1671 BINDING SITE2 are target binding sites found in untranslated regions of mRNA encoded by KIAA1671, corresponding to target binding sites such as BINDING SITE I, BINDING SITE II or BINDING SITE III of FIG. 8. Table 4 illustrates the complementarity of the nucleotide sequences of KIAA1671 BINDING SITE1 and KIAA1671 BINDING SITE2, designated SEQ ID:17191 and SEQ ID:7194 respectively, to the nucleotide sequence of GAM189 RNA, herein designated GAM RNA, also designated SEQ ID:246.

Another function of GAM189 is therefore inhibition of KIAA1671 (Accession XP_037809.1). Accordingly, utilities of GAM189 include diagnosis, prevention and treatment of diseases and clinical conditions associated with KIAA1671.

KIAA1712 (Accession XP_041497.2) is another GAM189 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:1142 and SEQ ID:14165 respectively, to the nucleotide sequence of GAM189 RNA, herein designated GAM RNA, also designated SEQ ID:246.

Another function of GAM189 is therefore inhibition of KIAA1712 (Accession XP_041497.2). Accordingly, utilities of GAM189 include diagnosis, prevention and treatment of diseases and clinical conditions associated with KIAA1712.

KIAA1712 (Accession XP_041497.2) is another GAM189 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:14165 and SEQ ID:1142 respectively, to the nucleotide sequence of GAM189 RNA, herein designated GAM RNA, also designated SEQ ID:246.

Another function of GAM189 is therefore inhibition of KIAA1712 (Accession XP_041497.2). Accordingly, utilities of GAM189 include diagnosis, prevention and treatment of diseases and clinical conditions associated with KIAA1712.

KIAA1724 (Accession XP_040280.2) is another GAM189 target gene, herein designated TARGET GENE. KIAA1724 BINDING SITE is a target binding site found in the 5' untranslated region of mRNA encoded by KIAA1724, corresponding to a target binding site such as BINDING SITE I, BINDING SITE II or BINDING SITE III of FIG. 8. Table 4 illustrates the complementarity of the nucleotide sequences of KIAA1724 BINDING SITE, designated SEQ ID:14630, to the nucleotide sequence of GAM189 RNA, herein designated GAM RNA, also designated SEQ ID:246.

Another function of GAM189 is therefore inhibition of KIAA1724 (Accession XP_040280.2). Accordingly, utilities of GAM189 include diagnosis, prevention and treatment of diseases and clinical conditions associated with KIAA1724.

KIAA1737 (Accession NP_219494.1) is another GAM189 target gene, herein designated TARGET GENE. KIAA1737 BINDING SITE is a target binding site found in the 3' untranslated region of mRNA encoded by KIAA1737, corresponding to a target binding site such as BINDING SITE I, BINDING SITE II or BINDING SITE III of FIG. 8. Table 4 illustrates the complementarity of the nucleotide sequences of KIAA1737 BINDING SITE, designated SEQ ID:10602, to the nucleotide sequence of GAM189 RNA, herein designated GAM RNA, also designated SEQ ID:246.

Another function of GAM189 is therefore inhibition of KIAA1737 (Accession NP_219494.1). Accordingly, utilities of GAM189 include diagnosis, prevention and treatment of diseases and clinical conditions associated with KIAA1737.

KIAA1775 (Accession NP_149091.1) is another GAM189 target gene, herein designated TARGET GENE. KIAA1775 BINDING SITE is a target binding site found in the 3' untranslated region of mRNA encoded by KIAA1775, corresponding to a target binding site such as BINDING SITE I, BINDING SITE II or BINDING SITE III of FIG. 8. Table 4 illustrates the complementarity of the nucleotide sequences of KIAA1775 BINDING SITE, designated SEQ ID:1618, to the nucleotide sequence of GAM189 RNA, herein designated GAM RNA, also designated SEQ ID:246.

Another function of GAM189 is therefore inhibition of KIAA1775 (Accession NP_149091.1). Accordingly, utilities of GAM189 include diagnosis, prevention and treatment of diseases and clinical conditions associated with KIAA1775.

KIAA1784 (Accession NP_115820.1) is another GAM189 target gene, herein designated TARGET GENE. KIAA1784 BINDING SITE is a target binding site found in the 3' untranslated region of mRNA encoded by KIAA1784, corresponding to a target binding site such as BINDING SITE I, BINDING SITE II or BINDING SITE III of FIG. 8. Table 4 illustrates the complementarity of the nucleotide sequences of KIAA1784 BINDING SITE, designated SEQ ID:11058, to the nucleotide sequence of GAM189 RNA, herein designated GAM RNA, also designated SEQ ID:246.

Another function of GAM189 is therefore inhibition of KIAA1784 (Accession NP_115820.1). Accordingly, utilities of GAM189 include diagnosis, prevention and treatment of diseases and clinical conditions associated with KIAA1784.

KIAA1822 (Accession XP_041566.2) is another GAM189 target gene, herein designated TARGET GENE. KIAA1822 BINDING SITE is a target binding site found in the 3' untranslated region of mRNA encoded by KIAA1822, corresponding to a target binding site such as BINDING SITE I, BINDING SITE II or BINDING SITE III of FIG. 8. Table 4 illustrates the complementarity of the nucleotide sequences of KIAA1822 BINDING SITE, designated SEQ ID:10095, to the nucleotide sequence of GAM189 RNA, herein designated GAM RNA, also designated SEQ ID:246.

Another function of GAM189 is therefore inhibition of KIAA1822 (Accession XP_041566.2). Accordingly, utilities of GAM189 include diagnosis, prevention and treatment of diseases and clinical conditions associated with KIAA1822.

KIAA1827 (Accession XP_290834.1) is another GAM189 target gene, herein designated TARGET GENE. KIAA1827 BINDING SITE1 and KIAA1827 BINDING SITE2 are target binding sites found in untranslated regions of mRNA encoded by KIAA1827, corresponding to target binding sites such as BINDING SITE I, BINDING SITE II or BINDING SITE III of FIG. 8. Table 4 illustrates the complementarity of the nucleotide sequences of KIAA1827 BINDING SITE1 and KIAA1827 BINDING SITE2, designated SEQ ID:2143 and SEQ ID:12636 respectively, to the nucleotide sequence of GAM189 RNA, herein designated GAM RNA, also designated SEQ ID:246.

Another function of GAM189 is therefore inhibition of KIAA1827 (Accession XP_290834.1). Accordingly, utilities of GAM189 include diagnosis, prevention and treatment of diseases and clinical conditions associated with KIAA1827.

KIAA1829 (Accession XP_030378.2) is another GAM189 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:14863, to the nucleotide sequence of GAM189 RNA, herein designated GAM RNA, also designated SEQ ID:246.

Another function of GAM189 is therefore inhibition of KIAA1829 (Accession XP_030378.2). Accordingly, utilities of GAM189 include diagnosis, prevention and treatment of diseases and clinical conditions associated with KIAA1829.

KIAA1836 (Accession XP_114087.2) is another GAM189 target gene, herein designated TARGET GENE. KIAA1836 BINDING SITE is a target binding site found in the 3' untranslated region of mRNA encoded by KIAA1836, corresponding to a target binding site such as BINDING SITE I, BINDING SITE II or BINDING SITE III of FIG. 8. Table 4 illustrates the complementarity of the nucleotide sequences of KIAA1836 BINDING SITE, designated SEQ ID:12627, to the nucleotide sequence of GAM189 RNA, herein designated GAM RNA, also designated SEQ ID:246.

Another function of GAM189 is therefore inhibition of KIAA1836 (Accession XP_114087.2). Accordingly, utilities of GAM189 include diagnosis, prevention and treatment of diseases and clinical conditions associated with KIAA1836.

KIAA1853 (Accession XP_045184.1) is another GAM189 target gene, herein designated TARGET GENE.

KIAA1853 BINDING SITE is a target binding site found in the 3' untranslated region of mRNA encoded by KIAA1853, corresponding to a target binding site such as BINDING SITE I, BINDING SITE II or BINDING SITE III of FIG. 8. Table 4 illustrates the complementarity of the nucleotide sequences of KIAA1853 BINDING SITE, designated SEQ ID:19095, to the nucleotide sequence of GAM189 RNA, herein designated GAM RNA, also designated SEQ ID:246.

Another function of GAM189 is therefore inhibition of KIAA1853 (Accession XP_045184.1). Accordingly, utilities of GAM189 include diagnosis, prevention and treatment of diseases and clinical conditions associated with KIAA1853.

KIAA1904 (Accession XP_056282.1) is another GAM189 target gene, herein designated TARGET GENE. KIAA1904 BINDING SITE is a target binding site found in the 3' untranslated region of mRNA encoded by KIAA1904, corresponding to a target binding site such as BINDING SITE I, BINDING SITE II or BINDING SITE III of FIG. 8. Table 4 illustrates the complementarity of the nucleotide sequences of KIAA1904 BINDING SITE, designated SEQ ID:16492, to the nucleotide sequence of GAM189 RNA, herein designated GAM RNA, also designated SEQ ID:246.

Another function of GAM189 is therefore inhibition of KIAA1904 (Accession XP_056282.1). Accordingly, utilities of GAM189 include diagnosis, prevention and treatment of diseases and clinical conditions associated with KIAA1904.

KIAA1922 (Accession XP_057040.1) is another GAM189 target gene, herein designated TARGET GENE. KIAA1922 BINDING SITE is a target binding site found in the 5' untranslated region of mRNA encoded by KIAA1922, corresponding to a target binding site such as BINDING SITE I, BINDING SITE II or BINDING SITE III of FIG. 8. Table 4 illustrates the complementarity of the nucleotide sequences of KIAA1922 BINDING SITE, designated SEQ ID:7553, to the nucleotide sequence of GAM189 RNA, herein designated GAM RNA, also designated SEQ ID:246.

Another function of GAM189 is therefore inhibition of KIAA1922 (Accession XP_057040.1). Accordingly, utilities of GAM189 include diagnosis, prevention and treatment of diseases and clinical conditions associated with KIAA1922.

KIAA1924 (Accession NP_694971.2) is another GAM189 target gene, herein designated TARGET GENE. KIAA1924 BINDING SITE1 and KIAA1924 BINDING SITE2 are target binding sites found in untranslated regions of mRNA encoded by KIAA1924, corresponding to target binding sites such as BINDING SITE I, BINDING SITE II or BINDING SITE III of FIG. 8. Table 4 illustrates the complementarity of the nucleotide sequences of KIAA1924 BINDING SITE1 and KIAA1924 BINDING SITE2, designated SEQ ID:1857 and SEQ ID:8341 respectively, to the nucleotide sequence of GAM189 RNA, herein designated GAM RNA, also designated SEQ ID:246.

Another function of GAM189 is therefore inhibition of KIAA1924 (Accession NP_694971.2). Accordingly, utilities of GAM189 include diagnosis, prevention and treatment of diseases and clinical conditions associated with KIAA1924.

KIAA1937 (Accession XP_057107.3) is another GAM189 target gene, herein designated TARGET GENE. KIAA1937 BINDING SITE is a target binding site found in the 5' untranslated region of mRNA encoded by KIAA1937, corresponding to a target binding site such as BINDING SITE I, BINDING SITE II or BINDING SITE III of FIG. 8. Table 4 illustrates the complementarity of the nucleotide sequences of KIAA1937 BINDING SITE, designated SEQ ID:2983, to the nucleotide sequence of GAM189 RNA, herein designated GAM RNA, also designated SEQ ID:246.

Another function of GAM189 is therefore inhibition of KIAA1937 (Accession XP_057107.3). Accordingly, utilities of GAM189 include diagnosis, prevention and treatment of diseases and clinical conditions associated with KIAA1937.

KIAA1971 (Accession XP_058720.4) is another GAM189 target gene, herein designated TARGET GENE. KIAA1971 BINDING SITE1 and KIAA1971 BINDING SITE2 are target binding sites found in untranslated regions of mRNA encoded by KIAA1971, corresponding to target binding sites such as BINDING SITE I, BINDING SITE II or BINDING SITE III of FIG. 8. Table 4 illustrates the complementarity of the nucleotide sequences of KIAA1971 BINDING SITE1 and KIAA1971 BINDING SITE2, designated SEQ ID:6902 and SEQ ID:11506 respectively, to the nucleotide sequence of GAM189 RNA, herein designated GAM RNA, also designated SEQ ID:246.

Another function of GAM189 is therefore inhibition of KIAA1971 (Accession XP_058720.4). Accordingly, utilities of GAM189 include diagnosis, prevention and treatment of diseases and clinical conditions associated with KIAA1971.

KIAA1987 (Accession XP_113870.1) is another GAM189 target gene, herein designated TARGET GENE. KIAA1987 BINDING SITE is a target binding site found in the 5' untranslated region of mRNA encoded by KIAA1987, corresponding to a target binding site such as BINDING SITE I, BINDING SITE II or BINDING SITE III of FIG. 8. Table 4 illustrates the complementarity of the nucleotide sequences of KIAA1987 BINDING SITE, designated SEQ ID:7554, to the nucleotide sequence of GAM189 RNA, herein designated GAM RNA, also designated SEQ ID:246.

Another function of GAM189 is therefore inhibition of KIAA1987 (Accession XP_113870.1). Accordingly, utilities of GAM189 include diagnosis, prevention and treatment of diseases and clinical conditions associated with KIAA1987.

KIAA2028 (Accession XP_059415.2) is another GAM189 target gene, herein designated TARGET GENE. KIAA2028 BINDING SITE is a target binding site found in the 3' untranslated region of mRNA encoded by KIAA2028, corresponding to a target binding site such as BINDING SITE I, BINDING SITE II or BINDING SITE III of FIG. 8. Table 4 illustrates the complementarity of the nucleotide sequences of KIAA2028 BINDING SITE, designated SEQ ID:12100, to the nucleotide sequence of GAM189 RNA, herein designated GAM RNA, also designated SEQ ID:246.

Another function of GAM189 is therefore inhibition of KIAA2028 (Accession XP_059415.2). Accordingly, utilities of GAM189 include diagnosis, prevention and treatment of diseases and clinical conditions associated with KIAA2028.

Kruppel-like factor 12 (KLF12, Accession NP_009180.3) is another GAM189 target gene, herein designated TARGET GENE. KLF12 BINDING SITE is a target binding site found in the 3' untranslated region of multiple transcripts of mRNA encoded by KLF12, corresponding to a target binding site such as BINDING SITE I, BINDING SITE II or BINDING SITE III of FIG. 8. Table 4 illustrates the complementarity of the nucleotide sequences of KLF12 BINDING SITE, designated SEQ ID:1127, to the nucleotide sequence of GAM189 RNA, herein designated GAM RNA, also designated SEQ ID:246.

Another function of GAM189 is therefore inhibition of Kruppel-like factor 12 (KLF12, Accession NP_009180.3). Accordingly, utilities of GAM189 include diagnosis, prevention and treatment of diseases and clinical conditions associated with KLF12.

Killer cell lectin-like receptor subfamily d, member 1 (KLRD1, Accession NP_002253.1) is another GAM189 target gene, herein designated TARGET GENE. KLRD1 BINDING SITE is a target binding site found in the 3' untranslated region of multiple transcripts of mRNA encoded by KLRD1, corresponding to a target binding site such as BINDING SITE I, BINDING SITE II or BINDING SITE III of FIG. 8. Table 4 illustrates the complementarity of the nucleotide sequences of KLRD1 BINDING SITE, designated SEQ ID:2353, to the nucleotide sequence of GAM189 RNA, herein designated GAM RNA, also designated SEQ ID:246.

Another function of GAM189 is therefore inhibition of Killer cell lectin-like receptor subfamily d, member 1 (KLRD1, Accession NP_002253.1), a gene which is a receptor for the recognition of mhc class i hla-e molecules by nk cells and some cytotoxic t-cells. Accordingly, utilities of GAM189 include diagnosis, prevention and treatment of diseases and clinical conditions associated with KLRD1.

The function of KLRD1 has been established by previous studies. Natural killer (NK) cells are a distinct lineage of lymphocytes that mediate cytotoxic activity and secrete cytokines upon immune stimulation. Several genes of the C-type lectin superfamily, including members of the NKG2 family, are expressed by NK cells and may be involved in the regulation of NK cell function. See NKG2A, 161555. To study CD94, an antigen preferentially expressed on NK cells, Chang et al. (1995) used an expression cloning strategy to isolate an IL2-activated polyclonal NK cell line cDNA encoding CD94. Northern blot analysis revealed that CD94 is expressed as 3 major transcripts of 0.8, 1.8, and 3.5 kb and a minor transcript of 5.5 kb in NK cell lines. The predicted protein contains a 147-amino acid extracellular domain with several motifs characteristic of C-type lectins, a 26-amino acid transmembrane domain, and a 7-amino acid cytoplasmic domain. CD94 is classified as a type II membrane protein because it has an external C terminus. The amino acid sequence of CD94 is 27 to 32% identical to those of NKG2 family members NKG2A, NKG2C (KLRC2; 602891), NKG2D (OMIM Ref. No. 602893), and NKG2E (KLRC3; 602892). Chang et al. (1995) stated that the virtual absence of a cytoplasmic domain implies that CD94 function requires association with other receptors. Lazetic et al. (1996) demonstrated that CD94 forms disulfide-bonded heterodimers with NKG2A, NKG2C, and NKG2E. Rodriguez et al. (1998) reported that the CD94 gene contains 6 exons. Using S1 nuclease protection and primer extension assay, they found that transcription initiation in CD94 is heterogeneous, but is restricted to a 60-bp region around the major initiation site. Chang et al. (1995) mapped the CD94 gene to chromosome 12 using a somatic cell hybrid panel. By analysis of a cosmid contig, Plougastel and Trowsdale (1998) found that the CD94 gene is located at 12p13.2-p12.3, within the NK complex, a cluster of C-type lectin genes preferentially expressed in NK cells.

Full details of the abovementioned studies are described in the following publications, the disclosure of which are hereby incorporated by reference:

Plougastel, B.; Trowsdale, J.: Sequence analysis of a 62-kb region overlapping the human KLRC cluster of genes. Genomics 49:193-199, 1998. ; and Rodriguez, A.; Carretero, M.; Glienke, J.; Bellon, T.; Ramirez, A.; Lehrach, H.; Francis, F.; Lopez-Botet, M.: Structure of the human CD94 C-type lectin gene. Immunogenetics 47:305-309.

Further studies establishing the function and utilities of KLRD1 are found in John Hopkins OMIM database record ID 602894, and in cited publications listed in Table 5, which are hereby incorporated by reference. Killer cell lectin-like receptor subfamily d, member 1 (KLRD1, Accession NP_031360.1) is another GAM189 target gene, herein designated TARGET GENE. KLRD1 BINDING SITE is a target binding site found in the 3' untranslated region of multiple transcripts of mRNA encoded by KLRD1, corresponding to a target binding site such as BINDING SITE I, BINDING SITE II or BINDING SITE III of FIG. 8. Table 4 illustrates the complementarity of the nucleotide sequences of KLRD1 BINDING SITE, designated SEQ ID:2353, to the nucleotide sequence of GAM189 RNA, herein designated GAM RNA, also designated SEQ ID:246.

Another function of GAM189 is therefore inhibition of Killer cell lectin-like receptor subfamily d, member 1 (KLRD1, Accession NP_031360.1), a gene which is a receptor for the recognition of mhc class i hla-e molecules by nk cells and some cytotoxic t-cells. Accordingly, utilities of GAM189 include diagnosis, prevention and treatment of diseases and clinical conditions associated with KLRD1.

The function of KLRD1 has been established by previous studies. Natural killer (NK) cells are a distinct lineage of lymphocytes that mediate cytotoxic activity and secrete cytokines upon immune stimulation. Several genes of the C-type lectin superfamily, including members of the NKG2 family, are expressed by NK cells and may be involved in the regulation of NK cell function. See NKG2A, 161555. To study CD94, an antigen preferentially expressed on NK cells, Chang et al. (1995) used an expression cloning strategy to isolate an IL2-activated polyclonal NK cell line cDNA encoding CD94. Northern blot analysis revealed that CD94 is expressed as 3 major transcripts of 0.8, 1.8, and 3.5 kb and a minor transcript of 5.5 kb in NK cell lines. The predicted protein contains a 147-amino acid extracellular domain with several motifs characteristic of C-type lectins, a 26-amino acid transmembrane domain, and a 7-amino acid cytoplasmic domain. CD94 is classified as a type II membrane protein because it has an external C terminus. The amino acid sequence of CD94 is 27 to 32% identical to those of NKG2 family members NKG2A, NKG2C (KLRC2; 602891), NKG2D (OMIM Ref. No. 602893), and NKG2E (KLRC3; 602892). Chang et al. (1995) stated that the virtual absence of a cytoplasmic domain implies that CD94 function requires association with other receptors. Lazetic et al. (1996) demonstrated that CD94 forms disulfide-bonded heterodimers with NKG2A, NKG2C, and NKG2E. Rodriguez et al. (1998) reported that the CD94 gene contains 6 exons. Using S1 nuclease protection and primer extension assay, they found that transcription initiation in CD94 is heterogeneous, but is restricted to a 60-bp region around the major initiation site. Chang et al. (1995) mapped the CD94 gene to chromosome 12 using a somatic cell hybrid panel. By analysis of a cosmid contig, Plougastel and Trowsdale (1998) found that the CD94 gene is located at 12p13.2-p12.3, within the NK complex, a cluster of C-type lectin genes preferentially expressed in NK cells.

Full details of the abovementioned studies are described in the following publications, the disclosure of which are hereby incorporated by reference:

Plougastel, B.; Trowsdale, J.: Sequence analysis of a 62-kb region overlapping the human KLRC cluster of genes. Genomics 49:193-199, 1998. ; and Rodriguez, A.; Carretero, M.; Glienke, J.; Bellon, T.; Ramirez, A.; Lehrach, H.; Francis, F.; Lopez-Botet, M.: Structure of the human CD94 C-type lectin gene. Immunogenetics 47:305-309.

Further studies establishing the function and utilities of KLRD1 are found in John Hopkins OMIM database record ID 602894, and in cited publications listed in Table 5, which are hereby incorporated by reference. Kynurenine 3-monooxygenase (kynurenine 3-hydroxylase) (KMO, Accession NP_003670.1) is another GAM189 target gene, herein designated TARGET GENE. KMO BINDING SITE is a target binding site found in the 3' untranslated region of mRNA encoded by KMO, corresponding to a target binding site such as BINDING SITE I, BINDING SITE II or BINDING SITE III of FIG. 8. Table 4 illustrates the complementarity of the nucleotide sequences of KMO BINDING SITE, designated SEQ ID:6338, to the nucleotide sequence of GAM189 RNA, herein designated GAM RNA, also designated SEQ ID:246.

Another function of GAM189 is therefore inhibition of Kynurenine 3-monooxygenase (kynurenine 3-hydroxylase) (KMO, Accession NP_003670.1), a gene which may play a role in encephalic photoreception. Accordingly, utilities of GAM189 include diagnosis, prevention and treatment of diseases and clinical conditions associated with KMO.

The function of KMO and its association with various diseases and clinical conditions, has been established by previous studies, as described hereinabove with reference to GAM30.1. Lysosomal-associated membrane protein 3 (LAMP3, Accession NP_055213.1) is another GAM189 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:17760, to the nucleotide sequence of GAM189 RNA, herein designated GAM RNA, also designated SEQ ID:246.

Another function of GAM189 is therefore inhibition of Lysosomal-associated membrane protein 3 (LAMP3, Accession NP_055213.1). Accordingly, utilities of GAM189 include diagnosis, prevention and treatment of diseases and clinical conditions associated with LAMP3.

Leucyl-trna synthetase (LARS, Accession NP_064502.8) is another GAM189 target gene, herein designated TARGET GENE. LARS BINDING SITE is a target binding site found in the 5' untranslated region of mRNA encoded by LARS, corresponding to a target binding site such as BINDING SITE I, BINDING SITE II or BINDING SITE III of FIG. 8. Table 4 illustrates the complementarity of the nucleotide sequences of LARS BINDING SITE, designated SEQ ID:2620, to the nucleotide sequence of GAM189 RNA, herein designated GAM RNA, also designated SEQ ID:246.

Another function of GAM189 is therefore inhibition of Leucyl-trna synthetase (LARS, Accession NP_064502.8). Accordingly, utilities of GAM189 include diagnosis, prevention and treatment of diseases and clinical conditions associated with LARS.

Lim and sh3 protein 1 (LASP1, Accession NP_006139.1) is another GAM189 target gene, herein designated TARGET GENE. LASP1 BINDING SITE is a target binding site found in the 3' untranslated region of mRNA encoded by LASP1, corresponding to a target binding site such as BINDING SITE I, BINDING SITE II or BINDING SITE III of FIG. 8. Table 4 illustrates the complementarity of the nucleotide sequences of LASP1 BINDING SITE, designated SEQ ID:17709, to the nucleotide sequence of GAM189 RNA, herein designated GAM RNA, also designated SEQ ID:246.

Another function of GAM189 is therefore inhibition of Lim and sh3 protein 1 (LASP1, Accession NP_006139.1). Accordingly, utilities of GAM189 include diagnosis, prevention and treatment of diseases and clinical conditions associated with LASP1.

Lipocalin 7 (LCN7, Accession NP_071447.1) is another GAM189 target gene, herein designated TARGET GENE. LCN7 BINDING SITE is a target binding site found in the 3' untranslated region of mRNA encoded by LCN7, corresponding to a target binding site such as BINDING SITE I, BINDING SITE II or BINDING SITE III of FIG. 8. Table 4 illustrates the complementarity of the nucleotide sequences of LCN7 BINDING SITE, designated SEQ ID:15937, to the nucleotide sequence of GAM189 RNA, herein designated GAM RNA, also designated SEQ ID:246.

Another function of GAM189 is therefore inhibition of Lipocalin 7 (LCN7, Accession NP_071447.1). Accordingly, utilities of GAM189 include diagnosis, prevention and treatment of diseases and clinical conditions associated with LCN7.

Leucine zipper-ef-hand containing transmembrane protein 1 (LETM1, Accession NP_036450.1) is another GAM189 target gene, herein designated TARGET GENE. LETM1 BINDING SITE is a target binding site found in the 3' untranslated region of mRNA encoded by LETM1, corresponding to a target binding site such as BINDING SITE I, BINDING SITE II or BINDING SITE III of FIG. 8. Table 4 illustrates the complementarity of the nucleotide sequences of LETM1 BINDING SITE, designated SEQ ID:18695, to the nucleotide sequence of GAM189 RNA, herein designated GAM RNA, also designated SEQ ID:246.

Another function of GAM189 is therefore inhibition of Leucine zipper-ef-hand containing transmembrane protein 1 (LETM1, Accession NP_036450.1). Accordingly, utilities of GAM189 include diagnosis, prevention and treatment of diseases and clinical conditions associated with LETM1.

LGP2 (Accession NP_077024.1) is another GAM189 target gene, herein designated TARGET GENE. LGP2 BINDING SITE is a target binding site found in the 5' untranslated region of mRNA encoded by LGP2, corresponding to a target binding site such as BINDING SITE I, BINDING SITE II or BINDING SITE III of FIG. 8. Table 4 illustrates the complementarity of the nucleotide sequences of LGP2 BINDING SITE, designated SEQ ID:8032, to the nucleotide sequence of GAM189 RNA, herein designated GAM RNA, also designated SEQ ID:246.

Another function of GAM189 is therefore inhibition of LGP2 (Accession NP_077024.1). Accordingly, utilities of GAM189 include diagnosis, prevention and treatment of diseases and clinical conditions associated with LGP2.

Lim homeobox protein 2 (LHX2, Accession NP_004780.3) is another GAM189 target gene, herein designated TARGET GENE. LHX2 BINDING SITE is a target binding site found in the 5' untranslated region of mRNA encoded by LHX2, corresponding to a target binding site such as BINDING SITE I, BINDING SITE II or BINDING SITE III of FIG. 8. Table 4 illustrates the complementarity of the nucleotide sequences of LHX2 BINDING SITE, designated SEQ ID:4178, to the nucleotide sequence of GAM189 RNA, herein designated GAM RNA, also designated SEQ ID:246.

Another function of GAM189 is therefore inhibition of Lim homeobox protein 2 (LHX2, Accession NP_004780.3).

Accordingly, utilities of GAM189 include diagnosis, prevention and treatment of diseases and clinical conditions associated with LHX2.

LIN-28 (Accession NP_078950.1) is another GAM189 target gene, herein designated TARGET GENE. LIN-28 BINDING SITE is a target binding site found in the 3' untranslated region of mRNA encoded by LIN-28, corresponding to a target binding site such as BINDING SITE I, BINDING SITE II or BINDING SITE III of FIG. 8. Table 4 illustrates the complementarity of the nucleotide sequences of LIN-28 BINDING SITE, designated SEQ ID:4726, to the nucleotide sequence of GAM189 RNA, herein designated GAM RNA, also designated SEQ ID:246.

Another function of GAM189 is therefore inhibition of LIN-28 (Accession NP_078950.1). Accordingly, utilities of GAM189 include diagnosis, prevention and treatment of diseases and clinical conditions associated with LIN-28.

Link-GEFII (Accession NP_057423.1) is another GAM189 target gene, herein designated TARGET GENE. Link-GEFII BINDING SITE is a target binding site found in the 3' untranslated region of mRNA encoded by Link-GEFII, corresponding to a target binding site such as BINDING SITE I, BINDING SITE II or BINDING SITE III of FIG. 8. Table 4 illustrates the complementarity of the nucleotide sequences of Link-GEFII BINDING SITE, designated SEQ ID:19936, to the nucleotide sequence of GAM189 RNA, herein designated GAM RNA, also designated SEQ ID:246.

Another function of GAM189 is therefore inhibition of Link-GEFII (Accession NP_057423.1). Accordingly, utilities of GAM189 include diagnosis, prevention and treatment of diseases and clinical conditions associated with Link-GEFII.

Lipase, member h (LIPH, Accession NP_640341.1) is another GAM189 target gene, herein designated TARGET GENE. LIPH BINDING SITE is a target binding site found in the 3' untranslated region of mRNA encoded by LIPH, corresponding to a target binding site such as BINDING SITE I, BINDING SITE II or BINDING SITE III of FIG. 8. Table 4 illustrates the complementarity of the nucleotide sequences of LIPH BINDING SITE, designated SEQ ID:10379, to the nucleotide sequence of GAM189 RNA, herein designated GAM RNA, also designated SEQ ID:246.

Another function of GAM189 is therefore inhibition of Lipase, member h (LIPH, Accession NP_640341.1). Accordingly, utilities of GAM189 include diagnosis, prevention and treatment of diseases and clinical conditions associated with LIPH.

Lethal giant larvae homolog 2 (drosophila) (LLGL2, Accession NP_004515.1) is another GAM189 target gene, herein designated TARGET GENE. LLGL2 BINDING SITE is a target binding site found in the 3' untranslated region of mRNA encoded by LLGL2, corresponding to a target binding site such as BINDING SITE I, BINDING SITE II or BINDING SITE III of FIG. 8. Table 4 illustrates the complementarity of the nucleotide sequences of LLGL2 BINDING SITE, designated SEQ ID:15172, to the nucleotide sequence of GAM189 RNA, herein designated GAM RNA, also designated SEQ ID:246.

Another function of GAM189 is therefore inhibition of Lethal giant larvae homolog 2 (drosophila) (LLGL2, Accession NP_004515.1) . Accordingly, utilities of GAM189 include diagnosis, prevention and treatment of diseases and clinical conditions associated with LLGL2.

LNK (Accession NP_005466.1) is another GAM189 target gene, herein designated TARGET GENE. LNK BINDING SITE1 and LNK BINDING SITE2 are target binding sites found in untranslated regions of mRNA encoded by LNK, corresponding to target binding sites such as BINDING SITE I, BINDING SITE II or BINDING SITE III of FIG. 8. Table 4 illustrates the complementarity of the nucleotide sequences of LNK BINDING SITE1 and LNK BINDING SITE2, designated SEQ ID:13992 and SEQ ID:1866 respectively, to the nucleotide sequence of GAM189 RNA, herein designated GAM RNA, also designated SEQ ID:246.

Another function of GAM189 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM189 include diagnosis, prevention and treatment of diseases and clinical conditions associated with LNK.

The function of LNK and its association with various diseases and clinical conditions, has been established by previous studies, as described hereinabove with reference to GAM130.1. LOC112687 (Accession XP_053145.1) is another GAM189 target gene, herein designated TARGET GENE. LOC112687 BINDING SITE1 through LOC112687 BINDING SITE3 are target binding sites found in untranslated regions of mRNA encoded by LOC112687, corresponding to target binding sites such as BINDING SITE I, BINDING SITE II or BINDING SITE III of FIG. 8. Table 4 illustrates the complementarity of the nucleotide sequences of LOC112687 BINDING SITE1 through LOC112687 BINDING SITE3, designated SEQ ID:16673, SEQ ID:793 and SEQ ID:7988 respectively, to the nucleotide sequence of GAM189 RNA, herein designated GAM RNA, also designated SEQ ID:246.

Another function of GAM189 is therefore inhibition of LOC112687 (Accession XP_053145.1). Accordingly, utilities of GAM189 include diagnosis, prevention and treatment of diseases and clinical conditions associated with LOC112687.

LOC112817 (Accession NP_612422.2) is another GAM189 target gene, herein designated TARGET GENE. LOC112817 BINDING SITE is a target binding site found in the 3' untranslated region of mRNA encoded by LOC112817, corresponding to a target binding site such as BINDING SITE I, BINDING SITE II or BINDING SITE III of FIG. 8. Table 4 illustrates the complementarity of the nucleotide sequences of LOC112817 BINDING SITE, designated SEQ ID:16256, to the nucleotide sequence of GAM189 RNA, herein designated GAM RNA, also designated SEQ ID:246.

Another function of GAM189 is therefore inhibition of LOC112817 (Accession NP_612422.2). Accordingly, utilities of GAM189 include diagnosis, prevention and treatment of diseases and clinical conditions associated with LOC112817.

LOC113444 (Accession NP_612437.2) is another GAM189 target gene, herein designated TARGET GENE. LOC113444 BINDING SITE1 through LOC113444 BINDING SITE3 are target binding sites found in untranslated regions of mRNA encoded by LOC113444, corresponding to target binding sites such as BINDING SITE I, BINDING SITE II or BINDING SITE III of FIG. 8. Table 4 illustrates the complementarity of the nucleotide sequences of LOC113444 BINDING SITE1 through LOC113444 BINDING SITE3, designated SEQ ID:18294, SEQ ID:5336 and SEQ ID:15899 respectively, to the nucleotide sequence of GAM189 RNA, herein designated GAM RNA, also designated SEQ ID:246.

Another function of GAM189 is therefore inhibition of LOC113444 (Accession NP_612437.2). Accordingly, utilities of GAM189 include diagnosis, prevention and treatment of diseases and clinical conditions associated with LOC113444.

LOC113828 (Accession NP_612444.1) is another GAM189 target gene, herein designated TARGET GENE. LOC113828 BINDING SITE is a target binding site found in the 5' untranslated region of mRNA encoded by LOC113828, corresponding to a target binding site such as BINDING SITE I, BINDING SITE II or BINDING SITE III of FIG. 8. Table 4 illustrates the complementarity of the nucleotide sequences of LOC113828 BINDING SITE, designated SEQ ID:5632, to the nucleotide sequence of GAM189 RNA, herein designated GAM RNA, also designated SEQ ID:246.

Another function of GAM189 is therefore inhibition of LOC113828 (Accession NP_612444.1). Accordingly, utilities of GAM189 include diagnosis, prevention and treatment of diseases and clinical conditions associated with LOC113828.

LOC115123 (Accession XP_055276.1) is another GAM189 target gene, herein designated TARGET GENE. LOC115123 BINDING SITE is a target binding site found in the 5' untranslated region of mRNA encoded by LOC115123, corresponding to a target binding site such as BINDING SITE I, BINDING SITE II or BINDING SITE III of FIG. 8. Table 4 illustrates the complementarity of the nucleotide sequences of LOC115123 BINDING SITE, designated SEQ ID:15271, to the nucleotide sequence of GAM189 RNA, herein designated GAM RNA, also designated SEQ ID:246.

Another function of GAM189 is therefore inhibition of LOC115123 (Accession XP_055276.1). Accordingly, utilities of GAM189 include diagnosis, prevention and treatment of diseases and clinical conditions associated with LOC115123.

LOC115219 (Accession XP_055499.2) is another GAM189 target gene, herein designated TARGET GENE. LOC115219 BINDING SITE is a target binding site found in the 5' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:12422, to the nucleotide sequence of GAM189 RNA, herein designated GAM RNA, also designated SEQ ID:246.

Another function of GAM189 is therefore inhibition of LOC115219 (Accession XP_055499.2). Accordingly, utilities of GAM189 include diagnosis, prevention and treatment of diseases and clinical conditions associated with LOC115219.

LOC115648 (Accession NP_663299.1) is another GAM189 target gene, herein designated TARGET GENE. LOC115648 BINDING SITE is a target binding site found in the 3' untranslated region of mRNA encoded by LOC115648, corresponding to a target binding site such as BINDING SITE I, BINDING SITE II or BINDING SITE III of FIG. 8. Table 4 illustrates the complementarity of the nucleotide sequences of LOC115648 BINDING SITE, designated SEQ ID:7429, to the nucleotide sequence of GAM189 RNA, herein designated GAM RNA, also designated SEQ ID:246.

Another function of GAM189 is therefore inhibition of LOC115648 (Accession NP_663299.1). Accordingly, utilities of GAM189 include diagnosis, prevention and treatment of diseases and clinical conditions associated with LOC115648.

LOC116411 (Accession XP_058095.1) is another GAM189 target gene, herein designated TARGET GENE. LOC116411 BINDING SITE is a target binding site found in the 5' untranslated region of mRNA encoded by LOC116411, corresponding to a target binding site such as BINDING SITE I, BINDING SITE II or BINDING SITE III of FIG. 8. Table 4 illustrates the complementarity of the nucleotide sequences of LOC116411 BINDING SITE, designated SEQ ID:14720, to the nucleotide sequence of GAM189 RNA, herein designated GAM RNA, also designated SEQ ID:246.

Another function of GAM189 is therefore inhibition of LOC116411 (Accession XP_058095.1). Accordingly, utilities of GAM189 include diagnosis, prevention and treatment of diseases and clinical conditions associated with LOC116411.

LOC118490 (Accession XP_060981.3) is another GAM189 target gene, herein designated TARGET GENE. LOC118490 BINDING SITE is a target binding site found in the 3' untranslated region of mRNA encoded by LOC118490, corresponding to a target binding site such as BINDING SITE I, BINDING SITE II or BINDING SITE III of FIG. 8. Table 4 illustrates the complementarity of the nucleotide sequences of LOC118490 BINDING SITE, designated SEQ ID:456, to the nucleotide sequence of GAM189 RNA, herein designated GAM RNA, also designated SEQ ID:246.

Another function of GAM189 is therefore inhibition of LOC118490 (Accession XP_060981.3). Accordingly, utilities of GAM189 include diagnosis, prevention and treatment of diseases and clinical conditions associated with LOC118490.

LOC118812 (Accession NP_849154.1) is another GAM189 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:2649, to the nucleotide sequence of GAM189 RNA, herein designated GAM RNA, also designated SEQ ID:246.

Another function of GAM189 is therefore inhibition of LOC118812 (Accession NP_849154.1). Accordingly, utilities of GAM189 include diagnosis, prevention and treatment of diseases and clinical conditions associated with LOC118812.

LOC118812 (Accession XP_058346.2) is another GAM189 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:2649, to the nucleotide sequence of GAM189 RNA, herein designated GAM RNA, also designated SEQ ID:246.

Another function of GAM189 is therefore inhibition of LOC118812 (Accession XP_058346.2). Accordingly, utilities of GAM189 include diagnosis, prevention and treatment of diseases and clinical conditions associated with LOC118812.

LOC119395 (Accession XP_061446.3) is another GAM189 target gene, herein designated TARGET GENE. LOC119395 BINDING SITE is a target binding site found in the 5' untranslated region of mRNA encoded by LOC119395, corresponding to a target binding site such as BINDING SITE I, BINDING SITE II or BINDING SITE III of FIG. 8. Table 4 illustrates the complementarity of the nucleotide sequences of LOC119395 BINDING SITE, designated SEQ ID:745, to the nucleotide sequence of GAM189 RNA, herein designated GAM RNA, also designated SEQ ID:246.

Another function of GAM189 is therefore inhibition of LOC119395 (Accession XP_061446.3). Accordingly, utilities of GAM189 include diagnosis, prevention and treatment of diseases and clinical conditions associated with LOC119395.

LOC120526 (Accession XP_058475.1) is another GAM189 target gene, herein designated TARGET GENE. LOC120526 BINDING SITE is a target binding site found in the 3' untranslated region of mRNA encoded by LOC120526, corresponding to a target binding site such as BINDING SITE I, BINDING SITE II or BINDING SITE III of FIG. 8. Table 4 illustrates the complementarity of the nucleotide sequences of LOC120526 BINDING SITE, designated SEQ ID:17112, to the nucleotide sequence of GAM189 RNA, herein designated GAM RNA, also designated SEQ ID:246.

Another function of GAM189 is therefore inhibition of LOC120526 (Accession XP_058475.1). Accordingly, utilities of GAM189 include diagnosis, prevention and treatment of diseases and clinical conditions associated with LOC120526.

LOC121952 (Accession XP_062872.2) is another GAM189 target gene, herein designated TARGET GENE. LOC121952 BINDING SITE is a target binding site found in the 5' untranslated region of mRNA encoded by LOC121952, corresponding to a target binding site such as BINDING SITE I, BINDING SITE II or BINDING SITE III of FIG. 8. Table 4 illustrates the complementarity of the nucleotide sequences of LOC121952 BINDING SITE, designated SEQ ID:9891, to the nucleotide sequence of GAM189 RNA, herein designated GAM RNA, also designated SEQ ID:246.

Another function of GAM189 is therefore inhibition of LOC121952 (Accession XP_062872.2). Accordingly, utilities of GAM189 include diagnosis, prevention and treatment of diseases and clinical conditions associated with LOC121952.

LOC124221 (Accession XP_058785.3) is another GAM189 target gene, herein designated TARGET GENE. LOC124221 BINDING SITE is a target binding site found in the 5' untranslated region of mRNA encoded by LOC124221, corresponding to a target binding site such as BINDING SITE I, BINDING SITE II or BINDING SITE III of FIG. 8. Table 4 illustrates the complementarity of the nucleotide sequences of LOC124221 BINDING SITE, designated SEQ ID:14576, to the nucleotide sequence of GAM189 RNA, herein designated GAM RNA, also designated SEQ ID:246.

Another function of GAM189 is therefore inhibition of LOC124221 (Accession XP_058785.3). Accordingly, utilities of GAM189 include diagnosis, prevention and treatment of diseases and clinical conditions associated with LOC124221.

LOC125061 (Accession XP_058889.3) is another GAM189 target gene, herein designated TARGET GENE. LOC125061 BINDING SITE is a target binding site found in the 3' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:1744, to the nucleotide sequence of GAM189 RNA, herein designated GAM RNA, also designated SEQ ID:246.

Another function of GAM189 is therefore inhibition of LOC125061 (Accession XP_058889.3). Accordingly, utilities of GAM189 include diagnosis, prevention and treatment of diseases and clinical conditions associated with LOC125061.

LOC126669 (Accession XP_060121.4) is another GAM189 target gene, herein designated TARGET GENE. LOC126669 BINDING SITE is a target binding site found in the 3' untranslated region of mRNA encoded by LOC126669, corresponding to a target binding site such as BINDING SITE I, BINDING SITE II or BINDING SITE III of FIG. 8. Table 4 illustrates the complementarity of the nucleotide sequences of LOC126669 BINDING SITE, designated SEQ ID:3477, to the nucleotide sequence of GAM189 RNA, herein designated GAM RNA, also designated SEQ ID:246.

Another function of GAM189 is therefore inhibition of LOC126669 (Accession XP_060121.4). Accordingly, utilities of GAM189 include diagnosis, prevention and treatment of diseases and clinical conditions associated with LOC126669.

LOC127253 (Accession XP_059122.1) is another GAM189 target gene, herein designated TARGET GENE. LOC127253 BINDING SITE is a target binding site found in the 3' untranslated region of mRNA encoded by LOC127253, corresponding to a target binding site such as BINDING SITE I, BINDING SITE II or BINDING SITE III of FIG. 8. Table 4 illustrates the complementarity of the nucleotide sequences of LOC127253 BINDING SITE, designated SEQ ID:18918, to the nucleotide sequence of GAM189 RNA, herein designated GAM RNA, also designated SEQ ID:246.

Another function of GAM189 is therefore inhibition of LOC127253 (Accession XP_059122.1). Accordingly, utilities of GAM189 include diagnosis, prevention and treatment of diseases and clinical conditions associated with LOC127253.

LOC127841 (Accession XP_059184.1) is another GAM189 target gene, herein designated TARGET GENE. LOC127841 BINDING SITE is a target binding site found in the 5' untranslated region of mRNA encoded by LOC127841, corresponding to a target binding site such as BINDING SITE I, BINDING SITE II or BINDING SITE III of FIG. 8. Table 4 illustrates the complementarity of the nucleotide sequences of LOC127841 BINDING SITE, designated SEQ ID:18516, to the nucleotide sequence of GAM189 RNA, herein designated GAM RNA, also designated SEQ ID:246.

Another function of GAM189 is therefore inhibition of LOC127841 (Accession XP_059184.1). Accordingly, utilities of GAM189 include diagnosis, prevention and treatment of diseases and clinical conditions associated with LOC127841.

LOC128387 (Accession XP_059243.2) is another GAM189 target gene, herein designated TARGET GENE. LOC128387 BINDING SITE is a target binding site found in the 3' untranslated region of mRNA encoded by LOC128387, corresponding to a target binding site such as BINDING SITE I, BINDING SITE II or BINDING SITE III of FIG. 8. Table 4 illustrates the complementarity of the nucleotide sequences of LOC128387 BINDING SITE, designated SEQ ID:15173, to the nucleotide sequence of GAM189 RNA, herein designated GAM RNA, also designated SEQ ID:246.

Another function of GAM189 is therefore inhibition of LOC128387 (Accession XP_059243.2). Accordingly, utilities of GAM189 include diagnosis, prevention and treatment of diseases and clinical conditions associated with LOC128387.

LOC132241 (Accession XP_059583.1) is another GAM189 target gene, herein designated TARGET GENE. LOC132241 BINDING SITE is a target binding site found in the 5' untranslated region of mRNA encoded by LOC132241, corresponding to a target binding site such as BINDING SITE I, BINDING SITE II or BINDING SITE III of FIG. 8. Table 4 illustrates the complementarity of the nucleotide sequences of LOC132241 BINDING SITE, designated SEQ ID:509, to the nucleotide sequence of GAM189 RNA, herein designated GAM RNA, also designated SEQ ID:246.

Another function of GAM189 is therefore inhibition of LOC132241 (Accession XP_059583.1). Accordingly, utilities of GAM189 include diagnosis, prevention and treatment of diseases and clinical conditions associated with LOC132241.

LOC135293 (Accession XP_072402.4) is another GAM189 target gene, herein designated TARGET GENE. LOC135293 BINDING SITE1 and LOC135293 BINDING SITE2 are target binding sites found in untranslated regions of mRNA encoded by LOC135293, corresponding to target binding sites such as BINDING SITE I, BINDING SITE II or BINDING SITE III of FIG. 8. Table 4 illustrates the complementarity of the nucleotide sequences of LOC135293 BINDING SITE1 and LOC135293 BINDING SITE2, designated SEQ ID:3512 and SEQ ID:10443 respectively, to the nucleotide sequence of GAM189 RNA, herein designated GAM RNA, also designated SEQ ID:246.

Another function of GAM189 is therefore inhibition of LOC135293 (Accession XP_072402.4). Accordingly, utilities of GAM189 include diagnosis, prevention and treatment of diseases and clinical conditions associated with LOC135293.

LOC135763 (Accession NP_612639.1) is another GAM189 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:17207, to the nucleotide sequence of GAM189 RNA, herein designated GAM RNA, also designated SEQ ID:246.

Another function of GAM189 is therefore inhibition of LOC135763 (Accession NP_612639.1). Accordingly, utilities of GAM189 include diagnosis, prevention and treatment of diseases and clinical conditions associated with LOC135763.

LOC135818 (Accession XP_059804.4) is another GAM189 target gene, herein designated TARGET GENE. LOC135818 BINDING SITE is a target binding site found in the 3' untranslated region of mRNA encoded by LOC135818, corresponding to a target binding site such as BINDING SITE I, BINDING SITE II or BINDING SITE III of FIG. 8. Table 4 illustrates the complementarity of the nucleotide sequences of LOC135818 BINDING SITE, designated SEQ ID:19136, to the nucleotide sequence of GAM189 RNA, herein designated GAM RNA, also designated SEQ ID:246.

Another function of GAM189 is therefore inhibition of LOC135818 (Accession XP_059804.4). Accordingly, utilities of GAM189 include diagnosis, prevention and treatment of diseases and clinical conditions associated with LOC135818.

LOC137886 (Accession XP_059929.3) is another GAM189 target gene, herein designated TARGET GENE. LOC137886 BINDING SITE is a target binding site found in the 3' untranslated region of mRNA encoded by LOC137886, corresponding to a target binding site such as BINDING SITE I, BINDING SITE II or BINDING SITE III of FIG. 8. Table 4 illustrates the complementarity of the nucleotide sequences of LOC137886 BINDING SITE, designated SEQ ID:19990, to the nucleotide sequence of GAM189 RNA, herein designated GAM RNA, also designated SEQ ID:246.

Another function of GAM189 is therefore inhibition of LOC137886 (Accession XP_059929.3). Accordingly, utilities of GAM189 include diagnosis, prevention and treatment of diseases and clinical conditions associated with LOC137886.

LOC139422 (Accession XP_066687.2) is another GAM189 target gene, herein designated TARGET GENE. LOC139422 BINDING SITE is a target binding site found in the 5' untranslated region of mRNA encoded by LOC139422, corresponding to a target binding site such as BINDING SITE I, BINDING SITE II or BINDING SITE III of FIG. 8. Table 4 illustrates the complementarity of the nucleotide sequences of LOC139422 BINDING SITE, designated SEQ ID:9489, to the nucleotide sequence of GAM189 RNA, herein designated GAM RNA, also designated SEQ ID:246.

Another function of GAM189 is therefore inhibition of LOC139422 (Accession XP_066687.2). Accordingly, utilities of GAM189 include diagnosis, prevention and treatment of diseases and clinical conditions associated with LOC139422.

LOC143241 (Accession NP_620167.1) is another GAM189 target gene, herein designated TARGET GENE. LOC143241 BINDING SITE is a target binding site found in the 5' untranslated region of mRNA encoded by LOC143241, corresponding to a target binding site such as BINDING SITE I, BINDING SITE II or BINDING SITE III of FIG. 8. Table 4 illustrates the complementarity of the nucleotide sequences of LOC143241 BINDING SITE, designated SEQ ID:15574, to the nucleotide sequence of GAM189 RNA, herein designated GAM RNA, also designated SEQ ID:246.

Another function of GAM189 is therefore inhibition of LOC143241 (Accession NP_620167.1). Accordingly, utilities of GAM189 include diagnosis, prevention and treatment of diseases and clinical conditions associated with LOC143241.

LOC144248 (Accession XP_084786.1) is another GAM189 target gene, herein designated TARGET GENE. LOC144248 BINDING SITE is a target binding site found in the 5' untranslated region of mRNA encoded by LOC144248, corresponding to a target binding site such as BINDING SITE I, BINDING SITE II or BINDING SITE III of FIG. 8. Table 4 illustrates the complementarity of the nucleotide sequences of LOC144248 BINDING SITE, designated SEQ ID:3159, to the nucleotide sequence of GAM189 RNA, herein designated GAM RNA, also designated SEQ ID:246.

Another function of GAM189 is therefore inhibition of LOC144248 (Accession XP_084786.1). Accordingly, utilities of GAM189 include diagnosis, prevention and treatment of diseases and clinical conditions associated with LOC144248.

LOC144266 (Accession XP_084795.1) is another GAM189 target gene, herein designated TARGET GENE. LOC144266 BINDING SITE is a target binding site found in the 5' untranslated region of mRNA encoded by LOC144266, corresponding to a target binding site such as BINDING SITE I, BINDING SITE II or BINDING SITE III of FIG. 8. Table 4 illustrates the complementarity of the nucleotide sequences of LOC144266 BINDING SITE, designated SEQ ID:17498, to the nucleotide sequence of GAM189 RNA, herein designated GAM RNA, also designated SEQ ID:246.

Another function of GAM189 is therefore inhibition of LOC144266 (Accession XP_084795.1). Accordingly, utilities of GAM189 include diagnosis, prevention and treatment of diseases and clinical conditions associated with LOC144266.

LOC144404 (Accession XP_084852.6) is another GAM189 target gene, herein designated TARGET GENE. LOC144404 BINDING SITE1 through LOC144404 BINDING SITE3 are target binding sites found in untranslated regions of mRNA encoded by LOC144404, corresponding to target binding sites such as BINDING SITE I, BINDING SITE II or BINDING SITE III of FIG. 8. Table 4 illustrates the complementarity of the nucleotide sequences of LOC144404 BINDING SITE1 through LOC144404 BINDING SITE3, designated SEQ ID:5897, SEQ ID:1633 and SEQ ID:15352 respectively, to the nucleotide sequence of GAM189 RNA, herein designated GAM RNA, also designated SEQ ID:246.

Another function of GAM189 is therefore inhibition of LOC144404 (Accession XP_084852.6). Accordingly, utilities of GAM189 include diagnosis, prevention and treatment of diseases and clinical conditions associated with LOC144404.

LOC144467 (Accession NP_612482.1) is another GAM189 target gene, herein designated TARGET GENE. LOC144467 BINDING SITE is a target binding site found in the 5' untranslated region of mRNA encoded by LOC144467, corresponding to a target binding site such as BINDING SITE I, BINDING SITE II or BINDING SITE III of FIG. 8. Table 4 illustrates the complementarity of the nucleotide sequences of LOC144467 BINDING SITE, designated SEQ ID:5733, to the nucleotide sequence of GAM189 RNA, herein designated GAM RNA, also designated SEQ ID:246.

Another function of GAM189 is therefore inhibition of LOC144467 (Accession NP_612482.1). Accordingly, utilities of GAM189 include diagnosis, prevention and treatment of diseases and clinical conditions associated with LOC144467.

LOC144481 (Accession XP_096611.2) is another GAM189 target gene, herein designated TARGET GENE. LOC144481 BINDING SITE is a target binding site found in the 3' untranslated region of mRNA encoded by LOC144481, corresponding to a target binding site such as BINDING SITE I, BINDING SITE II or BINDING SITE III of FIG. 8. Table 4 illustrates the complementarity of the nucleotide sequences of LOC144481 BINDING SITE, designated SEQ ID:19220, to the nucleotide sequence of GAM189 RNA, herein designated GAM RNA, also designated SEQ ID:246.

Another function of GAM189 is therefore inhibition of LOC144481 (Accession XP_096611.2). Accordingly, utilities of GAM189 include diagnosis, prevention and treatment of diseases and clinical conditions associated with LOC144481.

LOC144667 (Accession XP_096648.1) is another GAM189 target gene, herein designated TARGET GENE. LOC144667 BINDING SITE is a target binding site found in the 3' untranslated region of mRNA encoded by LOC144667, corresponding to a target binding site such as BINDING SITE I, BINDING SITE II or BINDING SITE III of FIG. 8. Table 4 illustrates the complementarity of the nucleotide sequences of LOC144667 BINDING SITE, designated SEQ ID:12712, to the nucleotide sequence of GAM189 RNA, herein designated GAM RNA, also designated SEQ ID:246.

Another function of GAM189 is therefore inhibition of LOC144667 (Accession XP_096648.1). Accordingly, utilities of GAM189 include diagnosis, prevention and treatment of diseases and clinical conditions associated with LOC144667.

LOC144742 (Accession XP_084949.1) is another GAM189 target gene, herein designated TARGET GENE. LOC144742 BINDING SITE is a target binding site found in the 5' untranslated region of mRNA encoded by LOC144742, corresponding to a target binding site such as BINDING SITE I, BINDING SITE II or BINDING SITE III of FIG. 8. Table 4 illustrates the complementarity of the nucleotide sequences of LOC144742 BINDING SITE, designated SEQ ID:17736, to the nucleotide sequence of GAM189 RNA, herein designated GAM RNA, also designated SEQ ID:246.

Another function of GAM189 is therefore inhibition of LOC144742 (Accession XP_084949.1). Accordingly, utilities of GAM189 include diagnosis, prevention and treatment of diseases and clinical conditions associated with LOC144742.

LOC144766 (Accession XP_084963.2) is another GAM189 target gene, herein designated TARGET GENE. LOC144766 BINDING SITE is a target binding site found in the 5' untranslated region of mRNA encoded by LOC144766, corresponding to a target binding site such as BINDING SITE I, BINDING SITE II or BINDING SITE III of FIG. 8. Table 4 illustrates the complementarity of the nucleotide sequences of LOC144766 BINDING SITE, designated SEQ ID:8972, to the nucleotide sequence of GAM189 RNA, herein designated GAM RNA, also designated SEQ ID:246.

Another function of GAM189 is therefore inhibition of LOC144766 (Accession XP_084963.2). Accordingly, utilities of GAM189 include diagnosis, prevention and treatment of diseases and clinical conditions associated with LOC144766.

LOC144776 (Accession XP_084964.1) is another GAM189 target gene, herein designated TARGET GENE. LOC144776 BINDING SITE1 and LOC144776 BINDING SITE2 are target binding sites found in untranslated regions of mRNA encoded by LOC144776, corresponding to target binding sites such as BINDING SITE I, BINDING SITE II or BINDING SITE III of FIG. 8. Table 4 illustrates the complementarity of the nucleotide sequences of LOC144776 BINDING SITE1 and LOC144776 BINDING SITE2, designated SEQ ID:444 and SEQ ID:16275 respectively, to the nucleotide sequence of GAM189 RNA, herein designated GAM RNA, also designated SEQ ID:246.

Another function of GAM189 is therefore inhibition of LOC144776 (Accession XP_084964.1). Accordingly, utilities of GAM189 include diagnosis, prevention and treatment of diseases and clinical conditions associated with LOC144776.

LOC144817 (Accession XP_084972.1) is another GAM189 target gene, herein designated TARGET GENE. LOC144817 BINDING SITE is a target binding site found in the 5' untranslated region of mRNA encoded by LOC144817, corresponding to a target binding site such as BINDING SITE I, BINDING SITE II or BINDING SITE III of FIG. 8. Table 4 illustrates the complementarity of the nucleotide sequences of LOC144817 BINDING SITE, designated SEQ ID:12065, to the nucleotide sequence of GAM189 RNA, herein designated GAM RNA, also designated SEQ ID:246.

Another function of GAM189 is therefore inhibition of LOC144817 (Accession XP_084972.1). Accordingly, utilities of GAM189 include diagnosis, prevention and treatment of diseases and clinical conditions associated with LOC144817.

LOC144962 (Accession XP_084990.1) is another GAM189 target gene, herein designated TARGET GENE. LOC144962 BINDING SITE is a target binding site found in the 5' untranslated region of mRNA encoded by LOC144962, corresponding to a target binding site such as BINDING SITE I, BINDING SITE II or BINDING SITE III of FIG. 8. Table 4 illustrates the complementarity of the nucleotide sequences of LOC144962 BINDING SITE, designated SEQ ID:12130, to the nucleotide sequence of GAM189 RNA, herein designated GAM RNA, also designated SEQ ID:246.

Another function of GAM189 is therefore inhibition of LOC144962 (Accession XP_084990.1). Accordingly, utilities of GAM189 include diagnosis, prevention and treatment of diseases and clinical conditions associated with LOC144962.

LOC145098 (Accession XP_085022.1) is another GAM189 target gene, herein designated TARGET GENE.

LOC145098 BINDING SITE is a target binding site found in the 5' untranslated region of mRNA encoded by LOC145098, corresponding to a target binding site such as BINDING SITE I, BINDING SITE II or BINDING SITE III of FIG. 8. Table 4 illustrates the complementarity of the nucleotide sequences of LOC145098 BINDING SITE, designated SEQ ID:675, to the nucleotide sequence of GAM189 RNA, herein designated GAM RNA, also designated SEQ ID:246.

Another function of GAM189 is therefore inhibition of LOC145098 (Accession XP_085022.1). Accordingly, utilities of GAM189 include diagnosis, prevention and treatment of diseases and clinical conditions associated with LOC145098.

LOC145231 (Accession XP_096740.1) is another GAM189 target gene, herein designated TARGET GENE. LOC145231 BINDING SITE is a target binding site found in the 3' untranslated region of mRNA encoded by LOC145231, corresponding to a target binding site such as BINDING SITE I, BINDING SITE II or BINDING SITE III of FIG. 8. Table 4 illustrates the complementarity of the nucleotide sequences of LOC145231 BINDING SITE, designated SEQ ID:6417, to the nucleotide sequence of GAM189 RNA, herein designated GAM RNA, also designated SEQ ID:246.

Another function of GAM189 is therefore inhibition of LOC145231 (Accession XP_096740.1). Accordingly, utilities of GAM189 include diagnosis, prevention and treatment of diseases and clinical conditions associated with LOC145231.

LOC145268 (Accession XP_085072.1) is another GAM189 target gene, herein designated TARGET GENE. LOC145268 BINDING SITE is a target binding site found in the 5' untranslated region of mRNA encoded by LOC145268, corresponding to a target binding site such as BINDING SITE I, BINDING SITE II or BINDING SITE III of FIG. 8. Table 4 illustrates the complementarity of the nucleotide sequences of LOC145268 BINDING SITE, designated SEQ ID:18805, to the nucleotide sequence of GAM189 RNA, herein designated GAM RNA, also designated SEQ ID:246.

Another function of GAM189 is therefore inhibition of LOC145268 (Accession XP_085072.1). Accordingly, utilities of GAM189 include diagnosis, prevention and treatment of diseases and clinical conditions associated with LOC145268.

LOC145725 (Accession XP_085211.1) is another GAM189 target gene, herein designated TARGET GENE. LOC145725 BINDING SITE is a target binding site found in the 3' untranslated region of mRNA encoded by LOC145725, corresponding to a target binding site such as BINDING SITE I, BINDING SITE II or BINDING SITE III of FIG. 8. Table 4 illustrates the complementarity of the nucleotide sequences of LOC145725 BINDING SITE, designated SEQ ID:4773, to the nucleotide sequence of GAM189 RNA, herein designated GAM RNA, also designated SEQ ID:246.

Another function of GAM189 is therefore inhibition of LOC145725 (Accession XP_085211.1). Accordingly, utilities of GAM189 include diagnosis, prevention and treatment of diseases and clinical conditions associated with LOC145725.

LOC145757 (Accession XP_085227.1) is another GAM189 target gene, herein designated TARGET GENE. LOC145757 BINDING SITE1 and LOC145757 BINDING SITE2 are target binding sites found in untranslated regions of mRNA encoded by LOC145757, corresponding to target binding sites such as BINDING SITE I, BINDING SITE II or BINDING SITE III of FIG. 8. Table 4 illustrates the complementarity of the nucleotide sequences of LOC145757 BINDING SITE1 and LOC145757 BINDING SITE2, designated SEQ ID:11523 and SEQ ID:7370 respectively, to the nucleotide sequence of GAM189 RNA, herein designated GAM RNA, also designated SEQ ID:246.

Another function of GAM189 is therefore inhibition of LOC145757 (Accession XP_085227.1). Accordingly, utilities of GAM189 include diagnosis, prevention and treatment of diseases and clinical conditions associated with LOC145757.

LOC145783 (Accession XP_085231.2) is another GAM189 target gene, herein designated TARGET GENE. LOC145783 BINDING SITE is a target binding site found in the 5' untranslated region of mRNA encoded by LOC145783, corresponding to a target binding site such as BINDING SITE I, BINDING SITE II or BINDING SITE III of FIG. 8. Table 4 illustrates the complementarity of the nucleotide sequences of LOC145783 BINDING SITE, designated SEQ ID:2196, to the nucleotide sequence of GAM189 RNA, herein designated GAM RNA, also designated SEQ ID:246.

Another function of GAM189 is therefore inhibition of LOC145783 (Accession XP_085231.2). Accordingly, utilities of GAM189 include diagnosis, prevention and treatment of diseases and clinical conditions associated with LOC145783.

LOC145813 (Accession XP_096873.1) is another GAM189 target gene, herein designated TARGET GENE. LOC145813 BINDING SITE is a target binding site found in the 5' untranslated region of mRNA encoded by LOC145813, corresponding to a target binding site such as BINDING SITE I, BINDING SITE II or BINDING SITE III of FIG. 8. Table 4 illustrates the complementarity of the nucleotide sequences of LOC145813 BINDING SITE, designated SEQ ID:16256, to the nucleotide sequence of GAM189 RNA, herein designated GAM RNA, also designated SEQ ID:246.

Another function of GAM189 is therefore inhibition of LOC145813 (Accession XP_096873.1). Accordingly, utilities of GAM189 include diagnosis, prevention and treatment of diseases and clinical conditions associated with LOC145813.

LOC145988 (Accession XP_085290.3) is another GAM189 target gene, herein designated TARGET GENE. LOC145988 BINDING SITE is a target binding site found in the 5' untranslated region of mRNA encoded by LOC145988, corresponding to a target binding site such as BINDING SITE I, BINDING SITE II or BINDING SITE III of FIG. 8. Table 4 illustrates the complementarity of the nucleotide sequences of LOC145988 BINDING SITE, designated SEQ ID:11009, to the nucleotide sequence of GAM189 RNA, herein designated GAM RNA, also designated SEQ ID:246.

Another function of GAM189 is therefore inhibition of LOC145988 (Accession XP_085290.3). Accordingly, utilities of GAM189 include diagnosis, prevention and treatment of diseases and clinical conditions associated with LOC145988.

LOC146177 (Accession NP_778229.1) is another GAM189 target gene, herein designated TARGET GENE. LOC146177 BINDING SITE is a target binding site found in the 5' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:16175, to the nucleotide sequence of GAM189 RNA, herein designated GAM RNA, also designated SEQ ID:246.

Another function of GAM189 is therefore inhibition of LOC146177 (Accession NP_778229.1). Accordingly, utilities of GAM189 include diagnosis, prevention and treatment of diseases and clinical conditions associated with LOC146177.

LOC146229 (Accession XP_085387.1) is another GAM189 target gene, herein designated TARGET GENE. LOC146229 BINDING SITE1 through LOC146229 BINDING SITE4 are target binding sites found in untranslated regions of mRNA encoded by LOC146229, corresponding to target binding sites such as BINDING SITE I, BINDING SITE II or BINDING SITE III of FIG. 8. Table 4 illustrates the complementarity of the nucleotide sequences of LOC146229 BINDING SITE1 through LOC146229 BINDING SITE4, designated SEQ ID:8706, SEQ ID:5672, SEQ ID:5551 and SEQ ID:1644 respectively, to the nucleotide sequence of GAM189 RNA, herein designated GAM RNA, also designated SEQ ID:246.

Another function of GAM189 is therefore inhibition of LOC146229 (Accession XP_085387.1). Accordingly, utilities of GAM189 include diagnosis, prevention and treatment of diseases and clinical conditions associated with LOC146229.

LOC146346 (Accession XP_085430.1) is another GAM189 target gene, herein designated TARGET GENE. LOC146346 BINDING SITE1 and LOC146346 BINDING SITE2 are target binding sites found in untranslated regions of mRNA encoded by LOC146346, corresponding to target binding sites such as BINDING SITE I, BINDING SITE II or BINDING SITE III of FIG. 8. Table 4 illustrates the complementarity of the nucleotide sequences of LOC146346 BINDING SITE1 and LOC146346 BINDING SITE2, designated SEQ ID:17670 and SEQ ID:5798 respectively, to the nucleotide sequence of GAM189 RNA, herein designated GAM RNA, also designated SEQ ID:246.

Another function of GAM189 is therefore inhibition of LOC146346 (Accession XP_085430.1). Accordingly, utilities of GAM189 include diagnosis, prevention and treatment of diseases and clinical conditions associated with LOC146346.

LOC146429 (Accession XP_096998.2) is another GAM189 target gene, herein designated TARGET GENE. LOC146429 BINDING SITE is a target binding site found in the 5' untranslated region of mRNA encoded by LOC146429, corresponding to a target binding site such as BINDING SITE I, BINDING SITE II or BINDING SITE III of FIG. 8. Table 4 illustrates the complementarity of the nucleotide sequences of LOC146429 BINDING SITE, designated SEQ ID:2457, to the nucleotide sequence of GAM189 RNA, herein designated GAM RNA, also designated SEQ ID:246.

Another function of GAM189 is therefore inhibition of LOC146429 (Accession XP_096998.2). Accordingly, utilities of GAM189 include diagnosis, prevention and treatment of diseases and clinical conditions associated with LOC146429.

LOC146443 (Accession XP_085461.6) is another GAM189 target gene, herein designated TARGET GENE. LOC146443 BINDING SITE is a target binding site found in the 5' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:813, to the nucleotide sequence of GAM189 RNA, herein designated GAM RNA, also designated SEQ ID:246.

Another function of GAM189 is therefore inhibition of LOC146443 (Accession XP_085461.6). Accordingly, utilities of GAM189 include diagnosis, prevention and treatment of diseases and clinical conditions associated with LOC146443.

LOC146475 (Accession XP_097006.1) is another GAM189 target gene, herein designated TARGET GENE. LOC146475 BINDING SITE is a target binding site found in the 5' untranslated region of mRNA encoded by LOC146475, corresponding to a target binding site such as BINDING SITE I, BINDING SITE II or BINDING SITE III of FIG. 8. Table 4 illustrates the complementarity of the nucleotide sequences of LOC146475 BINDING SITE, designated SEQ ID:9246, to the nucleotide sequence of GAM189 RNA, herein designated GAM RNA, also designated SEQ ID:246.

Another function of GAM189 is therefore inhibition of LOC146475 (Accession XP_097006.1). Accordingly, utilities of GAM189 include diagnosis, prevention and treatment of diseases and clinical conditions associated with LOC146475.

LOC146513 (Accession XP_097013.1) is another GAM189 target gene, herein designated TARGET GENE. LOC146513 BINDING SITE is a target binding site found in the 3' untranslated region of mRNA encoded by LOC146513, corresponding to a target binding site such as BINDING SITE I, BINDING SITE II or BINDING SITE III of FIG. 8. Table 4 illustrates the complementarity of the nucleotide sequences of LOC146513 BINDING SITE, designated SEQ ID:3374, to the nucleotide sequence of GAM189 RNA, herein designated GAM RNA, also designated SEQ ID:246.

Another function of GAM189 is therefore inhibition of LOC146513 (Accession XP_097013.1). Accordingly, utilities of GAM189 include diagnosis, prevention and treatment of diseases and clinical conditions associated with LOC146513.

LOC146603 (Accession XP_085514.2) is another GAM189 target gene, herein designated TARGET GENE. LOC146603 BINDING SITE is a target binding site found in the 5' untranslated region of mRNA encoded by LOC146603, corresponding to a target binding site such as BINDING SITE I, BINDING SITE II or BINDING SITE III of FIG. 8. Table 4 illustrates the complementarity of the nucleotide sequences of LOC146603 BINDING SITE, designated SEQ ID:7382, to the nucleotide sequence of GAM189 RNA, herein designated GAM RNA, also designated SEQ ID:246.

Another function of GAM189 is therefore inhibition of LOC146603 (Accession XP_085514.2). Accordingly, utilities of GAM189 include diagnosis, prevention and treatment of diseases and clinical conditions associated with LOC146603.

LOC146784 (Accession XP_085588.1) is another GAM189 target gene, herein designated TARGET GENE. LOC146784 BINDING SITE is a target binding site found in the 5' untranslated region of mRNA encoded by LOC146784, corresponding to a target binding site such as BINDING SITE I, BINDING SITE II or BINDING SITE III of FIG. 8. Table 4 illustrates the complementarity of the nucleotide sequences of LOC146784 BINDING SITE, designated SEQ ID:13448, to the nucleotide sequence of GAM189 RNA, herein designated GAM RNA, also designated SEQ ID:246.

Another function of GAM189 is therefore inhibition of LOC146784 (Accession XP_085588.1). Accordingly, utilities of GAM189 include diagnosis, prevention and treatment of diseases and clinical conditions associated with LOC146784.

LOC146839 (Accession XP_097107.1) is another GAM189 target gene, herein designated TARGET GENE. LOC146839 BINDING SITE is a target binding site found in the 3' untranslated region of mRNA encoded by LOC146839, corresponding to a target binding site such as BINDING SITE I, BINDING SITE II or BINDING SITE III of FIG. 8. Table 4 illustrates the complementarity of the nucleotide sequences of LOC146839 BINDING SITE, designated SEQ ID:1745, to the nucleotide sequence of GAM189 RNA, herein designated GAM RNA, also designated SEQ ID:246.

Another function of GAM189 is therefore inhibition of LOC146839 (Accession XP_097107.1). Accordingly, utilities of GAM189 include diagnosis, prevention and treatment of diseases and clinical conditions associated with LOC146839.

LOC146894 (Accession NP_660316.1) is another GAM189 target gene, herein designated TARGET GENE. LOC146894 BINDING SITE is a target binding site found in the 3' untranslated region of mRNA encoded by LOC146894, corresponding to a target binding site such as BINDING SITE I, BINDING SITE II or BINDING SITE III of FIG. 8. Table 4 illustrates the complementarity of the nucleotide sequences of LOC146894 BINDING SITE, designated SEQ ID:8315, to the nucleotide sequence of GAM189 RNA, herein designated GAM RNA, also designated SEQ ID:246.

Another function of GAM189 is therefore inhibition of LOC146894 (Accession NP_660316.1). Accordingly, utilities of GAM189 include diagnosis, prevention and treatment of diseases and clinical conditions associated with LOC146894.

LOC146895 (Accession XP_097120.1) is another GAM189 target gene, herein designated TARGET GENE. LOC146895 BINDING SITE is a target binding site found in the 5' untranslated region of mRNA encoded by LOC146895, corresponding to a target binding site such as BINDING SITE I, BINDING SITE II or BINDING SITE III of FIG. 8. Table 4 illustrates the complementarity of the nucleotide sequences of LOC146895 BINDING SITE, designated SEQ ID:8232, to the nucleotide sequence of GAM189 RNA, herein designated GAM RNA, also designated SEQ ID:246.

Another function of GAM189 is therefore inhibition of LOC146895 (Accession XP_097120.1). Accordingly, utilities of GAM189 include diagnosis, prevention and treatment of diseases and clinical conditions associated with LOC146895.

LOC146901 (Accession XP_097121.1) is another GAM189 target gene, herein designated TARGET GENE. LOC146901 BINDING SITE is a target binding site found in the 3' untranslated region of mRNA encoded by LOC146901, corresponding to a target binding site such as BINDING SITE I, BINDING SITE II or BINDING SITE III of FIG. 8. Table 4 illustrates the complementarity of the nucleotide sequences of LOC146901 BINDING SITE, designated SEQ ID:6392, to the nucleotide sequence of GAM189 RNA, herein designated GAM RNA, also designated SEQ ID:246.

Another function of GAM189 is therefore inhibition of LOC146901 (Accession XP_097121.1). Accordingly, utilities of GAM189 include diagnosis, prevention and treatment of diseases and clinical conditions associated with LOC146901.

LOC146909 (Accession XP_085634.2) is another GAM189 target gene, herein designated TARGET GENE. LOC146909 BINDING SITE1 and LOC146909 BINDING SITE2 are target binding sites found in untranslated regions of mRNA encoded by LOC146909, corresponding to target binding sites such as BINDING SITE I, BINDING SITE II or BINDING SITE III of FIG. 8. Table 4 illustrates the complementarity of the nucleotide sequences of LOC146909 BINDING SITE1 and LOC146909 BINDING SITE2, designated SEQ ID:19550 and SEQ ID:9492 respectively, to the nucleotide sequence of GAM189 RNA, herein designated GAM RNA, also designated SEQ ID:246.

Another function of GAM189 is therefore inhibition of LOC146909 (Accession XP_085634.2). Accordingly, utilities of GAM189 include diagnosis, prevention and treatment of diseases and clinical conditions associated with LOC146909.

LOC147071 (Accession XP_054031.5) is another GAM189 target gene, herein designated TARGET GENE. LOC147071 BINDING SITE is a target binding site found in the 5' untranslated region of mRNA encoded by LOC147071, corresponding to a target binding site such as BINDING SITE I, BINDING SITE II or BINDING SITE III of FIG. 8. Table 4 illustrates the complementarity of the nucleotide sequences of LOC147071 BINDING SITE, designated SEQ ID:16699, to the nucleotide sequence of GAM189 RNA, herein designated GAM RNA, also designated SEQ ID:246.

Another function of GAM189 is therefore inhibition of LOC147071 (Accession XP_054031.5). Accordingly, utilities of GAM189 include diagnosis, prevention and treatment of diseases and clinical conditions associated with LOC147071.

LOC147080 (Accession XP_097182.1) is another GAM189 target gene, herein designated TARGET GENE. LOC147080 BINDING SITE is a target binding site found in the 5' untranslated region of mRNA encoded by LOC147080, corresponding to a target binding site such as BINDING SITE I, BINDING SITE II or BINDING SITE III of FIG. 8. Table 4 illustrates the complementarity of the nucleotide sequences of LOC147080 BINDING SITE, designated SEQ ID:12558, to the nucleotide sequence of GAM189 RNA, herein designated GAM RNA, also designated SEQ ID:246.

Another function of GAM189 is therefore inhibition of LOC147080 (Accession XP_097182.1). Accordingly, utilities of GAM189 include diagnosis, prevention and treatment of diseases and clinical conditions associated with LOC147080.

LOC147166 (Accession XP_085722.2) is another GAM189 target gene, herein designated TARGET GENE. LOC147166 BINDING SITE is a target binding site found in the 3' untranslated region of mRNA encoded by LOC147166, corresponding to a target binding site such as BINDING SITE I, BINDING SITE II or BINDING SITE III of FIG. 8. Table 4 illustrates the complementarity of the nucleotide sequences of LOC147166 BINDING SITE, designated SEQ ID:10618, to the nucleotide sequence of GAM189 RNA, herein designated GAM RNA, also designated SEQ ID:246.

Another function of GAM189 is therefore inhibition of LOC147166 (Accession XP_085722.2). Accordingly, utilities of GAM189 include diagnosis, prevention and treatment of diseases and clinical conditions associated with LOC147166.

LOC147381 (Accession XP_097230.2) is another GAM189 target gene, herein designated TARGET GENE. LOC147381 BINDING SITE is a target binding site found in the 3' untranslated region of mRNA encoded by LOC147381, corresponding to a target binding site such as BINDING SITE I, BINDING SITE II or BINDING SITE III of FIG. 8. Table 4 illustrates the complementarity of the nucleotide sequences of LOC147381 BINDING SITE, designated SEQ ID:19915, to the nucleotide sequence of GAM189 RNA, herein designated GAM RNA, also designated SEQ ID:246.

Another function of GAM189 is therefore inhibition of LOC147381 (Accession XP_097230.2). Accordingly, utilities of GAM189 include diagnosis, prevention and treatment of diseases and clinical conditions associated with LOC147381.

LOC147407 (Accession XP_084000.1) is another GAM189 target gene, herein designated TARGET GENE. LOC147407 BINDING SITE is a target binding site found in the 3' untranslated region of mRNA encoded by LOC147407, corresponding to a target binding site such as BINDING SITE I, BINDING SITE II or BINDING SITE III of FIG. 8. Table 4 illustrates the complementarity of the nucleotide sequences of LOC147407 BINDING SITE, designated SEQ ID:12065, to the nucleotide sequence of GAM189 RNA, herein designated GAM RNA, also designated SEQ ID:246.

Another function of GAM189 is therefore inhibition of LOC147407 (Accession XP_084000.1). Accordingly, utilities of GAM189 include diagnosis, prevention and treatment of diseases and clinical conditions associated with LOC147407.

LOC147817 (Accession XP_085903.1) is another GAM189 target gene, herein designated TARGET GENE. LOC147817 BINDING SITE1 and LOC147817 BINDING SITE2 are target binding sites found in untranslated regions of mRNA encoded by LOC147817, corresponding to target binding sites such as BINDING SITE I, BINDING SITE II or BINDING SITE III of FIG. 8. Table 4 illustrates the complementarity of the nucleotide sequences of LOC147817 BINDING SITE1 and LOC147817 BINDING SITE2, designated SEQ ID:1634 and SEQ ID:19233 respectively, to the nucleotide sequence of GAM189 RNA, herein designated GAM RNA, also designated SEQ ID:246.

Another function of GAM189 is therefore inhibition of LOC147817 (Accession XP_085903.1). Accordingly, utilities of GAM189 include diagnosis, prevention and treatment of diseases and clinical conditions associated with LOC147817.

LOC147841 (Accession XP_085924.2) is another GAM189 target gene, herein designated TARGET GENE. LOC147841 BINDING SITE1 and LOC147841 BINDING SITE2 are target binding sites found in untranslated regions of mRNA encoded by LOC147841, corresponding to target binding sites such as BINDING SITE I, BINDING SITE II or BINDING SITE III of FIG. 8. Table 4 illustrates the complementarity of the nucleotide sequences of LOC147841 BINDING SITE1 and LOC147841 BINDING SITE2, designated SEQ ID:12065 and SEQ ID:8642 respectively, to the nucleotide sequence of GAM189 RNA, herein designated GAM RNA, also designated SEQ ID:246.

Another function of GAM189 is therefore inhibition of LOC147841 (Accession XP_085924.2). Accordingly, utilities of GAM189 include diagnosis, prevention and treatment of diseases and clinical conditions associated with LOC147841.

LOC147947 (Accession XP_085974.1) is another GAM189 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:17952, to the nucleotide sequence of GAM189 RNA, herein designated GAM RNA, also designated SEQ ID:246.

Another function of GAM189 is therefore inhibition of LOC147947 (Accession XP_085974.1). Accordingly, utilities of GAM189 include diagnosis, prevention and treatment of diseases and clinical conditions associated with LOC147947.

LOC148137 (Accession NP_653293.1) is another GAM189 target gene, herein designated TARGET GENE. LOC148137 BINDING SITE1 and LOC148137 BINDING SITE2 are target binding sites found in untranslated regions of mRNA encoded by LOC148137, corresponding to target binding sites such as BINDING SITE I, BINDING SITE II or BINDING SITE III of FIG. 8. Table 4 illustrates the complementarity of the nucleotide sequences of LOC148137 BINDING SITE1 and LOC148137 BINDING SITE2, designated SEQ ID:5784 and SEQ ID:17935 respectively, to the nucleotide sequence of GAM189 RNA, herein designated GAM RNA, also designated SEQ ID:246.

Another function of GAM189 is therefore inhibition of LOC148137 (Accession NP_653293.1). Accordingly, utilities of GAM189 include diagnosis, prevention and treatment of diseases and clinical conditions associated with LOC148137.

LOC148198 (Accession XP_047554.4) is another GAM189 target gene, herein designated TARGET GENE. LOC148198 BINDING SITE is a target binding site found in the 3' untranslated region of mRNA encoded by LOC148198, corresponding to a target binding site such as BINDING SITE I, BINDING SITE II or BINDING SITE III of FIG. 8. Table 4 illustrates the complementarity of the nucleotide sequences of LOC148198 BINDING SITE, designated SEQ ID:11563, to the nucleotide sequence of GAM189 RNA, herein designated GAM RNA, also designated SEQ ID:246.

Another function of GAM189 is therefore inhibition of LOC148198 (Accession XP_047554.4). Accordingly, utilities of GAM189 include diagnosis, prevention and treatment of diseases and clinical conditions associated with LOC148198.

LOC148708 (Accession XP_086286.4) is another GAM189 target gene, herein designated TARGET GENE. LOC148708 BINDING SITE is a target binding site found in the 3' untranslated region of mRNA encoded by LOC148708, corresponding to a target binding site such as BINDING SITE I, BINDING SITE II or BINDING SITE III of FIG. 8. Table 4 illustrates the complementarity of the nucleotide sequences of LOC148708 BINDING SITE, designated SEQ ID:15671, to the nucleotide sequence of GAM189 RNA, herein designated GAM RNA, also designated SEQ ID:246.

Another function of GAM189 is therefore inhibition of LOC148708 (Accession XP_086286.4). Accordingly, utilities of GAM189 include diagnosis, prevention and treatment of diseases and clinical conditions associated with LOC148708.

LOC148709 (Accession XP_086281.1) is another GAM189 target gene, herein designated TARGET GENE. LOC148709 BINDING SITE1 and LOC148709 BINDING SITE2 are target binding sites found in untranslated regions of mRNA encoded by LOC148709, corresponding to target binding sites such as BINDING SITE I, BINDING SITE II or BINDING SITE III of FIG. 8. Table 4 illustrates the complementarity of the nucleotide sequences of LOC148709 BINDING SITE1 and LOC148709 BINDING SITE2, designated SEQ ID:9201 and SEQ ID:6922 respectively, to the nucleotide sequence of GAM189 RNA, herein designated GAM RNA, also designated SEQ ID:246.

Another function of GAM189 is therefore inhibition of LOC148709 (Accession XP_086281.1). Accordingly, utilities of GAM189 include diagnosis, prevention and treatment of diseases and clinical conditions associated with LOC148709.

LOC149149 (Accession XP_097598.1) is another GAM189 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:2184, to the nucleotide sequence of GAM189 RNA, herein designated GAM RNA, also designated SEQ ID:246.

Another function of GAM189 is therefore inhibition of LOC149149 (Accession XP_097598.1). Accordingly, utilities of GAM189 include diagnosis, prevention and treatment of diseases and clinical conditions associated with LOC149149.

LOC149194 (Accession XP_086458.1) is another GAM189 target gene, herein designated TARGET GENE. LOC149194 BINDING SITE is a target binding site found in the 3' untranslated region of mRNA encoded by LOC149194, corresponding to a target binding site such as BINDING SITE I, BINDING SITE II or BINDING SITE III of FIG. 8. Table 4 illustrates the complementarity of the nucleotide sequences of LOC149194 BINDING SITE, designated SEQ ID:12637, to the nucleotide sequence of GAM189 RNA, herein designated GAM RNA, also designated SEQ ID:246.

Another function of GAM189 is therefore inhibition of LOC149194 (Accession XP_086458.1). Accordingly, utilities of GAM189 include diagnosis, prevention and treatment of diseases and clinical conditions associated with LOC149194.

LOC149371 (Accession NP_787072.1) is another GAM189 target gene, herein designated TARGET GENE. LOC149371 BINDING SITE is a target binding site found in the 3' untranslated region of mRNA encoded by LOC149371, corresponding to a target binding site such as BINDING SITE I, BINDING SITE II or BINDING SITE III of FIG. 8. Table 4 illustrates the complementarity of the nucleotide sequences of LOC149371 BINDING SITE, designated SEQ ID:13354, to the nucleotide sequence of GAM189 RNA, herein designated GAM RNA, also designated SEQ ID:246.

Another function of GAM189 is therefore inhibition of LOC149371 (Accession NP_787072.1). Accordingly, utilities of GAM189 include diagnosis, prevention and treatment of diseases and clinical conditions associated with LOC149371.

LOC149466 (Accession XP_086546.1) is another GAM189 target gene, herein designated TARGET GENE. LOC149466 BINDING SITE is a target binding site found in the 3' untranslated region of mRNA encoded by LOC149466, corresponding to a target binding site such as BINDING SITE I, BINDING SITE II or BINDING SITE III of FIG. 8. Table 4 illustrates the complementarity of the nucleotide sequences of LOC149466 BINDING SITE, designated SEQ ID:16260, to the nucleotide sequence of GAM189 RNA, herein designated GAM RNA, also designated SEQ ID:246.

Another function of GAM189 is therefore inhibition of LOC149466 (Accession XP_086546.1). Accordingly, utilities of GAM189 include diagnosis, prevention and treatment of diseases and clinical conditions associated with LOC149466.

LOC149478 (Accession XP_086536.1) is another GAM189 target gene, herein designated TARGET GENE. LOC149478 BINDING SITE is a target binding site found in the 3' untranslated region of mRNA encoded by LOC149478, corresponding to a target binding site such as BINDING SITE I, BINDING SITE II or BINDING SITE III of FIG. 8. Table 4 illustrates the complementarity of the nucleotide sequences of LOC149478 BINDING SITE, designated SEQ ID:5016, to the nucleotide sequence of GAM189 RNA, herein designated GAM RNA, also designated SEQ ID:246.

Another function of GAM189 is therefore inhibition of LOC149478 (Accession XP_086536.1). Accordingly, utilities of GAM189 include diagnosis, prevention and treatment of diseases and clinical conditions associated with LOC149478.

LOC149506 (Accession XP_097661.1) is another GAM189 target gene, herein designated TARGET GENE. LOC149506 BINDING SITE is a target binding site found in the 3' untranslated region of mRNA encoded by LOC149506, corresponding to a target binding site such as BINDING SITE I, BINDING SITE II or BINDING SITE III of FIG. 8. Table 4 illustrates the complementarity of the nucleotide sequences of LOC149506 BINDING SITE, designated SEQ ID:2139, to the nucleotide sequence of GAM189 RNA, herein designated GAM RNA, also designated SEQ ID:246.

Another function of GAM189 is therefore inhibition of LOC149506 (Accession XP_097661.1). Accordingly, utilities of GAM189 include diagnosis, prevention and treatment of diseases and clinical conditions associated with LOC149506.

LOC149606 (Accession XP_086600.1) is another GAM189 target gene, herein designated TARGET GENE. LOC149606 BINDING SITE is a target binding site found in the 3' untranslated region of mRNA encoded by LOC149606, corresponding to a target binding site such as BINDING SITE I, BINDING SITE II or BINDING SITE III of FIG. 8. Table 4 illustrates the complementarity of the nucleotide sequences of LOC149606 BINDING SITE, designated SEQ ID:8887, to the nucleotide sequence of GAM189 RNA, herein designated GAM RNA, also designated SEQ ID:246.

Another function of GAM189 is therefore inhibition of LOC149606 (Accession XP_086600.1). Accordingly, utilities of GAM189 include diagnosis, prevention and treatment of diseases and clinical conditions associated with LOC149606.

LOC149692 (Accession XP_097706.1) is another GAM189 target gene, herein designated TARGET GENE. LOC149692 BINDING SITE is a target binding site found in the 3' untranslated region of mRNA encoded by LOC149692, corresponding to a target binding site such as BINDING SITE I, BINDING SITE II or BINDING SITE III of FIG. 8. Table 4 illustrates the complementarity of the nucleotide sequences of LOC149692 BINDING SITE, designated SEQ ID:11025, to the nucleotide sequence of GAM189 RNA, herein designated GAM RNA, also designated SEQ ID:246.

Another function of GAM189 is therefore inhibition of LOC149692 (Accession XP_097706.1). Accordingly, utilities of GAM189 include diagnosis, prevention and treatment of diseases and clinical conditions associated with LOC149692.

LOC149703 (Accession XP_097719.1) is another GAM189 target gene, herein designated TARGET GENE. LOC149703 BINDING SITE is a target binding site found in the 5' untranslated region of mRNA encoded by LOC149703, corresponding to a target binding site such as BINDING SITE I, BINDING SITE II or BINDING SITE III of FIG. 8. Table 4 illustrates the complementarity of the nucleotide sequences of LOC149703 BINDING SITE, designated SEQ ID:10508, to the nucleotide sequence of GAM189 RNA, herein designated GAM RNA, also designated SEQ ID:246.

Another function of GAM189 is therefore inhibition of LOC149703 (Accession XP_097719.1). Accordingly, utilities of GAM189 include diagnosis, prevention and treatment of diseases and clinical conditions associated with LOC149703.

LOC149832 (Accession XP_097733.1) is another GAM189 target gene, herein designated TARGET GENE. LOC149832 BINDING SITE is a target binding site found in the 5' untranslated region of mRNA encoded by LOC149832, corresponding to a target binding site such as BINDING SITE I, BINDING SITE II or BINDING SITE III of FIG. 8. Table 4 illustrates the complementarity of the nucleotide sequences of LOC149832 BINDING SITE, designated SEQ ID:17917, to the nucleotide sequence of GAM189 RNA, herein designated GAM RNA, also designated SEQ ID:246.

Another function of GAM189 is therefore inhibition of LOC149832 (Accession XP_097733.1). Accordingly, utilities of GAM189 include diagnosis, prevention and treatment of diseases and clinical conditions associated with LOC149832.

LOC150054 (Accession XP_097797.1) is another GAM189 target gene, herein designated TARGET GENE. LOC150054 BINDING SITE is a target binding site found in the 5' untranslated region of mRNA encoded by LOC150054, corresponding to a target binding site such as BINDING SITE I, BINDING SITE II or BINDING SITE III of FIG. 8. Table 4 illustrates the complementarity of the nucleotide sequences of LOC150054 BINDING SITE, designated SEQ ID:5157, to the nucleotide sequence of GAM189 RNA, herein designated GAM RNA, also designated SEQ ID:246.

Another function of GAM189 is therefore inhibition of LOC150054 (Accession XP_097797.1). Accordingly, utilities of GAM189 include diagnosis, prevention and treatment of diseases and clinical conditions associated with LOC150054.

LOC150225 (Accession XP_097870.1) is another GAM189 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:7207, to the nucleotide sequence of GAM189 RNA, herein designated GAM RNA, also designated SEQ ID:246.

Another function of GAM189 is therefore inhibition of LOC150225 (Accession XP_097870.1). Accordingly, utilities of GAM189 include diagnosis, prevention and treatment of diseases and clinical conditions associated with LOC150225.

LOC150384 (Accession XP_097894.1) is another GAM189 target gene, herein designated TARGET GENE. LOC150384 BINDING SITE is a target binding site found in the 5' untranslated region of mRNA encoded by LOC150384, corresponding to a target binding site such as BINDING SITE I, BINDING SITE II or BINDING SITE III of FIG. 8. Table 4 illustrates the complementarity of the nucleotide sequences of LOC150384 BINDING SITE, designated SEQ ID:7485, to the nucleotide sequence of GAM189 RNA, herein designated GAM RNA, also designated SEQ ID:246.

Another function of GAM189 is therefore inhibition of LOC150384 (Accession XP_097894.1). Accordingly, utilities of GAM189 include diagnosis, prevention and treatment of diseases and clinical conditions associated with LOC150384.

LOC150397 (Accession XP_086907.1) is another GAM189 target gene, herein designated TARGET GENE. LOC150397 BINDING SITE is a target binding site found in the 3' untranslated region of mRNA encoded by LOC150397, corresponding to a target binding site such as BINDING SITE I, BINDING SITE II or BINDING SITE III of FIG. 8. Table 4 illustrates the complementarity of the nucleotide sequences of LOC150397 BINDING SITE, designated SEQ ID:19467, to the nucleotide sequence of GAM189 RNA, herein designated GAM RNA, also designated SEQ ID:246.

Another function of GAM189 is therefore inhibition of LOC150397 (Accession XP_086907.1). Accordingly, utilities of GAM189 include diagnosis, prevention and treatment of diseases and clinical conditions associated with LOC150397.

LOC150587 (Accession XP_097917.1) is another GAM189 target gene, herein designated TARGET GENE. LOC150587 BINDING SITE is a target binding site found in the 5' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:16940, to the nucleotide sequence of GAM189 RNA, herein designated GAM RNA, also designated SEQ ID:246.

Another function of GAM189 is therefore inhibition of LOC150587 (Accession XP_097917.1). Accordingly, utilities of GAM189 include diagnosis, prevention and treatment of diseases and clinical conditions associated with LOC150587.

LOC151057 (Accession XP_097998.1) is another GAM189 target gene, herein designated TARGET GENE. LOC151057 BINDING SITE is a target binding site found in the 3' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:12075, to the nucleotide sequence of GAM189 RNA, herein designated GAM RNA, also designated SEQ ID:246.

Another function of GAM189 is therefore inhibition of LOC151057 (Accession XP_097998.1). Accordingly, utilities of GAM189 include diagnosis, prevention and treatment of diseases and clinical conditions associated with LOC151057.

LOC151196 (Accession XP_098019.1) is another GAM189 target gene, herein designated TARGET GENE. LOC151196 BINDING SITE is a target binding site found in the 3' untranslated region of mRNA encoded by LOC151196, corresponding to a target binding site such as BINDING SITE I, BINDING SITE II or BINDING SITE III of FIG. 8. Table 4 illustrates the complementarity of the nucleotide sequences of LOC151196 BINDING SITE, designated SEQ ID:19774, to the nucleotide sequence of GAM189 RNA, herein designated GAM RNA, also designated SEQ ID:246.

Another function of GAM189 is therefore inhibition of LOC151196 (Accession XP_098019.1). Accordingly, utilities of GAM189 include diagnosis, prevention and treatment of diseases and clinical conditions associated with LOC151196.

LOC151201 (Accession XP_098021.1) is another GAM189 target gene, herein designated TARGET GENE. LOC151201 BINDING SITE1 and LOC151201 BINDING SITE2 are target binding sites found in untranslated regions of mRNA encoded by LOC151201, corresponding to target binding sites such as BINDING SITE I, BINDING SITE II or BINDING SITE III of FIG. 8. Table 4 illustrates the complementarity of the nucleotide sequences of LOC151201 BINDING SITE1 and LOC151201 BINDING SITE2, designated SEQ ID:2572 and SEQ ID:12725 respectively, to the nucleotide sequence of GAM189 RNA, herein designated GAM RNA, also designated SEQ ID:246.

Another function of GAM189 is therefore inhibition of LOC151201 (Accession XP_098021.1). Accordingly, utilities of GAM189 include diagnosis, prevention and treatment of diseases and clinical conditions associated with LOC151201.

LOC151475 (Accession XP_098063.1) is another GAM189 target gene, herein designated TARGET GENE. LOC151475 BINDING SITE1 and LOC151475 BINDING SITE2 are target binding sites found in untranslated regions of mRNA encoded by LOC151475, corresponding to target binding sites such as BINDING SITE I, BINDING SITE II or BINDING SITE III of FIG. 8. Table 4 illustrates the complementarity of the nucleotide sequences of LOC151475 BINDING SITE1 and LOC151475 BINDING SITE2, designated SEQ ID:4174 and SEQ ID:4371 respectively, to the nucleotide sequence of GAM189 RNA, herein designated GAM RNA, also designated SEQ ID:246.

Another function of GAM189 is therefore inhibition of LOC151475 (Accession XP_098063.1). Accordingly, utilities of GAM189 include diagnosis, prevention and treatment of diseases and clinical conditions associated with LOC151475.

LOC151610 (Accession XP_087245.1) is another GAM189 target gene, herein designated TARGET GENE. LOC151610 BINDING SITE is a target binding site found in the 5' untranslated region of mRNA encoded by LOC151610, corresponding to a target binding site such as BINDING SITE I, BINDING SITE II or BINDING SITE III of FIG. 8. Table 4 illustrates the complementarity of the nucleotide sequences of LOC151610 BINDING SITE, designated SEQ ID:2599, to the nucleotide sequence of GAM189 RNA, herein designated GAM RNA, also designated SEQ ID:246.

Another function of GAM189 is therefore inhibition of LOC151610 (Accession XP_087245.1). Accordingly, utilities of GAM189 include diagnosis, prevention and treatment of diseases and clinical conditions associated with LOC151610.

LOC151636 (Accession NP_612144.1) is another GAM189 target gene, herein designated TARGET GENE. LOC151636 BINDING SITE1 through LOC151636 BINDING SITE3 are target binding sites found in untranslated regions of mRNA encoded by LOC151636, corresponding to target binding sites such as BINDING SITE I, BINDING SITE II or BINDING SITE III of FIG. 8. Table 4 illustrates the complementarity of the nucleotide sequences of LOC151636 BINDING SITE1 through LOC151636 BINDING SITE3, designated SEQ ID:4151, SEQ ID:14731 and SEQ ID:2693 respectively, to the nucleotide sequence of GAM189 RNA, herein designated GAM RNA, also designated SEQ ID:246.

Another function of GAM189 is therefore inhibition of LOC151636 (Accession NP_612144.1). Accordingly, utilities of GAM189 include diagnosis, prevention and treatment of diseases and clinical conditions associated with LOC151636.

LOC151657 (Accession XP_098100.2) is another GAM189 target gene, herein designated TARGET GENE. LOC151657 BINDING SITE is a target binding site found in the 5' untranslated region of mRNA encoded by LOC151657, corresponding to a target binding site such as BINDING SITE I, BINDING SITE II or BINDING SITE III of FIG. 8. Table 4 illustrates the complementarity of the nucleotide sequences of LOC151657 BINDING SITE, designated SEQ ID:4248, to the nucleotide sequence of GAM189 RNA, herein designated GAM RNA, also designated SEQ ID:246.

Another function of GAM189 is therefore inhibition of LOC151657 (Accession XP_098100.2). Accordingly, utilities of GAM189 include diagnosis, prevention and treatment of diseases and clinical conditions associated with LOC151657.

LOC151877 (Accession XP_098132.1) is another GAM189 target gene, herein designated TARGET GENE. LOC151877 BINDING SITE is a target binding site found in the 3' untranslated region of mRNA encoded by LOC151877, corresponding to a target binding site such as BINDING SITE I, BINDING SITE II or BINDING SITE III of FIG. 8. Table 4 illustrates the complementarity of the nucleotide sequences of LOC151877 BINDING SITE, designated SEQ ID:4677, to the nucleotide sequence of GAM189 RNA, herein designated GAM RNA, also designated SEQ ID:246.

Another function of GAM189 is therefore inhibition of LOC151877 (Accession XP_098132.1). Accordingly, utilities of GAM189 include diagnosis, prevention and treatment of diseases and clinical conditions associated with LOC151877.

LOC152245 (Accession XP_098182.1) is another GAM189 target gene, herein designated TARGET GENE. LOC152245 BINDING SITE is a target binding site found in the 3' untranslated region of mRNA encoded by LOC152245, corresponding to a target binding site such as BINDING SITE I, BINDING SITE II or BINDING SITE III of FIG. 8. Table 4 illustrates the complementarity of the nucleotide sequences of LOC152245 BINDING SITE, designated SEQ ID:9470, to the nucleotide sequence of GAM189 RNA, herein designated GAM RNA, also designated SEQ ID:246.

Another function of GAM189 is therefore inhibition of LOC152245 (Accession XP_098182.1). Accordingly, utilities of GAM189 include diagnosis, prevention and treatment of diseases and clinical conditions associated with LOC152245.

LOC152445 (Accession XP_098231.1) is another GAM189 target gene, herein designated TARGET GENE. LOC152445 BINDING SITE is a target binding site found in the 3' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:2922, to the nucleotide sequence of GAM189 RNA, herein designated GAM RNA, also designated SEQ ID:246.

Another function of GAM189 is therefore inhibition of LOC152445 (Accession XP_098231.1). Accordingly, utilities of GAM189 include diagnosis, prevention and treatment of diseases and clinical conditions associated with LOC152445.

LOC152620 (Accession XP_011108.2) is another GAM189 target gene, herein designated TARGET GENE. LOC152620 BINDING SITE is a target binding site found in the 3' untranslated region of mRNA encoded by LOC152620, corresponding to a target binding site such as BINDING SITE I, BINDING SITE II or BINDING SITE III of FIG. 8. Table 4 illustrates the complementarity of the nucleotide sequences of LOC152620 BINDING SITE, designated SEQ ID:1745, to the nucleotide sequence of GAM189 RNA, herein designated GAM RNA, also designated SEQ ID:246.

Another function of GAM189 is therefore inhibition of LOC152620 (Accession XP_011108.2). Accordingly, utilities of GAM189 include diagnosis, prevention and treatment of diseases and clinical conditions associated with LOC152620.

LOC152719 (Accession XP_098257.1) is another GAM189 target gene, herein designated TARGET GENE. LOC152719 BINDING SITE1 and LOC152719 BINDING SITE2 are target binding sites found in untranslated regions of mRNA encoded by LOC152719, corresponding to target binding sites such as BINDING SITE I, BINDING SITE II or BINDING SITE III of FIG. 8. Table 4 illustrates the complementarity of the nucleotide sequences of LOC152719 BINDING SITE1 and LOC152719 BINDING SITE2, designated SEQ ID:17637 and SEQ ID:11919 respectively, to the nucleotide sequence of GAM189 RNA, herein designated GAM RNA, also designated SEQ ID:246.

Another function of GAM189 is therefore inhibition of LOC152719 (Accession XP_098257.1). Accordingly, utilities of GAM189 include diagnosis, prevention and treatment of diseases and clinical conditions associated with LOC152719.

LOC152794 (Accession XP_087525.1) is another GAM189 target gene, herein designated TARGET GENE. LOC152794 BINDING SITE is a target binding site found in the 5' untranslated region of mRNA encoded by LOC152794, corresponding to a target binding site such as BINDING SITE I, BINDING SITE II or BINDING SITE III of FIG. 8. Table 4 illustrates the complementarity of the nucleotide sequences of LOC152794 BINDING SITE, designated SEQ ID:2010, to the nucleotide sequence of GAM189 RNA, herein designated GAM RNA, also designated SEQ ID:246.

Another function of GAM189 is therefore inhibition of LOC152794 (Accession XP_087525.1). Accordingly, utilities of GAM189 include diagnosis, prevention and treatment of diseases and clinical conditions associated with LOC152794.

LOC152804 (Accession XP_098266.2) is another GAM189 target gene, herein designated TARGET GENE. LOC152804 BINDING SITE is a target binding site found in the 3' untranslated region of mRNA encoded by LOC152804, corresponding to a target binding site such as BINDING SITE I, BINDING SITE II or BINDING SITE III of FIG. 8. Table 4 illustrates the complementarity of the nucleotide sequences of LOC152804 BINDING SITE, designated SEQ ID:9568, to the nucleotide sequence of GAM189 RNA, herein designated GAM RNA, also designated SEQ ID:246.

Another function of GAM189 is therefore inhibition of LOC152804 (Accession XP_098266.2). Accordingly, utilities of GAM189 include diagnosis, prevention and treatment of diseases and clinical conditions associated with LOC152804.

LOC153077 (Accession XP_098307.1) is another GAM189 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:5304, to the nucleotide sequence of GAM189 RNA, herein designated GAM RNA, also designated SEQ ID:246.

Another function of GAM189 is therefore inhibition of LOC153077 (Accession XP_098307.1). Accordingly, utilities of GAM189 include diagnosis, prevention and treatment of diseases and clinical conditions associated with LOC153077.

LOC153811 (Accession XP_087779.2) is another GAM189 target gene, herein designated TARGET GENE. LOC153811 BINDING SITE1 through LOC153811 BINDING SITE3 are target binding sites found in untranslated regions of mRNA encoded by LOC153811, corresponding to target binding sites such as BINDING SITE I, BINDING SITE II or BINDING SITE III of FIG. 8. Table 4 illustrates the complementarity of the nucleotide sequences of LOC153811 BINDING SITE1 through LOC153811 BINDING SITE3, designated SEQ ID:9683, SEQ ID:17512 and SEQ ID:19665 respectively, to the nucleotide sequence of GAM189 RNA, herein designated GAM RNA, also designated SEQ ID:246.

Another function of GAM189 is therefore inhibition of LOC153811 (Accession XP_087779.2). Accordingly, utilities of GAM189 include diagnosis, prevention and treatment of diseases and clinical conditions associated with LOC153811.

LOC153883 (Accession XP_087798.1) is another GAM189 target gene, herein designated TARGET GENE. LOC153883 BINDING SITE is a target binding site found in the 5' untranslated region of mRNA encoded by LOC153883, corresponding to a target binding site such as BINDING SITE I, BINDING SITE II or BINDING SITE III of FIG. 8. Table 4 illustrates the complementarity of the nucleotide sequences of LOC153883 BINDING SITE, designated SEQ ID:15929, to the nucleotide sequence of GAM189 RNA, herein designated GAM RNA, also designated SEQ ID:246.

Another function of GAM189 is therefore inhibition of LOC153883 (Accession XP_087798.1). Accordingly, utilities of GAM189 include diagnosis, prevention and treatment of diseases and clinical conditions associated with LOC153883.

LOC153910 (Accession XP_087801.1) is another GAM189 target gene, herein designated TARGET GENE. LOC153910 BINDING SITE is a target binding site found in the 5' untranslated region of mRNA encoded by LOC153910, corresponding to a target binding site such as BINDING SITE I, BINDING SITE II or BINDING SITE III of FIG. 8. Table 4 illustrates the complementarity of the nucleotide sequences of LOC153910 BINDING SITE, designated SEQ ID:2882, to the nucleotide sequence of GAM189 RNA, herein designated GAM RNA, also designated SEQ ID:246.

Another function of GAM189 is therefore inhibition of LOC153910 (Accession XP_087801.1). Accordingly, utilities of GAM189 include diagnosis, prevention and treatment of diseases and clinical conditions associated with LOC153910.

LOC154282 (Accession XP_098505.1) is another GAM189 target gene, herein designated TARGET GENE. LOC154282 BINDING SITE is a target binding site found in the 5' untranslated region of mRNA encoded by LOC154282, corresponding to a target binding site such as BINDING SITE I, BINDING SITE II or BINDING SITE III of FIG. 8. Table 4 illustrates the complementarity of the nucleotide sequences of LOC154282 BINDING SITE, designated SEQ ID:4307, to the nucleotide sequence of GAM189 RNA, herein designated GAM RNA, also designated SEQ ID:246.

Another function of GAM189 is therefore inhibition of LOC154282 (Accession XP_098505.1). Accordingly, utilities of GAM189 include diagnosis, prevention and treatment of diseases and clinical conditions associated with LOC154282.

LOC154822 (Accession XP_098618.3) is another GAM189 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:19205, to the nucleotide sequence of GAM189 RNA, herein designated GAM RNA, also designated SEQ ID:246.

Another function of GAM189 is therefore inhibition of LOC154822 (Accession XP_098618.3). Accordingly, utilities of GAM189 include diagnosis, prevention and treatment of diseases and clinical conditions associated with LOC154822.

LOC154877 (Accession XP_098626.1) is another GAM189 target gene, herein designated TARGET GENE. LOC154877 BINDING SITE1 through LOC154877 BINDING SITE3 are target binding sites found in untranslated regions of mRNA encoded by LOC154877, corresponding to target binding sites such as BINDING SITE I, BINDING SITE II or BINDING SITE III of FIG. 8. Table 4 illustrates the complementarity of the nucleotide sequences of LOC154877 BINDING SITE1 through LOC154877 BINDING SITE3, designated SEQ ID:17731, SEQ ID:3200 and SEQ ID:16089 respectively, to the nucleotide sequence of GAM189 RNA, herein designated GAM RNA, also designated SEQ ID:246.

Another function of GAM189 is therefore inhibition of LOC154877 (Accession XP_098626.1). Accordingly, utilities of GAM189 include diagnosis, prevention and treatment of diseases and clinical conditions associated with LOC154877.

LOC155066 (Accession XP_088142.4) is another GAM189 target gene, herein designated TARGET GENE. LOC155066 BINDING SITE is a target binding site found in the 3' untranslated region of mRNA encoded by LOC155066, corresponding to a target binding site such as BINDING SITE I, BINDING SITE II or BINDING SITE III of FIG. 8. Table 4 illustrates the complementarity of the nucleotide sequences of LOC155066 BINDING SITE, designated SEQ ID:17980, to the nucleotide sequence of GAM189 RNA, herein designated GAM RNA, also designated SEQ ID:246.

Another function of GAM189 is therefore inhibition of LOC155066 (Accession XP_088142.4). Accordingly, utilities of GAM189 include diagnosis, prevention and treatment of diseases and clinical conditions associated with LOC155066.

LOC158014 (Accession XP_088442.1) is another GAM189 target gene, herein designated TARGET GENE. LOC158014 BINDING SITE is a target binding site found in the 5' untranslated region of mRNA encoded by LOC158014, corresponding to a target binding site such as BINDING SITE I, BINDING SITE II or BINDING SITE III of FIG. 8. Table 4 illustrates the complementarity of the nucleotide sequences of LOC158014 BINDING SITE, designated SEQ ID:2542, to the nucleotide sequence of GAM189 RNA, herein designated GAM RNA, also designated SEQ ID:246.

Another function of GAM189 is therefore inhibition of LOC158014 (Accession XP_088442.1). Accordingly, utilities of GAM189 include diagnosis, prevention and treatment of diseases and clinical conditions associated with LOC158014.

LOC158228 (Accession XP_098903.4) is another GAM189 target gene, herein designated TARGET GENE. LOC158228 BINDING SITE is a target binding site found in the 3' untranslated region of mRNA encoded by LOC158228, corresponding to a target binding site such as BINDING SITE I, BINDING SITE II or BINDING SITE III of FIG. 8. Table 4 illustrates the complementarity of the nucleotide sequences of LOC158228 BINDING SITE, designated SEQ ID:5779, to the nucleotide sequence of GAM189 RNA, herein designated GAM RNA, also designated SEQ ID:246.

Another function of GAM189 is therefore inhibition of LOC158228 (Accession XP_098903.4). Accordingly, utilities of GAM189 include diagnosis, prevention and treatment of diseases and clinical conditions associated with LOC158228.

LOC158310 (Accession XP_098919.1) is another GAM189 target gene, herein designated TARGET GENE. LOC158310 BINDING SITE is a target binding site found in the 5' untranslated region of mRNA encoded by LOC158310, corresponding to a target binding site such as BINDING SITE I, BINDING SITE II or BINDING SITE III of FIG. 8. Table 4 illustrates the complementarity of the nucleotide sequences of LOC158310 BINDING SITE, designated SEQ ID:14859, to the nucleotide sequence of GAM189 RNA, herein designated GAM RNA, also designated SEQ ID:246.

Another function of GAM189 is therefore inhibition of LOC158310 (Accession XP_098919.1). Accordingly, utilities of GAM189 include diagnosis, prevention and treatment of diseases and clinical conditions associated with LOC158310.

LOC158381 (Accession XP_048461.1) is another GAM189 target gene, herein designated TARGET GENE. LOC158381 BINDING SITE is a target binding site found in the 5' untranslated region of mRNA encoded by LOC158381, corresponding to a target binding site such as BINDING SITE I, BINDING SITE II or BINDING SITE III of FIG. 8. Table 4 illustrates the complementarity of the nucleotide sequences of LOC158381 BINDING SITE, designated SEQ ID:6212, to the nucleotide sequence of GAM189 RNA, herein designated GAM RNA, also designated SEQ ID:246.

Another function of GAM189 is therefore inhibition of LOC158381 (Accession XP_048461.1). Accordingly, utilities of GAM189 include diagnosis, prevention and treatment of diseases and clinical conditions associated with LOC158381.

LOC158402 (Accession XP_098936.1) is another GAM189 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:17964, to the nucleotide sequence of GAM189 RNA, herein designated GAM RNA, also designated SEQ ID:246.

Another function of GAM189 is therefore inhibition of LOC158402 (Accession XP_098936.1). Accordingly, utilities of GAM189 include diagnosis, prevention and treatment of diseases and clinical conditions associated with LOC158402.

LOC158436 (Accession XP_098942.1) is another GAM189 target gene, herein designated TARGET GENE. LOC158436 BINDING SITE is a target binding site found in the 3' untranslated region of mRNA encoded by LOC158436, corresponding to a target binding site such as BINDING SITE I, BINDING SITE II or BINDING SITE III of FIG. 8. Table 4 illustrates the complementarity of the nucleotide sequences of LOC158436 BINDING SITE, designated SEQ ID:1263, to the nucleotide sequence of GAM189 RNA, herein designated GAM RNA, also designated SEQ ID:246.

Another function of GAM189 is therefore inhibition of LOC158436 (Accession XP_098942.1). Accordingly, utilities of GAM189 include diagnosis, prevention and treatment of diseases and clinical conditions associated with LOC158436.

LOC158476 (Accession XP_098955.1) is another GAM189 target gene, herein designated TARGET GENE. LOC158476 BINDING SITE is a target binding site found in the 3' untranslated region of mRNA encoded by LOC158476, corresponding to a target binding site such as BINDING SITE I, BINDING SITE II or BINDING SITE III of FIG. 8. Table 4 illustrates the complementarity of the nucleotide sequences of LOC158476 BINDING SITE, designated SEQ ID:935, to the nucleotide sequence of GAM189 RNA, herein designated GAM RNA, also designated SEQ ID:246.

Another function of GAM189 is therefore inhibition of LOC158476 (Accession XP_098955.1). Accordingly, utilities of GAM189 include diagnosis, prevention and treatment of diseases and clinical conditions associated with LOC158476.

LOC158572 (Accession XP_088608.1) is another GAM189 target gene, herein designated TARGET GENE. LOC158572 BINDING SITE is a target binding site found in the 3' untranslated region of mRNA encoded by LOC158572, corresponding to a target binding site such as BINDING SITE I, BINDING SITE II or BINDING SITE III of FIG. 8. Table 4 illustrates the complementarity of the nucleotide sequences of LOC158572 BINDING SITE, designated SEQ ID:12003, to the nucleotide sequence of GAM189 RNA, herein designated GAM RNA, also designated SEQ ID:246.

Another function of GAM189 is therefore inhibition of LOC158572 (Accession XP_088608.1). Accordingly, utilities of GAM189 include diagnosis, prevention and treatment of diseases and clinical conditions associated with LOC158572.

LOC158668 (Accession XP_045161.1) is another GAM189 target gene, herein designated TARGET GENE. LOC158668 BINDING SITE is a target binding site found in the 3' untranslated region of mRNA encoded by LOC158668, corresponding to a target binding site such as BINDING SITE I, BINDING SITE II or BINDING SITE III of FIG. 8. Table 4 illustrates the complementarity of the nucleotide sequences of LOC158668 BINDING SITE, designated SEQ ID:16260, to the nucleotide sequence of GAM189 RNA, herein designated GAM RNA, also designated SEQ ID:246.

Another function of GAM189 is therefore inhibition of LOC158668 (Accession XP_045161.1). Accordingly, utilities of GAM189 include diagnosis, prevention and treatment of diseases and clinical conditions associated with LOC158668.

LOC160897 (Accession XP_090573.3) is another GAM189 target gene, herein designated TARGET GENE. LOC160897 BINDING SITE is a target binding site found in the 5' untranslated region of mRNA encoded by LOC160897, corresponding to a target binding site such as BINDING SITE I, BINDING SITE II or BINDING SITE III of FIG. 8. Table 4 illustrates the complementarity of the nucleotide sequences of LOC160897 BINDING SITE, designated SEQ ID:17208, to the nucleotide sequence of GAM189 RNA, herein designated GAM RNA, also designated SEQ ID:246.

Another function of GAM189 is therefore inhibition of LOC160897 (Accession XP_090573.3). Accordingly, utilities of GAM189 include diagnosis, prevention and treatment of diseases and clinical conditions associated with LOC160897.

LOC162427 (Accession XP_091549.3) is another GAM189 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:12068 and SEQ ID:12068 respectively, to the nucleotide sequence of GAM189 RNA, herein designated GAM RNA, also designated SEQ ID:246.

Another function of GAM189 is therefore inhibition of LOC162427 (Accession XP_091549.3). Accordingly, utilities of GAM189 include diagnosis, prevention and treatment of diseases and clinical conditions associated with LOC162427.

LOC162427 (Accession XP_091549.3) is another GAM189 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:8231 and SEQ ID:8231 respectively, to the nucleotide sequence of GAM189 RNA, herein designated GAM RNA, also designated SEQ ID:246.

Another function of GAM189 is therefore inhibition of LOC162427 (Accession XP_091549.3). Accordingly, utilities of GAM189 include diagnosis, prevention and treatment of diseases and clinical conditions associated with LOC162427.

LOC162962 (Accession XP_091886.7) is another GAM189 target gene, herein designated TARGET GENE. LOC162962 BINDING SITE is a target binding site found in the 3' untranslated region of mRNA encoded by LOC162962, corresponding to a target binding site such as BINDING SITE I, BINDING SITE II or BINDING SITE III of FIG. 8. Table 4 illustrates the complementarity of the nucleotide sequences of LOC162962 BINDING SITE, designated SEQ ID:3249, to the nucleotide sequence of GAM189 RNA, herein designated GAM RNA, also designated SEQ ID:246.

Another function of GAM189 is therefore inhibition of LOC162962 (Accession XP_091886.7). Accordingly, utilities of GAM189 include diagnosis, prevention and treatment of diseases and clinical conditions associated with LOC162962.

LOC162967 (Accession XP_091890.6) is another GAM189 target gene, herein designated TARGET GENE. LOC162967 BINDING SITE is a target binding site found in the 3' untranslated region of mRNA encoded by LOC162967, corresponding to a target binding site such as BINDING SITE I, BINDING SITE II or BINDING SITE III of FIG. 8. Table 4 illustrates the complementarity of the nucleotide sequences of LOC162967 BINDING SITE, designated SEQ ID:13831, to the nucleotide sequence of GAM189 RNA, herein designated GAM RNA, also designated SEQ ID:246.

Another function of GAM189 is therefore inhibition of LOC162967 (Accession XP_091890.6). Accordingly, utilities of GAM189 include diagnosis, prevention and treatment of diseases and clinical conditions associated with LOC162967.

LOC163227 (Accession NP_775802.1) is another GAM189 target gene, herein designated TARGET GENE. LOC163227 BINDING SITE1 and LOC163227 BINDING SITE2 are target binding sites found in untranslated regions of mRNA encoded by LOC163227, corresponding to target binding sites such as BINDING SITE I, BINDING SITE II or BINDING SITE III of FIG. 8. Table 4 illustrates the complementarity of the nucleotide sequences of LOC163227 BINDING SITE1 and LOC163227 BINDING SITE2, designated SEQ ID:9147 and SEQ ID:11854 respectively, to the nucleotide sequence of GAM189 RNA, herein designated GAM RNA, also designated SEQ ID:246.

Another function of GAM189 is therefore inhibition of LOC163227 (Accession NP_775802.1). Accordingly, utilities of GAM189 include diagnosis, prevention and treatment of diseases and clinical conditions associated with LOC163227.

LOC164091 (Accession XP_089356.1) is another GAM189 target gene, herein designated TARGET GENE. LOC164091 BINDING SITE is a target binding site found in the 3' untranslated region of mRNA encoded by LOC164091, corresponding to a target binding site such as BINDING SITE I, BINDING SITE II or BINDING SITE III of FIG. 8. Table 4 illustrates the complementarity of the nucleotide sequences of LOC164091 BINDING SITE, designated SEQ ID:7989, to the nucleotide sequence of GAM189 RNA, herein designated GAM RNA, also designated SEQ ID:246.

Another function of GAM189 is therefore inhibition of LOC164091 (Accession XP_089356.1). Accordingly, utilities of GAM189 include diagnosis, prevention and treatment of diseases and clinical conditions associated with LOC164091.

LOC168451 (Accession XP_095114.2) is another GAM189 target gene, herein designated TARGET GENE. LOC168451 BINDING SITE is a target binding site found in the 3' untranslated region of mRNA encoded by LOC168451, corresponding to a target binding site such as BINDING SITE I, BINDING SITE II or BINDING SITE III of FIG. 8. Table 4 illustrates the complementarity of the nucleotide sequences of LOC168451 BINDING SITE, designated SEQ ID:19786, to the nucleotide sequence of GAM189 RNA, herein designated GAM RNA, also designated SEQ ID:246.

Another function of GAM189 is therefore inhibition of LOC168451 (Accession XP_095114.2). Accordingly, utilities of GAM189 include diagnosis, prevention and treatment of diseases and clinical conditions associated with LOC168451.

LOC170409 (Accession XP_096330.1) is another GAM189 target gene, herein designated TARGET GENE. LOC170409 BINDING SITE is a target binding site found in the 5' untranslated region of mRNA encoded by LOC170409, corresponding to a target binding site such as BINDING SITE I, BINDING SITE II or BINDING SITE III of FIG. 8. Table 4 illustrates the complementarity of the nucleotide sequences of LOC170409 BINDING SITE, designated SEQ ID:15561, to the nucleotide sequence of GAM189 RNA, herein designated GAM RNA, also designated SEQ ID:246.

Another function of GAM189 is therefore inhibition of LOC170409 (Accession XP_096330.1). Accordingly, utilities of GAM189 include diagnosis, prevention and treatment of diseases and clinical conditions associated with LOC170409.

LOC196264 (Accession XP_113683.1) is another GAM189 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:2452, to the nucleotide sequence of GAM189 RNA, herein designated GAM RNA, also designated SEQ ID:246.

Another function of GAM189 is therefore inhibition of LOC196264 (Accession XP_113683.1). Accordingly, utilities of GAM189 include diagnosis, prevention and treatment of diseases and clinical conditions associated with LOC196264.

LOC197342 (Accession XP_113869.1) is another GAM189 target gene, herein designated TARGET GENE. LOC197342 BINDING SITE is a target binding site found in the 3' untranslated region of mRNA encoded by LOC197342, corresponding to a target binding site such as BINDING SITE I, BINDING SITE II or BINDING SITE III of FIG. 8. Table 4 illustrates the complementarity of the nucleotide sequences of LOC197342 BINDING SITE, designated SEQ ID:2432, to the nucleotide sequence of GAM189 RNA, herein designated GAM RNA, also designated SEQ ID:246.

Another function of GAM189 is therefore inhibition of LOC197342 (Accession XP_113869.1). Accordingly, utilities of GAM189 include diagnosis, prevention and treatment of diseases and clinical conditions associated with LOC197342.

LOC197358 (Accession XP_113872.2) is another GAM189 target gene, herein designated TARGET GENE. LOC197358 BINDING SITE1 and LOC197358 BINDING SITE2 are target binding sites found in untranslated regions of mRNA encoded by LOC197358, corresponding to target binding sites such as BINDING SITE I, BINDING SITE II or BINDING SITE III of FIG. 8. Table 4 illustrates the complementarity of the nucleotide sequences of LOC197358 BINDING SITE1 and LOC197358 BINDING SITE2, designated SEQ ID:6387 and SEQ ID:4625 respectively, to the nucleotide sequence of GAM189 RNA, herein designated GAM RNA, also designated SEQ ID:246.

Another function of GAM189 is therefore inhibition of LOC197358 (Accession XP_113872.2). Accordingly, utilities of GAM189 include diagnosis, prevention and treatment of diseases and clinical conditions associated with LOC197358.

LOC199725 (Accession XP_117119.1) is another GAM189 target gene, herein designated TARGET GENE. LOC199725 BINDING SITE is a target binding site found in the 5' untranslated region of mRNA encoded by LOC199725, corresponding to a target binding site such as BINDING SITE I, BINDING SITE II or BINDING SITE III of FIG. 8. Table 4 illustrates the complementarity of the nucleotide sequences of LOC199725 BINDING SITE, designated SEQ ID:10884, to the nucleotide sequence of GAM189 RNA, herein designated GAM RNA, also designated SEQ ID:246.

Another function of GAM189 is therefore inhibition of LOC199725 (Accession XP_117119.1). Accordingly, utilities of GAM189 include diagnosis, prevention and treatment of diseases and clinical conditions associated with LOC199725.

LOC199899 (Accession XP_117153.1) is another GAM189 target gene, herein designated TARGET GENE. LOC199899 BINDING SITE1 and LOC199899 BINDING SITE2 are target binding sites found in untranslated regions of mRNA encoded by LOC199899, corresponding to target binding sites such as BINDING SITE I, BINDING SITE II or BINDING SITE III of FIG. 8. Table 4 illustrates the complementarity of the nucleotide sequences of LOC199899 BINDING SITE1 and LOC199899 BINDING SITE2, designated SEQ ID:8292 and SEQ ID:5253 respectively, to the nucleotide sequence of GAM189 RNA, herein designated GAM RNA, also designated SEQ ID:246.

Another function of GAM189 is therefore inhibition of LOC199899 (Accession XP_117153.1). Accordingly, utilities of GAM189 include diagnosis, prevention and treatment of diseases and clinical conditions associated with LOC199899.

LOC199906 (Accession XP_114052.1) is another GAM189 target gene, herein designated TARGET GENE. LOC199906 BINDING SITE is a target binding site found in the 3' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:19756, to the nucleotide sequence of GAM189 RNA, herein designated GAM RNA, also designated SEQ ID:246.

Another function of GAM189 is therefore inhibition of LOC199906 (Accession XP_114052.1). Accordingly, utilities of GAM189 include diagnosis, prevention and treatment of diseases and clinical conditions associated with LOC199906.

LOC200169 (Accession XP_117200.1) is another GAM189 target gene, herein designated TARGET GENE. LOC200169 BINDING SITE1 and LOC200169 BINDING SITE2 are target binding sites found in untranslated regions of multiple transcripts of mRNA encoded by LOC200169, corresponding to target binding sites such as BINDING SITE I, BINDING SITE II or BINDING SITE III of FIG. 8. Table 4 illustrates the complementarity of the nucleotide sequences of LOC200169 BINDING SITE1 and LOC200169 BINDING SITE2, designated SEQ ID:6122 and SEQ ID:5066 respectively, to the nucleotide sequence of GAM189 RNA, herein designated GAM RNA, also designated SEQ ID:246.

Another function of GAM189 is therefore inhibition of LOC200169 (Accession XP_117200.1). Accordingly, utilities of GAM189 include diagnosis, prevention and treatment of diseases and clinical conditions associated with LOC200169.

LOC200844 (Accession XP_114306.1) is another GAM189 target gene, herein designated TARGET GENE. LOC200844 BINDING SITE is a target binding site found in the 5' untranslated region of mRNA encoded by LOC200844, corresponding to a target binding site such as BINDING SITE I, BINDING SITE II or BINDING SITE III of FIG. 8. Table 4 illustrates the complementarity of the nucleotide sequences of LOC200844 BINDING SITE, designated SEQ ID:16540, to the nucleotide sequence of GAM189 RNA, herein designated GAM RNA, also designated SEQ ID:246.

Another function of GAM189 is therefore inhibition of LOC200844 (Accession XP_114306.1). Accordingly, utilities of GAM189 include diagnosis, prevention and treatment of diseases and clinical conditions associated with LOC200844.

LOC200860 (Accession XP_117289.1) is another GAM189 target gene, herein designated TARGET GENE. LOC200860 BINDING SITE1 and LOC200860 BINDING SITE2 are target binding sites found in untranslated regions of mRNA encoded by LOC200860, corresponding to target binding sites such as BINDING SITE I, BINDING SITE II or BINDING SITE III of FIG. 8. Table 4 illustrates the complementarity of the nucleotide sequences of LOC200860 BINDING SITE1 and LOC200860 BINDING SITE2, designated SEQ ID:12075 and SEQ ID:4175 respectively, to the nucleotide sequence of GAM189 RNA, herein designated GAM RNA, also designated SEQ ID:246.

Another function of GAM189 is therefore inhibition of LOC200860 (Accession XP_117289.1). Accordingly, utilities of GAM189 include diagnosis, prevention and treatment of diseases and clinical conditions associated with LOC200860.

LOC200895 (Accession NP_789785.1) is another GAM189 target gene, herein designated TARGET GENE. LOC200895 BINDING SITE1 and LOC200895 BINDING SITE2 are target binding sites found in untranslated regions of mRNA encoded by LOC200895, corresponding to target binding sites such as BINDING SITE I, BINDING SITE II or BINDING SITE III of FIG. 8. Table 4 illustrates the complementarity of the nucleotide sequences of LOC200895 BINDING SITE1 and LOC200895 BINDING SITE2, designated SEQ ID:17681 and SEQ ID:11863 respectively, to the nucleotide sequence of GAM189 RNA, herein designated GAM RNA, also designated SEQ ID:246.

Another function of GAM189 is therefore inhibition of LOC200895 (Accession NP_789785.1). Accordingly, utilities of GAM189 include diagnosis, prevention and treatment of diseases and clinical conditions associated with LOC200895.

LOC200916 (Accession XP_114317.3) is another GAM189 target gene, herein designated TARGET GENE. LOC200916 BINDING SITE is a target binding site found in the 3' untranslated region of mRNA encoded by LOC200916, corresponding to a target binding site such as BINDING SITE I, BINDING SITE II or BINDING SITE III of FIG. 8. Table 4 illustrates the complementarity of the nucleotide sequences of LOC200916 BINDING SITE, designated SEQ ID:3465, to the nucleotide sequence of GAM189 RNA, herein designated GAM RNA, also designated SEQ ID:246.

Another function of GAM189 is therefore inhibition of LOC200916 (Accession XP_114317.3). Accordingly, utilities of GAM189 include diagnosis, prevention and treatment of diseases and clinical conditions associated with LOC200916.

LOC201164 (Accession NP_849158.1) is another GAM189 target gene, herein designated TARGET GENE. LOC201164 BINDING SITE1 and LOC201164 BINDING SITE2 are target binding sites found in untranslated regions of multiple transcripts of mRNA encoded by LOC201164, corresponding to target binding sites such as BINDING SITE I, BINDING SITE II or BINDING SITE III of FIG. 8. Table 4 illustrates the complementarity of the nucleotide sequences of LOC201164 BINDING SITE1 and LOC201164 BINDING SITE2, designated SEQ ID:16993 and SEQ ID:13384 respectively, to the nucleotide sequence of GAM189 RNA, herein designated GAM RNA, also designated SEQ ID:246.

Another function of GAM189 is therefore inhibition of LOC201164 (Accession NP_849158.1). Accordingly, utilities of GAM189 include diagnosis, prevention and treatment of diseases and clinical conditions associated with LOC201164.

LOC201292 (Accession NP_775818.1) is another GAM189 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:4556, to the nucleotide sequence of GAM189 RNA, herein designated GAM RNA, also designated SEQ ID:246.

Another function of GAM189 is therefore inhibition of LOC201292 (Accession NP_775818.1). Accordingly, utilities of GAM189 include diagnosis, prevention and treatment of diseases and clinical conditions associated with LOC201292.

LOC201562 (Accession XP_114343.2) is another GAM189 target gene, herein designated TARGET GENE. LOC201562 BINDING SITE is a target binding site found in the 3' untranslated region of mRNA encoded by LOC201562, corresponding to a target binding site such as BINDING SITE I, BINDING SITE II or BINDING SITE III of FIG. 8. Table 4 illustrates the complementarity of the nucleotide sequences of LOC201562 BINDING SITE, designated SEQ ID:15044, to the nucleotide sequence of GAM189 RNA, herein designated GAM RNA, also designated SEQ ID:246.

Another function of GAM189 is therefore inhibition of LOC201562 (Accession XP_114343.2). Accordingly, utilities of GAM189 include diagnosis, prevention and treatment of diseases and clinical conditions associated with LOC201562.

LOC201725 (Accession XP_114370.1) is another GAM189 target gene, herein designated TARGET GENE. LOC201725 BINDING SITE is a target binding site found in the 3' untranslated region of mRNA encoded by LOC201725, corresponding to a target binding site such as BINDING SITE I, BINDING SITE II or BINDING SITE III of FIG. 8. Table 4 illustrates the complementarity of the nucleotide sequences of LOC201725 BINDING SITE, designated SEQ ID:5492, to the nucleotide sequence of GAM189 RNA, herein designated GAM RNA, also designated SEQ ID:246.

Another function of GAM189 is therefore inhibition of LOC201725 (Accession XP_114370.1). Accordingly, utilities of GAM189 include diagnosis, prevention and treatment of diseases and clinical conditions associated with LOC201725.

LOC202400 (Accession XP_117397.1) is another GAM189 target gene, herein designated TARGET GENE. LOC202400 BINDING SITE is a target binding site found in the 5' untranslated region of mRNA encoded by LOC202400, corresponding to a target binding site such as BINDING SITE I, BINDING SITE II or BINDING SITE III of FIG. 8. Table 4 illustrates the complementarity of the nucleotide sequences of LOC202400 BINDING SITE, designated SEQ ID:9145, to the nucleotide sequence of GAM189 RNA, herein designated GAM RNA, also designated SEQ ID:246.

Another function of GAM189 is therefore inhibition of LOC202400 (Accession XP_117397.1). Accordingly, utilities of GAM189 include diagnosis, prevention and treatment of diseases and clinical conditions associated with LOC202400.

LOC202404 (Accession XP_114481.4) is another GAM189 target gene, herein designated TARGET GENE. LOC202404 BINDING SITE is a target binding site found in the 3' untranslated region of mRNA encoded by LOC202404, corresponding to a target binding site such as BINDING SITE I, BINDING SITE II or BINDING SITE III of FIG. 8. Table 4 illustrates the complementarity of the nucleotide sequences of LOC202404 BINDING SITE, designated SEQ ID:18628, to the nucleotide sequence of GAM189 RNA, herein designated GAM RNA, also designated SEQ ID:246.

Another function of GAM189 is therefore inhibition of LOC202404 (Accession XP_114481.4). Accordingly, utilities of GAM189 include diagnosis, prevention and treatment of diseases and clinical conditions associated with LOC202404.

LOC202460 (Accession XP_114493.1) is another GAM189 target gene, herein designated TARGET GENE. LOC202460 BINDING SITE is a target binding site found in the 5' untranslated region of mRNA encoded by LOC202460, corresponding to a target binding site such as BINDING SITE I, BINDING SITE II or BINDING SITE III of FIG. 8. Table 4 illustrates the complementarity of the nucleotide sequences of LOC202460 BINDING SITE, designated SEQ ID:16450, to the nucleotide sequence of GAM189 RNA, herein designated GAM RNA, also designated SEQ ID:246.

Another function of GAM189 is therefore inhibition of LOC202460 (Accession XP_114493.1). Accordingly, utilities of GAM189 include diagnosis, prevention and treatment of diseases and clinical conditions associated with LOC202460.

LOC202934 (Accession XP_117486.2) is another GAM189 target gene, herein designated TARGET GENE. LOC202934 BINDING SITE1 and LOC202934 BINDING SITE2 are target binding sites found in untranslated regions of mRNA encoded by LOC202934, corresponding to target binding sites such as BINDING SITE I, BINDING SITE II or BINDING SITE III of FIG. 8. Table 4 illustrates the complementarity of the nucleotide sequences of LOC202934 BINDING SITE1 and LOC202934 BINDING SITE2, designated SEQ ID:4820 and SEQ ID:1729 respectively, to the nucleotide sequence of GAM189 RNA, herein designated GAM RNA, also designated SEQ ID:246.

Another function of GAM189 is therefore inhibition of LOC202934 (Accession XP_117486.2). Accordingly, utilities of GAM189 include diagnosis, prevention and treatment of diseases and clinical conditions associated with LOC202934.

LOC203547 (Accession XP_114719.1) is another GAM189 target gene, herein designated TARGET GENE. LOC203547 BINDING SITE1 and LOC203547 BINDING SITE2 are target binding sites found in untranslated regions of mRNA encoded by LOC203547, corresponding to target binding sites such as BINDING SITE I, BINDING SITE II or BINDING SITE III of FIG. 8. Table 4 illustrates the complementarity of the nucleotide sequences of LOC203547 BINDING SITE1 and LOC203547 BINDING SITE2, designated SEQ ID:9545 and SEQ ID:2351 respectively, to the nucleotide sequence of GAM189 RNA, herein designated GAM RNA, also designated SEQ ID:246.

Another function of GAM189 is therefore inhibition of LOC203547 (Accession XP_114719.1). Accordingly, utilities of GAM189 include diagnosis, prevention and treatment of diseases and clinical conditions associated with LOC203547.

LOC204288 (Accession XP_115295.1) is another GAM189 target gene, herein designated TARGET GENE. LOC204288 BINDING SITE is a target binding site found in the 3' untranslated region of mRNA encoded by LOC204288, corresponding to a target binding site such as BINDING SITE I, BINDING SITE II or BINDING SITE III of FIG. 8. Table 4 illustrates the complementarity of the nucleotide sequences of LOC204288 BINDING SITE, designated SEQ ID:10724, to the nucleotide sequence of GAM189 RNA, herein designated GAM RNA, also designated SEQ ID:246.

Another function of GAM189 is therefore inhibition of LOC204288 (Accession XP_115295.1). Accordingly, utilities of GAM189 include diagnosis, prevention and treatment of diseases and clinical conditions associated with LOC204288.

LOC219293 (Accession XP_166599.2) is another GAM189 target gene, herein designated TARGET GENE. LOC219293 BINDING SITE is a target binding site found in the 3' untranslated region of mRNA encoded by LOC219293, corresponding to a target binding site such as BINDING SITE I, BINDING SITE II or BINDING SITE III of FIG. 8. Table 4 illustrates the complementarity of the nucleotide sequences of LOC219293 BINDING SITE, designated SEQ ID:19361, to the nucleotide sequence of GAM189 RNA, herein designated GAM RNA, also designated SEQ ID:246.

Another function of GAM189 is therefore inhibition of LOC219293 (Accession XP_166599.2). Accordingly, utilities of GAM189 include diagnosis, prevention and treatment of diseases and clinical conditions associated with LOC219293.

LOC219700 (Accession XP_167570.1) is another GAM189 target gene, herein designated TARGET GENE. LOC219700 BINDING SITE is a target binding site found in the 5' untranslated region of mRNA encoded by LOC219700, corresponding to a target binding site such as BINDING SITE I, BINDING SITE II or BINDING SITE III of FIG. 8. Table 4 illustrates the complementarity of the nucleotide sequences of LOC219700 BINDING SITE, designated SEQ ID:2410, to the nucleotide sequence of GAM189 RNA, herein designated GAM RNA, also designated SEQ ID:246.

Another function of GAM189 is therefore inhibition of LOC219700 (Accession XP_167570.1). Accordingly, utilities of GAM189 include diagnosis, prevention and treatment of diseases and clinical conditions associated with LOC219700.

LOC219731 (Accession XP_167596.1) is another GAM189 target gene, herein designated TARGET GENE.

LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:4678, to the nucleotide sequence of GAM189 RNA, herein designated GAM RNA, also designated SEQ ID:246.

Another function of GAM189 is therefore inhibition of LOC219731 (Accession XP_167596.1). Accordingly, utilities of GAM189 include diagnosis, prevention and treatment of diseases and clinical conditions associated with LOC219731.

LOC219735 (Accession XP_167601.1) is another GAM189 target gene, herein designated TARGET GENE. LOC219735 BINDING SITE is a target binding site found in the 3' untranslated region of mRNA encoded by LOC219735, corresponding to a target binding site such as BINDING SITE I, BINDING SITE II or BINDING SITE III of FIG. 8. Table 4 illustrates the complementarity of the nucleotide sequences of LOC219735 BINDING SITE, designated SEQ ID:18913, to the nucleotide sequence of GAM189 RNA, herein designated GAM RNA, also designated SEQ ID:246.

Another function of GAM189 is therefore inhibition of LOC219735 (Accession XP_167601.1). Accordingly, utilities of GAM189 include diagnosis, prevention and treatment of diseases and clinical conditions associated with LOC219735.

LOC219894 (Accession XP_167782.1) is another GAM189 target gene, herein designated TARGET GENE. LOC219894 BINDING SITE is a target binding site found in the 3' untranslated region of mRNA encoded by LOC219894, corresponding to a target binding site such as BINDING SITE I, BINDING SITE II or BINDING SITE III of FIG. 8. Table 4 illustrates the complementarity of the nucleotide sequences of LOC219894 BINDING SITE, designated SEQ ID:14588, to the nucleotide sequence of GAM189 RNA, herein designated GAM RNA, also designated SEQ ID:246.

Another function of GAM189 is therefore inhibition of LOC219894 (Accession XP_167782.1). Accordingly, utilities of GAM189 include diagnosis, prevention and treatment of diseases and clinical conditions associated with LOC219894.

LOC220074 (Accession NP_660352.1) is another GAM189 target gene, herein designated TARGET GENE. LOC220074 BINDING SITE1 through LOC220074 BINDING SITE3 are target binding sites found in untranslated regions of mRNA encoded by LOC220074, corresponding to target binding sites such as BINDING SITE I, BINDING SITE II or BINDING SITE III of FIG. 8. Table 4 illustrates the complementarity of the nucleotide sequences of LOC220074 BINDING SITE1 through LOC220074 BINDING SITE3, designated SEQ ID:16838, SEQ ID:6497 and SEQ ID:9147 respectively, to the nucleotide sequence of GAM189 RNA, herein designated GAM RNA, also designated SEQ ID:246.

Another function of GAM189 is therefore inhibition of LOC220074 (Accession NP_660352.1). Accordingly, utilities of GAM189 include diagnosis, prevention and treatment of diseases and clinical conditions associated with LOC220074.

LOC221174 (Accession XP_167915.1) is another GAM189 target gene, herein designated TARGET GENE. LOC221174 BINDING SITE is a target binding site found in the 5' untranslated region of mRNA encoded by LOC221174, corresponding to a target binding site such as BINDING SITE I, BINDING SITE II or BINDING SITE III of FIG. 8. Table 4 illustrates the complementarity of the nucleotide sequences of LOC221174 BINDING SITE, designated SEQ ID:17256, to the nucleotide sequence of GAM189 RNA, herein designated GAM RNA, also designated SEQ ID:246.

Another function of GAM189 is therefore inhibition of LOC221174 (Accession XP_167915.1). Accordingly, utilities of GAM189 include diagnosis, prevention and treatment of diseases and clinical conditions associated with LOC221174.

LOC221663 (Accession XP_168131.1) is another GAM189 target gene, herein designated TARGET GENE. LOC221663 BINDING SITE is a target binding site found in the 5' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:1939, to the nucleotide sequence of GAM189 RNA, herein designated GAM RNA, also designated SEQ ID:246.

Another function of GAM189 is therefore inhibition of LOC221663 (Accession XP_168131.1). Accordingly, utilities of GAM189 include diagnosis, prevention and treatment of diseases and clinical conditions associated with LOC221663.

LOC221946 (Accession XP_168340.1) is another GAM189 target gene, herein designated TARGET GENE. LOC221946 BINDING SITE is a target binding site found in the 3' untranslated region of mRNA encoded by LOC221946, corresponding to a target binding site such as BINDING SITE I, BINDING SITE II or BINDING SITE III of FIG. 8. Table 4 illustrates the complementarity of the nucleotide sequences of LOC221946 BINDING SITE, designated SEQ ID:15948, to the nucleotide sequence of GAM189 RNA, herein designated GAM RNA, also designated SEQ ID:246.

Another function of GAM189 is therefore inhibition of LOC221946 (Accession XP_168340.1). Accordingly, utilities of GAM189 include diagnosis, prevention and treatment of diseases and clinical conditions associated with LOC221946.

LOC221960 (Accession XP_165859.1) is another GAM189 target gene, herein designated TARGET GENE. LOC221960 BINDING SITE is a target binding site found in the 3' untranslated region of mRNA encoded by LOC221960, corresponding to a target binding site such as BINDING SITE I, BINDING SITE II or BINDING SITE III of FIG. 8. Table 4 illustrates the complementarity of the nucleotide sequences of LOC221960 BINDING SITE, designated SEQ ID:14860, to the nucleotide sequence of GAM189 RNA, herein designated GAM RNA, also designated SEQ ID:246.

Another function of GAM189 is therefore inhibition of LOC221960 (Accession XP_165859.1). Accordingly, utilities of GAM189 include diagnosis, prevention and treatment of diseases and clinical conditions associated with LOC221960.

LOC221964 (Accession XP_168342.1) is another GAM189 target gene, herein designated TARGET GENE. LOC221964 BINDING SITE is a target binding site found in the 3' untranslated region of mRNA encoded by LOC221964, corresponding to a target binding site such as BINDING SITE I, BINDING SITE II or BINDING SITE III of FIG. 8. Table 4 illustrates the complementarity of the nucleotide sequences of LOC221964 BINDING SITE, designated SEQ ID:17029, to the nucleotide sequence of GAM189 RNA, herein designated GAM RNA, also designated SEQ ID:246.

Another function of GAM189 is therefore inhibition of LOC221964 (Accession XP_168342.1). Accordingly, utilities of GAM189 include diagnosis, prevention and treatment of diseases and clinical conditions associated with LOC221964.

LOC222057 (Accession XP_166594.2) is another GAM189 target gene, herein designated TARGET GENE. LOC222057 BINDING SITE is a target binding site found in the 5' untranslated region of mRNA encoded by LOC222057, corresponding to a target binding site such as BINDING SITE I, BINDING SITE II or BINDING SITE III of FIG. 8. Table 4 illustrates the complementarity of the nucleotide sequences of LOC222057 BINDING SITE, designated SEQ ID:12803, to the nucleotide sequence of GAM189 RNA, herein designated GAM RNA, also designated SEQ ID:246.

Another function of GAM189 is therefore inhibition of LOC222057 (Accession XP_166594.2). Accordingly, utilities of GAM189 include diagnosis, prevention and treatment of diseases and clinical conditions associated with LOC222057.

LOC222068 (Accession XP_166556.1) is another GAM189 target gene, herein designated TARGET GENE. LOC222068 BINDING SITE is a target binding site found in the 3' untranslated region of mRNA encoded by LOC222068, corresponding to a target binding site such as BINDING SITE I, BINDING SITE II or BINDING SITE III of FIG. 8. Table 4 illustrates the complementarity of the nucleotide sequences of LOC222068 BINDING SITE, designated SEQ ID:3232, to the nucleotide sequence of GAM189 RNA, herein designated GAM RNA, also designated SEQ ID:246.

Another function of GAM189 is therefore inhibition of LOC222068 (Accession XP_166556.1). Accordingly, utilities of GAM189 include diagnosis, prevention and treatment of diseases and clinical conditions associated with LOC222068.

LOC222159 (Accession XP_212100.1) is another GAM189 target gene, herein designated TARGET GENE. LOC222159 BINDING SITE is a target binding site found in the 5' untranslated region of multiple transcripts of mRNA encoded by LOC222159, corresponding to a target binding site such as BINDING SITE I, BINDING SITE II or BINDING SITE III of FIG. 8. Table 4 illustrates the complementarity of the nucleotide sequences of LOC222159 BINDING SITE, designated SEQ ID:16228, to the nucleotide sequence of GAM189 RNA, herein designated GAM RNA, also designated SEQ ID:246.

Another function of GAM189 is therefore inhibition of LOC222159 (Accession XP_212100.1). Accordingly, utilities of GAM189 include diagnosis, prevention and treatment of diseases and clinical conditions associated with LOC222159.

LOC252983 (Accession XP_170858.2) is another GAM189 target gene, herein designated TARGET GENE. LOC252983 BINDING SITE is a target binding site found in the 3' untranslated region of mRNA encoded by LOC252983, corresponding to a target binding site such as BINDING SITE I, BINDING SITE II or BINDING SITE III of FIG. 8. Table 4 illustrates the complementarity of the nucleotide sequences of LOC252983 BINDING SITE, designated SEQ ID:2959, to the nucleotide sequence of GAM189 RNA, herein designated GAM RNA, also designated SEQ ID:246.

Another function of GAM189 is therefore inhibition of LOC252983 (Accession XP_170858.2). Accordingly, utilities of GAM189 include diagnosis, prevention and treatment of diseases and clinical conditions associated with LOC252983.

LOC253612 (Accession XP_172985.2) is another GAM189 target gene, herein designated TARGET GENE. LOC253612 BINDING SITE is a target binding site found in the 5' untranslated region of mRNA encoded by LOC253612, corresponding to a target binding site such as BINDING SITE I, BINDING SITE II or BINDING SITE III of FIG. 8. Table 4 illustrates the complementarity of the nucleotide sequences of LOC253612 BINDING SITE, designated SEQ ID:5487, to the nucleotide sequence of GAM189 RNA, herein designated GAM RNA, also designated SEQ ID:246.

Another function of GAM189 is therefore inhibition of LOC253612 (Accession XP_172985.2). Accordingly, utilities of GAM189 include diagnosis, prevention and treatment of diseases and clinical conditions associated with LOC253612.

LOC253805 (Accession XP_172854.1) is another GAM189 target gene, herein designated TARGET GENE. LOC253805 BINDING SITE is a target binding site found in the 3' untranslated region of mRNA encoded by LOC253805, corresponding to a target binding site such as BINDING SITE I, BINDING SITE II or BINDING SITE III of FIG. 8. Table 4 illustrates the complementarity of the nucleotide sequences of LOC253805 BINDING SITE, designated SEQ ID:4532, to the nucleotide sequence of GAM189 RNA, herein designated GAM RNA, also designated SEQ ID:246.

Another function of GAM189 is therefore inhibition of LOC253805 (Accession XP_172854.1). Accordingly, utilities of GAM189 include diagnosis, prevention and treatment of diseases and clinical conditions associated with LOC253805.

LOC254875 (Accession XP_171170.1) is another GAM189 target gene, herein designated TARGET GENE. LOC254875 BINDING SITE is a target binding site found in the 3' untranslated region of mRNA encoded by LOC254875, corresponding to a target binding site such as BINDING SITE I, BINDING SITE II or BINDING SITE III of FIG. 8. Table 4 illustrates the complementarity of the nucleotide sequences of LOC254875 BINDING SITE, designated SEQ ID:6188, to the nucleotide sequence of GAM189 RNA, herein designated GAM RNA, also designated SEQ ID:246.

Another function of GAM189 is therefore inhibition of LOC254875 (Accession XP_171170.1). Accordingly, utilities of GAM189 include diagnosis, prevention and treatment of diseases and clinical conditions associated with LOC254875.

LOC255031 (Accession XP_173187.1) is another GAM189 target gene, herein designated TARGET GENE. LOC255031 BINDING SITE is a target binding site found in the 3' untranslated region of mRNA encoded by LOC255031, corresponding to a target binding site such as BINDING SITE I, BINDING SITE II or BINDING SITE III of FIG. 8. Table 4 illustrates the complementarity of the nucleotide sequences of LOC255031 BINDING SITE, designated SEQ ID:3261, to the nucleotide sequence of GAM189 RNA, herein designated GAM RNA, also designated SEQ ID:246.

Another function of GAM189 is therefore inhibition of LOC255031 (Accession XP_173187.1). Accordingly, utilities of GAM189 include diagnosis, prevention and treatment of diseases and clinical conditions associated with LOC255031.

LOC255177 (Accession XP_172941.1) is another GAM189 target gene, herein designated TARGET GENE. LOC255177 BINDING SITE is a target binding site found in the 3' untranslated region of mRNA encoded by LOC255177, corresponding to a target binding site such as BINDING SITE I, BINDING SITE II or BINDING SITE III of FIG. 8. Table 4 illustrates the complementarity of the nucleotide sequences of LOC255177 BINDING SITE, designated SEQ ID:6294, to the nucleotide sequence of GAM189 RNA, herein designated GAM RNA, also designated SEQ ID:246.

Another function of GAM189 is therefore inhibition of LOC255177 (Accession XP_172941.1). Accordingly, utilities of GAM189 include diagnosis, prevention and treatment of diseases and clinical conditions associated with LOC255177.

LOC255458 (Accession XP_173150.1) is another GAM189 target gene, herein designated TARGET GENE. LOC255458 BINDING SITE is a target binding site found in the 5' untranslated region of mRNA encoded by LOC255458, corresponding to a target binding site such as BINDING SITE I, BINDING SITE II or BINDING SITE III of FIG. 8. Table 4 illustrates the complementarity of the nucleotide sequences of LOC255458 BINDING SITE, designated SEQ ID:6365, to the nucleotide sequence of GAM189 RNA, herein designated GAM RNA, also designated SEQ ID:246.

Another function of GAM189 is therefore inhibition of LOC255458 (Accession XP_173150.1). Accordingly, utilities of GAM189 include diagnosis, prevention and treatment of diseases and clinical conditions associated with LOC255458.

LOC255488 (Accession XP_172581.2) is another GAM189 target gene, herein designated TARGET GENE. LOC255488 BINDING SITE is a target binding site found in the 3' untranslated region of mRNA encoded by LOC255488, corresponding to a target binding site such as BINDING SITE I, BINDING SITE II or BINDING SITE III of FIG. 8. Table 4 illustrates the complementarity of the nucleotide sequences of LOC255488 BINDING SITE, designated SEQ ID:3150, to the nucleotide sequence of GAM189 RNA, herein designated GAM RNA, also designated SEQ ID:246.

Another function of GAM189 is therefore inhibition of LOC255488 (Accession XP_172581.2). Accordingly, utilities of GAM189 include diagnosis, prevention and treatment of diseases and clinical conditions associated with LOC255488.

LOC255975 (Accession XP_171083.2) is another GAM189 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:12803, to the nucleotide sequence of GAM189 RNA, herein designated GAM RNA, also designated SEQ ID:246.

Another function of GAM189 is therefore inhibition of LOC255975 (Accession XP_171083.2). Accordingly, utilities of GAM189 include diagnosis, prevention and treatment of diseases and clinical conditions associated with LOC255975.

LOC256614 (Accession XP_172864.1) is another GAM189 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:7385, to the nucleotide sequence of GAM189 RNA, herein designated GAM RNA, also designated SEQ ID:246.

Another function of GAM189 is therefore inhibition of LOC256614 (Accession XP_172864.1). Accordingly, utilities of GAM189 include diagnosis, prevention and treatment of diseases and clinical conditions associated with LOC256614.

LOC282905 (Accession XP_212606.1) is another GAM189 target gene, herein designated TARGET GENE. LOC282905 BINDING SITE is a target binding site found in the 5' untranslated region of mRNA encoded by LOC282905, corresponding to a target binding site such as BINDING SITE I, BINDING SITE II or BINDING SITE III of FIG. 8. Table 4 illustrates the complementarity of the nucleotide sequences of LOC282905 BINDING SITE, designated SEQ ID:986, to the nucleotide sequence of GAM189 RNA, herein designated GAM RNA, also designated SEQ ID:246.

Another function of GAM189 is therefore inhibition of LOC282905 (Accession XP_212606.1). Accordingly, utilities of GAM189 include diagnosis, prevention and treatment of diseases and clinical conditions associated with LOC282905.

LOC282943 (Accession XP_212647.1) is another GAM189 target gene, herein designated TARGET GENE. LOC282943 BINDING SITE is a target binding site found in the 5' untranslated region of mRNA encoded by LOC282943, corresponding to a target binding site such as BINDING SITE I, BINDING SITE II or BINDING SITE III of FIG. 8. Table 4 illustrates the complementarity of the nucleotide sequences of LOC282943 BINDING SITE, designated SEQ ID:986, to the nucleotide sequence of GAM189 RNA, herein designated GAM RNA, also designated SEQ ID:246.

Another function of GAM189 is therefore inhibition of LOC282943 (Accession XP_212647.1). Accordingly, utilities of GAM189 include diagnosis, prevention and treatment of diseases and clinical conditions associated with LOC282943.

LOC282963 (Accession XP_210834.1) is another GAM189 target gene, herein designated TARGET GENE. LOC282963 BINDING SITE is a target binding site found in the 3' untranslated region of mRNA encoded by LOC282963, corresponding to a target binding site such as BINDING SITE I, BINDING SITE II or BINDING SITE III of FIG. 8. Table 4 illustrates the complementarity of the nucleotide sequences of LOC282963 BINDING SITE, designated SEQ ID:814, to the nucleotide sequence of GAM189 RNA, herein designated GAM RNA, also designated SEQ ID:246.

Another function of GAM189 is therefore inhibition of LOC282963 (Accession XP_210834.1). Accordingly, utilities of GAM189 include diagnosis, prevention and treatment of diseases and clinical conditions associated with LOC282963.

LOC282972 (Accession XP_210837.1) is another GAM189 target gene, herein designated TARGET GENE. LOC282972 BINDING SITE is a target binding site found in the 3' untranslated region of mRNA encoded by LOC282972, corresponding to a target binding site such as BINDING SITE I, BINDING SITE II or BINDING SITE III of FIG. 8. Table 4 illustrates the complementarity of the nucleotide sequences of LOC282972 BINDING SITE, designated SEQ ID:18172, to the nucleotide sequence of GAM189 RNA, herein designated GAM RNA, also designated SEQ ID:246.

Another function of GAM189 is therefore inhibition of LOC282972 (Accession XP_210837.1). Accordingly, utilities of GAM189 include diagnosis, prevention and treatment of diseases and clinical conditions associated with LOC282972.

LOC282987 (Accession XP_210845.1) is another GAM189 target gene, herein designated TARGET GENE. LOC282987 BINDING SITE1 and LOC282987 BINDING SITE2 are target binding sites found in untranslated regions of mRNA encoded by LOC282987, corresponding to target binding sites such as BINDING SITE I, BINDING SITE II or BINDING SITE III of FIG. 8. Table 4 illustrates the complementarity of the nucleotide sequences of LOC282987 BINDING SITE1 and LOC282987 BINDING SITE2, designated SEQ ID:16541 and SEQ ID:12068 respectively, to the nucleotide sequence of GAM189 RNA, herein designated GAM RNA, also designated SEQ ID:246.

Another function of GAM189 is therefore inhibition of LOC282987 (Accession XP_210845.1). Accordingly, utilities of GAM189 include diagnosis, prevention and treatment of diseases and clinical conditions associated with LOC282987.

LOC282997 (Accession XP_208473.1) is another GAM189 target gene, herein designated TARGET GENE. LOC282997 BINDING SITE is a target binding site found in the 3' untranslated region of mRNA encoded by LOC282997, corresponding to a target binding site such as BINDING SITE I, BINDING SITE II or BINDING SITE III of FIG. 8. Table 4 illustrates the complementarity of the nucleotide sequences of LOC282997 BINDING SITE, designated SEQ ID:11798, to the nucleotide sequence of GAM189 RNA, herein designated GAM RNA, also designated SEQ ID:246.

Another function of GAM189 is therefore inhibition of LOC282997 (Accession XP_208473.1). Accordingly, utilities of GAM189 include diagnosis, prevention and treatment of diseases and clinical conditions associated with LOC282997.

LOC283047 (Accession XP_210870.1) is another GAM189 target gene, herein designated TARGET GENE. LOC283047 BINDING SITE is a target binding site found in the 3' untranslated region of mRNA encoded by LOC283047, corresponding to a target binding site such as BINDING SITE I, BINDING SITE II or BINDING SITE III of FIG. 8. Table 4 illustrates the complementarity of the nucleotide sequences of LOC283047 BINDING SITE, designated SEQ ID:17587, to the nucleotide sequence of GAM189 RNA, herein designated GAM RNA, also designated SEQ ID:246.

Another function of GAM189 is therefore inhibition of LOC283047 (Accession XP_210870.1). Accordingly, utilities of GAM189 include diagnosis, prevention and treatment of diseases and clinical conditions associated with LOC283047.

LOC283061 (Accession XP_210875.1) is another GAM189 target gene, herein designated TARGET GENE. LOC283061 BINDING SITE is a target binding site found in the 3' untranslated region of mRNA encoded by LOC283061, corresponding to a target binding site such as BINDING SITE I, BINDING SITE II or BINDING SITE III of FIG. 8. Table 4 illustrates the complementarity of the nucleotide sequences of LOC283061 BINDING SITE, designated SEQ ID:7252, to the nucleotide sequence of GAM189 RNA, herein designated GAM RNA, also designated SEQ ID:246.

Another function of GAM189 is therefore inhibition of LOC283061 (Accession XP_210875.1). Accordingly, utilities of GAM189 include diagnosis, prevention and treatment of diseases and clinical conditions associated with LOC283061.

LOC283087 (Accession XP_208509.1) is another GAM189 target gene, herein designated TARGET GENE. LOC283087 BINDING SITE is a target binding site found in the 3' untranslated region of mRNA encoded by LOC283087, corresponding to a target binding site such as BINDING SITE I, BINDING SITE II or BINDING SITE III of FIG. 8. Table 4 illustrates the complementarity of the nucleotide sequences of LOC283087 BINDING SITE, designated SEQ ID:4176, to the nucleotide sequence of GAM189 RNA, herein designated GAM RNA, also designated SEQ ID:246.

Another function of GAM189 is therefore inhibition of LOC283087 (Accession XP_208509.1). Accordingly, utilities of GAM189 include diagnosis, prevention and treatment of diseases and clinical conditions associated with LOC283087.

LOC283089 (Accession XP_210885.1) is another GAM189 target gene, herein designated TARGET GENE. LOC283089 BINDING SITE is a target binding site found in the 5' untranslated region of mRNA encoded by LOC283089, corresponding to a target binding site such as BINDING SITE I, BINDING SITE II or BINDING SITE III of FIG. 8. Table 4 illustrates the complementarity of the nucleotide sequences of LOC283089 BINDING SITE, designated SEQ ID:2219, to the nucleotide sequence of GAM189 RNA, herein designated GAM RNA, also designated SEQ ID:246.

Another function of GAM189 is therefore inhibition of LOC283089 (Accession XP_210885.1). Accordingly, utilities of GAM189 include diagnosis, prevention and treatment of diseases and clinical conditions associated with LOC283089.

LOC283119 (Accession XP_210895.1) is another GAM189 target gene, herein designated TARGET GENE. LOC283119 BINDING SITE is a target binding site found in the 3' untranslated region of mRNA encoded by LOC283119, corresponding to a target binding site such as BINDING SITE I, BINDING SITE II or BINDING SITE III of FIG. 8. Table 4 illustrates the complementarity of the nucleotide sequences of LOC283119 BINDING SITE, designated SEQ ID:16397, to the nucleotide sequence of GAM189 RNA, herein designated GAM RNA, also designated SEQ ID:246.

Another function of GAM189 is therefore inhibition of LOC283119 (Accession XP_210895.1). Accordingly, utilities of GAM189 include diagnosis, prevention and treatment of diseases and clinical conditions associated with LOC283119.

LOC283130 (Accession XP_208525.3) is another GAM189 target gene, herein designated TARGET GENE. LOC283130 BINDING SITE is a target binding site found in the 3' untranslated region of mRNA encoded by LOC283130, corresponding to a target binding site such as BINDING SITE I, BINDING SITE II or BINDING SITE III of FIG. 8. Table 4 illustrates the complementarity of the nucleotide sequences of LOC283130 BINDING SITE, designated SEQ ID:5323, to the nucleotide sequence of GAM189 RNA, herein designated GAM RNA, also designated SEQ ID:246.

Another function of GAM189 is therefore inhibition of LOC283130 (Accession XP_208525.3). Accordingly, utilities of GAM189 include diagnosis, prevention and treatment of diseases and clinical conditions associated with LOC283130.

LOC283140 (Accession XP_210911.1) is another GAM189 target gene, herein designated TARGET GENE. LOC283140 BINDING SITE is a target binding site found in the 3' untranslated region of mRNA encoded by LOC283140, corresponding to a target binding site such as BINDING SITE I, BINDING SITE II or BINDING SITE III of FIG. 8. Table 4 illustrates the complementarity of the nucleotide sequences of LOC283140 BINDING SITE, designated SEQ ID:12544, to the nucleotide sequence of GAM189 RNA, herein designated GAM RNA, also designated SEQ ID:246.

Another function of GAM189 is therefore inhibition of LOC283140 (Accession XP_210911.1). Accordingly, utilities of GAM189 include diagnosis, prevention and treatment of diseases and clinical conditions associated with LOC283140.

LOC283142 (Accession XP_210925.1) is another GAM189 target gene, herein designated TARGET GENE. LOC283142 BINDING SITE is a target binding site found in the 3' untranslated region of mRNA encoded by LOC283142, corresponding to a target binding site such as BINDING SITE I, BINDING SITE II or BINDING SITE III of FIG. 8. Table 4 illustrates the complementarity of the nucleotide sequences of LOC283142 BINDING SITE, designated SEQ ID:19977, to the nucleotide sequence of GAM189 RNA, herein designated GAM RNA, also designated SEQ ID:246.

Another function of GAM189 is therefore inhibition of LOC283142 (Accession XP_210925.1). Accordingly, utilities of GAM189 include diagnosis, prevention and treatment of diseases and clinical conditions associated with LOC283142.

LOC283143 (Accession XP_210920.1) is another GAM189 target gene, herein designated TARGET GENE. LOC283143 BINDING SITE is a target binding site found in the 3' untranslated region of mRNA encoded by LOC283143, corresponding to a target binding site such as BINDING SITE I, BINDING SITE II or BINDING SITE III of FIG. 8. Table 4 illustrates the complementarity of the nucleotide sequences of LOC283143 BINDING SITE, designated SEQ ID:2650, to the nucleotide sequence of GAM189 RNA, herein designated GAM RNA, also designated SEQ ID:246.

Another function of GAM189 is therefore inhibition of LOC283143 (Accession XP_210920.1). Accordingly, utilities of GAM189 include diagnosis, prevention and treatment of diseases and clinical conditions associated with LOC283143.

LOC283152 (Accession XP_210917.2) is another GAM189 target gene, herein designated TARGET GENE. LOC283152 BINDING SITE is a target binding site found in the 5' untranslated region of mRNA encoded by LOC283152, corresponding to a target binding site such as BINDING SITE I, BINDING SITE II or BINDING SITE III of FIG. 8. Table 4 illustrates the complementarity of the nucleotide sequences of LOC283152 BINDING SITE, designated SEQ ID:19812, to the nucleotide sequence of GAM189 RNA, herein designated GAM RNA, also designated SEQ ID:246.

Another function of GAM189 is therefore inhibition of LOC283152 (Accession XP_210917.2). Accordingly, utilities of GAM189 include diagnosis, prevention and treatment of diseases and clinical conditions associated with LOC283152.

LOC283170 (Accession XP_208535.1) is another GAM189 target gene, herein designated TARGET GENE. LOC283170 BINDING SITE is a target binding site found in the 3' untranslated region of mRNA encoded by LOC283170, corresponding to a target binding site such as BINDING SITE I, BINDING SITE II or BINDING SITE III of FIG. 8. Table 4 illustrates the complementarity of the nucleotide sequences of LOC283170 BINDING SITE, designated SEQ ID:4979, to the nucleotide sequence of GAM189 RNA, herein designated GAM RNA, also designated SEQ ID:246.

Another function of GAM189 is therefore inhibition of LOC283170 (Accession XP_208535.1). Accordingly, utilities of GAM189 include diagnosis, prevention and treatment of diseases and clinical conditions associated with LOC283170.

LOC283177 (Accession XP_210903.1) is another GAM189 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:15574, to the nucleotide sequence of GAM189 RNA, herein designated GAM RNA, also designated SEQ ID:246.

Another function of GAM189 is therefore inhibition of LOC283177 (Accession XP_210903.1). Accordingly, utilities of GAM189 include diagnosis, prevention and treatment of diseases and clinical conditions associated with LOC283177.

LOC283215 (Accession XP_208555.2) is another GAM189 target gene, herein designated TARGET GENE. LOC283215 BINDING SITE is a target binding site found in the 3' untranslated region of mRNA encoded by LOC283215, corresponding to a target binding site such as BINDING SITE I, BINDING SITE II or BINDING SITE III of FIG. 8. Table 4 illustrates the complementarity of the nucleotide sequences of LOC283215 BINDING SITE, designated SEQ ID:10112, to the nucleotide sequence of GAM189 RNA, herein designated GAM RNA, also designated SEQ ID:246.

Another function of GAM189 is therefore inhibition of LOC283215 (Accession XP_208555.2). Accordingly, utilities of GAM189 include diagnosis, prevention and treatment of diseases and clinical conditions associated with LOC283215.

LOC283241 (Accession NP_787089.1) is another GAM189 target gene, herein designated TARGET GENE. LOC283241 BINDING SITE is a target binding site found in the 5' untranslated region of mRNA encoded by LOC283241, corresponding to a target binding site such as BINDING SITE I, BINDING SITE II or BINDING SITE III of FIG. 8. Table 4 illustrates the complementarity of the nucleotide sequences of LOC283241 BINDING SITE, designated SEQ ID:9525, to the nucleotide sequence of GAM189 RNA, herein designated GAM RNA, also designated SEQ ID:246.

Another function of GAM189 is therefore inhibition of LOC283241 (Accession NP_787089.1). Accordingly, utilities of GAM189 include diagnosis, prevention and treatment of diseases and clinical conditions associated with LOC283241.

LOC283244 (Accession XP_208583.2) is another GAM189 target gene, herein designated TARGET GENE. LOC283244 BINDING SITE is a target binding site found in the 3' untranslated region of mRNA encoded by LOC283244, corresponding to a target binding site such as BINDING SITE I, BINDING SITE II or BINDING SITE III of FIG. 8. Table 4 illustrates the complementarity of the nucleotide sequences of LOC283244 BINDING SITE, designated SEQ ID:4496, to the nucleotide sequence of GAM189 RNA, herein designated GAM RNA, also designated SEQ ID:246.

Another function of GAM189 is therefore inhibition of LOC283244 (Accession XP_208583.2). Accordingly, utilities of GAM189 include diagnosis, prevention and treatment of diseases and clinical conditions associated with LOC283244.

LOC283262 (Accession XP_210952.1) is another GAM189 target gene, herein designated TARGET GENE. LOC283262 BINDING SITE is a target binding site found in the 5' untranslated region of mRNA encoded by LOC283262, corresponding to a target binding site such as BINDING SITE I, BINDING SITE II or BINDING SITE III of FIG. 8. Table 4 illustrates the complementarity of the nucleotide sequences of LOC283262 BINDING SITE, designated SEQ ID:8223, to the nucleotide sequence of GAM189 RNA, herein designated GAM RNA, also designated SEQ ID:246.

Another function of GAM189 is therefore inhibition of LOC283262 (Accession XP_210952.1). Accordingly, utilities of GAM189 include diagnosis, prevention and treatment of diseases and clinical conditions associated with LOC283262.

LOC283278 (Accession XP_210961.1) is another GAM189 target gene, herein designated TARGET GENE.

LOC283278 BINDING SITE is a target binding site found in the 3' untranslated region of mRNA encoded by LOC283278, corresponding to a target binding site such as BINDING SITE I, BINDING SITE II or BINDING SITE III of FIG. 8. Table 4 illustrates the complementarity of the nucleotide sequences of LOC283278 BINDING SITE, designated SEQ ID:9036, to the nucleotide sequence of GAM189 RNA, herein designated GAM RNA, also designated SEQ ID:246.

Another function of GAM189 is therefore inhibition of LOC283278 (Accession XP_210961.1). Accordingly, utilities of GAM189 include diagnosis, prevention and treatment of diseases and clinical conditions associated with LOC283278.

LOC283293 (Accession XP_210962.1) is another GAM189 target gene, herein designated TARGET GENE. LOC283293 BINDING SITE is a target binding site found in the 3' untranslated region of mRNA encoded by LOC283293, corresponding to a target binding site such as BINDING SITE I, BINDING SITE II or BINDING SITE III of FIG. 8. Table 4 illustrates the complementarity of the nucleotide sequences of LOC283293 BINDING SITE, designated SEQ ID:17952, to the nucleotide sequence of GAM189 RNA, herein designated GAM RNA, also designated SEQ ID:246.

Another function of GAM189 is therefore inhibition of LOC283293 (Accession XP_210962.1). Accordingly, utilities of GAM189 include diagnosis, prevention and treatment of diseases and clinical conditions associated with LOC283293.

LOC283299 (Accession XP_210965.1) is another GAM189 target gene, herein designated TARGET GENE. LOC283299 BINDING SITE is a target binding site found in the 5' untranslated region of mRNA encoded by LOC283299, corresponding to a target binding site such as BINDING SITE I, BINDING SITE II or BINDING SITE III of FIG. 8. Table 4 illustrates the complementarity of the nucleotide sequences of LOC283299 BINDING SITE, designated SEQ ID:9585, to the nucleotide sequence of GAM189 RNA, herein designated GAM RNA, also designated SEQ ID:246.

Another function of GAM189 is therefore inhibition of LOC283299 (Accession XP_210965.1). Accordingly, utilities of GAM189 include diagnosis, prevention and treatment of diseases and clinical conditions associated with LOC283299.

LOC283329 (Accession XP_210978.1) is another GAM189 target gene, herein designated TARGET GENE. LOC283329 BINDING SITE is a target binding site found in the 5' untranslated region of mRNA encoded by LOC283329, corresponding to a target binding site such as BINDING SITE I, BINDING SITE II or BINDING SITE III of FIG. 8. Table 4 illustrates the complementarity of the nucleotide sequences of LOC283329 BINDING SITE, designated SEQ ID:2201, to the nucleotide sequence of GAM189 RNA, herein designated GAM RNA, also designated SEQ ID:246.

Another function of GAM189 is therefore inhibition of LOC283329 (Accession XP_210978.1). Accordingly, utilities of GAM189 include diagnosis, prevention and treatment of diseases and clinical conditions associated with LOC283329.

LOC283335 (Accession XP_210981.1) is another GAM189 target gene, herein designated TARGET GENE. LOC283335 BINDING SITE1 and LOC283335 BINDING SITE2 are target binding sites found in untranslated regions of mRNA encoded by LOC283335, corresponding to target binding sites such as BINDING SITE I, BINDING SITE II or BINDING SITE III of FIG. 8. Table 4 illustrates the complementarity of the nucleotide sequences of LOC283335 BINDING SITE1 and LOC283335 BINDING SITE2, designated SEQ ID:2143 and SEQ ID:16144 respectively, to the nucleotide sequence of GAM189 RNA, herein designated GAM RNA, also designated SEQ ID:246.

Another function of GAM189 is therefore inhibition of LOC283335 (Accession XP_210981.1). Accordingly, utilities of GAM189 include diagnosis, prevention and treatment of diseases and clinical conditions associated with LOC283335.

LOC283377 (Accession XP_208647.1) is another GAM189 target gene, herein designated TARGET GENE. LOC283377 BINDING SITE is a target binding site found in the 3' untranslated region of mRNA encoded by LOC283377, corresponding to a target binding site such as BINDING SITE I, BINDING SITE II or BINDING SITE III of FIG. 8. Table 4 illustrates the complementarity of the nucleotide sequences of LOC283377 BINDING SITE, designated SEQ ID:8232, to the nucleotide sequence of GAM189 RNA, herein designated GAM RNA, also designated SEQ ID:246.

Another function of GAM189 is therefore inhibition of LOC283377 (Accession XP_208647.1). Accordingly, utilities of GAM189 include diagnosis, prevention and treatment of diseases and clinical conditions associated with LOC283377.

LOC283387 (Accession XP_211007.1) is another GAM189 target gene, herein designated TARGET GENE. LOC283387 BINDING SITE is a target binding site found in the 3' untranslated region of mRNA encoded by LOC283387, corresponding to a target binding site such as BINDING SITE I, BINDING SITE II or BINDING SITE III of FIG. 8. Table 4 illustrates the complementarity of the nucleotide sequences of LOC283387 BINDING SITE, designated SEQ ID:7265, to the nucleotide sequence of GAM189 RNA, herein designated GAM RNA, also designated SEQ ID:246.

Another function of GAM189 is therefore inhibition of LOC283387 (Accession XP_211007.1). Accordingly, utilities of GAM189 include diagnosis, prevention and treatment of diseases and clinical conditions associated with LOC283387.

LOC283394 (Accession XP_211021.1) is another GAM189 target gene, herein designated TARGET GENE. LOC283394 BINDING SITE is a target binding site found in the 5' untranslated region of mRNA encoded by LOC283394, corresponding to a target binding site such as BINDING SITE I, BINDING SITE II or BINDING SITE III of FIG. 8. Table 4 illustrates the complementarity of the nucleotide sequences of LOC283394 BINDING SITE, designated SEQ ID:1730, to the nucleotide sequence of GAM189 RNA, herein designated GAM RNA, also designated SEQ ID:246.

Another function of GAM189 is therefore inhibition of LOC283394 (Accession XP_211021.1). Accordingly, utilities of GAM189 include diagnosis, prevention and treatment of diseases and clinical conditions associated with LOC283394.

LOC283395 (Accession XP_211020.1) is another GAM189 target gene, herein designated TARGET GENE. LOC283395 BINDING SITE is a target binding site found in the 3' untranslated region of mRNA encoded by LOC283395, corresponding to a target binding site such as BINDING SITE I, BINDING SITE II or BINDING SITE III of FIG. 8. Table 4 illustrates the complementarity of the nucleotide sequences of LOC283395 BINDING SITE, designated SEQ ID:9003, to the nucleotide sequence of GAM189 RNA, herein designated GAM RNA, also designated SEQ ID:246.

Another function of GAM189 is therefore inhibition of LOC283395 (Accession XP_211020.1). Accordingly, utilities of GAM189 include diagnosis, prevention and treatment of diseases and clinical conditions associated with LOC283395.

LOC283400 (Accession XP_211024.1) is another GAM189 target gene, herein designated TARGET GENE. LOC283400 BINDING SITE is a target binding site found in the 5' untranslated region of mRNA encoded by LOC283400, corresponding to a target binding site such as BINDING SITE I, BINDING SITE II or BINDING SITE III of FIG. 8. Table 4 illustrates the complementarity of the nucleotide sequences of LOC283400 BINDING SITE, designated SEQ ID:19206, to the nucleotide sequence of GAM189 RNA, herein designated GAM RNA, also designated SEQ ID:246.

Another function of GAM189 is therefore inhibition of LOC283400 (Accession XP_211024.1). Accordingly, utilities of GAM189 include diagnosis, prevention and treatment of diseases and clinical conditions associated with LOC283400.

LOC283432 (Accession XP_211032.1) is another GAM189 target gene, herein designated TARGET GENE. LOC283432 BINDING SITE is a target binding site found in the 5' untranslated region of mRNA encoded by LOC283432, corresponding to a target binding site such as BINDING SITE I, BINDING SITE II or BINDING SITE III of FIG. 8. Table 4 illustrates the complementarity of the nucleotide sequences of LOC283432 BINDING SITE, designated SEQ ID:16658, to the nucleotide sequence of GAM189 RNA, herein designated GAM RNA, also designated SEQ ID:246.

Another function of GAM189 is therefore inhibition of LOC283432 (Accession XP_211032.1). Accordingly, utilities of GAM189 include diagnosis, prevention and treatment of diseases and clinical conditions associated with LOC283432.

LOC283441 (Accession XP_211043.1) is another GAM189 target gene, herein designated TARGET GENE. LOC283441 BINDING SITE is a target binding site found in the 3' untranslated region of mRNA encoded by LOC283441, corresponding to a target binding site such as BINDING SITE I, BINDING SITE II or BINDING SITE III of FIG. 8. Table 4 illustrates the complementarity of the nucleotide sequences of LOC283441 BINDING SITE, designated SEQ ID:2220, to the nucleotide sequence of GAM189 RNA, herein designated GAM RNA, also designated SEQ ID:246.

Another function of GAM189 is therefore inhibition of LOC283441 (Accession XP_211043.1). Accordingly, utilities of GAM189 include diagnosis, prevention and treatment of diseases and clinical conditions associated with LOC283441.

LOC283442 (Accession XP_211037.1) is another GAM189 target gene, herein designated TARGET GENE. LOC283442 BINDING SITE is a target binding site found in the 5' untranslated region of mRNA encoded by LOC283442, corresponding to a target binding site such as BINDING SITE I, BINDING SITE II or BINDING SITE III of FIG. 8. Table 4 illustrates the complementarity of the nucleotide sequences of LOC283442 BINDING SITE, designated SEQ ID:10032, to the nucleotide sequence of GAM189 RNA, herein designated GAM RNA, also designated SEQ ID:246.

Another function of GAM189 is therefore inhibition of LOC283442 (Accession XP_211037.1). Accordingly, utilities of GAM189 include diagnosis, prevention and treatment of diseases and clinical conditions associated with LOC283442.

LOC283445 (Accession XP_211044.1) is another GAM189 target gene, herein designated TARGET GENE. LOC283445 BINDING SITE is a target binding site found in the 5' untranslated region of mRNA encoded by LOC283445, corresponding to a target binding site such as BINDING SITE I, BINDING SITE II or BINDING SITE III of FIG. 8. Table 4 illustrates the complementarity of the nucleotide sequences of LOC283445 BINDING SITE, designated SEQ ID:5683, to the nucleotide sequence of GAM189 RNA, herein designated GAM RNA, also designated SEQ ID:246.

Another function of GAM189 is therefore inhibition of LOC283445 (Accession XP_211044.1). Accordingly, utilities of GAM189 include diagnosis, prevention and treatment of diseases and clinical conditions associated with LOC283445.

LOC283452 (Accession XP_208679.1) is another GAM189 target gene, herein designated TARGET GENE. LOC283452 BINDING SITE is a target binding site found in the 5' untranslated region of mRNA encoded by LOC283452, corresponding to a target binding site such as BINDING SITE I, BINDING SITE II or BINDING SITE III of FIG. 8. Table 4 illustrates the complementarity of the nucleotide sequences of LOC283452 BINDING SITE, designated SEQ ID:7397, to the nucleotide sequence of GAM189 RNA, herein designated GAM RNA, also designated SEQ ID:246.

Another function of GAM189 is therefore inhibition of LOC283452 (Accession XP_208679.1). Accordingly, utilities of GAM189 include diagnosis, prevention and treatment of diseases and clinical conditions associated with LOC283452.

LOC283454 (Accession XP_211049.1) is another GAM189 target gene, herein designated TARGET GENE. LOC283454 BINDING SITE is a target binding site found in the 5' untranslated region of mRNA encoded by LOC283454, corresponding to a target binding site such as BINDING SITE I, BINDING SITE II or BINDING SITE III of FIG. 8. Table 4 illustrates the complementarity of the nucleotide sequences of LOC283454 BINDING SITE, designated SEQ ID:14861, to the nucleotide sequence of GAM189 RNA, herein designated GAM RNA, also designated SEQ ID:246.

Another function of GAM189 is therefore inhibition of LOC283454 (Accession XP_211049.1). Accordingly, utilities of GAM189 include diagnosis, prevention and treatment of diseases and clinical conditions associated with LOC283454.

LOC283467 (Accession XP_211050.1) is another GAM189 target gene, herein designated TARGET GENE. LOC283467 BINDING SITE is a target binding site found in the 3' untranslated region of mRNA encoded by LOC283467, corresponding to a target binding site such as BINDING SITE I, BINDING SITE II or BINDING SITE III of FIG. 8. Table 4 illustrates the complementarity of the nucleotide sequences of LOC283467 BINDING SITE, designated SEQ ID:13967, to the nucleotide sequence of GAM189 RNA, herein designated GAM RNA, also designated SEQ ID:246.

Another function of GAM189 is therefore inhibition of LOC283467 (Accession XP_211050.1). Accordingly, utilities of GAM189 include diagnosis, prevention and treatment of diseases and clinical conditions associated with LOC283467.

LOC283475 (Accession XP_211056.1) is another GAM189 target gene, herein designated TARGET GENE. LOC283475 BINDING SITE is a target binding site found in the 3' untranslated region of mRNA encoded by LOC283475, corresponding to a target binding site such as BINDING SITE I, BINDING SITE II or BINDING SITE III of FIG. 8. Table 4 illustrates the complementarity of the nucleotide sequences of LOC283475 BINDING SITE, designated SEQ ID:9892, to the nucleotide sequence of GAM189 RNA, herein designated GAM RNA, also designated SEQ ID:246.

Another function of GAM189 is therefore inhibition of LOC283475 (Accession XP__211056.1). Accordingly, utilities of GAM189 include diagnosis, prevention and treatment of diseases and clinical conditions associated with LOC283475.

LOC283484 (Accession XP__211053.1) is another GAM189 target gene, herein designated TARGET GENE. LOC283484 BINDING SITE is a target binding site found in the 5' untranslated region of mRNA encoded by LOC283484, corresponding to a target binding site such as BINDING SITE I, BINDING SITE II or BINDING SITE III of FIG. 8. Table 4 illustrates the complementarity of the nucleotide sequences of LOC283484 BINDING SITE, designated SEQ ID:17710, to the nucleotide sequence of GAM189 RNA, herein designated GAM RNA, also designated SEQ ID:246.

Another function of GAM189 is therefore inhibition of LOC283484 (Accession XP__211053.1). Accordingly, utilities of GAM189 include diagnosis, prevention and treatment of diseases and clinical conditions associated with LOC283484.

LOC283487 (Accession XP__211062.1) is another GAM189 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:7371, to the nucleotide sequence of GAM189 RNA, herein designated GAM RNA, also designated SEQ ID:246.

Another function of GAM189 is therefore inhibition of LOC283487 (Accession XP__211062.1). Accordingly, utilities of GAM189 include diagnosis, prevention and treatment of diseases and clinical conditions associated with LOC283487.

LOC283507 (Accession XP__211075.1) is another GAM189 target gene, herein designated TARGET GENE. LOC283507 BINDING SITE is a target binding site found in the 3' untranslated region of mRNA encoded by LOC283507, corresponding to a target binding site such as BINDING SITE I, BINDING SITE II or BINDING SITE III of FIG. 8. Table 4 illustrates the complementarity of the nucleotide sequences of LOC283507 BINDING SITE, designated SEQ ID:12075, to the nucleotide sequence of GAM189 RNA, herein designated GAM RNA, also designated SEQ ID:246.

Another function of GAM189 is therefore inhibition of LOC283507 (Accession XP__211075.1). Accordingly, utilities of GAM189 include diagnosis, prevention and treatment of diseases and clinical conditions associated with LOC283507.

LOC283534 (Accession XP__211083.1) is another GAM189 target gene, herein designated TARGET GENE. LOC283534 BINDING SITE is a target binding site found in the 3' untranslated region of mRNA encoded by LOC283534, corresponding to a target binding site such as BINDING SITE I, BINDING SITE II or BINDING SITE III of FIG. 8. Table 4 illustrates the complementarity of the nucleotide sequences of LOC283534 BINDING SITE, designated SEQ ID:3199, to the nucleotide sequence of GAM189 RNA, herein designated GAM RNA, also designated SEQ ID:246.

Another function of GAM189 is therefore inhibition of LOC283534 (Accession XP__211083.1). Accordingly, utilities of GAM189 include diagnosis, prevention and treatment of diseases and clinical conditions associated with LOC283534.

LOC283570 (Accession XP__211118.1) is another GAM189 target gene, herein designated TARGET GENE. LOC283570 BINDING SITE is a target binding site found in the 3' untranslated region of mRNA encoded by LOC283570, corresponding to a target binding site such as BINDING SITE I, BINDING SITE II or BINDING SITE III of FIG. 8. Table 4 illustrates the complementarity of the nucleotide sequences of LOC283570 BINDING SITE, designated SEQ ID:13652, to the nucleotide sequence of GAM189 RNA, herein designated GAM RNA, also designated SEQ ID:246.

Another function of GAM189 is therefore inhibition of LOC283570 (Accession XP__211118.1). Accordingly, utilities of GAM189 include diagnosis, prevention and treatment of diseases and clinical conditions associated with LOC283570.

LOC283575 (Accession XP__211095.1) is another GAM189 target gene, herein designated TARGET GENE. LOC283575 BINDING SITE1 and LOC283575 BINDING SITE2 are target binding sites found in untranslated regions of mRNA encoded by LOC283575, corresponding to target binding sites such as BINDING SITE I, BINDING SITE II or BINDING SITE III of FIG. 8. Table 4 illustrates the complementarity of the nucleotide sequences of LOC283575 BINDING SITE1 and LOC283575 BINDING SITE2, designated SEQ ID:6183 and SEQ ID:10067 respectively, to the nucleotide sequence of GAM189 RNA, herein designated GAM RNA, also designated SEQ ID:246.

Another function of GAM189 is therefore inhibition of LOC283575 (Accession XP__211095.1). Accordingly, utilities of GAM189 include diagnosis, prevention and treatment of diseases and clinical conditions associated with LOC283575.

LOC283585 (Accession XP__294741.1) is another GAM189 target gene, herein designated TARGET GENE. LOC283585 BINDING SITE is a target binding site found in the 5' untranslated region of mRNA encoded by LOC283585, corresponding to a target binding site such as BINDING SITE I, BINDING SITE II or BINDING SITE III of FIG. 8. Table 4 illustrates the complementarity of the nucleotide sequences of LOC283585 BINDING SITE, designated SEQ ID:10466, to the nucleotide sequence of GAM189 RNA, herein designated GAM RNA, also designated SEQ ID:246.

Another function of GAM189 is therefore inhibition of LOC283585 (Accession XP__294741.1). Accordingly, utilities of GAM189 include diagnosis, prevention and treatment of diseases and clinical conditions associated with LOC283585.

LOC283588 (Accession NP__787093.1) is another GAM189 target gene, herein designated TARGET GENE. LOC283588 BINDING SITE is a target binding site found in the 3' untranslated region of mRNA encoded by LOC283588, corresponding to a target binding site such as BINDING SITE I, BINDING SITE II or BINDING SITE III of FIG. 8. Table 4 illustrates the complementarity of the nucleotide sequences of LOC283588 BINDING SITE, designated SEQ ID:10638, to the nucleotide sequence of GAM189 RNA, herein designated GAM RNA, also designated SEQ ID:246.

Another function of GAM189 is therefore inhibition of LOC283588 (Accession NP__787093.1). Accordingly, utilities of GAM189 include diagnosis, prevention and treatment of diseases and clinical conditions associated with LOC283588.

LOC283624 (Accession XP__211126.1) is another GAM189 target gene, herein designated TARGET GENE. LOC283624 BINDING SITE is a target binding site found in the 5' untranslated region of mRNA encoded by LOC283624, corresponding to a target binding site such as BINDING SITE I, BINDING SITE II or BINDING SITE III of FIG. 8. Table 4 illustrates the complementarity of the nucleotide sequences of LOC283624 BINDING SITE, designated SEQ ID:4420, to the nucleotide sequence of GAM189 RNA, herein designated GAM RNA, also designated SEQ ID:246.

Another function of GAM189 is therefore inhibition of LOC283624 (Accession XP_211126.1). Accordingly, utilities of GAM189 include diagnosis, prevention and treatment of diseases and clinical conditions associated with LOC283624.

LOC283637 (Accession XP_211134.1) is another GAM189 target gene, herein designated TARGET GENE. LOC283637 BINDING SITE1 and LOC283637 BINDING SITE2 are target binding sites found in untranslated regions of mRNA encoded by LOC283637, corresponding to target binding sites such as BINDING SITE I, BINDING SITE II or BINDING SITE III of FIG. 8. Table 4 illustrates the complementarity of the nucleotide sequences of LOC283637 BINDING SITE1 and LOC283637 BINDING SITE2, designated SEQ ID:14859 and SEQ ID:3581 respectively, to the nucleotide sequence of GAM189 RNA, herein designated GAM RNA, also designated SEQ ID:246.

Another function of GAM189 is therefore inhibition of LOC283637 (Accession XP_211134.1). Accordingly, utilities of GAM189 include diagnosis, prevention and treatment of diseases and clinical conditions associated with LOC283637.

LOC283641 (Accession XP_208764.1) is another GAM189 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:17964, to the nucleotide sequence of GAM189 RNA, herein designated GAM RNA, also designated SEQ ID:246.

Another function of GAM189 is therefore inhibition of LOC283641 (Accession XP_208764.1). Accordingly, utilities of GAM189 include diagnosis, prevention and treatment of diseases and clinical conditions associated with LOC283641.

LOC283663 (Accession XP_211147.1) is another GAM189 target gene, herein designated TARGET GENE. LOC283663 BINDING SITE is a target binding site found in the 5' untranslated region of mRNA encoded by LOC283663, corresponding to a target binding site such as BINDING SITE I, BINDING SITE II or BINDING SITE III of FIG. 8. Table 4 illustrates the complementarity of the nucleotide sequences of LOC283663 BINDING SITE, designated SEQ ID:16674, to the nucleotide sequence of GAM189 RNA, herein designated GAM RNA, also designated SEQ ID:246.

Another function of GAM189 is therefore inhibition of LOC283663 (Accession XP_211147.1). Accordingly, utilities of GAM189 include diagnosis, prevention and treatment of diseases and clinical conditions associated with LOC283663.

LOC283664 (Accession XP_208773.1) is another GAM189 target gene, herein designated TARGET GENE. LOC283664 BINDING SITE is a target binding site found in the 5' untranslated region of mRNA encoded by LOC283664, corresponding to a target binding site such as BINDING SITE I, BINDING SITE II or BINDING SITE III of FIG. 8. Table 4 illustrates the complementarity of the nucleotide sequences of LOC283664 BINDING SITE, designated SEQ ID:8450, to the nucleotide sequence of GAM189 RNA, herein designated GAM RNA, also designated SEQ ID:246.

Another function of GAM189 is therefore inhibition of LOC283664 (Accession XP_208773.1). Accordingly, utilities of GAM189 include diagnosis, prevention and treatment of diseases and clinical conditions associated with LOC283664.

LOC283672 (Accession XP_211152.1) is another GAM189 target gene, herein designated TARGET GENE. LOC283672 BINDING SITE is a target binding site found in the 5' untranslated region of mRNA encoded by LOC283672, corresponding to a target binding site such as BINDING SITE I, BINDING SITE II or BINDING SITE III of FIG. 8. Table 4 illustrates the complementarity of the nucleotide sequences of LOC283672 BINDING SITE, designated SEQ ID:1730, to the nucleotide sequence of GAM189 RNA, herein designated GAM RNA, also designated SEQ ID:246.

Another function of GAM189 is therefore inhibition of LOC283672 (Accession XP_211152.1). Accordingly, utilities of GAM189 include diagnosis, prevention and treatment of diseases and clinical conditions associated with LOC283672.

LOC283687 (Accession NP_787094.1) is another GAM189 target gene, herein designated TARGET GENE. LOC283687 BINDING SITE is a target binding site found in the 3' untranslated region of mRNA encoded by LOC283687, corresponding to a target binding site such as BINDING SITE I, BINDING SITE II or BINDING SITE III of FIG. 8. Table 4 illustrates the complementarity of the nucleotide sequences of LOC283687 BINDING SITE, designated SEQ ID:11904, to the nucleotide sequence of GAM189 RNA, herein designated GAM RNA, also designated SEQ ID:246.

Another function of GAM189 is therefore inhibition of LOC283687 (Accession NP_787094.1). Accordingly, utilities of GAM189 include diagnosis, prevention and treatment of diseases and clinical conditions associated with LOC283687.

LOC283693 (Accession XP_208788.1) is another GAM189 target gene, herein designated TARGET GENE. LOC283693 BINDING SITE is a target binding site found in the 3' untranslated region of mRNA encoded by LOC283693, corresponding to a target binding site such as BINDING SITE I, BINDING SITE II or BINDING SITE III of FIG. 8. Table 4 illustrates the complementarity of the nucleotide sequences of LOC283693 BINDING SITE, designated SEQ ID:5305, to the nucleotide sequence of GAM189 RNA, herein designated GAM RNA, also designated SEQ ID:246.

Another function of GAM189 is therefore inhibition of LOC283693 (Accession XP_208788.1). Accordingly, utilities of GAM189 include diagnosis, prevention and treatment of diseases and clinical conditions associated with LOC283693.

LOC283701 (Accession XP_211170.3) is another GAM189 target gene, herein designated TARGET GENE. LOC283701 BINDING SITE1 and LOC283701 BINDING SITE2 are target binding sites found in untranslated regions of mRNA encoded by LOC283701, corresponding to target binding sites such as BINDING SITE I, BINDING SITE II or BINDING SITE III of FIG. 8. Table 4 illustrates the complementarity of the nucleotide sequences of LOC283701 BINDING SITE1 and LOC283701 BINDING SITE2, designated SEQ ID:13716 and SEQ ID:14381 respectively, to the nucleotide sequence of GAM189 RNA, herein designated GAM RNA, also designated SEQ ID:246.

Another function of GAM189 is therefore inhibition of LOC283701 (Accession XP_211170.3). Accordingly, utilities of GAM189 include diagnosis, prevention and treatment of diseases and clinical conditions associated with LOC283701.

LOC283723 (Accession XP_211176.1) is another GAM189 target gene, herein designated TARGET GENE. LOC283723 BINDING SITE is a target binding site found in the 5' untranslated region of mRNA encoded by LOC283723, corresponding to a target binding site such as BINDING SITE I, BINDING SITE II or BINDING SITE III of FIG. 8. Table 4 illustrates the complementarity of the nucleotide sequences of LOC283723 BINDING SITE, designated SEQ ID:9256, to the nucleotide sequence of GAM189 RNA, herein designated GAM RNA, also designated SEQ ID:246.

Another function of GAM189 is therefore inhibition of LOC283723 (Accession XP_211176.1). Accordingly, utilities of GAM189 include diagnosis, prevention and treatment of diseases and clinical conditions associated with LOC283723.

LOC283741 (Accession XP_208115.1) is another GAM189 target gene, herein designated TARGET GENE. LOC283741 BINDING SITE is a target binding site found in the 3' untranslated region of mRNA encoded by LOC283741, corresponding to a target binding site such as BINDING SITE I, BINDING SITE II or BINDING SITE III of FIG. 8. Table 4 illustrates the complementarity of the nucleotide sequences of LOC283741 BINDING SITE, designated SEQ ID:11523, to the nucleotide sequence of GAM189 RNA, herein designated GAM RNA, also designated SEQ ID:246.

Another function of GAM189 is therefore inhibition of LOC283741 (Accession XP_208115.1). Accordingly, utilities of GAM189 include diagnosis, prevention and treatment of diseases and clinical conditions associated with LOC283741.

LOC283767 (Accession XP_208835.1) is another GAM189 target gene, herein designated TARGET GENE. LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:12479, to the nucleotide sequence of GAM189 RNA, herein designated GAM RNA, also designated SEQ ID:246.

Another function of GAM189 is therefore inhibition of LOC283767 (Accession XP_208835.1). Accordingly, utilities of GAM189 include diagnosis, prevention and treatment of diseases and clinical conditions associated with LOC283767.

LOC283778 (Accession XP_211199.1) is another GAM189 target gene, herein designated TARGET GENE. LOC283778 BINDING SITE is a target binding site found in the 5' untranslated region of mRNA encoded by LOC283778, corresponding to a target binding site such as BINDING SITE I, BINDING SITE II or BINDING SITE III of FIG. 8. Table 4 illustrates the complementarity of the nucleotide sequences of LOC283778 BINDING SITE, designated SEQ ID:4370, to the nucleotide sequence of GAM189 RNA, herein designated GAM RNA, also designated SEQ ID:246.

Another function of GAM189 is therefore inhibition of LOC283778 (Accession XP_211199.1). Accordingly, utilities of GAM189 include diagnosis, prevention and treatment of diseases and clinical conditions associated with LOC283778.

LOC283779 (Accession XP_211198.1) is another GAM189 target gene, herein designated TARGET GENE. LOC283779 BINDING SITE is a target binding site found in the 3' untranslated region of mRNA encoded by LOC283779, corresponding to a target binding site such as BINDING SITE I, BINDING SITE II or BINDING SITE III of FIG. 8. Table 4 illustrates the complementarity of the nucleotide sequences of LOC283779 BINDING SITE, designated SEQ ID:17644, to the nucleotide sequence of GAM189 RNA, herein designated GAM RNA, also designated SEQ ID:246.

Another function of GAM189 is therefore inhibition of LOC283779 (Accession XP_211198.1). Accordingly, utilities of GAM189 include diagnosis, prevention and treatment of diseases and clinical conditions associated with LOC283779.

LOC283801 (Accession XP_208122.1) is another GAM189 target gene, herein designated TARGET GENE. LOC283801 BINDING SITE is a target binding site found in the 3' untranslated region of mRNA encoded by LOC283801, corresponding to a target binding site such as BINDING SITE I, BINDING SITE II or BINDING SITE III of FIG. 8. Table 4 illustrates the complementarity of the nucleotide sequences of LOC283801 BINDING SITE, designated SEQ ID:6265, to the nucleotide sequence of GAM189 RNA, herein designated GAM RNA, also designated SEQ ID:246.

Another function of GAM189 is therefore inhibition of LOC283801 (Accession XP_208122.1). Accordingly, utilities of GAM189 include diagnosis, prevention and treatment of diseases and clinical conditions associated with LOC283801.

LOC283802 (Accession XP_208850.1) is another GAM189 target gene, herein designated TARGET GENE. LOC283802 BINDING SITE is a target binding site found in the 3' untranslated region of mRNA encoded by LOC283802, corresponding to a target binding site such as BINDING SITE I, BINDING SITE II or BINDING SITE III of FIG. 8. Table 4 illustrates the complementarity of the nucleotide sequences of LOC283802 BINDING SITE, designated SEQ ID:16700, to the nucleotide sequence of GAM189 RNA, herein designated GAM RNA, also designated SEQ ID:246.

Another function of GAM189 is therefore inhibition of LOC283802 (Accession XP_208850.1). Accordingly, utilities of GAM189 include diagnosis, prevention and treatment of diseases and clinical conditions associated with LOC283802.

LOC283818 (Accession XP_211218.1) is another GAM189 target gene, herein designated TARGET GENE. LOC283818 BINDING SITE is a target binding site found in the 3' untranslated region of mRNA encoded by LOC283818, corresponding to a target binding site such as BINDING SITE I, BINDING SITE II or BINDING SITE III of FIG. 8. Table 4 illustrates the complementarity of the nucleotide sequences of LOC283818 BINDING SITE, designated SEQ ID:9546, to the nucleotide sequence of GAM189 RNA, herein designated GAM RNA, also designated SEQ ID:246.

Another function of GAM189 is therefore inhibition of LOC283818 (Accession XP_211218.1). Accordingly, utilities of GAM189 include diagnosis, prevention and treatment of diseases and clinical conditions associated with LOC283818.

LOC283849 (Accession XP_208870.1) is another GAM189 target gene, herein designated TARGET GENE. LOC283849 BINDING SITE is a target binding site found in the 5' untranslated region of multiple transcripts of mRNA encoded by LOC283849, corresponding to a target binding site such as BINDING SITE I, BINDING SITE II or BINDING SITE III of FIG. 8. Table 4 illustrates the complementarity of the nucleotide sequences of LOC283849 BINDING SITE, designated SEQ ID:4308, to the nucleotide sequence of GAM189 RNA, herein designated GAM RNA, also designated SEQ ID:246.

Another function of GAM189 is therefore inhibition of LOC283849 (Accession XP_208870.1). Accordingly, utilities of GAM189 include diagnosis, prevention and treatment of diseases and clinical conditions associated with LOC283849.

LOC283849 (Accession NP_848611.1) is another GAM189 target gene, herein designated TARGET GENE. LOC283849 BINDING SITE is a target binding site found in the 5' untranslated region of multiple transcripts of mRNA encoded by LOC283849, corresponding to a target binding site such as BINDING SITE I, BINDING SITE II or BINDING SITE III of FIG. 8. Table 4 illustrates the complementarity of the nucleotide sequences of LOC283849 BINDING SITE, designated SEQ ID:4308, to the nucleotide sequence of GAM189 RNA, herein designated GAM RNA, also designated SEQ ID:246.

Another function of GAM189 is therefore inhibition of LOC283849 (Accession NP_848611.1). Accordingly, utilities of GAM189 include diagnosis, prevention and treatment of diseases and clinical conditions associated with LOC283849.

LOC283851 (Accession XP_211229.1) is another GAM189 target gene, herein designated TARGET GENE. LOC283851 BINDING SITE is a target binding site found in the 3' untranslated region of mRNA encoded by LOC283851, corresponding to a target binding site such as BINDING SITE I, BINDING SITE II or BINDING SITE III of FIG. 8. Table 4 illustrates the complementarity of the nucleotide sequences of LOC283851 BINDING SITE, designated SEQ ID:4974, to the nucleotide sequence of GAM189 RNA, herein designated GAM RNA, also designated SEQ ID:246.

Another function of GAM189 is therefore inhibition of LOC283851 (Accession XP_211229.1). Accordingly, utilities of GAM189 include diagnosis, prevention and treatment of diseases and clinical conditions associated with LOC283851.

LOC283856 (Accession XP_211233.1) is another GAM189 target gene, herein designated TARGET GENE. LOC283856 BINDING SITE is a target binding site found in the 3' untranslated region of mRNA encoded by LOC283856, corresponding to a target binding site such as BINDING SITE I, BINDING SITE II or BINDING SITE III of FIG. 8. Table 4 illustrates the complementarity of the nucleotide sequences of LOC283856 BINDING SITE, designated SEQ ID:6184, to the nucleotide sequence of GAM189 RNA, herein designated GAM RNA, also designated SEQ ID:246.

Another function of GAM189 is therefore inhibition of LOC283856 (Accession XP_211233.1). Accordingly, utilities of GAM189 include diagnosis, prevention and treatment of diseases and clinical conditions associated with LOC283856.

LOC283861 (Accession NP_787095.1) is another GAM189 target gene, herein designated TARGET GENE. LOC283861 BINDING SITE1 and LOC283861 BINDING SITE2 are target binding sites found in untranslated regions of mRNA encoded by LOC283861, corresponding to target binding sites such as BINDING SITE I, BINDING SITE II or BINDING SITE III of FIG. 8. Table 4 illustrates the complementarity of the nucleotide sequences of LOC283861 BINDING SITE1 and LOC283861 BINDING SITE2, designated SEQ ID:1401 and SEQ ID:1635 respectively, to the nucleotide sequence of GAM189 RNA, herein designated GAM RNA, also designated SEQ ID:246.

Another function of GAM189 is therefore inhibition of LOC283861 (Accession NP_787095.1). Accordingly, utilities of GAM189 include diagnosis, prevention and treatment of diseases and clinical conditions associated with LOC283861.

LOC283863 (Accession XP_208875.1) is another GAM189 target gene, herein designated TARGET GENE. LOC283863 BINDING SITE is a target binding site found in the 3' untranslated region of mRNA encoded by LOC283863, corresponding to a target binding site such as BINDING SITE I, BINDING SITE II or BINDING SITE III of FIG. 8. Table 4 illustrates the complementarity of the nucleotide sequences of LOC283863 BINDING SITE, designated SEQ ID:13285, to the nucleotide sequence of GAM189 RNA, herein designated GAM RNA, also designated SEQ ID:246.

Another function of GAM189 is therefore inhibition of LOC283863 (Accession XP_208875.1). Accordingly, utilities of GAM189 include diagnosis, prevention and treatment of diseases and clinical conditions associated with LOC283863.

LOC283887 (Accession XP_211248.2) is another GAM189 target gene, herein designated TARGET GENE. LOC283887 BINDING SITE is a target binding site found in the 5' untranslated region of mRNA encoded by LOC283887, corresponding to a target binding site such as BINDING SITE I, BINDING SITE II or BINDING SITE III of FIG. 8. Table 4 illustrates the complementarity of the nucleotide sequences of LOC283887 BINDING SITE, designated SEQ ID:18993, to the nucleotide sequence of GAM189 RNA, herein designated GAM RNA, also designated SEQ ID:246.

Another function of GAM189 is therefore inhibition of LOC283887 (Accession XP_211248.2). Accordingly, utilities of GAM189 include diagnosis, prevention and treatment of diseases and clinical conditions associated with LOC283887.

LOC283888 (Accession XP_211249.1) is another GAM189 target gene, herein designated TARGET GENE. LOC283888 BINDING SITE1 and LOC283888 BINDING SITE2 are target binding sites found in untranslated regions of mRNA encoded by LOC283888, corresponding to target binding sites such as BINDING SITE I, BINDING SITE II or BINDING SITE III of FIG. 8. Table 4 illustrates the complementarity of the nucleotide sequences of LOC283888 BINDING SITE1 and LOC283888 BINDING SITE2, designated SEQ ID:14104 and SEQ ID:11072 respectively, to the nucleotide sequence of GAM189 RNA, herein designated GAM RNA, also designated SEQ ID:246.

Another function of GAM189 is therefore inhibition of LOC283888 (Accession XP_211249.1). Accordingly, utilities of GAM189 include diagnosis, prevention and treatment of diseases and clinical conditions associated with LOC283888.

LOC283889 (Accession XP_208899.1) is another GAM189 target gene, herein designated TARGET GENE. LOC283889 BINDING SITE1 and LOC283889 BINDING SITE2 are target binding sites found in untranslated regions of mRNA encoded by LOC283889, corresponding to target binding sites such as BINDING SITE I, BINDING SITE II or BINDING SITE III of FIG. 8. Table 4 illustrates the complementarity of the nucleotide sequences of LOC283889 BINDING SITE1 and LOC283889 BINDING SITE2, designated SEQ ID:10739 and SEQ ID:3899 respectively, to the nucleotide sequence of GAM189 RNA, herein designated GAM RNA, also designated SEQ ID:246.

Another function of GAM189 is therefore inhibition of LOC283889 (Accession XP_208899.1). Accordingly, utilities of GAM189 include diagnosis, prevention and treatment of diseases and clinical conditions associated with LOC283889.

LOC283928 (Accession XP_208909.1) is another GAM189 target gene, herein designated TARGET GENE. LOC283928 BINDING SITE1 and LOC283928 BINDING SITE2 are target binding sites found in untranslated regions of mRNA encoded by LOC283928, corresponding to target binding sites such as BINDING SITE I, BINDING SITE II or BINDING SITE III of FIG. 8. Table 4 illustrates the complementarity of the nucleotide sequences of LOC283928 BINDING SITE1 and LOC283928 BINDING SITE2, designated SEQ ID:20101 and SEQ ID:4703 respectively, to the nucleotide sequence of GAM189 RNA, herein designated GAM RNA, also designated SEQ ID:246.

Another function of GAM189 is therefore inhibition of LOC283928 (Accession XP_208909.1). Accordingly, utilities of GAM189 include diagnosis, prevention and treatment of diseases and clinical conditions associated with LOC283928.

LOC283929 (Accession XP_208905.2) is another GAM189 target gene, herein designated TARGET GENE. LOC283929 BINDING SITE is a target binding site found in the 5' untranslated region of mRNA encoded by LOC283929, corresponding to a target binding site such as BINDING SITE I, BINDING SITE II or BINDING SITE III of FIG. 8. Table 4 illustrates the complementarity of the nucleotide sequences of LOC283929 BINDING SITE, designated SEQ ID:15775, to the nucleotide sequence of GAM189 RNA, herein designated GAM RNA, also designated SEQ ID:246.

Another function of GAM189 is therefore inhibition of LOC283929 (Accession XP_208905.2). Accordingly, utilities of GAM189 include diagnosis, prevention and treatment of diseases and clinical conditions associated with LOC283929.

LOC283964 (Accession XP_208145.2) is another GAM189 target gene, herein designated TARGET GENE. LOC283964 BINDING SITE is a target binding site found in the 3' untranslated region of mRNA encoded by LOC283964, corresponding to a target binding site such as BINDING SITE I, BINDING SITE II or BINDING SITE III of FIG. 8. Table 4 illustrates the complementarity of the nucleotide sequences of LOC283964 BINDING SITE, designated SEQ ID:19569, to the nucleotide sequence of GAM189 RNA, herein designated GAM RNA, also designated SEQ ID:246.

Another function of GAM189 is therefore inhibition of LOC283964 (Accession XP_208145.2). Accordingly, utilities of GAM189 include diagnosis, prevention and treatment of diseases and clinical conditions associated with LOC283964.

LOC284001 (Accession XP_208958.2) is another GAM189 target gene, herein designated TARGET GENE. LOC284001 BINDING SITE1 and LOC284001 BINDING SITE2 are target binding sites found in untranslated regions of mRNA encoded by LOC284001, corresponding to target binding sites such as BINDING SITE I, BINDING SITE II or BINDING SITE III of FIG. 8. Table 4 illustrates the complementarity of the nucleotide sequences of LOC284001 BINDING SITE1 and LOC284001 BINDING SITE2, designated SEQ ID:11764 and SEQ ID:18161 respectively, to the nucleotide sequence of GAM189 RNA, herein designated GAM RNA, also designated SEQ ID:246.

Another function of GAM189 is therefore inhibition of LOC284001 (Accession XP_208958.2). Accordingly, utilities of GAM189 include diagnosis, prevention and treatment of diseases and clinical conditions associated with LOC284001.

LOC284016 (Accession XP_211298.1) is another GAM189 target gene, herein designated TARGET GENE. LOC284016 BINDING SITE is a target binding site found in the 3' untranslated region of mRNA encoded by LOC284016, corresponding to a target binding site such as BINDING SITE I, BINDING SITE II or BINDING SITE III of FIG. 8. Table 4 illustrates the complementarity of the nucleotide sequences of LOC284016 BINDING SITE, designated SEQ ID:3244, to the nucleotide sequence of GAM189 RNA, herein designated GAM RNA, also designated SEQ ID:246.

Another function of GAM189 is therefore inhibition of LOC284016 (Accession XP_211298.1). Accordingly, utilities of GAM189 include diagnosis, prevention and treatment of diseases and clinical conditions associated with LOC284016.

LOC284017 (Accession XP_208961.1) is another GAM189 target gene, herein designated TARGET GENE. LOC284017 BINDING SITE is a target binding site found in the 3' untranslated region of mRNA encoded by LOC284017, corresponding to a target binding site such as BINDING SITE I, BINDING SITE II or BINDING SITE III of FIG. 8. Table 4 illustrates the complementarity of the nucleotide sequences of LOC284017 BINDING SITE, designated SEQ ID:18610, to the nucleotide sequence of GAM189 RNA, herein designated GAM RNA, also designated SEQ ID:246.

Another function of GAM189 is therefore inhibition of LOC284017 (Accession XP_208961.1). Accordingly, utilities of GAM189 include diagnosis, prevention and treatment of diseases and clinical conditions associated with LOC284017.

LOC284019 (Accession XP_211302.1) is another GAM189 target gene, herein designated TARGET GENE. LOC284019 BINDING SITE is a target binding site found in the 3' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:10124, to the nucleotide sequence of GAM189 RNA, herein designated GAM RNA, also designated SEQ ID:246.

Another function of GAM189 is therefore inhibition of LOC284019 (Accession XP_211302.1). Accordingly, utilities of GAM189 include diagnosis, prevention and treatment of diseases and clinical conditions associated with LOC284019.

LOC284023 (Accession XP_208983.3) is another GAM189 target gene, herein designated TARGET GENE. LOC284023 BINDING SITE1 and LOC284023 BINDING SITE2 are target binding sites found in untranslated regions of mRNA encoded by LOC284023, corresponding to target binding sites such as BINDING SITE I, BINDING SITE II or BINDING SITE III of FIG. 8. Table 4 illustrates the complementarity of the nucleotide sequences of LOC284023 BINDING SITE1 and LOC284023 BINDING SITE2, designated SEQ ID:17953 and SEQ ID:14597 respectively, to the nucleotide sequence of GAM189 RNA, herein designated GAM RNA, also designated SEQ ID:246.

Another function of GAM189 is therefore inhibition of LOC284023 (Accession XP_208983.3). Accordingly, utilities of GAM189 include diagnosis, prevention and treatment of diseases and clinical conditions associated with LOC284023.

LOC284048 (Accession XP_208152.1) is another GAM189 target gene, herein designated TARGET GENE. LOC284048 BINDING SITE is a target binding site found in the 3' untranslated region of mRNA encoded by LOC284048, corresponding to a target binding site such as BINDING SITE I, BINDING SITE II or BINDING SITE III of FIG. 8. Table 4 illustrates the complementarity of the nucleotide sequences of LOC284048 BINDING SITE, designated SEQ ID:10847, to the nucleotide sequence of GAM189 RNA, herein designated GAM RNA, also designated SEQ ID:246.

Another function of GAM189 is therefore inhibition of LOC284048 (Accession XP_208152.1). Accordingly, utilities of GAM189 include diagnosis, prevention and treatment of diseases and clinical conditions associated with LOC284048.

LOC284074 (Accession XP_211321.1) is another GAM189 target gene, herein designated TARGET GENE. LOC284074 BINDING SITE1 and LOC284074 BINDING SITE2 are target binding sites found in untranslated regions of mRNA encoded by LOC284074, corresponding to target binding sites such as BINDING SITE I, BINDING SITE II or BINDING SITE III of FIG. 8. Table 4 illustrates the complementarity of the nucleotide sequences of LOC284074 BINDING SITE1 and LOC284074 BINDING SITE2, designated SEQ ID:15531 and SEQ ID:1596 respectively, to the nucleotide sequence of GAM189 RNA, herein designated GAM RNA, also designated SEQ ID:246.

Another function of GAM189 is therefore inhibition of LOC284074 (Accession XP_211321.1). Accordingly, utilities of GAM189 include diagnosis, prevention and treatment of diseases and clinical conditions associated with LOC284074.

LOC284082 (Accession XP_211323.1) is another GAM189 target gene, herein designated TARGET GENE. LOC284082 BINDING SITE is a target binding site found in the 3' untranslated region of mRNA encoded by LOC284082, corresponding to a target binding site such as BINDING SITE I, BINDING SITE II or BINDING SITE III of FIG. 8. Table 4 illustrates the complementarity of the nucleotide sequences of LOC284082 BINDING SITE, designated SEQ ID:18527, to the nucleotide sequence of GAM189 RNA, herein designated GAM RNA, also designated SEQ ID:246.

Another function of GAM189 is therefore inhibition of LOC284082 (Accession XP_211323.1). Accordingly, utilities of GAM189 include diagnosis, prevention and treatment of diseases and clinical conditions associated with LOC284082.

LOC284095 (Accession XP_211324.1) is another GAM189 target gene, herein designated TARGET GENE. LOC284095 BINDING SITE1 through LOC284095 BINDING SITE3 are target binding sites found in untranslated regions of mRNA encoded by LOC284095, corresponding to target binding sites such as BINDING SITE I, BINDING SITE II or BINDING SITE III of FIG. 8. Table 4 illustrates the complementarity of the nucleotide sequences of LOC284095 BINDING SITE1 through LOC284095 BINDING SITE3, designated SEQ ID:15513, SEQ ID:11799 and SEQ ID:7333 respectively, to the nucleotide sequence of GAM189 RNA, herein designated GAM RNA, also designated SEQ ID:246.

Another function of GAM189 is therefore inhibition of LOC284095 (Accession XP_211324.1). Accordingly, utilities of GAM189 include diagnosis, prevention and treatment of diseases and clinical conditions associated with LOC284095.

LOC284098 (Accession XP_209008.3) is another GAM189 target gene, herein designated TARGET GENE. LOC284098 BINDING SITE is a target binding site found in the 3' untranslated region of mRNA encoded by LOC284098, corresponding to a target binding site such as BINDING SITE I, BINDING SITE II or BINDING SITE III of FIG. 8. Table 4 illustrates the complementarity of the nucleotide sequences of LOC284098 BINDING SITE, designated SEQ ID:8582, to the nucleotide sequence of GAM189 RNA, herein designated GAM RNA, also designated SEQ ID:246.

Another function of GAM189 is therefore inhibition of LOC284098 (Accession XP_209008.3). Accordingly, utilities of GAM189 include diagnosis, prevention and treatment of diseases and clinical conditions associated with LOC284098.

LOC284100 (Accession XP_209015.1) is another GAM189 target gene, herein designated TARGET GENE. LOC284100 BINDING SITE is a target binding site found in the 3' untranslated region of mRNA encoded by LOC284100, corresponding to a target binding site such as BINDING SITE I, BINDING SITE II or BINDING SITE III of FIG. 8. Table 4 illustrates the complementarity of the nucleotide sequences of LOC284100 BINDING SITE, designated SEQ ID:1777, to the nucleotide sequence of GAM189 RNA, herein designated GAM RNA, also designated SEQ ID:246.

Another function of GAM189 is therefore inhibition of LOC284100 (Accession XP_209015.1). Accordingly, utilities of GAM189 include diagnosis, prevention and treatment of diseases and clinical conditions associated with LOC284100.

LOC284101 (Accession XP_209019.1) is another GAM189 target gene, herein designated TARGET GENE. LOC284101 BINDING SITE is a target binding site found in the 5' untranslated region of mRNA encoded by LOC284101, corresponding to a target binding site such as BINDING SITE I, BINDING SITE II or BINDING SITE III of FIG. 8. Table 4 illustrates the complementarity of the nucleotide sequences of LOC284101 BINDING SITE, designated SEQ ID:19537, to the nucleotide sequence of GAM189 RNA, herein designated GAM RNA, also designated SEQ ID:246.

Another function of GAM189 is therefore inhibition of LOC284101 (Accession XP_209019.1). Accordingly, utilities of GAM189 include diagnosis, prevention and treatment of diseases and clinical conditions associated with LOC284101.

LOC284102 (Accession XP_211327.3) is another GAM189 target gene, herein designated TARGET GENE. LOC284102 BINDING SITE1 through LOC284102 BINDING SITE3 are target binding sites found in untranslated regions of mRNA encoded by LOC284102, corresponding to target binding sites such as BINDING SITE I, BINDING SITE II or BINDING SITE III of FIG. 8. Table 4 illustrates the complementarity of the nucleotide sequences of LOC284102 BINDING SITE1 through LOC284102 BINDING SITE3, designated SEQ ID:7745, SEQ ID:18149 and SEQ ID:3233 respectively, to the nucleotide sequence of GAM189 RNA, herein designated GAM RNA, also designated SEQ ID:246.

Another function of GAM189 is therefore inhibition of LOC284102 (Accession XP_211327.3). Accordingly, utilities of GAM189 include diagnosis, prevention and treatment of diseases and clinical conditions associated with LOC284102.

LOC284128 (Accession XP_211342.1) is another GAM189 target gene, herein designated TARGET GENE. LOC284128 BINDING SITE1 and LOC284128 BINDING SITE2 are target binding sites found in untranslated regions of mRNA encoded by LOC284128, corresponding to target binding sites such as BINDING SITE I, BINDING SITE II or BINDING SITE III of FIG. 8. Table 4 illustrates the complementarity of the nucleotide sequences of LOC284128 BINDING SITE1 and LOC284128 BINDING SITE2, designated SEQ ID:17271 and SEQ ID:1966 respectively, to the nucleotide sequence of GAM189 RNA, herein designated GAM RNA, also designated SEQ ID:246.

Another function of GAM189 is therefore inhibition of LOC284128 (Accession XP_211342.1). Accordingly, utilities of GAM189 include diagnosis, prevention and treatment of diseases and clinical conditions associated with LOC284128.

LOC284135 (Accession XP_209032.1) is another GAM189 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:12779, to the nucleotide sequence of GAM189 RNA, herein designated GAM RNA, also designated SEQ ID:246.

Another function of GAM189 is therefore inhibition of LOC284135 (Accession XP_209032.1). Accordingly, utilities of GAM189 include diagnosis, prevention and treatment of diseases and clinical conditions associated with LOC284135.

LOC284145 (Accession XP_211353.1) is another GAM189 target gene, herein designated TARGET GENE. LOC284145 BINDING SITE is a target binding site found in the 5' untranslated region of mRNA encoded by LOC284145, corresponding to a target binding site such as BINDING SITE I, BINDING SITE II or BINDING SITE III of FIG. 8. Table 4 illustrates the complementarity of the nucleotide sequences of LOC284145 BINDING SITE, designated SEQ ID:4102, to the nucleotide sequence of GAM189 RNA, herein designated GAM RNA, also designated SEQ ID:246.

Another function of GAM189 is therefore inhibition of LOC284145 (Accession XP_211353.1). Accordingly, utilities of GAM189 include diagnosis, prevention and treatment of diseases and clinical conditions associated with LOC284145.

LOC284171 (Accession XP_209051.1) is another GAM189 target gene, herein designated TARGET GENE. LOC284171 BINDING SITE is a target binding site found in the 3' untranslated region of mRNA encoded by LOC284171, corresponding to a target binding site such as BINDING SITE I, BINDING SITE II or BINDING SITE III of FIG. 8. Table 4 illustrates the complementarity of the nucleotide sequences of LOC284171 BINDING SITE, designated SEQ ID:11530, to the nucleotide sequence of GAM189 RNA, herein designated GAM RNA, also designated SEQ ID:246.

Another function of GAM189 is therefore inhibition of LOC284171 (Accession XP_209051.1). Accordingly, utilities of GAM189 include diagnosis, prevention and treatment of diseases and clinical conditions associated with LOC284171.

LOC284183 (Accession XP_209059.1) is another GAM189 target gene, herein designated TARGET GENE. LOC284183 BINDING SITE1 and LOC284183 BINDING SITE2 are target binding sites found in untranslated regions of mRNA encoded by LOC284183, corresponding to target binding sites such as BINDING SITE I, BINDING SITE II or BINDING SITE III of FIG. 8. Table 4 illustrates the complementarity of the nucleotide sequences of LOC284183 BINDING SITE1 and LOC284183 BINDING SITE2, designated SEQ ID:1111 and SEQ ID:9456 respectively, to the nucleotide sequence of GAM189 RNA, herein designated GAM RNA, also designated SEQ ID:246.

Another function of GAM189 is therefore inhibition of LOC284183 (Accession XP_209059.1). Accordingly, utilities of GAM189 include diagnosis, prevention and treatment of diseases and clinical conditions associated with LOC284183.

LOC284186 (Accession XP_209060.2) is another GAM189 target gene, herein designated TARGET GENE. LOC284186 BINDING SITE is a target binding site found in the 3' untranslated region of mRNA encoded by LOC284186, corresponding to a target binding site such as BINDING SITE I, BINDING SITE II or BINDING SITE III of FIG. 8. Table 4 illustrates the complementarity of the nucleotide sequences of LOC284186 BINDING SITE, designated SEQ ID:14861, to the nucleotide sequence of GAM189 RNA, herein designated GAM RNA, also designated SEQ ID:246.

Another function of GAM189 is therefore inhibition of LOC284186 (Accession XP_209060.2). Accordingly, utilities of GAM189 include diagnosis, prevention and treatment of diseases and clinical conditions associated with LOC284186.

LOC284191 (Accession XP_211377.1) is another GAM189 target gene, herein designated TARGET GENE. LOC284191 BINDING SITE is a target binding site found in the 5' untranslated region of mRNA encoded by LOC284191, corresponding to a target binding site such as BINDING SITE I, BINDING SITE II or BINDING SITE III of FIG. 8. Table 4 illustrates the complementarity of the nucleotide sequences of LOC284191 BINDING SITE, designated SEQ ID:4421, to the nucleotide sequence of GAM189 RNA, herein designated GAM RNA, also designated SEQ ID:246.

Another function of GAM189 is therefore inhibition of LOC284191 (Accession XP_211377.1). Accordingly, utilities of GAM189 include diagnosis, prevention and treatment of diseases and clinical conditions associated with LOC284191.

LOC284202 (Accession XP_208174.2) is another GAM189 target gene, herein designated TARGET GENE. LOC284202 BINDING SITE is a target binding site found in the 3' untranslated region of mRNA encoded by LOC284202, corresponding to a target binding site such as BINDING SITE I, BINDING SITE II or BINDING SITE III of FIG. 8. Table 4 illustrates the complementarity of the nucleotide sequences of LOC284202 BINDING SITE, designated SEQ ID:3800, to the nucleotide sequence of GAM189 RNA, herein designated GAM RNA, also designated SEQ ID:246.

Another function of GAM189 is therefore inhibition of LOC284202 (Accession XP_208174.2). Accordingly, utilities of GAM189 include diagnosis, prevention and treatment of diseases and clinical conditions associated with LOC284202.

LOC284267 (Accession XP_211411.1) is another GAM189 target gene, herein designated TARGET GENE. LOC284267 BINDING SITE is a target binding site found in the 5' untranslated region of mRNA encoded by LOC284267, corresponding to a target binding site such as BINDING SITE I, BINDING SITE II or BINDING SITE III of FIG. 8. Table 4 illustrates the complementarity of the nucleotide sequences of LOC284267 BINDING SITE, designated SEQ ID:8494, to the nucleotide sequence of GAM189 RNA, herein designated GAM RNA, also designated SEQ ID:246.

Another function of GAM189 is therefore inhibition of LOC284267 (Accession XP_211411.1). Accordingly, utilities of GAM189 include diagnosis, prevention and treatment of diseases and clinical conditions associated with LOC284267.

LOC284276 (Accession XP_211412.1) is another GAM189 target gene, herein designated TARGET GENE. LOC284276 BINDING SITE is a target binding site found in the 5' untranslated region of mRNA encoded by LOC284276, corresponding to a target binding site such as BINDING SITE I, BINDING SITE II or BINDING SITE III of FIG. 8. Table 4 illustrates the complementarity of the nucleotide sequences of LOC284276 BINDING SITE, designated SEQ ID:1026, to the nucleotide sequence of GAM189 RNA, herein designated GAM RNA, also designated SEQ ID:246.

Another function of GAM189 is therefore inhibition of LOC284276 (Accession XP_211412.1). Accordingly, utilities of GAM189 include diagnosis, prevention and treatment of diseases and clinical conditions associated with LOC284276.

LOC284286 (Accession XP_211419.1) is another GAM189 target gene, herein designated TARGET GENE. LOC284286 BINDING SITE is a target binding site found in the 3' untranslated region of mRNA encoded by LOC284286, corresponding to a target binding site such as BINDING SITE I, BINDING SITE II or BINDING SITE III of FIG. 8. Table 4 illustrates the complementarity of the nucleotide sequences of LOC284286 BINDING SITE, designated SEQ ID:19875, to the nucleotide sequence of GAM189 RNA, herein designated GAM RNA, also designated SEQ ID:246.

Another function of GAM189 is therefore inhibition of LOC284286 (Accession XP_211419.1). Accordingly, utilities of GAM189 include diagnosis, prevention and treatment of diseases and clinical conditions associated with LOC284286.

LOC284289 (Accession XP_209105.1) is another GAM189 target gene, herein designated TARGET GENE. LOC284289 BINDING SITE1 and LOC284289 BINDING SITE2 are target binding sites found in untranslated regions of mRNA encoded by LOC284289, corresponding to target binding sites such as BINDING SITE I, BINDING SITE II or BINDING SITE III of FIG. 8. Table 4 illustrates the complementarity of the nucleotide sequences of LOC284289 BINDING SITE1 and LOC284289 BINDING SITE2, designated SEQ ID:16648 and SEQ ID:1885 respectively, to the nucleotide sequence of GAM189 RNA, herein designated GAM RNA, also designated SEQ ID:246.

Another function of GAM189 is therefore inhibition of LOC284289 (Accession XP_209105.1). Accordingly, utilities of GAM189 include diagnosis, prevention and treatment of diseases and clinical conditions associated with LOC284289.

LOC284297 (Accession XP_209112.1) is another GAM189 target gene, herein designated TARGET GENE. LOC284297 BINDING SITE is a target binding site found in the 3' untranslated region of mRNA encoded by LOC284297, corresponding to a target binding site such as BINDING SITE I, BINDING SITE II or BINDING SITE III of FIG. 8. Table 4 illustrates the complementarity of the nucleotide sequences of LOC284297 BINDING SITE, designated SEQ ID:1751, to the nucleotide sequence of GAM189 RNA, herein designated GAM RNA, also designated SEQ ID:246.

Another function of GAM189 is therefore inhibition of LOC284297 (Accession XP_209112.1). Accordingly, utilities of GAM189 include diagnosis, prevention and treatment of diseases and clinical conditions associated with LOC284297.

LOC284304 (Accession XP_211426.1) is another GAM189 target gene, herein designated TARGET GENE. LOC284304 BINDING SITE is a target binding site found in the 3' untranslated region of mRNA encoded by LOC284304, corresponding to a target binding site such as BINDING SITE I, BINDING SITE II or BINDING SITE III of FIG. 8. Table 4 illustrates the complementarity of the nucleotide sequences of LOC284304 BINDING SITE, designated SEQ ID:4849, to the nucleotide sequence of GAM189 RNA, herein designated GAM RNA, also designated SEQ ID:246.

Another function of GAM189 is therefore inhibition of LOC284304 (Accession XP_211426.1). Accordingly, utilities of GAM189 include diagnosis, prevention and treatment of diseases and clinical conditions associated with LOC284304.

LOC284317 (Accession XP_209162.1) is another GAM189 target gene, herein designated TARGET GENE. LOC284317 BINDING SITE1 and LOC284317 BINDING SITE2 are target binding sites found in untranslated regions of mRNA encoded by LOC284317, corresponding to target binding sites such as BINDING SITE I, BINDING SITE II or BINDING SITE III of FIG. 8. Table 4 illustrates the complementarity of the nucleotide sequences of LOC284317 BINDING SITE1 and LOC284317 BINDING SITE2, designated SEQ ID:7077 and SEQ ID:3386 respectively, to the nucleotide sequence of GAM189 RNA, herein designated GAM RNA, also designated SEQ ID:246.

Another function of GAM189 is therefore inhibition of LOC284317 (Accession XP_209162.1). Accordingly, utilities of GAM189 include diagnosis, prevention and treatment of diseases and clinical conditions associated with LOC284317.

LOC284325 (Accession XP_209143.1) is another GAM189 target gene, herein designated TARGET GENE. LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:1731, to the nucleotide sequence of GAM189 RNA, herein designated GAM RNA, also designated SEQ ID:246.

Another function of GAM189 is therefore inhibition of LOC284325 (Accession XP_209143.1). Accordingly, utilities of GAM189 include diagnosis, prevention and treatment of diseases and clinical conditions associated with LOC284325.

LOC284356 (Accession XP_211437.1) is another GAM189 target gene, herein designated TARGET GENE. LOC284356 BINDING SITE is a target binding site found in the 3' untranslated region of mRNA encoded by LOC284356, corresponding to a target binding site such as BINDING SITE I, BINDING SITE II or BINDING SITE III of FIG. 8. Table 4 illustrates the complementarity of the nucleotide sequences of LOC284356 BINDING SITE, designated SEQ ID:11986, to the nucleotide sequence of GAM189 RNA, herein designated GAM RNA, also designated SEQ ID:246.

Another function of GAM189 is therefore inhibition of LOC284356 (Accession XP_211437.1). Accordingly, utilities of GAM189 include diagnosis, prevention and treatment of diseases and clinical conditions associated with LOC284356.

LOC284362 (Accession XP_211435.1) is another GAM189 target gene, herein designated TARGET GENE. LOC284362 BINDING SITE is a target binding site found in the 3' untranslated region of mRNA encoded by LOC284362, corresponding to a target binding site such as BINDING SITE I, BINDING SITE II or BINDING SITE III of FIG. 8. Table 4 illustrates the complementarity of the nucleotide sequences of LOC284362 BINDING SITE, designated SEQ ID:18898, to the nucleotide sequence of GAM189 RNA, herein designated GAM RNA, also designated SEQ ID:246.

Another function of GAM189 is therefore inhibition of LOC284362 (Accession XP_211435.1). Accordingly, utilities of GAM189 include diagnosis, prevention and treatment of diseases and clinical conditions associated with LOC284362.

LOC284375 (Accession XP_209154.1) is another GAM189 target gene, herein designated TARGET GENE. LOC284375 BINDING SITE is a target binding site found in the 3' untranslated region of mRNA encoded by LOC284375, corresponding to a target binding site such as BINDING SITE I, BINDING SITE II or BINDING SITE III of FIG. 8. Table 4 illustrates the complementarity of the nucleotide sequences of LOC284375 BINDING SITE, designated SEQ ID:16701, to the nucleotide sequence of GAM189 RNA, herein designated GAM RNA, also designated SEQ ID:246.

Another function of GAM189 is therefore inhibition of LOC284375 (Accession XP_209154.1). Accordingly, utilities of GAM189 include diagnosis, prevention and treatment of diseases and clinical conditions associated with LOC284375.

LOC284376 (Accession XP_209157.1) is another GAM189 target gene, herein designated TARGET GENE. LOC284376 BINDING SITE is a target binding site found in the 3' untranslated region of mRNA encoded by LOC284376, corresponding to a target binding site such as BINDING SITE I, BINDING SITE II or BINDING SITE III of FIG. 8. Table 4 illustrates the complementarity of the nucleotide sequences of LOC284376 BINDING SITE, designated SEQ ID:19718, to the nucleotide sequence of GAM189 RNA, herein designated GAM RNA, also designated SEQ ID:246.

Another function of GAM189 is therefore inhibition of LOC284376 (Accession XP_209157.1). Accordingly, utilities of GAM189 include diagnosis, prevention and treatment of diseases and clinical conditions associated with LOC284376.

LOC284379 (Accession XP_209163.1) is another GAM189 target gene, herein designated TARGET GENE. LOC284379 BINDING SITE is a target binding site found in the 3' untranslated region of mRNA encoded by LOC284379, corresponding to a target binding site such as BINDING SITE I, BINDING SITE II or BINDING SITE III of FIG. 8. Table 4 illustrates the complementarity of the nucleotide sequences of LOC284379 BINDING SITE, designated SEQ ID:9312, to the nucleotide sequence of GAM189 RNA, herein designated GAM RNA, also designated SEQ ID:246.

Another function of GAM189 is therefore inhibition of LOC284379 (Accession XP_209163.1). Accordingly, utilities of GAM189 include diagnosis, prevention and treatment of diseases and clinical conditions associated with LOC284379.

LOC284395 (Accession XP_211454.1) is another GAM189 target gene, herein designated TARGET GENE. LOC284395 BINDING SITE is a target binding site found in the 5' untranslated region of mRNA encoded by LOC284395, corresponding to a target binding site such as BINDING SITE I, BINDING SITE II or BINDING SITE III of FIG. 8. Table 4 illustrates the complementarity of the nucleotide sequences of LOC284395 BINDING SITE, designated SEQ ID:16459, to the nucleotide sequence of GAM189 RNA, herein designated GAM RNA, also designated SEQ ID:246.

Another function of GAM189 is therefore inhibition of LOC284395 (Accession XP_211454.1). Accordingly, utilities of GAM189 include diagnosis, prevention and treatment of diseases and clinical conditions associated with LOC284395.

LOC284396 (Accession XP_211452.1) is another GAM189 target gene, herein designated TARGET GENE. LOC284396 BINDING SITE is a target binding site found in the 3' untranslated region of mRNA encoded by LOC284396, corresponding to a target binding site such as BINDING SITE I, BINDING SITE II or BINDING SITE III of FIG. 8. Table 4 illustrates the complementarity of the nucleotide sequences of LOC284396 BINDING SITE, designated SEQ ID:10399, to the nucleotide sequence of GAM189 RNA, herein designated GAM RNA, also designated SEQ ID:246.

Another function of GAM189 is therefore inhibition of LOC284396 (Accession XP_211452.1). Accordingly, utilities of GAM189 include diagnosis, prevention and treatment of diseases and clinical conditions associated with LOC284396.

LOC284405 (Accession XP_209183.2) is another GAM189 target gene, herein designated TARGET GENE. LOC284405 BINDING SITE1 and LOC284405 BINDING SITE2 are target binding sites found in untranslated regions of mRNA encoded by LOC284405, corresponding to target binding sites such as BINDING SITE I, BINDING SITE II or BINDING SITE III of FIG. 8. Table 4 illustrates the complementarity of the nucleotide sequences of LOC284405 BINDING SITE1 and LOC284405 BINDING SITE2, designated SEQ ID:19462 and SEQ ID:2645 respectively, to the nucleotide sequence of GAM189 RNA, herein designated GAM RNA, also designated SEQ ID:246.

Another function of GAM189 is therefore inhibition of LOC284405 (Accession XP_209183.2). Accordingly, utilities of GAM189 include diagnosis, prevention and treatment of diseases and clinical conditions associated with LOC284405.

LOC284408 (Accession XP_211443.1) is another GAM189 target gene, herein designated TARGET GENE. LOC284408 BINDING SITE is a target binding site found in the 5' untranslated region of mRNA encoded by LOC284408, corresponding to a target binding site such as BINDING SITE I, BINDING SITE II or BINDING SITE III of FIG. 8. Table 4 illustrates the complementarity of the nucleotide sequences of LOC284408 BINDING SITE, designated SEQ ID:14364, to the nucleotide sequence of GAM189 RNA, herein designated GAM RNA, also designated SEQ ID:246.

Another function of GAM189 is therefore inhibition of LOC284408 (Accession XP_211443.1). Accordingly, utilities of GAM189 include diagnosis, prevention and treatment of diseases and clinical conditions associated with LOC284408.

LOC284410 (Accession XP_211449.1) is another GAM189 target gene, herein designated TARGET GENE. LOC284410 BINDING SITE is a target binding site found in the 3' untranslated region of mRNA encoded by LOC284410, corresponding to a target binding site such as BINDING SITE I, BINDING SITE II or BINDING SITE III of FIG. 8. Table 4 illustrates the complementarity of the nucleotide sequences of LOC284410 BINDING SITE, designated SEQ ID:17304, to the nucleotide sequence of GAM189 RNA, herein designated GAM RNA, also designated SEQ ID:246.

Another function of GAM189 is therefore inhibition of LOC284410 (Accession XP_211449.1). Accordingly, utilities of GAM189 include diagnosis, prevention and treatment of diseases and clinical conditions associated with LOC284410.

LOC284421 (Accession XP_209200.1) is another GAM189 target gene, herein designated TARGET GENE. LOC284421 BINDING SITE1 and LOC284421 BINDING SITE2 are target binding sites found in untranslated regions of mRNA encoded by LOC284421, corresponding to target binding sites such as BINDING SITE I, BINDING SITE II or BINDING SITE III of FIG. 8. Table 4 illustrates the complementarity of the nucleotide sequences of LOC284421 BINDING SITE1 and LOC284421 BINDING SITE2, designated SEQ ID:4533 and SEQ ID:15844 respectively, to the nucleotide sequence of GAM189 RNA, herein designated GAM RNA, also designated SEQ ID:246.

Another function of GAM189 is therefore inhibition of LOC284421 (Accession XP_209200.1). Accordingly, utilities of GAM189 include diagnosis, prevention and treatment of diseases and clinical conditions associated with LOC284421.

LOC284421 (Accession XP_209200.1) is another GAM189 target gene, herein designated TARGET GENE. LOC284421 BINDING SITE1 and LOC284421 BINDING SITE2 are target binding sites found in untranslated regions of mRNA encoded by LOC284421, corresponding to target binding sites such as BINDING SITE I, BINDING SITE II or BINDING SITE III of FIG. 8. Table 4 illustrates the complementarity of the nucleotide sequences of LOC284421 BINDING SITE1 and LOC284421 BINDING SITE2, designated SEQ ID:15844 and SEQ ID:4975 respectively, to the nucleotide sequence of GAM189 RNA, herein designated GAM RNA, also designated SEQ ID:246.

Another function of GAM189 is therefore inhibition of LOC284421 (Accession XP_209200.1). Accordingly, utilities of GAM189 include diagnosis, prevention and treatment of diseases and clinical conditions associated with LOC284421.

LOC284426 (Accession XP_209198.1) is another GAM189 target gene, herein designated TARGET GENE. LOC284426 BINDING SITE1 through LOC284426 BINDING SITE3 are target binding sites found in untranslated regions of mRNA encoded by LOC284426, corresponding to target binding sites such as BINDING SITE I, BINDING SITE II or BINDING SITE III of FIG. 8. Table 4 illustrates the complementarity of the nucleotide sequences of LOC284426 BINDING SITE1 through LOC284426 BINDING SITE3, designated SEQ ID:5357, SEQ ID:13177 and SEQ ID:8752 respectively, to the nucleotide sequence of GAM189 RNA, herein designated GAM RNA, also designated SEQ ID:246.

Another function of GAM189 is therefore inhibition of LOC284426 (Accession XP_209198.1). Accordingly, utilities of GAM189 include diagnosis, prevention and treatment of diseases and clinical conditions associated with LOC284426.

LOC284454 (Accession XP_209216.1) is another GAM189 target gene, herein designated TARGET GENE. LOC284454 BINDING SITE1 through LOC284454 BINDING SITE3 are target binding sites found in untranslated regions of mRNA encoded by LOC284454, corresponding to target binding sites such as BINDING SITE I, BINDING SITE II or BINDING SITE III of FIG. 8. Table 4 illustrates the complementarity of the nucleotide sequences of LOC284454 BINDING SITE1 through LOC284454 BINDING SITE3, designated SEQ ID:3999, SEQ ID:19117 and SEQ ID:16031 respectively, to the nucleotide sequence of GAM189 RNA, herein designated GAM RNA, also designated SEQ ID:246.

Another function of GAM189 is therefore inhibition of LOC284454 (Accession XP_209216.1). Accordingly, utilities of GAM189 include diagnosis, prevention and treatment of diseases and clinical conditions associated with LOC284454.

LOC284456 (Accession XP_211470.1) is another GAM189 target gene, herein designated TARGET GENE. LOC284456 BINDING SITE is a target binding site found in the 3' untranslated region of mRNA encoded by LOC284456, corresponding to a target binding site such as BINDING SITE I, BINDING SITE II or BINDING SITE III of FIG. 8. Table 4 illustrates the complementarity of the nucleotide sequences of LOC284456 BINDING SITE, designated SEQ ID:18777, to the nucleotide sequence of GAM189 RNA, herein designated GAM RNA, also designated SEQ ID:246.

Another function of GAM189 is therefore inhibition of LOC284456 (Accession XP_211470.1). Accordingly, utilities of GAM189 include diagnosis, prevention and treatment of diseases and clinical conditions associated with LOC284456.

LOC284471 (Accession XP_209225.1) is another GAM189 target gene, herein designated TARGET GENE. LOC284471 BINDING SITE is a target binding site found in the 3' untranslated region of mRNA encoded by LOC284471, corresponding to a target binding site such as BINDING SITE I, BINDING SITE II or BINDING SITE III of FIG. 8. Table 4 illustrates the complementarity of the nucleotide sequences of LOC284471 BINDING SITE, designated SEQ ID:19286, to the nucleotide sequence of GAM189 RNA, herein designated GAM RNA, also designated SEQ ID:246.

Another function of GAM189 is therefore inhibition of LOC284471 (Accession XP_209225.1). Accordingly, utilities of GAM189 include diagnosis, prevention and treatment of diseases and clinical conditions associated with LOC284471.

LOC284512 (Accession XP_211500.1) is another GAM189 target gene, herein designated TARGET GENE. LOC284512 BINDING SITE is a target binding site found in the 3' untranslated region of mRNA encoded by LOC284512, corresponding to a target binding site such as BINDING SITE I, BINDING SITE II or BINDING SITE III of FIG. 8. Table 4 illustrates the complementarity of the nucleotide sequences of LOC284512 BINDING SITE, designated SEQ ID:14119, to the nucleotide sequence of GAM189 RNA, herein designated GAM RNA, also designated SEQ ID:246.

Another function of GAM189 is therefore inhibition of LOC284512 (Accession XP_211500.1). Accordingly, utilities of GAM189 include diagnosis, prevention and treatment of diseases and clinical conditions associated with LOC284512.

LOC284513 (Accession XP_211502.1) is another GAM189 target gene, herein designated TARGET GENE. LOC284513 BINDING SITE is a target binding site found in the 5' untranslated region of mRNA encoded by LOC284513, corresponding to a target binding site such as BINDING SITE I, BINDING SITE II or BINDING SITE III of FIG. 8. Table 4 illustrates the complementarity of the nucleotide sequences of LOC284513 BINDING SITE, designated SEQ ID:18865, to the nucleotide sequence of GAM189 RNA, herein designated GAM RNA, also designated SEQ ID:246.

Another function of GAM189 is therefore inhibition of LOC284513 (Accession XP_211502.1). Accordingly, utilities of GAM189 include diagnosis, prevention and treatment of diseases and clinical conditions associated with LOC284513.

LOC284549 (Accession XP_211514.1) is another GAM189 target gene, herein designated TARGET GENE. LOC284549 BINDING SITE is a target binding site found in the 5' untranslated region of mRNA encoded by LOC284549, corresponding to a target binding site such as BINDING SITE I, BINDING SITE II or BINDING SITE III of FIG. 8. Table 4 illustrates the complementarity of the nucleotide sequences of LOC284549 BINDING SITE, designated SEQ ID:19112, to the nucleotide sequence of GAM189 RNA, herein designated GAM RNA, also designated SEQ ID:246.

Another function of GAM189 is therefore inhibition of LOC284549 (Accession XP_211514.1). Accordingly, utilities of GAM189 include diagnosis, prevention and treatment of diseases and clinical conditions associated with LOC284549.

LOC284551 (Accession XP_211515.1) is another GAM189 target gene, herein designated TARGET GENE. LOC284551 BINDING SITE is a target binding site found in the 3' untranslated region of mRNA encoded by LOC284551, corresponding to a target binding site such as BINDING SITE I, BINDING SITE II or BINDING SITE III of FIG. 8. Table 4 illustrates the complementarity of the nucleotide sequences of LOC284551 BINDING SITE, designated SEQ ID:9493, to the nucleotide sequence of GAM189 RNA, herein designated GAM RNA, also designated SEQ ID:246.

Another function of GAM189 is therefore inhibition of LOC284551 (Accession XP_211515.1). Accordingly, utilities of GAM189 include diagnosis, prevention and treatment of diseases and clinical conditions associated with LOC284551.

LOC284577 (Accession XP_211522.1) is another GAM189 target gene, herein designated TARGET GENE. LOC284577 BINDING SITE is a target binding site found in the 3' untranslated region of mRNA encoded by LOC284577, corresponding to a target binding site such as BINDING SITE I, BINDING SITE II or BINDING SITE III of FIG. 8. Table 4 illustrates the complementarity of the nucleotide sequences of LOC284577 BINDING SITE, designated SEQ ID:19533, to the nucleotide sequence of GAM189 RNA, herein designated GAM RNA, also designated SEQ ID:246.

Another function of GAM189 is therefore inhibition of LOC284577 (Accession XP_211522.1). Accordingly, utilities of GAM189 include diagnosis, prevention and treatment of diseases and clinical conditions associated with LOC284577.

LOC284587 (Accession XP_209278.3) is another GAM189 target gene, herein designated TARGET GENE. LOC284587 BINDING SITE is a target binding site found in the 5' untranslated region of mRNA encoded by LOC284587, corresponding to a target binding site such as BINDING SITE I, BINDING SITE II or BINDING SITE III of FIG. 8. Table 4 illustrates the complementarity of the nucleotide sequences of LOC284587 BINDING SITE, designated SEQ ID:12803, to the nucleotide sequence of GAM189 RNA, herein designated GAM RNA, also designated SEQ ID:246.

Another function of GAM189 is therefore inhibition of LOC284587 (Accession XP_209278.3). Accordingly, utilities of GAM189 include diagnosis, prevention and treatment of diseases and clinical conditions associated with LOC284587.

LOC284611 (Accession XP_211552.1) is another GAM189 target gene, herein designated TARGET GENE. LOC284611 BINDING SITE is a target binding site found in the 3' untranslated region of mRNA encoded by LOC284611, corresponding to a target binding site such as BINDING SITE I, BINDING SITE II or BINDING SITE III of FIG. 8. Table 4 illustrates the complementarity of the nucleotide sequences of LOC284611 BINDING SITE, designated SEQ ID:12497, to the nucleotide sequence of GAM189 RNA, herein designated GAM RNA, also designated SEQ ID:246.

Another function of GAM189 is therefore inhibition of LOC284611 (Accession XP_211552.1). Accordingly, utilities of GAM189 include diagnosis, prevention and treatment of diseases and clinical conditions associated with LOC284611.

LOC284628 (Accession XP_211561.1) is another GAM189 target gene, herein designated TARGET GENE. LOC284628 BINDING SITE is a target binding site found in the 5' untranslated region of mRNA encoded by LOC284628, corresponding to a target binding site such as BINDING SITE I, BINDING SITE II or BINDING SITE III of FIG. 8. Table 4 illustrates the complementarity of the nucleotide sequences of LOC284628 BINDING SITE, designated SEQ ID:18882, to the nucleotide sequence of GAM189 RNA, herein designated GAM RNA, also designated SEQ ID:246.

Another function of GAM189 is therefore inhibition of LOC284628 (Accession XP_211561.1). Accordingly, utilities of GAM189 include diagnosis, prevention and treatment of diseases and clinical conditions associated with LOC284628.

LOC284675 (Accession XP_209319.1) is another GAM189 target gene, herein designated TARGET GENE. LOC284675 BINDING SITE1 and LOC284675 BINDING SITE2 are target binding sites found in untranslated regions of mRNA encoded by LOC284675, corresponding to target binding sites such as BINDING SITE I, BINDING SITE II or BINDING SITE III of FIG. 8. Table 4 illustrates the complementarity of the nucleotide sequences of LOC284675 BINDING SITE1 and LOC284675 BINDING SITE2, designated SEQ ID:2389 and SEQ ID:501 respectively, to the nucleotide sequence of GAM189 RNA, herein designated GAM RNA, also designated SEQ ID:246.

Another function of GAM189 is therefore inhibition of LOC284675 (Accession XP_209319.1). Accordingly, utilities of GAM189 include diagnosis, prevention and treatment of diseases and clinical conditions associated with LOC284675.

LOC284683 (Accession XP_208236.1) is another GAM189 target gene, herein designated TARGET GENE. LOC284683 BINDING SITE is a target binding site found in the 3' untranslated region of mRNA encoded by LOC284683, corresponding to a target binding site such as BINDING SITE I, BINDING SITE II or BINDING SITE III of FIG. 8. Table 4 illustrates the complementarity of the nucleotide sequences of LOC284683 BINDING SITE, designated SEQ ID:5926, to the nucleotide sequence of GAM189 RNA, herein designated GAM RNA, also designated SEQ ID:246.

Another function of GAM189 is therefore inhibition of LOC284683 (Accession XP_208236.1). Accordingly, utilities of GAM189 include diagnosis, prevention and treatment of diseases and clinical conditions associated with LOC284683.

LOC284701 (Accession XP_294994.1) is another GAM189 target gene, herein designated TARGET GENE. LOC284701 BINDING SITE is a target binding site found in the 5' untranslated region of mRNA encoded by LOC284701, corresponding to a target binding site such as BINDING SITE I, BINDING SITE II or BINDING SITE III of FIG. 8. Table 4 illustrates the complementarity of the nucleotide sequences of LOC284701 BINDING SITE, designated SEQ ID:12803, to the nucleotide sequence of GAM189 RNA, herein designated GAM RNA, also designated SEQ ID:246.

Another function of GAM189 is therefore inhibition of LOC284701 (Accession XP_294994.1). Accordingly, utilities of GAM189 include diagnosis, prevention and treatment of diseases and clinical conditions associated with LOC284701.

LOC284708 (Accession XP_209332.1) is another GAM189 target gene, herein designated TARGET GENE. LOC284708 BINDING SITE is a target binding site found in the 3' untranslated region of mRNA encoded by LOC284708, corresponding to a target binding site such as BINDING SITE I, BINDING SITE II or BINDING SITE III of FIG. 8. Table 4 illustrates the complementarity of the nucleotide sequences of LOC284708 BINDING SITE, designated SEQ ID:5153, to the nucleotide sequence of GAM189 RNA, herein designated GAM RNA, also designated SEQ ID:246.

Another function of GAM189 is therefore inhibition of LOC284708 (Accession XP_209332.1). Accordingly, utilities of GAM189 include diagnosis, prevention and treatment of diseases and clinical conditions associated with LOC284708.

LOC284723 (Accession XP_211602.1) is another GAM189 target gene, herein designated TARGET GENE.

LOC284723 BINDING SITE1 through LOC284723 BINDING SITE3 are target binding sites found in untranslated regions of mRNA encoded by LOC284723, corresponding to target binding sites such as BINDING SITE I, BINDING SITE II or BINDING SITE III of FIG. 8. Table 4 illustrates the complementarity of the nucleotide sequences of LOC284723 BINDING SITE1 through LOC284723 BINDING SITE3, designated SEQ ID:6498, SEQ ID:3182 and SEQ ID:2215 respectively, to the nucleotide sequence of GAM189 RNA, herein designated GAM RNA, also designated SEQ ID:246.

Another function of GAM189 is therefore inhibition of LOC284723 (Accession XP_211602.1). Accordingly, utilities of GAM189 include diagnosis, prevention and treatment of diseases and clinical conditions associated with LOC284723.

LOC284805 (Accession XP_209371.1) is another GAM189 target gene, herein designated TARGET GENE. LOC284805 BINDING SITE1 through LOC284805 BINDING SITE3 are target binding sites found in untranslated regions of mRNA encoded by LOC284805, corresponding to target binding sites such as BINDING SITE I, BINDING SITE II or BINDING SITE III of FIG. 8. Table 4 illustrates the complementarity of the nucleotide sequences of LOC284805 BINDING SITE1 through LOC284805 BINDING SITE3, designated SEQ ID:8046, SEQ ID:853 and SEQ ID:1544 respectively, to the nucleotide sequence of GAM189 RNA, herein designated GAM RNA, also designated SEQ ID:246.

Another function of GAM189 is therefore inhibition of LOC284805 (Accession XP_209371.1). Accordingly, utilities of GAM189 include diagnosis, prevention and treatment of diseases and clinical conditions associated with LOC284805.

LOC284839 (Accession XP_211661.1) is another GAM189 target gene, herein designated TARGET GENE. LOC284839 BINDING SITE is a target binding site found in the 5' untranslated region of mRNA encoded by LOC284839, corresponding to a target binding site such as BINDING SITE I, BINDING SITE II or BINDING SITE III of FIG. 8. Table 4 illustrates the complementarity of the nucleotide sequences of LOC284839 BINDING SITE, designated SEQ ID:19401, to the nucleotide sequence of GAM189 RNA, herein designated GAM RNA, also designated SEQ ID:246.

Another function of GAM189 is therefore inhibition of LOC284839 (Accession XP_211661.1). Accordingly, utilities of GAM189 include diagnosis, prevention and treatment of diseases and clinical conditions associated with LOC284839.

LOC284853 (Accession XP_209383.1) is another GAM189 target gene, herein designated TARGET GENE. LOC284853 BINDING SITE is a target binding site found in the 3' untranslated region of mRNA encoded by LOC284853, corresponding to a target binding site such as BINDING SITE I, BINDING SITE II or BINDING SITE III of FIG. 8. Table 4 illustrates the complementarity of the nucleotide sequences of LOC284853 BINDING SITE, designated SEQ ID:3582, to the nucleotide sequence of GAM189 RNA, herein designated GAM RNA, also designated SEQ ID:246.

Another function of GAM189 is therefore inhibition of LOC284853 (Accession XP_209383.1). Accordingly, utilities of GAM189 include diagnosis, prevention and treatment of diseases and clinical conditions associated with LOC284853.

LOC284856 (Accession XP_302835.1) is another GAM189 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:12736, to the nucleotide sequence of GAM189 RNA, herein designated GAM RNA, also designated SEQ ID:246.

Another function of GAM189 is therefore inhibition of LOC284856 (Accession XP_302835.1). Accordingly, utilities of GAM189 include diagnosis, prevention and treatment of diseases and clinical conditions associated with LOC284856.

LOC284856 (Accession XP_211668.2) is another GAM189 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:12736, to the nucleotide sequence of GAM189 RNA, herein designated GAM RNA, also designated SEQ ID:246.

Another function of GAM189 is therefore inhibition of LOC284856 (Accession XP_211668.2). Accordingly, utilities of GAM189 include diagnosis, prevention and treatment of diseases and clinical conditions associated with LOC284856.

LOC284859 (Accession XP_209384.2) is another GAM189 target gene, herein designated TARGET GENE. LOC284859 BINDING SITE is a target binding site found in the 3' untranslated region of mRNA encoded by LOC284859, corresponding to a target binding site such as BINDING SITE I, BINDING SITE II or BINDING SITE III of FIG. 8. Table 4 illustrates the complementarity of the nucleotide sequences of LOC284859 BINDING SITE, designated SEQ ID:16785, to the nucleotide sequence of GAM189 RNA, herein designated GAM RNA, also designated SEQ ID:246.

Another function of GAM189 is therefore inhibition of LOC284859 (Accession XP_209384.2). Accordingly, utilities of GAM189 include diagnosis, prevention and treatment of diseases and clinical conditions associated with LOC284859.

LOC284861 (Accession XP_211670.2) is another GAM189 target gene, herein designated TARGET GENE. LOC284861 BINDING SITE is a target binding site found in the 5' untranslated region of mRNA encoded by LOC284861, corresponding to a target binding site such as BINDING SITE I, BINDING SITE II or BINDING SITE III of FIG. 8. Table 4 illustrates the complementarity of the nucleotide sequences of LOC284861 BINDING SITE, designated SEQ ID:16785, to the nucleotide sequence of GAM189 RNA, herein designated GAM RNA, also designated SEQ ID:246.

Another function of GAM189 is therefore inhibition of LOC284861 (Accession XP_211670.2). Accordingly, utilities of GAM189 include diagnosis, prevention and treatment of diseases and clinical conditions associated with LOC284861.

LOC284865 (Accession XP_211672.1) is another GAM189 target gene, herein designated TARGET GENE. LOC284865 BINDING SITE is a target binding site found in the 3' untranslated region of mRNA encoded by LOC284865, corresponding to a target binding site such as BINDING SITE I, BINDING SITE II or BINDING SITE III of FIG. 8. Table 4 illustrates the complementarity of the nucleotide sequences of LOC284865 BINDING SITE, designated SEQ ID:1645, to the nucleotide sequence of GAM189 RNA, herein designated GAM RNA, also designated SEQ ID:246.

Another function of GAM189 is therefore inhibition of LOC284865 (Accession XP_211672.1). Accordingly, utilities of GAM189 include diagnosis, prevention and treatment of diseases and clinical conditions associated with LOC284865.

LOC284873 (Accession XP_209412.1) is another GAM189 target gene, herein designated TARGET GENE. LOC284873 BINDING SITE is a target binding site found in the 3' untranslated region of mRNA encoded by LOC284873, corresponding to a target binding site such as BINDING SITE I, BINDING SITE II or BINDING SITE III of FIG. 8. Table 4 illustrates the complementarity of the nucleotide sequences of LOC284873 BINDING SITE, designated SEQ ID:16785, to the nucleotide sequence of GAM189 RNA, herein designated GAM RNA, also designated SEQ ID:246.

Another function of GAM189 is therefore inhibition of LOC284873 (Accession XP_209412.1). Accordingly, utilities of GAM189 include diagnosis, prevention and treatment of diseases and clinical conditions associated with LOC284873.

LOC284874 (Accession XP_209394.1) is another GAM189 target gene, herein designated TARGET GENE. LOC284874 BINDING SITE1 and LOC284874 BINDING SITE2 are target binding sites found in untranslated regions of mRNA encoded by LOC284874, corresponding to target binding sites such as BINDING SITE I, BINDING SITE II or BINDING SITE III of FIG. 8. Table 4 illustrates the complementarity of the nucleotide sequences of LOC284874 BINDING SITE1 and LOC284874 BINDING SITE2, designated SEQ ID:3846 and SEQ ID:16244 respectively, to the nucleotide sequence of GAM189 RNA, herein designated GAM RNA, also designated SEQ ID:246.

Another function of GAM189 is therefore inhibition of LOC284874 (Accession XP_209394.1). Accordingly, utilities of GAM189 include diagnosis, prevention and treatment of diseases and clinical conditions associated with LOC284874.

LOC284934 (Accession XP_211696.1) is another GAM189 target gene, herein designated TARGET GENE. LOC284934 BINDING SITE is a target binding site found in the 5' untranslated region of mRNA encoded by LOC284934, corresponding to a target binding site such as BINDING SITE I, BINDING SITE II or BINDING SITE III of FIG. 8. Table 4 illustrates the complementarity of the nucleotide sequences of LOC284934 BINDING SITE, designated SEQ ID:14894, to the nucleotide sequence of GAM189 RNA, herein designated GAM RNA, also designated SEQ ID:246.

Another function of GAM189 is therefore inhibition of LOC284934 (Accession XP_211696.1). Accordingly, utilities of GAM189 include diagnosis, prevention and treatment of diseases and clinical conditions associated with LOC284934.

LOC284947 (Accession XP_211705.1) is another GAM189 target gene, herein designated TARGET GENE. LOC284947 BINDING SITE is a target binding site found in the 3' untranslated region of mRNA encoded by LOC284947, corresponding to a target binding site such as BINDING SITE I, BINDING SITE II or BINDING SITE III of FIG. 8. Table 4 illustrates the complementarity of the nucleotide sequences of LOC284947 BINDING SITE, designated SEQ ID:5465, to the nucleotide sequence of GAM189 RNA, herein designated GAM RNA, also designated SEQ ID:246.

Another function of GAM189 is therefore inhibition of LOC284947 (Accession XP_211705.1). Accordingly, utilities of GAM189 include diagnosis, prevention and treatment of diseases and clinical conditions associated with LOC284947.

LOC284950 (Accession XP_211703.1) is another GAM189 target gene, herein designated TARGET GENE. LOC284950 BINDING SITE is a target binding site found in the 3' untranslated region of mRNA encoded by LOC284950, corresponding to a target binding site such as BINDING SITE I, BINDING SITE II or BINDING SITE III of FIG. 8. Table 4 illustrates the complementarity of the nucleotide sequences of LOC284950 BINDING SITE, designated SEQ ID:4025, to the nucleotide sequence of GAM189 RNA, herein designated GAM RNA, also designated SEQ ID:246.

Another function of GAM189 is therefore inhibition of LOC284950 (Accession XP_211703.1). Accordingly, utilities of GAM189 include diagnosis, prevention and treatment of diseases and clinical conditions associated with LOC284950.

LOC285002 (Accession XP_211731.2) is another GAM189 target gene, herein designated TARGET GENE. LOC285002 BINDING SITE is a target binding site found in the 3' untranslated region of mRNA encoded by LOC285002, corresponding to a target binding site such as BINDING SITE I, BINDING SITE II or BINDING SITE III of FIG. 8. Table 4 illustrates the complementarity of the nucleotide sequences of LOC285002 BINDING SITE, designated SEQ ID:3500, to the nucleotide sequence of GAM189 RNA, herein designated GAM RNA, also designated SEQ ID:246.

Another function of GAM189 is therefore inhibition of LOC285002 (Accession XP_211731.2). Accordingly, utilities of GAM189 include diagnosis, prevention and treatment of diseases and clinical conditions associated with LOC285002.

LOC285026 (Accession XP_209440.1) is another GAM189 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:17523, to the nucleotide sequence of GAM189 RNA, herein designated GAM RNA, also designated SEQ ID:246.

Another function of GAM189 is therefore inhibition of LOC285026 (Accession XP_209440.1). Accordingly, utilities of GAM189 include diagnosis, prevention and treatment of diseases and clinical conditions associated with LOC285026.

LOC285052 (Accession XP_211751.1) is another GAM189 target gene, herein designated TARGET GENE. LOC285052 BINDING SITE is a target binding site found in the 3' untranslated region of mRNA encoded by LOC285052, corresponding to a target binding site such as BINDING SITE I, BINDING SITE II or BINDING SITE III of FIG. 8. Table 4 illustrates the complementarity of the nucleotide sequences of LOC285052 BINDING SITE, designated SEQ ID:2174, to the nucleotide sequence of GAM189 RNA, herein designated GAM RNA, also designated SEQ ID:246.

Another function of GAM189 is therefore inhibition of LOC285052 (Accession XP_211751.1). Accordingly, utilities of GAM189 include diagnosis, prevention and treatment of diseases and clinical conditions associated with LOC285052.

LOC285058 (Accession XP_211753.1) is another GAM189 target gene, herein designated TARGET GENE. LOC285058 BINDING SITE is a target binding site found in the 5' untranslated region of mRNA encoded by LOC285058, corresponding to a target binding site such as BINDING SITE I, BINDING SITE II or BINDING SITE III of FIG. 8. Table 4 illustrates the complementarity of the nucleotide sequences of LOC285058 BINDING SITE, designated SEQ ID:20023, to the nucleotide sequence of GAM189 RNA, herein designated GAM RNA, also designated SEQ ID:246.

Another function of GAM189 is therefore inhibition of LOC285058 (Accession XP_211753.1). Accordingly, utilities of GAM189 include diagnosis, prevention and treatment of diseases and clinical conditions associated with LOC285058.

LOC285083 (Accession XP_209464.1) is another GAM189 target gene, herein designated TARGET GENE. LOC285083 BINDING SITE is a target binding site found in the 3' untranslated region of mRNA encoded by LOC285083, corresponding to a target binding site such as BINDING SITE I, BINDING SITE II or BINDING SITE III of FIG. 8. Table 4 illustrates the complementarity of the nucleotide sequences of LOC285083 BINDING SITE, designated SEQ ID:5667, to the nucleotide sequence of GAM189 RNA, herein designated GAM RNA, also designated SEQ ID:246.

Another function of GAM189 is therefore inhibition of LOC285083 (Accession XP_209464.1). Accordingly, utilities of GAM189 include diagnosis, prevention and treatment of diseases and clinical conditions associated with LOC285083.

LOC285088 (Accession XP_209465.1) is another GAM189 target gene, herein designated TARGET GENE. LOC285088 BINDING SITE is a target binding site found in the 3' untranslated region of mRNA encoded by LOC285088, corresponding to a target binding site such as BINDING SITE I, BINDING SITE II or BINDING SITE III of FIG. 8. Table 4 illustrates the complementarity of the nucleotide sequences of LOC285088 BINDING SITE, designated SEQ ID:6092, to the nucleotide sequence of GAM189 RNA, herein designated GAM RNA, also designated SEQ ID:246.

Another function of GAM189 is therefore inhibition of LOC285088 (Accession XP_209465.1). Accordingly, utilities of GAM189 include diagnosis, prevention and treatment of diseases and clinical conditions associated with LOC285088.

LOC285123 (Accession XP_211773.1) is another GAM189 target gene, herein designated TARGET GENE. LOC285123 BINDING SITE is a target binding site found in the 3' untranslated region of mRNA encoded by LOC285123, corresponding to a target binding site such as BINDING SITE I, BINDING SITE II or BINDING SITE III of FIG. 8. Table 4 illustrates the complementarity of the nucleotide sequences of LOC285123 BINDING SITE, designated SEQ ID:17113, to the nucleotide sequence of GAM189 RNA, herein designated GAM RNA, also designated SEQ ID:246.

Another function of GAM189 is therefore inhibition of LOC285123 (Accession XP_211773.1). Accordingly, utilities of GAM189 include diagnosis, prevention and treatment of diseases and clinical conditions associated with LOC285123.

LOC285127 (Accession XP_211771.1) is another GAM189 target gene, herein designated TARGET GENE. LOC285127 BINDING SITE1 and LOC285127 BINDING SITE2 are target binding sites found in untranslated regions of mRNA encoded by LOC285127, corresponding to target binding sites such as BINDING SITE I, BINDING SITE II or BINDING SITE III of FIG. 8. Table 4 illustrates the complementarity of the nucleotide sequences of LOC285127 BINDING SITE1 and LOC285127 BINDING SITE2, designated SEQ ID:11528 and SEQ ID:5921 respectively, to the nucleotide sequence of GAM189 RNA, herein designated GAM RNA, also designated SEQ ID:246.

Another function of GAM189 is therefore inhibition of LOC285127 (Accession XP_211771.1). Accordingly, utilities of GAM189 include diagnosis, prevention and treatment of diseases and clinical conditions associated with LOC285127.

LOC285166 (Accession XP_211791.1) is another GAM189 target gene, herein designated TARGET GENE. LOC285166 BINDING SITE is a target binding site found in the 3' untranslated region of mRNA encoded by LOC285166, corresponding to a target binding site such as BINDING SITE I, BINDING SITE II or BINDING SITE III of FIG. 8. Table 4 illustrates the complementarity of the nucleotide sequences of LOC285166 BINDING SITE, designated SEQ ID:4283, to the nucleotide sequence of GAM189 RNA, herein designated GAM RNA, also designated SEQ ID:246.

Another function of GAM189 is therefore inhibition of LOC285166 (Accession XP_211791.1). Accordingly, utilities of GAM189 include diagnosis, prevention and treatment of diseases and clinical conditions associated with LOC285166.

LOC285176 (Accession XP_209500.1) is another GAM189 target gene, herein designated TARGET GENE. LOC285176 BINDING SITE is a target binding site found in the 3' untranslated region of mRNA encoded by LOC285176, corresponding to a target binding site such as BINDING SITE I, BINDING SITE II or BINDING SITE III of FIG. 8. Table 4 illustrates the complementarity of the nucleotide sequences of LOC285176 BINDING SITE, designated SEQ ID:7860, to the nucleotide sequence of GAM189 RNA, herein designated GAM RNA, also designated SEQ ID:246.

Another function of GAM189 is therefore inhibition of LOC285176 (Accession XP_209500.1). Accordingly, utilities of GAM189 include diagnosis, prevention and treatment of diseases and clinical conditions associated with LOC285176.

LOC285193 (Accession XP_209509.1) is another GAM189 target gene, herein designated TARGET GENE. LOC285193 BINDING SITE is a target binding site found in the 3' untranslated region of mRNA encoded by LOC285193, corresponding to a target binding site such as BINDING SITE I, BINDING SITE II or BINDING SITE III of FIG. 8. Table 4 illustrates the complementarity of the nucleotide sequences of LOC285193 BINDING SITE, designated SEQ ID:1745, to the nucleotide sequence of GAM189 RNA, herein designated GAM RNA, also designated SEQ ID:246.

Another function of GAM189 is therefore inhibition of LOC285193 (Accession XP_209509.1). Accordingly, utilities of GAM189 include diagnosis, prevention and treatment of diseases and clinical conditions associated with LOC285193.

LOC285221 (Accession XP_209521.1) is another GAM189 target gene, herein designated TARGET GENE. LOC285221 BINDING SITE is a target binding site found in the 5' untranslated region of mRNA encoded by LOC285221, corresponding to a target binding site such as BINDING SITE I, BINDING SITE II or BINDING SITE III of FIG. 8. Table 4 illustrates the complementarity of the nucleotide sequences of LOC285221 BINDING SITE, designated SEQ ID:13597, to the nucleotide sequence of GAM189 RNA, herein designated GAM RNA, also designated SEQ ID:246.

Another function of GAM189 is therefore inhibition of LOC285221 (Accession XP_209521.1). Accordingly, utilities of GAM189 include diagnosis, prevention and treatment of diseases and clinical conditions associated with LOC285221.

LOC285231 (Accession XP_211813.1) is another GAM189 target gene, herein designated TARGET GENE. LOC285231 BINDING SITE1 through LOC285231 BINDING SITE3 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231 BINDING SITE1 through LOC285231 BINDING SITE3, designated SEQ ID:8001, SEQ ID:8001 and SEQ ID:15366 respectively, to the nucleotide sequence of GAM189 RNA, herein designated GAM RNA, also designated SEQ ID:246.

Another function of GAM189 is therefore inhibition of LOC285231 (Accession XP_211813.1). Accordingly, utilities of GAM189 include diagnosis, prevention and treatment of diseases and clinical conditions associated with LOC285231.

LOC285231 (Accession XP_211813.1) is another GAM189 target gene, herein designated TARGET GENE. LOC285231 BINDING SITE1 through LOC285231 BINDING SITE3 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231 BINDING SITE1 through LOC285231 BINDING SITE3, designated SEQ ID:9352, SEQ ID:15575 and SEQ ID:9374 respectively, to the nucleotide sequence of GAM189 RNA, herein designated GAM RNA, also designated SEQ ID:246.

Another function of GAM189 is therefore inhibition of LOC285231 (Accession XP_211813.1). Accordingly, utilities of GAM189 include diagnosis, prevention and treatment of diseases and clinical conditions associated with LOC285231.

LOC285334 (Accession XP_211844.1) is another GAM189 target gene, herein designated TARGET GENE. LOC285334 BINDING SITE is a target binding site found in the 3' untranslated region of mRNA encoded by LOC285334, corresponding to a target binding site such as BINDING SITE I, BINDING SITE II or BINDING SITE III of FIG. 8. Table 4 illustrates the complementarity of the nucleotide sequences of LOC285334 BINDING SITE, designated SEQ ID:1027, to the nucleotide sequence of GAM189 RNA, herein designated GAM RNA, also designated SEQ ID:246.

Another function of GAM189 is therefore inhibition of LOC285334 (Accession XP_211844.1). Accordingly, utilities of GAM189 include diagnosis, prevention and treatment of diseases and clinical conditions associated with LOC285334.

LOC285345 (Accession XP_211854.1) is another GAM189 target gene, herein designated TARGET GENE. LOC285345 BINDING SITE1 and LOC285345 BINDING SITE2 are target binding sites found in untranslated regions of mRNA encoded by LOC285345, corresponding to target binding sites such as BINDING SITE I, BINDING SITE II or BINDING SITE III of FIG. 8. Table 4 illustrates the complementarity of the nucleotide sequences of LOC285345 BINDING SITE1 and LOC285345 BINDING SITE2, designated SEQ ID:556 and SEQ ID:18883 respectively, to the nucleotide sequence of GAM189 RNA, herein designated GAM RNA, also designated SEQ ID:246.

Another function of GAM189 is therefore inhibition of LOC285345 (Accession XP_211854.1). Accordingly, utilities of GAM189 include diagnosis, prevention and treatment of diseases and clinical conditions associated with LOC285345.

LOC285366 (Accession XP_209581.1) is another GAM189 target gene, herein designated TARGET GENE. LOC285366 BINDING SITE is a target binding site found in the 3' untranslated region of mRNA encoded by LOC285366, corresponding to a target binding site such as BINDING SITE I, BINDING SITE II or BINDING SITE III of FIG. 8. Table 4 illustrates the complementarity of the nucleotide sequences of LOC285366 BINDING SITE, designated SEQ ID:6117, to the nucleotide sequence of GAM189 RNA, herein designated GAM RNA, also designated SEQ ID:246.

Another function of GAM189 is therefore inhibition of LOC285366 (Accession XP_209581.1). Accordingly, utilities of GAM189 include diagnosis, prevention and treatment of diseases and clinical conditions associated with LOC285366.

LOC285369 (Accession XP_211861.3) is another GAM189 target gene, herein designated TARGET GENE. LOC285369 BINDING SITE is a target binding site found in the 3' untranslated region of mRNA encoded by LOC285369, corresponding to a target binding site such as BINDING SITE I, BINDING SITE II or BINDING SITE III of FIG. 8. Table 4 illustrates the complementarity of the nucleotide sequences of LOC285369 BINDING SITE, designated SEQ ID:10352, to the nucleotide sequence of GAM189 RNA, herein designated GAM RNA, also designated SEQ ID:246.

Another function of GAM189 is therefore inhibition of LOC285369 (Accession XP_211861.3). Accordingly, utilities of GAM189 include diagnosis, prevention and treatment of diseases and clinical conditions associated with LOC285369.

LOC285389 (Accession XP_211873.1) is another GAM189 target gene, herein designated TARGET GENE. LOC285389 BINDING SITE is a target binding site found in the 3' untranslated region of mRNA encoded by LOC285389, corresponding to a target binding site such as BINDING SITE I, BINDING SITE II or BINDING SITE III of FIG. 8. Table 4 illustrates the complementarity of the nucleotide sequences of LOC285389 BINDING SITE, designated SEQ ID:19692, to the nucleotide sequence of GAM189 RNA, herein designated GAM RNA, also designated SEQ ID:246.

Another function of GAM189 is therefore inhibition of LOC285389 (Accession XP_211873.1). Accordingly, utilities of GAM189 include diagnosis, prevention and treatment of diseases and clinical conditions associated with LOC285389.

LOC285392 (Accession XP_211879.1) is another GAM189 target gene, herein designated TARGET GENE. LOC285392 BINDING SITE1 and LOC285392 BINDING SITE2 are target binding sites found in untranslated regions of mRNA encoded by LOC285392, corresponding to target binding sites such as BINDING SITE I, BINDING SITE II or BINDING SITE III of FIG. 8. Table 4 illustrates the complementarity of the nucleotide sequences of LOC285392 BINDING SITE1 and LOC285392 BINDING SITE2, designated SEQ ID:9688 and SEQ ID:17969 respectively, to the nucleotide sequence of GAM189 RNA, herein designated GAM RNA, also designated SEQ ID:246.

Another function of GAM189 is therefore inhibition of LOC285392 (Accession XP_211879.1). Accordingly, utilities of GAM189 include diagnosis, prevention and treatment of diseases and clinical conditions associated with LOC285392.

LOC285398 (Accession XP_209593.1) is another GAM189 target gene, herein designated TARGET GENE. LOC285398 BINDING SITE1 and LOC285398 BINDING SITE2 are target binding sites found in untranslated regions of mRNA encoded by LOC285398, corresponding to target binding sites such as BINDING SITE I, BINDING SITE II or BINDING SITE III of FIG. 8. Table 4 illustrates the complementarity of the nucleotide sequences of LOC285398 BINDING SITE1 and LOC285398 BINDING SITE2, designated SEQ ID:4655 and SEQ ID:13286 respectively, to the nucleotide sequence of GAM189 RNA, herein designated GAM RNA, also designated SEQ ID:246.

Another function of GAM189 is therefore inhibition of LOC285398 (Accession XP_209593.1). Accordingly, utilities of GAM189 include diagnosis, prevention and treatment of diseases and clinical conditions associated with LOC285398.

LOC285429 (Accession XP_209607.3) is another GAM189 target gene, herein designated TARGET GENE. LOC285429 BINDING SITE is a target binding site found in the 3' untranslated region of mRNA encoded by LOC285429, corresponding to a target binding site such as BINDING SITE I, BINDING SITE II or BINDING SITE III of FIG. 8. Table 4 illustrates the complementarity of the nucleotide sequences of LOC285429 BINDING SITE, designated SEQ ID:4171, to the nucleotide sequence of GAM189 RNA, herein designated GAM RNA, also designated SEQ ID:246.

Another function of GAM189 is therefore inhibition of LOC285429 (Accession XP_209607.3). Accordingly, utilities of GAM189 include diagnosis, prevention and treatment of diseases and clinical conditions associated with LOC285429.

LOC285488 (Accession XP_211914.1) is another GAM189 target gene, herein designated TARGET GENE. LOC285488 BINDING SITE is a target binding site found in the 5' untranslated region of mRNA encoded by LOC285488, corresponding to a target binding site such as BINDING SITE I, BINDING SITE II or BINDING SITE III of FIG. 8. Table 4 illustrates the complementarity of the nucleotide sequences of LOC285488 BINDING SITE, designated SEQ ID:13804, to the nucleotide sequence of GAM189 RNA, herein designated GAM RNA, also designated SEQ ID:246.

Another function of GAM189 is therefore inhibition of LOC285488 (Accession XP_211914.1). Accordingly, utilities of GAM189 include diagnosis, prevention and treatment of diseases and clinical conditions associated with LOC285488.

LOC285491 (Accession XP_211917.1) is another GAM189 target gene, herein designated TARGET GENE. LOC285491 BINDING SITE is a target binding site found in the 3' untranslated region of mRNA encoded by LOC285491, corresponding to a target binding site such as BINDING SITE I, BINDING SITE II or BINDING SITE III of FIG. 8. Table 4 illustrates the complementarity of the nucleotide sequences of LOC285491 BINDING SITE, designated SEQ ID:11239, to the nucleotide sequence of GAM189 RNA, herein designated GAM RNA, also designated SEQ ID:246.

Another function of GAM189 is therefore inhibition of LOC285491 (Accession XP_211917.1). Accordingly, utilities of GAM189 include diagnosis, prevention and treatment of diseases and clinical conditions associated with LOC285491.

LOC285509 (Accession XP_211923.1) is another GAM189 target gene, herein designated TARGET GENE. LOC285509 BINDING SITE is a target binding site found in the 5' untranslated region of mRNA encoded by LOC285509, corresponding to a target binding site such as BINDING SITE I, BINDING SITE II or BINDING SITE III of FIG. 8. Table 4 illustrates the complementarity of the nucleotide sequences of LOC285509 BINDING SITE, designated SEQ ID:3519, to the nucleotide sequence of GAM189 RNA, herein designated GAM RNA, also designated SEQ ID:246.

Another function of GAM189 is therefore inhibition of LOC285509 (Accession XP_211923.1). Accordingly, utilities of GAM189 include diagnosis, prevention and treatment of diseases and clinical conditions associated with LOC285509.

LOC285510 (Accession XP_209643.1) is another GAM189 target gene, herein designated TARGET GENE. LOC285510 BINDING SITE is a target binding site found in the 3' untranslated region of mRNA encoded by LOC285510, corresponding to a target binding site such as BINDING SITE I, BINDING SITE II or BINDING SITE III of FIG. 8. Table 4 illustrates the complementarity of the nucleotide sequences of LOC285510 BINDING SITE, designated SEQ ID:14552, to the nucleotide sequence of GAM189 RNA, herein designated GAM RNA, also designated SEQ ID:246.

Another function of GAM189 is therefore inhibition of LOC285510 (Accession XP_209643.1). Accordingly, utilities of GAM189 include diagnosis, prevention and treatment of diseases and clinical conditions associated with LOC285510.

LOC285540 (Accession XP_209654.1) is another GAM189 target gene, herein designated TARGET GENE. LOC285540 BINDING SITE1 and LOC285540 BINDING SITE2 are target binding sites found in untranslated regions of mRNA encoded by LOC285540, corresponding to target binding sites such as BINDING SITE I, BINDING SITE II or BINDING SITE III of FIG. 8. Table 4 illustrates the complementarity of the nucleotide sequences of LOC285540 BINDING SITE1 and LOC285540 BINDING SITE2, designated SEQ ID:6961 and SEQ ID:9543 respectively, to the nucleotide sequence of GAM189 RNA, herein designated GAM RNA, also designated SEQ ID:246.

Another function of GAM189 is therefore inhibition of LOC285540 (Accession XP_209654.1). Accordingly, utilities of GAM189 include diagnosis, prevention and treatment of diseases and clinical conditions associated with LOC285540.

LOC285560 (Accession XP_209660.1) is another GAM189 target gene, herein designated TARGET GENE. LOC285560 BINDING SITE is a target binding site found in the 3' untranslated region of mRNA encoded by LOC285560, corresponding to a target binding site such as BINDING SITE I, BINDING SITE II or BINDING SITE III of FIG. 8. Table 4 illustrates the complementarity of the nucleotide sequences of LOC285560 BINDING SITE, designated SEQ ID:8718, to the nucleotide sequence of GAM189 RNA, herein designated GAM RNA, also designated SEQ ID:246.

Another function of GAM189 is therefore inhibition of LOC285560 (Accession XP_209660.1). Accordingly, utilities of GAM189 include diagnosis, prevention and treatment of diseases and clinical conditions associated with LOC285560.

LOC285589 (Accession XP_209671.1) is another GAM189 target gene, herein designated TARGET GENE. LOC285589 BINDING SITE1 and LOC285589 BINDING SITE2 are target binding sites found in untranslated regions of mRNA encoded by LOC285589, corresponding to target binding sites such as BINDING SITE I, BINDING SITE II or BINDING SITE III of FIG. 8. Table 4 illustrates the complementarity of the nucleotide sequences of LOC285589 BINDING SITE1 and LOC285589 BINDING SITE2, designated SEQ ID:17087 and SEQ ID:12804 respectively, to the nucleotide sequence of GAM189 RNA, herein designated GAM RNA, also designated SEQ ID:246.

Another function of GAM189 is therefore inhibition of LOC285589 (Accession XP_209671.1). Accordingly, utilities of GAM189 include diagnosis, prevention and treatment of diseases and clinical conditions associated with LOC285589.

LOC285626 (Accession XP_211959.1) is another GAM189 target gene, herein designated TARGET GENE. LOC285626 BINDING SITE is a target binding site found in the 5' untranslated region of mRNA encoded by LOC285626, corresponding to a target binding site such as BINDING SITE I, BINDING SITE II or BINDING SITE III of FIG. 8. Table 4 illustrates the complementarity of the nucleotide sequences of LOC285626 BINDING SITE, designated SEQ ID:13843, to the nucleotide sequence of GAM189 RNA, herein designated GAM RNA, also designated SEQ ID:246.

Another function of GAM189 is therefore inhibition of LOC285626 (Accession XP_211959.1). Accordingly, utilities of GAM189 include diagnosis, prevention and treatment of diseases and clinical conditions associated with LOC285626.

LOC285638 (Accession XP_209693.1) is another GAM189 target gene, herein designated TARGET GENE. LOC285638 BINDING SITE is a target binding site found in the 5' untranslated region of mRNA encoded by LOC285638, corresponding to a target binding site such as BINDING SITE I, BINDING SITE II or BINDING SITE III of FIG. 8. Table 4 illustrates the complementarity of the nucleotide sequences of LOC285638 BINDING SITE, designated SEQ ID:4949, to the nucleotide sequence of GAM189 RNA, herein designated GAM RNA, also designated SEQ ID:246.

Another function of GAM189 is therefore inhibition of LOC285638 (Accession XP_209693.1). Accordingly, utilities of GAM189 include diagnosis, prevention and treatment of diseases and clinical conditions associated with LOC285638.

LOC285679 (Accession XP_209719.2) is another GAM189 target gene, herein designated TARGET GENE. LOC285679 BINDING SITE is a target binding site found in the 3' untranslated region of mRNA encoded by LOC285679, corresponding to a target binding site such as BINDING SITE I, BINDING SITE II or BINDING SITE III of FIG. 8. Table 4 illustrates the complementarity of the nucleotide sequences of LOC285679 BINDING SITE, designated SEQ ID:19299, to the nucleotide sequence of GAM189 RNA, herein designated GAM RNA, also designated SEQ ID:246.

Another function of GAM189 is therefore inhibition of LOC285679 (Accession XP_209719.2). Accordingly, utilities of GAM189 include diagnosis, prevention and treatment of diseases and clinical conditions associated with LOC285679.

LOC285689 (Accession XP_209724.1) is another GAM189 target gene, herein designated TARGET GENE. LOC285689 BINDING SITE is a target binding site found in the 3' untranslated region of mRNA encoded by LOC285689, corresponding to a target binding site such as BINDING SITE I, BINDING SITE II or BINDING SITE III of FIG. 8. Table 4 illustrates the complementarity of the nucleotide sequences of LOC285689 BINDING SITE, designated SEQ ID:17726, to the nucleotide sequence of GAM189 RNA, herein designated GAM RNA, also designated SEQ ID:246.

Another function of GAM189 is therefore inhibition of LOC285689 (Accession XP_209724.1). Accordingly, utilities of GAM189 include diagnosis, prevention and treatment of diseases and clinical conditions associated with LOC285689.

LOC285693 (Accession XP_211981.1) is another GAM189 target gene, herein designated TARGET GENE. LOC285693 BINDING SITE is a target binding site found in the 5' untranslated region of mRNA encoded by LOC285693, corresponding to a target binding site such as BINDING SITE I, BINDING SITE II or BINDING SITE III of FIG. 8. Table 4 illustrates the complementarity of the nucleotide sequences of LOC285693 BINDING SITE, designated SEQ ID:16940, to the nucleotide sequence of GAM189 RNA, herein designated GAM RNA, also designated SEQ ID:246.

Another function of GAM189 is therefore inhibition of LOC285693 (Accession XP_211981.1). Accordingly, utilities of GAM189 include diagnosis, prevention and treatment of diseases and clinical conditions associated with LOC285693.

LOC285722 (Accession XP_211997.1) is another GAM189 target gene, herein designated TARGET GENE. LOC285722 BINDING SITE is a target binding site found in the 5' untranslated region of mRNA encoded by LOC285722, corresponding to a target binding site such as BINDING SITE I, BINDING SITE II or BINDING SITE III of FIG. 8. Table 4 illustrates the complementarity of the nucleotide sequences of LOC285722 BINDING SITE, designated SEQ ID:18012, to the nucleotide sequence of GAM189 RNA, herein designated GAM RNA, also designated SEQ ID:246.

Another function of GAM189 is therefore inhibition of LOC285722 (Accession XP_211997.1). Accordingly, utilities of GAM189 include diagnosis, prevention and treatment of diseases and clinical conditions associated with LOC285722.

LOC285744 (Accession XP_209743.1) is another GAM189 target gene, herein designated TARGET GENE. LOC285744 BINDING SITE is a target binding site found in the 3' untranslated region of mRNA encoded by LOC285744, corresponding to a target binding site such as BINDING SITE I, BINDING SITE II or BINDING SITE III of FIG. 8. Table 4 illustrates the complementarity of the nucleotide sequences of LOC285744 BINDING SITE, designated SEQ ID:11141, to the nucleotide sequence of GAM189 RNA, herein designated GAM RNA, also designated SEQ ID:246.

Another function of GAM189 is therefore inhibition of LOC285744 (Accession XP_209743.1). Accordingly, utilities of GAM189 include diagnosis, prevention and treatment of diseases and clinical conditions associated with LOC285744.

LOC285747 (Accession XP_209742.1) is another GAM189 target gene, herein designated TARGET GENE. LOC285747 BINDING SITE is a target binding site found in the 3' untranslated region of mRNA encoded by LOC285747, corresponding to a target binding site such as BINDING SITE I, BINDING SITE II or BINDING SITE III of FIG. 8. Table 4 illustrates the complementarity of the nucleotide sequences of LOC285747 BINDING SITE, designated SEQ ID:11528, to the nucleotide sequence of GAM189 RNA, herein designated GAM RNA, also designated SEQ ID:246.

Another function of GAM189 is therefore inhibition of LOC285747 (Accession XP_209742.1). Accordingly, utilities of GAM189 include diagnosis, prevention and treatment of diseases and clinical conditions associated with LOC285747.

LOC285760 (Accession XP_209750.1) is another GAM189 target gene, herein designated TARGET GENE. LOC285760 BINDING SITE is a target binding site found in the 3' untranslated region of mRNA encoded by LOC285760, corresponding to a target binding site such as BINDING SITE I, BINDING SITE II or BINDING SITE III of FIG. 8. Table 4 illustrates the complementarity of the nucleotide sequences of LOC285760 BINDING SITE, designated SEQ ID:13412, to the nucleotide sequence of GAM189 RNA, herein designated GAM RNA, also designated SEQ ID:246.

Another function of GAM189 is therefore inhibition of LOC285760 (Accession XP_209750.1). Accordingly, utilities of GAM189 include diagnosis, prevention and treatment of diseases and clinical conditions associated with LOC285760.

LOC285777 (Accession XP_212013.1) is another GAM189 target gene, herein designated TARGET GENE.

LOC285777 BINDING SITE is a target binding site found in the 5' untranslated region of mRNA encoded by LOC285777, corresponding to a target binding site such as BINDING SITE I, BINDING SITE II or BINDING SITE III of FIG. 8. Table 4 illustrates the complementarity of the nucleotide sequences of LOC285777 BINDING SITE, designated SEQ ID:16810, to the nucleotide sequence of GAM189 RNA, herein designated GAM RNA, also designated SEQ ID:246.

Another function of GAM189 is therefore inhibition of LOC285777 (Accession XP_212013.1). Accordingly, utilities of GAM189 include diagnosis, prevention and treatment of diseases and clinical conditions associated with LOC285777.

LOC285812 (Accession XP_212055.1) is another GAM189 target gene, herein designated TARGET GENE. LOC285812 BINDING SITE is a target binding site found in the 3' untranslated region of mRNA encoded by LOC285812, corresponding to a target binding site such as BINDING SITE I, BINDING SITE II or BINDING SITE III of FIG. 8. Table 4 illustrates the complementarity of the nucleotide sequences of LOC285812 BINDING SITE, designated SEQ ID:559, to the nucleotide sequence of GAM189 RNA, herein designated GAM RNA, also designated SEQ ID:246.

Another function of GAM189 is therefore inhibition of LOC285812 (Accession XP_212055.1). Accordingly, utilities of GAM189 include diagnosis, prevention and treatment of diseases and clinical conditions associated with LOC285812.

LOC285813 (Accession XP_212036.1) is another GAM189 target gene, herein designated TARGET GENE. LOC285813 BINDING SITE is a target binding site found in the 5' untranslated region of mRNA encoded by LOC285813, corresponding to a target binding site such as BINDING SITE I, BINDING SITE II or BINDING SITE III of FIG. 8. Table 4 illustrates the complementarity of the nucleotide sequences of LOC285813 BINDING SITE, designated SEQ ID:12389, to the nucleotide sequence of GAM189 RNA, herein designated GAM RNA, also designated SEQ ID:246.

Another function of GAM189 is therefore inhibition of LOC285813 (Accession XP_212036.1). Accordingly, utilities of GAM189 include diagnosis, prevention and treatment of diseases and clinical conditions associated with LOC285813.

LOC285822 (Accession XP_209777.1) is another GAM189 target gene, herein designated TARGET GENE. LOC285822 BINDING SITE1 and LOC285822 BINDING SITE2 are target binding sites found in untranslated regions of mRNA encoded by LOC285822, corresponding to target binding sites such as BINDING SITE I, BINDING SITE II or BINDING SITE III of FIG. 8. Table 4 illustrates the complementarity of the nucleotide sequences of LOC285822 BINDING SITE1 and LOC285822 BINDING SITE2, designated SEQ ID:1847 and SEQ ID:9753 respectively, to the nucleotide sequence of GAM189 RNA, herein designated GAM RNA, also designated SEQ ID:246.

Another function of GAM189 is therefore inhibition of LOC285822 (Accession XP_209777.1). Accordingly, utilities of GAM189 include diagnosis, prevention and treatment of diseases and clinical conditions associated with LOC285822.

LOC285830 (Accession XP_212043.1) is another GAM189 target gene, herein designated TARGET GENE. LOC285830 BINDING SITE is a target binding site found in the 5' untranslated region of mRNA encoded by LOC285830, corresponding to a target binding site such as BINDING SITE I, BINDING SITE II or BINDING SITE III of FIG. 8. Table 4 illustrates the complementarity of the nucleotide sequences of LOC285830 BINDING SITE, designated SEQ ID:986, to the nucleotide sequence of GAM189 RNA, herein designated GAM RNA, also designated SEQ ID:246.

Another function of GAM189 is therefore inhibition of LOC285830 (Accession XP_212043.1). Accordingly, utilities of GAM189 include diagnosis, prevention and treatment of diseases and clinical conditions associated with LOC285830.

LOC285843 (Accession XP_212034.1) is another GAM189 target gene, herein designated TARGET GENE. LOC285843 BINDING SITE is a target binding site found in the 3' untranslated region of mRNA encoded by LOC285843, corresponding to a target binding site such as BINDING SITE I, BINDING SITE II or BINDING SITE III of FIG. 8. Table 4 illustrates the complementarity of the nucleotide sequences of LOC285843 BINDING SITE, designated SEQ ID:17964, to the nucleotide sequence of GAM189 RNA, herein designated GAM RNA, also designated SEQ ID:246.

Another function of GAM189 is therefore inhibition of LOC285843 (Accession XP_212034.1). Accordingly, utilities of GAM189 include diagnosis, prevention and treatment of diseases and clinical conditions associated with LOC285843.

LOC285847 (Accession XP_212045.1) is another GAM189 target gene, herein designated TARGET GENE. LOC285847 BINDING SITE is a target binding site found in the 5' untranslated region of mRNA encoded by LOC285847, corresponding to a target binding site such as BINDING SITE I, BINDING SITE II or BINDING SITE III of FIG. 8. Table 4 illustrates the complementarity of the nucleotide sequences of LOC285847 BINDING SITE, designated SEQ ID:18945, to the nucleotide sequence of GAM189 RNA, herein designated GAM RNA, also designated SEQ ID:246.

Another function of GAM189 is therefore inhibition of LOC285847 (Accession XP_212045.1). Accordingly, utilities of GAM189 include diagnosis, prevention and treatment of diseases and clinical conditions associated with LOC285847.

LOC285872 (Accession XP_212061.1) is another GAM189 target gene, herein designated TARGET GENE. LOC285872 BINDING SITE is a target binding site found in the 3' untranslated region of mRNA encoded by LOC285872, corresponding to a target binding site such as BINDING SITE I, BINDING SITE II or BINDING SITE III of FIG. 8. Table 4 illustrates the complementarity of the nucleotide sequences of LOC285872 BINDING SITE, designated SEQ ID:10885, to the nucleotide sequence of GAM189 RNA, herein designated GAM RNA, also designated SEQ ID:246.

Another function of GAM189 is therefore inhibition of LOC285872 (Accession XP_212061.1). Accordingly, utilities of GAM189 include diagnosis, prevention and treatment of diseases and clinical conditions associated with LOC285872.

LOC285914 (Accession XP_209810.1) is another GAM189 target gene, herein designated TARGET GENE. LOC285914 BINDING SITE is a target binding site found in the 3' untranslated region of mRNA encoded by LOC285914, corresponding to a target binding site such as BINDING SITE I, BINDING SITE II or BINDING SITE III of FIG. 8. Table 4 illustrates the complementarity of the nucleotide sequences of LOC285914 BINDING SITE, designated SEQ ID:6188, to the nucleotide sequence of GAM189 RNA, herein designated GAM RNA, also designated SEQ ID:246.

Another function of GAM189 is therefore inhibition of LOC285914 (Accession XP_209810.1). Accordingly, utilities of GAM189 include diagnosis, prevention and treatment of diseases and clinical conditions associated with LOC285914.

LOC285923 (Accession XP_212104.1) is another GAM189 target gene, herein designated TARGET GENE. LOC285923 BINDING SITE is a target binding site found in the 3' untranslated region of mRNA encoded by LOC285923, corresponding to a target binding site such as BINDING SITE I, BINDING SITE II or BINDING SITE III of FIG. 8. Table 4 illustrates the complementarity of the nucleotide sequences of LOC285923 BINDING SITE, designated SEQ ID:19536, to the nucleotide sequence of GAM189 RNA, herein designated GAM RNA, also designated SEQ ID:246.

Another function of GAM189 is therefore inhibition of LOC285923 (Accession XP_212104.1). Accordingly, utilities of GAM189 include diagnosis, prevention and treatment of diseases and clinical conditions associated with LOC285923.

LOC285924 (Accession XP_209816.1) is another GAM189 target gene, herein designated TARGET GENE. LOC285924 BINDING SITE is a target binding site found in the 3' untranslated region of mRNA encoded by LOC285924, corresponding to a target binding site such as BINDING SITE I, BINDING SITE II or BINDING SITE III of FIG. 8. Table 4 illustrates the complementarity of the nucleotide sequences of LOC285924 BINDING SITE, designated SEQ ID:17126, to the nucleotide sequence of GAM189 RNA, herein designated GAM RNA, also designated SEQ ID:246.

Another function of GAM189 is therefore inhibition of LOC285924 (Accession XP_209816.1). Accordingly, utilities of GAM189 include diagnosis, prevention and treatment of diseases and clinical conditions associated with LOC285924.

LOC285945 (Accession XP_212092.1) is another GAM189 target gene, herein designated TARGET GENE. LOC285945 BINDING SITE is a target binding site found in the 5' untranslated region of mRNA encoded by LOC285945, corresponding to a target binding site such as BINDING SITE I, BINDING SITE II or BINDING SITE III of FIG. 8. Table 4 illustrates the complementarity of the nucleotide sequences of LOC285945 BINDING SITE, designated SEQ ID:12075, to the nucleotide sequence of GAM189 RNA, herein designated GAM RNA, also designated SEQ ID:246.

Another function of GAM189 is therefore inhibition of LOC285945 (Accession XP_212092.1). Accordingly, utilities of GAM189 include diagnosis, prevention and treatment of diseases and clinical conditions associated with LOC285945.

LOC285952 (Accession XP_209821.1) is another GAM189 target gene, herein designated TARGET GENE. LOC285952 BINDING SITE is a target binding site found in the 3' untranslated region of mRNA encoded by LOC285952, corresponding to a target binding site such as BINDING SITE I, BINDING SITE II or BINDING SITE III of FIG. 8. Table 4 illustrates the complementarity of the nucleotide sequences of LOC285952 BINDING SITE, designated SEQ ID:15323, to the nucleotide sequence of GAM189 RNA, herein designated GAM RNA, also designated SEQ ID:246.

Another function of GAM189 is therefore inhibition of LOC285952 (Accession XP_209821.1). Accordingly, utilities of GAM189 include diagnosis, prevention and treatment of diseases and clinical conditions associated with LOC285952.

LOC285961 (Accession XP_209833.1) is another GAM189 target gene, herein designated TARGET GENE. LOC285961 BINDING SITE is a target binding site found in the 5' untranslated region of mRNA encoded by LOC285961, corresponding to a target binding site such as BINDING SITE I, BINDING SITE II or BINDING SITE III of FIG. 8. Table 4 illustrates the complementarity of the nucleotide sequences of LOC285961 BINDING SITE, designated SEQ ID:2604, to the nucleotide sequence of GAM189 RNA, herein designated GAM RNA, also designated SEQ ID:246.

Another function of GAM189 is therefore inhibition of LOC285961 (Accession XP_209833.1). Accordingly, utilities of GAM189 include diagnosis, prevention and treatment of diseases and clinical conditions associated with LOC285961.

LOC285972 (Accession XP_212105.1) is another GAM189 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:5318, to the nucleotide sequence of GAM189 RNA, herein designated GAM RNA, also designated SEQ ID:246.

Another function of GAM189 is therefore inhibition of LOC285972 (Accession XP_212105.1). Accordingly, utilities of GAM189 include diagnosis, prevention and treatment of diseases and clinical conditions associated with LOC285972.

LOC285979 (Accession XP_212117.1) is another GAM189 target gene, herein designated TARGET GENE. LOC285979 BINDING SITE1 and LOC285979 BINDING SITE2 are target binding sites found in untranslated regions of mRNA encoded by LOC285979, corresponding to target binding sites such as BINDING SITE I, BINDING SITE II or BINDING SITE III of FIG. 8. Table 4 illustrates the complementarity of the nucleotide sequences of LOC285979 BINDING SITE1 and LOC285979 BINDING SITE2, designated SEQ ID:1397 and SEQ ID:6388 respectively, to the nucleotide sequence of GAM189 RNA, herein designated GAM RNA, also designated SEQ ID:246.

Another function of GAM189 is therefore inhibition of LOC285979 (Accession XP_212117.1). Accordingly, utilities of GAM189 include diagnosis, prevention and treatment of diseases and clinical conditions associated with LOC285979.

LOC285989 (Accession XP_212111.1) is another GAM189 target gene, herein designated TARGET GENE. LOC285989 BINDING SITE is a target binding site found in the 3' untranslated region of mRNA encoded by LOC285989, corresponding to a target binding site such as BINDING SITE I, BINDING SITE II or BINDING SITE III of FIG. 8. Table 4 illustrates the complementarity of the nucleotide sequences of LOC285989 BINDING SITE, designated SEQ ID:11742, to the nucleotide sequence of GAM189 RNA, herein designated GAM RNA, also designated SEQ ID:246.

Another function of GAM189 is therefore inhibition of LOC285989 (Accession XP_212111.1). Accordingly, utilities of GAM189 include diagnosis, prevention and treatment of diseases and clinical conditions associated with LOC285989.

LOC285999 (Accession XP_212120.1) is another GAM189 target gene, herein designated TARGET GENE. LOC285999 BINDING SITE is a target binding site found in the 3' untranslated region of mRNA encoded by LOC285999, corresponding to a target binding site such as BINDING SITE I, BINDING SITE II or BINDING SITE III of FIG. 8. Table 4 illustrates the complementarity of the nucleotide sequences of LOC285999 BINDING SITE, designated SEQ ID:3647, to the nucleotide sequence of GAM189 RNA, herein designated GAM RNA, also designated SEQ ID:246.

Another function of GAM189 is therefore inhibition of LOC285999 (Accession XP_212120.1). Accordingly, utilities of GAM189 include diagnosis, prevention and treatment of diseases and clinical conditions associated with LOC285999.

LOC286029 (Accession XP_209866.1) is another GAM189 target gene, herein designated TARGET GENE. LOC286029 BINDING SITE is a target binding site found in the 3' untranslated region of mRNA encoded by LOC286029, corresponding to a target binding site such as BINDING SITE I, BINDING SITE II or BINDING SITE III of FIG. 8. Table 4 illustrates the complementarity of the nucleotide sequences of LOC286029 BINDING SITE, designated SEQ ID:15231, to the nucleotide sequence of GAM189 RNA, herein designated GAM RNA, also designated SEQ ID:246.

Another function of GAM189 is therefore inhibition of LOC286029 (Accession XP_209866.1). Accordingly, utilities of GAM189 include diagnosis, prevention and treatment of diseases and clinical conditions associated with LOC286029.

LOC286030 (Accession XP_209868.1) is another GAM189 target gene, herein designated TARGET GENE. LOC286030 BINDING SITE is a target binding site found in the 5' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:2244, to the nucleotide sequence of GAM189 RNA, herein designated GAM RNA, also designated SEQ ID:246.

Another function of GAM189 is therefore inhibition of LOC286030 (Accession XP_209868.1). Accordingly, utilities of GAM189 include diagnosis, prevention and treatment of diseases and clinical conditions associated with LOC286030.

LOC286039 (Accession XP_209873.1) is another GAM189 target gene, herein designated TARGET GENE. LOC286039 BINDING SITE is a target binding site found in the 5' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:11035, to the nucleotide sequence of GAM189 RNA, herein designated GAM RNA, also designated SEQ ID:246.

Another function of GAM189 is therefore inhibition of LOC286039 (Accession XP_209873.1). Accordingly, utilities of GAM189 include diagnosis, prevention and treatment of diseases and clinical conditions associated with LOC286039.

LOC286052 (Accession XP_212152.1) is another GAM189 target gene, herein designated TARGET GENE. LOC286052 BINDING SITE is a target binding site found in the 3' untranslated region of mRNA encoded by LOC286052, corresponding to a target binding site such as BINDING SITE I, BINDING SITE II or BINDING SITE III of FIG. 8. Table 4 illustrates the complementarity of the nucleotide sequences of LOC286052 BINDING SITE, designated SEQ ID:9367, to the nucleotide sequence of GAM189 RNA, herein designated GAM RNA, also designated SEQ ID:246.

Another function of GAM189 is therefore inhibition of LOC286052 (Accession XP_212152.1). Accordingly, utilities of GAM189 include diagnosis, prevention and treatment of diseases and clinical conditions associated with LOC286052.

LOC286075 (Accession NP_776192.1) is another GAM189 target gene, herein designated TARGET GENE. LOC286075 BINDING SITE is a target binding site found in the 5' untranslated region of mRNA encoded by LOC286075, corresponding to a target binding site such as BINDING SITE I, BINDING SITE II or BINDING SITE III of FIG. 8. Table 4 illustrates the complementarity of the nucleotide sequences of LOC286075 BINDING SITE, designated SEQ ID:17965, to the nucleotide sequence of GAM189 RNA, herein designated GAM RNA, also designated SEQ ID:246.

Another function of GAM189 is therefore inhibition of LOC286075 (Accession NP_776192.1). Accordingly, utilities of GAM189 include diagnosis, prevention and treatment of diseases and clinical conditions associated with LOC286075.

LOC286078 (Accession XP_212163.1) is another GAM189 target gene, herein designated TARGET GENE. LOC286078 BINDING SITE1 through LOC286078 BINDING SITE5 are target binding sites found in untranslated regions of mRNA encoded by LOC286078, corresponding to target binding sites such as BINDING SITE I, BINDING SITE II or BINDING SITE III of FIG. 8. Table 4 illustrates the complementarity of the nucleotide sequences of LOC286078 BINDING SITE1 through LOC286078 BINDING SITE5, designated SEQ ID:15589, SEQ ID:16716, SEQ ID:15083, SEQ ID:3810 and SEQ ID:13100 respectively, to the nucleotide sequence of GAM189 RNA, herein designated GAM RNA, also designated SEQ ID:246.

Another function of GAM189 is therefore inhibition of LOC286078 (Accession XP_212163.1). Accordingly, utilities of GAM189 include diagnosis, prevention and treatment of diseases and clinical conditions associated with LOC286078.

LOC286090 (Accession XP_212166.3) is another GAM189 target gene, herein designated TARGET GENE. LOC286090 BINDING SITE is a target binding site found in the 5' untranslated region of mRNA encoded by LOC286090, corresponding to a target binding site such as BINDING SITE I, BINDING SITE II or BINDING SITE III of FIG. 8. Table 4 illustrates the complementarity of the nucleotide sequences of LOC286090 BINDING SITE, designated SEQ ID:16409, to the nucleotide sequence of GAM189 RNA, herein designated GAM RNA, also designated SEQ ID:246.

Another function of GAM189 is therefore inhibition of LOC286090 (Accession XP_212166.3). Accordingly, utilities of GAM189 include diagnosis, prevention and treatment of diseases and clinical conditions associated with LOC286090.

LOC286126 (Accession XP_212185.1) is another GAM189 target gene, herein designated TARGET GENE. LOC286126 BINDING SITE is a target binding site found in the 3' untranslated region of mRNA encoded by LOC286126, corresponding to a target binding site such as BINDING SITE I, BINDING SITE II or BINDING SITE III of FIG. 8. Table 4 illustrates the complementarity of the nucleotide sequences of LOC286126 BINDING SITE, designated SEQ ID:7847, to the nucleotide sequence of GAM189 RNA, herein designated GAM RNA, also designated SEQ ID:246.

Another function of GAM189 is therefore inhibition of LOC286126 (Accession XP_212185.1). Accordingly, utilities of GAM189 include diagnosis, prevention and treatment of diseases and clinical conditions associated with LOC286126.

LOC286132 (Accession XP_212194.1) is another GAM189 target gene, herein designated TARGET GENE. LOC286132 BINDING SITE is a target binding site found in the 5' untranslated region of mRNA encoded by LOC286132, corresponding to a target binding site such as BINDING SITE I, BINDING SITE II or BINDING SITE III of FIG. 8. Table 4 illustrates the complementarity of the nucleotide sequences of LOC286132 BINDING SITE, designated SEQ ID:7113, to the nucleotide sequence of GAM189 RNA, herein designated GAM RNA, also designated SEQ ID:246.

Another function of GAM189 is therefore inhibition of LOC286132 (Accession XP_212194.1). Accordingly, utilities of GAM189 include diagnosis, prevention and treatment of diseases and clinical conditions associated with LOC286132.

LOC286135 (Accession XP_212196.1) is another GAM189 target gene, herein designated TARGET GENE. LOC286135 BINDING SITE is a target binding site found in the 3' untranslated region of mRNA encoded by LOC286135, corresponding to a target binding site such as BINDING SITE I, BINDING SITE II or BINDING SITE III of FIG. 8. Table 4 illustrates the complementarity of the nucleotide sequences of LOC286135 BINDING SITE, designated SEQ ID:9746, to the nucleotide sequence of GAM189 RNA, herein designated GAM RNA, also designated SEQ ID:246.

Another function of GAM189 is therefore inhibition of LOC286135 (Accession XP_212196.1). Accordingly, utilities of GAM189 include diagnosis, prevention and treatment of diseases and clinical conditions associated with LOC286135.

LOC286166 (Accession XP_209925.1) is another GAM189 target gene, herein designated TARGET GENE. LOC286166 BINDING SITE is a target binding site found in the 5' untranslated region of mRNA encoded by LOC286166, corresponding to a target binding site such as BINDING SITE I, BINDING SITE II or BINDING SITE III of FIG. 8. Table 4 illustrates the complementarity of the nucleotide sequences of LOC286166 BINDING SITE, designated SEQ ID:3927, to the nucleotide sequence of GAM189 RNA, herein designated GAM RNA, also designated SEQ ID:246.

Another function of GAM189 is therefore inhibition of LOC286166 (Accession XP_209925.1). Accordingly, utilities of GAM189 include diagnosis, prevention and treatment of diseases and clinical conditions associated with LOC286166.

LOC286170 (Accession XP_212211.1) is another GAM189 target gene, herein designated TARGET GENE. LOC286170 BINDING SITE is a target binding site found in the 5' untranslated region of mRNA encoded by LOC286170, corresponding to a target binding site such as BINDING SITE I, BINDING SITE II or BINDING SITE III of FIG. 8. Table 4 illustrates the complementarity of the nucleotide sequences of LOC286170 BINDING SITE, designated SEQ ID:8426, to the nucleotide sequence of GAM189 RNA, herein designated GAM RNA, also designated SEQ ID:246.

Another function of GAM189 is therefore inhibition of LOC286170 (Accession XP_212211.1). Accordingly, utilities of GAM189 include diagnosis, prevention and treatment of diseases and clinical conditions associated with LOC286170.

LOC286186 (Accession XP_212219.1) is another GAM189 target gene, herein designated TARGET GENE. LOC286186 BINDING SITE1 and LOC286186 BINDING SITE2 are target binding sites found in untranslated regions of mRNA encoded by LOC286186, corresponding to target binding sites such as BINDING SITE I, BINDING SITE II or BINDING SITE III of FIG. 8. Table 4 illustrates the complementarity of the nucleotide sequences of LOC286186 BINDING SITE1 and LOC286186 BINDING SITE2, designated SEQ ID:18020 and SEQ ID:3430 respectively, to the nucleotide sequence of GAM189 RNA, herein designated GAM RNA, also designated SEQ ID:246.

Another function of GAM189 is therefore inhibition of LOC286186 (Accession XP_212219.1). Accordingly, utilities of GAM189 include diagnosis, prevention and treatment of diseases and clinical conditions associated with LOC286186.

LOC286206 (Accession XP_209953.1) is another GAM189 target gene, herein designated TARGET GENE. LOC286206 BINDING SITE is a target binding site found in the 3' untranslated region of mRNA encoded by LOC286206, corresponding to a target binding site such as BINDING SITE I, BINDING SITE II or BINDING SITE III of FIG. 8. Table 4 illustrates the complementarity of the nucleotide sequences of LOC286206 BINDING SITE, designated SEQ ID:2600, to the nucleotide sequence of GAM189 RNA, herein designated GAM RNA, also designated SEQ ID:246.

Another function of GAM189 is therefore inhibition of LOC286206 (Accession XP_209953.1). Accordingly, utilities of GAM189 include diagnosis, prevention and treatment of diseases and clinical conditions associated with LOC286206.

LOC286207 (Accession XP_209941.1) is another GAM189 target gene, herein designated TARGET GENE. LOC286207 BINDING SITE is a target binding site found in the 3' untranslated region of mRNA encoded by LOC286207, corresponding to a target binding site such as BINDING SITE I, BINDING SITE II or BINDING SITE III of FIG. 8. Table 4 illustrates the complementarity of the nucleotide sequences of LOC286207 BINDING SITE, designated SEQ ID:19893, to the nucleotide sequence of GAM189 RNA, herein designated GAM RNA, also designated SEQ ID:246.

Another function of GAM189 is therefore inhibition of LOC286207 (Accession XP_209941.1). Accordingly, utilities of GAM189 include diagnosis, prevention and treatment of diseases and clinical conditions associated with LOC286207.

LOC286208 (Accession XP_212230.1) is another GAM189 target gene, herein designated TARGET GENE. LOC286208 BINDING SITE1 through LOC286208 BINDING SITE3 are target binding sites found in untranslated regions of mRNA encoded by LOC286208, corresponding to target binding sites such as BINDING SITE I, BINDING SITE II or BINDING SITE III of FIG. 8. Table 4 illustrates the complementarity of the nucleotide sequences of LOC286208 BINDING SITE1 through LOC286208 BINDING SITE3, designated SEQ ID:2849, SEQ ID:4372 and SEQ ID:9724 respectively, to the nucleotide sequence of GAM189 RNA, herein designated GAM RNA, also designated SEQ ID:246.

Another function of GAM189 is therefore inhibition of LOC286208 (Accession XP_212230.1). Accordingly, utilities of GAM189 include diagnosis, prevention and treatment of diseases and clinical conditions associated with LOC286208.

LOC286215 (Accession XP_212228.1) is another GAM189 target gene, herein designated TARGET GENE. LOC286215 BINDING SITE is a target binding site found in the 5' untranslated region of mRNA encoded by LOC286215, corresponding to a target binding site such as BINDING SITE I, BINDING SITE II or BINDING SITE III of FIG. 8. Table 4 illustrates the complementarity of the nucleotide sequences of LOC286215 BINDING SITE, designated SEQ ID:19240, to the nucleotide sequence of GAM189 RNA, herein designated GAM RNA, also designated SEQ ID:246.

Another function of GAM189 is therefore inhibition of LOC286215 (Accession XP_212228.1). Accordingly, utilities of GAM189 include diagnosis, prevention and treatment of diseases and clinical conditions associated with LOC286215.

LOC286221 (Accession XP_212233.1) is another GAM189 target gene, herein designated TARGET GENE. LOC286221 BINDING SITE is a target binding site found in the 5' untranslated region of mRNA encoded by LOC286221, corresponding to a target binding site such as BINDING SITE I, BINDING SITE II or BINDING SITE III of FIG. 8. Table 4 illustrates the complementarity of the nucleotide sequences of LOC286221 BINDING SITE, designated SEQ ID:7774, to the nucleotide sequence of GAM189 RNA, herein designated GAM RNA, also designated SEQ ID:246.

Another function of GAM189 is therefore inhibition of LOC286221 (Accession XP_212233.1). Accordingly, utilities of GAM189 include diagnosis, prevention and treatment of diseases and clinical conditions associated with LOC286221.

LOC286223 (Accession XP_209956.1) is another GAM189 target gene, herein designated TARGET GENE. LOC286223 BINDING SITE is a target binding site found in the 3' untranslated region of mRNA encoded by LOC286223, corresponding to a target binding site such as BINDING SITE I, BINDING SITE II or BINDING SITE III of FIG. 8. Table 4 illustrates the complementarity of the nucleotide sequences of LOC286223 BINDING SITE, designated SEQ ID:6118, to the nucleotide sequence of GAM189 RNA, herein designated GAM RNA, also designated SEQ ID:246.

Another function of GAM189 is therefore inhibition of LOC286223 (Accession XP_209956.1). Accordingly, utilities of GAM189 include diagnosis, prevention and treatment of diseases and clinical conditions associated with LOC286223.

LOC286245 (Accession XP_212244.1) is another GAM189 target gene, herein designated TARGET GENE. LOC286245 BINDING SITE is a target binding site found in the 5' untranslated region of mRNA encoded by LOC286245, corresponding to a target binding site such as BINDING SITE I, BINDING SITE II or BINDING SITE III of FIG. 8. Table 4 illustrates the complementarity of the nucleotide sequences of LOC286245 BINDING SITE, designated SEQ ID:6868, to the nucleotide sequence of GAM189 RNA, herein designated GAM RNA, also designated SEQ ID:246.

Another function of GAM189 is therefore inhibition of LOC286245 (Accession XP_212244.1). Accordingly, utilities of GAM189 include diagnosis, prevention and treatment of diseases and clinical conditions associated with LOC286245.

LOC286341 (Accession XP_212278.1) is another GAM189 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:15975, to the nucleotide sequence of GAM189 RNA, herein designated GAM RNA, also designated SEQ ID:246.

Another function of GAM189 is therefore inhibition of LOC286341 (Accession XP_212278.1). Accordingly, utilities of GAM189 include diagnosis, prevention and treatment of diseases and clinical conditions associated with LOC286341.

LOC286347 (Accession XP_208408.1) is another GAM189 target gene, herein designated TARGET GENE. LOC286347 BINDING SITE is a target binding site found in the 5' untranslated region of mRNA encoded by LOC286347, corresponding to a target binding site such as BINDING SITE I, BINDING SITE II or BINDING SITE III of FIG. 8. Table 4 illustrates the complementarity of the nucleotide sequences of LOC286347 BINDING SITE, designated SEQ ID:522, to the nucleotide sequence of GAM189 RNA, herein designated GAM RNA, also designated SEQ ID:246.

Another function of GAM189 is therefore inhibition of LOC286347 (Accession XP_208408.1). Accordingly, utilities of GAM189 include diagnosis, prevention and treatment of diseases and clinical conditions associated with LOC286347.

LOC286354 (Accession XP_212286.1) is another GAM189 target gene, herein designated TARGET GENE. LOC286354 BINDING SITE is a target binding site found in the 5' untranslated region of mRNA encoded by LOC286354, corresponding to a target binding site such as BINDING SITE I, BINDING SITE II or BINDING SITE III of FIG. 8. Table 4 illustrates the complementarity of the nucleotide sequences of LOC286354 BINDING SITE, designated SEQ ID:15730, to the nucleotide sequence of GAM189 RNA, herein designated GAM RNA, also designated SEQ ID:246.

Another function of GAM189 is therefore inhibition of LOC286354 (Accession XP_212286.1). Accordingly, utilities of GAM189 include diagnosis, prevention and treatment of diseases and clinical conditions associated with LOC286354.

LOC286356 (Accession XP_212290.1) is another GAM189 target gene, herein designated TARGET GENE. LOC286356 BINDING SITE is a target binding site found in the 5' untranslated region of mRNA encoded by LOC286356, corresponding to a target binding site such as BINDING SITE I, BINDING SITE II or BINDING SITE III of FIG. 8. Table 4 illustrates the complementarity of the nucleotide sequences of LOC286356 BINDING SITE, designated SEQ ID:7385, to the nucleotide sequence of GAM189 RNA, herein designated GAM RNA, also designated SEQ ID:246.

Another function of GAM189 is therefore inhibition of LOC286356 (Accession XP_212290.1). Accordingly, utilities of GAM189 include diagnosis, prevention and treatment of diseases and clinical conditions associated with LOC286356.

LOC286357 (Accession XP_212285.1) is another GAM189 target gene, herein designated TARGET GENE. LOC286357 BINDING SITE is a target binding site found in the 5' untranslated region of mRNA encoded by LOC286357, corresponding to a target binding site such as BINDING SITE I, BINDING SITE II or BINDING SITE III of FIG. 8. Table 4 illustrates the complementarity of the nucleotide sequences of LOC286357 BINDING SITE, designated SEQ ID:14974, to the nucleotide sequence of GAM189 RNA, herein designated GAM RNA, also designated SEQ ID:246.

Another function of GAM189 is therefore inhibition of LOC286357 (Accession XP_212285.1). Accordingly, utilities of GAM189 include diagnosis, prevention and treatment of diseases and clinical conditions associated with LOC286357.

LOC286371 (Accession XP_212291.1) is another GAM189 target gene, herein designated TARGET GENE. LOC286371 BINDING SITE is a target binding site found in the 3' untranslated region of mRNA encoded by LOC286371, corresponding to a target binding site such as BINDING SITE I, BINDING SITE II or BINDING SITE III of FIG. 8. Table 4 illustrates the complementarity of the nucleotide sequences of LOC286371 BINDING SITE, designated SEQ ID:3785, to the nucleotide sequence of GAM189 RNA, herein designated GAM RNA, also designated SEQ ID:246.

Another function of GAM189 is therefore inhibition of LOC286371 (Accession XP_212291.1). Accordingly, utilities of GAM189 include diagnosis, prevention and treatment of diseases and clinical conditions associated with LOC286371.

LOC286395 (Accession XP_212308.1) is another GAM189 target gene, herein designated TARGET GENE. LOC286395 BINDING SITE is a target binding site found in the 5' untranslated region of mRNA encoded by LOC286395, corresponding to a target binding site such as BINDING SITE I, BINDING SITE II or BINDING SITE III of FIG. 8. Table 4 illustrates the complementarity of the nucleotide sequences of LOC286395 BINDING SITE, designated SEQ ID:2722, to the nucleotide sequence of GAM189 RNA, herein designated GAM RNA, also designated SEQ ID:246.

Another function of GAM189 is therefore inhibition of LOC286395 (Accession XP_212308.1). Accordingly, utilities of GAM189 include diagnosis, prevention and treatment of diseases and clinical conditions associated with LOC286395.

LOC286401 (Accession XP_212310.1) is another GAM189 target gene, herein designated TARGET GENE. LOC286401 BINDING SITE is a target binding site found in the 5' untranslated region of mRNA encoded by LOC286401, corresponding to a target binding site such as BINDING SITE I, BINDING SITE II or BINDING SITE III of FIG. 8. Table 4 illustrates the complementarity of the nucleotide sequences of LOC286401 BINDING SITE, designated SEQ ID:1038, to the nucleotide sequence of GAM189 RNA, herein designated GAM RNA, also designated SEQ ID:246.

Another function of GAM189 is therefore inhibition of LOC286401 (Accession XP_212310.1). Accordingly, utilities of GAM189 include diagnosis, prevention and treatment of diseases and clinical conditions associated with LOC286401.

LOC286441 (Accession XP_212319.1) is another GAM189 target gene, herein designated TARGET GENE. LOC286441 BINDING SITE is a target binding site found in the 3' untranslated region of mRNA encoded by LOC286441, corresponding to a target binding site such as BINDING SITE I, BINDING SITE II or BINDING SITE III of FIG. 8. Table 4 illustrates the complementarity of the nucleotide sequences of LOC286441 BINDING SITE, designated SEQ ID:2754, to the nucleotide sequence of GAM189 RNA, herein designated GAM RNA, also designated SEQ ID:246.

Another function of GAM189 is therefore inhibition of LOC286441 (Accession XP_212319.1). Accordingly, utilities of GAM189 include diagnosis, prevention and treatment of diseases and clinical conditions associated with LOC286441.

LOC286467 (Accession XP_210063.1) is another GAM189 target gene, herein designated TARGET GENE. LOC286467 BINDING SITE is a target binding site found in the 3' untranslated region of mRNA encoded by LOC286467, corresponding to a target binding site such as BINDING SITE I, BINDING SITE II or BINDING SITE III of FIG. 8. Table 4 illustrates the complementarity of the nucleotide sequences of LOC286467 BINDING SITE, designated SEQ ID:9580, to the nucleotide sequence of GAM189 RNA, herein designated GAM RNA, also designated SEQ ID:246.

Another function of GAM189 is therefore inhibition of LOC286467 (Accession XP_210063.1). Accordingly, utilities of GAM189 include diagnosis, prevention and treatment of diseases and clinical conditions associated with LOC286467.

LOC286553 (Accession XP_212340.1) is another GAM189 target gene, herein designated TARGET GENE. LOC286553 BINDING SITE is a target binding site found in the 3' untranslated region of mRNA encoded by LOC286553, corresponding to a target binding site such as BINDING SITE I, BINDING SITE II or BINDING SITE III of FIG. 8. Table 4 illustrates the complementarity of the nucleotide sequences of LOC286553 BINDING SITE, designated SEQ ID:3183, to the nucleotide sequence of GAM189 RNA, herein designated GAM RNA, also designated SEQ ID:246.

Another function of GAM189 is therefore inhibition of LOC286553 (Accession XP_212340.1). Accordingly, utilities of GAM189 include diagnosis, prevention and treatment of diseases and clinical conditions associated with LOC286553.

LOC286558 (Accession XP_210106.1) is another GAM189 target gene, herein designated TARGET GENE. LOC286558 BINDING SITE is a target binding site found in the 3' untranslated region of mRNA encoded by LOC286558, corresponding to a target binding site such as BINDING SITE I, BINDING SITE II or BINDING SITE III of FIG. 8. Table 4 illustrates the complementarity of the nucleotide sequences of LOC286558 BINDING SITE, designated SEQ ID:9264, to the nucleotide sequence of GAM189 RNA, herein designated GAM RNA, also designated SEQ ID:246.

Another function of GAM189 is therefore inhibition of LOC286558 (Accession XP_210106.1). Accordingly, utilities of GAM189 include diagnosis, prevention and treatment of diseases and clinical conditions associated with LOC286558.

LOC286564 (Accession XP_210108.1) is another GAM189 target gene, herein designated TARGET GENE. LOC286564 BINDING SITE is a target binding site found in the 3' untranslated region of mRNA encoded by LOC286564, corresponding to a target binding site such as BINDING SITE I, BINDING SITE II or BINDING SITE III of FIG. 8. Table 4 illustrates the complementarity of the nucleotide sequences of LOC286564 BINDING SITE, designated SEQ ID:9264, to the nucleotide sequence of GAM189 RNA, herein designated GAM RNA, also designated SEQ ID:246.

Another function of GAM189 is therefore inhibition of LOC286564 (Accession XP_210108.1). Accordingly, utilities of GAM189 include diagnosis, prevention and treatment of diseases and clinical conditions associated with LOC286564.

LOC338562 (Accession XP_294654.1) is another GAM189 target gene, herein designated TARGET GENE. LOC338562 BINDING SITE is a target binding site found in the 3' untranslated region of mRNA encoded by LOC338562, corresponding to a target binding site such as BINDING SITE I, BINDING SITE II or BINDING SITE III of FIG. 8. Table 4 illustrates the complementarity of the nucleotide sequences of LOC338562 BINDING SITE, designated SEQ ID:13760, to the nucleotide sequence of GAM189 RNA, herein designated GAM RNA, also designated SEQ ID:246.

Another function of GAM189 is therefore inhibition of LOC338562 (Accession XP_294654.1). Accordingly, utilities of GAM189 include diagnosis, prevention and treatment of diseases and clinical conditions associated with LOC338562.

LOC338565 (Accession XP_294653.1) is another GAM189 target gene, herein designated TARGET GENE. LOC338565 BINDING SITE is a target binding site found in the 3' untranslated region of mRNA encoded by LOC338565, corresponding to a target binding site such as BINDING SITE I, BINDING SITE II or BINDING SITE III of FIG. 8. Table 4 illustrates the complementarity of the nucleotide sequences of LOC338565 BINDING SITE, designated SEQ ID:12867, to the nucleotide sequence of GAM189 RNA, herein designated GAM RNA, also designated SEQ ID:246.

Another function of GAM189 is therefore inhibition of LOC338565 (Accession XP_294653.1). Accordingly, utilities of GAM189 include diagnosis, prevention and treatment of diseases and clinical conditions associated with LOC338565.

LOC338575 (Accession XP_290473.1) is another GAM189 target gene, herein designated TARGET GENE. LOC338575 BINDING SITE is a target binding site found in the 3' untranslated region of mRNA encoded by LOC338575, corresponding to a target binding site such as BINDING SITE I, BINDING SITE II or BINDING SITE III of FIG. 8. Table 4 illustrates the complementarity of the nucleotide sequences of LOC338575 BINDING SITE, designated SEQ ID:14074, to the nucleotide sequence of GAM189 RNA, herein designated GAM RNA, also designated SEQ ID:246.

Another function of GAM189 is therefore inhibition of LOC338575 (Accession XP_290473.1). Accordingly, utilities of GAM189 include diagnosis, prevention and treatment of diseases and clinical conditions associated with LOC338575.

LOC338579 (Accession XP_290472.1) is another GAM189 target gene, herein designated TARGET GENE. LOC338579 BINDING SITE is a target binding site found in the 3' untranslated region of mRNA encoded by LOC338579, corresponding to a target binding site such as BINDING SITE I, BINDING SITE II or BINDING SITE III of FIG. 8. Table 4 illustrates the complementarity of the nucleotide sequences of LOC338579 BINDING SITE, designated SEQ ID:4528, to the nucleotide sequence of GAM189 RNA, herein designated GAM RNA, also designated SEQ ID:246.

Another function of GAM189 is therefore inhibition of LOC338579 (Accession XP_290472.1). Accordingly, utilities of GAM189 include diagnosis, prevention and treatment of diseases and clinical conditions associated with LOC338579.

LOC338585 (Accession XP_294658.1) is another GAM189 target gene, herein designated TARGET GENE. LOC338585 BINDING SITE is a target binding site found in the 5' untranslated region of mRNA encoded by LOC338585, corresponding to a target binding site such as BINDING SITE I, BINDING SITE II or BINDING SITE III of FIG. 8. Table 4 illustrates the complementarity of the nucleotide sequences of LOC338585 BINDING SITE, designated SEQ ID:7523, to the nucleotide sequence of GAM189 RNA, herein designated GAM RNA, also designated SEQ ID:246.

Another function of GAM189 is therefore inhibition of LOC338585 (Accession XP_294658.1). Accordingly, utilities of GAM189 include diagnosis, prevention and treatment of diseases and clinical conditions associated with LOC338585.

LOC338645 (Accession XP_290494.1) is another GAM189 target gene, herein designated TARGET GENE. LOC338645 BINDING SITE is a target binding site found in the 3' untranslated region of mRNA encoded by LOC338645, corresponding to a target binding site such as BINDING SITE I, BINDING SITE II or BINDING SITE III of FIG. 8. Table 4 illustrates the complementarity of the nucleotide sequences of LOC338645 BINDING SITE, designated SEQ ID:6626, to the nucleotide sequence of GAM189 RNA, herein designated GAM RNA, also designated SEQ ID:246.

Another function of GAM189 is therefore inhibition of LOC338645 (Accession XP_290494.1). Accordingly, utilities of GAM189 include diagnosis, prevention and treatment of diseases and clinical conditions associated with LOC338645.

LOC338709 (Accession XP_211595.2) is another GAM189 target gene, herein designated TARGET GENE. LOC338709 BINDING SITE is a target binding site found in the 5' untranslated region of mRNA encoded by LOC338709, corresponding to a target binding site such as BINDING SITE I, BINDING SITE II or BINDING SITE III of FIG. 8. Table 4 illustrates the complementarity of the nucleotide sequences of LOC338709 BINDING SITE, designated SEQ ID:12803, to the nucleotide sequence of GAM189 RNA, herein designated GAM RNA, also designated SEQ ID:246.

Another function of GAM189 is therefore inhibition of LOC338709 (Accession XP_211595.2). Accordingly, utilities of GAM189 include diagnosis, prevention and treatment of diseases and clinical conditions associated with LOC338709.

LOC338731 (Accession XP_294688.1) is another GAM189 target gene, herein designated TARGET GENE. LOC338731 BINDING SITE is a target binding site found in the 3' untranslated region of mRNA encoded by LOC338731, corresponding to a target binding site such as BINDING SITE I, BINDING SITE II or BINDING SITE III of FIG. 8. Table 4 illustrates the complementarity of the nucleotide sequences of LOC338731 BINDING SITE, designated SEQ ID:6518, to the nucleotide sequence of GAM189 RNA, herein designated GAM RNA, also designated SEQ ID:246.

Another function of GAM189 is therefore inhibition of LOC338731 (Accession XP_294688.1). Accordingly, utilities of GAM189 include diagnosis, prevention and treatment of diseases and clinical conditions associated with LOC338731.

LOC338739 (Accession XP_294690.1) is another GAM189 target gene, herein designated TARGET GENE. LOC338739 BINDING SITE1 and LOC338739 BINDING SITE2 are target binding sites found in untranslated regions of mRNA encoded by LOC338739, corresponding to target binding sites such as BINDING SITE I, BINDING SITE II or BINDING SITE III of FIG. 8. Table 4 illustrates the complementarity of the nucleotide sequences of LOC338739 BINDING SITE1 and LOC338739 BINDING SITE2, designated SEQ ID:15044 and SEQ ID:14732 respectively, to the nucleotide sequence of GAM189 RNA, herein designated GAM RNA, also designated SEQ ID:246.

Another function of GAM189 is therefore inhibition of LOC338739 (Accession XP_294690.1). Accordingly, utilities of GAM189 include diagnosis, prevention and treatment of diseases and clinical conditions associated with LOC338739.

LOC338773 (Accession XP_290570.1) is another GAM189 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:16493, to the nucleotide sequence of GAM189 RNA, herein designated GAM RNA, also designated SEQ ID:246.

Another function of GAM189 is therefore inhibition of LOC338773 (Accession XP_290570.1). Accordingly, utilities of GAM189 include diagnosis, prevention and treatment of diseases and clinical conditions associated with LOC338773.

LOC338819 (Accession XP_290216.1) is another GAM189 target gene, herein designated TARGET GENE. LOC338819 BINDING SITE is a target binding site found in the 3' untranslated region of mRNA encoded by LOC338819, corresponding to a target binding site such as BINDING SITE I, BINDING SITE II or BINDING SITE III of FIG. 8. Table 4 illustrates the complementarity of the nucleotide sequences of LOC338819 BINDING SITE, designated SEQ ID:11507, to the nucleotide sequence of GAM189 RNA, herein designated GAM RNA, also designated SEQ ID:246.

Another function of GAM189 is therefore inhibition of LOC338819 (Accession XP_290216.1). Accordingly, utilities of GAM189 include diagnosis, prevention and treatment of diseases and clinical conditions associated with LOC338819.

LOC338899 (Accession XP_294740.1) is another GAM189 target gene, herein designated TARGET GENE. LOC338899 BINDING SITE is a target binding site found in the 5' untranslated region of mRNA encoded by LOC338899, corresponding to a target binding site such as BINDING SITE I, BINDING SITE II or BINDING SITE III of FIG. 8. Table 4 illustrates the complementarity of the nucleotide sequences of LOC338899 BINDING SITE, designated SEQ ID:12341, to the nucleotide sequence of GAM189 RNA, herein designated GAM RNA, also designated SEQ ID:246.

Another function of GAM189 is therefore inhibition of LOC338899 (Accession XP_294740.1). Accordingly, utilities of GAM189 include diagnosis, prevention and treatment of diseases and clinical conditions associated with LOC338899.

LOC338923 (Accession XP_294742.1) is another GAM189 target gene, herein designated TARGET GENE. LOC338923 BINDING SITE1 and LOC338923 BINDING SITE2 are target binding sites found in untranslated regions of mRNA encoded by LOC338923, corresponding to target binding sites such as BINDING SITE I, BINDING SITE II or BINDING SITE III of FIG. 8. Table 4 illustrates the complementarity of the nucleotide sequences of LOC338923 BINDING SITE1 and LOC338923 BINDING SITE2, designated SEQ ID:8559 and SEQ ID:4298 respectively, to the nucleotide sequence of GAM189 RNA, herein designated GAM RNA, also designated SEQ ID:246.

Another function of GAM189 is therefore inhibition of LOC338923 (Accession XP_294742.1). Accordingly, utilities of GAM189 include diagnosis, prevention and treatment of diseases and clinical conditions associated with LOC338923.

LOC338963 (Accession XP_294757.1) is another GAM189 target gene, herein designated TARGET GENE. LOC338963 BINDING SITE is a target binding site found in the 3' untranslated region of mRNA encoded by LOC338963, corresponding to a target binding site such as BINDING SITE I, BINDING SITE II or BINDING SITE III of FIG. 8. Table 4 illustrates the complementarity of the nucleotide sequences of LOC338963 BINDING SITE, designated SEQ ID:3348, to the nucleotide sequence of GAM189 RNA, herein designated GAM RNA, also designated SEQ ID:246.

Another function of GAM189 is therefore inhibition of LOC338963 (Accession XP_294757.1). Accordingly, utilities of GAM189 include diagnosis, prevention and treatment of diseases and clinical conditions associated with LOC338963.

LOC338991 (Accession XP_290663.1) is another GAM189 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:12479, to the nucleotide sequence of GAM189 RNA, herein designated GAM RNA, also designated SEQ ID:246.

Another function of GAM189 is therefore inhibition of LOC338991 (Accession XP_290663.1). Accordingly, utilities of GAM189 include diagnosis, prevention and treatment of diseases and clinical conditions associated with LOC338991.

LOC338999 (Accession XP_290659.1) is another GAM189 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:12479, to the nucleotide sequence of GAM189 RNA, herein designated GAM RNA, also designated SEQ ID:246.

Another function of GAM189 is therefore inhibition of LOC338999 (Accession XP_290659.1). Accordingly, utilities of GAM189 include diagnosis, prevention and treatment of diseases and clinical conditions associated with LOC338999.

LOC339077 (Accession XP_294802.2) is another GAM189 target gene, herein designated TARGET GENE. LOC339077 BINDING SITE is a target binding site found in the 3' untranslated region of mRNA encoded by LOC339077, corresponding to a target binding site such as BINDING SITE I, BINDING SITE II or BINDING SITE III of FIG. 8. Table 4 illustrates the complementarity of the nucleotide sequences of LOC339077 BINDING SITE, designated SEQ ID:17484, to the nucleotide sequence of GAM189 RNA, herein designated GAM RNA, also designated SEQ ID:246.

Another function of GAM189 is therefore inhibition of LOC339077 (Accession XP_294802.2). Accordingly, utilities of GAM189 include diagnosis, prevention and treatment of diseases and clinical conditions associated with LOC339077.

LOC339078 (Accession XP_290692.1) is another GAM189 target gene, herein designated TARGET GENE. LOC339078 BINDING SITE is a target binding site found in the 3' untranslated region of mRNA encoded by LOC339078, corresponding to a target binding site such as BINDING SITE I, BINDING SITE II or BINDING SITE III of FIG. 8. Table 4 illustrates the complementarity of the nucleotide sequences of LOC339078 BINDING SITE, designated SEQ ID:9543, to the nucleotide sequence of GAM189 RNA, herein designated GAM RNA, also designated SEQ ID:246.

Another function of GAM189 is therefore inhibition of LOC339078 (Accession XP_290692.1). Accordingly, utilities of GAM189 include diagnosis, prevention and treatment of diseases and clinical conditions associated with LOC339078.

LOC339083 (Accession XP_290697.2) is another GAM189 target gene, herein designated TARGET GENE. LOC339083 BINDING SITE is a target binding site found in the 5' untranslated region of mRNA encoded by LOC339083, corresponding to a target binding site such as BINDING SITE I, BINDING SITE II or BINDING SITE III of FIG. 8. Table 4 illustrates the complementarity of the nucleotide sequences of LOC339083 BINDING SITE, designated SEQ ID:1843, to the nucleotide sequence of GAM189 RNA, herein designated GAM RNA, also designated SEQ ID:246.

Another function of GAM189 is therefore inhibition of LOC339083 (Accession XP_290697.2). Accordingly, utilities of GAM189 include diagnosis, prevention and treatment of diseases and clinical conditions associated with LOC339083.

LOC339108 (Accession XP_290711.1) is another GAM189 target gene, herein designated TARGET GENE.

LOC339108 BINDING SITE is a target binding site found in the 5' untranslated region of mRNA encoded by LOC339108, corresponding to a target binding site such as BINDING SITE I, BINDING SITE II or BINDING SITE III of FIG. 8. Table 4 illustrates the complementarity of the nucleotide sequences of LOC339108 BINDING SITE, designated SEQ ID:14266, to the nucleotide sequence of GAM189 RNA, herein designated GAM RNA, also designated SEQ ID:246.

Another function of GAM189 is therefore inhibition of LOC339108 (Accession XP_290711.1). Accordingly, utilities of GAM189 include diagnosis, prevention and treatment of diseases and clinical conditions associated with LOC339108.

LOC339146 (Accession XP_294825.1) is another GAM189 target gene, herein designated TARGET GENE. LOC339146 BINDING SITE is a target binding site found in the 5' untranslated region of mRNA encoded by LOC339146, corresponding to a target binding site such as BINDING SITE I, BINDING SITE II or BINDING SITE III of FIG. 8. Table 4 illustrates the complementarity of the nucleotide sequences of LOC339146 BINDING SITE, designated SEQ ID:15614, to the nucleotide sequence of GAM189 RNA, herein designated GAM RNA, also designated SEQ ID:246.

Another function of GAM189 is therefore inhibition of LOC339146 (Accession XP_294825.1). Accordingly, utilities of GAM189 include diagnosis, prevention and treatment of diseases and clinical conditions associated with LOC339146.

LOC339178 (Accession XP_290742.1) is another GAM189 target gene, herein designated TARGET GENE. LOC339178 BINDING SITE is a target binding site found in the 3' untranslated region of mRNA encoded by LOC339178, corresponding to a target binding site such as BINDING SITE I, BINDING SITE II or BINDING SITE III of FIG. 8. Table 4 illustrates the complementarity of the nucleotide sequences of LOC339178 BINDING SITE, designated SEQ ID:16261, to the nucleotide sequence of GAM189 RNA, herein designated GAM RNA, also designated SEQ ID:246.

Another function of GAM189 is therefore inhibition of LOC339178 (Accession XP_290742.1). Accordingly, utilities of GAM189 include diagnosis, prevention and treatment of diseases and clinical conditions associated with LOC339178.

LOC339201 (Accession XP_290756.1) is another GAM189 target gene, herein designated TARGET GENE. LOC339201 BINDING SITE is a target binding site found in the 3' untranslated region of mRNA encoded by LOC339201, corresponding to a target binding site such as BINDING SITE I, BINDING SITE II or BINDING SITE III of FIG. 8. Table 4 illustrates the complementarity of the nucleotide sequences of LOC339201 BINDING SITE, designated SEQ ID:4056, to the nucleotide sequence of GAM189 RNA, herein designated GAM RNA, also designated SEQ ID:246.

Another function of GAM189 is therefore inhibition of LOC339201 (Accession XP_290756.1). Accordingly, utilities of GAM189 include diagnosis, prevention and treatment of diseases and clinical conditions associated with LOC339201.

LOC339216 (Accession XP_290762.2) is another GAM189 target gene, herein designated TARGET GENE. LOC339216 BINDING SITE is a target binding site found in the 5' untranslated region of mRNA encoded by LOC339216, corresponding to a target binding site such as BINDING SITE I, BINDING SITE II or BINDING SITE III of FIG. 8. Table 4 illustrates the complementarity of the nucleotide sequences of LOC339216 BINDING SITE, designated SEQ ID:19537, to the nucleotide sequence of GAM189 RNA, herein designated GAM RNA, also designated SEQ ID:246.

Another function of GAM189 is therefore inhibition of LOC339216 (Accession XP_290762.2). Accordingly, utilities of GAM189 include diagnosis, prevention and treatment of diseases and clinical conditions associated with LOC339216.

LOC339248 (Accession XP_294879.1) is another GAM189 target gene, herein designated TARGET GENE. LOC339248 BINDING SITE is a target binding site found in the 3' untranslated region of mRNA encoded by LOC339248, corresponding to a target binding site such as BINDING SITE I, BINDING SITE II or BINDING SITE III of FIG. 8. Table 4 illustrates the complementarity of the nucleotide sequences of LOC339248 BINDING SITE, designated SEQ ID:19597, to the nucleotide sequence of GAM189 RNA, herein designated GAM RNA, also designated SEQ ID:246.

Another function of GAM189 is therefore inhibition of LOC339248 (Accession XP_294879.1). Accordingly, utilities of GAM189 include diagnosis, prevention and treatment of diseases and clinical conditions associated with LOC339248.

LOC339250 (Accession XP_294883.1) is another GAM189 target gene, herein designated TARGET GENE. LOC339250 BINDING SITE is a target binding site found in the 3' untranslated region of mRNA encoded by LOC339250, corresponding to a target binding site such as BINDING SITE I, BINDING SITE II or BINDING SITE III of FIG. 8. Table 4 illustrates the complementarity of the nucleotide sequences of LOC339250 BINDING SITE, designated SEQ ID:19597, to the nucleotide sequence of GAM189 RNA, herein designated GAM RNA, also designated SEQ ID:246.

Another function of GAM189 is therefore inhibition of LOC339250 (Accession XP_294883.1). Accordingly, utilities of GAM189 include diagnosis, prevention and treatment of diseases and clinical conditions associated with LOC339250.

LOC339282 (Accession XP_294900.2) is another GAM189 target gene, herein designated TARGET GENE. LOC339282 BINDING SITE is a target binding site found in the 5' untranslated region of mRNA encoded by LOC339282, corresponding to a target binding site such as BINDING SITE I, BINDING SITE II or BINDING SITE III of FIG. 8. Table 4 illustrates the complementarity of the nucleotide sequences of LOC339282 BINDING SITE, designated SEQ ID:19537, to the nucleotide sequence of GAM189 RNA, herein designated GAM RNA, also designated SEQ ID:246.

Another function of GAM189 is therefore inhibition of LOC339282 (Accession XP_294900.2). Accordingly, utilities of GAM189 include diagnosis, prevention and treatment of diseases and clinical conditions associated with LOC339282.

LOC339283 (Accession XP_294899.2) is another GAM189 target gene, herein designated TARGET GENE. LOC339283 BINDING SITE is a target binding site found in the 5' untranslated region of mRNA encoded by LOC339283, corresponding to a target binding site such as BINDING SITE I, BINDING SITE II or BINDING SITE III of FIG. 8. Table 4 illustrates the complementarity of the nucleotide sequences of LOC339283 BINDING SITE, designated SEQ ID:11314, to the nucleotide sequence of GAM189 RNA, herein designated GAM RNA, also designated SEQ ID:246.

Another function of GAM189 is therefore inhibition of LOC339283 (Accession XP_294899.2). Accordingly, utilities of GAM189 include diagnosis, prevention and treatment of diseases and clinical conditions associated with LOC339283.

LOC339324 (Accession XP_290838.1) is another GAM189 target gene, herein designated TARGET GENE. LOC339324 BINDING SITE is a target binding site found in the 3' untranslated region of mRNA encoded by LOC339324, corresponding to a target binding site such as BINDING SITE I, BINDING SITE II or BINDING SITE III of FIG. 8. Table 4 illustrates the complementarity of the nucleotide sequences of LOC339324 BINDING SITE, designated SEQ ID:9544, to the nucleotide sequence of GAM189 RNA, herein designated GAM RNA, also designated SEQ ID:246.

Another function of GAM189 is therefore inhibition of LOC339324 (Accession XP_290838.1). Accordingly, utilities of GAM189 include diagnosis, prevention and treatment of diseases and clinical conditions associated with LOC339324.

LOC339325 (Accession XP_290830.1) is another GAM189 target gene, herein designated TARGET GENE. LOC339325 BINDING SITE1 and LOC339325 BINDING SITE2 are target binding sites found in untranslated regions of mRNA encoded by LOC339325, corresponding to target binding sites such as BINDING SITE I, BINDING SITE II or BINDING SITE III of FIG. 8. Table 4 illustrates the complementarity of the nucleotide sequences of LOC339325 BINDING SITE1 and LOC339325 BINDING SITE2, designated SEQ ID:17114 and SEQ ID:16940 respectively, to the nucleotide sequence of GAM189 RNA, herein designated GAM RNA, also designated SEQ ID:246.

Another function of GAM189 is therefore inhibition of LOC339325 (Accession XP_290830.1). Accordingly, utilities of GAM189 include diagnosis, prevention and treatment of diseases and clinical conditions associated with LOC339325.

LOC339417 (Accession XP_294944.1) is another GAM189 target gene, herein designated TARGET GENE. LOC339417 BINDING SITE is a target binding site found in the 5' untranslated region of mRNA encoded by LOC339417, corresponding to a target binding site such as BINDING SITE I, BINDING SITE II or BINDING SITE III of FIG. 8. Table 4 illustrates the complementarity of the nucleotide sequences of LOC339417 BINDING SITE, designated SEQ ID:2027, to the nucleotide sequence of GAM189 RNA, herein designated GAM RNA, also designated SEQ ID:246.

Another function of GAM189 is therefore inhibition of LOC339417 (Accession XP_294944.1). Accordingly, utilities of GAM189 include diagnosis, prevention and treatment of diseases and clinical conditions associated with LOC339417.

LOC339448 (Accession XP_290902.1) is another GAM189 target gene, herein designated TARGET GENE. LOC339448 BINDING SITE is a target binding site found in the 3' untranslated region of mRNA encoded by LOC339448, corresponding to a target binding site such as BINDING SITE I, BINDING SITE II or BINDING SITE III of FIG. 8. Table 4 illustrates the complementarity of the nucleotide sequences of LOC339448 BINDING SITE, designated SEQ ID:10679, to the nucleotide sequence of GAM189 RNA, herein designated GAM RNA, also designated SEQ ID:246.

Another function of GAM189 is therefore inhibition of LOC339448 (Accession XP_290902.1). Accordingly, utilities of GAM189 include diagnosis, prevention and treatment of diseases and clinical conditions associated with LOC339448.

LOC339458 (Accession XP_290911.1) is another GAM189 target gene, herein designated TARGET GENE. LOC339458 BINDING SITE is a target binding site found in the 3' untranslated region of mRNA encoded by LOC339458, corresponding to a target binding site such as BINDING SITE I, BINDING SITE II or BINDING SITE III of FIG. 8. Table 4 illustrates the complementarity of the nucleotide sequences of LOC339458 BINDING SITE, designated SEQ ID:5488, to the nucleotide sequence of GAM189 RNA, herein designated GAM RNA, also designated SEQ ID:246.

Another function of GAM189 is therefore inhibition of LOC339458 (Accession XP_290911.1). Accordingly, utilities of GAM189 include diagnosis, prevention and treatment of diseases and clinical conditions associated with LOC339458.

LOC339459 (Accession XP_290907.2) is another GAM189 target gene, herein designated TARGET GENE. LOC339459 BINDING SITE is a target binding site found in the 3' untranslated region of mRNA encoded by LOC339459, corresponding to a target binding site such as BINDING SITE I, BINDING SITE II or BINDING SITE III of FIG. 8. Table 4 illustrates the complementarity of the nucleotide sequences of LOC339459 BINDING SITE, designated SEQ ID:13513, to the nucleotide sequence of GAM189 RNA, herein designated GAM RNA, also designated SEQ ID:246.

Another function of GAM189 is therefore inhibition of LOC339459 (Accession XP_290907.2). Accordingly, utilities of GAM189 include diagnosis, prevention and treatment of diseases and clinical conditions associated with LOC339459.

LOC339492 (Accession XP_290919.1) is another GAM189 target gene, herein designated TARGET GENE. LOC339492 BINDING SITE1 through LOC339492 BINDING SITE3 are target binding sites found in untranslated regions of mRNA encoded by LOC339492, corresponding to target binding sites such as BINDING SITE I, BINDING SITE II or BINDING SITE III of FIG. 8. Table 4 illustrates the complementarity of the nucleotide sequences of LOC339492 BINDING SITE1 through LOC339492 BINDING SITE3, designated SEQ ID:7386, SEQ ID:8590 and SEQ ID:695 respectively, to the nucleotide sequence of GAM189 RNA, herein designated GAM RNA, also designated SEQ ID:246.

Another function of GAM189 is therefore inhibition of LOC339492 (Accession XP_290919.1). Accordingly, utilities of GAM189 include diagnosis, prevention and treatment of diseases and clinical conditions associated with LOC339492.

LOC339577 (Accession XP_295005.1) is another GAM189 target gene, herein designated TARGET GENE. LOC339577 BINDING SITE1 and LOC339577 BINDING SITE2 are target binding sites found in untranslated regions of mRNA encoded by LOC339577, corresponding to target binding sites such as BINDING SITE I, BINDING SITE II or BINDING SITE III of FIG. 8. Table 4 illustrates the complementarity of the nucleotide sequences of LOC339577 BINDING SITE1 and LOC339577 BINDING SITE2, designated SEQ ID:14733 and SEQ ID:12075 respectively, to the nucleotide sequence of GAM189 RNA, herein designated GAM RNA, also designated SEQ ID:246.

Another function of GAM189 is therefore inhibition of LOC339577 (Accession XP_295005.1). Accordingly, utilities of GAM189 include diagnosis, prevention and treatment of diseases and clinical conditions associated with LOC339577.

LOC339600 (Accession XP_295014.1) is another GAM189 target gene, herein designated TARGET GENE. LOC339600 BINDING SITE is a target binding site found in the 3' untranslated region of mRNA encoded by LOC339600, corresponding to a target binding site such as BINDING SITE I, BINDING SITE II or BINDING SITE III of FIG. 8. Table 4 illustrates the complementarity of the nucleotide sequences of LOC339600 BINDING SITE, designated SEQ ID:15295, to the nucleotide sequence of GAM189 RNA, herein designated GAM RNA, also designated SEQ ID:246.

Another function of GAM189 is therefore inhibition of LOC339600 (Accession XP_295014.1). Accordingly, utilities of GAM189 include diagnosis, prevention and treatment of diseases and clinical conditions associated with LOC339600.

LOC339659 (Accession XP_290981.1) is another GAM189 target gene, herein designated TARGET GENE. LOC339659 BINDING SITE is a target binding site found in the 3' untranslated region of mRNA encoded by LOC339659, corresponding to a target binding site such as BINDING SITE I, BINDING SITE II or BINDING SITE III of FIG. 8. Table 4 illustrates the complementarity of the nucleotide sequences of LOC339659 BINDING SITE, designated SEQ ID:17076, to the nucleotide sequence of GAM189 RNA, herein designated GAM RNA, also designated SEQ ID:246.

Another function of GAM189 is therefore inhibition of LOC339659 (Accession XP_290981.1). Accordingly, utilities of GAM189 include diagnosis, prevention and treatment of diseases and clinical conditions associated with LOC339659.

LOC339685 (Accession XP_295032.1) is another GAM189 target gene, herein designated TARGET GENE. LOC339685 BINDING SITE is a target binding site found in the 5' untranslated region of mRNA encoded by LOC339685, corresponding to a target binding site such as BINDING SITE I, BINDING SITE II or BINDING SITE III of FIG. 8. Table 4 illustrates the complementarity of the nucleotide sequences of LOC339685 BINDING SITE, designated SEQ ID:1982, to the nucleotide sequence of GAM189 RNA, herein designated GAM RNA, also designated SEQ ID:246.

Another function of GAM189 is therefore inhibition of LOC339685 (Accession XP_295032.1). Accordingly, utilities of GAM189 include diagnosis, prevention and treatment of diseases and clinical conditions associated with LOC339685.

LOC339694 (Accession XP_295035.1) is another GAM189 target gene, herein designated TARGET GENE. LOC339694 BINDING SITE is a target binding site found in the 5' untranslated region of mRNA encoded by LOC339694, corresponding to a target binding site such as BINDING SITE I, BINDING SITE II or BINDING SITE III of FIG. 8. Table 4 illustrates the complementarity of the nucleotide sequences of LOC339694 BINDING SITE, designated SEQ ID:15954, to the nucleotide sequence of GAM189 RNA, herein designated GAM RNA, also designated SEQ ID:246.

Another function of GAM189 is therefore inhibition of LOC339694 (Accession XP_295035.1). Accordingly, utilities of GAM189 include diagnosis, prevention and treatment of diseases and clinical conditions associated with LOC339694.

LOC339711 (Accession XP_295038.1) is another GAM189 target gene, herein designated TARGET GENE. LOC339711 BINDING SITE is a target binding site found in the 3' untranslated region of mRNA encoded by LOC339711, corresponding to a target binding site such as BINDING SITE I, BINDING SITE II or BINDING SITE III of FIG. 8. Table 4 illustrates the complementarity of the nucleotide sequences of LOC339711 BINDING SITE, designated SEQ ID:11528, to the nucleotide sequence of GAM189 RNA, herein designated GAM RNA, also designated SEQ ID:246.

Another function of GAM189 is therefore inhibition of LOC339711 (Accession XP_295038.1). Accordingly, utilities of GAM189 include diagnosis, prevention and treatment of diseases and clinical conditions associated with LOC339711.

LOC339720 (Accession XP_295041.1) is another GAM189 target gene, herein designated TARGET GENE. LOC339720 BINDING SITE is a target binding site found in the 5' untranslated region of mRNA encoded by LOC339720, corresponding to a target binding site such as BINDING SITE I, BINDING SITE II or BINDING SITE III of FIG. 8. Table 4 illustrates the complementarity of the nucleotide sequences of LOC339720 BINDING SITE, designated SEQ ID:16942, to the nucleotide sequence of GAM189 RNA, herein designated GAM RNA, also designated SEQ ID:246.

Another function of GAM189 is therefore inhibition of LOC339720 (Accession XP_295041.1). Accordingly, utilities of GAM189 include diagnosis, prevention and treatment of diseases and clinical conditions associated with LOC339720.

LOC339803 (Accession XP_295072.1) is another GAM189 target gene, herein designated TARGET GENE. LOC339803 BINDING SITE is a target binding site found in the 3' untranslated region of mRNA encoded by LOC339803, corresponding to a target binding site such as BINDING SITE I, BINDING SITE II or BINDING SITE III of FIG. 8. Table 4 illustrates the complementarity of the nucleotide sequences of LOC339803 BINDING SITE, designated SEQ ID:13337, to the nucleotide sequence of GAM189 RNA, herein designated GAM RNA, also designated SEQ ID:246.

Another function of GAM189 is therefore inhibition of LOC339803 (Accession XP_295072.1). Accordingly, utilities of GAM189 include diagnosis, prevention and treatment of diseases and clinical conditions associated with LOC339803.

LOC339808 (Accession XP_295071.1) is another GAM189 target gene, herein designated TARGET GENE. LOC339808 BINDING SITE is a target binding site found in the 3' untranslated region of mRNA encoded by LOC339808, corresponding to a target binding site such as BINDING SITE I, BINDING SITE II or BINDING SITE III of FIG. 8. Table 4 illustrates the complementarity of the nucleotide sequences of LOC339808 BINDING SITE, designated SEQ ID:6146, to the nucleotide sequence of GAM189 RNA, herein designated GAM RNA, also designated SEQ ID:246.

Another function of GAM189 is therefore inhibition of LOC339808 (Accession XP_295071.1). Accordingly, utilities of GAM189 include diagnosis, prevention and treatment of diseases and clinical conditions associated with LOC339808.

LOC339809 (Accession XP_291020.1) is another GAM189 target gene, herein designated TARGET GENE. LOC339809 BINDING SITE1 and LOC339809 BINDING SITE2 are target binding sites found in untranslated regions of mRNA encoded by LOC339809, corresponding to target binding sites such as BINDING SITE I, BINDING SITE II or BINDING SITE III of FIG. 8. Table 4 illustrates the complementarity of the nucleotide sequences of LOC339809 BINDING SITE1 and LOC339809 BINDING SITE2, designated SEQ ID:1744 and SEQ ID:17750 respectively, to the nucleotide sequence of GAM189 RNA, herein designated GAM RNA, also designated SEQ ID:246.

Another function of GAM189 is therefore inhibition of LOC339809 (Accession XP_291020.1). Accordingly, utilities of GAM189 include diagnosis, prevention and treatment of diseases and clinical conditions associated with LOC339809.

LOC339833 (Accession XP_291031.1) is another GAM189 target gene, herein designated TARGET GENE. LOC339833 BINDING SITE1 and LOC339833 BINDING SITE2 are target binding sites found in untranslated regions of mRNA encoded by LOC339833, corresponding to target binding sites such as BINDING SITE I, BINDING SITE II or BINDING SITE III of FIG. 8. Table 4 illustrates the complementarity of the nucleotide sequences of LOC339833 BINDING SITE1 and LOC339833 BINDING SITE2, designated SEQ ID:7633 and SEQ ID:10421 respectively, to the nucleotide sequence of GAM189 RNA, herein designated GAM RNA, also designated SEQ ID:246.

Another function of GAM189 is therefore inhibition of LOC339833 (Accession XP_291031.1). Accordingly, utilities of GAM189 include diagnosis, prevention and treatment of diseases and clinical conditions associated with LOC339833.

LOC339834 (Accession XP_291033.1) is another GAM189 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:14645, to the nucleotide sequence of GAM189 RNA, herein designated GAM RNA, also designated SEQ ID:246.

Another function of GAM189 is therefore inhibition of LOC339834 (Accession XP_291033.1). Accordingly, utilities of GAM189 include diagnosis, prevention and treatment of diseases and clinical conditions associated with LOC339834.

LOC339834 (Accession NP_835467.1) is another GAM189 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:14645, to the nucleotide sequence of GAM189 RNA, herein designated GAM RNA, also designated SEQ ID:246.

Another function of GAM189 is therefore inhibition of LOC339834 (Accession NP_835467.1). Accordingly, utilities of GAM189 include diagnosis, prevention and treatment of diseases and clinical conditions associated with LOC339834.

LOC339872 (Accession XP_291050.1) is another GAM189 target gene, herein designated TARGET GENE. LOC339872 BINDING SITE1 through LOC339872 BINDING SITE3 are target binding sites found in untranslated regions of mRNA encoded by LOC339872, corresponding to target binding sites such as BINDING SITE I, BINDING SITE II or BINDING SITE III of FIG. 8. Table 4 illustrates the complementarity of the nucleotide sequences of LOC339872 BINDING SITE1 through LOC339872 BINDING SITE3, designated SEQ ID:5858, SEQ ID:9299 and SEQ ID:4026 respectively, to the nucleotide sequence of GAM189 RNA, herein designated GAM RNA, also designated SEQ ID:246.

Another function of GAM189 is therefore inhibition of LOC339872 (Accession XP_291050.1). Accordingly, utilities of GAM189 include diagnosis, prevention and treatment of diseases and clinical conditions associated with LOC339872.

LOC339894 (Accession XP_295095.1) is another GAM189 target gene, herein designated TARGET GENE. LOC339894 BINDING SITE is a target binding site found in the 5' untranslated region of mRNA encoded by LOC339894, corresponding to a target binding site such as BINDING SITE I, BINDING SITE II or BINDING SITE III of FIG. 8. Table 4 illustrates the complementarity of the nucleotide sequences of LOC339894 BINDING SITE, designated SEQ ID:1081, to the nucleotide sequence of GAM189 RNA, herein designated GAM RNA, also designated SEQ ID:246.

Another function of GAM189 is therefore inhibition of LOC339894 (Accession XP_295095.1). Accordingly, utilities of GAM189 include diagnosis, prevention and treatment of diseases and clinical conditions associated with LOC339894.

LOC339907 (Accession XP_291065.1) is another GAM189 target gene, herein designated TARGET GENE. LOC339907 BINDING SITE is a target binding site found in the 3' untranslated region of mRNA encoded by LOC339907, corresponding to a target binding site such as BINDING SITE I, BINDING SITE II or BINDING SITE III of FIG. 8. Table 4 illustrates the complementarity of the nucleotide sequences of LOC339907 BINDING SITE, designated SEQ ID:3425, to the nucleotide sequence of GAM189 RNA, herein designated GAM RNA, also designated SEQ ID:246.

Another function of GAM189 is therefore inhibition of LOC339907 (Accession XP_291065.1). Accordingly, utilities of GAM189 include diagnosis, prevention and treatment of diseases and clinical conditions associated with LOC339907.

LOC339909 (Accession XP_291069.1) is another GAM189 target gene, herein designated TARGET GENE. LOC339909 BINDING SITE is a target binding site found in the 5' untranslated region of mRNA encoded by LOC339909, corresponding to a target binding site such as BINDING SITE I, BINDING SITE II or BINDING SITE III of FIG. 8. Table 4 illustrates the complementarity of the nucleotide sequences of LOC339909 BINDING SITE, designated SEQ ID:10709, to the nucleotide sequence of GAM189 RNA, herein designated GAM RNA, also designated SEQ ID:246.

Another function of GAM189 is therefore inhibition of LOC339909 (Accession XP_291069.1). Accordingly, utilities of GAM189 include diagnosis, prevention and treatment of diseases and clinical conditions associated with LOC339909.

LOC339914 (Accession XP_295099.1) is another GAM189 target gene, herein designated TARGET GENE. LOC339914 BINDING SITE is a target binding site found in the 5' untranslated region of mRNA encoded by LOC339914, corresponding to a target binding site such as BINDING SITE I, BINDING SITE II or BINDING SITE III of FIG. 8. Table 4 illustrates the complementarity of the nucleotide sequences of LOC339914 BINDING SITE, designated SEQ ID:714, to the nucleotide sequence of GAM189 RNA, herein designated GAM RNA, also designated SEQ ID:246.

Another function of GAM189 is therefore inhibition of LOC339914 (Accession XP_295099.1). Accordingly, utilities of GAM189 include diagnosis, prevention and treatment of diseases and clinical conditions associated with LOC339914.

LOC339970 (Accession XP_291095.1) is another GAM189 target gene, herein designated TARGET GENE. LOC339970 BINDING SITE is a target binding site found in the 3' untranslated region of mRNA encoded by LOC339970, corresponding to a target binding site such as BINDING SITE I, BINDING SITE II or BINDING SITE III of FIG. 8. Table 4 illustrates the complementarity of the nucleotide sequences of LOC339970 BINDING SITE, designated SEQ ID:16942, to the nucleotide sequence of GAM189 RNA, herein designated GAM RNA, also designated SEQ ID:246.

Another function of GAM189 is therefore inhibition of LOC339970 (Accession XP_291095.1). Accordingly, utilities of GAM189 include diagnosis, prevention and treatment of diseases and clinical conditions associated with LOC339970.

LOC340037 (Accession XP_295137.1) is another GAM189 target gene, herein designated TARGET GENE. LOC340037 BINDING SITE is a target binding site found in the 3' untranslated region of mRNA encoded by LOC340037, corresponding to a target binding site such as BINDING SITE I, BINDING SITE II or BINDING SITE III of FIG. 8. Table 4 illustrates the complementarity of the nucleotide sequences of LOC340037 BINDING SITE, designated SEQ ID:12244, to the nucleotide sequence of GAM189 RNA, herein designated GAM RNA, also designated SEQ ID:246.

Another function of GAM189 is therefore inhibition of LOC340037 (Accession XP_295137.1). Accordingly, utilities of GAM189 include diagnosis, prevention and treatment of diseases and clinical conditions associated with LOC340037.

LOC340125 (Accession XP_291150.1) is another GAM189 target gene, herein designated TARGET GENE. LOC340125 BINDING SITE is a target binding site found in the 5' untranslated region of mRNA encoded by LOC340125, corresponding to a target binding site such as BINDING SITE I, BINDING SITE II or BINDING SITE III of FIG. 8. Table 4 illustrates the complementarity of the nucleotide sequences of LOC340125 BINDING SITE, designated SEQ ID:12803, to the nucleotide sequence of GAM189 RNA, herein designated GAM RNA, also designated SEQ ID:246.

Another function of GAM189 is therefore inhibition of LOC340125 (Accession XP_291150.1). Accordingly, utilities of GAM189 include diagnosis, prevention and treatment of diseases and clinical conditions associated with LOC340125.

LOC340138 (Accession XP_291153.1) is another GAM189 target gene, herein designated TARGET GENE. LOC340138 BINDING SITE is a target binding site found in the 3' untranslated region of mRNA encoded by LOC340138, corresponding to a target binding site such as BINDING SITE I, BINDING SITE II or BINDING SITE III of FIG. 8. Table 4 illustrates the complementarity of the nucleotide sequences of LOC340138 BINDING SITE, designated SEQ ID:11753, to the nucleotide sequence of GAM189 RNA, herein designated GAM RNA, also designated SEQ ID:246.

Another function of GAM189 is therefore inhibition of LOC340138 (Accession XP_291153.1). Accordingly, utilities of GAM189 include diagnosis, prevention and treatment of diseases and clinical conditions associated with LOC340138.

LOC340156 (Accession XP_291158.1) is another GAM189 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:10096, to the nucleotide sequence of GAM189 RNA, herein designated GAM RNA, also designated SEQ ID:246.

Another function of GAM189 is therefore inhibition of LOC340156 (Accession XP_291158.1). Accordingly, utilities of GAM189 include diagnosis, prevention and treatment of diseases and clinical conditions associated with LOC340156.

LOC340227 (Accession XP_291203.1) is another GAM189 target gene, herein designated TARGET GENE. LOC340227 BINDING SITE is a target binding site found in the 5' untranslated region of mRNA encoded by LOC340227, corresponding to a target binding site such as BINDING SITE I, BINDING SITE II or BINDING SITE III of FIG. 8. Table 4 illustrates the complementarity of the nucleotide sequences of LOC340227 BINDING SITE, designated SEQ ID:12803, to the nucleotide sequence of GAM189 RNA, herein designated GAM RNA, also designated SEQ ID:246.

Another function of GAM189 is therefore inhibition of LOC340227 (Accession XP_291203.1). Accordingly, utilities of GAM189 include diagnosis, prevention and treatment of diseases and clinical conditions associated with LOC340227.

LOC340238 (Accession XP_295188.1) is another GAM189 target gene, herein designated TARGET GENE. LOC340238 BINDING SITE is a target binding site found in the 5' untranslated region of mRNA encoded by LOC340238, corresponding to a target binding site such as BINDING SITE I, BINDING SITE II or BINDING SITE III of FIG. 8. Table 4 illustrates the complementarity of the nucleotide sequences of LOC340238 BINDING SITE, designated SEQ ID:2179, to the nucleotide sequence of GAM189 RNA, herein designated GAM RNA, also designated SEQ ID:246.

Another function of GAM189 is therefore inhibition of LOC340238 (Accession XP_295188.1). Accordingly, utilities of GAM189 include diagnosis, prevention and treatment of diseases and clinical conditions associated with LOC340238.

LOC340259 (Accession XP_295190.1) is another GAM189 target gene, herein designated TARGET GENE. LOC340259 BINDING SITE is a target binding site found in the 5' untranslated region of mRNA encoded by LOC340259, corresponding to a target binding site such as BINDING SITE I, BINDING SITE II or BINDING SITE III of FIG. 8. Table 4 illustrates the complementarity of the nucleotide sequences of LOC340259 BINDING SITE, designated SEQ ID:18147, to the nucleotide sequence of GAM189 RNA, herein designated GAM RNA, also designated SEQ ID:246.

Another function of GAM189 is therefore inhibition of LOC340259 (Accession XP_295190.1). Accordingly, utilities of GAM189 include diagnosis, prevention and treatment of diseases and clinical conditions associated with LOC340259.

LOC340290 (Accession XP_291214.1) is another GAM189 target gene, herein designated TARGET GENE. LOC340290 BINDING SITE is a target binding site found in the 5' untranslated region of mRNA encoded by LOC340290, corresponding to a target binding site such as BINDING SITE I, BINDING SITE II or BINDING SITE III of FIG. 8. Table 4 illustrates the complementarity of the nucleotide sequences of LOC340290 BINDING SITE, designated SEQ ID:15740, to the nucleotide sequence of GAM189 RNA, herein designated GAM RNA, also designated SEQ ID:246.

Another function of GAM189 is therefore inhibition of LOC340290 (Accession XP_291214.1). Accordingly, utilities of GAM189 include diagnosis, prevention and treatment of diseases and clinical conditions associated with LOC340290.

LOC340390 (Accession XP_291269.1) is another GAM189 target gene, herein designated TARGET GENE. LOC340390 BINDING SITE is a target binding site found in the 3' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:18868, to the nucleotide sequence of GAM189 RNA, herein designated GAM RNA, also designated SEQ ID:246.

Another function of GAM189 is therefore inhibition of LOC340390 (Accession XP_291269.1). Accordingly, utilities of GAM189 include diagnosis, prevention and treatment of diseases and clinical conditions associated with LOC340390.

LOC340408 (Accession XP_291274.1) is another GAM189 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:1309, to the nucleotide sequence of GAM189 RNA, herein designated GAM RNA, also designated SEQ ID:246.

Another function of GAM189 is therefore inhibition of LOC340408 (Accession XP_291274.1). Accordingly, utilities of GAM189 include diagnosis, prevention and treatment of diseases and clinical conditions associated with LOC340408.

LOC340414 (Accession XP_295240.1) is another GAM189 target gene, herein designated TARGET GENE. LOC340414 BINDING SITE is a target binding site found in the 3' untranslated region of mRNA encoded by LOC340414, corresponding to a target binding site such as BINDING SITE I, BINDING SITE II or BINDING SITE III of FIG. 8. Table 4 illustrates the complementarity of the nucleotide sequences of LOC340414 BINDING SITE, designated SEQ ID:1744, to the nucleotide sequence of GAM189 RNA, herein designated GAM RNA, also designated SEQ ID:246.

Another function of GAM189 is therefore inhibition of LOC340414 (Accession XP_295240.1). Accordingly, utilities of GAM189 include diagnosis, prevention and treatment of diseases and clinical conditions associated with LOC340414.

LOC340450 (Accession XP_295252.1) is another GAM189 target gene, herein designated TARGET GENE. LOC340450 BINDING SITE is a target binding site found in the 5' untranslated region of mRNA encoded by LOC340450, corresponding to a target binding site such as BINDING SITE I, BINDING SITE II or BINDING SITE III of FIG. 8. Table 4 illustrates the complementarity of the nucleotide sequences of LOC340450 BINDING SITE, designated SEQ ID:1744, to the nucleotide sequence of GAM189 RNA, herein designated GAM RNA, also designated SEQ ID:246.

Another function of GAM189 is therefore inhibition of LOC340450 (Accession XP_295252.1). Accordingly, utilities of GAM189 include diagnosis, prevention and treatment of diseases and clinical conditions associated with LOC340450.

LOC340528 (Accession XP_295268.1) is another GAM189 target gene, herein designated TARGET GENE. LOC340528 BINDING SITE is a target binding site found in the 5' untranslated region of mRNA encoded by LOC340528, corresponding to a target binding site such as BINDING SITE I, BINDING SITE II or BINDING SITE III of FIG. 8. Table 4 illustrates the complementarity of the nucleotide sequences of LOC340528 BINDING SITE, designated SEQ ID:13053, to the nucleotide sequence of GAM189 RNA, herein designated GAM RNA, also designated SEQ ID:246.

Another function of GAM189 is therefore inhibition of LOC340528 (Accession XP_295268.1). Accordingly, utilities of GAM189 include diagnosis, prevention and treatment of diseases and clinical conditions associated with LOC340528.

LOC342926 (Accession XP_292790.2) is another GAM189 target gene, herein designated TARGET GENE. LOC342926 BINDING SITE is a target binding site found in the 3' untranslated region of mRNA encoded by LOC342926, corresponding to a target binding site such as BINDING SITE I, BINDING SITE II or BINDING SITE III of FIG. 8. Table 4 illustrates the complementarity of the nucleotide sequences of LOC342926 BINDING SITE, designated SEQ ID:13464, to the nucleotide sequence of GAM189 RNA, herein designated GAM RNA, also designated SEQ ID:246.

Another function of GAM189 is therefore inhibition of LOC342926 (Accession XP_292790.2). Accordingly, utilities of GAM189 include diagnosis, prevention and treatment of diseases and clinical conditions associated with LOC342926.

LOC343435 (Accession XP_295563.1) is another GAM189 target gene, herein designated TARGET GENE. LOC343435 BINDING SITE is a target binding site found in the 5' untranslated region of mRNA encoded by LOC343435, corresponding to a target binding site such as BINDING SITE I, BINDING SITE II or BINDING SITE III of FIG. 8. Table 4 illustrates the complementarity of the nucleotide sequences of LOC343435 BINDING SITE, designated SEQ ID:439, to the nucleotide sequence of GAM189 RNA, herein designated GAM RNA, also designated SEQ ID:246.

Another function of GAM189 is therefore inhibition of LOC343435 (Accession XP_295563.1). Accordingly, utilities of GAM189 include diagnosis, prevention and treatment of diseases and clinical conditions associated with LOC343435.

LOC345275 (Accession NP_835236.1) is another GAM189 target gene, herein designated TARGET GENE. LOC345275 BINDING SITE is a target binding site found in the 3' untranslated region of multiple transcripts of mRNA encoded by LOC345275, corresponding to a target binding site such as BINDING SITE I, BINDING SITE II or BINDING SITE III of FIG. 8. Table 4 illustrates the complementarity of the nucleotide sequences of LOC345275 BINDING SITE, designated SEQ ID:523, to the nucleotide sequence of GAM189 RNA, herein designated GAM RNA, also designated SEQ ID:246.

Another function of GAM189 is therefore inhibition of LOC345275 (Accession NP_835236.1). Accordingly, utilities of GAM189 include diagnosis, prevention and treatment of diseases and clinical conditions associated with LOC345275.

LOC345878 (Accession XP_293993.2) is another GAM189 target gene, herein designated TARGET GENE. LOC345878 BINDING SITE is a target binding site found in the 5' untranslated region of mRNA encoded by LOC345878, corresponding to a target binding site such as BINDING SITE I, BINDING SITE II or BINDING SITE III of FIG. 8. Table 4 illustrates the complementarity of the nucleotide sequences of LOC345878 BINDING SITE, designated SEQ ID:12611, to the nucleotide sequence of GAM189 RNA, herein designated GAM RNA, also designated SEQ ID:246.

Another function of GAM189 is therefore inhibition of LOC345878 (Accession XP_293993.2). Accordingly, utilities of GAM189 include diagnosis, prevention and treatment of diseases and clinical conditions associated with LOC345878.

LOC346653 (Accession XP_294357.2) is another GAM189 target gene, herein designated TARGET GENE. LOC346653 BINDING SITE is a target binding site found in the 3' untranslated region of mRNA encoded by LOC346653, corresponding to a target binding site such as BINDING SITE I, BINDING SITE II or BINDING SITE III of FIG. 8. Table 4 illustrates the complementarity of the nucleotide sequences of LOC346653 BINDING SITE, designated SEQ ID:17927, to the nucleotide sequence of GAM189 RNA, herein designated GAM RNA, also designated SEQ ID:246.

Another function of GAM189 is therefore inhibition of LOC346653 (Accession XP_294357.2). Accordingly, utilities of GAM189 include diagnosis, prevention and treatment of diseases and clinical conditions associated with LOC346653.

LOC347648 (Accession XP_300226.1) is another GAM189 target gene, herein designated TARGET GENE. LOC347648 BINDING SITE is a target binding site found in the 3' untranslated region of mRNA encoded by LOC347648, corresponding to a target binding site such as BINDING SITE I, BINDING SITE II or BINDING SITE III of FIG. 8. Table 4 illustrates the complementarity of the nucleotide sequences of LOC347648 BINDING SITE, designated SEQ ID:9837, to the nucleotide sequence of GAM189 RNA, herein designated GAM RNA, also designated SEQ ID:246.

Another function of GAM189 is therefore inhibition of LOC347648 (Accession XP_300226.1). Accordingly, utilities of GAM189 include diagnosis, prevention and treatment of diseases and clinical conditions associated with LOC347648.

LOC347764 (Accession XP_300530.1) is another GAM189 target gene, herein designated TARGET GENE. LOC347764 BINDING SITE is a target binding site found in the 5' untranslated region of mRNA encoded by LOC347764, corresponding to a target binding site such as BINDING SITE I, BINDING SITE II or BINDING SITE III of FIG. 8. Table 4 illustrates the complementarity of the nucleotide sequences of LOC347764 BINDING SITE, designated SEQ ID:11420, to the nucleotide sequence of GAM189 RNA, herein designated GAM RNA, also designated SEQ ID:246.

Another function of GAM189 is therefore inhibition of LOC347764 (Accession XP_300530.1). Accordingly, utilities of GAM189 include diagnosis, prevention and treatment of diseases and clinical conditions associated with LOC347764.

LOC347905 (Accession XP_302624.1) is another GAM189 target gene, herein designated TARGET GENE. LOC347905 BINDING SITE is a target binding site found in the 5' untranslated region of mRNA encoded by LOC347905, corresponding to a target binding site such as BINDING SITE I, BINDING SITE II or BINDING SITE III of FIG. 8. Table 4 illustrates the complementarity of the nucleotide sequences of LOC347905 BINDING SITE, designated SEQ ID:9505, to the nucleotide sequence of GAM189 RNA, herein designated GAM RNA, also designated SEQ ID:246.

Another function of GAM189 is therefore inhibition of LOC347905 (Accession XP_302624.1). Accordingly, utilities of GAM189 include diagnosis, prevention and treatment of diseases and clinical conditions associated with LOC347905.

LOC347918 (Accession XP_300565.1) is another GAM189 target gene, herein designated TARGET GENE. LOC347918 BINDING SITE is a target binding site found in the 5' untranslated region of mRNA encoded by LOC347918, corresponding to a target binding site such as BINDING SITE I, BINDING SITE II or BINDING SITE III of FIG. 8. Table 4 illustrates the complementarity of the nucleotide sequences of LOC347918 BINDING SITE, designated SEQ ID:17689, to the nucleotide sequence of GAM189 RNA, herein designated GAM RNA, also designated SEQ ID:246.

Another function of GAM189 is therefore inhibition of LOC347918 (Accession XP_300565.1). Accordingly, utilities of GAM189 include diagnosis, prevention and treatment of diseases and clinical conditions associated with LOC347918.

LOC348075 (Accession XP_302653.1) is another GAM189 target gene, herein designated TARGET GENE. LOC348075 BINDING SITE1 and LOC348075 BINDING SITE2 are target binding sites found in untranslated regions of mRNA encoded by LOC348075, corresponding to target binding sites such as BINDING SITE I, BINDING SITE II or BINDING SITE III of FIG. 8. Table 4 illustrates the complementarity of the nucleotide sequences of LOC348075 BINDING SITE1 and LOC348075 BINDING SITE2, designated SEQ ID:13716 and SEQ ID:14381 respectively, to the nucleotide sequence of GAM189 RNA, herein designated GAM RNA, also designated SEQ ID:246.

Another function of GAM189 is therefore inhibition of LOC348075 (Accession XP_302653.1). Accordingly, utilities of GAM189 include diagnosis, prevention and treatment of diseases and clinical conditions associated with LOC348075.

LOC348094 (Accession XP_300615.1) is another GAM189 target gene, herein designated TARGET GENE. LOC348094 BINDING SITE1 and LOC348094 BINDING SITE2 are target binding sites found in untranslated regions of mRNA encoded by LOC348094, corresponding to target binding sites such as BINDING SITE I, BINDING SITE II or BINDING SITE III of FIG. 8. Table 4 illustrates the complementarity of the nucleotide sequences of LOC348094 BINDING SITE1 and LOC348094 BINDING SITE2, designated SEQ ID:13332 and SEQ ID:16473 respectively, to the nucleotide sequence of GAM189 RNA, herein designated GAM RNA, also designated SEQ ID:246.

Another function of GAM189 is therefore inhibition of LOC348094 (Accession XP_300615.1). Accordingly, utilities of GAM189 include diagnosis, prevention and treatment of diseases and clinical conditions associated with LOC348094.

LOC348113 (Accession XP_300623.1) is another GAM189 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:12479, to the nucleotide sequence of GAM189 RNA, herein designated GAM RNA, also designated SEQ ID:246.

Another function of GAM189 is therefore inhibition of LOC348113 (Accession XP_300623.1). Accordingly, utilities of GAM189 include diagnosis, prevention and treatment of diseases and clinical conditions associated with LOC348113.

LOC348115 (Accession XP_300626.1) is another GAM189 target gene, herein designated TARGET GENE. LOC348115 BINDING SITE is a target binding site found in the 5' untranslated region of mRNA encoded by LOC348115, corresponding to a target binding site such as BINDING SITE I, BINDING SITE II or BINDING SITE III of FIG. 8. Table 4 illustrates the complementarity of the nucleotide sequences of LOC348115 BINDING SITE, designated SEQ ID:13705, to the nucleotide sequence of GAM189 RNA, herein designated GAM RNA, also designated SEQ ID:246.

Another function of GAM189 is therefore inhibition of LOC348115 (Accession XP_300626.1). Accordingly, utilities of GAM189 include diagnosis, prevention and treatment of diseases and clinical conditions associated with LOC348115.

LOC348137 (Accession XP_300635.1) is another GAM189 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:12479, to the nucleotide sequence of GAM189 RNA, herein designated GAM RNA, also designated SEQ ID:246.

Another function of GAM189 is therefore inhibition of LOC348137 (Accession XP_300635.1). Accordingly, utilities of GAM189 include diagnosis, prevention and treatment of diseases and clinical conditions associated with LOC348137.

LOC348142 (Accession XP_300636.1) is another GAM189 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:12479, to the nucleotide sequence of GAM189 RNA, herein designated GAM RNA, also designated SEQ ID:246.

Another function of GAM189 is therefore inhibition of LOC348142 (Accession XP_300636.1). Accordingly, utilities of GAM189 include diagnosis, prevention and treatment of diseases and clinical conditions associated with LOC348142.

LOC348235 (Accession XP_300670.1) is another GAM189 target gene, herein designated TARGET GENE. LOC348235 BINDING SITE is a target binding site found in the 3' untranslated region of mRNA encoded by LOC348235, corresponding to a target binding site such as BINDING SITE I, BINDING SITE II or BINDING SITE III of FIG. 8. Table 4 illustrates the complementarity of the nucleotide sequences of LOC348235 BINDING SITE, designated SEQ ID:15852, to the nucleotide sequence of GAM189 RNA, herein designated GAM RNA, also designated SEQ ID:246.

Another function of GAM189 is therefore inhibition of LOC348235 (Accession XP_300670.1). Accordingly, utilities of GAM189 include diagnosis, prevention and treatment of diseases and clinical conditions associated with LOC348235.

LOC348262 (Accession XP_300683.1) is another GAM189 target gene, herein designated TARGET GENE. LOC348262 BINDING SITE is a target binding site found in the 5' untranslated region of mRNA encoded by LOC348262, corresponding to a target binding site such as BINDING SITE I, BINDING SITE II or BINDING SITE III of FIG. 8. Table 4 illustrates the complementarity of the nucleotide sequences of LOC348262 BINDING SITE, designated SEQ ID:7306, to the nucleotide sequence of GAM189 RNA, herein designated GAM RNA, also designated SEQ ID:246.

Another function of GAM189 is therefore inhibition of LOC348262 (Accession XP_300683.1). Accordingly, utilities of GAM189 include diagnosis, prevention and treatment of diseases and clinical conditions associated with LOC348262.

LOC348314 (Accession XP_302716.1) is another GAM189 target gene, herein designated TARGET GENE. LOC348314 BINDING SITE is a target binding site found in the 5' untranslated region of mRNA encoded by LOC348314, corresponding to a target binding site such as BINDING SITE I, BINDING SITE II or BINDING SITE III of FIG. 8. Table 4 illustrates the complementarity of the nucleotide sequences of LOC348314 BINDING SITE, designated SEQ ID:16669, to the nucleotide sequence of GAM189 RNA, herein designated GAM RNA, also designated SEQ ID:246.

Another function of GAM189 is therefore inhibition of LOC348314 (Accession XP_302716.1). Accordingly, utilities of GAM189 include diagnosis, prevention and treatment of diseases and clinical conditions associated with LOC348314.

LOC348326 (Accession XP_300696.1) is another GAM189 target gene, herein designated TARGET GENE. LOC348326 BINDING SITE is a target binding site found in the 3' untranslated region of mRNA encoded by LOC348326, corresponding to a target binding site such as BINDING SITE I, BINDING SITE II or BINDING SITE III of FIG. 8. Table 4 illustrates the complementarity of the nucleotide sequences of LOC348326 BINDING SITE, designated SEQ ID:19778, to the nucleotide sequence of GAM189 RNA, herein designated GAM RNA, also designated SEQ ID:246.

Another function of GAM189 is therefore inhibition of LOC348326 (Accession XP_300696.1). Accordingly, utilities of GAM189 include diagnosis, prevention and treatment of diseases and clinical conditions associated with LOC348326.

LOC348327 (Accession XP_030209.2) is another GAM189 target gene, herein designated TARGET GENE. LOC348327 BINDING SITE is a target binding site found in the 3' untranslated region of mRNA encoded by LOC348327, corresponding to a target binding site such as BINDING SITE I, BINDING SITE II or BINDING SITE III of FIG. 8. Table 4 illustrates the complementarity of the nucleotide sequences of LOC348327 BINDING SITE, designated SEQ ID:8820, to the nucleotide sequence of GAM189 RNA, herein designated GAM RNA, also designated SEQ ID:246.

Another function of GAM189 is therefore inhibition of LOC348327 (Accession XP_030209.2). Accordingly, utilities of GAM189 include diagnosis, prevention and treatment of diseases and clinical conditions associated with LOC348327.

LOC348393 (Accession XP_302741.1) is another GAM189 target gene, herein designated TARGET GENE. LOC348393 BINDING SITE1 and LOC348393 BINDING SITE2 are target binding sites found in untranslated regions of mRNA encoded by LOC348393, corresponding to target binding sites such as BINDING SITE I, BINDING SITE II or BINDING SITE III of FIG. 8. Table 4 illustrates the complementarity of the nucleotide sequences of LOC348393 BINDING SITE1 and LOC348393 BINDING SITE2, designated SEQ ID:872 and SEQ ID:11192 respectively, to the nucleotide sequence of GAM189 RNA, herein designated GAM RNA, also designated SEQ ID:246.

Another function of GAM189 is therefore inhibition of LOC348393 (Accession XP_302741.1). Accordingly, utilities of GAM189 include diagnosis, prevention and treatment of diseases and clinical conditions associated with LOC348393.

LOC348396 (Accession XP_300729.1) is another GAM189 target gene, herein designated TARGET GENE. LOC348396 BINDING SITE1 through LOC348396 BINDING SITE3 are target binding sites found in untranslated regions of mRNA encoded by LOC348396, corresponding to target binding sites such as BINDING SITE I, BINDING SITE II or BINDING SITE III of FIG. 8. Table 4 illustrates the complementarity of the nucleotide sequences of LOC348396 BINDING SITE1 through LOC348396 BINDING SITE3, designated SEQ ID:10270, SEQ ID:1569 and SEQ ID:9545 respectively, to the nucleotide sequence of GAM189 RNA, herein designated GAM RNA, also designated SEQ ID:246.

Another function of GAM189 is therefore inhibition of LOC348396 (Accession XP_300729.1). Accordingly, utilities of GAM189 include diagnosis, prevention and treatment of diseases and clinical conditions associated with LOC348396.

LOC348402 (Accession XP_300730.1) is another GAM189 target gene, herein designated TARGET GENE. LOC348402 BINDING SITE1 through LOC348402 BINDING SITE3 are target binding sites found in untranslated regions of mRNA encoded by LOC348402, corresponding to target binding sites such as BINDING SITE I, BINDING SITE II or BINDING SITE III of FIG. 8. Table 4 illustrates the complementarity of the nucleotide sequences of LOC348402 BINDING SITE1 through LOC348402 BINDING SITE3, designated SEQ ID:7386, SEQ ID:695 and SEQ ID:8590 respectively, to the nucleotide sequence of GAM189 RNA, herein designated GAM RNA, also designated SEQ ID:246.

Another function of GAM189 is therefore inhibition of LOC348402 (Accession XP_300730.1). Accordingly, utilities of GAM189 include diagnosis, prevention and treatment of diseases and clinical conditions associated with LOC348402.

LOC348445 (Accession XP_300738.1) is another GAM189 target gene, herein designated TARGET GENE. LOC348445 BINDING SITE is a target binding site found in the 3' untranslated region of mRNA encoded by LOC348445, corresponding to a target binding site such as BINDING SITE I, BINDING SITE II or BINDING SITE III of FIG. 8. Table 4 illustrates the complementarity of the nucleotide sequences of LOC348445 BINDING SITE, designated SEQ ID:19778, to the nucleotide sequence of GAM189 RNA, herein designated GAM RNA, also designated SEQ ID:246.

Another function of GAM189 is therefore inhibition of LOC348445 (Accession XP_300738.1). Accordingly, utilities of GAM189 include diagnosis, prevention and treatment of diseases and clinical conditions associated with LOC348445.

LOC348455 (Accession XP_302760.1) is another GAM189 target gene, herein designated TARGET GENE. LOC348455 BINDING SITE is a target binding site found in the 3' untranslated region of mRNA encoded by LOC348455, corresponding to a target binding site such as BINDING SITE I, BINDING SITE II or BINDING SITE III of FIG. 8. Table 4 illustrates the complementarity of the nucleotide sequences of LOC348455 BINDING SITE, designated SEQ ID:15049, to the nucleotide sequence of GAM189 RNA, herein designated GAM RNA, also designated SEQ ID:246.

Another function of GAM189 is therefore inhibition of LOC348455 (Accession XP_302760.1). Accordingly, utilities of GAM189 include diagnosis, prevention and treatment of diseases and clinical conditions associated with LOC348455.

LOC348460 (Accession XP_300743.1) is another GAM189 target gene, herein designated TARGET GENE. LOC348460 BINDING SITE1 and LOC348460 BINDING SITE2 are target binding sites found in untranslated regions of mRNA encoded by LOC348460, corresponding to target binding sites such as BINDING SITE I, BINDING SITE II or BINDING SITE III of FIG. 8. Table 4 illustrates the complementarity of the nucleotide sequences of LOC348460 BINDING SITE1 and LOC348460 BINDING SITE2, designated SEQ ID:13465 and SEQ ID:4143 respectively, to the nucleotide sequence of GAM189 RNA, herein designated GAM RNA, also designated SEQ ID:246.

Another function of GAM189 is therefore inhibition of LOC348460 (Accession XP_300743.1). Accordingly, utilities of GAM189 include diagnosis, prevention and treatment of diseases and clinical conditions associated with LOC348460.

LOC348474 (Accession XP_209299.2) is another GAM189 target gene, herein designated TARGET GENE. LOC348474 BINDING SITE is a target binding site found in the 3' untranslated region of mRNA encoded by LOC348474, corresponding to a target binding site such as BINDING SITE I, BINDING SITE II or BINDING SITE III of FIG. 8. Table 4 illustrates the complementarity of the nucleotide sequences of LOC348474 BINDING SITE, designated SEQ ID:17206, to the nucleotide sequence of GAM189 RNA, herein designated GAM RNA, also designated SEQ ID:246.

Another function of GAM189 is therefore inhibition of LOC348474 (Accession XP_209299.2). Accordingly, utilities of GAM189 include diagnosis, prevention and treatment of diseases and clinical conditions associated with LOC348474.

LOC348494 (Accession XP_302789.1) is another GAM189 target gene, herein designated TARGET GENE. LOC348494 BINDING SITE is a target binding site found in the 5' untranslated region of mRNA encoded by LOC348494, corresponding to a target binding site such as BINDING SITE I, BINDING SITE II or BINDING SITE III of FIG. 8. Table 4 illustrates the complementarity of the nucleotide sequences of LOC348494 BINDING SITE, designated SEQ ID:6119, to the nucleotide sequence of GAM189 RNA, herein designated GAM RNA, also designated SEQ ID:246.

Another function of GAM189 is therefore inhibition of LOC348494 (Accession XP_302789.1). Accordingly, utilities of GAM189 include diagnosis, prevention and treatment of diseases and clinical conditions associated with LOC348494.

LOC348503 (Accession XP_300762.1) is another GAM189 target gene, herein designated TARGET GENE. LOC348503 BINDING SITE is a target binding site found in the 3' untranslated region of mRNA encoded by LOC348503, corresponding to a target binding site such as BINDING SITE I, BINDING SITE II or BINDING SITE III of FIG. 8. Table 4 illustrates the complementarity of the nucleotide sequences of LOC348503 BINDING SITE, designated SEQ ID:19361, to the nucleotide sequence of GAM189 RNA, herein designated GAM RNA, also designated SEQ ID:246.

Another function of GAM189 is therefore inhibition of LOC348503 (Accession XP_300762.1). Accordingly, utilities of GAM189 include diagnosis, prevention and treatment of diseases and clinical conditions associated with LOC348503.

LOC348508 (Accession XP_302806.1) is another GAM189 target gene, herein designated TARGET GENE. LOC348508 BINDING SITE is a target binding site found in the 5' untranslated region of mRNA encoded by LOC348508, corresponding to a target binding site such as BINDING SITE I, BINDING SITE II or BINDING SITE III of FIG. 8. Table 4 illustrates the complementarity of the nucleotide sequences of LOC348508 BINDING SITE, designated SEQ ID:12803, to the nucleotide sequence of GAM189 RNA, herein designated GAM RNA, also designated SEQ ID:246.

Another function of GAM189 is therefore inhibition of LOC348508 (Accession XP_302806.1). Accordingly, utilities of GAM189 include diagnosis, prevention and treatment of diseases and clinical conditions associated with LOC348508.

LOC348525 (Accession XP_300778.1) is another GAM189 target gene, herein designated TARGET GENE. LOC348525 BINDING SITE is a target binding site found in the 3' untranslated region of mRNA encoded by LOC348525, corresponding to a target binding site such as BINDING SITE I, BINDING SITE II or BINDING SITE III of FIG. 8. Table 4 illustrates the complementarity of the nucleotide sequences of LOC348525 BINDING SITE, designated SEQ ID:5488, to the nucleotide sequence of GAM189 RNA, herein designated GAM RNA, also designated SEQ ID:246.

Another function of GAM189 is therefore inhibition of LOC348525 (Accession XP_300778.1). Accordingly, utilities of GAM189 include diagnosis, prevention and treatment of diseases and clinical conditions associated with LOC348525.

LOC348532 (Accession XP_302818.1) is another GAM189 target gene, herein designated TARGET GENE. LOC348532 BINDING SITE1 and LOC348532 BINDING SITE2 are target binding sites found in untranslated regions of mRNA encoded by LOC348532, corresponding to target binding sites such as BINDING SITE I, BINDING SITE II or BINDING SITE III of FIG. 8. Table 4 illustrates the complementarity of the nucleotide sequences of LOC348532 BINDING SITE1 and LOC348532 BINDING SITE2, designated SEQ ID:872 and SEQ ID:11192 respectively, to the nucleotide sequence of GAM189 RNA, herein designated GAM RNA, also designated SEQ ID:246.

Another function of GAM189 is therefore inhibition of LOC348532 (Accession XP_302818.1). Accordingly, utilities of GAM189 include diagnosis, prevention and treatment of diseases and clinical conditions associated with LOC348532.

LOC348583 (Accession XP_302833.1) is another GAM189 target gene, herein designated TARGET GENE. LOC348583 BINDING SITE is a target binding site found in the 3' untranslated region of mRNA encoded by LOC348583, corresponding to a target binding site such as BINDING SITE I, BINDING SITE II or BINDING SITE III of FIG. 8. Table 4 illustrates the complementarity of the nucleotide sequences of LOC348583 BINDING SITE, designated SEQ ID:8544, to the nucleotide sequence of GAM189 RNA, herein designated GAM RNA, also designated SEQ ID:246.

Another function of GAM189 is therefore inhibition of LOC348583 (Accession XP_302833.1). Accordingly, utilities of GAM189 include diagnosis, prevention and treatment of diseases and clinical conditions associated with LOC348583.

LOC348594 (Accession XP_302834.1) is another GAM189 target gene, herein designated TARGET GENE. LOC348594 BINDING SITE is a target binding site found in the 5' untranslated region of mRNA encoded by LOC348594, corresponding to a target binding site such as BINDING SITE I, BINDING SITE II or BINDING SITE III of FIG. 8. Table 4 illustrates the complementarity of the nucleotide sequences of LOC348594 BINDING SITE, designated SEQ ID:16785, to the nucleotide sequence of GAM189 RNA, herein designated GAM RNA, also designated SEQ ID:246.

Another function of GAM189 is therefore inhibition of LOC348594 (Accession XP_302834.1). Accordingly, utilities of GAM189 include diagnosis, prevention and treatment of diseases and clinical conditions associated with LOC348594.

LOC348595 (Accession XP_302837.1) is another GAM189 target gene, herein designated TARGET GENE. LOC348595 BINDING SITE is a target binding site found in the 3' untranslated region of mRNA encoded by LOC348595, corresponding to a target binding site such as BINDING SITE I, BINDING SITE II or BINDING SITE III of FIG. 8. Table 4 illustrates the complementarity of the nucleotide sequences of LOC348595 BINDING SITE, designated SEQ ID:16785, to the nucleotide sequence of GAM189 RNA, herein designated GAM RNA, also designated SEQ ID:246.

Another function of GAM189 is therefore inhibition of LOC348595 (Accession XP_302837.1). Accordingly, utilities of GAM189 include diagnosis, prevention and treatment of diseases and clinical conditions associated with LOC348595.

LOC348603 (Accession XP_302844.1) is another GAM189 target gene, herein designated TARGET GENE. LOC348603 BINDING SITE is a target binding site found in the 5' untranslated region of mRNA encoded by LOC348603, corresponding to a target binding site such as BINDING SITE I, BINDING SITE II or BINDING SITE III of FIG. 8. Table 4 illustrates the complementarity of the nucleotide sequences of LOC348603 BINDING SITE, designated SEQ ID:16785, to the nucleotide sequence of GAM189 RNA, herein designated GAM RNA, also designated SEQ ID:246.

Another function of GAM189 is therefore inhibition of LOC348603 (Accession XP_302844.1). Accordingly, utilities of GAM189 include diagnosis, prevention and treatment of diseases and clinical conditions associated with LOC348603.

LOC348605 (Accession XP_300793.1) is another GAM189 target gene, herein designated TARGET GENE. LOC348605 BINDING SITE is a target binding site found in the 3' untranslated region of mRNA encoded by LOC348605, corresponding to a target binding site such as BINDING SITE I, BINDING SITE II or BINDING SITE III of FIG. 8. Table 4 illustrates the complementarity of the nucleotide sequences of LOC348605 BINDING SITE, designated SEQ ID:16785, to the nucleotide sequence of GAM189 RNA, herein designated GAM RNA, also designated SEQ ID:246.

Another function of GAM189 is therefore inhibition of LOC348605 (Accession XP_300793.1). Accordingly, utilities of GAM189 include diagnosis, prevention and treatment of diseases and clinical conditions associated with LOC348605.

LOC348702 (Accession XP_300808.1) is another GAM189 target gene, herein designated TARGET GENE. LOC348702 BINDING SITE is a target binding site found in the 5' untranslated region of mRNA encoded by LOC348702, corresponding to a target binding site such as BINDING SITE I, BINDING SITE II or BINDING SITE III of FIG. 8. Table 4 illustrates the complementarity of the nucleotide sequences of LOC348702 BINDING SITE, designated SEQ ID:7387, to the nucleotide sequence of GAM189 RNA, herein designated GAM RNA, also designated SEQ ID:246.

Another function of GAM189 is therefore inhibition of LOC348702 (Accession XP_300808.1). Accordingly, utilities of GAM189 include diagnosis, prevention and treatment of diseases and clinical conditions associated with LOC348702.

LOC348790 (Accession XP_300843.1) is another GAM189 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:810, to the nucleotide sequence of GAM189 RNA, herein designated GAM RNA, also designated SEQ ID:246.

Another function of GAM189 is therefore inhibition of LOC348790 (Accession XP_300843.1). Accordingly, utilities of GAM189 include diagnosis, prevention and treatment of diseases and clinical conditions associated with LOC348790.

LOC348797 (Accession XP_302888.1) is another GAM189 target gene, herein designated TARGET GENE. LOC348797 BINDING SITE is a target binding site found in the 3' untranslated region of mRNA encoded by LOC348797, corresponding to a target binding site such as BINDING SITE I, BINDING SITE II or BINDING SITE III of FIG. 8. Table 4 illustrates the complementarity of the nucleotide sequences of LOC348797 BINDING SITE, designated SEQ ID:7741, to the nucleotide sequence of GAM189 RNA, herein designated GAM RNA, also designated SEQ ID:246.

Another function of GAM189 is therefore inhibition of LOC348797 (Accession XP_302888.1). Accordingly, utilities of GAM189 include diagnosis, prevention and treatment of diseases and clinical conditions associated with LOC348797.

LOC348798 (Accession XP_300845.1) is another GAM189 target gene, herein designated TARGET GENE. LOC348798 BINDING SITE is a target binding site found in the 5' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:19402, to the nucleotide sequence of GAM189 RNA, herein designated GAM RNA, also designated SEQ ID:246.

Another function of GAM189 is therefore inhibition of LOC348798 (Accession XP_300845.1). Accordingly, utilities of GAM189 include diagnosis, prevention and treatment of diseases and clinical conditions associated with LOC348798.

LOC348825 (Accession XP_300853.1) is another GAM189 target gene, herein designated TARGET GENE. LOC348825 BINDING SITE is a target binding site found in the 5' untranslated region of mRNA encoded by LOC348825, corresponding to a target binding site such as BINDING SITE I, BINDING SITE II or BINDING SITE III of FIG. 8. Table 4 illustrates the complementarity of the nucleotide sequences of LOC348825 BINDING SITE, designated SEQ ID:15126, to the nucleotide sequence of GAM189 RNA, herein designated GAM RNA, also designated SEQ ID:246.

Another function of GAM189 is therefore inhibition of LOC348825 (Accession XP_300853.1). Accordingly, utilities of GAM189 include diagnosis, prevention and treatment of diseases and clinical conditions associated with LOC348825.

LOC348842 (Accession XP_300861.1) is another GAM189 target gene, herein designated TARGET GENE. LOC348842 BINDING SITE is a target binding site found in the 5' untranslated region of mRNA encoded by LOC348842, corresponding to a target binding site such as BINDING SITE I, BINDING SITE II or BINDING SITE III of FIG. 8. Table 4 illustrates the complementarity of the nucleotide sequences of LOC348842 BINDING SITE, designated SEQ ID:12803, to the nucleotide sequence of GAM189 RNA, herein designated GAM RNA, also designated SEQ ID:246.

Another function of GAM189 is therefore inhibition of LOC348842 (Accession XP_300861.1). Accordingly, utilities of GAM189 include diagnosis, prevention and treatment of diseases and clinical conditions associated with LOC348842.

LOC348947 (Accession XP_302929.1) is another GAM189 target gene, herein designated TARGET GENE. LOC348947 BINDING SITE is a target binding site found in the 3' untranslated region of mRNA encoded by LOC348947, corresponding to a target binding site such as BINDING SITE I, BINDING SITE II or BINDING SITE III of FIG. 8. Table 4 illustrates the complementarity of the nucleotide sequences of LOC348947 BINDING SITE, designated SEQ ID:8605, to the nucleotide sequence of GAM189 RNA, herein designated GAM RNA, also designated SEQ ID:246.

Another function of GAM189 is therefore inhibition of LOC348947 (Accession XP_302929.1). Accordingly, utilities of GAM189 include diagnosis, prevention and treatment of diseases and clinical conditions associated with LOC348947.

LOC348995 (Accession XP_300434.1) is another GAM189 target gene, herein designated TARGET GENE. LOC348995 BINDING SITE is a target binding site found in the 3' untranslated region of mRNA encoded by LOC348995, corresponding to a target binding site such as BINDING SITE I, BINDING SITE II or BINDING SITE III of FIG. 8. Table 4 illustrates the complementarity of the nucleotide sequences of LOC348995 BINDING SITE, designated SEQ ID:1900, to the nucleotide sequence of GAM189 RNA, herein designated GAM RNA, also designated SEQ ID:246.

Another function of GAM189 is therefore inhibition of LOC348995 (Accession XP_300434.1). Accordingly, utilities of GAM189 include diagnosis, prevention and treatment of diseases and clinical conditions associated with LOC348995.

LOC349024 (Accession XP_300250.1) is another GAM189 target gene, herein designated TARGET GENE. LOC349024 BINDING SITE1 and LOC349024 BINDING SITE2 are target binding sites found in untranslated regions of mRNA encoded by LOC349024, corresponding to target binding sites such as BINDING SITE I, BINDING SITE II or BINDING SITE III of FIG. 8. Table 4 illustrates the complementarity of the nucleotide sequences of LOC349024 BINDING SITE1 and LOC349024 BINDING SITE2, designated SEQ ID:1746 and SEQ ID:4617 respectively, to the nucleotide sequence of GAM189 RNA, herein designated GAM RNA, also designated SEQ ID:246.

Another function of GAM189 is therefore inhibition of LOC349024 (Accession XP_300250.1). Accordingly, utilities of GAM189 include diagnosis, prevention and treatment of diseases and clinical conditions associated with LOC349024.

LOC349075 (Accession XP_300932.1) is another GAM189 target gene, herein designated TARGET GENE. LOC349075 BINDING SITE is a target binding site found in the 3' untranslated region of mRNA encoded by LOC349075, corresponding to a target binding site such as BINDING SITE I, BINDING SITE II or BINDING SITE III of FIG. 8. Table 4 illustrates the complementarity of the nucleotide sequences of LOC349075 BINDING SITE, designated SEQ ID:16022, to the nucleotide sequence of GAM189 RNA, herein designated GAM RNA, also designated SEQ ID:246.

Another function of GAM189 is therefore inhibition of LOC349075 (Accession XP_300932.1). Accordingly, utilities of GAM189 include diagnosis, prevention and treatment of diseases and clinical conditions associated with LOC349075.

LOC349096 (Accession XP_300937.1) is another GAM189 target gene, herein designated TARGET GENE. LOC349096 BINDING SITE is a target binding site found in the 3' untranslated region of mRNA encoded by LOC349096, corresponding to a target binding site such as BINDING SITE I, BINDING SITE II or BINDING SITE III of FIG. 8. Table 4 illustrates the complementarity of the nucleotide sequences of LOC349096 BINDING SITE, designated SEQ ID:6188, to the nucleotide sequence of GAM189 RNA, herein designated GAM RNA, also designated SEQ ID:246.

Another function of GAM189 is therefore inhibition of LOC349096 (Accession XP_300937.1). Accordingly, utilities of GAM189 include diagnosis, prevention and treatment of diseases and clinical conditions associated with LOC349096.

LOC349114 (Accession XP_302960.1) is another GAM189 target gene, herein designated TARGET GENE. LOC349114 BINDING SITE is a target binding site found in the 5' untranslated region of mRNA encoded by LOC349114, corresponding to a target binding site such as BINDING SITE I, BINDING SITE II or BINDING SITE III of FIG. 8. Table 4 illustrates the complementarity of the nucleotide sequences of LOC349114 BINDING SITE, designated SEQ ID:12803, to the nucleotide sequence of GAM189 RNA, herein designated GAM RNA, also designated SEQ ID:246.

Another function of GAM189 is therefore inhibition of LOC349114 (Accession XP_302960.1). Accordingly, utilities of GAM189 include diagnosis, prevention and treatment of diseases and clinical conditions associated with LOC349114.

LOC349170 (Accession XP_300969.1) is another GAM189 target gene, herein designated TARGET GENE. LOC349170 BINDING SITE1 through LOC349170 BINDING SITE5 are target binding sites found in untranslated regions of mRNA encoded by LOC349170, corresponding to target binding sites such as BINDING SITE I, BINDING SITE II or BINDING SITE III of FIG. 8. Table 4 illustrates the complementarity of the nucleotide sequences of LOC349170 BINDING SITE1 through LOC349170 BINDING SITE5, designated SEQ ID:9545, SEQ ID:11508, SEQ ID:18074, SEQ ID:3349 and SEQ ID:958 respectively, to the nucleotide sequence of GAM189 RNA, herein designated GAM RNA, also designated SEQ ID:246.

Another function of GAM189 is therefore inhibition of LOC349170 (Accession XP_300969.1). Accordingly, utilities of GAM189 include diagnosis, prevention and treatment of diseases and clinical conditions associated with LOC349170.

LOC349251 (Accession XP_300251.1) is another GAM189 target gene, herein designated TARGET GENE. LOC349251 BINDING SITE1 and LOC349251 BINDING SITE2 are target binding sites found in untranslated regions of mRNA encoded by LOC349251, corresponding to target binding sites such as BINDING SITE I, BINDING SITE II or BINDING SITE III of FIG. 8. Table 4 illustrates the complementarity of the nucleotide sequences of LOC349251 BINDING SITE1 and LOC349251 BINDING SITE2, designated SEQ ID:4454 and SEQ ID:2323 respectively, to the nucleotide sequence of GAM189 RNA, herein designated GAM RNA, also designated SEQ ID:246.

Another function of GAM189 is therefore inhibition of LOC349251 (Accession XP_300251.1). Accordingly, utilities of GAM189 include diagnosis, prevention and treatment of diseases and clinical conditions associated with LOC349251.

LOC349360 (Accession XP_088528.1) is another GAM189 target gene, herein designated TARGET GENE. LOC349360 BINDING SITE is a target binding site found in the 5' untranslated region of mRNA encoded by LOC349360, corresponding to a target binding site such as BINDING SITE I, BINDING SITE II or BINDING SITE III of FIG. 8. Table 4 illustrates the complementarity of the nucleotide sequences of LOC349360 BINDING SITE, designated SEQ ID:10639, to the nucleotide sequence of GAM189 RNA, herein designated GAM RNA, also designated SEQ ID:246.

Another function of GAM189 is therefore inhibition of LOC349360 (Accession XP_088528.1). Accordingly, utilities of GAM189 include diagnosis, prevention and treatment of diseases and clinical conditions associated with LOC349360.

LOC349408 (Accession XP_303044.1) is another GAM189 target gene, herein designated TARGET GENE. LOC349408 BINDING SITE is a target binding site found in the 5' untranslated region of mRNA encoded by LOC349408, corresponding to a target binding site such as BINDING SITE I, BINDING SITE II or BINDING SITE III of FIG. 8. Table 4 illustrates the complementarity of the nucleotide sequences of LOC349408 BINDING SITE, designated SEQ ID:13466, to the nucleotide sequence of GAM189 RNA, herein designated GAM RNA, also designated SEQ ID:246.

Another function of GAM189 is therefore inhibition of LOC349408 (Accession XP_303044.1). Accordingly, utilities of GAM189 include diagnosis, prevention and treatment of diseases and clinical conditions associated with LOC349408.

LOC349440 (Accession XP_300513.1) is another GAM189 target gene, herein designated TARGET GENE. LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:4112, to the nucleotide sequence of GAM189 RNA, herein designated GAM RNA, also designated SEQ ID:246.

Another function of GAM189 is therefore inhibition of LOC349440 (Accession XP_300513.1). Accordingly, utilities of GAM189 include diagnosis, prevention and treatment of diseases and clinical conditions associated with LOC349440.

LOC350106 (Accession XP_303810.1) is another GAM189 target gene, herein designated TARGET GENE. LOC350106 BINDING SITE is a target binding site found in the 5' untranslated region of mRNA encoded by LOC350106, corresponding to a target binding site such as BINDING SITE I, BINDING SITE II or BINDING SITE III of FIG. 8. Table 4 illustrates the complementarity of the nucleotide sequences of LOC350106 BINDING SITE, designated SEQ ID:18715, to the nucleotide sequence of GAM189 RNA, herein designated GAM RNA, also designated SEQ ID:246.

Another function of GAM189 is therefore inhibition of LOC350106 (Accession XP_303810.1). Accordingly, utilities of GAM189 include diagnosis, prevention and treatment of diseases and clinical conditions associated with LOC350106.

LOC350914 (Accession XP_304556.1) is another GAM189 target gene, herein designated TARGET GENE. LOC350914 BINDING SITE is a target binding site found in the 5' untranslated region of mRNA encoded by LOC350914, corresponding to a target binding site such as BINDING SITE I, BINDING SITE II or BINDING SITE III of FIG. 8. Table 4 illustrates the complementarity of the nucleotide sequences of LOC350914 BINDING SITE, designated SEQ ID:19860, to the nucleotide sequence of GAM189 RNA, herein designated GAM RNA, also designated SEQ ID:246.

Another function of GAM189 is therefore inhibition of LOC350914 (Accession XP_304556.1). Accordingly, utilities of GAM189 include diagnosis, prevention and treatment of diseases and clinical conditions associated with LOC350914.

LOC51058 (Accession NP_056995.1) is another GAM189 target gene, herein designated TARGET GENE. LOC51058 BINDING SITE is a target binding site found in the 3' untranslated region of mRNA encoded by LOC51058, corresponding to a target binding site such as BINDING SITE I, BINDING SITE II or BINDING SITE III of FIG. 8. Table 4 illustrates the complementarity of the nucleotide sequences of LOC51058 BINDING SITE, designated SEQ ID:5678, to the nucleotide sequence of GAM189 RNA, herein designated GAM RNA, also designated SEQ ID:246.

Another function of GAM189 is therefore inhibition of LOC51058 (Accession NP_056995.1). Accordingly, utilities of GAM189 include diagnosis, prevention and treatment of diseases and clinical conditions associated with LOC51058.

LOC51193 (Accession NP_057415.1) is another GAM189 target gene, herein designated TARGET GENE. LOC51193 BINDING SITE1 and LOC51193 BINDING SITE2 are target binding sites found in untranslated regions of mRNA encoded by LOC51193, corresponding to target binding sites such as BINDING SITE I, BINDING SITE II or BINDING SITE III of FIG. 8. Table 4 illustrates the complementarity of the nucleotide sequences of LOC51193 BINDING SITE1 and LOC51193 BINDING SITE2, designated SEQ ID:3111 and SEQ ID:14721 respectively, to the nucleotide sequence of GAM189 RNA, herein designated GAM RNA, also designated SEQ ID:246.

Another function of GAM189 is therefore inhibition of LOC51193 (Accession NP_057415.1). Accordingly, utilities of GAM189 include diagnosis, prevention and treatment of diseases and clinical conditions associated with LOC51193.

LOC51257 (Accession NP_057580.2) is another GAM189 target gene, herein designated TARGET GENE. LOC51257 BINDING SITE is a target binding site found in the 5' untranslated region of mRNA encoded by LOC51257, corresponding to a target binding site such as BINDING SITE I, BINDING SITE II or BINDING SITE III of FIG. 8. Table 4 illustrates the complementarity of the nucleotide sequences of LOC51257 BINDING SITE, designated SEQ ID:14855, to the nucleotide sequence of GAM189 RNA, herein designated GAM RNA, also designated SEQ ID:246.

Another function of GAM189 is therefore inhibition of LOC51257 (Accession NP_057580.2). Accordingly, utilities of GAM189 include diagnosis, prevention and treatment of diseases and clinical conditions associated with LOC51257.

LOC51334 (Accession NP_057728.1) is another GAM189 target gene, herein designated TARGET GENE. LOC51334 BINDING SITE is a target binding site found in the 5' untranslated region of mRNA encoded by LOC51334, corresponding to a target binding site such as BINDING SITE I, BINDING SITE II or BINDING SITE III of FIG. 8. Table 4 illustrates the complementarity of the nucleotide sequences of LOC51334 BINDING SITE, designated SEQ ID:8243, to the nucleotide sequence of GAM189 RNA, herein designated GAM RNA, also designated SEQ ID:246.

Another function of GAM189 is therefore inhibition of LOC51334 (Accession NP_057728.1). Accordingly, utilities of GAM189 include diagnosis, prevention and treatment of diseases and clinical conditions associated with LOC51334.

LOC51336 (Accession NP_057730.1) is another GAM189 target gene, herein designated TARGET GENE. LOC51336 BINDING SITE is a target binding site found in the 3' untranslated region of mRNA encoded by LOC51336, corresponding to a target binding site such as BINDING SITE I, BINDING SITE II or BINDING SITE III of FIG. 8. Table 4 illustrates the complementarity of the nucleotide sequences of LOC51336 BINDING SITE, designated SEQ ID:18703, to the nucleotide sequence of GAM189 RNA, herein designated GAM RNA, also designated SEQ ID:246.

Another function of GAM189 is therefore inhibition of LOC51336 (Accession NP_057730.1). Accordingly, utilities of GAM189 include diagnosis, prevention and treatment of diseases and clinical conditions associated with LOC51336.

LOC55954 (Accession NP_061976.1) is another GAM189 target gene, herein designated TARGET GENE. LOC55954 BINDING SITE is a target binding site found in the 5' untranslated region of mRNA encoded by LOC55954, corresponding to a target binding site such as BINDING SITE I, BINDING SITE II or BINDING SITE III of FIG. 8. Table 4 illustrates the complementarity of the nucleotide sequences of LOC55954 BINDING SITE, designated SEQ ID:17853, to the nucleotide sequence of GAM189 RNA, herein designated GAM RNA, also designated SEQ ID:246.

Another function of GAM189 is therefore inhibition of LOC55954 (Accession NP_061976.1). Accordingly, utilities of GAM189 include diagnosis, prevention and treatment of diseases and clinical conditions associated with LOC55954.

LOC56902 (Accession NP_064528.1) is another GAM189 target gene, herein designated TARGET GENE. LOC56902 BINDING SITE is a target binding site found in the 3' untranslated region of mRNA encoded by LOC56902, corresponding to a target binding site such as BINDING SITE I, BINDING SITE II or BINDING SITE III of FIG. 8. Table 4 illustrates the complementarity of the nucleotide sequences of LOC56902 BINDING SITE, designated SEQ ID:5945, to the nucleotide sequence of GAM189 RNA, herein designated GAM RNA, also designated SEQ ID:246.

Another function of GAM189 is therefore inhibition of LOC56902 (Accession NP_064528.1). Accordingly, utilities of GAM189 include diagnosis, prevention and treatment of diseases and clinical conditions associated with LOC56902.

LOC56926 (Accession NP_064555.1) is another GAM189 target gene, herein designated TARGET GENE. LOC56926 BINDING SITE is a target binding site found in the 3' untranslated region of mRNA encoded by LOC56926, corresponding to a target binding site such as BINDING SITE I, BINDING SITE II or BINDING SITE III of FIG. 8. Table 4 illustrates the complementarity of the nucleotide sequences of LOC56926 BINDING SITE, designated SEQ ID:8643, to the nucleotide sequence of GAM189 RNA, herein designated GAM RNA, also designated SEQ ID:246.

Another function of GAM189 is therefore inhibition of LOC56926 (Accession NP_064555.1). Accordingly, utilities of GAM189 include diagnosis, prevention and treatment of diseases and clinical conditions associated with LOC56926.

LOC57107 (Accession NP_065114.2) is another GAM189 target gene, herein designated TARGET GENE. LOC57107 BINDING SITE is a target binding site found in the 3' untranslated region of mRNA encoded by LOC57107, corresponding to a target binding site such as BINDING SITE I, BINDING SITE II or BINDING SITE III of FIG. 8. Table 4 illustrates the complementarity of the nucleotide sequences of LOC57107 BINDING SITE, designated SEQ ID:16916, to the nucleotide sequence of GAM189 RNA, herein designated GAM RNA, also designated SEQ ID:246.

Another function of GAM189 is therefore inhibition of LOC57107 (Accession NP_065114.2). Accordingly, utilities of GAM189 include diagnosis, prevention and treatment of diseases and clinical conditions associated with LOC57107.

LOC57146 (Accession NP_065155.2) is another GAM189 target gene, herein designated TARGET GENE. LOC57146 BINDING SITE is a target binding site found in the 3' untranslated region of mRNA encoded by LOC57146, corresponding to a target binding site such as BINDING SITE I, BINDING SITE II or BINDING SITE III of FIG. 8. Table 4 illustrates the complementarity of the nucleotide sequences of LOC57146 BINDING SITE, designated SEQ ID:11036, to the nucleotide sequence of GAM189 RNA, herein designated GAM RNA, also designated SEQ ID:246.

Another function of GAM189 is therefore inhibition of LOC57146 (Accession NP_065155.2). Accordingly, utilities of GAM189 include diagnosis, prevention and treatment of diseases and clinical conditions associated with LOC57146.

LOC89894 (Accession NP_612350.1) is another GAM189 target gene, herein designated TARGET GENE. LOC89894 BINDING SITE is a target binding site found in the 5' untranslated region of mRNA encoded by LOC89894, corresponding to a target binding site such as BINDING SITE I, BINDING SITE II or BINDING SITE III of FIG. 8. Table 4 illustrates the complementarity of the nucleotide sequences of LOC89894 BINDING SITE, designated SEQ ID:14184, to the nucleotide sequence of GAM189 RNA, herein designated GAM RNA, also designated SEQ ID:246.

Another function of GAM189 is therefore inhibition of LOC89894 (Accession NP_612350.1). Accordingly, utilities of GAM189 include diagnosis, prevention and treatment of diseases and clinical conditions associated with LOC89894.

LOC90408 (Accession XP_031517.1) is another GAM189 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:7704, to the nucleotide sequence of GAM189 RNA, herein designated GAM RNA, also designated SEQ ID:246.

Another function of GAM189 is therefore inhibition of LOC90408 (Accession XP_031517.1). Accordingly, utilities of GAM189 include diagnosis, prevention and treatment of diseases and clinical conditions associated with LOC90408.

LOC90485 (Accession XP_032059.1) is another GAM189 target gene, herein designated TARGET GENE. LOC90485 BINDING SITE1 and LOC90485 BINDING SITE2 are target binding sites found in untranslated regions of mRNA encoded by LOC90485, corresponding to target binding sites such as BINDING SITE I, BINDING SITE II or BINDING SITE III of FIG. 8. Table 4 illustrates the complementarity of the nucleotide sequences of LOC90485 BINDING SITE1 and LOC90485 BINDING SITE2, designated SEQ ID:18698 and SEQ ID:6896 respectively, to the nucleotide sequence of GAM189 RNA, herein designated GAM RNA, also designated SEQ ID:246.

Another function of GAM189 is therefore inhibition of LOC90485 (Accession XP_032059.1). Accordingly, utilities of GAM189 include diagnosis, prevention and treatment of diseases and clinical conditions associated with LOC90485.

LOC90719 (Accession XP_033704.1) is another GAM189 target gene, herein designated TARGET GENE. LOC90719 BINDING SITE is a target binding site found in the 3' untranslated region of mRNA encoded by LOC90719, corresponding to a target binding site such as BINDING SITE I, BINDING SITE II or BINDING SITE III of FIG. 8. Table 4 illustrates the complementarity of the nucleotide sequences of LOC90719 BINDING SITE, designated SEQ ID:13994, to the nucleotide sequence of GAM189 RNA, herein designated GAM RNA, also designated SEQ ID:246.

Another function of GAM189 is therefore inhibition of LOC90719 (Accession XP_033704.1). Accordingly, utilities of GAM189 include diagnosis, prevention and treatment of diseases and clinical conditions associated with LOC90719.

LOC90999 (Accession XP_035410.1) is another GAM189 target gene, herein designated TARGET GENE. LOC90999 BINDING SITE is a target binding site found in the 3' untranslated region of mRNA encoded by LOC90999, corresponding to a target binding site such as BINDING SITE I, BINDING SITE II or BINDING SITE III of FIG. 8. Table 4 illustrates the complementarity of the nucleotide sequences of LOC90999 BINDING SITE, designated SEQ ID:15038, to the nucleotide sequence of GAM189 RNA, herein designated GAM RNA, also designated SEQ ID:246.

Another function of GAM189 is therefore inhibition of LOC90999 (Accession XP_035410.1). Accordingly, utilities of GAM189 include diagnosis, prevention and treatment of diseases and clinical conditions associated with LOC90999.

LOC91115 (Accession XP_036218.1) is another GAM189 target gene, herein designated TARGET GENE. LOC91115 BINDING SITE1 through LOC91115 BINDING SITE3 are target binding sites found in untranslated regions of mRNA encoded by LOC91115, corresponding to target binding sites such as BINDING SITE I, BINDING SITE II or BINDING SITE III of FIG. 8. Table 4 illustrates the complementarity of the nucleotide sequences of LOC91115 BINDING SITE1 through LOC91115 BINDING SITE3, designated SEQ ID:19989, SEQ ID:12591 and SEQ ID:17831 respectively, to the nucleotide sequence of GAM189 RNA, herein designated GAM RNA, also designated SEQ ID:246.

Another function of GAM189 is therefore inhibition of LOC91115 (Accession XP_036218.1). Accordingly, utilities of GAM189 include diagnosis, prevention and treatment of diseases and clinical conditions associated with LOC91115.

LOC91170 (Accession XP_036612.1) is another GAM189 target gene, herein designated TARGET GENE. LOC91170 BINDING SITE is a target binding site found in the 5' untranslated region of mRNA encoded by LOC91170, corresponding to a target binding site such as BINDING SITE I, BINDING SITE II or BINDING SITE III of FIG. 8. Table 4 illustrates the complementarity of the nucleotide sequences of LOC91170 BINDING SITE, designated SEQ ID:16178, to the nucleotide sequence of GAM189 RNA, herein designated GAM RNA, also designated SEQ ID:246.

Another function of GAM189 is therefore inhibition of LOC91170 (Accession XP_036612.1). Accordingly, utilities of GAM189 include diagnosis, prevention and treatment of diseases and clinical conditions associated with LOC91170.

LOC91250 (Accession XP_037135.1) is another GAM189 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:8577, to the nucleotide sequence of GAM189 RNA, herein designated GAM RNA, also designated SEQ ID:246.

Another function of GAM189 is therefore inhibition of LOC91250 (Accession XP_037135.1). Accordingly, utilities of GAM189 include diagnosis, prevention and treatment of diseases and clinical conditions associated with LOC91250.

LOC91266 (Accession XP_037268.1) is another GAM189 target gene, herein designated TARGET GENE. LOC91266 BINDING SITE is a target binding site found in the 5' untranslated region of mRNA encoded by LOC91266, corresponding to a target binding site such as BINDING SITE I, BINDING SITE II or BINDING SITE III of FIG. 8. Table 4 illustrates the complementarity of the nucleotide sequences of LOC91266 BINDING SITE, designated SEQ ID:18355, to the nucleotide sequence of GAM189 RNA, herein designated GAM RNA, also designated SEQ ID:246.

Another function of GAM189 is therefore inhibition of LOC91266 (Accession XP_037268.1). Accordingly, utilities of GAM189 include diagnosis, prevention and treatment of diseases and clinical conditions associated with LOC91266.

LOC91373 (Accession XP_038063.5) is another GAM189 target gene, herein designated TARGET GENE. LOC91373 BINDING SITE is a target binding site found in the 3' untranslated region of mRNA encoded by LOC91373, corresponding to a target binding site such as BINDING SITE I, BINDING SITE II or BINDING SITE III of FIG. 8. Table 4 illustrates the complementarity of the nucleotide sequences of LOC91373 BINDING SITE, designated SEQ ID:9077, to the nucleotide sequence of GAM189 RNA, herein designated GAM RNA, also designated SEQ ID:246.

Another function of GAM189 is therefore inhibition of LOC91373 (Accession XP_038063.5). Accordingly, utilities of GAM189 include diagnosis, prevention and treatment of diseases and clinical conditions associated with LOC91373.

LOC91549 (Accession XP_039115.1) is another GAM189 target gene, herein designated TARGET GENE. LOC91549 BINDING SITE is a target binding site found in the 5' untranslated region of mRNA encoded by LOC91549, corresponding to a target binding site such as BINDING SITE I, BINDING SITE II or BINDING SITE III of FIG. 8. Table 4 illustrates the complementarity of the nucleotide sequences of LOC91549 BINDING SITE, designated SEQ ID:17238, to the nucleotide sequence of GAM189 RNA, herein designated GAM RNA, also designated SEQ ID:246.

Another function of GAM189 is therefore inhibition of LOC91549 (Accession XP_039115.1). Accordingly, utilities of GAM189 include diagnosis, prevention and treatment of diseases and clinical conditions associated with LOC91549.

LOC91661 (Accession NP_612381.1) is another GAM189 target gene, herein designated TARGET GENE. LOC91661 BINDING SITE is a target binding site found in the 3' untranslated region of mRNA encoded by LOC91661, corresponding to a target binding site such as BINDING SITE I, BINDING SITE II or BINDING SITE III of FIG. 8. Table 4 illustrates the complementarity of the nucleotide sequences of LOC91661 BINDING SITE, designated SEQ ID:8303, to the nucleotide sequence of GAM189 RNA, herein designated GAM RNA, also designated SEQ ID:246.

Another function of GAM189 is therefore inhibition of LOC91661 (Accession NP_612381.1). Accordingly, utilities of GAM189 include diagnosis, prevention and treatment of diseases and clinical conditions associated with LOC91661.

LOC91663 (Accession NP_612382.1) is another GAM189 target gene, herein designated TARGET GENE. LOC91663 BINDING SITE is a target binding site found in the 3' untranslated region of mRNA encoded by LOC91663, corresponding to a target binding site such as BINDING SITE I, BINDING SITE II or BINDING SITE III of FIG. 8. Table 4 illustrates the complementarity of the nucleotide sequences of LOC91663 BINDING SITE, designated SEQ ID:8075, to the nucleotide sequence of GAM189 RNA, herein designated GAM RNA, also designated SEQ ID:246.

Another function of GAM189 is therefore inhibition of LOC91663 (Accession NP_612382.1). Accordingly, utilities of GAM189 include diagnosis, prevention and treatment of diseases and clinical conditions associated with LOC91663.

LOC91893 (Accession XP_041340.1) is another GAM189 target gene, herein designated TARGET GENE. LOC91893 BINDING SITE is a target binding site found in the 3' untranslated region of mRNA encoded by LOC91893, corresponding to a target binding site such as BINDING SITE I, BINDING SITE II or BINDING SITE III of FIG. 8. Table 4 illustrates the complementarity of the nucleotide sequences of LOC91893 BINDING SITE, designated SEQ ID:14589, to the nucleotide sequence of GAM189 RNA, herein designated GAM RNA, also designated SEQ ID:246.

Another function of GAM189 is therefore inhibition of LOC91893 (Accession XP_041340.1). Accordingly, utilities of GAM189 include diagnosis, prevention and treatment of diseases and clinical conditions associated with LOC91893.

LOC92148 (Accession XP_043160.1) is another GAM189 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:4097, to the nucleotide sequence of GAM189 RNA, herein designated GAM RNA, also designated SEQ ID:246.

Another function of GAM189 is therefore inhibition of LOC92148 (Accession XP_043160.1). Accordingly, utilities of GAM189 include diagnosis, prevention and treatment of diseases and clinical conditions associated with LOC92148.

LOC92597 (Accession NP_775739.1) is another GAM189 target gene, herein designated TARGET GENE. LOC92597 BINDING SITE is a target binding site found in the 3' untranslated region of mRNA encoded by LOC92597, corresponding to a target binding site such as BINDING SITE I, BINDING SITE II or BINDING SITE III of FIG. 8. Table 4 illustrates the complementarity of the nucleotide sequences of LOC92597 BINDING SITE, designated SEQ ID:19339, to the nucleotide sequence of GAM189 RNA, herein designated GAM RNA, also designated SEQ ID:246.

Another function of GAM189 is therefore inhibition of LOC92597 (Accession NP_775739.1). Accordingly, utilities of GAM189 include diagnosis, prevention and treatment of diseases and clinical conditions associated with LOC92597.

LOC93132 (Accession XP_049396.1) is another GAM189 target gene, herein designated TARGET GENE. LOC93132 BINDING SITE is a target binding site found in the 5' untranslated region of mRNA encoded by LOC93132, corresponding to a target binding site such as BINDING SITE I, BINDING SITE II or BINDING SITE III of FIG. 8. Table 4 illustrates the complementarity of the nucleotide sequences of LOC93132 BINDING SITE, designated SEQ ID:9953, to the nucleotide sequence of GAM189 RNA, herein designated GAM RNA, also designated SEQ ID:246.

Another function of GAM189 is therefore inhibition of LOC93132 (Accession XP_049396.1). Accordingly, utilities of GAM189 include diagnosis, prevention and treatment of diseases and clinical conditions associated with LOC93132.

Lanosterol synthase (2,3-oxidosqualene-lanosterol cyclase) (LSS, Accession NP_002331.2) is another GAM189 target gene, herein designated TARGET GENE. LSS BINDING SITE is a target binding site found in the 3' untranslated region of mRNA encoded by LSS, corresponding to a target binding site such as BINDING SITE I, BINDING SITE II or BINDING SITE III of FIG. 8. Table 4 illustrates the complementarity of the nucleotide sequences of LSS BINDING SITE, designated SEQ ID:6091, to the nucleotide sequence of GAM189 RNA, herein designated GAM RNA, also designated SEQ ID:246.

Another function of GAM189 is therefore inhibition of Lanosterol synthase (2,3-oxidosqualene-lanosterol cyclase) (LSS, Accession NP_002331.2). Accordingly, utilities of GAM189 include diagnosis, prevention and treatment of diseases and clinical conditions associated with LSS.

Leukotriene b4 receptor (LTB4R, Accession NP_000743.1) is another GAM189 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:1022, to the nucleotide sequence of GAM189 RNA, herein designated GAM RNA, also designated SEQ ID:246.

Another function of GAM189 is therefore inhibition of Leukotriene b4 receptor (LTB4R, Accession NP_000743.1), a gene which may be the cardiac p2y receptor involved in the regulation of cardiac muscle contraction through modulation of l-type calcium currents. Accordingly, utilities of GAM189 include diagnosis, prevention and treatment of diseases and clinical conditions associated with LTB4R.

The function of LTB4R and its association with various diseases and clinical conditions, has been established by previous studies, as described hereinabove with reference to GAM30.1. Leukotriene b4 receptor 2 (LTB4R2, Accession NP_062813.1) is another GAM189 target gene, herein designated TARGET GENE. LTB4R2 BINDING SITE is a target binding site found in the 5' untranslated region of mRNA encoded by LTB4R2, corresponding to a target binding site such as BINDING SITE I, BINDING SITE II or BINDING SITE III of FIG. 8. Table 4 illustrates the complementarity of the nucleotide sequences of LTB4R2 BINDING SITE, designated SEQ ID:15504, to the nucleotide sequence of GAM189 RNA, herein designated GAM RNA, also designated SEQ ID:246.

Another function of GAM189 is therefore inhibition of Leukotriene b4 receptor 2 (LTB4R2, Accession NP_062813.1). Accordingly, utilities of GAM189 include diagnosis, prevention and treatment of diseases and clinical conditions associated with LTB4R2.

Lymphocyte antigen 75 (LY75, Accession NP_002340.1) is another GAM189 target gene, herein designated TARGET GENE. LY75 BINDING SITE is a target binding site found in the 3' untranslated region of mRNA encoded by LY75, corresponding to a target binding site such as BINDING SITE I, BINDING SITE II or BINDING SITE III of FIG. 8. Table 4 illustrates the complementarity of the nucleotide sequences of LY75 BINDING SITE, designated SEQ ID:17724, to the nucleotide sequence of GAM189 RNA, herein designated GAM RNA, also designated SEQ ID:246.

Another function of GAM189 is therefore inhibition of Lymphocyte antigen 75 (LY75, Accession NP_002340.1). Accordingly, utilities of GAM189 include diagnosis, prevention and treatment of diseases and clinical conditions associated with LY75.

Lysozyme (renal amyloidosis) (Ly, Accession NP_000230.1) is another GAM189 target gene, herein designated TARGET GENE. LYZ BINDING SITE is a target binding site found in the 3' untranslated region of mRNA encoded by Ly, corresponding to a target binding site such as BINDING SITE I, BINDING SITE II or BINDING SITE III of FIG. 8. Table 4 illustrates the complementarity of the nucleotide sequences of LYZ BINDING SITE, designated SEQ ID:7382, to the nucleotide sequence of GAM189 RNA, herein designated GAM RNA, also designated SEQ ID:246.

Another function of GAM189 is therefore inhibition of Lysozyme (renal amyloidosis) (Ly, Accession NP_000230.1), a gene which a bacteriolytic enzyme. and therefore may be associated with Renal amyloidosis. Accordingly, utilities of GAM189 include diagnosis, prevention and treatment of Renal amyloidosis, and of other diseases and clinical conditions associated with LYZ.

The function of LYZ has been established by previous studies. Lysozyme (EC 3.2.1.17) catalyzes the hydrolysis of certain mucopolysaccharides of bacterial cell walls. Specifically, it catalyzes the hydrolysis of the bacterial cell wall beta(1-4) glycosidic linkages between N-acetylmuramic acid and N-acetylglucosamine. It is found in spleen, lung, kidney, white blood cells, plasma, saliva, milk and tears. Alexander Fleming (1881-1955), of penicillin fame, discovered and named lysozyme. In a communication to the Royal Society, Fleming (1922) wrote: '. I wish to draw attention to a substance present in the tissues and secretions of the body, which is capable of rapidly dissolving certain bacteria. As this substance has properties akin to those of ferments I have called it a Lysozyme.' Fleming and Allison (1922) demonstrated an unusually high concentration in cartilage, indeed the highest of any tissue. Its role in cartilage is unknown. It resembles lactalbumin (OMIM Ref. No. 149750) in structure. Human lysozyme has a molecular mass of 14,602 Da. Neufeld (1972) suggested that a genetic defect of lysozyme might underlie a skeletal dysplasia. Spitznagel et al. (1972) observed a patient with selective deficiency of a particular type of neutrophil granule which resulted in about 50% reduction in lysozyme levels. The patient showed increased susceptibility to infectionPrieur et al. (1974) described inherited lysozyme deficiency in rabbits. No abnormality of cartilage or bone was noted (Greenwald et al., 1975). Older mutant rabbits showed increased susceptibility to infections, especially subcutaneous abscesses (Prieur, 1975). Camara et al. (1990) identified 2 isozymes of rabbit lysozyme and showed that their distribution was tissue specific. Leukocytic and gastrointestinal isozymes were clearly distinguished, and a possible lymphoepithelial isozyme that resembled the gastrointestinal isozyme electrophoretically and chromatographically but not kinetically was demonstrated. Mutant, lysozyme-deficient rabbits completely lacked a detectable leukocytic isozyme but had gastrointestinal and lymphoepithelial isozymes indistinguishable from those of normal rabbits. By electrophoretic methods, the mutant rabbits were shown to lack a protein band corresponding to that of the leukocytic isozyme in normal rabbits Canet et al. (1999) studied the unfolding and refolding properties of human lysozyme and 2 of its amyloidogenic variants, ile56 to thr and asp67 to his, by stopped-flow fluorescence and hydrogen exchange pulse labeling coupled with mass spectrometry. Their results suggested that the amyloidogenic nature of the lysozyme variants arises from a decrease in the stability of the native fold relative to partially folded intermediates. The origin of this instability was different in the 2 variants, being caused in one case primarily by a reduction in the folding rate and in the other by an increase in the unfolding rate. In both cases, this resulted in a low population of soluble partially folded species that can aggregate in a slow and controlled manner to form amyloid fibrils Full details of the abovementioned studies are described in the following publications, the disclosure of which are hereby incorporated by reference:

Canet, D.; Sunde, M.; Last, A. M.; Miranker, A.; Spencer, A.; Robinson, C. V.; Dobson, C. M.: Mechanistic studies of the folding of human lysozyme and the origin of amyloidogenic behavior in its disease-related variants. Biochemistry 38:6419-6427, 1999; and Camara, V. M.; Harding, J. W.; Prieur, D. J.: Inherited lysozyme deficiency in rabbits: the absence of a primary isozyme of lysozyme as the cause of the condition. Lab. Invest. 63:544-55.

Further studies establishing the function and utilities of LYZ are found in John Hopkins OMIM database record ID 153450, and in cited publications listed in Table 5, which are hereby incorporated by reference. Leucine zipper, putative tumor suppressor 1 (LZTS1, Accession NP_066300.1) is another GAM189 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:4518, to the nucleotide sequence of GAM189 RNA, herein designated GAM RNA, also designated SEQ ID:246.

Another function of GAM189 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM189 include diagnosis, prevention and treatment of diseases and clinical conditions associated with LZTS1.

The function of LZTS1 and its association with various diseases and clinical conditions, has been established by previous studies, as described hereinabove with reference to GAM130.1. MAC30 (Accession XP_031536.2) is another GAM189 target gene, herein designated TARGET GENE. MAC30 BINDING SITE is a target binding site found in the 3' untranslated region of mRNA encoded by MAC30, corresponding to a target binding site such as BINDING SITE I, BINDING SITE II or BINDING SITE III of FIG. 8. Table 4 illustrates the complementarity of the nucleotide sequences of MAC30 BINDING SITE, designated SEQ ID:5069, to the nucleotide sequence of GAM189 RNA, herein designated GAM RNA, also designated SEQ ID:246.

Another function of GAM189 is therefore inhibition of MAC30 (Accession XP_031536.2). Accordingly, utilities of GAM189 include diagnosis, prevention and treatment of diseases and clinical conditions associated with MAC30.

MAIL (Accession NP_113607.1) is another GAM189 target gene, herein designated TARGET GENE. MAIL BINDING SITE is a target binding site found in the 3' untranslated region of mRNA encoded by MAIL, corresponding to a target binding site such as BINDING SITE I, BINDING SITE II or BINDING SITE III of FIG. 8. Table 4 illustrates the complementarity of the nucleotide sequences of MAIL BINDING SITE, designated SEQ ID:2338, to the nucleotide sequence of GAM189 RNA, herein designated GAM RNA, also designated SEQ ID:246.

Another function of GAM189 is therefore inhibition of MAIL (Accession NP_113607.1). Accordingly, utilities of GAM189 include diagnosis, prevention and treatment of diseases and clinical conditions associated with MAIL.

Male germ cell-associated kinase (MAK, Accession NP_005897.1) is another GAM189 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:1989, to the nucleotide sequence of GAM189 RNA, herein designated GAM RNA, also designated SEQ ID:246.

Another function of GAM189 is therefore inhibition of Male germ cell-associated kinase (MAK, Accession NP_005897.1), a gene which plays an important role in spermatogenesis. Accordingly, utilities of GAM189 include diagnosis, prevention and treatment of diseases and clinical conditions associated with MAK.

The function of MAK and its association with various diseases and clinical conditions, has been established by previous studies, as described hereinabove with reference to GAM30.1. MAPA (Accession NP_660299.1) is another GAM189 target gene, herein designated TARGET GENE. MAPA BINDING SITE is a target binding site found in the 3' untranslated region of mRNA encoded by MAPA, corresponding to a target binding site such as BINDING SITE I, BINDING SITE II or BINDING SITE III of FIG. 8. Table 4 illustrates the complementarity of the nucleotide sequences of MAPA BINDING SITE, designated SEQ ID:5231, to the nucleotide sequence of GAM189 RNA, herein designated GAM RNA, also designated SEQ ID:246.

Another function of GAM189 is therefore inhibition of MAPA (Accession NP_660299.1). Accordingly, utilities of GAM189 include diagnosis, prevention and treatment of diseases and clinical conditions associated with MAPA.

Mitogen-activated protein kinase 8 interacting protein 3 (MAPK8IP3, Accession NP_203750.1) is another GAM189 target gene, herein designated TARGET GENE. MAPK8IP3 BINDING SITE is a target binding site found in the 3' untranslated region of multiple transcripts of mRNA encoded by MAPK8IP3, corresponding to a target binding site such as BINDING SITE I, BINDING SITE II or BINDING SITE III of FIG. 8. Table 4 illustrates the complementarity of the nucleotide sequences of MAPK8IP3 BINDING SITE, designated SEQ ID:14298, to the nucleotide sequence of GAM189 RNA, herein designated GAM RNA, also designated SEQ ID:246.

Another function of GAM189 is therefore inhibition of Mitogen-activated protein kinase 8 interacting protein 3 (MAPK8IP3, Accession NP_203750.1). Accordingly, utilities of GAM189 include diagnosis, prevention and treatment of diseases and clinical conditions associated with MAPK8IP3.

MCLC (Accession NP_055942.1) is another GAM189 target gene, herein designated TARGET GENE. MCLC BINDING SITE is a target binding site found in the 3' untranslated region of mRNA encoded by MCLC, corresponding to a target binding site such as BINDING SITE I, BINDING SITE II or BINDING SITE III of FIG. 8. Table 4 illustrates the complementarity of the nucleotide sequences of MCLC BINDING SITE, designated SEQ ID:7270, to the nucleotide sequence of GAM189 RNA, herein designated GAM RNA, also designated SEQ ID:246.

Another function of GAM189 is therefore inhibition of MCLC (Accession NP_055942.1). Accordingly, utilities of GAM189 include diagnosis, prevention and treatment of diseases and clinical conditions associated with MCLC.

Mdm2, transformed 3t3 cell double minute 2, p53 binding protein (mouse) (MDM2, Accession NP_006873.1) is another GAM189 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM189 RNA, herein designated GAM RNA, also designated SEQ ID:246.

Another function of GAM189 is therefore inhibition of Mdm2, transformed 3t3 cell double minute 2, p53 binding protein (mouse) (MDM2, Accession NP_006873.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM189 include diagnosis, prevention and treatment of Tumors (including soft tissue sarcomas, osteosarcomas and gliomas), and of other diseases and clinical conditions associated with MDM2.

The function of MDM2 has been established by previous studies. MDM2 acts as a major regulator of the tumor suppressor p53 (OMIM Ref. No. 191170) by targeting its destruction. Oliner et al. (1992) used MDM2 clones to localize the human gene to 12q13-q14 by analysis of human-hamster somatic cell hybrids. By fluorescence in situ hybridization onto simultaneously DAPI-banded metaphase chromosomes and interphase nuclei, Mitchell et al. (1995) mapped MDM2 to 12q14.3-q15 distal to CDK4 (OMIM Ref. No. 123829) and flanked by Genethon microsatellites D12S80 and D12S83. On both the physical and the genetic maps of chromosome 12, Bureau et al. (1995) mapped the IFG gene (OMIM Ref. No. 147570) close to the D12S335 and D12S313 microsatellites. They also physically mapped it close to the locus of the MDM2 oncogene on 12q15, a localization proximal to that arrived at earlier. They described the organization of the Ifg, Myf6 (OMIM Ref. No. 159991), Mdm1, and Mdm2 loci on mouse chromosome 10 in a region with homology of synteny to human 12q15. . Bueso-Ramos et al. (1993) found overexpression of the MDM2 oncogene in leukemias. Inactivation of tumor suppressor genes leads to deregulated cell proliferation and is a key factor in human tumorigenesis. Mutations in the p53 and retinoblastoma (OMIM Ref. No. 180200) genes are frequently associated with human cancers, and simultaneous inactivation of both RB and p53 is frequently observed in naturally occurring tumors. Additionally, 3 distinct DNA tumor virus groups (papovaviruses, adenoviruses, and human papillomaviruses) transform cells by targeting and inactivating certain functions of both the p53 and RB1 gene products. Xiao et al. (1995) showed that MDM2 interacts physically and functionally with the RB protein and can inhibit its growth regulatory capacity. They thus demonstrated that both RB and p53 can be subjected to negative regulation by the product of a single cellular protooncogene. Mdm2 acts as a major regulator of the tumor suppressor p53 by targeting its destruction. Ries et al. (2000) showed that the mdm2 gene is also regulated by the Ras-driven Raf/MEK/MAP kinase pathway, in a p53-independent manner. Mdm2 induced by activated Raf degrades p53 in the absence of the Mdm2 inhibitor p19(ARF) (OMIM Ref. No. 600160). This regulatory pathway accounts for the observation that cells transformed by oncogenic Ras are more resistant to p53-dependent apoptosis following exposure to DNA damage. Activation of the Ras-induced Raf/MEK/MAP kinase may therefore play a key role in suppressing p53 during tumor development and treatment. In primary cells, Raf also activates the Mdm2 inhibitor p19(ARF). Levels of p53 are therefore determined by opposing effects of Raf-induced p19(ARF) and Mdm2. The MDM2 oncoprotein promotes cell survival and cell cycle progression by inhibiting the p53 tumor suppressor protein (OMIM Ref. No. 191170). To regulate p53, MDM2 must gain nuclear entry; Mayo and Donner (2001) identified the mechanism that induces this. Mitogen-induced activation of phosphatidylinositol 3-kinase (see OMIM Ref. No. PIK3CA; 171834) and its downstream target, the AKT/PKB serine-threonine kinase (OMIM Ref. No. 164730), results in phosphorylation of MDM2 on serine-166 and serine-186. Phosphorylation on these sites is necessary for translocation of MDM2 from the cytoplasm into the nucleus. Pharmacologic blockade of PI3-kinase/AKT signaling or expression of dominant-negative PI3-kinase or AKT inhibits nuclear entry of MDM2, increases cellular levels of p53, and augments p53 transcriptional activity. Expression of constitutively active AKT promotes nuclear entry of MDM2, diminishes cellular levels of p53, and decreases p53 transcriptional activity. Mutation of the AKT phosphorylation sites in MDM2 produces a mutant protein that is unable to enter the nucleus and increases p53 activity. The demonstration that PI3-kinase/AKT signaling affects MDM2 localization provided insight into how this pathway, which is inappropriately activated in many malignancies, affects the function of p53. Testa and Bellacosa (2001) reviewed the central role of AKT in tumorigenesis.

Full details of the abovementioned studies are described in the following publications, the disclosure of which are hereby incorporated by reference:

Ries, S.; Biederer, C.; Woods, D.; Shifman, O.; Shirasawa, S.; Sasazuki, T.; McMahon, M.; Oren, M.; McCormick, F.: Opposing effects of Ras on p53: transcriptional activation of mdm2 and induction of p19(ARF). Cell 103:321-330, 2000; and Bueso-Ramos, C. E.; Yang, Y.; deLeon, E.; McCown, P.; Stass, S. A.; Albitar, M.: The human MDM-2 oncogene is overexpressed in leukemias. Blood 82:2617-2623, 1993.

Further studies establishing the function and utilities of MDM2 are found in John Hopkins OMIM database record ID 164785, and in cited publications listed in Table 5, which are hereby incorporated by reference. Mdm2, transformed 3t3 cell double minute 2, p53 binding protein (mouse) (MDM2, Accession NP_006870.1) is another GAM189 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM189 RNA, herein designated GAM RNA, also designated SEQ ID:246.

Another function of GAM189 is therefore inhibition of Mdm2, transformed 3t3 cell double minute 2, p53 binding protein (mouse) (MDM2, Accession NP_006870.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM189 include diagnosis, prevention and treatment of Tumors (including soft tissue sarcomas, osteosarcomas and gliomas), and of other diseases and clinical conditions associated with MDM2.

The function of MDM2 has been established by previous studies. MDM2 acts as a major regulator of the tumor suppressor p53 (OMIM Ref. No. 191170) by targeting its destruction. Oliner et al. (1992) used MDM2 clones to localize the human gene to 12q13-q14 by analysis of human-hamster somatic cell hybrids. By fluorescence in situ hybridization onto simultaneously DAPI-banded metaphase chromosomes and interphase nuclei, Mitchell et al. (1995) mapped MDM2 to 12q14.3-q15 distal to CDK4 (OMIM Ref. No. 123829) and flanked by Genethon microsatellites D12S80 and D12S83. On both the physical and the genetic maps of chromosome 12, Bureau et al. (1995) mapped the IFG gene (OMIM Ref. No. 147570) close to the D12S335 and D12S313 microsatellites. They also physically mapped it close to the locus of the MDM2 oncogene on 12q15, a localization proximal to that arrived at earlier. They described the organization of the Ifg, Myf6 (OMIM Ref. No. 159991), Mdm1, and Mdm2 loci on mouse chromosome 10 in a region with homology of synteny to human 12q15. . Bueso-Ramos et al. (1993) found overexpression of the MDM2 oncogene in leukemias. Inactivation of tumor suppressor genes leads to deregulated cell proliferation and is a key factor in human tumorigenesis. Mutations in the p53 and retinoblastoma (OMIM Ref. No. 180200) genes are frequently associated with human cancers, and simultaneous inactivation of both RB and p53 is frequently observed in naturally occurring tumors. Additionally, 3 distinct DNA tumor virus groups (papovaviruses, adenoviruses, and human papillomaviruses) transform cells by targeting and inactivating certain functions of both the p53 and RB1 gene products. Xiao et al. (1995) showed that MDM2 interacts physically and functionally with the RB protein and can inhibit its growth regulatory capacity. They thus demonstrated that both RB and p53 can be subjected to negative regulation by the product of a single cellular protooncogene. Mdm2 acts as a major regulator of the tumor suppressor p53 by targeting its destruction. Ries et al. (2000) showed that the mdm2 gene is also regulated by the Ras-driven Raf/MEK/MAP kinase pathway, in a p53-independent manner. Mdm2 induced by activated Raf degrades p53 in the absence of the Mdm2 inhibitor p19(ARF) (OMIM Ref. No. 600160). This regulatory pathway accounts for the observation that cells transformed by oncogenic Ras are more resistant to p53-dependent apoptosis following exposure to DNA damage. Activation of the Ras-induced Raf/MEK/MAP kinase may therefore play a key role in suppressing p53 during tumor development and treatment. In primary cells, Raf also activates the Mdm2 inhibitor p19(ARF). Levels of p53 are therefore determined by opposing effects of Raf-induced p19(ARF) and Mdm2. The MDM2 oncoprotein promotes cell survival and cell cycle progression by inhibiting the p53 tumor suppressor protein (OMIM Ref. No. 191170). To regulate p53, MDM2 must gain nuclear entry; Mayo and Donner (2001) identified the mechanism that induces this. Mitogen-induced activation of phosphatidylinositol 3-kinase (see OMIM Ref. No. PIK3CA; 171834) and its downstream target, the AKT/PKB serine-threonine kinase (OMIM Ref. No. 164730), results in phosphorylation of MDM2 on serine-166 and serine-186. Phosphorylation on these sites is necessary for translocation of MDM2 from the cytoplasm into the nucleus. Pharmacologic blockade of PI3-kinase/AKT signaling or expression of dominant-negative PI3-kinase or AKT inhibits nuclear entry of MDM2, increases cellular levels of p53, and augments p53 transcriptional activity. Expression of constitutively active AKT promotes nuclear entry of MDM2, diminishes cellular levels of p53, and decreases p53 transcriptional activity. Mutation of the AKT phosphorylation sites in MDM2 produces a mutant protein that is unable to enter the nucleus and increases p53 activity. The demonstration that PI3-kinase/AKT signaling affects MDM2 localization provided insight into how this pathway, which is inappropriately activated in many malignancies, affects the function of p53. Testa and Bellacosa (2001) reviewed the central role of AKT in tumorigenesis.

Full details of the abovementioned studies are described in the following publications, the disclosure of which are hereby incorporated by reference:

Ries, S.; Biederer, C.; Woods, D.; Shifman, O.; Shirasawa, S.; Sasazuki, T.; McMahon, M.; Oren, M.; McCormick, F.: Opposing effects of Ras on p53: transcriptional activation of mdm2 and induction of p19(ARF). Cell 103:321-330, 2000; and Bueso-Ramos, C. E.; Yang, Y.; deLeon, E.; McCown, P.; Stass, S. A.; Albitar, M.: The human MDM-2 oncogene is overexpressed in leukemias. Blood 82:2617-2623, 1993.

Further studies establishing the function and utilities of MDM2 are found in John Hopkins OMIM database record ID 164785, and in cited publications listed in Table 5, which are hereby incorporated by reference. Mdm2, transformed 3t3 cell double minute 2, p53 binding protein (mouse) (MDM2, Accession NP_006869.1) is another GAM189 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM189 RNA, herein designated GAM RNA, also designated SEQ ID:246.

Another function of GAM189 is therefore inhibition of Mdm2, transformed 3t3 cell double minute 2, p53 binding protein (mouse) (MDM2, Accession NP_006869.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM189 include diagnosis, prevention and treatment of Tumors (including soft tissue sarcomas, osteosarcomas and gliomas), and of other diseases and clinical conditions associated with MDM2.

The function of MDM2 has been established by previous studies. MDM2 acts as a major regulator of the tumor suppressor p53 (OMIM Ref. No. 191170) by targeting its destruction. Oliner et al. (1992) used MDM2 clones to localize the human gene to 12q13-q14 by analysis of human-hamster somatic cell hybrids. By fluorescence in situ hybridization onto simultaneously DAPI-banded metaphase chromosomes and interphase nuclei, Mitchell et al. (1995) mapped MDM2 to 12q14.3-q15 distal to CDK4 (OMIM Ref. No. 123829) and flanked by Genethon microsatellites D12S80 and D12S83. On both the physical and the genetic maps of chromosome 12, Bureau et al. (1995) mapped the IFG gene (OMIM Ref. No. 147570) close to the D12S335 and D12S313 microsatellites. They also physically mapped it close to the locus of the MDM2 oncogene on 12q15, a localization proximal to that arrived at earlier. They described the organization of the Ifg, Myf6 (OMIM Ref. No. 159991), Mdm1, and Mdm2 loci on mouse chromosome 10 in a region with homology of synteny to human 12q15. . Bueso-Ramos et al. (1993) found overexpression of the MDM2 oncogene in leukemias. Inactivation of tumor suppressor genes leads to deregulated cell proliferation and is a key factor in human tumorigenesis. Mutations in the p53 and retinoblastoma (OMIM Ref. No. 180200) genes are frequently associated with human cancers, and simultaneous inactivation of both RB and p53 is frequently observed in naturally occurring tumors. Additionally, 3 distinct DNA tumor virus groups (papovaviruses, adenoviruses, and human papillomaviruses) transform cells by targeting and inactivating certain functions of both the p53 and RB1 gene products. Xiao et al. (1995) showed that MDM2 interacts physically and functionally with the RB protein and can inhibit its growth regulatory capacity. They thus demonstrated that both RB and p53 can be subjected to negative regulation by the product of a single cellular protooncogene. Mdm2 acts as a major regulator of the tumor suppressor p53 by targeting its destruction. Ries et al. (2000) showed that the mdm2 gene is also regulated by the Ras-driven Raf/MEK/MAP kinase pathway, in a p53-independent manner. Mdm2 induced by activated Raf degrades p53 in the absence of the Mdm2 inhibitor p19(ARF) (OMIM Ref. No. 600160). This regulatory pathway accounts for the observation that cells transformed by oncogenic Ras are more resistant to p53-dependent apoptosis following exposure to DNA damage. Activation of the Ras-induced Raf/MEK/MAP kinase may therefore play a key role in suppressing p53 during tumor development and treatment. In primary cells, Raf also activates the Mdm2 inhibitor p19(ARF). Levels of p53 are therefore determined by opposing effects of Raf-induced p19(ARF) and Mdm2. The MDM2 oncoprotein promotes cell survival and cell cycle progression by inhibiting the p53 tumor suppressor protein (OMIM Ref. No. 191170). To regulate p53, MDM2 must gain nuclear entry; Mayo and Donner (2001) identified the mechanism that induces this. Mitogen-induced activation of phosphatidylinositol 3-kinase (see OMIM Ref. No. PIK3CA; 171834) and its downstream target, the AKT/PKB serine-threonine kinase (OMIM Ref. No. 164730), results in phosphorylation of MDM2 on serine-166 and serine-186. Phosphorylation on these sites is necessary for translocation of MDM2 from the cytoplasm into the nucleus. Pharmacologic blockade of PI3-kinase/AKT signaling or expression of dominant-negative PI3-kinase or AKT inhibits nuclear entry of MDM2, increases cellular levels of p53, and augments p53 transcriptional activity. Expression of constitutively active AKT promotes nuclear entry of MDM2, diminishes cellular levels of p53, and decreases p53 transcriptional activity. Mutation of the AKT phosphorylation sites in MDM2 produces a mutant protein that is unable to enter the nucleus and increases p53 activity. The demonstration that PI3-kinase/AKT signaling affects MDM2 localization provided insight into how this pathway, which is inappropriately activated in many malignancies, affects the function of p53. Testa and Bellacosa (2001) reviewed the central role of AKT in tumorigenesis.

Full details of the abovementioned studies are described in the following publications, the disclosure of which are hereby incorporated by reference:

Ries, S.; Biederer, C.; Woods, D.; Shifman, O.; Shirasawa, S.; Sasazuki, T.; McMahon, M.; Oren, M.; McCormick, F.: Opposing effects of Ras on p53: transcriptional activation of mdm2 and induction of p19(ARF). Cell 103:321-330, 2000; and Bueso-Ramos, C. E.; Yang, Y.; deLeon, E.; McCown, P.; Stass, S. A.; Albitar, M.: The human MDM-2 oncogene is overexpressed in leukemias. Blood 82:2617-2623, 1993.

Further studies establishing the function and utilities of MDM2 are found in John Hopkins OMIM database record ID 164785, and in cited publications listed in Table 5, which are hereby incorporated by reference. Mdm2, transformed 3t3 cell double minute 2, p53 binding protein (mouse) (MDM2, Accession NP_006872.1) is another GAM189 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM189 RNA, herein designated GAM RNA, also designated SEQ ID:246.

Another function of GAM189 is therefore inhibition of Mdm2, transformed 3t3 cell double minute 2, p53 binding protein (mouse) (MDM2, Accession NP_006872.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM189 include diagnosis, prevention and treatment of Tumors (including soft tissue sarcomas, osteosarcomas and gliomas), and of other diseases and clinical conditions associated with MDM2.

The function of MDM2 has been established by previous studies. MDM2 acts as a major regulator of the tumor suppressor p53 (OMIM Ref. No. 191170) by targeting its destruction. Oliner et al. (1992) used MDM2 clones to localize the human gene to 12q13-q14 by analysis of human-hamster somatic cell hybrids. By fluorescence in situ hybridization onto simultaneously DAPI-banded metaphase chromosomes and interphase nuclei, Mitchell et al. (1995) mapped MDM2 to 12q14.3-q15 distal to CDK4 (OMIM Ref. No. 123829) and flanked by Genethon microsatellites D12S80 and D12S83. On both the physical and the genetic maps of chromosome 12, Bureau et al. (1995) mapped the IFG gene (OMIM Ref. No. 147570) close to the D12S335 and D12S313 microsatellites. They also physically mapped it close to the locus of the MDM2 oncogene on 12q15, a localization proximal to that arrived at earlier. They described the organization of the Ifg, Myf6 (OMIM Ref. No. 159991), Mdm1, and Mdm2 loci on mouse chromosome 10 in a region with homology of synteny to human 12q15. . Bueso-Ramos et al. (1993) found overexpression of the MDM2 oncogene in leukemias. Inactivation of tumor suppressor genes leads to deregulated cell proliferation and is a key factor in human tumorigenesis. Mutations in the p53 and retinoblastoma (OMIM Ref. No. 180200) genes are frequently associated with human cancers, and simultaneous inactivation of both RB and p53 is frequently observed in naturally occurring tumors. Additionally, 3 distinct DNA tumor virus groups (papovaviruses, adenoviruses, and human papillomaviruses) transform cells by targeting and inactivating certain functions of both the p53 and RB1 gene products. Xiao et al. (1995) showed that MDM2 interacts physically and functionally with the RB protein and can inhibit its growth regulatory capacity. They thus demonstrated that both RB and p53 can be subjected to negative regulation by the product of a single cellular protooncogene. Mdm2 acts as a major regulator of the tumor suppressor p53 by targeting its destruction. Ries et al. (2000) showed that the mdm2 gene is also regulated by the Ras-driven Raf/MEK/MAP kinase pathway, in a p53-independent manner. Mdm2 induced by activated Raf degrades p53 in the absence of the Mdm2 inhibitor p19(ARF) (OMIM Ref. No. 600160). This regulatory pathway accounts for the observation that cells transformed by oncogenic Ras are more resistant to p53-dependent apoptosis following exposure to DNA damage. Activation of the Ras-induced Raf/MEK/MAP kinase may therefore play a key role in suppressing p53 during tumor development and treatment. In primary cells, Raf also activates the Mdm2 inhibitor p19(ARF). Levels of p53 are therefore determined by opposing effects of Raf-induced p19(ARF) and Mdm2. The MDM2 oncoprotein promotes cell survival and cell cycle progression by inhibiting the p53 tumor suppressor protein (OMIM Ref. No. 191170). To regulate p53, MDM2 must gain nuclear entry; Mayo and Donner (2001) identified the mechanism that induces this. Mitogen-induced activation of phosphatidylinositol 3-kinase (see OMIM Ref. No. PIK3CA; 171834) and its downstream target, the AKT/PKB serine-threonine kinase (OMIM Ref. No. 164730), results in phosphorylation of MDM2 on serine-166 and serine-186. Phosphorylation on these sites is necessary for translocation of MDM2 from the cytoplasm into the nucleus. Pharmacologic blockade of PI3-kinase/AKT signaling or expression of dominant-negative PI3-kinase or AKT inhibits nuclear entry of MDM2, increases cellular levels of p53, and augments p53 transcriptional activity. Expression of constitutively active AKT promotes nuclear entry of MDM2, diminishes cellular levels of p53, and decreases p53 transcriptional activity. Mutation of the AKT phosphorylation sites in MDM2 produces a mutant protein that is unable to enter the nucleus and increases p53 activity. The demonstration that PI3-kinase/AKT signaling affects MDM2 localization provided insight into how this pathway, which is inappropriately activated in many malignancies, affects the function of p53. Testa and Bellacosa (2001) reviewed the central role of AKT in tumorigenesis.

Full details of the abovementioned studies are described in the following publications, the disclosure of which are hereby incorporated by reference:

Ries, S.; Biederer, C.; Woods, D.; Shifman, O.; Shirasawa, S.; Sasazuki, T.; McMahon, M.; Oren, M.; McCormick, F.: Opposing effects of Ras on p53: transcriptional activation of mdm2 and induction of p19(ARF). Cell 103:321-330, 2000; and Bueso-Ramos, C. E.; Yang, Y.; deLeon, E.; McCown, P.; Stass, S. A.; Albitar, M.: The human MDM-2 oncogene is overexpressed in leukemias. Blood 82:2617-2623, 1993.

Further studies establishing the function and utilities of MDM2 are found in John Hopkins OMIM database record ID 164785, and in cited publications listed in Table 5, which are hereby incorporated by reference. Mdm2, transformed 3t3 cell double minute 2, p53 binding protein (mouse) (MDM2, Accession NP_002383.1) is another GAM189 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM189 RNA, herein designated GAM RNA, also designated SEQ ID:246.

Another function of GAM189 is therefore inhibition of Mdm2, transformed 3t3 cell double minute 2, p53 binding protein (mouse) (MDM2, Accession NP_002383.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM189 include diagnosis, prevention and treatment of Tumors (including soft tissue sarcomas, osteosarcomas and gliomas), and of other diseases and clinical conditions associated with MDM2.

The function of MDM2 has been established by previous studies. MDM2 acts as a major regulator of the tumor suppressor p53 (OMIM Ref. No. 191170) by targeting its destruction. Oliner et al. (1992) used MDM2 clones to localize the human gene to 12q13-q14 by analysis of human-hamster somatic cell hybrids. By fluorescence in situ hybridization onto simultaneously DAPI-banded metaphase chromosomes and interphase nuclei, Mitchell et al. (1995) mapped MDM2 to 12q14.3-q15 distal to CDK4 (OMIM Ref. No. 123829) and flanked by Genethon microsatellites D12S80 and D12S83. On both the physical and the genetic maps of chromosome 12, Bureau et al. (1995) mapped the IFG gene (OMIM Ref. No. 147570) close to the D12S335 and D12S313 microsatellites. They also physically mapped it close to the locus of the MDM2 oncogene on 12q15, a localization proximal to that arrived at earlier. They described the organization of the Ifg, Myf6 (OMIM Ref. No. 159991), Mdm1, and Mdm2 loci on mouse chromosome 10 in a region with homology of synteny to human 12q15. . Bueso-Ramos et al. (1993) found overexpression of the MDM2 oncogene in leukemias. Inactivation of tumor suppressor genes leads to deregulated cell proliferation and is a key factor in human tumorigenesis. Mutations in the p53 and retinoblastoma (OMIM Ref. No. 180200) genes are frequently associated with human cancers, and simultaneous inactivation of both RB and p53 is frequently observed in naturally occurring tumors. Additionally, 3 distinct DNA tumor virus groups (papovaviruses, adenoviruses, and human papillomaviruses) transform cells by targeting and inactivating certain functions of both the p53 and RB1 gene products. Xiao et al. (1995) showed that MDM2 interacts physically and functionally with the RB protein and can inhibit its growth regulatory capacity. They thus demonstrated that both RB and p53 can be subjected to negative regulation by the product of a single cellular protooncogene. Mdm2 acts as a major regulator of the tumor suppressor p53 by targeting its destruction. Ries et al. (2000) showed that the mdm2 gene is also regulated by the Ras-driven Raf/MEK/MAP kinase pathway, in a p53-independent manner. Mdm2 induced by activated Raf degrades p53 in the absence of the Mdm2 inhibitor p19(ARF) (OMIM Ref. No. 600160). This regulatory pathway accounts for the observation that cells transformed by oncogenic Ras are more resistant to p53-dependent apoptosis following exposure to DNA damage. Activation of the Ras-induced Raf/MEK/MAP kinase may therefore play a key role in suppressing p53 during tumor development and treatment. In primary cells, Raf also activates the Mdm2 inhibitor p19(ARF). Levels of p53 are therefore determined by opposing effects of Raf-induced p19(ARF) and Mdm2. The MDM2 oncoprotein promotes cell survival and cell cycle progression by inhibiting the p53 tumor suppressor protein (OMIM Ref. No. 191170). To regulate p53, MDM2 must gain nuclear entry; Mayo and Donner (2001) identified the mechanism that induces this. Mitogen-induced activation of phosphatidylinositol 3-kinase (see OMIM Ref. No. PIK3CA; 171834) and its downstream target, the AKT/PKB serine-threonine kinase (OMIM Ref. No. 164730), results in phosphorylation of MDM2 on serine-166 and serine-186. Phosphorylation on these sites is necessary for translocation of MDM2 from the cytoplasm into the nucleus. Pharmacologic blockade of PI3-kinase/AKT signaling or expression of dominant-negative PI3-kinase or AKT inhibits nuclear entry of MDM2, increases cellular levels of p53, and augments p53 transcriptional activity. Expression of constitutively active AKT promotes nuclear entry of MDM2, diminishes cellular levels of p53, and decreases p53 transcriptional activity. Mutation of the AKT phosphorylation sites in MDM2 produces a mutant protein that is unable to enter the nucleus and increases p53 activity. The demonstration that PI3-kinase/AKT signaling affects MDM2 localization provided insight into how this pathway, which is inappropriately activated in many malignancies, affects the function of p53. Testa and Bellacosa (2001) reviewed the central role of AKT in tumorigenesis.

Full details of the abovementioned studies are described in the following publications, the disclosure of which are hereby incorporated by reference:

Ries, S.; Biederer, C.; Woods, D.; Shifman, O.; Shirasawa, S.; Sasazuki, T.; McMahon, M.; Oren, M.; McCormick, F.: Opposing effects of Ras on p53: transcriptional activation of mdm2 and induction of p19(ARF). Cell 103:321-330, 2000; and Bueso-Ramos, C. E.; Yang, Y.; deLeon, E.; McCown, P.; Stass, S. A.; Albitar, M.: The human MDM-2 oncogene is overexpressed in leukemias. Blood 82:2617-2623, 1993.

Further studies establishing the function and utilities of MDM2 are found in John Hopkins OMIM database record ID 164785, and in cited publications listed in Table 5, which are hereby incorporated by reference. Mdm2, transformed 3t3 cell double minute 2, p53 binding protein (mouse) (MDM2, Accession NP_006871.1) is another GAM189 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM189 RNA, herein designated GAM RNA, also designated SEQ ID:246.

Another function of GAM189 is therefore inhibition of Mdm2, transformed 3t3 cell double minute 2, p53 binding protein (mouse) (MDM2, Accession NP_006871.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM189 include diagnosis, prevention and treatment of Tumors (including soft tissue sarcomas, osteosarcomas and gliomas), and of other diseases and clinical conditions associated with MDM2.

The function of MDM2 has been established by previous studies. MDM2 acts as a major regulator of the tumor suppressor p53 (OMIM Ref. No. 191170) by targeting its destruction. Oliner et al. (1992) used MDM2 clones to localize the human gene to 12q13-q14 by analysis of human-hamster somatic cell hybrids. By fluorescence in situ hybridization onto simultaneously DAPI-banded metaphase chromosomes and interphase nuclei, Mitchell et al. (1995) mapped MDM2 to 12q14.3-q15 distal to CDK4 (OMIM Ref. No. 123829) and flanked by Genethon microsatellites D12S80 and D12S83. On both the physical and the genetic maps of chromosome 12, Bureau et al. (1995) mapped the IFG gene (OMIM Ref. No. 147570) close to the D12S335 and D12S313 microsatellites. They also physically mapped it close to the locus of the MDM2 oncogene on 12q15, a localization proximal to that arrived at earlier. They described the organization of the Ifg, Myf6 (OMIM Ref. No. 159991), Mdm1, and Mdm2 loci on mouse chromosome 10 in a region with homology of synteny to human 12q15. . Bueso-Ramos et al. (1993) found overexpression of the MDM2 oncogene in leukemias. Inactivation of tumor suppressor genes leads to deregulated cell proliferation and is a key factor in human tumorigenesis. Mutations in the p53 and retinoblastoma (OMIM Ref. No. 180200) genes are frequently associated with human cancers, and simultaneous inactivation of both RB and p53 is frequently observed in naturally occurring tumors. Additionally, 3 distinct DNA tumor virus groups (papovaviruses, adenoviruses, and human papillomaviruses) transform cells by targeting and inactivating certain functions of both the p53 and RB1 gene products. Xiao et al. (1995) showed that MDM2 interacts physically and functionally with the RB protein and can inhibit its growth regulatory capacity. They thus demonstrated that both RB and p53 can be subjected to negative regulation by the product of a single cellular protooncogene. Mdm2 acts as a major regulator of the tumor suppressor p53 by targeting its destruction. Ries et al. (2000) showed that the mdm2 gene is also regulated by the Ras-driven Raf/MEK/MAP kinase pathway, in a p53-independent manner. Mdm2 induced by activated Raf degrades p53 in the absence of the Mdm2 inhibitor p19(ARF) (OMIM Ref. No. 600160). This regulatory pathway accounts for the observation that cells transformed by oncogenic Ras are more resistant to p53-dependent apoptosis following exposure to DNA damage. Activation of the Ras-induced Raf/MEK/MAP kinase may therefore play a key role in suppressing p53 during tumor development and treatment. In primary cells, Raf also activates the Mdm2 inhibitor p19(ARF). Levels of p53 are therefore determined by opposing effects of Raf-induced p19(ARF) and Mdm2. The MDM2 oncoprotein promotes cell survival and cell cycle progression by inhibiting the p53 tumor suppressor protein (OMIM Ref. No. 191170). To regulate p53, MDM2 must gain nuclear entry; Mayo and Donner (2001) identified the mechanism that induces this. Mitogen-induced activation of phosphatidylinositol 3-kinase (see OMIM Ref. No. PIK3CA; 171834) and its downstream target, the AKT/PKB serine-threonine kinase (OMIM Ref. No. 164730), results in phosphorylation of MDM2 on serine-166 and serine-186. Phosphorylation on these sites is necessary for translocation of MDM2 from the cytoplasm into the nucleus. Pharmacologic blockade of PI3-kinase/AKT signaling or expression of dominant-negative PI3-kinase or AKT inhibits nuclear entry of MDM2, increases cellular levels of p53, and augments p53 transcriptional activity. Expression of constitutively active AKT promotes nuclear entry of MDM2, diminishes cellular levels of p53, and decreases p53 transcriptional activity. Mutation of the AKT phosphorylation sites in MDM2 produces a mutant protein that is unable to enter the nucleus and increases p53 activity. The demonstration that PI3-kinase/AKT signaling affects MDM2 localization provided insight into how this pathway, which is inappropriately activated in many malignancies, affects the function of p53. Testa and Bellacosa (2001) reviewed the central role of AKT in tumorigenesis.

Full details of the abovementioned studies are described in the following publications, the disclosure of which are hereby incorporated by reference:

Ries, S.; Biederer, C.; Woods, D.; Shifman, O.; Shirasawa, S.; Sasazuki, T.; McMahon, M.; Oren, M.; McCormick, F.: Opposing effects of Ras on p53: transcriptional activation of mdm2 and induction of p19(ARF). Cell 103:321-330, 2000; and Bueso-Ramos, C. E.; Yang, Y.; deLeon, E.; McCown, P.; Stass, S. A.; Albitar, M.: The human MDM-2 oncogene is overexpressed in leukemias. Blood 82:2617-2623, 1993.

Further studies establishing the function and utilities of MDM2 are found in John Hopkins OMIM database record ID 164785, and in cited publications listed in Table 5, which are hereby incorporated by reference. Mdm4, transformed 3t3 cell double minute 4, p53 binding protein (mouse) (MDM4, Accession NP_002384.1) is another GAM189 target gene, herein designated TARGET GENE. MDM4 BINDING SITE is a target binding site found in the 3' untranslated region of mRNA encoded by MDM4, corresponding to a target binding site such as BINDING SITE I, BINDING SITE II or BINDING SITE III of FIG. 8. Table 4 illustrates the complementarity of the nucleotide sequences of MDM4 BINDING SITE, designated SEQ ID:7078, to the nucleotide sequence of GAM189 RNA, herein designated GAM RNA, also designated SEQ ID:246.

Another function of GAM189 is therefore inhibition of Mdm4, transformed 3t3 cell double minute 4, p53 binding protein (mouse) (MDM4, Accession NP_002384.1), a gene which Strongly similar to murine Mdm4; may interact with p53. Accordingly, utilities of GAM189 include diagnosis, prevention and treatment of diseases and clinical conditions associated with MDM4.

The function of MDM4 has been established by previous studies. Shvarts et al. (1997) isolated cDNAs encoding MDM4 by screening a human cDNA library from a colonic tumorigenic cell line with a mouse mdmx probe. The human MDM4 gene encodes a 490-amino acid protein containing a RING finger domain and a putative nuclear localization signal. The predicted mass of the protein was 54 kD, while the observed mass was 80 kD, a difference which Shvarts et al. (1997) stated was probably due to phosphorylation or other posttranslational modification. Northern blot analysis revealed a 10-kb mRNA expressed at a high level in thymus and at lower levels in all other tissues tested. A 2.2-kb mRNA was detected in testis. MDM4 protein produced by in vitro translation interacts with p53 (OMIM Ref. No. 191170) via a binding domain located in the N- terminal region of the MDM4 protein. MDM4 shows significant structural similarity to p53-binding protein MDM2 (OMIM Ref. No. 164785), an E3 ubiquitin ligase. The interaction between MDM2 and p53 is critical for cell viability; loss of Mdm2 causes cell death in vitro and in vivo in a p53-dependent manner. MDM4 has some of the same properties as MDM2, but unlike MDM2, it does not cause nuclear export or degradation of p53. To study MDM4 function in vivo, Parant et al. (2001) deleted the Mdm4 gene in mice. Mdm4-null mice died at 7.5 to 8.5 days postcoitum due to loss of cell proliferation. When Parant et al. (2001) crossed in a p53-null allele, they found that loss of p53 completely rescued the Mdm4 -/-embryonic lethality. Thus, MDM2 and MDM4 are nonoverlapping critical regulators of p53 in vivo. These data defined a new pathway of p53 regulation and raised the possibility that increased MDM4 levels and the resulting inactivation of p53 contribute to the development of human tumors. By fluorescence in situ hybridization, Shvarts et al. (1997) mapped the MDM4 gene to human chromosome 1q32.

Full details of the abovementioned studies are described in the following publications, the disclosure of which are hereby incorporated by reference:

Parant, J.; Chavez-Reyes, A.; Little, N. A.; Yan, W.; Reinke, V.; Jochemsen, A. G.; Lozano, G.: Rescue of embryonic lethality in Mdm4-null mice by loss of Trp53 suggests a nonoverlapping pathway with MDM2 to regulate p53. Nature Genet. 29:92-95, 2001; and Shvarts, A.; Bazuine, M.; Dekker, P.; Ramos, Y. F. M.; Steegenga, W. T.; Merckx, G.; van Ham, R. C. A.; van der Houven van Oordt, W.; van der Eb, A. J.; Jochemsen, A. G. : Isolation an.

Further studies establishing the function and utilities of MDM4 are found in John Hopkins OMIM database record ID 602704, and in cited publications listed in Table 5, which are hereby incorporated by reference. Mediterranean fever (MEFV, Accession NP_000234.1) is another GAM189 target gene, herein designated TARGET GENE. MEFV BINDING SITE1 and MEFV BINDING SITE2 are target binding sites found in untranslated regions of mRNA encoded by MEFV, corresponding to target binding sites such as BINDING SITE I, BINDING SITE II or BINDING SITE III of FIG. 8. Table 4 illustrates the complementarity of the nucleotide sequences of MEFV BINDING SITE1 and MEFV BINDING SITE2, designated SEQ ID:19829 and SEQ ID:5443 respectively, to the nucleotide sequence of GAM189 RNA, herein designated GAM RNA, also designated SEQ ID:246.

Another function of GAM189 is therefore inhibition of Mediterranean fever (MEFV, Accession NP_000234.1). Accordingly, utilities of GAM189 include diagnosis, prevention and treatment of diseases and clinical conditions associated with MEFV.

Mesoderm development candidate 2 (MESDC2, Accession XP_051854.1) is another GAM189 target gene, herein designated TARGET GENE. MESDC2 BINDING SITE is a target binding site found in the 3' untranslated region of mRNA encoded by MESDC2, corresponding to a target binding site such as BINDING SITE I, BINDING SITE II or BINDING SITE III of FIG. 8. Table 4 illustrates the complementarity of the nucleotide sequences of MESDC2 BINDING SITE, designated SEQ ID:6523, to the nucleotide sequence of GAM189 RNA, herein designated GAM RNA, also designated SEQ ID:246.

Another function of GAM189 is therefore inhibition of Mesoderm development candidate 2 (MESDC2, Accession XP_051854.1). Accordingly, utilities of GAM189 include diagnosis, prevention and treatment of diseases and clinical conditions associated with MESDC2.

MFTC (Accession NP_110407.2) is another GAM189 target gene, herein designated TARGET GENE. MFTC BINDING SITE is a target binding site found in the 3' untranslated region of mRNA encoded by MFTC, corresponding to a target binding site such as BINDING SITE I, BINDING SITE II or BINDING SITE III of FIG. 8. Table 4 illustrates the complementarity of the nucleotide sequences of MFTC BINDING SITE, designated SEQ ID:16545, to the nucleotide sequence of GAM189 RNA, herein designated GAM RNA, also designated SEQ ID:246.

Another function of GAM189 is therefore inhibition of MFTC (Accession NP_110407.2). Accordingly, utilities of GAM189 include diagnosis, prevention and treatment of diseases and clinical conditions associated with MFTC.

Mannosyl (alpha-1,6-)-glycoprotein beta-1,2-n-acetylglucosaminyltransferase (MGAT2, Accession NP_079374.1) is another GAM189 target gene, herein designated TARGET GENE. MGAT2 BINDING SITE is a target binding site found in the 3' untranslated region of multiple transcripts of mRNA encoded by MGAT2, corresponding to a target binding site such as BINDING SITE I, BINDING SITE II or BINDING SITE III of FIG. 8. Table 4 illustrates the complementarity of the nucleotide sequences of MGAT2 BINDING SITE, designated SEQ ID:9699, to the nucleotide sequence of GAM189 RNA, herein designated GAM RNA, also designated SEQ ID:246.

Another function of GAM189 is therefore inhibition of Mannosyl (alpha-1,6-)-glycoprotein beta-1,2-n-acetylglucosaminyltransferase (MGAT2, Accession NP_079374.1). Accordingly, utilities of GAM189 include diagnosis, prevention and treatment of diseases and clinical conditions associated with MGAT2.

MGC10772 (Accession NP_085044.2) is another GAM189 target gene, herein designated TARGET GENE. MGC10772 BINDING SITE is a target binding site found in the 5' untranslated region of mRNA encoded by MGC10772, corresponding to a target binding site such as BINDING SITE I, BINDING SITE II or BINDING SITE III of FIG. 8. Table 4 illustrates the complementarity of the nucleotide sequences of MGC10772 BINDING SITE, designated SEQ ID:5386, to the nucleotide sequence of GAM189 RNA, herein designated GAM RNA, also designated SEQ ID:246.

Another function of GAM189 is therefore inhibition of MGC10772 (Accession NP__085044.2). Accordingly, utilities of GAM189 include diagnosis, prevention and treatment of diseases and clinical conditions associated with MGC10772.

MGC10818 (Accession NP__085045.2) is another GAM189 target gene, herein designated TARGET GENE. MGC10818 BINDING SITE is a target binding site found in the 3' untranslated region of mRNA encoded by MGC10818, corresponding to a target binding site such as BINDING SITE I, BINDING SITE II or BINDING SITE III of FIG. 8. Table 4 illustrates the complementarity of the nucleotide sequences of MGC10818 BINDING SITE, designated SEQ ID:2199, to the nucleotide sequence of GAM189 RNA, herein designated GAM RNA, also designated SEQ ID:246.

Another function of GAM189 is therefore inhibition of MGC10818 (Accession NP__085045.2). Accordingly, utilities of GAM189 include diagnosis, prevention and treatment of diseases and clinical conditions associated with MGC10818.

MGC11102 (Accession NP__115701.2) is another GAM189 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:17609, to the nucleotide sequence of GAM189 RNA, herein designated GAM RNA, also designated SEQ ID:246.

Another function of GAM189 is therefore inhibition of MGC11102 (Accession NP__115701.2). Accordingly, utilities of GAM189 include diagnosis, prevention and treatment of diseases and clinical conditions associated with MGC11102.

MGC12262 (Accession NP__116085.1) is another GAM189 target gene, herein designated TARGET GENE. MGC12262 BINDING SITE is a target binding site found in the 5' untranslated region of mRNA encoded by MGC12262, corresponding to a target binding site such as BINDING SITE I, BINDING SITE II or BINDING SITE III of FIG. 8. Table 4 illustrates the complementarity of the nucleotide sequences of MGC12262 BINDING SITE, designated SEQ ID:12220, to the nucleotide sequence of GAM189 RNA, herein designated GAM RNA, also designated SEQ ID:246.

Another function of GAM189 is therefore inhibition of MGC12262 (Accession NP__116085.1). Accordingly, utilities of GAM189 include diagnosis, prevention and treatment of diseases and clinical conditions associated with MGC12262.

MGC12518 (Accession NP__291026.1) is another GAM189 target gene, herein designated TARGET GENE. MGC12518 BINDING SITE is a target binding site found in the 3' untranslated region of mRNA encoded by MGC12518, corresponding to a target binding site such as BINDING SITE I, BINDING SITE II or BINDING SITE III of FIG. 8. Table 4 illustrates the complementarity of the nucleotide sequences of MGC12518 BINDING SITE, designated SEQ ID:18251, to the nucleotide sequence of GAM189 RNA, herein designated GAM RNA, also designated SEQ ID:246.

Another function of GAM189 is therefore inhibition of MGC12518 (Accession NP__291026.1). Accordingly, utilities of GAM189 include diagnosis, prevention and treatment of diseases and clinical conditions associated with MGC12518.

MGC13017 (Accession NP__542387.1) is another GAM189 target gene, herein designated TARGET GENE. MGC13017 BINDING SITE is a target binding site found in the 3' untranslated region of mRNA encoded by MGC13017, corresponding to a target binding site such as BINDING SITE I, BINDING SITE II or BINDING SITE III of FIG. 8. Table 4 illustrates the complementarity of the nucleotide sequences of MGC13017 BINDING SITE, designated SEQ ID:11562, to the nucleotide sequence of GAM189 RNA, herein designated GAM RNA, also designated SEQ ID:246.

Another function of GAM189 is therefore inhibition of MGC13017 (Accession NP__542387.1). Accordingly, utilities of GAM189 include diagnosis, prevention and treatment of diseases and clinical conditions associated with MGC13017.

MGC13024 (Accession NP__689501.1) is another GAM189 target gene, herein designated TARGET GENE. MGC13024 BINDING SITE is a target binding site found in the 3' untranslated region of mRNA encoded by MGC13024, corresponding to a target binding site such as BINDING SITE I, BINDING SITE II or BINDING SITE III of FIG. 8. Table 4 illustrates the complementarity of the nucleotide sequences of MGC13024 BINDING SITE, designated SEQ ID:13564, to the nucleotide sequence of GAM189 RNA, herein designated GAM RNA, also designated SEQ ID:246.

Another function of GAM189 is therefore inhibition of MGC13024 (Accession NP__689501.1). Accordingly, utilities of GAM189 include diagnosis, prevention and treatment of diseases and clinical conditions associated with MGC13024.

MGC13138 (Accession NP__219363.1) is another GAM189 target gene, herein designated TARGET GENE. MGC13138 BINDING SITE1 and MGC13138 BINDING SITE2 are target binding sites found in untranslated regions of mRNA encoded by MGC13138, corresponding to target binding sites such as BINDING SITE I, BINDING SITE II or BINDING SITE III of FIG. 8. Table 4 illustrates the complementarity of the nucleotide sequences of MGC13138 BINDING SITE1 and MGC13138 BINDING SITE2, designated SEQ ID:6646 and SEQ ID:9543 respectively, to the nucleotide sequence of GAM189 RNA, herein designated GAM RNA, also designated SEQ ID:246.

Another function of GAM189 is therefore inhibition of MGC13138 (Accession NP__219363.1). Accordingly, utilities of GAM189 include diagnosis, prevention and treatment of diseases and clinical conditions associated with MGC13138.

MGC13170 (Accession NP__116101.1) is another GAM189 target gene, herein designated TARGET GENE. MGC13170 BINDING SITE is a target binding site found in the 3' untranslated region of mRNA encoded by MGC13170, corresponding to a target binding site such as BINDING SITE I, BINDING SITE II or BINDING SITE III of FIG. 8. Table 4 illustrates the complementarity of the nucleotide sequences of MGC13170 BINDING SITE, designated SEQ ID:20116, to the nucleotide sequence of GAM189 RNA, herein designated GAM RNA, also designated SEQ ID:246.

Another function of GAM189 is therefore inhibition of MGC13170 (Accession NP__116101.1). Accordingly, utilities of GAM189 include diagnosis, prevention and treatment of diseases and clinical conditions associated with MGC13170.

MGC13204 (Accession NP__113653.1) is another GAM189 target gene, herein designated TARGET GENE.

MGC13204 BINDING SITE is a target binding site found in the 3' untranslated region of mRNA encoded by MGC13204, corresponding to a target binding site such as BINDING SITE I, BINDING SITE II or BINDING SITE III of FIG. 8. Table 4 illustrates the complementarity of the nucleotide sequences of MGC13204 BINDING SITE, designated SEQ ID:9494, to the nucleotide sequence of GAM189 RNA, herein designated GAM RNA, also designated SEQ ID:246.

Another function of GAM189 is therefore inhibition of MGC13204 (Accession NP_113653.1). Accordingly, utilities of GAM189 include diagnosis, prevention and treatment of diseases and clinical conditions associated with MGC13204.

MGC14289 (Accession NP_542391.1) is another GAM189 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:3677, to the nucleotide sequence of GAM189 RNA, herein designated GAM RNA, also designated SEQ ID:246.

Another function of GAM189 is therefore inhibition of MGC14289 (Accession NP_542391.1). Accordingly, utilities of GAM189 include diagnosis, prevention and treatment of diseases and clinical conditions associated with MGC14289.

MGC14436 (Accession NP_116286.1) is another GAM189 target gene, herein designated TARGET GENE. MGC14436 BINDING SITE is a target binding site found in the 5' untranslated region of mRNA encoded by MGC14436, corresponding to a target binding site such as BINDING SITE I, BINDING SITE II or BINDING SITE III of FIG. 8. Table 4 illustrates the complementarity of the nucleotide sequences of MGC14436 BINDING SITE, designated SEQ ID:17347, to the nucleotide sequence of GAM189 RNA, herein designated GAM RNA, also designated SEQ ID:246.

Another function of GAM189 is therefore inhibition of MGC14436 (Accession NP_116286.1). Accordingly, utilities of GAM189 include diagnosis, prevention and treatment of diseases and clinical conditions associated with MGC14436.

MGC14836 (Accession NP_219480.1) is another GAM189 target gene, herein designated TARGET GENE. MGC14836 BINDING SITE is a target binding site found in the 3' untranslated region of mRNA encoded by MGC14836, corresponding to a target binding site such as BINDING SITE I, BINDING SITE II or BINDING SITE III of FIG. 8. Table 4 illustrates the complementarity of the nucleotide sequences of MGC14836 BINDING SITE, designated SEQ ID:15044, to the nucleotide sequence of GAM189 RNA, herein designated GAM RNA, also designated SEQ ID:246.

Another function of GAM189 is therefore inhibition of MGC14836 (Accession NP_219480.1). Accordingly, utilities of GAM189 include diagnosis, prevention and treatment of diseases and clinical conditions associated with MGC14836.

MGC15419 (Accession NP_079011.2) is another GAM189 target gene, herein designated TARGET GENE. MGC15419 BINDING SITE is a target binding site found in the 3' untranslated region of mRNA encoded by MGC15419, corresponding to a target binding site such as BINDING SITE I, BINDING SITE II or BINDING SITE III of FIG. 8. Table 4 illustrates the complementarity of the nucleotide sequences of MGC15419 BINDING SITE, designated SEQ ID:15115, to the nucleotide sequence of GAM189 RNA, herein designated GAM RNA, also designated SEQ ID:246.

Another function of GAM189 is therefore inhibition of MGC15419 (Accession NP_079011.2). Accordingly, utilities of GAM189 include diagnosis, prevention and treatment of diseases and clinical conditions associated with MGC15419.

MGC15606 (Accession NP_659474.1) is another GAM189 target gene, herein designated TARGET GENE. MGC15606 BINDING SITE is a target binding site found in the 5' untranslated region of mRNA encoded by MGC15606, corresponding to a target binding site such as BINDING SITE I, BINDING SITE II or BINDING SITE III of FIG. 8. Table 4 illustrates the complementarity of the nucleotide sequences of MGC15606 BINDING SITE, designated SEQ ID:10968, to the nucleotide sequence of GAM189 RNA, herein designated GAM RNA, also designated SEQ ID:246.

Another function of GAM189 is therefore inhibition of MGC15606 (Accession NP_659474.1). Accordingly, utilities of GAM189 include diagnosis, prevention and treatment of diseases and clinical conditions associated with MGC15606.

MGC15668 (Accession NP_116145.1) is another GAM189 target gene, herein designated TARGET GENE. MGC15668 BINDING SITE is a target binding site found in the 3' untranslated region of mRNA encoded by MGC15668, corresponding to a target binding site such as BINDING SITE I, BINDING SITE II or BINDING SITE III of FIG. 8. Table 4 illustrates the complementarity of the nucleotide sequences of MGC15668 BINDING SITE, designated SEQ ID:3620, to the nucleotide sequence of GAM189 RNA, herein designated GAM RNA, also designated SEQ ID:246.

Another function of GAM189 is therefore inhibition of MGC15668 (Accession NP_116145.1). Accordingly, utilities of GAM189 include diagnosis, prevention and treatment of diseases and clinical conditions associated with MGC15668.

MGC15873 (Accession NP_116309.1) is another GAM189 target gene, herein designated TARGET GENE. MGC15873 BINDING SITE is a target binding site found in the 5' untranslated region of mRNA encoded by MGC15873, corresponding to a target binding site such as BINDING SITE I, BINDING SITE II or BINDING SITE III of FIG. 8. Table 4 illustrates the complementarity of the nucleotide sequences of MGC15873 BINDING SITE, designated SEQ ID:2894, to the nucleotide sequence of GAM189 RNA, herein designated GAM RNA, also designated SEQ ID:246.

Another function of GAM189 is therefore inhibition of MGC15873 (Accession NP_116309.1). Accordingly, utilities of GAM189 include diagnosis, prevention and treatment of diseases and clinical conditions associated with MGC15873.

MGC1842 (Accession XP_037797.2) is another GAM189 target gene, herein designated TARGET GENE. MGC1842 BINDING SITE is a target binding site found in the 3' untranslated region of mRNA encoded by MGC1842, corresponding to a target binding site such as BINDING SITE I, BINDING SITE II or BINDING SITE III of FIG. 8. Table 4 illustrates the complementarity of the nucleotide sequences of MGC1842 BINDING SITE, designated SEQ ID:15046, to the nucleotide sequence of GAM189 RNA, herein designated GAM RNA, also designated SEQ ID:246.

Another function of GAM189 is therefore inhibition of MGC1842 (Accession XP_037797.2). Accordingly, utilities of GAM189 include diagnosis, prevention and treatment of diseases and clinical conditions associated with MGC1842.

MGC21675 (Accession NP_443093.1) is another GAM189 target gene, herein designated TARGET GENE. MGC21675 BINDING SITE is a target binding site found in the 3' untranslated region of mRNA encoded by MGC21675, corresponding to a target binding site such as BINDING SITE I, BINDING SITE II or BINDING SITE III of FIG. 8. Table 4 illustrates the complementarity of the nucleotide sequences of MGC21675 BINDING SITE, designated SEQ ID:16916, to the nucleotide sequence of GAM189 RNA, herein designated GAM RNA, also designated SEQ ID:246.

Another function of GAM189 is therefore inhibition of MGC21675 (Accession NP_443093.1). Accordingly, utilities of GAM189 include diagnosis, prevention and treatment of diseases and clinical conditions associated with MGC21675.

MGC21738 (Accession NP_659481.1) is another GAM189 target gene, herein designated TARGET GENE. MGC21738 BINDING SITE is a target binding site found in the 3' untranslated region of mRNA encoded by MGC21738, corresponding to a target binding site such as BINDING SITE I, BINDING SITE II or BINDING SITE III of FIG. 8. Table 4 illustrates the complementarity of the nucleotide sequences of MGC21738 BINDING SITE, designated SEQ ID:8134, to the nucleotide sequence of GAM189 RNA, herein designated GAM RNA, also designated SEQ ID:246.

Another function of GAM189 is therefore inhibition of MGC21738 (Accession NP_659481.1). Accordingly, utilities of GAM189 include diagnosis, prevention and treatment of diseases and clinical conditions associated with MGC21738.

MGC2306 (Accession NP_002041.2) is another GAM189 target gene, herein designated TARGET GENE. MGC2306 BINDING SITE is a target binding site found in the 3' untranslated region of mRNA encoded by MGC2306, corresponding to a target binding site such as BINDING SITE I, BINDING SITE II or BINDING SITE III of FIG. 8. Table 4 illustrates the complementarity of the nucleotide sequences of MGC2306 BINDING SITE, designated SEQ ID:7160, to the nucleotide sequence of GAM189 RNA, herein designated GAM RNA, also designated SEQ ID:246.

Another function of GAM189 is therefore inhibition of MGC2306 (Accession NP_002041.2). Accordingly, utilities of GAM189 include diagnosis, prevention and treatment of diseases and clinical conditions associated with MGC2306.

MGC2474 (Accession NP_076420.1) is another GAM189 target gene, herein designated TARGET GENE. MGC2474 BINDING SITE1 and MGC2474 BINDING SITE2 are target binding sites found in untranslated regions of mRNA encoded by MGC2474, corresponding to target binding sites such as BINDING SITE I, BINDING SITE II or BINDING SITE III of FIG. 8. Table 4 illustrates the complementarity of the nucleotide sequences of MGC2474 BINDING SITE1 and MGC2474 BINDING SITE2, designated SEQ ID:7797 and SEQ ID:18665 respectively, to the nucleotide sequence of GAM189 RNA, herein designated GAM RNA, also designated SEQ ID:246.

Another function of GAM189 is therefore inhibition of MGC2474 (Accession NP_076420.1). Accordingly, utilities of GAM189 include diagnosis, prevention and treatment of diseases and clinical conditions associated with MGC2474.

MGC2477 (Accession NP_077004.1) is another GAM189 target gene, herein designated TARGET GENE. MGC2477 BINDING SITE1 through MGC2477 BINDING SITE3 are target binding sites found in untranslated regions of mRNA encoded by MGC2477, corresponding to target binding sites such as BINDING SITE I, BINDING SITE II or BINDING SITE III of FIG. 8. Table 4 illustrates the complementarity of the nucleotide sequences of MGC2477 BINDING SITE1 through MGC2477 BINDING SITE3, designated SEQ ID:8610, SEQ ID:19729 and SEQ ID:5609 respectively, to the nucleotide sequence of GAM189 RNA, herein designated GAM RNA, also designated SEQ ID:246.

Another function of GAM189 is therefore inhibition of MGC2477 (Accession NP_077004.1). Accordingly, utilities of GAM189 include diagnosis, prevention and treatment of diseases and clinical conditions associated with MGC2477.

MGC2603 (Accession NP_076942.1) is another GAM189 target gene, herein designated TARGET GENE. MGC2603 BINDING SITE is a target binding site found in the 3' untranslated region of mRNA encoded by MGC2603, corresponding to a target binding site such as BINDING SITE I, BINDING SITE II or BINDING SITE III of FIG. 8. Table 4 illustrates the complementarity of the nucleotide sequences of MGC2603 BINDING SITE, designated SEQ ID:5845, to the nucleotide sequence of GAM189 RNA, herein designated GAM RNA, also designated SEQ ID:246.

Another function of GAM189 is therefore inhibition of MGC2603 (Accession NP_076942.1). Accordingly, utilities of GAM189 include diagnosis, prevention and treatment of diseases and clinical conditions associated with MGC2603.

MGC2718 (Accession NP_076972.2) is another GAM189 target gene, herein designated TARGET GENE. MGC2718 BINDING SITE is a target binding site found in the 3' untranslated region of mRNA encoded by MGC2718, corresponding to a target binding site such as BINDING SITE I, BINDING SITE II or BINDING SITE III of FIG. 8. Table 4 illustrates the complementarity of the nucleotide sequences of MGC2718 BINDING SITE, designated SEQ ID:3976, to the nucleotide sequence of GAM189 RNA, herein designated GAM RNA, also designated SEQ ID:246.

Another function of GAM189 is therefore inhibition of MGC2718 (Accession NP_076972.2). Accordingly, utilities of GAM189 include diagnosis, prevention and treatment of diseases and clinical conditions associated with MGC2718.

MGC27345 (Accession XP_300964.1) is another GAM189 target gene, herein designated TARGET GENE. MGC27345 BINDING SITE1 and MGC27345 BINDING SITE2 are target binding sites found in untranslated regions of multiple transcripts of mRNA encoded by MGC27345, corresponding to target binding sites such as BINDING SITE I, BINDING SITE II or BINDING SITE III of FIG. 8. Table 4 illustrates the complementarity of the nucleotide sequences of MGC27345 BINDING SITE1 and MGC27345 BINDING SITE2, designated SEQ ID:19385 and SEQ ID:18352 respectively, to the nucleotide sequence of GAM189 RNA, herein designated GAM RNA, also designated SEQ ID:246.

Another function of GAM189 is therefore inhibition of MGC27345 (Accession XP_300964.1). Accordingly, utilities of GAM189 include diagnosis, prevention and treatment of diseases and clinical conditions associated with MGC27345.

MGC29891 (Accession NP_653219.1) is another GAM189 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:14858, to the nucleotide sequence of GAM189 RNA, herein designated GAM RNA, also designated SEQ ID:246.

Another function of GAM189 is therefore inhibition of MGC29891 (Accession NP_653219.1). Accordingly, utilities of GAM189 include diagnosis, prevention and treatment of diseases and clinical conditions associated with MGC29891.

MGC29898 (Accession NP_659485.1) is another GAM189 target gene, herein designated TARGET GENE. MGC29898 BINDING SITE is a target binding site found in the 3' untranslated region of mRNA encoded by MGC29898, corresponding to a target binding site such as BINDING SITE I, BINDING SITE II or BINDING SITE III of FIG. 8. Table 4 illustrates the complementarity of the nucleotide sequences of MGC29898 BINDING SITE, designated SEQ ID:16672, to the nucleotide sequence of GAM189 RNA, herein designated GAM RNA, also designated SEQ ID:246.

Another function of GAM189 is therefore inhibition of MGC29898 (Accession NP_659485.1). Accordingly, utilities of GAM189 include diagnosis, prevention and treatment of diseases and clinical conditions associated with MGC29898.

MGC3113 (Accession NP_076940.1) is another GAM189 target gene, herein designated TARGET GENE. MGC3113 BINDING SITE is a target binding site found in the 3' untranslated region of mRNA encoded by MGC3113, corresponding to a target binding site such as BINDING SITE I, BINDING SITE II or BINDING SITE III of FIG. 8. Table 4 illustrates the complementarity of the nucleotide sequences of MGC3113 BINDING SITE, designated SEQ ID:10136, to the nucleotide sequence of GAM189 RNA, herein designated GAM RNA, also designated SEQ ID:246.

Another function of GAM189 is therefore inhibition of MGC3113 (Accession NP_076940.1). Accordingly, utilities of GAM189 include diagnosis, prevention and treatment of diseases and clinical conditions associated with MGC3113.

MGC3207 (Accession NP_115661.1) is another GAM189 target gene, herein designated TARGET GENE. MGC3207 BINDING SITE1 and MGC3207 BINDING SITE2 are target binding sites found in untranslated regions of mRNA encoded by MGC3207, corresponding to target binding sites such as BINDING SITE I, BINDING SITE II or BINDING SITE III of FIG. 8. Table 4 illustrates the complementarity of the nucleotide sequences of MGC3207 BINDING SITE1 and MGC3207 BINDING SITE2, designated SEQ ID:5157 and SEQ ID:13812 respectively, to the nucleotide sequence of GAM189 RNA, herein designated GAM RNA, also designated SEQ ID:246.

Another function of GAM189 is therefore inhibition of MGC3207 (Accession NP_115661.1). Accordingly, utilities of GAM189 include diagnosis, prevention and treatment of diseases and clinical conditions associated with MGC3207.

MGC3329 (Accession NP_076991.2) is another GAM189 target gene, herein designated TARGET GENE. MGC3329 BINDING SITE is a target binding site found in the 3' untranslated region of mRNA encoded by MGC3329, corresponding to a target binding site such as BINDING SITE I, BINDING SITE II or BINDING SITE III of FIG. 8. Table 4 illustrates the complementarity of the nucleotide sequences of MGC3329 BINDING SITE, designated SEQ ID:4477, to the nucleotide sequence of GAM189 RNA, herein designated GAM RNA, also designated SEQ ID:246.

Another function of GAM189 is therefore inhibition of MGC3329 (Accession NP_076991.2). Accordingly, utilities of GAM189 include diagnosis, prevention and treatment of diseases and clinical conditions associated with MGC3329.

MGC33637 (Accession NP_689809.1) is another GAM189 target gene, herein designated TARGET GENE. MGC33637 BINDING SITE is a target binding site found in the 3' untranslated region of mRNA encoded by MGC33637, corresponding to a target binding site such as BINDING SITE I, BINDING SITE II or BINDING SITE III of FIG. 8. Table 4 illustrates the complementarity of the nucleotide sequences of MGC33637 BINDING SITE, designated SEQ ID:12069, to the nucleotide sequence of GAM189 RNA, herein designated GAM RNA, also designated SEQ ID:246.

Another function of GAM189 is therefore inhibition of MGC33637 (Accession NP_689809.1). Accordingly, utilities of GAM189 include diagnosis, prevention and treatment of diseases and clinical conditions associated with MGC33637.

MGC33887 (Accession NP_659473.1) is another GAM189 target gene, herein designated TARGET GENE. MGC33887 BINDING SITE is a target binding site found in the 3' untranslated region of mRNA encoded by MGC33887, corresponding to a target binding site such as BINDING SITE I, BINDING SITE II or BINDING SITE III of FIG. 8. Table 4 illustrates the complementarity of the nucleotide sequences of MGC33887 BINDING SITE, designated SEQ ID:8724, to the nucleotide sequence of GAM189 RNA, herein designated GAM RNA, also designated SEQ ID:246.

Another function of GAM189 is therefore inhibition of MGC33887 (Accession NP_659473.1). Accordingly, utilities of GAM189 include diagnosis, prevention and treatment of diseases and clinical conditions associated with MGC33887.

MGC34034 (Accession NP_694956.1) is another GAM189 target gene, herein designated TARGET GENE. MGC34034 BINDING SITE is a target binding site found in the 5' untranslated region of mRNA encoded by MGC34034, corresponding to a target binding site such as BINDING SITE I, BINDING SITE II or BINDING SITE III of FIG. 8. Table 4 illustrates the complementarity of the nucleotide sequences of MGC34034 BINDING SITE, designated SEQ ID:9529, to the nucleotide sequence of GAM189 RNA, herein designated GAM RNA, also designated SEQ ID:246.

Another function of GAM189 is therefore inhibition of MGC34034 (Accession NP_694956.1). Accordingly, utilities of GAM189 include diagnosis, prevention and treatment of diseases and clinical conditions associated with MGC34034.

MGC34079 (Accession NP_689688.1) is another GAM189 target gene, herein designated TARGET GENE. MGC34079 BINDING SITE is a target binding site found in the 3' untranslated region of mRNA encoded by MGC34079, corresponding to a target binding site such as BINDING SITE I, BINDING SITE II or BINDING SITE III of FIG. 8. Table 4 illustrates the complementarity of the nucleotide sequences of MGC34079 BINDING SITE, designated SEQ ID:19817, to the nucleotide sequence of GAM189 RNA, herein designated GAM RNA, also designated SEQ ID:246.

Another function of GAM189 is therefore inhibition of MGC34079 (Accession NP_689688.1). Accordingly, utilities of GAM189 include diagnosis, prevention and treatment of diseases and clinical conditions associated with MGC34079.

MGC34132 (Accession XP_291029.1) is another GAM189 target gene, herein designated TARGET GENE. MGC34132 BINDING SITE1 and MGC34132 BINDING SITE2 are target binding sites found in untranslated regions of mRNA encoded by MGC34132, corresponding to target binding sites such as BINDING SITE I, BINDING SITE II or BINDING SITE III of FIG. 8. Table 4 illustrates the complementarity of the nucleotide sequences of MGC34132 BINDING SITE1 and MGC34132 BINDING SITE2, designated SEQ ID:9087 and SEQ ID:8232 respectively, to the nucleotide sequence of GAM189 RNA, herein designated GAM RNA, also designated SEQ ID:246.

Another function of GAM189 is therefore inhibition of MGC34132 (Accession XP_291029.1). Accordingly, utilities of GAM189 include diagnosis, prevention and treatment of diseases and clinical conditions associated with MGC34132.

MGC35136 (Accession NP_689640.1) is another GAM189 target gene, herein designated TARGET GENE. MGC35136 BINDING SITE is a target binding site found in the 5' untranslated region of mRNA encoded by MGC35136, corresponding to a target binding site such as BINDING SITE I, BINDING SITE II or BINDING SITE III of FIG. 8. Table 4 illustrates the complementarity of the nucleotide sequences of MGC35136 BINDING SITE, designated SEQ ID:8535, to the nucleotide sequence of GAM189 RNA, herein designated GAM RNA, also designated SEQ ID:246.

Another function of GAM189 is therefore inhibition of MGC35136 (Accession NP_689640.1). Accordingly, utilities of GAM189 include diagnosis, prevention and treatment of diseases and clinical conditions associated with MGC35136.

MGC35440 (Accession NP_694952.1) is another GAM189 target gene, herein designated TARGET GENE. MGC35440 BINDING SITE1 and MGC35440 BINDING SITE2 are target binding sites found in untranslated regions of mRNA encoded by MGC35440, corresponding to target binding sites such as BINDING SITE I, BINDING SITE II or BINDING SITE III of FIG. 8. Table 4 illustrates the complementarity of the nucleotide sequences of MGC35440 BINDING SITE1 and MGC35440 BINDING SITE2, designated SEQ ID:7378 and SEQ ID:6886 respectively, to the nucleotide sequence of GAM189 RNA, herein designated GAM RNA, also designated SEQ ID:246.

Another function of GAM189 is therefore inhibition of MGC35440 (Accession NP_694952.1). Accordingly, utilities of GAM189 include diagnosis, prevention and treatment of diseases and clinical conditions associated with MGC35440.

MGC35468 (Accession NP_694976.1) is another GAM189 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:7484, to the nucleotide sequence of GAM189 RNA, herein designated GAM RNA, also designated SEQ ID:246.

Another function of GAM189 is therefore inhibition of MGC35468 (Accession NP_694976.1). Accordingly, utilities of GAM189 include diagnosis, prevention and treatment of diseases and clinical conditions associated with MGC35468.

MGC35521 (Accession NP_659502.1) is another GAM189 target gene, herein designated TARGET GENE. MGC35521 BINDING SITE is a target binding site found in the 3' untranslated region of mRNA encoded by MGC35521, corresponding to a target binding site such as BINDING SITE I, BINDING SITE II or BINDING SITE III of FIG. 8. Table 4 illustrates the complementarity of the nucleotide sequences of MGC35521 BINDING SITE, designated SEQ ID:18741, to the nucleotide sequence of GAM189 RNA, herein designated GAM RNA, also designated SEQ ID:246.

Another function of GAM189 is therefore inhibition of MGC35521 (Accession NP_659502.1). Accordingly, utilities of GAM189 include diagnosis, prevention and treatment of diseases and clinical conditions associated with MGC35521.

MGC3771 (Accession NP_112232.1) is another GAM189 target gene, herein designated TARGET GENE. MGC3771 BINDING SITE is a target binding site found in the 5' untranslated region of mRNA encoded by MGC3771, corresponding to a target binding site such as BINDING SITE I, BINDING SITE II or BINDING SITE III of FIG. 8. Table 4 illustrates the complementarity of the nucleotide sequences of MGC3771 BINDING SITE, designated SEQ ID:3231, to the nucleotide sequence of GAM189 RNA, herein designated GAM RNA, also designated SEQ ID:246.

Another function of GAM189 is therefore inhibition of MGC3771 (Accession NP_112232.1). Accordingly, utilities of GAM189 include diagnosis, prevention and treatment of diseases and clinical conditions associated with MGC3771.

MGC39320 (Accession NP_689642.2) is another GAM189 target gene, herein designated TARGET GENE. MGC39320 BINDING SITE is a target binding site found in the 3' untranslated region of mRNA encoded by MGC39320, corresponding to a target binding site such as BINDING SITE I, BINDING SITE II or BINDING SITE III of FIG. 8. Table 4 illustrates the complementarity of the nucleotide sequences of MGC39320 BINDING SITE, designated SEQ ID:13428, to the nucleotide sequence of GAM189 RNA, herein designated GAM RNA, also designated SEQ ID:246.

Another function of GAM189 is therefore inhibition of MGC39320 (Accession NP_689642.2). Accordingly, utilities of GAM189 include diagnosis, prevention and treatment of diseases and clinical conditions associated with MGC39320.

MGC40157 (Accession NP_689563.1) is another GAM189 target gene, herein designated TARGET GENE. MGC40157 BINDING SITE is a target binding site found in the 3' untranslated region of mRNA encoded by MGC40157, corresponding to a target binding site such as BINDING SITE I, BINDING SITE II or BINDING SITE III of FIG. 8. Table 4 illustrates the complementarity of the nucleotide sequences of MGC40157 BINDING SITE, designated SEQ ID:10743, to the nucleotide sequence of GAM189 RNA, herein designated GAM RNA, also designated SEQ ID:246.

Another function of GAM189 is therefore inhibition of MGC40157 (Accession NP_689563.1). Accordingly, utilities of GAM189 include diagnosis, prevention and treatment of diseases and clinical conditions associated with MGC40157.

MGC40168 (Accession NP_714920.1) is another GAM189 target gene, herein designated TARGET GENE. MGC40168 BINDING SITE is a target binding site found in the 5' untranslated region of mRNA encoded by MGC40168, corresponding to a target binding site such as BINDING SITE I, BINDING SITE II or BINDING SITE III of FIG. 8. Table 4 illustrates the complementarity of the nucleotide sequences of MGC40168 BINDING SITE, designated SEQ ID:7220, to the nucleotide sequence of GAM189 RNA, herein designated GAM RNA, also designated SEQ ID:246.

Another function of GAM189 is therefore inhibition of MGC40168 (Accession NP_714920.1). Accordingly, utilities of GAM189 include diagnosis, prevention and treatment of diseases and clinical conditions associated with MGC40168.

MGC40579 (Accession NP_689989.1) is another GAM189 target gene, herein designated TARGET GENE. MGC40579 BINDING SITE1 and MGC40579 BINDING SITE2 are target binding sites found in untranslated regions of mRNA encoded by MGC40579, corresponding to target binding sites such as BINDING SITE I, BINDING SITE II or BINDING SITE III of FIG. 8. Table 4 illustrates the complementarity of the nucleotide sequences of MGC40579 BIND- ING SITE1 and MGC40579 BINDING SITE2, designated SEQ ID:19220 and SEQ ID:16218 respectively, to the nucleotide sequence of GAM189 RNA, herein designated GAM RNA, also designated SEQ ID:246.

Another function of GAM189 is therefore inhibition of MGC40579 (Accession NP_689989.1). Accordingly, utilities of GAM189 include diagnosis, prevention and treatment of diseases and clinical conditions associated with MGC40579.

MGC4248 (Accession NP_115709.2) is another GAM189 target gene, herein designated TARGET GENE. MGC4248 BINDING SITE is a target binding site found in the 3' untranslated region of mRNA encoded by MGC4248, corresponding to a target binding site such as BINDING SITE I, BINDING SITE II or BINDING SITE III of FIG. 8. Table 4 illustrates the complementarity of the nucleotide sequences of MGC4248 BINDING SITE, designated SEQ ID:3338, to the nucleotide sequence of GAM189 RNA, herein designated GAM RNA, also designated SEQ ID:246.

Another function of GAM189 is therefore inhibition of MGC4248 (Accession NP_115709.2). Accordingly, utilities of GAM189 include diagnosis, prevention and treatment of diseases and clinical conditions associated with MGC4248.

MGC43122 (Accession NP_775784.1) is another GAM189 target gene, herein designated TARGET GENE. MGC43122 BINDING SITE is a target binding site found in the 3' untranslated region of mRNA encoded by MGC43122, corresponding to a target binding site such as BINDING SITE I, BINDING SITE II or BINDING SITE III of FIG. 8. Table 4 illustrates the complementarity of the nucleotide sequences of MGC43122 BINDING SITE, designated SEQ ID:12783, to the nucleotide sequence of GAM189 RNA, herein designated GAM RNA, also designated SEQ ID:246.

Another function of GAM189 is therefore inhibition of MGC43122 (Accession NP_775784.1). Accordingly, utilities of GAM189 include diagnosis, prevention and treatment of diseases and clinical conditions associated with MGC43122.

MGC50337 (Accession NP_848604.1) is another GAM189 target gene, herein designated TARGET GENE. MGC50337 BINDING SITE is a target binding site found in the 3' untranslated region of mRNA encoded by MGC50337, corresponding to a target binding site such as BINDING SITE I, BINDING SITE II or BINDING SITE III of FIG. 8. Table 4 illustrates the complementarity of the nucleotide sequences of MGC50337 BINDING SITE, designated SEQ ID:2959, to the nucleotide sequence of GAM189 RNA, herein designated GAM RNA, also designated SEQ ID:246.

Another function of GAM189 is therefore inhibition of MGC50337 (Accession NP_848604.1). Accordingly, utilities of GAM189 include diagnosis, prevention and treatment of diseases and clinical conditions associated with MGC50337.

MGC50452 (Accession NP_775733.1) is another GAM189 target gene, herein designated TARGET GENE. MGC50452 BINDING SITE is a target binding site found in the 3' untranslated region of mRNA encoded by MGC50452, corresponding to a target binding site such as BINDING SITE I, BINDING SITE II or BINDING SITE III of FIG. 8. Table 4 illustrates the complementarity of the nucleotide sequences of MGC50452 BINDING SITE, designated SEQ ID:16867, to the nucleotide sequence of GAM189 RNA, herein designated GAM RNA, also designated SEQ ID:246.

Another function of GAM189 is therefore inhibition of MGC50452 (Accession NP_775733.1). Accordingly, utilities of GAM189 include diagnosis, prevention and treatment of diseases and clinical conditions associated with MGC50452.

MGC50559 (Accession NP_776163.1) is another GAM189 target gene, herein designated TARGET GENE. MGC50559 BINDING SITE1 and MGC50559 BINDING SITE2 are target binding sites found in untranslated regions of mRNA encoded by MGC50559, corresponding to target binding sites such as BINDING SITE I, BINDING SITE II or BINDING SITE III of FIG. 8. Table 4 illustrates the complementarity of the nucleotide sequences of MGC50559 BINDING SITE1 and MGC50559 BINDING SITE2, designated SEQ ID:11296 and SEQ ID:15151 respectively, to the nucleotide sequence of GAM189 RNA, herein designated GAM RNA, also designated SEQ ID:246.

Another function of GAM189 is therefore inhibition of MGC50559 (Accession NP_776163.1). Accordingly, utilities of GAM189 include diagnosis, prevention and treatment of diseases and clinical conditions associated with MGC50559.

MGC9912 (Accession NP_542395.1) is another GAM189 target gene, herein designated TARGET GENE. MGC9912 BINDING SITE is a target binding site found in the 3' untranslated region of mRNA encoded by MGC9912, corresponding to a target binding site such as BINDING SITE I, BINDING SITE II or BINDING SITE III of FIG. 8. Table 4 illustrates the complementarity of the nucleotide sequences of MGC9912 BINDING SITE, designated SEQ ID:12221, to the nucleotide sequence of GAM189 RNA, herein designated GAM RNA, also designated SEQ ID:246.

Another function of GAM189 is therefore inhibition of MGC9912 (Accession NP_542395.1). Accordingly, utilities of GAM189 include diagnosis, prevention and treatment of diseases and clinical conditions associated with MGC9912.

MGRN1 (Accession XP_048119.4) is another GAM189 target gene, herein designated TARGET GENE. MGRN1 BINDING SITE is a target binding site found in the 3' untranslated region of mRNA encoded by MGRN1, corresponding to a target binding site such as BINDING SITE I, BINDING SITE II or BINDING SITE III of FIG. 8. Table 4 illustrates the complementarity of the nucleotide sequences of MGRN1 BINDING SITE, designated SEQ ID:16616, to the nucleotide sequence of GAM189 RNA, herein designated GAM RNA, also designated SEQ ID:246.

Another function of GAM189 is therefore inhibition of MGRN1 (Accession XP_048119.4). Accordingly, utilities of GAM189 include diagnosis, prevention and treatment of diseases and clinical conditions associated with MGRN1.

Mhc class ii transactivator (MHC2TA, Accession NP_000237.1) is another GAM189 target gene, herein designated TARGET GENE. MHC2TA BINDING SITE1 through MHC2TA BINDING SITE3 are target binding sites found in untranslated regions of mRNA encoded by MHC2TA, corresponding to target binding sites such as BINDING SITE I, BINDING SITE II or BINDING SITE III of FIG. 8. Table 4 illustrates the complementarity of the nucleotide sequences of MHC2TA BINDING SITE1 through MHC2TA BINDING SITE3, designated SEQ ID:2053, SEQ ID:783 and SEQ ID:922 respectively, to the nucleotide sequence of GAM189 RNA, herein designated GAM RNA, also designated SEQ ID:246.

Another function of GAM189 is therefore inhibition of Mhc class ii transactivator (MHC2TA, Accession NP_000237.1). Accordingly, utilities of GAM189 include diagnosis, prevention and treatment of diseases and clinical conditions associated with MHC2TA.

MIRAB13 (Accession NP_203744.1) is another GAM189 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:11523, to the nucleotide sequence of GAM189 RNA, herein designated GAM RNA, also designated SEQ ID:246.

Another function of GAM189 is therefore inhibition of MIRAB13 (Accession NP_203744.1). Accordingly, utilities of GAM189 include diagnosis, prevention and treatment of diseases and clinical conditions associated with MIRAB13.

MIRAB13 (Accession XP_039236.6) is another GAM189 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:11523, to the nucleotide sequence of GAM189 RNA, herein designated GAM RNA, also designated SEQ ID:246.

Another function of GAM189 is therefore inhibition of MIRAB13 (Accession XP_039236.6). Accordingly, utilities of GAM189 include diagnosis, prevention and treatment of diseases and clinical conditions associated with MIRAB13.

Makorin, ring finger protein, 4 (MKRN4, Accession NP_110384.1) is another GAM189 target gene, herein designated TARGET GENE. MKRN4 BINDING SITE is a target binding site found in the 3' untranslated region of mRNA encoded by MKRN4, corresponding to a target binding site such as BINDING SITE I, BINDING SITE II or BINDING SITE III of FIG. 8. Table 4 illustrates the complementarity of the nucleotide sequences of MKRN4 BINDING SITE, designated SEQ ID:12075, to the nucleotide sequence of GAM189 RNA, herein designated GAM RNA, also designated SEQ ID:246.

Another function of GAM189 is therefore inhibition of Makorin, ring finger protein, 4 (MKRN4, Accession NP_110384.1). Accordingly, utilities of GAM189 include diagnosis, prevention and treatment of diseases and clinical conditions associated with MKRN4.

Melan-a (MLANA, Accession NP_005502.1) is another GAM189 target gene, herein designated TARGET GENE. MLANA BINDING SITE is a target binding site found in the 3' untranslated region of mRNA encoded by MLANA, corresponding to a target binding site such as BINDING SITE I, BINDING SITE II or BINDING SITE III of FIG. 8. Table 4 illustrates the complementarity of the nucleotide sequences of MLANA BINDING SITE, designated SEQ ID:13029, to the nucleotide sequence of GAM189 RNA, herein designated GAM RNA, also designated SEQ ID:246.

Another function of GAM189 is therefore inhibition of Melan-a (MLANA, Accession NP_005502.1). Accordingly, utilities of GAM189 include diagnosis, prevention and treatment of diseases and clinical conditions associated with MLANA.

Megalencephalic leukoencephalopathy with subcortical cysts 1 (MLC1, Accession NP_055981.1) is another GAM189 target gene, herein designated TARGET GENE. MLC1 BINDING SITE1 and MLC1 BINDING SITE2 are target binding sites found in untranslated regions of multiple transcripts of mRNA encoded by MLC1, corresponding to target binding sites such as BINDING SITE I, BINDING SITE II or BINDING SITE III of FIG. 8. Table 4 illustrates the complementarity of the nucleotide sequences of MLC1 BINDING SITE1 and MLC1 BINDING SITE2, designated SEQ ID:14833 and SEQ ID:19859 respectively, to the nucleotide sequence of GAM189 RNA, herein designated GAM RNA, also designated SEQ ID:246.

Another function of GAM189 is therefore inhibition of Megalencephalic leukoencephalopathy with subcortical cysts 1 (MLC1, Accession NP_055981.1). Accordingly, utilities of GAM189 include diagnosis, prevention and treatment of diseases and clinical conditions associated with MLC1.

Megalencephalic leukoencephalopathy with subcortical cysts 1 (MLC1, Accession NP_055981.1) is another GAM189 target gene, herein designated TARGET GENE. MLC1 BINDING SITE1 and MLC1 BINDING SITE2 are target binding sites found in untranslated regions of multiple transcripts of mRNA encoded by MLC1, corresponding to target binding sites such as BINDING SITE I, BINDING SITE II or BINDING SITE III of FIG. 8. Table 4 illustrates the complementarity of the nucleotide sequences of MLC1 BINDING SITE1 and MLC1 BINDING SITE2, designated SEQ ID:19859 and SEQ ID:19859 respectively, to the nucleotide sequence of GAM189 RNA, herein designated GAM RNA, also designated SEQ ID:246.

Another function of GAM189 is therefore inhibition of Megalencephalic leukoencephalopathy with subcortical cysts 1 (MLC1, Accession NP_055981.1). Accordingly, utilities of GAM189 include diagnosis, prevention and treatment of diseases and clinical conditions associated with MLC1.

Megalencephalic leukoencephalopathy with subcortical cysts 1 (MLC1, Accession NP_055981.1) is another GAM189 target gene, herein designated TARGET GENE. MLC1 BINDING SITE1 and MLC1 BINDING SITE2 are target binding sites found in untranslated regions of multiple transcripts of mRNA encoded by MLC1, corresponding to target binding sites such as BINDING SITE I, BINDING SITE II or BINDING SITE III of FIG. 8. Table 4 illustrates the complementarity of the nucleotide sequences of MLC1 BINDING SITE1 and MLC1 BINDING SITE2, designated SEQ ID:19859 and SEQ ID:14833 respectively, to the nucleotide sequence of GAM189 RNA, herein designated GAM RNA, also designated SEQ ID:246.

Another function of GAM189 is therefore inhibition of Megalencephalic leukoencephalopathy with subcortical cysts 1 (MLC1, Accession NP_055981.1). Accordingly, utilities of GAM189 include diagnosis, prevention and treatment of diseases and clinical conditions associated with MLC1.

Melanoma-derived leucine zipper, extra-nuclear factor (MLZE, Accession NP_113603.1) is another GAM189 target gene, herein designated TARGET GENE. MLZE BINDING SITE is a target binding site found in the 5' untranslated region of mRNA encoded by MLZE, corresponding to a target binding site such as BINDING SITE I, BINDING SITE II or BINDING SITE III of FIG. 8. Table 4 illustrates the complementarity of the nucleotide sequences of MLZE BINDING SITE, designated SEQ ID:9728, to the nucleotide sequence of GAM189 RNA, herein designated GAM RNA, also designated SEQ ID:246.

Another function of GAM189 is therefore inhibition of Melanoma-derived leucine zipper, extra-nuclear factor (MLZE, Accession NP_113603.1). Accordingly, utilities of GAM189 include diagnosis, prevention and treatment of diseases and clinical conditions associated with MLZE.

Matrix metalloproteinase-like 1 (MMPL1, Accession NP_004133.1) is another GAM189 target gene, herein designated TARGET GENE. MMPL1 BINDING SITE is a target binding site found in the 3' untranslated region of mRNA encoded by MMPL1, corresponding to a target binding site such as BINDING SITE I, BINDING SITE II or BINDING SITE III of FIG. 8. Table 4 illustrates the complementarity of the nucleotide sequences of MMPL1 BINDING SITE, designated SEQ ID:4374, to the nucleotide sequence of GAM189 RNA, herein designated GAM RNA, also designated SEQ ID:246.

Another function of GAM189 is therefore inhibition of Matrix metalloproteinase-like 1 (MMPL1, Accession NP_004133.1). Accordingly, utilities of GAM189 include diagnosis, prevention and treatment of diseases and clinical conditions associated with MMPL1.

Modulator of apoptosis 1 (MOAP1, Accession NP_071434.2) is another GAM189 target gene, herein designated TARGET GENE. MOAP1 BINDING SITE is a target binding site found in the 3' untranslated region of mRNA encoded by MOAP1, corresponding to a target binding site such as BINDING SITE I, BINDING SITE II or BINDING SITE III of FIG. 8. Table 4 illustrates the complementarity of the nucleotide sequences of MOAP1 BINDING SITE, designated SEQ ID:1744, to the nucleotide sequence of GAM189 RNA, herein designated GAM RNA, also designated SEQ ID:246.

Another function of GAM189 is therefore inhibition of Modulator of apoptosis 1 (MOAP1, Accession NP_071434.2). Accordingly, utilities of GAM189 include diagnosis, prevention and treatment of diseases and clinical conditions associated with MOAP1.

moblak (Accession NP_570719.1) is another GAM189 target gene, herein designated TARGET GENE. moblak BINDING SITE is a target binding site found in the 3' untranslated region of mRNA encoded by moblak, corresponding to a target binding site such as BINDING SITE I, BINDING SITE II or BINDING SITE III of FIG. 8. Table 4 illustrates the complementarity of the nucleotide sequences of moblak BINDING SITE, designated SEQ ID:19657, to the nucleotide sequence of GAM189 RNA, herein designated GAM RNA, also designated SEQ ID:246.

Another function of GAM189 is therefore inhibition of moblak (Accession NP_570719.1). Accordingly, utilities of GAM189 include diagnosis, prevention and treatment of diseases and clinical conditions associated with moblak.

Molybdenum cofactor synthesis 3 (MOCS3, Accession NP_055299.1) is another GAM189 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:12064, to the nucleotide sequence of GAM189 RNA, herein designated GAM RNA, also designated SEQ ID:246.

Another function of GAM189 is therefore inhibition of Molybdenum cofactor synthesis 3 (MOCS3, Accession NP_055299.1). Accordingly, utilities of GAM189 include diagnosis, prevention and treatment of diseases and clinical conditions associated with MOCS3.

Myeloproliferative leukemia virus oncogene (MPL, Accession NP_005364.1) is another GAM189 target gene, herein designated TARGET GENE. MPL BINDING SITE1 and MPL BINDING SITE2 are target binding sites found in untranslated regions of mRNA encoded by MPL, corresponding to target binding sites such as BINDING SITE I, BINDING SITE II or BINDING SITE III of FIG. 8. Table 4 illustrates the complementarity of the nucleotide sequences of MPL BINDING SITE1 and MPL BINDING SITE2, designated SEQ ID:11185 and SEQ ID:16608 respectively, to the nucleotide sequence of GAM189 RNA, herein designated GAM RNA, also designated SEQ ID:246.

Another function of GAM189 is therefore inhibition of Myeloproliferative leukemia virus oncogene (MPL, Accession NP_005364.1). Accordingly, utilities of GAM189 include diagnosis, prevention and treatment of diseases and clinical conditions associated with MPL.

Mitochondrial ribosomal protein l35 (MRPL35, Accession NP_057706.2) is another GAM189 target gene, herein designated TARGET GENE. MRPL35 BINDING SITE is a target binding site found in the 3' untranslated region of multiple transcripts of mRNA encoded by MRPL35, corresponding to a target binding site such as BINDING SITE I, BINDING SITE II or BINDING SITE III of FIG. 8. Table 4 illustrates the complementarity of the nucleotide sequences of MRPL35 BINDING SITE, designated SEQ ID:9545, to the nucleotide sequence of GAM189 RNA, herein designated GAM RNA, also designated SEQ ID:246.

Another function of GAM189 is therefore inhibition of Mitochondrial ribosomal protein l35 (MRPL35, Accession NP_057706.2). Accordingly, utilities of GAM189 include diagnosis, prevention and treatment of diseases and clinical conditions associated with MRPL35.

Mitochondrial ribosomal protein l44 (MRPL44, Accession NP_075066.1) is another GAM189 target gene, herein designated TARGET GENE. MRPL44 BINDING SITE is a target binding site found in the 3' untranslated region of mRNA encoded by MRPL44, corresponding to a target binding site such as BINDING SITE I, BINDING SITE II or BINDING SITE III of FIG. 8. Table 4 illustrates the complementarity of the nucleotide sequences of MRPL44 BINDING SITE, designated SEQ ID:14596, to the nucleotide sequence of GAM189 RNA, herein designated GAM RNA, also designated SEQ ID:246.

Another function of GAM189 is therefore inhibition of Mitochondrial ribosomal protein l44 (MRPL44, Accession NP_075066.1). Accordingly, utilities of GAM189 include diagnosis, prevention and treatment of diseases and clinical conditions associated with MRPL44.

Mitochondrial ribosomal protein l49 (MRPL49, Accession NP_004918.1) is another GAM189 target gene, herein designated TARGET GENE. MRPL49 BINDING SITE is a target binding site found in the 3' untranslated region of mRNA encoded by MRPL49, corresponding to a target binding site such as BINDING SITE I, BINDING SITE II or BINDING SITE III of FIG. 8. Table 4 illustrates the complementarity of the nucleotide sequences of MRPL49 BINDING SITE, designated SEQ ID:5438, to the nucleotide sequence of GAM189 RNA, herein designated GAM RNA, also designated SEQ ID:246.

Another function of GAM189 is therefore inhibition of Mitochondrial ribosomal protein l49 (MRPL49, Accession NP_004918.1). Accordingly, utilities of GAM189 include diagnosis, prevention and treatment of diseases and clinical conditions associated with MRPL49.

Mitochondrial ribosomal protein s27 (MRPS27, Accession NP_055899.1) is another GAM189 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:4179, to the nucleotide sequence of GAM189 RNA, herein designated GAM RNA, also designated SEQ ID:246.

Another function of GAM189 is therefore inhibition of Mitochondrial ribosomal protein s27 (MRPS27, Accession NP_055899.1). Accordingly, utilities of GAM189 include diagnosis, prevention and treatment of diseases and clinical conditions associated with MRPS27.

MSTP028 (Accession NP_114160.1) is another GAM189 target gene, herein designated TARGET GENE. MSTP028 BINDING SITE is a target binding site found in the 3' untranslated region of mRNA encoded by MSTP028, corresponding to a target binding site such as BINDING SITE I, BINDING SITE II or BINDING SITE III of FIG. 8. Table 4 illustrates the complementarity of the nucleotide sequences of MSTP028 BINDING SITE, designated SEQ ID:12951, to the nucleotide sequence of GAM189 RNA, herein designated GAM RNA, also designated SEQ ID:246.

Another function of GAM189 is therefore inhibition of MSTP028 (Accession NP_114160.1). Accordingly, utilities of GAM189 include diagnosis, prevention and treatment of diseases and clinical conditions associated with MSTP028.

MTH2 (Accession NP_060753.1) is another GAM189 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:15874, to the nucleotide sequence of GAM189 RNA, herein designated GAM RNA, also designated SEQ ID:246.

Another function of GAM189 is therefore inhibition of MTH2 (Accession NP_060753.1). Accordingly, utilities of GAM189 include diagnosis, prevention and treatment of diseases and clinical conditions associated with MTH2.

V-myc myelocytomatosis viral oncogene homolog 2 (avian) (MYCL2, Accession NP_005368.1) is another GAM189 target gene, herein designated TARGET GENE. MYCL2 BINDING SITE is a target binding site found in the 3' untranslated region of mRNA encoded by MYCL2, corresponding to a target binding site such as BINDING SITE I, BINDING SITE II or BINDING SITE III of FIG. 8. Table 4 illustrates the complementarity of the nucleotide sequences of MYCL2 BINDING SITE, designated SEQ ID:16868, to the nucleotide sequence of GAM189 RNA, herein designated GAM RNA, also designated SEQ ID:246.

Another function of GAM189 is therefore inhibition of V-myc myelocytomatosis viral oncogene homolog 2 (avian) (MYCL2, Accession NP_005368.1). Accordingly, utilities of GAM189 include diagnosis, prevention and treatment of diseases and clinical conditions associated with MYCL2.

MYLC2PL (Accession NP_612412.1) is another GAM189 target gene, herein designated TARGET GENE. MYLC2PL BINDING SITE is a target binding site found in the 5' untranslated region of mRNA encoded by MYLC2PL, corresponding to a target binding site such as BINDING SITE I, BINDING SITE II or BINDING SITE III of FIG. 8. Table 4 illustrates the complementarity of the nucleotide sequences of MYLC2PL BINDING SITE, designated SEQ ID:3580, to the nucleotide sequence of GAM189 RNA, herein designated GAM RNA, also designated SEQ ID:246.

Another function of GAM189 is therefore inhibition of MYLC2PL (Accession NP_612412.1). Accordingly, utilities of GAM189 include diagnosis, prevention and treatment of diseases and clinical conditions associated with MYLC2PL.

Myosin 5c (MYO5C, Accession NP_061198.1) is another GAM189 target gene, herein designated TARGET GENE. MYO5C BINDING SITE is a target binding site found in the 3' untranslated region of mRNA encoded by MYO5C, corresponding to a target binding site such as BINDING SITE I, BINDING SITE II or BINDING SITE III of FIG. 8. Table 4 illustrates the complementarity of the nucleotide sequences of MYO5C BINDING SITE, designated SEQ ID:4306, to the nucleotide sequence of GAM189 RNA, herein designated GAM RNA, also designated SEQ ID:246.

Another function of GAM189 is therefore inhibition of Myosin 5c (MYO5C, Accession NP_061198.1). Accordingly, utilities of GAM189 include diagnosis, prevention and treatment of diseases and clinical conditions associated with MYO5C.

NACT (Accession NP_808218.1) is another GAM189 target gene, herein designated TARGET GENE. NACT BINDING SITE is a target binding site found in the 3' untranslated region of mRNA encoded by NACT, corresponding to a target binding site such as BINDING SITE I, BINDING SITE II or BINDING SITE III of FIG. 8. Table 4 illustrates the complementarity of the nucleotide sequences of NACT BINDING SITE, designated SEQ ID:19968, to the nucleotide sequence of GAM189 RNA, herein designated GAM RNA, also designated SEQ ID:246.

Another function of GAM189 is therefore inhibition of NACT (Accession NP_808218.1). Accordingly, utilities of GAM189 include diagnosis, prevention and treatment of diseases and clinical conditions associated with NACT.

Nanog (Accession NP_079141.1) is another GAM189 target gene, herein designated TARGET GENE. Nanog BINDING SITE is a target binding site found in the 3' untranslated region of mRNA encoded by Nanog, corresponding to a target binding site such as BINDING SITE I, BINDING SITE II or BINDING SITE III of FIG. 8. Table 4 illustrates the complementarity of the nucleotide sequences of Nanog BINDING SITE, designated SEQ ID:11523, to the nucleotide sequence of GAM189 RNA, herein designated GAM RNA, also designated SEQ ID:246.

Another function of GAM189 is therefore inhibition of Nanog (Accession NP_079141.1). Accordingly, utilities of GAM189 include diagnosis, prevention and treatment of diseases and clinical conditions associated with Nanog.

NCAG1 (Accession NP_115536.1) is another GAM189 target gene, herein designated TARGET GENE. NCAG1 BINDING SITE is a target binding site found in the 3' untranslated region of mRNA encoded by NCAG1, corresponding to a target binding site such as BINDING SITE I, BINDING SITE II or BINDING SITE III of FIG. 8. Table 4 illustrates the complementarity of the nucleotide sequences of NCAG1 BINDING SITE, designated SEQ ID:3766, to the nucleotide sequence of GAM189 RNA, herein designated GAM RNA, also designated SEQ ID:246.

Another function of GAM189 is therefore inhibition of NCAG1 (Accession NP_115536.1). Accordingly, utilities of GAM189 include diagnosis, prevention and treatment of diseases and clinical conditions associated with NCAG1.

Nuclear receptor coactivator 6 (NCOA6, Accession NP_054790.1) is another GAM189 target gene, herein designated TARGET GENE. NCOA6 BINDING SITE1 and NCOA6 BINDING SITE2 are target binding sites found in untranslated regions of mRNA encoded by NCOA6, corresponding to target binding sites such as BINDING SITE I, BINDING SITE II or BINDING SITE III of FIG. 8. Table 4 illustrates the complementarity of the nucleotide sequences of NCOA6 BINDING SITE1 and NCOA6 BINDING SITE2, designated SEQ ID:19446 and SEQ ID:12826 respectively, to the nucleotide sequence of GAM189 RNA, herein designated GAM RNA, also designated SEQ ID:246.

Another function of GAM189 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM189 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Nuclear receptor coactivator 6 interacting protein (NCOA6IP, Accession NP_079107.5) is another GAM189 target gene, herein designated TARGET GENE. NCOA6IP BINDING SITE1 and NCOA6IP BINDING SITE2 are target binding sites found in untranslated regions of mRNA encoded by NCOA6IP, corresponding to target binding sites such as BINDING SITE I, BINDING SITE II or BINDING SITE III of FIG. 8. Table 4 illustrates the complementarity of the nucleotide sequences of NCOA6IP BINDING SITE1 and NCOA6IP BINDING SITE2, designated SEQ ID:10534 and SEQ ID:8841 respectively, to the nucleotide sequence of GAM189 RNA, herein designated GAM RNA, also designated SEQ ID:246.

Another function of GAM189 is therefore inhibition of Nuclear receptor coactivator 6 interacting protein (NCOA6IP, Accession NP_079107.5). Accordingly, utilities of GAM189 include diagnosis, prevention and treatment of diseases and clinical conditions associated with NCOA6IP.

NDP52 (Accession NP_005822.1) is another GAM189 target gene, herein designated TARGET GENE. NDP52 BINDING SITE is a target binding site found in the 3' untranslated region of mRNA encoded by NDP52, corresponding to a target binding site such as BINDING SITE I, BINDING SITE II or BINDING SITE III of FIG. 8. Table 4 illustrates the complementarity of the nucleotide sequences of NDP52 BINDING SITE, designated SEQ ID:15337, to the nucleotide sequence of GAM189 RNA, herein designated GAM RNA, also designated SEQ ID:246.

Another function of GAM189 is therefore inhibition of NDP52 (Accession NP_005822.1). Accordingly, utilities of GAM189 include diagnosis, prevention and treatment of diseases and clinical conditions associated with NDP52.

Ndrg family member 3 (NDRG3, Accession NP_114402.1) is another GAM189 target gene, herein designated TARGET GENE. NDRG3 BINDING SITE is a target binding site found in the 3' untranslated region of multiple transcripts of mRNA encoded by NDRG3, corresponding to a target binding site such as BINDING SITE I, BINDING SITE II or BINDING SITE III of FIG. 8. Table 4 illustrates the complementarity of the nucleotide sequences of NDRG3 BINDING SITE, designated SEQ ID:15102, to the nucleotide sequence of GAM189 RNA, herein designated GAM RNA, also designated SEQ ID:246.

Another function of GAM189 is therefore inhibition of Ndrg family member 3 (NDRG3, Accession NP_114402.1). Accordingly, utilities of GAM189 include diagnosis, prevention and treatment of diseases and clinical conditions associated with NDRG3.

Nadh dehydrogenase (ubiquinone) 1, subcomplex unknown, 2, 14.5 kda (NDUFC2, Accession NP_004540.1) is another GAM189 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:10192, to the nucleotide sequence of GAM189 RNA, herein designated GAM RNA, also designated SEQ ID:246.

Another function of GAM189 is therefore inhibition of Nadh dehydrogenase (ubiquinone) 1, subcomplex unknown, 2, 14.5 kda (NDUFC2, Accession NP_004540.1). Accordingly, utilities of GAM189 include diagnosis, prevention and treatment of diseases and clinical conditions associated with NDUFC2.

Sialidase 3 (membrane sialidase) (NEU3, Accession NP_006647.2) is another GAM189 target gene, herein designated TARGET GENE. NEU3 BINDING SITE is a target binding site found in the 5' untranslated region of mRNA encoded by NEU3, corresponding to a target binding site such as BINDING SITE I, BINDING SITE II or BINDING SITE III of FIG. 8. Table 4 illustrates the complementarity of the nucleotide sequences of NEU3 BINDING SITE, designated SEQ ID:12075, to the nucleotide sequence of GAM189 RNA, herein designated GAM RNA, also designated SEQ ID:246.

Another function of GAM189 is therefore inhibition of Sialidase 3 (membrane sialidase) (NEU3, Accession NP_006647.2). Accordingly, utilities of GAM189 include diagnosis, prevention and treatment of diseases and clinical conditions associated with NEU3.

Neurofibromin 2 (bilateral acoustic neuroma) (NF2, Accession NP_057502.1) is another GAM189 target gene, herein designated TARGET GENE. NF2 BINDING SITE is a target binding site found in the 5' untranslated region of multiple transcripts of mRNA encoded by NF2, corresponding to a target binding site such as BINDING SITE I, BINDING SITE II or BINDING SITE III of FIG. 8. Table 4 illustrates the complementarity of the nucleotide sequences of NF2 BINDING SITE, designated SEQ ID:9169, to the nucleotide sequence of GAM189 RNA, herein designated GAM RNA, also designated SEQ ID:246.

Another function of GAM189 is therefore inhibition of Neurofibromin 2 (bilateral acoustic neuroma) (NF2, Accession NP_057502.1). Accordingly, utilities of GAM189 include diagnosis, prevention and treatment of diseases and clinical conditions associated with NF2.

Non-pou domain containing, octamer-binding (NONO, Accession NP_031389.2) is another GAM189 target gene, herein designated TARGET GENE. NONO BINDING SITE is a target binding site found in the 3' untranslated region of mRNA encoded by NONO, corresponding to a target binding site such as BINDING SITE I, BINDING SITE II or BINDING SITE III of FIG. 8. Table 4 illustrates the complementarity of the nucleotide sequences of NONO BINDING SITE, designated SEQ ID:17960, to the nucleotide sequence of GAM189 RNA, herein designated GAM RNA, also designated SEQ ID:246.

Another function of GAM189 is therefore inhibition of Non-pou domain containing, octamer-binding (NONO, Accession NP_031389.2), a gene which is a nuclear protein which contains RNA recognition motifs. Accordingly, utilities of GAM189 include diagnosis, prevention and treatment of diseases and clinical conditions associated with NONO.

The function of NONO has been established by previous studies. Dong et al. (1993) purified and cloned the cDNA of HeLa cell p54nrb, a nuclear protein with 2 RNA recognition motifs and extensive homology to human splicing factor PSF and Drosophila NONA/BJ6. Brown et al. (1997) examined the expression of 33 X-linked genes in 8 mouse/human somatic cell hybrids that contained either the human active (3 hybrids) or inactive (5 hybrids) X chromosome. They found that the p54nrb gene was expressed only in those hybrids with the active human X. Using a megabase scale from pter to qter devised by Nelson et al. (1995), they noted that the approximate physical position of the gene was 70 Mb from pter. Brown et al. (1997) placed it in almost exactly the same position as the CCG1 gene (TAF2A; 313650), which had been mapped to Xq13- q27, and approximately 2 Mb proximal to PHKA1 (OMIM Ref. No. 311870), which had been mapped to Xq13. Thus, Xq13 is the likely location. The AFX1 gene (OMIM Ref. No. 300033) and the NRB54 gene map to a yeast artificial chromosome (YAC) contig of Xq13.1 that harbors the X-linked dystonia-parkinsonism locus DYT3 (OMIM Ref. No. 314250). Peters et al. (1997) found that the AFX1 gene is composed of 3 exons with most of exon 3 being untranslated. The NRB54 gene is made up of 12 exons ranging in size from 40 to 1,227 bp. The start codon is in exon 3 and the stop codon in exon 12. Both genes are expressed in the brain, among other tissues. Peters et al. (1997) excluded both genes as candidates of DYT3 by sequencing of the exons and the flanking intronic sequences in a patient and a control, and by Northern blot analysis.

Full details of the abovementioned studies are described in the following publications, the disclosure of which are hereby incorporated by reference:

Brown, C. J.; Carrel, L.; Willard, H. F.: Expression of genes from the human active and inactive X chromosomes. Am. J. Hum. Genet. 60:1333-1343, 1997; and Peters, U.; Haberhausen, G.; Kostrzewa, M.; Nolte, D.; Muller, U.: AFX1 and p54(nrb): fine mapping, genomic structure, and exclusion as candidate genes of X-linked dystonia parkinsonism.

Further studies establishing the function and utilities of NONO are found in John Hopkins OMIM database record ID 300084, and in cited publications listed in Table 5, which are hereby incorporated by reference. NOSIP (Accession NP_057037.1) is another GAM189 target gene, herein designated TARGET GENE. NOSIP BINDING SITE is a target binding site found in the 5' untranslated region of mRNA encoded by NOSIP, corresponding to a target binding site such as BINDING SITE I, BINDING SITE II or BINDING SITE III of FIG. 8. Table 4 illustrates the complementarity of the nucleotide sequences of NOSIP BINDING SITE, designated SEQ ID:7311, to the nucleotide sequence of GAM189 RNA, herein designated GAM RNA, also designated SEQ ID:246.

Another function of GAM189 is therefore inhibition of NOSIP (Accession NP_057037.1). Accordingly, utilities of GAM189 include diagnosis, prevention and treatment of diseases and clinical conditions associated with NOSIP.

Neuronal pentraxin receptor (NPTXR, Accession NP_055108.2) is another GAM189 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:5189, to the nucleotide sequence of GAM189 RNA, herein designated GAM RNA, also designated SEQ ID:246.

Another function of GAM189 is therefore inhibition of Neuronal pentraxin receptor (NPTXR, Accession NP_055108.2). Accordingly, utilities of GAM189 include diagnosis, prevention and treatment of diseases and clinical conditions associated with NPTXR.

Neuronal pentraxin receptor (NPTXR, Accession NP_478058.1) is another GAM189 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:5189, to the nucleotide sequence of GAM189 RNA, herein designated GAM RNA, also designated SEQ ID:246.

Another function of GAM189 is therefore inhibition of Neuronal pentraxin receptor (NPTXR, Accession NP_478058.1). Accordingly, utilities of GAM189 include diagnosis, prevention and treatment of diseases and clinical conditions associated with NPTXR.

Nad(p)h dehydrogenase, quinone 1 (NQO1, Accession NP_000894.1) is another GAM189 target gene, herein designated TARGET GENE. NQO1 BINDING SITE is a target binding site found in the 3' untranslated region of mRNA encoded by NQO1, corresponding to a target binding site such as BINDING SITE I, BINDING SITE II or BINDING SITE III of FIG. 8. Table 4 illustrates the complementarity of the nucleotide sequences of NQO1 BINDING SITE, designated SEQ ID:14855, to the nucleotide sequence of GAM189 RNA, herein designated GAM RNA, also designated SEQ ID:246.

Another function of GAM189 is therefore inhibition of Nad(p)h dehydrogenase, quinone 1 (NQO1, Accession NP_000894.1), a gene which is cytochrome b5 reductase which reduces redox dyes and quinones. Accordingly, utilities of GAM189 include diagnosis, prevention and treatment of diseases and clinical conditions associated with NQO1.

The function of NQO1 has been established by previous studies. By study of man-mouse somatic cell hybrids, Grzeschik (1980) and Povey et al. (1980) identified a fourth diaphorase locus (DIA4) which segregates with chromosome 16. The regional assignment was 16q12-q22 (smallest region of overlap, SRO). Edwards et al. (1983) showed that the quantitative polymorphism of DIA4 can be attributed to the segregation of a 'low activity' allele. In 4 to 6% of persons there is a DIA4-absent phenotype. In a series of human/hamster hybrids, made using a human parental cell heterozygous for both phosphoglycolate phosphatase (PGP; 172280) and DIA4, the low activity allele and the PGP(2) allele cosegregated except in 2 of 16 discordant hybrids. DIA4 is presumably the same as NAD(P)H:menadione oxidoreductase (NMOR1). Jaiswal et al. (1988) showed that tetrachlorodibenzo-p-dioxin (TCDD) treatment of a human hepatoblastoma cell produced a 5-fold induction of NMOR1 activity. They isolated several overlapping human NMOR1 cDNAs. Southern blot analysis of human genomic DNA suggested the presence of a single NMOR1 gene approximately 10 kb long. They identified 4 potential polyadenylation sites and found 3 mRNAs in human cells. The 3 mRNA species appeared to be differentially regulated following TCDD treatment. By means of Southern blot analysis of genomic DNA from human/rodent somatic cell hybrids, Jaiswal et al. (1988) demonstrated that the gene is located on chromosome 16, consistent with the assignment of DIA4 to that chromosome. By means of mouse/human somatic cell hybrids containing rearranged chromosome 16 together with multiple probes, Chen et al. (1991) assigned the NMOR1 locus to 16q22.1.

Animal model experiments lend further support to the function of NQO1. Radjendirane et al. (1998) generated Nqo1-null mice by targeted disruption. Mice lacking NQO1 gene expression were indistinguishable from wildtype mice. However, Nqo1-null mice exhibited increased toxicity when administered menadione compared with wildtype mice. These results established a role for NQO1 in protection against quinone toxicity.

It is appreciated that the abovementioned animal model for NQO1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jaiswal, A. K.; McBride, O. W.; Adesnik, M.; Nebert, D. W.: Human dioxin-inducible cytosolic NAD(P)H:menadione oxidoreductase: cDNA sequence and localization of gene to chromosome 16. J. Biol. Chem. 263:13572-13578, 1988. ; and Radjendirane, V.; Joseph, P.; Lee, Y.-H.; Kimura, S.; Klein-Szanto, A. J. P.; Gonzalez, F. J.; Jaiswal, A. K.: Disruption of the DT diaphorase (NQO1) gene in mice leads to increased me.

Further studies establishing the function and utilities of NQO1 are found in John Hopkins OMIM database record ID 125860, and in cited publications listed in Table 5, which are hereby incorporated by reference. Nuclear receptor subfamily 2, group e, member 1 (NR2E1, Accession NP_003260.1) is another GAM189 target gene, herein designated TARGET GENE. NR2E1 BINDING SITE is a target binding site found in the 5' untranslated region of mRNA encoded by NR2E1, corresponding to a target binding site such as BINDING SITE I, BINDING SITE II or BINDING SITE III of FIG. 8. Table 4 illustrates the complementarity of the nucleotide sequences of NR2E1 BINDING SITE, designated SEQ ID:13178, to the nucleotide sequence of GAM189 RNA, herein designated GAM RNA, also designated SEQ ID:246.

Another function of GAM189 is therefore inhibition of Nuclear receptor subfamily 2, group e, member 1 (NR2E1, Accession NP_003260.1), a gene which may be required for brain development and be involved in the regulation of retinal development . Accordingly, utilities of GAM189 include diagnosis, prevention and treatment of diseases and clinical conditions associated with NR2E1.

The function of NR2E1 has been established by previous studies. The product of the Drosophila terminal/gap gene 'tailless' (tll) is expressed in the embryonic brain and is required for brain development in flies. The tll protein is a ligand-activated nuclear receptor-type transcription factor. In 2 discrete subregions of the DNA-binding domain (DBD) that modulate the mode of DNA binding, the tll protein contains changes that distinguish it from all other nuclear receptors. Yu et al. (1994) identified the chick and mouse Tlx genes, encoding the vertebrate tll homolog. The vertebrate Tlx proteins are highly conserved, and both avian and mammalian Tlx contain the distinct tll DBD sequences. In vitro DNA-binding assays demonstrated that Tlx and tll share a target gene specificity that is unique among the nuclear receptor superfamily. Ectopic expression of chick Tlx in fly embryos caused a repression of segmentation comparable to that elicited by tll. In situ hybridization to chick and mouse embryos revealed that Tlx is expressed in the head ectoderm in early embryos. At later stages, cells expressing Tlx are localized in the ventricular zone of the neuroepithelial layer, suggesting that Tlx is involved in transcriptional control in undifferentiated neuroepithelial cells in the anterior regions of the developing vertebrate brain. By searching for genes located within the 6q21-q23 region of minimal deletion (RMD) associated with hematologic malignancies, Jackson et al. (1998) identified the human TLX homolog, also called NR2E1. The TLX gene contains 9 exons and spans 24 kb. By a combination of direct sequencing, exon trapping, and library screening, they isolated human TLX cDNAs. The predicted 386-amino acid human protein shares 97% and 99% identity with chick and mouse TLX, respectively. The highest degree of similarity between TLX and Drosophila tll is within the DBDs and the ligand-binding domains (LBDs) of the proteins. Northern blot analysis revealed that the approximately 3.9-kb TLX mRNA is expressed exclusively in brain.

Full details of the abovementioned studies are described in the following publications, the disclosure of which are hereby incorporated by reference:

Jackson, A.; Panayiotidis, P.; Foroni, L.: The human homologue of the Drosophila tailless gene (TLX): characterization and mapping to a region of common deletion in human lymphoid leukemia on chromosome 6q21. Genomics 50:34-43, 1998; and y, R. T.; McKeown, M.; Evans, R. M.; Umesono, K.: Relationship between Drosophila gap gene tailless and a vertebrate nuclear receptor Tlx. Nature 370:375- 379, 1994.

Further studies establishing the function and utilities of NR2E1 are found in John Hopkins OMIM database record ID 603849, and in cited publications listed in Table 5, which are hereby incorporated by reference. NRLN1 (Accession NP_660277.1) is another GAM189 target gene, herein designated TARGET GENE. NRLN1 BINDING SITE is a target binding site found in the 5' untranslated region of mRNA encoded by NRLN1, corresponding to a target binding site such as BINDING SITE I, BINDING SITE II or BINDING SITE III of FIG. 8. Table 4 illustrates the complementarity of the nucleotide sequences of NRLN1 BINDING SITE, designated SEQ ID:15825, to the nucleotide sequence of GAM189 RNA, herein designated GAM RNA, also designated SEQ ID:246.

Another function of GAM189 is therefore inhibition of NRLN1 (Accession NP_660277.1). Accordingly, utilities of GAM189 include diagnosis, prevention and treatment of diseases and clinical conditions associated with NRLN1.

5'-nucleotidase, cytosolic ii (NT5C2, Accession NP_036361.1) is another GAM189 target gene, herein designated TARGET GENE. NT5C2 BINDING SITE is a target binding site found in the 5' untranslated region of mRNA encoded by NT5C2, corresponding to a target binding site such as BINDING SITE I, BINDING SITE II or BINDING SITE III of FIG. 8. Table 4 illustrates the complementarity of the nucleotide sequences of NT5C2 BINDING SITE, designated SEQ ID:4030, to the nucleotide sequence of GAM189 RNA, herein designated GAM RNA, also designated SEQ ID:246.

Another function of GAM189 is therefore inhibition of 5'-nucleotidase, cytosolic ii (NT5C2, Accession NP_036361.1). Accordingly, utilities of GAM189 include diagnosis, prevention and treatment of diseases and clinical conditions associated with NT5C2.

Nudix (nucleoside diphosphate linked moiety x)-type motif 4 (NUDT4, Accession NP_061967.2) is another GAM189 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:18879, to the nucleotide sequence of GAM189 RNA, herein designated GAM RNA, also designated SEQ ID:246.

Another function of GAM189 is therefore inhibition of Nudix (nucleoside diphosphate linked moiety x)-type motif 4 (NUDT4, Accession NP_061967.2). Accordingly, utilities of GAM189 include diagnosis, prevention and treatment of diseases and clinical conditions associated with NUDT4.

Nuclear mitotic apparatus protein 1 (NUMA1, Accession NP_006176.1) is another GAM189 target gene, herein designated TARGET GENE. NUMA1 BINDING SITE is a target binding site found in the 5' untranslated region of mRNA encoded by NUMA1, corresponding to a target binding site such as BINDING SITE I, BINDING SITE II or BINDING SITE III of FIG. 8. Table 4 illustrates the complementarity of the nucleotide sequences of NUMA1 BINDING SITE, designated SEQ ID:14343, to the nucleotide sequence of GAM189 RNA, herein designated GAM RNA, also designated SEQ ID:246.

Another function of GAM189 is therefore inhibition of Nuclear mitotic apparatus protein 1 (NUMA1, Accession NP_006176.1), a gene which is nuclear mitotic apparatus protein. Accordingly, utilities of GAM189 include diagnosis, prevention and treatment of diseases and clinical conditions associated with NUMA1.

The function of NUMA1 and its association with various diseases and clinical conditions, has been established by previous studies, as described hereinabove with reference to GAM133.1. NUP43 (Accession NP_078923.2) is another GAM189 target gene, herein designated TARGET GENE. NUP43 BINDING SITE is a target binding site found in the 3' untranslated region of mRNA encoded by NUP43, corresponding to a target binding site such as BINDING SITE I, BINDING SITE II or BINDING SITE III of FIG. 8. Table 4 illustrates the complementarity of the nucleotide sequences of NUP43 BINDING SITE, designated SEQ ID:1900, to the nucleotide sequence of GAM189 RNA, herein designated GAM RNA, also designated SEQ ID:246.

Another function of GAM189 is therefore inhibition of NUP43 (Accession NP_078923.2). Accordingly, utilities of GAM189 include diagnosis, prevention and treatment of diseases and clinical conditions associated with NUP43.

Nucleoredoxin (NXN, Accession NP_071908.1) is another GAM189 target gene, herein designated TARGET GENE. NXN BINDING SITE is a target binding site found in the 3' untranslated region of mRNA encoded by NXN, corresponding to a target binding site such as BINDING SITE I, BINDING SITE II or BINDING SITE III of FIG. 8. Table 4 illustrates the complementarity of the nucleotide sequences of NXN BINDING SITE, designated SEQ ID:935, to the nucleotide sequence of GAM189 RNA, herein designated GAM RNA, also designated SEQ ID:246.

Another function of GAM189 is therefore inhibition of Nucleoredoxin (NXN, Accession NP_071908.1). Accordingly, utilities of GAM189 include diagnosis, prevention and treatment of diseases and clinical conditions associated with NXN.

Olfactory receptor, family 51, subfamily e, member 2 (OR51E2, Accession NP_110401.1) is another GAM189 target gene, herein designated TARGET GENE. OR51E2 BINDING SITE is a target binding site found in the 3' untranslated region of mRNA encoded by OR51E2, corresponding to a target binding site such as BINDING SITE I, BINDING SITE II or BINDING SITE III of FIG. 8. Table 4 illustrates the complementarity of the nucleotide sequences of OR51E2 BINDING SITE, designated SEQ ID:4096, to the nucleotide sequence of GAM189 RNA, herein designated GAM RNA, also designated SEQ ID:246.

Another function of GAM189 is therefore inhibition of Olfactory receptor, family 51, subfamily e, member 2 (OR51E2, Accession NP_110401.1). Accordingly, utilities of GAM189 include diagnosis, prevention and treatment of diseases and clinical conditions associated with OR51E2.

Origin recognition complex, subunit 1-like (yeast) (ORC1L, Accession NP_004144.1) is another GAM189 target gene, herein designated TARGET GENE. ORC1L BINDING SITE is a target binding site found in the 3' untranslated region of mRNA encoded by ORC1L, corresponding to a target binding site such as BINDING SITE I, BINDING SITE II or BINDING SITE III of FIG. 8. Table 4 illustrates the complementarity of the nucleotide sequences of ORC1L BINDING SITE, designated SEQ ID:17969, to the nucleotide sequence of GAM189 RNA, herein designated GAM RNA, also designated SEQ ID:246.

Another function of GAM189 is therefore inhibition of Origin recognition complex, subunit 1-like (yeast) (ORC1L, Accession NP_004144.1), a gene which may be required for initiation of DNA replication. Accordingly, utilities of GAM189 include diagnosis, prevention and treatment of diseases and clinical conditions associated with ORC1L.

The function of ORC1L and its association with various diseases and clinical conditions, has been established by previous studies, as described hereinabove with reference to GAM136.1. Oxysterol binding protein-like 2 (OSBPL2, Accession NP_055650.1) is another GAM189 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:7553, to the nucleotide sequence of GAM189 RNA, herein designated GAM RNA, also designated SEQ ID:246.

Another function of GAM189 is therefore inhibition of Oxysterol binding protein-like 2 (OSBPL2, Accession NP_055650.1). Accordingly, utilities of GAM189 include diagnosis, prevention and treatment of diseases and clinical conditions associated with OSBPL2.

Oxysterol binding protein-like 2 (OSBPL2, Accession NP_653081.1) is another GAM189 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:7553, to the nucleotide sequence of GAM189 RNA, herein designated GAM RNA, also designated SEQ ID:246.

Another function of GAM189 is therefore inhibition of Oxysterol binding protein-like 2 (OSBPL2, Accession NP_653081.1). Accordingly, utilities of GAM189 include diagnosis, prevention and treatment of diseases and clinical conditions associated with OSBPL2.

Purinergic receptor p2x-like 1, orphan receptor (P2RXL1, Accession NP_005437.1) is another GAM189 target gene, herein designated TARGET GENE. P2RXL1 BINDING SITE is a target binding site found in the 3' untranslated region of mRNA encoded by P2RXL1, corresponding to a target binding site such as BINDING SITE I, BINDING SITE II or BINDING SITE III of FIG. 8. Table 4 illustrates the complementarity of the nucleotide sequences of P2RXL1 BINDING SITE, designated SEQ ID:4425, to the nucleotide sequence of GAM189 RNA, herein designated GAM RNA, also designated SEQ ID:246.

Another function of GAM189 is therefore inhibition of Purinergic receptor p2x-like 1, orphan receptor (P2RXL1, Accession NP_005437.1). Accordingly, utilities of GAM189 include diagnosis, prevention and treatment of diseases and clinical conditions associated with P2RXL1.

Purinergic receptor p2y, g-protein coupled, 1 (P2RY1, Accession NP_002554.1) is another GAM189 target gene, herein designated TARGET GENE. P2RY1 BINDING SITE is a target binding site found in the 3' untranslated region of mRNA encoded by P2RY1, corresponding to a target binding site such as BINDING SITE I, BINDING SITE II or BINDING SITE III of FIG. 8. Table 4 illustrates the complementarity of the nucleotide sequences of P2RY1 BINDING SITE, designated SEQ ID:8453, to the nucleotide sequence of GAM189 RNA, herein designated GAM RNA, also designated SEQ ID:246.

Another function of GAM189 is therefore inhibition of Purinergic receptor p2y, g-protein coupled, 1 (P2RY1, Accession NP_002554.1), a gene which plays an essential role in thrombotic states. Accordingly, utilities of GAM189 include diagnosis, prevention and treatment of diseases and clinical conditions associated with P2RY1.

The function of P2RY1 has been established by previous studies. P2 purinoceptors have been broadly classified as P2X receptors (e.g., 600843), which are ATP-gated channels; P2Z receptors, which mediate nonselective pores in mast cells; and P2Y receptors, a family of G protein-coupled receptors. Based on the recommendation for nomenclature of P2 purinoceptors, the P2Y purinoceptors were numbered in the order of cloning. Ayyanathan et al. (1996) noted that P2Y1, P2Y2 (PR2Y2; 600041), and P2Y3 have been cloned from a variety of species. P2Y1 responds to both ADP and ATP. The P2Y2 receptor cDNA was cloned in the human and this receptor was known as P2U under previous nomenclature. Ayyanathan et al. (1996) cloned the human P2Y1 receptor (P2RY1) and its 2 alternately polyadenylated forms of mRNA. The P2Y1 purinoceptor was also cloned from a human placenta cDNA library by Leon et al. (1996). They found that the gene encodes a 372-amino acid polypeptide. Northern blot analysis revealed 2 transcripts of 4.6 and 7.5 kb which were expressed in many tissues. Using oligonucleotide primers specific for the human P2Y1 purinergic receptor, Ayyanathan et al. (1996) amplified a region from genomic DNA from a panel of mouse/human somatic cell hybrid cell lines and localized the P2Y1 gene to human chromosome 3. By sequence tagged site (STS) mapping utilizing the National Center for Biotechnology Information (NCBI) database, Somers et al. (1997) mapped the P2RY1 gene between flanking markers D3S1279 and D3S1280 at a position 173 to 174 cM from the most telomeric markers on the short arm of chromosome 3.

Animal model experiments lend further support to the function of P2RY1. Leon et al. (1999) generated P2Y1-null mice to define the physiologic role of the P2Y1 receptor. These mice were viable with no apparent abnormalities affecting their development, survival, reproduction, or morphology of platelets, and the platelet count in these animals was identical to that of wildtype mice. However, platelets from P2Y1-deficient mice were unable to aggregate in response to usual concentrations of ADP and displayed impaired aggregation to other agonists, while high concentrations of ADP induced platelet aggregation without shape change. In addition, ADP-induced inhibition of adenylyl cyclase still occurred, demonstrating the existence of an ADP receptor distinct from P2Y1. P2Y1-null mice had no spontaneous bleeding tendency but were resistant to thromboembolism induced by intravenous injection of ADP or collagen and adrenaline. Hence, the P2Y1 receptor plays an essential role in thrombotic states and represents a potential target for antithrombotic drugs.

It is appreciated that the abovementioned animal model for P2RY1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ayyanathan, K.; Webbs, T. E.; Sandhu, A. K.; Athwal, R. S.; Barnard, E. A.; Kunapuli, S. P.: Cloning and chromosomal localization of the human P2Y1 purinoceptor. Biochem. Biophys. Res. Commun. 218:783-788, 1996; and Leon, C.; Hechler, B.; Freund, M.; Eckly, A.; Vial, C.; Ohlmann, P.; Dierich, A.; LeMeur, M.; Cazenave, J.-P.; Gachet, C.: Defective platelet aggregation and increased resistance to thr.

Further studies establishing the function and utilities of P2RY1 are found in John Hopkins OMIM database record ID 601167, and in cited publications listed in Table 5, which are hereby incorporated by reference. P450RAI-2 (Accession NP_063938.1) is another GAM189 target gene, herein designated TARGET GENE. P450RAI-2 BINDING SITE is a target binding site found in the 3' untranslated region of mRNA encoded by P450RAI-2, corresponding to a target binding site such as BINDING SITE I, BINDING SITE II or BINDING SITE III of FIG. 8. Table 4 illustrates the complementarity of the nucleotide sequences of P450RAI-2 BINDING SITE, designated SEQ ID:18160, to the nucleotide sequence of GAM189 RNA, herein designated GAM RNA, also designated SEQ ID:246.

Another function of GAM189 is therefore inhibition of P450RAI-2 (Accession NP_063938.1). Accordingly, utilities of GAM189 include diagnosis, prevention and treatment of diseases and clinical conditions associated with P450RAI-2.

Phosphoribosylaminoimidazole carboxylase, phosphoribosylaminoimidazole succinocarboxamide synthetase (PAICS, Accession NP_006443.1) is another GAM189 target gene, herein designated TARGET GENE. PAICS BINDING SITE is a target binding site found in the 3' untranslated region of mRNA encoded by PAICS, corresponding to a target binding site such as BINDING SITE I, BINDING SITE II or BINDING SITE III of FIG. 8. Table 4 illustrates the complementarity of the nucleotide sequences of PAICS BINDING SITE, designated SEQ ID:16852, to the nucleotide sequence of GAM189 RNA, herein designated GAM RNA, also designated SEQ ID:246.

Another function of GAM189 is therefore inhibition of Phosphoribosylaminoimidazole carboxylase, phosphoribosylaminoimidazole succinocarboxamide synthetase (PAICS, Accession NP_006443.1), a gene which is required for purine biosynthesis. Accordingly, utilities of GAM189 include diagnosis, prevention and treatment of diseases and clinical conditions associated with PAICS.

The function of PAICS and its association with various diseases and clinical conditions, has been established by previous studies, as described hereinabove with reference to GAM96.1. Pas domain containing serine/threonine kinase (PASK, Accession NP_055963.1) is another GAM189 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:2769, to the nucleotide sequence of GAM189 RNA, herein designated GAM RNA, also designated SEQ ID:246.

Another function of GAM189 is therefore inhibition of Pas domain containing serine/threonine kinase (PASK, Accession NP_055963.1). Accordingly, utilities of GAM189 include diagnosis, prevention and treatment of diseases and clinical conditions associated with PASK.

Protocadherin alpha 9 (PCDHA9, Accession NP_054724.1) is another GAM189 target gene, herein designated TARGET GENE. PCDHA9 BINDING SITE1 and PCDHA9 BINDING SITE2 are target binding sites found in untranslated regions of multiple transcripts of mRNA encoded by PCDHA9, corresponding to target binding sites such as BINDING SITE I, BINDING SITE II or BINDING SITE III of FIG. 8. Table 4 illustrates the complementarity of the nucleotide sequences of PCDHA9 BINDING SITE1 and PCDHA9 BINDING SITE2, designated SEQ ID:16048 and SEQ ID:10427 respectively, to the nucleotide sequence of GAM189 RNA, herein designated GAM RNA, also designated SEQ ID:246.

Another function of GAM189 is therefore inhibition of Protocadherin alpha 9 (PCDHA9, Accession NP_054724.1), a gene which is a calcium-dependent cell-adhesion protein. Accordingly, utilities of GAM189 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Protocadherin beta 11 (PCDHB11, Accession NP_061754.1) is another GAM189 target gene, herein designated TARGET GENE. PCDHB11 BINDING SITE is a target binding site found in the 3' untranslated region of mRNA encoded by PCDHB11, corresponding to a target binding site such as BINDING SITE I, BINDING SITE II or BINDING SITE III of FIG. 8. Table 4 illustrates the complementarity of the nucleotide sequences of PCDHB11 BINDING SITE, designated SEQ ID:10723, to the nucleotide sequence of GAM189 RNA, herein designated GAM RNA, also designated SEQ ID:246.

Another function of GAM189 is therefore inhibition of Protocadherin beta 11 (PCDHB11, Accession NP_061754.1). Accordingly, utilities of GAM189 include diagnosis, prevention and treatment of diseases and clinical conditions associated with PCDHB11.

Protocadherin beta 16 (PCDHB16, Accession NP_066008.1) is another GAM189 target gene, herein designated TARGET GENE. PCDHB16 BINDING SITE is a target binding site found in the 3' untranslated region of mRNA encoded by PCDHB16, corresponding to a target binding site such as BINDING SITE I, BINDING SITE II or BINDING SITE III of FIG. 8. Table 4 illustrates the complementarity of the nucleotide sequences of PCDHB16 BINDING SITE, designated SEQ ID:4617, to the nucleotide sequence of GAM189 RNA, herein designated GAM RNA, also designated SEQ ID:246.

Another function of GAM189 is therefore inhibition of Protocadherin beta 16 (PCDHB16, Accession NP_066008.1), a gene which is a potential calcium-dependent cell-adhesion protein. Accordingly, utilities of GAM189 include diagnosis, prevention and treatment of diseases and clinical conditions associated with PCDHB16.

The function of PCDHB16 has been established by previous studies. Cadherins are calcium-dependent cell-cell adhesion molecules that mediate neural cell-cell interactions. Protocadherins constitute a subfamily of nonclassic cadherins. PCDHB16 is a member of the beta cluster of protocadherin genes on 5q31. For specific information on the PCDHB genes, see 604967. Using PCR with degenerate primers to screen melanoma cell lines, Matsuyoshi et al. (1997) obtained a cDNA fragment encoding part of PCDHB16, which they termed ME1. RT-PCR analysis detected expression of ME1 in melanoma cell lines and normal fibroblast cell lines, but not in a squamous carcinoma cell lines or normal melanocytes, suggesting that ME1 may play a role in the strong cell-cell adhesiveness of melanoma cells.

Full details of the abovementioned studies are described in the following publications, the disclosure of which are hereby incorporated by reference:

Matsuyoshi, N.; Tanaka, T.; Toda, K.; Imamura, S.: Identification of novel cadherins expressed in human melanoma cells. J. Invest. Derm. 108:908-913, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse and.

Further studies establishing the function and utilities of PCDHB16 are found in John Hopkins OMIM database record ID 606345, and in cited publications listed in Table 5, which are hereby incorporated by reference. Protocadherin beta 9 (PCDHB9, Accession NP_061992.2) is another GAM189 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:11523, to the nucleotide sequence of GAM189 RNA, herein designated GAM RNA, also designated SEQ ID:246.

Another function of GAM189 is therefore inhibition of Protocadherin beta 9 (PCDHB9, Accession NP_061992.2), a gene which is a potential calcium-dependent cell-adhesion protein. Accordingly, utilities of GAM189 include diagnosis, prevention and treatment of diseases and clinical conditions associated with PCDHB9.

The function of PCDHB9 and its association with various diseases and clinical conditions, has been established by previous studies, as described hereinabove with reference to GAM72.1. Phosphodiesterase 6b, cgmp-specific, rod, beta (congenital stationary night blindness 3, autosomal dominant) (PDE6B, Accession NP_000274.1) is another GAM189 target gene, herein designated TARGET GENE. PDE6B BINDING SITE is a target binding site found in the 3' untranslated region of mRNA encoded by PDE6B, corresponding to a target binding site such as BINDING SITE I, BINDING SITE II or BINDING SITE III of FIG. 8. Table 4 illustrates the complementarity of the nucleotide sequences of PDE6B BINDING SITE, designated SEQ ID:936, to the nucleotide sequence of GAM189 RNA, herein designated GAM RNA, also designated SEQ ID:246.

Another function of GAM189 is therefore inhibition of Phosphodiesterase 6b, cgmp-specific, rod, beta (congenital stationary night blindness 3, autosomal dominant) (PDE6B, Accession NP_000274.1). Accordingly, utilities of GAM189 include diagnosis, prevention and treatment of diseases and clinical conditions associated with PDE6B.

Platelet derived growth factor c (PDGFC, Accession NP_057289.1) is another GAM189 target gene, herein designated TARGET GENE. PDGFC BINDING SITE is a target binding site found in the 3' untranslated region of mRNA encoded by PDGFC, corresponding to a target binding site such as BINDING SITE I, BINDING SITE II or BINDING SITE III of FIG. 8. Table 4 illustrates the complementarity of the nucleotide sequences of PDGFC BINDING SITE, designated SEQ ID:905, to the nucleotide sequence of GAM189 RNA, herein designated GAM RNA, also designated SEQ ID:246.

Another function of GAM189 is therefore inhibition of Platelet derived growth factor c (PDGFC, Accession NP_057289.1). Accordingly, utilities of GAM189 include diagnosis, prevention and treatment of diseases and clinical conditions associated with PDGFC.

Pdz and lim domain 2 (mystique) (PDLIM2, Accession NP_789847.1) is another GAM189 target gene, herein designated TARGET GENE. PDLIM2 BINDING SITE is a target binding site found in the 3' untranslated region of multiple transcripts of mRNA encoded by PDLIM2, corresponding to a target binding site such as BINDING SITE I, BINDING SITE II or BINDING SITE III of FIG. 8. Table 4 illustrates the complementarity of the nucleotide sequences of PDLIM2 BINDING SITE, designated SEQ ID:14973, to the nucleotide sequence of GAM189 RNA, herein designated GAM RNA, also designated SEQ ID:246.

Another function of GAM189 is therefore inhibition of Pdz and lim domain 2 (mystique) (PDLIM2, Accession NP_789847.1). Accordingly, utilities of GAM189 include diagnosis, prevention and treatment of diseases and clinical conditions associated with PDLIM2.

Pdz domain containing 1 (PDZK1, Accession NP_002605.2) is another GAM189 target gene, herein designated TARGET GENE. PDZK1 BINDING SITE is a target binding site found in the 5' untranslated region of mRNA encoded by PDZK1, corresponding to a target binding site such as BINDING SITE I, BINDING SITE II or BINDING SITE III of FIG. 8. Table 4 illustrates the complementarity of the nucleotide sequences of PDZK1 BINDING SITE, designated SEQ ID:4194, to the nucleotide sequence of GAM189 RNA, herein designated GAM RNA, also designated SEQ ID:246.

Another function of GAM189 is therefore inhibition of Pdz domain containing 1 (PDZK1, Accession NP_002605.2), a gene which is a contains PDZ interaction domains, interacts with MAP17, a protein involved in control of cell proliferation. and therefore may be associated with Autosomal dominant hypophosphatemic rickets. Accordingly, utilities of GAM189 include diagnosis, prevention and treatment of Autosomal dominant hypophosphatemic rickets, and of other diseases and clinical conditions associated with PDZK1.

The function of PDZK1 and its association with various diseases and clinical conditions, has been established by previous studies, as described hereinabove with reference to GAM136.1. PDZRN1 (Accession NP_699202.1) is another GAM189 target gene, herein designated TARGET GENE. PDZRN1 BINDING SITE is a target binding site found in the 3' untranslated region of mRNA encoded by PDZRN1, corresponding to a target binding site such as BINDING SITE I, BINDING SITE II or BINDING SITE III of FIG. 8. Table 4 illustrates the complementarity of the nucleotide sequences of PDZRN1 BINDING SITE, designated SEQ ID:5270, to the nucleotide sequence of GAM189 RNA, herein designated GAM RNA, also designated SEQ ID:246.

Another function of GAM189 is therefore inhibition of PDZRN1 (Accession NP_699202.1). Accordingly, utilities of GAM189 include diagnosis, prevention and treatment of diseases and clinical conditions associated with PDZRN1.

Pellino homolog 1 (drosophila) (PELI1, Accession NP_065702.2) is another GAM189 target gene, herein designated TARGET GENE. PELI1 BINDING SITE1 through PELI1 BINDING SITE3 are target binding sites found in untranslated regions of mRNA encoded by PELI1, corresponding to target binding sites such as BINDING SITE I, BINDING SITE II or BINDING SITE III of FIG. 8. Table 4 illustrates the complementarity of the nucleotide sequences of PELI1 BINDING SITE1 through PELI1 BINDING SITE3, designated SEQ ID:7382, SEQ ID:14861 and SEQ ID:5491 respectively, to the nucleotide sequence of GAM189 RNA, herein designated GAM RNA, also designated SEQ ID:246.

Another function of GAM189 is therefore inhibition of Pellino homolog 1 (drosophila) (PELI1, Accession NP_065702.2). Accordingly, utilities of GAM189 include diagnosis, prevention and treatment of diseases and clinical conditions associated with PELI1.

Period homolog 2 (drosophila) (PER2, Accession NP_073728.1) is another GAM189 target gene, herein designated TARGET GENE. PER2 BINDING SITE is a target binding site found in the 3' untranslated region of multiple transcripts of mRNA encoded by PER2, corresponding to a target binding site such as BINDING SITE I, BINDING SITE II or BINDING SITE III of FIG. 8. Table 4 illustrates the complementarity of the nucleotide sequences of PER2 BINDING SITE, designated SEQ ID:19703, to the nucleotide sequence of GAM189 RNA, herein designated GAM RNA, also designated SEQ ID:246.

Another function of GAM189 is therefore inhibition of Period homolog 2 (drosophila) (PER2, Accession NP_073728.1), a gene which Period homolog 2; putative circadian clock protein; has a PAS dimerization domain and therefore may be associated with Familial advanced sleep-phase syndrome. Accordingly, utilities of GAM189 include diagnosis, prevention and treatment of Familial advanced sleep-phase syndrome, and of other diseases and clinical conditions associated with PER2.

The function of PER2 and its association with various diseases and clinical conditions, has been established by previous studies, as described hereinabove with reference to GAM130.1. Phosphoribosylformylglycinamidine synthase (fgar amidotransferase) (PFAS, Accession NP_036525.1) is another GAM189 target gene, herein designated TARGET GENE. PFAS BINDING SITE is a target binding site found in the 3' untranslated region of mRNA encoded by PFAS, corresponding to a target binding site such as BINDING SITE I, BINDING SITE II or BINDING SITE III of FIG. 8. Table 4 illustrates the complementarity of the nucleotide sequences of PFAS BINDING SITE, designated SEQ ID:16261, to the nucleotide sequence of GAM189 RNA, herein designated GAM RNA, also designated SEQ ID:246.

Another function of GAM189 is therefore inhibition of Phosphoribosylformylglycinamidine synthase (fgar amidotransferase) (PFAS, Accession NP_036525.1). Accordingly, utilities of GAM189 include diagnosis, prevention and treatment of diseases and clinical conditions associated with PFAS.

PHAX (Accession NP_115553.1) is another GAM189 target gene, herein designated TARGET GENE. PHAX BINDING SITE is a target binding site found in the 3' untranslated region of mRNA encoded by PHAX, corresponding to a target binding site such as BINDING SITE I, BINDING SITE II or BINDING SITE III of FIG. 8. Table 4 illustrates the complementarity of the nucleotide sequences of PHAX BINDING SITE, designated SEQ ID:12159, to the nucleotide sequence of GAM189 RNA, herein designated GAM RNA, also designated SEQ ID:246.

Another function of GAM189 is therefore inhibition of PHAX (Accession NP_115553.1). Accordingly, utilities of GAM189 include diagnosis, prevention and treatment of diseases and clinical conditions associated with PHAX.

Polymeric immunoglobulin receptor (PIGR, Accession NP_002635.2) is another GAM189 target gene, herein designated TARGET GENE. PIGR BINDING SITE is a target binding site found in the 3' untranslated region of mRNA encoded by PIGR, corresponding to a target binding site such as BINDING SITE I, BINDING SITE II or BINDING SITE III of FIG. 8. Table 4 illustrates the complementarity of the nucleotide sequences of PIGR BINDING SITE, designated SEQ ID:11059, to the nucleotide sequence of GAM189 RNA, herein designated GAM RNA, also designated SEQ ID:246.

Another function of GAM189 is therefore inhibition of Polymeric immunoglobulin receptor (PIGR, Accession NP_002635.2). Accordingly, utilities of GAM189 include diagnosis, prevention and treatment of diseases and clinical conditions associated with PIGR.

Phosphoinositide-3-kinase, class 2, beta polypeptide (PIK3C2B, Accession NP_002637.2) is another GAM189 target gene, herein designated TARGET GENE. PIK3C2B BINDING SITE is a target binding site found in the 3' untranslated region of mRNA encoded by PIK3C2B, corresponding to a target binding site such as BINDING SITE I, BINDING SITE II or BINDING SITE III of FIG. 8. Table 4 illustrates the complementarity of the nucleotide sequences of PIK3C2B BINDING SITE, designated SEQ ID:10488, to the nucleotide sequence of GAM189 RNA, herein designated GAM RNA, also designated SEQ ID:246.

Another function of GAM189 is therefore inhibition of Phosphoinositide-3-kinase, class 2, beta polypeptide (PIK3C2B, Accession NP_002637.2). Accordingly, utilities of GAM189 include diagnosis, prevention and treatment of diseases and clinical conditions associated with PIK3C2B.

Phosphoinositide-3-kinase, class 3 (PIK3C3, Accession NP_002638.1) is another GAM189 target gene, herein designated TARGET GENE. PIK3C3 BINDING SITE is a target binding site found in the 3' untranslated region of mRNA encoded by PIK3C3, corresponding to a target binding site such as BINDING SITE I, BINDING SITE II or BINDING SITE III of FIG. 8. Table 4 illustrates the complementarity of the nucleotide sequences of PIK3C3 BINDING SITE, designated SEQ ID:8874, to the nucleotide sequence of GAM189 RNA, herein designated GAM RNA, also designated SEQ ID:246.

Another function of GAM189 is therefore inhibition of Phosphoinositide-3-kinase, class 3 (PIK3C3, Accession NP_002638.1). Accordingly, utilities of GAM189 include diagnosis, prevention and treatment of diseases and clinical conditions associated with PIK3C3.

Phosphoinositide-3-kinase, catalytic, delta polypeptide (PIK3CD, Accession NP_005017.2) is another GAM189 target gene, herein designated TARGET GENE. PIK3CD BINDING SITE is a target binding site found in the 3' untranslated region of mRNA encoded by PIK3CD, corresponding to a target binding site such as BINDING SITE I, BINDING SITE II or BINDING SITE III of FIG. 8. Table 4 illustrates the complementarity of the nucleotide sequences of PIK3CD BINDING SITE, designated SEQ ID:9545, to the nucleotide sequence of GAM189 RNA, herein designated GAM RNA, also designated SEQ ID:246.

Another function of GAM189 is therefore inhibition of Phosphoinositide-3-kinase, catalytic, delta polypeptide (PIK3CD, Accession NP_005017.2), a gene which regulating cell growth. Accordingly, utilities of GAM189 include diagnosis, prevention and treatment of diseases and clinical conditions associated with PIK3CD.

The function of PIK3CD and its association with various diseases and clinical conditions, has been established by previous studies, as described hereinabove with reference to GAM136.1. Pbx/knotted 1 homeobox 1 (PKNOX1, Accession NP_004562.2) is another GAM189 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:8826, to the nucleotide sequence of GAM189 RNA, herein designated GAM RNA, also designated SEQ ID:246.

Another function of GAM189 is therefore inhibition of Pbx/knotted 1 homeobox 1 (PKNOX1, Accession NP_004562.2), a gene which may regulate gene expression and control cell differentiation. Accordingly, utilities of GAM189 include diagnosis, prevention and treatment of diseases and clinical conditions associated with PKNOX1.

The function of PKNOX1 and its association with various diseases and clinical conditions, has been established by previous studies, as described hereinabove with reference to GAM55.1. Phospholipase a2, group vi (cytosolic, calcium-independent) (PLA2G6, Accession NP_003551.1) is another GAM189 target gene, herein designated TARGET GENE. PLA2G6 BINDING SITE is a target binding site found in the 3' untranslated region of mRNA encoded by PLA2G6, corresponding to a target binding site such as BINDING SITE I, BINDING SITE II or BINDING SITE III of FIG. 8. Table 4 illustrates the complementarity of the nucleotide sequences of PLA2G6 BINDING SITE, designated SEQ ID:16143, to the nucleotide sequence of GAM189 RNA, herein designated GAM RNA, also designated SEQ ID:246.

Another function of GAM189 is therefore inhibition of Phospholipase a2, group vi (cytosolic, calcium-independent) (PLA2G6, Accession NP_003551.1). Accordingly, utilities of GAM189 include diagnosis, prevention and treatment of diseases and clinical conditions associated with PLA2G6.

Pro-melanin-concentrating hormone-like 1 (PMCHL1, Accession NP_114093.1) is another GAM189 target gene, herein designated TARGET GENE. PMCHL1 BINDING SITE is a target binding site found in the 3' untranslated region of mRNA encoded by PMCHL1, corresponding to a target binding site such as BINDING SITE I, BINDING SITE II or BINDING SITE III of FIG. 8. Table 4 illustrates the complementarity of the nucleotide sequences of PMCHL1 BINDING SITE, designated SEQ ID:16917, to the nucleotide sequence of GAM189 RNA, herein designated GAM RNA, also designated SEQ ID:246.

Another function of GAM189 is therefore inhibition of Pro-melanin-concentrating hormone-like 1 (PMCHL1, Accession NP_114093.1). Accordingly, utilities of GAM189 include diagnosis, prevention and treatment of diseases and clinical conditions associated with PMCHL1.

Pro-melanin-concentrating hormone-like 2 (PMCHL2, Accession NP_114094.1) is another GAM189 target gene, herein designated TARGET GENE. PMCHL2 BINDING SITE is a target binding site found in the 3' untranslated region of mRNA encoded by PMCHL2, corresponding to a target binding site such as BINDING SITE I, BINDING SITE II or BINDING SITE III of FIG. 8. Table 4 illustrates the complementarity of the nucleotide sequences of PMCHL2 BINDING SITE, designated SEQ ID:16917, to the nucleotide sequence of GAM189 RNA, herein designated GAM RNA, also designated SEQ ID:246.

Another function of GAM189 is therefore inhibition of Pro-melanin-concentrating hormone-like 2 (PMCHL2, Accession NP_114094.1). Accordingly, utilities of GAM189 include diagnosis, prevention and treatment of diseases and clinical conditions associated with PMCHL2.

PMPCA (Accession NP_055975.1) is another GAM189 target gene, herein designated TARGET GENE. PMPCA BINDING SITE is a target binding site found in the 3' untranslated region of mRNA encoded by PMPCA, corresponding to a target binding site such as BINDING SITE I, BINDING SITE II or BINDING SITE III of FIG. 8. Table 4 illustrates the complementarity of the nucleotide sequences of PMPCA BINDING SITE, designated SEQ ID:7640, to the nucleotide sequence of GAM189 RNA, herein designated GAM RNA, also designated SEQ ID:246.

Another function of GAM189 is therefore inhibition of PMPCA (Accession NP_055975.1). Accordingly, utilities of GAM189 include diagnosis, prevention and treatment of diseases and clinical conditions associated with PMPCA.

Paraneoplastic antigen ma2 (PNMA2, Accession NP_009188.1) is another GAM189 target gene, herein designated TARGET GENE. PNMA2 BINDING SITE1 and PNMA2 BINDING SITE2 are target binding sites found in untranslated regions of mRNA encoded by PNMA2, corresponding to target binding sites such as BINDING SITE I, BINDING SITE II or BINDING SITE III of FIG. 8. Table 4 illustrates the complementarity of the nucleotide sequences of PNMA2 BINDING SITE1 and PNMA2 BINDING SITE2, designated SEQ ID:17067 and SEQ ID:8006 respectively, to the nucleotide sequence of GAM189 RNA, herein designated GAM RNA, also designated SEQ ID:246.

Another function of GAM189 is therefore inhibition of Paraneoplastic antigen ma2 (PNMA2, Accession NP_009188.1). Accordingly, utilities of GAM189 include diagnosis, prevention and treatment of diseases and clinical conditions associated with PNMA2.

Protein o-fucosyltransferase 1 (POFUT1, Accession NP_056167.1) is another GAM189 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:11287, to the nucleotide sequence of GAM189 RNA, herein designated GAM RNA, also designated SEQ ID:246.

Another function of GAM189 is therefore inhibition of Protein o-fucosyltransferase 1 (POFUT1, Accession NP_056167.1) . Accordingly, utilities of GAM189 include diagnosis, prevention and treatment of diseases and clinical conditions associated with POFUT1.

Polymerase (dna directed), epsilon 3 (p17 subunit) (POLE3, Accession NP_059139.2) is another GAM189 target gene, herein designated TARGET GENE. POLE3 BINDING SITE is a target binding site found in the 3' untranslated region of mRNA encoded by POLE3, corresponding to a target binding site such as BINDING SITE I, BINDING SITE II or BINDING SITE III of FIG. 8. Table 4 illustrates the complementarity of the nucleotide sequences of POLE3 BINDING SITE, designated SEQ ID:6151, to the nucleotide sequence of GAM189 RNA, herein designated GAM RNA, also designated SEQ ID:246.

Another function of GAM189 is therefore inhibition of Polymerase (dna directed), epsilon 3 (p17 subunit) (POLE3, Accession NP_059139.2). Accordingly, utilities of GAM189 include diagnosis, prevention and treatment of diseases and clinical conditions associated with POLE3.

Polymerase (rna) ii (dna directed) polypeptide d (POLR2D, Accession NP_004796.1) is another GAM189 target gene, herein designated TARGET GENE. POLR2D BINDING SITE1 and POLR2D BINDING SITE2 are target binding sites found in untranslated regions of mRNA encoded by POLR2D, corresponding to target binding sites such as BINDING SITE I, BINDING SITE II or BINDING SITE III of FIG. 8. Table 4 illustrates the complementarity of the nucleotide sequences of POLR2D BINDING SITE1 and POLR2D BINDING SITE2, designated SEQ ID:5412 and SEQ ID:2798 respectively, to the nucleotide sequence of GAM189 RNA, herein designated GAM RNA, also designated SEQ ID:246.

Another function of GAM189 is therefore inhibition of Polymerase (rna) ii (dna directed) polypeptide d (POLR2D, Accession NP_004796.1). Accordingly, utilities of GAM189 include diagnosis, prevention and treatment of diseases and clinical conditions associated with POLR2D.

Paraoxonase 1 (PON1, Accession NP_000437.3) is another GAM189 target gene, herein designated TARGET GENE. PON1 BINDING SITE is a target binding site found in the 3' untranslated region of mRNA encoded by PON1, corresponding to a target binding site such as BINDING SITE I, BINDING SITE II or BINDING SITE III of FIG. 8. Table 4 illustrates the complementarity of the nucleotide sequences of PON1 BINDING SITE, designated SEQ ID:2152, to the nucleotide sequence of GAM189 RNA, herein designated GAM RNA, also designated SEQ ID:246.

Another function of GAM189 is therefore inhibition of Paraoxonase 1 (PON1, Accession NP_000437.3), a gene which hydrolyzes the toxic metabolites of a variety of organophosphorus insecticides. Accordingly, utilities of GAM189 include diagnosis, prevention and treatment of diseases and clinical conditions associated with PON1.

The function of PON1 has been established by previous studies. Two factors result in large individual variations in PON serum levels: a substrate-dependent activity polymorphism and large individual differences in PON protein levels that are stable over time. Animal model studies indicated that PON activity levels are likely to play a major role in determining sensitivity to several organophosphate insecticides (Clendennin et al., 1996). The arg192 isoform (168820.0001) appears to be a risk factor in coronary artery disease. Serum paraoxonase is an esterase that is associated with high density lipoproteins (HDLs) in the plasma. It is involved in the detoxification of organophosphate insecticides such as parathion and chlorpyrifos. PON1 may also confer protection against coronary artery disease by destroying proinflammatory oxidized lipids present in oxidized low density lipoproteins (LDLs). To study the role of PON1 in vivo, Shih et al. (1998) created PON1-knockout mice by gene targeting. Compared with their wildtype littermates, PON1-deficient mice were extremely sensitive to the toxic effects of chlorpyrifos oxon, the activated form of chlorpyrifos, and were more sensitive to chlorpyrifos itself. HDLs isolated from PON1-deficient mice were unable to prevent LDL oxidation in a cocultured cell model of the artery wall, and both HDLs and LDLs isolated from PON1-knockout mice were more susceptible to oxidation by cocultured cells than were lipoproteins from wildtype littermates. When fed on a high-fat, high-cholesterol diet, PON1-null mice were more susceptible to atherosclerosis than were their wildtype littermates.

Full details of the abovementioned studies are described in the following publications, the disclosure of which are hereby incorporated by reference:

Clendenning, J. B.; Humbert, R.; Green, E. D.; Wood, C.; Traver, D.; Furlong, C. E. : Structural organization of the human PON1 gene. Genomics 35:586-589, 1996; and Shih, D. M.; Gu, L.; Xia, Y.-R.; Navab, M.; Li, W.-F.; Hama, S.; Castellani, L. W.; Furlong, C. E.; Costa, L. G.; Fogelman, A. M.; Lusis, A. J.: Mice lacking serum paraoxonase are suscepti.

Further studies establishing the function and utilities of PON1 are found in John Hopkins OMIM database record ID 168820, and in cited publications listed in Table 5, which are hereby incorporated by reference. Pou domain, class 2, associating factor 1 (POU2AF1, Accession NP_006226.1) is another GAM189 target gene, herein designated TARGET GENE. POU2AF1 BINDING SITE is a target binding site found in the 3' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:20135, to the nucleotide sequence of GAM189 RNA, herein designated GAM RNA, also designated SEQ ID:246.

Another function of GAM189 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM189 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. Pou domain, class 2, transcription factor 3 (POU2F3, Accession NP_055167.1) is another GAM189 target gene, herein designated TARGET GENE. POU2F3 BINDING SITE is a target binding site found in the 3' untranslated region of mRNA encoded by POU2F3, corresponding to a target binding site such as BINDING SITE I, BINDING SITE II or BINDING SITE III of FIG. 8. Table 4 illustrates the complementarity of the nucleotide sequences of POU2F3 BINDING SITE, designated SEQ ID:16114, to the nucleotide sequence of GAM189 RNA, herein designated GAM RNA, also designated SEQ ID:246.

Another function of GAM189 is therefore inhibition of Pou domain, class 2, transcription factor 3 (POU2F3, Accession NP_055167.1). Accordingly, utilities of GAM189 include diagnosis, prevention and treatment of diseases and clinical conditions associated with POU2F3.

PP1628 (Accession NP_079477.1) is another GAM189 target gene, herein designated TARGET GENE. PP1628 BINDING SITE is a target binding site found in the 5' untranslated region of mRNA encoded by PP1628, corresponding to a target binding site such as BINDING SITE I, BINDING SITE II or BINDING SITE III of FIG. 8. Table 4 illustrates the complementarity of the nucleotide sequences of PP1628 BINDING SITE, designated SEQ ID:10180, to the nucleotide sequence of GAM189 RNA, herein designated GAM RNA, also designated SEQ ID:246.

Another function of GAM189 is therefore inhibition of PP1628 (Accession NP_079477.1). Accordingly, utilities of GAM189 include diagnosis, prevention and treatment of diseases and clinical conditions associated with PP1628.

PP3111 (Accession NP_071439.2) is another GAM189 target gene, herein designated TARGET GENE. PP3111 BINDING SITE is a target binding site found in the 3' untranslated region of mRNA encoded by PP3111, corresponding to a target binding site such as BINDING SITE I, BINDING SITE II or BINDING SITE III of FIG. 8. Table 4 illustrates the complementarity of the nucleotide sequences of PP3111 BINDING SITE, designated SEQ ID:10883, to the nucleotide sequence of GAM189 RNA, herein designated GAM RNA, also designated SEQ ID:246.

Another function of GAM189 is therefore inhibition of PP3111 (Accession NP_071439.2). Accordingly, utilities of GAM189 include diagnosis, prevention and treatment of diseases and clinical conditions associated with PP3111.

PP3856 (Accession NP_660202.1) is another GAM189 target gene, herein designated TARGET GENE. PP3856 BINDING SITE is a target binding site found in the 5' untranslated region of mRNA encoded by PP3856, corresponding to a target binding site such as BINDING SITE I, BINDING SITE II or BINDING SITE III of FIG. 8. Table 4 illustrates the complementarity of the nucleotide sequences of PP3856 BINDING SITE, designated SEQ ID:10744, to the nucleotide sequence of GAM189 RNA, herein designated GAM RNA, also designated SEQ ID:246.

Another function of GAM189 is therefore inhibition of PP3856 (Accession NP_660202.1). Accordingly, utilities of GAM189 include diagnosis, prevention and treatment of diseases and clinical conditions associated with PP3856.

Phosphatidic acid phosphatase type 2c (PPAP2C, Accession NP_803545.1) is another GAM189 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM189 RNA, herein designated GAM RNA, also designated SEQ ID:246.

Another function of GAM189 is therefore inhibition of Phosphatidic acid phosphatase type 2c (PPAP2C, Accession NP_803545.1). Accordingly, utilities of GAM189 include diagnosis, prevention and treatment of diseases and clinical conditions associated with PPAP2C.

Phosphatidic acid phosphatase type 2c (PPAP2C, Accession NP_808211.1) is another GAM189 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM189 RNA, herein designated GAM RNA, also designated SEQ ID:246.

Another function of GAM189 is therefore inhibition of Phosphatidic acid phosphatase type 2c (PPAP2C, Accession NP_808211.1). Accordingly, utilities of GAM189 include diagnosis, prevention and treatment of diseases and clinical conditions associated with PPAP2C.

Phosphatidic acid phosphatase type 2c (PPAP2C, Accession NP_003703.1) is another GAM189 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM189 RNA, herein designated GAM RNA, also designated SEQ ID:246.

Another function of GAM189 is therefore inhibition of Phosphatidic acid phosphatase type 2c (PPAP2C, Accession NP_003703.1). Accordingly, utilities of GAM189 include diagnosis, prevention and treatment of diseases and clinical conditions associated with PPAP2C.

Protein phosphatase, ef hand calcium-binding domain 2 (PPEF2, Accession NP_690911.1) is another GAM189 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM189 RNA, herein designated GAM RNA, also designated SEQ ID:246.

Another function of GAM189 is therefore inhibition of Protein phosphatase, ef hand calcium-binding domain 2 (PPEF2, Accession NP_690911.1), a gene which is a homolog of Drosophila rdgC. Accordingly, utilities of GAM189 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_690910.1) is another GAM189 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM189 RNA, herein designated GAM RNA, also designated SEQ ID:246.

Another function of GAM189 is therefore inhibition of Protein phosphatase, ef hand calcium-binding domain 2 (PPEF2, Accession NP_690910.1), a gene which is a homolog of Drosophila rdgC. Accordingly, utilities of GAM189 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_006230.2) is another GAM189 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM189 RNA, herein designated GAM RNA, also designated SEQ ID:246.

Another function of GAM189 is therefore inhibition of Protein phosphatase, ef hand calcium-binding domain 2 (PPEF2, Accession NP_006230.2), a gene which is a homolog of Drosophila rdgC. Accordingly, utilities of GAM189 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein tyrosine phosphatase, receptor type, f polypeptide (ptprf), interacting protein (liprin), alpha 4 (PPFIA4, Accession XP_046751.3) is another GAM189 target gene, herein designated TARGET GENE. PPFIA4 BINDING SITE is a target binding site found in the 5' untranslated region of mRNA encoded by PPFIA4, corresponding to a target binding site such as BINDING SITE I, BINDING SITE II or BINDING SITE III of FIG. 8. Table 4 illustrates the complementarity of the nucleotide sequences of PPFIA4 BINDING SITE, designated SEQ ID:16851, to the nucleotide sequence of GAM189 RNA, herein designated GAM RNA, also designated SEQ ID:246.

Another function of GAM189 is therefore inhibition of Protein tyrosine phosphatase, receptor type, f polypeptide (ptprf), interacting protein (liprin), alpha 4 (PPFIA4, Accession XP_046751.3). Accordingly, utilities of GAM189 include diagnosis, prevention and treatment of diseases and clinical conditions associated with PPFIA4.

Ptprf interacting protein, binding protein 1 (liprin beta 1) (PPFIBP1, Accession NP_003613.2) is another GAM189 target gene, herein designated TARGET GENE. PPFIBP1 BINDING SITE1 through PPFIBP1 BINDING SITE3 are target binding sites found in untranslated regions of multiple transcripts of mRNA encoded by PPFIBP1, corresponding to target binding sites such as BINDING SITE I, BINDING SITE II or BINDING SITE III of FIG. 8. Table 4 illustrates the complementarity of the nucleotide sequences of PPFIBP1 BINDING SITE1 through PPFIBP1 BINDING SITE3, designated SEQ ID:12217, SEQ ID:8231 and SEQ ID:10708 respectively, to the nucleotide sequence of GAM189 RNA, herein designated GAM RNA, also designated SEQ ID:246.

Another function of GAM189 is therefore inhibition of Ptprf interacting protein, binding protein 1 (liprin beta 1) (PPFIBP1, Accession NP_003613.2). Accordingly, utilities of GAM189 include diagnosis, prevention and treatment of diseases and clinical conditions associated with PPFIBP1.

Peptidylprolyl isomerase d (cyclophilin d) (PPID, Accession NP_005029.1) is another GAM189 target gene, herein designated TARGET GENE. PPID BINDING SITE is a target binding site found in the 3' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:7378, to the nucleotide sequence of GAM189 RNA, herein designated GAM RNA, also designated SEQ ID:246.

Another function of GAM189 is therefore inhibition of Peptidylprolyl isomerase d (cyclophilin d) (PPID, Accession NP_005029.1), a gene which catalyzes the cis-trans isomerization of proline imidic peptide bonds in oligopeptides. Accordingly, utilities of GAM189 include diagnosis, prevention and treatment of diseases and clinical conditions associated with PPID.

The function of PPID and its association with various diseases and clinical conditions, has been established by previous studies, as described hereinabove with reference to GAM136.1. Peptidylprolyl isomerase (cyclophilin)-like 2 (PPIL2, Accession NP_055152.1) is another GAM189 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:13122, to the nucleotide sequence of GAM189 RNA, herein designated GAM RNA, also designated SEQ ID:246.

Another function of GAM189 is therefore inhibition of Peptidylprolyl isomerase (cyclophilin)-like 2 (PPIL2, Accession NP_055152.1). Accordingly, utilities of GAM189 include diagnosis, prevention and treatment of diseases and clinical conditions associated with PPIL2.

Protein phosphatase 1, regulatory (inhibitor) subunit 12b (PPP1R12B, Accession NP_115288.1) is another GAM189 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:3861, to the nucleotide sequence of GAM189 RNA, herein designated GAM RNA, also designated SEQ ID:246.

Another function of GAM189 is therefore inhibition of Protein phosphatase 1, regulatory (inhibitor) subunit 12b (PPP1R12B, Accession NP_115288.1). Accordingly, utilities of GAM189 include diagnosis, prevention and treatment of diseases and clinical conditions associated with PPP1R12B.

Protein phosphatase 1, regulatory (inhibitor) subunit 12b (PPP1R12B, Accession NP_002472.1) is another GAM189 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:3861, to the nucleotide sequence of GAM189 RNA, herein designated GAM RNA, also designated SEQ ID:246.

Another function of GAM189 is therefore inhibition of Protein phosphatase 1, regulatory (inhibitor) subunit 12b (PPP1R12B, Accession NP_002472.1). Accordingly, utilities of GAM189 include diagnosis, prevention and treatment of diseases and clinical conditions associated with PPP1R12B.

Protein kinase, interferon-inducible double stranded rna dependent (PRKR, Accession NP_002750.1) is another GAM189 target gene, herein designated TARGET GENE. PRKR BINDING SITE is a target binding site found in the 3' untranslated region of mRNA encoded by PRKR, corresponding to a target binding site such as BINDING SITE I, BINDING SITE II or BINDING SITE III of FIG. 8. Table 4 illustrates the complementarity of the nucleotide sequences of PRKR BINDING SITE, designated SEQ ID:4790, to the nucleotide sequence of GAM189 RNA, herein designated GAM RNA, also designated SEQ ID:246.

Another function of GAM189 is therefore inhibition of Protein kinase, interferon-inducible double stranded rna dependent (PRKR, Accession NP_002750.1), a gene which catalyze the phosphorylation of the alpha subunit of eif2. and therefore may be associated with Huntington's disease. Accordingly, utilities of GAM189 include diagnosis, prevention and treatment of Huntington's disease, and of other diseases and clinical conditions associated with PRKR.

The function of PRKR and its association with various diseases and clinical conditions, has been established by previous studies, as described hereinabove with reference to GAM136.1. Protein kinase, lysine deficient 3 (PRKWNK3, Accession NP_065973.1) is another GAM189 target gene, herein designated TARGET GENE. PRKWNK3 BINDING SITE is a target binding site found in the 3' untranslated region of mRNA encoded by PRKWNK3, corresponding to a target binding site such as BINDING SITE I, BINDING SITE II or BINDING SITE III of FIG. 8. Table 4 illustrates the complementarity of the nucleotide sequences of PRKWNK3 BINDING SITE, designated SEQ ID:14862, to the nucleotide sequence of GAM189 RNA, herein designated GAM RNA, also designated SEQ ID:246.

Another function of GAM189 is therefore inhibition of Protein kinase, lysine deficient 3 (PRKWNK3, Accession NP_065973.1). Accordingly, utilities of GAM189 include diagnosis, prevention and treatment of diseases and clinical conditions associated with PRKWNK3.

Prion protein 2 (dublet) (PRND, Accession NP_036541.1) is another GAM189 target gene, herein designated TARGET GENE. PRND BINDING SITE1 and PRND BINDING SITE2 are target binding sites found in untranslated regions of mRNA encoded by PRND, corresponding to target binding sites such as BINDING SITE I, BINDING SITE II or BINDING SITE III of FIG. 8. Table 4 illustrates the complementarity of the nucleotide sequences of PRND BINDING SITE1 and PRND BINDING SITE2, designated SEQ ID:1539 and SEQ ID:4170 respectively, to the nucleotide sequence of GAM189 RNA, herein designated GAM RNA, also designated SEQ ID:246.

Another function of GAM189 is therefore inhibition of Prion protein 2 (dublet) (PRND, Accession NP_036541.1), a gene which is similar to prion protein PRNP. Accordingly, utilities of GAM189 include diagnosis, prevention and treatment of diseases and clinical conditions associated with PRND.

The function of PRND and its association with various diseases and clinical conditions, has been established by previous studies, as described hereinabove with reference to GAM116.1. PRO0297 (Accession NP_054800.1) is another GAM189 target gene, herein designated TARGET GENE. PRO0297 BINDING SITE is a target binding site found in the 5' untranslated region of mRNA encoded by PRO0297, corresponding to a target binding site such as BINDING SITE I, BINDING SITE II or BINDING SITE III of FIG. 8. Table 4 illustrates the complementarity of the nucleotide sequences of PRO0297 BINDING SITE, designated SEQ ID:10574, to the nucleotide sequence of GAM189 RNA, herein designated GAM RNA, also designated SEQ ID:246.

Another function of GAM189 is therefore inhibition of PRO0297 (Accession NP_054800.1). Accordingly, utilities of GAM189 include diagnosis, prevention and treatment of diseases and clinical conditions associated with PRO0297.

PRO0365 (Accession NP_054845.1) is another GAM189 target gene, herein designated TARGET GENE. PRO0365 BINDING SITE is a target binding site found in the 5' untranslated region of mRNA encoded by PRO0365, corresponding to a target binding site such as BINDING SITE I, BINDING SITE II or BINDING SITE III of FIG. 8. Table 4 illustrates the complementarity of the nucleotide sequences of PRO0365 BINDING SITE, designated SEQ ID:18148, to the nucleotide sequence of GAM189 RNA, herein designated GAM RNA, also designated SEQ ID:246.

Another function of GAM189 is therefore inhibition of PRO0365 (Accession NP_054845.1). Accordingly, utilities of GAM189 include diagnosis, prevention and treatment of diseases and clinical conditions associated with PRO0365.

PRO1048 (Accession NP_060967.1) is another GAM189 target gene, herein designated TARGET GENE. PRO1048 BINDING SITE is a target binding site found in the 3' untranslated region of mRNA encoded by PRO1048, corresponding to a target binding site such as BINDING SITE I, BINDING SITE II or BINDING SITE III of FIG. 8. Table 4 illustrates the complementarity of the nucleotide sequences of PRO1048 BINDING SITE, designated SEQ ID:12596, to the nucleotide sequence of GAM189 RNA, herein designated GAM RNA, also designated SEQ ID:246.

Another function of GAM189 is therefore inhibition of PRO1048 (Accession NP_060967.1). Accordingly, utilities of GAM189 include diagnosis, prevention and treatment of diseases and clinical conditions associated with PRO1048.

PRO2730 (Accession NP_079498.1) is another GAM189 target gene, herein designated TARGET GENE. PRO2730 BINDING SITE is a target binding site found in the 3' untranslated region of mRNA encoded by PRO2730, corresponding to a target binding site such as BINDING SITE I, BINDING SITE II or BINDING SITE III of FIG. 8. Table 4 illustrates the complementarity of the nucleotide sequences of PRO2730 BINDING SITE, designated SEQ ID:2048, to the nucleotide sequence of GAM189 RNA, herein designated GAM RNA, also designated SEQ ID:246.

Another function of GAM189 is therefore inhibition of PRO2730 (Accession NP_079498.1). Accordingly, utilities of GAM189 include diagnosis, prevention and treatment of diseases and clinical conditions associated with PRO2730.

PROM2 (Accession NP_653308.1) is another GAM189 target gene, herein designated TARGET GENE. PROM2 BINDING SITE1 and PROM2 BINDING SITE2 are target binding sites found in untranslated regions of mRNA encoded by PROM2, corresponding to target binding sites such as BINDING SITE I, BINDING SITE II or BINDING SITE III of FIG. 8. Table 4 illustrates the complementarity of the nucleotide sequences of PROM2 BINDING SITE1 and PROM2 BINDING SITE2, designated SEQ ID:2147 and SEQ ID:13176 respectively, to the nucleotide sequence of GAM189 RNA, herein designated GAM RNA, also designated SEQ ID:246.

Another function of GAM189 is therefore inhibition of PROM2 (Accession NP_653308.1). Accordingly, utilities of GAM189 include diagnosis, prevention and treatment of diseases and clinical conditions associated with PROM2.

Prp31 pre-mrna processing factor 31 homolog (yeast) (PRPF31, Accession NP_056444.1) is another GAM189 target gene, herein designated TARGET GENE. PRPF31 BINDING SITE is a target binding site found in the 3' untranslated region of mRNA encoded by PRPF31, corresponding to a target binding site such as BINDING SITE I, BINDING SITE II or BINDING SITE III of FIG. 8. Table 4 illustrates the complementarity of the nucleotide sequences of PRPF31 BINDING SITE, designated SEQ ID:11313, to the nucleotide sequence of GAM189 RNA, herein designated GAM RNA, also designated SEQ ID:246.

Another function of GAM189 is therefore inhibition of Prp31 pre-mrna processing factor 31 homolog (yeast) (PRPF31, Accession NP_056444.1), a gene which is likely to be involved in pre-mRNA splicing and therefore is associated with Retinitis pigmentosa. Accordingly, utilities of GAM189 include diagnosis, prevention and treatment of Retinitis pigmentosa, and of other diseases and clinical conditions associated with PRPF31.

The function of PRPF31 has been established by previous studies. Using a positional cloning approach supported by bioinformatics, Vithana et al. (2001) narrowed the genomic region of the autosomal dominant retinitis pigmentosa-11 locus (RP11; 600138) to an approximately 600-kb region between markers D19S927 and D19S781.2 on 19q13.4. Within this region, they identified the PRPF31 gene, a homolog of the S. cerevisiae pre-mRNA splicing gene Prp31 (Weidenhammer et al., 1996). PRPF31 encodes a putative 499-amino acid protein that is 20% and 38% identical to its S. cerevisiae and S. pombe homologs, respectively. The level of sequence identity to the yeast genes indicates that PRPF31 is likely to be involved in pre-mRNA splicing. PRPF31 and its homologs all contain a region homologous to Nop, a putative snoRNA-binding domain. In yeast Prp31, the Nop domain is thought to mediate protein-RNA interactions required for spliceosome assembly. PRPF31 also has putative nuclear localization signals in its medial region, providing further evidence for a nuclear role.

Full details of the abovementioned studies are described in the following publications, the disclosure of which are hereby incorporated by reference:

Al-Maghtheh, M.; Vithana, E.; Tarttelin, E.; Jay, M.; Evans, K.; Moore, T.; Bhattachary, S.; Inglehearn, C. F.: Evidence for a major retinitis pigmentosa locus on 19q13.4 (RP11), and association with a unique bimodal expressivity phenotype. Am. J. Hum. Genet. 59:864-871, 1996; and Vithana, E. N.; Abu-Safieh, L.; Allen, M. J.; Carey, A.; Papaioannou, M.; Chakarova, C.; Al-Maghtheh, M.; Ebenezer, N. D.; Willis, C.; Moore, A. T.; Bird, A. C.; Hunt, D. M.; Bhattachary.

Further studies establishing the function and utilities of PRPF31 are found in John Hopkins OMIM database record ID 606419, and in cited publications listed in Table 5, which are hereby incorporated by reference. Proteasome (prosome, macropain) 26s subunit, non-atpase, 9 (PSMD9, Accession NP_002804.2) is another GAM189 target gene, herein designated TARGET GENE. PSMD9 BINDING SITE is a target binding site found in the 3' untranslated region of mRNA encoded by PSMD9, corresponding to a target binding site such as BINDING SITE I, BINDING SITE II or BINDING SITE III of FIG. 8. Table 4 illustrates the complementarity of the nucleotide sequences of PSMD9 BINDING SITE, designated SEQ ID:17758, to the nucleotide sequence of GAM189 RNA, herein designated GAM RNA, also designated SEQ ID:246.

Another function of GAM189 is therefore inhibition of Proteasome (prosome, macropain) 26s subunit, non-atpase, 9 (PSMD9, Accession NP_002804.2), a gene which acts as a regulatory subunit of the 26 proteasome. Accordingly, utilities of GAM189 include diagnosis, prevention and treatment of diseases and clinical conditions associated with PSMD9.

The function of PSMD9 and its association with various diseases and clinical conditions, has been established by previous studies, as described hereinabove with reference to GAM30.1. Phosphoserine phosphatase (PSPH, Accession NP_004568.1) is another GAM189 target gene, herein designated TARGET GENE. PSPH BINDING SITE is a target binding site found in the 3' untranslated region of mRNA encoded by PSPH, corresponding to a target binding site such as BINDING SITE I, BINDING SITE II or BINDING SITE III of FIG. 8. Table 4 illustrates the complementarity of the nucleotide sequences of PSPH BINDING SITE, designated SEQ ID:15044, to the nucleotide sequence of GAM189 RNA, herein designated GAM RNA, also designated SEQ ID:246.

Another function of GAM189 is therefore inhibition of Phosphoserine phosphatase (PSPH, Accession NP_004568.1). Accordingly, utilities of GAM189 include diagnosis, prevention and treatment of diseases and clinical conditions associated with PSPH.

Prostaglandin e synthase (PTGES, Accession NP_004869.1) is another GAM189 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:16070, to the nucleotide sequence of GAM189 RNA, herein designated GAM RNA, also designated SEQ ID:246.

Another function of GAM189 is therefore inhibition of Prostaglandin e synthase (PTGES, Accession NP_004869.1). Accordingly, utilities of GAM189 include diagnosis, prevention and treatment of diseases and clinical conditions associated with PTGES.

Prostaglandin i2 (prostacyclin) synthase (PTGIS, Accession NP_000952.1) is another GAM189 target gene, herein designated TARGET GENE. PTGIS BINDING SITE1 and PTGIS BINDING SITE2 are target binding sites found in untranslated regions of mRNA encoded by PTGIS, corresponding to target binding sites such as BINDING SITE I, BINDING SITE II or BINDING SITE III of FIG. 8. Table 4 illustrates the complementarity of the nucleotide sequences of PTGIS BINDING SITE1 and PTGIS BINDING SITE2, designated SEQ ID:17361 and SEQ ID:10783 respectively, to the nucleotide sequence of GAM189 RNA, herein designated GAM RNA, also designated SEQ ID:246.

Another function of GAM189 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM189 include diagnosis, prevention and treatment of diseases and clinical conditions associated with PTGIS.

The function of PTGIS and its association with various diseases and clinical conditions, has been established by previous studies, as described hereinabove with reference to GAM30.1. Ptk2 protein tyrosine kinase 2 (PTK2, Accession NP_005598.3) is another GAM189 target gene, herein designated TARGET GENE. PTK2 BINDING SITE is a target binding site found in the 5' untranslated region of multiple transcripts of mRNA encoded by PTK2, corresponding to a target binding site such as BINDING SITE I, BINDING SITE II or BINDING SITE III of FIG. 8. Table 4 illustrates the complementarity of the nucleotide sequences of PTK2 BINDING SITE, designated SEQ ID:10355, to the nucleotide sequence of GAM189 RNA, herein designated GAM RNA, also designated SEQ ID:246.

Another function of GAM189 is therefore inhibition of Ptk2 protein tyrosine kinase 2 (PTK2, Accession NP_005598.3), a gene which involves in intracellular signal transduction pathway and is a putative homolog of chicken focal adhesion associated kinase. Accordingly, utilities of GAM189 include diagnosis, prevention and treatment of diseases and clinical conditions associated with PTK2.

The function of PTK2 and its association with various diseases and clinical conditions, has been established by previous studies, as described hereinabove with reference to GAM65.2. Phosphorylase, glycogen; muscle (mcardle syndrome, glycogen storage disease type v) (PYGM, Accession NP_005600.1) is another GAM189 target gene, herein designated TARGET GENE. PYGM BINDING SITE is a target binding site found in the 5' untranslated region of mRNA encoded by PYGM, corresponding to a target binding site such as BINDING SITE I, BINDING SITE II or BINDING SITE III of FIG. 8. Table 4 illustrates the complementarity of the nucleotide sequences of PYGM BINDING SITE, designated SEQ ID:15938, to the nucleotide sequence of GAM189 RNA, herein designated GAM RNA, also designated SEQ ID:246.

Another function of GAM189 is therefore inhibition of Phosphorylase, glycogen; muscle (mcardle syndrome, glycogen storage disease type v) (PYGM, Accession NP_005600.1). Accordingly, utilities of GAM189 include diagnosis, prevention and treatment of diseases and clinical conditions associated with PYGM.

RAB11-FIP4 (Accession NP_116321.2) is another GAM189 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:13848, to the nucleotide sequence of GAM189 RNA, herein designated GAM RNA, also designated SEQ ID:246.

Another function of GAM189 is therefore inhibition of RAB11-FIP4 (Accession NP_116321.2). Accordingly, utilities of GAM189 include diagnosis, prevention and treatment of diseases and clinical conditions associated with RAB11-FIP4.

Rab21, member ras oncogene family (RAB21, Accession NP_055814.1) is another GAM189 target gene, herein designated TARGET GENE. RAB21 BINDING SITE is a target binding site found in the 3' untranslated region of mRNA encoded by RAB21, corresponding to a target binding site such as BINDING SITE I, BINDING SITE II or BINDING SITE III of FIG. 8. Table 4 illustrates the complementarity of the nucleotide sequences of RAB21 BINDING SITE, designated SEQ ID:7076, to the nucleotide sequence of GAM189 RNA, herein designated GAM RNA, also designated SEQ ID:246.

Another function of GAM189 is therefore inhibition of Rab21, member ras oncogene family (RAB21, Accession NP_055814.1). Accordingly, utilities of GAM189 include diagnosis, prevention and treatment of diseases and clinical conditions associated with RAB21.

Rab33b, member ras oncogene family (RAB33B, Accession NP_112586.1) is another GAM189 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:7910, to the nucleotide sequence of GAM189 RNA, herein designated GAM RNA, also designated SEQ ID:246.

Another function of GAM189 is therefore inhibition of Rab33b, member ras oncogene family (RAB33B, Accession NP_112586.1). Accordingly, utilities of GAM189 include diagnosis, prevention and treatment of diseases and clinical conditions associated with RAB33B.

Rab36, member ras oncogene family (RAB36, Accession NP_004905.1) is another GAM189 target gene, herein designated TARGET GENE. RAB36 BINDING SITE1 and RAB36 BINDING SITE2 are target binding sites found in untranslated regions of mRNA encoded by RAB36, corresponding to target binding sites such as BINDING SITE I, BINDING SITE II or BINDING SITE III of FIG. 8. Table 4 illustrates the complementarity of the nucleotide sequences of RAB36 BINDING SITE1 and RAB36 BINDING SITE2, designated SEQ ID:808 and SEQ ID:1652 respectively, to the nucleotide sequence of GAM189 RNA, herein designated GAM RNA, also designated SEQ ID:246.

Another function of GAM189 is therefore inhibition of Rab36, member ras oncogene family (RAB36, Accession NP_004905.1), a gene which is involved in protein transport. Accordingly, utilities of GAM189 include diagnosis, prevention and treatment of diseases and clinical conditions associated with RAB36.

The function of RAB36 and its association with various diseases and clinical conditions, has been established by previous studies, as described hereinabove with reference to GAM130.1. Rab39, member ras oncogene family (RAB39, Accession XP_084662.1) is another GAM189 target gene, herein designated TARGET GENE. RAB39 BINDING SITE is a target binding site found in the 3' untranslated region of mRNA encoded by RAB39, corresponding to a target binding site such as BINDING SITE I, BINDING SITE II or BINDING SITE III of FIG. 8. Table 4 illustrates the complementarity of the nucleotide sequences of RAB39 BINDING SITE, designated SEQ ID:3754, to the nucleotide sequence of GAM189 RNA, herein designated GAM RNA, also designated SEQ ID:246.

Another function of GAM189 is therefore inhibition of Rab39, member ras oncogene family (RAB39, Accession XP_084662.1). Accordingly, utilities of GAM189 include diagnosis, prevention and treatment of diseases and clinical conditions associated with RAB39.

Rab4a, member ras oncogene family (RAB4A, Accession NP_004569.2) is another GAM189 target gene, herein designated TARGET GENE. RAB4A BINDING SITE is a target binding site found in the 5' untranslated region of mRNA encoded by RAB4A, corresponding to a target binding site such as BINDING SITE I, BINDING SITE II or BINDING SITE III of FIG. 8. Table 4 illustrates the complementarity of the nucleotide sequences of RAB4A BINDING SITE, designated SEQ ID:16568, to the nucleotide sequence of GAM189 RNA, herein designated GAM RNA, also designated SEQ ID:246.

Another function of GAM189 is therefore inhibition of Rab4a, member ras oncogene family (RAB4A, Accession NP_004569.2), a gene which is involved in protein transport. Accordingly, utilities of GAM189 include diagnosis, prevention and treatment of diseases and clinical conditions associated with RAB4A.

The function of RAB4A and its association with various diseases and clinical conditions, has been established by previous studies, as described hereinabove with reference to GAM55.2. Rab, member of ras oncogene family-like 2a (RABL2A, Accession NP_038198.1) is another GAM189 target gene, herein designated TARGET GENE. RABL2A BINDING SITE is a target binding site found in the 3' untranslated region of multiple transcripts of mRNA encoded by RABL2A, corresponding to a target binding site such as BINDING SITE I, BINDING SITE II or BINDING SITE III of FIG. 8. Table 4 illustrates the complementarity of the nucleotide sequences of RABL2A BINDING SITE, designated SEQ ID:2648, to the nucleotide sequence of GAM189 RNA, herein designated GAM RNA, also designated SEQ ID:17.

Another function of GAM189 is therefore inhibition of Rab, member of ras oncogene family-like 2a (RABL2A, Accession NP_038198.1). Accordingly, utilities of GAM189 include diagnosis, prevention and treatment of diseases and clinical conditions associated with RABL2A.

Rab, member of ras oncogene family-like 2b (RABL2B, Accession NP_009012.1) is another GAM189 target gene, herein designated TARGET GENE. RABL2B BINDING SITE is a target binding site found in the 3' untranslated region of mRNA encoded by RABL2B, corresponding to a target binding site such as BINDING SITE I, BINDING SITE II or BINDING SITE III of FIG. 8. Table 4 illustrates the complementarity of the nucleotide sequences of RABL2B BINDING SITE, designated SEQ ID:2648, to the nucleotide sequence of GAM189 RNA, herein designated GAM RNA, also designated SEQ ID:246.

Another function of GAM189 is therefore inhibition of Rab, member of ras oncogene family-like 2b (RABL2B, Accession NP_009012.1). Accordingly, utilities of GAM189 include diagnosis, prevention and treatment of diseases and clinical conditions associated with RABL2B.

RAI (Accession NP_006654.1) is another GAM189 target gene, herein designated TARGET GENE. RAI BINDING SITE is a target binding site found in the 5' untranslated region of mRNA encoded by RAI, corresponding to a target binding site such as BINDING SITE I, BINDING SITE II or BINDING SITE III of FIG. 8. Table 4 illustrates the complementarity of the nucleotide sequences of RAI BINDING SITE, designated SEQ ID:8937, to the nucleotide sequence of GAM189 RNA, herein designated GAM RNA, also designated SEQ ID:246.

Another function of GAM189 is therefore inhibition of RAI (Accession NP_006654.1). Accordingly, utilities of GAM189 include diagnosis, prevention and treatment of diseases and clinical conditions associated with RAI.

Retinoic acid induced 16 (RAI16, Accession NP_073586.3) is another GAM189 target gene, herein designated TARGET GENE. RAI16 BINDING SITE is a target binding site found in the 3' untranslated region of mRNA encoded by RAI16, corresponding to a target binding site such as BINDING SITE I, BINDING SITE II or BINDING SITE III of FIG. 8. Table 4 illustrates the complementarity of the nucleotide sequences of RAI16 BINDING SITE, designated SEQ ID:4335, to the nucleotide sequence of GAM189 RNA, herein designated GAM RNA, also designated SEQ ID:246.

Another function of GAM189 is therefore inhibition of Retinoic acid induced 16 (RAI16, Accession NP_073586.3). Accordingly, utilities of GAM189 include diagnosis, prevention and treatment of diseases and clinical conditions associated with RAI16.

Retinoic acid induced 17 (RAI17, Accession XP_166091.2) is another GAM189 target gene, herein designated TARGET GENE. RAI17 BINDING SITE is a target binding site found in the 3' untranslated region of multiple transcripts of mRNA encoded by RAI17, corresponding to a target binding site such as BINDING SITE I, BINDING SITE II or BINDING SITE III of FIG. 8. Table 4 illustrates the complementarity of the nucleotide sequences of RAI17 BINDING SITE, designated SEQ ID:7523, to the nucleotide sequence of GAM189 RNA, herein designated GAM RNA, also designated SEQ ID:246.

Another function of GAM189 is therefore inhibition of Retinoic acid induced 17 (RAI17, Accession XP_166091.2). Accordingly, utilities of GAM189 include diagnosis, prevention and treatment of diseases and clinical conditions associated with RAI17.

Retinoic acid induced 17 (RAI17, Accession NP_065071.1) is another GAM189 target gene, herein designated TARGET GENE. RAI17 BINDING SITE is a target binding site found in the 3' untranslated region of multiple transcripts of mRNA encoded by RAI17, corresponding to a target binding site such as BINDING SITE I, BINDING SITE II or BINDING SITE III of FIG. 8. Table 4 illustrates the complementarity of the nucleotide sequences of RAI17 BINDING SITE, designated SEQ ID:7523, to the nucleotide sequence of GAM189 RNA, herein designated GAM RNA, also designated SEQ ID:246.

Another function of GAM189 is therefore inhibition of Retinoic acid induced 17 (RAI17, Accession NP_065071.1). Accordingly, utilities of GAM189 include diagnosis, prevention and treatment of diseases and clinical conditions associated with RAI17.

Retinoic acid induced 3 (RAI3, Accession NP_003970.1) is another GAM189 target gene, herein designated TARGET GENE. RAI3 BINDING SITE is a target binding site found in the 3' untranslated region of mRNA encoded by RAI3, corresponding to a target binding site such as BINDING SITE I, BINDING SITE II or BINDING SITE III of FIG. 8. Table 4 illustrates the complementarity of the nucleotide sequences of RAI3 BINDING SITE, designated SEQ ID:12784, to the nucleotide sequence of GAM189 RNA, herein designated GAM RNA, also designated SEQ ID:246.

Another function of GAM189 is therefore inhibition of Retinoic acid induced 3 (RAI3, Accession NP_003970.1). Accordingly, utilities of GAM189 include diagnosis, prevention and treatment of diseases and clinical conditions associated with RAI3.

RAP140 (Accession NP_056039.1) is another GAM189 target gene, herein designated TARGET GENE. RAP140 BINDING SITE is a target binding site found in the 3' untranslated region of mRNA encoded by RAP140, corresponding to a target binding site such as BINDING SITE I, BINDING SITE II or BINDING SITE III of FIG. 8. Table 4 illustrates the complementarity of the nucleotide sequences of RAP140 BINDING SITE, designated SEQ ID:16472, to the nucleotide sequence of GAM189 RNA, herein designated GAM RNA, also designated SEQ ID:246.

Another function of GAM189 is therefore inhibition of RAP140 (Accession NP_056039.1). Accordingly, utilities of GAM189 include diagnosis, prevention and treatment of diseases and clinical conditions associated with RAP140.

Retinoic acid receptor, gamma (RARG, Accession NP_000957.1) is another GAM189 target gene, herein designated TARGET GENE. RARG BINDING SITE is a target binding site found in the 5' untranslated region of mRNA encoded by RARG, corresponding to a target binding site such as BINDING SITE I, BINDING SITE II or BINDING SITE III of FIG. 8. Table 4 illustrates the complementarity of the nucleotide sequences of RARG BINDING SITE, designated SEQ ID:11090, to the nucleotide sequence of GAM189 RNA, herein designated GAM RNA, also designated SEQ ID:246.

Another function of GAM189 is therefore inhibition of Retinoic acid receptor, gamma (RARG, Accession NP_000957.1). Accordingly, utilities of GAM189 include diagnosis, prevention and treatment of diseases and clinical conditions associated with RARG.

Ras association (ralgds/af-6) domain family 2 (RASSF2, Accession NP_055552.1) is another GAM189 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM189 RNA, herein designated GAM RNA, also designated SEQ ID:246.

Another function of GAM189 is therefore inhibition of Ras association (ralgds/af-6) domain family 2 (RASSF2, Accession NP_055552.1). Accordingly, utilities of GAM189 include diagnosis, prevention and treatment of diseases and clinical conditions associated with RASSF2.

Ras association (ralgds/af-6) domain family 2 (RASSF2, Accession NP_739579.1) is another GAM189 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM189 RNA, herein designated GAM RNA, also designated SEQ ID:246.

Another function of GAM189 is therefore inhibition of Ras association (ralgds/af-6) domain family 2 (RASSF2, Accession NP_739579.1). Accordingly, utilities of GAM189 include diagnosis, prevention and treatment of diseases and clinical conditions associated with RASSF2.

Ras association (ralgds/af-6) domain family 2 (RASSF2, Accession NP_739580.1) is another GAM189 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM189 RNA, herein designated GAM RNA, also designated SEQ ID:246.

Another function of GAM189 is therefore inhibition of Ras association (ralgds/af-6) domain family 2 (RASSF2, Accession NP_739580.1). Accordingly, utilities of GAM189 include diagnosis, prevention and treatment of diseases and clinical conditions associated with RASSF2.

Retinoblastoma binding protein 1 (RBBP1, Accession NP_002883.2) is another GAM189 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:11014, to the nucleotide sequence of GAM189 RNA, herein designated GAM RNA, also designated SEQ ID:246.

Another function of GAM189 is therefore inhibition of Retinoblastoma binding protein 1 (RBBP1, Accession NP_002883.2). Accordingly, utilities of GAM189 include diagnosis, prevention and treatment of diseases and clinical conditions associated with RBBP1.

Retinoblastoma binding protein 1 (RBBP1, Accession NP_075376.1) is another GAM189 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:11014, to the nucleotide sequence of GAM189 RNA, herein designated GAM RNA, also designated SEQ ID:246.

Another function of GAM189 is therefore inhibition of Retinoblastoma binding protein 1 (RBBP1, Accession NP_075376.1). Accordingly, utilities of GAM189 include diagnosis, prevention and treatment of diseases and clinical conditions associated with RBBP1.

Retinoblastoma binding protein 1 (RBBP1, Accession NP_075377.1) is another GAM189 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:11014, to the nucleotide sequence of GAM189 RNA, herein designated GAM RNA, also designated SEQ ID:246.

Another function of GAM189 is therefore inhibition of Retinoblastoma binding protein 1 (RBBP1, Accession NP_075377.1). Accordingly, utilities of GAM189 include diagnosis, prevention and treatment of diseases and clinical conditions associated with RBBP1.

Retinoblastoma binding protein 9 (RBBP9, Accession NP_006597.2) is another GAM189 target gene, herein designated TARGET GENE. RBBP9 BINDING SITE is a target binding site found in the 3' untranslated region of multiple transcripts of mRNA encoded by RBBP9, corresponding to a target binding site such as BINDING SITE I, BINDING SITE II or BINDING SITE III of FIG. 8. Table 4 illustrates the complementarity of the nucleotide sequences of RBBP9 BINDING SITE, designated SEQ ID:16100, to the nucleotide sequence of GAM189 RNA, herein designated GAM RNA, also designated SEQ ID:246.

Another function of GAM189 is therefore inhibition of Retinoblastoma binding protein 9 (RBBP9, Accession NP_006597.2). Accordingly, utilities of GAM189 include diagnosis, prevention and treatment of diseases and clinical conditions associated with RBBP9.

Retinoblastoma-like 2 (p130) (RBL2, Accession NP_005602.2) is another GAM189 target gene, herein designated TARGET GENE. RBL2 BINDING SITE is a target binding site found in the 3' untranslated region of mRNA encoded by RBL2, corresponding to a target binding site such as BINDING SITE I, BINDING SITE II or BINDING SITE III of FIG. 8. Table 4 illustrates the complementarity of the nucleotide sequences of RBL2 BINDING SITE, designated SEQ ID:6615, to the nucleotide sequence of GAM189 RNA, herein designated GAM RNA, also designated SEQ ID:246.

Another function of GAM189 is therefore inhibition of Retinoblastoma-like 2 (p130) (RBL2, Accession NP_005602.2), a gene which may be a tumor suppressor and therefore may be associated with Cancer. Accordingly, utilities of GAM189 include diagnosis, prevention and treatment of Cancer, and of other diseases and clinical conditions associated with RBL2.

The function of RBL2 has been established by previous studies. Mayol et al. (1993) cloned a retinoblastoma-related human gene, referred to as RB2, on the basis of sequence homology of the E1A-binding domain of the retinoblastoma gene (RB1; 180200). Structural homology with RB1 suggested a possible function of RB2 as a tumor suppressor gene. Yeung et al. (1993) mapped the gene to human chromosome 16q12.2 and rat chromosome 19, using fluorescence in situ hybridization and somatic hybrid cell analysis, respectively. Based on known syntenic relationships among human, rat and mouse, the data suggested that the mouse homolog resides on chromosome 8. Deletions of chromosome 16q have been found in several human neoplasms, including breast, ovarian, hepatic, and prostatic cancers, which supports the involvement of RB2 in human cancer as a tumor suppressor gene. This locus is symbolized RBL2 because it was identified after the gene on chromosome 20, which is symbolized RBL1 (OMIM Ref. No. 116957). RBL1 has a molecular weight of 107 kD; RBL2 has a molecular weight of about 120 kD.

Full details of the abovementioned studies are described in the following publications, the disclosure of which are hereby incorporated by reference:

Baldi, A.; Boccia, V.; Claudio, P. P.; De Luca, A.; Giordano, A.: Genomic structure of the human retinoblastoma-related Rb2/p130 gene. Proc. Nat. Acad. Sci. 93:4629-4632, 1996; and Mayol, X.; Grana, X.; Baldi, A.; Sang, N.; Hu, Q.; Giordano, A.: Cloning of a new member of the retinoblastoma gene family (pRb2) which binds to the E1A transforming domain. Oncogene.

Further studies establishing the function and utilities of RBL2 are found in John Hopkins OMIM database record ID 180203, and in cited publications listed in Table 5, which are hereby incorporated by reference. RCBTB1 (Accession NP_060661.2) is another GAM189 target gene, herein designated TARGET GENE. RCBTB1 BINDING SITE is a target binding site found in the 5' untranslated region of mRNA encoded by RCBTB1, corresponding to a target binding site such as BINDING SITE I, BINDING SITE II or BINDING SITE III of FIG. 8. Table 4 illustrates the complementarity of the nucleotide sequences of RCBTB1 BINDING SITE, designated SEQ ID:13829, to the nucleotide sequence of GAM189 RNA, herein designated GAM RNA, also designated SEQ ID:246.

Another function of GAM189 is therefore inhibition of RCBTB1 (Accession NP_060661.2). Accordingly, utilities of GAM189 include diagnosis, prevention and treatment of diseases and clinical conditions associated with RCBTB1.

RCD-8 (Accession NP_055144.2) is another GAM189 target gene, herein designated TARGET GENE. RCD-8 BINDING SITE is a target binding site found in the 3' untranslated region of mRNA encoded by RCD-8, corresponding to a target binding site such as BINDING SITE I, BINDING SITE II or BINDING SITE III of FIG. 8. Table 4 illustrates the complementarity of the nucleotide sequences of RCD-8 BINDING SITE, designated SEQ ID:13335, to the nucleotide sequence of GAM189 RNA, herein designated GAM RNA, also designated SEQ ID:246.

Another function of GAM189 is therefore inhibition of RCD-8 (Accession NP_055144.2). Accordingly, utilities of GAM189 include diagnosis, prevention and treatment of diseases and clinical conditions associated with RCD-8.

RDH13 (Accession NP_612421.1) is another GAM189 target gene, herein designated TARGET GENE. RDH13 BINDING SITE is a target binding site found in the 5' untranslated region of mRNA encoded by RDH13, corresponding to a target binding site such as BINDING SITE I, BINDING SITE II or BINDING SITE III of FIG. 8. Table 4 illustrates the complementarity of the nucleotide sequences of RDH13 BINDING SITE, designated SEQ ID:9713, to the nucleotide sequence of GAM189 RNA, herein designated GAM RNA, also designated SEQ ID:246.

Another function of GAM189 is therefore inhibition of RDH13 (Accession NP_612421.1). Accordingly, utilities of GAM189 include diagnosis, prevention and treatment of diseases and clinical conditions associated with RDH13.

Regulator of g-protein signalling 3 (RGS3, Accession NP_570613.1) is another GAM189 target gene, herein designated TARGET GENE. RGS3 BINDING SITE is a target binding site found in the 5' untranslated region of multiple transcripts of mRNA encoded by RGS3, corresponding to a target binding site such as BINDING SITE I, BINDING SITE II or BINDING SITE III of FIG. 8. Table 4 illustrates the complementarity of the nucleotide sequences of RGS3 BINDING SITE, designated SEQ ID:3344, to the nucleotide sequence of GAM189 RNA, herein designated GAM RNA, also designated SEQ ID:246.

Another function of GAM189 is therefore inhibition of Regulator of g-protein signalling 3 (RGS3, Accession NP_570613.1), a gene which negatively regulates G protein-coupled receptor signalling. Accordingly, utilities of GAM189 include diagnosis, prevention and treatment of diseases and clinical conditions associated with RGS3.

The function of RGS3 and its association with various diseases and clinical conditions, has been established by previous studies, as described hereinabove with reference to GAM146.1. Rhesus blood group, d antigen (RHD, Accession NP_057208.2) is another GAM189 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:13465 and SEQ ID:4143 respectively, to the nucleotide sequence of GAM189 RNA, herein designated GAM RNA, also designated SEQ ID:246.

Another function of GAM189 is therefore inhibition of Rhesus blood group, d antigen (RHD, Accession NP_057208.2), a gene which Major antigen of the RH system. Accordingly, utilities of GAM189 include diagnosis, prevention and treatment of diseases and clinical conditions associated with RHD.

The function of RHD and its association with various diseases and clinical conditions, has been established by previous studies, as described hereinabove with reference to GAM161.1. Rhesus blood group, d antigen (RHD, Accession NP_057309.2) is another GAM189 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:4143 and SEQ ID:13465 respectively, to the nucleotide sequence of GAM189 RNA, herein designated GAM RNA, also designated SEQ ID:246.

Another function of GAM189 is therefore inhibition of Rhesus blood group, d antigen (RHD, Accession NP_057309.2), a gene which Major antigen of the RH system. Accordingly, utilities of GAM189 include diagnosis, prevention and treatment of diseases and clinical conditions associated with RHD.

The function of RHD and its association with various diseases and clinical conditions, has been established by previous studies, as described hereinabove with reference to GAM161.1. RHPN2 (Accession NP_149094.2) is another GAM189 target gene, herein designated TARGET GENE. RHPN2 BINDING SITE is a target binding site found in the 3' untranslated region of mRNA encoded by RHPN2, corresponding to a target binding site such as BINDING SITE I, BINDING SITE II or BINDING SITE III of FIG. 8. Table 4 illustrates the complementarity of the nucleotide sequences of RHPN2 BINDING SITE, designated SEQ ID:11803, to the nucleotide sequence of GAM189 RNA, herein designated GAM RNA, also designated SEQ ID:246.

Another function of GAM189 is therefore inhibition of RHPN2 (Accession NP_149094.2). Accordingly, utilities of GAM189 include diagnosis, prevention and treatment of diseases and clinical conditions associated with RHPN2.

RIP60 (Accession NP_037532.1) is another GAM189 target gene, herein designated TARGET GENE. RIP60 BINDING SITE is a target binding site found in the 3' untranslated region of multiple transcripts of mRNA encoded by RIP60, corresponding to a target binding site such as BINDING SITE I, BINDING SITE II or BINDING SITE III of FIG. 8. Table 4 illustrates the complementarity of the nucleotide sequences of RIP60 BINDING SITE, designated SEQ ID:5556, to the nucleotide sequence of GAM189 RNA, herein designated GAM RNA, also designated SEQ ID:246.

Another function of GAM189 is therefore inhibition of RIP60 (Accession NP_037532.1). Accordingly, utilities of GAM189 include diagnosis, prevention and treatment of diseases and clinical conditions associated with RIP60.

RIP60 (Accession NP_055189.1) is another GAM189 target gene, herein designated TARGET GENE. RIP60 BINDING SITE is a target binding site found in the 3' untranslated region of multiple transcripts of mRNA encoded by RIP60, corresponding to a target binding site such as BINDING SITE I, BINDING SITE II or BINDING SITE III of FIG. 8. Table 4 illustrates the complementarity of the nucleotide sequences of RIP60 BINDING SITE, designated SEQ ID:5556, to the nucleotide sequence of GAM189 RNA, herein designated GAM RNA, also designated SEQ ID:246.

Another function of GAM189 is therefore inhibition of RIP60 (Accession NP_055189.1). Accordingly, utilities of GAM189 include diagnosis, prevention and treatment of diseases and clinical conditions associated with RIP60.

RNF137 (Accession NP_060543.4) is another GAM189 target gene, herein designated TARGET GENE. RNF137 BINDING SITE1 and RNF137 BINDING SITE2 are target binding sites found in untranslated regions of mRNA encoded by RNF137, corresponding to target binding sites such as BINDING SITE I, BINDING SITE II or BINDING SITE III of FIG. 8. Table 4 illustrates the complementarity of the nucleotide sequences of RNF137 BINDING SITE1 and RNF137 BINDING SITE2, designated SEQ ID:7446 and SEQ ID:16940 respectively, to the nucleotide sequence of GAM189 RNA, herein designated GAM RNA, also designated SEQ ID:246.

Another function of GAM189 is therefore inhibition of RNF137 (Accession NP_060543.4). Accordingly, utilities of GAM189 include diagnosis, prevention and treatment of diseases and clinical conditions associated with RNF137.

RNF144 (Accession NP_055561.1) is another GAM189 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:4727, to the nucleotide sequence of GAM189 RNA, herein designated GAM RNA, also designated SEQ ID:246.

Another function of GAM189 is therefore inhibition of RNF144 (Accession NP_055561.1). Accordingly, utilities of GAM189 include diagnosis, prevention and treatment of diseases and clinical conditions associated with RNF144.

Ring finger protein (c3hc4 type) 8 (RNF8, Accession NP_003949.1) is another GAM189 target gene, herein designated TARGET GENE. RNF8 BINDING SITE1 and RNF8 BINDING SITE2 are target binding sites found in untranslated regions of mRNA encoded by RNF8, corresponding to target binding sites such as BINDING SITE I, BINDING SITE II or BINDING SITE III of FIG. 8. Table 4 illustrates the complementarity of the nucleotide sequences of RNF8 BINDING SITE1 and RNF8 BINDING SITE2, designated SEQ ID:13778 and SEQ ID:9745 respectively, to the nucleotide sequence of GAM189 RNA, herein designated GAM RNA, also designated SEQ ID:246.

Another function of GAM189 is therefore inhibition of Ring finger protein (c3hc4 type) 8 (RNF8, Accession NP_003949.1). Accordingly, utilities of GAM189 include diagnosis, prevention and treatment of diseases and clinical conditions associated with RNF8.

Retinitis pigmentosa 2 (x-linked recessive) (RP2, Accession NP_008846.1) is another GAM189 target gene, herein designated TARGET GENE. RP2 BINDING SITE is a target binding site found in the 3' untranslated region of mRNA encoded by RP2, corresponding to a target binding site such as BINDING SITE I, BINDING SITE II or BINDING SITE III of FIG. 8. Table 4 illustrates the complementarity of the nucleotide sequences of RP2 BINDING SITE, designated SEQ ID:6582, to the nucleotide sequence of GAM189 RNA, herein designated GAM RNA, also designated SEQ ID:246.

Another function of GAM189 is therefore inhibition of Retinitis pigmentosa 2 (x-linked recessive) (RP2, Accession NP_008846.1). Accordingly, utilities of GAM189 include diagnosis, prevention and treatment of diseases and clinical conditions associated with RP2.

Rabphilin 3a-like (without c2 domains) (RPH3AL, Accession NP_008918.1) is another GAM189 target gene, herein designated TARGET GENE. RPH3AL BINDING SITE is a target binding site found in the 3' untranslated region of mRNA encoded by RPH3AL, corresponding to a target binding site such as BINDING SITE I, BINDING SITE II or BINDING SITE III of FIG. 8. Table 4 illustrates the complementarity of the nucleotide sequences of RPH3AL BINDING SITE, designated SEQ ID:2614, to the nucleotide sequence of GAM189 RNA, herein designated GAM RNA, also designated SEQ ID:246.

Another function of GAM189 is therefore inhibition of Rabphilin 3a-like (without c2 domains) (RPH3AL, Accession NP_008918.1), a gene which is a protein transporter. could play a role in neurotransmitter release by regulating membrane flow in the nerve terminal. Accordingly, utilities of GAM189 include diagnosis, prevention and treatment of diseases and clinical conditions associated with RPH3AL.

The function of RPH3AL has been established by previous studies. Secretions of hormones and neurotransmitters from endocrine cells and neurons, respectively, are regulated by calcium ions, which trigger exocytosis. The RAS-associated protein RAB3A (OMIM Ref. No. 179490) is involved in the recruitment of synaptic vesicles for exocytosis. Using a DNA fragment encoding the Rab3A-binding domain of a mouse rabphilin-3A cDNA, Kotake et al. (1997) probed a rat islet cDNA library under low stringency. A partial rabphilin-3A-related protein was identified and designated Noc2; a full-length Noc2 clone was isolated from a rat insulin-secreting cell line cDNA library. The Noc2 cDNA encodes a 302-amino acid protein that shows 40.7% amino acid identity and 77.9% similarity to the N-terminal region of rat rabphilin-3A. However, it lacks the C2 domains, and hence the Noc2 (no C2 domain) designation. Noc2 contains 1 potential protein kinase A and 3 potential protein kinase C phosphorylation sites. RNA blot analysis revealed that a single 2.2-or 2.6-kb transcript of Noc2 is expressed at very high levels in pancreatic islets, and at low to moderate or high levels in other endocrine tissues and hormone-secreting cell lines, but at very low levels in brain. Screening a mouse embryonic cDNA library with the yeast 2-hybrid system, Kotake et al. (1997) showed that Noc2 interacts with the LIM domain-containing protein zyxin (OMIM Ref. No. 602002), a component of the cytoskeleton. The authors suggested that Noc2 is probably involved in regulated exocytosis in endocrine cells by interacting with the cytoskeleton Using cDNA selection, Smith et al. (1999) identified a human transcript spanning a common deletion on 17p13.3 found in approximately 40% of medulloblastomas. The full-length coding sequence predicted a 315-amino acid protein displaying 77% amino acid identity with the rat Noc2 (OMIM Ref. No. Rph3al) protein. Northern blot analysis detected moderate to high expression of a 2.6-kb RPH3AL transcript in thyroid, ovary, stomach, heart, pancreas, skeletal muscle, kidney, and liver Full details of the abovementioned studies are described in the following publications, the disclosure of which are hereby incorporated by reference:

Kotake, K.; Ozaki, N.; Mizuta, M.; Sekiy, S.; Inagaki, N.; Seino, S.: Noc2, a putative zinc finger protein involved in exocytosis in endocrine cells. J. Biol. Chem. 272:29407-29410, 1997; and Smith, J. S.; Tachibana, I.; Allen, C.; Chiappa, S. A.; Lee, H. K.; McIver, B.; Jenkins, R. B.; Raffel, C.: Cloning of a human ortholog (RPH3AL) of (RNO)Rph3al from a candidate 17p13.3 med.

Further studies establishing the function and utilities of RPH3AL are found in John Hopkins OMIM database record ID 604881, and in cited publications listed in Table 5, which are hereby incorporated by reference. RPP30 (Accession NP_006404.1) is another GAM189 target gene, herein designated TARGET GENE. RPP30 BINDING SITE1 and RPP30 BINDING SITE2 are target binding sites found in untranslated regions of mRNA encoded by RPP30, corresponding to target binding sites such as BINDING SITE I, BINDING SITE II or BINDING SITE III of FIG. 8. Table 4 illustrates the complementarity of the nucleotide sequences of RPP30 BINDING SITE1 and RPP30 BINDING SITE2, designated SEQ ID:445 and SEQ ID:19325 respectively, to the nucleotide sequence of GAM189 RNA, herein designated GAM RNA, also designated SEQ ID:246.

Another function of GAM189 is therefore inhibition of RPP30 (Accession NP_006404.1), a gene which is a component of ribonuclease p that processes 5' ends of precursor tRNAs. Accordingly, utilities of GAM189 include diagnosis, prevention and treatment of diseases and clinical conditions associated with RPP30.

The function of RPP30 and its association with various diseases and clinical conditions, has been established by previous studies, as described hereinabove with reference to GAM136.1. S100A15 (Accession NP_789793.1) is another GAM189 target gene, herein designated TARGET GENE. S100A15 BINDING SITE is a target binding site found in the 3' untranslated region of mRNA encoded by S100A15, corresponding to a target binding site such as BINDING SITE I, BINDING SITE II or BINDING SITE III of FIG. 8. Table 4 illustrates the complementarity of the nucleotide sequences of S100A15 BINDING SITE, designated SEQ ID:19723, to the nucleotide sequence of GAM189 RNA, herein designated GAM RNA, also designated SEQ ID:246.

Another function of GAM189 is therefore inhibition of S100A15 (Accession NP_789793.1). Accordingly, utilities of GAM189 include diagnosis, prevention and treatment of diseases and clinical conditions associated with S100A15.

SARM1 (Accession NP_055892.1) is another GAM189 target gene, herein designated TARGET GENE. SARM1 BINDING SITE1 and SARM1 BINDING SITE2 are target binding sites found in untranslated regions of mRNA encoded by SARM1, corresponding to target binding sites such as BINDING SITE I, BINDING SITE II or BINDING SITE III of FIG. 8. Table 4 illustrates the complementarity of the nucleotide sequences of SARM1 BINDING SITE1 and SARM1 BINDING SITE2, designated SEQ ID:4282 and SEQ ID:7147 respectively, to the nucleotide sequence of GAM189 RNA, herein designated GAM RNA, also designated SEQ ID:246.

Another function of GAM189 is therefore inhibition of SARM1 (Accession NP_055892.1). Accordingly, utilities of GAM189 include diagnosis, prevention and treatment of diseases and clinical conditions associated with SARM1.

Sarcoma amplified sequence (SAS, Accession NP_005972.1) is another GAM189 target gene, herein designated TARGET GENE. SAS BINDING SITE is a target binding site found in the 3' untranslated region of mRNA encoded by SAS, corresponding to a target binding site such as BINDING SITE I, BINDING SITE II or BINDING SITE III of FIG. 8. Table 4 illustrates the complementarity of the nucleotide sequences of SAS BINDING SITE, designated SEQ ID:17726, to the nucleotide sequence of GAM189 RNA, herein designated GAM RNA, also designated SEQ ID:246.

Another function of GAM189 is therefore inhibition of Sarcoma amplified sequence (SAS, Accession NP_005972.1), a gene which is a member of the transmembrane 4 superfamily (TM4SF) and may be involved in growth-related cellular processes T. Accordingly, utilities of GAM189 include diagnosis, prevention and treatment of diseases and clinical conditions associated with SAS.

The function of SAS and its association with various diseases and clinical conditions, has been established by previous studies, as described hereinabove with reference to GAM88.1. SBLF (Accession NP_006864.2) is another GAM189 target gene, herein designated TARGET GENE. SBLF BINDING SITE is a target binding site found in the 3' untranslated region of mRNA encoded by SBLF, corresponding to a target binding site such as BINDING SITE I, BINDING SITE II or BINDING SITE III of FIG. 8. Table 4 illustrates the complementarity of the nucleotide sequences of SBLF BINDING SITE, designated SEQ ID:14551, to the nucleotide sequence of GAM189 RNA, herein designated GAM RNA, also designated SEQ ID:246.

Another function of GAM189 is therefore inhibition of SBLF (Accession NP_006864.2). Accordingly, utilities of GAM189 include diagnosis, prevention and treatment of diseases and clinical conditions associated with SBLF.

SCAMP-4 (Accession NP_524558.1) is another GAM189 target gene, herein designated TARGET GENE. SCAMP-4 BINDING SITE is a target binding site found in the 3' untranslated region of mRNA encoded by SCAMP-4, corresponding to a target binding site such as BINDING SITE I, BINDING SITE II or BINDING SITE III of FIG. 8. Table 4 illustrates the complementarity of the nucleotide sequences of SCAMP-4 BINDING SITE, designated SEQ ID:2153, to the nucleotide sequence of GAM189 RNA, herein designated GAM RNA, also designated SEQ ID:246.

Another function of GAM189 is therefore inhibition of SCAMP-4 (Accession NP_524558.1). Accordingly, utilities of GAM189 include diagnosis, prevention and treatment of diseases and clinical conditions associated with SCAMP-4.

Scan domain containing 2 (SCAND2, Accession NP_071333.2) is another GAM189 target gene, herein designated TARGET GENE. SCAND2 BINDING SITE is a target binding site found in the 3' untranslated region of multiple transcripts of mRNA encoded by SCAND2, corresponding to a target binding site such as BINDING SITE I, BINDING SITE II or BINDING SITE III of FIG. 8. Table 4 illustrates the complementarity of the nucleotide sequences of SCAND2 BINDING SITE, designated SEQ ID:7179, to the nucleotide sequence of GAM189 RNA, herein designated GAM RNA, also designated SEQ ID:246.

Another function of GAM189 is therefore inhibition of Scan domain containing 2 (SCAND2, Accession NP_071333.2). Accordingly, utilities of GAM189 include diagnosis, prevention and treatment of diseases and clinical conditions associated with SCAND2.

Scavenger receptor class f, member 1 (SCARF1, Accession NP_003684.1) is another GAM189 target gene, herein designated TARGET GENE. SCARF1 BINDING SITE is a target binding site found in the 3' untranslated region of mRNA encoded by SCARF1, corresponding to a target binding site such as BINDING SITE I, BINDING SITE II or BINDING SITE III of FIG. 8. Table 4 illustrates the complementarity of the nucleotide sequences of SCARF1 BINDING SITE, designated SEQ ID:5158, to the nucleotide sequence of GAM189 RNA, herein designated GAM RNA, also designated SEQ ID:246.

Another function of GAM189 is therefore inhibition of Scavenger receptor class f, member 1 (SCARF1, Accession NP_003684.1). Accordingly, utilities of GAM189 include diagnosis, prevention and treatment of diseases and clinical conditions associated with SCARF1.

Stearoyl-coa desaturase (delta-9-desaturase) (SCD, Accession NP_005054.2) is another GAM189 target gene, herein designated TARGET GENE. SCD BINDING SITE is a target binding site found in the 3' untranslated region of mRNA encoded by SCD, corresponding to a target binding site such as BINDING SITE I, BINDING SITE II or BINDING SITE III of FIG. 8. Table 4 illustrates the complementarity of the nucleotide sequences of SCD BINDING SITE, designated SEQ ID:3800, to the nucleotide sequence of GAM189 RNA, herein designated GAM RNA, also designated SEQ ID:246.

Another function of GAM189 is therefore inhibition of Stearoyl-coa desaturase (delta-9-desaturase) (SCD, Accession NP_005054.2), a gene which functions in the synthesis of unsaturated fatty acids. Accordingly, utilities of GAM189 include diagnosis, prevention and treatment of diseases and clinical conditions associated with SCD.

The function of SCD and its association with various diseases and clinical conditions, has been established by previous studies, as described hereinabove with reference to GAM144.1. Sex comb on midleg-like 2 (drosophila) (SCML2, Accession NP_006080.1) is another GAM189 target gene, herein designated TARGET GENE. SCML2 BINDING SITE is a target binding site found in the 3' untranslated region of mRNA encoded by SCML2, corresponding to a target binding site such as BINDING SITE I, BINDING SITE II or BINDING SITE III of FIG. 8. Table 4 illustrates the complementarity of the nucleotide sequences of SCML2 BINDING SITE, designated SEQ ID:3898, to the nucleotide sequence of GAM189 RNA, herein designated GAM RNA, also designated SEQ ID:246.

Another function of GAM189 is therefore inhibition of Sex comb on midleg-like 2 (drosophila) (SCML2, Accession NP_006080.1). Accordingly, utilities of GAM189 include diagnosis, prevention and treatment of diseases and clinical conditions associated with SCML2.

Sodium channel, voltage-gated, type ii, beta polypeptide (SCN2B, Accession NP_004579.1) is another GAM189 target gene, herein designated TARGET GENE. SCN2B BINDING SITE is a target binding site found in the 3' untranslated region of mRNA encoded by SCN2B, corresponding to a target binding site such as BINDING SITE I, BINDING SITE II or BINDING SITE III of FIG. 8. Table 4 illustrates the complementarity of the nucleotide sequences of SCN2B BINDING SITE, designated SEQ ID:13704, to the nucleotide sequence of GAM189 RNA, herein designated GAM RNA, also designated SEQ ID:246.

Another function of GAM189 is therefore inhibition of Sodium channel, voltage-gated, type ii, beta polypeptide (SCN2B, Accession NP_004579.1), a gene which modulates channel properties. Accordingly, utilities of GAM189 include diagnosis, prevention and treatment of diseases and clinical conditions associated with SCN2B.

The function of SCN2B has been established by previous studies. Jones et al. (1996) used a rat brain Scn2b cDNA to map the mouse gene in interspecific backcrosses. They found that it is linked to markers from the central region of mouse chromosome 9 and noted that the neurologic mutation 'staggerer' (Imai and Kingsley, 1994) had been mapped there also. No recombination was found with the Il10r gene (OMIM Ref. No. 146933). Thus, mouse Scn2b is located within a conserved linkage group with orthologs on human chromosome 11q22-qter. By fluorescence in situ hybridization, Eubanks et al. (1997) mapped the SCN2B gene to 11q23. Bolino et al. (1998) reported that the SCN2B gene consists of 4 exons and 3 introns spanning a region of approximately 12 kb Full details of the abovementioned studies are described in the following publications, the disclosure of which are hereby incorporated by reference:

Bolino, A.; Seri, M.; Caroli, F.; Eubanks, J.; Srinivasan, J.; Mandich, P.; Schenone, A.; Quattrone, A.; Romeo, G.; Catterall, W. A.; Devoto, M.: Exclusion of the SCN2B gene as candidate for CMT4B. Europ. J. Hum. Genet. 6:629-634, 1998; and Eubanks, J.; Srinivasan, J.; Dinulos, M. B.; Disteche, C. M.; Catterall, W. A.: Structure and chromosomal localization of the beta2 subunit of the human brain sodium channel. Neurorepo.

Further studies establishing the function and utilities of SCN2B are found in John Hopkins OMIM database record ID 601327, and in cited publications listed in Table 5, which are hereby incorporated by reference. SCN3B (Accession NP_060870.1) is another GAM189 target gene, herein designated TARGET GENE. SCN3B BINDING SITE is a target binding site found in the 3' untranslated region of mRNA encoded by SCN3B, corresponding to a target binding site such as BINDING SITE I, BINDING SITE II or BINDING SITE III of FIG. 8. Table 4 illustrates the complementarity of the nucleotide sequences of SCN3B BINDING SITE, designated SEQ ID:4399, to the nucleotide sequence of GAM189 RNA, herein designated GAM RNA, also designated SEQ ID:246.

Another function of GAM189 is therefore inhibition of SCN3B (Accession NP_060870.1). Accordingly, utilities of GAM189 include diagnosis, prevention and treatment of diseases and clinical conditions associated with SCN3B.

SDS-RS1 (Accession NP_612441.1) is another GAM189 target gene, herein designated TARGET GENE. SDS-RS1 BINDING SITE is a target binding site found in the 5' untranslated region of mRNA encoded by SDS-RS1, corresponding to a target binding site such as BINDING SITE I, BINDING SITE II or BINDING SITE III of FIG. 8. Table 4 illustrates the complementarity of the nucleotide sequences of SDS-RS1 BINDING SITE, designated SEQ ID:14127, to the nucleotide sequence of GAM189 RNA, herein designated GAM RNA, also designated SEQ ID:246.

Another function of GAM189 is therefore inhibition of SDS-RS1 (Accession NP_612441.1). Accordingly, utilities of GAM189 include diagnosis, prevention and treatment of diseases and clinical conditions associated with SDS-RS1.

Spondyloepiphyseal dysplasia, late (SEDL, Accession NP_055378.1) is another GAM189 target gene, herein designated TARGET GENE. SEDL BINDING SITE1 through SEDL BINDING SITE3 are target binding sites found in untranslated regions of mRNA encoded by SEDL, corresponding to target binding sites such as BINDING SITE I, BINDING SITE II or BINDING SITE III of FIG. 8. Table 4 illustrates the complementarity of the nucleotide sequences of SEDL BINDING SITE1 through SEDL BINDING SITE3, designated SEQ ID:15576, SEQ ID:11591 and SEQ ID:926 respectively, to the nucleotide sequence of GAM189 RNA, herein designated GAM RNA, also designated SEQ ID:246.

Another function of GAM189 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM189 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. Sema domain, immunoglobulin domain (ig), short basic domain, secreted, (semaphorin) 3e (SEMA3E, Accession NP_036563.1) is another GAM189 target gene, herein designated TARGET GENE. SEMA3E BINDING SITE is a target binding site found in the 3' untranslated region of mRNA encoded by SEMA3E, corresponding to a target binding site such as BINDING SITE I, BINDING SITE II or BINDING SITE III of FIG. 8. Table 4 illustrates the complementarity of the nucleotide sequences of SEMA3E BINDING SITE, designated SEQ ID:13353, to the nucleotide sequence of GAM189 RNA, herein designated GAM RNA, also designated SEQ ID:246.

Another function of GAM189 is therefore inhibition of Sema domain, immunoglobulin domain (ig), short basic domain, secreted, (semaphorin) 3e (SEMA3E, Accession NP_036563.1). Accordingly, utilities of GAM189 include diagnosis, prevention and treatment of diseases and clinical conditions associated with SEMA3E.

Selenoprotein n, 1 (SEPN1, Accession NP_065184.1) is another GAM189 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:18255, to the nucleotide sequence of GAM189 RNA, herein designated GAM RNA, also designated SEQ ID:246.

Another function of GAM189 is therefore inhibition of Selenoprotein n, 1 (SEPN1, Accession NP_065184.1). Accordingly, utilities of GAM189 include diagnosis, prevention and treatment of diseases and clinical conditions associated with SEPN1.

Small edrk-rich factor 1a (telomeric) (SERF1A, Accession NP_068802.1) is another GAM189 target gene, herein designated TARGET GENE. SERF1A BINDING SITE1 and SERF1A BINDING SITE2 are target binding sites found in untranslated regions of mRNA encoded by SERF1A, corresponding to target binding sites such as BINDING SITE I, BINDING SITE II or BINDING SITE III of FIG. 8. Table 4 illustrates the complementarity of the nucleotide sequences of SERF1A BINDING SITE1 and SERF1A BINDING SITE2, designated SEQ ID:15849 and SEQ ID:9219 respectively, to the nucleotide sequence of GAM189 RNA, herein designated GAM RNA, also designated SEQ ID:246.

Another function of GAM189 is therefore inhibition of Small edrk-rich factor 1a (telomeric) (SERF1A, Accession NP_068802.1). Accordingly, utilities of GAM189 include diagnosis, prevention and treatment of diseases and clinical conditions associated with SERF1A.

Small edrk-rich factor 1b (centromeric) (SERF1B, Accession NP_075267.1) is another GAM189 target gene, herein designated TARGET GENE. SERF1B BINDING SITE1 and SERF1B BINDING SITE2 are target binding sites found in untranslated regions of mRNA encoded by SERF1B, corresponding to target binding sites such as BINDING SITE I, BINDING SITE II or BINDING SITE III of FIG. 8. Table 4 illustrates the complementarity of the nucleotide sequences of SERF1B BINDING SITE1 and SERF1B BINDING SITE2, designated SEQ ID:15849 and SEQ ID:9219 respectively, to the nucleotide sequence of GAM189 RNA, herein designated GAM RNA, also designated SEQ ID:246.

Another function of GAM189 is therefore inhibition of Small edrk-rich factor 1b (centromeric) (SERF1B, Accession NP_075267.1). Accordingly, utilities of GAM189 include diagnosis, prevention and treatment of diseases and clinical conditions associated with SERF1B.

Serine (or cysteine) proteinase inhibitor, clade b (ovalbumin), member 9 (SERPINB9, Accession NP_004146.1) is another GAM189 target gene, herein designated TARGET GENE. SERPINB9 BINDING SITE1 and SERPINB9 BINDING SITE2 are target binding sites found in untranslated regions of mRNA encoded by SERPINB9, corresponding to target binding sites such as BINDING SITE I, BINDING SITE II or BINDING SITE III of FIG. 8. Table 4 illustrates the complementarity of the nucleotide sequences of SERPINB9 BINDING SITE1 and SERPINB9 BINDING SITE2, designated SEQ ID:4363 and SEQ ID:9152 respectively, to the nucleotide sequence of GAM189 RNA, herein designated GAM RNA, also designated SEQ ID:246.

Another function of GAM189 is therefore inhibition of Serine (or cysteine) proteinase inhibitor, clade b (ovalbumin), member 9 (SERPINB9, Accession NP_004146.1), a gene which may be a serpin serine protease inhibitor that interacts with granzyme B (GZMB). Accordingly, utilities of GAM189 include diagnosis, prevention and treatment of diseases and clinical conditions associated with SERPINB9.

The function of SERPINB9 and its association with various diseases and clinical conditions, has been established by previous studies, as described hereinabove with reference to GAM88.2. Sideroflexin 2 (SFXN2, Accession XP_058359.2) is another GAM189 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:3678, to the nucleotide sequence of GAM189 RNA, herein designated GAM RNA, also designated SEQ ID:246.

Another function of GAM189 is therefore inhibition of Sideroflexin 2 (SFXN2, Accession XP_058359.2). Accordingly, utilities of GAM189 include diagnosis, prevention and treatment of diseases and clinical conditions associated with SFXN2.

Sideroflexin 2 (SFXN2, Accession NP_849189.1) is another GAM189 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:3678, to the nucleotide sequence of GAM189 RNA, herein designated GAM RNA, also designated SEQ ID:246.

Another function of GAM189 is therefore inhibition of Sideroflexin 2 (SFXN2, Accession NP_849189.1). Accordingly, utilities of GAM189 include diagnosis, prevention and treatment of diseases and clinical conditions associated with SFXN2.

Sh3 domain binding glutamic acid-rich protein like 2 (SH3BGRL2, Accession NP_113657.1) is another GAM189 target gene, herein designated TARGET GENE. SH3BGRL2 BINDING SITE is a target binding site found in the 3' untranslated region of mRNA encoded by SH3BGRL2, corresponding to a target binding site such as BINDING SITE I, BINDING SITE II or BINDING SITE III of FIG. 8. Table 4 illustrates the complementarity of the nucleotide sequences of SH3BGRL2 BINDING SITE, designated SEQ ID:2741, to the nucleotide sequence of GAM189 RNA, herein designated GAM RNA, also designated SEQ ID:246.

Another function of GAM189 is therefore inhibition of Sh3 domain binding glutamic acid-rich protein like 2 (SH3BGRL2, Accession NP_113657.1). Accordingly, utilities of GAM189 include diagnosis, prevention and treatment of diseases and clinical conditions associated with SH3BGRL2.

Sh3-domain binding protein 2 (SH3BP2, Accession NP_003014.2) is another GAM189 target gene, herein designated TARGET GENE. SH3BP2 BINDING SITE1 through SH3BP2 BINDING SITE3 are target binding sites found in untranslated regions of mRNA encoded by SH3BP2, corresponding to target binding sites such as BINDING SITE I, BINDING SITE II or BINDING SITE III of FIG. 8. Table 4 illustrates the complementarity of the nucleotide sequences of SH3BP2 BINDING SITE1 through SH3BP2 BINDING SITE3, designated SEQ ID:3836, SEQ ID:9440 and SEQ ID:1122 respectively, to the nucleotide sequence of GAM189 RNA, herein designated GAM RNA, also designated SEQ ID:246.

Another function of GAM189 is therefore inhibition of Sh3-domain binding protein 2 (SH3BP2, Accession NP_003014.2). Accordingly, utilities of GAM189 include diagnosis, prevention and treatment of diseases and clinical conditions associated with SH3BP2.

Short stature homeobox (SHOX, Accession NP_006874.1) is another GAM189 target gene, herein designated TARGET GENE. SHOX BINDING SITE is a target binding site found in the 3' untranslated region of multiple transcripts of mRNA encoded by SHOX, corresponding to a target binding site such as BINDING SITE I, BINDING SITE II or BINDING SITE III of FIG. 8. Table 4 illustrates the complementarity of the nucleotide sequences of SHOX BINDING SITE, designated SEQ ID:4375, to the nucleotide sequence of GAM189 RNA, herein designated GAM RNA, also designated SEQ ID:246.

Another function of GAM189 is therefore inhibition of Short stature homeobox (SHOX, Accession NP_006874.1). Accordingly, utilities of GAM189 include diagnosis, prevention and treatment of diseases and clinical conditions associated with SHOX.

Sialic acid binding ig-like lectin 8 (SIGLEC8, Accession NP_055257.1) is another GAM189 target gene, herein designated TARGET GENE. SIGLEC8 BINDING SITE is a target binding site found in the 3' untranslated region of mRNA encoded by SIGLEC8, corresponding to a target binding site such as BINDING SITE I, BINDING SITE II or BINDING SITE III of FIG. 8. Table 4 illustrates the complementarity of the nucleotide sequences of SIGLEC8 BINDING SITE, designated SEQ ID:4513, to the nucleotide sequence of GAM189 RNA, herein designated GAM RNA, also designated SEQ ID:246.

Another function of GAM189 is therefore inhibition of Sialic acid binding ig-like lectin 8 (SIGLEC8, Accession NP_055257.1), a gene which is a cell adhesion molecule for postnatal neural development. Accordingly, utilities of GAM189 include diagnosis, prevention and treatment of diseases and clinical conditions associated with SIGLEC8.

The function of SIGLEC8 and its association with various diseases and clinical conditions, has been established by previous studies, as described hereinabove with reference to GAM63.1. Tal1 (scl) interrupting locus (SIL, Accession NP_003026.1) is another GAM189 target gene, herein designated TARGET GENE. SIL BINDING SITE is a target binding site found in the 3' untranslated region of mRNA encoded by SIL, corresponding to a target binding site such as BINDING SITE I, BINDING SITE II or BINDING SITE III of FIG. 8. Table 4 illustrates the complementarity of the nucleotide sequences of SIL BINDING SITE, designated SEQ ID:12411, to the nucleotide sequence of GAM189 RNA, herein designated GAM RNA, also designated SEQ ID:246.

Another function of GAM189 is therefore inhibition of Tal1 (scl) interrupting locus (SIL, Accession NP_003026.1), a gene which may be required for axial development and left-right specification and therefore may be associated with Prominent midline neural tube defects, abnormal left-right development. Accordingly, utilities of GAM189 include diagnosis, prevention and treatment of Prominent midline neural tube defects, abnormal left-right development, and of other diseases and clinical conditions associated with SIL.

The function of SIL and its association with various diseases and clinical conditions, has been established by previous studies, as described hereinabove with reference to GAM30.1. Signal-regulatory protein beta 1 (SIRPB1, Accession NP_006056.1) is another GAM189 target gene, herein designated TARGET GENE. SIRPB1 BINDING SITE is a target binding site found in the 3' untranslated region of mRNA encoded by SIRPB1, corresponding to a target binding site such as BINDING SITE I, BINDING SITE II or BINDING SITE III of FIG. 8. Table 4 illustrates the complementarity of the nucleotide sequences of SIRPB1 BINDING SITE, designated SEQ ID:14771, to the nucleotide sequence of GAM189 RNA, herein designated GAM RNA, also designated SEQ ID:246.

Another function of GAM189 is therefore inhibition of Signal-regulatory protein beta 1 (SIRPB1, Accession NP_006056.1). Accordingly, utilities of GAM189 include diagnosis, prevention and treatment of diseases and clinical conditions associated with SIRPB1.

Src-like-adaptor 2 (SLA2, Accession NP_115590.1) is another GAM189 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:19573, to the nucleotide sequence of GAM189 RNA, herein designated GAM RNA, also designated SEQ ID:246.

Another function of GAM189 is therefore inhibition of Src-like-adaptor 2 (SLA2, Accession NP_115590.1). Accordingly, utilities of GAM189 include diagnosis, prevention and treatment of diseases and clinical conditions associated with SLA2.

Src-like-adaptor 2 (SLA2, Accession NP_778252.1) is another GAM189 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:19573, to the nucleotide sequence of GAM189 RNA, herein designated GAM RNA, also designated SEQ ID:246.

Another function of GAM189 is therefore inhibition of Src-like-adaptor 2 (SLA2, Accession NP_778252.1). Accordingly, utilities of GAM189 include diagnosis, prevention and treatment of diseases and clinical conditions associated with SLA2.

Solute carrier family 12 (potassium/chloride transporters), member 8 (SLC12A8, Accession NP_078904.1) is another GAM189 target gene, herein designated TARGET GENE. SLC12A8 BINDING SITE is a target binding site found in the 3' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:5190, to the nucleotide sequence of GAM189 RNA, herein designated GAM RNA, also designated SEQ ID:246.

Another function of GAM189 is therefore inhibition of Solute carrier family 12 (potassium/chloride transporters), member 8 (SLC12A8, Accession NP_078904.1). Accordingly, utilities of GAM189 include diagnosis, prevention and treatment of diseases and clinical conditions associated with SLC12A8.

Solute carrier family 13 (sodium/sulfate symporters), member 1 (SLC13A1, Accession NP_071889.2) is another GAM189 target gene, herein designated TARGET GENE. SLC13A1 BINDING SITE is a target binding site found in the 3' untranslated region of mRNA encoded by SLC13A1, corresponding to a target binding site such as BINDING SITE I, BINDING SITE II or BINDING SITE III of FIG. 8. Table 4 illustrates the complementarity of the nucleotide sequences of SLC13A1 BINDING SITE, designated SEQ ID:4370, to the nucleotide sequence of GAM189 RNA, herein designated GAM RNA, also designated SEQ ID:246.

Another function of GAM189 is therefore inhibition of Solute carrier family 13 (sodium/sulfate symporters), member 1 (SLC13A1, Accession NP_071889.2). Accordingly, utilities of GAM189 include diagnosis, prevention and treatment of diseases and clinical conditions associated with SLC13A1.

Solute carrier family 14 (urea transporter), member 2 (SLC14A2, Accession NP_009094.2) is another GAM189 target gene, herein designated TARGET GENE. SLC14A2 BINDING SITE is a target binding site found in the 5' untranslated region of mRNA encoded by SLC14A2, corresponding to a target binding site such as BINDING SITE I, BINDING SITE II or BINDING SITE III of FIG. 8. Table 4 illustrates the complementarity of the nucleotide sequences of SLC14A2 BINDING SITE, designated SEQ ID:4514, to the nucleotide sequence of GAM189 RNA, herein designated GAM RNA, also designated SEQ ID:246.

Another function of GAM189 is therefore inhibition of Solute carrier family 14 (urea transporter), member 2 (SLC14A2, Accession NP_009094.2), a gene which is a renal urea transporter 2. and therefore may be associated with Orthostatic hypotension. Accordingly, utilities of GAM189 include diagnosis, prevention and treatment of Orthostatic hypotension, and of other diseases and clinical conditions associated with SLC14A2.

The function of SLC14A2 and its association with various diseases and clinical conditions, has been established by previous studies, as described hereinabove with reference to GAM97.1. Solute carrier family 15 (oligopeptide transporter), member 1 (SLC15A1, Accession NP_005064.1) is another GAM189 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:18930, to the nucleotide sequence of GAM189 RNA, herein designated GAM RNA, also designated SEQ ID:246.

Another function of GAM189 is therefore inhibition of Solute carrier family 15 (oligopeptide transporter), member 1 (SLC15A1, Accession NP_005064.1), a gene which is a H(+)-coupled peptide transporter. Accordingly, utilities of GAM189 include diagnosis, prevention and treatment of diseases and clinical conditions associated with SLC15A1.

The function of SLC15A1 and its association with various diseases and clinical conditions, has been established by previous studies, as described hereinabove with reference to GAM30.1. Solute carrier family 16 (monocarboxylic acid transporters), member 4 (SLC16A4, Accession NP_004687.1) is another GAM189 target gene, herein designated TARGET GENE. SLC16A4 BINDING SITE is a target binding site found in the 3' untranslated region of mRNA encoded by SLC16A4, corresponding to a target binding site such as BINDING SITE I, BINDING SITE II or BINDING SITE III of FIG. 8. Table 4 illustrates the complementarity of the nucleotide sequences of SLC16A4 BINDING SITE, designated SEQ ID:611, to the nucleotide sequence of GAM189 RNA, herein designated GAM RNA, also designated SEQ ID:246.

Another function of GAM189 is therefore inhibition of Solute carrier family 16 (monocarboxylic acid transporters), member 4 (SLC16A4, Accession NP_004687.1). Accordingly, utilities of GAM189 include diagnosis, prevention and treatment of diseases and clinical conditions associated with SLC16A4.

Solute carrier family 19, member 3 (SLC19A3, Accession NP_079519.1) is another GAM189 target gene, herein designated TARGET GENE. SLC19A3 BINDING SITE is a target binding site found in the 3' untranslated region of mRNA encoded by SLC19A3, corresponding to a target binding site such as BINDING SITE I, BINDING SITE II or BINDING SITE III of FIG. 8. Table 4 illustrates the complementarity of the nucleotide sequences of SLC19A3 BINDING SITE, designated SEQ ID:6713, to the nucleotide sequence of GAM189 RNA, herein designated GAM RNA, also designated SEQ ID:246.

Another function of GAM189 is therefore inhibition of Solute carrier family 19, member 3 (SLC19A3, Accession NP_079519.1). Accordingly, utilities of GAM189 include diagnosis, prevention and treatment of diseases and clinical conditions associated with SLC19A3.

Solute carrier family 1 (neutral amino acid transporter), member 5 (SLC1A5, Accession NP_005619.1) is another GAM189 target gene, herein designated TARGET GENE. SLC1A5 BINDING SITE is a target binding site found in the 3' untranslated region of mRNA encoded by SLC1A5, corresponding to a target binding site such as BINDING SITE I, BINDING SITE II or BINDING SITE III of FIG. 8. Table 4 illustrates the complementarity of the nucleotide sequences of SLC1A5 BINDING SITE, designated SEQ ID:1277, to the nucleotide sequence of GAM189 RNA, herein designated GAM RNA, also designated SEQ ID:246.

Another function of GAM189 is therefore inhibition of Solute carrier family 1 (neutral amino acid transporter), member 5 (SLC1A5, Accession NP_005619.1). Accordingly, utilities of GAM189 include diagnosis, prevention and treatment of diseases and clinical conditions associated with SLC1A5.

Solute carrier family 24 (sodium/potassium/calcium exchanger), member 1 (SLC24A1, Accession NP_004718.1) is another GAM189 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:10966, to the nucleotide sequence of GAM189 RNA, herein designated GAM RNA, also designated SEQ ID:246.

Another function of GAM189 is therefore inhibition of Solute carrier family 24 (sodium/potassium/calcium exchanger), member 1 (SLC24A1, Accession NP_004718.1), a gene which is a critical component of the visual transduction cascade, controlling the calcium concentration of outer segments during light and darkness. Accordingly, utilities of GAM189 include diagnosis, prevention and treatment of diseases and clinical conditions associated with SLC24A1.

The function of SLC24A1 and its association with various diseases and clinical conditions, has been established by previous studies, as described hereinabove with reference to GAM130.1. SLC30A5 (Accession NP_076960.1) is another GAM189 target gene, herein designated TARGET GENE. SLC30A5 BINDING SITE is a target binding site found in the 3' untranslated region of multiple transcripts of mRNA encoded by SLC30A5, corresponding to a target binding site such as BINDING SITE I, BINDING SITE II or BINDING SITE III of FIG. 8. Table 4 illustrates the complementarity of the nucleotide sequences of SLC30A5 BINDING SITE, designated SEQ ID:3692, to the nucleotide sequence of GAM189 RNA, herein designated GAM RNA, also designated SEQ ID:246.

Another function of GAM189 is therefore inhibition of SLC30A5 (Accession NP_076960.1). Accordingly, utilities of GAM189 include diagnosis, prevention and treatment of diseases and clinical conditions associated with SLC30A5.

SLC30A6 (Accession NP_060434.2) is another GAM189 target gene, herein designated TARGET GENE. SLC30A6 BINDING SITE is a target binding site found in the 3' untranslated region of mRNA encoded by SLC30A6, corresponding to a target binding site such as BINDING SITE I, BINDING SITE II or BINDING SITE III of FIG. 8. Table 4 illustrates the complementarity of the nucleotide sequences of SLC30A6 BINDING SITE, designated SEQ ID:5362, to the nucleotide sequence of GAM189 RNA, herein designated GAM RNA, also designated SEQ ID:246.

Another function of GAM189 is therefore inhibition of SLC30A6 (Accession NP_060434.2). Accordingly, utilities of GAM189 include diagnosis, prevention and treatment of diseases and clinical conditions associated with SLC30A6.

SLC35E2 (Accession XP_049733.6) is another GAM189 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:13336, to the nucleotide sequence of GAM189 RNA, herein designated GAM RNA, also designated SEQ ID:246.

Another function of GAM189 is therefore inhibition of SLC35E2 (Accession XP_049733.6). Accordingly, utilities of GAM189 include diagnosis, prevention and treatment of diseases and clinical conditions associated with SLC35E2.

Solute carrier family 39 (zinc transporter), member 1 (SLC39A1, Accession NP_055252.2) is another GAM189 target gene, herein designated TARGET GENE. SLC39A1 BINDING SITE is a target binding site found in the 5' untranslated region of mRNA encoded by SLC39A1, corresponding to a target binding site such as BINDING SITE I, BINDING SITE II or BINDING SITE III of FIG. 8. Table 4 illustrates the complementarity of the nucleotide sequences of SLC39A1 BINDING SITE, designated SEQ ID:9528, to the nucleotide sequence of GAM189 RNA, herein designated GAM RNA, also designated SEQ ID:246.

Another function of GAM189 is therefore inhibition of Solute carrier family 39 (zinc transporter), member 1 (SLC39A1, Accession NP_055252.2), a gene which is a divalent (zinc/iron) metal ion transporter. Accordingly, utilities of GAM189 include diagnosis, prevention and treatment of diseases and clinical conditions associated with SLC39A1.

The function of SLC39A1 and its association with various diseases and clinical conditions, has been established by previous studies, as described hereinabove with reference to GAM175.1. Solute carrier family 4, sodium bicarbonate transporter-like, member 11 (SLC4A11, Accession NP_114423.1) is another GAM189 target gene, herein designated TARGET GENE. SLC4A11 BINDING SITE is a target binding site found in the 3' untranslated region of mRNA encoded by SLC4A11, corresponding to a target binding site such as BINDING SITE I, BINDING SITE II or BINDING SITE III of FIG. 8. Table 4 illustrates the complementarity of the nucleotide sequences of SLC4A11 BINDING SITE, designated SEQ ID:806, to the nucleotide sequence of GAM189 RNA, herein designated GAM RNA, also designated SEQ ID:246.

Another function of GAM189 is therefore inhibition of Solute carrier family 4, sodium bicarbonate transporter-like, member 11 (SLC4A11, Accession NP_114423.1). Accordingly, utilities of GAM189 include diagnosis, prevention and treatment of diseases and clinical conditions associated with SLC4A11.

Solute carrier family 5 (sodium/glucose cotransporter), member 1 (SLC5A1, Accession NP_000334.1) is another GAM189 target gene, herein designated TARGET GENE. SLC5A1 BINDING SITE is a target binding site found in the 3' untranslated region of mRNA encoded by SLC5A1, corresponding to a target binding site such as BINDING SITE I, BINDING SITE II or BINDING SITE III of FIG. 8. Table 4 illustrates the complementarity of the nucleotide sequences of SLC5A1 BINDING SITE, designated SEQ ID:2571, to the nucleotide sequence of GAM189 RNA, herein designated GAM RNA, also designated SEQ ID:246.

Another function of GAM189 is therefore inhibition of Solute carrier family 5 (sodium/glucose cotransporter), member 1 (SLC5A1, Accession NP_000334.1). Accordingly, utilities of GAM189 include diagnosis, prevention and treatment of diseases and clinical conditions associated with SLC5A1.

Solute carrier family 6 (neurotransmitter transporter), member 14 (SLC6A14, Accession NP_009162.1) is another GAM189 target gene, herein designated TARGET GENE. SLC6A14 BINDING SITE is a target binding site found in the 3' untranslated region of mRNA encoded by SLC6A14, corresponding to a target binding site such as BINDING SITE I, BINDING SITE II or BINDING SITE III of FIG. 8. Table 4 illustrates the complementarity of the nucleotide sequences of SLC6A14 BINDING SITE, designated SEQ ID:13830, to the nucleotide sequence of GAM189 RNA, herein designated GAM RNA, also designated SEQ ID:246.

Another function of GAM189 is therefore inhibition of Solute carrier family 6 (neurotransmitter transporter), member 14 (SLC6A14, Accession NP_009162.1). Accordingly, utilities of GAM189 include diagnosis, prevention and treatment of diseases and clinical conditions associated with SLC6A14.

Solute carrier family 6 (neurotransmitter transporter, dopamine), member 3 (SLC6A3, Accession NP_001035.1) is another GAM189 target gene, herein designated TARGET GENE. SLC6A3 BINDING SITE is a target binding site found in the 3' untranslated region of mRNA encoded by SLC6A3, corresponding to a target binding site such as BINDING SITE I, BINDING SITE II or BINDING SITE III of FIG. 8. Table 4 illustrates the complementarity of the nucleotide sequences of SLC6A3 BINDING SITE, designated SEQ ID:12941, to the nucleotide sequence of GAM189 RNA, herein designated GAM RNA, also designated SEQ ID:246.

Another function of GAM189 is therefore inhibition of Solute carrier family 6 (neurotransmitter transporter, dopamine), member 3 (SLC6A3, Accession NP_001035.1), a gene which terminates the action of dopamine by its high affinity sodium-dependent reuptake into presynaptic terminals. Accordingly, utilities of GAM189 include diagnosis, prevention and treatment of diseases and clinical conditions associated with SLC6A3.

The function of SLC6A3 has been established by previous studies. Giros et al. (1996) found that the disruption of the mouse dopamine transporter gene results in spontaneous hyperlocomotion despite major adaptive changes such as decreases in neurotransmitter and receptor levels. In homozygous mice, dopamine persisted at least 100 times longer in the extracellular space, providing a biochemical explanation of the hyperdopaminergic phenotype and demonstrating the critical role of the transporter in regulating neurotransmission. The authors noted that the dopamine transporter is an obligatory target of cocaine and amphetamine, as demonstrated by the fact that these psychostimulants had no effect on locomotor activity or dopamine release and uptake in mice lacking the transporter. Giros et al. (1996) stated that the DAT knockout mice should be an excellent tool for the study and development of drugs used in the management of dopaminergic dysfunction. There are similarities between the hyperdopaminergic phenotype of the knockout mice and some of the positive symptoms of schizophrenic patients. Specific blockade of the dopamine transporter with high-affinity inhibitors may be beneficial in illnesses such as Parkinson disease, where the effective levels of dopamine are markedly reduced.

Full details of the abovementioned studies are described in the following publications, the disclosure of which are hereby incorporated by reference:

Gainetdinov, R. R.; Wetsel, W. C.; Jones, S. R.; Levin, E. D.; Jaber, M.; Caron, M. G.: Role of serotonin in the paradoxical calming effect of psychostimulants on hyperactivity. Science 283:397-401, 1999; and Giros, B.; Jaber, M.; Jones, S. R.; Wightman, R. M.; Caron, M. G.: Hyperlocomotion and indifference to cocaine and amphetamine in mice lacking the dopamine receptor. Nature 370:606-612, 1.

Further studies establishing the function and utilities of SLC6A3 are found in John Hopkins OMIM database record ID 126455, and in cited publications listed in Table 5, which are hereby incorporated by reference. SMAC (Accession NP_620308.1) is another GAM189 target gene, herein designated TARGET GENE. SMAC BINDING SITE1 and SMAC BINDING SITE2 are target binding sites found in untranslated regions of multiple transcripts of mRNA encoded by SMAC, corresponding to target binding sites such as BINDING SITE I, BINDING SITE II or BINDING SITE III of FIG. 8. Table 4 illustrates the complementarity of the nucleotide sequences of SMAC BINDING SITE1 and SMAC BINDING SITE2, designated SEQ ID:18165 and SEQ ID:1861 respectively, to the nucleotide sequence of GAM189 RNA, herein designated GAM RNA, also designated SEQ ID:246.

Another function of GAM189 is therefore inhibition of SMAC (Accession NP_620308.1), a gene which promotes apoptosis via caspase activation. Accordingly, utilities of GAM189 include diagnosis, prevention and treatment of diseases and clinical conditions associated with SMAC.

The function of SMAC and its association with various diseases and clinical conditions, has been established by previous studies, as described hereinabove with reference to GAM136.1. Synaptosomal-associated protein, 23 kda (SNAP23, Accession NP_570710.1) is another GAM189 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:19007, to the nucleotide sequence of GAM189 RNA, herein designated GAM RNA, also designated SEQ ID:246.

Another function of GAM189 is therefore inhibition of Synaptosomal-associated protein, 23 kda (SNAP23, Accession NP_570710.1), a gene which is essential component of the high affinity receptor for the general membrane fusion machinery. Accordingly, utilities of GAM189 include diagnosis, prevention and treatment of diseases and clinical conditions associated with SNAP23.

The function of SNAP23 and its association with various diseases and clinical conditions, has been established by previous studies, as described hereinabove with reference to GAM30.1. Synaptosomal-associated protein, 23 kda (SNAP23, Accession NP_003816.2) is another GAM189 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:19007, to the nucleotide sequence of GAM189 RNA, herein designated GAM RNA, also designated SEQ ID:246.

Another function of GAM189 is therefore inhibition of Synaptosomal-associated protein, 23 kda (SNAP23, Accession NP_003816.2), a gene which is essential component of the high affinity receptor for the general membrane fusion machinery. Accordingly, utilities of GAM189 include diagnosis, prevention and treatment of diseases and clinical conditions associated with SNAP23.

The function of SNAP23 and its association with various diseases and clinical conditions, has been established by previous studies, as described hereinabove with reference to GAM30.1. SNARK (Accession NP_112214.1) is another GAM189 target gene, herein designated TARGET GENE. SNARK BINDING SITE is a target binding site found in the 3' untranslated region of mRNA encoded by SNARK, corresponding to a target binding site such as BINDING SITE I, BINDING SITE II or BINDING SITE III of FIG. 8. Table 4 illustrates the complementarity of the nucleotide sequences of SNARK BINDING SITE, designated SEQ ID:18622, to the nucleotide sequence of GAM189 RNA, herein designated GAM RNA, also designated SEQ ID:246.

Another function of GAM189 is therefore inhibition of SNARK (Accession NP_112214.1). Accordingly, utilities of GAM189 include diagnosis, prevention and treatment of diseases and clinical conditions associated with SNARK.

Syntaphilin (SNPH, Accession NP_055538.1) is another GAM189 target gene, herein designated TARGET GENE. SNPH BINDING SITE is a target binding site found in the 3' untranslated region of mRNA encoded by SNPH, corresponding to a target binding site such as BINDING SITE I, BINDING SITE II or BINDING SITE III of FIG. 8. Table 4 illustrates the complementarity of the nucleotide sequences of SNPH BINDING SITE, designated SEQ ID:15041, to the nucleotide sequence of GAM189 RNA, herein designated GAM RNA, also designated SEQ ID:246.

Another function of GAM189 is therefore inhibition of Syntaphilin (SNPH, Accession NP_055538.1). Accordingly, utilities of GAM189 include diagnosis, prevention and treatment of diseases and clinical conditions associated with SNPH.

Sorting nexin 15 (SNX15, Accession NP_037438.2) is another GAM189 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:7625, to the nucleotide sequence of GAM189 RNA, herein designated GAM RNA, also designated SEQ ID:246.

Another function of GAM189 is therefore inhibition of Sorting nexin 15 (SNX15, Accession NP_037438.2). Accordingly, utilities of GAM189 include diagnosis, prevention and treatment of diseases and clinical conditions associated with SNX15.

Sorting nexin 15 (SNX15, Accession NP_680086.1) is another GAM189 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:7625, to the nucleotide sequence of GAM189 RNA, herein designated GAM RNA, also designated SEQ ID:246.

Another function of GAM189 is therefore inhibition of Sorting nexin 15 (SNX15, Accession NP_680086.1). Accordingly, utilities of GAM189 include diagnosis, prevention and treatment of diseases and clinical conditions associated with SNX15.

SNX22 (Accession NP_079074.1) is another GAM189 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:13596, to the nucleotide sequence of GAM189 RNA, herein designated GAM RNA, also designated SEQ ID:246.

Another function of GAM189 is therefore inhibition of SNX22 (Accession NP_079074.1). Accordingly, utilities of GAM189 include diagnosis, prevention and treatment of diseases and clinical conditions associated with SNX22.

SNX27 (Accession NP_112180.4) is another GAM189 target gene, herein designated TARGET GENE. SNX27 BINDING SITE is a target binding site found in the 3' untranslated region of mRNA encoded by SNX27, corresponding to a target binding site such as BINDING SITE I, BINDING SITE II or BINDING SITE III of FIG. 8. Table 4 illustrates the complementarity of the nucleotide sequences of SNX27 BINDING SITE, designated SEQ ID:16941, to the nucleotide sequence of GAM189 RNA, herein designated GAM RNA, also designated SEQ ID:246.

Another function of GAM189 is therefore inhibition of SNX27 (Accession NP_112180.4). Accordingly, utilities of GAM189 include diagnosis, prevention and treatment of diseases and clinical conditions associated with SNX27.

Sialophorin (gpl115, leukosialin, cd43) (SPN, Accession NP_003114.1) is another GAM189 target gene, herein designated TARGET GENE. SPN BINDING SITE is a target binding site found in the 3' untranslated region of mRNA encoded by SPN, corresponding to a target binding site such as BINDING SITE I, BINDING SITE II or BINDING SITE III of FIG. 8. Table 4 illustrates the complementarity of the nucleotide sequences of SPN BINDING SITE, designated SEQ ID:16209, to the nucleotide sequence of GAM189 RNA, herein designated GAM RNA, also designated SEQ ID:246.

Another function of GAM189 is therefore inhibition of Sialophorin (gpl115, leukosialin, cd43) (SPN, Accession NP_003114.1), a gene which plays a role in the physicochemical properties of the t-cell surface and in lectin binding. presents carbohydrate ligands to selectins. . and therefore may be associated with Wiskott-aldrich syndrome. Accordingly, utilities of GAM189 include diagnosis, prevention and treatment of Wiskott-aldrich syndrome, and of other diseases and clinical conditions associated with SPN.

The function of SPN and its association with various diseases and clinical conditions, has been established by previous studies, as described hereinabove with reference to GAM130.1. Speckle-type poz protein (SPOP, Accession NP_003554.1) is another GAM189 target gene, herein designated TARGET GENE. SPOP BINDING SITE is a target binding site found in the 5' untranslated region of mRNA encoded by SPOP, corresponding to a target binding site such as BINDING SITE I, BINDING SITE II or BINDING SITE III of FIG. 8. Table 4 illustrates the complementarity of the nucleotide sequences of SPOP BINDING SITE, designated SEQ ID:5610, to the nucleotide sequence of GAM189 RNA, herein designated GAM RNA, also designated SEQ ID:246.

Another function of GAM189 is therefore inhibition of Speckle-type poz protein (SPOP, Accession NP_003554.1). Accordingly, utilities of GAM189 include diagnosis, prevention and treatment of diseases and clinical conditions associated with SPOP.

SQV7L (Accession XP_047287.1) is another GAM189 target gene, herein designated TARGET GENE. SQV7L BINDING SITE is a target binding site found in the 5' untranslated region of mRNA encoded by SQV7L, corresponding to a target binding site such as BINDING SITE I, BINDING SITE II or BINDING SITE III of FIG. 8. Table 4 illustrates the complementarity of the nucleotide sequences of SQV7L BINDING SITE, designated SEQ ID:7375, to the nucleotide sequence of GAM189 RNA, herein designated GAM RNA, also designated SEQ ID:246.

Another function of GAM189 is therefore inhibition of SQV7L (Accession XP_047287.1). Accordingly, utilities of GAM189 include diagnosis, prevention and treatment of diseases and clinical conditions associated with SQV7L.

Sarcalumenin (SRL, Accession XP_064152.3) is another GAM189 target gene, herein designated TARGET GENE. SRL BINDING SITE is a target binding site found in the 3' untranslated region of mRNA encoded by SRL, corresponding to a target binding site such as BINDING SITE I, BINDING SITE II or BINDING SITE III of FIG. 8. Table 4 illustrates the complementarity of the nucleotide sequences of SRL BINDING SITE, designated SEQ ID:6681, to the nucleotide sequence of GAM189 RNA, herein designated GAM RNA, also designated SEQ ID:246.

Another function of GAM189 is therefore inhibition of Sarcalumenin (SRL, Accession XP_064152.3). Accordingly, utilities of GAM189 include diagnosis, prevention and treatment of diseases and clinical conditions associated with SRL.

Serine/arginine repetitive matrix 2 (SRRM2, Accession NP_057417.2) is another GAM189 target gene, herein designated TARGET GENE. SRRM2 BINDING SITE is a target binding site found in the 5' untranslated region of mRNA encoded by SRRM2, corresponding to a target binding site such as BINDING SITE I, BINDING SITE II or BINDING SITE III of FIG. 8. Table 4 illustrates the complementarity of the nucleotide sequences of SRRM2 BINDING SITE, designated SEQ ID:18975, to the nucleotide sequence of GAM189 RNA, herein designated GAM RNA, also designated SEQ ID:246.

Another function of GAM189 is therefore inhibition of Serine/arginine repetitive matrix 2 (SRRM2, Accession NP_057417.2), a gene which RELATED NUCLEAR MATRIX PROTEIN. Accordingly, utilities of GAM189 include diagnosis, prevention and treatment of diseases and clinical conditions associated with SRRM2.

The function of SRRM2 has been established by previous studies. For background information on SRM proteins, see SRM160 (OMIM Ref. No. 605975). By biochemical purification, micropeptide sequence analysis, EST database searching, and screening a monocytoid cDNA library, Blencowe et al. (2000) isolated a cDNA encoding SRM300. Like SRM160, the deduced 2,296-amino acid SRM300 protein is rich in serine (S), arginine (R), and proline (P), has numerous SR dipeptides and 2 long polyserine domains, and lacks an RNA recognition domain. A portion of the SRM300 protein is identical to a partial protein, KIAA0324, identified by Nagase et al. (1997). By RT-PCR analysis, Nagase et al. (1997) detected ubiquitous expression of KIAA0324. Using immunoblot and immunoprecipitation analyses and confocal microscopy, Blencowe et al. (2000) confirmed that SRM300 associates with SRM160 and pre-mRNA and is localized in nuclear speckles. Reconstitution of SRM160/SRM300-depleted splicing reactions with recombinant SRM160 restored splicing activity, suggesting that SRM160 is the more important component of the complex. By screening a cDNA library for RNA ligands, Sawada et al. (2000) identified a cDNA encoding SRM300, which they termed SRL300. The deduced 2,752-amino acid protein has multiple R, S, and P residues, numerous phosphorylation sites, and a predicted molecular mass of 300 kD, suggesting that it may be the full-length protein. Immunoblot analysis detected GST fusion proteins of greater than 300 kD in human and rat cells. Northern blot analysis revealed expression of a 9.0- to 10.0-kb SRL300 transcript in all tissues and cell lines tested. By radiation hybrid analysis, Nagase et al. (1997) mapped the SRM300 gene, or KIAA0324, to chromosome 16. By genomic sequence analysis, Blencowe et al. (2000) mapped the SRM300 gene to chromosome 16.

Full details of the abovementioned studies are described in the following publications, the disclosure of which are hereby incorporated by reference:

Blencowe, B. J.; Bauren, G.; Eldridge, A. G.; Issner, R.; Nickerson, J. A.; Rosonina, E.; Sharp, P. A.: The SRm160/300 splicing coactivator subunits. RNA 6:111-120, 2000; and Sawada, Y.; Miura, Y.; Umeki, K.; Tamaoki, T.; Fujinaga, K.; Ohtaki, S.: Cloning and characterization of a novel RNA-binding protein SRL300 with RS domains. Biochim. Biophys. Acta 1492.

Further studies establishing the function and utilities of SRRM2 are found in John Hopkins OMIM database record ID 606032, and in cited publications listed in Table 5, which are hereby incorporated by reference. Synovial sarcoma translocation, chromosome 18 (SS18, Accession NP_005628.1) is another GAM189 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:17762, to the nucleotide sequence of GAM189 RNA, herein designated GAM RNA, also designated SEQ ID:246.

Another function of GAM189 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM189 include diagnosis, prevention and treatment of Human synovial sarcomas, and of other diseases and clinical conditions associated with SS18.

The function of SS18 and its association with various diseases and clinical conditions, has been established by previous studies, as described hereinabove with reference to GAM130.1. STAF65(gamma) (Accession NP_055675.1) is another GAM189 target gene, herein designated TARGET GENE. STAF65(gamma) BINDING SITE is a target binding site found in the 3' untranslated region of mRNA encoded by STAF65(gamma), corresponding to a target binding site such as BINDING SITE I, BINDING SITE II or BINDING SITE III of FIG. 8. Table 4 illustrates the complementarity of the nucleotide sequences of STAF65(gamma) BINDING SITE, designated SEQ ID:2196, to the nucleotide sequence of GAM189 RNA, herein designated GAM RNA, also designated SEQ ID:246.

Another function of GAM189 is therefore inhibition of STAF65(gamma) (Accession NP_055675.1). Accordingly, utilities of GAM189 include diagnosis, prevention and treatment of diseases and clinical conditions associated with STAF65(gamma).

Staufen, rna binding protein (drosophila) (STAU, Accession NP_004593.1) is another GAM189 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:3950, to the nucleotide sequence of GAM189 RNA, herein designated GAM RNA, also designated SEQ ID:246.

Another function of GAM189 is therefore inhibition of Staufen, rna binding protein (drosophila) (STAU, Accession NP_004593.1), a gene which may play a role in specific positioning of mrnas at given sites in the cell and in stimulating their translation at the site. Accordingly, utilities of GAM189 include diagnosis, prevention and treatment of diseases and clinical conditions associated with STAU.

The function of STAU and its association with various diseases and clinical conditions, has been established by previous studies, as described hereinabove with reference to GAM37.1. Sulfotransferase, estrogen-preferring (STE, Accession NP_005411.1) is another GAM189 target gene, herein designated TARGET GENE. STE BINDING SITE is a target binding site found in the 3' untranslated region of mRNA encoded by STE, corresponding to a target binding site such as BINDING SITE I, BINDING SITE II or BINDING SITE III of FIG. 8. Table 4 illustrates the complementarity of the nucleotide sequences of STE BINDING SITE, designated SEQ ID:3303, to the nucleotide sequence of GAM189 RNA, herein designated GAM RNA, also designated SEQ ID:246.

Another function of GAM189 is therefore inhibition of Sulfotransferase, estrogen-preferring (STE, Accession NP_005411.1), a gene which sulfates estrone and dehydroepiandrosterone, but not dopamine. Accordingly, utilities of GAM189 include diagnosis, prevention and treatment of diseases and clinical conditions associated with STE.

The function of STE has been established by previous studies. Sulfation is an important pathway in the biotransformation of steroid hormones such as estrogens. Human liver contains 2 different types of sulfotransferases, dehydroepiandrosterone (DHEA) sulfotransferase (OMIM Ref. No. 125263) and phenol sulfotransferase (STP1; 171150). Aksoy et al. (1994) set out to test the possibility that human tissues may contain 1 or more estrogen sulfotransferases orthologous to the proteins encoded by EST cDNAs that had been cloned from other mammalian species. They succeeded in cloning a cDNA for human liver EST and studied selected properties of the protein that it encodes. Estrone sulfate is the predominant form of estrogen found in the circulation in women and could thus serve as precursor for active estrogens in target tissues by removal of the sulfate group through the action of endogenous steroid sulfatase. Bernier et al. (1994) used a cDNA encoding human placental estrogen sulfotransferase as a probe for isolating a clone containing almost the whole genomic sequence. The gene contains 9 short exons separated by 8 introns in an expanse of approximately 7.7 kb. The first 2 exons, named exon 1a and exon 1b, are noncoding and correspond to the 5-prime untranslated sequences of human brain and human placental estrogen sulfotransferase cDNAs, respectively. Transfection of chloramphenicol acetyltransferase reporter gene vectors containing the 5-prime flanking sequence upstream from exon 1a and exon 1b into human adrenal adenocarcinoma cells indicated that both sequences possess promoter activity. The results were interpreted as indicating that human brain aryl sulfotransferase and placental estrogen sulfotransferase mRNA species are transcribed from a single gene by alternate exon 1a and exon 1b promoters, respectively. Using DNA from panels of human-rodent somatic cell hybrids and amplification of the gene by PCR, Bernier et al. (1994) assigned the placental estrogen sulfotransferase gene to chromosome 16. On the other hand, Her et al. (1995) mapped liver estrogen sulfotransferase cDNA to 4q13.1 by fluorescence in situ hybridization, suggesting that these may be 2 separate genes. They found that the liver STE gene spans approximately 20 kb and consists of 8 exons, ranging in length from 95 to 181 bp. The locations of most exon-intron splice junctions within STE were identical to those found in a human phenol ST gene (STM; 600641). (The STM gene maps to chromosome 16p11.2. Indeed, STM is the same as the 'placental estrogen sulfotransferase' gene mapped by Bernier et al. (1994) to chromosome 16 (Weinshilboum, 1995).) In addition, the locations of 5 STE introns were conserved in the human DHEA-sulfotransferase gene, which is located on chromosome 19. Weinshilboum et al. (1997) reviewed the genes in the mouse corresponding to the sulfotransferase genes in the human. The Ste gene is located on mouse chromosome 5.

Full details of the abovementioned studies are described in the following publications, the disclosure of which are hereby incorporated by reference:

Aksoy, I. A.; Wood, T. C.; Weinshilboum, R.: Human liver estrogen sulfotransferase: identification by cDNA cloning and expression. Biochem. Biophys. Res. Commun. 200: 1621-1629, 1994; and Bernier, F.; Leblanc, G.; Labrie, F.; Luu-The, V.: Structure of human estrogen and aryl sulfotransferase gene: two mRNA species issued from a single gene. J. Biol. Chem. 269:28200-282.

Further studies establishing the function and utilities of STE are found in John Hopkins OMIM database record ID 600043, and in cited publications listed in Table 5, which are hereby incorporated by reference. Six transmembrane epithelial antigen of prostate 2 (STEAP2, Accession NP_694544.1) is another GAM189 target gene, herein designated TARGET GENE. STEAP2 BINDING SITE is a target binding site found in the 3' untranslated region of mRNA encoded by STEAP2, corresponding to a target binding site such as BINDING SITE I, BINDING SITE II or BINDING SITE III of FIG. 8. Table 4 illustrates the complementarity of the nucleotide sequences of STEAP2 BINDING SITE, designated SEQ ID:9147, to the nucleotide sequence of GAM189 RNA, herein designated GAM RNA, also designated SEQ ID:246.

Another function of GAM189 is therefore inhibition of Six transmembrane epithelial antigen of prostate 2 (STEAP2, Accession NP_694544.1). Accordingly, utilities of GAM189 include diagnosis, prevention and treatment of diseases and clinical conditions associated with STEAP2.

Stomatin (STOM, Accession NP_004090.3) is another GAM189 target gene, herein designated TARGET GENE. STOM BINDING SITE is a target binding site found in the 3' untranslated region of mRNA encoded by STOM, corresponding to a target binding site such as BINDING SITE I, BINDING SITE II or BINDING SITE III of FIG. 8. Table 4 illustrates the complementarity of the nucleotide sequences of STOM BINDING SITE, designated SEQ ID:2907, to the nucleotide sequence of GAM189 RNA, herein designated GAM RNA, also designated SEQ ID:246.

Another function of GAM189 is therefore inhibition of Stomatin (STOM, Accession NP_004090.3). Accordingly, utilities of GAM189 include diagnosis, prevention and treatment of diseases and clinical conditions associated with STOM.

Syntaxin 12 (STX12, Accession NP_803173.1) is another GAM189 target gene, herein designated TARGET GENE. STX12 BINDING SITE is a target binding site found in the 3' untranslated region of mRNA encoded by STX12, corresponding to a target binding site such as BINDING SITE I, BINDING SITE II or BINDING SITE III of FIG. 8. Table 4 illustrates the complementarity of the nucleotide sequences of STX12 BINDING SITE, designated SEQ ID:12575, to the nucleotide sequence of GAM189 RNA, herein designated GAM RNA, also designated SEQ ID:246.

Another function of GAM189 is therefore inhibition of Syntaxin 12 (STX12, Accession NP_803173.1). Accordingly, utilities of GAM189 include diagnosis, prevention and treatment of diseases and clinical conditions associated with STX12.

Synaptotagmin xi (SYT11, Accession NP_689493.2) is another GAM189 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:9033, to the nucleotide sequence of GAM189 RNA, herein designated GAM RNA, also designated SEQ ID:246.

Another function of GAM189 is therefore inhibition of Synaptotagmin xi (SYT11, Accession NP_689493.2). Accordingly, utilities of GAM189 include diagnosis, prevention and treatment of diseases and clinical conditions associated with SYT11.

Synaptotagmin xiii (SYT13, Accession NP_065877.1) is another GAM189 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:15294, to the nucleotide sequence of GAM189 RNA, herein designated GAM RNA, also designated SEQ ID:246.

Another function of GAM189 is therefore inhibition of Synaptotagmin xiii (SYT13, Accession NP_065877.1). Accordingly, utilities of GAM189 include diagnosis, prevention and treatment of diseases and clinical conditions associated with SYT13.

TADA3L (Accession NP_597814.1) is another GAM189 target gene, herein designated TARGET GENE. TADA3L BINDING SITE is a target binding site found in the 3' untranslated region of multiple transcripts of mRNA encoded by TADA3L, corresponding to a target binding site such as BINDING SITE I, BINDING SITE II or BINDING SITE III of FIG. 8. Table 4 illustrates the complementarity of the nucleotide sequences of TADA3L BINDING SITE, designated SEQ ID:9087, to the nucleotide sequence of GAM189 RNA, herein designated GAM RNA, also designated SEQ ID:246.

Another function of GAM189 is therefore inhibition of TADA3L (Accession NP_597814.1). Accordingly, utilities of GAM189 include diagnosis, prevention and treatment of diseases and clinical conditions associated with TADA3L.

T-cell acute lymphocytic leukemia 1 (TAL1, Accession NP_003180.1) is another GAM189 target gene, herein designated TARGET GENE. TAL1 BINDING SITE is a target binding site found in the 3' untranslated region of mRNA encoded by TAL1, corresponding to a target binding site such as BINDING SITE I, BINDING SITE II or BINDING SITE III of FIG. 8. Table 4 illustrates the complementarity of the nucleotide sequences of TAL1 BINDING SITE, designated SEQ ID:18260, to the nucleotide sequence of GAM189 RNA, herein designated GAM RNA, also designated SEQ ID:246.

Another function of GAM189 is therefore inhibition of T-cell acute lymphocytic leukemia 1 (TAL1, Accession NP_003180.1), a gene which may help control cell growth and differentiation. Accordingly, utilities of GAM189 include diagnosis, prevention and treatment of diseases and clinical conditions associated with TAL1.

The function of TAL1 and its association with various diseases and clinical conditions, has been established by previous studies, as described hereinabove with reference to GAM30.1. Tap binding protein (tapasin) (TAPBP, Accession NP_003181.3) is another GAM189 target gene, herein designated TARGET GENE. TAPBP BINDING SITE1 through TAPBP BINDING SITE3 are target binding sites found in untranslated regions of multiple transcripts of mRNA encoded by TAPBP, corresponding to target binding sites such as BINDING SITE I, BINDING SITE II or BINDING SITE III of FIG. 8. Table 4 illustrates the complementarity of the nucleotide sequences of TAPBP BINDING SITE1 through TAPBP BINDING SITE3, designated SEQ ID:11523, SEQ ID:12247 and SEQ ID:16940 respectively, to the nucleotide sequence of GAM189 RNA, herein designated GAM RNA, also designated SEQ ID:246.

Another function of GAM189 is therefore inhibition of Tap binding protein (tapasin) (TAPBP, Accession NP_003181.3), a gene which is involved in MHC class I-restricted antigen processing. Accordingly, utilities of GAM189 include diagnosis, prevention and treatment of diseases and clinical conditions associated with TAPBP.

The function of TAPBP and its association with various diseases and clinical conditions, has been established by previous studies, as described hereinabove with reference to GAM136.1. Tyrosine aminotransferase (TAT, Accession NP_000344.1) is another GAM189 target gene, herein designated TARGET GENE. TAT BINDING SITE is a target binding site found in the 3' untranslated region of mRNA encoded by TAT, corresponding to a target binding site such as BINDING SITE I, BINDING SITE II or BINDING SITE III of FIG. 8. Table 4 illustrates the complementarity of the nucleotide sequences of TAT BINDING SITE, designated SEQ ID:18942, to the nucleotide sequence of GAM189 RNA, herein designated GAM RNA, also designated SEQ ID:246.

Another function of GAM189 is therefore inhibition of Tyrosine aminotransferase (TAT, Accession NP_000344.1), a gene which is tyrosine aminotransferase and strongly similar to rat Rn.9947, which plays a role in gluconeogenesis. Accordingly, utilities of GAM189 include diagnosis, prevention and treatment of diseases and clinical conditions associated with TAT.

The function of TAT has been established by previous studies. Richner (1938) and Hanhart (1947) described an oculocutaneous syndrome characterized by herpetiform corneal ulcers and painful punctate keratoses of digits, palms, and soles. Richner (1938) described skin lesions in brother and sister. Only the brother had corneal lesions. Hanhart (1947) reported that the parents of his patient were second cousins. Hanhart (1947) also described associated severe mental and somatic retardation. The pedigree he reported was reproduced by Waardenburg et al. (1961). Waardenburg et al. (1961) described children of a first-cousin marriage, one with the full syndrome and one with only corneal changes. Ventura et al. (1965) described the syndrome in 2 sons of first-cousin parents. Buist (1967) referred to studies of a child with tyrosinemia and tyrosine transaminase deficiency, but normal p-hydroxyphenylpyruvic acid oxidase. Phenylalanine level was normal. Hydroxyphenylpyruvic acid was elevated in the urine. Fellman et al. (1969) reported chemical studies on the same patient. Only the mitochondrial form of tyrosine aminotransferase (TAT) was present in the liver. The soluble form of TAT (EC 2.6.1.5) was lacking. The patient had markedly elevated tyrosine blood levels and an increase in urinary p-hydroxyphenylpyruvate and p-hydroxyphenyllactate. A regulator gene for tyrosine transaminase is X-linked (OMIM Ref. No. 314350). Goldsmith et al. (1973) demonstrated tyrosinemia and phenylaceticacidemia in this disorder. Their patient was the 14-year-old son of consanguineous Italian parents. The urine contained excessive P-hydroxyphenylactic acid. Urinary P-hydroxyphenylpyruvic acid was normal. Clinical and biochemical improvement accompanied low phenylalanine-low tyrosine diet. They suggested that soluble TAT may be deficient. Mitochondrial tyrosine transaminase is normal. Beinfang et al. (1976) described the ophthalmologic findings in the patient reported by Goldsmith et al. (1973). This condition is also known as tyrosinemia with palmar and plantar keratosis and keratitis. Garibaldi et al. (1977) observed this disorder, which they called oculocutaneous tyrosinosis, in a 42-month-old girl and her maternal aunt. The parents of the maternal aunt were first cousins. They emphasized the importance of early diagnosis in order to prevent mental retardation by means of a diet restricted in phenylalanine and tyrosine. Hunziker (1980) reported brother and sister with unusually late onset (about age 15). Their patients' skin lesions were improved with a diet restricted in phenylalanine and tyrosine. In a consanguineous sibship, Rehak et al. (1981) reported 4 cases of Richner-Hanhart syndrome. Cutaneous manifestations were typical but the eyes were not involved, suggesting heterogeneity in this disorder. Bohnert and Anton-Lamprecht (1982) reported unique ultrastructural changes: thickening of the granular layer and increased synthesis of tonofibrils and keratohyalin; in the ridged palmar or plantar skin, large numbers of microtubules and unusually tight packing of tonofibrillar masses, which contained tubular channels or inclusions of microtubules. The authors assumed that increased cohesion and tight packing of tonofilaments prevent normal spreading of keratohyalin and result in its globular appearance. Further, they suggested that excessive amounts of intracellular tyrosine enhance crosslinks between aggregated tonofilaments. In an Ashkenazi Jewish family, Chitayat et al. (1992) observed 2 adult sibs, offspring of a first-cousin marriage, with persistent hypertyrosinemia. A curious feature was that the affected female sib, aged 41 years, had hypertyrosinemia and characteristic oculocutaneous signs; the brother, aged 39 years, had hypertyrosinemia but no oculocutaneous disease. Both sibs had 2 children; none had signs of metabolic fetopathy.

Full details of the abovementioned studies are described in the following publications, the disclosure of which are hereby incorporated by reference:

Goldsmith, L. A.; Kang, E. S.; Bienfang, D. C.; Jimbow, K.; Gerald, P. S.; Baden, H. P.: Tyrosinemia with plantar and palmar keratosis and keratitis. J. Pediat. 83:798-805, 1973; and Hunziker, N.: Richner-Hanhart syndrome and tyrosinemia type II. Dermatologica 160:180-189, 1980.

Further studies establishing the function and utilities of TAT are found in John Hopkins OMIM database record ID 276600, and in cited publications listed in Table 5, which are hereby incorporated by reference. Tbc1 domain family, member 5 (TBC1D5, Accession NP_055559.1) is another GAM189 target gene, herein designated TARGET GENE. TBC1D5 BINDING SITE1 and TBC1D5 BINDING SITE2 are target binding sites found in untranslated regions of mRNA encoded by TBC1D5, corresponding to target binding sites such as BINDING SITE I, BINDING SITE II or BINDING SITE III of FIG. 8. Table 4 illustrates the complementarity of the nucleotide sequences of TBC1D5 BINDING SITE1 and TBC1D5 BINDING SITE2, designated SEQ ID:14859 and SEQ ID:16449 respectively, to the nucleotide sequence of GAM189 RNA, herein designated GAM RNA, also designated SEQ ID:246.

Another function of GAM189 is therefore inhibition of Tbc1 domain family, member 5 (TBC1D5, Accession NP_055559.1). Accordingly, utilities of GAM189 include diagnosis, prevention and treatment of diseases and clinical conditions associated with TBC1D5.

T-box 3 (ulnar mammary syndrome) (TBX3, Accession NP_005987.2) is another GAM189 target gene, herein designated TARGET GENE. TBX3 BINDING SITE is a target binding site found in the 5' untranslated region of multiple transcripts of mRNA encoded by TBX3, corresponding to a target binding site such as BINDING SITE I, BINDING SITE II or BINDING SITE III of FIG. 8. Table 4 illustrates the complementarity of the nucleotide sequences of TBX3 BINDING SITE, designated SEQ ID:19690, to the nucleotide sequence of GAM189 RNA, herein designated GAM RNA, also designated SEQ ID:246.

Another function of GAM189 is therefore inhibition of T-box 3 (ulnar mammary syndrome) (TBX3, Accession NP_005987.2). Accordingly, utilities of GAM189 include diagnosis, prevention and treatment of diseases and clinical conditions associated with TBX3.

T-box 3 (ulnar mammary syndrome) (TBX3, Accession NP_057653.2) is another GAM189 target gene, herein designated TARGET GENE. TBX3 BINDING SITE is a target binding site found in the 5' untranslated region of multiple transcripts of mRNA encoded by TBX3, corresponding to a target binding site such as BINDING SITE I, BINDING SITE II or BINDING SITE III of FIG. 8. Table 4 illustrates the complementarity of the nucleotide sequences of TBX3 BINDING SITE, designated SEQ ID:19690, to the nucleotide sequence of GAM189 RNA, herein designated GAM RNA, also designated SEQ ID:246.

Another function of GAM189 is therefore inhibition of T-box 3 (ulnar mammary syndrome) (TBX3, Accession NP_057653.2). Accordingly, utilities of GAM189 include diagnosis, prevention and treatment of diseases and clinical conditions associated with TBX3.

Transcription factor 2, hepatic; lf-b3; variant hepatic nuclear factor (TCF2, Accession NP_006472.1) is another GAM189 target gene, herein designated TARGET GENE. TCF2 BINDING SITE is a target binding site found in the 3' untranslated region of multiple transcripts of mRNA encoded by TCF2, corresponding to a target binding site such as BINDING SITE I, BINDING SITE II or BINDING SITE III of FIG. 8. Table 4 illustrates the complementarity of the nucleotide sequences of TCF2 BINDING SITE, designated SEQ ID:625, to the nucleotide sequence of GAM189 RNA, herein designated GAM RNA, also designated SEQ ID:246.

Another function of GAM189 is therefore inhibition of Transcription factor 2, hepatic; lf-b3; variant hepatic nuclear factor (TCF2, Accession NP_006472.1), a gene which probably binds to the inverted palindrome 5'-gttaatnattaac-3'. and therefore is associated with Maturity-onset diabetes of the young type 5 (mody5), familial hypoplastic glomerulocystic kidney disease (gckd). Accordingly, utilities of GAM189 include diagnosis, prevention and treatment of Maturity-onset diabetes of the young type 5 (mody5), familial hypoplastic glomerulocystic kidney disease (gckd), and of other diseases and clinical conditions associated with TCF2.

The function of TCF2 and its association with various diseases and clinical conditions, has been established by previous studies, as described hereinabove with reference to GAM144.1. T-cell leukemia/lymphoma 6 (TCL6, Accession NP_065575.1) is another GAM189 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17450, to the nucleotide sequence of GAM189 RNA, herein designated GAM RNA, also designated SEQ ID:246.

Another function of GAM189 is therefore inhibition of T-cell leukemia/lymphoma 6 (TCL6, Accession NP_065575.1). Accordingly, utilities of GAM189 include diagnosis, prevention and treatment of diseases and clinical conditions associated with TCL6.

T-cell leukemia/lymphoma 6 (TCL6, Accession NP_036600.2) is another GAM189 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17450, to the nucleotide sequence of GAM189 RNA, herein designated GAM RNA, also designated SEQ ID:246.

Another function of GAM189 is therefore inhibition of T-cell leukemia/lymphoma 6 (TCL6, Accession NP_036600.2). Accordingly, utilities of GAM189 include diagnosis, prevention and treatment of diseases and clinical conditions associated with TCL6.

T-cell leukemia/lymphoma 6 (TCL6, Accession NP_065577.2) is another GAM189 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17450, to the nucleotide sequence of GAM189 RNA, herein designated GAM RNA, also designated SEQ ID:246.

Another function of GAM189 is therefore inhibition of T-cell leukemia/lymphoma 6 (TCL6, Accession NP_065577.2). Accordingly, utilities of GAM189 include diagnosis, prevention and treatment of diseases and clinical conditions associated with TCL6.

T-cell leukemia/lymphoma 6 (TCL6, Accession NP_055233.1) is another GAM189 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17450, to the nucleotide sequence of GAM189 RNA, herein designated GAM RNA, also designated SEQ ID:246.

Another function of GAM189 is therefore inhibition of T-cell leukemia/lymphoma 6 (TCL6, Accession NP_055233.1). Accordingly, utilities of GAM189 include diagnosis, prevention and treatment of diseases and clinical conditions associated with TCL6.

Teratocarcinoma-derived growth factor 1 (TDGF1, Accession NP_003203.1) is another GAM189 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:8563, to the nucleotide sequence of GAM189 RNA, herein designated GAM RNA, also designated SEQ ID:246.

Another function of GAM189 is therefore inhibition of Teratocarcinoma-derived growth factor 1 (TDGF1, Accession NP_003203.1), a gene which can play a role in the determination of the epiblastic cells that subsequently give rise to the mesoderm. and therefore may be associated with Forebrain defects. Accordingly, utilities of GAM189 include diagnosis, prevention and treatment of Forebrain defects, and of other diseases and clinical conditions associated with TDGF1.

The function of TDGF1 and its association with various diseases and clinical conditions, has been established by previous studies, as described hereinabove with reference to GAM30.1. TERA (Accession NP_067061.1) is another GAM189 target gene, herein designated TARGET GENE. TERA BINDING SITE1 and TERA BINDING SITE2 are target binding sites found in untranslated regions of mRNA encoded by TERA, corresponding to target binding sites such as BINDING SITE I, BINDING SITE II or BINDING SITE III of FIG. 8. Table 4 illustrates the complementarity of the nucleotide sequences of TERA BINDING SITE1 and TERA BINDING SITE2, designated SEQ ID:17755 and SEQ ID:14491 respectively, to the nucleotide sequence of GAM189 RNA, herein designated GAM RNA, also designated SEQ ID:246.

Another function of GAM189 is therefore inhibition of TERA (Accession NP_067061.1). Accordingly, utilities of GAM189 include diagnosis, prevention and treatment of diseases and clinical conditions associated with TERA.

Telomeric repeat binding factor (nima-interacting) 1 (TERF1, Accession NP_059523.1) is another GAM189 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:1745, to the nucleotide sequence of GAM189 RNA, herein designated GAM RNA, also designated SEQ ID:246.

Another function of GAM189 is therefore inhibition of Telomeric repeat binding factor (nima-interacting) 1 (TERF1, Accession NP_059523.1), a gene which negatively regulates telomere length, involves in regulation of the mitotic spindle. Accordingly, utilities of GAM189 include diagnosis, prevention and treatment of diseases and clinical conditions associated with TERF1.

The function of TERF1 has been established by previous studies. Human chromosomes carry at their termini long arrays of double-stranded hexamers (OMIM Ref. No. TTAGGG) that are maintained by the enzyme telomerase (OMIM Ref. No. 187270). Chong et al. (1995) noted that telomeric DNA is thought to form a protective nucleoprotein cap through its association with telomere-specific proteins; also see review by Zakian (1995). Because the loss of telomere function can induce cell cycle arrest and genome instability, the telomeric complex is probably required in all human cells. Changes in the structure and function of human telomeres are thought to play a role in malignant transformation and cellular senescence. Protein components of the telomeric complex had been identified in ciliates and yeast, but not in vertebrate systems. Quests for vertebrate telomeric proteins had yielded a single candidate that could potentially bind along the length of the telomeric TTAGGG repeat array. This protein, called TRF (telomeric repeat-binding factor) by Chong et al. (1995), was shown by the authors to associate with double-stranded TTAGGG repeat arrays in vitro. TRF displays strong specificity for vertebrate telomere DNA. Human TRF activity is detectable in HeLa cell nuclear extracts on the basis of its ability to alter the mobility of double-stranded DNA fragments containing the sequence (OMIM Ref. No. TTAGGG)12. Using this assay, Chong et al. (1995) purified HeLa TRF to near homogeneity. Three independent preparations of purified TRF contained a protein in the 60-kD apparent molecular mass range, which copurified with TRF activity over a column containing double-stranded TTAGGG repeats. Amino acid sequences revealed sequence identity to an anonymous partial cDNA in the GenBank database. On the basis of this nucleotide sequence, cDNAs were isolated from a HeLa cell library, sequenced, and found to contain an open reading frame encoding all sequence peptides. The cDNA hybridized 2 mRNAs of approximately 1.8 and 3.0 kb that are expressed in a variety of human tissues. The cDNA derived from the larger mRNA revealed an open reading frame encoding a 439-amino acid protein. In vitro transcription and translation of the cloned cDNA produced a protein of the same size as purified HeLa TRF. Comparison with the sequence information in the databases indicated that human TRF is a novel protein with 3 previously recognized sequence motifs. There is one DNA-binding repeat resembling that of MYB (OMIM Ref. No. 189990) and an N-terminal acidic domain. Immunofluorescent labeling showed that TRF specifically colocalizes with telomeric DNA in human metaphase cells and is located at chromosome ends during metaphase. Chong et al. (1995) stated that the presence of TRF along the telomeric TTAGGG repeat array demonstrates that human telomeres form a specialized nuclear protein complex. In yeast, Marcand et al. (1997) demonstrated a protein-counting mechanism for regulation of the length of telomeres. This mechanism involves the telomere repeat-binding protein Rap1p. Because the structural and functional properties of telomeres appear to be highly conserved, Marcand et al. (1997) suggested that their findings may be relevant to telomere length regulation in humans, which has been associated with aging and cancer. Okabe et al. (2000) investigated cellular factors required for telomere formation using the frequency of telomere seeding as an index and identified TRF1 as an essential transacting factor. The exogenous telomere repeat induced telomere formation at a frequency determined by the availability of TRF1, even in telomerase-negative cells. The authors concluded that TRF1 has a novel physiologic significance distinct from its role as a regulator of telomere length in the endogenous chromosome.

Full details of the abovementioned studies are described in the following publications, the disclosure of which are hereby incorporated by reference:

Chong, L.; van Steensel, B.; Broccoli, D.; Erdjument-Bromage, H.; Hanish, J.; Tempst, P.; de Lange, T.: A human telomeric protein. Science 270:1663-1667, 1995; and Okabe, J.; Eguchi, A.; Masago, A.; Hayakawa, T.; Nakanishi, M.: TRF1 is a critical trans-acting factor required for de novo telomere formation in human cells. Hum. Molec. Genet. 9:263.

Further studies establishing the function and utilities of TERF1 are found in John Hopkins OMIM database record ID 600951, and in cited publications listed in Table 5, which are hereby incorporated by reference. Telomeric repeat binding factor (nima-interacting) 1 (TERF1, Accession NP_003209.1) is another GAM189 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1

BINDING SITE, designated SEQ ID:1745, to the nucleotide sequence of GAM189 RNA, herein designated GAM RNA, also designated SEQ ID:246.

Another function of GAM189 is therefore inhibition of Telomeric repeat binding factor (nima-interacting) 1 (TERF1, Accession NP_003209.1), a gene which negatively regulates telomere length, involves in regulation of the mitotic spindle. Accordingly, utilities of GAM189 include diagnosis, prevention and treatment of diseases and clinical conditions associated with TERF1.

The function of TERF1 has been established by previous studies. Human chromosomes carry at their termini long arrays of double-stranded hexamers (OMIM Ref. No. TTAGGG) that are maintained by the enzyme telomerase (OMIM Ref. No. 187270). Chong et al. (1995) noted that telomeric DNA is thought to form a protective nucleoprotein cap through its association with telomere-specific proteins; also see review by Zakian (1995). Because the loss of telomere function can induce cell cycle arrest and genome instability, the telomeric complex is probably required in all human cells. Changes in the structure and function of human telomeres are thought to play a role in malignant transformation and cellular senescence. Protein components of the telomeric complex had been identified in ciliates and yeast, but not in vertebrate systems. Quests for vertebrate telomeric proteins had yielded a single candidate that could potentially bind along the length of the telomeric TTAGGG repeat array. This protein, called TRF (telomeric repeat-binding factor) by Chong et al. (1995), was shown by the authors to associate with double-stranded TTAGGG repeat arrays in vitro. TRF displays strong specificity for vertebrate telomere DNA. Human TRF activity is detectable in HeLa cell nuclear extracts on the basis of its ability to alter the mobility of double-stranded DNA fragments containing the sequence (OMIM Ref. No. TTAGGG)12. Using this assay, Chong et al. (1995) purified HeLa TRF to near homogeneity. Three independent preparations of purified TRF contained a protein in the 60-kD apparent molecular mass range, which copurified with TRF activity over a column containing double-stranded TTAGGG repeats. Amino acid sequences revealed sequence identity to an anonymous partial cDNA in the GenBank database. On the basis of this nucleotide sequence, cDNAs were isolated from a HeLa cell library, sequenced, and found to contain an open reading frame encoding all sequence peptides. The cDNA hybridized 2 mRNAs of approximately 1.8 and 3.0 kb that are expressed in a variety of human tissues. The cDNA derived from the larger mRNA revealed an open reading frame encoding a 439-amino acid protein. In vitro transcription and translation of the cloned cDNA produced a protein of the same size as purified HeLa TRF. Comparison with the sequence information in the databases indicated that human TRF is a novel protein with 3 previously recognized sequence motifs. There is one DNA- binding repeat resembling that of MYB (OMIM Ref. No. 189990) and an N-terminal acidic domain. Immunofluorescent labeling showed that TRF specifically colocalizes with telomeric DNA in human metaphase cells and is located at chromosome ends during metaphase. Chong et al. (1995) stated that the presence of TRF along the telomeric TTAGGG repeat array demonstrates that human telomeres form a specialized nuclear protein complex. In yeast, Marcand et al. (1997) demonstrated a protein-counting mechanism for regulation of the length of telomeres. This mechanism involves the telomere repeat-binding protein Rap1p. Because the structural and functional properties of telomeres appear to be highly conserved, Marcand et al. (1997) suggested that their findings may be relevant to telomere length regulation in humans, which has been associated with aging and cancer. Okabe et al. (2000) investigated cellular factors required for telomere formation using the frequency of telomere seeding as an index and identified TRF1 as an essential transacting factor. The exogenous telomere repeat induced telomere formation at a frequency determined by the availability of TRF1, even in telomerase-negative cells. The authors concluded that TRF1 has a novel physiologic significance distinct from its role as a regulator of telomere length in the endogenous chromosome.

Full details of the abovementioned studies are described in the following publications, the disclosure of which are hereby incorporated by reference:

Chong, L.; van Steensel, B.; Broccoli, D.; Erdjument-Bromage, H.; Hanish, J.; Tempst, P.; de Lange, T.: A human telomeric protein. Science 270:1663-1667, 1995; and Okabe, J.; Eguchi, A.; Masago, A.; Hayakawa, T.; Nakanishi, M.: TRF1 is a critical trans-acting factor required for de novo telomere formation in human cells. Hum. Molec. Genet. 9:263.

Further studies establishing the function and utilities of TERF1 are found in John Hopkins OMIM database record ID 600951, and in cited publications listed in Table 5, which are hereby incorporated by reference. Telomeric repeat binding factor 2 (TERF2, Accession NP_005643.1) is another GAM189 target gene, herein designated TARGET GENE. TERF2 BINDING SITE is a target binding site found in the 3' untranslated region of mRNA encoded by TERF2, corresponding to a target binding site such as BINDING SITE I, BINDING SITE II or BINDING SITE III of FIG. 8. Table 4 illustrates the complementarity of the nucleotide sequences of TERF2 BINDING SITE, designated SEQ ID:1744, to the nucleotide sequence of GAM189 RNA, herein designated GAM RNA, also designated SEQ ID:246.

Another function of GAM189 is therefore inhibition of Telomeric repeat binding factor 2 (TERF2, Accession NP_005643.1), a gene which plays a key role in the protective activity of telomeres. Accordingly, utilities of GAM189 include diagnosis, prevention and treatment of diseases and clinical conditions associated with TERF2.

The function of TERF2 and its association with various diseases and clinical conditions, has been established by previous studies, as described hereinabove with reference to GAM133.2. Tgfb-induced factor 2 (tale family homeobox) (TGIF2, Accession NP_068581.1) is another GAM189 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:6881, to the nucleotide sequence of GAM189 RNA, herein designated GAM RNA, also designated SEQ ID:246.

Another function of GAM189 is therefore inhibition of Tgfb-induced factor 2 (tale family homeobox) (TGIF2, Accession NP_068581.1). Accordingly, utilities of GAM189 include diagnosis, prevention and treatment of diseases and clinical conditions associated with TGIF2.

Tigger transposable element derived 6 (TIGD6, Accession NP_112215.1) is another GAM189 target gene, herein designated TARGET GENE. TIGD6 BINDING SITE is a target binding site found in the 3' untranslated region of mRNA encoded by TIGD6, corresponding to a target binding site such as BINDING SITE I, BINDING SITE II or BINDING SITE III of FIG. 8. Table 4 illustrates the complementarity of the nucleotide sequences of TIGD6 BINDING SITE, designated SEQ ID:4933, to the nucleotide sequence of GAM189 RNA, herein designated GAM RNA, also designated SEQ ID:246.

Another function of GAM189 is therefore inhibition of Tigger transposable element derived 6 (TIGD6, Accession NP_112215.1). Accordingly, utilities of GAM189 include diagnosis, prevention and treatment of diseases and clinical conditions associated with TIGD6.

TIM50L (Accession XP_053074.2) is another GAM189 target gene, herein designated TARGET GENE. TIM50L BINDING SITE1 and TIM50L BINDING SITE2 are target binding sites found in untranslated regions of mRNA encoded by TIM50L, corresponding to target binding sites such as BINDING SITE I, BINDING SITE II or BINDING SITE III of FIG. 8. Table 4 illustrates the complementarity of the nucleotide sequences of TIM50L BINDING SITE1 and TIM50L BINDING SITE2, designated SEQ ID:5989 and SEQ ID:10157 respectively, to the nucleotide sequence of GAM189 RNA, herein designated GAM RNA, also designated SEQ ID:246.

Another function of GAM189 is therefore inhibition of TIM50L (Accession XP_053074.2). Accordingly, utilities of GAM189 include diagnosis, prevention and treatment of diseases and clinical conditions associated with TIM50L.

Tousled-like kinase 1 (TLK1, Accession NP_036422.2) is another GAM189 target gene, herein designated TARGET GENE. TLK1 BINDING SITE is a target binding site found in the 5' untranslated region of mRNA encoded by TLK1, corresponding to a target binding site such as BINDING SITE I, BINDING SITE II or BINDING SITE III of FIG. 8. Table 4 illustrates the complementarity of the nucleotide sequences of TLK1 BINDING SITE, designated SEQ ID:6551, to the nucleotide sequence of GAM189 RNA, herein designated GAM RNA, also designated SEQ ID:246.

Another function of GAM189 is therefore inhibition of Tousled-like kinase 1 (TLK1, Accession NP_036422.2). Accordingly, utilities of GAM189 include diagnosis, prevention and treatment of diseases and clinical conditions associated with TLK1.

Toll-like receptor 5 (TLR5, Accession NP_003259.2) is another GAM189 target gene, herein designated TARGET GENE. TLR5 BINDING SITE is a target binding site found in the 5' untranslated region of mRNA encoded by TLR5, corresponding to a target binding site such as BINDING SITE I, BINDING SITE II or BINDING SITE III of FIG. 8. Table 4 illustrates the complementarity of the nucleotide sequences of TLR5 BINDING SITE, designated SEQ ID:16229, to the nucleotide sequence of GAM189 RNA, herein designated GAM RNA, also designated SEQ ID:246.

Another function of GAM189 is therefore inhibition of Toll-like receptor 5 (TLR5, Accession NP_003259.2), a gene which participates in the innate immune response to bacterial flagellins. Accordingly, utilities of GAM189 include diagnosis, prevention and treatment of diseases and clinical conditions associated with TLR5.

The function of TLR5 and its association with various diseases and clinical conditions, has been established by previous studies, as described hereinabove with reference to GAM40.1. Transmembrane, cochlear expressed, 1 (TMC1, Accession NP_619636.2) is another GAM189 target gene, herein designated TARGET GENE. TMC1 BINDING SITE is a target binding site found in the 5' untranslated region of mRNA encoded by TMC1, corresponding to a target binding site such as BINDING SITE I, BINDING SITE II or BINDING SITE III of FIG. 8. Table 4 illustrates the complementarity of the nucleotide sequences of TMC1 BINDING SITE, designated SEQ ID:2152, to the nucleotide sequence of GAM189 RNA, herein designated GAM RNA, also designated SEQ ID:246.

Another function of GAM189 is therefore inhibition of Transmembrane, cochlear expressed, 1 (TMC1, Accession NP_619636.2), a gene which is required for normal function of cochlear hair cells and therefore may be associated with Autosomal recessive nonsyndromic neurosensory deafness and autosomal dominant nonsyndromic sensorineural hearing loss. Accordingly, utilities of GAM189 include diagnosis, prevention and treatment of Autosomal recessive nonsyndromic neurosensory deafness and autosomal dominant nonsyndromic sensorineural hearing loss ., and of other diseases and clinical conditions associated with TMC1.

The function of TMC1 and its association with various diseases and clinical conditions, has been established by previous studies, as described hereinabove with reference to GAM136.1. TMEM14A (Accession NP_054770.1) is another GAM189 target gene, herein designated TARGET GENE. TMEM14A BINDING SITE is a target binding site found in the 5' untranslated region of mRNA encoded by TMEM14A, corresponding to a target binding site such as BINDING SITE I, BINDING SITE II or BINDING SITE III of FIG. 8. Table 4 illustrates the complementarity of the nucleotide sequences of TMEM14A BINDING SITE, designated SEQ ID:5271, to the nucleotide sequence of GAM189 RNA, herein designated GAM RNA, also designated SEQ ID:246.

Another function of GAM189 is therefore inhibition of TMEM14A (Accession NP_054770.1). Accordingly, utilities of GAM189 include diagnosis, prevention and treatment of diseases and clinical conditions associated with TMEM14A.

Transmembrane protease, serine 3 (TMPRSS3, Accession NP_076927.1) is another GAM189 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM189 RNA, herein designated GAM RNA, also designated SEQ ID:246.

Another function of GAM189 is therefore inhibition of Transmembrane protease, serine 3 (TMPRSS3, Accession NP_076927.1). Accordingly, utilities of GAM189 include diagnosis, prevention and treatment of diseases and clinical conditions associated with TMPRSS3.

Transmembrane protease, serine 3 (TMPRSS3, Accession NP_115777.1) is another GAM189 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM189 RNA, herein designated GAM RNA, also designated SEQ ID:246.

Another function of GAM189 is therefore inhibition of Transmembrane protease, serine 3 (TMPRSS3, Accession NP_115777.1). Accordingly, utilities of GAM189 include diagnosis, prevention and treatment of diseases and clinical conditions associated with TMPRSS3.

Transmembrane protease, serine 3 (TMPRSS3, Accession NP_115780.1) is another GAM189 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM189 RNA, herein designated GAM RNA, also designated SEQ ID:246.

Another function of GAM189 is therefore inhibition of Transmembrane protease, serine 3 (TMPRSS3, Accession NP_115780.1). Accordingly, utilities of GAM189 include diagnosis, prevention and treatment of diseases and clinical conditions associated with TMPRSS3.

Tumor necrosis factor, alpha-induced protein 2 (TNFAIP2, Accession NP_006282.2) is another GAM189 target gene, herein designated TARGET GENE. TNFAIP2 BINDING SITE1 and TNFAIP2 BINDING SITE2 are target binding sites found in untranslated regions of mRNA encoded by TNFAIP2, corresponding to target binding sites such as BINDING SITE I, BINDING SITE II or BINDING SITE III of FIG. 8. Table 4 illustrates the complementarity of the nucleotide sequences of TNFAIP2 BINDING SITE1 and TNFAIP2 BINDING SITE2, designated SEQ ID:13948 and SEQ ID:17621 respectively, to the nucleotide sequence of GAM189 RNA, herein designated GAM RNA, also designated SEQ ID:246.

Another function of GAM189 is therefore inhibition of Tumor necrosis factor, alpha-induced protein 2 (TNFAIP2, Accession NP_006282.2). Accordingly, utilities of GAM189 include diagnosis, prevention and treatment of diseases and clinical conditions associated with TNFAIP2.

Tumor necrosis factor receptor superfamily, member 10b (TNFRSF10B, Accession NP_003833.3) is another GAM189 target gene, herein designated TARGET GENE. TNFRSF10B BINDING SITE1 and TNFRSF10B BINDING SITE2 are target binding sites found in untranslated regions of multiple transcripts of mRNA encoded by TNFRSF10B, corresponding to target binding sites such as BINDING SITE I, BINDING SITE II or BINDING SITE III of FIG. 8. Table 4 illustrates the complementarity of the nucleotide sequences of TNFRSF10B BINDING SITE1 and TNFRSF10B BINDING SITE2, designated SEQ ID:4398 and SEQ ID:4398 respectively, to the nucleotide sequence of GAM189 RNA, herein designated GAM RNA, also designated SEQ ID:246.

Another function of GAM189 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM189 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 10b (TNFRSF10B, Accession NP_671716.1) is another GAM189 target gene, herein designated TARGET GENE. TNFRSF10B BINDING SITE1 and TNFRSF10B BINDING SITE2 are target binding sites found in untranslated regions of multiple transcripts of mRNA encoded by TNFRSF10B, corresponding to target binding sites such as BINDING SITE I, BINDING SITE II or BINDING SITE III of FIG. 8. Table 4 illustrates the complementarity of the nucleotide sequences of TNFRSF10B BINDING SITE1 and TNFRSF10B BINDING SITE2, designated SEQ ID:15107 and SEQ ID:15107 respectively, to the nucleotide sequence of GAM189 RNA, herein designated GAM RNA, also designated SEQ ID:246.

Another function of GAM189 is therefore inhibition of Tumor necrosis factor receptor superfamily, member 10b (TNFRSF10B, Accession NP_671716.1), a gene which forms complex that induces apoptosis. and therefore may be associated with Squamous cell carcinoma. Accordingly, utilities of GAM189 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 11a, activator of nfkb (TNFRSF11A, Accession NP_003830.1) is another GAM189 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:2200, to the nucleotide sequence of GAM189 RNA, herein designated GAM RNA, also designated SEQ ID:246.

Another function of GAM189 is therefore inhibition of Tumor necrosis factor receptor superfamily, member 11a, activator of nfkb (TNFRSF11A, Accession NP_003830.1). Accordingly, utilities of GAM189 include diagnosis, prevention and treatment of diseases and clinical conditions associated with TNFRSF11A.

Tumor necrosis factor receptor superfamily, member 21 (TNFRSF21, Accession NP_055267.1) is another GAM189 target gene, herein designated TARGET GENE. TNFRSF21 BINDING SITE is a target binding site found in the 3' untranslated region of mRNA encoded by TNFRSF21, corresponding to a target binding site such as BINDING SITE I, BINDING SITE II or BINDING SITE III of FIG. 8. Table 4 illustrates the complementarity of the nucleotide sequences of TNFRSF21 BINDING SITE, designated SEQ ID:16759, to the nucleotide sequence of GAM189 RNA, herein designated GAM RNA, also designated SEQ ID:246.

Another function of GAM189 is therefore inhibition of Tumor necrosis factor receptor superfamily, member 21 (TNFRSF21, Accession NP_055267.1). Accordingly, utilities of GAM189 include diagnosis, prevention and treatment of diseases and clinical conditions associated with TNFRSF21.

Tumor necrosis factor receptor superfamily, member 9 (TNFRSF9, Accession NP_001552.2) is another GAM189 target gene, herein designated TARGET GENE. TNFRSF9 BINDING SITE is a target binding site found in the 3' untranslated region of mRNA encoded by TNFRSF9, corresponding to a target binding site such as BINDING SITE I, BINDING SITE II or BINDING SITE III of FIG. 8. Table 4 illustrates the complementarity of the nucleotide sequences of TNFRSF9 BINDING SITE, designated SEQ ID:13464, to the nucleotide sequence of GAM189 RNA, herein designated GAM RNA, also designated SEQ ID:246.

Another function of GAM189 is therefore inhibition of Tumor necrosis factor receptor superfamily, member 9 (TNFRSF9, Accession NP_001552.2), a gene which inhibits proliferation of activated T lymphocytes. Accordingly, utilities of GAM189 include diagnosis, prevention and treatment of diseases and clinical conditions associated with TNFRSF9.

The function of TNFRSF9 has been established by previous studies. Schwarz et al. (1996) reported that ILA inhibits proliferation of activated T lymphocytes and induces programmed cell death. Loo et al. (1997) reported that, unlike its mouse counterpart, human 4-1BB binds only to its ligand, TNFSF9, and not to extracellular matrix proteins such as laminin (see OMIM Ref. No. 150240). The authors attributed this species distinction to sequence differences in the N-terminal laminin-homologous domain of human 4-1BB.

Full details of the abovementioned studies are described in the following publications, the disclosure of which are hereby incorporated by reference:

Loo, D. T.; Chalupny, N. J.; Bajorath, J.; Shuford, W. W.; Mittler, R. S.; Aruffo, A.: Analysis of 4-1BBL and laminin binding to murine 4-1BB, a member of the tumor necrosis factor receptor superfamily, and comparison with human 4-1BB. J. Biol. Chem. 272:6448-6456, 1997; and Schwarz, H.; Arden, K.; Lotz, M.: CD137, a member of the tumor necrosis factor receptor family, is located on chromosome 1p36, in a cluster of related genes, and colocalizes with sever.

Further studies establishing the function and utilities of TNFRSF9 are found in John Hopkins OMIM database record ID 602250, and in cited publications listed in Table 5, which are hereby incorporated by reference. Tensin (TNS, Accession NP_072174.2) is another GAM189 target gene, herein designated TARGET GENE. TNS BINDING SITE is a target binding site found in the 3' untranslated region of mRNA encoded by TNS, corresponding to a target binding site such as BINDING SITE I, BINDING SITE II or BINDING SITE III of FIG. 8. Table 4 illustrates the complementarity of the nucleotide sequences of TNS BINDING SITE, designated SEQ ID:8787, to the nucleotide sequence of GAM189 RNA, herein designated GAM RNA, also designated SEQ ID:246.

Another function of GAM189 is therefore inhibition of Tensin (TNS, Accession NP_072174.2). Accordingly, utilities of GAM189 include diagnosis, prevention and treatment of diseases and clinical conditions associated with TNS.

TOLLIP (Accession NP_061882.2) is another GAM189 target gene, herein designated TARGET GENE. TOLLIP BINDING SITE1 and TOLLIP BINDING SITE2 are target binding sites found in untranslated regions of mRNA encoded by TOLLIP, corresponding to target binding sites such as BINDING SITE I, BINDING SITE II or BINDING SITE III of FIG. 8. Table 4 illustrates the complementarity of the nucleotide sequences of TOLLIP BINDING SITE1 and TOLLIP BINDING SITE2, designated SEQ ID:13694 and SEQ ID:3306 respectively, to the nucleotide sequence of GAM189 RNA, herein designated GAM RNA, also designated SEQ ID:246.

Another function of GAM189 is therefore inhibition of TOLLIP (Accession NP_061882.2). Accordingly, utilities of GAM189 include diagnosis, prevention and treatment of diseases and clinical conditions associated with TOLLIP.

Topoisomerase (dna) iii beta (TOP3B, Accession NP_003926.1) is another GAM189 target gene, herein designated TARGET GENE. TOP3B BINDING SITE is a target binding site found in the 3' untranslated region of mRNA encoded by TOP3B, corresponding to a target binding site such as BINDING SITE I, BINDING SITE II or BINDING SITE III of FIG. 8. Table 4 illustrates the complementarity of the nucleotide sequences of TOP3B BINDING SITE, designated SEQ ID:4495, to the nucleotide sequence of GAM189 RNA, herein designated GAM RNA, also designated SEQ ID:246.

Another function of GAM189 is therefore inhibition of Topoisomerase (dna) iii beta (TOP3B, Accession NP_003926.1). Accordingly, utilities of GAM189 include diagnosis, prevention and treatment of diseases and clinical conditions associated with TOP3B.

Torsin family 1, member b (torsin b) (TOR1B, Accession NP_055321.1) is another GAM189 target gene, herein designated TARGET GENE. TOR1B BINDING SITE is a target binding site found in the 3' untranslated region of mRNA encoded by TOR1B, corresponding to a target binding site such as BINDING SITE I, BINDING SITE II or BINDING SITE III of FIG. 8. Table 4 illustrates the complementarity of the nucleotide sequences of TOR1B BINDING SITE, designated SEQ ID:14221, to the nucleotide sequence of GAM189 RNA, herein designated GAM RNA, also designated SEQ ID:246.

Another function of GAM189 is therefore inhibition of Torsin family 1, member b (torsin b) (TOR1B, Accession NP_055321.1). Accordingly, utilities of GAM189 include diagnosis, prevention and treatment of diseases and clinical conditions associated with TOR1B.

TOSO (Accession NP_005440.1) is another GAM189 target gene, herein designated TARGET GENE. TOSO BINDING SITE is a target binding site found in the 3' untranslated region of mRNA encoded by TOSO, corresponding to a target binding site such as BINDING SITE I, BINDING SITE II or BINDING SITE III of FIG. 8. Table 4 illustrates the complementarity of the nucleotide sequences of TOSO BINDING SITE, designated SEQ ID:5682, to the nucleotide sequence of GAM189 RNA, herein designated GAM RNA, also designated SEQ ID:246.

Another function of GAM189 is therefore inhibition of TOSO (Accession NP_005440.1). Accordingly, utilities of GAM189 include diagnosis, prevention and treatment of diseases and clinical conditions associated with TOSO.

Tumor protein p53 (li-fraumeni syndrome) (TP53, Accession NP_000537.2) is another GAM189 target gene, herein designated TARGET GENE. TP53 BINDING SITE is a target binding site found in the 3' untranslated region of mRNA encoded by TP53, corresponding to a target binding site such as BINDING SITE I, BINDING SITE II or BINDING SITE III of FIG. 8. Table 4 illustrates the complementarity of the nucleotide sequences of TP53 BINDING SITE, designated SEQ ID:4654, to the nucleotide sequence of GAM189 RNA, herein designated GAM RNA, also designated SEQ ID:246.

Another function of GAM189 is therefore inhibition of Tumor protein p53 (li-fraumeni syndrome) (TP53, Accession NP_000537.2). Accordingly, utilities of GAM189 include diagnosis, prevention and treatment of diseases and clinical conditions associated with TP53.

TP53I11 (Accession XP_029347.6) is another GAM189 target gene, herein designated TARGET GENE. TP53I11 BINDING SITE is a target binding site found in the 5' untranslated region of multiple transcripts of mRNA encoded by TP53I11, corresponding to a target binding site such as BINDING SITE I, BINDING SITE II or BINDING SITE III of FIG. 8. Table 4 illustrates the complementarity of the nucleotide sequences of TP53I11 BINDING SITE, designated SEQ ID:14987, to the nucleotide sequence of GAM189 RNA, herein designated GAM RNA, also designated SEQ ID:246.

Another function of GAM189 is therefore inhibition of TP53I11 (Accession XP_029347.6). Accordingly, utilities of GAM189 include diagnosis, prevention and treatment of diseases and clinical conditions associated with TP53I11.

Thiopurine s-methyltransferase (TPMT, Accession NP_000358.1) is another GAM189 target gene, herein designated TARGET GENE. TPMT BINDING SITE is a target binding site found in the 3' untranslated region of mRNA encoded by TPMT, corresponding to a target binding site such as BINDING SITE I, BINDING SITE II or BINDING SITE III of FIG. 8. Table 4 illustrates the complementarity of the nucleotide sequences of TPMT BINDING SITE, designated SEQ ID:19670, to the nucleotide sequence of GAM189 RNA, herein designated GAM RNA, also designated SEQ ID:246.

Another function of GAM189 is therefore inhibition of Thiopurine s-methyltransferase (TPMT, Accession NP_000358.1), a gene which catalyzes the s-methylation of thiopurine drugs such as 6-mercaptopurine. and therefore may be associated with Thiopurine s-methyltransferase polymorphism. Accordingly, utilities of GAM189 include diagnosis, prevention and treatment of Thiopurine s-methyltransferase polymorphism, and of other diseases and clinical conditions associated with TPMT.

The function of TPMT and its association with various diseases and clinical conditions, has been established by previous studies, as described hereinabove with reference to GAM130.1. Tnf receptor-associated factor 5 (TRAF5, Accession NP_004610.1) is another GAM189 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:7045, to the nucleotide sequence of GAM189 RNA, herein designated GAM RNA, also designated SEQ ID:246.

Another function of GAM189 is therefore inhibition of Tnf receptor-associated factor 5 (TRAF5, Accession NP_004610.1), a gene which Member of a family of proteins that interact with TNF receptors; binds the lymphotoxin beta receptor (LTBR). Accordingly, utilities of GAM189 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tnf receptor-associated factor 5 (TRAF5, Accession NP_665702.1) is another GAM189 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:7045, to the nucleotide sequence of GAM189 RNA, herein designated GAM RNA, also designated SEQ ID:246.

Another function of GAM189 is therefore inhibition of Tnf receptor-associated factor 5 (TRAF5, Accession NP_665702.1), a gene which Member of a family of proteins that interact with TNF receptors; binds the lymphotoxin beta receptor (LTBR). Accordingly, utilities of GAM189 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tripartite motif-containing 16 (TRIM16, Accession NP_006461.2) is another GAM189 target gene, herein designated TARGET GENE. TRIM16 BINDING SITE is a target binding site found in the 3' untranslated region of mRNA encoded by TRIM16, corresponding to a target binding site such as BINDING SITE I, BINDING SITE II or BINDING SITE III of FIG. 8. Table 4 illustrates the complementarity of the nucleotide sequences of TRIM16 BINDING SITE, designated SEQ ID:4601, to the nucleotide sequence of GAM189 RNA, herein designated GAM RNA, also designated SEQ ID:246.

Another function of GAM189 is therefore inhibition of Tripartite motif-containing 16 (TRIM16, Accession NP_006461.2). Accordingly, utilities of GAM189 include diagnosis, prevention and treatment of diseases and clinical conditions associated with TRIM16.

Tripartite motif-containing 5 (TRIM5, Accession NP_149023.1) is another GAM189 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:5879, to the nucleotide sequence of GAM189 RNA, herein designated GAM RNA, also designated SEQ ID:246.

Another function of GAM189 is therefore inhibition of Tripartite motif-containing 5 (TRIM5, Accession NP_149023.1). Accordingly, utilities of GAM189 include diagnosis, prevention and treatment of diseases and clinical conditions associated with TRIM5.

Tripartite motif-containing 6 (TRIM6, Accession NP_477514.1) is another GAM189 target gene, herein designated TARGET GENE. TRIM6 BINDING SITE is a target binding site found in the 3' untranslated region of mRNA encoded by TRIM6, corresponding to a target binding site such as BINDING SITE I, BINDING SITE II or BINDING SITE III of FIG. 8. Table 4 illustrates the complementarity of the nucleotide sequences of TRIM6 BINDING SITE, designated SEQ ID:13572, to the nucleotide sequence of GAM189 RNA, herein designated GAM RNA, also designated SEQ ID:246.

Another function of GAM189 is therefore inhibition of Tripartite motif-containing 6 (TRIM6, Accession NP_477514.1). Accordingly, utilities of GAM189 include diagnosis, prevention and treatment of diseases and clinical conditions associated with TRIM6.

TRIP-Br2 (Accession NP_055570.1) is another GAM189 target gene, herein designated TARGET GENE. TRIP-Br2 BINDING SITE is a target binding site found in the 3' untranslated region of mRNA encoded by TRIP-Br2, corresponding to a target binding site such as BINDING SITE I, BINDING SITE II or BINDING SITE III of FIG. 8. Table 4 illustrates the complementarity of the nucleotide sequences of TRIP-Br2 BINDING SITE, designated SEQ ID:19574, to the nucleotide sequence of GAM189 RNA, herein designated GAM RNA, also designated SEQ ID:246.

Another function of GAM189 is therefore inhibition of TRIP-Br2 (Accession NP_055570.1). Accordingly, utilities of GAM189 include diagnosis, prevention and treatment of diseases and clinical conditions associated with TRIP-Br2.

Transient receptor potential cation channel, subfamily m, member 6 (TRPM6, Accession NP_060132.3) is another GAM189 target gene, herein designated TARGET GENE. TRPM6 BINDING SITE is a target binding site found in the 3' untranslated region of mRNA encoded by TRPM6, corresponding to a target binding site such as BINDING SITE I, BINDING SITE II or BINDING SITE III of FIG. 8. Table 4 illustrates the complementarity of the nucleotide sequences of TRPM6 BINDING SITE, designated SEQ ID:18177, to the nucleotide sequence of GAM189 RNA, herein designated GAM RNA, also designated SEQ ID:246.

Another function of GAM189 is therefore inhibition of Transient receptor potential cation channel, subfamily m, member 6 (TRPM6, Accession NP__060132.3), a gene which contains a predicted ion channel domain and a protein kinase domain. and therefore is associated with Hypomagnesemia with secondary hypocalcemia. Accordingly, utilities of GAM189 include diagnosis, prevention and treatment of Hypomagnesemia with secondary hypocalcemia, and of other diseases and clinical conditions associated with TRPM6.

The function of TRPM6 and its association with various diseases and clinical conditions, has been established by previous studies, as described hereinabove with reference to GAM130.1. Transient receptor potential cation channel, subfamily v, member 1 (TRPV1, Accession NP__542436.1) is another GAM189 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:16980 and SEQ ID:19833 respectively, to the nucleotide sequence of GAM189 RNA, herein designated GAM RNA, also designated SEQ ID:246.

Another function of GAM189 is therefore inhibition of Transient receptor potential cation channel, subfamily v, member 1 (TRPV1, Accession NP__542436.1), a gene which functions as a receptor for capsaicin. Accordingly, utilities of GAM189 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP__542437.1) is another GAM189 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:16980 and SEQ ID:16980 respectively, to the nucleotide sequence of GAM189 RNA, herein designated GAM RNA, also designated SEQ ID:246.

Another function of GAM189 is therefore inhibition of Transient receptor potential cation channel, subfamily v, member 1 (TRPV1, Accession NP__542437.1), a gene which functions as a receptor for capsaicin. Accordingly, utilities of GAM189 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP__542436.1) is another GAM189 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:19833 and SEQ ID:19833 respectively, to the nucleotide sequence of GAM189 RNA, herein designated GAM RNA, also designated SEQ ID:246.

Another function of GAM189 is therefore inhibition of Transient receptor potential cation channel, subfamily v, member 1 (TRPV1, Accession NP__542436.1), a gene which functions as a receptor for capsaicin. Accordingly, utilities of GAM189 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP__542435.1) is another GAM189 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:19833 and SEQ ID:16980 respectively, to the nucleotide sequence of GAM189 RNA, herein designated GAM RNA, also designated SEQ ID:246.

Another function of GAM189 is therefore inhibition of Transient receptor potential cation channel, subfamily v, member 1 (TRPV1, Accession NP__542435.1), a gene which functions as a receptor for capsaicin. Accordingly, utilities of GAM189 include diagnosis, prevention and treatment of diseases and clinical conditions associated with TRPV1.

The function of TRPV1 and its association with various diseases and clinical conditions, has been established by previous studies, as described hereinabove with reference to GAM130.1. Tuberous sclerosis 1 (TSC1, Accession NP__000359.1) is another GAM189 target gene, herein designated TARGET GENE. TSC1 BINDING SITE is a target binding site found in the 3' untranslated region of mRNA encoded by TSC1, corresponding to a target binding site such as BINDING SITE I, BINDING SITE II or BINDING SITE III of FIG. 8. Table 4 illustrates the complementarity of the nucleotide sequences of TSC1 BINDING SITE, designated SEQ ID:15082, to the nucleotide sequence of GAM189 RNA, herein designated GAM RNA, also designated SEQ ID:246.

Another function of GAM189 is therefore inhibition of Tuberous sclerosis 1 (TSC1, Accession NP__000359.1). Accordingly, utilities of GAM189 include diagnosis, prevention and treatment of diseases and clinical conditions associated with TSC1.

Tspy-like (TSPy, Accession XP__166325.1) is another GAM189 target gene, herein designated TARGET GENE. TSPYL BINDING SITE is a target binding site found in the 3' untranslated region of mRNA encoded by TSPy, corresponding to a target binding site such as BINDING SITE I, BINDING SITE II or BINDING SITE III of FIG. 8. Table 4 illustrates the complementarity of the nucleotide sequences of TSPYL BINDING SITE, designated SEQ ID:15042, to the nucleotide sequence of GAM189 RNA, herein designated GAM RNA, also designated SEQ ID:246.

Another function of GAM189 is therefore inhibition of Tspy-like (TSPy, Accession XP__166325.1). Accordingly, utilities of GAM189 include diagnosis, prevention and treatment of diseases and clinical conditions associated with TSPYL.

TTY7 (Accession NP__114132.1) is another GAM189 target gene, herein designated TARGET GENE. TTY7 BINDING SITE is a target binding site found in the 5' untranslated region of mRNA encoded by TTY7, corresponding to a target binding site such as BINDING SITE I, BINDING SITE II or BINDING SITE III of FIG. 8. Table 4 illustrates the complementarity of the nucleotide sequences of TTY7 BINDING SITE, designated SEQ ID:1016, to the nucleotide sequence of GAM189 RNA, herein designated GAM RNA, also designated SEQ ID:246.

Another function of GAM189 is therefore inhibition of TTY7 (Accession NP__114132.1). Accordingly, utilities of GAM189 include diagnosis, prevention and treatment of diseases and clinical conditions associated with TTY7.

TU12B1-TY (Accession NP__057659.1) is another GAM189 target gene, herein designated TARGET GENE. TU12B1-TY BINDING SITE1 through TU12B1-TY BINDING SITE3 are target binding sites found in untranslated regions of mRNA encoded by TU12B1-TY, corresponding to target binding sites such as BINDING SITE I, BINDING SITE II or BINDING SITE III of FIG. 8. Table 4 illustrates the complementarity of the nucleotide sequences of TU12B1-TY BINDING SITE1 through TU12B1-TY BINDING SITE3, designated SEQ ID:4256, SEQ ID:16036 and SEQ ID:15780 respectively, to the nucleotide sequence of GAM189 RNA, herein designated GAM RNA, also designated SEQ ID:246.

Another function of GAM189 is therefore inhibition of TU12B1-TY (Accession NP__057659.1). Accordingly, utilities of GAM189 include diagnosis, prevention and treatment of diseases and clinical conditions associated with TU12B1-TY.

TUCAN (Accession NP__055774.1) is another GAM189 target gene, herein designated TARGET GENE. TUCAN BINDING SITE1 and TUCAN BINDING SITE2 are target binding sites found in untranslated regions of mRNA encoded by TUCAN, corresponding to target binding sites such as BINDING SITE I, BINDING SITE II or BINDING SITE III of FIG. 8. Table 4 illustrates the complementarity of the nucleotide sequences of TUCAN BINDING SITE1 and TUCAN BINDING SITE2, designated SEQ ID:9530 and SEQ ID:7106 respectively, to the nucleotide sequence of GAM189 RNA, herein designated GAM RNA, also designated SEQ ID:246.

Another function of GAM189 is therefore inhibition of TUCAN (Accession NP__055774.1). Accordingly, utilities of GAM189 include diagnosis, prevention and treatment of diseases and clinical conditions associated with TUCAN.

TXL-2 (Accession NP__835231.1) is another GAM189 target gene, herein designated TARGET GENE. TXL-2 BINDING SITE is a target binding site found in the 5' untranslated region of mRNA encoded by TXL-2, corresponding to a target binding site such as BINDING SITE I, BINDING SITE II or BINDING SITE III of FIG. 8. Table 4 illustrates the complementarity of the nucleotide sequences of TXL-2 BINDING SITE, designated SEQ ID:15381, to the nucleotide sequence of GAM189 RNA, herein designated GAM RNA, also designated SEQ ID:246.

Another function of GAM189 is therefore inhibition of TXL-2 (Accession NP__835231.1). Accordingly, utilities of GAM189 include diagnosis, prevention and treatment of diseases and clinical conditions associated with TXL-2.

Thioredoxin-like 2 (TXNL2, Accession NP__006532.1) is another GAM189 target gene, herein designated TARGET GENE. TXNL2 BINDING SITE1 and TXNL2 BINDING SITE2 are target binding sites found in untranslated regions of mRNA encoded by TXNL2, corresponding to target binding sites such as BINDING SITE I, BINDING SITE II or BINDING SITE III of FIG. 8. Table 4 illustrates the complementarity of the nucleotide sequences of TXNL2 BINDING SITE1 and TXNL2 BINDING SITE2, designated SEQ ID:19232 and SEQ ID:9147 respectively, to the nucleotide sequence of GAM189 RNA, herein designated GAM RNA, also designated SEQ ID:246.

Another function of GAM189 is therefore inhibition of Thioredoxin-like 2 (TXNL2, Accession NP__006532.1). Accordingly, utilities of GAM189 include diagnosis, prevention and treatment of diseases and clinical conditions associated with TXNL2.

U1SNRNPBP (Accession NP__851034.1) is another GAM189 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM189 RNA, herein designated GAM RNA, also designated SEQ ID:246.

Another function of GAM189 is therefore inhibition of U1SNRNPBP (Accession NP__851034.1). Accordingly, utilities of GAM189 include diagnosis, prevention and treatment of diseases and clinical conditions associated with U1SNRNPBP.

U1SNRNPBP (Accession NP__851030.1) is another GAM189 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM189 RNA, herein designated GAM RNA, also designated SEQ ID:246.

Another function of GAM189 is therefore inhibition of U1SNRNPBP (Accession NP__851030.1). Accordingly, utilities of GAM189 include diagnosis, prevention and treatment of diseases and clinical conditions associated with U1SNRNPBP.

U1SNRNPBP (Accession NP__008951.1) is another GAM189 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM189 RNA, herein designated GAM RNA, also designated SEQ ID:246.

Another function of GAM189 is therefore inhibition of U1SNRNPBP (Accession NP__008951.1). Accordingly, utilities of GAM189 include diagnosis, prevention and treatment of diseases and clinical conditions associated with U1SNRNPBP.

UCK1 (Accession NP__113620.1) is another GAM189 target gene, herein designated TARGET GENE. UCK1 BINDING SITE is a target binding site found in the 3' untranslated region of mRNA encoded by UCK1, corresponding to a target binding site such as BINDING SITE I, BINDING SITE II or BINDING SITE III of FIG. 8. Table 4 illustrates the complementarity of the nucleotide sequences of UCK1 BINDING SITE, designated SEQ ID:11791, to the nucleotide sequence of GAM189 RNA, herein designated GAM RNA, also designated SEQ ID:246.

Another function of GAM189 is therefore inhibition of UCK1 (Accession NP_113620.1). Accordingly, utilities of GAM189 include diagnosis, prevention and treatment of diseases and clinical conditions associated with UCK1.

Udp-glucose dehydrogenase (UGDH, Accession NP_003350.1) is another GAM189 target gene, herein designated TARGET GENE. UGDH BINDING SITE is a target binding site found in the 3' untranslated region of mRNA encoded by UGDH, corresponding to a target binding site such as BINDING SITE I, BINDING SITE II or BINDING SITE III of FIG. 8. Table 4 illustrates the complementarity of the nucleotide sequences of UGDH BINDING SITE, designated SEQ ID:7909, to the nucleotide sequence of GAM189 RNA, herein designated GAM RNA, also designated SEQ ID:246.

Another function of GAM189 is therefore inhibition of Udp-glucose dehydrogenase (UGDH, Accession NP_003350.1), a gene which is an UDP- glucose dehydrogenase. Accordingly, utilities of GAM189 include diagnosis, prevention and treatment of diseases and clinical conditions associated with UGDH.

The function of UGDH and its association with various diseases and clinical conditions, has been established by previous studies, as described hereinabove with reference to GAM69.2. Udp glycosyltransferase 1 family, polypeptide a1 (UGT1A1, Accession NP_000454.1) is another GAM189 target gene, herein designated TARGET GENE. UGT1A1 BINDING SITE is a target binding site found in the 3' untranslated region of mRNA encoded by UGT1A1, corresponding to a target binding site such as BINDING SITE I, BINDING SITE II or BINDING SITE III of FIG. 8. Table 4 illustrates the complementarity of the nucleotide sequences of UGT1A1 BINDING SITE, designated SEQ ID:10967, to the nucleotide sequence of GAM189 RNA, herein designated GAM RNA, also designated SEQ ID:246.

Another function of GAM189 is therefore inhibition of Udp glycosyltransferase 1 family, polypeptide a1 (UGT1A1, Accession NP_000454.1). Accordingly, utilities of GAM189 include diagnosis, prevention and treatment of diseases and clinical conditions associated with UGT1A1.

Udp glycosyltransferase 1 family, polypeptide a10 (UGT1A10, Accession NP_061948.1) is another GAM189 target gene, herein designated TARGET GENE. UGT1A10 BINDING SITE is a target binding site found in the 3' untranslated region of mRNA encoded by UGT1A10, corresponding to a target binding site such as BINDING SITE I, BINDING SITE II or BINDING SITE III of FIG. 8. Table 4 illustrates the complementarity of the nucleotide sequences of UGT1A10 BINDING SITE, designated SEQ ID:10967, to the nucleotide sequence of GAM189 RNA, herein designated GAM RNA, also designated SEQ ID:246.

Another function of GAM189 is therefore inhibition of Udp glycosyltransferase 1 family, polypeptide a10 (UGT1A10, Accession NP_061948.1). Accordingly, utilities of GAM189 include diagnosis, prevention and treatment of diseases and clinical conditions associated with UGT1A10.

Udp glycosyltransferase 1 family, polypeptide a4 (UGT1A4, Accession NP_009051.1) is another GAM189 target gene, herein designated TARGET GENE. UGT1A4 BINDING SITE is a target binding site found in the 3' untranslated region of mRNA encoded by UGT1A4, corresponding to a target binding site such as BINDING SITE I, BINDING SITE II or BINDING SITE III of FIG. 8. Table 4 illustrates the complementarity of the nucleotide sequences of UGT1A4 BINDING SITE, designated SEQ ID:10967, to the nucleotide sequence of GAM189 RNA, herein designated GAM RNA, also designated SEQ ID:246.

Another function of GAM189 is therefore inhibition of Udp glycosyltransferase 1 family, polypeptide a4 (UGT1A4, Accession NP_009051.1), a gene which is of major importance in the conjugation and subsequent elimination of potentially toxic xenobiotics and endogenous compounds. and therefore may be associated with Gilbert's syndrome, criglernajjar. Accordingly, utilities of GAM189 include diagnosis, prevention and treatment of Gilbert's syndrome, crigler-najjar, and of other diseases and clinical conditions associated with UGT1A4.

The function of UGT1A4 has been established by previous studies. By screening a liver cDNA library with a probe to a conserved transferase C-terminal sequence, followed by 5-prime RACE, Ritter et al. (1991) obtained cDNAs encoding UGT1A1 and UGT1A4, which they termed HUGBR1 and HUGBR2, respectively. The deduced 534-amino acid UGT1A4 protein shares 66% sequence similarity with UGT1A1 in the N terminus, which contains potential N-linked glycosylation sites, and complete identity after codon 287. Northern blot analysis revealed expression of a 2.6-kb transcript in liver. Unlike UGT1A1, expression of UGT1A4 is normal in type I Crigler-Najjar syndrome (OMIM Ref. No. 218800). Functional analysis showed that UGT1A4 has glucuronidating activity although, in a review of the UGTs, Tukey and Strassburg (2000) found that UGT1A4 activity with bilirubin is rather modest compared to that of UGT1A1. UGT1A4 is relatively active with amines, steroids, and sapogenins. By Northern blot analysis, Ritter et al. (1992) determined that UGT1A4, then termed UGT1D, is expressed at lower levels than UGT1A1 in liver. By Southern blot analysis, Ritter et al. (1992) determined that all of the UGT1A genes map to the same locus on chromosome 2.

Full details of the abovementioned studies are described in the following publications, the disclosure of which are hereby incorporated by reference:

Ritter, J. K.; Chen, F.; Sheen, Y. Y.; Tran, H. M.; Kimura, S.; Yeatman, M. T.; Owens, I. S.: A novel complex locus UGT1 encodes human bilirubin, phenol, and other UDP-glucuronosyltransferase isozymes with identical carboxyl termini. J. Biol. Chem. 267:3257-3261, 1992; and Tukey, R. H.; Strassburg, C. P.: Human UDP-glucuronosyltransferases: metabolism, expression, and disease. Annu. Rev. Pharm. Toxicol. 40:581-616, 2000.

Further studies establishing the function and utilities of UGT1A4 are found in John Hopkins OMIM database record ID 606429, and in cited publications listed in Table 5, which are hereby incorporated by reference. Udp glycosyltransferase 1 family, polypeptide a6 (UGT1A6, Accession NP_001063.1) is another GAM189 target gene, herein designated TARGET GENE. UGT1A6 BINDING SITE is a target binding site found in the 3' untranslated region of mRNA encoded by UGT1A6, corresponding to a target binding site such as BINDING SITE I, BINDING SITE II or BINDING SITE III of FIG. 8. Table 4 illustrates the complementarity of the nucleotide sequences of UGT1A6 BINDING SITE, designated SEQ ID:10967, to the nucleotide sequence of GAM189 RNA, herein designated GAM RNA, also designated SEQ ID:246.

Another function of GAM189 is therefore inhibition of Udp glycosyltransferase 1 family, polypeptide a6 (UGT1A6, Accession NP_001063.1). Accordingly, utilities of GAM189 include diagnosis, prevention and treatment of diseases and clinical conditions associated with UGT1A6.

Udp glycosyltransferase 1 family, polypeptide a8 (UGT1A8, Accession NP_061949.3) is another GAM189 target gene, herein designated TARGET GENE. UGT1A8 BINDING SITE is a target binding site found in the 3' untranslated region of mRNA encoded by UGT1A8, corresponding to a target binding site such as BINDING SITE I, BINDING SITE II or BINDING SITE III of FIG. 8. Table 4 illustrates the complementarity of the nucleotide sequences of UGT1A8 BINDING SITE, designated SEQ ID:10967, to the nucleotide sequence of GAM189 RNA, herein designated GAM RNA, also designated SEQ ID:246.

Another function of GAM189 is therefore inhibition of Udp glycosyltransferase 1 family, polypeptide a8 (UGT1A8, Accession NP_061949.3), a gene which is of major importance in the conjugation and subsequent elimination of potentially toxic xenobiotics and endogenous compounds. Accordingly, utilities of GAM189 include diagnosis, prevention and treatment of diseases and clinical conditions associated with UGT1A8.

The function of UGT1A8 has been established by previous studies. By screening colon cDNA libraries with UGT-specific primers, Mojarrabi and Mackenzie (1998) detected and sequenced UGT1A1, UGT1A3 (OMIM Ref. No. 606428), UGT1A4 (OMIM Ref. No. 606429), UGT1A6 (OMIM Ref. No. 606431), UGT1A8, UGT1A9 (OMIM Ref. No. 606434), and UGT1A10 (OMIM Ref. No. 606435). Of these forms, only UGT1A8 and UGT1A10 are expressed predominantly in colon; the others are found in liver and other extrahepatic tissues. Sequence analysis predicted that the catalytically active form of UGT1A8 has lys132, thr202, and met212, instead of arg, ala, and leu, respectively, at these positions. Western blot analysis showed expression of a 56-kD protein that is most active towards hydroxylated metabolites of carcinogenic coumarins. RT-PCR analysis revealed expression in colon but not in liver, kidney, and several other tissues. Mojarrabi and Mackenzie (1998) suggested that UGT1A8 may be of particular importance in the glucuronidation of drugs given orally or as suppositories as well as in the elimination of ingested dietary mutagens and toxins. No 2 tissues contain the same identical complement of UGT proteins. This observation suggests that the functional properties of the proteins may have evolved to meet the unique challenges necessary for glucuronidation in different tissues. This is best represented by the extrahepatic expression of UGT1A7, UGT1A8, and UGT1A10, all 3 of which are found in different tissues of the intestinal tract. With the high concentration of UGTs in the intestinal tract, these proteins may play an important role in first-pass metabolism, and thus alterations in function resulting from pharmacogenetic differences may influence systemic drug levels and therapeutic outcome. Huang et al. (2002) identified 4 genotypes at the UGT1A8 locus in 69 individuals. Their results indicated that the functional properties of the proteins encoded by UGT1A8*1 and UGT1A8*2 differ significantly in catalytic potential from UGT1A8*3.

Full details of the abovementioned studies are described in the following publications, the disclosure of which are hereby incorporated by reference:

Huang, Y.-H.; Galijatovic, A.; Nguyen, N.; Geske, D.; Beaton, D.; Green, J.; Green, M.; Peters, W. H.; Tukey, R. H.: Identification and functional characterization of UDP- glucuronosyltransferases UGT1A8*1, UGT1A8*2 and UGT1A8*3. Pharmacogenetics 12:287-297, 2002; and Mojarrabi, B.; Mackenzie, P. I.: Characterization of two UDP glucuronosyltransferases that are predominantly expressed in human colon. Biochem. Biophys. Res. Commun. 247:704-709, 199.

Further studies establishing the function and utilities of UGT1A8 are found in John Hopkins OMIM database record ID 606433, and in cited publications listed in Table 5, which are hereby incorporated by reference. Udp glycosyltransferase 1 family, polypeptide a9 (UGT1A9, Accession NP_066307.1) is another GAM189 target gene, herein designated TARGET GENE. UGT1A9 BINDING SITE is a target binding site found in the 3' untranslated region of mRNA encoded by UGT1A9, corresponding to a target binding site such as BINDING SITE I, BINDING SITE II or BINDING SITE III of FIG. 8. Table 4 illustrates the complementarity of the nucleotide sequences of UGT1A9 BINDING SITE, designated SEQ ID:10967, to the nucleotide sequence of GAM189 RNA, herein designated GAM RNA, also designated SEQ ID:246.

Another function of GAM189 is therefore inhibition of Udp glycosyltransferase 1 family, polypeptide a9 (UGT1A9, Accession NP_066307.1), a gene which is of major importance in the conjugation and subsequent elimination of potentially toxic xenobiotics and endogenous compounds. Accordingly, utilities of GAM189 include diagnosis, prevention and treatment of diseases and clinical conditions associated with UGT1A9.

The function of UGT1A9 has been established by previous studies. By screening a liver cDNA library with a UGT1A6 (OMIM Ref. No. 606431) probe, Wooster et al. (1991) isolated a cDNA encoding UGT1A9, which they termed HLUGP4. The deduced 531-amino acid protein shares 67% overall sequence identity with UGT1A1 but only 38% in the N terminus. Western blot analysis showed expression of a 56-kD protein. Functional analysis indicated that, like UGT1A6, UGT1A9 is most active towards halogenated phenols with higher UGT1A9 activity with simple phenols. Findlay et al. (2000) reported that the predominant thyroid hormone released from the thyroid gland, T4, and the inactive rat T3 were glucuronidated by cloned expressed bilirubin UGT1A1 and also phenol UGT1A9. Results from Crigler-Najjar (see OMIM Ref. No. 218800) microsomal samples indicated that UGT1A1 was the main contributor to thyroid hormone glucuronidation in the liver, with rat T3 being the preferential substrate. In kidney microsomes, thyroid hormone glucuronidation was more complex, suggesting that more than just the UGT1A9 isoform may be involved. Bioactive T3 was not significantly glucuronidated by these isoforms and other UGTs, and sulfotransferases may have been involved.

Full details of the abovementioned studies are described in the following publications, the disclosure of which are hereby incorporated by reference:

Wooster, R.; Sutherland, L.; Ebner, T.; Clarke, D.; Da Cruz e Silva, O.; Burchell, B.: Cloning and stable expression of a new member of the human liver phenol/bilirubin:UDP-glucuronosyltransferase cDNA family. Biochem. J. 278:465-469, 1991; and Findlay, K. A. B.; Kaptein, E.; Visser, T. J.; Burchell, B.: Characterization of the uridine diphosphate-glucuronosyl-transferase-catalyzing thyroid hormone glucuronidation in man. J. C.

Further studies establishing the function and utilities of UGT1A9 are found in John Hopkins OMIM database record ID 606434, and in cited publications listed in Table 5, which are hereby incorporated by reference. Uridine monophosphate synthetase (orotate phosphoribosyl transferase and orotidine-5'-decarboxylase) (UMPS, Accession NP_000364.1) is another GAM189 target gene, herein designated TARGET GENE. UMPS BINDING SITE is a target binding site found in the 3' untranslated region of mRNA encoded by UMPS, corresponding to a target binding site such as BINDING SITE I, BINDING SITE II or BINDING SITE III of FIG. 8. Table 4 illustrates the complementarity of the nucleotide sequences of UMPS BINDING SITE, designated SEQ ID:2144, to the nucleotide sequence of GAM189 RNA, herein designated GAM RNA, also designated SEQ ID:246.

Another function of GAM189 is therefore inhibition of Uridine monophosphate synthetase (orotate phosphoribosyl transferase and orotidine-5'-decarboxylase) (UMPS, Accession NP_000364.1). Accordingly, utilities of GAM189 include diagnosis, prevention and treatment of diseases and clinical conditions associated with UMPS.

Unc-84 homolog a (c. elegans) (UNC84B, Accession XP_039332.1) is another GAM189 target gene, herein designated TARGET GENE. UNC84B BINDING SITE is a target binding site found in the 3' untranslated region of multiple transcripts of mRNA encoded by UNC84B, corresponding to a target binding site such as BINDING SITE I, BINDING SITE II or BINDING SITE III of FIG. 8. Table 4 illustrates the complementarity of the nucleotide sequences of UNC84B BINDING SITE, designated SEQ ID:13541, to the nucleotide sequence of GAM189 RNA, herein designated GAM RNA, also designated SEQ ID:246.

Another function of GAM189 is therefore inhibition of Unc-84 homolog a (c. elegans) (UNC84B, Accession XP_039332.1). Accordingly, utilities of GAM189 include diagnosis, prevention and treatment of diseases and clinical conditions associated with UNC84B.

Unc-84 homolog a (c. elegans) (UNC84B, Accession NP_056189.1) is another GAM189 target gene, herein designated TARGET GENE. UNC84B BINDING SITE is a target binding site found in the 3' untranslated region of multiple transcripts of mRNA encoded by UNC84B, corresponding to a target binding site such as BINDING SITE I, BINDING SITE II or BINDING SITE III of FIG. 8. Table 4 illustrates the complementarity of the nucleotide sequences of UNC84B BINDING SITE, designated SEQ ID:13541, to the nucleotide sequence of GAM189 RNA, herein designated GAM RNA, also designated SEQ ID:246.

Another function of GAM189 is therefore inhibition of Unc-84 homolog a (c. elegans) (UNC84B, Accession NP_056189.1). Accordingly, utilities of GAM189 include diagnosis, prevention and treatment of diseases and clinical conditions associated with UNC84B.

URG4 (Accession NP_060390.2) is another GAM189 target gene, herein designated TARGET GENE. URG4 BINDING SITE is a target binding site found in the 3' untranslated region of mRNA encoded by URG4, corresponding to a target binding site such as BINDING SITE I, BINDING SITE II or BINDING SITE III of FIG. 8. Table 4 illustrates the complementarity of the nucleotide sequences of URG4 BINDING SITE, designated SEQ ID:6788, to the nucleotide sequence of GAM189 RNA, herein designated GAM RNA, also designated SEQ ID:246.

Another function of GAM189 is therefore inhibition of URG4 (Accession NP_060390.2). Accordingly, utilities of GAM189 include diagnosis, prevention and treatment of diseases and clinical conditions associated with URG4.

Ubiquitin specific protease 22 (USP22, Accession XP_042698.2) is another GAM189 target gene, herein designated TARGET GENE. USP22 BINDING SITE is a target binding site found in the 3' untranslated region of mRNA encoded by USP22, corresponding to a target binding site such as BINDING SITE I, BINDING SITE II or BINDING SITE III of FIG. 8. Table 4 illustrates the complementarity of the nucleotide sequences of USP22 BINDING SITE, designated SEQ ID:11288, to the nucleotide sequence of GAM189 RNA, herein designated GAM RNA, also designated SEQ ID:246.

Another function of GAM189 is therefore inhibition of Ubiquitin specific protease 22 (USP22, Accession XP_042698.2). Accordingly, utilities of GAM189 include diagnosis, prevention and treatment of diseases and clinical conditions associated with USP22.

VDU1 (Accession NP_055832.2) is another GAM189 target gene, herein designated TARGET GENE. VDU1 BINDING SITE is a target binding site found in the 3' untranslated region of mRNA encoded by VDU1, corresponding to a target binding site such as BINDING SITE I, BINDING SITE II or BINDING SITE III of FIG. 8. Table 4 illustrates the complementarity of the nucleotide sequences of VDU1 BINDING SITE, designated SEQ ID:3187, to the nucleotide sequence of GAM189 RNA, herein designated GAM RNA, also designated SEQ ID:246.

Another function of GAM189 is therefore inhibition of VDU1 (Accession NP_055832.2). Accordingly, utilities of GAM189 include diagnosis, prevention and treatment of diseases and clinical conditions associated with VDU1.

Vent-like homeobox 2 (VENTX2, Accession NP_055283.1) is another GAM189 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:19331, to the nucleotide sequence of GAM189 RNA, herein designated GAM RNA, also designated SEQ ID:246.

Another function of GAM189 is therefore inhibition of Vent-like homeobox 2 (VENTX2, Accession NP_055283.1). Accordingly, utilities of GAM189 include diagnosis, prevention and treatment of diseases and clinical conditions associated with VENTX2.

Von hippel-lindau syndrome (VHL, Accession NP_000542.1) is another GAM189 target gene, herein designated TARGET GENE. VHL BINDING SITE1 and VHL BINDING SITE2 are target binding sites found in untranslated regions of mRNA encoded by VHL, corresponding to target binding sites such as BINDING SITE I, BINDING SITE II or BINDING SITE III of FIG. 8. Table 4 illustrates the complementarity of the nucleotide sequences of VHL BINDING SITE1 and VHL BINDING SITE2, designated SEQ ID:3873 and SEQ ID:8786 respectively, to the nucleotide sequence of GAM189 RNA, herein designated GAM RNA, also designated SEQ ID:246.

Another function of GAM189 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM189 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. Vasoactive intestinal peptide receptor 2 (VIPR2, Accession NP_003373.2) is another GAM189 target gene, herein designated TARGET GENE. VIPR2 BINDING SITE is a target binding site found in the 3' untranslated region of mRNA encoded by VIPR2, corresponding to a target binding site such as BINDING SITE I, BINDING SITE II or BINDING SITE III of FIG. 8. Table 4 illustrates the complementarity of the nucleotide sequences of VIPR2 BINDING SITE, designated SEQ ID:7754, to the nucleotide sequence of GAM189 RNA, herein designated GAM RNA, also designated SEQ ID:246.

Another function of GAM189 is therefore inhibition of Vasoactive intestinal peptide receptor 2 (VIPR2, Accession NP_003373.2). Accordingly, utilities of GAM189 include diagnosis, prevention and treatment of diseases and clinical conditions associated with VIPR2.

VPS39 (Accession XP_031720.2) is another GAM189 target gene, herein designated TARGET GENE. VPS39 BINDING SITE is a target binding site found in the 3' untranslated region of mRNA encoded by VPS39, corresponding to a target binding site such as BINDING SITE I, BINDING SITE II or BINDING SITE III of FIG. 8. Table 4 illustrates the complementarity of the nucleotide sequences of VPS39 BINDING SITE, designated SEQ ID:18246, to the nucleotide sequence of GAM189 RNA, herein designated GAM RNA, also designated SEQ ID:246.

Another function of GAM189 is therefore inhibition of VPS39 (Accession XP_031720.2). Accordingly, utilities of GAM189 include diagnosis, prevention and treatment of diseases and clinical conditions associated with VPS39.

Vesicle transport through interaction with t-snares homolog 1a (yeast) (VTI1A, Accession NP_660207.1) is another GAM189 target gene, herein designated TARGET GENE. VTI1A BINDING SITE is a target binding site found in the 3' untranslated region of mRNA encoded by VTI1A, corresponding to a target binding site such as BINDING SITE I, BINDING SITE II or BINDING SITE III of FIG. 8. Table 4 illustrates the complementarity of the nucleotide sequences of VTI1A BINDING SITE, designated SEQ ID:2313, to the nucleotide sequence of GAM189 RNA, herein designated GAM RNA, also designated SEQ ID:246.

Another function of GAM189 is therefore inhibition of Vesicle transport through interaction with t-snares homolog 1a (yeast) (VTI1A, Accession NP_660207.1). Accordingly, utilities of GAM189 include diagnosis, prevention and treatment of diseases and clinical conditions associated with VTI1A.

Williams beuren syndrome chromosome region 18 (WBSCR18, Accession NP_115693.2) is another GAM189 target gene, herein designated TARGET GENE. WBSCR18 BINDING SITE is a target binding site found in the 3' untranslated region of mRNA encoded by WBSCR18, corresponding to a target binding site such as BINDING SITE I, BINDING SITE II or BINDING SITE III of FIG. 8. Table 4 illustrates the complementarity of the nucleotide sequences of WBSCR18 BINDING SITE, designated SEQ ID:2152, to the nucleotide sequence of GAM189 RNA, herein designated GAM RNA, also designated SEQ ID:246.

Another function of GAM189 is therefore inhibition of Williams beuren syndrome chromosome region 18 (WBSCR18, Accession NP_115693.2). Accordingly, utilities of GAM189 include diagnosis, prevention and treatment of diseases and clinical conditions associated with WBSCR18.

Wd repeat domain 6 (WDR6, Accession NP_439891.1) is another GAM189 target gene, herein designated TARGET GENE. WDR6 BINDING SITE is a target binding site found in the 5' untranslated region of multiple transcripts of mRNA encoded by WDR6, corresponding to a target binding site such as BINDING SITE I, BINDING SITE II or BINDING SITE III of FIG. 8. Table 4 illustrates the complementarity of the nucleotide sequences of WDR6 BINDING SITE, designated SEQ ID:12628, to the nucleotide sequence of GAM189 RNA, herein designated GAM RNA, also designated SEQ ID:246.

Another function of GAM189 is therefore inhibition of Wd repeat domain 6 (WDR6, Accession NP_439891.1). Accordingly, utilities of GAM189 include diagnosis, prevention and treatment of diseases and clinical conditions associated with WDR6.

Wolf-hirschhorn syndrome candidate 1 (WHSC1, Accession NP_579889.1) is another GAM189 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:9245, to the nucleotide sequence of GAM189 RNA, herein designated GAM RNA, also designated SEQ ID:246.

Another function of GAM189 is therefore inhibition of Wolf-hirschhorn syndrome candidate 1 (WHSC1, Accession NP_579889.1), a gene which binds covalently to and repairs g/t mismatches. and therefore may be associated with Wolf-hirschhorn syndrome. Accordingly, utilities of GAM189 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wingless-type mmtv integration site family, member 5a (WNT5A, Accession NP_003383.1) is another GAM189 target gene, herein designated TARGET GENE. WNT5A BINDING SITE is a target binding site found in the 5' untranslated region of mRNA encoded by WNT5A, corresponding to a target binding site such as BINDING SITE I, BINDING SITE II or BINDING SITE III of FIG. 8. Table 4 illustrates the complementarity of the nucleotide sequences of WNT5A BINDING SITE, designated SEQ ID:10269, to the nucleotide sequence of GAM189 RNA, herein designated GAM RNA, also designated SEQ ID:246.

Another function of GAM189 is therefore inhibition of Wingless-type mmtv integration site family, member 5a (WNT5A, Accession NP_003383.1), a gene which is a ligand for members of the frizzled family of seven transmembrane receptors and is probablely a developmental protein. Accordingly, utilities of GAM189 include diagnosis, prevention and treatment of diseases and clinical conditions associated with WNT5A.

The function of WNT5A and its association with various diseases and clinical conditions, has been established by previous studies, as described hereinabove with reference to GAM116.1. X-ray repair complementing defective repair in chinese hamster cells 2 (XRCC2, Accession NP_005422.1) is another GAM189 target gene, herein designated TARGET GENE. XRCC2 BINDING SITE1 through XRCC2 BINDING SITE3 are target binding sites found in untranslated regions of mRNA encoded by XRCC2, corresponding to target binding sites such as BINDING SITE I, BINDING SITE II or BINDING SITE III of FIG. 8. Table 4 illustrates the complementarity of the nucleotide sequences of XRCC2 BINDING SITE1 through XRCC2 BINDING SITE3, designated SEQ ID:10148, SEQ ID:12605 and SEQ ID:9688 respectively, to the nucleotide sequence of GAM189 RNA, herein designated GAM RNA, also designated SEQ ID:246.

Another function of GAM189 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM189 include diagnosis, prevention and treatment of diseases and clinical conditions associated with XRCC2.

The function of XRCC2 and its association with various diseases and clinical conditions, has been established by previous studies, as described hereinabove with reference to GAM72.1. V-yes-1 yamaguchi sarcoma viral oncogene homolog 1 (YES1, Accession NP_005424.1) is another GAM189 target gene, herein designated TARGET GENE. YES1 BINDING SITE is a target binding site found in the 3' untranslated region of mRNA encoded by YES1, corresponding to a target binding site such as BINDING SITE I, BINDING SITE II or BINDING SITE III of FIG. 8. Table 4 illustrates the complementarity of the nucleotide sequences of YES1 BINDING SITE, designated SEQ ID:16112, to the nucleotide sequence of GAM189 RNA, herein designated GAM RNA, also designated SEQ ID:246.

Another function of GAM189 is therefore inhibition of V-yes-1 yamaguchi sarcoma viral oncogene homolog 1 (YES1, Accession NP_005424.1), a gene which is a putative protein-tyrosine kinase. Accordingly, utilities of GAM189 include diagnosis, prevention and treatment of diseases and clinical conditions associated with YES1.

The function of YES1 and its association with various diseases and clinical conditions, has been established by previous studies, as described hereinabove with reference to GAM30.1. ZAP (Accession NP_064504.2) is another GAM189 target gene, herein designated TARGET GENE. ZAP BINDING SITE1 and ZAP BINDING SITE2 are target binding sites found in untranslated regions of multiple transcripts of mRNA encoded by ZAP, corresponding to target binding sites such as BINDING SITE I, BINDING SITE II or BINDING SITE III of FIG. 8. Table 4 illustrates the complementarity of the nucleotide sequences of ZAP BINDING SITE1 and ZAP BINDING SITE2, designated SEQ ID:508 and SEQ ID:3071 respectively, to the nucleotide sequence of GAM189 RNA, herein designated GAM RNA, also designated SEQ ID:246.

Another function of GAM189 is therefore inhibition of ZAP (Accession NP_064504.2). Accordingly, utilities of GAM189 include diagnosis, prevention and treatment of diseases and clinical conditions associated with ZAP.

ZFP30 (Accession NP_055713.1) is another GAM189 target gene, herein designated TARGET GENE. ZFP30 BINDING SITE is a target binding site found in the 3' untranslated region of mRNA encoded by ZFP30, corresponding to a target binding site such as BINDING SITE I, BINDING SITE II or BINDING SITE III of FIG. 8. Table 4 illustrates the complementarity of the nucleotide sequences of ZFP30 BINDING SITE, designated SEQ ID:9331, to the nucleotide sequence of GAM189 RNA, herein designated GAM RNA, also designated SEQ ID:246.

Another function of GAM189 is therefore inhibition of ZFP30 (Accession NP_055713.1). Accordingly, utilities of GAM189 include diagnosis, prevention and treatment of diseases and clinical conditions associated with ZFP30.

ZFP42 (Accession NP_777560.1) is another GAM189 target gene, herein designated TARGET GENE. ZFP42 BINDING SITE is a target binding site found in the 3' untranslated region of mRNA encoded by ZFP42, corresponding to a target binding site such as BINDING SITE I, BINDING SITE II or BINDING SITE III of FIG. 8. Table 4 illustrates the complementarity of the nucleotide sequences of ZFP42 BINDING SITE, designated SEQ ID:10587, to the nucleotide sequence of GAM189 RNA, herein designated GAM RNA, also designated SEQ ID:246.

Another function of GAM189 is therefore inhibition of ZFP42 (Accession NP_777560.1). Accordingly, utilities of GAM189 include diagnosis, prevention and treatment of diseases and clinical conditions associated with ZFP42.

Zinc finger protein 64 homolog (mouse) (ZFP64, Accession NP_060667.1) is another GAM189 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:15043, to the nucleotide sequence of GAM189 RNA, herein designated GAM RNA, also designated SEQ ID:246.

Another function of GAM189 is therefore inhibition of Zinc finger protein 64 homolog (mouse) (ZFP64, Accession NP_060667.1). Accordingly, utilities of GAM189 include diagnosis, prevention and treatment of diseases and clinical conditions associated with ZFP64.

Zinc finger protein 64 homolog (mouse) (ZFP64, Accession NP_071371.2) is another GAM189 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:15043, to the nucleotide sequence of GAM189 RNA, herein designated GAM RNA, also designated SEQ ID:246.

Another function of GAM189 is therefore inhibition of Zinc finger protein 64 homolog (mouse) (ZFP64, Accession NP_071371.2). Accordingly, utilities of GAM189 include diagnosis, prevention and treatment of diseases and clinical conditions associated with ZFP64.

ZFYVE26 (Accession XP_031077.1) is another GAM189 target gene, herein designated TARGET GENE. ZFYVE26 BINDING SITE is a target binding site found in the 3' untranslated region of mRNA encoded by ZFYVE26, corresponding to a target binding site such as BINDING SITE I, BINDING SITE II or BINDING SITE III of FIG. 8. Table 4 illustrates the complementarity of the nucleotide sequences of ZFYVE26 BINDING SITE, designated SEQ ID:12160, to the nucleotide sequence of GAM189 RNA, herein designated GAM RNA, also designated SEQ ID:246.

Another function of GAM189 is therefore inhibition of ZFYVE26 (Accession XP_031077.1). Accordingly, utilities of GAM189 include diagnosis, prevention and treatment of diseases and clinical conditions associated with ZFYVE26.

ZMYND17 (Accession NP_848546.1) is another GAM189 target gene, herein designated TARGET GENE. ZMYND17 BINDING SITE is a target binding site found in the 3' untranslated region of mRNA encoded by ZMYND17, corresponding to a target binding site such as BINDING SITE I, BINDING SITE II or BINDING SITE III of FIG. 8. Table 4 illustrates the complementarity of the nucleotide sequences of ZMYND17 BINDING SITE, designated SEQ ID:456, to the nucleotide sequence of GAM189 RNA, herein designated GAM RNA, also designated SEQ ID:246.

Another function of GAM189 is therefore inhibition of ZMYND17 (Accession NP_848546.1). Accordingly, utilities of GAM189 include diagnosis, prevention and treatment of diseases and clinical conditions associated with ZMYND17.

Zinc finger protein 18 (kox 11) (ZNF18, Accession XP_085596.2) is another GAM189 target gene, herein designated TARGET GENE. ZNF18 BINDING SITE is a target binding site found in the 5' untranslated region of mRNA encoded by ZNF18, corresponding to a target binding site such as BINDING SITE I, BINDING SITE II or BINDING SITE III of FIG. 8. Table 4 illustrates the complementarity of the nucleotide sequences of ZNF18 BINDING SITE, designated SEQ ID:19151, to the nucleotide sequence of GAM189 RNA, herein designated GAM RNA, also designated SEQ ID:246.

Another function of GAM189 is therefore inhibition of Zinc finger protein 18 (kox 11) (ZNF18, Accession XP_085596.2). Accordingly, utilities of GAM189 include diagnosis, prevention and treatment of diseases and clinical conditions associated with ZNF18.

Zinc finger protein 253 (ZNF253, Accession NP_066385.1) is another GAM189 target gene, herein designated TARGET GENE. ZNF253 BINDING SITE is a target binding site found in the 3' untranslated region of mRNA encoded by ZNF253, corresponding to a target binding site such as BINDING SITE I, BINDING SITE II or BINDING SITE III of FIG. 8. Table 4 illustrates the complementarity of the nucleotide sequences of ZNF253 BINDING SITE, designated SEQ ID:19746, to the nucleotide sequence of GAM189 RNA, herein designated GAM RNA, also designated SEQ ID:246.

Another function of GAM189 is therefore inhibition of Zinc finger protein 253 (ZNF253, Accession NP_066385.1). Accordingly, utilities of GAM189 include diagnosis, prevention and treatment of diseases and clinical conditions associated with ZNF253.

Zinc finger protein 264 (ZNF264, Accession NP_003408.1) is another GAM189 target gene, herein designated TARGET GENE. ZNF264 BINDING SITE1 and ZNF264 BINDING SITE2 are target binding sites found in untranslated regions of mRNA encoded by ZNF264, corresponding to target binding sites such as BINDING SITE I, BINDING SITE II or BINDING SITE III of FIG. 8. Table 4 illustrates the complementarity of the nucleotide sequences of ZNF264 BINDING SITE1 and ZNF264 BINDING SITE2, designated SEQ ID:3319 and SEQ ID:9147 respectively, to the nucleotide sequence of GAM189 RNA, herein designated GAM RNA, also designated SEQ ID:246.

Another function of GAM189 is therefore inhibition of Zinc finger protein 264 (ZNF264, Accession NP_003408.1). Accordingly, utilities of GAM189 include diagnosis, prevention and treatment of diseases and clinical conditions associated with ZNF264.

Zinc finger protein 273 (ZNF273, Accession XP_088082.1) is another GAM189 target gene, herein designated TARGET GENE. ZNF273 BINDING SITE is a target binding site found in the 3' untranslated region of mRNA encoded by ZNF273, corresponding to a target binding site such as BINDING SITE I, BINDING SITE II or BINDING SITE III of FIG. 8. Table 4 illustrates the complementarity of the nucleotide sequences of ZNF273 BINDING SITE, designated SEQ ID:18868, to the nucleotide sequence of GAM189 RNA, herein designated GAM RNA, also designated SEQ ID:246.

Another function of GAM189 is therefore inhibition of Zinc finger protein 273 (ZNF273, Accession XP_088082.1). Accordingly, utilities of GAM189 include diagnosis, prevention and treatment of diseases and clinical conditions associated with ZNF273.

Zinc finger protein 281 (ZNF281, Accession NP_036614.1) is another GAM189 target gene, herein designated TARGET GENE. ZNF281 BINDING SITE is a target binding site found in the 3' untranslated region of mRNA encoded by ZNF281, corresponding to a target binding site such as BINDING SITE I, BINDING SITE II or BINDING SITE III of FIG. 8. Table 4 illustrates the complementarity of the nucleotide sequences of ZNF281 BINDING SITE, designated SEQ ID:16434, to the nucleotide sequence of GAM189 RNA, herein designated GAM RNA, also designated SEQ ID:246.

Another function of GAM189 is therefore inhibition of Zinc finger protein 281 (ZNF281, Accession NP_036614.1). Accordingly, utilities of GAM189 include diagnosis, prevention and treatment of diseases and clinical conditions associated with ZNF281.

Zinc finger protein 289, id1 regulated (ZNF289, Accession NP_115765.2) is another GAM189 target gene, herein designated TARGET GENE. ZNF289 BINDING SITE is a target binding site found in the 3' untranslated region of mRNA encoded by ZNF289, corresponding to a target binding site such as BINDING SITE I, BINDING SITE II or BINDING SITE III of FIG. 8. Table 4 illustrates the complementarity of the nucleotide sequences of ZNF289 BINDING SITE, designated SEQ ID:13159, to the nucleotide sequence of GAM189 RNA, herein designated GAM RNA, also designated SEQ ID:246.

Another function of GAM189 is therefore inhibition of Zinc finger protein 289, id1 regulated (ZNF289, Accession NP_115765.2). Accordingly, utilities of GAM189 include diagnosis, prevention and treatment of diseases and clinical conditions associated with ZNF289.

Zinc finger protein 305 (ZNF305, Accession NP_055539.1) is another GAM189 target gene, herein designated TARGET GENE. ZNF305 BINDING SITE is a target binding site found in the 3' untranslated region of mRNA encoded by ZNF305, corresponding to a target binding site such as BINDING SITE I, BINDING SITE II or BINDING SITE III of FIG. 8. Table 4 illustrates the complementarity of the nucleotide sequences of ZNF305 BINDING SITE, designated SEQ ID:18505, to the nucleotide sequence of GAM189 RNA, herein designated GAM RNA, also designated SEQ ID:246.

Another function of GAM189 is therefore inhibition of Zinc finger protein 305 (ZNF305, Accession NP_055539.1). Accordingly, utilities of GAM189 include diagnosis, prevention and treatment of diseases and clinical conditions associated with ZNF305.

Zinc finger protein 334 (ZNF334, Accession NP_060572.2) is another GAM189 target gene, herein designated TARGET GENE. ZNF334 BINDING SITE1 and ZNF334 BINDING SITE2 are target binding sites found in untranslated regions of mRNA encoded by ZNF334, corresponding to target binding sites such as BINDING SITE I, BINDING SITE II or BINDING SITE III of FIG. 8. Table 4 illustrates the complementarity of the nucleotide sequences of ZNF334 BINDING SITE1 and ZNF334 BINDING SITE2, designated SEQ ID:9628 and SEQ ID:5064 respectively, to the nucleotide sequence of GAM189 RNA, herein designated GAM RNA, also designated SEQ ID:246.

Another function of GAM189 is therefore inhibition of Zinc finger protein 334 (ZNF334, Accession NP_060572.2). Accordingly, utilities of GAM189 include diagnosis, prevention and treatment of diseases and clinical conditions associated with ZNF334.

Zinc finger protein 339 (ZNF339, Accession NP_067043.1) is another GAM189 target gene, herein designated TARGET GENE. ZNF339 BINDING SITE is a target binding site found in the 3' untranslated region of mRNA encoded by ZNF339, corresponding to a target binding site such as BINDING SITE I, BINDING SITE II or BINDING SITE III of FIG. 8. Table 4 illustrates the complementarity of the nucleotide sequences of ZNF339 BINDING SITE, designated SEQ ID:1729, to the nucleotide sequence of GAM189 RNA, herein designated GAM RNA, also designated SEQ ID:246.

Another function of GAM189 is therefore inhibition of Zinc finger protein 339 (ZNF339, Accession NP_067043.1). Accordingly, utilities of GAM189 include diagnosis, prevention and treatment of diseases and clinical conditions associated with ZNF339.

Zinc finger protein 345 (ZNF345, Accession NP_003410.1) is another GAM189 target gene, herein designated TARGET GENE. ZNF345 BINDING SITE is a target binding site found in the 3' untranslated region of mRNA encoded by ZNF345, corresponding to a target binding site such as BINDING SITE I, BINDING SITE II or BINDING SITE III of FIG. 8. Table 4 illustrates the complementarity of the nucleotide sequences of ZNF345 BINDING SITE, designated SEQ ID:1011, to the nucleotide sequence of GAM189 RNA, herein designated GAM RNA, also designated SEQ ID:246.

Another function of GAM189 is therefore inhibition of Zinc finger protein 345 (ZNF345, Accession NP_003410.1). Accordingly, utilities of GAM189 include diagnosis, prevention and treatment of diseases and clinical conditions associated with ZNF345.

Zinc finger protein 398 (ZNF398, Accession NP_065832.1) is another GAM189 target gene, herein designated TARGET GENE. ZNF398 BINDING SITE is a target binding site found in the 5' untranslated region of multiple transcripts of mRNA encoded by ZNF398, corresponding to a target binding site such as BINDING SITE I, BINDING SITE II or BINDING SITE III of FIG. 8. Table 4 illustrates the complementarity of the nucleotide sequences of ZNF398 BINDING SITE, designated SEQ ID:8530, to the nucleotide sequence of GAM189 RNA, herein designated GAM RNA, also designated SEQ ID:246.

Another function of GAM189 is therefore inhibition of Zinc finger protein 398 (ZNF398, Accession NP_065832.1). Accordingly, utilities of GAM189 include diagnosis, prevention and treatment of diseases and clinical conditions associated with ZNF398.

ZNF409 (Accession NP_055709.1) is another GAM189 target gene, herein designated TARGET GENE. ZNF409 BINDING SITE is a target binding site found in the 5' untranslated region of mRNA encoded by ZNF409, corresponding to a target binding site such as BINDING SITE I, BINDING SITE II or BINDING SITE III of FIG. 8. Table 4 illustrates the complementarity of the nucleotide sequences of ZNF409 BINDING SITE, designated SEQ ID:2388, to the nucleotide sequence of GAM189 RNA, herein designated GAM RNA, also designated SEQ ID:246.

Another function of GAM189 is therefore inhibition of ZNF409 (Accession NP_055709.1). Accordingly, utilities of GAM189 include diagnosis, prevention and treatment of diseases and clinical conditions associated with ZNF409.

ZNF431 (Accession XP_086098.2) is another GAM189 target gene, herein designated TARGET GENE. ZNF431 BINDING SITE is a target binding site found in the 3' untranslated region of mRNA encoded by ZNF431, corresponding to a target binding site such as BINDING SITE I, BINDING SITE II or BINDING SITE III of FIG. 8. Table 4 illustrates the complementarity of the nucleotide sequences of ZNF431 BINDING SITE, designated SEQ ID:8477, to the nucleotide sequence of GAM189 RNA, herein designated GAM RNA, also designated SEQ ID:246.

Another function of GAM189 is therefore inhibition of ZNF431 (Accession XP_086098.2). Accordingly, utilities of GAM189 include diagnosis, prevention and treatment of diseases and clinical conditions associated with ZNF431.

ZNF432 (Accession NP_055465.1) is another GAM189 target gene, herein designated TARGET GENE. ZNF432 BINDING SITE is a target binding site found in the 3' untranslated region of mRNA encoded by ZNF432, corresponding to a target binding site such as BINDING SITE I, BINDING SITE II or BINDING SITE III of FIG. 8. Table 4 illustrates the complementarity of the nucleotide sequences of ZNF432 BINDING SITE, designated SEQ ID:5065, to the nucleotide sequence of GAM189 RNA, herein designated GAM RNA, also designated SEQ ID:246.

Another function of GAM189 is therefore inhibition of ZNF432 (Accession NP_055465.1). Accordingly, utilities of GAM189 include diagnosis, prevention and treatment of diseases and clinical conditions associated with ZNF432.

ZNF440 (Accession NP_689570.1) is another GAM189 target gene, herein designated TARGET GENE. ZNF440 BINDING SITE is a target binding site found in the 3' untranslated region of mRNA encoded by ZNF440, corresponding to a target binding site such as BINDING SITE I, BINDING SITE II or BINDING SITE III of FIG. 8. Table 4 illustrates the complementarity of the nucleotide sequences of ZNF440 BINDING SITE, designated SEQ ID:1744, to the nucleotide sequence of GAM189 RNA, herein designated GAM RNA, also designated SEQ ID:246.

Another function of GAM189 is therefore inhibition of ZNF440 (Accession NP_689570.1). Accordingly, utilities of GAM189 include diagnosis, prevention and treatment of diseases and clinical conditions associated with ZNF440.

Zinc finger protein 70 (cos17) (ZNF70, Accession NP_068735.1) is another GAM189 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:17076, to the nucleotide sequence of GAM189 RNA, herein designated GAM RNA, also designated SEQ ID:246.

Another function of GAM189 is therefore inhibition of Zinc finger protein 70 (cos17) (ZNF70, Accession NP_068735.1). Accordingly, utilities of GAM189 include diagnosis, prevention and treatment of diseases and clinical conditions associated with ZNF70.

Zinc finger protein 70 (cos17) (ZNF70, Accession NP_852101.1) is another GAM189 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:17076, to the nucleotide sequence of GAM189 RNA, herein designated GAM RNA, also designated SEQ ID:246.

Another function of GAM189 is therefore inhibition of Zinc finger protein 70 (cos17) (ZNF70, Accession NP_852101.1). Accordingly, utilities of GAM189 include diagnosis, prevention and treatment of diseases and clinical conditions associated with ZNF70.

Zinc finger protein 74 (cos52) (ZNF74, Accession NP_003417.1) is another GAM189 target gene, herein designated TARGET GENE. ZNF74 BINDING SITE is a target binding site found in the 5' untranslated region of mRNA encoded by ZNF74, corresponding to a target binding site such as BINDING SITE I, BINDING SITE II or BINDING SITE III of FIG. 8. Table 4 illustrates the complementarity of the nucleotide sequences of ZNF74 BINDING SITE, designated SEQ ID:12340, to the nucleotide sequence of GAM189 RNA, herein designated GAM RNA, also designated SEQ ID:246.

Another function of GAM189 is therefore inhibition of Zinc finger protein 74 (cos52) (ZNF74, Accession NP_003417.1). Accordingly, utilities of GAM189 include diagnosis, prevention and treatment of diseases and clinical conditions associated with ZNF74.

FIG. 8 further provides a conceptual description of a novel bioinformatically detected of the present invention, referred to here as Genomic Address Messenger 190 (GAM190), which modulates expression of respective target genes thereof, the function and utility of which target genes is known in the art.

GAM190 is a novel bioinformatically detected regulatory, non protein coding, micro RNA (miRNA) gene. The method by which GAM190 was detected is described hereinabove with reference to FIGS. 8-15.

GAM190 gene, herein designated GAM GENE, and GAM190 target gene, herein designated TARGET GENE, are human genes contained in the human genome.

GAM190 gene encodes a GAM190 precursor RNA, herein designated GAM PRECURSOR RNA. Similar to other miRNA genes, and unlike most ordinary genes, GAM190 precursor RNA does not encode a protein. A nucleotide sequence identical or highly similar to the nucleotide sequence of GAM190 precursor RNA is designated SEQ ID:99, and is provided hereinbelow with reference to the sequence listing part. Nucleotide sequence SEQ ID:99 is located at position 151667587 relative to chromosome 3.

GAM190 precursor RNA folds onto itself, forming GAM190 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM190 precursor RNA folds onto itself, forming GAM190 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM190 precursor RNA, designated SEQ-ID:99, and a schematic representation of a predicted secondary folding of GAM190 folded precursor RNA are further described with reference to Table 2, hereby incorporated by reference.

An enzyme complex designated DICER COMPLEX, 'dices' the GAM190 folded precursor RNA into GAM190 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM190 RNA is designated SEQ ID:289, and is provided hereinbelow with references to the sequence listing part and Table 3, hereby incorporated by reference.

GAM190 target gene, herein designated TARGET GENE, encodes a corresponding messenger RNA, GAM190 target RNA, herein designated GAM TARGET RNA. GAM190 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM190 RNA, herein designated GAM RNA, binds complementarily to one or more target binding sites located in untranslated regions of GAM190 target RNA, herein designated GAM TARGET RNA. This complementary binding is due to the fact that the nucleotide sequence of GAM190 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM190 RNA may have a different number of target binding sites in untranslated regions of a GAM190 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM190 RNA, herein designated GAM RNA, to target binding sites on GAM190 target RNA, herein designated GAM TARGET RNA, such as BINDING SITE I, BINDING SITE II and BINDING SITE III, inhibits translation of GAM190 target RNA into GAM190 target protein, herein designated GAM TARGET PROTEIN. GAM target protein is therefore outlined by a broken line.

It is appreciated that GAM190 target gene, herein designated TARGET GENE, in fact represents a plurality of GAM190 target genes. The mRNA of each one of this plurality of GAM190 target genes comprises one or more target binding sites, each having a nucleotide sequence which is at least partly complementary to GAM190 RNA, herein designated GAM RNA, and which when bound by GAM190 RNA causes inhibition of translation of respective one or more GAM190 target proteins.

It is further appreciated by one skilled in the art that the mode of translational inhibition illustrated by FIG. 8 with specific reference to translational inhibition exerted by GAM190 gene, herein designated GAM GENE, on one or more GAM190 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM190 correlate with, and may be deduced from, the identity of the target genes which GAM190 binds and inhibits, and the function of these target genes, as elaborated hereinbelow.

Atp-binding cassette, sub-family c (cftr/mrp), member 3 (ABCC3, Accession NP_064422.1) is a GAM190 target gene, herein designated TARGET GENE. ABCC3 BINDING SITE is a target binding site found in the 3' untranslated region of multiple transcripts of mRNA encoded by ABCC3, corresponding to a target binding site such as BINDING SITE I, BINDING SITE II or BINDING SITE III of FIG. 8. Table 4 illustrates the complementarity of the nucleotide sequences of ABCC3 BINDING SITE, designated SEQ ID:1929, to the nucleotide sequence of GAM190 RNA, herein designated GAM RNA, also designated SEQ ID:289.

A function of GAM190 is therefore inhibition of Atp-binding cassette, sub-family c (cftr/mrp), member 3 (ABCC3, Accession NP_064422.1), a gene which may act as an inducible transporter in the biliary and intestinal excretion of organic anions. Accordingly, utilities of GAM190 include diagnosis, prevention and treatment of diseases and clinical conditions associated with ABCC3.

The function of ABCC3 and its association with various diseases and clinical conditions, has been established by previous studies, as described hereinabove with reference to GAM66.2. Acidic repeat containing (ACRC, Accession NP_443189.1) is another GAM190 target gene, herein designated TARGET GENE. ACRC BINDING SITE is a target binding site found in the 5' untranslated region of mRNA encoded by ACRC, corresponding to a target binding site such as BINDING SITE I, BINDING SITE II or BINDING SITE III of FIG. 8. Table 4 illustrates the complementarity of the nucleotide sequences of ACRC BINDING SITE, designated SEQ ID:16426, to the nucleotide sequence of GAM190 RNA, herein designated GAM RNA, also designated SEQ ID:289.

Another function of GAM190 is therefore inhibition of Acidic repeat containing (ACRC, Accession NP_443189.1). Accordingly, utilities of GAM190 include diagnosis, prevention and treatment of diseases and clinical conditions associated with ACRC.

Adenylate cyclase 1 (brain) (ADCY1, Accession NP_066939.1) is another GAM190 target gene, herein designated TARGET GENE. ADCY1 BINDING SITE is a target binding site found in the 3' untranslated region of multiple transcripts of mRNA encoded by ADCY1, corresponding to a target binding site such as BINDING SITE I, BINDING SITE II or BINDING SITE III of FIG. 8. Table 4 illustrates the complementarity of the nucleotide sequences of ADCY1 BINDING SITE, designated SEQ ID:16609, to the nucleotide sequence of GAM190 RNA, herein designated GAM RNA, also designated SEQ ID:289.

Another function of GAM190 is therefore inhibition of Adenylate cyclase 1 (brain) (ADCY1, Accession NP_066939.1), a gene which a calmodulin-sensitive adenylyl cyclase. it may play a role in memory acquisition and learning. Accordingly, utilities of GAM190 include diagnosis, prevention and treatment of diseases and clinical conditions associated with ADCY1.

The function of ADCY1 and its association with various diseases and clinical conditions, has been established by previous studies, as described hereinabove with reference to GAM144.1. Amylo-1, 6-glucosidase, 4-alpha-glucanotransferase (glycogen debranching enzyme, glycogen storage disease type iii) (AGL, Accession NP_000636.1) is another GAM190 target gene, herein designated TARGET GENE. AGL BINDING SITE is a target binding site found in the 5' untranslated region of multiple transcripts of mRNA encoded by AGL, corresponding to a target binding site such as BINDING SITE I, BINDING SITE II or BINDING SITE III of FIG. 8. Table 4 illustrates the complementarity of the nucleotide sequences of AGL BINDING SITE, designated SEQ ID:9569, to the nucleotide sequence of GAM190 RNA, herein designated GAM RNA, also designated SEQ ID:289.

Another function of GAM190 is therefore inhibition of Amylo-1, 6-glucosidase, 4-alpha-glucanotransferase (glycogen debranching enzyme, glycogen storage disease type iii) (AGL, Accession NP_000636.1). Accordingly, utilities of GAM190 include diagnosis, prevention and treatment of diseases and clinical conditions associated with AGL.

AGS3 (Accession NP_056412.1) is another GAM190 target gene, herein designated TARGET GENE. AGS3 BINDING SITE is a target binding site found in the 3' untranslated region of multiple transcripts of mRNA encoded by AGS3, corresponding to a target binding site such as BINDING SITE I, BINDING SITE II or BINDING SITE III of FIG. 8. Table 4 illustrates the complementarity of the nucleotide sequences of AGS3 BINDING SITE, designated SEQ ID:16761, to the nucleotide sequence of GAM190 RNA, herein designated GAM RNA, also designated SEQ ID:289.

Another function of GAM190 is therefore inhibition of AGS3 (Accession NP_056412.1). Accordingly, utilities of GAM190 include diagnosis, prevention and treatment of diseases and clinical conditions associated with AGS3.

Ankyrin-like with transmembrane domains 1 (ANKTM1, Accession NP_015628.1) is another GAM190 target gene, herein designated TARGET GENE. ANKTM1 BINDING SITE is a target binding site found in the 3' untranslated region of mRNA encoded by ANKTM1, corresponding to a target binding site such as BINDING SITE I, BINDING SITE II or BINDING SITE III of FIG. 8. Table 4 illustrates the complementarity of the nucleotide sequences of ANKTM1 BINDING SITE, designated SEQ ID:10754, to the nucleotide sequence of GAM190 RNA, herein designated GAM RNA, also designated SEQ ID:289.

Another function of GAM190 is therefore inhibition of Ankyrin-like with transmembrane domains 1 (ANKTM1, Accession NP_015628.1), a gene which attaches integral membrane proteins to cytoskeletal elements. Accordingly, utilities of GAM190 include diagnosis, prevention and treatment of diseases and clinical conditions associated with ANKTM1.

The function of ANKTM1 has been established by previous studies. A set of transformation-sensitive proteins that are expressed by normal fibroblasts but are specifically repressed after oncogenic transformation has emerged from studies of tumor virus-transformed fibroblasts. To identify proteins that are lost during the establishment of the transformed phenotype of a tumor cell, Schenker and Trueb (1998) prepared a subtracted cDNA library with mRNA from normal human fibroblasts and from their matched SV40-transformed counterparts. They identified more than 40 clones that showed a dramatic reduction in their relative expression after oncogenic transformation, including a partial cDNA encoding a novel ankyrin-like protein, which has been named ANKTM1. ANKTM1 gene expression was consistently downregulated in a variety of cell lines derived from spontaneous mesenchymal tumors. By screening a human lung fibroblast cDNA library with the partial ANKTM1 cDNA, followed by 5-prime RACE, Jaquemar et al. (1999) isolated the complete ANKTM1 coding sequence. The deduced 1,119-amino acid ANKTM1 protein has a calculated molecular mass of 127.4 kD; the authors called it p120. ANKTM1 protein from fibroblast and liposarcoma cell extracts migrated as a 130-kD polypeptide on Western blots. The predicted ANKTM1 protein can be divided into 2 parts, an N-terminal portion that is related to the cytoskeletal protein ankyrin (see OMIM Ref. No. ANK1; 182900) and a C-terminal portion that is related to transmembrane proteins. The N-terminal region contains eighteen 33-amino acid repeats, 15 of which share 21 to 52% sequence identity with the consensus motif derived from the repeats of ankyrin-like proteins and 3 of which share only partial similarity with the consensus repeat sequence. The C-terminal region contains 7 hydrophobic segments, 6 of which are putative transmembrane domains and 1 of which may enter the lipid bilayer only partially, possibly as a pore loop structure. ANKTM1 is predicted to assume a type II membrane orientation, with the N terminus located cytoplasmically. The overall structure of ANKTM1 is reminiscent of TRP- like proteins (e.g., TRPC7; 603749), which function as store-operated calcium channels. ANKTM1 contains 5 potential N-glycosylation sites, but 3 are situated cytoplasmically and are unlikely to be used. ANKTM1 does not contain an N-terminal signal peptide. Northern blot analysis detected a 4.6-kb ANKTM1 transcript in human fibroblasts. ANKTM1 expression was not observed in SV40-transformed fibroblasts or in cell lines derived from the following spontaneous mesenchymal tumors:4 rhabdomyosarcomas, 2 fibrosarcomas, 1 osteosarcoma, and 1 chondrosarcoma. ANKTM1 was expressed in cells from a liposarcoma and in 1 of 2 leiomyosarcoma cell lines. Northern blot analysis did not detect ANKTM1 expression in any of several adult or fetal human tissues. However, RT-PCR of RNA from a 12-week- old human embryo showed an extremely low level of ANKTM1 expression. Overexpression of recombinant ANKTM1 protein in eukaryotic cells appeared to interfere with normal growth. Jaquemar et al. (1999) suggested that ANKTM1 may play a direct or indirect role in signal transduction and growth control. By FISH, Jaquemar et al. (1999) mapped the ANKTM1 gene to 8q13.

Full details of the abovementioned studies are described in the following publications, the disclosure of which are hereby incorporated by reference:

Jaquemar, D.; Schenker, T.; Trueb, B.: An ankyrin-like protein with transmembrane domains is specifically lost after oncogenic transformation of human fibroblasts. J. Biol. Chem. 274:7325-7333, 1999; and Schenker, T.; Trueb, B.: Down-regulated proteins of mesenchymal tumor cells. Exp. Cell Res. 239:161-168, 1998.

Further studies establishing the function and utilities of ANKTM1 are found in John Hopkins OMIM database record ID 604775, and in cited publications listed in Table 5, which are hereby incorporated by reference. Annexin a10 (ANXA10, Accession NP_009124.1) is another GAM190 target gene, herein designated TARGET GENE. ANXA10 BINDING SITE is a target binding site found in the 3' untranslated region of mRNA encoded by ANXA10, corresponding to a target binding site such as BINDING SITE I, BINDING SITE II or BINDING SITE III of FIG. 8. Table 4 illustrates the complementarity of the nucleotide sequences of ANXA10 BINDING SITE, designated SEQ ID:6862, to the nucleotide sequence of GAM190 RNA, herein designated GAM RNA, also designated SEQ ID:289.

Another function of GAM190 is therefore inhibition of Annexin a10 (ANXA10, Accession NP_009124.1). Accordingly, utilities of GAM190 include diagnosis, prevention and treatment of diseases and clinical conditions associated with ANXA10.

Rho gtpase activating protein 6 (ARHGAP6, Accession NP_001165.1) is another GAM190 target gene, herein designated TARGET GENE. ARHGAP6 BINDING SITE is a target binding site found in the 5' untranslated region of multiple transcripts of mRNA encoded by ARHGAP6, corresponding to a target binding site such as BINDING SITE I, BINDING SITE II or BINDING SITE III of FIG. 8. Table 4 illustrates the complementarity of the nucleotide sequences of ARHGAP6 BINDING SITE, designated SEQ ID:2102, to the nucleotide sequence of GAM190 RNA, herein designated GAM RNA, also designated SEQ ID:289.

Another function of GAM190 is therefore inhibition of Rho gtpase activating protein 6 (ARHGAP6, Accession NP_001165.1), a gene which activates the rho-type GTPases by converting them to an inactive GTP-bound state. and therefore may be associated with Skin defects syndrome. Accordingly, utilities of GAM190 include diagnosis, prevention and treatment of Skin defects syndrome., and of other diseases and clinical conditions associated with ARHGAP6.

The function of ARHGAP6 has been established by previous studies. In a search for the genetic defect in microphthalmia with linear skin defects syndrome (MLS; 309801), Schaefer et al. (1997) trapped exons from 14 overlapping cosmids from the 500-kb MLS critical region in Xp22.3. Using exon connection followed by cDNA library screening, they identified a 2.4-kb contig of cDNA clones spanning 170 kb of genomic sequence in the MLS deletion region. Northern analysis of this cDNA detected a prominent transcript of approximately 4.2 kb and a less abundant transcript of approximately 6 kb in all tissues examined, with additional transcripts in skeletal muscle. Sequence analysis revealed a coding region of 601 amino acids contained in 12 exons, with a splice variant isoform of 495 amino acids. The predicted protein sequence of the gene, symbolized ARHGAP6, contains homology to the GTPase-activating (GAP) domain of the Rho-GAP family of proteins (e.g., 300023), which has been implicated in the regulation of actin polymerization at the plasma membrane in several cellular processes. Schaefer et al. (1997) discussed reasons for thinking that a defect in the Rho pathway may play a role in the pathogenesis of MLS syndrome. Prakash et al. (2000) investigated the function of ARHGAP6 by generating Arhgap6 null mice and also by in vitro expression studies. Surprisingly, loss of the rhoGAP function of Arhgap6 did not cause any detectable phenotypic or behavioral abnormalities in the mutant mice. Transfected mammalian cells expressing ARHGAP6 lost their actin stress fibers, retracted from the growth surface, and extended thin, branching processes resembling filopodia. The ARHGAP6 protein colocalized with actin filaments through an N-terminal domain and recruited filamentous actin into the growing processes. Mutation of a conserved arginine residue in the rhoGAP domain prevented the loss of stress fibers but had little effect on process outgrowth. The authors concluded that ARHGAP6 has 2 independent functions: one as a GAP with specificity for RhoA and the other as a cytoskeletal protein that promotes actin remodeling.

Full details of the abovementioned studies are described in the following publications, the disclosure of which are hereby incorporated by reference:

Prakash, S. K.; Paylor, R.; Jenna, S.; Lamarche-Vane, N.; Armstrong, D. L.; Xu, B.; Mancini, M. A.; Zoghbi, H. Y.: Functional analysis of ARHGAP6, a novel GTPase- activating protein for RhoA. Hum. Molec. Genet. 9:477-488, 2000; and Schaefer, L.; Prakash, S.; Zoghbi, H. Y.: Cloning and characterization of a novel rho-type GTPase-activating protein gene (ARHGAP6) from the critical region for microphthalmia with li.

Further studies establishing the function and utilities of ARHGAP6 are found in John Hopkins OMIM database record ID 300118, and in cited publications listed in Table 5, which are hereby incorporated by reference. Rho guanine nucleotide exchange factor (gef) 7 (ARHGEF7, Accession NP_003890.1) is another GAM190 target gene, herein designated TARGET GENE. ARHGEF7 BINDING SITE is a target binding site found in the 3' untranslated region of multiple transcripts of mRNA encoded by ARHGEF7, corresponding to a target binding site such as BINDING SITE I, BINDING SITE II or BINDING SITE III of FIG. 8. Table 4 illustrates the complementarity of the nucleotide sequences of ARHGEF7 BINDING SITE, designated SEQ ID:3061, to the nucleotide sequence of GAM190 RNA, herein designated GAM RNA, also designated SEQ ID:289.

Another function of GAM190 is therefore inhibition of Rho guanine nucleotide exchange factor (gef) 7 (ARHGEF7, Accession NP_003890.1), a gene which acts as a rac1 guanine nucleotide exchange factor (gef) and can induce membrane ruffling. Accordingly, utilities of GAM190 include diagnosis, prevention and treatment of diseases and clinical conditions associated with ARHGEF7.

The function of ARHGEF7 and its association with various diseases and clinical conditions, has been established by previous studies, as described hereinabove with reference to GAM40.2. Atpase, class vi, type 11b (ATP11B, Accession XP_087254.2) is another GAM190 target gene, herein designated TARGET GENE. ATP11B BINDING SITE is a target binding site found in the 3' untranslated region of mRNA encoded by ATP11B, corresponding to a target binding site such as BINDING SITE I, BINDING SITE II or BINDING SITE III of FIG. 8. Table 4 illustrates the complementarity of the nucleotide sequences of ATP11B BINDING SITE, designated SEQ ID:10635, to the nucleotide sequence of GAM190 RNA, herein designated GAM RNA, also designated SEQ ID:289.

Another function of GAM190 is therefore inhibition of Atpase, class vi, type 11b (ATP11B, Accession XP_087254.2), a gene which is phosphorylated in their intermediate state, drives uphill transport of ions across membranes. Accordingly, utilities of GAM190 include diagnosis, prevention and treatment of diseases and clinical conditions associated with ATP11B.

The function of ATP11B and its association with various diseases and clinical conditions, has been established by previous studies, as described hereinabove with reference to GAM66.2. Atpase, h+ transporting, lysosomal 13 kda, v1 subunit g isoform 2 (ATP6V1G2, Accession NP_612139.1) is another GAM190 target gene, herein designated TARGET GENE. ATP6V1G2 BINDING SITE is a target binding site found in the 3' untranslated region of multiple transcripts of mRNA encoded by ATP6V1G2, corresponding to a target binding site such as BINDING SITE I, BINDING SITE II or BINDING SITE III of FIG. 8. Table 4 illustrates the complementarity of the nucleotide sequences of ATP6V1G2 BINDING SITE, designated SEQ ID:1415, to the nucleotide sequence of GAM190 RNA, herein designated GAM RNA, also designated SEQ ID:289.

Another function of GAM190 is therefore inhibition of Atpase, h+ transporting, lysosomal 13 kda, v1 subunit g isoform 2 (ATP6V1G2, Accession NP_612139.1). Accordingly, utilities of GAM190 include diagnosis, prevention and treatment of diseases and clinical conditions associated with ATP6V1G2.

Atpase, h+ transporting, lysosomal 13 kda, v1 subunit g isoform 2 (ATP6V1G2, Accession NP_569730.1) is another GAM190 target gene, herein designated TARGET GENE. ATP6V1G2 BINDING SITE is a target binding site found in the 3' untranslated region of multiple transcripts of mRNA encoded by ATP6V1G2, corresponding to a target binding site such as BINDING SITE I, BINDING SITE II or BINDING SITE III of FIG. 8. Table 4 illustrates the complementarity of the nucleotide sequences of ATP6V1G2 BINDING SITE, designated SEQ ID:1415, to the nucleotide sequence of GAM190 RNA, herein designated GAM RNA, also designated SEQ ID:289.

Another function of GAM190 is therefore inhibition of Atpase, h+ transporting, lysosomal 13 kda, v1 subunit g isoform 2 (ATP6V1G2, Accession NP_569730.1). Accordingly, utilities of GAM190 include diagnosis, prevention and treatment of diseases and clinical conditions associated with ATP6V1G2.

Atpase, cu++ transporting, beta polypeptide (wilson disease) (ATP7B, Accession NP_000044.1) is another GAM190 target gene, herein designated TARGET GENE. ATP7B BINDING SITE is a target binding site found in the 3' untranslated region of mRNA encoded by ATP7B, corresponding to a target binding site such as BINDING SITE I, BINDING SITE II or BINDING SITE III of FIG. 8. Table 4 illustrates the complementarity of the nucleotide sequences of ATP7B BINDING SITE, designated SEQ ID:1270, to the nucleotide sequence of GAM190 RNA, herein designated GAM RNA, also designated SEQ ID:289.

Another function of GAM190 is therefore inhibition of Atpase, cu++ transporting, beta polypeptide (wilson disease) (ATP7B, Accession NP_000044.1). Accordingly, utilities of GAM190 include diagnosis, prevention and treatment of diseases and clinical conditions associated with ATP7B.

Udp-gal:betaglcnac beta 1,4-galactosyltransferase, polypeptide 5 (B4GALT5, Accession NP_004767.1) is another GAM190 target gene, herein designated TARGET GENE. B4GALT5 BINDING SITE is a target binding site found in the 3' untranslated region of mRNA encoded by B4GALT5, corresponding to a target binding site such as BINDING SITE I, BINDING SITE II or BINDING SITE III of FIG. 8. Table 4 illustrates the complementarity of the nucleotide sequences of B4GALT5 BINDING SITE, designated SEQ ID:2973, to the nucleotide sequence of GAM190 RNA, herein designated GAM RNA, also designated SEQ ID:289.

Another function of GAM190 is therefore inhibition of Udp-gal:betaglcnac beta 1,4-galactosyltransferase, polypeptide 5 (B4GALT5, Accession NP_004767.1). Accordingly, utilities of GAM190 include diagnosis, prevention and treatment of diseases and clinical conditions associated with B4GALT5.

Bromodomain adjacent to zinc finger domain, 2a (BAZ2A, Accession NP_038477.1) is another GAM190 target gene, herein designated TARGET GENE. BAZ2A BINDING SITE is a target binding site found in the 3' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:6467, to the nucleotide sequence of GAM190 RNA, herein designated GAM RNA, also designated SEQ ID:289.

Another function of GAM190 is therefore inhibition of Bromodomain adjacent to zinc finger domain, 2a (BAZ2A, Accession NP_038477.1) . Accordingly, utilities of GAM190 include diagnosis, prevention and treatment of diseases and clinical conditions associated with BAZ2A.

C14orf132 (Accession NP_064600.1) is another GAM190 target gene, herein designated TARGET GENE. C14orf132 BINDING SITE is a target binding site found in the 3' untranslated region of mRNA encoded by C14orf132, corresponding to a target binding site such as BINDING SITE I, BINDING SITE II or BINDING SITE III of FIG. 8. Table 4 illustrates the complementarity of the nucleotide sequences of C14orf132 BINDING SITE, designated SEQ ID:10053, to the nucleotide sequence of GAM190 RNA, herein designated GAM RNA, also designated SEQ ID:289.

Another function of GAM190 is therefore inhibition of C14orf132 (Accession NP_064600.1). Accordingly, utilities of GAM190 include diagnosis, prevention and treatment of diseases and clinical conditions associated with C14orf132.

C1q and tumor necrosis factor related protein 5 (C1QTNF5, Accession NP_056460.1) is another GAM190 target gene, herein designated TARGET GENE. C1QTNF5 BINDING SITE is a target binding site found in the 3' untranslated region of mRNA encoded by C1QTNF5, corresponding to a target binding site such as BINDING SITE I, BINDING SITE II or BINDING SITE III of FIG. 8. Table 4 illustrates the complementarity of the nucleotide sequences of C1QTNF5 BINDING SITE, designated SEQ ID:19062, to the nucleotide sequence of GAM190 RNA, herein designated GAM RNA, also designated SEQ ID:289.

Another function of GAM190 is therefore inhibition of C1q and tumor necrosis factor related protein 5 (C1QTNF5, Accession NP_056460.1). Accordingly, utilities of GAM190 include diagnosis, prevention and treatment of diseases and clinical conditions associated with C1QTNF5.

Carbohydrate kinase-like (CARKL, Accession NP_037408.1) is another GAM190 target gene, herein designated TARGET GENE. CARKL BINDING SITE is a target binding site found in the 3' untranslated region of mRNA encoded by CARKL, corresponding to a target binding site such as BINDING SITE I, BINDING SITE II or BINDING SITE III of FIG. 8. Table 4 illustrates the complementarity of the nucleotide sequences of CARKL BINDING SITE, designated SEQ ID:13528, to the nucleotide sequence of GAM190 RNA, herein designated GAM RNA, also designated SEQ ID:289.

Another function of GAM190 is therefore inhibition of Carbohydrate kinase-like (CARKL, Accession NP_037408.1), a gene which is a putative carbohydrate kinase and may be a modifier for the cystinosis phenotype. Accordingly, utilities of GAM190 include diagnosis, prevention and treatment of diseases and clinical conditions associated with CARKL.

The function of CARKL has been established by previous studies. Touchman et al. (2000) sequenced 200 kb surrounding the gene encoding cystinosin (CTNS; 606272), which is mutated in nephropathic cystinosis (OMIM Ref. No. 219800), on chromosome 17p13. They found that genomic sequence in this region matched known ESTs. Using PCR primers to amplify a human fetal kidney cDNA library, the authors cloned a cDNA, which they designated CARKL (carbohydrate kinase-like), encoding a deduced 478-amino acid protein. The CARKL protein contains motifs showing weak similarity to 2 domains of the FGGY family of carbohydrate kinases. It does not appear to contain a signal sequence, suggesting that it is localized in the cytoplasm. Northern blot analysis detected expression of a 3.9-kb CARKL transcript predominantly in liver, kidney, and pancreas, with weaker expression in heart, placenta, brain, and lung. Additionally, a 2.7-kb transcript was detected in liver and, to a lesser extent, in heart. By sequence analysis, Touchman et al. (2000) determined that the CARKL gene maps within the telomeric end of a 57-kb segment on 17p13 that is commonly deleted in cystinosis. They hypothesized that CARKL may be a modifier for the cystinosis phenotype.

Full details of the abovementioned studies are described in the following publications, the disclosure of which are hereby incorporated by reference:

Touchman, J. W.; Anikster, Y.; Dietrich, N. L.; Braden Maduro, V. V.; McDowell, G.; Shotelersuk, V.; Bouffard, G. G.; Beckstrom-Sternberg, S. M.; Gahl, W. A.; Green, E. D.: The genomic region encompassing the nephropathic cystinosis gene (CTNS): complete sequencing of a 200-kb segment and discovery of a novel gene within the common cystinosis-causing deletion. Genome Res. 10:165-173, 2000. ; and Phornphutkul, C.; Anikster, Y.; Huizing, M.; Braun, P.; Brodie, C.; Chou, J. Y.; Gahl, W. A.: The promoter of a lysosomal membrane transporter gene, CTNS, binds Sp-1, shares sequences.

Further studies establishing the function and utilities of CARKL are found in John Hopkins OMIM database record ID 605060, and in cited publications listed in Table 5, which are hereby incorporated by reference. CAS1 (Accession NP_075051.2) is another GAM190 target gene, herein designated TARGET GENE. CAS1 BINDING SITE is a target binding site found in the 3' untranslated region of mRNA encoded by CAS1, corresponding to a target binding site such as BINDING SITE I, BINDING SITE II or BINDING SITE III of FIG. 8. Table 4 illustrates the complementarity of the nucleotide sequences of CAS1 BINDING SITE, designated SEQ ID:16002, to the nucleotide sequence of GAM190 RNA, herein designated GAM RNA, also designated SEQ ID:289.

Another function of GAM190 is therefore inhibition of CAS1 (Accession NP_075051.2). Accordingly, utilities of GAM190 include diagnosis, prevention and treatment of diseases and clinical conditions associated with CAS1.

Cyclin f (CCNF, Accession NP_001752.1) is another GAM190 target gene, herein designated TARGET GENE. CCNF BINDING SITE is a target binding site found in the 3' untranslated region of mRNA encoded by CCNF, corresponding to a target binding site such as BINDING SITE I, BINDING SITE II or BINDING SITE III of FIG. 8. Table 4 illustrates the complementarity of the nucleotide sequences of CCNF BINDING SITE, designated SEQ ID:2161, to the nucleotide sequence of GAM190 RNA, herein designated GAM RNA, also designated SEQ ID:289.

Another function of GAM190 is therefore inhibition of Cyclin f (CCNF, Accession NP_001752.1), a gene which likely to be involved in the control of the cell cycle during s phase and g2. Accordingly, utilities of GAM190 include diagnosis, prevention and treatment of diseases and clinical conditions associated with CCNF.

The function of CCNF and its association with various diseases and clinical conditions, has been established by previous studies, as described hereinabove with reference to GAM130.1. Chemokine (c-c motif) receptor 2 (CCR2, Accession NP_000638.1) is another GAM190 target gene, herein designated TARGET GENE. CCR2 BINDING SITE is a target binding site found in the 3' untranslated region of multiple transcripts of mRNA encoded by CCR2, corresponding to a target binding site such as BINDING SITE I, BINDING SITE II or BINDING SITE III of FIG. 8. Table 4 illustrates the complementarity of the nucleotide sequences of CCR2 BINDING SITE, designated SEQ ID:8836, to the nucleotide sequence of GAM190 RNA, herein designated GAM RNA, also designated SEQ ID:289.

Another function of GAM190 is therefore inhibition of Chemokine (c-c motif) receptor 2 (CCR2, Accession NP_000638.1), a gene which binds chemokines and transduces a signal by increasing the intracellular calcium ions level. and therefore may be associated with Hiv-1 infection. Accordingly, utilities of GAM190 include diagnosis, prevention and treatment of Hiv-1 infection, and of other diseases and clinical conditions associated with CCR2.

The function of CCR2 and its association with various diseases and clinical conditions, has been established by previous studies, as described hereinabove with reference to GAM175.1. Cd209 antigen (CD209, Accession NP_066978.1) is another GAM190 target gene, herein designated TARGET GENE. CD209 BINDING SITE is a target binding site found in the 3' untranslated region of mRNA encoded by CD209, corresponding to a target binding site such as BINDING SITE I, BINDING SITE II or BINDING SITE III of FIG. 8. Table 4 illustrates the complementarity of the nucleotide sequences of CD209 BINDING SITE, designated SEQ ID:1357, to the nucleotide sequence of GAM190 RNA, herein designated GAM RNA, also designated SEQ ID:289.

Another function of GAM190 is therefore inhibition of Cd209 antigen (CD209, Accession NP_066978.1), a gene which may play an important role in the CD4-independent association of HIV with cells. Accordingly, utilities of GAM190 include diagnosis, prevention and treatment of diseases and clinical conditions associated with CD209.

The function of CD209 and its association with various diseases and clinical conditions, has been established by previous studies, as described hereinabove with reference to GAM96.1. Cd4 antigen (p55) (CD4, Accession NP_000607.1) is another GAM190 target gene, herein designated TARGET GENE. CD4 BINDING SITE is a target binding site found in the 3' untranslated region of mRNA encoded by CD4, corresponding to a target binding site such as BINDING SITE I, BINDING SITE II or BINDING SITE III of FIG. 8. Table 4 illustrates the complementarity of the nucleotide sequences of CD4 BINDING SITE, designated SEQ ID:4243, to the nucleotide sequence of GAM190 RNA, herein designated GAM RNA, also designated SEQ ID:289.

Another function of GAM190 is therefore inhibition of Cd4 antigen (p55) (CD4, Accession NP_000607.1), a gene which is T-cell surface glycoprotein and has role in cell-cell interactions and may act in signal transduction and therefore may be associated with Infectious and immune-mediated diseases. Accordingly, utilities of GAM190 include diagnosis, prevention and treatment of Infectious and immune-mediated diseases, and of other diseases and clinical conditions associated with CD4.

The function of CD4 and its association with various diseases and clinical conditions, has been established by previous studies, as described hereinabove with reference to GAM66.2. Cdc14 cell division cycle 14 homolog a (s. cerevisiae) (CDC14A, Accession NP_003663.2) is another GAM190 target gene, herein designated TARGET GENE. CDC14A BINDING SITE is a target binding site found in the 3' untranslated region of multiple transcripts of mRNA encoded by CDC14A, corresponding to a target binding site such as BINDING SITE I, BINDING SITE II or BINDING SITE III of FIG. 8. Table 4 illustrates the complementarity of the nucleotide sequences of CDC14A BINDING SITE, designated SEQ ID:12880, to the nucleotide sequence of GAM190 RNA, herein designated GAM RNA, also designated SEQ ID:289.

Another function of GAM190 is therefore inhibition of Cdc14 cell division cycle 14 homolog a (s. cerevisiae) (CDC14A, Accession NP_003663.2). Accordingly, utilities of GAM190 include diagnosis, prevention and treatment of diseases and clinical conditions associated with CDC14A.

Centaurin, delta 2 (CENTD2, Accession NP_056057.1) is another GAM190 target gene, herein designated TARGET GENE. CENTD2 BINDING SITE is a target binding site found in the 3' untranslated region of multiple transcripts of mRNA encoded by CENTD2, corresponding to a target binding site such as BINDING SITE I, BINDING SITE II or BINDING SITE III of FIG. 8. Table 4 illustrates the complementarity of the nucleotide sequences of CENTD2 BINDING SITE, designated SEQ ID:5185, to the nucleotide sequence of GAM190 RNA, herein designated GAM RNA, also designated SEQ ID:289.

Another function of GAM190 is therefore inhibition of Centaurin, delta 2 (CENTD2, Accession NP_056057.1), a gene which involved in cell signaling/communication. Accordingly, utilities of GAM190 include diagnosis, prevention and treatment of diseases and clinical conditions associated with CENTD2.

The function of CENTD2 and its association with various diseases and clinical conditions, has been established by previous studies, as described hereinabove with reference to GAM51.1. Centaurin, delta 2 (CENTD2, Accession NP_631920.1) is another GAM190 target gene, herein designated TARGET GENE. CENTD2 BINDING SITE is a target binding site found in the 3' untranslated region of multiple transcripts of mRNA encoded by CENTD2, corresponding to a target binding site such as BINDING SITE I, BINDING SITE II or BINDING SITE III of FIG. 8. Table 4 illustrates the complementarity of the nucleotide sequences of CENTD2 BINDING SITE, designated SEQ ID:5185, to the nucleotide sequence of GAM190 RNA, herein designated GAM RNA, also designated SEQ ID:289.

Another function of GAM190 is therefore inhibition of Centaurin, delta 2 (CENTD2, Accession NP_631920.1), a gene which involved in cell signaling/communication. Accordingly, utilities of GAM190 include diagnosis, prevention and treatment of diseases and clinical conditions associated with CENTD2.

The function of CENTD2 and its association with various diseases and clinical conditions, has been established by previous studies, as described hereinabove with reference to GAM51.1. Chloride channel 6 (CLCN6, Accession NP_068504.1) is another GAM190 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:15103, to the nucleotide sequence of GAM190 RNA, herein designated GAM RNA, also designated SEQ ID:289.

Another function of GAM190 is therefore inhibition of Chloride channel 6 (CLCN6, Accession NP_068504.1), a gene which is a voltage- gated chloride channel. Accordingly, utilities of GAM190 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_068503.1) is another GAM190 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:15103, to the nucleotide sequence of GAM190 RNA, herein designated GAM RNA, also designated SEQ ID:289.

Another function of GAM190 is therefore inhibition of Chloride channel 6 (CLCN6, Accession NP_068503.1), a gene which is a voltage-gated chloride channel. Accordingly, utilities of GAM190 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_001277.1) is another GAM190 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:15103, to the nucleotide sequence of GAM190 RNA, herein designated GAM RNA, also designated SEQ ID:289.

Another function of GAM190 is therefore inhibition of Chloride channel 6 (CLCN6, Accession NP_001277.1), a gene which is a voltage-gated chloride channel. Accordingly, utilities of GAM190 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_068505.1) is another GAM190 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:15103, to the nucleotide sequence of GAM190 RNA, herein designated GAM RNA, also designated SEQ ID:289.

Another function of GAM190 is therefore inhibition of Chloride channel 6 (CLCN6, Accession NP_068505.1), a gene which is a voltage-gated chloride channel. Accordingly, utilities of GAM190 include diagnosis, prevention and treatment of diseases and clinical conditions associated with CLCN6.

The function of CLCN6 and its association with various diseases and clinical conditions, has been established by previous studies, as described hereinabove with reference to GAM40.1. C-type (calcium dependent, carbohydrate-recognition domain) lectin, superfamily member 9 (CLECSF9, Accession NP_055173.1) is another GAM190 target gene, herein designated TARGET GENE. CLECSF9 BINDING SITE is a target binding site found in the 3' untranslated region of mRNA encoded by CLECSF9, corresponding to a target binding site such as BINDING SITE I, BINDING SITE II or BINDING SITE III of FIG. 8. Table 4 illustrates the complementarity of the nucleotide sequences of CLECSF9 BINDING SITE, designated SEQ ID:15211, to the nucleotide sequence of GAM190 RNA, herein designated GAM RNA, also designated SEQ ID:289.

Another function of GAM190 is therefore inhibition of C-type (calcium dependent, carbohydrate-recognition domain) lectin, superfamily member 9 (CLECSF9, Accession NP_055173.1). Accordingly, utilities of GAM190 include diagnosis, prevention and treatment of diseases and clinical conditions associated with CLECSF9.

Clock homolog (mouse) (CLOCK, Accession NP_004889.1) is another GAM190 target gene, herein designated TARGET GENE. CLOCK BINDING SITE is a target binding site found in the 3' untranslated region of mRNA encoded by CLOCK, corresponding to a target binding site such as BINDING SITE I, BINDING SITE II or BINDING SITE III of FIG. 8. Table 4 illustrates the complementarity of the nucleotide sequences of CLOCK BINDING SITE, designated SEQ ID:16410, to the nucleotide sequence of GAM190 RNA, herein designated GAM RNA, also designated SEQ ID:289.

Another function of GAM190 is therefore inhibition of Clock homolog (mouse) (CLOCK, Accession NP_004889.1). Accordingly, utilities of GAM190 include diagnosis, prevention and treatment of diseases and clinical conditions associated with CLOCK.

Carboxypeptidase a1 (pancreatic) (CPA1, Accession NP_001859.1) is another GAM190 target gene, herein designated TARGET GENE. CPA1 BINDING SITE is a target binding site found in the 3' untranslated region of mRNA encoded by CPA1, corresponding to a target binding site such as BINDING SITE I, BINDING SITE II or BINDING SITE III of FIG. 8. Table 4 illustrates the complementarity of the nucleotide sequences of CPA1 BINDING SITE, designated SEQ ID:8808, to the nucleotide sequence of GAM190 RNA, herein designated GAM RNA, also designated SEQ ID:289.

Another function of GAM190 is therefore inhibition of Carboxypeptidase a1 (pancreatic) (CPA1, Accession NP_001859.1), a gene which is a monomeric pancreatic metalloprotease. Accordingly, utilities of GAM190 include diagnosis, prevention and treatment of diseases and clinical conditions associated with CPA1.

The function of CPA1 has been established by previous studies. Carboxypeptidase A (EC 3.4.2.1) is a pancreatic exopeptidase. Three different forms of human pancreatic procarboxypeptidase A have been isolated. The A1 and A2 (OMIM Ref. No. 600688) forms are monomeric proteins with different biochemical properties. Honey et al. (1984, 1986) found that an 8.6-kb human DNA fragment (detected by means of a rat cDNA probe for CPA) cosegregated with chromosome 7. The assignment was narrowed by demonstration of absence of the human DNA fragment in cells with a deletion of 7q22-qter. By studying mouse-hamster hybrid cells, Honey et al. (1986) assigned the CPA gene to mouse chromosome 6. Trypsin (OMIM Ref. No. 276000) is also on human 7q22-qter and on mouse 6. Stewart et al. (1990) concluded from multipoint linkage analysis with established chromosome 7 markers that the most likely location of carboxypeptidase is 7q31-qter. It lies distal to cystic fibrosis at a distance of approximately 12 cM Carboxypeptidase A1 is one of the genes whose expression in the pancreas was demonstrated by Velculescu et al. (1995) with a novel method for Ser. analysis of gene expression (SAGE). The method allowed the quantitative and simultaneous analysis of a large number of transcripts. To demonstrate the strategy, short diagnostic sequence tags (SSTs) were isolated from pancreas, concatenated, and cloned. Manual sequencing of 1,000 tags revealed a gene expression pattern characteristic of pancreas. New pancreatic transcripts corresponding to novel tags were also identified. SAGE is based on 2 principles: first, that a short nucleotide sequence tag (9 to 10 bp) contained sufficient information to uniquely identify a transcript; and second, that concatenation of SSTs allows the efficient analysis of transcripts in a Ser. manner by the sequencing of multiple tags within a single clone. Using SAGE, Velculescu et al. (1995) found that procarboxypeptidase A1 was the gene represented by the tag found most frequently in the pancreatic transcripts (7.6%). The authors suggested that SAGE should allow a direct readout of expression in any given cell type or tissue. They envisioned a major application to be the comparison of gene expression patterns in various developmental and disease states. Any laboratory with the capability to perform PCR and manual sequencing could perform SAGE for this purpose. Adaptation of this technique to an automated sequencer would allow the analysis of over 1,000 transcripts in a single 3-hour run Full details of the abovementioned studies are described in the following publications, the disclosure of which are hereby incorporated by reference:

Honey, N. K.; Sakaguchi, A. Y.; Lalley, P. A.; Quinto, C.; Rutter, W. J.; Naylor, S. L.: Assignment of the gene for carboxypeptidase A to human chromosome 7q22-qter and to mouse chromosome 6. Hum. Genet. 72:27-31, 1986; and Velculescu, V. E.; Zhang, L.; Vogelstein, B.; Kinzler, K. W.: Ser. analysis of gene expression. Science 270:484-487, 1995.

Further studies establishing the function and utilities of CPA1 are found in John Hopkins OMIM database record ID 114850, and in cited publications listed in Table 5, which are hereby incorporated by reference. Carboxypeptidase a5 (CPA5, Accession NP_525124.2) is another GAM190 target gene, herein designated TARGET GENE. CPA5 BINDING SITE is a target binding site found in the 3' untranslated region of mRNA encoded by CPA5, corresponding to a target binding site such as BINDING SITE I, BINDING SITE II or BINDING SITE III of FIG. 8. Table 4 illustrates the complementarity of the nucleotide sequences of CPA5 BINDING SITE, designated SEQ ID:16798, to the nucleotide sequence of GAM190 RNA, herein designated GAM RNA, also designated SEQ ID:289.

Another function of GAM190 is therefore inhibition of Carboxypeptidase a5 (CPA5, Accession NP_525124.2). Accordingly, utilities of GAM190 include diagnosis, prevention and treatment of diseases and clinical conditions associated with CPA5.

Copine iii (CPNE3, Accession NP_003900.1) is another GAM190 target gene, herein designated TARGET GENE. CPNE3 BINDING SITE is a target binding site found in the 3' untranslated region of mRNA encoded by CPNE3, corresponding to a target binding site such as BINDING SITE I, BINDING SITE II or BINDING SITE III of FIG. 8. Table 4 illustrates the complementarity of the nucleotide sequences of CPNE3 BINDING SITE, designated SEQ ID:16717, to the nucleotide sequence of GAM190 RNA, herein designated GAM RNA, also designated SEQ ID:289.

Another function of GAM190 is therefore inhibition of Copine iii (CPNE3, Accession NP_003900.1), a gene which may function in membrane traffiking. Accordingly, utilities of GAM190 include diagnosis, prevention and treatment of diseases and clinical conditions associated with CPNE3.

The function of CPNE3 has been established by previous studies. By screening human brain cDNAs for the potential to encode proteins larger than 50 kD, Ishikawa et al. (1998) identified a CPNE3 cDNA, which they called KIAA0636. The deduced 537-amino acid CPNE3 protein is 65.7% identical to CPNE1. By SDS-PAGE, the in vitro transcribed/translated product of the CPNE3 cDNA had a molecular mass of 65 kD. RT-PCR detected CPNE3 expression in all human tissues examined By immunoprecipitation and kinase assay, Caudell et al. (2000) serendipitously identified a 60-kD protein identical to CPNE3. CPNE3 contains 2 N-terminal C2 domains, like CPNE1, CPNE6 (OMIM Ref. No. 605688), and CPNE7 (OMIM Ref. No. 605689), but these 4 copines have divergent C termini. CPNE3 is 63%, 52%, and 47% identical to CPNE1, CPNE6, and CPNE7, respectively.

Northern blot analysis revealed ubiquitous expression of a 5.0-kb transcript. Biochemical analysis showed that CPNE3 appears to possess endogenous kinase activity, although it lacks a classic kinase domain. CPNE3 is phosphorylated on both serine and threonine residues but not on tyrosine residues.

Full details of the abovementioned studies are described in the following publications, the disclosure of which are hereby incorporated by reference:

Creutz, C. E.; Tomsig, J. L.; Snyder, S. L.; Gautier, M.-C.; Skouri, F.; Beisson, J.; Cohen, J.: The copines, a novel class of C2 domain-containing, calcium- dependent, phospholipid-binding proteins conserved from Paramecium to humans. J. Biol. Chem. 273:1393-1402, 1998; and Caudell, E. G.; Caudell, J. J.; Tang, C.-H.; y, T.-K.; Frederick, M. J.; Grimm, E. A.: Characterization of human copine III as a phosphoprotein with associated kinase activity. Biochem.

Further studies establishing the function and utilities of CPNE3 are found in John Hopkins OMIM database record ID 604207, and in cited publications listed in Table 5, which are hereby incorporated by reference. Crystallin, zeta (quinone reductase)-like 1 (CRYZL1, Accession NP_005102.2) is another GAM190 target gene, herein designated TARGET GENE. CRYZL1 BINDING SITE is a target binding site found in the 3' untranslated region of multiple transcripts of mRNA encoded by CRYZL1, corresponding to a target binding site such as BINDING SITE I, BINDING SITE II or BINDING SITE III of FIG. 8. Table 4 illustrates the complementarity of the nucleotide sequences of CRYZL1 BINDING SITE, designated SEQ ID:7391, to the nucleotide sequence of GAM190 RNA, herein designated GAM RNA, also designated SEQ ID:289.

Another function of GAM190 is therefore inhibition of Crystallin, zeta (quinone reductase)-like 1 (CRYZL1, Accession NP_005102.2). Accordingly, utilities of GAM190 include diagnosis, prevention and treatment of diseases and clinical conditions associated with CRYZL1.

Crystallin, zeta (quinone reductase)-like 1 (CRYZL1, Accession NP_665857.1) is another GAM190 target gene, herein designated TARGET GENE. CRYZL1 BINDING SITE is a target binding site found in the 3' untranslated region of multiple transcripts of mRNA encoded by CRYZL1, corresponding to a target binding site such as BINDING SITE I, BINDING SITE II or BINDING SITE III of FIG. 8. Table 4 illustrates the complementarity of the nucleotide sequences of CRYZL1 BINDING SITE, designated SEQ ID:7391, to the nucleotide sequence of GAM190 RNA, herein designated GAM RNA, also designated SEQ ID:289.

Another function of GAM190 is therefore inhibition of Crystallin, zeta (quinone reductase)-like 1 (CRYZL1, Accession NP_665857.1). Accordingly, utilities of GAM190 include diagnosis, prevention and treatment of diseases and clinical conditions associated with CRYZL1.

Digeorge syndrome critical region gene 2 (DGCR2, Accession NP_005128.1) is another GAM190 target gene, herein designated TARGET GENE. DGCR2 BINDING SITE is a target binding site found in the 3' untranslated region of mRNA encoded by DGCR2, corresponding to a target binding site such as BINDING SITE I, BINDING SITE II or BINDING SITE III of FIG. 8. Table 4 illustrates the complementarity of the nucleotide sequences of DGCR2 BINDING SITE, designated SEQ ID:16760, to the nucleotide sequence of GAM190 RNA, herein designated GAM RNA, also designated SEQ ID:289.

Another function of GAM190 is therefore inhibition of Digeorge syndrome critical region gene 2 (DGCR2, Accession NP_005128.1), a gene which is putative adhesion receptor and intervenes in cell-cell or cell-matrix interactions and therefore may be associated with Digeorge syndrome. Accordingly, utilities of GAM190 include diagnosis, prevention and treatment of Digeorge syndrome, and of other diseases and clinical conditions associated with DGCR2.

The function of DGCR2 and its association with various diseases and clinical conditions, has been established by previous studies, as described hereinabove with reference to GAM84.1. DKFZp313G1735 (Accession XP_087728.2) is another GAM190 target gene, herein designated TARGET GENE. DKFZp313G1735 BINDING SITE is a target binding site found in the 3' untranslated region of mRNA encoded by DKFZp313G1735, corresponding to a target binding site such as BINDING SITE I, BINDING SITE II or BINDING SITE III of FIG. 8. Table 4 illustrates the complementarity of the nucleotide sequences of DKFZp313G1735 BINDING SITE, designated SEQ ID:13429, to the nucleotide sequence of GAM190 RNA, herein designated GAM RNA, also designated SEQ ID:289.

Another function of GAM190 is therefore inhibition of DKFZp313G1735 (Accession XP_087728.2). Accordingly, utilities of GAM190 include diagnosis, prevention and treatment of diseases and clinical conditions associated with DKFZp313G1735.

DKFZP434E2135 (Accession NP_110431.1) is another GAM190 target gene, herein designated TARGET GENE. DKFZP434E2135 BINDING SITE is a target binding site found in the 3' untranslated region of mRNA encoded by DKFZP434E2135, corresponding to a target binding site such as BINDING SITE I, BINDING SITE II or BINDING SITE III of FIG. 8. Table 4 illustrates the complementarity of the nucleotide sequences of DKFZP434E2135 BINDING SITE, designated SEQ ID:14814, to the nucleotide sequence of GAM190 RNA, herein designated GAM RNA, also designated SEQ ID:289.

Another function of GAM190 is therefore inhibition of DKFZP434E2135 (Accession NP_110431.1). Accordingly, utilities of GAM190 include diagnosis, prevention and treatment of diseases and clinical conditions associated with DKFZP434E2135.

DKFZp434L142 (Accession NP_057697.1) is another GAM190 target gene, herein designated TARGET GENE. DKFZp434L142 BINDING SITE is a target binding site found in the 3' untranslated region of mRNA encoded by DKFZp434L142, corresponding to a target binding site such as BINDING SITE I, BINDING SITE II or BINDING SITE III of FIG. 8. Table 4 illustrates the complementarity of the nucleotide sequences of DKFZp434L142 BINDING SITE, designated SEQ ID:14147, to the nucleotide sequence of GAM190 RNA, herein designated GAM RNA, also designated SEQ ID:289.

Another function of GAM190 is therefore inhibition of DKFZp434L142 (Accession NP_057697.1). Accordingly, utilities of GAM190 include diagnosis, prevention and treatment of diseases and clinical conditions associated with DKFZp434L142.

DKFZP586D0919 (Accession NP_056248.1) is another GAM190 target gene, herein designated TARGET GENE. DKFZP586D0919 BINDING SITE is a target binding site found in the 3' untranslated region of mRNA encoded by DKFZP586D0919, corresponding to a target binding site such as BINDING SITE I, BINDING SITE II or BINDING SITE III of FIG. 8. Table 4 illustrates the complementarity of the nucleotide sequences of DKFZP586D0919 BINDING SITE, designated SEQ ID:19113, to the nucleotide sequence of GAM190 RNA, herein designated GAM RNA, also designated SEQ ID:289.

Another function of GAM190 is therefore inhibition of DKFZP586D0919 (Accession NP_056248.1). Accordingly, utilities of GAM190 include diagnosis, prevention and treatment of diseases and clinical conditions associated with DKFZP586D0919.

DKFZP727G051 (Accession XP_045308.2) is another GAM190 target gene, herein designated TARGET GENE. DKFZP727G051 BINDING SITE is a target binding site found in the 3' untranslated region of mRNA encoded by DKFZP727G051, corresponding to a target binding site such as BINDING SITE I, BINDING SITE II or BINDING SITE III of FIG. 8. Table 4 illustrates the complementarity of the nucleotide sequences of DKFZP727G051 BINDING SITE, designated SEQ ID:12451, to the nucleotide sequence of GAM190 RNA, herein designated GAM RNA, also designated SEQ ID:289.

Another function of GAM190 is therefore inhibition of DKFZP727G051 (Accession XP_045308.2). Accordingly, utilities of GAM190 include diagnosis, prevention and treatment of diseases and clinical conditions associated with DKFZP727G051.

DKFZP727M111 (Accession NP_056355.2) is another GAM190 target gene, herein designated TARGET GENE. DKFZP727M111 BINDING SITE is a target binding site found in the 3' untranslated region of mRNA encoded by DKFZP727M111, corresponding to a target binding site such as BINDING SITE I, BINDING SITE II or BINDING SITE III of FIG. 8. Table 4 illustrates the complementarity of the nucleotide sequences of DKFZP727M111 BINDING SITE, designated SEQ ID:12399, to the nucleotide sequence of GAM190 RNA, herein designated GAM RNA, also designated SEQ ID:289.

Another function of GAM190 is therefore inhibition of DKFZP727M111 (Accession NP_056355.2). Accordingly, utilities of GAM190 include diagnosis, prevention and treatment of diseases and clinical conditions associated with DKFZP727M111.

DPF3 (Accession NP_036206.1) is another GAM190 target gene, herein designated TARGET GENE. DPF3 BINDING SITE is a target binding site found in the 3' untranslated region of mRNA encoded by DPF3, corresponding to a target binding site such as BINDING SITE I, BINDING SITE II or BINDING SITE III of FIG. 8. Table 4 illustrates the complementarity of the nucleotide sequences of DPF3 BINDING SITE, designated SEQ ID:14462, to the nucleotide sequence of GAM190 RNA, herein designated GAM RNA, also designated SEQ ID:289.

Another function of GAM190 is therefore inhibition of DPF3 (Accession NP_036206.1). Accordingly, utilities of GAM190 include diagnosis, prevention and treatment of diseases and clinical conditions associated with DPF3.

E2IG5 (Accession NP_055182.2) is another GAM190 target gene, herein designated TARGET GENE. E2IG5 BINDING SITE is a target binding site found in the 3' untranslated region of mRNA encoded by E2IG5, corresponding to a target binding site such as BINDING SITE I, BINDING SITE II or BINDING SITE III of FIG. 8. Table 4 illustrates the complementarity of the nucleotide sequences of E2IG5 BINDING SITE, designated SEQ ID:3520, to the nucleotide sequence of GAM190 RNA, herein designated GAM RNA, also designated SEQ ID:289.

Another function of GAM190 is therefore inhibition of E2IG5 (Accession NP_055182.2). Accordingly, utilities of GAM190 include diagnosis, prevention and treatment of diseases and clinical conditions associated with E2IG5.

Extra spindle poles like 1 (s. cerevisiae) (ESPL1, Accession NP_036423.1) is another GAM190 target gene, herein designated TARGET GENE. ESPL1 BINDING SITE is a target binding site found in the 5' untranslated region of mRNA encoded by ESPL1, corresponding to a target binding site such as BINDING SITE I, BINDING SITE II or BINDING SITE III of FIG. 8. Table 4 illustrates the complementarity of the nucleotide sequences of ESPL1 BINDING SITE, designated SEQ ID:7872, to the nucleotide sequence of GAM190 RNA, herein designated GAM RNA, also designated SEQ ID:289.

Another function of GAM190 is therefore inhibition of Extra spindle poles like 1 (s. cerevisiae) (ESPL1, Accession NP_036423.1). Accordingly, utilities of GAM190 include diagnosis, prevention and treatment of diseases and clinical conditions associated with ESPL1.

Ets variant gene 1 (ETV1, Accession NP_004947.2) is another GAM190 target gene, herein designated TARGET GENE. ETV1 BINDING SITE is a target binding site found in the 5' untranslated region of mRNA encoded by ETV1, corresponding to a target binding site such as BINDING SITE I, BINDING SITE II or BINDING SITE III of FIG. 8. Table 4 illustrates the complementarity of the nucleotide sequences of ETV1 BINDING SITE, designated SEQ ID:18488, to the nucleotide sequence of GAM190 RNA, herein designated GAM RNA, also designated SEQ ID:289.

Another function of GAM190 is therefore inhibition of Ets variant gene 1 (ETV1, Accession NP_004947.2). Accordingly, utilities of GAM190 include diagnosis, prevention and treatment of diseases and clinical conditions associated with ETV1.

Exostoses (multiple)-like 2 (EXTL2, Accession NP_001430.1) is another GAM190 target gene, herein designated TARGET GENE. EXTL2 BINDING SITE is a target binding site found in the 3' untranslated region of mRNA encoded by EXTL2, corresponding to a target binding site such as BINDING SITE I, BINDING SITE II or BINDING SITE III of FIG. 8. Table 4 illustrates the complementarity of the nucleotide sequences of EXTL2 BINDING SITE, designated SEQ ID:3245, to the nucleotide sequence of GAM190 RNA, herein designated GAM RNA, also designated SEQ ID:289.

Another function of GAM190 is therefore inhibition of Exostoses (multiple)-like 2 (EXTL2, Accession NP_001430.1), a gene which is homologous to the EXT and EXTL genes. Accordingly, utilities of GAM190 include diagnosis, prevention and treatment of diseases and clinical conditions associated with EXTL2.

The function of EXTL2 has been established by previous studies. In patients with multiple exostoses, mutations in 2 different genes have been found: EXT1 (OMIM Ref. No. 133700) on 8q and EXT2 (OMIM Ref. No. 133701) on 11p. In addition, linkage has demonstrated a third locus, EXT3 (OMIM Ref. No. 600209), on 19p as the site of mutations causing multiple exostoses. The family of EXT genes was extended by the identification of an EXT-like gene (EXTL1; 601738) showing a high degree of homology with the EXT genes. Wuyts et al. (1997) described a second EXT-like gene, EXTL2, that is homologous to the EXT and EXTL genes. EXTL2 was found to consist of 5 exons encoding a ubiquitously expressed 330-amino acid protein. In addition, a putative pseudogene, EXTL2P, was identified. Saito et al. (1998) also cloned an EXTL2 cDNA, which they called EXTR2. By Northern blot analysis, they detected a 3.4-kb transcript in all tissues tested except leukocyte, where the gene was hardly transcribed. Its expression was relatively constant among tissues, but was weak in liver, lung, and thymus. By fluorescence in situ hybridization, Wuyts et al. (1997) mapped the EXTL2 gene to 1p12-p11 and the EXTL2 pseudogene to 2q24-q31. By somatic cell hybrid and radiation hybrid analyses, Saito et al. (1998) mapped the EXTL2 gene to chromosome 1p21. Wuyts and Van Hul (2000) cloned mouse Extl2, which has the same genomic structure as the human gene, encodes a protein identical in size, and has a sequence that is 87% identical to the human sequence. By radiation hybrid analysis, they mapped the mouse gene to chromosome 3.

Full details of the abovementioned studies are described in the following publications, the disclosure of which are hereby incorporated by reference:

Wuyts, W.; Van Hul, W.; Hendrickx, J.; Speleman, F.; Wauters, J.; De Boulle, K.; Van Roy, N.; Van Agtmael, T.; Bossuy, P.; Willems, P. J.: Identification and characterization of a novel member of the EXT gene family, EXTL2. Europ. J. Hum. Genet. 5:382-389, 1997; and Wuyts, W.; Van Hul, W.: Characterization and genomic localization of the mouse Extl2 gene. Cytogenet. Cell Genet. 89:185-188, 2000.

Further studies establishing the function and utilities of EXTL2 are found in John Hopkins OMIM database record ID 602411, and in cited publications listed in Table 5, which are hereby incorporated by reference. FLJ00007 (Accession NP_258260.1) is another GAM190 target gene, herein designated TARGET GENE. FLJ00007 BINDING SITE is a target binding site found in the 3' untranslated region of mRNA encoded by FLJ00007, corresponding to a target binding site such as BINDING SITE I, BINDING SITE II or BINDING SITE III of FIG. 8. Table 4 illustrates the complementarity of the nucleotide sequences of FLJ00007 BINDING SITE, designated SEQ ID:9436, to the nucleotide sequence of GAM190 RNA, herein designated GAM RNA, also designated SEQ ID:289.

Another function of GAM190 is therefore inhibition of FLJ00007 (Accession NP_258260.1). Accordingly, utilities of GAM190 include diagnosis, prevention and treatment of diseases and clinical conditions associated with FLJ00007.

FLJ12425 (Accession XP_098290.1) is another GAM190 target gene, herein designated TARGET GENE. FLJ12425 BINDING SITE is a target binding site found in the 3' untranslated region of mRNA encoded by FLJ12425, corresponding to a target binding site such as BINDING SITE I, BINDING SITE II or BINDING SITE III of FIG. 8. Table 4 illustrates the complementarity of the nucleotide sequences of FLJ12425 BINDING SITE, designated SEQ ID:16869, to the nucleotide sequence of GAM190 RNA, herein designated GAM RNA, also designated SEQ ID:289.

Another function of GAM190 is therefore inhibition of FLJ12425 (Accession XP_098290.1). Accordingly, utilities of GAM190 include diagnosis, prevention and treatment of diseases and clinical conditions associated with FLJ12425.

FLJ13114 (Accession NP_078817.1) is another GAM190 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:6552, to the nucleotide sequence of GAM190 RNA, herein designated GAM RNA, also designated SEQ ID:289.

Another function of GAM190 is therefore inhibition of FLJ13114 (Accession NP_078817.1). Accordingly, utilities of GAM190 include diagnosis, prevention and treatment of diseases and clinical conditions associated with FLJ13114.

FLJ13744 (Accession NP_079287.1) is another GAM190 target gene, herein designated TARGET GENE. FLJ13744 BINDING SITE is a target binding site found in the 5' untranslated region of mRNA encoded by FLJ13744, corresponding to a target binding site such as BINDING SITE I, BINDING SITE II or BINDING SITE III of FIG. 8. Table 4 illustrates the complementarity of the nucleotide sequences of FLJ13744 BINDING SITE, designated SEQ ID:5728, to the nucleotide sequence of GAM190 RNA, herein designated GAM RNA, also designated SEQ ID:289.

Another function of GAM190 is therefore inhibition of FLJ13744 (Accession NP_079287.1). Accordingly, utilities of GAM190 include diagnosis, prevention and treatment of diseases and clinical conditions associated with FLJ13744.

FLJ13962 (Accession NP_079138.1) is another GAM190 target gene, herein designated TARGET GENE. FLJ13962 BINDING SITE is a target binding site found in the 3' untranslated region of mRNA encoded by FLJ13962, corresponding to a target binding site such as BINDING SITE I, BINDING SITE II or BINDING SITE III of FIG. 8. Table 4 illustrates the complementarity of the nucleotide sequences of FLJ13962 BINDING SITE, designated SEQ ID:3592, to the nucleotide sequence of GAM190 RNA, herein designated GAM RNA, also designated SEQ ID:289.

Another function of GAM190 is therefore inhibition of FLJ13962 (Accession NP_079138.1). Accordingly, utilities of GAM190 include diagnosis, prevention and treatment of diseases and clinical conditions associated with FLJ13962.

FLJ14779 (Accession NP_116227.1) is another GAM190 target gene, herein designated TARGET GENE. FLJ14779 BINDING SITE is a target binding site found in the 3' untranslated region of mRNA encoded by FLJ14779, corresponding to a target binding site such as BINDING SITE I, BINDING SITE II or BINDING SITE III of FIG. 8. Table 4 illustrates the complementarity of the nucleotide sequences of FLJ14779 BINDING SITE, designated SEQ ID:10085, to the nucleotide sequence of GAM190 RNA, herein designated GAM RNA, also designated SEQ ID:289.

Another function of GAM190 is therefore inhibition of FLJ14779 (Accession NP_116227.1). Accordingly, utilities of GAM190 include diagnosis, prevention and treatment of diseases and clinical conditions associated with FLJ14779.

FLJ20035 (Accession NP_060101.2) is another GAM190 target gene, herein designated TARGET GENE. FLJ20035 BINDING SITE is a target binding site found in the 3' untranslated region of mRNA encoded by FLJ20035, corresponding to a target binding site such as BINDING SITE I, BINDING SITE II or BINDING SITE III of FIG. 8. Table 4 illustrates the complementarity of the nucleotide sequences of FLJ20035 BINDING SITE, designated SEQ ID:7692, to the nucleotide sequence of GAM190 RNA, herein designated GAM RNA, also designated SEQ ID:289.

Another function of GAM190 is therefore inhibition of FLJ20035 (Accession NP_060101.2). Accordingly, utilities of GAM190 include diagnosis, prevention and treatment of diseases and clinical conditions associated with FLJ20035.

FLJ20189 (Accession NP_060174.1) is another GAM190 target gene, herein designated TARGET GENE. FLJ20189 BINDING SITE is a target binding site found in the 3' untranslated region of mRNA encoded by FLJ20189, corresponding to a target binding site such as BINDING SITE I, BINDING SITE II or BINDING SITE III of FIG. 8. Table 4 illustrates the complementarity of the nucleotide sequences of FLJ20189 BINDING SITE, designated SEQ ID:6742, to the nucleotide sequence of GAM190 RNA, herein designated GAM RNA, also designated SEQ ID:289.

Another function of GAM190 is therefore inhibition of FLJ20189 (Accession NP_060174.1). Accordingly, utilities of GAM190 include diagnosis, prevention and treatment of diseases and clinical conditions associated with FLJ20189.

FLJ20618 (Accession NP_060373.1) is another GAM190 target gene, herein designated TARGET GENE. FLJ20618 BINDING SITE is a target binding site found in the 3' untranslated region of mRNA encoded by FLJ20618, corresponding to a target binding site such as BINDING SITE I, BINDING SITE II or BINDING SITE III of FIG. 8. Table 4 illustrates the complementarity of the nucleotide sequences of FLJ20618 BINDING SITE, designated SEQ ID:6968, to the nucleotide sequence of GAM190 RNA, herein designated GAM RNA, also designated SEQ ID:289.

Another function of GAM190 is therefore inhibition of FLJ20618 (Accession NP_060373.1). Accordingly, utilities of GAM190 include diagnosis, prevention and treatment of diseases and clinical conditions associated with FLJ20618.

FLJ21687 (Accession NP_079135.1) is another GAM190 target gene, herein designated TARGET GENE. FLJ21687 BINDING SITE is a target binding site found in the 3' untranslated region of mRNA encoded by FLJ21687, corresponding to a target binding site such as BINDING SITE I, BINDING SITE II or BINDING SITE III of FIG. 8. Table 4 illustrates the complementarity of the nucleotide sequences of FLJ21687 BINDING SITE, designated SEQ ID:11614, to the nucleotide sequence of GAM190 RNA, herein designated GAM RNA, also designated SEQ ID:289.

Another function of GAM190 is therefore inhibition of FLJ21687 (Accession NP_079135.1). Accordingly, utilities of GAM190 include diagnosis, prevention and treatment of diseases and clinical conditions associated with FLJ21687.

FLJ22688 (Accession NP_079405.2) is another GAM190 target gene, herein designated TARGET GENE. FLJ22688 BINDING SITE is a target binding site found in the 3' untranslated region of mRNA encoded by FLJ22688, corresponding to a target binding site such as BINDING SITE I, BINDING SITE II or BINDING SITE III of FIG. 8. Table 4 illustrates the complementarity of the nucleotide sequences of FLJ22688 BINDING SITE, designated SEQ ID:18629, to the nucleotide sequence of GAM190 RNA, herein designated GAM RNA, also designated SEQ ID:289.

Another function of GAM190 is therefore inhibition of FLJ22688 (Accession NP_079405.2). Accordingly, utilities of GAM190 include diagnosis, prevention and treatment of diseases and clinical conditions associated with FLJ22688.

FLJ22955 (Accession NP_079095.2) is another GAM190 target gene, herein designated TARGET GENE. FLJ22955 BINDING SITE is a target binding site found in the 3' untranslated region of mRNA encoded by FLJ22955, corresponding to a target binding site such as BINDING SITE I, BINDING SITE II or BINDING SITE III of FIG. 8. Table 4 illustrates the complementarity of the nucleotide sequences of FLJ22955 BINDING SITE, designated SEQ ID:11826, to the nucleotide sequence of GAM190 RNA, herein designated GAM RNA, also designated SEQ ID:289.

Another function of GAM190 is therefore inhibition of FLJ22955 (Accession NP_079095.2). Accordingly, utilities of GAM190 include diagnosis, prevention and treatment of diseases and clinical conditions associated with FLJ22955.

FLJ23235 (Accession NP_079219.1) is another GAM190 target gene, herein designated TARGET GENE. FLJ23235 BINDING SITE is a target binding site found in the 3' untranslated region of mRNA encoded by FLJ23235, corresponding to a target binding site such as BINDING SITE I, BINDING SITE II or BINDING SITE III of FIG. 8. Table 4 illustrates the complementarity of the nucleotide sequences of FLJ23235 BINDING SITE, designated SEQ ID:2723, to the nucleotide sequence of GAM190 RNA, herein designated GAM RNA, also designated SEQ ID:289.

Another function of GAM190 is therefore inhibition of FLJ23235 (Accession NP_079219.1). Accordingly, utilities of GAM190 include diagnosis, prevention and treatment of diseases and clinical conditions associated with FLJ23235.

FLJ30046 (Accession NP_653196.1) is another GAM190 target gene, herein designated TARGET GENE. FLJ30046 BINDING SITE is a target binding site found in the 3' untranslated region of mRNA encoded by FLJ30046, corresponding to a target binding site such as BINDING SITE I, BINDING SITE II or BINDING SITE III of FIG. 8. Table 4 illustrates the complementarity of the nucleotide sequences of FLJ30046 BINDING SITE, designated SEQ ID:2890, to the nucleotide sequence of GAM190 RNA, herein designated GAM RNA, also designated SEQ ID:289.

Another function of GAM190 is therefore inhibition of FLJ30046 (Accession NP_653196.1). Accordingly, utilities of GAM190 include diagnosis, prevention and treatment of diseases and clinical conditions associated with FLJ30046.

FLJ33318 (Accession NP_694961.1) is another GAM190 target gene, herein designated TARGET GENE. FLJ33318 BINDING SITE is a target binding site found in the 3' untranslated region of mRNA encoded by FLJ33318, corresponding to a target binding site such as BINDING SITE I, BINDING SITE II or BINDING SITE III of FIG. 8. Table 4 illustrates the complementarity of the nucleotide sequences of FLJ33318 BINDING SITE, designated SEQ ID:5940, to the nucleotide sequence of GAM190 RNA, herein designated GAM RNA, also designated SEQ ID:289.

Another function of GAM190 is therefore inhibition of FLJ33318 (Accession NP_694961.1). Accordingly, utilities of GAM190 include diagnosis, prevention and treatment of diseases and clinical conditions associated with FLJ33318.

FLJ33708 (Accession NP_775946.1) is another GAM190 target gene, herein designated TARGET GENE. FLJ33708 BINDING SITE is a target binding site found in the 3' untranslated region of mRNA encoded by FLJ33708, corresponding to a target binding site such as BINDING SITE I, BINDING SITE II or BINDING SITE III of FIG. 8. Table 4 illustrates the complementarity of the nucleotide sequences of FLJ33708 BINDING SITE, designated SEQ ID:7549, to the nucleotide sequence of GAM190 RNA, herein designated GAM RNA, also designated SEQ ID:289.

Another function of GAM190 is therefore inhibition of FLJ33708 (Accession NP_775946.1). Accordingly, utilities of GAM190 include diagnosis, prevention and treatment of diseases and clinical conditions associated with FLJ33708.

FLJ38865 (Accession NP_689907.1) is another GAM190 target gene, herein designated TARGET GENE. FLJ38865 BINDING SITE is a target binding site found in the 3' untranslated region of mRNA encoded by FLJ38865, corresponding to a target binding site such as BINDING SITE I, BINDING SITE II or BINDING SITE III of FIG. 8. Table 4 illustrates the complementarity of the nucleotide sequences of FLJ38865 BINDING SITE, designated SEQ ID:17233, to the nucleotide sequence of GAM190 RNA, herein designated GAM RNA, also designated SEQ ID:289.

Another function of GAM190 is therefore inhibition of FLJ38865 (Accession NP_689907.1). Accordingly, utilities of GAM190 include diagnosis, prevention and treatment of diseases and clinical conditions associated with FLJ38865.

FLJ39378 (Accession NP_847884.1) is another GAM190 target gene, herein designated TARGET GENE. FLJ39378 BINDING SITE is a target binding site found in the 3' untranslated region of mRNA encoded by FLJ39378, corresponding to a target binding site such as BINDING SITE I, BINDING SITE II or BINDING SITE III of FIG. 8. Table 4 illustrates the complementarity of the nucleotide sequences of FLJ39378 BINDING SITE, designated SEQ ID:15804, to the nucleotide sequence of GAM190 RNA, herein designated GAM RNA, also designated SEQ ID:289.

Another function of GAM190 is therefore inhibition of FLJ39378 (Accession NP_847884.1). Accordingly, utilities of GAM190 include diagnosis, prevention and treatment of diseases and clinical conditions associated with FLJ39378.

FLJ39873 (Accession NP_776160.1) is another GAM190 target gene, herein designated TARGET GENE. FLJ39873 BINDING SITE is a target binding site found in the 3' untranslated region of mRNA encoded by FLJ39873, corresponding to a target binding site such as BINDING SITE I, BINDING SITE II or BINDING SITE III of FIG. 8. Table 4 illustrates the complementarity of the nucleotide sequences of FLJ39873 BINDING SITE, designated SEQ ID:16670, to the nucleotide sequence of GAM190 RNA, herein designated GAM RNA, also designated SEQ ID:289.

Another function of GAM190 is therefore inhibition of FLJ39873 (Accession NP_776160.1). Accordingly, utilities of GAM190 include diagnosis, prevention and treatment of diseases and clinical conditions associated with FLJ39873.

FLJ40597 (Accession NP_689828.1) is another GAM190 target gene, herein designated TARGET GENE. FLJ40597 BINDING SITE is a target binding site found in the 3' untranslated region of mRNA encoded by FLJ40597, corresponding to a target binding site such as BINDING SITE I, BINDING SITE II or BINDING SITE III of FIG. 8. Table 4 illustrates the complementarity of the nucleotide sequences of FLJ40597 BINDING SITE, designated SEQ ID:10738, to the nucleotide sequence of GAM190 RNA, herein designated GAM RNA, also designated SEQ ID:289.

Another function of GAM190 is therefore inhibition of FLJ40597 (Accession NP_689828.1). Accordingly, utilities of GAM190 include diagnosis, prevention and treatment of diseases and clinical conditions associated with FLJ40597.

Forkhead box o1a (rhabdomyosarcoma) (FOXO1A, Accession NP_002006.2) is another GAM190 target gene, herein designated TARGET GENE. FOXO1A BINDING SITE is a target binding site found in the 3' untranslated region of mRNA encoded by FOXO1A, corresponding to a target binding site such as BINDING SITE I, BINDING SITE II or BINDING SITE III of FIG. 8. Table 4 illustrates the complementarity of the nucleotide sequences of FOXO1A BINDING SITE, designated SEQ ID:9586, to the nucleotide sequence of GAM190 RNA, herein designated GAM RNA, also designated SEQ ID:289.

Another function of GAM190 is therefore inhibition of Forkhead box o1a (rhabdomyosarcoma) (FOXO1A, Accession NP_002006.2), a gene which is a probable transcription factor. and therefore may be associated with Alveolar rhabdomyosarcoma-2. Accordingly, utilities of GAM190 include diagnosis, prevention and treatment of Alveolar rhabdomyosarcoma-2., and of other diseases and clinical conditions associated with FOXO1A.

The function of FOXO1A and its association with various diseases and clinical conditions, has been established by previous studies, as described hereinabove with reference to GAM189.1. Fyve and coiled-coil domain containing 1 (FYCO1, Accession NP_078789.1) is another GAM190 target gene, herein designated TARGET GENE. FYCO1 BINDING SITE is a target binding site found in the 3' untranslated region of mRNA encoded by FYCO1, corresponding to a target binding site such as BINDING SITE I, BINDING SITE II or BINDING SITE III of FIG. 8. Table 4 illustrates the complementarity of the nucleotide sequences of FYCO1 BINDING SITE, designated SEQ ID:17030, to the nucleotide sequence of GAM190 RNA, herein designated GAM RNA, also designated SEQ ID:289.

Another function of GAM190 is therefore inhibition of Fyve and coiled-coil domain containing 1 (FYCO1, Accession NP_078789.1). Accordingly, utilities of GAM190 include diagnosis, prevention and treatment of diseases and clinical conditions associated with FYCO1.

Growth arrest-specific 2 like 1 (GAS2L1, Accession NP_006469.2) is another GAM190 target gene, herein designated TARGET GENE. GAS2L1 BINDING SITE is a target binding site found in the 5' untranslated region of multiple transcripts of mRNA encoded by GAS2L1, corresponding to a target binding site such as BINDING SITE I, BINDING SITE II or BINDING SITE III of FIG. 8. Table 4 illustrates the complementarity of the nucleotide sequences of GAS2L1 BINDING SITE, designated SEQ ID:11278, to the nucleotide sequence of GAM190 RNA, herein designated GAM RNA, also designated SEQ ID:289.

Another function of GAM190 is therefore inhibition of Growth arrest-specific 2 like 1 (GAS2L1, Accession NP_006469.2). Accordingly, utilities of GAM190 include diagnosis, prevention and treatment of diseases and clinical conditions associated with GAS2L1.

GMPPA (Accession NP_037467.1) is another GAM190 target gene, herein designated TARGET GENE. GMPPA BINDING SITE is a target binding site found in the 3' untranslated region of mRNA encoded by GMPPA, corresponding to a target binding site such as BINDING SITE I, BINDING SITE II or BINDING SITE III of FIG. 8. Table 4 illustrates the complementarity of the nucleotide sequences of GMPPA BINDING SITE, designated SEQ ID:709, to the nucleotide sequence of GAM190 RNA, herein designated GAM RNA, also designated SEQ ID:289.

Another function of GAM190 is therefore inhibition of GMPPA (Accession NP_037467.1). Accordingly, utilities of GAM190 include diagnosis, prevention and treatment of diseases and clinical conditions associated with GMPPA.

G protein-coupled receptor 56 (GPR56, Accession NP_005673.2) is another GAM190 target gene, herein designated TARGET GENE. GPR56 BINDING SITE is a target binding site found in the 3' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:5394, to the nucleotide sequence of GAM190 RNA, herein designated GAM RNA, also designated SEQ ID:289.

Another function of GAM190 is therefore inhibition of G protein-coupled receptor 56 (GPR56, Accession NP_005673.2), a gene which transduces extracellular signals through heterotrimeric G proteins. Accordingly, utilities of GAM190 include diagnosis, prevention and treatment of diseases and clinical conditions associated with GPR56.

The function of GPR56 and its association with various diseases and clinical conditions, has been established by previous studies, as described hereinabove with reference to GAM63.1. Glutamate receptor, ionotropic, n-methyl-d-aspartate 3a (GRIN3A, Accession NP_597702.1) is another GAM190 target gene, herein designated TARGET GENE. GRIN3A BINDING SITE is a target binding site found in the 3' untranslated region of mRNA encoded by GRIN3A, corresponding to a target binding site such as BINDING SITE I, BINDING SITE II or BINDING SITE III of FIG. 8. Table 4 illustrates the complementarity of the nucleotide sequences of GRIN3A BINDING SITE, designated SEQ ID:14895, to the nucleotide sequence of GAM190 RNA, herein designated GAM RNA, also designated SEQ ID:289.

Another function of GAM190 is therefore inhibition of Glutamate receptor, ionotropic, n-methyl-d-aspartate 3a (GRIN3A, Accession NP_597702.1). Accordingly, utilities of GAM190 include diagnosis, prevention and treatment of diseases and clinical conditions associated with GRIN3A.

Histone deacetylase 6 (HDAC6, Accession NP_006035.2) is another GAM190 target gene, herein designated TARGET GENE. HDAC6 BINDING SITE is a target binding site found in the 3' untranslated region of mRNA encoded by HDAC6, corresponding to a target binding site such as BINDING SITE I, BINDING SITE II or BINDING SITE III of FIG. 8. Table 4 illustrates the complementarity of the nucleotide sequences of HDAC6 BINDING SITE, designated SEQ ID:11395, to the nucleotide sequence of GAM190 RNA, herein designated GAM RNA, also designated SEQ ID:289.

Another function of GAM190 is therefore inhibition of Histone deacetylase 6 (HDAC6, Accession NP_006035.2), a gene which plays an important role in transcriptional regulation, cell cycle progression and developmental events (by similarity). Accordingly, utilities of GAM190 include diagnosis, prevention and treatment of diseases and clinical conditions associated with HDAC6.

The function of HDAC6 and its association with various diseases and clinical conditions, has been established by previous studies, as described hereinabove with reference to GAM146.1. HECA (Accession NP_057301.1) is another GAM190 target gene, herein designated TARGET GENE. HECA BINDING SITE is a target binding site found in the 3' untranslated region of mRNA encoded by HECA, corresponding to a target binding site such as BINDING SITE I, BINDING SITE II or BINDING SITE III of FIG. 8. Table 4 illustrates the complementarity of the nucleotide sequences of HECA BINDING SITE, designated SEQ ID:13430, to the nucleotide sequence of GAM190 RNA, herein designated GAM RNA, also designated SEQ ID:289.

Another function of GAM190 is therefore inhibition of HECA (Accession NP_057301.1). Accordingly, utilities of GAM190 include diagnosis, prevention and treatment of diseases and clinical conditions associated with HECA.

Human immunodeficiency virus type i enhancer binding protein 2 (HIVEP2, Accession NP_006725.2) is another GAM190 target gene, herein designated TARGET GENE. HIVEP2 BINDING SITE is a target binding site found in the 5' untranslated region of mRNA encoded by HIVEP2, corresponding to a target binding site such as BINDING SITE I, BINDING SITE II or BINDING SITE III of FIG. 8. Table 4 illustrates the complementarity of the nucleotide sequences of HIVEP2 BINDING SITE, designated SEQ ID:3062, to the nucleotide sequence of GAM190 RNA, herein designated GAM RNA, also designated SEQ ID:289.

Another function of GAM190 is therefore inhibition of Human immunodeficiency virus type i enhancer binding protein 2 (HIVEP2, Accession NP_006725.2). Accordingly, utilities of GAM190 include diagnosis, prevention and treatment of diseases and clinical conditions associated with HIVEP2.

Heat shock 70 kda protein 4 (HSPA4, Accession XP_114482.1) is another GAM190 target gene, herein designated TARGET GENE. HSPA4 BINDING SITE is a target binding site found in the 3' untranslated region of mRNA encoded by HSPA4, corresponding to a target binding site such as BINDING SITE I, BINDING SITE II or BINDING SITE III of FIG. 8. Table 4 illustrates the complementarity of the nucleotide sequences of HSPA4 BINDING SITE, designated SEQ ID:10608, to the nucleotide sequence of GAM190 RNA, herein designated GAM RNA, also designated SEQ ID:289.

Another function of GAM190 is therefore inhibition of Heat shock 70 kda protein 4 (HSPA4, Accession XP_114482.1). Accordingly, utilities of GAM190 include diagnosis, prevention and treatment of diseases and clinical conditions associated with HSPA4.

Islet amyloid polypeptide (IAPP, Accession NP_000406.1) is another GAM190 target gene, herein designated TARGET GENE. IAPP BINDING SITE is a target binding site found in the 5' untranslated region of mRNA encoded by IAPP, corresponding to a target binding site such as BINDING SITE I, BINDING SITE II or BINDING SITE III of FIG. 8. Table 4 illustrates the complementarity of the nucleotide sequences of IAPP BINDING SITE, designated SEQ ID:10420, to the nucleotide sequence of GAM190 RNA, herein designated GAM RNA, also designated SEQ ID:289.

Another function of GAM190 is therefore inhibition of Islet amyloid polypeptide (IAPP, Accession NP_000406.1), a gene which selectively inhibits insulin-stimulated glucose utilization and glycogen deposition and therefore may be associated with Type ii diabetes. Accordingly, utilities of GAM190 include diagnosis, prevention and treatment of Type ii diabetes, and of other diseases and clinical conditions associated with IAPP.

The function of IAPP has been established by previous studies. IAPP has cysteine residues in positions 2 and 7, a feature found in all known calcitonin gene-related peptides (OMIM Ref. No. 114130). IAPP shows 46% amino acid sequence homology with CGRP II (OMIM Ref. No. 114160). Since IAPP has been demonstrated immunochemically in normal beta cells of several mammals, it probably has an important role in respect to pancreatic islet function. Cooper et al. (1988) presented evidence that the 37-amino acid peptide may be a hormone present in normal individuals; hence, 'diabetes-associated peptide' is an inappropriate designation. Cooper et al. (1988) synthesized whole amylin by using solid-phase techniques, with formation of the disulfide linkage by oxidation in dilute aqueous solution and recovery of the peptide by lyophilization. The effects of amylin on glucose metabolism were studied by 2 in vitro preparations: isolated rat soleus muscle strips and isolated rat adipocytes. In skeletal muscle, amylin resulted in a marked decrease in insulin-stimulated glycogen synthesis with resulting reduction in insulin- stimulated glucose uptake. In muscle, amylin resulted in a failure of response to the concentration of insulin required to stimulate glucose uptake half-maximally in untreated muscles. No effects were observed in isolated adipocytes. Amylin may be a factor in the etiology of the insulin resistance in type II diabetes mellitus. A correlation has been observed between the extent of islet amyloid deposition and the clinical severity of type II diabetes. Mosselman et al. (1988) isolated and partially characterized the human IAPP gene. By hybridization to DNA from human-rodent somatic cell hybrids, Mosselman et al. (1988) demonstrated that the IAPP gene is located on 12pter-q14. Because of the striking parallelism in the genetic constitution of chromosomes 11 and 12, suggesting an ancient tetraploidization, the mapping of this calcitonin-related gene to 12 is of interest; 2 calcitonin genes are located on 11p. The amyloid in amyloid- producing medullary carcinoma of the thyroid, a feature of multiple endocrine neoplasia type II (OMIM Ref. No. 171400), is derived from calcitonin. Sanke et al. (1988) showed that the islet amyloid polypeptide is derived from an 89-amino acid precursor by proteolytic processing. The processed peptide, 37-amino acids long, is bracketed at its NH(2) and COOH termini by lys-arg and gly-lys-arg, respectively. The data indicated that this amyloid peptide is generated by proteolytic processing similar to that for proinsulin and other islet pro-hormones and also that the peptide may be carboxyamidated. Mosselman et al. (1989) found that 2 exons, which are approximately 5 kb apart, encode the 89-amino acid pre-pro-IAPP. A putative signal sequence at the amino-terminus of the precursor suggested that IAPP is a secreted protein. From the DNA sequence of a partial cDNA clone and a phage lambda genomic clone of the coding region of the amylin gene, Roberts et al. (1989) concluded that this peptide is synthesized as a precursor peptide called proamylin. The sequences of the genes for amylin and the calcitonin gene-related peptides show strong similarity, especially in their 5-prime coding regions, where these peptides have a conserved intramolecular disulfide bridge, and also in their 3-prime coding regions, where the presence of a glycine codon strongly suggests that the carboxyl-terminal residue, like that of CGRP, is amidated. In a study of the biologic activity of amylin synthesized with or without the disulfide bridge and/or amidation, Roberts et al. (1989) demonstrated that both features are necessary for full biologic activity, thereby confirming the functional importance of those regions of the molecule that have been conserved at both protein and genetic levels.

Animal model experiments lend further support to the function of IAPP. Janson et al. (1996) created homozygous transgenic mice with a high level of expression of human IAPP. Male transgenic mice spontaneously developed diabetes mellitus by 8 weeks of age, which was associated with selective beta-cell death and impaired insulin secretion. Approximately 20% of female transgenic mice spontaneously developed diabetes at 30+ weeks of age when beta-cell degeneration and both amorphous and amyloid deposits of IAPP were present. Large deposits of IAPP-derived amyloid did not appear to be important to the cytotoxicity, but early, small amorphous intra- and extracellular aggregates of human IAPP were consistently present at the time of beta-cell death and therefore may be the most cytotoxic form of IAPP.

It is appreciated that the abovementioned animal model for IAPP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Cooper, G. J.; Willis, A. C.; Clark, A.; Turner, R. C.; Sim, R. B.; Reid, K. B.: Purification and characterization of a peptide from amyloid-rich pancreases of type 2 diabetic patients. Proc. Nat. Acad. Sci. 84:8628-8632, 1987; and Cooper, G. J. S.; Leighton, B.; Dimitriadis, G. D.; Parry-Billings, M.; Kowalchuk, J. M.; Howland, K.; Rothbard, J. B.; Willis, A. C.; Reid, K. B. M.: Amylin found in amyloid deposits.

Further studies establishing the function and utilities of IAPP are found in John Hopkins OMIM database record ID 147940, and in cited publications listed in Table 5, which are hereby incorporated by reference. Interleukin 10 receptor, alpha (IL10RA, Accession NP_001549.1) is another GAM190 target gene, herein designated TARGET GENE. IL10RA BINDING SITE is a target binding site found in the 3' untranslated region of mRNA encoded by IL10RA, corresponding to a target binding site such as BINDING SITE I, BINDING SITE II or BINDING SITE III of FIG. 8. Table 4 illustrates the complementarity of the nucleotide sequences of IL10RA BINDING SITE, designated SEQ ID:2291, to the nucleotide sequence of GAM190 RNA, herein designated GAM RNA, also designated SEQ ID:289.

Another function of GAM190 is therefore inhibition of Interleukin 10 receptor, alpha (IL10RA, Accession NP_001549.1), a gene which is a receptor for il-10. Accordingly, utilities of GAM190 include diagnosis, prevention and treatment of diseases and clinical conditions associated with IL10RA.

The function of IL10RA has been established by previous studies. Interleukin- 10 (OMIM Ref. No. 124092) is a cytokine produced by B cells, T helper cells, and cells of the monocyte/macrophage lineage that exhibits diverse activities on different cell lines. Tan et al. (1993) showed that the protein can be enzymatically iodinated to high specific radioactivity with retention of biologic activity. The radiolabeled ligand was found to bind specifically to its receptor in several mouse and human cell lines. For both mouse and human cell lines examined, there appeared to be at most only a few hundred IL10 receptors per cell. Mouse IL10 was capable of blocking binding of human IL10 to mouse but not human cells. Ho et al. (1993) found that mouse il-10r is structurally related to interferon receptors. Since IL-10 inhibits macrophage activation by interferon-gamma, a possible implication of this relationship is interaction of IL- 10R and IFN-gamma-R or their signaling pathways. Liu et al. (1994) assigned the IL10R gene to chromosome 11 by analysis of DNAs from human/hamster hybrid cell lines. Taniyama et al. (1995) regionalized the assignment to 11q23.3 by fluorescence in situ hybridization.

Full details of the abovementioned studies are described in the following publications, the disclosure of which are hereby incorporated by reference:

Ho, A. S. Y.; Liu, Y.; Khan, T. A.; Hsu, D.-H.; Bazan, J. F.; Moore, K. W.: A receptor for interleukin 10 is related to interferon receptors. Proc. Nat. Acad. Sci. 90:11267-11271, 1993; and Liu, Y.; Wei, S. H.-Y.; Ho, A. S.-Y.; de Waal Malefy, R.; Moore, K. W.: Expression cloning and characterization of a human Il-10 receptor. J. Immun. 152:1821-1829, 1994.

Further studies establishing the function and utilities of IL10RA are found in John Hopkins OMIM database record ID 146933, and in cited publications listed in Table 5, which are hereby incorporated by reference. Interleukin 18 receptor 1 (IL18R1, Accession NP_003846.1) is another GAM190 target gene, herein designated TARGET GENE. IL18R1 BINDING SITE is a target binding site found in the 3' untranslated region of mRNA encoded by IL18R1, corresponding to a target binding site such as BINDING SITE I, BINDING SITE II or BINDING SITE III of FIG. 8. Table 4 illustrates the complementarity of the nucleotide sequences of IL18R1 BINDING SITE, designated SEQ ID:10177, to the nucleotide sequence of GAM190 RNA, herein designated GAM RNA, also designated SEQ ID:289.

Another function of GAM190 is therefore inhibition of Interleukin 18 receptor 1 (IL18R1, Accession NP_003846.1), a gene which is required for dorsal-ventral embryonic polarity and promotes heterophilic cellular adhesion. Accordingly, utilities of GAM190 include diagnosis, prevention and treatment of diseases and clinical conditions associated with IL18R1.

The function of IL18R1 has been established by previous studies. Using a YAC template known to contain IL1R1 (OMIM Ref. No. 147810), Parnet et al. (1996) cloned by PCR with degenerate primers what was thought to be a member of the interleukin-1 receptor family, which they called IL1 receptor-related protein (OMIM Ref. No. IL1RRP). The gene encodes a 541-amino acid protein. Although the sequence was similar to that of IL1Rs, the extracellular portion failed to bind IL1A (OMIM Ref. No. 147760), IL1B (OMIM Ref. No. 147720), or IL1RN (OMIM Ref. No. 147679). When the cytoplasmic domain was fused to mouse IL1 extracellular and transmembrane portions, it activated NF-kappa-B (OMIM Ref. No. 164011) in response to IL1. Northern blot analysis revealed that IL1RRP is expressed in lung, leukocytes, spleen, liver, thymus, prostate, small intestine, colon, placenta, and heart, and is absent from brain, skeletal muscle, pancreas, and kidney. Torigoe et al. (1997) purified human IL18R, symbolized IL18R1, by selecting a Hodgkin disease cell line, L428, that was the best binder in IL18 (OMIM Ref. No. 600953) binding assays. The binding of radiolabeled IL18 was inhibited by IL18 but not by IL1B, with which it has 15% amino acid homology but no functional resemblance. The authors raised a monoclonal antibody against L428 cells and used it to purify IL18R from solubilized cells after wheat germ lectin chromatography. They found that the internal amino acid sequence matched that of IL1RRP. When expressed in COS-1 cells, the cDNA of IL1RRP conferred IL18 binding properties and the ability to activate NF-kappa-B in response to IL18 but not IL1B.

Full details of the abovementioned studies are described in the following publications, the disclosure of which are hereby incorporated by reference:

Dale, M.; Nicklin, M. J.: Interleukin-1 receptor cluster: gene organization of IL1R2, IL1R1, IL1RL2 (IL-1Rrp2), IL1RL1 (T1/ST2), and IL18R1 (IL-1Rrp) on human chromosome 2q. Genomics 57:177-179, 1999; and Parnet, P.; Garka, K. E.; Bonnert, T. P.; Dower, S. K.; Sims, J. E.: IL-1Rrp is a novel receptor-like molecule similar to the type I interleukin-1 receptor and its homologues T1/ST2 an.

Further studies establishing the function and utilities of IL18R1 are found in John Hopkins OMIM database record ID 604494, and in cited publications listed in Table 5, which are hereby incorporated by reference. Insulin receptor-related receptor (INSRR, Accession XP_043563.2) is another GAM190 target gene, herein designated TARGET GENE. INSRR BINDING SITE is a target binding site found in the 3' untranslated region of multiple transcripts of mRNA encoded by INSRR, corresponding to a target binding site such as BINDING SITE I, BINDING SITE II or BINDING SITE III of FIG. 8. Table 4 illustrates the complementarity of the nucleotide sequences of INSRR BINDING SITE, designated SEQ ID:19916, to the nucleotide sequence of GAM190 RNA, herein designated GAM RNA, also designated SEQ ID:289.

Another function of GAM190 is therefore inhibition of Insulin receptor-related receptor (INSRR, Accession XP_043563.2), a gene which phosphorylates the insulin receptor substrates irs-1 and irs-2. Accordingly, utilities of GAM190 include diagnosis, prevention and treatment of diseases and clinical conditions associated with INSRR.

The function of INSRR has been established by previous studies. Shier and Watt (1989) isolated genomic DNA that appeared to encode a novel receptor that was structurally as similar to the insulin receptor (OMIM Ref. No. 147670) and the IGF1 receptor (OMIM Ref. No. 147370) as the last two are to each other. This similarity suggested that the insulin receptor-related receptor (IRR) mediates the action of a ligand that is identical or very similar to insulin, IGF1, or IGF2. Kurachi et al. (1992) isolated IRR cDNA from rat brain and examined the expression of IRR mRNA in a variety of rat tissues. They demonstrated that, in contrast to the wide distribution of the insulin receptor and the IGF1 receptor mRNAs, the IRR mRNA is expressed preferentially in the kidney, which indicates that it has unique functions as a member of the insulin receptor family. Using genomic DNA encoding part of IRR in Southern blot analysis of DNA from human-mouse cell hybrids, Shier et al. (1990) assigned the INSRR gene to human chromosome 1. By radiation hybrid analysis, Whitmore et al. (1999) mapped the gene to chromosome 1q21-q23

Full details of the abovementioned studies are described in the following publications, the disclosure of which are hereby incorporated by reference:

Shier, P.; Willard, H. F.; Watt, V. M.: Localization of the insulin receptor-related receptor gene to human chromosome 1. Cytogenet. Cell Genet. 54:80- 81, 1990; and Whitmore, T. E.; Maurer, M. F.; Day, H. L.; Jelmberg, A. C.; Dasovich, M. M.; Sundborg, L. M.; Burkhead, S. K.; Heipel, M. D.; Madden, K. L.; Kramer, J. M.; Kuijper, J. L.; Xu, W. F.; Ja.

Further studies establishing the function and utilities of INSRR are found in John Hopkins OMIM database record ID 147671, and in cited publications listed in Table 5, which are hereby incorporated by reference. Insulin receptor substrate 2 (IRS2, Accession XP_007095.5) is another GAM190 target gene, herein designated TARGET GENE. IRS2 BINDING SITE is a target binding site found in the 3' untranslated region of mRNA encoded by IRS2, corresponding to a target binding site such as BINDING SITE I, BINDING SITE II or BINDING SITE III of FIG. 8. Table 4 illustrates the complementarity of the nucleotide sequences of IRS2 BINDING SITE, designated SEQ ID:13393, to the nucleotide sequence of GAM190 RNA, herein designated GAM RNA, also designated SEQ ID:289.

Another function of GAM190 is therefore inhibition of Insulin receptor substrate 2 (IRS2, Accession XP_007095.5), a gene which may mediate the control of various cellular processes by insulin. and therefore may be associated with Diabetes, type ii, susceptibility to. Accordingly, utilities of GAM190 include diagnosis, prevention and treatment of Diabetes, type ii, susceptibility to, and of other diseases and clinical conditions associated with IRS2.

The function of IRS2 has been established by previous studies. The protein IRS1 (OMIM Ref. No. 147545) acts as an interface between signaling proteins with Src homology-2 domains (SH2 proteins) and the receptors for insulin (INS; 176730), IGF2 (OMIM Ref. No. 147470), growth hormone (GH1; 139250), several interleukins (IL4, 147780; IL9, 146931; IL13, 147683), and other cytokines. It regulates gene expression and stimulates mitogenesis and appears to mediate insulin/IGF1- stimulated glucose transport. Thus, the finding that survival of the homozygous Irs1 knockout mouse with only mild resistance to hypertension was surprising. This dilemma was provisionally resolved by the discovery by Sun et al. (1995) of a second IRS signaling protein in mouse. They purified and cloned a likely candidate from mouse myeloid progenitor cells and, because of its resemblance to IRS1, they designated it IRS2. Alignment of the sequences of IRS2 and IRS1 demonstrated a highly conserved N terminus containing a pleckstrin-homology domain and a phosphotyrosine-binding (PTB) domain, and a poorly conserved C terminus containing several tyrosine phosphorylation motifs. IRS2 is expressed in many cells, including tissues from the homozygous IRS1 knockout mouse. Sun et al. (1995) suggested that IRS2 may be essential for signaling by several receptor systems. Mammarella et al. (2000) genotyped 193 Italian patients with type II diabetes (OMIM Ref. No. 125853) and 206 control subjects for the IRS2 G1057D polymorphism (600797.0001). They found evidence for a strong association between type II diabetes and the polymorphism, which appears to be protective against type II diabetes in a codominant fashion Animal model experiments lend further support to the function of IRS2. Tobe et al. (2001) observed that Irs2-deficient mice (Kubota et al. (2000)) showed increased adiposity with increased serum leptin level, suggesting leptin resistance before the mice developed diabetes. Using oligonucleotide microarray and Northern blot analyses to analyze gene expression, Tobe et al. (2001) detected increased expression of SREBP1, a downstream target of insulin, in Irs2- deficient mouse liver. Using high dose leptin administration, They provided evidence that leptin resistance in Irs2-deficient mice is causally related to SREBP1 gene induction. The authors concluded that Irs2 gene disruption results in leptin resistance, causing SREBP1 gene induction, obesity, fatty liver, and diabetes It is appreciated that the abovementioned animal model for IRS2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sun, X. J.; Wang, L.-M.; Zhang, Y.; Yenush, L.; Myers, M. G., Jr.; Glasheen, E.; Lane, W. S.; Pierce, J. H.; White, M. F.: Role of IRS-2 in insulin and cytokine signalling. Nature 377: 173-177, 1995; and Tobe, K.; Suzuki, R.; Aoyama, M.; Yamauchi, T.; Kamon, J.; Kubota, N.; Terauchi, Y.; Matsui, J.; Akanuma, Y.; Kimura, S.; Tanaka, J.; Abe, M.; Ohsumi, J.; Nagai, R.; Kadowaki, T.: Incre.

Further studies establishing the function and utilities of IRS2 are found in John Hopkins OMIM database record ID 600797, and in cited publications listed in Table 5, which are hereby incorporated by reference. Inter-alpha (globulin) inhibitor, h1 polypeptide (ITIH1, Accession NP_002206.1) is another GAM190 target gene, herein designated TARGET GENE. ITIH1 BINDING SITE is a target binding site found in the 3' untranslated region of mRNA encoded by ITIH1, corresponding to a target binding site such as BINDING SITE I, BINDING SITE II or BINDING SITE III of FIG. 8. Table 4 illustrates the complementarity of the nucleotide sequences of ITIH1 BINDING SITE, designated SEQ ID:16797, to the nucleotide sequence of GAM190 RNA, herein designated GAM RNA, also designated SEQ ID:289.

Another function of GAM190 is therefore inhibition of Inter-alpha (globulin) inhibitor, h1 polypeptide (ITIH1, Accession NP_002206.1), a gene which may act as a carrier of hyaluronan in serum or as a binding protein between hyaluronan and other matrix protein. Accordingly, utilities of GAM190 include diagnosis, prevention and treatment of diseases and clinical conditions associated with ITIH1.

The function of ITIH1 and its association with various diseases and clinical conditions, has been established by previous studies, as described hereinabove with reference to GAM63.1. Potassium channel, subfamily k, member 5 (KCNK5, Accession NP_003731.1) is another GAM190 target gene, herein designated TARGET GENE. KCNK5 BINDING SITE is a target binding site found in the 3' untranslated region of mRNA encoded by KCNK5, corresponding to a target binding site such as BINDING SITE I, BINDING SITE II or BINDING SITE III of FIG. 8. Table 4 illustrates the complementarity of the nucleotide sequences of KCNK5 BINDING SITE, designated SEQ ID:14350, to the nucleotide sequence of GAM190 RNA, herein designated GAM RNA, also designated SEQ ID:289.

Another function of GAM190 is therefore inhibition of Potassium channel, subfamily k, member 5 (KCNK5, Accession NP_003731.1). Accordingly, utilities of GAM190 include diagnosis, prevention and treatment of diseases and clinical conditions associated with KCNK5.

KEO4 (Accession NP_006450.1) is another GAM190 target gene, herein designated TARGET GENE. KEO4 BINDING SITE is a target binding site found in the 3' untranslated region of mRNA encoded by KEO4, corresponding to a target binding site such as BINDING SITE I, BINDING SITE II or BINDING SITE III of FIG. 8. Table 4 illustrates the complementarity of the nucleotide sequences of KEO4 BINDING SITE, designated SEQ ID:12625, to the nucleotide sequence of GAM190 RNA, herein designated GAM RNA, also designated SEQ ID:289.

Another function of GAM190 is therefore inhibition of KEO4 (Accession NP_006450.1). Accordingly, utilities of GAM190 include diagnosis, prevention and treatment of diseases and clinical conditions associated with KEO4.

KIAA0179 (Accession XP_035973.4) is another GAM190 target gene, herein designated TARGET GENE. KIAA0179 BINDING SITE1 and KIAA0179 BINDING SITE2 are target binding sites found in untranslated regions of mRNA encoded by KIAA0179, corresponding to target binding sites such as BINDING SITE I, BINDING SITE II or BINDING SITE III of FIG. 8. Table 4 illustrates the complementarity of the nucleotide sequences of KIAA0179 BINDING SITE1 and KIAA0179 BINDING SITE2, designated SEQ ID:16659 and SEQ ID:5898 respectively, to the nucleotide sequence of GAM190 RNA, herein designated GAM RNA, also designated SEQ ID:289.

Another function of GAM190 is therefore inhibition of KIAA0179 (Accession XP_035973.4). Accordingly, utilities of GAM190 include diagnosis, prevention and treatment of diseases and clinical conditions associated with KIAA0179.

KIAA1001 (Accession NP_055775.1) is another GAM190 target gene, herein designated TARGET GENE. KIAA1001 BINDING SITE is a target binding site found in the 3' untranslated region of mRNA encoded by KIAA1001, corresponding to a target binding site such as BINDING SITE I, BINDING SITE II or BINDING SITE III of FIG. 8. Table 4 illustrates the complementarity of the nucleotide sequences of KIAA1001 BINDING SITE, designated SEQ ID:2770, to the nucleotide sequence of GAM190 RNA, herein designated GAM RNA, also designated SEQ ID:289.

Another function of GAM190 is therefore inhibition of KIAA1001 (Accession NP_055775.1). Accordingly, utilities of GAM190 include diagnosis, prevention and treatment of diseases and clinical conditions associated with KIAA1001.

KIAA1007 (Accession NP_057368.1) is another GAM190 target gene, herein designated TARGET GENE. KIAA1007 BINDING SITE is a target binding site found in the 3' untranslated region of mRNA encoded by KIAA1007, corresponding to a target binding site such as BINDING SITE I, BINDING SITE II or BINDING SITE III of FIG. 8. Table 4 illustrates the complementarity of the nucleotide sequences of KIAA1007 BINDING SITE, designated SEQ ID:17180, to the nucleotide sequence of GAM190 RNA, herein designated GAM RNA, also designated SEQ ID:289.

Another function of GAM190 is therefore inhibition of KIAA1007 (Accession NP_057368.1). Accordingly, utilities of GAM190 include diagnosis, prevention and treatment of diseases and clinical conditions associated with KIAA1007.

KIAA1025 (Accession XP_034056.6) is another GAM190 target gene, herein designated TARGET GENE. KIAA1025 BINDING SITE is a target binding site found in the 3' untranslated region of mRNA encoded by KIAA1025, corresponding to a target binding site such as BINDING SITE I, BINDING SITE II or BINDING SITE III of FIG. 8. Table 4 illustrates the complementarity of the nucleotide sequences of KIAA1025 BINDING SITE, designated SEQ ID:11253, to the nucleotide sequence of GAM190 RNA, herein designated GAM RNA, also designated SEQ ID:289.

Another function of GAM190 is therefore inhibition of KIAA1025 (Accession XP_034056.6). Accordingly, utilities of GAM190 include diagnosis, prevention and treatment of diseases and clinical conditions associated with KIAA1025.

KIAA1200 (Accession XP_031054.4) is another GAM190 target gene, herein designated TARGET GENE. KIAA1200 BINDING SITE is a target binding site found in the 3' untranslated region of mRNA encoded by KIAA1200, corresponding to a target binding site such as BINDING SITE I, BINDING SITE II or BINDING SITE III of FIG. 8. Table 4 illustrates the complementarity of the nucleotide sequences of KIAA1200 BINDING SITE, designated SEQ ID:8002, to the nucleotide sequence of GAM190 RNA, herein designated GAM RNA, also designated SEQ ID:289.

Another function of GAM190 is therefore inhibition of KIAA1200 (Accession XP_031054.4). Accordingly, utilities of GAM190 include diagnosis, prevention and treatment of diseases and clinical conditions associated with KIAA1200.

KIAA1432 (Accession XP_039698.3) is another GAM190 target gene, herein designated TARGET GENE. KIAA1432 BINDING SITE is a target binding site found in the 5' untranslated region of mRNA encoded by KIAA1432, corresponding to a target binding site such as BINDING SITE I, BINDING SITE II or BINDING SITE III of FIG. 8. Table 4 illustrates the complementarity of the nucleotide sequences of KIAA1432 BINDING SITE, designated SEQ ID:20070, to the nucleotide sequence of GAM190 RNA, herein designated GAM RNA, also designated SEQ ID:289.

Another function of GAM190 is therefore inhibition of KIAA1432 (Accession XP_039698.3). Accordingly, utilities of GAM190 include diagnosis, prevention and treatment of diseases and clinical conditions associated with KIAA1432.

KIAA1613 (Accession XP_035946.3) is another GAM190 target gene, herein designated TARGET GENE. KIAA1613 BINDING SITE is a target binding site found in the 3' untranslated region of mRNA encoded by KIAA1613, corresponding to a target binding site such as BINDING SITE I, BINDING SITE II or BINDING SITE III of FIG. 8. Table 4 illustrates the complementarity of the nucleotide sequences of KIAA1613 BINDING SITE, designated SEQ ID:8531, to the nucleotide sequence of GAM190 RNA, herein designated GAM RNA, also designated SEQ ID:289.

Another function of GAM190 is therefore inhibition of KIAA1613 (Accession XP_035946.3). Accordingly, utilities of GAM190 include diagnosis, prevention and treatment of diseases and clinical conditions associated with KIAA1613.

KIAA1813 (Accession XP_046743.2) is another GAM190 target gene, herein designated TARGET GENE. KIAA1813 BINDING SITE is a target binding site found in the 5' untranslated region of mRNA encoded by KIAA1813, corresponding to a target binding site such as BINDING SITE I, BINDING SITE II or BINDING SITE III of FIG. 8. Table 4 illustrates the complementarity of the nucleotide sequences of KIAA1813 BINDING SITE, designated SEQ ID:13394, to the nucleotide sequence of GAM190 RNA, herein designated GAM RNA, also designated SEQ ID:289.

Another function of GAM190 is therefore inhibition of KIAA1813 (Accession XP_046743.2). Accordingly, utilities of GAM190 include diagnosis, prevention and treatment of diseases and clinical conditions associated with KIAA1813.

KIAA1894 (Accession XP_058025.2) is another GAM190 target gene, herein designated TARGET GENE. KIAA1894 BINDING SITE is a target binding site found in the 3' untranslated region of mRNA encoded by KIAA1894, corresponding to a target binding site such as BINDING SITE I, BINDING SITE II or BINDING SITE III of FIG. 8. Table 4 illustrates the complementarity of the nucleotide sequences of KIAA1894 BINDING SITE, designated SEQ ID:7357, to the nucleotide sequence of GAM190 RNA, herein designated GAM RNA, also designated SEQ ID:289.

Another function of GAM190 is therefore inhibition of KIAA1894 (Accession XP_058025.2). Accordingly, utilities of GAM190 include diagnosis, prevention and treatment of diseases and clinical conditions associated with KIAA1894.

KIAA1999 (Accession XP_114447.2) is another GAM190 target gene, herein designated TARGET GENE. KIAA1999 BINDING SITE is a target binding site found in the 3' untranslated region of mRNA encoded by KIAA1999, corresponding to a target binding site such as BINDING SITE I, BINDING SITE II or BINDING SITE III of FIG. 8. Table 4 illustrates the complementarity of the nucleotide sequences of KIAA1999 BINDING SITE, designated SEQ ID:4798, to the nucleotide sequence of GAM190 RNA, herein designated GAM RNA, also designated SEQ ID:289.

Another function of GAM190 is therefore inhibition of KIAA1999 (Accession XP_114447.2). Accordingly, utilities of GAM190 include diagnosis, prevention and treatment of diseases and clinical conditions associated with KIAA1999.

KIAA2028 (Accession XP_059415.2) is another GAM190 target gene, herein designated TARGET GENE. KIAA2028 BINDING SITE is a target binding site found in the 3' untranslated region of mRNA encoded by KIAA2028, corresponding to a target binding site such as BINDING SITE I, BINDING SITE II or BINDING SITE III of FIG. 8. Table 4 illustrates the complementarity of the nucleotide sequences of KIAA2028 BINDING SITE, designated SEQ ID:7392, to the nucleotide sequence of GAM190 RNA, herein designated GAM RNA, also designated SEQ ID:289.

Another function of GAM190 is therefore inhibition of KIAA2028 (Accession XP_059415.2). Accordingly, utilities of GAM190 include diagnosis, prevention and treatment of diseases and clinical conditions associated with KIAA2028.

LCHN (Accession XP_098615.2) is another GAM190 target gene, herein designated TARGET GENE. LCHN BINDING SITE is a target binding site found in the 3' untranslated region of mRNA encoded by LCHN, corresponding to a target binding site such as BINDING SITE I, BINDING SITE II or BINDING SITE III of FIG. 8. Table 4 illustrates the complementarity of the nucleotide sequences of LCHN BINDING SITE, designated SEQ ID:13962, to the nucleotide sequence of GAM190 RNA, herein designated GAM RNA, also designated SEQ ID:289.

Another function of GAM190 is therefore inhibition of LCHN (Accession XP_098615.2). Accordingly, utilities of GAM190 include diagnosis, prevention and treatment of diseases and clinical conditions associated with LCHN.

Lim homeobox protein 3 (LHX3, Accession NP_055379.1) is another GAM190 target gene, herein designated TARGET GENE. LHX3 BINDING SITE is a target binding site found in the 3' untranslated region of multiple transcripts of mRNA encoded by LHX3, corresponding to a target binding site such as BINDING SITE I, BINDING SITE II or BINDING SITE III of FIG. 8. Table 4 illustrates the complementarity of the nucleotide sequences of LHX3 BINDING SITE, designated SEQ ID:17614, to the nucleotide sequence of GAM190 RNA, herein designated GAM RNA, also designated SEQ ID:289.

Another function of GAM190 is therefore inhibition of Lim homeobox protein 3 (LHX3, Accession NP_055379.1). Accordingly, utilities of GAM190 include diagnosis, prevention and treatment of diseases and clinical conditions associated with LHX3.

Lim homeobox protein 3 (LHX3, Accession NP_835258.1) is another GAM190 target gene, herein designated TARGET GENE. LHX3 BINDING SITE is a target binding site found in the 3' untranslated region of multiple transcripts of mRNA encoded by LHX3, corresponding to a target binding site such as BINDING SITE I, BINDING SITE II or BINDING SITE III of FIG. 8. Table 4 illustrates the complementarity of the nucleotide sequences of LHX3 BINDING SITE, designated SEQ ID:17614, to the nucleotide sequence of GAM190 RNA, herein designated GAM RNA, also designated SEQ ID:289.

Another function of GAM190 is therefore inhibition of Lim homeobox protein 3 (LHX3, Accession NP_835258.1). Accordingly, utilities of GAM190 include diagnosis, prevention and treatment of diseases and clinical conditions associated with LHX3.

LOC112868 (Accession XP_053402.1) is another GAM190 target gene, herein designated TARGET GENE. LOC112868 BINDING SITE is a target binding site found in the 3' untranslated region of mRNA encoded by LOC112868, corresponding to a target binding site such as BINDING SITE I, BINDING SITE II or BINDING SITE III of FIG. 8. Table 4 illustrates the complementarity of the nucleotide sequences of LOC112868 BINDING SITE, designated SEQ ID:19114, to the nucleotide sequence of GAM190 RNA, herein designated GAM RNA, also designated SEQ ID:289.

Another function of GAM190 is therefore inhibition of LOC112868 (Accession XP_053402.1). Accordingly, utilities of GAM190 include diagnosis, prevention and treatment of diseases and clinical conditions associated with LOC112868.

LOC122282 (Accession XP_063046.4) is another GAM190 target gene, herein designated TARGET GENE. LOC122282 BINDING SITE is a target binding site found in the 3' untranslated region of mRNA encoded by LOC122282, corresponding to a target binding site such as BINDING SITE I, BINDING SITE II or BINDING SITE III of FIG. 8. Table 4 illustrates the complementarity of the nucleotide sequences of LOC122282 BINDING SITE, designated SEQ ID:3932, to the nucleotide sequence of GAM190 RNA, herein designated GAM RNA, also designated SEQ ID:289.

Another function of GAM190 is therefore inhibition of LOC122282 (Accession XP_063046.4). Accordingly, utilities of GAM190 include diagnosis, prevention and treatment of diseases and clinical conditions associated with LOC122282.

LOC130074 (Accession XP_072228.2) is another GAM190 target gene, herein designated TARGET GENE. LOC130074 BINDING SITE is a target binding site found in the 3' untranslated region of mRNA encoded by LOC130074, corresponding to a target binding site such as BINDING SITE I, BINDING SITE II or BINDING SITE III of FIG. 8. Table 4 illustrates the complementarity of the nucleotide sequences of LOC130074 BINDING SITE, designated SEQ ID:12021, to the nucleotide sequence of GAM190 RNA, herein designated GAM RNA, also designated SEQ ID:289.

Another function of GAM190 is therefore inhibition of LOC130074 (Accession XP_072228.2). Accordingly, utilities of GAM190 include diagnosis, prevention and treatment of diseases and clinical conditions associated with LOC130074.

LOC130951 (Accession NP_620159.2) is another GAM190 target gene, herein designated TARGET GENE. LOC130951 BINDING SITE is a target binding site found in the 3' untranslated region of mRNA encoded by LOC130951, corresponding to a target binding site such as BINDING SITE I, BINDING SITE II or BINDING SITE III of FIG. 8. Table 4 illustrates the complementarity of the nucleotide sequences of LOC130951 BINDING SITE, designated SEQ ID:12589, to the nucleotide sequence of GAM190 RNA, herein designated GAM RNA, also designated SEQ ID:289.

Another function of GAM190 is therefore inhibition of LOC130951 (Accession NP_620159.2). Accordingly, utilities of GAM190 include diagnosis, prevention and treatment of diseases and clinical conditions associated with LOC130951.

LOC145820 (Accession XP_085246.1) is another GAM190 target gene, herein designated TARGET GENE. LOC145820 BINDING SITE is a target binding site found in the 3' untranslated region of mRNA encoded by LOC145820, corresponding to a target binding site such as BINDING SITE I, BINDING SITE II or BINDING SITE III of FIG. 8. Table 4 illustrates the complementarity of the nucleotide sequences of LOC145820 BINDING SITE, designated SEQ ID:17550, to the nucleotide sequence of GAM190 RNA, herein designated GAM RNA, also designated SEQ ID:289.

Another function of GAM190 is therefore inhibition of LOC145820 (Accession XP_085246.1). Accordingly, utilities of GAM190 include diagnosis, prevention and treatment of diseases and clinical conditions associated with LOC145820.

LOC146895 (Accession XP_097120.1) is another GAM190 target gene, herein designated TARGET GENE. LOC146895 BINDING SITE is a target binding site found in the 5' untranslated region of mRNA encoded by LOC146895, corresponding to a target binding site such as BINDING SITE I, BINDING SITE II or BINDING SITE III of FIG. 8. Table 4 illustrates the complementarity of the nucleotide sequences of LOC146895 BINDING SITE, designated SEQ ID:17975, to the nucleotide sequence of GAM190 RNA, herein designated GAM RNA, also designated SEQ ID:289.

Another function of GAM190 is therefore inhibition of LOC146895 (Accession XP_097120.1). Accordingly, utilities of GAM190 include diagnosis, prevention and treatment of diseases and clinical conditions associated with LOC146895.

LOC150138 (Accession XP_086789.1) is another GAM190 target gene, herein designated TARGET GENE. LOC150138 BINDING SITE is a target binding site found in the 5' untranslated region of mRNA encoded by LOC150138, corresponding to a target binding site such as BINDING SITE I, BINDING SITE II or BINDING SITE III of FIG. 8. Table 4 illustrates the complementarity of the nucleotide sequences of LOC150138 BINDING SITE, designated SEQ ID:16139, to the nucleotide sequence of GAM190 RNA, herein designated GAM RNA, also designated SEQ ID:289.

Another function of GAM190 is therefore inhibition of LOC150138 (Accession XP_086789.1). Accordingly, utilities of GAM190 include diagnosis, prevention and treatment of diseases and clinical conditions associated with LOC150138.

LOC150933 (Accession XP_097971.1) is another GAM190 target gene, herein designated TARGET GENE. LOC150933 BINDING SITE is a target binding site found in the 5' untranslated region of mRNA encoded by LOC150933, corresponding to a target binding site such as BINDING SITE I, BINDING SITE II or BINDING SITE III of FIG. 8. Table 4 illustrates the complementarity of the nucleotide sequences of LOC150933 BINDING SITE, designated SEQ ID:802, to the nucleotide sequence of GAM190 RNA, herein designated GAM RNA, also designated SEQ ID:289.

Another function of GAM190 is therefore inhibition of LOC150933 (Accession XP_097971.1). Accordingly, utilities of GAM190 include diagnosis, prevention and treatment of diseases and clinical conditions associated with LOC150933.

LOC151979 (Accession XP_087354.5) is another GAM190 target gene, herein designated TARGET GENE. LOC151979 BINDING SITE is a target binding site found in the 5' untranslated region of mRNA encoded by LOC151979, corresponding to a target binding site such as BINDING SITE I, BINDING SITE II or BINDING SITE III of FIG. 8. Table 4 illustrates the complementarity of the nucleotide sequences of LOC151979 BINDING SITE, designated SEQ ID:2273, to the nucleotide sequence of GAM190 RNA, herein designated GAM RNA, also designated SEQ ID:289.

Another function of GAM190 is therefore inhibition of LOC151979 (Accession XP_087354.5). Accordingly, utilities of GAM190 include diagnosis, prevention and treatment of diseases and clinical conditions associated with LOC151979.

LOC157556 (Accession XP_098783.1) is another GAM190 target gene, herein designated TARGET GENE. LOC157556 BINDING SITE is a target binding site found in the 3' untranslated region of mRNA encoded by LOC157556, corresponding to a target binding site such as BINDING SITE I, BINDING SITE II or BINDING SITE III of FIG. 8. Table 4 illustrates the complementarity of the nucleotide sequences of LOC157556 BINDING SITE, designated SEQ ID:13070, to the nucleotide sequence of GAM190 RNA, herein designated GAM RNA, also designated SEQ ID:289.

Another function of GAM190 is therefore inhibition of LOC157556 (Accession XP_098783.1). Accordingly, utilities of GAM190 include diagnosis, prevention and treatment of diseases and clinical conditions associated with LOC157556.

LOC168474 (Accession XP_095122.3) is another GAM190 target gene, herein designated TARGET GENE. LOC168474 BINDING SITE is a target binding site found in the 3' untranslated region of mRNA encoded by LOC168474, corresponding to a target binding site such as BINDING SITE I, BINDING SITE II or BINDING SITE III of FIG. 8. Table 4 illustrates the complementarity of the nucleotide sequences of LOC168474 BINDING SITE, designated SEQ ID:1886, to the nucleotide sequence of GAM190 RNA, herein designated GAM RNA, also designated SEQ ID:289.

Another function of GAM190 is therefore inhibition of LOC168474 (Accession XP_095122.3). Accordingly, utilities of GAM190 include diagnosis, prevention and treatment of diseases and clinical conditions associated with LOC168474.

LOC196264 (Accession XP_113683.1) is another GAM190 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:2140, to the nucleotide sequence of GAM190 RNA, herein designated GAM RNA, also designated SEQ ID:289.

Another function of GAM190 is therefore inhibition of LOC196264 (Accession XP_113683.1). Accordingly, utilities of GAM190 include diagnosis, prevention and treatment of diseases and clinical conditions associated with LOC196264.

LOC201229 (Accession XP_113925.1) is another GAM190 target gene, herein designated TARGET GENE. LOC201229 BINDING SITE is a target binding site found in the 3' untranslated region of mRNA encoded by LOC201229, corresponding to a target binding site such as BINDING SITE I, BINDING SITE II or BINDING SITE III of FIG. 8. Table 4 illustrates the complementarity of the nucleotide sequences of LOC201229 BINDING SITE, designated SEQ ID:8606, to the nucleotide sequence of GAM190 RNA, herein designated GAM RNA, also designated SEQ ID:289.

Another function of GAM190 is therefore inhibition of LOC201229 (Accession XP_113925.1). Accordingly, utilities of GAM190 include diagnosis, prevention and treatment of diseases and clinical conditions associated with LOC201229.

LOC203107 (Accession XP_300975.1) is another GAM190 target gene, herein designated TARGET GENE. LOC203107 BINDING SITE is a target binding site found in the 3' untranslated region of mRNA encoded by LOC203107, corresponding to a target binding site such as BINDING SITE I, BINDING SITE II or BINDING SITE III of FIG. 8. Table 4 illustrates the complementarity of the nucleotide sequences of LOC203107 BINDING SITE, designated SEQ ID:3628, to the nucleotide sequence of GAM190 RNA, herein designated GAM RNA, also designated SEQ ID:289.

Another function of GAM190 is therefore inhibition of LOC203107 (Accession XP_300975.1). Accordingly, utilities of GAM190 include diagnosis, prevention and treatment of diseases and clinical conditions associated with LOC203107.

LOC222160 (Accession XP_168431.1) is another GAM190 target gene, herein designated TARGET GENE. LOC222160 BINDING SITE is a target binding site found in the 5' untranslated region of mRNA encoded by LOC222160, corresponding to a target binding site such as BINDING SITE I, BINDING SITE II or BINDING SITE III of FIG. 8. Table 4 illustrates the complementarity of the nucleotide sequences of LOC222160 BINDING SITE, designated SEQ ID:4845, to the nucleotide sequence of GAM190 RNA, herein designated GAM RNA, also designated SEQ ID:289.

Another function of GAM190 is therefore inhibition of LOC222160 (Accession XP_168431.1). Accordingly, utilities of GAM190 include diagnosis, prevention and treatment of diseases and clinical conditions associated with LOC222160.

LOC253782 (Accession XP_171023.1) is another GAM190 target gene, herein designated TARGET GENE. LOC253782 BINDING SITE is a target binding site found in the 5' untranslated region of mRNA encoded by LOC253782, corresponding to a target binding site such as BINDING SITE I, BINDING SITE II or BINDING SITE III of FIG. 8. Table 4 illustrates the complementarity of the nucleotide sequences of LOC253782 BINDING SITE, designated SEQ ID:10609, to the nucleotide sequence of GAM190 RNA, herein designated GAM RNA, also designated SEQ ID:289.

Another function of GAM190 is therefore inhibition of LOC253782 (Accession XP_171023.1). Accordingly, utilities of GAM190 include diagnosis, prevention and treatment of diseases and clinical conditions associated with LOC253782.

LOC255167 (Accession XP_173156.1) is another GAM190 target gene, herein designated TARGET GENE. LOC255167 BINDING SITE is a target binding site found in the 3' untranslated region of mRNA encoded by LOC255167, corresponding to a target binding site such as BINDING SITE I, BINDING SITE II or BINDING SITE III of FIG. 8. Table 4 illustrates the complementarity of the nucleotide sequences of LOC255167 BINDING SITE, designated SEQ ID:8769, to the nucleotide sequence of GAM190 RNA, herein designated GAM RNA, also designated SEQ ID:289.

Another function of GAM190 is therefore inhibition of LOC255167 (Accession XP_173156.1). Accordingly, utilities of GAM190 include diagnosis, prevention and treatment of diseases and clinical conditions associated with LOC255167.

LOC256374 (Accession XP_170597.1) is another GAM190 target gene, herein designated TARGET GENE. LOC256374 BINDING SITE is a target binding site found in the 3' untranslated region of mRNA encoded by LOC256374, corresponding to a target binding site such as BINDING SITE I, BINDING SITE II or BINDING SITE III of FIG. 8. Table 4 illustrates the complementarity of the nucleotide sequences of LOC256374 BINDING SITE, designated SEQ ID:4774, to the nucleotide sequence of GAM190 RNA, herein designated GAM RNA, also designated SEQ ID:289.

Another function of GAM190 is therefore inhibition of LOC256374 (Accession XP_170597.1). Accordingly, utilities of GAM190 include diagnosis, prevention and treatment of diseases and clinical conditions associated with LOC256374.

LOC283107 (Accession XP_210889.1) is another GAM190 target gene, herein designated TARGET GENE. LOC283107 BINDING SITE is a target binding site found in the 5' untranslated region of mRNA encoded by LOC283107, corresponding to a target binding site such as BINDING SITE I, BINDING SITE II or BINDING SITE III of FIG. 8. Table 4 illustrates the complementarity of the nucleotide sequences of LOC283107 BINDING SITE, designated SEQ ID:19787, to the nucleotide sequence of GAM190 RNA, herein designated GAM RNA, also designated SEQ ID:289.

Another function of GAM190 is therefore inhibition of LOC283107 (Accession XP_210889.1). Accordingly, utilities of GAM190 include diagnosis, prevention and treatment of diseases and clinical conditions associated with LOC283107.

LOC283143 (Accession XP_210920.1) is another GAM190 target gene, herein designated TARGET GENE. LOC283143 BINDING SITE is a target binding site found in the 3' untranslated region of mRNA encoded by LOC283143, corresponding to a target binding site such as BINDING SITE I, BINDING SITE II or BINDING SITE III of FIG. 8. Table 4 illustrates the complementarity of the nucleotide sequences of LOC283143 BINDING SITE, designated SEQ ID:8033, to the nucleotide sequence of GAM190 RNA, herein designated GAM RNA, also designated SEQ ID:289.

Another function of GAM190 is therefore inhibition of LOC283143 (Accession XP_210920.1). Accordingly, utilities of GAM190 include diagnosis, prevention and treatment of diseases and clinical conditions associated with LOC283143.

LOC283244 (Accession XP_208583.2) is another GAM190 target gene, herein designated TARGET GENE.

LOC283244 BINDING SITE is a target binding site found in the 3' untranslated region of mRNA encoded by LOC283244, corresponding to a target binding site such as BINDING SITE I, BINDING SITE II or BINDING SITE III of FIG. 8. Table 4 illustrates the complementarity of the nucleotide sequences of LOC283244 BINDING SITE, designated SEQ ID:11642, to the nucleotide sequence of GAM190 RNA, herein designated GAM RNA, also designated SEQ ID:289.

Another function of GAM190 is therefore inhibition of LOC283244 (Accession XP_208583.2). Accordingly, utilities of GAM190 include diagnosis, prevention and treatment of diseases and clinical conditions associated with LOC283244.

LOC283331 (Accession XP_210977.1) is another GAM190 target gene, herein designated TARGET GENE. LOC283331 BINDING SITE is a target binding site found in the 5' untranslated region of mRNA encoded by LOC283331, corresponding to a target binding site such as BINDING SITE I, BINDING SITE II or BINDING SITE III of FIG. 8. Table 4 illustrates the complementarity of the nucleotide sequences of LOC283331 BINDING SITE, designated SEQ ID:19234, to the nucleotide sequence of GAM190 RNA, herein designated GAM RNA, also designated SEQ ID:289.

Another function of GAM190 is therefore inhibition of LOC283331 (Accession XP_210977.1). Accordingly, utilities of GAM190 include diagnosis, prevention and treatment of diseases and clinical conditions associated with LOC283331.

LOC283352 (Accession XP_210989.1) is another GAM190 target gene, herein designated TARGET GENE. LOC283352 BINDING SITE is a target binding site found in the 5' untranslated region of mRNA encoded by LOC283352, corresponding to a target binding site such as BINDING SITE I, BINDING SITE II or BINDING SITE III of FIG. 8. Table 4 illustrates the complementarity of the nucleotide sequences of LOC283352 BINDING SITE, designated SEQ ID:11381, to the nucleotide sequence of GAM190 RNA, herein designated GAM RNA, also designated SEQ ID:289.

Another function of GAM190 is therefore inhibition of LOC283352 (Accession XP_210989.1). Accordingly, utilities of GAM190 include diagnosis, prevention and treatment of diseases and clinical conditions associated with LOC283352.

LOC283582 (Accession XP_211119.1) is another GAM190 target gene, herein designated TARGET GENE. LOC283582 BINDING SITE is a target binding site found in the 3' untranslated region of mRNA encoded by LOC283582, corresponding to a target binding site such as BINDING SITE I, BINDING SITE II or BINDING SITE III of FIG. 8. Table 4 illustrates the complementarity of the nucleotide sequences of LOC283582 BINDING SITE, designated SEQ ID:19719, to the nucleotide sequence of GAM190 RNA, herein designated GAM RNA, also designated SEQ ID:289.

Another function of GAM190 is therefore inhibition of LOC283582 (Accession XP_211119.1). Accordingly, utilities of GAM190 include diagnosis, prevention and treatment of diseases and clinical conditions associated with LOC283582.

LOC283624 (Accession XP_211126.1) is another GAM190 target gene, herein designated TARGET GENE. LOC283624 BINDING SITE is a target binding site found in the 5' untranslated region of mRNA encoded by LOC283624, corresponding to a target binding site such as BINDING SITE I, BINDING SITE II or BINDING SITE III of FIG. 8. Table 4 illustrates the complementarity of the nucleotide sequences of LOC283624 BINDING SITE, designated SEQ ID:3276, to the nucleotide sequence of GAM190 RNA, herein designated GAM RNA, also designated SEQ ID:289.

Another function of GAM190 is therefore inhibition of LOC283624 (Accession XP_211126.1). Accordingly, utilities of GAM190 include diagnosis, prevention and treatment of diseases and clinical conditions associated with LOC283624.

LOC283911 (Accession XP_211259.2) is another GAM190 target gene, herein designated TARGET GENE. LOC283911 BINDING SITE is a target binding site found in the 5' untranslated region of mRNA encoded by LOC283911, corresponding to a target binding site such as BINDING SITE I, BINDING SITE II or BINDING SITE III of FIG. 8. Table 4 illustrates the complementarity of the nucleotide sequences of LOC283911 BINDING SITE, designated SEQ ID:5990, to the nucleotide sequence of GAM190 RNA, herein designated GAM RNA, also designated SEQ ID:289.

Another function of GAM190 is therefore inhibition of LOC283911 (Accession XP_211259.2). Accordingly, utilities of GAM190 include diagnosis, prevention and treatment of diseases and clinical conditions associated with LOC283911.

LOC284019 (Accession XP_211302.1) is another GAM190 target gene, herein designated TARGET GENE. LOC284019 BINDING SITE is a target binding site found in the 3' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:17779, to the nucleotide sequence of GAM190 RNA, herein designated GAM RNA, also designated SEQ ID:289.

Another function of GAM190 is therefore inhibition of LOC284019 (Accession XP_211302.1). Accordingly, utilities of GAM190 include diagnosis, prevention and treatment of diseases and clinical conditions associated with LOC284019.

LOC284145 (Accession XP_211353.1) is another GAM190 target gene, herein designated TARGET GENE. LOC284145 BINDING SITE is a target binding site found in the 3' untranslated region of mRNA encoded by LOC284145, corresponding to a target binding site such as BINDING SITE I, BINDING SITE II or BINDING SITE III of FIG. 8. Table 4 illustrates the complementarity of the nucleotide sequences of LOC284145 BINDING SITE, designated SEQ ID:4876, to the nucleotide sequence of GAM190 RNA, herein designated GAM RNA, also designated SEQ ID:289.

Another function of GAM190 is therefore inhibition of LOC284145 (Accession XP_211353.1). Accordingly, utilities of GAM190 include diagnosis, prevention and treatment of diseases and clinical conditions associated with LOC284145.

LOC284260 (Accession XP_211408.1) is another GAM190 target gene, herein designated TARGET GENE. LOC284260 BINDING SITE is a target binding site found in the 5' untranslated region of mRNA encoded by LOC284260, corresponding to a target binding site such as BINDING SITE I, BINDING SITE II or BINDING SITE III of FIG. 8. Table 4 illustrates the complementarity of the nucleotide sequences of LOC284260 BINDING SITE, designated SEQ ID:9975, to the nucleotide sequence of GAM190 RNA, herein designated GAM RNA, also designated SEQ ID:289.

Another function of GAM190 is therefore inhibition of LOC284260 (Accession XP_211408.1). Accordingly, utilities of GAM190 include diagnosis, prevention and treatment of diseases and clinical conditions associated with LOC284260.

LOC284665 (Accession XP_211581.1) is another GAM190 target gene, herein designated TARGET GENE. LOC284665 BINDING SITE is a target binding site found in the 5' untranslated region of mRNA encoded by LOC284665, corresponding to a target binding site such as BINDING SITE I, BINDING SITE II or BINDING SITE III of FIG. 8. Table 4 illustrates the complementarity of the nucleotide sequences of LOC284665 BINDING SITE, designated SEQ ID:9976, to the nucleotide sequence of GAM190 RNA, herein designated GAM RNA, also designated SEQ ID:289.

Another function of GAM190 is therefore inhibition of LOC284665 (Accession XP_211581.1). Accordingly, utilities of GAM190 include diagnosis, prevention and treatment of diseases and clinical conditions associated with LOC284665.

LOC284678 (Accession XP_209318.1) is another GAM190 target gene, herein designated TARGET GENE. LOC284678 BINDING SITE is a target binding site found in the 3' untranslated region of mRNA encoded by LOC284678, corresponding to a target binding site such as BINDING SITE I, BINDING SITE II or BINDING SITE III of FIG. 8. Table 4 illustrates the complementarity of the nucleotide sequences of LOC284678 BINDING SITE, designated SEQ ID:10939, to the nucleotide sequence of GAM190 RNA, herein designated GAM RNA, also designated SEQ ID:289.

Another function of GAM190 is therefore inhibition of LOC284678 (Accession XP_209318.1). Accordingly, utilities of GAM190 include diagnosis, prevention and treatment of diseases and clinical conditions associated with LOC284678.

LOC284719 (Accession XP_211601.1) is another GAM190 target gene, herein designated TARGET GENE. LOC284719 BINDING SITE is a target binding site found in the 3' untranslated region of mRNA encoded by LOC284719, corresponding to a target binding site such as BINDING SITE I, BINDING SITE II or BINDING SITE III of FIG. 8. Table 4 illustrates the complementarity of the nucleotide sequences of LOC284719 BINDING SITE, designated SEQ ID:9623, to the nucleotide sequence of GAM190 RNA, herein designated GAM RNA, also designated SEQ ID:289.

Another function of GAM190 is therefore inhibition of LOC284719 (Accession XP_211601.1). Accordingly, utilities of GAM190 include diagnosis, prevention and treatment of diseases and clinical conditions associated with LOC284719.

LOC284995 (Accession XP_211729.1) is another GAM190 target gene, herein designated TARGET GENE. LOC284995 BINDING SITE is a target binding site found in the 5' untranslated region of mRNA encoded by LOC284995, corresponding to a target binding site such as BINDING SITE I, BINDING SITE II or BINDING SITE III of FIG. 8. Table 4 illustrates the complementarity of the nucleotide sequences of LOC284995 BINDING SITE, designated SEQ ID:17855, to the nucleotide sequence of GAM190 RNA, herein designated GAM RNA, also designated SEQ ID:289.

Another function of GAM190 is therefore inhibition of LOC284995 (Accession XP_211729.1). Accordingly, utilities of GAM190 include diagnosis, prevention and treatment of diseases and clinical conditions associated with LOC284995.

LOC285009 (Accession XP_209435.1) is another GAM190 target gene, herein designated TARGET GENE. LOC285009 BINDING SITE is a target binding site found in the 5' untranslated region of mRNA encoded by LOC285009, corresponding to a target binding site such as BINDING SITE I, BINDING SITE II or BINDING SITE III of FIG. 8. Table 4 illustrates the complementarity of the nucleotide sequences of LOC285009 BINDING SITE, designated SEQ ID:13385, to the nucleotide sequence of GAM190 RNA, herein designated GAM RNA, also designated SEQ ID:289.

Another function of GAM190 is therefore inhibition of LOC285009 (Accession XP_209435.1). Accordingly, utilities of GAM190 include diagnosis, prevention and treatment of diseases and clinical conditions associated with LOC285009.

LOC285023 (Accession XP_211737.1) is another GAM190 target gene, herein designated TARGET GENE. LOC285023 BINDING SITE is a target binding site found in the 5' untranslated region of mRNA encoded by LOC285023, corresponding to a target binding site such as BINDING SITE I, BINDING SITE II or BINDING SITE III of FIG. 8. Table 4 illustrates the complementarity of the nucleotide sequences of LOC285023 BINDING SITE, designated SEQ ID:6445, to the nucleotide sequence of GAM190 RNA, herein designated GAM RNA, also designated SEQ ID:289.

Another function of GAM190 is therefore inhibition of LOC285023 (Accession XP_211737.1). Accordingly, utilities of GAM190 include diagnosis, prevention and treatment of diseases and clinical conditions associated with LOC285023.

LOC285026 (Accession XP_209440.1) is another GAM190 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:4367, to the nucleotide sequence of GAM190 RNA, herein designated GAM RNA, also designated SEQ ID:289.

Another function of GAM190 is therefore inhibition of LOC285026 (Accession XP_209440.1). Accordingly, utilities of GAM190 include diagnosis, prevention and treatment of diseases and clinical conditions associated with LOC285026.

LOC285402 (Accession XP_211884.1) is another GAM190 target gene, herein designated TARGET GENE. LOC285402 BINDING SITE is a target binding site found in the 3' untranslated region of mRNA encoded by LOC285402, corresponding to a target binding site such as BINDING SITE I, BINDING SITE II or BINDING SITE III of FIG. 8. Table 4 illustrates the complementarity of the nucleotide sequences of LOC285402 BINDING SITE, designated SEQ ID:12287, to the nucleotide sequence of GAM190 RNA, herein designated GAM RNA, also designated SEQ ID:289.

Another function of GAM190 is therefore inhibition of LOC285402 (Accession XP_211884.1). Accordingly, utilities of GAM190 include diagnosis, prevention and treatment of diseases and clinical conditions associated with LOC285402.

LOC285531 (Accession XP_211929.1) is another GAM190 target gene, herein designated TARGET GENE. LOC285531 BINDING SITE is a target binding site found in the 5' untranslated region of mRNA encoded by LOC285531, corresponding to a target binding site such as BINDING SITE I, BINDING SITE II or BINDING SITE III of FIG. 8. Table 4 illustrates the complementarity of the nucleotide sequences of LOC285531 BINDING SITE, designated SEQ ID:7733, to the nucleotide sequence of GAM190 RNA, herein designated GAM RNA, also designated SEQ ID:289.

Another function of GAM190 is therefore inhibition of LOC285531 (Accession XP_211929.1). Accordingly, utilities of GAM190 include diagnosis, prevention and treatment of diseases and clinical conditions associated with LOC285531.

LOC285703 (Accession XP_209728.1) is another GAM190 target gene, herein designated TARGET GENE. LOC285703 BINDING SITE is a target binding site found in the 5' untranslated region of mRNA encoded by LOC285703, corresponding to a target binding site such as BINDING SITE I, BINDING SITE II or BINDING SITE III of FIG. 8. Table 4 illustrates the complementarity of the nucleotide sequences of LOC285703 BINDING SITE, designated SEQ ID:11785, to the nucleotide sequence of GAM190 RNA, herein designated GAM RNA, also designated SEQ ID:289.

Another function of GAM190 is therefore inhibition of LOC285703 (Accession XP_209728.1). Accordingly, utilities of GAM190 include diagnosis, prevention and treatment of diseases and clinical conditions associated with LOC285703.

LOC285733 (Accession XP_212006.1) is another GAM190 target gene, herein designated TARGET GENE. LOC285733 BINDING SITE is a target binding site found in the 3' untranslated region of mRNA encoded by LOC285733, corresponding to a target binding site such as BINDING SITE I, BINDING SITE II or BINDING SITE III of FIG. 8. Table 4 illustrates the complementarity of the nucleotide sequences of LOC285733 BINDING SITE, designated SEQ ID:12713, to the nucleotide sequence of GAM190 RNA, herein designated GAM RNA, also designated SEQ ID:289.

Another function of GAM190 is therefore inhibition of LOC285733 (Accession XP_212006.1). Accordingly, utilities of GAM190 include diagnosis, prevention and treatment of diseases and clinical conditions associated with LOC285733.

LOC285945 (Accession XP_212092.1) is another GAM190 target gene, herein designated TARGET GENE. LOC285945 BINDING SITE is a target binding site found in the 5' untranslated region of mRNA encoded by LOC285945, corresponding to a target binding site such as BINDING SITE I, BINDING SITE II or BINDING SITE III of FIG. 8. Table 4 illustrates the complementarity of the nucleotide sequences of LOC285945 BINDING SITE, designated SEQ ID:1977, to the nucleotide sequence of GAM190 RNA, herein designated GAM RNA, also designated SEQ ID:289.

Another function of GAM190 is therefore inhibition of LOC285945 (Accession XP_212092.1). Accordingly, utilities of GAM190 include diagnosis, prevention and treatment of diseases and clinical conditions associated with LOC285945.

LOC286030 (Accession XP_209868.1) is another GAM190 target gene, herein designated TARGET GENE. LOC286030 BINDING SITE is a target binding site found in the 5' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:3883, to the nucleotide sequence of GAM190 RNA, herein designated GAM RNA, also designated SEQ ID:289.

Another function of GAM190 is therefore inhibition of LOC286030 (Accession XP_209868.1). Accordingly, utilities of GAM190 include diagnosis, prevention and treatment of diseases and clinical conditions associated with LOC286030.

LOC338616 (Accession XP_294666.1) is another GAM190 target gene, herein designated TARGET GENE. LOC338616 BINDING SITE is a target binding site found in the 5' untranslated region of mRNA encoded by LOC338616, corresponding to a target binding site such as BINDING SITE I, BINDING SITE II or BINDING SITE III of FIG. 8. Table 4 illustrates the complementarity of the nucleotide sequences of LOC338616 BINDING SITE, designated SEQ ID:10009, to the nucleotide sequence of GAM190 RNA, herein designated GAM RNA, also designated SEQ ID:289.

Another function of GAM190 is therefore inhibition of LOC338616 (Accession XP_294666.1). Accordingly, utilities of GAM190 include diagnosis, prevention and treatment of diseases and clinical conditions associated with LOC338616.

LOC338866 (Accession XP_294736.1) is another GAM190 target gene, herein designated TARGET GENE. LOC338866 BINDING SITE is a target binding site found in the 5' untranslated region of mRNA encoded by LOC338866, corresponding to a target binding site such as BINDING SITE I, BINDING SITE II or BINDING SITE III of FIG. 8. Table 4 illustrates the complementarity of the nucleotide sequences of LOC338866 BINDING SITE, designated SEQ ID:10133, to the nucleotide sequence of GAM190 RNA, herein designated GAM RNA, also designated SEQ ID:289.

Another function of GAM190 is therefore inhibition of LOC338866 (Accession XP_294736.1). Accordingly, utilities of GAM190 include diagnosis, prevention and treatment of diseases and clinical conditions associated with LOC338866.

LOC339273 (Accession XP_294893.1) is another GAM190 target gene, herein designated TARGET GENE. LOC339273 BINDING SITE1 and LOC339273 BINDING SITE2 are target binding sites found in untranslated regions of mRNA encoded by LOC339273, corresponding to target binding sites such as BINDING SITE I, BINDING SITE II or BINDING SITE III of FIG. 8. Table 4 illustrates the complementarity of the nucleotide sequences of LOC339273 BINDING SITE1 and LOC339273 BINDING SITE2, designated SEQ ID:7171 and SEQ ID:1143 respectively, to the nucleotide sequence of GAM190 RNA, herein designated GAM RNA, also designated SEQ ID:289.

Another function of GAM190 is therefore inhibition of LOC339273 (Accession XP_294893.1). Accordingly, utilities of GAM190 include diagnosis, prevention and treatment of diseases and clinical conditions associated with LOC339273.

LOC339545 (Accession XP_290946.1) is another GAM190 target gene, herein designated TARGET GENE. LOC339545 BINDING SITE is a target binding site found in the 3' untranslated region of mRNA encoded by LOC339545, corresponding to a target binding site such as BINDING SITE I, BINDING SITE II or BINDING SITE III of FIG. 8. Table 4 illustrates the complementarity of the nucleotide sequences of LOC339545 BINDING SITE, designated SEQ ID:18173, to the nucleotide sequence of GAM190 RNA, herein designated GAM RNA, also designated SEQ ID:289.

Another function of GAM190 is therefore inhibition of LOC339545 (Accession XP_290946.1). Accordingly, utilities of GAM190 include diagnosis, prevention and treatment of diseases and clinical conditions associated with LOC339545.

LOC339553 (Accession XP_290949.1) is another GAM190 target gene, herein designated TARGET GENE. LOC339553 BINDING SITE is a target binding site found in the 3' untranslated region of mRNA encoded by LOC339553, corresponding to a target binding site such as BINDING SITE I, BINDING SITE II or BINDING SITE III of FIG. 8. Table 4 illustrates the complementarity of the nucleotide sequences of LOC339553 BINDING SITE, designated SEQ ID:18173, to the nucleotide sequence of GAM190 RNA, herein designated GAM RNA, also designated SEQ ID:289.

Another function of GAM190 is therefore inhibition of LOC339553 (Accession XP_290949.1). Accordingly, utilities of GAM190 include diagnosis, prevention and treatment of diseases and clinical conditions associated with LOC339553.

LOC339694 (Accession XP_295035.1) is another GAM190 target gene, herein designated TARGET GENE. LOC339694 BINDING SITE is a target binding site found in the 3' untranslated region of mRNA encoded by LOC339694, corresponding to a target binding site such as BINDING SITE I, BINDING SITE II or BINDING SITE III of FIG. 8. Table 4 illustrates the complementarity of the nucleotide sequences of LOC339694 BINDING SITE, designated SEQ ID:1952, to the nucleotide sequence of GAM190 RNA, herein designated GAM RNA, also designated SEQ ID:289.

Another function of GAM190 is therefore inhibition of LOC339694 (Accession XP_295035.1). Accordingly, utilities of GAM190 include diagnosis, prevention and treatment of diseases and clinical conditions associated with LOC339694.

LOC339859 (Accession XP_295088.1) is another GAM190 target gene, herein designated TARGET GENE. LOC339859 BINDING SITE1 and LOC339859 BINDING SITE2 are target binding sites found in untranslated regions of mRNA encoded by LOC339859, corresponding to target binding sites such as BINDING SITE I, BINDING SITE II or BINDING SITE III of FIG. 8. Table 4 illustrates the complementarity of the nucleotide sequences of LOC339859 BINDING SITE1 and LOC339859 BINDING SITE2, designated SEQ ID:12990 and SEQ ID:15811 respectively, to the nucleotide sequence of GAM190 RNA, herein designated GAM RNA, also designated SEQ ID:289.

Another function of GAM190 is therefore inhibition of LOC339859 (Accession XP_295088.1). Accordingly, utilities of GAM190 include diagnosis, prevention and treatment of diseases and clinical conditions associated with LOC339859.

LOC339874 (Accession XP_295090.1) is another GAM190 target gene, herein designated TARGET GENE. LOC339874 BINDING SITE is a target binding site found in the 3' untranslated region of mRNA encoded by LOC339874, corresponding to a target binding site such as BINDING SITE I, BINDING SITE II or BINDING SITE III of FIG. 8. Table 4 illustrates the complementarity of the nucleotide sequences of LOC339874 BINDING SITE, designated SEQ ID:1545, to the nucleotide sequence of GAM190 RNA, herein designated GAM RNA, also designated SEQ ID:289.

Another function of GAM190 is therefore inhibition of LOC339874 (Accession XP_295090.1). Accordingly, utilities of GAM190 include diagnosis, prevention and treatment of diseases and clinical conditions associated with LOC339874.

LOC339987 (Accession XP_295123.1) is another GAM190 target gene, herein designated TARGET GENE. LOC339987 BINDING SITE is a target binding site found in the 3' untranslated region of mRNA encoded by LOC339987, corresponding to a target binding site such as BINDING SITE I, BINDING SITE II or BINDING SITE III of FIG. 8. Table 4 illustrates the complementarity of the nucleotide sequences of LOC339987 BINDING SITE, designated SEQ ID:18833, to the nucleotide sequence of GAM190 RNA, herein designated GAM RNA, also designated SEQ ID:289.

Another function of GAM190 is therefore inhibition of LOC339987 (Accession XP_295123.1). Accordingly, utilities of GAM190 include diagnosis, prevention and treatment of diseases and clinical conditions associated with LOC339987.

LOC348326 (Accession XP_300696.1) is another GAM190 target gene, herein designated TARGET GENE. LOC348326 BINDING SITE is a target binding site found in the 3' untranslated region of mRNA encoded by LOC348326, corresponding to a target binding site such as BINDING SITE I, BINDING SITE II or BINDING SITE III of FIG. 8. Table 4 illustrates the complementarity of the nucleotide sequences of LOC348326 BINDING SITE, designated SEQ ID:18880, to the nucleotide sequence of GAM190 RNA, herein designated GAM RNA, also designated SEQ ID:289.

Another function of GAM190 is therefore inhibition of LOC348326 (Accession XP_300696.1). Accordingly, utilities of GAM190 include diagnosis, prevention and treatment of diseases and clinical conditions associated with LOC348326.

LOC348445 (Accession XP_300738.1) is another GAM190 target gene, herein designated TARGET GENE. LOC348445 BINDING SITE is a target binding site found in the 3' untranslated region of mRNA encoded by LOC348445, corresponding to a target binding site such as BINDING SITE I, BINDING SITE II or BINDING SITE III of FIG. 8. Table 4 illustrates the complementarity of the nucleotide sequences of LOC348445 BINDING SITE, designated SEQ ID:18880, to the nucleotide sequence of GAM190 RNA, herein designated GAM RNA, also designated SEQ ID:289.

Another function of GAM190 is therefore inhibition of LOC348445 (Accession XP_300738.1). Accordingly, utilities of GAM190 include diagnosis, prevention and treatment of diseases and clinical conditions associated with LOC348445.

LOC348492 (Accession XP_300758.1) is another GAM190 target gene, herein designated TARGET GENE. LOC348492 BINDING SITE is a target binding site found in the 3' untranslated region of mRNA encoded by LOC348492, corresponding to a target binding site such as BINDING SITE I, BINDING SITE II or BINDING SITE III of FIG. 8. Table 4 illustrates the complementarity of the nucleotide sequences of LOC348492 BINDING SITE, designated SEQ ID:6321, to the nucleotide sequence of GAM190 RNA, herein designated GAM RNA, also designated SEQ ID:289.

Another function of GAM190 is therefore inhibition of LOC348492 (Accession XP_300758.1). Accordingly, utilities of GAM190 include diagnosis, prevention and treatment of diseases and clinical conditions associated with LOC348492.

LOC348527 (Accession XP_300779.1) is another GAM190 target gene, herein designated TARGET GENE. LOC348527 BINDING SITE is a target binding site found in the 5' untranslated region of mRNA encoded by LOC348527, corresponding to a target binding site such as BINDING SITE I, BINDING SITE II or BINDING SITE III of FIG. 8. Table 4 illustrates the complementarity of the nucleotide sequences of LOC348527 BINDING SITE, designated SEQ ID:19269, to the nucleotide sequence of GAM190 RNA, herein designated GAM RNA, also designated SEQ ID:289.

Another function of GAM190 is therefore inhibition of LOC348527 (Accession XP_300779.1). Accordingly, utilities of GAM190 include diagnosis, prevention and treatment of diseases and clinical conditions associated with LOC348527.

LOC348570 (Accession XP_290329.1) is another GAM190 target gene, herein designated TARGET GENE. LOC348570 BINDING SITE is a target binding site found in the 3' untranslated region of mRNA encoded by LOC348570, corresponding to a target binding site such as BINDING SITE I, BINDING SITE II or BINDING SITE III of FIG. 8. Table 4 illustrates the complementarity of the nucleotide sequences of LOC348570 BINDING SITE, designated SEQ ID:8957, to the nucleotide sequence of GAM190 RNA, herein designated GAM RNA, also designated SEQ ID:289.

Another function of GAM190 is therefore inhibition of LOC348570 (Accession XP_290329.1). Accordingly, utilities of GAM190 include diagnosis, prevention and treatment of diseases and clinical conditions associated with LOC348570.

LOC348687 (Accession XP_302853.1) is another GAM190 target gene, herein designated TARGET GENE. LOC348687 BINDING SITE is a target binding site found in the 3' untranslated region of mRNA encoded by LOC348687, corresponding to a target binding site such as BINDING SITE I, BINDING SITE II or BINDING SITE III of FIG. 8. Table 4 illustrates the complementarity of the nucleotide sequences of LOC348687 BINDING SITE, designated SEQ ID:18314, to the nucleotide sequence of GAM190 RNA, herein designated GAM RNA, also designated SEQ ID:289.

Another function of GAM190 is therefore inhibition of LOC348687 (Accession XP_302853.1). Accordingly, utilities of GAM190 include diagnosis, prevention and treatment of diseases and clinical conditions associated with LOC348687.

LOC348808 (Accession XP_302893.1) is another GAM190 target gene, herein designated TARGET GENE. LOC348808 BINDING SITE is a target binding site found in the 3' untranslated region of mRNA encoded by LOC348808, corresponding to a target binding site such as BINDING SITE I, BINDING SITE II or BINDING SITE III of FIG. 8. Table 4 illustrates the complementarity of the nucleotide sequences of LOC348808 BINDING SITE, designated SEQ ID:9714, to the nucleotide sequence of GAM190 RNA, herein designated GAM RNA, also designated SEQ ID:289.

Another function of GAM190 is therefore inhibition of LOC348808 (Accession XP_302893.1). Accordingly, utilities of GAM190 include diagnosis, prevention and treatment of diseases and clinical conditions associated with LOC348808.

LOC348835 (Accession XP_302902.1) is another GAM190 target gene, herein designated TARGET GENE. LOC348835 BINDING SITE is a target binding site found in the 5' untranslated region of mRNA encoded by LOC348835, corresponding to a target binding site such as BINDING SITE I, BINDING SITE II or BINDING SITE III of FIG. 8. Table 4 illustrates the complementarity of the nucleotide sequences of LOC348835 BINDING SITE, designated SEQ ID:3838, to the nucleotide sequence of GAM190 RNA, herein designated GAM RNA, also designated SEQ ID:289.

Another function of GAM190 is therefore inhibition of LOC348835 (Accession XP_302902.1). Accordingly, utilities of GAM190 include diagnosis, prevention and treatment of diseases and clinical conditions associated with LOC348835.

LOC349251 (Accession XP_300251.1) is another GAM190 target gene, herein designated TARGET GENE. LOC349251 BINDING SITE is a target binding site found in the 3' untranslated region of mRNA encoded by LOC349251, corresponding to a target binding site such as BINDING SITE I, BINDING SITE II or BINDING SITE III of FIG. 8. Table 4 illustrates the complementarity of the nucleotide sequences of LOC349251 BINDING SITE, designated SEQ ID:13594, to the nucleotide sequence of GAM190 RNA, herein designated GAM RNA, also designated SEQ ID:289.

Another function of GAM190 is therefore inhibition of LOC349251 (Accession XP_300251.1). Accordingly, utilities of GAM190 include diagnosis, prevention and treatment of diseases and clinical conditions associated with LOC349251.

LOC349408 (Accession XP_303044.1) is another GAM190 target gene, herein designated TARGET GENE. LOC349408 BINDING SITE is a target binding site found in the 5' untranslated region of mRNA encoded by LOC349408, corresponding to a target binding site such as BINDING SITE I, BINDING SITE II or BINDING SITE III of FIG. 8. Table 4 illustrates the complementarity of the nucleotide sequences of LOC349408 BINDING SITE, designated SEQ ID:19652, to the nucleotide sequence of GAM190 RNA, herein designated GAM RNA, also designated SEQ ID:289.

Another function of GAM190 is therefore inhibition of LOC349408 (Accession XP_303044.1). Accordingly, utilities of GAM190 include diagnosis, prevention and treatment of diseases and clinical conditions associated with LOC349408.

LOC51619 (Accession NP_057067.1) is another GAM190 target gene, herein designated TARGET GENE. LOC51619 BINDING SITE is a target binding site found in the 3' untranslated region of mRNA encoded by LOC51619, corresponding to a target binding site such as BINDING SITE I, BINDING SITE II or BINDING SITE III of FIG. 8. Table 4 illustrates the complementarity of the nucleotide sequences of LOC51619 BINDING SITE, designated SEQ ID:4728, to the nucleotide sequence of GAM190 RNA, herein designated GAM RNA, also designated SEQ ID:289.

Another function of GAM190 is therefore inhibition of LOC51619 (Accession NP_057067.1). Accordingly, utilities of GAM190 include diagnosis, prevention and treatment of diseases and clinical conditions associated with LOC51619.

LOC57209 (Accession XP_290488.1) is another GAM190 target gene, herein designated TARGET GENE. LOC57209 BINDING SITE is a target binding site found in the 3' untranslated region of mRNA encoded by LOC57209, corresponding to a target binding site such as BINDING SITE I, BINDING SITE II or BINDING SITE III of FIG. 8. Table 4 illustrates the complementarity of the nucleotide sequences of LOC57209 BINDING SITE, designated SEQ ID:19313, to the nucleotide sequence of GAM190 RNA, herein designated GAM RNA, also designated SEQ ID:289.

Another function of GAM190 is therefore inhibition of LOC57209 (Accession XP_290488.1). Accordingly, utilities of GAM190 include diagnosis, prevention and treatment of diseases and clinical conditions associated with LOC57209.

LOC65121 (Accession NP_075389.1) is another GAM190 target gene, herein designated TARGET GENE. LOC65121 BINDING SITE is a target binding site found in the 3' untranslated region of mRNA encoded by LOC65121, corresponding to a target binding site such as BINDING SITE I, BINDING SITE II or BINDING SITE III of FIG. 8. Table 4 illustrates the complementarity of the nucleotide sequences of LOC65121 BINDING SITE, designated SEQ ID:18173, to the nucleotide sequence of GAM190 RNA, herein designated GAM RNA, also designated SEQ ID:289.

Another function of GAM190 is therefore inhibition of LOC65121 (Accession NP_075389.1). Accordingly, utilities of GAM190 include diagnosis, prevention and treatment of diseases and clinical conditions associated with LOC65121.

LOC65122 (Accession NP_075390.1) is another GAM190 target gene, herein designated TARGET GENE.

LOC65122 BINDING SITE is a target binding site found in the 3' untranslated region of mRNA encoded by LOC65122, corresponding to a target binding site such as BINDING SITE I, BINDING SITE II or BINDING SITE III of FIG. 8. Table 4 illustrates the complementarity of the nucleotide sequences of LOC65122 BINDING SITE, designated SEQ ID:18173, to the nucleotide sequence of GAM190 RNA, herein designated GAM RNA, also designated SEQ ID:289.

Another function of GAM190 is therefore inhibition of LOC65122 (Accession NP_075390.1). Accordingly, utilities of GAM190 include diagnosis, prevention and treatment of diseases and clinical conditions associated with LOC65122.

LOC90170 (Accession XP_029589.1) is another GAM190 target gene, herein designated TARGET GENE. LOC90170 BINDING SITE is a target binding site found in the 5' untranslated region of mRNA encoded by LOC90170, corresponding to a target binding site such as BINDING SITE I, BINDING SITE II or BINDING SITE III of FIG. 8. Table 4 illustrates the complementarity of the nucleotide sequences of LOC90170 BINDING SITE, designated SEQ ID:16015, to the nucleotide sequence of GAM190 RNA, herein designated GAM RNA, also designated SEQ ID:289.

Another function of GAM190 is therefore inhibition of LOC90170 (Accession XP_029589.1). Accordingly, utilities of GAM190 include diagnosis, prevention and treatment of diseases and clinical conditions associated with LOC90170.

LOC90750 (Accession XP_033868.1) is another GAM190 target gene, herein designated TARGET GENE. LOC90750 BINDING SITE is a target binding site found in the 3' untranslated region of mRNA encoded by LOC90750, corresponding to a target binding site such as BINDING SITE I, BINDING SITE II or BINDING SITE III of FIG. 8. Table 4 illustrates the complementarity of the nucleotide sequences of LOC90750 BINDING SITE, designated SEQ ID:3453, to the nucleotide sequence of GAM190 RNA, herein designated GAM RNA, also designated SEQ ID:289.

Another function of GAM190 is therefore inhibition of LOC90750 (Accession XP_033868.1). Accordingly, utilities of GAM190 include diagnosis, prevention and treatment of diseases and clinical conditions associated with LOC90750.

LOC91250 (Accession XP_037135.1) is another GAM190 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:4751, to the nucleotide sequence of GAM190 RNA, herein designated GAM RNA, also designated SEQ ID:289.

Another function of GAM190 is therefore inhibition of LOC91250 (Accession XP_037135.1). Accordingly, utilities of GAM190 include diagnosis, prevention and treatment of diseases and clinical conditions associated with LOC91250.

LOC92249 (Accession XP_043814.1) is another GAM190 target gene, herein designated TARGET GENE. LOC92249 BINDING SITE is a target binding site found in the 3' untranslated region of mRNA encoded by LOC92249, corresponding to a target binding site such as BINDING SITE I, BINDING SITE II or BINDING SITE III of FIG. 8. Table 4 illustrates the complementarity of the nucleotide sequences of LOC92249 BINDING SITE, designated SEQ ID:14921, to the nucleotide sequence of GAM190 RNA, herein designated GAM RNA, also designated SEQ ID:289.

Another function of GAM190 is therefore inhibition of LOC92249 (Accession XP_043814.1). Accordingly, utilities of GAM190 include diagnosis, prevention and treatment of diseases and clinical conditions associated with LOC92249.

Low density lipoprotein-related protein 1b (deleted in tumors) (LRP1B, Accession NP_061027.1) is another GAM190 target gene, herein designated TARGET GENE. LRP1B BINDING SITE is a target binding site found in the 3' untranslated region of mRNA encoded by LRP1B, corresponding to a target binding site such as BINDING SITE I, BINDING SITE II or BINDING SITE III of FIG. 8. Table 4 illustrates the complementarity of the nucleotide sequences of LRP1B BINDING SITE, designated SEQ ID:12085, to the nucleotide sequence of GAM190 RNA, herein designated GAM RNA, also designated SEQ ID:289.

Another function of GAM190 is therefore inhibition of Low density lipoprotein-related protein 1b (deleted in tumors) (LRP1B, Accession NP_061027.1). Accordingly, utilities of GAM190 include diagnosis, prevention and treatment of diseases and clinical conditions associated with LRP1B.

Low density lipoprotein receptor-related protein 4 (LRP4, Accession XP_035037.2) is another GAM190 target gene, herein designated TARGET GENE. LRP4 BINDING SITE is a target binding site found in the 3' untranslated region of mRNA encoded by LRP4, corresponding to a target binding site such as BINDING SITE I, BINDING SITE II or BINDING SITE III of FIG. 8. Table 4 illustrates the complementarity of the nucleotide sequences of LRP4 BINDING SITE, designated SEQ ID:16297, to the nucleotide sequence of GAM190 RNA, herein designated GAM RNA, also designated SEQ ID:289.

Another function of GAM190 is therefore inhibition of Low density lipoprotein receptor-related protein 4 (LRP4, Accession XP_035037.2). Accordingly, utilities of GAM190 include diagnosis, prevention and treatment of diseases and clinical conditions associated with LRP4.

Mitogen-activated protein kinase kinase kinase 13 (MAP3K13, Accession NP_004712.1) is another GAM190 target gene, herein designated TARGET GENE. MAP3K13 BINDING SITE is a target binding site found in the 3' untranslated region of mRNA encoded by MAP3K13, corresponding to a target binding site such as BINDING SITE I, BINDING SITE II or BINDING SITE III of FIG. 8. Table 4 illustrates the complementarity of the nucleotide sequences of MAP3K13 BINDING SITE, designated SEQ ID:9282, to the nucleotide sequence of GAM190 RNA, herein designated GAM RNA, also designated SEQ ID:289.

Another function of GAM190 is therefore inhibition of Mitogen-activated protein kinase kinase kinase 13 (MAP3K13, Accession NP_004712.1). Accordingly, utilities of GAM190 include diagnosis, prevention and treatment of diseases and clinical conditions associated with MAP3K13.

MAPKBP1 (Accession XP_031706.7) is another GAM190 target gene, herein designated TARGET GENE. MAPKBP1 BINDING SITE is a target binding site found in the 3' untranslated region of mRNA encoded by MAPKBP1, corresponding to a target binding site such as BINDING SITE I, BINDING SITE II or BINDING SITE III of FIG. 8. Table 4 illustrates the complementarity of the nucleotide sequences of MAPKBP1 BINDING SITE, designated SEQ ID:2864, to the nucleotide sequence of GAM190 RNA, herein designated GAM RNA, also designated SEQ ID:289.

Another function of GAM190 is therefore inhibition of MAPKBP1 (Accession XP_031706.7). Accordingly, utilities of GAM190 include diagnosis, prevention and treatment of diseases and clinical conditions associated with MAPKBP1.

Methyl-cpg binding domain protein 4 (MBD4, Accession NP_003916.1) is another GAM190 target gene, herein designated TARGET GENE. MBD4 BINDING SITE is a target binding site found in the 3' untranslated region of mRNA encoded by MBD4, corresponding to a target binding site such as BINDING SITE I, BINDING SITE II or BINDING SITE III of FIG. 8. Table 4 illustrates the complementarity of the nucleotide sequences of MBD4 BINDING SITE, designated SEQ ID:6949, to the nucleotide sequence of GAM190 RNA, herein designated GAM RNA, also designated SEQ ID:289.

Another function of GAM190 is therefore inhibition of Methyl-cpg binding domain protein 4 (MBD4, Accession NP_003916.1), a gene which are likely to be mediators of the effects of DNA methylation in mammalian cells. Accordingly, utilities of GAM190 include diagnosis, prevention and treatment of diseases and clinical conditions associated with MBD4.

The function of MBD4 and its association with various diseases and clinical conditions, has been established by previous studies, as described hereinabove with reference to GAM47.1. MGC13053 (Accession NP_116099.1) is another GAM190 target gene, herein designated TARGET GENE. MGC13053 BINDING SITE is a target binding site found in the 3' untranslated region of mRNA encoded by MGC13053, corresponding to a target binding site such as BINDING SITE I, BINDING SITE II or BINDING SITE III of FIG. 8. Table 4 illustrates the complementarity of the nucleotide sequences of MGC13053 BINDING SITE, designated SEQ ID:7515, to the nucleotide sequence of GAM190 RNA, herein designated GAM RNA, also designated SEQ ID:289.

Another function of GAM190 is therefore inhibition of MGC13053 (Accession NP_116099.1). Accordingly, utilities of GAM190 include diagnosis, prevention and treatment of diseases and clinical conditions associated with MGC13053.

MGC15438 (Accession NP_116263.2) is another GAM190 target gene, herein designated TARGET GENE. MGC15438 BINDING SITE is a target binding site found in the 3' untranslated region of mRNA encoded by MGC15438, corresponding to a target binding site such as BINDING SITE I, BINDING SITE II or BINDING SITE III of FIG. 8. Table 4 illustrates the complementarity of the nucleotide sequences of MGC15438 BINDING SITE, designated SEQ ID:8619, to the nucleotide sequence of GAM190 RNA, herein designated GAM RNA, also designated SEQ ID:289.

Another function of GAM190 is therefore inhibition of MGC15438 (Accession NP_116263.2). Accordingly, utilities of GAM190 include diagnosis, prevention and treatment of diseases and clinical conditions associated with MGC15438.

MGC17986 (Accession NP_705836.1) is another GAM190 target gene, herein designated TARGET GENE. MGC17986 BINDING SITE is a target binding site found in the 3' untranslated region of mRNA encoded by MGC17986, corresponding to a target binding site such as BINDING SITE I, BINDING SITE II or BINDING SITE III of FIG. 8. Table 4 illustrates the complementarity of the nucleotide sequences of MGC17986 BINDING SITE, designated SEQ ID:5825, to the nucleotide sequence of GAM190 RNA, herein designated GAM RNA, also designated SEQ ID:289.

Another function of GAM190 is therefore inhibition of MGC17986 (Accession NP_705836.1). Accordingly, utilities of GAM190 include diagnosis, prevention and treatment of diseases and clinical conditions associated with MGC17986.

MGC35304 (Accession NP_694987.1) is another GAM190 target gene, herein designated TARGET GENE. MGC35304 BINDING SITE is a target binding site found in the 3' untranslated region of mRNA encoded by MGC35304, corresponding to a target binding site such as BINDING SITE I, BINDING SITE II or BINDING SITE III of FIG. 8. Table 4 illustrates the complementarity of the nucleotide sequences of MGC35304 BINDING SITE, designated SEQ ID:17665, to the nucleotide sequence of GAM190 RNA, herein designated GAM RNA, also designated SEQ ID:289.

Another function of GAM190 is therefore inhibition of MGC35304 (Accession NP_694987.1). Accordingly, utilities of GAM190 include diagnosis, prevention and treatment of diseases and clinical conditions associated with MGC35304.

MGC45714 (Accession NP_689677.1) is another GAM190 target gene, herein designated TARGET GENE. MGC45714 BINDING SITE is a target binding site found in the 3' untranslated region of mRNA encoded by MGC45714, corresponding to a target binding site such as BINDING SITE I, BINDING SITE II or BINDING SITE III of FIG. 8. Table 4 illustrates the complementarity of the nucleotide sequences of MGC45714 BINDING SITE, designated SEQ ID:8478, to the nucleotide sequence of GAM190 RNA, herein designated GAM RNA, also designated SEQ ID:289.

Another function of GAM190 is therefore inhibition of MGC45714 (Accession NP_689677.1). Accordingly, utilities of GAM190 include diagnosis, prevention and treatment of diseases and clinical conditions associated with MGC45714.

MGC5466 (Accession NP_112184.1) is another GAM190 target gene, herein designated TARGET GENE. MGC5466 BINDING SITE is a target binding site found in the 3' untranslated region of mRNA encoded by MGC5466, corresponding to a target binding site such as BINDING SITE I, BINDING SITE II or BINDING SITE III of FIG. 8. Table 4 illustrates the complementarity of the nucleotide sequences of MGC5466 BINDING SITE, designated SEQ ID:3145, to the nucleotide sequence of GAM190 RNA, herein designated GAM RNA, also designated SEQ ID:289.

Another function of GAM190 is therefore inhibition of MGC5466 (Accession NP_112184.1). Accordingly, utilities of GAM190 include diagnosis, prevention and treatment of diseases and clinical conditions associated with MGC5466.

MLC1SA (Accession NP_002466.1) is another GAM190 target gene, herein designated TARGET GENE. MLC1SA BINDING SITE is a target binding site found in the 3' untranslated region of mRNA encoded by MLC1SA, corresponding to a target binding site such as BINDING SITE I, BINDING SITE II or BINDING SITE III of FIG. 8. Table 4 illustrates the complementarity of the nucleotide sequences of MLC1SA BINDING SITE, designated SEQ ID:4844, to the nucleotide sequence of GAM190 RNA, herein designated GAM RNA, also designated SEQ ID:289.

Another function of GAM190 is therefore inhibition of MLC1SA (Accession NP_002466.1). Accordingly, utilities of GAM190 include diagnosis, prevention and treatment of diseases and clinical conditions associated with MLC1SA.

Myelin oligodendrocyte glycoprotein (MOG, Accession NP_002424.1) is another GAM190 target gene, herein designated TARGET GENE. MOG BINDING SITE is a target binding site found in the 3' untranslated region of mRNA encoded by MOG, corresponding to a target binding site such as BINDING SITE I, BINDING SITE II or BINDING SITE III of FIG. 8. Table 4 illustrates the complementarity of the nucleotide sequences of MOG BINDING SITE, designated SEQ ID:6547, to the nucleotide sequence of GAM190 RNA, herein designated GAM RNA, also designated SEQ ID:289.

Another function of GAM190 is therefore inhibition of Myelin oligodendrocyte glycoprotein (MOG, Accession NP_002424.1). Accordingly, utilities of GAM190 include diagnosis, prevention and treatment of diseases and clinical conditions associated with MOG.

MORF4L2 (Accession NP_036418.1) is another GAM190 target gene, herein designated TARGET GENE. MORF4L2 BINDING SITE is a target binding site found in the 3' untranslated region of mRNA encoded by MORF4L2, corresponding to a target binding site such as BINDING SITE I, BINDING SITE II or BINDING SITE III of FIG. 8. Table 4 illustrates the complementarity of the nucleotide sequences of MORF4L2 BINDING SITE, designated SEQ ID:17588, to the nucleotide sequence of GAM190 RNA, herein designated GAM RNA, also designated SEQ ID:289.

Another function of GAM190 is therefore inhibition of MORF4L2 (Accession NP_036418.1). Accordingly, utilities of GAM190 include diagnosis, prevention and treatment of diseases and clinical conditions associated with MORF4L2.

M-phase phosphoprotein 9 (MPHOSPH9, Accession NP_073619.1) is another GAM190 target gene, herein designated TARGET GENE. MPHOSPH9 BINDING SITE is a target binding site found in the 5' untranslated region of mRNA encoded by MPHOSPH9, corresponding to a target binding site such as BINDING SITE I, BINDING SITE II or BINDING SITE III of FIG. 8. Table 4 illustrates the complementarity of the nucleotide sequences of MPHOSPH9 BINDING SITE, designated SEQ ID:8003, to the nucleotide sequence of GAM190 RNA, herein designated GAM RNA, also designated SEQ ID:289.

Another function of GAM190 is therefore inhibition of M-phase phosphoprotein 9 (MPHOSPH9, Accession NP_073619.1). Accordingly, utilities of GAM190 include diagnosis, prevention and treatment of diseases and clinical conditions associated with MPHOSPH9.

Male-specific lethal 3-like 1 (drosophila) (MSL3L1, Accession NP_523352.1) is another GAM190 target gene, herein designated TARGET GENE. MSL3L1 BINDING SITE is a target binding site found in the 3' untranslated region of multiple transcripts of mRNA encoded by MSL3L1, corresponding to a target binding site such as BINDING SITE I, BINDING SITE II or BINDING SITE III of FIG. 8. Table 4 illustrates the complementarity of the nucleotide sequences of MSL3L1 BINDING SITE, designated SEQ ID:17050, to the nucleotide sequence of GAM190 RNA, herein designated GAM RNA, also designated SEQ ID:289.

Another function of GAM190 is therefore inhibition of Male-specific lethal 3-like 1 (drosophila) (MSL3L1, Accession NP_523352.1). Accordingly, utilities of GAM190 include diagnosis, prevention and treatment of diseases and clinical conditions associated with MSL3L1.

Metallothionein 1f (functional) (MT1F, Accession NP_005940.1) is another GAM190 target gene, herein designated TARGET GENE. MT1F BINDING SITE is a target binding site found in the 3' untranslated region of mRNA encoded by MT1F, corresponding to a target binding site such as BINDING SITE I, BINDING SITE II or BINDING SITE III of FIG. 8. Table 4 illustrates the complementarity of the nucleotide sequences of MT1F BINDING SITE, designated SEQ ID:17234, to the nucleotide sequence of GAM190 RNA, herein designated GAM RNA, also designated SEQ ID:289.

Another function of GAM190 is therefore inhibition of Metallothionein 1f (functional) (MT1F, Accession NP_005940.1). Accordingly, utilities of GAM190 include diagnosis, prevention and treatment of diseases and clinical conditions associated with MT1F.

Metallothionein 1g (MT1G, Accession NP_005941.1) is another GAM190 target gene, herein designated TARGET GENE. MT1G BINDING SITE is a target binding site found in the 3' untranslated region of mRNA encoded by MT1G, corresponding to a target binding site such as BINDING SITE I, BINDING SITE II or BINDING SITE III of FIG. 8. Table 4 illustrates the complementarity of the nucleotide sequences of MT1G BINDING SITE, designated SEQ ID:4199, to the nucleotide sequence of GAM190 RNA, herein designated GAM RNA, also designated SEQ ID:289.

Another function of GAM190 is therefore inhibition of Metallothionein 1g (MT1G, Accession NP_005941.1), a gene which is active in metal homeostasis and protects against heavy-metal toxicity. Accordingly, utilities of GAM190 include diagnosis, prevention and treatment of diseases and clinical conditions associated with MT1G.

The function of MT1G has been established by previous studies. See 156350. Karin et al. (1984), West et al. (1990), and others have mapped the locus containing the MT1 gene family to chromosome 16q13. Foster et al. (1988) described the structure of the human MT1G gene. They showed that the MT1G gene promoter is not cell type-specific. However, they also found that, while the gene was expressed in certain hepatoma-derived cell lines in response to heavy metals (but not to dexamethasone), a lymphoblastoid cell line did not express MT1G, suggesting to them that MT1G gene expression is regulated differentially and in a cell-specific manner. They also found that the MT1G promoter is 5 times more active than the MT1F (OMIM Ref. No. 156352) promoter in transient transfection studies.

Full details of the abovementioned studies are described in the following publications, the disclosure of which are hereby incorporated by reference:

Karin, M.; Eddy, R. L.; Henry, W. M.; Haley, L. L.; Byers, M. G.; Shows, T. B.: Human metallothionein genes are clustered on chromosome 16. Proc. Nat. Acad. Sci. 81:5494-5498, 1984; and West, A. K.; Stallings, R.; Hildebrand, C. E.; Chiu, R.; Karin, M.; Richards, R. I.: Human metallothionein genes: structure of the functional locus at 16q13. Genomics 8:513-518, 1990.

Further studies establishing the function and utilities of MT1G are found in John Hopkins OMIM database record ID 156353, and in cited publications listed in Table 5, which are hereby incorporated by reference. Metallothionein 1h (MT1H, Accession NP_005942.1) is another GAM190 target gene, herein designated TARGET GENE. MT1H BINDING SITE is a target binding site found in the 3' untranslated region of mRNA encoded by MT1H, corresponding to a target binding site such as BINDING SITE I, BINDING SITE II or BINDING SITE III of FIG. 8. Table 4 illustrates the complementarity of the nucleotide sequences of MT1H BINDING SITE, designated SEQ ID:6444, to the nucleotide sequence of GAM190 RNA, herein designated GAM RNA, also designated SEQ ID:289.

Another function of GAM190 is therefore inhibition of Metallothionein 1h (MT1H, Accession NP_005942.1). Accordingly, utilities of GAM190 include diagnosis, prevention and treatment of diseases and clinical conditions associated with MT1H.

Metallothionein 1l (MT1L, Accession NP_002441.2) is another GAM190 target gene, herein designated TARGET GENE. MT1L BINDING SITE is a target binding site found in the 3' untranslated region of mRNA encoded by MT1L, corresponding to a target binding site such as BINDING SITE I, BINDING SITE II or BINDING SITE III of FIG. 8. Table 4 illustrates the complementarity of the nucleotide sequences of MT1L BINDING SITE, designated SEQ ID:17203, to the nucleotide sequence of GAM190 RNA, herein designated GAM RNA, also designated SEQ ID:289.

Another function of GAM190 is therefore inhibition of Metallothionein 1l (MT1L, Accession NP_002441.2), a gene which plays a role in zinc and copper homeostasis during development. Accordingly, utilities of GAM190 include diagnosis, prevention and treatment of diseases and clinical conditions associated with MT1L.

The function of MT1L has been established by previous studies. See 156350. Karin et al. (1984), West et al. (1990), and others have mapped the locus containing the MT1 gene family to chromosome 16q13.

Full details of the abovementioned studies are described in the following publications, the disclosure of which are hereby incorporated by reference:

Karin, M.; Eddy, R. L.; Henry, W. M.; Haley, L. L.; Byers, M. G.; Shows, T. B.: Human metallothionein genes are clustered on chromosome 16. Proc. Nat. Acad. Sci. 81:5494-5498, 1984; and West, A. K.; Stallings, R.; Hildebrand, C. E.; Chiu, R.; Karin, M.; Richards, R. I. : Human metallothionein genes: structure of the functional locus at 16q13. Genomics 8:513-518, 1990.

Further studies establishing the function and utilities of MT1L are found in John Hopkins OMIM database record ID 156358, and in cited publications listed in Table 5, which are hereby incorporated by reference. Metallothionein 1x (MT1X, Accession NP_005943.1) is another GAM190 target gene, herein designated TARGET GENE. MT1X BINDING SITE is a target binding site found in the 3' untranslated region of mRNA encoded by MT1X, corresponding to a target binding site such as BINDING SITE I, BINDING SITE II or BINDING SITE III of FIG. 8. Table 4 illustrates the complementarity of the nucleotide sequences of MT1X BINDING SITE, designated SEQ ID:7997, to the nucleotide sequence of GAM190 RNA, herein designated GAM RNA, also designated SEQ ID:289.

Another function of GAM190 is therefore inhibition of Metallothionein 1x (MT1X, Accession NP_005943.1). Accordingly, utilities of GAM190 include diagnosis, prevention and treatment of diseases and clinical conditions associated with MT1X.

Myosin viia and rab interacting protein (MYRIP, Accession NP_056275.1) is another GAM190 target gene, herein designated TARGET GENE. MYRIP BINDING SITE is a target binding site found in the 3' untranslated region of mRNA encoded by MYRIP, corresponding to a target binding site such as BINDING SITE I, BINDING SITE II or BINDING SITE III of FIG. 8. Table 4 illustrates the complementarity of the nucleotide sequences of MYRIP BINDING SITE, designated SEQ ID:14896, to the nucleotide sequence of GAM190 RNA, herein designated GAM RNA, also designated SEQ ID:289.

Another function of GAM190 is therefore inhibition of Myosin viia and rab interacting protein (MYRIP, Accession NP_056275.1). Accordingly, utilities of GAM190 include diagnosis, prevention and treatment of diseases and clinical conditions associated with MYRIP.

NALP2 (Accession NP_060322.1) is another GAM190 target gene, herein designated TARGET GENE. NALP2 BINDING SITE is a target binding site found in the 3' untranslated region of mRNA encoded by NALP2, corresponding to a target binding site such as BINDING SITE I, BINDING SITE II or BINDING SITE III of FIG. 8. Table 4 illustrates the complementarity of the nucleotide sequences of NALP2 BINDING SITE, designated SEQ ID:2364, to the nucleotide sequence of GAM190 RNA, herein designated GAM RNA, also designated SEQ ID:289.

Another function of GAM190 is therefore inhibition of NALP2 (Accession NP_060322.1). Accordingly, utilities of GAM190 include diagnosis, prevention and treatment of diseases and clinical conditions associated with NALP2.

Nck adaptor protein 1 (NCK1, Accession NP_006144.1) is another GAM190 target gene, herein designated TARGET GENE. NCK1 BINDING SITE is a target binding site found in the 3' untranslated region of mRNA encoded by NCK1, corresponding to a target binding site such as BINDING SITE I, BINDING SITE II or BINDING SITE III of FIG. 8. Table 4 illustrates the complementarity of the nucleotide sequences of NCK1 BINDING SITE, designated SEQ ID:17015, to the nucleotide sequence of GAM190 RNA, herein designated GAM RNA, also designated SEQ ID:289.

Another function of GAM190 is therefore inhibition of Nck adaptor protein 1 (NCK1, Accession NP_006144.1). Accordingly, utilities of GAM190 include diagnosis, prevention and treatment of diseases and clinical conditions associated with NCK1.

Nk3 transcription factor related, locus 1 (drosophila) (NKX3-1, Accession NP_006158.2) is another GAM190 target gene, herein designated TARGET GENE. NKX3-1 BINDING SITE is a target binding site found in the 3' untranslated region of mRNA encoded by NKX3-1, corresponding to a target binding site such as BINDING SITE I, BINDING SITE II or BINDING SITE III of FIG. 8. Table 4 illustrates the complementarity of the nucleotide sequences of NKX3-1 BINDING SITE, designated SEQ ID:8119, to the nucleotide sequence of GAM190 RNA, herein designated GAM RNA, also designated SEQ ID:289.

Another function of GAM190 is therefore inhibition of Nk3 transcription factor related, locus 1 (drosophila) (NKX3-1, Accession NP_006158.2). Accordingly, utilities of GAM190 include diagnosis, prevention and treatment of diseases and clinical conditions associated with NKX3-1.

Neuroligin 1 (NLGN1, Accession NP_055747.1) is another GAM190 target gene, herein designated TARGET GENE. NLGN1 BINDING SITE is a target binding site found in the 3' untranslated region of mRNA encoded by NLGN1, corresponding to a target binding site such as BINDING SITE I, BINDING SITE II or BINDING SITE III of FIG. 8. Table 4 illustrates the complementarity of the nucleotide sequences of NLGN1 BINDING SITE, designated SEQ ID:8186, to the nucleotide sequence of GAM190 RNA, herein designated GAM RNA, also designated SEQ ID:289.

Another function of GAM190 is therefore inhibition of Neuroligin 1 (NLGN1, Accession NP_055747.1), a gene which may trigger the de novo formation of presynaptic structure. Accordingly, utilities of GAM190 include diagnosis, prevention and treatment of diseases and clinical conditions associated with NLGN1.

The function of NLGN1 and its association with various diseases and clinical conditions, has been established by previous studies, as described hereinabove with reference to GAM90.1. Notch homolog 1, translocation-associated (drosophila) (NOTCH1, Accession NP_060087.2) is another GAM190 target gene, herein designated TARGET GENE.

NOTCH1 BINDING SITE is a target binding site found in the 3' untranslated region of mRNA encoded by NOTCH1, corresponding to a target binding site such as BINDING SITE I, BINDING SITE II or BINDING SITE III of FIG. 8. Table 4 illustrates the complementarity of the nucleotide sequences of NOTCH1 BINDING SITE, designated SEQ ID:11588, to the nucleotide sequence of GAM190 RNA, herein designated GAM RNA, also designated SEQ ID:289.

Another function of GAM190 is therefore inhibition of Notch homolog 1, translocation-associated (drosophila) (NOTCH1, Accession NP_060087.2), a gene which is possibly involved in cell differentiation and lymphocyte function. and therefore may be associated with Neoplasia, a t-cell acute lymphoblastic leukemia. Accordingly, utilities of GAM190 include diagnosis, prevention and treatment of Neoplasia, a t-cell acute lymphoblastic leukemia, and of other diseases and clinical conditions associated with NOTCH1.

The function of NOTCH1 has been established by previous studies. Cytogenetic studies have shown that chromosome 7 band q34-q35, which contains the gene for the beta T-cell receptor (OMIM Ref. No. 186930), is a common site for translocation in T-cell neoplasms. In a translocation t(7;9) (q34;q34.3) found in a case of acute T-cell lymphoblastic leukemia, Ellisen et al. (1991) found that the locus on chromosome 9 contains a gene highly homologous to the Drosophila gene 'Notch.' Transcripts of the human gene, for which they proposed the name TAN1 (an acronym for translocation-associated Notch homolog), and its murine counterpart were demonstrated in many normal human fetal and adult mouse tissues but were most abundant in lymphoid tissues. In t(7;9) (q34;q34.3) translocations from 3 cases of acute T-cell lymphoblastic leukemia, Ellisen et al. (1991) found breakpoints within 100 bp of an intron in TAN1, resulting in truncation of TAN1 transcripts. They interpreted the observations to indicate that TAN1 is important for normal lymphocyte function and that alterations in TAN1 play a role in the pathogenesis of some T-cell neoplasms. Milner et al. (1994) found that at least 1 Notch homolog is expressed in human bone marrow CD34+ cells, a population enriched for hematopoietic precursors. On the basis of these findings, they suggested that members of the Notch family, including TAN1, may be involved in mediating cell-fate decisions during hematopoiesis.

Animal model experiments lend further support to the function of NOTCH1. Huppert et al. (2000) mutated valine at position 1744 of the mouse Notch1 gene to glycine. This position is the site for proteolytic cleavage and is critical for Notch1 intracellular processing in tissue-culture cells. Huppert et al. (2000) generated homozygous animals carrying 2 germline mutations and compared these with mice who have 2 null alleles for Notch1 (Conlon et al., 1995). At embryonic day 8.5 to 10.5, homozygous embryos were detected at the expected mendelian frequency. Similar to the null alleles, embryo absorption was detected between embryonic day 10 and 12, and no homozygous embryos were recovered past embryonic day 12. These results suggested that efficient Notch processing is necessary for the early embryonic developmental aspects of Notch activity. RT-PCR and immunoprecipitation showed comparable amounts of Notch mRNA and protein, respectively, in the processing-deficient embryos and their heterozygous and wildtype littermates. The phenotypes associated with the single point mutation resembled the null Notch1 phenotype, but with slightly reduced penetrance.

It is appreciated that the abovementioned animal model for NOTCH1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ellisen, L. W.; Bird, J.; West, D. C.; Soreng, A. L.; Reynolds, T. C.; Smith, S. D.; Sklar, J.: TAN-1, the human homolog of the Drosophila Notch gene, is broken by chromosomal translocations in T lymphoblastic neoplasms. Cell 66:649-661, 1991; and Huppert, S. S.; Le, A.; Schroeter, E. H.; Mumm, J. S.; Saxena, M. T.; Milner, L. A.; Kopan, R.: Embryonic lethality in mice homozygous for a processing-deficient allele of Notch1. Natu.

Further studies establishing the function and utilities of NOTCH1 are found in John Hopkins OMIM database record ID 190198, and in cited publications listed in Table 5, which are hereby incorporated by reference. Nadph oxidase 1 (NOX1, Accession NP_039249.1) is another GAM190 target gene, herein designated TARGET GENE. NOX1 BINDING SITE is a target binding site found in the 5' untranslated region of multiple transcripts of mRNA encoded by NOX1, corresponding to a target binding site such as BINDING SITE I, BINDING SITE II or BINDING SITE III of FIG. 8. Table 4 illustrates the complementarity of the nucleotide sequences of NOX1 BINDING SITE, designated SEQ ID:8938, to the nucleotide sequence of GAM190 RNA, herein designated GAM RNA, also designated SEQ ID:289.

Another function of GAM190 is therefore inhibition of Nadph oxidase 1 (NOX1, Accession NP_039249.1), a gene which mediates the h+ currents of resting phagocytes and other tissues. Accordingly, utilities of GAM190 include diagnosis, prevention and treatment of diseases and clinical conditions associated with NOX1.

The function of NOX1 and its association with various diseases and clinical conditions, has been established by previous studies, as described hereinabove with reference to GAM96.1. Nadph oxidase 1 (NOX1, Accession NP_039248.1) is another GAM190 target gene, herein designated TARGET GENE. NOX1 BINDING SITE is a target binding site found in the 5' untranslated region of multiple transcripts of mRNA encoded by NOX1, corresponding to a target binding site such as BINDING SITE I, BINDING SITE II or BINDING SITE III of FIG. 8. Table 4 illustrates the complementarity of the nucleotide sequences of NOX1 BINDING SITE, designated SEQ ID:8938, to the nucleotide sequence of GAM190 RNA, herein designated GAM RNA, also designated SEQ ID:289.

Another function of GAM190 is therefore inhibition of Nadph oxidase 1 (NOX1, Accession NP_039248.1), a gene which mediates the h+ currents of resting phagocytes and other tissues. Accordingly, utilities of GAM190 include diagnosis, prevention and treatment of diseases and clinical conditions associated with NOX1.

The function of NOX1 and its association with various diseases and clinical conditions, has been established by previous studies, as described hereinabove with reference to GAM96.1. Nadph oxidase 1 (NOX1, Accession NP_008983.1) is another GAM190 target gene, herein designated TARGET GENE. NOX1 BINDING SITE is a target binding site found in the 5' untranslated region of multiple transcripts of mRNA encoded by NOX1, corresponding to a target binding site such as BINDING SITE I, BINDING SITE II or BINDING SITE III of FIG. 8. Table 4 illustrates the complementarity of the nucleotide sequences of NOX1 BINDING SITE, designated SEQ ID:8938, to the nucleotide sequence of GAM190 RNA, herein designated GAM RNA, also designated SEQ ID:289.

Another function of GAM190 is therefore inhibition of Nadph oxidase 1 (NOX1, Accession NP_008983.1), a gene which mediates the h+ currents of resting phagocytes and other tissues. Accordingly, utilities of GAM190 include diagnosis, prevention and treatment of diseases and clinical conditions associated with NOX1.

The function of NOX1 and its association with various diseases and clinical conditions, has been established by previous studies, as described hereinabove with reference to GAM96.1. Neuronal pentraxin ii (NPTX2, Accession NP_002514.1) is another GAM190 target gene, herein designated TARGET GENE. NPTX2 BINDING SITE is a target binding site found in the 3' untranslated region of mRNA encoded by NPTX2, corresponding to a target binding site such as BINDING SITE I, BINDING SITE II or BINDING SITE III of FIG. 8. Table 4 illustrates the complementarity of the nucleotide sequences of NPTX2 BINDING SITE, designated SEQ ID:4797, to the nucleotide sequence of GAM190 RNA, herein designated GAM RNA, also designated SEQ ID:289.

Another function of GAM190 is therefore inhibition of Neuronal pentraxin ii (NPTX2, Accession NP_002514.1), a gene which is likely to play role in the modification of cellular properties that underlie long-term plasticity. Accordingly, utilities of GAM190 include diagnosis, prevention and treatment of diseases and clinical conditions associated with NPTX2.

The function of NPTX2 has been established by previous studies. Pentraxins constitute a family of proteins that include C-reactive protein (CRP; 123260) and serum amyloid P protein (APCS; 104770). Hsu and Perin (1995) noted that the prototypic pentraxin, C-reactive protein, was first identified as a serum component that binds Streptococcus pneumoniae (Tillett and Francis, 1930 and Abernethy and Avery, 1941) and whose serum concentration increases up to 1,000-fold during an acute phase response. Pentraxins acquired their name from their ability to form pentameric (or decameric) complexes and have been characterized by their ability to bind numerous ligands. The latter property raises the possibility that these proteins may mediate a nonspecific uptake of bacteria and cell debris that may be associated with inflammation and immune responses. Schlimgen et al. (1995) identified a novel neuronal pentraxin in rat as a potential receptor mediating the uptake of the presynaptic snake venom toxin taipoxin (see OMIM Ref. No. NPTX1, 602367). Based on the low identity to other pentraxins and the hypothesis that this neuronal pentraxin may mediate uptake of degraded synaptic material, Hsu and Perin (1995) sought to identify additional members of what they suspected represents a new family of pentraxins. They reported the cDNA and genomic sequences of a second neuronal pentraxin in humans, for which they proposed the name neuronal pentraxin II (NPTX2). They found that it shows 54% amino acid identity to rat neuronal pentraxin I, with 69% identity over the carboxy-terminal half of NP I, and is 88% identical to a sperm acrosomal pentraxin. Northern blot analysis demonstrated that NPTX2 message is present in brain, testis, pancreas, liver, heart, and skeletal muscle; thus, unlike NP I, NP II is not exclusively localized to neurons. Like NP I, NP II has potential N-linked glycosylation sites. The human NPTX2 gene is 11 kb long and contains 4 introns. By fluorescence in situ hybridization, Hsu and Perin (1995) mapped the NPTX2 gene to 7q21.3-q22.1.

Full details of the abovementioned studies are described in the following publications, the disclosure of which are hereby incorporated by reference:

Hsu, Y.-C.; Perin, M. S.: Human neuronal pentraxin II (NPTX2): conservation, genomic structure, and chromosomal localization. Genomics 28:220-227, 1995; and Schlimgen, A. K.; Helms, J. A.; Vogel, H.; Perin, M. S.: Neuronal pentraxin, a secreted protein with homology to acute phase proteins of the immune system. Neuron 14:519-526, 1995.

Further studies establishing the function and utilities of NPTX2 are found in John Hopkins OMIM database record ID 600750, and in cited publications listed in Table 5, which are hereby incorporated by reference. Neuronal pentraxin receptor (NPTXR, Accession NP_478058.1) is another GAM190 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:13368, to the nucleotide sequence of GAM190 RNA, herein designated GAM RNA, also designated SEQ ID:289.

Another function of GAM190 is therefore inhibition of Neuronal pentraxin receptor (NPTXR, Accession NP_478058.1). Accordingly, utilities of GAM190 include diagnosis, prevention and treatment of diseases and clinical conditions associated with NPTXR.

Neuronal pentraxin receptor (NPTXR, Accession NP_055108.2) is another GAM190 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:13368, to the nucleotide sequence of GAM190 RNA, herein designated GAM RNA, also designated SEQ ID:289.

Another function of GAM190 is therefore inhibition of Neuronal pentraxin receptor (NPTXR, Accession NP_055108.2). Accordingly, utilities of GAM190 include diagnosis, prevention and treatment of diseases and clinical conditions associated with NPTXR.

Neuregulin 1 (NRG1, Accession NP_039252.1) is another GAM190 target gene, herein designated TARGET GENE. NRG1 BINDING SITE is a target binding site found in the 3' untranslated region of multiple transcripts of mRNA encoded by NRG1, corresponding to a target binding site such as BINDING SITE I, BINDING SITE II or BINDING SITE III of FIG. 8. Table 4 illustrates the complementarity of the nucleotide sequences of NRG1 BINDING SITE, designated SEQ ID:17541, to the nucleotide sequence of GAM190 RNA, herein designated GAM RNA, also designated SEQ ID:289.

Another function of GAM190 is therefore inhibition of Neuregulin 1 (NRG1, Accession NP_039252.1), a gene which is essential for neuronal development. Accordingly, utilities of GAM190 include diagnosis, prevention and treatment of diseases and clinical conditions associated with NRG1.

The function of NRG1 has been established by previous studies. The NEU/ERBB2 protooncogene (OMIM Ref. No. 164870) encodes a molecule that is closely related to epidermal growth factor receptor (EGFR; 131550) but binds none of the ligands of this receptor. Originally, NEU was identified as a dominant transforming gene in tumors of the peripheral nervous system that were induced by transplacental treatment of rat embryos with N-ethylnitrosourea. The period of susceptibility of NEU to carcinogenesis, i.e., midgestation, correlated with the timing of its expression in the nervous system. The existence of a NEU-specific ligand of endogenous nature activating NEU at a specific developmental stage was suggested. This ligand, known as heregulin (Holmes et al., 1992) or NEU differentiation factor, is a 44-kD glycoprotein that interacts with the NEU/ERBB2 receptor tyrosine kinase to increase its phosphorylation on tyrosine residues. Splice variants of heregulin, referred to as heregulin betas, have been described by Holmes et al. (1992).

Animal model experiments lend further support to the function of NRG1. Mice homozygous for disruptions of all NRG1 isoforms, all Ig-NRG1 isoforms, and all cytoplasmic tail-containing isoforms die at embryonic day 10.5 from cardiac defects. In particular, these mice die before significant expression of CRD-NRG1 isoforms, which predominate after midgestation. By histologic analyses, Wolpowitz et al. (2000) found that homozygous CRD-NRG1-deficient mice had normal neuronal trajectory and outgrowth, but that the projections defasciculated, branched abnormally, and failed to sustain peripheral neuromuscular synaptic development. Newborn mutants had immature skeletal muscle. Schwann cells were generated in the mutants but failed to survive, consistent with the designation of NRG1 as a Schwann cell survival factor. Schwann cells in turn appeared to provide trophic support only after the nerve had entered its target field and had begun synapse formation.

It is appreciated that the abovementioned animal model for NRG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Holmes, W. E.; Sliwkowski, M. X.; Akita, R. W.; Henzel, W. J.; Lee, J.; Park, J. W.; Yansura, D.; Abadi, N.; Raab, H.; Lewis, G. D.; Shepard, H. M.; Kuang, W.-J.; Wood, W. I.; Goeddel, D. V.; Vandlen, R. L.: Identification of heregulin, a specific activator of p185(erbB2). Science 256:1205-1210, 1992; and Wolpowitz, D.; Mason, T. B. A.; Dietrich, P.; Mendelsohn, M.; Talmage, D. A.; Role, L. W.: Cysteine-rich domain isoforms of the neuregulin-1 gene are required for maintenance of periph.

Further studies establishing the function and utilities of NRG1 are found in John Hopkins OMIM database record ID 142445, and in cited publications listed in Table 5, which are hereby incorporated by reference. Neuregulin 1 (NRG1, Accession NP_039256.1) is another GAM190 target gene, herein designated TARGET GENE. NRG1 BINDING SITE is a target binding site found in the 3' untranslated region of multiple transcripts of mRNA encoded by NRG1, corresponding to a target binding site such as BINDING SITE I, BINDING SITE II or BINDING SITE III of FIG. 8. Table 4 illustrates the complementarity of the nucleotide sequences of NRG1 BINDING SITE, designated SEQ ID:17541, to the nucleotide sequence of GAM190 RNA, herein designated GAM RNA, also designated SEQ ID:289.

Another function of GAM190 is therefore inhibition of Neuregulin 1 (NRG1, Accession NP_039256.1), a gene which is essential for neuronal development. Accordingly, utilities of GAM190 include diagnosis, prevention and treatment of diseases and clinical conditions associated with NRG1.

The function of NRG1 has been established by previous studies. The NEU/ERBB2 protooncogene (OMIM Ref. No. 164870) encodes a molecule that is closely related to epidermal growth factor receptor (EGFR; 131550) but binds none of the ligands of this receptor. Originally, NEU was identified as a dominant transforming gene in tumors of the peripheral nervous system that were induced by transplacental treatment of rat embryos with N-ethylnitrosourea. The period of susceptibility of NEU to carcinogenesis, i.e., midgestation, correlated with the timing of its expression in the nervous system. The existence of a NEU-specific ligand of endogenous nature activating NEU at a specific developmental stage was suggested. This ligand, known as heregulin (Holmes et al., 1992) or NEU differentiation factor, is a 44-kD glycoprotein that interacts with the NEU/ERBB2 receptor tyrosine kinase to increase its phosphorylation on tyrosine residues. Splice variants of heregulin, referred to as heregulin betas, have been described by Holmes et al. (1992).

Animal model experiments lend further support to the function of NRG1. Mice homozygous for disruptions of all NRG1 isoforms, all Ig-NRG1 isoforms, and all cytoplasmic tail-containing isoforms die at embryonic day 10.5 from cardiac defects. In particular, these mice die before significant expression of CRD-NRG1 isoforms, which predominate after midgestation. By histologic analyses, Wolpowitz et al. (2000) found that homozygous CRD-NRG1-deficient mice had normal neuronal trajectory and outgrowth, but that the projections defasciculated, branched abnormally, and failed to sustain peripheral neuromuscular synaptic development. Newborn mutants had immature skeletal muscle. Schwann cells were generated in the mutants but failed to survive, consistent with the designation of NRG1 as a Schwann cell survival factor. Schwann cells in turn appeared to provide trophic support only after the nerve had entered its target field and had begun synapse formation.

It is appreciated that the abovementioned animal model for NRG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Holmes, W. E.; Sliwkowski, M. X.; Akita, R. W.; Henzel, W. J.; Lee, J.; Park, J. W.; Yansura, D.; Abadi, N.; Raab, H.; Lewis, G. D.; Shepard, H. M.; Kuang, W.-J.; Wood, W. I.; Goeddel, D. V.; Vandlen, R. L.: Identification of heregulin, a specific activator of p185(erbB2). Science 256:1205-1210, 1992; and Wolpowitz, D.; Mason, T. B. A.; Dietrich, P.; Mendelsohn, M.; Talmage, D. A.; Role, L. W.: Cysteine-rich domain isoforms of the neuregulin-1 gene are required for maintenance of periph.

Further studies establishing the function and utilities of NRG1 are found in John Hopkins OMIM database record ID 142445, and in cited publications listed in Table 5, which are hereby incorporated by reference. Neuregulin 1 (NRG1, Accession NP_039253.1) is another GAM190 target gene, herein designated TARGET GENE. NRG1 BINDING SITE is a target binding site found in the 3' untranslated region of multiple transcripts of mRNA encoded by NRG1, corresponding to a target binding site such as BINDING SITE I, BINDING SITE II or BINDING SITE III of FIG. 8. Table 4 illustrates the complementarity of the nucleotide sequences of NRG1 BINDING SITE, designated SEQ ID:17541, to the nucleotide sequence of GAM190 RNA, herein designated GAM RNA, also designated SEQ ID:289.

Another function of GAM190 is therefore inhibition of Neuregulin 1 (NRG1, Accession NP_039253.1), a gene which is essential for neuronal development. Accordingly, utilities of GAM190 include diagnosis, prevention and treatment of diseases and clinical conditions associated with NRG1.

The function of NRG1 has been established by previous studies. The NEU/ERBB2 protooncogene (OMIM Ref. No. 164870) encodes a molecule that is closely related to epidermal growth factor receptor (EGFR; 131550) but binds none of the ligands of this receptor. Originally, NEU was identified as a dominant transforming gene in tumors of the peripheral nervous system that were induced by transplacental treatment of rat embryos with N-ethylnitrosourea. The period of susceptibility of NEU to carcinogenesis, i.e., midgestation, correlated with the timing of its expression in the nervous system. The existence of a NEU-specific ligand of endogenous nature activating NEU at a specific developmental stage was suggested. This ligand, known as heregulin (Holmes et al., 1992) or NEU differentiation factor, is a 44-kD glycoprotein that interacts with the NEU/ERBB2 receptor tyrosine kinase to increase its phosphorylation on tyrosine residues. Splice variants of heregulin, referred to as heregulin betas, have been described by Holmes et al. (1992).

Animal model experiments lend further support to the function of NRG1. Mice homozygous for disruptions of all NRG1 isoforms, all Ig-NRG1 isoforms, and all cytoplasmic tail-containing isoforms die at embryonic day 10.5 from cardiac defects. In particular, these mice die before significant expression of CRD-NRG1 isoforms, which predominate after midgestation. By histologic analyses, Wolpowitz et al. (2000) found that homozygous CRD-NRG1-deficient mice had normal neuronal trajectory and outgrowth, but that the projections defasciculated, branched abnormally, and failed to sustain peripheral neuromuscular synaptic development. Newborn mutants had immature skeletal muscle. Schwann cells were generated in the mutants but failed to survive, consistent with the designation of NRG1 as a Schwann cell survival factor. Schwann cells in turn appeared to provide trophic support only after the nerve had entered its target field and had begun synapse formation.

It is appreciated that the abovementioned animal model for NRG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Holmes, W. E.; Sliwkowski, M. X.; Akita, R. W.; Henzel, W. J.; Lee, J.; Park, J. W.; Yansura, D.; Abadi, N.; Raab, H.; Lewis, G. D.; Shepard, H. M.; Kuang, W.-J.; Wood, W. I.; Goeddel, D. V.; Vandlen, R. L.: Identification of heregulin, a specific activator of p185(erbB2). Science 256:1205-1210, 1992; and Wolpowitz, D.; Mason, T. B. A.; Dietrich, P.; Mendelsohn, M.; Talmage, D. A.; Role, L. W.: Cysteine-rich domain isoforms of the neuregulin-1 gene are required for maintenance of periph.

Further studies establishing the function and utilities of NRG1 are found in John Hopkins OMIM database record ID 142445, and in cited publications listed in Table 5, which are hereby incorporated by reference. Neurexin 3 (NRXN3, Accession NP_004787.2) is another GAM190 target gene, herein designated TARGET GENE. NRXN3 BINDING SITE is a target binding site found in the 3' untranslated region of multiple transcripts of mRNA encoded by NRXN3, corresponding to a target binding site such as BINDING SITE I, BINDING SITE II or BINDING SITE III of FIG. 8. Table 4 illustrates the complementarity of the nucleotide sequences of NRXN3 BINDING SITE, designated SEQ ID:14089, to the nucleotide sequence of GAM190 RNA, herein designated GAM RNA, also designated SEQ ID:289.

Another function of GAM190 is therefore inhibition of Neurexin 3 (NRXN3, Accession NP_004787.2), a gene which may be involved in cell recognition, cell adhesion, and mediate intracellular signaling. Accordingly, utilities of GAM190 include diagnosis, prevention and treatment of diseases and clinical conditions associated with NRXN3.

The function of NRXN3 and its association with various diseases and clinical conditions, has been established by previous studies, as described hereinabove with reference to GAM69.2. Neurexin 3 (NRXN3, Accession NP_620426.1) is another GAM190 target gene, herein designated TARGET GENE. NRXN3 BINDING SITE is a target binding site found in the 3' untranslated region of multiple transcripts of mRNA encoded by NRXN3, corresponding to a target binding site such as BINDING SITE I, BINDING SITE II or BINDING SITE III of FIG. 8. Table 4 illustrates the complementarity of the nucleotide sequences of NRXN3 BINDING SITE, designated SEQ ID:14089, to the nucleotide sequence of GAM190 RNA, herein designated GAM RNA, also designated SEQ ID:289.

Another function of GAM190 is therefore inhibition of Neurexin 3 (NRXN3, Accession NP_620426.1), a gene which may be involved in cell recognition, cell adhesion, and mediate intracellular signaling. Accordingly, utilities of GAM190 include diagnosis, prevention and treatment of diseases and clinical conditions associated with NRXN3.

The function of NRXN3 and its association with various diseases and clinical conditions, has been established by previous studies, as described hereinabove with reference to GAM69.2. Oxidised low density lipoprotein (lectin-like) receptor 1 (OLR1, Accession NP_002534.1) is another GAM190 target gene, herein designated TARGET GENE. OLR1 BINDING SITE is a target binding site found in the 3' untranslated region of mRNA encoded by OLR1, corresponding to a target binding site such as BINDING SITE I, BINDING SITE II or BINDING SITE III of FIG. 8. Table 4 illustrates the complementarity of the nucleotide sequences of OLR1 BINDING SITE, designated SEQ ID:2011, to the nucleotide sequence of GAM190 RNA, herein designated GAM RNA, also designated SEQ ID:289.

Another function of GAM190 is therefore inhibition of Oxidised low density lipoprotein (lectin-like) receptor 1 (OLR1, Accession NP_002534.1), a gene which is involved in degradation of oxidized LDL by vascular endothelial cells. Accordingly, utilities of GAM190 include diagnosis, prevention and treatment of diseases and clinical conditions associated with OLR1.

The function of OLR1 has been established by previous studies. Endothelial cell dysfunction or activation elicited by oxidatively modified low density lipoprotein (OMIM Ref. No. Ox-LDL) has been implicated in the pathogenesis of atherosclerosis. Vascular endothelial cells internalize and degrade Ox-LDL through a putative receptor-mediated pathway that does not involve macrophage scavenger receptors (see OMIM Ref. No. MSR1; 153622). To identify genes encoding Ox-LDL receptors, Sawamura et al. (1997) transfected mammalian cells with a cDNA expression library derived from bovine aortic endothelial cells and assayed for uptake of labeled Ox-LDL. They recovered a cDNA encoding an Ox-LDL receptor, which they designated lectin-like Ox-LDL receptor-1 (LOX1). Immunofluorescence studies showed that bovine LOX1 is expressed on the cell surface. Sawamura et al. (1997) cloned a cDNA encoding the human homolog of LOX1 by screening a human lung cDNA library with the bovine LOX1 cDNA. Cells stably expressing human LOX1 showed uptake of labeled Ox-LDL. The predicted 273-amino acid human LOX1 protein is 72% identical to bovine LOX1. Its structure is similar to that of C-type lectins such as CD94 (KLRD1) and NKR-P1 (KLRB1). Northern blot analysis revealed that human LOX1 is expressed as a 2.8-kb mRNA in various tissues, with the most abundant expression in placenta. Yamanaka et al. (1998) determined that LOX1 is expressed in vascular-rich organs but not in lymphocytes. Yamanaka et al. (1998) found that the LOX1 gene spans approximately 15 kb and consists of 6 exons. By fluorescence in situ hybridization, they mapped the gene to 12p12-p13, where genes of the natural killer cell receptors are clustered.

Full details of the abovementioned studies are described in the following publications, the disclosure of which are hereby incorporated by reference:

Sawamura, T.; Kume, N.; Aoyama, T.; Moriwaki, H.; Hoshikawa, H.; Aiba, Y.; Tanaka, T.; Miwa, S.; Katsura, Y.; Kita, T.; Masaki, T.: An endothelial receptor for oxidized low-density lipoprotein. Nature 386:73-77, 1997; and Yamanaka, S.; Zhang, X.-Y.; Miura, K.; Kim, S.; Iwao, H.: The human gene encoding the lectin-type oxidized LDL receptor (OLR1) is a novel member of the natural killer gene complex with.

Further studies establishing the function and utilities of OLR1 are found in John Hopkins OMIM database record ID 602601, and in cited publications listed in Table 5, which are hereby incorporated by reference. Oxysterol binding protein-like 3 (OSBPL3, Accession NP_663162.1) is another GAM190 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:18511, to the nucleotide sequence of GAM190 RNA, herein designated GAM RNA, also designated SEQ ID:289.

Another function of GAM190 is therefore inhibition of Oxysterol binding protein-like 3 (OSBPL3, Accession NP_663162.1). Accordingly, utilities of GAM190 include diagnosis, prevention and treatment of diseases and clinical conditions associated with OSBPL3.

Oxysterol binding protein-like 3 (OSBPL3, Accession NP_056365.1) is another GAM190 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:18511, to the nucleotide sequence of GAM190 RNA, herein designated GAM RNA, also designated SEQ ID:289.

Another function of GAM190 is therefore inhibition of Oxysterol binding protein-like 3 (OSBPL3, Accession NP_056365.1). Accordingly, utilities of GAM190 include diagnosis, prevention and treatment of diseases and clinical conditions associated with OSBPL3.

Oxysterol binding protein-like 3 (OSBPL3, Accession NP_663161.1) is another GAM190 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:18511, to the nucleotide sequence of GAM190 RNA, herein designated GAM RNA, also designated SEQ ID:289.

Another function of GAM190 is therefore inhibition of Oxysterol binding protein-like 3 (OSBPL3, Accession NP_663161.1). Accordingly, utilities of GAM190 include diagnosis, prevention and treatment of diseases and clinical conditions associated with OSBPL3.

Oxysterol binding protein-like 3 (OSBPL3, Accession NP_663164.1) is another GAM190 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:18511, to the nucleotide sequence of GAM190 RNA, herein designated GAM RNA, also designated SEQ ID:289.

Another function of GAM190 is therefore inhibition of Oxysterol binding protein-like 3 (OSBPL3, Accession NP_663164.1). Accordingly, utilities of GAM190 include diagnosis, prevention and treatment of diseases and clinical conditions associated with OSBPL3.

Oxysterol binding protein-like 3 (OSBPL3, Accession NP_663160.1) is another GAM190 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:18511, to the nucleotide sequence of GAM190 RNA, herein designated GAM RNA, also designated SEQ ID:289.

Another function of GAM190 is therefore inhibition of Oxysterol binding protein-like 3 (OSBPL3, Accession NP_663160.1). Accordingly, utilities of GAM190 include diagnosis, prevention and treatment of diseases and clinical conditions associated with OSBPL3.

Oxysterol binding protein-like 3 (OSBPL3, Accession NP_663163.1) is another GAM190 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:18511, to the nucleotide sequence of GAM190 RNA, herein designated GAM RNA, also designated SEQ ID:289.

Another function of GAM190 is therefore inhibition of Oxysterol binding protein-like 3 (OSBPL3, Accession NP_663163.1). Accordingly, utilities of GAM190 include diagnosis, prevention and treatment of diseases and clinical conditions associated with OSBPL3.

Peptidyl arginine deiminase, type iii (PADI3, Accession NP_057317.1) is another GAM190 target gene, herein designated TARGET GENE. PADI3 BINDING SITE is a target binding site found in the 3' untranslated region of mRNA encoded by PADI3, corresponding to a target binding site such as BINDING SITE I, BINDING SITE II or BINDING SITE III of FIG. 8. Table 4 illustrates the complementarity of the nucleotide sequences of PADI3 BINDING SITE, designated SEQ ID:16411, to the nucleotide sequence of GAM190 RNA, herein designated GAM RNA, also designated SEQ ID:289.

Another function of GAM190 is therefore inhibition of Peptidyl arginine deiminase, type iii (PADI3, Accession NP_057317.1). Accordingly, utilities of GAM190 include diagnosis, prevention and treatment of diseases and clinical conditions associated with PADI3.

Putative homeodomain transcription factor 2 (PHTF2, Accession NP_065165.1) is another GAM190 target gene, herein designated TARGET GENE. PHTF2 BINDING SITE is a target binding site found in the 3' untranslated region of mRNA encoded by PHTF2, corresponding to a target binding site such as BINDING SITE I, BINDING SITE II or BINDING SITE III of FIG. 8. Table 4 illustrates the complementarity of the nucleotide sequences of PHTF2 BINDING SITE, designated SEQ ID:13802, to the nucleotide sequence of GAM190 RNA, herein designated GAM RNA, also designated SEQ ID:289.

Another function of GAM190 is therefore inhibition of Putative homeodomain transcription factor 2 (PHTF2, Accession NP_065165.1). Accordingly, utilities of GAM190 include diagnosis, prevention and treatment of diseases and clinical conditions associated with PHTF2.

POLR3D (Accession NP_001713.1) is another GAM190 target gene, herein designated TARGET GENE. POLR3D BINDING SITE is a target binding site found in the 3' untranslated region of mRNA encoded by POLR3D, corresponding to a target binding site such as BINDING SITE I, BINDING SITE II or BINDING SITE III of FIG. 8. Table 4 illustrates the complementarity of the nucleotide sequences of POLR3D BINDING SITE, designated SEQ ID:17860, to the nucleotide sequence of GAM190 RNA, herein designated GAM RNA, also designated SEQ ID:289.

Another function of GAM190 is therefore inhibition of POLR3D (Accession NP_001713.1). Accordingly, utilities of GAM190 include diagnosis, prevention and treatment of diseases and clinical conditions associated with POLR3D.

Peptidylprolyl isomerase a (cyclophilin a) (PPIA, Accession NP_066953.1) is another GAM190 target gene, herein designated TARGET GENE. PPIA BINDING SITE is a target binding site found in the 3' untranslated region of mRNA encoded by PPIA, corresponding to a target binding site such as BINDING SITE I, BINDING SITE II or BINDING SITE III of FIG. 8. Table 4 illustrates the complementarity of the nucleotide sequences of PPIA BINDING SITE, designated SEQ ID:8957, to the nucleotide sequence of GAM190 RNA, herein designated GAM RNA, also designated SEQ ID:289.

Another function of GAM190 is therefore inhibition of Peptidylprolyl isomerase a (cyclophilin a) (PPIA, Accession NP_066953.1), a gene which is involved in protein folding and/or intracellular protein transport. Accordingly, utilities of GAM190 include diagnosis, prevention and treatment of diseases and clinical conditions associated with PPIA.

The function of PPIA has been established by previous studies. Cyclophilin is a specific high-affinity binding protein for the immunosuppressant agent cyclosporin A. Because of its dramatic effects on decreasing morbidity and increasing survival rates in human transplants, the molecular mechanism of immunosuppression by cyclosporin A has been a matter of much interest. Liu et al. (1990) cloned human cDNA for T-cell CYPH and constructed an expression vector under control of the tac promoter for efficient expression in E. coli. Cyclophilin A (also designated peptidyl-prolyl cis/trans isomerase A or PPIA) is a member of the immunophilin class of proteins that all possess peptidyl-prolyl cis/trans isomerase activity and, therefore, are believed to be involved in protein folding and/or intracellular protein transport. Luban et al. (1993) showed that cyclophilin A binds to the gag protein of human immunodeficiency virus type 1 (HIV-1). This interaction can be inhibited by the immunosuppressant cyclosporin A and also by nonimmunosuppressive, cyclophilin A-binding cyclosporin A derivatives, which were also shown to exhibit potent anti-HIV-1 activity. Thus, cyclophilin A may have an essential function in HIV-1 replication. Using a panel of somatic rodent/human cell hybrids and PCR technology, Willenbrink et al. (1995) mapped the cyclophilin gene (designated PPIA) on chromosome 7 and 4 pseudogenes (PPIP2, PPIP3, PPIP4, and PPIP6) to chromosomes 14, 10, 18, and 3, respectively. Using chromosome 7 and chromosome 10 deletion hybrid panels, they further localized the PPIA coding gene to 7p13-p11.2, as confirmed by fluorescence in situ hybridization (FISH) analysis, and a pseudogene (PPIP3) to the region 10q11.2-q23. Braaten et al. (1996) mapped the PPIA gene to 7p13 by FISH.

Full details of the abovementioned studies are described in the following publications, the disclosure of which are hereby incorporated by reference:

Liu, J.; Albers, M. W.; Chen, C.-M.; Schreiber, S. L.; Walsh, C. T.: Cloning, expression, and purification of human cyclophilin in Escherichia coli and assessment of the catalytic role of cysteines by site-directed mutagenesis. Proc. Nat. Acad. Sci. 87:2304-2308, 1990; and Willenbrink, W.; Halaschek, J.; Schuffenhauer, S.; Kunz, J.; Steinkasserer, A.: Cyclophilin A, the major intracellular receptor for the immunosuppressant cyclosporin A, maps to chromosome.

Further studies establishing the function and utilities of PPIA are found in John Hopkins OMIM database record ID 123840, and in cited publications listed in Table 5, which are hereby incorporated by reference. Proteasome (prosome, macropain) 26s subunit, non-atpase, 5 (PSMD5, Accession NP_005038.1) is another GAM190 target gene, herein designated TARGET GENE. PSMD5 BINDING SITE is a target binding site found in the 3' untranslated region of mRNA encoded by PSMD5, corresponding to a target binding site such as BINDING SITE I, BINDING SITE II or BINDING SITE III of FIG. 8. Table 4 illustrates the complementarity of the nucleotide sequences of PSMD5 BINDING SITE, designated SEQ ID:8408, to the nucleotide sequence of GAM190 RNA, herein designated GAM RNA, also designated SEQ ID:289.

Another function of GAM190 is therefore inhibition of Proteasome (prosome, macropain) 26s subunit, non-atpase, 5 (PSMD5, Accession NP_005038.1), a gene which is the non-ATPase subunit 5 of the 26S proteasome (prosome macropain). Accordingly, utilities of GAM190 include diagnosis, prevention and treatment of diseases and clinical conditions associated with PSMD5.

The function of PSMD5 has been established by previous studies. The covalent attachment of ubiquitin to proteins produces substrates for the 26S ATP-dependent protease. This enzyme is composed of the multicatalytic protease, or proteasome, and a regulatory ATPase complex. Both the multicatalytic protease and the regulatory complex are multisubunit structures that associate in the presence of ATP to form the 26S enzyme. Deveraux et al. (1994) identified a 50-kD subunit of the regulatory complex, which they called subunit 5 (S5) based upon its relative mobility on SDS-polyacrylamide gels. Deveraux et al. (1995) demonstrated that 2 distinct subunits of the 26S protease migrate as 50-kD proteins, and thus, S5 represents 2 proteins, which the authors termed S5A (PSMD4; 601648) and S5B, also called PSMD5. Deveraux et al. (1995) sequenced peptides from the PSMD5 subunit of the human red blood cell 26S protease. Using the amino acid sequence, they isolated human cDNAs comprising a full-length PSMD5 cDNA. The deduced 505-amino acid PSMD5 protein is enriched in leucine residues, particularly in the N-terminal region. PSMD5 contains 9 dileucine repeats and a sequence, NPNY, similar to the tyrosine-based motifs. Dileucine repeats and tyrosine-based motifs are thought to contribute to internalization and/or targeting. PSMD5 has a calculated molecular mass of 56 kD and focuses at pH 5.3 on 2-dimensional gels. Recombinant PSMD5 did not bind to ubiquitin polymers. By sequencing cDNAs randomly selected from a cDNA library derived from a human immature myeloid cell line, Nomura et al. (1994) isolated a partial cDNA encoding PSMD5, which they called KIAA0072. Northern blot analysis detected PSMD5 expression in a wide variety of human tissues, with the highest expression in lung and skeletal muscle. Deveraux et al. (1995) noted that the nucleotide sequence of the KIAA0072 cDNA is identical to the corresponding nucleotide sequence of the S5B cDNA.

Full details of the abovementioned studies are described in the following publications, the disclosure of which are hereby incorporated by reference:

Deveraux, Q.; Jensen, C.; Rechsteiner, M.: Molecular cloning and expression of a 26 S protease subunit enriched in dileucine repeats. J. Biol. Chem. 270:23726-23729, 1995; and Deveraux, Q.; Ustrell, V.; Pickart, C.; Rechsteiner, M.: A 26 S protease subunit that binds ubiquitin conjugates. J. Biol. Chem. 269:7059-7061, 1994.

Further studies establishing the function and utilities of PSMD5 are found in John Hopkins OMIM database record ID 604452, and in cited publications listed in Table 5, which are hereby incorporated by reference. Prostaglandin-endoperoxide synthase 1 (prostaglandin g/h synthase and cyclooxygenase) (PTGS1, Accession NP_542158.1) is another GAM190 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:9441, to the nucleotide sequence of GAM190 RNA, herein designated GAM RNA, also designated SEQ ID:289.

Another function of GAM190 is therefore inhibition of Prostaglandin-endoperoxide synthase 1 (prostaglandin g/h synthase and cyclooxygenase) (PTGS1, Accession NP_542158.1), a gene which may play an important role in regulating or promoting cell proliferation in some normal and neoplastically transformed cells. Accordingly, utilities of GAM190 include diagnosis, prevention and treatment of diseases and clinical conditions associated with PTGS1.

The function of PTGS1 and its association with various diseases and clinical conditions, has been established by previous studies, as described hereinabove with reference to GAM40.1. Prostaglandin-endoperoxide synthase 1 (prostaglandin g/h synthase and cyclooxygenase) (PTGS1, Accession NP_000953.2) is another GAM190 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:9441, to the nucleotide sequence of GAM190 RNA, herein designated GAM RNA, also designated SEQ ID:289.

Another function of GAM190 is therefore inhibition of Prostaglandin-endoperoxide synthase 1 (prostaglandin g/h synthase and cyclooxygenase) (PTGS1, Accession NP_000953.2), a gene which may play an important role in regulating or promoting cell proliferation in some normal and neoplastically transformed cells. Accordingly, utilities of GAM190 include diagnosis, prevention and treatment of diseases and clinical conditions associated with PTGS1.

The function of PTGS1 and its association with various diseases and clinical conditions, has been established by previous studies, as described hereinabove with reference to GAM40.1. Arginine-glutamic acid dipeptide (re) repeats (RERE, Accession NP_036234.2) is another GAM190 target gene, herein designated TARGET GENE. RERE BINDING SITE is a target binding site found in the 3' untranslated region of mRNA encoded by RERE, corresponding to a target binding site such as BINDING SITE I, BINDING SITE II or BINDING SITE III of FIG. 8. Table 4 illustrates the complementarity of the nucleotide sequences of RERE BINDING SITE, designated SEQ ID:16468, to the nucleotide sequence of GAM190 RNA, herein designated GAM RNA, also designated SEQ ID:289.

Another function of GAM190 is therefore inhibition of Arginine-glutamic acid dipeptide (re) repeats (RERE, Accession NP_036234.2), a gene which binds DRPLA and locates in the nucleus and therefore may be associated with Dentatorubral-pallidoluysian atrophy. Accordingly, utilities of GAM190 include diagnosis, prevention and treatment of Dentatorubral-pallidoluysian atrophy, and of other diseases and clinical conditions associated with RERE.

The function of RERE and its association with various diseases and clinical conditions, has been established by previous studies, as described hereinabove with reference to GAM47.1. Regulating synaptic membrane exocytosis 2 (RIMS2, Accession NP_055492.1) is another GAM190 target gene, herein designated TARGET GENE. RIMS2 BINDING SITE is a target binding site found in the 5' untranslated region of mRNA encoded by RIMS2, corresponding to a target binding site such as BINDING SITE I, BINDING SITE II or BINDING SITE III of FIG. 8. Table 4 illustrates the complementarity of the nucleotide sequences of RIMS2 BINDING SITE, designated SEQ ID:14112, to the nucleotide sequence of GAM190 RNA, herein designated GAM RNA, also designated SEQ ID:289.

Another function of GAM190 is therefore inhibition of Regulating synaptic membrane exocytosis 2 (RIMS2, Accession NP_055492.1). Accordingly, utilities of GAM190 include diagnosis, prevention and treatment of diseases and clinical conditions associated with RIMS2.

SEMA6D (Accession NP_705872.1) is another GAM190 target gene, herein designated TARGET GENE. SEMA6D BINDING SITE is a target binding site found in the 3' untranslated region of multiple transcripts of mRNA encoded by SEMA6D, corresponding to a target binding site such as BINDING SITE I, BINDING SITE II or BINDING SITE III of FIG. 8. Table 4 illustrates the complementarity of the nucleotide sequences of SEMA6D BINDING SITE, designated SEQ ID:13936, to the nucleotide sequence of GAM190 RNA, herein designated GAM RNA, also designated SEQ ID:289.

Another function of GAM190 is therefore inhibition of SEMA6D (Accession NP_705872.1). Accordingly, utilities of GAM190 include diagnosis, prevention and treatment of diseases and clinical conditions associated with SEMA6D.

Solute carrier family 9 (sodium/hydrogen exchanger), isoform 1 (antiporter, na+/h+, amiloride sensitive) (SLC9A1, Accession NP_003038.2) is another GAM190 target gene, herein designated TARGET GENE. SLC9A1 BINDING SITE is a target binding site found in the 5' untranslated region of mRNA encoded by SLC9A1, corresponding to a target binding site such as BINDING SITE I, BINDING SITE II or BINDING SITE III of FIG. 8. Table 4 illustrates the complementarity of the nucleotide sequences of SLC9A1 BINDING SITE, designated SEQ ID:7514, to the nucleotide sequence of GAM190 RNA, herein designated GAM RNA, also designated SEQ ID:289.

Another function of GAM190 is therefore inhibition of Solute carrier family 9 (sodium/hydrogen exchanger), isoform 1 (antiporter, na+/h+, amiloride sensitive) (SLC9A1, Accession NP_003038.2), a gene which is involved in ph regulation to eliminate acids generated by active metabolism or to counter adverse environmental conditions. Accordingly, utilities of GAM190 include diagnosis, prevention and treatment of diseases and clinical conditions associated with SLC9A1.

The function of SLC9A1 and its association with various diseases and clinical conditions, has been established by previous studies, as described hereinabove with reference to GAM63.1. SNX24 (Accession NP_054754.1) is another GAM190 target gene, herein designated TARGET GENE. SNX24 BINDING SITE is a target binding site found in the 3' untranslated region of mRNA encoded by SNX24, corresponding to a target binding site such as BINDING SITE I, BINDING SITE II or BINDING SITE III of FIG. 8. Table 4 illustrates the complementarity of the nucleotide sequences of SNX24 BINDING SITE, designated SEQ ID:12825, to the nucleotide sequence of GAM190 RNA, herein designated GAM RNA, also designated SEQ ID:289.

Another function of GAM190 is therefore inhibition of SNX24 (Accession NP_054754.1). Accordingly, utilities of GAM190 include diagnosis, prevention and treatment of diseases and clinical conditions associated with SNX24.

Suppressor of cytokine signaling 1 (SOCS1, Accession NP_003736.1) is another GAM190 target gene, herein designated TARGET GENE. SOCS1 BINDING SITE is a target binding site found in the 3' untranslated region of mRNA encoded by SOCS1, corresponding to a target binding site such as BINDING SITE I, BINDING SITE II or BINDING SITE III of FIG. 8. Table 4 illustrates the complementarity of the nucleotide sequences of SOCS1 BINDING SITE, designated SEQ ID:10166, to the nucleotide sequence of GAM190 RNA, herein designated GAM RNA, also designated SEQ ID:289.

Another function of GAM190 is therefore inhibition of Suppressor of cytokine signaling 1 (SOCS1, Accession NP_003736.1). Accordingly, utilities of GAM190 include diagnosis, prevention and treatment of diseases and clinical conditions associated with SOCS1.

Spondin 1, (f-spondin) extracellular matrix protein (SPON1, Accession NP_006099.1) is another GAM190 target gene, herein designated TARGET GENE. SPON1 BINDING SITE is a target binding site found in the 3' untranslated region of mRNA encoded by SPON1, corresponding to a target binding site such as BINDING SITE I, BINDING SITE II or BINDING SITE III of FIG. 8. Table 4 illustrates the complementarity of the nucleotide sequences of SPON1 BINDING SITE, designated SEQ ID:13425, to the nucleotide sequence of GAM190 RNA, herein designated GAM RNA, also designated SEQ ID:289.

Another function of GAM190 is therefore inhibition of Spondin 1, (f-spondin) extracellular matrix protein (SPON1, Accession NP_006099.1). Accordingly, utilities of GAM190 include diagnosis, prevention and treatment of diseases and clinical conditions associated with SPON1.

Sprouty homolog 3 (drosophila) (SPRY3, Accession NP_005831.1) is another GAM190 target gene, herein designated TARGET GENE. SPRY3 BINDING SITE is a target binding site found in the 3' untranslated region of mRNA encoded by SPRY3, corresponding to a target binding site such as BINDING SITE I, BINDING SITE II or BINDING SITE III of FIG. 8. Table 4 illustrates the complementarity of the nucleotide sequences of SPRY3 BINDING SITE, designated SEQ ID:14598, to the nucleotide sequence of GAM190 RNA, herein designated GAM RNA, also designated SEQ ID:289.

Another function of GAM190 is therefore inhibition of Sprouty homolog 3 (drosophila) (SPRY3, Accession NP_005831.1). Accordingly, utilities of GAM190 include diagnosis, prevention and treatment of diseases and clinical conditions associated with SPRY3.

SSH-3 (Accession NP_060746.2) is another GAM190 target gene, herein designated TARGET GENE. SSH-3 BINDING SITE is a target binding site found in the 3' untranslated region of multiple transcripts of mRNA encoded by SSH-3, corresponding to a target binding site such as BINDING SITE I, BINDING SITE II or BINDING SITE III of FIG. 8. Table 4 illustrates the complementarity of the nucleotide sequences of SSH-3 BINDING SITE, designated SEQ ID:17604, to the nucleotide sequence of GAM190 RNA, herein designated GAM RNA, also designated SEQ ID:289.

Another function of GAM190 is therefore inhibition of SSH-3 (Accession NP_060746.2). Accordingly, utilities of GAM190 include diagnosis, prevention and treatment of diseases and clinical conditions associated with SSH-3.

SSH-3 (Accession NP_060327.2) is another GAM190 target gene, herein designated TARGET GENE. SSH-3 BINDING SITE is a target binding site found in the 3' untranslated region of multiple transcripts of mRNA encoded by SSH-3, corresponding to a target binding site such as BINDING SITE I, BINDING SITE II or BINDING SITE III of FIG. 8. Table 4 illustrates the complementarity of the nucleotide sequences of SSH-3 BINDING SITE, designated SEQ ID:17604, to the nucleotide sequence of GAM190 RNA, herein designated GAM RNA, also designated SEQ ID:289.

Another function of GAM190 is therefore inhibition of SSH-3 (Accession NP_060327.2). Accordingly, utilities of GAM190 include diagnosis, prevention and treatment of diseases and clinical conditions associated with SSH-3.

Suppressor of fused homolog (drosophila) (SUFU, Accession NP_057253.2) is another GAM190 target gene, herein designated TARGET GENE. SUFU BINDING SITE is a target binding site found in the 3' untranslated region of mRNA encoded by SUFU, corresponding to a target binding site such as BINDING SITE I, BINDING SITE II or BINDING SITE III of FIG. 8. Table 4 illustrates the complementarity of the nucleotide sequences of SUFU BINDING SITE, designated SEQ ID:12371, to the nucleotide sequence of GAM190 RNA, herein designated GAM RNA, also designated SEQ ID:289.

Another function of GAM190 is therefore inhibition of Suppressor of fused homolog (drosophila) (SUFU, Accession NP_057253.2). Accordingly, utilities of GAM190 include diagnosis, prevention and treatment of diseases and clinical conditions associated with SUFU.

Srb7 suppressor of rna polymerase b homolog (yeast) (SURB7, Accession NP_004255.2) is another GAM190 target gene, herein designated TARGET GENE. SURB7 BINDING SITE is a target binding site found in the 3' untranslated region of mRNA encoded by SURB7, corresponding to a target binding site such as BINDING SITE I, BINDING SITE II or BINDING SITE III of FIG. 8. Table 4 illustrates the complementarity of the nucleotide sequences of SURB7 BINDING SITE, designated SEQ ID:3571, to the nucleotide sequence of GAM190 RNA, herein designated GAM RNA, also designated SEQ ID:289.

Another function of GAM190 is therefore inhibition of Srb7 suppressor of rna polymerase b homolog (yeast) (SURB7, Accession NP_004255.2). Accordingly, utilities of GAM190 include diagnosis, prevention and treatment of diseases and clinical conditions associated with SURB7.

SUV39H2 (Accession NP_078946.1) is another GAM190 target gene, herein designated TARGET GENE. SUV39H2 BINDING SITE is a target binding site found in the 3' untranslated region of mRNA encoded by SUV39H2, corresponding to a target binding site such as BINDING SITE I, BINDING SITE II or BINDING SITE III of FIG. 8. Table 4 illustrates the complementarity of the nucleotide sequences of SUV39H2 BINDING SITE, designated SEQ ID:3837, to the nucleotide sequence of GAM190 RNA, herein designated GAM RNA, also designated SEQ ID:289.

Another function of GAM190 is therefore inhibition of SUV39H2 (Accession NP_078946.1), a gene which is involved in gene repression and the modification of position-effect-variegation. Accordingly, utilities of GAM190 include diagnosis, prevention and treatment of diseases and clinical conditions associated with SUV39H2.

The function of SUV39H2 has been established by previous studies. O'Carroll et al. (2000) isolated and characterized a murine gene, Suv39h2, that encodes an H3 histone (see OMIM Ref. No. 601128) methyltransferase (OMIM Ref. No. HMTase) with 59% identity to Suv39h1 (OMIM Ref. No. 300254). Although both Suv39h loci displayed overlapping expression profiles during mouse embryogenesis, Suv39h2 transcripts remained specifically expressed in adult testes. Immunolocalization of the Suv39h2 protein during spermatogenesis indicated enriched distribution at the heterochromatin from the leptotene to the round spermatid stage. Moreover, Suv39h2 specifically accumulated with chromatin of the sex chromosomes (XY body, which undergo transcriptional silencing during the first meiotic prophase. These data were consistent with redundant enzymatic roles for Suv39h1 and Suv39h2 during mouse development and suggested an additional function of the Suv39h2 HMTase in organizing meiotic heterochromatin that may even impart an epigenetic imprint to the male germline.

Animal model experiments lend further support to the function of SUV39H2. Peters et al. (2001) generated mice deficient for either Suv39h1 or Suv39h2. These animals displayed normal viability and fertility and did not exhibit apparent phenotypes. The authors subsequently intercrossed Suv39h1 -/- and Suv39h2 -/- mice to generate compound Suv39h mutants that were then used to derive Suv39h double-null mice (Suv39h1 -/- and Suv39h2 -/-). These mice displayed severely impaired viability and chromosomal instabilities that were associated with an increased tumor risk and perturbed chromosome interactions during male meiosis. These data suggested a crucial role for pericentric H3 histone-lys9 methylation in protecting genome stability and defined the Suv39h HMTases as important epigenetic regulators for mammalian development.

It is appreciated that the abovementioned animal model for SUV39H2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

O'Carroll, D.; Scherthan, H.; Peters, A. H. F. M.; Opravil, S.; Haynes, A. R.; Laible, G.; Rea, S.; Schmid, M.; Lebersorger, A.; Jerratsch, M.; Sattler, L.; Mattei, M. G.; Denny, P.; Brown, S. D. M.; Schweizer, D.; Jenuwein, T.: Isolation and characterization of Suv39h2, a second histone H3 methyltransferase gene that displays testis-specific expression. Molec. Cell. Biol. 20:9423-9433, 2000; and Peters, A. H. F. M.; O'Carroll, D.; Scherthan, H.; Mechtler, K.; Sauer, S.; Schofer, C.; Weipoltshammer, K.; Pagani, M.; Lachner, M.; Kohlmaier, A.; Opravil, S.; Doyle, M.; Sibilia, M.

Further studies establishing the function and utilities of SUV39H2 are found in John Hopkins OMIM database record ID 606503, and in cited publications listed in Table 5, which are hereby incorporated by reference. TPH2 (Accession NP_775489.1) is another GAM190 target gene, herein designated TARGET GENE. TPH2 BINDING SITE is a target binding site found in the 3' untranslated region of mRNA encoded by TPH2, corresponding to a target binding site such as BINDING SITE I, BINDING SITE II or BINDING SITE III of FIG. 8. Table 4 illustrates the complementarity of the nucleotide sequences of TPH2 BINDING SITE, designated SEQ ID:11938, to the nucleotide sequence of GAM190 RNA, herein designated GAM RNA, also designated SEQ ID:289.

Another function of GAM190 is therefore inhibition of TPH2 (Accession NP_775489.1). Accordingly, utilities of GAM190 include diagnosis, prevention and treatment of diseases and clinical conditions associated with TPH2.

Trophinin (TRO, Accession NP_808223.1) is another GAM190 target gene, herein designated TARGET GENE. TRO BINDING SITE is a target binding site found in the 3' untranslated region of multiple transcripts of mRNA encoded by TRO, corresponding to a target binding site such as BINDING SITE I, BINDING SITE II or BINDING SITE III of FIG. 8. Table 4 illustrates the complementarity of the nucleotide sequences of TRO BINDING SITE, designated SEQ ID:7155, to the nucleotide sequence of GAM190 RNA, herein designated GAM RNA, also designated SEQ ID:289.

Another function of GAM190 is therefore inhibition of Trophinin (TRO, Accession NP_808223.1), a gene which functions as an adhesion molecule. Accordingly, utilities of GAM190 include diagnosis, prevention and treatment of diseases and clinical conditions associated with TRO.

The function of TRO has been established by previous studies. The initial attachment of the trophoblast to the endometrial epithelium during implantation occurs via the apical cell membranes of the embryonic and maternal cells. Fukuda et al. (1995) found that cells from HT-H, a trophoblastic teratocarcinoma cell line, adhered efficiently to cells from SNG-M, an endometrial adenocarcinoma cell line. The adhesion was homophilic and cell type-specific, and occurred at the respective upper cell surfaces. To identify the adhesion molecules, the authors screened an HT-H expression library in COS-1 cells. They found that expression of 2 distinct cDNAs, encoding trophinin (cloned from trophoblastic cells) and tastin (OMIM Ref. No. 603872), was necessary for adhesion. The deduced 749-amino acid trophinin protein contains 69 tandem repeats of decapeptide sequences. In vitro translated trophinin has a molecular mass of 61 kD. Sequence and structural analyses revealed that trophinin is an intrinsic plasma membrane protein with 8 predicted transmembrane domains, an intracellular N-terminal region, and 3 hydrophilic regions exposed on the cell surface. COS-1 cells expressing trophinin and tastin aggregated in suspension, and soluble peptides of the cell surface domain of trophinin bound to the cell surface of trophinin-expressing cells. Northern blot analysis detected trophinin expression as 3.5-, 7.5-, and 10-kb mRNAs in both HT-H and SNG-M cells. However, neither trophinin nor tastin was expressed in various other human cell types tested, with the exception of macrophages. Using immunofluorescence, Fukuda et al. (1995) detected strong expression of both genes in the trophectoderm surface of monkey blastocysts, as well as in human endometrial surface epithelium at a time consistent with that expected for the 'implantation window.' These authors suggested that trophinin and tastin might mediate the adhesion of the blastocyst to the endometrial epithelium at the time of implantation. Using immunohistochemistry, Suzuki et al. (1999) determined that trophinin and bystin (OMIM Ref. No. 603871), a trophinin- and tastin-binding protein, were found in the placenta from the sixth week of pregnancy. Trophinin and bystin were localized in the cytoplasm of the syncytiotrophoblast in the chorionic villi and in endometrial decidual cells at the uteroplacental interface. After week 10, the levels of trophinin, tastin, and bystin decreased and then disappeared from placental villi.

Full details of the abovementioned studies are described in the following publications, the disclosure of which are hereby incorporated by reference:

Fukuda, M. N.; Sato, T.; Nakayama, J.; Klier, G.; Mikami, M.; Aoki, D.; Nozawa, S. : Trophinin and tastin, a novel cell adhesion molecule complex with potential involvement in embryo implantation. Genes Dev. 9:1199-1210, 1995; and Suzuki, N.; Nakayama, J.; Shih, I. M.; Aoki, D.; Nozawa, S.; Fukuda, M. N.: Expression of trophinin, tastin, and bystin by trophoblast and endometrial cells in human placenta. Biol. Reprod.

Further studies establishing the function and utilities of TRO are found in John Hopkins OMIM database record ID 300132, and in cited publications listed in Table 5, which are hereby incorporated by reference. Trophinin (TRO, Accession NP_808226.1) is another GAM190 target gene, herein designated TARGET GENE. TRO BINDING SITE is a target binding site found in the 3' untranslated region of multiple transcripts of mRNA encoded by TRO, corresponding to a target binding site such as BINDING SITE I, BINDING SITE II or BINDING SITE III of FIG. 8. Table 4 illustrates the complementarity of the nucleotide sequences of TRO BINDING SITE, designated SEQ ID:7155, to the nucleotide sequence of GAM190 RNA, herein designated GAM RNA, also designated SEQ ID:289.

Another function of GAM190 is therefore inhibition of Trophinin (TRO, Accession NP_808226.1), a gene which functions as an adhesion molecule. Accordingly, utilities of GAM190 include diagnosis, prevention and treatment of diseases and clinical conditions associated with TRO.

The function of TRO has been established by previous studies. The initial attachment of the trophoblast to the endometrial epithelium during implantation occurs via the apical cell membranes of the embryonic and maternal cells. Fukuda et al. (1995) found that cells from HT-H, a trophoblastic teratocarcinoma cell line, adhered efficiently to cells from SNG-M, an endometrial adenocarcinoma cell line. The adhesion was homophilic and cell type-specific, and occurred at the respective upper cell surfaces. To identify the adhesion molecules, the authors screened an HT-H expression library in COS-1 cells. They found that expression of 2 distinct cDNAs, encoding trophinin (cloned from trophoblastic cells) and tastin (OMIM Ref. No. 603872), was necessary for adhesion. The deduced 749-amino acid trophinin protein contains 69 tandem repeats of decapeptide sequences. In vitro translated trophinin has a molecular mass of 61 kD. Sequence and structural analyses revealed that trophinin is an intrinsic plasma membrane protein with 8 predicted transmembrane domains, an intracellular N-terminal region, and 3 hydrophilic regions exposed on the cell surface. COS-1 cells expressing trophinin and tastin aggregated in suspension, and soluble peptides of the cell surface domain of trophinin bound to the cell surface of trophinin-expressing cells. Northern blot analysis detected trophinin expression as 3.5-, 7.5-, and 10-kb mRNAs in both HT-H and SNG-M cells. However, neither trophinin nor tastin was expressed in various other human cell types tested, with the exception of macrophages. Using immunofluorescence, Fukuda et al. (1995) detected strong expression of both genes in the trophectoderm surface of monkey blastocysts, as well as in human endometrial surface epithelium at a time consistent with that expected for the 'implantation window.' These authors suggested that trophinin and tastin might mediate the adhesion of the blastocyst to the endometrial epithelium at the time of implantation. Using immunohistochemistry, Suzuki et al. (1999) determined that trophinin and bystin (OMIM Ref. No. 603871), a trophinin- and tastin-binding protein, were found in the placenta from the sixth week of pregnancy. Trophinin and bystin were localized in the cytoplasm of the syncytiotrophoblast in the chorionic villi and in endometrial decidual cells at the uteroplacental interface. After week 10, the levels of trophinin, tastin, and bystin decreased and then disappeared from placental villi.

Full details of the abovementioned studies are described in the following publications, the disclosure of which are hereby incorporated by reference:

Fukuda, M. N.; Sato, T.; Nakayama, J.; Klier, G.; Mikami, M.; Aoki, D.; Nozawa, S. : Trophinin and tastin, a novel cell adhesion molecule complex with potential involvement in embryo implantation. Genes Dev. 9:1199-1210, 1995; and Suzuki, N.; Nakayama, J.; Shih, I. M.; Aoki, D.; Nozawa, S.; Fukuda, M. N.: Expression of trophinin, tastin, and bystin by trophoblast and endometrial cells in human placenta. Biol. Reprod.

Further studies establishing the function and utilities of TRO are found in John Hopkins OMIM database record ID 300132, and in cited publications listed in Table 5, which are hereby incorporated by reference. Transient receptor potential cation channel, subfamily v, member 3 (TRPV3, Accession NP_659505.1) is another GAM190 target gene, herein designated TARGET GENE. TRPV3 BINDING SITE is a target binding site found in the 3' untranslated region of mRNA encoded by TRPV3, corresponding to a target binding site such as BINDING SITE I, BINDING SITE II or BINDING SITE III of FIG. 8. Table 4 illustrates the complementarity of the nucleotide sequences of TRPV3 BINDING SITE, designated SEQ ID:668, to the nucleotide sequence of GAM190 RNA, herein designated GAM RNA, also designated SEQ ID:289.

Another function of GAM190 is therefore inhibition of Transient receptor potential cation channel, subfamily v, member 3 (TRPV3, Accession NP_659505.1). Accordingly, utilities of GAM190 include diagnosis, prevention and treatment of diseases and clinical conditions associated with TRPV3.

Ubiquilin 2 (UBQLN2, Accession NP_038472.2) is another GAM190 target gene, herein designated TARGET GENE. UBQLN2 BINDING SITE is a target binding site found in the 3' untranslated region of mRNA encoded by UBQLN2, corresponding to a target binding site such as BINDING SITE I, BINDING SITE II or BINDING SITE III of FIG. 8. Table 4 illustrates the complementarity of the nucleotide sequences of UBQLN2 BINDING SITE, designated SEQ ID:17562, to the nucleotide sequence of GAM190 RNA, herein designated GAM RNA, also designated SEQ ID:289.

Another function of GAM190 is therefore inhibition of Ubiquilin 2 (UBQLN2, Accession NP_038472.2), a gene which is involved in spindle pole body duplication with rad23. Accordingly, utilities of GAM190 include diagnosis, prevention and treatment of diseases and clinical conditions associated with UBQLN2.

The function of UBQLN2 has been established by previous studies. By performing independent yeast 2-hybrid screens, Kleijnen et al. (2000) isolated cDNAs encoding PLIC1 (UBQLN1; 605046) and PLIC2, homologs of the mouse Plics (proteins linking integrin-associated protein (IAP; 601028) and cytoskeleton) and the yeast Dsk2 protein. The predicted 624-amino acid PLIC2 protein, also called UBQLN2, shares 72% amino acid identity with PLIC1. Two motifs are conserved in the mammalian PLICs and yeast Dsk2, an N-terminal ubiquitin (OMIM Ref. No. 191320)-like (UBL) domain and a C-terminal ubiquitin-associated (UBA) domain. Unlike ubiquitin, the UBL domain of the PLICs does not have a diglycine motif in its C terminus; the diglycine motif serves as a target site for cellular hydrolases that release ubiquitin from precursor fusion proteins. The absence of a GG sequence suggests that the UBL domain in the PLICs is an integral part of the open reading frame. The UBA domain is a loosely defined sequence motif present in multiple enzyme classes of the ubiquitination machinery. The most notable difference between the mammalian PLICs is the presence of a collagen-like motif in PLIC2 that is absent in PLIC1 and yeast Dsk2. This domain is most homologous to the collagen-like oncoprotein of herpesvirus Saimiri, STP- C488, which is implicated in intracellular signaling via the RAS-RAF pathway (see OMIM Ref. No. 190020). The collagen-like domain of PLIC2 contains 8 PXGP motifs that are susceptible to cleavage by collagenase in vitro. Kleijnen et al (2000) showed that the human PLICs physically associate with both proteasomes and ubiquitin ligases in large complexes. Overexpression of PLICs interfered with the in vivo degradation of 2 unrelated ubiquitin-dependent proteasome substrates, p53 (OMIM Ref. No. 191170) and I-kappa-B-alpha (NFKBIA; 164008), but not a ubiquitin-independent substrate. These findings raised the possibility that the PLICs, and possibly related ubiquitin-like family members, may functionally link the ubiquitination machinery to the proteasome to affect in vivo protein degradation. By screening a human lung 2-hybrid cDNA library using a pGBT9-STCH (OMIM Ref. No. 601100) plasmid as bait, Kaye et al. (2000) isolated a cDNA encoding UBQLN2, which they termed CHAP1/DSK2. Mutation analysis determined that the C-terminal Sti1-like repeat sequence, but neither the N- terminal UBL domain nor the C-terminal UBA domain, is required for binding of UBQLN2 to the ATPase domain of STCH.

Full details of the abovementioned studies are described in the following publications, the disclosure of which are hereby incorporated by reference:

Kay, F. J.; Shows, T. B.: Assignment of ubiquilin 2 (UBQLN2) to human chromosome xp11.23-p11.1 by GeneBridge radiation hybrids. Cytogenet. Cell Genet. 89:116-117, 2000; and Kleijnen, M. F.; Shih, A. H.; Zhou, P.; Kumar, S.; Soccio, R. E.; Kedersha, N. L.; Gill, G.; Howley, P. M.: The hPLIC proteins may provide a link between the ubiquitination machinery.

Further studies establishing the function and utilities of UBQLN2 are found in John Hopkins OMIM database record ID 300264, and in cited publications listed in Table 5, which are hereby incorporated by reference. Unc-5 homolog b (c. elegans) (UNC5C, Accession NP_003719.2) is another GAM190 target gene, herein designated TARGET GENE. UNC5C BINDING SITE is a target binding site found in the 3' untranslated region of mRNA encoded by UNC5C, corresponding to a target binding site such as BINDING SITE I, BINDING SITE II or BINDING SITE III of FIG. 8. Table 4 illustrates the complementarity of the nucleotide sequences of UNC5C BINDING SITE, designated SEQ ID:19876, to the nucleotide sequence of GAM190 RNA, herein designated GAM RNA, also designated SEQ ID:289.

Another function of GAM190 is therefore inhibition of Unc-5 homolog b (c. elegans) (UNC5C, Accession NP_003719.2), a gene which is a putative receptor for netrin, which is involved in axon guidance. Accordingly, utilities of GAM190 include diagnosis, prevention and treatment of diseases and clinical conditions associated with UNC5C.

The function of UNC5C has been established by previous studies. Migration of neurons from proliferative zones to their functional sites is fundamental to the normal development of the central nervous system. Mice homozygous for the rostral cerebellar malformation (rcm) mutation exhibit cerebellar and midbrain defects, apparently as a result of abnormal neuronal migration. Ackerman et al. (1997) reported that in rcm-mutant mice, the cerebellum is smaller and has fewer folia than in wildtype, ectopic cerebellar cells are present in midbrain regions by 3 days after birth, and there are abnormalities in postnatal cerebellar-neuronal migration. The authors isolated cDNAs encoding the rcm protein (Rcm). Sequence analysis revealed that the predicted 931-amino acid mouse protein is a transmembrane protein that contains 2 immunoglobulin (Ig)-like domains and 2 type I thrombospondin (THBS1; 188060) motifs in the extracellular region. Ig and THBS1 domains are also found in the extracellular region of the C. elegans UNC5 transmembrane protein, and the C-terminal 865-amino acid region of Rcm is 30% identical to UNC5. Ackerman et al. (1997) stated that the UNC5 protein is essential for dorsal guidance of pioneer axons and for the movement of cells away from the netrin ligand. In the developing brain of vertebrates, netrin-1 (OMIM Ref. No. 601614) plays a role in both cell migration and axonal guidance. Leonardo et al. (1997) demonstrated that Rcm binds netrin-1 in vitro. Ackerman et al. (1997) concluded that Rcm and its ligand are important in critical migratory and/or cell-proliferation events during cerebellar development. Przyborski et al. (1998) found that disruption of the mouse rcm gene, also called the Unc5h3 gene, resulted in a failure of tangentially migrating granule cells to recognize the rostral boundary of the cerebellum. By searching an EST database for sequences related to the Unc5h3 gene, Ackerman and Knowles (1998) identified a partial human fetal brain cDNA encoding UNC5C, the human Unc5h3 homolog. Using 5-prime RACE, they cloned a cDNA corresponding to the entire UNC5C coding region. The predicted 931-amino acid human protein has the overall domain structure of UNC5 family proteins, and is 97% identical to Unc5h3. Northern blot analysis revealed that the 9.5-kb UNC5 mRNA is expressed in brain and heart, and at low levels in kidney.

Full details of the abovementioned studies are described in the following publications, the disclosure of which are hereby incorporated by reference:

Przyborski, S. A.; Knowles, B. B.; Ackerman, S. L.: Embryonic phenotype of Unc5h3 mutant mice suggests chemorepulsion during the formation of the rostral cerebellar boundary. Development 125:41-50, 1998; and Ackerman, S. L.; Knowles, B. B.: Cloning and mapping of the UNC5C gene to human chromosome 4q21-q23. Genomics 52:205-208, 1998.

Further studies establishing the function and utilities of UNC5C are found in John Hopkins OMIM database record ID 603610, and in cited publications listed in Table 5, which are hereby incorporated by reference. Reserved (WDR17, Accession NP_733828.2) is another GAM190 target gene, herein designated TARGET GENE. WDR17 BINDING SITE is a target binding site found in the 3' untranslated region of multiple transcripts of mRNA encoded by WDR17, corresponding to a target binding site such as BINDING SITE I, BINDING SITE II or BINDING SITE III of FIG. 8. Table 4 illustrates the complementarity of the nucleotide sequences of WDR17 BINDING SITE, designated SEQ ID:1039, to the nucleotide sequence of GAM190 RNA, herein designated GAM RNA, also designated SEQ ID:289.

Another function of GAM190 is therefore inhibition of Reserved (WDR17, Accession NP_733828.2). Accordingly, utilities of GAM190 include diagnosis, prevention and treatment of diseases and clinical conditions associated with WDR17.

ZBTB2 (Accession NP_065912.1) is another GAM190 target gene, herein designated TARGET GENE. ZBTB2 BINDING SITE is a target binding site found in the 3' untranslated region of mRNA encoded by ZBTB2, corresponding to a target binding site such as BINDING SITE I, BINDING SITE II or BINDING SITE III of FIG. 8. Table 4 illustrates the complementarity of the nucleotide sequences of ZBTB2 BINDING SITE, designated SEQ ID:12940, to the nucleotide sequence of GAM190 RNA, herein designated GAM RNA, also designated SEQ ID:289.

Another function of GAM190 is therefore inhibition of ZBTB2 (Accession NP_065912.1). Accordingly, utilities of GAM190 include diagnosis, prevention and treatment of diseases and clinical conditions associated with ZBTB2.

Zinc finger protein 179 (ZNF179, Accession NP_009079.1) is another GAM190 target gene, herein designated TARGET GENE. ZNF179 BINDING SITE is a target binding site found in the 3' untranslated region of mRNA encoded by ZNF179, corresponding to a target binding site such as BINDING SITE I, BINDING SITE II or BINDING SITE III of FIG. 8. Table 4 illustrates the complementarity of the nucleotide sequences of ZNF179 BINDING SITE, designated SEQ ID:13355, to the nucleotide sequence of GAM190 RNA, herein designated GAM RNA, also designated SEQ ID:289.

Another function of GAM190 is therefore inhibition of Zinc finger protein 179 (ZNF179, Accession NP_009079.1), a gene which has zink finger and a member of the RING finger protein family of transcription factors. and therefore may be associated with Smith-magenis syndrome. Accordingly, utilities of GAM190 include diagnosis, prevention and treatment of Smith-magenis syndrome, and of other diseases and clinical conditions associated with ZNF179.

The function of ZNF179 and its association with various diseases and clinical conditions, has been established by previous studies, as described hereinabove with reference to GAM63.1. Zinc finger protein 213 (ZNF213, Accession XP_036493.1) is another GAM190 target gene, herein designated TARGET GENE. ZNF213 BINDING SITE is a target binding site found in the 3' untranslated region of mRNA encoded by ZNF213, corresponding to a target binding site such as BINDING SITE I, BINDING SITE II or BINDING SITE III of FIG. 8. Table 4 illustrates the complementarity of the nucleotide sequences of ZNF213 BINDING SITE, designated SEQ ID:6621, to the nucleotide sequence of GAM190 RNA, herein designated GAM RNA, also designated SEQ ID:289.

Another function of GAM190 is therefore inhibition of Zinc finger protein 213 (ZNF213, Accession XP_036493.1). Accordingly, utilities of GAM190 include diagnosis, prevention and treatment of diseases and clinical conditions associated with ZNF213.

Zinc finger protein 264 (ZNF264, Accession NP_003408.1) is another GAM190 target gene, herein designated TARGET GENE. ZNF264 BINDING SITE is a target binding site found in the 3' untranslated region of mRNA encoded by ZNF264, corresponding to a target binding site such as BINDING SITE I, BINDING SITE II or BINDING SITE III of FIG. 8. Table 4 illustrates the complementarity of the nucleotide sequences of ZNF264 BINDING SITE, designated SEQ ID:15761, to the nucleotide sequence of GAM190 RNA, herein designated GAM RNA, also designated SEQ ID:289.

Another function of GAM190 is therefore inhibition of Zinc finger protein 264 (ZNF264, Accession NP_003408.1). Accordingly, utilities of GAM190 include diagnosis, prevention and treatment of diseases and clinical conditions associated with ZNF264.

FIG. 8 further provides a conceptual description of a novel bioinformatically detected of the present invention, referred to here as Genomic Address Messenger 191 (GAM191), which modulates expression of respective target genes thereof, the function and utility of which target genes is known in the art.

GAM191 is a novel bioinformatically detected regulatory, non protein coding, micro RNA (miRNA) gene. The method by which GAM191 was detected is described hereinabove with reference to FIGS. 8-15.

GAM191 gene, herein designated GAM GENE, and GAM191 target gene, herein designated TARGET GENE, are human genes contained in the human genome.

GAM191 gene encodes a GAM191 precursor RNA, herein designated GAM PRECURSOR RNA. Similar to other miRNA genes, and unlike most ordinary genes, GAM191 precursor RNA does not encode a protein. A nucleotide sequence identical or highly similar to the nucleotide sequence of GAM191 precursor RNA is designated SEQ ID:165, and is provided hereinbelow with reference to the sequence listing part.

GAM191 precursor RNA folds onto itself, forming GAM191 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM191 precursor RNA folds onto itself, forming GAM191 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM191 precursor RNA, designated SEQ-ID:165, and a schematic representation of a predicted secondary folding of GAM191 folded precursor RNA are further described with reference to Table 2, hereby incorporated by reference.

An enzyme complex designated DICER COMPLEX, 'dices' the GAM191 folded precursor RNA into GAM191 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM191 RNA is designated SEQ ID:389, and is provided hereinbelow with references to the sequence listing part and Table 3, hereby incorporated by reference.

GAM191 target gene, herein designated TARGET GENE, encodes a corresponding messenger RNA, GAM191 target RNA, herein designated GAM TARGET RNA. GAM191 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM191 RNA, herein designated GAM RNA, binds complementarily to one or more target binding sites located in untranslated regions of GAM191 target RNA, herein designated GAM TARGET RNA. This complementary binding is due to the fact that the nucleotide sequence of GAM191 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM191 RNA may have a different number of target binding sites in untranslated regions of a GAM191 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM191 RNA, herein designated GAM RNA, to target binding sites on GAM191 target RNA, herein designated GAM TARGET RNA, such as BINDING SITE I, BINDING SITE II and BINDING SITE III, inhibits translation of GAM191 target RNA into GAM191 target protein, herein designated GAM TARGET PROTEIN. GAM target protein is therefore outlined by a broken line.

It is appreciated that GAM191 target gene, herein designated TARGET GENE, in fact represents a plurality of GAM191 target genes. The mRNA of each one of this plurality of GAM191 target genes comprises one or more target binding sites, each having a nucleotide sequence which is at least partly complementary to GAM191 RNA, herein designated GAM RNA, and which when bound by GAM191 RNA causes inhibition of translation of respective one or more GAM191 target proteins.

It is further appreciated by one skilled in the art that the mode of translational inhibition illustrated by FIG. 8 with specific reference to translational inhibition exerted by GAM191 gene, herein designated GAM GENE, on one or more GAM191 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM191 correlate with, and may be deduced from, the identity of the target genes which GAM191 binds and inhibits, and the function of these target genes, as elaborated hereinbelow.

PRO1048 (Accession NM_018497.1) is a GAM191 target gene, herein designated TARGET GENE. PRO1048 BINDING SITE is a target binding site found in the 3' untranslated region of mRNA encoded by PRO1048, corresponding to a target binding site such as BINDING SITE I, BINDING SITE II or BINDING SITE III of FIG. 8. Table 4 illustrates the complementarity of the nucleotide sequences of PRO1048 BINDING SITE, designated SEQ ID:7282, to the nucleotide sequence of GAM191 RNA, herein designated GAM RNA, also designated SEQ ID:389.

A function of GAM191 is therefore inhibition of PRO1048 (Accession NM_018497.1). Accordingly, utilities of GAM191 include diagnosis, prevention and treatment of diseases and clinical conditions associated with PRO1048.

FIG. 8 further provides a conceptual description of a novel bioinformatically detected of the present invention, referred to here as Genomic Address Messenger 192 (GAM192), which modulates expression of respective target genes thereof, the function and utility of which target genes is known in the art.

GAM192 is a novel bioinformatically detected regulatory, non protein coding, micro RNA (miRNA) gene. The method by which GAM192 was detected is described hereinabove with reference to FIGS. 8-15.

GAM192 gene, herein designated GAM GENE, and GAM192 target gene, herein designated TARGET GENE, are human genes contained in the human genome.

GAM192 gene encodes a GAM192 precursor RNA, herein designated GAM PRECURSOR RNA. Similar to other miRNA genes, and unlike most ordinary genes, GAM192 precursor RNA does not encode a protein. A nucleotide sequence identical or highly similar to the nucleotide sequence of GAM192 precursor RNA is designated SEQ ID:70, and is provided hereinbelow with reference to the sequence listing part. Nucleotide sequence SEQ ID:70 is located at position 208634246 relative to chromosome 2.

GAM192 precursor RNA folds onto itself, forming GAM192 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM192 precursor RNA folds onto itself, forming GAM192 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM192 precursor RNA, designated SEQ-ID:70, and a schematic representation of a predicted secondary folding of GAM192 folded precursor RNA are further described with reference to Table 2, hereby incorporated by reference.

An enzyme complex designated DICER COMPLEX, 'dices' the GAM192 folded precursor RNA into GAM192 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM192 RNA is designated SEQ ID:393, and is provided hereinbelow with references to the sequence listing part and Table 3, hereby incorporated by reference.

GAM192 target gene, herein designated TARGET GENE, encodes a corresponding messenger RNA, GAM192 target RNA, herein designated GAM TARGET RNA. GAM192 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM192 RNA, herein designated GAM RNA, binds complementarily to one or more target binding sites located in untranslated regions of GAM192 target RNA, herein designated GAM TARGET RNA. This complementary binding is due to the fact that the nucleotide sequence of GAM192 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM192 RNA may have a different number of target binding sites in untranslated regions of a GAM192 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM192 RNA, herein designated GAM RNA, to target binding sites on GAM192 target RNA, herein designated GAM TARGET RNA, such as BINDING SITE I, BINDING SITE II and BINDING SITE III, inhibits translation of GAM192 target RNA into GAM192 target protein, herein designated GAM TARGET PROTEIN. GAM target protein is therefore outlined by a broken line.

It is appreciated that GAM192 target gene, herein designated TARGET GENE, in fact represents a plurality of GAM192 target genes. The mRNA of each one of this plurality of GAM192 target genes comprises one or more target binding sites, each having a nucleotide sequence which is at least partly complementary to GAM192 RNA, herein designated GAM RNA, and which when bound by GAM192 RNA causes inhibition of translation of respective one or more GAM192 target proteins.

It is further appreciated by one skilled in the art that the mode of translational inhibition illustrated by FIG. 8 with specific reference to translational inhibition exerted by GAM192 gene, herein designated GAM GENE, on one or more GAM192 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM192 correlate with, and may be deduced from, the identity of the target genes which GAM192 binds and inhibits, and the function of these target genes, as elaborated hereinbelow.

A kinase (prka) anchor protein 2 (AKAP2, Accession) is a GAM192 target gene, herein designated TARGET GENE. AKAP2 BINDING SITE is a target binding site found in the 3' untranslated region of multiple transcripts of mRNA encoded by AKAP2, corresponding to a target binding site such as BINDING SITE I, BINDING SITE II or BINDING SITE III of FIG. 8. Table 4 illustrates the complementarity of the nucleotide sequences of AKAP2 BINDING SITE, designated SEQ ID:7475, to the nucleotide sequence of GAM192 RNA, herein designated GAM RNA, also designated SEQ ID:393.

A function of GAM192 is therefore inhibition of A kinase (prka) anchor protein 2 (AKAP2, Accession), a gene which binds to regulatory subunit (rii) of protein kinase a. Accordingly, utilities of GAM192 include diagnosis, prevention and treatment of diseases and clinical conditions associated with AKAP2.

The function of AKAP2 and its association with various diseases and clinical conditions, has been established by previous studies, as described hereinabove with reference to GAM94.1. KIAA1336 (Accession NM_020779.1) is another GAM192 target gene, herein designated TARGET GENE. KIAA1336 BINDING SITE is a target binding site found in the 3' untranslated region of mRNA encoded by KIAA1336, corresponding to a target binding site such as BINDING SITE I, BINDING SITE II or BINDING SITE III of FIG. 8. Table 4 illustrates the complementarity of the nucleotide sequences of KIAA1336 BINDING SITE, designated SEQ ID:4284, to the nucleotide sequence of GAM192 RNA, herein designated GAM RNA, also designated SEQ ID:393.

Another function of GAM192 is therefore inhibition of KIAA1336 (Accession NM_020779.1). Accordingly, utilities of GAM192 include diagnosis, prevention and treatment of diseases and clinical conditions associated with KIAA1336.

FIG. 8 further provides a conceptual description of a novel bioinformatically detected of the present invention, referred to here as Genomic Address Messenger 193 (GAM193), which modulates expression of respective target genes thereof, the function and utility of which target genes is known in the art.

GAM193 is a novel bioinformatically detected regulatory, non protein coding, micro RNA (miRNA) gene. The method by which GAM193 was detected is described hereinabove with reference to FIGS. 8-15.

GAM193 gene, herein designated GAM GENE, and GAM193 target gene, herein designated TARGET GENE, are human genes contained in the human genome.

GAM193 gene encodes a GAM193 precursor RNA, herein designated GAM PRECURSOR RNA. Similar to other miRNA genes, and unlike most ordinary genes, GAM193 precursor RNA does not encode a protein. A nucleotide sequence identical or highly similar to the nucleotide sequence of GAM193 precursor RNA is designated SEQ ID:139, and is provided hereinbelow with reference to the sequence listing part. Nucleotide sequence SEQ ID:139 is located at position 362 relative to chromosome 7.

GAM193 precursor RNA folds onto itself, forming GAM193 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM193 precursor RNA folds onto itself, forming GAM193 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM193 precursor RNA, designated SEQ-ID:139, and a schematic representation of a predicted secondary folding of GAM193 folded precursor RNA are further described with reference to Table 2, hereby incorporated by reference.

An enzyme complex designated DICER COMPLEX, 'dices' the GAM193 folded precursor RNA into GAM193 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM193 RNA is designated SEQ ID:268, and is provided hereinbelow with references to the sequence listing part and Table 3, hereby incorporated by reference.

GAM193 target gene, herein designated TARGET GENE, encodes a corresponding messenger RNA, GAM193 target RNA, herein designated GAM TARGET RNA. GAM193 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM193 RNA, herein designated GAM RNA, binds complementarily to one or more target binding sites located in untranslated regions of GAM193 target RNA, herein designated GAM TARGET RNA. This complementary binding is due to the fact that the nucleotide sequence of GAM193 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM193 RNA may have a different number of target binding sites in untranslated regions of a GAM193 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM193 RNA, herein designated GAM RNA, to target binding sites on GAM193 target RNA, herein designated GAM TARGET RNA, such as BINDING SITE I, BINDING SITE II and BINDING SITE III, inhibits translation of GAM193 target RNA into GAM193 target protein, herein designated GAM TARGET PROTEIN. GAM target protein is therefore outlined by a broken line.

It is appreciated that GAM193 target gene, herein designated TARGET GENE, in fact represents a plurality of GAM193 target genes. The mRNA of each one of this plurality of GAM193 target genes comprises one or more target binding sites, each having a nucleotide sequence which is at least partly complementary to GAM193 RNA, herein designated GAM RNA, and which when bound by GAM193 RNA causes inhibition of translation of respective one or more GAM193 target proteins.

It is further appreciated by one skilled in the art that the mode of translational inhibition illustrated by FIG. 8 with specific reference to translational inhibition exerted by GAM193 gene, herein designated GAM GENE, on one or more GAM193 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM193 correlate with, and may be deduced from, the identity of the target genes which GAM193 binds and inhibits, and the function of these target genes, as elaborated hereinbelow.

AHRR (Accession NP_065782.1) is a GAM193 target gene, herein designated TARGET GENE. AHRR BINDING SITE is a target binding site found in the 3' untranslated region of mRNA encoded by AHRR, corresponding to a target binding site such as BINDING SITE I, BINDING SITE II or BINDING SITE III of FIG. 8. Table 4 illustrates the complementarity of the nucleotide sequences of AHRR BINDING SITE, designated SEQ ID:2984, to the nucleotide sequence of GAM193 RNA, herein designated GAM RNA, also designated SEQ ID:268.

A function of GAM193 is therefore inhibition of AHRR (Accession NP_065782.1). Accordingly, utilities of GAM193 include diagnosis, prevention and treatment of diseases and clinical conditions associated with AHRR.

Aldo-keto reductase family 7, member a3 (aflatoxin aldehyde reductase) (AKR7A3, Accession NP_036199.1) is another GAM193 target gene, herein designated TARGET GENE. AKR7A3 BINDING SITE is a target binding site found in the 3' untranslated region of mRNA encoded by AKR7A3, corresponding to a target binding site such as BINDING SITE I, BINDING SITE II or BINDING SITE III of FIG. 8. Table 4 illustrates the complementarity of the nucleotide sequences of AKR7A3 BINDING SITE, designated SEQ ID:11149, to the nucleotide sequence of GAM193 RNA, herein designated GAM RNA, also designated SEQ ID:268.

Another function of GAM193 is therefore inhibition of Aldo-keto reductase family 7, member a3 (aflatoxin aldehyde reductase) (AKR7A3, Accession NP_036199.1). Accordingly, utilities of GAM193 include diagnosis, prevention and treatment of diseases and clinical conditions associated with AKR7A3.

Angiomotin like 1 (AMOTL1, Accession NP_570899.1) is another GAM193 target gene, herein designated TARGET GENE. AMOTL1 BINDING SITE is a target binding site found in the 3' untranslated region of mRNA encoded by AMOTL1, corresponding to a target binding site such as BINDING SITE I, BINDING SITE II or BINDING SITE III of FIG. 8. Table 4 illustrates the complementarity of the nucleotide sequences of AMOTL1 BINDING SITE, designated SEQ ID:14975, to the nucleotide sequence of GAM193 RNA, herein designated GAM RNA, also designated SEQ ID:268.

Another function of GAM193 is therefore inhibition of Angiomotin like 1 (AMOTL1, Accession NP_570899.1). Accordingly, utilities of GAM193 include diagnosis, prevention and treatment of diseases and clinical conditions associated with AMOTL1.

Bcl2-like 13 (apoptosis facilitator) (BCL2L13, Accession NP_056182.1) is another GAM193 target gene, herein designated TARGET GENE. BCL2L13 BINDING SITE is a target binding site found in the 3' untranslated region of mRNA encoded by BCL2L13, corresponding to a target binding site such as BINDING SITE I, BINDING SITE II or BINDING SITE III of FIG. 8. Table 4 illustrates the complementarity of the nucleotide sequences of BCL2L13 BINDING SITE, designated SEQ ID:14529, to the nucleotide sequence of GAM193 RNA, herein designated GAM RNA, also designated SEQ ID:268.

Another function of GAM193 is therefore inhibition of Bcl2-like 13 (apoptosis facilitator) (BCL2L13, Accession NP_056182.1). Accordingly, utilities of GAM193 include diagnosis, prevention and treatment of diseases and clinical conditions associated with BCL2L13.

Chromosome 2 open reading frame 7 (C2orf7, Accession NP_115695.1) is another GAM193 target gene, herein designated TARGET GENE. C2orf7 BINDING SITE is a target binding site found in the 3' untranslated region of mRNA encoded by C2orf7, corresponding to a target binding site such as BINDING SITE I, BINDING SITE II or BINDING SITE III of FIG. 8. Table 4 illustrates the complementarity of the nucleotide sequences of C2orf7 BINDING SITE, designated SEQ ID:11975, to the nucleotide sequence of GAM193 RNA, herein designated GAM RNA, also designated SEQ ID:268.

Another function of GAM193 is therefore inhibition of Chromosome 2 open reading frame 7 (C2orf7, Accession NP_115695.1). Accordingly, utilities of GAM193 include diagnosis, prevention and treatment of diseases and clinical conditions associated with C2orf7.

C4ST (Accession NP_060883.1) is another GAM193 target gene, herein designated TARGET GENE. C4ST BINDING SITE is a target binding site found in the 3' untranslated region of mRNA encoded by C4ST, corresponding to a target binding site such as BINDING SITE I, BINDING SITE II or BINDING SITE III of FIG. 8. Table 4 illustrates the complementarity of the nucleotide sequences of C4ST BINDING SITE, designated SEQ ID:18004, to the nucleotide sequence of GAM193 RNA, herein designated GAM RNA, also designated SEQ ID:268.

Another function of GAM193 is therefore inhibition of C4ST (Accession NP_060883.1). Accordingly, utilities of GAM193 include diagnosis, prevention and treatment of diseases and clinical conditions associated with C4ST.

Calcium channel, voltage-dependent, beta 2 subunit (CACNB2, Accession NP_000715.1) is another GAM193 target gene, herein designated TARGET GENE. CACNB2 BINDING SITE is a target binding site found in the 3' untranslated region of mRNA encoded by CACNB2, corresponding to a target binding site such as BINDING SITE I, BINDING SITE II or BINDING SITE III of FIG. 8. Table 4 illustrates the complementarity of the nucleotide sequences of CACNB2 BINDING SITE, designated SEQ ID:11254, to the nucleotide sequence of GAM193 RNA, herein designated GAM RNA, also designated SEQ ID:268.

Another function of GAM193 is therefore inhibition of Calcium channel, voltage-dependent, beta 2 subunit (CACNB2, Accession NP_000715.1). Accordingly, utilities of GAM193 include diagnosis, prevention and treatment of diseases and clinical conditions associated with CACNB2.

Calpain 2, (m/ii) large subunit (CAPN2, Accession NP_001739.1) is another GAM193 target gene, herein designated TARGET GENE. CAPN2 BINDING SITE is a target binding site found in the 3' untranslated region of mRNA encoded by CAPN2, corresponding to a target binding site such as BINDING SITE I, BINDING SITE II or BINDING SITE III of FIG. 8. Table 4 illustrates the complementarity of the nucleotide sequences of CAPN2 BINDING SITE, designated SEQ ID:4529, to the nucleotide sequence of GAM193 RNA, herein designated GAM RNA, also designated SEQ ID:268.

Another function of GAM193 is therefore inhibition of Calpain 2, (m/ii) large subunit (CAPN2, Accession NP_001739.1). Accordingly, utilities of GAM193 include diagnosis, prevention and treatment of diseases and clinical conditions associated with CAPN2.

Carboxypeptidase d (CPD, Accession NP_001295.2) is another GAM193 target gene, herein designated TARGET GENE. CPD BINDING SITE is a target binding site found in the 3' untranslated region of mRNA encoded by CPD, corresponding to a target binding site such as BINDING SITE I, BINDING SITE II or BINDING SITE III of FIG. 8. Table 4 illustrates the complementarity of the nucleotide sequences of CPD BINDING SITE, designated SEQ ID:7505, to the nucleotide sequence of GAM193 RNA, herein designated GAM RNA, also designated SEQ ID:268.

Another function of GAM193 is therefore inhibition of Carboxypeptidase d (CPD, Accession NP_001295.2), a gene which is a membrane-bound metalloprotease. Accordingly, utilities of GAM193 include diagnosis, prevention and treatment of diseases and clinical conditions associated with CPD.

The function of CPD and its association with various diseases and clinical conditions, has been established by previous studies, as described hereinabove with reference to GAM66.2. DKFZp434M0331 (Accession NP_060070.1) is another GAM193 target gene, herein designated TARGET GENE. DKFZp434M0331 BINDING SITE is a target binding site found in the 5' untranslated region of mRNA encoded by DKFZp434M0331, corresponding to a target binding site such as BINDING SITE I, BINDING SITE II or BINDING SITE III of FIG. 8. Table 4 illustrates the complementarity of the nucleotide sequences of DKFZp434M0331 BINDING SITE, designated SEQ ID:16786, to the nucleotide sequence of GAM193 RNA, herein designated GAM RNA, also designated SEQ ID:268.

Another function of GAM193 is therefore inhibition of DKFZp434M0331 (Accession NP_060070.1). Accordingly, utilities of GAM193 include diagnosis, prevention and treatment of diseases and clinical conditions associated with DKFZp434M0331.

Down syndrome critical region gene 1-like 1 (DSCR1L1, Accession NP_005813.1) is another GAM193 target gene, herein designated TARGET GENE. DSCR1L1 BINDING SITE is a target binding site found in the 3' untranslated region of mRNA encoded by DSCR1L1, corresponding to a target binding site such as BINDING SITE I, BINDING SITE II or BINDING SITE III of FIG. 8. Table 4 illustrates the complementarity of the nucleotide sequences of DSCR1L1

BINDING SITE, designated SEQ ID:3399, to the nucleotide sequence of GAM193 RNA, herein designated GAM RNA, also designated SEQ ID:268.

Another function of GAM193 is therefore inhibition of Down syndrome critical region gene 1-like 1 (DSCR1L1, Accession NP_005813.1). Accordingly, utilities of GAM193 include diagnosis, prevention and treatment of diseases and clinical conditions associated with DSCR1L1.

Ets variant gene 5 (ets-related molecule) (ETV5, Accession NP_004445.1) is another GAM193 target gene, herein designated TARGET GENE. ETV5 BINDING SITE is a target binding site found in the 3' untranslated region of mRNA encoded by ETV5, corresponding to a target binding site such as BINDING SITE I, BINDING SITE II or BINDING SITE III of FIG. 8. Table 4 illustrates the complementarity of the nucleotide sequences of ETV5 BINDING SITE, designated SEQ ID:10755, to the nucleotide sequence of GAM193 RNA, herein designated GAM RNA, also designated SEQ ID:268.

Another function of GAM193 is therefore inhibition of Ets variant gene 5 (ets-related molecule) (ETV5, Accession NP_004445.1), a gene which DNA binding protein of the Ets oncoprotein family. Accordingly, utilities of GAM193 include diagnosis, prevention and treatment of diseases and clinical conditions associated with ETV5.

The function of ETV5 has been established by previous studies. See ETV1 (OMIM Ref. No. 600541), ETV4 (OMIM Ref. No. 600711), and ETV6 (OMIM Ref. No. 600618). Monte et al. (1994) isolated a human testis cDNA for ERM, a member of the Ets-related transcription factors. The 2.2-kb clone encoded a 510-amino acid putative protein which shares about 95% identity with the mouse genes Pea3 and Er81 in the 85-residue DNA-binding ETS domain. ERM is about 85% identical with these proteins within the N-terminal acidic domain. Further, the protein was shown to bind to an oligonucleotide containing the consensus nucleotide core sequence GGAA recognized by the other Ets proteins. Monte et al. (1994) showed that ERM is widely expressed in human cell lines and tissues (except for normal lymphocytes) and is especially high in brain and placenta. In mouse tissues, Pea3 and Er81 mRNAs displayed restricted patterns of expression, whereas ERM was widely expressed in human tissues. Monte et al. (1996) showed that the human ERM gene contains 14 exons distributed over 65 kb of genomic DNA. The authors mapped the gene to 3q27-q29 by in situ hybridization. Protopopova et al. (1996) mapped the ERM gene, a transcription factor related to the ETS1 (OMIM Ref. No. 164720), to 3q28 by fluorescence in situ hybridization.

Full details of the abovementioned studies are described in the following publications, the disclosure of which are hereby incorporated by reference:

Monte, D.; Baert, J. L.; Defossez, P. A.; de Launoit, Y.; Stehelin, D.: Molecular cloning and characterization of human ERM, a new member of the Ets family closely related to mouse PEA3 and ER81 transcription factors. Oncogene 9:1397-1406, 1994; and Monte, D.; Coutte, L.; Dewitte, F.; Defossez, P.-A.; Le Coniat, M.; Stehelin, D.; Berger, R.; de Launoit, Y.: Genomic organization of the human ERM (ETV5) gene, a PEA3 group member of E.

Further studies establishing the function and utilities of ETV5 are found in John Hopkins OMIM database record ID 601600, and in cited publications listed in Table 5, which are hereby incorporated by reference. Formin homology 2 domain containing 2 (FHOD2, Accession XP_057927.2) is another GAM193 target gene, herein designated TARGET GENE. FHOD2 BINDING SITE is a target binding site found in the 3' untranslated region of mRNA encoded by FHOD2, corresponding to a target binding site such as BINDING SITE I, BINDING SITE II or BINDING SITE III of FIG. 8. Table 4 illustrates the complementarity of the nucleotide sequences of FHOD2 BINDING SITE, designated SEQ ID:8919, to the nucleotide sequence of GAM193 RNA, herein designated GAM RNA, also designated SEQ ID:268.

Another function of GAM193 is therefore inhibition of Formin homology 2 domain containing 2 (FHOD2, Accession XP_057927.2). Accordingly, utilities of GAM193 include diagnosis, prevention and treatment of diseases and clinical conditions associated with FHOD2.

FLJ10824 (Accession XP_051956.8) is another GAM193 target gene, herein designated TARGET GENE. FLJ10824 BINDING SITE is a target binding site found in the 3' untranslated region of mRNA encoded by FLJ10824, corresponding to a target binding site such as BINDING SITE I, BINDING SITE II or BINDING SITE III of FIG. 8. Table 4 illustrates the complementarity of the nucleotide sequences of FLJ10824 BINDING SITE, designated SEQ ID:13628, to the nucleotide sequence of GAM193 RNA, herein designated GAM RNA, also designated SEQ ID:268.

Another function of GAM193 is therefore inhibition of FLJ10824 (Accession XP_051956.8). Accordingly, utilities of GAM193 include diagnosis, prevention and treatment of diseases and clinical conditions associated with FLJ10824.

FLJ20265 (Accession NP_060203.2) is another GAM193 target gene, herein designated TARGET GENE. FLJ20265 BINDING SITE is a target binding site found in the 3' untranslated region of mRNA encoded by FLJ20265, corresponding to a target binding site such as BINDING SITE I, BINDING SITE II or BINDING SITE III of FIG. 8. Table 4 illustrates the complementarity of the nucleotide sequences of FLJ20265 BINDING SITE, designated SEQ ID:15924, to the nucleotide sequence of GAM193 RNA, herein designated GAM RNA, also designated SEQ ID:268.

Another function of GAM193 is therefore inhibition of FLJ20265 (Accession NP_060203.2). Accordingly, utilities of GAM193 include diagnosis, prevention and treatment of diseases and clinical conditions associated with FLJ20265.

FLJ21302 (Accession NP_075052.1) is another GAM193 target gene, herein designated TARGET GENE. FLJ21302 BINDING SITE is a target binding site found in the 3' untranslated region of mRNA encoded by FLJ21302, corresponding to a target binding site such as BINDING SITE I, BINDING SITE II or BINDING SITE III of FIG. 8. Table 4 illustrates the complementarity of the nucleotide sequences of FLJ21302 BINDING SITE, designated SEQ ID:17809, to the nucleotide sequence of GAM193 RNA, herein designated GAM RNA, also designated SEQ ID:268.

Another function of GAM193 is therefore inhibition of FLJ21302 (Accession NP_075052.1). Accordingly, utilities of GAM193 include diagnosis, prevention and treatment of diseases and clinical conditions associated with FLJ21302.

GAS41 (Accession NP_006521.1) is another GAM193 target gene, herein designated TARGET GENE. GAS41 BINDING SITE is a target binding site found in the 3' untranslated region of mRNA encoded by GAS41, corresponding to a target binding site such as BINDING SITE I, BINDING SITE II or BINDING SITE III of FIG. 8. Table 4 illustrates the complementarity of the nucleotide sequences of GAS41 BINDING SITE, designated SEQ ID:14327, to the nucleotide sequence of GAM193 RNA, herein designated GAM RNA, also designated SEQ ID:268.

Another function of GAM193 is therefore inhibition of GAS41 (Accession NP_006521.1), a gene which may also represent a transcription factor. and therefore may be associated with Glioma. Accordingly, utilities of GAM193 include diagnosis, prevention and treatment of Glioma, and of other diseases and clinical conditions associated with GAS41.

The function of GAS41 has been established by previous studies. Gene amplification, which is generally considered to occur late in tumor development, is a common feature of high-grade glioma. Fischer et al. (1997) reported cloning and sequencing a cDNA, termed glioma-amplified sequence-41 (GAS41) by them, that was identified in a glioblastoma cell line by microdissection-mediated cDNA capture. An increased copy number of GAS41 was found in glioblastoma multiforme and astrocytoma III, and at a high frequency in astrocytoma grades I and II. Sequence comparison indicated high similarity between the GAS41 protein, the yeast and human AF9 (OMIM Ref. No. 159558), and human ENL (OMIM Ref. No. 159556). Fischer et al. (1997) noted that both AF9 and ENL belong to a new class of transcription factors, indicating that GAS41 may also represent a transcription factor. With GAS41 being the first gene found with increased copy number in low-grade glioma, this study provided the first evidence that gene amplification can occur in early tumor development. The GAS41 gene had been isolated from a homogeneously staining region (HSR) at 12q13-q15 by microdissection-mediated cDNA capture (Gracia et al., 1996).

Full details of the abovementioned studies are described in the following publications, the disclosure of which are hereby incorporated by reference:

Fischer, U.; Heckel, D.; Michel, A.; Janka, M.; Hulsebos, T.; Meese, E.: Cloning of a novel transcription factor-like gene amplified in human glioma including astrocytoma grade I. Hum. Molec. Genet. 6:1817-1822, 1997. ; and Gracia, E.; Fischer, U.; Elkahloun, A.; Trent, J. M.; Meese, E.; Meltzer, P. S.: Isolation of genes amplified in human cancers by microdissection mediated cDNA capture. Hum. Molec. Gen.

Further studies establishing the function and utilities of GAS41 are found in John Hopkins OMIM database record ID 602116, and in cited publications listed in Table 5, which are hereby incorporated by reference. Glutamate receptor, ionotropic, n-methyl d-aspartate 2b (GRIN2B, Accession NP_000825.1) is another GAM193 target gene, herein designated TARGET GENE. GRIN2B BINDING SITE is a target binding site found in the 3' untranslated region of mRNA encoded by GRIN2B, corresponding to a target binding site such as BINDING SITE I, BINDING SITE II or BINDING SITE III of FIG. 8. Table 4 illustrates the complementarity of the nucleotide sequences of GRIN2B BINDING SITE, designated SEQ ID:16251, to the nucleotide sequence of GAM193 RNA, herein designated GAM RNA, also designated SEQ ID:268.

Another function of GAM193 is therefore inhibition of Glutamate receptor, ionotropic, n-methyl d-aspartate 2b (GRIN2B, Accession NP_000825.1). Accordingly, utilities of GAM193 include diagnosis, prevention and treatment of diseases and clinical conditions associated with GRIN2B.

General transcription factor iih, polypeptide 2, 44 kda (GTF2H2, Accession NP_001506.1) is another GAM193 target gene, herein designated TARGET GENE. GTF2H2 BINDING SITE is a target binding site found in the 3' untranslated region of mRNA encoded by GTF2H2, corresponding to a target binding site such as BINDING SITE I, BINDING SITE II or BINDING SITE III of FIG. 8. Table 4 illustrates the complementarity of the nucleotide sequences of GTF2H2 BINDING SITE, designated SEQ ID:8307, to the nucleotide sequence of GAM193 RNA, herein designated GAM RNA, also designated SEQ ID:268.

Another function of GAM193 is therefore inhibition of General transcription factor iih, polypeptide 2, 44 kda (GTF2H2, Accession NP_001506.1), a gene which is subunit of RNA polymerase II transcription initiation factor IIH and involves in transcription and DNA repair. Accordingly, utilities of GAM193 include diagnosis, prevention and treatment of diseases and clinical conditions associated with GTF2H2.

The function of GTF2H2 has been established by previous studies. Transcription factor IIH (TFIIH; OMIM Ref. No. 189972) is associated with the RNA polymerase II transcription complex, which is involved in transcription and transcription-mediated DNA repair. Humbert et al. (1994) described the cloning of the genes encoding the human 44-kD subunit and the 34-kD subunit (OMIM Ref. No. 601750) of TFIIH. The 44-kD subunit gene (also symbolized GTF2H2) appears to be the human counterpart of yeast SSL1, a gene involved in UV resistance. The childhood-onset spinal muscular atrophies are a clinical heterogeneous group of autosomal recessive disorders characterized by selective degeneration of the anterior horn cells with subsequent weakness and atrophy of limb muscles; see SMA1 (OMIM Ref. No. 253300). The disease locus maps to 5q13, a region characterized by genetic instability and DNA duplication. Carter et al. (1997) noted that, among the duplicated genes in this region, the telomeric copy of the SMN (survival motor neuron) gene (SMN1; 600354) is thought to be the major disease-determining gene, since it is missing in the majority of SMA patients and since small, intragenic mutations in the gene have been associated with the disorder. Approximately half of the severely affected SMA1 patients are also missing both homologs of a neighboring gene, the neuronal apoptosis inhibitory protein (NAIP; 600355). The loss of NAIP may affect disease severity. Clearly, the molecular event underlying the childhood-onset SMAs are complex, possibly involving multiple genes. Carter et al. (1997) reported a third multicopy gene in the SMA region, encoding the p44 subunit of basal transcription factor II (BTF2). One copy of this transcription-repair gene (symbolized BTF2p44 by them) was deleted in at least 15% of all SMA cases. A single copy of the gene was mapped to the SMA region on 5q by van der Steege et al. (1995). Carter et al. (1997) reported the presence of multiple copies of the gene in the SMA region located in close proximity to NAIP and SMN1. Furthermore, they reported a 1-bp polymorphism that distinguished 2 gene copies and they documented the SMA-associated deletion of 1 version of the gene. The 2 polymorphic forms of the p44 gene differ by 2 nonconservative changes (ile- to - met in exon 7 and leu- to - val in exon 10), appear to be ubiquitously expressed, and are present in fetal and adult tissues and in SMA and control lymphoblasts. Carter et al. (1997) stated that physical mapping in the SMA region is complicated and imprecise, presumably due to the great instability and variability arising from the duplication, deletion, and gene conversion of highly homologous DNA in this region.

Full details of the abovementioned studies are described in the following publications, the disclosure of which are hereby incorporated by reference:

Humbert, S.; van Vuuren, H.; Lutz, Y.; Hoeijmakers, J. H.; Egly, J. M.; Moncollin, V.: p44 and p34 subunits of the BTF2/TFIIH transcription factor have homologies with SSL1, a yeast protein involved in DNA repair. EMBO J. 13:2393-2398, 1994; and Carter, T. A.; Bonnemann, C. G.; Wang, C. H.; Obici, S.; Parano, E.; De Fatima Bonaldo, M.; Ross, B. M.; Penchaszadeh, G. K.; Mackenzie, A.; Bento Soares, M.; Kunkel, L. M.; Gilliam, T.

Further studies establishing the function and utilities of GTF2H2 are found in John Hopkins OMIM database record ID 601748, and in cited publications listed in Table 5, which are hereby incorporated by reference. Glycogenin 2 (GYG2, Accession NP_003909.1) is another GAM193 target gene, herein designated TARGET GENE. GYG2 BINDING SITE is a target binding site found in the 3' untranslated region of mRNA encoded by GYG2, corresponding to a target binding site such as BINDING SITE I, BINDING SITE II or BINDING SITE III of FIG. 8. Table 4 illustrates the complementarity of the nucleotide sequences of GYG2 BINDING SITE, designated SEQ ID:9556, to the nucleotide sequence of GAM193 RNA, herein designated GAM RNA, also designated SEQ ID:268.

Another function of GAM193 is therefore inhibition of Glycogenin 2 (GYG2, Accession NP_003909.1), a gene which primes de novo glycogen synthesis and can determine glycogen accumulation. Accordingly, utilities of GAM193 include diagnosis, prevention and treatment of diseases and clinical conditions associated with GYG2.

The function of GYG2 has been established by previous studies. Glycogenin is a self-glucosylating protein covalently linked to glycogen that acts as a primer for the action of glycogen synthase. See Gy, the muscle glycogenin (OMIM Ref. No. 603942). By searching an EST database for sequences related to Gy, Mu et al. (1997) isolated cDNAs encoding a related protein, which they designated glycogenin-2 (GN2). They suggested that muscle glycogenin be referred to as glycogenin-1. Sequence analysis revealed that the cDNAs encode several different GN2 isoforms, 3 of which are found in liver. The liver isoforms, which have different N termini, share 42 to 45% protein sequence identity with glycogenin-1. Mu et al. (1997) demonstrated that recombinant GN2 exhibited all of the biochemical properties of glycogenin; it self-glucosylated, acted as a substrate for glycogen synthase, and was released from glycogen by alpha-amylase treatment. Northern blot analysis revealed that the 3.6-kb GN2 mRNA was expressed most strongly in liver. Mu and Roach (1998) determined that human liver extracts contain both glycogenin-1 and GN2. In vitro and coimmunoprecipitation studies demonstrated that the 2 glycogenins interact with each other. Unlike glycogenin-1, overexpression of GN2 in mammalian cells resulted in a significant increase in glycogen accumulation in the cell, indicating that the level of GN2 can determine glycogen accumulation.

Full details of the abovementioned studies are described in the following publications, the disclosure of which are hereby incorporated by reference:

Mu, J.; Roach, P. J.: Characterization of human glycogenin-2, a self-glucosylating initiator of liver glycogen metabolism. J. Biol. Chem. 273:34850-34856, 1998; and Mu, J.; Skurat, A. V.; Roach, P. J.: Glycogenin-2, a novel self-glucosylating protein involved in liver glycogen biosynthesis. J. Biol. Chem. 272:27589-27597, 1997.

Further studies establishing the function and utilities of GYG2 are found in John Hopkins OMIM database record ID 300198, and in cited publications listed in Table 5, which are hereby incorporated by reference. HSPC230 (Accession NP_057571.1) is another GAM193 target gene, herein designated TARGET GENE. HSPC230 BINDING SITE is a target binding site found in the 3' untranslated region of mRNA encoded by HSPC230, corresponding to a target binding site such as BINDING SITE I, BINDING SITE II or BINDING SITE III of FIG. 8. Table 4 illustrates the complementarity of the nucleotide sequences of HSPC230 BINDING SITE, designated SEQ ID:9132, to the nucleotide sequence of GAM193 RNA, herein designated GAM RNA, also designated SEQ ID:268.

Another function of GAM193 is therefore inhibition of HSPC230 (Accession NP_057571.1). Accordingly, utilities of GAM193 include diagnosis, prevention and treatment of diseases and clinical conditions associated with HSPC230.

IRTA1 (Accession NP_112572.1) is another GAM193 target gene, herein designated TARGET GENE. IRTA1 BINDING SITE is a target binding site found in the 3' untranslated region of mRNA encoded by IRTA1, corresponding to a target binding site such as BINDING SITE I, BINDING SITE II or BINDING SITE III of FIG. 8. Table 4 illustrates the complementarity of the nucleotide sequences of IRTA1 BINDING SITE, designated SEQ ID:7687, to the nucleotide sequence of GAM193 RNA, herein designated GAM RNA, also designated SEQ ID:268.

Another function of GAM193 is therefore inhibition of IRTA1 (Accession NP_112572.1). Accordingly, utilities of GAM193 include diagnosis, prevention and treatment of diseases and clinical conditions associated with IRTA1.

Integrin, alpha v (vitronectin receptor, alpha polypeptide, antigen cd51) (ITGAV, Accession NP_002201.1) is another GAM193 target gene, herein designated TARGET GENE. ITGAV BINDING SITE is a target binding site found in the 3' untranslated region of mRNA encoded by ITGAV, corresponding to a target binding site such as BINDING SITE I, BINDING SITE II or BINDING SITE III of FIG. 8. Table 4 illustrates the complementarity of the nucleotide sequences of ITGAV BINDING SITE, designated SEQ ID:12126, to the nucleotide sequence of GAM193 RNA, herein designated GAM RNA, also designated SEQ ID:268.

Another function of GAM193 is therefore inhibition of Integrin, alpha v (vitronectin receptor, alpha polypeptide, antigen cd51) (ITGAV, Accession NP_002201.1), a gene which is a member of the integrin family of cell-surface proteins. Accordingly, utilities of GAM193 include diagnosis, prevention and treatment of diseases and clinical conditions associated with ITGAV.

The function of ITGAV and its association with various diseases and clinical conditions, has been established by previous studies, as described hereinabove with reference to GAM65.1. KIAA0555 (Accession NP_055605.1) is another GAM193 target gene, herein designated TARGET GENE. KIAA0555 BINDING SITE is a target binding site found in the 3' untranslated region of mRNA encoded by KIAA0555, corresponding to a target binding site such as BINDING SITE I, BINDING SITE II or BINDING SITE III of FIG. 8. Table 4 illustrates the complementarity of the nucleotide sequences of KIAA0555 BINDING SITE, designated SEQ ID:6266, to the nucleotide sequence of GAM193 RNA, herein designated GAM RNA, also designated SEQ ID:268.

Another function of GAM193 is therefore inhibition of KIAA0555 (Accession NP_055605.1). Accordingly, utilities of GAM193 include diagnosis, prevention and treatment of diseases and clinical conditions associated with KIAA0555.

KIAA1046 (Accession NP_055743.1) is another GAM193 target gene, herein designated TARGET GENE. KIAA1046 BINDING SITE is a target binding site found in the 3' untranslated region of mRNA encoded by KIAA1046, corresponding to a target binding site such as BINDING SITE I, BINDING SITE II or BINDING SITE III of FIG. 8. Table 4 illustrates the complementarity of the nucleotide sequences of KIAA1046 BINDING SITE, designated SEQ ID:17833, to the nucleotide sequence of GAM193 RNA, herein designated GAM RNA, also designated SEQ ID:268.

Another function of GAM193 is therefore inhibition of KIAA1046 (Accession NP_055743.1). Accordingly, utilities of GAM193 include diagnosis, prevention and treatment of diseases and clinical conditions associated with KIAA1046.

KIAA1265 (Accession XP_047707.1) is another GAM193 target gene, herein designated TARGET GENE. KIAA1265 BINDING SITE is a target binding site found in the 3' untranslated region of mRNA encoded by KIAA1265, corresponding to a target binding site such as BINDING SITE I, BINDING SITE II or BINDING SITE III of FIG. 8. Table 4 illustrates the complementarity of the nucleotide sequences of KIAA1265 BINDING SITE, designated SEQ ID:8735, to the nucleotide sequence of GAM193 RNA, herein designated GAM RNA, also designated SEQ ID:268.

Another function of GAM193 is therefore inhibition of KIAA1265 (Accession XP_047707.1). Accordingly, utilities of GAM193 include diagnosis, prevention and treatment of diseases and clinical conditions associated with KIAA1265.

KIAA1935 (Accession XP_087672.1) is another GAM193 target gene, herein designated TARGET GENE. KIAA1935 BINDING SITE is a target binding site found in the 3' untranslated region of mRNA encoded by KIAA1935, corresponding to a target binding site such as BINDING SITE I, BINDING SITE II or BINDING SITE III of FIG. 8. Table 4 illustrates the complementarity of the nucleotide sequences of KIAA1935 BINDING SITE, designated SEQ ID:5530, to the nucleotide sequence of GAM193 RNA, herein designated GAM RNA, also designated SEQ ID:268.

Another function of GAM193 is therefore inhibition of KIAA1935 (Accession XP_087672.1). Accordingly, utilities of GAM193 include diagnosis, prevention and treatment of diseases and clinical conditions associated with KIAA1935.

KIDINS220 (Accession XP_291015.1) is another GAM193 target gene, herein designated TARGET GENE. KIDINS220 BINDING SITE is a target binding site found in the 3' untranslated region of mRNA encoded by KIDINS220, corresponding to a target binding site such as BINDING SITE I, BINDING SITE II or BINDING SITE III of FIG. 8. Table 4 illustrates the complementarity of the nucleotide sequences of KIDINS220 BINDING SITE, designated SEQ ID:5248, to the nucleotide sequence of GAM193 RNA, herein designated GAM RNA, also designated SEQ ID:268.

Another function of GAM193 is therefore inhibition of KIDINS220 (Accession XP_291015.1). Accordingly, utilities of GAM193 include diagnosis, prevention and treatment of diseases and clinical conditions associated with KIDINS220.

V-kit hardy-zuckerman 4 feline sarcoma viral oncogene homolog (KIT, Accession NP_000213.1) is another GAM193 target gene, herein designated TARGET GENE. KIT BINDING SITE is a target binding site found in the 3' untranslated region of mRNA encoded by KIT, corresponding to a target binding site such as BINDING SITE I, BINDING SITE II or BINDING SITE III of FIG. 8. Table 4 illustrates the complementarity of the nucleotide sequences of KIT BINDING SITE, designated SEQ ID:17832, to the nucleotide sequence of GAM193 RNA, herein designated GAM RNA, also designated SEQ ID:268.

Another function of GAM193 is therefore inhibition of V-kit hardy-zuckerman 4 feline sarcoma viral oncogene homolog (KIT, Accession NP_000213.1), a gene which is the receptor for stem cell factor (mast cell growth factor) and has a tyrosine-protein kinase activity. Accordingly, utilities of GAM193 include diagnosis, prevention and treatment of diseases and clinical conditions associated with KIT.

The function of KIT has been established by previous studies. Geissler et al. (1988) showed that in the mouse the kit gene is disrupted in 2 spontaneous mutant W alleles. It was previously known that mutations at the W locus in the mouse (producing changes, including white-coat color, sterility, and anemia, attributable to failure of stem cell populations to migrate and/or proliferate effectively during development) map in the same region as kit. Thus, the KIT protooncogene, which encodes a putative tyrosine kinase receptor, was a candidate for the W locus. The protooncogene KIT encodes a transmembrane tyrosine kinase. A strong structural homology of KIT to the CSF1 receptor (OMIM Ref. No. 164770) and the platelet-derived growth factor receptor (OMIM Ref. No. 173490) suggests a model for the action of the KIT gene product during differentiation. The phenotypes of W mutants suggest that 3 cell populations in which KIT function is critical are the pluripotent hematopoietic stem cell, the migrating melanoblast during early embryonic development, and the primordial germ cell during this same period of development. Identification of the ligand for KIT will help in the understanding of its function. A genetic clue to its nature may be found through characterization of the Sl ('steel') locus of the mouse. The phenotypes of mutants at this locus closely resemble mutants at the W locus; however, unlike W, the defect in Sl is not intrinsic to the progenitor stem cells of the affected tissues, but rather lies in the environment in which melanoblast, germ cell, and hematopoietic progenitors differentiate and proliferate. Chabot et al. (1988) also related kit to a W mutation in the mouse. These findings will prompt search for comparable changes in disorders such as Fanconi anemia (OMIM Ref. No. 227650). In the dominant W(42) spotting phenotype in the mouse, Tan et al. (1990) demonstrated an asp790- to - asparagine mutation in the KIT protein product. Aspartic acid-790 is a conserved residue in all protein kinases. Nocka et al. (1990) identified mutations in other alleles at the W locus: W(37), E- to -K at position 582; W(v), T- to - M at position 660; and W(41), V- to -M at position 831. The W mutation is the result of a 78-amino acid deletion that includes the transmembrane of the KIT protein. Nocka et al. (1990) detected a 125-kD KIT protein in homozygous W/W mast cells which lacked kinase activity and did not express KIT on the cell surface. Thus, in mice, the c-kit receptor tyrosine kinase is the gene product of the W locus, whereas Sl encodes the ligand for this growth factor receptor. Microphthalmia (mi/mi) in mice also shows deficiency in melanocytes and mast cells. In addition, whereas W and Sl mutants can be anemic and sterile, 'mi' mice are osteopetrotic due to a monocyte/macrophage defect. Dubreuil et al. (1991) found that the fms gene (OMIM Ref. No. 164770) complements the mitogenic defect in mast cells of mutant W mice but not of mi/mi mice. Brannan et al. (1991) detected a HaeIII polymorphism in the KIT gene. This polymorphism was linked to other 4q markers. Poduslo et al. (1991) described a strategy for identifying polymorphic genetic markers in the 3-prime untranslated regions of coding loci. The method combined PCR and single-strand conformation polymorphism (SSCP) analysis Animal model experiments lend further support to the function of KIT. Signaling from the KIT receptor tyrosine kinase is essential for primordial germ cell growth both in vivo and in vitro. Many downstream effectors of the KIT signaling pathway have been identified in other cell types, but how these molecules control primordial germ cell survival and proliferation are unknown. Determination of the KIT effectors acting in primoridial germ cells has been hampered by the lack of effective methods to manipulate easily gene expression in these cells. De Miguel et al. (2002) overcame this problem by testing the efficacy of retroviral-mediated gene transfer for manipulating gene expression in mammalian germ cells. They found that primordial germ cells can successfully be infected with a variety of types of retroviruses. They used this method to demonstrate an important role of the AKT1 (OMIM Ref. No. 164730) in regulating primordial germ cell growth It is appreciated that the abovementioned animal model for KIT is acknowledged by those skilled in the art as a scientifically valid animal model, as can be further appreciated from the publications sited hereinbelow.

Full details of the abovementioned studies are described in the following publications, the disclosure of which are hereby incorporated by reference:

Poduslo, S. E.; Dean, M.; Kolch, U.; O'Brien, S. J.: Detecting high-resolution polymorphisms in human coding loci by combining PCR and single-strand conformation polymorphism (SSCP) analysis. Am. J. Hum. Genet. 49:106-111, 1991; and De Miguel, M. P.; Cheng, L.; Holland, E. C.; Federspiel, M. J.; Donovan, P. J.: Dissection of the c-Kit signaling pathway in mouse primordial germ cells by retroviral- mediated gene tran.

Further studies establishing the function and utilities of KIT are found in John Hopkins OMIM database record ID 164920, and in cited publications listed in Table 5, which are hereby incorporated by reference. Lysosomal-associated membrane protein 2 (LAMP2, Accession NP_054701.1) is another GAM193 target gene, herein designated TARGET GENE. LAMP2 BINDING SITE is a target binding site found in the 3' untranslated region of multiple transcripts of mRNA encoded by LAMP2, corresponding to a target binding site such as BINDING SITE I, BINDING SITE II or BINDING SITE III of FIG. 8. Table 4 illustrates the complementarity of the nucleotide sequences of LAMP2 BINDING SITE, designated SEQ ID:1978, to the nucleotide sequence of GAM193 RNA, herein designated GAM RNA, also designated SEQ ID:268.

Another function of GAM193 is therefore inhibition of Lysosomal-associated membrane protein 2 (LAMP2, Accession NP_054701.1). Accordingly, utilities of GAM193 include diagnosis, prevention and treatment of diseases and clinical conditions associated with LAMP2.

LOC115548 (Accession XP_291142.1) is another GAM193 target gene, herein designated TARGET GENE. LOC115548 BINDING SITE is a target binding site found in the 3' untranslated region of mRNA encoded by LOC115548, corresponding to a target binding site such as BINDING SITE I, BINDING SITE II or BINDING SITE III of FIG. 8. Table 4 illustrates the complementarity of the nucleotide sequences of LOC115548 BINDING SITE, designated SEQ ID:13272, to the nucleotide sequence of GAM193 RNA, herein designated GAM RNA, also designated SEQ ID:268.

Another function of GAM193 is therefore inhibition of LOC115548 (Accession XP_291142.1). Accordingly, utilities of GAM193 include diagnosis, prevention and treatment of diseases and clinical conditions associated with LOC115548.

LOC142955 (Accession XP_084389.1) is another GAM193 target gene, herein designated TARGET GENE. LOC142955 BINDING SITE is a target binding site found in the 5' untranslated region of mRNA encoded by LOC142955, corresponding to a target binding site such as BINDING SITE I, BINDING SITE II or BINDING SITE III of FIG. 8. Table 4 illustrates the complementarity of the nucleotide sequences of LOC142955 BINDING SITE, designated SEQ ID:5300, to the nucleotide sequence of GAM193 RNA, herein designated GAM RNA, also designated SEQ ID:268.

Another function of GAM193 is therefore inhibition of LOC142955 (Accession XP_084389.1). Accordingly, utilities of GAM193 include diagnosis, prevention and treatment of diseases and clinical conditions associated with LOC142955.

LOC146517 (Accession XP_085491.1) is another GAM193 target gene, herein designated TARGET GENE. LOC146517 BINDING SITE is a target binding site found in the 3' untranslated region of mRNA encoded by LOC146517, corresponding to a target binding site such as BINDING SITE I, BINDING SITE II or BINDING SITE III of FIG. 8. Table 4 illustrates the complementarity of the nucleotide sequences of LOC146517 BINDING SITE, designated SEQ ID:19666, to the nucleotide sequence of GAM193 RNA, herein designated GAM RNA, also designated SEQ ID:268.

Another function of GAM193 is therefore inhibition of LOC146517 (Accession XP_085491.1). Accordingly, utilities of GAM193 include diagnosis, prevention and treatment of diseases and clinical conditions associated with LOC146517.

LOC149684 (Accession XP_097710.1) is another GAM193 target gene, herein designated TARGET GENE. LOC149684 BINDING SITE is a target binding site found in the 3' untranslated region of mRNA encoded by LOC149684, corresponding to a target binding site such as BINDING SITE I, BINDING SITE II or BINDING SITE III of FIG. 8. Table 4 illustrates the complementarity of the nucleotide sequences of LOC149684 BINDING SITE, designated SEQ ID:17873, to the nucleotide sequence of GAM193 RNA, herein designated GAM RNA, also designated SEQ ID:268.

Another function of GAM193 is therefore inhibition of LOC149684 (Accession XP_097710.1). Accordingly, utilities of GAM193 include diagnosis, prevention and treatment of diseases and clinical conditions associated with LOC149684.

LOC152200 (Accession XP_098174.1) is another GAM193 target gene, herein designated TARGET GENE. LOC152200 BINDING SITE is a target binding site found in the 3' untranslated region of mRNA encoded by LOC152200, corresponding to a target binding site such as BINDING SITE I, BINDING SITE II or BINDING SITE III of FIG. 8. Table 4 illustrates the complementarity of the nucleotide sequences of LOC152200 BINDING SITE, designated SEQ ID:17088, to the nucleotide sequence of GAM193 RNA, herein designated GAM RNA, also designated SEQ ID:268.

Another function of GAM193 is therefore inhibition of LOC152200 (Accession XP_098174.1). Accordingly, utilities of GAM193 include diagnosis, prevention and treatment of diseases and clinical conditions associated with LOC152200.

LOC219392 (Accession XP_165921.1) is another GAM193 target gene, herein designated TARGET GENE. LOC219392 BINDING SITE is a target binding site found in the 5' untranslated region of mRNA encoded by LOC219392, corresponding to a target binding site such as BINDING SITE I, BINDING SITE II or BINDING SITE III of FIG. 8. Table 4 illustrates the complementarity of the nucleotide sequences of LOC219392 BINDING SITE, designated SEQ ID:19644, to the nucleotide sequence of GAM193 RNA, herein designated GAM RNA, also designated SEQ ID:268.

Another function of GAM193 is therefore inhibition of LOC219392 (Accession XP_165921.1). Accordingly, utilities of GAM193 include diagnosis, prevention and treatment of diseases and clinical conditions associated with LOC219392.

LOC254100 (Accession XP_172851.1) is another GAM193 target gene, herein designated TARGET GENE. LOC254100 BINDING SITE is a target binding site found in the 3' untranslated region of mRNA encoded by LOC254100, corresponding to a target binding site such as BINDING SITE I, BINDING SITE II or BINDING SITE III of FIG. 8. Table 4 illustrates the complementarity of the nucleotide sequences of LOC254100 BINDING SITE, designated SEQ ID:8379, to the nucleotide sequence of GAM193 RNA, herein designated GAM RNA, also designated SEQ ID:268.

Another function of GAM193 is therefore inhibition of LOC254100 (Accession XP_172851.1). Accordingly, utilities of GAM193 include diagnosis, prevention and treatment of diseases and clinical conditions associated with LOC254100.

LOC284020 (Accession XP_208151.1) is another GAM193 target gene, herein designated TARGET GENE. LOC284020 BINDING SITE is a target binding site found in the 3' untranslated region of mRNA encoded by LOC284020, corresponding to a target binding site such as BINDING SITE I, BINDING SITE II or BINDING SITE III of FIG. 8. Table 4 illustrates the complementarity of the nucleotide sequences of LOC284020 BINDING SITE, designated SEQ ID:12022, to the nucleotide sequence of GAM193 RNA, herein designated GAM RNA, also designated SEQ ID:268.

Another function of GAM193 is therefore inhibition of LOC284020 (Accession XP_208151.1). Accordingly, utilities of GAM193 include diagnosis, prevention and treatment of diseases and clinical conditions associated with LOC284020.

LOC338597 (Accession XP_290482.1) is another GAM193 target gene, herein designated TARGET GENE. LOC338597 BINDING SITE is a target binding site found in the 3' untranslated region of mRNA encoded by LOC338597, corresponding to a target binding site such as BINDING SITE I, BINDING SITE II or BINDING SITE III of FIG. 8. Table 4 illustrates the complementarity of the nucleotide sequences of LOC338597 BINDING SITE, designated SEQ ID:13628, to the nucleotide sequence of GAM193 RNA, herein designated GAM RNA, also designated SEQ ID:268.

Another function of GAM193 is therefore inhibition of LOC338597 (Accession XP_290482.1). Accordingly, utilities of GAM193 include diagnosis, prevention and treatment of diseases and clinical conditions associated with LOC338597.

LOC338739 (Accession XP_294690.1) is another GAM193 target gene, herein designated TARGET GENE. LOC338739 BINDING SITE is a target binding site found in the 3' untranslated region of mRNA encoded by LOC338739, corresponding to a target binding site such as BINDING SITE I, BINDING SITE II or BINDING SITE III of FIG. 8. Table 4 illustrates the complementarity of the nucleotide sequences of LOC338739 BINDING SITE, designated SEQ ID:17845, to the nucleotide sequence of GAM193 RNA, herein designated GAM RNA, also designated SEQ ID:268.

Another function of GAM193 is therefore inhibition of LOC338739 (Accession XP_294690.1). Accordingly, utilities of GAM193 include diagnosis, prevention and treatment of diseases and clinical conditions associated with LOC338739.

LOC338961 (Accession XP_294753.1) is another GAM193 target gene, herein designated TARGET GENE. LOC338961 BINDING SITE is a target binding site found in the 3' untranslated region of mRNA encoded by LOC338961, corresponding to a target binding site such as BINDING SITE I, BINDING SITE II or BINDING SITE III of FIG. 8. Table 4 illustrates the complementarity of the nucleotide sequences of LOC338961 BINDING SITE, designated SEQ ID:12926, to the nucleotide sequence of GAM193 RNA, herein designated GAM RNA, also designated SEQ ID:268.

Another function of GAM193 is therefore inhibition of LOC338961 (Accession XP_294753.1). Accordingly, utilities of GAM193 include diagnosis, prevention and treatment of diseases and clinical conditions associated with LOC338961.

LOC339003 (Accession XP_290660.1) is another GAM193 target gene, herein designated TARGET GENE. LOC339003 BINDING SITE is a target binding site found in the 5' untranslated region of mRNA encoded by LOC339003, corresponding to a target binding site such as BINDING SITE I, BINDING SITE II or BINDING SITE III of FIG. 8. Table 4 illustrates the complementarity of the nucleotide sequences of LOC339003 BINDING SITE, designated SEQ ID:10159, to the nucleotide sequence of GAM193 RNA, herein designated GAM RNA, also designated SEQ ID:268.

Another function of GAM193 is therefore inhibition of LOC339003 (Accession XP_290660.1). Accordingly, utilities of GAM193 include diagnosis, prevention and treatment of diseases and clinical conditions associated with LOC339003.

LOC339952 (Accession XP_295110.1) is another GAM193 target gene, herein designated TARGET GENE. LOC339952 BINDING SITE is a target binding site found in the 5' untranslated region of mRNA encoded by LOC339952, corresponding to a target binding site such as BINDING SITE I, BINDING SITE II or BINDING SITE III of FIG. 8. Table 4 illustrates the complementarity of the nucleotide sequences of LOC339952 BINDING SITE, designated SEQ ID:2352, to the nucleotide sequence of GAM193 RNA, herein designated GAM RNA, also designated SEQ ID:268.

Another function of GAM193 is therefore inhibition of LOC339952 (Accession XP_295110.1). Accordingly, utilities of GAM193 include diagnosis, prevention and treatment of diseases and clinical conditions associated with LOC339952.

LOC347774 (Accession XP_290475.1) is another GAM193 target gene, herein designated TARGET GENE. LOC347774 BINDING SITE is a target binding site found in the 3' untranslated region of mRNA encoded by LOC347774, corresponding to a target binding site such as BINDING SITE I, BINDING SITE II or BINDING SITE III of FIG. 8. Table 4 illustrates the complementarity of the nucleotide sequences of LOC347774 BINDING SITE, designated SEQ ID:13628, to the nucleotide sequence of GAM193 RNA, herein designated GAM RNA, also designated SEQ ID:268.

Another function of GAM193 is therefore inhibition of LOC347774 (Accession XP_290475.1). Accordingly, utilities of GAM193 include diagnosis, prevention and treatment of diseases and clinical conditions associated with LOC347774.

LOC349277 (Accession XP_303016.1) is another GAM193 target gene, herein designated TARGET GENE. LOC349277 BINDING SITE is a target binding site found in the 5' untranslated region of mRNA encoded by LOC349277, corresponding to a target binding site such as BINDING SITE I, BINDING SITE II or BINDING SITE III of FIG. 8. Table 4 illustrates the complementarity of the nucleotide sequences of LOC349277 BINDING SITE, designated SEQ ID:3953, to the nucleotide sequence of GAM193 RNA, herein designated GAM RNA, also designated SEQ ID:268.

Another function of GAM193 is therefore inhibition of LOC349277 (Accession XP_303016.1). Accordingly, utilities of GAM193 include diagnosis, prevention and treatment of diseases and clinical conditions associated with LOC349277.

LOC349299 (Accession XP_303021.1) is another GAM193 target gene, herein designated TARGET GENE. LOC349299 BINDING SITE is a target binding site found in the 5' untranslated region of mRNA encoded by LOC349299, corresponding to a target binding site such as BINDING SITE I, BINDING SITE II or BINDING SITE III of FIG. 8. Table 4 illustrates the complementarity of the nucleotide sequences of LOC349299 BINDING SITE, designated SEQ ID:3953, to the nucleotide sequence of GAM193 RNA, herein designated GAM RNA, also designated SEQ ID:268.

Another function of GAM193 is therefore inhibition of LOC349299 (Accession XP_303021.1). Accordingly, utilities of GAM193 include diagnosis, prevention and treatment of diseases and clinical conditions associated with LOC349299.

LOC54103 (Accession XP_168508.4) is another GAM193 target gene, herein designated TARGET GENE. LOC54103 BINDING SITE is a target binding site found in the 3' untranslated region of mRNA encoded by LOC54103, corresponding to a target binding site such as BINDING SITE I, BINDING SITE II or BINDING SITE III of FIG. 8. Table 4 illustrates the complementarity of the nucleotide sequences of LOC54103 BINDING SITE, designated SEQ ID:12980, to the nucleotide sequence of GAM193 RNA, herein designated GAM RNA, also designated SEQ ID:268.

Another function of GAM193 is therefore inhibition of LOC54103 (Accession XP_168508.4). Accordingly, utilities of GAM193 include diagnosis, prevention and treatment of diseases and clinical conditions associated with LOC54103.

LOC91149 (Accession XP_036480.1) is another GAM193 target gene, herein designated TARGET GENE. LOC91149 BINDING SITE is a target binding site found in the 3' untranslated region of mRNA encoded by LOC91149, corresponding to a target binding site such as BINDING SITE I, BINDING SITE II or BINDING SITE III of FIG. 8. Table 4 illustrates the complementarity of the nucleotide sequences of LOC91149 BINDING SITE, designated SEQ ID:6578, to the nucleotide sequence of GAM193 RNA, herein designated GAM RNA, also designated SEQ ID:268.

Another function of GAM193 is therefore inhibition of LOC91149 (Accession XP_036480.1). Accordingly, utilities of GAM193 include diagnosis, prevention and treatment of diseases and clinical conditions associated with LOC91149.

LOC92497 (Accession XP_045436.1) is another GAM193 target gene, herein designated TARGET GENE. LOC92497 BINDING SITE is a target binding site found in the 5' untranslated region of mRNA encoded by LOC92497, corresponding to a target binding site such as BINDING SITE I, BINDING SITE II or BINDING SITE III of FIG. 8. Table 4 illustrates the complementarity of the nucleotide sequences of LOC92497 BINDING SITE, designated SEQ ID:16786, to the nucleotide sequence of GAM193 RNA, herein designated GAM RNA, also designated SEQ ID:268.

Another function of GAM193 is therefore inhibition of LOC92497 (Accession XP_045436.1). Accordingly, utilities of GAM193 include diagnosis, prevention and treatment of diseases and clinical conditions associated with LOC92497.

Lim domain containing preferred translocation partner in lipoma (LPP, Accession NP_005569.1) is another GAM193 target gene, herein designated TARGET GENE. LPP BINDING SITE is a target binding site found in the 3' untranslated region of mRNA encoded by LPP, corresponding to a target binding site such as BINDING SITE I, BINDING SITE II or BINDING SITE III of FIG. 8. Table 4 illustrates the complementarity of the nucleotide sequences of LPP BINDING SITE, designated SEQ ID:14339, to the nucleotide sequence of GAM193 RNA, herein designated GAM RNA, also designated SEQ ID:268.

Another function of GAM193 is therefore inhibition of Lim domain containing preferred translocation partner in lipoma (LPP, Accession NP_005569.1). Accordingly, utilities of GAM193 include diagnosis, prevention and treatment of diseases and clinical conditions associated with LPP.

Methyl cpg binding protein 2 (rett syndrome) (MECP2, Accession NP_004983.1) is another GAM193 target gene, herein designated TARGET GENE. MECP2 BINDING SITE is a target binding site found in the 3' untranslated region of mRNA encoded by MECP2, corresponding to a target binding site such as BINDING SITE I, BINDING SITE II or BINDING SITE III of FIG. 8. Table 4 illustrates the complementarity of the nucleotide sequences of MECP2 BINDING SITE, designated SEQ ID:10015, to the nucleotide sequence of GAM193 RNA, herein designated GAM RNA, also designated SEQ ID:268.

Another function of GAM193 is therefore inhibition of Methyl cpg binding protein 2 (rett syndrome) (MECP2, Accession NP_004983.1). Accordingly, utilities of GAM193 include diagnosis, prevention and treatment of diseases and clinical conditions associated with MECP2.

MGC14353 (Accession NP_116120.1) is another GAM193 target gene, herein designated TARGET GENE. MGC14353 BINDING SITE is a target binding site found in the 3' untranslated region of mRNA encoded by MGC14353, corresponding to a target binding site such as BINDING SITE I, BINDING SITE II or BINDING SITE III of FIG. 8. Table 4 illustrates the complementarity of the nucleotide sequences of MGC14353 BINDING SITE, designated SEQ ID:10146, to the nucleotide sequence of GAM193 RNA, herein designated GAM RNA, also designated SEQ ID:268.

Another function of GAM193 is therefore inhibition of MGC14353 (Accession NP_116120.1). Accordingly, utilities of GAM193 include diagnosis, prevention and treatment of diseases and clinical conditions associated with MGC14353.

MGC2776 (Accession NP_079541.1) is another GAM193 target gene, herein designated TARGET GENE. MGC2776 BINDING SITE is a target binding site found in the 3' untranslated region of mRNA encoded by MGC2776, corresponding to a target binding site such as BINDING SITE I, BINDING SITE II or BINDING SITE III of FIG. 8. Table 4 illustrates the complementarity of the nucleotide sequences of MGC2776 BINDING SITE, designated SEQ ID:2621, to the nucleotide sequence of GAM193 RNA, herein designated GAM RNA, also designated SEQ ID:268.

Another function of GAM193 is therefore inhibition of MGC2776 (Accession NP_079541.1). Accordingly, utilities of GAM193 include diagnosis, prevention and treatment of diseases and clinical conditions associated with MGC2776.

Makorin, ring finger protein, 3 (MKRN3, Accession NP_005655.1) is another GAM193 target gene, herein designated TARGET GENE. MKRN3 BINDING SITE is a target binding site found in the 3' untranslated region of mRNA encoded by MKRN3, corresponding to a target binding site such as BINDING SITE I, BINDING SITE II or BINDING SITE III of FIG. 8. Table 4 illustrates the complementarity of the nucleotide sequences of MKRN3 BINDING SITE, designated SEQ ID:3557, to the nucleotide sequence of GAM193 RNA, herein designated GAM RNA, also designated SEQ ID:268.

Another function of GAM193 is therefore inhibition of Makorin, ring finger protein, 3 (MKRN3, Accession NP_005655.1). Accordingly, utilities of GAM193 include diagnosis, prevention and treatment of diseases and clinical conditions associated with MKRN3.

MU (Accession NP_071368.1) is another GAM193 target gene, herein designated TARGET GENE. MU BINDING SITE is a target binding site found in the 3' untranslated region of mRNA encoded by MU, corresponding to a target binding site such as BINDING SITE I, BINDING SITE II or BINDING SITE III of FIG. 8. Table 4 illustrates the complementarity of the nucleotide sequences of MU BINDING SITE, designated SEQ ID:2785, to the nucleotide sequence of GAM193 RNA, herein designated GAM RNA, also designated SEQ ID:268.

Another function of GAM193 is therefore inhibition of MU (Accession NP_071368.1). Accordingly, utilities of GAM193 include diagnosis, prevention and treatment of diseases and clinical conditions associated with MU.

Neuroligin 4, y linked (NLGN4Y, Accession NP_055708.1) is another GAM193 target gene, herein designated TARGET GENE. NLGN4Y BINDING SITE is a target binding site found in the 3' untranslated region of mRNA encoded by NLGN4Y, corresponding to a target binding site such as BINDING SITE I, BINDING SITE II or BINDING SITE III of FIG. 8. Table 4 illustrates the complementarity of the nucleotide sequences of NLGN4Y BINDING SITE, designated SEQ ID:6577, to the nucleotide sequence of GAM193 RNA, herein designated GAM RNA, also designated SEQ ID:268.

Another function of GAM193 is therefore inhibition of Neuroligin 4, y linked (NLGN4Y, Accession NP_055708.1). Accordingly, utilities of GAM193 include diagnosis, prevention and treatment of diseases and clinical conditions associated with NLGN4Y.

Neuropeptide y (NPY, Accession NP_000896.1) is another GAM193 target gene, herein designated TARGET GENE. NPY BINDING SITE is a target binding site found in the 3' untranslated region of mRNA encoded by NPY, corresponding to a target binding site such as BINDING SITE I, BINDING SITE II or BINDING SITE III of FIG. 8. Table 4 illustrates the complementarity of the nucleotide sequences of NPY BINDING SITE, designated SEQ ID:549, to the nucleotide sequence of GAM193 RNA, herein designated GAM RNA, also designated SEQ ID:268.

Another function of GAM193 is therefore inhibition of Neuropeptide y (NPY, Accession NP_000896.1), a gene which is implicated in the control of feeding and in the secretion of gonadotrophin-release hormone. Accordingly, utilities of GAM193 include diagnosis, prevention and treatment of diseases and clinical conditions associated with NPY.

The function of NPY has been established by previous studies. Hansel et al. (2001) identified a role for NPY in promoting proliferation of postnatal neuronal precursor cells. NPY is synthesized in the postnatal olfactory epithelium by sustentacular cells, previously proposed to function only in structural support. Mice with a targeted deletion of NPY contained half as many dividing olfactory neuronal precursor cells as did controls. Furthermore, NPY-deficient mice developed significantly fewer olfactory neurons by adulthood. NPY acts on multipotent neuronal precursor or basal cells to activate rapidly and transiently the extracellular signal-regulated kinase (ERK) 1/2 (OMIM Ref. No. 601795) subgroup of mitogen-activated protein kinases. The NPY Y1 receptor subtype (OMIM Ref. No. 162641) appears to mediate this effect. The ability of NPY to induce neuronal precursor proliferation is mediated by protein kinase C (PKC; 176960), indicating an upstream PKC-dependent activation of ERK1/2. These results indicate that NPY may regulate neuronal precursor proliferation in the adult mammal.

Animal model experiments lend further support to the function of NPY. Neuropeptide Y is a neuromodulator implicated in the control of energy balance and is overproduced in the hypothalamus of ob/ob mice. To determine the role of NPY in the response to leptin (OMIM Ref. No. 164160) deficiency, Erickson et al. (1996) generated ob/ob mice deficient in NPY. In the absence of NPY, ob/ob mice were less obese because of reduced food intake and increased energy expenditure, and were less severely affected by diabetes, sterility, and somatotropic defects. These results were interpreted as indicating that NPY is a central effector of leptin deficiency.

It is appreciated that the abovementioned animal model for NPY is acknowledged by those skilled in the art as a scientifically valid animal model, as can be further appreciated from the publications sited hereinbelow.

Full details of the abovementioned studies are described in the following publications, the disclosure of which are hereby incorporated by reference:

Erickson, J. C.; Hollopeter, G.; Palmiter, R. D.: Attenuation of the obesity syndrome of ob/ob mice by the loss of neuropeptide Y. Science 274:1704-1706, 1996; and Hansel, D. E.; Eipper, B. A.; Ronnett, G. V.: Neuropeptide Y functions as a neuroproliferative factor. Nature 410:940-943, 2001.

Further studies establishing the function and utilities of NPY are found in John Hopkins OMIM database record ID 162640, and in cited publications listed in Table 5, which are hereby incorporated by reference. P114-RHO-GEF (Accession NP_056133.1) is another GAM193 target gene, herein designated TARGET GENE. P114-RHO-GEF BINDING SITE is a target binding site found in the 3' untranslated region of mRNA encoded by P114-RHO-GEF, corresponding to a target binding site such as BINDING SITE I, BINDING SITE II or BINDING SITE III of FIG. 8. Table 4 illustrates the complementarity of the nucleotide sequences of P114-RHO-GEF BINDING SITE, designated SEQ ID:6818, to the nucleotide sequence of GAM193 RNA, herein designated GAM RNA, also designated SEQ ID:268.

Another function of GAM193 is therefore inhibition of P114-RHO-GEF (Accession NP_056133.1). Accordingly, utilities of GAM193 include diagnosis, prevention and treatment of diseases and clinical conditions associated with P114-RHO-GEF.

Pyruvate dehydrogenase kinase, isoenzyme 3 (PDK3, Accession NP_005382.1) is another GAM193 target gene, herein designated TARGET GENE. PDK3 BINDING SITE is a target binding site found in the 3' untranslated region of mRNA encoded by PDK3, corresponding to a target binding site such as BINDING SITE I, BINDING SITE II or BINDING SITE III of FIG. 8. Table 4 illustrates the complementarity of the nucleotide sequences of PDK3 BINDING SITE, designated SEQ ID:13449, to the nucleotide sequence of GAM193 RNA, herein designated GAM RNA, also designated SEQ ID:268.

Another function of GAM193 is therefore inhibition of Pyruvate dehydrogenase kinase, isoenzyme 3 (PDK3, Accession NP_005382.1). Accordingly, utilities of GAM193 include diagnosis, prevention and treatment of diseases and clinical conditions associated with PDK3.

Protein kinase (camp-dependent, catalytic) inhibitor alpha (PKIA, Accession NP_006814.1) is another GAM193 target gene, herein designated TARGET GENE. PKIA BINDING SITE is a target binding site found in the 3' untranslated region of mRNA encoded by PKIA, corresponding to a target binding site such as BINDING SITE I, BINDING SITE II or BINDING SITE III of FIG. 8. Table 4 illustrates the complementarity of the nucleotide sequences of PKIA BINDING SITE, designated SEQ ID:11912, to the nucleotide sequence of GAM193 RNA, herein designated GAM RNA, also designated SEQ ID:268.

Another function of GAM193 is therefore inhibition of Protein kinase (camp-dependent, catalytic) inhibitor alpha (PKIA, Accession NP_006814.1). Accordingly, utilities of GAM193 include diagnosis, prevention and treatment of diseases and clinical conditions associated with PKIA.

Pou domain, class 2, associating factor 1 (POU2AF1, Accession NP_006226.1) is another GAM193 target gene, herein designated TARGET GENE. POU2AF1 BINDING SITE is a target binding site found in the 3' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:3129, to the nucleotide sequence of GAM193 RNA, herein designated GAM RNA, also designated SEQ ID:268.

Another function of GAM193 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM193 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. RCBTB1 (Accession NP_060661.2) is another GAM193 target gene, herein designated TARGET GENE. RCBTB1 BINDING SITE is a target binding site found in the 3' untranslated region of mRNA encoded by RCBTB1, corresponding to a target binding site such as BINDING SITE I, BINDING SITE II or BINDING SITE III of FIG. 8. Table 4 illustrates the complementarity of the nucleotide sequences of RCBTB1 BINDING SITE, designated SEQ ID:13748, to the nucleotide sequence of GAM193 RNA, herein designated GAM RNA, also designated SEQ ID:268.

Another function of GAM193 is therefore inhibition of RCBTB1 (Accession NP_060661.2). Accordingly, utilities of GAM193 include diagnosis, prevention and treatment of diseases and clinical conditions associated with RCBTB1.

Restin (reed-steinberg cell-expressed intermediate filament-associated protein) (RSN, Accession NP_002947.1) is another GAM193 target gene, herein designated TARGET GENE. RSN BINDING SITE is a target binding site found in the 3' untranslated region of mRNA encoded by RSN, corresponding to a target binding site such as BINDING SITE I, BINDING SITE II or BINDING SITE III of FIG. 8. Table 4 illustrates the complementarity of the nucleotide sequences of RSN BINDING SITE, designated SEQ ID:9415, to the nucleotide sequence of GAM193 RNA, herein designated GAM RNA, also designated SEQ ID:268.

Another function of GAM193 is therefore inhibition of Restin (reed-steinberg cell-expressed intermediate filament-associated protein) (RSN, Accession NP_002947.1), a gene which seems to be a intermediate filament associated protein that links endocytic vesicles to microtubules. Accordingly, utilities of GAM193 include diagnosis, prevention and treatment of diseases and clinical conditions associated with RSN.

The function of RSN and its association with various diseases and clinical conditions, has been established by previous studies, as described hereinabove with reference to GAM66.2. Sel-1 suppressor of lin-12-like (c. elegans) (SEL1L, Accession NP_005056.3) is another GAM193 target gene, herein designated TARGET GENE. SEL1L BINDING SITE is a target binding site found in the 3' untranslated region of mRNA encoded by SEL1L, corresponding to a target binding site such as BINDING SITE I, BINDING SITE II or BINDING SITE III of FIG. 8. Table 4 illustrates the complementarity of the nucleotide sequences of SEL1L BINDING SITE, designated SEQ ID:1707, to the nucleotide sequence of GAM193 RNA, herein designated GAM RNA, also designated SEQ ID:268.

Another function of GAM193 is therefore inhibition of Sel-1 suppressor of lin-12-like (c. elegans) (SEL1L, Accession NP_005056.3), a gene which may play a role in notch signaling (by similarity). Accordingly, utilities of GAM193 include diagnosis, prevention and treatment of diseases and clinical conditions associated with SEL1L.

The function of SEL1L has been established by previous studies. Biunno et al. (1997) isolated a novel cDNA, designated SEL1L by them, that shows sequence similarities to sel-1, a gene identified as an extragenic suppressor of the lin-12 hypomorphic mutant from C. elegans (3,4:Grant and Greenwald, 1996, 1997). SEL1L exhibited a tissue-specific pattern of expression: high levels of a single 7.5-kb transcript were detected only in the pancreas of healthy individuals, whereas low to undetectable levels were observed in other adult tissues and in some fetal tissues. Because of the tissue-specific expression of the gene, Biunno et al. (1997) studied the gene in human pancreatic carcinomas. They found that 17% of adenocarcinomas of the pancreas did not express SEL1L to a detectable level; however, no gross genomic alterations were apparent within a few hundred kb of the relevant region. By somatic cell hybrid analysis and fluorescence in situ hybridization, Biunno et al. (1997) mapped the SEL1L gene to chromosome 14q31. Donoviel and Bernstein (1999) localized the gene to 14q24.3-q31 by FISH and radiation hybrid analysis.

Full details of the abovementioned studies are described in the following publications, the disclosure of which are hereby incorporated by reference:

Biunno, I.; Appierto, V.; Cattaneo, M.; Leone, B. E.; Balzano, G.; Socci, C.; Saccone, S.; Letizia, A.; Valle, G. D.; Sgaramella, V.: Isolation of a pancreas-specific gene located on human chromosome 14q31: expression analysis in human pancreatic ductal carcinomas. Genomics 46:284-286, 1997; and Donoviel, D. B.; Bernstein, A.: SEL-1L maps to human chromosome 14, near the insulin-dependent diabetes mellitus locus 11. Genomics 56:232-233, 1999.

Further studies establishing the function and utilities of SEL1L are found in John Hopkins OMIM database record ID 602329, and in cited publications listed in Table 5, which are hereby incorporated by reference. Serum/glucocorticoid regulated kinase-like (SGKL, Accession NP_037389.4) is another GAM193 target gene, herein designated TARGET GENE. SGKL BINDING SITE is a target binding site found in the 3' untranslated region of multiple transcripts of mRNA encoded by SGKL, corresponding to a target binding site such as BINDING SITE I, BINDING SITE II or BINDING SITE III of FIG. 8. Table 4 illustrates the complementarity of the nucleotide sequences of SGKL BINDING SITE, designated SEQ ID:19551, to the nucleotide sequence of GAM193 RNA, herein designated GAM RNA, also designated SEQ ID:268.

Another function of GAM193 is therefore inhibition of Serum/glucocorticoid regulated kinase-like (SGKL, Accession NP_037389.4). Accordingly, utilities of GAM193 include diagnosis, prevention and treatment of diseases and clinical conditions associated with SGKL.

Serum/glucocorticoid regulated kinase-like (SGKL, Accession NP_733827.2) is another GAM193 target gene, herein designated TARGET GENE. SGKL BINDING SITE is a target binding site found in the 3' untranslated region of multiple transcripts of mRNA encoded by SGKL, corresponding to a target binding site such as BINDING SITE I, BINDING SITE II or BINDING SITE III of FIG. 8. Table 4 illustrates the complementarity of the nucleotide sequences of SGKL BINDING SITE, designated SEQ ID:19551, to the nucleotide sequence of GAM193 RNA, herein designated GAM RNA, also designated SEQ ID:268.

Another function of GAM193 is therefore inhibition of Serum/glucocorticoid regulated kinase-like (SGKL, Accession NP_733827.2). Accordingly, utilities of GAM193 include diagnosis, prevention and treatment of diseases and clinical conditions associated with SGKL.

SIMP (Accession XP_114346.2) is another GAM193 target gene, herein designated TARGET GENE. SIMP BINDING SITE is a target binding site found in the 3' untranslated region of mRNA encoded by SIMP, corresponding to a target binding site such as BINDING SITE I, BINDING SITE II or BINDING SITE III of FIG. 8. Table 4 illustrates the complementarity of the nucleotide sequences of SIMP BINDING SITE, designated SEQ ID:20030, to the nucleotide sequence of GAM193 RNA, herein designated GAM RNA, also designated SEQ ID:268.

Another function of GAM193 is therefore inhibition of SIMP (Accession XP_114346.2). Accordingly, utilities of GAM193 include diagnosis, prevention and treatment of diseases and clinical conditions associated with SIMP.

Solute carrier family 12 (sodium/potassium/chloride transporters), member 2 (SLC12A2, Accession NP_001037.1) is another GAM193 target gene, herein designated TARGET GENE. SLC12A2 BINDING SITE is a target binding site found in the 3' untranslated region of mRNA encoded by SLC12A2, corresponding to a target binding site such as BINDING SITE I, BINDING SITE II or BINDING SITE III of FIG. 8. Table 4 illustrates the complementarity of the nucleotide sequences of SLC12A2 BINDING SITE, designated SEQ ID:2850, to the nucleotide sequence of GAM193 RNA, herein designated GAM RNA, also designated SEQ ID:268.

Another function of GAM193 is therefore inhibition of Solute carrier family 12 (sodium/potassium/chloride transporters), member 2 (SLC12A2, Accession NP_001037.1), a gene which transports chloride ions across secretory epithelia. Accordingly, utilities of GAM193 include diagnosis, prevention and treatment of diseases and clinical conditions associated with SLC12A2.

The function of SLC12A2 has been established by previous studies. By moving chloride into epithelial cells, the Na-K-Cl cotransporter aids transcellular movement of chloride across both secretory and absorptive epithelia. Using cDNA probes from the elasmobranch secretory Na-K-Cl cotransporter reported by Xu et al. (1994), Payne et al. (1995) identified the human homolog, which they referred to as NKCC1. By screening cDNA libraries of a human colonic carcinoma cell line, they identified a sequence of 4,115 bases that encoded a deduced protein of 1,212 amino acids with 12 transmembrane segments. By fluorescence in situ hybridization, they localized the cotransporter gene to 5q23.3. Human embryonic kidney cells stably transfected with the full-length cDNA expressed a protein of approximately 170 kD which was recognized by anti-cotransporter antibodies. Following treatment with N-glycosidase F, the molecular mass of the expressed protein was similar to that predicted for the core protein from the cDNA sequence. Evans et al. (2000) tested directly the possibility that the salivary fluid secretory mechanism requires Na+/K+/2Cl-cotransporter-mediated Cl-uptake. They studied the in vivo and in vitro functioning of acinar cells from the parotid glands of mice with targeted disruption of the Nkcc1 gene, which encodes the salivary cotransporter. In wildtype mice Nkcc1 was localized to the basolateral membranes of parotid acinar cells, whereas expression was not detected in duct cells. The lack of functional Nkcc1 resulted in a dramatic reduction (greater than 60%) in the volume of saliva secreted in response to a muscarinic agonist, the primary in situ salivation signal. Expression of the chloride/bicarbonate exchanger AE2 (SLC4A2; 109280) was enhanced, suggesting that this transporter compensates for the loss of functional Nkcc1. The ability of the parotid gland to conserve NaCl was abolished in Nkcc1-deficient mice. Evans et al. (2000) suggested that some cases of 'idiopathic' dry mouth disease may have a basis in a defect of Nkcc1.

Full details of the abovementioned studies are described in the following publications, the disclosure of which are hereby incorporated by reference:

Payne, J. A.; Xu, J.-C.; Haas, M.; Lytle, C. Y.; Ward, D.; Forbush, B., III : Primary structure, functional expression, and chromosomal localization of the bumetanide-sensitive Na-K-Cl cotransporter in human colon. J. Biol. Chem. 270: 17977-17985, 1995; and Evans, R. L.; Park, K.; Turner, R. J.; Watson, G. E.; Nguyen, H.-V.; Dennett, M. R.; Hand, A. R.; Flagella, M.; Shull, G. E.; Melvin, J. E.: Severe impairment of salivation in Na+/K+/2Cl.

Further studies establishing the function and utilities of SLC12A2 are found in John Hopkins OMIM database record ID 600840, and in cited publications listed in Table 5, which are hereby incorporated by reference. Solute carrier family 16 (monocarboxylic acid transporters), member 6 (SLC16A6, Accession NP_004685.1) is another GAM193 target gene, herein designated TARGET GENE. SLC16A6 BINDING SITE is a target binding site found in the 3' untranslated region of mRNA encoded by SLC16A6, corresponding to a target binding site such as BINDING SITE I, BINDING SITE II or BINDING SITE III of FIG. 8. Table 4 illustrates the complementarity of the nucleotide sequences of SLC16A6 BINDING SITE, designated SEQ ID:2622, to the nucleotide sequence of GAM193 RNA, herein designated GAM RNA, also designated SEQ ID:268.

Another function of GAM193 is therefore inhibition of Solute carrier family 16 (monocarboxylic acid transporters), member 6 (SLC16A6, Accession NP_004685.1). Accordingly, utilities of GAM193 include diagnosis, prevention and treatment of diseases and clinical conditions associated with SLC16A6.

Solute carrier family 6 (neurotransmitter transporter, dopamine), member 3 (SLC6A3, Accession NP_001035.1) is another GAM193 target gene, herein designated TARGET GENE. SLC6A3 BINDING SITE is a target binding site found in the 3' untranslated region of mRNA encoded by SLC6A3, corresponding to a target binding site such as BINDING SITE I, BINDING SITE II or BINDING SITE III of FIG. 8. Table 4 illustrates the complementarity of the nucleotide sequences of SLC6A3 BINDING SITE, designated SEQ ID:9121, to the nucleotide sequence of GAM193 RNA, herein designated GAM RNA, also designated SEQ ID:268.

Another function of GAM193 is therefore inhibition of Solute carrier family 6 (neurotransmitter transporter, dopamine), member 3 (SLC6A3, Accession NP_001035.1), a gene which terminates the action of dopamine by its high affinity sodium-dependent reuptake into presynaptic terminals. Accordingly, utilities of GAM193 include diagnosis, prevention and treatment of diseases and clinical conditions associated with SLC6A3.

The function of SLC6A3 and its association with various diseases and clinical conditions, has been established by previous studies, as described hereinabove with reference to GAM189.1. SMARCAD1 (Accession NP_064544.1) is another GAM193 target gene, herein designated TARGET GENE. SMARCAD1 BINDING SITE is a target binding site found in the 3' untranslated region of mRNA encoded by SMARCAD1, corresponding to a target binding site such as BINDING SITE I, BINDING SITE II or BINDING SITE III of FIG. 8. Table 4 illustrates the complementarity of the nucleotide sequences of SMARCAD1 BINDING SITE, designated SEQ ID:8809, to the nucleotide sequence of GAM193 RNA, herein designated GAM RNA, also designated SEQ ID:268.

Another function of GAM193 is therefore inhibition of SMARCAD1 (Accession NP_064544.1). Accordingly, utilities of GAM193 include diagnosis, prevention and treatment of diseases and clinical conditions associated with SMARCAD1.

ST18 (Accession NP_055497.1) is another GAM193 target gene, herein designated TARGET GENE. ST18 BINDING SITE is a target binding site found in the 3' untranslated region of mRNA encoded by ST18, corresponding to a target binding site such as BINDING SITE I, BINDING SITE II or BINDING SITE III of FIG. 8. Table 4 illustrates the complementarity of the nucleotide sequences of ST18 BINDING SITE, designated SEQ ID:4579, to the nucleotide sequence of GAM193 RNA, herein designated GAM RNA, also designated SEQ ID:268.

Another function of GAM193 is therefore inhibition of ST18 (Accession NP_055497.1). Accordingly, utilities of GAM193 include diagnosis, prevention and treatment of diseases and clinical conditions associated with ST18.

Staufen, rna binding protein, homolog 2 (drosophila) (STAU2, Accession NP_055208.1) is another GAM193 target gene, herein designated TARGET GENE. STAU2 BINDING SITE is a target binding site found in the 3' untranslated region of mRNA encoded by STAU2, corresponding to a target binding site such as BINDING SITE I, BINDING SITE II or BINDING SITE III of FIG. 8. Table 4 illustrates the complementarity of the nucleotide sequences of STAU2 BINDING SITE, designated SEQ ID:19453, to the nucleotide sequence of GAM193 RNA, herein designated GAM RNA, also designated SEQ ID:268.

Another function of GAM193 is therefore inhibition of Staufen, rna binding protein, homolog 2 (drosophila) (STAU2, Accession NP_055208.1). Accordingly, utilities of GAM193 include diagnosis, prevention and treatment of diseases and clinical conditions associated with STAU2.

Stanniocalcin 2 (STC2, Accession NP_003705.1) is another GAM193 target gene, herein designated TARGET GENE. STC2 BINDING SITE is a target binding site found in the 3' untranslated region of mRNA encoded by STC2, corresponding to a target binding site such as BINDING SITE I, BINDING SITE II or BINDING SITE III of FIG. 8. Table 4 illustrates the complementarity of the nucleotide sequences of STC2 BINDING SITE, designated SEQ ID:696, to the nucleotide sequence of GAM193 RNA, herein designated GAM RNA, also designated SEQ ID:268.

Another function of GAM193 is therefore inhibition of Stanniocalcin 2 (STC2, Accession NP_003705.1). Accordingly, utilities of GAM193 include diagnosis, prevention and treatment of diseases and clinical conditions associated with STC2.

Tubulointerstitial nephritis antigen (TINAG, Accession NP_055279.1) is another GAM193 target gene, herein designated TARGET GENE. TINAG BINDING SITE is a target binding site found in the 3' untranslated region of mRNA encoded by TINAG, corresponding to a target binding site such as BINDING SITE I, BINDING SITE II or BINDING SITE III of FIG. 8. Table 4 illustrates the complementarity of the nucleotide sequences of TINAG BINDING SITE, designated SEQ ID:12710, to the nucleotide sequence of GAM193 RNA, herein designated GAM RNA, also designated SEQ ID:268.

Another function of GAM193 is therefore inhibition of Tubulointerstitial nephritis antigen (TINAG, Accession NP_055279.1). Accordingly, utilities of GAM193 include diagnosis, prevention and treatment of diseases and clinical conditions associated with TINAG.

Unc-51-like kinase 2 (c. elegans) (ULK2, Accession NP_055498.2) is another GAM193 target gene, herein designated TARGET GENE. ULK2 BINDING SITE is a target binding site found in the 3' untranslated region of mRNA encoded by ULK2, corresponding to a target binding site such as BINDING SITE I, BINDING SITE II or BINDING SITE III of FIG. 8. Table 4 illustrates the complementarity of the nucleotide sequences of ULK2 BINDING SITE, designated SEQ ID:17181, to the nucleotide sequence of GAM193 RNA, herein designated GAM RNA, also designated SEQ ID:268.

Another function of GAM193 is therefore inhibition of Unc-51-like kinase 2 (c. elegans) (ULK2, Accession NP_055498.2). Accordingly, utilities of GAM193 include diagnosis, prevention and treatment of diseases and clinical conditions associated with ULK2.

ZAK (Accession NP_598407.1) is another GAM193 target gene, herein designated TARGET GENE. ZAK BINDING SITE is a target binding site found in the 3' untranslated region of multiple transcripts of mRNA encoded by ZAK, corresponding to a target binding site such as BINDING SITE I, BINDING SITE II or BINDING SITE III of FIG. 8. Table 4 illustrates the complementarity of the nucleotide sequences of ZAK BINDING SITE, designated SEQ ID:7242, to the nucleotide sequence of GAM193 RNA, herein designated GAM RNA, also designated SEQ ID:268.

Another function of GAM193 is therefore inhibition of ZAK (Accession NP_598407.1). Accordingly, utilities of GAM193 include diagnosis, prevention and treatment of diseases and clinical conditions associated with ZAK.

FIG. 8 further provides a conceptual description of a novel bioinformatically detected of the present invention, referred to here as Genomic Address Messenger 194 (GAM194), which modulates expression of respective target genes thereof, the function and utility of which target genes is known in the art.

GAM194 is a novel bioinformatically detected regulatory, non protein coding, micro RNA (miRNA) gene. The method by which GAM194 was detected is described hereinabove with reference to FIGS. 8-15.

GAM194 gene, herein designated GAM GENE, and GAM194 target gene, herein designated TARGET GENE, are human genes contained in the human genome.

GAM194 gene encodes a GAM194 precursor RNA, herein designated GAM PRECURSOR RNA. Similar to other miRNA genes, and unlike most ordinary genes, GAM194 precursor RNA does not encode a protein. A nucleotide sequence identical or highly similar to the nucleotide sequence of GAM194 precursor RNA is designated SEQ ID:40, and is provided hereinbelow with reference to the sequence listing part. Nucleotide sequence SEQ ID:40 is located at position 49043012 relative to chromosome 13.

GAM194 precursor RNA folds onto itself, forming GAM194 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM194 precursor RNA folds onto itself, forming GAM194 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM194 precursor RNA, designated SEQ-ID:40, and a schematic representation of a predicted secondary folding of GAM194 folded precursor RNA are further described with reference to Table 2, hereby incorporated by reference.

An enzyme complex designated DICER COMPLEX, 'dices' the GAM194 folded precursor RNA into GAM194 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM194 RNA is designated SEQ ID:350, and is provided hereinbelow with references to the sequence listing part and Table 3, hereby incorporated by reference.

GAM194 target gene, herein designated TARGET GENE, encodes a corresponding messenger RNA, GAM194 target RNA, herein designated GAM TARGET RNA. GAM194 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM194 RNA, herein designated GAM RNA, binds complementarily to one or more target binding sites located in untranslated regions of GAM194 target RNA, herein designated GAM TARGET RNA. This complementary binding is due to the fact that the nucleotide sequence of GAM194 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM194 RNA may have a different number of target binding sites in untranslated regions of a GAM194 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM194 RNA, herein designated GAM RNA, to target binding sites on GAM194 target RNA, herein designated GAM TARGET RNA, such as BINDING SITE I, BINDING SITE II and BINDING SITE III, inhibits translation of GAM194 target RNA into GAM194 target protein, herein designated GAM TARGET PROTEIN. GAM target protein is therefore outlined by a broken line.

It is appreciated that GAM194 target gene, herein designated TARGET GENE, in fact represents a plurality of GAM194 target genes. The mRNA of each one of this plurality of GAM194 target genes comprises one or more target binding sites, each having a nucleotide sequence which is at least partly complementary to GAM194 RNA, herein designated GAM RNA, and which when bound by GAM194 RNA causes inhibition of translation of respective one or more GAM194 target proteins.

It is further appreciated by one skilled in the art that the mode of translational inhibition illustrated by FIG. 8 with specific reference to translational inhibition exerted by GAM194 gene, herein designated GAM GENE, on one or more GAM194 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM194 correlate with, and may be deduced from, the identity of the target genes which GAM194 binds and inhibits, and the function of these target genes, as elaborated hereinbelow.

FLJ10716 (Accession NM_018191.2) is a GAM194 target gene, herein designated TARGET GENE. FLJ10716 BINDING SITE is a target binding site found in the 3' untranslated region of mRNA encoded by FLJ10716, corresponding to a target binding site such as BINDING SITE I, BINDING SITE II or BINDING SITE III of FIG. 8. Table 4 illustrates the complementarity of the nucleotide sequences of FLJ10716 BINDING SITE, designated SEQ ID:11429, to the nucleotide sequence of GAM194 RNA, herein designated GAM RNA, also designated SEQ ID:350.

A function of GAM194 is therefore inhibition of FLJ10716 (Accession NM_018191.2). Accordingly, utilities of GAM194 include diagnosis, prevention and treatment of diseases and clinical conditions associated with FLJ10716.

FIG. 8 further provides a conceptual description of a novel bioinformatically detected of the present invention, referred to here as Genomic Address Messenger 195 (GAM195), which modulates expression of respective target genes thereof, the function and utility of which target genes is known in the art.

GAM195 is a novel bioinformatically detected regulatory, non protein coding, micro RNA (miRNA) gene. The method by which GAM195 was detected is described hereinabove with reference to FIGS. 8-15.

GAM195 gene, herein designated GAM GENE, and GAM195 target gene, herein designated TARGET GENE, are human genes contained in the human genome.

GAM195 gene encodes a GAM195 precursor RNA, herein designated GAM PRECURSOR RNA. Similar to other miRNA genes, and unlike most ordinary genes, GAM195 precursor RNA does not encode a protein. A nucleotide sequence identical or highly similar to the nucleotide sequence of GAM195 precursor RNA is designated SEQ ID:122, and is provided hereinbelow with reference to the sequence listing part. Nucleotide sequence SEQ ID:122 is located at position 39124959 relative to chromosome 4.

GAM195 precursor RNA folds onto itself, forming GAM195 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM195 precursor RNA folds onto itself, forming GAM195 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM195 precursor RNA, designated SEQ-ID:122, and a schematic representation of a predicted secondary folding of GAM195 folded precursor RNA are further described with reference to Table 2, hereby incorporated by reference.

An enzyme complex designated DICER COMPLEX, 'dices' the GAM195 folded precursor RNA into GAM195 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM195 RNA is designated SEQ ID:334, and is provided hereinbelow with references to the sequence listing part and Table 3, hereby incorporated by reference.

GAM195 target gene, herein designated TARGET GENE, encodes a corresponding messenger RNA, GAM195 target RNA, herein designated GAM TARGET RNA. GAM195 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM195 RNA, herein designated GAM RNA, binds complementarily to one or more target binding sites located in untranslated regions of GAM195 target RNA, herein designated GAM TARGET RNA. This complementary binding is due to the fact that the nucleotide sequence of GAM195 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM195 RNA may have a different number of target binding sites in untranslated regions of a GAM195 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM195 RNA, herein designated GAM RNA, to target binding sites on GAM195 target RNA, herein designated GAM TARGET RNA, such as BINDING SITE I, BINDING SITE II and BINDING SITE III, inhibits translation of GAM195 target RNA into GAM195 target protein, herein designated GAM TARGET PROTEIN. GAM target protein is therefore outlined by a broken line.

It is appreciated that GAM195 target gene, herein designated TARGET GENE, in fact represents a plurality of GAM195 target genes. The mRNA of each one of this plurality of GAM195 target genes comprises one or more target binding sites, each having a nucleotide sequence which is at least partly complementary to GAM195 RNA, herein designated GAM RNA, and which when bound by GAM195 RNA causes inhibition of translation of respective one or more GAM195 target proteins.

It is further appreciated by one skilled in the art that the mode of translational inhibition illustrated by FIG. 8 with specific reference to translational inhibition exerted by GAM195 gene, herein designated GAM GENE, on one or more GAM195 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM195 correlate with, and may be deduced from, the identity of the target genes which GAM195 binds and inhibits, and the function of these target genes, as elaborated hereinbelow.

Atpase inhibitory factor 1 (ATPIF1, Accession NP_835497.1) is a GAM195 target gene, herein designated TARGET GENE. ATPIF1 BINDING SITE is a target binding site found in the 3' untranslated region of multiple transcripts of mRNA encoded by ATPIF1, corresponding to a target binding site such as BINDING SITE I, BINDING SITE II or BINDING SITE III of FIG. 8. Table 4 illustrates the complementarity of the nucleotide sequences of ATPIF1 BINDING SITE, designated SEQ ID:13146, to the nucleotide sequence of GAM195 RNA, herein designated GAM RNA, also designated SEQ ID:334.

A function of GAM195 is therefore inhibition of Atpase inhibitory factor 1 (ATPIF1, Accession NP_835497.1). Accordingly, utilities of GAM195 include diagnosis, prevention and treatment of diseases and clinical conditions associated with ATPIF1.

Atpase inhibitory factor 1 (ATPIF1, Accession NP_057395.1) is another GAM195 target gene, herein designated TARGET GENE. ATPIF1 BINDING SITE is a target binding site found in the 3' untranslated region of multiple transcripts of mRNA encoded by ATPIF1, corresponding to a target binding site such as BINDING SITE I, BINDING SITE II or BINDING SITE III of FIG. 8. Table 4 illustrates the complementarity of the nucleotide sequences of ATPIF1 BINDING SITE, designated SEQ ID:13146, to the nucleotide sequence of GAM195 RNA, herein designated GAM RNA, also designated SEQ ID:334.

Another function of GAM195 is therefore inhibition of Atpase inhibitory factor 1 (ATPIF1, Accession NP_057395.1). Accordingly, utilities of GAM195 include diagnosis, prevention and treatment of diseases and clinical conditions associated with ATPIF1.

Atpase inhibitory factor 1 (ATPIF1, Accession NP_835498.1) is another GAM195 target gene, herein designated TARGET GENE. ATPIF1 BINDING SITE is a target binding site found in the 3' untranslated region of multiple transcripts of mRNA encoded by ATPIF1, corresponding to a target binding site such as BINDING SITE I, BINDING SITE II or BINDING SITE III of FIG. 8. Table 4 illustrates the complementarity of the nucleotide sequences of ATPIF1 BINDING SITE, designated SEQ ID:13146, to the nucleotide sequence of GAM195 RNA, herein designated GAM RNA, also designated SEQ ID:334.

Another function of GAM195 is therefore inhibition of Atpase inhibitory factor 1 (ATPIF1, Accession NP_835498.1). Accordingly, utilities of GAM195 include diagnosis, prevention and treatment of diseases and clinical conditions associated with ATPIF1.

Cat eye syndrome chromosome region, candidate 7 (CECR7, Accession XP_086803.1) is another GAM195 target gene, herein designated TARGET GENE. CECR7 BINDING SITE is a target binding site found in the 3' untranslated region of mRNA encoded by CECR7, corresponding to a target binding site such as BINDING SITE I, BINDING SITE II or BINDING SITE III of FIG. 8. Table 4 illustrates the complementarity of the nucleotide sequences of CECR7 BINDING SITE, designated SEQ ID:4000, to the nucleotide sequence of GAM195 RNA, herein designated GAM RNA, also designated SEQ ID:334.

Another function of GAM195 is therefore inhibition of Cat eye syndrome chromosome region, candidate 7 (CECR7, Accession XP_086803.1). Accordingly, utilities of GAM195 include diagnosis, prevention and treatment of diseases and clinical conditions associated with CECR7.

Desmocollin 1 (DSC1, Accession NP_004939.1) is another GAM195 target gene, herein designated TARGET GENE. DSC1 BINDING SITE is a target binding site found in the 3' untranslated region of multiple transcripts of mRNA encoded by DSC1, corresponding to a target binding site such as BINDING SITE I, BINDING SITE II or BINDING SITE III of FIG. 8. Table 4 illustrates the complementarity of the nucleotide sequences of DSC1 BINDING SITE, designated SEQ ID:19861, to the nucleotide sequence of GAM195 RNA, herein designated GAM RNA, also designated SEQ ID:334.

Another function of GAM195 is therefore inhibition of Desmocollin 1 (DSC1, Accession NP_004939.1), a gene which is a component of intercellular desmosome junctions. Accordingly, utilities of GAM195 include diagnosis, prevention and treatment of diseases and clinical conditions associated with DSC1.

The function of DSC1 has been established by previous studies. The desmosome is a complex adhesive structure that plays a fundamental role in maintaining the strength and integrity of epithelial tissues. Central to this role are transmembrane glycoproteins that mediate cell-cell adhesion at the extracellular surface and interact with the cytoskeleton (via components of the desmosomal plaque), thus linking the intermediate filament networks of adjacent cells. Desmosomal glycoproteins comprise 2 distinct groups, the desmogleins and the desmocollins, both of which are members of the cadherin superfamily of Ca(2+)-dependent cell adhesion molecules. In the human, 2 types of desmocollins had been identified, symbolized DSC1 and DSC2 (OMIM Ref. No. 125645), and each occurs in 2 alternatively spliced forms (variants a and b) that have different cytoplasmic domains reflecting different interactions with components of the desmosomal plaque (Troyanovsky et al., 1993). King et al. (1993) isolated cDNA clones encoding a human desmocollin that is expressed in the more differentiated layers of human epidermis. This isoform has 53% amino acid identity with the previously isolated type 3 desmocollin, which is expressed in the basal layers of the epidermis. However, the N and C termini of the mature proteins are more highly conserved. Using a panel of somatic cell hybrids, King et al. (1993) assigned the DSC1 gene to chromosome 18, where the DSC2 gene and the 3 desmoglein genes (DSG1, 125670; DSG2, 125671; DSG3, 169615) had previously been mapped.

Full details of the abovementioned studies are described in the following publications, the disclosure of which are hereby incorporated by reference:

King, I. A.; Arnemann, J.; Spurr, N. K.; Buxton, R. S.: Cloning of the cDNA (DSC1) coding for human type 1 desmocollin and its assignment to chromosome 18. Genomics 18:185-194, 1993; and Troyanovsky, S. M.; Eshkind, L. G.; Troyanovsky, R. B.; Leube, R. E.; Franke, W. W.: Contributions of cytoplasmic domains of desmosomal cadherins to desmosome assembly and intermediate.

Further studies establishing the function and utilities of DSC1 are found in John Hopkins OMIM database record ID 125643, and in cited publications listed in Table 5, which are hereby incorporated by reference. Desmocollin 1 (DSC1, Accession NP_077739.1) is another GAM195 target gene, herein designated TARGET GENE. DSC1 BINDING SITE is a target binding site found in the 3' untranslated region of multiple transcripts of mRNA encoded by DSC1, corresponding to a target binding site such as BINDING SITE I, BINDING SITE II or BINDING SITE III of FIG. 8. Table 4 illustrates the complementarity of the nucleotide sequences of DSC1 BINDING SITE, designated SEQ ID:19861, to the nucleotide sequence of GAM195 RNA, herein designated GAM RNA, also designated SEQ ID:334.

Another function of GAM195 is therefore inhibition of Desmocollin 1 (DSC1, Accession NP_077739.1), a gene which is a component of intercellular desmosome junctions. Accordingly, utilities of GAM195 include diagnosis, prevention and treatment of diseases and clinical conditions associated with DSC1.

The function of DSC1 has been established by previous studies. The desmosome is a complex adhesive structure that plays a fundamental role in maintaining the strength and integrity of epithelial tissues. Central to this role are transmembrane glycoproteins that mediate cell-cell adhesion at the extracellular surface and interact with the cytoskeleton (via components of the desmosomal plaque), thus linking the intermediate filament networks of adjacent cells. Desmosomal glycoproteins comprise 2 distinct groups, the desmogleins and the desmocollins, both of which are members of the cadherin superfamily of Ca(2+)-dependent cell adhesion molecules. In the human, 2 types of desmocollins had been identified, symbolized DSC1 and DSC2 (OMIM Ref. No. 125645), and each occurs in 2 alternatively spliced forms (variants a and b) that have different cytoplasmic domains reflecting different interactions with components of the desmosomal plaque (Troyanovsky et al., 1993). King et al. (1993) isolated cDNA clones encoding a human desmocollin that is expressed in the more differentiated layers of human epidermis. This isoform has 53% amino acid identity with the previously isolated type 3 desmocollin, which is expressed in the basal layers of the epidermis. However, the N and C termini of the mature proteins are more highly conserved.

Using a panel of somatic cell hybrids, King et al. (1993) assigned the DSC1 gene to chromosome 18, where the DSC2 gene and the 3 desmoglein genes (DSG1, 125670; DSG2, 125671; DSG3, 169615) had previously been mapped.

Full details of the abovementioned studies are described in the following publications, the disclosure of which are hereby incorporated by reference:

King, I. A.; Arnemann, J.; Spurr, N. K.; Buxton, R. S.: Cloning of the cDNA (DSC1) coding for human type 1 desmocollin and its assignment to chromosome 18. Genomics 18:185-194, 1993; and Troyanovsky, S. M.; Eshkind, L. G.; Troyanovsky, R. B.; Leube, R. E.; Franke, W. W. : Contributions of cytoplasmic domains of desmosomal cadherins to desmosome assembly and intermediate.

Further studies establishing the function and utilities of DSC1 are found in John Hopkins OMIM database record ID 125643, and in cited publications listed in Table 5, which are hereby incorporated by reference. Fibroblast growth factor 2 (basic) (FGF2, Accession NP_001997.3) is another GAM195 target gene, herein designated TARGET GENE. FGF2 BINDING SITE is a target binding site found in the 3' untranslated region of mRNA encoded by FGF2, corresponding to a target binding site such as BINDING SITE I, BINDING SITE II or BINDING SITE III of FIG. 8. Table 4 illustrates the complementarity of the nucleotide sequences of FGF2 BINDING SITE, designated SEQ ID:18914, to the nucleotide sequence of GAM195 RNA, herein designated GAM RNA, also designated SEQ ID:334.

Another function of GAM195 is therefore inhibition of Fibroblast growth factor 2 (basic) (FGF2, Accession NP_001997.3), a gene which the Basic fibroblast growth factor 2; is mitogenic, angiogenic, and neurotrophic factor. Accordingly, utilities of GAM195 include diagnosis, prevention and treatment of diseases and clinical conditions associated with FGF2.

The function of FGF2 and its association with various diseases and clinical conditions, has been established by previous studies, as described hereinabove with reference to GAM36.1. FLJ12787 (Accession NP_115551.1) is another GAM195 target gene, herein designated TARGET GENE. FLJ12787 BINDING SITE is a target binding site found in the 3' untranslated region of mRNA encoded by FLJ12787, corresponding to a target binding site such as BINDING SITE I, BINDING SITE II or BINDING SITE III of FIG. 8. Table 4 illustrates the complementarity of the nucleotide sequences of FLJ12787 BINDING SITE, designated SEQ ID:1139, to the nucleotide sequence of GAM195 RNA, herein designated GAM RNA, also designated SEQ ID:334.

Another function of GAM195 is therefore inhibition of FLJ12787 (Accession NP_115551.1). Accordingly, utilities of GAM195 include diagnosis, prevention and treatment of diseases and clinical conditions associated with FLJ12787.

FLJ20086 (Accession NP_060131.1) is another GAM195 target gene, herein designated TARGET GENE. FLJ20086 BINDING SITE is a target binding site found in the 3' untranslated region of mRNA encoded by FLJ20086, corresponding to a target binding site such as BINDING SITE I, BINDING SITE II or BINDING SITE III of FIG. 8. Table 4 illustrates the complementarity of the nucleotide sequences of FLJ20086 BINDING SITE, designated SEQ ID:11844, to the nucleotide sequence of GAM195 RNA, herein designated GAM RNA, also designated SEQ ID:334.

Another function of GAM195 is therefore inhibition of FLJ20086 (Accession NP_060131.1). Accordingly, utilities of GAM195 include diagnosis, prevention and treatment of diseases and clinical conditions associated with FLJ20086.

FLJ20727 (Accession NP_060414.2) is another GAM195 target gene, herein designated TARGET GENE. FLJ20727 BINDING SITE is a target binding site found in the 3' untranslated region of mRNA encoded by FLJ20727, corresponding to a target binding site such as BINDING SITE I, BINDING SITE II or BINDING SITE III of FIG. 8. Table 4 illustrates the complementarity of the nucleotide sequences of FLJ20727 BINDING SITE, designated SEQ ID:18778, to the nucleotide sequence of GAM195 RNA, herein designated GAM RNA, also designated SEQ ID:334.

Another function of GAM195 is therefore inhibition of FLJ20727 (Accession NP_060414.2). Accordingly, utilities of GAM195 include diagnosis, prevention and treatment of diseases and clinical conditions associated with FLJ20727.

FLJ21269 (Accession NP_079383.1) is another GAM195 target gene, herein designated TARGET GENE. FLJ21269 BINDING SITE is a target binding site found in the 3' untranslated region of mRNA encoded by FLJ21269, corresponding to a target binding site such as BINDING SITE I, BINDING SITE II or BINDING SITE III of FIG. 8. Table 4 illustrates the complementarity of the nucleotide sequences of FLJ21269 BINDING SITE, designated SEQ ID:2872, to the nucleotide sequence of GAM195 RNA, herein designated GAM RNA, also designated SEQ ID:334.

Another function of GAM195 is therefore inhibition of FLJ21269 (Accession NP_079383.1). Accordingly, utilities of GAM195 include diagnosis, prevention and treatment of diseases and clinical conditions associated with FLJ21269.

FLJ23749 (Accession NP_689484.1) is another GAM195 target gene, herein designated TARGET GENE. FLJ23749 BINDING SITE is a target binding site found in the 3' untranslated region of mRNA encoded by FLJ23749, corresponding to a target binding site such as BINDING SITE I, BINDING SITE II or BINDING SITE III of FIG. 8. Table 4 illustrates the complementarity of the nucleotide sequences of FLJ23749 BINDING SITE, designated SEQ ID:1179, to the nucleotide sequence of GAM195 RNA, herein designated GAM RNA, also designated SEQ ID:334.

Another function of GAM195 is therefore inhibition of FLJ23749 (Accession NP_689484.1). Accordingly, utilities of GAM195 include diagnosis, prevention and treatment of diseases and clinical conditions associated with FLJ23749.

Gap junction protein, beta 2, 26 kda (connexin 26) (GJB2, Accession NP_003995.1) is another GAM195 target gene, herein designated TARGET GENE. GJB2 BINDING SITE1 and GJB2 BINDING SITE2 are target binding sites found in untranslated regions of mRNA encoded by GJB2, corresponding to target binding sites such as BINDING SITE I, BINDING SITE II or BINDING SITE III of FIG. 8. Table 4 illustrates the complementarity of the nucleotide sequences of GJB2 BINDING SITE1 and GJB2 BINDING SITE2, designated SEQ ID:18295 and SEQ ID:11557 respectively, to the nucleotide sequence of GAM195 RNA, herein designated GAM RNA, also designated SEQ ID:334.

Another function of GAM195 is therefore inhibition of Gap junction protein, beta 2, 26 kda (connexin 26) (GJB2, Accession NP_003995.1). Accordingly, utilities of GAM195 include diagnosis, prevention and treatment of diseases and clinical conditions associated with GJB2.

Glypican 3 (GPC3, Accession NP_004475.1) is another GAM195 target gene, herein designated TARGET GENE. GPC3 BINDING SITE is a target binding site found in the 3' untranslated region of mRNA encoded by GPC3, corresponding to a target binding site such as BINDING SITE I, BINDING SITE II or BINDING SITE III of FIG. 8. Table 4 illustrates the complementarity of the nucleotide sequences of GPC3 BINDING SITE, designated SEQ ID:10408, to the nucleotide sequence of GAM195 RNA, herein designated GAM RNA, also designated SEQ ID:334.

Another function of GAM195 is therefore inhibition of Glypican 3 (GPC3, Accession NP_004475.1). Accordingly, utilities of GAM195 include diagnosis, prevention and treatment of diseases and clinical conditions associated with GPC3.

Potassium inwardly-rectifying channel, subfamily j, member 16 (KCNJ16, Accession NP_061128.1) is another GAM195 target gene, herein designated TARGET GENE. KCNJ16 BINDING SITE is a target binding site found in the 5' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:3607, to the nucleotide sequence of GAM195 RNA, herein designated GAM RNA, also designated SEQ ID:334.

Another function of GAM195 is therefore inhibition of Potassium inwardly-rectifying channel, subfamily j, member 16 (KCNJ16, Accession NP_061128.1). Accordingly, utilities of GAM195 include diagnosis, prevention and treatment of diseases and clinical conditions associated with KCNJ16.

Potassium inwardly-rectifying channel, subfamily j, member 16 (KCNJ16, Accession NP_733937.1) is another GAM195 target gene, herein designated TARGET GENE. KCNJ16 BINDING SITE is a target binding site found in the 5' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:3607, to the nucleotide sequence of GAM195 RNA, herein designated GAM RNA, also designated SEQ ID:334.

Another function of GAM195 is therefore inhibition of Potassium inwardly-rectifying channel, subfamily j, member 16 (KCNJ16, Accession NP_733937.1). Accordingly, utilities of GAM195 include diagnosis, prevention and treatment of diseases and clinical conditions associated with KCNJ16.

Potassium inwardly-rectifying channel, subfamily j, member 16 (KCNJ16, Accession NP_733938.1) is another GAM195 target gene, herein designated TARGET GENE. KCNJ16 BINDING SITE is a target binding site found in the 5' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:3607, to the nucleotide sequence of GAM195 RNA, herein designated GAM RNA, also designated SEQ ID:334.

Another function of GAM195 is therefore inhibition of Potassium inwardly-rectifying channel, subfamily j, member 16 (KCNJ16, Accession NP_733938.1). Accordingly, utilities of GAM195 include diagnosis, prevention and treatment of diseases and clinical conditions associated with KCNJ16.

KIAA0173 (Accession NP_055455.1) is another GAM195 target gene, herein designated TARGET GENE. KIAA0173 BINDING SITE is a target binding site found in the 3' untranslated region of mRNA encoded by KIAA0173, corresponding to a target binding site such as BINDING SITE I, BINDING SITE II or BINDING SITE III of FIG. 8. Table 4 illustrates the complementarity of the nucleotide sequences of KIAA0173 BINDING SITE, designated SEQ ID:8331, to the nucleotide sequence of GAM195 RNA, herein designated GAM RNA, also designated SEQ ID:334.

Another function of GAM195 is therefore inhibition of KIAA0173 (Accession NP_055455.1). Accordingly, utilities of GAM195 include diagnosis, prevention and treatment of diseases and clinical conditions associated with KIAA0173.

KIAA1954 (Accession XP_085375.4) is another GAM195 target gene, herein designated TARGET GENE. KIAA1954 BINDING SITE is a target binding site found in the 3' untranslated region of mRNA encoded by KIAA1954, corresponding to a target binding site such as BINDING SITE I, BINDING SITE II or BINDING SITE III of FIG. 8. Table 4 illustrates the complementarity of the nucleotide sequences of KIAA1954 BINDING SITE, designated SEQ ID:16208, to the nucleotide sequence of GAM195 RNA, herein designated GAM RNA, also designated SEQ ID:334.

Another function of GAM195 is therefore inhibition of KIAA1954 (Accession XP_085375.4). Accordingly, utilities of GAM195 include diagnosis, prevention and treatment of diseases and clinical conditions associated with KIAA1954.

KIAA1972 (Accession XP_166279.1) is another GAM195 target gene, herein designated TARGET GENE. KIAA1972 BINDING SITE is a target binding site found in the 3' untranslated region of mRNA encoded by KIAA1972, corresponding to a target binding site such as BINDING SITE I, BINDING SITE II or BINDING SITE III of FIG. 8. Table 4 illustrates the complementarity of the nucleotide sequences of KIAA1972 BINDING SITE, designated SEQ ID:3715, to the nucleotide sequence of GAM195 RNA, herein designated GAM RNA, also designated SEQ ID:334.

Another function of GAM195 is therefore inhibition of KIAA1972 (Accession XP_166279.1). Accordingly, utilities of GAM195 include diagnosis, prevention and treatment of diseases and clinical conditions associated with KIAA1972.

LOC143891 (Accession XP_084661.3) is another GAM195 target gene, herein designated TARGET GENE. LOC143891 BINDING SITE is a target binding site found in the 3' untranslated region of mRNA encoded by LOC143891, corresponding to a target binding site such as BINDING SITE I, BINDING SITE II or BINDING SITE III of FIG. 8. Table 4 illustrates the complementarity of the nucleotide sequences of LOC143891 BINDING SITE, designated SEQ ID:17605, to the nucleotide sequence of GAM195 RNA, herein designated GAM RNA, also designated SEQ ID:334.

Another function of GAM195 is therefore inhibition of LOC143891 (Accession XP_084661.3). Accordingly, utilities of GAM195 include diagnosis, prevention and treatment of diseases and clinical conditions associated with LOC143891.

LOC145453 (Accession XP_085120.1) is another GAM195 target gene, herein designated TARGET GENE. LOC145453 BINDING SITE is a target binding site found in the 3' untranslated region of mRNA encoded by LOC145453, corresponding to a target binding site such as BINDING SITE I, BINDING SITE II or BINDING SITE III of FIG. 8. Table 4 illustrates the complementarity of the nucleotide sequences of LOC145453 BINDING SITE, designated SEQ ID:1564, to the nucleotide sequence of GAM195 RNA, herein designated GAM RNA, also designated SEQ ID:334.

Another function of GAM195 is therefore inhibition of LOC145453 (Accession XP_085120.1). Accordingly, utilities of GAM195 include diagnosis, prevention and treatment of diseases and clinical conditions associated with LOC145453.

LOC146443 (Accession XP_085461.6) is another GAM195 target gene, herein designated TARGET GENE. LOC146443 BINDING SITE is a target binding site found in the 5' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:4001, to the nucleotide sequence of GAM195 RNA, herein designated GAM RNA, also designated SEQ ID:334.

Another function of GAM195 is therefore inhibition of LOC146443 (Accession XP_085461.6). Accordingly, utilities of GAM195 include diagnosis, prevention and treatment of diseases and clinical conditions associated with LOC146443.

LOC151057 (Accession XP_097998.1) is another GAM195 target gene, herein designated TARGET GENE. LOC151057 BINDING SITE is a target binding site found in the 3' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:13828, to the nucleotide sequence of GAM195 RNA, herein designated GAM RNA, also designated SEQ ID:334.

Another function of GAM195 is therefore inhibition of LOC151057 (Accession XP_097998.1). Accordingly, utilities of GAM195 include diagnosis, prevention and treatment of diseases and clinical conditions associated with LOC151057.

LOC284231 (Accession XP_208184.1) is another GAM195 target gene, herein designated TARGET GENE. LOC284231 BINDING SITE is a target binding site found in the 5' untranslated region of mRNA encoded by LOC284231, corresponding to a target binding site such as BINDING SITE I, BINDING SITE II or BINDING SITE III of FIG. 8. Table 4 illustrates the complementarity of the nucleotide sequences of LOC284231 BINDING SITE, designated SEQ ID:4846, to the nucleotide sequence of GAM195 RNA, herein designated GAM RNA, also designated SEQ ID:334.

Another function of GAM195 is therefore inhibition of LOC284231 (Accession XP_208184.1). Accordingly, utilities of GAM195 include diagnosis, prevention and treatment of diseases and clinical conditions associated with LOC284231.

LOC284396 (Accession XP_211452.1) is another GAM195 target gene, herein designated TARGET GENE. LOC284396 BINDING SITE is a target binding site found in the 3' untranslated region of mRNA encoded by LOC284396, corresponding to a target binding site such as BINDING SITE I, BINDING SITE II or BINDING SITE III of FIG. 8. Table 4 illustrates the complementarity of the nucleotide sequences of LOC284396 BINDING SITE, designated SEQ ID:13621, to the nucleotide sequence of GAM195 RNA, herein designated GAM RNA, also designated SEQ ID:334.

Another function of GAM195 is therefore inhibition of LOC284396 (Accession XP_211452.1). Accordingly, utilities of GAM195 include diagnosis, prevention and treatment of diseases and clinical conditions associated with LOC284396.

LOC284927 (Accession XP_211689.1) is another GAM195 target gene, herein designated TARGET GENE. LOC284927 BINDING SITE is a target binding site found in the 3' untranslated region of mRNA encoded by LOC284927, corresponding to a target binding site such as BINDING SITE I, BINDING SITE II or BINDING SITE III of FIG. 8. Table 4 illustrates the complementarity of the nucleotide sequences of LOC284927 BINDING SITE, designated SEQ ID:1922, to the nucleotide sequence of GAM195 RNA, herein designated GAM RNA, also designated SEQ ID:334.

Another function of GAM195 is therefore inhibition of LOC284927 (Accession XP_211689.1). Accordingly, utilities of GAM195 include diagnosis, prevention and treatment of diseases and clinical conditions associated with LOC284927.

LOC285953 (Accession XP_209820.1) is another GAM195 target gene, herein designated TARGET GENE. LOC285953 BINDING SITE is a target binding site found in the 3' untranslated region of mRNA encoded by LOC285953, corresponding to a target binding site such as BINDING SITE I, BINDING SITE II or BINDING SITE III of FIG. 8. Table 4 illustrates the complementarity of the nucleotide sequences of LOC285953 BINDING SITE, designated SEQ ID:2646, to the nucleotide sequence of GAM195 RNA, herein designated GAM RNA, also designated SEQ ID:334.

Another function of GAM195 is therefore inhibition of LOC285953 (Accession XP_209820.1). Accordingly, utilities of GAM195 include diagnosis, prevention and treatment of diseases and clinical conditions associated with LOC285953.

LOC286470 (Accession XP_212325.1) is another GAM195 target gene, herein designated TARGET GENE. LOC286470 BINDING SITE is a target binding site found in the 3' untranslated region of mRNA encoded by LOC286470, corresponding to a target binding site such as BINDING SITE I, BINDING SITE II or BINDING SITE III of FIG. 8. Table 4 illustrates the complementarity of the nucleotide sequences of LOC286470 BINDING SITE, designated SEQ ID:1532, to the nucleotide sequence of GAM195 RNA, herein designated GAM RNA, also designated SEQ ID:334.

Another function of GAM195 is therefore inhibition of LOC286470 (Accession XP_212325.1). Accordingly, utilities of GAM195 include diagnosis, prevention and treatment of diseases and clinical conditions associated with LOC286470.

LOC339778 (Accession XP_295061.1) is another GAM195 target gene, herein designated TARGET GENE. LOC339778 BINDING SITE is a target binding site found in the 3' untranslated region of mRNA encoded by LOC339778, corresponding to a target binding site such as BINDING SITE I, BINDING SITE II or BINDING SITE III of FIG. 8. Table 4 illustrates the complementarity of the nucleotide sequences of LOC339778 BINDING SITE, designated SEQ ID:17583, to the nucleotide sequence of GAM195 RNA, herein designated GAM RNA, also designated SEQ ID:334.

Another function of GAM195 is therefore inhibition of LOC339778 (Accession XP_295061.1). Accordingly, utilities of GAM195 include diagnosis, prevention and treatment of diseases and clinical conditions associated with LOC339778.

Metallothionein-like 5, testis-specific (tesmin) (MTL5, Accession NP_004914.1) is another GAM195 target gene, herein designated TARGET GENE. MTL5 BINDING SITE is a target binding site found in the 3' untranslated region of mRNA encoded by MTL5, corresponding to a target binding site such as BINDING SITE I, BINDING SITE II or BINDING SITE III of FIG. 8. Table 4 illustrates the complementarity of the nucleotide sequences of MTL5 BINDING SITE, designated SEQ ID:16748, to the nucleotide sequence of GAM195 RNA, herein designated GAM RNA, also designated SEQ ID:334.

Another function of GAM195 is therefore inhibition of Metallothionein-like 5, testis-specific (tesmin) (MTL5, Accession NP_004914.1), a gene which functions in metal homeostasis and protects against heavy-metal toxicity. Accordingly, utilities of GAM195 include diagnosis, prevention and treatment of diseases and clinical conditions associated with MTL5.

The function of MTL5 has been established by previous studies. By randomized RT-PCR on mRNA from mouse tissues, Sugihara et al. (1999) isolated a testis- specific transcript, which they called TF1. By screening a human testis cDNA library with TF1 as a probe, they cloned a novel cDNA, which they called testis-specific metallothionein-like protein, or tesmin. Tesmin encodes a predicted cysteine- rich, 295-amino acid protein that is 76.3% homologous to mouse tesmin. Sequence analysis revealed the presence of 2 metallothionein (MT)-like motifs. MT expression has been observed to be higher in testes than in liver tissue (Salehi-Ashtiani et al., 1993) and to be actively expressed in a developmentally regulated fashion in mouse male germ cells (De et al., 1991). Tesmin shows no homology to other testis-specific genes. In situ hybridization of adult mouse testicular sections showed that expression of tesmin is restricted to spermatocytes. RT-PCR analysis on testicular transcripts from mice showed that expression of tesmin occurs as early as day 8 and coincides with the entry of germ cells in meiosis.

Full details of the abovementioned studies are described in the following publications, the disclosure of which are hereby incorporated by reference:

De, S. K.; Enders, G. C.; Andrews, G. K.: High levels of metallothionein messenger RNAs in male germ cells of the adult mouse. Molec. Endocr. 5:628-636, 1991; and Salehi-Ashtiani, K.; Widrow, R. J.; Markert, C. L.; Goldberg, E.: Testis-specific expression of a metallothionein I-driven transgene correlates with undermethylation of the locus in te.

Further studies establishing the function and utilities of MTL5 are found in John Hopkins OMIM database record ID 604374, and in cited publications listed in Table 5, which are hereby incorporated by reference. Neuronal cell adhesion molecule (NRCAM, Accession NP_005001.1) is another GAM195 target gene, herein designated TARGET GENE. NRCAM BINDING SITE is a target binding site found in the 3' untranslated region of mRNA encoded by NRCAM, corresponding to a target binding site such as BINDING SITE I, BINDING SITE II or BINDING SITE III of FIG. 8. Table 4 illustrates the complementarity of the nucleotide sequences of NRCAM BINDING SITE, designated SEQ ID:1144, to the nucleotide sequence of GAM195 RNA, herein designated GAM RNA, also designated SEQ ID:334.

Another function of GAM195 is therefore inhibition of Neuronal cell adhesion molecule (NRCAM, Accession NP_005001.1), a gene which functions as a cell surface protein and belongs to the immunoglobulin superfamily. Accordingly, utilities of GAM195 include diagnosis, prevention and treatment of diseases and clinical conditions associated with NRCAM.

The function of NRCAM and its association with various diseases and clinical conditions, has been established by previous studies, as described hereinabove with reference to GAM148.1. NUCKS (Accession NP_073568.1) is another GAM195 target gene, herein designated TARGET GENE. NUCKS BINDING SITE is a target binding site found in the 3' untranslated region of mRNA encoded by NUCKS, corresponding to a target binding site such as BINDING SITE I, BINDING SITE II or BINDING SITE III of FIG. 8. Table 4 illustrates the complementarity of the nucleotide sequences of NUCKS BINDING SITE, designated SEQ ID:19959, to the nucleotide sequence of GAM195 RNA, herein designated GAM RNA, also designated SEQ ID:334.

Another function of GAM195 is therefore inhibition of NUCKS (Accession NP_073568.1). Accordingly, utilities of GAM195 include diagnosis, prevention and treatment of diseases and clinical conditions associated with NUCKS.

Oligophrenin 1 (OPHN1, Accession NP_002538.1) is another GAM195 target gene, herein designated TARGET GENE. OPHN1 BINDING SITE is a target binding site found in the 3' untranslated region of mRNA encoded by OPHN1, corresponding to a target binding site such as BINDING SITE I, BINDING SITE II or BINDING SITE III of FIG. 8. Table 4 illustrates the complementarity of the nucleotide sequences of OPHN1 BINDING SITE, designated SEQ ID:1488, to the nucleotide sequence of GAM195 RNA, herein designated GAM RNA, also designated SEQ ID:334.

Another function of GAM195 is therefore inhibition of Oligophrenin 1 (OPHN1, Accession NP_002538.1). Accordingly, utilities of GAM195 include diagnosis, prevention and treatment of diseases and clinical conditions associated with OPHN1.

P450RAI-2 (Accession NP_063938.1) is another GAM195 target gene, herein designated TARGET GENE. P450RAI-2 BINDING SITE is a target binding site found in the 3' untranslated region of mRNA encoded by P450RAI-2, corresponding to a target binding site such as BINDING SITE I, BINDING SITE II or BINDING SITE III of FIG. 8. Table 4 illustrates the complementarity of the nucleotide sequences of P450RAI-2 BINDING SITE, designated SEQ ID:14707, to the nucleotide sequence of GAM195 RNA, herein designated GAM RNA, also designated SEQ ID:334.

Another function of GAM195 is therefore inhibition of P450RAI-2 (Accession NP_063938.1). Accordingly, utilities of GAM195 include diagnosis, prevention and treatment of diseases and clinical conditions associated with P450RAI-2.

PDIP1 (Accession XP_170803.1) is another GAM195 target gene, herein designated TARGET GENE. PDIP1 BINDING SITE is a target binding site found in the 3' untranslated region of multiple transcripts of mRNA encoded by PDIP1, corresponding to a target binding site such as BINDING SITE I, BINDING SITE II or BINDING SITE III of FIG. 8. Table 4 illustrates the complementarity of the nucleotide sequences of PDIP1 BINDING SITE, designated SEQ ID:8489, to the nucleotide sequence of GAM195 RNA, herein designated GAM RNA, also designated SEQ ID:334.

Another function of GAM195 is therefore inhibition of PDIP1 (Accession XP_170803.1). Accordingly, utilities of GAM195 include diagnosis, prevention and treatment of diseases and clinical conditions associated with PDIP1.

PDIP1 (Accession NP_849194.1) is another GAM195 target gene, herein designated TARGET GENE. PDIP1 BINDING SITE is a target binding site found in the 3' untranslated region of multiple transcripts of mRNA encoded by PDIP1, corresponding to a target binding site such as BINDING SITE I, BINDING SITE II or BINDING SITE III of FIG. 8. Table 4 illustrates the complementarity of the nucleotide sequences of PDIP1 BINDING SITE, designated SEQ ID:8489, to the nucleotide sequence of GAM195 RNA, herein designated GAM RNA, also designated SEQ ID:334.

Another function of GAM195 is therefore inhibition of PDIP1 (Accession NP_849194.1). Accordingly, utilities of GAM195 include diagnosis, prevention and treatment of diseases and clinical conditions associated with PDIP1.

Plasminogen-like (PLGL, Accession NP_002656.1) is another GAM195 target gene, herein designated TARGET GENE. PLGL BINDING SITE is a target binding site found in the 3' untranslated region of mRNA encoded by PLGL, corresponding to a target binding site such as BINDING SITE I, BINDING SITE II or BINDING SITE III of FIG. 8. Table 4 illustrates the complementarity of the nucleotide sequences of PLGL BINDING SITE, designated SEQ ID:2694, to the nucleotide sequence of GAM195 RNA, herein designated GAM RNA, also designated SEQ ID:334.

Another function of GAM195 is therefore inhibition of Plasminogen-like (PLGL, Accession NP_002656.1), a gene which is necessary for extracellular matrix destruction. Accordingly, utilities of GAM195 include diagnosis, prevention and treatment of diseases and clinical conditions associated with PLGL.

The function of PLGL has been established by previous studies. Frank et al. (1989) used a plasminogen probe encoding kringles 1-3 to detect homologous loci on human chromosomes 6 and 2 by somatic cell hybrid analysis. Regional localization by in situ hybridization placed the loci at 6q26-q27 and 2p11-q11. Further analysis by varying washing stringencies of hybridization filters showed greater homology with the chromosome 6 locus than with the chromosome 2 locus. The results were interpreted as confirming localization of the plasminogen gene (OMIM Ref. No. 173350) to chromosome 6 and indicating that a homologous sequence of unknown identity is located on chromosome 2. The sequence on chromosome 2 may represent a pseudogene or it may be an unidentified kringle-containing protein. Magnaghi et al. (1995), in their FIG. 3, presented a restriction map showing the orientation of the PLG and PLGL genes to each other and to the LPA gene (OMIM Ref. No. 152200) and the LPA-like gene.

Full details of the abovementioned studies are described in the following publications, the disclosure of which are hereby incorporated by reference:

Frank, S. L.; Klisak, I.; Sparkes, R. S.; Lusis, A. J.: A gene homologous to plasminogen located on human chromosome 2q11-p11. Genomics 4:449-451, 1989; and Magnaghi, P.; Agazzi, A.; Semino, O.; Ferrari, M.; Barbui, T.; D'Angelo, A.; Taramelli, R.: A recombination event in the closely linked plasminogen and apolipoprotein(a) gene loci. Cli.

Further studies establishing the function and utilities of PLGL are found in John Hopkins OMIM database record ID 173340, and in cited publications listed in Table 5, which are hereby incorporated by reference. RNF41 (Accession NP_005776.1) is another GAM195 target gene, herein designated TARGET GENE. RNF41 BINDING SITE is a target binding site found in the 3' untranslated region of mRNA encoded by RNF41, corresponding to a target binding site such as BINDING SITE I, BINDING SITE II or BINDING SITE III of FIG. 8. Table 4 illustrates the complementarity of the nucleotide sequences of RNF41 BINDING SITE, designated SEQ ID:14646, to the nucleotide sequence of GAM195 RNA, herein designated GAM RNA, also designated SEQ ID:334.

Another function of GAM195 is therefore inhibition of RNF41 (Accession NP_005776.1). Accordingly, utilities of GAM195 include diagnosis, prevention and treatment of diseases and clinical conditions associated with RNF41.

Sh3 and multiple ankyrin repeat domains 2 (SHANK2, Accession NP_036441.1) is another GAM195 target gene, herein designated TARGET GENE. SHANK2 BINDING SITE is a target binding site found in the 3' untranslated region of multiple transcripts of mRNA encoded by SHANK2, corresponding to a target binding site such as BINDING SITE I, BINDING SITE II or BINDING SITE III of FIG. 8. Table 4 illustrates the complementarity of the nucleotide sequences of SHANK2 BINDING SITE, designated SEQ ID:11675, to the nucleotide sequence of GAM195 RNA, herein designated GAM RNA, also designated SEQ ID:334.

Another function of GAM195 is therefore inhibition of Sh3 and multiple ankyrin repeat domains 2 (SHANK2, Accession NP_036441.1). Accordingly, utilities of GAM195 include diagnosis, prevention and treatment of diseases and clinical conditions associated with SHANK2.

Solute carrier family 38, member 2 (SLC38A2, Accession NP_061849.2) is another GAM195 target gene, herein designated TARGET GENE. SLC38A2 BINDING SITE is a target binding site found in the 3' untranslated region of mRNA encoded by SLC38A2, corresponding to a target binding site such as BINDING SITE I, BINDING SITE II or BINDING SITE III of FIG. 8. Table 4 illustrates the complementarity of the nucleotide sequences of SLC38A2 BINDING SITE, designated SEQ ID:451, to the nucleotide sequence of GAM195 RNA, herein designated GAM RNA, also designated SEQ ID:334.

Another function of GAM195 is therefore inhibition of Solute carrier family 38, member 2 (SLC38A2, Accession NP_061849.2), a gene which is an amino acid transporter. Accordingly, utilities of GAM195 include diagnosis, prevention and treatment of diseases and clinical conditions associated with SLC38A2.

The function of SLC38A2 has been established by previous studies. . Sugawara et al. (2000) cloned a rat skeletal muscle Ata2 cDNA. The deduced Ata2 protein shares 55% sequence identity with the rat glutamine transporter GlnT (Ata1). When expressed in mammalian cells, Ata2 mediated sodium-dependent transport of MeAIB. The Ata2 transporter was specific for neutral amino acids. It was pH-sensitive and lithium-intolerant. The sodium:amino acid stoichiometry was 1:1. When expressed in Xenopus oocytes, transport of neutral amino acids via Ata2 was associated with inward currents. The substrate- induced current was sodium-dependent and pH-sensitive. By screening human fetal brain cDNAs for the potential to encode large proteins, Nagase et al. (2000) isolated a partial ATA2 cDNA, which they called KIAA1382, that lacks 5-prime coding sequence. The deduced 462-amino acid ATA2 partial protein shares 57% amino acid sequence identity with the human transporter protein g17 across 98% of its length. RT-PCR followed by ELISA detected ATA2 expression in all human tissues examined, with the highest level in adult brain. Within the brain, ATA2 expression was found in all regions tested, with the highest level in the subthalamic nucleus.

Full details of the abovementioned studies are described in the following publications, the disclosure of which are hereby incorporated by reference:

Nagase, T.; Kikuno, R.; Ishikawa, K.; Hirosawa, M.; Ohara, O.: Prediction of the coding sequences of unidentified human genes. XVI. The complete sequences of 150 new cDNA clones from brain which code for large proteins in vitro. DNA Res. 7:65-73, 2000; and Sugawara, M.; Nakanishi, T.; Fei, Y.-J.; Huang, W.; Ganapathy, M. E.; Leibach, F. H.; Ganapathy, V.: Cloning of an amino acid transporter with functional characteristics and tissue exp.

Further studies establishing the function and utilities of SLC38A2 are found in John Hopkins OMIM database record ID 605180, and in cited publications listed in Table 5, which are hereby incorporated by reference. Tripartite motif-containing 9 (TRIM9, Accession NP_443210.1) is another GAM195 target gene, herein designated TARGET GENE. TRIM9 BINDING SITE is a target binding site found in the 3' untranslated region of multiple transcripts of mRNA encoded by TRIM9, corresponding to a target binding site such as BINDING SITE I, BINDING SITE II or BINDING SITE III of FIG. 8. Table 4 illustrates the complementarity of the nucleotide sequences of TRIM9 BINDING SITE, designated SEQ ID:10464, to the nucleotide sequence of GAM195 RNA, herein designated GAM RNA, also designated SEQ ID:334.

Another function of GAM195 is therefore inhibition of Tripartite motif-containing 9 (TRIM9, Accession NP_443210.1), a gene which may function as a positive regulator for mannosylphosphate transferase and is required to mediate mannosylphosphate transfer in both the core and outer chain portions of n-linked. oligosaccharides. Accordingly, utilities of GAM195 include diagnosis, prevention and treatment of diseases and clinical conditions associated with TRIM9.

The function of TRIM9 and its association with various diseases and clinical conditions, has been established by previous studies, as described hereinabove with reference to GAM72.1. Was protein family, member 3 (WASF3, Accession NP_006637.2) is another GAM195 target gene, herein designated TARGET GENE. WASF3 BINDING SITE is a target binding site found in the 3' untranslated region of mRNA encoded by WASF3, corresponding to a target binding site such as BINDING SITE I, BINDING SITE II or BINDING SITE III of FIG. 8. Table 4 illustrates the complementarity of the nucleotide sequences of WASF3 BINDING SITE, designated SEQ ID:12232, to the nucleotide sequence of GAM195 RNA, herein designated GAM RNA, also designated SEQ ID:334.

Another function of GAM195 is therefore inhibition of Was protein family, member 3 (WASF3, Accession NP_006637.2), a gene which stimulates actin polymerization. Accordingly, utilities of GAM195 include diagnosis, prevention and treatment of diseases and clinical conditions associated with WASF3.

The function of WASF3 and its association with various diseases and clinical conditions, has been established by previous studies, as described hereinabove with reference to GAM65.2. Zinc finger protein 2 (a1-5) (ZNF2, Accession NP_066574.1) is another GAM195 target gene, herein designated TARGET GENE. ZNF2 BINDING SITE is a target binding site found in the 3' untranslated region of mRNA encoded by ZNF2, corresponding to a target binding site such as BINDING SITE I, BINDING SITE II or BINDING SITE III of FIG. 8. Table 4 illustrates the complementarity of the nucleotide sequences of ZNF2 BINDING SITE, designated SEQ ID:8545, to the nucleotide sequence of GAM195 RNA, herein designated GAM RNA, also designated SEQ ID:334.

Another function of GAM195 is therefore inhibition of Zinc finger protein 2 (a1-5) (ZNF2, Accession NP_066574.1). Accordingly, utilities of GAM195 include diagnosis, prevention and treatment of diseases and clinical conditions associated with ZNF2.

FIG. 8 further provides a conceptual description of a novel bioinformatically detected of the present invention, referred to here as Genomic Address Messenger 196 (GAM196), which modulates expression of respective target genes thereof, the function and utility of which target genes is known in the art.

GAM196 is a novel bioinformatically detected regulatory, non protein coding, micro RNA (miRNA) gene. The method by which GAM196 was detected is described hereinabove with reference to FIGS. 8-15.

GAM196 gene, herein designated GAM GENE, and GAM196 target gene, herein designated TARGET GENE, are human genes contained in the human genome.

GAM196 gene encodes a GAM196 precursor RNA, herein designated GAM PRECURSOR RNA. Similar to other miRNA genes, and unlike most ordinary genes, GAM196 precursor RNA does not encode a protein. A nucleotide sequence identical or highly similar to the nucleotide sequence of GAM196 precursor RNA is designated SEQ ID:67, and is provided hereinbelow with reference to the sequence listing part.

GAM196 precursor RNA folds onto itself, forming GAM196 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM196 precursor RNA folds onto itself, forming GAM196 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM196 precursor RNA, designated SEQ-ID:67, and a schematic representation of a predicted secondary folding of GAM196 folded precursor RNA are further described with reference to Table 2, hereby incorporated by reference.

An enzyme complex designated DICER COMPLEX, 'dices' the GAM196 folded precursor RNA into GAM196 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM196 RNA is designated SEQ ID:209, and is provided hereinbelow with references to the sequence listing part and Table 3, hereby incorporated by reference.

GAM196 target gene, herein designated TARGET GENE, encodes a corresponding messenger RNA, GAM196 target RNA, herein designated GAM TARGET RNA. GAM196 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM196 RNA, herein designated GAM RNA, binds complementarily to one or more target binding sites located in untranslated regions of GAM196 target RNA, herein designated GAM TARGET RNA. This complementary binding is due to the fact that the nucleotide sequence of GAM196 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM196 RNA may have a different number of target binding sites in untranslated regions of a GAM196 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM196 RNA, herein designated GAM RNA, to target binding sites on GAM196 target RNA, herein designated GAM TARGET RNA, such as BINDING SITE I, BINDING SITE II and BINDING SITE III, inhibits translation of GAM196 target RNA into GAM196 target protein, herein designated GAM TARGET PROTEIN. GAM target protein is therefore outlined by a broken line.

It is appreciated that GAM196 target gene, herein designated TARGET GENE, in fact represents a plurality of GAM196 target genes. The mRNA of each one of this plurality of GAM196 target genes comprises one or more target binding sites, each having a nucleotide sequence which is at least partly complementary to GAM196 RNA, herein designated GAM RNA, and which when bound by GAM196 RNA causes inhibition of translation of respective one or more GAM196 target proteins.

It is further appreciated by one skilled in the art that the mode of translational inhibition illustrated by FIG. 8 with specific reference to translational inhibition exerted by GAM196 gene, herein designated GAM GENE, on one or more GAM196 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM196 correlate with, and may be deduced from, the identity of the target genes which GAM196 binds and inhibits, and the function of these target genes, as elaborated hereinbelow.

Adaptor-related protein complex 1, mu 1 subunit (AP1M1, Accession NM_032493.2) is a GAM196 target gene, herein designated TARGET GENE. AP1M1 BINDING SITE is a target binding site found in the 3' untranslated region of mRNA encoded by AP1M1, corresponding to a target binding site such as BINDING SITE I, BINDING SITE II or BINDING SITE III of FIG. 8. Table 4 illustrates the complementarity of the nucleotide sequences of AP1M1 BINDING SITE, designated SEQ ID:18556, to the nucleotide sequence of GAM196 RNA, herein designated GAM RNA, also designated SEQ ID:209.

A function of GAM196 is therefore inhibition of Adaptor-related protein complex 1, mu 1 subunit (AP1M1, Accession NM_032493.2), a gene which promotes the formation of clathrin-coated pits and vesicles. Accordingly, utilities of GAM196 include diagnosis, prevention and treatment of diseases and clinical conditions associated with AP1M1.

The function of AP1M1 and its association with various diseases and clinical conditions, has been established by previous studies, as described hereinabove with reference to GAM130.1. Adaptor-related protein complex 1, sigma 1 subunit (AP1S1, Accession NM_057089.1) is another GAM196 target gene, herein designated TARGET GENE. AP1S1 BINDING SITE is a target binding site found in the 3' untranslated region of multiple transcripts of mRNA encoded by AP1S1, corresponding to a target binding site such as BINDING SITE I, BINDING SITE II or BINDING SITE III of FIG. 8. Table 4 illustrates the complementarity of the nucleotide sequences of AP1S1 BINDING SITE, designated SEQ ID:1717, to the nucleotide sequence of GAM196 RNA, herein designated GAM RNA, also designated SEQ ID:209.

Another function of GAM196 is therefore inhibition of Adaptor-related protein complex 1, sigma 1 subunit (AP1S1, Accession NM_057089.1), a gene which promotes the formation of clathrin-coated pits and vesicles. Accordingly, utilities of GAM196 include diagnosis, prevention and treatment of diseases and clinical conditions associated with AP1S1.

The function of AP1S1 and its association with various diseases and clinical conditions, has been established by previous studies, as described hereinabove with reference to GAM47.1. Chloride channel 6 (CLCN6, Accession NM_021735.1) is another GAM196 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:17159, to the nucleotide sequence of GAM196 RNA, herein designated GAM RNA, also designated SEQ ID:209.

Another function of GAM196 is therefore inhibition of Chloride channel 6 (CLCN6, Accession NM_021735.1), a gene which is a voltage- gated chloride channel. Accordingly, utilities of GAM196 include diagnosis, prevention and treatment of diseases and clinical conditions associated with CLCN6.

The function of CLCN6 and its association with various diseases and clinical conditions, has been established by previous studies, as described hereinabove with reference to GAM40.1. FLJ11722 (Accession NM_024970.1) is another GAM196 target gene, herein designated TARGET GENE. FLJ11722 BINDING SITE is a target binding site found in the 3' untranslated region of mRNA encoded by FLJ11722, corresponding to a target binding site such as BINDING SITE I, BINDING SITE II or BINDING SITE III of FIG. 8. Table 4 illustrates the complementarity of the nucleotide sequences of FLJ11722 BINDING SITE, designated SEQ ID:1140, to the nucleotide sequence of GAM196 RNA, herein designated GAM RNA, also designated SEQ ID:209.

Another function of GAM196 is therefore inhibition of FLJ11722 (Accession NM_024970.1). Accordingly, utilities of GAM196 include diagnosis, prevention and treatment of diseases and clinical conditions associated with FLJ11722.

FLJ14107 (Accession NM_025026.1) is another GAM196 target gene, herein designated TARGET GENE. FLJ14107 BINDING SITE is a target binding site found in the 3' untranslated region of mRNA encoded by FLJ14107, corresponding to a target binding site such as BINDING SITE I, BINDING SITE II or BINDING SITE III of FIG. 8. Table 4 illustrates the complementarity of the nucleotide sequences of FLJ14107 BINDING SITE, designated SEQ ID:17744, to the nucleotide sequence of GAM196 RNA, herein designated GAM RNA, also designated SEQ ID:209.

Another function of GAM196 is therefore inhibition of FLJ14107 (Accession NM_025026.1). Accordingly, utilities of GAM196 include diagnosis, prevention and treatment of diseases and clinical conditions associated with FLJ14107.

FLJ14280 (Accession NM_024886.1) is another GAM196 target gene, herein designated TARGET GENE. FLJ14280 BINDING SITE is a target binding site found in the 3' untranslated region of mRNA encoded by FLJ14280, corresponding to a target binding site such as BINDING SITE I, BINDING SITE II or BINDING SITE III of FIG. 8. Table 4 illustrates the complementarity of the nucleotide sequences of FLJ14280 BINDING SITE, designated SEQ ID:2799, to the nucleotide sequence of GAM196 RNA, herein designated GAM RNA, also designated SEQ ID:209.

Another function of GAM196 is therefore inhibition of FLJ14280 (Accession NM_024886.1). Accordingly, utilities of GAM196 include diagnosis, prevention and treatment of diseases and clinical conditions associated with FLJ14280.

FLJ23447 (Accession NM_024825.1) is another GAM196 target gene, herein designated TARGET GENE. FLJ23447 BINDING SITE is a target binding site found in the 5' untranslated region of mRNA encoded by FLJ23447, corresponding to a target binding site such as BINDING SITE I, BINDING SITE II or BINDING SITE III of FIG. 8. Table 4 illustrates the complementarity of the nucleotide sequences of FLJ23447 BINDING SITE, designated SEQ ID:7447, to the nucleotide sequence of GAM196 RNA, herein designated GAM RNA, also designated SEQ ID:209.

Another function of GAM196 is therefore inhibition of FLJ23447 (Accession NM_024825.1). Accordingly, utilities of GAM196 include diagnosis, prevention and treatment of diseases and clinical conditions associated with FLJ23447.

KIAA1691 (Accession XM_166523.1) is another GAM196 target gene, herein designated TARGET GENE. KIAA1691 BINDING SITE is a target binding site found in the 3' untranslated region of mRNA encoded by KIAA1691, corresponding to a target binding site such as BINDING SITE I, BINDING SITE II or BINDING SITE III of FIG. 8. Table 4 illustrates the complementarity of the nucleotide sequences of KIAA1691 BINDING SITE, designated SEQ ID:14970, to the nucleotide sequence of GAM196 RNA, herein designated GAM RNA, also designated SEQ ID:209.

Another function of GAM196 is therefore inhibition of KIAA1691 (Accession XM_166523.1). Accordingly, utilities of GAM196 include diagnosis, prevention and treatment of diseases and clinical conditions associated with KIAA1691.

KIAA1940 (Accession XM_086981.2) is another GAM196 target gene, herein designated TARGET GENE. KIAA1940 BINDING SITE is a target binding site found in the 3' untranslated region of mRNA encoded by KIAA1940, corresponding to a target binding site such as BINDING SITE I, BINDING SITE II or BINDING SITE III of FIG. 8. Table 4 illustrates the complementarity of the nucleotide sequences of KIAA1940 BINDING SITE, designated SEQ ID:12635, to the nucleotide sequence of GAM196 RNA, herein designated GAM RNA, also designated SEQ ID:209.

Another function of GAM196 is therefore inhibition of KIAA1940 (Accession XM_086981.2). Accordingly, utilities of GAM196 include diagnosis, prevention and treatment of diseases and clinical conditions associated with KIAA1940.

LOC138128 (Accession) is another GAM196 target gene, herein designated TARGET GENE. LOC138128 BINDING SITE is a target binding site found in the 5' untranslated region of mRNA encoded by LOC138128, corresponding to a target binding site such as BINDING SITE I, BINDING SITE II or BINDING SITE III of FIG. 8. Table 4 illustrates the complementarity of the nucleotide sequences of LOC138128 BINDING SITE, designated SEQ ID:16109, to the nucleotide sequence of GAM196 RNA, herein designated GAM RNA, also designated SEQ ID:209.

Another function of GAM196 is therefore inhibition of LOC138128 (Accession). Accordingly, utilities of GAM196 include diagnosis, prevention and treatment of diseases and clinical conditions associated with LOC138128.

LOC149657 (Accession XM_097702.2) is another GAM196 target gene, herein designated TARGET GENE. LOC149657 BINDING SITE is a target binding site found in the 3' untranslated region of mRNA encoded by LOC149657, corresponding to a target binding site such as BINDING SITE I, BINDING SITE II or BINDING SITE III of FIG. 8. Table 4 illustrates the complementarity of the nucleotide sequences of LOC149657 BINDING SITE, designated SEQ ID:10864, to the nucleotide sequence of GAM196 RNA, herein designated GAM RNA, also designated SEQ ID:209.

Another function of GAM196 is therefore inhibition of LOC149657 (Accession XM_097702.2). Accordingly, utilities of GAM196 include diagnosis, prevention and treatment of diseases and clinical conditions associated with LOC149657.

LOC150837 (Accession XM_087019.1) is another GAM196 target gene, herein designated TARGET GENE. LOC150837 BINDING SITE is a target binding site found in the 3' untranslated region of mRNA encoded by LOC150837, corresponding to a target binding site such as BINDING SITE I, BINDING SITE II or BINDING SITE III of FIG. 8. Table 4 illustrates the complementarity of the nucleotide sequences of LOC150837 BINDING SITE, designated SEQ ID:9457, to the nucleotide sequence of GAM196 RNA, herein designated GAM RNA, also designated SEQ ID:209.

Another function of GAM196 is therefore inhibition of LOC150837 (Accession XM_087019.1). Accordingly, utilities of GAM196 include diagnosis, prevention and treatment of diseases and clinical conditions associated with LOC150837.

LOC151556 (Accession) is another GAM196 target gene, herein designated TARGET GENE. LOC151556 BINDING SITE is a target binding site found in the 5' untranslated region of mRNA encoded by LOC151556, corresponding to a target binding site such as BINDING SITE I, BINDING SITE II or BINDING SITE III of FIG. 8. Table 4 illustrates the complementarity of the nucleotide sequences of LOC151556 BINDING SITE, designated SEQ ID:2480, to the nucleotide sequence of GAM196 RNA, herein designated GAM RNA, also designated SEQ ID:209.

Another function of GAM196 is therefore inhibition of LOC151556 (Accession). Accordingly, utilities of GAM196 include diagnosis, prevention and treatment of diseases and clinical conditions associated with LOC151556.

LOC254016 (Accession) is another GAM196 target gene, herein designated TARGET GENE. LOC254016 BINDING SITE is a target binding site found in the 3' untranslated region of mRNA encoded by LOC254016, corresponding to a target binding site such as BINDING SITE I, BINDING SITE II or BINDING SITE III of FIG. 8. Table 4 illustrates the complementarity of the nucleotide sequences of LOC254016 BINDING SITE, designated SEQ ID:17846, to the nucleotide sequence of GAM196 RNA, herein designated GAM RNA, also designated SEQ ID:209.

Another function of GAM196 is therefore inhibition of LOC254016 (Accession). Accordingly, utilities of GAM196 include diagnosis, prevention and treatment of diseases and clinical conditions associated with LOC254016.

Nebulin-related anchoring protein (Nrap, Accession NM_006175.2) is another GAM196 target gene, herein designated TARGET GENE. Nrap BINDING SITE is a target binding site found in the 3' untranslated region of mRNA encoded by Nrap, corresponding to a target binding site such as BINDING SITE I, BINDING SITE II or BINDING SITE III of FIG. 8. Table 4 illustrates the complementarity of the nucleotide sequences of Nrap BINDING SITE, designated SEQ ID:5880, to the nucleotide sequence of GAM196 RNA, herein designated GAM RNA, also designated SEQ ID:209.

Another function of GAM196 is therefore inhibition of Nebulin-related anchoring protein (Nrap, Accession NM_006175.2), a gene which performs an anchoring function to link the terminal actin filaments of myofibrils to protein complexes located beneath the sarcolemma. Accordingly, utilities of GAM196 include diagnosis, prevention and treatment of diseases and clinical conditions associated with Nrap.

The function of Nrap and its association with various diseases and clinical conditions, has been established by previous studies, as described hereinabove with reference to GAM72.1. Shb (src homology 2 domain containing) adaptor protein b (SHB, Accession NM_003028.1) is another GAM196 target gene, herein designated TARGET GENE. SHB BINDING SITE is a target binding site found in the 5' untranslated region of mRNA encoded by SHB, corresponding to a target binding site such as BINDING SITE I, BINDING SITE II or BINDING SITE III of FIG. 8. Table 4 illustrates the complementarity of the nucleotide sequences of SHB BINDING SITE, designated SEQ ID:5017, to the nucleotide sequence of GAM196 RNA, herein designated GAM RNA, also designated SEQ ID:209.

Another function of GAM196 is therefore inhibition of Shb (src homology 2 domain containing) adaptor protein b (SHB, Accession NM_003028.1), a gene which is an adaptor protein, mediates the interaction of other proteins. Accordingly, utilities of GAM196 include diagnosis, prevention and treatment of diseases and clinical conditions associated with SHB.

The function of SHB has been established by previous studies. Many proteins involved in the regulation of cellular proliferation contain sequence motifs named SH2 and SH3 (Pawson and Gish, 1992). These domains mediate interaction with other proteins; the SH2 domain interacts with tyrosine phosphorylation sites, while SH3 domains interact with proline-rich sequences. Many signal transduction pathways involve the induction of the formation of complexes of proteins such as growth factor receptors, adaptor proteins, and target enzymes through SH2 and SH3 interactions. Adaptor proteins are molecules with multiple protein interaction motifs that do not appear to have catalytic activity of their own but mediate the interaction of other proteins. The SHB gene encodes 2 such adaptor proteins (from 2 different start methionines) of 67 and 56 kD (Welsh et al., 1994). By PCR analysis of a somatic cell hybrid mapping panel, Yulug et al. (1994) mapped the SHB gene to chromosome 9. By fluorescence in situ hybridization, they regionalized the gene to 9p12-p11.

Full details of the abovementioned studies are described in the following publications, the disclosure of which are hereby incorporated by reference:

Welsh, M.; Mares, J.; Karlsson, T.; Lavergne, C.; Breant, B.; Claesson-Welsh, L. : Shb is a ubiquitously expressed Src homology 2 protein. Oncogene 9: 19-27, 1994; and Yulug, I. G.; Hillermann, R.; Fisher, E. M. C.: The SHB adaptor protein maps to human chromosome 9. Genomics 24:615-617, 1994.

Further studies establishing the function and utilities of SHB are found in John Hopkins OMIM database record ID 600314, and in cited publications listed in Table 5, which are hereby incorporated by reference. TSLP (Accession NM_033035.2) is another GAM196 target gene, herein designated TARGET GENE. TSLP BINDING SITE is a target binding site found in the 5' untranslated region of multiple transcripts of mRNA encoded by TSLP, corresponding to a target binding site such as BINDING SITE I, BINDING SITE II or BINDING SITE III of FIG. 8. Table 4 illustrates the complementarity of the nucleotide sequences of TSLP BINDING SITE, designated SEQ ID:8451, to the nucleotide sequence of GAM196 RNA, herein designated GAM RNA, also designated SEQ ID:209.

Another function of GAM196 is therefore inhibition of TSLP (Accession NM_033035.2), a gene which may contribute directly to the activation of Langerhans cells and inhibit apoptosis. Accordingly, utilities of GAM196 include diagnosis, prevention and treatment of diseases and clinical conditions associated with TSLP.

The function of TSLP has been established by previous studies. By EST and genomic database screening for sequences similar to IL7, followed by screening a lung fibroblast sarcoma cDNA library, Reche et al. (2001) obtained a cDNA encoding TSLP. The deduced 159-amino acid protein, which is only 43% identical to mouse Tslp, contains a 28-residue signal sequence, 6 cysteines, and 2 N-glycosylation sites. SDS-PAGE analysis showed expression of a 23-kD protein, larger than the predicted 15 kD, suggesting that TSLP is glycosylated. PCR analysis of a panel of cDNA libraries and cultured cell lines indicated that expression of a 1.3-kb TSLP transcript may be restricted to a few lung libraries. Reche et al. (2001) also identified TSLP receptor, which is composed of TSLPR (CRLF2; 300357) and IL7R (OMIM Ref. No. 146661) subunits. Dendritic cells (DCs) and monocytes coexpress IL7R and TSLPR. Quentmeier et al. (2001) also cloned and characterized TSLP. They noted the presence of 7 basic C-terminal amino acids (KKRRKRK) in the protein and that 6 of the 7 cysteines in the mouse protein (those involved in disulfide bond formation) are conserved in human, whereas the sites for N-glycosylation are distinct. Northern blot analysis revealed wide expression of an approximately 1.1-kb transcript, with highest levels in heart, liver, testis, and prostate. Reche et al. (2001) showed that incubation of DCs or monocytes with TSLP enhanced the expression of CCL17 (OMIM Ref. No. 601520), CCL18 (OMIM Ref. No. 603757), CCL22 (OMIM Ref. No. 602957), and CCL19 (OMIM Ref. No. 602227). IL7, on the other hand, induced expression of CCL17, CCL22, and CCL19, but also CXCL8 (OMIM Ref. No. 146930), CXCL7 (OMIM Ref. No. 121010), CXCL5 (OMIM Ref. No. 600324), CXCL1 (OMIM Ref. No. 155730), CXCL2 (OMIM Ref. No. 139110), and CXCL3 (OMIM Ref. No. 139111). Functional analysis indicated that TSLP enhances the DC maturation process, as evidenced by upregulation of DC markers and costimulatory molecules and stronger T-cell proliferation. By screening myeloid cell lines, Quentmeier et al. (2001) established that an acute myeloid leukemia line, MUTZ-3, responds by proliferating in response to TSLP. TSLP also inhibited apoptosis in these cells. Proliferation in response to TSLP could not be attributed to the production of other growth factors tested and could be inhibited by relatively high concentrations of anti-IL7R. TSLP, like IL7, stimulated phosphorylation of STAT5 (OMIM Ref. No. 601511), but unlike IL7, it did not activate JAK3 (OMIM Ref. No. 600173). TSLP did not phosphorylate mitogen-activated protein kinases (e.g., ERK1; 601795). By flow cytometric analysis, Soumelis et al. (2002) showed that TSLP-activated DCs (TSLP-DCs) express higher levels of HLA-DR and DCLAMP (OMIM Ref. No. 605883) than do nonactivated or IL7-activated DCs, and that TSLP-DCs induce marked proliferation and expansion of allogeneic naive CD4 (OMIM Ref. No. 186940)-positive T cells. Quantitative mRNA screening and ELISA analysis showed that TSLP-DCs do not produce detectable proinflammatory cytokines, but do produce high levels of TARC (CCL17) and MDC (CCL22) chemokines, which preferentially attract CCR4 (OMIM Ref. No. 604836)-expressing Th2 lymphocytes. TSLP-DCs induced CD4 cells to produce high amounts of IL13 (OMIM Ref. No. 147683), IL5 (OMIM Ref. No. 147850), and the proinflammatory cytokine tumor necrosis factor (TNF; 191160), but only low amounts of IL10 (OMIM Ref. No. 124092) and gamma-interferon (IFNG; 147570). RT-PCR analysis did not detect TSLP in most hemopoietic cells, the exception being mast cells. Keratinocytes, epithelial cells, smooth muscle cells, and lung fibroblasts also expressed high levels of TSLP. Within tonsils, highest levels were in crypt epithelial cells. Soumelis et al. (2002) suggested that TSLP may contribute to constitutive inflammation in this tissue and sporadic inflammation in squamous epithelium. Immunohistochemical analysis of allergic inflammatory tissue showed high expression of TSLP in keratinocytes of acute and chronic atopic dermatitis lesions, but no expression in normal skin. Strong TSLP expression in atopic dermatitis was associated with the disappearance of langerin (OMIM Ref. No. 604862)-positive Langerhans cells within the epidermis and the concurrent appearance of many DCLAMP- activated DCs within the dermis, many of which expressed langerin. Soumelis et al. (2002) proposed that TSLP expression by keratinocytes in atopic dermatitis lesions may contribute directly to the activation of Langerhans cells, which may migrate into the dermis and then the draining lymph nodes where they can prime allergen-specific Th2 responses.

Full details of the abovementioned studies are described in the following publications, the disclosure of which are hereby incorporated by reference:

Reche, P. A.; Soumelis, V.; Gorman, D. M.; Clifford, T.; Liu, M.; Travis, M.; Zurawski, S. M.; Johnston, J.; Liu, Y.-J.; Spits, H.; de Waal Malefy, R.; Kastelein, R. A.; Bazan, J. F.: Human thymic stromal lymphopoietin preferentially stimulates myeloid cells. J. Immun. 167:336-343, 2001; and Soumelis, V.; Reche, P. A.; Kanzler, H.; Yuan, W.; Edward, G.; Homey, B.; Gilliet, M.; Ho, S.; Antonenko, S.; Lauerma, A.; Smith, K.; Gorman, D.; Zurawski, S.; Abrams, J.; Menon, S.; Mc.

Further studies establishing the function and utilities of TSLP are found in John Hopkins OMIM database record ID 607003, and in cited publications listed in Table 5, which are hereby incorporated by reference.

FIG. 8 further provides a conceptual description of a novel bioinformatically detected of the present invention, referred to here as Genomic Address Messenger 281 (GAM281), which modulates expression of respective target genes thereof, the function and utility of which target genes is known in the art.

GAM281 is a novel bioinformatically detected regulatory, non protein coding, micro RNA (miRNA) gene. The method by which GAM281 was detected is described hereinabove with reference to FIGS. 8-15.

GAM281 gene, herein designated GAM GENE, and GAM281 target gene, herein designated TARGET GENE, are human genes contained in the human genome.

GAM281 gene encodes a GAM281 precursor RNA, herein designated GAM PRECURSOR RNA. Similar to other miRNA genes, and unlike most ordinary genes, GAM281 precursor RNA does not encode a protein. A nucleotide sequence identical or highly similar to the nucleotide sequence of GAM281 precursor RNA is designated SEQ ID:164, and is provided hereinbelow with reference to the sequence listing part.

GAM281 precursor RNA folds onto itself, forming GAM281 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM281 precursor RNA folds onto itself, forming GAM281 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM281 precursor RNA, designated SEQ-ID:164, and a schematic representation of a predicted secondary folding of GAM281 folded precursor RNA are further described with reference to Table 2, hereby incorporated by reference.

An enzyme complex designated DICER COMPLEX, 'dices' the GAM281 folded precursor RNA into GAM281 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM281 RNA is designated SEQ ID:278, and is provided hereinbelow with references to the sequence listing part and Table 3, hereby incorporated by reference.

GAM281 target gene, herein designated TARGET GENE, encodes a corresponding messenger RNA, GAM281 target RNA, herein designated GAM TARGET RNA. GAM281 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM281 RNA, herein designated GAM RNA, binds complementarily to one or more target binding sites located in untranslated regions of GAM281 target RNA, herein designated GAM TARGET RNA. This complementary binding is due to the fact that the nucleotide sequence of GAM281 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM281 RNA may have a different number of target binding sites in untranslated regions of a GAM281 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM281 RNA, herein designated GAM RNA, to target binding sites on GAM281 target RNA, herein designated GAM TARGET RNA, such as BINDING SITE I, BINDING SITE II and BINDING SITE III, inhibits translation of GAM281 target RNA into GAM281 target protein, herein designated GAM TARGET PROTEIN. GAM target protein is therefore outlined by a broken line.

It is appreciated that GAM281 target gene, herein designated TARGET GENE, in fact represents a plurality of GAM281 target genes. The mRNA of each one of this plurality of GAM281 target genes comprises one or more target binding sites, each having a nucleotide sequence which is at least partly complementary to GAM281 RNA, herein designated GAM RNA, and which when bound by GAM281 RNA causes inhibition of translation of respective one or more GAM281 target proteins.

It is further appreciated by one skilled in the art that the mode of translational inhibition illustrated by FIG. 8 with specific reference to translational inhibition exerted by GAM281 gene, herein designated GAM GENE, on one or more GAM281 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM281 correlate with, and may be deduced from, the identity of the target genes which GAM281 binds and inhibits, and the function of these target genes, as elaborated hereinbelow.

(Accession NP_444285.1) is a GAM281 target gene, herein designated TARGET GENE. BINDING SITE is a target binding site found in the 3' untranslated region of multiple transcripts of mRNA encoded by, corresponding to a target binding site such as BINDING SITE I, BINDING SITE II or BINDING SITE III of FIG. 8. Table 4 illustrates the complementarity of the nucleotide sequences of BINDING SITE, designated SEQ ID:13946, to the nucleotide sequence of GAM281 RNA, herein designated GAM RNA, also designated SEQ ID:278.

A function of GAM281 is therefore inhibition of (Accession NP_444285.1). Accordingly, utilities of GAM281 include diagnosis, prevention and treatment of diseases and clinical conditions associated with .

15E1.2 (Accession XP_290596.1) is another GAM281 target gene, herein designated TARGET GENE. 15E1.2 BINDING SITE is a target binding site found in the 3' untranslated region of mRNA encoded by 15E1.2, corresponding to a target binding site such as BINDING SITE I, BINDING SITE II or BINDING SITE III of FIG. 8. Table 4 illustrates the complementarity of the nucleotide sequences of 15E1.2 BINDING SITE, designated SEQ ID:12868, to the nucleotide sequence of GAM281 RNA, herein designated GAM RNA, also designated SEQ ID:278.

Another function of GAM281 is therefore inhibition of 15E1.2 (Accession XP_290596.1). Accordingly, utilities of GAM281 include diagnosis, prevention and treatment of diseases and clinical conditions associated with 15E1.2.

Alpha-1-b glycoprotein (A1BG, Accession NP_570602.2) is another GAM281 target gene, herein designated TARGET GENE. A1BG BINDING SITE1 and A1BG BINDING SITE2 are target binding sites found in untranslated regions of mRNA encoded by A1BG, corresponding to target binding sites such as BINDING SITE I, BINDING SITE II or BINDING SITE III of FIG. 8. Table 4 illustrates the complementarity of the nucleotide sequences of A1BG BINDING SITE1 and A1BG BINDING SITE2, designated SEQ ID:18868 and SEQ ID:2534 respectively, to the nucleotide sequence of GAM281 RNA, herein designated GAM RNA, also designated SEQ ID:278.

Another function of GAM281 is therefore inhibition of Alpha-1-b glycoprotein (A1BG, Accession NP_570602.2), a gene which plays a plasma protein of unknown function. Accordingly, utilities of GAM281 include diagnosis, prevention and treatment of diseases and clinical conditions associated with A1BG.

The function of A1BG and its association with various diseases and clinical conditions, has been established by previous studies, as described hereinabove with reference to GAM130.1. Aminoadipate-semialdehyde synthase (AASS, Accession NP_005754.2) is another GAM281 target gene, herein designated TARGET GENE. AASS BINDING SITE is a target binding site found in the 3' untranslated region of mRNA encoded by AASS, corresponding to a target binding site such as BINDING SITE I, BINDING SITE II or BINDING SITE III of FIG. 8. Table 4 illustrates the complementarity of the nucleotide sequences of AASS BINDING SITE, designated SEQ ID:6339, to the nucleotide sequence of GAM281 RNA, herein designated GAM RNA, also designated SEQ ID:278.

Another function of GAM281 is therefore inhibition of Aminoadipate-semialdehyde synthase (AASS, Accession NP_005754.2). Accordingly, utilities of GAM281 include diagnosis, prevention and treatment of diseases and clinical conditions associated with AASS.

ABCA13 (Accession NP_689914.2) is another GAM281 target gene, herein designated TARGET GENE. ABCA13 BINDING SITE is a target binding site found in the 3' untranslated region of mRNA encoded by ABCA13, corresponding to a target binding site such as BINDING SITE I, BINDING SITE II or BINDING SITE III of FIG. 8. Table 4 illustrates the complementarity of the nucleotide sequences of ABCA13 BINDING SITE, designated SEQ ID:7385, to the nucleotide sequence of GAM281 RNA, herein designated GAM RNA, also designated SEQ ID:278.

Another function of GAM281 is therefore inhibition of ABCA13 (Accession NP_689914.2). Accordingly, utilities of GAM281 include diagnosis, prevention and treatment of diseases and clinical conditions associated with ABCA13.

Atp-binding cassette, sub-family c (cftr/mrp), member 11 (ABCC11, Accession NP_149163.2) is another GAM281 target gene, herein designated TARGET GENE. ABCC11 BINDING SITE is a target binding site found in the 5' untranslated region of multiple transcripts of mRNA encoded by ABCC11, corresponding to a target binding site such as BINDING SITE I, BINDING SITE II or BINDING SITE III of FIG. 8. Table 4 illustrates the complementarity of the nucleotide sequences of ABCC11 BINDING SITE, designated SEQ ID:7022, to the nucleotide sequence of GAM281 RNA, herein designated GAM RNA, also designated SEQ ID:278.

Another function of GAM281 is therefore inhibition of Atp-binding cassette, sub-family c (cftr/mrp), member 11 (ABCC11, Accession NP_149163.2), a gene which acts as a multispecific organic anion pump which can transport nucleotide analogs (by similarity). Accordingly, utilities of GAM281 include diagnosis, prevention and treatment of diseases and clinical conditions associated with ABCC11.

The function of ABCC11 and its association with various diseases and clinical conditions, has been established by previous studies, as described hereinabove with reference to GAM189.1. Actin binding lim protein 2 (ABLIM2, Accession NP_115808.1) is another GAM281 target gene, herein designated TARGET GENE. ABLIM2 BINDING SITE is a target binding site found in the 5' untranslated region of mRNA encoded by ABLIM2, corresponding to a target binding site such as BINDING SITE I, BINDING SITE II or BINDING SITE III of FIG. 8. Table 4 illustrates the complementarity of the nucleotide sequences of ABLIM2 BINDING SITE, designated SEQ ID:3488, to the nucleotide sequence of GAM281 RNA, herein designated GAM RNA, also designated SEQ ID:278.

Another function of GAM281 is therefore inhibition of Actin binding lim protein 2 (ABLIM2, Accession NP_115808.1). Accordingly, utilities of GAM281 include diagnosis, prevention and treatment of diseases and clinical conditions associated with ABLIM2.

Acyl-coenzyme a dehydrogenase, short/branched chain (ACADSB, Accession NP_001600.1) is another GAM281 target gene, herein designated TARGET GENE. ACADSB BINDING SITE is a target binding site found in the 3' untranslated region of mRNA encoded by ACADSB, corresponding to a target binding site such as BINDING SITE I, BINDING SITE II or BINDING SITE III of FIG. 8. Table 4 illustrates the complementarity of the nucleotide sequences of ACADSB BINDING SITE, designated SEQ ID:16689, to the nucleotide sequence of GAM281 RNA, herein designated GAM RNA, also designated SEQ ID:278.

Another function of GAM281 is therefore inhibition of Acyl-coenzyme a dehydrogenase, short/branched chain (ACADSB, Accession NP_001600.1). Accordingly, utilities of GAM281 include diagnosis, prevention and treatment of diseases and clinical conditions associated with ACADSB.

A disintegrin-like and metalloprotease (reprolysin type) with thrombospondin type 1 motif, 3 (ADAMTS3, Accession NP_055058.1) is another GAM281 target gene, herein designated TARGET GENE. ADAMTS3 BINDING SITE is a target binding site found in the 5' untranslated region of mRNA encoded by ADAMTS3, corresponding to a target binding site such as BINDING SITE I, BINDING SITE II or BINDING SITE III of FIG. 8. Table 4 illustrates the complementarity of the nucleotide sequences of ADAMTS3 BINDING SITE, designated SEQ ID:16811, to the nucleotide sequence of GAM281 RNA, herein designated GAM RNA, also designated SEQ ID:278.

Another function of GAM281 is therefore inhibition of A disintegrin-like and metalloprotease (reprolysin type) with thrombospondin type 1 motif, 3 (ADAMTS3, Accession NP_055058.1), a gene which cleaves the propeptides of type ii collagen prior to fibril assembly. Accordingly, utilities of GAM281 include diagnosis, prevention and treatment of diseases and clinical conditions associated with ADAMTS3.

The function of ADAMTS3 and its association with various diseases and clinical conditions, has been established by previous studies, as described hereinabove with reference to GAM216.1. A disintegrin-like and metalloprotease (reprolysin type) with thrombospondin type 1 motif, 4 (ADAMTS4, Accession NP_005090.1) is another GAM281 target gene, herein designated TARGET GENE. ADAMTS4 BINDING SITE1 and ADAMTS4 BINDING SITE2 are target binding sites found in untranslated regions of mRNA encoded by ADAMTS4, corresponding to target binding sites such as BINDING SITE I, BINDING SITE II or BINDING SITE III of FIG. 8. Table 4 illustrates the complementarity of the nucleotide sequences of ADAMTS4 BINDING SITE1 and ADAMTS4 BINDING SITE2, designated SEQ ID:13757 and SEQ ID:1651 respectively, to the nucleotide sequence of GAM281 RNA, herein designated GAM RNA, also designated SEQ ID:278.

Another function of GAM281 is therefore inhibition of A disintegrin-like and metalloprotease (reprolysin type) with thrombospondin type 1 motif, 4 (ADAMTS4, Accession NP_005090.1), a gene which cleaves aggrecan, a cartilage proteoglycan, and may be involved in its turnover. Accordingly, utilities of GAM281 include diagnosis, prevention and treatment of diseases and clinical conditions associated with ADAMTS4.

The function of ADAMTS4 and its association with various diseases and clinical conditions, has been established by previous studies, as described hereinabove with reference to GAM189.1. Adenosine deaminase, rna-specific, b1 (red1 homolog rat) (ADARB1, Accession NP_056648.1) is another GAM281 target gene, herein designated TARGET GENE. ADARB1 BINDING SITE is a target binding site found in the 3' untranslated region of multiple transcripts of mRNA encoded by ADARB1, corresponding to a target binding site such as BINDING SITE I, BINDING SITE II or BINDING SITE III of FIG. 8. Table 4 illustrates the complementarity of the nucleotide sequences of ADARB1 BINDING SITE, designated SEQ ID:12610, to the nucleotide sequence of GAM281 RNA, herein designated GAM RNA, also designated SEQ ID:278.

Another function of GAM281 is therefore inhibition of Adenosine deaminase, rna-specific, b1 (red1 homolog rat) (ADARB1, Accession NP_056648.1), a gene which RNA editing involves the deamination of adenosines at specific sites. Accordingly, utilities of GAM281 include diagnosis, prevention and treatment of diseases and clinical conditions associated with ADARB1.

The function of ADARB1 has been established by previous studies. RNA editing involves the deamination of adenosines at specific sites, the result of which can be a change in the amino acid sequence of the protein so that it differs from that predicted by the sequence of the DNA. Editing of the glutamate receptor B (GluRB; 138247) pre-mRNA has been shown to alter a codon (referred to as the Q/R site) for a channel determinant that controls the calcium permeability of the AMPA glutamate receptors. Melcher et al. (1996) tested the candidate dsRNA adenosine deaminase DRADA (OMIM Ref. No. 601059) and showed that when coexpressed with a GluR-B minigene in HEK 293 cells, DRADA produced low-level editing at the GluR-B Q/R site. The authors then screened a rat brain cDNA library with the predicted catalytic domain of rat DRADA to identify other potential editing enzymes. A cDNA encoding a predicted 711-amino acid protein was isolated that gave about 90% of the expected activity in their editing assay. Melcher et al. (1996) designated this novel mammalian RNA editing protein RNA-editing enzyme-1 (RED1). Rat RED1 and DRADA share about 31% overall identity primarily due to their conservation in the C-terminal catalytic domain. Northern blots showed highest expression of RED1 in rat brain. Melcher et al. (1996) further observed that while RED1 was more efficient at deaminating some sites, DRADA had stronger activity at others. They speculated that a combination of these and perhaps other editing enzymes may be involved in determining the overall editing process for a given transcript. Higuchi et al. (2000) studied ADAR2-mediated RNA editing by generating mice that were homozygous for a targeted functional null allele. Editing in Adar2 -/- mice was substantially reduced at most of 25 positions in diverse transcripts; the mutant mice became prone to seizures and died young. The impaired phenotype appeared to result entirely from a single underedited position, since it reverted to normal when both alleles for the underedited transcript were substituted with alleles encoding the edited version exonically. The critical position specifies an ion channel determinant, the Q/R site, in AMPA receptor GluRB premessenger RNA. Higuchi et al. (2000) concluded that this transcript is physiologically the most important substrate of ADAR2.

Full details of the abovementioned studies are described in the following publications, the disclosure of which are hereby incorporated by reference:

Melcher, T.; Maas, S.; Herb, A.; Sprengel, R.; Seeburg, P. H.; Higuchi, M.: A mammalian RNA editing enzyme. Nature 379:460-463, 1996; and Higuchi, M.; Maas, S.; Single, F. N.; Hartner, J.; Rozov, A.; Burnashev, N.; Feldmeyer, D.; Sprengel, R.; Seeburg, P. H.: Point mutation in an AMPA receptor gene rescues lethality in mi.

Further studies establishing the function and utilities of ADARB1 are found in John Hopkins OMIM database record ID 601218, and in cited publications listed in Table 5, which are hereby incorporated by reference. Adenylate cyclase 1 (brain) (ADCY1, Accession NP_066939.1) is another GAM281 target gene, herein designated TARGET GENE. ADCY1 BINDING SITE is a target binding site found in the 3' untranslated region of multiple transcripts of mRNA encoded by ADCY1, corresponding to a target binding site such as BINDING SITE I, BINDING SITE II or BINDING SITE III of FIG. 8. Table 4 illustrates the complementarity of the nucleotide sequences of ADCY1 BINDING SITE, designated SEQ ID:6261, to the nucleotide sequence of GAM281 RNA, herein designated GAM RNA, also designated SEQ ID:278.

Another function of GAM281 is therefore inhibition of Adenylate cyclase 1 (brain) (ADCY1, Accession NP_066939.1), a gene which a calmodulin-sensitive adenylyl cyclase. it may play a role in memory acquisition and learning. Accordingly, utilities of GAM281 include diagnosis, prevention and treatment of diseases and clinical conditions associated with ADCY1.

The function of ADCY1 and its association with various diseases and clinical conditions, has been established by previous studies, as described hereinabove with reference to GAM144.1. Adenylate cyclase 6 (ADCY6, Accession NP_056085.1) is another GAM281 target gene, herein designated TARGET GENE. ADCY6 BINDING SITE is a target binding site found in the 5' untranslated region of multiple transcripts of mRNA encoded by ADCY6, corresponding to a target binding site such as BINDING SITE I, BINDING SITE II or BINDING SITE III of FIG. 8. Table 4 illustrates the complementarity of the nucleotide sequences of ADCY6 BINDING SITE, designated SEQ ID:16688, to the nucleotide sequence of GAM281 RNA, herein designated GAM RNA, also designated SEQ ID:278.

Another function of GAM281 is therefore inhibition of Adenylate cyclase 6 (ADCY6, Accession NP_056085.1), a gene which this a membrane-bound, ca(2+)-inhibitable adenylyl cyclase (by similarity). Accordingly, utilities of GAM281 include diagnosis, prevention and treatment of diseases and clinical conditions associated with ADCY6.

The function of ADCY6 and its association with various diseases and clinical conditions, has been established by previous studies, as described hereinabove with reference to GAM67.2. Adenosine a2a receptor (ADORA2A, Accession NP_000666.2) is another GAM281 target gene, herein designated TARGET GENE. ADORA2A BINDING SITE is a target binding site found in the 3' untranslated region of mRNA encoded by ADORA2A, corresponding to a target binding site such as BINDING SITE I, BINDING SITE II or BINDING SITE III of FIG. 8. Table 4 illustrates the complementarity of the nucleotide sequences of ADORA2A BINDING SITE, designated SEQ ID:19456, to the nucleotide sequence of GAM281 RNA, herein designated GAM RNA, also designated SEQ ID:278.

Another function of GAM281 is therefore inhibition of Adenosine a2a receptor (ADORA2A, Accession NP_000666.2), a gene which regulates phagocytosis, apoptosis and platelet aggregation. Accordingly, utilities of GAM281 include diagnosis, prevention and treatment of diseases and clinical conditions associated with ADORA2A.

The function of ADORA2A and its association with various diseases and clinical conditions, has been established by previous studies, as described hereinabove with reference to GAM139.1. Agmatine ureohydrolase (agmatinase) (AGMAT, Accession NP_079034.2) is another GAM281 target gene, herein designated TARGET GENE. AGMAT BINDING SITE is a target binding site found in the 3' untranslated region of mRNA encoded by AGMAT, corresponding to a target binding site such as BINDING SITE I, BINDING SITE II or BINDING SITE III of FIG. 8. Table 4 illustrates the complementarity of the nucleotide sequences of AGMAT BINDING SITE, designated SEQ ID:9193, to the nucleotide sequence of GAM281 RNA, herein designated GAM RNA, also designated SEQ ID:278.

Another function of GAM281 is therefore inhibition of Agmatine ureohydrolase (agmatinase) (AGMAT, Accession NP_079034.2). Accordingly, utilities of GAM281 include diagnosis, prevention and treatment of diseases and clinical conditions associated with AGMAT.

Angiotensin ii receptor-associated protein (AGTRAP, Accession NP_065083.2) is another GAM281 target gene, herein designated TARGET GENE. AGTRAP BINDING SITE is a target binding site found in the 3' untranslated region of mRNA encoded by AGTRAP, corresponding to a target binding site such as BINDING SITE I, BINDING SITE II or BINDING SITE III of FIG. 8. Table 4 illustrates the complementarity of the nucleotide sequences of AGTRAP BINDING SITE, designated SEQ ID:3359, to the nucleotide sequence of GAM281 RNA, herein designated GAM RNA, also designated SEQ ID:278.

Another function of GAM281 is therefore inhibition of Angiotensin ii receptor-associated protein (AGTRAP, Accession NP_065083.2). Accordingly, utilities of GAM281 include diagnosis, prevention and treatment of diseases and clinical conditions associated with AGTRAP.

Aryl hydrocarbon receptor (AHR, Accession NP_001612.1) is another GAM281 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:8217, to the nucleotide sequence of GAM281 RNA, herein designated GAM RNA, also designated SEQ ID:278.

Another function of GAM281 is therefore inhibition of Aryl hydrocarbon receptor (AHR, Accession NP_001612.1), a gene which plays a role in modulating carcinogenesis through the induction of xenobiotic-metabolizing enzymes and therefore may be associated with Stomach tumors. Accordingly, utilities of GAM281 include diagnosis, prevention and treatment of Stomach tumors, and of other diseases and clinical conditions associated with AHR.

The function of AHR and its association with various diseases and clinical conditions, has been established by previous studies, as described hereinabove with reference to GAM30.1. Absent in melanoma 1 (AIM1, Accession XP_166300.1) is another GAM281 target gene, herein designated TARGET GENE. AIM1 BINDING SITE is a target binding site found in the 3' untranslated region of mRNA encoded by AIM1, corresponding to a target binding site such as BINDING SITE I, BINDING SITE II or BINDING SITE III of FIG. 8. Table 4 illustrates the complementarity of the nucleotide sequences of AIM1 BINDING SITE, designated SEQ ID:16864, to the nucleotide sequence of GAM281 RNA, herein designated GAM RNA, also designated SEQ ID:278.

Another function of GAM281 is therefore inhibition of Absent in melanoma 1 (AIM1, Accession XP_166300.1), a gene which is altered in association with tumor suppression in a model of human melanoma and therefore may be associated with Malignant melanoma. Accordingly, utilities of GAM281 include diagnosis, prevention and treatment of Malignant melanoma, and of other diseases and clinical conditions associated with AIM1.

The function of AIM1 and its association with various diseases and clinical conditions, has been established by previous studies, as described hereinabove with reference to GAM136.1. Aldehyde dehydrogenase 1 family, member b1 (ALDH1B1, Accession NP_000683.3) is another GAM281 target gene, herein designated TARGET GENE. ALDH1B1 BINDING SITE is a target binding site found in the 3' untranslated region of mRNA encoded by ALDH1B1, corresponding to a target binding site such as BINDING SITE I, BINDING SITE II or BINDING SITE III of FIG. 8. Table 4 illustrates the complementarity of the nucleotide sequences of ALDH1B1 BINDING SITE, designated SEQ ID:2153, to the nucleotide sequence of GAM281 RNA, herein designated GAM RNA, also designated SEQ ID:278.

Another function of GAM281 is therefore inhibition of Aldehyde dehydrogenase 1 family, member b1 (ALDH1B1, Accession NP_000683.3). Accordingly, utilities of GAM281 include diagnosis, prevention and treatment of diseases and clinical conditions associated with ALDH1B1.

Arachidonate 15-lipoxygenase (ALOX15, Accession NP_001131.1) is another GAM281 target gene, herein designated TARGET GENE. ALOX15 BINDING SITE is a target binding site found in the 3' untranslated region of mRNA encoded by ALOX15, corresponding to a target binding site such as BINDING SITE I, BINDING SITE II or BINDING SITE III of FIG. 8. Table 4 illustrates the complementarity of the nucleotide sequences of ALOX15 BINDING SITE, designated SEQ ID:19939, to the nucleotide sequence of GAM281 RNA, herein designated GAM RNA, also designated SEQ ID:278.

Another function of GAM281 is therefore inhibition of Arachidonate 15-lipoxygenase (ALOX15, Accession NP_001131.1), a gene which converts arachidonic acid to 15s-hydroperoxyeicosatetraenoic acid. Accordingly, utilities of GAM281 include diagnosis, prevention and treatment of diseases and clinical conditions associated with ALOX15.

The function of ALOX15 and its association with various diseases and clinical conditions, has been established by previous studies, as described hereinabove with reference to GAM189.1. AMID (Accession NP_116186.1) is another GAM281 target gene, herein designated TARGET GENE. AMID BINDING SITE is a target binding site found in the 3' untranslated region of mRNA encoded by AMID, corresponding to a target binding site such as BINDING SITE I, BINDING SITE II or BINDING SITE III of FIG. 8. Table 4 illustrates the complementarity of the nucleotide sequences of AMID BINDING SITE, designated SEQ ID:5895, to the nucleotide sequence of GAM281 RNA, herein designated GAM RNA, also designated SEQ ID:278.

Another function of GAM281 is therefore inhibition of AMID (Accession NP_116186.1). Accordingly, utilities of GAM281 include diagnosis, prevention and treatment of diseases and clinical conditions associated with AMID.

Ankyrin repeat domain 6 (ANKRD6, Accession NP_055757.1) is another GAM281 target gene, herein designated TARGET GENE. ANKRD6 BINDING SITE is a target binding site found in the 3' untranslated region of mRNA encoded by ANKRD6, corresponding to a target binding site such as BINDING SITE I, BINDING SITE II or BINDING SITE III of FIG. 8. Table 4 illustrates the complementarity of the nucleotide sequences of ANKRD6 BINDING SITE, designated SEQ ID:1746, to the nucleotide sequence of GAM281 RNA, herein designated GAM RNA, also designated SEQ ID:278.

Another function of GAM281 is therefore inhibition of Ankyrin repeat domain 6 (ANKRD6, Accession NP_055757.1). Accordingly, utilities of GAM281 include diagnosis, prevention and treatment of diseases and clinical conditions associated with ANKRD6.

Alanyl (membrane) aminopeptidase (aminopeptidase n, aminopeptidase m, microsomal aminopeptidase, cd13, p150) (ANPEP, Accession NP_001141.1) is another GAM281 target gene, herein designated TARGET GENE. ANPEP BINDING SITE is a target binding site found in the 5' untranslated region of mRNA encoded by ANPEP, corresponding to a target binding site such as BINDING SITE I, BINDING SITE II or BINDING SITE III of FIG. 8. Table 4 illustrates the complementarity of the nucleotide sequences of ANPEP BINDING SITE, designated SEQ ID:6737, to the nucleotide sequence of GAM281 RNA, herein designated GAM RNA, also designated SEQ ID:278.

Another function of GAM281 is therefore inhibition of Alanyl (membrane) aminopeptidase (aminopeptidase n, aminopeptidase m, microsomal aminopeptidase, cd13, p150) (ANPEP, Accession NP_001141.1), a gene which is a cell-surface transmembrane glycosylated metalloprotease that processes signaling peptides. and therefore may be associated with Leukemia, lymphoma. Accordingly, utilities of GAM281 include diagnosis, prevention and treatment of Leukemia, lymphoma, and of other diseases and clinical conditions associated with ANPEP.

The function of ANPEP has been established by previous studies. A surface antigen glycoprotein of molecular weight about 150,000 is recognized by monoclonal antibodies MY7 and MCS2. Look et al. (1986) isolated the complete ANPEP gene, which they called GP150, from a human placental genomic library. By study of somatic cell hybrid DNA and by in situ hybridization, the GP150 gene was assigned to 15q25-q26. This chromosomal location coincides with that of the oncogene FES (OMIM Ref. No. 190030), which is also expressed in myeloid cells. They are separate loci, however, because FES probes do not hybridize to cloned sequences spanning the GP150 gene and the 2 genes have different restriction maps. Like FES, GP150 is distal to the breakpoint in t(15;17)(q22;q21.1) of acute promyelocytic leukemia. By analysis of mouse- human somatic cell hybrids, Watt and Willard (1990) assigned the ANPEP gene, which they called PEPN, to 15q11-qter. With a genomic DNA probe, they detected a frequent DraIII polymorphism useful as a marker for human chromosome 15. Look et al. (1989) determined the complete primary structure of GP150, known as CD13. The large extracellular carboxyterminal domain contained a pentapeptide consensus sequence characteristic of members of the zinc-binding metalloproteinase superfamily. Sequence comparisons with known enzymes of this class showed that CD13 and aminopeptidase N are identical. The latter enzyme was thought to be involved in the metabolism of regulatory peptides by diverse cell types, including small intestinal and renal tubular epithelial cells, macrophages, granulocytes, and synaptic membranes from the CNS.

Full details of the abovementioned studies are described in the following publications, the disclosure of which are hereby incorporated by reference:

Look, A. T.; Ashmun, R. A.; Shapiro, L. H.; Peiper, S. C.: Human myeloid plasma membrane glycoprotein CD13 (gp150) is identical to aminopeptidase N. J. Clin. Invest. 83:1299-1307, 1989; and Look, A. T.; Peiper, S. C.; Rebentisch, M. B.; Ashmun, R. A.; Roussel, M. F.; Lemons, R. S.; Le Beau, M. M.; Rubin, C. M.; Sherr, C. J.: Molecular cloning, expression, and chromosomal.

Further studies establishing the function and utilities of ANPEP are found in John Hopkins OMIM database record ID 151530, and in cited publications listed in Table 5, which are hereby incorporated by reference. AP1S3 (Accession XP_291023.1) is another GAM281 target gene, herein designated TARGET GENE. AP1S3 BINDING SITE is a target binding site found in the 3' untranslated region of multiple transcripts of mRNA encoded by AP1S3, corresponding to a target binding site such as BINDING SITE I, BINDING SITE II or BINDING SITE III of FIG. 8. Table 4 illustrates the complementarity of the nucleotide sequences of AP1S3 BINDING SITE, designated SEQ ID:10109, to the nucleotide sequence of GAM281 RNA, herein designated GAM RNA, also designated SEQ ID:278.

Another function of GAM281 is therefore inhibition of AP1S3 (Accession XP_291023.1). Accordingly, utilities of GAM281 include diagnosis, prevention and treatment of diseases and clinical conditions associated with AP1S3.

Adaptor-related protein complex 3, sigma 2 subunit (AP3S2, Accession NP_005820.1) is another GAM281 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:19874, to the nucleotide sequence of GAM281 RNA, herein designated GAM RNA, also designated SEQ ID:278.

Another function of GAM281 is therefore inhibition of Adaptor-related protein complex 3, sigma 2 subunit (AP3S2, Accession NP_005820.1). Accordingly, utilities of GAM281 include diagnosis, prevention and treatment of diseases and clinical conditions associated with AP3S2.

Apoptotic protease activating factor (APAF1, Accession NP_001151.1) is another GAM281 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:16578 and SEQ ID:19360 respectively, to the nucleotide sequence of GAM281 RNA, herein designated GAM RNA, also designated SEQ ID:278.

Another function of GAM281 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM281 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apoptotic protease activating factor (APAF1, Accession NP_037361.1) is another GAM281 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:16578 and SEQ ID:19360 respectively, to the nucleotide sequence of GAM281 RNA, herein designated GAM RNA, also designated SEQ ID:278.

Another function of GAM281 is therefore inhibition of Apoptotic protease activating factor (APAF1, Accession NP_037361.1), a gene which functions in the mitochondrial apoptotic pathway that leads to caspase 9 dependent activation of caspase 3 and therefore may be associated with Cancer. Accordingly, utilities of GAM281 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. APG-1 (Accession NP_055093.2) is another GAM281 target gene, herein designated TARGET GENE. APG-1 BINDING SITE is a target binding site found in the 5' untranslated region of mRNA encoded by APG-1, corresponding to a target binding site such as BINDING SITE I, BINDING SITE II or BINDING SITE III of FIG. 8. Table 4 illustrates the complementarity of the nucleotide sequences of APG-1 BINDING SITE, designated SEQ ID:17324, to the nucleotide sequence of GAM281 RNA, herein designated GAM RNA, also designated SEQ ID:278.

Another function of GAM281 is therefore inhibition of APG-1 (Accession NP_055093.2). Accordingly, utilities of GAM281 include diagnosis, prevention and treatment of diseases and clinical conditions associated with APG-1.

APM1 (Accession NP_004788.1) is another GAM281 target gene, herein designated TARGET GENE. APM1 BINDING SITE1 through APM1 BINDING SITE3 are target binding sites found in untranslated regions of mRNA encoded by APM1, corresponding to target binding sites such as BINDING SITE I, BINDING SITE II or BINDING SITE III of FIG. 8. Table 4 illustrates the complementarity of the nucleotide sequences of APM1 BINDING SITE1 through APM1 BINDING SITE3, designated SEQ ID:20035, SEQ ID:5598 and SEQ ID:11707 respectively, to the nucleotide sequence of GAM281 RNA, herein designated GAM RNA, also designated SEQ ID:278.

Another function of GAM281 is therefore inhibition of APM1 (Accession NP_004788.1). Accordingly, utilities of GAM281 include diagnosis, prevention and treatment of diseases and clinical conditions associated with APM1.

Apolipoprotein b mrna editing enzyme, catalytic polypeptide-like 3f (APOBEC3F, Accession NP_660341.2) is another GAM281 target gene, herein designated TARGET GENE. APOBEC3F BINDING SITE is a target binding site found in the 3' untranslated region of mRNA encoded by APOBEC3F, corresponding to a target binding site such as BINDING SITE I, BINDING SITE II or BINDING SITE III of FIG. 8. Table 4 illustrates the complementarity of the nucleotide sequences of APOBEC3F BINDING SITE, designated SEQ ID:5622, to the nucleotide sequence of GAM281 RNA, herein designated GAM RNA, also designated SEQ ID:278.

Another function of GAM281 is therefore inhibition of Apolipoprotein b mrna editing enzyme, catalytic polypeptide-like 3f (APOBEC3F, Accession NP_660341.2). Accordingly, utilities of GAM281 include diagnosis, prevention and treatment of diseases and clinical conditions associated with APOBEC3F.

Apolipoprotein l, 2 (APOL2, Accession NP_663612.1) is another GAM281 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:8064, to the nucleotide sequence of GAM281 RNA, herein designated GAM RNA, also designated SEQ ID:278.

Another function of GAM281 is therefore inhibition of Apolipoprotein 1, 2 (APOL2, Accession NP_663612.1). Accordingly, utilities of GAM281 include diagnosis, prevention and treatment of diseases and clinical conditions associated with APOL2.

Apolipoprotein l, 2 (APOL2, Accession NP_112092.1) is another GAM281 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:8064, to the nucleotide sequence of GAM281 RNA, herein designated GAM RNA, also designated SEQ ID:278.

Another function of GAM281 is therefore inhibition of Apolipoprotein 1, 2 (APOL2, Accession NP_112092.1). Accordingly, utilities of GAM281 include diagnosis, prevention and treatment of diseases and clinical conditions associated with APOL2.

Amyloid beta precursor protein (cytoplasmic tail) binding protein 2 (APPBP2, Accession NP_006371.2) is another GAM281 target gene, herein designated TARGET GENE. APPBP2 BINDING SITE is a target binding site found in the 3' untranslated region of mRNA encoded by APPBP2, corresponding to a target binding site such as BINDING SITE I, BINDING SITE II or BINDING SITE III of FIG. 8. Table 4 illustrates the complementarity of the nucleotide sequences of APPBP2 BINDING SITE, designated SEQ ID:4095, to the nucleotide sequence of GAM281 RNA, herein designated GAM RNA, also designated SEQ ID:278.

Another function of GAM281 is therefore inhibition of Amyloid beta precursor protein (cytoplasmic tail) binding protein 2 (APPBP2, Accession NP_006371.2), a gene which interacts with the basolateral sorting signal of amyloid precursor protein. and therefore may be associated with Alzheimer's disease. Accordingly, utilities of GAM281 include diagnosis, prevention and treatment of Alzheimer's disease, and of other diseases and clinical conditions associated with APPBP2.

The function of APPBP2 and its association with various diseases and clinical conditions, has been established by previous studies, as described hereinabove with reference to GAM130.1. APPL (Accession NP_036228.1) is another GAM281 target gene, herein designated TARGET GENE.

APPL BINDING SITE is a target binding site found in the 3' untranslated region of mRNA encoded by APPL, corresponding to a target binding site such as BINDING SITE I, BINDING SITE II or BINDING SITE III of FIG. 8. Table 4 illustrates the complementarity of the nucleotide sequences of APPL BINDING SITE, designated SEQ ID:12068, to the nucleotide sequence of GAM281 RNA, herein designated GAM RNA, also designated SEQ ID:278.

Another function of GAM281 is therefore inhibition of APPL (Accession NP_036228.1). Accordingly, utilities of GAM281 include diagnosis, prevention and treatment of diseases and clinical conditions associated with APPL.

Aquaporin 2 (collecting duct) (AQP2, Accession NP_000477.1) is another GAM281 target gene, herein designated TARGET GENE. AQP2 BINDING SITE is a target binding site found in the 3' untranslated region of mRNA encoded by AQP2, corresponding to a target binding site such as BINDING SITE I, BINDING SITE II or BINDING SITE III of FIG. 8. Table 4 illustrates the complementarity of the nucleotide sequences of AQP2 BINDING SITE, designated SEQ ID:18318, to the nucleotide sequence of GAM281 RNA, herein designated GAM RNA, also designated SEQ ID:278.

Another function of GAM281 is therefore inhibition of Aquaporin 2 (collecting duct) (AQP2, Accession NP_000477.1). Accordingly, utilities of GAM281 include diagnosis, prevention and treatment of diseases and clinical conditions associated with AQP2.

Aquaporin 6, kidney specific (AQP6, Accession NP_445738.1) is another GAM281 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:3169, to the nucleotide sequence of GAM281 RNA, herein designated GAM RNA, also designated SEQ ID:278.

Another function of GAM281 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM281 include diagnosis, prevention and treatment of diseases and clinical conditions associated with AQP6.

The function of AQP6 and its association with various diseases and clinical conditions, has been established by previous studies, as described hereinabove with reference to GAM51.1. Aquaporin 6, kidney specific (AQP6, Accession NP_001643.1) is another GAM281 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:3169, to the nucleotide sequence of GAM281 RNA, herein designated GAM RNA, also designated SEQ ID:278.

Another function of GAM281 is therefore inhibition of Aquaporin 6, kidney specific (AQP6, Accession NP_001643.1), a gene which participates in distinct physiologic function such as glomerular filtration, tubular endocytosis, and acid-base-metabolism. Accordingly, utilities of GAM281 include diagnosis, prevention and treatment of diseases and clinical conditions associated with AQP6.

The function of AQP6 and its association with various diseases and clinical conditions, has been established by previous studies, as described hereinabove with reference to GAM51.1. Archain 1 (ARCN1, Accession NP_001646.2) is another GAM281 target gene, herein designated TARGET GENE. ARCN1 BINDING SITE is a target binding site found in the 3' untranslated region of mRNA encoded by ARCN1, corresponding to a target binding site such as BINDING SITE I, BINDING SITE II or BINDING SITE III of FIG. 8. Table 4 illustrates the complementarity of the nucleotide sequences of ARCN1 BINDING SITE, designated SEQ ID:13747, to the nucleotide sequence of GAM281 RNA, herein designated GAM RNA, also designated SEQ ID:278.

Another function of GAM281 is therefore inhibition of Archain 1 (ARCN1, Accession NP_001646.2), a gene which plays a fundamental role in eukaryotic cell biology. Accordingly, utilities of GAM281 include diagnosis, prevention and treatment of diseases and clinical conditions associated with ARCN1.

The function of ARCN1 and its association with various diseases and clinical conditions, has been established by previous studies, as described hereinabove with reference to GAM30.1. Adp-ribosylation factor related protein 1 (ARFRP1, Accession NP_003215.1) is another GAM281 target gene, herein designated TARGET GENE. ARFRP1 BINDING SITE is a target binding site found in the 3' untranslated region of mRNA encoded by ARFRP1, corresponding to a target binding site such as BINDING SITE I, BINDING SITE II or BINDING SITE III of FIG. 8. Table 4 illustrates the complementarity of the nucleotide sequences of ARFRP1 BINDING SITE, designated SEQ ID:6901, to the nucleotide sequence of GAM281 RNA, herein designated GAM RNA, also designated SEQ ID:278.

Another function of GAM281 is therefore inhibition of Adp-ribosylation factor related protein 1 (ARFRP1, Accession NP_003215.1). Accordingly, utilities of GAM281 include diagnosis, prevention and treatment of diseases and clinical conditions associated with ARFRP1.

Ras homolog gene family, member f (in filopodia) (ARHF, Accession NP_061907.1) is another GAM281 target gene, herein designated TARGET GENE. ARHF BINDING SITE is a target binding site found in the 3' untranslated region of mRNA encoded by ARHF, corresponding to a target binding site such as BINDING SITE I, BINDING SITE II or BINDING SITE III of FIG. 8. Table 4 illustrates the complementarity of the nucleotide sequences of ARHF BINDING SITE, designated SEQ ID:7962, to the nucleotide sequence of GAM281 RNA, herein designated GAM RNA, also designated SEQ ID:278.

Another function of GAM281 is therefore inhibition of Ras homolog gene family, member f (in filopodia) (ARHF, Accession NP_061907.1). Accordingly, utilities of GAM281 include diagnosis, prevention and treatment of diseases and clinical conditions associated with ARHF.

Rho gtpase activating protein 1 (ARHGAP1, Accession NP_004299.1) is another GAM281 target gene, herein designated TARGET GENE. ARHGAP1 BINDING SITE is a target binding site found in the 3' untranslated region of mRNA encoded by ARHGAP1, corresponding to a target binding site such as BINDING SITE I, BINDING SITE II or BINDING SITE III of FIG. 8. Table 4 illustrates the complementarity of the nucleotide sequences of ARHGAP1 BINDING SITE, designated SEQ ID:4096, to the nucleotide sequence of GAM281 RNA, herein designated GAM RNA, also designated SEQ ID:278.

Another function of GAM281 is therefore inhibition of Rho gtpase activating protein 1 (ARHGAP1, Accession NP_004299.1). Accordingly, utilities of GAM281 include diagnosis, prevention and treatment of diseases and clinical conditions associated with ARHGAP1.

ARHGAP11A (Accession NP_055598.1) is another GAM281 target gene, herein designated TARGET GENE. ARHGAP11A BINDING SITE is a target binding site found in the 3' untranslated region of mRNA encoded by ARHGAP11A, corresponding to a target binding site such as BINDING SITE I, BINDING SITE II or BINDING SITE III of FIG. 8. Table 4 illustrates the complementarity of the nucleotide sequences of ARHGAP11A BINDING SITE, designated SEQ ID:17742, to the nucleotide sequence of GAM281 RNA, herein designated GAM RNA, also designated SEQ ID:278.

Another function of GAM281 is therefore inhibition of ARHGAP11A (Accession NP_055598.1). Accordingly, utilities of GAM281 include diagnosis, prevention and treatment of diseases and clinical conditions associated with ARHGAP11A.

Rho guanine nucleotide exchange factor (gef) 4 (ARHGEF4, Accession NP_127462.1) is another GAM281 target gene, herein designated TARGET GENE. ARHGEF4 BINDING SITE is a target binding site found in the 3' untranslated region of multiple transcripts of mRNA encoded by ARHGEF4, corresponding to a target binding site such as BINDING SITE I, BINDING SITE II or BINDING SITE III of FIG. 8. Table 4 illustrates the complementarity of the nucleotide sequences of ARHGEF4 BINDING SITE, designated SEQ ID:14328, to the nucleotide sequence of GAM281 RNA, herein designated GAM RNA, also designated SEQ ID:278.

Another function of GAM281 is therefore inhibition of Rho guanine nucleotide exchange factor (gef) 4 (ARHGEF4, Accession NP_127462.1). Accordingly, utilities of GAM281 include diagnosis, prevention and treatment of diseases and clinical conditions associated with ARHGEF4.

Rho guanine nucleotide exchange factor (gef) 4 (ARHGEF4, Accession NP_056135.2) is another GAM281 target gene, herein designated TARGET GENE. ARHGEF4 BINDING SITE is a target binding site found in the 3' untranslated region of multiple transcripts of mRNA encoded by ARHGEF4, corresponding to a target binding site such as BINDING SITE I, BINDING SITE II or BINDING SITE III of FIG. 8. Table 4 illustrates the complementarity of the nucleotide sequences of ARHGEF4 BINDING SITE, designated SEQ ID:14328, to the nucleotide sequence of GAM281 RNA, herein designated GAM RNA, also designated SEQ ID:278.

Another function of GAM281 is therefore inhibition of Rho guanine nucleotide exchange factor (gef) 4 (ARHGEF4, Accession NP_056135.2). Accordingly, utilities of GAM281 include diagnosis, prevention and treatment of diseases and clinical conditions associated with ARHGEF4.

ARPP-19 (Accession NP_006619.1) is another GAM281 target gene, herein designated TARGET GENE. ARPP-19 BINDING SITE is a target binding site found in the 3' untranslated region of mRNA encoded by ARPP-19, corresponding to a target binding site such as BINDING SITE I, BINDING SITE II or BINDING SITE III of FIG. 8. Table 4 illustrates the complementarity of the nucleotide sequences of ARPP-19 BINDING SITE, designated SEQ ID:944, to the nucleotide sequence of GAM281 RNA, herein designated GAM RNA, also designated SEQ ID:278.

Another function of GAM281 is therefore inhibition of ARPP-19 (Accession NP_006619.1). Accordingly, utilities of GAM281 include diagnosis, prevention and treatment of diseases and clinical conditions associated with ARPP-19.

Arylsulfatase b (ARSB, Accession NP_000037.1) is another GAM281 target gene, herein designated TARGET GENE. ARSB BINDING SITE is a target binding site found in the 5' untranslated region of mRNA encoded by ARSB, corresponding to a target binding site such as BINDING SITE I, BINDING SITE II or BINDING SITE III of FIG. 8. Table 4 illustrates the complementarity of the nucleotide sequences of ARSB BINDING SITE, designated SEQ ID:13855, to the nucleotide sequence of GAM281 RNA, herein designated GAM RNA, also designated SEQ ID:278.

Another function of GAM281 is therefore inhibition of Arylsulfatase b (ARSB, Accession NP_000037.1). Accordingly, utilities of GAM281 include diagnosis, prevention and treatment of diseases and clinical conditions associated with ARSB.

Ankyrin repeat and socs box-containing 16 (ASB16, Accession NP_543139.4) is another GAM281 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:14722, to the nucleotide sequence of GAM281 RNA, herein designated GAM RNA, also designated SEQ ID:278.

Another function of GAM281 is therefore inhibition of Ankyrin repeat and socs box-containing 16 (ASB16, Accession NP_543139.4) . Accordingly, utilities of GAM281 include diagnosis, prevention and treatment of diseases and clinical conditions associated with ASB16.

Ankyrin repeat and socs box-containing 6 (ASB6, Accession NP_060343.1) is another GAM281 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:10305 and SEQ ID:2196 respectively, to the nucleotide sequence of GAM281 RNA, herein designated GAM RNA, also designated SEQ ID:278.

Another function of GAM281 is therefore inhibition of Ankyrin repeat and socs box-containing 6 (ASB6, Accession NP_060343.1). Accordingly, utilities of GAM281 include diagnosis, prevention and treatment of diseases and clinical conditions associated with ASB6.

Ankyrin repeat and socs box-containing 6 (ASB6, Accession NP_821066.1) is another GAM281 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:10305 and SEQ ID:2196 respectively, to the nucleotide sequence of GAM281 RNA, herein designated GAM RNA, also designated SEQ ID:278.

Another function of GAM281 is therefore inhibition of Ankyrin repeat and socs box-containing 6 (ASB6, Accession NP_821066.1). Accordingly, utilities of GAM281 include diagnosis, prevention and treatment of diseases and clinical conditions associated with ASB6.

ASE-1 (Accession NP_036231.1) is another GAM281 target gene, herein designated TARGET GENE. ASE-1 BINDING SITE1 and ASE-1 BINDING SITE2 are target binding sites found in untranslated regions of mRNA encoded by ASE-1, corresponding to target binding sites such as BINDING SITE I, BINDING SITE II or BINDING SITE III of FIG. 8. Table 4 illustrates the complementarity of the nucleotide sequences of ASE-1 BINDING SITE1 and ASE-1 BINDING SITE2, designated SEQ ID:3101 and SEQ ID:1741 respectively, to the nucleotide sequence of GAM281 RNA, herein designated GAM RNA, also designated SEQ ID:278.

Another function of GAM281 is therefore inhibition of ASE-1 (Accession NP_036231.1). Accordingly, utilities of GAM281 include diagnosis, prevention and treatment of diseases and clinical conditions associated with ASE-1.

ATF7IP2 (Accession NP_079273.1) is another GAM281 target gene, herein designated TARGET GENE. ATF7IP2 BINDING SITE is a target binding site found in the 3' untranslated region of mRNA encoded by ATF7IP2, corresponding to a target binding site such as BINDING SITE I, BINDING SITE II or BINDING SITE III of FIG. 8. Table 4 illustrates the complementarity of the nucleotide sequences of ATF7IP2 BINDING SITE, designated SEQ ID:9602, to the nucleotide sequence of GAM281 RNA, herein designated GAM RNA, also designated SEQ ID:278.

Another function of GAM281 is therefore inhibition of ATF7IP2 (Accession NP_079273.1). Accordingly, utilities of GAM281 include diagnosis, prevention and treatment of diseases and clinical conditions associated with ATF7IP2.

Ataxia telangiectasia mutated (includes complementation groups a, c and d) (ATM, Accession NP_000042.2) is another GAM281 target gene, herein designated TARGET GENE. ATM BINDING SITE1 and ATM BINDING SITE2 are target binding sites found in untranslated regions of multiple transcripts of mRNA encoded by ATM, corresponding to target binding sites such as BINDING SITE I, BINDING SITE II or BINDING SITE III of FIG. 8. Table 4 illustrates the complementarity of the nucleotide sequences of ATM BINDING SITE1 and ATM BINDING SITE2, designated SEQ ID:12000 and SEQ ID:1837 respectively, to the nucleotide sequence of GAM281 RNA, herein designated GAM RNA, also designated SEQ ID:278.

Another function of GAM281 is therefore inhibition of Ataxia telangiectasia mutated (includes complementation groups a, c and d) (ATM, Accession NP_000042.2). Accordingly, utilities of GAM281 include diagnosis, prevention and treatment of diseases and clinical conditions associated with ATM.

Atpase, na+/k+ transporting, beta 2 polypeptide (ATP1B2, Accession NP_001669.1) is another GAM281 target gene, herein designated TARGET GENE. ATP1B2 BINDING SITE is a target binding site found in the 3' untranslated region of mRNA encoded by ATP1B2, corresponding to a target binding site such as BINDING SITE I, BINDING SITE II or BINDING SITE III of FIG. 8. Table 4 illustrates the complementarity of the nucleotide sequences of ATP1B2 BINDING SITE, designated SEQ ID:16916, to the nucleotide sequence of GAM281 RNA, herein designated GAM RNA, also designated SEQ ID:278.

Another function of GAM281 is therefore inhibition of Atpase, na+/k+ transporting, beta 2 polypeptide (ATP1B2, Accession NP_001669.1), a gene which catalyzes the hydrolysis of ATP coupled with the exchange of Na+/K+ ions across the plasma membrane. Accordingly, utilities of GAM281 include diagnosis, prevention and treatment of diseases and clinical conditions associated with ATP1B2.

The function of ATP1B2 and its association with various diseases and clinical conditions, has been established by previous studies, as described hereinabove with reference to GAM130.1. Atpase, (na+)/k+ transporting, beta 4 polypeptide (ATP1B4, Accession NP_036201.1) is another GAM281 target gene, herein designated TARGET GENE. ATP1B4 BINDING SITE is a target binding site found in the 3' untranslated region of mRNA encoded by ATP1B4, corresponding to a target binding site such as BINDING SITE I, BINDING SITE II or BINDING SITE III of FIG. 8. Table 4 illustrates the complementarity of the nucleotide sequences of ATP1B4 BINDING SITE, designated SEQ ID:13042, to the nucleotide sequence of GAM281 RNA, herein designated GAM RNA, also designated SEQ ID:278.

Another function of GAM281 is therefore inhibition of Atpase, (na+)/k+ transporting, beta 4 polypeptide (ATP1B4, Accession NP_036201.1). Accordingly, utilities of GAM281 include diagnosis, prevention and treatment of diseases and clinical conditions associated with ATP1B4.

Atpase, h+ transporting, lysosomal 38 kda, v0 subunit d isoform 2 (ATP6V0D2, Accession NP_689778.1) is another GAM281 target gene, herein designated TARGET GENE. ATP6V0D2 BINDING SITE1 and ATP6V0D2 BINDING SITE2 are target binding sites found in untranslated regions of mRNA encoded by ATP6V0D2, corresponding to target binding sites such as BINDING SITE I, BINDING SITE II or BINDING SITE III of FIG. 8. Table 4 illustrates the complementarity of the nucleotide sequences of ATP6V0D2 BINDING SITE1 and ATP6V0D2 BINDING SITE2, designated SEQ ID:17102 and SEQ ID:15039 respectively, to the nucleotide sequence of GAM281 RNA, herein designated GAM RNA, also designated SEQ ID:278.

Another function of GAM281 is therefore inhibition of Atpase, h+ transporting, lysosomal 38 kda, v0 subunit d isoform 2 (ATP6V0D2, Accession NP_689778.1). Accordingly, utilities of GAM281 include diagnosis, prevention and treatment of diseases and clinical conditions associated with ATP6V0D2.

ATP6V1A (Accession NP_001681.2) is another GAM281 target gene, herein designated TARGET GENE. ATP6V1A BINDING SITE is a target binding site found in the 3' untranslated region of mRNA encoded by ATP6V1A, corresponding to a target binding site such as BINDING SITE I, BINDING SITE II or BINDING SITE III of FIG. 8. Table 4 illustrates the complementarity of the nucleotide sequences of ATP6V1A BINDING SITE, designated SEQ ID:18868, to the nucleotide sequence of GAM281 RNA, herein designated GAM RNA, also designated SEQ ID:278.

Another function of GAM281 is therefore inhibition of ATP6V1A (Accession NP_001681.2). Accordingly, utilities of GAM281 include diagnosis, prevention and treatment of diseases and clinical conditions associated with ATP6V1A.

Atpase, cu++ transporting, alpha polypeptide (menkes syndrome) (ATP7A, Accession NP_000043.1) is another GAM281 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:4112, to the nucleotide sequence of GAM281 RNA, herein designated GAM RNA, also designated SEQ ID:278.

Another function of GAM281 is therefore inhibition of Atpase, cu++ transporting, alpha polypeptide (menkes syndrome) (ATP7A, Accession NP_000043.1). Accordingly, utilities of GAM281 include diagnosis, prevention and treatment of diseases and clinical conditions associated with ATP7A.

Axl receptor tyrosine kinase (AXL, Accession NP_068713.2) is another GAM281 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:11802, to the nucleotide sequence of GAM281 RNA, herein designated GAM RNA, also designated SEQ ID:278.

Another function of GAM281 is therefore inhibition of Axl receptor tyrosine kinase (AXL, Accession NP_068713.2). Accordingly, utilities of GAM281 include diagnosis, prevention and treatment of diseases and clinical conditions associated with AXL.

Axl receptor tyrosine kinase (AXL, Accession NP_001690.2) is another GAM281 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:11802, to the nucleotide sequence of GAM281 RNA, herein designated GAM RNA, also designated SEQ ID:278.

Another function of GAM281 is therefore inhibition of Axl receptor tyrosine kinase (AXL, Accession NP_001690.2). Accordingly, utilities of GAM281 include diagnosis, prevention and treatment of diseases and clinical conditions associated with AXL.

Udp-gal:betaglcnac beta 1,4-galactosyltransferase, polypeptide 4 (B4GALT4, Accession NP_003769.1) is another GAM281 target gene, herein designated TARGET GENE. B4GALT4 BINDING SITE is a target binding site found in the 3' untranslated region of mRNA encoded by B4GALT4, corresponding to a target binding site such as BINDING SITE I, BINDING SITE II or BINDING SITE III of FIG. 8. Table 4 illustrates the complementarity of the nucleotide sequences of B4GALT4 BINDING SITE, designated SEQ ID:11028, to the nucleotide sequence of GAM281 RNA, herein designated GAM RNA, also designated SEQ ID:278.

Another function of GAM281 is therefore inhibition of Udp-gal:betaglcnac beta 1,4-galactosyltransferase, polypeptide 4 (B4GALT4, Accession NP_003769.1). Accordingly, utilities of GAM281 include diagnosis, prevention and treatment of diseases and clinical conditions associated with B4GALT4.

Udp-gal:betaglcnac beta 1,4-galactosyltransferase, polypeptide 5 (B4GALT5, Accession NP_004767.1) is another GAM281 target gene, herein designated TARGET GENE. B4GALT5 BINDING SITE is a target binding site found in the 3' untranslated region of mRNA encoded by B4GALT5, corresponding to a target binding site such as BINDING SITE I, BINDING SITE II or BINDING SITE III of FIG. 8. Table 4 illustrates the complementarity of the nucleotide sequences of B4GALT5 BINDING SITE, designated SEQ ID:16140, to the nucleotide sequence of GAM281 RNA, herein designated GAM RNA, also designated SEQ ID:278.

Another function of GAM281 is therefore inhibition of Udp-gal:betaglcnac beta 1,4-galactosyltransferase, polypeptide 5 (B4GALT5, Accession NP_004767.1). Accordingly, utilities of GAM281 include diagnosis, prevention and treatment of diseases and clinical conditions associated with B4GALT5.

Xylosylprotein beta 1,4-galactosyltransferase, polypeptide 7 (galactosyltransferase i) (B4GALT7, Accession NP_009186.1) is another GAM281 target gene, herein designated TARGET GENE. B4GALT7 BINDING SITE is a target binding site found in the 3' untranslated region of mRNA encoded by B4GALT7, corresponding to a target binding site such as BINDING SITE I, BINDING SITE II or BINDING SITE III of FIG. 8. Table 4 illustrates the complementarity of the nucleotide sequences of B4GALT7 BINDING SITE, designated SEQ ID:18475, to the nucleotide sequence of GAM281 RNA, herein designated GAM RNA, also designated SEQ ID:278.

Another function of GAM281 is therefore inhibition of Xylosylprotein beta 1,4-galactosyltransferase, polypeptide 7 (galactosyltransferase i) (B4GALT7, Accession NP_009186.1). Accordingly, utilities of GAM281 include diagnosis, prevention and treatment of diseases and clinical conditions associated with B4GALT7.

BA108L7.2 (Accession NP_112233.2) is another GAM281 target gene, herein designated TARGET GENE. BA108L7.2 BINDING SITE is a target binding site found in the 3' untranslated region of mRNA encoded by BA108L7.2, corresponding to a target binding site such as BINDING SITE I, BINDING SITE II or BINDING SITE III of FIG. 8. Table 4 illustrates the complementarity of the nucleotide sequences of BA108L7.2 BINDING SITE, designated SEQ ID:10888, to the nucleotide sequence of GAM281 RNA, herein designated GAM RNA, also designated SEQ ID:278.

Another function of GAM281 is therefore inhibition of BA108L7.2 (Accession NP_112233.2). Accordingly, utilities of GAM281 include diagnosis, prevention and treatment of diseases and clinical conditions associated with BA108L7.2.

Beta-site app-cleaving enzyme (BACE, Accession NP_620429.1) is another GAM281 target gene, herein designated TARGET GENE. BACE BINDING SITE is a target binding site found in the 5' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:16660, to the nucleotide sequence of GAM281 RNA, herein designated GAM RNA, also designated SEQ ID:278.

Another function of GAM281 is therefore inhibition of Beta-site app-cleaving enzyme (BACE, Accession NP_620429.1), a gene which is responsible for the proteolytic processing of the amyloid precursor protein and therefore may be associated with Alzheimer disease. Accordingly, utilities of GAM281 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_036236.1) is another GAM281 target gene, herein designated TARGET GENE. BACE BINDING SITE is a target binding site found in the 5' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:16660, to the nucleotide sequence of GAM281 RNA, herein designated GAM RNA, also designated SEQ ID:278.

Another function of GAM281 is therefore inhibition of Beta-site app-cleaving enzyme (BACE, Accession NP_036236.1), a gene which is responsible for the proteolytic processing of the amyloid precursor protein and therefore may be associated with Alzheimer disease. Accordingly, utilities of GAM281 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_620427.1) is another GAM281 target gene, herein designated TARGET GENE. BACE BINDING SITE is a target binding site found in the 5' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:16660, to the nucleotide sequence of GAM281 RNA, herein designated GAM RNA, also designated SEQ ID:278.

Another function of GAM281 is therefore inhibition of Beta-site app-cleaving enzyme (BACE, Accession NP_620427.1), a gene which is responsible for the proteolytic processing of the amyloid precursor protein and therefore may be associated with Alzheimer disease. Accordingly, utilities of GAM281 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_620428.1) is another GAM281 target gene, herein designated TARGET GENE. BACE BINDING SITE is a target binding site found in the 5' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:16660, to the nucleotide sequence of GAM281 RNA, herein designated GAM RNA, also designated SEQ ID:278.

Another function of GAM281 is therefore inhibition of Beta-site app-cleaving enzyme (BACE, Accession NP_620428.1), a gene which is responsible for the proteolytic processing of the amyloid precursor protein and therefore may be associated with Alzheimer disease. Accordingly, utilities of GAM281 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Btb and cnc homology 1, basic leucine zipper transcription factor 2 (BACH2, Accession NP_068585.1) is another GAM281 target gene, herein designated TARGET GENE. BACH2 BINDING SITE is a target binding site found in the 3' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:2573, to the nucleotide sequence of GAM281 RNA, herein designated GAM RNA, also designated SEQ ID:278.

Another function of GAM281 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM281 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. Bcl2-associated athanogene 5 (BAG5, Accession NP_004864.1) is another GAM281 target gene, herein designated TARGET GENE. BAG5 BINDING SITE is a target binding site found in the 3' untranslated region of mRNA encoded by BAG5, corresponding to a target binding site such as BINDING SITE I, BINDING SITE II or BINDING SITE III of FIG. 8. Table 4 illustrates the complementarity of the nucleotide sequences of BAG5 BINDING SITE, designated SEQ ID:5695, to the nucleotide sequence of GAM281 RNA, herein designated GAM RNA, also designated SEQ ID:278.

Another function of GAM281 is therefore inhibition of Bcl2-associated athanogene 5 (BAG5, Accession NP_004864.1). Accordingly, utilities of GAM281 include diagnosis, prevention and treatment of diseases and clinical conditions associated with BAG5.

Bromodomain adjacent to zinc finger domain, 2a (BAZ2A, Accession NP_038477.1) is another GAM281 target gene, herein designated TARGET GENE. BAZ2A BINDING SITE is a target binding site found in the 5' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:8852, to the nucleotide sequence of GAM281 RNA, herein designated GAM RNA, also designated SEQ ID:278.

Another function of GAM281 is therefore inhibition of Bromodomain adjacent to zinc finger domain, 2a (BAZ2A, Accession NP_038477.1) . Accordingly, utilities of GAM281 include diagnosis, prevention and treatment of diseases and clinical conditions associated with BAZ2A.

Butyrylcholinesterase (BCHE, Accession NP_000046.1) is another GAM281 target gene, herein designated TARGET GENE. BCHE BINDING SITE is a target binding site found in the 5' untranslated region of mRNA encoded by BCHE, corresponding to a target binding site such as BINDING SITE I, BINDING SITE II or BINDING SITE III of FIG. 8. Table 4 illustrates the complementarity of the nucleotide sequences of BCHE BINDING SITE, designated SEQ ID:7089, to the nucleotide sequence of GAM281 RNA, herein designated GAM RNA, also designated SEQ ID:278.

Another function of GAM281 is therefore inhibition of Butyrylcholinesterase (BCHE, Accession NP_000046.1). Accordingly, utilities of GAM281 include diagnosis, prevention and treatment of diseases and clinical conditions associated with BCHE.

B-cell cll/lymphoma 10 (BCL10, Accession NP_003912.1) is another GAM281 target gene, herein designated TARGET GENE. BCL10 BINDING SITE is a target binding site found in the 3' untranslated region of mRNA encoded by BCL10, corresponding to a target binding site such as BINDING SITE I, BINDING SITE II or BINDING SITE III of FIG. 8. Table 4 illustrates the complementarity of the nucleotide sequences of BCL10 BINDING SITE, designated SEQ ID:19576, to the nucleotide sequence of GAM281 RNA, herein designated GAM RNA, also designated SEQ ID:278.

Another function of GAM281 is therefore inhibition of B-cell cll/lymphoma 10 (BCL10, Accession NP_003912.1), a gene which is a positive regulator of lymphocyte proliferation, NF-kappaB activator. and therefore may be associated with Malt lymphoma, follicular lymphoma. Accordingly, utilities of GAM281 include diagnosis, prevention and treatment of Malt lymphoma, follicular lymphoma, and of other diseases and clinical conditions associated with BCL10.

The function of BCL10 and its association with various diseases and clinical conditions, has been established by previous studies, as described hereinabove with reference to GAM136.1. Bradykinin receptor b1 (BDKRB1, Accession NP_000701.2) is another GAM281 target gene, herein designated TARGET GENE. BDKRB1 BINDING SITE is a target binding site found in the 5' untranslated region of mRNA encoded by BDKRB1, corresponding to a target binding site such as BINDING SITE I, BINDING SITE II or BINDING SITE III of FIG. 8. Table 4 illustrates the complementarity of the nucleotide sequences of BDKRB1 BINDING SITE, designated SEQ ID:8663, to the nucleotide sequence of GAM281 RNA, herein designated GAM RNA, also designated SEQ ID:278.

Another function of GAM281 is therefore inhibition of Bradykinin receptor b1 (BDKRB1, Accession NP_000701.2), a gene which mediates intracellular calcium flux. Accordingly, utilities of GAM281 include diagnosis, prevention and treatment of diseases and clinical conditions associated with BDKRB1.

The function of BDKRB1 and its association with various diseases and clinical conditions, has been established by previous studies, as described hereinabove with reference to GAM136.1. Bradykinin receptor b2 (BDKRB2, Accession NP_000614.1) is another GAM281 target gene, herein designated TARGET GENE. BDKRB2 BINDING SITE is a target binding site found in the 3' untranslated region of mRNA encoded by BDKRB2, corresponding to a target binding site such as BINDING SITE I, BINDING SITE II or BINDING SITE III of FIG. 8. Table 4 illustrates the complementarity of the nucleotide sequences of BDKRB2 BINDING SITE, designated SEQ ID:15590, to the nucleotide sequence of GAM281 RNA, herein designated GAM RNA, also designated SEQ ID:278.

Another function of GAM281 is therefore inhibition of Bradykinin receptor b2 (BDKRB2, Accession NP_000614.1), a gene which involves in inflammation, vasodilation, smooth muscle contraction, relaxation, and response to pain and therefore may be associated with Cardiovascular diseases. Accordingly, utilities of GAM281 include diagnosis, prevention and treatment of Cardiovascular diseases, and of other diseases and clinical conditions associated with BDKRB2.

The function of BDKRB2 and its association with various diseases and clinical conditions, has been established by previous studies, as described hereinabove with reference to GAM94.1. B double prime 1, subunit of rna polymerase iii transcription initiation factor iiib (BDP1, Accession NP_060899.1) is another GAM281 target gene, herein designated TARGET GENE. BDP1 BINDING SITE is a target binding site found in the 3' untranslated region of mRNA encoded by BDP1, corresponding to a target binding site such as BINDING SITE I, BINDING SITE II or BINDING SITE III of FIG. 8. Table 4 illustrates the complementarity of the nucleotide sequences of BDP1 BINDING SITE, designated SEQ ID:19556, to the nucleotide sequence of GAM281 RNA, herein designated GAM RNA, also designated SEQ ID:278.

Another function of GAM281 is therefore inhibition of B double prime 1, subunit of rna polymerase iii transcription initiation factor iiib (BDP1, Accession NP_060899.1), a gene which activates RNA polymerase III transcription. Accordingly, utilities of GAM281 include diagnosis, prevention and treatment of diseases and clinical conditions associated with BDP1.

The function of BDP1 and its association with various diseases and clinical conditions, has been established by previous studies, as described hereinabove with reference to GAM146.1. BENE (Accession NP_005425.1) is another GAM281 target gene, herein designated TARGET GENE. BENE BINDING SITE is a target binding site found in the 3' untranslated region of mRNA encoded by BENE, corresponding to a target binding site such as BINDING SITE I, BINDING SITE II or BINDING SITE III of FIG. 8. Table 4 illustrates the complementarity of the nucleotide sequences of BENE BINDING SITE, designated SEQ ID:6009, to the nucleotide sequence of GAM281 RNA, herein designated GAM RNA, also designated SEQ ID:278.

Another function of GAM281 is therefore inhibition of BENE (Accession NP_005425.1). Accordingly, utilities of GAM281 include diagnosis, prevention and treatment of diseases and clinical conditions associated with BENE.

BHD (Accession NP_659434.2) is another GAM281 target gene, herein designated TARGET GENE. BHD BINDING SITE is a target binding site found in the 3' untranslated region of multiple transcripts of mRNA encoded by BHD, corresponding to a target binding site such as BINDING SITE I, BINDING SITE II or BINDING SITE III of FIG. 8. Table 4 illustrates the complementarity of the nucleotide sequences of BHD BINDING SITE, designated SEQ ID:9036, to the nucleotide sequence of GAM281 RNA, herein designated GAM RNA, also designated SEQ ID:278.

Another function of GAM281 is therefore inhibition of BHD (Accession NP_659434.2). Accordingly, utilities of GAM281 include diagnosis, prevention and treatment of diseases and clinical conditions associated with BHD.

BIA2 (Accession NP_056246.1) is another GAM281 target gene, herein designated TARGET GENE. BIA2 BINDING SITE is a target binding site found in the 3' untranslated region of mRNA encoded by BIA2, corresponding to a target binding site such as BINDING SITE I, BINDING SITE II or BINDING SITE III of FIG. 8. Table 4 illustrates the complementarity of the nucleotide sequences of BIA2 BINDING SITE, designated SEQ ID:6389, to the nucleotide sequence of GAM281 RNA, herein designated GAM RNA, also designated SEQ ID:278.

Another function of GAM281 is therefore inhibition of BIA2 (Accession NP_056246.1). Accordingly, utilities of GAM281 include diagnosis, prevention and treatment of diseases and clinical conditions associated with BIA2.

Bh3 interacting domain death agonist (BID, Accession NP_001187.1) is another GAM281 target gene, herein designated TARGET GENE. BID BINDING SITE is a target binding site found in the 5' untranslated region of mRNA encoded by BID, corresponding to a target binding site such as BINDING SITE I, BINDING SITE II or BINDING SITE III of FIG. 8. Table 4 illustrates the complementarity of the nucleotide sequences of BID BINDING SITE, designated SEQ ID:10620, to the nucleotide sequence of GAM281 RNA, herein designated GAM RNA, also designated SEQ ID:278.

Another function of GAM281 is therefore inhibition of Bh3 interacting domain death agonist (BID, Accession NP_001187.1), a gene which induces ice-like proteases and apoptosis and therefore may be associated with Cat eye syndrome. Accordingly, utilities of GAM281 include diagnosis, prevention and treatment of Cat eye syndrome, and of other diseases and clinical conditions associated with BID.

The function of BID has been established by previous studies. Wang et al. (1996) identified a gene they termed BID (BH3 Interacting domain Death agonist) that encodes a novel death agonist that heterodimerizes with either agonists (BAX) or antagonists (BCL2). BID possesses only the BH3 domain, lacks a C-terminal signal-anchor segment, and is found in both cytosolic and membrane locations. BID's only homology with the BCL2 family is the conserved BH3 domain. BID counters the protective effect of BCL2. Expression of BID induces ICE-like proteases which are thought to be downstream of BCL2, activated in apoptosis, and required for aspects of cell death. Wang et al. (1996) stated that the discovery of this BH3-only molecule supports the identification of BH3 as a death domain and favors a model in which BID represents a death ligand for the membrane-bound receptor BAX. Luo et al. (1998) reported the purification of a cytosolic protein that induces cytochrome c release from mitochondria in response to caspase-8 (CASP8; 601763), the apical caspase activated by cell surface death receptors such as FAS (OMIM Ref. No. 134637) and TNF (OMIM Ref. No. 191160). Peptide mass fingerprinting identified this protein as BID. CASP8 cleaves BID, and the COOH-terminal part translocates to mitochondria where it triggers cytochrome c release. Immunodepletion of BID from cell extracts eliminated the cytochrome c releasing activity. The cytochrome c releasing activity of BID was antagonized by BCL2 (OMIM Ref. No. 151430). A mutation at the BH3 domain diminished its cytochrome c releasing activity. BID, therefore, relays an apoptotic signal from the cell surface to mitochondria. Li et al. (1998) reported that BID is a specific proximal substrate of CASP8 in the Fas apoptotic signaling pathway. While full-length BID is localized in cytosol, truncated BID translocates to mitochondria and thus transduces apoptotic signals from cytoplasmic membrane to mitochondria. Truncated BID induces first the clustering of mitochondria around the nuclei and release of cytochrome c independent of caspase activity, and then the loss of mitochondrial membrane potential, cell shrinkage, and nuclear condensation in a caspase-dependent fashion. The results of Li et al. (1998) indicated that BID is a mediator of mitochondrial damage induced by CASP8.

Animal model experiments lend further support to the function of BID. Yin et al. (1999) generated mice deficient in Bid by homologous recombination. Bid -/- mice were born at the expected frequency and had no developmental abnormalities. When Bid -/- mice were injected with an antibody against Fas, nearly all survived, whereas wildtype mice died from hepatocellular apoptosis and hemorrhagic necrosis. About half of the Bid -/- mice had no apparent liver injury and showed no evidence of activation of the effector caspases 3 (OMIM Ref. No. 600636) and 7 (OMIM Ref. No. 601761), although the initiator caspase-8 had been activated. Other Bid-deficient mice survived with only moderate damage: all 3 caspases (3, 7, and 8) were activated, but their cell nuclei were intact, and no mitochondrial cytochrome c was released. Yin et al. (1999) also investigated the effects of Bid deficiency in cultured cells treated with anti-Fas antibody or with TNF-alpha. In these Bid -/- cells, mitochondrial dysfunction was delayed, cytochrome c was not released, effector caspase activity was reduced, and the cleavage of apoptosis substrates was altered. This loss-of-function model indicates that Bid is a critical substrate in vivo for signaling by death-receptor agonists that mediates a mitochondrial amplification loop that is essential for the apoptosis of selected cells.

It is appreciated that the abovementioned animal model for BID is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, H.; Zhu, H.; Xu, C.; Yuan, J.: Cleavage of BID by caspase 8 mediates the mitochondrial damage in the Fas pathway of apoptosis. Cell 94:491-501, 1998; and Yin, X.-M.; Wang, K.; Gross, A.; Zhao, Y.; Zinkel, S.; Klocke, B.; Roth, K. A.; Korsmeyer, S. J.: Bid-deficient mice are resistant to Fas-induced hepatocellular apoptosis. Nature 400.

Further studies establishing the function and utilities of BID are found in John Hopkins OMIM database record ID 601997, and in cited publications listed in Table 5, which are hereby incorporated by reference. BMF (Accession NP_277038.1) is another GAM281 target gene, herein designated TARGET GENE. BMF BINDING SITE is a target binding site found in the 3' untranslated region of mRNA encoded by BMF, corresponding to a target binding site such as BINDING SITE I, BINDING SITE II or BINDING SITE III of FIG. 8. Table 4 illustrates the complementarity of the nucleotide sequences of BMF BINDING SITE, designated SEQ ID:759, to the nucleotide sequence of GAM281 RNA, herein designated GAM RNA, also designated SEQ ID:278.

Another function of GAM281 is therefore inhibition of BMF (Accession NP_277038.1). Accordingly, utilities of GAM281 include diagnosis, prevention and treatment of diseases and clinical conditions associated with BMF.

Bone morphogenetic protein 6 (BMP6, Accession NP_001709.1) is another GAM281 target gene, herein designated TARGET GENE. BMP6 BINDING SITE is a target binding site found in the 3' untranslated region of mRNA encoded by BMP6, corresponding to a target binding site such as BINDING SITE I, BINDING SITE II or BINDING SITE III of FIG. 8. Table 4 illustrates the complementarity of the nucleotide sequences of BMP6 BINDING SITE, designated SEQ ID:6882, to the nucleotide sequence of GAM281 RNA, herein designated GAM RNA, also designated SEQ ID:278.

Another function of GAM281 is therefore inhibition of Bone morphogenetic protein 6 (BMP6, Accession NP_001709.1), a gene which induces cartilage and bone formation. Accordingly, utilities of GAM281 include diagnosis, prevention and treatment of diseases and clinical conditions associated with BMP6.

The function of BMP6 has been established by previous studies. See BMP5 (OMIM Ref. No. 112265). Hahn et al. (1992) mapped both BMP5 and BMP6 to human chromosome 6 by study of human/rodent somatic cell hybrid lines with cDNA probes. Olavesen et al. (1997) reported fine mapping of 39 ESTs on 6p25-p23. Most of the ESTs (31 of 39) were positioned in the 6p24-p23 interval; of these, 8 were located within a single PAC clone. BMP6 was 1 of the 8 loci on the PAC, between TFAP2 (OMIM Ref. No. 107580) at the centromeric side and DSP (OMIM Ref. No. 125647) on the telomeric side. Rickard et al. (1998) presented evidence that the skeletal effects of estrogen on bone and cartilage may be mediated by increased production of BMP6 by osteoblasts. They investigated the effect of estrogen on BMP production in 2 estrogen-responsive, human immortalized cell lines that display the mature osteoblast phenotype.

Full details of the abovementioned studies are described in the following publications, the disclosure of which are hereby incorporated by reference:

Hahn, G. V.; Cohen, R. B.; Wozney, J. M.; Levitz, C. L.; Shore, E. M.; Zasloff, M. A.; Kaplan, F. S.: A bone morphogenetic protein subfamily: chromosomal localization of human genes for BMP5, BMP6, and BMP7. Genomics 14:759-762, 1992; and Rickard, D. J.; Hofbauer, L. C.; Bonde, S. K.; Gori, F.; Spelsberg, T. C.; Riggs, B. L.: Bone morphogenetic protein-6 production in human osteoblastic cell lines: selective regulation b.

Further studies establishing the function and utilities of BMP6 are found in John Hopkins OMIM database record ID 112266, and in cited publications listed in Table 5, which are hereby incorporated by reference. BNIP-S (Accession NP_612122.1) is another GAM281 target gene, herein designated TARGET GENE. BNIP-S BINDING SITE is a target binding site found in the 3' untranslated region of multiple transcripts of mRNA encoded by BNIP-S, corresponding to a target binding site such as BINDING SITE I, BINDING SITE II or BINDING SITE III of FIG. 8. Table 4 illustrates the complementarity of the nucleotide sequences of BNIP-S BINDING SITE, designated SEQ ID:5845, to the nucleotide sequence of GAM281 RNA, herein designated GAM RNA, also designated SEQ ID:278.

Another function of GAM281 is therefore inhibition of BNIP-S (Accession NP_612122.1). Accordingly, utilities of GAM281 include diagnosis, prevention and treatment of diseases and clinical conditions associated with BNIP-S.

BRIP1 (Accession NP_114432.1) is another GAM281 target gene, herein designated TARGET GENE. BRIP1 BINDING SITE is a target binding site found in the 3' untranslated region of mRNA encoded by BRIP1, corresponding to a target binding site such as BINDING SITE I, BINDING SITE II or BINDING SITE III of FIG. 8. Table 4 illustrates the complementarity of the nucleotide sequences of BRIP1 BINDING SITE, designated SEQ ID:13904, to the nucleotide sequence of GAM281 RNA, herein designated GAM RNA, also designated SEQ ID:278.

Another function of GAM281 is therefore inhibition of BRIP1 (Accession NP_114432.1). Accordingly, utilities of GAM281 include diagnosis, prevention and treatment of diseases and clinical conditions associated with BRIP1.

Bromodomain and phd finger containing, 3 (BRPF3, Accession XP_166450.1) is another GAM281 target gene, herein designated TARGET GENE. BRPF3 BINDING SITE is a target binding site found in the 3' untranslated region of mRNA encoded by BRPF3, corresponding to a target binding site such as BINDING SITE I, BINDING SITE II or BINDING SITE III of FIG. 8. Table 4 illustrates the complementarity of the nucleotide sequences of BRPF3 BINDING SITE, designated SEQ ID:7755, to the nucleotide sequence of GAM281 RNA, herein designated GAM RNA, also designated SEQ ID:278.

Another function of GAM281 is therefore inhibition of Bromodomain and phd finger containing, 3 (BRPF3, Accession XP_166450.1). Accordingly, utilities of GAM281 include diagnosis, prevention and treatment of diseases and clinical conditions associated with BRPF3.

Butyrophilin, subfamily 3, member a1 (BTN3A1, Accession NP_008979.2) is another GAM281 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:2067, to the nucleotide sequence of GAM281 RNA, herein designated GAM RNA, also designated SEQ ID:278.

Another function of GAM281 is therefore inhibition of Butyrophilin, subfamily 3, member a1 (BTN3A1, Accession NP_008979.2). Accordingly, utilities of GAM281 include diagnosis, prevention and treatment of diseases and clinical conditions associated with BTN3A1.

BXDC1 (Accession XP_166303.1) is another GAM281 target gene, herein designated TARGET GENE. BXDC1 BINDING SITE1 and BXDC1 BINDING SITE2 are target binding sites found in untranslated regions of mRNA encoded by BXDC1, corresponding to target binding sites such as BINDING SITE I, BINDING SITE II or BINDING SITE III of FIG. 8. Table 4 illustrates the complementarity of the nucleotide sequences of BXDC1 BINDING SITE1 and BXDC1 BINDING SITE2, designated SEQ ID:4549 and SEQ ID:12129 respectively, to the nucleotide sequence of GAM281 RNA, herein designated GAM RNA, also designated SEQ ID:278.

Another function of GAM281 is therefore inhibition of BXDC1 (Accession XP_166303.1). Accordingly, utilities of GAM281 include diagnosis, prevention and treatment of diseases and clinical conditions associated with BXDC1.

BY55 (Accession NP_008984.1) is another GAM281 target gene, herein designated TARGET GENE. BY55 BINDING SITE is a target binding site found in the 5' untranslated region of mRNA encoded by BY55, corresponding to a target binding site such as BINDING SITE I, BINDING SITE II or BINDING SITE III of FIG. 8. Table 4 illustrates the complementarity of the nucleotide sequences of BY55 BINDING SITE, designated SEQ ID:7101, to the nucleotide sequence of GAM281 RNA, herein designated GAM RNA, also designated SEQ ID:278.

Another function of GAM281 is therefore inhibition of BY55 (Accession NP_008984.1). Accordingly, utilities of GAM281 include diagnosis, prevention and treatment of diseases and clinical conditions associated with BY55.

Chromosome 11 open reading frame 13 (C11orf13, Accession NP_003466.1) is another GAM281 target gene, herein designated TARGET GENE. C11orf13 BINDING SITE is a target binding site found in the 3' untranslated region of mRNA encoded by C11orf13, corresponding to a target binding site such as BINDING SITE I, BINDING SITE II or BINDING SITE III of FIG. 8. Table 4 illustrates the complementarity of the nucleotide sequences of C11orf13 BINDING SITE, designated SEQ ID:3521, to the nucleotide sequence of GAM281 RNA, herein designated GAM RNA, also designated SEQ ID:278.

Another function of GAM281 is therefore inhibition of Chromosome 11 open reading frame 13 (C11orf13, Accession NP_003466.1). Accordingly, utilities of GAM281 include diagnosis, prevention and treatment of diseases and clinical conditions associated with C11orf13.

Chromosome 11 open reading frame 17 (C11orf17, Accession NP_065693.2) is another GAM281 target gene, herein designated TARGET GENE. C11orf17 BINDING SITE is a target binding site found in the 3' untranslated region of mRNA encoded by C11orf17, corresponding to a target binding site such as BINDING SITE I, BINDING SITE II or BINDING SITE III of FIG. 8. Table 4 illustrates the complementarity of the nucleotide sequences of C11orf17 BINDING SITE, designated SEQ ID:11525, to the nucleotide sequence of GAM281 RNA, herein designated GAM RNA, also designated SEQ ID:278.

Another function of GAM281 is therefore inhibition of Chromosome 11 open reading frame 17 (C11orf17, Accession NP_065693.2). Accordingly, utilities of GAM281 include diagnosis, prevention and treatment of diseases and clinical conditions associated with C11orf17.

Chromosome 13 open reading frame 1 (C13orf1, Accession NP_065189.1) is another GAM281 target gene, herein designated TARGET GENE. C13orf1 BINDING SITE is a target binding site found in the 3' untranslated region of mRNA encoded by C13orf1, corresponding to a target binding site such as BINDING SITE I, BINDING SITE II or BINDING SITE III of FIG. 8. Table 4 illustrates the complementarity of the nucleotide sequences of C13orf1 BINDING SITE, designated SEQ ID:5746, to the nucleotide sequence of GAM281 RNA, herein designated GAM RNA, also designated SEQ ID:278.

Another function of GAM281 is therefore inhibition of Chromosome 13 open reading frame 1 (C13orf1, Accession NP_065189.1). Accordingly, utilities of GAM281 include diagnosis, prevention and treatment of diseases and clinical conditions associated with C13orf1.

Chromosome 14 open reading frame 1 (C14orf1, Accession NP_009107.1) is another GAM281 target gene, herein designated TARGET GENE. C14orf1 BINDING SITE is a target binding site found in the 3' untranslated region of mRNA encoded by C14orf1, corresponding to a target binding site such as BINDING SITE I, BINDING SITE II or BINDING SITE III of FIG. 8. Table 4 illustrates the complementarity of the nucleotide sequences of C14orf1 BINDING SITE, designated SEQ ID:12744, to the nucleotide sequence of GAM281 RNA, herein designated GAM RNA, also designated SEQ ID:278.

Another function of GAM281 is therefore inhibition of Chromosome 14 open reading frame 1 (C14orf1, Accession NP_009107.1). Accordingly, utilities of GAM281 include diagnosis, prevention and treatment of diseases and clinical conditions associated with C14orf1.

C14orf113 (Accession NP_060100.1) is another GAM281 target gene, herein designated TARGET GENE. C14orf113 BINDING SITE1 and C14orf113 BINDING SITE2 are target binding sites found in untranslated regions of mRNA encoded by C14orf113, corresponding to target binding sites such as BINDING SITE I, BINDING SITE II or BINDING SITE III of FIG. 8. Table 4 illustrates the complementarity of the nucleotide sequences of C14orf113 BINDING SITE1 and C14orf113 BINDING SITE2, designated SEQ ID:18863 and SEQ ID:5052 respectively, to the nucleotide sequence of GAM281 RNA, herein designated GAM RNA, also designated SEQ ID:278.

Another function of GAM281 is therefore inhibition of C14orf113 (Accession NP_060100.1). Accordingly, utilities of GAM281 include diagnosis, prevention and treatment of diseases and clinical conditions associated with C14orf113.

C14orf115 (Accession NP_060698.1) is another GAM281 target gene, herein designated TARGET GENE. C14orf115 BINDING SITE is a target binding site found in the 5' untranslated region of mRNA encoded by C14orf115, corresponding to a target binding site such as BINDING SITE I, BINDING SITE II or BINDING SITE III of FIG. 8. Table 4 illustrates the complementarity of the nucleotide sequences of C14orf115 BINDING SITE, designated SEQ ID:1480, to the nucleotide sequence of GAM281 RNA, herein designated GAM RNA, also designated SEQ ID:278.

Another function of GAM281 is therefore inhibition of C14orf115 (Accession NP_060698.1). Accordingly, utilities of GAM281 include diagnosis, prevention and treatment of diseases and clinical conditions associated with C14orf115.

C14orf143 (Accession NP_660274.1) is another GAM281 target gene, herein designated TARGET GENE.

C14orf143 BINDING SITE is a target binding site found in the 3' untranslated region of mRNA encoded by C14orf143, corresponding to a target binding site such as BINDING SITE I, BINDING SITE II or BINDING SITE III of FIG. 8. Table 4 illustrates the complementarity of the nucleotide sequences of C14orf143 BINDING SITE, designated SEQ ID:17955, to the nucleotide sequence of GAM281 RNA, herein designated GAM RNA, also designated SEQ ID:278.

Another function of GAM281 is therefore inhibition of C14orf143 (Accession NP_660274.1). Accordingly, utilities of GAM281 include diagnosis, prevention and treatment of diseases and clinical conditions associated with C14orf143.

C14orf92 (Accession NP_055643.1) is another GAM281 target gene, herein designated TARGET GENE. C14orf92 BINDING SITE is a target binding site found in the 3' untranslated region of mRNA encoded by C14orf92, corresponding to a target binding site such as BINDING SITE I, BINDING SITE II or BINDING SITE III of FIG. 8. Table 4 illustrates the complementarity of the nucleotide sequences of C14orf92 BINDING SITE, designated SEQ ID:14861, to the nucleotide sequence of GAM281 RNA, herein designated GAM RNA, also designated SEQ ID:278.

Another function of GAM281 is therefore inhibition of C14orf92 (Accession NP_055643.1). Accordingly, utilities of GAM281 include diagnosis, prevention and treatment of diseases and clinical conditions associated with C14orf92.

Chromosome 16 open reading frame 7 (C16orf7, Accession NP_004904.1) is another GAM281 target gene, herein designated TARGET GENE. C16orf7 BINDING SITE is a target binding site found in the 3' untranslated region of mRNA encoded by C16orf7, corresponding to a target binding site such as BINDING SITE I, BINDING SITE II or BINDING SITE III of FIG. 8. Table 4 illustrates the complementarity of the nucleotide sequences of C16orf7 BINDING SITE, designated SEQ ID:16110, to the nucleotide sequence of GAM281 RNA, herein designated GAM RNA, also designated SEQ ID:278.

Another function of GAM281 is therefore inhibition of Chromosome 16 open reading frame 7 (C16orf7, Accession NP_004904.1). Accordingly, utilities of GAM281 include diagnosis, prevention and treatment of diseases and clinical conditions associated with C16orf7.

Chromosome 1 open reading frame 24 (C1orf24, Accession NP_443198.1) is another GAM281 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:19538, to the nucleotide sequence of GAM281 RNA, herein designated GAM RNA, also designated SEQ ID:278.

Another function of GAM281 is therefore inhibition of Chromosome 1 open reading frame 24 (C1orf24, Accession NP_443198.1). Accordingly, utilities of GAM281 include diagnosis, prevention and treatment of diseases and clinical conditions associated with C1orf24.

C1q and tumor necrosis factor related protein 6 (C1QTNF6, Accession NP_114116.2) is another GAM281 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:14882, to the nucleotide sequence of GAM281 RNA, herein designated GAM RNA, also designated SEQ ID:278.

Another function of GAM281 is therefore inhibition of C1q and tumor necrosis factor related protein 6 (C1QTNF6, Accession NP_114116.2). Accordingly, utilities of GAM281 include diagnosis, prevention and treatment of diseases and clinical conditions associated with C1QTNF6.

Chromosome 20 open reading frame 147 (C20orf147, Accession NP_689880.1) is another GAM281 target gene, herein designated TARGET GENE. C20orf147 BINDING SITE is a target binding site found in the 3' untranslated region of mRNA encoded by C20orf147, corresponding to a target binding site such as BINDING SITE I, BINDING SITE II or BINDING SITE III of FIG. 8. Table 4 illustrates the complementarity of the nucleotide sequences of C20orf147 BINDING SITE, designated SEQ ID:16257, to the nucleotide sequence of GAM281 RNA, herein designated GAM RNA, also designated SEQ ID:278.

Another function of GAM281 is therefore inhibition of Chromosome 20 open reading frame 147 (C20orf147, Accession NP_689880.1). Accordingly, utilities of GAM281 include diagnosis, prevention and treatment of diseases and clinical conditions associated with C20orf147.

Chromosome 21 open reading frame 67 (C21orf67, Accession NP_478068.1) is another GAM281 target gene, herein designated TARGET GENE. C21orf67 BINDING SITE is a target binding site found in the 5' untranslated region of mRNA encoded by C21orf67, corresponding to a target binding site such as BINDING SITE I, BINDING SITE II or BINDING SITE III of FIG. 8. Table 4 illustrates the complementarity of the nucleotide sequences of C21orf67 BINDING SITE, designated SEQ ID:6569, to the nucleotide sequence of GAM281 RNA, herein designated GAM RNA, also designated SEQ ID:278.

Another function of GAM281 is therefore inhibition of Chromosome 21 open reading frame 67 (C21orf67, Accession NP_478068.1). Accordingly, utilities of GAM281 include diagnosis, prevention and treatment of diseases and clinical conditions associated with C21orf67.

Chromosome 22 open reading frame 19 (C22orf19, Accession NP_003669.2) is another GAM281 target gene, herein designated TARGET GENE. C22orf19 BINDING SITE is a target binding site found in the 3' untranslated region of mRNA encoded by C22orf19, corresponding to a target binding site such as BINDING SITE I, BINDING SITE II or BINDING SITE III of FIG. 8. Table 4 illustrates the complementarity of the nucleotide sequences of C22orf19 BINDING SITE, designated SEQ ID:18897, to the nucleotide sequence of GAM281 RNA, herein designated GAM RNA, also designated SEQ ID:278.

Another function of GAM281 is therefore inhibition of Chromosome 22 open reading frame 19 (C22orf19, Accession NP_003669.2). Accordingly, utilities of GAM281 include diagnosis, prevention and treatment of diseases and clinical conditions associated with C22orf19.

C3IP1 (Accession NP_067646.1) is another GAM281 target gene, herein designated TARGET GENE. C3IP1 BINDING SITE is a target binding site found in the 3' untranslated region of mRNA encoded by C3IP1, corresponding to a target binding site such as BINDING SITE I, BINDING SITE II or BINDING SITE III of FIG. 8. Table 4 illustrates the complementarity of the nucleotide sequences of C3IP1 BINDING SITE, designated SEQ ID:2482, to the nucleotide sequence of GAM281 RNA, herein designated GAM RNA, also designated SEQ ID:278.

Another function of GAM281 is therefore inhibition of C3IP1 (Accession NP_067646.1). Accordingly, utilities of GAM281 include diagnosis, prevention and treatment of diseases and clinical conditions associated with C3IP1.

C4orf9 (Accession XP_035572.1) is another GAM281 target gene, herein designated TARGET GENE. C4orf9 BINDING SITE is a target binding site found in the 3' untranslated region of mRNA encoded by C4orf9, corresponding to a target binding site such as BINDING SITE I, BINDING SITE II or BINDING SITE III of FIG. 8. Table 4 illustrates the complementarity of the nucleotide sequences of C4orf9 BINDING SITE, designated SEQ ID:15574, to the nucleotide sequence of GAM281 RNA, herein designated GAM RNA, also designated SEQ ID:278.

Another function of GAM281 is therefore inhibition of C4orf9 (Accession XP_035572.1). Accordingly, utilities of GAM281 include diagnosis, prevention and treatment of diseases and clinical conditions associated with C4orf9.

Chromosome 6 open reading frame 33 (C6orf33, Accession NP_588608.1) is another GAM281 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:6896, to the nucleotide sequence of GAM281 RNA, herein designated GAM RNA, also designated SEQ ID:278.

Another function of GAM281 is therefore inhibition of Chromosome 6 open reading frame 33 (C6orf33, Accession NP_588608.1). Accordingly, utilities of GAM281 include diagnosis, prevention and treatment of diseases and clinical conditions associated with C6orf33.

C6orf5 (Accession NP_056339.2) is another GAM281 target gene, herein designated TARGET GENE. C6orf5 BINDING SITE1 and C6orf5 BINDING SITE2 are target binding sites found in untranslated regions of mRNA encoded by C6orf5, corresponding to target binding sites such as BINDING SITE I, BINDING SITE II or BINDING SITE III of FIG. 8. Table 4 illustrates the complementarity of the nucleotide sequences of C6orf5 BINDING SITE1 and C6orf5 BINDING SITE2, designated SEQ ID:12805 and SEQ ID:10099 respectively, to the nucleotide sequence of GAM281 RNA, herein designated GAM RNA, also designated SEQ ID:278.

Another function of GAM281 is therefore inhibition of C6orf5 (Accession NP_056339.2). Accordingly, utilities of GAM281 include diagnosis, prevention and treatment of diseases and clinical conditions associated with C6orf5.

C6orf57 (Accession NP_660310.1) is another GAM281 target gene, herein designated TARGET GENE. C6orf57 BINDING SITE is a target binding site found in the 3' untranslated region of mRNA encoded by C6orf57, corresponding to a target binding site such as BINDING SITE I, BINDING SITE II or BINDING SITE III of FIG. 8. Table 4 illustrates the complementarity of the nucleotide sequences of C6orf57 BINDING SITE, designated SEQ ID:2114, to the nucleotide sequence of GAM281 RNA, herein designated GAM RNA, also designated SEQ ID:278.

Another function of GAM281 is therefore inhibition of C6orf57 (Accession NP_660310.1). Accordingly, utilities of GAM281 include diagnosis, prevention and treatment of diseases and clinical conditions associated with C6orf57.

Complement component 7 (C7, Accession NP_000578.1) is another GAM281 target gene, herein designated TARGET GENE. C7 BINDING SITE1 and C7 BINDING SITE2 are target binding sites found in untranslated regions of mRNA encoded by C7, corresponding to target binding sites such as BINDING SITE I, BINDING SITE II or BINDING SITE III of FIG. 8. Table 4 illustrates the complementarity of the nucleotide sequences of C7 BINDING SITE1 and C7 BINDING SITE2, designated SEQ ID:17778 and SEQ ID:9684 respectively, to the nucleotide sequence of GAM281 RNA, herein designated GAM RNA, also designated SEQ ID:278.

Another function of GAM281 is therefore inhibition of Complement component 7 (C7, Accession NP_000578.1). Accordingly, utilities of GAM281 include diagnosis, prevention and treatment of diseases and clinical conditions associated with C7.

Chromosome 9 open reading frame 5 (C9orf5, Accession NP_114401.1) is another GAM281 target gene, herein designated TARGET GENE. C9orf5 BINDING SITE is a target binding site found in the 3' untranslated region of mRNA encoded by C9orf5, corresponding to a target binding site such as BINDING SITE I, BINDING SITE II or BINDING SITE III of FIG. 8. Table 4 illustrates the complementarity of the nucleotide sequences of C9orf5 BINDING SITE, designated SEQ ID:14258, to the nucleotide sequence of GAM281 RNA, herein designated GAM RNA, also designated SEQ ID:278.

Another function of GAM281 is therefore inhibition of Chromosome 9 open reading frame 5 (C9orf5, Accession NP_114401.1). Accordingly, utilities of GAM281 include diagnosis, prevention and treatment of diseases and clinical conditions associated with C9orf5.

Chromosome 9 open reading frame 9 (C9orf9, Accession NP_061829.2) is another GAM281 target gene, herein designated TARGET GENE. C9orf9 BINDING SITE1 and C9orf9 BINDING SITE2 are target binding sites found in untranslated regions of mRNA encoded by C9orf9, corresponding to target binding sites such as BINDING SITE I, BINDING SITE II or BINDING SITE III of FIG. 8. Table 4 illustrates the complementarity of the nucleotide sequences of C9orf9 BINDING SITE1 and C9orf9 BINDING SITE2, designated SEQ ID:5477 and SEQ ID:11520 respectively, to the nucleotide sequence of GAM281 RNA, herein designated GAM RNA, also designated SEQ ID:278.

Another function of GAM281 is therefore inhibition of Chromosome 9 open reading frame 9 (C9orf9, Accession NP_061829.2). Accordingly, utilities of GAM281 include diagnosis, prevention and treatment of diseases and clinical conditions associated with C9orf9.

CAB2 (Accession NP_219487.2) is another GAM281 target gene, herein designated TARGET GENE. CAB2 BINDING SITE is a target binding site found in the 3' untranslated region of mRNA encoded by CAB2, corresponding to a target binding site such as BINDING SITE I, BINDING SITE II or BINDING SITE III of FIG. 8. Table 4 illustrates the complementarity of the nucleotide sequences of CAB2 BINDING SITE, designated SEQ ID:9181, to the nucleotide sequence of GAM281 RNA, herein designated GAM RNA, also designated SEQ ID:278.

Another function of GAM281 is therefore inhibition of CAB2 (Accession NP_219487.2). Accordingly, utilities of GAM281 include diagnosis, prevention and treatment of diseases and clinical conditions associated with CAB2.

Calcium binding protein 4 (CABP4, Accession NP_660201.1) is another GAM281 target gene, herein designated TARGET GENE. CABP4 BINDING SITE is a target binding site found in the 5' untranslated region of mRNA encoded by CABP4, corresponding to a target binding site such as BINDING SITE I, BINDING SITE II or BINDING SITE III of FIG. 8. Table 4 illustrates the complementarity of the nucleotide sequences of CABP4 BINDING SITE, designated SEQ ID:7624, to the nucleotide sequence of GAM281 RNA, herein designated GAM RNA, also designated SEQ ID:278.

Another function of GAM281 is therefore inhibition of Calcium binding protein 4 (CABP4, Accession NP_660201.1). Accordingly, utilities of GAM281 include diagnosis, prevention and treatment of diseases and clinical conditions associated with CABP4.

Calcium modulating ligand (CAMLG, Accession NP_001736.1) is another GAM281 target gene, herein designated TARGET GENE. CAMLG BINDING SITE is a target binding site found in the 3' untranslated region of mRNA encoded by CAMLG, corresponding to a target binding site such as BINDING SITE I, BINDING SITE II or BINDING SITE III of FIG. 8. Table 4 illustrates the complementarity of the nucleotide sequences of CAMLG BINDING SITE, designated SEQ ID:18944, to the nucleotide sequence of GAM281 RNA, herein designated GAM RNA, also designated SEQ ID:278.

Another function of GAM281 is therefore inhibition of Calcium modulating ligand (CAMLG, Accession NP_001736.1), a gene which is likely involved in the mobilization of calcium as a result of the tcr/cd3 complex interaction. Accordingly, utilities of GAM281 include diagnosis, prevention and treatment of diseases and clinical conditions associated with CAMLG.

The function of CAMLG and its association with various diseases and clinical conditions, has been established by previous studies, as described hereinabove with reference to GAM130.1. CAPRI (Accession NP_008920.3) is another GAM281 target gene, herein designated TARGET GENE. CAPRI BINDING SITE is a target binding site found in the 3' untranslated region of mRNA encoded by CAPRI, corresponding to a target binding site such as BINDING SITE I, BINDING SITE II or BINDING SITE III of FIG. 8. Table 4 illustrates the complementarity of the nucleotide sequences of CAPRI BINDING SITE, designated SEQ ID:4271, to the nucleotide sequence of GAM281 RNA, herein designated GAM RNA, also designated SEQ ID:278.

Another function of GAM281 is therefore inhibition of CAPRI (Accession NP_008920.3). Accordingly, utilities of GAM281 include diagnosis, prevention and treatment of diseases and clinical conditions associated with CAPRI.

Caspase recruitment domain family, member 6 (CARD6, Accession NP_115976.2) is another GAM281 target gene, herein designated TARGET GENE. CARD6 BINDING SITE is a target binding site found in the 3' untranslated region of mRNA encoded by CARD6, corresponding to a target binding site such as BINDING SITE I, BINDING SITE II or BINDING SITE III of FIG. 8. Table 4 illustrates the complementarity of the nucleotide sequences of CARD6 BINDING SITE, designated SEQ ID:9036, to the nucleotide sequence of GAM281 RNA, herein designated GAM RNA, also designated SEQ ID:278.

Another function of GAM281 is therefore inhibition of Caspase recruitment domain family, member 6 (CARD6, Accession NP_115976.2) . Accordingly, utilities of GAM281 include diagnosis, prevention and treatment of diseases and clinical conditions associated with CARD6.

Caspase 2, apoptosis-related cysteine protease (neural precursor cell expressed, developmentally down-regulated 2) (CASP2, Accession NP_116766.1) is another GAM281 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM281 RNA, herein designated GAM RNA, also designated SEQ ID:278.

Another function of GAM281 is therefore inhibition of Caspase 2, apoptosis-related cysteine protease (neural precursor cell expressed, developmentally down-regulated 2) (CASP2, Accession NP_116766.1), a gene which involves in the activation cascade of caspases responsible for apoptosis execution. Accordingly, utilities of GAM281 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116765.1) is another GAM281 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM281 RNA, herein designated GAM RNA, also designated SEQ ID:278.

Another function of GAM281 is therefore inhibition of Caspase 2, apoptosis-related cysteine protease (neural precursor cell expressed, developmentally down-regulated 2) (CASP2, Accession NP_116765.1), a gene which involves in the activation cascade of caspases responsible for apoptosis execution. Accordingly, utilities of GAM281 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_001215.1) is another GAM281 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM281 RNA, herein designated GAM RNA, also designated SEQ ID:278.

Another function of GAM281 is therefore inhibition of Caspase 2, apoptosis-related cysteine protease (neural precursor cell expressed, developmentally down-regulated 2) (CASP2, Accession NP_001215.1), a gene which involves in the activation cascade of caspases responsible for apoptosis execution. Accordingly, utilities of GAM281 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116764.1) is another GAM281 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM281 RNA, herein designated GAM RNA, also designated SEQ ID:278.

Another function of GAM281 is therefore inhibition of Caspase 2, apoptosis-related cysteine protease (neural precursor cell expressed, developmentally down-regulated 2) (CASP2, Accession NP_116764.1), a gene which involves in the activation cascade of caspases responsible for apoptosis execution. Accordingly, utilities of GAM281 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 8, apoptosis-related cysteine protease (CASP8, Accession NP_203520.1) is another GAM281 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM281 RNA, herein designated GAM RNA, also designated SEQ ID:278.

Another function of GAM281 is therefore inhibition of Caspase 8, apoptosis-related cysteine protease (CASP8, Accession NP_203520.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM281 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203521.1) is another GAM281 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM281 RNA, herein designated GAM RNA, also designated SEQ ID:278.

Another function of GAM281 is therefore inhibition of Caspase 8, apoptosis-related cysteine protease (CASP8, Accession NP_203521.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM281 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_001219.2) is another GAM281 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM281 RNA, herein designated GAM RNA, also designated SEQ ID:278.

Another function of GAM281 is therefore inhibition of Caspase 8, apoptosis-related cysteine protease (CASP8, Accession NP_001219.2), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM281 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203519.1) is another GAM281 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM281 RNA, herein designated GAM RNA, also designated SEQ ID:278.

Another function of GAM281 is therefore inhibition of Caspase 8, apoptosis-related cysteine protease (CASP8, Accession NP_203519.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM281 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Core-binding factor, runt domain, alpha subunit 2; translocated to, 2 (CBFA2T2, Accession NP_787060.1) is another GAM281 target gene, herein designated TARGET GENE. CBFA2T2 BINDING SITE is a target binding site found in the 5' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:8242, to the nucleotide sequence of GAM281 RNA, herein designated GAM RNA, also designated SEQ ID:278.

Another function of GAM281 is therefore inhibition of Core-binding factor, runt domain, alpha subunit 2; translocated to, 2 (CBFA2T2, Accession NP_787060.1), a gene which is a putative transcription factor. Accordingly, utilities of GAM281 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Chemokine (c-c motif) ligand 16 (CCL16, Accession NP_004581.1) is another GAM281 target gene, herein designated TARGET GENE. CCL16 BINDING SITE is a target binding site found in the 3' untranslated region of mRNA encoded by CCL16, corresponding to a target binding site such as BINDING SITE I, BINDING SITE II or BINDING SITE III of FIG. 8. Table 4 illustrates the complementarity of the nucleotide sequences of CCL16 BINDING SITE, designated SEQ ID:9543, to the nucleotide sequence of GAM281 RNA, herein designated GAM RNA, also designated SEQ ID:278.

Another function of GAM281 is therefore inhibition of Chemokine (c-c motif) ligand 16 (CCL16, Accession NP_004581.1). Accordingly, utilities of GAM281 include diagnosis, prevention and treatment of diseases and clinical conditions associated with CCL16.

Chemokine (c-c motif) ligand 22 (CCL22, Accession NP_002981.2) is another GAM281 target gene, herein designated TARGET GENE. CCL22 BINDING SITE1 and CCL22 BINDING SITE2 are target binding sites found in untranslated regions of mRNA encoded by CCL22, corresponding to target binding sites such as BINDING SITE I, BINDING SITE II or BINDING SITE III of FIG. 8. Table 4 illustrates the complementarity of the nucleotide sequences of CCL22 BINDING SITE1 and CCL22 BINDING SITE2, designated SEQ ID:15049 and SEQ ID:1679 respectively, to the nucleotide sequence of GAM281 RNA, herein designated GAM RNA, also designated SEQ ID:278.

Another function of GAM281 is therefore inhibition of Chemokine (c-c motif) ligand 22 (CCL22, Accession NP_002981.2). Accordingly, utilities of GAM281 include diagnosis, prevention and treatment of diseases and clinical conditions associated with CCL22.

Cyclin f (CCNF, Accession NP_001752.1) is another GAM281 target gene, herein designated TARGET GENE. CCNF BINDING SITE is a target binding site found in the 3' untranslated region of mRNA encoded by CCNF, corresponding to a target binding site such as BINDING SITE I, BINDING SITE II or BINDING SITE III of FIG. 8. Table 4 illustrates the complementarity of the nucleotide sequences of CCNF BINDING SITE, designated SEQ ID:17624, to the nucleotide sequence of GAM281 RNA, herein designated GAM RNA, also designated SEQ ID:278.

Another function of GAM281 is therefore inhibition of Cyclin f (CCNF, Accession NP_001752.1), a gene which likely to be involved in the control of the cell cycle during s phase and g2. Accordingly, utilities of GAM281 include diagnosis, prevention and treatment of diseases and clinical conditions associated with CCNF.

The function of CCNF and its association with various diseases and clinical conditions, has been established by previous studies, as described hereinabove with reference to GAM130.1. Ccr4 carbon catabolite repression 4-like (s. cerevisiae) (CCRN4L, Accession NP_036250.2) is another GAM281 target gene, herein designated TARGET GENE. CCRN4L BINDING SITE is a target binding site found in the 3' untranslated region of mRNA encoded by CCRN4L, corresponding to a target binding site such as BINDING SITE I, BINDING SITE II or BINDING SITE III of FIG. 8. Table 4 illustrates the complementarity of the nucleotide sequences of CCRN4L BINDING SITE, designated SEQ ID:4698, to the nucleotide sequence of GAM281 RNA, herein designated GAM RNA, also designated SEQ ID:278.

Another function of GAM281 is therefore inhibition of Ccr4 carbon catabolite repression 4-like (s. cerevisiae) (CCRN4L, Accession NP_036250.2). Accordingly, utilities of GAM281 include diagnosis, prevention and treatment of diseases and clinical conditions associated with CCRN4L.

Cd209 antigen (CD209, Accession NP_066978.1) is another GAM281 target gene, herein designated TARGET GENE. CD209 BINDING SITE1 and CD209 BINDING SITE2 are target binding sites found in untranslated regions of mRNA encoded by CD209, corresponding to target binding sites such as BINDING SITE I, BINDING SITE II or BINDING SITE III of FIG. 8. Table 4 illustrates the complementarity of the nucleotide sequences of CD209 BINDING SITE1 and CD209 BINDING SITE2, designated SEQ ID:4298 and SEQ ID:17051 respectively, to the nucleotide sequence of GAM281 RNA, herein designated GAM RNA, also designated SEQ ID:278.

Another function of GAM281 is therefore inhibition of Cd209 antigen (CD209, Accession NP_066978.1), a gene which may play an important role in the CD4-independent association of HIV with cells. Accordingly, utilities of GAM281 include diagnosis, prevention and treatment of diseases and clinical conditions associated with CD209.

The function of CD209 and its association with various diseases and clinical conditions, has been established by previous studies, as described hereinabove with reference to GAM96.1. Cd24 antigen (small cell lung carcinoma cluster 4 antigen) (CD24, Accession NP_037362.1) is another GAM281 target gene, herein designated TARGET GENE. CD24 BINDING SITE is a target binding site found in the 3' untranslated region of mRNA encoded by CD24, corresponding to a target binding site such as BINDING SITE I, BINDING SITE II or BINDING SITE III of FIG. 8. Table 4 illustrates the complementarity of the nucleotide sequences of CD24 BINDING SITE, designated SEQ ID:19572, to the nucleotide sequence of GAM281 RNA, herein designated GAM RNA, also designated SEQ ID:278.

Another function of GAM281 is therefore inhibition of Cd24 antigen (small cell lung carcinoma cluster 4 antigen) (CD24, Accession NP_037362.1). Accordingly, utilities of GAM281 include diagnosis, prevention and treatment of diseases and clinical conditions associated with CD24.

Cdc14 cell division cycle 14 homolog b (s. cerevisiae) (CDC14B, Accession NP_201589.1) is another GAM281 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:17127, to the nucleotide sequence of GAM281 RNA, herein designated GAM RNA, also designated SEQ ID:278.

Another function of GAM281 is therefore inhibition of Cdc14 cell division cycle 14 homolog b (s. cerevisiae) (CDC14B, Accession NP_201589.1). Accordingly, utilities of GAM281 include diagnosis, prevention and treatment of diseases and clinical conditions associated with CDC14B.

Cell division cycle 2-like 2 (CDC2L2, Accession NP_296370.1) is another GAM281 target gene, herein designated TARGET GENE. CDC2L2 BINDING SITE is a target binding site found in the 5' untranslated region of multiple transcripts of mRNA encoded by CDC2L2, corresponding to a target binding site such as BINDING SITE I, BINDING SITE II or BINDING SITE III of FIG. 8. Table 4 illustrates the complementarity of the nucleotide sequences of CDC2L2 BINDING SITE, designated SEQ ID:15084, to the nucleotide sequence of GAM281 RNA, herein designated GAM RNA, also designated SEQ ID:278.

Another function of GAM281 is therefore inhibition of Cell division cycle 2-like 2 (CDC2L2, Accession NP_296370.1). Accordingly, utilities of GAM281 include diagnosis, prevention and treatment of diseases and clinical conditions associated with CDC2L2.

Cdc6 cell division cycle 6 homolog (s. cerevisiae) (CDC6, Accession NP_001245.1) is another GAM281 target gene, herein designated TARGET GENE. CDC6 BINDING SITE is a target binding site found in the 3' untranslated region of mRNA encoded by CDC6, corresponding to a target binding site such as BINDING SITE I, BINDING SITE II or BINDING SITE III of FIG. 8. Table 4 illustrates the complementarity of the nucleotide sequences of CDC6 BINDING SITE, designated SEQ ID:9211, to the nucleotide sequence of GAM281 RNA, herein designated GAM RNA, also designated SEQ ID:278.

Another function of GAM281 is therefore inhibition of Cdc6 cell division cycle 6 homolog (s. cerevisiae) (CDC6, Accession NP_001245.1), a gene which is a component of the origin recognition complex (orc) that binds origins of replication. Accordingly, utilities of GAM281 include diagnosis, prevention and treatment of diseases and clinical conditions associated with CDC6.

The function of CDC6 and its association with various diseases and clinical conditions, has been established by previous studies, as described hereinabove with reference to GAM189.1. CDCP1 (Accession NP_073753.3) is another GAM281 target gene, herein designated TARGET GENE. CDCP1 BINDING SITE is a target binding site found in the 3' untranslated region of multiple transcripts of mRNA encoded by CDCP1, corresponding to a target binding site such as BINDING SITE I, BINDING SITE II or BINDING SITE III of FIG. 8. Table 4 illustrates the complementarity of the nucleotide sequences of CDCP1 BINDING SITE, designated SEQ ID:12091, to the nucleotide sequence of GAM281 RNA, herein designated GAM RNA, also designated SEQ ID:278.

Another function of GAM281 is therefore inhibition of CDCP1 (Accession NP_073753.3). Accordingly, utilities of GAM281 include diagnosis, prevention and treatment of diseases and clinical conditions associated with CDCP1.

Cadherin 1, type 1, e-cadherin (epithelial) (CDH1, Accession NP_004351.1) is another GAM281 target gene, herein designated TARGET GENE. CDH1 BINDING SITE1 and CDH1 BINDING SITE2 are target binding sites found in untranslated regions of mRNA encoded by CDH1, corresponding to target binding sites such as BINDING SITE I, BINDING SITE II or BINDING SITE III of FIG. 8. Table 4 illustrates the complementarity of the nucleotide sequences of CDH1 BINDING SITE1 and CDH1 BINDING SITE2, designated SEQ ID:12580 and SEQ ID:5514 respectively, to the nucleotide sequence of GAM281 RNA, herein designated GAM RNA, also designated SEQ ID:278.

Another function of GAM281 is therefore inhibition of Cadherin 1, type 1, e-cadherin (epithelial) (CDH1, Accession NP_004351.1) . Accordingly, utilities of GAM281 include diagnosis, prevention and treatment of diseases and clinical conditions associated with CDH1.

Cadherin 17, li cadherin (liver-intestine) (CDH17, Accession NP_004054.2) is another GAM281 target gene, herein designated TARGET GENE. CDH17 BINDING SITE is a target binding site found in the 3' untranslated region of mRNA encoded by CDH17, corresponding to a target binding site such as BINDING SITE I, BINDING SITE II or BINDING SITE III of FIG. 8. Table 4 illustrates the complementarity of the nucleotide sequences of CDH17 BINDING SITE, designated SEQ ID:13851, to the nucleotide sequence of GAM281 RNA, herein designated GAM RNA, also designated SEQ ID:278.

Another function of GAM281 is therefore inhibition of Cadherin 17, li cadherin (liver-intestine) (CDH17, Accession NP_004054.2), a gene which may have a role in the morphological organization of liver and intestine and involved in intestinal peptide transport. Accordingly, utilities of GAM281 include diagnosis, prevention and treatment of diseases and clinical conditions associated with CDH17.

The function of CDH17 and its association with various diseases and clinical conditions, has been established by previous studies, as described hereinabove with reference to GAM161.1. CDK11 (Accession XP_166324.1) is another GAM281 target gene, herein designated TARGET GENE. CDK11 BINDING SITE is a target binding site found in the 3' untranslated region of multiple transcripts of mRNA encoded by CDK11, corresponding to a target binding site such as BINDING SITE I, BINDING SITE II or BINDING SITE III of FIG. 8. Table 4 illustrates the complementarity of the nucleotide sequences of CDK11 BINDING SITE, designated SEQ ID:8162, to the nucleotide sequence of GAM281 RNA, herein designated GAM RNA, also designated SEQ ID:278.

Another function of GAM281 is therefore inhibition of CDK11 (Accession XP_166324.1). Accordingly, utilities of GAM281 include diagnosis, prevention and treatment of diseases and clinical conditions associated with CDK11.

CDKAL1 (Accession NP_060244.1) is another GAM281 target gene, herein designated TARGET GENE. CDKAL1 BINDING SITE1 and CDKAL1 BINDING SITE2 are target binding sites found in untranslated regions of mRNA encoded by CDKAL1, corresponding to target binding sites such as BINDING SITE I, BINDING SITE II or BINDING SITE III of FIG. 8. Table 4 illustrates the complementarity of the nucleotide sequences of CDKAL1 BINDING SITE1 and CDKAL1 BINDING SITE2, designated SEQ ID:1255 and SEQ ID:3603 respectively, to the nucleotide sequence of GAM281 RNA, herein designated GAM RNA, also designated SEQ ID:278.

Another function of GAM281 is therefore inhibition of CDKAL1 (Accession NP_060244.1). Accordingly, utilities of GAM281 include diagnosis, prevention and treatment of diseases and clinical conditions associated with CDKAL1.

CDT6 (Accession NP_066969.1) is another GAM281 target gene, herein designated TARGET GENE. CDT6 BINDING SITE is a target binding site found in the 3' untranslated region of mRNA encoded by CDT6, corresponding to a target binding site such as BINDING SITE I, BINDING SITE II or BINDING SITE III of FIG. 8. Table 4 illustrates the complementarity of the nucleotide sequences of CDT6 BINDING SITE, designated SEQ ID:18500, to the nucleotide sequence of GAM281 RNA, herein designated GAM RNA, also designated SEQ ID:278.

Another function of GAM281 is therefore inhibition of CDT6 (Accession NP_066969.1). Accordingly, utilities of GAM281 include diagnosis, prevention and treatment of diseases and clinical conditions associated with CDT6.

Carcinoembryonic antigen-related cell adhesion molecule 8 (CEACAM8, Accession NP_001807.2) is another GAM281 target gene, herein designated TARGET GENE. CEACAM8 BINDING SITE is a target binding site found in the 3' untranslated region of mRNA encoded by CEACAM8, corresponding to a target binding site such as BINDING SITE I, BINDING SITE II or BINDING SITE III of FIG. 8. Table 4 illustrates the complementarity of the nucleotide sequences of CEACAM8 BINDING SITE, designated SEQ ID:17969, to the nucleotide sequence of GAM281 RNA, herein designated GAM RNA, also designated SEQ ID:278.

Another function of GAM281 is therefore inhibition of Carcinoembryonic antigen-related cell adhesion molecule 8 (CEACAM8, Accession NP_001807.2). Accordingly, utilities of GAM281 include diagnosis, prevention and treatment of diseases and clinical conditions associated with CEACAM8.

Cat eye syndrome chromosome region, candidate 1 (CECR1, Accession NP_059120.2) is another GAM281 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:9037 and SEQ ID:4574 respectively, to the nucleotide sequence of GAM281 RNA, herein designated GAM RNA, also designated SEQ ID:278.

Another function of GAM281 is therefore inhibition of Cat eye syndrome chromosome region, candidate 1 (CECR1, Accession NP_059120.2). Accordingly, utilities of GAM281 include diagnosis, prevention and treatment of diseases and clinical conditions associated with CECR1.

Cat eye syndrome chromosome region, candidate 1 (CECR1, Accession NP_803124.1) is another GAM281 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:4574 and SEQ ID:9037 respectively, to the nucleotide sequence of GAM281 RNA, herein designated GAM RNA, also designated SEQ ID:278.

Another function of GAM281 is therefore inhibition of Cat eye syndrome chromosome region, candidate 1 (CECR1, Accession NP_803124.1). Accordingly, utilities of GAM281 include diagnosis, prevention and treatment of diseases and clinical conditions associated with CECR1.

Centromere protein h (CENPH, Accession NP_075060.1) is another GAM281 target gene, herein designated TARGET GENE. CENPH BINDING SITE is a target binding site found in the 3' untranslated region of mRNA encoded by CENPH, corresponding to a target binding site such as BINDING SITE I, BINDING SITE II or BINDING SITE III of FIG. 8. Table 4 illustrates the complementarity of the nucleotide sequences of CENPH BINDING SITE, designated SEQ ID:19549, to the nucleotide sequence of GAM281 RNA, herein designated GAM RNA, also designated SEQ ID:278.

Another function of GAM281 is therefore inhibition of Centromere protein h (CENPH, Accession NP_075060.1). Accordingly, utilities of GAM281 include diagnosis, prevention and treatment of diseases and clinical conditions associated with CENPH.

Centromere protein j (CENPJ, Accession NP_060921.2) is another GAM281 target gene, herein designated TARGET GENE. CENPJ BINDING SITE is a target binding site found in the 5' untranslated region of mRNA encoded by CENPJ, corresponding to a target binding site such as BINDING SITE I, BINDING SITE II or BINDING SITE III of FIG. 8. Table 4 illustrates the complementarity of the nucleotide sequences of CENPJ BINDING SITE, designated SEQ ID:13565, to the nucleotide sequence of GAM281 RNA, herein designated GAM RNA, also designated SEQ ID:278.

Another function of GAM281 is therefore inhibition of Centromere protein j (CENPJ, Accession NP_060921.2). Accordingly, utilities of GAM281 include diagnosis, prevention and treatment of diseases and clinical conditions associated with CENPJ.

CGI-150 (Accession NP_057164.1) is another GAM281 target gene, herein designated TARGET GENE. CGI-150 BINDING SITE is a target binding site found in the 5' untranslated region of mRNA encoded by CGI-150, corresponding to a target binding site such as BINDING SITE I, BINDING SITE II or BINDING SITE III of FIG. 8. Table 4 illustrates the complementarity of the nucleotide sequences of CGI-150 BINDING SITE, designated SEQ ID:2191, to the nucleotide sequence of GAM281 RNA, herein designated GAM RNA, also designated SEQ ID:278.

Another function of GAM281 is therefore inhibition of CGI-150 (Accession NP_057164.1). Accordingly, utilities of GAM281 include diagnosis, prevention and treatment of diseases and clinical conditions associated with CGI-150.

CGI-43 (Accession NP_056437.1) is another GAM281 target gene, herein designated TARGET GENE. CGI-43 BINDING SITE is a target binding site found in the 3' untranslated region of mRNA encoded by CGI-43, corresponding to a target binding site such as BINDING SITE I, BINDING SITE II or BINDING SITE III of FIG. 8. Table 4 illustrates the complementarity of the nucleotide sequences of CGI-43 BINDING SITE, designated SEQ ID:14860, to the nucleotide sequence of GAM281 RNA, herein designated GAM RNA, also designated SEQ ID:278.

Another function of GAM281 is therefore inhibition of CGI-43 (Accession NP_056437.1). Accordingly, utilities of GAM281 include diagnosis, prevention and treatment of diseases and clinical conditions associated with CGI-43.

Chromodomain helicase dna binding protein 5 (CHD5, Accession NP_056372.1) is another GAM281 target gene, herein designated TARGET GENE. CHD5 BINDING SITE is a target binding site found in the 3' untranslated region of mRNA encoded by CHD5, corresponding to a target binding site such as BINDING SITE I, BINDING SITE II or BINDING SITE III of FIG. 8. Table 4 illustrates the complementarity of the nucleotide sequences of CHD5 BINDING SITE, designated SEQ ID:2568, to the nucleotide sequence of GAM281 RNA, herein designated GAM RNA, also designated SEQ ID:278.

Another function of GAM281 is therefore inhibition of Chromodomain helicase dna binding protein 5 (CHD5, Accession NP_056372.1). Accordingly, utilities of GAM281 include diagnosis, prevention and treatment of diseases and clinical conditions associated with CHD5.

Chromatin accessibility complex 1 (CHRAC1, Accession NP_059140.1) is another GAM281 target gene, herein designated TARGET GENE. CHRAC1 BINDING SITE is a target binding site found in the 3' untranslated region of mRNA encoded by CHRAC1, corresponding to a target binding site such as BINDING SITE I, BINDING SITE II or BINDING SITE III of FIG. 8. Table 4 illustrates the complementarity of the nucleotide sequences of CHRAC1 BINDING SITE, designated SEQ ID:9475, to the nucleotide sequence of GAM281 RNA, herein designated GAM RNA, also designated SEQ ID:278.

Another function of GAM281 is therefore inhibition of Chromatin accessibility complex 1 (CHRAC1, Accession NP_059140.1). Accordingly, utilities of GAM281 include diagnosis, prevention and treatment of diseases and clinical conditions associated with CHRAC1.

Carbohydrate (chondroitin) synthase 1 (CHSY1, Accession NP_055733.2) is another GAM281 target gene, herein designated TARGET GENE. CHSY1 BINDING SITE is a target binding site found in the 3' untranslated region of mRNA encoded by CHSY1, corresponding to a target binding site such as BINDING SITE I, BINDING SITE II or BINDING SITE III of FIG. 8. Table 4 illustrates the complementarity of the nucleotide sequences of CHSY1 BINDING SITE, designated SEQ ID:11924, to the nucleotide sequence of GAM281 RNA, herein designated GAM RNA, also designated SEQ ID:278.

Another function of GAM281 is therefore inhibition of Carbohydrate (chondroitin) synthase 1 (CHSY1, Accession NP_055733.2). Accordingly, utilities of GAM281 include diagnosis, prevention and treatment of diseases and clinical conditions associated with CHSY1.

Cold autoinflammatory syndrome 1 (CIAS1, Accession NP_004886.2) is another GAM281 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:13461, to the nucleotide sequence of GAM281 RNA, herein designated GAM RNA, also designated SEQ ID:278.

Another function of GAM281 is therefore inhibition of Cold autoinflammatory syndrome 1 (CIAS1, Accession NP_004886.2), a gene which may mediate protein-protein interactions; contains a leucine rich repeat and therefore may be associated with Familial cold autoinflammatory syndrome, muckle-wells syndrome. Accordingly, utilities of GAM281 include diagnosis, prevention and treatment of Familial cold autoinflammatory syndrome, muckle-wells syndrome, and of other diseases and clinical conditions associated with CIAS1.

The function of CIAS1 and its association with various diseases and clinical conditions, has been established by previous studies, as described hereinabove with reference to GAM90.1. CIP29 (Accession NP_115740.3) is another GAM281 target gene, herein designated TARGET GENE. CIP29 BINDING SITE1 and CIP29 BINDING SITE2 are target binding sites found in untranslated regions of mRNA encoded by CIP29, corresponding to target binding sites such as BINDING SITE I, BINDING SITE II or BINDING SITE III of FIG. 8. Table 4 illustrates the complementarity of the nucleotide sequences of CIP29 BINDING SITE1 and CIP29 BINDING SITE2, designated SEQ ID:3509 and SEQ ID:20120 respectively, to the nucleotide sequence of GAM281 RNA, herein designated GAM RNA, also designated SEQ ID:278.

Another function of GAM281 is therefore inhibition of CIP29 (Accession NP_115740.3). Accordingly, utilities of GAM281 include diagnosis, prevention and treatment of diseases and clinical conditions associated with CIP29.

Claudin 14 (CLDN14, Accession NP_652763.1) is another GAM281 target gene, herein designated TARGET GENE. CLDN14 BINDING SITE is a target binding site found in the 5' untranslated region of multiple transcripts of mRNA encoded by CLDN14, corresponding to a target binding site such as BINDING SITE I, BINDING SITE II or BINDING SITE III of FIG. 8. Table 4 illustrates the complementarity of the nucleotide sequences of CLDN14 BINDING SITE, designated SEQ ID:3558, to the nucleotide sequence of GAM281 RNA, herein designated GAM RNA, also designated SEQ ID:278.

Another function of GAM281 is therefore inhibition of Claudin 14 (CLDN14, Accession NP_652763.1), a gene which provides structural support for the auditory neuroepithelium. and therefore is associated with Deafness. Accordingly, utilities of GAM281 include diagnosis, prevention and treatment of Deafness, and of other diseases and clinical conditions associated with CLDN14.

The function of CLDN14 and its association with various diseases and clinical conditions, has been established by previous studies, as described hereinabove with reference to GAM94.1. C-type (calcium dependent, carbohydrate-recognition domain) lectin, superfamily member 12 (CLECSF12, Accession NP_072092.2) is another GAM281 target gene, herein designated TARGET GENE. CLECSF12 BINDING SITE1 and CLECSF12 BINDING SITE2 are target binding sites found in untranslated regions of mRNA encoded by CLECSF12, corresponding to target binding sites such as BINDING SITE I, BINDING SITE II or BINDING SITE III of FIG. 8. Table 4 illustrates the complementarity of the nucleotide sequences of CLECSF12 BINDING SITE1 and CLECSF12 BINDING SITE2, designated SEQ ID:16192 and SEQ ID:15296 respectively, to the nucleotide sequence of GAM281 RNA, herein designated GAM RNA, also designated SEQ ID:278.

Another function of GAM281 is therefore inhibition of C-type (calcium dependent, carbohydrate-recognition domain) lectin, superfamily member 12 (CLECSF12, Accession NP_072092.2), a gene which is a pattern- recognition receptor . Accordingly, utilities of GAM281 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. Chloride intracellular channel 5 (CLIC5, Accession NP_058625.1) is another GAM281 target gene, herein designated TARGET GENE. CLIC5 BINDING SITE is a target binding site found in the 5' untranslated region of mRNA encoded by CLIC5, corresponding to a target binding site such as BINDING SITE I, BINDING SITE II or BINDING SITE III of FIG. 8. Table 4 illustrates the complementarity of the nucleotide sequences of CLIC5 BINDING SITE, designated SEQ ID:19116, to the nucleotide sequence of GAM281 RNA, herein designated GAM RNA, also designated SEQ ID:278.

Another function of GAM281 is therefore inhibition of Chloride intracellular channel 5 (CLIC5, Accession NP_058625.1). Accordingly, utilities of GAM281 include diagnosis, prevention and treatment of diseases and clinical conditions associated with CLIC5.

Ceroid-lipofuscinosis, neuronal 6, late infantile, variant (CLN6, Accession NP_060352.1) is another GAM281 target gene, herein designated TARGET GENE. CLN6 BINDING SITE is a target binding site found in the 3' untranslated region of mRNA encoded by CLN6, corresponding to a target binding site such as BINDING SITE I, BINDING SITE II or BINDING SITE III of FIG. 8. Table 4 illustrates the complementarity of the nucleotide sequences of CLN6 BINDING SITE, designated SEQ ID:19830, to the nucleotide sequence of GAM281 RNA, herein designated GAM RNA, also designated SEQ ID:278.

Another function of GAM281 is therefore inhibition of Ceroid-lipofuscinosis, neuronal 6, late infantile, variant (CLN6, Accession NP_060352.1). Accordingly, utilities of GAM281 include diagnosis, prevention and treatment of diseases and clinical conditions associated with CLN6.

Ceroid-lipofuscinosis, neuronal 8 (epilepsy, progressive with mental retardation) (CLN8, Accession NP_061764.2) is another GAM281 target gene, herein designated TARGET GENE. CLN8 BINDING SITE is a target binding site found in the 3' untranslated region of mRNA encoded by CLN8, corresponding to a target binding site such as BINDING SITE I, BINDING SITE II or BINDING SITE III of FIG. 8. Table 4 illustrates the complementarity of the nucleotide sequences of CLN8 BINDING SITE, designated SEQ ID:515, to the nucleotide sequence of GAM281 RNA, herein designated GAM RNA, also designated SEQ ID:278.

Another function of GAM281 is therefore inhibition of Ceroid-lipofuscinosis, neuronal 8 (epilepsy, progressive with mental retardation) (CLN8, Accession NP_061764.2). Accordingly, utilities of GAM281 include diagnosis, prevention and treatment of diseases and clinical conditions associated with CLN8.

Cell matrix adhesion regulator (CMAR, Accession NP_005191.2) is another GAM281 target gene, herein designated TARGET GENE. CMAR BINDING SITE1 and CMAR BINDING SITE2 are target binding sites found in untranslated regions of mRNA encoded by CMAR, corresponding to target binding sites such as BINDING SITE I, BINDING SITE II or BINDING SITE III of FIG. 8. Table 4 illustrates the complementarity of the nucleotide sequences of CMAR BINDING SITE1 and CMAR BINDING SITE2, designated SEQ ID:5053 and SEQ ID:18767 respectively, to the nucleotide sequence of GAM281 RNA, herein designated GAM RNA, also designated SEQ ID:278.

Another function of GAM281 is therefore inhibition of Cell matrix adhesion regulator (CMAR, Accession NP_005191.2). Accordingly, utilities of GAM281 include diagnosis, prevention and treatment of diseases and clinical conditions associated with CMAR.

Calponin 2 (CNN2, Accession NP_004359.1) is another GAM281 target gene, herein designated TARGET GENE. CNN2 BINDING SITE is a target binding site found in the 3' untranslated region of mRNA encoded by CNN2, corresponding to a target binding site such as BINDING SITE I, BINDING SITE II or BINDING SITE III of FIG. 8. Table 4 illustrates the complementarity of the nucleotide sequences of CNN2 BINDING SITE, designated SEQ ID:9959, to the nucleotide sequence of GAM281 RNA, herein designated GAM RNA, also designated SEQ ID:278.

Another function of GAM281 is therefore inhibition of Calponin 2 (CNN2, Accession NP_004359.1), a gene which may be involved in the structural organization and/or anchorage of actin filaments. Accordingly, utilities of GAM281 include diagnosis, prevention and treatment of diseases and clinical conditions associated with CNN2.

The function of CNN2 and its association with various diseases and clinical conditions, has been established by previous studies, as described hereinabove with reference to GAM136.1.2',3'-cyclic nucleotide 3' phosphodiesterase (CNP, Accession NP_149124.1) is another GAM281 target gene, herein designated TARGET GENE. CNP BINDING SITE is a target binding site found in the 3' untranslated region of mRNA encoded by CNP, corresponding to a target binding site such as BINDING SITE I, BINDING SITE II or BINDING SITE III of FIG. 8. Table 4 illustrates the complementarity of the nucleotide sequences of CNP BINDING SITE, designated SEQ ID:606, to the nucleotide sequence of GAM281 RNA, herein designated GAM RNA, also designated SEQ ID:278.

Another function of GAM281 is therefore inhibition of 2',3'-cyclic nucleotide 3' phosphodiesterase (CNP, Accession NP_149124.1), a gene which can link tubulin to membranes and may regulate cytoplasmic microtubule distribution. Accordingly, utilities of GAM281 include diagnosis, prevention and treatment of diseases and clinical conditions associated with CNP.

The function of CNP and its association with various diseases and clinical conditions, has been established by previous studies, as described hereinabove with reference to GAM189.1. Collagen, type iv, alpha 4 (COL4A4, Accession NP_000083.1) is another GAM281 target gene, herein designated TARGET GENE. COL4A4 BINDING SITE is a target binding site found in the 5' untranslated region of mRNA encoded by COL4A4, corresponding to a target binding site such as BINDING SITE I, BINDING SITE II or BINDING SITE III of FIG. 8. Table 4 illustrates the complementarity of the nucleotide sequences of COL4A4 BINDING SITE, designated SEQ ID:12506, to the nucleotide sequence of GAM281 RNA, herein designated GAM RNA, also designated SEQ ID:278.

Another function of GAM281 is therefore inhibition of Collagen, type iv, alpha 4 (COL4A4, Accession NP_000083.1). Accordingly, utilities of GAM281 include diagnosis, prevention and treatment of diseases and clinical conditions associated with COL4A4.

Collectin sub-family member 12 (COLEC12, Accession NP_110408.2) is another GAM281 target gene, herein designated TARGET GENE. COLEC12 BINDING SITE1 and COLEC12 BINDING SITE2 are target binding sites found in untranslated regions of multiple transcripts of mRNA encoded by COLEC12, corresponding to target binding sites such as BINDING SITE I, BINDING SITE II or BINDING SITE III of FIG. 8. Table 4 illustrates the complementarity of the nucleotide sequences of COLEC12 BINDING SITE1 and COLEC12 BINDING SITE2, designated SEQ ID:12507 and SEQ ID:11525 respectively, to the nucleotide sequence of GAM281 RNA, herein designated GAM RNA, also designated SEQ ID:278.

Another function of GAM281 is therefore inhibition of Collectin sub-family member 12 (COLEC12, Accession NP_110408.2). Accordingly, utilities of GAM281 include diagnosis, prevention and treatment of diseases and clinical conditions associated with COLEC12.

COQ4 (Accession NP_057119.1) is another GAM281 target gene, herein designated TARGET GENE. COQ4 BINDING SITE is a target binding site found in the 3' untranslated region of mRNA encoded by COQ4, corresponding to a target binding site such as BINDING SITE I, BINDING SITE II or BINDING SITE III of FIG. 8. Table 4 illustrates the complementarity of the nucleotide sequences of COQ4 BINDING SITE, designated SEQ ID:14708, to the nucleotide sequence of GAM281 RNA, herein designated GAM RNA, also designated SEQ ID:278.

Another function of GAM281 is therefore inhibition of COQ4 (Accession NP_057119.1). Accordingly, utilities of GAM281 include diagnosis, prevention and treatment of diseases and clinical conditions associated with COQ4.

Coronin, actin binding protein, 1c (CORO1C, Accession NP_055140.1) is another GAM281 target gene, herein designated TARGET GENE. CORO1C BINDING SITE is a target binding site found in the 3' untranslated region of mRNA encoded by CORO1C, corresponding to a target binding site such as BINDING SITE I, BINDING SITE II or BINDING SITE III of FIG. 8. Table 4 illustrates the complementarity of the nucleotide sequences of CORO1C BINDING SITE, designated SEQ ID:13595, to the nucleotide sequence of GAM281 RNA, herein designated GAM RNA, also designated SEQ ID:278.

Another function of GAM281 is therefore inhibition of Coronin, actin binding protein, 1c (CORO1C, Accession NP_055140.1). Accordingly, utilities of GAM281 include diagnosis, prevention and treatment of diseases and clinical conditions associated with CORO1C.

Cox15 homolog, cytochrome c oxidase assembly protein (yeast) (COX15, Accession NP_510870.1) is another GAM281 target gene, herein designated TARGET GENE. COX15 BINDING SITE is a target binding site found in the 3' untranslated region of multiple transcripts of mRNA encoded by COX15, corresponding to a target binding site such as BINDING SITE I, BINDING SITE II or BINDING SITE III of FIG. 8. Table 4 illustrates the complementarity of the nucleotide sequences of COX15 BINDING SITE, designated SEQ ID:7552, to the nucleotide sequence of GAM281 RNA, herein designated GAM RNA, also designated SEQ ID:278.

Another function of GAM281 is therefore inhibition of Cox15 homolog, cytochrome c oxidase assembly protein (yeast) (COX15, Accession NP_510870.1). Accordingly, utilities of GAM281 include diagnosis, prevention and treatment of diseases and clinical conditions associated with COX15.

Carboxypeptidase a4 (CPA4, Accession NP_057436.1) is another GAM281 target gene, herein designated TARGET GENE. CPA4 BINDING SITE is a target binding site found in the 3' untranslated region of mRNA encoded by CPA4, corresponding to a target binding site such as BINDING SITE I, BINDING SITE II or BINDING SITE III of FIG. 8. Table 4 illustrates the complementarity of the nucleotide sequences of CPA4 BINDING SITE, designated SEQ ID:8942, to the nucleotide sequence of GAM281 RNA, herein designated GAM RNA, also designated SEQ ID:278.

Another function of GAM281 is therefore inhibition of Carboxypeptidase a4 (CPA4, Accession NP_057436.1). Accordingly, utilities of GAM281 include diagnosis, prevention and treatment of diseases and clinical conditions associated with CPA4.

CPR8 (Accession NP_065790.1) is another GAM281 target gene, herein designated TARGET GENE. CPR8 BINDING SITE is a target binding site found in the 3' untranslated region of multiple transcripts of mRNA encoded by CPR8, corresponding to a target binding site such as BINDING SITE I, BINDING SITE II or BINDING SITE III of FIG. 8. Table 4 illustrates the complementarity of the nucleotide sequences of CPR8 BINDING SITE, designated SEQ ID:13999, to the nucleotide sequence of GAM281 RNA, herein designated GAM RNA, also designated SEQ ID:278.

Another function of GAM281 is therefore inhibition of CPR8 (Accession NP_065790.1). Accordingly, utilities of GAM281 include diagnosis, prevention and treatment of diseases and clinical conditions associated with CPR8.

Carbamoyl-phosphate synthetase 1, mitochondrial (CPS1, Accession NP_001866.2) is another GAM281 target gene, herein designated TARGET GENE. CPS1 BINDING SITE is a target binding site found in the 3' untranslated region of mRNA encoded by CPS1, corresponding to a target binding site such as BINDING SITE I, BINDING SITE II or BINDING SITE III of FIG. 8. Table 4 illustrates the complementarity of the nucleotide sequences of CPS1 BINDING SITE, designated SEQ ID:14493, to the nucleotide sequence of GAM281 RNA, herein designated GAM RNA, also designated SEQ ID:278.

Another function of GAM281 is therefore inhibition of Carbamoyl-phosphate synthetase 1, mitochondrial (CPS1, Accession NP_001866.2). Accordingly, utilities of GAM281 include diagnosis, prevention and treatment of diseases and clinical conditions associated with CPS1.

Cleavage and polyadenylation specific factor 2, 100 kda (CPSF2, Accession XP_029311.2) is another GAM281 target gene, herein designated TARGET GENE. CPSF2 BINDING SITE1 and CPSF2 BINDING SITE2 are target binding sites found in untranslated regions of mRNA encoded by CPSF2, corresponding to target binding sites such as BINDING SITE I, BINDING SITE II or BINDING SITE III of FIG. 8. Table 4 illustrates the complementarity of the nucleotide sequences of CPSF2 BINDING SITE1 and CPSF2 BINDING SITE2, designated SEQ ID:591 and SEQ ID:1877 respectively, to the nucleotide sequence of GAM281 RNA, herein designated GAM RNA, also designated SEQ ID:278.

Another function of GAM281 is therefore inhibition of Cleavage and polyadenylation specific factor 2, 100 kda (CPSF2, Accession XP_029311.2). Accordingly, utilities of GAM281 include diagnosis, prevention and treatment of diseases and clinical conditions associated with CPSF2.

Complement component (3b/4b) receptor 1, including knops blood group system (CR1, Accession NP_000642.2) is another GAM281 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:17292, to the nucleotide sequence of GAM281 RNA, herein designated GAM RNA, also designated SEQ ID:278.

Another function of GAM281 is therefore inhibition of Complement component (3b/4b) receptor 1, including knops blood group system (CR1, Accession NP_000642.2). Accordingly, utilities of GAM281 include diagnosis, prevention and treatment of diseases and clinical conditions associated with CR1.

Complement component (3b/4b) receptor 1, including knops blood group system (CR1, Accession NP_000564.1) is another GAM281 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:17292, to the nucleotide sequence of GAM281 RNA, herein designated GAM RNA, also designated SEQ ID:278.

Another function of GAM281 is therefore inhibition of Complement component (3b/4b) receptor 1, including knops blood group system (CR1, Accession NP_000564.1). Accordingly, utilities of GAM281 include diagnosis, prevention and treatment of diseases and clinical conditions associated with CR1.

Cytokine receptor-like factor 3 (CRLF3, Accession NP_057070.2) is another GAM281 target gene, herein designated TARGET GENE. CRLF3 BINDING SITE is a target binding site found in the 3' untranslated region of mRNA encoded by CRLF3, corresponding to a target binding site such as BINDING SITE I, BINDING SITE II or BINDING SITE III of FIG. 8. Table 4 illustrates the complementarity of the nucleotide sequences of CRLF3 BINDING SITE, designated SEQ ID:7105, to the nucleotide sequence of GAM281 RNA, herein designated GAM RNA, also designated SEQ ID:278.

Another function of GAM281 is therefore inhibition of Cytokine receptor-like factor 3 (CRLF3, Accession NP_057070.2). Accordingly, utilities of GAM281 include diagnosis, prevention and treatment of diseases and clinical conditions associated with CRLF3.

Cofactor required for sp1 transcriptional activation, subunit 6, 77 kda (CRSP6, Accession NP_004259.3) is another GAM281 target gene, herein designated TARGET GENE. CRSP6 BINDING SITE is a target binding site found in the 3' untranslated region of mRNA encoded by CRSP6, corresponding to a target binding site such as BINDING SITE I, BINDING SITE II or BINDING SITE III of FIG. 8. Table 4 illustrates the complementarity of the nucleotide sequences of CRSP6 BINDING SITE, designated SEQ ID:7661, to the nucleotide sequence of GAM281 RNA, herein designated GAM RNA, also designated SEQ ID:278.

Another function of GAM281 is therefore inhibition of Cofactor required for sp1 transcriptional activation, subunit 6, 77 kda (CRSP6, Accession NP_004259.3), a gene which is required for Sp1 mediated transcriptional activation with TAF (II)s. Accordingly, utilities of GAM281 include diagnosis, prevention and treatment of diseases and clinical conditions associated with CRSP6.

The function of CRSP6 and its association with various diseases and clinical conditions, has been established by previous studies, as described hereinabove with reference to GAM189.1. Cartilage associated protein (CRTAP, Accession NP_006362.1) is another GAM281 target gene, herein designated TARGET GENE. CRTAP BINDING SITE is a target binding site found in the 3' untranslated region of mRNA encoded by CRTAP, corresponding to a target binding site such as BINDING SITE I, BINDING SITE II or BINDING SITE III of FIG. 8. Table 4 illustrates the complementarity of the nucleotide sequences of CRTAP BINDING SITE, designated SEQ ID:7107, to the nucleotide sequence of GAM281 RNA, herein designated GAM RNA, also designated SEQ ID:278.

Another function of GAM281 is therefore inhibition of Cartilage associated protein (CRTAP, Accession NP_006362.1), a gene which is a novel developmentally regulated chick embryo protein. Accordingly, utilities of GAM281 include diagnosis, prevention and treatment of diseases and clinical conditions associated with CRTAP.

The function of CRTAP and its association with various diseases and clinical conditions, has been established by previous studies, as described hereinabove with reference to GAM136.1. Cysteine sulfinic acid decarboxylase (CSAD, Accession NP_057073.2) is another GAM281 target gene, herein designated TARGET GENE. CSAD BINDING SITE is a target binding site found in the 3' untranslated region of mRNA encoded by CSAD, corresponding to a target binding site such as BINDING SITE I, BINDING SITE II or BINDING SITE III of FIG. 8. Table 4 illustrates the complementarity of the nucleotide sequences of CSAD BINDING SITE, designated SEQ ID:7030, to the nucleotide sequence of GAM281 RNA, herein designated GAM RNA, also designated SEQ ID:278.

Another function of GAM281 is therefore inhibition of Cysteine sulfinic acid decarboxylase (CSAD, Accession NP_057073.2). Accordingly, utilities of GAM281 include diagnosis, prevention and treatment of diseases and clinical conditions associated with CSAD.

CSE-C (Accession NP_061851.1) is another GAM281 target gene, herein designated TARGET GENE. CSE-C BINDING SITE is a target binding site found in the 5' untranslated region of multiple transcripts of mRNA encoded by CSE-C, corresponding to a target binding site such as BINDING SITE I, BINDING SITE II or BINDING SITE III of FIG. 8. Table 4 illustrates the complementarity of the nucleotide sequences of CSE-C BINDING SITE, designated SEQ ID:2336, to the nucleotide sequence of GAM281 RNA, herein designated GAM RNA, also designated SEQ ID:278.

Another function of GAM281 is therefore inhibition of CSE-C (Accession NP_061851.1). Accordingly, utilities of GAM281 include diagnosis, prevention and treatment of diseases and clinical conditions associated with CSE-C.

Cse1 chromosome segregation 1-like (yeast) (CSE1L, Accession NP_803185.1) is another GAM281 target gene, herein designated TARGET GENE. CSE1L BINDING SITE is a target binding site found in the 3' untranslated region of multiple transcripts of mRNA encoded by CSE1L, corresponding to a target binding site such as BINDING SITE I, BINDING SITE II or BINDING SITE III of FIG. 8. Table 4 illustrates the complementarity of the nucleotide sequences of CSE1L BINDING SITE, designated SEQ ID:6312, to the nucleotide sequence of GAM281 RNA, herein designated GAM RNA, also designated SEQ ID:278.

Another function of GAM281 is therefore inhibition of Cse1 chromosome segregation 1-like (yeast) (CSE1L, Accession NP_803185.1). Accordingly, utilities of GAM281 include diagnosis, prevention and treatment of diseases and clinical conditions associated with CSE1L.

Casein kinase 1, gamma 2 (CSNK1G2, Accession NP_001310.2) is another GAM281 target gene, herein designated TARGET GENE. CSNK1G2 BINDING SITE is a target binding site found in the 3' untranslated region of mRNA encoded by CSNK1G2, corresponding to a target binding site such as BINDING SITE I, BINDING SITE II or BINDING SITE III of FIG. 8. Table 4 illustrates the complementarity of the nucleotide sequences of CSNK1G2 BINDING SITE, designated SEQ ID:14869, to the nucleotide sequence of GAM281 RNA, herein designated GAM RNA, also designated SEQ ID:278.

Another function of GAM281 is therefore inhibition of Casein kinase 1, gamma 2 (CSNK1G2, Accession NP_001310.2). Accordingly, utilities of GAM281 include diagnosis, prevention and treatment of diseases and clinical conditions associated with CSNK1G2.

Casein kinase 2, alpha prime polypeptide (CSNK2A2, Accession NP_001887.1) is another GAM281 target gene, herein designated TARGET GENE. CSNK2A2 BINDING SITE is a target binding site found in the 5' untranslated region of mRNA encoded by CSNK2A2, corresponding to a target binding site such as BINDING SITE I, BINDING SITE II or BINDING SITE III of FIG. 8. Table 4 illustrates the complementarity of the nucleotide sequences of CSNK2A2 BINDING SITE, designated SEQ ID:15382, to the nucleotide sequence of GAM281 RNA, herein designated GAM RNA, also designated SEQ ID:278.

Another function of GAM281 is therefore inhibition of Casein kinase 2, alpha prime polypeptide (CSNK2A2, Accession NP_001887.1), a gene which catalyzes the phosphorylation of serine or threonine residues in proteins. Accordingly, utilities of GAM281 include diagnosis, prevention and treatment of diseases and clinical conditions associated with CSNK2A2.

The function of CSNK2A2 and its association with various diseases and clinical conditions, has been established by previous studies, as described hereinabove with reference to GAM189.1. CST (Accession NP_004852.1) is another GAM281 target gene, herein designated TARGET GENE. CST BINDING SITE is a target binding site found in the 5' untranslated region of mRNA encoded by CST, corresponding to a target binding site such as BINDING SITE I, BINDING SITE II or BINDING SITE III of FIG. 8. Table 4 illustrates the complementarity of the nucleotide sequences of CST BINDING SITE, designated SEQ ID:9756, to the nucleotide sequence of GAM281 RNA, herein designated GAM RNA, also designated SEQ ID:278.

Another function of GAM281 is therefore inhibition of CST (Accession NP_004852.1), a gene which nucleotide-sugar transporter. Accordingly, utilities of GAM281 include diagnosis, prevention and treatment of diseases and clinical conditions associated with CST.

The function of CST and its association with various diseases and clinical conditions, has been established by previous studies, as described hereinabove with reference to GAM221.1. CTEN (Accession NP_116254.3) is another GAM281 target gene, herein designated TARGET GENE. CTEN BINDING SITE is a target binding site found in the 3' untranslated region of mRNA encoded by CTEN, corresponding to a target binding site such as BINDING SITE I, BINDING SITE II or BINDING SITE III of FIG. 8. Table 4 illustrates the complementarity of the nucleotide sequences of CTEN BINDING SITE, designated SEQ ID:14746, to the nucleotide sequence of GAM281 RNA, herein designated GAM RNA, also designated SEQ ID:278.

Another function of GAM281 is therefore inhibition of CTEN (Accession NP_116254.3). Accordingly, utilities of GAM281 include diagnosis, prevention and treatment of diseases and clinical conditions associated with CTEN.

Cardiotrophin 1 (CTF1, Accession NP_001321.1) is another GAM281 target gene, herein designated TARGET GENE. CTF1 BINDING SITE is a target binding site found in the 3' untranslated region of mRNA encoded by CTF1, corresponding to a target binding site such as BINDING SITE I, BINDING SITE II or BINDING SITE III of FIG. 8. Table 4 illustrates the complementarity of the nucleotide sequences of CTF1 BINDING SITE, designated SEQ ID:13287, to the nucleotide sequence of GAM281 RNA, herein designated GAM RNA, also designated SEQ ID:278.

Another function of GAM281 is therefore inhibition of Cardiotrophin 1 (CTF1, Accession NP_001321.1), a gene which may play a role in cardiac hypertrophy. and therefore may be associated with Cardiac hypertrophy. Accordingly, utilities of GAM281 include diagnosis, prevention and treatment of Cardiac hypertrophy, and of other diseases and clinical conditions associated with CTF1.

The function of CTF1 and its association with various diseases and clinical conditions, has been established by previous studies, as described hereinabove with reference to GAM189.1. Cathepsin b (CTSB, Accession NP_680090.1) is another GAM281 target gene, herein designated TARGET GENE. CTSB BINDING SITE is a target binding site found in the 5' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:12465, to the nucleotide sequence of GAM281 RNA, herein designated GAM RNA, also designated SEQ ID:278.

Another function of GAM281 is therefore inhibition of Cathepsin b (CTSB, Accession NP_680090.1). Accordingly, utilities of GAM281 include diagnosis, prevention and treatment of diseases and clinical conditions associated with CTSB.

Cathepsin b (CTSB, Accession NP_680092.1) is another GAM281 target gene, herein designated TARGET GENE. CTSB BINDING SITE is a target binding site found in the 5' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:12465, to the nucleotide sequence of GAM281 RNA, herein designated GAM RNA, also designated SEQ ID:278.

Another function of GAM281 is therefore inhibition of Cathepsin b (CTSB, Accession NP_680092.1). Accordingly, utilities of GAM281 include diagnosis, prevention and treatment of diseases and clinical conditions associated with CTSB.

Cathepsin s (CTSS, Accession NP_004070.3) is another GAM281 target gene, herein designated TARGET GENE. CTSS BINDING SITE is a target binding site found in the 3' untranslated region of mRNA encoded by CTSS, corresponding to a target binding site such as BINDING SITE I, BINDING SITE II or BINDING SITE III of FIG. 8. Table 4 illustrates the complementarity of the nucleotide sequences of CTSS BINDING SITE, designated SEQ ID:4517, to the nucleotide sequence of GAM281 RNA, herein designated GAM RNA, also designated SEQ ID:278.

Another function of GAM281 is therefore inhibition of Cathepsin s (CTSS, Accession NP_004070.3), a gene which is a lysosomal cysteine (thiol) protease that cleaves elastin. Accordingly, utilities of GAM281 include diagnosis, prevention and treatment of diseases and clinical conditions associated with CTSS.

The function of CTSS and its association with various diseases and clinical conditions, has been established by previous studies, as described hereinabove with reference to GAM72.1. Chemokine (c-x-c motif) ligand 16 (CXCL16, Accession NP_071342.1) is another GAM281 target gene, herein designated TARGET GENE. CXCL16 BINDING SITE is a target binding site found in the 3' untranslated region of mRNA encoded by CXCL16, corresponding to a target binding site such as BINDING SITE I, BINDING SITE II or BINDING SITE III of FIG. 8. Table 4 illustrates the complementarity of the nucleotide sequences of CXCL16 BINDING SITE, designated SEQ ID:17688, to the nucleotide sequence of GAM281 RNA, herein designated GAM RNA, also designated SEQ ID:278.

Another function of GAM281 is therefore inhibition of Chemokine (c-x-c motif) ligand 16 (CXCL16, Accession NP_071342.1), a gene which induces calcium mobilization. Accordingly, utilities of GAM281 include diagnosis, prevention and treatment of diseases and clinical conditions associated with CXCL16.

The function of CXCL16 and its association with various diseases and clinical conditions, has been established by previous studies, as described hereinabove with reference to GAM189.1. Chemokine (c-x-c motif) ligand 6 (granulocyte chemotactic protein 2) (CXCL6, Accession NP_002984.1) is another GAM281 target gene, herein designated TARGET GENE. CXCL6 BINDING SITE is a target binding site found in the 3' untranslated region of mRNA encoded by CXCL6, corresponding to a target binding site such as BINDING SITE I, BINDING SITE II or BINDING SITE III of FIG. 8. Table 4 illustrates the complementarity of the nucleotide sequences of CXCL6 BINDING SITE, designated SEQ ID:4626, to the nucleotide sequence of GAM281 RNA, herein designated GAM RNA, also designated SEQ ID:278.

Another function of GAM281 is therefore inhibition of Chemokine (c-x-c motif) ligand 6 (granulocyte chemotactic protein 2) (CXCL6, Accession NP_002984.1), a gene which is chemotactic for neutrophil granulocytes. Accordingly, utilities of GAM281 include diagnosis, prevention and treatment of diseases and clinical conditions associated with CXCL6.

The function of CXCL6 has been established by previous studies. Rovai et al. (1997) cloned the human GCP2 gene, as well as epithelial cell-derived neutrophil-activating peptide- 78 (ENA78, or SCYB5; 600324). Both coding and noncoding portions of the GCP2 gene share very high nucleotide similarity to ENA78, except for the occurrence of a long interspersed sequence 5-prime of the GCP2 gene. The GCP2 gene encodes a propeptide of 114 amino acids. Despite 85% identity of the first 270 nucleotides 5-prime of the transcription start sites, GCP2 and the other CXC chemokine gene ENA78 showed cell-specific differences in regulation. Wuyts et al. (1997) synthesized and purified a human GCP2 protein of 75 amino acids. In vitro, synthetic GCP2 was an equally active chemoattractant for neutrophilic granulocytes as was natural 75-amino acid GCP2. Synthetic GCP2 did not stimulate eosinophil, monocyte, or lymphocyte chemotaxis. The authors showed that GCP2 binds to the chemokine receptors CXCR1 and CXCR2. In vivo studies in rabbit demonstrated that GCP2 is a potent inflammatory mediator.

Full details of the abovementioned studies are described in the following publications, the disclosure of which are hereby incorporated by reference:

Rovai, L. E.; Herschman, H. R.; Smith, J. B.: Cloning and characterization of the human granulocyte chemotactic protein-2 gene. J. Immun. 158:5257-5266, 1997; and Wuyts, A.; van Osselaer, N.; Haelens, A.; Samson, I.; Herdewijn, P.; Ben-Baruch, A.; Oppenheim, J. J.; Proost, P.; van Damme, J.: Characterization of synthetic human granulocyte chemot.

Further studies establishing the function and utilities of CXCL6 are found in John Hopkins OMIM database record ID 138965, and in cited publications listed in Table 5, which are hereby incorporated by reference. Chromosome x open reading frame 12 (CXorf12, Accession NP_003483.1) is another GAM281 target gene, herein designated TARGET GENE. CXorf12 BINDING SITE is a target binding site found in the 3' untranslated region of mRNA encoded by CXorf12, corresponding to a target binding site such as BINDING SITE I, BINDING SITE II or BINDING SITE III of FIG. 8. Table 4 illustrates the complementarity of the nucleotide sequences of CXorf12 BINDING SITE, designated SEQ ID:4704, to the nucleotide sequence of GAM281 RNA, herein designated GAM RNA, also designated SEQ ID:278.

Another function of GAM281 is therefore inhibition of Chromosome x open reading frame 12 (CXorf12, Accession NP_003483.1). Accordingly, utilities of GAM281 include diagnosis, prevention and treatment of diseases and clinical conditions associated with CXorf12.

CYCS (Accession NP_061820.1) is another GAM281 target gene, herein designated TARGET GENE. CYCS BINDING SITE1 through CYCS BINDING SITE3 are target binding sites found in untranslated regions of mRNA encoded by CYCS, corresponding to target binding sites such as BINDING SITE I, BINDING SITE II or BINDING SITE III of FIG. 8. Table 4 illustrates the complementarity of the nucleotide sequences of CYCS BINDING SITE1 through CYCS BINDING SITE3, designated SEQ ID:18868, SEQ ID:18991 and SEQ ID:9339 respectively, to the nucleotide sequence of GAM281 RNA, herein designated GAM RNA, also designated SEQ ID:278.

Another function of GAM281 is therefore inhibition of CYCS (Accession NP_061820.1). Accordingly, utilities of GAM281 include diagnosis, prevention and treatment of diseases and clinical conditions associated with CYCS.

Cylicin, basic protein of sperm head cytoskeleton 2 (CYLC2, Accession NP_001331.1) is another GAM281 target gene, herein designated TARGET GENE. CYLC2 BINDING SITE is a target binding site found in the 3' untranslated region of mRNA encoded by CYLC2, corresponding to a target binding site such as BINDING SITE I, BINDING SITE II or BINDING SITE III of FIG. 8. Table 4 illustrates the complementarity of the nucleotide sequences of CYLC2 BINDING SITE, designated SEQ ID:15540, to the nucleotide sequence of GAM281 RNA, herein designated GAM RNA, also designated SEQ ID:278.

Another function of GAM281 is therefore inhibition of Cylicin, basic protein of sperm head cytoskeleton 2 (CYLC2, Accession NP_001331.1). Accordingly, utilities of GAM281 include diagnosis, prevention and treatment of diseases and clinical conditions associated with CYLC2.

Cytochrome p450, subfamily i (aromatic compound-inducible), polypeptide 2 (CYP1A2, Accession NP_000752.1) is another GAM281 target gene, herein designated TARGET GENE. CYP1A2 BINDING SITE1 through CYP1A2 BINDING SITE3 are target binding sites found in untranslated regions of mRNA encoded by CYP1A2, corresponding to target binding sites such as BINDING SITE I, BINDING SITE II or BINDING SITE III of FIG. 8. Table 4 illustrates the complementarity of the nucleotide sequences of CYP1A2 BINDING SITE1 through CYP1A2 BINDING SITE3, designated SEQ ID:18279, SEQ ID:6637 and SEQ ID:13576 respectively, to the nucleotide sequence of GAM281 RNA, herein designated GAM RNA, also designated SEQ ID:278.

Another function of GAM281 is therefore inhibition of Cytochrome p450, subfamily i (aromatic compound-inducible), polypeptide 2 (CYP1A2, Accession NP_000752.1), a gene which intervenes in an NADPH-dependent electron transport pathway. and therefore may be associated with Porphyria cutanea tarda. Accordingly, utilities of GAM281 include diagnosis, prevention and treatment of Porphyria cutanea tarda, and of other diseases and clinical conditions associated with CYP1A2.

The function of CYP1A2 and its association with various diseases and clinical conditions, has been established by previous studies, as described hereinabove with reference to GAM30.1. Cytochrome p450, subfamily iib (phenobarbital-inducible), polypeptide 6 (CYP2B6, Accession NP_000758.1) is another GAM281 target gene, herein designated TARGET GENE. CYP2B6 BINDING SITE1 and CYP2B6 BINDING SITE2 are target binding sites found in untranslated regions of mRNA encoded by CYP2B6, corresponding to target binding sites such as BINDING SITE I, BINDING SITE II or BINDING SITE III of FIG. 8. Table 4 illustrates the complementarity of the nucleotide sequences of CYP2B6 BINDING SITE1 and CYP2B6 BINDING SITE2, designated SEQ ID:10618 and SEQ ID:2194 respectively, to the nucleotide sequence of GAM281 RNA, herein designated GAM RNA, also designated SEQ ID:278.

Another function of GAM281 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM281 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. Cytochrome p450, subfamily ivf, polypeptide 3 (leukotriene b4 omega hydroxylase) (CYP4F3, Accession NP_000887.1) is another GAM281 target gene, herein designated TARGET GENE. CYP4F3 BINDING SITE is a target binding site found in the 3' untranslated region of mRNA encoded by CYP4F3, corresponding to a target binding site such as BINDING SITE I, BINDING SITE II or BINDING SITE III of FIG. 8. Table 4 illustrates the complementarity of the nucleotide sequences of CYP4F3 BINDING SITE, designated SEQ ID:9158, to the nucleotide sequence of GAM281 RNA, herein designated GAM RNA, also designated SEQ ID:278.

Another function of GAM281 is therefore inhibition of Cytochrome p450, subfamily ivf, polypeptide 3 (leukotriene b4 omega hydroxylase) (CYP4F3, Accession NP_000887.1), a gene which converts leukotriene B4 into the less active 20-hydroxy-leukotriene B4. Accordingly, utilities of GAM281 include diagnosis, prevention and treatment of diseases and clinical conditions associated with CYP4F3.

The function of CYP4F3 and its association with various diseases and clinical conditions, has been established by previous studies, as described hereinabove with reference to GAM67.1. CYP51A1 (Accession NP_000777.1) is another GAM281 target gene, herein designated TARGET GENE. CYP51A1 BINDING SITE is a target binding site found in the 3' untranslated region of mRNA encoded by CYP51A1, corresponding to a target binding site such as BINDING SITE I, BINDING SITE II or BINDING SITE III of FIG. 8. Table 4 illustrates the complementarity of the nucleotide sequences of CYP51A1 BINDING SITE, designated SEQ ID:2152, to the nucleotide sequence of GAM281 RNA, herein designated GAM RNA, also designated SEQ ID:278.

Another function of GAM281 is therefore inhibition of CYP51A1 (Accession NP_000777.1). Accordingly, utilities of GAM281 include diagnosis, prevention and treatment of diseases and clinical conditions associated with CYP51A1.

Cytochrome p450, subfamily viiib (sterol 12-alpha-hydroxylase), polypeptide 1 (CYP8B1, Accession NP_004382.1) is another GAM281 target gene, herein designated TARGET GENE. CYP8B1 BINDING SITE is a target binding site found in the 3' untranslated region of mRNA encoded by CYP8B1, corresponding to a target binding site such as BINDING SITE I, BINDING SITE II or BINDING SITE III of FIG. 8. Table 4 illustrates the complementarity of the nucleotide sequences of CYP8B1 BINDING SITE, designated SEQ ID:5978, to the nucleotide sequence of GAM281 RNA, herein designated GAM RNA, also designated SEQ ID:278.

Another function of GAM281 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM281 include diagnosis, prevention and treatment of diseases and clinical conditions associated with CYP8B1.

The function of CYP8B1 and its association with various diseases and clinical conditions, has been established by previous studies, as described hereinabove with reference to GAM47.1. D2S448 (Accession XP_056455.2) is another GAM281 target gene, herein designated TARGET GENE. D2S448 BINDING SITE is a target binding site found in the 3' untranslated region of mRNA encoded by D2S448, corresponding to a target binding site such as BINDING SITE I, BINDING SITE II or BINDING SITE III of FIG. 8. Table 4 illustrates the complementarity of the nucleotide sequences of D2S448 BINDING SITE, designated SEQ ID:11750, to the nucleotide sequence of GAM281 RNA, herein designated GAM RNA, also designated SEQ ID:278.

Another function of GAM281 is therefore inhibition of D2S448 (Accession XP_056455.2). Accordingly, utilities of GAM281 include diagnosis, prevention and treatment of diseases and clinical conditions associated with D2S448.

DBC-1 (Accession NP_066997.3) is another GAM281 target gene, herein designated TARGET GENE. DBC-1 BINDING SITE is a target binding site found in the 3' untranslated region of mRNA encoded by DBC-1, corresponding to a target binding site such as BINDING SITE I, BINDING SITE II or BINDING SITE III of FIG. 8. Table 4 illustrates the complementarity of the nucleotide sequences of DBC-1 BINDING SITE, designated SEQ ID:12841, to the nucleotide sequence of GAM281 RNA, herein designated GAM RNA, also designated SEQ ID:278.

Another function of GAM281 is therefore inhibition of DBC-1 (Accession NP_066997.3). Accordingly, utilities of GAM281 include diagnosis, prevention and treatment of diseases and clinical conditions associated with DBC-1.

Debranching enzyme homolog 1 (s. cerevisiae) (DBR1, Accession NP_057300.1) is another GAM281 target gene, herein designated TARGET GENE. DBR1 BINDING SITE is a target binding site found in the 3' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:7961, to the nucleotide sequence of GAM281 RNA, herein designated GAM RNA, also designated SEQ ID:278.

Another function of GAM281 is therefore inhibition of Debranching enzyme homolog 1 (s. cerevisiae) (DBR1, Accession NP_057300.1). Accordingly, utilities of GAM281 include diagnosis, prevention and treatment of diseases and clinical conditions associated with DBR1.

Deoxycytidine kinase (DCK, Accession NP_000779.1) is another GAM281 target gene, herein designated TARGET GENE. DCK BINDING SITE is a target binding site found in the 3' untranslated region of mRNA encoded by DCK, corresponding to a target binding site such as BINDING SITE I, BINDING SITE II or BINDING SITE III of FIG. 8. Table 4 illustrates the complementarity of the nucleotide sequences of DCK BINDING SITE, designated SEQ ID:3487, to the nucleotide sequence of GAM281 RNA, herein designated GAM RNA, also designated SEQ ID:278.

Another function of GAM281 is therefore inhibition of Deoxycytidine kinase (DCK, Accession NP_000779.1), a gene which mediates the phosphorylation of several deoxyribonucleosides and their analogs. Accordingly, utilities of GAM281 include diagnosis, prevention and treatment of diseases and clinical conditions associated with DCK.

The function of DCK and its association with various diseases and clinical conditions, has been established by previous studies, as described hereinabove with reference to GAM148.1. Doublecortex; lissencephaly, x-linked (doublecortin) (DCX, Accession NP_835364.1) is another GAM281 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM281 RNA, herein designated GAM RNA, also designated SEQ ID:278.

Another function of GAM281 is therefore inhibition of Doublecortex; lissencephaly, x-linked (doublecortin) (DCX, Accession NP_835364.1). Accordingly, utilities of GAM281 include diagnosis, prevention and treatment of diseases and clinical conditions associated with DCX.

Doublecortex; lissencephaly, x-linked (doublecortin) (DCX, Accession NP_000546.2) is another GAM281 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM281 RNA, herein designated GAM RNA, also designated SEQ ID:278.

Another function of GAM281 is therefore inhibition of Doublecortex; lissencephaly, x-linked (doublecortin) (DCX, Accession NP_000546.2). Accordingly, utilities of GAM281 include diagnosis, prevention and treatment of diseases and clinical conditions associated with DCX.

Doublecortex; lissencephaly, x-linked (doublecortin) (DCX, Accession NP_835365.1) is another GAM281 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM281 RNA, herein designated GAM RNA, also designated SEQ ID:278.

Another function of GAM281 is therefore inhibition of Doublecortex; lissencephaly, x-linked (doublecortin) (DCX, Accession NP_835365.1). Accordingly, utilities of GAM281 include diagnosis, prevention and treatment of diseases and clinical conditions associated with DCX.

Doublecortex; lissencephaly, x-linked (doublecortin) (DCX, Accession NP_835366.1) is another GAM281 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM281 RNA, herein designated GAM RNA, also designated SEQ ID:278.

Another function of GAM281 is therefore inhibition of Doublecortex; lissencephaly, x-linked (doublecortin) (DCX, Accession NP_835366.1). Accordingly, utilities of GAM281 include diagnosis, prevention and treatment of diseases and clinical conditions associated with DCX.

Dead/h (asp-glu-ala-asp/his) box polypeptide 31 (DDX31, Accession NP_619526.1) is another GAM281 target gene, herein designated TARGET GENE. DDX31 BINDING SITE is a target binding site found in the 3' untranslated region of multiple transcripts of mRNA encoded by DDX31, corresponding to a target binding site such as BINDING SITE I, BINDING SITE II or BINDING SITE III of FIG. 8. Table 4 illustrates the complementarity of the nucleotide sequences of DDX31 BINDING SITE, designated SEQ ID:16338, to the nucleotide sequence of GAM281 RNA, herein designated GAM RNA, also designated SEQ ID:278.

Another function of GAM281 is therefore inhibition of Dead/h (asp-glu-ala-asp/his) box polypeptide 31 (DDX31, Accession NP_619526.1). Accordingly, utilities of GAM281 include diagnosis, prevention and treatment of diseases and clinical conditions associated with DDX31.

Desmin (DES, Accession NP_001918.2) is another GAM281 target gene, herein designated TARGET GENE. DES BINDING SITE is a target binding site found in the 3' untranslated region of mRNA encoded by DES, corresponding to a target binding site such as BINDING SITE I, BINDING SITE II or BINDING SITE III of FIG. 8. Table 4 illustrates the complementarity of the nucleotide sequences of DES BINDING SITE, designated SEQ ID:14498, to the nucleotide sequence of GAM281 RNA, herein designated GAM RNA, also designated SEQ ID:278.

Another function of GAM281 is therefore inhibition of Desmin (DES, Accession NP_001918.2). Accordingly, utilities of GAM281 include diagnosis, prevention and treatment of diseases and clinical conditions associated with DES.

Dna fragmentation factor, 40 kda, beta polypeptide (caspase-activated dnase) (DFFB, Accession NP_004393.1) is another GAM281 target gene, herein designated TARGET GENE. DFFB BINDING SITE1 and DFFB BINDING SITE2 are target binding sites found in untranslated regions of mRNA encoded by DFFB, corresponding to target binding sites such as BINDING SITE I, BINDING SITE II or BINDING SITE III of FIG. 8. Table 4 illustrates the complementarity of the nucleotide sequences of DFFB BINDING SITE1 and DFFB BINDING SITE2, designated SEQ ID:2019 and SEQ ID:9091 respectively, to the nucleotide sequence of GAM281 RNA, herein designated GAM RNA, also designated SEQ ID:278.

Another function of GAM281 is therefore inhibition of Dna fragmentation factor, 40 kda, beta polypeptide (caspase-activated dnase) (DFFB, Accession NP_004393.1), a gene which induces DNA fragmentation and chromatin condensation during apoptosis. Accordingly, utilities of GAM281 include diagnosis, prevention and treatment of diseases and clinical conditions associated with DFFB.

The function of DFFB and its association with various diseases and clinical conditions, has been established by previous studies, as described hereinabove with reference to GAM130.1. Dihydrofolate reductase (DHFR, Accession NP_000782.1) is another GAM281 target gene, herein designated TARGET GENE. DHFR BINDING SITE is a target binding site found in the 3' untranslated region of mRNA encoded by DHFR, corresponding to a target binding site such as BINDING SITE I, BINDING SITE II or BINDING SITE III of FIG. 8. Table 4 illustrates the complementarity of the nucleotide sequences of DHFR BINDING SITE, designated SEQ ID:8052, to the nucleotide sequence of GAM281 RNA, herein designated GAM RNA, also designated SEQ ID:278.

Another function of GAM281 is therefore inhibition of Dihydrofolate reductase (DHFR, Accession NP_000782.1), a gene which converts dihydrofolate into tetrahydrofolate. Accordingly, utilities of GAM281 include diagnosis, prevention and treatment of diseases and clinical conditions associated with DHFR.

The function of DHFR and its association with various diseases and clinical conditions, has been established by previous studies, as described hereinabove with reference to GAM64.1. Diaphanous homolog 2 (drosophila) (DIAPH2, Accession NP_006720.1) is another GAM281 target gene, herein designated TARGET GENE. DIAPH2 BINDING SITE is a target binding site found in the 3' untranslated region of multiple transcripts of mRNA encoded by DIAPH2, corresponding to a target binding site such as BINDING SITE I, BINDING SITE II or BINDING SITE III of FIG. 8. Table 4 illustrates the complementarity of the nucleotide sequences of DIAPH2 BINDING SITE, designated SEQ ID:14492, to the nucleotide sequence of GAM281 RNA, herein designated GAM RNA, also designated SEQ ID:278.

Another function of GAM281 is therefore inhibition of Diaphanous homolog 2 (drosophila) (DIAPH2, Accession NP_006720.1), a gene which may affect in oogenesis and therefore may be associated with Premature ovarian failure. Accordingly, utilities of GAM281 include diagnosis, prevention and treatment of Premature ovarian failure., and of other diseases and clinical conditions associated with DIAPH2.

The function of DIAPH2 and its association with various diseases and clinical conditions, has been established by previous studies, as described hereinabove with reference to GAM66.1. Disrupted in schizophrenia 1 (DISC1, Accession NP_061132.1) is another GAM281 target gene, herein designated TARGET GENE. DISC1 BINDING SITE1 and DISC1 BINDING SITE2 are target binding sites found in untranslated regions of mRNA encoded by DISC1, corresponding to target binding sites such as BINDING SITE I, BINDING SITE II or BINDING SITE III of FIG. 8. Table 4 illustrates the complementarity of the nucleotide sequences of DISC1 BINDING SITE1 and DISC1 BINDING SITE2, designated SEQ ID:1298 and SEQ ID:11285 respectively, to the nucleotide sequence of GAM281 RNA, herein designated GAM RNA, also designated SEQ ID:278.

Another function of GAM281 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM281 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. DKFZP434B044 (Accession NP_113664.1) is another GAM281 target gene, herein designated TARGET GENE. DKFZP434B044 BINDING SITE is a target binding site found in the 3' untranslated region of mRNA encoded by DKFZP434B044, corresponding to a target binding site such as BINDING SITE I, BINDING SITE II or BINDING SITE III of FIG. 8. Table 4 illustrates the complementarity of the nucleotide sequences of DKFZP434B044 BINDING SITE, designated SEQ ID:4080, to the nucleotide sequence of GAM281 RNA, herein designated GAM RNA, also designated SEQ ID:278.

Another function of GAM281 is therefore inhibition of DKFZP434B044 (Accession NP_113664.1). Accordingly, utilities of GAM281 include diagnosis, prevention and treatment of diseases and clinical conditions associated with DKFZP434B044.

DKFZP434B1727 (Accession NP_115519.1) is another GAM281 target gene, herein designated TARGET GENE. DKFZP434B1727 BINDING SITE is a target binding site found in the 3' untranslated region of mRNA encoded by DKFZP434B1727, corresponding to a target binding site such as BINDING SITE I, BINDING SITE II or BINDING SITE III of FIG. 8. Table 4 illustrates the complementarity of the nucleotide sequences of DKFZP434B1727 BINDING SITE, designated SEQ ID:4014, to the nucleotide sequence of GAM281 RNA, herein designated GAM RNA, also designated SEQ ID:278.

Another function of GAM281 is therefore inhibition of DKFZP434B1727 (Accession NP_115519.1). Accordingly, utilities of GAM281 include diagnosis, prevention and treatment of diseases and clinical conditions associated with DKFZP434B1727.

DKFZp434C0923 (Accession NP_060068.1) is another GAM281 target gene, herein designated TARGET GENE. DKFZp434C0923 BINDING SITE is a target binding site found in the 3' untranslated region of mRNA encoded by DKFZp434C0923, corresponding to a target binding site such as BINDING SITE I, BINDING SITE II or BINDING SITE III of FIG. 8. Table 4 illustrates the complementarity of the nucleotide sequences of DKFZp434C0923 BINDING SITE, designated SEQ ID:8235, to the nucleotide sequence of GAM281 RNA, herein designated GAM RNA, also designated SEQ ID:278.

Another function of GAM281 is therefore inhibition of DKFZp434C0923 (Accession NP_060068.1). Accordingly, utilities of GAM281 include diagnosis, prevention and treatment of diseases and clinical conditions associated with DKFZp434C0923.

DKFZP434C212 (Accession XP_044196.3) is another GAM281 target gene, herein designated TARGET GENE. DKFZP434C212 BINDING SITE is a target binding site found in the 3' untranslated region of mRNA encoded by DKFZP434C212, corresponding to a target binding site such as BINDING SITE I, BINDING SITE II or BINDING SITE III of FIG. 8. Table 4 illustrates the complementarity of the nucleotide sequences of DKFZP434C212 BINDING SITE, designated SEQ ID:8661, to the nucleotide sequence of GAM281 RNA, herein designated GAM RNA, also designated SEQ ID:278.

Another function of GAM281 is therefore inhibition of DKFZP434C212 (Accession XP_044196.3). Accordingly, utilities of GAM281 include diagnosis, prevention and treatment of diseases and clinical conditions associated with DKFZP434C212.

DKFZP434D146 (Accession NP_056410.2) is another GAM281 target gene, herein designated TARGET GENE. DKFZP434D146 BINDING SITE is a target binding site found in the 3' untranslated region of mRNA encoded by DKFZP434D146, corresponding to a target binding site such as BINDING SITE I, BINDING SITE II or BINDING SITE III of FIG. 8. Table 4 illustrates the complementarity of the nucleotide sequences of DKFZP434D146 BINDING SITE, designated SEQ ID:2209, to the nucleotide sequence of GAM281 RNA, herein designated GAM RNA, also designated SEQ ID:278.

Another function of GAM281 is therefore inhibition of DKFZP434D146 (Accession NP_056410.2). Accordingly, utilities of GAM281 include diagnosis, prevention and treatment of diseases and clinical conditions associated with DKFZP434D146.

DKFZp434E2220 (Accession NP_060082.1) is another GAM281 target gene, herein designated TARGET GENE. DKFZp434E2220 BINDING SITE is a target binding site found in the 5' untranslated region of mRNA encoded by DKFZp434E2220, corresponding to a target binding site such as BINDING SITE I, BINDING SITE II or BINDING SITE III of FIG. 8. Table 4 illustrates the complementarity of the nucleotide sequences of DKFZp434E2220 BINDING SITE, designated SEQ ID:11326, to the nucleotide sequence of GAM281 RNA, herein designated GAM RNA, also designated SEQ ID:278.

Another function of GAM281 is therefore inhibition of DKFZp434E2220 (Accession NP_060082.1). Accordingly, utilities of GAM281 include diagnosis, prevention and treatment of diseases and clinical conditions associated with DKFZp434E2220.

DKFZP434F0318 (Accession NP_110444.1) is another GAM281 target gene, herein designated TARGET GENE. DKFZP434F0318 BINDING SITE is a target binding site found in the 3' untranslated region of mRNA encoded by DKFZP434F0318, corresponding to a target binding site such as BINDING SITE I, BINDING SITE II or BINDING SITE III of FIG. 8. Table 4 illustrates the complementarity of the nucleotide sequences of DKFZP434F0318 BINDING SITE, designated SEQ ID:16771, to the nucleotide sequence of GAM281 RNA, herein designated GAM RNA, also designated SEQ ID:278.

Another function of GAM281 is therefore inhibition of DKFZP434F0318 (Accession NP_110444.1). Accordingly, utilities of GAM281 include diagnosis, prevention and treatment of diseases and clinical conditions associated with DKFZP434F0318.

DKFZp434F1719 (Accession NP_115624.1) is another GAM281 target gene, herein designated TARGET GENE. DKFZp434F1719 BINDING SITE is a target binding site found in the 3' untranslated region of mRNA encoded by DKFZp434F1719, corresponding to a target binding site such as BINDING SITE I, BINDING SITE II or BINDING SITE III of FIG. 8. Table 4 illustrates the complementarity of the nucleotide sequences of DKFZp434F1719 BINDING SITE, designated SEQ ID:3951, to the nucleotide sequence of GAM281 RNA, herein designated GAM RNA, also designated SEQ ID:278.

Another function of GAM281 is therefore inhibition of DKFZp434F1719 (Accession NP_115624.1). Accordingly, utilities of GAM281 include diagnosis, prevention and treatment of diseases and clinical conditions associated with DKFZp434F1719.

DKFZp434K1210 (Accession NP_060076.1) is another GAM281 target gene, herein designated TARGET GENE. DKFZp434K1210 BINDING SITE is a target binding site found in the 3' untranslated region of mRNA encoded by DKFZp434K1210, corresponding to a target binding site such as BINDING SITE I, BINDING SITE II or BINDING SITE III of FIG. 8. Table 4 illustrates the complementarity of the nucleotide sequences of DKFZp434K1210 BINDING SITE, designated SEQ ID:4195, to the nucleotide sequence of GAM281 RNA, herein designated GAM RNA, also designated SEQ ID:278.

Another function of GAM281 is therefore inhibition of DKFZp434K1210 (Accession NP_060076.1). Accordingly, utilities of GAM281 include diagnosis, prevention and treatment of diseases and clinical conditions associated with DKFZp434K1210.

DKFZp547H025 (Accession NP_064546.1) is another GAM281 target gene, herein designated TARGET GENE. DKFZp547H025 BINDING SITE is a target binding site found in the 3' untranslated region of mRNA encoded by DKFZp547H025, corresponding to a target binding site such as BINDING SITE I, BINDING SITE II or BINDING SITE III of FIG. 8. Table 4 illustrates the complementarity of the nucleotide sequences of DKFZp547H025 BINDING SITE, designated SEQ ID:14246, to the nucleotide sequence of GAM281 RNA, herein designated GAM RNA, also designated SEQ ID:278.

Another function of GAM281 is therefore inhibition of DKFZp547H025 (Accession NP_064546.1). Accordingly, utilities of GAM281 include diagnosis, prevention and treatment of diseases and clinical conditions associated with DKFZp547H025.

DKFZp547I094 (Accession NP_115531.1) is another GAM281 target gene, herein designated TARGET GENE. DKFZp547I094 BINDING SITE is a target binding site found in the 3' untranslated region of mRNA encoded by DKFZp547I094, corresponding to a target binding site such as BINDING SITE I, BINDING SITE II or BINDING SITE III of FIG. 8. Table 4 illustrates the complementarity of the nucleotide sequences of DKFZp547I094 BINDING SITE, designated SEQ ID:1180, to the nucleotide sequence of GAM281 RNA, herein designated GAM RNA, also designated SEQ ID:278.

Another function of GAM281 is therefore inhibition of DKFZp547I094 (Accession NP_115531.1). Accordingly, utilities of GAM281 include diagnosis, prevention and treatment of diseases and clinical conditions associated with DKFZp547I094.

DKFZp547P234 (Accession NP_694590.1) is another GAM281 target gene, herein designated TARGET GENE. DKFZp547P234 BINDING SITE is a target binding site found in the 3' untranslated region of mRNA encoded by DKFZp547P234, corresponding to a target binding site such as BINDING SITE I, BINDING SITE II or BINDING SITE III of FIG. 8. Table 4 illustrates the complementarity of the nucleotide sequences of DKFZp547P234 BINDING SITE, designated SEQ ID:11057, to the nucleotide sequence of GAM281 RNA, herein designated GAM RNA, also designated SEQ ID:278.

Another function of GAM281 is therefore inhibition of DKFZp547P234 (Accession NP_694590.1). Accordingly, utilities of GAM281 include diagnosis, prevention and treatment of diseases and clinical conditions associated with DKFZp547P234.

DKFZP564D166 (Accession NP_108648.1) is another GAM281 target gene, herein designated TARGET GENE. DKFZP564D166 BINDING SITE is a target binding site found in the 3' untranslated region of multiple transcripts of mRNA encoded by DKFZP564D166, corresponding to a target binding site such as BINDING SITE I, BINDING SITE II or BINDING SITE III of FIG. 8. Table 4 illustrates the complementarity of the nucleotide sequences of DKFZP564D166 BINDING SITE, designated SEQ ID:17204, to the nucleotide sequence of GAM281 RNA, herein designated GAM RNA, also designated SEQ ID:278.

Another function of GAM281 is therefore inhibition of DKFZP564D166 (Accession NP_108648.1). Accordingly, utilities of GAM281 include diagnosis, prevention and treatment of diseases and clinical conditions associated with DKFZP564D166.

DKFZP564G092 (Accession NP_056416.1) is another GAM281 target gene, herein designated TARGET GENE. DKFZP564G092 BINDING SITE is a target binding site found in the 5' untranslated region of mRNA encoded by DKFZP564G092, corresponding to a target binding site such as BINDING SITE I, BINDING SITE II or BINDING SITE III of FIG. 8. Table 4 illustrates the complementarity of the nucleotide sequences of DKFZP564G092 BINDING SITE, designated SEQ ID:2662, to the nucleotide sequence of GAM281 RNA, herein designated GAM RNA, also designated SEQ ID:278.

Another function of GAM281 is therefore inhibition of DKFZP564G092 (Accession NP_056416.1). Accordingly, utilities of GAM281 include diagnosis, prevention and treatment of diseases and clinical conditions associated with DKFZP564G092.

DKFZP564I122 (Accession XP_032397.1) is another GAM281 target gene, herein designated TARGET GENE. DKFZP564I122 BINDING SITE is a target binding site found in the 3' untranslated region of mRNA encoded by DKFZP564I122, corresponding to a target binding site such as BINDING SITE I, BINDING SITE II or BINDING SITE III of FIG. 8. Table 4 illustrates the complementarity of the nucleotide sequences of DKFZP564I122 BINDING SITE, designated SEQ ID:16590, to the nucleotide sequence of GAM281 RNA, herein designated GAM RNA, also designated SEQ ID:278.

Another function of GAM281 is therefore inhibition of DKFZP564I122 (Accession XP_032397.1). Accordingly, utilities of GAM281 include diagnosis, prevention and treatment of diseases and clinical conditions associated with DKFZP564I122.

DKFZP564J0863 (Accession NP_056274.1) is another GAM281 target gene, herein designated TARGET GENE. DKFZP564J0863 BINDING SITE is a target binding site found in the 3' untranslated region of mRNA encoded by DKFZP564J0863, corresponding to a target binding site such as BINDING SITE I, BINDING SITE II or BINDING SITE III of FIG. 8. Table 4 illustrates the complementarity of the nucleotide sequences of DKFZP564J0863 BINDING SITE, designated SEQ ID:1067, to the nucleotide sequence of GAM281 RNA, herein designated GAM RNA, also designated SEQ ID:278.

Another function of GAM281 is therefore inhibition of DKFZP564J0863 (Accession NP_056274.1). Accordingly, utilities of GAM281 include diagnosis, prevention and treatment of diseases and clinical conditions associated with DKFZP564J0863.

DKFZP564J157 (Accession NP_060927.1) is another GAM281 target gene, herein designated TARGET GENE. DKFZP564J157 BINDING SITE is a target binding site found in the 5' untranslated region of mRNA encoded by DKFZP564J157, corresponding to a target binding site such as BINDING SITE I, BINDING SITE II or BINDING SITE III of FIG. 8. Table 4 illustrates the complementarity of the nucleotide sequences of DKFZP564J157 BINDING SITE, designated SEQ ID:18768, to the nucleotide sequence of GAM281 RNA, herein designated GAM RNA, also designated SEQ ID:278.

Another function of GAM281 is therefore inhibition of DKFZP564J157 (Accession NP_060927.1). Accordingly, utilities of GAM281 include diagnosis, prevention and treatment of diseases and clinical conditions associated with DKFZP564J157.

DKFZP564K0322 (Accession NP_114429.1) is another GAM281 target gene, herein designated TARGET GENE. DKFZP564K0322 BINDING SITE is a target binding site found in the 3' untranslated region of mRNA encoded by DKFZP564K0322, corresponding to a target binding site such as BINDING SITE I, BINDING SITE II or BINDING SITE III of FIG. 8. Table 4 illustrates the complementarity of the nucleotide sequences of DKFZP564K0322 BINDING SITE, designated SEQ ID:17964, to the nucleotide sequence of GAM281 RNA, herein designated GAM RNA, also designated SEQ ID:278.

Another function of GAM281 is therefore inhibition of DKFZP564K0322 (Accession NP_114429.1). Accordingly, utilities of GAM281 include diagnosis, prevention and treatment of diseases and clinical conditions associated with DKFZP564K0322.

DKFZp564K142 (Accession NP_115497.2) is another GAM281 target gene, herein designated TARGET GENE. DKFZp564K142 BINDING SITE is a target binding site found in the 3' untranslated region of mRNA encoded by DKFZp564K142, corresponding to a target binding site such as BINDING SITE I, BINDING SITE II or BINDING SITE III of FIG. 8. Table 4 illustrates the complementarity of the nucleotide sequences of DKFZp564K142 BINDING SITE, designated SEQ ID:2663, to the nucleotide sequence of GAM281 RNA, herein designated GAM RNA, also designated SEQ ID:278.

Another function of GAM281 is therefore inhibition of DKFZp564K142 (Accession NP_115497.2). Accordingly, utilities of GAM281 include diagnosis, prevention and treatment of diseases and clinical conditions associated with DKFZp564K142.

DKFZP564O0423 (Accession XP_166254.2) is another GAM281 target gene, herein designated TARGET GENE. DKFZP564O0423 BINDING SITE is a target binding site found in the 3' untranslated region of mRNA encoded by DKFZP564O0423, corresponding to a target binding site such as BINDING SITE I, BINDING SITE II or BINDING SITE III of FIG. 8. Table 4 illustrates the complementarity of the nucleotide sequences of DKFZP564O0423 BINDING SITE, designated SEQ ID:10819, to the nucleotide sequence of GAM281 RNA, herein designated GAM RNA, also designated SEQ ID:278.

Another function of GAM281 is therefore inhibition of DKFZP564O0423 (Accession XP_166254.2). Accordingly, utilities of GAM281 include diagnosis, prevention and treatment of diseases and clinical conditions associated with DKFZP564O0423.

DKFZP564O0523 (Accession NP_115496.1) is another GAM281 target gene, herein designated TARGET GENE. DKFZP564O0523 BINDING SITE is a target binding site found in the 3' untranslated region of mRNA encoded by DKFZP564O0523, corresponding to a target binding site such as BINDING SITE I, BINDING SITE II or BINDING SITE III of FIG. 8. Table 4 illustrates the complementarity of the nucleotide sequences of DKFZP564O0523 BINDING SITE, designated SEQ ID:3686, to the nucleotide sequence of GAM281 RNA, herein designated GAM RNA, also designated SEQ ID:278.

Another function of GAM281 is therefore inhibition of DKFZP564O0523 (Accession NP_115496.1). Accordingly, utilities of GAM281 include diagnosis, prevention and treatment of diseases and clinical conditions associated with DKFZP564O0523.

DKFZP566D1346 (Accession NP_110443.1) is another GAM281 target gene, herein designated TARGET GENE. DKFZP566D1346 BINDING SITE is a target binding site found in the 5' untranslated region of mRNA encoded by DKFZP566D1346, corresponding to a target binding site such as BINDING SITE I, BINDING SITE II or BINDING SITE III of FIG. 8. Table 4 illustrates the complementarity of the nucleotide sequences of DKFZP566D1346 BINDING SITE, designated SEQ ID:10539, to the nucleotide sequence of GAM281 RNA, herein designated GAM RNA, also designated SEQ ID:278.

Another function of GAM281 is therefore inhibition of DKFZP566D1346 (Accession NP_110443.1). Accordingly, utilities of GAM281 include diagnosis, prevention and treatment of diseases and clinical conditions associated with DKFZP566D1346.

DKFZP566I1024 (Accession NP_056226.1) is another GAM281 target gene, herein designated TARGET GENE. DKFZP566I1024 BINDING SITE is a target binding site found in the 3' untranslated region of mRNA encoded by DKFZP566I1024, corresponding to a target binding site such as BINDING SITE I, BINDING SITE II or BINDING SITE III of FIG. 8. Table 4 illustrates the complementarity of the nucleotide sequences of DKFZP566I1024 BINDING SITE, designated SEQ ID:12353, to the nucleotide sequence of GAM281 RNA, herein designated GAM RNA, also designated SEQ ID:278.

Another function of GAM281 is therefore inhibition of DKFZP566I1024 (Accession NP_056226.1). Accordingly, utilities of GAM281 include diagnosis, prevention and treatment of diseases and clinical conditions associated with DKFZP566I1024.

DKFZp586C0721 (Accession XP_098416.1) is another GAM281 target gene, herein designated TARGET GENE. DKFZp586C0721 BINDING SITE is a target binding site found in the 3' untranslated region of mRNA encoded by DKFZp586C0721, corresponding to a target binding site such as BINDING SITE I, BINDING SITE II or BINDING SITE III of FIG. 8. Table 4 illustrates the complementarity of the nucleotide sequences of DKFZp586C0721 BINDING SITE, designated SEQ ID:12173, to the nucleotide sequence of GAM281 RNA, herein designated GAM RNA, also designated SEQ ID:278.

Another function of GAM281 is therefore inhibition of DKFZp586C0721 (Accession XP_098416.1). Accordingly, utilities of GAM281 include diagnosis, prevention and treatment of diseases and clinical conditions associated with DKFZp586C0721.

DKFZP586D0919 (Accession NP_056248.1) is another GAM281 target gene, herein designated TARGET GENE. DKFZP586D0919 BINDING SITE is a target binding site found in the 3' untranslated region of mRNA encoded by DKFZP586D0919, corresponding to a target binding site such as BINDING SITE I, BINDING SITE II or BINDING SITE III of FIG. 8. Table 4 illustrates the complementarity of the nucleotide sequences of DKFZP586D0919 BINDING SITE, designated SEQ ID:11134, to the nucleotide sequence of GAM281 RNA, herein designated GAM RNA, also designated SEQ ID:278.

Another function of GAM281 is therefore inhibition of DKFZP586D0919 (Accession NP_056248.1). Accordingly, utilities of GAM281 include diagnosis, prevention and treatment of diseases and clinical conditions associated with DKFZP586D0919.

DKFZp667B1218 (Accession NP_808881.1) is another GAM281 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:15574, to the nucleotide sequence of GAM281 RNA, herein designated GAM RNA, also designated SEQ ID:278.

Another function of GAM281 is therefore inhibition of DKFZp667B1218 (Accession NP_808881.1). Accordingly, utilities of GAM281 include diagnosis, prevention and treatment of diseases and clinical conditions associated with DKFZp667B1218.

DKFZp667E0512 (Accession XP_117353.1) is another GAM281 target gene, herein designated TARGET GENE. DKFZp667E0512 BINDING SITE is a target binding site found in the 3' untranslated region of mRNA encoded by DKFZp667E0512, corresponding to a target binding site such as BINDING SITE I, BINDING SITE II or BINDING SITE III of FIG. 8. Table 4 illustrates the complementarity of the nucleotide sequences of DKFZp667E0512 BINDING SITE, designated SEQ ID:8492, to the nucleotide sequence of GAM281 RNA, herein designated GAM RNA, also designated SEQ ID:278.

Another function of GAM281 is therefore inhibition of DKFZp667E0512 (Accession XP_117353.1). Accordingly, utilities of GAM281 include diagnosis, prevention and treatment of diseases and clinical conditions associated with DKFZp667E0512.

DKFZp761B107 (Accession NP_775734.1) is another GAM281 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:13571, to the nucleotide sequence of GAM281 RNA, herein designated GAM RNA, also designated SEQ ID:278.

Another function of GAM281 is therefore inhibition of DKFZp761B107 (Accession NP_775734.1). Accordingly, utilities of GAM281 include diagnosis, prevention and treatment of diseases and clinical conditions associated with DKFZp761B107.

DKFZp761B128 (Accession NP_689650.1) is another GAM281 target gene, herein designated TARGET GENE. DKFZp761B128 BINDING SITE is a target binding site found in the 5' untranslated region of mRNA encoded by DKFZp761B128, corresponding to a target binding site such as BINDING SITE I, BINDING SITE II or BINDING SITE III of FIG. 8. Table 4 illustrates the complementarity of the nucleotide sequences of DKFZp761B128 BINDING SITE, designated SEQ ID:17969, to the nucleotide sequence of GAM281 RNA, herein designated GAM RNA, also designated SEQ ID:278.

Another function of GAM281 is therefore inhibition of DKFZp761B128 (Accession NP_689650.1). Accordingly, utilities of GAM281 include diagnosis, prevention and treatment of diseases and clinical conditions associated with DKFZp761B128.

DKFZp761H039 (Accession NP_061181.1) is another GAM281 target gene, herein designated TARGET GENE. DKFZp761H039 BINDING SITE is a target binding site found in the 3' untranslated region of mRNA encoded by DKFZp761H039, corresponding to a target binding site such as BINDING SITE I, BINDING SITE II or BINDING SITE III of FIG. 8. Table 4 illustrates the complementarity of the nucleotide sequences of DKFZp761H039 BINDING SITE, designated SEQ ID:15190, to the nucleotide sequence of GAM281 RNA, herein designated GAM RNA, also designated SEQ ID:278.

Another function of GAM281 is therefore inhibition of DKFZp761H039 (Accession NP_061181.1). Accordingly, utilities of GAM281 include diagnosis, prevention and treatment of diseases and clinical conditions associated with DKFZp761H039.

DKFZp761I2123 (Accession XP_166582.2) is another GAM281 target gene, herein designated TARGET GENE. DKFZp761I2123 BINDING SITE is a target binding site found in the 3' untranslated region of mRNA encoded by DKFZp761I2123, corresponding to a target binding site such as BINDING SITE I, BINDING SITE II or BINDING SITE III of FIG. 8. Table 4 illustrates the complementarity of the nucleotide sequences of DKFZp761I2123 BINDING SITE, designated SEQ ID:12187, to the nucleotide sequence of GAM281 RNA, herein designated GAM RNA, also designated SEQ ID:278.

Another function of GAM281 is therefore inhibition of DKFZp761I2123 (Accession XP_166582.2). Accordingly, utilities of GAM281 include diagnosis, prevention and treatment of diseases and clinical conditions associated with DKFZp761I2123.

DKFZp761J139 (Accession NP_115656.1) is another GAM281 target gene, herein designated TARGET GENE. DKFZp761J139 BINDING SITE is a target binding site found in the 5' untranslated region of mRNA encoded by DKFZp761J139, corresponding to a target binding site such as BINDING SITE I, BINDING SITE II or BINDING SITE III of FIG. 8. Table 4 illustrates the complementarity of the nucleotide sequences of DKFZp761J139 BINDING SITE, designated SEQ ID:5768, to the nucleotide sequence of GAM281 RNA, herein designated GAM RNA, also designated SEQ ID:278.

Another function of GAM281 is therefore inhibition of DKFZp761J139 (Accession NP_115656.1). Accordingly, utilities of GAM281 include diagnosis, prevention and treatment of diseases and clinical conditions associated with DKFZp761J139.

DKFZp761K1423 (Accession NP_060892.1) is another GAM281 target gene, herein designated TARGET GENE. DKFZp761K1423 BINDING SITE is a target binding site found in the 5' untranslated region of mRNA encoded by DKFZp761K1423, corresponding to a target binding site such as BINDING SITE I, BINDING SITE II or BINDING SITE III of FIG. 8. Table 4 illustrates the complementarity of the nucleotide sequences of DKFZp761K1423 BINDING SITE, designated SEQ ID:7711, to the nucleotide sequence of GAM281 RNA, herein designated GAM RNA, also designated SEQ ID:278.

Another function of GAM281 is therefore inhibition of DKFZp761K1423 (Accession NP_060892.1). Accordingly, utilities of GAM281 include diagnosis, prevention and treatment of diseases and clinical conditions associated with DKFZp761K1423.

DKFZp761N1114 (Accession XP_086327.6) is another GAM281 target gene, herein designated TARGET GENE. DKFZp761N1114 BINDING SITE is a target binding site found in the 3' untranslated region of mRNA encoded by DKFZp761N1114, corresponding to a target binding site such as BINDING SITE I, BINDING SITE II or BINDING SITE III of FIG. 8. Table 4 illustrates the complementarity of the nucleotide sequences of DKFZp761N1114 BINDING SITE, designated SEQ ID:13529, to the nucleotide sequence of GAM281 RNA, herein designated GAM RNA, also designated SEQ ID:278.

Another function of GAM281 is therefore inhibition of DKFZp761N1114 (Accession XP_086327.6). Accordingly, utilities of GAM281 include diagnosis, prevention and treatment of diseases and clinical conditions associated with DKFZp761N1114.

DKFZp761O0113 (Accession NP_060879.1) is another GAM281 target gene, herein designated TARGET GENE. DKFZp761O0113 BINDING SITE is a target binding site found in the 5' untranslated region of mRNA encoded by DKFZp761O0113, corresponding to a target binding site such as BINDING SITE I, BINDING SITE II or BINDING SITE III of FIG. 8. Table 4 illustrates the complementarity of the nucleotide sequences of DKFZp761O0113 BINDING SITE, designated SEQ ID:7699, to the nucleotide sequence of GAM281 RNA, herein designated GAM RNA, also designated SEQ ID:278.

Another function of GAM281 is therefore inhibition of DKFZp761O0113 (Accession NP_060879.1). Accordingly, utilities of GAM281 include diagnosis, prevention and treatment of diseases and clinical conditions associated with DKFZp761O0113.

DKFZp761P1121 (Accession NP_690870.1) is another GAM281 target gene, herein designated TARGET GENE. DKFZp761P1121 BINDING SITE is a target binding site found in the 3' untranslated region of mRNA encoded by DKFZp761P1121, corresponding to a target binding site such as BINDING SITE I, BINDING SITE II or BINDING SITE III of FIG. 8. Table 4 illustrates the complementarity of the nucleotide sequences of DKFZp761P1121 BINDING SITE, designated SEQ ID:9147, to the nucleotide sequence of GAM281 RNA, herein designated GAM RNA, also designated SEQ ID:278.

Another function of GAM281 is therefore inhibition of DKFZp761P1121 (Accession NP_690870.1). Accordingly, utilities of GAM281 include diagnosis, prevention and treatment of diseases and clinical conditions associated with DKFZp761P1121.

DKFZp762C2414 (Accession NP_848637.1) is another GAM281 target gene, herein designated TARGET GENE. DKFZp762C2414 BINDING SITE is a target binding site found in the 3' untranslated region of mRNA encoded by DKFZp762C2414, corresponding to a target binding site such as BINDING SITE I, BINDING SITE II or BINDING SITE III of FIG. 8. Table 4 illustrates the complementarity of the nucleotide sequences of DKFZp762C2414 BINDING SITE, designated SEQ ID:4056, to the nucleotide sequence of GAM281 RNA, herein designated GAM RNA, also designated SEQ ID:278.

Another function of GAM281 is therefore inhibition of DKFZp762C2414 (Accession NP_848637.1). Accordingly, utilities of GAM281 include diagnosis, prevention and treatment of diseases and clinical conditions associated with DKFZp762C2414.

DKFZp762H185 (Accession XP_172976.2) is another GAM281 target gene, herein designated TARGET GENE. DKFZp762H185 BINDING SITE is a target binding site found in the 3' untranslated region of mRNA encoded by DKFZp762H185, corresponding to a target binding site such as BINDING SITE I, BINDING SITE II or BINDING SITE III of FIG. 8. Table 4 illustrates the complementarity of the nucleotide sequences of DKFZp762H185 BINDING SITE, designated SEQ ID:13803, to the nucleotide sequence of GAM281 RNA, herein designated GAM RNA, also designated SEQ ID:278.

Another function of GAM281 is therefore inhibition of DKFZp762H185 (Accession XP_172976.2). Accordingly, utilities of GAM281 include diagnosis, prevention and treatment of diseases and clinical conditions associated with DKFZp762H185.

DKFZp762I137 (Accession NP_689624.1) is another GAM281 target gene, herein designated TARGET GENE. DKFZp762I137 BINDING SITE is a target binding site found in the 3' untranslated region of mRNA encoded by DKFZp762I137, corresponding to a target binding site such as BINDING SITE I, BINDING SITE II or BINDING SITE III of FIG. 8. Table 4 illustrates the complementarity of the nucleotide sequences of DKFZp762I137 BINDING SITE, designated SEQ ID:1744, to the nucleotide sequence of GAM281 RNA, herein designated GAM RNA, also designated SEQ ID:278.

Another function of GAM281 is therefore inhibition of DKFZp762I137 (Accession NP_689624.1). Accordingly, utilities of GAM281 include diagnosis, prevention and treatment of diseases and clinical conditions associated with DKFZp762I137.

DKFZp762I194 (Accession NP_689597.1) is another GAM281 target gene, herein designated TARGET GENE. DKFZp762I194 BINDING SITE is a target binding site found in the 3' untranslated region of mRNA encoded by DKFZp762I194, corresponding to a target binding site such as BINDING SITE I, BINDING SITE II or BINDING SITE III of FIG. 8. Table 4 illustrates the complementarity of the nucleotide sequences of DKFZp762I194 BINDING SITE, designated SEQ ID:6884, to the nucleotide sequence of GAM281 RNA, herein designated GAM RNA, also designated SEQ ID:278.

Another function of GAM281 is therefore inhibition of DKFZp762I194 (Accession NP_689597.1). Accordingly, utilities of GAM281 include diagnosis, prevention and treatment of diseases and clinical conditions associated with DKFZp762I194.

DKFZp762L0311 (Accession NP_061189.2) is another GAM281 target gene, herein designated TARGET GENE. DKFZp762L0311 BINDING SITE is a target binding site found in the 3' untranslated region of mRNA encoded by DKFZp762L0311, corresponding to a target binding site such as BINDING SITE I, BINDING SITE II or BINDING SITE III of FIG. 8. Table 4 illustrates the complementarity of the nucleotide sequences of DKFZp762L0311 BINDING SITE, designated SEQ ID:9194, to the nucleotide sequence of GAM281 RNA, herein designated GAM RNA, also designated SEQ ID:278.

Another function of GAM281 is therefore inhibition of DKFZp762L0311 (Accession NP_061189.2). Accordingly, utilities of GAM281 include diagnosis, prevention and treatment of diseases and clinical conditions associated with DKFZp762L0311.

Discs, large homolog 2, chapsyn-110 (drosophila) (DLG2, Accession NP_001355.1) is another GAM281 target gene, herein designated TARGET GENE. DLG2 BINDING SITE is a target binding site found in the 5' untranslated region of mRNA encoded by DLG2, corresponding to a target binding site such as BINDING SITE I, BINDING SITE II or BINDING SITE III of FIG. 8. Table 4 illustrates the complementarity of the nucleotide sequences of DLG2 BINDING SITE, designated SEQ ID:9202, to the nucleotide sequence of GAM281 RNA, herein designated GAM RNA, also designated SEQ ID:278.

Another function of GAM281 is therefore inhibition of Discs, large homolog 2, chapsyn-110 (drosophila) (DLG2, Accession NP_001355.1), a gene which may mediate organized clustering of NMDA receptors. Accordingly, utilities of GAM281 include diagnosis, prevention and treatment of diseases and clinical conditions associated with DLG2.

The function of DLG2 has been established by previous studies. The proper distribution of voltage-gated and ligand-gated ion channels on the neuronal surface is critical for the processing and transmission of electrical signals in neurons. Kim et al. (1995) hypothesized that potential anchoring molecules bind to the C-terminal intracellular tail of Shaker subfamily potassium channels. Using a yeast 2-hybrid screen with the C terminus of the rat Shaker subfamily member Kv1.4 (see OMIM Ref. No. KCNA4; 176266) as bait, they isolated partial human brain cDNAs encoding PSD95 (OMIM Ref. No. 602887), SAP97 (OMIM Ref. No. 601014), and DLG2. All 3 proteins are members of the 'membrane-associated guanylate kinase' (MAGUK) family. Kim et al. (1996) isolated additional cDNAs corresponding to the entire coding region of DLG2, which they called 'channel-associated protein of synapses-110' (chapsyn-110). Like PSD95 and SAP97, the predicted 870-amino acid chapsyn-110 protein contains 3 PDZ domains, an SH3 domain, and a guanylate kinase homology region. The chapsyn-110 protein is 78%, 71%, and 57% identical to SAP97, PSD95, and the Drosophila 'discs large' protein, respectively. Using immunohistochemical analysis of rat brain, these authors found that chapsyn-110 has a somatodendritic expression pattern that overlaps partly with PSD95 but that contrasts with the axonal distribution of SAP97. When expressed in mammalian cells, chapsyn-110 and PSD95 each mediated the clustering of both NMDA receptors (e.g., 138249) and potassium channels. Chapsyn-110 and PSD95 heteromultimerized with each other and were recruited into the same NMDA receptor and potassium channel clusters. Kim et al. (1996) suggested that these 2 MAGUK proteins may interact at postsynaptic sites to form a multimeric scaffold for the clustering of receptors, ion channels, and associated signaling proteins. Northern blot analysis indicated that chapsyn-110 is expressed predominantly in the rat brain, where a major 6-kb mRNA and a minor 5-kb mRNA were detected.

Full details of the abovementioned studies are described in the following publications, the disclosure of which are hereby incorporated by reference:

Kim, E.; Cho, K.-O.; Rothschild, A.; Sheng, M.: Heteromultimerization and NMDA receptor-clustering activity of Chapsyn-110, a member of the PSD-95 family of proteins. Neuron 17:103-113, 1996; and Kim, E.; Niethammer, M.; Rothschild, A.; Jan, Y. N.; Sheng, M.: Clustering of Shaker-type K+ channels by interaction with a family of membrane-associated guanylate kinases. Nature 378.

Further studies establishing the function and utilities of DLG2 are found in John Hopkins OMIM database record ID 603583, and in cited publications listed in Table 5, which are hereby incorporated by reference. Dynein, axonemal, heavy polypeptide 11 (DNAH11, Accession NP_003768.1) is another GAM281 target gene, herein designated TARGET GENE. DNAH11 BINDING SITE is a target binding site found in the 3' untranslated region of mRNA encoded by DNAH11, corresponding to a target binding site such as BINDING SITE I, BINDING SITE II or BINDING SITE III of FIG. 8. Table 4 illustrates the complementarity of the nucleotide sequences of DNAH11 BINDING SITE, designated SEQ ID:1214, to the nucleotide sequence of GAM281 RNA, herein designated GAM RNA, also designated SEQ ID:278.

Another function of GAM281 is therefore inhibition of Dynein, axonemal, heavy polypeptide 11 (DNAH11, Accession NP_003768.1), a gene which may function as a motor protein. Accordingly, utilities of GAM281 include diagnosis, prevention and treatment of diseases and clinical conditions associated with DNAH11.

The function of DNAH11 and its association with various diseases and clinical conditions, has been established by previous studies, as described hereinabove with reference to GAM189.1. Dnaj (hsp40) homolog, subfamily b, member 5 (DNAJB5, Accession NP_036398.2) is another GAM281 target gene, herein designated TARGET GENE. DNAJB5 BINDING SITE is a target binding site found in the 3' untranslated region of mRNA encoded by DNAJB5, corresponding to a target binding site such as BINDING SITE I, BINDING SITE II or BINDING SITE III of FIG. 8. Table 4 illustrates the complementarity of the nucleotide sequences of DNAJB5 BINDING SITE, designated SEQ ID:5815, to the nucleotide sequence of GAM281 RNA, herein designated GAM RNA, also designated SEQ ID:278.

Another function of GAM281 is therefore inhibition of Dnaj (hsp40) homolog, subfamily b, member 5 (DNAJB5, Accession NP_036398.2). Accordingly, utilities of GAM281 include diagnosis, prevention and treatment of diseases and clinical conditions associated with DNAJB5.

Dynein, cytoplasmic, light polypeptide 2a (DNCL2A, Accession NP_808853.1) is another GAM281 target gene, herein designated TARGET GENE. DNCL2A BINDING SITE is a target binding site found in the 3' untranslated region of multiple transcripts of mRNA encoded by DNCL2A, corresponding to a target binding site such as BINDING SITE I, BINDING SITE II or BINDING SITE III of FIG. 8. Table 4 illustrates the complementarity of the nucleotide sequences of DNCL2A BINDING SITE, designated SEQ ID:949, to the nucleotide sequence of GAM281 RNA, herein designated GAM RNA, also designated SEQ ID:278.

Another function of GAM281 is therefore inhibition of Dynein, cytoplasmic, light polypeptide 2a (DNCL2A, Accession NP_808853.1). Accordingly, utilities of GAM281 include diagnosis, prevention and treatment of diseases and clinical conditions associated with DNCL2A.

Dolichyl-phosphate mannosyltransferase polypeptide 2, regulatory subunit (DPM2, Accession NP_689903.1) is another GAM281 target gene, herein designated TARGET GENE. DPM2 BINDING SITE is a target binding site found in the 3' untranslated region of multiple transcripts of mRNA encoded by DPM2, corresponding to a target binding site such as BINDING SITE I, BINDING SITE II or BINDING SITE III of FIG. 8. Table 4 illustrates the complementarity of the nucleotide sequences of DPM2 BINDING SITE, designated SEQ ID:3466, to the nucleotide sequence of GAM281 RNA, herein designated GAM RNA, also designated SEQ ID:278.

Another function of GAM281 is therefore inhibition of Dolichyl-phosphate mannosyltransferase polypeptide 2, regulatory subunit (DPM2, Accession NP_689903.1). Accordingly, utilities of GAM281 include diagnosis, prevention and treatment of diseases and clinical conditions associated with DPM2.

DRIM (Accession NP_055318.1) is another GAM281 target gene, herein designated TARGET GENE. DRIM BINDING SITE is a target binding site found in the 3' untranslated region of mRNA encoded by DRIM, corresponding to a target binding site such as BINDING SITE I, BINDING SITE II or BINDING SITE III of FIG. 8. Table 4 illustrates the complementarity of the nucleotide sequences of DRIM BINDING SITE, designated SEQ ID:6633, to the nucleotide sequence of GAM281 RNA, herein designated GAM RNA, also designated SEQ ID:278.

Another function of GAM281 is therefore inhibition of DRIM (Accession NP_055318.1). Accordingly, utilities of GAM281 include diagnosis, prevention and treatment of diseases and clinical conditions associated with DRIM.

Dentatorubral-pallidoluysian atrophy (atrophin-1) (DRPLA, Accession NP_001931.1) is another GAM281 target gene, herein designated TARGET GENE. DRPLA BINDING SITE is a target binding site found in the 5' untranslated region of mRNA encoded by DRPLA, corresponding to a target binding site such as BINDING SITE I, BINDING SITE II or BINDING SITE III of FIG. 8. Table 4 illustrates the complementarity of the nucleotide sequences of DRPLA BINDING SITE, designated SEQ ID:9796, to the nucleotide sequence of GAM281 RNA, herein designated GAM RNA, also designated SEQ ID:278.

Another function of GAM281 is therefore inhibition of Dentatorubral-pallidoluysian atrophy (atrophin-1) (DRPLA, Accession NP_001931.1). Accordingly, utilities of GAM281 include diagnosis, prevention and treatment of diseases and clinical conditions associated with DRPLA.

Desmocollin 3 (DSC3, Accession NP_001932.1) is another GAM281 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:7559, to the nucleotide sequence of GAM281 RNA, herein designated GAM RNA, also designated SEQ ID:278.

Another function of GAM281 is therefore inhibition of Desmocollin 3 (DSC3, Accession NP_001932.1), a gene which is a component of intercellular desmosome junctions. Accordingly, utilities of GAM281 include diagnosis, prevention and treatment of diseases and clinical conditions associated with DSC3.

The function of DSC3 and its association with various diseases and clinical conditions, has been established by previous studies, as described hereinabove with reference to GAM30.1. Desmocollin 3 (DSC3, Accession NP_077741.1) is another GAM281 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:7559, to the nucleotide sequence of GAM281 RNA, herein designated GAM RNA, also designated SEQ ID:278.

Another function of GAM281 is therefore inhibition of Desmocollin 3 (DSC3, Accession NP_077741.1), a gene which is a component of intercellular desmosome junctions. Accordingly, utilities of GAM281 include diagnosis, prevention and treatment of diseases and clinical conditions associated with DSC3.

The function of DSC3 and its association with various diseases and clinical conditions, has been established by previous studies, as described hereinabove with reference to GAM30.1. Down syndrome critical region gene 6 (DSCR6, Accession NP_061835.1) is another GAM281 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:14954, to the nucleotide sequence of GAM281 RNA, herein designated GAM RNA, also designated SEQ ID:278.

Another function of GAM281 is therefore inhibition of Down syndrome critical region gene 6 (DSCR6, Accession NP_061835.1). Accordingly, utilities of GAM281 include diagnosis, prevention and treatment of diseases and clinical conditions associated with DSCR6.

DUPLIN (Accession XP_208760.3) is another GAM281 target gene, herein designated TARGET GENE. DUPLIN BINDING SITE is a target binding site found in the 3' untranslated region of mRNA encoded by DUPLIN, corresponding to a target binding site such as BINDING SITE I, BINDING SITE II or BINDING SITE III of FIG. 8. Table 4 illustrates the complementarity of the nucleotide sequences of DUPLIN BINDING SITE, designated SEQ ID:6863, to the nucleotide sequence of GAM281 RNA, herein designated GAM RNA, also designated SEQ ID:278.

Another function of GAM281 is therefore inhibition of DUPLIN (Accession XP_208760.3). Accordingly, utilities of GAM281 include diagnosis, prevention and treatment of diseases and clinical conditions associated with DUPLIN.

Dual specificity phosphatase 19 (DUSP19, Accession NP_543152.1) is another GAM281 target gene, herein designated TARGET GENE. DUSP19 BINDING SITE1 and DUSP19 BINDING SITE2 are target binding sites found in untranslated regions of mRNA encoded by DUSP19, corresponding to target binding sites such as BINDING SITE I, BINDING SITE II or BINDING SITE III of FIG. 8. Table 4 illustrates the complementarity of the nucleotide sequences of DUSP19 BINDING SITE1 and DUSP19 BINDING SITE2, designated SEQ ID:5768 and SEQ ID:15367 respectively, to the nucleotide sequence of GAM281 RNA, herein designated GAM RNA, also designated SEQ ID:278.

Another function of GAM281 is therefore inhibition of Dual specificity phosphatase 19 (DUSP19, Accession NP_543152.1). Accordingly, utilities of GAM281 include diagnosis, prevention and treatment of diseases and clinical conditions associated with DUSP19.

Dual-specificity tyrosine-(y)-phosphorylation regulated kinase 1a (DYRK1A, Accession NP_567824.1) is another GAM281 target gene, herein designated TARGET GENE. DYRK1A BINDING SITE is a target binding site found in the 5' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:10913, to the nucleotide sequence of GAM281 RNA, herein designated GAM RNA, also designated SEQ ID:278.

Another function of GAM281 is therefore inhibition of Dual-specificity tyrosine-(y)-phosphorylation regulated kinase 1a (DYRK1A, Accession NP_567824.1), a gene which regulates cell proliferation and may be involved in brain development . and therefore may be associated with Down syndrome. Accordingly, utilities of GAM281 include diagnosis, prevention and treatment of Down syndrome, and of other diseases and clinical conditions associated with DYRK1A.

The function of DYRK1A and its association with various diseases and clinical conditions, has been established by previous studies, as described hereinabove with reference to GAM63.1. Endometrial bleeding associated factor (left-right determination, factor a; transforming growth factor beta superfamily) (EBAF, Accession NP_003231.2) is another GAM281 target gene, herein designated TARGET GENE. EBAF BINDING SITE is a target binding site found in the 3' untranslated region of mRNA encoded by EBAF, corresponding to a target binding site such as BINDING SITE I, BINDING SITE II or BINDING SITE III of FIG. 8. Table 4 illustrates the complementarity of the nucleotide sequences of EBAF BINDING SITE, designated SEQ ID:18275, to the nucleotide sequence of GAM281 RNA, herein designated GAM RNA, also designated SEQ ID:278.

Another function of GAM281 is therefore inhibition of Endometrial bleeding associated factor (left-right determination, factor a; transforming growth factor beta superfamily) (EBAF, Accession NP_003231.2), a gene which LEFT-RIGHT AXIS MALFORMATIONS and therefore is associated with Left-right axis malformations. Accordingly, utilities of GAM281 include diagnosis, prevention and treatment of Left-right axis malformations, and of other diseases and clinical conditions associated with EBAF.

The function of EBAF and its association with various diseases and clinical conditions, has been established by previous studies, as described hereinabove with reference to GAM189.1. Endothelial differentiation, sphingolipid g-protein-coupled receptor, 8 (EDG8, Accession NP_110387.1) is another GAM281 target gene, herein designated TARGET GENE. EDG8 BINDING SITE is a target binding site found in the 3' untranslated region of mRNA encoded by EDG8, corresponding to a target binding site such as BINDING SITE I, BINDING SITE II or BINDING SITE III of FIG. 8. Table 4 illustrates the complementarity of the nucleotide sequences of EDG8 BINDING SITE, designated SEQ ID:12263, to the nucleotide sequence of GAM281 RNA, herein designated GAM RNA, also designated SEQ ID:278.

Another function of GAM281 is therefore inhibition of Endothelial differentiation, sphingolipid g-protein-coupled receptor, 8 (EDG8, Accession NP_110387.1). Accordingly, utilities of GAM281 include diagnosis, prevention and treatment of diseases and clinical conditions associated with EDG8.

EEF2K (Accession NP_037434.1) is another GAM281 target gene, herein designated TARGET GENE. EEF2K BINDING SITE is a target binding site found in the 3' untranslated region of mRNA encoded by EEF2K, corresponding to a target binding site such as BINDING SITE I, BINDING SITE II or BINDING SITE III of FIG. 8. Table 4 illustrates the complementarity of the nucleotide sequences of EEF2K BINDING SITE, designated SEQ ID:2595, to the nucleotide sequence of GAM281 RNA, herein designated GAM RNA, also designated SEQ ID:278.

Another function of GAM281 is therefore inhibition of EEF2K (Accession NP_037434.1), a gene which phosphorylates serine or threonine on the eukaryotic elongation factor-2 and therefore may be associated with Systemic lupus erythematosus and cancer. Accordingly, utilities of GAM281 include diagnosis, prevention and treatment of Systemic lupus erythematosus and cancer, and of other diseases and clinical conditions associated with EEF2K.

The function of EEF2K and its association with various diseases and clinical conditions, has been established by previous studies, as described hereinabove with reference to GAM189.1. Egf-like-domain, multiple 4 (EGFL4, Accession XP_290821.1) is another GAM281 target gene, herein designated TARGET GENE. EGFL4 BINDING SITE is a target binding site found in the 5' untranslated region of mRNA encoded by EGFL4, corresponding to a target binding site such as BINDING SITE I, BINDING SITE II or BINDING SITE III of FIG. 8. Table 4 illustrates the complementarity of the nucleotide sequences of EGFL4 BINDING SITE, designated SEQ ID:5780, to the nucleotide sequence of GAM281 RNA, herein designated GAM RNA, also designated SEQ ID:278.

Another function of GAM281 is therefore inhibition of Egf-like-domain, multiple 4 (EGFL4, Accession XP_290821.1). Accordingly, utilities of GAM281 include diagnosis, prevention and treatment of diseases and clinical conditions associated with EGFL4.

Eh-domain containing 1 (EHD1, Accession NP_006786.2) is another GAM281 target gene, herein designated TARGET GENE. EHD1 BINDING SITE is a target binding site found in the 3' untranslated region of mRNA encoded by EHD1, corresponding to a target binding site such as BINDING SITE I, BINDING SITE II or BINDING SITE III of FIG. 8. Table 4 illustrates the complementarity of the nucleotide sequences of EHD1 BINDING SITE, designated SEQ ID:7065, to the nucleotide sequence of GAM281 RNA, herein designated GAM RNA, also designated SEQ ID:278.

Another function of GAM281 is therefore inhibition of Eh-domain containing 1 (EHD1, Accession NP_006786.2), a gene which may be involved in ligand-initiated endocytosis. Accordingly, utilities of GAM281 include diagnosis, prevention and treatment of diseases and clinical conditions associated with EHD1.

The function of EHD1 and its association with various diseases and clinical conditions, has been established by previous studies, as described hereinabove with reference to GAM65.1. Eh-domain containing 2 (EHD2, Accession NP_055416.2) is another GAM281 target gene, herein designated TARGET GENE. EHD2 BINDING SITE is a target binding site found in the 3' untranslated region of mRNA encoded by EHD2, corresponding to a target binding site such as BINDING SITE I, BINDING SITE II or BINDING SITE III of FIG. 8. Table 4 illustrates the complementarity of the nucleotide sequences of EHD2 BINDING SITE, designated SEQ ID:4837, to the nucleotide sequence of GAM281 RNA, herein designated GAM RNA, also designated SEQ ID:278.

Another function of GAM281 is therefore inhibition of Eh-domain containing 2 (EHD2, Accession NP_055416.2). Accordingly, utilities of GAM281 include diagnosis, prevention and treatment of diseases and clinical conditions associated with EHD2.

Eukaryotic translation initiation factor 2c, 1 (EIF2C1, Accession NP_036331.1) is another GAM281 target gene, herein designated TARGET GENE. EIF2C1 BINDING SITE is a target binding site found in the 3' untranslated region of mRNA encoded by EIF2C1, corresponding to a target binding site such as BINDING SITE I, BINDING SITE II or BINDING SITE III of FIG. 8. Table 4 illustrates the complementarity of the nucleotide sequences of EIF2C1 BINDING SITE, designated SEQ ID:2761, to the nucleotide sequence of GAM281 RNA, herein designated GAM RNA, also designated SEQ ID:278.

Another function of GAM281 is therefore inhibition of Eukaryotic translation initiation factor 2c, 1 (EIF2C1, Accession NP_036331.1), a gene which plays an important role in the eukaryotic peptide chain initiation process. Accordingly, utilities of GAM281 include diagnosis, prevention and treatment of diseases and clinical conditions associated with EIF2C1.

The function of EIF2C1 and its association with various diseases and clinical conditions, has been established by previous studies, as described hereinabove with reference to GAM223.1. Eukaryotic translation initiation factor 2, subunit 3 gamma, 52 kda (EIF2S3, Accession NP_001406.1) is another GAM281 target gene, herein designated TARGET GENE. EIF2S3 BINDING SITE is a target binding site found in the 3' untranslated region of mRNA encoded by EIF2S3, corresponding to a target binding site such as BINDING SITE I, BINDING SITE II or BINDING SITE III of FIG. 8. Table 4 illustrates the complementarity of the nucleotide sequences of EIF2S3 BINDING SITE, designated SEQ ID:1744, to the nucleotide sequence of GAM281 RNA, herein designated GAM RNA, also designated SEQ ID:278.

Another function of GAM281 is therefore inhibition of Eukaryotic translation initiation factor 2, subunit 3 gamma, 52 kda (EIF2S3, Accession NP_001406.1), a gene which functions in the early steps of protein synthesis. Accordingly, utilities of GAM281 include diagnosis, prevention and treatment of diseases and clinical conditions associated with EIF2S3.

The function of EIF2S3 and its association with various diseases and clinical conditions, has been established by previous studies, as described hereinabove with reference to GAM189.1. Eukaryotic translation initiation factor 5a2 (EIF5A2, Accession NP_065123.1) is another GAM281 target gene, herein designated TARGET GENE. EIF5A2 BINDING SITE is a target binding site found in the 3' untranslated region of mRNA encoded by EIF5A2, corresponding to a target binding site such as BINDING SITE I, BINDING SITE II or BINDING SITE III of FIG. 8. Table 4 illustrates the complementarity of the nucleotide sequences of EIF5A2 BINDING SITE, designated SEQ ID:8340, to the nucleotide sequence of GAM281 RNA, herein designated GAM RNA, also designated SEQ ID:278.

Another function of GAM281 is therefore inhibition of Eukaryotic translation initiation factor 5a2 (EIF5A2, Accession NP_065123.1). Accordingly, utilities of GAM281 include diagnosis, prevention and treatment of diseases and clinical conditions associated with EIF5A2.

ELP3 (Accession NP_060561.3) is another GAM281 target gene, herein designated TARGET GENE. ELP3 BINDING SITE is a target binding site found in the 3' untranslated region of mRNA encoded by ELP3, corresponding to a target binding site such as BINDING SITE I, BINDING SITE II or BINDING SITE III of FIG. 8. Table 4 illustrates the complementarity of the nucleotide sequences of ELP3 BINDING SITE, designated SEQ ID:14236, to the nucleotide sequence of GAM281 RNA, herein designated GAM RNA, also designated SEQ ID:278.

Another function of GAM281 is therefore inhibition of ELP3 (Accession NP_060561.3). Accordingly, utilities of GAM281 include diagnosis, prevention and treatment of diseases and clinical conditions associated with ELP3.

Egf-like module containing, mucin-like, hormone receptor-like sequence 2 (EMR2, Accession NP_690881.1) is another GAM281 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:13462, to the nucleotide sequence of GAM281 RNA, herein designated GAM RNA, also designated SEQ ID:278.

Another function of GAM281 is therefore inhibition of Egf-like module containing, mucin-like, hormone receptor-like sequence 2 (EMR2, Accession NP_690881.1). Accordingly, utilities of GAM281 include diagnosis, prevention and treatment of diseases and clinical conditions associated with EMR2.

Egf-like module containing, mucin-like, hormone receptor-like sequence 2 (EMR2, Accession NP_038475.2) is another GAM281 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:13462, to the nucleotide sequence of GAM281 RNA, herein designated GAM RNA, also designated SEQ ID:278.

Another function of GAM281 is therefore inhibition of Egf-like module containing, mucin-like, hormone receptor-like sequence 2 (EMR2, Accession NP_038475.2). Accordingly, utilities of GAM281 include diagnosis, prevention and treatment of diseases and clinical conditions associated with EMR2.

Egf-like module containing, mucin-like, hormone receptor-like sequence 2 (EMR2, Accession NP_690885.1) is another GAM281 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:13462, to the nucleotide sequence of GAM281 RNA, herein designated GAM RNA, also designated SEQ ID:278.

Another function of GAM281 is therefore inhibition of Egf-like module containing, mucin-like, hormone receptor-like sequence 2 (EMR2, Accession NP_690885.1). Accordingly, utilities of GAM281 include diagnosis, prevention and treatment of diseases and clinical conditions associated with EMR2.

Egf-like module containing, mucin-like, hormone receptor-like sequence 2 (EMR2, Accession NP_690883.1) is another GAM281 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:13462, to the nucleotide sequence of GAM281 RNA, herein designated GAM RNA, also designated SEQ ID:278.

Another function of GAM281 is therefore inhibition of Egf-like module containing, mucin-like, hormone receptor-like sequence 2 (EMR2, Accession NP_690883.1). Accordingly, utilities of GAM281 include diagnosis, prevention and treatment of diseases and clinical conditions associated with EMR2.

Egf-like module containing, mucin-like, hormone receptor-like sequence 2 (EMR2, Accession NP_690882.1) is another GAM281 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:13462, to the nucleotide sequence of GAM281 RNA, herein designated GAM RNA, also designated SEQ ID:278.

Another function of GAM281 is therefore inhibition of Egf-like module containing, mucin-like, hormone receptor-like sequence 2 (EMR2, Accession NP_690882.1). Accordingly, utilities of GAM281 include diagnosis, prevention and treatment of diseases and clinical conditions associated with EMR2.

Egf-like module containing, mucin-like, hormone receptor-like sequence 2 (EMR2, Accession NP_690884.1) is another GAM281 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:13462, to the nucleotide sequence of GAM281 RNA, herein designated GAM RNA, also designated SEQ ID:278.

Another function of GAM281 is therefore inhibition of Egf-like module containing, mucin-like, hormone receptor-like sequence 2 (EMR2, Accession NP_690884.1). Accordingly, utilities of GAM281 include diagnosis, prevention and treatment of diseases and clinical conditions associated with EMR2.

Egf-like module containing, mucin-like, hormone receptor-like sequence 2 (EMR2, Accession NP_690880.1) is another GAM281 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:13462, to the nucleotide sequence of GAM281 RNA, herein designated GAM RNA, also designated SEQ ID:278.

Another function of GAM281 is therefore inhibition of Egf-like module containing, mucin-like, hormone receptor-like sequence 2 (EMR2, Accession NP_690880.1). Accordingly, utilities of GAM281 include diagnosis, prevention and treatment of diseases and clinical conditions associated with EMR2.

Endonuclease g-like 1 (ENDOGL1, Accession NP_005098.1) is another GAM281 target gene, herein designated TARGET GENE. ENDOGL1 BINDING SITE is a target binding site found in the 3' untranslated region of mRNA encoded by ENDOGL1, corresponding to a target binding site such as BINDING SITE I, BINDING SITE II or BINDING SITE III of FIG. 8. Table 4 illustrates the complementarity of the nucleotide sequences of ENDOGL1 BINDING SITE, designated SEQ ID:5031, to the nucleotide sequence of GAM281 RNA, herein designated GAM RNA, also designated SEQ ID:278.

Another function of GAM281 is therefore inhibition of Endonuclease g-like 1 (ENDOGL1, Accession NP_005098.1). Accordingly, utilities of GAM281 include diagnosis, prevention and treatment of diseases and clinical conditions associated with ENDOGL1.

Epiregulin (EREG, Accession NP_001423.1) is another GAM281 target gene, herein designated TARGET GENE. EREG BINDING SITE is a target binding site found in the 3' untranslated region of mRNA encoded by EREG, corresponding to a target binding site such as BINDING SITE I, BINDING SITE II or BINDING SITE III of FIG. 8. Table 4 illustrates the complementarity of the nucleotide sequences of EREG BINDING SITE, designated SEQ ID:17956, to the nucleotide sequence of GAM281 RNA, herein designated GAM RNA, also designated SEQ ID:278.

Another function of GAM281 is therefore inhibition of Epiregulin (EREG, Accession NP_001423.1). Accordingly, utilities of GAM281 include diagnosis, prevention and treatment of diseases and clinical conditions associated with EREG.

ERN2 (Accession NP_150296.1) is another GAM281 target gene, herein designated TARGET GENE. ERN2 BINDING SITE is a target binding site found in the 5' untranslated region of mRNA encoded by ERN2, corresponding to a target binding site such as BINDING SITE I, BINDING SITE II or BINDING SITE III of FIG. 8. Table 4 illustrates the complementarity of the nucleotide sequences of ERN2 BINDING SITE, designated SEQ ID:12665, to the nucleotide sequence of GAM281 RNA, herein designated GAM RNA, also designated SEQ ID:278.

Another function of GAM281 is therefore inhibition of ERN2 (Accession NP_150296.1). Accordingly, utilities of GAM281 include diagnosis, prevention and treatment of diseases and clinical conditions associated with ERN2.

Ero1-like (s. cerevisiae) (ERO1L, Accession NP_055399.1) is another GAM281 target gene, herein designated TARGET GENE. ERO1L BINDING SITE is a target binding site found in the 5' untranslated region of mRNA encoded by ERO1L, corresponding to a target binding site such as BINDING SITE I, BINDING SITE II or BINDING SITE III of FIG. 8. Table 4 illustrates the complementarity of the nucleotide sequences of ERO1L BINDING SITE, designated SEQ ID:11477, to the nucleotide sequence of GAM281 RNA, herein designated GAM RNA, also designated SEQ ID:278.

Another function of GAM281 is therefore inhibition of Ero1-like (s. cerevisiae) (ERO1L, Accession NP_055399.1).

Accordingly, utilities of GAM281 include diagnosis, prevention and treatment of diseases and clinical conditions associated with ERO1L.

Extra spindle poles like 1 (s. cerevisiae) (ESPL1, Accession NP_036423.1) is another GAM281 target gene, herein designated TARGET GENE. ESPL1 BINDING SITE is a target binding site found in the 5' untranslated region of mRNA encoded by ESPL1, corresponding to a target binding site such as BINDING SITE I, BINDING SITE II or BINDING SITE III of FIG. 8. Table 4 illustrates the complementarity of the nucleotide sequences of ESPL1 BINDING SITE, designated SEQ ID:20090, to the nucleotide sequence of GAM281 RNA, herein designated GAM RNA, also designated SEQ ID:278.

Another function of GAM281 is therefore inhibition of Extra spindle poles like 1 (s. cerevisiae) (ESPL1, Accession NP_036423.1) . Accordingly, utilities of GAM281 include diagnosis, prevention and treatment of diseases and clinical conditions associated with ESPL1.

Ellis van creveld syndrome (EVC, Accession NP_714928.1) is another GAM281 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:18115, to the nucleotide sequence of GAM281 RNA, herein designated GAM RNA, also designated SEQ ID:278.

Another function of GAM281 is therefore inhibition of Ellis van creveld syndrome (EVC, Accession NP_714928.1). Accordingly, utilities of GAM281 include diagnosis, prevention and treatment of diseases and clinical conditions associated with EVC.

Ellis van creveld syndrome (EVC, Accession NP_055371.1) is another GAM281 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:18115, to the nucleotide sequence of GAM281 RNA, herein designated GAM RNA, also designated SEQ ID:278.

Another function of GAM281 is therefore inhibition of Ellis van creveld syndrome (EVC, Accession NP_055371.1). Accordingly, utilities of GAM281 include diagnosis, prevention and treatment of diseases and clinical conditions associated with EVC.

EVER1 (Accession NP_009198.3) is another GAM281 target gene, herein designated TARGET GENE. EVER1 BINDING SITE is a target binding site found in the 3' untranslated region of mRNA encoded by EVER1, corresponding to a target binding site such as BINDING SITE I, BINDING SITE II or BINDING SITE III of FIG. 8. Table 4 illustrates the complementarity of the nucleotide sequences of EVER1 BINDING SITE, designated SEQ ID:14255, to the nucleotide sequence of GAM281 RNA, herein designated GAM RNA, also designated SEQ ID:278.

Another function of GAM281 is therefore inhibition of EVER1 (Accession NP_009198.3). Accordingly, utilities of GAM281 include diagnosis, prevention and treatment of diseases and clinical conditions associated with EVER1.

Ecotropic viral integration site 5 (EVI5, Accession NP_005656.2) is another GAM281 target gene, herein designated TARGET GENE. EVI5 BINDING SITE1 and EVI5 BINDING SITE2 are target binding sites found in untranslated regions of mRNA encoded by EVI5, corresponding to target binding sites such as BINDING SITE I, BINDING SITE II or BINDING SITE III of FIG. 8. Table 4 illustrates the complementarity of the nucleotide sequences of EVI5 BINDING SITE1 and EVI5 BINDING SITE2, designated SEQ ID:11607 and SEQ ID:7219 respectively, to the nucleotide sequence of GAM281 RNA, herein designated GAM RNA, also designated SEQ ID:278.

Another function of GAM281 is therefore inhibition of Ecotropic viral integration site 5 (EVI5, Accession NP_005656.2). Accordingly, utilities of GAM281 include diagnosis, prevention and treatment of diseases and clinical conditions associated with EVI5.

F11R (Accession NP_058642.1) is another GAM281 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM281 RNA, herein designated GAM RNA, also designated SEQ ID:278.

Another function of GAM281 is therefore inhibition of F11R (Accession NP_058642.1). Accordingly, utilities of GAM281 include diagnosis, prevention and treatment of diseases and clinical conditions associated with F11R.

F11R (Accession NP_653087.1) is another GAM281 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM281 RNA, herein designated GAM RNA, also designated SEQ ID:278.

Another function of GAM281 is therefore inhibition of F11R (Accession NP_653087.1). Accordingly, utilities of GAM281 include diagnosis, prevention and treatment of diseases and clinical conditions associated with F11R.

F11R (Accession NP_653086.1) is another GAM281 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM281 RNA, herein designated GAM RNA, also designated SEQ ID:278.

Another function of GAM281 is therefore inhibition of F11R (Accession NP_653086.1). Accordingly, utilities of GAM281 include diagnosis, prevention and treatment of diseases and clinical conditions associated with F11R.

F11R (Accession NP_653085.1) is another GAM281 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM281 RNA, herein designated GAM RNA, also designated SEQ ID:278.

Another function of GAM281 is therefore inhibition of F11R (Accession NP_653085.1). Accordingly, utilities of GAM281 include diagnosis, prevention and treatment of diseases and clinical conditions associated with F11R.

Coagulation factor ii (thrombin) receptor-like 2 (F2RL2, Accession NP_004092.1) is another GAM281 target gene, herein designated TARGET GENE. F2RL2 BINDING SITE is a target binding site found in the 3' untranslated region of mRNA encoded by F2RL2, corresponding to a target binding site such as BINDING SITE I, BINDING SITE II or BINDING SITE III of FIG. 8. Table 4 illustrates the complementarity of the nucleotide sequences of F2RL2 BINDING SITE, designated SEQ ID:10122, to the nucleotide sequence of GAM281 RNA, herein designated GAM RNA, also designated SEQ ID:278.

Another function of GAM281 is therefore inhibition of Coagulation factor ii (thrombin) receptor-like 2 (F2RL2, Accession NP_004092.1), a gene which receptor for activated thrombin coupled to g proteins that stimulate phosphoinositide hydrolysis. Accordingly, utilities of GAM281 include diagnosis, prevention and treatment of diseases and clinical conditions associated with F2RL2.

The function of F2RL2 and its association with various diseases and clinical conditions, has been established by previous studies, as described hereinabove with reference to GAM136.1. Coagulation factor ii (thrombin) receptor-like 3 (F2RL3, Accession NP_003941.1) is another GAM281 target gene, herein designated TARGET GENE. F2RL3 BINDING SITE is a target binding site found in the 3' untranslated region of mRNA encoded by F2RL3, corresponding to a target binding site such as BINDING SITE I, BINDING SITE II or BINDING SITE III of FIG. 8. Table 4 illustrates the complementarity of the nucleotide sequences of F2RL3 BINDING SITE, designated SEQ ID:4234, to the nucleotide sequence of GAM281 RNA, herein designated GAM RNA, also designated SEQ ID:278.

Another function of GAM281 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM281 include diagnosis, prevention and treatment of diseases and clinical conditions associated with F2RL3.

The function of F2RL3 and its association with various diseases and clinical conditions, has been established by previous studies, as described hereinabove with reference to GAM72.1. Coagulation factor iii (thromboplastin, tissue factor) (F3, Accession NP_001984.1) is another GAM281 target gene, herein designated TARGET GENE. F3 BINDING SITE is a target binding site found in the 3' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:18492, to the nucleotide sequence of GAM281 RNA, herein designated GAM RNA, also designated SEQ ID:278.

Another function of GAM281 is therefore inhibition of Coagulation factor iii (thromboplastin, tissue factor) (F3, Accession NP_001984.1), a gene which functions in normal hemostasis. Accordingly, utilities of GAM281 include diagnosis, prevention and treatment of diseases and clinical conditions associated with F3.

The function of F3 and its association with various diseases and clinical conditions, has been established by previous studies, as described hereinabove with reference to GAM136.1. Coagulation factor v (proaccelerin, labile factor) (F5, Accession NP_000121.1) is another GAM281 target gene, herein designated TARGET GENE. F5 BINDING SITE is a target binding site found in the 5' untranslated region of mRNA encoded by F5, corresponding to a target binding site such as BINDING SITE I, BINDING SITE II or BINDING SITE III of FIG. 8. Table 4 illustrates the complementarity of the nucleotide sequences of F5 BINDING SITE, designated SEQ ID:7269, to the nucleotide sequence of GAM281 RNA, herein designated GAM RNA, also designated SEQ ID:278.

Another function of GAM281 is therefore inhibition of Coagulation factor v (proaccelerin, labile factor) (F5, Accession NP_000121.1). Accordingly, utilities of GAM281 include diagnosis, prevention and treatment of diseases and clinical conditions associated with F5.

Fatty acid binding protein 2, intestinal (FABP2, Accession NP_000125.1) is another GAM281 target gene, herein designated TARGET GENE. FABP2 BINDING SITE is a target binding site found in the 3' untranslated region of mRNA encoded by FABP2, corresponding to a target binding site such as BINDING SITE I, BINDING SITE II or BINDING SITE III of FIG. 8. Table 4 illustrates the complementarity of the nucleotide sequences of FABP2 BINDING SITE, designated SEQ ID:2195, to the nucleotide sequence of GAM281 RNA, herein designated GAM RNA, also designated SEQ ID:278.

Another function of GAM281 is therefore inhibition of Fatty acid binding protein 2, intestinal (FABP2, Accession NP_000125.1), a gene which may have a role in dietary fat uptake or processing. and therefore may be associated with Cardiovascular disease and type 2 diabetes. Accordingly, utilities of GAM281 include diagnosis, prevention and treatment of Cardiovascular disease and type 2 diabetes, and of other diseases and clinical conditions associated with FABP2.

The function of FABP2 and its association with various diseases and clinical conditions, has been established by previous studies, as described hereinabove with reference to GAM189.1. Family with sequence similarity 13, member a1 (FAM13A1, Accession NP_055698.1) is another GAM281 target gene, herein designated TARGET GENE. FAM13A1 BINDING SITE is a target binding site found in the 3' untranslated region of mRNA encoded by FAM13A1, corresponding to a target binding site such as BINDING SITE I, BINDING SITE II or BINDING SITE III of FIG. 8. Table 4 illustrates the complementarity of the nucleotide sequences of FAM13A1 BINDING SITE, designated SEQ ID:9972, to the nucleotide sequence of GAM281 RNA, herein designated GAM RNA, also designated SEQ ID:278.

Another function of GAM281 is therefore inhibition of Family with sequence similarity 13, member a1 (FAM13A1, Accession NP_055698.1). Accordingly, utilities of GAM281 include diagnosis, prevention and treatment of diseases and clinical conditions associated with FAM13A1.

Fanconi anemia, complementation group c (FANCC, Accession NP_000127.1) is another GAM281 target gene, herein designated TARGET GENE. FANCC BINDING SITE is a target binding site found in the 3' untranslated region of mRNA encoded by FANCC, corresponding to a target binding site such as BINDING SITE I, BINDING SITE II or BINDING SITE III of FIG. 8. Table 4 illustrates the complementarity of the nucleotide sequences of FANCC BINDING SITE, designated SEQ ID:15368, to the nucleotide sequence of GAM281 RNA, herein designated GAM RNA, also designated SEQ ID:278.

Another function of GAM281 is therefore inhibition of Fanconi anemia, complementation group c (FANCC, Accession NP_000127.1). Accordingly, utilities of GAM281 include diagnosis, prevention and treatment of diseases and clinical conditions associated with FANCC.

Fanconi anemia, complementation group e (FANCE, Accession NP_068741.1) is another GAM281 target gene, herein designated TARGET GENE. FANCE BINDING SITE is a target binding site found in the 3' untranslated region of mRNA encoded by FANCE, corresponding to a target binding site such as BINDING SITE I, BINDING SITE II or BINDING SITE III of FIG. 8. Table 4 illustrates the complementarity of the nucleotide sequences of FANCE BINDING SITE, designated SEQ ID:5597, to the nucleotide sequence of GAM281 RNA, herein designated GAM RNA, also designated SEQ ID:278.

Another function of GAM281 is therefore inhibition of Fanconi anemia, complementation group e (FANCE, Accession NP_068741.1), a gene which is a possible regulator of lymphocyte and platelet function. and therefore is associated with Fanconi anemia, complementation group e. Accordingly, utilities of GAM281 include diagnosis, prevention and treatment of Fanconi anemia, complementation group e., and of other diseases and clinical conditions associated with FANCE.

The function of FANCE and its association with various diseases and clinical conditions, has been established by previous studies, as described hereinabove with reference to GAM189.1. Fanconi anemia, complementation group f (FANCF, Accession NP_073562.1) is another GAM281 target gene, herein designated TARGET GENE. FANCF BINDING SITE is a target binding site found in the 3' untranslated region of mRNA encoded by FANCF, corresponding to a target binding site such as BINDING SITE I, BINDING SITE II or BINDING SITE III of FIG. 8. Table 4 illustrates the complementarity of the nucleotide sequences of FANCF BINDING SITE, designated SEQ ID:5816, to the nucleotide sequence of GAM281 RNA, herein designated GAM RNA, also designated SEQ ID:278.

Another function of GAM281 is therefore inhibition of Fanconi anemia, complementation group f (FANCF, Accession NP_073562.1). Accordingly, utilities of GAM281 include diagnosis, prevention and treatment of diseases and clinical conditions associated with FANCF.

FAT3 (Accession XP_061871.5) is another GAM281 target gene, herein designated TARGET GENE. FAT3 BINDING SITE is a target binding site found in the 3' untranslated region of mRNA encoded by FAT3, corresponding to a target binding site such as BINDING SITE I, BINDING SITE II or BINDING SITE III of FIG. 8. Table 4 illustrates the complementarity of the nucleotide sequences of FAT3 BINDING SITE, designated SEQ ID:8236, to the nucleotide sequence of GAM281 RNA, herein designated GAM RNA, also designated SEQ ID:278.

Another function of GAM281 is therefore inhibition of FAT3 (Accession XP_061871.5). Accordingly, utilities of GAM281 include diagnosis, prevention and treatment of diseases and clinical conditions associated with FAT3.

F-box and leucine-rich repeat protein 7 (FBXL7, Accession NP_036436.1) is another GAM281 target gene, herein designated TARGET GENE. FBXL7 BINDING SITE is a target binding site found in the 3' untranslated region of mRNA encoded by FBXL7, corresponding to a target binding site such as BINDING SITE I, BINDING SITE II or BINDING SITE III of FIG. 8. Table 4 illustrates the complementarity of the nucleotide sequences of FBXL7 BINDING SITE, designated SEQ ID:11584, to the nucleotide sequence of GAM281 RNA, herein designated GAM RNA, also designated SEQ ID:278.

Another function of GAM281 is therefore inhibition of F-box and leucine-rich repeat protein 7 (FBXL7, Accession NP_036436.1), a gene which may be involved in in phosphorylation-dependent ubiquitination. Accordingly, utilities of GAM281 include diagnosis, prevention and treatment of diseases and clinical conditions associated with FBXL7.

The function of FBXL7 and its association with various diseases and clinical conditions, has been established by previous studies, as described hereinabove with reference to GAM40.1. F-box only protein 27 (FBXO27, Accession XP_059045.1) is another GAM281 target gene, herein designated TARGET GENE. FBXO27 BINDING SITE is a target binding site found in the 3' untranslated region of multiple transcripts of mRNA encoded by FBXO27, corresponding to a target binding site such as BINDING SITE I, BINDING SITE II or BINDING SITE III of FIG. 8. Table 4 illustrates the complementarity of the nucleotide sequences of FBXO27 BINDING SITE, designated SEQ ID:16526, to the nucleotide sequence of GAM281 RNA, herein designated GAM RNA, also designated SEQ ID:278.

Another function of GAM281 is therefore inhibition of F-box only protein 27 (FBXO27, Accession XP_059045.1). Accordingly, utilities of GAM281 include diagnosis, prevention and treatment of diseases and clinical conditions associated with FBXO27.

F-box only protein 27 (FBXO27, Accession NP_849142.1) is another GAM281 target gene, herein designated TARGET GENE. FBXO27 BINDING SITE is a target binding site found in the 3' untranslated region of multiple transcripts of mRNA encoded by FBXO27, corresponding to a target binding site such as BINDING SITE I, BINDING SITE II or BINDING SITE III of FIG. 8. Table 4 illustrates the complementarity of the nucleotide sequences of FBXO27 BINDING SITE, designated SEQ ID:16526, to the nucleotide sequence of GAM281 RNA, herein designated GAM RNA, also designated SEQ ID:278.

Another function of GAM281 is therefore inhibition of F-box only protein 27 (FBXO27, Accession NP_849142.1). Accordingly, utilities of GAM281 include diagnosis, prevention and treatment of diseases and clinical conditions associated with FBXO27.

Fc fragment of iga, receptor for (FCAR, Accession NP_579811.1) is another GAM281 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10448, SEQ ID:10448 and SEQ ID:10448 respectively, to the nucleotide sequence of GAM281 RNA, herein designated GAM RNA, also designated SEQ ID:278.

Another function of GAM281 is therefore inhibition of Fc fragment of iga, receptor for (FCAR, Accession NP_579811.1), a gene which binds to the fc region of immunoglobulins alpha and mediates several functions including cytokine production. and therefore may be associated with Iga nephropathy. Accordingly, utilities of GAM281 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579803.1) is another GAM281 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10448, SEQ ID:10448 and SEQ ID:10448 respectively, to the nucleotide sequence of GAM281 RNA, herein designated GAM RNA, also designated SEQ ID:278.

Another function of GAM281 is therefore inhibition of Fc fragment of iga, receptor for (FCAR, Accession NP_579803.1), a gene which binds to the fc region of immunoglobulins alpha and mediates several functions including cytokine production. and therefore may be associated with Iga nephropathy. Accordingly, utilities of GAM281 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_001991.1) is another GAM281 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:3819, SEQ ID:17643 and SEQ ID:17643 respectively, to the nucleotide sequence of GAM281 RNA, herein designated GAM RNA, also designated SEQ ID:278.

Another function of GAM281 is therefore inhibition of Fc fragment of iga, receptor for (FCAR, Accession NP_001991.1), a gene which binds to the fc region of immunoglobulins alpha and mediates several functions including cytokine production. and therefore may be associated with Iga nephropathy. Accordingly, utilities of GAM281 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579807.1) is another GAM281 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10448, SEQ ID:497 and SEQ ID:2141 respectively, to the nucleotide sequence of GAM281 RNA, herein designated GAM RNA, also designated SEQ ID:278.

Another function of GAM281 is therefore inhibition of Fc fragment of iga, receptor for (FCAR, Accession NP_579807.1), a gene which binds to the fc region of immunoglobulins alpha and mediates several functions including cytokine production. and therefore may be associated with Iga nephropathy. Accordingly, utilities of GAM281 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fer-1-like 4 (c. elegans) (FER1L4, Accession XP_300246.1) is another GAM281 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:11291, to the nucleotide sequence of GAM281 RNA, herein designated GAM RNA, also designated SEQ ID:278.

Another function of GAM281 is therefore inhibition of Fer-1-like 4 (c. elegans) (FER1L4, Accession XP_300246.1). Accordingly, utilities of GAM281 include diagnosis, prevention and treatment of diseases and clinical conditions associated with FER1L4.

Fer-1-like 4 (c. elegans) (FER1L4, Accession XP_300246.1) is another GAM281 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:11291, to the nucleotide sequence of GAM281 RNA, herein designated GAM RNA, also designated SEQ ID:278.

Another function of GAM281 is therefore inhibition of Fer-1-like 4 (c. elegans) (FER1L4, Accession XP_300246.1). Accordingly, utilities of GAM281 include diagnosis, prevention and treatment of diseases and clinical conditions associated with FER1L4.

Fasciculation and elongation protein zeta 1 (zygin i) (FEZ1, Accession NP_072043.1) is another GAM281 target gene, herein designated TARGET GENE. FEZ1 BINDING SITE is a target binding site found in the 3' untranslated region of multiple transcripts of mRNA encoded by FEZ1, corresponding to a target binding site such as BINDING SITE I, BINDING SITE II or BINDING SITE III of FIG. 8. Table 4 illustrates the complementarity of the nucleotide sequences of FEZ1 BINDING SITE, designated SEQ ID:5204, to the nucleotide sequence of GAM281 RNA, herein designated GAM RNA, also designated SEQ ID:278.

Another function of GAM281 is therefore inhibition of Fasciculation and elongation protein zeta 1 (zygin i) (FEZ1, Accession NP_072043.1), a gene which Zygin 1; may have a role in axonal outgrowth; has similarity to C. elegans UNC-76. Accordingly, utilities of GAM281 include diagnosis, prevention and treatment of diseases and clinical conditions associated with FEZ1.

The function of FEZ1 and its association with various diseases and clinical conditions, has been established by previous studies, as described hereinabove with reference to GAM30.1. Fibroblast growth factor 2 (basic) (FGF2, Accession NP_001997.3) is another GAM281 target gene, herein designated TARGET GENE. FGF2 BINDING SITE is a target binding site found in the 3' untranslated region of mRNA encoded by FGF2, corresponding to a target binding site such as BINDING SITE I, BINDING SITE II or BINDING SITE III of FIG. 8. Table 4 illustrates the complementarity of the nucleotide sequences of FGF2 BINDING SITE, designated SEQ ID:11604, to the nucleotide sequence of GAM281 RNA, herein designated GAM RNA, also designated SEQ ID:278.

Another function of GAM281 is therefore inhibition of Fibroblast growth factor 2 (basic) (FGF2, Accession NP_001997.3), a gene which the Basic fibroblast growth factor 2; is mitogenic, angiogenic, and neurotrophic factor. Accordingly, utilities of GAM281 include diagnosis, prevention and treatment of diseases and clinical conditions associated with FGF2.

The function of FGF2 and its association with various diseases and clinical conditions, has been established by previous studies, as described hereinabove with reference to GAM36.1. Fibroblast growth factor 5 (FGF5, Accession NP_004455.1) is another GAM281 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:14382, to the nucleotide sequence of GAM281 RNA, herein designated GAM RNA, also designated SEQ ID:278.

Another function of GAM281 is therefore inhibition of Fibroblast growth factor 5 (FGF5, Accession NP_004455.1), a gene which induces transformation and may regulate neuronal differentiation. Accordingly, utilities of GAM281 include diagnosis, prevention and treatment of diseases and clinical conditions associated with FGF5.

The function of FGF5 and its association with various diseases and clinical conditions, has been established by previous studies, as described hereinabove with reference to GAM106.1. Fibroblast growth factor 5 (FGF5, Accession NP_149134.1) is another GAM281 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:14382, to the nucleotide sequence of GAM281 RNA, herein designated GAM RNA, also designated SEQ ID:278.

Another function of GAM281 is therefore inhibition of Fibroblast growth factor 5 (FGF5, Accession NP_149134.1), a gene which induces transformation and may regulate neuronal differentiation. Accordingly, utilities of GAM281 include diagnosis, prevention and treatment of diseases and clinical conditions associated with FGF5.

The function of FGF5 and its association with various diseases and clinical conditions, has been established by previous studies, as described hereinabove with reference to GAM106.1. Four and a half lim domains 2 (FHL2, Accession NP_001441.2) is another GAM281 target gene, herein designated TARGET GENE. FHL2 BINDING SITE is a target binding site found in the 5' untranslated region of mRNA encoded by FHL2, corresponding to a target binding site such as BINDING SITE I, BINDING SITE II or BINDING SITE III of FIG. 8. Table 4 illustrates the complementarity of the nucleotide sequences of FHL2 BINDING SITE, designated SEQ ID:16589, to the nucleotide sequence of GAM281 RNA, herein designated GAM RNA, also designated SEQ ID:278.

Another function of GAM281 is therefore inhibition of Four and a half lim domains 2 (FHL2, Accession NP_001441.2), a gene which Contains four LIM domains and an additional zinc finger. Accordingly, utilities of GAM281 include diagnosis, prevention and treatment of diseases and clinical conditions associated with FHL2.

The function of FHL2 and its association with various diseases and clinical conditions, has been established by previous studies, as described hereinabove with reference to GAM189.1. FISH (Accession NP_055446.1) is another GAM281 target gene, herein designated TARGET GENE. FISH BINDING SITE is a target binding site found in the 5' untranslated region of mRNA encoded by FISH, corresponding to a target binding site such as BINDING SITE I, BINDING SITE II or BINDING SITE III of FIG. 8. Table 4 illustrates the complementarity of the nucleotide sequences of FISH BINDING SITE, designated SEQ ID:13261, to the nucleotide sequence of GAM281 RNA, herein designated GAM RNA, also designated SEQ ID:278.

Another function of GAM281 is therefore inhibition of FISH (Accession NP_055446.1). Accordingly, utilities of GAM281 include diagnosis, prevention and treatment of diseases and clinical conditions associated with FISH.

Fk506 binding protein 9, 63 kda (FKBP9, Accession NP_009201.1) is another GAM281 target gene, herein designated TARGET GENE. FKBP9 BINDING SITE is a target binding site found in the 3' untranslated region of mRNA encoded by FKBP9, corresponding to a target binding site such as BINDING SITE I, BINDING SITE II or BINDING SITE III of FIG. 8. Table 4 illustrates the complementarity of the nucleotide sequences of FKBP9 BINDING SITE, designated SEQ ID:7851, to the nucleotide sequence of GAM281 RNA, herein designated GAM RNA, also designated SEQ ID:278.

Another function of GAM281 is therefore inhibition of Fk506 binding protein 9, 63 kda (FKBP9, Accession NP_009201.1) . Accordingly, utilities of GAM281 include diagnosis, prevention and treatment of diseases and clinical conditions associated with FKBP9.

FLJ00060 (Accession XP_028154.1) is another GAM281 target gene, herein designated TARGET GENE. FLJ00060 BINDING SITE is a target binding site found in the 5' untranslated region of mRNA encoded by FLJ00060, corresponding to a target binding site such as BINDING SITE I, BINDING SITE II or BINDING SITE III of FIG. 8. Table 4 illustrates the complementarity of the nucleotide sequences of FLJ00060 BINDING SITE, designated SEQ ID:11528, to the nucleotide sequence of GAM281 RNA, herein designated GAM RNA, also designated SEQ ID:278.

Another function of GAM281 is therefore inhibition of FLJ00060 (Accession XP_028154.1). Accordingly, utilities of GAM281 include diagnosis, prevention and treatment of diseases and clinical conditions associated with FLJ00060.

FLJ10101 (Accession NP_078994.1) is another GAM281 target gene, herein designated TARGET GENE. FLJ10101 BINDING SITE is a target binding site found in the 3' untranslated region of mRNA encoded by FLJ10101, corresponding to a target binding site such as BINDING SITE I, BINDING SITE II or BINDING SITE III of FIG. 8. Table 4 illustrates the complementarity of the nucleotide sequences of FLJ10101 BINDING SITE, designated SEQ ID:9189, to the nucleotide sequence of GAM281 RNA, herein designated GAM RNA, also designated SEQ ID:278.

Another function of GAM281 is therefore inhibition of FLJ10101 (Accession NP_078994.1). Accordingly, utilities of GAM281 include diagnosis, prevention and treatment of diseases and clinical conditions associated with FLJ10101.

FLJ10232 (Accession NP_060503.1) is another GAM281 target gene, herein designated TARGET GENE. FLJ10232 BINDING SITE is a target binding site found in the 3' untranslated region of mRNA encoded by FLJ10232, corresponding to a target binding site such as BINDING SITE I, BINDING SITE II or BINDING SITE III of FIG. 8. Table 4 illustrates the complementarity of the nucleotide sequences of FLJ10232 BINDING SITE, designated SEQ ID:19236, to the nucleotide sequence of GAM281 RNA, herein designated GAM RNA, also designated SEQ ID:278.

Another function of GAM281 is therefore inhibition of FLJ10232 (Accession NP_060503.1). Accordingly, utilities of GAM281 include diagnosis, prevention and treatment of diseases and clinical conditions associated with FLJ10232.

FLJ10298 (Accession NP_060520.2) is another GAM281 target gene, herein designated TARGET GENE. FLJ10298 BINDING SITE is a target binding site found in the 3' untranslated region of mRNA encoded by FLJ10298, corresponding to a target binding site such as BINDING SITE I, BINDING SITE II or BINDING SITE III of FIG. 8. Table 4 illustrates the complementarity of the nucleotide sequences of FLJ10298 BINDING SITE, designated SEQ ID:2615, to the nucleotide sequence of GAM281 RNA, herein designated GAM RNA, also designated SEQ ID:278.

Another function of GAM281 is therefore inhibition of FLJ10298 (Accession NP_060520.2). Accordingly, utilities of GAM281 include diagnosis, prevention and treatment of diseases and clinical conditions associated with FLJ10298.

FLJ10346 (Accession NP_060535.1) is another GAM281 target gene, herein designated TARGET GENE. FLJ10346 BINDING SITE is a target binding site found in the 5' untranslated region of mRNA encoded by FLJ10346, corresponding to a target binding site such as BINDING SITE I, BINDING SITE II or BINDING SITE III of FIG. 8. Table 4 illustrates the complementarity of the nucleotide sequences of FLJ10346 BINDING SITE, designated SEQ ID:19219, to the nucleotide sequence of GAM281 RNA, herein designated GAM RNA, also designated SEQ ID:278.

Another function of GAM281 is therefore inhibition of FLJ10346 (Accession NP_060535.1). Accordingly, utilities of GAM281 include diagnosis, prevention and treatment of diseases and clinical conditions associated with FLJ10346.

FLJ10520 (Accession NP_060594.2) is another GAM281 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:4272, to the nucleotide sequence of GAM281 RNA, herein designated GAM RNA, also designated SEQ ID:278.

Another function of GAM281 is therefore inhibition of FLJ10520 (Accession NP_060594.2). Accordingly, utilities of GAM281 include diagnosis, prevention and treatment of diseases and clinical conditions associated with FLJ10520.

FLJ10535 (Accession NP_060599.1) is another GAM281 target gene, herein designated TARGET GENE. FLJ10535 BINDING SITE is a target binding site found in the 3' untranslated region of mRNA encoded by FLJ10535, corresponding to a target binding site such as BINDING SITE I, BINDING SITE II or BINDING SITE III of FIG. 8. Table 4 illustrates the complementarity of the nucleotide sequences of FLJ10535 BINDING SITE, designated SEQ ID:9543, to the nucleotide sequence of GAM281 RNA, herein designated GAM RNA, also designated SEQ ID:278.

Another function of GAM281 is therefore inhibition of FLJ10535 (Accession NP_060599.1). Accordingly, utilities of GAM281 include diagnosis, prevention and treatment of diseases and clinical conditions associated with FLJ10535.

FLJ10560 (Accession NP_060608.1) is another GAM281 target gene, herein designated TARGET GENE. FLJ10560 BINDING SITE is a target binding site found in the 3' untranslated region of mRNA encoded by FLJ10560, corresponding to a target binding site such as BINDING SITE I, BINDING SITE II or BINDING SITE III of FIG. 8. Table 4 illustrates the complementarity of the nucleotide sequences of FLJ10560 BINDING SITE, designated SEQ ID:15591, to the nucleotide sequence of GAM281 RNA, herein designated GAM RNA, also designated SEQ ID:278.

Another function of GAM281 is therefore inhibition of FLJ10560 (Accession NP_060608.1). Accordingly, utilities of GAM281 include diagnosis, prevention and treatment of diseases and clinical conditions associated with FLJ10560.

FLJ10569 (Accession NP_060612.1) is another GAM281 target gene, herein designated TARGET GENE. FLJ10569 BINDING SITE is a target binding site found in the 5' untranslated region of mRNA encoded by FLJ10569, corresponding to a target binding site such as BINDING SITE I, BINDING SITE II or BINDING SITE III of FIG. 8. Table 4 illustrates the complementarity of the nucleotide sequences of FLJ10569 BINDING SITE, designated SEQ ID:11899, to the nucleotide sequence of GAM281 RNA, herein designated GAM RNA, also designated SEQ ID:278.

Another function of GAM281 is therefore inhibition of FLJ10569 (Accession NP_060612.1). Accordingly, utilities of GAM281 include diagnosis, prevention and treatment of diseases and clinical conditions associated with FLJ10569.

FLJ10640 (Accession NP_061896.1) is another GAM281 target gene, herein designated TARGET GENE. FLJ10640 BINDING SITE is a target binding site found in the 5' untranslated region of mRNA encoded by FLJ10640, corresponding to a target binding site such as BINDING SITE I, BINDING SITE II or BINDING SITE III of FIG. 8. Table 4 illustrates the complementarity of the nucleotide sequences of FLJ10640 BINDING SITE, designated SEQ ID:18109, to the nucleotide sequence of GAM281 RNA, herein designated GAM RNA, also designated SEQ ID:278.

Another function of GAM281 is therefore inhibition of FLJ10640 (Accession NP_061896.1). Accordingly, utilities of GAM281 include diagnosis, prevention and treatment of diseases and clinical conditions associated with FLJ10640.

FLJ10713 (Accession NP_060659.1) is another GAM281 target gene, herein designated TARGET GENE. FLJ10713 BINDING SITE is a target binding site found in the 3' untranslated region of mRNA encoded by FLJ10713, corresponding to a target binding site such as BINDING SITE I, BINDING SITE II or BINDING SITE III of FIG. 8. Table 4 illustrates the complementarity of the nucleotide sequences of FLJ10713 BINDING SITE, designated SEQ ID:7909, to the nucleotide sequence of GAM281 RNA, herein designated GAM RNA, also designated SEQ ID:278.

Another function of GAM281 is therefore inhibition of FLJ10713 (Accession NP_060659.1). Accordingly, utilities of GAM281 include diagnosis, prevention and treatment of diseases and clinical conditions associated with FLJ10713.

FLJ10769 (Accession NP_060680.1) is another GAM281 target gene, herein designated TARGET GENE. FLJ10769 BINDING SITE is a target binding site found in the 3' untranslated region of mRNA encoded by FLJ10769, corresponding to a target binding site such as BINDING SITE I, BINDING SITE II or BINDING SITE III of FIG. 8. Table 4 illustrates the complementarity of the nucleotide sequences of FLJ10769 BINDING SITE, designated SEQ ID:12257, to the nucleotide sequence of GAM281 RNA, herein designated GAM RNA, also designated SEQ ID:278.

Another function of GAM281 is therefore inhibition of FLJ10769 (Accession NP_060680.1). Accordingly, utilities of GAM281 include diagnosis, prevention and treatment of diseases and clinical conditions associated with FLJ10769.

FLJ10846 (Accession NP_060711.1) is another GAM281 target gene, herein designated TARGET GENE. FLJ10846 BINDING SITE is a target binding site found in the 3' untranslated region of mRNA encoded by FLJ10846, corresponding to a target binding site such as BINDING SITE I, BINDING SITE II or BINDING SITE III of FIG. 8. Table 4 illustrates the complementarity of the nucleotide sequences of FLJ10846 BINDING SITE, designated SEQ ID:11528, to the nucleotide sequence of GAM281 RNA, herein designated GAM RNA, also designated SEQ ID:278.

Another function of GAM281 is therefore inhibition of FLJ10846 (Accession NP_060711.1). Accordingly, utilities of GAM281 include diagnosis, prevention and treatment of diseases and clinical conditions associated with FLJ10846.

FLJ10847 (Accession NP_060712.2) is another GAM281 target gene, herein designated TARGET GENE. FLJ10847 BINDING SITE is a target binding site found in the 3' untranslated region of mRNA encoded by FLJ10847, corresponding to a target binding site such as BINDING SITE I, BINDING SITE II or BINDING SITE III of FIG. 8. Table 4 illustrates the complementarity of the nucleotide sequences of FLJ10847 BINDING SITE, designated SEQ ID:19357, to the nucleotide sequence of GAM281 RNA, herein designated GAM RNA, also designated SEQ ID:278.

Another function of GAM281 is therefore inhibition of FLJ10847 (Accession NP_060712.2). Accordingly, utilities of GAM281 include diagnosis, prevention and treatment of diseases and clinical conditions associated with FLJ10847.

FLJ10898 (Accession NP_060733.1) is another GAM281 target gene, herein designated TARGET GENE. FLJ10898 BINDING SITE is a target binding site found in the 3' untranslated region of mRNA encoded by FLJ10898, corresponding to a target binding site such as BINDING SITE I, BINDING SITE II or BINDING SITE III of FIG. 8. Table 4 illustrates the complementarity of the nucleotide sequences of FLJ10898 BINDING SITE, designated SEQ ID:7243, to the nucleotide sequence of GAM281 RNA, herein designated GAM RNA, also designated SEQ ID:278.

Another function of GAM281 is therefore inhibition of FLJ10898 (Accession NP_060733.1). Accordingly, utilities of GAM281 include diagnosis, prevention and treatment of diseases and clinical conditions associated with FLJ10898.

FLJ10922 (Accession NP_060743.1) is another GAM281 target gene, herein designated TARGET GENE. FLJ10922 BINDING SITE is a target binding site found in the 3' untranslated region of mRNA encoded by FLJ10922, corresponding to a target binding site such as BINDING SITE I, BINDING SITE II or BINDING SITE III of FIG. 8. Table 4 illustrates the complementarity of the nucleotide sequences of FLJ10922 BINDING SITE, designated SEQ ID:18818, to the nucleotide sequence of GAM281 RNA, herein designated GAM RNA, also designated SEQ ID:278.

Another function of GAM281 is therefore inhibition of FLJ10922 (Accession NP_060743.1). Accordingly, utilities of GAM281 include diagnosis, prevention and treatment of diseases and clinical conditions associated with FLJ10922.

FLJ10932 (Accession NP_060747.1) is another GAM281 target gene, herein designated TARGET GENE. FLJ10932 BINDING SITE is a target binding site found in the 3' untranslated region of mRNA encoded by FLJ10932, corresponding to a target binding site such as BINDING SITE I, BINDING SITE II or BINDING SITE III of FIG. 8. Table 4 illustrates the complementarity of the nucleotide sequences of FLJ10932 BINDING SITE, designated SEQ ID:4934, to the nucleotide sequence of GAM281 RNA, herein designated GAM RNA, also designated SEQ ID:278.

Another function of GAM281 is therefore inhibition of FLJ10932 (Accession NP_060747.1). Accordingly, utilities of GAM281 include diagnosis, prevention and treatment of diseases and clinical conditions associated with FLJ10932.

FLJ10936 (Accession NP_060749.2) is another GAM281 target gene, herein designated TARGET GENE. FLJ10936 BINDING SITE is a target binding site found in the 3' untranslated region of mRNA encoded by FLJ10936, corresponding to a target binding site such as BINDING SITE I, BINDING SITE II or BINDING SITE III of FIG. 8. Table 4 illustrates the complementarity of the nucleotide sequences of FLJ10936 BINDING SITE, designated SEQ ID:7238, to the nucleotide sequence of GAM281 RNA, herein designated GAM RNA, also designated SEQ ID:278.

Another function of GAM281 is therefore inhibition of FLJ10936 (Accession NP_060749.2). Accordingly, utilities of GAM281 include diagnosis, prevention and treatment of diseases and clinical conditions associated with FLJ10936.

FLJ11029 (Accession NP_060774.1) is another GAM281 target gene, herein designated TARGET GENE. FLJ11029 BINDING SITE is a target binding site found in the 3' untranslated region of mRNA encoded by FLJ11029, corresponding to a target binding site such as BINDING SITE I, BINDING SITE II or BINDING SITE III of FIG. 8. Table 4 illustrates the complementarity of the nucleotide sequences of FLJ11029 BINDING SITE, designated SEQ ID:3089, to the nucleotide sequence of GAM281 RNA, herein designated GAM RNA, also designated SEQ ID:278.

Another function of GAM281 is therefore inhibition of FLJ11029 (Accession NP_060774.1). Accordingly, utilities of GAM281 include diagnosis, prevention and treatment of diseases and clinical conditions associated with FLJ11029.

FLJ11323 (Accession NP_060860.1) is another GAM281 target gene, herein designated TARGET GENE. FLJ11323 BINDING SITE is a target binding site found in the 3' untranslated region of multiple transcripts of mRNA encoded by FLJ11323, corresponding to a target binding site such as BINDING SITE I, BINDING SITE II or BINDING SITE III of FIG. 8. Table 4 illustrates the complementarity of the nucleotide sequences of FLJ11323 BINDING SITE, designated SEQ ID:2044, to the nucleotide sequence of GAM281 RNA, herein designated GAM RNA, also designated SEQ ID:278.

Another function of GAM281 is therefore inhibition of FLJ11323 (Accession NP_060860.1). Accordingly, utilities of GAM281 include diagnosis, prevention and treatment of diseases and clinical conditions associated with FLJ11323.

FLJ11467 (Accession NP_079239.2) is another GAM281 target gene, herein designated TARGET GENE. FLJ11467 BINDING SITE is a target binding site found in the 3' untranslated region of mRNA encoded by FLJ11467, corresponding to a target binding site such as BINDING SITE I, BINDING SITE II or BINDING SITE III of FIG. 8. Table 4 illustrates the complementarity of the nucleotide sequences of FLJ11467 BINDING SITE, designated SEQ ID:834, to the nucleotide sequence of GAM281 RNA, herein designated GAM RNA, also designated SEQ ID:278.

Another function of GAM281 is therefore inhibition of FLJ11467 (Accession NP_079239.2). Accordingly, utilities of GAM281 include diagnosis, prevention and treatment of diseases and clinical conditions associated with FLJ11467.

FLJ11710 (Accession NP_079122.1) is another GAM281 target gene, herein designated TARGET GENE. FLJ11710 BINDING SITE1 and FLJ11710 BINDING SITE2 are target binding sites found in untranslated regions of mRNA encoded by FLJ11710, corresponding to target binding sites such as BINDING SITE I, BINDING SITE II or BINDING SITE III of FIG. 8. Table 4 illustrates the complementarity of the nucleotide sequences of FLJ11710 BINDING SITE1 and FLJ11710 BINDING SITE2, designated SEQ ID:9688 and SEQ ID:2245 respectively, to the nucleotide sequence of GAM281 RNA, herein designated GAM RNA, also designated SEQ ID:278.

Another function of GAM281 is therefore inhibition of FLJ11710 (Accession NP_079122.1). Accordingly, utilities of GAM281 include diagnosis, prevention and treatment of diseases and clinical conditions associated with FLJ11710.

FLJ11715 (Accession NP_078840.1) is another GAM281 target gene, herein designated TARGET GENE. FLJ11715 BINDING SITE is a target binding site found in the 3' untranslated region of mRNA encoded by FLJ11715, corresponding to a target binding site such as BINDING SITE I, BINDING SITE II or BINDING SITE III of FIG. 8. Table 4 illustrates the complementarity of the nucleotide sequences of FLJ11715 BINDING SITE, designated SEQ ID:3305, to the nucleotide sequence of GAM281 RNA, herein designated GAM RNA, also designated SEQ ID:278.

Another function of GAM281 is therefore inhibition of FLJ11715 (Accession NP_078840.1). Accordingly, utilities of GAM281 include diagnosis, prevention and treatment of diseases and clinical conditions associated with FLJ11715.

FLJ11800 (Accession NP_079250.1) is another GAM281 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:10847, to the nucleotide sequence of GAM281 RNA, herein designated GAM RNA, also designated SEQ ID:278.

Another function of GAM281 is therefore inhibition of FLJ11800 (Accession NP_079250.1). Accordingly, utilities of GAM281 include diagnosis, prevention and treatment of diseases and clinical conditions associated with FLJ11800.

FLJ12076 (Accession NP_079463.2) is another GAM281 target gene, herein designated TARGET GENE. FLJ12076 BINDING SITE is a target binding site found in the 3' untranslated region of mRNA encoded by FLJ12076, corresponding to a target binding site such as BINDING SITE I, BINDING SITE II or BINDING SITE III of FIG. 8. Table 4 illustrates the complementarity of the nucleotide sequences of FLJ12076 BINDING SITE, designated SEQ ID:8886, to the nucleotide sequence of GAM281 RNA, herein designated GAM RNA, also designated SEQ ID:278.

Another function of GAM281 is therefore inhibition of FLJ12076 (Accession NP_079463.2). Accordingly, utilities of GAM281 include diagnosis, prevention and treatment of diseases and clinical conditions associated with FLJ12076.

FLJ12363 (Accession NP_115543.1) is another GAM281 target gene, herein designated TARGET GENE. FLJ12363 BINDING SITE is a target binding site found in the 3' untranslated region of mRNA encoded by FLJ12363, corresponding to a target binding site such as BINDING SITE I, BINDING SITE II or BINDING SITE III of FIG. 8. Table 4 illustrates the complementarity of the nucleotide sequences of FLJ12363 BINDING SITE, designated SEQ ID:17722, to the nucleotide sequence of GAM281 RNA, herein designated GAM RNA, also designated SEQ ID:278.

Another function of GAM281 is therefore inhibition of FLJ12363 (Accession NP_115543.1). Accordingly, utilities of GAM281 include diagnosis, prevention and treatment of diseases and clinical conditions associated with FLJ12363.

FLJ12448 (Accession NP_075046.1) is another GAM281 target gene, herein designated TARGET GENE. FLJ12448 BINDING SITE is a target binding site found in the 3' untranslated region of mRNA encoded by FLJ12448, corresponding to a target binding site such as BINDING SITE I, BINDING SITE II or BINDING SITE III of FIG. 8. Table 4 illustrates the complementarity of the nucleotide sequences of FLJ12448 BINDING SITE, designated SEQ ID:8405, to the nucleotide sequence of GAM281 RNA, herein designated GAM RNA, also designated SEQ ID:278.

Another function of GAM281 is therefore inhibition of FLJ12448 (Accession NP_075046.1). Accordingly, utilities of GAM281 include diagnosis, prevention and treatment of diseases and clinical conditions associated with FLJ12448.

FLJ12572 (Accession NP_075056.2) is another GAM281 target gene, herein designated TARGET GENE. FLJ12572 BINDING SITE is a target binding site found in the 5' untranslated region of mRNA encoded by FLJ12572, corresponding to a target binding site such as BINDING SITE I, BINDING SITE II or BINDING SITE III of FIG. 8. Table 4 illustrates the complementarity of the nucleotide sequences of FLJ12572 BINDING SITE, designated SEQ ID:17515, to the nucleotide sequence of GAM281 RNA, herein designated GAM RNA, also designated SEQ ID:278.

Another function of GAM281 is therefore inhibition of FLJ12572 (Accession NP_075056.2). Accordingly, utilities of GAM281 include diagnosis, prevention and treatment of diseases and clinical conditions associated with FLJ12572.

FLJ12586 (Accession NP_078896.2) is another GAM281 target gene, herein designated TARGET GENE. FLJ12586 BINDING SITE is a target binding site found in the 5' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:10410, to the nucleotide sequence of GAM281 RNA, herein designated GAM RNA, also designated SEQ ID:278.

Another function of GAM281 is therefore inhibition of FLJ12586 (Accession NP_078896.2). Accordingly, utilities of GAM281 include diagnosis, prevention and treatment of diseases and clinical conditions associated with FLJ12586.

FLJ12649 (Accession XP_291344.1) is another GAM281 target gene, herein designated TARGET GENE. FLJ12649 BINDING SITE is a target binding site found in the 3' untranslated region of mRNA encoded by FLJ12649, corresponding to a target binding site such as BINDING SITE I, BINDING SITE II or BINDING SITE III of FIG. 8. Table 4 illustrates the complementarity of the nucleotide sequences of FLJ12649 BINDING SITE, designated SEQ ID:3686, to the nucleotide sequence of GAM281 RNA, herein designated GAM RNA, also designated SEQ ID:278.

Another function of GAM281 is therefore inhibition of FLJ12649 (Accession XP_291344.1). Accordingly, utilities of GAM281 include diagnosis, prevention and treatment of diseases and clinical conditions associated with FLJ12649.

FLJ12687 (Accession NP_079193.2) is another GAM281 target gene, herein designated TARGET GENE. FLJ12687 BINDING SITE is a target binding site found in the 3' untranslated region of mRNA encoded by FLJ12687, corresponding to a target binding site such as BINDING SITE I, BINDING SITE II or BINDING SITE III of FIG. 8. Table 4 illustrates the complementarity of the nucleotide sequences of FLJ12687 BINDING SITE, designated SEQ ID:3324, to the nucleotide sequence of GAM281 RNA, herein designated GAM RNA, also designated SEQ ID:278.

Another function of GAM281 is therefore inhibition of FLJ12687 (Accession NP_079193.2). Accordingly, utilities of GAM281 include diagnosis, prevention and treatment of diseases and clinical conditions associated with FLJ12687.

FLJ12747 (Accession XP_290972.1) is another GAM281 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:10683, to the nucleotide sequence of GAM281 RNA, herein designated GAM RNA, also designated SEQ ID:278.

Another function of GAM281 is therefore inhibition of FLJ12747 (Accession XP_290972.1). Accordingly, utilities of GAM281 include diagnosis, prevention and treatment of diseases and clinical conditions associated with FLJ12747.

FLJ12787 (Accession NP_115551.1) is another GAM281 target gene, herein designated TARGET GENE. FLJ12787 BINDING SITE is a target binding site found in the 3' untranslated region of mRNA encoded by FLJ12787, corresponding to a target binding site such as BINDING SITE I, BINDING SITE II or BINDING SITE III of FIG. 8. Table 4 illustrates the complementarity of the nucleotide sequences of FLJ12787 BINDING SITE, designated SEQ ID:14839, to the nucleotide sequence of GAM281 RNA, herein designated GAM RNA, also designated SEQ ID:278.

Another function of GAM281 is therefore inhibition of FLJ12787 (Accession NP_115551.1). Accordingly, utilities of GAM281 include diagnosis, prevention and treatment of diseases and clinical conditions associated with FLJ12787.

FLJ12800 (Accession NP_075054.1) is another GAM281 target gene, herein designated TARGET GENE. FLJ12800 BINDING SITE is a target binding site found in the 3' untranslated region of mRNA encoded by FLJ12800, corresponding to a target binding site such as BINDING SITE I, BINDING SITE II or BINDING SITE III of FIG. 8. Table 4 illustrates the complementarity of the nucleotide sequences of FLJ12800 BINDING SITE, designated SEQ ID:4261, to the nucleotide sequence of GAM281 RNA, herein designated GAM RNA, also designated SEQ ID:278.

Another function of GAM281 is therefore inhibition of FLJ12800 (Accession NP_075054.1). Accordingly, utilities of GAM281 include diagnosis, prevention and treatment of diseases and clinical conditions associated with FLJ12800.

FLJ12888 (Accession NP_079221.1) is another GAM281 target gene, herein designated TARGET GENE. FLJ12888 BINDING SITE is a target binding site found in the 3' untranslated region of mRNA encoded by FLJ12888, corresponding to a target binding site such as BINDING SITE I, BINDING SITE II or BINDING SITE III of FIG. 8. Table 4 illustrates the complementarity of the nucleotide sequences of FLJ12888 BINDING SITE, designated SEQ ID:17723, to the nucleotide sequence of GAM281 RNA, herein designated GAM RNA, also designated SEQ ID:278.

Another function of GAM281 is therefore inhibition of FLJ12888 (Accession NP_079221.1). Accordingly, utilities of GAM281 include diagnosis, prevention and treatment of diseases and clinical conditions associated with FLJ12888.

FLJ12903 (Accession NP_073590.1) is another GAM281 target gene, herein designated TARGET GENE. FLJ12903 BINDING SITE is a target binding site found in the 3' untranslated region of mRNA encoded by FLJ12903, corresponding to a target binding site such as BINDING SITE I, BINDING SITE II or BINDING SITE III of FIG. 8. Table 4 illustrates the complementarity of the nucleotide sequences of FLJ12903 BINDING SITE, designated SEQ ID:10224, to the nucleotide sequence of GAM281 RNA, herein designated GAM RNA, also designated SEQ ID:278.

Another function of GAM281 is therefore inhibition of FLJ12903 (Accession NP_073590.1). Accordingly, utilities of GAM281 include diagnosis, prevention and treatment of diseases and clinical conditions associated with FLJ12903.

FLJ12960 (Accession NP_078914.1) is another GAM281 target gene, herein designated TARGET GENE. FLJ12960 BINDING SITE is a target binding site found in the 3' untranslated region of mRNA encoded by FLJ12960, corresponding to a target binding site such as BINDING SITE I, BINDING SITE II or BINDING SITE III of FIG. 8. Table 4 illustrates the complementarity of the nucleotide sequences of FLJ12960 BINDING SITE, designated SEQ ID:11523, to the nucleotide sequence of GAM281 RNA, herein designated GAM RNA, also designated SEQ ID:278.

Another function of GAM281 is therefore inhibition of FLJ12960 (Accession NP_078914.1). Accordingly, utilities of GAM281 include diagnosis, prevention and treatment of diseases and clinical conditions associated with FLJ12960.

FLJ12973 (Accession NP_079184.1) is another GAM281 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:5230, to the nucleotide sequence of GAM281 RNA, herein designated GAM RNA, also designated SEQ ID:278.

Another function of GAM281 is therefore inhibition of FLJ12973 (Accession NP_079184.1). Accordingly, utilities of GAM281 include diagnosis, prevention and treatment of diseases and clinical conditions associated with FLJ12973.

FLJ12975 (Accession NP_079085.2) is another GAM281 target gene, herein designated TARGET GENE. FLJ12975 BINDING SITE is a target binding site found in the 3' untranslated region of mRNA encoded by FLJ12975, corresponding to a target binding site such as BINDING SITE I, BINDING SITE II or BINDING SITE III of FIG. 8. Table 4 illustrates the complementarity of the nucleotide sequences of FLJ12975 BINDING SITE, designated SEQ ID:2409, to the nucleotide sequence of GAM281 RNA, herein designated GAM RNA, also designated SEQ ID:278.

Another function of GAM281 is therefore inhibition of FLJ12975 (Accession NP_079085.2). Accordingly, utilities of GAM281 include diagnosis, prevention and treatment of diseases and clinical conditions associated with FLJ12975.

FLJ12986 (Accession XP_290685.1) is another GAM281 target gene, herein designated TARGET GENE. FLJ12986 BINDING SITE1 and FLJ12986 BINDING SITE2 are target binding sites found in untranslated regions of mRNA encoded by FLJ12986, corresponding to target binding sites such as BINDING SITE I, BINDING SITE II or BINDING SITE III of FIG. 8. Table 4 illustrates the complementarity of the nucleotide sequences of FLJ12986 BINDING SITE1 and FLJ12986 BINDING SITE2, designated SEQ ID:6037 and SEQ ID:11396 respectively, to the nucleotide sequence of GAM281 RNA, herein designated GAM RNA, also designated SEQ ID:278.

Another function of GAM281 is therefore inhibition of FLJ12986 (Accession XP_290685.1). Accordingly, utilities of GAM281 include diagnosis, prevention and treatment of diseases and clinical conditions associated with FLJ12986.

FLJ13072 (Accession XP_117117.2) is another GAM281 target gene, herein designated TARGET GENE. FLJ13072 BINDING SITE is a target binding site found in the 3' untranslated region of mRNA encoded by FLJ13072, corresponding to a target binding site such as BINDING SITE I, BINDING SITE II or BINDING SITE III of FIG. 8. Table 4 illustrates the complementarity of the nucleotide sequences of FLJ13072 BINDING SITE, designated SEQ ID:2223, to the nucleotide sequence of GAM281 RNA, herein designated GAM RNA, also designated SEQ ID:278.

Another function of GAM281 is therefore inhibition of FLJ13072 (Accession XP_117117.2). Accordingly, utilities of GAM281 include diagnosis, prevention and treatment of diseases and clinical conditions associated with FLJ13072.

FLJ13114 (Accession NP_078817.1) is another GAM281 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:11919, to the nucleotide sequence of GAM281 RNA, herein designated GAM RNA, also designated SEQ ID:278.

Another function of GAM281 is therefore inhibition of FLJ13114 (Accession NP_078817.1). Accordingly, utilities of GAM281 include diagnosis, prevention and treatment of diseases and clinical conditions associated with FLJ13114.

FLJ13189 (Accession NP_079158.1) is another GAM281 target gene, herein designated TARGET GENE. FLJ13189 BINDING SITE is a target binding site found in the 3' untranslated region of mRNA encoded by FLJ13189, corresponding to a target binding site such as BINDING SITE I, BINDING SITE II or BINDING SITE III of FIG. 8. Table 4 illustrates the complementarity of the nucleotide sequences of FLJ13189 BINDING SITE, designated SEQ ID:4530, to the nucleotide sequence of GAM281 RNA, herein designated GAM RNA, also designated SEQ ID:278.

Another function of GAM281 is therefore inhibition of FLJ13189 (Accession NP_079158.1). Accordingly, utilities of GAM281 include diagnosis, prevention and treatment of diseases and clinical conditions associated with FLJ13189.

FLJ13197 (Accession NP_078890.1) is another GAM281 target gene, herein designated TARGET GENE. FLJ13197 BINDING SITE is a target binding site found in the 3' untranslated region of mRNA encoded by FLJ13197, corresponding to a target binding site such as BINDING SITE I, BINDING SITE II or BINDING SITE III of FIG. 8. Table 4 illustrates the complementarity of the nucleotide sequences of FLJ13197 BINDING SITE, designated SEQ ID:8231, to the nucleotide sequence of GAM281 RNA, herein designated GAM RNA, also designated SEQ ID:278.

Another function of GAM281 is therefore inhibition of FLJ13197 (Accession NP_078890.1). Accordingly, utilities of GAM281 include diagnosis, prevention and treatment of diseases and clinical conditions associated with FLJ13197.

FLJ13441 (Accession NP_076413.1) is another GAM281 target gene, herein designated TARGET GENE. FLJ13441 BINDING SITE1 and FLJ13441 BINDING SITE2 are target binding sites found in untranslated regions of mRNA encoded by FLJ13441, corresponding to target binding sites such as BINDING SITE I, BINDING SITE II or BINDING SITE III of FIG. 8. Table 4 illustrates the complementarity of the nucleotide sequences of FLJ13441 BINDING SITE1 and FLJ13441 BINDING SITE2, designated SEQ ID:3478 and SEQ ID:12452 respectively, to the nucleotide sequence of GAM281 RNA, herein designated GAM RNA, also designated SEQ ID:278.

Another function of GAM281 is therefore inhibition of FLJ13441 (Accession NP_076413.1). Accordingly, utilities of GAM281 include diagnosis, prevention and treatment of diseases and clinical conditions associated with FLJ13441.

FLJ13456 (Accession XP_038291.5) is another GAM281 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:8163, to the nucleotide sequence of GAM281 RNA, herein designated GAM RNA, also designated SEQ ID:278.

Another function of GAM281 is therefore inhibition of FLJ13456 (Accession XP_038291.5). Accordingly, utilities of GAM281 include diagnosis, prevention and treatment of diseases and clinical conditions associated with FLJ13456.

FLJ13590 (Accession NP_079116.2) is another GAM281 target gene, herein designated TARGET GENE. FLJ13590 BINDING SITE is a target binding site found in the 5' untranslated region of mRNA encoded by FLJ13590, corresponding to a target binding site such as BINDING SITE I, BINDING SITE II or BINDING SITE III of FIG. 8. Table 4 illustrates the complementarity of the nucleotide sequences of FLJ13590 BINDING SITE, designated SEQ ID:7813, to the nucleotide sequence of GAM281 RNA, herein designated GAM RNA, also designated SEQ ID:278.

Another function of GAM281 is therefore inhibition of FLJ13590 (Accession NP_079116.2). Accordingly, utilities of GAM281 include diagnosis, prevention and treatment of diseases and clinical conditions associated with FLJ13590.

FLJ13744 (Accession NP_079287.1) is another GAM281 target gene, herein designated TARGET GENE. FLJ13744 BINDING SITE is a target binding site found in the 3' untranslated region of mRNA encoded by FLJ13744, corresponding to a target binding site such as BINDING SITE I, BINDING SITE II or BINDING SITE III of FIG. 8. Table 4 illustrates the complementarity of the nucleotide sequences of FLJ13744 BINDING SITE, designated SEQ ID:6185, to the nucleotide sequence of GAM281 RNA, herein designated GAM RNA, also designated SEQ ID:278.

Another function of GAM281 is therefore inhibition of FLJ13744 (Accession NP_079287.1). Accordingly, utilities of GAM281 include diagnosis, prevention and treatment of diseases and clinical conditions associated with FLJ13744.

FLJ13910 (Accession NP_073617.1) is another GAM281 target gene, herein designated TARGET GENE. FLJ13910 BINDING SITE is a target binding site found in the 3' untranslated region of mRNA encoded by FLJ13910, corresponding to a target binding site such as BINDING SITE I, BINDING SITE II or BINDING SITE III of FIG. 8. Table 4 illustrates the complementarity of the nucleotide sequences of FLJ13910 BINDING SITE, designated SEQ ID:7691, to the nucleotide sequence of GAM281 RNA, herein designated GAM RNA, also designated SEQ ID:278.

Another function of GAM281 is therefore inhibition of FLJ13910 (Accession NP_073617.1). Accordingly, utilities of GAM281 include diagnosis, prevention and treatment of diseases and clinical conditions associated with FLJ13910.

FLJ13984 (Accession NP_079046.1) is another GAM281 target gene, herein designated TARGET GENE. FLJ13984 BINDING SITE is a target binding site found in the 5' untranslated region of mRNA encoded by FLJ13984, corresponding to a target binding site such as BINDING SITE I, BINDING SITE II or BINDING SITE III of FIG. 8. Table 4 illustrates the complementarity of the nucleotide sequences of FLJ13984 BINDING SITE, designated SEQ ID:10809, to the nucleotide sequence of GAM281 RNA, herein designated GAM RNA, also designated SEQ ID:278.

Another function of GAM281 is therefore inhibition of FLJ13984 (Accession NP_079046.1). Accordingly, utilities of GAM281 include diagnosis, prevention and treatment of diseases and clinical conditions associated with FLJ13984.

FLJ14100 (Accession NP_079301.1) is another GAM281 target gene, herein designated TARGET GENE. FLJ14100 BINDING SITE is a target binding site found in the 3' untranslated region of mRNA encoded by FLJ14100, corresponding to a target binding site such as BINDING SITE I, BINDING SITE II or BINDING SITE III of FIG. 8. Table 4 illustrates the complementarity of the nucleotide sequences of FLJ14100 BINDING SITE, designated SEQ ID:12143, to the nucleotide sequence of GAM281 RNA, herein designated GAM RNA, also designated SEQ ID:278.

Another function of GAM281 is therefore inhibition of FLJ14100 (Accession NP_079301.1). Accordingly, utilities of GAM281 include diagnosis, prevention and treatment of diseases and clinical conditions associated with FLJ14100.

FLJ14351 (Accession NP_079008.1) is another GAM281 target gene, herein designated TARGET GENE. FLJ14351 BINDING SITE is a target binding site found in the 3' untranslated region of mRNA encoded by FLJ14351, corresponding to a target binding site such as BINDING SITE I, BINDING SITE II or BINDING SITE III of FIG. 8. Table 4 illustrates the complementarity of the nucleotide sequences of FLJ14351 BINDING SITE, designated SEQ ID:8586, to the nucleotide sequence of GAM281 RNA, herein designated GAM RNA, also designated SEQ ID:278.

Another function of GAM281 is therefore inhibition of FLJ14351 (Accession NP_079008.1). Accordingly, utilities of GAM281 include diagnosis, prevention and treatment of diseases and clinical conditions associated with FLJ14351.

FLJ14442 (Accession NP_116174.1) is another GAM281 target gene, herein designated TARGET GENE. FLJ14442 BINDING SITE is a target binding site found in the 3' untranslated region of mRNA encoded by FLJ14442, corresponding to a target binding site such as BINDING SITE I, BINDING SITE II or BINDING SITE III of FIG. 8. Table 4 illustrates the complementarity of the nucleotide sequences of FLJ14442 BINDING SITE, designated SEQ ID:16259, to the nucleotide sequence of GAM281 RNA, herein designated GAM RNA, also designated SEQ ID:278.

Another function of GAM281 is therefore inhibition of FLJ14442 (Accession NP_116174.1). Accordingly, utilities of GAM281 include diagnosis, prevention and treatment of diseases and clinical conditions associated with FLJ14442.

FLJ14675 (Accession NP_116212.3) is another GAM281 target gene, herein designated TARGET GENE. FLJ14675 BINDING SITE is a target binding site found in the 3' untranslated region of mRNA encoded by FLJ14675, corresponding to a target binding site such as BINDING SITE I, BINDING SITE II or BINDING SITE III of FIG. 8. Table 4 illustrates the complementarity of the nucleotide sequences of FLJ14675 BINDING SITE, designated SEQ ID:16071, to the nucleotide sequence of GAM281 RNA, herein designated GAM RNA, also designated SEQ ID:278.

Another function of GAM281 is therefore inhibition of FLJ14675 (Accession NP_116212.3). Accordingly, utilities of GAM281 include diagnosis, prevention and treatment of diseases and clinical conditions associated with FLJ14675.

FLJ14803 (Accession NP_116231.1) is another GAM281 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:939, to the nucleotide sequence of GAM281 RNA, herein designated GAM RNA, also designated SEQ ID:278.

Another function of GAM281 is therefore inhibition of FLJ14803 (Accession NP_116231.1). Accordingly, utilities of GAM281 include diagnosis, prevention and treatment of diseases and clinical conditions associated with FLJ14803.

FLJ14957 (Accession NP_116255.1) is another GAM281 target gene, herein designated TARGET GENE. FLJ14957 BINDING SITE is a target binding site found in the 3' untranslated region of mRNA encoded by FLJ14957, corresponding to a target binding site such as BINDING SITE I, BINDING SITE II or BINDING SITE III of FIG. 8. Table 4 illustrates the complementarity of the nucleotide sequences of FLJ14957 BINDING SITE, designated SEQ ID:13527, to the nucleotide sequence of GAM281 RNA, herein designated GAM RNA, also designated SEQ ID:278.

Another function of GAM281 is therefore inhibition of FLJ14957 (Accession NP_116255.1). Accordingly, utilities of GAM281 include diagnosis, prevention and treatment of diseases and clinical conditions associated with FLJ14957.

FLJ20045 (Accession NP_060108.1) is another GAM281 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:12557, to the nucleotide sequence of GAM281 RNA, herein designated GAM RNA, also designated SEQ ID:278.

Another function of GAM281 is therefore inhibition of FLJ20045 (Accession NP_060108.1). Accordingly, utilities of GAM281 include diagnosis, prevention and treatment of diseases and clinical conditions associated with FLJ20045.

FLJ20079 (Accession NP_060126.1) is another GAM281 target gene, herein designated TARGET GENE. FLJ20079 BINDING SITE is a target binding site found in the 3' untranslated region of mRNA encoded by FLJ20079, corresponding to a target binding site such as BINDING SITE I, BINDING SITE II or BINDING SITE III of FIG. 8. Table 4 illustrates the complementarity of the nucleotide sequences of FLJ20079 BINDING SITE, designated SEQ ID:14265, to the nucleotide sequence of GAM281 RNA, herein designated GAM RNA, also designated SEQ ID:278.

Another function of GAM281 is therefore inhibition of FLJ20079 (Accession NP_060126.1). Accordingly, utilities of GAM281 include diagnosis, prevention and treatment of diseases and clinical conditions associated with FLJ20079.

FLJ20095 (Accession NP_060136.1) is another GAM281 target gene, herein designated TARGET GENE. FLJ20095 BINDING SITE is a target binding site found in the 3' untranslated region of mRNA encoded by FLJ20095, corresponding to a target binding site such as BINDING SITE I, BINDING SITE II or BINDING SITE III of FIG. 8. Table 4 illustrates the complementarity of the nucleotide sequences of FLJ20095 BINDING SITE, designated SEQ ID:7385, to the nucleotide sequence of GAM281 RNA, herein designated GAM RNA, also designated SEQ ID:278.

Another function of GAM281 is therefore inhibition of FLJ20095 (Accession NP_060136.1). Accordingly, utilities of GAM281 include diagnosis, prevention and treatment of diseases and clinical conditions associated with FLJ20095.

FLJ20123 (Accession NP_060144.1) is another GAM281 target gene, herein designated TARGET GENE. FLJ20123 BINDING SITE is a target binding site found in the 5' untranslated region of mRNA encoded by FLJ20123, corresponding to a target binding site such as BINDING SITE I, BINDING SITE II or BINDING SITE III of FIG. 8. Table 4 illustrates the complementarity of the nucleotide sequences of FLJ20123 BINDING SITE, designated SEQ ID:17513, to the nucleotide sequence of GAM281 RNA, herein designated GAM RNA, also designated SEQ ID:278.

Another function of GAM281 is therefore inhibition of FLJ20123 (Accession NP_060144.1). Accordingly, utilities of GAM281 include diagnosis, prevention and treatment of diseases and clinical conditions associated with FLJ20123.

FLJ20136 (Accession NP_060154.1) is another GAM281 target gene, herein designated TARGET GENE. FLJ20136 BINDING SITE is a target binding site found in the 3' untranslated region of mRNA encoded by FLJ20136, corresponding to a target binding site such as BINDING SITE I, BINDING SITE II or BINDING SITE III of FIG. 8. Table 4 illustrates the complementarity of the nucleotide sequences of FLJ20136 BINDING SITE, designated SEQ ID:4536, to the nucleotide sequence of GAM281 RNA, herein designated GAM RNA, also designated SEQ ID:278.

Another function of GAM281 is therefore inhibition of FLJ20136 (Accession NP_060154.1). Accordingly, utilities of GAM281 include diagnosis, prevention and treatment of diseases and clinical conditions associated with FLJ20136.

FLJ20147 (Accession NP_060157.1) is another GAM281 target gene, herein designated TARGET GENE. FLJ20147 BINDING SITE is a target binding site found in the 3' untranslated region of mRNA encoded by FLJ20147, corresponding to a target binding site such as BINDING SITE I, BINDING SITE II or BINDING SITE III of FIG. 8. Table 4 illustrates the complementarity of the nucleotide sequences of FLJ20147 BINDING SITE, designated SEQ ID:2624, to the nucleotide sequence of GAM281 RNA, herein designated GAM RNA, also designated SEQ ID:278.

Another function of GAM281 is therefore inhibition of FLJ20147 (Accession NP_060157.1). Accordingly, utilities of GAM281 include diagnosis, prevention and treatment of diseases and clinical conditions associated with FLJ20147.

FLJ20207 (Accession NP_060181.2) is another GAM281 target gene, herein designated TARGET GENE. FLJ20207 BINDING SITE is a target binding site found in the 5' untranslated region of mRNA encoded by FLJ20207, corresponding to a target binding site such as BINDING SITE I, BINDING SITE II or BINDING SITE III of FIG. 8. Table 4 illustrates the complementarity of the nucleotide sequences of FLJ20207 BINDING SITE, designated SEQ ID:14870, to the nucleotide sequence of GAM281 RNA, herein designated GAM RNA, also designated SEQ ID:278.

Another function of GAM281 is therefore inhibition of FLJ20207 (Accession NP_060181.2). Accordingly, utilities of GAM281 include diagnosis, prevention and treatment of diseases and clinical conditions associated with FLJ20207.

FLJ20245 (Accession NP_060193.1) is another GAM281 target gene, herein designated TARGET GENE. FLJ20245 BINDING SITE1 and FLJ20245 BINDING SITE2 are target binding sites found in untranslated regions of mRNA encoded by FLJ20245, corresponding to target binding sites such as BINDING SITE I, BINDING SITE II or BINDING SITE III of FIG. 8. Table 4 illustrates the complementarity of the nucleotide sequences of FLJ20245 BINDING SITE1 and FLJ20245 BINDING SITE2, designated SEQ ID:5275 and SEQ ID:8581 respectively, to the nucleotide sequence of GAM281 RNA, herein designated GAM RNA, also designated SEQ ID:278.

Another function of GAM281 is therefore inhibition of FLJ20245 (Accession NP_060193.1). Accordingly, utilities of GAM281 include diagnosis, prevention and treatment of diseases and clinical conditions associated with FLJ20245.

FLJ20257 (Accession NP_062552.1) is another GAM281 target gene, herein designated TARGET GENE. FLJ20257 BINDING SITE is a target binding site found in the 3' untranslated region of mRNA encoded by FLJ20257, corresponding to a target binding site such as BINDING SITE I, BINDING SITE II or BINDING SITE III of FIG. 8. Table 4 illustrates the complementarity of the nucleotide sequences of FLJ20257 BINDING SITE, designated SEQ ID:7206, to the nucleotide sequence of GAM281 RNA, herein designated GAM RNA, also designated SEQ ID:278.

Another function of GAM281 is therefore inhibition of FLJ20257 (Accession NP_062552.1). Accordingly, utilities of GAM281 include diagnosis, prevention and treatment of diseases and clinical conditions associated with FLJ20257.

FLJ20308 (Accession NP_060228.1) is another GAM281 target gene, herein designated TARGET GENE. FLJ20308 BINDING SITE is a target binding site found in the 3' untranslated region of mRNA encoded by FLJ20308, corresponding to a target binding site such as BINDING SITE I, BINDING SITE II or BINDING SITE III of FIG. 8. Table 4 illustrates the complementarity of the nucleotide sequences of FLJ20308 BINDING SITE, designated SEQ ID:5413, to the nucleotide sequence of GAM281 RNA, herein designated GAM RNA, also designated SEQ ID:278.

Another function of GAM281 is therefore inhibition of FLJ20308 (Accession NP_060228.1). Accordingly, utilities of GAM281 include diagnosis, prevention and treatment of diseases and clinical conditions associated with FLJ20308.

FLJ20320 (Accession NP_060235.1) is another GAM281 target gene, herein designated TARGET GENE. FLJ20320 BINDING SITE is a target binding site found in the 5' untranslated region of mRNA encoded by FLJ20320, corresponding to a target binding site such as BINDING SITE I, BINDING SITE II or BINDING SITE III of FIG. 8. Table 4 illustrates the complementarity of the nucleotide sequences of FLJ20320 BINDING SITE, designated SEQ ID:16994, to the nucleotide sequence of GAM281 RNA, herein designated GAM RNA, also designated SEQ ID:278.

Another function of GAM281 is therefore inhibition of FLJ20320 (Accession NP_060235.1). Accordingly, utilities of GAM281 include diagnosis, prevention and treatment of diseases and clinical conditions associated with FLJ20320.

FLJ20344 (Accession NP_060246.1) is another GAM281 target gene, herein designated TARGET GENE. FLJ20344 BINDING SITE is a target binding site found in the 3' untranslated region of mRNA encoded by FLJ20344, corresponding to a target binding site such as BINDING SITE I, BINDING SITE II or BINDING SITE III of FIG. 8. Table 4 illustrates the complementarity of the nucleotide sequences of FLJ20344 BINDING SITE, designated SEQ ID:4079, to the nucleotide sequence of GAM281 RNA, herein designated GAM RNA, also designated SEQ ID:278.

Another function of GAM281 is therefore inhibition of FLJ20344 (Accession NP_060246.1). Accordingly, utilities of GAM281 include diagnosis, prevention and treatment of diseases and clinical conditions associated with FLJ20344.

FLJ20359 (Accession NP_060251.1) is another GAM281 target gene, herein designated TARGET GENE. FLJ20359

BINDING SITE is a target binding site found in the 3' untranslated region of mRNA encoded by FLJ20359, corresponding to a target binding site such as BINDING SITE I, BINDING SITE II or BINDING SITE III of FIG. 8. Table 4 illustrates the complementarity of the nucleotide sequences of FLJ20359 BINDING SITE, designated SEQ ID:11024, to the nucleotide sequence of GAM281 RNA, herein designated GAM RNA, also designated SEQ ID:278.

Another function of GAM281 is therefore inhibition of FLJ20359 (Accession NP_060251.1). Accordingly, utilities of GAM281 include diagnosis, prevention and treatment of diseases and clinical conditions associated with FLJ20359.

FLJ20375 (Accession NP_060264.2) is another GAM281 target gene, herein designated TARGET GENE. FLJ20375 BINDING SITE is a target binding site found in the 3' untranslated region of mRNA encoded by FLJ20375, corresponding to a target binding site such as BINDING SITE I, BINDING SITE II or BINDING SITE III of FIG. 8. Table 4 illustrates the complementarity of the nucleotide sequences of FLJ20375 BINDING SITE, designated SEQ ID:9357, to the nucleotide sequence of GAM281 RNA, herein designated GAM RNA, also designated SEQ ID:278.

Another function of GAM281 is therefore inhibition of FLJ20375 (Accession NP_060264.2). Accordingly, utilities of GAM281 include diagnosis, prevention and treatment of diseases and clinical conditions associated with FLJ20375.

FLJ20507 (Accession NP_060319.1) is another GAM281 target gene, herein designated TARGET GENE. FLJ20507 BINDING SITE is a target binding site found in the 3' untranslated region of mRNA encoded by FLJ20507, corresponding to a target binding site such as BINDING SITE I, BINDING SITE II or BINDING SITE III of FIG. 8. Table 4 illustrates the complementarity of the nucleotide sequences of FLJ20507 BINDING SITE, designated SEQ ID:3211, to the nucleotide sequence of GAM281 RNA, herein designated GAM RNA, also designated SEQ ID:278.

Another function of GAM281 is therefore inhibition of FLJ20507 (Accession NP_060319.1). Accordingly, utilities of GAM281 include diagnosis, prevention and treatment of diseases and clinical conditions associated with FLJ20507.

FLJ20511 (Accession NP_060323.1) is another GAM281 target gene, herein designated TARGET GENE. FLJ20511 BINDING SITE is a target binding site found in the 3' untranslated region of mRNA encoded by FLJ20511, corresponding to a target binding site such as BINDING SITE I, BINDING SITE II or BINDING SITE III of FIG. 8. Table 4 illustrates the complementarity of the nucleotide sequences of FLJ20511 BINDING SITE, designated SEQ ID:17759, to the nucleotide sequence of GAM281 RNA, herein designated GAM RNA, also designated SEQ ID:278.

Another function of GAM281 is therefore inhibition of FLJ20511 (Accession NP_060323.1). Accordingly, utilities of GAM281 include diagnosis, prevention and treatment of diseases and clinical conditions associated with FLJ20511.

FLJ20671 (Accession NP_060394.1) is another GAM281 target gene, herein designated TARGET GENE. FLJ20671 BINDING SITE1 and FLJ20671 BINDING SITE2 are target binding sites found in untranslated regions of mRNA encoded by FLJ20671, corresponding to target binding sites such as BINDING SITE I, BINDING SITE II or BINDING SITE III of FIG. 8. Table 4 illustrates the complementarity of the nucleotide sequences of FLJ20671 BINDING SITE1 and FLJ20671 BINDING SITE2, designated SEQ ID:16491 and SEQ ID:13041 respectively, to the nucleotide sequence of GAM281 RNA, herein designated GAM RNA, also designated SEQ ID:278.

Another function of GAM281 is therefore inhibition of FLJ20671 (Accession NP_060394.1). Accordingly, utilities of GAM281 include diagnosis, prevention and treatment of diseases and clinical conditions associated with FLJ20671.

FLJ20700 (Accession NP_060402.1) is another GAM281 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:18943, to the nucleotide sequence of GAM281 RNA, herein designated GAM RNA, also designated SEQ ID:278.

Another function of GAM281 is therefore inhibition of FLJ20700 (Accession NP_060402.1). Accordingly, utilities of GAM281 include diagnosis, prevention and treatment of diseases and clinical conditions associated with FLJ20700.

FLJ20813 (Accession NP_060431.1) is another GAM281 target gene, herein designated TARGET GENE. FLJ20813 BINDING SITE is a target binding site found in the 3' untranslated region of mRNA encoded by FLJ20813, corresponding to a target binding site such as BINDING SITE I, BINDING SITE II or BINDING SITE III of FIG. 8. Table 4 illustrates the complementarity of the nucleotide sequences of FLJ20813 BINDING SITE, designated SEQ ID:10574, to the nucleotide sequence of GAM281 RNA, herein designated GAM RNA, also designated SEQ ID:278.

Another function of GAM281 is therefore inhibition of FLJ20813 (Accession NP_060431.1). Accordingly, utilities of GAM281 include diagnosis, prevention and treatment of diseases and clinical conditions associated with FLJ20813.

FLJ20825 (Accession NP_060432.1) is another GAM281 target gene, herein designated TARGET GENE. FLJ20825 BINDING SITE1 and FLJ20825 BINDING SITE2 are target binding sites found in untranslated regions of mRNA encoded by FLJ20825, corresponding to target binding sites such as BINDING SITE I, BINDING SITE II or BINDING SITE III of FIG. 8. Table 4 illustrates the complementarity of the nucleotide sequences of FLJ20825 BINDING SITE1 and FLJ20825 BINDING SITE2, designated SEQ ID:3016 and SEQ ID:19008 respectively, to the nucleotide sequence of GAM281 RNA, herein designated GAM RNA, also designated SEQ ID:278.

Another function of GAM281 is therefore inhibition of FLJ20825 (Accession NP_060432.1). Accordingly, utilities of GAM281 include diagnosis, prevention and treatment of diseases and clinical conditions associated with FLJ20825.

FLJ20886 (Accession NP_079475.1) is another GAM281 target gene, herein designated TARGET GENE. FLJ20886 BINDING SITE is a target binding site found in the 5' untranslated region of mRNA encoded by FLJ20886, corresponding to a target binding site such as BINDING SITE I, BINDING SITE II or BINDING SITE III of FIG. 8. Table 4 illustrates the complementarity of the nucleotide sequences of FLJ20886 BINDING SITE, designated SEQ ID:5155, to the nucleotide sequence of GAM281 RNA, herein designated GAM RNA, also designated SEQ ID:278.

Another function of GAM281 is therefore inhibition of FLJ20886 (Accession NP_079475.1). Accordingly, utilities of GAM281 include diagnosis, prevention and treatment of diseases and clinical conditions associated with FLJ20886.

FLJ21128 (Accession NP_079359.2) is another GAM281 target gene, herein designated TARGET GENE. FLJ21128 BINDING SITE is a target binding site found in the 3' untranslated region of mRNA encoded by FLJ21128, corresponding to a target binding site such as BINDING SITE I, BINDING SITE II or BINDING SITE III of FIG. 8. Table 4 illustrates the complementarity of the nucleotide sequences of FLJ21128 BINDING SITE, designated SEQ ID:17516, to the nucleotide sequence of GAM281 RNA, herein designated GAM RNA, also designated SEQ ID:278.

Another function of GAM281 is therefore inhibition of FLJ21128 (Accession NP_079359.2). Accordingly, utilities of GAM281 include diagnosis, prevention and treatment of diseases and clinical conditions associated with FLJ21128.

FLJ21603 (Accession NP_079038.1) is another GAM281 target gene, herein designated TARGET GENE. FLJ21603 BINDING SITE is a target binding site found in the 3' untranslated region of mRNA encoded by FLJ21603, corresponding to a target binding site such as BINDING SITE I, BINDING SITE II or BINDING SITE III of FIG. 8. Table 4 illustrates the complementarity of the nucleotide sequences of FLJ21603 BINDING SITE, designated SEQ ID:15047, to the nucleotide sequence of GAM281 RNA, herein designated GAM RNA, also designated SEQ ID:278.

Another function of GAM281 is therefore inhibition of FLJ21603 (Accession NP_079038.1). Accordingly, utilities of GAM281 include diagnosis, prevention and treatment of diseases and clinical conditions associated with FLJ21603.

FLJ21673 (Accession NP_112160.1) is another GAM281 target gene, herein designated TARGET GENE. FLJ21673 BINDING SITE is a target binding site found in the 5' untranslated region of mRNA encoded by FLJ21673, corresponding to a target binding site such as BINDING SITE I, BINDING SITE II or BINDING SITE III of FIG. 8. Table 4 illustrates the complementarity of the nucleotide sequences of FLJ21673 BINDING SITE, designated SEQ ID:1435, to the nucleotide sequence of GAM281 RNA, herein designated GAM RNA, also designated SEQ ID:278.

Another function of GAM281 is therefore inhibition of FLJ21673 (Accession NP_112160.1). Accordingly, utilities of GAM281 include diagnosis, prevention and treatment of diseases and clinical conditions associated with FLJ21673.

FLJ21777 (Accession NP_115585.1) is another GAM281 target gene, herein designated TARGET GENE. FLJ21777 BINDING SITE is a target binding site found in the 3' untranslated region of mRNA encoded by FLJ21777, corresponding to a target binding site such as BINDING SITE I, BINDING SITE II or BINDING SITE III of FIG. 8. Table 4 illustrates the complementarity of the nucleotide sequences of FLJ21777 BINDING SITE, designated SEQ ID:4203, to the nucleotide sequence of GAM281 RNA, herein designated GAM RNA, also designated SEQ ID:278.

Another function of GAM281 is therefore inhibition of FLJ21777 (Accession NP_115585.1). Accordingly, utilities of GAM281 include diagnosis, prevention and treatment of diseases and clinical conditions associated with FLJ21777.

FLJ21865 (Accession NP_073596.1) is another GAM281 target gene, herein designated TARGET GENE. FLJ21865 BINDING SITE is a target binding site found in the 3' untranslated region of mRNA encoded by FLJ21865, corresponding to a target binding site such as BINDING SITE I, BINDING SITE II or BINDING SITE III of FIG. 8. Table 4 illustrates the complementarity of the nucleotide sequences of FLJ21865 BINDING SITE, designated SEQ ID:13223, to the nucleotide sequence of GAM281 RNA, herein designated GAM RNA, also designated SEQ ID:278.

Another function of GAM281 is therefore inhibition of FLJ21865 (Accession NP_073596.1). Accordingly, utilities of GAM281 include diagnosis, prevention and treatment of diseases and clinical conditions associated with FLJ21865.

FLJ22029 (Accession NP_079225.2) is another GAM281 target gene, herein designated TARGET GENE. FLJ22029 BINDING SITE1 through FLJ22029 BINDING SITE3 are target binding sites found in untranslated regions of mRNA encoded by FLJ22029, corresponding to target binding sites such as BINDING SITE I, BINDING SITE II or BINDING SITE III of FIG. 8. Table 4 illustrates the complementarity of the nucleotide sequences of FLJ22029 BINDING SITE1 through FLJ22029 BINDING SITE3, designated SEQ ID:5439, SEQ ID:19447 and SEQ ID:1727 respectively, to the nucleotide sequence of GAM281 RNA, herein designated GAM RNA, also designated SEQ ID:278.

Another function of GAM281 is therefore inhibition of FLJ22029 (Accession NP_079225.2). Accordingly, utilities of GAM281 include diagnosis, prevention and treatment of diseases and clinical conditions associated with FLJ22029.

FLJ22167 (Accession NP_078809.2) is another GAM281 target gene, herein designated TARGET GENE. FLJ22167 BINDING SITE is a target binding site found in the 5' untranslated region of mRNA encoded by FLJ22167, corresponding to a target binding site such as BINDING SITE I, BINDING SITE II or BINDING SITE III of FIG. 8. Table 4 illustrates the complementarity of the nucleotide sequences of FLJ22167 BINDING SITE, designated SEQ ID:15971, to the nucleotide sequence of GAM281 RNA, herein designated GAM RNA, also designated SEQ ID:278.

Another function of GAM281 is therefore inhibition of FLJ22167 (Accession NP_078809.2). Accordingly, utilities of GAM281 include diagnosis, prevention and treatment of diseases and clinical conditions associated with FLJ22167.

FLJ22329 (Accession NP_078932.2) is another GAM281 target gene, herein designated TARGET GENE. FLJ22329 BINDING SITE is a target binding site found in the 3' untranslated region of mRNA encoded by FLJ22329, corresponding to a target binding site such as BINDING SITE I, BINDING SITE II or BINDING SITE III of FIG. 8. Table 4 illustrates the complementarity of the nucleotide sequences of FLJ22329 BINDING SITE, designated SEQ ID:9543, to the nucleotide sequence of GAM281 RNA, herein designated GAM RNA, also designated SEQ ID:278.

Another function of GAM281 is therefore inhibition of FLJ22329 (Accession NP_078932.2). Accordingly, utilities of GAM281 include diagnosis, prevention and treatment of diseases and clinical conditions associated with FLJ22329.

FLJ22531 (Accession NP_078926.2) is another GAM281 target gene, herein designated TARGET GENE. FLJ22531 BINDING SITE is a target binding site found in the 5' untranslated region of mRNA encoded by FLJ22531, corresponding to a target binding site such as BINDING SITE I, BINDING SITE II or BINDING SITE III of FIG. 8. Table 4 illustrates the complementarity of the nucleotide sequences of FLJ22531 BINDING SITE, designated SEQ ID:5636, to the nucleotide sequence of GAM281 RNA, herein designated GAM RNA, also designated SEQ ID:278.

Another function of GAM281 is therefore inhibition of FLJ22531 (Accession NP_078926.2). Accordingly, utilities of GAM281 include diagnosis, prevention and treatment of diseases and clinical conditions associated with FLJ22531.

FLJ22693 (Accession NP_073587.1) is another GAM281 target gene, herein designated TARGET GENE. FLJ22693 BINDING SITE is a target binding site found in the 5' untranslated region of mRNA encoded by FLJ22693, corresponding to a target binding site such as BINDING SITE I, BINDING SITE II or BINDING SITE III of FIG. 8. Table 4 illustrates the complementarity of the nucleotide sequences of FLJ22693 BINDING SITE, designated SEQ ID:4200, to the nucleotide sequence of GAM281 RNA, herein designated GAM RNA, also designated SEQ ID:278.

Another function of GAM281 is therefore inhibition of FLJ22693 (Accession NP_073587.1). Accordingly, utilities of GAM281 include diagnosis, prevention and treatment of diseases and clinical conditions associated with FLJ22693.

FLJ22794 (Accession NP_071357.1) is another GAM281 target gene, herein designated TARGET GENE. FLJ22794 BINDING SITE is a target binding site found in the 3' untranslated region of mRNA encoded by FLJ22794, corresponding to a target binding site such as BINDING SITE I, BINDING SITE II or BINDING SITE III of FIG. 8. Table 4 illustrates the complementarity of the nucleotide sequences of FLJ22794 BINDING SITE, designated SEQ ID:5559, to the nucleotide sequence of GAM281 RNA, herein designated GAM RNA, also designated SEQ ID:278.

Another function of GAM281 is therefore inhibition of FLJ22794 (Accession NP_071357.1). Accordingly, utilities of GAM281 include diagnosis, prevention and treatment of diseases and clinical conditions associated with FLJ22794.

FLJ22955 (Accession NP_079095.2) is another GAM281 target gene, herein designated TARGET GENE. FLJ22955 BINDING SITE is a target binding site found in the 3' untranslated region of mRNA encoded by FLJ22955, corresponding to a target binding site such as BINDING SITE I, BINDING SITE II or BINDING SITE III of FIG. 8. Table 4 illustrates the complementarity of the nucleotide sequences of FLJ22955 BINDING SITE, designated SEQ ID:19507, to the nucleotide sequence of GAM281 RNA, herein designated GAM RNA, also designated SEQ ID:278.

Another function of GAM281 is therefore inhibition of FLJ22955 (Accession NP_079095.2). Accordingly, utilities of GAM281 include diagnosis, prevention and treatment of diseases and clinical conditions associated with FLJ22955.

FLJ22965 (Accession NP_071384.1) is another GAM281 target gene, herein designated TARGET GENE. FLJ22965 BINDING SITE is a target binding site found in the 3' untranslated region of mRNA encoded by FLJ22965, corresponding to a target binding site such as BINDING SITE I, BINDING SITE II or BINDING SITE III of FIG. 8. Table 4 illustrates the complementarity of the nucleotide sequences of FLJ22965 BINDING SITE, designated SEQ ID:2808, to the nucleotide sequence of GAM281 RNA, herein designated GAM RNA, also designated SEQ ID:278.

Another function of GAM281 is therefore inhibition of FLJ22965 (Accession NP_071384.1). Accordingly, utilities of GAM281 include diagnosis, prevention and treatment of diseases and clinical conditions associated with FLJ22965.

FLJ23024 (Accession NP_079212.1) is another GAM281 target gene, herein designated TARGET GENE. FLJ23024 BINDING SITE is a target binding site found in the 3' untranslated region of mRNA encoded by FLJ23024, corresponding to a target binding site such as BINDING SITE I, BINDING SITE II or BINDING SITE III of FIG. 8. Table 4 illustrates the complementarity of the nucleotide sequences of FLJ23024 BINDING SITE, designated SEQ ID:9682, to the nucleotide sequence of GAM281 RNA, herein designated GAM RNA, also designated SEQ ID:278.

Another function of GAM281 is therefore inhibition of FLJ23024 (Accession NP_079212.1). Accordingly, utilities of GAM281 include diagnosis, prevention and treatment of diseases and clinical conditions associated with FLJ23024.

FLJ23040 (Accession NP_079450.1) is another GAM281 target gene, herein designated TARGET GENE. FLJ23040 BINDING SITE1 and FLJ23040 BINDING SITE2 are target binding sites found in untranslated regions of mRNA encoded by FLJ23040, corresponding to target binding sites such as BINDING SITE I, BINDING SITE II or BINDING SITE III of FIG. 8. Table 4 illustrates the complementarity of the nucleotide sequences of FLJ23040 BINDING SITE1 and FLJ23040 BINDING SITE2, designated SEQ ID:18256 and SEQ ID:14760 respectively, to the nucleotide sequence of GAM281 RNA, herein designated GAM RNA, also designated SEQ ID:278.

Another function of GAM281 is therefore inhibition of FLJ23040 (Accession NP_079450.1). Accordingly, utilities of GAM281 include diagnosis, prevention and treatment of diseases and clinical conditions associated with FLJ23040.

FLJ23053 (Accession NP_075058.1) is another GAM281 target gene, herein designated TARGET GENE. FLJ23053 BINDING SITE is a target binding site found in the 3' untranslated region of mRNA encoded by FLJ23053, corresponding to a target binding site such as BINDING SITE I, BINDING SITE II or BINDING SITE III of FIG. 8. Table 4 illustrates the complementarity of the nucleotide sequences of FLJ23053 BINDING SITE, designated SEQ ID:8693, to the nucleotide sequence of GAM281 RNA, herein designated GAM RNA, also designated SEQ ID:278.

Another function of GAM281 is therefore inhibition of FLJ23053 (Accession NP_075058.1). Accordingly, utilities of GAM281 include diagnosis, prevention and treatment of diseases and clinical conditions associated with FLJ23053.

FLJ23186 (Accession NP_078892.1) is another GAM281 target gene, herein designated TARGET GENE. FLJ23186 BINDING SITE is a target binding site found in the 3' untranslated region of mRNA encoded by FLJ23186, corresponding to a target binding site such as BINDING SITE I, BINDING SITE II or BINDING SITE III of FIG. 8. Table 4 illustrates the complementarity of the nucleotide sequences of FLJ23186 BINDING SITE, designated SEQ ID:1340, to the nucleotide sequence of GAM281 RNA, herein designated GAM RNA, also designated SEQ ID:278.

Another function of GAM281 is therefore inhibition of FLJ23186 (Accession NP_078892.1). Accordingly, utilities of GAM281 include diagnosis, prevention and treatment of diseases and clinical conditions associated with FLJ23186.

FLJ23263 (Accession NP_079391.1) is another GAM281 target gene, herein designated TARGET GENE. FLJ23263 BINDING SITE is a target binding site found in the 5' untranslated region of mRNA encoded by FLJ23263, corresponding to a target binding site such as BINDING SITE I, BINDING SITE II or BINDING SITE III of FIG. 8. Table 4 illustrates the complementarity of the nucleotide sequences of FLJ23263 BINDING SITE, designated SEQ ID:11523, to the nucleotide sequence of GAM281 RNA, herein designated GAM RNA, also designated SEQ ID:278.

Another function of GAM281 is therefore inhibition of FLJ23263 (Accession NP_079391.1). Accordingly, utilities of GAM281 include diagnosis, prevention and treatment of diseases and clinical conditions associated with FLJ23263.

FLJ23356 (Accession NP_115613.1) is another GAM281 target gene, herein designated TARGET GENE. FLJ23356 BINDING SITE is a target binding site found in the 3' untranslated region of mRNA encoded by FLJ23356, corresponding to a target binding site such as BINDING SITE I, BINDING SITE II or BINDING SITE III of FIG. 8. Table 4 illustrates the complementarity of the nucleotide sequences of FLJ23356 BINDING SITE, designated SEQ ID:12273, to the nucleotide sequence of GAM281 RNA, herein designated GAM RNA, also designated SEQ ID:278.

Another function of GAM281 is therefore inhibition of FLJ23356 (Accession NP_115613.1). Accordingly, utilities of GAM281 include diagnosis, prevention and treatment of diseases and clinical conditions associated with FLJ23356.

FLJ23392 (Accession NP_079060.1) is another GAM281 target gene, herein designated TARGET GENE. FLJ23392

BINDING SITE1 through FLJ23392 BINDING SITE3 are target binding sites found in untranslated regions of mRNA encoded by FLJ23392, corresponding to target binding sites such as BINDING SITE I, BINDING SITE II or BINDING SITE III of FIG. 8. Table 4 illustrates the complementarity of the nucleotide sequences of FLJ23392 BINDING SITE1 through FLJ23392 BINDING SITE3, designated SEQ ID:20052, SEQ ID:9148 and SEQ ID:5554 respectively, to the nucleotide sequence of GAM281 RNA, herein designated GAM RNA, also designated SEQ ID:278.

Another function of GAM281 is therefore inhibition of FLJ23392 (Accession NP_079060.1). Accordingly, utilities of GAM281 include diagnosis, prevention and treatment of diseases and clinical conditions associated with FLJ23392.

FLJ23416 (Accession NP_115614.1) is another GAM281 target gene, herein designated TARGET GENE. FLJ23416 BINDING SITE is a target binding site found in the 3' untranslated region of mRNA encoded by FLJ23416, corresponding to a target binding site such as BINDING SITE I, BINDING SITE II or BINDING SITE III of FIG. 8. Table 4 illustrates the complementarity of the nucleotide sequences of FLJ23416 BINDING SITE, designated SEQ ID:2152, to the nucleotide sequence of GAM281 RNA, herein designated GAM RNA, also designated SEQ ID:278.

Another function of GAM281 is therefore inhibition of FLJ23416 (Accession NP_115614.1). Accordingly, utilities of GAM281 include diagnosis, prevention and treatment of diseases and clinical conditions associated with FLJ23416.

FLJ23556 (Accession NP_079156.1) is another GAM281 target gene, herein designated TARGET GENE. FLJ23556 BINDING SITE1 and FLJ23556 BINDING SITE2 are target binding sites found in untranslated regions of mRNA encoded by FLJ23556, corresponding to target binding sites such as BINDING SITE I, BINDING SITE II or BINDING SITE III of FIG. 8. Table 4 illustrates the complementarity of the nucleotide sequences of FLJ23556 BINDING SITE1 and FLJ23556 BINDING SITE2, designated SEQ ID:17969 and SEQ ID:11323 respectively, to the nucleotide sequence of GAM281 RNA, herein designated GAM RNA, also designated SEQ ID:278.

Another function of GAM281 is therefore inhibition of FLJ23556 (Accession NP_079156.1). Accordingly, utilities of GAM281 include diagnosis, prevention and treatment of diseases and clinical conditions associated with FLJ23556.

FLJ23563 (Accession XP_041701.4) is another GAM281 target gene, herein designated TARGET GENE. FLJ23563 BINDING SITE is a target binding site found in the 3' untranslated region of mRNA encoded by FLJ23563, corresponding to a target binding site such as BINDING SITE I, BINDING SITE II or BINDING SITE III of FIG. 8. Table 4 illustrates the complementarity of the nucleotide sequences of FLJ23563 BINDING SITE, designated SEQ ID:15048, to the nucleotide sequence of GAM281 RNA, herein designated GAM RNA, also designated SEQ ID:278.

Another function of GAM281 is therefore inhibition of FLJ23563 (Accession XP_041701.4). Accordingly, utilities of GAM281 include diagnosis, prevention and treatment of diseases and clinical conditions associated with FLJ23563.

FLJ25416 (Accession NP_659455.2) is another GAM281 target gene, herein designated TARGET GENE. FLJ25416 BINDING SITE is a target binding site found in the 5' untranslated region of mRNA encoded by FLJ25416, corresponding to a target binding site such as BINDING SITE I, BINDING SITE II or BINDING SITE III of FIG. 8. Table 4 illustrates the complementarity of the nucleotide sequences of FLJ25416 BINDING SITE, designated SEQ ID:16915, to the nucleotide sequence of GAM281 RNA, herein designated GAM RNA, also designated SEQ ID:278.

Another function of GAM281 is therefore inhibition of FLJ25416 (Accession NP_659455.2). Accordingly, utilities of GAM281 include diagnosis, prevention and treatment of diseases and clinical conditions associated with FLJ25416.

FLJ25421 (Accession NP_689725.2) is another GAM281 target gene, herein designated TARGET GENE. FLJ25421 BINDING SITE is a target binding site found in the 5' untranslated region of mRNA encoded by FLJ25421, corresponding to a target binding site such as BINDING SITE I, BINDING SITE II or BINDING SITE III of FIG. 8. Table 4 illustrates the complementarity of the nucleotide sequences of FLJ25421 BINDING SITE, designated SEQ ID:12127, to the nucleotide sequence of GAM281 RNA, herein designated GAM RNA, also designated SEQ ID:278.

Another function of GAM281 is therefore inhibition of FLJ25421 (Accession NP_689725.2). Accordingly, utilities of GAM281 include diagnosis, prevention and treatment of diseases and clinical conditions associated with FLJ25421.

FLJ25795 (Accession NP_689633.1) is another GAM281 target gene, herein designated TARGET GENE. FLJ25795 BINDING SITE is a target binding site found in the 3' untranslated region of mRNA encoded by FLJ25795, corresponding to a target binding site such as BINDING SITE I, BINDING SITE II or BINDING SITE III of FIG. 8. Table 4 illustrates the complementarity of the nucleotide sequences of FLJ25795 BINDING SITE, designated SEQ ID:934, to the nucleotide sequence of GAM281 RNA, herein designated GAM RNA, also designated SEQ ID:278.

Another function of GAM281 is therefore inhibition of FLJ25795 (Accession NP_689633.1). Accordingly, utilities of GAM281 include diagnosis, prevention and treatment of diseases and clinical conditions associated with FLJ25795.

FLJ30507 (Accession NP_694555.1) is another GAM281 target gene, herein designated TARGET GENE. FLJ30507 BINDING SITE is a target binding site found in the 5' untranslated region of mRNA encoded by FLJ30507, corresponding to a target binding site such as BINDING SITE I, BINDING SITE II or BINDING SITE III of FIG. 8. Table 4 illustrates the complementarity of the nucleotide sequences of FLJ30507 BINDING SITE, designated SEQ ID:17957, to the nucleotide sequence of GAM281 RNA, herein designated GAM RNA, also designated SEQ ID:278.

Another function of GAM281 is therefore inhibition of FLJ30507 (Accession NP_694555.1). Accordingly, utilities of GAM281 include diagnosis, prevention and treatment of diseases and clinical conditions associated with FLJ30507.

FLJ30532 (Accession NP_653325.1) is another GAM281 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:19834, to the nucleotide sequence of GAM281 RNA, herein designated GAM RNA, also designated SEQ ID:278.

Another function of GAM281 is therefore inhibition of FLJ30532 (Accession NP_653325.1). Accordingly, utilities of GAM281 include diagnosis, prevention and treatment of diseases and clinical conditions associated with FLJ30532.

FLJ31139 (Accession NP_775928.1) is another GAM281 target gene, herein designated TARGET GENE. FLJ31139 BINDING SITE1 through FLJ31139 BINDING SITE3 are target binding sites found in untranslated regions of mRNA encoded by FLJ31139, corresponding to target binding sites such as BINDING SITE I, BINDING SITE II or BINDING SITE III of FIG. 8. Table 4 illustrates the complementarity of the nucleotide sequences of FLJ31139 BINDING SITE1 through FLJ31139 BINDING SITE3, designated SEQ ID:15200, SEQ ID:18868 and SEQ ID:3952 respectively, to the nucleotide sequence of GAM281 RNA, herein designated GAM RNA, also designated SEQ ID:278.

Another function of GAM281 is therefore inhibition of FLJ31139 (Accession NP_775928.1). Accordingly, utilities of GAM281 include diagnosis, prevention and treatment of diseases and clinical conditions associated with FLJ31139.

FLJ31153 (Accession NP_653201.1) is another GAM281 target gene, herein designated TARGET GENE. FLJ31153 BINDING SITE is a target binding site found in the 3' untranslated region of mRNA encoded by FLJ31153, corresponding to a target binding site such as BINDING SITE I, BINDING SITE II or BINDING SITE III of FIG. 8. Table 4 illustrates the complementarity of the nucleotide sequences of FLJ31153 BINDING SITE, designated SEQ ID:7373, to the nucleotide sequence of GAM281 RNA, herein designated GAM RNA, also designated SEQ ID:278.

Another function of GAM281 is therefore inhibition of FLJ31153 (Accession NP_653201.1). Accordingly, utilities of GAM281 include diagnosis, prevention and treatment of diseases and clinical conditions associated with FLJ31153.

FLJ31166 (Accession NP_694567.1) is another GAM281 target gene, herein designated TARGET GENE. FLJ31166 BINDING SITE is a target binding site found in the 3' untranslated region of mRNA encoded by FLJ31166, corresponding to a target binding site such as BINDING SITE I, BINDING SITE II or BINDING SITE III of FIG. 8. Table 4 illustrates the complementarity of the nucleotide sequences of FLJ31166 BINDING SITE, designated SEQ ID:19301, to the nucleotide sequence of GAM281 RNA, herein designated GAM RNA, also designated SEQ ID:278.

Another function of GAM281 is therefore inhibition of FLJ31166 (Accession NP_694567.1). Accordingly, utilities of GAM281 include diagnosis, prevention and treatment of diseases and clinical conditions associated with FLJ31166.

FLJ31322 (Accession NP_689600.1) is another GAM281 target gene, herein designated TARGET GENE. FLJ31322 BINDING SITE is a target binding site found in the 3' untranslated region of mRNA encoded by FLJ31322, corresponding to a target binding site such as BINDING SITE I, BINDING SITE II or BINDING SITE III of FIG. 8. Table 4 illustrates the complementarity of the nucleotide sequences of FLJ31322 BINDING SITE, designated SEQ ID:17683, to the nucleotide sequence of GAM281 RNA, herein designated GAM RNA, also designated SEQ ID:278.

Another function of GAM281 is therefore inhibition of FLJ31322 (Accession NP_689600.1). Accordingly, utilities of GAM281 include diagnosis, prevention and treatment of diseases and clinical conditions associated with FLJ31322.

FLJ31338 (Accession NP_689682.1) is another GAM281 target gene, herein designated TARGET GENE. FLJ31338 BINDING SITE is a target binding site found in the 3' untranslated region of mRNA encoded by FLJ31338, corresponding to a target binding site such as BINDING SITE I, BINDING SITE II or BINDING SITE III of FIG. 8. Table 4 illustrates the complementarity of the nucleotide sequences of FLJ31338 BINDING SITE, designated SEQ ID:1672, to the nucleotide sequence of GAM281 RNA, herein designated GAM RNA, also designated SEQ ID:278.

Another function of GAM281 is therefore inhibition of FLJ31338 (Accession NP_689682.1). Accordingly, utilities of GAM281 include diagnosis, prevention and treatment of diseases and clinical conditions associated with FLJ31338.

FLJ31384 (Accession NP_689685.1) is another GAM281 target gene, herein designated TARGET GENE. FLJ31384 BINDING SITE is a target binding site found in the 3' untranslated region of mRNA encoded by FLJ31384, corresponding to a target binding site such as BINDING SITE I, BINDING SITE II or BINDING SITE III of FIG. 8. Table 4 illustrates the complementarity of the nucleotide sequences of FLJ31384 BINDING SITE, designated SEQ ID:14326, to the nucleotide sequence of GAM281 RNA, herein designated GAM RNA, also designated SEQ ID:278.

Another function of GAM281 is therefore inhibition of FLJ31384 (Accession NP_689685.1). Accordingly, utilities of GAM281 include diagnosis, prevention and treatment of diseases and clinical conditions associated with FLJ31384.

FLJ31393 (Accession NP_694569.1) is another GAM281 target gene, herein designated TARGET GENE. FLJ31393 BINDING SITE is a target binding site found in the 5' untranslated region of mRNA encoded by FLJ31393, corresponding to a target binding site such as BINDING SITE I, BINDING SITE II or BINDING SITE III of FIG. 8. Table 4 illustrates the complementarity of the nucleotide sequences of FLJ31393 BINDING SITE, designated SEQ ID:9670, to the nucleotide sequence of GAM281 RNA, herein designated GAM RNA, also designated SEQ ID:278.

Another function of GAM281 is therefore inhibition of FLJ31393 (Accession NP_694569.1). Accordingly, utilities of GAM281 include diagnosis, prevention and treatment of diseases and clinical conditions associated with FLJ31393.

FLJ31401 (Accession NP_689877.1) is another GAM281 target gene, herein designated TARGET GENE. FLJ31401 BINDING SITE is a target binding site found in the 3' untranslated region of mRNA encoded by FLJ31401, corresponding to a target binding site such as BINDING SITE I, BINDING SITE II or BINDING SITE III of FIG. 8. Table 4 illustrates the complementarity of the nucleotide sequences of FLJ31401 BINDING SITE, designated SEQ ID:16543, to the nucleotide sequence of GAM281 RNA, herein designated GAM RNA, also designated SEQ ID:278.

Another function of GAM281 is therefore inhibition of FLJ31401 (Accession NP_689877.1). Accordingly, utilities of GAM281 include diagnosis, prevention and treatment of diseases and clinical conditions associated with FLJ31401.

FLJ31434 (Accession NP_689709.1) is another GAM281 target gene, herein designated TARGET GENE. FLJ31434 BINDING SITE is a target binding site found in the 3' untranslated region of mRNA encoded by FLJ31434, corresponding to a target binding site such as BINDING SITE I, BINDING SITE II or BINDING SITE III of FIG. 8. Table 4 illustrates the complementarity of the nucleotide sequences of FLJ31434 BINDING SITE, designated SEQ ID:9290, to the nucleotide sequence of GAM281 RNA, herein designated GAM RNA, also designated SEQ ID:278.

Another function of GAM281 is therefore inhibition of FLJ31434 (Accession NP_689709.1). Accordingly, utilities of GAM281 include diagnosis, prevention and treatment of diseases and clinical conditions associated with FLJ31434.

FLJ32096 (Accession NP_776156.1) is another GAM281 target gene, herein designated TARGET GENE. FLJ32096 BINDING SITE1 and FLJ32096 BINDING SITE2 are target binding sites found in untranslated regions of mRNA encoded by FLJ32096, corresponding to target binding sites such as BINDING SITE I, BINDING SITE II or BINDING SITE III of FIG. 8. Table 4 illustrates the complementarity of the nucleotide sequences of FLJ32096 BINDING SITE1 and FLJ32096 BINDING SITE2, designated SEQ ID:1025 and SEQ ID:16043 respectively, to the nucleotide sequence of GAM281 RNA, herein designated GAM RNA, also designated SEQ ID:278.

Another function of GAM281 is therefore inhibition of FLJ32096 (Accession NP_776156.1). Accordingly, utilities of GAM281 include diagnosis, prevention and treatment of diseases and clinical conditions associated with FLJ32096.

FLJ32130 (Accession NP_689671.2) is another GAM281 target gene, herein designated TARGET GENE. FLJ32130 BINDING SITE1 through FLJ32130 BINDING SITE3 are target binding sites found in untranslated regions of mRNA encoded by FLJ32130, corresponding to target binding sites such as BINDING SITE I, BINDING SITE II or BINDING SITE III of FIG. 8. Table 4 illustrates the complementarity of the nucleotide sequences of FLJ32130 BINDING SITE1 through FLJ32130 BINDING SITE3, designated SEQ ID:4630, SEQ ID:15049 and SEQ ID:2061 respectively, to the nucleotide sequence of GAM281 RNA, herein designated GAM RNA, also designated SEQ ID:278.

Another function of GAM281 is therefore inhibition of FLJ32130 (Accession NP_689671.2). Accordingly, utilities of GAM281 include diagnosis, prevention and treatment of diseases and clinical conditions associated with FLJ32130.

FLJ32206 (Accession NP_689710.1) is another GAM281 target gene, herein designated TARGET GENE. FLJ32206 BINDING SITE is a target binding site found in the 3' untranslated region of mRNA encoded by FLJ32206, corresponding to a target binding site such as BINDING SITE I, BINDING SITE II or BINDING SITE III of FIG. 8. Table 4 illustrates the complementarity of the nucleotide sequences of FLJ32206 BINDING SITE, designated SEQ ID:3860, to the nucleotide sequence of GAM281 RNA, herein designated GAM RNA, also designated SEQ ID:278.

Another function of GAM281 is therefore inhibition of FLJ32206 (Accession NP_689710.1). Accordingly, utilities of GAM281 include diagnosis, prevention and treatment of diseases and clinical conditions associated with FLJ32206.

FLJ32332 (Accession NP_653242.1) is another GAM281 target gene, herein designated TARGET GENE. FLJ32332 BINDING SITE is a target binding site found in the 3' untranslated region of mRNA encoded by FLJ32332, corresponding to a target binding site such as BINDING SITE I, BINDING SITE II or BINDING SITE III of FIG. 8. Table 4 illustrates the complementarity of the nucleotide sequences of FLJ32332 BINDING SITE, designated SEQ ID:12917, to the nucleotide sequence of GAM281 RNA, herein designated GAM RNA, also designated SEQ ID:278.

Another function of GAM281 is therefore inhibition of FLJ32332 (Accession NP_653242.1). Accordingly, utilities of GAM281 include diagnosis, prevention and treatment of diseases and clinical conditions associated with FLJ32332.

FLJ32334 (Accession NP_653166.1) is another GAM281 target gene, herein designated TARGET GENE. FLJ32334 BINDING SITE is a target binding site found in the 3' untranslated region of mRNA encoded by FLJ32334, corresponding to a target binding site such as BINDING SITE I, BINDING SITE II or BINDING SITE III of FIG. 8. Table 4 illustrates the complementarity of the nucleotide sequences of FLJ32334 BINDING SITE, designated SEQ ID:8493, to the nucleotide sequence of GAM281 RNA, herein designated GAM RNA, also designated SEQ ID:278.

Another function of GAM281 is therefore inhibition of FLJ32334 (Accession NP_653166.1). Accordingly, utilities of GAM281 include diagnosis, prevention and treatment of diseases and clinical conditions associated with FLJ32334.

FLJ32499 (Accession NP_653208.1) is another GAM281 target gene, herein designated TARGET GENE. FLJ32499 BINDING SITE is a target binding site found in the 3' untranslated region of mRNA encoded by FLJ32499, corresponding to a target binding site such as BINDING SITE I, BINDING SITE II or BINDING SITE III of FIG. 8. Table 4 illustrates the complementarity of the nucleotide sequences of FLJ32499 BINDING SITE, designated SEQ ID:4681, to the nucleotide sequence of GAM281 RNA, herein designated GAM RNA, also designated SEQ ID:278.

Another function of GAM281 is therefore inhibition of FLJ32499 (Accession NP_653208.1). Accordingly, utilities of GAM281 include diagnosis, prevention and treatment of diseases and clinical conditions associated with FLJ32499.

FLJ32731 (Accession NP_689632.1) is another GAM281 target gene, herein designated TARGET GENE. FLJ32731 BINDING SITE is a target binding site found in the 3' untranslated region of mRNA encoded by FLJ32731, corresponding to a target binding site such as BINDING SITE I, BINDING SITE II or BINDING SITE III of FIG. 8. Table 4 illustrates the complementarity of the nucleotide sequences of FLJ32731 BINDING SITE, designated SEQ ID:16099, to the nucleotide sequence of GAM281 RNA, herein designated GAM RNA, also designated SEQ ID:278.

Another function of GAM281 is therefore inhibition of FLJ32731 (Accession NP_689632.1). Accordingly, utilities of GAM281 include diagnosis, prevention and treatment of diseases and clinical conditions associated with FLJ32731.

FLJ32803 (Accession NP_694584.1) is another GAM281 target gene, herein designated TARGET GENE. FLJ32803 BINDING SITE is a target binding site found in the 3' untranslated region of mRNA encoded by FLJ32803, corresponding to a target binding site such as BINDING SITE I, BINDING SITE II or BINDING SITE III of FIG. 8. Table 4 illustrates the complementarity of the nucleotide sequences of FLJ32803 BINDING SITE, designated SEQ ID:1856, to the nucleotide sequence of GAM281 RNA, herein designated GAM RNA, also designated SEQ ID:278.

Another function of GAM281 is therefore inhibition of FLJ32803 (Accession NP_694584.1). Accordingly, utilities of GAM281 include diagnosis, prevention and treatment of diseases and clinical conditions associated with FLJ32803.

FLJ32865 (Accession NP_653214.1) is another GAM281 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:2146, to the nucleotide sequence of GAM281 RNA, herein designated GAM RNA, also designated SEQ ID:278.

Another function of GAM281 is therefore inhibition of FLJ32865 (Accession NP_653214.1). Accordingly, utilities of GAM281 include diagnosis, prevention and treatment of diseases and clinical conditions associated with FLJ32865.

FLJ32894 (Accession NP_653268.1) is another GAM281 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:7467, to the nucleotide sequence of GAM281 RNA, herein designated GAM RNA, also designated SEQ ID:278.

Another function of GAM281 is therefore inhibition of FLJ32894 (Accession NP_653268.1). Accordingly, utilities of GAM281 include diagnosis, prevention and treatment of diseases and clinical conditions associated with FLJ32894.

FLJ32932 (Accession NP_690873.1) is another GAM281 target gene, herein designated TARGET GENE. FLJ32932 BINDING SITE is a target binding site found in the 3' untranslated region of mRNA encoded by FLJ32932, corresponding to a target binding site such as BINDING SITE I, BINDING SITE II or BINDING SITE III of FIG. 8. Table 4 illustrates the complementarity of the nucleotide sequences of FLJ32932 BINDING SITE, designated SEQ ID:9555, to the nucleotide sequence of GAM281 RNA, herein designated GAM RNA, also designated SEQ ID:278.

Another function of GAM281 is therefore inhibition of FLJ32932 (Accession NP_690873.1). Accordingly, utilities of GAM281 include diagnosis, prevention and treatment of diseases and clinical conditions associated with FLJ32932.

FLJ33505 (Accession NP_689530.1) is another GAM281 target gene, herein designated TARGET GENE. FLJ33505 BINDING SITE is a target binding site found in the 3' untranslated region of mRNA encoded by FLJ33505, corresponding to a target binding site such as BINDING SITE I, BINDING SITE II or BINDING SITE III of FIG. 8. Table 4 illustrates the complementarity of the nucleotide sequences of FLJ33505 BINDING SITE, designated SEQ ID:13693, to the nucleotide sequence of GAM281 RNA, herein designated GAM RNA, also designated SEQ ID:278.

Another function of GAM281 is therefore inhibition of FLJ33505 (Accession NP_689530.1). Accordingly, utilities of GAM281 include diagnosis, prevention and treatment of diseases and clinical conditions associated with FLJ33505.

FLJ33655 (Accession NP_775912.1) is another GAM281 target gene, herein designated TARGET GENE. FLJ33655 BINDING SITE is a target binding site found in the 3' untranslated region of mRNA encoded by FLJ33655, corresponding to a target binding site such as BINDING SITE I, BINDING SITE II or BINDING SITE III of FIG. 8. Table 4 illustrates the complementarity of the nucleotide sequences of FLJ33655 BINDING SITE, designated SEQ ID:16113, to the nucleotide sequence of GAM281 RNA, herein designated GAM RNA, also designated SEQ ID:278.

Another function of GAM281 is therefore inhibition of FLJ33655 (Accession NP_775912.1). Accordingly, utilities of GAM281 include diagnosis, prevention and treatment of diseases and clinical conditions associated with FLJ33655.

FLJ34817 (Accession NP_689516.1) is another GAM281 target gene, herein designated TARGET GENE. FLJ34817 BINDING SITE1 and FLJ34817 BINDING SITE2 are target binding sites found in untranslated regions of mRNA encoded by FLJ34817, corresponding to target binding sites such as BINDING SITE I, BINDING SITE II or BINDING SITE III of FIG. 8. Table 4 illustrates the complementarity of the nucleotide sequences of FLJ34817 BINDING SITE1 and FLJ34817 BINDING SITE2, designated SEQ ID:7075 and SEQ ID:4004 respectively, to the nucleotide sequence of GAM281 RNA, herein designated GAM RNA, also designated SEQ ID:278.

Another function of GAM281 is therefore inhibition of FLJ34817 (Accession NP_689516.1). Accordingly, utilities of GAM281 include diagnosis, prevention and treatment of diseases and clinical conditions associated with FLJ34817.

FLJ34922 (Accession NP_689483.1) is another GAM281 target gene, herein designated TARGET GENE. FLJ34922 BINDING SITE is a target binding site found in the 5' untranslated region of mRNA encoded by FLJ34922, corresponding to a target binding site such as BINDING SITE I, BINDING SITE II or BINDING SITE III of FIG. 8. Table 4 illustrates the complementarity of the nucleotide sequences of FLJ34922 BINDING SITE, designated SEQ ID:18132, to the nucleotide sequence of GAM281 RNA, herein designated GAM RNA, also designated SEQ ID:278.

Another function of GAM281 is therefore inhibition of FLJ34922 (Accession NP_689483.1). Accordingly, utilities of GAM281 include diagnosis, prevention and treatment of diseases and clinical conditions associated with FLJ34922.

FLJ34969 (Accession XP_114353.1) is another GAM281 target gene, herein designated TARGET GENE. FLJ34969 BINDING SITE is a target binding site found in the 3' untranslated region of mRNA encoded by FLJ34969, corresponding to a target binding site such as BINDING SITE I, BINDING SITE II or BINDING SITE III of FIG. 8. Table 4 illustrates the complementarity of the nucleotide sequences of FLJ34969 BINDING SITE, designated SEQ ID:581, to the nucleotide sequence of GAM281 RNA, herein designated GAM RNA, also designated SEQ ID:278.

Another function of GAM281 is therefore inhibition of FLJ34969 (Accession XP_114353.1). Accordingly, utilities of GAM281 include diagnosis, prevention and treatment of diseases and clinical conditions associated with FLJ34969.

FLJ35105 (Accession NP_689890.1) is another GAM281 target gene, herein designated TARGET GENE. FLJ35105 BINDING SITE is a target binding site found in the 5' untranslated region of mRNA encoded by FLJ35105, corresponding to a target binding site such as BINDING SITE I, BINDING SITE II or BINDING SITE III of FIG. 8. Table 4 illustrates the complementarity of the nucleotide sequences of FLJ35105 BINDING SITE, designated SEQ ID:18938, to the nucleotide sequence of GAM281 RNA, herein designated GAM RNA, also designated SEQ ID:278.

Another function of GAM281 is therefore inhibition of FLJ35105 (Accession NP_689890.1). Accordingly, utilities of GAM281 include diagnosis, prevention and treatment of diseases and clinical conditions associated with FLJ35105.

FLJ35487 (Accession NP_776181.1) is another GAM281 target gene, herein designated TARGET GENE. FLJ35487 BINDING SITE is a target binding site found in the 3' untranslated region of mRNA encoded by FLJ35487, corresponding to a target binding site such as BINDING SITE I, BINDING SITE II or BINDING SITE III of FIG. 8. Table 4 illustrates the complementarity of the nucleotide sequences of FLJ35487 BINDING SITE, designated SEQ ID:12556, to the nucleotide sequence of GAM281 RNA, herein designated GAM RNA, also designated SEQ ID:278.

Another function of GAM281 is therefore inhibition of FLJ35487 (Accession NP_776181.1). Accordingly, utilities of GAM281 include diagnosis, prevention and treatment of diseases and clinical conditions associated with FLJ35487.

FLJ35681 (Accession NP_787096.1) is another GAM281 target gene, herein designated TARGET GENE. FLJ35681 BINDING SITE1 and FLJ35681 BINDING SITE2 are target binding sites found in untranslated regions of mRNA encoded by FLJ35681, corresponding to target binding sites such as BINDING SITE I, BINDING SITE II or BINDING SITE III of FIG. 8. Table 4 illustrates the complementarity of the nucleotide sequences of FLJ35681 BINDING SITE1 and FLJ35681 BINDING SITE2, designated SEQ ID:1653 and SEQ ID:11521 respectively, to the nucleotide sequence of GAM281 RNA, herein designated GAM RNA, also designated SEQ ID:278.

Another function of GAM281 is therefore inhibition of FLJ35681 (Accession NP_787096.1). Accordingly, utilities of GAM281 include diagnosis, prevention and treatment of diseases and clinical conditions associated with FLJ35681.

FLJ35848 (Accession XP_290755.1) is another GAM281 target gene, herein designated TARGET GENE. FLJ35848

BINDING SITE is a target binding site found in the 3' untranslated region of mRNA encoded by FLJ35848, corresponding to a target binding site such as BINDING SITE I, BINDING SITE II or BINDING SITE III of FIG. 8. Table 4 illustrates the complementarity of the nucleotide sequences of FLJ35848 BINDING SITE, designated SEQ ID:14986, to the nucleotide sequence of GAM281 RNA, herein designated GAM RNA, also designated SEQ ID:278.

Another function of GAM281 is therefore inhibition of FLJ35848 (Accession XP_290755.1). Accordingly, utilities of GAM281 include diagnosis, prevention and treatment of diseases and clinical conditions associated with FLJ35848.

FLJ36112 (Accession NP_775950.1) is another GAM281 target gene, herein designated TARGET GENE. FLJ36112 BINDING SITE is a target binding site found in the 3' untranslated region of mRNA encoded by FLJ36112, corresponding to a target binding site such as BINDING SITE I, BINDING SITE II or BINDING SITE III of FIG. 8. Table 4 illustrates the complementarity of the nucleotide sequences of FLJ36112 BINDING SITE, designated SEQ ID:6601, to the nucleotide sequence of GAM281 RNA, herein designated GAM RNA, also designated SEQ ID:278.

Another function of GAM281 is therefore inhibition of FLJ36112 (Accession NP_775950.1). Accordingly, utilities of GAM281 include diagnosis, prevention and treatment of diseases and clinical conditions associated with FLJ36112.

FLJ36445 (Accession NP_694965.1) is another GAM281 target gene, herein designated TARGET GENE. FLJ36445 BINDING SITE is a target binding site found in the 3' untranslated region of mRNA encoded by FLJ36445, corresponding to a target binding site such as BINDING SITE I, BINDING SITE II or BINDING SITE III of FIG. 8. Table 4 illustrates the complementarity of the nucleotide sequences of FLJ36445 BINDING SITE, designated SEQ ID:2147, to the nucleotide sequence of GAM281 RNA, herein designated GAM RNA, also designated SEQ ID:278.

Another function of GAM281 is therefore inhibition of FLJ36445 (Accession NP_694965.1). Accordingly, utilities of GAM281 include diagnosis, prevention and treatment of diseases and clinical conditions associated with FLJ36445.

FLJ37045 (Accession NP_787085.1) is another GAM281 target gene, herein designated TARGET GENE. FLJ37045 BINDING SITE is a target binding site found in the 3' untranslated region of mRNA encoded by FLJ37045, corresponding to a target binding site such as BINDING SITE I, BINDING SITE II or BINDING SITE III of FIG. 8. Table 4 illustrates the complementarity of the nucleotide sequences of FLJ37045 BINDING SITE, designated SEQ ID:9497, to the nucleotide sequence of GAM281 RNA, herein designated GAM RNA, also designated SEQ ID:278.

Another function of GAM281 is therefore inhibition of FLJ37045 (Accession NP_787085.1). Accordingly, utilities of GAM281 include diagnosis, prevention and treatment of diseases and clinical conditions associated with FLJ37045.

FLJ37078 (Accession NP_694588.1) is another GAM281 target gene, herein designated TARGET GENE. FLJ37078 BINDING SITE is a target binding site found in the 5' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:11528, to the nucleotide sequence of GAM281 RNA, herein designated GAM RNA, also designated SEQ ID:278.

Another function of GAM281 is therefore inhibition of FLJ37078 (Accession NP_694588.1). Accordingly, utilities of GAM281 include diagnosis, prevention and treatment of diseases and clinical conditions associated with FLJ37078.

FLJ37266 (Accession NP_787088.1) is another GAM281 target gene, herein designated TARGET GENE. FLJ37266 BINDING SITE is a target binding site found in the 3' untranslated region of mRNA encoded by FLJ37266, corresponding to a target binding site such as BINDING SITE I, BINDING SITE II or BINDING SITE III of FIG. 8. Table 4 illustrates the complementarity of the nucleotide sequences of FLJ37266 BINDING SITE, designated SEQ ID:4602, to the nucleotide sequence of GAM281 RNA, herein designated GAM RNA, also designated SEQ ID:278.

Another function of GAM281 is therefore inhibition of FLJ37266 (Accession NP_787088.1). Accordingly, utilities of GAM281 include diagnosis, prevention and treatment of diseases and clinical conditions associated with FLJ37266.

FLJ37433 (Accession NP_848612.1) is another GAM281 target gene, herein designated TARGET GENE. FLJ37433 BINDING SITE is a target binding site found in the 3' untranslated region of mRNA encoded by FLJ37433, corresponding to a target binding site such as BINDING SITE I, BINDING SITE II or BINDING SITE III of FIG. 8. Table 4 illustrates the complementarity of the nucleotide sequences of FLJ37433 BINDING SITE, designated SEQ ID:8582, to the nucleotide sequence of GAM281 RNA, herein designated GAM RNA, also designated SEQ ID:278.

Another function of GAM281 is therefore inhibition of FLJ37433 (Accession NP_848612.1). Accordingly, utilities of GAM281 include diagnosis, prevention and treatment of diseases and clinical conditions associated with FLJ37433.

FLJ37543 (Accession NP_775938.1) is another GAM281 target gene, herein designated TARGET GENE. FLJ37543 BINDING SITE is a target binding site found in the 3' untranslated region of mRNA encoded by FLJ37543, corresponding to a target binding site such as BINDING SITE I, BINDING SITE II or BINDING SITE III of FIG. 8. Table 4 illustrates the complementarity of the nucleotide sequences of FLJ37543 BINDING SITE, designated SEQ ID:5495, to the nucleotide sequence of GAM281 RNA, herein designated GAM RNA, also designated SEQ ID:278.

Another function of GAM281 is therefore inhibition of FLJ37543 (Accession NP_775938.1). Accordingly, utilities of GAM281 include diagnosis, prevention and treatment of diseases and clinical conditions associated with FLJ37543.

FLJ38101 (Accession NP_694993.2) is another GAM281 target gene, herein designated TARGET GENE. FLJ38101 BINDING SITE is a target binding site found in the 3' untranslated region of mRNA encoded by FLJ38101, corresponding to a target binding site such as BINDING SITE I, BINDING SITE II or BINDING SITE III of FIG. 8. Table 4 illustrates the complementarity of the nucleotide sequences of FLJ38101 BINDING SITE, designated SEQ ID:5589, to the nucleotide sequence of GAM281 RNA, herein designated GAM RNA, also designated SEQ ID:278.

Another function of GAM281 is therefore inhibition of FLJ38101 (Accession NP_694993.2). Accordingly, utilities of GAM281 include diagnosis, prevention and treatment of diseases and clinical conditions associated with FLJ38101.

FLJ38149 (Accession XP_091919.5) is another GAM281 target gene, herein designated TARGET GENE. FLJ38149 BINDING SITE1 through FLJ38149 BINDING SITE3 are target binding sites found in untranslated regions of mRNA encoded by FLJ38149, corresponding to target binding sites such as BINDING SITE I, BINDING SITE II or BINDING SITE III of FIG. 8. Table 4 illustrates the complementarity of the nucleotide sequences of FLJ38149 BINDING SITE1 through FLJ38149 BINDING SITE3, designated SEQ ID:15044, SEQ ID:18971 and SEQ ID:9373 respectively, to the nucleotide sequence of GAM281 RNA, herein designated GAM RNA, also designated SEQ ID:278.

Another function of GAM281 is therefore inhibition of FLJ38149 (Accession XP_091919.5). Accordingly, utilities of GAM281 include diagnosis, prevention and treatment of diseases and clinical conditions associated with FLJ38149.

FLJ38281 (Accession NP_689814.1) is another GAM281 target gene, herein designated TARGET GENE. FLJ38281 BINDING SITE1 and FLJ38281 BINDING SITE2 are target binding sites found in untranslated regions of mRNA encoded by FLJ38281, corresponding to target binding sites such as BINDING SITE I, BINDING SITE II or BINDING SITE III of FIG. 8. Table 4 illustrates the complementarity of the nucleotide sequences of FLJ38281 BINDING SITE1 and FLJ38281 BINDING SITE2, designated SEQ ID:9492 and SEQ ID:6885 respectively, to the nucleotide sequence of GAM281 RNA, herein designated GAM RNA, also designated SEQ ID:278.

Another function of GAM281 is therefore inhibition of FLJ38281 (Accession NP_689814.1). Accordingly, utilities of GAM281 include diagnosis, prevention and treatment of diseases and clinical conditions associated with FLJ38281.

FLJ38607 (Accession NP_689867.1) is another GAM281 target gene, herein designated TARGET GENE. FLJ38607 BINDING SITE1 and FLJ38607 BINDING SITE2 are target binding sites found in untranslated regions of mRNA encoded by FLJ38607, corresponding to target binding sites such as BINDING SITE I, BINDING SITE II or BINDING SITE III of FIG. 8. Table 4 illustrates the complementarity of the nucleotide sequences of FLJ38607 BINDING SITE1 and FLJ38607 BINDING SITE2, designated SEQ ID:16688 and SEQ ID:7382 respectively, to the nucleotide sequence of GAM281 RNA, herein designated GAM RNA, also designated SEQ ID:278.

Another function of GAM281 is therefore inhibition of FLJ38607 (Accession NP_689867.1). Accordingly, utilities of GAM281 include diagnosis, prevention and treatment of diseases and clinical conditions associated with FLJ38607.

FLJ38792 (Accession NP_848615.1) is another GAM281 target gene, herein designated TARGET GENE. FLJ38792 BINDING SITE is a target binding site found in the 3' untranslated region of mRNA encoded by FLJ38792, corresponding to a target binding site such as BINDING SITE I, BINDING SITE II or BINDING SITE III of FIG. 8. Table 4 illustrates the complementarity of the nucleotide sequences of FLJ38792 BINDING SITE, designated SEQ ID:14861, to the nucleotide sequence of GAM281 RNA, herein designated GAM RNA, also designated SEQ ID:278.

Another function of GAM281 is therefore inhibition of FLJ38792 (Accession NP_848615.1). Accordingly, utilities of GAM281 include diagnosis, prevention and treatment of diseases and clinical conditions associated with FLJ38792.

FLJ38819 (Accession NP_665872.1) is another GAM281 target gene, herein designated TARGET GENE. FLJ38819 BINDING SITE1 and FLJ38819 BINDING SITE2 are target binding sites found in untranslated regions of mRNA encoded by FLJ38819, corresponding to target binding sites such as BINDING SITE I, BINDING SITE II or BINDING SITE III of FIG. 8. Table 4 illustrates the complementarity of the nucleotide sequences of FLJ38819 BINDING SITE1 and FLJ38819 BINDING SITE2, designated SEQ ID:18642 and SEQ ID:9791 respectively, to the nucleotide sequence of GAM281 RNA, herein designated GAM RNA, also designated SEQ ID:278.

Another function of GAM281 is therefore inhibition of FLJ38819 (Accession NP_665872.1). Accordingly, utilities of GAM281 include diagnosis, prevention and treatment of diseases and clinical conditions associated with FLJ38819.

FLJ38991 (Accession NP_776188.1) is another GAM281 target gene, herein designated TARGET GENE. FLJ38991 BINDING SITE1 and FLJ38991 BINDING SITE2 are target binding sites found in untranslated regions of mRNA encoded by FLJ38991, corresponding to target binding sites such as BINDING SITE I, BINDING SITE II or BINDING SITE III of FIG. 8. Table 4 illustrates the complementarity of the nucleotide sequences of FLJ38991 BINDING SITE1 and FLJ38991 BINDING SITE2, designated SEQ ID:14236 and SEQ ID:10356 respectively, to the nucleotide sequence of GAM281 RNA, herein designated GAM RNA, also designated SEQ ID:278.

Another function of GAM281 is therefore inhibition of FLJ38991 (Accession NP_776188.1). Accordingly, utilities of GAM281 include diagnosis, prevention and treatment of diseases and clinical conditions associated with FLJ38991.

FLJ39415 (Accession NP_775952.1) is another GAM281 target gene, herein designated TARGET GENE. FLJ39415 BINDING SITE is a target binding site found in the 3' untranslated region of mRNA encoded by FLJ39415, corresponding to a target binding site such as BINDING SITE I, BINDING SITE II or BINDING SITE III of FIG. 8. Table 4 illustrates the complementarity of the nucleotide sequences of FLJ39415 BINDING SITE, designated SEQ ID:11673, to the nucleotide sequence of GAM281 RNA, herein designated GAM RNA, also designated SEQ ID:278.

Another function of GAM281 is therefore inhibition of FLJ39415 (Accession NP_775952.1). Accordingly, utilities of GAM281 include diagnosis, prevention and treatment of diseases and clinical conditions associated with FLJ39415.

FLJ39441 (Accession XP_084736.6) is another GAM281 target gene, herein designated TARGET GENE. FLJ39441 BINDING SITE is a target binding site found in the 3' untranslated region of mRNA encoded by FLJ39441, corresponding to a target binding site such as BINDING SITE I, BINDING SITE II or BINDING SITE III of FIG. 8. Table 4 illustrates the complementarity of the nucleotide sequences of FLJ39441 BINDING SITE, designated SEQ ID:7388, to the nucleotide sequence of GAM281 RNA, herein designated GAM RNA, also designated SEQ ID:278.

Another function of GAM281 is therefore inhibition of FLJ39441 (Accession XP_084736.6). Accordingly, utilities of GAM281 include diagnosis, prevention and treatment of diseases and clinical conditions associated with FLJ39441.

FLJ39599 (Accession NP_776164.1) is another GAM281 target gene, herein designated TARGET GENE. FLJ39599 BINDING SITE1 through FLJ39599 BINDING SITE3 are target binding sites found in untranslated regions of mRNA encoded by FLJ39599, corresponding to target binding sites such as BINDING SITE I, BINDING SITE II or BINDING SITE III of FIG. 8. Table 4 illustrates the complementarity of the nucleotide sequences of FLJ39599 BINDING SITE1 through FLJ39599 BINDING SITE3, designated SEQ ID:8232, SEQ ID:16001 and SEQ ID:2845 respectively, to the nucleotide sequence of GAM281 RNA, herein designated GAM RNA, also designated SEQ ID:278.

Another function of GAM281 is therefore inhibition of FLJ39599 (Accession NP_776164.1). Accordingly, utilities of GAM281 include diagnosis, prevention and treatment of diseases and clinical conditions associated with FLJ39599.

FLJ39639 (Accession XP_290687.1) is another GAM281 target gene, herein designated TARGET GENE. FLJ39639 BINDING SITE1 and FLJ39639 BINDING SITE2 are target binding sites found in untranslated regions of mRNA encoded by FLJ39639, corresponding to target binding sites such as BINDING SITE I, BINDING SITE II or BINDING SITE III of FIG. 8. Table 4 illustrates the complementarity of the nucleotide sequences of FLJ39639 BINDING SITE1 and FLJ39639 BINDING SITE2, designated SEQ ID:6883 and SEQ ID:9190 respectively, to the nucleotide sequence of GAM281 RNA, herein designated GAM RNA, also designated SEQ ID:278.

Another function of GAM281 is therefore inhibition of FLJ39639 (Accession XP_290687.1). Accordingly, utilities of GAM281 include diagnosis, prevention and treatment of diseases and clinical conditions associated with FLJ39639.

FLJ39821 (Accession NP_775971.1) is another GAM281 target gene, herein designated TARGET GENE. FLJ39821 BINDING SITE is a target binding site found in the 3' untranslated region of mRNA encoded by FLJ39821, corresponding to a target binding site such as BINDING SITE I, BINDING SITE II or BINDING SITE III of FIG. 8. Table 4 illustrates the complementarity of the nucleotide sequences of FLJ39821 BINDING SITE, designated SEQ ID:17406, to the nucleotide sequence of GAM281 RNA, herein designated GAM RNA, also designated SEQ ID:278.

Another function of GAM281 is therefore inhibition of FLJ39821 (Accession NP_775971.1). Accordingly, utilities of GAM281 include diagnosis, prevention and treatment of diseases and clinical conditions associated with FLJ39821.

FLJ90231 (Accession NP_775852.1) is another GAM281 target gene, herein designated TARGET GENE. FLJ90231 BINDING SITE is a target binding site found in the 3' untranslated region of mRNA encoded by FLJ90231, corresponding to a target binding site such as BINDING SITE I, BINDING SITE II or BINDING SITE III of FIG. 8. Table 4 illustrates the complementarity of the nucleotide sequences of FLJ90231 BINDING SITE, designated SEQ ID:10357, to the nucleotide sequence of GAM281 RNA, herein designated GAM RNA, also designated SEQ ID:278.

Another function of GAM281 is therefore inhibition of FLJ90231 (Accession NP_775852.1). Accordingly, utilities of GAM281 include diagnosis, prevention and treatment of diseases and clinical conditions associated with FLJ90231.

FLJ90586 (Accession NP_699176.1) is another GAM281 target gene, herein designated TARGET GENE. FLJ90586 BINDING SITE is a target binding site found in the 3' untranslated region of mRNA encoded by FLJ90586, corresponding to a target binding site such as BINDING SITE I, BINDING SITE II or BINDING SITE III of FIG. 8. Table 4 illustrates the complementarity of the nucleotide sequences of FLJ90586 BINDING SITE, designated SEQ ID:2786, to the nucleotide sequence of GAM281 RNA, herein designated GAM RNA, also designated SEQ ID:278.

Another function of GAM281 is therefore inhibition of FLJ90586 (Accession NP_699176.1). Accordingly, utilities of GAM281 include diagnosis, prevention and treatment of diseases and clinical conditions associated with FLJ90586.

FLJ90723 (Accession NP_787115.1) is another GAM281 target gene, herein designated TARGET GENE. FLJ90723 BINDING SITE is a target binding site found in the 3' untranslated region of mRNA encoded by FLJ90723, corresponding to a target binding site such as BINDING SITE I, BINDING SITE II or BINDING SITE III of FIG. 8. Table 4 illustrates the complementarity of the nucleotide sequences of FLJ90723 BINDING SITE, designated SEQ ID:19889, to the nucleotide sequence of GAM281 RNA, herein designated GAM RNA, also designated SEQ ID:278.

Another function of GAM281 is therefore inhibition of FLJ90723 (Accession NP_787115.1). Accordingly, utilities of GAM281 include diagnosis, prevention and treatment of diseases and clinical conditions associated with FLJ90723.

Formin binding protein 1 (FNBP1, Accession XP_052666.3) is another GAM281 target gene, herein designated TARGET GENE. FNBP1 BINDING SITE is a target binding site found in the 3' untranslated region of mRNA encoded by FNBP1, corresponding to a target binding site such as BINDING SITE I, BINDING SITE II or BINDING SITE III of FIG. 8. Table 4 illustrates the complementarity of the nucleotide sequences of FNBP1 BINDING SITE, designated SEQ ID:16354, to the nucleotide sequence of GAM281 RNA, herein designated GAM RNA, also designated SEQ ID:278.

Another function of GAM281 is therefore inhibition of Formin binding protein 1 (FNBP1, Accession XP_052666.3). Accordingly, utilities of GAM281 include diagnosis, prevention and treatment of diseases and clinical conditions associated with FNBP1.

Forkhead box e2 (FOXE2, Accession NP_036317.1) is another GAM281 target gene, herein designated TARGET GENE. FOXE2 BINDING SITE is a target binding site found in the 5' untranslated region of mRNA encoded by FOXE2, corresponding to a target binding site such as BINDING SITE I, BINDING SITE II or BINDING SITE III of FIG. 8. Table 4 illustrates the complementarity of the nucleotide sequences of FOXE2 BINDING SITE, designated SEQ ID:15626, to the nucleotide sequence of GAM281 RNA, herein designated GAM RNA, also designated SEQ ID:278.

Another function of GAM281 is therefore inhibition of Forkhead box e2 (FOXE2, Accession NP_036317.1). Accordingly, utilities of GAM281 include diagnosis, prevention and treatment of diseases and clinical conditions associated with FOXE2.

Forkhead box o1a (rhabdomyosarcoma) (FOXO1A, Accession NP_002006.2) is another GAM281 target gene, herein designated TARGET GENE. FOXO1A BINDING SITE is a target binding site found in the 3' untranslated region of mRNA encoded by FOXO1A, corresponding to a target binding site such as BINDING SITE I, BINDING SITE II or BINDING SITE III of FIG. 8. Table 4 illustrates the complementarity of the nucleotide sequences of FOXO1A BINDING SITE, designated SEQ ID:736, to the nucleotide sequence of GAM281 RNA, herein designated GAM RNA, also designated SEQ ID:278.

Another function of GAM281 is therefore inhibition of Forkhead box o1a (rhabdomyosarcoma) (FOXO1A, Accession NP_002006.2), a gene which is a probable transcription factor. and therefore may be associated with Alveolar rhabdomyosarcoma-2. Accordingly, utilities of GAM281 include diagnosis, prevention and treatment of Alveolar rhabdomyosarcoma-2., and of other diseases and clinical conditions associated with FOXO1A.

The function of FOXO1A and its association with various diseases and clinical conditions, has been established by previous studies, as described hereinabove with reference to GAM189.1. Fsh primary response (lrpr1 homolog, rat) 1 (FSHPRH1, Accession NP_006724.1) is another GAM281 target gene, herein designated TARGET GENE. FSHPRH1 BINDING SITE is a target binding site found in the 5' untranslated region of mRNA encoded by FSHPRH1, corresponding to a target binding site such as BINDING SITE I, BINDING SITE II or BINDING SITE III of FIG. 8. Table 4 illustrates the complementarity of the nucleotide sequences of FSHPRH1 BINDING SITE, designated SEQ ID:11528, to the nucleotide sequence of GAM281 RNA, herein designated GAM RNA, also designated SEQ ID:278.

Another function of GAM281 is therefore inhibition of Fsh primary response (lrpr1 homolog, rat) 1 (FSHPRH1, Accession NP_006724.1), a gene which is involved in the response of gonadal tissues to follicle- stimulating hormone. and therefore may be associated with Hypergonadotropic ovarian dysgenesis (odg), x-linked disorders of gonadal development. Accordingly, utilities of GAM281 include diagnosis, prevention and treatment of Hypergonadotropic ovarian dysgenesis (odg), x-linked disorders of gonadal development, and of other diseases and clinical conditions associated with FSH-PRH1.

The function of FSHPRH1 and its association with various diseases and clinical conditions, has been established by previous studies, as described hereinabove with reference to GAM189.1. Follistatin-like 1 (FSTL1, Accession NP_009016.1) is another GAM281 target gene, herein designated TARGET GENE. FSTL1 BINDING SITE is a target binding site found in the 3' untranslated region of mRNA encoded by FSTL1, corresponding to a target binding site such as BINDING SITE I, BINDING SITE II or BINDING SITE III of FIG. 8. Table 4 illustrates the complementarity of the nucleotide sequences of FSTL1 BINDING SITE, designated SEQ ID:11213, to the nucleotide sequence of GAM281 RNA, herein designated GAM RNA, also designated SEQ ID:278.

Another function of GAM281 is therefore inhibition of Follistatin-like 1 (FSTL1, Accession NP_009016.1), a gene which may modulate the action of some growth factors on cell proliferation and differentiation. and therefore may be associated with Rheumatoid arthritis. Accordingly, utilities of GAM281 include diagnosis, prevention and treatment of Rheumatoid arthritis, and of other diseases and clinical conditions associated with FSTL1.

The function of FSTL1 and its association with various diseases and clinical conditions, has been established by previous studies, as described hereinabove with reference to GAM279.1. Fucosyltransferase 1 (galactoside 2-alpha-l-fucosyltransferase, bombay phenotype included) (FUT1, Accession NP_000139.1) is another GAM281 target gene, herein designated TARGET GENE. FUT1 BINDING SITE1 and FUT1 BINDING SITE2 are target binding sites found in untranslated regions of mRNA encoded by FUT1, corresponding to target binding sites such as BINDING SITE I, BINDING SITE II or BINDING SITE III of FIG. 8. Table 4 illustrates the complementarity of the nucleotide sequences of FUT1 BINDING SITE1 and FUT1 BINDING SITE2, designated SEQ ID:11525 and SEQ ID:16365 respectively, to the nucleotide sequence of GAM281 RNA, herein designated GAM RNA, also designated SEQ ID:278.

Another function of GAM281 is therefore inhibition of Fucosyltransferase 1 (galactoside 2-alpha-l-fucosyltransferase, bombay phenotype included) (FUT1, Accession NP_000139.1). Accordingly, utilities of GAM281 include diagnosis, prevention and treatment of diseases and clinical conditions associated with FUT1.

Frizzled homolog 4 (drosophila) (FZD4, Accession NP_036325.2) is another GAM281 target gene, herein designated TARGET GENE. FZD4 BINDING SITE is a target binding site found in the 3' untranslated region of mRNA encoded by FZD4, corresponding to a target binding site such as BINDING SITE I, BINDING SITE II or BINDING SITE III of FIG. 8. Table 4 illustrates the complementarity of the nucleotide sequences of FZD4 BINDING SITE, designated SEQ ID:4487, to the nucleotide sequence of GAM281 RNA, herein designated GAM RNA, also designated SEQ ID:278.

Another function of GAM281 is therefore inhibition of Frizzled homolog 4 (drosophila) (FZD4, Accession NP_036325.2), a gene which may function in cell polarity, cell fate specification and cancer; similar to frizzled receptor family, has seven transmembrane domains and therefore may be associated with Familial exudative vitreoretinopathy. Accordingly, utilities of GAM281 include diagnosis, prevention and treatment of Familial exudative vitreoretinopathy, and of other diseases and clinical conditions associated with FZD4.

The function of FZD4 and its association with various diseases and clinical conditions, has been established by previous studies, as described hereinabove with reference to GAM67.1. Interferon, alpha-inducible protein (clone ifi-6-16) (G1P3, Accession NP_075010.1) is another GAM281 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:724, to the nucleotide sequence of GAM281 RNA, herein designated GAM RNA, also designated SEQ ID:278.

Another function of GAM281 is therefore inhibition of Interferon, alpha-inducible protein (clone ifi-6-16) (G1P3, Accession NP_075010.1), a gene which is an interferon-stimulated gene (ISG). Accordingly, utilities of GAM281 include diagnosis, prevention and treatment of diseases and clinical conditions associated with G1P3.

The function of G1P3 and its association with various diseases and clinical conditions, has been established by previous studies, as described hereinabove with reference to GAM234.1. Interferon, alpha-inducible protein (clone ifi-6-16) (G1P3, Accession NP_002029.3) is another GAM281 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:724, to the nucleotide sequence of GAM281 RNA, herein designated GAM RNA, also designated SEQ ID:278.

Another function of GAM281 is therefore inhibition of Interferon, alpha-inducible protein (clone ifi-6-16) (G1P3, Accession NP_002029.3), a gene which is an interferon-stimulated gene (ISG). Accordingly, utilities of GAM281 include diagnosis, prevention and treatment of diseases and clinical conditions associated with G1P3.

The function of G1P3 and its association with various diseases and clinical conditions, has been established by previous studies, as described hereinabove with reference to GAM234.1. Interferon, alpha-inducible protein (clone ifi-6-16) (G1P3, Accession NP_075011.1) is another GAM281 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:724, to the nucleotide sequence of GAM281 RNA, herein designated GAM RNA, also designated SEQ ID:278.

Another function of GAM281 is therefore inhibition of Interferon, alpha-inducible protein (clone ifi-6-16) (G1P3, Accession NP_075011.1), a gene which is an interferon-stimulated gene (ISG). Accordingly, utilities of GAM281 include diagnosis, prevention and treatment of diseases and clinical conditions associated with G1P3.

The function of G1P3 and its association with various diseases and clinical conditions, has been established by previous studies, as described hereinabove with reference to GAM234.1. G2A (Accession NP_037477.1) is another GAM281 target gene, herein designated TARGET GENE. G2A BINDING SITE is a target binding site found in the 3' untranslated region of mRNA encoded by G2A, corresponding to a target binding site such as BINDING SITE I, BINDING SITE II or BINDING SITE III of FIG. 8. Table 4 illustrates the complementarity of the nucleotide sequences of G2A BINDING SITE, designated SEQ ID:8714, to the nucleotide sequence of GAM281 RNA, herein designated GAM RNA, also designated SEQ ID:278.

Another function of GAM281 is therefore inhibition of G2A (Accession NP_037477.1), a gene which may mediate some of the effects of extracellular atp on insulin secretion. and therefore may be associated with Autoimmune disease. Accordingly, utilities of GAM281 include diagnosis, prevention and treatment of Autoimmune disease, and of other diseases and clinical conditions associated with G2A.

The function of G2A and its association with various diseases and clinical conditions, has been established by previous studies, as described hereinabove with reference to GAM189.1. Glucose-6-phosphatase, catalytic (glycogen storage disease type i, von gierke disease) (G6PC, Accession NP_000142.1) is another GAM281 target gene, herein designated TARGET GENE. G6PC BINDING SITE is a target binding site found in the 3' untranslated region of mRNA encoded by G6PC, corresponding to a target binding site such as BINDING SITE I, BINDING SITE II or BINDING SITE III of FIG. 8. Table 4 illustrates the complementarity of the nucleotide sequences of G6PC BINDING SITE, designated SEQ ID:4204, to the nucleotide sequence of GAM281 RNA, herein designated GAM RNA, also designated SEQ ID:278.

Another function of GAM281 is therefore inhibition of Glucose-6-phosphatase, catalytic (glycogen storage disease type i, von gierke disease) (G6PC, Accession NP_000142.1). Accordingly, utilities of GAM281 include diagnosis, prevention and treatment of diseases and clinical conditions associated with G6PC.

GAL3ST-4 (Accession NP_078913.3) is another GAM281 target gene, herein designated TARGET GENE. GAL3ST-4 BINDING SITE is a target binding site found in the 3' untranslated region of mRNA encoded by GAL3ST-4, corresponding to a target binding site such as BINDING SITE I, BINDING SITE II or BINDING SITE III of FIG. 8. Table 4 illustrates the complementarity of the nucleotide sequences of GAL3ST-4 BINDING SITE, designated SEQ ID:4518, to the nucleotide sequence of GAM281 RNA, herein designated GAM RNA, also designated SEQ ID:278.

Another function of GAM281 is therefore inhibition of GAL3ST-4 (Accession NP_078913.3). Accordingly, utilities of GAM281 include diagnosis, prevention and treatment of diseases and clinical conditions associated with GAL3ST-4.

Gata binding protein 2 (GATA2, Accession NP_116027.2) is another GAM281 target gene, herein designated TARGET GENE. GATA2 BINDING SITE is a target binding site found in the 3' untranslated region of mRNA encoded by GATA2, corresponding to a target binding site such as BINDING SITE I, BINDING SITE II or BINDING SITE III of FIG. 8. Table 4 illustrates the complementarity of the nucleotide sequences of GATA2 BINDING SITE, designated SEQ ID:16014, to the nucleotide sequence of GAM281 RNA, herein designated GAM RNA, also designated SEQ ID:278.

Another function of GAM281 is therefore inhibition of Gata binding protein 2 (GATA2, Accession NP_116027.2). Accordingly, utilities of GAM281 include diagnosis, prevention and treatment of diseases and clinical conditions associated with GATA2.

GBP4 (Accession NP_443173.2) is another GAM281 target gene, herein designated TARGET GENE. GBP4 BINDING SITE is a target binding site found in the 3' untranslated region of mRNA encoded by GBP4, corresponding to a target binding site such as BINDING SITE I, BINDING SITE II or BINDING SITE III of FIG. 8. Table 4 illustrates the complementarity of the nucleotide sequences of GBP4 BINDING SITE, designated SEQ ID:15052, to the nucleotide sequence of GAM281 RNA, herein designated GAM RNA, also designated SEQ ID:278.

Another function of GAM281 is therefore inhibition of GBP4 (Accession NP_443173.2). Accordingly, utilities of GAM281 include diagnosis, prevention and treatment of diseases and clinical conditions associated with GBP4.

Golgi associated, gamma adaptin ear containing, arf binding protein 2 (GGA2, Accession NP_619581.1) is another GAM281 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:5631, to the nucleotide sequence of GAM281 RNA, herein designated GAM RNA, also designated SEQ ID:278.

Another function of GAM281 is therefore inhibition of Golgi associated, gamma adaptin ear containing, arf binding protein 2 (GGA2, Accession NP_619581.1). Accordingly, utilities of GAM281 include diagnosis, prevention and treatment of diseases and clinical conditions associated with GGA2.

Golgi associated, gamma adaptin ear containing, arf binding protein 2 (GGA2, Accession NP_055859.1) is another GAM281 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:5631, to the nucleotide sequence of GAM281 RNA, herein designated GAM RNA, also designated SEQ ID:278.

Another function of GAM281 is therefore inhibition of Golgi associated, gamma adaptin ear containing, arf binding protein 2 (GGA2, Accession NP_055859.1). Accordingly, utilities of GAM281 include diagnosis, prevention and treatment of diseases and clinical conditions associated with GGA2.

Gamma-glutamyltransferase 1 (GGT1, Accession NP_005256.1) is another GAM281 target gene, herein designated TARGET GENE. GGT1 BINDING SITE is a target binding site found in the 5' untranslated region of multiple transcripts of mRNA encoded by GGT1, corresponding to a target binding site such as BINDING SITE I, BINDING SITE II or BINDING SITE III of FIG. 8. Table 4 illustrates the complementarity of the nucleotide sequences of GGT1 BINDING SITE, designated SEQ ID:13688, to the nucleotide sequence of GAM281 RNA, herein designated GAM RNA, also designated SEQ ID:278.

Another function of GAM281 is therefore inhibition of Gamma-glutamyltransferase 1 (GGT1, Accession NP_005256.1), a gene which catalyzes the transfer of the glutamyl moiety of glutathione to a variety of amino acids and dipeptide acceptors and therefore is associated with Glutathionuria. Accordingly, utilities of GAM281 include diagnosis, prevention and treatment of Glutathionuria, and of other diseases and clinical conditions associated with GGT1.

The function of GGT1 and its association with various diseases and clinical conditions, has been established by previous studies, as described hereinabove with reference to GAM234.1. Gamma-glutamyltransferase 1 (GGT1, Accession NP_038265.1) is another GAM281 target gene, herein designated TARGET GENE. GGT1 BINDING SITE is a target binding site found in the 5' untranslated region of multiple transcripts of mRNA encoded by GGT1, corresponding to a target binding site such as BINDING SITE I, BINDING SITE II or BINDING SITE III of FIG. 8. Table 4 illustrates the complementarity of the nucleotide sequences of GGT1 BINDING SITE, designated SEQ ID:13688, to the nucleotide sequence of GAM281 RNA, herein designated GAM RNA, also designated SEQ ID:278.

Another function of GAM281 is therefore inhibition of Gamma-glutamyltransferase 1 (GGT1, Accession NP_038265.1), a gene which catalyzes the transfer of the glutamyl moiety of glutathione to a variety of amino acids and dipeptide acceptors and therefore is associated with Glutathionuria. Accordingly, utilities of GAM281 include diagnosis, prevention and treatment of Glutathionuria, and of other diseases and clinical conditions associated with GGT1.

The function of GGT1 and its association with various diseases and clinical conditions, has been established by previous studies, as described hereinabove with reference to GAM234.1. Gamma-glutamyltransferase 1 (GGT1, Accession NP_038347.1) is another GAM281 target gene, herein designated TARGET GENE. GGT1 BINDING SITE is a target binding site found in the 5' untranslated region of multiple transcripts of mRNA encoded by GGT1, corresponding to a target binding site such as BINDING SITE I, BINDING SITE II or BINDING SITE III of FIG. 8. Table 4 illustrates the complementarity of the nucleotide sequences of GGT1 BINDING SITE, designated SEQ ID:13688, to the nucleotide sequence of GAM281 RNA, herein designated GAM RNA, also designated SEQ ID:278.

Another function of GAM281 is therefore inhibition of Gamma-glutamyltransferase 1 (GGT1, Accession NP_038347.1), a gene which catalyzes the transfer of the glutamyl moiety of glutathione to a variety of amino acids and dipeptide acceptors and therefore is associated with Glutathionuria. Accordingly, utilities of GAM281 include diagnosis, prevention and treatment of Glutathionuria, and of other diseases and clinical conditions associated with GGT1.

The function of GGT1 and its association with various diseases and clinical conditions, has been established by previous studies, as described hereinabove with reference to GAM234.1. Gamma-glutamyltransferase 2 (GGT2, Accession XP_290331.1) is another GAM281 target gene, herein designated TARGET GENE. GGT2 BINDING SITE is a target binding site found in the 5' untranslated region of mRNA encoded by GGT2, corresponding to a target binding site such as BINDING SITE I, BINDING SITE II or BINDING SITE III of FIG. 8. Table 4 illustrates the complementarity of the nucleotide sequences of GGT2 BINDING SITE, designated SEQ ID:13688, to the nucleotide sequence of GAM281 RNA, herein designated GAM RNA, also designated SEQ ID:278.

Another function of GAM281 is therefore inhibition of Gamma-glutamyltransferase 2 (GGT2, Accession XP_290331.1). Accordingly, utilities of GAM281 include diagnosis, prevention and treatment of diseases and clinical conditions associated with GGT2.

Gm2 ganglioside activator protein (GM2A, Accession NP_000396.1) is another GAM281 target gene, herein designated TARGET GENE. GM2A BINDING SITE is a target binding site found in the 3' untranslated region of mRNA encoded by GM2A, corresponding to a target binding site such as BINDING SITE I, BINDING SITE II or BINDING SITE III of FIG. 8. Table 4 illustrates the complementarity of the nucleotide sequences of GM2A BINDING SITE, designated SEQ ID:11286, to the nucleotide sequence of GAM281 RNA, herein designated GAM RNA, also designated SEQ ID:278.

Another function of GAM281 is therefore inhibition of Gm2 ganglioside activator protein (GM2A, Accession NP_000396.1). Accordingly, utilities of GAM281 include diagnosis, prevention and treatment of diseases and clinical conditions associated with GM2A.

GNE (Accession NP_005467.1) is another GAM281 target gene, herein designated TARGET GENE. GNE BINDING SITE is a target binding site found in the 3' untranslated region of mRNA encoded by GNE, corresponding to a target binding site such as BINDING SITE I, BINDING SITE II or BINDING SITE III of FIG. 8. Table 4 illustrates the complementarity of the nucleotide sequences of GNE BINDING SITE, designated SEQ ID:8367, to the nucleotide sequence of GAM281 RNA, herein designated GAM RNA, also designated SEQ ID:278.

Another function of GAM281 is therefore inhibition of GNE (Accession NP_005467.1), a gene which has roles in sialic acid biosynthesis and regulates cell surface sialylation. Accordingly, utilities of GAM281 include diagnosis, prevention and treatment of diseases and clinical conditions associated with GNE.

The function of GNE and its association with various diseases and clinical conditions, has been established by previous studies, as described hereinabove with reference to GAM189.1. Guanine nucleotide binding protein (g protein), gamma 4 (GNG4, Accession NP_004476.1) is another GAM281 target gene, herein designated TARGET GENE. GNG4 BINDING SITE is a target binding site found in the 3' untranslated region of mRNA encoded by GNG4, corresponding to a target binding site such as BINDING SITE I, BINDING SITE II or BINDING SITE III of FIG. 8. Table 4 illustrates the complementarity of the nucleotide sequences of GNG4 BINDING SITE, designated SEQ ID:559, to the nucleotide sequence of GAM281 RNA, herein designated GAM RNA, also designated SEQ ID:278.

Another function of GAM281 is therefore inhibition of Guanine nucleotide binding protein (g protein), gamma 4 (GNG4, Accession NP_004476.1). Accordingly, utilities of GAM281 include diagnosis, prevention and treatment of diseases and clinical conditions associated with GNG4.

GNPNAT1 (Accession XP_085119.1) is another GAM281 target gene, herein designated TARGET GENE. GNPNAT1 BINDING SITE1 and GNPNAT1 BINDING SITE2 are target binding sites found in untranslated regions of mRNA encoded by GNPNAT1, corresponding to target binding sites such as BINDING SITE I, BINDING SITE II or BINDING SITE III of FIG. 8. Table 4 illustrates the complementarity of the nucleotide sequences of GNPNAT1 BINDING SITE1 and GNPNAT1 BINDING SITE2, designated SEQ ID:8464 and SEQ ID:854 respectively, to the nucleotide sequence of GAM281 RNA, herein designated GAM RNA, also designated SEQ ID:278.

Another function of GAM281 is therefore inhibition of GNPNAT1 (Accession XP_085119.1). Accordingly, utilities of GAM281 include diagnosis, prevention and treatment of diseases and clinical conditions associated with GNPNAT1.

GNRPX (Accession NP_060519.1) is another GAM281 target gene, herein designated TARGET GENE. GNRPX BINDING SITE is a target binding site found in the 3' untranslated region of mRNA encoded by GNRPX, corresponding to a target binding site such as BINDING SITE I, BINDING SITE II or BINDING SITE III of FIG. 8. Table 4 illustrates the complementarity of the nucleotide sequences of GNRPX BINDING SITE, designated SEQ ID:12243, to the nucleotide sequence of GAM281 RNA, herein designated GAM RNA, also designated SEQ ID:278.

Another function of GAM281 is therefore inhibition of GNRPX (Accession NP_060519.1). Accordingly, utilities of GAM281 include diagnosis, prevention and treatment of diseases and clinical conditions associated with GNRPX.

Golgi autoantigen, golgin subfamily a, 1 (GOLGA1, Accession NP_002068.1) is another GAM281 target gene, herein designated TARGET GENE. GOLGA1 BINDING SITE is a target binding site found in the 3' untranslated region of mRNA encoded by GOLGA1, corresponding to a target binding site such as BINDING SITE I, BINDING SITE II or BINDING SITE III of FIG. 8. Table 4 illustrates the complementarity of the nucleotide sequences of GOLGA1 BINDING SITE, designated SEQ ID:12206, to the nucleotide sequence of GAM281 RNA, herein designated GAM RNA, also designated SEQ ID:278.

Another function of GAM281 is therefore inhibition of Golgi autoantigen, golgin subfamily a, 1 (GOLGA1, Accession NP_002068.1) . Accordingly, utilities of GAM281 include diagnosis, prevention and treatment of diseases and clinical conditions associated with GOLGA1.

Golgi autoantigen, golgin subfamily a, 3 (GOLGA3, Accession NP_005886.2) is another GAM281 target gene, herein designated TARGET GENE. GOLGA3 BINDING SITE is a target binding site found in the 3' untranslated region of multiple transcripts of mRNA encoded by GOLGA3, corresponding to a target binding site such as BINDING SITE I, BINDING SITE II or BINDING SITE III of FIG. 8. Table 4 illustrates the complementarity of the nucleotide sequences of GOLGA3 BINDING SITE, designated SEQ ID:15049, to the nucleotide sequence of GAM281 RNA, herein designated GAM RNA, also designated SEQ ID:278.

Another function of GAM281 is therefore inhibition of Golgi autoantigen, golgin subfamily a, 3 (GOLGA3, Accession NP_005886.2) . Accordingly, utilities of GAM281 include diagnosis, prevention and treatment of diseases and clinical conditions associated with GOLGA3.

GOLGIN-67 (Accession NP_851421.1) is another GAM281 target gene, herein designated TARGET GENE. GOLGIN-67 BINDING SITE is a target binding site found in the 5' untranslated region of multiple transcripts of mRNA encoded by GOLGIN-67, corresponding to a target binding site such as BINDING SITE I, BINDING SITE II or BINDING SITE III of FIG. 8. Table 4 illustrates the complementarity of the nucleotide sequences of GOLGIN-67 BINDING SITE, designated SEQ ID:4244, to the nucleotide sequence of GAM281 RNA, herein designated GAM RNA, also designated SEQ ID:278.

Another function of GAM281 is therefore inhibition of GOLGIN-67 (Accession NP_851421.1). Accordingly, utilities of GAM281 include diagnosis, prevention and treatment of diseases and clinical conditions associated with GOLGIN-67.

Glycoprotein v (platelet) (GP5, Accession NP_004479.1) is another GAM281 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:5681, to the nucleotide sequence of GAM281 RNA, herein designated GAM RNA, also designated SEQ ID:278.

Another function of GAM281 is therefore inhibition of Glycoprotein v (platelet) (GP5, Accession NP_004479.1). Accordingly, utilities of GAM281 include diagnosis, prevention and treatment of diseases and clinical conditions associated with GP5.

GPP34R (Accession NP_060648.2) is another GAM281 target gene, herein designated TARGET GENE. GPP34R BINDING SITE is a target binding site found in the 3' untranslated region of mRNA encoded by GPP34R, corresponding to a target binding site such as BINDING SITE I, BINDING SITE II or BINDING SITE III of FIG. 8. Table 4 illustrates the complementarity of the nucleotide sequences of GPP34R BINDING SITE, designated SEQ ID:14203, to the nucleotide sequence of GAM281 RNA, herein designated GAM RNA, also designated SEQ ID:278.

Another function of GAM281 is therefore inhibition of GPP34R (Accession NP_060648.2). Accordingly, utilities of GAM281 include diagnosis, prevention and treatment of diseases and clinical conditions associated with GPP34R.

G protein-coupled receptor 114 (GPR114, Accession NP_722579.1) is another GAM281 target gene, herein designated TARGET GENE. GPR114 BINDING SITE is a target binding site found in the 3' untranslated region of mRNA encoded by GPR114, corresponding to a target binding site such as BINDING SITE I, BINDING SITE II or BINDING SITE III of FIG. 8. Table 4 illustrates the complementarity of the nucleotide sequences of GPR114 BINDING SITE, designated SEQ ID:10636, to the nucleotide sequence of GAM281 RNA, herein designated GAM RNA, also designated SEQ ID:278.

Another function of GAM281 is therefore inhibition of G protein-coupled receptor 114 (GPR114, Accession NP_722579.1). Accordingly, utilities of GAM281 include diagnosis, prevention and treatment of diseases and clinical conditions associated with GPR114.

G protein-coupled receptor 26 (GPR26, Accession NP_703143.1) is another GAM281 target gene, herein designated TARGET GENE. GPR26 BINDING SITE is a target binding site found in the 3' untranslated region of mRNA encoded by GPR26, corresponding to a target binding site such as BINDING SITE I, BINDING SITE II or BINDING SITE III of FIG. 8. Table 4 illustrates the complementarity of the nucleotide sequences of GPR26 BINDING SITE, designated SEQ ID:3010, to the nucleotide sequence of GAM281 RNA, herein designated GAM RNA, also designated SEQ ID:278.

Another function of GAM281 is therefore inhibition of G protein-coupled receptor 26 (GPR26, Accession NP_703143.1). Accordingly, utilities of GAM281 include diagnosis, prevention and treatment of diseases and clinical conditions associated with GPR26.

G protein-coupled receptor 4 (GPR4, Accession NP_005273.1) is another GAM281 target gene, herein designated TARGET GENE. GPR4 BINDING SITE is a target binding site found in the 3' untranslated region of mRNA encoded by GPR4, corresponding to a target binding site such as BINDING SITE I, BINDING SITE II or BINDING SITE III of FIG. 8. Table 4 illustrates the complementarity of the nucleotide sequences of GPR4 BINDING SITE, designated SEQ ID:4965, to the nucleotide sequence of GAM281 RNA, herein designated GAM RNA, also designated SEQ ID:278.

Another function of GAM281 is therefore inhibition of G protein-coupled receptor 4 (GPR4, Accession NP_005273.1), a gene which stimulates to produce increased calcium by both SPC and LPC . Accordingly, utilities of GAM281 include diagnosis, prevention and treatment of diseases and clinical conditions associated with GPR4.

The function of GPR4 and its association with various diseases and clinical conditions, has been established by previous studies, as described hereinabove with reference to GAM189.1. G protein-coupled receptor 56 (GPR56, Accession NP_005673.2) is another GAM281 target gene, herein designated TARGET GENE. GPR56 BINDING SITE is a target binding site found in the 5' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:8622, to the nucleotide sequence of GAM281 RNA, herein designated GAM RNA, also designated SEQ ID:278.

Another function of GAM281 is therefore inhibition of G protein-coupled receptor 56 (GPR56, Accession NP_005673.2), a gene which transduces extracellular signals through heterotrimeric G proteins. Accordingly, utilities of GAM281 include diagnosis, prevention and treatment of diseases and clinical conditions associated with GPR56.

The function of GPR56 and its association with various diseases and clinical conditions, has been established by previous studies, as described hereinabove with reference to GAM63.1. G protein-coupled receptor 61 (GPR61, Accession NP_114142.2) is another GAM281 target gene, herein designated TARGET GENE. GPR61 BINDING SITE is a target binding site found in the 3' untranslated region of mRNA encoded by GPR61, corresponding to a target binding site such as BINDING SITE I, BINDING SITE II or BINDING SITE III of FIG. 8. Table 4 illustrates the complementarity of the nucleotide sequences of GPR61 BINDING SITE, designated SEQ ID:15604, to the nucleotide sequence of GAM281 RNA, herein designated GAM RNA, also designated SEQ ID:278.

Another function of GAM281 is therefore inhibition of G protein-coupled receptor 61 (GPR61, Accession NP_114142.2), a gene which transduces extracellular signals through heterotrimeric G proteins. Accordingly, utilities of GAM281 include diagnosis, prevention and treatment of diseases and clinical conditions associated with GPR61.

The function of GPR61 and its association with various diseases and clinical conditions, has been established by previous studies, as described hereinabove with reference to GAM259.2. G protein-coupled receptor 66 (GPR66, Accession NP_006047.2) is another GAM281 target gene, herein designated TARGET GENE. GPR66 BINDING SITE is a target binding site found in the 3' untranslated region of mRNA encoded by GPR66, corresponding to a target binding site such as BINDING SITE I, BINDING SITE II or BINDING SITE III of FIG. 8. Table 4 illustrates the complementarity of the nucleotide sequences of GPR66 BINDING SITE, designated SEQ ID:19237, to the nucleotide sequence of GAM281 RNA, herein designated GAM RNA, also designated SEQ ID:278.

Another function of GAM281 is therefore inhibition of G protein-coupled receptor 66 (GPR66, Accession NP_006047.2). Accordingly, utilities of GAM281 include diagnosis, prevention and treatment of diseases and clinical conditions associated with GPR66.

G protein-coupled receptor 81 (GPR81, Accession NP_115943.1) is another GAM281 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:13260, to the nucleotide sequence of GAM281 RNA, herein designated GAM RNA, also designated SEQ ID:278.

Another function of GAM281 is therefore inhibition of G protein-coupled receptor 81 (GPR81, Accession NP_115943.1). Accordingly, utilities of GAM281 include diagnosis, prevention and treatment of diseases and clinical conditions associated with GPR81.

GR6 (Accession NP_031380.1) is another GAM281 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:2604, to the nucleotide sequence of GAM281 RNA, herein designated GAM RNA, also designated SEQ ID:278.

Another function of GAM281 is therefore inhibition of GR6 (Accession NP_031380.1). Accordingly, utilities of GAM281 include diagnosis, prevention and treatment of diseases and clinical conditions associated with GR6.

GRAF (Accession NP_055886.1) is another GAM281 target gene, herein designated TARGET GENE. GRAF BINDING SITE1 and GRAF BINDING SITE2 are target binding sites found in untranslated regions of mRNA encoded by GRAF, corresponding to target binding sites such as BINDING SITE I, BINDING SITE II or BINDING SITE III of FIG. 8. Table 4 illustrates the complementarity of the nucleotide sequences of GRAF BINDING SITE1 and GRAF BINDING SITE2, designated SEQ ID:13350 and SEQ ID:4362 respectively, to the nucleotide sequence of GAM281 RNA, herein designated GAM RNA, also designated SEQ ID:278.

Another function of GAM281 is therefore inhibition of GRAF (Accession NP_055886.1), a gene which iaa GTPase activating protein for p21-rac and therefore may be associated with Juvenile myelomonocytic leukemia. Accordingly, utilities of GAM281 include diagnosis, prevention and treatment of Juvenile myelomonocytic leukemia, and of other diseases and clinical conditions associated with GRAF.

The function of GRAF and its association with various diseases and clinical conditions, has been established by previous studies, as described hereinabove with reference to GAM189.1. GREB1 (Accession NP_055483.2) is another GAM281 target gene, herein designated TARGET GENE. GREB1 BINDING SITE1 through GREB1 BINDING SITE3 are target binding sites found in untranslated regions of multiple transcripts of mRNA encoded by GREB1, corresponding to target binding sites such as BINDING SITE I, BINDING SITE II or BINDING SITE III of FIG. 8. Table 4 illustrates the complementarity of the nucleotide sequences of GREB1 BINDING SITE1 through GREB1 BINDING SITE3, designated SEQ ID:14113, SEQ ID:14861 and SEQ ID:9792 respectively, to the nucleotide sequence of GAM281 RNA, herein designated GAM RNA, also designated SEQ ID:278.

Another function of GAM281 is therefore inhibition of GREB1 (Accession NP_055483.2). Accordingly, utilities of GAM281 include diagnosis, prevention and treatment of diseases and clinical conditions associated with GREB1.

Glutamate receptor, ionotropic, delta 1 (GRID1, Accession XP_043613.8) is another GAM281 target gene, herein designated TARGET GENE. GRID1 BINDING SITE is a target binding site found in the 3' untranslated region of mRNA encoded by GRID1, corresponding to a target binding site such as BINDING SITE I, BINDING SITE II or BINDING SITE III of FIG. 8. Table 4 illustrates the complementarity of the nucleotide sequences of GRID1 BINDING SITE, designated SEQ ID:17390, to the nucleotide sequence of GAM281 RNA, herein designated GAM RNA, also designated SEQ ID:278.

Another function of GAM281 is therefore inhibition of Glutamate receptor, ionotropic, delta 1 (GRID1, Accession XP_043613.8). Accordingly, utilities of GAM281 include diagnosis, prevention and treatment of diseases and clinical conditions associated with GRID1.

Glutamate receptor, ionotropic, n-methyl d-aspartate-like 1a (GRINL1A, Accession NP_056347.1) is another GAM281 target gene, herein designated TARGET GENE. GRINL1A BINDING SITE is a target binding site found in the 3' untranslated region of mRNA encoded by GRINL1A, corresponding to a target binding site such as BINDING SITE I, BINDING SITE II or BINDING SITE III of FIG. 8. Table 4 illustrates the complementarity of the nucleotide sequences of GRINL1A BINDING SITE, designated SEQ ID:5433, to the nucleotide sequence of GAM281 RNA, herein designated GAM RNA, also designated SEQ ID:278.

Another function of GAM281 is therefore inhibition of Glutamate receptor, ionotropic, n-methyl d-aspartate-like 1a (GRINL1A, Accession NP_056347.1), a gene which plays a role in the development and function of the mammalian brain. Accordingly, utilities of GAM281 include diagnosis, prevention and treatment of diseases and clinical conditions associated with GRINL1A.

The function of GRINL1A and its association with various diseases and clinical conditions, has been established by previous studies, as described hereinabove with reference to GAM189.1. Glutamate receptor, metabotropic 6 (GRM6, Accession NP_000834.1) is another GAM281 target gene, herein designated TARGET GENE. GRM6 BINDING SITE is a target binding site found in the 3' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:10398, to the nucleotide sequence of GAM281 RNA, herein designated GAM RNA, also designated SEQ ID:278.

Another function of GAM281 is therefore inhibition of Glutamate receptor, metabotropic 6 (GRM6, Accession NP_000834.1). Accordingly, utilities of GAM281 include diagnosis, prevention and treatment of diseases and clinical conditions associated with GRM6.

GRWD (Accession NP_113673.2) is another GAM281 target gene, herein designated TARGET GENE. GRWD BINDING SITE is a target binding site found in the 3' untranslated region of mRNA encoded by GRWD, corresponding to a target binding site such as BINDING SITE I, BINDING SITE II or BINDING SITE III of FIG. 8. Table 4 illustrates the complementarity of the nucleotide sequences of GRWD BINDING SITE, designated SEQ ID:7996, to the nucleotide sequence of GAM281 RNA, herein designated GAM RNA, also designated SEQ ID:278.

Another function of GAM281 is therefore inhibition of GRWD (Accession NP_113673.2). Accordingly, utilities of GAM281 include diagnosis, prevention and treatment of diseases and clinical conditions associated with GRWD.

GSDM (Accession XP_209009.1) is another GAM281 target gene, herein designated TARGET GENE. GSDM BINDING SITE is a target binding site found in the 3' untranslated region of multiple transcripts of mRNA encoded by GSDM, corresponding to a target binding site such as BINDING SITE I, BINDING SITE II or BINDING SITE III of FIG. 8. Table 4 illustrates the complementarity of the nucleotide sequences of GSDM BINDING SITE, designated SEQ ID:3199, to the nucleotide sequence of GAM281 RNA, herein designated GAM RNA, also designated SEQ ID:278.

Another function of GAM281 is therefore inhibition of GSDM (Accession XP_209009.1). Accordingly, utilities of GAM281 include diagnosis, prevention and treatment of diseases and clinical conditions associated with GSDM.

GSDM (Accession NP_835465.1) is another GAM281 target gene, herein designated TARGET GENE. GSDM BINDING SITE is a target binding site found in the 3' untranslated region of multiple transcripts of mRNA encoded by GSDM, corresponding to a target binding site such as BINDING SITE I, BINDING SITE II or BINDING SITE III of FIG. 8. Table 4 illustrates the complementarity of the nucleotide sequences of GSDM BINDING SITE, designated SEQ ID:3199, to the nucleotide sequence of GAM281 RNA, herein designated GAM RNA, also designated SEQ ID:278.

Another function of GAM281 is therefore inhibition of GSDM (Accession NP_835465.1). Accordingly, utilities of GAM281 include diagnosis, prevention and treatment of diseases and clinical conditions associated with GSDM.

Glutathione s-transferase m1 (GSTM1, Accession NP_000552.2) is another GAM281 target gene, herein designated TARGET GENE. GSTM1 BINDING SITE is a target binding site found in the 3' untranslated region of multiple transcripts of mRNA encoded by GSTM1, corresponding to a target binding site such as BINDING SITE I, BINDING SITE II or BINDING SITE III of FIG. 8. Table 4 illustrates the complementarity of the nucleotide sequences of GSTM1 BINDING SITE, designated SEQ ID:12752, to the nucleotide sequence of GAM281 RNA, herein designated GAM RNA, also designated SEQ ID:278.

Another function of GAM281 is therefore inhibition of Glutathione s-transferase m1 (GSTM1, Accession NP_000552.2), a gene which is conjugation of reduced glutathione to a wide number of exogenous and endogenous hydrophobic electrophiles. and therefore may be associated with Aplastic anemia and cancer. Accordingly, utilities of GAM281 include diagnosis, prevention and treatment of Aplastic anemia and cancer, and of other diseases and clinical conditions associated with GSTM1.

The function of GSTM1 and its association with various diseases and clinical conditions, has been established by previous studies, as described hereinabove with reference to GAM189.1. Glutathione s-transferase m1 (GSTM1, Accession NP_666533.1) is another GAM281 target gene, herein designated TARGET GENE. GSTM1 BINDING SITE is a target binding site found in the 3' untranslated region of multiple transcripts of mRNA encoded by GSTM1, corresponding to a target binding site such as BINDING SITE I, BINDING SITE II or BINDING SITE III of FIG. 8. Table 4 illustrates the complementarity of the nucleotide sequences of GSTM1 BINDING SITE, designated SEQ ID:12752, to the nucleotide sequence of GAM281 RNA, herein designated GAM RNA, also designated SEQ ID:278.

Another function of GAM281 is therefore inhibition of Glutathione s-transferase m1 (GSTM1, Accession NP_666533.1), a gene which is conjugation of reduced glutathione to a wide number of exogenous and endogenous hydrophobic electrophiles. and therefore may be associated with Aplastic anemia and cancer. Accordingly, utilities of GAM281 include diagnosis, prevention and treatment of Aplastic anemia and cancer, and of other diseases and clinical conditions associated with GSTM1.

The function of GSTM1 and its association with various diseases and clinical conditions, has been established by previous studies, as described hereinabove with reference to GAM189.1. Glutathione s-transferase m2 (muscle) (GSTM2, Accession NP__000839.1) is another GAM281 target gene, herein designated TARGET GENE. GSTM2 BINDING SITE is a target binding site found in the 3' untranslated region of mRNA encoded by GSTM2, corresponding to a target binding site such as BINDING SITE I, BINDING SITE II or BINDING SITE III of FIG. 8. Table 4 illustrates the complementarity of the nucleotide sequences of GSTM2 BINDING SITE, designated SEQ ID:12752, to the nucleotide sequence of GAM281 RNA, herein designated GAM RNA, also designated SEQ ID:278.

Another function of GAM281 is therefore inhibition of Glutathione s-transferase m2 (muscle) (GSTM2, Accession NP__000839.1). Accordingly, utilities of GAM281 include diagnosis, prevention and treatment of diseases and clinical conditions associated with GSTM2.

Glutathione s-transferase m4 (GSTM4, Accession NP__671490.1) is another GAM281 target gene, herein designated TARGET GENE. GSTM4 BINDING SITE is a target binding site found in the 3' untranslated region of multiple transcripts of mRNA encoded by GSTM4, corresponding to a target binding site such as BINDING SITE I, BINDING SITE II or BINDING SITE III of FIG. 8. Table 4 illustrates the complementarity of the nucleotide sequences of GSTM4 BINDING SITE, designated SEQ ID:12752, to the nucleotide sequence of GAM281 RNA, herein designated GAM RNA, also designated SEQ ID:278.

Another function of GAM281 is therefore inhibition of Glutathione s-transferase m4 (GSTM4, Accession NP__671490.1), a gene which conjugates reduced glutathione to a wide number of exogenous and endogenous hydrophobic electrophiles. Accordingly, utilities of GAM281 include diagnosis, prevention and treatment of diseases and clinical conditions associated with GSTM4.

The function of GSTM4 and its association with various diseases and clinical conditions, has been established by previous studies, as described hereinabove with reference to GAM189.1. Glutathione s-transferase m4 (GSTM4, Accession NP__000841.1) is another GAM281 target gene, herein designated TARGET GENE. GSTM4 BINDING SITE is a target binding site found in the 3' untranslated region of multiple transcripts of mRNA encoded by GSTM4, corresponding to a target binding site such as BINDING SITE I, BINDING SITE II or BINDING SITE III of FIG. 8. Table 4 illustrates the complementarity of the nucleotide sequences of GSTM4 BINDING SITE, designated SEQ ID:12752, to the nucleotide sequence of GAM281 RNA, herein designated GAM RNA, also designated SEQ ID:278.

Another function of GAM281 is therefore inhibition of Glutathione s-transferase m4 (GSTM4, Accession NP__000841.1), a gene which conjugates reduced glutathione to a wide number of exogenous and endogenous hydrophobic electrophiles. Accordingly, utilities of GAM281 include diagnosis, prevention and treatment of diseases and clinical conditions associated with GSTM4.

The function of GSTM4 and its association with various diseases and clinical conditions, has been established by previous studies, as described hereinabove with reference to GAM189.1. General transcription factor iie, polypeptide 1, alpha 56 kda (GTF2E1, Accession NP__005504.1) is another GAM281 target gene, herein designated TARGET GENE. GTF2E1 BINDING SITE is a target binding site found in the 3' untranslated region of mRNA encoded by GTF2E1, corresponding to a target binding site such as BINDING SITE I, BINDING SITE II or BINDING SITE III of FIG. 8. Table 4 illustrates the complementarity of the nucleotide sequences of GTF2E1 BINDING SITE, designated SEQ ID:15661, to the nucleotide sequence of GAM281 RNA, herein designated GAM RNA, also designated SEQ ID:278.

Another function of GAM281 is therefore inhibition of General transcription factor iie, polypeptide 1, alpha 56 kda (GTF2E1, Accession NP__005504.1). Accordingly, utilities of GAM281 include diagnosis, prevention and treatment of diseases and clinical conditions associated with GTF2E1.

GTF2IRD2 (Accession NP__775808.1) is another GAM281 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:11522, to the nucleotide sequence of GAM281 RNA, herein designated GAM RNA, also designated SEQ ID:278.

Another function of GAM281 is therefore inhibition of GTF2IRD2 (Accession NP__775808.1). Accordingly, utilities of GAM281 include diagnosis, prevention and treatment of diseases and clinical conditions associated with GTF2IRD2.

GTF2IRD2 (Accession NP__115579.3) is another GAM281 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:11522, to the nucleotide sequence of GAM281 RNA, herein designated GAM RNA, also designated SEQ ID:278.

Another function of GAM281 is therefore inhibition of GTF2IRD2 (Accession NP__115579.3). Accordingly, utilities of GAM281 include diagnosis, prevention and treatment of diseases and clinical conditions associated with GTF2IRD2.

GTPBG3 (Accession NP__116009.1) is another GAM281 target gene, herein designated TARGET GENE. GTPBG3 BINDING SITE1 and GTPBG3 BINDING SITE2 are target binding sites found in untranslated regions of mRNA encoded by GTPBG3, corresponding to target binding sites such as BINDING SITE I, BINDING SITE II or BINDING SITE III of FIG. 8. Table 4 illustrates the complementarity of the nucleotide sequences of GTPBG3 BINDING SITE1 and GTPBG3 BINDING SITE2, designated SEQ ID:7812 and SEQ ID:10292 respectively, to the nucleotide sequence of GAM281 RNA, herein designated GAM RNA, also designated SEQ ID:278.

Another function of GAM281 is therefore inhibition of GTPBG3 (Accession NP__116009.1). Accordingly, utilities of GAM281 include diagnosis, prevention and treatment of diseases and clinical conditions associated with GTPBG3.

Glycogenin (Gy, Accession NP__004121.2) is another GAM281 target gene, herein designated TARGET GENE. GYG BINDING SITE is a target binding site found in the 3' untranslated region of mRNA encoded by Gy, corresponding to a target binding site such as BINDING SITE I, BINDING SITE II or BINDING SITE III of FIG. 8. Table 4 illustrates the complementarity of the nucleotide sequences of GYG BINDING SITE, designated SEQ ID:4258, to the nucleotide sequence of GAM281 RNA, herein designated GAM RNA, also designated SEQ ID:278.

Another function of GAM281 is therefore inhibition of Glycogenin (Gy, Accession NP_004121.2), a gene which primes de novo glycogen synthesis. Accordingly, utilities of GAM281 include diagnosis, prevention and treatment of diseases and clinical conditions associated with GYG.

The function of GYG and its association with various diseases and clinical conditions, has been established by previous studies, as described hereinabove with reference to GAM189.1. H-plk (Accession NP_056936.1) is another GAM281 target gene, herein designated TARGET GENE. H-plk BINDING SITE is a target binding site found in the 5' untranslated region of mRNA encoded by H-plk, corresponding to a target binding site such as BINDING SITE I, BINDING SITE II or BINDING SITE III of FIG. 8. Table 4 illustrates the complementarity of the nucleotide sequences of H-plk BINDING SITE, designated SEQ ID:12753, to the nucleotide sequence of GAM281 RNA, herein designated GAM RNA, also designated SEQ ID:278.

Another function of GAM281 is therefore inhibition of H-plk (Accession NP_056936.1). Accordingly, utilities of GAM281 include diagnosis, prevention and treatment of diseases and clinical conditions associated with H-plk.

H2AV (Accession NP_619541.1) is another GAM281 target gene, herein designated TARGET GENE. H2AV BINDING SITE is a target binding site found in the 3' untranslated region of multiple transcripts of mRNA encoded by H2AV, corresponding to a target binding site such as BINDING SITE I, BINDING SITE II or BINDING SITE III of FIG. 8. Table 4 illustrates the complementarity of the nucleotide sequences of H2AV BINDING SITE, designated SEQ ID:18864, to the nucleotide sequence of GAM281 RNA, herein designated GAM RNA, also designated SEQ ID:278.

Another function of GAM281 is therefore inhibition of H2AV (Accession NP_619541.1). Accordingly, utilities of GAM281 include diagnosis, prevention and treatment of diseases and clinical conditions associated with H2AV.

H63 (Accession NP_612432.2) is another GAM281 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:4554, to the nucleotide sequence of GAM281 RNA, herein designated GAM RNA, also designated SEQ ID:278.

Another function of GAM281 is therefore inhibition of H63 (Accession NP_612432.2). Accordingly, utilities of GAM281 include diagnosis, prevention and treatment of diseases and clinical conditions associated with H63.

H63 (Accession NP_816929.1) is another GAM281 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:4554, to the nucleotide sequence of GAM281 RNA, herein designated GAM RNA, also designated SEQ ID:278.

Another function of GAM281 is therefore inhibition of H63 (Accession NP_816929.1). Accordingly, utilities of GAM281 include diagnosis, prevention and treatment of diseases and clinical conditions associated with H63.

Hepatitis a virus cellular receptor 2 (HAVCR2, Accession NP_116171.2) is another GAM281 target gene, herein designated TARGET GENE. HAVCR2 BINDING SITE is a target binding site found in the 3' untranslated region of mRNA encoded by HAVCR2, corresponding to a target binding site such as BINDING SITE I, BINDING SITE II or BINDING SITE III of FIG. 8. Table 4 illustrates the complementarity of the nucleotide sequences of HAVCR2 BINDING SITE, designated SEQ ID:16260, to the nucleotide sequence of GAM281 RNA, herein designated GAM RNA, also designated SEQ ID:278.

Another function of GAM281 is therefore inhibition of Hepatitis a virus cellular receptor 2 (HAVCR2, Accession NP_116171.2). Accordingly, utilities of GAM281 include diagnosis, prevention and treatment of diseases and clinical conditions associated with HAVCR2.

Hemopoietic cell kinase (HCK, Accession NP_002101.2) is another GAM281 target gene, herein designated TARGET GENE. HCK BINDING SITE is a target binding site found in the 3' untranslated region of mRNA encoded by HCK, corresponding to a target binding site such as BINDING SITE I, BINDING SITE II or BINDING SITE III of FIG. 8. Table 4 illustrates the complementarity of the nucleotide sequences of HCK BINDING SITE, designated SEQ ID:7142, to the nucleotide sequence of GAM281 RNA, herein designated GAM RNA, also designated SEQ ID:278.

Another function of GAM281 is therefore inhibition of Hemopoietic cell kinase (HCK, Accession NP_002101.2), a gene which is non-receptor protein tyrosine kinase. and therefore may be associated with Leukemias. Accordingly, utilities of GAM281 include diagnosis, prevention and treatment of Leukemias, and of other diseases and clinical conditions associated with HCK.

The function of HCK has been established by previous studies. During a search for a cDNA clone representing human SRC (OMIM Ref. No. 190090), Quintrell et al. (1987) encountered a previously unrecognized gene that appeared to encode a protein-tyrosine kinase similar to SRC. Ziegler et al. (1987) found the same gene by a different route. Expression of this gene may be limited to certain hemopoietic cells and is especially prominent in cells of myeloid lineage, particularly mature granulocytes and monocytes. Therefore, Quintrell et al. (1987) designated the gene HCK (pronounced 'hick') for hemopoietic cell kinase. They described the nucleotide sequence of a cDNA clone that represents most or all of the mRNA for HCK, the deduced amino acid sequence of the protein encoded by HCK, and the distribution of RNA transcribed from HCK among various hemopoietic cells. By spot-blot analysis of sorted chromosomes and by in situ hybridization, Quintrell et al. (1987) assigned the HCK gene to 20q11-q12. Since this region is affected by interstitial deletions in some acute myeloid leukemias and myeloproliferative disorders, they suggested that damage to HCK may contribute to the pathogenesis of these conditions.

Full details of the abovementioned studies are described in the following publications, the disclosure of which are hereby incorporated by reference:

Quintrell, N.; Lebo, R.; Varmus, H.; Bishop, J. M.; Pettenati, M. J.; Le Beau, M. M.; Diaz, M. O.; Rowley, J. D.: Identification of a human gene (HCK) that encodes a protein-tyrosine kinase and is expressed in hemopoietic cells. Molec. Cell. Biol. 7:2267-2275, 1987; and Ziegler, S. F.; Marth, J. D.; Lewis, D. B.; Perlmutter, R. M.: Novel protein-tyrosine kinase gene (hck) preferentially expressed in cells of hematopoietic origin. Molec. Cell. Biol. 7.

Further studies establishing the function and utilities of HCK are found in John Hopkins OMIM database record ID 142370, and in cited publications listed in Table 5, which are hereby incorporated by reference. HE9 (Accession NP_741997.1) is another GAM281 target gene, herein designated TARGET GENE. HE9 BINDING SITE is a target binding site found in the 3' untranslated region of mRNA encoded by HE9, corresponding to a target binding site such as BINDING SITE I, BINDING SITE II or BINDING SITE III of FIG. 8. Table 4 illustrates the complementarity of the nucleotide sequences of HE9 BINDING SITE, designated SEQ ID:7942, to the nucleotide sequence of GAM281 RNA, herein designated GAM RNA, also designated SEQ ID:278.

Another function of GAM281 is therefore inhibition of HE9 (Accession NP_741997.1). Accordingly, utilities of GAM281 include diagnosis, prevention and treatment of diseases and clinical conditions associated with HE9.

HECA (Accession NP_057301.1) is another GAM281 target gene, herein designated TARGET GENE. HECA BINDING SITE is a target binding site found in the 3' untranslated region of mRNA encoded by HECA, corresponding to a target binding site such as BINDING SITE I, BINDING SITE II or BINDING SITE III of FIG. 8. Table 4 illustrates the complementarity of the nucleotide sequences of HECA BINDING SITE, designated SEQ ID:17954, to the nucleotide sequence of GAM281 RNA, herein designated GAM RNA, also designated SEQ ID:278.

Another function of GAM281 is therefore inhibition of HECA (Accession NP_057301.1). Accordingly, utilities of GAM281 include diagnosis, prevention and treatment of diseases and clinical conditions associated with HECA.

HEMK (Accession NP_057257.1) is another GAM281 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:6468, to the nucleotide sequence of GAM281 RNA, herein designated GAM RNA, also designated SEQ ID:278.

Another function of GAM281 is therefore inhibition of HEMK (Accession NP_057257.1). Accordingly, utilities of GAM281 include diagnosis, prevention and treatment of diseases and clinical conditions associated with HEMK.

Hephaestin (HEPH, Accession NP_055614.1) is another GAM281 target gene, herein designated TARGET GENE. HEPH BINDING SITE is a target binding site found in the 5' untranslated region of multiple transcripts of mRNA encoded by HEPH, corresponding to a target binding site such as BINDING SITE I, BINDING SITE II or BINDING SITE III of FIG. 8. Table 4 illustrates the complementarity of the nucleotide sequences of HEPH BINDING SITE, designated SEQ ID:15338, to the nucleotide sequence of GAM281 RNA, herein designated GAM RNA, also designated SEQ ID:278.

Another function of GAM281 is therefore inhibition of Hephaestin (HEPH, Accession NP_055614.1), a gene which is thought to be a membrane-bound protein responsible for transport of dietary iron from epithelial cells of the intestinal lumen into the circulatory system. Accordingly, utilities of GAM281 include diagnosis, prevention and treatment of diseases and clinical conditions associated with HEPH.

The function of HEPH and its association with various diseases and clinical conditions, has been established by previous studies, as described hereinabove with reference to GAM189.1. Hexosaminidase a (alpha polypeptide) (HEXA, Accession NP_000511.1) is another GAM281 target gene, herein designated TARGET GENE. HEXA BINDING SITE is a target binding site found in the 3' untranslated region of mRNA encoded by HEXA, corresponding to a target binding site such as BINDING SITE I, BINDING SITE II or BINDING SITE III of FIG. 8. Table 4 illustrates the complementarity of the nucleotide sequences of HEXA BINDING SITE, designated SEQ ID:14035, to the nucleotide sequence of GAM281 RNA, herein designated GAM RNA, also designated SEQ ID:278.

Another function of GAM281 is therefore inhibition of Hexosaminidase a (alpha polypeptide) (HEXA, Accession NP_000511.1). Accordingly, utilities of GAM281 include diagnosis, prevention and treatment of diseases and clinical conditions associated with HEXA.

Herv-h ltr-associating 3 (HHLA3, Accession XP_294968.1) is another GAM281 target gene, herein designated TARGET GENE. HHLA3 BINDING SITE is a target binding site found in the 5' untranslated region of multiple transcripts of mRNA encoded by HHLA3, corresponding to a target binding site such as BINDING SITE I, BINDING SITE II or BINDING SITE III of FIG. 8. Table 4 illustrates the complementarity of the nucleotide sequences of HHLA3 BINDING SITE, designated SEQ ID:13713, to the nucleotide sequence of GAM281 RNA, herein designated GAM RNA, also designated SEQ ID:278.

Another function of GAM281 is therefore inhibition of Herv-h ltr-associating 3 (HHLA3, Accession XP_294968.1). Accordingly, utilities of GAM281 include diagnosis, prevention and treatment of diseases and clinical conditions associated with HHLA3.

Herv-h ltr-associating 3 (HHLA3, Accession NP_009002.1) is another GAM281 target gene, herein designated TARGET GENE. HHLA3 BINDING SITE is a target binding site found in the 5' untranslated region of multiple transcripts of mRNA encoded by HHLA3, corresponding to a target binding site such as BINDING SITE I, BINDING SITE II or BINDING SITE III of FIG. 8. Table 4 illustrates the complementarity of the nucleotide sequences of HHLA3 BINDING SITE, designated SEQ ID:13713, to the nucleotide sequence of GAM281 RNA, herein designated GAM RNA, also designated SEQ ID:278.

Another function of GAM281 is therefore inhibition of Herv-h ltr-associating 3 (HHLA3, Accession NP_009002.1). Accordingly, utilities of GAM281 include diagnosis, prevention and treatment of diseases and clinical conditions associated with HHLA3.

HIC (Accession XP_041273.1) is another GAM281 target gene, herein designated TARGET GENE. HIC BINDING SITE is a target binding site found in the 5' untranslated region of mRNA encoded by HIC, corresponding to a target binding site such as BINDING SITE I, BINDING SITE II or BINDING SITE III of FIG. 8. Table 4 illustrates the complementarity of the nucleotide sequences of HIC BINDING SITE, designated SEQ ID:488, to the nucleotide sequence of GAM281 RNA, herein designated GAM RNA, also designated SEQ ID:278.

Another function of GAM281 is therefore inhibition of HIC (Accession XP_041273.1). Accordingly, utilities of GAM281 include diagnosis, prevention and treatment of diseases and clinical conditions associated with HIC.

Holocarboxylase synthetase (biotin-[proprionyl-coenzyme a-carboxylase (atp-hydrolysing)] ligase) (HLCS, Accession NP_000402.2) is another GAM281 target gene, herein designated TARGET GENE. HLCS BINDING SITE is a target binding site found in the 5' untranslated region of mRNA encoded by HLCS, corresponding to a target binding site such as BINDING SITE I, BINDING SITE II or BINDING SITE III of FIG. 8. Table 4 illustrates the complementarity of the nucleotide sequences of HLCS BINDING SITE, designated SEQ ID:2142, to the nucleotide sequence of GAM281 RNA, herein designated GAM RNA, also designated SEQ ID:278.

Another function of GAM281 is therefore inhibition of Holocarboxylase synthetase (biotin-[proprionyl-coenzyme a-carboxylase (atp-hydrolysing)] ligase) (HLCS, Accession NP_000402.2). Accordingly, utilities of GAM281 include diagnosis, prevention and treatment of diseases and clinical conditions associated with HLCS.

High-mobility group 20a (HMG20A, Accession NP_060670.1) is another GAM281 target gene, herein designated TARGET GENE. HMG20A BINDING SITE is a target binding site found in the 3' untranslated region of mRNA encoded by HMG20A, corresponding to a target binding site such as BINDING SITE I, BINDING SITE II or BINDING SITE III of FIG. 8. Table 4 illustrates the complementarity of the nucleotide sequences of HMG20A BINDING SITE, designated SEQ ID:5040, to the nucleotide sequence of GAM281 RNA, herein designated GAM RNA, also designated SEQ ID:278.

Another function of GAM281 is therefore inhibition of High-mobility group 20a (HMG20A, Accession NP_060670.1). Accordingly, utilities of GAM281 include diagnosis, prevention and treatment of diseases and clinical conditions associated with HMG20A.

HPRN (Accession NP_071938.1) is another GAM281 target gene, herein designated TARGET GENE. HPRN BINDING SITE is a target binding site found in the 3' untranslated region of mRNA encoded by HPRN, corresponding to a target binding site such as BINDING SITE I, BINDING SITE II or BINDING SITE III of FIG. 8. Table 4 illustrates the complementarity of the nucleotide sequences of HPRN BINDING SITE, designated SEQ ID:12916, to the nucleotide sequence of GAM281 RNA, herein designated GAM RNA, also designated SEQ ID:278.

Another function of GAM281 is therefore inhibition of HPRN (Accession NP_071938.1). Accordingly, utilities of GAM281 include diagnosis, prevention and treatment of diseases and clinical conditions associated with HPRN.

Histamine receptor h4 (HRH4, Accession NP_067637.2) is another GAM281 target gene, herein designated TARGET GENE. HRH4 BINDING SITE1 through HRH4 BINDING SITE3 are target binding sites found in untranslated regions of mRNA encoded by HRH4, corresponding to target binding sites such as BINDING SITE I, BINDING SITE II or BINDING SITE III of FIG. 8. Table 4 illustrates the complementarity of the nucleotide sequences of HRH4 BINDING SITE1 through HRH4 BINDING SITE3, designated SEQ ID:5301, SEQ ID:5358 and SEQ ID:3116 respectively, to the nucleotide sequence of GAM281 RNA, herein designated GAM RNA, also designated SEQ ID:278.

Another function of GAM281 is therefore inhibition of Histamine receptor h4 (HRH4, Accession NP_067637.2). Accordingly, utilities of GAM281 include diagnosis, prevention and treatment of diseases and clinical conditions associated with HRH4.

HSC3 (Accession NP_660157.1) is another GAM281 target gene, herein designated TARGET GENE. HSC3 BINDING SITE is a target binding site found in the 3' untranslated region of mRNA encoded by HSC3, corresponding to a target binding site such as BINDING SITE I, BINDING SITE II or BINDING SITE III of FIG. 8. Table 4 illustrates the complementarity of the nucleotide sequences of HSC3 BINDING SITE, designated SEQ ID:1095, to the nucleotide sequence of GAM281 RNA, herein designated GAM RNA, also designated SEQ ID:278.

Another function of GAM281 is therefore inhibition of HSC3 (Accession NP_660157.1). Accordingly, utilities of GAM281 include diagnosis, prevention and treatment of diseases and clinical conditions associated with HSC3.

HSD3B7 (Accession NP_079469.2) is another GAM281 target gene, herein designated TARGET GENE. HSD3B7 BINDING SITE is a target binding site found in the 3' untranslated region of mRNA encoded by HSD3B7, corresponding to a target binding site such as BINDING SITE I, BINDING SITE II or BINDING SITE III of FIG. 8. Table 4 illustrates the complementarity of the nucleotide sequences of HSD3B7 BINDING SITE, designated SEQ ID:2674, to the nucleotide sequence of GAM281 RNA, herein designated GAM RNA, also designated SEQ ID:278.

Another function of GAM281 is therefore inhibition of HSD3B7 (Accession NP_079469.2). Accordingly, utilities of GAM281 include diagnosis, prevention and treatment of diseases and clinical conditions associated with HSD3B7.

HSMPP8 (Accession XP_167894.1) is another GAM281 target gene, herein designated TARGET GENE. HSMPP8 BINDING SITE is a target binding site found in the 3' untranslated region of mRNA encoded by HSMPP8, corresponding to a target binding site such as BINDING SITE I, BINDING SITE II or BINDING SITE III of FIG. 8. Table 4 illustrates the complementarity of the nucleotide sequences of HSMPP8 BINDING SITE, designated SEQ ID:7797, to the nucleotide sequence of GAM281 RNA, herein designated GAM RNA, also designated SEQ ID:278.

Another function of GAM281 is therefore inhibition of HSMPP8 (Accession XP_167894.1). Accordingly, utilities of GAM281 include diagnosis, prevention and treatment of diseases and clinical conditions associated with HSMPP8.

HSNOV1 (Accession NP_059985.2) is another GAM281 target gene, herein designated TARGET GENE. HSNOV1 BINDING SITE1 and HSNOV1 BINDING SITE2 are target binding sites found in untranslated regions of mRNA encoded by HSNOV1, corresponding to target binding sites such as BINDING SITE I, BINDING SITE II or BINDING SITE III of FIG. 8. Table 4 illustrates the complementarity of the nucleotide sequences of HSNOV1 BINDING SITE1 and HSNOV1 BINDING SITE2, designated SEQ ID:849 and SEQ ID:12942 respectively, to the nucleotide sequence of GAM281 RNA, herein designated GAM RNA, also designated SEQ ID:278.

Another function of GAM281 is therefore inhibition of HSNOV1 (Accession NP_059985.2). Accordingly, utilities of GAM281 include diagnosis, prevention and treatment of diseases and clinical conditions associated with HSNOV1.

HSPC065 (Accession NP_054876.2) is another GAM281 target gene, herein designated TARGET GENE. HSPC065 BINDING SITE1 and HSPC065 BINDING SITE2 are target binding sites found in untranslated regions of mRNA encoded by HSPC065, corresponding to target binding sites such as BINDING SITE I, BINDING SITE II or BINDING SITE III of FIG. 8. Table 4 illustrates the complementarity of the nucleotide sequences of HSPC065 BINDING SITE1 and HSPC065 BINDING SITE2, designated SEQ ID:4676 and SEQ ID:713 respectively, to the nucleotide sequence of GAM281 RNA, herein designated GAM RNA, also designated SEQ ID:278.

Another function of GAM281 is therefore inhibition of HSPC065 (Accession NP_054876.2). Accordingly, utilities of GAM281 include diagnosis, prevention and treatment of diseases and clinical conditions associated with HSPC065.

5-hydroxytryptamine (serotonin) receptor 1d (HTR1D, Accession NP_000855.1) is another GAM281 target gene, herein designated TARGET GENE. HTR1D BINDING SITE is a target binding site found in the 3' untranslated region of mRNA encoded by HTR1D, corresponding to a target binding site such as BINDING SITE I, BINDING SITE II or BINDING SITE III of FIG. 8. Table 4 illustrates the complementarity of the nucleotide sequences of HTR1D BINDING SITE, designated SEQ ID:2563, to the nucleotide sequence of GAM281 RNA, herein designated GAM RNA, also designated SEQ ID:278.

Another function of GAM281 is therefore inhibition of 5-hydroxytryptamine (serotonin) receptor 1d (HTR1D, Accession NP_000855.1), a gene which belongs to g-protein coupled receptor. Accordingly, utilities of GAM281 include diagnosis, prevention and treatment of diseases and clinical conditions associated with HTR1D.

The function of HTR1D and its association with various diseases and clinical conditions, has been established by previous studies, as described hereinabove with reference to GAM189. 1.5-hydroxytryptamine (serotonin) receptor 1e (HTR1E, Accession NP_000856.1) is another GAM281 target gene, herein designated TARGET GENE. HTR1E BINDING SITE is a target binding site found in the 5' untranslated region of mRNA encoded by HTR1E, corresponding to a target binding site such as BINDING SITE I, BINDING SITE II or BINDING SITE III of FIG. 8. Table 4 illustrates the complementarity of the nucleotide sequences of HTR1E BINDING SITE, designated SEQ ID:538, to the nucleotide sequence of GAM281 RNA, herein designated GAM RNA, also designated SEQ ID:278.

Another function of GAM281 is therefore inhibition of 5-hydroxytryptamine (serotonin) receptor 1e (HTR1E, Accession NP_000856.1), a gene which belongs to g-protein coupled receptors. Accordingly, utilities of GAM281 include diagnosis, prevention and treatment of diseases and clinical conditions associated with HTR1E.

The function of HTR1E and its association with various diseases and clinical conditions, has been established by previous studies, as described hereinabove with reference to GAM161. 1.5-hydroxytryptamine (serotonin) receptor 3b (HTR3B, Accession NP_006019.1) is another GAM281 target gene, herein designated TARGET GENE. HTR3B BINDING SITE is a target binding site found in the 5' untranslated region of mRNA encoded by HTR3B, corresponding to a target binding site such as BINDING SITE I, BINDING SITE II or BINDING SITE III of FIG. 8. Table 4 illustrates the complementarity of the nucleotide sequences of HTR3B BINDING SITE, designated SEQ ID:656, to the nucleotide sequence of GAM281 RNA, herein designated GAM RNA, also designated SEQ ID:278.

Another function of GAM281 is therefore inhibition of 5-hydroxytryptamine (serotonin) receptor 3b (HTR3B, Accession NP_006019.1), a gene which is a component of ligand gated ion channels. Accordingly, utilities of GAM281 include diagnosis, prevention and treatment of diseases and clinical conditions associated with HTR3B.

The function of HTR3B has been established by previous studies. Serotonin mediates rapid excitatory responses through ligand-gated channels (HTR3 receptors). When expressed as a homomeric unit, HTR3A (OMIM Ref. No. 182139) is a functional receptor but displays rather weak conductance. By searching human genome sequence data, Davies et al. (1999) identified a homolog of the HTR3A subunit in a PAC clone from 11q23.1, the same chromosomal location of HTR3A. Using anchored PCR to screen brain and kidney cDNA libraries, they obtained a cDNA clone, which they designated HTR3B, that encodes a 441-amino acid protein with 41% sequence identity to HTR3A. Northern blot analysis revealed expression of a 4.4-kb transcript in kidney and brain, specifically in caudate nucleus, hippocampus, and thalamus, and particularly in amygdala. These regions of the brain also express 2.4-kb transcripts for HTR3A. HTR3B was absent from heart, placenta, lung, liver, skeletal muscle, and pancreas. The authors determined that HTR3B cannot assemble as a homomeric HTR3 receptor but that heteromeric HTR3A/HTR3B receptors display a large single-channel conductance (16 pS), low permeability to calcium ions, and a current-voltage relationship resembling that of characterized neuronal HTR3 channels. By RT-PCR in situ hybridization, Dubin et al. (1999) found that HTR3A and HTR3B colocalize in amygdala, telencephalon, and entorhinal cortex, as well as in small monocytes of spleen and tonsil, and in uterus, prostate, ovary, placenta, and intestine. Hydropathy analysis indicated that the HTR3B protein has 4 putative transmembrane domains. In contrast to HTR3A, HTR3B lacks the 3 negatively charged residues bracketing the second transmembrane domain that are thought to be critical for the rate of ion transport in acetylcholine receptors (see OMIM Ref. No. CHRNA1, 100690). It also contains 5 potential glycosylation and 4 potential phosphorylation sites.

Full details of the abovementioned studies are described in the following publications, the disclosure of which are hereby incorporated by reference:

Davies, P. A.; Pistis, M.; Hanna, M. C.; Peters, J. A.; Lambert, J. J.; Hales, T. G.; Kirkness, E. F.: The 5-HT(3B) subunit is a major determinant of serotonin-receptor function. Nature 397:359-363, 1999; and Dubin, A. E.; Huvar, R.; D'Andrea, M. R.; Pyati, J.; Zhu, J. Y.; Joy, K. C.; Wilson, S. J.; Galindo, J. E.; Glass, C. A.; Luo, L.; Jackson, M. R.; Lovenberg, T. W.; Erlander, M. G.: Th.

Further studies establishing the function and utilities of HTR3B are found in John Hopkins OMIM database record ID 604654, and in cited publications listed in Table 5, which are hereby incorporated by reference. Hormonally upregulated neu-associated kinase (HUNK, Accession NP_055401.1) is another GAM281 target gene, herein designated TARGET GENE. HUNK BINDING SITE is a target binding site found in the 3' untranslated region of mRNA encoded by HUNK, corresponding to a target binding site such as BINDING SITE I, BINDING SITE II or BINDING SITE III of FIG. 8. Table 4 illustrates the complementarity of the nucleotide sequences of HUNK BINDING SITE, designated SEQ ID:17952, to the nucleotide sequence of GAM281 RNA, herein designated GAM RNA, also designated SEQ ID:278.

Another function of GAM281 is therefore inhibition of Hormonally upregulated neu-associated kinase (HUNK, Accession NP_055401.1). Accordingly, utilities of GAM281 include diagnosis, prevention and treatment of diseases and clinical conditions associated with HUNK.

Hus1 checkpoint homolog (s. pombe) (HUS1, Accession NP_004498.1) is another GAM281 target gene, herein designated TARGET GENE. HUS1 BINDING SITE is a target binding site found in the 3' untranslated region of mRNA encoded by HUS1, corresponding to a target binding site such as BINDING SITE I, BINDING SITE II or BINDING SITE III of FIG. 8. Table 4 illustrates the complementarity of the nucleotide sequences of HUS1 BINDING SITE, designated SEQ ID:14238, to the nucleotide sequence of GAM281 RNA, herein designated GAM RNA, also designated SEQ ID:278.

Another function of GAM281 is therefore inhibition of Hus1 checkpoint homolog (s. pombe) (HUS1, Accession NP_004498.1), a gene which May form DNA damage-responsive protein complex. Accordingly, utilities of GAM281 include diagnosis, prevention and treatment of diseases and clinical conditions associated with HUS1.

The function of HUS1 and its association with various diseases and clinical conditions, has been established by previous studies, as described hereinabove with reference to GAM189.1. Hyaluronoglucosaminidase 1 (HYAL1, Accession NP_695018.1) is another GAM281 target gene, herein designated TARGET GENE. HYAL1 BINDING SITE is a target binding site found in the 5' untranslated region of multiple transcripts of mRNA encoded by HYAL1, corresponding to a target binding site such as BINDING SITE I, BINDING SITE II or BINDING SITE III of FIG. 8. Table 4 illustrates the complementarity of the nucleotide sequences of HYAL1 BINDING SITE, designated SEQ ID:1192, to the nucleotide sequence of GAM281 RNA, herein designated GAM RNA, also designated SEQ ID:278.

Another function of GAM281 is therefore inhibition of Hyaluronoglucosaminidase 1 (HYAL1, Accession NP_695018.1), a gene which plays a role in cell proliferation, migration and differentiation. Accordingly, utilities of GAM281 include diagnosis, prevention and treatment of diseases and clinical conditions associated with HYAL1.

The function of HYAL1 and its association with various diseases and clinical conditions, has been established by previous studies, as described hereinabove with reference to GAM180.2. Hyaluronoglucosaminidase 4 (HYAL4, Accession NP_036401.1) is another GAM281 target gene, herein designated TARGET GENE. HYAL4 BINDING SITE is a target binding site found in the 5' untranslated region of mRNA encoded by HYAL4, corresponding to a target binding site such as BINDING SITE I, BINDING SITE II or BINDING SITE III of FIG. 8. Table 4 illustrates the complementarity of the nucleotide sequences of HYAL4 BINDING SITE, designated SEQ ID:2143, to the nucleotide sequence of GAM281 RNA, herein designated GAM RNA, also designated SEQ ID:278.

Another function of GAM281 is therefore inhibition of Hyaluronoglucosaminidase 4 (HYAL4, Accession NP_036401.1). Accordingly, utilities of GAM281 include diagnosis, prevention and treatment of diseases and clinical conditions associated with HYAL4.

Intercellular adhesion molecule 1 (cd54), human rhinovirus receptor (ICAM1, Accession NP_000192.1) is another GAM281 target gene, herein designated TARGET GENE. ICAM1 BINDING SITE is a target binding site found in the 3' untranslated region of mRNA encoded by ICAM1, corresponding to a target binding site such as BINDING SITE I, BINDING SITE II or BINDING SITE III of FIG. 8. Table 4 illustrates the complementarity of the nucleotide sequences of ICAM1 BINDING SITE, designated SEQ ID:12075, to the nucleotide sequence of GAM281 RNA, herein designated GAM RNA, also designated SEQ ID:278.

Another function of GAM281 is therefore inhibition of Intercellular adhesion molecule 1 (cd54), human rhinovirus receptor (ICAM1, Accession NP_000192.1), a gene which binds the integrin LFA-1 (ITGB2) and promotes adhesion; member of the immunoglobulin superfamily and therefore may be associated with Malaria, cerebral, susceptibility to. Accordingly, utilities of GAM281 include diagnosis, prevention and treatment of Malaria, cerebral, susceptibility to, and of other diseases and clinical conditions associated with ICAM1.

The function of ICAM1 and its association with various diseases and clinical conditions, has been established by previous studies, as described hereinabove with reference to GAM189.1. ICK (Accession NP_057597.2) is another GAM281 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:7385, to the nucleotide sequence of GAM281 RNA, herein designated GAM RNA, also designated SEQ ID:278.

Another function of GAM281 is therefore inhibition of ICK (Accession NP_057597.2). Accordingly, utilities of GAM281 include diagnosis, prevention and treatment of diseases and clinical conditions associated with ICK.

ICK (Accession NP_055735.1) is another GAM281 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:7385, to the nucleotide sequence of GAM281 RNA, herein designated GAM RNA, also designated SEQ ID:278.

Another function of GAM281 is therefore inhibition of ICK (Accession NP_055735.1). Accordingly, utilities of GAM281 include diagnosis, prevention and treatment of diseases and clinical conditions associated with ICK.

Insulin-like growth factor 1 (somatomedin c) (IGF1, Accession NP_000609.1) is another GAM281 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:6279, to the nucleotide sequence of GAM281 RNA, herein designated GAM RNA, also designated SEQ ID:278.

Another function of GAM281 is therefore inhibition of Insulin-like growth factor 1 (somatomedin c) (IGF1, Accession NP_000609.1), a gene which are structurally and functionally related to insulin but have a much higher growth-promoting activity and therefore may be associated with Growth retardation with sensorineural deafness and mental retardation. Accordingly, utilities of GAM281 include diagnosis, prevention and treatment of Growth retardation with sensorineural deafness and mental retardation, and of other diseases and clinical conditions associated with IGF1.

The function of IGF1 and its association with various diseases and clinical conditions, has been established by previous studies, as described hereinabove with reference to GAM66.2. Interleukin 11 (IL11, Accession NP_000632.1) is another GAM281 target gene, herein designated TARGET GENE. IL11 BINDING SITE is a target binding site found in the 3' untranslated region of mRNA encoded by IL11, corresponding to a target binding site such as BINDING SITE I, BINDING SITE II or BINDING SITE III of FIG. 8. Table 4 illustrates the complementarity of the nucleotide sequences of IL11 BINDING SITE, designated SEQ ID:11544, to the nucleotide sequence of GAM281 RNA, herein designated GAM RNA, also designated SEQ ID:278.

Another function of GAM281 is therefore inhibition of Interleukin 11 (IL11, Accession NP_000632.1), a gene which stimulates the proliferation of hematopoietic stem cells and megakaryocyte progenitor cells and induces megakaryocyte maturation. Accordingly, utilities of GAM281 include diagnosis, prevention and treatment of diseases and clinical conditions associated with IL11.

The function of IL11 and its association with various diseases and clinical conditions, has been established by previous studies, as described hereinabove with reference to GAM41.1. Interleukin 16 (lymphocyte chemoattractant factor) (IL16, Accession NP_757366.1) is another GAM281 target gene, herein designated TARGET GENE. IL16 BINDING SITE is a target binding site found in the 5' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:19554, to the nucleotide sequence of GAM281 RNA, herein designated GAM RNA, also designated SEQ ID:278.

Another function of GAM281 is therefore inhibition of Interleukin 16 (lymphocyte chemoattractant factor) (IL16, Accession NP_757366.1), a gene which modulates T-cell activation. Accordingly, utilities of GAM281 include diagnosis, prevention and treatment of diseases and clinical conditions associated with IL16.

The function of IL16 and its association with various diseases and clinical conditions, has been established by previous studies, as described hereinabove with reference to GAM66.1. Interleukin 21 receptor (IL21R, Accession NP_068570.1) is another GAM281 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM281 RNA, herein designated GAM RNA, also designated SEQ ID:278.

Another function of GAM281 is therefore inhibition of Interleukin 21 receptor (IL21R, Accession NP_068570.1), a gene which is involved in receptor mediated endocytosis and transduces the mitogenic signals of il- 2. Accordingly, utilities of GAM281 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 21 receptor (IL21R, Accession NP_851565.1) is another GAM281 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM281 RNA, herein designated GAM RNA, also designated SEQ ID:278.

Another function of GAM281 is therefore inhibition of Interleukin 21 receptor (IL21R, Accession NP_851565.1), a gene which is involved in receptor mediated endocytosis and transduces the mitogenic signals of il- 2. Accordingly, utilities of GAM281 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 21 receptor (IL21R, Accession NP_851564.1) is another GAM281 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM281 RNA, herein designated GAM RNA, also designated SEQ ID:278.

Another function of GAM281 is therefore inhibition of Interleukin 21 receptor (IL21R, Accession NP_851564.1), a gene which is involved in receptor mediated endocytosis and transduces the mitogenic signals of il- 2. Accordingly, utilities of GAM281 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 28 receptor, alpha (IL28RA, Accession NP_775087.1) is another GAM281 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM281 RNA, herein designated GAM RNA, also designated SEQ ID:278.

Another function of GAM281 is therefore inhibition of Interleukin 28 receptor, alpha (IL28RA, Accession NP_775087.1). Accordingly, utilities of GAM281 include diagnosis, prevention and treatment of diseases and clinical conditions associated with IL28RA.

Interleukin 28 receptor, alpha (IL28RA, Accession NP_775088.1) is another GAM281 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM281 RNA, herein designated GAM RNA, also designated SEQ ID:278.

Another function of GAM281 is therefore inhibition of Interleukin 28 receptor, alpha (IL28RA, Accession NP_775088.1). Accordingly, utilities of GAM281 include diagnosis, prevention and treatment of diseases and clinical conditions associated with IL28RA.

Interleukin 28 receptor, alpha (IL28RA, Accession NP_734464.1) is another GAM281 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM281 RNA, herein designated GAM RNA, also designated SEQ ID:278.

Another function of GAM281 is therefore inhibition of Interleukin 28 receptor, alpha (IL28RA, Accession NP_734464.1). Accordingly, utilities of GAM281 include diagnosis, prevention and treatment of diseases and clinical conditions associated with IL28RA.

IMPACT (Accession NP_060909.1) is another GAM281 target gene, herein designated TARGET GENE. IMPACT BINDING SITE is a target binding site found in the 3' untranslated region of mRNA encoded by IMPACT, corresponding to a target binding site such as BINDING SITE I, BINDING SITE II or BINDING SITE III of FIG. 8. Table 4 illustrates the complementarity of the nucleotide sequences of IMPACT BINDING SITE, designated SEQ ID:8975, to the nucleotide sequence of GAM281 RNA, herein designated GAM RNA, also designated SEQ ID:278.

Another function of GAM281 is therefore inhibition of IMPACT (Accession NP_060909.1). Accordingly, utilities of GAM281 include diagnosis, prevention and treatment of diseases and clinical conditions associated with IMPACT.

INHBE (Accession NP_113667.1) is another GAM281 target gene, herein designated TARGET GENE. INHBE BINDING SITE is a target binding site found in the 3' untranslated region of mRNA encoded by INHBE, corresponding to a target binding site such as BINDING SITE I, BINDING SITE II or BINDING SITE III of FIG. 8. Table 4 illustrates the complementarity of the nucleotide sequences of INHBE BINDING SITE, designated SEQ ID:16283, to the nucleotide sequence of GAM281 RNA, herein designated GAM RNA, also designated SEQ ID:278.

Another function of GAM281 is therefore inhibition of INHBE (Accession NP_113667.1). Accordingly, utilities of GAM281 include diagnosis, prevention and treatment of diseases and clinical conditions associated with INHBE.

Indolethylamine n-methyltransferase (INMT, Accession NP_006765.3) is another GAM281 target gene, herein designated TARGET GENE. INMT BINDING SITE1 and INMT BINDING SITE2 are target binding sites found in untranslated regions of mRNA encoded by INMT, corresponding to target binding sites such as BINDING SITE I, BINDING SITE II or BINDING SITE III of FIG. 8. Table 4 illustrates the complementarity of the nucleotide sequences of INMT BINDING SITE1 and INMT BINDING SITE2, designated SEQ ID:9149 and SEQ ID:11523 respectively, to the nucleotide sequence of GAM281 RNA, herein designated GAM RNA, also designated SEQ ID:278.

Another function of GAM281 is therefore inhibition of Indolethylamine n-methyltransferase (INMT, Accession NP_006765.3). Accordingly, utilities of GAM281 include diagnosis, prevention and treatment of diseases and clinical conditions associated with INMT.

Interferon regulatory factor 4 (IRF4, Accession NP_002451.1) is another GAM281 target gene, herein designated TARGET GENE. IRF4 BINDING SITE1 and IRF4 BINDING SITE2 are target binding sites found in untranslated regions of mRNA encoded by IRF4, corresponding to target binding sites such as BINDING SITE I, BINDING SITE II or BINDING SITE III of FIG. 8. Table 4 illustrates the complementarity of the nucleotide sequences of IRF4 BINDING SITE1 and IRF4 BINDING SITE2, designated SEQ ID:2698 and SEQ ID:1517 respectively, to the nucleotide sequence of GAM281 RNA, herein designated GAM RNA, also designated SEQ ID:278.

Another function of GAM281 is therefore inhibition of Interferon regulatory factor 4 (IRF4, Accession NP_002451.1). Accordingly, utilities of GAM281 include diagnosis, prevention and treatment of diseases and clinical conditions associated with IRF4.

IRTA2 (Accession NP_112571.1) is another GAM281 target gene, herein designated TARGET GENE. IRTA2 BINDING SITE is a target binding site found in the 5' untranslated region of mRNA encoded by IRTA2, corresponding to a target binding site such as BINDING SITE I, BINDING SITE II or BINDING SITE III of FIG. 8. Table 4 illustrates the complementarity of the nucleotide sequences of IRTA2 BINDING SITE, designated SEQ ID:19371, to the nucleotide sequence of GAM281 RNA, herein designated GAM RNA, also designated SEQ ID:278.

Another function of GAM281 is therefore inhibition of IRTA2 (Accession NP_112571.1), a gene which binds to the fc region of immunoglobulins gamma low affinity receptor. and therefore may be associated with Burkitt lymphoma. Accordingly, utilities of GAM281 include diagnosis, prevention and treatment of Burkitt lymphoma, and of other diseases and clinical conditions associated with IRTA2.

The function of IRTA2 has been established by previous studies. Chromosomal abnormalities involving translocation breakpoints at 1q21-q23 are frequent in B-cell non-Hodgkin lymphoma (see OMIM Ref. No. BCL9; 602597) and multiple myeloma (MM; OMIM Ref. No. 254500). By cloning the breakpoints of a (1;14)(q21;q32) chromosomal translocation in the FR4 multiple myeloma cell line, followed by exon trapping and screening a spleen cDNA library, Hatzivassiliou et al. (2001) obtained cDNAs encoding 3 isoforms of IRTA1 (OMIM Ref. No. 605876) and 4 isoforms of IRTA2. The 3 major IRTA2 mRNA isoforms (ITRA2A, ITRA2B, and ITRA2C) each have their own unique 3-prime untranslated region, and the proteins they encode share a common amino acid sequence until residue 560, including a signal peptide and 6 extracellular Ig-type domains. Sequence analysis predicted that IRTA2A is a 759-amino acid secreted glycoprotein with 8 total extracellular Ig-type domains followed by 13 unique, predominantly polar residues at its C terminus. After the common 560 amino acids, IRTA2B has only 32 additional residues, whose hydrophobicity is compatible with its docking to the plasma membrane via a GPI anchor. The 977-amino acid IRTA2C protein shares the first 746 amino acids with IRTA2A. IRTA2C has a total of 9 extracellular Ig-type domains with 8 potential N-linked glycosylation sites; a 23-residue transmembrane region; and a 104-residue cytoplasmic domain with 3 consensus SH2-binding domains, all of which exhibit features of ITIMs (immune-receptor tyrosine-based inhibition motifs) and are encoded by separate exons. The fourth isoform, IRTA2D, encodes a peptide of 152 amino acids. Northern blot analysis detected 2.8-, 4.4-, 5.3-, and 0.6-kb IRTA2 transcripts in lymph node, spleen, bone marrow, and small intestine, with a preponderance of the IRTA2A isoform. In situ hybridization analysis detected IRTA2 expression in tonsillar germinal center centrocytes, but not in centroblasts, as well as in intraepithelial and interfollicular regions. Nakayama et al. (2001) independently cloned IRTA2, which they called BXMAS1, by representational difference analysis of genes activated by anti-IgM crosslinking of a human B-cell line. The deduced 977-amino acid protein contains 8 ITIMs and 8 potential N-linked glycosylation sites. Northern blot analysis detected a 6.7-kb transcript and a larger transcript between 14- and 17-kb in B cells 24 to 36 hours after activation. Northern blot analysis of tissues detected expression only in spleen In situ hybridization analysis demonstrated expression of IRTA2 in the mantle zone of tonsil tissue but not in germinal center cells Full details of the abovementioned studies are described in the following publications, the disclosure of which are hereby incorporated by reference:

Hatzivassiliou, G.; Miller, I.; Takizawa, J.; Palanisamy, N.; Rao, P. H.; Iida, S.; Tagawa, S.; Taniwaki, M.; Russo, J.; Neri, A.; Cattoretti, G.; Clynes, R.; Mendelsohn, C.; Chaganti, R. S. K.; Dalla-Favera, R.: IRTA1 and IRTA2, novel immunoglobulin superfamily receptors expressed in B cells and involved in chromosome 1q21 abnormalities in B cell malignancy. Immunity 14:277- 289, 2001; and Nakayama, Y.; Weissman, S. M.; Bothwell, A. L. M.: BXMAS1 identifies a cluster of homologous genes differentially expressed in B cells. Biochem. Biophys. Res. Commun. 285:830-837, 200.

Further studies establishing the function and utilities of IRTA2 are found in John Hopkins OMIM database record ID 605877, and in cited publications listed in Table 5, which are hereby incorporated by reference. Integrin, alpha d (ITGAD, Accession XP__113880.1) is another GAM281 target gene, herein designated TARGET GENE. ITGAD BINDING SITE is a target binding site found in the 3' untranslated region of mRNA encoded by ITGAD, corresponding to a target binding site such as BINDING SITE I, BINDING SITE II or BINDING SITE III of FIG. 8. Table 4 illustrates the complementarity of the nucleotide sequences of ITGAD BINDING SITE, designated SEQ ID:2749, to the nucleotide sequence of GAM281 RNA, herein designated GAM RNA, also designated SEQ ID:278.

Another function of GAM281 is therefore inhibition of Integrin, alpha d (ITGAD, Accession XP__113880.1). Accordingly, utilities of GAM281 include diagnosis, prevention and treatment of diseases and clinical conditions associated with ITGAD.

Integrin, alpha m (complement component receptor 3, alpha; also known as cd11b (p170), macrophage antigen alpha polypeptide) (ITGAM, Accession NP__000623.1) is another GAM281 target gene, herein designated TARGET GENE. ITGAM BINDING SITE is a target binding site found in the 3' untranslated region of mRNA encoded by ITGAM, corresponding to a target binding site such as BINDING SITE I, BINDING SITE II or BINDING SITE III of FIG. 8. Table 4 illustrates the complementarity of the nucleotide sequences of ITGAM BINDING SITE, designated SEQ ID:5922, to the nucleotide sequence of GAM281 RNA, herein designated GAM RNA, also designated SEQ ID:278.

Another function of GAM281 is therefore inhibition of Integrin, alpha m (complement component receptor 3, alpha; also known as cd11b (p170), macrophage antigen alpha polypeptide) (ITGAM, Accession NP__000623.1), a gene which is invovled in various adhesive interactions of monocytes, macrophages and granulocytes as well as in mediating the uptake of complement-coated particles. Accordingly, utilities of GAM281 include diagnosis, prevention and treatment of diseases and clinical conditions associated with ITGAM.

The function of ITGAM and its association with various diseases and clinical conditions, has been established by previous studies, as described hereinabove with reference to GAM51.1. Integrin, alpha x (antigen cd11c (p150), alpha polypeptide) (ITGAX, Accession NP__000878.1) is another GAM281 target gene, herein designated TARGET GENE. ITGAX BINDING SITE is a target binding site found in the 3' untranslated region of mRNA encoded by ITGAX, corresponding to a target binding site such as BINDING SITE I, BINDING SITE II or BINDING SITE III of FIG. 8. Table 4 illustrates the complementarity of the nucleotide sequences of ITGAX BINDING SITE, designated SEQ ID:559, to the nucleotide sequence of GAM281 RNA, herein designated GAM RNA, also designated SEQ ID:278.

Another function of GAM281 is therefore inhibition of Integrin, alpha x (antigen cd11c (p150), alpha polypeptide) (ITGAX, Accession NP__000878.1). Accordingly, utilities of GAM281 include diagnosis, prevention and treatment of diseases and clinical conditions associated with ITGAX.

Inositol 1,4,5-triphosphate receptor, type 2 (ITPR2, Accession NP__002214.1) is another GAM281 target gene, herein designated TARGET GENE. ITPR2 BINDING SITE is a target binding site found in the 3' untranslated region of mRNA encoded by ITPR2, corresponding to a target binding site such as BINDING SITE I, BINDING SITE II or BINDING SITE III of FIG. 8. Table 4 illustrates the complementarity of the nucleotide sequences of ITPR2 BINDING SITE, designated SEQ ID:20047, to the nucleotide sequence of GAM281 RNA, herein designated GAM RNA, also designated SEQ ID:278.

Another function of GAM281 is therefore inhibition of Inositol 1,4,5-triphosphate receptor, type 2 (ITPR2, Accession NP__002214.1). Accordingly, utilities of GAM281 include diagnosis, prevention and treatment of diseases and clinical conditions associated with ITPR2.

Janus kinase 3 (a protein tyrosine kinase, leukocyte) (JAK3, Accession NP__000206.1) is another GAM281 target gene, herein designated TARGET GENE. JAK3 BINDING SITE is a target binding site found in the 3' untranslated region of mRNA encoded by JAK3, corresponding to a target binding site such as BINDING SITE I, BINDING SITE II or BINDING SITE III of FIG. 8. Table 4 illustrates the complementarity of the nucleotide sequences of JAK3 BINDING SITE, designated SEQ ID:18060, to the nucleotide sequence of GAM281 RNA, herein designated GAM RNA, also designated SEQ ID:278.

Another function of GAM281 is therefore inhibition of Janus kinase 3 (a protein tyrosine kinase, leukocyte) (JAK3, Accession NP__000206.1). Accordingly, utilities of GAM281 include diagnosis, prevention and treatment of diseases and clinical conditions associated with JAK3.

JDP2 (Accession NP__569736.1) is another GAM281 target gene, herein designated TARGET GENE. JDP2 BINDING SITE is a target binding site found in the 3' untranslated region of mRNA encoded by JDP2, corresponding to a target binding site such as BINDING SITE I, BINDING SITE II or BINDING SITE III of FIG. 8. Table 4 illustrates the complementarity of the nucleotide sequences of JDP2 BINDING SITE, designated SEQ ID:2088, to the nucleotide sequence of GAM281 RNA, herein designated GAM RNA, also designated SEQ ID:278.

Another function of GAM281 is therefore inhibition of JDP2 (Accession NP__569736.1). Accordingly, utilities of GAM281 include diagnosis, prevention and treatment of diseases and clinical conditions associated with JDP2.

JM11 (Accession NP__296375.1) is another GAM281 target gene, herein designated TARGET GENE. JM11 BINDING SITE is a target binding site found in the 3' untranslated region of mRNA encoded by JM11, corresponding to a target binding site such as BINDING SITE I, BINDING SITE II or BINDING SITE III of FIG. 8. Table 4 illustrates the complementarity of the nucleotide sequences of JM11 BINDING SITE, designated SEQ ID:10197, to the nucleotide sequence of GAM281 RNA, herein designated GAM RNA, also designated SEQ ID:278.

Another function of GAM281 is therefore inhibition of JM11 (Accession NP__296375.1). Accordingly, utilities of GAM281 include diagnosis, prevention and treatment of diseases and clinical conditions associated with JM11.

Jerky homolog (mouse) (JRK, Accession NP_003715.1) is another GAM281 target gene, herein designated TARGET GENE. JRK BINDING SITE is a target binding site found in the 3' untranslated region of mRNA encoded by JRK, corresponding to a target binding site such as BINDING SITE I, BINDING SITE II or BINDING SITE III of FIG. 8. Table 4 illustrates the complementarity of the nucleotide sequences of JRK BINDING SITE, designated SEQ ID:3927, to the nucleotide sequence of GAM281 RNA, herein designated GAM RNA, also designated SEQ ID:278.

Another function of GAM281 is therefore inhibition of Jerky homolog (mouse) (JRK, Accession NP_003715.1), a gene which might function as a DNA-binding protein and therefore may be associated with Absence epilepsy. Accordingly, utilities of GAM281 include diagnosis, prevention and treatment of Absence epilepsy, and of other diseases and clinical conditions associated with JRK.

The function of JRK and its association with various diseases and clinical conditions, has been established by previous studies, as described hereinabove with reference to GAM65.2. JWA (Accession NP_006398.1) is another GAM281 target gene, herein designated TARGET GENE. JWA BINDING SITE is a target binding site found in the 3' untranslated region of mRNA encoded by JWA, corresponding to a target binding site such as BINDING SITE I, BINDING SITE II or BINDING SITE III of FIG. 8. Table 4 illustrates the complementarity of the nucleotide sequences of JWA BINDING SITE, designated SEQ ID:8446, to the nucleotide sequence of GAM281 RNA, herein designated GAM RNA, also designated SEQ ID:278.

Another function of GAM281 is therefore inhibition of JWA (Accession NP_006398.1). Accordingly, utilities of GAM281 include diagnosis, prevention and treatment of diseases and clinical conditions associated with JWA.

Potassium inwardly-rectifying channel, subfamily j, member 11 (KCNJ11, Accession NP_000516.2) is another GAM281 target gene, herein designated TARGET GENE. KCNJ11 BINDING SITE is a target binding site found in the 5' untranslated region of mRNA encoded by KCNJ11, corresponding to a target binding site such as BINDING SITE I, BINDING SITE II or BINDING SITE III of FIG. 8. Table 4 illustrates the complementarity of the nucleotide sequences of KCNJ11 BINDING SITE, designated SEQ ID:15049, to the nucleotide sequence of GAM281 RNA, herein designated GAM RNA, also designated SEQ ID:278.

Another function of GAM281 is therefore inhibition of Potassium inwardly-rectifying channel, subfamily j, member 11 (KCNJ11, Accession NP_000516.2), a gene which is controlled by g proteins. inward rectifier k+ channels are characterized by a greater tendency to allow potassium to flow into the cell rather than out of it. and therefore is associated with Persistent hyperinsulinemic hypoglycemia of infancy. Accordingly, utilities of GAM281 include diagnosis, prevention and treatment of Persistent hyperinsulinemic hypoglycemia of infancy, and of other diseases and clinical conditions associated with KCNJ11.

The function of KCNJ11 and its association with various diseases and clinical conditions, has been established by previous studies, as described hereinabove with reference to GAM189.1. Potassium inwardly-rectifying channel, subfamily j, member 16 (KCNJ16, Accession NP_733938.1) is another GAM281 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM281 RNA, herein designated GAM RNA, also designated SEQ ID:278.

Another function of GAM281 is therefore inhibition of Potassium inwardly-rectifying channel, subfamily j, member 16 (KCNJ16, Accession NP_733938.1). Accordingly, utilities of GAM281 include diagnosis, prevention and treatment of diseases and clinical conditions associated with KCNJ16.

Potassium inwardly-rectifying channel, subfamily j, member 16 (KCNJ16, Accession NP_061128.1) is another GAM281 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM281 RNA, herein designated GAM RNA, also designated SEQ ID:278.

Another function of GAM281 is therefore inhibition of Potassium inwardly-rectifying channel, subfamily j, member 16 (KCNJ16, Accession NP_061128.1). Accordingly, utilities of GAM281 include diagnosis, prevention and treatment of diseases and clinical conditions associated with KCNJ16.

Potassium inwardly-rectifying channel, subfamily j, member 16 (KCNJ16, Accession NP_733937.1) is another GAM281 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM281 RNA, herein designated GAM RNA, also designated SEQ ID:278.

Another function of GAM281 is therefore inhibition of Potassium inwardly-rectifying channel, subfamily j, member 16 (KCNJ16, Accession NP_733937.1). Accordingly, utilities of GAM281 include diagnosis, prevention and treatment of diseases and clinical conditions associated with KCNJ16.

Potassium channel, subfamily k, member 3 (KCNK3, Accession NP_002237.1) is another GAM281 target gene, herein designated TARGET GENE. KCNK3 BINDING SITE is a target binding site found in the 3' untranslated region of mRNA encoded by KCNK3, corresponding to a target binding site such as BINDING SITE I, BINDING SITE II or BINDING SITE III of FIG. 8. Table 4 illustrates the complementarity of the nucleotide sequences of KCNK3 BINDING SITE, designated SEQ ID:16912, to the nucleotide sequence of GAM281 RNA, herein designated GAM RNA, also designated SEQ ID:278.

Another function of GAM281 is therefore inhibition of Potassium channel, subfamily k, member 3 (KCNK3, Accession NP_002237.1), a gene which is a ph-dependent, voltage-insensitive, background potassium channel. Accordingly, utilities of GAM281 include diagnosis, prevention and treatment of diseases and clinical conditions associated with KCNK3.

The function of KCNK3 has been established by previous studies. Potassium channels are ubiquitous multisubunit membrane proteins that regulate membrane potential in numerous cell types. One family of mammalian K+ channels is characterized by the presence of 4 transmembrane domains and 2 P domains per subunit; this family includes TASK, TWIK (KCNK1; 601745), and TREK (KCNK2; 603219). Duprat et al. (1997) identified mouse expressed sequence tags with similarity to TREK and TWIK and cloned a corresponding cDNA from a mouse brain library. The mouse cDNA was used to clone the human counterpart from a kidney cDNA library. The human cDNA, designated TASK, encodes a 394-amino acid polypeptide with 85% identity to the mouse ortholog. The sequence contains consensus sites for N-linked glycosylation and for phosphorylation at the C-terminal. Northern blot analysis showed that TASK is expressed in a variety of human tissues, with highest levels in pancreas and placenta. Expression of the TASK cDNA revealed that the functional protein creates currents that are K(+)-selective, instantaneous, and noninactivating. These currents showed an outward rectification when external K+ was low, but evinced absence of activation and inactivation kinetics as well as voltage independence, characteristics of so-called leak or background conductances. TASK currents were very sensitive to small changes in extracellular pH, suggesting that TASK has a role in cellular responses to changes in extracellular pH. Lesage and Lazdunski (1998) used a radiation hybrid mapping panel to map the human KCNK3 gene to chromosome 2p23 between markers WI13615 and WI11298. By fluorescence in situ hybridization, Manjunath et al. (1999) mapped the KCNK3 gene to 2p24.1-p23.3 and the mouse homolog to chromosome 5B.

Full details of the abovementioned studies are described in the following publications, the disclosure of which are hereby incorporated by reference:

Lesage, F.; Lazdunski, M.: Mapping of human potassium channel genes TREK-1 (KCNK2) and TASK (KCNK3) to chromosomes 1q41 and 2p23. Genomics 51:478-479, 1998; and Manjunath, N. A.; Bray-Ward, P.; Goldstein, S. A. N.; Gallagher, P. G.: Assignment of the 2P domain, acid-sensitive potassium channel OAT1 gene KCNK3 to human chromosome bands 2p24.1-p.

Further studies establishing the function and utilities of KCNK3 are found in John Hopkins OMIM database record ID 603220, and in cited publications listed in Table 5, which are hereby incorporated by reference. KENAE (Accession NP_789786.1) is another GAM281 target gene, herein designated TARGET GENE. KENAE BINDING SITE is a target binding site found in the 3' untranslated region of mRNA encoded by KENAE, corresponding to a target binding site such as BINDING SITE I, BINDING SITE II or BINDING SITE III of FIG. 8. Table 4 illustrates the complementarity of the nucleotide sequences of KENAE BINDING SITE, designated SEQ ID:14862, to the nucleotide sequence of GAM281 RNA, herein designated GAM RNA, also designated SEQ ID:278.

Another function of GAM281 is therefore inhibition of KENAE (Accession NP_789786.1). Accordingly, utilities of GAM281 include diagnosis, prevention and treatment of diseases and clinical conditions associated with KENAE.

KIAA0063 (Accession NP_055691.1) is another GAM281 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:5884, to the nucleotide sequence of GAM281 RNA, herein designated GAM RNA, also designated SEQ ID:278.

Another function of GAM281 is therefore inhibition of KIAA0063 (Accession NP_055691.1). Accordingly, utilities of GAM281 include diagnosis, prevention and treatment of diseases and clinical conditions associated with KIAA0063.

KIAA0082 (Accession NP_055865.1) is another GAM281 target gene, herein designated TARGET GENE. KIAA0082 BINDING SITE is a target binding site found in the 3' untranslated region of mRNA encoded by KIAA0082, corresponding to a target binding site such as BINDING SITE I, BINDING SITE II or BINDING SITE III of FIG. 8. Table 4 illustrates the complementarity of the nucleotide sequences of KIAA0082 BINDING SITE, designated SEQ ID:18751, to the nucleotide sequence of GAM281 RNA, herein designated GAM RNA, also designated SEQ ID:278.

Another function of GAM281 is therefore inhibition of KIAA0082 (Accession NP_055865.1). Accordingly, utilities of GAM281 include diagnosis, prevention and treatment of diseases and clinical conditions associated with KIAA0082.

KIAA0087 (Accession NP_055584.1) is another GAM281 target gene, herein designated TARGET GENE. KIAA0087 BINDING SITE is a target binding site found in the 3' untranslated region of mRNA encoded by KIAA0087, corresponding to a target binding site such as BINDING SITE I, BINDING SITE II or BINDING SITE III of FIG. 8. Table 4 illustrates the complementarity of the nucleotide sequences of KIAA0087 BINDING SITE, designated SEQ ID:10179, to the nucleotide sequence of GAM281 RNA, herein designated GAM RNA, also designated SEQ ID:278.

Another function of GAM281 is therefore inhibition of KIAA0087 (Accession NP_055584.1). Accordingly, utilities of GAM281 include diagnosis, prevention and treatment of diseases and clinical conditions associated with KIAA0087.

KIAA0117 (Accession XP_290939.1) is another GAM281 target gene, herein designated TARGET GENE. KIAA0117 BINDING SITE is a target binding site found in the 3' untranslated region of mRNA encoded by KIAA0117, corresponding to a target binding site such as BINDING SITE I, BINDING SITE II or BINDING SITE III of FIG. 8. Table 4 illustrates the complementarity of the nucleotide sequences of KIAA0117 BINDING SITE, designated SEQ ID:9255, to the nucleotide sequence of GAM281 RNA, herein designated GAM RNA, also designated SEQ ID:278.

Another function of GAM281 is therefore inhibition of KIAA0117 (Accession XP_290939.1). Accordingly, utilities of GAM281 include diagnosis, prevention and treatment of diseases and clinical conditions associated with KIAA0117.

KIAA0182 (Accession XP_050495.4) is another GAM281 target gene, herein designated TARGET GENE. KIAA0182 BINDING SITE is a target binding site found in the 3' untranslated region of mRNA encoded by KIAA0182, corresponding to a target binding site such as BINDING SITE I, BINDING SITE II or BINDING SITE III of FIG. 8. Table 4 illustrates the complementarity of the nucleotide sequences of KIAA0182 BINDING SITE, designated SEQ ID:2218, to the nucleotide sequence of GAM281 RNA, herein designated GAM RNA, also designated SEQ ID:278.

Another function of GAM281 is therefore inhibition of KIAA0182 (Accession XP_050495.4). Accordingly, utilities of GAM281 include diagnosis, prevention and treatment of diseases and clinical conditions associated with KIAA0182.

KIAA0186 (Accession NP_066545.1) is another GAM281 target gene, herein designated TARGET GENE. KIAA0186 BINDING SITE is a target binding site found in the 3' untranslated region of mRNA encoded by KIAA0186, corresponding to a target binding site such as BINDING SITE I, BINDING SITE II or BINDING SITE III of FIG. 8. Table 4 illustrates the complementarity of the nucleotide sequences of KIAA0186 BINDING SITE, designated SEQ ID:2625, to the nucleotide sequence of GAM281 RNA, herein designated GAM RNA, also designated SEQ ID:278.

Another function of GAM281 is therefore inhibition of KIAA0186 (Accession NP_066545.1). Accordingly, utilities of GAM281 include diagnosis, prevention and treatment of diseases and clinical conditions associated with KIAA0186.

KIAA0205 (Accession NP_055688.1) is another GAM281 target gene, herein designated TARGET GENE. KIAA0205 BINDING SITE is a target binding site found in the 3' untranslated region of mRNA encoded by KIAA0205, corresponding to a target binding site such as BINDING SITE I, BINDING SITE II or BINDING SITE III of FIG. 8. Table 4 illustrates the complementarity of the nucleotide sequences of KIAA0205 BINDING SITE, designated SEQ ID:3429, to the nucleotide sequence of GAM281 RNA, herein designated GAM RNA, also designated SEQ ID:278.

Another function of GAM281 is therefore inhibition of KIAA0205 (Accession NP_055688.1). Accordingly, utilities of GAM281 include diagnosis, prevention and treatment of diseases and clinical conditions associated with KIAA0205.

KIAA0237 (Accession NP_055562.1) is another GAM281 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:17386, to the nucleotide sequence of GAM281 RNA, herein designated GAM RNA, also designated SEQ ID:278.

Another function of GAM281 is therefore inhibition of KIAA0237 (Accession NP_055562.1). Accordingly, utilities of GAM281 include diagnosis, prevention and treatment of diseases and clinical conditions associated with KIAA0237.

KIAA0258 (Accession NP_055600.1) is another GAM281 target gene, herein designated TARGET GENE. KIAA0258 BINDING SITE is a target binding site found in the 3' untranslated region of mRNA encoded by KIAA0258, corresponding to a target binding site such as BINDING SITE I, BINDING SITE II or BINDING SITE III of FIG. 8. Table 4 illustrates the complementarity of the nucleotide sequences of KIAA0258 BINDING SITE, designated SEQ ID:9416, to the nucleotide sequence of GAM281 RNA, herein designated GAM RNA, also designated SEQ ID:278.

Another function of GAM281 is therefore inhibition of KIAA0258 (Accession NP_055600.1). Accordingly, utilities of GAM281 include diagnosis, prevention and treatment of diseases and clinical conditions associated with KIAA0258.

KIAA0295 (Accession XP_042833.2) is another GAM281 target gene, herein designated TARGET GENE. KIAA0295 BINDING SITE is a target binding site found in the 3' untranslated region of mRNA encoded by KIAA0295, corresponding to a target binding site such as BINDING SITE I, BINDING SITE II or BINDING SITE III of FIG. 8. Table 4 illustrates the complementarity of the nucleotide sequences of KIAA0295 BINDING SITE, designated SEQ ID:10742, to the nucleotide sequence of GAM281 RNA, herein designated GAM RNA, also designated SEQ ID:278.

Another function of GAM281 is therefore inhibition of KIAA0295 (Accession XP_042833.2). Accordingly, utilities of GAM281 include diagnosis, prevention and treatment of diseases and clinical conditions associated with KIAA0295.

KIAA0318 (Accession XP_044334.1) is another GAM281 target gene, herein designated TARGET GENE. KIAA0318 BINDING SITE is a target binding site found in the 3' untranslated region of mRNA encoded by KIAA0318, corresponding to a target binding site such as BINDING SITE I, BINDING SITE II or BINDING SITE III of FIG. 8. Table 4 illustrates the complementarity of the nucleotide sequences of KIAA0318 BINDING SITE, designated SEQ ID:13450, to the nucleotide sequence of GAM281 RNA, herein designated GAM RNA, also designated SEQ ID:278.

Another function of GAM281 is therefore inhibition of KIAA0318 (Accession XP_044334.1). Accordingly, utilities of GAM281 include diagnosis, prevention and treatment of diseases and clinical conditions associated with KIAA0318.

KIAA0435 (Accession NP_055616.1) is another GAM281 target gene, herein designated TARGET GENE. KIAA0435 BINDING SITE is a target binding site found in the 5' untranslated region of mRNA encoded by KIAA0435, corresponding to a target binding site such as BINDING SITE I, BINDING SITE II or BINDING SITE III of FIG. 8. Table 4 illustrates the complementarity of the nucleotide sequences of KIAA0435 BINDING SITE, designated SEQ ID:5041, to the nucleotide sequence of GAM281 RNA, herein designated GAM RNA, also designated SEQ ID:278.

Another function of GAM281 is therefore inhibition of KIAA0435 (Accession NP_055616.1). Accordingly, utilities of GAM281 include diagnosis, prevention and treatment of diseases and clinical conditions associated with KIAA0435.

KIAA0446 (Accession XP_044155.1) is another GAM281 target gene, herein designated TARGET GENE. KIAA0446 BINDING SITE is a target binding site found in the 5' untranslated region of mRNA encoded by KIAA0446, corresponding to a target binding site such as BINDING SITE I, BINDING SITE II or BINDING SITE III of FIG. 8. Table 4 illustrates the complementarity of the nucleotide sequences of KIAA0446 BINDING SITE, designated SEQ ID:1475, to the nucleotide sequence of GAM281 RNA, herein designated GAM RNA, also designated SEQ ID:278.

Another function of GAM281 is therefore inhibition of KIAA0446 (Accession XP_044155.1). Accordingly, utilities of GAM281 include diagnosis, prevention and treatment of diseases and clinical conditions associated with KIAA0446.

KIAA0459 (Accession XP_027862.1) is another GAM281 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:4531, to the nucleotide sequence of GAM281 RNA, herein designated GAM RNA, also designated SEQ ID:278.

Another function of GAM281 is therefore inhibition of KIAA0459 (Accession XP_027862.1). Accordingly, utilities of GAM281 include diagnosis, prevention and treatment of diseases and clinical conditions associated with KIAA0459.

KIAA0469 (Accession NP_055666.1) is another GAM281 target gene, herein designated TARGET GENE.

KIAA0469 BINDING SITE1 and KIAA0469 BINDING SITE2 are target binding sites found in untranslated regions of mRNA encoded by KIAA0469, corresponding to target binding sites such as BINDING SITE I, BINDING SITE II or BINDING SITE III of FIG. 8. Table 4 illustrates the complementarity of the nucleotide sequences of KIAA0469 BINDING SITE1 and KIAA0469 BINDING SITE2, designated SEQ ID:9147 and SEQ ID:9493 respectively, to the nucleotide sequence of GAM281 RNA, herein designated GAM RNA, also designated SEQ ID:278.

Another function of GAM281 is therefore inhibition of KIAA0469 (Accession NP_055666.1). Accordingly, utilities of GAM281 include diagnosis, prevention and treatment of diseases and clinical conditions associated with KIAA0469.

KIAA0475 (Accession NP_055679.1) is another GAM281 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:16940, to the nucleotide sequence of GAM281 RNA, herein designated GAM RNA, also designated SEQ ID:278.

Another function of GAM281 is therefore inhibition of KIAA0475 (Accession NP_055679.1). Accordingly, utilities of GAM281 include diagnosis, prevention and treatment of diseases and clinical conditions associated with KIAA0475.

KIAA0493 (Accession XP_034717.1) is another GAM281 target gene, herein designated TARGET GENE. KIAA0493 BINDING SITE is a target binding site found in the 5' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:17206, to the nucleotide sequence of GAM281 RNA, herein designated GAM RNA, also designated SEQ ID:278.

Another function of GAM281 is therefore inhibition of KIAA0493 (Accession XP_034717.1). Accordingly, utilities of GAM281 include diagnosis, prevention and treatment of diseases and clinical conditions associated with KIAA0493.

KIAA0495 (Accession XP_031397.1) is another GAM281 target gene, herein designated TARGET GENE. KIAA0495 BINDING SITE is a target binding site found in the 3' untranslated region of mRNA encoded by KIAA0495, corresponding to a target binding site such as BINDING SITE I, BINDING SITE II or BINDING SITE III of FIG. 8. Table 4 illustrates the complementarity of the nucleotide sequences of KIAA0495 BINDING SITE, designated SEQ ID:14759, to the nucleotide sequence of GAM281 RNA, herein designated GAM RNA, also designated SEQ ID:278.

Another function of GAM281 is therefore inhibition of KIAA0495 (Accession XP_031397.1). Accordingly, utilities of GAM281 include diagnosis, prevention and treatment of diseases and clinical conditions associated with KIAA0495.

KIAA0513 (Accession NP_055547.1) is another GAM281 target gene, herein designated TARGET GENE. KIAA0513 BINDING SITE is a target binding site found in the 3' untranslated region of mRNA encoded by KIAA0513, corresponding to a target binding site such as BINDING SITE I, BINDING SITE II or BINDING SITE III of FIG. 8. Table 4 illustrates the complementarity of the nucleotide sequences of KIAA0513 BINDING SITE, designated SEQ ID:3931, to the nucleotide sequence of GAM281 RNA, herein designated GAM RNA, also designated SEQ ID:278.

Another function of GAM281 is therefore inhibition of KIAA0513 (Accession NP_055547.1). Accordingly, utilities of GAM281 include diagnosis, prevention and treatment of diseases and clinical conditions associated with KIAA0513.

KIAA0527 (Accession XP_171054.1) is another GAM281 target gene, herein designated TARGET GENE. KIAA0527 BINDING SITE is a target binding site found in the 3' untranslated region of mRNA encoded by KIAA0527, corresponding to a target binding site such as BINDING SITE I, BINDING SITE II or BINDING SITE III of FIG. 8. Table 4 illustrates the complementarity of the nucleotide sequences of KIAA0527 BINDING SITE, designated SEQ ID:19745, to the nucleotide sequence of GAM281 RNA, herein designated GAM RNA, also designated SEQ ID:278.

Another function of GAM281 is therefore inhibition of KIAA0527 (Accession XP_171054.1). Accordingly, utilities of GAM281 include diagnosis, prevention and treatment of diseases and clinical conditions associated with KIAA0527.

KIAA0532 (Accession XP_047659.6) is another GAM281 target gene, herein designated TARGET GENE. KIAA0532 BINDING SITE is a target binding site found in the 3' untranslated region of mRNA encoded by KIAA0532, corresponding to a target binding site such as BINDING SITE I, BINDING SITE II or BINDING SITE III of FIG. 8. Table 4 illustrates the complementarity of the nucleotide sequences of KIAA0532 BINDING SITE, designated SEQ ID:12455, to the nucleotide sequence of GAM281 RNA, herein designated GAM RNA, also designated SEQ ID:278.

Another function of GAM281 is therefore inhibition of KIAA0532 (Accession XP_047659.6). Accordingly, utilities of GAM281 include diagnosis, prevention and treatment of diseases and clinical conditions associated with KIAA0532.

KIAA0555 (Accession NP_055605.1) is another GAM281 target gene, herein designated TARGET GENE. KIAA0555 BINDING SITE is a target binding site found in the 3' untranslated region of mRNA encoded by KIAA0555, corresponding to a target binding site such as BINDING SITE I, BINDING SITE II or BINDING SITE III of FIG. 8. Table 4 illustrates the complementarity of the nucleotide sequences of KIAA0555 BINDING SITE, designated SEQ ID:5555, to the nucleotide sequence of GAM281 RNA, herein designated GAM RNA, also designated SEQ ID:278.

Another function of GAM281 is therefore inhibition of KIAA0555 (Accession NP_055605.1). Accordingly, utilities of GAM281 include diagnosis, prevention and treatment of diseases and clinical conditions associated with KIAA0555.

KIAA0557 (Accession XP_085507.1) is another GAM281 target gene, herein designated TARGET GENE. KIAA0557 BINDING SITE is a target binding site found in the 3' untranslated region of mRNA encoded by KIAA0557, corresponding to a target binding site such as BINDING SITE I, BINDING SITE II or BINDING SITE III of FIG. 8. Table 4 illustrates the complementarity of the nucleotide sequences of KIAA0557 BINDING SITE, designated SEQ ID:2234, to the nucleotide sequence of GAM281 RNA, herein designated GAM RNA, also designated SEQ ID:278.

Another function of GAM281 is therefore inhibition of KIAA0557 (Accession XP_085507.1). Accordingly, utilities of GAM281 include diagnosis, prevention and treatment of diseases and clinical conditions associated with KIAA0557.

KIAA0561 (Accession XP_038150.2) is another GAM281 target gene, herein designated TARGET GENE. KIAA0561 BINDING SITE is a target binding site found in the 3' untranslated region of mRNA encoded by KIAA0561, corresponding to a target binding site such as BINDING SITE I, BINDING SITE II or BINDING SITE III of FIG. 8. Table 4 illustrates the complementarity of the nucleotide sequences of KIAA0561 BINDING SITE, designated SEQ ID:9629, to the nucleotide sequence of GAM281 RNA, herein designated GAM RNA, also designated SEQ ID:278.

Another function of GAM281 is therefore inhibition of KIAA0561 (Accession XP_038150.2). Accordingly, utilities of GAM281 include diagnosis, prevention and treatment of diseases and clinical conditions associated with KIAA0561.

KIAA0562 (Accession NP_055519.1) is another GAM281 target gene, herein designated TARGET GENE. KIAA0562 BINDING SITE is a target binding site found in the 3' untranslated region of mRNA encoded by KIAA0562, corresponding to a target binding site such as BINDING SITE I, BINDING SITE II or BINDING SITE III of FIG. 8. Table 4 illustrates the complementarity of the nucleotide sequences of KIAA0562 BINDING SITE, designated SEQ ID:16544, to the nucleotide sequence of GAM281 RNA, herein designated GAM RNA, also designated SEQ ID:278.

Another function of GAM281 is therefore inhibition of KIAA0562 (Accession NP_055519.1). Accordingly, utilities of GAM281 include diagnosis, prevention and treatment of diseases and clinical conditions associated with KIAA0562.

KIAA0563 (Accession NP_055649.1) is another GAM281 target gene, herein designated TARGET GENE. KIAA0563 BINDING SITE is a target binding site found in the 5' untranslated region of mRNA encoded by KIAA0563, corresponding to a target binding site such as BINDING SITE I, BINDING SITE II or BINDING SITE III of FIG. 8. Table 4 illustrates the complementarity of the nucleotide sequences of KIAA0563 BINDING SITE, designated SEQ ID:16377, to the nucleotide sequence of GAM281 RNA, herein designated GAM RNA, also designated SEQ ID:278.

Another function of GAM281 is therefore inhibition of KIAA0563 (Accession NP_055649.1). Accordingly, utilities of GAM281 include diagnosis, prevention and treatment of diseases and clinical conditions associated with KIAA0563.

KIAA0682 (Accession NP_055667.1) is another GAM281 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:6522, to the nucleotide sequence of GAM281 RNA, herein designated GAM RNA, also designated SEQ ID:278.

Another function of GAM281 is therefore inhibition of KIAA0682 (Accession NP_055667.1). Accordingly, utilities of GAM281 include diagnosis, prevention and treatment of diseases and clinical conditions associated with KIAA0682.

KIAA0683 (Accession NP_057195.1) is another GAM281 target gene, herein designated TARGET GENE. KIAA0683 BINDING SITE is a target binding site found in the 3' untranslated region of mRNA encoded by KIAA0683, corresponding to a target binding site such as BINDING SITE I, BINDING SITE II or BINDING SITE III of FIG. 8. Table 4 illustrates the complementarity of the nucleotide sequences of KIAA0683 BINDING SITE, designated SEQ ID:18206, to the nucleotide sequence of GAM281 RNA, herein designated GAM RNA, also designated SEQ ID:278.

Another function of GAM281 is therefore inhibition of KIAA0683 (Accession NP_057195.1). Accordingly, utilities of GAM281 include diagnosis, prevention and treatment of diseases and clinical conditions associated with KIAA0683.

KIAA0831 (Accession NP_055739.1) is another GAM281 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:3260, to the nucleotide sequence of GAM281 RNA, herein designated GAM RNA, also designated SEQ ID:278.

Another function of GAM281 is therefore inhibition of KIAA0831 (Accession NP_055739.1). Accordingly, utilities of GAM281 include diagnosis, prevention and treatment of diseases and clinical conditions associated with KIAA0831.

KIAA0841 (Accession XP_049237.1) is another GAM281 target gene, herein designated TARGET GENE. KIAA0841 BINDING SITE1 and KIAA0841 BINDING SITE2 are target binding sites found in untranslated regions of mRNA encoded by KIAA0841, corresponding to target binding sites such as BINDING SITE I, BINDING SITE II or BINDING SITE III of FIG. 8. Table 4 illustrates the complementarity of the nucleotide sequences of KIAA0841 BINDING SITE1 and KIAA0841 BINDING SITE2, designated SEQ ID:8185 and SEQ ID:5490 respectively, to the nucleotide sequence of GAM281 RNA, herein designated GAM RNA, also designated SEQ ID:278.

Another function of GAM281 is therefore inhibition of KIAA0841 (Accession XP_049237.1). Accordingly, utilities of GAM281 include diagnosis, prevention and treatment of diseases and clinical conditions associated with KIAA0841.

KIAA0861 (Accession NP_055893.2) is another GAM281 target gene, herein designated TARGET GENE. KIAA0861 BINDING SITE is a target binding site found in the 3' untranslated region of mRNA encoded by KIAA0861, corresponding to a target binding site such as BINDING SITE I, BINDING SITE II or BINDING SITE III of FIG. 8. Table 4 illustrates the complementarity of the nucleotide sequences of KIAA0861 BINDING SITE, designated SEQ ID:2153, to the nucleotide sequence of GAM281 RNA, herein designated GAM RNA, also designated SEQ ID:278.

Another function of GAM281 is therefore inhibition of KIAA0861 (Accession NP_055893.2). Accordingly, utilities of GAM281 include diagnosis, prevention and treatment of diseases and clinical conditions associated with KIAA0861.

KIAA0889 (Accession NP_056192.1) is another GAM281 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:13271, to the nucleotide sequence of GAM281 RNA, herein designated GAM RNA, also designated SEQ ID:278.

Another function of GAM281 is therefore inhibition of KIAA0889 (Accession NP_056192.1). Accordingly, utilities of GAM281 include diagnosis, prevention and treatment of diseases and clinical conditions associated with KIAA0889.

KIAA0924 (Accession NP_055712.1) is another GAM281 target gene, herein designated TARGET GENE. KIAA0924 BINDING SITE1 and KIAA0924 BINDING SITE2 are target binding sites found in untranslated regions of mRNA encoded by KIAA0924, corresponding to target binding sites such as BINDING SITE I, BINDING SITE II or BINDING SITE III of FIG. 8. Table 4 illustrates the complementarity of the nucleotide sequences of KIAA0924 BINDING SITE1 and KIAA0924 BINDING SITE2, designated SEQ ID:13297 and SEQ ID:7655 respectively, to the nucleotide sequence of GAM281 RNA, herein designated GAM RNA, also designated SEQ ID:278.

Another function of GAM281 is therefore inhibition of KIAA0924 (Accession NP_055712.1). Accordingly, utilities of GAM281 include diagnosis, prevention and treatment of diseases and clinical conditions associated with KIAA0924.

KIAA0931 (Accession XP_041191.2) is another GAM281 target gene, herein designated TARGET GENE. KIAA0931 BINDING SITE is a target binding site found in the 3' untranslated region of mRNA encoded by KIAA0931, corresponding to a target binding site such as BINDING SITE I, BINDING SITE II or BINDING SITE III of FIG. 8. Table 4 illustrates the complementarity of the nucleotide sequences of KIAA0931 BINDING SITE, designated SEQ ID:14272, to the nucleotide sequence of GAM281 RNA, herein designated GAM RNA, also designated SEQ ID:278.

Another function of GAM281 is therefore inhibition of KIAA0931 (Accession XP_041191.2). Accordingly, utilities of GAM281 include diagnosis, prevention and treatment of diseases and clinical conditions associated with KIAA0931.

KIAA0935 (Accession XP_052620.6) is another GAM281 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:11958, to the nucleotide sequence of GAM281 RNA, herein designated GAM RNA, also designated SEQ ID:278.

Another function of GAM281 is therefore inhibition of KIAA0935 (Accession XP_052620.6). Accordingly, utilities of GAM281 include diagnosis, prevention and treatment of diseases and clinical conditions associated with KIAA0935.

KIAA0962 (Accession XP_290942.1) is another GAM281 target gene, herein designated TARGET GENE. KIAA0962 BINDING SITE is a target binding site found in the 3' untranslated region of mRNA encoded by KIAA0962, corresponding to a target binding site such as BINDING SITE I, BINDING SITE II or BINDING SITE III of FIG. 8. Table 4 illustrates the complementarity of the nucleotide sequences of KIAA0962 BINDING SITE, designated SEQ ID:8976, to the nucleotide sequence of GAM281 RNA, herein designated GAM RNA, also designated SEQ ID:278.

Another function of GAM281 is therefore inhibition of KIAA0962 (Accession XP_290942.1). Accordingly, utilities of GAM281 include diagnosis, prevention and treatment of diseases and clinical conditions associated with KIAA0962.

KIAA1002 (Accession XP_290584.1) is another GAM281 target gene, herein designated TARGET GENE. KIAA1002 BINDING SITE is a target binding site found in the 5' untranslated region of mRNA encoded by KIAA1002, corresponding to a target binding site such as BINDING SITE I, BINDING SITE II or BINDING SITE III of FIG. 8. Table 4 illustrates the complementarity of the nucleotide sequences of KIAA1002 BINDING SITE, designated SEQ ID:12518, to the nucleotide sequence of GAM281 RNA, herein designated GAM RNA, also designated SEQ ID:278.

Another function of GAM281 is therefore inhibition of KIAA1002 (Accession XP_290584.1). Accordingly, utilities of GAM281 include diagnosis, prevention and treatment of diseases and clinical conditions associated with KIAA1002.

KIAA1032 (Accession XP_038604.4) is another GAM281 target gene, herein designated TARGET GENE. KIAA1032 BINDING SITE is a target binding site found in the 3' untranslated region of mRNA encoded by KIAA1032, corresponding to a target binding site such as BINDING SITE I, BINDING SITE II or BINDING SITE III of FIG. 8. Table 4 illustrates the complementarity of the nucleotide sequences of KIAA1032 BINDING SITE, designated SEQ ID:1326, to the nucleotide sequence of GAM281 RNA, herein designated GAM RNA, also designated SEQ ID:278.

Another function of GAM281 is therefore inhibition of KIAA1032 (Accession XP_038604.4). Accordingly, utilities of GAM281 include diagnosis, prevention and treatment of diseases and clinical conditions associated with KIAA1032.

KIAA1040 (Accession XP_051091.3) is another GAM281 target gene, herein designated TARGET GENE. KIAA1040 BINDING SITE is a target binding site found in the 3' untranslated region of mRNA encoded by KIAA1040, corresponding to a target binding site such as BINDING SITE I, BINDING SITE II or BINDING SITE III of FIG. 8. Table 4 illustrates the complementarity of the nucleotide sequences of KIAA1040 BINDING SITE, designated SEQ ID:11846, to the nucleotide sequence of GAM281 RNA, herein designated GAM RNA, also designated SEQ ID:278.

Another function of GAM281 is therefore inhibition of KIAA1040 (Accession XP_051091.3). Accordingly, utilities of GAM281 include diagnosis, prevention and treatment of diseases and clinical conditions associated with KIAA1040.

KIAA1041 (Accession NP_055762.1) is another GAM281 target gene, herein designated TARGET GENE. KIAA1041 BINDING SITE is a target binding site found in the 3' untranslated region of mRNA encoded by KIAA1041, corresponding to a target binding site such as BINDING SITE I, BINDING SITE II or BINDING SITE III of FIG. 8. Table 4 illustrates the complementarity of the nucleotide sequences of KIAA1041 BINDING SITE, designated SEQ ID:3653, to the nucleotide sequence of GAM281 RNA, herein designated GAM RNA, also designated SEQ ID:278.

Another function of GAM281 is therefore inhibition of KIAA1041 (Accession NP_055762.1). Accordingly, utilities of GAM281 include diagnosis, prevention and treatment of diseases and clinical conditions associated with KIAA1041.

KIAA1052 (Accession NP_055771.1) is another GAM281 target gene, herein designated TARGET GENE. KIAA1052 BINDING SITE is a target binding site found in the 5' untranslated region of mRNA encoded by KIAA1052, corresponding to a target binding site such as BINDING SITE I, BINDING SITE II or BINDING SITE III of FIG. 8. Table 4 illustrates the complementarity of the nucleotide sequences of KIAA1052 BINDING SITE, designated SEQ ID:919, to the nucleotide sequence of GAM281 RNA, herein designated GAM RNA, also designated SEQ ID:278.

Another function of GAM281 is therefore inhibition of KIAA1052 (Accession NP_055771.1). Accordingly, utilities of GAM281 include diagnosis, prevention and treatment of diseases and clinical conditions associated with KIAA1052.

KIAA1054 (Accession XP_043493.5) is another GAM281 target gene, herein designated TARGET GENE. KIAA1054 BINDING SITE is a target binding site found in the 3' untranslated region of mRNA encoded by KIAA1054, corresponding to a target binding site such as BINDING SITE I, BINDING SITE II or BINDING SITE III of FIG. 8. Table 4 illustrates the complementarity of the nucleotide sequences of KIAA1054 BINDING SITE, designated SEQ ID:14832, to the nucleotide sequence of GAM281 RNA, herein designated GAM RNA, also designated SEQ ID:278.

Another function of GAM281 is therefore inhibition of KIAA1054 (Accession XP_043493.5). Accordingly, utilities of GAM281 include diagnosis, prevention and treatment of diseases and clinical conditions associated with KIAA1054.

KIAA1115 (Accession NP_055746.1) is another GAM281 target gene, herein designated TARGET GENE. KIAA1115 BINDING SITE is a target binding site found in the 3' untranslated region of mRNA encoded by KIAA1115, corresponding to a target binding site such as BINDING SITE I, BINDING SITE II or BINDING SITE III of FIG. 8. Table 4 illustrates the complementarity of the nucleotide sequences of KIAA1115 BINDING SITE, designated SEQ ID:9842, to the nucleotide sequence of GAM281 RNA, herein designated GAM RNA, also designated SEQ ID:278.

Another function of GAM281 is therefore inhibition of KIAA1115 (Accession NP_055746.1). Accordingly, utilities of GAM281 include diagnosis, prevention and treatment of diseases and clinical conditions associated with KIAA1115.

KIAA1126 (Accession XP_050325.1) is another GAM281 target gene, herein designated TARGET GENE. KIAA1126 BINDING SITE is a target binding site found in the 3' untranslated region of mRNA encoded by KIAA1126, corresponding to a target binding site such as BINDING SITE I, BINDING SITE II or BINDING SITE III of FIG. 8. Table 4 illustrates the complementarity of the nucleotide sequences of KIAA1126 BINDING SITE, designated SEQ ID:10583, to the nucleotide sequence of GAM281 RNA, herein designated GAM RNA, also designated SEQ ID:278.

Another function of GAM281 is therefore inhibition of KIAA1126 (Accession XP_050325.1). Accordingly, utilities of GAM281 include diagnosis, prevention and treatment of diseases and clinical conditions associated with KIAA1126.

KIAA1128 (Accession NP_061872.1) is another GAM281 target gene, herein designated TARGET GENE. KIAA1128 BINDING SITE is a target binding site found in the 3' untranslated region of mRNA encoded by KIAA1128, corresponding to a target binding site such as BINDING SITE I, BINDING SITE II or BINDING SITE III of FIG. 8. Table 4 illustrates the complementarity of the nucleotide sequences of KIAA1128 BINDING SITE, designated SEQ ID:5783, to the nucleotide sequence of GAM281 RNA, herein designated GAM RNA, also designated SEQ ID:278.

Another function of GAM281 is therefore inhibition of KIAA1128 (Accession NP_061872.1). Accordingly, utilities of GAM281 include diagnosis, prevention and treatment of diseases and clinical conditions associated with KIAA1128.

KIAA1143 (Accession XP_044014.1) is another GAM281 target gene, herein designated TARGET GENE. KIAA1143 BINDING SITE is a target binding site found in the 3' untranslated region of mRNA encoded by KIAA1143, corresponding to a target binding site such as BINDING SITE I, BINDING SITE II or BINDING SITE III of FIG. 8. Table 4 illustrates the complementarity of the nucleotide sequences of KIAA1143 BINDING SITE, designated SEQ ID:7385, to the nucleotide sequence of GAM281 RNA, herein designated GAM RNA, also designated SEQ ID:278.

Another function of GAM281 is therefore inhibition of KIAA1143 (Accession XP_044014.1). Accordingly, utilities of GAM281 include diagnosis, prevention and treatment of diseases and clinical conditions associated with KIAA1143.

KIAA1155 (Accession XP_030864.2) is another GAM281 target gene, herein designated TARGET GENE. KIAA1155 BINDING SITE is a target binding site found in the 3' untranslated region of mRNA encoded by KIAA1155, corresponding to a target binding site such as BINDING SITE I, BINDING SITE II or BINDING SITE III of FIG. 8. Table 4 illustrates the complementarity of the nucleotide sequences of KIAA1155 BINDING SITE, designated SEQ ID:2664, to the nucleotide sequence of GAM281 RNA, herein designated GAM RNA, also designated SEQ ID:278.

Another function of GAM281 is therefore inhibition of KIAA1155 (Accession XP_030864.2). Accordingly, utilities of GAM281 include diagnosis, prevention and treatment of diseases and clinical conditions associated with KIAA1155.

KIAA1170 (Accession XP_045907.2) is another GAM281 target gene, herein designated TARGET GENE. KIAA1170 BINDING SITE is a target binding site found in the 3' untranslated region of mRNA encoded by KIAA1170, corresponding to a target binding site such as BINDING SITE I, BINDING SITE II or BINDING SITE III of FIG. 8. Table 4 illustrates the complementarity of the nucleotide sequences of KIAA1170 BINDING SITE, designated SEQ ID:10162, to the nucleotide sequence of GAM281 RNA, herein designated GAM RNA, also designated SEQ ID:278.

Another function of GAM281 is therefore inhibition of KIAA1170 (Accession XP_045907.2). Accordingly, utilities of GAM281 include diagnosis, prevention and treatment of diseases and clinical conditions associated with KIAA1170.

KIAA1185 (Accession NP_065761.1) is another GAM281 target gene, herein designated TARGET GENE. KIAA1185 BINDING SITE is a target binding site found in the 3' untranslated region of mRNA encoded by KIAA1185, corresponding to a target binding site such as BINDING SITE I, BINDING SITE II or BINDING SITE III of FIG. 8. Table 4 illustrates the complementarity of the nucleotide sequences of KIAA1185 BINDING SITE, designated SEQ ID:5755, to the nucleotide sequence of GAM281 RNA, herein designated GAM RNA, also designated SEQ ID:278.

Another function of GAM281 is therefore inhibition of KIAA1185 (Accession NP_065761.1). Accordingly, utilities of GAM281 include diagnosis, prevention and treatment of diseases and clinical conditions associated with KIAA1185.

KIAA1193 (Accession XP_041843.1) is another GAM281 target gene, herein designated TARGET GENE.

KIAA1193 BINDING SITE is a target binding site found in the 3' untranslated region of mRNA encoded by KIAA1193, corresponding to a target binding site such as BINDING SITE I, BINDING SITE II or BINDING SITE III of FIG. 8. Table 4 illustrates the complementarity of the nucleotide sequences of KIAA1193 BINDING SITE, designated SEQ ID:17517, to the nucleotide sequence of GAM281 RNA, herein designated GAM RNA, also designated SEQ ID:278.

Another function of GAM281 is therefore inhibition of KIAA1193 (Accession XP_041843.1). Accordingly, utilities of GAM281 include diagnosis, prevention and treatment of diseases and clinical conditions associated with KIAA1193.

KIAA1198 (Accession NP_065765.1) is another GAM281 target gene, herein designated TARGET GENE. KIAA1198 BINDING SITE1 through KIAA1198 BINDING SITE5 are target binding sites found in untranslated regions of mRNA encoded by KIAA1198, corresponding to target binding sites such as BINDING SITE I, BINDING SITE II or BINDING SITE III of FIG. 8. Table 4 illustrates the complementarity of the nucleotide sequences of KIAA1198 BINDING SITE1 through KIAA1198 BINDING SITE5, designated SEQ ID:13749, SEQ ID:16088, SEQ ID:12389, SEQ ID:16471 and SEQ ID:12478 respectively, to the nucleotide sequence of GAM281 RNA, herein designated GAM RNA, also designated SEQ ID:278.

Another function of GAM281 is therefore inhibition of KIAA1198 (Accession NP_065765.1). Accordingly, utilities of GAM281 include diagnosis, prevention and treatment of diseases and clinical conditions associated with KIAA1198.

KIAA1210 (Accession XP_172801.1) is another GAM281 target gene, herein designated TARGET GENE. KIAA1210 BINDING SITE is a target binding site found in the 3' untranslated region of mRNA encoded by KIAA1210, corresponding to a target binding site such as BINDING SITE I, BINDING SITE II or BINDING SITE III of FIG. 8. Table 4 illustrates the complementarity of the nucleotide sequences of KIAA1210 BINDING SITE, designated SEQ ID:9144, to the nucleotide sequence of GAM281 RNA, herein designated GAM RNA, also designated SEQ ID:278.

Another function of GAM281 is therefore inhibition of KIAA1210 (Accession XP_172801.1). Accordingly, utilities of GAM281 include diagnosis, prevention and treatment of diseases and clinical conditions associated with KIAA1210.

KIAA1257 (Accession XP_031577.2) is another GAM281 target gene, herein designated TARGET GENE. KIAA1257 BINDING SITE1 through KIAA1257 BINDING SITE3 are target binding sites found in untranslated regions of mRNA encoded by KIAA1257, corresponding to target binding sites such as BINDING SITE I, BINDING SITE II or BINDING SITE III of FIG. 8. Table 4 illustrates the complementarity of the nucleotide sequences of KIAA1257 BINDING SITE1 through KIAA1257 BINDING SITE3, designated SEQ ID:8196, SEQ ID:11523 and SEQ ID:9032 respectively, to the nucleotide sequence of GAM281 RNA, herein designated GAM RNA, also designated SEQ ID:278.

Another function of GAM281 is therefore inhibition of KIAA1257 (Accession XP_031577.2). Accordingly, utilities of GAM281 include diagnosis, prevention and treatment of diseases and clinical conditions associated with KIAA1257.

KIAA1268 (Accession XP_291055.1) is another GAM281 target gene, herein designated TARGET GENE. KIAA1268 BINDING SITE is a target binding site found in the 3' untranslated region of mRNA encoded by KIAA1268, corresponding to a target binding site such as BINDING SITE I, BINDING SITE II or BINDING SITE III of FIG. 8. Table 4 illustrates the complementarity of the nucleotide sequences of KIAA1268 BINDING SITE, designated SEQ ID:3236, to the nucleotide sequence of GAM281 RNA, herein designated GAM RNA, also designated SEQ ID:278.

Another function of GAM281 is therefore inhibition of KIAA1268 (Accession XP_291055.1). Accordingly, utilities of GAM281 include diagnosis, prevention and treatment of diseases and clinical conditions associated with KIAA1268.

KIAA1273 (Accession XP_300760.1) is another GAM281 target gene, herein designated TARGET GENE. KIAA1273 BINDING SITE is a target binding site found in the 5' untranslated region of mRNA encoded by KIAA1273, corresponding to a target binding site such as BINDING SITE I, BINDING SITE II or BINDING SITE III of FIG. 8. Table 4 illustrates the complementarity of the nucleotide sequences of KIAA1273 BINDING SITE, designated SEQ ID:7374, to the nucleotide sequence of GAM281 RNA, herein designated GAM RNA, also designated SEQ ID:278.

Another function of GAM281 is therefore inhibition of KIAA1273 (Accession XP_300760.1). Accordingly, utilities of GAM281 include diagnosis, prevention and treatment of diseases and clinical conditions associated with KIAA1273.

KIAA1287 (Accession NP_065799.1) is another GAM281 target gene, herein designated TARGET GENE. KIAA1287 BINDING SITE is a target binding site found in the 3' untranslated region of mRNA encoded by KIAA1287, corresponding to a target binding site such as BINDING SITE I, BINDING SITE II or BINDING SITE III of FIG. 8. Table 4 illustrates the complementarity of the nucleotide sequences of KIAA1287 BINDING SITE, designated SEQ ID:9573, to the nucleotide sequence of GAM281 RNA, herein designated GAM RNA, also designated SEQ ID:278.

Another function of GAM281 is therefore inhibition of KIAA1287 (Accession NP_065799.1). Accordingly, utilities of GAM281 include diagnosis, prevention and treatment of diseases and clinical conditions associated with KIAA1287.

KIAA1393 (Accession XP_050793.2) is another GAM281 target gene, herein designated TARGET GENE. KIAA1393 BINDING SITE is a target binding site found in the 3' untranslated region of mRNA encoded by KIAA1393, corresponding to a target binding site such as BINDING SITE I, BINDING SITE II or BINDING SITE III of FIG. 8. Table 4 illustrates the complementarity of the nucleotide sequences of KIAA1393 BINDING SITE, designated SEQ ID:10123, to the nucleotide sequence of GAM281 RNA, herein designated GAM RNA, also designated SEQ ID:278.

Another function of GAM281 is therefore inhibition of KIAA1393 (Accession XP_050793.2). Accordingly, utilities of GAM281 include diagnosis, prevention and treatment of diseases and clinical conditions associated with KIAA1393.

KIAA1443 (Accession NP_065885.1) is another GAM281 target gene, herein designated TARGET GENE. KIAA1443 BINDING SITE is a target binding site found in the 3' untranslated region of mRNA encoded by KIAA1443, corresponding to a target binding site such as BINDING SITE I, BINDING SITE II or BINDING SITE III of FIG. 8. Table 4 illustrates the complementarity of the nucleotide sequences of KIAA1443 BINDING SITE, designated SEQ ID:15171, to the nucleotide sequence of GAM281 RNA, herein designated GAM RNA, also designated SEQ ID:278.

Another function of GAM281 is therefore inhibition of KIAA1443 (Accession NP_065885.1). Accordingly, utilities of GAM281 include diagnosis, prevention and treatment of diseases and clinical conditions associated with KIAA1443.

KIAA1456 (Accession XP_040100.3) is another GAM281 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:5529, to the nucleotide sequence of GAM281 RNA, herein designated GAM RNA, also designated SEQ ID:278.

Another function of GAM281 is therefore inhibition of KIAA1456 (Accession XP_040100.3). Accordingly, utilities of GAM281 include diagnosis, prevention and treatment of diseases and clinical conditions associated with KIAA1456.

KIAA1465 (Accession XP_027396.4) is another GAM281 target gene, herein designated TARGET GENE. KIAA1465 BINDING SITE1 and KIAA1465 BINDING SITE2 are target binding sites found in untranslated regions of mRNA encoded by KIAA1465, corresponding to target binding sites such as BINDING SITE I, BINDING SITE II or BINDING SITE III of FIG. 8. Table 4 illustrates the complementarity of the nucleotide sequences of KIAA1465 BINDING SITE1 and KIAA1465 BINDING SITE2, designated SEQ ID:18992 and SEQ ID:18838 respectively, to the nucleotide sequence of GAM281 RNA, herein designated GAM RNA, also designated SEQ ID:278.

Another function of GAM281 is therefore inhibition of KIAA1465 (Accession XP_027396.4). Accordingly, utilities of GAM281 include diagnosis, prevention and treatment of diseases and clinical conditions associated with KIAA1465.

KIAA1493 (Accession XP_034415.1) is another GAM281 target gene, herein designated TARGET GENE. KIAA1493 BINDING SITE is a target binding site found in the 3' untranslated region of mRNA encoded by KIAA1493, corresponding to a target binding site such as BINDING SITE I, BINDING SITE II or BINDING SITE III of FIG. 8. Table 4 illustrates the complementarity of the nucleotide sequences of KIAA1493 BINDING SITE, designated SEQ ID:15045, to the nucleotide sequence of GAM281 RNA, herein designated GAM RNA, also designated SEQ ID:278.

Another function of GAM281 is therefore inhibition of KIAA1493 (Accession XP_034415.1). Accordingly, utilities of GAM281 include diagnosis, prevention and treatment of diseases and clinical conditions associated with KIAA1493.

KIAA1508 (Accession XP_290952.1) is another GAM281 target gene, herein designated TARGET GENE. KIAA1508 BINDING SITE is a target binding site found in the 3' untranslated region of mRNA encoded by KIAA1508, corresponding to a target binding site such as BINDING SITE I, BINDING SITE II or BINDING SITE III of FIG. 8. Table 4 illustrates the complementarity of the nucleotide sequences of KIAA1508 BINDING SITE, designated SEQ ID:8820, to the nucleotide sequence of GAM281 RNA, herein designated GAM RNA, also designated SEQ ID:278.

Another function of GAM281 is therefore inhibition of KIAA1508 (Accession XP_290952.1). Accordingly, utilities of GAM281 include diagnosis, prevention and treatment of diseases and clinical conditions associated with KIAA1508.

KIAA1518 (Accession XP_170889.1) is another GAM281 target gene, herein designated TARGET GENE. KIAA1518 BINDING SITE is a target binding site found in the 3' untranslated region of multiple transcripts of mRNA encoded by KIAA1518, corresponding to a target binding site such as BINDING SITE I, BINDING SITE II or BINDING SITE III of FIG. 8. Table 4 illustrates the complementarity of the nucleotide sequences of KIAA1518 BINDING SITE, designated SEQ ID:13383, to the nucleotide sequence of GAM281 RNA, herein designated GAM RNA, also designated SEQ ID:278.

Another function of GAM281 is therefore inhibition of KIAA1518 (Accession XP_170889.1). Accordingly, utilities of GAM281 include diagnosis, prevention and treatment of diseases and clinical conditions associated with KIAA1518.

KIAA1530 (Accession XP_042661.5) is another GAM281 target gene, herein designated TARGET GENE. KIAA1530 BINDING SITE1 through KIAA1530 BINDING SITE3 are target binding sites found in untranslated regions of mRNA encoded by KIAA1530, corresponding to target binding sites such as BINDING SITE I, BINDING SITE II or BINDING SITE III of FIG. 8. Table 4 illustrates the complementarity of the nucleotide sequences of KIAA1530 BINDING SITE1 through KIAA1530 BINDING SITE3, designated SEQ ID:4028, SEQ ID:12345 and SEQ ID:15284 respectively, to the nucleotide sequence of GAM281 RNA, herein designated GAM RNA, also designated SEQ ID:278.

Another function of GAM281 is therefore inhibition of KIAA1530 (Accession XP_042661.5). Accordingly, utilities of GAM281 include diagnosis, prevention and treatment of diseases and clinical conditions associated with KIAA1530.

KIAA1550 (Accession XP_039393.3) is another GAM281 target gene, herein designated TARGET GENE. KIAA1550 BINDING SITE is a target binding site found in the 3' untranslated region of mRNA encoded by KIAA1550, corresponding to a target binding site such as BINDING SITE I, BINDING SITE II or BINDING SITE III of FIG. 8. Table 4 illustrates the complementarity of the nucleotide sequences of KIAA1550 BINDING SITE, designated SEQ ID:3790, to the nucleotide sequence of GAM281 RNA, herein designated GAM RNA, also designated SEQ ID:278.

Another function of GAM281 is therefore inhibition of KIAA1550 (Accession XP_039393.3). Accordingly, utilities of GAM281 include diagnosis, prevention and treatment of diseases and clinical conditions associated with KIAA1550.

KIAA1559 (Accession XP_054472.2) is another GAM281 target gene, herein designated TARGET GENE. KIAA1559 BINDING SITE is a target binding site found in the 3' untranslated region of mRNA encoded by KIAA1559, corresponding to a target binding site such as BINDING SITE I, BINDING SITE II or BINDING SITE III of FIG. 8. Table 4 illustrates the complementarity of the nucleotide sequences of KIAA1559 BINDING SITE, designated SEQ ID:4029, to the nucleotide sequence of GAM281 RNA, herein designated GAM RNA, also designated SEQ ID:278.

Another function of GAM281 is therefore inhibition of KIAA1559 (Accession XP_054472.2). Accordingly, utilities of GAM281 include diagnosis, prevention and treatment of diseases and clinical conditions associated with KIAA1559.

KIAA1571 (Accession XP_027744.1) is another GAM281 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:14154, to the nucleotide sequence of GAM281 RNA, herein designated GAM RNA, also designated SEQ ID:278.

Another function of GAM281 is therefore inhibition of KIAA1571 (Accession XP_027744.1). Accordingly, utilities of GAM281 include diagnosis, prevention and treatment of diseases and clinical conditions associated with KIAA1571.

KIAA1615 (Accession NP_066002.1) is another GAM281 target gene, herein designated TARGET GENE. KIAA1615 BINDING SITE1 and KIAA1615 BINDING SITE2 are target binding sites found in untranslated regions of mRNA encoded by KIAA1615, corresponding to target binding sites such as BINDING SITE I, BINDING SITE II or BINDING SITE III of FIG. 8. Table 4 illustrates the complementarity of the nucleotide sequences of KIAA1615 BINDING SITE1 and KIAA1615 BINDING SITE2, designated SEQ ID:8549 and SEQ ID:10111 respectively, to the nucleotide sequence of GAM281 RNA, herein designated GAM RNA, also designated SEQ ID:278.

Another function of GAM281 is therefore inhibition of KIAA1615 (Accession NP_066002.1). Accordingly, utilities of GAM281 include diagnosis, prevention and treatment of diseases and clinical conditions associated with KIAA1615.

KIAA1671 (Accession XP_037809.1) is another GAM281 target gene, herein designated TARGET GENE. KIAA1671 BINDING SITE1 and KIAA1671 BINDING SITE2 are target binding sites found in untranslated regions of mRNA encoded by KIAA1671, corresponding to target binding sites such as BINDING SITE I, BINDING SITE II or BINDING SITE III of FIG. 8. Table 4 illustrates the complementarity of the nucleotide sequences of KIAA1671 BINDING SITE1 and KIAA1671 BINDING SITE2, designated SEQ ID:7194 and SEQ ID:17191 respectively, to the nucleotide sequence of GAM281 RNA, herein designated GAM RNA, also designated SEQ ID:278.

Another function of GAM281 is therefore inhibition of KIAA1671 (Accession XP_037809.1). Accordingly, utilities of GAM281 include diagnosis, prevention and treatment of diseases and clinical conditions associated with KIAA1671.

KIAA1679 (Accession XP_046570.3) is another GAM281 target gene, herein designated TARGET GENE. KIAA1679 BINDING SITE is a target binding site found in the 3' untranslated region of mRNA encoded by KIAA1679, corresponding to a target binding site such as BINDING SITE I, BINDING SITE II or BINDING SITE III of FIG. 8. Table 4 illustrates the complementarity of the nucleotide sequences of KIAA1679 BINDING SITE, designated SEQ ID:5094, to the nucleotide sequence of GAM281 RNA, herein designated GAM RNA, also designated SEQ ID:278.

Another function of GAM281 is therefore inhibition of KIAA1679 (Accession XP_046570.3). Accordingly, utilities of GAM281 include diagnosis, prevention and treatment of diseases and clinical conditions associated with KIAA1679.

KIAA1712 (Accession XP_041497.2) is another GAM281 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:1142 and SEQ ID:14165 respectively, to the nucleotide sequence of GAM281 RNA, herein designated GAM RNA, also designated SEQ ID:278.

Another function of GAM281 is therefore inhibition of KIAA1712 (Accession XP_041497.2). Accordingly, utilities of GAM281 include diagnosis, prevention and treatment of diseases and clinical conditions associated with KIAA1712.

KIAA1712 (Accession NP_085136.1) is another GAM281 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:1142 and SEQ ID:14165 respectively, to the nucleotide sequence of GAM281 RNA, herein designated GAM RNA, also designated SEQ ID:278.

Another function of GAM281 is therefore inhibition of KIAA1712 (Accession NP_085136.1). Accordingly, utilities of GAM281 include diagnosis, prevention and treatment of diseases and clinical conditions associated with KIAA1712.

KIAA1724 (Accession XP_040280.2) is another GAM281 target gene, herein designated TARGET GENE. KIAA1724 BINDING SITE1 and KIAA1724 BINDING SITE2 are target binding sites found in untranslated regions of mRNA encoded by KIAA1724, corresponding to target binding sites such as BINDING SITE I, BINDING SITE II or BINDING SITE III of FIG. 8. Table 4 illustrates the complementarity of the nucleotide sequences of KIAA1724 BINDING SITE1 and KIAA1724 BINDING SITE2, designated SEQ ID:14630 and SEQ ID:15040 respectively, to the nucleotide sequence of GAM281 RNA, herein designated GAM RNA, also designated SEQ ID:278.

Another function of GAM281 is therefore inhibition of KIAA1724 (Accession XP_040280.2). Accordingly, utilities of GAM281 include diagnosis, prevention and treatment of diseases and clinical conditions associated with KIAA1724.

KIAA1737 (Accession NP_219494.1) is another GAM281 target gene, herein designated TARGET GENE. KIAA1737 BINDING SITE is a target binding site found in the 3' untranslated region of mRNA encoded by KIAA1737, corresponding to a target binding site such as BINDING SITE I, BINDING SITE II or BINDING SITE III of FIG. 8. Table 4 illustrates the complementarity of the nucleotide sequences of KIAA1737 BINDING SITE, designated SEQ ID:10602, to the nucleotide sequence of GAM281 RNA, herein designated GAM RNA, also designated SEQ ID:278.

Another function of GAM281 is therefore inhibition of KIAA1737 (Accession NP_219494.1). Accordingly, utilities of GAM281 include diagnosis, prevention and treatment of diseases and clinical conditions associated with KIAA1737.

KIAA1775 (Accession NP_149091.1) is another GAM281 target gene, herein designated TARGET GENE. KIAA1775 BINDING SITE1 and KIAA1775 BINDING SITE2 are target binding sites found in untranslated regions of mRNA encoded by KIAA1775, corresponding to target binding sites such as BINDING SITE I, BINDING SITE II or BINDING SITE III of FIG. 8. Table 4 illustrates the complementarity of the nucleotide sequences of KIAA1775 BIND- ING SITE1 and KIAA1775 BINDING SITE2, designated SEQ ID:17949 and SEQ ID:1618 respectively, to the nucleotide sequence of GAM281 RNA, herein designated GAM RNA, also designated SEQ ID:278.

Another function of GAM281 is therefore inhibition of KIAA1775 (Accession NP_149091.1). Accordingly, utilities of GAM281 include diagnosis, prevention and treatment of diseases and clinical conditions associated with KIAA1775.

KIAA1784 (Accession NP_115820.1) is another GAM281 target gene, herein designated TARGET GENE. KIAA1784 BINDING SITE is a target binding site found in the 3' untranslated region of mRNA encoded by KIAA1784, corresponding to a target binding site such as BINDING SITE I, BINDING SITE II or BINDING SITE III of FIG. 8. Table 4 illustrates the complementarity of the nucleotide sequences of KIAA1784 BINDING SITE, designated SEQ ID:11058, to the nucleotide sequence of GAM281 RNA, herein designated GAM RNA, also designated SEQ ID:278.

Another function of GAM281 is therefore inhibition of KIAA1784 (Accession NP_115820.1). Accordingly, utilities of GAM281 include diagnosis, prevention and treatment of diseases and clinical conditions associated with KIAA1784.

KIAA1822 (Accession XP_041566.2) is another GAM281 target gene, herein designated TARGET GENE. KIAA1822 BINDING SITE is a target binding site found in the 3' untranslated region of mRNA encoded by KIAA1822, corresponding to a target binding site such as BINDING SITE I, BINDING SITE II or BINDING SITE III of FIG. 8. Table 4 illustrates the complementarity of the nucleotide sequences of KIAA1822 BINDING SITE, designated SEQ ID:10095, to the nucleotide sequence of GAM281 RNA, herein designated GAM RNA, also designated SEQ ID:278.

Another function of GAM281 is therefore inhibition of KIAA1822 (Accession XP_041566.2). Accordingly, utilities of GAM281 include diagnosis, prevention and treatment of diseases and clinical conditions associated with KIAA1822.

KIAA1827 (Accession XP_290834.1) is another GAM281 target gene, herein designated TARGET GENE. KIAA1827 BINDING SITE1 and KIAA1827 BINDING SITE2 are target binding sites found in untranslated regions of mRNA encoded by KIAA1827, corresponding to target binding sites such as BINDING SITE I, BINDING SITE II or BINDING SITE III of FIG. 8. Table 4 illustrates the complementarity of the nucleotide sequences of KIAA1827 BINDING SITE1 and KIAA1827 BINDING SITE2, designated SEQ ID:2143 and SEQ ID:12636 respectively, to the nucleotide sequence of GAM281 RNA, herein designated GAM RNA, also designated SEQ ID:278.

Another function of GAM281 is therefore inhibition of KIAA1827 (Accession XP_290834.1). Accordingly, utilities of GAM281 include diagnosis, prevention and treatment of diseases and clinical conditions associated with KIAA1827.

KIAA1829 (Accession XP_030378.2) is another GAM281 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:14863, to the nucleotide sequence of GAM281 RNA, herein designated GAM RNA, also designated SEQ ID:278.

Another function of GAM281 is therefore inhibition of KIAA1829 (Accession XP_030378.2). Accordingly, utilities of GAM281 include diagnosis, prevention and treatment of diseases and clinical conditions associated with KIAA1829.

KIAA1836 (Accession XP_114087.2) is another GAM281 target gene, herein designated TARGET GENE. KIAA1836 BINDING SITE is a target binding site found in the 3' untranslated region of mRNA encoded by KIAA1836, corresponding to a target binding site such as BINDING SITE I, BINDING SITE II or BINDING SITE III of FIG. 8. Table 4 illustrates the complementarity of the nucleotide sequences of KIAA1836 BINDING SITE, designated SEQ ID:12627, to the nucleotide sequence of GAM281 RNA, herein designated GAM RNA, also designated SEQ ID:278.

Another function of GAM281 is therefore inhibition of KIAA1836 (Accession XP_114087.2). Accordingly, utilities of GAM281 include diagnosis, prevention and treatment of diseases and clinical conditions associated with KIAA1836.

KIAA1853 (Accession XP_045184.1) is another GAM281 target gene, herein designated TARGET GENE. KIAA1853 BINDING SITE is a target binding site found in the 3' untranslated region of mRNA encoded by KIAA1853, corresponding to a target binding site such as BINDING SITE I, BINDING SITE II or BINDING SITE III of FIG. 8. Table 4 illustrates the complementarity of the nucleotide sequences of KIAA1853 BINDING SITE, designated SEQ ID:19095, to the nucleotide sequence of GAM281 RNA, herein designated GAM RNA, also designated SEQ ID:278.

Another function of GAM281 is therefore inhibition of KIAA1853 (Accession XP_045184.1). Accordingly, utilities of GAM281 include diagnosis, prevention and treatment of diseases and clinical conditions associated with KIAA1853.

KIAA1862 (Accession XP_044212.4) is another GAM281 target gene, herein designated TARGET GENE. KIAA1862 BINDING SITE is a target binding site found in the 3' untranslated region of mRNA encoded by KIAA1862, corresponding to a target binding site such as BINDING SITE I, BINDING SITE II or BINDING SITE III of FIG. 8. Table 4 illustrates the complementarity of the nucleotide sequences of KIAA1862 BINDING SITE, designated SEQ ID:16627, to the nucleotide sequence of GAM281 RNA, herein designated GAM RNA, also designated SEQ ID:278.

Another function of GAM281 is therefore inhibition of KIAA1862 (Accession XP_044212.4). Accordingly, utilities of GAM281 include diagnosis, prevention and treatment of diseases and clinical conditions associated with KIAA1862.

KIAA1904 (Accession XP_056282.1) is another GAM281 target gene, herein designated TARGET GENE. KIAA1904 BINDING SITE is a target binding site found in the 3' untranslated region of mRNA encoded by KIAA1904, corresponding to a target binding site such as BINDING SITE I, BINDING SITE II or BINDING SITE III of FIG. 8. Table 4 illustrates the complementarity of the nucleotide sequences of KIAA1904 BINDING SITE, designated SEQ ID:16492, to the nucleotide sequence of GAM281 RNA, herein designated GAM RNA, also designated SEQ ID:278.

Another function of GAM281 is therefore inhibition of KIAA1904 (Accession XP_056282.1). Accordingly, utilities of GAM281 include diagnosis, prevention and treatment of diseases and clinical conditions associated with KIAA1904.

KIAA1922 (Accession XP_057040.1) is another GAM281 target gene, herein designated TARGET GENE.

KIAA1922 BINDING SITE is a target binding site found in the 5' untranslated region of mRNA encoded by KIAA1922, corresponding to a target binding site such as BINDING SITE I, BINDING SITE II or BINDING SITE III of FIG. 8. Table 4 illustrates the complementarity of the nucleotide sequences of KIAA1922 BINDING SITE, designated SEQ ID:7553, to the nucleotide sequence of GAM281 RNA, herein designated GAM RNA, also designated SEQ ID:278.

Another function of GAM281 is therefore inhibition of KIAA1922 (Accession XP_057040.1). Accordingly, utilities of GAM281 include diagnosis, prevention and treatment of diseases and clinical conditions associated with KIAA1922.

KIAA1924 (Accession NP_694971.2) is another GAM281 target gene, herein designated TARGET GENE. KIAA1924 BINDING SITE1 and KIAA1924 BINDING SITE2 are target binding sites found in untranslated regions of mRNA encoded by KIAA1924, corresponding to target binding sites such as BINDING SITE I, BINDING SITE II or BINDING SITE III of FIG. 8. Table 4 illustrates the complementarity of the nucleotide sequences of KIAA1924 BINDING SITE1 and KIAA1924 BINDING SITE2, designated SEQ ID:8341 and SEQ ID:1857 respectively, to the nucleotide sequence of GAM281 RNA, herein designated GAM RNA, also designated SEQ ID:278.

Another function of GAM281 is therefore inhibition of KIAA1924 (Accession NP_694971.2). Accordingly, utilities of GAM281 include diagnosis, prevention and treatment of diseases and clinical conditions associated with KIAA1924.

KIAA1937 (Accession XP_057107.3) is another GAM281 target gene, herein designated TARGET GENE. KIAA1937 BINDING SITE is a target binding site found in the 5' untranslated region of mRNA encoded by KIAA1937, corresponding to a target binding site such as BINDING SITE I, BINDING SITE II or BINDING SITE III of FIG. 8. Table 4 illustrates the complementarity of the nucleotide sequences of KIAA1937 BINDING SITE, designated SEQ ID:2983, to the nucleotide sequence of GAM281 RNA, herein designated GAM RNA, also designated SEQ ID:278.

Another function of GAM281 is therefore inhibition of KIAA1937 (Accession XP_057107.3). Accordingly, utilities of GAM281 include diagnosis, prevention and treatment of diseases and clinical conditions associated with KIAA1937.

KIAA1971 (Accession XP_058720.4) is another GAM281 target gene, herein designated TARGET GENE. KIAA1971 BINDING SITE1 through KIAA1971 BINDING SITE3 are target binding sites found in untranslated regions of mRNA encoded by KIAA1971, corresponding to target binding sites such as BINDING SITE I, BINDING SITE II or BINDING SITE III of FIG. 8. Table 4 illustrates the complementarity of the nucleotide sequences of KIAA1971 BINDING SITE1 through KIAA1971 BINDING SITE3, designated SEQ ID:11506, SEQ ID:6902 and SEQ ID:5820 respectively, to the nucleotide sequence of GAM281 RNA, herein designated GAM RNA, also designated SEQ ID:278.

Another function of GAM281 is therefore inhibition of KIAA1971 (Accession XP_058720.4). Accordingly, utilities of GAM281 include diagnosis, prevention and treatment of diseases and clinical conditions associated with KIAA1971.

KIAA1987 (Accession XP_113870.1) is another GAM281 target gene, herein designated TARGET GENE. KIAA1987 BINDING SITE is a target binding site found in the 5' untranslated region of mRNA encoded by KIAA1987, corresponding to a target binding site such as BINDING SITE I, BINDING SITE II or BINDING SITE III of FIG. 8. Table 4 illustrates the complementarity of the nucleotide sequences of KIAA1987 BINDING SITE, designated SEQ ID:7554, to the nucleotide sequence of GAM281 RNA, herein designated GAM RNA, also designated SEQ ID:278.

Another function of GAM281 is therefore inhibition of KIAA1987 (Accession XP_113870.1). Accordingly, utilities of GAM281 include diagnosis, prevention and treatment of diseases and clinical conditions associated with KIAA1987.

KIAA2028 (Accession XP_059415.2) is another GAM281 target gene, herein designated TARGET GENE. KIAA2028 BINDING SITE is a target binding site found in the 3' untranslated region of mRNA encoded by KIAA2028, corresponding to a target binding site such as BINDING SITE I, BINDING SITE II or BINDING SITE III of FIG. 8. Table 4 illustrates the complementarity of the nucleotide sequences of KIAA2028 BINDING SITE, designated SEQ ID:12100, to the nucleotide sequence of GAM281 RNA, herein designated GAM RNA, also designated SEQ ID:278.

Another function of GAM281 is therefore inhibition of KIAA2028 (Accession XP_059415.2). Accordingly, utilities of GAM281 include diagnosis, prevention and treatment of diseases and clinical conditions associated with KIAA2028.

KIF25 (Accession NP_005346.2) is another GAM281 target gene, herein designated TARGET GENE. KIF25 BINDING SITE is a target binding site found in the 5' untranslated region of multiple transcripts of mRNA encoded by KIF25, corresponding to a target binding site such as BINDING SITE I, BINDING SITE II or BINDING SITE III of FIG. 8. Table 4 illustrates the complementarity of the nucleotide sequences of KIF25 BINDING SITE, designated SEQ ID:17138, to the nucleotide sequence of GAM281 RNA, herein designated GAM RNA, also designated SEQ ID:278.

Another function of GAM281 is therefore inhibition of KIF25 (Accession NP_005346.2). Accordingly, utilities of GAM281 include diagnosis, prevention and treatment of diseases and clinical conditions associated with KIF25.

KIF25 (Accession NP_085118.1) is another GAM281 target gene, herein designated TARGET GENE. KIF25 BINDING SITE is a target binding site found in the 5' untranslated region of multiple transcripts of mRNA encoded by KIF25, corresponding to a target binding site such as BINDING SITE I, BINDING SITE II or BINDING SITE III of FIG. 8. Table 4 illustrates the complementarity of the nucleotide sequences of KIF25 BINDING SITE, designated SEQ ID:17138, to the nucleotide sequence of GAM281 RNA, herein designated GAM RNA, also designated SEQ ID:278.

Another function of GAM281 is therefore inhibition of KIF25 (Accession NP_085118.1). Accordingly, utilities of GAM281 include diagnosis, prevention and treatment of diseases and clinical conditions associated with KIF25.

KIP2 (Accession NP_006374.1) is another GAM281 target gene, herein designated TARGET GENE. KIP2 BINDING SITE is a target binding site found in the 3' untranslated region of mRNA encoded by KIP2, corresponding to a target binding site such as BINDING SITE I, BINDING SITE II or BINDING SITE III of FIG. 8. Table 4 illustrates the complementarity of the nucleotide sequences of KIP2 BINDING SITE, designated SEQ ID:4201, to the nucleotide sequence of GAM281 RNA, herein designated GAM RNA, also designated SEQ ID:278.

Another function of GAM281 is therefore inhibition of KIP2 (Accession NP_006374.1). Accordingly, utilities of GAM281 include diagnosis, prevention and treatment of diseases and clinical conditions associated with KIP2.

Kruppel-like factor 12 (KLF12, Accession NP_009180.3) is another GAM281 target gene, herein designated TARGET GENE. KLF12 BINDING SITE is a target binding site found in the 3' untranslated region of multiple transcripts of mRNA encoded by KLF12, corresponding to a target binding site such as BINDING SITE I, BINDING SITE II or BINDING SITE III of FIG. 8. Table 4 illustrates the complementarity of the nucleotide sequences of KLF12 BINDING SITE, designated SEQ ID:1127, to the nucleotide sequence of GAM281 RNA, herein designated GAM RNA, also designated SEQ ID:278.

Another function of GAM281 is therefore inhibition of Kruppel-like factor 12 (KLF12, Accession NP_009180.3). Accordingly, utilities of GAM281 include diagnosis, prevention and treatment of diseases and clinical conditions associated with KLF12.

Killer cell lectin-like receptor subfamily d, member 1 (KLRD1, Accession NP_002253.1) is another GAM281 target gene, herein designated TARGET GENE. KLRD1 BINDING SITE is a target binding site found in the 3' untranslated region of multiple transcripts of mRNA encoded by KLRD1, corresponding to a target binding site such as BINDING SITE I, BINDING SITE II or BINDING SITE III of FIG. 8. Table 4 illustrates the complementarity of the nucleotide sequences of KLRD1 BINDING SITE, designated SEQ ID:2353, to the nucleotide sequence of GAM281 RNA, herein designated GAM RNA, also designated SEQ ID:278.

Another function of GAM281 is therefore inhibition of Killer cell lectin-like receptor subfamily d, member 1 (KLRD1, Accession NP_002253.1), a gene which is a receptor for the recognition of mhc class i hla-e molecules by nk cells and some cytotoxic t-cells. Accordingly, utilities of GAM281 include diagnosis, prevention and treatment of diseases and clinical conditions associated with KLRD1.

The function of KLRD1 and its association with various diseases and clinical conditions, has been established by previous studies, as described hereinabove with reference to GAM189.1. Killer cell lectin-like receptor subfamily d, member 1 (KLRD1, Accession NP_031360.1) is another GAM281 target gene, herein designated TARGET GENE. KLRD1 BINDING SITE is a target binding site found in the 3' untranslated region of multiple transcripts of mRNA encoded by KLRD1, corresponding to a target binding site such as BINDING SITE I, BINDING SITE II or BINDING SITE III of FIG. 8. Table 4 illustrates the complementarity of the nucleotide sequences of KLRD1 BINDING SITE, designated SEQ ID:2353, to the nucleotide sequence of GAM281 RNA, herein designated GAM RNA, also designated SEQ ID:278.

Another function of GAM281 is therefore inhibition of Killer cell lectin-like receptor subfamily d, member 1 (KLRD1, Accession NP_031360.1), a gene which is a receptor for the recognition of mhc class i hla-e molecules by nk cells and some cytotoxic t-cells. Accordingly, utilities of GAM281 include diagnosis, prevention and treatment of diseases and clinical conditions associated with KLRD1.

The function of KLRD1 and its association with various diseases and clinical conditions, has been established by previous studies, as described hereinabove with reference to GAM189.1. Kynurenine 3-monooxygenase (kynurenine 3-hydroxylase) (KMO, Accession NP_003670.1) is another GAM281 target gene, herein designated TARGET GENE. KMO BINDING SITE is a target binding site found in the 3' untranslated region of mRNA encoded by KMO, corresponding to a target binding site such as BINDING SITE I, BINDING SITE II or BINDING SITE III of FIG. 8. Table 4 illustrates the complementarity of the nucleotide sequences of KMO BINDING SITE, designated SEQ ID:6338, to the nucleotide sequence of GAM281 RNA, herein designated GAM RNA, also designated SEQ ID:278.

Another function of GAM281 is therefore inhibition of Kynurenine 3-monooxygenase (kynurenine 3-hydroxylase) (KMO, Accession NP_003670.1), a gene which may play a role in encephalic photoreception. Accordingly, utilities of GAM281 include diagnosis, prevention and treatment of diseases and clinical conditions associated with KMO.

The function of KMO and its association with various diseases and clinical conditions, has been established by previous studies, as described hereinabove with reference to GAM30.1. Lysosomal-associated membrane protein 3 (LAMP3, Accession NP_055213.1) is another GAM281 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:17760, to the nucleotide sequence of GAM281 RNA, herein designated GAM RNA, also designated SEQ ID:278.

Another function of GAM281 is therefore inhibition of Lysosomal-associated membrane protein 3 (LAMP3, Accession NP_055213.1). Accordingly, utilities of GAM281 include diagnosis, prevention and treatment of diseases and clinical conditions associated with LAMP3.

Lipocalin 7 (LCN7, Accession NP_071447.1) is another GAM281 target gene, herein designated TARGET GENE. LCN7 BINDING SITE is a target binding site found in the 3' untranslated region of mRNA encoded by LCN7, corresponding to a target binding site such as BINDING SITE I, BINDING SITE II or BINDING SITE III of FIG. 8. Table 4 illustrates the complementarity of the nucleotide sequences of LCN7 BINDING SITE, designated SEQ ID:15937, to the nucleotide sequence of GAM281 RNA, herein designated GAM RNA, also designated SEQ ID:278.

Another function of GAM281 is therefore inhibition of Lipocalin 7 (LCN7, Accession NP_071447.1). Accordingly, utilities of GAM281 include diagnosis, prevention and treatment of diseases and clinical conditions associated with LCN7.

LCX (Accession XP_167612.2) is another GAM281 target gene, herein designated TARGET GENE. LCX BINDING SITE is a target binding site found in the 3' untranslated region of mRNA encoded by LCX, corresponding to a target binding site such as BINDING SITE I, BINDING SITE II or BINDING SITE III of FIG. 8. Table 4 illustrates the complementarity of the nucleotide sequences of LCX BINDING SITE, designated SEQ ID:2891, to the nucleotide sequence of GAM281 RNA, herein designated GAM RNA, also designated SEQ ID:278.

Another function of GAM281 is therefore inhibition of LCX (Accession XP_167612.2). Accordingly, utilities of GAM281 include diagnosis, prevention and treatment of diseases and clinical conditions associated with LCX.

Leptin receptor overlapping transcript-like 1 (LEPROTL1, Accession NP_056159.1) is another GAM281 target gene, herein designated TARGET GENE. LEPROTL1 BINDING SITE is a target binding site found in the 3' untranslated region of mRNA encoded by LEPROTL1, corresponding to a target binding site such as BINDING SITE I, BINDING SITE II or BINDING SITE III of FIG. 8. Table 4 illustrates the complementarity of the nucleotide sequences of LEPROTL1

BINDING SITE, designated SEQ ID:1871, to the nucleotide sequence of GAM281 RNA, herein designated GAM RNA, also designated SEQ ID:278.

Another function of GAM281 is therefore inhibition of Leptin receptor overlapping transcript-like 1 (LEPROTL1, Accession NP_056159.1). Accordingly, utilities of GAM281 include diagnosis, prevention and treatment of diseases and clinical conditions associated with LEPROTL1.

Leucine zipper-ef-hand containing transmembrane protein 1 (LETM1, Accession NP_036450.1) is another GAM281 target gene, herein designated TARGET GENE. LETM1 BINDING SITE is a target binding site found in the 3' untranslated region of mRNA encoded by LETM1, corresponding to a target binding site such as BINDING SITE I, BINDING SITE II or BINDING SITE III of FIG. 8. Table 4 illustrates the complementarity of the nucleotide sequences of LETM1 BINDING SITE, designated SEQ ID:18695, to the nucleotide sequence of GAM281 RNA, herein designated GAM RNA, also designated SEQ ID:278.

Another function of GAM281 is therefore inhibition of Leucine zipper-ef-hand containing transmembrane protein 1 (LETM1, Accession NP_036450.1). Accordingly, utilities of GAM281 include diagnosis, prevention and treatment of diseases and clinical conditions associated with LETM1.

LGP1 (Accession NP_115873.1) is another GAM281 target gene, herein designated TARGET GENE. LGP1 BINDING SITE is a target binding site found in the 5' untranslated region of mRNA encoded by LGP1, corresponding to a target binding site such as BINDING SITE I, BINDING SITE II or BINDING SITE III of FIG. 8. Table 4 illustrates the complementarity of the nucleotide sequences of LGP1 BINDING SITE, designated SEQ ID:16610, to the nucleotide sequence of GAM281 RNA, herein designated GAM RNA, also designated SEQ ID:278.

Another function of GAM281 is therefore inhibition of LGP1 (Accession NP_115873.1). Accordingly, utilities of GAM281 include diagnosis, prevention and treatment of diseases and clinical conditions associated with LGP1.

LGP2 (Accession NP_077024.1) is another GAM281 target gene, herein designated TARGET GENE. LGP2 BINDING SITE is a target binding site found in the 5' untranslated region of mRNA encoded by LGP2, corresponding to a target binding site such as BINDING SITE I, BINDING SITE II or BINDING SITE III of FIG. 8. Table 4 illustrates the complementarity of the nucleotide sequences of LGP2 BINDING SITE, designated SEQ ID:8032, to the nucleotide sequence of GAM281 RNA, herein designated GAM RNA, also designated SEQ ID:278.

Another function of GAM281 is therefore inhibition of LGP2 (Accession NP_077024.1). Accordingly, utilities of GAM281 include diagnosis, prevention and treatment of diseases and clinical conditions associated with LGP2.

LIN-28 (Accession NP_078950.1) is another GAM281 target gene, herein designated TARGET GENE. LIN-28 BINDING SITE is a target binding site found in the 3' untranslated region of mRNA encoded by LIN-28, corresponding to a target binding site such as BINDING SITE I, BINDING SITE II or BINDING SITE III of FIG. 8. Table 4 illustrates the complementarity of the nucleotide sequences of LIN-28 BINDING SITE, designated SEQ ID:4726, to the nucleotide sequence of GAM281 RNA, herein designated GAM RNA, also designated SEQ ID:278.

Another function of GAM281 is therefore inhibition of LIN-28 (Accession NP_078950.1). Accordingly, utilities of GAM281 include diagnosis, prevention and treatment of diseases and clinical conditions associated with LIN-28.

Link-GEFII (Accession NP_057423.1) is another GAM281 target gene, herein designated TARGET GENE. Link-GEFII BINDING SITE is a target binding site found in the 3' untranslated region of mRNA encoded by Link-GEFII, corresponding to a target binding site such as BINDING SITE I, BINDING SITE II or BINDING SITE III of FIG. 8. Table 4 illustrates the complementarity of the nucleotide sequences of Link-GEFII BINDING SITE, designated SEQ ID:19936, to the nucleotide sequence of GAM281 RNA, herein designated GAM RNA, also designated SEQ ID:278.

Another function of GAM281 is therefore inhibition of Link-GEFII (Accession NP_057423.1). Accordingly, utilities of GAM281 include diagnosis, prevention and treatment of diseases and clinical conditions associated with Link-GEFII.

Lipase, member h (LIPH, Accession NP_640341.1) is another GAM281 target gene, herein designated TARGET GENE. LIPH BINDING SITE is a target binding site found in the 3' untranslated region of mRNA encoded by LIPH, corresponding to a target binding site such as BINDING SITE I, BINDING SITE II or BINDING SITE III of FIG. 8. Table 4 illustrates the complementarity of the nucleotide sequences of LIPH BINDING SITE, designated SEQ ID:10379, to the nucleotide sequence of GAM281 RNA, herein designated GAM RNA, also designated SEQ ID:278.

Another function of GAM281 is therefore inhibition of Lipase, member h (LIPH, Accession NP_640341.1). Accordingly, utilities of GAM281 include diagnosis, prevention and treatment of diseases and clinical conditions associated with LIPH.

LNK (Accession NP_005466.1) is another GAM281 target gene, herein designated TARGET GENE. LNK BINDING SITE is a target binding site found in the 3' untranslated region of mRNA encoded by LNK, corresponding to a target binding site such as BINDING SITE I, BINDING SITE II or BINDING SITE III of FIG. 8. Table 4 illustrates the complementarity of the nucleotide sequences of LNK BINDING SITE, designated SEQ ID:13992, to the nucleotide sequence of GAM281 RNA, herein designated GAM RNA, also designated SEQ ID:278.

Another function of GAM281 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM281 include diagnosis, prevention and treatment of diseases and clinical conditions associated with LNK.

The function of LNK and its association with various diseases and clinical conditions, has been established by previous studies, as described hereinabove with reference to GAM130.1. LOC112687 (Accession XP_053145.1) is another GAM281 target gene, herein designated TARGET GENE. LOC112687 BINDING SITE is a target binding site found in the 3' untranslated region of mRNA encoded by LOC112687, corresponding to a target binding site such as BINDING SITE I, BINDING SITE II or BINDING SITE III of FIG. 8. Table 4 illustrates the complementarity of the nucleotide sequences of LOC112687 BINDING SITE, designated SEQ ID:16673, to the nucleotide sequence of GAM281 RNA, herein designated GAM RNA, also designated SEQ ID:278.

Another function of GAM281 is therefore inhibition of LOC112687 (Accession XP_053145.1). Accordingly, utilities of GAM281 include diagnosis, prevention and treatment of diseases and clinical conditions associated with LOC112687.

LOC112817 (Accession NP_612422.2) is another GAM281 target gene, herein designated TARGET GENE. LOC112817 BINDING SITE is a target binding site found in the 3' untranslated region of mRNA encoded by LOC112817, corresponding to a target binding site such as BINDING SITE I, BINDING SITE II or BINDING SITE III of FIG. 8. Table 4 illustrates the complementarity of the nucleotide sequences of LOC112817 BINDING SITE, designated SEQ ID:16256, to the nucleotide sequence of GAM281 RNA, herein designated GAM RNA, also designated SEQ ID:278.

Another function of GAM281 is therefore inhibition of LOC112817 (Accession NP_612422.2). Accordingly, utilities of GAM281 include diagnosis, prevention and treatment of diseases and clinical conditions associated with LOC112817.

LOC112868 (Accession XP_053402.1) is another GAM281 target gene, herein designated TARGET GENE. LOC112868 BINDING SITE is a target binding site found in the 5' untranslated region of mRNA encoded by LOC112868, corresponding to a target binding site such as BINDING SITE I, BINDING SITE II or BINDING SITE III of FIG. 8. Table 4 illustrates the complementarity of the nucleotide sequences of LOC112868 BINDING SITE, designated SEQ ID:12772, to the nucleotide sequence of GAM281 RNA, herein designated GAM RNA, also designated SEQ ID:278.

Another function of GAM281 is therefore inhibition of LOC112868 (Accession XP_053402.1). Accordingly, utilities of GAM281 include diagnosis, prevention and treatment of diseases and clinical conditions associated with LOC112868.

LOC113444 (Accession NP_612437.2) is another GAM281 target gene, herein designated TARGET GENE. LOC113444 BINDING SITE1 through LOC113444 BINDING SITE3 are target binding sites found in untranslated regions of mRNA encoded by LOC113444, corresponding to target binding sites such as BINDING SITE I, BINDING SITE II or BINDING SITE III of FIG. 8. Table 4 illustrates the complementarity of the nucleotide sequences of LOC113444 BINDING SITE1 through LOC113444 BINDING SITE3, designated SEQ ID:15899, SEQ ID:5336 and SEQ ID:18294 respectively, to the nucleotide sequence of GAM281 RNA, herein designated GAM RNA, also designated SEQ ID:278.

Another function of GAM281 is therefore inhibition of LOC113444 (Accession NP_612437.2). Accordingly, utilities of GAM281 include diagnosis, prevention and treatment of diseases and clinical conditions associated with LOC113444.

LOC113828 (Accession NP_612444.1) is another GAM281 target gene, herein designated TARGET GENE. LOC113828 BINDING SITE is a target binding site found in the 5' untranslated region of mRNA encoded by LOC113828, corresponding to a target binding site such as BINDING SITE I, BINDING SITE II or BINDING SITE III of FIG. 8. Table 4 illustrates the complementarity of the nucleotide sequences of LOC113828 BINDING SITE, designated SEQ ID:5632, to the nucleotide sequence of GAM281 RNA, herein designated GAM RNA, also designated SEQ ID:278.

Another function of GAM281 is therefore inhibition of LOC113828 (Accession NP_612444.1). Accordingly, utilities of GAM281 include diagnosis, prevention and treatment of diseases and clinical conditions associated with LOC113828.

LOC115123 (Accession XP_055276.1) is another GAM281 target gene, herein designated TARGET GENE. LOC115123 BINDING SITE is a target binding site found in the 5' untranslated region of mRNA encoded by LOC115123, corresponding to a target binding site such as BINDING SITE I, BINDING SITE II or BINDING SITE III of FIG. 8. Table 4 illustrates the complementarity of the nucleotide sequences of LOC115123 BINDING SITE, designated SEQ ID:15271, to the nucleotide sequence of GAM281 RNA, herein designated GAM RNA, also designated SEQ ID:278.

Another function of GAM281 is therefore inhibition of LOC115123 (Accession XP_055276.1). Accordingly, utilities of GAM281 include diagnosis, prevention and treatment of diseases and clinical conditions associated with LOC115123.

LOC115219 (Accession XP_055499.2) is another GAM281 target gene, herein designated TARGET GENE. LOC115219 BINDING SITE is a target binding site found in the 5' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:12422, to the nucleotide sequence of GAM281 RNA, herein designated GAM RNA, also designated SEQ ID:278.

Another function of GAM281 is therefore inhibition of LOC115219 (Accession XP_055499.2). Accordingly, utilities of GAM281 include diagnosis, prevention and treatment of diseases and clinical conditions associated with LOC115219.

LOC115648 (Accession NP_663299.1) is another GAM281 target gene, herein designated TARGET GENE. LOC115648 BINDING SITE is a target binding site found in the 3' untranslated region of mRNA encoded by LOC115648, corresponding to a target binding site such as BINDING SITE I, BINDING SITE II or BINDING SITE III of FIG. 8. Table 4 illustrates the complementarity of the nucleotide sequences of LOC115648 BINDING SITE, designated SEQ ID:7429, to the nucleotide sequence of GAM281 RNA, herein designated GAM RNA, also designated SEQ ID:278.

Another function of GAM281 is therefore inhibition of LOC115648 (Accession NP_663299.1). Accordingly, utilities of GAM281 include diagnosis, prevention and treatment of diseases and clinical conditions associated with LOC115648.

LOC116411 (Accession XP_058095.1) is another GAM281 target gene, herein designated TARGET GENE. LOC116411 BINDING SITE is a target binding site found in the 5' untranslated region of mRNA encoded by LOC116411, corresponding to a target binding site such as BINDING SITE I, BINDING SITE II or BINDING SITE III of FIG. 8. Table 4 illustrates the complementarity of the nucleotide sequences of LOC116411 BINDING SITE, designated SEQ ID:14720, to the nucleotide sequence of GAM281 RNA, herein designated GAM RNA, also designated SEQ ID:278.

Another function of GAM281 is therefore inhibition of LOC116411 (Accession XP_058095.1). Accordingly, utilities of GAM281 include diagnosis, prevention and treatment of diseases and clinical conditions associated with LOC116411.

LOC118490 (Accession XP_060981.3) is another GAM281 target gene, herein designated TARGET GENE. LOC118490 BINDING SITE is a target binding site found in the 3' untranslated region of mRNA encoded by LOC118490, corresponding to a target binding site such as BINDING SITE I, BINDING SITE II or BINDING SITE III of FIG. 8. Table 4 illustrates the complementarity of the nucleotide sequences of LOC118490 BINDING SITE, designated SEQ ID:456, to the nucleotide sequence of GAM281 RNA, herein designated GAM RNA, also designated SEQ ID:278.

Another function of GAM281 is therefore inhibition of LOC118490 (Accession XP_060981.3). Accordingly, utilities of GAM281 include diagnosis, prevention and treatment of diseases and clinical conditions associated with LOC118490.

LOC118812 (Accession NP_849154.1) is another GAM281 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:2649, to the nucleotide sequence of GAM281 RNA, herein designated GAM RNA, also designated SEQ ID:278.

Another function of GAM281 is therefore inhibition of LOC118812 (Accession NP_849154.1). Accordingly, utilities of GAM281 include diagnosis, prevention and treatment of diseases and clinical conditions associated with LOC118812.

LOC118812 (Accession XP_058346.2) is another GAM281 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:2649, to the nucleotide sequence of GAM281 RNA, herein designated GAM RNA, also designated SEQ ID:278.

Another function of GAM281 is therefore inhibition of LOC118812 (Accession XP_058346.2). Accordingly, utilities of GAM281 include diagnosis, prevention and treatment of diseases and clinical conditions associated with LOC118812.

LOC120526 (Accession XP_058475.1) is another GAM281 target gene, herein designated TARGET GENE. LOC120526 BINDING SITE is a target binding site found in the 3' untranslated region of mRNA encoded by LOC120526, corresponding to a target binding site such as BINDING SITE I, BINDING SITE II or BINDING SITE III of FIG. 8. Table 4 illustrates the complementarity of the nucleotide sequences of LOC120526 BINDING SITE, designated SEQ ID:17112, to the nucleotide sequence of GAM281 RNA, herein designated GAM RNA, also designated SEQ ID:278.

Another function of GAM281 is therefore inhibition of LOC120526 (Accession XP_058475.1). Accordingly, utilities of GAM281 include diagnosis, prevention and treatment of diseases and clinical conditions associated with LOC120526.

LOC121952 (Accession XP_062872.2) is another GAM281 target gene, herein designated TARGET GENE. LOC121952 BINDING SITE is a target binding site found in the 5' untranslated region of mRNA encoded by LOC121952, corresponding to a target binding site such as BINDING SITE I, BINDING SITE II or BINDING SITE III of FIG. 8. Table 4 illustrates the complementarity of the nucleotide sequences of LOC121952 BINDING SITE, designated SEQ ID:9891, to the nucleotide sequence of GAM281 RNA, herein designated GAM RNA, also designated SEQ ID:278.

Another function of GAM281 is therefore inhibition of LOC121952 (Accession XP_062872.2). Accordingly, utilities of GAM281 include diagnosis, prevention and treatment of diseases and clinical conditions associated with LOC121952.

LOC124221 (Accession XP_058785.3) is another GAM281 target gene, herein designated TARGET GENE. LOC124221 BINDING SITE is a target binding site found in the 5' untranslated region of mRNA encoded by LOC124221, corresponding to a target binding site such as BINDING SITE I, BINDING SITE II or BINDING SITE III of FIG. 8. Table 4 illustrates the complementarity of the nucleotide sequences of LOC124221 BINDING SITE, designated SEQ ID:14576, to the nucleotide sequence of GAM281 RNA, herein designated GAM RNA, also designated SEQ ID:278.

Another function of GAM281 is therefore inhibition of LOC124221 (Accession XP_058785.3). Accordingly, utilities of GAM281 include diagnosis, prevention and treatment of diseases and clinical conditions associated with LOC124221.

LOC125061 (Accession XP_058889.3) is another GAM281 target gene, herein designated TARGET GENE. LOC125061 BINDING SITE is a target binding site found in the 3' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:1744, to the nucleotide sequence of GAM281 RNA, herein designated GAM RNA, also designated SEQ ID:278.

Another function of GAM281 is therefore inhibition of LOC125061 (Accession XP_058889.3). Accordingly, utilities of GAM281 include diagnosis, prevention and treatment of diseases and clinical conditions associated with LOC125061.

LOC126669 (Accession XP_060121.4) is another GAM281 target gene, herein designated TARGET GENE. LOC126669 BINDING SITE1 and LOC126669 BINDING SITE2 are target binding sites found in untranslated regions of mRNA encoded by LOC126669, corresponding to target binding sites such as BINDING SITE I, BINDING SITE II or BINDING SITE III of FIG. 8. Table 4 illustrates the complementarity of the nucleotide sequences of LOC126669 BINDING SITE1 and LOC126669 BINDING SITE2, designated SEQ ID:17906 and SEQ ID:3477 respectively, to the nucleotide sequence of GAM281 RNA, herein designated GAM RNA, also designated SEQ ID:278.

Another function of GAM281 is therefore inhibition of LOC126669 (Accession XP_060121.4). Accordingly, utilities of GAM281 include diagnosis, prevention and treatment of diseases and clinical conditions associated with LOC126669.

LOC127253 (Accession XP_059122.1) is another GAM281 target gene, herein designated TARGET GENE. LOC127253 BINDING SITE is a target binding site found in the 3' untranslated region of mRNA encoded by LOC127253, corresponding to a target binding site such as BINDING SITE I, BINDING SITE II or BINDING SITE III of FIG. 8. Table 4 illustrates the complementarity of the nucleotide sequences of LOC127253 BINDING SITE, designated SEQ ID:18918, to the nucleotide sequence of GAM281 RNA, herein designated GAM RNA, also designated SEQ ID:278.

Another function of GAM281 is therefore inhibition of LOC127253 (Accession XP_059122.1). Accordingly, utilities of GAM281 include diagnosis, prevention and treatment of diseases and clinical conditions associated with LOC127253.

LOC127841 (Accession XP_059184.1) is another GAM281 target gene, herein designated TARGET GENE. LOC127841 BINDING SITE is a target binding site found in the 5' untranslated region of mRNA encoded by LOC127841, corresponding to a target binding site such as BINDING SITE I, BINDING SITE II or BINDING SITE III of FIG. 8. Table 4 illustrates the complementarity of the nucleotide sequences of LOC127841 BINDING SITE, designated SEQ ID:18516, to the nucleotide sequence of GAM281 RNA, herein designated GAM RNA, also designated SEQ ID:278.

Another function of GAM281 is therefore inhibition of LOC127841 (Accession XP_059184.1). Accordingly, utilities of GAM281 include diagnosis, prevention and treatment of diseases and clinical conditions associated with LOC127841.

LOC128387 (Accession XP_059243.2) is another GAM281 target gene, herein designated TARGET GENE. LOC128387 BINDING SITE is a target binding site found in the 3' untranslated region of mRNA encoded by LOC128387, corresponding to a target binding site such as BINDING SITE I, BINDING SITE II or BINDING SITE III of FIG. 8. Table 4 illustrates the complementarity of the nucleotide sequences of LOC128387 BINDING SITE, designated SEQ ID:15173, to the nucleotide sequence of GAM281 RNA, herein designated GAM RNA, also designated SEQ ID:278.

Another function of GAM281 is therefore inhibition of LOC128387 (Accession XP_059243.2). Accordingly, utilities of GAM281 include diagnosis, prevention and treatment of diseases and clinical conditions associated with LOC128387.

LOC130813 (Accession XP_065904.1) is another GAM281 target gene, herein designated TARGET GENE. LOC130813 BINDING SITE is a target binding site found in the 3' untranslated region of mRNA encoded by LOC130813, corresponding to a target binding site such as BINDING SITE I, BINDING SITE II or BINDING SITE III of FIG. 8. Table 4 illustrates the complementarity of the nucleotide sequences of LOC130813 BINDING SITE, designated SEQ ID:12052, to the nucleotide sequence of GAM281 RNA, herein designated GAM RNA, also designated SEQ ID:278.

Another function of GAM281 is therefore inhibition of LOC130813 (Accession XP_065904.1). Accordingly, utilities of GAM281 include diagnosis, prevention and treatment of diseases and clinical conditions associated with LOC130813.

LOC132241 (Accession XP_059583.1) is another GAM281 target gene, herein designated TARGET GENE. LOC132241 BINDING SITE is a target binding site found in the 5' untranslated region of mRNA encoded by LOC132241, corresponding to a target binding site such as BINDING SITE I, BINDING SITE II or BINDING SITE III of FIG. 8. Table 4 illustrates the complementarity of the nucleotide sequences of LOC132241 BINDING SITE, designated SEQ ID:509, to the nucleotide sequence of GAM281 RNA, herein designated GAM RNA, also designated SEQ ID:278.

Another function of GAM281 is therefore inhibition of LOC132241 (Accession XP_059583.1). Accordingly, utilities of GAM281 include diagnosis, prevention and treatment of diseases and clinical conditions associated with LOC132241.

LOC135293 (Accession XP_072402.4) is another GAM281 target gene, herein designated TARGET GENE. LOC135293 BINDING SITE1 and LOC135293 BINDING SITE2 are target binding sites found in untranslated regions of mRNA encoded by LOC135293, corresponding to target binding sites such as BINDING SITE I, BINDING SITE II or BINDING SITE III of FIG. 8. Table 4 illustrates the complementarity of the nucleotide sequences of LOC135293 BINDING SITE1 and LOC135293 BINDING SITE2, designated SEQ ID:3512 and SEQ ID:10443 respectively, to the nucleotide sequence of GAM281 RNA, herein designated GAM RNA, also designated SEQ ID:278.

Another function of GAM281 is therefore inhibition of LOC135293 (Accession XP_072402.4). Accordingly, utilities of GAM281 include diagnosis, prevention and treatment of diseases and clinical conditions associated with LOC135293.

LOC135763 (Accession NP_612639.1) is another GAM281 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:17207, to the nucleotide sequence of GAM281 RNA, herein designated GAM RNA, also designated SEQ ID:278.

Another function of GAM281 is therefore inhibition of LOC135763 (Accession NP_612639.1). Accordingly, utilities of GAM281 include diagnosis, prevention and treatment of diseases and clinical conditions associated with LOC135763.

LOC135818 (Accession XP_059804.4) is another GAM281 target gene, herein designated TARGET GENE. LOC135818 BINDING SITE is a target binding site found in the 3' untranslated region of mRNA encoded by LOC135818, corresponding to a target binding site such as BINDING SITE I, BINDING SITE II or BINDING SITE III of FIG. 8. Table 4 illustrates the complementarity of the nucleotide sequences of LOC135818 BINDING SITE, designated SEQ ID:19136, to the nucleotide sequence of GAM281 RNA, herein designated GAM RNA, also designated SEQ ID:278.

Another function of GAM281 is therefore inhibition of LOC135818 (Accession XP_059804.4). Accordingly, utilities of GAM281 include diagnosis, prevention and treatment of diseases and clinical conditions associated with LOC135818.

LOC137886 (Accession XP_059929.3) is another GAM281 target gene, herein designated TARGET GENE. LOC137886 BINDING SITE is a target binding site found in the 3' untranslated region of mRNA encoded by LOC137886, corresponding to a target binding site such as BINDING SITE I, BINDING SITE II or BINDING SITE III of FIG. 8. Table 4 illustrates the complementarity of the nucleotide sequences of LOC137886 BINDING SITE, designated SEQ ID:19990, to the nucleotide sequence of GAM281 RNA, herein designated GAM RNA, also designated SEQ ID:278.

Another function of GAM281 is therefore inhibition of LOC137886 (Accession XP_059929.3). Accordingly, utilities of GAM281 include diagnosis, prevention and treatment of diseases and clinical conditions associated with LOC137886.

LOC138428 (Accession XP_059972.1) is another GAM281 target gene, herein designated TARGET GENE. LOC138428 BINDING SITE is a target binding site found in the 3' untranslated region of mRNA encoded by LOC138428, corresponding to a target binding site such as BINDING SITE I, BINDING SITE II or BINDING SITE III of FIG. 8. Table 4 illustrates the complementarity of the nucleotide sequences of LOC138428 BINDING SITE, designated SEQ ID:3277, to the nucleotide sequence of GAM281 RNA, herein designated GAM RNA, also designated SEQ ID:278.

Another function of GAM281 is therefore inhibition of LOC138428 (Accession XP_059972.1). Accordingly, utilities of GAM281 include diagnosis, prevention and treatment of diseases and clinical conditions associated with LOC138428.

LOC139422 (Accession XP_066687.2) is another GAM281 target gene, herein designated TARGET GENE. LOC139422 BINDING SITE is a target binding site found in the 5' untranslated region of mRNA encoded by LOC139422, corresponding to a target binding site such as BINDING SITE I, BINDING SITE II or BINDING SITE III of FIG. 8. Table 4 illustrates the complementarity of the nucleotide sequences of LOC139422 BINDING SITE, designated SEQ ID:9489, to the nucleotide sequence of GAM281 RNA, herein designated GAM RNA, also designated SEQ ID:278.

Another function of GAM281 is therefore inhibition of LOC139422 (Accession XP_066687.2). Accordingly, utilities of GAM281 include diagnosis, prevention and treatment of diseases and clinical conditions associated with LOC139422.

LOC142946 (Accession XP_096365.1) is another GAM281 target gene, herein designated TARGET GENE. LOC142946 BINDING SITE is a target binding site found in the 3' untranslated region of mRNA encoded by LOC142946, corresponding to a target binding site such as BINDING SITE I, BINDING SITE II or BINDING SITE III of FIG. 8. Table 4 illustrates the complementarity of the nucleotide sequences of LOC142946 BINDING SITE, designated SEQ ID:2999, to the nucleotide sequence of GAM281 RNA, herein designated GAM RNA, also designated SEQ ID:278.

Another function of GAM281 is therefore inhibition of LOC142946 (Accession XP_096365.1). Accordingly, utilities of GAM281 include diagnosis, prevention and treatment of diseases and clinical conditions associated with LOC142946.

LOC143241 (Accession NP_620167.1) is another GAM281 target gene, herein designated TARGET GENE. LOC143241 BINDING SITE is a target binding site found in the 5' untranslated region of mRNA encoded by LOC143241, corresponding to a target binding site such as BINDING SITE I, BINDING SITE II or BINDING SITE III of FIG. 8. Table 4 illustrates the complementarity of the nucleotide sequences of LOC143241 BINDING SITE, designated SEQ ID:15574, to the nucleotide sequence of GAM281 RNA, herein designated GAM RNA, also designated SEQ ID:278.

Another function of GAM281 is therefore inhibition of LOC143241 (Accession NP_620167.1). Accordingly, utilities of GAM281 include diagnosis, prevention and treatment of diseases and clinical conditions associated with LOC143241.

LOC144248 (Accession XP_084786.1) is another GAM281 target gene, herein designated TARGET GENE. LOC144248 BINDING SITE is a target binding site found in the 5' untranslated region of mRNA encoded by LOC144248, corresponding to a target binding site such as BINDING SITE I, BINDING SITE II or BINDING SITE III of FIG. 8. Table 4 illustrates the complementarity of the nucleotide sequences of LOC144248 BINDING SITE, designated SEQ ID:3159, to the nucleotide sequence of GAM281 RNA, herein designated GAM RNA, also designated SEQ ID:278.

Another function of GAM281 is therefore inhibition of LOC144248 (Accession XP_084786.1). Accordingly, utilities of GAM281 include diagnosis, prevention and treatment of diseases and clinical conditions associated with LOC144248.

LOC144402 (Accession NP_705898.1) is another GAM281 target gene, herein designated TARGET GENE. LOC144402 BINDING SITE is a target binding site found in the 3' untranslated region of mRNA encoded by LOC144402, corresponding to a target binding site such as BINDING SITE I, BINDING SITE II or BINDING SITE III of FIG. 8. Table 4 illustrates the complementarity of the nucleotide sequences of LOC144402 BINDING SITE, designated SEQ ID:3665, to the nucleotide sequence of GAM281 RNA, herein designated GAM RNA, also designated SEQ ID:278.

Another function of GAM281 is therefore inhibition of LOC144402 (Accession NP_705898.1). Accordingly, utilities of GAM281 include diagnosis, prevention and treatment of diseases and clinical conditions associated with LOC144402.

LOC144404 (Accession XP_084852.6) is another GAM281 target gene, herein designated TARGET GENE. LOC144404 BINDING SITE1 through LOC144404 BINDING SITE3 are target binding sites found in untranslated regions of mRNA encoded by LOC144404, corresponding to target binding sites such as BINDING SITE I, BINDING SITE II or BINDING SITE III of FIG. 8. Table 4 illustrates the complementarity of the nucleotide sequences of LOC144404 BINDING SITE1 through LOC144404 BINDING SITE3, designated SEQ ID:15352, SEQ ID:5897 and SEQ ID:1633 respectively, to the nucleotide sequence of GAM281 RNA, herein designated GAM RNA, also designated SEQ ID:278.

Another function of GAM281 is therefore inhibition of LOC144404 (Accession XP_084852.6). Accordingly, utilities of GAM281 include diagnosis, prevention and treatment of diseases and clinical conditions associated with LOC144404.

LOC144481 (Accession XP_096611.2) is another GAM281 target gene, herein designated TARGET GENE. LOC144481 BINDING SITE is a target binding site found in the 3' untranslated region of mRNA encoded by LOC144481, corresponding to a target binding site such as BINDING SITE I, BINDING SITE II or BINDING SITE III of FIG. 8. Table 4 illustrates the complementarity of the nucleotide sequences of LOC144481 BINDING SITE, designated SEQ ID:19220, to the nucleotide sequence of GAM281 RNA, herein designated GAM RNA, also designated SEQ ID:278.

Another function of GAM281 is therefore inhibition of LOC144481 (Accession XP_096611.2). Accordingly, utilities of GAM281 include diagnosis, prevention and treatment of diseases and clinical conditions associated with LOC144481.

LOC144667 (Accession XP_096648.1) is another GAM281 target gene, herein designated TARGET GENE. LOC144667 BINDING SITE is a target binding site found in the 3' untranslated region of mRNA encoded by LOC144667, corresponding to a target binding site such as BINDING SITE I, BINDING SITE II or BINDING SITE III of FIG. 8. Table 4 illustrates the complementarity of the nucleotide sequences of LOC144667 BINDING SITE, designated SEQ ID:12712, to the nucleotide sequence of GAM281 RNA, herein designated GAM RNA, also designated SEQ ID:278.

Another function of GAM281 is therefore inhibition of LOC144667 (Accession XP_096648.1). Accordingly, utilities of GAM281 include diagnosis, prevention and treatment of diseases and clinical conditions associated with LOC144667.

LOC144742 (Accession XP_084949.1) is another GAM281 target gene, herein designated TARGET GENE. LOC144742 BINDING SITE is a target binding site found in the 5' untranslated region of mRNA encoded by LOC144742, corresponding to a target binding site such as BINDING SITE I, BINDING SITE II or BINDING SITE III of FIG. 8. Table 4 illustrates the complementarity of the nucleotide sequences of LOC144742 BINDING SITE, designated SEQ ID:17736, to the nucleotide sequence of GAM281 RNA, herein designated GAM RNA, also designated SEQ ID:278.

Another function of GAM281 is therefore inhibition of LOC144742 (Accession XP_084949.1). Accordingly, utilities of GAM281 include diagnosis, prevention and treatment of diseases and clinical conditions associated with LOC144742.

LOC144747 (Accession XP_084954.1) is another GAM281 target gene, herein designated TARGET GENE. LOC144747 BINDING SITE is a target binding site found in the 5' untranslated region of mRNA encoded by LOC144747, corresponding to a target binding site such as BINDING SITE I, BINDING SITE II or BINDING SITE III of FIG. 8. Table 4 illustrates the complementarity of the nucleotide sequences of LOC144747 BINDING SITE, designated SEQ ID:12981, to the nucleotide sequence of GAM281 RNA, herein designated GAM RNA, also designated SEQ ID:278.

Another function of GAM281 is therefore inhibition of LOC144747 (Accession XP_084954.1). Accordingly, utilities of GAM281 include diagnosis, prevention and treatment of diseases and clinical conditions associated with LOC144747.

LOC144766 (Accession XP_084963.2) is another GAM281 target gene, herein designated TARGET GENE. LOC144766 BINDING SITE is a target binding site found in the 5' untranslated region of mRNA encoded by LOC144766, corresponding to a target binding site such as BINDING SITE I, BINDING SITE II or BINDING SITE III of FIG. 8. Table 4 illustrates the complementarity of the nucleotide sequences of LOC144766 BINDING SITE, designated SEQ ID:8972, to the nucleotide sequence of GAM281 RNA, herein designated GAM RNA, also designated SEQ ID:278.

Another function of GAM281 is therefore inhibition of LOC144766 (Accession XP_084963.2). Accordingly, utilities of GAM281 include diagnosis, prevention and treatment of diseases and clinical conditions associated with LOC144766.

LOC144776 (Accession XP_084964.1) is another GAM281 target gene, herein designated TARGET GENE. LOC144776 BINDING SITE1 and LOC144776 BINDING SITE2 are target binding sites found in untranslated regions of mRNA encoded by LOC144776, corresponding to target binding sites such as BINDING SITE I, BINDING SITE II or BINDING SITE III of FIG. 8. Table 4 illustrates the complementarity of the nucleotide sequences of LOC144776 BINDING SITE1 and LOC144776 BINDING SITE2, designated SEQ ID:444 and SEQ ID:16275 respectively, to the nucleotide sequence of GAM281 RNA, herein designated GAM RNA, also designated SEQ ID:278.

Another function of GAM281 is therefore inhibition of LOC144776 (Accession XP_084964.1). Accordingly, utilities of GAM281 include diagnosis, prevention and treatment of diseases and clinical conditions associated with LOC144776.

LOC144817 (Accession XP_084972.1) is another GAM281 target gene, herein designated TARGET GENE. LOC144817 BINDING SITE is a target binding site found in the 5' untranslated region of mRNA encoded by LOC144817, corresponding to a target binding site such as BINDING SITE I, BINDING SITE II or BINDING SITE III of FIG. 8. Table 4 illustrates the complementarity of the nucleotide sequences of LOC144817 BINDING SITE, designated SEQ ID:12065, to the nucleotide sequence of GAM281 RNA, herein designated GAM RNA, also designated SEQ ID:278.

Another function of GAM281 is therefore inhibition of LOC144817 (Accession XP_084972.1). Accordingly, utilities of GAM281 include diagnosis, prevention and treatment of diseases and clinical conditions associated with LOC144817.

LOC144871 (Accession XP_096698.1) is another GAM281 target gene, herein designated TARGET GENE. LOC144871 BINDING SITE is a target binding site found in the 3' untranslated region of mRNA encoded by LOC144871, corresponding to a target binding site such as BINDING SITE I, BINDING SITE II or BINDING SITE III of FIG. 8. Table 4 illustrates the complementarity of the nucleotide sequences of LOC144871 BINDING SITE, designated SEQ ID:14506, to the nucleotide sequence of GAM281 RNA, herein designated GAM RNA, also designated SEQ ID:278.

Another function of GAM281 is therefore inhibition of LOC144871 (Accession XP_096698.1). Accordingly, utilities of GAM281 include diagnosis, prevention and treatment of diseases and clinical conditions associated with LOC144871.

LOC144962 (Accession XP_084990.1) is another GAM281 target gene, herein designated TARGET GENE. LOC144962 BINDING SITE is a target binding site found in the 5' untranslated region of mRNA encoded by LOC144962, corresponding to a target binding site such as BINDING SITE I, BINDING SITE II or BINDING SITE III of FIG. 8. Table 4 illustrates the complementarity of the nucleotide sequences of LOC144962 BINDING SITE, designated SEQ ID:12130, to the nucleotide sequence of GAM281 RNA, herein designated GAM RNA, also designated SEQ ID:278.

Another function of GAM281 is therefore inhibition of LOC144962 (Accession XP_084990.1). Accordingly, utilities of GAM281 include diagnosis, prevention and treatment of diseases and clinical conditions associated with LOC144962.

LOC145268 (Accession XP_085072.1) is another GAM281 target gene, herein designated TARGET GENE. LOC145268 BINDING SITE1 and LOC145268 BINDING SITE2 are target binding sites found in untranslated regions of mRNA encoded by LOC145268, corresponding to target binding sites such as BINDING SITE I, BINDING SITE II or BINDING SITE III of FIG. 8. Table 4 illustrates the complementarity of the nucleotide sequences of LOC145268 BINDING SITE1 and LOC145268 BINDING SITE2, designated SEQ ID:18805 and SEQ ID:6493 respectively, to the nucleotide sequence of GAM281 RNA, herein designated GAM RNA, also designated SEQ ID:278.

Another function of GAM281 is therefore inhibition of LOC145268 (Accession XP_085072.1). Accordingly, utilities of GAM281 include diagnosis, prevention and treatment of diseases and clinical conditions associated with LOC145268.

LOC145453 (Accession XP_085120.1) is another GAM281 target gene, herein designated TARGET GENE. LOC145453 BINDING SITE is a target binding site found in the 5' untranslated region of mRNA encoded by LOC145453, corresponding to a target binding site such as BINDING SITE I, BINDING SITE II or BINDING SITE III of FIG. 8. Table 4 illustrates the complementarity of the nucleotide sequences of LOC145453 BINDING SITE, designated SEQ ID:11939, to the nucleotide sequence of GAM281 RNA, herein designated GAM RNA, also designated SEQ ID:278.

Another function of GAM281 is therefore inhibition of LOC145453 (Accession XP_085120.1). Accordingly, utilities of GAM281 include diagnosis, prevention and treatment of diseases and clinical conditions associated with LOC145453.

LOC145663 (Accession XP_096829.1) is another GAM281 target gene, herein designated TARGET GENE. LOC145663 BINDING SITE is a target binding site found in the 3' untranslated region of mRNA encoded by LOC145663, corresponding to a target binding site such as BINDING SITE I, BINDING SITE II or BINDING SITE III of FIG. 8. Table 4 illustrates the complementarity of the nucleotide sequences of LOC145663 BINDING SITE, designated SEQ ID:13897, to the nucleotide sequence of GAM281 RNA, herein designated GAM RNA, also designated SEQ ID:278.

Another function of GAM281 is therefore inhibition of LOC145663 (Accession XP_096829.1). Accordingly, utilities of GAM281 include diagnosis, prevention and treatment of diseases and clinical conditions associated with LOC145663.

LOC145725 (Accession XP_085211.1) is another GAM281 target gene, herein designated TARGET GENE. LOC145725 BINDING SITE is a target binding site found in the 3' untranslated region of mRNA encoded by LOC145725, corresponding to a target binding site such as BINDING SITE I, BINDING SITE II or BINDING SITE III of FIG. 8. Table 4 illustrates the complementarity of the nucleotide sequences of LOC145725 BINDING SITE, designated SEQ ID:4773, to the nucleotide sequence of GAM281 RNA, herein designated GAM RNA, also designated SEQ ID:278.

Another function of GAM281 is therefore inhibition of LOC145725 (Accession XP_085211.1). Accordingly, utilities of GAM281 include diagnosis, prevention and treatment of diseases and clinical conditions associated with LOC145725.

LOC145757 (Accession XP_085227.1) is another GAM281 target gene, herein designated TARGET GENE. LOC145757 BINDING SITE1 and LOC145757 BINDING SITE2 are target binding sites found in untranslated regions of mRNA encoded by LOC145757, corresponding to target binding sites such as BINDING SITE I, BINDING SITE II or BINDING SITE III of FIG. 8. Table 4 illustrates the complementarity of the nucleotide sequences of LOC145757 BINDING SITE1 and LOC145757 BINDING SITE2, designated SEQ ID:11523 and SEQ ID:7370 respectively, to the nucleotide sequence of GAM281 RNA, herein designated GAM RNA, also designated SEQ ID:278.

Another function of GAM281 is therefore inhibition of LOC145757 (Accession XP_085227.1). Accordingly, utilities of GAM281 include diagnosis, prevention and treatment of diseases and clinical conditions associated with LOC145757.

LOC145783 (Accession XP_085231.2) is another GAM281 target gene, herein designated TARGET GENE. LOC145783 BINDING SITE is a target binding site found in the 5' untranslated region of mRNA encoded by LOC145783, corresponding to a target binding site such as BINDING SITE I, BINDING SITE II or BINDING SITE III of FIG. 8. Table 4 illustrates the complementarity of the nucleotide sequences of LOC145783 BINDING SITE, designated SEQ ID:2196, to the nucleotide sequence of GAM281 RNA, herein designated GAM RNA, also designated SEQ ID:278.

Another function of GAM281 is therefore inhibition of LOC145783 (Accession XP_085231.2). Accordingly, utilities of GAM281 include diagnosis, prevention and treatment of diseases and clinical conditions associated with LOC145783.

LOC145813 (Accession XP_096873.1) is another GAM281 target gene, herein designated TARGET GENE. LOC145813 BINDING SITE is a target binding site found in the 5' untranslated region of mRNA encoded by LOC145813, corresponding to a target binding site such as BINDING SITE I, BINDING SITE II or BINDING SITE III of FIG. 8. Table 4 illustrates the complementarity of the nucleotide sequences of LOC145813 BINDING SITE, designated SEQ ID:16256, to the nucleotide sequence of GAM281 RNA, herein designated GAM RNA, also designated SEQ ID:278.

Another function of GAM281 is therefore inhibition of LOC145813 (Accession XP_096873.1). Accordingly, utilities of GAM281 include diagnosis, prevention and treatment of diseases and clinical conditions associated with LOC145813.

LOC146177 (Accession NP_778229.1) is another GAM281 target gene, herein designated TARGET GENE. LOC146177 BINDING SITE is a target binding site found in the 5' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:16175, to the nucleotide sequence of GAM281 RNA, herein designated GAM RNA, also designated SEQ ID:278.

Another function of GAM281 is therefore inhibition of LOC146177 (Accession NP_778229.1). Accordingly, utilities of GAM281 include diagnosis, prevention and treatment of diseases and clinical conditions associated with LOC146177.

LOC146229 (Accession XP_085387.1) is another GAM281 target gene, herein designated TARGET GENE. LOC146229 BINDING SITE1 through LOC146229 BINDING SITE4 are target binding sites found in untranslated regions of mRNA encoded by LOC146229, corresponding to target binding sites such as BINDING SITE I, BINDING SITE II or BINDING SITE III of FIG. 8. Table 4 illustrates the complementarity of the nucleotide sequences of LOC146229 BINDING SITE1 through LOC146229 BINDING SITE4, designated SEQ ID:5551, SEQ ID:5672, SEQ ID:8706 and SEQ ID:1644 respectively, to the nucleotide sequence of GAM281 RNA, herein designated GAM RNA, also designated SEQ ID:278.

Another function of GAM281 is therefore inhibition of LOC146229 (Accession XP_085387.1). Accordingly, utilities of GAM281 include diagnosis, prevention and treatment of diseases and clinical conditions associated with LOC146229.

LOC146346 (Accession XP_085430.1) is another GAM281 target gene, herein designated TARGET GENE. LOC146346 BINDING SITE1 through LOC146346 BINDING SITE3 are target binding sites found in untranslated regions of mRNA encoded by LOC146346, corresponding to target binding sites such as BINDING SITE I, BINDING SITE II or BINDING SITE III of FIG. 8. Table 4 illustrates the complementarity of the nucleotide sequences of LOC146346 BINDING SITE1 through LOC146346 BINDING SITE3, designated SEQ ID:1901, SEQ ID:5798 and SEQ ID:17670 respectively, to the nucleotide sequence of GAM281 RNA, herein designated GAM RNA, also designated SEQ ID:278.

Another function of GAM281 is therefore inhibition of LOC146346 (Accession XP_085430.1). Accordingly, utilities of GAM281 include diagnosis, prevention and treatment of diseases and clinical conditions associated with LOC146346.

LOC146429 (Accession XP_096998.2) is another GAM281 target gene, herein designated TARGET GENE. LOC146429 BINDING SITE1 and LOC146429 BINDING SITE2 are target binding sites found in untranslated regions of mRNA encoded by LOC146429, corresponding to target binding sites such as BINDING SITE I, BINDING SITE II or BINDING SITE III of FIG. 8. Table 4 illustrates the complementarity of the nucleotide sequences of LOC146429 BINDING SITE1 and LOC146429 BINDING SITE2, designated SEQ ID:2457 and SEQ ID:4769 respectively, to the nucleotide sequence of GAM281 RNA, herein designated GAM RNA, also designated SEQ ID:278.

Another function of GAM281 is therefore inhibition of LOC146429 (Accession XP_096998.2). Accordingly, utilities of GAM281 include diagnosis, prevention and treatment of diseases and clinical conditions associated with LOC146429.

LOC146443 (Accession XP_085461.6) is another GAM281 target gene, herein designated TARGET GENE. LOC146443 BINDING SITE is a target binding site found in the 5' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:813, to the nucleotide sequence of GAM281 RNA, herein designated GAM RNA, also designated SEQ ID:278.

Another function of GAM281 is therefore inhibition of LOC146443 (Accession XP_085461.6). Accordingly, utilities of GAM281 include diagnosis, prevention and treatment of diseases and clinical conditions associated with LOC146443.

LOC146475 (Accession XP_097006.1) is another GAM281 target gene, herein designated TARGET GENE. LOC146475 BINDING SITE is a target binding site found in the 5' untranslated region of mRNA encoded by LOC146475, corresponding to a target binding site such as BINDING SITE I, BINDING SITE II or BINDING SITE III of FIG. 8. Table 4 illustrates the complementarity of the nucleotide sequences of LOC146475 BINDING SITE, designated SEQ ID:9246, to the nucleotide sequence of GAM281 RNA, herein designated GAM RNA, also designated SEQ ID:278.

Another function of GAM281 is therefore inhibition of LOC146475 (Accession XP_097006.1). Accordingly, utilities of GAM281 include diagnosis, prevention and treatment of diseases and clinical conditions associated with LOC146475.

LOC146513 (Accession XP_097013.1) is another GAM281 target gene, herein designated TARGET GENE. LOC146513 BINDING SITE is a target binding site found in the 3' untranslated region of mRNA encoded by LOC146513, corresponding to a target binding site such as BINDING SITE I, BINDING SITE II or BINDING SITE III of FIG. 8. Table 4 illustrates the complementarity of the nucleotide sequences of LOC146513 BINDING SITE, designated SEQ ID:3374, to the nucleotide sequence of GAM281 RNA, herein designated GAM RNA, also designated SEQ ID:278.

Another function of GAM281 is therefore inhibition of LOC146513 (Accession XP_097013.1). Accordingly, utilities of GAM281 include diagnosis, prevention and treatment of diseases and clinical conditions associated with LOC146513.

LOC146603 (Accession XP_085514.2) is another GAM281 target gene, herein designated TARGET GENE. LOC146603 BINDING SITE is a target binding site found in the 5' untranslated region of mRNA encoded by LOC146603, corresponding to a target binding site such as BINDING SITE I, BINDING SITE II or BINDING SITE III of FIG. 8. Table 4 illustrates the complementarity of the nucleotide sequences of LOC146603 BINDING SITE, designated SEQ ID:7382, to the nucleotide sequence of GAM281 RNA, herein designated GAM RNA, also designated SEQ ID:278.

Another function of GAM281 is therefore inhibition of LOC146603 (Accession XP_085514.2). Accordingly, utilities of GAM281 include diagnosis, prevention and treatment of diseases and clinical conditions associated with LOC146603.

LOC146756 (Accession XP_097085.5) is another GAM281 target gene, herein designated TARGET GENE. LOC146756 BINDING SITE is a target binding site found in the 3' untranslated region of mRNA encoded by LOC146756, corresponding to a target binding site such as BINDING SITE I, BINDING SITE II or BINDING SITE III of FIG. 8. Table 4 illustrates the complementarity of the nucleotide sequences of LOC146756 BINDING SITE, designated SEQ ID:5954, to the nucleotide sequence of GAM281 RNA, herein designated GAM RNA, also designated SEQ ID:278.

Another function of GAM281 is therefore inhibition of LOC146756 (Accession XP_097085.5). Accordingly, utilities of GAM281 include diagnosis, prevention and treatment of diseases and clinical conditions associated with LOC146756.

LOC146784 (Accession XP_085588.1) is another GAM281 target gene, herein designated TARGET GENE. LOC146784 BINDING SITE is a target binding site found in the 5' untranslated region of mRNA encoded by LOC146784, corresponding to a target binding site such as BINDING SITE I, BINDING SITE II or BINDING SITE III of FIG. 8. Table 4 illustrates the complementarity of the nucleotide sequences of LOC146784 BINDING SITE, designated SEQ ID:13448, to the nucleotide sequence of GAM281 RNA, herein designated GAM RNA, also designated SEQ ID:278.

Another function of GAM281 is therefore inhibition of LOC146784 (Accession XP_085588.1). Accordingly, utilities of GAM281 include diagnosis, prevention and treatment of diseases and clinical conditions associated with LOC146784.

LOC146839 (Accession XP_097107.1) is another GAM281 target gene, herein designated TARGET GENE. LOC146839 BINDING SITE is a target binding site found in the 3' untranslated region of mRNA encoded by LOC146839, corresponding to a target binding site such as BINDING SITE I, BINDING SITE II or BINDING SITE III of FIG. 8. Table 4 illustrates the complementarity of the nucleotide sequences of LOC146839 BINDING SITE, designated SEQ ID:1745, to the nucleotide sequence of GAM281 RNA, herein designated GAM RNA, also designated SEQ ID:278.

Another function of GAM281 is therefore inhibition of LOC146839 (Accession XP_097107.1). Accordingly, utilities of GAM281 include diagnosis, prevention and treatment of diseases and clinical conditions associated with LOC146839.

LOC146894 (Accession NP_660316.1) is another GAM281 target gene, herein designated TARGET GENE. LOC146894 BINDING SITE is a target binding site found in the 3' untranslated region of mRNA encoded by LOC146894, corresponding to a target binding site such as BINDING SITE I, BINDING SITE II or BINDING SITE III of FIG. 8. Table 4 illustrates the complementarity of the nucleotide sequences of LOC146894 BINDING SITE, designated SEQ ID:8315, to the nucleotide sequence of GAM281 RNA, herein designated GAM RNA, also designated SEQ ID:278.

Another function of GAM281 is therefore inhibition of LOC146894 (Accession NP_660316.1). Accordingly, utilities of GAM281 include diagnosis, prevention and treatment of diseases and clinical conditions associated with LOC146894.

LOC146895 (Accession XP_097120.1) is another GAM281 target gene, herein designated TARGET GENE. LOC146895 BINDING SITE is a target binding site found in the 5' untranslated region of mRNA encoded by LOC146895, corresponding to a target binding site such as BINDING SITE I, BINDING SITE II or BINDING SITE III of FIG. 8. Table 4 illustrates the complementarity of the nucleotide sequences of LOC146895 BINDING SITE, designated SEQ ID:8232, to the nucleotide sequence of GAM281 RNA, herein designated GAM RNA, also designated SEQ ID:278.

Another function of GAM281 is therefore inhibition of LOC146895 (Accession XP_097120.1). Accordingly, utilities of GAM281 include diagnosis, prevention and treatment of diseases and clinical conditions associated with LOC146895.

LOC146901 (Accession XP_097121.1) is another GAM281 target gene, herein designated TARGET GENE. LOC146901 BINDING SITE is a target binding site found in the 3' untranslated region of mRNA encoded by LOC146901, corresponding to a target binding site such as BINDING SITE I, BINDING SITE II or BINDING SITE III of FIG. 8. Table 4 illustrates the complementarity of the nucleotide sequences of LOC146901 BINDING SITE, designated SEQ ID:6392, to the nucleotide sequence of GAM281 RNA, herein designated GAM RNA, also designated SEQ ID:278.

Another function of GAM281 is therefore inhibition of LOC146901 (Accession XP_097121.1). Accordingly, utilities of GAM281 include diagnosis, prevention and treatment of diseases and clinical conditions associated with LOC146901.

LOC146909 (Accession XP_085634.2) is another GAM281 target gene, herein designated TARGET GENE. LOC146909 BINDING SITE1 and LOC146909 BINDING SITE2 are target binding sites found in untranslated regions of mRNA encoded by LOC146909, corresponding to target binding sites such as BINDING SITE I, BINDING SITE II or BINDING SITE III of FIG. 8. Table 4 illustrates the complementarity of the nucleotide sequences of LOC146909 BINDING SITE1 and LOC146909 BINDING SITE2, designated SEQ ID:9492 and SEQ ID:19550 respectively, to the nucleotide sequence of GAM281 RNA, herein designated GAM RNA, also designated SEQ ID:278.

Another function of GAM281 is therefore inhibition of LOC146909 (Accession XP_085634.2). Accordingly, utilities of GAM281 include diagnosis, prevention and treatment of diseases and clinical conditions associated with LOC146909.

LOC147071 (Accession XP_054031.5) is another GAM281 target gene, herein designated TARGET GENE. LOC147071 BINDING SITE is a target binding site found in the 5' untranslated region of mRNA encoded by LOC147071, corresponding to a target binding site such as BINDING SITE I, BINDING SITE II or BINDING SITE III of FIG. 8. Table 4 illustrates the complementarity of the nucleotide sequences of LOC147071 BINDING SITE, designated SEQ ID:16699, to the nucleotide sequence of GAM281 RNA, herein designated GAM RNA, also designated SEQ ID:278.

Another function of GAM281 is therefore inhibition of LOC147071 (Accession XP_054031.5). Accordingly, utilities of GAM281 include diagnosis, prevention and treatment of diseases and clinical conditions associated with LOC147071.

LOC147080 (Accession XP_097182.1) is another GAM281 target gene, herein designated TARGET GENE. LOC147080 BINDING SITE is a target binding site found in the 5' untranslated region of mRNA encoded by LOC147080, corresponding to a target binding site such as BINDING SITE I, BINDING SITE II or BINDING SITE III of FIG. 8. Table 4 illustrates the complementarity of the nucleotide sequences of LOC147080 BINDING SITE, designated SEQ ID:12558, to the nucleotide sequence of GAM281 RNA, herein designated GAM RNA, also designated SEQ ID:278.

Another function of GAM281 is therefore inhibition of LOC147080 (Accession XP_097182.1). Accordingly, utilities of GAM281 include diagnosis, prevention and treatment of diseases and clinical conditions associated with LOC147080.

LOC147166 (Accession XP_085722.2) is another GAM281 target gene, herein designated TARGET GENE. LOC147166 BINDING SITE is a target binding site found in the 3' untranslated region of mRNA encoded by LOC147166, corresponding to a target binding site such as BINDING SITE I, BINDING SITE II or BINDING SITE III of FIG. 8. Table 4 illustrates the complementarity of the nucleotide sequences of LOC147166 BINDING SITE, designated SEQ ID:10618, to the nucleotide sequence of GAM281 RNA, herein designated GAM RNA, also designated SEQ ID:278.

Another function of GAM281 is therefore inhibition of LOC147166 (Accession XP_085722.2). Accordingly, utilities of GAM281 include diagnosis, prevention and treatment of diseases and clinical conditions associated with LOC147166.

LOC147381 (Accession XP_097230.2) is another GAM281 target gene, herein designated TARGET GENE. LOC147381 BINDING SITE is a target binding site found in the 3' untranslated region of mRNA encoded by LOC147381, corresponding to a target binding site such as BINDING SITE I, BINDING SITE II or BINDING SITE III of FIG. 8. Table 4 illustrates the complementarity of the nucleotide sequences of LOC147381 BINDING SITE, designated SEQ ID:19915, to the nucleotide sequence of GAM281 RNA, herein designated GAM RNA, also designated SEQ ID:278.

Another function of GAM281 is therefore inhibition of LOC147381 (Accession XP_097230.2). Accordingly, utilities of GAM281 include diagnosis, prevention and treatment of diseases and clinical conditions associated with LOC147381.

LOC147407 (Accession XP_084000.1) is another GAM281 target gene, herein designated TARGET GENE. LOC147407 BINDING SITE is a target binding site found in the 3' untranslated region of mRNA encoded by LOC147407, corresponding to a target binding site such as BINDING SITE I, BINDING SITE II or BINDING SITE III of FIG. 8. Table 4 illustrates the complementarity of the nucleotide sequences of LOC147407 BINDING SITE, designated SEQ ID:12065, to the nucleotide sequence of GAM281 RNA, herein designated GAM RNA, also designated SEQ ID:278.

Another function of GAM281 is therefore inhibition of LOC147407 (Accession XP_084000.1). Accordingly, utilities of GAM281 include diagnosis, prevention and treatment of diseases and clinical conditions associated with LOC147407.

LOC147622 (Accession XP_097255.1) is another GAM281 target gene, herein designated TARGET GENE. LOC147622 BINDING SITE is a target binding site found in the 3' untranslated region of mRNA encoded by LOC147622, corresponding to a target binding site such as BINDING SITE I, BINDING SITE II or BINDING SITE III of FIG. 8. Table 4 illustrates the complementarity of the nucleotide sequences of LOC147622 BINDING SITE, designated SEQ ID:16101, to the nucleotide sequence of GAM281 RNA, herein designated GAM RNA, also designated SEQ ID:278.

Another function of GAM281 is therefore inhibition of LOC147622 (Accession XP_097255.1). Accordingly, utilities of GAM281 include diagnosis, prevention and treatment of diseases and clinical conditions associated with LOC147622.

LOC147817 (Accession XP_085903.1) is another GAM281 target gene, herein designated TARGET GENE. LOC147817 BINDING SITE1 and LOC147817 BINDING SITE2 are target binding sites found in untranslated regions of mRNA encoded by LOC147817, corresponding to target binding sites such as BINDING SITE I, BINDING SITE II or BINDING SITE III of FIG. 8. Table 4 illustrates the complementarity of the nucleotide sequences of LOC147817 BINDING SITE1 and LOC147817 BINDING SITE2, designated SEQ ID:19233 and SEQ ID:1634 respectively, to the nucleotide sequence of GAM281 RNA, herein designated GAM RNA, also designated SEQ ID:278.

Another function of GAM281 is therefore inhibition of LOC147817 (Accession XP_085903.1). Accordingly, utilities of GAM281 include diagnosis, prevention and treatment of diseases and clinical conditions associated with LOC147817.

LOC147841 (Accession XP_085924.2) is another GAM281 target gene, herein designated TARGET GENE. LOC147841 BINDING SITE1 and LOC147841 BINDING SITE2 are target binding sites found in untranslated regions of mRNA encoded by LOC147841, corresponding to target binding sites such as BINDING SITE I, BINDING SITE II or BINDING SITE III of FIG. 8. Table 4 illustrates the complementarity of the nucleotide sequences of LOC147841 BINDING SITE1 and LOC147841 BINDING SITE2, designated SEQ ID:12065 and SEQ ID:8642 respectively, to the nucleotide sequence of GAM281 RNA, herein designated GAM RNA, also designated SEQ ID:278.

Another function of GAM281 is therefore inhibition of LOC147841 (Accession XP_085924.2). Accordingly, utilities of GAM281 include diagnosis, prevention and treatment of diseases and clinical conditions associated with LOC147841.

LOC147947 (Accession XP_085974.1) is another GAM281 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:17952, to the nucleotide sequence of GAM281 RNA, herein designated GAM RNA, also designated SEQ ID:278.

Another function of GAM281 is therefore inhibition of LOC147947 (Accession XP_085974.1). Accordingly, utilities of GAM281 include diagnosis, prevention and treatment of diseases and clinical conditions associated with LOC147947.

LOC148137 (Accession NP_653293.1) is another GAM281 target gene, herein designated TARGET GENE. LOC148137 BINDING SITE1 and LOC148137 BINDING SITE2 are target binding sites found in untranslated regions of mRNA encoded by LOC148137, corresponding to target binding sites such as BINDING SITE I, BINDING SITE II or BINDING SITE III of FIG. 8. Table 4 illustrates the complementarity of the nucleotide sequences of LOC148137 BINDING SITE1 and LOC148137 BINDING SITE2, designated SEQ ID:17935 and SEQ ID:5784 respectively, to the nucleotide sequence of GAM281 RNA, herein designated GAM RNA, also designated SEQ ID:278.

Another function of GAM281 is therefore inhibition of LOC148137 (Accession NP_653293.1). Accordingly, utilities of GAM281 include diagnosis, prevention and treatment of diseases and clinical conditions associated with LOC148137.

LOC148189 (Accession XP_086087.1) is another GAM281 target gene, herein designated TARGET GENE. LOC148189 BINDING SITE is a target binding site found in the 5' untranslated region of mRNA encoded by LOC148189, corresponding to a target binding site such as BINDING SITE I, BINDING SITE II or BINDING SITE III of FIG. 8. Table 4 illustrates the complementarity of the nucleotide sequences of LOC148189 BINDING SITE, designated SEQ ID:12666, to the nucleotide sequence of GAM281 RNA, herein designated GAM RNA, also designated SEQ ID:278.

Another function of GAM281 is therefore inhibition of LOC148189 (Accession XP_086087.1). Accordingly, utilities of GAM281 include diagnosis, prevention and treatment of diseases and clinical conditions associated with LOC148189.

LOC148198 (Accession XP_047554.4) is another GAM281 target gene, herein designated TARGET GENE. LOC148198 BINDING SITE is a target binding site found in the 3' untranslated region of mRNA encoded by LOC148198, corresponding to a target binding site such as BINDING SITE I, BINDING SITE II or BINDING SITE III of FIG. 8. Table 4 illustrates the complementarity of the nucleotide sequences of LOC148198 BINDING SITE, designated SEQ ID:11563, to the nucleotide sequence of GAM281 RNA, herein designated GAM RNA, also designated SEQ ID:278.

Another function of GAM281 is therefore inhibition of LOC148198 (Accession XP_047554.4). Accordingly, utilities of GAM281 include diagnosis, prevention and treatment of diseases and clinical conditions associated with LOC148198.

LOC148708 (Accession XP_086286.4) is another GAM281 target gene, herein designated TARGET GENE. LOC148708 BINDING SITE is a target binding site found in the 3' untranslated region of mRNA encoded by LOC148708, corresponding to a target binding site such as BINDING SITE I, BINDING SITE II or BINDING SITE III of FIG. 8. Table 4 illustrates the complementarity of the nucleotide sequences of LOC148708 BINDING SITE, designated SEQ ID:15671, to the nucleotide sequence of GAM281 RNA, herein designated GAM RNA, also designated SEQ ID:278.

Another function of GAM281 is therefore inhibition of LOC148708 (Accession XP_086286.4). Accordingly, utilities of GAM281 include diagnosis, prevention and treatment of diseases and clinical conditions associated with LOC148708.

LOC148709 (Accession XP_086281.1) is another GAM281 target gene, herein designated TARGET GENE. LOC148709 BINDING SITE is a target binding site found in the 5' untranslated region of mRNA encoded by LOC148709, corresponding to a target binding site such as BINDING SITE I, BINDING SITE II or BINDING SITE III of FIG. 8. Table 4 illustrates the complementarity of the nucleotide sequences of LOC148709 BINDING SITE, designated SEQ ID:9201, to the nucleotide sequence of GAM281 RNA, herein designated GAM RNA, also designated SEQ ID:278.

Another function of GAM281 is therefore inhibition of LOC148709 (Accession XP_086281.1). Accordingly, utilities of GAM281 include diagnosis, prevention and treatment of diseases and clinical conditions associated with LOC148709.

LOC149149 (Accession XP_097598.1) is another GAM281 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:2184, to the nucleotide sequence of GAM281 RNA, herein designated GAM RNA, also designated SEQ ID:278.

Another function of GAM281 is therefore inhibition of LOC149149 (Accession XP_097598.1). Accordingly, utilities of GAM281 include diagnosis, prevention and treatment of diseases and clinical conditions associated with LOC149149.

LOC149371 (Accession NP_787072.1) is another GAM281 target gene, herein designated TARGET GENE.

LOC149371 BINDING SITE is a target binding site found in the 3' untranslated region of mRNA encoded by LOC149371, corresponding to a target binding site such as BINDING SITE I, BINDING SITE II or BINDING SITE III of FIG. 8. Table 4 illustrates the complementarity of the nucleotide sequences of LOC149371 BINDING SITE, designated SEQ ID:13354, to the nucleotide sequence of GAM281 RNA, herein designated GAM RNA, also designated SEQ ID:278.

Another function of GAM281 is therefore inhibition of LOC149371 (Accession NP_787072.1). Accordingly, utilities of GAM281 include diagnosis, prevention and treatment of diseases and clinical conditions associated with LOC149371.

LOC149466 (Accession XP_086546.1) is another GAM281 target gene, herein designated TARGET GENE. LOC149466 BINDING SITE is a target binding site found in the 3' untranslated region of mRNA encoded by LOC149466, corresponding to a target binding site such as BINDING SITE I, BINDING SITE II or BINDING SITE III of FIG. 8. Table 4 illustrates the complementarity of the nucleotide sequences of LOC149466 BINDING SITE, designated SEQ ID:16260, to the nucleotide sequence of GAM281 RNA, herein designated GAM RNA, also designated SEQ ID:278.

Another function of GAM281 is therefore inhibition of LOC149466 (Accession XP_086546.1). Accordingly, utilities of GAM281 include diagnosis, prevention and treatment of diseases and clinical conditions associated with LOC149466.

LOC149478 (Accession XP_086536.1) is another GAM281 target gene, herein designated TARGET GENE. LOC149478 BINDING SITE is a target binding site found in the 3' untranslated region of mRNA encoded by LOC149478, corresponding to a target binding site such as BINDING SITE I, BINDING SITE II or BINDING SITE III of FIG. 8. Table 4 illustrates the complementarity of the nucleotide sequences of LOC149478 BINDING SITE, designated SEQ ID:5016, to the nucleotide sequence of GAM281 RNA, herein designated GAM RNA, also designated SEQ ID:278.

Another function of GAM281 is therefore inhibition of LOC149478 (Accession XP_086536.1). Accordingly, utilities of GAM281 include diagnosis, prevention and treatment of diseases and clinical conditions associated with LOC149478.

LOC149506 (Accession XP_097661.1) is another GAM281 target gene, herein designated TARGET GENE. LOC149506 BINDING SITE1 and LOC149506 BINDING SITE2 are target binding sites found in untranslated regions of mRNA encoded by LOC149506, corresponding to target binding sites such as BINDING SITE I, BINDING SITE II or BINDING SITE III of FIG. 8. Table 4 illustrates the complementarity of the nucleotide sequences of LOC149506 BINDING SITE1 and LOC149506 BINDING SITE2, designated SEQ ID:2139 and SEQ ID:1489 respectively, to the nucleotide sequence of GAM281 RNA, herein designated GAM RNA, also designated SEQ ID:278.

Another function of GAM281 is therefore inhibition of LOC149506 (Accession XP_097661.1). Accordingly, utilities of GAM281 include diagnosis, prevention and treatment of diseases and clinical conditions associated with LOC149506.

LOC149692 (Accession XP_097706.1) is another GAM281 target gene, herein designated TARGET GENE. LOC149692 BINDING SITE is a target binding site found in the 3' untranslated region of mRNA encoded by LOC149692, corresponding to a target binding site such as BINDING SITE I, BINDING SITE II or BINDING SITE III of FIG. 8. Table 4 illustrates the complementarity of the nucleotide sequences of LOC149692 BINDING SITE, designated SEQ ID:11025, to the nucleotide sequence of GAM281 RNA, herein designated GAM RNA, also designated SEQ ID:278.

Another function of GAM281 is therefore inhibition of LOC149692 (Accession XP_097706.1). Accordingly, utilities of GAM281 include diagnosis, prevention and treatment of diseases and clinical conditions associated with LOC149692.

LOC149703 (Accession XP_097719.1) is another GAM281 target gene, herein designated TARGET GENE. LOC149703 BINDING SITE is a target binding site found in the 5' untranslated region of mRNA encoded by LOC149703, corresponding to a target binding site such as BINDING SITE I, BINDING SITE II or BINDING SITE III of FIG. 8. Table 4 illustrates the complementarity of the nucleotide sequences of LOC149703 BINDING SITE, designated SEQ ID:10508, to the nucleotide sequence of GAM281 RNA, herein designated GAM RNA, also designated SEQ ID:278.

Another function of GAM281 is therefore inhibition of LOC149703 (Accession XP_097719.1). Accordingly, utilities of GAM281 include diagnosis, prevention and treatment of diseases and clinical conditions associated with LOC149703.

LOC150054 (Accession XP_097797.1) is another GAM281 target gene, herein designated TARGET GENE. LOC150054 BINDING SITE is a target binding site found in the 5' untranslated region of mRNA encoded by LOC150054, corresponding to a target binding site such as BINDING SITE I, BINDING SITE II or BINDING SITE III of FIG. 8. Table 4 illustrates the complementarity of the nucleotide sequences of LOC150054 BINDING SITE, designated SEQ ID:5157, to the nucleotide sequence of GAM281 RNA, herein designated GAM RNA, also designated SEQ ID:278.

Another function of GAM281 is therefore inhibition of LOC150054 (Accession XP_097797.1). Accordingly, utilities of GAM281 include diagnosis, prevention and treatment of diseases and clinical conditions associated with LOC150054.

LOC150150 (Accession XP_097820.1) is another GAM281 target gene, herein designated TARGET GENE. LOC150150 BINDING SITE is a target binding site found in the 5' untranslated region of mRNA encoded by LOC150150, corresponding to a target binding site such as BINDING SITE I, BINDING SITE II or BINDING SITE III of FIG. 8. Table 4 illustrates the complementarity of the nucleotide sequences of LOC150150 BINDING SITE, designated SEQ ID:8279, to the nucleotide sequence of GAM281 RNA, herein designated GAM RNA, also designated SEQ ID:278.

Another function of GAM281 is therefore inhibition of LOC150150 (Accession XP_097820.1). Accordingly, utilities of GAM281 include diagnosis, prevention and treatment of diseases and clinical conditions associated with LOC150150.

LOC150157 (Accession XP_097823.1) is another GAM281 target gene, herein designated TARGET GENE. LOC150157 BINDING SITE is a target binding site found in the 3' untranslated region of mRNA encoded by LOC150157, corresponding to a target binding site such as BINDING SITE I, BINDING SITE II or BINDING SITE III of FIG. 8. Table 4 illustrates the complementarity of the nucleotide sequences of LOC150157 BINDING SITE, designated SEQ ID:13000, to the nucleotide sequence of GAM281 RNA, herein designated GAM RNA, also designated SEQ ID:278.

Another function of GAM281 is therefore inhibition of LOC150157 (Accession XP_097823.1). Accordingly, utilities of GAM281 include diagnosis, prevention and treatment of diseases and clinical conditions associated with LOC150157.

LOC150166 (Accession XP_097824.1) is another GAM281 target gene, herein designated TARGET GENE. LOC150166 BINDING SITE is a target binding site found in the 5' untranslated region of mRNA encoded by LOC150166, corresponding to a target binding site such as BINDING SITE I, BINDING SITE II or BINDING SITE III of FIG. 8. Table 4 illustrates the complementarity of the nucleotide sequences of LOC150166 BINDING SITE, designated SEQ ID:19856, to the nucleotide sequence of GAM281 RNA, herein designated GAM RNA, also designated SEQ ID:278.

Another function of GAM281 is therefore inhibition of LOC150166 (Accession XP_097824.1). Accordingly, utilities of GAM281 include diagnosis, prevention and treatment of diseases and clinical conditions associated with LOC150166.

LOC150225 (Accession XP_097870.1) is another GAM281 target gene, herein designated TARGET GENE. LOC150225 BINDING SITE1 and LOC150225 BINDING SITE2 are target binding sites found in untranslated regions of mRNA encoded by LOC150225, corresponding to target binding sites such as BINDING SITE I, BINDING SITE II or BINDING SITE III of FIG. 8. Table 4 illustrates the complementarity of the nucleotide sequences of LOC150225 BINDING SITE1 and LOC150225 BINDING SITE2, designated SEQ ID:4400 and SEQ ID:7207 respectively, to the nucleotide sequence of GAM281 RNA, herein designated GAM RNA, also designated SEQ ID:278.

Another function of GAM281 is therefore inhibition of LOC150225 (Accession XP_097870.1). Accordingly, utilities of GAM281 include diagnosis, prevention and treatment of diseases and clinical conditions associated with LOC150225.

LOC150356 (Accession XP_086884.2) is another GAM281 target gene, herein designated TARGET GENE. LOC150356 BINDING SITE is a target binding site found in the 5' untranslated region of mRNA encoded by LOC150356, corresponding to a target binding site such as BINDING SITE I, BINDING SITE II or BINDING SITE III of FIG. 8. Table 4 illustrates the complementarity of the nucleotide sequences of LOC150356 BINDING SITE, designated SEQ ID:9922, to the nucleotide sequence of GAM281 RNA, herein designated GAM RNA, also designated SEQ ID:278.

Another function of GAM281 is therefore inhibition of LOC150356 (Accession XP_086884.2). Accordingly, utilities of GAM281 include diagnosis, prevention and treatment of diseases and clinical conditions associated with LOC150356.

LOC150383 (Accession XP_086905.1) is another GAM281 target gene, herein designated TARGET GENE. LOC150383 BINDING SITE is a target binding site found in the 3' untranslated region of mRNA encoded by LOC150383, corresponding to a target binding site such as BINDING SITE I, BINDING SITE II or BINDING SITE III of FIG. 8. Table 4 illustrates the complementarity of the nucleotide sequences of LOC150383 BINDING SITE, designated SEQ ID:826, to the nucleotide sequence of GAM281 RNA, herein designated GAM RNA, also designated SEQ ID:278.

Another function of GAM281 is therefore inhibition of LOC150383 (Accession XP_086905.1). Accordingly, utilities of GAM281 include diagnosis, prevention and treatment of diseases and clinical conditions associated with LOC150383.

LOC150384 (Accession XP_097894.1) is another GAM281 target gene, herein designated TARGET GENE. LOC150384 BINDING SITE is a target binding site found in the 5' untranslated region of mRNA encoded by LOC150384, corresponding to a target binding site such as BINDING SITE I, BINDING SITE II or BINDING SITE III of FIG. 8. Table 4 illustrates the complementarity of the nucleotide sequences of LOC150384 BINDING SITE, designated SEQ ID:7485, to the nucleotide sequence of GAM281 RNA, herein designated GAM RNA, also designated SEQ ID:278.

Another function of GAM281 is therefore inhibition of LOC150384 (Accession XP_097894.1). Accordingly, utilities of GAM281 include diagnosis, prevention and treatment of diseases and clinical conditions associated with LOC150384.

LOC150407 (Accession XP_086906.1) is another GAM281 target gene, herein designated TARGET GENE. LOC150407 BINDING SITE is a target binding site found in the 3' untranslated region of mRNA encoded by LOC150407, corresponding to a target binding site such as BINDING SITE I, BINDING SITE II or BINDING SITE III of FIG. 8. Table 4 illustrates the complementarity of the nucleotide sequences of LOC150407 BINDING SITE, designated SEQ ID:5756, to the nucleotide sequence of GAM281 RNA, herein designated GAM RNA, also designated SEQ ID:278.

Another function of GAM281 is therefore inhibition of LOC150407 (Accession XP_086906.1). Accordingly, utilities of GAM281 include diagnosis, prevention and treatment of diseases and clinical conditions associated with LOC150407.

LOC150587 (Accession XP_097917.1) is another GAM281 target gene, herein designated TARGET GENE. LOC150587 BINDING SITE is a target binding site found in the 5' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:16940, to the nucleotide sequence of GAM281 RNA, herein designated GAM RNA, also designated SEQ ID:278.

Another function of GAM281 is therefore inhibition of LOC150587 (Accession XP_097917.1). Accordingly, utilities of GAM281 include diagnosis, prevention and treatment of diseases and clinical conditions associated with LOC150587.

LOC150819 (Accession XP_097954.1) is another GAM281 target gene, herein designated TARGET GENE. LOC150819 BINDING SITE is a target binding site found in the 5' untranslated region of mRNA encoded by LOC150819, corresponding to a target binding site such as BINDING SITE I, BINDING SITE II or BINDING SITE III of FIG. 8. Table 4 illustrates the complementarity of the nucleotide sequences of LOC150819 BINDING SITE, designated SEQ ID:18257, to the nucleotide sequence of GAM281 RNA, herein designated GAM RNA, also designated SEQ ID:278.

Another function of GAM281 is therefore inhibition of LOC150819 (Accession XP_097954.1). Accordingly, utilities of GAM281 include diagnosis, prevention and treatment of diseases and clinical conditions associated with LOC150819.

LOC151057 (Accession XP_097998.1) is another GAM281 target gene, herein designated TARGET GENE. LOC151057 BINDING SITE is a target binding site found in the 3' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:12075, to the nucleotide sequence of GAM281 RNA, herein designated GAM RNA, also designated SEQ ID:278.

Another function of GAM281 is therefore inhibition of LOC151057 (Accession XP_097998.1). Accordingly, utilities of GAM281 include diagnosis, prevention and treatment of diseases and clinical conditions associated with LOC151057.

LOC151196 (Accession XP_098019.1) is another GAM281 target gene, herein designated TARGET GENE. LOC151196 BINDING SITE is a target binding site found in the 3' untranslated region of mRNA encoded by LOC151196, corresponding to a target binding site such as BINDING SITE I, BINDING SITE II or BINDING SITE III of FIG. 8. Table 4 illustrates the complementarity of the nucleotide sequences of LOC151196 BINDING SITE, designated SEQ ID:19774, to the nucleotide sequence of GAM281 RNA, herein designated GAM RNA, also designated SEQ ID:278.

Another function of GAM281 is therefore inhibition of LOC151196 (Accession XP_098019.1). Accordingly, utilities of GAM281 include diagnosis, prevention and treatment of diseases and clinical conditions associated with LOC151196.

LOC151201 (Accession XP_098021.1) is another GAM281 target gene, herein designated TARGET GENE. LOC151201 BINDING SITE1 and LOC151201 BINDING SITE2 are target binding sites found in untranslated regions of mRNA encoded by LOC151201, corresponding to target binding sites such as BINDING SITE I, BINDING SITE II or BINDING SITE III of FIG. 8. Table 4 illustrates the complementarity of the nucleotide sequences of LOC151201 BINDING SITE1 and LOC151201 BINDING SITE2, designated SEQ ID:12725 and SEQ ID:2572 respectively, to the nucleotide sequence of GAM281 RNA, herein designated GAM RNA, also designated SEQ ID:278.

Another function of GAM281 is therefore inhibition of LOC151201 (Accession XP_098021.1). Accordingly, utilities of GAM281 include diagnosis, prevention and treatment of diseases and clinical conditions associated with LOC151201.

LOC151475 (Accession XP_098063.1) is another GAM281 target gene, herein designated TARGET GENE. LOC151475 BINDING SITE1 and LOC151475 BINDING SITE2 are target binding sites found in untranslated regions of mRNA encoded by LOC151475, corresponding to target binding sites such as BINDING SITE I, BINDING SITE II or BINDING SITE III of FIG. 8. Table 4 illustrates the complementarity of the nucleotide sequences of LOC151475 BINDING SITE1 and LOC151475 BINDING SITE2, designated SEQ ID:4174 and SEQ ID:4371 respectively, to the nucleotide sequence of GAM281 RNA, herein designated GAM RNA, also designated SEQ ID:278.

Another function of GAM281 is therefore inhibition of LOC151475 (Accession XP_098063.1). Accordingly, utilities of GAM281 include diagnosis, prevention and treatment of diseases and clinical conditions associated with LOC151475.

LOC151636 (Accession NP_612144.1) is another GAM281 target gene, herein designated TARGET GENE. LOC151636 BINDING SITE1 through LOC151636 BINDING SITE3 are target binding sites found in untranslated regions of mRNA encoded by LOC151636, corresponding to target binding sites such as BINDING SITE I, BINDING SITE II or BINDING SITE III of FIG. 8. Table 4 illustrates the complementarity of the nucleotide sequences of LOC151636 BINDING SITE1 through LOC151636 BINDING SITE3, designated SEQ ID:2693, SEQ ID:4151 and SEQ ID:14731 respectively, to the nucleotide sequence of GAM281 RNA, herein designated GAM RNA, also designated SEQ ID:278.

Another function of GAM281 is therefore inhibition of LOC151636 (Accession NP_612144.1). Accordingly, utilities of GAM281 include diagnosis, prevention and treatment of diseases and clinical conditions associated with LOC151636.

LOC151658 (Accession XP_098103.1) is another GAM281 target gene, herein designated TARGET GENE. LOC151658 BINDING SITE is a target binding site found in the 5' untranslated region of mRNA encoded by LOC151658, corresponding to a target binding site such as BINDING SITE I, BINDING SITE II or BINDING SITE III of FIG. 8. Table 4 illustrates the complementarity of the nucleotide sequences of LOC151658 BINDING SITE, designated SEQ ID:3130, to the nucleotide sequence of GAM281 RNA, herein designated GAM RNA, also designated SEQ ID:278.

Another function of GAM281 is therefore inhibition of LOC151658 (Accession XP_098103.1). Accordingly, utilities of GAM281 include diagnosis, prevention and treatment of diseases and clinical conditions associated with LOC151658.

LOC151877 (Accession XP_098132.1) is another GAM281 target gene, herein designated TARGET GENE. LOC151877 BINDING SITE1 and LOC151877 BINDING SITE2 are target binding sites found in untranslated regions of mRNA encoded by LOC151877, corresponding to target binding sites such as BINDING SITE I, BINDING SITE II or BINDING SITE III of FIG. 8. Table 4 illustrates the complementarity of the nucleotide sequences of LOC151877 BINDING SITE1 and LOC151877 BINDING SITE2, designated SEQ ID:17499 and SEQ ID:4677 respectively, to the nucleotide sequence of GAM281 RNA, herein designated GAM RNA, also designated SEQ ID:278.

Another function of GAM281 is therefore inhibition of LOC151877 (Accession XP_098132.1). Accordingly, utilities of GAM281 include diagnosis, prevention and treatment of diseases and clinical conditions associated with LOC151877.

LOC151878 (Accession XP_087329.1) is another GAM281 target gene, herein designated TARGET GENE. LOC151878 BINDING SITE is a target binding site found in the 5' untranslated region of mRNA encoded by LOC151878, corresponding to a target binding site such as BINDING SITE I, BINDING SITE II or BINDING SITE III of FIG. 8. Table 4 illustrates the complementarity of the nucleotide sequences of LOC151878 BINDING SITE, designated SEQ ID:15127, to the nucleotide sequence of GAM281 RNA, herein designated GAM RNA, also designated SEQ ID:278.

Another function of GAM281 is therefore inhibition of LOC151878 (Accession XP_087329.1). Accordingly, utilities of GAM281 include diagnosis, prevention and treatment of diseases and clinical conditions associated with LOC151878.

LOC152245 (Accession XP_098182.1) is another GAM281 target gene, herein designated TARGET GENE. LOC152245 BINDING SITE1 and LOC152245 BINDING SITE2 are target binding sites found in untranslated regions of mRNA encoded by LOC152245, corresponding to target binding sites such as BINDING SITE I, BINDING SITE II or BINDING SITE III of FIG. 8. Table 4 illustrates the complementarity of the nucleotide sequences of LOC152245 BINDING SITE1 and LOC152245 BINDING SITE2, designated SEQ ID:9470 and SEQ ID:3559 respectively, to the nucleotide sequence of GAM281 RNA, herein designated GAM RNA, also designated SEQ ID:278.

Another function of GAM281 is therefore inhibition of LOC152245 (Accession XP_098182.1). Accordingly, utilities of GAM281 include diagnosis, prevention and treatment of diseases and clinical conditions associated with LOC152245.

LOC152445 (Accession XP_098231.1) is another GAM281 target gene, herein designated TARGET GENE. LOC152445 BINDING SITE1 and LOC152445 BINDING SITE2 are target binding sites found in untranslated regions of mRNA encoded by LOC152445, corresponding to target binding sites such as BINDING SITE I, BINDING SITE II or BINDING SITE III of FIG. 8. Table 4 illustrates the complementarity of the nucleotide sequences of LOC152445 BINDING SITE1 and LOC152445 BINDING SITE2, designated SEQ ID:6147 and SEQ ID:2922 respectively, to the nucleotide sequence of GAM281 RNA, herein designated GAM RNA, also designated SEQ ID:278.

Another function of GAM281 is therefore inhibition of LOC152445 (Accession XP_098231.1). Accordingly, utilities of GAM281 include diagnosis, prevention and treatment of diseases and clinical conditions associated with LOC152445.

LOC152620 (Accession XP_011108.2) is another GAM281 target gene, herein designated TARGET GENE. LOC152620 BINDING SITE is a target binding site found in the 3' untranslated region of mRNA encoded by LOC152620, corresponding to a target binding site such as BINDING SITE I, BINDING SITE II or BINDING SITE III of FIG. 8. Table 4 illustrates the complementarity of the nucleotide sequences of LOC152620 BINDING SITE, designated SEQ ID:1745, to the nucleotide sequence of GAM281 RNA, herein designated GAM RNA, also designated SEQ ID:278.

Another function of GAM281 is therefore inhibition of LOC152620 (Accession XP_011108.2). Accordingly, utilities of GAM281 include diagnosis, prevention and treatment of diseases and clinical conditions associated with LOC152620.

LOC152719 (Accession XP_098257.1) is another GAM281 target gene, herein designated TARGET GENE. LOC152719 BINDING SITE1 and LOC152719 BINDING SITE2 are target binding sites found in untranslated regions of mRNA encoded by LOC152719, corresponding to target binding sites such as BINDING SITE I, BINDING SITE II or BINDING SITE III of FIG. 8. Table 4 illustrates the complementarity of the nucleotide sequences of LOC152719 BINDING SITE1 and LOC152719 BINDING SITE2, designated SEQ ID:11919 and SEQ ID:17637 respectively, to the nucleotide sequence of GAM281 RNA, herein designated GAM RNA, also designated SEQ ID:278.

Another function of GAM281 is therefore inhibition of LOC152719 (Accession XP_098257.1). Accordingly, utilities of GAM281 include diagnosis, prevention and treatment of diseases and clinical conditions associated with LOC152719.

LOC152765 (Accession XP_087519.1) is another GAM281 target gene, herein designated TARGET GENE. LOC152765 BINDING SITE is a target binding site found in the 5' untranslated region of mRNA encoded by LOC152765, corresponding to a target binding site such as BINDING SITE I, BINDING SITE II or BINDING SITE III of FIG. 8. Table 4 illustrates the complementarity of the nucleotide sequences of LOC152765 BINDING SITE, designated SEQ ID:18605, to the nucleotide sequence of GAM281 RNA, herein designated GAM RNA, also designated SEQ ID:278.

Another function of GAM281 is therefore inhibition of LOC152765 (Accession XP_087519.1). Accordingly, utilities of GAM281 include diagnosis, prevention and treatment of diseases and clinical conditions associated with LOC152765.

LOC152794 (Accession XP_087525.1) is another GAM281 target gene, herein designated TARGET GENE. LOC152794 BINDING SITE is a target binding site found in the 5' untranslated region of mRNA encoded by LOC152794, corresponding to a target binding site such as BINDING SITE I, BINDING SITE II or BINDING SITE III of FIG. 8. Table 4 illustrates the complementarity of the nucleotide sequences of LOC152794 BINDING SITE, designated SEQ ID:2010, to the nucleotide sequence of GAM281 RNA, herein designated GAM RNA, also designated SEQ ID:278.

Another function of GAM281 is therefore inhibition of LOC152794 (Accession XP_087525.1). Accordingly, utilities of GAM281 include diagnosis, prevention and treatment of diseases and clinical conditions associated with LOC152794.

LOC152804 (Accession XP_098266.2) is another GAM281 target gene, herein designated TARGET GENE. LOC152804 BINDING SITE is a target binding site found in the 3' untranslated region of mRNA encoded by LOC152804, corresponding to a target binding site such as BINDING SITE I, BINDING SITE II or BINDING SITE III of FIG. 8. Table 4 illustrates the complementarity of the nucleotide sequences of LOC152804 BINDING SITE, designated SEQ ID:9568, to the nucleotide sequence of GAM281 RNA, herein designated GAM RNA, also designated SEQ ID:278.

Another function of GAM281 is therefore inhibition of LOC152804 (Accession XP_098266.2). Accordingly, utilities of GAM281 include diagnosis, prevention and treatment of diseases and clinical conditions associated with LOC152804.

LOC153027 (Accession XP_041221.1) is another GAM281 target gene, herein designated TARGET GENE. LOC153027 BINDING SITE is a target binding site found in the 3' untranslated region of mRNA encoded by LOC153027, corresponding to a target binding site such as BINDING SITE I, BINDING SITE II or BINDING SITE III of FIG. 8. Table 4 illustrates the complementarity of the nucleotide sequences of LOC153027 BINDING SITE, designated SEQ ID:1646, to the nucleotide sequence of GAM281 RNA, herein designated GAM RNA, also designated SEQ ID:278.

Another function of GAM281 is therefore inhibition of LOC153027 (Accession XP_041221.1). Accordingly, utilities of GAM281 include diagnosis, prevention and treatment of diseases and clinical conditions associated with LOC153027.

LOC153077 (Accession XP_098307.1) is another GAM281 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:5304, to the nucleotide sequence of GAM281 RNA, herein designated GAM RNA, also designated SEQ ID:278.

Another function of GAM281 is therefore inhibition of LOC153077 (Accession XP_098307.1). Accordingly, utilities of GAM281 include diagnosis, prevention and treatment of diseases and clinical conditions associated with LOC153077.

LOC153811 (Accession XP_087779.2) is another GAM281 target gene, herein designated TARGET GENE. LOC153811 BINDING SITE1 through LOC153811 BINDING SITE4 are target binding sites found in untranslated regions of mRNA encoded by LOC153811, corresponding to target binding sites such as BINDING SITE I, BINDING SITE II or BINDING SITE III of FIG. 8. Table 4 illustrates the complementarity of the nucleotide sequences of LOC153811 BINDING SITE1 through LOC153811 BINDING SITE4, designated SEQ ID:19665, SEQ ID:9683, SEQ ID:9170 and SEQ ID:17512 respectively, to the nucleotide sequence of GAM281 RNA, herein designated GAM RNA, also designated SEQ ID:278.

Another function of GAM281 is therefore inhibition of LOC153811 (Accession XP_087779.2). Accordingly, utilities of GAM281 include diagnosis, prevention and treatment of diseases and clinical conditions associated with LOC153811.

LOC153883 (Accession XP_087798.1) is another GAM281 target gene, herein designated TARGET GENE. LOC153883 BINDING SITE is a target binding site found in the 5' untranslated region of mRNA encoded by LOC153883, corresponding to a target binding site such as BINDING SITE I, BINDING SITE II or BINDING SITE III of FIG. 8. Table 4 illustrates the complementarity of the nucleotide sequences of LOC153883 BINDING SITE, designated SEQ ID:15929, to the nucleotide sequence of GAM281 RNA, herein designated GAM RNA, also designated SEQ ID:278.

Another function of GAM281 is therefore inhibition of LOC153883 (Accession XP_087798.1). Accordingly, utilities of GAM281 include diagnosis, prevention and treatment of diseases and clinical conditions associated with LOC153883.

LOC153910 (Accession XP_087801.1) is another GAM281 target gene, herein designated TARGET GENE. LOC153910 BINDING SITE is a target binding site found in the 5' untranslated region of mRNA encoded by LOC153910, corresponding to a target binding site such as BINDING SITE I, BINDING SITE II or BINDING SITE III of FIG. 8. Table 4 illustrates the complementarity of the nucleotide sequences of LOC153910 BINDING SITE, designated SEQ ID:2882, to the nucleotide sequence of GAM281 RNA, herein designated GAM RNA, also designated SEQ ID:278.

Another function of GAM281 is therefore inhibition of LOC153910 (Accession XP_087801.1). Accordingly, utilities of GAM281 include diagnosis, prevention and treatment of diseases and clinical conditions associated with LOC153910.

LOC154282 (Accession XP_098505.1) is another GAM281 target gene, herein designated TARGET GENE. LOC154282 BINDING SITE is a target binding site found in the 5' untranslated region of mRNA encoded by LOC154282, corresponding to a target binding site such as BINDING SITE I, BINDING SITE II or BINDING SITE III of FIG. 8. Table 4 illustrates the complementarity of the nucleotide sequences of LOC154282 BINDING SITE, designated SEQ ID:4307, to the nucleotide sequence of GAM281 RNA, herein designated GAM RNA, also designated SEQ ID:278.

Another function of GAM281 is therefore inhibition of LOC154282 (Accession XP_098505.1). Accordingly, utilities of GAM281 include diagnosis, prevention and treatment of diseases and clinical conditions associated with LOC154282.

LOC154822 (Accession XP_098618.3) is another GAM281 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:19205, to the nucleotide sequence of GAM281 RNA, herein designated GAM RNA, also designated SEQ ID:278.

Another function of GAM281 is therefore inhibition of LOC154822 (Accession XP_098618.3). Accordingly, utilities of GAM281 include diagnosis, prevention and treatment of diseases and clinical conditions associated with LOC154822.

LOC154877 (Accession XP_098626.1) is another GAM281 target gene, herein designated TARGET GENE. LOC154877 BINDING SITE1 through LOC154877 BINDING SITE4 are target binding sites found in untranslated regions of mRNA encoded by LOC154877, corresponding to target binding sites such as BINDING SITE I, BINDING SITE II or BINDING SITE III of FIG. 8. Table 4 illustrates the complementarity of the nucleotide sequences of LOC154877 BINDING SITE1 through LOC154877 BINDING SITE4, designated SEQ ID:17731, SEQ ID:3200, SEQ ID:12700 and SEQ ID:16089 respectively, to the nucleotide sequence of GAM281 RNA, herein designated GAM RNA, also designated SEQ ID:278.

Another function of GAM281 is therefore inhibition of LOC154877 (Accession XP_098626.1). Accordingly, utilities of GAM281 include diagnosis, prevention and treatment of diseases and clinical conditions associated with LOC154877.

LOC155066 (Accession XP_088142.4) is another GAM281 target gene, herein designated TARGET GENE. LOC155066 BINDING SITE is a target binding site found in the 3' untranslated region of mRNA encoded by LOC155066, corresponding to a target binding site such as BINDING SITE I, BINDING SITE II or BINDING SITE III of FIG. 8. Table 4 illustrates the complementarity of the nucleotide sequences of LOC155066 BINDING SITE, designated SEQ ID:17980, to the nucleotide sequence of GAM281 RNA, herein designated GAM RNA, also designated SEQ ID:278.

Another function of GAM281 is therefore inhibition of LOC155066 (Accession XP_088142.4). Accordingly, utilities of GAM281 include diagnosis, prevention and treatment of diseases and clinical conditions associated with LOC155066.

LOC157931 (Accession XP_098845.1) is another GAM281 target gene, herein designated TARGET GENE. LOC157931 BINDING SITE is a target binding site found in the 3' untranslated region of mRNA encoded by LOC157931, corresponding to a target binding site such as BINDING SITE I, BINDING SITE II or BINDING SITE III of FIG. 8. Table 4 illustrates the complementarity of the nucleotide sequences of LOC157931 BINDING SITE, designated SEQ ID:9709, to the nucleotide sequence of GAM281 RNA, herein designated GAM RNA, also designated SEQ ID:278.

Another function of GAM281 is therefore inhibition of LOC157931 (Accession XP_098845.1). Accordingly, utilities of GAM281 include diagnosis, prevention and treatment of diseases and clinical conditions associated with LOC157931.

LOC158014 (Accession XP_088442.1) is another GAM281 target gene, herein designated TARGET GENE. LOC158014 BINDING SITE is a target binding site found in the 5' untranslated region of mRNA encoded by LOC158014, corresponding to a target binding site such as BINDING SITE I, BINDING SITE II or BINDING SITE III of FIG. 8. Table 4 illustrates the complementarity of the nucleotide sequences of LOC158014 BINDING SITE, designated SEQ ID:2542, to the nucleotide sequence of GAM281 RNA, herein designated GAM RNA, also designated SEQ ID:278.

Another function of GAM281 is therefore inhibition of LOC158014 (Accession XP_088442.1). Accordingly, utilities of GAM281 include diagnosis, prevention and treatment of diseases and clinical conditions associated with LOC158014.

LOC158228 (Accession XP_098903.4) is another GAM281 target gene, herein designated TARGET GENE. LOC158228 BINDING SITE is a target binding site found in the 3' untranslated region of mRNA encoded by LOC158228, corresponding to a target binding site such as BINDING SITE I, BINDING SITE II or BINDING SITE III of FIG. 8. Table 4 illustrates the complementarity of the nucleotide sequences of LOC158228 BINDING SITE, designated SEQ ID:5779, to the nucleotide sequence of GAM281 RNA, herein designated GAM RNA, also designated SEQ ID:278.

Another function of GAM281 is therefore inhibition of LOC158228 (Accession XP_098903.4). Accordingly, utilities of GAM281 include diagnosis, prevention and treatment of diseases and clinical conditions associated with LOC158228.

LOC158310 (Accession XP_098919.1) is another GAM281 target gene, herein designated TARGET GENE. LOC158310 BINDING SITE is a target binding site found in the 5' untranslated region of mRNA encoded by LOC158310, corresponding to a target binding site such as BINDING SITE I, BINDING SITE II or BINDING SITE III of FIG. 8. Table 4 illustrates the complementarity of the nucleotide sequences of LOC158310 BINDING SITE, designated SEQ ID:14859, to the nucleotide sequence of GAM281 RNA, herein designated GAM RNA, also designated SEQ ID:278.

Another function of GAM281 is therefore inhibition of LOC158310 (Accession XP_098919.1). Accordingly, utilities of GAM281 include diagnosis, prevention and treatment of diseases and clinical conditions associated with LOC158310.

LOC158402 (Accession XP_098936.1) is another GAM281 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:17964, to the nucleotide sequence of GAM281 RNA, herein designated GAM RNA, also designated SEQ ID:278.

Another function of GAM281 is therefore inhibition of LOC158402 (Accession XP_098936.1). Accordingly, utilities of GAM281 include diagnosis, prevention and treatment of diseases and clinical conditions associated with LOC158402.

LOC158436 (Accession XP_098942.1) is another GAM281 target gene, herein designated TARGET GENE. LOC158436 BINDING SITE is a target binding site found in the 3' untranslated region of mRNA encoded by LOC158436, corresponding to a target binding site such as BINDING SITE I, BINDING SITE II or BINDING SITE III of FIG. 8. Table 4 illustrates the complementarity of the nucleotide sequences of LOC158436 BINDING SITE, designated SEQ ID:1263, to the nucleotide sequence of GAM281 RNA, herein designated GAM RNA, also designated SEQ ID:278.

Another function of GAM281 is therefore inhibition of LOC158436 (Accession XP_098942.1). Accordingly, utilities of GAM281 include diagnosis, prevention and treatment of diseases and clinical conditions associated with LOC158436.

LOC158476 (Accession XP_098955.1) is another GAM281 target gene, herein designated TARGET GENE. LOC158476 BINDING SITE1 and LOC158476 BINDING SITE2 are target binding sites found in untranslated regions of mRNA encoded by LOC158476, corresponding to target binding sites such as BINDING SITE I, BINDING SITE II or BINDING SITE III of FIG. 8. Table 4 illustrates the complementarity of the nucleotide sequences of LOC158476 BINDING SITE1 and LOC158476 BINDING SITE2, designated SEQ ID:17016 and SEQ ID:935 respectively, to the nucleotide sequence of GAM281 RNA, herein designated GAM RNA, also designated SEQ ID:278.

Another function of GAM281 is therefore inhibition of LOC158476 (Accession XP_098955.1). Accordingly, utilities of GAM281 include diagnosis, prevention and treatment of diseases and clinical conditions associated with LOC158476.

LOC158563 (Accession XP_088606.1) is another GAM281 target gene, herein designated TARGET GENE. LOC158563 BINDING SITE is a target binding site found in the 5' untranslated region of mRNA encoded by LOC158563, corresponding to a target binding site such as BINDING SITE I, BINDING SITE II or BINDING SITE III of FIG. 8. Table 4 illustrates the complementarity of the nucleotide sequences of LOC158563 BINDING SITE, designated SEQ ID:3426, to the nucleotide sequence of GAM281 RNA, herein designated GAM RNA, also designated SEQ ID:278.

Another function of GAM281 is therefore inhibition of LOC158563 (Accession XP_088606.1). Accordingly, utilities of GAM281 include diagnosis, prevention and treatment of diseases and clinical conditions associated with LOC158563.

LOC158572 (Accession XP_088608.1) is another GAM281 target gene, herein designated TARGET GENE. LOC158572 BINDING SITE is a target binding site found in the 3' untranslated region of mRNA encoded by LOC158572, corresponding to a target binding site such as BINDING SITE I, BINDING SITE II or BINDING SITE III of FIG. 8. Table 4 illustrates the complementarity of the nucleotide sequences of LOC158572 BINDING SITE, designated SEQ ID:12003, to the nucleotide sequence of GAM281 RNA, herein designated GAM RNA, also designated SEQ ID:278.

Another function of GAM281 is therefore inhibition of LOC158572 (Accession XP_088608.1). Accordingly, utilities of GAM281 include diagnosis, prevention and treatment of diseases and clinical conditions associated with LOC158572.

LOC158668 (Accession XP_045161.1) is another GAM281 target gene, herein designated TARGET GENE. LOC158668 BINDING SITE is a target binding site found in the 3' untranslated region of mRNA encoded by LOC158668, corresponding to a target binding site such as BINDING SITE I, BINDING SITE II or BINDING SITE III of FIG. 8. Table 4 illustrates the complementarity of the nucleotide sequences of LOC158668 BINDING SITE, designated SEQ ID:16260, to the nucleotide sequence of GAM281 RNA, herein designated GAM RNA, also designated SEQ ID:278.

Another function of GAM281 is therefore inhibition of LOC158668 (Accession XP_045161.1). Accordingly, utilities of GAM281 include diagnosis, prevention and treatment of diseases and clinical conditions associated with LOC158668.

LOC160897 (Accession XP_090573.3) is another GAM281 target gene, herein designated TARGET GENE. LOC160897 BINDING SITE is a target binding site found in the 5' untranslated region of mRNA encoded by LOC160897, corresponding to a target binding site such as BINDING SITE I, BINDING SITE II or BINDING SITE III of FIG. 8. Table 4 illustrates the complementarity of the nucleotide sequences of LOC160897 BINDING SITE, designated SEQ ID:17208, to the nucleotide sequence of GAM281 RNA, herein designated GAM RNA, also designated SEQ ID:278.

Another function of GAM281 is therefore inhibition of LOC160897 (Accession XP_090573.3). Accordingly, utilities of GAM281 include diagnosis, prevention and treatment of diseases and clinical conditions associated with LOC160897.

LOC161247 (Accession XP_090783.3) is another GAM281 target gene, herein designated TARGET GENE. LOC161247 BINDING SITE is a target binding site found in the 5' untranslated region of mRNA encoded by LOC161247, corresponding to a target binding site such as BINDING SITE I, BINDING SITE II or BINDING SITE III of FIG. 8. Table 4 illustrates the complementarity of the nucleotide sequences of LOC161247 BINDING SITE, designated SEQ ID:16016, to the nucleotide sequence of GAM281 RNA, herein designated GAM RNA, also designated SEQ ID:278.

Another function of GAM281 is therefore inhibition of LOC161247 (Accession XP_090783.3). Accordingly, utilities of GAM281 include diagnosis, prevention and treatment of diseases and clinical conditions associated with LOC161247.

LOC162427 (Accession XP_091549.3) is another GAM281 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:12068 and SEQ ID:12068 respectively, to the nucleotide sequence of GAM281 RNA, herein designated GAM RNA, also designated SEQ ID:278.

Another function of GAM281 is therefore inhibition of LOC162427 (Accession XP_091549.3). Accordingly, utilities of GAM281 include diagnosis, prevention and treatment of diseases and clinical conditions associated with LOC162427.

LOC162427 (Accession NP_835227.1) is another GAM281 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:8231 and SEQ ID:8231 respectively, to the nucleotide sequence of GAM281 RNA, herein designated GAM RNA, also designated SEQ ID:278.

Another function of GAM281 is therefore inhibition of LOC162427 (Accession NP_835227.1). Accordingly, utilities of GAM281 include diagnosis, prevention and treatment of diseases and clinical conditions associated with LOC162427.

LOC162962 (Accession XP_091886.7) is another GAM281 target gene, herein designated TARGET GENE. LOC162962 BINDING SITE1 and LOC162962 BINDING SITE2 are target binding sites found in untranslated regions of mRNA encoded by LOC162962, corresponding to target binding sites such as BINDING SITE I, BINDING SITE II or BINDING SITE III of FIG. 8. Table 4 illustrates the complementarity of the nucleotide sequences of LOC162962 BINDING SITE1 and LOC162962 BINDING SITE2, designated SEQ ID:3249 and SEQ ID:13131 respectively, to the nucleotide sequence of GAM281 RNA, herein designated GAM RNA, also designated SEQ ID:278.

Another function of GAM281 is therefore inhibition of LOC162962 (Accession XP_091886.7). Accordingly, utilities of GAM281 include diagnosis, prevention and treatment of diseases and clinical conditions associated with LOC162962.

LOC162967 (Accession XP_091890.6) is another GAM281 target gene, herein designated TARGET GENE. LOC162967 BINDING SITE is a target binding site found in the 3' untranslated region of mRNA encoded by LOC162967, corresponding to a target binding site such as BINDING SITE I, BINDING SITE II or BINDING SITE III of FIG. 8. Table 4 illustrates the complementarity of the nucleotide sequences of LOC162967 BINDING SITE, designated SEQ ID:13831, to the nucleotide sequence of GAM281 RNA, herein designated GAM RNA, also designated SEQ ID:278.

Another function of GAM281 is therefore inhibition of LOC162967 (Accession XP_091890.6). Accordingly, utilities of GAM281 include diagnosis, prevention and treatment of diseases and clinical conditions associated with LOC162967.

LOC163227 (Accession NP_775802.1) is another GAM281 target gene, herein designated TARGET GENE. LOC163227 BINDING SITE1 and LOC163227 BINDING SITE2 are target binding sites found in untranslated regions of mRNA encoded by LOC163227, corresponding to target binding sites such as BINDING SITE I, BINDING SITE II or BINDING SITE III of FIG. 8. Table 4 illustrates the complementarity of the nucleotide sequences of LOC163227 BINDING SITE1 and LOC163227 BINDING SITE2, designated SEQ ID:11854 and SEQ ID:9147 respectively, to the nucleotide sequence of GAM281 RNA, herein designated GAM RNA, also designated SEQ ID:278.

Another function of GAM281 is therefore inhibition of LOC163227 (Accession NP_775802.1). Accordingly, utilities of GAM281 include diagnosis, prevention and treatment of diseases and clinical conditions associated with LOC163227.

LOC164091 (Accession XP_089356.1) is another GAM281 target gene, herein designated TARGET GENE. LOC164091 BINDING SITE is a target binding site found in the 3' untranslated region of mRNA encoded by LOC164091, corresponding to a target binding site such as BINDING SITE I, BINDING SITE II or BINDING SITE III of FIG. 8. Table 4 illustrates the complementarity of the nucleotide sequences of LOC164091 BINDING SITE, designated SEQ ID:7989, to the nucleotide sequence of GAM281 RNA, herein designated GAM RNA, also designated SEQ ID:278.

Another function of GAM281 is therefore inhibition of LOC164091 (Accession XP_089356.1). Accordingly, utilities of GAM281 include diagnosis, prevention and treatment of diseases and clinical conditions associated with LOC164091.

LOC168002 (Accession XP_094794.2) is another GAM281 target gene, herein designated TARGET GENE. LOC168002 BINDING SITE is a target binding site found in the 3' untranslated region of mRNA encoded by LOC168002, corresponding to a target binding site such as BINDING SITE I, BINDING SITE II or BINDING SITE III of FIG. 8. Table 4 illustrates the complementarity of the nucleotide sequences of LOC168002 BINDING SITE, designated SEQ ID:3971, to the nucleotide sequence of GAM281 RNA, herein designated GAM RNA, also designated SEQ ID:278.

Another function of GAM281 is therefore inhibition of LOC168002 (Accession XP_094794.2). Accordingly, utilities of GAM281 include diagnosis, prevention and treatment of diseases and clinical conditions associated with LOC168002.

LOC168451 (Accession XP_095114.2) is another GAM281 target gene, herein designated TARGET GENE. LOC168451 BINDING SITE is a target binding site found in the 3' untranslated region of mRNA encoded by LOC168451, corresponding to a target binding site such as BINDING SITE I, BINDING SITE II or BINDING SITE III of FIG. 8. Table 4 illustrates the complementarity of the nucleotide sequences of LOC168451 BINDING SITE, designated SEQ ID:19786, to the nucleotide sequence of GAM281 RNA, herein designated GAM RNA, also designated SEQ ID:278.

Another function of GAM281 is therefore inhibition of LOC168451 (Accession XP_095114.2). Accordingly, utilities of GAM281 include diagnosis, prevention and treatment of diseases and clinical conditions associated with LOC168451.

LOC170409 (Accession XP_096330.1) is another GAM281 target gene, herein designated TARGET GENE. LOC170409 BINDING SITE is a target binding site found in the 5' untranslated region of mRNA encoded by LOC170409, corresponding to a target binding site such as BINDING SITE I, BINDING SITE II or BINDING SITE III of FIG. 8. Table 4 illustrates the complementarity of the nucleotide sequences of LOC170409 BINDING SITE, designated SEQ ID:15561, to the nucleotide sequence of GAM281 RNA, herein designated GAM RNA, also designated SEQ ID:278.

Another function of GAM281 is therefore inhibition of LOC170409 (Accession XP_096330.1). Accordingly, utilities of GAM281 include diagnosis, prevention and treatment of diseases and clinical conditions associated with LOC170409.

LOC196264 (Accession XP_113683.1) is another GAM281 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:2452, to the nucleotide sequence of GAM281 RNA, herein designated GAM RNA, also designated SEQ ID:278.

Another function of GAM281 is therefore inhibition of LOC196264 (Accession XP_113683.1). Accordingly, utilities of GAM281 include diagnosis, prevention and treatment of diseases and clinical conditions associated with LOC196264.

LOC197358 (Accession XP_113872.2) is another GAM281 target gene, herein designated TARGET GENE. LOC197358 BINDING SITE1 and LOC197358 BINDING SITE2 are target binding sites found in untranslated regions of mRNA encoded by LOC197358, corresponding to target binding sites such as BINDING SITE I, BINDING SITE II or BINDING SITE III of FIG. 8. Table 4 illustrates the complementarity of the nucleotide sequences of LOC197358 BINDING SITE1 and LOC197358 BINDING SITE2, designated SEQ ID:6387 and SEQ ID:4625 respectively, to the nucleotide sequence of GAM281 RNA, herein designated GAM RNA, also designated SEQ ID:278.

Another function of GAM281 is therefore inhibition of LOC197358 (Accession XP_113872.2). Accordingly, utilities of GAM281 include diagnosis, prevention and treatment of diseases and clinical conditions associated with LOC197358.

LOC199725 (Accession XP_117119.1) is another GAM281 target gene, herein designated TARGET GENE. LOC199725 BINDING SITE is a target binding site found in the 5' untranslated region of mRNA encoded by LOC199725, corresponding to a target binding site such as BINDING SITE I, BINDING SITE II or BINDING SITE III of FIG. 8. Table 4 illustrates the complementarity of the nucleotide sequences of LOC199725 BINDING SITE, designated SEQ ID:10884, to the nucleotide sequence of GAM281 RNA, herein designated GAM RNA, also designated SEQ ID:278.

Another function of GAM281 is therefore inhibition of LOC199725 (Accession XP_117119.1). Accordingly, utilities of GAM281 include diagnosis, prevention and treatment of diseases and clinical conditions associated with LOC199725.

LOC199899 (Accession XP_117153.1) is another GAM281 target gene, herein designated TARGET GENE. LOC199899 BINDING SITE1 and LOC199899 BINDING SITE2 are target binding sites found in untranslated regions of mRNA encoded by LOC199899, corresponding to target binding sites such as BINDING SITE I, BINDING SITE II or BINDING SITE III of FIG. 8. Table 4 illustrates the complementarity of the nucleotide sequences of LOC199899 BINDING SITE1 and LOC199899 BINDING SITE2, designated SEQ ID:5253 and SEQ ID:8292 respectively, to the nucleotide sequence of GAM281 RNA, herein designated GAM RNA, also designated SEQ ID:278.

Another function of GAM281 is therefore inhibition of LOC199899 (Accession XP_117153.1). Accordingly, utilities of GAM281 include diagnosis, prevention and treatment of diseases and clinical conditions associated with LOC199899.

LOC199906 (Accession XP_114052.1) is another GAM281 target gene, herein designated TARGET GENE. LOC199906 BINDING SITE is a target binding site found in the 3' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:19756, to the nucleotide sequence of GAM281 RNA, herein designated GAM RNA, also designated SEQ ID:278.

Another function of GAM281 is therefore inhibition of LOC199906 (Accession XP_114052.1). Accordingly, utilities of GAM281 include diagnosis, prevention and treatment of diseases and clinical conditions associated with LOC199906.

LOC200169 (Accession XP_117200.1) is another GAM281 target gene, herein designated TARGET GENE. LOC200169 BINDING SITE1 and LOC200169 BINDING SITE2 are target binding sites found in untranslated regions of multiple transcripts of mRNA encoded by LOC200169, corresponding to target binding sites such as BINDING SITE I, BINDING SITE II or BINDING SITE III of FIG. 8. Table 4 illustrates the complementarity of the nucleotide sequences of LOC200169 BINDING SITE1 and LOC200169 BINDING SITE2, designated SEQ ID:6122 and SEQ ID:5066 respectively, to the nucleotide sequence of GAM281 RNA, herein designated GAM RNA, also designated SEQ ID:278.

Another function of GAM281 is therefore inhibition of LOC200169 (Accession XP_117200.1). Accordingly, utilities of GAM281 include diagnosis, prevention and treatment of diseases and clinical conditions associated with LOC200169.

LOC200860 (Accession XP_117289.1) is another GAM281 target gene, herein designated TARGET GENE. LOC200860 BINDING SITE1 and LOC200860 BINDING SITE2 are target binding sites found in untranslated regions of mRNA encoded by LOC200860, corresponding to target binding sites such as BINDING SITE I, BINDING SITE II or BINDING SITE III of FIG. 8. Table 4 illustrates the complementarity of the nucleotide sequences of LOC200860 BINDING SITE1 and LOC200860 BINDING SITE2, designated SEQ ID:4175 and SEQ ID:12075 respectively, to the nucleotide sequence of GAM281 RNA, herein designated GAM RNA, also designated SEQ ID:278.

Another function of GAM281 is therefore inhibition of LOC200860 (Accession XP_117289.1). Accordingly, utilities of GAM281 include diagnosis, prevention and treatment of diseases and clinical conditions associated with LOC200860.

LOC200895 (Accession NP_789785.1) is another GAM281 target gene, herein designated TARGET GENE. LOC200895 BINDING SITE1 and LOC200895 BINDING SITE2 are target binding sites found in untranslated regions of mRNA encoded by LOC200895, corresponding to target binding sites such as BINDING SITE I, BINDING SITE II or BINDING SITE III of FIG. 8. Table 4 illustrates the complementarity of the nucleotide sequences of LOC200895 BINDING SITE1 and LOC200895 BINDING SITE2, designated SEQ ID:17681 and SEQ ID:11863 respectively, to the nucleotide sequence of GAM281 RNA, herein designated GAM RNA, also designated SEQ ID:278.

Another function of GAM281 is therefore inhibition of LOC200895 (Accession NP_789785.1). Accordingly, utilities of GAM281 include diagnosis, prevention and treatment of diseases and clinical conditions associated with LOC200895.

LOC200916 (Accession XP_114317.3) is another GAM281 target gene, herein designated TARGET GENE. LOC200916 BINDING SITE is a target binding site found in the 3' untranslated region of mRNA encoded by LOC200916, corresponding to a target binding site such as BINDING SITE I, BINDING SITE II or BINDING SITE III of FIG. 8. Table 4 illustrates the complementarity of the nucleotide sequences of LOC200916 BINDING SITE, designated SEQ ID:3465, to the nucleotide sequence of GAM281 RNA, herein designated GAM RNA, also designated SEQ ID:278.

Another function of GAM281 is therefore inhibition of LOC200916 (Accession XP_114317.3). Accordingly, utilities of GAM281 include diagnosis, prevention and treatment of diseases and clinical conditions associated with LOC200916.

LOC201164 (Accession NP_849158.1) is another GAM281 target gene, herein designated TARGET GENE. LOC201164 BINDING SITE1 and LOC201164 BINDING SITE2 are target binding sites found in untranslated regions of multiple transcripts of mRNA encoded by LOC201164, corresponding to target binding sites such as BINDING SITE I, BINDING SITE II or BINDING SITE III of FIG. 8. Table 4 illustrates the complementarity of the nucleotide sequences of LOC201164 BINDING SITE1 and LOC201164 BINDING SITE2, designated SEQ ID:16993 and SEQ ID:13384 respectively, to the nucleotide sequence of GAM281 RNA, herein designated GAM RNA, also designated SEQ ID:278.

Another function of GAM281 is therefore inhibition of LOC201164 (Accession NP_849158.1). Accordingly, utilities of GAM281 include diagnosis, prevention and treatment of diseases and clinical conditions associated with LOC201164.

LOC201292 (Accession NP_775818.1) is another GAM281 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:4556, to the nucleotide sequence of GAM281 RNA, herein designated GAM RNA, also designated SEQ ID:278.

Another function of GAM281 is therefore inhibition of LOC201292 (Accession NP_775818.1). Accordingly, utilities of GAM281 include diagnosis, prevention and treatment of diseases and clinical conditions associated with LOC201292.

LOC201562 (Accession XP_114343.2) is another GAM281 target gene, herein designated TARGET GENE. LOC201562 BINDING SITE is a target binding site found in the 3' untranslated region of mRNA encoded by LOC201562, corresponding to a target binding site such as BINDING SITE I, BINDING SITE II or BINDING SITE III of FIG. 8. Table 4 illustrates the complementarity of the nucleotide sequences of LOC201562 BINDING SITE, designated SEQ ID:15044, to the nucleotide sequence of GAM281 RNA, herein designated GAM RNA, also designated SEQ ID:278.

Another function of GAM281 is therefore inhibition of LOC201562 (Accession XP_114343.2). Accordingly, utilities of GAM281 include diagnosis, prevention and treatment of diseases and clinical conditions associated with LOC201562.

LOC201725 (Accession XP_114370.1) is another GAM281 target gene, herein designated TARGET GENE. LOC201725 BINDING SITE is a target binding site found in the 3' untranslated region of mRNA encoded by LOC201725, corresponding to a target binding site such as BINDING SITE I, BINDING SITE II or BINDING SITE III of FIG. 8. Table 4 illustrates the complementarity of the nucleotide sequences of LOC201725 BINDING SITE, designated SEQ ID:5492, to the nucleotide sequence of GAM281 RNA, herein designated GAM RNA, also designated SEQ ID:278.

Another function of GAM281 is therefore inhibition of LOC201725 (Accession XP_114370.1). Accordingly, utilities of GAM281 include diagnosis, prevention and treatment of diseases and clinical conditions associated with LOC201725.

LOC202400 (Accession XP_117397.1) is another GAM281 target gene, herein designated TARGET GENE. LOC202400 BINDING SITE is a target binding site found in the 5' untranslated region of mRNA encoded by LOC202400, corresponding to a target binding site such as BINDING SITE I, BINDING SITE II or BINDING SITE III of FIG. 8. Table 4 illustrates the complementarity of the nucleotide sequences of LOC202400 BINDING SITE, designated SEQ ID:9145, to the nucleotide sequence of GAM281 RNA, herein designated GAM RNA, also designated SEQ ID:278.

Another function of GAM281 is therefore inhibition of LOC202400 (Accession XP_117397.1). Accordingly, utilities of GAM281 include diagnosis, prevention and treatment of diseases and clinical conditions associated with LOC202400.

LOC202404 (Accession XP_114481.4) is another GAM281 target gene, herein designated TARGET GENE. LOC202404 BINDING SITE is a target binding site found in the 3' untranslated region of mRNA encoded by LOC202404, corresponding to a target binding site such as BINDING SITE I, BINDING SITE II or BINDING SITE III of FIG. 8. Table 4 illustrates the complementarity of the nucleotide sequences of LOC202404 BINDING SITE, designated SEQ ID:18628, to the nucleotide sequence of GAM281 RNA, herein designated GAM RNA, also designated SEQ ID:278.

Another function of GAM281 is therefore inhibition of LOC202404 (Accession XP_114481.4). Accordingly, utilities of GAM281 include diagnosis, prevention and treatment of diseases and clinical conditions associated with LOC202404.

LOC202460 (Accession XP_114493.1) is another GAM281 target gene, herein designated TARGET GENE. LOC202460 BINDING SITE1 and LOC202460 BINDING SITE2 are target binding sites found in untranslated regions of mRNA encoded by LOC202460, corresponding to target binding sites such as BINDING SITE I, BINDING SITE II or BINDING SITE III of FIG. 8. Table 4 illustrates the complementarity of the nucleotide sequences of LOC202460 BINDING SITE1 and LOC202460 BINDING SITE2, designated SEQ ID:16450 and SEQ ID:11010 respectively, to the nucleotide sequence of GAM281 RNA, herein designated GAM RNA, also designated SEQ ID:278.

Another function of GAM281 is therefore inhibition of LOC202460 (Accession XP_114493.1). Accordingly, utilities of GAM281 include diagnosis, prevention and treatment of diseases and clinical conditions associated with LOC202460.

LOC202934 (Accession XP_117486.2) is another GAM281 target gene, herein designated TARGET GENE. LOC202934 BINDING SITE1 and LOC202934 BINDING SITE2 are target binding sites found in untranslated regions of mRNA encoded by LOC202934, corresponding to target binding sites such as BINDING SITE I, BINDING SITE II or BINDING SITE III of FIG. 8. Table 4 illustrates the complementarity of the nucleotide sequences of LOC202934 BINDING SITE1 and LOC202934 BINDING SITE2, designated SEQ ID:4820 and SEQ ID:1729 respectively, to the nucleotide sequence of GAM281 RNA, herein designated GAM RNA, also designated SEQ ID:278.

Another function of GAM281 is therefore inhibition of LOC202934 (Accession XP_117486.2). Accordingly, utilities of GAM281 include diagnosis, prevention and treatment of diseases and clinical conditions associated with LOC202934.

LOC203547 (Accession XP_114719.1) is another GAM281 target gene, herein designated TARGET GENE. LOC203547 BINDING SITE1 and LOC203547 BINDING SITE2 are target binding sites found in untranslated regions of mRNA encoded by LOC203547, corresponding to target binding sites such as BINDING SITE I, BINDING SITE II or BINDING SITE III of FIG. 8. Table 4 illustrates the complementarity of the nucleotide sequences of LOC203547 BINDING SITE1 and LOC203547 BINDING SITE2, designated SEQ ID:9545 and SEQ ID:2351 respectively, to the nucleotide sequence of GAM281 RNA, herein designated GAM RNA, also designated SEQ ID:278.

Another function of GAM281 is therefore inhibition of LOC203547 (Accession XP_114719.1). Accordingly, utilities of GAM281 include diagnosis, prevention and treatment of diseases and clinical conditions associated with LOC203547.

LOC204288 (Accession XP_115295.1) is another GAM281 target gene, herein designated TARGET GENE. LOC204288 BINDING SITE is a target binding site found in the 3' untranslated region of mRNA encoded by LOC204288, corresponding to a target binding site such as BINDING SITE I, BINDING SITE II or BINDING SITE III of FIG. 8. Table 4 illustrates the complementarity of the nucleotide sequences of LOC204288 BINDING SITE, designated SEQ ID:10724, to the nucleotide sequence of GAM281 RNA, herein designated GAM RNA, also designated SEQ ID:278.

Another function of GAM281 is therefore inhibition of LOC204288 (Accession XP_115295.1). Accordingly, utilities of GAM281 include diagnosis, prevention and treatment of diseases and clinical conditions associated with LOC204288.

LOC219293 (Accession XP_166599.2) is another GAM281 target gene, herein designated TARGET GENE. LOC219293 BINDING SITE is a target binding site found in the 3' untranslated region of mRNA encoded by LOC219293, corresponding to a target binding site such as BINDING SITE I, BINDING SITE II or BINDING SITE III of FIG. 8. Table 4 illustrates the complementarity of the nucleotide sequences of LOC219293 BINDING SITE, designated SEQ ID:19361, to the nucleotide sequence of GAM281 RNA, herein designated GAM RNA, also designated SEQ ID:278.

Another function of GAM281 is therefore inhibition of LOC219293 (Accession XP_166599.2). Accordingly, utilities of GAM281 include diagnosis, prevention and treatment of diseases and clinical conditions associated with LOC219293.

LOC219700 (Accession XP_167570.1) is another GAM281 target gene, herein designated TARGET GENE. LOC219700 BINDING SITE is a target binding site found in the 5' untranslated region of mRNA encoded by LOC219700, corresponding to a target binding site such as BINDING SITE I, BINDING SITE II or BINDING SITE III of FIG. 8. Table 4 illustrates the complementarity of the nucleotide sequences of LOC219700 BINDING SITE, designated SEQ ID:2410, to the nucleotide sequence of GAM281 RNA, herein designated GAM RNA, also designated SEQ ID:278.

Another function of GAM281 is therefore inhibition of LOC219700 (Accession XP_167570.1). Accordingly, utilities of GAM281 include diagnosis, prevention and treatment of diseases and clinical conditions associated with LOC219700.

LOC219731 (Accession XP_167596.1) is another GAM281 target gene, herein designated TARGET GENE. LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:4678, to the nucleotide sequence of GAM281 RNA, herein designated GAM RNA, also designated SEQ ID:278.

Another function of GAM281 is therefore inhibition of LOC219731 (Accession XP_167596.1). Accordingly, utilities of GAM281 include diagnosis, prevention and treatment of diseases and clinical conditions associated with LOC219731.

LOC219735 (Accession XP_167601.1) is another GAM281 target gene, herein designated TARGET GENE. LOC219735 BINDING SITE is a target binding site found in the 3' untranslated region of mRNA encoded by LOC219735, corresponding to a target binding site such as BINDING SITE I, BINDING SITE II or BINDING SITE III of FIG. 8. Table 4 illustrates the complementarity of the nucleotide sequences of LOC219735 BINDING SITE, designated SEQ ID:18913, to the nucleotide sequence of GAM281 RNA, herein designated GAM RNA, also designated SEQ ID:278.

Another function of GAM281 is therefore inhibition of LOC219735 (Accession XP_167601.1). Accordingly, utilities of GAM281 include diagnosis, prevention and treatment of diseases and clinical conditions associated with LOC219735.

LOC219894 (Accession XP_167782.1) is another GAM281 target gene, herein designated TARGET GENE. LOC219894 BINDING SITE is a target binding site found in the 3' untranslated region of mRNA encoded by LOC219894, corresponding to a target binding site such as BINDING SITE I, BINDING SITE II or BINDING SITE III of FIG. 8. Table 4 illustrates the complementarity of the nucleotide sequences of LOC219894 BINDING SITE, designated SEQ ID:14588, to the nucleotide sequence of GAM281 RNA, herein designated GAM RNA, also designated SEQ ID:278.

Another function of GAM281 is therefore inhibition of LOC219894 (Accession XP_167782.1). Accordingly, utilities of GAM281 include diagnosis, prevention and treatment of diseases and clinical conditions associated with LOC219894.

LOC220074 (Accession NP_660352.1) is another GAM281 target gene, herein designated TARGET GENE. LOC220074 BINDING SITE1 through LOC220074 BINDING SITE3 are target binding sites found in untranslated regions of mRNA encoded by LOC220074, corresponding to target binding sites such as BINDING SITE I, BINDING SITE II or BINDING SITE III of FIG. 8. Table 4 illustrates the complementarity of the nucleotide sequences of LOC220074 BINDING SITE1 through LOC220074 BINDING SITE3, designated SEQ ID:6497, SEQ ID:9147 and SEQ ID:16838 respectively, to the nucleotide sequence of GAM281 RNA, herein designated GAM RNA, also designated SEQ ID:278.

Another function of GAM281 is therefore inhibition of LOC220074 (Accession NP_660352.1). Accordingly, utilities of GAM281 include diagnosis, prevention and treatment of diseases and clinical conditions associated with LOC220074.

LOC221663 (Accession XP_168131.1) is another GAM281 target gene, herein designated TARGET GENE. LOC221663 BINDING SITE is a target binding site found in the 5' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:1939, to the nucleotide sequence of GAM281 RNA, herein designated GAM RNA, also designated SEQ ID:278.

Another function of GAM281 is therefore inhibition of LOC221663 (Accession XP_168131.1). Accordingly, utilities of GAM281 include diagnosis, prevention and treatment of diseases and clinical conditions associated with LOC221663.

LOC221889 (Accession XP_166513.1) is another GAM281 target gene, herein designated TARGET GENE. LOC221889 BINDING SITE is a target binding site found in the 3' untranslated region of mRNA encoded by LOC221889, corresponding to a target binding site such as BINDING SITE I, BINDING SITE II or BINDING SITE III of FIG. 8. Table 4 illustrates the complementarity of the nucleotide sequences of LOC221889 BINDING SITE, designated SEQ ID:3555, to the nucleotide sequence of GAM281 RNA, herein designated GAM RNA, also designated SEQ ID:278.

Another function of GAM281 is therefore inhibition of LOC221889 (Accession XP_166513.1). Accordingly, utilities of GAM281 include diagnosis, prevention and treatment of diseases and clinical conditions associated with LOC221889.

LOC221946 (Accession XP_168340.1) is another GAM281 target gene, herein designated TARGET GENE. LOC221946 BINDING SITE is a target binding site found in the 3' untranslated region of mRNA encoded by LOC221946, corresponding to a target binding site such as BINDING SITE I, BINDING SITE II or BINDING SITE III of FIG. 8. Table 4 illustrates the complementarity of the nucleotide sequences of LOC221946 BINDING SITE, designated SEQ ID:15948, to the nucleotide sequence of GAM281 RNA, herein designated GAM RNA, also designated SEQ ID:278.

Another function of GAM281 is therefore inhibition of LOC221946 (Accession XP_168340.1). Accordingly, utilities of GAM281 include diagnosis, prevention and treatment of diseases and clinical conditions associated with LOC221946.

LOC221960 (Accession XP_165859.1) is another GAM281 target gene, herein designated TARGET GENE. LOC221960 BINDING SITE is a target binding site found in the 3' untranslated region of mRNA encoded by LOC221960, corresponding to a target binding site such as BINDING SITE I, BINDING SITE II or BINDING SITE III of FIG. 8. Table 4 illustrates the complementarity of the nucleotide sequences of LOC221960 BINDING SITE, designated SEQ ID:14860, to the nucleotide sequence of GAM281 RNA, herein designated GAM RNA, also designated SEQ ID:278.

Another function of GAM281 is therefore inhibition of LOC221960 (Accession XP_165859.1). Accordingly, utilities of GAM281 include diagnosis, prevention and treatment of diseases and clinical conditions associated with LOC221960.

LOC221964 (Accession XP_168342.1) is another GAM281 target gene, herein designated TARGET GENE. LOC221964 BINDING SITE is a target binding site found in the 3' untranslated region of mRNA encoded by LOC221964, corresponding to a target binding site such as BINDING SITE I, BINDING SITE II or BINDING SITE III of FIG. 8. Table 4 illustrates the complementarity of the nucleotide sequences of LOC221964 BINDING SITE, designated SEQ ID:17029, to the nucleotide sequence of GAM281 RNA, herein designated GAM RNA, also designated SEQ ID:278.

Another function of GAM281 is therefore inhibition of LOC221964 (Accession XP_168342.1). Accordingly, utilities of GAM281 include diagnosis, prevention and treatment of diseases and clinical conditions associated with LOC221964.

LOC222031 (Accession XP_168371.1) is another GAM281 target gene, herein designated TARGET GENE. LOC222031 BINDING SITE is a target binding site found in the 5' untranslated region of mRNA encoded by LOC222031, corresponding to a target binding site such as BINDING SITE I, BINDING SITE II or BINDING SITE III of FIG. 8. Table 4 illustrates the complementarity of the nucleotide sequences of LOC222031 BINDING SITE, designated SEQ ID:7700, to the nucleotide sequence of GAM281 RNA, herein designated GAM RNA, also designated SEQ ID:278.

Another function of GAM281 is therefore inhibition of LOC222031 (Accession XP_168371.1). Accordingly, utilities of GAM281 include diagnosis, prevention and treatment of diseases and clinical conditions associated with LOC222031.

LOC222057 (Accession XP_166594.2) is another GAM281 target gene, herein designated TARGET GENE. LOC222057 BINDING SITE is a target binding site found in the 5' untranslated region of mRNA encoded by LOC222057, corresponding to a target binding site such as BINDING SITE I, BINDING SITE II or BINDING SITE III of FIG. 8. Table 4 illustrates the complementarity of the nucleotide sequences of LOC222057 BINDING SITE, designated SEQ ID:12803, to the nucleotide sequence of GAM281 RNA, herein designated GAM RNA, also designated SEQ ID:278.

Another function of GAM281 is therefore inhibition of LOC222057 (Accession XP_166594.2). Accordingly, utilities of GAM281 include diagnosis, prevention and treatment of diseases and clinical conditions associated with LOC222057.

LOC222068 (Accession XP_166556.1) is another GAM281 target gene, herein designated TARGET GENE. LOC222068 BINDING SITE is a target binding site found in the 3' untranslated region of mRNA encoded by LOC222068, corresponding to a target binding site such as BINDING SITE I, BINDING SITE II or BINDING SITE III of FIG. 8. Table 4 illustrates the complementarity of the nucleotide sequences of LOC222068 BINDING SITE, designated SEQ ID:3232, to the nucleotide sequence of GAM281 RNA, herein designated GAM RNA, also designated SEQ ID:278.

Another function of GAM281 is therefore inhibition of LOC222068 (Accession XP_166556.1). Accordingly, utilities of GAM281 include diagnosis, prevention and treatment of diseases and clinical conditions associated with LOC222068.

LOC222159 (Accession XP_212100.1) is another GAM281 target gene, herein designated TARGET GENE. LOC222159 BINDING SITE is a target binding site found in the 5' untranslated region of multiple transcripts of mRNA encoded by LOC222159, corresponding to a target binding site such as BINDING SITE I, BINDING SITE II or BINDING SITE III of FIG. 8. Table 4 illustrates the complementarity of the nucleotide sequences of LOC222159 BINDING SITE, designated SEQ ID:16228, to the nucleotide sequence of GAM281 RNA, herein designated GAM RNA, also designated SEQ ID:278.

Another function of GAM281 is therefore inhibition of LOC222159 (Accession XP_212100.1). Accordingly, utilities of GAM281 include diagnosis, prevention and treatment of diseases and clinical conditions associated with LOC222159.

LOC253612 (Accession XP_172985.2) is another GAM281 target gene, herein designated TARGET GENE. LOC253612 BINDING SITE is a target binding site found in the 5' untranslated region of mRNA encoded by LOC253612, corresponding to a target binding site such as BINDING SITE I, BINDING SITE II or BINDING SITE III of FIG. 8. Table 4 illustrates the complementarity of the nucleotide sequences of LOC253612 BINDING SITE, designated SEQ ID:5487, to the nucleotide sequence of GAM281 RNA, herein designated GAM RNA, also designated SEQ ID:278.

Another function of GAM281 is therefore inhibition of LOC253612 (Accession XP_172985.2). Accordingly, utilities of GAM281 include diagnosis, prevention and treatment of diseases and clinical conditions associated with LOC253612.

LOC253805 (Accession XP_172854.1) is another GAM281 target gene, herein designated TARGET GENE. LOC253805 BINDING SITE is a target binding site found in the 3' untranslated region of mRNA encoded by LOC253805, corresponding to a target binding site such as BINDING SITE I, BINDING SITE II or BINDING SITE III of FIG. 8. Table 4 illustrates the complementarity of the nucleotide sequences of LOC253805 BINDING SITE, designated SEQ ID:4532, to the nucleotide sequence of GAM281 RNA, herein designated GAM RNA, also designated SEQ ID:278.

Another function of GAM281 is therefore inhibition of LOC253805 (Accession XP_172854.1). Accordingly, utilities of GAM281 include diagnosis, prevention and treatment of diseases and clinical conditions associated with LOC253805.

LOC253992 (Accession XP_172953.2) is another GAM281 target gene, herein designated TARGET GENE. LOC253992 BINDING SITE is a target binding site found in the 5' untranslated region of mRNA encoded by LOC253992, corresponding to a target binding site such as BINDING SITE I, BINDING SITE II or BINDING SITE III of FIG. 8. Table 4 illustrates the complementarity of the nucleotide sequences of LOC253992 BINDING SITE, designated SEQ ID:3617, to the nucleotide sequence of GAM281 RNA, herein designated GAM RNA, also designated SEQ ID:278.

Another function of GAM281 is therefore inhibition of LOC253992 (Accession XP_172953.2). Accordingly, utilities of GAM281 include diagnosis, prevention and treatment of diseases and clinical conditions associated with LOC253992.

LOC254875 (Accession XP_171170.1) is another GAM281 target gene, herein designated TARGET GENE. LOC254875 BINDING SITE1 and LOC254875 BINDING SITE2 are target binding sites found in untranslated regions of mRNA encoded by LOC254875, corresponding to target binding sites such as BINDING SITE I, BINDING SITE II or BINDING SITE III of FIG. 8. Table 4 illustrates the complementarity of the nucleotide sequences of LOC254875BINDING SITE1 and LOC254875 BINDING SITE2, designated SEQ ID:14560 and SEQ ID:6188 respectively, to the nucleotide sequence of GAM281 RNA, herein designated GAM RNA, also designated SEQ ID:278.

Another function of GAM281 is therefore inhibition of LOC254875 (Accession XP_171170.1). Accordingly, utilities of GAM281 include diagnosis, prevention and treatment of diseases and clinical conditions associated with LOC254875.

LOC255031 (Accession XP_173187.1) is another GAM281 target gene, herein designated TARGET GENE. LOC255031 BINDING SITE1 and LOC255031 BINDING SITE2 are target binding sites found in untranslated regions of mRNA encoded by LOC255031, corresponding to target binding sites such as BINDING SITE I, BINDING SITE II or BINDING SITE III of FIG. 8. Table 4 illustrates the complementarity of the nucleotide sequences of LOC255031 BINDING SITE1 and LOC255031 BINDING SITE2, designated SEQ ID:13629 and SEQ ID:3261 respectively, to the nucleotide sequence of GAM281 RNA, herein designated GAM RNA, also designated SEQ ID:278.

Another function of GAM281 is therefore inhibition of LOC255031 (Accession XP_173187.1). Accordingly, utilities of GAM281 include diagnosis, prevention and treatment of diseases and clinical conditions associated with LOC255031.

LOC255177 (Accession XP_172941.1) is another GAM281 target gene, herein designated TARGET GENE. LOC255177 BINDING SITE is a target binding site found in the 3' untranslated region of mRNA encoded by LOC255177, corresponding to a target binding site such as BINDING SITE I, BINDING SITE II or BINDING SITE III of FIG. 8. Table 4 illustrates the complementarity of the nucleotide sequences of LOC255177 BINDING SITE, designated SEQ ID:6294, to the nucleotide sequence of GAM281 RNA, herein designated GAM RNA, also designated SEQ ID:278.

Another function of GAM281 is therefore inhibition of LOC255177 (Accession XP_172941.1). Accordingly, utilities of GAM281 include diagnosis, prevention and treatment of diseases and clinical conditions associated with LOC255177.

LOC255458 (Accession XP_173150.1) is another GAM281 target gene, herein designated TARGET GENE. LOC255458 BINDING SITE is a target binding site found in the 5' untranslated region of mRNA encoded by LOC255458, corresponding to a target binding site such as BINDING SITE I, BINDING SITE II or BINDING SITE III of FIG. 8. Table 4 illustrates the complementarity of the nucleotide sequences of LOC255458 BINDING SITE, designated SEQ ID:6365, to the nucleotide sequence of GAM281 RNA, herein designated GAM RNA, also designated SEQ ID:278.

Another function of GAM281 is therefore inhibition of LOC255458 (Accession XP_173150.1). Accordingly, utilities of GAM281 include diagnosis, prevention and treatment of diseases and clinical conditions associated with LOC255458.

LOC255488 (Accession XP_172581.2) is another GAM281 target gene, herein designated TARGET GENE. LOC255488 BINDING SITE is a target binding site found in the 3' untranslated region of mRNA encoded by LOC255488, corresponding to a target binding site such as BINDING SITE I, BINDING SITE II or BINDING SITE III of FIG. 8. Table 4 illustrates the complementarity of the nucleotide sequences of LOC255488 BINDING SITE, designated SEQ ID:3150, to the nucleotide sequence of GAM281 RNA, herein designated GAM RNA, also designated SEQ ID:278.

Another function of GAM281 is therefore inhibition of LOC255488 (Accession XP_172581.2). Accordingly, utilities of GAM281 include diagnosis, prevention and treatment of diseases and clinical conditions associated with LOC255488.

LOC255736 (Accession XP_170898.2) is another GAM281 target gene, herein designated TARGET GENE. LOC255736 BINDING SITE is a target binding site found in the 5' untranslated region of mRNA encoded by LOC255736, corresponding to a target binding site such as BINDING SITE I, BINDING SITE II or BINDING SITE III of FIG. 8. Table 4 illustrates the complementarity of the nucleotide sequences of LOC255736 BINDING SITE, designated SEQ ID:2873, to the nucleotide sequence of GAM281 RNA, herein designated GAM RNA, also designated SEQ ID:278.

Another function of GAM281 is therefore inhibition of LOC255736 (Accession XP_170898.2). Accordingly, utilities of GAM281 include diagnosis, prevention and treatment of diseases and clinical conditions associated with LOC255736.

LOC255975 (Accession XP_171083.2) is another GAM281 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:12803, to the nucleotide sequence of GAM281 RNA, herein designated GAM RNA, also designated SEQ ID:278.

Another function of GAM281 is therefore inhibition of LOC255975 (Accession XP_171083.2). Accordingly, utilities of GAM281 include diagnosis, prevention and treatment of diseases and clinical conditions associated with LOC255975.

LOC256614 (Accession XP_172864.1) is another GAM281 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:7385, to the nucleotide sequence of GAM281 RNA, herein designated GAM RNA, also designated SEQ ID:278.

Another function of GAM281 is therefore inhibition of LOC256614 (Accession XP_172864.1). Accordingly, utilities of GAM281 include diagnosis, prevention and treatment of diseases and clinical conditions associated with LOC256614.

LOC282905 (Accession XP_212606.1) is another GAM281 target gene, herein designated TARGET GENE. LOC282905 BINDING SITE is a target binding site found in the 5' untranslated region of mRNA encoded by LOC282905, corresponding to a target binding site such as BINDING SITE I, BINDING SITE II or BINDING SITE III of FIG. 8. Table 4 illustrates the complementarity of the nucleotide sequences of LOC282905 BINDING SITE, designated SEQ ID:986, to the nucleotide sequence of GAM281 RNA, herein designated GAM RNA, also designated SEQ ID:278.

Another function of GAM281 is therefore inhibition of LOC282905 (Accession XP_212606.1). Accordingly, utilities of GAM281 include diagnosis, prevention and treatment of diseases and clinical conditions associated with LOC282905.

LOC282943 (Accession XP_212647.1) is another GAM281 target gene, herein designated TARGET GENE. LOC282943 BINDING SITE is a target binding site found in the 5' untranslated region of mRNA encoded by LOC282943, corresponding to a target binding site such as BINDING SITE I, BINDING SITE II or BINDING SITE III of FIG. 8. Table 4 illustrates the complementarity of the nucleotide sequences of LOC282943 BINDING SITE, designated SEQ ID:986, to the nucleotide sequence of GAM281 RNA, herein designated GAM RNA, also designated SEQ ID:278.

Another function of GAM281 is therefore inhibition of LOC282943 (Accession XP_212647.1). Accordingly, utilities of GAM281 include diagnosis, prevention and treatment of diseases and clinical conditions associated with LOC282943.

LOC282963 (Accession XP_210834.1) is another GAM281 target gene, herein designated TARGET GENE. LOC282963 BINDING SITE1 and LOC282963 BINDING SITE2 are target binding sites found in untranslated regions of mRNA encoded by LOC282963, corresponding to target binding sites such as BINDING SITE I, BINDING SITE II or BINDING SITE III of FIG. 8. Table 4 illustrates the complementarity of the nucleotide sequences of LOC282963 BINDING SITE1 and LOC282963 BINDING SITE2, designated SEQ ID:814 and SEQ ID:2675 respectively, to the nucleotide sequence of GAM281 RNA, herein designated GAM RNA, also designated SEQ ID:278.

Another function of GAM281 is therefore inhibition of LOC282963 (Accession XP_210834.1). Accordingly, utilities of GAM281 include diagnosis, prevention and treatment of diseases and clinical conditions associated with LOC282963.

LOC282972 (Accession XP_210837.1) is another GAM281 target gene, herein designated TARGET GENE. LOC282972 BINDING SITE is a target binding site found in the 3' untranslated region of mRNA encoded by LOC282972, corresponding to a target binding site such as BINDING SITE I, BINDING SITE II or BINDING SITE III of FIG. 8. Table 4 illustrates the complementarity of the nucleotide sequences of LOC282972 BINDING SITE, designated SEQ ID:18172, to the nucleotide sequence of GAM281 RNA, herein designated GAM RNA, also designated SEQ ID:278.

Another function of GAM281 is therefore inhibition of LOC282972 (Accession XP_210837.1). Accordingly, utilities of GAM281 include diagnosis, prevention and treatment of diseases and clinical conditions associated with LOC282972.

LOC282987 (Accession XP_210845.1) is another GAM281 target gene, herein designated TARGET GENE. LOC282987 BINDING SITE1 and LOC282987 BINDING SITE2 are target binding sites found in untranslated regions of mRNA encoded by LOC282987, corresponding to target binding sites such as BINDING SITE I, BINDING SITE II or BINDING SITE III of FIG. 8. Table 4 illustrates the complementarity of the nucleotide sequences of LOC282987 BINDING SITE1 and LOC282987 BINDING SITE2, designated SEQ ID:16541 and SEQ ID:12068 respectively, to the nucleotide sequence of GAM281 RNA, herein designated GAM RNA, also designated SEQ ID:278.

Another function of GAM281 is therefore inhibition of LOC282987 (Accession XP_210845.1). Accordingly, utilities of GAM281 include diagnosis, prevention and treatment of diseases and clinical conditions associated with LOC282987.

LOC282997 (Accession XP_208473.1) is another GAM281 target gene, herein designated TARGET GENE. LOC282997 BINDING SITE is a target binding site found in the 3' untranslated region of mRNA encoded by LOC282997, corresponding to a target binding site such as BINDING SITE I, BINDING SITE II or BINDING SITE III of FIG. 8. Table 4 illustrates the complementarity of the nucleotide sequences of LOC282997 BINDING SITE, designated SEQ ID:11798, to the nucleotide sequence of GAM281 RNA, herein designated GAM RNA, also designated SEQ ID:278.

Another function of GAM281 is therefore inhibition of LOC282997 (Accession XP_208473.1). Accordingly, utilities of GAM281 include diagnosis, prevention and treatment of diseases and clinical conditions associated with LOC282997.

LOC283031 (Accession XP_210859.1) is another GAM281 target gene, herein designated TARGET GENE. LOC283031 BINDING SITE is a target binding site found in the 3' untranslated region of mRNA encoded by LOC283031, corresponding to a target binding site such as BINDING SITE I, BINDING SITE II or BINDING SITE III of FIG. 8. Table 4 illustrates the complementarity of the nucleotide sequences of LOC283031 BINDING SITE, designated SEQ ID:6384, to the nucleotide sequence of GAM281 RNA, herein designated GAM RNA, also designated SEQ ID:278.

Another function of GAM281 is therefore inhibition of LOC283031 (Accession XP_210859.1). Accordingly, utilities of GAM281 include diagnosis, prevention and treatment of diseases and clinical conditions associated with LOC283031.

LOC283035 (Accession XP_208488.1) is another GAM281 target gene, herein designated TARGET GENE. LOC283035 BINDING SITE is a target binding site found in the 3' untranslated region of mRNA encoded by LOC283035, corresponding to a target binding site such as BINDING SITE I, BINDING SITE II or BINDING SITE III of FIG. 8. Table 4 illustrates the complementarity of the nucleotide sequences of LOC283035 BINDING SITE, designated SEQ ID:1940, to the nucleotide sequence of GAM281 RNA, herein designated GAM RNA, also designated SEQ ID:278.

Another function of GAM281 is therefore inhibition of LOC283035 (Accession XP_208488.1). Accordingly, utilities of GAM281 include diagnosis, prevention and treatment of diseases and clinical conditions associated with LOC283035.

LOC283047 (Accession XP_210870.1) is another GAM281 target gene, herein designated TARGET GENE. LOC283047 BINDING SITE is a target binding site found in the 3' untranslated region of mRNA encoded by LOC283047, corresponding to a target binding site such as BINDING SITE I, BINDING SITE II or BINDING SITE III of FIG. 8. Table 4 illustrates the complementarity of the nucleotide sequences of LOC283047 BINDING SITE, designated SEQ ID:17587, to the nucleotide sequence of GAM281 RNA, herein designated GAM RNA, also designated SEQ ID:278.

Another function of GAM281 is therefore inhibition of LOC283047 (Accession XP_210870.1). Accordingly, utilities of GAM281 include diagnosis, prevention and treatment of diseases and clinical conditions associated with LOC283047.

LOC283061 (Accession XP_210875.1) is another GAM281 target gene, herein designated TARGET GENE. LOC283061 BINDING SITE is a target binding site found in the 3' untranslated region of mRNA encoded by LOC283061, corresponding to a target binding site such as BINDING SITE I, BINDING SITE II or BINDING SITE III of FIG. 8. Table 4 illustrates the complementarity of the nucleotide sequences of LOC283061 BINDING SITE, designated SEQ ID:7252, to the nucleotide sequence of GAM281 RNA, herein designated GAM RNA, also designated SEQ ID:278.

Another function of GAM281 is therefore inhibition of LOC283061 (Accession XP_210875.1). Accordingly, utilities of GAM281 include diagnosis, prevention and treatment of diseases and clinical conditions associated with LOC283061.

LOC283087 (Accession XP_208509.1) is another GAM281 target gene, herein designated TARGET GENE. LOC283087 BINDING SITE is a target binding site found in the 3' untranslated region of mRNA encoded by LOC283087, corresponding to a target binding site such as BINDING SITE I, BINDING SITE II or BINDING SITE III of FIG. 8. Table 4 illustrates the complementarity of the nucleotide sequences of LOC283087 BINDING SITE, designated SEQ ID:4176, to the nucleotide sequence of GAM281 RNA, herein designated GAM RNA, also designated SEQ ID:278.

Another function of GAM281 is therefore inhibition of LOC283087 (Accession XP_208509.1). Accordingly, utilities of GAM281 include diagnosis, prevention and treatment of diseases and clinical conditions associated with LOC283087.

LOC283089 (Accession XP_210885.1) is another GAM281 target gene, herein designated TARGET GENE. LOC283089 BINDING SITE is a target binding site found in the 5' untranslated region of mRNA encoded by LOC283089, corresponding to a target binding site such as BINDING SITE I, BINDING SITE II or BINDING SITE III of FIG. 8. Table 4 illustrates the complementarity of the nucleotide sequences of LOC283089 BINDING SITE, designated SEQ ID:2219, to the nucleotide sequence of GAM281 RNA, herein designated GAM RNA, also designated SEQ ID:278.

Another function of GAM281 is therefore inhibition of LOC283089 (Accession XP_210885.1). Accordingly, utilities of GAM281 include diagnosis, prevention and treatment of diseases and clinical conditions associated with LOC283089.

LOC283119 (Accession XP_210895.1) is another GAM281 target gene, herein designated TARGET GENE. LOC283119 BINDING SITE is a target binding site found in the 3' untranslated region of mRNA encoded by LOC283119, corresponding to a target binding site such as BINDING SITE I, BINDING SITE II or BINDING SITE III of FIG. 8. Table 4 illustrates the complementarity of the nucleotide sequences of LOC283119 BINDING SITE, designated SEQ ID:16397, to the nucleotide sequence of GAM281 RNA, herein designated GAM RNA, also designated SEQ ID:278.

Another function of GAM281 is therefore inhibition of LOC283119 (Accession XP_210895.1). Accordingly, utilities of GAM281 include diagnosis, prevention and treatment of diseases and clinical conditions associated with LOC283119.

LOC283130 (Accession XP_208525.3) is another GAM281 target gene, herein designated TARGET GENE.

LOC283130 BINDING SITE is a target binding site found in the 3' untranslated region of mRNA encoded by LOC283130, corresponding to a target binding site such as BINDING SITE I, BINDING SITE II or BINDING SITE III of FIG. 8. Table 4 illustrates the complementarity of the nucleotide sequences of LOC283130 BINDING SITE, designated SEQ ID:5323, to the nucleotide sequence of GAM281 RNA, herein designated GAM RNA, also designated SEQ ID:278.

Another function of GAM281 is therefore inhibition of LOC283130 (Accession XP_208525.3). Accordingly, utilities of GAM281 include diagnosis, prevention and treatment of diseases and clinical conditions associated with LOC283130.

LOC283140 (Accession XP_210911.1) is another GAM281 target gene, herein designated TARGET GENE. LOC283140 BINDING SITE is a target binding site found in the 3' untranslated region of mRNA encoded by LOC283140, corresponding to a target binding site such as BINDING SITE I, BINDING SITE II or BINDING SITE III of FIG. 8. Table 4 illustrates the complementarity of the nucleotide sequences of LOC283140 BINDING SITE, designated SEQ ID:12544, to the nucleotide sequence of GAM281 RNA, herein designated GAM RNA, also designated SEQ ID:278.

Another function of GAM281 is therefore inhibition of LOC283140 (Accession XP_210911.1). Accordingly, utilities of GAM281 include diagnosis, prevention and treatment of diseases and clinical conditions associated with LOC283140.

LOC283143 (Accession XP_210920.1) is another GAM281 target gene, herein designated TARGET GENE. LOC283143 BINDING SITE is a target binding site found in the 3' untranslated region of mRNA encoded by LOC283143, corresponding to a target binding site such as BINDING SITE I, BINDING SITE II or BINDING SITE III of FIG. 8. Table 4 illustrates the complementarity of the nucleotide sequences of LOC283143 BINDING SITE, designated SEQ ID:2650, to the nucleotide sequence of GAM281 RNA, herein designated GAM RNA, also designated SEQ ID:278.

Another function of GAM281 is therefore inhibition of LOC283143 (Accession XP_210920.1). Accordingly, utilities of GAM281 include diagnosis, prevention and treatment of diseases and clinical conditions associated with LOC283143.

LOC283152 (Accession XP_210917.2) is another GAM281 target gene, herein designated TARGET GENE. LOC283152 BINDING SITE is a target binding site found in the 5' untranslated region of mRNA encoded by LOC283152, corresponding to a target binding site such as BINDING SITE I, BINDING SITE II or BINDING SITE III of FIG. 8. Table 4 illustrates the complementarity of the nucleotide sequences of LOC283152 BINDING SITE, designated SEQ ID:19812, to the nucleotide sequence of GAM281 RNA, herein designated GAM RNA, also designated SEQ ID:278.

Another function of GAM281 is therefore inhibition of LOC283152 (Accession XP_210917.2). Accordingly, utilities of GAM281 include diagnosis, prevention and treatment of diseases and clinical conditions associated with LOC283152.

LOC283170 (Accession XP_208535.1) is another GAM281 target gene, herein designated TARGET GENE. LOC283170 BINDING SITE is a target binding site found in the 3' untranslated region of mRNA encoded by LOC283170, corresponding to a target binding site such as BINDING SITE I, BINDING SITE II or BINDING SITE III of FIG. 8. Table 4 illustrates the complementarity of the nucleotide sequences of LOC283170 BINDING SITE, designated SEQ ID:4979, to the nucleotide sequence of GAM281 RNA, herein designated GAM RNA, also designated SEQ ID:278.

Another function of GAM281 is therefore inhibition of LOC283170 (Accession XP_208535.1). Accordingly, utilities of GAM281 include diagnosis, prevention and treatment of diseases and clinical conditions associated with LOC283170.

LOC283177 (Accession XP_210903.1) is another GAM281 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:15574, to the nucleotide sequence of GAM281 RNA, herein designated GAM RNA, also designated SEQ ID:278.

Another function of GAM281 is therefore inhibition of LOC283177 (Accession XP_210903.1). Accordingly, utilities of GAM281 include diagnosis, prevention and treatment of diseases and clinical conditions associated with LOC283177.

LOC283215 (Accession XP_208555.2) is another GAM281 target gene, herein designated TARGET GENE. LOC283215 BINDING SITE1 and LOC283215 BINDING SITE2 are target binding sites found in untranslated regions of mRNA encoded by LOC283215, corresponding to target binding sites such as BINDING SITE I, BINDING SITE II or BINDING SITE III of FIG. 8. Table 4 illustrates the complementarity of the nucleotide sequences of LOC283215 BINDING SITE1 and LOC283215 BINDING SITE2, designated SEQ ID:10112 and SEQ ID:8144 respectively, to the nucleotide sequence of GAM281 RNA, herein designated GAM RNA, also designated SEQ ID:278.

Another function of GAM281 is therefore inhibition of LOC283215 (Accession XP_208555.2). Accordingly, utilities of GAM281 include diagnosis, prevention and treatment of diseases and clinical conditions associated with LOC283215.

LOC283241 (Accession NP_787089.1) is another GAM281 target gene, herein designated TARGET GENE. LOC283241 BINDING SITE is a target binding site found in the 5' untranslated region of mRNA encoded by LOC283241, corresponding to a target binding site such as BINDING SITE I, BINDING SITE II or BINDING SITE III of FIG. 8. Table 4 illustrates the complementarity of the nucleotide sequences of LOC283241 BINDING SITE, designated SEQ ID:9525, to the nucleotide sequence of GAM281 RNA, herein designated GAM RNA, also designated SEQ ID:278.

Another function of GAM281 is therefore inhibition of LOC283241 (Accession NP_787089.1). Accordingly, utilities of GAM281 include diagnosis, prevention and treatment of diseases and clinical conditions associated with LOC283241.

LOC283262 (Accession XP_210952.1) is another GAM281 target gene, herein designated TARGET GENE. LOC283262 BINDING SITE is a target binding site found in the 5' untranslated region of mRNA encoded by LOC283262, corresponding to a target binding site such as BINDING SITE I, BINDING SITE II or BINDING SITE III of FIG. 8. Table 4 illustrates the complementarity of the nucleotide sequences of LOC283262 BINDING SITE, designated SEQ ID:8223, to the nucleotide sequence of GAM281 RNA, herein designated GAM RNA, also designated SEQ ID:278.

Another function of GAM281 is therefore inhibition of LOC283262 (Accession XP_210952.1). Accordingly, utilities of GAM281 include diagnosis, prevention and treatment of diseases and clinical conditions associated with LOC283262.

LOC283278 (Accession XP_210961.1) is another GAM281 target gene, herein designated TARGET GENE. LOC283278 BINDING SITE is a target binding site found in the 3' untranslated region of mRNA encoded by LOC283278, corresponding to a target binding site such as BINDING SITE I, BINDING SITE II or BINDING SITE III of FIG. 8. Table 4 illustrates the complementarity of the nucleotide sequences of LOC283278 BINDING SITE, designated SEQ ID:9036, to the nucleotide sequence of GAM281 RNA, herein designated GAM RNA, also designated SEQ ID:278.

Another function of GAM281 is therefore inhibition of LOC283278 (Accession XP_210961.1). Accordingly, utilities of GAM281 include diagnosis, prevention and treatment of diseases and clinical conditions associated with LOC283278.

LOC283293 (Accession XP_210962.1) is another GAM281 target gene, herein designated TARGET GENE. LOC283293 BINDING SITE is a target binding site found in the 3' untranslated region of mRNA encoded by LOC283293, corresponding to a target binding site such as BINDING SITE I, BINDING SITE II or BINDING SITE III of FIG. 8. Table 4 illustrates the complementarity of the nucleotide sequences of LOC283293 BINDING SITE, designated SEQ ID:17952, to the nucleotide sequence of GAM281 RNA, herein designated GAM RNA, also designated SEQ ID:278.

Another function of GAM281 is therefore inhibition of LOC283293 (Accession XP_210962.1). Accordingly, utilities of GAM281 include diagnosis, prevention and treatment of diseases and clinical conditions associated with LOC283293.

LOC283299 (Accession XP_210965.1) is another GAM281 target gene, herein designated TARGET GENE. LOC283299 BINDING SITE is a target binding site found in the 5' untranslated region of mRNA encoded by LOC283299, corresponding to a target binding site such as BINDING SITE I, BINDING SITE II or BINDING SITE III of FIG. 8. Table 4 illustrates the complementarity of the nucleotide sequences of LOC283299 BINDING SITE, designated SEQ ID:9585, to the nucleotide sequence of GAM281 RNA, herein designated GAM RNA, also designated SEQ ID:278.

Another function of GAM281 is therefore inhibition of LOC283299 (Accession XP_210965.1). Accordingly, utilities of GAM281 include diagnosis, prevention and treatment of diseases and clinical conditions associated with LOC283299.

LOC283329 (Accession XP_210978.1) is another GAM281 target gene, herein designated TARGET GENE. LOC283329 BINDING SITE1 and LOC283329 BINDING SITE2 are target binding sites found in untranslated regions of mRNA encoded by LOC283329, corresponding to target binding sites such as BINDING SITE I, BINDING SITE II or BINDING SITE III of FIG. 8. Table 4 illustrates the complementarity of the nucleotide sequences of LOC283329 BINDING SITE1 and LOC283329 BINDING SITE2, designated SEQ ID:2201 and SEQ ID:12183 respectively, to the nucleotide sequence of GAM281 RNA, herein designated GAM RNA, also designated SEQ ID:278.

Another function of GAM281 is therefore inhibition of LOC283329 (Accession XP_210978.1). Accordingly, utilities of GAM281 include diagnosis, prevention and treatment of diseases and clinical conditions associated with LOC283329.

LOC283335 (Accession XP_210981.1) is another GAM281 target gene, herein designated TARGET GENE. LOC283335 BINDING SITE1 and LOC283335 BINDING SITE2 are target binding sites found in untranslated regions of mRNA encoded by LOC283335, corresponding to target binding sites such as BINDING SITE I, BINDING SITE II or BINDING SITE III of FIG. 8. Table 4 illustrates the complementarity of the nucleotide sequences of LOC283335 BINDING SITE1 and LOC283335 BINDING SITE2, designated SEQ ID:16144 and SEQ ID:2143 respectively, to the nucleotide sequence of GAM281 RNA, herein designated GAM RNA, also designated SEQ ID:278.

Another function of GAM281 is therefore inhibition of LOC283335 (Accession XP_210981.1). Accordingly, utilities of GAM281 include diagnosis, prevention and treatment of diseases and clinical conditions associated with LOC283335.

LOC283377 (Accession XP_208647.1) is another GAM281 target gene, herein designated TARGET GENE. LOC283377 BINDING SITE is a target binding site found in the 3' untranslated region of mRNA encoded by LOC283377, corresponding to a target binding site such as BINDING SITE I, BINDING SITE II or BINDING SITE III of FIG. 8. Table 4 illustrates the complementarity of the nucleotide sequences of LOC283377 BINDING SITE, designated SEQ ID:8232, to the nucleotide sequence of GAM281 RNA, herein designated GAM RNA, also designated SEQ ID:278.

Another function of GAM281 is therefore inhibition of LOC283377 (Accession XP_208647.1). Accordingly, utilities of GAM281 include diagnosis, prevention and treatment of diseases and clinical conditions associated with LOC283377.

LOC283387 (Accession XP_211007.1) is another GAM281 target gene, herein designated TARGET GENE. LOC283387 BINDING SITE is a target binding site found in the 3' untranslated region of mRNA encoded by LOC283387, corresponding to a target binding site such as BINDING SITE I, BINDING SITE II or BINDING SITE III of FIG. 8. Table 4 illustrates the complementarity of the nucleotide sequences of LOC283387 BINDING SITE, designated SEQ ID:7265, to the nucleotide sequence of GAM281 RNA, herein designated GAM RNA, also designated SEQ ID:278.

Another function of GAM281 is therefore inhibition of LOC283387 (Accession XP_211007.1). Accordingly, utilities of GAM281 include diagnosis, prevention and treatment of diseases and clinical conditions associated with LOC283387.

LOC283394 (Accession XP_211021.1) is another GAM281 target gene, herein designated TARGET GENE. LOC283394 BINDING SITE is a target binding site found in the 5' untranslated region of mRNA encoded by LOC283394, corresponding to a target binding site such as BINDING SITE I, BINDING SITE II or BINDING SITE III of FIG. 8. Table 4 illustrates the complementarity of the nucleotide sequences of LOC283394 BINDING SITE, designated SEQ ID:1730, to the nucleotide sequence of GAM281 RNA, herein designated GAM RNA, also designated SEQ ID:278.

Another function of GAM281 is therefore inhibition of LOC283394 (Accession XP_211021.1). Accordingly, utilities of GAM281 include diagnosis, prevention and treatment of diseases and clinical conditions associated with LOC283394.

LOC283395 (Accession XP_211020.1) is another GAM281 target gene, herein designated TARGET GENE. LOC283395 BINDING SITE is a target binding site found in the 3' untranslated region of mRNA encoded by LOC283395, corresponding to a target binding site such as BINDING SITE I, BINDING SITE II or BINDING SITE III of FIG. 8. Table 4 illustrates the complementarity of the nucleotide sequences of LOC283395 BINDING SITE, designated SEQ ID:9003, to the nucleotide sequence of GAM281 RNA, herein designated GAM RNA, also designated SEQ ID:278.

Another function of GAM281 is therefore inhibition of LOC283395 (Accession XP_211020.1). Accordingly, utilities of GAM281 include diagnosis, prevention and treatment of diseases and clinical conditions associated with LOC283395.

LOC283400 (Accession XP_211024.1) is another GAM281 target gene, herein designated TARGET GENE. LOC283400 BINDING SITE is a target binding site found in the 5' untranslated region of mRNA encoded by LOC283400, corresponding to a target binding site such as BINDING SITE I, BINDING SITE II or BINDING SITE III of FIG. 8. Table 4 illustrates the complementarity of the nucleotide sequences of LOC283400 BINDING SITE, designated SEQ ID:19206, to the nucleotide sequence of GAM281 RNA, herein designated GAM RNA, also designated SEQ ID:278.

Another function of GAM281 is therefore inhibition of LOC283400 (Accession XP_211024.1). Accordingly, utilities of GAM281 include diagnosis, prevention and treatment of diseases and clinical conditions associated with LOC283400.

LOC283432 (Accession XP_211032.1) is another GAM281 target gene, herein designated TARGET GENE. LOC283432 BINDING SITE is a target binding site found in the 5' untranslated region of mRNA encoded by LOC283432, corresponding to a target binding site such as BINDING SITE I, BINDING SITE II or BINDING SITE III of FIG. 8. Table 4 illustrates the complementarity of the nucleotide sequences of LOC283432 BINDING SITE, designated SEQ ID:16658, to the nucleotide sequence of GAM281 RNA, herein designated GAM RNA, also designated SEQ ID:278.

Another function of GAM281 is therefore inhibition of LOC283432 (Accession XP_211032.1). Accordingly, utilities of GAM281 include diagnosis, prevention and treatment of diseases and clinical conditions associated with LOC283432.

LOC283434 (Accession XP_211034.1) is another GAM281 target gene, herein designated TARGET GENE. LOC283434 BINDING SITE is a target binding site found in the 5' untranslated region of mRNA encoded by LOC283434, corresponding to a target binding site such as BINDING SITE I, BINDING SITE II or BINDING SITE III of FIG. 8. Table 4 illustrates the complementarity of the nucleotide sequences of LOC283434 BINDING SITE, designated SEQ ID:16366, to the nucleotide sequence of GAM281 RNA, herein designated GAM RNA, also designated SEQ ID:278.

Another function of GAM281 is therefore inhibition of LOC283434 (Accession XP_211034.1). Accordingly, utilities of GAM281 include diagnosis, prevention and treatment of diseases and clinical conditions associated with LOC283434.

LOC283441 (Accession XP_211043.1) is another GAM281 target gene, herein designated TARGET GENE. LOC283441 BINDING SITE is a target binding site found in the 3' untranslated region of mRNA encoded by LOC283441, corresponding to a target binding site such as BINDING SITE I, BINDING SITE II or BINDING SITE III of FIG. 8. Table 4 illustrates the complementarity of the nucleotide sequences of LOC283441 BINDING SITE, designated SEQ ID:2220, to the nucleotide sequence of GAM281 RNA, herein designated GAM RNA, also designated SEQ ID:278.

Another function of GAM281 is therefore inhibition of LOC283441 (Accession XP_211043.1). Accordingly, utilities of GAM281 include diagnosis, prevention and treatment of diseases and clinical conditions associated with LOC283441.

LOC283442 (Accession XP_211037.1) is another GAM281 target gene, herein designated TARGET GENE. LOC283442 BINDING SITE is a target binding site found in the 5' untranslated region of mRNA encoded by LOC283442, corresponding to a target binding site such as BINDING SITE I, BINDING SITE II or BINDING SITE III of FIG. 8. Table 4 illustrates the complementarity of the nucleotide sequences of LOC283442 BINDING SITE, designated SEQ ID:10032, to the nucleotide sequence of GAM281 RNA, herein designated GAM RNA, also designated SEQ ID:278.

Another function of GAM281 is therefore inhibition of LOC283442 (Accession XP_211037.1). Accordingly, utilities of GAM281 include diagnosis, prevention and treatment of diseases and clinical conditions associated with LOC283442.

LOC283445 (Accession XP_211044.1) is another GAM281 target gene, herein designated TARGET GENE. LOC283445 BINDING SITE is a target binding site found in the 5' untranslated region of mRNA encoded by LOC283445, corresponding to a target binding site such as BINDING SITE I, BINDING SITE II or BINDING SITE III of FIG. 8. Table 4 illustrates the complementarity of the nucleotide sequences of LOC283445 BINDING SITE, designated SEQ ID:5683, to the nucleotide sequence of GAM281 RNA, herein designated GAM RNA, also designated SEQ ID:278.

Another function of GAM281 is therefore inhibition of LOC283445 (Accession XP_211044.1). Accordingly, utilities of GAM281 include diagnosis, prevention and treatment of diseases and clinical conditions associated with LOC283445.

LOC283452 (Accession XP_208679.1) is another GAM281 target gene, herein designated TARGET GENE. LOC283452 BINDING SITE is a target binding site found in the 5' untranslated region of mRNA encoded by LOC283452, corresponding to a target binding site such as BINDING SITE I, BINDING SITE II or BINDING SITE III of FIG. 8. Table 4 illustrates the complementarity of the nucleotide sequences of LOC283452 BINDING SITE, designated SEQ ID:7397, to the nucleotide sequence of GAM281 RNA, herein designated GAM RNA, also designated SEQ ID:278.

Another function of GAM281 is therefore inhibition of LOC283452 (Accession XP_208679.1). Accordingly, utilities of GAM281 include diagnosis, prevention and treatment of diseases and clinical conditions associated with LOC283452.

LOC283454 (Accession XP_211049.1) is another GAM281 target gene, herein designated TARGET GENE. LOC283454 BINDING SITE is a target binding site found in the 5' untranslated region of mRNA encoded by LOC283454, corresponding to a target binding site such as BINDING SITE I, BINDING SITE II or BINDING SITE III of FIG. 8. Table 4 illustrates the complementarity of the nucleotide sequences of LOC283454 BINDING SITE, designated SEQ ID:14861, to the nucleotide sequence of GAM281 RNA, herein designated GAM RNA, also designated SEQ ID:278.

Another function of GAM281 is therefore inhibition of LOC283454 (Accession XP_211049.1). Accordingly, utilities of GAM281 include diagnosis, prevention and treatment of diseases and clinical conditions associated with LOC283454.

LOC283467 (Accession XP_211050.1) is another GAM281 target gene, herein designated TARGET GENE. LOC283467 BINDING SITE is a target binding site found in the 3' untranslated region of mRNA encoded by LOC283467, corresponding to a target binding site such as BINDING SITE I, BINDING SITE II or BINDING SITE III of FIG. 8. Table 4 illustrates the complementarity of the nucleotide sequences of LOC283467 BINDING SITE, designated SEQ ID:13967, to the nucleotide sequence of GAM281 RNA, herein designated GAM RNA, also designated SEQ ID:278.

Another function of GAM281 is therefore inhibition of LOC283467 (Accession XP_211050.1). Accordingly, utilities of GAM281 include diagnosis, prevention and treatment of diseases and clinical conditions associated with LOC283467.

LOC283475 (Accession XP_211056.1) is another GAM281 target gene, herein designated TARGET GENE. LOC283475 BINDING SITE is a target binding site found in the 3' untranslated region of mRNA encoded by LOC283475, corresponding to a target binding site such as BINDING SITE I, BINDING SITE II or BINDING SITE III of FIG. 8. Table 4 illustrates the complementarity of the nucleotide sequences of LOC283475 BINDING SITE, designated SEQ ID:9892, to the nucleotide sequence of GAM281 RNA, herein designated GAM RNA, also designated SEQ ID:278.

Another function of GAM281 is therefore inhibition of LOC283475 (Accession XP_211056.1). Accordingly, utilities of GAM281 include diagnosis, prevention and treatment of diseases and clinical conditions associated with LOC283475.

LOC283484 (Accession XP_211053.1) is another GAM281 target gene, herein designated TARGET GENE. LOC283484 BINDING SITE is a target binding site found in the 5' untranslated region of mRNA encoded by LOC283484, corresponding to a target binding site such as BINDING SITE I, BINDING SITE II or BINDING SITE III of FIG. 8. Table 4 illustrates the complementarity of the nucleotide sequences of LOC283484 BINDING SITE, designated SEQ ID:17710, to the nucleotide sequence of GAM281 RNA, herein designated GAM RNA, also designated SEQ ID:278.

Another function of GAM281 is therefore inhibition of LOC283484 (Accession XP_211053.1). Accordingly, utilities of GAM281 include diagnosis, prevention and treatment of diseases and clinical conditions associated with LOC283484.

LOC283487 (Accession XP_211062.1) is another GAM281 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:7371, to the nucleotide sequence of GAM281 RNA, herein designated GAM RNA, also designated SEQ ID:278.

Another function of GAM281 is therefore inhibition of LOC283487 (Accession XP_211062.1). Accordingly, utilities of GAM281 include diagnosis, prevention and treatment of diseases and clinical conditions associated with LOC283487.

LOC283507 (Accession XP_211075.1) is another GAM281 target gene, herein designated TARGET GENE. LOC283507 BINDING SITE is a target binding site found in the 3' untranslated region of mRNA encoded by LOC283507, corresponding to a target binding site such as BINDING SITE I, BINDING SITE II or BINDING SITE III of FIG. 8. Table 4 illustrates the complementarity of the nucleotide sequences of LOC283507 BINDING SITE, designated SEQ ID:12075, to the nucleotide sequence of GAM281 RNA, herein designated GAM RNA, also designated SEQ ID:278.

Another function of GAM281 is therefore inhibition of LOC283507 (Accession XP_211075.1). Accordingly, utilities of GAM281 include diagnosis, prevention and treatment of diseases and clinical conditions associated with LOC283507.

LOC283520 (Accession XP_211071.1) is another GAM281 target gene, herein designated TARGET GENE. LOC283520 BINDING SITE is a target binding site found in the 5' untranslated region of mRNA encoded by LOC283520, corresponding to a target binding site such as BINDING SITE I, BINDING SITE II or BINDING SITE III of FIG. 8. Table 4 illustrates the complementarity of the nucleotide sequences of LOC283520 BINDING SITE, designated SEQ ID:2025, to the nucleotide sequence of GAM281 RNA, herein designated GAM RNA, also designated SEQ ID:278.

Another function of GAM281 is therefore inhibition of LOC283520 (Accession XP_211071.1). Accordingly, utilities of GAM281 include diagnosis, prevention and treatment of diseases and clinical conditions associated with LOC283520.

LOC283534 (Accession XP_211083.1) is another GAM281 target gene, herein designated TARGET GENE. LOC283534 BINDING SITE is a target binding site found in the 3' untranslated region of mRNA encoded by LOC283534, corresponding to a target binding site such as BINDING SITE I, BINDING SITE II or BINDING SITE III of FIG. 8. Table 4 illustrates the complementarity of the nucleotide sequences of LOC283534 BINDING SITE, designated SEQ ID:3199, to the nucleotide sequence of GAM281 RNA, herein designated GAM RNA, also designated SEQ ID:278.

Another function of GAM281 is therefore inhibition of LOC283534 (Accession XP_211083.1). Accordingly, utilities of GAM281 include diagnosis, prevention and treatment of diseases and clinical conditions associated with LOC283534.

LOC283566 (Accession XP_211114.1) is another GAM281 target gene, herein designated TARGET GENE. LOC283566 BINDING SITE is a target binding site found in the 3' untranslated region of mRNA encoded by LOC283566, corresponding to a target binding site such as BINDING SITE I, BINDING SITE II or BINDING SITE III of FIG. 8. Table 4 illustrates the complementarity of the nucleotide sequences of LOC283566 BINDING SITE, designated SEQ ID:15869, to the nucleotide sequence of GAM281 RNA, herein designated GAM RNA, also designated SEQ ID:278.

Another function of GAM281 is therefore inhibition of LOC283566 (Accession XP_211114.1). Accordingly, utilities of GAM281 include diagnosis, prevention and treatment of diseases and clinical conditions associated with LOC283566.

LOC283570 (Accession XP_211118.1) is another GAM281 target gene, herein designated TARGET GENE. LOC283570 BINDING SITE is a target binding site found in the 3' untranslated region of mRNA encoded by LOC283570, corresponding to a target binding site such as BINDING SITE I, BINDING SITE II or BINDING SITE III of FIG. 8. Table 4 illustrates the complementarity of the nucleotide sequences of LOC283570 BINDING SITE, designated SEQ ID:13652, to the nucleotide sequence of GAM281 RNA, herein designated GAM RNA, also designated SEQ ID:278.

Another function of GAM281 is therefore inhibition of LOC283570 (Accession XP_211118.1). Accordingly, utilities of GAM281 include diagnosis, prevention and treatment of diseases and clinical conditions associated with LOC283570.

LOC283575 (Accession XP_211095.1) is another GAM281 target gene, herein designated TARGET GENE.

LOC283575 BINDING SITE1 and LOC283575 BINDING SITE2 are target binding sites found in untranslated regions of mRNA encoded by LOC283575, corresponding to target binding sites such as BINDING SITE I, BINDING SITE II or BINDING SITE III of FIG. 8. Table 4 illustrates the complementarity of the nucleotide sequences of LOC283575 BINDING SITE1 and LOC283575 BINDING SITE2, designated SEQ ID:10067 and SEQ ID:6183 respectively, to the nucleotide sequence of GAM281 RNA, herein designated GAM RNA, also designated SEQ ID:278.

Another function of GAM281 is therefore inhibition of LOC283575 (Accession XP_211095.1). Accordingly, utilities of GAM281 include diagnosis, prevention and treatment of diseases and clinical conditions associated with LOC283575.

LOC283585 (Accession XP_294741.1) is another GAM281 target gene, herein designated TARGET GENE. LOC283585 BINDING SITE is a target binding site found in the 5' untranslated region of mRNA encoded by LOC283585, corresponding to a target binding site such as BINDING SITE I, BINDING SITE II or BINDING SITE III of FIG. 8. Table 4 illustrates the complementarity of the nucleotide sequences of LOC283585 BINDING SITE, designated SEQ ID:10466, to the nucleotide sequence of GAM281 RNA, herein designated GAM RNA, also designated SEQ ID:278.

Another function of GAM281 is therefore inhibition of LOC283585 (Accession XP_294741.1). Accordingly, utilities of GAM281 include diagnosis, prevention and treatment of diseases and clinical conditions associated with LOC283585.

LOC283588 (Accession NP_787093.1) is another GAM281 target gene, herein designated TARGET GENE. LOC283588 BINDING SITE is a target binding site found in the 3' untranslated region of mRNA encoded by LOC283588, corresponding to a target binding site such as BINDING SITE I, BINDING SITE II or BINDING SITE III of FIG. 8. Table 4 illustrates the complementarity of the nucleotide sequences of LOC283588 BINDING SITE, designated SEQ ID:10638, to the nucleotide sequence of GAM281 RNA, herein designated GAM RNA, also designated SEQ ID:278.

Another function of GAM281 is therefore inhibition of LOC283588 (Accession NP_787093.1). Accordingly, utilities of GAM281 include diagnosis, prevention and treatment of diseases and clinical conditions associated with LOC283588.

LOC283624 (Accession XP_211126.1) is another GAM281 target gene, herein designated TARGET GENE. LOC283624 BINDING SITE1 and LOC283624 BINDING SITE2 are target binding sites found in untranslated regions of mRNA encoded by LOC283624, corresponding to target binding sites such as BINDING SITE I, BINDING SITE II or BINDING SITE III of FIG. 8. Table 4 illustrates the complementarity of the nucleotide sequences of LOC283624 BINDING SITE1 and LOC283624 BINDING SITE2, designated SEQ ID:4420 and SEQ ID:15245 respectively, to the nucleotide sequence of GAM281 RNA, herein designated GAM RNA, also designated SEQ ID:278.

Another function of GAM281 is therefore inhibition of LOC283624 (Accession XP_211126.1). Accordingly, utilities of GAM281 include diagnosis, prevention and treatment of diseases and clinical conditions associated with LOC283624.

LOC283637 (Accession XP_211134.1) is another GAM281 target gene, herein designated TARGET GENE. LOC283637 BINDING SITE1 and LOC283637 BINDING SITE2 are target binding sites found in untranslated regions of mRNA encoded by LOC283637, corresponding to target binding sites such as BINDING SITE I, BINDING SITE II or BINDING SITE III of FIG. 8. Table 4 illustrates the complementarity of the nucleotide sequences of LOC283637 BINDING SITE1 and LOC283637 BINDING SITE2, designated SEQ ID:3581 and SEQ ID:14859 respectively, to the nucleotide sequence of GAM281 RNA, herein designated GAM RNA, also designated SEQ ID:278.

Another function of GAM281 is therefore inhibition of LOC283637 (Accession XP_211134.1). Accordingly, utilities of GAM281 include diagnosis, prevention and treatment of diseases and clinical conditions associated with LOC283637.

LOC283641 (Accession XP_208764.1) is another GAM281 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:17964, to the nucleotide sequence of GAM281 RNA, herein designated GAM RNA, also designated SEQ ID:278.

Another function of GAM281 is therefore inhibition of LOC283641 (Accession XP_208764.1). Accordingly, utilities of GAM281 include diagnosis, prevention and treatment of diseases and clinical conditions associated with LOC283641.

LOC283663 (Accession XP_211147.1) is another GAM281 target gene, herein designated TARGET GENE. LOC283663 BINDING SITE is a target binding site found in the 5' untranslated region of mRNA encoded by LOC283663, corresponding to a target binding site such as BINDING SITE I, BINDING SITE II or BINDING SITE III of FIG. 8. Table 4 illustrates the complementarity of the nucleotide sequences of LOC283663 BINDING SITE, designated SEQ ID:16674, to the nucleotide sequence of GAM281 RNA, herein designated GAM RNA, also designated SEQ ID:278.

Another function of GAM281 is therefore inhibition of LOC283663 (Accession XP_211147.1). Accordingly, utilities of GAM281 include diagnosis, prevention and treatment of diseases and clinical conditions associated with LOC283663.

LOC283664 (Accession XP_208773.1) is another GAM281 target gene, herein designated TARGET GENE. LOC283664 BINDING SITE is a target binding site found in the 5' untranslated region of mRNA encoded by LOC283664, corresponding to a target binding site such as BINDING SITE I, BINDING SITE II or BINDING SITE III of FIG. 8. Table 4 illustrates the complementarity of the nucleotide sequences of LOC283664 BINDING SITE, designated SEQ ID:8450, to the nucleotide sequence of GAM281 RNA, herein designated GAM RNA, also designated SEQ ID:278.

Another function of GAM281 is therefore inhibition of LOC283664 (Accession XP_208773.1). Accordingly, utilities of GAM281 include diagnosis, prevention and treatment of diseases and clinical conditions associated with LOC283664.

LOC283672 (Accession XP_211152.1) is another GAM281 target gene, herein designated TARGET GENE. LOC283672 BINDING SITE is a target binding site found in the 5' untranslated region of mRNA encoded by LOC283672, corresponding to a target binding site such as BINDING SITE I, BINDING SITE II or BINDING SITE III of FIG. 8. Table 4 illustrates the complementarity of the nucleotide sequences of LOC283672 BINDING SITE, designated SEQ ID:1730, to the nucleotide sequence of GAM281 RNA, herein designated GAM RNA, also designated SEQ ID:278.

Another function of GAM281 is therefore inhibition of LOC283672 (Accession XP_211152.1). Accordingly, utilities of GAM281 include diagnosis, prevention and treatment of diseases and clinical conditions associated with LOC283672.

LOC283687 (Accession NP_787094.1) is another GAM281 target gene, herein designated TARGET GENE. LOC283687 BINDING SITE is a target binding site found in the 3' untranslated region of mRNA encoded by LOC283687, corresponding to a target binding site such as BINDING SITE I, BINDING SITE II or BINDING SITE III of FIG. 8. Table 4 illustrates the complementarity of the nucleotide sequences of LOC283687 BINDING SITE, designated SEQ ID:11904, to the nucleotide sequence of GAM281 RNA, herein designated GAM RNA, also designated SEQ ID:278.

Another function of GAM281 is therefore inhibition of LOC283687 (Accession NP_787094.1). Accordingly, utilities of GAM281 include diagnosis, prevention and treatment of diseases and clinical conditions associated with LOC283687.

LOC283689 (Accession XP_211165.1) is another GAM281 target gene, herein designated TARGET GENE. LOC283689 BINDING SITE is a target binding site found in the 5' untranslated region of mRNA encoded by LOC283689, corresponding to a target binding site such as BINDING SITE I, BINDING SITE II or BINDING SITE III of FIG. 8. Table 4 illustrates the complementarity of the nucleotide sequences of LOC283689 BINDING SITE, designated SEQ ID:3654, to the nucleotide sequence of GAM281 RNA, herein designated GAM RNA, also designated SEQ ID:278.

Another function of GAM281 is therefore inhibition of LOC283689 (Accession XP_211165.1). Accordingly, utilities of GAM281 include diagnosis, prevention and treatment of diseases and clinical conditions associated with LOC283689.

LOC283693 (Accession XP_208788.1) is another GAM281 target gene, herein designated TARGET GENE. LOC283693 BINDING SITE1 and LOC283693 BINDING SITE2 are target binding sites found in untranslated regions of mRNA encoded by LOC283693, corresponding to target binding sites such as BINDING SITE I, BINDING SITE II or BINDING SITE III of FIG. 8. Table 4 illustrates the complementarity of the nucleotide sequences of LOC283693 BINDING SITE1 and LOC283693 BINDING SITE2, designated SEQ ID:5305 and SEQ ID:16069 respectively, to the nucleotide sequence of GAM281 RNA, herein designated GAM RNA, also designated SEQ ID:278.

Another function of GAM281 is therefore inhibition of LOC283693 (Accession XP_208788.1). Accordingly, utilities of GAM281 include diagnosis, prevention and treatment of diseases and clinical conditions associated with LOC283693.

LOC283701 (Accession XP_211170.3) is another GAM281 target gene, herein designated TARGET GENE. LOC283701 BINDING SITE1 and LOC283701 BINDING SITE2 are target binding sites found in untranslated regions of mRNA encoded by LOC283701, corresponding to target binding sites such as BINDING SITE I, BINDING SITE II or BINDING SITE III of FIG. 8. Table 4 illustrates the complementarity of the nucleotide sequences of LOC283701 BINDING SITE1 and LOC283701 BINDING SITE2, designated SEQ ID:13716 and SEQ ID:14381 respectively, to the nucleotide sequence of GAM281 RNA, herein designated GAM RNA, also designated SEQ ID:278.

Another function of GAM281 is therefore inhibition of LOC283701 (Accession XP_211170.3). Accordingly, utilities of GAM281 include diagnosis, prevention and treatment of diseases and clinical conditions associated with LOC283701.

LOC283706 (Accession XP_208804.3) is another GAM281 target gene, herein designated TARGET GENE. LOC283706 BINDING SITE is a target binding site found in the 3' untranslated region of mRNA encoded by LOC283706, corresponding to a target binding site such as BINDING SITE I, BINDING SITE II or BINDING SITE III of FIG. 8. Table 4 illustrates the complementarity of the nucleotide sequences of LOC283706 BINDING SITE, designated SEQ ID:5985, to the nucleotide sequence of GAM281 RNA, herein designated GAM RNA, also designated SEQ ID:278.

Another function of GAM281 is therefore inhibition of LOC283706 (Accession XP_208804.3). Accordingly, utilities of GAM281 include diagnosis, prevention and treatment of diseases and clinical conditions associated with LOC283706.

LOC283715 (Accession XP_208800.1) is another GAM281 target gene, herein designated TARGET GENE. LOC283715 BINDING SITE is a target binding site found in the 3' untranslated region of mRNA encoded by LOC283715, corresponding to a target binding site such as BINDING SITE I, BINDING SITE II or BINDING SITE III of FIG. 8. Table 4 illustrates the complementarity of the nucleotide sequences of LOC283715 BINDING SITE, designated SEQ ID:15912, to the nucleotide sequence of GAM281 RNA, herein designated GAM RNA, also designated SEQ ID:278.

Another function of GAM281 is therefore inhibition of LOC283715 (Accession XP_208800.1). Accordingly, utilities of GAM281 include diagnosis, prevention and treatment of diseases and clinical conditions associated with LOC283715.

LOC283741 (Accession XP_208115.1) is another GAM281 target gene, herein designated TARGET GENE. LOC283741 BINDING SITE is a target binding site found in the 3' untranslated region of mRNA encoded by LOC283741, corresponding to a target binding site such as BINDING SITE I, BINDING SITE II or BINDING SITE III of FIG. 8. Table 4 illustrates the complementarity of the nucleotide sequences of LOC283741 BINDING SITE, designated SEQ ID:11523, to the nucleotide sequence of GAM281 RNA, herein designated GAM RNA, also designated SEQ ID:278.

Another function of GAM281 is therefore inhibition of LOC283741 (Accession XP_208115.1). Accordingly, utilities of GAM281 include diagnosis, prevention and treatment of diseases and clinical conditions associated with LOC283741.

LOC283767 (Accession XP_208835.1) is another GAM281 target gene, herein designated TARGET GENE. LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:12479, to the nucleotide sequence of GAM281 RNA, herein designated GAM RNA, also designated SEQ ID:278.

Another function of GAM281 is therefore inhibition of LOC283767 (Accession XP_208835.1). Accordingly, utilities of GAM281 include diagnosis, prevention and treatment of diseases and clinical conditions associated with LOC283767.

LOC283778 (Accession XP_211199.1) is another GAM281 target gene, herein designated TARGET GENE. LOC283778 BINDING SITE is a target binding site found in the 5' untranslated region of mRNA encoded by LOC283778, corresponding to a target binding site such as BINDING SITE I, BINDING SITE II or BINDING SITE III of FIG. 8. Table 4 illustrates the complementarity of the nucleotide sequences of LOC283778 BINDING SITE, designated SEQ ID:4370, to the nucleotide sequence of GAM281 RNA, herein designated GAM RNA, also designated SEQ ID:278.

Another function of GAM281 is therefore inhibition of LOC283778 (Accession XP_211199.1). Accordingly, utilities of GAM281 include diagnosis, prevention and treatment of diseases and clinical conditions associated with LOC283778.

LOC283779 (Accession XP_211198.1) is another GAM281 target gene, herein designated TARGET GENE. LOC283779 BINDING SITE is a target binding site found in the 3' untranslated region of mRNA encoded by LOC283779, corresponding to a target binding site such as BINDING SITE I, BINDING SITE II or BINDING SITE III of FIG. 8. Table 4 illustrates the complementarity of the nucleotide sequences of LOC283779 BINDING SITE, designated SEQ ID:17644, to the nucleotide sequence of GAM281 RNA, herein designated GAM RNA, also designated SEQ ID:278.

Another function of GAM281 is therefore inhibition of LOC283779 (Accession XP_211198.1). Accordingly, utilities of GAM281 include diagnosis, prevention and treatment of diseases and clinical conditions associated with LOC283779.

LOC283801 (Accession XP_208122.1) is another GAM281 target gene, herein designated TARGET GENE. LOC283801 BINDING SITE is a target binding site found in the 3' untranslated region of mRNA encoded by LOC283801, corresponding to a target binding site such as BINDING SITE I, BINDING SITE II or BINDING SITE III of FIG. 8. Table 4 illustrates the complementarity of the nucleotide sequences of LOC283801 BINDING SITE, designated SEQ ID:6265, to the nucleotide sequence of GAM281 RNA, herein designated GAM RNA, also designated SEQ ID:278.

Another function of GAM281 is therefore inhibition of LOC283801 (Accession XP_208122.1). Accordingly, utilities of GAM281 include diagnosis, prevention and treatment of diseases and clinical conditions associated with LOC283801.

LOC283802 (Accession XP_208850.1) is another GAM281 target gene, herein designated TARGET GENE. LOC283802 BINDING SITE is a target binding site found in the 3' untranslated region of mRNA encoded by LOC283802, corresponding to a target binding site such as BINDING SITE I, BINDING SITE II or BINDING SITE III of FIG. 8. Table 4 illustrates the complementarity of the nucleotide sequences of LOC283802 BINDING SITE, designated SEQ ID:16700, to the nucleotide sequence of GAM281 RNA, herein designated GAM RNA, also designated SEQ ID:278.

Another function of GAM281 is therefore inhibition of LOC283802 (Accession XP_208850.1). Accordingly, utilities of GAM281 include diagnosis, prevention and treatment of diseases and clinical conditions associated with LOC283802.

LOC283810 (Accession XP_208853.1) is another GAM281 target gene, herein designated TARGET GENE. LOC283810 BINDING SITE is a target binding site found in the 5' untranslated region of mRNA encoded by LOC283810, corresponding to a target binding site such as BINDING SITE I, BINDING SITE II or BINDING SITE III of FIG. 8. Table 4 illustrates the complementarity of the nucleotide sequences of LOC283810 BINDING SITE, designated SEQ ID:9395, to the nucleotide sequence of GAM281 RNA, herein designated GAM RNA, also designated SEQ ID:278.

Another function of GAM281 is therefore inhibition of LOC283810 (Accession XP_208853.1). Accordingly, utilities of GAM281 include diagnosis, prevention and treatment of diseases and clinical conditions associated with LOC283810.

LOC283818 (Accession XP_211218.1) is another GAM281 target gene, herein designated TARGET GENE. LOC283818 BINDING SITE is a target binding site found in the 3' untranslated region of mRNA encoded by LOC283818, corresponding to a target binding site such as BINDING SITE I, BINDING SITE II or BINDING SITE III of FIG. 8. Table 4 illustrates the complementarity of the nucleotide sequences of LOC283818 BINDING SITE, designated SEQ ID:9546, to the nucleotide sequence of GAM281 RNA, herein designated GAM RNA, also designated SEQ ID:278.

Another function of GAM281 is therefore inhibition of LOC283818 (Accession XP_211218.1). Accordingly, utilities of GAM281 include diagnosis, prevention and treatment of diseases and clinical conditions associated with LOC283818.

LOC283851 (Accession XP_211229.1) is another GAM281 target gene, herein designated TARGET GENE. LOC283851 BINDING SITE is a target binding site found in the 3' untranslated region of mRNA encoded by LOC283851, corresponding to a target binding site such as BINDING SITE I, BINDING SITE II or BINDING SITE III of FIG. 8. Table 4 illustrates the complementarity of the nucleotide sequences of LOC283851 BINDING SITE, designated SEQ ID:4974, to the nucleotide sequence of GAM281 RNA, herein designated GAM RNA, also designated SEQ ID:278.

Another function of GAM281 is therefore inhibition of LOC283851 (Accession XP_211229.1). Accordingly, utilities of GAM281 include diagnosis, prevention and treatment of diseases and clinical conditions associated with LOC283851.

LOC283856 (Accession XP_211233.1) is another GAM281 target gene, herein designated TARGET GENE. LOC283856 BINDING SITE is a target binding site found in the 3' untranslated region of mRNA encoded by LOC283856, corresponding to a target binding site such as BINDING SITE I, BINDING SITE II or BINDING SITE III of FIG. 8. Table 4 illustrates the complementarity of the nucleotide sequences of LOC283856 BINDING SITE, designated SEQ ID:6184, to the nucleotide sequence of GAM281 RNA, herein designated GAM RNA, also designated SEQ ID:278.

Another function of GAM281 is therefore inhibition of LOC283856 (Accession XP_211233.1). Accordingly, utilities of GAM281 include diagnosis, prevention and treatment of diseases and clinical conditions associated with LOC283856.

LOC283857 (Accession XP_211236.1) is another GAM281 target gene, herein designated TARGET GENE. LOC283857 BINDING SITE is a target binding site found in the 5' untranslated region of mRNA encoded by LOC283857, corresponding to a target binding site such as BINDING SITE I, BINDING SITE II or BINDING SITE III of FIG. 8. Table 4 illustrates the complementarity of the nucleotide sequences of LOC283857 BINDING SITE, designated SEQ ID:10167, to the nucleotide sequence of GAM281 RNA, herein designated GAM RNA, also designated SEQ ID:278.

Another function of GAM281 is therefore inhibition of LOC283857 (Accession XP_211236.1). Accordingly, utilities of GAM281 include diagnosis, prevention and treatment of diseases and clinical conditions associated with LOC283857.

LOC283861 (Accession NP_787095.1) is another GAM281 target gene, herein designated TARGET GENE.

LOC283861 BINDING SITE1 through LOC283861 BINDING SITE3 are target binding sites found in untranslated regions of mRNA encoded by LOC283861, corresponding to target binding sites such as BINDING SITE I, BINDING SITE II or BINDING SITE III of FIG. 8. Table 4 illustrates the complementarity of the nucleotide sequences of LOC283861 BINDING SITE1 through LOC283861 BINDING SITE3, designated SEQ ID:1635, SEQ ID:1401 and SEQ ID:7476 respectively, to the nucleotide sequence of GAM281 RNA, herein designated GAM RNA, also designated SEQ ID:278.

Another function of GAM281 is therefore inhibition of LOC283861 (Accession NP_787095.1). Accordingly, utilities of GAM281 include diagnosis, prevention and treatment of diseases and clinical conditions associated with LOC283861.

LOC283863 (Accession XP_208875.1) is another GAM281 target gene, herein designated TARGET GENE. LOC283863 BINDING SITE is a target binding site found in the 3' untranslated region of mRNA encoded by LOC283863, corresponding to a target binding site such as BINDING SITE I, BINDING SITE II or BINDING SITE III of FIG. 8. Table 4 illustrates the complementarity of the nucleotide sequences of LOC283863 BINDING SITE, designated SEQ ID:13285, to the nucleotide sequence of GAM281 RNA, herein designated GAM RNA, also designated SEQ ID:278.

Another function of GAM281 is therefore inhibition of LOC283863 (Accession XP_208875.1). Accordingly, utilities of GAM281 include diagnosis, prevention and treatment of diseases and clinical conditions associated with LOC283863.

LOC283887 (Accession XP_211248.2) is another GAM281 target gene, herein designated TARGET GENE. LOC283887 BINDING SITE is a target binding site found in the 5' untranslated region of mRNA encoded by LOC283887, corresponding to a target binding site such as BINDING SITE I, BINDING SITE II or BINDING SITE III of FIG. 8. Table 4 illustrates the complementarity of the nucleotide sequences of LOC283887 BINDING SITE, designated SEQ ID:18993, to the nucleotide sequence of GAM281 RNA, herein designated GAM RNA, also designated SEQ ID:278.

Another function of GAM281 is therefore inhibition of LOC283887 (Accession XP_211248.2). Accordingly, utilities of GAM281 include diagnosis, prevention and treatment of diseases and clinical conditions associated with LOC283887.

LOC283888 (Accession XP_211249.1) is another GAM281 target gene, herein designated TARGET GENE. LOC283888 BINDING SITE1 and LOC283888 BINDING SITE2 are target binding sites found in untranslated regions of mRNA encoded by LOC283888, corresponding to target binding sites such as BINDING SITE I, BINDING SITE II or BINDING SITE III of FIG. 8. Table 4 illustrates the complementarity of the nucleotide sequences of LOC283888 BINDING SITE1 and LOC283888 BINDING SITE2, designated SEQ ID:11072 and SEQ ID:14104 respectively, to the nucleotide sequence of GAM281 RNA, herein designated GAM RNA, also designated SEQ ID:278.

Another function of GAM281 is therefore inhibition of LOC283888 (Accession XP_211249.1). Accordingly, utilities of GAM281 include diagnosis, prevention and treatment of diseases and clinical conditions associated with LOC283888.

LOC283889 (Accession XP_208899.1) is another GAM281 target gene, herein designated TARGET GENE. LOC283889 BINDING SITE1 and LOC283889 BINDING SITE2 are target binding sites found in untranslated regions of mRNA encoded by LOC283889, corresponding to target binding sites such as BINDING SITE I, BINDING SITE II or BINDING SITE III of FIG. 8. Table 4 illustrates the complementarity of the nucleotide sequences of LOC283889 BINDING SITE1 and LOC283889 BINDING SITE2, designated SEQ ID:5525 and SEQ ID:3899 respectively, to the nucleotide sequence of GAM281 RNA, herein designated GAM RNA, also designated SEQ ID:278.

Another function of GAM281 is therefore inhibition of LOC283889 (Accession XP_208899.1). Accordingly, utilities of GAM281 include diagnosis, prevention and treatment of diseases and clinical conditions associated with LOC283889.

LOC283894 (Accession XP_211250.1) is another GAM281 target gene, herein designated TARGET GENE. LOC283894 BINDING SITE is a target binding site found in the 3' untranslated region of mRNA encoded by LOC283894, corresponding to a target binding site such as BINDING SITE I, BINDING SITE II or BINDING SITE III of FIG. 8. Table 4 illustrates the complementarity of the nucleotide sequences of LOC283894 BINDING SITE, designated SEQ ID:7156, to the nucleotide sequence of GAM281 RNA, herein designated GAM RNA, also designated SEQ ID:278.

Another function of GAM281 is therefore inhibition of LOC283894 (Accession XP_211250.1). Accordingly, utilities of GAM281 include diagnosis, prevention and treatment of diseases and clinical conditions associated with LOC283894.

LOC283909 (Accession XP_211256.1) is another GAM281 target gene, herein designated TARGET GENE. LOC283909 BINDING SITE is a target binding site found in the 3' untranslated region of mRNA encoded by LOC283909, corresponding to a target binding site such as BINDING SITE I, BINDING SITE II or BINDING SITE III of FIG. 8. Table 4 illustrates the complementarity of the nucleotide sequences of LOC283909 BINDING SITE, designated SEQ ID:7156, to the nucleotide sequence of GAM281 RNA, herein designated GAM RNA, also designated SEQ ID:278.

Another function of GAM281 is therefore inhibition of LOC283909 (Accession XP_211256.1). Accordingly, utilities of GAM281 include diagnosis, prevention and treatment of diseases and clinical conditions associated with LOC283909.

LOC283928 (Accession XP_208909.1) is another GAM281 target gene, herein designated TARGET GENE. LOC283928 BINDING SITE1 through LOC283928 BINDING SITE3 are target binding sites found in untranslated regions of mRNA encoded by LOC283928, corresponding to target binding sites such as BINDING SITE I, BINDING SITE II or BINDING SITE III of FIG. 8. Table 4 illustrates the complementarity of the nucleotide sequences of LOC283928 BINDING SITE1 through LOC283928 BINDING SITE3, designated SEQ ID:20101, SEQ ID:4703 and SEQ ID:11501 respectively, to the nucleotide sequence of GAM281 RNA, herein designated GAM RNA, also designated SEQ ID:278.

Another function of GAM281 is therefore inhibition of LOC283928 (Accession XP_208909.1). Accordingly, utilities of GAM281 include diagnosis, prevention and treatment of diseases and clinical conditions associated with LOC283928.

LOC283929 (Accession XP_208905.2) is another GAM281 target gene, herein designated TARGET GENE. LOC283929 BINDING SITE is a target binding site found in the 5' untranslated region of mRNA encoded by LOC283929, corresponding to a target binding site such as BINDING SITE I, BINDING SITE II or BINDING SITE III of FIG. 8. Table 4 illustrates the complementarity of the nucleotide sequences of LOC283929 BINDING SITE, designated SEQ ID:15775, to the nucleotide sequence of GAM281 RNA, herein designated GAM RNA, also designated SEQ ID:278.

Another function of GAM281 is therefore inhibition of LOC283929 (Accession XP_208905.2). Accordingly, utilities of GAM281 include diagnosis, prevention and treatment of diseases and clinical conditions associated with LOC283929.

LOC283954 (Accession XP_208931.1) is another GAM281 target gene, herein designated TARGET GENE. LOC283954 BINDING SITE is a target binding site found in the 3' untranslated region of mRNA encoded by LOC283954, corresponding to a target binding site such as BINDING SITE I, BINDING SITE II or BINDING SITE III of FIG. 8. Table 4 illustrates the complementarity of the nucleotide sequences of LOC283954 BINDING SITE, designated SEQ ID:10461, to the nucleotide sequence of GAM281 RNA, herein designated GAM RNA, also designated SEQ ID:278.

Another function of GAM281 is therefore inhibition of LOC283954 (Accession XP_208931.1). Accordingly, utilities of GAM281 include diagnosis, prevention and treatment of diseases and clinical conditions associated with LOC283954.

LOC283964 (Accession XP_208145.2) is another GAM281 target gene, herein designated TARGET GENE. LOC283964 BINDING SITE is a target binding site found in the 3' untranslated region of mRNA encoded by LOC283964, corresponding to a target binding site such as BINDING SITE I, BINDING SITE II or BINDING SITE III of FIG. 8. Table 4 illustrates the complementarity of the nucleotide sequences of LOC283964 BINDING SITE, designated SEQ ID:19569, to the nucleotide sequence of GAM281 RNA, herein designated GAM RNA, also designated SEQ ID:278.

Another function of GAM281 is therefore inhibition of LOC283964 (Accession XP_208145.2). Accordingly, utilities of GAM281 include diagnosis, prevention and treatment of diseases and clinical conditions associated with LOC283964.

LOC283983 (Accession XP_211289.1) is another GAM281 target gene, herein designated TARGET GENE. LOC283983 BINDING SITE is a target binding site found in the 3' untranslated region of mRNA encoded by LOC283983, corresponding to a target binding site such as BINDING SITE I, BINDING SITE II or BINDING SITE III of FIG. 8. Table 4 illustrates the complementarity of the nucleotide sequences of LOC283983 BINDING SITE, designated SEQ ID:4650, to the nucleotide sequence of GAM281 RNA, herein designated GAM RNA, also designated SEQ ID:278.

Another function of GAM281 is therefore inhibition of LOC283983 (Accession XP_211289.1). Accordingly, utilities of GAM281 include diagnosis, prevention and treatment of diseases and clinical conditions associated with LOC283983.

LOC284001 (Accession XP_208958.2) is another GAM281 target gene, herein designated TARGET GENE. LOC284001 BINDING SITE is a target binding site found in the 3' untranslated region of mRNA encoded by LOC284001, corresponding to a target binding site such as BINDING SITE I, BINDING SITE II or BINDING SITE III of FIG. 8. Table 4 illustrates the complementarity of the nucleotide sequences of LOC284001 BINDING SITE, designated SEQ ID:18161, to the nucleotide sequence of GAM281 RNA, herein designated GAM RNA, also designated SEQ ID:278.

Another function of GAM281 is therefore inhibition of LOC284001 (Accession XP_208958.2). Accordingly, utilities of GAM281 include diagnosis, prevention and treatment of diseases and clinical conditions associated with LOC284001.

LOC284016 (Accession XP_211298.1) is another GAM281 target gene, herein designated TARGET GENE. LOC284016 BINDING SITE1 and LOC284016 BINDING SITE2 are target binding sites found in untranslated regions of mRNA encoded by LOC284016, corresponding to target binding sites such as BINDING SITE I, BINDING SITE II or BINDING SITE III of FIG. 8. Table 4 illustrates the complementarity of the nucleotide sequences of LOC284016 BINDING SITE1 and LOC284016 BINDING SITE2, designated SEQ ID:3244 and SEQ ID:17923 respectively, to the nucleotide sequence of GAM281 RNA, herein designated GAM RNA, also designated SEQ ID:278.

Another function of GAM281 is therefore inhibition of LOC284016 (Accession XP_211298.1). Accordingly, utilities of GAM281 include diagnosis, prevention and treatment of diseases and clinical conditions associated with LOC284016.

LOC284017 (Accession XP_208961.1) is another GAM281 target gene, herein designated TARGET GENE. LOC284017 BINDING SITE is a target binding site found in the 3' untranslated region of mRNA encoded by LOC284017, corresponding to a target binding site such as BINDING SITE I, BINDING SITE II or BINDING SITE III of FIG. 8. Table 4 illustrates the complementarity of the nucleotide sequences of LOC284017 BINDING SITE, designated SEQ ID:18610, to the nucleotide sequence of GAM281 RNA, herein designated GAM RNA, also designated SEQ ID:278.

Another function of GAM281 is therefore inhibition of LOC284017 (Accession XP_208961.1). Accordingly, utilities of GAM281 include diagnosis, prevention and treatment of diseases and clinical conditions associated with LOC284017.

LOC284019 (Accession XP_211302.1) is another GAM281 target gene, herein designated TARGET GENE. LOC284019 BINDING SITE is a target binding site found in the 3' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:10124, to the nucleotide sequence of GAM281 RNA, herein designated GAM RNA, also designated SEQ ID:278.

Another function of GAM281 is therefore inhibition of LOC284019 (Accession XP_211302.1). Accordingly, utilities of GAM281 include diagnosis, prevention and treatment of diseases and clinical conditions associated with LOC284019.

LOC284023 (Accession XP_208983.3) is another GAM281 target gene, herein designated TARGET GENE. LOC284023 BINDING SITE1 and LOC284023 BINDING SITE2 are target binding sites found in untranslated regions of mRNA encoded by LOC284023, corresponding to target binding sites such as BINDING SITE I, BINDING SITE II or BINDING SITE III of FIG. 8. Table 4 illustrates the complementarity of the nucleotide sequences of LOC284023 BINDING SITE1 and LOC284023 BINDING SITE2, designated SEQ ID:14597 and SEQ ID:17953 respectively, to the nucleotide sequence of GAM281 RNA, herein designated GAM RNA, also designated SEQ ID:278.

Another function of GAM281 is therefore inhibition of LOC284023 (Accession XP_208983.3). Accordingly, utilities of GAM281 include diagnosis, prevention and treatment of diseases and clinical conditions associated with LOC284023.

LOC284048 (Accession XP_208152.1) is another GAM281 target gene, herein designated TARGET GENE. LOC284048 BINDING SITE is a target binding site found in the 3' untranslated region of mRNA encoded by LOC284048, corresponding to a target binding site such as BINDING SITE I, BINDING SITE II or BINDING SITE III of FIG. 8. Table 4 illustrates the complementarity of the nucleotide sequences of LOC284048 BINDING SITE, designated SEQ ID:10847, to the nucleotide sequence of GAM281 RNA, herein designated GAM RNA, also designated SEQ ID:278.

Another function of GAM281 is therefore inhibition of LOC284048 (Accession XP_208152.1). Accordingly, utilities of GAM281 include diagnosis, prevention and treatment of diseases and clinical conditions associated with LOC284048.

LOC284063 (Accession XP_208992.1) is another GAM281 target gene, herein designated TARGET GENE. LOC284063 BINDING SITE is a target binding site found in the 3' untranslated region of mRNA encoded by LOC284063, corresponding to a target binding site such as BINDING SITE I, BINDING SITE II or BINDING SITE III of FIG. 8. Table 4 illustrates the complementarity of the nucleotide sequences of LOC284063 BINDING SITE, designated SEQ ID:6213, to the nucleotide sequence of GAM281 RNA, herein designated GAM RNA, also designated SEQ ID:278.

Another function of GAM281 is therefore inhibition of LOC284063 (Accession XP_208992.1). Accordingly, utilities of GAM281 include diagnosis, prevention and treatment of diseases and clinical conditions associated with LOC284063.

LOC284074 (Accession XP_211321.1) is another GAM281 target gene, herein designated TARGET GENE. LOC284074 BINDING SITE1 and LOC284074 BINDING SITE2 are target binding sites found in untranslated regions of mRNA encoded by LOC284074, corresponding to target binding sites such as BINDING SITE I, BINDING SITE II or BINDING SITE III of FIG. 8. Table 4 illustrates the complementarity of the nucleotide sequences of LOC284074 BINDING SITE1 and LOC284074 BINDING SITE2, designated SEQ ID:1596 and SEQ ID:15531 respectively, to the nucleotide sequence of GAM281 RNA, herein designated GAM RNA, also designated SEQ ID:278.

Another function of GAM281 is therefore inhibition of LOC284074 (Accession XP_211321.1). Accordingly, utilities of GAM281 include diagnosis, prevention and treatment of diseases and clinical conditions associated with LOC284074.

LOC284082 (Accession XP_211323.1) is another GAM281 target gene, herein designated TARGET GENE. LOC284082 BINDING SITE is a target binding site found in the 3' untranslated region of mRNA encoded by LOC284082, corresponding to a target binding site such as BINDING SITE I, BINDING SITE II or BINDING SITE III of FIG. 8. Table 4 illustrates the complementarity of the nucleotide sequences of LOC284082 BINDING SITE, designated SEQ ID:18527, to the nucleotide sequence of GAM281 RNA, herein designated GAM RNA, also designated SEQ ID:278.

Another function of GAM281 is therefore inhibition of LOC284082 (Accession XP_211323.1). Accordingly, utilities of GAM281 include diagnosis, prevention and treatment of diseases and clinical conditions associated with LOC284082.

LOC284095 (Accession XP_211324.1) is another GAM281 target gene, herein designated TARGET GENE. LOC284095 BINDING SITE1 through LOC284095 BINDING SITE3 are target binding sites found in untranslated regions of mRNA encoded by LOC284095, corresponding to target binding sites such as BINDING SITE I, BINDING SITE II or BINDING SITE III of FIG. 8. Table 4 illustrates the complementarity of the nucleotide sequences of LOC284095 BINDING SITE1 through LOC284095 BINDING SITE3, designated SEQ ID:7333, SEQ ID:11799 and SEQ ID:15513 respectively, to the nucleotide sequence of GAM281 RNA, herein designated GAM RNA, also designated SEQ ID:278.

Another function of GAM281 is therefore inhibition of LOC284095 (Accession XP_211324.1). Accordingly, utilities of GAM281 include diagnosis, prevention and treatment of diseases and clinical conditions associated with LOC284095.

LOC284098 (Accession XP_209008.3) is another GAM281 target gene, herein designated TARGET GENE. LOC284098 BINDING SITE is a target binding site found in the 3' untranslated region of mRNA encoded by LOC284098, corresponding to a target binding site such as BINDING SITE I, BINDING SITE II or BINDING SITE III of FIG. 8. Table 4 illustrates the complementarity of the nucleotide sequences of LOC284098 BINDING SITE, designated SEQ ID:8582, to the nucleotide sequence of GAM281 RNA, herein designated GAM RNA, also designated SEQ ID:278.

Another function of GAM281 is therefore inhibition of LOC284098 (Accession XP_209008.3). Accordingly, utilities of GAM281 include diagnosis, prevention and treatment of diseases and clinical conditions associated with LOC284098.

LOC284100 (Accession XP_209015.1) is another GAM281 target gene, herein designated TARGET GENE. LOC284100 BINDING SITE is a target binding site found in the 3' untranslated region of mRNA encoded by LOC284100, corresponding to a target binding site such as BINDING SITE I, BINDING SITE II or BINDING SITE III of FIG. 8. Table 4 illustrates the complementarity of the nucleotide sequences of LOC284100 BINDING SITE, designated SEQ ID:1777, to the nucleotide sequence of GAM281 RNA, herein designated GAM RNA, also designated SEQ ID:278.

Another function of GAM281 is therefore inhibition of LOC284100 (Accession XP_209015.1). Accordingly, utilities of GAM281 include diagnosis, prevention and treatment of diseases and clinical conditions associated with LOC284100.

LOC284101 (Accession XP_209019.1) is another GAM281 target gene, herein designated TARGET GENE. LOC284101 BINDING SITE is a target binding site found in the 5' untranslated region of mRNA encoded by LOC284101, corresponding to a target binding site such as BINDING SITE I, BINDING SITE II or BINDING SITE III of FIG. 8. Table 4 illustrates the complementarity of the nucleotide sequences of LOC284101 BINDING SITE, designated SEQ ID:19537, to the nucleotide sequence of GAM281 RNA, herein designated GAM RNA, also designated SEQ ID:278.

Another function of GAM281 is therefore inhibition of LOC284101 (Accession XP_209019.1). Accordingly, utilities of GAM281 include diagnosis, prevention and treatment of diseases and clinical conditions associated with LOC284101.

LOC284102 (Accession XP_211327.3) is another GAM281 target gene, herein designated TARGET GENE. LOC284102 BINDING SITE1 through LOC284102 BINDING SITE3 are target binding sites found in untranslated regions of mRNA encoded by LOC284102, corresponding to target binding sites such as BINDING SITE I, BINDING SITE II or BINDING SITE III of FIG. 8. Table 4 illustrates the complementarity of the nucleotide sequences of LOC284102 BINDING SITE1 through LOC284102 BINDING SITE3, designated SEQ ID:18149, SEQ ID:3233 and SEQ ID:7745 respectively, to the nucleotide sequence of GAM281 RNA, herein designated GAM RNA, also designated SEQ ID:278.

Another function of GAM281 is therefore inhibition of LOC284102 (Accession XP_211327.3). Accordingly, utilities of GAM281 include diagnosis, prevention and treatment of diseases and clinical conditions associated with LOC284102.

LOC284117 (Accession XP_209024.1) is another GAM281 target gene, herein designated TARGET GENE. LOC284117 BINDING SITE is a target binding site found in the 3' untranslated region of mRNA encoded by LOC284117, corresponding to a target binding site such as BINDING SITE I, BINDING SITE II or BINDING SITE III of FIG. 8. Table 4 illustrates the complementarity of the nucleotide sequences of LOC284117 BINDING SITE, designated SEQ ID:3725, to the nucleotide sequence of GAM281 RNA, herein designated GAM RNA, also designated SEQ ID:278.

Another function of GAM281 is therefore inhibition of LOC284117 (Accession XP_209024.1). Accordingly, utilities of GAM281 include diagnosis, prevention and treatment of diseases and clinical conditions associated with LOC284117.

LOC284128 (Accession XP_211342.1) is another GAM281 target gene, herein designated TARGET GENE. LOC284128 BINDING SITE1 and LOC284128 BINDING SITE2 are target binding sites found in untranslated regions of mRNA encoded by LOC284128, corresponding to target binding sites such as BINDING SITE I, BINDING SITE II or BINDING SITE III of FIG. 8. Table 4 illustrates the complementarity of the nucleotide sequences of LOC284128 BINDING SITE1 and LOC284128 BINDING SITE2, designated SEQ ID:17271 and SEQ ID:1966 respectively, to the nucleotide sequence of GAM281 RNA, herein designated GAM RNA, also designated SEQ ID:278.

Another function of GAM281 is therefore inhibition of LOC284128 (Accession XP_211342.1). Accordingly, utilities of GAM281 include diagnosis, prevention and treatment of diseases and clinical conditions associated with LOC284128.

LOC284135 (Accession XP_209032.1) is another GAM281 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:12779, to the nucleotide sequence of GAM281 RNA, herein designated GAM RNA, also designated SEQ ID:278.

Another function of GAM281 is therefore inhibition of LOC284135 (Accession XP_209032.1). Accordingly, utilities of GAM281 include diagnosis, prevention and treatment of diseases and clinical conditions associated with LOC284135.

LOC284145 (Accession XP_211353.1) is another GAM281 target gene, herein designated TARGET GENE. LOC284145 BINDING SITE is a target binding site found in the 5' untranslated region of mRNA encoded by LOC284145, corresponding to a target binding site such as BINDING SITE I, BINDING SITE II or BINDING SITE III of FIG. 8. Table 4 illustrates the complementarity of the nucleotide sequences of LOC284145 BINDING SITE, designated SEQ ID:4102, to the nucleotide sequence of GAM281 RNA, herein designated GAM RNA, also designated SEQ ID:278.

Another function of GAM281 is therefore inhibition of LOC284145 (Accession XP_211353.1). Accordingly, utilities of GAM281 include diagnosis, prevention and treatment of diseases and clinical conditions associated with LOC284145.

LOC284171 (Accession XP_209051.1) is another GAM281 target gene, herein designated TARGET GENE. LOC284171 BINDING SITE is a target binding site found in the 3' untranslated region of mRNA encoded by LOC284171, corresponding to a target binding site such as BINDING SITE I, BINDING SITE II or BINDING SITE III of FIG. 8. Table 4 illustrates the complementarity of the nucleotide sequences of LOC284171 BINDING SITE, designated SEQ ID:11530, to the nucleotide sequence of GAM281 RNA, herein designated GAM RNA, also designated SEQ ID:278.

Another function of GAM281 is therefore inhibition of LOC284171 (Accession XP_209051.1). Accordingly, utilities of GAM281 include diagnosis, prevention and treatment of diseases and clinical conditions associated with LOC284171.

LOC284183 (Accession XP_209059.1) is another GAM281 target gene, herein designated TARGET GENE. LOC284183 BINDING SITE1 and LOC284183 BINDING SITE2 are target binding sites found in untranslated regions of mRNA encoded by LOC284183, corresponding to target binding sites such as BINDING SITE I, BINDING SITE II or BINDING SITE III of FIG. 8. Table 4 illustrates the complementarity of the nucleotide sequences of LOC284183 BINDING SITE1 and LOC284183 BINDING SITE2, designated SEQ ID:1111 and SEQ ID:9456 respectively, to the nucleotide sequence of GAM281 RNA, herein designated GAM RNA, also designated SEQ ID:278.

Another function of GAM281 is therefore inhibition of LOC284183 (Accession XP_209059.1). Accordingly, utilities of GAM281 include diagnosis, prevention and treatment of diseases and clinical conditions associated with LOC284183.

LOC284186 (Accession XP_209060.2) is another GAM281 target gene, herein designated TARGET GENE. LOC284186 BINDING SITE is a target binding site found in the 3' untranslated region of mRNA encoded by LOC284186, corresponding to a target binding site such as BINDING SITE I, BINDING SITE II or BINDING SITE III of FIG. 8. Table 4 illustrates the complementarity of the nucleotide sequences of LOC284186 BINDING SITE, designated SEQ ID:14861, to the nucleotide sequence of GAM281 RNA, herein designated GAM RNA, also designated SEQ ID:278.

Another function of GAM281 is therefore inhibition of LOC284186 (Accession XP_209060.2). Accordingly, utilities of GAM281 include diagnosis, prevention and treatment of diseases and clinical conditions associated with LOC284186.

LOC284245 (Accession XP_211397.1) is another GAM281 target gene, herein designated TARGET GENE. LOC284245 BINDING SITE is a target binding site found in the 5' untranslated region of mRNA encoded by LOC284245, corresponding to a target binding site such as BINDING SITE I, BINDING SITE II or BINDING SITE III of FIG. 8. Table 4 illustrates the complementarity of the nucleotide sequences of LOC284245 BINDING SITE, designated SEQ ID:8707, to the nucleotide sequence of GAM281 RNA, herein designated GAM RNA, also designated SEQ ID:278.

Another function of GAM281 is therefore inhibition of LOC284245 (Accession XP_211397.1). Accordingly, utilities of GAM281 include diagnosis, prevention and treatment of diseases and clinical conditions associated with LOC284245.

LOC284267 (Accession XP_211411.1) is another GAM281 target gene, herein designated TARGET GENE. LOC284267 BINDING SITE is a target binding site found in the 5' untranslated region of mRNA encoded by LOC284267, corresponding to a target binding site such as BINDING SITE I, BINDING SITE II or BINDING SITE III of FIG. 8. Table 4 illustrates the complementarity of the nucleotide sequences of LOC284267 BINDING SITE, designated SEQ ID:8494, to the nucleotide sequence of GAM281 RNA, herein designated GAM RNA, also designated SEQ ID:278.

Another function of GAM281 is therefore inhibition of LOC284267 (Accession XP_211411.1). Accordingly, utilities of GAM281 include diagnosis, prevention and treatment of diseases and clinical conditions associated with LOC284267.

LOC284276 (Accession XP_211412.1) is another GAM281 target gene, herein designated TARGET GENE. LOC284276 BINDING SITE is a target binding site found in the 5' untranslated region of mRNA encoded by LOC284276, corresponding to a target binding site such as BINDING SITE I, BINDING SITE II or BINDING SITE III of FIG. 8. Table 4 illustrates the complementarity of the nucleotide sequences of LOC284276 BINDING SITE, designated SEQ ID:1026, to the nucleotide sequence of GAM281 RNA, herein designated GAM RNA, also designated SEQ ID:278.

Another function of GAM281 is therefore inhibition of LOC284276 (Accession XP_211412.1). Accordingly, utilities of GAM281 include diagnosis, prevention and treatment of diseases and clinical conditions associated with LOC284276.

LOC284286 (Accession XP_211419.1) is another GAM281 target gene, herein designated TARGET GENE. LOC284286 BINDING SITE is a target binding site found in the 3' untranslated region of mRNA encoded by LOC284286, corresponding to a target binding site such as BINDING SITE I, BINDING SITE II or BINDING SITE III of FIG. 8. Table 4 illustrates the complementarity of the nucleotide sequences of LOC284286 BINDING SITE, designated SEQ ID:19875, to the nucleotide sequence of GAM281 RNA, herein designated GAM RNA, also designated SEQ ID:278.

Another function of GAM281 is therefore inhibition of LOC284286 (Accession XP_211419.1). Accordingly, utilities of GAM281 include diagnosis, prevention and treatment of diseases and clinical conditions associated with LOC284286.

LOC284289 (Accession XP_209105.1) is another GAM281 target gene, herein designated TARGET GENE. LOC284289 BINDING SITE is a target binding site found in the 3' untranslated region of mRNA encoded by LOC284289, corresponding to a target binding site such as BINDING SITE I, BINDING SITE II or BINDING SITE III of FIG. 8. Table 4 illustrates the complementarity of the nucleotide sequences of LOC284289 BINDING SITE, designated SEQ ID:1885, to the nucleotide sequence of GAM281 RNA, herein designated GAM RNA, also designated SEQ ID:278.

Another function of GAM281 is therefore inhibition of LOC284289 (Accession XP_209105.1). Accordingly, utilities of GAM281 include diagnosis, prevention and treatment of diseases and clinical conditions associated with LOC284289.

LOC284304 (Accession XP_211426.1) is another GAM281 target gene, herein designated TARGET GENE. LOC284304 BINDING SITE is a target binding site found in the 3' untranslated region of mRNA encoded by LOC284304, corresponding to a target binding site such as BINDING SITE I, BINDING SITE II or BINDING SITE III of FIG. 8. Table 4 illustrates the complementarity of the nucleotide sequences of LOC284304 BINDING SITE, designated SEQ ID:4849, to the nucleotide sequence of GAM281 RNA, herein designated GAM RNA, also designated SEQ ID:278.

Another function of GAM281 is therefore inhibition of LOC284304 (Accession XP_211426.1). Accordingly, utilities of GAM281 include diagnosis, prevention and treatment of diseases and clinical conditions associated with LOC284304.

LOC284305 (Accession XP_211425.1) is another GAM281 target gene, herein designated TARGET GENE. LOC284305 BINDING SITE1 and LOC284305 BINDING SITE2 are target binding sites found in untranslated regions of mRNA encoded by LOC284305, corresponding to target binding sites such as BINDING SITE I, BINDING SITE II or BINDING SITE III of FIG. 8. Table 4 illustrates the complementarity of the nucleotide sequences of LOC284305 BINDING SITE1 and LOC284305 BINDING SITE2, designated SEQ ID:2477 and SEQ ID:3802 respectively, to the nucleotide sequence of GAM281 RNA, herein designated GAM RNA, also designated SEQ ID:278.

Another function of GAM281 is therefore inhibition of LOC284305 (Accession XP_211425.1). Accordingly, utilities of GAM281 include diagnosis, prevention and treatment of diseases and clinical conditions associated with LOC284305.

LOC284317 (Accession XP_209162.1) is another GAM281 target gene, herein designated TARGET GENE. LOC284317 BINDING SITE1 and LOC284317 BINDING SITE2 are target binding sites found in untranslated regions of mRNA encoded by LOC284317, corresponding to target binding sites such as BINDING SITE I, BINDING SITE II or BINDING SITE III of FIG. 8. Table 4 illustrates the complementarity of the nucleotide sequences of LOC284317 BINDING SITE1 and LOC284317 BINDING SITE2, designated SEQ ID:7077 and SEQ ID:3386 respectively, to the nucleotide sequence of GAM281 RNA, herein designated GAM RNA, also designated SEQ ID:278.

Another function of GAM281 is therefore inhibition of LOC284317 (Accession XP_209162.1). Accordingly, utilities of GAM281 include diagnosis, prevention and treatment of diseases and clinical conditions associated with LOC284317.

LOC284321 (Accession XP_211432.1) is another GAM281 target gene, herein designated TARGET GENE. LOC284321 BINDING SITE is a target binding site found in the 5' untranslated region of mRNA encoded by LOC284321, corresponding to a target binding site such as BINDING SITE I, BINDING SITE II or BINDING SITE III of FIG. 8. Table 4 illustrates the complementarity of the nucleotide sequences of LOC284321 BINDING SITE, designated SEQ ID:11129, to the nucleotide sequence of GAM281 RNA, herein designated GAM RNA, also designated SEQ ID:278.

Another function of GAM281 is therefore inhibition of LOC284321 (Accession XP_211432.1). Accordingly, utilities of GAM281 include diagnosis, prevention and treatment of diseases and clinical conditions associated with LOC284321.

LOC284325 (Accession XP_209143.1) is another GAM281 target gene, herein designated TARGET GENE. LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:1731, to the nucleotide sequence of GAM281 RNA, herein designated GAM RNA, also designated SEQ ID:278.

Another function of GAM281 is therefore inhibition of LOC284325 (Accession XP_209143.1). Accordingly, utilities of GAM281 include diagnosis, prevention and treatment of diseases and clinical conditions associated with LOC284325.

LOC284356 (Accession XP_211437.1) is another GAM281 target gene, herein designated TARGET GENE. LOC284356 BINDING SITE is a target binding site found in the 3' untranslated region of mRNA encoded by LOC284356, corresponding to a target binding site such as BINDING SITE I, BINDING SITE II or BINDING SITE III of FIG. 8. Table 4 illustrates the complementarity of the nucleotide sequences of LOC284356 BINDING SITE, designated SEQ ID:11986, to the nucleotide sequence of GAM281 RNA, herein designated GAM RNA, also designated SEQ ID:278.

Another function of GAM281 is therefore inhibition of LOC284356 (Accession XP_211437.1). Accordingly, utilities of GAM281 include diagnosis, prevention and treatment of diseases and clinical conditions associated with LOC284356.

LOC284362 (Accession XP_211435.1) is another GAM281 target gene, herein designated TARGET GENE. LOC284362 BINDING SITE is a target binding site found in the 3' untranslated region of mRNA encoded by LOC284362, corresponding to a target binding site such as BINDING SITE I, BINDING SITE II or BINDING SITE III of FIG. 8. Table 4 illustrates the complementarity of the nucleotide sequences of LOC284362 BINDING SITE, designated SEQ ID:18898, to the nucleotide sequence of GAM281 RNA, herein designated GAM RNA, also designated SEQ ID:278.

Another function of GAM281 is therefore inhibition of LOC284362 (Accession XP_211435.1). Accordingly, utilities of GAM281 include diagnosis, prevention and treatment of diseases and clinical conditions associated with LOC284362.

LOC284375 (Accession XP_209154.1) is another GAM281 target gene, herein designated TARGET GENE. LOC284375 BINDING SITE is a target binding site found in the 3' untranslated region of mRNA encoded by LOC284375, corresponding to a target binding site such as BINDING SITE I, BINDING SITE II or BINDING SITE III of FIG. 8. Table 4 illustrates the complementarity of the nucleotide sequences of LOC284375 BINDING SITE, designated SEQ ID:16701, to the nucleotide sequence of GAM281 RNA, herein designated GAM RNA, also designated SEQ ID:278.

Another function of GAM281 is therefore inhibition of LOC284375 (Accession XP_209154.1). Accordingly, utilities of GAM281 include diagnosis, prevention and treatment of diseases and clinical conditions associated with LOC284375.

LOC284376 (Accession XP_209157.1) is another GAM281 target gene, herein designated TARGET GENE. LOC284376 BINDING SITE1 and LOC284376 BINDING SITE2 are target binding sites found in untranslated regions of mRNA encoded by LOC284376, corresponding to target binding sites such as BINDING SITE I, BINDING SITE II or BINDING SITE III of FIG. 8. Table 4 illustrates the complementarity of the nucleotide sequences of LOC284376BINDING SITE1 and LOC284376 BINDING SITE2, designated SEQ ID:19718 and SEQ ID:981 respectively, to the nucleotide sequence of GAM281 RNA, herein designated GAM RNA, also designated SEQ ID:278.

Another function of GAM281 is therefore inhibition of LOC284376 (Accession XP_209157.1). Accordingly, utilities of GAM281 include diagnosis, prevention and treatment of diseases and clinical conditions associated with LOC284376.

LOC284379 (Accession XP_209163.1) is another GAM281 target gene, herein designated TARGET GENE. LOC284379 BINDING SITE is a target binding site found in the 3' untranslated region of mRNA encoded by LOC284379, corresponding to a target binding site such as BINDING SITE I, BINDING SITE II or BINDING SITE III of FIG. 8. Table 4 illustrates the complementarity of the nucleotide sequences of LOC284379 BINDING SITE, designated SEQ ID:9312, to the nucleotide sequence of GAM281 RNA, herein designated GAM RNA, also designated SEQ ID:278.

Another function of GAM281 is therefore inhibition of LOC284379 (Accession XP_209163.1). Accordingly, utilities of GAM281 include diagnosis, prevention and treatment of diseases and clinical conditions associated with LOC284379.

LOC284396 (Accession XP_211452.1) is another GAM281 target gene, herein designated TARGET GENE. LOC284396 BINDING SITE is a target binding site found in the 3' untranslated region of mRNA encoded by LOC284396, corresponding to a target binding site such as BINDING SITE I, BINDING SITE II or BINDING SITE III of FIG. 8. Table 4 illustrates the complementarity of the nucleotide sequences of LOC284396 BINDING SITE, designated SEQ ID:10399, to the nucleotide sequence of GAM281 RNA, herein designated GAM RNA, also designated SEQ ID:278.

Another function of GAM281 is therefore inhibition of LOC284396 (Accession XP_211452.1). Accordingly, utilities of GAM281 include diagnosis, prevention and treatment of diseases and clinical conditions associated with LOC284396.

LOC284405 (Accession XP_209183.2) is another GAM281 target gene, herein designated TARGET GENE. LOC284405 BINDING SITE1 and LOC284405 BINDING SITE2 are target binding sites found in untranslated regions of mRNA encoded by LOC284405, corresponding to target binding sites such as BINDING SITE I, BINDING SITE II or BINDING SITE III of FIG. 8. Table 4 illustrates the complementarity of the nucleotide sequences of LOC284405 BINDING SITE1 and LOC284405 BINDING SITE2, designated SEQ ID:2645 and SEQ ID:19462 respectively, to the nucleotide sequence of GAM281 RNA, herein designated GAM RNA, also designated SEQ ID:278.

Another function of GAM281 is therefore inhibition of LOC284405 (Accession XP_209183.2). Accordingly, utilities of GAM281 include diagnosis, prevention and treatment of diseases and clinical conditions associated with LOC284405.

LOC284408 (Accession XP_211443.1) is another GAM281 target gene, herein designated TARGET GENE. LOC284408 BINDING SITE is a target binding site found in the 5' untranslated region of mRNA encoded by LOC284408, corresponding to a target binding site such as BINDING SITE I, BINDING SITE II or BINDING SITE III of FIG. 8. Table 4 illustrates the complementarity of the nucleotide sequences of LOC284408 BINDING SITE, designated SEQ ID:14364, to the nucleotide sequence of GAM281 RNA, herein designated GAM RNA, also designated SEQ ID:278.

Another function of GAM281 is therefore inhibition of LOC284408 (Accession XP_211443.1). Accordingly, utilities of GAM281 include diagnosis, prevention and treatment of diseases and clinical conditions associated with LOC284408.

LOC284410 (Accession XP_211449.1) is another GAM281 target gene, herein designated TARGET GENE. LOC284410 BINDING SITE is a target binding site found in the 3' untranslated region of mRNA encoded by LOC284410, corresponding to a target binding site such as BINDING SITE I, BINDING SITE II or BINDING SITE III of FIG. 8. Table 4 illustrates the complementarity of the nucleotide sequences of LOC284410 BINDING SITE, designated SEQ ID:17304, to the nucleotide sequence of GAM281 RNA, herein designated GAM RNA, also designated SEQ ID:278.

Another function of GAM281 is therefore inhibition of LOC284410 (Accession XP_211449.1). Accordingly, utilities of GAM281 include diagnosis, prevention and treatment of diseases and clinical conditions associated with LOC284410.

LOC284421 (Accession XP_209200.1) is another GAM281 target gene, herein designated TARGET GENE. LOC284421 BINDING SITE is a target binding site found in the 5' untranslated region of mRNA encoded by LOC284421, corresponding to a target binding site such as BINDING SITE I, BINDING SITE II or BINDING SITE III of FIG. 8. Table 4 illustrates the complementarity of the nucleotide sequences of LOC284421 BINDING SITE, designated SEQ ID:4533, to the nucleotide sequence of GAM281 RNA, herein designated GAM RNA, also designated SEQ ID:278.

Another function of GAM281 is therefore inhibition of LOC284421 (Accession XP_209200.1). Accordingly, utilities of GAM281 include diagnosis, prevention and treatment of diseases and clinical conditions associated with LOC284421.

LOC284426 (Accession XP_209198.1) is another GAM281 target gene, herein designated TARGET GENE. LOC284426 BINDING SITE1 and LOC284426 BINDING SITE2 are target binding sites found in untranslated regions of mRNA encoded by LOC284426, corresponding to target binding sites such as BINDING SITE I, BINDING SITE II or BINDING SITE III of FIG. 8. Table 4 illustrates the complementarity of the nucleotide sequences of LOC284426 BINDING SITE1 and LOC284426 BINDING SITE2, designated SEQ ID:4975 and SEQ ID:5357 respectively, to the nucleotide sequence of GAM281 RNA, herein designated GAM RNA, also designated SEQ ID:278.

Another function of GAM281 is therefore inhibition of LOC284426 (Accession XP_209198.1). Accordingly, utilities of GAM281 include diagnosis, prevention and treatment of diseases and clinical conditions associated with LOC284426.

LOC284436 (Accession XP_290862.1) is another GAM281 target gene, herein designated TARGET GENE. LOC284436 BINDING SITE is a target binding site found in the 3' untranslated region of mRNA encoded by LOC284436, corresponding to a target binding site such as BINDING SITE I, BINDING SITE II or BINDING SITE III of FIG. 8. Table 4 illustrates the complementarity of the nucleotide sequences of LOC284436 BINDING SITE, designated SEQ ID:16193, to the nucleotide sequence of GAM281 RNA, herein designated GAM RNA, also designated SEQ ID:278.

Another function of GAM281 is therefore inhibition of LOC284436 (Accession XP_290862.1). Accordingly, utilities of GAM281 include diagnosis, prevention and treatment of diseases and clinical conditions associated with LOC284436.

LOC284439 (Accession XP_209204.2) is another GAM281 target gene, herein designated TARGET GENE. LOC284439 BINDING SITE is a target binding site found in the 3' untranslated region of mRNA encoded by LOC284439, corresponding to a target binding site such as BINDING SITE I, BINDING SITE II or BINDING SITE III of FIG. 8. Table 4 illustrates the complementarity of the nucleotide sequences of LOC284439 BINDING SITE, designated SEQ ID:3825, to the nucleotide sequence of GAM281 RNA, herein designated GAM RNA, also designated SEQ ID:278.

Another function of GAM281 is therefore inhibition of LOC284439 (Accession XP_209204.2). Accordingly, utilities of GAM281 include diagnosis, prevention and treatment of diseases and clinical conditions associated with LOC284439.

LOC284440 (Accession XP_209210.1) is another GAM281 target gene, herein designated TARGET GENE. LOC284440 BINDING SITE is a target binding site found in the 3' untranslated region of mRNA encoded by LOC284440, corresponding to a target binding site such as BINDING SITE I, BINDING SITE II or BINDING SITE III of FIG. 8. Table 4 illustrates the complementarity of the nucleotide sequences of LOC284440 BINDING SITE, designated SEQ ID:8752, to the nucleotide sequence of GAM281 RNA, herein designated GAM RNA, also designated SEQ ID:278.

Another function of GAM281 is therefore inhibition of LOC284440 (Accession XP_209210.1). Accordingly, utilities of GAM281 include diagnosis, prevention and treatment of diseases and clinical conditions associated with LOC284440.

LOC284454 (Accession XP_209216.1) is another GAM281 target gene, herein designated TARGET GENE. LOC284454 BINDING SITE1 through LOC284454 BINDING SITE3 are target binding sites found in untranslated regions of mRNA encoded by LOC284454, corresponding to target binding sites such as BINDING SITE I, BINDING SITE II or BINDING SITE III of FIG. 8. Table 4 illustrates the complementarity of the nucleotide sequences of LOC284454 BINDING SITE1 through LOC284454 BINDING SITE3, designated SEQ ID:16031, SEQ ID:17976 and SEQ ID:3999 respectively, to the nucleotide sequence of GAM281 RNA, herein designated GAM RNA, also designated SEQ ID:278.

Another function of GAM281 is therefore inhibition of LOC284454 (Accession XP_209216.1). Accordingly, utilities of GAM281 include diagnosis, prevention and treatment of diseases and clinical conditions associated with LOC284454.

LOC284456 (Accession XP_211470.1) is another GAM281 target gene, herein designated TARGET GENE. LOC284456 BINDING SITE1 and LOC284456 BINDING SITE2 are target binding sites found in untranslated regions of mRNA encoded by LOC284456, corresponding to target binding sites such as BINDING SITE I, BINDING SITE II or BINDING SITE III of FIG. 8. Table 4 illustrates the complementarity of the nucleotide sequences of LOC284456 BINDING SITE1 and LOC284456 BINDING SITE2, designated SEQ ID:10621 and SEQ ID:18777 respectively, to the nucleotide sequence of GAM281 RNA, herein designated GAM RNA, also designated SEQ ID:278.

Another function of GAM281 is therefore inhibition of LOC284456 (Accession XP_211470.1). Accordingly, utilities of GAM281 include diagnosis, prevention and treatment of diseases and clinical conditions associated with LOC284456.

LOC284459 (Accession XP_290826.1) is another GAM281 target gene, herein designated TARGET GENE. LOC284459 BINDING SITE is a target binding site found in the 3' untranslated region of mRNA encoded by LOC284459, corresponding to a target binding site such as BINDING SITE I, BINDING SITE II or BINDING SITE III of FIG. 8. Table 4 illustrates the complementarity of the nucleotide sequences of LOC284459 BINDING SITE, designated SEQ ID:10211, to the nucleotide sequence of GAM281 RNA, herein designated GAM RNA, also designated SEQ ID:278.

Another function of GAM281 is therefore inhibition of LOC284459 (Accession XP_290826.1). Accordingly, utilities of GAM281 include diagnosis, prevention and treatment of diseases and clinical conditions associated with LOC284459.

LOC284471 (Accession XP_209225.1) is another GAM281 target gene, herein designated TARGET GENE. LOC284471 BINDING SITE is a target binding site found in the 3' untranslated region of mRNA encoded by LOC284471, corresponding to a target binding site such as BINDING SITE I, BINDING SITE II or BINDING SITE III of FIG. 8. Table 4 illustrates the complementarity of the nucleotide sequences of LOC284471 BINDING SITE, designated SEQ ID:19286, to the nucleotide sequence of GAM281 RNA, herein designated GAM RNA, also designated SEQ ID:278.

Another function of GAM281 is therefore inhibition of LOC284471 (Accession XP_209225.1). Accordingly, utilities of GAM281 include diagnosis, prevention and treatment of diseases and clinical conditions associated with LOC284471.

LOC284495 (Accession XP_302752.1) is another GAM281 target gene, herein designated TARGET GENE. LOC284495 BINDING SITE is a target binding site found in the 3' untranslated region of mRNA encoded by LOC284495, corresponding to a target binding site such as BINDING SITE I, BINDING SITE II or BINDING SITE III of FIG. 8. Table 4 illustrates the complementarity of the nucleotide sequences of LOC284495 BINDING SITE, designated SEQ ID:12538, to the nucleotide sequence of GAM281 RNA, herein designated GAM RNA, also designated SEQ ID:278.

Another function of GAM281 is therefore inhibition of LOC284495 (Accession XP_302752.1). Accordingly, utilities of GAM281 include diagnosis, prevention and treatment of diseases and clinical conditions associated with LOC284495.

LOC284512 (Accession XP_211500.1) is another GAM281 target gene, herein designated TARGET GENE. LOC284512 BINDING SITE is a target binding site found in the 3' untranslated region of mRNA encoded by LOC284512, corresponding to a target binding site such as BINDING SITE I, BINDING SITE II or BINDING SITE III of FIG. 8. Table 4 illustrates the complementarity of the nucleotide sequences of LOC284512 BINDING SITE, designated SEQ ID:14119, to the nucleotide sequence of GAM281 RNA, herein designated GAM RNA, also designated SEQ ID:278.

Another function of GAM281 is therefore inhibition of LOC284512 (Accession XP_211500.1). Accordingly, utilities of GAM281 include diagnosis, prevention and treatment of diseases and clinical conditions associated with LOC284512.

LOC284513 (Accession XP_211502.1) is another GAM281 target gene, herein designated TARGET GENE. LOC284513 BINDING SITE is a target binding site found in the 5' untranslated region of mRNA encoded by LOC284513, corresponding to a target binding site such as BINDING SITE I, BINDING SITE II or BINDING SITE III of FIG. 8. Table 4 illustrates the complementarity of the nucleotide sequences of LOC284513 BINDING SITE, designated SEQ ID:18865, to the nucleotide sequence of GAM281 RNA, herein designated GAM RNA, also designated SEQ ID:278.

Another function of GAM281 is therefore inhibition of LOC284513 (Accession XP_211502.1). Accordingly, utilities of GAM281 include diagnosis, prevention and treatment of diseases and clinical conditions associated with LOC284513.

LOC284514 (Accession XP_209244.1) is another GAM281 target gene, herein designated TARGET GENE. LOC284514 BINDING SITE is a target binding site found in the 5' untranslated region of mRNA encoded by LOC284514, corresponding to a target binding site such as BINDING SITE I, BINDING SITE II or BINDING SITE III of FIG. 8. Table 4 illustrates the complementarity of the nucleotide sequences of LOC284514 BINDING SITE, designated SEQ ID:4125, to the nucleotide sequence of GAM281 RNA, herein designated GAM RNA, also designated SEQ ID:278.

Another function of GAM281 is therefore inhibition of LOC284514 (Accession XP_209244.1). Accordingly, utilities of GAM281 include diagnosis, prevention and treatment of diseases and clinical conditions associated with LOC284514.

LOC284549 (Accession XP_211514.1) is another GAM281 target gene, herein designated TARGET GENE. LOC284549 BINDING SITE is a target binding site found in the 5' untranslated region of mRNA encoded by LOC284549, corresponding to a target binding site such as BINDING SITE I, BINDING SITE II or BINDING SITE III of FIG. 8. Table 4 illustrates the complementarity of the nucleotide sequences of LOC284549 BINDING SITE, designated SEQ ID:19112, to the nucleotide sequence of GAM281 RNA, herein designated GAM RNA, also designated SEQ ID:278.

Another function of GAM281 is therefore inhibition of LOC284549 (Accession XP_211514.1). Accordingly, utilities of GAM281 include diagnosis, prevention and treatment of diseases and clinical conditions associated with LOC284549.

LOC284551 (Accession XP_211515.1) is another GAM281 target gene, herein designated TARGET GENE. LOC284551 BINDING SITE is a target binding site found in the 3' untranslated region of mRNA encoded by LOC284551, corresponding to a target binding site such as BINDING SITE I, BINDING SITE II or BINDING SITE III of FIG. 8. Table 4 illustrates the complementarity of the nucleotide sequences of LOC284551 BINDING SITE, designated SEQ ID:9493, to the nucleotide sequence of GAM281 RNA, herein designated GAM RNA, also designated SEQ ID:278.

Another function of GAM281 is therefore inhibition of LOC284551 (Accession XP_211515.1). Accordingly, utilities of GAM281 include diagnosis, prevention and treatment of diseases and clinical conditions associated with LOC284551.

LOC284568 (Accession XP_209263.1) is another GAM281 target gene, herein designated TARGET GENE. LOC284568 BINDING SITE is a target binding site found in the 5' untranslated region of mRNA encoded by LOC284568, corresponding to a target binding site such as BINDING SITE I, BINDING SITE II or BINDING SITE III of FIG. 8. Table 4 illustrates the complementarity of the nucleotide sequences of LOC284568 BINDING SITE, designated SEQ ID:3996, to the nucleotide sequence of GAM281 RNA, herein designated GAM RNA, also designated SEQ ID:278.

Another function of GAM281 is therefore inhibition of LOC284568 (Accession XP_209263.1). Accordingly, utilities of GAM281 include diagnosis, prevention and treatment of diseases and clinical conditions associated with LOC284568.

LOC284577 (Accession XP_211522.1) is another GAM281 target gene, herein designated TARGET GENE. LOC284577 BINDING SITE is a target binding site found in the 3' untranslated region of mRNA encoded by LOC284577, corresponding to a target binding site such as BINDING SITE I, BINDING SITE II or BINDING SITE III of FIG. 8. Table 4 illustrates the complementarity of the nucleotide sequences of LOC284577 BINDING SITE, designated SEQ ID:19533, to the nucleotide sequence of GAM281 RNA, herein designated GAM RNA, also designated SEQ ID:278.

Another function of GAM281 is therefore inhibition of LOC284577 (Accession XP_211522.1). Accordingly, utilities of GAM281 include diagnosis, prevention and treatment of diseases and clinical conditions associated with LOC284577.

LOC284587 (Accession XP_209278.3) is another GAM281 target gene, herein designated TARGET GENE.

LOC284587 BINDING SITE is a target binding site found in the 5' untranslated region of mRNA encoded by LOC284587, corresponding to a target binding site such as BINDING SITE I, BINDING SITE II or BINDING SITE III of FIG. 8. Table 4 illustrates the complementarity of the nucleotide sequences of LOC284587 BINDING SITE, designated SEQ ID:12803, to the nucleotide sequence of GAM281 RNA, herein designated GAM RNA, also designated SEQ ID:278.

Another function of GAM281 is therefore inhibition of LOC284587 (Accession XP_209278.3). Accordingly, utilities of GAM281 include diagnosis, prevention and treatment of diseases and clinical conditions associated with LOC284587.

LOC284606 (Accession XP_211543.1) is another GAM281 target gene, herein designated TARGET GENE. LOC284606 BINDING SITE is a target binding site found in the 3' untranslated region of mRNA encoded by LOC284606, corresponding to a target binding site such as BINDING SITE I, BINDING SITE II or BINDING SITE III of FIG. 8. Table 4 illustrates the complementarity of the nucleotide sequences of LOC284606 BINDING SITE, designated SEQ ID:2771, to the nucleotide sequence of GAM281 RNA, herein designated GAM RNA, also designated SEQ ID:278.

Another function of GAM281 is therefore inhibition of LOC284606 (Accession XP_211543.1). Accordingly, utilities of GAM281 include diagnosis, prevention and treatment of diseases and clinical conditions associated with LOC284606.

LOC284611 (Accession XP_211552.1) is another GAM281 target gene, herein designated TARGET GENE. LOC284611 BINDING SITE is a target binding site found in the 3' untranslated region of mRNA encoded by LOC284611, corresponding to a target binding site such as BINDING SITE I, BINDING SITE II or BINDING SITE III of FIG. 8. Table 4 illustrates the complementarity of the nucleotide sequences of LOC284611 BINDING SITE, designated SEQ ID:12497, to the nucleotide sequence of GAM281 RNA, herein designated GAM RNA, also designated SEQ ID:278.

Another function of GAM281 is therefore inhibition of LOC284611 (Accession XP_211552.1). Accordingly, utilities of GAM281 include diagnosis, prevention and treatment of diseases and clinical conditions associated with LOC284611.

LOC284628 (Accession XP_211561.1) is another GAM281 target gene, herein designated TARGET GENE. LOC284628 BINDING SITE is a target binding site found in the 5' untranslated region of mRNA encoded by LOC284628, corresponding to a target binding site such as BINDING SITE I, BINDING SITE II or BINDING SITE III of FIG. 8. Table 4 illustrates the complementarity of the nucleotide sequences of LOC284628 BINDING SITE, designated SEQ ID:18882, to the nucleotide sequence of GAM281 RNA, herein designated GAM RNA, also designated SEQ ID:278.

Another function of GAM281 is therefore inhibition of LOC284628 (Accession XP_211561.1). Accordingly, utilities of GAM281 include diagnosis, prevention and treatment of diseases and clinical conditions associated with LOC284628.

LOC284630 (Accession XP_211562.1) is another GAM281 target gene, herein designated TARGET GENE. LOC284630 BINDING SITE is a target binding site found in the 3' untranslated region of mRNA encoded by LOC284630, corresponding to a target binding site such as BINDING SITE I, BINDING SITE II or BINDING SITE III of FIG. 8. Table 4 illustrates the complementarity of the nucleotide sequences of LOC284630 BINDING SITE, designated SEQ ID:8272, to the nucleotide sequence of GAM281 RNA, herein designated GAM RNA, also designated SEQ ID:278.

Another function of GAM281 is therefore inhibition of LOC284630 (Accession XP_211562.1). Accordingly, utilities of GAM281 include diagnosis, prevention and treatment of diseases and clinical conditions associated with LOC284630.

LOC284663 (Accession XP_209310.1) is another GAM281 target gene, herein designated TARGET GENE. LOC284663 BINDING SITE is a target binding site found in the 3' untranslated region of mRNA encoded by LOC284663, corresponding to a target binding site such as BINDING SITE I, BINDING SITE II or BINDING SITE III of FIG. 8. Table 4 illustrates the complementarity of the nucleotide sequences of LOC284663 BINDING SITE, designated SEQ ID:5249, to the nucleotide sequence of GAM281 RNA, herein designated GAM RNA, also designated SEQ ID:278.

Another function of GAM281 is therefore inhibition of LOC284663 (Accession XP_209310.1). Accordingly, utilities of GAM281 include diagnosis, prevention and treatment of diseases and clinical conditions associated with LOC284663.

LOC284675 (Accession XP_209319.1) is another GAM281 target gene, herein designated TARGET GENE. LOC284675 BINDING SITE1 through LOC284675 BINDING SITE3 are target binding sites found in untranslated regions of mRNA encoded by LOC284675, corresponding to target binding sites such as BINDING SITE I, BINDING SITE II or BINDING SITE III of FIG. 8. Table 4 illustrates the complementarity of the nucleotide sequences of LOC284675 BINDING SITE1 through LOC284675 BINDING SITE3, designated SEQ ID:5250, SEQ ID:2389 and SEQ ID:501 respectively, to the nucleotide sequence of GAM281 RNA, herein designated GAM RNA, also designated SEQ ID:278.

Another function of GAM281 is therefore inhibition of LOC284675 (Accession XP_209319.1). Accordingly, utilities of GAM281 include diagnosis, prevention and treatment of diseases and clinical conditions associated with LOC284675.

LOC284701 (Accession XP_294994.1) is another GAM281 target gene, herein designated TARGET GENE. LOC284701 BINDING SITE is a target binding site found in the 5' untranslated region of mRNA encoded by LOC284701, corresponding to a target binding site such as BINDING SITE I, BINDING SITE II or BINDING SITE III of FIG. 8. Table 4 illustrates the complementarity of the nucleotide sequences of LOC284701 BINDING SITE, designated SEQ ID:12803, to the nucleotide sequence of GAM281 RNA, herein designated GAM RNA, also designated SEQ ID:278.

Another function of GAM281 is therefore inhibition of LOC284701 (Accession XP_294994.1). Accordingly, utilities of GAM281 include diagnosis, prevention and treatment of diseases and clinical conditions associated with LOC284701.

LOC284708 (Accession XP_209332.1) is another GAM281 target gene, herein designated TARGET GENE. LOC284708 BINDING SITE is a target binding site found in the 3' untranslated region of mRNA encoded by LOC284708, corresponding to a target binding site such as BINDING SITE I, BINDING SITE II or BINDING SITE III of FIG. 8. Table 4 illustrates the complementarity of the nucleotide sequences of LOC284708 BINDING SITE, designated SEQ ID:5153, to the nucleotide sequence of GAM281 RNA, herein designated GAM RNA, also designated SEQ ID:278.

Another function of GAM281 is therefore inhibition of LOC284708 (Accession XP_209332.1). Accordingly, utilities of GAM281 include diagnosis, prevention and treatment of diseases and clinical conditions associated with LOC284708.

LOC284723 (Accession XP_211602.1) is another GAM281 target gene, herein designated TARGET GENE. LOC284723 BINDING SITE1 and LOC284723 BINDING SITE2 are target binding sites found in untranslated regions of mRNA encoded by LOC284723, corresponding to target binding sites such as BINDING SITE I, BINDING SITE II or BINDING SITE III of FIG. 8. Table 4 illustrates the complementarity of the nucleotide sequences of LOC284723 BINDING SITE1 and LOC284723 BINDING SITE2, designated SEQ ID:6498 and SEQ ID:3182 respectively, to the nucleotide sequence of GAM281 RNA, herein designated GAM RNA, also designated SEQ ID:278.

Another function of GAM281 is therefore inhibition of LOC284723 (Accession XP_211602.1). Accordingly, utilities of GAM281 include diagnosis, prevention and treatment of diseases and clinical conditions associated with LOC284723.

LOC284754 (Accession XP_211627.1) is another GAM281 target gene, herein designated TARGET GENE. LOC284754 BINDING SITE is a target binding site found in the 5' untranslated region of mRNA encoded by LOC284754, corresponding to a target binding site such as BINDING SITE I, BINDING SITE II or BINDING SITE III of FIG. 8. Table 4 illustrates the complementarity of the nucleotide sequences of LOC284754 BINDING SITE, designated SEQ ID:10930, to the nucleotide sequence of GAM281 RNA, herein designated GAM RNA, also designated SEQ ID:278.

Another function of GAM281 is therefore inhibition of LOC284754 (Accession XP_211627.1). Accordingly, utilities of GAM281 include diagnosis, prevention and treatment of diseases and clinical conditions associated with LOC284754.

LOC284805 (Accession XP_209371.1) is another GAM281 target gene, herein designated TARGET GENE. LOC284805 BINDING SITE1 through LOC284805 BINDING SITE3 are target binding sites found in untranslated regions of mRNA encoded by LOC284805, corresponding to target binding sites such as BINDING SITE I, BINDING SITE II or BINDING SITE III of FIG. 8. Table 4 illustrates the complementarity of the nucleotide sequences of LOC284805 BINDING SITE1 through LOC284805 BINDING SITE3, designated SEQ ID:1544, SEQ ID:8046 and SEQ ID:853 respectively, to the nucleotide sequence of GAM281 RNA, herein designated GAM RNA, also designated SEQ ID:278.

Another function of GAM281 is therefore inhibition of LOC284805 (Accession XP_209371.1). Accordingly, utilities of GAM281 include diagnosis, prevention and treatment of diseases and clinical conditions associated with LOC284805.

LOC284839 (Accession XP_211661.1) is another GAM281 target gene, herein designated TARGET GENE. LOC284839 BINDING SITE is a target binding site found in the 5' untranslated region of mRNA encoded by LOC284839, corresponding to a target binding site such as BINDING SITE I, BINDING SITE II or BINDING SITE III of FIG. 8. Table 4 illustrates the complementarity of the nucleotide sequences of LOC284839 BINDING SITE, designated SEQ ID:19401, to the nucleotide sequence of GAM281 RNA, herein designated GAM RNA, also designated SEQ ID:278.

Another function of GAM281 is therefore inhibition of LOC284839 (Accession XP_211661.1). Accordingly, utilities of GAM281 include diagnosis, prevention and treatment of diseases and clinical conditions associated with LOC284839.

LOC284853 (Accession XP_209383.1) is another GAM281 target gene, herein designated TARGET GENE. LOC284853 BINDING SITE is a target binding site found in the 3' untranslated region of mRNA encoded by LOC284853, corresponding to a target binding site such as BINDING SITE I, BINDING SITE II or BINDING SITE III of FIG. 8. Table 4 illustrates the complementarity of the nucleotide sequences of LOC284853 BINDING SITE, designated SEQ ID:3582, to the nucleotide sequence of GAM281 RNA, herein designated GAM RNA, also designated SEQ ID:278.

Another function of GAM281 is therefore inhibition of LOC284853 (Accession XP_209383.1). Accordingly, utilities of GAM281 include diagnosis, prevention and treatment of diseases and clinical conditions associated with LOC284853.

LOC284856 (Accession XP_211668.2) is another GAM281 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:12736, to the nucleotide sequence of GAM281 RNA, herein designated GAM RNA, also designated SEQ ID:278.

Another function of GAM281 is therefore inhibition of LOC284856 (Accession XP_211668.2). Accordingly, utilities of GAM281 include diagnosis, prevention and treatment of diseases and clinical conditions associated with LOC284856.

LOC284856 (Accession XP_302835.1) is another GAM281 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:12736, to the nucleotide sequence of GAM281 RNA, herein designated GAM RNA, also designated SEQ ID:278.

Another function of GAM281 is therefore inhibition of LOC284856 (Accession XP_302835.1). Accordingly, utilities of GAM281 include diagnosis, prevention and treatment of diseases and clinical conditions associated with LOC284856.

LOC284865 (Accession XP_211672.1) is another GAM281 target gene, herein designated TARGET GENE. LOC284865 BINDING SITE is a target binding site found in the 3' untranslated region of mRNA encoded by LOC284865, corresponding to a target binding site such as BINDING SITE I, BINDING SITE II or BINDING SITE III of FIG. 8. Table 4 illustrates the complementarity of the nucleotide sequences of LOC284865 BINDING SITE, designated SEQ ID:1645, to the nucleotide sequence of GAM281 RNA, herein designated GAM RNA, also designated SEQ ID:278.

Another function of GAM281 is therefore inhibition of LOC284865 (Accession XP_211672.1). Accordingly, utilities of GAM281 include diagnosis, prevention and treatment of diseases and clinical conditions associated with LOC284865.

LOC284874 (Accession XP_209394.1) is another GAM281 target gene, herein designated TARGET GENE. LOC284874 BINDING SITE1 and LOC284874 BINDING SITE2 are target binding sites found in untranslated regions of mRNA encoded by LOC284874, corresponding to target binding sites such as BINDING SITE I, BINDING SITE II or BINDING SITE III of FIG. 8. Table 4 illustrates the complementarity of the nucleotide sequences of LOC284874 BINDING SITE1 and LOC284874 BINDING SITE2, designated SEQ ID:16244 and SEQ ID:3846 respectively, to the nucleotide sequence of GAM281 RNA, herein designated GAM RNA, also designated SEQ ID:278.

Another function of GAM281 is therefore inhibition of LOC284874 (Accession XP_209394.1). Accordingly, utilities of GAM281 include diagnosis, prevention and treatment of diseases and clinical conditions associated with LOC284874.

LOC284934 (Accession XP_211696.1) is another GAM281 target gene, herein designated TARGET GENE. LOC284934 BINDING SITE is a target binding site found in the 5' untranslated region of mRNA encoded by LOC284934, corresponding to a target binding site such as BINDING SITE I, BINDING SITE II or BINDING SITE III of FIG. 8. Table 4 illustrates the complementarity of the nucleotide sequences of LOC284934 BINDING SITE, designated SEQ ID:14894, to the nucleotide sequence of GAM281 RNA, herein designated GAM RNA, also designated SEQ ID:278.

Another function of GAM281 is therefore inhibition of LOC284934 (Accession XP_211696.1). Accordingly, utilities of GAM281 include diagnosis, prevention and treatment of diseases and clinical conditions associated with LOC284934.

LOC284950 (Accession XP_211703.1) is another GAM281 target gene, herein designated TARGET GENE. LOC284950 BINDING SITE1 and LOC284950 BINDING SITE2 are target binding sites found in untranslated regions of mRNA encoded by LOC284950, corresponding to target binding sites such as BINDING SITE I, BINDING SITE II or BINDING SITE III of FIG. 8. Table 4 illustrates the complementarity of the nucleotide sequences of LOC284950BINDING SITE1 and LOC284950 BINDING SITE2, designated SEQ ID:4025 and SEQ ID:17553 respectively, to the nucleotide sequence of GAM281 RNA, herein designated GAM RNA, also designated SEQ ID:278.

Another function of GAM281 is therefore inhibition of LOC284950 (Accession XP_211703.1). Accordingly, utilities of GAM281 include diagnosis, prevention and treatment of diseases and clinical conditions associated with LOC284950.

LOC285002 (Accession XP_211731.2) is another GAM281 target gene, herein designated TARGET GENE. LOC285002 BINDING SITE is a target binding site found in the 3' untranslated region of mRNA encoded by LOC285002, corresponding to a target binding site such as BINDING SITE I, BINDING SITE II or BINDING SITE III of FIG. 8. Table 4 illustrates the complementarity of the nucleotide sequences of LOC285002 BINDING SITE, designated SEQ ID:3500, to the nucleotide sequence of GAM281 RNA, herein designated GAM RNA, also designated SEQ ID:278.

Another function of GAM281 is therefore inhibition of LOC285002 (Accession XP_211731.2). Accordingly, utilities of GAM281 include diagnosis, prevention and treatment of diseases and clinical conditions associated with LOC285002.

LOC285026 (Accession XP_209440.1) is another GAM281 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:17523, to the nucleotide sequence of GAM281 RNA, herein designated GAM RNA, also designated SEQ ID:278.

Another function of GAM281 is therefore inhibition of LOC285026 (Accession XP_209440.1). Accordingly, utilities of GAM281 include diagnosis, prevention and treatment of diseases and clinical conditions associated with LOC285026.

LOC285036 (Accession XP_210798.1) is another GAM281 target gene, herein designated TARGET GENE. LOC285036 BINDING SITE is a target binding site found in the 3' untranslated region of mRNA encoded by LOC285036, corresponding to a target binding site such as BINDING SITE I, BINDING SITE II or BINDING SITE III of FIG. 8. Table 4 illustrates the complementarity of the nucleotide sequences of LOC285036 BINDING SITE, designated SEQ ID:13688, to the nucleotide sequence of GAM281 RNA, herein designated GAM RNA, also designated SEQ ID:278.

Another function of GAM281 is therefore inhibition of LOC285036 (Accession XP_210798.1). Accordingly, utilities of GAM281 include diagnosis, prevention and treatment of diseases and clinical conditions associated with LOC285036.

LOC285052 (Accession XP_211751.1) is another GAM281 target gene, herein designated TARGET GENE. LOC285052 BINDING SITE is a target binding site found in the 3' untranslated region of mRNA encoded by LOC285052, corresponding to a target binding site such as BINDING SITE I, BINDING SITE II or BINDING SITE III of FIG. 8. Table 4 illustrates the complementarity of the nucleotide sequences of LOC285052 BINDING SITE, designated SEQ ID:2174, to the nucleotide sequence of GAM281 RNA, herein designated GAM RNA, also designated SEQ ID:278.

Another function of GAM281 is therefore inhibition of LOC285052 (Accession XP_211751.1). Accordingly, utilities of GAM281 include diagnosis, prevention and treatment of diseases and clinical conditions associated with LOC285052.

LOC285058 (Accession XP_211753.1) is another GAM281 target gene, herein designated TARGET GENE. LOC285058 BINDING SITE is a target binding site found in the 5' untranslated region of mRNA encoded by LOC285058, corresponding to a target binding site such as BINDING SITE I, BINDING SITE II or BINDING SITE III of FIG. 8. Table 4 illustrates the complementarity of the nucleotide sequences of LOC285058 BINDING SITE, designated SEQ ID:20023, to the nucleotide sequence of GAM281 RNA, herein designated GAM RNA, also designated SEQ ID:278.

Another function of GAM281 is therefore inhibition of LOC285058 (Accession XP_211753.1). Accordingly, utilities of GAM281 include diagnosis, prevention and treatment of diseases and clinical conditions associated with LOC285058.

LOC285083 (Accession XP_209464.1) is another GAM281 target gene, herein designated TARGET GENE. LOC285083 BINDING SITE is a target binding site found in the 3' untranslated region of mRNA encoded by LOC285083, corresponding to a target binding site such as BINDING SITE I, BINDING SITE II or BINDING SITE III of FIG. 8. Table 4 illustrates the complementarity of the nucleotide sequences of LOC285083 BINDING SITE, designated SEQ ID:5667, to the nucleotide sequence of GAM281 RNA, herein designated GAM RNA, also designated SEQ ID:278.

Another function of GAM281 is therefore inhibition of LOC285083 (Accession XP_209464.1). Accordingly, utilities of GAM281 include diagnosis, prevention and treatment of diseases and clinical conditions associated with LOC285083.

LOC285088 (Accession XP_209465.1) is another GAM281 target gene, herein designated TARGET GENE. LOC285088 BINDING SITE is a target binding site found in the 3' untranslated region of mRNA encoded by LOC285088, corresponding to a target binding site such as BINDING SITE I, BINDING SITE II or BINDING SITE III of FIG. 8. Table 4 illustrates the complementarity of the nucleotide sequences of LOC285088 BINDING SITE, designated SEQ ID:6092, to the nucleotide sequence of GAM281 RNA, herein designated GAM RNA, also designated SEQ ID:278.

Another function of GAM281 is therefore inhibition of LOC285088 (Accession XP_209465.1). Accordingly, utilities of GAM281 include diagnosis, prevention and treatment of diseases and clinical conditions associated with LOC285088.

LOC285123 (Accession XP_211773.1) is another GAM281 target gene, herein designated TARGET GENE. LOC285123 BINDING SITE is a target binding site found in the 3' untranslated region of mRNA encoded by LOC285123, corresponding to a target binding site such as BINDING SITE I, BINDING SITE II or BINDING SITE III of FIG. 8. Table 4 illustrates the complementarity of the nucleotide sequences of LOC285123 BINDING SITE, designated SEQ ID:17113, to the nucleotide sequence of GAM281 RNA, herein designated GAM RNA, also designated SEQ ID:278.

Another function of GAM281 is therefore inhibition of LOC285123 (Accession XP_211773.1). Accordingly, utilities of GAM281 include diagnosis, prevention and treatment of diseases and clinical conditions associated with LOC285123.

LOC285127 (Accession XP_211771.1) is another GAM281 target gene, herein designated TARGET GENE. LOC285127 BINDING SITE1 and LOC285127 BINDING SITE2 are target binding sites found in untranslated regions of mRNA encoded by LOC285127, corresponding to target binding sites such as BINDING SITE I, BINDING SITE II or BINDING SITE III of FIG. 8. Table 4 illustrates the complementarity of the nucleotide sequences of LOC285127 BINDING SITE1 and LOC285127 BINDING SITE2, designated SEQ ID:5921 and SEQ ID:11528 respectively, to the nucleotide sequence of GAM281 RNA, herein designated GAM RNA, also designated SEQ ID:278.

Another function of GAM281 is therefore inhibition of LOC285127 (Accession XP_211771.1). Accordingly, utilities of GAM281 include diagnosis, prevention and treatment of diseases and clinical conditions associated with LOC285127.

LOC285166 (Accession XP_211791.1) is another GAM281 target gene, herein designated TARGET GENE. LOC285166 BINDING SITE1 and LOC285166 BINDING SITE2 are target binding sites found in untranslated regions of mRNA encoded by LOC285166, corresponding to target binding sites such as BINDING SITE I, BINDING SITE II or BINDING SITE III of FIG. 8. Table 4 illustrates the complementarity of the nucleotide sequences of LOC285166 BINDING SITE1 and LOC285166 BINDING SITE2, designated SEQ ID:4283 and SEQ ID:19378 respectively, to the nucleotide sequence of GAM281 RNA, herein designated GAM RNA, also designated SEQ ID:278.

Another function of GAM281 is therefore inhibition of LOC285166 (Accession XP_211791.1). Accordingly, utilities of GAM281 include diagnosis, prevention and treatment of diseases and clinical conditions associated with LOC285166.

LOC285176 (Accession XP_209500.1) is another GAM281 target gene, herein designated TARGET GENE. LOC285176 BINDING SITE is a target binding site found in the 3' untranslated region of mRNA encoded by LOC285176, corresponding to a target binding site such as BINDING SITE I, BINDING SITE II or BINDING SITE III of FIG. 8. Table 4 illustrates the complementarity of the nucleotide sequences of LOC285176 BINDING SITE, designated SEQ ID:7860, to the nucleotide sequence of GAM281 RNA, herein designated GAM RNA, also designated SEQ ID:278.

Another function of GAM281 is therefore inhibition of LOC285176 (Accession XP_209500.1). Accordingly, utilities of GAM281 include diagnosis, prevention and treatment of diseases and clinical conditions associated with LOC285176.

LOC285193 (Accession XP_209509.1) is another GAM281 target gene, herein designated TARGET GENE. LOC285193 BINDING SITE is a target binding site found in the 3' untranslated region of mRNA encoded by LOC285193, corresponding to a target binding site such as BINDING SITE I, BINDING SITE II or BINDING SITE III of FIG. 8. Table 4 illustrates the complementarity of the nucleotide sequences of LOC285193 BINDING SITE, designated SEQ ID:1745, to the nucleotide sequence of GAM281 RNA, herein designated GAM RNA, also designated SEQ ID:278.

Another function of GAM281 is therefore inhibition of LOC285193 (Accession XP_209509.1). Accordingly, utilities of GAM281 include diagnosis, prevention and treatment of diseases and clinical conditions associated with LOC285193.

LOC285221 (Accession XP_209521.1) is another GAM281 target gene, herein designated TARGET GENE. LOC285221 BINDING SITE is a target binding site found in the 5' untranslated region of mRNA encoded by LOC285221, corresponding to a target binding site such as BINDING SITE I, BINDING SITE II or BINDING SITE III of FIG. 8. Table 4 illustrates the complementarity of the nucleotide sequences of LOC285221 BINDING SITE, designated SEQ ID:13597, to the nucleotide sequence of GAM281 RNA, herein designated GAM RNA, also designated SEQ ID:278.

Another function of GAM281 is therefore inhibition of LOC285221 (Accession XP_209521.1). Accordingly, utilities of GAM281 include diagnosis, prevention and treatment of diseases and clinical conditions associated with LOC285221.

LOC285231 (Accession XP_211813.1) is another GAM281 target gene, herein designated TARGET GENE. LOC285231 BINDING SITE1 and LOC285231 BINDING SITE2 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231BINDING SITE1 and LOC285231 BINDING SITE2, designated SEQ ID:8001 and SEQ ID:15366 respectively, to the nucleotide sequence of GAM281 RNA, herein designated GAM RNA, also designated SEQ ID:278.

Another function of GAM281 is therefore inhibition of LOC285231 (Accession XP_211813.1). Accordingly, utilities of GAM281 include diagnosis, prevention and treatment of diseases and clinical conditions associated with LOC285231.

LOC285231 (Accession XP_211813.1) is another GAM281 target gene, herein designated TARGET GENE. LOC285231 BINDING SITE1 and LOC285231 BINDING SITE2 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231 BIND- ING SITE1 and LOC285231 BINDING SITE2, designated SEQ ID:8001 and SEQ ID:5012 respectively, to the nucleotide sequence of GAM281 RNA, herein designated GAM RNA, also designated SEQ ID:278.

Another function of GAM281 is therefore inhibition of LOC285231 (Accession XP_211813.1). Accordingly, utilities of GAM281 include diagnosis, prevention and treatment of diseases and clinical conditions associated with LOC285231.

LOC285281 (Accession XP_211829.1) is another GAM281 target gene, herein designated TARGET GENE. LOC285281 BINDING SITE is a target binding site found in the 5' untranslated region of mRNA encoded by LOC285281, corresponding to a target binding site such as BINDING SITE I, BINDING SITE II or BINDING SITE III of FIG. 8. Table 4 illustrates the complementarity of the nucleotide sequences of LOC285281 BINDING SITE, designated SEQ ID:15575, to the nucleotide sequence of GAM281 RNA, herein designated GAM RNA, also designated SEQ ID:278.

Another function of GAM281 is therefore inhibition of LOC285281 (Accession XP_211829.1). Accordingly, utilities of GAM281 include diagnosis, prevention and treatment of diseases and clinical conditions associated with LOC285281.

LOC285299 (Accession XP_209554.1) is another GAM281 target gene, herein designated TARGET GENE. LOC285299 BINDING SITE is a target binding site found in the 3' untranslated region of mRNA encoded by LOC285299, corresponding to a target binding site such as BINDING SITE I, BINDING SITE II or BINDING SITE III of FIG. 8. Table 4 illustrates the complementarity of the nucleotide sequences of LOC285299 BINDING SITE, designated SEQ ID:9374, to the nucleotide sequence of GAM281 RNA, herein designated GAM RNA, also designated SEQ ID:278.

Another function of GAM281 is therefore inhibition of LOC285299 (Accession XP_209554.1). Accordingly, utilities of GAM281 include diagnosis, prevention and treatment of diseases and clinical conditions associated with LOC285299.

LOC285334 (Accession XP_211844.1) is another GAM281 target gene, herein designated TARGET GENE. LOC285334 BINDING SITE is a target binding site found in the 3' untranslated region of mRNA encoded by LOC285334, corresponding to a target binding site such as BINDING SITE I, BINDING SITE II or BINDING SITE III of FIG. 8. Table 4 illustrates the complementarity of the nucleotide sequences of LOC285334 BINDING SITE, designated SEQ ID:1027, to the nucleotide sequence of GAM281 RNA, herein designated GAM RNA, also designated SEQ ID:278.

Another function of GAM281 is therefore inhibition of LOC285334 (Accession XP_211844.1). Accordingly, utilities of GAM281 include diagnosis, prevention and treatment of diseases and clinical conditions associated with LOC285334.

LOC285345 (Accession XP_211854.1) is another GAM281 target gene, herein designated TARGET GENE. LOC285345 BINDING SITE1 and LOC285345 BINDING SITE2 are target binding sites found in untranslated regions of mRNA encoded by LOC285345, corresponding to target binding sites such as BINDING SITE I, BINDING SITE II or BINDING SITE III of FIG. 8. Table 4 illustrates the complementarity of the nucleotide sequences of LOC285345 BINDING SITE1 and LOC285345 BINDING SITE2, designated SEQ ID:18883 and SEQ ID:556 respectively, to the nucleotide sequence of GAM281 RNA, herein designated GAM RNA, also designated SEQ ID:278.

Another function of GAM281 is therefore inhibition of LOC285345 (Accession XP_211854.1). Accordingly, utilities of GAM281 include diagnosis, prevention and treatment of diseases and clinical conditions associated with LOC285345.

LOC285366 (Accession XP_209581.1) is another GAM281 target gene, herein designated TARGET GENE. LOC285366 BINDING SITE is a target binding site found in the 3' untranslated region of mRNA encoded by LOC285366, corresponding to a target binding site such as BINDING SITE I, BINDING SITE II or BINDING SITE III of FIG. 8. Table 4 illustrates the complementarity of the nucleotide sequences of LOC285366 BINDING SITE, designated SEQ ID:6117, to the nucleotide sequence of GAM281 RNA, herein designated GAM RNA, also designated SEQ ID:278.

Another function of GAM281 is therefore inhibition of LOC285366 (Accession XP_209581.1). Accordingly, utilities of GAM281 include diagnosis, prevention and treatment of diseases and clinical conditions associated with LOC285366.

LOC285369 (Accession XP_211861.3) is another GAM281 target gene, herein designated TARGET GENE. LOC285369 BINDING SITE is a target binding site found in the 3' untranslated region of mRNA encoded by LOC285369, corresponding to a target binding site such as BINDING SITE I, BINDING SITE II or BINDING SITE III of FIG. 8. Table 4 illustrates the complementarity of the nucleotide sequences of LOC285369 BINDING SITE, designated SEQ ID:10352, to the nucleotide sequence of GAM281 RNA, herein designated GAM RNA, also designated SEQ ID:278.

Another function of GAM281 is therefore inhibition of LOC285369 (Accession XP_211861.3). Accordingly, utilities of GAM281 include diagnosis, prevention and treatment of diseases and clinical conditions associated with LOC285369.

LOC285389 (Accession XP_211873.1) is another GAM281 target gene, herein designated TARGET GENE. LOC285389 BINDING SITE is a target binding site found in the 3' untranslated region of mRNA encoded by LOC285389, corresponding to a target binding site such as BINDING SITE I, BINDING SITE II or BINDING SITE III of FIG. 8. Table 4 illustrates the complementarity of the nucleotide sequences of LOC285389 BINDING SITE, designated SEQ ID:19692, to the nucleotide sequence of GAM281 RNA, herein designated GAM RNA, also designated SEQ ID:278.

Another function of GAM281 is therefore inhibition of LOC285389 (Accession XP_211873.1). Accordingly, utilities of GAM281 include diagnosis, prevention and treatment of diseases and clinical conditions associated with LOC285389.

LOC285392 (Accession XP_211879.1) is another GAM281 target gene, herein designated TARGET GENE. LOC285392 BINDING SITE1 and LOC285392 BINDING SITE2 are target binding sites found in untranslated regions of mRNA encoded by LOC285392, corresponding to target binding sites such as BINDING SITE I, BINDING SITE II or BINDING SITE III of FIG. 8. Table 4 illustrates the complementarity of the nucleotide sequences of LOC285392 BINDING SITE1 and LOC285392 BINDING SITE2, designated SEQ ID:9688 and SEQ ID:17969 respectively, to the nucleotide sequence of GAM281 RNA, herein designated GAM RNA, also designated SEQ ID:278.

Another function of GAM281 is therefore inhibition of LOC285392 (Accession XP_211879.1). Accordingly, utilities of GAM281 include diagnosis, prevention and treatment of diseases and clinical conditions associated with LOC285392.

LOC285398 (Accession XP_209593.1) is another GAM281 target gene, herein designated TARGET GENE. LOC285398 BINDING SITE1 and LOC285398 BINDING SITE2 are target binding sites found in untranslated regions of mRNA encoded by LOC285398, corresponding to target binding sites such as BINDING SITE I, BINDING SITE II or BINDING SITE III of FIG. 8. Table 4 illustrates the complementarity of the nucleotide sequences of LOC285398 BINDING SITE1 and LOC285398 BINDING SITE2, designated SEQ ID:13286 and SEQ ID:4655 respectively, to the nucleotide sequence of GAM281 RNA, herein designated GAM RNA, also designated SEQ ID:278.

Another function of GAM281 is therefore inhibition of LOC285398 (Accession XP_209593.1). Accordingly, utilities of GAM281 include diagnosis, prevention and treatment of diseases and clinical conditions associated with LOC285398.

LOC285429 (Accession XP_209607.3) is another GAM281 target gene, herein designated TARGET GENE. LOC285429 BINDING SITE is a target binding site found in the 3' untranslated region of mRNA encoded by LOC285429, corresponding to a target binding site such as BINDING SITE I, BINDING SITE II or BINDING SITE III of FIG. 8. Table 4 illustrates the complementarity of the nucleotide sequences of LOC285429 BINDING SITE, designated SEQ ID:4171, to the nucleotide sequence of GAM281 RNA, herein designated GAM RNA, also designated SEQ ID:278.

Another function of GAM281 is therefore inhibition of LOC285429 (Accession XP_209607.3). Accordingly, utilities of GAM281 include diagnosis, prevention and treatment of diseases and clinical conditions associated with LOC285429.

LOC285488 (Accession XP_211914.1) is another GAM281 target gene, herein designated TARGET GENE. LOC285488 BINDING SITE is a target binding site found in the 5' untranslated region of mRNA encoded by LOC285488, corresponding to a target binding site such as BINDING SITE I, BINDING SITE II or BINDING SITE III of FIG. 8. Table 4 illustrates the complementarity of the nucleotide sequences of LOC285488 BINDING SITE, designated SEQ ID:13804, to the nucleotide sequence of GAM281 RNA, herein designated GAM RNA, also designated SEQ ID:278.

Another function of GAM281 is therefore inhibition of LOC285488 (Accession XP_211914.1). Accordingly, utilities of GAM281 include diagnosis, prevention and treatment of diseases and clinical conditions associated with LOC285488.

LOC285491 (Accession XP_211917.1) is another GAM281 target gene, herein designated TARGET GENE. LOC285491 BINDING SITE is a target binding site found in the 3' untranslated region of mRNA encoded by LOC285491, corresponding to a target binding site such as BINDING SITE I, BINDING SITE II or BINDING SITE III of FIG. 8. Table 4 illustrates the complementarity of the nucleotide sequences of LOC285491 BINDING SITE, designated SEQ ID:11239, to the nucleotide sequence of GAM281 RNA, herein designated GAM RNA, also designated SEQ ID:278.

Another function of GAM281 is therefore inhibition of LOC285491 (Accession XP_211917.1). Accordingly, utilities of GAM281 include diagnosis, prevention and treatment of diseases and clinical conditions associated with LOC285491.

LOC285509 (Accession XP_211923.1) is another GAM281 target gene, herein designated TARGET GENE. LOC285509 BINDING SITE is a target binding site found in the 5' untranslated region of mRNA encoded by LOC285509, corresponding to a target binding site such as BINDING SITE I, BINDING SITE II or BINDING SITE III of FIG. 8. Table 4 illustrates the complementarity of the nucleotide sequences of LOC285509 BINDING SITE, designated SEQ ID:3519, to the nucleotide sequence of GAM281 RNA, herein designated GAM RNA, also designated SEQ ID:278.

Another function of GAM281 is therefore inhibition of LOC285509 (Accession XP_211923.1). Accordingly, utilities of GAM281 include diagnosis, prevention and treatment of diseases and clinical conditions associated with LOC285509.

LOC285540 (Accession XP_209654.1) is another GAM281 target gene, herein designated TARGET GENE. LOC285540 BINDING SITE1 and LOC285540 BINDING SITE2 are target binding sites found in untranslated regions of mRNA encoded by LOC285540, corresponding to target binding sites such as BINDING SITE I, BINDING SITE II or BINDING SITE III of FIG. 8. Table 4 illustrates the complementarity of the nucleotide sequences of LOC285540 BINDING SITE1 and LOC285540 BINDING SITE2, designated SEQ ID:9543 and SEQ ID:6961 respectively, to the nucleotide sequence of GAM281 RNA, herein designated GAM RNA, also designated SEQ ID:278.

Another function of GAM281 is therefore inhibition of LOC285540 (Accession XP_209654.1). Accordingly, utilities of GAM281 include diagnosis, prevention and treatment of diseases and clinical conditions associated with LOC285540.

LOC285560 (Accession XP_209660.1) is another GAM281 target gene, herein designated TARGET GENE. LOC285560 BINDING SITE is a target binding site found in the 3' untranslated region of mRNA encoded by LOC285560, corresponding to a target binding site such as BINDING SITE I, BINDING SITE II or BINDING SITE III of FIG. 8. Table 4 illustrates the complementarity of the nucleotide sequences of LOC285560 BINDING SITE, designated SEQ ID:8718, to the nucleotide sequence of GAM281 RNA, herein designated GAM RNA, also designated SEQ ID:278.

Another function of GAM281 is therefore inhibition of LOC285560 (Accession XP_209660.1). Accordingly, utilities of GAM281 include diagnosis, prevention and treatment of diseases and clinical conditions associated with LOC285560.

LOC285577 (Accession XP_211941.1) is another GAM281 target gene, herein designated TARGET GENE. LOC285577 BINDING SITE is a target binding site found in the 5' untranslated region of mRNA encoded by LOC285577, corresponding to a target binding site such as BINDING SITE I, BINDING SITE II or BINDING SITE III of FIG. 8. Table 4 illustrates the complementarity of the nucleotide sequences of LOC285577 BINDING SITE, designated SEQ ID:4455, to the nucleotide sequence of GAM281 RNA, herein designated GAM RNA, also designated SEQ ID:278.

Another function of GAM281 is therefore inhibition of LOC285577 (Accession XP_211941.1). Accordingly, utilities of GAM281 include diagnosis, prevention and treatment of diseases and clinical conditions associated with LOC285577.

LOC285589 (Accession XP_209671.1) is another GAM281 target gene, herein designated TARGET GENE. LOC285589 BINDING SITE1 and LOC285589 BINDING SITE2 are target binding sites found in untranslated regions of mRNA encoded by LOC285589, corresponding to target binding sites such as BINDING SITE I, BINDING SITE II or BINDING SITE III of FIG. 8. Table 4 illustrates the complementarity of the nucleotide sequences of LOC285589 BINDING SITE1 and LOC285589 BINDING SITE2, designated SEQ ID:12804 and SEQ ID:17087 respectively, to the nucleotide sequence of GAM281 RNA, herein designated GAM RNA, also designated SEQ ID:278.

Another function of GAM281 is therefore inhibition of LOC285589 (Accession XP_209671.1). Accordingly, utilities of GAM281 include diagnosis, prevention and treatment of diseases and clinical conditions associated with LOC285589.

LOC285626 (Accession XP_211959.1) is another GAM281 target gene, herein designated TARGET GENE. LOC285626 BINDING SITE is a target binding site found in the 5' untranslated region of mRNA encoded by LOC285626, corresponding to a target binding site such as BINDING SITE I, BINDING SITE II or BINDING SITE III of FIG. 8. Table 4 illustrates the complementarity of the nucleotide sequences of LOC285626 BINDING SITE, designated SEQ ID:13843, to the nucleotide sequence of GAM281 RNA, herein designated GAM RNA, also designated SEQ ID:278.

Another function of GAM281 is therefore inhibition of LOC285626 (Accession XP_211959.1). Accordingly, utilities of GAM281 include diagnosis, prevention and treatment of diseases and clinical conditions associated with LOC285626.

LOC285633 (Accession XP_211965.1) is another GAM281 target gene, herein designated TARGET GENE. LOC285633 BINDING SITE is a target binding site found in the 5' untranslated region of mRNA encoded by LOC285633, corresponding to a target binding site such as BINDING SITE I, BINDING SITE II or BINDING SITE III of FIG. 8. Table 4 illustrates the complementarity of the nucleotide sequences of LOC285633 BINDING SITE, designated SEQ ID:12452, to the nucleotide sequence of GAM281 RNA, herein designated GAM RNA, also designated SEQ ID:278.

Another function of GAM281 is therefore inhibition of LOC285633 (Accession XP_211965.1). Accordingly, utilities of GAM281 include diagnosis, prevention and treatment of diseases and clinical conditions associated with LOC285633.

LOC285638 (Accession XP_209693.1) is another GAM281 target gene, herein designated TARGET GENE. LOC285638 BINDING SITE is a target binding site found in the 5' untranslated region of mRNA encoded by LOC285638, corresponding to a target binding site such as BINDING SITE I, BINDING SITE II or BINDING SITE III of FIG. 8. Table 4 illustrates the complementarity of the nucleotide sequences of LOC285638 BINDING SITE, designated SEQ ID:4949, to the nucleotide sequence of GAM281 RNA, herein designated GAM RNA, also designated SEQ ID:278.

Another function of GAM281 is therefore inhibition of LOC285638 (Accession XP_209693.1). Accordingly, utilities of GAM281 include diagnosis, prevention and treatment of diseases and clinical conditions associated with LOC285638.

LOC285679 (Accession XP_209719.2) is another GAM281 target gene, herein designated TARGET GENE. LOC285679 BINDING SITE is a target binding site found in the 3' untranslated region of mRNA encoded by LOC285679, corresponding to a target binding site such as BINDING SITE I, BINDING SITE II or BINDING SITE III of FIG. 8. Table 4 illustrates the complementarity of the nucleotide sequences of LOC285679 BINDING SITE, designated SEQ ID:19299, to the nucleotide sequence of GAM281 RNA, herein designated GAM RNA, also designated SEQ ID:278.

Another function of GAM281 is therefore inhibition of LOC285679 (Accession XP_209719.2). Accordingly, utilities of GAM281 include diagnosis, prevention and treatment of diseases and clinical conditions associated with LOC285679.

LOC285683 (Accession XP_211980.1) is another GAM281 target gene, herein designated TARGET GENE. LOC285683 BINDING SITE is a target binding site found in the 5' untranslated region of mRNA encoded by LOC285683, corresponding to a target binding site such as BINDING SITE I, BINDING SITE II or BINDING SITE III of FIG. 8. Table 4 illustrates the complementarity of the nucleotide sequences of LOC285683 BINDING SITE, designated SEQ ID:959, to the nucleotide sequence of GAM281 RNA, herein designated GAM RNA, also designated SEQ ID:278.

Another function of GAM281 is therefore inhibition of LOC285683 (Accession XP_211980.1). Accordingly, utilities of GAM281 include diagnosis, prevention and treatment of diseases and clinical conditions associated with LOC285683.

LOC285689 (Accession XP_209724.1) is another GAM281 target gene, herein designated TARGET GENE. LOC285689 BINDING SITE is a target binding site found in the 3' untranslated region of mRNA encoded by LOC285689, corresponding to a target binding site such as BINDING SITE I, BINDING SITE II or BINDING SITE III of FIG. 8. Table 4 illustrates the complementarity of the nucleotide sequences of LOC285689 BINDING SITE, designated SEQ ID:17726, to the nucleotide sequence of GAM281 RNA, herein designated GAM RNA, also designated SEQ ID:278.

Another function of GAM281 is therefore inhibition of LOC285689 (Accession XP_209724.1). Accordingly, utilities of GAM281 include diagnosis, prevention and treatment of diseases and clinical conditions associated with LOC285689.

LOC285693 (Accession XP_211981.1) is another GAM281 target gene, herein designated TARGET GENE. LOC285693 BINDING SITE is a target binding site found in the 5' untranslated region of mRNA encoded by LOC285693, corresponding to a target binding site such as BINDING SITE I, BINDING SITE II or BINDING SITE III of FIG. 8. Table 4 illustrates the complementarity of the nucleotide sequences of LOC285693 BINDING SITE, designated SEQ ID:16940, to the nucleotide sequence of GAM281 RNA, herein designated GAM RNA, also designated SEQ ID:278.

Another function of GAM281 is therefore inhibition of LOC285693 (Accession XP_211981.1). Accordingly, utilities of GAM281 include diagnosis, prevention and treatment of diseases and clinical conditions associated with LOC285693.

LOC285713 (Accession XP_211992.1) is another GAM281 target gene, herein designated TARGET GENE. LOC285713 BINDING SITE is a target binding site found in the 3' untranslated region of mRNA encoded by LOC285713, corresponding to a target binding site such as BINDING SITE I, BINDING SITE II or BINDING SITE III of FIG. 8. Table 4 illustrates the complementarity of the nucleotide sequences of LOC285713 BINDING SITE, designated SEQ ID:3414, to the nucleotide sequence of GAM281 RNA, herein designated GAM RNA, also designated SEQ ID:278.

Another function of GAM281 is therefore inhibition of LOC285713 (Accession XP_211992.1). Accordingly, utilities of GAM281 include diagnosis, prevention and treatment of diseases and clinical conditions associated with LOC285713.

LOC285722 (Accession XP_211997.1) is another GAM281 target gene, herein designated TARGET GENE. LOC285722 BINDING SITE is a target binding site found in the 5' untranslated region of mRNA encoded by LOC285722, corresponding to a target binding site such as BINDING SITE I, BINDING SITE II or BINDING SITE III of FIG. 8. Table 4 illustrates the complementarity of the nucleotide sequences of LOC285722 BINDING SITE, designated SEQ ID:18012, to the nucleotide sequence of GAM281 RNA, herein designated GAM RNA, also designated SEQ ID:278.

Another function of GAM281 is therefore inhibition of LOC285722 (Accession XP_211997.1). Accordingly, utilities of GAM281 include diagnosis, prevention and treatment of diseases and clinical conditions associated with LOC285722.

LOC285744 (Accession XP_209743.1) is another GAM281 target gene, herein designated TARGET GENE. LOC285744 BINDING SITE is a target binding site found in the 3' untranslated region of mRNA encoded by LOC285744, corresponding to a target binding site such as BINDING SITE I, BINDING SITE II or BINDING SITE III of FIG. 8. Table 4 illustrates the complementarity of the nucleotide sequences of LOC285744 BINDING SITE, designated SEQ ID:11141, to the nucleotide sequence of GAM281 RNA, herein designated GAM RNA, also designated SEQ ID:278.

Another function of GAM281 is therefore inhibition of LOC285744 (Accession XP_209743.1). Accordingly, utilities of GAM281 include diagnosis, prevention and treatment of diseases and clinical conditions associated with LOC285744.

LOC285747 (Accession XP_209742.1) is another GAM281 target gene, herein designated TARGET GENE. LOC285747 BINDING SITE1 and LOC285747 BINDING SITE2 are target binding sites found in untranslated regions of mRNA encoded by LOC285747, corresponding to target binding sites such as BINDING SITE I, BINDING SITE II or BINDING SITE III of FIG. 8. Table 4 illustrates the complementarity of the nucleotide sequences of LOC285747BINDING SITE1 and LOC285747 BINDING SITE2, designated SEQ ID:11528 and SEQ ID:7537 respectively, to the nucleotide sequence of GAM281 RNA, herein designated GAM RNA, also designated SEQ ID:278.

Another function of GAM281 is therefore inhibition of LOC285747 (Accession XP_209742.1). Accordingly, utilities of GAM281 include diagnosis, prevention and treatment of diseases and clinical conditions associated with LOC285747.

LOC285760 (Accession XP_209750.1) is another GAM281 target gene, herein designated TARGET GENE. LOC285760 BINDING SITE is a target binding site found in the 3' untranslated region of mRNA encoded by LOC285760, corresponding to a target binding site such as BINDING SITE I, BINDING SITE II or BINDING SITE III of FIG. 8. Table 4 illustrates the complementarity of the nucleotide sequences of LOC285760 BINDING SITE, designated SEQ ID:13412, to the nucleotide sequence of GAM281 RNA, herein designated GAM RNA, also designated SEQ ID:278.

Another function of GAM281 is therefore inhibition of LOC285760 (Accession XP_209750.1). Accordingly, utilities of GAM281 include diagnosis, prevention and treatment of diseases and clinical conditions associated with LOC285760.

LOC285766 (Accession XP_295177.1) is another GAM281 target gene, herein designated TARGET GENE. LOC285766 BINDING SITE is a target binding site found in the 5' untranslated region of mRNA encoded by LOC285766, corresponding to a target binding site such as BINDING SITE I, BINDING SITE II or BINDING SITE III of FIG. 8. Table 4 illustrates the complementarity of the nucleotide sequences of LOC285766 BINDING SITE, designated SEQ ID:1304, to the nucleotide sequence of GAM281 RNA, herein designated GAM RNA, also designated SEQ ID:278.

Another function of GAM281 is therefore inhibition of LOC285766 (Accession XP_295177.1). Accordingly, utilities of GAM281 include diagnosis, prevention and treatment of diseases and clinical conditions associated with LOC285766.

LOC285777 (Accession XP_212013.1) is another GAM281 target gene, herein designated TARGET GENE. LOC285777 BINDING SITE is a target binding site found in the 5' untranslated region of mRNA encoded by LOC285777, corresponding to a target binding site such as BINDING SITE I, BINDING SITE II or BINDING SITE III of FIG. 8. Table 4 illustrates the complementarity of the nucleotide sequences of LOC285777 BINDING SITE, designated SEQ ID:16810, to the nucleotide sequence of GAM281 RNA, herein designated GAM RNA, also designated SEQ ID:278.

Another function of GAM281 is therefore inhibition of LOC285777 (Accession XP_212013.1). Accordingly, utilities of GAM281 include diagnosis, prevention and treatment of diseases and clinical conditions associated with LOC285777.

LOC285812 (Accession XP_212055.1) is another GAM281 target gene, herein designated TARGET GENE. LOC285812 BINDING SITE is a target binding site found in the 3' untranslated region of mRNA encoded by LOC285812, corresponding to a target binding site such as BINDING SITE I, BINDING SITE II or BINDING SITE III of FIG. 8. Table 4 illustrates the complementarity of the nucleotide sequences of LOC285812 BINDING SITE, designated SEQ ID:559, to the nucleotide sequence of GAM281 RNA, herein designated GAM RNA, also designated SEQ ID:278.

Another function of GAM281 is therefore inhibition of LOC285812 (Accession XP_212055.1). Accordingly, utilities of GAM281 include diagnosis, prevention and treatment of diseases and clinical conditions associated with LOC285812.

LOC285813 (Accession XP_212036.1) is another GAM281 target gene, herein designated TARGET GENE. LOC285813 BINDING SITE is a target binding site found in the 5' untranslated region of mRNA encoded by LOC285813, corresponding to a target binding site such as BINDING SITE I, BINDING SITE II or BINDING SITE III of FIG. 8. Table 4 illustrates the complementarity of the nucleotide sequences of LOC285813 BINDING SITE, designated SEQ ID:12389, to the nucleotide sequence of GAM281 RNA, herein designated GAM RNA, also designated SEQ ID:278.

Another function of GAM281 is therefore inhibition of LOC285813 (Accession XP_212036.1). Accordingly, utilities of GAM281 include diagnosis, prevention and treatment of diseases and clinical conditions associated with LOC285813.

LOC285822 (Accession XP_209777.1) is another GAM281 target gene, herein designated TARGET GENE. LOC285822 BINDING SITE1 and LOC285822 BINDING SITE2 are target binding sites found in untranslated regions of mRNA encoded by LOC285822, corresponding to target binding sites such as BINDING SITE I, BINDING SITE II or BINDING SITE III of FIG. 8. Table 4 illustrates the complementarity of the nucleotide sequences of LOC285822 BINDING SITE1 and LOC285822 BINDING SITE2, designated SEQ ID:1847 and SEQ ID:9753 respectively, to the nucleotide sequence of GAM281 RNA, herein designated GAM RNA, also designated SEQ ID:278.

Another function of GAM281 is therefore inhibition of LOC285822 (Accession XP_209777.1). Accordingly, utilities of GAM281 include diagnosis, prevention and treatment of diseases and clinical conditions associated with LOC285822.

LOC285830 (Accession XP_212043.1) is another GAM281 target gene, herein designated TARGET GENE.

LOC285830 BINDING SITE is a target binding site found in the 5' untranslated region of mRNA encoded by LOC285830, corresponding to a target binding site such as BINDING SITE I, BINDING SITE II or BINDING SITE III of FIG. 8. Table 4 illustrates the complementarity of the nucleotide sequences of LOC285830 BINDING SITE, designated SEQ ID:986, to the nucleotide sequence of GAM281 RNA, herein designated GAM RNA, also designated SEQ ID:278.

Another function of GAM281 is therefore inhibition of LOC285830 (Accession XP_212043.1). Accordingly, utilities of GAM281 include diagnosis, prevention and treatment of diseases and clinical conditions associated with LOC285830.

LOC285843 (Accession XP_212034.1) is another GAM281 target gene, herein designated TARGET GENE. LOC285843 BINDING SITE1 through LOC285843 BINDING SITE3 are target binding sites found in untranslated regions of mRNA encoded by LOC285843, corresponding to target binding sites such as BINDING SITE I, BINDING SITE II or BINDING SITE III of FIG. 8. Table 4 illustrates the complementarity of the nucleotide sequences of LOC285843 BINDING SITE1 through LOC285843 BINDING SITE3, designated SEQ ID:14125, SEQ ID:4368 and SEQ ID:17964 respectively, to the nucleotide sequence of GAM281 RNA, herein designated GAM RNA, also designated SEQ ID:278.

Another function of GAM281 is therefore inhibition of LOC285843 (Accession XP_212034.1). Accordingly, utilities of GAM281 include diagnosis, prevention and treatment of diseases and clinical conditions associated with LOC285843.

LOC285847 (Accession XP_212045.1) is another GAM281 target gene, herein designated TARGET GENE. LOC285847 BINDING SITE is a target binding site found in the 5' untranslated region of mRNA encoded by LOC285847, corresponding to a target binding site such as BINDING SITE I, BINDING SITE II or BINDING SITE III of FIG. 8. Table 4 illustrates the complementarity of the nucleotide sequences of LOC285847 BINDING SITE, designated SEQ ID:18945, to the nucleotide sequence of GAM281 RNA, herein designated GAM RNA, also designated SEQ ID:278.

Another function of GAM281 is therefore inhibition of LOC285847 (Accession XP_212045.1). Accordingly, utilities of GAM281 include diagnosis, prevention and treatment of diseases and clinical conditions associated with LOC285847.

LOC285872 (Accession XP_212061.1) is another GAM281 target gene, herein designated TARGET GENE. LOC285872 BINDING SITE is a target binding site found in the 3' untranslated region of mRNA encoded by LOC285872, corresponding to a target binding site such as BINDING SITE I, BINDING SITE II or BINDING SITE III of FIG. 8. Table 4 illustrates the complementarity of the nucleotide sequences of LOC285872 BINDING SITE, designated SEQ ID:10885, to the nucleotide sequence of GAM281 RNA, herein designated GAM RNA, also designated SEQ ID:278.

Another function of GAM281 is therefore inhibition of LOC285872 (Accession XP_212061.1). Accordingly, utilities of GAM281 include diagnosis, prevention and treatment of diseases and clinical conditions associated with LOC285872.

LOC285896 (Accession XP_209806.1) is another GAM281 target gene, herein designated TARGET GENE. LOC285896 BINDING SITE is a target binding site found in the 3' untranslated region of mRNA encoded by LOC285896, corresponding to a target binding site such as BINDING SITE I, BINDING SITE II or BINDING SITE III of FIG. 8. Table 4 illustrates the complementarity of the nucleotide sequences of LOC285896 BINDING SITE, designated SEQ ID:15236, to the nucleotide sequence of GAM281 RNA, herein designated GAM RNA, also designated SEQ ID:278.

Another function of GAM281 is therefore inhibition of LOC285896 (Accession XP_209806.1). Accordingly, utilities of GAM281 include diagnosis, prevention and treatment of diseases and clinical conditions associated with LOC285896.

LOC285914 (Accession XP_209810.1) is another GAM281 target gene, herein designated TARGET GENE. LOC285914 BINDING SITE1 and LOC285914 BINDING SITE2 are target binding sites found in untranslated regions of mRNA encoded by LOC285914, corresponding to target binding sites such as BINDING SITE I, BINDING SITE II or BINDING SITE III of FIG. 8. Table 4 illustrates the complementarity of the nucleotide sequences of LOC285914 BINDING SITE1 and LOC285914 BINDING SITE2, designated SEQ ID:14560 and SEQ ID:6188 respectively, to the nucleotide sequence of GAM281 RNA, herein designated GAM RNA, also designated SEQ ID:278.

Another function of GAM281 is therefore inhibition of LOC285914 (Accession XP_209810.1). Accordingly, utilities of GAM281 include diagnosis, prevention and treatment of diseases and clinical conditions associated with LOC285914.

LOC285922 (Accession XP_209822.1) is another GAM281 target gene, herein designated TARGET GENE. LOC285922 BINDING SITE is a target binding site found in the 3' untranslated region of mRNA encoded by LOC285922, corresponding to a target binding site such as BINDING SITE I, BINDING SITE II or BINDING SITE III of FIG. 8. Table 4 illustrates the complementarity of the nucleotide sequences of LOC285922 BINDING SITE, designated SEQ ID:12799, to the nucleotide sequence of GAM281 RNA, herein designated GAM RNA, also designated SEQ ID:278.

Another function of GAM281 is therefore inhibition of LOC285922 (Accession XP_209822.1). Accordingly, utilities of GAM281 include diagnosis, prevention and treatment of diseases and clinical conditions associated with LOC285922.

LOC285923 (Accession XP_212104.1) is another GAM281 target gene, herein designated TARGET GENE. LOC285923 BINDING SITE is a target binding site found in the 3' untranslated region of mRNA encoded by LOC285923, corresponding to a target binding site such as BINDING SITE I, BINDING SITE II or BINDING SITE III of FIG. 8. Table 4 illustrates the complementarity of the nucleotide sequences of LOC285923 BINDING SITE, designated SEQ ID:19536, to the nucleotide sequence of GAM281 RNA, herein designated GAM RNA, also designated SEQ ID:278.

Another function of GAM281 is therefore inhibition of LOC285923 (Accession XP_212104.1). Accordingly, utilities of GAM281 include diagnosis, prevention and treatment of diseases and clinical conditions associated with LOC285923.

LOC285930 (Accession XP_209818.1) is another GAM281 target gene, herein designated TARGET GENE. LOC285930 BINDING SITE is a target binding site found in the 5' untranslated region of mRNA encoded by LOC285930, corresponding to a target binding site such as BINDING SITE I, BINDING SITE II or BINDING SITE III of FIG. 8. Table 4 illustrates the complementarity of the nucleotide sequences of LOC285930 BINDING SITE, designated SEQ ID:1867, to the nucleotide sequence of GAM281 RNA, herein designated GAM RNA, also designated SEQ ID:278.

Another function of GAM281 is therefore inhibition of LOC285930 (Accession XP_209818.1). Accordingly, utilities of GAM281 include diagnosis, prevention and treatment of diseases and clinical conditions associated with LOC285930.

LOC285945 (Accession XP_212092.1) is another GAM281 target gene, herein designated TARGET GENE. LOC285945 BINDING SITE is a target binding site found in the 5' untranslated region of mRNA encoded by LOC285945, corresponding to a target binding site such as BINDING SITE I, BINDING SITE II or BINDING SITE III of FIG. 8. Table 4 illustrates the complementarity of the nucleotide sequences of LOC285945 BINDING SITE, designated SEQ ID:12075, to the nucleotide sequence of GAM281 RNA, herein designated GAM RNA, also designated SEQ ID:278.

Another function of GAM281 is therefore inhibition of LOC285945 (Accession XP_212092.1). Accordingly, utilities of GAM281 include diagnosis, prevention and treatment of diseases and clinical conditions associated with LOC285945.

LOC285946 (Accession XP_212103.1) is another GAM281 target gene, herein designated TARGET GENE. LOC285946 BINDING SITE is a target binding site found in the 3' untranslated region of mRNA encoded by LOC285946, corresponding to a target binding site such as BINDING SITE I, BINDING SITE II or BINDING SITE III of FIG. 8. Table 4 illustrates the complementarity of the nucleotide sequences of LOC285946 BINDING SITE, designated SEQ ID:11558, to the nucleotide sequence of GAM281 RNA, herein designated GAM RNA, also designated SEQ ID:278.

Another function of GAM281 is therefore inhibition of LOC285946 (Accession XP_212103.1). Accordingly, utilities of GAM281 include diagnosis, prevention and treatment of diseases and clinical conditions associated with LOC285946.

LOC285952 (Accession XP_209821.1) is another GAM281 target gene, herein designated TARGET GENE. LOC285952 BINDING SITE is a target binding site found in the 3' untranslated region of mRNA encoded by LOC285952, corresponding to a target binding site such as BINDING SITE I, BINDING SITE II or BINDING SITE III of FIG. 8. Table 4 illustrates the complementarity of the nucleotide sequences of LOC285952 BINDING SITE, designated SEQ ID:15323, to the nucleotide sequence of GAM281 RNA, herein designated GAM RNA, also designated SEQ ID:278.

Another function of GAM281 is therefore inhibition of LOC285952 (Accession XP_209821.1). Accordingly, utilities of GAM281 include diagnosis, prevention and treatment of diseases and clinical conditions associated with LOC285952.

LOC285961 (Accession XP_209833.1) is another GAM281 target gene, herein designated TARGET GENE. LOC285961 BINDING SITE is a target binding site found in the 5' untranslated region of mRNA encoded by LOC285961, corresponding to a target binding site such as BINDING SITE I, BINDING SITE II or BINDING SITE III of FIG. 8. Table 4 illustrates the complementarity of the nucleotide sequences of LOC285961 BINDING SITE, designated SEQ ID:2604, to the nucleotide sequence of GAM281 RNA, herein designated GAM RNA, also designated SEQ ID:278.

Another function of GAM281 is therefore inhibition of LOC285961 (Accession XP_209833.1). Accordingly, utilities of GAM281 include diagnosis, prevention and treatment of diseases and clinical conditions associated with LOC285961.

LOC285968 (Accession XP_212107.1) is another GAM281 target gene, herein designated TARGET GENE. LOC285968 BINDING SITE is a target binding site found in the 3' untranslated region of mRNA encoded by LOC285968, corresponding to a target binding site such as BINDING SITE I, BINDING SITE II or BINDING SITE III of FIG. 8. Table 4 illustrates the complementarity of the nucleotide sequences of LOC285968 BINDING SITE, designated SEQ ID:10956, to the nucleotide sequence of GAM281 RNA, herein designated GAM RNA, also designated SEQ ID:278.

Another function of GAM281 is therefore inhibition of LOC285968 (Accession XP_212107.1). Accordingly, utilities of GAM281 include diagnosis, prevention and treatment of diseases and clinical conditions associated with LOC285968.

LOC285972 (Accession XP_212105.1) is another GAM281 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:5318, to the nucleotide sequence of GAM281 RNA, herein designated GAM RNA, also designated SEQ ID:278.

Another function of GAM281 is therefore inhibition of LOC285972 (Accession XP_212105.1). Accordingly, utilities of GAM281 include diagnosis, prevention and treatment of diseases and clinical conditions associated with LOC285972.

LOC285979 (Accession XP_212117.1) is another GAM281 target gene, herein designated TARGET GENE. LOC285979 BINDING SITE1 and LOC285979 BINDING SITE2 are target binding sites found in untranslated regions of mRNA encoded by LOC285979, corresponding to target binding sites such as BINDING SITE I, BINDING SITE II or BINDING SITE III of FIG. 8. Table 4 illustrates the complementarity of the nucleotide sequences of LOC285979 BINDING SITE1 and LOC285979 BINDING SITE2, designated SEQ ID:1397 and SEQ ID:6388 respectively, to the nucleotide sequence of GAM281 RNA, herein designated GAM RNA, also designated SEQ ID:278.

Another function of GAM281 is therefore inhibition of LOC285979 (Accession XP_212117.1). Accordingly, utilities of GAM281 include diagnosis, prevention and treatment of diseases and clinical conditions associated with LOC285979.

LOC285989 (Accession XP_212111.1) is another GAM281 target gene, herein designated TARGET GENE. LOC285989 BINDING SITE is a target binding site found in the 3' untranslated region of mRNA encoded by LOC285989, corresponding to a target binding site such as BINDING SITE I, BINDING SITE II or BINDING SITE III of FIG. 8. Table 4 illustrates the complementarity of the nucleotide sequences of LOC285989 BINDING SITE, designated SEQ ID:11742, to the nucleotide sequence of GAM281 RNA, herein designated GAM RNA, also designated SEQ ID:278.

Another function of GAM281 is therefore inhibition of LOC285989 (Accession XP_212111.1). Accordingly, utilities of GAM281 include diagnosis, prevention and treatment of diseases and clinical conditions associated with LOC285989.

LOC285999 (Accession XP_212120.1) is another GAM281 target gene, herein designated TARGET GENE. LOC285999 BINDING SITE is a target binding site found in the 3' untranslated region of mRNA encoded by LOC285999, corresponding to a target binding site such as BINDING SITE I, BINDING SITE II or BINDING SITE III of FIG. 8. Table 4 illustrates the complementarity of the nucleotide sequences of LOC285999 BINDING SITE, designated SEQ ID:17306, to the nucleotide sequence of GAM281 RNA, herein designated GAM RNA, also designated SEQ ID:278.

Another function of GAM281 is therefore inhibition of LOC285999 (Accession XP_212120.1). Accordingly, utilities of GAM281 include diagnosis, prevention and treatment of diseases and clinical conditions associated with LOC285999.

LOC286029 (Accession XP_209866.1) is another GAM281 target gene, herein designated TARGET GENE. LOC286029 BINDING SITE is a target binding site found in the 3' untranslated region of mRNA encoded by LOC286029, corresponding to a target binding site such as BINDING SITE I, BINDING SITE II or BINDING SITE III of FIG. 8. Table 4 illustrates the complementarity of the nucleotide sequences of LOC286029 BINDING SITE, designated SEQ ID:15231, to the nucleotide sequence of GAM281 RNA, herein designated GAM RNA, also designated SEQ ID:278.

Another function of GAM281 is therefore inhibition of LOC286029 (Accession XP_209866.1). Accordingly, utilities of GAM281 include diagnosis, prevention and treatment of diseases and clinical conditions associated with LOC286029.

LOC286030 (Accession XP_209868.1) is another GAM281 target gene, herein designated TARGET GENE. LOC286030 BINDING SITE is a target binding site found in the 5' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:2244, to the nucleotide sequence of GAM281 RNA, herein designated GAM RNA, also designated SEQ ID:278.

Another function of GAM281 is therefore inhibition of LOC286030 (Accession XP_209868.1). Accordingly, utilities of GAM281 include diagnosis, prevention and treatment of diseases and clinical conditions associated with LOC286030.

LOC286032 (Accession XP_209867.2) is another GAM281 target gene, herein designated TARGET GENE. LOC286032 BINDING SITE is a target binding site found in the 3' untranslated region of mRNA encoded by LOC286032, corresponding to a target binding site such as BINDING SITE I, BINDING SITE II or BINDING SITE III of FIG. 8. Table 4 illustrates the complementarity of the nucleotide sequences of LOC286032 BINDING SITE, designated SEQ ID:7792, to the nucleotide sequence of GAM281 RNA, herein designated GAM RNA, also designated SEQ ID:278.

Another function of GAM281 is therefore inhibition of LOC286032 (Accession XP_209867.2). Accordingly, utilities of GAM281 include diagnosis, prevention and treatment of diseases and clinical conditions associated with LOC286032.

LOC286039 (Accession XP_209873.1) is another GAM281 target gene, herein designated TARGET GENE. LOC286039 BINDING SITE is a target binding site found in the 5' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:11035, to the nucleotide sequence of GAM281 RNA, herein designated GAM RNA, also designated SEQ ID:278.

Another function of GAM281 is therefore inhibition of LOC286039 (Accession XP_209873.1). Accordingly, utilities of GAM281 include diagnosis, prevention and treatment of diseases and clinical conditions associated with LOC286039.

LOC286052 (Accession XP_212152.1) is another GAM281 target gene, herein designated TARGET GENE. LOC286052 BINDING SITE is a target binding site found in the 3' untranslated region of mRNA encoded by LOC286052, corresponding to a target binding site such as BINDING SITE I, BINDING SITE II or BINDING SITE III of FIG. 8. Table 4 illustrates the complementarity of the nucleotide sequences of LOC286052 BINDING SITE, designated SEQ ID:9367, to the nucleotide sequence of GAM281 RNA, herein designated GAM RNA, also designated SEQ ID:278.

Another function of GAM281 is therefore inhibition of LOC286052 (Accession XP_212152.1). Accordingly, utilities of GAM281 include diagnosis, prevention and treatment of diseases and clinical conditions associated with LOC286052.

LOC286058 (Accession XP_212158.1) is another GAM281 target gene, herein designated TARGET GENE. LOC286058 BINDING SITE is a target binding site found in the 3' untranslated region of mRNA encoded by LOC286058, corresponding to a target binding site such as BINDING SITE I, BINDING SITE II or BINDING SITE III of FIG. 8. Table 4 illustrates the complementarity of the nucleotide sequences of LOC286058 BINDING SITE, designated SEQ ID:9186, to the nucleotide sequence of GAM281 RNA, herein designated GAM RNA, also designated SEQ ID:278.

Another function of GAM281 is therefore inhibition of LOC286058 (Accession XP_212158.1). Accordingly, utilities of GAM281 include diagnosis, prevention and treatment of diseases and clinical conditions associated with LOC286058.

LOC286075 (Accession NP_776192.1) is another GAM281 target gene, herein designated TARGET GENE. LOC286075 BINDING SITE is a target binding site found in the 5' untranslated region of mRNA encoded by LOC286075, corresponding to a target binding site such as BINDING SITE I, BINDING SITE II or BINDING SITE III of FIG. 8. Table 4 illustrates the complementarity of the nucleotide sequences of LOC286075 BINDING SITE, designated SEQ ID:17965, to the nucleotide sequence of GAM281 RNA, herein designated GAM RNA, also designated SEQ ID:278.

Another function of GAM281 is therefore inhibition of LOC286075 (Accession NP_776192.1). Accordingly, utilities of GAM281 include diagnosis, prevention and treatment of diseases and clinical conditions associated with LOC286075.

LOC286078 (Accession XP_212163.1) is another GAM281 target gene, herein designated TARGET GENE. LOC286078 BINDING SITE1 through LOC286078 BINDING SITE5 are target binding sites found in untranslated regions of mRNA encoded by LOC286078, corresponding to target binding sites such as BINDING SITE I, BINDING SITE II or BINDING SITE III of FIG. 8. Table 4 illustrates the complementarity of the nucleotide sequences of LOC286078 BINDING SITE1 through LOC286078 BINDING SITE5, designated SEQ ID:16716, SEQ ID:15083, SEQ ID:3810, SEQ ID:15589 and SEQ ID:13100 respectively, to the nucleotide sequence of GAM281 RNA, herein designated GAM RNA, also designated SEQ ID:278.

Another function of GAM281 is therefore inhibition of LOC286078 (Accession XP_212163.1). Accordingly, utilities of GAM281 include diagnosis, prevention and treatment of diseases and clinical conditions associated with LOC286078.

LOC286090 (Accession XP_212166.3) is another GAM281 target gene, herein designated TARGET GENE. LOC286090 BINDING SITE is a target binding site found in the 5' untranslated region of mRNA encoded by LOC286090, corresponding to a target binding site such as BINDING SITE I, BINDING SITE II or BINDING SITE III of FIG. 8. Table 4 illustrates the complementarity of the nucleotide sequences of LOC286090 BINDING SITE, designated SEQ ID:16409, to the nucleotide sequence of GAM281 RNA, herein designated GAM RNA, also designated SEQ ID:278.

Another function of GAM281 is therefore inhibition of LOC286090 (Accession XP_212166.3). Accordingly, utilities of GAM281 include diagnosis, prevention and treatment of diseases and clinical conditions associated with LOC286090.

LOC286103 (Accession XP_209897.1) is another GAM281 target gene, herein designated TARGET GENE. LOC286103 BINDING SITE is a target binding site found in the 3' untranslated region of multiple transcripts of mRNA encoded by LOC286103, corresponding to a target binding site such as BINDING SITE I, BINDING SITE II or BINDING SITE III of FIG. 8. Table 4 illustrates the complementarity of the nucleotide sequences of LOC286103 BINDING SITE, designated SEQ ID:11672, to the nucleotide sequence of GAM281 RNA, herein designated GAM RNA, also designated SEQ ID:278.

Another function of GAM281 is therefore inhibition of LOC286103 (Accession XP_209897.1). Accordingly, utilities of GAM281 include diagnosis, prevention and treatment of diseases and clinical conditions associated with LOC286103.

LOC286103 (Accession NP_848630.1) is another GAM281 target gene, herein designated TARGET GENE. LOC286103 BINDING SITE is a target binding site found in the 3' untranslated region of multiple transcripts of mRNA encoded by LOC286103, corresponding to a target binding site such as BINDING SITE I, BINDING SITE II or BINDING SITE III of FIG. 8. Table 4 illustrates the complementarity of the nucleotide sequences of LOC286103 BINDING SITE, designated SEQ ID:11672, to the nucleotide sequence of GAM281 RNA, herein designated GAM RNA, also designated SEQ ID:278.

Another function of GAM281 is therefore inhibition of LOC286103 (Accession NP_848630.1). Accordingly, utilities of GAM281 include diagnosis, prevention and treatment of diseases and clinical conditions associated with LOC286103.

LOC286126 (Accession XP_212185.1) is another GAM281 target gene, herein designated TARGET GENE. LOC286126 BINDING SITE is a target binding site found in the 3' untranslated region of mRNA encoded by LOC286126, corresponding to a target binding site such as BINDING SITE I, BINDING SITE II or BINDING SITE III of FIG. 8. Table 4 illustrates the complementarity of the nucleotide sequences of LOC286126 BINDING SITE, designated SEQ ID:7847, to the nucleotide sequence of GAM281 RNA, herein designated GAM RNA, also designated SEQ ID:278.

Another function of GAM281 is therefore inhibition of LOC286126 (Accession XP_212185.1). Accordingly, utilities of GAM281 include diagnosis, prevention and treatment of diseases and clinical conditions associated with LOC286126.

LOC286132 (Accession XP_212194.1) is another GAM281 target gene, herein designated TARGET GENE. LOC286132 BINDING SITE is a target binding site found in the 5' untranslated region of mRNA encoded by LOC286132, corresponding to a target binding site such as BINDING SITE I, BINDING SITE II or BINDING SITE III of FIG. 8. Table 4 illustrates the complementarity of the nucleotide sequences of LOC286132 BINDING SITE, designated SEQ ID:7113, to the nucleotide sequence of GAM281 RNA, herein designated GAM RNA, also designated SEQ ID:278.

Another function of GAM281 is therefore inhibition of LOC286132 (Accession XP_212194.1). Accordingly, utilities of GAM281 include diagnosis, prevention and treatment of diseases and clinical conditions associated with LOC286132.

LOC286166 (Accession XP_209925.1) is another GAM281 target gene, herein designated TARGET GENE. LOC286166 BINDING SITE1 and LOC286166 BINDING SITE2 are target binding sites found in untranslated regions of mRNA encoded by LOC286166, corresponding to target binding sites such as BINDING SITE I, BINDING SITE II or BINDING SITE III of FIG. 8. Table 4 illustrates the complementarity of the nucleotide sequences of LOC286166 BINDING SITE1 and LOC286166 BINDING SITE2, designated SEQ ID:3927 and SEQ ID:12946 respectively, to the nucleotide sequence of GAM281 RNA, herein designated GAM RNA, also designated SEQ ID:278.

Another function of GAM281 is therefore inhibition of LOC286166 (Accession XP_209925.1). Accordingly, utilities of GAM281 include diagnosis, prevention and treatment of diseases and clinical conditions associated with LOC286166.

LOC286170 (Accession XP_212211.1) is another GAM281 target gene, herein designated TARGET GENE. LOC286170 BINDING SITE is a target binding site found in the 5' untranslated region of mRNA encoded by LOC286170, corresponding to a target binding site such as BINDING SITE I, BINDING SITE II or BINDING SITE III of FIG. 8. Table 4 illustrates the complementarity of the nucleotide sequences of LOC286170 BINDING SITE, designated SEQ ID:8426, to the nucleotide sequence of GAM281 RNA, herein designated GAM RNA, also designated SEQ ID:278.

Another function of GAM281 is therefore inhibition of LOC286170 (Accession XP_212211.1). Accordingly, utilities of GAM281 include diagnosis, prevention and treatment of diseases and clinical conditions associated with LOC286170.

LOC286184 (Accession XP_212216.1) is another GAM281 target gene, herein designated TARGET GENE. LOC286184 BINDING SITE is a target binding site found in the 5' untranslated region of mRNA encoded by LOC286184, corresponding to a target binding site such as BINDING SITE I, BINDING SITE II or BINDING SITE III of FIG. 8. Table 4 illustrates the complementarity of the nucleotide sequences of LOC286184 BINDING SITE, designated SEQ ID:12053, to the nucleotide sequence of GAM281 RNA, herein designated GAM RNA, also designated SEQ ID:278.

Another function of GAM281 is therefore inhibition of LOC286184 (Accession XP_212216.1). Accordingly, utilities of GAM281 include diagnosis, prevention and treatment of diseases and clinical conditions associated with LOC286184.

LOC286186 (Accession XP_212219.1) is another GAM281 target gene, herein designated TARGET GENE. LOC286186 BINDING SITE1 and LOC286186 BINDING SITE2 are target binding sites found in untranslated regions of mRNA encoded by LOC286186, corresponding to target binding sites such as BINDING SITE I, BINDING SITE II or BINDING SITE III of FIG. 8. Table 4 illustrates the complementarity of the nucleotide sequences of LOC286186 BINDING SITE1 and LOC286186 BINDING SITE2, designated SEQ ID:3430 and SEQ ID:18020 respectively, to the nucleotide sequence of GAM281 RNA, herein designated GAM RNA, also designated SEQ ID:278.

Another function of GAM281 is therefore inhibition of LOC286186 (Accession XP_212219.1). Accordingly, utilities of GAM281 include diagnosis, prevention and treatment of diseases and clinical conditions associated with LOC286186.

LOC286206 (Accession XP_209953.1) is another GAM281 target gene, herein designated TARGET GENE. LOC286206 BINDING SITE is a target binding site found in the 3' untranslated region of mRNA encoded by LOC286206, corresponding to a target binding site such as BINDING SITE I, BINDING SITE II or BINDING SITE III of FIG. 8. Table 4 illustrates the complementarity of the nucleotide sequences of LOC286206 BINDING SITE, designated SEQ ID:2600, to the nucleotide sequence of GAM281 RNA, herein designated GAM RNA, also designated SEQ ID:278.

Another function of GAM281 is therefore inhibition of LOC286206 (Accession XP_209953.1). Accordingly, utilities of GAM281 include diagnosis, prevention and treatment of diseases and clinical conditions associated with LOC286206.

LOC286207 (Accession XP_209941.1) is another GAM281 target gene, herein designated TARGET GENE. LOC286207 BINDING SITE is a target binding site found in the 3' untranslated region of mRNA encoded by LOC286207, corresponding to a target binding site such as BINDING SITE I, BINDING SITE II or BINDING SITE III of FIG. 8. Table 4 illustrates the complementarity of the nucleotide sequences of LOC286207 BINDING SITE, designated SEQ ID:19893, to the nucleotide sequence of GAM281 RNA, herein designated GAM RNA, also designated SEQ ID:278.

Another function of GAM281 is therefore inhibition of LOC286207 (Accession XP_209941.1). Accordingly, utilities of GAM281 include diagnosis, prevention and treatment of diseases and clinical conditions associated with LOC286207.

LOC286208 (Accession XP_212230.1) is another GAM281 target gene, herein designated TARGET GENE. LOC286208 BINDING SITE1 through LOC286208 BINDING SITE3 are target binding sites found in untranslated regions of mRNA encoded by LOC286208, corresponding to target binding sites such as BINDING SITE I, BINDING SITE II or BINDING SITE III of FIG. 8. Table 4 illustrates the complementarity of the nucleotide sequences of LOC286208 BINDING SITE1 through LOC286208 BINDING SITE3, designated SEQ ID:9724, SEQ ID:4372 and SEQ ID:2849 respectively, to the nucleotide sequence of GAM281 RNA, herein designated GAM RNA, also designated SEQ ID:278.

Another function of GAM281 is therefore inhibition of LOC286208 (Accession XP_212230.1). Accordingly, utilities of GAM281 include diagnosis, prevention and treatment of diseases and clinical conditions associated with LOC286208.

LOC286215 (Accession XP_212228.1) is another GAM281 target gene, herein designated TARGET GENE. LOC286215 BINDING SITE is a target binding site found in the 5' untranslated region of mRNA encoded by LOC286215, corresponding to a target binding site such as BINDING SITE I, BINDING SITE II or BINDING SITE III of FIG. 8. Table 4 illustrates the complementarity of the nucleotide sequences of LOC286215 BINDING SITE, designated SEQ ID:19240, to the nucleotide sequence of GAM281 RNA, herein designated GAM RNA, also designated SEQ ID:278.

Another function of GAM281 is therefore inhibition of LOC286215 (Accession XP_212228.1). Accordingly, utilities of GAM281 include diagnosis, prevention and treatment of diseases and clinical conditions associated with LOC286215.

LOC286218 (Accession XP_212235.1) is another GAM281 target gene, herein designated TARGET GENE. LOC286218 BINDING SITE is a target binding site found in the 3' untranslated region of mRNA encoded by LOC286218, corresponding to a target binding site such as BINDING SITE I, BINDING SITE II or BINDING SITE III of FIG. 8. Table 4 illustrates the complementarity of the nucleotide sequences of LOC286218 BINDING SITE, designated SEQ ID:6316, to the nucleotide sequence of GAM281 RNA, herein designated GAM RNA, also designated SEQ ID:278.

Another function of GAM281 is therefore inhibition of LOC286218 (Accession XP_212235.1). Accordingly, utilities of GAM281 include diagnosis, prevention and treatment of diseases and clinical conditions associated with LOC286218.

LOC286221 (Accession XP_212233.1) is another GAM281 target gene, herein designated TARGET GENE. LOC286221 BINDING SITE is a target binding site found in the 5' untranslated region of mRNA encoded by LOC286221, corresponding to a target binding site such as BINDING SITE I, BINDING SITE II or BINDING SITE III of FIG. 8. Table 4 illustrates the complementarity of the nucleotide sequences of LOC286221 BINDING SITE, designated SEQ ID:7774, to the nucleotide sequence of GAM281 RNA, herein designated GAM RNA, also designated SEQ ID:278.

Another function of GAM281 is therefore inhibition of LOC286221 (Accession XP_212233.1). Accordingly, utilities of GAM281 include diagnosis, prevention and treatment of diseases and clinical conditions associated with LOC286221.

LOC286245 (Accession XP_212244.1) is another GAM281 target gene, herein designated TARGET GENE. LOC286245 BINDING SITE is a target binding site found in the 5' untranslated region of mRNA encoded by LOC286245, corresponding to a target binding site such as BINDING SITE I, BINDING SITE II or BINDING SITE III of FIG. 8. Table 4 illustrates the complementarity of the nucleotide sequences of LOC286245 BINDING SITE, designated SEQ ID:6868, to the nucleotide sequence of GAM281 RNA, herein designated GAM RNA, also designated SEQ ID:278.

Another function of GAM281 is therefore inhibition of LOC286245 (Accession XP_212244.1). Accordingly, utilities of GAM281 include diagnosis, prevention and treatment of diseases and clinical conditions associated with LOC286245.

LOC286258 (Accession XP_209972.1) is another GAM281 target gene, herein designated TARGET GENE. LOC286258 BINDING SITE is a target binding site found in the 3' untranslated region of mRNA encoded by LOC286258, corresponding to a target binding site such as BINDING SITE I, BINDING SITE II or BINDING SITE III of FIG. 8. Table 4 illustrates the complementarity of the nucleotide sequences of LOC286258 BINDING SITE, designated SEQ ID:11262, to the nucleotide sequence of GAM281 RNA, herein designated GAM RNA, also designated SEQ ID:278.

Another function of GAM281 is therefore inhibition of LOC286258 (Accession XP_209972.1). Accordingly, utilities of GAM281 include diagnosis, prevention and treatment of diseases and clinical conditions associated with LOC286258.

LOC286337 (Accession XP_212274.3) is another GAM281 target gene, herein designated TARGET GENE. LOC286337 BINDING SITE1 and LOC286337 BINDING SITE2 are target binding sites found in untranslated regions of mRNA encoded by LOC286337, corresponding to target binding sites such as BINDING SITE I, BINDING SITE II or BINDING SITE III of FIG. 8. Table 4 illustrates the complementarity of the nucleotide sequences of LOC286337BINDING SITE1 and LOC286337 BINDING SITE2, designated SEQ ID:14911 and SEQ ID:7808 respectively, to the nucleotide sequence of GAM281 RNA, herein designated GAM RNA, also designated SEQ ID:278.

Another function of GAM281 is therefore inhibition of LOC286337 (Accession XP_212274.3). Accordingly, utilities of GAM281 include diagnosis, prevention and treatment of diseases and clinical conditions associated with LOC286337.

LOC286341 (Accession XP_212278.1) is another GAM281 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:15975, to the nucleotide sequence of GAM281 RNA, herein designated GAM RNA, also designated SEQ ID:278.

Another function of GAM281 is therefore inhibition of LOC286341 (Accession XP_212278.1). Accordingly, utilities of GAM281 include diagnosis, prevention and treatment of diseases and clinical conditions associated with LOC286341.

LOC286354 (Accession XP_212286.1) is another GAM281 target gene, herein designated TARGET GENE. LOC286354 BINDING SITE is a target binding site found in the 5' untranslated region of mRNA encoded by LOC286354, corresponding to a target binding site such as BINDING SITE I, BINDING SITE II or BINDING SITE III of FIG. 8. Table 4 illustrates the complementarity of the nucleotide sequences of LOC286354 BINDING SITE, designated SEQ ID:15730, to the nucleotide sequence of GAM281 RNA, herein designated GAM RNA, also designated SEQ ID:278.

Another function of GAM281 is therefore inhibition of LOC286354 (Accession XP_212286.1). Accordingly, utilities of GAM281 include diagnosis, prevention and treatment of diseases and clinical conditions associated with LOC286354.

LOC286356 (Accession XP_212290.1) is another GAM281 target gene, herein designated TARGET GENE. LOC286356 BINDING SITE is a target binding site found in the 5' untranslated region of mRNA encoded by LOC286356, corresponding to a target binding site such as BINDING SITE I, BINDING SITE II or BINDING SITE III of FIG. 8. Table 4 illustrates the complementarity of the nucleotide sequences of LOC286356 BINDING SITE, designated SEQ ID:7385, to the nucleotide sequence of GAM281 RNA, herein designated GAM RNA, also designated SEQ ID:278.

Another function of GAM281 is therefore inhibition of LOC286356 (Accession XP_212290.1). Accordingly, utilities of GAM281 include diagnosis, prevention and treatment of diseases and clinical conditions associated with LOC286356.

LOC286357 (Accession XP_212285.1) is another GAM281 target gene, herein designated TARGET GENE. LOC286357 BINDING SITE is a target binding site found in the 5' untranslated region of mRNA encoded by LOC286357, corresponding to a target binding site such as BINDING SITE I, BINDING SITE II or BINDING SITE III of FIG. 8. Table 4 illustrates the complementarity of the nucleotide sequences of LOC286357 BINDING SITE, designated SEQ ID:14974, to the nucleotide sequence of GAM281 RNA, herein designated GAM RNA, also designated SEQ ID:278.

Another function of GAM281 is therefore inhibition of LOC286357 (Accession XP_212285.1). Accordingly, utilities of GAM281 include diagnosis, prevention and treatment of diseases and clinical conditions associated with LOC286357.

LOC286371 (Accession XP_212291.1) is another GAM281 target gene, herein designated TARGET GENE. LOC286371 BINDING SITE is a target binding site found in the 3' untranslated region of mRNA encoded by LOC286371, corresponding to a target binding site such as BINDING SITE I, BINDING SITE II or BINDING SITE III of FIG. 8. Table 4 illustrates the complementarity of the nucleotide sequences of LOC286371 BINDING SITE, designated SEQ ID:3785, to the nucleotide sequence of GAM281 RNA, herein designated GAM RNA, also designated SEQ ID:278.

Another function of GAM281 is therefore inhibition of LOC286371 (Accession XP_212291.1). Accordingly, utilities of GAM281 include diagnosis, prevention and treatment of diseases and clinical conditions associated with LOC286371.

LOC286395 (Accession XP_212308.1) is another GAM281 target gene, herein designated TARGET GENE. LOC286395 BINDING SITE1 through LOC286395 BINDING SITE4 are target binding sites found in untranslated regions of mRNA encoded by LOC286395, corresponding to target binding sites such as BINDING SITE I, BINDING SITE II or BINDING SITE III of FIG. 8. Table 4 illustrates the complementarity of the nucleotide sequences of LOC286395 BINDING SITE1 through LOC286395 BINDING SITE4, designated SEQ ID:2180, SEQ ID:2722, SEQ ID:5359 and SEQ ID:16177 respectively, to the nucleotide sequence of GAM281 RNA, herein designated GAM RNA, also designated SEQ ID:278.

Another function of GAM281 is therefore inhibition of LOC286395 (Accession XP_212308.1). Accordingly, utilities of GAM281 include diagnosis, prevention and treatment of diseases and clinical conditions associated with LOC286395.

LOC286401 (Accession XP_212310.1) is another GAM281 target gene, herein designated TARGET GENE. LOC286401 BINDING SITE is a target binding site found in the 5' untranslated region of mRNA encoded by LOC286401, corresponding to a target binding site such as BINDING SITE I, BINDING SITE II or BINDING SITE III of FIG. 8. Table 4 illustrates the complementarity of the nucleotide sequences of LOC286401 BINDING SITE, designated SEQ ID:1038, to the nucleotide sequence of GAM281 RNA, herein designated GAM RNA, also designated SEQ ID:278.

Another function of GAM281 is therefore inhibition of LOC286401 (Accession XP_212310.1). Accordingly, utilities of GAM281 include diagnosis, prevention and treatment of diseases and clinical conditions associated with LOC286401.

LOC286441 (Accession XP_212319.1) is another GAM281 target gene, herein designated TARGET GENE. LOC286441 BINDING SITE is a target binding site found in the 3' untranslated region of mRNA encoded by LOC286441, corresponding to a target binding site such as BINDING SITE I, BINDING SITE II or BINDING SITE III of FIG. 8. Table 4 illustrates the complementarity of the nucleotide sequences of LOC286441 BINDING SITE, designated SEQ ID:2754, to the nucleotide sequence of GAM281 RNA, herein designated GAM RNA, also designated SEQ ID:278.

Another function of GAM281 is therefore inhibition of LOC286441 (Accession XP_212319.1). Accordingly, utilities of GAM281 include diagnosis, prevention and treatment of diseases and clinical conditions associated with LOC286441.

LOC286467 (Accession XP_210063.1) is another GAM281 target gene, herein designated TARGET GENE. LOC286467 BINDING SITE is a target binding site found in the 3' untranslated region of mRNA encoded by LOC286467, corresponding to a target binding site such as BINDING SITE I, BINDING SITE II or BINDING SITE III of FIG. 8. Table 4 illustrates the complementarity of the nucleotide sequences of LOC286467 BINDING SITE, designated SEQ ID:9580, to the nucleotide sequence of GAM281 RNA, herein designated GAM RNA, also designated SEQ ID:278.

Another function of GAM281 is therefore inhibition of LOC286467 (Accession XP_210063.1). Accordingly, utilities of GAM281 include diagnosis, prevention and treatment of diseases and clinical conditions associated with LOC286467.

LOC286553 (Accession XP_212340.1) is another GAM281 target gene, herein designated TARGET GENE. LOC286553 BINDING SITE is a target binding site found in the 3' untranslated region of mRNA encoded by LOC286553, corresponding to a target binding site such as BINDING SITE I, BINDING SITE II or BINDING SITE III of FIG. 8. Table 4 illustrates the complementarity of the nucleotide sequences of LOC286553 BINDING SITE, designated SEQ ID:3183, to the nucleotide sequence of GAM281 RNA, herein designated GAM RNA, also designated SEQ ID:278.

Another function of GAM281 is therefore inhibition of LOC286553 (Accession XP_212340.1). Accordingly, utilities of GAM281 include diagnosis, prevention and treatment of diseases and clinical conditions associated with LOC286553.

LOC286558 (Accession XP_210106.1) is another GAM281 target gene, herein designated TARGET GENE. LOC286558 BINDING SITE is a target binding site found in the 3' untranslated region of mRNA encoded by LOC286558, corresponding to a target binding site such as BINDING SITE I, BINDING SITE II or BINDING SITE III of FIG. 8. Table 4 illustrates the complementarity of the nucleotide sequences of LOC286558 BINDING SITE, designated SEQ ID:9264, to the nucleotide sequence of GAM281 RNA, herein designated GAM RNA, also designated SEQ ID:278.

Another function of GAM281 is therefore inhibition of LOC286558 (Accession XP_210106.1). Accordingly, utilities of GAM281 include diagnosis, prevention and treatment of diseases and clinical conditions associated with LOC286558.

LOC286564 (Accession XP_210108.1) is another GAM281 target gene, herein designated TARGET GENE. LOC286564 BINDING SITE is a target binding site found in the 3' untranslated region of mRNA encoded by LOC286564, corresponding to a target binding site such as BINDING SITE I, BINDING SITE II or BINDING SITE III of FIG. 8. Table 4 illustrates the complementarity of the nucleotide sequences of LOC286564 BINDING SITE, designated SEQ ID:9264, to the nucleotide sequence of GAM281 RNA, herein designated GAM RNA, also designated SEQ ID:278.

Another function of GAM281 is therefore inhibition of LOC286564 (Accession XP_210108.1). Accordingly, utilities of GAM281 include diagnosis, prevention and treatment of diseases and clinical conditions associated with LOC286564.

LOC338562 (Accession XP_294654.1) is another GAM281 target gene, herein designated TARGET GENE. LOC338562 BINDING SITE is a target binding site found in the 3' untranslated region of mRNA encoded by LOC338562, corresponding to a target binding site such as BINDING SITE I, BINDING SITE II or BINDING SITE III of FIG. 8. Table 4 illustrates the complementarity of the nucleotide sequences of LOC338562 BINDING SITE, designated SEQ ID:13760, to the nucleotide sequence of GAM281 RNA, herein designated GAM RNA, also designated SEQ ID:278.

Another function of GAM281 is therefore inhibition of LOC338562 (Accession XP_294654.1). Accordingly, utilities of GAM281 include diagnosis, prevention and treatment of diseases and clinical conditions associated with LOC338562.

LOC338565 (Accession XP_294653.1) is another GAM281 target gene, herein designated TARGET GENE. LOC338565 BINDING SITE1 and LOC338565 BINDING SITE2 are target binding sites found in untranslated regions of mRNA encoded by LOC338565, corresponding to target binding sites such as BINDING SITE I, BINDING SITE II or BINDING SITE III of FIG. 8. Table 4 illustrates the complementarity of the nucleotide sequences of LOC338565 BINDING SITE1 and LOC338565 BINDING SITE2, designated SEQ ID:12867 and SEQ ID:7596 respectively, to the nucleotide sequence of GAM281 RNA, herein designated GAM RNA, also designated SEQ ID:278.

Another function of GAM281 is therefore inhibition of LOC338565 (Accession XP_294653.1). Accordingly, utilities of GAM281 include diagnosis, prevention and treatment of diseases and clinical conditions associated with LOC338565.

LOC338579 (Accession XP_290472.1) is another GAM281 target gene, herein designated TARGET GENE. LOC338579 BINDING SITE is a target binding site found in the 3' untranslated region of mRNA encoded by LOC338579, corresponding to a target binding site such as BINDING SITE I, BINDING SITE II or BINDING SITE III of FIG. 8. Table 4 illustrates the complementarity of the nucleotide sequences of LOC338579 BINDING SITE, designated SEQ ID:4528, to the nucleotide sequence of GAM281 RNA, herein designated GAM RNA, also designated SEQ ID:278.

Another function of GAM281 is therefore inhibition of LOC338579 (Accession XP_290472.1). Accordingly, utilities of GAM281 include diagnosis, prevention and treatment of diseases and clinical conditions associated with LOC338579.

LOC338585 (Accession XP_294658.1) is another GAM281 target gene, herein designated TARGET GENE. LOC338585 BINDING SITE is a target binding site found in the 5' untranslated region of mRNA encoded by LOC338585, corresponding to a target binding site such as BINDING SITE I, BINDING SITE II or BINDING SITE III of FIG. 8. Table 4 illustrates the complementarity of the nucleotide sequences of LOC338585 BINDING SITE, designated SEQ ID:7523, to the nucleotide sequence of GAM281 RNA, herein designated GAM RNA, also designated SEQ ID:278.

Another function of GAM281 is therefore inhibition of LOC338585 (Accession XP_294658.1). Accordingly, utilities of GAM281 include diagnosis, prevention and treatment of diseases and clinical conditions associated with LOC338585.

LOC338609 (Accession XP_294664.1) is another GAM281 target gene, herein designated TARGET GENE. LOC338609 BINDING SITE is a target binding site found in the 3' untranslated region of mRNA encoded by LOC338609, corresponding to a target binding site such as BINDING SITE I, BINDING SITE II or BINDING SITE III of FIG. 8. Table 4 illustrates the complementarity of the nucleotide sequences of LOC338609 BINDING SITE, designated SEQ ID:18810, to the nucleotide sequence of GAM281 RNA, herein designated GAM RNA, also designated SEQ ID:278.

Another function of GAM281 is therefore inhibition of LOC338609 (Accession XP_294664.1). Accordingly, utilities of GAM281 include diagnosis, prevention and treatment of diseases and clinical conditions associated with LOC338609.

LOC338645 (Accession XP_290494.1) is another GAM281 target gene, herein designated TARGET GENE. LOC338645 BINDING SITE is a target binding site found in the 3' untranslated region of mRNA encoded by LOC338645, corresponding to a target binding site such as BINDING SITE I, BINDING SITE II or BINDING SITE III of FIG. 8. Table 4 illustrates the complementarity of the nucleotide sequences of LOC338645 BINDING SITE, designated SEQ ID:6626, to the nucleotide sequence of GAM281 RNA, herein designated GAM RNA, also designated SEQ ID:278.

Another function of GAM281 is therefore inhibition of LOC338645 (Accession XP_290494.1). Accordingly, utilities of GAM281 include diagnosis, prevention and treatment of diseases and clinical conditions associated with LOC338645.

LOC338709 (Accession XP_211595.2) is another GAM281 target gene, herein designated TARGET GENE. LOC338709 BINDING SITE is a target binding site found in the 5' untranslated region of mRNA encoded by LOC338709, corresponding to a target binding site such as BINDING SITE I, BINDING SITE II or BINDING SITE III of FIG. 8. Table 4 illustrates the complementarity of the nucleotide sequences of LOC338709 BINDING SITE, designated SEQ ID:12803, to the nucleotide sequence of GAM281 RNA, herein designated GAM RNA, also designated SEQ ID:278.

Another function of GAM281 is therefore inhibition of LOC338709 (Accession XP_211595.2). Accordingly, utilities of GAM281 include diagnosis, prevention and treatment of diseases and clinical conditions associated with LOC338709.

LOC338739 (Accession XP_294690.1) is another GAM281 target gene, herein designated TARGET GENE. LOC338739 BINDING SITE1 and LOC338739 BINDING SITE2 are target binding sites found in untranslated regions of mRNA encoded by LOC338739, corresponding to target binding sites such as BINDING SITE I, BINDING SITE II or BINDING SITE III of FIG. 8. Table 4 illustrates the complementarity of the nucleotide sequences of LOC338739 BINDING SITE1 and LOC338739 BINDING SITE2, designated SEQ ID:15044 and SEQ ID:14732 respectively, to the nucleotide sequence of GAM281 RNA, herein designated GAM RNA, also designated SEQ ID:278.

Another function of GAM281 is therefore inhibition of LOC338739 (Accession XP_294690.1). Accordingly, utilities of GAM281 include diagnosis, prevention and treatment of diseases and clinical conditions associated with LOC338739.

LOC338773 (Accession XP_290570.1) is another GAM281 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:16493, to the nucleotide sequence of GAM281 RNA, herein designated GAM RNA, also designated SEQ ID:278.

Another function of GAM281 is therefore inhibition of LOC338773 (Accession XP_290570.1). Accordingly, utilities of GAM281 include diagnosis, prevention and treatment of diseases and clinical conditions associated with LOC338773.

LOC338819 (Accession XP_290216.1) is another GAM281 target gene, herein designated TARGET GENE. LOC338819 BINDING SITE is a target binding site found in the 3' untranslated region of mRNA encoded by LOC338819, corresponding to a target binding site such as BINDING SITE I, BINDING SITE II or BINDING SITE III of FIG. 8. Table 4 illustrates the complementarity of the nucleotide sequences of LOC338819 BINDING SITE, designated SEQ ID:11507, to the nucleotide sequence of GAM281 RNA, herein designated GAM RNA, also designated SEQ ID:278.

Another function of GAM281 is therefore inhibition of LOC338819 (Accession XP_290216.1). Accordingly, utilities of GAM281 include diagnosis, prevention and treatment of diseases and clinical conditions associated with LOC338819.

LOC338899 (Accession XP_294740.1) is another GAM281 target gene, herein designated TARGET GENE. LOC338899 BINDING SITE is a target binding site found in the 5' untranslated region of mRNA encoded by LOC338899, corresponding to a target binding site such as BINDING SITE I, BINDING SITE II or BINDING SITE III of FIG. 8. Table 4 illustrates the complementarity of the nucleotide sequences of LOC338899 BINDING SITE, designated SEQ ID:12341, to the nucleotide sequence of GAM281 RNA, herein designated GAM RNA, also designated SEQ ID:278.

Another function of GAM281 is therefore inhibition of LOC338899 (Accession XP_294740.1). Accordingly, utilities of GAM281 include diagnosis, prevention and treatment of diseases and clinical conditions associated with LOC338899.

LOC338923 (Accession XP_294742.1) is another GAM281 target gene, herein designated TARGET GENE. LOC338923 BINDING SITE1 and LOC338923 BINDING SITE2 are target binding sites found in untranslated regions of mRNA encoded by LOC338923, corresponding to target binding sites such as BINDING SITE I, BINDING SITE II or BINDING SITE III of FIG. 8. Table 4 illustrates the complementarity of the nucleotide sequences of LOC338923 BINDING SITE1 and LOC338923 BINDING SITE2, designated SEQ ID:4298 and SEQ ID:8559 respectively, to the nucleotide sequence of GAM281 RNA, herein designated GAM RNA, also designated SEQ ID:278.

Another function of GAM281 is therefore inhibition of LOC338923 (Accession XP_294742.1). Accordingly, utilities of GAM281 include diagnosis, prevention and treatment of diseases and clinical conditions associated with LOC338923.

LOC338963 (Accession XP_294757.1) is another GAM281 target gene, herein designated TARGET GENE. LOC338963 BINDING SITE is a target binding site found in the 3' untranslated region of mRNA encoded by LOC338963, corresponding to a target binding site such as BINDING SITE I, BINDING SITE II or BINDING SITE III of FIG. 8. Table 4 illustrates the complementarity of the nucleotide sequences of LOC338963 BINDING SITE, designated SEQ ID:3348, to the nucleotide sequence of GAM281 RNA, herein designated GAM RNA, also designated SEQ ID:278.

Another function of GAM281 is therefore inhibition of LOC338963 (Accession XP_294757.1). Accordingly, utilities of GAM281 include diagnosis, prevention and treatment of diseases and clinical conditions associated with LOC338963.

LOC338991 (Accession XP_290663.1) is another GAM281 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:12479, to the nucleotide sequence of GAM281 RNA, herein designated GAM RNA, also designated SEQ ID:278.

Another function of GAM281 is therefore inhibition of LOC338991 (Accession XP_290663.1). Accordingly, utilities of GAM281 include diagnosis, prevention and treatment of diseases and clinical conditions associated with LOC338991.

LOC338999 (Accession XP_290659.1) is another GAM281 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:12479, to the nucleotide sequence of GAM281 RNA, herein designated GAM RNA, also designated SEQ ID:278.

Another function of GAM281 is therefore inhibition of LOC338999 (Accession XP_290659.1). Accordingly, utilities of GAM281 include diagnosis, prevention and treatment of diseases and clinical conditions associated with LOC338999.

LOC339077 (Accession XP_294802.2) is another GAM281 target gene, herein designated TARGET GENE. LOC339077 BINDING SITE is a target binding site found in the 3' untranslated region of mRNA encoded by LOC339077, corresponding to a target binding site such as BINDING SITE I, BINDING SITE II or BINDING SITE III of FIG. 8. Table 4 illustrates the complementarity of the nucleotide sequences of LOC339077 BINDING SITE, designated SEQ ID:17484, to the nucleotide sequence of GAM281 RNA, herein designated GAM RNA, also designated SEQ ID:278.

Another function of GAM281 is therefore inhibition of LOC339077 (Accession XP_294802.2). Accordingly, utilities of GAM281 include diagnosis, prevention and treatment of diseases and clinical conditions associated with LOC339077.

LOC339078 (Accession XP_290692.1) is another GAM281 target gene, herein designated TARGET GENE. LOC339078 BINDING SITE is a target binding site found in the 3' untranslated region of mRNA encoded by LOC339078, corresponding to a target binding site such as BINDING SITE I, BINDING SITE II or BINDING SITE III of FIG. 8. Table 4 illustrates the complementarity of the nucleotide sequences of LOC339078 BINDING SITE, designated SEQ ID:9543, to the nucleotide sequence of GAM281 RNA, herein designated GAM RNA, also designated SEQ ID:278.

Another function of GAM281 is therefore inhibition of LOC339078 (Accession XP_290692.1). Accordingly, utilities of GAM281 include diagnosis, prevention and treatment of diseases and clinical conditions associated with LOC339078.

LOC339108 (Accession XP_290711.1) is another GAM281 target gene, herein designated TARGET GENE. LOC339108 BINDING SITE is a target binding site found in the 5' untranslated region of mRNA encoded by LOC339108, corresponding to a target binding site such as BINDING SITE I, BINDING SITE II or BINDING SITE III of FIG. 8. Table 4 illustrates the complementarity of the nucleotide sequences of LOC339108 BINDING SITE, designated SEQ ID:14266, to the nucleotide sequence of GAM281 RNA, herein designated GAM RNA, also designated SEQ ID:278.

Another function of GAM281 is therefore inhibition of LOC339108 (Accession XP_290711.1). Accordingly, utilities of GAM281 include diagnosis, prevention and treatment of diseases and clinical conditions associated with LOC339108.

LOC339146 (Accession XP_294825.1) is another GAM281 target gene, herein designated TARGET GENE. LOC339146 BINDING SITE is a target binding site found in the 5' untranslated region of mRNA encoded by LOC339146, corresponding to a target binding site such as BINDING SITE I, BINDING SITE II or BINDING SITE III of FIG. 8. Table 4 illustrates the complementarity of the nucleotide sequences of LOC339146 BINDING SITE, designated SEQ ID:15614, to the nucleotide sequence of GAM281 RNA, herein designated GAM RNA, also designated SEQ ID:278.

Another function of GAM281 is therefore inhibition of LOC339146 (Accession XP_294825.1). Accordingly, utilities of GAM281 include diagnosis, prevention and treatment of diseases and clinical conditions associated with LOC339146.

LOC339153 (Accession XP_294827.1) is another GAM281 target gene, herein designated TARGET GENE. LOC339153 BINDING SITE is a target binding site found in the 3' untranslated region of mRNA encoded by LOC339153, corresponding to a target binding site such as BINDING SITE I, BINDING SITE II or BINDING SITE III of FIG. 8. Table 4 illustrates the complementarity of the nucleotide sequences of LOC339153 BINDING SITE, designated SEQ ID:13344, to the nucleotide sequence of GAM281 RNA, herein designated GAM RNA, also designated SEQ ID:278.

Another function of GAM281 is therefore inhibition of LOC339153 (Accession XP_294827.1). Accordingly, utilities of GAM281 include diagnosis, prevention and treatment of diseases and clinical conditions associated with LOC339153.

LOC339154 (Accession XP_294832.1) is another GAM281 target gene, herein designated TARGET GENE. LOC339154 BINDING SITE is a target binding site found in the 3' untranslated region of mRNA encoded by LOC339154, corresponding to a target binding site such as BINDING SITE I, BINDING SITE II or BINDING SITE III of FIG. 8. Table 4 illustrates the complementarity of the nucleotide sequences of LOC339154 BINDING SITE, designated SEQ ID:4196, to the nucleotide sequence of GAM281 RNA, herein designated GAM RNA, also designated SEQ ID:278.

Another function of GAM281 is therefore inhibition of LOC339154 (Accession XP_294832.1). Accordingly, utilities of GAM281 include diagnosis, prevention and treatment of diseases and clinical conditions associated with LOC339154.

LOC339178 (Accession XP_290742.1) is another GAM281 target gene, herein designated TARGET GENE. LOC339178 BINDING SITE is a target binding site found in the 3' untranslated region of mRNA encoded by LOC339178, corresponding to a target binding site such as BINDING SITE I, BINDING SITE II or BINDING SITE III of FIG. 8. Table 4 illustrates the complementarity of the nucleotide sequences of LOC339178 BINDING SITE, designated SEQ ID:16261, to the nucleotide sequence of GAM281 RNA, herein designated GAM RNA, also designated SEQ ID:278.

Another function of GAM281 is therefore inhibition of LOC339178 (Accession XP_290742.1). Accordingly, utilities of GAM281 include diagnosis, prevention and treatment of diseases and clinical conditions associated with LOC339178.

LOC339201 (Accession XP_290756.1) is another GAM281 target gene, herein designated TARGET GENE. LOC339201 BINDING SITE is a target binding site found in the 3' untranslated region of mRNA encoded by LOC339201, corresponding to a target binding site such as BINDING SITE I, BINDING SITE II or BINDING SITE III of FIG. 8. Table 4 illustrates the complementarity of the nucleotide sequences of LOC339201 BINDING SITE, designated SEQ ID:4056, to the nucleotide sequence of GAM281 RNA, herein designated GAM RNA, also designated SEQ ID:278.

Another function of GAM281 is therefore inhibition of LOC339201 (Accession XP_290756.1). Accordingly, utilities of GAM281 include diagnosis, prevention and treatment of diseases and clinical conditions associated with LOC339201.

LOC339216 (Accession XP_290762.2) is another GAM281 target gene, herein designated TARGET GENE. LOC339216 BINDING SITE is a target binding site found in the 5' untranslated region of mRNA encoded by LOC339216, corresponding to a target binding site such as BINDING SITE I, BINDING SITE II or BINDING SITE III of FIG. 8. Table 4 illustrates the complementarity of the nucleotide sequences of LOC339216 BINDING SITE, designated SEQ ID:19537, to the nucleotide sequence of GAM281 RNA, herein designated GAM RNA, also designated SEQ ID:278.

Another function of GAM281 is therefore inhibition of LOC339216 (Accession XP_290762.2). Accordingly, utilities of GAM281 include diagnosis, prevention and treatment of diseases and clinical conditions associated with LOC339216.

LOC339282 (Accession XP_294900.2) is another GAM281 target gene, herein designated TARGET GENE. LOC339282 BINDING SITE is a target binding site found in the 5' untranslated region of mRNA encoded by LOC339282, corresponding to a target binding site such as BINDING SITE I, BINDING SITE II or BINDING SITE III of FIG. 8. Table 4 illustrates the complementarity of the nucleotide sequences of LOC339282 BINDING SITE, designated SEQ ID:19537, to the nucleotide sequence of GAM281 RNA, herein designated GAM RNA, also designated SEQ ID:278.

Another function of GAM281 is therefore inhibition of LOC339282 (Accession XP_294900.2). Accordingly, utilities of GAM281 include diagnosis, prevention and treatment of diseases and clinical conditions associated with LOC339282.

LOC339283 (Accession XP_294899.2) is another GAM281 target gene, herein designated TARGET GENE. LOC339283 BINDING SITE is a target binding site found in the 5' untranslated region of mRNA encoded by LOC339283, corresponding to a target binding site such as BINDING SITE I, BINDING SITE II or BINDING SITE III of FIG. 8. Table 4 illustrates the complementarity of the nucleotide sequences of LOC339283 BINDING SITE, designated SEQ ID:11314, to the nucleotide sequence of GAM281 RNA, herein designated GAM RNA, also designated SEQ ID:278.

Another function of GAM281 is therefore inhibition of LOC339283 (Accession XP_294899.2). Accordingly, utilities of GAM281 include diagnosis, prevention and treatment of diseases and clinical conditions associated with LOC339283.

LOC339298 (Accession XP_294903.1) is another GAM281 target gene, herein designated TARGET GENE. LOC339298 BINDING SITE is a target binding site found in the 5' untranslated region of mRNA encoded by LOC339298, corresponding to a target binding site such as BINDING SITE I, BINDING SITE II or BINDING SITE III of FIG. 8. Table 4 illustrates the complementarity of the nucleotide sequences of LOC339298 BINDING SITE, designated SEQ ID:12349, to the nucleotide sequence of GAM281 RNA, herein designated GAM RNA, also designated SEQ ID:278.

Another function of GAM281 is therefore inhibition of LOC339298 (Accession XP_294903.1). Accordingly, utilities of GAM281 include diagnosis, prevention and treatment of diseases and clinical conditions associated with LOC339298.

LOC339321 (Accession XP_290831.1) is another GAM281 target gene, herein designated TARGET GENE. LOC339321 BINDING SITE is a target binding site found in the 5' untranslated region of mRNA encoded by LOC339321, corresponding to a target binding site such as BINDING SITE I, BINDING SITE II or BINDING SITE III of FIG. 8. Table 4 illustrates the complementarity of the nucleotide sequences of LOC339321 BINDING SITE, designated SEQ ID:2039, to the nucleotide sequence of GAM281 RNA, herein designated GAM RNA, also designated SEQ ID:278.

Another function of GAM281 is therefore inhibition of LOC339321 (Accession XP_290831.1). Accordingly, utilities of GAM281 include diagnosis, prevention and treatment of diseases and clinical conditions associated with LOC339321.

LOC339324 (Accession XP_290838.1) is another GAM281 target gene, herein designated TARGET GENE. LOC339324 BINDING SITE is a target binding site found in the 3' untranslated region of mRNA encoded by LOC339324, corresponding to a target binding site such as BINDING SITE I, BINDING SITE II or BINDING SITE III of FIG. 8. Table 4 illustrates the complementarity of the nucleotide sequences of LOC339324 BINDING SITE, designated SEQ ID:9544, to the nucleotide sequence of GAM281 RNA, herein designated GAM RNA, also designated SEQ ID:278.

Another function of GAM281 is therefore inhibition of LOC339324 (Accession XP_290838.1). Accordingly, utilities of GAM281 include diagnosis, prevention and treatment of diseases and clinical conditions associated with LOC339324.

LOC339325 (Accession XP_290830.1) is another GAM281 target gene, herein designated TARGET GENE. LOC339325 BINDING SITE1 and LOC339325 BINDING SITE2 are target binding sites found in untranslated regions of mRNA encoded by LOC339325, corresponding to target binding sites such as BINDING SITE I, BINDING SITE II or BINDING SITE III of FIG. 8. Table 4 illustrates the complementarity of the nucleotide sequences of LOC339325 BINDING SITE1 and LOC339325 BINDING SITE2, designated SEQ ID:17114 and SEQ ID:16940 respectively, to the nucleotide sequence of GAM281 RNA, herein designated GAM RNA, also designated SEQ ID:278.

Another function of GAM281 is therefore inhibition of LOC339325 (Accession XP_290830.1). Accordingly, utilities of GAM281 include diagnosis, prevention and treatment of diseases and clinical conditions associated with LOC339325.

LOC339400 (Accession XP_294926.1) is another GAM281 target gene, herein designated TARGET GENE. LOC339400 BINDING SITE is a target binding site found in the 3' untranslated region of mRNA encoded by LOC339400, corresponding to a target binding site such as BINDING SITE I, BINDING SITE II or BINDING SITE III of FIG. 8. Table 4 illustrates the complementarity of the nucleotide sequences of LOC339400 BINDING SITE, designated SEQ ID:14072, to the nucleotide sequence of GAM281 RNA, herein designated GAM RNA, also designated SEQ ID:278.

Another function of GAM281 is therefore inhibition of LOC339400 (Accession XP_294926.1). Accordingly, utilities of GAM281 include diagnosis, prevention and treatment of diseases and clinical conditions associated with LOC339400.

LOC339417 (Accession XP_294944.1) is another GAM281 target gene, herein designated TARGET GENE. LOC339417 BINDING SITE is a target binding site found in the 5' untranslated region of mRNA encoded by LOC339417, corresponding to a target binding site such as BINDING SITE I, BINDING SITE II or BINDING SITE III of FIG. 8. Table 4 illustrates the complementarity of the nucleotide sequences of LOC339417 BINDING SITE, designated SEQ ID:2027, to the nucleotide sequence of GAM281 RNA, herein designated GAM RNA, also designated SEQ ID:278.

Another function of GAM281 is therefore inhibition of LOC339417 (Accession XP_294944.1). Accordingly, utilities of GAM281 include diagnosis, prevention and treatment of diseases and clinical conditions associated with LOC339417.

LOC339448 (Accession XP_290902.1) is another GAM281 target gene, herein designated TARGET GENE. LOC339448 BINDING SITE is a target binding site found in the 3' untranslated region of mRNA encoded by LOC339448, corresponding to a target binding site such as BINDING SITE I, BINDING SITE II or BINDING SITE III of FIG. 8. Table 4 illustrates the complementarity of the nucleotide sequences of LOC339448 BINDING SITE, designated SEQ ID:10679, to the nucleotide sequence of GAM281 RNA, herein designated GAM RNA, also designated SEQ ID:278.

Another function of GAM281 is therefore inhibition of LOC339448 (Accession XP_290902.1). Accordingly, utilities of GAM281 include diagnosis, prevention and treatment of diseases and clinical conditions associated with LOC339448.

LOC339458 (Accession XP_290911.1) is another GAM281 target gene, herein designated TARGET GENE. LOC339458 BINDING SITE is a target binding site found in the 3' untranslated region of mRNA encoded by LOC339458, corresponding to a target binding site such as BINDING SITE I, BINDING SITE II or BINDING SITE III of FIG. 8. Table 4 illustrates the complementarity of the nucleotide sequences of LOC339458 BINDING SITE, designated SEQ ID:5488, to the nucleotide sequence of GAM281 RNA, herein designated GAM RNA, also designated SEQ ID:278.

Another function of GAM281 is therefore inhibition of LOC339458 (Accession XP_290911.1). Accordingly, utilities of GAM281 include diagnosis, prevention and treatment of diseases and clinical conditions associated with LOC339458.

LOC339459 (Accession XP_290907.2) is another GAM281 target gene, herein designated TARGET GENE. LOC339459 BINDING SITE is a target binding site found in the 3' untranslated region of mRNA encoded by LOC339459, corresponding to a target binding site such as BINDING SITE I, BINDING SITE II or BINDING SITE III of FIG. 8. Table 4 illustrates the complementarity of the nucleotide sequences of LOC339459 BINDING SITE, designated SEQ ID:13513, to the nucleotide sequence of GAM281 RNA, herein designated GAM RNA, also designated SEQ ID:278.

Another function of GAM281 is therefore inhibition of LOC339459 (Accession XP_290907.2). Accordingly, utilities of GAM281 include diagnosis, prevention and treatment of diseases and clinical conditions associated with LOC339459.

LOC339492 (Accession XP_290919.1) is another GAM281 target gene, herein designated TARGET GENE. LOC339492 BINDING SITE1 and LOC339492 BINDING SITE2 are target binding sites found in untranslated regions of mRNA encoded by LOC339492, corresponding to target binding sites such as BINDING SITE I, BINDING SITE II or BINDING SITE III of FIG. 8. Table 4 illustrates the complementarity of the nucleotide sequences of LOC339492 BINDING SITE1 and LOC339492 BINDING SITE2, designated SEQ ID:8590 and SEQ ID:7386 respectively, to the nucleotide sequence of GAM281 RNA, herein designated GAM RNA, also designated SEQ ID:278.

Another function of GAM281 is therefore inhibition of LOC339492 (Accession XP_290919.1). Accordingly, utilities of GAM281 include diagnosis, prevention and treatment of diseases and clinical conditions associated with LOC339492.

LOC339577 (Accession XP_295005.1) is another GAM281 target gene, herein designated TARGET GENE. LOC339577 BINDING SITE1 and LOC339577 BINDING SITE2 are target binding sites found in untranslated regions of mRNA encoded by LOC339577, corresponding to target binding sites such as BINDING SITE I, BINDING SITE II or BINDING SITE III of FIG. 8. Table 4 illustrates the complementarity of the nucleotide sequences of LOC339577 BINDING SITE1 and LOC339577 BINDING SITE2, designated SEQ ID:14733 and SEQ ID:12075 respectively, to the nucleotide sequence of GAM281 RNA, herein designated GAM RNA, also designated SEQ ID:278.

Another function of GAM281 is therefore inhibition of LOC339577 (Accession XP_295005.1). Accordingly, utilities of GAM281 include diagnosis, prevention and treatment of diseases and clinical conditions associated with LOC339577.

LOC339600 (Accession XP_295014.1) is another GAM281 target gene, herein designated TARGET GENE. LOC339600 BINDING SITE is a target binding site found in the 3' untranslated region of mRNA encoded by LOC339600, corresponding to a target binding site such as BINDING SITE I, BINDING SITE II or BINDING SITE III of FIG. 8. Table 4 illustrates the complementarity of the nucleotide sequences of LOC339600 BINDING SITE, designated SEQ ID:15295, to the nucleotide sequence of GAM281 RNA, herein designated GAM RNA, also designated SEQ ID:278.

Another function of GAM281 is therefore inhibition of LOC339600 (Accession XP_295014.1). Accordingly, utilities of GAM281 include diagnosis, prevention and treatment of diseases and clinical conditions associated with LOC339600.

LOC339659 (Accession XP_290981.1) is another GAM281 target gene, herein designated TARGET GENE. LOC339659 BINDING SITE is a target binding site found in the 3' untranslated region of mRNA encoded by LOC339659, corresponding to a target binding site such as BINDING SITE I, BINDING SITE II or BINDING SITE III of FIG. 8. Table 4 illustrates the complementarity of the nucleotide sequences of LOC339659 BINDING SITE, designated SEQ ID:17076, to the nucleotide sequence of GAM281 RNA, herein designated GAM RNA, also designated SEQ ID:278.

Another function of GAM281 is therefore inhibition of LOC339659 (Accession XP_290981.1). Accordingly, utilities of GAM281 include diagnosis, prevention and treatment of diseases and clinical conditions associated with LOC339659.

LOC339685 (Accession XP_295032.1) is another GAM281 target gene, herein designated TARGET GENE. LOC339685 BINDING SITE is a target binding site found in the 5' untranslated region of mRNA encoded by LOC339685, corresponding to a target binding site such as BINDING SITE I, BINDING SITE II or BINDING SITE III of FIG. 8. Table 4 illustrates the complementarity of the nucleotide sequences of LOC339685 BINDING SITE, designated SEQ ID:1982, to the nucleotide sequence of GAM281 RNA, herein designated GAM RNA, also designated SEQ ID:278.

Another function of GAM281 is therefore inhibition of LOC339685 (Accession XP_295032.1). Accordingly, utilities of GAM281 include diagnosis, prevention and treatment of diseases and clinical conditions associated with LOC339685.

LOC339694 (Accession XP_295035.1) is another GAM281 target gene, herein designated TARGET GENE. LOC339694 BINDING SITE is a target binding site found in the 5' untranslated region of mRNA encoded by LOC339694, corresponding to a target binding site such as BINDING SITE I, BINDING SITE II or BINDING SITE III of FIG. 8. Table 4 illustrates the complementarity of the nucleotide sequences of LOC339694 BINDING SITE, designated SEQ ID:15954, to the nucleotide sequence of GAM281 RNA, herein designated GAM RNA, also designated SEQ ID:278.

Another function of GAM281 is therefore inhibition of LOC339694 (Accession XP_295035.1). Accordingly, utilities of GAM281 include diagnosis, prevention and treatment of diseases and clinical conditions associated with LOC339694.

LOC339711 (Accession XP_295038.1) is another GAM281 target gene, herein designated TARGET GENE. LOC339711 BINDING SITE is a target binding site found in the 3' untranslated region of mRNA encoded by LOC339711, corresponding to a target binding site such as BINDING SITE I, BINDING SITE II or BINDING SITE III of FIG. 8. Table 4 illustrates the complementarity of the nucleotide sequences of LOC339711 BINDING SITE, designated SEQ ID:11528, to the nucleotide sequence of GAM281 RNA, herein designated GAM RNA, also designated SEQ ID:278.

Another function of GAM281 is therefore inhibition of LOC339711 (Accession XP_295038.1). Accordingly, utilities of GAM281 include diagnosis, prevention and treatment of diseases and clinical conditions associated with LOC339711.

LOC339720 (Accession XP_295041.1) is another GAM281 target gene, herein designated TARGET GENE. LOC339720 BINDING SITE1 and LOC339720 BINDING SITE2 are target binding sites found in untranslated regions of mRNA encoded by LOC339720, corresponding to target binding sites such as BINDING SITE I, BINDING SITE II or BINDING SITE III of FIG. 8. Table 4 illustrates the complementarity of the nucleotide sequences of LOC339720 BINDING SITE1 and LOC339720 BINDING SITE2, designated SEQ ID:16942 and SEQ ID:18414 respectively, to the nucleotide sequence of GAM281 RNA, herein designated GAM RNA, also designated SEQ ID:278.

Another function of GAM281 is therefore inhibition of LOC339720 (Accession XP_295041.1). Accordingly, utilities of GAM281 include diagnosis, prevention and treatment of diseases and clinical conditions associated with LOC339720.

LOC339803 (Accession XP_295072.1) is another GAM281 target gene, herein designated TARGET GENE. LOC339803 BINDING SITE is a target binding site found in the 3' untranslated region of mRNA encoded by LOC339803, corresponding to a target binding site such as BINDING SITE I, BINDING SITE II or BINDING SITE III of FIG. 8. Table 4 illustrates the complementarity of the nucleotide sequences of LOC339803 BINDING SITE, designated SEQ ID:13337, to the nucleotide sequence of GAM281 RNA, herein designated GAM RNA, also designated SEQ ID:278.

Another function of GAM281 is therefore inhibition of LOC339803 (Accession XP_295072.1). Accordingly, utilities of GAM281 include diagnosis, prevention and treatment of diseases and clinical conditions associated with LOC339803.

LOC339809 (Accession XP_291020.1) is another GAM281 target gene, herein designated TARGET GENE. LOC339809 BINDING SITE1 and LOC339809 BINDING SITE2 are target binding sites found in untranslated regions of mRNA encoded by LOC339809, corresponding to target binding sites such as BINDING SITE I, BINDING SITE II or BINDING SITE III of FIG. 8. Table 4 illustrates the complementarity of the nucleotide sequences of LOC339809 BINDING SITE1 and LOC339809 BINDING SITE2, designated SEQ ID:1744 and SEQ ID:17750 respectively, to the nucleotide sequence of GAM281 RNA, herein designated GAM RNA, also designated SEQ ID:278.

Another function of GAM281 is therefore inhibition of LOC339809 (Accession XP_291020.1). Accordingly, utilities of GAM281 include diagnosis, prevention and treatment of diseases and clinical conditions associated with LOC339809.

LOC339833 (Accession XP_291031.1) is another GAM281 target gene, herein designated TARGET GENE. LOC339833 BINDING SITE1 and LOC339833 BINDING SITE2 are target binding sites found in untranslated regions of mRNA encoded by LOC339833, corresponding to target binding sites such as BINDING SITE I, BINDING SITE II or BINDING SITE III of FIG. 8. Table 4 illustrates the complementarity of the nucleotide sequences of LOC339833BINDING SITE1 and LOC339833 BINDING SITE2, designated SEQ ID:10421 and SEQ ID:7633 respectively, to the nucleotide sequence of GAM281 RNA, herein designated GAM RNA, also designated SEQ ID:278.

Another function of GAM281 is therefore inhibition of LOC339833 (Accession XP_291031.1). Accordingly, utilities of GAM281 include diagnosis, prevention and treatment of diseases and clinical conditions associated with LOC339833.

LOC339834 (Accession NP_835467.1) is another GAM281 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:14645, to the nucleotide sequence of GAM281 RNA, herein designated GAM RNA, also designated SEQ ID:278.

Another function of GAM281 is therefore inhibition of LOC339834 (Accession NP_835467.1). Accordingly, utilities of GAM281 include diagnosis, prevention and treatment of diseases and clinical conditions associated with LOC339834.

LOC339834 (Accession XP_291033.1) is another GAM281 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:14645, to the nucleotide sequence of GAM281 RNA, herein designated GAM RNA, also designated SEQ ID:278.

Another function of GAM281 is therefore inhibition of LOC339834 (Accession XP_291033.1). Accordingly, utilities of GAM281 include diagnosis, prevention and treatment of diseases and clinical conditions associated with LOC339834.

LOC339872 (Accession XP_291050.1) is another GAM281 target gene, herein designated TARGET GENE. LOC339872 BINDING SITE1 through LOC339872 BINDING SITE3 are target binding sites found in untranslated regions of mRNA encoded by LOC339872, corresponding to target binding sites such as BINDING SITE I, BINDING SITE II or BINDING SITE III of FIG. 8. Table 4 illustrates the complementarity of the nucleotide sequences of LOC339872 BINDING SITE1 through LOC339872 BINDING SITE3, designated SEQ ID:5858, SEQ ID:9299 and SEQ ID:4026 respectively, to the nucleotide sequence of GAM281 RNA, herein designated GAM RNA, also designated SEQ ID:278.

Another function of GAM281 is therefore inhibition of LOC339872 (Accession XP_291050.1). Accordingly, utilities of GAM281 include diagnosis, prevention and treatment of diseases and clinical conditions associated with LOC339872.

LOC339894 (Accession XP_295095.1) is another GAM281 target gene, herein designated TARGET GENE. LOC339894 BINDING SITE is a target binding site found in the 5' untranslated region of mRNA encoded by LOC339894, corresponding to a target binding site such as BINDING SITE I, BINDING SITE II or BINDING SITE III of FIG. 8. Table 4 illustrates the complementarity of the nucleotide sequences of LOC339894 BINDING SITE, designated SEQ ID:1081, to the nucleotide sequence of GAM281 RNA, herein designated GAM RNA, also designated SEQ ID:278.

Another function of GAM281 is therefore inhibition of LOC339894 (Accession XP_295095.1). Accordingly, utilities of GAM281 include diagnosis, prevention and treatment of diseases and clinical conditions associated with LOC339894.

LOC339907 (Accession XP_291065.1) is another GAM281 target gene, herein designated TARGET GENE. LOC339907 BINDING SITE is a target binding site found in the 3' untranslated region of mRNA encoded by LOC339907, corresponding to a target binding site such as BINDING SITE I, BINDING SITE II or BINDING SITE III of FIG. 8. Table 4 illustrates the complementarity of the nucleotide sequences of LOC339907 BINDING SITE, designated SEQ ID:3425, to the nucleotide sequence of GAM281 RNA, herein designated GAM RNA, also designated SEQ ID:278.

Another function of GAM281 is therefore inhibition of LOC339907 (Accession XP_291065.1). Accordingly, utilities of GAM281 include diagnosis, prevention and treatment of diseases and clinical conditions associated with LOC339907.

LOC339909 (Accession XP_291069.1) is another GAM281 target gene, herein designated TARGET GENE. LOC339909 BINDING SITE is a target binding site found in the 5' untranslated region of mRNA encoded by LOC339909, corresponding to a target binding site such as BINDING SITE I, BINDING SITE II or BINDING SITE III of FIG. 8. Table 4 illustrates the complementarity of the nucleotide sequences of LOC339909 BINDING SITE, designated SEQ ID:10709, to the nucleotide sequence of GAM281 RNA, herein designated GAM RNA, also designated SEQ ID:278.

Another function of GAM281 is therefore inhibition of LOC339909 (Accession XP_291069.1). Accordingly, utilities of GAM281 include diagnosis, prevention and treatment of diseases and clinical conditions associated with LOC339909.

LOC339914 (Accession XP_295099.1) is another GAM281 target gene, herein designated TARGET GENE. LOC339914 BINDING SITE1 and LOC339914 BINDING SITE2 are target binding sites found in untranslated regions of mRNA encoded by LOC339914, corresponding to target binding sites such as BINDING SITE I, BINDING SITE II or BINDING SITE III of FIG. 8. Table 4 illustrates the complementarity of the nucleotide sequences of LOC339914 BINDING SITE1 and LOC339914 BINDING SITE2, designated SEQ ID:714 and SEQ ID:18305 respectively, to the nucleotide sequence of GAM281 RNA, herein designated GAM RNA, also designated SEQ ID:278.

Another function of GAM281 is therefore inhibition of LOC339914 (Accession XP_295099.1). Accordingly, utilities of GAM281 include diagnosis, prevention and treatment of diseases and clinical conditions associated with LOC339914.

LOC339970 (Accession XP_291095.1) is another GAM281 target gene, herein designated TARGET GENE. LOC339970 BINDING SITE is a target binding site found in the 3' untranslated region of mRNA encoded by LOC339970, corresponding to a target binding site such as BINDING SITE I, BINDING SITE II or BINDING SITE III of FIG. 8. Table 4 illustrates the complementarity of the nucleotide sequences of LOC339970 BINDING SITE, designated SEQ ID:16942, to the nucleotide sequence of GAM281 RNA, herein designated GAM RNA, also designated SEQ ID:278.

Another function of GAM281 is therefore inhibition of LOC339970 (Accession XP_291095.1). Accordingly, utilities of GAM281 include diagnosis, prevention and treatment of diseases and clinical conditions associated with LOC339970.

LOC340012 (Accession XP_291113.2) is another GAM281 target gene, herein designated TARGET GENE. LOC340012 BINDING SITE is a target binding site found in the 3' untranslated region of mRNA encoded by LOC340012, corresponding to a target binding site such as BINDING SITE I, BINDING SITE II or BINDING SITE III of FIG. 8. Table 4 illustrates the complementarity of the nucleotide sequences of LOC340012 BINDING SITE, designated SEQ ID:3454, to the nucleotide sequence of GAM281 RNA, herein designated GAM RNA, also designated SEQ ID:278.

Another function of GAM281 is therefore inhibition of LOC340012 (Accession XP_291113.2). Accordingly, utilities of GAM281 include diagnosis, prevention and treatment of diseases and clinical conditions associated with LOC340012.

LOC340037 (Accession XP_295137.1) is another GAM281 target gene, herein designated TARGET GENE. LOC340037 BINDING SITE is a target binding site found in the 3' untranslated region of mRNA encoded by LOC340037, corresponding to a target binding site such as BINDING SITE I, BINDING SITE II or BINDING SITE III of FIG. 8. Table 4 illustrates the complementarity of the nucleotide sequences of LOC340037 BINDING SITE, designated SEQ ID:12244, to the nucleotide sequence of GAM281 RNA, herein designated GAM RNA, also designated SEQ ID:278.

Another function of GAM281 is therefore inhibition of LOC340037 (Accession XP_295137.1). Accordingly, utilities of GAM281 include diagnosis, prevention and treatment of diseases and clinical conditions associated with LOC340037.

LOC340125 (Accession XP_291150.1) is another GAM281 target gene, herein designated TARGET GENE. LOC340125 BINDING SITE is a target binding site found in the 5' untranslated region of mRNA encoded by LOC340125, corresponding to a target binding site such as BINDING SITE I, BINDING SITE II or BINDING SITE III of FIG. 8. Table 4 illustrates the complementarity of the nucleotide sequences of LOC340125 BINDING SITE, designated SEQ ID:12803, to the nucleotide sequence of GAM281 RNA, herein designated GAM RNA, also designated SEQ ID:278.

Another function of GAM281 is therefore inhibition of LOC340125 (Accession XP_291150.1). Accordingly, utilities of GAM281 include diagnosis, prevention and treatment of diseases and clinical conditions associated with LOC340125.

LOC340133 (Accession XP_291151.1) is another GAM281 target gene, herein designated TARGET GENE. LOC340133 BINDING SITE is a target binding site found in the 3' untranslated region of mRNA encoded by LOC340133, corresponding to a target binding site such as BINDING SITE I, BINDING SITE II or BINDING SITE III of FIG. 8. Table 4 illustrates the complementarity of the nucleotide sequences of LOC340133 BINDING SITE, designated SEQ ID:10105, to the nucleotide sequence of GAM281 RNA, herein designated GAM RNA, also designated SEQ ID:278.

Another function of GAM281 is therefore inhibition of LOC340133 (Accession XP_291151.1). Accordingly, utilities of GAM281 include diagnosis, prevention and treatment of diseases and clinical conditions associated with LOC340133.

LOC340138 (Accession XP_291153.1) is another GAM281 target gene, herein designated TARGET GENE. LOC340138 BINDING SITE is a target binding site found in the 3' untranslated region of mRNA encoded by LOC340138, corresponding to a target binding site such as BINDING SITE I, BINDING SITE II or BINDING SITE III of FIG. 8. Table 4 illustrates the complementarity of the nucleotide sequences of LOC340138 BINDING SITE, designated SEQ ID:11753, to the nucleotide sequence of GAM281 RNA, herein designated GAM RNA, also designated SEQ ID:278.

Another function of GAM281 is therefore inhibition of LOC340138 (Accession XP_291153.1). Accordingly, utilities of GAM281 include diagnosis, prevention and treatment of diseases and clinical conditions associated with LOC340138.

LOC340156 (Accession XP_291158.1) is another GAM281 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:10096, to the nucleotide sequence of GAM281 RNA, herein designated GAM RNA, also designated SEQ ID:278.

Another function of GAM281 is therefore inhibition of LOC340156 (Accession XP_291158.1). Accordingly, utilities of GAM281 include diagnosis, prevention and treatment of diseases and clinical conditions associated with LOC340156.

LOC340227 (Accession XP_291203.1) is another GAM281 target gene, herein designated TARGET GENE. LOC340227 BINDING SITE is a target binding site found in the 5' untranslated region of mRNA encoded by LOC340227, corresponding to a target binding site such as BINDING SITE I, BINDING SITE II or BINDING SITE III of FIG. 8. Table 4 illustrates the complementarity of the nucleotide sequences of LOC340227 BINDING SITE, designated SEQ ID:12803, to the nucleotide sequence of GAM281 RNA, herein designated GAM RNA, also designated SEQ ID:278.

Another function of GAM281 is therefore inhibition of LOC340227 (Accession XP_291203.1). Accordingly, utilities of GAM281 include diagnosis, prevention and treatment of diseases and clinical conditions associated with LOC340227.

LOC340238 (Accession XP_295188.1) is another GAM281 target gene, herein designated TARGET GENE. LOC340238 BINDING SITE is a target binding site found in the 5' untranslated region of mRNA encoded by LOC340238, corresponding to a target binding site such as BINDING SITE I, BINDING SITE II or BINDING SITE III of FIG. 8. Table 4 illustrates the complementarity of the nucleotide sequences of LOC340238 BINDING SITE, designated SEQ ID:2179, to the nucleotide sequence of GAM281 RNA, herein designated GAM RNA, also designated SEQ ID:278.

Another function of GAM281 is therefore inhibition of LOC340238 (Accession XP_295188.1). Accordingly, utilities of GAM281 include diagnosis, prevention and treatment of diseases and clinical conditions associated with LOC340238.

LOC340249 (Accession XP_291211.1) is another GAM281 target gene, herein designated TARGET GENE. LOC340249 BINDING SITE is a target binding site found in the 3' untranslated region of mRNA encoded by LOC340249, corresponding to a target binding site such as BINDING SITE I, BINDING SITE II or BINDING SITE III of FIG. 8. Table 4 illustrates the complementarity of the nucleotide sequences of LOC340249 BINDING SITE, designated SEQ ID:7647, to the nucleotide sequence of GAM281 RNA, herein designated GAM RNA, also designated SEQ ID:278.

Another function of GAM281 is therefore inhibition of LOC340249 (Accession XP_291211.1). Accordingly, utilities of GAM281 include diagnosis, prevention and treatment of diseases and clinical conditions associated with LOC340249.

LOC340259 (Accession XP_295190.1) is another GAM281 target gene, herein designated TARGET GENE. LOC340259 BINDING SITE1 and LOC340259 BINDING SITE2 are target binding sites found in untranslated regions of mRNA encoded by LOC340259, corresponding to target binding sites such as BINDING SITE I, BINDING SITE II or BINDING SITE III of FIG. 8. Table 4 illustrates the complementarity of the nucleotide sequences of LOC340259 BINDING SITE1 and LOC340259 BINDING SITE2, designated SEQ ID:18147 and SEQ ID:11519 respectively, to the nucleotide sequence of GAM281 RNA, herein designated GAM RNA, also designated SEQ ID:278.

Another function of GAM281 is therefore inhibition of LOC340259 (Accession XP_295190.1). Accordingly, utilities of GAM281 include diagnosis, prevention and treatment of diseases and clinical conditions associated with LOC340259.

LOC340290 (Accession XP_291214.1) is another GAM281 target gene, herein designated TARGET GENE. LOC340290 BINDING SITE is a target binding site found in the 5' untranslated region of mRNA encoded by LOC340290, corresponding to a target binding site such as BINDING SITE I, BINDING SITE II or BINDING SITE III of FIG. 8. Table 4 illustrates the complementarity of the nucleotide sequences of LOC340290 BINDING SITE, designated SEQ ID:15740, to the nucleotide sequence of GAM281 RNA, herein designated GAM RNA, also designated SEQ ID:278.

Another function of GAM281 is therefore inhibition of LOC340290 (Accession XP_291214.1). Accordingly, utilities of GAM281 include diagnosis, prevention and treatment of diseases and clinical conditions associated with LOC340290.

LOC340390 (Accession XP_291269.1) is another GAM281 target gene, herein designated TARGET GENE. LOC340390 BINDING SITE is a target binding site found in the 3' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:18868, to the nucleotide sequence of GAM281 RNA, herein designated GAM RNA, also designated SEQ ID:278.

Another function of GAM281 is therefore inhibition of LOC340390 (Accession XP_291269.1). Accordingly, utilities of GAM281 include diagnosis, prevention and treatment of diseases and clinical conditions associated with LOC340390.

LOC340408 (Accession XP_291274.1) is another GAM281 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:1309, to the nucleotide sequence of GAM281 RNA, herein designated GAM RNA, also designated SEQ ID:278.

Another function of GAM281 is therefore inhibition of LOC340408 (Accession XP_291274.1). Accordingly, utilities of GAM281 include diagnosis, prevention and treatment of diseases and clinical conditions associated with LOC340408.

LOC340414 (Accession XP_295240.1) is another GAM281 target gene, herein designated TARGET GENE. LOC340414 BINDING SITE is a target binding site found in the 3' untranslated region of mRNA encoded by LOC340414, corresponding to a target binding site such as BINDING SITE I, BINDING SITE II or BINDING SITE III of FIG. 8. Table 4 illustrates the complementarity of the nucleotide sequences of LOC340414 BINDING SITE, designated SEQ ID:1744, to the nucleotide sequence of GAM281 RNA, herein designated GAM RNA, also designated SEQ ID:278.

Another function of GAM281 is therefore inhibition of LOC340414 (Accession XP_295240.1). Accordingly, utilities of GAM281 include diagnosis, prevention and treatment of diseases and clinical conditions associated with LOC340414.

LOC340450 (Accession XP_295252.1) is another GAM281 target gene, herein designated TARGET GENE. LOC340450 BINDING SITE is a target binding site found in the 5' untranslated region of mRNA encoded by LOC340450, corresponding to a target binding site such as BINDING SITE I, BINDING SITE II or BINDING SITE III of FIG. 8. Table 4 illustrates the complementarity of the nucleotide sequences of LOC340450 BINDING SITE, designated SEQ ID:1744, to the nucleotide sequence of GAM281 RNA, herein designated GAM RNA, also designated SEQ ID:278.

Another function of GAM281 is therefore inhibition of LOC340450 (Accession XP_295252.1). Accordingly, utilities of GAM281 include diagnosis, prevention and treatment of diseases and clinical conditions associated with LOC340450.

LOC340815 (Accession XP_295776.1) is another GAM281 target gene, herein designated TARGET GENE. LOC340815 BINDING SITE is a target binding site found in the 5' untranslated region of mRNA encoded by LOC340815, corresponding to a target binding site such as BINDING SITE I, BINDING SITE II or BINDING SITE III of FIG. 8. Table 4 illustrates the complementarity of the nucleotide sequences of LOC340815 BINDING SITE, designated SEQ ID:6038, to the nucleotide sequence of GAM281 RNA, herein designated GAM RNA, also designated SEQ ID:278.

Another function of GAM281 is therefore inhibition of LOC340815 (Accession XP_295776.1). Accordingly, utilities of GAM281 include diagnosis, prevention and treatment of diseases and clinical conditions associated with LOC340815.

LOC342663 (Accession XP_297028.1) is another GAM281 target gene, herein designated TARGET GENE. LOC342663 BINDING SITE is a target binding site found in the 3' untranslated region of mRNA encoded by LOC342663, corresponding to a target binding site such as BINDING SITE I, BINDING SITE II or BINDING SITE III of FIG. 8. Table 4 illustrates the complementarity of the nucleotide sequences of LOC342663 BINDING SITE, designated SEQ ID:12875, to the nucleotide sequence of GAM281 RNA, herein designated GAM RNA, also designated SEQ ID:278.

Another function of GAM281 is therefore inhibition of LOC342663 (Accession XP_297028.1). Accordingly, utilities of GAM281 include diagnosis, prevention and treatment of diseases and clinical conditions associated with LOC342663.

LOC342926 (Accession XP_292790.2) is another GAM281 target gene, herein designated TARGET GENE. LOC342926 BINDING SITE is a target binding site found in the 3' untranslated region of mRNA encoded by LOC342926, corresponding to a target binding site such as BINDING SITE I, BINDING SITE II or BINDING SITE III of FIG. 8. Table 4 illustrates the complementarity of the nucleotide sequences of LOC342926 BINDING SITE, designated SEQ ID:13464, to the nucleotide sequence of GAM281 RNA, herein designated GAM RNA, also designated SEQ ID:278.

Another function of GAM281 is therefore inhibition of LOC342926 (Accession XP_292790.2). Accordingly, utilities of GAM281 include diagnosis, prevention and treatment of diseases and clinical conditions associated with LOC342926.

LOC345119 (Accession XP_298539.1) is another GAM281 target gene, herein designated TARGET GENE. LOC345119 BINDING SITE is a target binding site found in the 3' untranslated region of mRNA encoded by LOC345119, corresponding to a target binding site such as BINDING SITE I, BINDING SITE II or BINDING SITE III of FIG. 8. Table 4 illustrates the complementarity of the nucleotide sequences of LOC345119 BINDING SITE, designated SEQ ID:17910, to the nucleotide sequence of GAM281 RNA, herein designated GAM RNA, also designated SEQ ID:278.

Another function of GAM281 is therefore inhibition of LOC345119 (Accession XP_298539.1). Accordingly, utilities of GAM281 include diagnosis, prevention and treatment of diseases and clinical conditions associated with LOC345119.

LOC345275 (Accession NP_835236.1) is another GAM281 target gene, herein designated TARGET GENE. LOC345275 BINDING SITE is a target binding site found in the 3' untranslated region of multiple transcripts of mRNA encoded by LOC345275, corresponding to a target binding site such as BINDING SITE I, BINDING SITE II or BINDING SITE III of FIG. 8. Table 4 illustrates the complementarity of the nucleotide sequences of LOC345275 BINDING SITE, designated SEQ ID:523, to the nucleotide sequence of GAM281 RNA, herein designated GAM RNA, also designated SEQ ID:278.

Another function of GAM281 is therefore inhibition of LOC345275 (Accession NP_835236.1). Accordingly, utilities of GAM281 include diagnosis, prevention and treatment of diseases and clinical conditions associated with LOC345275.

LOC345878 (Accession XP_293993.2) is another GAM281 target gene, herein designated TARGET GENE. LOC345878 BINDING SITE is a target binding site found in the 5' untranslated region of mRNA encoded by LOC345878, corresponding to a target binding site such as BINDING SITE I, BINDING SITE II or BINDING SITE III of FIG. 8. Table 4 illustrates the complementarity of the nucleotide sequences of LOC345878 BINDING SITE, designated SEQ ID:12611, to the nucleotide sequence of GAM281 RNA, herein designated GAM RNA, also designated SEQ ID:278.

Another function of GAM281 is therefore inhibition of LOC345878 (Accession XP_293993.2). Accordingly, utilities of GAM281 include diagnosis, prevention and treatment of diseases and clinical conditions associated with LOC345878.

LOC346546 (Accession XP_294264.2) is another GAM281 target gene, herein designated TARGET GENE. LOC346546 BINDING SITE is a target binding site found in the 5' untranslated region of mRNA encoded by LOC346546, corresponding to a target binding site such as BINDING SITE I, BINDING SITE II or BINDING SITE III of FIG. 8. Table 4 illustrates the complementarity of the nucleotide sequences of LOC346546 BINDING SITE, designated SEQ ID:18735, to the nucleotide sequence of GAM281 RNA, herein designated GAM RNA, also designated SEQ ID:278.

Another function of GAM281 is therefore inhibition of LOC346546 (Accession XP_294264.2). Accordingly, utilities of GAM281 include diagnosis, prevention and treatment of diseases and clinical conditions associated with LOC346546.

LOC346653 (Accession XP_294357.2) is another GAM281 target gene, herein designated TARGET GENE. LOC346653 BINDING SITE is a target binding site found in the 3' untranslated region of mRNA encoded by LOC346653, corresponding to a target binding site such as BINDING SITE I, BINDING SITE II or BINDING SITE III of FIG. 8. Table 4 illustrates the complementarity of the nucleotide sequences of LOC346653 BINDING SITE, designated SEQ ID:17927, to the nucleotide sequence of GAM281 RNA, herein designated GAM RNA, also designated SEQ ID:278.

Another function of GAM281 is therefore inhibition of LOC346653 (Accession XP_294357.2). Accordingly, utilities of GAM281 include diagnosis, prevention and treatment of diseases and clinical conditions associated with LOC346653.

LOC347648 (Accession XP_300226.1) is another GAM281 target gene, herein designated TARGET GENE. LOC347648 BINDING SITE1 and LOC347648 BINDING SITE2 are target binding sites found in untranslated regions of mRNA encoded by LOC347648, corresponding to target binding sites such as BINDING SITE I, BINDING SITE II or BINDING SITE III of FIG. 8. Table 4 illustrates the complementarity of the nucleotide sequences of LOC347648 BINDING SITE1 and LOC347648 BINDING SITE2, designated SEQ ID:19153 and SEQ ID:9837 respectively, to the nucleotide sequence of GAM281 RNA, herein designated GAM RNA, also designated SEQ ID:278.

Another function of GAM281 is therefore inhibition of LOC347648 (Accession XP_300226.1). Accordingly, utilities of GAM281 include diagnosis, prevention and treatment of diseases and clinical conditions associated with LOC347648.

LOC347918 (Accession XP_300565.1) is another GAM281 target gene, herein designated TARGET GENE. LOC347918 BINDING SITE is a target binding site found in the 5' untranslated region of mRNA encoded by LOC347918, corresponding to a target binding site such as BINDING SITE I, BINDING SITE II or BINDING SITE III of FIG. 8. Table 4 illustrates the complementarity of the nucleotide sequences of LOC347918 BINDING SITE, designated SEQ ID:17689, to the nucleotide sequence of GAM281 RNA, herein designated GAM RNA, also designated SEQ ID:278.

Another function of GAM281 is therefore inhibition of LOC347918 (Accession XP_300565.1). Accordingly, utilities of GAM281 include diagnosis, prevention and treatment of diseases and clinical conditions associated with LOC347918.

LOC348071 (Accession XP_300620.1) is another GAM281 target gene, herein designated TARGET GENE. LOC348071 BINDING SITE is a target binding site found in the 3' untranslated region of mRNA encoded by LOC348071, corresponding to a target binding site such as BINDING SITE I, BINDING SITE II or BINDING SITE III of FIG. 8. Table 4 illustrates the complementarity of the nucleotide sequences of LOC348071 BINDING SITE, designated SEQ ID:5985, to the nucleotide sequence of GAM281 RNA, herein designated GAM RNA, also designated SEQ ID:278.

Another function of GAM281 is therefore inhibition of LOC348071 (Accession XP_300620.1). Accordingly, utilities of GAM281 include diagnosis, prevention and treatment of diseases and clinical conditions associated with LOC348071.

LOC348075 (Accession XP_302653.1) is another GAM281 target gene, herein designated TARGET GENE. LOC348075 BINDING SITE1 and LOC348075 BINDING SITE2 are target binding sites found in untranslated regions of mRNA encoded by LOC348075, corresponding to target binding sites such as BINDING SITE I, BINDING SITE II or BINDING SITE III of FIG. 8. Table 4 illustrates the complementarity of the nucleotide sequences of LOC348075 BINDING SITE1 and LOC348075 BINDING SITE2, designated SEQ ID:14381 and SEQ ID:13716 respectively, to the nucleotide sequence of GAM281 RNA, herein designated GAM RNA, also designated SEQ ID:278.

Another function of GAM281 is therefore inhibition of LOC348075 (Accession XP_302653.1). Accordingly, utilities of GAM281 include diagnosis, prevention and treatment of diseases and clinical conditions associated with LOC348075.

LOC348094 (Accession XP_300615.1) is another GAM281 target gene, herein designated TARGET GENE. LOC348094 BINDING SITE is a target binding site found in the 5' untranslated region of mRNA encoded by LOC348094, corresponding to a target binding site such as BINDING SITE I, BINDING SITE II or BINDING SITE III of FIG. 8. Table 4 illustrates the complementarity of the nucleotide sequences of LOC348094 BINDING SITE, designated SEQ ID:16473, to the nucleotide sequence of GAM281 RNA, herein designated GAM RNA, also designated SEQ ID:278.

Another function of GAM281 is therefore inhibition of LOC348094 (Accession XP_300615.1). Accordingly, utilities of GAM281 include diagnosis, prevention and treatment of diseases and clinical conditions associated with LOC348094.

LOC348113 (Accession XP_300623.1) is another GAM281 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:12479, to the nucleotide sequence of GAM281 RNA, herein designated GAM RNA, also designated SEQ ID:278.

Another function of GAM281 is therefore inhibition of LOC348113 (Accession XP_300623.1). Accordingly, utilities of GAM281 include diagnosis, prevention and treatment of diseases and clinical conditions associated with LOC348113.

LOC348115 (Accession XP_300626.1) is another GAM281 target gene, herein designated TARGET GENE. LOC348115 BINDING SITE is a target binding site found in the 5' untranslated region of mRNA encoded by LOC348115, corresponding to a target binding site such as BINDING SITE I, BINDING SITE II or BINDING SITE III of FIG. 8. Table 4 illustrates the complementarity of the nucleotide sequences of LOC348115 BINDING SITE, designated SEQ ID:13705, to the nucleotide sequence of GAM281 RNA, herein designated GAM RNA, also designated SEQ ID:278.

Another function of GAM281 is therefore inhibition of LOC348115 (Accession XP_300626.1). Accordingly, utilities of GAM281 include diagnosis, prevention and treatment of diseases and clinical conditions associated with LOC348115.

LOC348125 (Accession XP_302665.1) is another GAM281 target gene, herein designated TARGET GENE. LOC348125 BINDING SITE is a target binding site found in the 5' untranslated region of mRNA encoded by LOC348125, corresponding to a target binding site such as BINDING SITE I, BINDING SITE II or BINDING SITE III of FIG. 8. Table 4 illustrates the complementarity of the nucleotide sequences of LOC348125 BINDING SITE, designated SEQ ID:4673, to the nucleotide sequence of GAM281 RNA, herein designated GAM RNA, also designated SEQ ID:278.

Another function of GAM281 is therefore inhibition of LOC348125 (Accession XP_302665.1). Accordingly, utilities of GAM281 include diagnosis, prevention and treatment of diseases and clinical conditions associated with LOC348125.

LOC348137 (Accession XP_300635.1) is another GAM281 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:12479, to the nucleotide sequence of GAM281 RNA, herein designated GAM RNA, also designated SEQ ID:278.

Another function of GAM281 is therefore inhibition of LOC348137 (Accession XP_300635.1). Accordingly, utilities of GAM281 include diagnosis, prevention and treatment of diseases and clinical conditions associated with LOC348137.

LOC348142 (Accession XP_300636.1) is another GAM281 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:12479, to the nucleotide sequence of GAM281 RNA, herein designated GAM RNA, also designated SEQ ID:278.

Another function of GAM281 is therefore inhibition of LOC348142 (Accession XP_300636.1). Accordingly, utilities of GAM281 include diagnosis, prevention and treatment of diseases and clinical conditions associated with LOC348142.

LOC348212 (Accession XP_302685.1) is another GAM281 target gene, herein designated TARGET GENE. LOC348212 BINDING SITE is a target binding site found in the 5' untranslated region of mRNA encoded by LOC348212, corresponding to a target binding site such as BINDING SITE I, BINDING SITE II or BINDING SITE III of FIG. 8. Table 4 illustrates the complementarity of the nucleotide sequences of LOC348212 BINDING SITE, designated SEQ ID:15020, to the nucleotide sequence of GAM281 RNA, herein designated GAM RNA, also designated SEQ ID:278.

Another function of GAM281 is therefore inhibition of LOC348212 (Accession XP_302685.1). Accordingly, utilities of GAM281 include diagnosis, prevention and treatment of diseases and clinical conditions associated with LOC348212.

LOC348235 (Accession XP_300670.1) is another GAM281 target gene, herein designated TARGET GENE. LOC348235 BINDING SITE is a target binding site found in the 3' untranslated region of mRNA encoded by LOC348235, corresponding to a target binding site such as BINDING SITE I, BINDING SITE II or BINDING SITE III of FIG. 8. Table 4 illustrates the complementarity of the nucleotide sequences of LOC348235 BINDING SITE, designated SEQ ID:15852, to the nucleotide sequence of GAM281 RNA, herein designated GAM RNA, also designated SEQ ID:278.

Another function of GAM281 is therefore inhibition of LOC348235 (Accession XP_300670.1). Accordingly, utilities of GAM281 include diagnosis, prevention and treatment of diseases and clinical conditions associated with LOC348235.

LOC348261 (Accession XP_302704.1) is another GAM281 target gene, herein designated TARGET GENE. LOC348261 BINDING SITE is a target binding site found in the 3' untranslated region of mRNA encoded by LOC348261, corresponding to a target binding site such as BINDING SITE I, BINDING SITE II or BINDING SITE III of FIG. 8. Table 4 illustrates the complementarity of the nucleotide sequences of LOC348261 BINDING SITE, designated SEQ ID:10989, to the nucleotide sequence of GAM281 RNA, herein designated GAM RNA, also designated SEQ ID:278.

Another function of GAM281 is therefore inhibition of LOC348261 (Accession XP_302704.1). Accordingly, utilities of GAM281 include diagnosis, prevention and treatment of diseases and clinical conditions associated with LOC348261.

LOC348262 (Accession XP_300683.1) is another GAM281 target gene, herein designated TARGET GENE. LOC348262 BINDING SITE is a target binding site found in the 5' untranslated region of mRNA encoded by LOC348262, corresponding to a target binding site such as BINDING SITE I, BINDING SITE II or BINDING SITE III of FIG. 8. Table 4 illustrates the complementarity of the nucleotide sequences of LOC348262 BINDING SITE, designated SEQ ID:7306, to the nucleotide sequence of GAM281 RNA, herein designated GAM RNA, also designated SEQ ID:278.

Another function of GAM281 is therefore inhibition of LOC348262 (Accession XP_300683.1). Accordingly, utilities of GAM281 include diagnosis, prevention and treatment of diseases and clinical conditions associated with LOC348262.

LOC348314 (Accession XP_302716.1) is another GAM281 target gene, herein designated TARGET GENE. LOC348314 BINDING SITE is a target binding site found in the 5' untranslated region of mRNA encoded by LOC348314, corresponding to a target binding site such as BINDING SITE I, BINDING SITE II or BINDING SITE III of FIG. 8. Table 4 illustrates the complementarity of the nucleotide sequences of LOC348314 BINDING SITE, designated SEQ ID:16669, to the nucleotide sequence of GAM281 RNA, herein designated GAM RNA, also designated SEQ ID:278.

Another function of GAM281 is therefore inhibition of LOC348314 (Accession XP_302716.1). Accordingly, utilities of GAM281 include diagnosis, prevention and treatment of diseases and clinical conditions associated with LOC348314.

LOC348326 (Accession XP_300696.1) is another GAM281 target gene, herein designated TARGET GENE. LOC348326 BINDING SITE is a target binding site found in the 3' untranslated region of mRNA encoded by LOC348326, corresponding to a target binding site such as BINDING SITE I, BINDING SITE II or BINDING SITE III of FIG. 8. Table 4 illustrates the complementarity of the nucleotide sequences of LOC348326 BINDING SITE, designated SEQ ID:19778, to the nucleotide sequence of GAM281 RNA, herein designated GAM RNA, also designated SEQ ID:278.

Another function of GAM281 is therefore inhibition of LOC348326 (Accession XP_300696.1). Accordingly, utilities of GAM281 include diagnosis, prevention and treatment of diseases and clinical conditions associated with LOC348326.

LOC348327 (Accession XP_030209.2) is another GAM281 target gene, herein designated TARGET GENE. LOC348327 BINDING SITE is a target binding site found in the 3' untranslated region of mRNA encoded by LOC348327, corresponding to a target binding site such as BINDING SITE I, BINDING SITE II or BINDING SITE III of FIG. 8. Table 4 illustrates the complementarity of the nucleotide sequences of LOC348327 BINDING SITE, designated SEQ ID:8820, to the nucleotide sequence of GAM281 RNA, herein designated GAM RNA, also designated SEQ ID:278.

Another function of GAM281 is therefore inhibition of LOC348327 (Accession XP_030209.2). Accordingly, utilities of GAM281 include diagnosis, prevention and treatment of diseases and clinical conditions associated with LOC348327.

LOC348369 (Accession XP_302732.1) is another GAM281 target gene, herein designated TARGET GENE. LOC348369 BINDING SITE is a target binding site found in the 3' untranslated region of mRNA encoded by LOC348369, corresponding to a target binding site such as BINDING SITE I, BINDING SITE II or BINDING SITE III of FIG. 8. Table 4 illustrates the complementarity of the nucleotide sequences of LOC348369 BINDING SITE, designated SEQ ID:2235, to the nucleotide sequence of GAM281 RNA, herein designated GAM RNA, also designated SEQ ID:278.

Another function of GAM281 is therefore inhibition of LOC348369 (Accession XP_302732.1). Accordingly, utilities of GAM281 include diagnosis, prevention and treatment of diseases and clinical conditions associated with LOC348369.

LOC348393 (Accession XP_302741.1) is another GAM281 target gene, herein designated TARGET GENE. LOC348393 BINDING SITE1 and LOC348393 BINDING SITE2 are target binding sites found in untranslated regions of mRNA encoded by LOC348393, corresponding to target binding sites such as BINDING SITE I, BINDING SITE II or BINDING SITE III of FIG. 8. Table 4 illustrates the complementarity of the nucleotide sequences of LOC348393 BINDING SITE1 and LOC348393 BINDING SITE2, designated SEQ ID:11192 and SEQ ID:872 respectively, to the nucleotide sequence of GAM281 RNA, herein designated GAM RNA, also designated SEQ ID:278.

Another function of GAM281 is therefore inhibition of LOC348393 (Accession XP_302741.1). Accordingly, utilities of GAM281 include diagnosis, prevention and treatment of diseases and clinical conditions associated with LOC348393.

LOC348396 (Accession XP_300729.1) is another GAM281 target gene, herein designated TARGET GENE. LOC348396 BINDING SITE1 through LOC348396 BINDING SITE4 are target binding sites found in untranslated regions of mRNA encoded by LOC348396, corresponding to target binding sites such as BINDING SITE I, BINDING SITE II or BINDING SITE III of FIG. 8. Table 4 illustrates the complementarity of the nucleotide sequences of LOC348396 BINDING SITE1 through LOC348396 BINDING SITE4, designated SEQ ID:1569, SEQ ID:9545, SEQ ID:10270 and SEQ ID:4081 respectively, to the nucleotide sequence of GAM281 RNA, herein designated GAM RNA, also designated SEQ ID:278.

Another function of GAM281 is therefore inhibition of LOC348396 (Accession XP_300729.1). Accordingly, utilities of GAM281 include diagnosis, prevention and treatment of diseases and clinical conditions associated with LOC348396.

LOC348402 (Accession XP_300730.1) is another GAM281 target gene, herein designated TARGET GENE. LOC348402 BINDING SITE1 and LOC348402 BINDING SITE2 are target binding sites found in untranslated regions of mRNA encoded by LOC348402, corresponding to target binding sites such as BINDING SITE I, BINDING SITE II or BINDING SITE III of FIG. 8. Table 4 illustrates the complementarity of the nucleotide sequences of LOC348402 BINDING SITE1 and LOC348402 BINDING SITE2, designated SEQ ID:8590 and SEQ ID:7386 respectively, to the nucleotide sequence of GAM281 RNA, herein designated GAM RNA, also designated SEQ ID:278.

Another function of GAM281 is therefore inhibition of LOC348402 (Accession XP_300730.1). Accordingly, utilities of GAM281 include diagnosis, prevention and treatment of diseases and clinical conditions associated with LOC348402.

LOC348445 (Accession XP_300738.1) is another GAM281 target gene, herein designated TARGET GENE. LOC348445 BINDING SITE is a target binding site found in the 3' untranslated region of mRNA encoded by LOC348445, corresponding to a target binding site such as BINDING SITE I, BINDING SITE II or BINDING SITE III of FIG. 8. Table 4 illustrates the complementarity of the nucleotide sequences of LOC348445 BINDING SITE, designated SEQ ID:19778, to the nucleotide sequence of GAM281 RNA, herein designated GAM RNA, also designated SEQ ID:278.

Another function of GAM281 is therefore inhibition of LOC348445 (Accession XP_300738.1). Accordingly, utilities of GAM281 include diagnosis, prevention and treatment of diseases and clinical conditions associated with LOC348445.

LOC348455 (Accession XP_302760.1) is another GAM281 target gene, herein designated TARGET GENE. LOC348455 BINDING SITE is a target binding site found in the 3' untranslated region of mRNA encoded by LOC348455, corresponding to a target binding site such as BINDING SITE I, BINDING SITE II or BINDING SITE III of FIG. 8. Table 4 illustrates the complementarity of the nucleotide sequences of LOC348455 BINDING SITE, designated SEQ ID:15049, to the nucleotide sequence of GAM281 RNA, herein designated GAM RNA, also designated SEQ ID:278.

Another function of GAM281 is therefore inhibition of LOC348455 (Accession XP_302760.1). Accordingly, utilities of GAM281 include diagnosis, prevention and treatment of diseases and clinical conditions associated with LOC348455.

LOC348460 (Accession XP_300743.1) is another GAM281 target gene, herein designated TARGET GENE.

LOC348460 BINDING SITE1 and LOC348460 BINDING SITE2 are target binding sites found in untranslated regions of mRNA encoded by LOC348460, corresponding to target binding sites such as BINDING SITE I, BINDING SITE II or BINDING SITE III of FIG. 8. Table 4 illustrates the complementarity of the nucleotide sequences of LOC348460 BINDING SITE1 and LOC348460 BINDING SITE2, designated SEQ ID:13465 and SEQ ID:4143 respectively, to the nucleotide sequence of GAM281 RNA, herein designated GAM RNA, also designated SEQ ID:278.

Another function of GAM281 is therefore inhibition of LOC348460 (Accession XP_300743.1). Accordingly, utilities of GAM281 include diagnosis, prevention and treatment of diseases and clinical conditions associated with LOC348460.

LOC348474 (Accession XP_209299.2) is another GAM281 target gene, herein designated TARGET GENE. LOC348474 BINDING SITE is a target binding site found in the 3' untranslated region of mRNA encoded by LOC348474, corresponding to a target binding site such as BINDING SITE I, BINDING SITE II or BINDING SITE III of FIG. 8. Table 4 illustrates the complementarity of the nucleotide sequences of LOC348474 BINDING SITE, designated SEQ ID:17206, to the nucleotide sequence of GAM281 RNA, herein designated GAM RNA, also designated SEQ ID:278.

Another function of GAM281 is therefore inhibition of LOC348474 (Accession XP_209299.2). Accordingly, utilities of GAM281 include diagnosis, prevention and treatment of diseases and clinical conditions associated with LOC348474.

LOC348494 (Accession XP_302789.1) is another GAM281 target gene, herein designated TARGET GENE. LOC348494 BINDING SITE is a target binding site found in the 5' untranslated region of mRNA encoded by LOC348494, corresponding to a target binding site such as BINDING SITE I, BINDING SITE II or BINDING SITE III of FIG. 8. Table 4 illustrates the complementarity of the nucleotide sequences of LOC348494 BINDING SITE, designated SEQ ID:6119, to the nucleotide sequence of GAM281 RNA, herein designated GAM RNA, also designated SEQ ID:278.

Another function of GAM281 is therefore inhibition of LOC348494 (Accession XP_302789.1). Accordingly, utilities of GAM281 include diagnosis, prevention and treatment of diseases and clinical conditions associated with LOC348494.

LOC348499 (Accession XP_302799.1) is another GAM281 target gene, herein designated TARGET GENE. LOC348499 BINDING SITE is a target binding site found in the 3' untranslated region of mRNA encoded by LOC348499, corresponding to a target binding site such as BINDING SITE I, BINDING SITE II or BINDING SITE III of FIG. 8. Table 4 illustrates the complementarity of the nucleotide sequences of LOC348499 BINDING SITE, designated SEQ ID:2771, to the nucleotide sequence of GAM281 RNA, herein designated GAM RNA, also designated SEQ ID:278.

Another function of GAM281 is therefore inhibition of LOC348499 (Accession XP_302799.1). Accordingly, utilities of GAM281 include diagnosis, prevention and treatment of diseases and clinical conditions associated with LOC348499.

LOC348503 (Accession XP_300762.1) is another GAM281 target gene, herein designated TARGET GENE. LOC348503 BINDING SITE is a target binding site found in the 3' untranslated region of mRNA encoded by LOC348503, corresponding to a target binding site such as BINDING SITE I, BINDING SITE II or BINDING SITE III of FIG. 8. Table 4 illustrates the complementarity of the nucleotide sequences of LOC348503 BINDING SITE, designated SEQ ID:19361, to the nucleotide sequence of GAM281 RNA, herein designated GAM RNA, also designated SEQ ID:278.

Another function of GAM281 is therefore inhibition of LOC348503 (Accession XP_300762.1). Accordingly, utilities of GAM281 include diagnosis, prevention and treatment of diseases and clinical conditions associated with LOC348503.

LOC348508 (Accession XP_302806.1) is another GAM281 target gene, herein designated TARGET GENE. LOC348508 BINDING SITE is a target binding site found in the 5' untranslated region of mRNA encoded by LOC348508, corresponding to a target binding site such as BINDING SITE I, BINDING SITE II or BINDING SITE III of FIG. 8. Table 4 illustrates the complementarity of the nucleotide sequences of LOC348508 BINDING SITE, designated SEQ ID:12803, to the nucleotide sequence of GAM281 RNA, herein designated GAM RNA, also designated SEQ ID:278.

Another function of GAM281 is therefore inhibition of LOC348508 (Accession XP_302806.1). Accordingly, utilities of GAM281 include diagnosis, prevention and treatment of diseases and clinical conditions associated with LOC348508.

LOC348525 (Accession XP_300778.1) is another GAM281 target gene, herein designated TARGET GENE. LOC348525 BINDING SITE is a target binding site found in the 3' untranslated region of mRNA encoded by LOC348525, corresponding to a target binding site such as BINDING SITE I, BINDING SITE II or BINDING SITE III of FIG. 8. Table 4 illustrates the complementarity of the nucleotide sequences of LOC348525 BINDING SITE, designated SEQ ID:5488, to the nucleotide sequence of GAM281 RNA, herein designated GAM RNA, also designated SEQ ID:278.

Another function of GAM281 is therefore inhibition of LOC348525 (Accession XP_300778.1). Accordingly, utilities of GAM281 include diagnosis, prevention and treatment of diseases and clinical conditions associated with LOC348525.

LOC348532 (Accession XP_302818.1) is another GAM281 target gene, herein designated TARGET GENE. LOC348532 BINDING SITE1 and LOC348532 BINDING SITE2 are target binding sites found in untranslated regions of mRNA encoded by LOC348532, corresponding to target binding sites such as BINDING SITE I, BINDING SITE II or BINDING SITE III of FIG. 8. Table 4 illustrates the complementarity of the nucleotide sequences of LOC348532 BINDING SITE1 and LOC348532 BINDING SITE2, designated SEQ ID:872 and SEQ ID:11192 respectively, to the nucleotide sequence of GAM281 RNA, herein designated GAM RNA, also designated SEQ ID:278.

Another function of GAM281 is therefore inhibition of LOC348532 (Accession XP_302818.1). Accordingly, utilities of GAM281 include diagnosis, prevention and treatment of diseases and clinical conditions associated with LOC348532.

LOC348581 (Accession XP_302830.1) is another GAM281 target gene, herein designated TARGET GENE. LOC348581 BINDING SITE is a target binding site found in the 5' untranslated region of mRNA encoded by LOC348581, corresponding to a target binding site such as BINDING SITE I, BINDING SITE II or BINDING SITE III of FIG. 8. Table 4 illustrates the complementarity of the nucleotide sequences of LOC348581 BINDING SITE, designated SEQ ID:1998, to the nucleotide sequence of GAM281 RNA, herein designated GAM RNA, also designated SEQ ID:278.

Another function of GAM281 is therefore inhibition of LOC348581 (Accession XP_302830.1). Accordingly, utilities of GAM281 include diagnosis, prevention and treatment of diseases and clinical conditions associated with LOC348581.

LOC348699 (Accession XP_300816.1) is another GAM281 target gene, herein designated TARGET GENE. LOC348699 BINDING SITE is a target binding site found in the 5' untranslated region of mRNA encoded by LOC348699, corresponding to a target binding site such as BINDING SITE I, BINDING SITE II or BINDING SITE III of FIG. 8. Table 4 illustrates the complementarity of the nucleotide sequences of LOC348699 BINDING SITE, designated SEQ ID:10599, to the nucleotide sequence of GAM281 RNA, herein designated GAM RNA, also designated SEQ ID:278.

Another function of GAM281 is therefore inhibition of LOC348699 (Accession XP_300816.1). Accordingly, utilities of GAM281 include diagnosis, prevention and treatment of diseases and clinical conditions associated with LOC348699.

LOC348702 (Accession XP_300808.1) is another GAM281 target gene, herein designated TARGET GENE. LOC348702 BINDING SITE is a target binding site found in the 5' untranslated region of mRNA encoded by LOC348702, corresponding to a target binding site such as BINDING SITE I, BINDING SITE II or BINDING SITE III of FIG. 8. Table 4 illustrates the complementarity of the nucleotide sequences of LOC348702 BINDING SITE, designated SEQ ID:7387, to the nucleotide sequence of GAM281 RNA, herein designated GAM RNA, also designated SEQ ID:278.

Another function of GAM281 is therefore inhibition of LOC348702 (Accession XP_300808.1). Accordingly, utilities of GAM281 include diagnosis, prevention and treatment of diseases and clinical conditions associated with LOC348702.

LOC348738 (Accession XP_300826.1) is another GAM281 target gene, herein designated TARGET GENE. LOC348738 BINDING SITE is a target binding site found in the 3' untranslated region of mRNA encoded by LOC348738, corresponding to a target binding site such as BINDING SITE I, BINDING SITE II or BINDING SITE III of FIG. 8. Table 4 illustrates the complementarity of the nucleotide sequences of LOC348738 BINDING SITE, designated SEQ ID:2286, to the nucleotide sequence of GAM281 RNA, herein designated GAM RNA, also designated SEQ ID:278.

Another function of GAM281 is therefore inhibition of LOC348738 (Accession XP_300826.1). Accordingly, utilities of GAM281 include diagnosis, prevention and treatment of diseases and clinical conditions associated with LOC348738.

LOC348790 (Accession XP_300843.1) is another GAM281 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:810, to the nucleotide sequence of GAM281 RNA, herein designated GAM RNA, also designated SEQ ID:278.

Another function of GAM281 is therefore inhibition of LOC348790 (Accession XP_300843.1). Accordingly, utilities of GAM281 include diagnosis, prevention and treatment of diseases and clinical conditions associated with LOC348790.

LOC348797 (Accession XP_302888.1) is another GAM281 target gene, herein designated TARGET GENE. LOC348797 BINDING SITE is a target binding site found in the 3' untranslated region of mRNA encoded by LOC348797, corresponding to a target binding site such as BINDING SITE I, BINDING SITE II or BINDING SITE III of FIG. 8. Table 4 illustrates the complementarity of the nucleotide sequences of LOC348797 BINDING SITE, designated SEQ ID:7741, to the nucleotide sequence of GAM281 RNA, herein designated GAM RNA, also designated SEQ ID:278.

Another function of GAM281 is therefore inhibition of LOC348797 (Accession XP_302888.1). Accordingly, utilities of GAM281 include diagnosis, prevention and treatment of diseases and clinical conditions associated with LOC348797.

LOC348798 (Accession XP_300845.1) is another GAM281 target gene, herein designated TARGET GENE. LOC348798 BINDING SITE is a target binding site found in the 5' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:19402, to the nucleotide sequence of GAM281 RNA, herein designated GAM RNA, also designated SEQ ID:278.

Another function of GAM281 is therefore inhibition of LOC348798 (Accession XP_300845.1). Accordingly, utilities of GAM281 include diagnosis, prevention and treatment of diseases and clinical conditions associated with LOC348798.

LOC348825 (Accession XP_300853.1) is another GAM281 target gene, herein designated TARGET GENE. LOC348825 BINDING SITE1 and LOC348825 BINDING SITE2 are target binding sites found in untranslated regions of mRNA encoded by LOC348825, corresponding to target binding sites such as BINDING SITE I, BINDING SITE II or BINDING SITE III of FIG. 8. Table 4 illustrates the complementarity of the nucleotide sequences of LOC348825 BINDING SITE1 and LOC348825 BINDING SITE2, designated SEQ ID:15126 and SEQ ID:11688 respectively, to the nucleotide sequence of GAM281 RNA, herein designated GAM RNA, also designated SEQ ID:278.

Another function of GAM281 is therefore inhibition of LOC348825 (Accession XP_300853.1). Accordingly, utilities of GAM281 include diagnosis, prevention and treatment of diseases and clinical conditions associated with LOC348825.

LOC348842 (Accession XP_300861.1) is another GAM281 target gene, herein designated TARGET GENE. LOC348842 BINDING SITE is a target binding site found in the 5' untranslated region of mRNA encoded by LOC348842, corresponding to a target binding site such as BINDING SITE I, BINDING SITE II or BINDING SITE III of FIG. 8. Table 4 illustrates the complementarity of the nucleotide sequences of LOC348842 BINDING SITE, designated SEQ ID:12803, to the nucleotide sequence of GAM281 RNA, herein designated GAM RNA, also designated SEQ ID:278.

Another function of GAM281 is therefore inhibition of LOC348842 (Accession XP_300861.1). Accordingly, utilities of GAM281 include diagnosis, prevention and treatment of diseases and clinical conditions associated with LOC348842.

LOC348899 (Accession XP_302914.1) is another GAM281 target gene, herein designated TARGET GENE. LOC348899 BINDING SITE is a target binding site found in the 3' untranslated region of mRNA encoded by LOC348899, corresponding to a target binding site such as BINDING SITE I, BINDING SITE II or BINDING SITE III of FIG. 8. Table 4 illustrates the complementarity of the nucleotide sequences of LOC348899 BINDING SITE, designated SEQ ID:3454, to the nucleotide sequence of GAM281 RNA, herein designated GAM RNA, also designated SEQ ID:278.

Another function of GAM281 is therefore inhibition of LOC348899 (Accession XP_302914.1). Accordingly, utilities of GAM281 include diagnosis, prevention and treatment of diseases and clinical conditions associated with LOC348899.

LOC348928 (Accession XP_209688.1) is another GAM281 target gene, herein designated TARGET GENE. LOC348928 BINDING SITE is a target binding site found in the 3' untranslated region of mRNA encoded by LOC348928, corresponding to a target binding site such as BINDING SITE I, BINDING SITE II or BINDING SITE III of FIG. 8. Table 4 illustrates the complementarity of the nucleotide sequences of LOC348928 BINDING SITE, designated SEQ ID:1305, to the nucleotide sequence of GAM281 RNA, herein designated GAM RNA, also designated SEQ ID:278.

Another function of GAM281 is therefore inhibition of LOC348928 (Accession XP_209688.1). Accordingly, utilities of GAM281 include diagnosis, prevention and treatment of diseases and clinical conditions associated with LOC348928.

LOC348995 (Accession XP_300434.1) is another GAM281 target gene, herein designated TARGET GENE. LOC348995 BINDING SITE is a target binding site found in the 3' untranslated region of mRNA encoded by LOC348995, corresponding to a target binding site such as BINDING SITE I, BINDING SITE II or BINDING SITE III of FIG. 8. Table 4 illustrates the complementarity of the nucleotide sequences of LOC348995 BINDING SITE, designated SEQ ID:1900, to the nucleotide sequence of GAM281 RNA, herein designated GAM RNA, also designated SEQ ID:278.

Another function of GAM281 is therefore inhibition of LOC348995 (Accession XP_300434.1). Accordingly, utilities of GAM281 include diagnosis, prevention and treatment of diseases and clinical conditions associated with LOC348995.

LOC349024 (Accession XP_300250.1) is another GAM281 target gene, herein designated TARGET GENE. LOC349024 BINDING SITE1 and LOC349024 BINDING SITE2 are target binding sites found in untranslated regions of mRNA encoded by LOC349024, corresponding to target binding sites such as BINDING SITE I, BINDING SITE II or BINDING SITE III of FIG. 8. Table 4 illustrates the complementarity of the nucleotide sequences of LOC349024 BINDING SITE1 and LOC349024 BINDING SITE2, designated SEQ ID:1746 and SEQ ID:4617 respectively, to the nucleotide sequence of GAM281 RNA, herein designated GAM RNA, also designated SEQ ID:278.

Another function of GAM281 is therefore inhibition of LOC349024 (Accession XP_300250.1). Accordingly, utilities of GAM281 include diagnosis, prevention and treatment of diseases and clinical conditions associated with LOC349024.

LOC349075 (Accession XP_300932.1) is another GAM281 target gene, herein designated TARGET GENE. LOC349075 BINDING SITE is a target binding site found in the 3' untranslated region of mRNA encoded by LOC349075, corresponding to a target binding site such as BINDING SITE I, BINDING SITE II or BINDING SITE III of FIG. 8. Table 4 illustrates the complementarity of the nucleotide sequences of LOC349075 BINDING SITE, designated SEQ ID:16022, to the nucleotide sequence of GAM281 RNA, herein designated GAM RNA, also designated SEQ ID:278.

Another function of GAM281 is therefore inhibition of LOC349075 (Accession XP_300932.1). Accordingly, utilities of GAM281 include diagnosis, prevention and treatment of diseases and clinical conditions associated with LOC349075.

LOC349096 (Accession XP_300937.1) is another GAM281 target gene, herein designated TARGET GENE. LOC349096 BINDING SITE1 and LOC349096 BINDING SITE2 are target binding sites found in untranslated regions of mRNA encoded by LOC349096, corresponding to target binding sites such as BINDING SITE I, BINDING SITE II or BINDING SITE III of FIG. 8. Table 4 illustrates the complementarity of the nucleotide sequences of LOC349096 BINDING SITE1 and LOC349096 BINDING SITE2, designated SEQ ID:14560 and SEQ ID:6188 respectively, to the nucleotide sequence of GAM281 RNA, herein designated GAM RNA, also designated SEQ ID:278.

Another function of GAM281 is therefore inhibition of LOC349096 (Accession XP_300937.1). Accordingly, utilities of GAM281 include diagnosis, prevention and treatment of diseases and clinical conditions associated with LOC349096.

LOC349114 (Accession XP_302960.1) is another GAM281 target gene, herein designated TARGET GENE. LOC349114 BINDING SITE is a target binding site found in the 5' untranslated region of mRNA encoded by LOC349114, corresponding to a target binding site such as BINDING SITE I, BINDING SITE II or BINDING SITE III of FIG. 8. Table 4 illustrates the complementarity of the nucleotide sequences of LOC349114 BINDING SITE, designated SEQ ID:12803, to the nucleotide sequence of GAM281 RNA, herein designated GAM RNA, also designated SEQ ID:278.

Another function of GAM281 is therefore inhibition of LOC349114 (Accession XP_302960.1). Accordingly, utilities of GAM281 include diagnosis, prevention and treatment of diseases and clinical conditions associated with LOC349114.

LOC349136 (Accession XP_300958.1) is another GAM281 target gene, herein designated TARGET GENE. LOC349136 BINDING SITE is a target binding site found in the 5' untranslated region of mRNA encoded by LOC349136, corresponding to a target binding site such as BINDING SITE I, BINDING SITE II or BINDING SITE III of FIG. 8. Table 4 illustrates the complementarity of the nucleotide sequences of LOC349136 BINDING SITE, designated SEQ ID:6676, to the nucleotide sequence of GAM281 RNA, herein designated GAM RNA, also designated SEQ ID:278.

Another function of GAM281 is therefore inhibition of LOC349136 (Accession XP_300958.1). Accordingly, utilities of GAM281 include diagnosis, prevention and treatment of diseases and clinical conditions associated with LOC349136.

LOC349170 (Accession XP_300969.1) is another GAM281 target gene, herein designated TARGET GENE. LOC349170 BINDING SITE1 through LOC349170 BINDING SITE4 are target binding sites found in untranslated regions of mRNA encoded by LOC349170, corresponding to target binding sites such as BINDING SITE I, BINDING SITE II or BINDING SITE III of FIG. 8. Table 4 illustrates the complementarity of the nucleotide sequences of LOC349170 BINDING SITE1 through LOC349170 BINDING SITE4, designated SEQ ID:3349, SEQ ID:9545, SEQ ID:18074 and SEQ ID:11508 respectively, to the nucleotide sequence of GAM281 RNA, herein designated GAM RNA, also designated SEQ ID:278.

Another function of GAM281 is therefore inhibition of LOC349170 (Accession XP_300969.1). Accordingly, utilities of GAM281 include diagnosis, prevention and treatment of diseases and clinical conditions associated with LOC349170.

LOC349251 (Accession XP_300251.1) is another GAM281 target gene, herein designated TARGET GENE. LOC349251 BINDING SITE1 and LOC349251 BINDING SITE2 are target binding sites found in untranslated regions of mRNA encoded by LOC349251, corresponding to target binding sites such as BINDING SITE I, BINDING SITE II or BINDING SITE III of FIG. 8. Table 4 illustrates the complementarity of the nucleotide sequences of LOC349251 BINDING SITE1 and LOC349251 BINDING SITE2, designated SEQ ID:2323 and SEQ ID:4454 respectively, to the nucleotide sequence of GAM281 RNA, herein designated GAM RNA, also designated SEQ ID:278.

Another function of GAM281 is therefore inhibition of LOC349251 (Accession XP_300251.1). Accordingly, utilities of GAM281 include diagnosis, prevention and treatment of diseases and clinical conditions associated with LOC349251.

LOC349360 (Accession XP_088528.1) is another GAM281 target gene, herein designated TARGET GENE. LOC349360 BINDING SITE is a target binding site found in the 5' untranslated region of mRNA encoded by LOC349360, corresponding to a target binding site such as BINDING SITE I, BINDING SITE II or BINDING SITE III of FIG. 8. Table 4 illustrates the complementarity of the nucleotide sequences of LOC349360 BINDING SITE, designated SEQ ID:10639, to the nucleotide sequence of GAM281 RNA, herein designated GAM RNA, also designated SEQ ID:278.

Another function of GAM281 is therefore inhibition of LOC349360 (Accession XP_088528.1). Accordingly, utilities of GAM281 include diagnosis, prevention and treatment of diseases and clinical conditions associated with LOC349360.

LOC349408 (Accession XP_303044.1) is another GAM281 target gene, herein designated TARGET GENE. LOC349408 BINDING SITE is a target binding site found in the 5' untranslated region of mRNA encoded by LOC349408, corresponding to a target binding site such as BINDING SITE I, BINDING SITE II or BINDING SITE III of FIG. 8. Table 4 illustrates the complementarity of the nucleotide sequences of LOC349408 BINDING SITE, designated SEQ ID:13466, to the nucleotide sequence of GAM281 RNA, herein designated GAM RNA, also designated SEQ ID:278.

Another function of GAM281 is therefore inhibition of LOC349408 (Accession XP_303044.1). Accordingly, utilities of GAM281 include diagnosis, prevention and treatment of diseases and clinical conditions associated with LOC349408.

LOC349440 (Accession XP_300513.1) is another GAM281 target gene, herein designated TARGET GENE. LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:4112, to the nucleotide sequence of GAM281 RNA, herein designated GAM RNA, also designated SEQ ID:278.

Another function of GAM281 is therefore inhibition of LOC349440 (Accession XP_300513.1). Accordingly, utilities of GAM281 include diagnosis, prevention and treatment of diseases and clinical conditions associated with LOC349440.

LOC350106 (Accession XP_303810.1) is another GAM281 target gene, herein designated TARGET GENE. LOC350106 BINDING SITE is a target binding site found in the 5' untranslated region of mRNA encoded by LOC350106, corresponding to a target binding site such as BINDING SITE I, BINDING SITE II or BINDING SITE III of FIG. 8. Table 4 illustrates the complementarity of the nucleotide sequences of LOC350106 BINDING SITE, designated SEQ ID:18715, to the nucleotide sequence of GAM281 RNA, herein designated GAM RNA, also designated SEQ ID:278.

Another function of GAM281 is therefore inhibition of LOC350106 (Accession XP_303810.1). Accordingly, utilities of GAM281 include diagnosis, prevention and treatment of diseases and clinical conditions associated with LOC350106.

LOC350395 (Accession XP_304054.1) is another GAM281 target gene, herein designated TARGET GENE. LOC350395 BINDING SITE is a target binding site found in the 5' untranslated region of mRNA encoded by LOC350395, corresponding to a target binding site such as BINDING SITE I, BINDING SITE II or BINDING SITE III of FIG. 8. Table 4 illustrates the complementarity of the nucleotide sequences of LOC350395 BINDING SITE, designated SEQ ID:8276, to the nucleotide sequence of GAM281 RNA, herein designated GAM RNA, also designated SEQ ID:278.

Another function of GAM281 is therefore inhibition of LOC350395 (Accession XP_304054.1). Accordingly, utilities of GAM281 include diagnosis, prevention and treatment of diseases and clinical conditions associated with LOC350395.

LOC51058 (Accession NP_056995.1) is another GAM281 target gene, herein designated TARGET GENE. LOC51058 BINDING SITE is a target binding site found in the 3' untranslated region of mRNA encoded by LOC51058, corresponding to a target binding site such as BINDING SITE I, BINDING SITE II or BINDING SITE III of FIG. 8. Table 4 illustrates the complementarity of the nucleotide sequences of LOC51058 BINDING SITE, designated SEQ ID:5678, to the nucleotide sequence of GAM281 RNA, herein designated GAM RNA, also designated SEQ ID:278.

Another function of GAM281 is therefore inhibition of LOC51058 (Accession NP_056995.1). Accordingly, utilities of GAM281 include diagnosis, prevention and treatment of diseases and clinical conditions associated with LOC51058.

LOC51122 (Accession NP_057178.1) is another GAM281 target gene, herein designated TARGET GENE. LOC51122 BINDING SITE is a target binding site found in the 3' untranslated region of mRNA encoded by LOC51122, corresponding to a target binding site such as BINDING SITE I, BINDING SITE II or BINDING SITE III of FIG. 8. Table 4 illustrates the complementarity of the nucleotide sequences of LOC51122 BINDING SITE, designated SEQ ID:1167, to the nucleotide sequence of GAM281 RNA, herein designated GAM RNA, also designated SEQ ID:278.

Another function of GAM281 is therefore inhibition of LOC51122 (Accession NP_057178.1). Accordingly, utilities of GAM281 include diagnosis, prevention and treatment of diseases and clinical conditions associated with LOC51122.

LOC51193 (Accession NP_057415.1) is another GAM281 target gene, herein designated TARGET GENE. LOC51193 BINDING SITE1 and LOC51193 BINDING SITE2 are target binding sites found in untranslated regions of mRNA encoded by LOC51193, corresponding to target binding sites such as BINDING SITE I, BINDING SITE II or BINDING SITE III of FIG. 8. Table 4 illustrates the complementarity of the nucleotide sequences of LOC51193 BINDING SITE1 and LOC51193 BINDING SITE2, designated SEQ ID:3111 and SEQ ID:14721 respectively, to the nucleotide sequence of GAM281 RNA, herein designated GAM RNA, also designated SEQ ID:278.

Another function of GAM281 is therefore inhibition of LOC51193 (Accession NP_057415.1). Accordingly, utilities of GAM281 include diagnosis, prevention and treatment of diseases and clinical conditions associated with LOC51193.

LOC51257 (Accession NP_057580.2) is another GAM281 target gene, herein designated TARGET GENE. LOC51257 BINDING SITE is a target binding site found in the 5' untranslated region of mRNA encoded by LOC51257, corresponding to a target binding site such as BINDING SITE I, BINDING SITE II or BINDING SITE III of FIG. 8. Table 4 illustrates the complementarity of the nucleotide sequences of LOC51257 BINDING SITE, designated SEQ ID:14855, to the nucleotide sequence of GAM281 RNA, herein designated GAM RNA, also designated SEQ ID:278.

Another function of GAM281 is therefore inhibition of LOC51257 (Accession NP_057580.2). Accordingly, utilities of GAM281 include diagnosis, prevention and treatment of diseases and clinical conditions associated with LOC51257.

LOC51334 (Accession NP_057728.1) is another GAM281 target gene, herein designated TARGET GENE. LOC51334 BINDING SITE is a target binding site found in the 5' untranslated region of mRNA encoded by LOC51334, corresponding to a target binding site such as BINDING SITE I, BINDING SITE II or BINDING SITE III of FIG. 8. Table 4 illustrates the complementarity of the nucleotide sequences of LOC51334 BINDING SITE, designated SEQ ID:8243, to the nucleotide sequence of GAM281 RNA, herein designated GAM RNA, also designated SEQ ID:278.

Another function of GAM281 is therefore inhibition of LOC51334 (Accession NP_057728.1). Accordingly, utilities of GAM281 include diagnosis, prevention and treatment of diseases and clinical conditions associated with LOC51334.

LOC51336 (Accession NP_057730.1) is another GAM281 target gene, herein designated TARGET GENE. LOC51336 BINDING SITE is a target binding site found in the 3' untranslated region of mRNA encoded by LOC51336, corresponding to a target binding site such as BINDING SITE I, BINDING SITE II or BINDING SITE III of FIG. 8. Table 4 illustrates the complementarity of the nucleotide sequences of LOC51336 BINDING SITE, designated SEQ ID:18703, to the nucleotide sequence of GAM281 RNA, herein designated GAM RNA, also designated SEQ ID:278.

Another function of GAM281 is therefore inhibition of LOC51336 (Accession NP_057730.1). Accordingly, utilities of GAM281 include diagnosis, prevention and treatment of diseases and clinical conditions associated with LOC51336.

LOC55954 (Accession NP_061976.1) is another GAM281 target gene, herein designated TARGET GENE. LOC55954 BINDING SITE is a target binding site found in the 5' untranslated region of mRNA encoded by LOC55954, corresponding to a target binding site such as BINDING SITE I, BINDING SITE II or BINDING SITE III of FIG. 8. Table 4 illustrates the complementarity of the nucleotide sequences of LOC55954 BINDING SITE, designated SEQ ID:17853, to the nucleotide sequence of GAM281 RNA, herein designated GAM RNA, also designated SEQ ID:278.

Another function of GAM281 is therefore inhibition of LOC55954 (Accession NP_061976.1). Accordingly, utilities of GAM281 include diagnosis, prevention and treatment of diseases and clinical conditions associated with LOC55954.

LOC56902 (Accession NP_064528.1) is another GAM281 target gene, herein designated TARGET GENE. LOC56902 BINDING SITE is a target binding site found in the 3' untranslated region of mRNA encoded by LOC56902, corresponding to a target binding site such as BINDING SITE I, BINDING SITE II or BINDING SITE III of FIG. 8. Table 4 illustrates the complementarity of the nucleotide sequences of LOC56902 BINDING SITE, designated SEQ ID:5945, to the nucleotide sequence of GAM281 RNA, herein designated GAM RNA, also designated SEQ ID:278.

Another function of GAM281 is therefore inhibition of LOC56902 (Accession NP_064528.1). Accordingly, utilities of GAM281 include diagnosis, prevention and treatment of diseases and clinical conditions associated with LOC56902.

LOC57107 (Accession NP_065114.2) is another GAM281 target gene, herein designated TARGET GENE. LOC57107 BINDING SITE is a target binding site found in the 3' untranslated region of mRNA encoded by LOC57107, corresponding to a target binding site such as BINDING SITE I, BINDING SITE II or BINDING SITE III of FIG. 8. Table 4 illustrates the complementarity of the nucleotide sequences of LOC57107 BINDING SITE, designated SEQ ID:16916, to the nucleotide sequence of GAM281 RNA, herein designated GAM RNA, also designated SEQ ID:278.

Another function of GAM281 is therefore inhibition of LOC57107 (Accession NP_065114.2). Accordingly, utilities of GAM281 include diagnosis, prevention and treatment of diseases and clinical conditions associated with LOC57107.

LOC57146 (Accession NP_065155.2) is another GAM281 target gene, herein designated TARGET GENE. LOC57146 BINDING SITE is a target binding site found in the 3' untranslated region of mRNA encoded by LOC57146, corresponding to a target binding site such as BINDING SITE I, BINDING SITE II or BINDING SITE III of FIG. 8. Table 4 illustrates the complementarity of the nucleotide sequences of LOC57146 BINDING SITE, designated SEQ ID:11036, to the nucleotide sequence of GAM281 RNA, herein designated GAM RNA, also designated SEQ ID:278.

Another function of GAM281 is therefore inhibition of LOC57146 (Accession NP_065155.2). Accordingly, utilities of GAM281 include diagnosis, prevention and treatment of diseases and clinical conditions associated with LOC57146.

LOC57209 (Accession XP_290488.1) is another GAM281 target gene, herein designated TARGET GENE. LOC57209 BINDING SITE is a target binding site found in the 5' untranslated region of mRNA encoded by LOC57209, corresponding to a target binding site such as BINDING SITE I, BINDING SITE II or BINDING SITE III of FIG. 8. Table 4 illustrates the complementarity of the nucleotide sequences of LOC57209 BINDING SITE, designated SEQ ID:2349, to the nucleotide sequence of GAM281 RNA, herein designated GAM RNA, also designated SEQ ID:278.

Another function of GAM281 is therefore inhibition of LOC57209 (Accession XP_290488.1). Accordingly, utilities of GAM281 include diagnosis, prevention and treatment of diseases and clinical conditions associated with LOC57209.

LOC90110 (Accession XP_029046.1) is another GAM281 target gene, herein designated TARGET GENE. LOC90110 BINDING SITE is a target binding site found in the 3' untranslated region of mRNA encoded by LOC90110, corresponding to a target binding site such as BINDING SITE I, BINDING SITE II or BINDING SITE III of FIG. 8. Table 4 illustrates the complementarity of the nucleotide sequences of LOC90110 BINDING SITE, designated SEQ ID:10533, to the nucleotide sequence of GAM281 RNA, herein designated GAM RNA, also designated SEQ ID:278.

Another function of GAM281 is therefore inhibition of LOC90110 (Accession XP_029046.1). Accordingly, utilities of GAM281 include diagnosis, prevention and treatment of diseases and clinical conditions associated with LOC90110.

LOC90408 (Accession XP_031517.1) is another GAM281 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:7704, to the nucleotide sequence of GAM281 RNA, herein designated GAM RNA, also designated SEQ ID:278.

Another function of GAM281 is therefore inhibition of LOC90408 (Accession XP_031517.1). Accordingly, utilities of GAM281 include diagnosis, prevention and treatment of diseases and clinical conditions associated with LOC90408.

LOC90485 (Accession XP_032059.1) is another GAM281 target gene, herein designated TARGET GENE. LOC90485 BINDING SITE1 and LOC90485 BINDING SITE2 are target binding sites found in untranslated regions of mRNA encoded by LOC90485, corresponding to target binding sites such as BINDING SITE I, BINDING SITE II or BINDING SITE III of FIG. 8. Table 4 illustrates the complementarity of the nucleotide sequences of LOC90485 BINDING SITE1 and LOC90485 BINDING SITE2, designated SEQ ID:6896 and SEQ ID:18698 respectively, to the nucleotide sequence of GAM281 RNA, herein designated GAM RNA, also designated SEQ ID:278.

Another function of GAM281 is therefore inhibition of LOC90485 (Accession XP_032059.1). Accordingly, utilities of GAM281 include diagnosis, prevention and treatment of diseases and clinical conditions associated with LOC90485.

LOC90999 (Accession XP_035410.1) is another GAM281 target gene, herein designated TARGET GENE. LOC90999 BINDING SITE is a target binding site found in the 3' untranslated region of mRNA encoded by LOC90999, corresponding to a target binding site such as BINDING SITE I, BINDING SITE II or BINDING SITE III of FIG. 8. Table 4 illustrates the complementarity of the nucleotide sequences of LOC90999 BINDING SITE, designated SEQ ID:15038, to the nucleotide sequence of GAM281 RNA, herein designated GAM RNA, also designated SEQ ID:278.

Another function of GAM281 is therefore inhibition of LOC90999 (Accession XP_035410.1). Accordingly, utilities of GAM281 include diagnosis, prevention and treatment of diseases and clinical conditions associated with LOC90999.

LOC91056 (Accession NP_612377.1) is another GAM281 target gene, herein designated TARGET GENE. LOC91056 BINDING SITE is a target binding site found in the 3' untranslated region of multiple transcripts of mRNA encoded by LOC91056, corresponding to a target binding site such as BINDING SITE I, BINDING SITE II or BINDING SITE III of FIG. 8. Table 4 illustrates the complementarity of the nucleotide sequences of LOC91056 BINDING SITE, designated SEQ ID:14660, to the nucleotide sequence of GAM281 RNA, herein designated GAM RNA, also designated SEQ ID:278.

Another function of GAM281 is therefore inhibition of LOC91056 (Accession NP_612377.1). Accordingly, utilities of GAM281 include diagnosis, prevention and treatment of diseases and clinical conditions associated with LOC91056.

LOC91115 (Accession XP_036218.1) is another GAM281 target gene, herein designated TARGET GENE. LOC91115 BINDING SITE1 through LOC91115 BINDING SITE3 are target binding sites found in untranslated regions of mRNA encoded by LOC91115, corresponding to target binding sites such as BINDING SITE I, BINDING SITE II or BINDING SITE III of FIG. 8. Table 4 illustrates the complementarity of the nucleotide sequences of LOC91115 BINDING SITE1 through LOC91115 BINDING SITE3, designated SEQ ID:19989, SEQ ID:17831 and SEQ ID:12591 respectively, to the nucleotide sequence of GAM281 RNA, herein designated GAM RNA, also designated SEQ ID:278.

Another function of GAM281 is therefore inhibition of LOC91115 (Accession XP_036218.1). Accordingly, utilities of GAM281 include diagnosis, prevention and treatment of diseases and clinical conditions associated with LOC91115.

LOC91170 (Accession XP_036612.1) is another GAM281 target gene, herein designated TARGET GENE. LOC91170 BINDING SITE is a target binding site found in the 5' untranslated region of mRNA encoded by LOC91170, corresponding to a target binding site such as BINDING SITE I, BINDING SITE II or BINDING SITE III of FIG. 8. Table 4 illustrates the complementarity of the nucleotide sequences of LOC91170 BINDING SITE, designated SEQ ID:16178, to the nucleotide sequence of GAM281 RNA, herein designated GAM RNA, also designated SEQ ID:278.

Another function of GAM281 is therefore inhibition of LOC91170 (Accession XP_036612.1). Accordingly, utilities of GAM281 include diagnosis, prevention and treatment of diseases and clinical conditions associated with LOC91170.

LOC91250 (Accession XP_037135.1) is another GAM281 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:8577, to the nucleotide sequence of GAM281 RNA, herein designated GAM RNA, also designated SEQ ID:278.

Another function of GAM281 is therefore inhibition of LOC91250 (Accession XP_037135.1). Accordingly, utilities of GAM281 include diagnosis, prevention and treatment of diseases and clinical conditions associated with LOC91250.

LOC91266 (Accession XP_037268.1) is another GAM281 target gene, herein designated TARGET GENE. LOC91266 BINDING SITE is a target binding site found in the 5' untranslated region of mRNA encoded by LOC91266, corresponding to a target binding site such as BINDING SITE I, BINDING SITE II or BINDING SITE III of FIG. 8. Table 4 illustrates the complementarity of the nucleotide sequences of LOC91266 BINDING SITE, designated SEQ ID:18355, to the nucleotide sequence of GAM281 RNA, herein designated GAM RNA, also designated SEQ ID:278.

Another function of GAM281 is therefore inhibition of LOC91266 (Accession XP_037268.1). Accordingly, utilities of GAM281 include diagnosis, prevention and treatment of diseases and clinical conditions associated with LOC91266.

LOC91373 (Accession XP_038063.5) is another GAM281 target gene, herein designated TARGET GENE. LOC91373 BINDING SITE is a target binding site found in the 3' untranslated region of mRNA encoded by LOC91373, corresponding to a target binding site such as BINDING SITE I, BINDING SITE II or BINDING SITE III of FIG. 8. Table 4 illustrates the complementarity of the nucleotide sequences of LOC91373 BINDING SITE, designated SEQ ID:9077, to the nucleotide sequence of GAM281 RNA, herein designated GAM RNA, also designated SEQ ID:278.

Another function of GAM281 is therefore inhibition of LOC91373 (Accession XP_038063.5). Accordingly, utilities of GAM281 include diagnosis, prevention and treatment of diseases and clinical conditions associated with LOC91373.

LOC91549 (Accession XP_039115.1) is another GAM281 target gene, herein designated TARGET GENE. LOC91549 BINDING SITE is a target binding site found in the 5' untranslated region of mRNA encoded by LOC91549, corresponding to a target binding site such as BINDING SITE I, BINDING SITE II or BINDING SITE III of FIG. 8. Table 4 illustrates the complementarity of the nucleotide sequences of LOC91549 BINDING SITE, designated SEQ ID:17238, to the nucleotide sequence of GAM281 RNA, herein designated GAM RNA, also designated SEQ ID:278.

Another function of GAM281 is therefore inhibition of LOC91549 (Accession XP_039115.1). Accordingly, utilities of GAM281 include diagnosis, prevention and treatment of diseases and clinical conditions associated with LOC91549.

LOC91661 (Accession NP_612381.1) is another GAM281 target gene, herein designated TARGET GENE. LOC91661 BINDING SITE is a target binding site found in the 3' untranslated region of mRNA encoded by LOC91661, corresponding to a target binding site such as BINDING SITE I, BINDING SITE II or BINDING SITE III of FIG. 8. Table 4 illustrates the complementarity of the nucleotide sequences of LOC91661 BINDING SITE, designated SEQ ID:8303, to the nucleotide sequence of GAM281 RNA, herein designated GAM RNA, also designated SEQ ID:278.

Another function of GAM281 is therefore inhibition of LOC91661 (Accession NP_612381.1). Accordingly, utilities of GAM281 include diagnosis, prevention and treatment of diseases and clinical conditions associated with LOC91661.

LOC91663 (Accession NP_612382.1) is another GAM281 target gene, herein designated TARGET GENE. LOC91663 BINDING SITE is a target binding site found in the 3' untranslated region of mRNA encoded by LOC91663, corresponding to a target binding site such as BINDING SITE I, BINDING SITE II or BINDING SITE III of FIG. 8. Table 4 illustrates the complementarity of the nucleotide sequences of LOC91663 BINDING SITE, designated SEQ ID:8075, to the nucleotide sequence of GAM281 RNA, herein designated GAM RNA, also designated SEQ ID:278.

Another function of GAM281 is therefore inhibition of LOC91663 (Accession NP_612382.1). Accordingly, utilities of GAM281 include diagnosis, prevention and treatment of diseases and clinical conditions associated with LOC91663.

LOC91893 (Accession XP_041340.1) is another GAM281 target gene, herein designated TARGET GENE. LOC91893 BINDING SITE is a target binding site found in the 3' untranslated region of mRNA encoded by LOC91893, corresponding to a target binding site such as BINDING SITE I, BINDING SITE II or BINDING SITE III of FIG. 8. Table 4 illustrates the complementarity of the nucleotide sequences of LOC91893 BINDING SITE, designated SEQ ID:14589, to the nucleotide sequence of GAM281 RNA, herein designated GAM RNA, also designated SEQ ID:278.

Another function of GAM281 is therefore inhibition of LOC91893 (Accession XP_041340.1). Accordingly, utilities of GAM281 include diagnosis, prevention and treatment of diseases and clinical conditions associated with LOC91893.

LOC92017 (Accession XP_042234.2) is another GAM281 target gene, herein designated TARGET GENE. LOC92017 BINDING SITE is a target binding site found in the 3' untranslated region of mRNA encoded by LOC92017, corresponding to a target binding site such as BINDING SITE I, BINDING SITE II or BINDING SITE III of FIG. 8. Table 4 illustrates the complementarity of the nucleotide sequences of LOC92017 BINDING SITE, designated SEQ ID:9327, to the nucleotide sequence of GAM281 RNA, herein designated GAM RNA, also designated SEQ ID:278.

Another function of GAM281 is therefore inhibition of LOC92017 (Accession XP_042234.2). Accordingly, utilities of GAM281 include diagnosis, prevention and treatment of diseases and clinical conditions associated with LOC92017.

LOC92148 (Accession XP_043160.1) is another GAM281 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:4097, to the nucleotide sequence of GAM281 RNA, herein designated GAM RNA, also designated SEQ ID:278.

Another function of GAM281 is therefore inhibition of LOC92148 (Accession XP_043160.1). Accordingly, utilities of GAM281 include diagnosis, prevention and treatment of diseases and clinical conditions associated with LOC92148.

LOC92360 (Accession XP_044589.1) is another GAM281 target gene, herein designated TARGET GENE. LOC92360 BINDING SITE is a target binding site found in the 3' untranslated region of mRNA encoded by LOC92360, corresponding to a target binding site such as BINDING SITE I, BINDING SITE II or BINDING SITE III of FIG. 8. Table 4 illustrates the complementarity of the nucleotide sequences of LOC92360 BINDING SITE, designated SEQ ID:1082, to the nucleotide sequence of GAM281 RNA, herein designated GAM RNA, also designated SEQ ID:278.

Another function of GAM281 is therefore inhibition of LOC92360 (Accession XP_044589.1). Accordingly, utilities of GAM281 include diagnosis, prevention and treatment of diseases and clinical conditions associated with LOC92360.

LOC92597 (Accession NP_775739.1) is another GAM281 target gene, herein designated TARGET GENE. LOC92597 BINDING SITE is a target binding site found in the 3' untranslated region of mRNA encoded by LOC92597, corresponding to a target binding site such as BINDING SITE I, BINDING SITE II or BINDING SITE III of FIG. 8. Table 4 illustrates the complementarity of the nucleotide sequences of LOC92597 BINDING SITE, designated SEQ ID:19339, to the nucleotide sequence of GAM281 RNA, herein designated GAM RNA, also designated SEQ ID:278.

Another function of GAM281 is therefore inhibition of LOC92597 (Accession NP_775739.1). Accordingly, utilities of GAM281 include diagnosis, prevention and treatment of diseases and clinical conditions associated with LOC92597.

LOC92659 (Accession XP_046434.3) is another GAM281 target gene, herein designated TARGET GENE. LOC92659 BINDING SITE is a target binding site found in the 3' untranslated region of mRNA encoded by LOC92659, corresponding to a target binding site such as BINDING SITE I, BINDING SITE II or BINDING SITE III of FIG. 8. Table 4 illustrates the complementarity of the nucleotide sequences of LOC92659 BINDING SITE, designated SEQ ID:10989, to the nucleotide sequence of GAM281 RNA, herein designated GAM RNA, also designated SEQ ID:278.

Another function of GAM281 is therefore inhibition of LOC92659 (Accession XP_046434.3). Accordingly, utilities of GAM281 include diagnosis, prevention and treatment of diseases and clinical conditions associated with LOC92659.

LOC93132 (Accession XP_049396.1) is another GAM281 target gene, herein designated TARGET GENE. LOC93132 BINDING SITE is a target binding site found in the 5' untranslated region of mRNA encoded by LOC93132, corresponding to a target binding site such as BINDING SITE I, BINDING SITE II or BINDING SITE III of FIG. 8. Table 4 illustrates the complementarity of the nucleotide sequences of LOC93132 BINDING SITE, designated SEQ ID:9953, to the nucleotide sequence of GAM281 RNA, herein designated GAM RNA, also designated SEQ ID:278.

Another function of GAM281 is therefore inhibition of LOC93132 (Accession XP_049396.1). Accordingly, utilities of GAM281 include diagnosis, prevention and treatment of diseases and clinical conditions associated with LOC93132.

LOC94431 (Accession NP_660280.1) is another GAM281 target gene, herein designated TARGET GENE. LOC94431 BINDING SITE is a target binding site found in the 5' untranslated region of mRNA encoded by LOC94431, corresponding to a target binding site such as BINDING SITE I, BINDING SITE II or BINDING SITE III of FIG. 8. Table 4 illustrates the complementarity of the nucleotide sequences of LOC94431 BINDING SITE, designated SEQ ID:18633, to the nucleotide sequence of GAM281 RNA, herein designated GAM RNA, also designated SEQ ID:278.

Another function of GAM281 is therefore inhibition of LOC94431 (Accession NP_660280.1). Accordingly, utilities of GAM281 include diagnosis, prevention and treatment of diseases and clinical conditions associated with LOC94431.

Lanosterol synthase (2,3-oxidosqualene-lanosterol cyclase) (LSS, Accession NP_002331.2) is another GAM281 target gene, herein designated TARGET GENE. LSS BINDING SITE is a target binding site found in the 3' untranslated region of mRNA encoded by LSS, corresponding to a target binding site such as BINDING SITE I, BINDING SITE II or BINDING SITE III of FIG. 8. Table 4 illustrates the complementarity of the nucleotide sequences of LSS BINDING SITE, designated SEQ ID:6091, to the nucleotide sequence of GAM281 RNA, herein designated GAM RNA, also designated SEQ ID:278.

Another function of GAM281 is therefore inhibition of Lanosterol synthase (2,3-oxidosqualene-lanosterol cyclase) (LSS, Accession NP_002331.2). Accordingly, utilities of GAM281 include diagnosis, prevention and treatment of diseases and clinical conditions associated with LSS.

Leukotriene b4 receptor (LTB4R, Accession NP_000743.1) is another GAM281 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:1022, to the nucleotide sequence of GAM281 RNA, herein designated GAM RNA, also designated SEQ ID:278.

Another function of GAM281 is therefore inhibition of Leukotriene b4 receptor (LTB4R, Accession NP_000743.1), a gene which may be the cardiac p2y receptor involved in the regulation of cardiac muscle contraction through modulation of l-type calcium currents. Accordingly, utilities of GAM281 include diagnosis, prevention and treatment of diseases and clinical conditions associated with LTB4R.

The function of LTB4R and its association with various diseases and clinical conditions, has been established by previous studies, as described hereinabove with reference to GAM30.1. Lymphocyte antigen 75 (LY75, Accession NP_002340.1) is another GAM281 target gene, herein designated TARGET GENE. LY75 BINDING SITE is a target binding site found in the 3' untranslated region of mRNA encoded by LY75, corresponding to a target binding site such as BINDING SITE I, BINDING SITE II or BINDING SITE III of FIG. 8. Table 4 illustrates the complementarity of the nucleotide sequences of LY75 BINDING SITE, designated SEQ ID:17724, to the nucleotide sequence of GAM281 RNA, herein designated GAM RNA, also designated SEQ ID:278.

Another function of GAM281 is therefore inhibition of Lymphocyte antigen 75 (LY75, Accession NP_002340.1). Accordingly, utilities of GAM281 include diagnosis, prevention and treatment of diseases and clinical conditions associated with LY75.

Lysozyme (renal amyloidosis) (Ly, Accession NP_000230.1) is another GAM281 target gene, herein designated TARGET GENE. LYZ BINDING SITE is a target binding site found in the 3' untranslated region of mRNA encoded by Ly, corresponding to a target binding site such as BINDING SITE I, BINDING SITE II or BINDING SITE III of FIG. 8. Table 4 illustrates the complementarity of the nucleotide sequences of LYZ BINDING SITE, designated SEQ ID:7382, to the nucleotide sequence of GAM281 RNA, herein designated GAM RNA, also designated SEQ ID:278.

Another function of GAM281 is therefore inhibition of Lysozyme (renal amyloidosis) (Ly, Accession NP_000230.1), a gene which a bacteriolytic enzyme. and therefore may be associated with Renal amyloidosis. Accordingly, utilities of GAM281 include diagnosis, prevention and treatment of Renal amyloidosis, and of other diseases and clinical conditions associated with LYZ.

The function of LYZ and its association with various diseases and clinical conditions, has been established by previous studies, as described hereinabove with reference to GAM189.1. Leucine zipper, putative tumor suppressor 1 (LZTS1, Accession NP_066300.1) is another GAM281 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:4518, to the nucleotide sequence of GAM281 RNA, herein designated GAM RNA, also designated SEQ ID:278.

Another function of GAM281 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM281 include diagnosis, prevention and treatment of diseases and clinical conditions associated with LZTS1.

The function of LZTS1 and its association with various diseases and clinical conditions, has been established by previous studies, as described hereinabove with reference to GAM130.1. MAC30 (Accession XP_031536.2) is another GAM281 target gene, herein designated TARGET GENE. MAC30 BINDING SITE is a target binding site found in the 3' untranslated region of mRNA encoded by MAC30, corresponding to a target binding site such as BINDING SITE I, BINDING SITE II or BINDING SITE III of FIG. 8. Table 4 illustrates the complementarity of the nucleotide sequences of MAC30 BINDING SITE, designated SEQ ID:5069, to the nucleotide sequence of GAM281 RNA, herein designated GAM RNA, also designated SEQ ID:278.

Another function of GAM281 is therefore inhibition of MAC30 (Accession XP_031536.2). Accordingly, utilities of GAM281 include diagnosis, prevention and treatment of diseases and clinical conditions associated with MAC30.

Map-kinase activating death domain (MADD, Accession NP_569832.1) is another GAM281 target gene, herein designated TARGET GENE. MADD BINDING SITE is a target binding site found in the 3' untranslated region of multiple transcripts of mRNA encoded by MADD, corresponding to a target binding site such as BINDING SITE I, BINDING SITE II or BINDING SITE III of FIG. 8. Table 4 illustrates the complementarity of the nucleotide sequences of MADD BINDING SITE, designated SEQ ID:3262, to the nucleotide sequence of GAM281 RNA, herein designated GAM RNA, also designated SEQ ID:278.

Another function of GAM281 is therefore inhibition of Map-kinase activating death domain (MADD, Accession NP_569832.1), a gene which may regulate two different pathways for neural activities.interacts with the type-1 tumor necrosis factor receptor (TNFR1); death domain-containing protein. Accordingly, utilities of GAM281 include diagnosis, prevention and treatment of diseases and clinical conditions associated with MADD.

The function of MADD and its association with various diseases and clinical conditions, has been established by previous studies, as described hereinabove with reference to GAM259.2. Map-kinase activating death domain (MADD, Accession NP_569828.1) is another GAM281 target gene, herein designated TARGET GENE. MADD BINDING SITE is a target binding site found in the 3' untranslated region of multiple transcripts of mRNA encoded by MADD, corresponding to a target binding site such as BINDING SITE I, BINDING SITE II or BINDING SITE III of FIG. 8. Table 4 illustrates the complementarity of the nucleotide sequences of MADD BINDING SITE, designated SEQ ID:3262, to the nucleotide sequence of GAM281 RNA, herein designated GAM RNA, also designated SEQ ID:278.

Another function of GAM281 is therefore inhibition of Map-kinase activating death domain (MADD, Accession NP_569828.1), a gene which may regulate two different pathways for neural activities.interacts with the type-1 tumor necrosis factor receptor (TNFR1); death domain-containing protein. Accordingly, utilities of GAM281 include diagnosis, prevention and treatment of diseases and clinical conditions associated with MADD.

The function of MADD and its association with various diseases and clinical conditions, has been established by previous studies, as described hereinabove with reference to GAM259.2. Map-kinase activating death domain (MADD, Accession NP_003673.2) is another GAM281 target gene, herein designated TARGET GENE. MADD BINDING SITE is a target binding site found in the 3' untranslated region of multiple transcripts of mRNA encoded by MADD, corresponding to a target binding site such as BINDING SITE I, BINDING SITE II or BINDING SITE III of FIG. 8. Table 4 illustrates the complementarity of the nucleotide sequences of MADD BINDING SITE, designated SEQ ID:3262, to the nucleotide sequence of GAM281 RNA, herein designated GAM RNA, also designated SEQ ID:278.

Another function of GAM281 is therefore inhibition of Map-kinase activating death domain (MADD, Accession NP_003673.2), a gene which may regulate two different pathways for neural activities.interacts with the type-1 tumor necrosis factor receptor (TNFR1); death domain-containing protein. Accordingly, utilities of GAM281 include diagnosis, prevention and treatment of diseases and clinical conditions associated with MADD.

The function of MADD and its association with various diseases and clinical conditions, has been established by previous studies, as described hereinabove with reference to GAM259.2. Map-kinase activating death domain (MADD, Accession NP_569829.1) is another GAM281 target gene, herein designated TARGET GENE. MADD BINDING SITE is a target binding site found in the 3' untranslated region of multiple transcripts of mRNA encoded by MADD, corresponding to a target binding site such as BINDING SITE I, BINDING SITE II or BINDING SITE III of FIG. 8. Table 4 illustrates the complementarity of the nucleotide sequences of MADD BINDING SITE, designated SEQ ID:3262, to the nucleotide sequence of GAM281 RNA, herein designated GAM RNA, also designated SEQ ID:278.

Another function of GAM281 is therefore inhibition of Map-kinase activating death domain (MADD, Accession NP_569829.1), a gene which may regulate two different pathways for neural activities.interacts with the type-1 tumor necrosis factor receptor (TNFR1); death domain-containing protein. Accordingly, utilities of GAM281 include diagnosis, prevention and treatment of diseases and clinical conditions associated with MADD.

The function of MADD and its association with various diseases and clinical conditions, has been established by previous studies, as described hereinabove with reference to GAM259.2. Map-kinase activating death domain (MADD, Accession NP_569830.1) is another GAM281 target gene, herein designated TARGET GENE. MADD BINDING SITE is a target binding site found in the 3' untranslated region of multiple transcripts of mRNA encoded by MADD, corresponding to a target binding site such as BINDING SITE I, BINDING SITE II or BINDING SITE III of FIG. 8. Table 4 illustrates the complementarity of the nucleotide sequences of MADD BINDING SITE, designated SEQ ID:3262, to the nucleotide sequence of GAM281 RNA, herein designated GAM RNA, also designated SEQ ID:278.

Another function of GAM281 is therefore inhibition of Map-kinase activating death domain (MADD, Accession NP_569830.1), a gene which may regulate two different pathways for neural activities.interacts with the type-1 tumor necrosis factor receptor (TNFR1); death domain-containing protein. Accordingly, utilities of GAM281 include diagnosis, prevention and treatment of diseases and clinical conditions associated with MADD.

The function of MADD and its association with various diseases and clinical conditions, has been established by previous studies, as described hereinabove with reference to GAM259.2. Map-kinase activating death domain (MADD, Accession NP_569826.1) is another GAM281 target gene, herein designated TARGET GENE. MADD BINDING SITE is a target binding site found in the 3' untranslated region of multiple transcripts of mRNA encoded by MADD, corresponding to a target binding site such as BINDING SITE I, BINDING SITE II or BINDING SITE III of FIG. 8. Table 4 illustrates the complementarity of the nucleotide sequences of MADD BINDING SITE, designated SEQ ID:3262, to the nucleotide sequence of GAM281 RNA, herein designated GAM RNA, also designated SEQ ID:278.

Another function of GAM281 is therefore inhibition of Map-kinase activating death domain (MADD, Accession NP_569826.1), a gene which may regulate two different pathways for neural activities.interacts with the type-1 tumor necrosis factor receptor (TNFR1); death domain-containing protein. Accordingly, utilities of GAM281 include diagnosis, prevention and treatment of diseases and clinical conditions associated with MADD.

The function of MADD and its association with various diseases and clinical conditions, has been established by previous studies, as described hereinabove with reference to GAM259.2. Map-kinase activating death domain (MADD, Accession NP_569831.1) is another GAM281 target gene, herein designated TARGET GENE. MADD BINDING SITE is a target binding site found in the 3' untranslated region of multiple transcripts of mRNA encoded by MADD, corresponding to a target binding site such as BINDING SITE I, BINDING SITE II or BINDING SITE III of FIG. 8. Table 4 illustrates the complementarity of the nucleotide sequences of MADD BINDING SITE, designated SEQ ID:3262, to the nucleotide sequence of GAM281 RNA, herein designated GAM RNA, also designated SEQ ID:278.

Another function of GAM281 is therefore inhibition of Map-kinase activating death domain (MADD, Accession NP_569831.1), a gene which may regulate two different pathways for neural activities.interacts with the type-1 tumor necrosis factor receptor (TNFR1); death domain-containing protein. Accordingly, utilities of GAM281 include diagnosis, prevention and treatment of diseases and clinical conditions associated with MADD.

The function of MADD and its association with various diseases and clinical conditions, has been established by previous studies, as described hereinabove with reference to GAM259.2. Map-kinase activating death domain (MADD, Accession NP_569827.1) is another GAM281 target gene, herein designated TARGET GENE. MADD BINDING SITE is a target binding site found in the 3' untranslated region of multiple transcripts of mRNA encoded by MADD, corresponding to a target binding site such as BINDING SITE I, BINDING SITE II or BINDING SITE III of FIG. 8. Table 4 illustrates the complementarity of the nucleotide sequences of MADD BINDING SITE, designated SEQ ID:3262, to the nucleotide sequence of GAM281 RNA, herein designated GAM RNA, also designated SEQ ID:278.

Another function of GAM281 is therefore inhibition of Map-kinase activating death domain (MADD, Accession NP_569827.1), a gene which may regulate two different pathways for neural activities.interacts with the type-1 tumor necrosis factor receptor (TNFR1); death domain-containing protein. Accordingly, utilities of GAM281 include diagnosis, prevention and treatment of diseases and clinical conditions associated with MADD.

The function of MADD and its association with various diseases and clinical conditions, has been established by previous studies, as described hereinabove with reference to GAM259.2. MAIL (Accession NP_113607.1) is another GAM281 target gene, herein designated TARGET GENE. MAIL BINDING SITE is a target binding site found in the 3' untranslated region of mRNA encoded by MAIL, corresponding to a target binding site such as BINDING SITE I, BINDING SITE II or BINDING SITE III of FIG. 8. Table 4 illustrates the complementarity of the nucleotide sequences of MAIL BINDING SITE, designated SEQ ID:2338, to the nucleotide sequence of GAM281 RNA, herein designated GAM RNA, also designated SEQ ID:278.

Another function of GAM281 is therefore inhibition of MAIL (Accession NP_113607.1). Accordingly, utilities of GAM281 include diagnosis, prevention and treatment of diseases and clinical conditions associated with MAIL.

Male germ cell-associated kinase (MAK, Accession NP_005897.1) is another GAM281 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:1989, to the nucleotide sequence of GAM281 RNA, herein designated GAM RNA, also designated SEQ ID:278.

Another function of GAM281 is therefore inhibition of Male germ cell-associated kinase (MAK, Accession NP_005897.1), a gene which plays an important role in spermatogenesis. Accordingly, utilities of GAM281 include diagnosis, prevention and treatment of diseases and clinical conditions associated with MAK.

The function of MAK and its association with various diseases and clinical conditions, has been established by previous studies, as described hereinabove with reference to GAM30.1. Mitogen-activated protein kinase kinase 1 (MAP2K1, Accession NP_002746.1) is another GAM281 target gene, herein designated TARGET GENE. MAP2K1 BINDING SITE is a target binding site found in the 3' untranslated region of mRNA encoded by MAP2K1, corresponding to a target binding site such as BINDING SITE I, BINDING SITE II or BINDING SITE III of FIG. 8. Table 4 illustrates the complementarity of the nucleotide sequences of MAP2K1 BINDING SITE, designated SEQ ID:5154, to the nucleotide sequence of GAM281 RNA, herein designated GAM RNA, also designated SEQ ID:278.

Another function of GAM281 is therefore inhibition of Mitogen-activated protein kinase kinase 1 (MAP2K1, Accession NP_002746.1), a gene which is a signaling intermediate, may take part in cell transformation and therefore may be associated with Colon cancer. Accordingly, utilities of GAM281 include diagnosis, prevention and treatment of Colon cancer, and of other diseases and clinical conditions associated with MAP2K1.

The function of MAP2K1 and its association with various diseases and clinical conditions, has been established by previous studies, as described hereinabove with reference to GAM99.1. MAPA (Accession NP_660299.1) is another GAM281 target gene, herein designated TARGET GENE. MAPA BINDING SITE is a target binding site found in the 3' untranslated region of mRNA encoded by MAPA, corresponding to a target binding site such as BINDING SITE I, BINDING SITE II or BINDING SITE III of FIG. 8. Table 4 illustrates the complementarity of the nucleotide sequences of MAPA BINDING SITE, designated SEQ ID:5231, to the nucleotide sequence of GAM281 RNA, herein designated GAM RNA, also designated SEQ ID:278.

Another function of GAM281 is therefore inhibition of MAPA (Accession NP_660299.1). Accordingly, utilities of GAM281 include diagnosis, prevention and treatment of diseases and clinical conditions associated with MAPA.

Mitogen-activated protein kinase 8 interacting protein 3 (MAPK8IP3, Accession NP_203750.1) is another GAM281 target gene, herein designated TARGET GENE. MAPK8IP3 BINDING SITE is a target binding site found in the 3' untranslated region of multiple transcripts of mRNA encoded by MAPK8IP3, corresponding to a target binding site such as BINDING SITE I, BINDING SITE II or BINDING SITE III of FIG. 8. Table 4 illustrates the complementarity of the nucleotide sequences of MAPK8IP3 BINDING SITE, designated SEQ ID:14298, to the nucleotide sequence of GAM281 RNA, herein designated GAM RNA, also designated SEQ ID:278.

Another function of GAM281 is therefore inhibition of Mitogen-activated protein kinase 8 interacting protein 3 (MAPK8IP3, Accession NP_203750.1). Accordingly, utilities of GAM281 include diagnosis, prevention and treatment of diseases and clinical conditions associated with MAPK8IP3.

Microtubule-associated protein, rp/eb family, member 1 (MAPRE1, Accession NP_036457.1) is another GAM281 target gene, herein designated TARGET GENE. MAPRE1 BINDING SITE is a target binding site found in the 3' untranslated region of mRNA encoded by MAPRE1, corresponding to a target binding site such as BINDING SITE I, BINDING SITE II or BINDING SITE III of FIG. 8. Table 4 illustrates the complementarity of the nucleotide sequences of MAPRE1 BINDING SITE, designated SEQ ID:20000, to the nucleotide sequence of GAM281 RNA, herein designated GAM RNA, also designated SEQ ID:278.

Another function of GAM281 is therefore inhibition of Microtubule-associated protein, rp/eb family, member 1 (MAPRE1, Accession NP_036457.1). Accordingly, utilities of GAM281 include diagnosis, prevention and treatment of diseases and clinical conditions associated with MAPRE1.

MCLC (Accession NP_055942.1) is another GAM281 target gene, herein designated TARGET GENE. MCLC BINDING SITE is a target binding site found in the 3' untranslated region of mRNA encoded by MCLC, corresponding to a target binding site such as BINDING SITE I, BINDING SITE II or BINDING SITE III of FIG. 8. Table 4 illustrates the complementarity of the nucleotide sequences of MCLC BINDING SITE, designated SEQ ID:7270, to the nucleotide sequence of GAM281 RNA, herein designated GAM RNA, also designated SEQ ID:278.

Another function of GAM281 is therefore inhibition of MCLC (Accession NP_055942.1). Accordingly, utilities of GAM281 include diagnosis, prevention and treatment of diseases and clinical conditions associated with MCLC.

Mdm2, transformed 3t3 cell double minute 2, p53 binding protein (mouse) (MDM2, Accession NP_006869.1) is another GAM281 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM281 RNA, herein designated GAM RNA, also designated SEQ ID:278.

Another function of GAM281 is therefore inhibition of Mdm2, transformed 3t3 cell double minute 2, p53 binding protein (mouse) (MDM2, Accession NP_006869.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM281 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006871.1) is another GAM281 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM281 RNA, herein designated GAM RNA, also designated SEQ ID:278.

Another function of GAM281 is therefore inhibition of Mdm2, transformed 3t3 cell double minute 2, p53 binding protein (mouse) (MDM2, Accession NP_006871.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM281 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006873.1) is another GAM281 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM281 RNA, herein designated GAM RNA, also designated SEQ ID:278.

Another function of GAM281 is therefore inhibition of Mdm2, transformed 3t3 cell double minute 2, p53 binding protein (mouse) (MDM2, Accession NP_006873.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM281 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006870.1) is another GAM281 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM281 RNA, herein designated GAM RNA, also designated SEQ ID:278.

Another function of GAM281 is therefore inhibition of Mdm2, transformed 3t3 cell double minute 2, p53 binding protein (mouse) (MDM2, Accession NP_006870.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM281 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006872.1) is another GAM281 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM281 RNA, herein designated GAM RNA, also designated SEQ ID:278.

Another function of GAM281 is therefore inhibition of Mdm2, transformed 3t3 cell double minute 2, p53 binding protein (mouse) (MDM2, Accession NP_006872.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM281 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_002383.1) is another GAM281 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM281 RNA, herein designated GAM RNA, also designated SEQ ID:278.

Another function of GAM281 is therefore inhibition of Mdm2, transformed 3t3 cell double minute 2, p53 binding protein (mouse) (MDM2, Accession NP_002383.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM281 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm4, transformed 3t3 cell double minute 4, p53 binding protein (mouse) (MDM4, Accession NP_002384.1) is another GAM281 target gene, herein designated TARGET GENE. MDM4 BINDING SITE is a target binding site found in the 3' untranslated region of mRNA encoded by MDM4, corresponding to a target binding site such as BINDING SITE I, BINDING SITE II or BINDING SITE III of FIG. 8. Table 4 illustrates the complementarity of the nucleotide sequences of MDM4 BINDING SITE, designated SEQ ID:7078, to the nucleotide sequence of GAM281 RNA, herein designated GAM RNA, also designated SEQ ID:278.

Another function of GAM281 is therefore inhibition of Mdm4, transformed 3t3 cell double minute 4, p53 binding protein (mouse) (MDM4, Accession NP_002384.1), a gene which Strongly similar to murine Mdm4; may interact with p53. Accordingly, utilities of GAM281 include diagnosis, prevention and treatment of diseases and clinical conditions associated with MDM4.

The function of MDM4 and its association with various diseases and clinical conditions, has been established by previous studies, as described hereinabove with reference to GAM189.1. MDS009 (Accession NP_064619.1) is another GAM281 target gene, herein designated TARGET GENE. MDS009 BINDING SITE is a target binding site found in the 5' untranslated region of mRNA encoded by MDS009, corresponding to a target binding site such as BINDING SITE I, BINDING SITE II or BINDING SITE III of FIG. 8. Table 4 illustrates the complementarity of the nucleotide sequences of MDS009 BINDING SITE, designated SEQ ID:835, to the nucleotide sequence of GAM281 RNA, herein designated GAM RNA, also designated SEQ ID:278.

Another function of GAM281 is therefore inhibition of MDS009 (Accession NP_064619.1). Accordingly, utilities of GAM281 include diagnosis, prevention and treatment of diseases and clinical conditions associated with MDS009.

Mediterranean fever (MEFV, Accession NP_000234.1) is another GAM281 target gene, herein designated TARGET GENE. MEFV BINDING SITE1 and MEFV BINDING SITE2 are target binding sites found in untranslated regions of mRNA encoded by MEFV, corresponding to target binding sites such as BINDING SITE I, BINDING SITE II or BINDING SITE III of FIG. 8. Table 4 illustrates the complementarity of the nucleotide sequences of MEFV BINDING SITE1 and MEFV BINDING SITE2, designated SEQ ID:19829 and SEQ ID:5443 respectively, to the nucleotide sequence of GAM281 RNA, herein designated GAM RNA, also designated SEQ ID:278.

Another function of GAM281 is therefore inhibition of Mediterranean fever (MEFV, Accession NP_000234.1). Accordingly, utilities of GAM281 include diagnosis, prevention and treatment of diseases and clinical conditions associated with MEFV.

Mesoderm development candidate 2 (MESDC2, Accession XP_051854.1) is another GAM281 target gene, herein designated TARGET GENE. MESDC2 BINDING SITE is a target binding site found in the 3' untranslated region of mRNA encoded by MESDC2, corresponding to a target binding site such as BINDING SITE I, BINDING SITE II or BINDING SITE III of FIG. 8. Table 4 illustrates the complementarity of the nucleotide sequences of MESDC2 BINDING SITE, designated SEQ ID:6523, to the nucleotide sequence of GAM281 RNA, herein designated GAM RNA, also designated SEQ ID:278.

Another function of GAM281 is therefore inhibition of Mesoderm development candidate 2 (MESDC2, Accession XP_051854.1). Accordingly, utilities of GAM281 include diagnosis, prevention and treatment of diseases and clinical conditions associated with MESDC2.

Microfibrillar-associated protein 4 (MFAP4, Accession NP_002395.1) is another GAM281 target gene, herein designated TARGET GENE. MFAP4 BINDING SITE is a target binding site found in the 3' untranslated region of mRNA encoded by MFAP4, corresponding to a target binding site such as BINDING SITE I, BINDING SITE II or BINDING SITE III of FIG. 8. Table 4 illustrates the complementarity of the nucleotide sequences of MFAP4 BINDING SITE, designated SEQ ID:9082, to the nucleotide sequence of GAM281 RNA, herein designated GAM RNA, also designated SEQ ID:278.

Another function of GAM281 is therefore inhibition of Microfibrillar-associated protein 4 (MFAP4, Accession NP_002395.1). Accordingly, utilities of GAM281 include diagnosis, prevention and treatment of diseases and clinical conditions associated with MFAP4.

MFTC (Accession NP_110407.2) is another GAM281 target gene, herein designated TARGET GENE. MFTC BINDING SITE is a target binding site found in the 3' untranslated region of mRNA encoded by MFTC, corresponding to a target binding site such as BINDING SITE I, BINDING SITE II or BINDING SITE III of FIG. 8. Table 4 illustrates the complementarity of the nucleotide sequences of MFTC BINDING SITE, designated SEQ ID:16545, to the nucleotide sequence of GAM281 RNA, herein designated GAM RNA, also designated SEQ ID:278.

Another function of GAM281 is therefore inhibition of MFTC (Accession NP_110407.2). Accordingly, utilities of GAM281 include diagnosis, prevention and treatment of diseases and clinical conditions associated with MFTC.

Mannosyl (alpha-1,6-)-glycoprotein beta-1,2-n-acetylglucosaminyltransferase (MGAT2, Accession NP_079374.1) is another GAM281 target gene, herein designated TARGET GENE. MGAT2 BINDING SITE is a target binding site found in the 3' untranslated region of multiple transcripts of mRNA encoded by MGAT2, corresponding to a target binding site such as BINDING SITE I, BINDING SITE II or BINDING SITE III of FIG. 8. Table 4 illustrates the complementarity of the nucleotide sequences of MGAT2 BINDING SITE, designated SEQ ID:9699, to the nucleotide sequence of GAM281 RNA, herein designated GAM RNA, also designated SEQ ID:278.

Another function of GAM281 is therefore inhibition of Mannosyl (alpha-1,6-)-glycoprotein beta-1,2-n-acetylglucosaminyltransferase (MGAT2, Accession NP_079374.1). Accordingly, utilities of GAM281 include diagnosis, prevention and treatment of diseases and clinical conditions associated with MGAT2.

MGC10200 (Accession NP_659497.1) is another GAM281 target gene, herein designated TARGET GENE. MGC10200 BINDING SITE is a target binding site found in the 3' untranslated region of mRNA encoded by MGC10200, corresponding to a target binding site such as BINDING SITE I, BINDING SITE II or BINDING SITE III of FIG. 8. Table 4 illustrates the complementarity of the nucleotide sequences of MGC10200 BINDING SITE, designated SEQ ID:5781, to the nucleotide sequence of GAM281 RNA, herein designated GAM RNA, also designated SEQ ID:278.

Another function of GAM281 is therefore inhibition of MGC10200 (Accession NP_659497.1). Accordingly, utilities of GAM281 include diagnosis, prevention and treatment of diseases and clinical conditions associated with MGC10200.

MGC10772 (Accession NP_085044.2) is another GAM281 target gene, herein designated TARGET GENE. MGC10772 BINDING SITE1 and MGC10772 BINDING SITE2 are target binding sites found in untranslated regions of mRNA encoded by MGC10772, corresponding to target binding sites such as BINDING SITE I, BINDING SITE II or BINDING SITE III of FIG. 8. Table 4 illustrates the complementarity of the nucleotide sequences of MGC10772 BINDING SITE1 and MGC10772 BINDING SITE2, designated SEQ ID:6519 and SEQ ID:5386 respectively, to the nucleotide sequence of GAM281 RNA, herein designated GAM RNA, also designated SEQ ID:278.

Another function of GAM281 is therefore inhibition of MGC10772 (Accession NP_085044.2). Accordingly, utilities of GAM281 include diagnosis, prevention and treatment of diseases and clinical conditions associated with MGC10772.

MGC10818 (Accession NP_085045.2) is another GAM281 target gene, herein designated TARGET GENE. MGC10818 BINDING SITE is a target binding site found in the 3' untranslated region of mRNA encoded by MGC10818, corresponding to a target binding site such as BINDING SITE I, BINDING SITE II or BINDING SITE III of FIG. 8. Table 4 illustrates the complementarity of the nucleotide sequences of MGC10818 BINDING SITE, designated SEQ ID:2199, to the nucleotide sequence of GAM281 RNA, herein designated GAM RNA, also designated SEQ ID:278.

Another function of GAM281 is therefore inhibition of MGC10818 (Accession NP_085045.2). Accordingly, utilities of GAM281 include diagnosis, prevention and treatment of diseases and clinical conditions associated with MGC10818.

MGC11102 (Accession NP_115701.2) is another GAM281 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:17609, to the nucleotide sequence of GAM281 RNA, herein designated GAM RNA, also designated SEQ ID:278.

Another function of GAM281 is therefore inhibition of MGC11102 (Accession NP_115701.2). Accordingly, utilities of GAM281 include diagnosis, prevention and treatment of diseases and clinical conditions associated with MGC11102.

MGC12262 (Accession NP_116085.1) is another GAM281 target gene, herein designated TARGET GENE. MGC12262 BINDING SITE1 and MGC12262 BINDING SITE2 are target binding sites found in untranslated regions of mRNA encoded by MGC12262, corresponding to target binding sites such as BINDING SITE I, BINDING SITE II or BINDING SITE III of FIG. 8. Table 4 illustrates the complementarity of the nucleotide sequences of MGC12262 BINDING SITE1 and MGC12262 BINDING SITE2, designated SEQ ID:4245 and SEQ ID:12220 respectively, to the nucleotide sequence of GAM281 RNA, herein designated GAM RNA, also designated SEQ ID:278.

Another function of GAM281 is therefore inhibition of MGC12262 (Accession NP_116085.1). Accordingly, utilities of GAM281 include diagnosis, prevention and treatment of diseases and clinical conditions associated with MGC12262.

MGC12518 (Accession NP_291026.1) is another GAM281 target gene, herein designated TARGET GENE. MGC12518 BINDING SITE is a target binding site found in the 3' untranslated region of mRNA encoded by MGC12518, corresponding to a target binding site such as BINDING SITE I, BINDING SITE II or BINDING SITE III of FIG. 8. Table 4 illustrates the complementarity of the nucleotide sequences of MGC12518 BINDING SITE, designated SEQ ID:18251, to the nucleotide sequence of GAM281 RNA, herein designated GAM RNA, also designated SEQ ID:278.

Another function of GAM281 is therefore inhibition of MGC12518 (Accession NP_291026.1). Accordingly, utilities of GAM281 include diagnosis, prevention and treatment of diseases and clinical conditions associated with MGC12518.

MGC12760 (Accession NP_116112.1) is another GAM281 target gene, herein designated TARGET GENE. MGC12760 BINDING SITE is a target binding site found in the 5' untranslated region of mRNA encoded by MGC12760, corresponding to a target binding site such as BINDING SITE I, BINDING SITE II or BINDING SITE III of FIG. 8. Table 4 illustrates the complementarity of the nucleotide sequences of MGC12760 BINDING SITE, designated SEQ ID:10178, to the nucleotide sequence of GAM281 RNA, herein designated GAM RNA, also designated SEQ ID:278.

Another function of GAM281 is therefore inhibition of MGC12760 (Accession NP_116112.1). Accordingly, utilities of GAM281 include diagnosis, prevention and treatment of diseases and clinical conditions associated with MGC12760.

MGC13017 (Accession NP_542387.1) is another GAM281 target gene, herein designated TARGET GENE. MGC13017 BINDING SITE is a target binding site found in the 3' untranslated region of mRNA encoded by MGC13017, corresponding to a target binding site such as BINDING SITE I, BINDING SITE II or BINDING SITE III of FIG. 8. Table 4 illustrates the complementarity of the nucleotide sequences of MGC13017 BINDING SITE, designated SEQ ID:11562, to the nucleotide sequence of GAM281 RNA, herein designated GAM RNA, also designated SEQ ID:278.

Another function of GAM281 is therefore inhibition of MGC13017 (Accession NP_542387.1). Accordingly, utilities of GAM281 include diagnosis, prevention and treatment of diseases and clinical conditions associated with MGC13017.

MGC13024 (Accession NP_689501.1) is another GAM281 target gene, herein designated TARGET GENE. MGC13024 BINDING SITE is a target binding site found in the 3' untranslated region of mRNA encoded by MGC13024, corresponding to a target binding site such as BINDING SITE I, BINDING SITE II or BINDING SITE III of FIG. 8. Table 4 illustrates the complementarity of the nucleotide sequences of MGC13024 BINDING SITE, designated SEQ ID:13564, to the nucleotide sequence of GAM281 RNA, herein designated GAM RNA, also designated SEQ ID:278.

Another function of GAM281 is therefore inhibition of MGC13024 (Accession NP_689501.1). Accordingly, utilities of GAM281 include diagnosis, prevention and treatment of diseases and clinical conditions associated with MGC13024.

MGC13138 (Accession NP_219363.1) is another GAM281 target gene, herein designated TARGET GENE. MGC13138 BINDING SITE1 and MGC13138 BINDING SITE2 are target binding sites found in untranslated regions of mRNA encoded by MGC13138, corresponding to target binding sites such as BINDING SITE I, BINDING SITE II or BINDING SITE III of FIG. 8. Table 4 illustrates the complementarity of the nucleotide sequences of MGC13138 BINDING SITE1 and MGC13138 BINDING SITE2, designated SEQ ID:6646 and SEQ ID:9543 respectively, to the nucleotide sequence of GAM281 RNA, herein designated GAM RNA, also designated SEQ ID:278.

Another function of GAM281 is therefore inhibition of MGC13138 (Accession NP_219363.1). Accordingly, utilities of GAM281 include diagnosis, prevention and treatment of diseases and clinical conditions associated with MGC13138.

MGC13170 (Accession NP_116101.1) is another GAM281 target gene, herein designated TARGET GENE. MGC13170 BINDING SITE is a target binding site found in the 3' untranslated region of mRNA encoded by MGC13170, corresponding to a target binding site such as BINDING SITE I, BINDING SITE II or BINDING SITE III of FIG. 8. Table 4 illustrates the complementarity of the nucleotide sequences of MGC13170 BINDING SITE, designated SEQ ID:20116, to the nucleotide sequence of GAM281 RNA, herein designated GAM RNA, also designated SEQ ID:278.

Another function of GAM281 is therefore inhibition of MGC13170 (Accession NP_116101.1). Accordingly, utilities of GAM281 include diagnosis, prevention and treatment of diseases and clinical conditions associated with MGC13170.

MGC13204 (Accession NP_113653.1) is another GAM281 target gene, herein designated TARGET GENE. MGC13204 BINDING SITE is a target binding site found in the 3' untranslated region of mRNA encoded by MGC13204, corresponding to a target binding site such as BINDING SITE I, BINDING SITE II or BINDING SITE III of FIG. 8. Table 4 illustrates the complementarity of the nucleotide sequences of MGC13204 BINDING SITE, designated SEQ ID:9494, to the nucleotide sequence of GAM281 RNA, herein designated GAM RNA, also designated SEQ ID:278.

Another function of GAM281 is therefore inhibition of MGC13204 (Accession NP_113653.1). Accordingly, utilities of GAM281 include diagnosis, prevention and treatment of diseases and clinical conditions associated with MGC13204.

MGC14289 (Accession NP_542391.1) is another GAM281 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:3677, to the nucleotide sequence of GAM281 RNA, herein designated GAM RNA, also designated SEQ ID:278.

Another function of GAM281 is therefore inhibition of MGC14289 (Accession NP_542391.1). Accordingly, utilities of GAM281 include diagnosis, prevention and treatment of diseases and clinical conditions associated with MGC14289.

MGC14436 (Accession NP_116286.1) is another GAM281 target gene, herein designated TARGET GENE. MGC14436 BINDING SITE is a target binding site found in the 5' untranslated region of mRNA encoded by MGC14436, corresponding to a target binding site such as BINDING SITE I, BINDING SITE II or BINDING SITE III of FIG. 8. Table 4 illustrates the complementarity of the nucleotide sequences of MGC14436 BINDING SITE, designated SEQ ID:17347, to the nucleotide sequence of GAM281 RNA, herein designated GAM RNA, also designated SEQ ID:278.

Another function of GAM281 is therefore inhibition of MGC14436 (Accession NP_116286.1). Accordingly, utilities of GAM281 include diagnosis, prevention and treatment of diseases and clinical conditions associated with MGC14436.

MGC14836 (Accession NP_219480.1) is another GAM281 target gene, herein designated TARGET GENE. MGC14836 BINDING SITE is a target binding site found in the 3' untranslated region of mRNA encoded by MGC14836, corresponding to a target binding site such as BINDING SITE I, BINDING SITE II or BINDING SITE III of FIG. 8. Table 4 illustrates the complementarity of the nucleotide sequences of MGC14836 BINDING SITE, designated SEQ ID:15044, to the nucleotide sequence of GAM281 RNA, herein designated GAM RNA, also designated SEQ ID:278.

Another function of GAM281 is therefore inhibition of MGC14836 (Accession NP_219480.1). Accordingly, utilities of GAM281 include diagnosis, prevention and treatment of diseases and clinical conditions associated with MGC14836.

MGC15606 (Accession NP_659474.1) is another GAM281 target gene, herein designated TARGET GENE. MGC15606 BINDING SITE is a target binding site found in the 5' untranslated region of mRNA encoded by MGC15606, corresponding to a target binding site such as BINDING SITE I, BINDING SITE II or BINDING SITE III of FIG. 8. Table 4 illustrates the complementarity of the nucleotide sequences of MGC15606 BINDING SITE, designated SEQ ID:10968, to the nucleotide sequence of GAM281 RNA, herein designated GAM RNA, also designated SEQ ID:278.

Another function of GAM281 is therefore inhibition of MGC15606 (Accession NP_659474.1). Accordingly, utilities of GAM281 include diagnosis, prevention and treatment of diseases and clinical conditions associated with MGC15606.

MGC15668 (Accession NP_116145.1) is another GAM281 target gene, herein designated TARGET GENE. MGC15668 BINDING SITE is a target binding site found in the 3' untranslated region of mRNA encoded by MGC15668, corresponding to a target binding site such as BINDING SITE I, BINDING SITE II or BINDING SITE III of FIG. 8. Table 4 illustrates the complementarity of the nucleotide sequences of MGC15668 BINDING SITE, designated SEQ ID:3620, to the nucleotide sequence of GAM281 RNA, herein designated GAM RNA, also designated SEQ ID:278.

Another function of GAM281 is therefore inhibition of MGC15668 (Accession NP_116145.1). Accordingly, utilities of GAM281 include diagnosis, prevention and treatment of diseases and clinical conditions associated with MGC15668.

MGC15873 (Accession NP_116309.1) is another GAM281 target gene, herein designated TARGET GENE. MGC15873 BINDING SITE is a target binding site found in the 5' untranslated region of mRNA encoded by MGC15873, corresponding to a target binding site such as BINDING SITE I, BINDING SITE II or BINDING SITE III of FIG. 8. Table 4 illustrates the complementarity of the nucleotide sequences of MGC15873 BINDING SITE, designated SEQ ID:2894, to the nucleotide sequence of GAM281 RNA, herein designated GAM RNA, also designated SEQ ID:278.

Another function of GAM281 is therefore inhibition of MGC15873 (Accession NP_116309.1). Accordingly, utilities of GAM281 include diagnosis, prevention and treatment of diseases and clinical conditions associated with MGC15873.

MGC16179 (Accession NP_116155.1) is another GAM281 target gene, herein designated TARGET GENE. MGC16179 BINDING SITE is a target binding site found in the 3' untranslated region of mRNA encoded by MGC16179, corresponding to a target binding site such as BINDING SITE I, BINDING SITE II or BINDING SITE III of FIG. 8. Table 4 illustrates the complementarity of the nucleotide sequences of MGC16179 BINDING SITE, designated SEQ ID:15168, to the nucleotide sequence of GAM281 RNA, herein designated GAM RNA, also designated SEQ ID:278.

Another function of GAM281 is therefore inhibition of MGC16179 (Accession NP_116155.1). Accordingly, utilities of GAM281 include diagnosis, prevention and treatment of diseases and clinical conditions associated with MGC16179.

MGC1842 (Accession XP_037797.2) is another GAM281 target gene, herein designated TARGET GENE. MGC1842 BINDING SITE is a target binding site found in the 3' untranslated region of mRNA encoded by MGC1842, corresponding to a target binding site such as BINDING SITE I, BINDING SITE II or BINDING SITE III of FIG. 8. Table 4 illustrates the complementarity of the nucleotide sequences of MGC1842 BINDING SITE, designated SEQ ID:15046, to the nucleotide sequence of GAM281 RNA, herein designated GAM RNA, also designated SEQ ID:278.

Another function of GAM281 is therefore inhibition of MGC1842 (Accession XP_037797.2). Accordingly, utilities of GAM281 include diagnosis, prevention and treatment of diseases and clinical conditions associated with MGC1842.

MGC21675 (Accession NP_443093.1) is another GAM281 target gene, herein designated TARGET GENE. MGC21675 BINDING SITE is a target binding site found in the 3' untranslated region of mRNA encoded by MGC21675, corresponding to a target binding site such as BINDING SITE I, BINDING SITE II or BINDING SITE III of FIG. 8. Table 4 illustrates the complementarity of the nucleotide sequences of MGC21675 BINDING SITE, designated SEQ ID:16916, to the nucleotide sequence of GAM281 RNA, herein designated GAM RNA, also designated SEQ ID:278.

Another function of GAM281 is therefore inhibition of MGC21675 (Accession NP_443093.1). Accordingly, utilities of GAM281 include diagnosis, prevention and treatment of diseases and clinical conditions associated with MGC21675.

MGC2306 (Accession NP_002041.2) is another GAM281 target gene, herein designated TARGET GENE. MGC2306 BINDING SITE is a target binding site found in the 3' untranslated region of mRNA encoded by MGC2306, corresponding to a target binding site such as BINDING SITE I, BINDING SITE II or BINDING SITE III of FIG. 8. Table 4 illustrates the complementarity of the nucleotide sequences of MGC2306 BINDING SITE, designated SEQ ID:7160, to the nucleotide sequence of GAM281 RNA, herein designated GAM RNA, also designated SEQ ID:278.

Another function of GAM281 is therefore inhibition of MGC2306 (Accession NP_002041.2). Accordingly, utilities of GAM281 include diagnosis, prevention and treatment of diseases and clinical conditions associated with MGC2306.

MGC2474 (Accession NP_076420.1) is another GAM281 target gene, herein designated TARGET GENE. MGC2474 BINDING SITE1 and MGC2474 BINDING SITE2 are target binding sites found in untranslated regions of mRNA encoded by MGC2474, corresponding to target binding sites such as BINDING SITE I, BINDING SITE II or BINDING SITE III of FIG. 8. Table 4 illustrates the complementarity of the nucleotide sequences of MGC2474 BINDING SITE1 and MGC2474 BINDING SITE2, designated SEQ ID:7797 and SEQ ID:18665 respectively, to the nucleotide sequence of GAM281 RNA, herein designated GAM RNA, also designated SEQ ID:278.

Another function of GAM281 is therefore inhibition of MGC2474 (Accession NP_076420.1). Accordingly, utilities of GAM281 include diagnosis, prevention and treatment of diseases and clinical conditions associated with MGC2474.

MGC2477 (Accession NP_077004.1) is another GAM281 target gene, herein designated TARGET GENE. MGC2477 BINDING SITE1 through MGC2477 BINDING SITE3 are target binding sites found in untranslated regions of mRNA encoded by MGC2477, corresponding to target binding sites such as BINDING SITE I, BINDING SITE II or BINDING SITE III of FIG. 8. Table 4 illustrates the complementarity of the nucleotide sequences of MGC2477 BINDING SITE1 through MGC2477 BINDING SITE3, designated SEQ ID:5609, SEQ ID:19729 and SEQ ID:8610 respectively, to the nucleotide sequence of GAM281 RNA, herein designated GAM RNA, also designated SEQ ID:278.

Another function of GAM281 is therefore inhibition of MGC2477 (Accession NP_077004.1). Accordingly, utilities of GAM281 include diagnosis, prevention and treatment of diseases and clinical conditions associated with MGC2477.

MGC2603 (Accession NP_076942.1) is another GAM281 target gene, herein designated TARGET GENE. MGC2603 BINDING SITE is a target binding site found in the 3' untranslated region of mRNA encoded by MGC2603, corresponding to a target binding site such as BINDING SITE I, BINDING SITE II or BINDING SITE III of FIG. 8. Table 4 illustrates the complementarity of the nucleotide sequences of MGC2603 BINDING SITE, designated SEQ ID:5845, to the nucleotide sequence of GAM281 RNA, herein designated GAM RNA, also designated SEQ ID:278.

Another function of GAM281 is therefore inhibition of MGC2603 (Accession NP_076942.1). Accordingly, utilities of GAM281 include diagnosis, prevention and treatment of diseases and clinical conditions associated with MGC2603.

MGC26914 (Accession NP_659413.1) is another GAM281 target gene, herein designated TARGET GENE. MGC26914 BINDING SITE is a target binding site found in the 3' untranslated region of mRNA encoded by MGC26914, corresponding to a target binding site such as BINDING SITE I, BINDING SITE II or BINDING SITE III of FIG. 8. Table 4 illustrates the complementarity of the nucleotide sequences of MGC26914 BINDING SITE, designated SEQ ID:15104, to the nucleotide sequence of GAM281 RNA, herein designated GAM RNA, also designated SEQ ID:278.

Another function of GAM281 is therefore inhibition of MGC26914 (Accession NP_659413.1). Accordingly, utilities of GAM281 include diagnosis, prevention and treatment of diseases and clinical conditions associated with MGC26914.

MGC2718 (Accession NP_076972.2) is another GAM281 target gene, herein designated TARGET GENE. MGC2718 BINDING SITE is a target binding site found in the 3' untranslated region of mRNA encoded by MGC2718, corresponding to a target binding site such as BINDING SITE I, BINDING SITE II or BINDING SITE III of FIG. 8. Table 4 illustrates the complementarity of the nucleotide sequences of MGC2718 BINDING SITE, designated SEQ ID:3976, to the nucleotide sequence of GAM281 RNA, herein designated GAM RNA, also designated SEQ ID:278.

Another function of GAM281 is therefore inhibition of MGC2718 (Accession NP_076972.2). Accordingly, utilities of GAM281 include diagnosis, prevention and treatment of diseases and clinical conditions associated with MGC2718.

MGC27345 (Accession XP_300964.1) is another GAM281 target gene, herein designated TARGET GENE. MGC27345 BINDING SITE1 and MGC27345 BINDING SITE2 are target binding sites found in untranslated regions of multiple transcripts of mRNA encoded by MGC27345, corresponding to target binding sites such as BINDING SITE I, BINDING SITE II or BINDING SITE III of FIG. 8. Table 4 illustrates the complementarity of the nucleotide sequences of MGC27345 BINDING SITE1 and MGC27345 BINDING SITE2, designated SEQ ID:18352 and SEQ ID:19385 respectively, to the nucleotide sequence of GAM281 RNA, herein designated GAM RNA, also designated SEQ ID:278.

Another function of GAM281 is therefore inhibition of MGC27345 (Accession XP_300964.1). Accordingly, utilities of GAM281 include diagnosis, prevention and treatment of diseases and clinical conditions associated with MGC27345.

MGC29891 (Accession NP_653219.1) is another GAM281 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:14858, to the nucleotide sequence of GAM281 RNA, herein designated GAM RNA, also designated SEQ ID:278.

Another function of GAM281 is therefore inhibition of MGC29891 (Accession NP_653219.1). Accordingly, utilities of GAM281 include diagnosis, prevention and treatment of diseases and clinical conditions associated with MGC29891.

MGC29898 (Accession NP_659485.1) is another GAM281 target gene, herein designated TARGET GENE. MGC29898 BINDING SITE is a target binding site found in the 3' untranslated region of mRNA encoded by MGC29898, corresponding to a target binding site such as BINDING SITE I, BINDING SITE II or BINDING SITE III of FIG. 8. Table 4 illustrates the complementarity of the nucleotide sequences of MGC29898 BINDING SITE, designated SEQ ID:16672, to the nucleotide sequence of GAM281 RNA, herein designated GAM RNA, also designated SEQ ID:278.

Another function of GAM281 is therefore inhibition of MGC29898 (Accession NP_659485.1). Accordingly, utilities of GAM281 include diagnosis, prevention and treatment of diseases and clinical conditions associated with MGC29898.

MGC3113 (Accession NP_076940.1) is another GAM281 target gene, herein designated TARGET GENE. MGC3113 BINDING SITE is a target binding site found in the 3' untranslated region of mRNA encoded by MGC3113, corresponding to a target binding site such as BINDING SITE I, BINDING SITE II or BINDING SITE III of FIG. 8. Table 4 illustrates the complementarity of the nucleotide sequences of MGC3113 BINDING SITE, designated SEQ ID:10136, to the nucleotide sequence of GAM281 RNA, herein designated GAM RNA, also designated SEQ ID:278.

Another function of GAM281 is therefore inhibition of MGC3113 (Accession NP_076940.1). Accordingly, utilities of GAM281 include diagnosis, prevention and treatment of diseases and clinical conditions associated with MGC3113.

MGC3207 (Accession NP_115661.1) is another GAM281 target gene, herein designated TARGET GENE. MGC3207 BINDING SITE1 and MGC3207 BINDING SITE2 are target binding sites found in untranslated regions of mRNA encoded by MGC3207, corresponding to target binding sites such as BINDING SITE I, BINDING SITE II or BINDING SITE III of FIG. 8. Table 4 illustrates the complementarity of the nucleotide sequences of MGC3207 BINDING SITE1 and MGC3207 BINDING SITE2, designated SEQ ID:5157 and SEQ ID:13812 respectively, to the nucleotide sequence of GAM281 RNA, herein designated GAM RNA, also designated SEQ ID:278.

Another function of GAM281 is therefore inhibition of MGC3207 (Accession NP_115661.1). Accordingly, utilities of GAM281 include diagnosis, prevention and treatment of diseases and clinical conditions associated with MGC3207.

MGC3329 (Accession NP_076991.2) is another GAM281 target gene, herein designated TARGET GENE. MGC3329 BINDING SITE is a target binding site found in the 3' untranslated region of mRNA encoded by MGC3329, corresponding to a target binding site such as BINDING SITE I, BINDING SITE II or BINDING SITE III of FIG. 8. Table 4 illustrates the complementarity of the nucleotide sequences of MGC3329 BINDING SITE, designated SEQ ID:4477, to the nucleotide sequence of GAM281 RNA, herein designated GAM RNA, also designated SEQ ID:278.

Another function of GAM281 is therefore inhibition of MGC3329 (Accession NP_076991.2). Accordingly, utilities of GAM281 include diagnosis, prevention and treatment of diseases and clinical conditions associated with MGC3329.

MGC33486 (Accession NP_694998.1) is another GAM281 target gene, herein designated TARGET GENE. MGC33486 BINDING SITE is a target binding site found in the 5' untranslated region of mRNA encoded by MGC33486, corresponding to a target binding site such as BINDING SITE I, BINDING SITE II or BINDING SITE III of FIG. 8. Table 4 illustrates the complementarity of the nucleotide sequences of MGC33486 BINDING SITE, designated SEQ ID:11585, to the nucleotide sequence of GAM281 RNA, herein designated GAM RNA, also designated SEQ ID:278.

Another function of GAM281 is therefore inhibition of MGC33486 (Accession NP_694998.1). Accordingly, utilities of GAM281 include diagnosis, prevention and treatment of diseases and clinical conditions associated with MGC33486.

MGC33637 (Accession NP_689809.1) is another GAM281 target gene, herein designated TARGET GENE. MGC33637 BINDING SITE is a target binding site found in the 3' untranslated region of mRNA encoded by MGC33637, corresponding to a target binding site such as BINDING SITE I, BINDING SITE II or BINDING SITE III of FIG. 8. Table 4 illustrates the complementarity of the nucleotide sequences of MGC33637 BINDING SITE, designated SEQ ID:12069, to the nucleotide sequence of GAM281 RNA, herein designated GAM RNA, also designated SEQ ID:278.

Another function of GAM281 is therefore inhibition of MGC33637 (Accession NP_689809.1). Accordingly, utilities of GAM281 include diagnosis, prevention and treatment of diseases and clinical conditions associated with MGC33637.

MGC33887 (Accession NP_659473.1) is another GAM281 target gene, herein designated TARGET GENE. MGC33887 BINDING SITE is a target binding site found in the 3' untranslated region of mRNA encoded by MGC33887, corresponding to a target binding site such as BINDING SITE I, BINDING SITE II or BINDING SITE III of FIG. 8. Table 4 illustrates the complementarity of the nucleotide sequences of MGC33887 BINDING SITE, designated SEQ ID:8724, to the nucleotide sequence of GAM281 RNA, herein designated GAM RNA, also designated SEQ ID:278.

Another function of GAM281 is therefore inhibition of MGC33887 (Accession NP_659473.1). Accordingly, utilities of GAM281 include diagnosis, prevention and treatment of diseases and clinical conditions associated with MGC33887.

MGC34034 (Accession NP_694956.1) is another GAM281 target gene, herein designated TARGET GENE. MGC34034 BINDING SITE is a target binding site found in the 5' untranslated region of mRNA encoded by MGC34034, corresponding to a target binding site such as BINDING SITE I, BINDING SITE II or BINDING SITE III of FIG. 8. Table 4 illustrates the complementarity of the nucleotide sequences of MGC34034 BINDING SITE, designated SEQ ID:9529, to the nucleotide sequence of GAM281 RNA, herein designated GAM RNA, also designated SEQ ID:278.

Another function of GAM281 is therefore inhibition of MGC34034 (Accession NP_694956.1). Accordingly, utilities of GAM281 include diagnosis, prevention and treatment of diseases and clinical conditions associated with MGC34034.

MGC34079 (Accession NP_689688.1) is another GAM281 target gene, herein designated TARGET GENE. MGC34079 BINDING SITE is a target binding site found in the 3' untranslated region of mRNA encoded by MGC34079, corresponding to a target binding site such as BINDING SITE I, BINDING SITE II or BINDING SITE III of FIG. 8. Table 4 illustrates the complementarity of the nucleotide sequences of MGC34079 BINDING SITE, designated SEQ ID:19817, to the nucleotide sequence of GAM281 RNA, herein designated GAM RNA, also designated SEQ ID:278.

Another function of GAM281 is therefore inhibition of MGC34079 (Accession NP_689688.1). Accordingly, utilities of GAM281 include diagnosis, prevention and treatment of diseases and clinical conditions associated with MGC34079.

MGC34132 (Accession XP_291029.1) is another GAM281 target gene, herein designated TARGET GENE. MGC34132 BINDING SITE1 and MGC34132 BINDING SITE2 are target binding sites found in untranslated regions of mRNA encoded by MGC34132, corresponding to target binding sites such as BINDING SITE I, BINDING SITE II or BINDING SITE III of FIG. 8. Table 4 illustrates the complementarity of the nucleotide sequences of MGC34132 BINDING SITE1 and MGC34132 BINDING SITE2, designated SEQ ID:9087 and SEQ ID:8232 respectively, to the nucleotide sequence of GAM281 RNA, herein designated GAM RNA, also designated SEQ ID:278.

Another function of GAM281 is therefore inhibition of MGC34132 (Accession XP_291029.1). Accordingly, utilities of GAM281 include diagnosis, prevention and treatment of diseases and clinical conditions associated with MGC34132.

MGC35136 (Accession NP_689640.1) is another GAM281 target gene, herein designated TARGET GENE. MGC35136 BINDING SITE is a target binding site found in the 5' untranslated region of mRNA encoded by MGC35136, corresponding to a target binding site such as BINDING SITE I, BINDING SITE II or BINDING SITE III of FIG. 8. Table 4 illustrates the complementarity of the nucleotide sequences of MGC35136 BINDING SITE, designated SEQ ID:8535, to the nucleotide sequence of GAM281 RNA, herein designated GAM RNA, also designated SEQ ID:278.

Another function of GAM281 is therefore inhibition of MGC35136 (Accession NP_689640.1). Accordingly, utilities of GAM281 include diagnosis, prevention and treatment of diseases and clinical conditions associated with MGC35136.

MGC35440 (Accession NP_694952.1) is another GAM281 target gene, herein designated TARGET GENE. MGC35440 BINDING SITE1 and MGC35440 BINDING SITE2 are target binding sites found in untranslated regions of mRNA encoded by MGC35440, corresponding to target binding sites such as BINDING SITE I, BINDING SITE II or BINDING SITE III of FIG. 8. Table 4 illustrates the complementarity of the nucleotide sequences of MGC35440 BINDING SITE1 and MGC35440 BINDING SITE2, designated SEQ ID:7378 and SEQ ID:6886 respectively, to the nucleotide sequence of GAM281 RNA, herein designated GAM RNA, also designated SEQ ID:278.

Another function of GAM281 is therefore inhibition of MGC35440 (Accession NP_694952.1). Accordingly, utilities of GAM281 include diagnosis, prevention and treatment of diseases and clinical conditions associated with MGC35440.

MGC35468 (Accession NP_694976.1) is another GAM281 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:7484, to the nucleotide sequence of GAM281 RNA, herein designated GAM RNA, also designated SEQ ID:278.

Another function of GAM281 is therefore inhibition of MGC35468 (Accession NP_694976.1). Accordingly, utilities of GAM281 include diagnosis, prevention and treatment of diseases and clinical conditions associated with MGC35468.

MGC3771 (Accession NP_112232.1) is another GAM281 target gene, herein designated TARGET GENE. MGC3771 BINDING SITE is a target binding site found in the 5' untranslated region of mRNA encoded by MGC3771, corresponding to a target binding site such as BINDING SITE I, BINDING SITE II or BINDING SITE III of FIG. 8. Table 4 illustrates the complementarity of the nucleotide sequences of MGC3771 BINDING SITE, designated SEQ ID:3231, to the nucleotide sequence of GAM281 RNA, herein designated GAM RNA, also designated SEQ ID:278.

Another function of GAM281 is therefore inhibition of MGC3771 (Accession NP_112232.1). Accordingly, utilities of GAM281 include diagnosis, prevention and treatment of diseases and clinical conditions associated with MGC3771.

MGC39320 (Accession NP_689642.2) is another GAM281 target gene, herein designated TARGET GENE. MGC39320 BINDING SITE is a target binding site found in the 3' untranslated region of mRNA encoded by MGC39320, corresponding to a target binding site such as BINDING SITE I, BINDING SITE II or BINDING SITE III of FIG. 8. Table 4 illustrates the complementarity of the nucleotide sequences of MGC39320 BINDING SITE, designated SEQ ID:13428, to the nucleotide sequence of GAM281 RNA, herein designated GAM RNA, also designated SEQ ID:278.

Another function of GAM281 is therefore inhibition of MGC39320 (Accession NP_689642.2). Accordingly, utilities of GAM281 include diagnosis, prevention and treatment of diseases and clinical conditions associated with MGC39320.

MGC40157 (Accession NP_689563.1) is another GAM281 target gene, herein designated TARGET GENE. MGC40157 BINDING SITE is a target binding site found in the 3' untranslated region of mRNA encoded by MGC40157, corresponding to a target binding site such as BINDING SITE I, BINDING SITE II or BINDING SITE III of FIG. 8. Table 4 illustrates the complementarity of the nucleotide sequences of MGC40157 BINDING SITE, designated SEQ ID:10743, to the nucleotide sequence of GAM281 RNA, herein designated GAM RNA, also designated SEQ ID:278.

Another function of GAM281 is therefore inhibition of MGC40157 (Accession NP_689563.1). Accordingly, utilities of GAM281 include diagnosis, prevention and treatment of diseases and clinical conditions associated with MGC40157.

MGC40168 (Accession NP_714920.1) is another GAM281 target gene, herein designated TARGET GENE. MGC40168 BINDING SITE is a target binding site found in the 5' untranslated region of mRNA encoded by MGC40168, corresponding to a target binding site such as BINDING SITE I, BINDING SITE II or BINDING SITE III of FIG. 8. Table 4 illustrates the complementarity of the nucleotide sequences of MGC40168 BINDING SITE, designated SEQ ID:7220, to the nucleotide sequence of GAM281 RNA, herein designated GAM RNA, also designated SEQ ID:278.

Another function of GAM281 is therefore inhibition of MGC40168 (Accession NP_714920.1). Accordingly, utilities of GAM281 include diagnosis, prevention and treatment of diseases and clinical conditions associated with MGC40168.

MGC40579 (Accession NP_689989.1) is another GAM281 target gene, herein designated TARGET GENE. MGC40579 BINDING SITE1 and MGC40579 BINDING SITE2 are target binding sites found in untranslated regions of mRNA encoded by MGC40579, corresponding to target binding sites such as BINDING SITE I, BINDING SITE II or BINDING SITE III of FIG. 8. Table 4 illustrates the complementarity of the nucleotide sequences of MGC40579 BINDING SITE1 and MGC40579 BINDING SITE2, designated SEQ ID:16218 and SEQ ID:19220 respectively, to the nucleotide sequence of GAM281 RNA, herein designated GAM RNA, also designated SEQ ID:278.

Another function of GAM281 is therefore inhibition of MGC40579 (Accession NP_689989.1). Accordingly, utilities of GAM281 include diagnosis, prevention and treatment of diseases and clinical conditions associated with MGC40579.

MGC4171 (Accession NP_077283.1) is another GAM281 target gene, herein designated TARGET GENE. MGC4171 BINDING SITE is a target binding site found in the 5' untranslated region of mRNA encoded by MGC4171, corresponding to a target binding site such as BINDING SITE I, BINDING SITE II or BINDING SITE III of FIG. 8. Table 4 illustrates the complementarity of the nucleotide sequences of MGC4171 BINDING SITE, designated SEQ ID:10555, to the nucleotide sequence of GAM281 RNA, herein designated GAM RNA, also designated SEQ ID:278.

Another function of GAM281 is therefore inhibition of MGC4171 (Accession NP_077283.1). Accordingly, utilities of GAM281 include diagnosis, prevention and treatment of diseases and clinical conditions associated with MGC4171.

MGC4248 (Accession NP_115709.2) is another GAM281 target gene, herein designated TARGET GENE. MGC4248 BINDING SITE1 and MGC4248 BINDING SITE2 are target binding sites found in untranslated regions of mRNA encoded by MGC4248, corresponding to target binding sites such as BINDING SITE I, BINDING SITE II or BINDING SITE III of FIG. 8. Table 4 illustrates the complementarity of the nucleotide sequences of MGC4248 BINDING SITE1 and MGC4248 BINDING SITE2, designated SEQ ID:3338 and SEQ ID:8539 respectively, to the nucleotide sequence of GAM281 RNA, herein designated GAM RNA, also designated SEQ ID:278.

Another function of GAM281 is therefore inhibition of MGC4248 (Accession NP_115709.2). Accordingly, utilities of GAM281 include diagnosis, prevention and treatment of diseases and clinical conditions associated with MGC4248.

MGC43122 (Accession NP_775784.1) is another GAM281 target gene, herein designated TARGET GENE. MGC43122 BINDING SITE is a target binding site found in the 3' untranslated region of mRNA encoded by MGC43122, corresponding to a target binding site such as BINDING SITE I, BINDING SITE II or BINDING SITE III of FIG. 8. Table 4 illustrates the complementarity of the nucleotide sequences of MGC43122 BINDING SITE, designated SEQ ID:12783, to the nucleotide sequence of GAM281 RNA, herein designated GAM RNA, also designated SEQ ID:278.

Another function of GAM281 is therefore inhibition of MGC43122 (Accession NP_775784.1). Accordingly, utilities of GAM281 include diagnosis, prevention and treatment of diseases and clinical conditions associated with MGC43122.

MGC4606 (Accession NP_078792.1) is another GAM281 target gene, herein designated TARGET GENE. MGC4606 BINDING SITE is a target binding site found in the 3' untranslated region of mRNA encoded by MGC4606, corresponding to a target binding site such as BINDING SITE I, BINDING SITE II or BINDING SITE III of FIG. 8. Table 4 illustrates the complementarity of the nucleotide sequences of MGC4606 BINDING SITE, designated SEQ ID:11069, to the nucleotide sequence of GAM281 RNA, herein designated GAM RNA, also designated SEQ ID:278.

Another function of GAM281 is therefore inhibition of MGC4606 (Accession NP_078792.1). Accordingly, utilities of GAM281 include diagnosis, prevention and treatment of diseases and clinical conditions associated with MGC4606.

MGC50452 (Accession NP_775733.1) is another GAM281 target gene, herein designated TARGET GENE. MGC50452 BINDING SITE is a target binding site found in the 3' untranslated region of mRNA encoded by MGC50452, corresponding to a target binding site such as BINDING SITE I, BINDING SITE II or BINDING SITE III of FIG. 8. Table 4 illustrates the complementarity of the nucleotide sequences of MGC50452 BINDING SITE, designated SEQ ID:16867, to the nucleotide sequence of GAM281 RNA, herein designated GAM RNA, also designated SEQ ID:278.

Another function of GAM281 is therefore inhibition of MGC50452 (Accession NP_775733.1). Accordingly, utilities of GAM281 include diagnosis, prevention and treatment of diseases and clinical conditions associated with MGC50452.

MGC50559 (Accession NP_776163.1) is another GAM281 target gene, herein designated TARGET GENE. MGC50559 BINDING SITE1 and MGC50559 BINDING SITE2 are target binding sites found in untranslated regions of mRNA encoded by MGC50559, corresponding to target binding sites such as BINDING SITE I, BINDING SITE II or BINDING SITE III of FIG. 8. Table 4 illustrates the complementarity of the nucleotide sequences of MGC50559 BINDING SITE1 and MGC50559 BINDING SITE2, designated SEQ ID:15151 and SEQ ID:11296 respectively, to the nucleotide sequence of GAM281 RNA, herein designated GAM RNA, also designated SEQ ID:278.

Another function of GAM281 is therefore inhibition of MGC50559 (Accession NP_776163.1). Accordingly, utilities of GAM281 include diagnosis, prevention and treatment of diseases and clinical conditions associated with MGC50559.

MGC5149 (Accession XP_051200.2) is another GAM281 target gene, herein designated TARGET GENE. MGC5149 BINDING SITE is a target binding site found in the 3' untranslated region of mRNA encoded by MGC5149, corresponding to a target binding site such as BINDING SITE I, BINDING SITE II or BINDING SITE III of FIG. 8. Table 4 illustrates the complementarity of the nucleotide sequences of MGC5149 BINDING SITE, designated SEQ ID:13759, to the nucleotide sequence of GAM281 RNA, herein designated GAM RNA, also designated SEQ ID:278.

Another function of GAM281 is therefore inhibition of MGC5149 (Accession XP_051200.2). Accordingly, utilities of GAM281 include diagnosis, prevention and treatment of diseases and clinical conditions associated with MGC5149.

MGC9912 (Accession NP_542395.1) is another GAM281 target gene, herein designated TARGET GENE. MGC9912 BINDING SITE is a target binding site found in the 3' untranslated region of mRNA encoded by MGC9912, corresponding to a target binding site such as BINDING SITE I, BINDING SITE II or BINDING SITE III of FIG. 8. Table 4 illustrates the complementarity of the nucleotide sequences of MGC9912 BINDING SITE, designated SEQ ID:12221, to the nucleotide sequence of GAM281 RNA, herein designated GAM RNA, also designated SEQ ID:278.

Another function of GAM281 is therefore inhibition of MGC9912 (Accession NP_542395.1). Accordingly, utilities of GAM281 include diagnosis, prevention and treatment of diseases and clinical conditions associated with MGC9912.

MGRN1 (Accession XP_048119.4) is another GAM281 target gene, herein designated TARGET GENE. MGRN1 BINDING SITE is a target binding site found in the 3' untranslated region of mRNA encoded by MGRN1, corresponding to a target binding site such as BINDING SITE I, BINDING SITE II or BINDING SITE III of FIG. 8. Table 4 illustrates the complementarity of the nucleotide sequences of MGRN1 BINDING SITE, designated SEQ ID:16616, to the nucleotide sequence of GAM281 RNA, herein designated GAM RNA, also designated SEQ ID:278.

Another function of GAM281 is therefore inhibition of MGRN1 (Accession XP_048119.4). Accordingly, utilities of GAM281 include diagnosis, prevention and treatment of diseases and clinical conditions associated with MGRN1.

Mhc class ii transactivator (MHC2TA, Accession NP_000237.1) is another GAM281 target gene, herein designated TARGET GENE. MHC2TA BINDING SITE1 through MHC2TA BINDING SITE3 are target binding sites found in untranslated regions of mRNA encoded by MHC2TA, corresponding to target binding sites such as BINDING SITE I, BINDING SITE II or BINDING SITE III of FIG. 8. Table 4 illustrates the complementarity of the nucleotide sequences of MHC2TA BINDING SITE1 through MHC2TA BINDING SITE3, designated SEQ ID:783, SEQ ID:2053 and SEQ ID:922 respectively, to the nucleotide sequence of GAM281 RNA, herein designated GAM RNA, also designated SEQ ID:278.

Another function of GAM281 is therefore inhibition of Mhc class ii transactivator (MHC2TA, Accession NP_000237.1). Accordingly, utilities of GAM281 include diagnosis, prevention and treatment of diseases and clinical conditions associated with MHC2TA.

MIRAB13 (Accession XP_039236.6) is another GAM281 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:11523, to the nucleotide sequence of GAM281 RNA, herein designated GAM RNA, also designated SEQ ID:278.

Another function of GAM281 is therefore inhibition of MIRAB13 (Accession XP_039236.6). Accordingly, utilities of GAM281 include diagnosis, prevention and treatment of diseases and clinical conditions associated with MIRAB13.

MIRAB13 (Accession NP_203744.1) is another GAM281 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:11523, to the nucleotide sequence of GAM281 RNA, herein designated GAM RNA, also designated SEQ ID:278.

Another function of GAM281 is therefore inhibition of MIRAB13 (Accession NP_203744.1). Accordingly, utilities of GAM281 include diagnosis, prevention and treatment of diseases and clinical conditions associated with MIRAB13.

Makorin, ring finger protein, 4 (MKRN4, Accession NP_110384.1) is another GAM281 target gene, herein designated TARGET GENE. MKRN4 BINDING SITE is a target binding site found in the 3' untranslated region of mRNA encoded by MKRN4, corresponding to a target binding site such as BINDING SITE I, BINDING SITE II or BINDING SITE III of FIG. 8. Table 4 illustrates the complementarity of the nucleotide sequences of MKRN4 BINDING SITE, designated SEQ ID:12075, to the nucleotide sequence of GAM281 RNA, herein designated GAM RNA, also designated SEQ ID:278.

Another function of GAM281 is therefore inhibition of Makorin, ring finger protein, 4 (MKRN4, Accession NP_110384.1). Accordingly, utilities of GAM281 include diagnosis, prevention and treatment of diseases and clinical conditions associated with MKRN4.

Melan-a (MLANA, Accession NP_005502.1) is another GAM281 target gene, herein designated TARGET GENE. MLANA BINDING SITE is a target binding site found in the 3' untranslated region of mRNA encoded by MLANA, corresponding to a target binding site such as BINDING SITE I, BINDING SITE II or BINDING SITE III of FIG. 8. Table 4 illustrates the complementarity of the nucleotide sequences of MLANA BINDING SITE, designated SEQ ID:13029, to the nucleotide sequence of GAM281 RNA, herein designated GAM RNA, also designated SEQ ID:278.

Another function of GAM281 is therefore inhibition of Melan-a (MLANA, Accession NP_005502.1). Accordingly, utilities of GAM281 include diagnosis, prevention and treatment of diseases and clinical conditions associated with MLANA.

Megalencephalic leukoencephalopathy with subcortical cysts 1 (MLC1, Accession NP_055981.1) is another GAM281 target gene, herein designated TARGET GENE. MLC1 BINDING SITE is a target binding site found in the 3' untranslated region of multiple transcripts of mRNA encoded by MLC1, corresponding to a target binding site such as BINDING SITE I, BINDING SITE II or BINDING SITE III of FIG. 8. Table 4 illustrates the complementarity of the nucleotide sequences of MLC1 BINDING SITE, designated SEQ ID:19859, to the nucleotide sequence of GAM281 RNA, herein designated GAM RNA, also designated SEQ ID:278.

Another function of GAM281 is therefore inhibition of Megalencephalic leukoencephalopathy with subcortical cysts 1 (MLC1, Accession NP_055981.1). Accordingly, utilities of GAM281 include diagnosis, prevention and treatment of diseases and clinical conditions associated with MLC1.

Megalencephalic leukoencephalopathy with subcortical cysts 1 (MLC1, Accession NP_055981.1) is another GAM281 target gene, herein designated TARGET GENE. MLC1 BINDING SITE is a target binding site found in the 3' untranslated region of multiple transcripts of mRNA encoded by MLC1, corresponding to a target binding site such as BINDING SITE I, BINDING SITE II or BINDING SITE III of FIG. 8. Table 4 illustrates the complementarity of the nucleotide sequences of MLC1 BINDING SITE, designated SEQ ID:19859, to the nucleotide sequence of GAM281 RNA, herein designated GAM RNA, also designated SEQ ID:278.

Another function of GAM281 is therefore inhibition of Megalencephalic leukoencephalopathy with subcortical cysts 1 (MLC1, Accession NP_055981.1). Accordingly, utilities of GAM281 include diagnosis, prevention and treatment of diseases and clinical conditions associated with MLC1.

Megalencephalic leukoencephalopathy with subcortical cysts 1 (MLC1, Accession NP_631941.1) is another GAM281 target gene, herein designated TARGET GENE. MLC1 BINDING SITE is a target binding site found in the 3' untranslated region of multiple transcripts of mRNA encoded by MLC1, corresponding to a target binding site such as BINDING SITE I, BINDING SITE II or BINDING SITE III of FIG. 8. Table 4 illustrates the complementarity of the nucleotide sequences of MLC1 BINDING SITE, designated SEQ ID:19859, to the nucleotide sequence of GAM281 RNA, herein designated GAM RNA, also designated SEQ ID:278.

Another function of GAM281 is therefore inhibition of Megalencephalic leukoencephalopathy with subcortical cysts 1 (MLC1, Accession NP_631941.1). Accordingly, utilities of GAM281 include diagnosis, prevention and treatment of diseases and clinical conditions associated with MLC1.

Megalencephalic leukoencephalopathy with subcortical cysts 1 (MLC1, Accession NP_631941.1) is another GAM281 target gene, herein designated TARGET GENE. MLC1 BINDING SITE is a target binding site found in the 3' untranslated region of multiple transcripts of mRNA encoded by MLC1, corresponding to a target binding site such as BINDING SITE I, BINDING SITE II or BINDING SITE III of FIG. 8. Table 4 illustrates the complementarity of the nucleotide sequences of MLC1 BINDING SITE, designated SEQ ID:19859, to the nucleotide sequence of GAM281 RNA, herein designated GAM RNA, also designated SEQ ID:278.

Another function of GAM281 is therefore inhibition of Megalencephalic leukoencephalopathy with subcortical cysts 1 (MLC1, Accession NP_631941.1). Accordingly, utilities of GAM281 include diagnosis, prevention and treatment of diseases and clinical conditions associated with MLC1.

Melanoma-derived leucine zipper, extra-nuclear factor (MLZE, Accession NP_113603.1) is another GAM281 target gene, herein designated TARGET GENE. MLZE BINDING SITE is a target binding site found in the 5' untranslated region of mRNA encoded by MLZE, corresponding to a target binding site such as BINDING SITE I, BINDING SITE II or BINDING SITE III of FIG. 8. Table 4 illustrates the complementarity of the nucleotide sequences of MLZE BINDING SITE, designated SEQ ID:9728, to the nucleotide sequence of GAM281 RNA, herein designated GAM RNA, also designated SEQ ID:278.

Another function of GAM281 is therefore inhibition of Melanoma-derived leucine zipper, extra-nuclear factor (MLZE, Accession NP_113603.1). Accordingly, utilities of GAM281 include diagnosis, prevention and treatment of diseases and clinical conditions associated with MLZE.

Matrix metalloproteinase-like 1 (MMPL1, Accession NP_004133.1) is another GAM281 target gene, herein designated TARGET GENE. MMPL1 BINDING SITE is a target binding site found in the 3' untranslated region of mRNA encoded by MMPL1, corresponding to a target binding site such as BINDING SITE I, BINDING SITE II or BINDING SITE III of FIG. 8. Table 4 illustrates the complementarity of the nucleotide sequences of MMPL1 BINDING SITE, designated SEQ ID:4374, to the nucleotide sequence of GAM281 RNA, herein designated GAM RNA, also designated SEQ ID:278.

Another function of GAM281 is therefore inhibition of Matrix metalloproteinase-like 1 (MMPL1, Accession NP_004133.1). Accordingly, utilities of GAM281 include diagnosis, prevention and treatment of diseases and clinical conditions associated with MMPL1.

MO25 (Accession NP_057373.1) is another GAM281 target gene, herein designated TARGET GENE. MO25 BINDING SITE1 and MO25 BINDING SITE2 are target binding sites found in untranslated regions of mRNA encoded by MO25, corresponding to target binding sites such as BINDING SITE I, BINDING SITE II or BINDING SITE III of FIG. 8. Table 4 illustrates the complementarity of the nucleotide sequences of MO25 BINDING SITE1 and MO25 BINDING SITE2, designated SEQ ID:7980 and SEQ ID:2695 respectively, to the nucleotide sequence of GAM281 RNA, herein designated GAM RNA, also designated SEQ ID:278.

Another function of GAM281 is therefore inhibition of MO25 (Accession NP_057373.1). Accordingly, utilities of GAM281 include diagnosis, prevention and treatment of diseases and clinical conditions associated with MO25.

Modulator of apoptosis 1 (MOAP1, Accession NP_071434.2) is another GAM281 target gene, herein designated TARGET GENE. MOAP1 BINDING SITE is a target binding site found in the 3' untranslated region of mRNA encoded by MOAP1, corresponding to a target binding site such as BINDING SITE I, BINDING SITE II or BINDING SITE III of FIG. 8. Table 4 illustrates the complementarity of the nucleotide sequences of MOAP1 BINDING SITE, designated SEQ ID:1744, to the nucleotide sequence of GAM281 RNA, herein designated GAM RNA, also designated SEQ ID:278.

Another function of GAM281 is therefore inhibition of Modulator of apoptosis 1 (MOAP1, Accession NP_071434.2). Accordingly, utilities of GAM281 include diagnosis, prevention and treatment of diseases and clinical conditions associated with MOAP1.

moblak (Accession NP_570719.1) is another GAM281 target gene, herein designated TARGET GENE. moblak BINDING SITE is a target binding site found in the 3' untranslated region of mRNA encoded by moblak, corresponding to a target binding site such as BINDING SITE I, BINDING SITE II or BINDING SITE III of FIG. 8. Table 4 illustrates the complementarity of the nucleotide sequences of moblak BINDING SITE, designated SEQ ID:19657, to the nucleotide sequence of GAM281 RNA, herein designated GAM RNA, also designated SEQ ID:278.

Another function of GAM281 is therefore inhibition of moblak (Accession NP_570719.1). Accordingly, utilities of GAM281 include diagnosis, prevention and treatment of diseases and clinical conditions associated with moblak.

Molybdenum cofactor synthesis 3 (MOCS3, Accession NP_055299.1) is another GAM281 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:12064, to the nucleotide sequence of GAM281 RNA, herein designated GAM RNA, also designated SEQ ID:278.

Another function of GAM281 is therefore inhibition of Molybdenum cofactor synthesis 3 (MOCS3, Accession NP_055299.1). Accordingly, utilities of GAM281 include diagnosis, prevention and treatment of diseases and clinical conditions associated with MOCS3.

Myeloproliferative leukemia virus oncogene (MPL, Accession NP_005364.1) is another GAM281 target gene, herein designated TARGET GENE. MPL BINDING SITE1 and MPL BINDING SITE2 are target binding sites found in untranslated regions of mRNA encoded by MPL, corresponding to target binding sites such as BINDING SITE I, BINDING SITE II or BINDING SITE III of FIG. 8. Table 4 illustrates the complementarity of the nucleotide sequences of MPL BINDING SITE1 and MPL BINDING SITE2, designated SEQ ID:16608 and SEQ ID:11185 respectively, to the nucleotide sequence of GAM281 RNA, herein designated GAM RNA, also designated SEQ ID:278.

Another function of GAM281 is therefore inhibition of Myeloproliferative leukemia virus oncogene (MPL, Accession NP_005364.1). Accordingly, utilities of GAM281 include diagnosis, prevention and treatment of diseases and clinical conditions associated with MPL.

Mitochondrial ribosomal protein l10 (MRPL10, Accession NP_683685.1) is another GAM281 target gene, herein designated TARGET GENE. MRPL10 BINDING SITE is a target binding site found in the 5' untranslated region of multiple transcripts of mRNA encoded by MRPL10, corresponding to a target binding site such as BINDING SITE I, BINDING SITE II or BINDING SITE III of FIG. 8. Table 4 illustrates the complementarity of the nucleotide sequences of MRPL10 BINDING SITE, designated SEQ ID:13874, to the nucleotide sequence of GAM281 RNA, herein designated GAM RNA, also designated SEQ ID:278.

Another function of GAM281 is therefore inhibition of Mitochondrial ribosomal protein l10 (MRPL10, Accession NP_683685.1). Accordingly, utilities of GAM281 include diagnosis, prevention and treatment of diseases and clinical conditions associated with MRPL10.

Mitochondrial ribosomal protein l35 (MRPL35, Accession NP_057706.2) is another GAM281 target gene, herein designated TARGET GENE. MRPL35 BINDING SITE is a target binding site found in the 3' untranslated region of multiple transcripts of mRNA encoded by MRPL35, corresponding to a target binding site such as BINDING SITE I, BINDING SITE II or BINDING SITE III of FIG. 8. Table 4 illustrates the complementarity of the nucleotide sequences of MRPL35 BINDING SITE, designated SEQ ID:9545, to the nucleotide sequence of GAM281 RNA, herein designated GAM RNA, also designated SEQ ID:278.

Another function of GAM281 is therefore inhibition of Mitochondrial ribosomal protein l35 (MRPL35, Accession NP_057706.2). Accordingly, utilities of GAM281 include diagnosis, prevention and treatment of diseases and clinical conditions associated with MRPL35.

Mitochondrial ribosomal protein l44 (MRPL44, Accession NP_075066.1) is another GAM281 target gene, herein designated TARGET GENE. MRPL44 BINDING SITE is a target binding site found in the 3' untranslated region of mRNA encoded by MRPL44, corresponding to a target binding site such as BINDING SITE I, BINDING SITE II or BINDING SITE III of FIG. 8. Table 4 illustrates the complementarity of the nucleotide sequences of MRPL44 BINDING SITE, designated SEQ ID:14596, to the nucleotide sequence of GAM281 RNA, herein designated GAM RNA, also designated SEQ ID:278.

Another function of GAM281 is therefore inhibition of Mitochondrial ribosomal protein l44 (MRPL44, Accession NP_075066.1). Accordingly, utilities of GAM281 include diagnosis, prevention and treatment of diseases and clinical conditions associated with MRPL44.

Mitochondrial ribosomal protein l49 (MRPL49, Accession NP_004918.1) is another GAM281 target gene, herein designated TARGET GENE. MRPL49 BINDING SITE is a target binding site found in the 3' untranslated region of mRNA encoded by MRPL49, corresponding to a target binding site such as BINDING SITE I, BINDING SITE II or BINDING SITE III of FIG. 8. Table 4 illustrates the complementarity of the nucleotide sequences of MRPL49 BINDING SITE, designated SEQ ID:5438, to the nucleotide sequence of GAM281 RNA, herein designated GAM RNA, also designated SEQ ID:278.

Another function of GAM281 is therefore inhibition of Mitochondrial ribosomal protein l49 (MRPL49, Accession NP_004918.1). Accordingly, utilities of GAM281 include diagnosis, prevention and treatment of diseases and clinical conditions associated with MRPL49.

Mitochondrial ribosomal protein s27 (MRPS27, Accession NP_055899.1) is another GAM281 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:4179, to the nucleotide sequence of GAM281 RNA, herein designated GAM RNA, also designated SEQ ID:278.

Another function of GAM281 is therefore inhibition of Mitochondrial ribosomal protein s27 (MRPS27, Accession NP_055899.1). Accordingly, utilities of GAM281 include diagnosis, prevention and treatment of diseases and clinical conditions associated with MRPS27.

MSTP028 (Accession NP_114160.1) is another GAM281 target gene, herein designated TARGET GENE. MSTP028 BINDING SITE is a target binding site found in the 3' untranslated region of mRNA encoded by MSTP028, corresponding to a target binding site such as BINDING SITE I, BINDING SITE II or BINDING SITE III of FIG. 8. Table 4 illustrates the complementarity of the nucleotide sequences of MSTP028 BINDING SITE, designated SEQ ID:12951, to the nucleotide sequence of GAM281 RNA, herein designated GAM RNA, also designated SEQ ID:278.

Another function of GAM281 is therefore inhibition of MSTP028 (Accession NP_114160.1). Accordingly, utilities of GAM281 include diagnosis, prevention and treatment of diseases and clinical conditions associated with MSTP028.

MtFMT (Accession NP_640335.1) is another GAM281 target gene, herein designated TARGET GENE. MtFMT BINDING SITE is a target binding site found in the 3' untranslated region of mRNA encoded by MtFMT, corresponding to a target binding site such as BINDING SITE I, BINDING SITE II or BINDING SITE III of FIG. 8. Table 4 illustrates the complementarity of the nucleotide sequences of MtFMT BINDING SITE, designated SEQ ID:12918, to the nucleotide sequence of GAM281 RNA, herein designated GAM RNA, also designated SEQ ID:278.

Another function of GAM281 is therefore inhibition of MtFMT (Accession NP_640335.1). Accordingly, utilities of GAM281 include diagnosis, prevention and treatment of diseases and clinical conditions associated with MtFMT.

MTH2 (Accession NP_060753.1) is another GAM281 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:15874, to the nucleotide sequence of GAM281 RNA, herein designated GAM RNA, also designated SEQ ID:278.

Another function of GAM281 is therefore inhibition of MTH2 (Accession NP_060753.1). Accordingly, utilities of GAM281 include diagnosis, prevention and treatment of diseases and clinical conditions associated with MTH2.

5-methyltetrahydrofolate-homocysteine methyltransferase (MTR, Accession NP_000245.1) is another GAM281 target gene, herein designated TARGET GENE. MTR BINDING SITE is a target binding site found in the 3' untranslated region of mRNA encoded by MTR, corresponding to a target binding site such as BINDING SITE I, BINDING SITE II or BINDING SITE III of FIG. 8. Table 4 illustrates the complementarity of the nucleotide sequences of MTR BINDING SITE, designated SEQ ID:2028, to the nucleotide sequence of GAM281 RNA, herein designated GAM RNA, also designated SEQ ID:278.

Another function of GAM281 is therefore inhibition of 5-methyltetrahydrofolate-homocysteine methyltransferase (MTR, Accession NP_000245.1). Accordingly, utilities of GAM281 include diagnosis, prevention and treatment of diseases and clinical conditions associated with MTR.

MU (Accession NP_071368.1) is another GAM281 target gene, herein designated TARGET GENE. MU BINDING SITE is a target binding site found in the 3' untranslated region of mRNA encoded by MU, corresponding to a target binding site such as BINDING SITE I, BINDING SITE II or BINDING SITE III of FIG. 8. Table 4 illustrates the complementarity of the nucleotide sequences of MU BINDING SITE, designated SEQ ID:2453, to the nucleotide sequence of GAM281 RNA, herein designated GAM RNA, also designated SEQ ID:278.

Another function of GAM281 is therefore inhibition of MU (Accession NP_071368.1). Accordingly, utilities of GAM281 include diagnosis, prevention and treatment of diseases and clinical conditions associated with MU.

V-myc myelocytomatosis viral oncogene homolog 2 (avian) (MYCL2, Accession NP_005368.1) is another GAM281 target gene, herein designated TARGET GENE. MYCL2 BINDING SITE is a target binding site found in the 3' untranslated region of mRNA encoded by MYCL2, corresponding to a target binding site such as BINDING SITE I, BINDING SITE II or BINDING SITE III of FIG. 8. Table 4 illustrates the complementarity of the nucleotide sequences of MYCL2 BINDING SITE, designated SEQ ID:16868, to the nucleotide sequence of GAM281 RNA, herein designated GAM RNA, also designated SEQ ID:278.

Another function of GAM281 is therefore inhibition of V-myc myelocytomatosis viral oncogene homolog 2 (avian) (MYCL2, Accession NP_005368.1). Accordingly, utilities of GAM281 include diagnosis, prevention and treatment of diseases and clinical conditions associated with MYCL2.

MYLC2PL (Accession NP_612412.1) is another GAM281 target gene, herein designated TARGET GENE. MYLC2PL BINDING SITE is a target binding site found in the 5' untranslated region of mRNA encoded by MYLC2PL, corresponding to a target binding site such as BINDING SITE I, BINDING SITE II or BINDING SITE III of FIG. 8. Table 4 illustrates the complementarity of the nucleotide sequences of MYLC2PL BINDING SITE, designated SEQ ID:3580, to the nucleotide sequence of GAM281 RNA, herein designated GAM RNA, also designated SEQ ID:278.

Another function of GAM281 is therefore inhibition of MYLC2PL (Accession NP_612412.1). Accordingly, utilities of GAM281 include diagnosis, prevention and treatment of diseases and clinical conditions associated with MYLC2PL.

Myosin 5c (MYO5C, Accession NP_061198.1) is another GAM281 target gene, herein designated TARGET GENE. MYO5C BINDING SITE is a target binding site found in the 3' untranslated region of mRNA encoded by MYO5C, corresponding to a target binding site such as BINDING SITE I, BINDING SITE II or BINDING SITE III of FIG. 8. Table 4 illustrates the complementarity of the nucleotide sequences of MYO5C BINDING SITE, designated SEQ ID:4306, to the nucleotide sequence of GAM281 RNA, herein designated GAM RNA, also designated SEQ ID:278.

Another function of GAM281 is therefore inhibition of Myosin 5c (MYO5C, Accession NP_061198.1). Accordingly, utilities of GAM281 include diagnosis, prevention and treatment of diseases and clinical conditions associated with MYO5C.

NACT (Accession NP_808218.1) is another GAM281 target gene, herein designated TARGET GENE. NACT BINDING SITE is a target binding site found in the 3' untranslated region of mRNA encoded by NACT, corresponding to a target binding site such as BINDING SITE I, BINDING SITE II or BINDING SITE III of FIG. 8. Table 4 illustrates the complementarity of the nucleotide sequences of NACT BINDING SITE, designated SEQ ID:19968, to the nucleotide sequence of GAM281 RNA, herein designated GAM RNA, also designated SEQ ID:278.

Another function of GAM281 is therefore inhibition of NACT (Accession NP_808218.1). Accordingly, utilities of GAM281 include diagnosis, prevention and treatment of diseases and clinical conditions associated with NACT.

NALP12 (Accession NP_150639.1) is another GAM281 target gene, herein designated TARGET GENE. NALP12 BINDING SITE is a target binding site found in the 5' untranslated region of multiple transcripts of mRNA encoded by NALP12, corresponding to a target binding site such as BINDING SITE I, BINDING SITE II or BINDING SITE III of FIG. 8. Table 4 illustrates the complementarity of the nucleotide sequences of NALP12 BINDING SITE, designated SEQ ID:3395, to the nucleotide sequence of GAM281 RNA, herein designated GAM RNA, also designated SEQ ID:278.

Another function of GAM281 is therefore inhibition of NALP12 (Accession NP_150639.1). Accordingly, utilities of GAM281 include diagnosis, prevention and treatment of diseases and clinical conditions associated with NALP12.

Nanog (Accession NP_079141.1) is another GAM281 target gene, herein designated TARGET GENE. Nanog BINDING SITE is a target binding site found in the 3' untranslated region of mRNA encoded by Nanog, corresponding to a target binding site such as BINDING SITE I, BINDING SITE II or BINDING SITE III of FIG. 8. Table 4 illustrates the complementarity of the nucleotide sequences of Nanog BINDING SITE, designated SEQ ID:11523, to the nucleotide sequence of GAM281 RNA, herein designated GAM RNA, also designated SEQ ID:278.

Another function of GAM281 is therefore inhibition of Nanog (Accession NP_079141.1). Accordingly, utilities of GAM281 include diagnosis, prevention and treatment of diseases and clinical conditions associated with Nanog.

NCAG1 (Accession NP_115536.1) is another GAM281 target gene, herein designated TARGET GENE. NCAG1 BINDING SITE1 and NCAG1 BINDING SITE2 are target binding sites found in untranslated regions of mRNA encoded by NCAG1, corresponding to target binding sites such as BINDING SITE I, BINDING SITE II or BINDING SITE III of FIG. 8. Table 4 illustrates the complementarity of the nucleotide sequences of NCAG1 BINDING SITE1 and NCAG1 BINDING SITE2, designated SEQ ID:3933 and SEQ ID:3766 respectively, to the nucleotide sequence of GAM281 RNA, herein designated GAM RNA, also designated SEQ ID:278.

Another function of GAM281 is therefore inhibition of NCAG1 (Accession NP_115536.1). Accordingly, utilities of GAM281 include diagnosis, prevention and treatment of diseases and clinical conditions associated with NCAG1.

Nuclear receptor coactivator 6 (NCOA6, Accession NP_054790.1) is another GAM281 target gene, herein designated TARGET GENE. NCOA6 BINDING SITE1 and NCOA6 BINDING SITE2 are target binding sites found in untranslated regions of mRNA encoded by NCOA6, corresponding to target binding sites such as BINDING SITE I, BINDING SITE II or BINDING SITE III of FIG. 8. Table 4 illustrates the complementarity of the nucleotide sequences of NCOA6 BINDING SITE1 and NCOA6 BINDING SITE2, designated SEQ ID:12826 and SEQ ID:19446 respectively, to the nucleotide sequence of GAM281 RNA, herein designated GAM RNA, also designated SEQ ID:278.

Another function of GAM281 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM281 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Nuclear receptor coactivator 6 interacting protein (NCOA6IP, Accession NP_079107.5) is another GAM281 target gene, herein designated TARGET GENE. NCOA6IP BINDING SITE is a target binding site found in the 3' untranslated region of mRNA encoded by NCOA6IP, corresponding to a target binding site such as BINDING SITE I, BINDING SITE II or BINDING SITE III of FIG. 8. Table 4 illustrates the complementarity of the nucleotide sequences of NCOA6IP BINDING SITE, designated SEQ ID:8841, to the nucleotide sequence of GAM281 RNA, herein designated GAM RNA, also designated SEQ ID:278.

Another function of GAM281 is therefore inhibition of Nuclear receptor coactivator 6 interacting protein (NCOA6IP, Accession NP_079107.5). Accordingly, utilities of GAM281 include diagnosis, prevention and treatment of diseases and clinical conditions associated with NCOA6IP.

NDP52 (Accession NP_005822.1) is another GAM281 target gene, herein designated TARGET GENE. NDP52 BINDING SITE is a target binding site found in the 3' untranslated region of mRNA encoded by NDP52, corresponding to a target binding site such as BINDING SITE I, BINDING SITE II or BINDING SITE III of FIG. 8. Table 4 illustrates the complementarity of the nucleotide sequences of NDP52 BINDING SITE, designated SEQ ID:15337, to the nucleotide sequence of GAM281 RNA, herein designated GAM RNA, also designated SEQ ID:278.

Another function of GAM281 is therefore inhibition of NDP52 (Accession NP_005822.1). Accordingly, utilities of GAM281 include diagnosis, prevention and treatment of diseases and clinical conditions associated with NDP52.

Ndrg family member 3 (NDRG3, Accession NP_114402.1) is another GAM281 target gene, herein designated TARGET GENE. NDRG3 BINDING SITE is a target binding site found in the 3' untranslated region of multiple transcripts of mRNA encoded by NDRG3, corresponding to a target binding site such as BINDING SITE I, BINDING SITE II or BINDING SITE III of FIG. 8. Table 4 illustrates the complementarity of the nucleotide sequences of NDRG3 BINDING SITE, designated SEQ ID:15102, to the nucleotide sequence of GAM281 RNA, herein designated GAM RNA, also designated SEQ ID:278.

Another function of GAM281 is therefore inhibition of Ndrg family member 3 (NDRG3, Accession NP_114402.1). Accordingly, utilities of GAM281 include diagnosis, prevention and treatment of diseases and clinical conditions associated with NDRG3.

Ndrg family member 4 (NDRG4, Accession NP_075061.1) is another GAM281 target gene, herein designated TARGET GENE. NDRG4 BINDING SITE is a target binding site found in the 3' untranslated region of multiple transcripts of mRNA encoded by NDRG4, corresponding to a target binding site such as BINDING SITE I, BINDING SITE II or BINDING SITE III of FIG. 8. Table 4 illustrates the complementarity of the nucleotide sequences of NDRG4 BINDING SITE, designated SEQ ID:6180, to the nucleotide sequence of GAM281 RNA, herein designated GAM RNA, also designated SEQ ID:278.

Another function of GAM281 is therefore inhibition of Ndrg family member 4 (NDRG4, Accession NP_075061.1). Accordingly, utilities of GAM281 include diagnosis, prevention and treatment of diseases and clinical conditions associated with NDRG4.

Ndrg family member 4 (NDRG4, Accession NP_065198.1) is another GAM281 target gene, herein designated TARGET GENE. NDRG4 BINDING SITE is a target binding site found in the 3' untranslated region of multiple transcripts of mRNA encoded by NDRG4, corresponding to a target binding site such as BINDING SITE I, BINDING SITE II or BINDING SITE III of FIG. 8. Table 4 illustrates the complementarity of the nucleotide sequences of NDRG4 BINDING SITE, designated SEQ ID:6180, to the nucleotide sequence of GAM281 RNA, herein designated GAM RNA, also designated SEQ ID:278.

Another function of GAM281 is therefore inhibition of Ndrg family member 4 (NDRG4, Accession NP_065198.1). Accordingly, utilities of GAM281 include diagnosis, prevention and treatment of diseases and clinical conditions associated with NDRG4.

Nadh dehydrogenase (ubiquinone) 1, subcomplex unknown, 2, 14.5 kda (NDUFC2, Accession NP_004540.1) is another GAM281 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:10192, to the nucleotide sequence of GAM281 RNA, herein designated GAM RNA, also designated SEQ ID:278.

Another function of GAM281 is therefore inhibition of Nadh dehydrogenase (ubiquinone) 1, subcomplex unknown, 2, 14.5 kda (NDUFC2, Accession NP_004540.1). Accordingly, utilities of GAM281 include diagnosis, prevention and treatment of diseases and clinical conditions associated with NDUFC2.

Nadh dehydrogenase (ubiquinone) fe-s protein 1, 75 kda (nadh-coenzyme q reductase) (NDUFS1, Accession NP_004997.3) is another GAM281 target gene, herein designated TARGET GENE. NDUFS1 BINDING SITE is a target binding site found in the 3' untranslated region of mRNA encoded by NDUFS1, corresponding to a target binding site such as BINDING SITE I, BINDING SITE II or BINDING SITE III of FIG. 8. Table 4 illustrates the complementarity of the nucleotide sequences of NDUFS1 BINDING SITE, designated SEQ ID:20168, to the nucleotide sequence of GAM281 RNA, herein designated GAM RNA, also designated SEQ ID:278.

Another function of GAM281 is therefore inhibition of Nadh dehydrogenase (ubiquinone) fe-s protein 1, 75 kda (nadh-coenzyme q reductase) (NDUFS1, Accession NP_004997.3). Accordingly, utilities of GAM281 include diagnosis, prevention and treatment of diseases and clinical conditions associated with NDUFS1.

Sialidase 3 (membrane sialidase) (NEU3, Accession NP_006647.2) is another GAM281 target gene, herein designated TARGET GENE. NEU3 BINDING SITE is a target binding site found in the 5' untranslated region of mRNA encoded by NEU3, corresponding to a target binding site such as BINDING SITE I, BINDING SITE II or BINDING SITE III of FIG. 8. Table 4 illustrates the complementarity of the nucleotide sequences of NEU3 BINDING SITE, designated SEQ ID:12075, to the nucleotide sequence of GAM281 RNA, herein designated GAM RNA, also designated SEQ ID:278.

Another function of GAM281 is therefore inhibition of Sialidase 3 (membrane sialidase) (NEU3, Accession NP_006647.2). Accordingly, utilities of GAM281 include diagnosis, prevention and treatment of diseases and clinical conditions associated with NEU3.

Neurofibromin 2 (bilateral acoustic neuroma) (NF2, Accession NP_057502.1) is another GAM281 target gene, herein designated TARGET GENE. NF2 BINDING SITE is a target binding site found in the 5' untranslated region of multiple transcripts of mRNA encoded by NF2, corresponding to a target binding site such as BINDING SITE I, BINDING SITE II or BINDING SITE III of FIG. 8. Table 4 illustrates the complementarity of the nucleotide sequences of NF2 BINDING SITE, designated SEQ ID:9169, to the nucleotide sequence of GAM281 RNA, herein designated GAM RNA, also designated SEQ ID:278.

Another function of GAM281 is therefore inhibition of Neurofibromin 2 (bilateral acoustic neuroma) (NF2, Accession NP_057502.1). Accordingly, utilities of GAM281 include diagnosis, prevention and treatment of diseases and clinical conditions associated with NF2.

Non-pou domain containing, octamer-binding (NONO, Accession NP_031389.2) is another GAM281 target gene, herein designated TARGET GENE. NONO BINDING SITE is a target binding site found in the 3' untranslated region of mRNA encoded by NONO, corresponding to a target binding site such as BINDING SITE I, BINDING SITE II or BINDING SITE III of FIG. 8. Table 4 illustrates the complementarity of the nucleotide sequences of NONO BINDING SITE, designated SEQ ID:17960, to the nucleotide sequence of GAM281 RNA, herein designated GAM RNA, also designated SEQ ID:278.

Another function of GAM281 is therefore inhibition of Non-pou domain containing, octamer-binding (NONO, Accession NP_031389.2), a gene which is a nuclear protein which contains RNA recognition motifs. Accordingly, utilities of GAM281 include diagnosis, prevention and treatment of diseases and clinical conditions associated with NONO.

The function of NONO and its association with various diseases and clinical conditions, has been established by previous studies, as described hereinabove with reference to GAM189.1. NOSIP (Accession NP_057037.1) is another GAM281 target gene, herein designated TARGET GENE. NOSIP BINDING SITE is a target binding site found in the 5' untranslated region of mRNA encoded by NOSIP, corresponding to a target binding site such as BINDING SITE I, BINDING SITE II or BINDING SITE III of FIG. 8. Table 4 illustrates the complementarity of the nucleotide sequences of NOSIP BINDING SITE, designated SEQ ID:7311, to the nucleotide sequence of GAM281 RNA, herein designated GAM RNA, also designated SEQ ID:278.

Another function of GAM281 is therefore inhibition of NOSIP (Accession NP_057037.1). Accordingly, utilities of GAM281 include diagnosis, prevention and treatment of diseases and clinical conditions associated with NOSIP.

Notch homolog 2 (drosophila) (NOTCH2, Accession NP_077719.2) is another GAM281 target gene, herein designated TARGET GENE. NOTCH2 BINDING SITE is a target binding site found in the 5' untranslated region of mRNA encoded by NOTCH2, corresponding to a target binding site such as BINDING SITE I, BINDING SITE II or BINDING SITE III of FIG. 8. Table 4 illustrates the complementarity of the nucleotide sequences of NOTCH2 BINDING SITE, designated SEQ ID:18893, to the nucleotide sequence of GAM281 RNA, herein designated GAM RNA, also designated SEQ ID:278.

Another function of GAM281 is therefore inhibition of Notch homolog 2 (drosophila) (NOTCH2, Accession NP_077719.2), a gene which is moderately similar to a region of murine Notch1 and contains an ankyrin repeat. Accordingly, utilities of GAM281 include diagnosis, prevention and treatment of diseases and clinical conditions associated with NOTCH2.

The function of NOTCH2 and its association with various diseases and clinical conditions, has been established by previous studies, as described hereinabove with reference to GAM47.1. Nucleoside phosphorylase (NP, Accession NP_000261.1) is another GAM281 target gene, herein designated TARGET GENE. NP BINDING SITE is a target binding site found in the 3' untranslated region of mRNA encoded by NP, corresponding to a target binding site such as BINDING SITE I, BINDING SITE II or BINDING SITE III of FIG. 8. Table 4 illustrates the complementarity of the nucleotide sequences of NP BINDING SITE, designated SEQ ID:13473, to the nucleotide sequence of GAM281 RNA, herein designated GAM RNA, also designated SEQ ID:278.

Another function of GAM281 is therefore inhibition of Nucleoside phosphorylase (NP, Accession NP_000261.1). Accordingly, utilities of GAM281 include diagnosis, prevention and treatment of diseases and clinical conditions associated with NP.

NPCR (Accession NP_660361.1) is another GAM281 target gene, herein designated TARGET GENE. NPCR BINDING SITE is a target binding site found in the 5' untranslated region of mRNA encoded by NPCR, corresponding to a target binding site such as BINDING SITE I, BINDING SITE II or BINDING SITE III of FIG. 8. Table 4 illustrates the complementarity of the nucleotide sequences of NPCR BINDING SITE, designated SEQ ID:5959, to the nucleotide sequence of GAM281 RNA, herein designated GAM RNA, also designated SEQ ID:278.

Another function of GAM281 is therefore inhibition of NPCR (Accession NP_660361.1). Accordingly, utilities of GAM281 diagnosis, prevention and treatment of diseases and clinical conditions associated with NPCR.

Neuronal pentraxin receptor (NPTXR, Accession NP_055108.2) is another GAM281 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:5189, to the nucleotide sequence of GAM281 RNA, herein designated GAM RNA, also designated SEQ ID:278.

Another function of GAM281 is therefore inhibition of Neuronal pentraxin receptor (NPTXR, Accession NP_055108.2). Accordingly, utilities of GAM281 include diagnosis, prevention and treatment of diseases and clinical conditions associated with NPTXR.

Neuronal pentraxin receptor (NPTXR, Accession NP_478058.1) is another GAM281 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:5189, to the nucleotide sequence of GAM281 RNA, herein designated GAM RNA, also designated SEQ ID:278.

Another function of GAM281 is therefore inhibition of Neuronal pentraxin receptor (NPTXR, Accession NP_478058.1). Accordingly, utilities of GAM281 include diagnosis, prevention and treatment of diseases and clinical conditions associated with NPTXR.

Nad(p)h dehydrogenase, quinone 1 (NQO1, Accession NP_000894.1) is another GAM281 target gene, herein designated TARGET GENE. NQO1 BINDING SITE is a target binding site found in the 3' untranslated region of mRNA encoded by NQO1, corresponding to a target binding site such as BINDING SITE I, BINDING SITE II or BINDING SITE III of FIG. 8. Table 4 illustrates the complementarity of the nucleotide sequences of NQO1 BINDING SITE, designated SEQ ID:14855, to the nucleotide sequence of GAM281 RNA, herein designated GAM RNA, also designated SEQ ID:278.

Another function of GAM281 is therefore inhibition of Nad(p)h dehydrogenase, quinone 1 (NQO1, Accession NP_000894.1), a gene which is cytochrome b5 reductase which reduces redox dyes and quinones. Accordingly, utilities of GAM281 include diagnosis, prevention and treatment of diseases and clinical conditions associated with NQO1.

The function of NQO1 and its association with various diseases and clinical conditions, has been established by previous studies, as described hereinabove with reference to GAM189.1. Nuclear receptor subfamily 2, group e, member 1 (NR2E1, Accession NP_003260.1) is another GAM281 target gene, herein designated TARGET GENE. NR2E1 BINDING SITE is a target binding site found in the 5' untranslated region of mRNA encoded by NR2E1, corresponding to a target binding site such as BINDING SITE I, BINDING SITE II or BINDING SITE III of FIG. 8. Table 4 illustrates the complementarity of the nucleotide sequences of NR2E1 BINDING SITE, designated SEQ ID:13178, to the nucleotide sequence of GAM281 RNA, herein designated GAM RNA, also designated SEQ ID:278.

Another function of GAM281 is therefore inhibition of Nuclear receptor subfamily 2, group e, member 1 (NR2E1, Accession NP_003260.1), a gene which may be required for brain development and be involved in the regulation of retinal development . Accordingly, utilities of GAM281 include diagnosis, prevention and treatment of diseases and clinical conditions associated with NR2E1.

The function of NR2E1 and its association with various diseases and clinical conditions, has been established by previous studies, as described hereinabove with reference to GAM189.1. NRLN1 (Accession NP_660277.1) is another GAM281 target gene, herein designated TARGET GENE. NRLN1 BINDING SITE is a target binding site found in the 5' untranslated region of mRNA encoded by NRLN1, corresponding to a target binding site such as BINDING SITE I, BINDING SITE II or BINDING SITE III of FIG. 8. Table 4 illustrates the complementarity of the nucleotide sequences of NRLN1 BINDING SITE, designated SEQ ID:15825, to the nucleotide sequence of GAM281 RNA, herein designated GAM RNA, also designated SEQ ID:278.

Another function of GAM281 is therefore inhibition of NRLN1 (Accession NP_660277.1). Accordingly, utilities of GAM281 include diagnosis, prevention and treatment of diseases and clinical conditions associated with NRLN1.

5'-nucleotidase, cytosolic ii (NT5C2, Accession NP_036361.1) is another GAM281 target gene, herein designated TARGET GENE. NT5C2 BINDING SITE is a target binding site found in the 5' untranslated region of mRNA encoded by NT5C2, corresponding to a target binding site such as BINDING SITE I, BINDING SITE II or BINDING SITE III of FIG. 8. Table 4 illustrates the complementarity of the nucleotide sequences of NT5C2 BINDING SITE, designated SEQ ID:4030, to the nucleotide sequence of GAM281 RNA, herein designated GAM RNA, also designated SEQ ID:278.

Another function of GAM281 is therefore inhibition of 5'-nucleotidase, cytosolic ii (NT5C2, Accession NP_036361.1). Accordingly, utilities of GAM281 include diagnosis, prevention and treatment of diseases and clinical conditions associated with NT5C2.

Nudix (nucleoside diphosphate linked moiety x)-type motif 4 (NUDT4, Accession NP_061967.2) is another GAM281 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:18879, to the nucleotide sequence of GAM281 RNA, herein designated GAM RNA, also designated SEQ ID:278.

Another function of GAM281 is therefore inhibition of Nudix (nucleoside diphosphate linked moiety x)-type motif 4 (NUDT4, Accession NP_061967.2). Accordingly, utilities of GAM281 include diagnosis, prevention and treatment of diseases and clinical conditions associated with NUDT4.

NUP43 (Accession NP_078923.2) is another GAM281 target gene, herein designated TARGET GENE. NUP43 BINDING SITE is a target binding site found in the 3' untranslated region of mRNA encoded by NUP43, corresponding to a target binding site such as BINDING SITE I, BINDING SITE II or BINDING SITE III of FIG. 8. Table 4 illustrates the complementarity of the nucleotide sequences of NUP43 BINDING SITE, designated SEQ ID:1900, to the nucleotide sequence of GAM281 RNA, herein designated GAM RNA, also designated SEQ ID:278.

Another function of GAM281 is therefore inhibition of NUP43 (Accession NP_078923.2). Accordingly, utilities of GAM281 include diagnosis, prevention and treatment of diseases and clinical conditions associated with NUP43.

Nucleoredoxin (NXN, Accession NP_071908.1) is another GAM281 target gene, herein designated TARGET GENE. NXN BINDING SITE is a target binding site found in the 3' untranslated region of mRNA encoded by NXN, corresponding to a target binding site such as BINDING SITE I, BINDING SITE II or BINDING SITE III of FIG. 8. Table 4 illustrates the complementarity of the nucleotide sequences of NXN BINDING SITE, designated SEQ ID:935, to the nucleotide sequence of GAM281 RNA, herein designated GAM RNA, also designated SEQ ID:278.

Another function of GAM281 is therefore inhibition of Nucleoredoxin (NXN, Accession NP_071908.1). Accordingly, utilities of GAM281 include diagnosis, prevention and treatment of diseases and clinical conditions associated with NXN.

Olfactory receptor, family 51, subfamily e, member 2 (OR51E2, Accession NP_110401.1) is another GAM281 target gene, herein designated TARGET GENE. OR51E2 BINDING SITE is a target binding site found in the 3' untranslated region of mRNA encoded by OR51E2, corresponding to a target binding site such as BINDING SITE I, BINDING SITE II or BINDING SITE III of FIG. 8. Table 4 illustrates the complementarity of the nucleotide sequences of OR51E2 BINDING SITE, designated SEQ ID:4096, to the nucleotide sequence of GAM281 RNA, herein designated GAM RNA, also designated SEQ ID:278.

Another function of GAM281 is therefore inhibition of Olfactory receptor, family 51, subfamily e, member 2 (OR51E2, Accession NP_110401.1). Accordingly, utilities of GAM281 include diagnosis, prevention and treatment of diseases and clinical conditions associated with OR51E2.

Origin recognition complex, subunit 1-like (yeast) (ORC1L, Accession NP_004144.1) is another GAM281 target gene, herein designated TARGET GENE. ORC1L BINDING SITE is a target binding site found in the 3' untranslated region of mRNA encoded by ORC1L, corresponding to a target binding site such as BINDING SITE I, BINDING SITE II or BINDING SITE III of FIG. 8. Table 4 illustrates the complementarity of the nucleotide sequences of ORC1L BINDING SITE, designated SEQ ID:17969, to the nucleotide sequence of GAM281 RNA, herein designated GAM RNA, also designated SEQ ID:278.

Another function of GAM281 is therefore inhibition of Origin recognition complex, subunit 1-like (yeast) (ORC1L, Accession NP_004144.1), a gene which may be required for initiation of DNA replication. Accordingly, utilities of GAM281 include diagnosis, prevention and treatment of diseases and clinical conditions associated with ORC1L.

The function of ORC1L and its association with various diseases and clinical conditions, has been established by previous studies, as described hereinabove with reference to GAM136.1. Oxysterol binding protein-like 2 (OSBPL2, Accession NP_055650.1) is another GAM281 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:7553, to the nucleotide sequence of GAM281 RNA, herein designated GAM RNA, also designated SEQ ID:278.

Another function of GAM281 is therefore inhibition of Oxysterol binding protein-like 2 (OSBPL2, Accession NP_055650.1). Accordingly, utilities of GAM281 include diagnosis, prevention and treatment of diseases and clinical conditions associated with OSBPL2.

Oxysterol binding protein-like 2 (OSBPL2, Accession NP_653081.1) is another GAM281 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:7553, to the nucleotide sequence of GAM281 RNA, herein designated GAM RNA, also designated SEQ ID:278.

Another function of GAM281 is therefore inhibition of Oxysterol binding protein-like 2 (OSBPL2, Accession NP_653081.1). Accordingly, utilities of GAM281 include diagnosis, prevention and treatment of diseases and clinical conditions associated with OSBPL2.

Otoancorin (OTOA, Accession NP_733764.1) is another GAM281 target gene, herein designated TARGET GENE. OTOA BINDING SITE is a target binding site found in the 5' untranslated region of multiple transcripts of mRNA encoded by OTOA, corresponding to a target binding site such as BINDING SITE I, BINDING SITE II or BINDING SITE III of FIG. 8. Table 4 illustrates the complementarity of the nucleotide sequences of OTOA BINDING SITE, designated SEQ ID:18386, to the nucleotide sequence of GAM281 RNA, herein designated GAM RNA, also designated SEQ ID:278.

Another function of GAM281 is therefore inhibition of Otoancorin (OTOA, Accession NP_733764.1). Accordingly, utilities of GAM281 include diagnosis, prevention and treatment of diseases and clinical conditions associated with OTOA.

P24B (Accession NP_031390.1) is another GAM281 target gene, herein designated TARGET GENE. P24B BINDING SITE is a target binding site found in the 3' untranslated region of mRNA encoded by P24B, corresponding to a target binding site such as BINDING SITE I, BINDING SITE II or BINDING SITE III of FIG. 8. Table 4 illustrates the complementarity of the nucleotide sequences of P24B BINDING SITE, designated SEQ ID:2381, to the nucleotide sequence of GAM281 RNA, herein designated GAM RNA, also designated SEQ ID:278.

Another function of GAM281 is therefore inhibition of P24B (Accession NP_031390.1). Accordingly, utilities of GAM281 include diagnosis, prevention and treatment of diseases and clinical conditions associated with P24B.

Purinergic receptor p2x, ligand-gated ion channel, 7 (P2RX7, Accession NP_803176.1) is another GAM281 target gene, herein designated TARGET GENE. P2RX7 BINDING SITE is a target binding site found in the 3' untranslated region of multiple transcripts of mRNA encoded by P2RX7, corresponding to a target binding site such as BINDING SITE I, BINDING SITE II or BINDING SITE III of FIG. 8. Table 4 illustrates the complementarity of the nucleotide sequences of P2RX7 BINDING SITE, designated SEQ ID:7388, to the nucleotide sequence of GAM281 RNA, herein designated GAM RNA, also designated SEQ ID:278.

Another function of GAM281 is therefore inhibition of Purinergic receptor p2x, ligand-gated ion channel, 7 (P2RX7, Accession NP_803176.1), a gene which responsible for atp-dependent lysis of macrophages and therefore may be associated with Chronic lymphatic leukemia. Accordingly, utilities of GAM281 include diagnosis, prevention and treatment of Chronic lymphatic leukemia, and of other diseases and clinical conditions associated with P2RX7.

The function of P2RX7 and its association with various diseases and clinical conditions, has been established by previous studies, as described hereinabove with reference to GAM72.1. Purinergic receptor p2x, ligand-gated ion channel, 7 (P2RX7, Accession NP_002553.2) is another GAM281 target gene, herein designated TARGET GENE. P2RX7 BINDING SITE is a target binding site found in the 3' untranslated region of multiple transcripts of mRNA encoded by P2RX7, corresponding to a target binding site such as BINDING SITE I, BINDING SITE II or BINDING SITE III of FIG. 8. Table 4 illustrates the complementarity of the nucleotide sequences of P2RX7 BINDING SITE, designated SEQ ID:7388, to the nucleotide sequence of GAM281 RNA, herein designated GAM RNA, also designated SEQ ID:278.

Another function of GAM281 is therefore inhibition of Purinergic receptor p2x, ligand-gated ion channel, 7 (P2RX7, Accession NP_002553.2), a gene which responsible for atp-dependent lysis of macrophages and therefore may be associated with Chronic lymphatic leukemia. Accordingly, utilities of GAM281 include diagnosis, prevention and treatment of Chronic lymphatic leukemia, and of other diseases and clinical conditions associated with P2RX7.

The function of P2RX7 and its association with various diseases and clinical conditions, has been established by previous studies, as described hereinabove with reference to GAM72.1. Purinergic receptor p2x-like 1, orphan receptor (P2RXL1, Accession NP_005437.1) is another GAM281 target gene, herein designated TARGET GENE. P2RXL1 BINDING SITE is a target binding site found in the 3' untranslated region of mRNA encoded by P2RXL1, corresponding to a target binding site such as BINDING SITE I, BINDING SITE II or BINDING SITE III of FIG. 8. Table 4 illustrates the complementarity of the nucleotide sequences of P2RXL1 BINDING SITE, designated SEQ ID:4425, to the nucleotide sequence of GAM281 RNA, herein designated GAM RNA, also designated SEQ ID:278.

Another function of GAM281 is therefore inhibition of Purinergic receptor p2x-like 1, orphan receptor (P2RXL1, Accession NP_005437.1). Accordingly, utilities of GAM281 include diagnosis, prevention and treatment of diseases and clinical conditions associated with P2RXL1.

P450RAI-2 (Accession NP_063938.1) is another GAM281 target gene, herein designated TARGET GENE. P450RAI-2 BINDING SITE is a target binding site found in the 3' untranslated region of mRNA encoded by P450RAI-2, corresponding to a target binding site such as BINDING SITE I, BINDING SITE II or BINDING SITE III of FIG. 8. Table 4 illustrates the complementarity of the nucleotide sequences of P450RAI-2 BINDING SITE, designated SEQ ID:18160, to the nucleotide sequence of GAM281 RNA, herein designated GAM RNA, also designated SEQ ID:278.

Another function of GAM281 is therefore inhibition of P450RAI-2 (Accession NP_063938.1). Accordingly, utilities of GAM281 include diagnosis, prevention and treatment of diseases and clinical conditions associated with P450RAI-2.

Phosphoribosylaminoimidazole carboxylase, phosphoribosylaminoimidazole succinocarboxamide synthetase (PAICS, Accession NP_006443.1) is another GAM281 target gene, herein designated TARGET GENE. PAICS BINDING SITE is a target binding site found in the 3' untranslated region of mRNA encoded by PAICS, corresponding to a target binding site such as BINDING SITE I, BINDING SITE II or BINDING SITE III of FIG. 8. Table 4 illustrates the complementarity of the nucleotide sequences of PAICS BINDING SITE, designated SEQ ID:16852, to the nucleotide sequence of GAM281 RNA, herein designated GAM RNA, also designated SEQ ID:278.

Another function of GAM281 is therefore inhibition of Phosphoribosylaminoimidazole carboxylase, phosphoribosylaminoimidazole succinocarboxamide synthetase (PAICS, Accession NP_006443.1), a gene which is required for purine biosynthesis. Accordingly, utilities of GAM281 include diagnosis, prevention and treatment of diseases and clinical conditions associated with PAICS.

The function of PAICS and its association with various diseases and clinical conditions, has been established by previous studies, as described hereinabove with reference to GAM96.1. Pas domain containing serine/threonine kinase (PASK, Accession NP_055963.1) is another GAM281 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:2769, to the nucleotide sequence of GAM281 RNA, herein designated GAM RNA, also designated SEQ ID:278.

Another function of GAM281 is therefore inhibition of Pas domain containing serine/threonine kinase (PASK, Accession NP_055963.1). Accordingly, utilities of GAM281 include diagnosis, prevention and treatment of diseases and clinical conditions associated with PASK.

Protocadherin alpha 9 (PCDHA9, Accession NP_054724.1) is another GAM281 target gene, herein designated TARGET GENE. PCDHA9 BINDING SITE1 and PCDHA9 BINDING SITE2 are target binding sites found in untranslated regions of multiple transcripts of mRNA encoded by PCDHA9, corresponding to target binding sites such as BINDING SITE I, BINDING SITE II or BINDING SITE III of FIG. 8. Table 4 illustrates the complementarity of the nucleotide sequences of PCDHA9 BINDING SITE1 and PCDHA9 BINDING SITE2, designated SEQ ID:16048 and SEQ ID:10427 respectively, to the nucleotide sequence of GAM281 RNA, herein designated GAM RNA, also designated SEQ ID:278.

Another function of GAM281 is therefore inhibition of Protocadherin alpha 9 (PCDHA9, Accession NP_054724.1), a gene which is a calcium-dependent cell-adhesion protein. Accordingly, utilities of GAM281 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Protocadherin beta 11 (PCDHB11, Accession NP_061754.1) is another GAM281 target gene, herein designated TARGET GENE. PCDHB11 BINDING SITE is a target binding site found in the 3' untranslated region of mRNA encoded by PCDHB11, corresponding to a target binding site such as BINDING SITE I, BINDING SITE II or BINDING SITE III of FIG. 8. Table 4 illustrates the complementarity of the nucleotide sequences of PCDHB11 BINDING SITE, designated SEQ ID:10723, to the nucleotide sequence of GAM281 RNA, herein designated GAM RNA, also designated SEQ ID:278.

Another function of GAM281 is therefore inhibition of Protocadherin beta 11 (PCDHB11, Accession NP_061754.1). Accordingly, utilities of GAM281 diagnosis, prevention and treatment of diseases and clinical conditions associated with PCDHB11.

Protocadherin beta 16 (PCDHB16, Accession NP_066008.1) is another GAM281 target gene, herein designated TARGET GENE. PCDHB16 BINDING SITE is a target binding site found in the 3' untranslated region of mRNA encoded by PCDHB16, corresponding to a target binding site such as BINDING SITE I, BINDING SITE II or BINDING SITE III of FIG. 8. Table 4 illustrates the complementarity of the nucleotide sequences of PCDHB16 BINDING SITE, designated SEQ ID:4617, to the nucleotide sequence of GAM281 RNA, herein designated GAM RNA, also designated SEQ ID:278.

Another function of GAM281 is therefore inhibition of Protocadherin beta 16 (PCDHB16, Accession NP_066008.1), a gene which is a potential calcium-dependent cell-adhesion protein. Accordingly, utilities of GAM281 include diagnosis, prevention and treatment of diseases and clinical conditions associated with PCDHB16.

The function of PCDHB16 and its association with various diseases and clinical conditions, has been established by previous studies, as described hereinabove with reference to GAM189.1. Protocadherin beta 9 (PCDHB9, Accession NP_061992.2) is another GAM281 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:11523, to the nucleotide sequence of GAM281 RNA, herein designated GAM RNA, also designated SEQ ID:278.

Another function of GAM281 is therefore inhibition of Protocadherin beta 9 (PCDHB9, Accession NP_061992.2), a gene which is a potential calcium-dependent cell-adhesion protein. Accordingly, utilities of GAM281 diagnosis, prevention and treatment of diseases and clinical conditions associated with PCDHB9.

The function of PCDHB9 and its association with various diseases and clinical conditions, has been established by previous studies, as described hereinabove with reference to GAM72.1. Phosducin-like (PDCL, Accession NP_005379.2) is another GAM281 target gene, herein designated TARGET GENE. PDCL BINDING SITE is a target binding site found in the 3' untranslated region of mRNA encoded by PDCL, corresponding to a target binding site such as BINDING SITE I, BINDING SITE II or BINDING SITE III of FIG. 8. Table 4 illustrates the complementarity of the nucleotide sequences of PDCL BINDING SITE, designated SEQ ID:4627, to the nucleotide sequence of GAM281 RNA, herein designated GAM RNA, also designated SEQ ID:278.

Another function of GAM281 is therefore inhibition of Phosducin-like (PDCL, Accession NP_005379.2), a gene which may regulate G-protein signaling and similar to phosducins. Accordingly, utilities of GAM281 include diagnosis, prevention and treatment of diseases and clinical conditions associated with PDCL.

The function of PDCL and its association with various diseases and clinical conditions, has been established by previous studies, as described hereinabove with reference to GAM30.1. Phosphodiesterase 6b, cgmp-specific, rod, beta (congenital stationary night blindness 3, autosomal dominant) (PDE6B, Accession NP_000274.1) is another GAM281 target gene, herein designated TARGET GENE. PDE6B BINDING SITE is a target binding site found in the 3' untranslated region of mRNA encoded by PDE6B, corresponding to a target binding site such as BINDING SITE I, BINDING SITE II or BINDING SITE III of FIG. 8. Table 4 illustrates the complementarity of the nucleotide sequences of PDE6B BINDING SITE, designated SEQ ID:936, to the nucleotide sequence of GAM281 RNA, herein designated GAM RNA, also designated SEQ ID:278.

Another function of GAM281 is therefore inhibition of Phosphodiesterase 6b, cgmp-specific, rod, beta (congenital stationary night blindness 3, autosomal dominant) (PDE6B, Accession NP_000274.1). Accordingly, utilities of GAM281 include diagnosis, prevention and treatment of diseases and clinical conditions associated with PDE6B.

Platelet derived growth factor c (PDGFC, Accession NP_057289.1) is another GAM281 target gene, herein designated TARGET GENE. PDGFC BINDING SITE1 through PDGFC BINDING SITE3 are target binding sites found in untranslated regions of mRNA encoded by PDGFC, corresponding to target binding sites such as BINDING SITE I, BINDING SITE II or BINDING SITE III of FIG. 8. Table 4 illustrates the complementarity of the nucleotide sequences of PDGFC BINDING SITE1 through PDGFC BINDING SITE3, designated SEQ ID:12574, SEQ ID:7486 and SEQ ID:905 respectively, to the nucleotide sequence of GAM281 RNA, herein designated GAM RNA, also designated SEQ ID:278.

Another function of GAM281 is therefore inhibition of Platelet derived growth factor c (PDGFC, Accession NP_057289.1). Accordingly, utilities of GAM281 include diagnosis, prevention and treatment of diseases and clinical conditions associated with PDGFC.

Pdz and lim domain 2 (mystique) (PDLIM2, Accession NP_789847.1) is another GAM281 target gene, herein designated TARGET GENE. PDLIM2 BINDING SITE is a target binding site found in the 3' untranslated region of multiple transcripts of mRNA encoded by PDLIM2, corresponding to a target binding site such as BINDING SITE I, BINDING SITE II or BINDING SITE III of FIG. 8. Table 4 illustrates the complementarity of the nucleotide sequences of PDLIM2 BINDING SITE, designated SEQ ID:14973, to the nucleotide sequence of GAM281 RNA, herein designated GAM RNA, also designated SEQ ID:278.

Another function of GAM281 is therefore inhibition of Pdz and lim domain 2 (mystique) (PDLIM2, Accession NP_789847.1). Accordingly, utilities of GAM281 include diagnosis, prevention and treatment of diseases and clinical conditions associated with PDLIM2.

Pdz domain containing 1 (PDZK1, Accession NP_002605.2) is another GAM281 target gene, herein designated TARGET GENE. PDZK1 BINDING SITE is a target binding site found in the 5' untranslated region of mRNA encoded by PDZK1, corresponding to a target binding site such as BINDING SITE I, BINDING SITE II or BINDING SITE III of FIG. 8. Table 4 illustrates the complementarity of the nucleotide sequences of PDZK1 BINDING SITE, designated SEQ ID:4194, to the nucleotide sequence of GAM281 RNA, herein designated GAM RNA, also designated SEQ ID:278.

Another function of GAM281 is therefore inhibition of Pdz domain containing 1 (PDZK1, Accession NP_002605.2), a gene which is a contains PDZ interaction domains, interacts with MAP17, a protein involved in control of cell proliferation. and therefore may be associated with Autosomal dominant hypophosphatemic rickets. Accordingly, utilities of GAM281 include diagnosis, prevention and treatment of Autosomal dominant hypophosphatemic rickets, and of other diseases and clinical conditions associated with PDZK1.

The function of PDZK1 and its association with various diseases and clinical conditions, has been established by previous studies, as described hereinabove with reference to GAM136.1. PDZRN1 (Accession NP_699202.1) is another GAM281 target gene, herein designated TARGET GENE. PDZRN1 BINDING SITE is a target binding site found in the 3' untranslated region of mRNA encoded by PDZRN1, corresponding to a target binding site such as BINDING SITE I, BINDING SITE II or BINDING SITE III of FIG. 8. Table 4 illustrates the complementarity of the nucleotide sequences of PDZRN1 BINDING SITE, designated SEQ ID:5270, to the nucleotide sequence of GAM281 RNA, herein designated GAM RNA, also designated SEQ ID:278.

Another function of GAM281 is therefore inhibition of PDZRN1 (Accession NP_699202.1). Accordingly, utilities of GAM281 include diagnosis, prevention and treatment of diseases and clinical conditions associated with PDZRN1.

Pellino homolog 1 (drosophila) (PELI1, Accession NP_065702.2) is another GAM281 target gene, herein designated TARGET GENE. PELI1 BINDING SITE1 through PELI1 BINDING SITE3 are target binding sites found in untranslated regions of mRNA encoded by PELI1, corresponding to target binding sites such as BINDING SITE I, BINDING SITE II or BINDING SITE III of FIG. 8. Table 4 illustrates the complementarity of the nucleotide sequences of PELI1 BINDING SITE1 through PELI1 BINDING SITE3, designated SEQ ID:5491, SEQ ID:7382 and SEQ ID:14861 respectively, to the nucleotide sequence of GAM281 RNA, herein designated GAM RNA, also designated SEQ ID:278.

Another function of GAM281 is therefore inhibition of Pellino homolog 1 (drosophila) (PELI1, Accession NP_065702.2). Accordingly, utilities of GAM281 include diagnosis, prevention and treatment of diseases and clinical conditions associated with PELI1.

PEPP3 (Accession NP_055750.1) is another GAM281 target gene, herein designated TARGET GENE. PEPP3 BINDING SITE is a target binding site found in the 3' untranslated region of mRNA encoded by PEPP3, corresponding to a target binding site such as BINDING SITE I, BINDING SITE II or BINDING SITE III of FIG. 8. Table 4 illustrates the complementarity of the nucleotide sequences of PEPP3 BINDING SITE, designated SEQ ID:5136, to the nucleotide sequence of GAM281 RNA, herein designated GAM RNA, also designated SEQ ID:278.

Another function of GAM281 is therefore inhibition of PEPP3 (Accession NP_055750.1). Accordingly, utilities of GAM281 include diagnosis, prevention and treatment of diseases and clinical conditions associated with PEPP3.

Period homolog 2 (drosophila) (PER2, Accession NP_073728.1) is another GAM281 target gene, herein designated TARGET GENE. PER2 BINDING SITE is a target binding site found in the 3' untranslated region of multiple transcripts of mRNA encoded by PER2, corresponding to a target binding site such as BINDING SITE I, BINDING SITE II or BINDING SITE III of FIG. 8. Table 4 illustrates the complementarity of the nucleotide sequences of PER2 BINDING SITE, designated SEQ ID:19703, to the nucleotide sequence of GAM281 RNA, herein designated GAM RNA, also designated SEQ ID:278.

Another function of GAM281 is therefore inhibition of Period homolog 2 (drosophila) (PER2, Accession NP_073728.1), a gene which Period homolog 2; putative circadian clock protein; has a PAS dimerization domain and therefore may be associated with Familial advanced sleep-phase syndrome. Accordingly, utilities of GAM281 include diagnosis, prevention and treatment of Familial advanced sleep-phase syndrome, and of other diseases and clinical conditions associated with PER2.

The function of PER2 and its association with various diseases and clinical conditions, has been established by previous studies, as described hereinabove with reference to GAM130.1. Phosphoribosylformylglycinamidine synthase (fgar amidotransferase) (PFAS, Accession NP_036525.1) is another GAM281 target gene, herein designated TARGET GENE. PFAS BINDING SITE is a target binding site found in the 3' untranslated region of mRNA encoded by PFAS, corresponding to a target binding site such as BINDING SITE I, BINDING SITE II or BINDING SITE III of FIG. 8. Table 4 illustrates the complementarity of the nucleotide sequences of PFAS BINDING SITE, designated SEQ ID:16261, to the nucleotide sequence of GAM281 RNA, herein designated GAM RNA, also designated SEQ ID:278.

Another function of GAM281 is therefore inhibition of Phosphoribosylformylglycinamidine synthase (fgar amidotransferase) (PFAS, Accession NP_036525.1). Accordingly, utilities of GAM281 include diagnosis, prevention and treatment of diseases and clinical conditions associated with PFAS.

PHAX (Accession NP_115553.1) is another GAM281 target gene, herein designated TARGET GENE. PHAX BINDING SITE is a target binding site found in the 3' untranslated region of mRNA encoded by PHAX, corresponding to a target binding site such as BINDING SITE I, BINDING SITE II or BINDING SITE III of FIG. 8. Table 4 illustrates the complementarity of the nucleotide sequences of PHAX BINDING SITE, designated SEQ ID:12159, to the nucleotide sequence of GAM281 RNA, herein designated GAM RNA, also designated SEQ ID:278.

Another function of GAM281 is therefore inhibition of PHAX (Accession NP_115553.1). Accordingly, utilities of GAM281 include diagnosis, prevention and treatment of diseases and clinical conditions associated with PHAX.

Phd finger protein 1 (PHF1, Accession NP_002627.1) is another GAM281 target gene, herein designated TARGET GENE. PHF1 BINDING SITE is a target binding site found in the 3' untranslated region of multiple transcripts of mRNA encoded by PHF1, corresponding to a target binding site such as BINDING SITE I, BINDING SITE II or BINDING SITE III of FIG. 8. Table 4 illustrates the complementarity of the nucleotide sequences of PHF1 BINDING SITE, designated SEQ ID:5036, to the nucleotide sequence of GAM281 RNA, herein designated GAM RNA, also designated SEQ ID:278.

Another function of GAM281 is therefore inhibition of Phd finger protein 1 (PHF1, Accession NP_002627.1). Accordingly, utilities of GAM281 include diagnosis, prevention and treatment of diseases and clinical conditions associated with PHF1.

Phd finger protein 1 (PHF1, Accession NP_077084.1) is another GAM281 target gene, herein designated TARGET GENE. PHF1 BINDING SITE is a target binding site found in the 3' untranslated region of multiple transcripts of mRNA encoded by PHF1, corresponding to a target binding site such as BINDING SITE I, BINDING SITE II or BINDING SITE III of FIG. 8. Table 4 illustrates the complementarity of the nucleotide sequences of PHF1 BINDING SITE, designated SEQ ID:5036, to the nucleotide sequence of GAM281 RNA, herein designated GAM RNA, also designated SEQ ID:278.

Another function of GAM281 is therefore inhibition of Phd finger protein 1 (PHF1, Accession NP_077084.1). Accordingly, utilities of GAM281 include diagnosis, prevention and treatment of diseases and clinical conditions associated with PHF1.

Polymeric immunoglobulin receptor (PIGR, Accession NP_002635.2) is another GAM281 target gene, herein designated TARGET GENE. PIGR BINDING SITE is a target binding site found in the 3' untranslated region of mRNA encoded by PIGR, corresponding to a target binding site such as BINDING SITE I, BINDING SITE II or BINDING SITE III of FIG. 8. Table 4 illustrates the complementarity of the nucleotide sequences of PIGR BINDING SITE, designated SEQ ID:11059, to the nucleotide sequence of GAM281 RNA, herein designated GAM RNA, also designated SEQ ID:278.

Another function of GAM281 is therefore inhibition of Polymeric immunoglobulin receptor (PIGR, Accession NP_002635.2). Accordingly, utilities of GAM281 include diagnosis, prevention and treatment of diseases and clinical conditions associated with PIGR.

Phosphoinositide-3-kinase, class 2, beta polypeptide (PIK3C2B, Accession NP_002637.2) is another GAM281 target gene, herein designated TARGET GENE. PIK3C2B BINDING SITE is a target binding site found in the 3' untranslated region of mRNA encoded by PIK3C2B, corresponding to a target binding site such as BINDING SITE I, BINDING SITE II or BINDING SITE III of FIG. 8. Table 4 illustrates the complementarity of the nucleotide sequences of PIK3C2B BINDING SITE, designated SEQ ID:10488, to the nucleotide sequence of GAM281 RNA, herein designated GAM RNA, also designated SEQ ID:278.

Another function of GAM281 is therefore inhibition of Phosphoinositide-3-kinase, class 2, beta polypeptide (PIK3C2B, Accession NP_002637.2). Accordingly, utilities of GAM281 include diagnosis, prevention and treatment of diseases and clinical conditions associated with PIK3C2B.

Phosphoinositide-3-kinase, catalytic, delta polypeptide (PIK3CD, Accession NP_005017.2) is another GAM281 target gene, herein designated TARGET GENE. PIK3CD BINDING SITE is a target binding site found in the 3'untranslated region of mRNA encoded by PIK3CD, corresponding to a target binding site such as BINDING SITE I, BINDING SITE II or BINDING SITE III of FIG. 8. Table 4 illustrates the complementarity of the nucleotide sequences of PIK3CD BINDING SITE, designated SEQ ID:9545, to the nucleotide sequence of GAM281 RNA, herein designated GAM RNA, also designated SEQ ID:278.

Another function of GAM281 is therefore inhibition of Phosphoinositide-3-kinase, catalytic, delta polypeptide (PIK3CD, Accession NP_005017.2), a gene which regulating cell growth. Accordingly, utilities of GAM281 include diagnosis, prevention and treatment of diseases and clinical conditions associated with PIK3CD.

The function of PIK3CD and its association with various diseases and clinical conditions, has been established by previous studies, as described hereinabove with reference to GAM136.1. Pbx/knotted 1 homeobox 1 (PKNOX1, Accession NP_004562.2) is another GAM281 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:8826, to the nucleotide sequence of GAM281 RNA, herein designated GAM RNA, also designated SEQ ID:278.

Another function of GAM281 is therefore inhibition of Pbx/knotted 1 homeobox 1 (PKNOX1, Accession NP_004562.2), a gene which may regulate gene expression and control cell differentiation. Accordingly, utilities of GAM281 include diagnosis, prevention and treatment of diseases and clinical conditions associated with PKNOX1.

The function of PKNOX1 and its association with various diseases and clinical conditions, has been established by previous studies, as described hereinabove with reference to GAM55.1. Pro-melanin-concentrating hormone-like 1 (PMCHL1, Accession NP_114093.1) is another GAM281 target gene, herein designated TARGET GENE. PMCHL1 BINDING SITE is a target binding site found in the 3' untranslated region of mRNA encoded by PMCHL1, corresponding to a target binding site such as BINDING SITE I, BINDING SITE II or BINDING SITE III of FIG. 8. Table 4 illustrates the complementarity of the nucleotide sequences of PMCHL1 BINDING SITE, designated SEQ ID:16917, to the nucleotide sequence of GAM281 RNA, herein designated GAM RNA, also designated SEQ ID:278.

Another function of GAM281 is therefore inhibition of Pro-melanin-concentrating hormone-like 1 (PMCHL1, Accession NP_114093.1). Accordingly, utilities of GAM281 include diagnosis, prevention and treatment of diseases and clinical conditions associated with PMCHL1.

Pro-melanin-concentrating hormone-like 2 (PMCHL2, Accession NP_114094.1) is another GAM281 target gene, herein designated TARGET GENE. PMCHL2 BINDING SITE is a target binding site found in the 3' untranslated region of mRNA encoded by PMCHL2, corresponding to a target binding site such as BINDING SITE I, BINDING SITE II or BINDING SITE III of FIG. 8. Table 4 illustrates the complementarity of the nucleotide sequences of PMCHL2 BINDING SITE, designated SEQ ID:16917, to the nucleotide sequence of GAM281 RNA, herein designated GAM RNA, also designated SEQ ID:278.

Another function of GAM281 is therefore inhibition of Pro-melanin-concentrating hormone-like 2 (PMCHL2, Accession NP_114094.1). Accordingly, utilities of GAM281 include diagnosis, prevention and treatment of diseases and clinical conditions associated with PMCHL2.

PMPCA (Accession NP_055975.1) is another GAM281 target gene, herein designated TARGET GENE. PMPCA BINDING SITE is a target binding site found in the 3' untranslated region of mRNA encoded by PMPCA, corresponding to a target binding site such as BINDING SITE I, BINDING SITE II or BINDING SITE III of FIG. 8. Table 4 illustrates the complementarity of the nucleotide sequences of PMPCA BINDING SITE, designated SEQ ID:7640, to the nucleotide sequence of GAM281 RNA, herein designated GAM RNA, also designated SEQ ID:278.

Another function of GAM281 is therefore inhibition of PMPCA (Accession NP_055975.1). Accordingly, utilities of GAM281 include diagnosis, prevention and treatment of diseases and clinical conditions associated with PMPCA.

Paraneoplastic antigen ma2 (PNMA2, Accession NP_009188.1) is another GAM281 target gene, herein designated TARGET GENE. PNMA2 BINDING SITE1 and PNMA2 BINDING SITE2 are target binding sites found in untranslated regions of mRNA encoded by PNMA2, corresponding to target binding sites such as BINDING SITE I, BINDING SITE II or BINDING SITE III of FIG. 8. Table 4 illustrates the complementarity of the nucleotide sequences of PNMA2 BINDING SITE1 and PNMA2 BINDING SITE2, designated SEQ ID:8006 and SEQ ID:17067 respectively, to the nucleotide sequence of GAM281 RNA, herein designated GAM RNA, also designated SEQ ID:278.

Another function of GAM281 is therefore inhibition of Paraneoplastic antigen ma2 (PNMA2, Accession NP_009188.1). Accordingly, utilities of GAM281 include diagnosis, prevention and treatment of diseases and clinical conditions associated with PNMA2.

Protein o-fucosyltransferase 1 (POFUT1, Accession NP_056167.1) is another GAM281 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:11287, to the nucleotide sequence of GAM281 RNA, herein designated GAM RNA, also designated SEQ ID:278.

Another function of GAM281 is therefore inhibition of Protein o-fucosyltransferase 1 (POFUT1, Accession NP_056167.1). Accordingly, utilities of GAM281 include diagnosis, prevention and treatment of diseases and clinical conditions associated with POFUT1.

Polymerase (dna directed), epsilon 3 (p17 subunit) (POLE3, Accession NP_059139.2) is another GAM281 target gene, herein designated TARGET GENE. POLE3 BINDING SITE is a target binding site found in the 3' untranslated region of mRNA encoded by POLE3, corresponding to a target binding site such as BINDING SITE I, BINDING SITE II or BINDING SITE III of FIG. 8. Table 4 illustrates the complementarity of the nucleotide sequences of POLE3 BINDING SITE, designated SEQ ID:6151, to the nucleotide sequence of GAM281 RNA, herein designated GAM RNA, also designated SEQ ID:278.

Another function of GAM281 is therefore inhibition of Polymerase (dna directed), epsilon 3 (p17 subunit) (POLE3, Accession NP_059139.2). Accordingly, utilities of GAM281 include diagnosis, prevention and treatment of diseases and clinical conditions associated with POLE3.

Polymerase (rna) ii (dna directed) polypeptide d (POLR2D, Accession NP_004796.1) is another GAM281 target gene, herein designated TARGET GENE. POLR2D BINDING SITE1 and POLR2D BINDING SITE2 are target binding sites found in untranslated regions of mRNA encoded by POLR2D, corresponding to target binding sites such as BINDING SITE I, BINDING SITE II or BINDING SITE III of FIG. 8. Table 4 illustrates the complementarity of the nucleotide sequences of POLR2D BINDING SITE1 and POLR2D BINDING SITE2, designated SEQ ID:2798 and SEQ ID:5412 respectively, to the nucleotide sequence of GAM281 RNA, herein designated GAM RNA, also designated SEQ ID:278.

Another function of GAM281 is therefore inhibition of Polymerase (rna) ii (dna directed) polypeptide d (POLR2D, Accession NP_004796.1). Accordingly, utilities of GAM281 include diagnosis, prevention and treatment of diseases and clinical conditions associated with POLR2D.

Paraoxonase 1 (PON1, Accession NP_000437.3) is another GAM281 target gene, herein designated TARGET GENE. PON1 BINDING SITE is a target binding site found in the 3' untranslated region of mRNA encoded by PON1, corresponding to a target binding site such as BINDING SITE I, BINDING SITE II or BINDING SITE III of FIG. 8. Table 4 illustrates the complementarity of the nucleotide sequences of PON1 BINDING SITE, designated SEQ ID:2152, to the nucleotide sequence of GAM281 RNA, herein designated GAM RNA, also designated SEQ ID:278.

Another function of GAM281 is therefore inhibition of Paraoxonase 1 (PON1, Accession NP_000437.3), a gene which hydrolyzes the toxic metabolites of a variety of organophosphorus insecticides. Accordingly, utilities of GAM281 include diagnosis, prevention and treatment of diseases and clinical conditions associated with PON1.

The function of PON1 and its association with various diseases and clinical conditions, has been established by previous studies, as described hereinabove with reference to GAM189.1. Pou domain, class 2, associating factor 1 (POU2AF1, Accession NP_006226.1) is another GAM281 target gene, herein designated TARGET GENE. POU2AF1 BINDING SITE is a target binding site found in the 3' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:20135, to the nucleotide sequence of GAM281 RNA, herein designated GAM RNA, also designated SEQ ID:278.

Another function of GAM281 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM281 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. Pou domain, class 2, transcription factor 3 (POU2F3, Accession NP_055167.1) is another GAM281 target gene, herein designated TARGET GENE. POU2F3 BINDING SITE is a target binding site found in the 3' untranslated region of mRNA encoded by POU2F3, corresponding to a target binding site such as BINDING SITE I, BINDING SITE II or BINDING SITE III of FIG. 8. Table 4 illustrates the complementarity of the nucleotide sequences of POU2F3 BINDING SITE, designated SEQ ID:16114, to the nucleotide sequence of GAM281 RNA, herein designated GAM RNA, also designated SEQ ID:278.

Another function of GAM281 is therefore inhibition of Pou domain, class 2, transcription factor 3 (POU2F3, Accession NP_055167.1). Accordingly, utilities of GAM281 include diagnosis, prevention and treatment of diseases and clinical conditions associated with POU2F3.

Pou domain, class 3, transcription factor 1 (POU3F1, Accession NP_002690.2) is another GAM281 target gene, herein designated TARGET GENE. POU3F1 BINDING SITE is a target binding site found in the 3' untranslated region of mRNA encoded by POU3F1, corresponding to a target binding site such as BINDING SITE I, BINDING SITE II or BINDING SITE III of FIG. 8. Table 4 illustrates the complementarity of the nucleotide sequences of POU3F1 BINDING SITE, designated SEQ ID:7918, to the nucleotide sequence of GAM281 RNA, herein designated GAM RNA, also designated SEQ ID:278.

Another function of GAM281 is therefore inhibition of Pou domain, class 3, transcription factor 1 (POU3F1, Accession NP_002690.2), a gene which involves in early embryogenesis and neurogenesis. Accordingly, utilities of GAM281 include diagnosis, prevention and treatment of diseases and clinical conditions associated with POU3F1.

The function of POU3F1 has been established by previous studies. The vertebrate class III POU transcription factors consist of 4 members: POU3F1 (Oct-6), POU3F2 (OMIM Ref. No. 600494), POU3F3 (Brain-1), and POU3F4 (Brain-4; 300039). The chromosomal locations of the murine class III POU genes were determined by interspecific backcross analysis (Avraham et al., 1993; Xia et al., 1993). On the basis of mouse-human chromosomal homologies, human POU3F1 and POU3F3 were expected to map to 1p and 2q, respectively. Sumiyama et al. (1998) found that the location of POU3F1 was consistent with this position, mapping to 1p34.1 by FISH. Contrary to the prediction, however, POU3F3 was mapped to 3p14.2 by the same method. The human POU3F2 and POU3F4 genes map to 6q16 and Xq21.1, respectively. Thus, the 4 human class III POU genes map to different chromosomes. A phylogenetic tree of these 4 genes shows that they emerged in a common ancestor of vertebrates. Studies of the genome structure of vertebrates suggest that genome duplication occurred at least twice in the early stage of vertebrate evolution; 4 homologous complexes such as Hox and MHC are interspersed in the mammalian genome. The findings with the 4 class III POU genes are consistent with the idea of 2 genome duplications. Xia et al. (1993) mapped the mouse homolog of the POU3F1 gene, called Tst1 by them, to chromosome 4. Most mice homozygous for a mutant Pou3f1 die soon after birth (Bermingham et al., 1996; Jaegle et al., 1996).

Full details of the abovementioned studies are described in the following publications, the disclosure of which are hereby incorporated by reference:

Sumiyama, K.; Washio-Watanabe, K.; Ono, T.; Yoshida, M. C.; Hayakawa, T.; Ueda, S. : Human class III POU genes, POU3F1 and POU3F3, map to chromosomes 1p34.1 and 3p14.1. Mammalian Genome 9:180-181, 1998; and Xia, Y.-R.; Andersen, B.; Mehrabian, M.; Diep, A. T.; Warden, C. H.; Mohandas, T.; McEvilly, R. J.; Rosenfeld, M. G.; Lusis, A. J.: Chromosomal organization of mammalian POU domain facto.

Further studies establishing the function and utilities of POU3F1 are found in John Hopkins OMIM database record ID 602479, and in cited publications listed in Table 5, which are hereby incorporated by reference. PP1628 (Accession NP_079477.1) is another GAM281 target gene, herein designated TARGET GENE. PP1628 BINDING SITE is a target binding site found in the 5' untranslated region of mRNA encoded by PP1628, corresponding to a target binding site such as BINDING SITE I, BINDING SITE II or BINDING SITE III of FIG. 8. Table 4 illustrates the complementarity of the nucleotide sequences of PP1628 BINDING SITE, designated SEQ ID:10180, to the nucleotide sequence of GAM281 RNA, herein designated GAM RNA, also designated SEQ ID:278.

Another function of GAM281 is therefore inhibition of PP1628 (Accession NP_079477.1). Accordingly, utilities of GAM281 include diagnosis, prevention and treatment of diseases and clinical conditions associated with PP1628.

PP3111 (Accession NP_071439.2) is another GAM281 target gene, herein designated TARGET GENE. PP3111 BINDING SITE is a target binding site found in the 3' untranslated region of mRNA encoded by PP3111, corresponding to a target binding site such as BINDING SITE I, BINDING SITE II or BINDING SITE III of FIG. 8. Table 4 illustrates the complementarity of the nucleotide sequences of PP3111 BINDING SITE, designated SEQ ID:10883, to the nucleotide sequence of GAM281 RNA, herein designated GAM RNA, also designated SEQ ID:278.

Another function of GAM281 is therefore inhibition of PP3111 (Accession NP_071439.2). Accordingly, utilities of GAM281 include diagnosis, prevention and treatment of diseases and clinical conditions associated with PP3111.

PP3856 (Accession NP_660202.1) is another GAM281 target gene, herein designated TARGET GENE. PP3856 BINDING SITE is a target binding site found in the 5' untranslated region of mRNA encoded by PP3856, corresponding to a target binding site such as BINDING SITE I, BINDING SITE II or BINDING SITE III of FIG. 8. Table 4 illustrates the complementarity of the nucleotide sequences of PP3856 BINDING SITE, designated SEQ ID:10744, to the nucleotide sequence of GAM281 RNA, herein designated GAM RNA, also designated SEQ ID:278.

Another function of GAM281 is therefore inhibition of PP3856 (Accession NP_660202.1). Accordingly, utilities of GAM281 include diagnosis, prevention and treatment of diseases and clinical conditions associated with PP3856.

Phosphatidic acid phosphatase type 2c (PPAP2C, Accession NP_803545.1) is another GAM281 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM281 RNA, herein designated GAM RNA, also designated SEQ ID:278.

Another function of GAM281 is therefore inhibition of Phosphatidic acid phosphatase type 2c (PPAP2C, Accession NP_803545.1). Accordingly, utilities of GAM281 include diagnosis, prevention and treatment of diseases and clinical conditions associated with PPAP2C.

Phosphatidic acid phosphatase type 2c (PPAP2C, Accession NP_808211.1) is another GAM281 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM281 RNA, herein designated GAM RNA, also designated SEQ ID:278.

Another function of GAM281 is therefore inhibition of Phosphatidic acid phosphatase type 2c (PPAP2C, Accession NP_808211.1). Accordingly, utilities of GAM281 include diagnosis, prevention and treatment of diseases and clinical conditions associated with PPAP2C.

Phosphatidic acid phosphatase type 2c (PPAP2C, Accession NP_003703.1) is another GAM281 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM281 RNA, herein designated GAM RNA, also designated SEQ ID:278.

Another function of GAM281 is therefore inhibition of Phosphatidic acid phosphatase type 2c (PPAP2C, Accession NP_003703.1). Accordingly, utilities of GAM281 include diagnosis, prevention and treatment of diseases and clinical conditions associated with PPAP2C.

Protein phosphatase, ef hand calcium-binding domain 2 (PPEF2, Accession NP_690911.1) is another GAM281 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM281 RNA, herein designated GAM RNA, also designated SEQ ID:278.

Another function of GAM281 is therefore inhibition of Protein phosphatase, ef hand calcium-binding domain 2 (PPEF2, Accession NP_690911.1), a gene which is a homolog of Drosophila rdgC. Accordingly, utilities of GAM281 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_006230.2) is another GAM281 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM281 RNA, herein designated GAM RNA, also designated SEQ ID:278.

Another function of GAM281 is therefore inhibition of Protein phosphatase, ef hand calcium-binding domain 2 (PPEF2, Accession NP_006230.2), a gene which is a homolog of Drosophila rdgC. Accordingly, utilities of GAM281 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_690910.1) is another GAM281 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM281 RNA, herein designated GAM RNA, also designated SEQ ID:278.

Another function of GAM281 is therefore inhibition of Protein phosphatase, ef hand calcium-binding domain 2 (PPEF2, Accession NP_690910.1), a gene which is a homolog of Drosophila rdgC. Accordingly, utilities of GAM281 include diagnosis, prevention and treatment of diseases and clinical conditions associated with PPEF2.

The function of PPEF2 and its association with various diseases and clinical conditions, has been established by previous studies, as described hereinabove with reference to GAM66.2. Ptprf interacting protein, binding protein 1 (liprin beta 1) (PPFIBP1, Accession NP_003613.2) is another GAM281 target gene, herein designated TARGET GENE. PPFIBP1 BINDING SITE1 through PPFIBP1 BINDING SITE3 are target binding sites found in untranslated regions of multiple transcripts of mRNA encoded by PPFIBP1, corresponding to target binding sites such as BINDING SITE I, BINDING SITE II or BINDING SITE III of FIG. 8. Table 4 illustrates the complementarity of the nucleotide sequences of PPFIBP1 BINDING SITE1 through PPFIBP1 BINDING SITE3, designated SEQ ID:12217, SEQ ID:10708 and SEQ ID:8231 respectively, to the nucleotide sequence of GAM281 RNA, herein designated GAM RNA, also designated SEQ ID:278.

Another function of GAM281 is therefore inhibition of Ptprf interacting protein, binding protein 1 (liprin beta 1)

(PPFIBP1, Accession NP_003613.2). Accordingly, utilities of GAM281 include diagnosis, prevention and treatment of diseases and clinical conditions associated with PPFIBP1.

Peptidylprolyl isomerase d (cyclophilin d) (PPID, Accession NP_005029.1) is another GAM281 target gene, herein designated TARGET GENE. PPID BINDING SITE is a target binding site found in the 3' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:7378, to the nucleotide sequence of GAM281 RNA, herein designated GAM RNA, also designated SEQ ID:278.

Another function of GAM281 is therefore inhibition of Peptidylprolyl isomerase d (cyclophilin d) (PPID, Accession NP_005029.1), a gene which catalyzes the cis-trans isomerization of proline imidic peptide bonds in oligopeptides. Accordingly, utilities of GAM281 include diagnosis, prevention and treatment of diseases and clinical conditions associated with PPID.

The function of PPID and its association with various diseases and clinical conditions, has been established by previous studies, as described hereinabove with reference to GAM136.1. Peptidylprolyl isomerase (cyclophilin)-like 2 (PPIL2, Accession NP_055152.1) is another GAM281 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:13122, to the nucleotide sequence of GAM281 RNA, herein designated GAM RNA, also designated SEQ ID:278.

Another function of GAM281 is therefore inhibition of Peptidylprolyl isomerase (cyclophilin)-like 2 (PPIL2, Accession NP_055152.1). Accordingly, utilities of GAM281 include diagnosis, prevention and treatment of diseases and clinical conditions associated with PPIL2.

Protein phosphatase 1, regulatory (inhibitor) subunit 12b (PPP1R12B, Accession NP_002472.1) is another GAM281 target gene, herein designated TARGET GENE. PPP1R12B BINDING SITE1 and PPP1R12B BINDING SITE2 are target binding sites found in untranslated regions of multiple transcripts of mRNA encoded by PPP1R12B, corresponding to target binding sites such as BINDING SITE I, BINDING SITE II or BINDING SITE III of FIG. 8. Table 4 illustrates the complementarity of the nucleotide sequences of PPP1R12B BINDING SITE1 and PPP1R12B BINDING SITE2, designated SEQ ID:13977 and SEQ ID:3861 respectively, to the nucleotide sequence of GAM281 RNA, herein designated GAM RNA, also designated SEQ ID:278.

Another function of GAM281 is therefore inhibition of Protein phosphatase 1, regulatory (inhibitor) subunit 12b (PPP1R12B, Accession NP_002472.1). Accordingly, utilities of GAM281 include diagnosis, prevention and treatment of diseases and clinical conditions associated with PPP1R12B.

Protein phosphatase 1, regulatory (inhibitor) subunit 12b (PPP1R12B, Accession NP_115288.1) is another GAM281 target gene, herein designated TARGET GENE. PPP1R12B BINDING SITE1 and PPP1R12B BINDING SITE2 are target binding sites found in untranslated regions of multiple transcripts of mRNA encoded by PPP1R12B, corresponding to target binding sites such as BINDING SITE I, BINDING SITE II or BINDING SITE III of FIG. 8. Table 4 illustrates the complementarity of the nucleotide sequences of PPP1R12B BINDING SITE1 and PPP1R12B BINDING SITE2, designated SEQ ID:13977 and SEQ ID:3861 respectively, to the nucleotide sequence of GAM281 RNA, herein designated GAM RNA, also designated SEQ ID:278.

Another function of GAM281 is therefore inhibition of Protein phosphatase 1, regulatory (inhibitor) subunit 12b (PPP1R12B, Accession NP_115288.1). Accordingly, utilities of GAM281 include diagnosis, prevention and treatment of diseases and clinical conditions associated with PPP1R12B.

Primase, polypeptide 2a, 58 kda (PRIM2A, Accession NP_000938.1) is another GAM281 target gene, herein designated TARGET GENE. PRIM2A BINDING SITE is a target binding site found in the 3' untranslated region of mRNA encoded by PRIM2A, corresponding to a target binding site such as BINDING SITE I, BINDING SITE II or BINDING SITE III of FIG. 8. Table 4 illustrates the complementarity of the nucleotide sequences of PRIM2A BINDING SITE, designated SEQ ID:10653, to the nucleotide sequence of GAM281 RNA, herein designated GAM RNA, also designated SEQ ID:278.

Another function of GAM281 is therefore inhibition of Primase, polypeptide 2a, 58 kda (PRIM2A, Accession NP_000938.1). Accordingly, utilities of GAM281 include diagnosis, prevention and treatment of diseases and clinical conditions associated with PRIM2A.

Protein kinase, interferon-inducible double stranded rna dependent (PRKR, Accession NP_002750.1) is another GAM281 target gene, herein designated TARGET GENE. PRKR BINDING SITE is a target binding site found in the 3' untranslated region of mRNA encoded by PRKR, corresponding to a target binding site such as BINDING SITE I, BINDING SITE II or BINDING SITE III of FIG. 8. Table 4 illustrates the complementarity of the nucleotide sequences of PRKR BINDING SITE, designated SEQ ID:4790, to the nucleotide sequence of GAM281 RNA, herein designated GAM RNA, also designated SEQ ID:278.

Another function of GAM281 is therefore inhibition of Protein kinase, interferon-inducible double stranded rna dependent (PRKR, Accession NP_002750.1), a gene which catalyze the phosphorylation of the alpha subunit of eif2. and therefore may be associated with Huntington's disease. Accordingly, utilities of GAM281 include diagnosis, prevention and treatment of Huntington's disease, and of other diseases and clinical conditions associated with PRKR.

The function of PRKR and its association with various diseases and clinical conditions, has been established by previous studies, as described hereinabove with reference to GAM136.1. Protein kinase, lysine deficient 3 (PRKWNK3, Accession NP_065973.1) is another GAM281 target gene, herein designated TARGET GENE. PRKWNK3 BINDING SITE is a target binding site found in the 3' untranslated region of mRNA encoded by PRKWNK3, corresponding to a target binding site such as BINDING SITE I, BINDING SITE II or BINDING SITE III of FIG. 8. Table 4 illustrates the complementarity of the nucleotide sequences of PRKWNK3 BINDING SITE, designated SEQ ID:14862, to the nucleotide sequence of GAM281 RNA, herein designated GAM RNA, also designated SEQ ID:278.

Another function of GAM281 is therefore inhibition of Protein kinase, lysine deficient 3 (PRKWNK3, Accession NP_065973.1). Accordingly, utilities of GAM281 include diagnosis, prevention and treatment of diseases and clinical conditions associated with PRKWNK3.

Protein kinase, y-linked (PRKY, Accession NP_002751.1) is another GAM281 target gene, herein designated TARGET GENE. PRKY BINDING SITE is a target binding site found in the 3' untranslated region of mRNA encoded by PRKY, corresponding to a target binding site such as BINDING SITE I, BINDING SITE II or BINDING SITE III of FIG. 8. Table 4 illustrates the complementarity of the nucleotide sequences of PRKY BINDING SITE, designated SEQ ID:6114, to the nucleotide sequence of GAM281 RNA, herein designated GAM RNA, also designated SEQ ID:278.

Another function of GAM281 is therefore inhibition of Protein kinase, y-linked (PRKY, Accession NP_002751.1), a gene which is a putative protein kinase. Accordingly, utilities of GAM281 include diagnosis, prevention and treatment of diseases and clinical conditions associated with PRKY.

The function of PRKY and its association with various diseases and clinical conditions, has been established by previous studies, as described hereinabove with reference to GAM72.1. Prion protein 2 (dublet) (PRND, Accession NP_036541.1) is another GAM281 target gene, herein designated TARGET GENE. PRND BINDING SITE1 and PRND BINDING SITE2 are target binding sites found in untranslated regions of mRNA encoded by PRND, corresponding to target binding sites such as BINDING SITE I, BINDING SITE II or BINDING SITE III of FIG. 8. Table 4 illustrates the complementarity of the nucleotide sequences of PRND BINDING SITE1 and PRND BINDING SITE2, designated SEQ ID:4170 and SEQ ID:1539 respectively, to the nucleotide sequence of GAM281 RNA, herein designated GAM RNA, also designated SEQ ID:278.

Another function of GAM281 is therefore inhibition of Prion protein 2 (dublet) (PRND, Accession NP_036541.1), a gene which is similar to prion protein PRNP. Accordingly, utilities of GAM281 include diagnosis, prevention and treatment of diseases and clinical conditions associated with PRND.

The function of PRND and its association with various diseases and clinical conditions, has been established by previous studies, as described hereinabove with reference to GAM116.1. PRO0297 (Accession NP_054800.1) is another GAM281 target gene, herein designated TARGET GENE. PRO0297 BINDING SITE is a target binding site found in the 5' untranslated region of mRNA encoded by PRO0297, corresponding to a target binding site such as BINDING SITE I, BINDING SITE II or BINDING SITE III of FIG. 8. Table 4 illustrates the complementarity of the nucleotide sequences of PRO0297 BINDING SITE, designated SEQ ID:10574, to the nucleotide sequence of GAM281 RNA, herein designated GAM RNA, also designated SEQ ID:278.

Another function of GAM281 is therefore inhibition of PRO0297 (Accession NP_054800.1). Accordingly, utilities of GAM281 include diagnosis, prevention and treatment of diseases and clinical conditions associated with PRO0297.

PRO0365 (Accession NP_054845.1) is another GAM281 target gene, herein designated TARGET GENE. PRO0365 BINDING SITE is a target binding site found in the 5' untranslated region of mRNA encoded by PRO0365, corresponding to a target binding site such as BINDING SITE I, BINDING SITE II or BINDING SITE III of FIG. 8. Table 4 illustrates the complementarity of the nucleotide sequences of PRO0365 BINDING SITE, designated SEQ ID:18148, to the nucleotide sequence of GAM281 RNA, herein designated GAM RNA, also designated SEQ ID:278.

Another function of GAM281 is therefore inhibition of PRO0365 (Accession NP_054845.1). Accordingly, utilities of GAM281 include diagnosis, prevention and treatment of diseases and clinical conditions associated with PRO0365.

PRO0456 (Accession NP_054846.1) is another GAM281 target gene, herein designated TARGET GENE. PRO0456 BINDING SITE is a target binding site found in the 3' untranslated region of mRNA encoded by PRO0456, corresponding to a target binding site such as BINDING SITE I, BINDING SITE II or BINDING SITE III of FIG. 8. Table 4 illustrates the complementarity of the nucleotide sequences of PRO0456 BINDING SITE, designated SEQ ID:9064, to the nucleotide sequence of GAM281 RNA, herein designated GAM RNA, also designated SEQ ID:278.

Another function of GAM281 is therefore inhibition of PRO0456 (Accession NP_054846.1). Accordingly, utilities of GAM281 include diagnosis, prevention and treatment of diseases and clinical conditions associated with PRO0456.

PRO1048 (Accession NP_060967.1) is another GAM281 target gene, herein designated TARGET GENE. PRO1048 BINDING SITE is a target binding site found in the 3' untranslated region of mRNA encoded by PRO1048, corresponding to a target binding site such as BINDING SITE I, BINDING SITE II or BINDING SITE III of FIG. 8. Table 4 illustrates the complementarity of the nucleotide sequences of PRO1048 BINDING SITE, designated SEQ ID:12596, to the nucleotide sequence of GAM281 RNA, herein designated GAM RNA, also designated SEQ ID:278.

Another function of GAM281 is therefore inhibition of PRO1048 (Accession NP_060967.1). Accordingly, utilities of GAM281 include diagnosis, prevention and treatment of diseases and clinical conditions associated with PRO1048.

PRO2730 (Accession NP_079498.1) is another GAM281 target gene, herein designated TARGET GENE. PRO2730 BINDING SITE is a target binding site found in the 3' untranslated region of mRNA encoded by PRO2730, corresponding to a target binding site such as BINDING SITE I, BINDING SITE II or BINDING SITE III of FIG. 8. Table 4 illustrates the complementarity of the nucleotide sequences of PRO2730 BINDING SITE, designated SEQ ID:2048, to the nucleotide sequence of GAM281 RNA, herein designated GAM RNA, also designated SEQ ID:278.

Another function of GAM281 is therefore inhibition of PRO2730 (Accession NP_079498.1). Accordingly, utilities of GAM281 include diagnosis, prevention and treatment of diseases and clinical conditions associated with PRO2730.

PROM2 (Accession NP_653308.1) is another GAM281 target gene, herein designated TARGET GENE. PROM2 BINDING SITE is a target binding site found in the 3' untranslated region of mRNA encoded by PROM2, corresponding to a target binding site such as BINDING SITE I, BINDING SITE II or BINDING SITE III of FIG. 8. Table 4 illustrates the complementarity of the nucleotide sequences of PROM2 BINDING SITE, designated SEQ ID:2147, to the nucleotide sequence of GAM281 RNA, herein designated GAM RNA, also designated SEQ ID:278.

Another function of GAM281 is therefore inhibition of PROM2 (Accession NP_653308.1). Accordingly, utilities of GAM281 include diagnosis, prevention and treatment of diseases and clinical conditions associated with PROM2.

Proteasome (prosome, macropain) 26s subunit, non-atpase, 9 (PSMD9, Accession NP_002804.2) is another GAM281 target gene, herein designated TARGET GENE. PSMD9 BINDING SITE is a target binding site found in the 3' untranslated region of mRNA encoded by PSMD9, corresponding to a target binding site such as BINDING SITE I, BINDING SITE II or BINDING SITE III of FIG. 8. Table 4 illustrates the complementarity of the nucleotide sequences of PSMD9 BINDING SITE, designated SEQ ID:17758, to the nucleotide sequence of GAM281 RNA, herein designated GAM RNA, also designated SEQ ID:278.

Another function of GAM281 is therefore inhibition of Proteasome (prosome, macropain) 26s subunit, non-atpase, 9 (PSMD9, Accession NP_002804.2), a gene which acts as a regulatory subunit of the 26 proteasome. Accordingly, utilities of GAM281 include diagnosis, prevention and treatment of diseases and clinical conditions associated with PSMD9.

The function of PSMD9 and its association with various diseases and clinical conditions, has been established by previous studies, as described hereinabove with reference to GAM30.1. Phosphoserine phosphatase (PSPH, Accession NP_004568.1) is another GAM281 target gene, herein designated TARGET GENE. PSPH BINDING SITE is a target binding site found in the 3' untranslated region of mRNA encoded by PSPH, corresponding to a target binding site such as BINDING SITE I, BINDING SITE II or BINDING SITE III of FIG. 8. Table 4 illustrates the complementarity of the nucleotide sequences of PSPH BINDING SITE, designated SEQ ID:15044, to the nucleotide sequence of GAM281 RNA, herein designated GAM RNA, also designated SEQ ID:278.

Another function of GAM281 is therefore inhibition of Phosphoserine phosphatase (PSPH, Accession NP_004568.1). Accordingly, utilities of GAM281 include diagnosis, prevention and treatment of diseases and clinical conditions associated with PSPH.

Proline-serine-threonine phosphatase interacting protein 2 (PSTPIP2, Accession NP_077748.2) is another GAM281 target gene, herein designated TARGET GENE. PSTPIP2 BINDING SITE is a target binding site found in the 3' untranslated region of mRNA encoded by PSTPIP2, corresponding to a target binding site such as BINDING SITE I, BINDING SITE II or BINDING SITE III of FIG. 8. Table 4 illustrates the complementarity of the nucleotide sequences of PSTPIP2 BINDING SITE, designated SEQ ID:12057, to the nucleotide sequence of GAM281 RNA, herein designated GAM RNA, also designated SEQ ID:278.

Another function of GAM281 is therefore inhibition of Proline-serine-threonine phosphatase interacting protein 2 (PSTPIP2, Accession NP_077748.2). Accordingly, utilities of GAM281 include diagnosis, prevention and treatment of diseases and clinical conditions associated with PSTPIP2.

Prostaglandin e synthase (PTGES, Accession NP_004869.1) is another GAM281 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:16070, to the nucleotide sequence of GAM281 RNA, herein designated GAM RNA, also designated SEQ ID:278.

Another function of GAM281 is therefore inhibition of Prostaglandin e synthase (PTGES, Accession NP_004869.1). Accordingly, utilities of GAM281 include diagnosis, prevention and treatment of diseases and clinical conditions associated with PTGES.

Prostaglandin i2 (prostacyclin) synthase (PTGIS, Accession NP_000952.1) is another GAM281 target gene, herein designated TARGET GENE. PTGIS BINDING SITE1 and PTGIS BINDING SITE2 are target binding sites found in untranslated regions of mRNA encoded by PTGIS, corresponding to target binding sites such as BINDING SITE I, BINDING SITE II or BINDING SITE III of FIG. 8. Table 4 illustrates the complementarity of the nucleotide sequences of PTGIS BINDING SITE1 and PTGIS BINDING SITE2, designated SEQ ID:17361 and SEQ ID:10783 respectively, to the nucleotide sequence of GAM281 RNA, herein designated GAM RNA, also designated SEQ ID:278.

Another function of GAM281 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM281 include diagnosis, prevention and treatment of diseases and clinical conditions associated with PTGIS.

The function of PTGIS and its association with various diseases and clinical conditions, has been established by previous studies, as described hereinabove with reference to GAM30.1. Ptk2 protein tyrosine kinase 2 (PTK2, Accession NP_005598.3) is another GAM281 target gene, herein designated TARGET GENE. PTK2 BINDING SITE is a target binding site found in the 5' untranslated region of multiple transcripts of mRNA encoded by PTK2, corresponding to a target binding site such as BINDING SITE I, BINDING SITE II or BINDING SITE III of FIG. 8. Table 4 illustrates the complementarity of the nucleotide sequences of PTK2 BINDING SITE, designated SEQ ID:10355, to the nucleotide sequence of GAM281 RNA, herein designated GAM RNA, also designated SEQ ID:278.

Another function of GAM281 is therefore inhibition of Ptk2 protein tyrosine kinase 2 (PTK2, Accession NP_005598.3), a gene which involves in intracellular signal transduction pathway and is a putative homolog of chicken focal adhesion associated kinase. Accordingly, utilities of GAM281 include diagnosis, prevention and treatment of diseases and clinical conditions associated with PTK2.

The function of PTK2 and its association with various diseases and clinical conditions, has been established by previous studies, as described hereinabove with reference to GAM65.2. Protein tyrosine phosphatase, receptor type, t (PTPRT, Accession NP_008981.2) is another GAM281 target gene, herein designated TARGET GENE. PTPRT BINDING SITE is a target binding site found in the 3' untranslated region of multiple transcripts of mRNA encoded by PTPRT, corresponding to a target binding site such as BINDING SITE I, BINDING SITE II or BINDING SITE III of FIG. 8. Table 4 illustrates the complementarity of the nucleotide sequences of PTPRT BINDING SITE, designated SEQ ID:12157, to the nucleotide sequence of GAM281 RNA, herein designated GAM RNA, also designated SEQ ID:278.

Another function of GAM281 is therefore inhibition of Protein tyrosine phosphatase, receptor type, t (PTPRT, Accession NP_008981.2). Accordingly, utilities of GAM281 include diagnosis, prevention and treatment of diseases and clinical conditions associated with PTPRT.

Protein tyrosine phosphatase, receptor type, t (PTPRT, Accession NP_573400.1) is another GAM281 target gene, herein designated TARGET GENE. PTPRT BINDING SITE is a target binding site found in the 3' untranslated region of multiple transcripts of mRNA encoded by PTPRT, corresponding to a target binding site such as BINDING SITE I, BINDING SITE II or BINDING SITE III of FIG. 8. Table 4 illustrates the complementarity of the nucleotide sequences of PTPRT BINDING SITE, designated SEQ ID:12157, to the nucleotide sequence of GAM281 RNA, herein designated GAM RNA, also designated SEQ ID:278.

Another function of GAM281 is therefore inhibition of Protein tyrosine phosphatase, receptor type, t (PTPRT, Accession NP_573400.1). Accordingly, utilities of GAM281 include diagnosis, prevention and treatment of diseases and clinical conditions associated with PTPRT.

Phosphorylase, glycogen; muscle (mcardle syndrome, glycogen storage disease type v) (PYGM, Accession NP_005600.1) is another GAM281 target gene, herein designated TARGET GENE. PYGM BINDING SITE is a target binding site found in the 5' untranslated region of mRNA encoded by PYGM, corresponding to a target binding site such as BINDING SITE I, BINDING SITE II or BINDING SITE III of FIG. 8. Table 4 illustrates the complementarity of the nucleotide sequences of PYGM BINDING SITE, designated SEQ ID:15938, to the nucleotide sequence of GAM281 RNA, herein designated GAM RNA, also designated SEQ ID:278.

Another function of GAM281 is therefore inhibition of Phosphorylase, glycogen; muscle (mcardle syndrome, glycogen storage disease type v) (PYGM, Accession NP_005600.1). Accordingly, utilities of GAM281 include diagnosis, prevention and treatment of diseases and clinical conditions associated with PYGM.

Peptide yy (Py, Accession NP_004151.1) is another GAM281 target gene, herein designated TARGET GENE. PYY BINDING SITE is a target binding site found in the 3' untranslated region of mRNA encoded by Py, corresponding to a target binding site such as BINDING SITE I, BINDING SITE II or BINDING SITE III of FIG. 8. Table 4 illustrates the complementarity of the nucleotide sequences of PYY BINDING SITE, designated SEQ ID:9133, to the nucleotide sequence of GAM281 RNA, herein designated GAM RNA, also designated SEQ ID:278.

Another function of GAM281 is therefore inhibition of Peptide yy (Py, Accession NP_004151.1). Accordingly, utilities of GAM281 include diagnosis, prevention and treatment of diseases and clinical conditions associated with PYY.

QRSL1 (Accession NP_060762.2) is another GAM281 target gene, herein designated TARGET GENE. QRSL1 BINDING SITE is a target binding site found in the 3' untranslated region of mRNA encoded by QRSL1, corresponding to a target binding site such as BINDING SITE I, BINDING SITE II or BINDING SITE III of FIG. 8. Table 4 illustrates the complementarity of the nucleotide sequences of QRSL1 BINDING SITE, designated SEQ ID:14971, to the nucleotide sequence of GAM281 RNA, herein designated GAM RNA, also designated SEQ ID:278.

Another function of GAM281 is therefore inhibition of QRSL1 (Accession NP_060762.2). Accordingly, utilities of GAM281 include diagnosis, prevention and treatment of diseases and clinical conditions associated with QRSL1.

RAB11-FIP4 (Accession NP_116321.2) is another GAM281 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:13848, to the nucleotide sequence of GAM281 RNA, herein designated GAM RNA, also designated SEQ ID:278.

Another function of GAM281 is therefore inhibition of RAB11-FIP4 (Accession NP_116321.2). Accordingly, utilities of GAM281 include diagnosis, prevention and treatment of diseases and clinical conditions associated with RAB11-FIP4.

Rab21, member ras oncogene family (RAB21, Accession NP_055814.1) is another GAM281 target gene, herein designated TARGET GENE. RAB21 BINDING SITE is a target binding site found in the 3' untranslated region of mRNA encoded by RAB21, corresponding to a target binding site such as BINDING SITE I, BINDING SITE II or BINDING SITE III of FIG. 8. Table 4 illustrates the complementarity of the nucleotide sequences of RAB21 BINDING SITE, designated SEQ ID:7076, to the nucleotide sequence of GAM281 RNA, herein designated GAM RNA, also designated SEQ ID:278.

Another function of GAM281 is therefore inhibition of Rab21, member ras oncogene family (RAB21, Accession NP_055814.1). Accordingly, utilities of GAM281 include diagnosis, prevention and treatment of diseases and clinical conditions associated with RAB21.

Rab33b, member ras oncogene family (RAB33B, Accession NP_112586.1) is another GAM281 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:7910, to the nucleotide sequence of GAM281 RNA, herein designated GAM RNA, also designated SEQ ID:278.

Another function of GAM281 is therefore inhibition of Rab33b, member ras oncogene family (RAB33B, Accession NP_112586.1). Accordingly, utilities of GAM281 include diagnosis, prevention and treatment of diseases and clinical conditions associated with RAB33B.

Rab36, member ras oncogene family (RAB36, Accession NP_004905.1) is another GAM281 target gene, herein designated TARGET GENE. RAB36 BINDING SITE1 and RAB36 BINDING SITE2 are target binding sites found in untranslated regions of mRNA encoded by RAB36, corresponding to target binding sites such as BINDING SITE I, BINDING SITE II or BINDING SITE III of FIG. 8. Table 4 illustrates the complementarity of the nucleotide sequences of RAB36 BINDING SITE1 and RAB36 BINDING SITE2, designated SEQ ID:808 and SEQ ID:1652 respectively, to the nucleotide sequence of GAM281 RNA, herein designated GAM RNA, also designated SEQ ID:278.

Another function of GAM281 is therefore inhibition of Rab36, member ras oncogene family (RAB36, Accession NP_004905.1), a gene which is involved in protein transport. Accordingly, utilities of GAM281 include diagnosis, prevention and treatment of diseases and clinical conditions associated with RAB36.

The function of RAB36 and its association with various diseases and clinical conditions, has been established by previous studies, as described hereinabove with reference to GAM130.1. Rab39, member ras oncogene family (RAB39, Accession XP_084662.1) is another GAM281 target gene, herein designated TARGET GENE. RAB39 BINDING SITE is a target binding site found in the 3' untranslated region of mRNA encoded by RAB39, corresponding to a target binding site such as BINDING SITE I, BINDING SITE II or BINDING SITE III of FIG. 8. Table 4 illustrates the complementarity of the nucleotide sequences of RAB39 BINDING SITE, designated SEQ ID:3754, to the nucleotide sequence of GAM281 RNA, herein designated GAM RNA, also designated SEQ ID:278.

Another function of GAM281 is therefore inhibition of Rab39, member ras oncogene family (RAB39, Accession XP_084662.1). Accordingly, utilities of GAM281 include diagnosis, prevention and treatment of diseases and clinical conditions associated with RAB39.

Rab4a, member ras oncogene family (RAB4A, Accession NP_004569.2) is another GAM281 target gene, herein designated TARGET GENE. RAB4A BINDING SITE is a target binding site found in the 5' untranslated region of mRNA encoded by RAB4A, corresponding to a target binding site such as BINDING SITE I, BINDING SITE II or BINDING SITE III of FIG. 8. Table 4 illustrates the complementarity of the nucleotide sequences of RAB4A BINDING SITE, designated SEQ ID:16568, to the nucleotide sequence of GAM281 RNA, herein designated GAM RNA, also designated SEQ ID:278.

Another function of GAM281 is therefore inhibition of Rab4a, member ras oncogene family (RAB4A, Accession NP_004569.2), a gene which is involved in protein transport. Accordingly, utilities of GAM281 include diagnosis, prevention and treatment of diseases and clinical conditions associated with RAB4A.

The function of RAB4A and its association with various diseases and clinical conditions, has been established by previous studies, as described hereinabove with reference to GAM55.2. Rab, member of ras oncogene family-like 2a (RABL2A, Accession NP_038198.1) is another GAM281 target gene, herein designated TARGET GENE. RABL2A BINDING SITE is a target binding site found in the 3' untranslated region of multiple transcripts of mRNA encoded by RABL2A, corresponding to a target binding site such as BINDING SITE I, BINDING SITE II or BINDING SITE III of FIG. 8. Table 4 illustrates the complementarity of the nucleotide sequences of RABL2A BINDING SITE, designated SEQ ID:2648, to the nucleotide sequence of GAM281 RNA, herein designated GAM RNA, also designated SEQ ID:278.

Another function of GAM281 is therefore inhibition of Rab, member of ras oncogene family-like 2a (RABL2A, Accession NP_038198.1). Accordingly, utilities of GAM281 include diagnosis, prevention and treatment of diseases and clinical conditions associated with RABL2A.

Rab, member of ras oncogene family-like 2b (RABL2B, Accession NP_009012.1) is another GAM281 target gene, herein designated TARGET GENE. RABL2B BINDING SITE is a target binding site found in the 3' untranslated region of mRNA encoded by RABL2B, corresponding to a target binding site such as BINDING SITE I, BINDING SITE II or BINDING SITE III of FIG. 8. Table 4 illustrates the complementarity of the nucleotide sequences of RABL2B BINDING SITE, designated SEQ ID:2648, to the nucleotide sequence of GAM281 RNA, herein designated GAM RNA, also designated SEQ ID:278.

Another function of GAM281 is therefore inhibition of Rab, member of ras oncogene family-like 2b (RABL2B, Accession NP_009012.1). Accordingly, utilities of GAM281 include diagnosis, prevention and treatment of diseases and clinical conditions associated with RABL2B.

RAI (Accession NP_006654.1) is another GAM281 target gene, herein designated TARGET GENE. RAI BINDING SITE is a target binding site found in the 5' untranslated region of mRNA encoded by RAI, corresponding to a target binding site such as BINDING SITE I, BINDING SITE II or BINDING SITE III of FIG. 8. Table 4 illustrates the complementarity of the nucleotide sequences of RAI BINDING SITE, designated SEQ ID:8937, to the nucleotide sequence of GAM281 RNA, herein designated GAM RNA, also designated SEQ ID:278.

Another function of GAM281 is therefore inhibition of RAI (Accession NP_006654.1). Accordingly, utilities of GAM281 include diagnosis, prevention and treatment of diseases and clinical conditions associated with RAI.

Retinoic acid induced 17 (RAI17, Accession NP_065071.1) is another GAM281 target gene, herein designated TARGET GENE. RAI17 BINDING SITE is a target binding site found in the 3' untranslated region of multiple transcripts of mRNA encoded by RAI17, corresponding to a target binding site such as BINDING SITE I, BINDING SITE II or BINDING SITE III of FIG. 8. Table 4 illustrates the complementarity of the nucleotide sequences of RAI17 BINDING SITE, designated SEQ ID:7523, to the nucleotide sequence of GAM281 RNA, herein designated GAM RNA, also designated SEQ ID:278.

Another function of GAM281 is therefore inhibition of Retinoic acid induced 17 (RAI17, Accession NP_065071.1). Accordingly, utilities of GAM281 include diagnosis, prevention and treatment of diseases and clinical conditions associated with RAI17.

Retinoic acid induced 17 (RAI17, Accession XP_166091.2) is another GAM281 target gene, herein designated TARGET GENE. RAI17 BINDING SITE is a target binding site found in the 3' untranslated region of multiple transcripts of mRNA encoded by RAI17, corresponding to a target binding site such as BINDING SITE I, BINDING SITE II or BINDING SITE III of FIG. 8. Table 4 illustrates the complementarity of the nucleotide sequences of RAI17 BINDING SITE, designated SEQ ID:7523, to the nucleotide sequence of GAM281 RNA, herein designated GAM RNA, also designated SEQ ID:278.

Another function of GAM281 is therefore inhibition of Retinoic acid induced 17 (RAI17, Accession XP_166091.2). Accordingly, utilities of GAM281 include diagnosis, prevention and treatment of diseases and clinical conditions associated with RAI17.

Retinoic acid induced 3 (RAI3, Accession NP_003970.1) is another GAM281 target gene, herein designated TARGET GENE. RAI3 BINDING SITE is a target binding site found in the 3' untranslated region of mRNA encoded by RAI3, corresponding to a target binding site such as BINDING SITE I, BINDING SITE II or BINDING SITE III of FIG. 8. Table 4 illustrates the complementarity of the nucleotide sequences of RAI3 BINDING SITE, designated SEQ ID:12784, to the nucleotide sequence of GAM281 RNA, herein designated GAM RNA, also designated SEQ ID:278.

Another function of GAM281 is therefore inhibition of Retinoic acid induced 3 (RAI3, Accession NP_003970.1). Accordingly, utilities of GAM281 include diagnosis, prevention and treatment of diseases and clinical conditions associated with RAI3.

RAP140 (Accession NP_056039.1) is another GAM281 target gene, herein designated TARGET GENE. RAP140 BINDING SITE is a target binding site found in the 3' untranslated region of mRNA encoded by RAP140, corresponding to a target binding site such as BINDING SITE I, BINDING SITE II or BINDING SITE III of FIG. 8. Table 4 illustrates the complementarity of the nucleotide sequences of RAP140 BINDING SITE, designated SEQ ID:16472, to the nucleotide sequence of GAM281 RNA, herein designated GAM RNA, also designated SEQ ID:278.

Another function of GAM281 is therefore inhibition of RAP140 (Accession NP_056039.1). Accordingly, utilities of GAM281 include diagnosis, prevention and treatment of diseases and clinical conditions associated with RAP140.

Retinoic acid receptor, gamma (RARG, Accession NP_000957.1) is another GAM281 target gene, herein designated TARGET GENE. RARG BINDING SITE is a target binding site found in the 5' untranslated region of mRNA encoded by RARG, corresponding to a target binding site such as BINDING SITE I, BINDING SITE II or BINDING SITE III of FIG. 8. Table 4 illustrates the complementarity of the nucleotide sequences of RARG BINDING SITE, designated SEQ ID:11090, to the nucleotide sequence of GAM281 RNA, herein designated GAM RNA, also designated SEQ ID:278.

Another function of GAM281 is therefore inhibition of Retinoic acid receptor, gamma (RARG, Accession NP_000957.1). Accordingly, utilities of GAM281 include diagnosis, prevention and treatment of diseases and clinical conditions associated with RARG.

Ras association (ralgds/af-6) domain family 2 (RASSF2, Accession NP_739580.1) is another GAM281 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM281 RNA, herein designated GAM RNA, also designated SEQ ID:278.

Another function of GAM281 is therefore inhibition of Ras association (ralgds/af-6) domain family 2 (RASSF2, Accession NP_739580.1). Accordingly, utilities of GAM281 include diagnosis, prevention and treatment of diseases and clinical conditions associated with RASSF2.

Ras association (ralgds/af-6) domain family 2 (RASSF2, Accession NP_739579.1) is another GAM281 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM281 RNA, herein designated GAM RNA, also designated SEQ ID:278.

Another function of GAM281 is therefore inhibition of Ras association (ralgds/af-6) domain family 2 (RASSF2, Accession NP_739579.1). Accordingly, utilities of GAM281 include diagnosis, prevention and treatment of diseases and clinical conditions associated with RASSF2.

Ras association (ralgds/af-6) domain family 2 (RASSF2, Accession NP_055552.1) is another GAM281 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM281 RNA, herein designated GAM RNA, also designated SEQ ID:278.

Another function of GAM281 is therefore inhibition of Ras association (ralgds/af-6) domain family 2 (RASSF2, Accession NP_055552.1). Accordingly, utilities of GAM281 include diagnosis, prevention and treatment of diseases and clinical conditions associated with RASSF2.

RBAK (Accession NP_066986.1) is another GAM281 target gene, herein designated TARGET GENE. RBAK BINDING SITE is a target binding site found in the 5' untranslated region of mRNA encoded by RBAK, corresponding to a target binding site such as BINDING SITE I, BINDING SITE II or BINDING SITE III of FIG. 8. Table 4 illustrates the complementarity of the nucleotide sequences of RBAK BINDING SITE, designated SEQ ID:12965, to the nucleotide sequence of GAM281 RNA, herein designated GAM RNA, also designated SEQ ID:278.

Another function of GAM281 is therefore inhibition of RBAK (Accession NP_066986.1). Accordingly, utilities of GAM281 include diagnosis, prevention and treatment of diseases and clinical conditions associated with RBAK.

Retinoblastoma binding protein 9 (RBBP9, Accession NP_006597.2) is another GAM281 target gene, herein designated TARGET GENE. RBBP9 BINDING SITE is a target binding site found in the 3' untranslated region of multiple transcripts of mRNA encoded by RBBP9, corresponding to a target binding site such as BINDING SITE I, BINDING SITE II or BINDING SITE III of FIG. 8. Table 4 illustrates the complementarity of the nucleotide sequences of RBBP9 BINDING SITE, designated SEQ ID:16100, to the nucleotide sequence of GAM281 RNA, herein designated GAM RNA, also designated SEQ ID:278.

Another function of GAM281 is therefore inhibition of Retinoblastoma binding protein 9 (RBBP9, Accession NP_006597.2). Accordingly, utilities of GAM281 include diagnosis, prevention and treatment of diseases and clinical conditions associated with RBBP9.

RCBTB1 (Accession NP_060661.2) is another GAM281 target gene, herein designated TARGET GENE. RCBTB1 BINDING SITE is a target binding site found in the 5' untranslated region of mRNA encoded by RCBTB1, corresponding to a target binding site such as BINDING SITE I, BINDING SITE II or BINDING SITE III of FIG. 8. Table 4 illustrates the complementarity of the nucleotide sequences of RCBTB1 BINDING SITE, designated SEQ ID:13829, to the nucleotide sequence of GAM281 RNA, herein designated GAM RNA, also designated SEQ ID:278.

Another function of GAM281 is therefore inhibition of RCBTB1 (Accession NP_060661.2). Accordingly, utilities of GAM281 include diagnosis, prevention and treatment of diseases and clinical conditions associated with RCBTB1.

RCD-8 (Accession NP_055144.2) is another GAM281 target gene, herein designated TARGET GENE. RCD-8 BINDING SITE is a target binding site found in the 3' untranslated region of mRNA encoded by RCD-8, corresponding to a target binding site such as BINDING SITE I, BINDING SITE II or BINDING SITE III of FIG. 8. Table 4 illustrates the complementarity of the nucleotide sequences of RCD-8 BINDING SITE, designated SEQ ID:13335, to the nucleotide sequence of GAM281 RNA, herein designated GAM RNA, also designated SEQ ID:278.

Another function of GAM281 is therefore inhibition of RCD-8 (Accession NP_055144.2). Accordingly, utilities of GAM281 include diagnosis, prevention and treatment of diseases and clinical conditions associated with RCD-8.

RDH13 (Accession NP_612421.1) is another GAM281 target gene, herein designated TARGET GENE. RDH13 BINDING SITE is a target binding site found in the 5' untranslated region of mRNA encoded by RDH13, corresponding to a target binding site such as BINDING SITE I, BINDING SITE II or BINDING SITE III of FIG. 8. Table 4 illustrates the complementarity of the nucleotide sequences of RDH13 BINDING SITE, designated SEQ ID:9713, to the nucleotide sequence of GAM281 RNA, herein designated GAM RNA, also designated SEQ ID:278.

Another function of GAM281 is therefore inhibition of RDH13 (Accession NP_612421.1). Accordingly, utilities of GAM281 include diagnosis, prevention and treatment of diseases and clinical conditions associated with RDH13.

REC14 (Accession NP_079510.1) is another GAM281 target gene, herein designated TARGET GENE. REC14 BINDING SITE is a target binding site found in the 5' untranslated region of mRNA encoded by REC14, corresponding to a target binding site such as BINDING SITE I, BINDING SITE II or BINDING SITE III of FIG. 8. Table 4 illustrates the complementarity of the nucleotide sequences of REC14 BINDING SITE, designated SEQ ID:5212, to the nucleotide sequence of GAM281 RNA, herein designated GAM RNA, also designated SEQ ID:278.

Another function of GAM281 is therefore inhibition of REC14 (Accession NP_079510.1). Accordingly, utilities of GAM281 include diagnosis, prevention and treatment of diseases and clinical conditions associated with REC14.

Regenerating islet-derived-like, pancreatic stone protein-like, pancreatic thread protein-like (rat) (REGL, Accession NP_006499.1) is another GAM281 target gene, herein designated TARGET GENE. REGL BINDING SITE is a target binding site found in the 3' untranslated region of mRNA encoded by REGL, corresponding to a target binding site such as BINDING SITE I, BINDING SITE II or BINDING SITE III of FIG. 8. Table 4 illustrates the complementarity of the nucleotide sequences of REGL BINDING SITE, designated SEQ ID:1455, to the nucleotide sequence of GAM281 RNA, herein designated GAM RNA, also designated SEQ ID:278.

Another function of GAM281 is therefore inhibition of Regenerating islet-derived-like, pancreatic stone protein-like, pancreatic thread protein-like (rat) (REGL, Accession NP_006499.1), a gene which is a member of REG family with unknown function. Accordingly, utilities of GAM281 include diagnosis, prevention and treatment of diseases and clinical conditions associated with REGL.

The function of REGL and its association with various diseases and clinical conditions, has been established by previous studies, as described hereinabove with reference to GAM63.1. Regulator of g-protein signalling 16 (RGS16, Accession NP_002919.1) is another GAM281 target gene, herein designated TARGET GENE. RGS16 BINDING SITE is a target binding site found in the 3' untranslated region of mRNA encoded by RGS16, corresponding to a target binding site such as BINDING SITE I, BINDING SITE II or BINDING SITE III of FIG. 8. Table 4 illustrates the complementarity of the nucleotide sequences of RGS16 BINDING SITE, designated SEQ ID:13380, to the nucleotide sequence of GAM281 RNA, herein designated GAM RNA, also designated SEQ ID:278.

Another function of GAM281 is therefore inhibition of Regulator of g-protein signalling 16 (RGS16, Accession NP_002919.1), a gene which inhibits signal transduction. Accordingly, utilities of GAM281 include diagnosis, prevention and treatment of diseases and clinical conditions associated with RGS16.

The function of RGS16 has been established by previous studies. Snow et al. (1998) found that the RGS16 gene contains 5 exons. Northern blot analysis revealed that RGS16 is expressed at high levels in retina and at lower levels in all other tissues examined. By searching for retinal-specific RGS family members that might be involved in the phototransduction cascade, Chen et al. (1996) identified cDNAs encoding the mouse and rat homologs of RGS16, called Rgs-r by them. Northern blot analysis showed that rat Rgs16 is expressed predominantly in the retina. Chen et al. (1996) found that mouse Rgs16 enhances the rate of GTP-hydrolysis by transducin (see OMIM Ref. No. GNAT2; 139340), suggesting that Rgs16 may play a role in regulating the kinetics of signaling in the phototransduction cascade. The mouse and rat Rgs16 proteins have 94% amino acid sequence identity. Snow et al. (1998) reported that the mouse and human RGS16 proteins have 86% amino acid sequence identity Full details of the abovementioned studies are described in the following publications, the disclosure of which are hereby incorporated by reference:

Snow, B. E.; Antonio, L.; Suggs, S.; Siderovski, D. P.: Cloning of a retinally abundant regulator of G-protein signaling (RGS-r/RGS16): genomic structure and chromosomal localization of the human gene. Gene 206:247-253, 1998; and Chen, C.-K.; Wieland, T.; Simon, M. I.: RGS-r, a retinal specific RGS protein, binds an intermediate conformation of transducin and enhances recycling. Proc. Nat. Acad. Sci. 93:12885-1288.

Further studies establishing the function and utilities of RGS16 are found in John Hopkins OMIM database record ID 602514, and in cited publications listed in Table 5, which are hereby incorporated by reference. Regulator of g-protein signalling 3 (RGS3, Accession NP_570613.1) is another GAM281 target gene, herein designated TARGET GENE. RGS3 BINDING SITE is a target binding site found in the 5' untranslated region of multiple transcripts of mRNA encoded by RGS3, corresponding to a target binding site such as BINDING SITE I, BINDING SITE II or BINDING SITE III of FIG. 8. Table 4 illustrates the complementarity of the nucleotide sequences of RGS3 BINDING SITE, designated SEQ ID:3344, to the nucleotide sequence of GAM281 RNA, herein designated GAM RNA, also designated SEQ ID:278.

Another function of GAM281 is therefore inhibition of Regulator of g-protein signalling 3 (RGS3, Accession NP_570613.1), a gene which negatively regulates G protein-coupled receptor signalling. Accordingly, utilities of GAM281 include diagnosis, prevention and treatment of diseases and clinical conditions associated with RGS3.

The function of RGS3 and its association with various diseases and clinical conditions, has been established by previous studies, as described hereinabove with reference to GAM146.1. Rhesus blood group, d antigen (RHD, Accession NP_057208.2) is another GAM281 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:4143 and SEQ ID:13465 respectively, to the nucleotide sequence of GAM281 RNA, herein designated GAM RNA, also designated SEQ ID:278.

Another function of GAM281 is therefore inhibition of Rhesus blood group, d antigen (RHD, Accession NP_057208.2), a gene which Major antigen of the RH system. Accordingly, utilities of GAM281 diagnosis, prevention and treatment of diseases and clinical conditions associated with RHD.

The function of RHD and its association with various diseases and clinical conditions, has been established by previous studies, as described hereinabove with reference to GAM161.1. Rhesus blood group, d antigen (RHD, Accession NP_057309.2) is another GAM281 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:4143 and SEQ ID:13465 respectively, to the nucleotide sequence of GAM281 RNA, herein designated GAM RNA, also designated SEQ ID:278.

Another function of GAM281 is therefore inhibition of Rhesus blood group, d antigen (RHD, Accession NP_057309.2), a gene which Major antigen of the RH system. Accordingly, utilities of GAM281 include diagnosis, prevention and treatment of diseases and clinical conditions associated with RHD.

The function of RHD and its association with various diseases and clinical conditions, has been established by previous studies, as described hereinabove with reference to GAM161.1. RHPN2 (Accession NP_149094.2) is another GAM281 target gene, herein designated TARGET GENE. RHPN2 BINDING SITE is a target binding site found in the 3' untranslated region of mRNA encoded by RHPN2, corresponding to a target binding site such as BINDING SITE I, BINDING SITE II or BINDING SITE III of FIG. 8. Table 4 illustrates the complementarity of the nucleotide sequences of RHPN2 BINDING SITE, designated SEQ ID:11803, to the nucleotide sequence of GAM281 RNA, herein designated GAM RNA, also designated SEQ ID:278.

Another function of GAM281 is therefore inhibition of RHPN2 (Accession NP_149094.2). Accordingly, utilities of GAM281 include diagnosis, prevention and treatment of diseases and clinical conditions associated with RHPN2.

RNF137 (Accession NP_060543.4) is another GAM281 target gene, herein designated TARGET GENE. RNF137 BINDING SITE1 and RNF137 BINDING SITE2 are target binding sites found in untranslated regions of mRNA encoded by RNF137, corresponding to target binding sites such as BINDING SITE I, BINDING SITE II or BINDING SITE III of FIG. 8. Table 4 illustrates the complementarity of the nucleotide sequences of RNF137 BINDING SITE1 and RNF137 BINDING SITE2, designated SEQ ID:16940 and SEQ ID:7446 respectively, to the nucleotide sequence of GAM281 RNA, herein designated GAM RNA, also designated SEQ ID:278.

Another function of GAM281 is therefore inhibition of RNF137 (Accession NP_060543.4). Accordingly, utilities of GAM281 include diagnosis, prevention and treatment of diseases and clinical conditions associated with RNF137.

RNF144 (Accession NP_055561.1) is another GAM281 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:13909, to the nucleotide sequence of GAM281 RNA, herein designated GAM RNA, also designated SEQ ID:278.

Another function of GAM281 is therefore inhibition of RNF144 (Accession NP_055561.1). Accordingly, utilities of GAM281 include diagnosis, prevention and treatment of diseases and clinical conditions associated with RNF144.

Ring finger protein (c3hc4 type) 8 (RNF8, Accession NP_003949.1) is another GAM281 target gene, herein designated TARGET GENE. RNF8 BINDING SITE is a target binding site found in the 3' untranslated region of mRNA encoded by RNF8, corresponding to a target binding site such as BINDING SITE I, BINDING SITE II or BINDING SITE III of FIG. 8. Table 4 illustrates the complementarity of the nucleotide sequences of RNF8 BINDING SITE, designated SEQ ID:13778, to the nucleotide sequence of GAM281 RNA, herein designated GAM RNA, also designated SEQ ID:278.

Another function of GAM281 is therefore inhibition of Ring finger protein (c3hc4 type) 8 (RNF8, Accession NP_003949.1). Accordingly, utilities of GAM281 include diagnosis, prevention and treatment of diseases and clinical conditions associated with RNF8.

Rna binding protein s1, serine-rich domain (RNPS1, Accession NP_542161.1) is another GAM281 target gene, herein designated TARGET GENE. RNPS1 BINDING SITE is a target binding site found in the 3' untranslated region of multiple transcripts of mRNA encoded by RNPS1, corresponding to a target binding site such as BINDING SITE I, BINDING SITE II or BINDING SITE III of FIG. 8. Table 4 illustrates the complementarity of the nucleotide sequences of RNPS1 BINDING SITE, designated SEQ ID:1646, to the nucleotide sequence of GAM281 RNA, herein designated GAM RNA, also designated SEQ ID:278.

Another function of GAM281 is therefore inhibition of Rna binding protein s1, serine-rich domain (RNPS1, Accession NP_542161.1). Accordingly, utilities of GAM281 include diagnosis, prevention and treatment of diseases and clinical conditions associated with RNPS1.

Rna binding protein s1, serine-rich domain (RNPS1, Accession NP_006702.1) is another GAM281 target gene, herein designated TARGET GENE. RNPS1 BINDING SITE is a target binding site found in the 3' untranslated region of multiple transcripts of mRNA encoded by RNPS1, corresponding to a target binding site such as BINDING SITE I, BINDING SITE II or BINDING SITE III of FIG. 8. Table 4 illustrates the complementarity of the nucleotide sequences of RNPS1 BINDING SITE, designated SEQ ID:1646, to the nucleotide sequence of GAM281 RNA, herein designated GAM RNA, also designated SEQ ID:278.

Another function of GAM281 is therefore inhibition of Rna binding protein s1, serine-rich domain (RNPS1, Accession NP_006702.1). Accordingly, utilities of GAM281 include diagnosis, prevention and treatment of diseases and clinical conditions associated with RNPS1.

Retinitis pigmentosa 2 (x-linked recessive) (RP2, Accession NP_008846.1) is another GAM281 target gene, herein designated TARGET GENE. RP2 BINDING SITE is a target binding site found in the 3' untranslated region of mRNA encoded by RP2, corresponding to a target binding site such as BINDING SITE I, BINDING SITE II or BINDING SITE III of FIG. 8. Table 4 illustrates the complementarity of the nucleotide sequences of RP2 BINDING SITE, designated SEQ ID:6582, to the nucleotide sequence of GAM281 RNA, herein designated GAM RNA, also designated SEQ ID:278.

Another function of GAM281 is therefore inhibition of Retinitis pigmentosa 2 (x-linked recessive) (RP2, Accession NP_008846.1). Accordingly, utilities of GAM281 include diagnosis, prevention and treatment of diseases and clinical conditions associated with RP2.

Rabphilin 3a-like (without c2 domains) (RPH3AL, Accession NP_008918.1) is another GAM281 target gene, herein designated TARGET GENE. RPH3AL BINDING SITE is a target binding site found in the 3' untranslated region of mRNA encoded by RPH3AL, corresponding to a target binding site such as BINDING SITE I, BINDING SITE II or BINDING SITE III of FIG. 8. Table 4 illustrates the complementarity of the nucleotide sequences of RPH3AL BINDING SITE, designated SEQ ID:2614, to the nucleotide sequence of GAM281 RNA, herein designated GAM RNA, also designated SEQ ID:278.

Another function of GAM281 is therefore inhibition of Rabphilin 3a-like (without c2 domains) (RPH3AL, Accession NP_008918.1), a gene which is a protein transporter. could play a role in neurotransmitter release by regulating membrane flow in the nerve terminal. Accordingly, utilities of GAM281 include diagnosis, prevention and treatment of diseases and clinical conditions associated with RPH3AL.

The function of RPH3AL and its association with various diseases and clinical conditions, has been established by previous studies, as described hereinabove with reference to GAM189.1. RPP30 (Accession NP_006404.1) is another GAM281 target gene, herein designated TARGET GENE. RPP30 BINDING SITE1 and RPP30 BINDING SITE2 are target binding sites found in untranslated regions of mRNA encoded by RPP30, corresponding to target binding sites such as BINDING SITE I, BINDING SITE II or BINDING SITE III of FIG. 8. Table 4 illustrates the complementarity of the nucleotide sequences of RPP30 BINDING SITE1 and RPP30 BINDING SITE2, designated SEQ ID:19325 and SEQ ID:445 respectively, to the nucleotide sequence of GAM281 RNA, herein designated GAM RNA, also designated SEQ ID:278.

Another function of GAM281 is therefore inhibition of RPP30 (Accession NP_006404.1), a gene which is a component of ribonuclease p that processes 5' ends of precursor tRNAs. Accordingly, utilities of GAM281 include diagnosis, prevention and treatment of diseases and clinical conditions associated with RPP30.

The function of RPP30 and its association with various diseases and clinical conditions, has been established by previous studies, as described hereinabove with reference to GAM136.1. RRP40 (Accession NP_057126.1) is another GAM281 target gene, herein designated TARGET GENE. RRP40 BINDING SITE is a target binding site found in the 5' untranslated region of mRNA encoded by RRP40, corresponding to a target binding site such as BINDING SITE I, BINDING SITE II or BINDING SITE III of FIG. 8. Table 4 illustrates the complementarity of the nucleotide sequences of RRP40 BINDING SITE, designated SEQ ID:14169, to the nucleotide sequence of GAM281 RNA, herein designated GAM RNA, also designated SEQ ID:278.

Another function of GAM281 is therefore inhibition of RRP40 (Accession NP_057126.1). Accordingly, utilities of GAM281 include diagnosis, prevention and treatment of diseases and clinical conditions associated with RRP40.

S100A15 (Accession NP_789793.1) is another GAM281 target gene, herein designated TARGET GENE. S100A15 BINDING SITE is a target binding site found in the 3' untranslated region of mRNA encoded by S100A15, corresponding to a target binding site such as BINDING SITE I, BINDING SITE II or BINDING SITE III of FIG. 8. Table 4 illustrates the complementarity of the nucleotide sequences of S100A15 BINDING SITE, designated SEQ ID:19723, to the nucleotide sequence of GAM281 RNA, herein designated GAM RNA, also designated SEQ ID:278.

Another function of GAM281 is therefore inhibition of S100A15 (Accession NP_789793.1). Accordingly, utilities of GAM281 include diagnosis, prevention and treatment of diseases and clinical conditions associated with S100A15.

SARM1 (Accession NP_055892.1) is another GAM281 target gene, herein designated TARGET GENE. SARM1 BINDING SITE1 and SARM1 BINDING SITE2 are target binding sites found in untranslated regions of mRNA encoded by SARM1, corresponding to target binding sites such as BINDING SITE I, BINDING SITE II or BINDING SITE III of FIG. 8. Table 4 illustrates the complementarity of the nucleotide sequences of SARM1 BINDING SITE1 and SARM1 BINDING SITE2, designated SEQ ID:4282 and SEQ ID:7147 respectively, to the nucleotide sequence of GAM281 RNA, herein designated GAM RNA, also designated SEQ ID:278.

Another function of GAM281 is therefore inhibition of SARM1 (Accession NP_055892.1). Accordingly, utilities of GAM281 include diagnosis, prevention and treatment of diseases and clinical conditions associated with SARM1.

Sarcoma amplified sequence (SAS, Accession NP_005972.1) is another GAM281 target gene, herein designated TARGET GENE. SAS BINDING SITE is a target binding site found in the 3' untranslated region of mRNA encoded by SAS, corresponding to a target binding site such as BINDING SITE I, BINDING SITE II or BINDING SITE III of FIG. 8. Table 4 illustrates the complementarity of the nucleotide sequences of SAS BINDING SITE, designated SEQ ID:17726, to the nucleotide sequence of GAM281 RNA, herein designated GAM RNA, also designated SEQ ID:278.

Another function of GAM281 is therefore inhibition of Sarcoma amplified sequence (SAS, Accession NP_005972.1), a gene which is a member of the transmembrane 4 superfamily (TM4SF) and may be involved in growth-related cellular processes T. Accordingly, utilities of GAM281 include diagnosis, prevention and treatment of diseases and clinical conditions associated with SAS.

The function of SAS and its association with various diseases and clinical conditions, has been established by previous studies, as described hereinabove with reference to GAM88.1. SBLF (Accession NP_006864.2) is another GAM281 target gene, herein designated TARGET GENE. SBLF BINDING SITE is a target binding site found in the 3' untranslated region of mRNA encoded by SBLF, corresponding to a target binding site such as BINDING SITE I, BINDING SITE II or BINDING SITE III of FIG. 8. Table 4 illustrates the complementarity of the nucleotide sequences of SBLF BINDING SITE, designated SEQ ID:14551, to the nucleotide sequence of GAM281 RNA, herein designated GAM RNA, also designated SEQ ID:278.

Another function of GAM281 is therefore inhibition of SBLF (Accession NP_006864.2). Accordingly, utilities of GAM281 include diagnosis, prevention and treatment of diseases and clinical conditions associated with SBLF.

SCAMP-4 (Accession NP_524558.1) is another GAM281 target gene, herein designated TARGET GENE. SCAMP-4 BINDING SITE is a target binding site found in the 3' untranslated region of mRNA encoded by SCAMP-4, corresponding to a target binding site such as BINDING SITE I, BINDING SITE II or BINDING SITE III of FIG. 8. Table 4 illustrates the complementarity of the nucleotide sequences of SCAMP-4 BINDING SITE, designated SEQ ID:2153, to the nucleotide sequence of GAM281 RNA, herein designated GAM RNA, also designated SEQ ID:278.

Another function of GAM281 is therefore inhibition of SCAMP-4 (Accession NP_524558.1). Accordingly, utilities of GAM281 include diagnosis, prevention and treatment of diseases and clinical conditions associated with SCAMP-4.

Scan domain containing 2 (SCAND2, Accession NP_071333.2) is another GAM281 target gene, herein designated TARGET GENE. SCAND2 BINDING SITE is a target binding site found in the 3' untranslated region of multiple transcripts of mRNA encoded by SCAND2, corresponding to a target binding site such as BINDING SITE I, BINDING SITE II or BINDING SITE III of FIG. 8. Table 4 illustrates the complementarity of the nucleotide sequences of SCAND2 BINDING SITE, designated SEQ ID:7179, to the nucleotide sequence of GAM281 RNA, herein designated GAM RNA, also designated SEQ ID:278.

Another function of GAM281 is therefore inhibition of Scan domain containing 2 (SCAND2, Accession NP_071333.2). Accordingly, utilities of GAM281 include diagnosis, prevention and treatment of diseases and clinical conditions associated with SCAND2.

SCAP (Accession NP_036367.1) is another GAM281 target gene, herein designated TARGET GENE. SCAP BINDING SITE is a target binding site found in the 3' untranslated region of mRNA encoded by SCAP, corresponding to a target binding site such as BINDING SITE I, BINDING SITE II or BINDING SITE III of FIG. 8. Table 4 illustrates the complementarity of the nucleotide sequences of SCAP BINDING SITE, designated SEQ ID:9400, to the nucleotide sequence of GAM281 RNA, herein designated GAM RNA, also designated SEQ ID:278.

Another function of GAM281 is therefore inhibition of SCAP (Accession NP_036367.1). Accordingly, utilities of GAM281 include diagnosis, prevention and treatment of diseases and clinical conditions associated with SCAP.

Scavenger receptor class f, member 1 (SCARF1, Accession NP_003684.1) is another GAM281 target gene, herein designated TARGET GENE. SCARF1 BINDING SITE is a target binding site found in the 3' untranslated region of mRNA encoded by SCARF1, corresponding to a target binding site such as BINDING SITE I, BINDING SITE II or BINDING SITE III of FIG. 8. Table 4 illustrates the complementarity of the nucleotide sequences of SCARF1 BINDING SITE, designated SEQ ID:5158, to the nucleotide sequence of GAM281 RNA, herein designated GAM RNA, also designated SEQ ID:278.

Another function of GAM281 is therefore inhibition of Scavenger receptor class f, member 1 (SCARF1, Accession NP_003684.1). Accordingly, utilities of GAM281 include diagnosis, prevention and treatment of diseases and clinical conditions associated with SCARF1.

Sex comb on midleg-like 2 (drosophila) (SCML2, Accession NP_006080.1) is another GAM281 target gene, herein designated TARGET GENE. SCML2 BINDING SITE is a target binding site found in the 3' untranslated region of mRNA encoded by SCML2, corresponding to a target binding site such as BINDING SITE I, BINDING SITE II or BINDING SITE III of FIG. 8. Table 4 illustrates the complementarity of the nucleotide sequences of SCML2 BINDING SITE, designated SEQ ID:3898, to the nucleotide sequence of GAM281 RNA, herein designated GAM RNA, also designated SEQ ID:278.

Another function of GAM281 is therefore inhibition of Sex comb on midleg-like 2 (drosophila) (SCML2, Accession NP_006080.1). Accordingly, utilities of GAM281 include diagnosis, prevention and treatment of diseases and clinical conditions associated with SCML2.

SCN3B (Accession NP_060870.1) is another GAM281 target gene, herein designated TARGET GENE. SCN3B BINDING SITE1 and SCN3B BINDING SITE2 are target binding sites found in untranslated regions of mRNA encoded by SCN3B, corresponding to target binding sites such as BINDING SITE I, BINDING SITE II or BINDING SITE III of FIG. 8. Table 4 illustrates the complementarity of the nucleotide sequences of SCN3B BINDING SITE1 and SCN3B BINDING SITE2, designated SEQ ID:16355 and SEQ ID:4399 respectively, to the nucleotide sequence of GAM281 RNA, herein designated GAM RNA, also designated SEQ ID:278.

Another function of GAM281 is therefore inhibition of SCN3B (Accession NP_060870.1). Accordingly, utilities of GAM281 include diagnosis, prevention and treatment of diseases and clinical conditions associated with SCN3B.

SDS-RS1 (Accession NP_612441.1) is another GAM281 target gene, herein designated TARGET GENE. SDS-RS1 BINDING SITE is a target binding site found in the 5' untranslated region of mRNA encoded by SDS-RS1, corresponding to a target binding site such as BINDING SITE I, BINDING SITE II or BINDING SITE III of FIG. 8. Table 4 illustrates the complementarity of the nucleotide sequences of SDS-RS1 BINDING SITE, designated SEQ ID:14127, to the nucleotide sequence of GAM281 RNA, herein designated GAM RNA, also designated SEQ ID:278.

Another function of GAM281 is therefore inhibition of SDS-RS1 (Accession NP_612441.1). Accordingly, utilities of GAM281 include diagnosis, prevention and treatment of diseases and clinical conditions associated with SDS-RS1.

Spondyloepiphyseal dysplasia, late (SEDL, Accession NP_055378.1) is another GAM281 target gene, herein designated TARGET GENE. SEDL BINDING SITE1 through SEDL BINDING SITE4 are target binding sites found in untranslated regions of mRNA encoded by SEDL, corresponding to target binding sites such as BINDING SITE I, BINDING SITE II or BINDING SITE III of FIG. 8. Table 4 illustrates the complementarity of the nucleotide sequences of SEDL BINDING SITE1 through SEDL BINDING SITE4, designated SEQ ID:11591, SEQ ID:16937, SEQ ID:15576 and SEQ ID:926 respectively, to the nucleotide sequence of GAM281 RNA, herein designated GAM RNA, also designated SEQ ID:278.

Another function of GAM281 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM281 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. SELH (Accession NP_734467.1) is another GAM281 target gene, herein designated TARGET GENE. SELH BINDING SITE is a target binding site found in the 5' untranslated region of mRNA encoded by SELH, corresponding to a target binding site such as BINDING SITE I, BINDING SITE II or BINDING SITE III of FIG. 8. Table 4 illustrates the complementarity of the nucleotide sequences of SELH BINDING SITE, designated SEQ ID:13030, to the nucleotide sequence of GAM281 RNA, herein designated GAM RNA, also designated SEQ ID:278.

Another function of GAM281 is therefore inhibition of SELH (Accession NP_734467.1). Accordingly, utilities of GAM281 include diagnosis, prevention and treatment of diseases and clinical conditions associated with SELH.

Sema domain, immunoglobulin domain (ig), short basic domain, secreted, (semaphorin) 3b (SEMA3B, Accession NP_004627.1) is another GAM281 target gene, herein designated TARGET GENE. SEMA3B BINDING SITE is a target binding site found in the 3' untranslated region of mRNA encoded by SEMA3B, corresponding to a target binding site such as BINDING SITE I, BINDING SITE II or BINDING SITE III of FIG. 8. Table 4 illustrates the complementarity of the nucleotide sequences of SEMA3B BINDING SITE, designated SEQ ID:17810, to the nucleotide sequence of GAM281 RNA, herein designated GAM RNA, also designated SEQ ID:278.

Another function of GAM281 is therefore inhibition of Sema domain, immunoglobulin domain (ig), short basic domain, secreted, (semaphorin) 3b (SEMA3B, Accession NP_004627.1). Accordingly, utilities of GAM281 include diagnosis, prevention and treatment of diseases and clinical conditions associated with SEMA3B.

Sema domain, immunoglobulin domain (ig), short basic domain, secreted, (semaphorin) 3e (SEMA3E, Accession NP_036563.1) is another GAM281 target gene, herein designated TARGET GENE. SEMA3E BINDING SITE is a target binding site found in the 3' untranslated region of mRNA encoded by SEMA3E, corresponding to a target binding site such as BINDING SITE I, BINDING SITE II or BINDING SITE III of FIG. 8. Table 4 illustrates the complementarity of the nucleotide sequences of SEMA3E BIND- ING SITE, designated SEQ ID:13353, to the nucleotide sequence of GAM281 RNA, herein designated GAM RNA, also designated SEQ ID:278.

Another function of GAM281 is therefore inhibition of Sema domain, immunoglobulin domain (ig), short basic domain, secreted, (semaphorin) 3e (SEMA3E, Accession NP_036563.1). Accordingly, utilities of GAM281 include diagnosis, prevention and treatment of diseases and clinical conditions associated with SEMA3E.

Selenoprotein n, 1 (SEPN1, Accession NP_065184.1) is another GAM281 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:18255, to the nucleotide sequence of GAM281 RNA, herein designated GAM RNA, also designated SEQ ID:278.

Another function of GAM281 is therefore inhibition of Selenoprotein n, 1 (SEPN1, Accession NP_065184.1). Accordingly, utilities of GAM281 include diagnosis, prevention and treatment of diseases and clinical conditions associated with SEPN1.

Small edrk-rich factor 1a (telomeric) (SERF1A, Accession NP_068802.1) is another GAM281 target gene, herein designated TARGET GENE. SERF1A BINDING SITE1 and SERF1A BINDING SITE2 are target binding sites found in untranslated regions of mRNA encoded by SERF1A, corresponding to target binding sites such as BINDING SITE I, BINDING SITE II or BINDING SITE III of FIG. 8. Table 4 illustrates the complementarity of the nucleotide sequences of SERF1A BINDING SITE1 and SERF1A BINDING SITE2, designated SEQ ID:9219 and SEQ ID:15849 respectively, to the nucleotide sequence of GAM281 RNA, herein designated GAM RNA, also designated SEQ ID:278.

Another function of GAM281 is therefore inhibition of Small edrk-rich factor 1a (telomeric) (SERF1A, Accession NP_068802.1). Accordingly, utilities of GAM281 include diagnosis, prevention and treatment of diseases and clinical conditions associated with SERF1A.

Small edrk-rich factor 1b (centromeric) (SERF1B, Accession NP_075267.1) is another GAM281 target gene, herein designated TARGET GENE. SERF1B BINDING SITE1 and SERF1B BINDING SITE2 are target binding sites found in untranslated regions of mRNA encoded by SERF1B, corresponding to target binding sites such as BINDING SITE I, BINDING SITE II or BINDING SITE III of FIG. 8. Table 4 illustrates the complementarity of the nucleotide sequences of SERF1B BINDING SITE1 and SERF1B BINDING SITE2, designated SEQ ID:15849 and SEQ ID:9219 respectively, to the nucleotide sequence of GAM281 RNA, herein designated GAM RNA, also designated SEQ ID:278.

Another function of GAM281 is therefore inhibition of Small edrk-rich factor 1b (centromeric) (SERF1B, Accession NP_075267.1). Accordingly, utilities of GAM281 include diagnosis, prevention and treatment of diseases and clinical conditions associated with SERF1B.

Small edrk-rich factor 2 (SERF2, Accession NP_005761.2) is another GAM281 target gene, herein designated TARGET GENE. SERF2 BINDING SITE is a target binding site found in the 5' untranslated region of mRNA encoded by SERF2, corresponding to a target binding site such as BINDING SITE I, BINDING SITE II or BINDING SITE III of FIG. 8. Table 4 illustrates the complementarity of the nucleotide sequences of SERF2 BINDING SITE, designated SEQ ID:16210, to the nucleotide sequence of GAM281 RNA, herein designated GAM RNA, also designated SEQ ID:278.

Another function of GAM281 is therefore inhibition of Small edrk-rich factor 2 (SERF2, Accession NP_005761.2). Accordingly, utilities of GAM281 include diagnosis, prevention and treatment of diseases and clinical conditions associated with SERF2.

Serine (or cysteine) proteinase inhibitor, clade b (ovalbumin), member 8 (SERPINB8, Accession NP_002631.1) is another GAM281 target gene, herein designated TARGET GENE. SERPINB8 BINDING SITE is a target binding site found in the 3' untranslated region of mRNA encoded by SERPINB8, corresponding to a target binding site such as BINDING SITE I, BINDING SITE II or BINDING SITE III of FIG. 8. Table 4 illustrates the complementarity of the nucleotide sequences of SERPINB8 BINDING SITE, designated SEQ ID:20173, to the nucleotide sequence of GAM281 RNA, herein designated GAM RNA, also designated SEQ ID:278.

Another function of GAM281 is therefore inhibition of Serine (or cysteine) proteinase inhibitor, clade b (ovalbumin), member 8 (SERPINB8, Accession NP_002631.1), a gene which protease inhibitors; may be a serpin serine protease inhibitor that binds thrombin. Accordingly, utilities of GAM281 include diagnosis, prevention and treatment of diseases and clinical conditions associated with SERPINB8.

The function of SERPINB8 has been established by previous studies. High molecular weight serine proteinase inhibitors (serpins) are a large superfamily of proteins which bind to and inactivate serine proteinases. These interactions are involved in many cellular processes including coagulation, fibrinolysis, complement fixation, matrix remodeling, and apoptosis. Sprecher et al. (1995) cloned 2 novel serpins, termed PI8 and PI9 (OMIM Ref. No. 601799), from a human placenta cDNA library. Sequence analysis showed that PI8 encodes a 376-amino acid polypeptide with over 60% identity to PI6 (OMIM Ref. No. 173321). Using Northern blotting, they observed that PI8 was expressed as 2 transcripts of 1.4 and 3.8 kb. The 1.4-kb transcript was most abundant in liver and lung while the 3.8-kb transcript was most abundant in skeletal muscle and heart. They showed that PI8 was localized to the cytoplasm of transfected cells and that it was able to form an SDS-insoluble complex with human thrombin (OMIM Ref. No. 176930). Serpins are characterized by a well-conserved tertiary structure that consists of 3 beta sheets and 8 or 9 alpha helices (Huber and Carrell, 1989). A critical portion of the molecule, the reactive center loop, connects beta sheets A and C and, in most cases, serves as bait for a target serine proteinase. Bartuski et al. (1997) stated that more than 100 members of the serpin superfamily are known, including C1 esterase inhibitor (C1NH; 606860), antithrombin III (AT3; 107300), protease inhibitor 7 (PI7; 177010), and maspin (PI5; 154790), which are involved in complement activation, coagulation, cell differentiation, and tumor suppression, respectively, as well as many others. The ovalbumin-type serpins (ov-serpins) are a subset of the serpin superfamily and are characterized by their high degree of homology to chicken ovalbumin, the lack of N- and C-terminal extensions, the absence of a signal peptide, and a serine rather than an asparagine residue at the penultimate position. Four members of the ov-serpin family had been mapped to a 300-kb region within 18q21.3: PI5, SCCA1 (OMIM Ref. No. 600517), SCCA2 (OMIM Ref. No. 600518), and PAI2 (OMIM Ref. No. 173390). Using a panel of 18q21.3 YAC clones, PCR, and DNA blotting, Bartuski et al. (1997) mapped 2 additional ov-serpins, cytoplasmic antiproteinase 2

(CAP2 or PI8) and bone marrow-associated serpin bomapin (PI10; 602058), to the same region. Three of the serpins (PI8, PI10, and PAI2) mapped to the same YACs. Bartuski et al. (1997) estimated that the size of the 18q21.3 serpin cluster spans approximately 500 kb and contains at least 6 serpin genes. The gene order is cen-PI5-SCCA2-SCCA1-PAI2-PI10-PI8-tel. The characterization of the serpin gene cluster at 18q21 provided new opportunities to study coordinate gene regulation and the evolution of gene families.

Full details of the abovementioned studies are described in the following publications, the disclosure of which are hereby incorporated by reference:

Bartuski, A. J.; Kamachi, Y.; Schick, C.; Overhauser, J.; Silverman, G. A.: Cytoplasmic antiproteinase 2 (PI8) and bomapin (PI10) map to the serpin cluster at 18q21.3. Genomics 43:321-328, 1997; and Sprecher, C. A.; Morgenstern, K. A.; Mathewes, S.; Dahlen, J. R.; Schrader, S. K.; Foster, D. C.; Kisiel, W.: Molecular cloning, expression, and partial characterization of two novel m.

Further studies establishing the function and utilities of SERPINB8 are found in John Hopkins OMIM database record ID 601697, and in cited publications listed in Table 5, which are hereby incorporated by reference. Serine (or cysteine) proteinase inhibitor, clade b (ovalbumin), member 9 (SERPINB9, Accession NP_004146.1) is another GAM281 target gene, herein designated TARGET GENE. SERPINB9 BINDING SITE1 and SERPINB9 BINDING SITE2 are target binding sites found in untranslated regions of mRNA encoded by SERPINB9, corresponding to target binding sites such as BINDING SITE I, BINDING SITE II or BINDING SITE III of FIG. 8. Table 4 illustrates the complementarity of the nucleotide sequences of SERPINB9 BINDING SITE1 and SERPINB9 BINDING SITE2, designated SEQ ID:4363 and SEQ ID:9152 respectively, to the nucleotide sequence of GAM281 RNA, herein designated GAM RNA, also designated SEQ ID:278.

Another function of GAM281 is therefore inhibition of Serine (or cysteine) proteinase inhibitor, clade b (ovalbumin), member 9 (SERPINB9, Accession NP_004146.1), a gene which may be a serpin serine protease inhibitor that interacts with granzyme B (GZMB). Accordingly, utilities of GAM281 include diagnosis, prevention and treatment of diseases and clinical conditions associated with SERPINB9.

The function of SERPINB9 and its association with various diseases and clinical conditions, has been established by previous studies, as described hereinabove with reference to GAM88.2. Sideroflexin 2 (SFXN2, Accession NP_849189.1) is another GAM281 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:3678, to the nucleotide sequence of GAM281 RNA, herein designated GAM RNA, also designated SEQ ID:278.

Another function of GAM281 is therefore inhibition of Sideroflexin 2 (SFXN2, Accession NP_849189.1). Accordingly, utilities of GAM281 include diagnosis, prevention and treatment of diseases and clinical conditions associated with SFXN2.

Sideroflexin 2 (SFXN2, Accession XP_058359.2) is another GAM281 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:3678, to the nucleotide sequence of GAM281 RNA, herein designated GAM RNA, also designated SEQ ID:278.

Another function of GAM281 is therefore inhibition of Sideroflexin 2 (SFXN2, Accession XP_058359.2). Accordingly, utilities of GAM281 include diagnosis, prevention and treatment of diseases and clinical conditions associated with SFXN2.

Sideroflexin 5 (SFXN5, Accession NP_653180.1) is another GAM281 target gene, herein designated TARGET GENE. SFXN5 BINDING SITE is a target binding site found in the 3' untranslated region of mRNA encoded by SFXN5, corresponding to a target binding site such as BINDING SITE I, BINDING SITE II or BINDING SITE III of FIG. 8. Table 4 illustrates the complementarity of the nucleotide sequences of SFXN5 BINDING SITE, designated SEQ ID:11307, to the nucleotide sequence of GAM281 RNA, herein designated GAM RNA, also designated SEQ ID:278.

Another function of GAM281 is therefore inhibition of Sideroflexin 5 (SFXN5, Accession NP_653180.1). Accordingly, utilities of GAM281 include diagnosis, prevention and treatment of diseases and clinical conditions associated with SFXN5.

Sh3-domain binding protein 2 (SH3BP2, Accession NP_003014.2) is another GAM281 target gene, herein designated TARGET GENE. SH3BP2 BINDING SITE1 and SH3BP2 BINDING SITE2 are target binding sites found in untranslated regions of mRNA encoded by SH3BP2, corresponding to target binding sites such as BINDING SITE I, BINDING SITE II or BINDING SITE III of FIG. 8. Table 4 illustrates the complementarity of the nucleotide sequences of SH3BP2 BINDING SITE1 and SH3BP2 BINDING SITE2, designated SEQ ID:3836 and SEQ ID:9440 respectively, to the nucleotide sequence of GAM281 RNA, herein designated GAM RNA, also designated SEQ ID:278.

Another function of GAM281 is therefore inhibition of Sh3-domain binding protein 2 (SH3BP2, Accession NP_003014.2). Accordingly, utilities of GAM281 include diagnosis, prevention and treatment of diseases and clinical conditions associated with SH3BP2.

Split hand/foot malformation (ectrodactyly) type 3 (SHFM3, Accession NP_071322.1) is another GAM281 target gene, herein designated TARGET GENE. SHFM3 BINDING SITE is a target binding site found in the 3' untranslated region of mRNA encoded by SHFM3, corresponding to a target binding site such as BINDING SITE I, BINDING SITE II or BINDING SITE III of FIG. 8. Table 4 illustrates the complementarity of the nucleotide sequences of SHFM3 BINDING SITE, designated SEQ ID:2197, to the nucleotide sequence of GAM281 RNA, herein designated GAM RNA, also designated SEQ ID:278.

Another function of GAM281 is therefore inhibition of Split hand/foot malformation (ectrodactyly) type 3 (SHFM3, Accession NP_071322.1), a gene which probably binds to some phosphorylated proteins and promotes their degradation. and therefore may be associated with Split-hand/split-foot malformation. Accordingly, utilities of GAM281 include diagnosis, prevention and treatment of Split-hand/split-foot malformation, and of other diseases and clinical conditions associated with SHFM3.

The function of SHFM3 and its association with various diseases and clinical conditions, has been established by previous studies, as described hereinabove with reference to GAM47.1. Short stature homeobox (SHOX, Accession NP_006874.1) is another GAM281 target gene, herein designated TARGET GENE. SHOX BINDING SITE1 and SHOX BINDING SITE2 are target binding sites found in untranslated regions of multiple transcripts of mRNA encoded by SHOX, corresponding to target binding sites such as BINDING SITE I, BINDING SITE II or BINDING SITE III of FIG. 8. Table 4 illustrates the complementarity of the nucleotide sequences of SHOX BINDING SITE1 and SHOX BINDING SITE2, designated SEQ ID:4375and SEQ ID:16527 respectively, to the nucleotide sequence of GAM281 RNA, herein designated GAM RNA, also designated SEQ ID:278.

Another function of GAM281 is therefore inhibition of Short stature homeobox (SHOX, Accession NP_006874.1). Accordingly, utilities of GAM281 include diagnosis, prevention and treatment of diseases and clinical conditions associated with SHOX.

Sialic acid binding ig-like lectin 8 (SIGLEC8, Accession NP_055257.1) is another GAM281 target gene, herein designated TARGET GENE. SIGLEC8 BINDING SITE is a target binding site found in the 3' untranslated region of mRNA encoded by SIGLEC8, corresponding to a target binding site such as BINDING SITE I, BINDING SITE II or BINDING SITE III of FIG. 8. Table 4 illustrates the complementarity of the nucleotide sequences of SIGLEC8 BINDING SITE, designated SEQ ID:4513, to the nucleotide sequence of GAM281 RNA, herein designated GAM RNA, also designated SEQ ID:278.

Another function of GAM281 is therefore inhibition of Sialic acid binding ig-like lectin 8 (SIGLEC8, Accession NP_055257.1), a gene which is a cell adhesion molecule for postnatal neural development. Accordingly, utilities of GAM281 include diagnosis, prevention and treatment of diseases and clinical conditions associated with SIGLEC8.

The function of SIGLEC8 and its association with various diseases and clinical conditions, has been established by previous studies, as described hereinabove with reference to GAM63.1. Tal1 (scl) interrupting locus (SIL, Accession NP_003026.1) is another GAM281 target gene, herein designated TARGET GENE. SIL BINDING SITE is a target binding site found in the 3' untranslated region of mRNA encoded by SIL, corresponding to a target binding site such as BINDING SITE I, BINDING SITE II or BINDING SITE III of FIG. 8. Table 4 illustrates the complementarity of the nucleotide sequences of SIL BINDING SITE, designated SEQ ID:12411, to the nucleotide sequence of GAM281 RNA, herein designated GAM RNA, also designated SEQ ID:278.

Another function of GAM281 is therefore inhibition of Tal1 (scl) interrupting locus (SIL, Accession NP_003026.1), a gene which may be required for axial development and left-right specification and therefore may be associated with Prominent midline neural tube defects, abnormal left-right development. Accordingly, utilities of GAM281 include diagnosis, prevention and treatment of Prominent midline neural tube defects, abnormal left-right development, and of other diseases and clinical conditions associated with SIL.

The function of SIL and its association with various diseases and clinical conditions, has been established by previous studies, as described hereinabove with reference to GAM30.1. Signal-regulatory protein beta 1 (SIRPB1, Accession NP_006056.1) is another GAM281 target gene, herein designated TARGET GENE. SIRPB1 BINDING SITE is a target binding site found in the 3' untranslated region of mRNA encoded by SIRPB1, corresponding to a target binding site such as BINDING SITE I, BINDING SITE II or BINDING SITE III of FIG. 8. Table 4 illustrates the complementarity of the nucleotide sequences of SIRPB1 BINDING SITE, designated SEQ ID:14771, to the nucleotide sequence of GAM281 RNA, herein designated GAM RNA, also designated SEQ ID:278.

Another function of GAM281 is therefore inhibition of Signal-regulatory protein beta 1 (SIRPB1, Accession NP_006056.1). Accordingly, utilities of GAM281 include diagnosis, prevention and treatment of diseases and clinical conditions associated with SIRPB1.

Src-like-adaptor 2 (SLA2, Accession NP_778252.1) is another GAM281 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:19573, to the nucleotide sequence of GAM281 RNA, herein designated GAM RNA, also designated SEQ ID:278.

Another function of GAM281 is therefore inhibition of Src-like-adaptor 2 (SLA2, Accession NP_778252.1). Accordingly, utilities of GAM281 include diagnosis, prevention and treatment of diseases and clinical conditions associated with SLA2.

Src-like-adaptor 2 (SLA2, Accession NP_115590.1) is another GAM281 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:19573, to the nucleotide sequence of GAM281 RNA, herein designated GAM RNA, also designated SEQ ID:278.

Another function of GAM281 is therefore inhibition of Src-like-adaptor 2 (SLA2, Accession NP_115590.1). Accordingly, utilities of GAM281 include diagnosis, prevention and treatment of diseases and clinical conditions associated with SLA2.

Solute carrier family 12 (potassium/chloride transporters), member 8 (SLC12A8, Accession NP_078904.1) is another GAM281 target gene, herein designated TARGET GENE. SLC12A8 BINDING SITE is a target binding site found in the 3' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:5190, to the nucleotide sequence of GAM281 RNA, herein designated GAM RNA, also designated SEQ ID:278.

Another function of GAM281 is therefore inhibition of Solute carrier family 12 (potassium/chloride transporters), member 8 (SLC12A8, Accession NP_078904.1). Accordingly, utilities of GAM281 include diagnosis, prevention and treatment of diseases and clinical conditions associated with SLC12A8.

Solute carrier family 13 (sodium/sulfate symporters), member 1 (SLC13A1, Accession NP_071889.2) is another GAM281 target gene, herein designated TARGET GENE. SLC13A1 BINDING SITE is a target binding site found in the 3' untranslated region of mRNA encoded by SLC13A1, corresponding to a target binding site such as BINDING SITE I, BINDING SITE II or BINDING SITE III of FIG. 8. Table 4 illustrates the complementarity of the nucleotide sequences of SLC13A1 BINDING SITE, designated SEQ ID:4370, to the nucleotide sequence of GAM281 RNA, herein designated GAM RNA, also designated SEQ ID:278.

Another function of GAM281 is therefore inhibition of Solute carrier family 13 (sodium/sulfate symporters), member 1 (SLC13A1, Accession NP_071889.2). Accordingly, utilities of GAM281 include diagnosis, prevention and treatment of diseases and clinical conditions associated with SLC13A1.

Solute carrier family 13 (sodium-dependent dicarboxylate transporter), member 3 (SLC13A3, Accession NP_073740.2) is another GAM281 target gene, herein designated TARGET GENE. SLC13A3 BINDING SITE is a target binding site found in the 3' untranslated region of mRNA encoded by SLC13A3, corresponding to a target binding site such as BINDING SITE I, BINDING SITE II or BINDING SITE III of FIG. 8. Table 4 illustrates the complementarity of the nucleotide sequences of SLC13A3 BINDING SITE, designated SEQ ID:7448, to the nucleotide sequence of GAM281 RNA, herein designated GAM RNA, also designated SEQ ID:278.

Another function of GAM281 is therefore inhibition of Solute carrier family 13 (sodium-dependent dicarboxylate transporter), member 3 (SLC13A3, Accession NP_073740.2). Accordingly, utilities of GAM281 include diagnosis, prevention and treatment of diseases and clinical conditions associated with SLC13A3.

Solute carrier family 14 (urea transporter), member 2 (SLC14A2, Accession NP_009094.2) is another GAM281 target gene, herein designated TARGET GENE. SLC14A2 BINDING SITE is a target binding site found in the 5' untranslated region of mRNA encoded by SLC14A2, corresponding to a target binding site such as BINDING SITE I, BINDING SITE II or BINDING SITE III of FIG. 8. Table 4 illustrates the complementarity of the nucleotide sequences of SLC14A2 BINDING SITE, designated SEQ ID:4514, to the nucleotide sequence of GAM281 RNA, herein designated GAM RNA, also designated SEQ ID:278.

Another function of GAM281 is therefore inhibition of Solute carrier family 14 (urea transporter), member 2 (SLC14A2, Accession NP_009094.2), a gene which is a renal urea transporter 2. and therefore may be associated with Orthostatic hypotension. Accordingly, utilities of GAM281 include diagnosis, prevention and treatment of Orthostatic hypotension, and of other diseases and clinical conditions associated with SLC14A2.

The function of SLC14A2 and its association with various diseases and clinical conditions, has been established by previous studies, as described hereinabove with reference to GAM97.1. Solute carrier family 15 (oligopeptide transporter), member 1 (SLC15A1, Accession NP_005064.1) is another GAM281 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:18930, to the nucleotide sequence of GAM281 RNA, herein designated GAM RNA, also designated SEQ ID:278.

Another function of GAM281 is therefore inhibition of Solute carrier family 15 (oligopeptide transporter), member 1 (SLC15A1, Accession NP_005064.1), a gene which is a H(+)-coupled peptide transporter. Accordingly, utilities of GAM281 include diagnosis, prevention and treatment of diseases and clinical conditions associated with SLC15A1.

The function of SLC15A1 and its association with various diseases and clinical conditions, has been established by previous studies, as described hereinabove with reference to GAM30.1. Solute carrier family 16 (monocarboxylic acid transporters), member 4 (SLC16A4, Accession NP_004687.1) is another GAM281 target gene, herein designated TARGET GENE. SLC16A4 BINDING SITE is a target binding site found in the 3' untranslated region of mRNA encoded by SLC16A4, corresponding to a target binding site such as BINDING SITE I, BINDING SITE II or BINDING SITE III of FIG. 8. Table 4 illustrates the complementarity of the nucleotide sequences of SLC16A4 BINDING SITE, designated SEQ ID:611, to the nucleotide sequence of GAM281 RNA, herein designated GAM RNA, also designated SEQ ID:278.

Another function of GAM281 is therefore inhibition of Solute carrier family 16 (monocarboxylic acid transporters), member 4 (SLC16A4, Accession NP_004687.1). Accordingly, utilities of GAM281 include diagnosis, prevention and treatment of diseases and clinical conditions associated with SLC16A4.

Solute carrier family 16 (monocarboxylic acid transporters), member 6 (SLC16A6, Accession NP_004685.1) is another GAM281 target gene, herein designated TARGET GENE. SLC16A6 BINDING SITE is a target binding site found in the 5' untranslated region of mRNA encoded by SLC16A6, corresponding to a target binding site such as BINDING SITE I, BINDING SITE II or BINDING SITE III of FIG. 8. Table 4 illustrates the complementarity of the nucleotide sequences of SLC16A6 BINDING SITE, designated SEQ ID:5302, to the nucleotide sequence of GAM281 RNA, herein designated GAM RNA, also designated SEQ ID:278.

Another function of GAM281 is therefore inhibition of Solute carrier family 16 (monocarboxylic acid transporters), member 6 (SLC16A6, Accession NP_004685.1). Accordingly, utilities of GAM281 include diagnosis, prevention and treatment of diseases and clinical conditions associated with SLC16A6.

Solute carrier family 19, member 3 (SLC19A3, Accession NP_079519.1) is another GAM281 target gene, herein designated TARGET GENE. SLC19A3 BINDING SITE is a target binding site found in the 3' untranslated region of mRNA encoded by SLC19A3, corresponding to a target binding site such as BINDING SITE I, BINDING SITE II or BINDING SITE III of FIG. 8. Table 4 illustrates the complementarity of the nucleotide sequences of SLC19A3 BINDING SITE, designated SEQ ID:6713, to the nucleotide sequence of GAM281 RNA, herein designated GAM RNA, also designated SEQ ID:278.

Another function of GAM281 is therefore inhibition of Solute carrier family 19, member 3 (SLC19A3, Accession NP_079519.1). Accordingly, utilities of GAM281 include diagnosis, prevention and treatment of diseases and clinical conditions associated with SLC19A3.

Solute carrier family 1 (neutral amino acid transporter), member 5 (SLC1A5, Accession NP_005619.1) is another GAM281 target gene, herein designated TARGET GENE. SLC1A5 BINDING SITE is a target binding site found in the 3' untranslated region of mRNA encoded by SLC1A5, corresponding to a target binding site such as BINDING SITE I, BINDING SITE II or BINDING SITE III of FIG. 8. Table 4 illustrates the complementarity of the nucleotide sequences of SLC1A5 BINDING SITE, designated SEQ ID:1277, to the nucleotide sequence of GAM281 RNA, herein designated GAM RNA, also designated SEQ ID:278.

Another function of GAM281 is therefore inhibition of Solute carrier family 1 (neutral amino acid transporter), member 5 (SLC1A5, Accession NP_005619.1). Accordingly, utilities of GAM281 include diagnosis, prevention and treatment of diseases and clinical conditions associated with SLC1A5.

Solute carrier family 21 (prostaglandin transporter), member 2 (SLC21A2, Accession NP_005621.1) is another GAM281 target gene, herein designated TARGET GENE. SLC21A2 BINDING SITE is a target binding site found in the 3' untranslated region of mRNA encoded by SLC21A2, corresponding to a target binding site such as BINDING SITE I, BINDING SITE II or BINDING SITE III of FIG. 8. Table 4 illustrates the complementarity of the nucleotide sequences of SLC21A2 BINDING SITE, designated SEQ ID:18939, to the nucleotide sequence of GAM281 RNA, herein designated GAM RNA, also designated SEQ ID:278.

Another function of GAM281 is therefore inhibition of Solute carrier family 21 (prostaglandin transporter), member 2 (SLC21A2, Accession NP_005621.1), a gene which is a Prostaglandin transporter. Accordingly, utilities of GAM281 include diagnosis, prevention and treatment of diseases and clinical conditions associated with SLC21A2.

The function of SLC21A2 and its association with various diseases and clinical conditions, has been established by previous studies, as described hereinabove with reference to GAM148.1. Solute carrier family 24 (sodium/potassium/calcium exchanger), member 1 (SLC24A1, Accession NP_004718.1) is another GAM281 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:10966, to the nucleotide sequence of GAM281 RNA, herein designated GAM RNA, also designated SEQ ID:278.

Another function of GAM281 is therefore inhibition of Solute carrier family 24 (sodium/potassium/calcium exchanger), member 1 (SLC24A1, Accession NP_004718.1), a gene which is a critical component of the visual transduction cascade, controlling the calcium concentration of outer segments during light and darkness. Accordingly, utilities of GAM281 include diagnosis, prevention and treatment of diseases and clinical conditions associated with SLC24A1.

The function of SLC24A1 and its association with various diseases and clinical conditions, has been established by previous studies, as described hereinabove with reference to GAM130.1. SLC30A5 (Accession NP_076960.1) is another GAM281 target gene, herein designated TARGET GENE. SLC30A5 BINDING SITE is a target binding site found in the 3' untranslated region of multiple transcripts of mRNA encoded by SLC30A5, corresponding to a target binding site such as BINDING SITE I, BINDING SITE II or BINDING SITE III of FIG. 8. Table 4 illustrates the complementarity of the nucleotide sequences of SLC30A5 BINDING SITE, designated SEQ ID:3692, to the nucleotide sequence of GAM281 RNA, herein designated GAM RNA, also designated SEQ ID:278.

Another function of GAM281 is therefore inhibition of SLC30A5 (Accession NP_076960.1). Accordingly, utilities of GAM281 include diagnosis, prevention and treatment of diseases and clinical conditions associated with SLC30A5.

SLC30A6 (Accession NP_060434.2) is another GAM281 target gene, herein designated TARGET GENE. SLC30A6 BINDING SITE is a target binding site found in the 3' untranslated region of mRNA encoded by SLC30A6, corresponding to a target binding site such as BINDING SITE I, BINDING SITE II or BINDING SITE III of FIG. 8. Table 4 illustrates the complementarity of the nucleotide sequences of SLC30A6 BINDING SITE, designated SEQ ID:5362, to the nucleotide sequence of GAM281 RNA, herein designated GAM RNA, also designated SEQ ID:278.

Another function of GAM281 is therefore inhibition of SLC30A6 (Accession NP_060434.2). Accordingly, utilities of GAM281 include diagnosis, prevention and treatment of diseases and clinical conditions associated with SLC30A6.

SLC35E2 (Accession XP_049733.6) is another GAM281 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:13336, to the nucleotide sequence of GAM281 RNA, herein designated GAM RNA, also designated SEQ ID:278.

Another function of GAM281 is therefore inhibition of SLC35E2 (Accession XP_049733.6). Accordingly, utilities of GAM281 include diagnosis, prevention and treatment of diseases and clinical conditions associated with SLC35E2.

Solute carrier family 39 (zinc transporter), member 1 (SLC39A1, Accession NP_055252.2) is another GAM281 target gene, herein designated TARGET GENE. SLC39A1 BINDING SITE is a target binding site found in the 5' untranslated region of mRNA encoded by SLC39A1, corresponding to a target binding site such as BINDING SITE I, BINDING SITE II or BINDING SITE III of FIG. 8. Table 4 illustrates the complementarity of the nucleotide sequences of SLC39A1 BINDING SITE, designated SEQ ID:9528, to the nucleotide sequence of GAM281 RNA, herein designated GAM RNA, also designated SEQ ID:278.

Another function of GAM281 is therefore inhibition of Solute carrier family 39 (zinc transporter), member 1 (SLC39A1, Accession NP_055252.2), a gene which is a divalent (zinc/iron) metal ion transporter. Accordingly, utilities of GAM281 include diagnosis, prevention and treatment of diseases and clinical conditions associated with SLC39A1.

The function of SLC39A1 and its association with various diseases and clinical conditions, has been established by previous studies, as described hereinabove with reference to GAM175.1. Solute carrier family 39 (zinc transporter), member 3 (SLC39A3, Accession NP_653165.1) is another GAM281 target gene, herein designated TARGET GENE. SLC39A3 BINDING SITE is a target binding site found in the 3' untranslated region of mRNA encoded by SLC39A3, corresponding to a target binding site such as BINDING SITE I, BINDING SITE II or BINDING SITE III of FIG. 8. Table 4 illustrates the complementarity of the nucleotide sequences of SLC39A3 BINDING SITE, designated SEQ ID:20136, to the nucleotide sequence of GAM281 RNA, herein designated GAM RNA, also designated SEQ ID:278.

Another function of GAM281 is therefore inhibition of Solute carrier family 39 (zinc transporter), member 3 (SLC39A3, Accession NP_653165.1). Accordingly, utilities of GAM281 include diagnosis, prevention and treatment of diseases and clinical conditions associated with SLC39A3.

Solute carrier family 6 (neurotransmitter transporter), member 14 (SLC6A14, Accession NP_009162.1) is another GAM281 target gene, herein designated TARGET GENE. SLC6A14 BINDING SITE is a target binding site found in the 3' untranslated region of mRNA encoded by SLC6A14, corresponding to a target binding site such as BINDING SITE I, BINDING SITE II or BINDING SITE III of FIG. 8. Table 4 illustrates the complementarity of the nucleotide sequences of SLC6A14 BINDING SITE, designated SEQ ID:13830, to the nucleotide sequence of GAM281 RNA, herein designated GAM RNA, also designated SEQ ID:278.

Another function of GAM281 is therefore inhibition of Solute carrier family 6 (neurotransmitter transporter), member 14 (SLC6A14, Accession NP_009162.1). Accordingly, utilities of GAM281 include diagnosis, prevention and treatment of diseases and clinical conditions associated with SLC6A14.

Solute carrier family 6 (neurotransmitter transporter, dopamine), member 3 (SLC6A3, Accession NP_001035.1) is another GAM281 target gene, herein designated TARGET GENE. SLC6A3 BINDING SITE is a target binding site found in the 3' untranslated region of mRNA encoded by SLC6A3, corresponding to a target binding site such as BINDING SITE I, BINDING SITE II or BINDING SITE III of FIG. 8. Table 4 illustrates the complementarity of the nucleotide sequences of SLC6A3 BINDING SITE, designated SEQ ID:12941, to the nucleotide sequence of GAM281 RNA, herein designated GAM RNA, also designated SEQ ID:278.

Another function of GAM281 is therefore inhibition of Solute carrier family 6 (neurotransmitter transporter, dopamine), member 3 (SLC6A3, Accession NP_001035.1), a gene which terminates the action of dopamine by its high affinity sodium-dependent reuptake into presynaptic terminals. Accordingly, utilities of GAM281 include diagnosis, prevention and treatment of diseases and clinical conditions associated with SLC6A3.

The function of SLC6A3 and its association with various diseases and clinical conditions, has been established by previous studies, as described hereinabove with reference to GAM189.1. SMAC (Accession NP_620308.1) is another GAM281 target gene, herein designated TARGET GENE. SMAC BINDING SITE1 and SMAC BINDING SITE2 are target binding sites found in untranslated regions of multiple transcripts of mRNA encoded by SMAC, corresponding to target binding sites such as BINDING SITE I, BINDING SITE II or BINDING SITE III of FIG. 8. Table 4 illustrates the complementarity of the nucleotide sequences of SMAC BINDING SITE1 and SMAC BINDING SITE2, designated SEQ ID:1861 and SEQ ID:18165 respectively, to the nucleotide sequence of GAM281 RNA, herein designated GAM RNA, also designated SEQ ID:278.

Another function of GAM281 is therefore inhibition of SMAC (Accession NP_620308.1), a gene which promotes apoptosis via caspase activation. Accordingly, utilities of GAM281 include diagnosis, prevention and treatment of diseases and clinical conditions associated with SMAC.

The function of SMAC and its association with various diseases and clinical conditions, has been established by previous studies, as described hereinabove with reference to GAM136.1. Smith-magenis syndrome chromosome region, candidate 5(SMCR5, Accession NP_658987.1) is another GAM281 target gene, herein designated TARGET GENE. SMCR5 BINDING SITE is a target binding site found in the 3' untranslated region of mRNA encoded by SMCR5, corresponding to a target binding site such as BINDING SITE I, BINDING SITE II or BINDING SITE III of FIG. 8. Table 4 illustrates the complementarity of the nucleotide sequences of SMCR5 BINDING SITE, designated SEQ ID:8677, to the nucleotide sequence of GAM281 RNA, herein designated GAM RNA, also designated SEQ ID:278.

Another function of GAM281 is therefore inhibition of Smith-magenis syndrome chromosome region, candidate 5 (SMCR5, Accession NP_658987.1). Accordingly, utilities of GAM281 diagnosis, prevention and treatment of diseases and clinical conditions associated with SMCR5.

Synaptosomal-associated protein, 23 kda (SNAP23, Accession NP_003816.2) is another GAM281 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:19007, to the nucleotide sequence of GAM281 RNA, herein designated GAM RNA, also designated SEQ ID:278.

Another function of GAM281 is therefore inhibition of Synaptosomal-associated protein, 23 kda (SNAP23, Accession NP_003816.2), a gene which is essential component of the high affinity receptor for the general membrane fusion machinery. Accordingly, utilities of GAM281 include diagnosis, prevention and treatment of diseases and clinical conditions associated with SNAP23.

The function of SNAP23 and its association with various diseases and clinical conditions, has been established by previous studies, as described hereinabove with reference to GAM30.1. Synaptosomal-associated protein, 23 kda (SNAP23, Accession NP_570710.1) is another GAM281 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:19007, to the nucleotide sequence of GAM281 RNA, herein designated GAM RNA, also designated SEQ ID:278.

Another function of GAM281 is therefore inhibition of Synaptosomal-associated protein, 23 kda (SNAP23, Accession NP_570710.1), a gene which is essential component of the high affinity receptor for the general membrane fusion machinery. Accordingly, utilities of GAM281 include diagnosis, prevention and treatment of diseases and clinical conditions associated with SNAP23.

The function of SNAP23 and its association with various diseases and clinical conditions, has been established by previous studies, as described hereinabove with reference to GAM30.1. SNARK (Accession NP_112214.1) is another GAM281 target gene, herein designated TARGET GENE. SNARK BINDING SITE is a target binding site found in the 3' untranslated region of mRNA encoded by SNARK, corresponding to a target binding site such as BINDING SITE I, BINDING SITE II or BINDING SITE III of FIG. 8. Table 4 illustrates the complementarity of the nucleotide sequences of SNARK BINDING SITE, designated SEQ ID:18622, to the nucleotide sequence of GAM281 RNA, herein designated GAM RNA, also designated SEQ ID:278.

Another function of GAM281 is therefore inhibition of SNARK (Accession NP_112214.1). Accordingly, utilities of GAM281 include diagnosis, prevention and treatment of diseases and clinical conditions associated with SNARK.

Syntaphilin (SNPH, Accession NP_055538.1) is another GAM281 target gene, herein designated TARGET GENE. SNPH BINDING SITE is a target binding site found in the 3' untranslated region of mRNA encoded by SNPH, corresponding to a target binding site such as BINDING SITE I, BINDING SITE II or BINDING SITE III of FIG. 8. Table 4 illustrates the complementarity of the nucleotide sequences of SNPH BINDING SITE, designated SEQ ID:15041, to the nucleotide sequence of GAM281 RNA, herein designated GAM RNA, also designated SEQ ID:278.

Another function of GAM281 is therefore inhibition of Syntaphilin (SNPH, Accession NP_055538.1). Accordingly, utilities of GAM281 include diagnosis, prevention and treatment of diseases and clinical conditions associated with SNPH.

Sorting nexin 15 (SNX15, Accession NP_037438.2) is another GAM281 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:7625, to the nucleotide sequence of GAM281 RNA, herein designated GAM RNA, also designated SEQ ID:278.

Another function of GAM281 is therefore inhibition of Sorting nexin 15 (SNX15, Accession NP_037438.2). Accordingly, utilities of GAM281 include diagnosis, prevention and treatment of diseases and clinical conditions associated with SNX15.

Sorting nexin 15 (SNX15, Accession NP_680086.1) is another GAM281 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:7625, to the nucleotide sequence of GAM281 RNA, herein designated GAM RNA, also designated SEQ ID:278.

Another function of GAM281 is therefore inhibition of Sorting nexin 15 (SNX15, Accession NP_680086.1). Accordingly, utilities of GAM281 include diagnosis, prevention and treatment of diseases and clinical conditions associated with SNX15.

SNX22 (Accession NP_079074.1) is another GAM281 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:13596, to the nucleotide sequence of GAM281 RNA, herein designated GAM RNA, also designated SEQ ID:278.

Another function of GAM281 is therefore inhibition of SNX22 (Accession NP_079074.1). Accordingly, utilities of GAM281 include diagnosis, prevention and treatment of diseases and clinical conditions associated with SNX22.

SNX27 (Accession NP_112180.4) is another GAM281 target gene, herein designated TARGET GENE. SNX27 BINDING SITE is a target binding site found in the 3' untranslated region of mRNA encoded by SNX27, corresponding to a target binding site such as BINDING SITE I, BINDING SITE II or BINDING SITE III of FIG. 8. Table 4 illustrates the complementarity of the nucleotide sequences of SNX27 BINDING SITE, designated SEQ ID:16941, to the nucleotide sequence of GAM281 RNA, herein designated GAM RNA, also designated SEQ ID:278.

Another function of GAM281 is therefore inhibition of SNX27 (Accession NP_112180.4). Accordingly, utilities of GAM281 include diagnosis, prevention and treatment of diseases and clinical conditions associated with SNX27.

Sialophorin (gpl115, leukosialin, cd43) (SPN, Accession NP_003114.1) is another GAM281 target gene, herein designated TARGET GENE. SPN BINDING SITE is a target binding site found in the 3' untranslated region of mRNA encoded by SPN, corresponding to a target binding site such as BINDING SITE I, BINDING SITE II or BINDING SITE III of FIG. 8. Table 4 illustrates the complementarity of the nucleotide sequences of SPN BINDING SITE, designated SEQ ID:16209, to the nucleotide sequence of GAM281 RNA, herein designated GAM RNA, also designated SEQ ID:278.

Another function of GAM281 is therefore inhibition of Sialophorin (gpl115, leukosialin, cd43) (SPN, Accession NP_003114.1), a gene which plays a role in the physicochemical properties of the t-cell surface and in lectin binding. presents carbohydrate ligands to selectins. and therefore may be associated with Wiskott-aldrich syndrome. Accordingly, utilities of GAM281 include diagnosis, prevention and treatment of Wiskott-aldrich syndrome, and of other diseases and clinical conditions associated with SPN.

The function of SPN and its association with various diseases and clinical conditions, has been established by previous studies, as described hereinabove with reference to GAM130.1. Speckle-type poz protein (SPOP, Accession NP_003554.1) is another GAM281 target gene, herein designated TARGET GENE. SPOP BINDING SITE is a target binding site found in the 5' untranslated region of mRNA encoded by SPOP, corresponding to a target binding site such as BINDING SITE I, BINDING SITE II or BINDING SITE III of FIG. 8. Table 4 illustrates the complementarity of the nucleotide sequences of SPOP BINDING SITE, designated SEQ ID:5610, to the nucleotide sequence of GAM281 RNA, herein designated GAM RNA, also designated SEQ ID:278.

Another function of GAM281 is therefore inhibition of Speckle-type poz protein (SPOP, Accession NP_003554.1). Accordingly, utilities of GAM281 include diagnosis, prevention and treatment of diseases and clinical conditions associated with SPOP.

SQV7L (Accession XP_047287.1) is another GAM281 target gene, herein designated TARGET GENE. SQV7L BINDING SITE is a target binding site found in the 5' untranslated region of mRNA encoded by SQV7L, corresponding to a target binding site such as BINDING SITE I, BINDING SITE II or BINDING SITE III of FIG. 8. Table 4 illustrates the complementarity of the nucleotide sequences of SQV7L BINDING SITE, designated SEQ ID:7375, to the nucleotide sequence of GAM281 RNA, herein designated GAM RNA, also designated SEQ ID:278.

Another function of GAM281 is therefore inhibition of SQV7L (Accession XP_047287.1). Accordingly, utilities of GAM281 include diagnosis, prevention and treatment of diseases and clinical conditions associated with SQV7L.

Sarcalumenin (SRL, Accession XP_064152.3) is another GAM281 target gene, herein designated TARGET GENE. SRL BINDING SITE is a target binding site found in the 3' untranslated region of mRNA encoded by SRL, corresponding to a target binding site such as BINDING SITE I, BINDING SITE II or BINDING SITE III of FIG. 8. Table 4 illustrates the complementarity of the nucleotide sequences of SRL BINDING SITE, designated SEQ ID:6681, to the nucleotide sequence of GAM281 RNA, herein designated GAM RNA, also designated SEQ ID:278.

Another function of GAM281 is therefore inhibition of Sarcalumenin (SRL, Accession XP_064152.3). Accordingly, utilities of GAM281 include diagnosis, prevention and treatment of diseases and clinical conditions associated with SRL.

Serine/arginine repetitive matrix 2 (SRRM2, Accession NP_057417.2) is another GAM281 target gene, herein designated TARGET GENE. SRRM2 BINDING SITE is a target binding site found in the 5' untranslated region of mRNA encoded by SRRM2, corresponding to a target binding site such as BINDING SITE I, BINDING SITE II or BINDING SITE III of FIG. 8. Table 4 illustrates the complementarity of the nucleotide sequences of SRRM2 BINDING SITE, designated SEQ ID:18975, to the nucleotide sequence of GAM281 RNA, herein designated GAM RNA, also designated SEQ ID:278.

Another function of GAM281 is therefore inhibition of Serine/arginine repetitive matrix 2 (SRRM2, Accession NP_057417.2), a gene which RELATED NUCLEAR MATRIX PROTEIN. Accordingly, utilities of GAM281 include diagnosis, prevention and treatment of diseases and clinical conditions associated with SRRM2.

The function of SRRM2 and its association with various diseases and clinical conditions, has been established by previous studies, as described hereinabove with reference to GAM189.1. Synovial sarcoma translocation, chromosome 18 (SS18, Accession NP_005628.1) is another GAM281 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:17762, to the nucleotide sequence of GAM281 RNA, herein designated GAM RNA, also designated SEQ ID:278.

Another function of GAM281 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM281 include diagnosis, prevention and treatment of Human synovial sarcomas, and of other diseases and clinical conditions associated with SS18.

The function of SS18 and its association with various diseases and clinical conditions, has been established by previous studies, as described hereinabove with reference to GAM130.1. STAF65(gamma) (Accession NP_055675.1) is another GAM281 target gene, herein designated TARGET GENE. STAF65(gamma) BINDING SITE is a target binding site found in the 3' untranslated region of mRNA encoded by STAF65(gamma), corresponding to a target binding site such as BINDING SITE I, BINDING SITE II or BINDING SITE III of FIG. 8. Table 4 illustrates the complementarity of the nucleotide sequences of STAF65(gamma) BINDING SITE, designated SEQ ID:2196, to the nucleotide sequence of GAM281 RNA, herein designated GAM RNA, also designated SEQ ID:278.

Another function of GAM281 is therefore inhibition of STAF65(gamma) (Accession NP_055675.1). Accordingly, utilities of GAM281 include diagnosis, prevention and treatment of diseases and clinical conditions associated with STAF65(gamma).

Signal transducing adaptor molecule (sh3 domain and itam motif) 2 (STAM2, Accession NP_005834.3) is another GAM281 target gene, herein designated TARGET GENE. STAM2 BINDING SITE is a target binding site found in the 3' untranslated region of mRNA encoded by STAM2, corresponding to a target binding site such as BINDING SITE I, BINDING SITE II or BINDING SITE III of FIG. 8. Table 4 illustrates the complementarity of the nucleotide sequences of STAM2 BINDING SITE, designated SEQ ID:5301, to the nucleotide sequence of GAM281 RNA, herein designated GAM RNA, also designated SEQ ID:278.

Another function of GAM281 is therefore inhibition of Signal transducing adaptor molecule (sh3 domain and itam motif) 2 (STAM2, Accession NP_005834.3). Accordingly, utilities of GAM281 include diagnosis, prevention and treatment of diseases and clinical conditions associated with STAM2.

Staufen, rna binding protein (drosophila) (STAU, Accession NP_004593.1) is another GAM281 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:3950, to the nucleotide sequence of GAM281 RNA, herein designated GAM RNA, also designated SEQ ID:278.

Another function of GAM281 is therefore inhibition of Staufen, rna binding protein (drosophila) (STAU, Accession NP_004593.1), a gene which may play a role in specific positioning of mrnas at given sites in the cell and in stimulating their translation at the site. Accordingly, utilities of GAM281 include diagnosis, prevention and treatment of diseases and clinical conditions associated with STAU.

The function of STAU and its association with various diseases and clinical conditions, has been established by previous studies, as described hereinabove with reference to GAM37.1. Sulfotransferase, estrogen-preferring (STE, Accession NP_005411.1) is another GAM281 target gene, herein designated TARGET GENE. STE BINDING SITE is a target binding site found in the 3' untranslated region of mRNA encoded by STE, corresponding to a target binding site such as BINDING SITE I, BINDING SITE II or BINDING SITE III of FIG. 8. Table 4 illustrates the complementarity of the nucleotide sequences of STE BINDING SITE, designated SEQ ID:3303, to the nucleotide sequence of GAM281 RNA, herein designated GAM RNA, also designated SEQ ID:278.

Another function of GAM281 is therefore inhibition of Sulfotransferase, estrogen-preferring (STE, Accession NP_005411.1), a gene which sulfates estrone and dehydroepiandrosterone, but not dopamine. Accordingly, utilities of GAM281 include diagnosis, prevention and treatment of diseases and clinical conditions associated with STE.

The function of STE and its association with various diseases and clinical conditions, has been established by previous studies, as described hereinabove with reference to GAM189.1. Six transmembrane epithelial antigen of prostate 2 (STEAP2, Accession NP_694544.1) is another GAM281 target gene, herein designated TARGET GENE. STEAP2 BINDING SITE is a target binding site found in the 3' untranslated region of mRNA encoded by STEAP2, corresponding to a target binding site such as BINDING SITE I, BINDING SITE II or BINDING SITE III of FIG. 8. Table 4 illustrates the complementarity of the nucleotide sequences of STEAP2 BINDING SITE, designated SEQ ID:9147, to the nucleotide sequence of GAM281 RNA, herein designated GAM RNA, also designated SEQ ID:278.

Another function of GAM281 is therefore inhibition of Six transmembrane epithelial antigen of prostate 2 (STEAP2, Accession NP_694544.1). Accordingly, utilities of GAM281 include diagnosis, prevention and treatment of diseases and clinical conditions associated with STEAP2.

Serine/threonine kinase 10 (STK10, Accession NP_005981.1) is another GAM281 target gene, herein designated TARGET GENE. STK10 BINDING SITE is a target binding site found in the 3' untranslated region of mRNA encoded by STK10, corresponding to a target binding site such as BINDING SITE I, BINDING SITE II or BINDING SITE III of FIG. 8. Table 4 illustrates the complementarity of the nucleotide sequences of STK10 BINDING SITE, designated SEQ ID:2481, to the nucleotide sequence of GAM281 RNA, herein designated GAM RNA, also designated SEQ ID:278.

Another function of GAM281 is therefore inhibition of Serine/threonine kinase 10 (STK10, Accession NP_005981.1), a gene which can act on substrates such as myelin basic protein and histone iia on serine and threonine residues. Accordingly, utilities of GAM281 include diagnosis, prevention and treatment of diseases and clinical conditions associated with STK10.

The function of STK10 and its association with various diseases and clinical conditions, has been established by previous studies, as described hereinabove with reference to GAM71.1. Stomatin (STOM, Accession NP_004090.3) is another GAM281 target gene, herein designated TARGET GENE. STOM BINDING SITE is a target binding site found in the 3' untranslated region of mRNA encoded by STOM, corresponding to a target binding site such as BINDING SITE I, BINDING SITE II or BINDING SITE III of FIG. 8. Table 4 illustrates the complementarity of the nucleotide sequences of STOM BINDING SITE, designated SEQ ID:2907, to the nucleotide sequence of GAM281 RNA, herein designated GAM RNA, also designated SEQ ID:278.

Another function of GAM281 is therefore inhibition of Stomatin (STOM, Accession NP_004090.3). Accordingly, utilities of GAM281 include diagnosis, prevention and treatment of diseases and clinical conditions associated with STOM.

Synaptotagmin xi (SYT11, Accession NP_689493.2) is another GAM281 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:9033, to the nucleotide sequence of GAM281 RNA, herein designated GAM RNA, also designated SEQ ID:278.

Another function of GAM281 is therefore inhibition of Synaptotagmin xi (SYT11, Accession NP_689493.2). Accordingly, utilities of GAM281 include diagnosis, prevention and treatment of diseases and clinical conditions associated with SYT11.

Synaptotagmin xiii (SYT13, Accession NP_065877.1) is another GAM281 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:15294, to the nucleotide sequence of GAM281 RNA, herein designated GAM RNA, also designated SEQ ID:278.

Another function of GAM281 is therefore inhibition of Synaptotagmin xiii (SYT13, Accession NP_065877.1). Accordingly, utilities of GAM281 include diagnosis, prevention and treatment of diseases and clinical conditions associated with SYT13.

TADA3L (Accession NP_597814.1) is another GAM281 target gene, herein designated TARGET GENE. TADA3L BINDING SITE is a target binding site found in the 3' untranslated region of multiple transcripts of mRNA encoded by TADA3L, corresponding to a target binding site such as BINDING SITE I, BINDING SITE II or BINDING SITE III of FIG. 8. Table 4 illustrates the complementarity of the nucleotide sequences of TADA3L BINDING SITE, designated SEQ ID:9087, to the nucleotide sequence of GAM281 RNA, herein designated GAM RNA, also designated SEQ ID:278.

Another function of GAM281 is therefore inhibition of TADA3L (Accession NP_597814.1). Accordingly, utilities of GAM281 include diagnosis, prevention and treatment of diseases and clinical conditions associated with TADA3L.

Taf11 rna polymerase ii, tata box binding protein (tbp)-associated factor, 28 kda (TAF11, Accession NP_005634.1) is another GAM281 target gene, herein designated TARGET GENE. TAF11 BINDING SITE is a target binding site found in the 3' untranslated region of mRNA encoded by TAF11, corresponding to a target binding site such as BINDING SITE I, BINDING SITE II or BINDING SITE III of FIG. 8. Table 4 illustrates the complementarity of the nucleotide sequences of TAF11 BINDING SITE, designated SEQ ID:1997, to the nucleotide sequence of GAM281 RNA, herein designated GAM RNA, also designated SEQ ID:278.

Another function of GAM281 is therefore inhibition of Taf11 rna polymerase ii, tata box binding protein (tbp)-associated factor, 28 kda (TAF11, Accession NP_005634.1), a gene which plays a central role in mediating promoter responses to various activators and repressors. Accordingly, utilities of GAM281 include diagnosis, prevention and treatment of diseases and clinical conditions associated with TAF11.

The function of TAF11 and its association with various diseases and clinical conditions, has been established by previous studies, as described hereinabove with reference to GAM130.1. T-cell acute lymphocytic leukemia 1 (TAL1, Accession NP_003180.1) is another GAM281 target gene, herein designated TARGET GENE. TAL1 BINDING SITE1 and TAL1 BINDING SITE2 are target binding sites found in untranslated regions of mRNA encoded by TAL1, corresponding to target binding sites such as BINDING SITE I, BINDING SITE II or BINDING SITE III of FIG. 8. Table 4 illustrates the complementarity of the nucleotide sequences of TAL1 BINDING SITE1 and TAL1 BINDING SITE2, designated SEQ ID:18260 and SEQ ID:3146 respectively, to the nucleotide sequence of GAM281 RNA, herein designated GAM RNA, also designated SEQ ID:278.

Another function of GAM281 is therefore inhibition of T-cell acute lymphocytic leukemia 1 (TAL1, Accession NP_003180.1), a gene which may help control cell growth and differentiation. Accordingly, utilities of GAM281 include diagnosis, prevention and treatment of diseases and clinical conditions associated with TAL1.

The function of TAL1 and its association with various diseases and clinical conditions, has been established by previous studies, as described hereinabove with reference to GAM30.1. Tap binding protein (tapasin) (TAPBP, Accession NP_003181.3) is another GAM281 target gene, herein designated TARGET GENE. TAPBP BINDING SITE1 through TAPBP BINDING SITE3 are target binding sites found in untranslated regions of multiple transcripts of mRNA encoded by TAPBP, corresponding to target binding sites such as BINDING SITE I, BINDING SITE II or BINDING SITE III of FIG. 8. Table 4 illustrates the complementarity of the nucleotide sequences of TAPBP BINDING SITE1 through TAPBP BINDING SITE3, designated SEQ ID:12247, SEQ ID:11523 and SEQ ID:16940 respectively, to the nucleotide sequence of GAM281 RNA, herein designated GAM RNA, also designated SEQ ID:278.

Another function of GAM281 is therefore inhibition of Tap binding protein (tapasin) (TAPBP, Accession NP_003181.3), a gene which is involved in MHC class I-restricted antigen processing. Accordingly, utilities of GAM281 include diagnosis, prevention and treatment of diseases and clinical conditions associated with TAPBP.

The function of TAPBP and its association with various diseases and clinical conditions, has been established by previous studies, as described hereinabove with reference to GAM136.1. Tyrosine aminotransferase (TAT, Accession NP_000344.1) is another GAM281 target gene, herein designated TARGET GENE. TAT BINDING SITE is a target binding site found in the 3' untranslated region of mRNA encoded by TAT, corresponding to a target binding site such as BINDING SITE I, BINDING SITE II or BINDING SITE III of FIG. 8. Table 4 illustrates the complementarity of the nucleotide sequences of TAT BINDING SITE, designated SEQ ID:18942, to the nucleotide sequence of GAM281 RNA, herein designated GAM RNA, also designated SEQ ID:278.

Another function of GAM281 is therefore inhibition of Tyrosine aminotransferase (TAT, Accession NP_000344.1), a gene which is tyrosine aminotransferase and strongly similar to rat Rn.9947, which plays a role in gluconeogenesis. Accordingly, utilities of GAM281 include diagnosis, prevention and treatment of diseases and clinical conditions associated with TAT.

The function of TAT and its association with various diseases and clinical conditions, has been established by previous studies, as described hereinabove with reference to GAM189.1. Tafazzin (cardiomyopathy, dilated 3a (x-linked); endocardial fibroelastosis 2; barth syndrome) (TAZ, Accession NP_851831.1) is another GAM281 target gene, herein designated TARGET GENE. TAZ BINDING SITE is a target binding site found in the 3' untranslated region of multiple transcripts of mRNA encoded by TAZ, corresponding to a target binding site such as BINDING SITE I, BINDING SITE II or BINDING SITE III of FIG. 8. Table 4 illustrates the complementarity of the nucleotide sequences of TAZ BINDING SITE, designated SEQ ID:9257, to the nucleotide sequence of GAM281 RNA, herein designated GAM RNA, also designated SEQ ID:278.

Another function of GAM281 is therefore inhibition of Tafazzin (cardiomyopathy, dilated 3a (x-linked); endocardial fibroelastosis 2; barth syndrome) (TAZ, Accession NP_851831.1). Accordingly, utilities of GAM281 include diagnosis, prevention and treatment of diseases and clinical conditions associated with TAZ.

Tbc1 domain family, member 5 (TBC1D5, Accession NP_055559.1) is another GAM281 target gene, herein designated TARGET GENE. TBC1D5 BINDING SITE1 and TBC1D5 BINDING SITE2 are target binding sites found in untranslated regions of mRNA encoded by TBC1D5, corresponding to target binding sites such as BINDING SITE I, BINDING SITE II or BINDING SITE III of FIG. 8. Table 4 illustrates the complementarity of the nucleotide sequences of TBC1D5 BINDING SITE1 and TBC1D5 BINDING SITE2, designated SEQ ID:16449 and SEQ ID:14859 respectively, to the nucleotide sequence of GAM281 RNA, herein designated GAM RNA, also designated SEQ ID:278.

Another function of GAM281 is therefore inhibition of Tbc1 domain family, member 5 (TBC1D5, Accession NP_055559.1). Accordingly, utilities of GAM281 include diagnosis, prevention and treatment of diseases and clinical conditions associated with TBC1D5.

Transcription factor 2, hepatic; lf-b3; variant hepatic nuclear factor (TCF2, Accession NP_006472.1) is another GAM281 target gene, herein designated TARGET GENE. TCF2 BINDING SITE is a target binding site found in the 3' untranslated region of multiple transcripts of mRNA encoded by TCF2, corresponding to a target binding site such as BINDING SITE I, BINDING SITE II or BINDING SITE III of FIG. 8. Table 4 illustrates the complementarity of the nucleotide sequences of TCF2 BINDING SITE, designated SEQ ID:625, to the nucleotide sequence of GAM281 RNA, herein designated GAM RNA, also designated SEQ ID:278.

Another function of GAM281 is therefore inhibition of Transcription factor 2, hepatic; lf-b3; variant hepatic nuclear factor (TCF2, Accession NP_006472.1), a gene which probably binds to the inverted palindrome 5'-gttaatnattaac-3'. and therefore is associated with Maturity-onset diabetes of the young type 5 (mody5), familial hypoplastic glomerulocystic kidney disease (gckd). Accordingly, utilities of GAM281 include diagnosis, prevention and treatment of Maturity-onset diabetes of the young type 5 (mody5), familial hypoplastic glomerulocystic kidney disease (gckd), and of other diseases and clinical conditions associated with TCF2.

The function of TCF2 and its association with various diseases and clinical conditions, has been established by previous studies, as described hereinabove with reference to GAM144.1. T-cell leukemia/lymphoma 6 (TCL6, Accession NP_055233.1) is another GAM281 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:17450 and SEQ ID:17450 respectively, to the nucleotide sequence of GAM281 RNA, herein designated GAM RNA, also designated SEQ ID:278.

Another function of GAM281 is therefore inhibition of T-cell leukemia/lymphoma 6 (TCL6, Accession NP_055233.1). Accordingly, utilities of GAM281 include diagnosis, prevention and treatment of diseases and clinical conditions associated with TCL6.

T-cell leukemia/lymphoma 6 (TCL6, Accession NP_065577.2) is another GAM281 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:17450 and SEQ ID:9387 respectively, to the nucleotide sequence of GAM281 RNA, herein designated GAM RNA, also designated SEQ ID:278.

Another function of GAM281 is therefore inhibition of T-cell leukemia/lymphoma 6 (TCL6, Accession NP_065577.2). Accordingly, utilities of GAM281 include diagnosis, prevention and treatment of diseases and clinical conditions associated with TCL6.

T-cell leukemia/lymphoma 6 (TCL6, Accession NP_065578.2) is another GAM281 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:9387 and SEQ ID:17450 respectively, to the nucleotide sequence of GAM281 RNA, herein designated GAM RNA, also designated SEQ ID:278.

Another function of GAM281 is therefore inhibition of T-cell leukemia/lymphoma 6 (TCL6, Accession NP_065578.2). Accordingly, utilities of GAM281 include diagnosis, prevention and treatment of diseases and clinical conditions associated with TCL6.

Teratocarcinoma-derived growth factor 1 (TDGF1, Accession NP_003203.1) is another GAM281 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:8563, to the nucleotide sequence of GAM281 RNA, herein designated GAM RNA, also designated SEQ ID:278.

Another function of GAM281 is therefore inhibition of Teratocarcinoma-derived growth factor 1 (TDGF1, Accession NP_003203.1), a gene which can play a role in the determination of the epiblastic cells that subsequently give rise to the mesoderm. and therefore may be associated with Forebrain defects. Accordingly, utilities of GAM281 include diagnosis, prevention and treatment of Forebrain defects, and of other diseases and clinical conditions associated with TDGF1.

The function of TDGF1 and its association with various diseases and clinical conditions, has been established by previous studies, as described hereinabove with reference to GAM30.1. TERA (Accession NP_067061.1) is another GAM281 target gene, herein designated TARGET GENE. TERA BINDING SITE is a target binding site found in the 3' untranslated region of mRNA encoded by TERA, corresponding to a target binding site such as BINDING SITE I, BINDING SITE II or BINDING SITE III of FIG. 8. Table 4 illustrates the complementarity of the nucleotide sequences of TERA BINDING SITE, designated SEQ ID:17755, to the nucleotide sequence of GAM281 RNA, herein designated GAM RNA, also designated SEQ ID:278.

Another function of GAM281 is therefore inhibition of TERA (Accession NP_067061.1). Accordingly, utilities of GAM281 include diagnosis, prevention and treatment of diseases and clinical conditions associated with TERA.

Telomeric repeat binding factor (nima-interacting) 1 (TERF1, Accession NP_003209.1) is another GAM281 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:1745, to the nucleotide sequence of GAM281 RNA, herein designated GAM RNA, also designated SEQ ID:278.

Another function of GAM281 is therefore inhibition of Telomeric repeat binding factor (nima-interacting) 1 (TERF1, Accession NP_003209.1), a gene which negatively regulates telomere length, involves in regulation of the mitotic spindle. Accordingly, utilities of GAM281 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor (nima-interacting) 1 (TERF1, Accession NP_059523.1) is another GAM281 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:1745, to the nucleotide sequence of GAM281 RNA, herein designated GAM RNA, also designated SEQ ID:278.

Another function of GAM281 is therefore inhibition of Telomeric repeat binding factor (nima-interacting) 1 (TERF1, Accession NP_059523.1), a gene which negatively regulates telomere length, involves in regulation of the mitotic spindle. Accordingly, utilities of GAM281 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor 2 (TERF2, Accession NP_005643.1) is another GAM281 target gene, herein designated TARGET GENE. TERF2 BINDING SITE is a target binding site found in the 3' untranslated region of mRNA encoded by TERF2, corresponding to a target binding site such as BINDING SITE I, BINDING SITE II or BINDING SITE III of FIG. 8. Table 4 illustrates the complementarity of the nucleotide sequences of TERF2 BINDING SITE, designated SEQ ID:1744, to the nucleotide sequence of GAM281 RNA, herein designated GAM RNA, also designated SEQ ID:278.

Another function of GAM281 is therefore inhibition of Telomeric repeat binding factor 2 (TERF2, Accession NP_005643.1), a gene which plays a key role in the protective activity of telomeres. Accordingly, utilities of GAM281 include diagnosis, prevention and treatment of diseases and clinical conditions associated with TERF2.

The function of TERF2 and its association with various diseases and clinical conditions, has been established by previous studies, as described hereinabove with reference to GAM133.2. Tgfb-induced factor 2 (tale family homeobox) (TGIF2, Accession NP_068581.1) is another GAM281 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:6881, to the nucleotide sequence of GAM281 RNA, herein designated GAM RNA, also designated SEQ ID:278.

Another function of GAM281 is therefore inhibition of Tgfb-induced factor 2 (tale family homeobox) (TGIF2, Accession NP_068581.1). Accordingly, utilities of GAM281 include diagnosis, prevention and treatment of diseases and clinical conditions associated with TGIF2.

Thioesterase, adipose associated (THEA, Accession NP_671517.1) is another GAM281 target gene, herein designated TARGET GENE. THEA BINDING SITE is a target binding site found in the 3' untranslated region of multiple transcripts of mRNA encoded by THEA, corresponding to a target binding site such as BINDING SITE I, BINDING SITE II or BINDING SITE III of FIG. 8. Table 4 illustrates the complementarity of the nucleotide sequences of THEA BINDING SITE, designated SEQ ID:14452, to the nucleotide sequence of GAM281 RNA, herein designated GAM RNA, also designated SEQ ID:278.

Another function of GAM281 is therefore inhibition of Thioesterase, adipose associated (THEA, Accession NP_671517.1). Accordingly, utilities of GAM281 include diagnosis, prevention and treatment of diseases and clinical conditions associated with THEA.

Tigger transposable element derived 6 (TIGD6, Accession NP_112215.1) is another GAM281 target gene, herein designated TARGET GENE. TIGD6 BINDING SITE is a target binding site found in the 3' untranslated region of mRNA encoded by TIGD6, corresponding to a target binding site such as BINDING SITE I, BINDING SITE II or BINDING SITE III of FIG. 8. Table 4 illustrates the complementarity of the nucleotide sequences of TIGD6 BINDING SITE, designated SEQ ID:4933, to the nucleotide sequence of GAM281 RNA, herein designated GAM RNA, also designated SEQ ID:278.

Another function of GAM281 is therefore inhibition of Tigger transposable element derived 6 (TIGD6, Accession NP_112215.1). Accordingly, utilities of GAM281 include diagnosis, prevention and treatment of diseases and clinical conditions associated with TIGD6.

TIM50L (Accession XP_053074.2) is another GAM281 target gene, herein designated TARGET GENE. TIM50L BINDING SITE1 and TIM50L BINDING SITE2 are target binding sites found in untranslated regions of mRNA encoded by TIM50L, corresponding to target binding sites such as BINDING SITE I, BINDING SITE II or BINDING SITE III of FIG. 8. Table 4 illustrates the complementarity of the nucleotide sequences of TIM50L BINDING SITE1 and TIM50L BINDING SITE2, designated SEQ ID:10157 and SEQ ID:5989 respectively, to the nucleotide sequence of GAM281 RNA, herein designated GAM RNA, also designated SEQ ID:278.

Another function of GAM281 is therefore inhibition of TIM50L (Accession XP_053074.2). Accordingly, utilities of GAM281 include diagnosis, prevention and treatment of diseases and clinical conditions associated with TIM50L.

Thymidine kinase 2, mitochondrial (TK2, Accession NP_004605.1) is another GAM281 target gene, herein designated TARGET GENE. TK2 BINDING SITE is a target binding site found in the 3' untranslated region of mRNA encoded by TK2, corresponding to a target binding site such as BINDING SITE I, BINDING SITE II or BINDING SITE III of FIG. 8. Table 4 illustrates the complementarity of the nucleotide sequences of TK2 BINDING SITE, designated SEQ ID:3160, to the nucleotide sequence of GAM281 RNA, herein designated GAM RNA, also designated SEQ ID:278.

Another function of GAM281 is therefore inhibition of Thymidine kinase 2, mitochondrial (TK2, Accession NP_004605.1), a gene which phosphorylates thymidine, deoxycytidine, deoxyuridine, and also anti-viral and anti-cancer nucleoside analogs and therefore may be associated with Mitochondrial dna depletion myopathy. Accordingly, utilities of GAM281 include diagnosis, prevention and treatment of Mitochondrial dna depletion myopathy, and of other diseases and clinical conditions associated with TK2.

The function of TK2 has been established by previous studies. Johansson and Karlsson (1997) cloned cDNAs encoding human TK2. The gene encodes a 234-amino acid polypeptide. Although TK2 is believed to reside in mitochondria, it contains no mitochondrial translocation signal sequence. Northern blot analysis revealed that TK2 was ubiquitously expressed as 2 transcripts of 2.4 and 4 kb. Expression of the TK2 cDNA revealed a 60- kD protein with phosphorylation activity similar to purified human TK2. Based on the partial protein sequence of human TK2, Wang et al. (1999) isolated a human brain TK2 cDNA. These authors noted that although the cDNA they isolated corresponds to the full-length mature protein, it is likely to be incomplete because it lacks the coding region for a mitochondrial target presequence. They reported that the predicted protein sequence matched that of purified TK2, but differed at the N-terminus and at amino acid 28 from the TK2 sequence deduced by Johansson and Karlsson (1997). TK2 shares approximately 40% identity with deoxycytidine kinase (OMIM Ref. No. 125450) and deoxyguanosine kinase (OMIM Ref. No. 601465) on the amino acid level. Wang et al. (1999) characterized both recombinant and native TK2 forms and found that the enzyme has broad substrate specificity and complex kinetics, suggesting that it may play a role in the activation of chemotherapeutic nucleoside analogs. Northern blot analysis indicated that the TK2 gene was expressed as multiple transcripts, some of which show a tissue- specific pattern. The highest levels of expression were observed in testis and ovary. Saada et al. (2001) identified 2 mutations in TK2, his90 to asn (188250.0001) and ile181 to asn (188250.0002), in 4 individuals who developed devastating myopathy and depletion of muscular mtDNA in infancy. In these individuals, the activity of TK2 in muscle mitochondria was reduced to 14 to 45% of the mean value in healthy control individuals. Mandel et al. (2001) identified mutations in the DGUOK gene in another form of mtDNA depletion syndrome, the hepatocerebral form (see OMIM Ref. No. 251880). They noted that the main supply of dNTPs for mtDNA synthesis comes from the salvage pathway initiated by DGK and TK2. The association of mtDNA depletion with mutations in the genes encoding these 2 kinases suggested that the salvage pathway enzymes are involved in the maintenance of balanced mitochondrial dNTP pools.

Full details of the abovementioned studies are described in the following publications, the disclosure of which are hereby incorporated by reference:

Wang, L.; Munch-Petersen, B.; Herrstrom Sjoberg, A.; Hellman, U.; Bergman, T.; Jornvall, H.; Eriksson, S.: Human thymidine kinase 2: molecular cloning and characterisation of the enzyme activity with antiviral and cytostatic nucleoside substrates. FEBS Lett. 443:170-174, 1999; and Saada, A.; Shaag, A.; Mandel, H.; Nevo, Y.; Eriksson, S.; Elpeleg, O.: Mutant mitochondrial thymidine kinase in mitochondrial DNA depletion myopathy. Nature Genet. 29:342-344, 2001.

Further studies establishing the function and utilities of TK2 are found in John Hopkins OMIM database record ID 188250, and in cited publications listed in Table 5, which are hereby incorporated by reference. Toll-like receptor 5 (TLR5, Accession NP_003259.2) is another GAM281 target gene, herein designated TARGET GENE. TLR5 BINDING SITE is a target binding site found in the 5' untranslated region of mRNA encoded by TLR5, corresponding to a target binding site such as BINDING SITE I, BINDING SITE II or BINDING SITE III of FIG. 8. Table 4 illustrates the complementarity of the nucleotide sequences of TLR5 BINDING SITE, designated SEQ ID:16229, to the nucleotide sequence of GAM281 RNA, herein designated GAM RNA, also designated SEQ ID:278.

Another function of GAM281 is therefore inhibition of Toll-like receptor 5 (TLR5, Accession NP_003259.2), a gene which participates in the innate immune response to bacterial flagellins. Accordingly, utilities of GAM281 include diagnosis, prevention and treatment of diseases and clinical conditions associated with TLR5.

The function of TLR5 and its association with various diseases and clinical conditions, has been established by previous studies, as described hereinabove with reference to GAM40.1. Transmembrane, cochlear expressed, 1 (TMC1, Accession NP_619636.2) is another GAM281 target gene, herein designated TARGET GENE. TMC1 BINDING SITE is a target binding site found in the 5' untranslated region of mRNA encoded by TMC1, corresponding to a target binding site such as BINDING SITE I, BINDING SITE II or BINDING SITE III of FIG. 8. Table 4 illustrates the complementarity of the nucleotide sequences of TMC1 BINDING SITE, designated SEQ ID:2152, to the nucleotide sequence of GAM281 RNA, herein designated GAM RNA, also designated SEQ ID:278.

Another function of GAM281 is therefore inhibition of Transmembrane, cochlear expressed, 1 (TMC1, Accession NP_619636.2), a gene which is required for normal function of cochlear hair cells and therefore may be associated with Autosomal recessive nonsyndromic neurosensory deafness and autosomal dominant nonsyndromic sensorineural hearing loss. Accordingly, utilities of GAM281 include diagnosis, prevention and treatment of Autosomal recessive nonsyndromic neurosensory deafness and autosomal dominant nonsyndromic sensorineural hearing loss, and of other diseases and clinical conditions associated with TMC1.

The function of TMC1 and its association with various diseases and clinical conditions, has been established by previous studies, as described hereinabove with reference to GAM136.1. TMEM14A (Accession NP_054770.1) is another GAM281 target gene, herein designated TARGET GENE. TMEM14A BINDING SITE is a target binding site found in the 5' untranslated region of mRNA encoded by TMEM14A, corresponding to a target binding site such as BINDING SITE I, BINDING SITE II or BINDING SITE III of FIG. 8. Table 4 illustrates the complementarity of the nucleotide sequences of TMEM14A BINDING SITE, designated SEQ ID:5271, to the nucleotide sequence of GAM281 RNA, herein designated GAM RNA, also designated SEQ ID:278.

Another function of GAM281 is therefore inhibition of TMEM14A (Accession NP_054770.1). Accordingly, utilities of GAM281 include diagnosis, prevention and treatment of diseases and clinical conditions associated with TMEM14A.

Transmembrane protease, serine 3 (TMPRSS3, Accession NP_076927.1) is another GAM281 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM281 RNA, herein designated GAM RNA, also designated SEQ ID:278.

Another function of GAM281 is therefore inhibition of Transmembrane protease, serine 3 (TMPRSS3, Accession NP_076927.1). Accordingly, utilities of GAM281 include diagnosis, prevention and treatment of diseases and clinical conditions associated with TMPRSS3.

Transmembrane protease, serine 3 (TMPRSS3, Accession NP_115780.1) is another GAM281 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM281 RNA, herein designated GAM RNA, also designated SEQ ID:278.

Another function of GAM281 is therefore inhibition of Transmembrane protease, serine 3 (TMPRSS3, Accession NP_115780.1). Accordingly, utilities of GAM281 include diagnosis, prevention and treatment of diseases and clinical conditions associated with TMPRSS3.

Transmembrane protease, serine 3 (TMPRSS3, Accession NP_115777.1) is another GAM281 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM281 RNA, herein designated GAM RNA, also designated SEQ ID:278.

Another function of GAM281 is therefore inhibition of Transmembrane protease, serine 3 (TMPRSS3, Accession NP_115777.1). Accordingly, utilities of GAM281 include diagnosis, prevention and treatment of diseases and clinical conditions associated with TMPRSS3.

Tumor necrosis factor, alpha-induced protein 2 (TNFAIP2, Accession NP_006282.2) is another GAM281 target gene, herein designated TARGET GENE. TNFAIP2 BINDING SITE is a target binding site found in the 3' untranslated region of mRNA encoded by TNFAIP2, corresponding to a target binding site such as BINDING SITE I, BINDING SITE II or BINDING SITE III of FIG. 8. Table 4 illustrates the complementarity of the nucleotide sequences of TNFAIP2BINDING SITE, designated SEQ ID:17621, to the nucleotide sequence of GAM281 RNA, herein designated GAM RNA, also designated SEQ ID:278.

Another function of GAM281 is therefore inhibition of Tumor necrosis factor, alpha-induced protein 2 (TNFAIP2, Accession NP_006282.2). Accordingly, utilities of GAM281 include diagnosis, prevention and treatment of diseases and clinical conditions associated with TNFAIP2.

Tumor necrosis factor receptor superfamily, member 10b (TNFRSF10B, Accession NP_003833.3) is another GAM281 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:4398, to the nucleotide sequence of GAM281 RNA, herein designated GAM RNA, also designated SEQ ID:278.

Another function of GAM281 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM281 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 10b (TNFRSF10B, Accession NP_671716.1) is another GAM281 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:4398, to the nucleotide sequence of GAM281 RNA, herein designated GAM RNA, also designated SEQ ID:278.

Another function of GAM281 is therefore inhibition of Tumor necrosis factor receptor superfamily, member 10b (TNFRSF10B, Accession NP_671716.1), a gene which forms complex that induces apoptosis. and therefore may be associated with Squamous cell carcinoma. Accordingly, utilities of GAM281 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 11a, activator of nfkb (TNFRSF11A, Accession NP_003830.1) is another GAM281 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:2200, to the nucleotide sequence of GAM281 RNA, herein designated GAM RNA, also designated SEQ ID:278.

Another function of GAM281 is therefore inhibition of Tumor necrosis factor receptor superfamily, member 11a, activator of nfkb (TNFRSF11A, Accession NP_003830.1). Accordingly, utilities of GAM281 include diagnosis, prevention and treatment of diseases and clinical conditions associated with TNFRSF11A.

Tumor necrosis factor receptor superfamily, member 18 (TNFRSF18, Accession NP_683700.1) is another GAM281 target gene, herein designated TARGET GENE. TNFRSF18 BINDING SITE is a target binding site found in the 3' untranslated region of multiple transcripts of mRNA encoded by TNFRSF18, corresponding to a target binding site such as BINDING SITE I, BINDING SITE II or BINDING SITE III of FIG. 8. Table 4 illustrates the complementarity of the nucleotide sequences of TNFRSF18 BINDING SITE, designated SEQ ID:8120, to the nucleotide sequence of GAM281 RNA, herein designated GAM RNA, also designated SEQ ID:278.

Another function of GAM281 is therefore inhibition of Tumor necrosis factor receptor superfamily, member 18 (TNFRSF18, Accession NP_683700.1), a gene which interacts between activated t lymphocytes and endothelial cells. Accordingly, utilities of GAM281 include diagnosis, prevention and treatment of diseases and clinical conditions associated with TNFRSF18.

The function of TNFRSF18 has been established by previous studies. Members of the tumor necrosis factor (TNF; 191160) and TNF receptor (TNFR) superfamilies regulate diverse biologic functions, including cell proliferation, differentiation, and survival. See 191190. Using differential display to identify T cell mRNAs induced by the synthetic glucocorticoid hormone dexamethasone, Nocentini et al. (1997) identified a mouse cDNA encoding a novel member of the TNFR family. They designated the corresponding gene Gitr for 'glucocorticoid-induced TNFR family-related gene.' Like other TNFRs, the predicted Gitr protein contains cysteine-rich repeats in the extracellular domain. In addition, the intracellular domain of Gitr shares significant homology with those of the mouse and human TNFRs 4-1BB (OMIM Ref. No. 602250) and CD27 (OMIM Ref. No. 186711). Nocentini et al. (1997) demonstrated that the Gitr gene is induced in T cells by dexamethasone as well as by other cell-activating stimuli. Gitr expression protected T cells from apoptosis induced by treatment with anti-CD3 (OMIM Ref. No. 186790) antibodies, but not by other apoptotic agents. The authors concluded that Gitr is a new member of the TNFR family involved in the regulation of T cell receptor-mediated cell death. Kwon et al. (1999) isolated cDNAs encoding the human Gitr homolog and the Gitr ligand (OMIM Ref. No. 603898), which they designated AITR (activation-inducible TNFR family member) and AITRL, respectively. These authors reported that the predicted 234-amino acid AITR protein is a type I transmembrane protein with a signal peptide and a single transmembrane region. AITR and mouse Gitr proteins are 55% identical. As with other TNFR family members, when expressed in mammalian cells, AITR mediated NF-kappa-B (see OMIM Ref. No. 164011) activation via TRAF2 (OMIM Ref. No. 601895). TRAF1 (OMIM Ref. No. 601711) and TRAF3 (OMIM Ref. No. 601896) appeared to downregulate AITR-induced NF-kappa-B activation. Northern blot analysis revealed that the 1.25-kb AITR mRNA is expressed in lymph node, peripheral blood leukocytes, and, weakly, in spleen. Expression of AITR, like that of other TNFRs, was upregulated in peripheral mononuclear cells after antigen stimulation. AITRL was constitutively expressed in an endothelial cell line, leading the authors to suggest that AITR and its ligand may be important for interactions between activated T lymphocytes and endothelial cells. Independently, Gurney et al. (1999) identified cDNAs encoding AITR and AITRL, which they called GITR and GITRL, respectively. Coexpression of ligand and receptor protected Jurkat T cells against antigen receptor-induced cell death, suggesting that GITRL and GITR may modulate T lymphocyte survival in peripheral tissues.

Full details of the abovementioned studies are described in the following publications, the disclosure of which are hereby incorporated by reference:

Gurney, A. L.; Marsters, S. A.; Huang, A.; Pitti, R. M.; Mark, M.; Baldwin, D. T.; Gray, A. M.; Dowd, P.; Brush, J.; Heldens, S.; Schow, P.; Goddard, A. D.; Wood, W. I.; Baker, K. P.; Godowski, P. J.; Ashkenazi, A.: Identification of a new member of the tumor necrosis factor family and its receptor, a human ortholog of mouse GITR. Curr. Biol. 9:215-218, 1999; and Kwon, B.; y, K.-Y.; Ni, J.; y, G.-L.; Jang, I.-K.; Kim, Y.-J.; Xing, L.; Liu, D.; Wang, S.-X.; Kwon, B. S.: Identification of a novel activation-inducible protein of the tumor necro.

Further studies establishing the function and utilities of TNFRSF18 are found in John Hopkins OMIM database record ID 603905, and in cited publications listed in Table 5, which are hereby incorporated by reference. Tumor necrosis factor receptor superfamily, member 18 (TNFRSF18, Accession NP_004186.1) is another GAM281 target gene, herein designated TARGET GENE. TNFRSF18 BINDING SITE is a target binding site found in the 3' untranslated region of multiple transcripts of mRNA encoded by TNFRSF18, corresponding to a target binding site such as BINDING SITE I, BINDING SITE II or BINDING SITE III of FIG. 8. Table 4 illustrates the complementarity of the nucleotide sequences of TNFRSF18 BINDING SITE, designated SEQ ID:8120, to the nucleotide sequence of GAM281 RNA, herein designated GAM RNA, also designated SEQ ID:278.

Another function of GAM281 is therefore inhibition of Tumor necrosis factor receptor superfamily, member 18 (TNFRSF18, Accession NP_004186.1), a gene which interacts between activated t lymphocytes and endothelial cells. Accordingly, utilities of GAM281 include diagnosis, prevention and treatment of diseases and clinical conditions associated with TNFRSF18.

The function of TNFRSF18 has been established by previous studies. Members of the tumor necrosis factor (TNF; 191160) and TNF receptor (TNFR) superfamilies regulate diverse biologic functions, including cell proliferation, differentiation, and survival. See 191190. Using differential display to identify T cell mRNAs induced by the synthetic glucocorticoid hormone dexamethasone, Nocentini et al. (1997) identified a mouse cDNA encoding a novel member of the TNFR family. They designated the corresponding gene Gitr for 'glucocorticoid-induced TNFR family-related gene.' Like other TNFRs, the predicted Gitr protein contains cysteine-rich repeats in the extracellular domain. In addition, the intracellular domain of Gitr shares significant homology with those of the mouse and human TNFRs 4-1BB (OMIM Ref. No. 602250) and CD27 (OMIM Ref. No. 186711). Nocentini et al. (1997) demonstrated that the Gitr gene is induced in T cells by dexamethasone as well as by other cell-activating stimuli. Gitr expression protected T cells from apoptosis induced by treatment with anti-CD3 (OMIM Ref. No. 186790) antibodies, but not by other apoptotic agents. The authors concluded that Gitr is a new member of the TNFR family involved in the regulation of T cell receptor-mediated cell death. Kwon et al. (1999) isolated cDNAs encoding the human Gitr homolog and the Gitr ligand (OMIM Ref. No. 603898), which they designated AITR (activation-inducible TNFR family member) and AITRL, respectively. These authors reported that the predicted 234-amino acid AITR protein is a type I transmembrane protein with a signal peptide and a single transmembrane region. AITR and mouse Gitr proteins are 55% identical. As with other TNFR family members, when expressed in mammalian cells, AITR mediated NF-kappa-B (see OMIM Ref. No. 164011) activation via TRAF2 (OMIM Ref. No. 601895). TRAF1 (OMIM Ref. No. 601711) and TRAF3 (OMIM Ref. No. 601896) appeared to downregulate AITR-induced NF-kappa-B activation. Northern blot analysis revealed that the 1.25-kb AITR mRNA is expressed in lymph node, peripheral blood leukocytes, and, weakly, in spleen. Expression of AITR, like that of other TNFRs, was upregulated in peripheral mononuclear cells after antigen stimulation. AITRL was constitutively expressed in an endothelial cell line, leading the authors to suggest that AITR and its ligand may be important for interactions between activated T lymphocytes and endothelial cells. Independently, Gurney et al. (1999) identified cDNAs encoding AITR and AITRL, which they called GITR and GITRL, respectively. Coexpression of ligand and receptor protected Jurkat T cells against antigen receptor-induced cell death, suggesting that GITRL and GITR may modulate T lymphocyte survival in peripheral tissues.

Full details of the abovementioned studies are described in the following publications, the disclosure of which are hereby incorporated by reference:

Gurney, A. L.; Marsters, S. A.; Huang, A.; Pitti, R. M.; Mark, M.; Baldwin, D. T.; Gray, A. M.; Dowd, P.; Brush, J.; Heldens, S.; Schow, P.; Goddard, A. D.; Wood, W. I.; Baker, K. P.; Godowski, P. J.; Ashkenazi, A.: Identification of a new member of the tumor necrosis factor family and its receptor, a human ortholog of mouse GITR. Curr. Biol. 9:215-218, 1999; and Kwon, B.; y, K.-Y.; Ni, J.; y, G.-L.; Jang, I.-K.; Kim, Y.-J.; Xing, L.; Liu, D.; Wang, S.-X.; Kwon, B. S.: Identification of a novel activation-inducible protein of the tumor necro.

Further studies establishing the function and utilities of TNFRSF18 are found in John Hopkins OMIM database record ID 603905, and in cited publications listed in Table 5, which are hereby incorporated by reference. Tumor necrosis factor receptor superfamily, member 18 (TNFRSF18, Accession NP_683699.1) is another GAM281 target gene, herein designated TARGET GENE. TNFRSF18 BINDING SITE is a target binding site found in the 3' untranslated region of multiple transcripts of mRNA encoded by TNFRSF18, corresponding to a target binding site such as BINDING SITE I, BINDING SITE II or BINDING SITE III of FIG. 8. Table 4 illustrates the complementarity of the nucleotide sequences of TNFRSF18 BINDING SITE, designated SEQ ID:8120, to the nucleotide sequence of GAM281 RNA, herein designated GAM RNA, also designated SEQ ID:278.

Another function of GAM281 is therefore inhibition of Tumor necrosis factor receptor superfamily, member 18 (TNFRSF18, Accession NP_683699.1), a gene which interacts between activated t lymphocytes and endothelial cells. Accordingly, utilities of GAM281 include diagnosis, prevention and treatment of diseases and clinical conditions associated with TNFRSF18.

The function of TNFRSF18 has been established by previous studies. Members of the tumor necrosis factor (TNF; 191160) and TNF receptor (TNFR) superfamilies regulate diverse biologic functions, including cell proliferation, differentiation, and survival. See 191190. Using differential display to identify T cell mRNAs induced by the synthetic glucocorticoid hormone dexamethasone, Nocentini et al. (1997) identified a mouse cDNA encoding a novel member of the TNFR family. They designated the corresponding gene Gitr for 'glucocorticoid-induced TNFR family-related gene.' Like other TNFRs, the predicted Gitr protein contains cysteine-rich repeats in the extracellular domain. In addition, the intracellular domain of Gitr shares significant homology with those of the mouse and human TNFRs 4-1BB (OMIM Ref. No. 602250) and CD27 (OMIM Ref. No. 186711). Nocentini et al. (1997) demonstrated that the Gitr gene is induced in T cells by dexamethasone as well as by other cell-activating stimuli. Gitr expression protected T cells from apoptosis induced by treatment with anti-CD3 (OMIM Ref. No. 186790) antibodies, but not by other apoptotic agents. The authors concluded that Gitr is a new member of the TNFR family involved in the regulation of T cell receptor-mediated cell death. Kwon et al. (1999) isolated cDNAs encoding the human Gitr homolog and the Gitr ligand (OMIM Ref. No. 603898), which they designated AITR (activation-inducible TNFR family member) and AITRL, respectively. These authors reported that the predicted 234- amino acid AITR protein is a type I transmembrane protein with a signal peptide and a single transmembrane region. AITR and mouse Gitr proteins are 55% identical. As with other TNFR family members, when expressed in mammalian cells, AITR mediated NF- kappa-B (see OMIM Ref. No. 164011) activation via TRAF2 (OMIM Ref. No. 601895). TRAF1 (OMIM Ref. No. 601711) and TRAF3 (OMIM Ref. No. 601896) appeared to downregulate AITR-induced NF-kappa-B activation. Northern blot analysis revealed that the 1.25-kb AITR mRNA is expressed in lymph node, peripheral blood leukocytes, and, weakly, in spleen. Expression of AITR, like that of other TNFRs, was upregulated in peripheral mononuclear cells after antigen stimulation. AITRL was constitutively expressed in an endothelial cell line, leading the authors to suggest that AITR and its ligand may be important for interactions between activated T lymphocytes and endothelial cells. Independently, Gurney et al. (1999) identified cDNAs encoding AITR and AITRL, which they called GITR and GITRL, respectively. Coexpression of ligand and receptor protected Jurkat T cells against antigen receptor-induced cell death, suggesting that GITRL and GITR may modulate T lymphocyte survival in peripheral tissues.

Full details of the abovementioned studies are described in the following publications, the disclosure of which are hereby incorporated by reference:

Gurney, A. L.; Marsters, S. A.; Huang, A.; Pitti, R. M.; Mark, M.; Baldwin, D. T.; Gray, A. M.; Dowd, P.; Brush, J.; Heldens, S.; Schow, P.; Goddard, A. D.; Wood, W. I.; Baker, K. P.; Godowski, P. J.; Ashkenazi, A.: Identification of a new member of the tumor necrosis factor family and its receptor, a human ortholog of mouse GITR. Curr. Biol. 9:215-218, 1999; and Kwon, B.; y, K.-Y.; Ni, J.; y, G.-L.; Jang, I.-K.; Kim, Y.-J.; Xing, L.; Liu, D.; Wang, S.-X.; Kwon, B. S.: Identification of a novel activation-inducible protein of the tumor necro.

Further studies establishing the function and utilities of TNFRSF18 are found in John Hopkins OMIM database record ID 603905, and in cited publications listed in Table 5, which are hereby incorporated by reference. Tumor necrosis factor receptor superfamily, member 9 (TNFRSF9, Accession NP_001552.2) is another GAM281 target gene, herein designated TARGET GENE. TNFRSF9 BINDING SITE is a target binding site found in the 3' untranslated region of mRNA encoded by TNFRSF9, corresponding to a target binding site such as BINDING SITE I, BINDING SITE II or BINDING SITE III of FIG. 8. Table 4 illustrates the complementarity of the nucleotide sequences of TNFRSF9 BINDING SITE, designated SEQ ID:13464, to the nucleotide sequence of GAM281 RNA, herein designated GAM RNA, also designated SEQ ID:278.

Another function of GAM281 is therefore inhibition of Tumor necrosis factor receptor superfamily, member 9 (TNFRSF9, Accession NP_001552.2), a gene which inhibits proliferation of activated T lymphocytes. Accordingly, utilities of GAM281 include diagnosis, prevention and treatment of diseases and clinical conditions associated with TNFRSF9.

The function of TNFRSF9 and its association with various diseases and clinical conditions, has been established by previous studies, as described hereinabove with reference to GAM189.1. Tnfaip3 interacting protein 3 (TNIP3, Accession NP_079149.2) is another GAM281 target gene, herein designated TARGET GENE. TNIP3 BINDING SITE is a target binding site found in the 3' untranslated region of mRNA encoded by TNIP3, corresponding to a target binding site such as BINDING SITE I, BINDING SITE II or BINDING SITE III of FIG. 8. Table 4 illustrates the complementarity of the nucleotide sequences of TNIP3 BINDING SITE, designated SEQ ID:15713, to the nucleotide sequence of GAM281 RNA, herein designated GAM RNA, also designated SEQ ID:278.

Another function of GAM281 is therefore inhibition of Tnfaip3 interacting protein 3 (TNIP3, Accession NP_079149.2). Accordingly, utilities of GAM281 include diagnosis, prevention and treatment of diseases and clinical conditions associated with TNIP3.

TOLLIP (Accession NP_061882.2) is another GAM281 target gene, herein designated TARGET GENE. TOLLIP BINDING SITE1 and TOLLIP BINDING SITE2 are target binding sites found in untranslated regions of mRNA encoded by TOLLIP, corresponding to target binding sites such as BINDING SITE I, BINDING SITE II or BINDING SITE III of FIG. 8. Table 4 illustrates the complementarity of the nucleotide sequences of TOLLIP BINDING SITE1 and TOLLIP BINDING SITE2, designated SEQ ID:9557 and SEQ ID:13694 respectively, to the nucleotide sequence of GAM281 RNA, herein designated GAM RNA, also designated SEQ ID:278.

Another function of GAM281 is therefore inhibition of TOLLIP (Accession NP_061882.2). Accordingly, utilities of GAM281 include diagnosis, prevention and treatment of diseases and clinical conditions associated with TOLLIP.

Torsin family 1, member b (torsin b) (TOR1B, Accession NP_055321.1) is another GAM281 target gene, herein designated TARGET GENE. TOR1B BINDING SITE is a target binding site found in the 3' untranslated region of mRNA encoded by TOR1B, corresponding to a target binding site such as BINDING SITE I, BINDING SITE II or BINDING SITE III of FIG. 8. Table 4 illustrates the complementarity of the nucleotide sequences of TOR1B BINDING SITE, designated SEQ ID:14221, to the nucleotide sequence of GAM281 RNA, herein designated GAM RNA, also designated SEQ ID:278.

Another function of GAM281 is therefore inhibition of Torsin family 1, member b (torsin b) (TOR1B, Accession NP_055321.1). Accordingly, utilities of GAM281 include diagnosis, prevention and treatment of diseases and clinical conditions associated with TOR1B.

Tumor protein p53 (li-fraumeni syndrome) (TP53, Accession NP_000537.2) is another GAM281 target gene, herein designated TARGET GENE. TP53 BINDING SITE is a target binding site found in the 3' untranslated region of mRNA encoded by TP53, corresponding to a target binding site such as BINDING SITE I, BINDING SITE II or BINDING SITE III of FIG. 8. Table 4 illustrates the complementarity of the nucleotide sequences of TP53 BINDING SITE, designated SEQ ID:4654, to the nucleotide sequence of GAM281 RNA, herein designated GAM RNA, also designated SEQ ID:278.

Another function of GAM281 is therefore inhibition of Tumor protein p53 (li-fraumeni syndrome) (TP53, Accession NP_000537.2). Accordingly, utilities of GAM281 include diagnosis, prevention and treatment of diseases and clinical conditions associated with TP53.

Thiopurine s-methyltransferase (TPMT, Accession NP_000358.1) is another GAM281 target gene, herein designated TARGET GENE. TPMT BINDING SITE is a target binding site found in the 3' untranslated region of mRNA encoded by TPMT, corresponding to a target binding site such as BINDING SITE I, BINDING SITE II or BINDING SITE III of FIG. 8. Table 4 illustrates the complementarity of the nucleotide sequences of TPMT BINDING SITE, designated SEQ ID:19670, to the nucleotide sequence of GAM281 RNA, herein designated GAM RNA, also designated SEQ ID:278.

Another function of GAM281 is therefore inhibition of Thiopurine s-methyltransferase (TPMT, Accession NP_000358.1), a gene which catalyzes the s-methylation of thiopurine drugs such as 6-mercaptopurine. and therefore may be associated with Thiopurine s-methyltransferase polymorphism. Accordingly, utilities of GAM281 include diagnosis, prevention and treatment of Thiopurine s-methyltransferase polymorphism, and of other diseases and clinical conditions associated with TPMT.

The function of TPMT and its association with various diseases and clinical conditions, has been established by previous studies, as described hereinabove with reference to GAM130.1. Tnf receptor-associated factor 2 (TRAF2, Accession NP_663770.1) is another GAM281 target gene, herein designated TARGET GENE. TRAF2 BINDING SITE is a target binding site found in the 3' untranslated region of multiple transcripts of mRNA encoded by TRAF2, corresponding to a target binding site such as BINDING SITE I, BINDING SITE II or BINDING SITE III of FIG. 8. Table 4 illustrates the complementarity of the nucleotide sequences of TRAF2 BINDING SITE, designated SEQ ID:778, to the nucleotide sequence of GAM281 RNA, herein designated GAM RNA, also designated SEQ ID:278.

Another function of GAM281 is therefore inhibition of Tnf receptor-associated factor 2 (TRAF2, Accession NP_663770.1). Accordingly, utilities of GAM281 include diagnosis, prevention and treatment of diseases and clinical conditions associated with TRAF2.

Tnf receptor-associated factor 2 (TRAF2, Accession NP_066961.2) is another GAM281 target gene, herein designated TARGET GENE. TRAF2 BINDING SITE is a target binding site found in the 3' untranslated region of multiple transcripts of mRNA encoded by TRAF2, corresponding to a target binding site such as BINDING SITE I, BINDING SITE II or BINDING SITE III of FIG. 8. Table 4 illustrates the complementarity of the nucleotide sequences of TRAF2 BINDING SITE, designated SEQ ID:778, to the nucleotide sequence of GAM281 RNA, herein designated GAM RNA, also designated SEQ ID:278.

Another function of GAM281 is therefore inhibition of Tnf receptor-associated factor 2 (TRAF2, Accession NP_066961.2). Accordingly, utilities of GAM281 include diagnosis, prevention and treatment of diseases and clinical conditions associated with TRAF2.

Tnf receptor-associated factor 5 (TRAF5, Accession NP_665702.1) is another GAM281 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:7045, to the nucleotide sequence of GAM281 RNA, herein designated GAM RNA, also designated SEQ ID:278.

Another function of GAM281 is therefore inhibition of Tnf receptor-associated factor 5 (TRAF5, Accession NP_665702.1), a gene which Member of a family of proteins that interact with TNF receptors; binds the lymphotoxin beta receptor (LTBR). Accordingly, utilities of GAM281 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tnf receptor-associated factor 5 (TRAF5, Accession NP_004610.1) is another GAM281 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:7045, to the nucleotide sequence of GAM281 RNA, herein designated GAM RNA, also designated SEQ ID:278.

Another function of GAM281 is therefore inhibition of Tnf receptor-associated factor 5 (TRAF5, Accession NP_004610.1), a gene which Member of a family of proteins that interact with TNF receptors; binds the lymphotoxin beta receptor (LTBR). Accordingly, utilities of GAM281 include diagnosis, prevention and treatment of diseases and clinical conditions associated with TRAF5.

The function of TRAF5 and its association with various diseases and clinical conditions, has been established by previous studies, as described hereinabove with reference to GAM69.2. TRAP150 (Accession NP_005110.1) is another GAM281 target gene, herein designated TARGET GENE. TRAP150 BINDING SITE is a target binding site found in the 3' untranslated region of mRNA encoded by TRAP150, corresponding to a target binding site such as BINDING SITE I, BINDING SITE II or BINDING SITE III of FIG. 8. Table 4 illustrates the complementarity of the nucleotide sequences of TRAP150 BINDING SITE, designated SEQ ID:4929, to the nucleotide sequence of GAM281 RNA, herein designated GAM RNA, also designated SEQ ID:278.

Another function of GAM281 is therefore inhibition of TRAP150 (Accession NP_005110.1). Accordingly, utilities of GAM281 include diagnosis, prevention and treatment of diseases and clinical conditions associated with TRAP150.

Three prime repair exonuclease 1 (TREX1, Accession NP_338598.1) is another GAM281 target gene, herein designated TARGET GENE. TREX1 BINDING SITE is a target binding site found in the 5' untranslated region of multiple transcripts of mRNA encoded by TREX1, corresponding to a target binding site such as BINDING SITE I, BINDING SITE II or BINDING SITE III of FIG. 8. Table 4 illustrates the complementarity of the nucleotide sequences of TREX1 BINDING SITE, designated SEQ ID:8479, to the nucleotide sequence of GAM281 RNA, herein designated GAM RNA, also designated SEQ ID:278.

Another function of GAM281 is therefore inhibition of Three prime repair exonuclease 1 (TREX1, Accession NP_338598.1). Accordingly, utilities of GAM281 include diagnosis, prevention and treatment of diseases and clinical conditions associated with TREX1.

Tripartite motif-containing 16 (TRIM16, Accession NP_006461.2) is another GAM281 target gene, herein designated TARGET GENE. TRIM16 BINDING SITE is a target binding site found in the 3' untranslated region of mRNA encoded by TRIM16, corresponding to a target binding site such as BINDING SITE I, BINDING SITE II or BINDING SITE III of FIG. 8. Table 4 illustrates the complementarity of the nucleotide sequences of TRIM16 BINDING SITE, designated SEQ ID:4601, to the nucleotide sequence of GAM281 RNA, herein designated GAM RNA, also designated SEQ ID:278.

Another function of GAM281 is therefore inhibition of Tripartite motif-containing 16 (TRIM16, Accession NP_006461.2). Accordingly, utilities of GAM281 include diagnosis, prevention and treatment of diseases and clinical conditions associated with TRIM16.

Tripartite motif-containing 5 (TRIM5, Accession NP_149023.1) is another GAM281 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:5879, to the nucleotide sequence of GAM281 RNA, herein designated GAM RNA, also designated SEQ ID:278.

Another function of GAM281 is therefore inhibition of Tripartite motif-containing 5 (TRIM5, Accession NP_149023.1). Accordingly, utilities of GAM281 include diagnosis, prevention and treatment of diseases and clinical conditions associated with TRIM5.

Tripartite motif-containing 6 (TRIM6, Accession NP_477514.1) is another GAM281 target gene, herein designated TARGET GENE. TRIM6 BINDING SITE is a target binding site found in the 3' untranslated region of mRNA encoded by TRIM6, corresponding to a target binding site such as BINDING SITE I, BINDING SITE II or BINDING SITE III of FIG. 8. Table 4 illustrates the complementarity of the nucleotide sequences of TRIM6 BINDING SITE, designated SEQ ID:13572, to the nucleotide sequence of GAM281 RNA, herein designated GAM RNA, also designated SEQ ID:278.

Another function of GAM281 is therefore inhibition of Tripartite motif-containing 6 (TRIM6, Accession NP_477514.1). Accordingly, utilities of GAM281 include diagnosis, prevention and treatment of diseases and clinical conditions associated with TRIM6.

Transient receptor potential cation channel, subfamily m, member 6 (TRPM6, Accession NP_060132.3) is another GAM281 target gene, herein designated TARGET GENE. TRPM6 BINDING SITE is a target binding site found in the 3' untranslated region of mRNA encoded by TRPM6, corresponding to a target binding site such as BINDING SITE I, BINDING SITE II or BINDING SITE III of FIG. 8. Table 4 illustrates the complementarity of the nucleotide sequences of TRPM6 BINDING SITE, designated SEQ ID:18177, to the nucleotide sequence of GAM281 RNA, herein designated GAM RNA, also designated SEQ ID:278.

Another function of GAM281 is therefore inhibition of Transient receptor potential cation channel, subfamily m, member 6 (TRPM6, Accession NP_060132.3), a gene which contains a predicted ion channel domain and a protein kinase domain. and therefore is associated with Hypomagnesemia with secondary hypocalcemia. Accordingly, utilities of GAM281 include diagnosis, prevention and treatment of Hypomagnesemia with secondary hypocalcemia, and of other diseases and clinical conditions associated with TRPM6.

The function of TRPM6 and its association with various diseases and clinical conditions, has been established by previous studies, as described hereinabove with reference to GAM130.1. Transient receptor potential cation channel, subfamily v, member 1 (TRPV1, Accession NP_542436.1) is another GAM281 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:19833 and SEQ ID:16980 respectively, to the nucleotide sequence of GAM281 RNA, herein designated GAM RNA, also designated SEQ ID:278.

Another function of GAM281 is therefore inhibition of Transient receptor potential cation channel, subfamily v, member 1 (TRPV1, Accession NP_542436.1), a gene which functions as a receptor for capsaicin. Accordingly, utilities of GAM281 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_061197.3) is another GAM281 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:16980 and SEQ ID:19833 respectively, to the nucleotide sequence of GAM281 RNA, herein designated GAM RNA, also designated SEQ ID:278.

Another function of GAM281 is therefore inhibition of Transient receptor potential cation channel, subfamily v, member 1 (TRPV1, Accession NP_061197.3), a gene which functions as a receptor for capsaicin. Accordingly, utilities of GAM281 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542435.1) is another GAM281 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:19833 and SEQ ID:16980 respectively, to the nucleotide sequence of GAM281 RNA, herein designated GAM RNA, also designated SEQ ID:278.

Another function of GAM281 is therefore inhibition of Transient receptor potential cation channel, subfamily v, member 1 (TRPV1, Accession NP_542435.1), a gene which functions as a receptor for capsaicin. Accordingly, utilities of GAM281 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542437.1) is another GAM281 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:19833 and SEQ ID:16980 respectively, to the nucleotide sequence of GAM281 RNA, herein designated GAM RNA, also designated SEQ ID:278.

Another function of GAM281 is therefore inhibition of Transient receptor potential cation channel, subfamily v, member 1 (TRPV1, Accession NP_542437.1), a gene which functions as a receptor for capsaicin. Accordingly, utilities of GAM281 include diagnosis, prevention and treatment of diseases and clinical conditions associated with TRPV1.

The function of TRPV1 and its association with various diseases and clinical conditions, has been established by previous studies, as described hereinabove with reference to GAM130.1. Tuberous sclerosis 1 (TSC1, Accession NP_000359.1) is another GAM281 target gene, herein designated TARGET GENE. TSC1 BINDING SITE is a target binding site found in the 3' untranslated region of mRNA encoded by TSC1, corresponding to a target binding site such as BINDING SITE I, BINDING SITE II or BINDING SITE III of FIG. 8. Table 4 illustrates the complementarity of the nucleotide sequences of TSC1 BINDING SITE, designated SEQ ID:15082, to the nucleotide sequence of GAM281 RNA, herein designated GAM RNA, also designated SEQ ID:278.

Another function of GAM281 is therefore inhibition of Tuberous sclerosis 1 (TSC1, Accession NP_000359.1). Accordingly, utilities of GAM281 include diagnosis, prevention and treatment of diseases and clinical conditions associated with TSC1.

Tspy-like (TSPy, Accession XP_166325.1) is another GAM281 target gene, herein designated TARGET GENE. TSPYL BINDING SITE is a target binding site found in the 3' untranslated region of mRNA encoded by TSPy, corresponding to a target binding site such as BINDING SITE I, BINDING SITE II or BINDING SITE III of FIG. 8. Table 4 illustrates the complementarity of the nucleotide sequences of TSPYL BINDING SITE, designated SEQ ID:15042, to the nucleotide sequence of GAM281 RNA, herein designated GAM RNA, also designated SEQ ID:278.

Another function of GAM281 is therefore inhibition of Tspy-like (TSPy, Accession XP_166325.1). Accordingly, utilities of GAM281 include diagnosis, prevention and treatment of diseases and clinical conditions associated with TSPYL.

Tetratricopeptide repeat domain 4 (TTC4, Accession NP_004614.1) is another GAM281 target gene, herein designated TARGET GENE. TTC4 BINDING SITE is a target binding site found in the 3' untranslated region of mRNA encoded by TTC4, corresponding to a target binding site such as BINDING SITE I, BINDING SITE II or BINDING SITE III of FIG. 8. Table 4 illustrates the complementarity of the nucleotide sequences of TTC4 BINDING SITE, designated SEQ ID:9587, to the nucleotide sequence of GAM281 RNA, herein designated GAM RNA, also designated SEQ ID:278.

Another function of GAM281 is therefore inhibition of Tetratricopeptide repeat domain 4 (TTC4, Accession NP_004614.1). Accordingly, utilities of GAM281 include diagnosis, prevention and treatment of diseases and clinical conditions associated with TTC4.

TTY7 (Accession NP_114132.1) is another GAM281 target gene, herein designated TARGET GENE. TTY7 BINDING SITE is a target binding site found in the 5' untranslated region of mRNA encoded by TTY7, corresponding to a target binding site such as BINDING SITE I, BINDING SITE II or BINDING SITE III of FIG. 8. Table 4 illustrates the complementarity of the nucleotide sequences of TTY7 BINDING SITE, designated SEQ ID:1016, to the nucleotide sequence of GAM281 RNA, herein designated GAM RNA, also designated SEQ ID:278.

Another function of GAM281 is therefore inhibition of TTY7 (Accession NP_114132.1). Accordingly, utilities of GAM281 include diagnosis, prevention and treatment of diseases and clinical conditions associated with TTY7.

TU12B1-TY (Accession NP_057659.1) is another GAM281 target gene, herein designated TARGET GENE. TU12B1-TY BINDING SITE1 through TU12B1-TY BINDING SITE3 are target binding sites found in untranslated regions of mRNA encoded by TU12B1-TY, corresponding to target binding sites such as BINDING SITE I, BINDING SITE II or BINDING SITE III of FIG. 8. Table 4 illustrates the complementarity of the nucleotide sequences of TU12B1-TY BINDING SITE1 through TU12B1-TY BINDING SITE3, designated SEQ ID:16036, SEQ ID:15780 and SEQ ID:4256 respectively, to the nucleotide sequence of GAM281 RNA, herein designated GAM RNA, also designated SEQ ID:278.

Another function of GAM281 is therefore inhibition of TU12B1-TY (Accession NP_057659.1). Accordingly, utilities of GAM281 include diagnosis, prevention and treatment of diseases and clinical conditions associated with TU12B1-TY.

TUCAN (Accession NP_055774.1) is another GAM281 target gene, herein designated TARGET GENE. TUCAN BINDING SITE1 through TUCAN BINDING SITE3 are target binding sites found in untranslated regions of mRNA encoded by TUCAN, corresponding to target binding sites such as BINDING SITE I, BINDING SITE II or BINDING SITE III of FIG. 8. Table 4 illustrates the complementarity of the nucleotide sequences of TUCAN BINDING SITE1 through TUCAN BINDING SITE3, designated SEQ ID:9530, SEQ ID:7106 and SEQ ID:13395 respectively, to the nucleotide sequence of GAM281 RNA, herein designated GAM RNA, also designated SEQ ID:278.

Another function of GAM281 is therefore inhibition of TUCAN (Accession NP_055774.1). Accordingly, utilities of GAM281 include diagnosis, prevention and treatment of diseases and clinical conditions associated with TUCAN.

Tuftelin 1 (TUFT1, Accession NP_064512.1) is another GAM281 target gene, herein designated TARGET GENE. TUFT1 BINDING SITE is a target binding site found in the 3' untranslated region of mRNA encoded by TUFT1, corresponding to a target binding site such as BINDING SITE I, BINDING SITE II or BINDING SITE III of FIG. 8. Table 4 illustrates the complementarity of the nucleotide sequences of TUFT1 BINDING SITE, designated SEQ ID:6115, to the nucleotide sequence of GAM281 RNA, herein designated GAM RNA, also designated SEQ ID:278.

Another function of GAM281 is therefore inhibition of Tuftelin 1 (TUFT1, Accession NP_064512.1), a gene which appears to play a role in cytokinesis, cell shape, and specialized functions such as secretion and capping. Accordingly, utilities of GAM281 include diagnosis, prevention and treatment of diseases and clinical conditions associated with TUFT1.

The function of TUFT1 and its association with various diseases and clinical conditions, has been established by previous studies, as described hereinabove with reference to GAM136.1. TXL-2 (Accession NP_835231.1) is another GAM281 target gene, herein designated TARGET GENE. TXL-2 BINDING SITE is a target binding site found in the 5' untranslated region of mRNA encoded by TXL-2, corresponding to a target binding site such as BINDING SITE I, BINDING SITE II or BINDING SITE III of FIG. 8. Table 4 illustrates the complementarity of the nucleotide sequences of TXL-2 BINDING SITE, designated SEQ ID:15381, to the nucleotide sequence of GAM281 RNA, herein designated GAM RNA, also designated SEQ ID:278.

Another function of GAM281 is therefore inhibition of TXL-2 (Accession NP_835231.1). Accordingly, utilities of GAM281 include diagnosis, prevention and treatment of diseases and clinical conditions associated with TXL-2.

Thioredoxin-like 2 (TXNL2, Accession NP_006532.1) is another GAM281 target gene, herein designated TARGET GENE. TXNL2 BINDING SITE is a target binding site found in the 3' untranslated region of mRNA encoded by TXNL2, corresponding to a target binding site such as BINDING SITE I, BINDING SITE II or BINDING SITE III of FIG. 8. Table 4 illustrates the complementarity of the nucleotide sequences of TXNL2 BINDING SITE, designated SEQ ID:9147, to the nucleotide sequence of GAM281 RNA, herein designated GAM RNA, also designated SEQ ID:278.

Another function of GAM281 is therefore inhibition of Thioredoxin-like 2 (TXNL2, Accession NP_006532.1).

Accordingly, utilities of GAM281 include diagnosis, prevention and treatment of diseases and clinical conditions associated with TXNL2.

U1SNRNPBP (Accession NP_851030.1) is another GAM281 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM281 RNA, herein designated GAM RNA, also designated SEQ ID:278.

Another function of GAM281 is therefore inhibition of U1SNRNPBP (Accession NP_851030.1). Accordingly, utilities of GAM281 include diagnosis, prevention and treatment of diseases and clinical conditions associated with U1SNRNPBP.

U1SNRNPBP (Accession NP_851034.1) is another GAM281 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM281 RNA, herein designated GAM RNA, also designated SEQ ID:278.

Another function of GAM281 is therefore inhibition of U1SNRNPBP (Accession NP_851034.1). Accordingly, utilities of GAM281 include diagnosis, prevention and treatment of diseases and clinical conditions associated with U1SNRNPBP.

U1SNRNPBP (Accession NP_008951.1) is another GAM281 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM281 RNA, herein designated GAM RNA, also designated SEQ ID:278.

Another function of GAM281 is therefore inhibition of U1SNRNPBP (Accession NP_008951.1). Accordingly, utilities of GAM281 include diagnosis, prevention and treatment of diseases and clinical conditions associated with U1SNRNPBP.

UCK1 (Accession NP_113620.1) is another GAM281 target gene, herein designated TARGET GENE. UCK1 BINDING SITE is a target binding site found in the 3' untranslated region of mRNA encoded by UCK1, corresponding to a target binding site such as BINDING SITE I, BINDING SITE II or BINDING SITE III of FIG. 8. Table 4 illustrates the complementarity of the nucleotide sequences of UCK1 BINDING SITE, designated SEQ ID:14148, to the nucleotide sequence of GAM281 RNA, herein designated GAM RNA, also designated SEQ ID:278.

Another function of GAM281 is therefore inhibition of UCK1 (Accession NP_113620.1). Accordingly, utilities of GAM281 include diagnosis, prevention and treatment of diseases and clinical conditions associated with UCK1.

Udp-glucose dehydrogenase (UGDH, Accession NP_003350.1) is another GAM281 target gene, herein designated TARGET GENE. UGDH BINDING SITE is a target binding site found in the 3' untranslated region of mRNA encoded by UGDH, corresponding to a target binding site such as BINDING SITE I, BINDING SITE II or BINDING SITE III of FIG. 8. Table 4 illustrates the complementarity of the nucleotide sequences of UGDH BINDING SITE, designated SEQ ID:7909, to the nucleotide sequence of GAM281 RNA, herein designated GAM RNA, also designated SEQ ID:278.

Another function of GAM281 is therefore inhibition of Udp-glucose dehydrogenase (UGDH, Accession NP_003350.1), a gene which is an UDP- glucose dehydrogenase. Accordingly, utilities of GAM281 include diagnosis, prevention and treatment of diseases and clinical conditions associated with UGDH.

The function of UGDH and its association with various diseases and clinical conditions, has been established by previous studies, as described hereinabove with reference to GAM69.2. Udp glycosyltransferase 1 family, polypeptide a1 (UGT1A1, Accession NP_000454.1) is another GAM281 target gene, herein designated TARGET GENE. UGT1A1 BINDING SITE is a target binding site found in the 3' untranslated region of mRNA encoded by UGT1A1, corresponding to a target binding site such as BINDING SITE I, BINDING SITE II or BINDING SITE III of FIG. 8. Table 4 illustrates the complementarity of the nucleotide sequences of UGT1A1 BINDING SITE, designated SEQ ID:10967, to the nucleotide sequence of GAM281 RNA, herein designated GAM RNA, also designated SEQ ID:278.

Another function of GAM281 is therefore inhibition of Udp glycosyltransferase 1 family, polypeptide a1 (UGT1A1, Accession NP_000454.1). Accordingly, utilities of GAM281 include diagnosis, prevention and treatment of diseases and clinical conditions associated with UGT1A1.

Udp glycosyltransferase 1 family, polypeptide a10 (UGT1A10, Accession NP_061948.1) is another GAM281 target gene, herein designated TARGET GENE. UGT1A10 BINDING SITE is a target binding site found in the 3' untranslated region of mRNA encoded by UGT1A10, corresponding to a target binding site such as BINDING SITE I, BINDING SITE II or BINDING SITE III of FIG. 8. Table 4 illustrates the complementarity of the nucleotide sequences of UGT1A10 BINDING SITE, designated SEQ ID:10967, to the nucleotide sequence of GAM281 RNA, herein designated GAM RNA, also designated SEQ ID:278.

Another function of GAM281 is therefore inhibition of Udp glycosyltransferase 1 family, polypeptide a10 (UGT1A10, Accession NP_061948.1). Accordingly, utilities of GAM281 include diagnosis, prevention and treatment of diseases and clinical conditions associated with UGT1A10.

Udp glycosyltransferase 1 family, polypeptide a4 (UGT1A4, Accession NP_009051.1) is another GAM281 target gene, herein designated TARGET GENE. UGT1A4 BINDING SITE is a target binding site found in the 3' untranslated region of mRNA encoded by UGT1A4, corresponding to a target binding site such as BINDING SITE I, BINDING SITE II or BINDING SITE III of FIG. 8. Table 4 illustrates the complementarity of the nucleotide sequences of UGT1A4 BINDING SITE, designated SEQ ID:10967, to the nucleotide sequence of GAM281 RNA, herein designated GAM RNA, also designated SEQ ID:278.

Another function of GAM281 is therefore inhibition of Udp glycosyltransferase 1 family, polypeptide a4 (UGT1A4, Accession NP_009051.1), a gene which is of major importance in the conjugation and subsequent elimination of potentially toxic xenobiotics and endogenous compounds. and therefore may be associated with Gilbert's syndrome, crigler-najjar. Accordingly, utilities of GAM281 include diagnosis, prevention and treatment of Gilbert's syndrome, crigler-najjar, and of other diseases and clinical conditions associated with UGT1A4.

The function of UGT1A4 and its association with various diseases and clinical conditions, has been established by previous studies, as described hereinabove with reference to GAM189.1. Udp glycosyltransferase 1 family, polypeptide a6 (UGT1A6, Accession NP_001063.1) is another GAM281 target gene, herein designated TARGET GENE. UGT1A6 BINDING SITE is a target binding site found in the 3' untranslated region of mRNA encoded by UGT1A6, corresponding to a target binding site such as BINDING SITE I, BINDING SITE II or BINDING SITE III of FIG. 8. Table 4 illustrates the complementarity of the nucleotide sequences of UGT1A6 BINDING SITE, designated SEQ ID:10967, to the nucleotide sequence of GAM281 RNA, herein designated GAM RNA, also designated SEQ ID:278.

Another function of GAM281 is therefore inhibition of Udp glycosyltransferase 1 family, polypeptide a6 (UGT1A6, Accession NP_001063.1). Accordingly, utilities of GAM281 include diagnosis, prevention and treatment of diseases and clinical conditions associated with UGT1A6.

Udp glycosyltransferase 1 family, polypeptide a8 (UGT1A8, Accession NP_061949.3) is another GAM281 target gene, herein designated TARGET GENE. UGT1A8 BINDING SITE is a target binding site found in the 3' untranslated region of mRNA encoded by UGT1A8, corresponding to a target binding site such as BINDING SITE I, BINDING SITE II or BINDING SITE III of FIG. 8. Table 4 illustrates the complementarity of the nucleotide sequences of UGT1A8 BINDING SITE, designated SEQ ID:10967, to the nucleotide sequence of GAM281 RNA, herein designated GAM RNA, also designated SEQ ID:278.

Another function of GAM281 is therefore inhibition of Udp glycosyltransferase 1 family, polypeptide a8 (UGT1A8, Accession NP_061949.3), a gene which is of major importance in the conjugation and subsequent elimination of potentially toxic xenobiotics and endogenous compounds. Accordingly, utilities of GAM281 include diagnosis, prevention and treatment of diseases and clinical conditions associated with UGT1A8.

The function of UGT1A8 and its association with various diseases and clinical conditions, has been established by previous studies, as described hereinabove with reference to GAM189.1. Udp glycosyltransferase 1 family, polypeptide a9 (UGT1A9, Accession NP_066307.1) is another GAM281 target gene, herein designated TARGET GENE. UGT1A9 BINDING SITE is a target binding site found in the 3' untranslated region of mRNA encoded by UGT1A9, corresponding to a target binding site such as BINDING SITE I, BINDING SITE II or BINDING SITE III of FIG. 8. Table 4 illustrates the complementarity of the nucleotide sequences of UGT1A9 BINDING SITE, designated SEQ ID:10967, to the nucleotide sequence of GAM281 RNA, herein designated GAM RNA, also designated SEQ ID:278.

Another function of GAM281 is therefore inhibition of Udp glycosyltransferase 1 family, polypeptide a9 (UGT1A9, Accession NP_066307.1), a gene which is of major importance in the conjugation and subsequent elimination of potentially toxic xenobiotics and endogenous compounds. Accordingly, utilities of GAM281 include diagnosis, prevention and treatment of diseases and clinical conditions associated with UGT1A9.

The function of UGT1A9 and its association with various diseases and clinical conditions, has been established by previous studies, as described hereinabove with reference to GAM189.1. Uridine monophosphate synthetase (orotate phosphoribosyl transferase and orotidine-5'-decarboxylase) (UMPS, Accession NP_000364.1) is another GAM281 target gene, herein designated TARGET GENE. UMPS BINDING SITE is a target binding site found in the 3' untranslated region of mRNA encoded by UMPS, corresponding to a target binding site such as BINDING SITE I, BINDING SITE II or BINDING SITE III of FIG. 8. Table 4 illustrates the complementarity of the nucleotide sequences of UMPS BINDING SITE, designated SEQ ID:2144, to the nucleotide sequence of GAM281 RNA, herein designated GAM RNA, also designated SEQ ID:278.

Another function of GAM281 is therefore inhibition of Uridine monophosphate synthetase (orotate phosphoribosyl transferase and orotidine-5'-decarboxylase) (UMPS, Accession NP_000364.1). Accordingly, utilities of GAM281 include diagnosis, prevention and treatment of diseases and clinical conditions associated with UMPS.

Unc-84 homolog a (c. elegans) (UNC84B, Accession XP_039332.1) is another GAM281 target gene, herein designated TARGET GENE. UNC84B BINDING SITE is a target binding site found in the 3' untranslated region of multiple transcripts of mRNA encoded by UNC84B, corresponding to a target binding site such as BINDING SITE I, BINDING SITE II or BINDING SITE III of FIG. 8. Table 4 illustrates the complementarity of the nucleotide sequences of UNC84B BINDING SITE, designated SEQ ID:13541, to the nucleotide sequence of GAM281 RNA, herein designated GAM RNA, also designated SEQ ID:278.

Another function of GAM281 is therefore inhibition of Unc-84 homolog a (c. elegans) (UNC84B, Accession XP_039332.1). Accordingly, utilities of GAM281 include diagnosis, prevention and treatment of diseases and clinical conditions associated with UNC84B.

Unc-84 homolog a (c. elegans) (UNC84B, Accession NP_056189.1) is another GAM281 target gene, herein designated TARGET GENE. UNC84B BINDING SITE is a target binding site found in the 3' untranslated region of multiple transcripts of mRNA encoded by UNC84B, corresponding to a target binding site such as BINDING SITE I, BINDING SITE II or BINDING SITE III of FIG. 8. Table 4 illustrates the complementarity of the nucleotide sequences of UNC84B BINDING SITE, designated SEQ ID:13541, to the nucleotide sequence of GAM281 RNA, herein designated GAM RNA, also designated SEQ ID:278.

Another function of GAM281 is therefore inhibition of Unc-84 homolog a (c. elegans) (UNC84B, Accession NP_056189.1). Accordingly, utilities of GAM281 include diagnosis, prevention and treatment of diseases and clinical conditions associated with UNC84B.

URG4 (Accession NP_060390.2) is another GAM281 target gene, herein designated TARGET GENE. URG4 BINDING SITE is a target binding site found in the 3' untranslated region of mRNA encoded by URG4, corresponding to a target binding site such as BINDING SITE I, BINDING SITE II or BINDING SITE III of FIG. 8. Table 4 illustrates the complementarity of the nucleotide sequences of URG4 BINDING SITE, designated SEQ ID:6788, to the nucleotide sequence of GAM281 RNA, herein designated GAM RNA, also designated SEQ ID:278.

Another function of GAM281 is therefore inhibition of URG4 (Accession NP_060390.2). Accordingly, utilities of GAM281 include diagnosis, prevention and treatment of diseases and clinical conditions associated with URG4.

Ubiquitin specific protease 22 (USP22, Accession XP_042698.2) is another GAM281 target gene, herein designated TARGET GENE. USP22 BINDING SITE is a target binding site found in the 3' untranslated region of mRNA encoded by USP22, corresponding to a target binding site such as BINDING SITE I, BINDING SITE II or BINDING SITE III of FIG. 8. Table 4 illustrates the complementarity of the nucleotide sequences of USP22 BINDING SITE, designated SEQ ID:11288, to the nucleotide sequence of GAM281 RNA, herein designated GAM RNA, also designated SEQ ID:278.

Another function of GAM281 is therefore inhibition of Ubiquitin specific protease 22 (USP22, Accession XP_042698.2). Accordingly, utilities of GAM281 include diagnosis, prevention and treatment of diseases and clinical conditions associated with USP22.

VDU1 (Accession NP_055832.2) is another GAM281 target gene, herein designated TARGET GENE. VDU1 BINDING SITE is a target binding site found in the 3' untranslated region of mRNA encoded by VDU1, corresponding to a target binding site such as BINDING SITE I, BINDING SITE II or BINDING SITE III of FIG. 8. Table 4 illustrates the complementarity of the nucleotide sequences of VDU1 BINDING SITE, designated SEQ ID:3187, to the nucleotide sequence of GAM281 RNA, herein designated GAM RNA, also designated SEQ ID:278.

Another function of GAM281 is therefore inhibition of VDU1 (Accession NP_055832.2). Accordingly, utilities of GAM281 include diagnosis, prevention and treatment of diseases and clinical conditions associated with VDU1.

Vent-like homeobox 2 (VENTX2, Accession NP_055283.1) is another GAM281 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:19331, to the nucleotide sequence of GAM281 RNA, herein designated GAM RNA, also designated SEQ ID:278.

Another function of GAM281 is therefore inhibition of Vent-like homeobox 2 (VENTX2, Accession NP_055283.1). Accordingly, utilities of GAM281 include diagnosis, prevention and treatment of diseases and clinical conditions associated with VENTX2.

Von hippel-lindau syndrome (VHL, Accession NP_000542.1) is another GAM281 target gene, herein designated TARGET GENE. VHL BINDING SITE1 and VHL BINDING SITE2 are target binding sites found in untranslated regions of mRNA encoded by VHL, corresponding to target binding sites such as BINDING SITE I, BINDING SITE II or BINDING SITE III of FIG. 8. Table 4 illustrates the complementarity of the nucleotide sequences of VHL BINDING SITE1 and VHL BINDING SITE2, designated SEQ ID:3873 and SEQ ID:8786 respectively, to the nucleotide sequence of GAM281 RNA, herein designated GAM RNA, also designated SEQ ID:278.

Another function of GAM281 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM281 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. Vasoactive intestinal peptide receptor 2 (VIPR2, Accession NP_003373.2) is another GAM281 target gene, herein designated TARGET GENE. VIPR2 BINDING SITE is a target binding site found in the 3' untranslated region of mRNA encoded by VIPR2, corresponding to a target binding site such as BINDING SITE I, BINDING SITE II or BINDING SITE III of FIG. 8. Table 4 illustrates the complementarity of the nucleotide sequences of VIPR2 BINDING SITE, designated SEQ ID:7754, to the nucleotide sequence of GAM281 RNA, herein designated GAM RNA, also designated SEQ ID:278.

Another function of GAM281 is therefore inhibition of Vasoactive intestinal peptide receptor 2 (VIPR2, Accession NP_003373.2). Accordingly, utilities of GAM281 include diagnosis, prevention and treatment of diseases and clinical conditions associated with VIPR2.

Vacuolar protein sorting 33a (yeast) (VPS33A, Accession NP_075067.2) is another GAM281 target gene, herein designated TARGET GENE. VPS33A BINDING SITE is a target binding site found in the 3' untranslated region of mRNA encoded by VPS33A, corresponding to a target binding site such as BINDING SITE I, BINDING SITE II or BINDING SITE III of FIG. 8. Table 4 illustrates the complementarity of the nucleotide sequences of VPS33A BINDING SITE, designated SEQ ID:16690, to the nucleotide sequence of GAM281 RNA, herein designated GAM RNA, also designated SEQ ID:278.

Another function of GAM281 is therefore inhibition of Vacuolar protein sorting 33a (yeast) (VPS33A, Accession NP_075067.2). Accordingly, utilities of GAM281 include diagnosis, prevention and treatment of diseases and clinical conditions associated with VPS33A.

Vesicle transport through interaction with t-snares homolog 1a (yeast) (VTI1A, Accession NP_660207.1) is another GAM281 target gene, herein designated TARGET GENE. VTI1A BINDING SITE is a target binding site found in the 3' untranslated region of mRNA encoded by VTI1A, corresponding to a target binding site such as BINDING SITE I, BINDING SITE II or BINDING SITE III of FIG. 8. Table 4 illustrates the complementarity of the nucleotide sequences of VTI1A BINDING SITE, designated SEQ ID:2313, to the nucleotide sequence of GAM281 RNA, herein designated GAM RNA, also designated SEQ ID:278.

Another function of GAM281 is therefore inhibition of Vesicle transport through interaction with t-snares homolog 1a (yeast) (VTI1A, Accession NP_660207.1). Accordingly, utilities of GAM281 include diagnosis, prevention and treatment of diseases and clinical conditions associated with VTI1A.

Williams-beuren syndrome chromosome region 1 (WBSCR1, Accession NP_071496.1) is another GAM281 target gene, herein designated TARGET GENE. WBSCR1 BINDING SITE is a target binding site found in the 3' untranslated region of multiple transcripts of mRNA encoded by WBSCR1, corresponding to a target binding site such as BINDING SITE I, BINDING SITE II or BINDING SITE III of FIG. 8. Table 4 illustrates the complementarity of the nucleotide sequences of WBSCR1 BINDING SITE, designated SEQ ID:11337, to the nucleotide sequence of GAM281 RNA, herein designated GAM RNA, also designated SEQ ID:278.

Another function of GAM281 is therefore inhibition of Williams-beuren syndrome chromosome region 1 (WBSCR1, Accession NP_071496.1), a gene which stimulates protein translation and therefore may be associated with Williams syndrome. Accordingly, utilities of GAM281 include diagnosis, prevention and treatment of Williams syndrome, and of other diseases and clinical conditions associated with WBSCR1.

The function of WBSCR1 and its association with various diseases and clinical conditions, has been established by previous studies, as described hereinabove with reference to GAM47.1. Williams-beuren syndrome chromosome region 1 (WBSCR1, Accession NP_114381.1) is another GAM281 target gene, herein designated TARGET GENE. WBSCR1 BINDING SITE is a target binding site found in the 3' untranslated region of multiple transcripts of mRNA encoded by WBSCR1, corresponding to a target binding site such as BINDING SITE I, BINDING SITE II or BINDING SITE III of FIG. 8. Table 4 illustrates the complementarity of the nucleotide sequences of WBSCR1 BINDING SITE, designated SEQ ID:11337, to the nucleotide sequence of GAM281 RNA, herein designated GAM RNA, also designated SEQ ID:278.

Another function of GAM281 is therefore inhibition of Williams-beuren syndrome chromosome region 1 (WBSCR1, Accession NP_114381.1), a gene which stimulates protein translation and therefore may be associated with Williams syndrome. Accordingly, utilities of GAM281 include diagnosis, prevention and treatment of Williams syndrome, and of other diseases and clinical conditions associated with WBSCR1.

The function of WBSCR1 and its association with various diseases and clinical conditions, has been established by previous studies, as described hereinabove with reference to GAM47.1. Williams beuren syndrome chromosome region 18 (WBSCR18, Accession NP_115693.2) is another GAM281 target gene, herein designated TARGET GENE. WBSCR18 BINDING SITE is a target binding site found in the 3' untranslated region of mRNA encoded by WBSCR18, corresponding to a target binding site such as BINDING SITE I, BINDING SITE II or BINDING SITE III of FIG. 8. Table 4 illustrates the complementarity of the nucleotide sequences of WBSCR18 BINDING SITE, designated SEQ ID:2152, to the nucleotide sequence of GAM281 RNA, herein designated GAM RNA, also designated SEQ ID:278.

Another function of GAM281 is therefore inhibition of Williams beuren syndrome chromosome region 18 (WBSCR18, Accession NP_115693.2). Accordingly, utilities of GAM281 include diagnosis, prevention and treatment of diseases and clinical conditions associated with WBSCR18.

Wolf-hirschhorn syndrome candidate 1 (WHSC1, Accession NP_579889.1) is another GAM281 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:9245, to the nucleotide sequence of GAM281 RNA, herein designated GAM RNA, also designated SEQ ID:278.

Another function of GAM281 is therefore inhibition of Wolf-hirschhorn syndrome candidate 1 (WHSC1, Accession NP_579889.1), a gene which binds covalently to and repairs g/t mismatches. and therefore may be associated with Wolf-hirschhorn syndrome. Accordingly, utilities of GAM281 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wnt1 inducible signaling pathway protein 2 (WISP2, Accession NP_003872.1) is another GAM281 target gene, herein designated TARGET GENE. WISP2 BINDING SITE is a target binding site found in the 3' untranslated region of mRNA encoded by WISP2, corresponding to a target binding site such as BINDING SITE I, BINDING SITE II or BINDING SITE III of FIG. 8. Table 4 illustrates the complementarity of the nucleotide sequences of WISP2 BINDING SITE, designated SEQ ID:6412, to the nucleotide sequence of GAM281 RNA, herein designated GAM RNA, also designated SEQ ID:278.

Another function of GAM281 is therefore inhibition of Wnt1 inducible signaling pathway protein 2 (WISP2, Accession NP_003872.1). Accordingly, utilities of GAM281 include diagnosis, prevention and treatment of diseases and clinical conditions associated with WISP2.

X-ray repair complementing defective repair in chinese hamster cells 2 (XRCC2, Accession NP_005422.1) is another GAM281 target gene, herein designated TARGET GENE. XRCC2 BINDING SITE1 through XRCC2 BINDING SITE3 are target binding sites found in untranslated regions of mRNA encoded by XRCC2, corresponding to target binding sites such as BINDING SITE I, BINDING SITE II or BINDING SITE III of FIG. 8. Table 4 illustrates the complementarity of the nucleotide sequences of XRCC2 BINDING SITE1 through XRCC2 BINDING SITE3, designated SEQ ID:12605, SEQ ID:10148 and SEQ ID:9688 respectively, to the nucleotide sequence of GAM281 RNA, herein designated GAM RNA, also designated SEQ ID:278.

Another function of GAM281 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM281 include diagnosis, prevention and treatment of diseases and clinical conditions associated with XRCC2.

The function of XRCC2 and its association with various diseases and clinical conditions, has been established by previous studies, as described hereinabove with reference to GAM72.1. V-yes-1 yamaguchi sarcoma viral oncogene homolog 1 (YES1, Accession NP_005424.1) is another GAM281 target gene, herein designated TARGET GENE. YES1 BINDING SITE is a target binding site found in the 3' untranslated region of mRNA encoded by YES1, corresponding to a target binding site such as BINDING SITE I, BINDING SITE II or BINDING SITE III of FIG. 8. Table 4 illustrates the complementarity of the nucleotide sequences of YES1 BINDING SITE, designated SEQ ID:16112, to the nucleotide sequence of GAM281 RNA, herein designated GAM RNA, also designated SEQ ID:278.

Another function of GAM281 is therefore inhibition of V-yes-1 yamaguchi sarcoma viral oncogene homolog 1 (YES1, Accession NP_005424.1), a gene which is a putative protein-tyrosine kinase. Accordingly, utilities of GAM281 include diagnosis, prevention and treatment of diseases and clinical conditions associated with YES1.

The function of YES1 and its association with various diseases and clinical conditions, has been established by previous studies, as described hereinabove with reference to GAM30.1. ZAK (Accession NP_598407.1) is another GAM281 target gene, herein designated TARGET GENE. ZAK BINDING SITE is a target binding site found in the 3' untranslated region of multiple transcripts of mRNA encoded by ZAK, corresponding to a target binding site such as BINDING SITE I, BINDING SITE II or BINDING SITE III of FIG. 8. Table 4 illustrates the complementarity of the nucleotide sequences of ZAK BINDING SITE, designated SEQ ID:7294, to the nucleotide sequence of GAM281 RNA, herein designated GAM RNA, also designated SEQ ID:278.

Another function of GAM281 is therefore inhibition of ZAK (Accession NP_598407.1). Accordingly, utilities of GAM281 include diagnosis, prevention and treatment of diseases and clinical conditions associated with ZAK.

ZAP (Accession NP_064504.2) is another GAM281 target gene, herein designated TARGET GENE. ZAP BINDING SITE is a target binding site found in the 3' untranslated region of multiple transcripts of mRNA encoded by ZAP, corresponding to a target binding site such as BINDING SITE I, BINDING SITE II or BINDING SITE III of FIG. 8. Table 4 illustrates the complementarity of the nucleotide sequences of ZAP BINDING SITE, designated SEQ ID:3071, to the nucleotide sequence of GAM281 RNA, herein designated GAM RNA, also designated SEQ ID:278.

Another function of GAM281 is therefore inhibition of ZAP (Accession NP_064504.2). Accordingly, utilities of GAM281 include diagnosis, prevention and treatment of diseases and clinical conditions associated with ZAP.

Z-dna binding protein 1 (ZBP1, Accession NP_110403.1) is another GAM281 target gene, herein designated TARGET GENE. ZBP1 BINDING SITE is a target binding site found in the 3' untranslated region of mRNA encoded by ZBP1, corresponding to a target binding site such as BINDING SITE I, BINDING SITE II or BINDING SITE III of FIG. 8. Table 4 illustrates the complementarity of the nucleotide sequences of ZBP1 BINDING SITE, designated SEQ ID:16276, to the nucleotide sequence of GAM281 RNA, herein designated GAM RNA, also designated SEQ ID:278.

Another function of GAM281 is therefore inhibition of Z-dna binding protein 1 (ZBP1, Accession NP_110403.1). Accordingly, utilities of GAM281 include diagnosis, prevention and treatment of diseases and clinical conditions associated with ZBP1.

ZFP30 (Accession NP_055713.1) is another GAM281 target gene, herein designated TARGET GENE. ZFP30 BINDING SITE is a target binding site found in the 3' untranslated region of mRNA encoded by ZFP30, corresponding to a target binding site such as BINDING SITE I, BINDING SITE II or BINDING SITE III of FIG. 8. Table 4 illustrates the complementarity of the nucleotide sequences of ZFP30 BINDING SITE, designated SEQ ID:9331, to the nucleotide sequence of GAM281 RNA, herein designated GAM RNA, also designated SEQ ID:278.

Another function of GAM281 is therefore inhibition of ZFP30 (Accession NP_055713.1). Accordingly, utilities of GAM281 include diagnosis, prevention and treatment of diseases and clinical conditions associated with ZFP30.

ZFP42 (Accession NP_777560.1) is another GAM281 target gene, herein designated TARGET GENE. ZFP42 BINDING SITE is a target binding site found in the 3' untranslated region of mRNA encoded by ZFP42, corresponding to a target binding site such as BINDING SITE I, BINDING SITE II or BINDING SITE III of FIG. 8. Table 4 illustrates the complementarity of the nucleotide sequences of ZFP42 BINDING SITE, designated SEQ ID:10587, to the nucleotide sequence of GAM281 RNA, herein designated GAM RNA, also designated SEQ ID:278.

Another function of GAM281 is therefore inhibition of ZFP42 (Accession NP_777560.1). Accordingly, utilities of GAM281 include diagnosis, prevention and treatment of diseases and clinical conditions associated with ZFP42.

Zinc finger protein 64 homolog (mouse) (ZFP64, Accession NP_060667.1) is another GAM281 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:15043, to the nucleotide sequence of GAM281 RNA, herein designated GAM RNA, also designated SEQ ID:278.

Another function of GAM281 is therefore inhibition of Zinc finger protein 64 homolog (mouse) (ZFP64, Accession NP_060667.1). Accordingly, utilities of GAM281 include diagnosis, prevention and treatment of diseases and clinical conditions associated with ZFP64.

Zinc finger protein 64 homolog (mouse) (ZFP64, Accession NP_071371.2) is another GAM281 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:15043, to the nucleotide sequence of GAM281 RNA, herein designated GAM RNA, also designated SEQ ID:278.

Another function of GAM281 is therefore inhibition of Zinc finger protein 64 homolog (mouse) (ZFP64, Accession NP_071371.2). Accordingly, utilities of GAM281 include diagnosis, prevention and treatment of diseases and clinical conditions associated with ZFP64.

ZFYVE26 (Accession XP_031077.1) is another GAM281 target gene, herein designated TARGET GENE. ZFYVE26 BINDING SITE is a target binding site found in the 3' untranslated region of mRNA encoded by ZFYVE26, corresponding to a target binding site such as BINDING SITE I, BINDING SITE II or BINDING SITE III of FIG. 8. Table 4 illustrates the complementarity of the nucleotide sequences of ZFYVE26 BINDING SITE, designated SEQ ID:12160, to the nucleotide sequence of GAM281 RNA, herein designated GAM RNA, also designated SEQ ID:278.

Another function of GAM281 is therefore inhibition of ZFYVE26 (Accession XP_031077.1). Accordingly, utilities of GAM281 include diagnosis, prevention and treatment of diseases and clinical conditions associated with ZFYVE26.

ZMYND17 (Accession NP_848546.1) is another GAM281 target gene, herein designated TARGET GENE. ZMYND17 BINDING SITE is a target binding site found in the 3' untranslated region of mRNA encoded by ZMYND17, corresponding to a target binding site such as BINDING SITE I, BINDING SITE II or BINDING SITE III of FIG. 8. Table 4 illustrates the complementarity of the nucleotide sequences of ZMYND17 BINDING SITE, designated SEQ ID:456, to the nucleotide sequence of GAM281 RNA, herein designated GAM RNA, also designated SEQ ID:278.

Another function of GAM281 is therefore inhibition of ZMYND17 (Accession NP_848546.1). Accordingly, utilities of GAM281 include diagnosis, prevention and treatment of diseases and clinical conditions associated with ZMYND17.

Zinc finger protein 253 (ZNF253, Accession NP_066385.1) is another GAM281 target gene, herein designated TARGET GENE. ZNF253 BINDING SITE is a target binding site found in the 3' untranslated region of mRNA encoded by ZNF253, corresponding to a target binding site such as BINDING SITE I, BINDING SITE II or BINDING SITE III of FIG. 8. Table 4 illustrates the complementarity of the nucleotide sequences of ZNF253 BINDING SITE, designated SEQ ID:19746, to the nucleotide sequence of GAM281 RNA, herein designated GAM RNA, also designated SEQ ID:278.

Another function of GAM281 is therefore inhibition of Zinc finger protein 253 (ZNF253, Accession NP_066385.1). Accordingly, utilities of GAM281 include diagnosis, prevention and treatment of diseases and clinical conditions associated with ZNF253.

Zinc finger protein 264 (ZNF264, Accession NP_003408.1) is another GAM281 target gene, herein designated TARGET GENE. ZNF264 BINDING SITE1 and ZNF264 BINDING SITE2 are target binding sites found in untranslated regions of mRNA encoded by ZNF264, corresponding to target binding sites such as BINDING SITE I, BINDING SITE II or BINDING SITE III of FIG. 8. Table 4 illustrates the complementarity of the nucleotide sequences of ZNF264 BINDING SITE1 and ZNF264 BINDING SITE2, designated SEQ ID:3319 and SEQ ID:9147 respectively, to the nucleotide sequence of GAM281 RNA, herein designated GAM RNA, also designated SEQ ID:278.

Another function of GAM281 is therefore inhibition of Zinc finger protein 264 (ZNF264, Accession NP_003408.1). Accordingly, utilities of GAM281 include diagnosis, prevention and treatment of diseases and clinical conditions associated with ZNF264.

Zinc finger protein 273 (ZNF273, Accession XP_088082.1) is another GAM281 target gene, herein designated TARGET GENE. ZNF273 BINDING SITE is a target binding site found in the 3' untranslated region of mRNA encoded by ZNF273, corresponding to a target binding site such as BINDING SITE I, BINDING SITE II or BINDING SITE III of FIG. 8. Table 4 illustrates the complementarity of the nucleotide sequences of ZNF273 BINDING SITE, designated SEQ ID:18868, to the nucleotide sequence of GAM281 RNA, herein designated GAM RNA, also designated SEQ ID:278.

Another function of GAM281 is therefore inhibition of Zinc finger protein 273 (ZNF273, Accession XP_088082.1). Accordingly, utilities of GAM281 include diagnosis, prevention and treatment of diseases and clinical conditions associated with ZNF273.

Zinc finger protein 289, id1 regulated (ZNF289, Accession NP_115765.2) is another GAM281 target gene, herein designated TARGET GENE. ZNF289 BINDING SITE is a target binding site found in the 3' untranslated region of mRNA encoded by ZNF289, corresponding to a target binding site such as BINDING SITE I, BINDING SITE II or BINDING SITE III of FIG. 8. Table 4 illustrates the complementarity of the nucleotide sequences of ZNF289 BINDING SITE, designated SEQ ID:13159, to the nucleotide sequence of GAM281 RNA, herein designated GAM RNA, also designated SEQ ID:278.

Another function of GAM281 is therefore inhibition of Zinc finger protein 289, id1 regulated (ZNF289, Accession NP_115765.2). Accordingly, utilities of GAM281 include diagnosis, prevention and treatment of diseases and clinical conditions associated with ZNF289.

Zinc finger protein 305 (ZNF305, Accession NP_055539.1) is another GAM281 target gene, herein designated TARGET GENE. ZNF305 BINDING SITE is a target binding site found in the 3' untranslated region of mRNA encoded by ZNF305, corresponding to a target binding site such as BINDING SITE I, BINDING SITE II or BINDING SITE III of FIG. 8. Table 4 illustrates the complementarity of the nucleotide sequences of ZNF305 BINDING SITE, designated SEQ ID:18505, to the nucleotide sequence of GAM281 RNA, herein designated GAM RNA, also designated SEQ ID:278.

Another function of GAM281 is therefore inhibition of Zinc finger protein 305 (ZNF305, Accession NP_055539.1). Accordingly, utilities of GAM281 include diagnosis, prevention and treatment of diseases and clinical conditions associated with ZNF305.

Zinc finger protein 334 (ZNF334, Accession NP_060572.2) is another GAM281 target gene, herein designated TARGET GENE. ZNF334 BINDING SITE1 and ZNF334 BINDING SITE2 are target binding sites found in untranslated regions of mRNA encoded by ZNF334, corresponding to target binding sites such as BINDING SITE I, BINDING SITE II or BINDING SITE III of FIG. 8. Table 4 illustrates the complementarity of the nucleotide sequences of ZNF334 BINDING SITE1 and ZNF334 BINDING SITE2, designated SEQ ID:5064 and SEQ ID:9628 respectively, to the nucleotide sequence of GAM281 RNA, herein designated GAM RNA, also designated SEQ ID:278.

Another function of GAM281 is therefore inhibition of Zinc finger protein 334 (ZNF334, Accession NP_060572.2). Accordingly, utilities of GAM281 include diagnosis, prevention and treatment of diseases and clinical conditions associated with ZNF334.

Zinc finger protein 339 (ZNF339, Accession NP_067043.1) is another GAM281 target gene, herein designated TARGET GENE. ZNF339 BINDING SITE is a target binding site found in the 3' untranslated region of mRNA encoded by ZNF339, corresponding to a target binding site such as BINDING SITE I, BINDING SITE II or BINDING SITE III of FIG. 8. Table 4 illustrates the complementarity of the nucleotide sequences of ZNF339 BINDING SITE, designated SEQ ID:1729, to the nucleotide sequence of GAM281 RNA, herein designated GAM RNA, also designated SEQ ID:278.

Another function of GAM281 is therefore inhibition of Zinc finger protein 339 (ZNF339, Accession NP_067043.1). Accordingly, utilities of GAM281 include diagnosis, prevention and treatment of diseases and clinical conditions associated with ZNF339.

Zinc finger protein 345 (ZNF345, Accession NP_003410.1) is another GAM281 target gene, herein designated TARGET GENE. ZNF345 BINDING SITE is a target binding site found in the 3' untranslated region of mRNA encoded by ZNF345, corresponding to a target binding site such as BINDING SITE I, BINDING SITE II or BINDING SITE III of FIG. 8. Table 4 illustrates the complementarity of the nucleotide sequences of ZNF345 BINDING SITE, designated SEQ ID:1011, to the nucleotide sequence of GAM281 RNA, herein designated GAM RNA, also designated SEQ ID:278.

Another function of GAM281 is therefore inhibition of Zinc finger protein 345 (ZNF345, Accession NP_003410.1). Accordingly, utilities of GAM281 include diagnosis, prevention and treatment of diseases and clinical conditions associated with ZNF345.

Zinc finger protein 347 (ZNF347, Accession NP_115973.1) is another GAM281 target gene, herein designated TARGET GENE. ZNF347 BINDING SITE is a target binding site found in the 3' untranslated region of mRNA encoded by ZNF347, corresponding to a target binding site such as BINDING SITE I, BINDING SITE II or BINDING SITE III of FIG. 8. Table 4 illustrates the complementarity of the nucleotide sequences of ZNF347 BINDING SITE, designated SEQ ID:8447, to the nucleotide sequence of GAM281 RNA, herein designated GAM RNA, also designated SEQ ID:278.

Another function of GAM281 is therefore inhibition of Zinc finger protein 347 (ZNF347, Accession NP_115973.1). Accordingly, utilities of GAM281 include diagnosis, prevention and treatment of diseases and clinical conditions associated with ZNF347.

Zinc finger protein 398 (ZNF398, Accession NP_065832.1) is another GAM281 target gene, herein designated TARGET GENE. ZNF398 BINDING SITE is a target binding site found in the 5' untranslated region of multiple transcripts of mRNA encoded by ZNF398, corresponding to a target binding site such as BINDING SITE I, BINDING SITE II or BINDING SITE III of FIG. 8. Table 4 illustrates the complementarity of the nucleotide sequences of ZNF398 BINDING SITE, designated SEQ ID:8530, to the nucleotide sequence of GAM281 RNA, herein designated GAM RNA, also designated SEQ ID:278.

Another function of GAM281 is therefore inhibition of Zinc finger protein 398 (ZNF398, Accession NP_065832.1). Accordingly, utilities of GAM281 include diagnosis, prevention and treatment of diseases and clinical conditions associated with ZNF398.

ZNF431 (Accession XP_086098.2) is another GAM281 target gene, herein designated TARGET GENE. ZNF431 BINDING SITE is a target binding site found in the 3' untranslated region of mRNA encoded by ZNF431, corresponding to a target binding site such as BINDING SITE I, BINDING SITE II or BINDING SITE III of FIG. 8. Table 4 illustrates the complementarity of the nucleotide sequences of ZNF431 BINDING SITE, designated SEQ ID:8477, to the nucleotide sequence of GAM281 RNA, herein designated GAM RNA, also designated SEQ ID:278.

Another function of GAM281 is therefore inhibition of ZNF431 (Accession XP_086098.2). Accordingly, utilities of GAM281 include diagnosis, prevention and treatment of diseases and clinical conditions associated with ZNF431.

ZNF432 (Accession NP_055465.1) is another GAM281 target gene, herein designated TARGET GENE. ZNF432 BINDING SITE is a target binding site found in the 3' untranslated region of mRNA encoded by ZNF432, corresponding to a target binding site such as BINDING SITE I, BINDING SITE II or BINDING SITE III of FIG. 8. Table 4 illustrates the complementarity of the nucleotide sequences of ZNF432 BINDING SITE, designated SEQ ID:5065, to the nucleotide sequence of GAM281 RNA, herein designated GAM RNA, also designated SEQ ID:278.

Another function of GAM281 is therefore inhibition of ZNF432 (Accession NP_055465.1). Accordingly, utilities of GAM281 include diagnosis, prevention and treatment of diseases and clinical conditions associated with ZNF432.

ZNF440 (Accession NP_689570.1) is another GAM281 target gene, herein designated TARGET GENE. ZNF440 BINDING SITE is a target binding site found in the 3' untranslated region of mRNA encoded by ZNF440, corresponding to a target binding site such as BINDING SITE I, BINDING SITE II or BINDING SITE III of FIG. 8. Table 4 illustrates the complementarity of the nucleotide sequences of ZNF440 BINDING SITE, designated SEQ ID:1744, to the nucleotide sequence of GAM281 RNA, herein designated GAM RNA, also designated SEQ ID:278.

Another function of GAM281 is therefore inhibition of ZNF440 (Accession NP_689570.1). Accordingly, utilities of GAM281 include diagnosis, prevention and treatment of diseases and clinical conditions associated with ZNF440.

Zinc finger protein 70 (cos17) (ZNF70, Accession NP_068735.1) is another GAM281 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:17076, to the nucleotide sequence of GAM281 RNA, herein designated GAM RNA, also designated SEQ ID:278.

Another function of GAM281 is therefore inhibition of Zinc finger protein 70 (cos17) (ZNF70, Accession NP_068735.1). Accordingly, utilities of GAM281 include diagnosis, prevention and treatment of diseases and clinical conditions associated with ZNF70.

Zinc finger protein 70 (cos17) (ZNF70, Accession NP_852101.1) is another GAM281 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:17076, to the nucleotide sequence of GAM281 RNA, herein designated GAM RNA, also designated SEQ ID:278.

Another function of GAM281 is therefore inhibition of Zinc finger protein 70 (cos17) (ZNF70, Accession NP_852101.1). Accordingly, utilities of GAM281 include diagnosis, prevention and treatment of diseases and clinical conditions associated with ZNF70.

FIG. 8 further provides a conceptual description of a novel bioinformatically detected of the present invention, referred to here as Genomic Address Messenger 391 (GAM391), which modulates expression of respective target genes thereof, the function and utility of which target genes is known in the art.

GAM391 is a novel bioinformatically detected regulatory, non protein coding, micro RNA (miRNA) gene. The method by which GAM391 was detected is described hereinabove with reference to FIGS. 8-15.

GAM391 gene, herein designated GAM GENE, and GAM391 target gene, herein designated TARGET GENE, are human genes contained in the human genome.

GAM391 gene encodes a GAM391 precursor RNA, herein designated GAM PRECURSOR RNA. Similar to other miRNA genes, and unlike most ordinary genes, GAM391 precursor RNA does not encode a protein. A nucleotide sequence identical or highly similar to the nucleotide sequence of GAM391 precursor RNA is designated SEQ ID:199, and is provided hereinbelow with reference to the sequence listing part.

GAM391 precursor RNA folds onto itself, forming GAM391 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM391 precursor RNA folds onto itself, forming GAM391 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM391 precursor RNA, designated SEQ-ID:199, and a schematic representation of a predicted secondary folding of GAM391 folded precursor RNA are further described with reference to Table 2, hereby incorporated by reference.

An enzyme complex designated DICER COMPLEX, 'dices' the GAM391 folded precursor RNA into GAM391 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM391 RNA is designated SEQ ID:326, and is provided hereinbelow with references to the sequence listing part and Table 3, hereby incorporated by reference.

GAM391 target gene, herein designated TARGET GENE, encodes a corresponding messenger RNA, GAM391 target RNA, herein designated GAM TARGET RNA. GAM391 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM391 RNA, herein designated GAM RNA, binds complementarily to one or more target binding sites located in untranslated regions of GAM391 target RNA, herein designated GAM TARGET RNA. This complementary binding is due to the fact that the nucleotide sequence of GAM391 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM391 RNA may have a different number of target binding sites in untranslated regions of a GAM391 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM391 RNA, herein designated GAM RNA, to target binding sites on GAM391 target RNA, herein designated GAM TARGET RNA, such as BINDING SITE I, BINDING SITE II and BINDING SITE III, inhibits translation of GAM391 target RNA into GAM391 target protein, herein designated GAM TARGET PROTEIN. GAM target protein is therefore outlined by a broken line.

It is appreciated that GAM391 target gene, herein designated TARGET GENE, in fact represents a plurality of GAM391 target genes. The mRNA of each one of this plurality of GAM391 target genes comprises one or more target binding sites, each having a nucleotide sequence which is at least partly complementary to GAM391 RNA, herein designated GAM RNA, and which when bound by GAM391 RNA causes inhibition of translation of respective one or more GAM391 target proteins.

It is further appreciated by one skilled in the art that the mode of translational inhibition illustrated by FIG. 8 with specific reference to translational inhibition exerted by GAM391 gene, herein designated GAM GENE, on one or more GAM391 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM391 correlate with, and may be deduced from, the identity of the target genes which GAM391 binds and inhibits, and the function of these target genes, as elaborated hereinbelow.

5'OY11.1 (Accession NP_542942.1) is a GAM391 target gene, herein designated TARGET GENE. 5'OY11.1 BINDING SITE is a target binding site found in the 5' untranslated region of mRNA encoded by 5'OY11.1, corresponding to a target binding site such as BINDING SITE I, BINDING SITE II or BINDING SITE III of FIG. 8. Table 4 illustrates the complementarity of the nucleotide sequences of 5'OY11.1 BINDING SITE, designated SEQ ID:5923, to the nucleotide sequence of GAM391 RNA, herein designated GAM RNA, also designated SEQ ID:326.

A function of GAM391 is therefore inhibition of 5'OY11.1 (Accession NP_542942.1). Accordingly, utilities of GAM391 include diagnosis, prevention and treatment of diseases and clinical conditions associated with 5'OY11.1.

APBB3 (Accession NP_573422.1) is another GAM391 target gene, herein designated TARGET GENE. APBB3 BINDING SITE is a target binding site found in the 3' untranslated region of multiple transcripts of mRNA encoded by APBB3, corresponding to a target binding site such as BINDING SITE I, BINDING SITE II or BINDING SITE III of FIG. 8. Table 4 illustrates the complementarity of the nucleotide sequences of APBB3 BINDING SITE, designated SEQ ID:539, to the nucleotide sequence of GAM391 RNA, herein designated GAM RNA, also designated SEQ ID:326.

Another function of GAM391 is therefore inhibition of APBB3 (Accession NP_573422.1). Accordingly, utilities of GAM391 include diagnosis, prevention and treatment of diseases and clinical conditions associated with APBB3.

APBB3 (Accession NP_573421.1) is another GAM391 target gene, herein designated TARGET GENE. APBB3 BINDING SITE is a target binding site found in the 3' untranslated region of multiple transcripts of mRNA encoded by APBB3, corresponding to a target binding site such as BINDING SITE I, BINDING SITE II or BINDING SITE III of FIG. 8. Table 4 illustrates the complementarity of the nucleotide sequences of APBB3 BINDING SITE, designated SEQ ID:539, to the nucleotide sequence of GAM391 RNA, herein designated GAM RNA, also designated SEQ ID:326.

Another function of GAM391 is therefore inhibition of APBB3 (Accession NP_573421.1). Accordingly, utilities of GAM391 include diagnosis, prevention and treatment of diseases and clinical conditions associated with APBB3.

Amyloid beta precursor protein (cytoplasmic tail) binding protein 2 (APPBP2, Accession NP_006371.2) is another GAM391 target gene, herein designated TARGET GENE. APPBP2 BINDING SITE is a target binding site found in the 3' untranslated region of mRNA encoded by APPBP2, corresponding to a target binding site such as BINDING SITE I, BINDING SITE II or BINDING SITE III of FIG. 8. Table 4 illustrates the complementarity of the nucleotide sequences of APPBP2 BINDING SITE, designated SEQ ID:1844, to the nucleotide sequence of GAM391 RNA, herein designated GAM RNA, also designated SEQ ID:326.

Another function of GAM391 is therefore inhibition of Amyloid beta precursor protein (cytoplasmic tail) binding protein 2 (APPBP2, Accession NP_006371.2), a gene which interacts with the basolateral sorting signal of amyloid precursor protein. and therefore may be associated with Alzheimer's disease. Accordingly, utilities of GAM391 include diagnosis, prevention and treatment of Alzheimer's disease, and of other diseases and clinical conditions associated with APPBP2.

The function of APPBP2 and its association with various diseases and clinical conditions, has been established by previous studies, as described hereinabove with reference to GAM130.1. Ankyrin repeat and socs box-containing 1 (ASB1, Accession NP_057198.1) is another GAM391 target gene, herein designated TARGET GENE. ASB1 BINDING SITE is a target binding site found in the 3' untranslated region of mRNA encoded by ASB1, corresponding to a target binding site such as BINDING SITE I, BINDING SITE II or BINDING SITE III of FIG. 8. Table 4 illustrates the complementarity of the nucleotide sequences of ASB1 BINDING SITE, designated SEQ ID:11800, to the nucleotide sequence of GAM391 RNA, herein designated GAM RNA, also designated SEQ ID:326.

Another function of GAM391 is therefore inhibition of Ankyrin repeat and socs box-containing 1 (ASB1, Accession NP_057198.1), a gene which May mediate protein-protein interactions. Accordingly, utilities of GAM391 include diagnosis, prevention and treatment of diseases and clinical conditions associated with ASB1.

The function of ASB1 and its association with various diseases and clinical conditions, has been established by previous studies, as described hereinabove with reference to GAM47.1. Atpase, class i, type 8b, member 2 (ATP8B2, Accession XP_290875.1) is another GAM391 target gene, herein designated TARGET GENE. ATP8B2 BINDING SITE is a target binding site found in the 5' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:11976, to the nucleotide sequence of GAM391 RNA, herein designated GAM RNA, also designated SEQ ID:326.

Another function of GAM391 is therefore inhibition of Atpase, class i, type 8b, member 2 (ATP8B2, Accession XP_290875.1). Accordingly, utilities of GAM391 include diagnosis, prevention and treatment of diseases and clinical conditions associated with ATP8B2.

Axotrophin (AXOT, Accession NP_073737.1) is another GAM391 target gene, herein designated TARGET GENE. AXOT BINDING SITE is a target binding site found in the 3' untranslated region of mRNA encoded by AXOT, corresponding to a target binding site such as BINDING SITE I, BINDING SITE II or BINDING SITE III of FIG. 8. Table 4 illustrates the complementarity of the nucleotide sequences of AXOT BINDING SITE, designated SEQ ID:3201, to the nucleotide sequence of GAM391 RNA, herein designated GAM RNA, also designated SEQ ID:326.

Another function of GAM391 is therefore inhibition of Axotrophin (AXOT, Accession NP_073737.1). Accordingly, utilities of GAM391 include diagnosis, prevention and treatment of diseases and clinical conditions associated with AXOT.

C14orf78 (Accession XP_290629.1) is another GAM391 target gene, herein designated TARGET GENE. C14orf78 BINDING SITE is a target binding site found in the 5' untranslated region of mRNA encoded by C14orf78, corresponding to a target binding site such as BINDING SITE I, BINDING SITE II or BINDING SITE III of FIG. 8. Table 4 illustrates the complementarity of the nucleotide sequences of C14orf78 BINDING SITE, designated SEQ ID:3928, to the nucleotide sequence of GAM391 RNA, herein designated GAM RNA, also designated SEQ ID:326.

Another function of GAM391 is therefore inhibition of C14orf78 (Accession XP_290629.1). Accordingly, utilities of GAM391 include diagnosis, prevention and treatment of diseases and clinical conditions associated with C14orf78.

Chromosome 1 open reading frame 24 (C1orf24, Accession NP_071366.1) is another GAM391 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:1181, to the nucleotide sequence of GAM391 RNA, herein designated GAM RNA, also designated SEQ ID:326.

Another function of GAM391 is therefore inhibition of Chromosome 1 open reading frame 24 (C1orf24, Accession NP_071366.1). Accordingly, utilities of GAM391 include diagnosis, prevention and treatment of diseases and clinical conditions associated with C1orf24.

Chromosome 1 open reading frame 24 (C1orf24, Accession NP_443198.1) is another GAM391 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:1181, to the nucleotide sequence of GAM391 RNA, herein designated GAM RNA, also designated SEQ ID:326.

Another function of GAM391 is therefore inhibition of Chromosome 1 open reading frame 24 (C1orf24, Accession NP_443198.1). Accordingly, utilities of GAM391 include diagnosis, prevention and treatment of diseases and clinical conditions associated with C1orf24.

Chromosome 21 open reading frame 82 (C21orf82, Accession NP_715632.1) is another GAM391 target gene, herein designated TARGET GENE. C21orf82 BINDING SITE is a target binding site found in the 3' untranslated region of mRNA encoded by C21orf82, corresponding to a target binding site such as BINDING SITE I, BINDING SITE II or BINDING SITE III of FIG. 8. Table 4 illustrates the complementarity of the nucleotide sequences of C21orf82 BINDING SITE, designated SEQ ID:5611, to the nucleotide sequence of GAM391 RNA, herein designated GAM RNA, also designated SEQ ID:326.

Another function of GAM391 is therefore inhibition of Chromosome 21 open reading frame 82 (C21orf82, Accession NP_715632.1). Accordingly, utilities of GAM391 include diagnosis, prevention and treatment of diseases and clinical conditions associated with C21orf82.

Reserved (C8orf6, Accession NP_663631.1) is another GAM391 target gene, herein designated TARGET GENE. C8orf6 BINDING SITE1 and C8orf6 BINDING SITE2 are target binding sites found in untranslated regions of mRNA encoded by C8orf6, corresponding to target binding sites such as BINDING SITE I, BINDING SITE II or BINDING SITE III of FIG. 8. Table 4 illustrates the complementarity of the nucleotide sequences of C8orf6 BINDING SITE1 and C8orf6 BINDING SITE2, designated SEQ ID:6819 and SEQ ID:16546 respectively, to the nucleotide sequence of GAM391 RNA, herein designated GAM RNA, also designated SEQ ID:326.

Another function of GAM391 is therefore inhibition of Reserved (C8orf6, Accession NP_663631.1). Accordingly, utilities of GAM391 include diagnosis, prevention and treatment of diseases and clinical conditions associated with C8orf6.

Chromosome 9 open reading frame 25 (C9orf25, Accession NP_671735.1) is another GAM391 target gene, herein designated TARGET GENE. C9orf25 BINDING SITE is a target binding site found in the 3' untranslated region of mRNA encoded by C9orf25, corresponding to a target binding site such as BINDING SITE I, BINDING SITE II or BINDING SITE III of FIG. 8. Table 4 illustrates the complementarity of the nucleotide sequences of C9orf25 BINDING SITE, designated SEQ ID:2377, to the nucleotide sequence of GAM391 RNA, herein designated GAM RNA, also designated SEQ ID:326.

Another function of GAM391 is therefore inhibition of Chromosome 9 open reading frame 25 (C9orf25, Accession NP_671735.1). Accordingly, utilities of GAM391 include diagnosis, prevention and treatment of diseases and clinical conditions associated with C9orf25.

Chemokine (c-c motif) receptor 2 (CCR2, Accession NP_000638.1) is another GAM391 target gene, herein designated TARGET GENE. CCR2 BINDING SITE is a target binding site found in the 3' untranslated region of multiple transcripts of mRNA encoded by CCR2, corresponding to a target binding site such as BINDING SITE I, BINDING SITE II or BINDING SITE III of FIG. 8. Table 4 illustrates the complementarity of the nucleotide sequences of CCR2 BINDING SITE, designated SEQ ID:9391, to the nucleotide sequence of GAM391 RNA, herein designated GAM RNA, also designated SEQ ID:326.

Another function of GAM391 is therefore inhibition of Chemokine (c-c motif) receptor 2 (CCR2, Accession NP_000638.1), a gene which binds chemokines and transduces a signal by increasing the intracellular calcium ions level. and therefore may be associated with Hiv-1 infection. Accordingly, utilities of GAM391 include diagnosis, prevention and treatment of Hiv-1 infection, and of other diseases and clinical conditions associated with CCR2.

The function of CCR2 and its association with various diseases and clinical conditions, has been established by previous studies, as described hereinabove with reference to GAM175.1. Cat eye syndrome chromosome region, candidate 6 (CECR6, Accession NP_114096.1) is another GAM391 target gene, herein designated TARGET GENE. CECR6 BINDING SITE is a target binding site found in the 3' untranslated region of mRNA encoded by CECR6, corresponding to a target binding site such as BINDING SITE I, BINDING SITE II or BINDING SITE III of FIG. 8. Table 4 illustrates the complementarity of the nucleotide sequences of CECR6 BINDING SITE, designated SEQ ID:1794, to the nucleotide sequence of GAM391 RNA, herein designated GAM RNA, also designated SEQ ID:326.

Another function of GAM391 is therefore inhibition of Cat eye syndrome chromosome region, candidate 6 (CECR6, Accession NP_114096.1). Accordingly, utilities of GAM391 include diagnosis, prevention and treatment of diseases and clinical conditions associated with CECR6.

Centaurin, delta 2 (CENTD2, Accession NP_056057.1) is another GAM391 target gene, herein designated TARGET GENE. CENTD2 BINDING SITE is a target binding site found in the 5' untranslated region of multiple transcripts of mRNA encoded by CENTD2, corresponding to a target binding site such as BINDING SITE I, BINDING SITE II or BINDING SITE III of FIG. 8. Table 4 illustrates the complementarity of the nucleotide sequences of CENTD2 BINDING SITE, designated SEQ ID:12112, to the nucleotide sequence of GAM391 RNA, herein designated GAM RNA, also designated SEQ ID:326.

Another function of GAM391 is therefore inhibition of Centaurin, delta 2 (CENTD2, Accession NP_056057.1), a gene which involved in cell signaling/communication. Accordingly, utilities of GAM391 include diagnosis, prevention and treatment of diseases and clinical conditions associated with CENTD2.

The function of CENTD2 and its association with various diseases and clinical conditions, has been established by previous studies, as described hereinabove with reference to GAM51.1. CGI-127 (Accession NP_057145.1) is another GAM391 target gene, herein designated TARGET GENE. CGI-127 BINDING SITE is a target binding site found in the 3' untranslated region of mRNA encoded by CGI-127, corresponding to a target binding site such as BINDING SITE I, BINDING SITE II or BINDING SITE III of FIG. 8. Table 4 illustrates the complementarity of the nucleotide sequences of CGI-127 BINDING SITE, designated SEQ ID:16833, to the nucleotide sequence of GAM391 RNA, herein designated GAM RNA, also designated SEQ ID:326.

Another function of GAM391 is therefore inhibition of CGI-127 (Accession NP_057145.1). Accordingly, utilities of GAM391 include diagnosis, prevention and treatment of diseases and clinical conditions associated with CGI-127.

Calcium homeostasis endoplasmic reticulum protein (CHERP, Accession NP_006378.2) is another GAM391 target gene, herein designated TARGET GENE. CHERP BINDING SITE is a target binding site found in the 3' untranslated region of mRNA encoded by CHERP, corresponding to a target binding site such as BINDING SITE I, BINDING SITE II or BINDING SITE III of FIG. 8. Table 4 illustrates the complementarity of the nucleotide sequences of CHERP BINDING SITE, designated SEQ ID:18403, to the nucleotide sequence of GAM391 RNA, herein designated GAM RNA, also designated SEQ ID:326.

Another function of GAM391 is therefore inhibition of Calcium homeostasis endoplasmic reticulum protein (CHERP, Accession NP_006378.2). Accordingly, utilities of GAM391 include diagnosis, prevention and treatment of diseases and clinical conditions associated with CHERP.

Cholinergic receptor, nicotinic, beta polypeptide 4 (CHRNB4, Accession NP_000741.1) is another GAM391 target gene, herein designated TARGET GENE. CHRNB4 BINDING SITE is a target binding site found in the 3' untranslated region of mRNA encoded by CHRNB4, corresponding to a target binding site such as BINDING SITE I, BINDING SITE II or BINDING SITE III of FIG. 8. Table 4 illustrates the complementarity of the nucleotide sequences of CHRNB4 BINDING SITE, designated SEQ ID:20038, to the nucleotide sequence of GAM391 RNA, herein designated GAM RNA, also designated SEQ ID:326.

Another function of GAM391 is therefore inhibition of Cholinergic receptor, nicotinic, beta polypeptide 4 (CHRNB4, Accession NP_000741.1), a gene which mediates fast signal transmission at synapses. Accordingly, utilities of GAM391 include diagnosis, prevention and treatment of diseases and clinical conditions associated with CHRNB4.

The function of CHRNB4 and its association with various diseases and clinical conditions, has been established by previous studies, as described hereinabove with reference to GAM76.1. Dab2 interacting protein (DAB2IP, Accession NP_115941.1) is another GAM391 target gene, herein designated TARGET GENE. DAB2IP BINDING SITE is a target binding site found in the 3' untranslated region of mRNA encoded by DAB2IP, corresponding to a target binding site such as BINDING SITE I, BINDING SITE II or BINDING SITE III of FIG. 8. Table 4 illustrates the complementarity of the nucleotide sequences of DAB2IP BINDING SITE, designated SEQ ID:8058, to the nucleotide sequence of GAM391 RNA, herein designated GAM RNA, also designated SEQ ID:326.

Another function of GAM391 is therefore inhibition of Dab2 interacting protein (DAB2IP, Accession NP_115941.1). Accordingly, utilities of GAM391 include diagnosis, prevention and treatment of diseases and clinical conditions associated with DAB2IP.

Damage-specific dna binding protein 1, 127 kda (DDB1, Accession NP_001914.2) is another GAM391 target gene, herein designated TARGET GENE. DDB1 BINDING SITE is a target binding site found in the 3' untranslated region of mRNA encoded by DDB1, corresponding to a target binding site such as BINDING SITE I, BINDING SITE II or BINDING SITE III of FIG. 8. Table 4 illustrates the complementarity of the nucleotide sequences of DDB1 BINDING SITE, designated SEQ ID:4279, to the nucleotide sequence of GAM391 RNA, herein designated GAM RNA, also designated SEQ ID:326.

Another function of GAM391 is therefore inhibition of Damage-specific dna binding protein 1, 127 kda (DDB1, Accession NP_001914.2). Accordingly, utilities of GAM391 include diagnosis, prevention and treatment of diseases and clinical conditions associated with DDB1.

DKFZP434O047 (Accession NP_056409.1) is another GAM391 target gene, herein designated TARGET GENE. DKFZP434O047 BINDING SITE is a target binding site found in the 5' untranslated region of mRNA encoded by DKFZP434O047, corresponding to a target binding site such as BINDING SITE I, BINDING SITE II or BINDING SITE III of FIG. 8. Table 4 illustrates the complementarity of the nucleotide sequences of DKFZP434O047 BINDING SITE, designated SEQ ID:13168, to the nucleotide sequence of GAM391 RNA, herein designated GAM RNA, also designated SEQ ID:326.

Another function of GAM391 is therefore inhibition of DKFZP434O047 (Accession NP_056409.1). Accordingly, utilities of GAM391 include diagnosis, prevention and treatment of diseases and clinical conditions associated with DKFZP434O047.

DKFZP434P211 (Accession NP_055364.1) is another GAM391 target gene, herein designated TARGET GENE. DKFZP434P211 BINDING SITE is a target binding site found in the 3' untranslated region of mRNA encoded by DKFZP434P211, corresponding to a target binding site such as BINDING SITE I, BINDING SITE II or BINDING SITE III of FIG. 8. Table 4 illustrates the complementarity of the nucleotide sequences of DKFZP434P211 BINDING SITE, designated SEQ ID:7211, to the nucleotide sequence of GAM391 RNA, herein designated GAM RNA, also designated SEQ ID:326.

Another function of GAM391 is therefore inhibition of DKFZP434P211 (Accession NP_055364.1). Accordingly, utilities of GAM391 include diagnosis, prevention and treatment of diseases and clinical conditions associated with DKFZP434P211.

E2f transcription factor 3 (E2F3, Accession NP_001940.1) is another GAM391 target gene, herein designated TARGET GENE. E2F3 BINDING SITE is a target binding site found in the 3' untranslated region of mRNA encoded by E2F3, corresponding to a target binding site such as BINDING SITE I, BINDING SITE II or BINDING SITE III of FIG. 8. Table 4 illustrates the complementarity of the nucleotide sequences of E2F3 BINDING SITE, designated SEQ ID:16925, to the nucleotide sequence of GAM391 RNA, herein designated GAM RNA, also designated SEQ ID:326.

Another function of GAM391 is therefore inhibition of E2f transcription factor 3 (E2F3, Accession NP_001940.1), a gene which binds dna and controls cell-cycle progression from g1 to s phase. and therefore may be associated with Hereditary autosomal dominant myoclonus dystonia. Accordingly, utilities of GAM391 include diagnosis, prevention and treatment of Hereditary autosomal dominant myoclonus dystonia, and of other diseases and clinical conditions associated with E2F3.

The function of E2F3 and its association with various diseases and clinical conditions, has been established by previous studies, as described hereinabove with reference to GAM44.1. Erythrocyte membrane protein band 4.1 like 4b (EPB41L4B, Accession NP_060894.1) is another GAM391 target gene, herein designated TARGET GENE. EPB41L4B BINDING SITE1 and EPB41L4B BINDING SITE2 are target binding sites found in untranslated regions of multiple transcripts of mRNA encoded by EPB41L4B, corresponding to target binding sites such as BINDING SITE I, BINDING SITE II or BINDING SITE III of FIG. 8. Table 4 illustrates the complementarity of the nucleotide sequences of EPB41L4B BINDING SITE1 and EPB41L4B BINDING SITE2, designated SEQ ID:16985 and SEQ ID:5606 respectively, to the nucleotide sequence of GAM391 RNA, herein designated GAM RNA, also designated SEQ ID:326.

Another function of GAM391 is therefore inhibition of Erythrocyte membrane protein band 4.1 like 4b (EPB41L4B, Accession NP_060894.1). Accordingly, utilities of GAM391 include diagnosis, prevention and treatment of diseases and clinical conditions associated with EPB41L4B.

Ellis van creveld syndrome (EVC, Accession NP_714928.1) is another GAM391 target gene, herein designated TARGET GENE. EVC BINDING SITE1 and EVC BINDING SITE2 are target binding sites found in untranslated regions of multiple transcripts of mRNA encoded by EVC, corresponding to target binding sites such as BINDING SITE I, BINDING SITE II or BINDING SITE III of FIG. 8. Table 4 illustrates the complementarity of the nucleotide sequences of EVC BINDING SITE1 and EVC BINDING SITE2, designated SEQ ID:8983 and SEQ ID:672 respectively, to the nucleotide sequence of GAM391 RNA, herein designated GAM RNA, also designated SEQ ID:326.

Another function of GAM391 is therefore inhibition of Ellis van creveld syndrome (EVC, Accession NP_714928.1). Accordingly, utilities of GAM391 include diagnosis, prevention and treatment of diseases and clinical conditions associated with EVC.

FLJ10350 (Accession NP_060537.2) is another GAM391 target gene, herein designated TARGET GENE. FLJ10350 BINDING SITE is a target binding site found in the 3' untranslated region of mRNA encoded by FLJ10350, corresponding to a target binding site such as BINDING SITE I, BINDING SITE II or BINDING SITE III of FIG. 8. Table 4 illustrates the complementarity of the nucleotide sequences of FLJ10350 BINDING SITE, designated SEQ ID:5633, to the nucleotide sequence of GAM391 RNA, herein designated GAM RNA, also designated SEQ ID:326.

Another function of GAM391 is therefore inhibition of FLJ10350 (Accession NP_060537.2). Accordingly, utilities of GAM391 include diagnosis, prevention and treatment of diseases and clinical conditions associated with FLJ10350.

FLJ10702 (Accession NP_060654.1) is another GAM391 target gene, herein designated TARGET GENE. FLJ10702 BINDING SITE is a target binding site found in the 3' untranslated region of mRNA encoded by FLJ10702, corresponding to a target binding site such as BINDING SITE I, BINDING SITE II or BINDING SITE III of FIG. 8. Table 4 illustrates the complementarity of the nucleotide sequences of FLJ10702 BINDING SITE, designated SEQ ID:3052, to the nucleotide sequence of GAM391 RNA, herein designated GAM RNA, also designated SEQ ID:326.

Another function of GAM391 is therefore inhibition of FLJ10702 (Accession NP_060654.1). Accordingly, utilities of GAM391 include diagnosis, prevention and treatment of diseases and clinical conditions associated with FLJ10702.

FLJ12409 (Accession NP_079381.1) is another GAM391 target gene, herein designated TARGET GENE. FLJ12409 BINDING SITE is a target binding site found in the 3' untranslated region of mRNA encoded by FLJ12409, corresponding to a target binding site such as BINDING SITE I, BINDING SITE II or BINDING SITE III of FIG. 8. Table 4 illustrates the complementarity of the nucleotide sequences of FLJ12409 BINDING SITE, designated SEQ ID:3246, to the nucleotide sequence of GAM391 RNA, herein designated GAM RNA, also designated SEQ ID:326.

Another function of GAM391 is therefore inhibition of FLJ12409 (Accession NP_079381.1). Accordingly, utilities of GAM391 include diagnosis, prevention and treatment of diseases and clinical conditions associated with FLJ12409.

FLJ14260 (Accession NP_079303.2) is another GAM391 target gene, herein designated TARGET GENE. FLJ14260 BINDING SITE is a target binding site found in the 5' untranslated region of mRNA encoded by FLJ14260, corresponding to a target binding site such as BINDING SITE I, BINDING SITE II or BINDING SITE III of FIG. 8. Table 4 illustrates the complementarity of the nucleotide sequences of FLJ14260 BINDING SITE, designated SEQ ID:17291, to the nucleotide sequence of GAM391 RNA, herein designated GAM RNA, also designated SEQ ID:326.

Another function of GAM391 is therefore inhibition of FLJ14260 (Accession NP_079303.2). Accordingly, utilities of GAM391 include diagnosis, prevention and treatment of diseases and clinical conditions associated with FLJ14260.

FLJ20275 (Accession NP_060207.1) is another GAM391 target gene, herein designated TARGET GENE. FLJ20275 BINDING SITE is a target binding site found in the 3' untranslated region of mRNA encoded by FLJ20275, corresponding to a target binding site such as BINDING SITE I, BINDING SITE II or BINDING SITE III of FIG. 8. Table 4 illustrates the complementarity of the nucleotide sequences of FLJ20275 BINDING SITE, designated SEQ ID:518, to the nucleotide sequence of GAM391 RNA, herein designated GAM RNA, also designated SEQ ID:326.

Another function of GAM391 is therefore inhibition of FLJ20275 (Accession NP_060207.1). Accordingly, utilities of GAM391 include diagnosis, prevention and treatment of diseases and clinical conditions associated with FLJ20275.

FLJ39005 (Accession NP_848616.1) is another GAM391 target gene, herein designated TARGET GENE. FLJ39005 BINDING SITE is a target binding site found in the 5' untranslated region of mRNA encoded by FLJ39005, corresponding to a target binding site such as BINDING SITE I, BINDING SITE II or BINDING SITE III of FIG. 8. Table 4 illustrates the complementarity of the nucleotide sequences of FLJ39005 BINDING SITE, designated SEQ ID:3674, to the nucleotide sequence of GAM391 RNA, herein designated GAM RNA, also designated SEQ ID:326.

Another function of GAM391 is therefore inhibition of FLJ39005 (Accession NP_848616.1). Accordingly, utilities of GAM391 include diagnosis, prevention and treatment of diseases and clinical conditions associated with FLJ39005.

Forkhead box m1 (FOXM1, Accession NP_068772.1) is another GAM391 target gene, herein designated TARGET GENE. FOXM1 BINDING SITE is a target binding site found in the 3' untranslated region of mRNA encoded by FOXM1, corresponding to a target binding site such as BINDING SITE I, BINDING SITE II or BINDING SITE III of FIG. 8. Table 4 illustrates the complementarity of the nucleotide sequences of FOXM1 BINDING SITE, designated SEQ ID:11174, to the nucleotide sequence of GAM391 RNA, herein designated GAM RNA, also designated SEQ ID:326.

Another function of GAM391 is therefore inhibition of Forkhead box m1 (FOXM1, Accession NP_068772.1), a gene which may play a role in the control of cell proliferation. Accordingly, utilities of GAM391 include diagnosis, prevention and treatment of diseases and clinical conditions associated with FOXM1.

The function of FOXM1 and its association with various diseases and clinical conditions, has been established by previous studies, as described hereinabove with reference to GAM116.1. Forkhead box p1 (FOXP1, Accession NP_116071.2) is another GAM391 target gene, herein designated TARGET GENE. FOXP1 BINDING SITE is a target binding site found in the 5' untranslated region of mRNA encoded by FOXP1, corresponding to a target binding site such as BINDING SITE I, BINDING SITE II or BINDING SITE III of FIG. 8. Table 4 illustrates the complementarity of the nucleotide sequences of FOXP1 BINDING SITE, designated SEQ ID:4841, to the nucleotide sequence of GAM391 RNA, herein designated GAM RNA, also designated SEQ ID:326.

Another function of GAM391 is therefore inhibition of Forkhead box p1 (FOXP1, Accession NP_116071.2). Accordingly, utilities of GAM391 include diagnosis, prevention and treatment of diseases and clinical conditions associated with FOXP1.

GALNACT-2 (Accession NP_061060.3) is another GAM391 target gene, herein designated TARGET GENE. GALNACT-2 BINDING SITE is a target binding site found in the 3' untranslated region of mRNA encoded by GALNACT-2, corresponding to a target binding site such as BINDING SITE I, BINDING SITE II or BINDING SITE III of FIG. 8. Table 4 illustrates the complementarity of the nucleotide sequences of GALNACT-2 BINDING SITE, designated SEQ ID:11066, to the nucleotide sequence of GAM391 RNA, herein designated GAM RNA, also designated SEQ ID:326.

Another function of GAM391 is therefore inhibition of GALNACT-2 (Accession NP_061060.3). Accordingly, utilities of GAM391 include diagnosis, prevention and treatment of diseases and clinical conditions associated with GALNACT-2.

Gata binding protein 2 (GATA2, Accession NP_116027.2) is another GAM391 target gene, herein designated TARGET GENE. GATA2 BINDING SITE is a target binding site found in the 3' untranslated region of mRNA encoded by GATA2, corresponding to a target binding site such as BINDING SITE I, BINDING SITE II or BINDING SITE III of FIG. 8. Table 4 illustrates the complementarity of the nucleotide sequences of GATA2 BINDING SITE, designated SEQ ID:12989, to the nucleotide sequence of GAM391 RNA, herein designated GAM RNA, also designated SEQ ID:326.

Another function of GAM391 is therefore inhibition of Gata binding protein 2 (GATA2, Accession NP_116027.2). Accordingly, utilities of GAM391 include diagnosis, prevention and treatment of diseases and clinical conditions associated with GATA2.

GEMIN7 (Accession NP_078983.1) is another GAM391 target gene, herein designated TARGET GENE. GEMIN7 BINDING SITE is a target binding site found in the 5' untranslated region of mRNA encoded by GEMIN7, corresponding to a target binding site such as BINDING SITE I, BINDING SITE II or BINDING SITE III of FIG. 8. Table 4 illustrates the complementarity of the nucleotide sequences of GEMIN7 BINDING SITE, designated SEQ ID:6579, to the nucleotide sequence of GAM391 RNA, herein designated GAM RNA, also designated SEQ ID:326.

Another function of GAM391 is therefore inhibition of GEMIN7 (Accession NP_078983.1). Accordingly, utilities of GAM391 include diagnosis, prevention and treatment of diseases and clinical conditions associated with GEMIN7.

Glutamate receptor, ionotropic, n-methyl d-aspartate 2b (GRIN2B, Accession NP_000825.1) is another GAM391 target gene, herein designated TARGET GENE. GRIN2B BINDING SITE is a target binding site found in the 3' untranslated region of mRNA encoded by GRIN2B, corresponding to a target binding site such as BINDING SITE I, BINDING SITE II or BINDING SITE III of FIG. 8. Table 4 illustrates the complementarity of the nucleotide sequences of GRIN2B BINDING SITE, designated SEQ ID:14110, to the nucleotide sequence of GAM391 RNA, herein designated GAM RNA, also designated SEQ ID:326.

Another function of GAM391 is therefore inhibition of Glutamate receptor, ionotropic, n-methyl d-aspartate 2b (GRIN2B, Accession NP_000825.1). Accordingly, utilities of GAM391 include diagnosis, prevention and treatment of diseases and clinical conditions associated with GRIN2B.

Hairy/enhancer-of-split related with yrpw motif-like (HEy, Accession NP_055386.1) is another GAM391 target gene, herein designated TARGET GENE. HEYL BINDING SITE is a target binding site found in the 3' untranslated region of mRNA encoded by HEy, corresponding to a target binding site such as BINDING SITE I, BINDING SITE II or BINDING SITE III of FIG. 8. Table 4 illustrates the complementarity of the nucleotide sequences of HEYL BINDING SITE, designated SEQ ID:11546, to the nucleotide sequence of GAM391 RNA, herein designated GAM RNA, also designated SEQ ID:326.

Another function of GAM391 is therefore inhibition of Hairy/enhancer-of-split related with yrpw motif-like (HEy, Accession NP_055386.1). Accordingly, utilities of GAM391 include diagnosis, prevention and treatment of diseases and clinical conditions associated with HEYL.

Indolethylamine n-methyltransferase (INMT, Accession NP_006765.3) is another GAM391 target gene, herein designated TARGET GENE. INMT BINDING SITE is a target binding site found in the 3' untranslated region of mRNA encoded by INMT, corresponding to a target binding site such as BINDING SITE I, BINDING SITE II or BINDING SITE III of FIG. 8. Table 4 illustrates the complementarity of the nucleotide sequences of INMT BINDING SITE, designated SEQ ID:9915, to the nucleotide sequence of GAM391 RNA, herein designated GAM RNA, also designated SEQ ID:326.

Another function of GAM391 is therefore inhibition of Indolethylamine n-methyltransferase (INMT, Accession NP_006765.3). Accordingly, utilities of GAM391 include diagnosis, prevention and treatment of diseases and clinical conditions associated with INMT.

Jumonji homolog (mouse) (JMJ, Accession NP_004964.2) is another GAM391 target gene, herein designated TARGET GENE. JMJ BINDING SITE is a target binding site found in the 3' untranslated region of mRNA encoded by JMJ, corresponding to a target binding site such as BINDING SITE I, BINDING SITE II or BINDING SITE III of FIG. 8. Table 4 illustrates the complementarity of the nucleotide sequences of JMJ BINDING SITE, designated SEQ ID:2359, to the nucleotide sequence of GAM391 RNA, herein designated GAM RNA, also designated SEQ ID:326.

Another function of GAM391 is therefore inhibition of Jumonji homolog (mouse) (JMJ, Accession NP_004964.2), a gene which participates in the negative regulation of cell growth. Accordingly, utilities of GAM391 include diagnosis, prevention and treatment of diseases and clinical conditions associated with JMJ.

The function of JMJ and its association with various diseases and clinical conditions, has been established by previous studies, as described hereinabove with reference to GAM47.1. Potassium voltage-gated channel, shaker-related subfamily, member 5 (KCNA5, Accession NP_002225.2) is another GAM391 target gene, herein designated TARGET GENE. KCNA5 BINDING SITE is a target binding site found in the 3' untranslated region of mRNA encoded by KCNA5, corresponding to a target binding site such as BINDING SITE I, BINDING SITE II or BINDING SITE III of FIG. 8. Table 4 illustrates the complementarity of the nucleotide sequences of KCNA5 BINDING SITE, designated SEQ ID:3000, to the nucleotide sequence of GAM391 RNA, herein designated GAM RNA, also designated SEQ ID:326.

Another function of GAM391 is therefore inhibition of Potassium voltage-gated channel, shaker-related subfamily, member 5 (KCNA5, Accession NP_002225.2), a gene which mediates the voltage-dependent potassium ion permeability of excitable membranes. Accordingly, utilities of GAM391 include diagnosis, prevention and treatment of diseases and clinical conditions associated with KCNA5.

The function of KCNA5 has been established by previous studies. Potassium channels play an important role in the regulation of pancreatic beta cells in response to glucose and the sulfonylurea oral hypoglycemic agents. Philipson et al. (1991) used a rat brain potassium channel probe to screen a human insulinoma cDNA library for clones encoding voltage-gated potassium channels. They isolated a series of cDNA clones which were then used to isolate and sequence a potassium channel gene, designated PCN1. Microinjection of synthetic RNA encoding PCN1 was accomplished in order to determine the electrophysiologic characteristics of the protein. These experiments demonstrated that the PCN1 potassium channel has the electrophysiologic characteristics of delayed-rectifier type channels. Tamkun et al. (1991) isolated human heart cDNAs encoding PCN1, which they called HK2, and HK1 (KCNA4; 176266). They reported that the predicted 605-amino acid HK2 protein shares the characteristics of voltage-gated potassium channels, with 6 potential membrane-spanning domains and a positively charged region in the fourth membrane-spanning domain. Northern blot analysis revealed that HK2 is expressed as a major 2.5- and a minor 1.5-kb mRNA in human atrium and ventricle. By study of somatic cell hybrids, McPherson et al. (1991) mapped a Shaker-related potassium voltage-gated channel gene to chromosome 12. Designated here KCNA5, the gene was identified with probe Kv1 from the rat. By multipoint linkage analysis of 8 CEPH families, Phromchotikul et al. (1993) mapped the KCNA5 gene to 12p and determined its position relative to 4 DNA markers. Using interspecific backcrosses between Mus musculus and Mus spretus, Klocke et al. (1993) mapped the Kcna5 gene to a cluster with the Kcna1 and Kcna6 (OMIM Ref. No. 176257) genes and the mouse homolog of TPI1 (OMIM Ref. No. 190450). Since TPI1 is located on band 12p13 in the human, the 3 K(+)-channel genes was predicted to be in the same band. Curran et al. (1992) mapped the KCNA5 gene, which they erroneously referred to as the KCNA1 gene, to chromosome 12 by use of human-rodent somatic cell panels and narrowed the localization to the distal short arm by in situ hybridization. Linkage studies had shown a maximum lod score of 2.72 at a recombination fraction of 0.05 between KCNA5 and the von Willebrand locus (VWF; 193400). Albrecht et al. (1995) determined that a 300-kb cluster on chromosome 12p13 contains the human KCNA6, KCNA1, and KCNA5 genes arranged in tandem Full details of the abovementioned studies are described in the following publications, the disclosure of which are hereby incorporated by reference:

Albrecht, B.; Weber, K.; Pongs, O.: Characterization of a voltage-activated K- channel gene cluster on human chromosome 12p13. Receptors Channels 3:213-220, 1995; and Curran, M. E.; Landes, G. M.; Keating, M. T.: Molecular cloning, characterization, and genomic localization of a human potassium channel gene. Genomics 12:729-737, 1992.

Further studies establishing the function and utilities of KCNA5 are found in John Hopkins OMIM database record ID 176267, and in cited publications listed in Table 5, which are hereby incorporated by reference. KIAA0276 (Accession XP_048199.1) is another GAM391 target gene, herein designated TARGET GENE. KIAA0276 BINDING SITE is a target binding site found in the 3' untranslated region of mRNA encoded by KIAA0276, corresponding to a target binding site such as BINDING SITE I, BINDING SITE II or BINDING SITE III of FIG. 8. Table 4 illustrates the complementarity of the nucleotide sequences of KIAA0276 BINDING SITE, designated SEQ ID:13253, to the nucleotide sequence of GAM391 RNA, herein designated GAM RNA, also designated SEQ ID:326.

Another function of GAM391 is therefore inhibition of KIAA0276 (Accession XP_048199.1). Accordingly, utilities of GAM391 include diagnosis, prevention and treatment of diseases and clinical conditions associated with KIAA0276.

KIAA0376 (Accession XP_037759.2) is another GAM391 target gene, herein designated TARGET GENE. KIAA0376 BINDING SITE is a target binding site found in the 3' untranslated region of mRNA encoded by KIAA0376, corresponding to a target binding site such as BINDING SITE I, BINDING SITE II or BINDING SITE III of FIG. 8. Table 4 illustrates the complementarity of the nucleotide sequences of KIAA0376 BINDING SITE, designated SEQ ID:5037, to the nucleotide sequence of GAM391 RNA, herein designated GAM RNA, also designated SEQ ID:326.

Another function of GAM391 is therefore inhibition of KIAA0376 (Accession XP_037759.2). Accordingly, utilities of GAM391 include diagnosis, prevention and treatment of diseases and clinical conditions associated with KIAA0376.

KIAA0773 (Accession NP_055505.1) is another GAM391 target gene, herein designated TARGET GENE. KIAA0773 BINDING SITE is a target binding site found in the 3' untranslated region of mRNA encoded by KIAA0773, corresponding to a target binding site such as BINDING SITE I, BINDING SITE II or BINDING SITE III of FIG. 8. Table 4 illustrates the complementarity of the nucleotide sequences of KIAA0773 BINDING SITE, designated SEQ ID:7493, to the nucleotide sequence of GAM391 RNA, herein designated GAM RNA, also designated SEQ ID:326.

Another function of GAM391 is therefore inhibition of KIAA0773 (Accession NP_055505.1). Accordingly, utilities of GAM391 include diagnosis, prevention and treatment of diseases and clinical conditions associated with KIAA0773.

KIAA0937 (Accession XP_166213.1) is another GAM391 target gene, herein designated TARGET GENE. KIAA0937 BINDING SITE is a target binding site found in the 3' untranslated region of mRNA encoded by KIAA0937, corresponding to a target binding site such as BINDING SITE I, BINDING SITE II or BINDING SITE III of FIG. 8. Table 4 illustrates the complementarity of the nucleotide sequences of KIAA0937 BINDING SITE, designated SEQ ID:11761, to the nucleotide sequence of GAM391 RNA, herein designated GAM RNA, also designated SEQ ID:326.

Another function of GAM391 is therefore inhibition of KIAA0937 (Accession XP_166213.1). Accordingly, utilities of GAM391 include diagnosis, prevention and treatment of diseases and clinical conditions associated with KIAA0937.

KIAA1462 (Accession XP_166132.1) is another GAM391 target gene, herein designated TARGET GENE. KIAA1462 BINDING SITE is a target binding site found in the 3' untranslated region of mRNA encoded by KIAA1462, corresponding to a target binding site such as BINDING SITE I, BINDING SITE II or BINDING SITE III of FIG. 8. Table 4 illustrates the complementarity of the nucleotide sequences of KIAA1462 BINDING SITE, designated SEQ ID:16373, to the nucleotide sequence of GAM391 RNA, herein designated GAM RNA, also designated SEQ ID:326.

Another function of GAM391 is therefore inhibition of KIAA1462 (Accession XP_166132.1). Accordingly, utilities of GAM391 include diagnosis, prevention and treatment of diseases and clinical conditions associated with KIAA1462.

KIAA1951 (Accession XP_057401.1) is another GAM391 target gene, herein designated TARGET GENE. KIAA1951 BINDING SITE is a target binding site found in the 3' untranslated region of mRNA encoded by KIAA1951, corresponding to a target binding site such as BINDING SITE I, BINDING SITE II or BINDING SITE III of FIG. 8. Table 4 illustrates the complementarity of the nucleotide sequences of KIAA1951 BINDING SITE, designated SEQ ID:13357, to the nucleotide sequence of GAM391 RNA, herein designated GAM RNA, also designated SEQ ID:326.

Another function of GAM391 is therefore inhibition of KIAA1951 (Accession XP_057401.1). Accordingly, utilities of GAM391 include diagnosis, prevention and treatment of diseases and clinical conditions associated with KIAA1951.

KIFC2 (Accession NP_665697.1) is another GAM391 target gene, herein designated TARGET GENE. KIFC2 BINDING SITE is a target binding site found in the 3' untranslated region of mRNA encoded by KIFC2, corresponding to a target binding site such as BINDING SITE I, BINDING SITE II or BINDING SITE III of FIG. 8. Table 4 illustrates the complementarity of the nucleotide sequences of KIFC2 BINDING SITE, designated SEQ ID:6714, to the nucleotide sequence of GAM391 RNA, herein designated GAM RNA, also designated SEQ ID:326.

Another function of GAM391 is therefore inhibition of KIFC2 (Accession NP_665697.1). Accordingly, utilities of GAM391 include diagnosis, prevention and treatment of diseases and clinical conditions associated with KIFC2.

Kringle containing transmembrane protein 1 (KREMEN1, Accession NP_114434.3) is another GAM391 target gene, herein designated TARGET GENE. KREMEN1 BINDING SITE is a target binding site found in the 3' untranslated region of multiple transcripts of mRNA encoded by KREMEN1, corresponding to a target binding site such as BINDING SITE I, BINDING SITE II or BINDING SITE III of FIG. 8. Table 4 illustrates the complementarity of the nucleotide sequences of KREMEN1 BINDING SITE, designated SEQ ID:7291, to the nucleotide sequence of GAM391 RNA, herein designated GAM RNA, also designated SEQ ID:326.

Another function of GAM391 is therefore inhibition of Kringle containing transmembrane protein 1 (KREMEN1, Accession NP_114434.3). Accordingly, utilities of GAM391 include diagnosis, prevention and treatment of diseases and clinical conditions associated with KREMEN1.

Lim domain binding 3 (LDB3, Accession XP_084376.6) is another GAM391 target gene, herein designated TARGET GENE. LDB3 BINDING SITE is a target binding site found in the 3' untranslated region of mRNA encoded by LDB3, corresponding to a target binding site such as BINDING SITE I, BINDING SITE II or BINDING SITE III of FIG. 8. Table 4 illustrates the complementarity of the nucleotide sequences of LDB3 BINDING SITE, designated SEQ ID:2117, to the nucleotide sequence of GAM391 RNA, herein designated GAM RNA, also designated SEQ ID:326.

Another function of GAM391 is therefore inhibition of Lim domain binding 3 (LDB3, Accession XP_084376.6), a gene which could play a role during mating. Accordingly, utilities of GAM391 include diagnosis, prevention and treatment of diseases and clinical conditions associated with LDB3.

The function of LDB3 and its association with various diseases and clinical conditions, has been established by previous studies, as described hereinabove with reference to GAM40.1. LOC125061 (Accession XP_058889.3) is another GAM391 target gene, herein designated TARGET GENE. LOC125061 BINDING SITE is a target binding site found in the 5' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:19284, to the nucleotide sequence of GAM391 RNA, herein designated GAM RNA, also designated SEQ ID:326.

Another function of GAM391 is therefore inhibition of LOC125061 (Accession XP_058889.3). Accordingly, utilities of GAM391 include diagnosis, prevention and treatment of diseases and clinical conditions associated with LOC125061.

LOC139201 (Accession XP_208439.1) is another GAM391 target gene, herein designated TARGET GENE. LOC139201 BINDING SITE is a target binding site found in the 3' untranslated region of mRNA encoded by LOC139201, corresponding to a target binding site such as BINDING SITE I, BINDING SITE II or BINDING SITE III of FIG. 8. Table 4 illustrates the complementarity of the nucleotide sequences of LOC139201 BINDING SITE, designated SEQ ID:11240, to the nucleotide sequence of GAM391 RNA, herein designated GAM RNA, also designated SEQ ID:326.

Another function of GAM391 is therefore inhibition of LOC139201 (Accession XP_208439.1). Accordingly, utilities of GAM391 include diagnosis, prevention and treatment of diseases and clinical conditions associated with LOC139201.

LOC143310 (Accession XP_084485.1) is another GAM391 target gene, herein designated TARGET GENE. LOC143310 BINDING SITE is a target binding site found in the 3' untranslated region of mRNA encoded by LOC143310, corresponding to a target binding site such as BINDING SITE I, BINDING SITE II or BINDING SITE III of FIG. 8. Table 4 illustrates the complementarity of the nucleotide sequences of LOC143310 BINDING SITE, designated SEQ ID:12539, to the nucleotide sequence of GAM391 RNA, herein designated GAM RNA, also designated SEQ ID:326.

Another function of GAM391 is therefore inhibition of LOC143310 (Accession XP_084485.1). Accordingly, utilities of GAM391 include diagnosis, prevention and treatment of diseases and clinical conditions associated with LOC143310.

LOC145660 (Accession XP_085200.1) is another GAM391 target gene, herein designated TARGET GENE. LOC145660 BINDING SITE is a target binding site found in the 5' untranslated region of mRNA encoded by LOC145660, corresponding to a target binding site such as BINDING SITE I, BINDING SITE II or BINDING SITE III of FIG. 8. Table 4 illustrates the complementarity of the nucleotide sequences of LOC145660 BINDING SITE, designated SEQ ID:10556, to the nucleotide sequence of GAM391 RNA, herein designated GAM RNA, also designated SEQ ID:326.

Another function of GAM391 is therefore inhibition of LOC145660 (Accession XP_085200.1). Accordingly, utilities of GAM391 include diagnosis, prevention and treatment of diseases and clinical conditions associated with LOC145660.

LOC145820 (Accession XP_085246.1) is another GAM391 target gene, herein designated TARGET GENE. LOC145820 BINDING SITE is a target binding site found in the 3' untranslated region of mRNA encoded by LOC145820, corresponding to a target binding site such as BINDING SITE I, BINDING SITE II or BINDING SITE III of FIG. 8. Table 4 illustrates the complementarity of the nucleotide sequences of LOC145820 BINDING SITE, designated SEQ ID:1993, to the nucleotide sequence of GAM391 RNA, herein designated GAM RNA, also designated SEQ ID:326.

Another function of GAM391 is therefore inhibition of LOC145820 (Accession XP_085246.1). Accordingly, utilities of GAM391 include diagnosis, prevention and treatment of diseases and clinical conditions associated with LOC145820.

LOC146243 (Accession XP_096956.1) is another GAM391 target gene, herein designated TARGET GENE. LOC146243 BINDING SITE is a target binding site found in the 3' untranslated region of mRNA encoded by LOC146243, corresponding to a target binding site such as BINDING SITE I, BINDING SITE II or BINDING SITE III of FIG. 8. Table 4 illustrates the complementarity of the nucleotide sequences of LOC146243 BINDING SITE, designated SEQ ID:11896, to the nucleotide sequence of GAM391 RNA, herein designated GAM RNA, also designated SEQ ID:326.

Another function of GAM391 is therefore inhibition of LOC146243 (Accession XP_096956.1). Accordingly, utilities of GAM391 include diagnosis, prevention and treatment of diseases and clinical conditions associated with LOC146243.

LOC146517 (Accession XP_085491.1) is another GAM391 target gene, herein designated TARGET GENE. LOC146517 BINDING SITE is a target binding site found in the 3' untranslated region of mRNA encoded by LOC146517, corresponding to a target binding site such as BINDING SITE I, BINDING SITE II or BINDING SITE III of FIG. 8. Table 4 illustrates the complementarity of the nucleotide sequences of LOC146517 BINDING SITE, designated SEQ ID:18098, to the nucleotide sequence of GAM391 RNA, herein designated GAM RNA, also designated SEQ ID:326.

Another function of GAM391 is therefore inhibition of LOC146517 (Accession XP_085491.1). Accordingly, utilities of GAM391 include diagnosis, prevention and treatment of diseases and clinical conditions associated with LOC146517.

LOC148709 (Accession XP_086281.1) is another GAM391 target gene, herein designated TARGET GENE. LOC148709 BINDING SITE is a target binding site found in the 5' untranslated region of mRNA encoded by LOC148709, corresponding to a target binding site such as BINDING SITE I, BINDING SITE II or BINDING SITE III of FIG. 8. Table 4 illustrates the complementarity of the nucleotide sequences of LOC148709 BINDING SITE, designated SEQ ID:17147, to the nucleotide sequence of GAM391 RNA, herein designated GAM RNA, also designated SEQ ID:326.

Another function of GAM391 is therefore inhibition of LOC148709 (Accession XP_086281.1). Accordingly, utilities of GAM391 include diagnosis, prevention and treatment of diseases and clinical conditions associated with LOC148709.

LOC150174 (Accession XP_086802.2) is another GAM391 target gene, herein designated TARGET GENE. LOC150174 BINDING SITE is a target binding site found in the 3' untranslated region of mRNA encoded by LOC150174, corresponding to a target binding site such as BINDING SITE I, BINDING SITE II or BINDING SITE III of FIG. 8. Table 4 illustrates the complementarity of the nucleotide sequences of LOC150174 BINDING SITE, designated SEQ ID:7211, to the nucleotide sequence of GAM391 RNA, herein designated GAM RNA, also designated SEQ ID:326.

Another function of GAM391 is therefore inhibition of LOC150174 (Accession XP_086802.2). Accordingly, utilities of GAM391 include diagnosis, prevention and treatment of diseases and clinical conditions associated with LOC150174.

LOC150213 (Accession XP_059324.1) is another GAM391 target gene, herein designated TARGET GENE. LOC150213 BINDING SITE is a target binding site found in the 3' untranslated region of mRNA encoded by LOC150213, corresponding to a target binding site such as BINDING SITE I, BINDING SITE II or BINDING SITE III of FIG. 8. Table 4 illustrates the complementarity of the nucleotide sequences of LOC150213 BINDING SITE, designated SEQ ID:7211, to the nucleotide sequence of GAM391 RNA, herein designated GAM RNA, also designated SEQ ID:326.

Another function of GAM391 is therefore inhibition of LOC150213 (Accession XP_059324.1). Accordingly, utilities of GAM391 include diagnosis, prevention and treatment of diseases and clinical conditions associated with LOC150213.

LOC151068 (Accession XP_098000.1) is another GAM391 target gene, herein designated TARGET GENE. LOC151068 BINDING SITE is a target binding site found in the 3' untranslated region of mRNA encoded by LOC151068, corresponding to a target binding site such as BINDING SITE I, BINDING SITE II or BINDING SITE III of FIG. 8. Table 4 illustrates the complementarity of the nucleotide sequences of LOC151068 BINDING SITE, designated SEQ ID:6116, to the nucleotide sequence of GAM391 RNA, herein designated GAM RNA, also designated SEQ ID:326.

Another function of GAM391 is therefore inhibition of LOC151068 (Accession XP_098000.1). Accordingly, utilities of GAM391 include diagnosis, prevention and treatment of diseases and clinical conditions associated with LOC151068.

LOC151124 (Accession XP_098006.1) is another GAM391 target gene, herein designated TARGET GENE. LOC151124 BINDING SITE is a target binding site found in the 5' untranslated region of mRNA encoded by LOC151124, corresponding to a target binding site such as BINDING SITE I, BINDING SITE II or BINDING SITE III of FIG. 8. Table 4 illustrates the complementarity of the nucleotide sequences of LOC151124 BINDING SITE, designated SEQ ID:6464, to the nucleotide sequence of GAM391 RNA, herein designated GAM RNA, also designated SEQ ID:326.

Another function of GAM391 is therefore inhibition of LOC151124 (Accession XP_098006.1). Accordingly, utilities of GAM391 include diagnosis, prevention and treatment of diseases and clinical conditions associated with LOC151124.

LOC151877 (Accession XP_098132.1) is another GAM391 target gene, herein designated TARGET GENE. LOC151877 BINDING SITE is a target binding site found in the 3' untranslated region of mRNA encoded by LOC151877, corresponding to a target binding site such as BINDING SITE I, BINDING SITE II or BINDING SITE III of FIG. 8. Table 4 illustrates the complementarity of the nucleotide sequences of LOC151877 BINDING SITE, designated SEQ ID:9078, to the nucleotide sequence of GAM391 RNA, herein designated GAM RNA, also designated SEQ ID:326.

Another function of GAM391 is therefore inhibition of LOC151877 (Accession XP_098132.1). Accordingly, utilities of GAM391 include diagnosis, prevention and treatment of diseases and clinical conditions associated with LOC151877.

LOC157531 (Accession XP_212210.1) is another GAM391 target gene, herein designated TARGET GENE. LOC157531 BINDING SITE is a target binding site found in the 5' untranslated region of multiple transcripts of mRNA encoded by LOC157531, corresponding to a target binding site such as BINDING SITE I, BINDING SITE II or BINDING SITE III of FIG. 8. Table 4 illustrates the complementarity of the nucleotide sequences of LOC157531 BINDING SITE, designated SEQ ID:9551, to the nucleotide sequence of GAM391 RNA, herein designated GAM RNA, also designated SEQ ID:326.

Another function of GAM391 is therefore inhibition of LOC157531 (Accession XP_212210.1). Accordingly, utilities of GAM391 include diagnosis, prevention and treatment of diseases and clinical conditions associated with LOC157531.

LOC196988 (Accession XP_113795.1) is another GAM391 target gene, herein designated TARGET GENE. LOC196988 BINDING SITE is a target binding site found in the 5' untranslated region of mRNA encoded by LOC196988, corresponding to a target binding site such as BINDING SITE I, BINDING SITE II or BINDING SITE III of FIG. 8. Table 4 illustrates the complementarity of the nucleotide sequences of LOC196988 BINDING SITE, designated SEQ ID:19127, to the nucleotide sequence of GAM391 RNA, herein designated GAM RNA, also designated SEQ ID:326.

Another function of GAM391 is therefore inhibition of LOC196988 (Accession XP_113795.1). Accordingly, utilities of GAM391 include diagnosis, prevention and treatment of diseases and clinical conditions associated with LOC196988.

LOC199718 (Accession XP_113998.1) is another GAM391 target gene, herein designated TARGET GENE. LOC199718 BINDING SITE is a target binding site found in the 5' untranslated region of mRNA encoded by LOC199718, corresponding to a target binding site such as BINDING SITE I, BINDING SITE II or BINDING SITE III of FIG. 8. Table 4 illustrates the complementarity of the nucleotide sequences of LOC199718 BINDING SITE, designated SEQ ID:10043, to the nucleotide sequence of GAM391 RNA, herein designated GAM RNA, also designated SEQ ID:326.

Another function of GAM391 is therefore inhibition of LOC199718 (Accession XP_113998.1). Accordingly, utilities of GAM391 include diagnosis, prevention and treatment of diseases and clinical conditions associated with LOC199718.

LOC200225 (Accession XP_117206.2) is another GAM391 target gene, herein designated TARGET GENE. LOC200225 BINDING SITE is a target binding site found in the 3' untranslated region of mRNA encoded by LOC200225, corresponding to a target binding site such as BINDING SITE I, BINDING SITE II or BINDING SITE III of FIG. 8. Table 4 illustrates the complementarity of the nucleotide sequences of LOC200225 BINDING SITE, designated SEQ ID:12207, to the nucleotide sequence of GAM391 RNA, herein designated GAM RNA, also designated SEQ ID:326.

Another function of GAM391 is therefore inhibition of LOC200225 (Accession XP_117206.2). Accordingly, utilities of GAM391 include diagnosis, prevention and treatment of diseases and clinical conditions associated with LOC200225.

LOC221922 (Accession XP_166555.2) is another GAM391 target gene, herein designated TARGET GENE. LOC221922 BINDING SITE is a target binding site found in the 5' untranslated region of mRNA encoded by LOC221922, corresponding to a target binding site such as BINDING SITE I, BINDING SITE II or BINDING SITE III of FIG. 8. Table 4 illustrates the complementarity of the nucleotide sequences of LOC221922 BINDING SITE, designated SEQ ID:14906, to the nucleotide sequence of GAM391 RNA, herein designated GAM RNA, also designated SEQ ID:326.

Another function of GAM391 is therefore inhibition of LOC221922 (Accession XP_166555.2). Accordingly, utilities of GAM391 include diagnosis, prevention and treatment of diseases and clinical conditions associated with LOC221922.

LOC254099 (Accession XP_173023.1) is another GAM391 target gene, herein designated TARGET GENE. LOC254099 BINDING SITE is a target binding site found in the 3' untranslated region of mRNA encoded by LOC254099, corresponding to a target binding site such as BINDING SITE I, BINDING SITE II or BINDING SITE III of FIG. 8. Table 4 illustrates the complementarity of the nucleotide sequences of LOC254099 BINDING SITE, designated SEQ ID:1936, to the nucleotide sequence of GAM391 RNA, herein designated GAM RNA, also designated SEQ ID:326.

Another function of GAM391 is therefore inhibition of LOC254099 (Accession XP_173023.1). Accordingly, utilities of GAM391 include diagnosis, prevention and treatment of diseases and clinical conditions associated with LOC254099.

LOC283030 (Accession XP_210858.1) is another GAM391 target gene, herein designated TARGET GENE. LOC283030 BINDING SITE is a target binding site found in the 3' untranslated region of mRNA encoded by LOC283030, corresponding to a target binding site such as BINDING SITE I, BINDING SITE II or BINDING SITE III of FIG. 8. Table 4 illustrates the complementarity of the nucleotide sequences of LOC283030 BINDING SITE, designated SEQ ID:19606, to the nucleotide sequence of GAM391 RNA, herein designated GAM RNA, also designated SEQ ID:326.

Another function of GAM391 is therefore inhibition of LOC283030 (Accession XP_210858.1). Accordingly, utilities of GAM391 include diagnosis, prevention and treatment of diseases and clinical conditions associated with LOC283030.

LOC283049 (Accession XP_210868.1) is another GAM391 target gene, herein designated TARGET GENE. LOC283049 BINDING SITE is a target binding site found in the 3' untranslated region of mRNA encoded by LOC283049, corresponding to a target binding site such as BINDING SITE I, BINDING SITE II or BINDING SITE III of FIG. 8. Table 4 illustrates the complementarity of the nucleotide sequences of LOC283049 BINDING SITE, designated SEQ ID:7277, to the nucleotide sequence of GAM391 RNA, herein designated GAM RNA, also designated SEQ ID:326.

Another function of GAM391 is therefore inhibition of LOC283049 (Accession XP_210868.1). Accordingly, utilities of GAM391 include diagnosis, prevention and treatment of diseases and clinical conditions associated with LOC283049.

LOC283530 (Accession XP_211079.1) is another GAM391 target gene, herein designated TARGET GENE. LOC283530 BINDING SITE is a target binding site found in the 5' untranslated region of mRNA encoded by LOC283530, corresponding to a target binding site such as BINDING SITE I, BINDING SITE II or BINDING SITE III of FIG. 8. Table 4 illustrates the complementarity of the nucleotide sequences of LOC283530 BINDING SITE, designated SEQ ID:9689, to the nucleotide sequence of GAM391 RNA, herein designated GAM RNA, also designated SEQ ID:326.

Another function of GAM391 is therefore inhibition of LOC283530 (Accession XP_211079.1). Accordingly, utilities of GAM391 include diagnosis, prevention and treatment of diseases and clinical conditions associated with LOC283530.

LOC283624 (Accession XP_211126.1) is another GAM391 target gene, herein designated TARGET GENE. LOC283624 BINDING SITE is a target binding site found in the 5' untranslated region of mRNA encoded by LOC283624, corresponding to a target binding site such as BINDING SITE I, BINDING SITE II or BINDING SITE III of FIG. 8. Table 4 illustrates the complementarity of the nucleotide sequences of LOC283624 BINDING SITE, designated SEQ ID:480, to the nucleotide sequence of GAM391 RNA, herein designated GAM RNA, also designated SEQ ID:326.

Another function of GAM391 is therefore inhibition of LOC283624 (Accession XP_211126.1). Accordingly, utilities of GAM391 include diagnosis, prevention and treatment of diseases and clinical conditions associated with LOC283624.

LOC284167 (Accession XP_208171.1) is another GAM391 target gene, herein designated TARGET GENE. LOC284167 BINDING SITE is a target binding site found in the 5' untranslated region of mRNA encoded by LOC284167, corresponding to a target binding site such as BINDING SITE I, BINDING SITE II or BINDING SITE III of FIG. 8. Table 4 illustrates the complementarity of the nucleotide sequences of LOC284167 BINDING SITE, designated SEQ ID:6945, to the nucleotide sequence of GAM391 RNA, herein designated GAM RNA, also designated SEQ ID:326.

Another function of GAM391 is therefore inhibition of LOC284167 (Accession XP_208171.1). Accordingly, utilities of GAM391 include diagnosis, prevention and treatment of diseases and clinical conditions associated with LOC284167.

LOC284313 (Accession XP_209116.1) is another GAM391 target gene, herein designated TARGET GENE. LOC284313 BINDING SITE is a target binding site found in the 5' untranslated region of mRNA encoded by LOC284313, corresponding to a target binding site such as BINDING SITE I, BINDING SITE II or BINDING SITE III of FIG. 8. Table 4 illustrates the complementarity of the nucleotide sequences of LOC284313 BINDING SITE, designated SEQ ID:3674, to the nucleotide sequence of GAM391 RNA, herein designated GAM RNA, also designated SEQ ID:326.

Another function of GAM391 is therefore inhibition of LOC284313 (Accession XP_209116.1). Accordingly, utilities of GAM391 include diagnosis, prevention and treatment of diseases and clinical conditions associated with LOC284313.

LOC284591 (Accession XP_211529.1) is another GAM391 target gene, herein designated TARGET GENE. LOC284591 BINDING SITE is a target binding site found in the 3' untranslated region of mRNA encoded by LOC284591, corresponding to a target binding site such as BINDING SITE I, BINDING SITE II or BINDING SITE III of FIG. 8. Table 4 illustrates the complementarity of the nucleotide sequences of LOC284591 BINDING SITE, designated SEQ ID:19633, to the nucleotide sequence of GAM391 RNA, herein designated GAM RNA, also designated SEQ ID:326.

Another function of GAM391 is therefore inhibition of LOC284591 (Accession XP_211529.1). Accordingly, utilities of GAM391 include diagnosis, prevention and treatment of diseases and clinical conditions associated with LOC284591.

LOC284791 (Accession XP_211633.1) is another GAM391 target gene, herein designated TARGET GENE. LOC284791 BINDING SITE is a target binding site found in the 5' untranslated region of mRNA encoded by LOC284791, corresponding to a target binding site such as BINDING SITE I, BINDING SITE II or BINDING SITE III of FIG. 8. Table 4 illustrates the complementarity of the nucleotide sequences of LOC284791 BINDING SITE, designated SEQ ID:11856, to the nucleotide sequence of GAM391 RNA, herein designated GAM RNA, also designated SEQ ID:326.

Another function of GAM391 is therefore inhibition of LOC284791 (Accession XP_211633.1). Accordingly, utilities of GAM391 include diagnosis, prevention and treatment of diseases and clinical conditions associated with LOC284791.

LOC285043 (Accession XP_211742.1) is another GAM391 target gene, herein designated TARGET GENE. LOC285043 BINDING SITE is a target binding site found in the 3' untranslated region of mRNA encoded by LOC285043, corresponding to a target binding site such as BINDING SITE I, BINDING SITE II or BINDING SITE III of FIG. 8. Table 4 illustrates the complementarity of the nucleotide sequences of LOC285043 BINDING SITE, designated SEQ ID:1586, to the nucleotide sequence of GAM391 RNA, herein designated GAM RNA, also designated SEQ ID:326.

Another function of GAM391 is therefore inhibition of LOC285043 (Accession XP_211742.1). Accordingly, utilities of GAM391 include diagnosis, prevention and treatment of diseases and clinical conditions associated with LOC285043.

LOC285151 (Accession XP_211782.1) is another GAM391 target gene, herein designated TARGET GENE. LOC285151 BINDING SITE is a target binding site found in the 5' untranslated region of mRNA encoded by LOC285151, corresponding to a target binding site such as BINDING SITE I, BINDING SITE II or BINDING SITE III of FIG. 8. Table 4 illustrates the complementarity of the nucleotide sequences of LOC285151 BINDING SITE, designated SEQ ID:9288, to the nucleotide sequence of GAM391 RNA, herein designated GAM RNA, also designated SEQ ID:326.

Another function of GAM391 is therefore inhibition of LOC285151 (Accession XP_211782.1). Accordingly, utilities of GAM391 include diagnosis, prevention and treatment of diseases and clinical conditions associated with LOC285151.

LOC285452 (Accession XP_209615.1) is another GAM391 target gene, herein designated TARGET GENE. LOC285452 BINDING SITE is a target binding site found in the 3' untranslated region of mRNA encoded by LOC285452, corresponding to a target binding site such as BINDING SITE I, BINDING SITE II or BINDING SITE III of FIG. 8. Table 4 illustrates the complementarity of the nucleotide sequences of LOC285452 BINDING SITE, designated SEQ ID:14330, to the nucleotide sequence of GAM391 RNA, herein designated GAM RNA, also designated SEQ ID:326.

Another function of GAM391 is therefore inhibition of LOC285452 (Accession XP_209615.1). Accordingly, utilities of GAM391 include diagnosis, prevention and treatment of diseases and clinical conditions associated with LOC285452.

LOC285687 (Accession XP_211985.1) is another GAM391 target gene, herein designated TARGET GENE. LOC285687 BINDING SITE is a target binding site found in the 5' untranslated region of mRNA encoded by LOC285687, corresponding to a target binding site such as BINDING SITE I, BINDING SITE II or BINDING SITE III of FIG. 8. Table 4 illustrates the complementarity of the nucleotide sequences of LOC285687 BINDING SITE, designated SEQ ID:15156, to the nucleotide sequence of GAM391 RNA, herein designated GAM RNA, also designated SEQ ID:326.

Another function of GAM391 is therefore inhibition of LOC285687 (Accession XP_211985.1). Accordingly, utilities of GAM391 include diagnosis, prevention and treatment of diseases and clinical conditions associated with LOC285687.

LOC285996 (Accession XP_212128.1) is another GAM391 target gene, herein designated TARGET GENE. LOC285996 BINDING SITE is a target binding site found in the 3' untranslated region of mRNA encoded by LOC285996, corresponding to a target binding site such as BINDING SITE I, BINDING SITE II or BINDING SITE III of FIG. 8. Table 4 illustrates the complementarity of the nucleotide sequences of LOC285996 BINDING SITE, designated SEQ ID:8402, to the nucleotide sequence of GAM391 RNA, herein designated GAM RNA, also designated SEQ ID:326.

Another function of GAM391 is therefore inhibition of LOC285996 (Accession XP_212128.1). Accordingly, utilities of GAM391 include diagnosis, prevention and treatment of diseases and clinical conditions associated with LOC285996.

LOC286220 (Accession XP_209954.1) is another GAM391 target gene, herein designated TARGET GENE. LOC286220 BINDING SITE is a target binding site found in the 3' untranslated region of mRNA encoded by LOC286220, corresponding to a target binding site such as BINDING SITE I, BINDING SITE II or BINDING SITE III of FIG. 8. Table 4 illustrates the complementarity of the nucleotide sequences of LOC286220 BINDING SITE, designated SEQ ID:1222, to the nucleotide sequence of GAM391 RNA, herein designated GAM RNA, also designated SEQ ID:326.

Another function of GAM391 is therefore inhibition of LOC286220 (Accession XP_209954.1). Accordingly, utilities of GAM391 include diagnosis, prevention and treatment of diseases and clinical conditions associated with LOC286220.

LOC286372 (Accession XP_212294.1) is another GAM391 target gene, herein designated TARGET GENE. LOC286372 BINDING SITE is a target binding site found in the 5' untranslated region of mRNA encoded by LOC286372, corresponding to a target binding site such as BINDING SITE I, BINDING SITE II or BINDING SITE III of FIG. 8. Table 4 illustrates the complementarity of the nucleotide sequences of LOC286372 BINDING SITE, designated SEQ ID:16638, to the nucleotide sequence of GAM391 RNA, herein designated GAM RNA, also designated SEQ ID:326.

Another function of GAM391 is therefore inhibition of LOC286372 (Accession XP_212294.1). Accordingly, utilities of GAM391 include diagnosis, prevention and treatment of diseases and clinical conditions associated with LOC286372.

LOC339568 (Accession XP_295008.1) is another GAM391 target gene, herein designated TARGET GENE. LOC339568 BINDING SITE is a target binding site found in the 5' untranslated region of mRNA encoded by LOC339568, corresponding to a target binding site such as BINDING SITE I, BINDING SITE II or BINDING SITE III of FIG. 8. Table 4 illustrates the complementarity of the nucleotide sequences of LOC339568 BINDING SITE, designated SEQ ID:12947, to the nucleotide sequence of GAM391 RNA, herein designated GAM RNA, also designated SEQ ID:326.

Another function of GAM391 is therefore inhibition of LOC339568 (Accession XP_295008.1). Accordingly, utilities of GAM391 include diagnosis, prevention and treatment of diseases and clinical conditions associated with LOC339568.

LOC340731 (Accession XP_291690.2) is another GAM391 target gene, herein designated TARGET GENE. LOC340731 BINDING SITE1 through LOC340731 BINDING SITE5 are target binding sites found in untranslated regions of mRNA encoded by LOC340731, corresponding to target binding sites such as BINDING SITE I, BINDING SITE II or BINDING SITE III of FIG. 8. Table 4 illustrates the complementarity of the nucleotide sequences of LOC340731 BINDING SITE1 through LOC340731 BINDING SITE5, designated SEQ ID:6111, SEQ ID:9019, SEQ ID:17313, SEQ ID:10106 and SEQ ID:1668 respectively, to the nucleotide sequence of GAM391 RNA, herein designated GAM RNA, also designated SEQ ID:326.

Another function of GAM391 is therefore inhibition of LOC340731 (Accession XP_291690.2). Accordingly, utilities of GAM391 include diagnosis, prevention and treatment of diseases and clinical conditions associated with LOC340731.

LOC348461 (Accession XP_302764.1) is another GAM391 target gene, herein designated TARGET GENE. LOC348461 BINDING SITE is a target binding site found in the 5' untranslated region of mRNA encoded by LOC348461, corresponding to a target binding site such as BINDING SITE I, BINDING SITE II or BINDING SITE III of FIG. 8. Table 4 illustrates the complementarity of the nucleotide sequences of LOC348461 BINDING SITE, designated SEQ ID:13888, to the nucleotide sequence of GAM391 RNA, herein designated GAM RNA, also designated SEQ ID:326.

Another function of GAM391 is therefore inhibition of LOC348461 (Accession XP_302764.1). Accordingly, utilities of GAM391 include diagnosis, prevention and treatment of diseases and clinical conditions associated with LOC348461.

LOC349408 (Accession XP_303044.1) is another GAM391 target gene, herein designated TARGET GENE. LOC349408 BINDING SITE1 through LOC349408 BINDING SITE3 are target binding sites found in untranslated regions of mRNA encoded by LOC349408, corresponding to target binding sites such as BINDING SITE I, BINDING SITE II or BINDING SITE III of FIG. 8. Table 4 illustrates the complementarity of the nucleotide sequences of LOC349408 BINDING SITE1 through LOC349408 BINDING SITE3, designated SEQ ID:6295, SEQ ID:10334 and SEQ ID:5729 respectively, to the nucleotide sequence of GAM391 RNA, herein designated GAM RNA, also designated SEQ ID:326.

Another function of GAM391 is therefore inhibition of LOC349408 (Accession XP_303044.1). Accordingly, utilities of GAM391 include diagnosis, prevention and treatment of diseases and clinical conditions associated with LOC349408.

LOC349999 (Accession XP_303713.1) is another GAM391 target gene, herein designated TARGET GENE. LOC349999 BINDING SITE is a target binding site found in the 5' untranslated region of mRNA encoded by LOC349999, corresponding to a target binding site such as BINDING SITE I, BINDING SITE II or BINDING SITE III of FIG. 8. Table 4 illustrates the complementarity of the nucleotide sequences of LOC349999 BINDING SITE, designated SEQ ID:12995, to the nucleotide sequence of GAM391 RNA, herein designated GAM RNA, also designated SEQ ID:326.

Another function of GAM391 is therefore inhibition of LOC349999 (Accession XP_303713.1). Accordingly, utilities of GAM391 include diagnosis, prevention and treatment of diseases and clinical conditions associated with LOC349999.

LOC90246 (Accession XP_030283.1) is another GAM391 target gene, herein designated TARGET GENE. LOC90246 BINDING SITE is a target binding site found in the 3' untranslated region of mRNA encoded by LOC90246, corresponding to a target binding site such as BINDING SITE I, BINDING SITE II or BINDING SITE III of FIG. 8. Table 4 illustrates the complementarity of the nucleotide sequences of LOC90246 BINDING SITE, designated SEQ ID:7361, to the nucleotide sequence of GAM391 RNA, herein designated GAM RNA, also designated SEQ ID:326.

Another function of GAM391 is therefore inhibition of LOC90246 (Accession XP_030283.1). Accordingly, utilities of GAM391 include diagnosis, prevention and treatment of diseases and clinical conditions associated with LOC90246.

LOC90719 (Accession XP_033704.1) is another GAM391 target gene, herein designated TARGET GENE. LOC90719 BINDING SITE is a target binding site found in the 3' untranslated region of mRNA encoded by LOC90719, corresponding to a target binding site such as BINDING SITE I, BINDING SITE II or BINDING SITE III of FIG. 8. Table 4 illustrates the complementarity of the nucleotide sequences of LOC90719 BINDING SITE, designated SEQ ID:16755, to the nucleotide sequence of GAM391 RNA, herein designated GAM RNA, also designated SEQ ID:326.

Another function of GAM391 is therefore inhibition of LOC90719 (Accession XP_033704.1). Accordingly, utilities of GAM391 include diagnosis, prevention and treatment of diseases and clinical conditions associated with LOC90719.

LOC90906 (Accession XP_034809.1) is another GAM391 target gene, herein designated TARGET GENE.

LOC90906 BINDING SITE is a target binding site found in the 3' untranslated region of mRNA encoded by LOC90906, corresponding to a target binding site such as BINDING SITE I, BINDING SITE II or BINDING SITE III of FIG. 8. Table 4 illustrates the complementarity of the nucleotide sequences of LOC90906 BINDING SITE, designated SEQ ID:17746, to the nucleotide sequence of GAM391 RNA, herein designated GAM RNA, also designated SEQ ID:326.

Another function of GAM391 is therefore inhibition of LOC90906 (Accession XP_034809.1). Accordingly, utilities of GAM391 include diagnosis, prevention and treatment of diseases and clinical conditions associated with LOC90906.

Mitogen-activated protein kinase 8 interacting protein 3 (MAPK8IP3, Accession NP_203750.1) is another GAM391 target gene, herein designated TARGET GENE. MAPK8IP3 BINDING SITE is a target binding site found in the 3' untranslated region of multiple transcripts of mRNA encoded by MAPK8IP3, corresponding to a target binding site such as BINDING SITE I, BINDING SITE II or BINDING SITE III of FIG. 8. Table 4 illustrates the complementarity of the nucleotide sequences of MAPK8IP3 BINDING SITE, designated SEQ ID:6962, to the nucleotide sequence of GAM391 RNA, herein designated GAM RNA, also designated SEQ ID:326.

Another function of GAM391 is therefore inhibition of Mitogen-activated protein kinase 8 interacting protein 3 (MAPK8IP3, Accession NP_203750.1). Accordingly, utilities of GAM391 include diagnosis, prevention and treatment of diseases and clinical conditions associated with MAPK8IP3.

MGC10772 (Accession NP_085044.2) is another GAM391 target gene, herein designated TARGET GENE. MGC10772 BINDING SITE is a target binding site found in the 3' untranslated region of mRNA encoded by MGC10772, corresponding to a target binding site such as BINDING SITE I, BINDING SITE II or BINDING SITE III of FIG. 8. Table 4 illustrates the complementarity of the nucleotide sequences of MGC10772 BINDING SITE, designated SEQ ID:3496, to the nucleotide sequence of GAM391 RNA, herein designated GAM RNA, also designated SEQ ID:326.

Another function of GAM391 is therefore inhibition of MGC10772 (Accession NP_085044.2). Accordingly, utilities of GAM391 include diagnosis, prevention and treatment of diseases and clinical conditions associated with MGC10772.

MGC10870 (Accession NP_115677.1) is another GAM391 target gene, herein designated TARGET GENE. MGC10870 BINDING SITE is a target binding site found in the 3' untranslated region of mRNA encoded by MGC10870, corresponding to a target binding site such as BINDING SITE I, BINDING SITE II or BINDING SITE III of FIG. 8. Table 4 illustrates the complementarity of the nucleotide sequences of MGC10870 BINDING SITE, designated SEQ ID:17365, to the nucleotide sequence of GAM391 RNA, herein designated GAM RNA, also designated SEQ ID:326.

Another function of GAM391 is therefore inhibition of MGC10870 (Accession NP_115677.1). Accordingly, utilities of GAM391 include diagnosis, prevention and treatment of diseases and clinical conditions associated with MGC10870.

MGC11102 (Accession NP_115701.2) is another GAM391 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:17225, to the nucleotide sequence of GAM391 RNA, herein designated GAM RNA, also designated SEQ ID:326.

Another function of GAM391 is therefore inhibition of MGC11102 (Accession NP_115701.2). Accordingly, utilities of GAM391 include diagnosis, prevention and treatment of diseases and clinical conditions associated with MGC11102.

MGC17299 (Accession NP_653227.1) is another GAM391 target gene, herein designated TARGET GENE. MGC17299 BINDING SITE is a target binding site found in the 5' untranslated region of mRNA encoded by MGC17299, corresponding to a target binding site such as BINDING SITE I, BINDING SITE II or BINDING SITE III of FIG. 8. Table 4 illustrates the complementarity of the nucleotide sequences of MGC17299 BINDING SITE, designated SEQ ID:14020, to the nucleotide sequence of GAM391 RNA, herein designated GAM RNA, also designated SEQ ID:326.

Another function of GAM391 is therefore inhibition of MGC17299 (Accession NP_653227.1). Accordingly, utilities of GAM391 include diagnosis, prevention and treatment of diseases and clinical conditions associated with MGC17299.

MGC2306 (Accession NP_002041.2) is another GAM391 target gene, herein designated TARGET GENE. MGC2306 BINDING SITE is a target binding site found in the 3' untranslated region of mRNA encoded by MGC2306, corresponding to a target binding site such as BINDING SITE I, BINDING SITE II or BINDING SITE III of FIG. 8. Table 4 illustrates the complementarity of the nucleotide sequences of MGC2306 BINDING SITE, designated SEQ ID:12989, to the nucleotide sequence of GAM391 RNA, herein designated GAM RNA, also designated SEQ ID:326.

Another function of GAM391 is therefore inhibition of MGC2306 (Accession NP_002041.2). Accordingly, utilities of GAM391 include diagnosis, prevention and treatment of diseases and clinical conditions associated with MGC2306.

MGC2508 (Accession NP_077303.1) is another GAM391 target gene, herein designated TARGET GENE. MGC2508 BINDING SITE is a target binding site found in the 3' untranslated region of mRNA encoded by MGC2508, corresponding to a target binding site such as BINDING SITE I, BINDING SITE II or BINDING SITE III of FIG. 8. Table 4 illustrates the complementarity of the nucleotide sequences of MGC2508 BINDING SITE, designated SEQ ID:11605, to the nucleotide sequence of GAM391 RNA, herein designated GAM RNA, also designated SEQ ID:326.

Another function of GAM391 is therefore inhibition of MGC2508 (Accession NP_077303.1). Accordingly, utilities of GAM391 include diagnosis, prevention and treatment of diseases and clinical conditions associated with MGC2508.

MTO1 (Accession NP_598400.1) is another GAM391 target gene, herein designated TARGET GENE. MTO1 BINDING SITE is a target binding site found in the 3' untranslated region of multiple transcripts of mRNA encoded by MTO1, corresponding to a target binding site such as BINDING SITE I, BINDING SITE II or BINDING SITE III of FIG. 8. Table 4 illustrates the complementarity of the nucleotide sequences of MTO1 BINDING SITE, designated SEQ ID:17745, to the nucleotide sequence of GAM391 RNA, herein designated GAM RNA, also designated SEQ ID:326.

Another function of GAM391 is therefore inhibition of MTO1 (Accession NP_598400.1). Accordingly, utilities of GAM391 include diagnosis, prevention and treatment of diseases and clinical conditions associated with MTO1.

Myosin, light polypeptide kinase (MYLK, Accession NP__444253.1) is another GAM391 target gene, herein designated TARGET GENE. MYLK BINDING SITE is a target binding site found in the 5' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:11895, to the nucleotide sequence of GAM391 RNA, herein designated GAM RNA, also designated SEQ ID:326.

Another function of GAM391 is therefore inhibition of Myosin, light polypeptide kinase (MYLK, Accession NP__444253.1), a gene which is involved in contraction of smooth muscle. Accordingly, utilities of GAM391 include diagnosis, prevention and treatment of diseases and clinical conditions associated with MYLK.

The function of MYLK and its association with various diseases and clinical conditions, has been established by previous studies, as described hereinabove with reference to GAM94.1. Myosin, light polypeptide kinase (MYLK, Accession NP__444256.1) is another GAM391 target gene, herein designated TARGET GENE. MYLK BINDING SITE is a target binding site found in the 5' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:11895, to the nucleotide sequence of GAM391 RNA, herein designated GAM RNA, also designated SEQ ID:326.

Another function of GAM391 is therefore inhibition of Myosin, light polypeptide kinase (MYLK, Accession NP__444256.1), a gene which is involved in contraction of smooth muscle. Accordingly, utilities of GAM391 include diagnosis, prevention and treatment of diseases and clinical conditions associated with MYLK.

The function of MYLK and its association with various diseases and clinical conditions, has been established by previous studies, as described hereinabove with reference to GAM94.1. Myosin, light polypeptide kinase (MYLK, Accession NP__444255.1) is another GAM391 target gene, herein designated TARGET GENE. MYLK BINDING SITE is a target binding site found in the 5' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:11895, to the nucleotide sequence of GAM391 RNA, herein designated GAM RNA, also designated SEQ ID:326.

Another function of GAM391 is therefore inhibition of Myosin, light polypeptide kinase (MYLK, Accession NP__444255.1), a gene which is involved in contraction of smooth muscle. Accordingly, utilities of GAM391 include diagnosis, prevention and treatment of diseases and clinical conditions associated with MYLK.

The function of MYLK and its association with various diseases and clinical conditions, has been established by previous studies, as described hereinabove with reference to GAM94.1. Myosin, light polypeptide kinase (MYLK, Accession NP__444254.1) is another GAM391 target gene, herein designated TARGET GENE. MYLK BINDING SITE is a target binding site found in the 5' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:11895, to the nucleotide sequence of GAM391 RNA, herein designated GAM RNA, also designated SEQ ID:326.

Another function of GAM391 is therefore inhibition of Myosin, light polypeptide kinase (MYLK, Accession NP__444254.1), a gene which is involved in contraction of smooth muscle. Accordingly, utilities of GAM391 include diagnosis, prevention and treatment of diseases and clinical conditions associated with MYLK.

The function of MYLK and its association with various diseases and clinical conditions, has been established by previous studies, as described hereinabove with reference to GAM94.1. Myosin, light polypeptide kinase (MYLK, Accession NP__444257.1) is another GAM391 target gene, herein designated TARGET GENE. MYLK BINDING SITE is a target binding site found in the 5' untranslated region of multiple transcripts of mRNA encoded by MYLK, corresponding to a target binding site such as BINDING SITE I, BINDING SITE II or BINDING SITE III of FIG. 8. Table 4 illustrates the complementarity of the nucleotide sequences of MYLK BINDING SITE, designated SEQ ID:11895, to the nucleotide sequence of GAM391 RNA, herein designated GAM RNA, also designated SEQ ID:326.

Another function of GAM391 is therefore inhibition of Myosin, light polypeptide kinase (MYLK, Accession NP__444257.1), a gene which is involved in contraction of smooth muscle. Accordingly, utilities of GAM391 include diagnosis, prevention and treatment of diseases and clinical conditions associated with MYLK.

The function of MYLK and its association with various diseases and clinical conditions, has been established by previous studies, as described hereinabove with reference to GAM94.1. N33 (Accession NP__006756.2) is another GAM391 target gene, herein designated TARGET GENE. N33 BINDING SITE is a target binding site found in the 3' untranslated region of multiple transcripts of mRNA encoded by N33, corresponding to a target binding site such as BINDING SITE I, BINDING SITE II or BINDING SITE III of FIG. 8. Table 4 illustrates the complementarity of the nucleotide sequences of N33 BINDING SITE, designated SEQ ID:6148, to the nucleotide sequence of GAM391 RNA, herein designated GAM RNA, also designated SEQ ID:326.

Another function of GAM391 is therefore inhibition of N33 (Accession NP__006756.2), a gene which is a putative integral membrane protein. and therefore may be associated with Metastatic prostate cancer. Accordingly, utilities of GAM391 include diagnosis, prevention and treatment of Metastatic prostate cancer, and of other diseases and clinical conditions associated with N33.

The function of N33 and its association with various diseases and clinical conditions, has been established by previous studies, as described hereinabove with reference to GAM223.1. Nucleoporin 54 kda (NUP54, Accession NP__059122.2) is another GAM391 target gene, herein designated TARGET GENE. NUP54 BINDING SITE is a target binding site found in the 5' untranslated region of mRNA encoded by NUP54, corresponding to a target binding site such as BINDING SITE I, BINDING SITE II or BINDING SITE III of FIG. 8. Table 4 illustrates the complementarity of the nucleotide sequences of NUP54 BINDING SITE, designated SEQ ID:7998, to the nucleotide sequence of GAM391 RNA, herein designated GAM RNA, also designated SEQ ID:326.

Another function of GAM391 is therefore inhibition of Nucleoporin 54 kda (NUP54, Accession NP__059122.2).

Accordingly, utilities of GAM391 include diagnosis, prevention and treatment of diseases and clinical conditions associated with NUP54.

Orthopedia homolog (drosophila) (OTP, Accession NP_115485.1) is another GAM391 target gene, herein designated TARGET GENE. OTP BINDING SITE is a target binding site found in the 3' untranslated region of mRNA encoded by OTP, corresponding to a target binding site such as BINDING SITE I, BINDING SITE II or BINDING SITE III of FIG. 8. Table 4 illustrates the complementarity of the nucleotide sequences of OTP BINDING SITE, designated SEQ ID:18727, to the nucleotide sequence of GAM391 RNA, herein designated GAM RNA, also designated SEQ ID:326.

Another function of GAM391 is therefore inhibition of Orthopedia homolog (drosophila) (OTP, Accession NP_115485.1), a gene which involves in the development of the forebrain and spinal cord. Accordingly, utilities of GAM391 include diagnosis, prevention and treatment of diseases and clinical conditions associated with OTP.

The function of OTP and its association with various diseases and clinical conditions, has been established by previous studies, as described hereinabove with reference to GAM148.1. Progesterone receptor membrane component 2 (PGRMC2, Accession NP_006311.1) is another GAM391 target gene, herein designated TARGET GENE. PGRMC2 BINDING SITE is a target binding site found in the 3' untranslated region of mRNA encoded by PGRMC2, corresponding to a target binding site such as BINDING SITE I, BINDING SITE II or BINDING SITE III of FIG. 8. Table 4 illustrates the complementarity of the nucleotide sequences of PGRMC2 BINDING SITE, designated SEQ ID:742, to the nucleotide sequence of GAM391 RNA, herein designated GAM RNA, also designated SEQ ID:326.

Another function of GAM391 is therefore inhibition of Progesterone receptor membrane component 2 (PGRMC2, Accession NP_006311.1). Accordingly, utilities of GAM391 include diagnosis, prevention and treatment of diseases and clinical conditions associated with PGRMC2.

Preimplantation protein 3 (PREI3, Accession NP_056202.1) is another GAM391 target gene, herein designated TARGET GENE. PREI3 BINDING SITE is a target binding site found in the 3' untranslated region of mRNA encoded by PREI3, corresponding to a target binding site such as BINDING SITE I, BINDING SITE II or BINDING SITE III of FIG. 8. Table 4 illustrates the complementarity of the nucleotide sequences of PREI3 BINDING SITE, designated SEQ ID:13783, to the nucleotide sequence of GAM391 RNA, herein designated GAM RNA, also designated SEQ ID:326.

Another function of GAM391 is therefore inhibition of Preimplantation protein 3 (PREI3, Accession NP_056202.1). Accordingly, utilities of GAM391 include diagnosis, prevention and treatment of diseases and clinical conditions associated with PREI3.

PRO2859 (Accession NP_061013.1) is another GAM391 target gene, herein designated TARGET GENE. PRO2859 BINDING SITE is a target binding site found in the 5' untranslated region of mRNA encoded by PRO2859, corresponding to a target binding site such as BINDING SITE I, BINDING SITE II or BINDING SITE III of FIG. 8. Table 4 illustrates the complementarity of the nucleotide sequences of PRO2859 BINDING SITE, designated SEQ ID:16593, to the nucleotide sequence of GAM391 RNA, herein designated GAM RNA, also designated SEQ ID:326.

Another function of GAM391 is therefore inhibition of PRO2859 (Accession NP_061013.1). Accordingly, utilities of GAM391 include diagnosis, prevention and treatment of diseases and clinical conditions associated with PRO2859.

Protease, serine, 11 (igf binding) (PRSS11, Accession NP_002766.1) is another GAM391 target gene, herein designated TARGET GENE. PRSS11 BINDING SITE is a target binding site found in the 3' untranslated region of mRNA encoded by PRSS11, corresponding to a target binding site such as BINDING SITE I, BINDING SITE II or BINDING SITE III of FIG. 8. Table 4 illustrates the complementarity of the nucleotide sequences of PRSS11 BINDING SITE, designated SEQ ID:15793, to the nucleotide sequence of GAM391 RNA, herein designated GAM RNA, also designated SEQ ID:326.

Another function of GAM391 is therefore inhibition of Protease, serine, 11 (igf binding) (PRSS11, Accession NP_002766.1), a gene which stimulates the proliferation and differentiation of a vast number of cell types. Accordingly, utilities of GAM391 include diagnosis, prevention and treatment of diseases and clinical conditions associated with PRSS11.

The function of PRSS11 has been established by previous studies. Insulin- like growth factors (IGFs; OMIM Ref. No. 147440) stimulate the proliferation and differentiation of a vast number of cell types. The action of the growth factors is mediated and controlled by a complex system of components, including at least 2 different forms of IGF, 2 IGF receptors (e.g., 147370), 7 different IGF-binding proteins (IGFBPs; OMIM Ref. No. 146730), and several proteases that cleave the IGFBPs. CLONING Zumbrunn and Trueb (1996) cloned the cDNA for a human protein, termed L56 by them, that seemed to be part of the IGF signaling system. The predicted protein encodes a 480-amino acid polypeptide with a molecular mass of 51 kD. Zumbrunn and Trueb (1996) found that PRSS11 contains a secretory signal sequence, an IGFBP-binding domain, and a serine protease domain. The serine protease domain is most similar to certain bacterial serine proteases. By Northern blot analysis, Zumbrunn and Trueb (1996) showed that PRSS11 is expressed in a variety of human tissues, with strongest expression in placenta. Hu et al. (1998) also cloned PRSS11. The deduced 480-amino acid protein is 98% identical to the cow, guinea pig, and rabbit proteins. It contains an N terminus homologous to MAC25 (IGFBP7; 602867) with a conserved Kazal-type serine protease inhibitor motif, as well as a C-terminal PDZ domain. Semiquantitative RT-PCR and immunoblot analyses showed an approximately 7-fold increase of PRSS11 in osteoarthritis cartilage compared with controls. Functional and mutational analyses indicated that PRS11 is a serine protease dependent on the presence of a serine at position 328

Full details of the abovementioned studies are described in the following publications, the disclosure of which are hereby incorporated by reference:

Hu, S.-I.; Carozza, M.; Klein, M.; Nantermet, P.; Luk, D.; Crowl, R. M.: Human HtrA, an evolutionarily conserved serine protease identified as a differentially expressed gene product in osteoarthritic cartilage. J. Biol. Chem. 273:34406-34412, 1998; and Zumbrunn, J.; Trueb, B.: Localization of the gene for a serine protease with IGF-binding domain (PRSS11) to human chromosome 10q25.3-q26.2. Genomics 45:461-462, 1997.

Further studies establishing the function and utilities of PRSS11 are found in John Hopkins OMIM database record ID 602194, and in cited publications listed in Table 5, which are hereby incorporated by reference. Solute carrier family 15 (h+/peptide transporter), member 2 (SLC15A2, Accession NP_066568.2) is another GAM391 target gene, herein designated TARGET GENE. SLC15A2 BINDING SITE is a target binding site found in the 3' untranslated region of mRNA encoded by SLC15A2, corresponding to a target binding site such as BINDING SITE I, BINDING SITE II or BINDING SITE III of FIG. 8. Table 4 illustrates the complementarity of the nucleotide sequences of SLC15A2 BINDING SITE, designated SEQ ID:1490, to the nucleotide sequence of GAM391 RNA, herein designated GAM RNA, also designated SEQ ID:326.

Another function of GAM391 is therefore inhibition of Solute carrier family 15 (h+/peptide transporter), member 2 (SLC15A2, Accession NP_066568.2). Accordingly, utilities of GAM391 include diagnosis, prevention and treatment of diseases and clinical conditions associated with SLC15A2.

Solute carrier family 19 (folate transporter), member 1 (SLC19A1, Accession NP_003047.1) is another GAM391 target gene, herein designated TARGET GENE. SLC19A1 BINDING SITE is a target binding site found in the 3' untranslated region of mRNA encoded by SLC19A1, corresponding to a target binding site such as BINDING SITE I, BINDING SITE II or BINDING SITE III of FIG. 8. Table 4 illustrates the complementarity of the nucleotide sequences of SLC19A1 BINDING SITE, designated SEQ ID:16419, to the nucleotide sequence of GAM391 RNA, herein designated GAM RNA, also designated SEQ ID:326.

Another function of GAM391 is therefore inhibition of Solute carrier family 19 (folate transporter), member 1 (SLC19A1, Accession NP_003047.1). Accordingly, utilities of GAM391 include diagnosis, prevention and treatment of diseases and clinical conditions associated with SLC19A1.

Solute carrier family 20 (phosphate transporter), member 1 (SLC20A1, Accession NP_005406.3) is another GAM391 target gene, herein designated TARGET GENE. SLC20A1 BINDING SITE is a target binding site found in the 3' untranslated region of mRNA encoded by SLC20A1, corresponding to a target binding site such as BINDING SITE I, BINDING SITE II or BINDING SITE III of FIG. 8. Table 4 illustrates the complementarity of the nucleotide sequences of SLC20A1 BINDING SITE, designated SEQ ID:9287, to the nucleotide sequence of GAM391 RNA, herein designated GAM RNA, also designated SEQ ID:326.

Another function of GAM391 is therefore inhibition of Solute carrier family 20 (phosphate transporter), member 1 (SLC20A1, Accession NP_005406.3), a gene which could be a sodium-phosphate symporter. Accordingly, utilities of GAM391 include diagnosis, prevention and treatment of diseases and clinical conditions associated with SLC20A1.

The function of SLC20A1 has been established by previous studies. By expression in Xenopus oocytes and in mammalian cells, Kavanaugh et al. (1994) determined that GLVR1 is a sodium-dependent phosphate symporter. Voltage-clamp analysis indicated net cation influx, suggesting that phosphate is transported with excess sodium ions. Palmer et al. (1999) showed that the GLVR1 gene consists of 11 exons spanning approximately 18 kb of genomic DNA. Exon 1 is noncoding. Using a luciferase reporter gene assay in transiently transfected chondrocytes and osteoblasts, Palmer et al. (2001) determined that the activity of the promoter of SLC20A1, which they called PIT1, requires a TATA-like sequence and a single SP1 (OMIM Ref. No. 189906) site. They found that this SP1 site could bind SP1 and SP3 (OMIM Ref. No. 601804). Despite the conservation of sequence between the human and mouse promoter, the promoter of mouse Pit1 depends on a combination of several cis-acting elements.

Full details of the abovementioned studies are described in the following publications, the disclosure of which are hereby incorporated by reference:

Kavanaugh, M. P.; Miller, D. G.; Zhang, W.; Law, W.; Kozak, S. L.; Kabat, D.; Miller, A. D.: Cell-surface receptors for gibbon ape leukemia virus and amphotropic murine retrovirus are inducible sodium-dependent phosphate symporters. Proc. Nat. Acad. Sci. 91:7071-7075, 1994; and Palmer, G.; Manen, D.; Bonjour, J.-P.; Caverzasio, J.: Species-specific mechanisms control the activity of the Pit1/PIT1 phosphate transporter gene promoter in mouse and human. Gene 279.

Further studies establishing the function and utilities of SLC20A1 are found in John Hopkins OMIM database record ID 137570, and in cited publications listed in Table 5, which are hereby incorporated by reference. Solute carrier family 24 (sodium/potassium/calcium exchanger), member 1 (SLC24A1, Accession NP_004718.1) is another GAM391 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:17502, to the nucleotide sequence of GAM391 RNA, herein designated GAM RNA, also designated SEQ ID:326.

Another function of GAM391 is therefore inhibition of Solute carrier family 24 (sodium/potassium/calcium exchanger), member 1 (SLC24A1, Accession NP_004718.1), a gene which is a critical component of the visual transduction cascade, controlling the calcium concentration of outer segments during light and darkness. Accordingly, utilities of GAM391 include diagnosis, prevention and treatment of diseases and clinical conditions associated with SLC24A1.

The function of SLC24A1 and its association with various diseases and clinical conditions, has been established by previous studies, as described hereinabove with reference to GAM130.1. Solute carrier family 39 (zinc transporter), member 3 (SLC39A3, Accession NP_653165.1) is another GAM391 target gene, herein designated TARGET GENE. SLC39A3 BINDING SITE is a target binding site found in the 3' untranslated region of mRNA encoded by SLC39A3, corresponding to a target binding site such as BINDING SITE I, BINDING SITE II or BINDING SITE III of FIG. 8. Table 4 illustrates the complementarity of the nucleotide sequences of SLC39A3 BINDING SITE, designated SEQ ID:15092, to the nucleotide sequence of GAM391 RNA, herein designated GAM RNA, also designated SEQ ID:326.

Another function of GAM391 is therefore inhibition of Solute carrier family 39 (zinc transporter), member 3 (SLC39A3, Accession NP_653165.1). Accordingly, utilities of GAM391 include diagnosis, prevention and treatment of diseases and clinical conditions associated with SLC39A3.

SNRK (Accession NP_060189.2) is another GAM391 target gene, herein designated TARGET GENE. SNRK BINDING SITE is a target binding site found in the 3' untranslated region of mRNA encoded by SNRK, corresponding to a target binding site such as BINDING SITE I, BINDING SITE II or BINDING SITE III of FIG. 8. Table 4 illustrates the complementarity of the nucleotide sequences of SNRK BINDING SITE, designated SEQ ID:12233, to the nucleotide sequence of GAM391 RNA, herein designated GAM RNA, also designated SEQ ID:326.

Another function of GAM391 is therefore inhibition of SNRK (Accession NP_060189.2). Accordingly, utilities of GAM391 include diagnosis, prevention and treatment of diseases and clinical conditions associated with SNRK.

Sry (sex determining region y)-box 11 (SOX11, Accession NP_003099.1) is another GAM391 target gene, herein designated TARGET GENE. SOX11 BINDING SITE is a target binding site found in the 3' untranslated region of mRNA encoded by SOX11, corresponding to a target binding site such as BINDING SITE I, BINDING SITE II or BINDING SITE III of FIG. 8. Table 4 illustrates the complementarity of the nucleotide sequences of SOX11 BINDING SITE, designated SEQ ID:14726, to the nucleotide sequence of GAM391 RNA, herein designated GAM RNA, also designated SEQ ID:326.

Another function of GAM391 is therefore inhibition of Sry (sex determining region y)-box 11 (SOX11, Accession NP_003099.1). Accordingly, utilities of GAM391 include diagnosis, prevention and treatment of diseases and clinical conditions associated with SOX11.

Sepiapterin reductase (7,8-dihydrobiopterin:nadp+ oxidoreductase) (SPR, Accession NP_003115.1) is another GAM391 target gene, herein designated TARGET GENE. SPR BINDING SITE is a target binding site found in the 3' untranslated region of mRNA encoded by SPR, corresponding to a target binding site such as BINDING SITE I, BINDING SITE II or BINDING SITE III of FIG. 8. Table 4 illustrates the complementarity of the nucleotide sequences of SPR BINDING SITE, designated SEQ ID:6469, to the nucleotide sequence of GAM391 RNA, herein designated GAM RNA, also designated SEQ ID:326.

Another function of GAM391 is therefore inhibition of Sepiapterin reductase (7,8-dihydrobiopterin:nadp+ oxidoreductase) (SPR, Accession NP_003115.1), a gene which catalyzes the and therefore is associated with Sepiapterin reductase deficiency. Accordingly, utilities of GAM391 include diagnosis, prevention and treatment of Sepiapterin reductase deficiency, and of other diseases and clinical conditions associated with SPR.

The function of SPR has been established by previous studies. Bonafe et al. (2001) reported 2 patients with progressive psychomotor retardation, dystonia, severe dopamine and serotonin deficiencies (low levels of 5-hydroxyindoleacetic and homovanillic acids), and abnormal pterin pattern (high levels of biopterin and dihydrobiopterin) in cerebrospinal fluid. They presented with normal urinary pterins and without hyperphenylalaninemia. Studies of skin fibroblasts revealed inactive sepiapterin reductase, the enzyme catalyzing the final 2-step reaction in the biosynthesis of tetrahydrobiopterin (BH4). Mutations in the SPR gene were detected in both patients: homozygous (182125.0001) in 1 and compound heterozygous (182125.0002) in the other. The authors suggested that autosomal recessive deficiency of sepiapterin reductase leads to BH4 and neurotransmitter deficiencies without hyperphenylalaninemia and may not be detected by neonatal screening for phenylketonuria.

Full details of the abovementioned studies are described in the following publications, the disclosure of which are hereby incorporated by reference:

Bonafe, L.; Thony, B.; Penzien, J. M.; Czarnecki, B.; Blau, N.: Mutations in the sepiapterin reductase gene cause a novel tetrahydrobiopterin-dependent monoamine- neurotransmitter deficiency without hyperphenylalaninemia. Am. J. Hum. Genet. 69:269-277, 2001; and Blau, N.; Thony, B.; Renneberg, A.; Arnold, L. A.; Hyland, K.: Dihydropteridine reductase deficiency localized to the central nervous system. J. Inherit. Metab. Dis. 21:433-434, 1998.

Further studies establishing the function and utilities of SPR are found in John Hopkins OMIM database record ID 182125, and in cited publications listed in Table 5, which are hereby incorporated by reference. Sprouty homolog 4 (drosophila) (SPRY4, Accession NP_112226.2) is another GAM391 target gene, herein designated TARGET GENE. SPRY4 BINDING SITE is a target binding site found in the 3' untranslated region of mRNA encoded by SPRY4, corresponding to a target binding site such as BINDING SITE I, BINDING SITE II or BINDING SITE III of FIG. 8. Table 4 illustrates the complementarity of the nucleotide sequences of SPRY4 BINDING SITE, designated SEQ ID:1887, to the nucleotide sequence of GAM391 RNA, herein designated GAM RNA, also designated SEQ ID:326.

Another function of GAM391 is therefore inhibition of Sprouty homolog 4 (drosophila) (SPRY4, Accession NP_112226.2). Accordingly, utilities of GAM391 include diagnosis, prevention and treatment of diseases and clinical conditions associated with SPRY4.

Signal transducer and activator of transcription 3 (acute-phase response factor) (STAT3, Accession NP_644805.1) is another GAM391 target gene, herein designated TARGET GENE. STAT3 BINDING SITE is a target binding site found in the 3' untranslated region of multiple transcripts of mRNA encoded by STAT3, corresponding to a target binding site such as BINDING SITE I, BINDING SITE II or BINDING SITE III of FIG. 8. Table 4 illustrates the complementarity of the nucleotide sequences of STAT3 BINDING SITE, designated SEQ ID:10246, to the nucleotide sequence of GAM391 RNA, herein designated GAM RNA, also designated SEQ ID:326.

Another function of GAM391 is therefore inhibition of Signal transducer and activator of transcription 3 (acute-phase response factor) (STAT3, Accession NP_644805.1), a gene which carries out a dual function: signal transduction and activation of transcription. Accordingly, utilities of GAM391 include diagnosis, prevention and treatment of diseases and clinical conditions associated with STAT3.

The function of STAT3 and its association with various diseases and clinical conditions, has been established by previous studies, as described hereinabove with reference to GAM47.1. Signal transducer and activator of transcription 3 (acute-phase response factor) (STAT3, Accession NP_003141.2) is another GAM391 target gene, herein designated TARGET GENE. STAT3 BINDING SITE is a target binding site found in the 3' untranslated region of multiple transcripts of mRNA encoded by STAT3, corresponding to a target binding site such as BINDING SITE I, BINDING SITE II or BINDING SITE III of FIG. 8. Table 4 illustrates the complementarity of the nucleotide sequences of STAT3 BINDING SITE, designated SEQ ID:10246, to the nucleotide sequence of GAM391 RNA, herein designated GAM RNA, also designated SEQ ID:326.

Another function of GAM391 is therefore inhibition of Signal transducer and activator of transcription 3 (acute-phase response factor) (STAT3, Accession NP_003141.2), a gene which carries out a dual function: signal transduction and activation of transcription. Accordingly, utilities of GAM391 include diagnosis, prevention and treatment of diseases and clinical conditions associated with STAT3.

The function of STAT3 and its association with various diseases and clinical conditions, has been established by previous studies, as described hereinabove with reference to GAM47.1. Surfeit 6 (SURF6, Accession NP_006744.2) is another GAM391 target gene, herein designated TARGET GENE. SURF6 BINDING SITE is a target binding site found in the 3' untranslated region of mRNA encoded by SURF6, corresponding to a target binding site such as BINDING SITE I, BINDING SITE II or BINDING SITE III of FIG. 8. Table 4 illustrates the complementarity of the nucleotide sequences of SURF6 BINDING SITE, designated SEQ ID:10519, to the nucleotide sequence of GAM391 RNA, herein designated GAM RNA, also designated SEQ ID:326.

Another function of GAM391 is therefore inhibition of Surfeit 6 (SURF6, Accession NP_006744.2). Accordingly, utilities of GAM391 include diagnosis, prevention and treatment of diseases and clinical conditions associated with SURF6.

Synaptotagmin iii (SYT3, Accession NP_115674.1) is another GAM391 target gene, herein designated TARGET GENE. SYT3 BINDING SITE is a target binding site found in the 5' untranslated region of mRNA encoded by SYT3, corresponding to a target binding site such as BINDING SITE I, BINDING SITE II or BINDING SITE III of FIG. 8. Table 4 illustrates the complementarity of the nucleotide sequences of SYT3 BINDING SITE, designated SEQ ID:3513, to the nucleotide sequence of GAM391 RNA, herein designated GAM RNA, also designated SEQ ID:326.

Another function of GAM391 is therefore inhibition of Synaptotagmin iii (SYT3, Accession NP_115674.1). Accordingly, utilities of GAM391 include diagnosis, prevention and treatment of diseases and clinical conditions associated with SYT3.

TBC1D7 (Accession NP_057579.1) is another GAM391 target gene, herein designated TARGET GENE. TBC1D7 BINDING SITE is a target binding site found in the 3' untranslated region of mRNA encoded by TBC1D7, corresponding to a target binding site such as BINDING SITE I, BINDING SITE II or BINDING SITE III of FIG. 8. Table 4 illustrates the complementarity of the nucleotide sequences of TBC1D7 BINDING SITE, designated SEQ ID:17570, to the nucleotide sequence of GAM391 RNA, herein designated GAM RNA, also designated SEQ ID:326.

Another function of GAM391 is therefore inhibition of TBC1D7 (Accession NP_057579.1). Accordingly, utilities of GAM391 include diagnosis, prevention and treatment of diseases and clinical conditions associated with TBC1D7.

T-cell leukemia/lymphoma 6 (TCL6, Accession NP_065578.2) is another GAM391 target gene, herein designated TARGET GENE. TCL6 BINDING SITE is a target binding site found in the 3' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:4551, to the nucleotide sequence of GAM391 RNA, herein designated GAM RNA, also designated SEQ ID:326.

Another function of GAM391 is therefore inhibition of T-cell leukemia/lymphoma 6 (TCL6, Accession NP_065578.2). Accordingly, utilities of GAM391 include diagnosis, prevention and treatment of diseases and clinical conditions associated with TCL6.

T-cell leukemia/lymphoma 6 (TCL6, Accession NP_065577.2) is another GAM391 target gene, herein designated TARGET GENE. TCL6 BINDING SITE is a target binding site found in the 3' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:4551, to the nucleotide sequence of GAM391 RNA, herein designated GAM RNA, also designated SEQ ID:326.

Another function of GAM391 is therefore inhibition of T-cell leukemia/lymphoma 6 (TCL6, Accession NP_065577.2). Accordingly, utilities of GAM391 include diagnosis, prevention and treatment of diseases and clinical conditions associated with TCL6.

Tumor necrosis factor receptor superfamily, member 19 (TNFRSF19, Accession NP_683760.1) is another GAM391 target gene, herein designated TARGET GENE. TNFRSF19 BINDING SITE is a target binding site found in the 3' untranslated region of multiple transcripts of mRNA encoded by TNFRSF19, corresponding to a target binding site such as BINDING SITE I, BINDING SITE II or BINDING SITE III of FIG. 8. Table 4 illustrates the complementarity of the nucleotide sequences of TNFRSF19 BINDING SITE, designated SEQ ID:14661, to the nucleotide sequence of GAM391 RNA, herein designated GAM RNA, also designated SEQ ID:326.

Another function of GAM391 is therefore inhibition of Tumor necrosis factor receptor superfamily, member 19 (TNFRSF19, Accession NP_683760.1). Accordingly, utilities of GAM391 include diagnosis, prevention and treatment of diseases and clinical conditions associated with TNFRSF19.

Testis-specific transcript, y-linked 14 (TTTY14, Accession NP_114138.1) is another GAM391 target gene, herein designated TARGET GENE. TTTY14 BINDING SITE is a target binding site found in the 5' untranslated region of multiple transcripts of mRNA encoded by TTTY14, corresponding to a target binding site such as BINDING SITE I, BINDING SITE II or BINDING SITE III of FIG. 8. Table 4 illustrates the complementarity of the nucleotide sequences of TTTY14 BINDING SITE, designated SEQ ID:2750, to the nucleotide sequence of GAM391 RNA, herein designated GAM RNA, also designated SEQ ID:326.

Another function of GAM391 is therefore inhibition of Testis-specific transcript, y-linked 14 (TTTY14, Accession NP_114138.1). Accordingly, utilities of GAM391 include diagnosis, prevention and treatment of diseases and clinical conditions associated with TTTY14.

Testis-specific transcript, y-linked 14 (TTTY14, Accession XP_291361.1) is another GAM391 target gene, herein designated TARGET GENE. TTTY14 BINDING SITE is a target binding site found in the 5' untranslated region of multiple transcripts of mRNA encoded by TTTY14, corresponding to a target binding site such as BINDING SITE I, BINDING SITE II or BINDING SITE III of FIG. 8. Table 4 illustrates the complementarity of the nucleotide sequences of TTTY14 BINDING SITE, designated SEQ ID:2750, to the nucleotide sequence of GAM391 RNA, herein designated GAM RNA, also designated SEQ ID:326.

Another function of GAM391 is therefore inhibition of Testis-specific transcript, y-linked 14 (TTTY14, Accession XP_291361.1). Accordingly, utilities of GAM391 include diagnosis, prevention and treatment of diseases and clinical conditions associated with TTTY14.

FIG. 8 further provides a conceptual description of a novel bioinformatically detected of the present invention, referred to here as Genomic Address Messenger 633 (GAM633), which modulates expression of respective target genes thereof, the function and utility of which target genes is known in the art.

GAM633 is a novel bioinformatically detected regulatory, non protein coding, micro RNA (miRNA) gene. The method by which GAM633 was detected is described hereinabove with reference to FIGS. 8-15.

GAM633 gene, herein designated GAM GENE, and GAM633 target gene, herein designated TARGET GENE, are human genes contained in the human genome.

GAM633 gene encodes a GAM633 precursor RNA, herein designated GAM PRECURSOR RNA. Similar to other miRNA genes, and unlike most ordinary genes, GAM633 precursor RNA does not encode a protein. A nucleotide sequence identical or highly similar to the nucleotide sequence of GAM633 precursor RNA is designated SEQ ID:68, and is provided hereinbelow with reference to the sequence listing part.

GAM633 precursor RNA folds onto itself, forming GAM633 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM633 precursor RNA folds onto itself, forming GAM633 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM633 precursor RNA, designated SEQ-ID:68, and a schematic representation of a predicted secondary folding of GAM633 folded precursor RNA are further described with reference to Table 2, hereby incorporated by reference.

An enzyme complex designated DICER COMPLEX, 'dices' the GAM633 folded precursor RNA into GAM633 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM633 RNA is designated SEQ ID:340, and is provided hereinbelow with references to the sequence listing part and Table 3, hereby incorporated by reference.

GAM633 target gene, herein designated TARGET GENE, encodes a corresponding messenger RNA, GAM633 target RNA, herein designated GAM TARGET RNA. GAM633 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM633 RNA, herein designated GAM RNA, binds complementarily to one or more target binding sites located in untranslated regions of GAM633 target RNA, herein designated GAM TARGET RNA. This complementary binding is due to the fact that the nucleotide sequence of GAM633 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM633 RNA may have a different number of target binding sites in untranslated regions of a GAM633 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM633 RNA, herein designated GAM RNA, to target binding sites on GAM633 target RNA, herein designated GAM TARGET RNA, such as BINDING SITE I, BINDING SITE II and BINDING SITE III, inhibits translation of GAM633 target RNA into GAM633 target protein, herein designated GAM TARGET PROTEIN. GAM target protein is therefore outlined by a broken line.

It is appreciated that GAM633 target gene, herein designated TARGET GENE, in fact represents a plurality of GAM633 target genes. The mRNA of each one of this plurality of GAM633 target genes comprises one or more target binding sites, each having a nucleotide sequence which is at least partly complementary to GAM633 RNA, herein designated GAM RNA, and which when bound by GAM633 RNA causes inhibition of translation of respective one or more GAM633 target proteins.

It is further appreciated by one skilled in the art that the mode of translational inhibition illustrated by FIG. 8 with specific reference to translational inhibition exerted by GAM633 gene, herein designated GAM GENE, on one or more GAM633 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM633 correlate with, and may be deduced from, the identity of the target genes which GAM633 binds and inhibits, and the function of these target genes, as elaborated hereinbelow.

Adenylate cyclase 7 (ADCY7, Accession NM_001114.1) is a GAM633 target gene, herein designated TARGET GENE. ADCY7 BINDING SITE is a target binding site found in the 3' untranslated region of mRNA encoded by ADCY7, corresponding to a target binding site such as BINDING SITE I, BINDING SITE II or BINDING SITE III of FIG. 8. Table 4 illustrates the complementarity of the nucleotide sequences of ADCY7 BINDING SITE, designated SEQ ID:8228, to the nucleotide sequence of GAM633 RNA, herein designated GAM RNA, also designated SEQ ID:340.

A function of GAM633 is therefore inhibition of Adenylate cyclase 7 (ADCY7, Accession NM_001114.1), a gene which this a membrane- bound, ca(2+)-inhibitable adenylyl cyclase. Accordingly, utilities of GAM633 include diagnosis, prevention and treatment of diseases and clinical conditions associated with ADCY7.

The function of ADCY7 and its association with various diseases and clinical conditions, has been established by previous studies, as described hereinabove with reference to GAM75.1. KIAA1866 (Accession XM_027658.5) is another GAM633 target gene, herein designated TARGET GENE. KIAA1866 BINDING SITE is a target binding site found in the 3' untranslated region of mRNA encoded by KIAA1866, corresponding to a target binding site such as BINDING SITE I, BINDING SITE II or BINDING SITE III of FIG. 8. Table 4 illustrates the complementarity of the nucleotide sequences of KIAA1866 BINDING SITE, designated SEQ ID:3886, to the nucleotide sequence of GAM633 RNA, herein designated GAM RNA, also designated SEQ ID:340.

Another function of GAM633 is therefore inhibition of KIAA1866 (Accession XM_027658.5). Accordingly, utilities of GAM633 include diagnosis, prevention and treatment of diseases and clinical conditions associated with KIAA1866.

KIAA1879 (Accession XM_056635.4) is another GAM633 target gene, herein designated TARGET GENE. KIAA1879 BINDING SITE is a target binding site found in the 5' untranslated region of mRNA encoded by KIAA1879, corresponding to a target binding site such as BINDING SITE I, BINDING SITE II or BINDING SITE III of FIG. 8. Table 4 illustrates the complementarity of the nucleotide sequences of KIAA1879 BINDING SITE, designated SEQ ID:6010, to the nucleotide sequence of GAM633 RNA, herein designated GAM RNA, also designated SEQ ID:340.

Another function of GAM633 is therefore inhibition of KIAA1879 (Accession XM_056635.4). Accordingly, utilities of GAM633 include diagnosis, prevention and treatment of diseases and clinical conditions associated with KIAA1879.

LOC147178 (Accession) is another GAM633 target gene, herein designated TARGET GENE. LOC147178 BINDING SITE is a target binding site found in the 3' untranslated region of mRNA encoded by LOC147178, corresponding to a target binding site such as BINDING SITE I, BINDING SITE II or BINDING SITE III of FIG. 8. Table 4 illustrates the complementarity of the nucleotide sequences of LOC147178 BINDING SITE, designated SEQ ID:2676, to the nucleotide sequence of GAM633 RNA, herein designated GAM RNA, also designated SEQ ID:340.

Another function of GAM633 is therefore inhibition of LOC147178 (Accession). Accordingly, utilities of GAM633 include diagnosis, prevention and treatment of diseases and clinical conditions associated with LOC147178.

LOC157697 (Accession XM_291282.2) is another GAM633 target gene, herein designated TARGET GENE. LOC157697 BINDING SITE is a target binding site found in the 5' untranslated region of mRNA encoded by LOC157697, corresponding to a target binding site such as BINDING SITE I, BINDING SITE II or BINDING SITE III of FIG. 8. Table 4 illustrates the complementarity of the nucleotide sequences of LOC157697 BINDING SITE, designated SEQ ID:20176, to the nucleotide sequence of GAM633 RNA, herein designated GAM RNA, also designated SEQ ID:340.

Another function of GAM633 is therefore inhibition of LOC157697 (Accession XM_291282.2). Accordingly, utilities of GAM633 include diagnosis, prevention and treatment of diseases and clinical conditions associated with LOC157697.

FIG. 8 further provides a conceptual description of a novel bioinformatically detected of the present invention, referred to here as Genomic Address Messenger 895 (GAM895), which modulates expression of respective target genes thereof, the function and utility of which target genes is known in the art.

GAM895 is a novel bioinformatically detected regulatory, non protein coding, micro RNA (miRNA) gene. The method by which GAM895 was detected is described hereinabove with reference to FIGS. 8-15.

GAM895 gene, herein designated GAM GENE, and GAM895 target gene, herein designated TARGET GENE, are human genes contained in the human genome.

GAM895 gene encodes a GAM895 precursor RNA, herein designated GAM PRECURSOR RNA. Similar to other miRNA genes, and unlike most ordinary genes, GAM895 precursor RNA does not encode a protein. A nucleotide sequence identical or highly similar to the nucleotide sequence of GAM895 precursor RNA is designated SEQ ID:93, and is provided hereinbelow with reference to the sequence listing part. Nucleotide sequence SEQ ID:93 is located at position 93949146 relative to chromosome 11.

GAM895 precursor RNA folds onto itself, forming GAM895 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM895 precursor RNA folds onto itself, forming GAM895 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM895 precursor RNA, designated SEQ-ID:93, and a schematic representation of a predicted secondary folding of GAM895 folded precursor RNA are further described with reference to Table 2, hereby incorporated by reference.

An enzyme complex designated DICER COMPLEX, 'dices' the GAM895 folded precursor RNA into GAM895 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM895 RNA is designated SEQ ID:379, and is provided hereinbelow with references to the sequence listing part and Table 3, hereby incorporated by reference.

GAM895 target gene, herein designated TARGET GENE, encodes a corresponding messenger RNA, GAM895 target RNA, herein designated GAM TARGET RNA. GAM895 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM895 RNA, herein designated GAM RNA, binds complementarily to one or more target binding sites located in untranslated regions of GAM895 target RNA, herein designated GAM TARGET RNA. This complementary binding is due to the fact that the nucleotide sequence of GAM895 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM895 RNA may have a different number of target binding sites in untranslated regions of a GAM895 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM895 RNA, herein designated GAM RNA, to target binding sites on GAM895 target RNA, herein designated GAM TARGET RNA, such as BINDING SITE I, BINDING SITE II and BINDING SITE III, inhibits translation of GAM895 target RNA into GAM895 target protein, herein designated GAM TARGET PROTEIN. GAM target protein is therefore outlined by a broken line.

It is appreciated that GAM895 target gene, herein designated TARGET GENE, in fact represents a plurality of GAM895 target genes. The mRNA of each one of this plurality of GAM895 target genes comprises one or more target binding sites, each having a nucleotide sequence which is at least partly complementary to GAM895 RNA, herein designated GAM RNA, and which when bound by GAM895 RNA causes inhibition of translation of respective one or more GAM895 target proteins.

It is further appreciated by one skilled in the art that the mode of translational inhibition illustrated by FIG. 8 with specific reference to translational inhibition exerted by GAM895 gene, herein designated GAM GENE, on one or more GAM895 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM895 correlate with, and may be deduced from, the identity of the target genes which GAM895 binds and inhibits, and the function of these target genes, as elaborated hereinbelow.

Atp-binding cassette, sub-family a (abc1), member 1 (ABCA1, Accession NP_005493.2) is a GAM895 target gene, herein designated TARGET GENE. ABCA1 BINDING SITE is a target binding site found in the 3' untranslated region of mRNA encoded by ABCA1, corresponding to a target binding site such as BINDING SITE I, BINDING SITE II or BINDING SITE III of FIG. 8. Table 4 illustrates the complementarity of the nucleotide sequences of ABCA1 BINDING SITE, designated SEQ ID:2647, to the nucleotide sequence of GAM895 RNA, herein designated GAM RNA, also designated SEQ ID:379.

A function of GAM895 is therefore inhibition of Atp-binding cassette, sub-family a (abc1), member 1 (ABCA1, Accession NP_005493.2), a gene which camp-dependent and sulfonylurea-sensitive anion transporter. and therefore is associated with Tangier disease (high density lipoprotein deficiency type i). Accordingly, utilities of GAM895 include diagnosis, prevention and treatment of Tangier disease (high density lipoprotein deficiency type i), and of other diseases and clinical conditions associated with ABCA1.

The function of ABCA1 and its association with various diseases and clinical conditions, has been established by previous studies, as described hereinabove with reference to GAM94.1. AD034 (Accession NP_113668.2) is another GAM895 target gene, herein designated TARGET GENE. AD034 BINDING SITE is a target binding site found in the 3' untranslated region of multiple transcripts of mRNA encoded by AD034, corresponding to a target binding site such as BINDING SITE I, BINDING SITE II or BINDING SITE III of FIG. 8. Table 4 illustrates the complementarity of the nucleotide sequences of AD034 BINDING SITE, designated SEQ ID:5799, to the nucleotide sequence of GAM895 RNA, herein designated GAM RNA, also designated SEQ ID:379.

Another function of GAM895 is therefore inhibition of AD034 (Accession NP_113668.2). Accordingly, utilities of GAM895 include diagnosis, prevention and treatment of diseases and clinical conditions associated with AD034.

AD034 (Accession NP_694550.1) is another GAM895 target gene, herein designated TARGET GENE. AD034 BINDING SITE is a target binding site found in the 3' untranslated region of multiple transcripts of mRNA encoded by AD034, corresponding to a target binding site such as BINDING SITE I, BINDING SITE II or BINDING SITE III of FIG. 8. Table 4 illustrates the complementarity of the nucleotide sequences of AD034 BINDING SITE, designated SEQ ID:5799, to the nucleotide sequence of GAM895 RNA, herein designated GAM RNA, also designated SEQ ID:379.

Another function of GAM895 is therefore inhibition of AD034 (Accession NP_694550.1). Accordingly, utilities of GAM895 include diagnosis, prevention and treatment of diseases and clinical conditions associated with AD034.

Aprataxin (APTX, Accession NP_778242.1) is another GAM895 target gene, herein designated TARGET GENE. APTX BINDING SITE is a target binding site found in the 5' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:11308, to the nucleotide sequence of GAM895 RNA, herein designated GAM RNA, also designated SEQ ID:379.

Another function of GAM895 is therefore inhibition of Aprataxin (APTX, Accession NP_778242.1). Accordingly, utilities of GAM895 include diagnosis, prevention and treatment of diseases and clinical conditions associated with APTX.

Cdc42 guanine nucleotide exchange factor (gef) 9 (ARHGEF9, Accession NP_056000.1) is another GAM895 target gene, herein designated TARGET GENE. ARHGEF9 BINDING SITE is a target binding site found in the 3' untranslated region of mRNA encoded by ARHGEF9, corresponding to a target binding site such as BINDING SITE I, BINDING SITE II or BINDING SITE III of FIG. 8. Table 4 illustrates the complementarity of the nucleotide sequences of ARHGEF9 BINDING SITE, designated SEQ ID:3229, to the nucleotide sequence of GAM895 RNA, herein designated GAM RNA, also designated SEQ ID:379.

Another function of GAM895 is therefore inhibition of Cdc42 guanine nucleotide exchange factor (gef) 9 (ARHGEF9, Accession NP_056000.1). Accordingly, utilities of GAM895 include diagnosis, prevention and treatment of diseases and clinical conditions associated with ARHGEF9.

Actin related protein 2/3 complex, subunit 5, 16 kda (ARPC5, Accession NP_005708.1) is another GAM895 target gene, herein designated TARGET GENE. ARPC5 BINDING SITE is a target binding site found in the 3' untranslated region of mRNA encoded by ARPC5, corresponding to a target binding site such as BINDING SITE I, BINDING SITE II or BINDING SITE III of FIG. 8. Table 4 illustrates the complementarity of the nucleotide sequences of ARPC5 BINDING SITE, designated SEQ ID:3112, to the nucleotide sequence of GAM895 RNA, herein designated GAM RNA, also designated SEQ ID:379.

Another function of GAM895 is therefore inhibition of Actin related protein 2/3 complex, subunit 5, 16 kda (ARPC5, Accession NP_005708.1). Accordingly, utilities of GAM895 include diagnosis, prevention and treatment of diseases and clinical conditions associated with ARPC5.

b5+b5R (Accession NP_057314.1) is another GAM895 target gene, herein designated TARGET GENE. b5+b5R BINDING SITE is a target binding site found in the 3' untranslated region of mRNA encoded by b5+b5R, corresponding to a target binding site such as BINDING SITE I, BINDING SITE II or BINDING SITE III of FIG. 8. Table 4 illustrates the complementarity of the nucleotide sequences of b5+b5R BINDING SITE, designated SEQ ID:14738, to the nucleotide sequence of GAM895 RNA, herein designated GAM RNA, also designated SEQ ID:379.

Another function of GAM895 is therefore inhibition of b5+b5R (Accession NP_057314.1). Accordingly, utilities of GAM895 include diagnosis, prevention and treatment of diseases and clinical conditions associated with b5+b5R.

Baculoviral iap repeat-containing 5 (survivin) (BIRC5, Accession NP_001159.1) is another GAM895 target gene, herein designated TARGET GENE. BIRC5 BINDING SITE is a target binding site found in the 3' untranslated region of mRNA encoded by BIRC5, corresponding to a target binding site such as BINDING SITE I, BINDING SITE II or BINDING SITE III of FIG. 8. Table 4 illustrates the complementarity of the nucleotide sequences of BIRC5 BINDING SITE, designated SEQ ID:19223, to the nucleotide sequence of GAM895 RNA, herein designated GAM RNA, also designated SEQ ID:379.

Another function of GAM895 is therefore inhibition of Baculoviral iap repeat-containing 5 (survivin) (BIRC5, Accession NP_001159.1). Accordingly, utilities of GAM895 include diagnosis, prevention and treatment of diseases and clinical conditions associated with BIRC5.

Basonuclin (BNC, Accession NP_001708.2) is another GAM895 target gene, herein designated TARGET GENE. BNC BINDING SITE is a target binding site found in the 3' untranslated region of mRNA encoded by BNC, corresponding to a target binding site such as BINDING SITE I, BINDING SITE II or BINDING SITE III of FIG. 8. Table 4 illustrates the complementarity of the nucleotide sequences of BNC BINDING SITE, designated SEQ ID:19010, to the nucleotide sequence of GAM895 RNA, herein designated GAM RNA, also designated SEQ ID:379.

Another function of GAM895 is therefore inhibition of Basonuclin (BNC, Accession NP_001708.2), a gene which plays a role in the maintenance of proliferative capacity and prevention of terminal differentiation of keratinocytes. Accordingly, utilities of GAM895 include diagnosis, prevention and treatment of diseases and clinical conditions associated with BNC.

The function of BNC and its association with various diseases and clinical conditions, has been established by previous studies, as described hereinabove with reference to GAM427.1. C13orf18 (Accession NP_079389.1) is another GAM895 target gene, herein designated TARGET GENE. C13orf18 BINDING SITE is a target binding site found in the 3' untranslated region of mRNA encoded by C13orf18, corresponding to a target binding site such as BINDING SITE I, BINDING SITE II or BINDING SITE III of FIG. 8. Table 4 illustrates the complementarity of the nucleotide sequences of C13orf18 BINDING SITE, designated SEQ ID:10373, to the nucleotide sequence of GAM895 RNA, herein designated GAM RNA, also designated SEQ ID:379.

Another function of GAM895 is therefore inhibition of C13orf18 (Accession NP_079389.1). Accordingly, utilities of GAM895 include diagnosis, prevention and treatment of diseases and clinical conditions associated with C13orf18.

Calcium-binding tyrosine-(y)-phosphorylation regulated (fibrousheathin 2) (CABy, Accession NP_036321.2) is another GAM895 target gene, herein designated TARGET GENE. CABYR BINDING SITE is a target binding site found in the 5' untranslated region of multiple transcripts of mRNA encoded by CABy, corresponding to a target binding site such as BINDING SITE I, BINDING SITE II or BINDING SITE III of FIG. 8. Table 4 illustrates the complementarity of the nucleotide sequences of CABYR BINDING SITE, designated SEQ ID:16855, to the nucleotide sequence of GAM895 RNA, herein designated GAM RNA, also designated SEQ ID:379.

Another function of GAM895 is therefore inhibition of Calcium-binding tyrosine-(y)-phosphorylation regulated (fibrousheathin 2) (CABy, Accession NP_036321.2). Accordingly, utilities of GAM895 include diagnosis, prevention and treatment of diseases and clinical conditions associated with CABYR.

Calcium-binding tyrosine-(y)-phosphorylation regulated (fibrousheathin 2) (CABy, Accession NP_722453.1) is another GAM895 target gene, herein designated TARGET GENE. CABYR BINDING SITE is a target binding site found in the 5' untranslated region of multiple transcripts of mRNA encoded by CABy, corresponding to a target binding site such as BINDING SITE I, BINDING SITE II or BINDING SITE III of FIG. 8. Table 4 illustrates the complementarity of the nucleotide sequences of CABYR BINDING SITE, designated SEQ ID:16855, to the nucleotide sequence of GAM895 RNA, herein designated GAM RNA, also designated SEQ ID:379.

Another function of GAM895 is therefore inhibition of Calcium-binding tyrosine-(y)-phosphorylation regulated (fibrousheathin 2) (CABy, Accession NP_722453.1). Accordingly, utilities of GAM895 include diagnosis, prevention and treatment of diseases and clinical conditions associated with CABYR.

Calcium-binding tyrosine-(y)-phosphorylation regulated (fibrousheathin 2) (CABy, Accession NP_722452.1) is another GAM895 target gene, herein designated TARGET GENE. CABYR BINDING SITE is a target binding site found in the 5' untranslated region of multiple transcripts of mRNA encoded by CABy, corresponding to a target binding site such as BINDING SITE I, BINDING SITE II or BINDING SITE III of FIG. 8. Table 4 illustrates the complementarity of the nucleotide sequences of CABYR BINDING SITE, designated SEQ ID:16855, to the nucleotide sequence of GAM895 RNA, herein designated GAM RNA, also designated SEQ ID:379.

Another function of GAM895 is therefore inhibition of Calcium-binding tyrosine-(y)-phosphorylation regulated (fibrousheathin 2) (CABy, Accession NP_722452.1). Accordingly, utilities of GAM895 include diagnosis, prevention and treatment of diseases and clinical conditions associated with CABYR.

Calcium-binding tyrosine-(y)-phosphorylation regulated (fibrousheathin 2) (CABy, Accession NP_722454.1) is another GAM895 target gene, herein designated TARGET GENE. CABYR BINDING SITE is a target binding site found in the 5' untranslated region of multiple transcripts of mRNA encoded by CABy, corresponding to a target binding site such as BINDING SITE I, BINDING SITE II or BINDING SITE III of FIG. 8. Table 4 illustrates the complementarity of the nucleotide sequences of CABYR BINDING SITE, designated SEQ ID:16855, to the nucleotide sequence of GAM895 RNA, herein designated GAM RNA, also designated SEQ ID:379.

Another function of GAM895 is therefore inhibition of Calcium-binding tyrosine-(y)-phosphorylation regulated (fibrousheathin 2) (CABy, Accession NP_722454.1). Accordingly, utilities of GAM895 include diagnosis, prevention and treatment of diseases and clinical conditions associated with CABYR.

Calcium-binding tyrosine-(y)-phosphorylation regulated (fibrousheathin 2) (CABy, Accession NP_619585.1) is another GAM895 target gene, herein designated TARGET GENE. CABYR BINDING SITE is a target binding site found in the 5' untranslated region of multiple transcripts of mRNA encoded by CABy, corresponding to a target binding site such as BINDING SITE I, BINDING SITE II or BINDING SITE III of FIG. 8. Table 4 illustrates the complementarity of the nucleotide sequences of CABYR BINDING SITE, designated SEQ ID:16855, to the nucleotide sequence of GAM895 RNA, herein designated GAM RNA, also designated SEQ ID:379.

Another function of GAM895 is therefore inhibition of Calcium-binding tyrosine-(y)-phosphorylation regulated (fibrousheathin 2) (CABy, Accession NP_619585.1). Accordingly, utilities of GAM895 include diagnosis, prevention and treatment of diseases and clinical conditions associated with CABYR.

Calmodulin 1 (phosphorylase kinase, delta) (CALM1, Accession NP_008819.1) is another GAM895 target gene, herein designated TARGET GENE. CALM1 BINDING SITE is a target binding site found in the 3' untranslated region of mRNA encoded by CALM1, corresponding to a target binding site such as BINDING SITE I, BINDING SITE II or BINDING SITE III of FIG. 8. Table 4 illustrates the complementarity of the nucleotide sequences of CALM1 BINDING SITE, designated SEQ ID:10029, to the nucleotide sequence of GAM895 RNA, herein designated GAM RNA, also designated SEQ ID:379.

Another function of GAM895 is therefore inhibition of Calmodulin 1 (phosphorylase kinase, delta) (CALM1, Accession NP_008819.1), a gene which plays roles in growth and the cell cycle as well as in signal transduction and the synthesis and release of neurotransmitters. Accordingly, utilities of GAM895 include diagnosis, prevention and treatment of diseases and clinical conditions associated with CALM1.

The function of CALM1 and its association with various diseases and clinical conditions, has been established by previous studies, as described hereinabove with reference to GAM180.1. Chromodomain protein, y chromosome-like (CDy, Accession NP_004815.2) is another GAM895 target gene, herein designated TARGET GENE. CDYL BINDING SITE is a target binding site found in the 3' untranslated region of multiple transcripts of mRNA encoded by CDy, corresponding to a target binding site such as BINDING SITE I, BINDING SITE II or BINDING SITE III of FIG. 8. Table 4 illustrates the complementarity of the nucleotide sequences of CDYL BINDING SITE, designated SEQ ID:11324, to the nucleotide sequence of GAM895 RNA, herein designated GAM RNA, also designated SEQ ID:379.

Another function of GAM895 is therefore inhibition of Chromodomain protein, y chromosome-like (CDy, Accession NP_004815.2). Accordingly, utilities of GAM895 include diagnosis, prevention and treatment of diseases and clinical conditions associated with CDYL.

Chromodomain protein, y chromosome-like (CDy, Accession NP_736608.1) is another GAM895 target gene, herein designated TARGET GENE. CDYL BINDING SITE is a target binding site found in the 3' untranslated region of multiple transcripts of mRNA encoded by CDy, corresponding to a target binding site such as BINDING SITE I, BINDING SITE II or BINDING SITE III of FIG. 8. Table 4 illustrates the complementarity of the nucleotide sequences of CDYL BINDING SITE, designated SEQ ID:11324, to the nucleotide sequence of GAM895 RNA, herein designated GAM RNA, also designated SEQ ID:379.

Another function of GAM895 is therefore inhibition of Chromodomain protein, y chromosome-like (CDy, Accession NP_736608.1). Accordingly, utilities of GAM895 include diagnosis, prevention and treatment of diseases and clinical conditions associated with CDYL.

Chromodomain protein, y chromosome-like (CDy, Accession NP_736607.1) is another GAM895 target gene, herein designated TARGET GENE. CDYL BINDING SITE is a target binding site found in the 3' untranslated region of multiple transcripts of mRNA encoded by CDy, corresponding to a target binding site such as BINDING SITE I, BINDING SITE II or BINDING SITE III of FIG. 8. Table 4 illustrates the complementarity of the nucleotide sequences of CDYL BINDING SITE, designated SEQ ID:11324, to the nucleotide sequence of GAM895 RNA, herein designated GAM RNA, also designated SEQ ID:379.

Another function of GAM895 is therefore inhibition of Chromodomain protein, y chromosome-like (CDy, Accession NP_736607.1). Accordingly, utilities of GAM895 include diagnosis, prevention and treatment of diseases and clinical conditions associated with CDYL.

CGI-141 (Accession NP_057156.1) is another GAM895 target gene, herein designated TARGET GENE. CGI-141 BINDING SITE is a target binding site found in the 3' untranslated region of mRNA encoded by CGI-141, corresponding to a target binding site such as BINDING SITE I, BINDING SITE II or BINDING SITE III of FIG. 8. Table 4 illustrates the complementarity of the nucleotide sequences of CGI-141 BINDING SITE, designated SEQ ID:12491, to the nucleotide sequence of GAM895 RNA, herein designated GAM RNA, also designated SEQ ID:379.

Another function of GAM895 is therefore inhibition of CGI-141 (Accession NP_057156.1). Accordingly, utilities of GAM895 include diagnosis, prevention and treatment of diseases and clinical conditions associated with CGI-141.

Contactin 3 (plasmacytoma associated) (CNTN3, Accession XP_039627.7) is another GAM895 target gene, herein designated TARGET GENE. CNTN3 BINDING SITE is a target binding site found in the 3' untranslated region of mRNA encoded by CNTN3, corresponding to a target binding site such as BINDING SITE I, BINDING SITE II or BINDING SITE III of FIG. 8. Table 4 illustrates the complementarity of the nucleotide sequences of CNTN3 BINDING SITE, designated SEQ ID:19069, to the nucleotide sequence of GAM895 RNA, herein designated GAM RNA, also designated SEQ ID:379.

Another function of GAM895 is therefore inhibition of Contactin 3 (plasmacytoma associated) (CNTN3, Accession XP_039627.7), a gene which may play a role in the initial growth and guidance of axons. and therefore may be associated with Plasmacytomas. Accordingly, utilities of GAM895 include diagnosis, prevention and treatment of Plasmacytomas, and of other diseases and clinical conditions associated with CNTN3.

The function of CNTN3 and its association with various diseases and clinical conditions, has been established by previous studies, as described hereinabove with reference to GAM55.2. CPR8 (Accession NP_065790.1) is another GAM895 target gene, herein designated TARGET GENE. CPR8 BINDING SITE1 and CPR8 BINDING SITE2 are target binding sites found in untranslated regions of multiple transcripts of mRNA encoded by CPR8, corresponding to target binding sites such as BINDING SITE I, BINDING SITE II or BINDING SITE III of FIG. 8. Table 4 illustrates the complementarity of the nucleotide sequences of CPR8 BINDING SITE1 and CPR8 BINDING SITE2, designated SEQ ID:9187 and SEQ ID:1778 respectively, to the nucleotide sequence of GAM895 RNA, herein designated GAM RNA, also designated SEQ ID:379.

Another function of GAM895 is therefore inhibition of CPR8 (Accession NP_065790.1). Accordingly, utilities of GAM895 include diagnosis, prevention and treatment of diseases and clinical conditions associated with CPR8.

Camp responsive element binding protein-like 2 (CREBL2, Accession NP_001301.1) is another GAM895 target gene, herein designated TARGET GENE. CREBL2 BINDING SITE is a target binding site found in the 3' untranslated region of mRNA encoded by CREBL2, corresponding to a target binding site such as BINDING SITE I, BINDING SITE II or BINDING SITE III of FIG. 8. Table 4 illustrates the complementarity of the nucleotide sequences of CREBL2 BINDING SITE, designated SEQ ID:14613, to the nucleotide sequence of GAM895 RNA, herein designated GAM RNA, also designated SEQ ID:379.

Another function of GAM895 is therefore inhibition of Camp responsive element binding protein-like 2 (CREBL2, Accession NP_001301.1) . Accordingly, utilities of GAM895 include diagnosis, prevention and treatment of diseases and clinical conditions associated with CREBL2.

DKFZp761B107 (Accession NP_775734.1) is another GAM895 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:10303, to the nucleotide sequence of GAM895 RNA, herein designated GAM RNA, also designated SEQ ID:379.

Another function of GAM895 is therefore inhibition of DKFZp761B107 (Accession NP_775734.1). Accordingly, utilities of GAM895 include diagnosis, prevention and treatment of diseases and clinical conditions associated with DKFZp761B107.

Edar-associated death domain (EDARADD, Accession NP_542776.1) is another GAM895 target gene, herein designated TARGET GENE. EDARADD BINDING SITE is a target binding site found in the 3' untranslated region of multiple transcripts of mRNA encoded by EDARADD, corresponding to a target binding site such as BINDING SITE I, BINDING SITE II or BINDING SITE III of FIG. 8. Table 4 illustrates the complementarity of the nucleotide sequences of EDARADD BINDING SITE, designated SEQ ID:18853, to the nucleotide sequence of GAM895 RNA, herein designated GAM RNA, also designated SEQ ID:379.

Another function of GAM895 is therefore inhibition of Edar-associated death domain (EDARADD, Accession NP_542776.1). Accordingly, utilities of GAM895 include diagnosis, prevention and treatment of diseases and clinical conditions associated with EDARADD.

Edar-associated death domain (EDARADD, Accession NP_665860.1) is another GAM895 target gene, herein designated TARGET GENE. EDARADD BINDING SITE is a target binding site found in the 3' untranslated region of multiple transcripts of mRNA encoded by EDARADD, corresponding to a target binding site such as BINDING SITE I, BINDING SITE II or BINDING SITE III of FIG. 8. Table 4 illustrates the complementarity of the nucleotide sequences of EDARADD BINDING SITE, designated SEQ ID:18853, to the nucleotide sequence of GAM895 RNA, herein designated GAM RNA, also designated SEQ ID:379.

Another function of GAM895 is therefore inhibition of Edar-associated death domain (EDARADD, Accession NP_665860.1). Accordingly, utilities of GAM895 include diagnosis, prevention and treatment of diseases and clinical conditions associated with EDARADD.

EEF2K (Accession NP_037434.1) is another GAM895 target gene, herein designated TARGET GENE. EEF2K BINDING SITE is a target binding site found in the 3' untranslated region of mRNA encoded by EEF2K, corresponding to a target binding site such as BINDING SITE I, BINDING SITE II or BINDING SITE III of FIG. 8. Table 4 illustrates the complementarity of the nucleotide sequences of EEF2K BINDING SITE, designated SEQ ID:3811, to the nucleotide sequence of GAM895 RNA, herein designated GAM RNA, also designated SEQ ID:379.

Another function of GAM895 is therefore inhibition of EEF2K (Accession NP_037434.1), a gene which phosphorylates serine or threonine on the eukaryotic elongation factor-2 and therefore may be associated with Systemic lupus erythematosus and cancer. Accordingly, utilities of GAM895 include diagnosis, prevention and treatment of Systemic lupus erythematosus and cancer, and of other diseases and clinical conditions associated with EEF2K.

The function of EEF2K and its association with various diseases and clinical conditions, has been established by previous studies, as described hereinabove with reference to GAM189.1. EXO70 (Accession NP_056034.1) is another GAM895 target gene, herein designated TARGET GENE. EXO70 BINDING SITE is a target binding site found in the 3' untranslated region of mRNA encoded by EXO70, corresponding to a target binding site such as BINDING SITE I, BINDING SITE II or BINDING SITE III of FIG. 8. Table 4 illustrates the complementarity of the nucleotide sequences of EXO70 BINDING SITE, designated SEQ ID:16998, to the nucleotide sequence of GAM895 RNA, herein designated GAM RNA, also designated SEQ ID:379.

Another function of GAM895 is therefore inhibition of EXO70 (Accession NP_056034.1). Accordingly, utilities of GAM895 include diagnosis, prevention and treatment of diseases and clinical conditions associated with EXO70.

Fatty acid binding protein 7, brain (FABP7, Accession NP_001437.1) is another GAM895 target gene, herein designated TARGET GENE. FABP7 BINDING SITE is a target binding site found in the 3' untranslated region of mRNA encoded by FABP7, corresponding to a target binding site such as BINDING SITE I, BINDING SITE II or BINDING SITE III of FIG. 8. Table 4 illustrates the complementarity of the nucleotide sequences of FABP7 BINDING SITE, designated SEQ ID:14375, to the nucleotide sequence of GAM895 RNA, herein designated GAM RNA, also designated SEQ ID:379.

Another function of GAM895 is therefore inhibition of Fatty acid binding protein 7, brain (FABP7, Accession NP_001437.1). Accordingly, utilities of GAM895 include diagnosis, prevention and treatment of diseases and clinical conditions associated with FABP7.

Fc fragment of igg, low affinity iiib, receptor for (cd16) (FCGR3B, Accession NP_000561.1) is another GAM895 target gene, herein designated TARGET GENE. FCGR3B BINDING SITE is a target binding site found in the 5' untranslated region of mRNA encoded by FCGR3B, corresponding to a target binding site such as BINDING SITE I, BINDING SITE II or BINDING SITE III of FIG. 8. Table 4 illustrates the complementarity of the nucleotide sequences of FCGR3B BINDING SITE, designated SEQ ID:12304, to the nucleotide sequence of GAM895 RNA, herein designated GAM RNA, also designated SEQ ID:379.

Another function of GAM895 is therefore inhibition of Fc fragment of igg, low affinity iiib, receptor for (cd16) (FCGR3B, Accession NP_000561.1). Accordingly, utilities of GAM895 include diagnosis, prevention and treatment of diseases and clinical conditions associated with FCGR3B.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075259.1) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075259.1). Accordingly, utilities of GAM895 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075418.1) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075418.1). Accordingly, utilities of GAM895 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075264.2) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075264.2). Accordingly, utilities of GAM895 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075261.1) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075261.1). Accordingly, utilities of GAM895 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075258.1) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075258.1). Accordingly, utilities of GAM895 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075420.1) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075420.1). Accordingly, utilities of GAM895 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075419.1) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075419.1). Accordingly, utilities of GAM895 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075417.1) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075417.1). Accordingly, utilities of GAM895 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_000132.1) is another GAM895 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:7425, to the nucleotide sequence of GAM895 RNA, herein designated GAM RNA, also designated SEQ ID:379.

Another function of GAM895 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_000132.1). Accordingly, utilities of GAM895 include diagnosis, prevention and treatment of diseases and clinical conditions associated with FGFR2.

Formin homology 2 domain containing 2 (FHOD2, Accession XP_057927.2) is another GAM895 target gene, herein designated TARGET GENE. FHOD2 BINDING SITE is a target binding site found in the 3' untranslated region of mRNA encoded by FHOD2, corresponding to a target binding site such as BINDING SITE I, BINDING SITE II or BINDING SITE III of FIG. 8. Table 4 illustrates the complementarity of the nucleotide sequences of FHOD2 BINDING SITE, designated SEQ ID:19209, to the nucleotide sequence of GAM895 RNA, herein designated GAM RNA, also designated SEQ ID:379.

Another function of GAM895 is therefore inhibition of Formin homology 2 domain containing 2 (FHOD2, Accession XP_057927.2). Accordingly, utilities of GAM895 include diagnosis, prevention and treatment of diseases and clinical conditions associated with FHOD2.

FLJ10298 (Accession NP_060520.2) is another GAM895 target gene, herein designated TARGET GENE. FLJ10298 BINDING SITE is a target binding site found in the 5' untranslated region of mRNA encoded by FLJ10298, corresponding to a target binding site such as BINDING SITE I, BINDING SITE II or BINDING SITE III of FIG. 8. Table 4 illustrates the complementarity of the nucleotide sequences of FLJ10298 BINDING SITE, designated SEQ ID:8638, to the nucleotide sequence of GAM895 RNA, herein designated GAM RNA, also designated SEQ ID:379.

Another function of GAM895 is therefore inhibition of FLJ10298 (Accession NP_060520.2). Accordingly, utilities of GAM895 include diagnosis, prevention and treatment of diseases and clinical conditions associated with FLJ10298.

FLJ12747 (Accession XP_290972.1) is another GAM895 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:19622, to the nucleotide sequence of GAM895 RNA, herein designated GAM RNA, also designated SEQ ID:379.

Another function of GAM895 is therefore inhibition of FLJ12747 (Accession XP_290972.1). Accordingly, utilities of GAM895 include diagnosis, prevention and treatment of diseases and clinical conditions associated with FLJ12747.

FLJ20360 (Accession NP_060252.1) is another GAM895 target gene, herein designated TARGET GENE. FLJ20360 BINDING SITE is a target binding site found in the 3' untranslated region of mRNA encoded by FLJ20360, corresponding to a target binding site such as BINDING SITE I, BINDING SITE II or BINDING SITE III of FIG. 8. Table 4 illustrates the complementarity of the nucleotide sequences of FLJ20360 BINDING SITE, designated SEQ ID:6214, to the nucleotide sequence of GAM895 RNA, herein designated GAM RNA, also designated SEQ ID:379.

Another function of GAM895 is therefore inhibition of FLJ20360 (Accession NP_060252.1). Accordingly, utilities of GAM895 include diagnosis, prevention and treatment of diseases and clinical conditions associated with FLJ20360.

FLJ20671 (Accession NP_060394.1) is another GAM895 target gene, herein designated TARGET GENE. FLJ20671 BINDING SITE is a target binding site found in the 3' untranslated region of mRNA encoded by FLJ20671, corresponding to a target binding site such as BINDING SITE I, BINDING SITE II or BINDING SITE III of FIG. 8. Table 4 illustrates the complementarity of the nucleotide sequences of FLJ20671 BINDING SITE, designated SEQ ID:14149, to the nucleotide sequence of GAM895 RNA, herein designated GAM RNA, also designated SEQ ID:379.

Another function of GAM895 is therefore inhibition of FLJ20671 (Accession NP_060394.1). Accordingly, utilities of GAM895 include diagnosis, prevention and treatment of diseases and clinical conditions associated with FLJ20671.

FLJ20719 (Accession NP_060410.1) is another GAM895 target gene, herein designated TARGET GENE. FLJ20719 BINDING SITE is a target binding site found in the 5' untranslated region of mRNA encoded by FLJ20719, corresponding to a target binding site such as BINDING SITE I, BINDING SITE II or BINDING SITE III of FIG. 8. Table 4 illustrates the complementarity of the nucleotide sequences of FLJ20719 BINDING SITE, designated SEQ ID:17227, to the nucleotide sequence of GAM895 RNA, herein designated GAM RNA, also designated SEQ ID:379.

Another function of GAM895 is therefore inhibition of FLJ20719 (Accession NP_060410.1). Accordingly, utilities of GAM895 include diagnosis, prevention and treatment of diseases and clinical conditions associated with FLJ20719.

FLJ23053 (Accession NP_075058.1) is another GAM895 target gene, herein designated TARGET GENE. FLJ23053 BINDING SITE is a target binding site found in the 3' untranslated region of mRNA encoded by FLJ23053, corresponding to a target binding site such as BINDING SITE I, BINDING SITE II or BINDING SITE III of FIG. 8. Table 4 illustrates the complementarity of the nucleotide sequences of FLJ23053 BINDING SITE, designated SEQ ID:3463, to the nucleotide sequence of GAM895 RNA, herein designated GAM RNA, also designated SEQ ID:379.

Another function of GAM895 is therefore inhibition of FLJ23053 (Accession NP_075058.1). Accordingly, utilities of GAM895 include diagnosis, prevention and treatment of diseases and clinical conditions associated with FLJ23053.

Fbj murine osteosarcoma viral oncogene homolog b (FOSB, Accession NP_006723.1) is another GAM895 target gene, herein designated TARGET GENE. FOSB BINDING SITE is a target binding site found in the 3' untranslated region of mRNA encoded by FOSB, corresponding to a target binding site such as BINDING SITE I, BINDING SITE II or BINDING SITE III of FIG. 8. Table 4 illustrates the complementarity of the nucleotide sequences of FOSB BINDING SITE, designated SEQ ID:13889, to the nucleotide sequence of GAM895 RNA, herein designated GAM RNA, also designated SEQ ID:379.

Another function of GAM895 is therefore inhibition of Fbj murine osteosarcoma viral oncogene homolog b (FOSB, Accession NP_006723.1), a gene which interacts with jun proteins enhancing their dna binding activity. and therefore may be associated with Cocaine addiction. Accordingly, utilities of GAM895 include diagnosis, prevention and treatment of Cocaine addiction, and of other diseases and clinical conditions associated with FOSB.

The function of FOSB and its association with various diseases and clinical conditions, has been established by previous studies, as described hereinabove with reference to GAM53.1. Forkhead box a1 (FOXA1, Accession NP_004487.2) is another GAM895 target gene, herein designated TARGET GENE. FOXA1 BINDING SITE is a target binding site found in the 3' untranslated region of mRNA encoded by FOXA1, corresponding to a target binding site such as BINDING SITE I, BINDING SITE II or BINDING SITE III of FIG. 8. Table 4 illustrates the complementarity of the nucleotide sequences of FOXA1 BINDING SITE, designated SEQ ID:19373, to the nucleotide sequence of GAM895 RNA, herein designated GAM RNA, also designated SEQ ID:379.

Another function of GAM895 is therefore inhibition of Forkhead box a1 (FOXA1, Accession NP_004487.2). Accordingly, utilities of GAM895 include diagnosis, prevention and treatment of diseases and clinical conditions associated with FOXA1.

Forkhead box d4 (FOXD4, Accession XP_095746.6) is another GAM895 target gene, herein designated TARGET GENE. FOXD4 BINDING SITE is a target binding site found in the 5' untranslated region of mRNA encoded by FOXD4, corresponding to a target binding site such as BINDING SITE I, BINDING SITE II or BINDING SITE III of FIG. 8. Table 4 illustrates the complementarity of the nucleotide sequences of FOXD4 BINDING SITE, designated SEQ ID:5668, to the nucleotide sequence of GAM895 RNA, herein designated GAM RNA, also designated SEQ ID:379.

Another function of GAM895 is therefore inhibition of Forkhead box d4 (FOXD4, Accession XP_095746.6). Accordingly, utilities of GAM895 include diagnosis, prevention and treatment of diseases and clinical conditions associated with FOXD4.

Fucose-1-phosphate guanylyltransferase (FPGT, Accession NP_003829.1) is another GAM895 target gene, herein designated TARGET GENE. FPGT BINDING SITE is a target binding site found in the 3' untranslated region of mRNA encoded by FPGT, corresponding to a target binding site such as BINDING SITE I, BINDING SITE II or BINDING SITE III of FIG. 8. Table 4 illustrates the complementarity of the nucleotide sequences of FPGT BINDING SITE, designated SEQ ID:17275, to the nucleotide sequence of GAM895 RNA, herein designated GAM RNA, also designated SEQ ID:379.

Another function of GAM895 is therefore inhibition of Fucose-1-phosphate guanylyltransferase (FPGT, Accession NP_003829.1). Accordingly, utilities of GAM895 include diagnosis, prevention and treatment of diseases and clinical conditions associated with FPGT.

HIST2H2BE (Accession NP_003519.1) is another GAM895 target gene, herein designated TARGET GENE. HIST2H2BE BINDING SITE is a target binding site found in the 3' untranslated region of mRNA encoded by HIST2H2BE, corresponding to a target binding site such as BINDING SITE I, BINDING SITE II or BINDING SITE III of FIG. 8. Table 4 illustrates the complementarity of the nucleotide sequences of HIST2H2BE BINDING SITE, designated SEQ ID:7494, to the nucleotide sequence of GAM895 RNA, herein designated GAM RNA, also designated SEQ ID:379.

Another function of GAM895 is therefore inhibition of HIST2H2BE (Accession NP_003519.1). Accordingly, utilities of GAM895 include diagnosis, prevention and treatment of diseases and clinical conditions associated with HIST2H2BE.

Hippocalcin like 4 (HPCAL4, Accession NP_057341.1) is another GAM895 target gene, herein designated TARGET GENE. HPCAL4 BINDING SITE is a target binding site found in the 3' untranslated region of mRNA encoded by HPCAL4, corresponding to a target binding site such as BINDING SITE I, BINDING SITE II or BINDING SITE III of FIG. 8. Table 4 illustrates the complementarity of the nucleotide sequences of HPCAL4 BINDING SITE, designated SEQ ID:11696, to the nucleotide sequence of GAM895 RNA, herein designated GAM RNA, also designated SEQ ID:379.

Another function of GAM895 is therefore inhibition of Hippocalcin like 4 (HPCAL4, Accession NP_057341.1). Accordingly, utilities of GAM895 include diagnosis, prevention and treatment of diseases and clinical conditions associated with HPCAL4.

Interferon regulatory factor 5 (IRF5, Accession NP_002191.1) is another GAM895 target gene, herein designated TARGET GENE. IRF5 BINDING SITE is a target binding site found in the 3' untranslated region of multiple transcripts of mRNA encoded by IRF5, corresponding to a target binding site such as BINDING SITE I, BINDING SITE II or BINDING SITE III of FIG. 8. Table 4 illustrates the complementarity of the nucleotide sequences of IRF5 BINDING SITE, designated SEQ ID:4930, to the nucleotide sequence of GAM895 RNA, herein designated GAM RNA, also designated SEQ ID:379.

Another function of GAM895 is therefore inhibition of Interferon regulatory factor 5 (IRF5, Accession NP_002191.1). Accordingly, utilities of GAM895 include diagnosis, prevention and treatment of diseases and clinical conditions associated with IRF5.

Interferon regulatory factor 5 (IRF5, Accession NP_116032.1) is another GAM895 target gene, herein designated TARGET GENE. IRF5 BINDING SITE is a target binding site found in the 3' untranslated region of multiple transcripts of mRNA encoded by IRF5, corresponding to a target binding site such as BINDING SITE I, BINDING SITE II or BINDING SITE III of FIG. 8. Table 4 illustrates the complementarity of the nucleotide sequences of IRF5 BINDING SITE, designated SEQ ID:4930, to the nucleotide sequence of GAM895 RNA, herein designated GAM RNA, also designated SEQ ID:379.

Another function of GAM895 is therefore inhibition of Interferon regulatory factor 5 (IRF5, Accession NP_116032.1). Accordingly, utilities of GAM895 include diagnosis, prevention and treatment of diseases and clinical conditions associated with IRF5.

Potassium voltage-gated channel, shaker-related subfamily, beta member 1 (KCNAB1, Accession NP_003462.2) is another GAM895 target gene, herein designated TARGET GENE. KCNAB1 BINDING SITE is a target binding site found in the 3' untranslated region of multiple transcripts of mRNA encoded by KCNAB1, corresponding to a target binding site such as BINDING SITE I, BINDING SITE II or BINDING SITE III of FIG. 8. Table 4 illustrates the complementarity of the nucleotide sequences of KCNAB1 BINDING SITE, designated SEQ ID:13233, to the nucleotide sequence of GAM895 RNA, herein designated GAM RNA, also designated SEQ ID:379.

Another function of GAM895 is therefore inhibition of Potassium voltage-gated channel, shaker-related subfamily, beta member 1 (KCNAB1, Accession NP_003462.2), a gene which is the regulatory beta subunit for a shaker-related voltage-gated potassium channel. Accordingly, utilities of GAM895 include diagnosis, prevention and treatment of diseases and clinical conditions associated with KCNAB1.

The function of KCNAB1 and its association with various diseases and clinical conditions, has been established by previous studies, as described hereinabove with reference to GAM333.1. Potassium voltage-gated channel, shaker-related subfamily, beta member 1 (KCNAB1, Accession NP_751891.1) is another GAM895 target gene, herein designated TARGET GENE. KCNAB1 BINDING SITE is a target binding site found in the 3' untranslated region of multiple transcripts of mRNA encoded by KCNAB1, corresponding to a target binding site such as BINDING SITE I, BINDING SITE II or BINDING SITE III of FIG. 8. Table 4 illustrates the complementarity of the nucleotide sequences of KCNAB1 BINDING SITE, designated SEQ ID:13233, to the nucleotide sequence of GAM895 RNA, herein designated GAM RNA, also designated SEQ ID:379.

Another function of GAM895 is therefore inhibition of Potassium voltage-gated channel, shaker-related subfamily, beta member 1 (KCNAB1, Accession NP_751891.1), a gene which is the regulatory beta subunit for a shaker-related voltage-gated potassium channel. Accordingly, utilities of GAM895 include diagnosis, prevention and treatment of diseases and clinical conditions associated with KCNAB1.

The function of KCNAB1 and its association with various diseases and clinical conditions, has been established by previous studies, as described hereinabove with reference to GAM333.1. Potassium voltage-gated channel, shaker-related subfamily, beta member 1 (KCNAB1, Accession NP_751892.1) is another GAM895 target gene, herein designated TARGET GENE. KCNAB1 BINDING SITE is a target binding site found in the 3' untranslated region of multiple transcripts of mRNA encoded by KCNAB1, corresponding to a target binding site such as BINDING SITE I, BINDING SITE II or BINDING SITE III of FIG. 8. Table 4 illustrates the complementarity of the nucleotide sequences of KCNAB1 BINDING SITE, designated SEQ ID:13233, to the nucleotide sequence of GAM895 RNA, herein designated GAM RNA, also designated SEQ ID:379.

Another function of GAM895 is therefore inhibition of Potassium voltage-gated channel, shaker-related subfamily, beta member 1 (KCNAB1, Accession NP_751892.1), a gene which is the regulatory beta subunit for a shaker-related voltage-gated potassium channel. Accordingly, utilities of GAM895 include diagnosis, prevention and treatment of diseases and clinical conditions associated with KCNAB1.

The function of KCNAB1 and its association with various diseases and clinical conditions, has been established by previous studies, as described hereinabove with reference to GAM333.1. Kdel (lys-asp-glu-leu) endoplasmic reticulum protein retention receptor 3 (KDELR3, Accession NP_006846.1) is another GAM895 target gene, herein designated TARGET GENE. KDELR3 BINDING SITE is a target binding site found in the 3' untranslated region of multiple transcripts of mRNA encoded by KDELR3, corresponding to a target binding site such as BINDING SITE I, BINDING SITE II or BINDING SITE III of FIG. 8. Table 4 illustrates the complementarity of the nucleotide sequences of KDELR3 BINDING SITE, designated SEQ ID:20033, to the nucleotide sequence of GAM895 RNA, herein designated GAM RNA, also designated SEQ ID:379.

Another function of GAM895 is therefore inhibition of Kdel (lys-asp-glu-leu) endoplasmic reticulum protein retention receptor 3 (KDELR3, Accession NP_006846.1). Accordingly, utilities of GAM895 include diagnosis, prevention and treatment of diseases and clinical conditions associated with KDELR3.

Kinase insert domain receptor (a type iii receptor tyrosine kinase) (KDR, Accession NP_002244.1) is another GAM895 target gene, herein designated TARGET GENE. KDR BINDING SITE is a target binding site found in the 3' untranslated region of mRNA encoded by KDR, corresponding to a target binding site such as BINDING SITE I, BINDING SITE II or BINDING SITE III of FIG. 8. Table 4 illustrates the complementarity of the nucleotide sequences of KDR BINDING SITE, designated SEQ ID:5354, to the nucleotide sequence of GAM895 RNA, herein designated GAM RNA, also designated SEQ ID:379.

Another function of GAM895 is therefore inhibition of Kinase insert domain receptor (a type iii receptor tyrosine kinase) (KDR, Accession NP_002244.1). Accordingly, utilities of GAM895 include diagnosis, prevention and treatment of diseases and clinical conditions associated with KDR.

KIAA0237 (Accession NP_055562.1) is another GAM895 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:14809, to the nucleotide sequence of GAM895 RNA, herein designated GAM RNA, also designated SEQ ID:379.

Another function of GAM895 is therefore inhibition of KIAA0237 (Accession NP_055562.1). Accordingly, utilities of GAM895 include diagnosis, prevention and treatment of diseases and clinical conditions associated with KIAA0237.

KIAA1594 (Accession XP_050754.5) is another GAM895 target gene, herein designated TARGET GENE. KIAA1594 BINDING SITE is a target binding site found in the 3' untranslated region of mRNA encoded by KIAA1594, corresponding to a target binding site such as BINDING SITE I, BINDING SITE II or BINDING SITE III of FIG. 8. Table 4 illustrates the complementarity of the nucleotide sequences of KIAA1594 BINDING SITE, designated SEQ ID:13533, to the nucleotide sequence of GAM895 RNA, herein designated GAM RNA, also designated SEQ ID:379.

Another function of GAM895 is therefore inhibition of KIAA1594 (Accession XP_050754.5). Accordingly, utilities of GAM895 include diagnosis, prevention and treatment of diseases and clinical conditions associated with KIAA1594.

KIAA1805 (Accession NP_115810.1) is another GAM895 target gene, herein designated TARGET GENE. KIAA1805 BINDING SITE is a target binding site found in the 3' untranslated region of mRNA encoded by KIAA1805, corresponding to a target binding site such as BINDING SITE I, BINDING SITE II or BINDING SITE III of FIG. 8. Table 4 illustrates the complementarity of the nucleotide sequences of KIAA1805 BINDING SITE, designated SEQ ID:11408, to the nucleotide sequence of GAM895 RNA, herein designated GAM RNA, also designated SEQ ID:379.

Another function of GAM895 is therefore inhibition of KIAA1805 (Accession NP_115810.1). Accordingly, utilities of GAM895 include diagnosis, prevention and treatment of diseases and clinical conditions associated with KIAA1805.

KIAA1894 (Accession XP_058025.2) is another GAM895 target gene, herein designated TARGET GENE. KIAA1894 BINDING SITE is a target binding site found in the 3' untranslated region of mRNA encoded by KIAA1894, corresponding to a target binding site such as BINDING SITE I, BINDING SITE II or BINDING SITE III of FIG. 8. Table 4 illustrates the complementarity of the nucleotide sequences of KIAA1894 BINDING SITE, designated SEQ ID:15021, to the nucleotide sequence of GAM895 RNA, herein designated GAM RNA, also designated SEQ ID:379.

Another function of GAM895 is therefore inhibition of KIAA1894 (Accession XP_058025.2). Accordingly, utilities of GAM895 include diagnosis, prevention and treatment of diseases and clinical conditions associated with KIAA1894.

KIAA1904 (Accession XP_056282.1) is another GAM895 target gene, herein designated TARGET GENE. KIAA1904 BINDING SITE is a target binding site found in the 3' untranslated region of mRNA encoded by KIAA1904, corresponding to a target binding site such as BINDING SITE I, BINDING SITE II or BINDING SITE III of FIG. 8. Table 4 illustrates the complementarity of the nucleotide sequences of KIAA1904 BINDING SITE, designated SEQ ID:17616, to the nucleotide sequence of GAM895 RNA, herein designated GAM RNA, also designated SEQ ID:379.

Another function of GAM895 is therefore inhibition of KIAA1904 (Accession XP_056282.1). Accordingly, utilities of GAM895 include diagnosis, prevention and treatment of diseases and clinical conditions associated with KIAA1904.

LCHN (Accession XP_098615.2) is another GAM895 target gene, herein designated TARGET GENE. LCHN BINDING SITE is a target binding site found in the 3' untranslated region of mRNA encoded by LCHN, corresponding to a target binding site such as BINDING SITE I, BINDING SITE II or BINDING SITE III of FIG. 8. Table 4 illustrates the complementarity of the nucleotide sequences of LCHN BINDING SITE, designated SEQ ID:13004, to the nucleotide sequence of GAM895 RNA, herein designated GAM RNA, also designated SEQ ID:379.

Another function of GAM895 is therefore inhibition of LCHN (Accession XP_098615.2). Accordingly, utilities of GAM895 include diagnosis, prevention and treatment of diseases and clinical conditions associated with LCHN.

LGN (Accession NP_037428.2) is another GAM895 target gene, herein designated TARGET GENE. LGN BINDING SITE is a target binding site found in the 3' untranslated region of mRNA encoded by LGN, corresponding to a target binding site such as BINDING SITE I, BINDING SITE II or BINDING SITE III of FIG. 8. Table 4 illustrates the complementarity of the nucleotide sequences of LGN BINDING SITE, designated SEQ ID:9501, to the nucleotide sequence of GAM895 RNA, herein designated GAM RNA, also designated SEQ ID:379.

Another function of GAM895 is therefore inhibition of LGN (Accession NP_037428.2). Accordingly, utilities of GAM895 include diagnosis, prevention and treatment of diseases and clinical conditions associated with LGN.

LOC126755 (Accession XP_059074.1) is another GAM895 target gene, herein designated TARGET GENE. LOC126755 BINDING SITE is a target binding site found in the 3' untranslated region of mRNA encoded by LOC126755, corresponding to a target binding site such as BINDING SITE I, BINDING SITE II or BINDING SITE III of FIG. 8. Table 4 illustrates the complementarity of the nucleotide sequences of LOC126755 BINDING SITE, designated SEQ ID:11812, to the nucleotide sequence of GAM895 RNA, herein designated GAM RNA, also designated SEQ ID:379.

Another function of GAM895 is therefore inhibition of LOC126755 (Accession XP_059074.1). Accordingly, utilities of GAM895 include diagnosis, prevention and treatment of diseases and clinical conditions associated with LOC126755.

LOC134637 (Accession XP_059727.3) is another GAM895 target gene, herein designated TARGET GENE. LOC134637 BINDING SITE is a target binding site found in the 3' untranslated region of mRNA encoded by LOC134637, corresponding to a target binding site such as BINDING SITE I, BINDING SITE II or BINDING SITE III of FIG. 8. Table 4 illustrates the complementarity of the nucleotide sequences of LOC134637 BINDING SITE, designated SEQ ID:6440, to the nucleotide sequence of GAM895 RNA, herein designated GAM RNA, also designated SEQ ID:379.

Another function of GAM895 is therefore inhibition of LOC134637 (Accession XP_059727.3). Accordingly, utilities of GAM895 include diagnosis, prevention and treatment of diseases and clinical conditions associated with LOC134637.

LOC146520 (Accession XP_085492.1) is another GAM895 target gene, herein designated TARGET GENE. LOC146520 BINDING SITE is a target binding site found in the 3' untranslated region of mRNA encoded by LOC146520, corresponding to a target binding site such as BINDING SITE I, BINDING SITE II or BINDING SITE III of FIG. 8. Table 4 illustrates the complementarity of the nucleotide sequences of LOC146520 BINDING SITE, designated SEQ ID:4472, to the nucleotide sequence of GAM895 RNA, herein designated GAM RNA, also designated SEQ ID:379.

Another function of GAM895 is therefore inhibition of LOC146520 (Accession XP_085492.1). Accordingly, utilities of GAM895 include diagnosis, prevention and treatment of diseases and clinical conditions associated with LOC146520.

LOC148696 (Accession XP_097505.1) is another GAM895 target gene, herein designated TARGET GENE. LOC148696 BINDING SITE is a target binding site found in the 5' untranslated region of mRNA encoded by LOC148696, corresponding to a target binding site such as BINDING SITE I, BINDING SITE II or BINDING SITE III of FIG. 8. Table 4 illustrates the complementarity of the nucleotide sequences of LOC148696 BINDING SITE, designated SEQ ID:12372, to the nucleotide sequence of GAM895 RNA, herein designated GAM RNA, also designated SEQ ID:379.

Another function of GAM895 is therefore inhibition of LOC148696 (Accession XP_097505.1). Accordingly, utilities of GAM895 include diagnosis, prevention and treatment of diseases and clinical conditions associated with LOC148696.

LOC151584 (Accession XP_098089.1) is another GAM895 target gene, herein designated TARGET GENE. LOC151584 BINDING SITE is a target binding site found in the 3' untranslated region of mRNA encoded by LOC151584, corresponding to a target binding site such as BINDING SITE I, BINDING SITE II or BINDING SITE III of FIG. 8. Table 4 illustrates the complementarity of the nucleotide sequences of LOC151584 BINDING SITE, designated SEQ ID:19877, to the nucleotide sequence of GAM895 RNA, herein designated GAM RNA, also designated SEQ ID:379.

Another function of GAM895 is therefore inhibition of LOC151584 (Accession XP_098089.1). Accordingly, utilities of GAM895 include diagnosis, prevention and treatment of diseases and clinical conditions associated with LOC151584.

LOC154084 (Accession XP_098468.1) is another GAM895 target gene, herein designated TARGET GENE. LOC154084 BINDING SITE is a target binding site found in the 5' untranslated region of mRNA encoded by LOC154084, corresponding to a target binding site such as BINDING SITE I, BINDING SITE II or BINDING SITE III of FIG. 8. Table 4 illustrates the complementarity of the nucleotide sequences of LOC154084 BINDING SITE, designated SEQ ID:10300, to the nucleotide sequence of GAM895 RNA, herein designated GAM RNA, also designated SEQ ID:379.

Another function of GAM895 is therefore inhibition of LOC154084 (Accession XP_098468.1). Accordingly, utilities of GAM895 include diagnosis, prevention and treatment of diseases and clinical conditions associated with LOC154084.

LOC158427 (Accession NP_640339.3) is another GAM895 target gene, herein designated TARGET GENE. LOC158427 BINDING SITE is a target binding site found in the 3' untranslated region of mRNA encoded by LOC158427, corresponding to a target binding site such as BINDING SITE I, BINDING SITE II or BINDING SITE III of FIG. 8. Table 4 illustrates the complementarity of the nucleotide sequences of LOC158427 BINDING SITE, designated SEQ ID:1013, to the nucleotide sequence of GAM895 RNA, herein designated GAM RNA, also designated SEQ ID:379.

Another function of GAM895 is therefore inhibition of LOC158427 (Accession NP_640339.3). Accordingly, utilities of GAM895 include diagnosis, prevention and treatment of diseases and clinical conditions associated with LOC158427.

LOC199953 (Accession XP_114067.2) is another GAM895 target gene, herein designated TARGET GENE. LOC199953 BINDING SITE is a target binding site found in the 3' untranslated region of mRNA encoded by LOC199953, corresponding to a target binding site such as BINDING SITE I, BINDING SITE II or BINDING SITE III of FIG. 8. Table 4 illustrates the complementarity of the nucleotide sequences of LOC199953 BINDING SITE, designated SEQ ID:13875, to the nucleotide sequence of GAM895 RNA, herein designated GAM RNA, also designated SEQ ID:379.

Another function of GAM895 is therefore inhibition of LOC199953 (Accession XP_114067.2). Accordingly, utilities of GAM895 include diagnosis, prevention and treatment of diseases and clinical conditions associated with LOC199953.

LOC203107 (Accession XP_300975.1) is another GAM895 target gene, herein designated TARGET GENE. LOC203107 BINDING SITE is a target binding site found in the 3' untranslated region of mRNA encoded by LOC203107, corresponding to a target binding site such as BINDING SITE I, BINDING SITE II or BINDING SITE III of FIG. 8. Table 4 illustrates the complementarity of the nucleotide sequences of LOC203107 BINDING SITE, designated SEQ ID:1112, to the nucleotide sequence of GAM895 RNA, herein designated GAM RNA, also designated SEQ ID:379.

Another function of GAM895 is therefore inhibition of LOC203107 (Accession XP_300975.1). Accordingly, utilities of GAM895 include diagnosis, prevention and treatment of diseases and clinical conditions associated with LOC203107.

LOC203504 (Accession XP_117550.1) is another GAM895 target gene, herein designated TARGET GENE. LOC203504 BINDING SITE is a target binding site found in the 3' untranslated region of mRNA encoded by LOC203504, corresponding to a target binding site such as BINDING SITE I, BINDING SITE II or BINDING SITE III of FIG. 8. Table 4 illustrates the complementarity of the nucleotide sequences of LOC203504 BINDING SITE, designated SEQ ID:15970, to the nucleotide sequence of GAM895 RNA, herein designated GAM RNA, also designated SEQ ID:379.

Another function of GAM895 is therefore inhibition of LOC203504 (Accession XP_117550.1). Accordingly, utilities of GAM895 include diagnosis, prevention and treatment of diseases and clinical conditions associated with LOC203504.

LOC221424 (Accession XP_168060.2) is another GAM895 target gene, herein designated TARGET GENE. LOC221424 BINDING SITE is a target binding site found in the 3' untranslated region of mRNA encoded by LOC221424, corresponding to a target binding site such as BINDING SITE I, BINDING SITE II or BINDING SITE III of FIG. 8. Table 4 illustrates the complementarity of the nucleotide sequences of LOC221424 BINDING SITE, designated SEQ ID:9114, to the nucleotide sequence of GAM895 RNA, herein designated GAM RNA, also designated SEQ ID:379.

Another function of GAM895 is therefore inhibition of LOC221424 (Accession XP_168060.2). Accordingly, utilities of GAM895 include diagnosis, prevention and treatment of diseases and clinical conditions associated with LOC221424.

LOC256861 (Accession XP_173004.1) is another GAM895 target gene, herein designated TARGET GENE. LOC256861 BINDING SITE is a target binding site found in the 3' untranslated region of mRNA encoded by LOC256861, corresponding to a target binding site such as BINDING SITE I, BINDING SITE II or BINDING SITE III of FIG. 8. Table 4 illustrates the complementarity of the nucleotide sequences of LOC256861 BINDING SITE, designated SEQ ID:14032, to the nucleotide sequence of GAM895 RNA, herein designated GAM RNA, also designated SEQ ID:379.

Another function of GAM895 is therefore inhibition of LOC256861 (Accession XP_173004.1). Accordingly, utilities of GAM895 include diagnosis, prevention and treatment of diseases and clinical conditions associated with LOC256861.

LOC283104 (Accession XP_210888.1) is another GAM895 target gene, herein designated TARGET GENE. LOC283104 BINDING SITE is a target binding site found in the 3' untranslated region of mRNA encoded by LOC283104, corresponding to a target binding site such as BINDING SITE I, BINDING SITE II or BINDING SITE III of FIG. 8. Table 4 illustrates the complementarity of the nucleotide sequences of LOC283104 BINDING SITE, designated SEQ ID:10722, to the nucleotide sequence of GAM895 RNA, herein designated GAM RNA, also designated SEQ ID:379.

Another function of GAM895 is therefore inhibition of LOC283104 (Accession XP_210888.1). Accordingly, utilities of GAM895 include diagnosis, prevention and treatment of diseases and clinical conditions associated with LOC283104.

LOC283241 (Accession NP_787089.1) is another GAM895 target gene, herein designated TARGET GENE. LOC283241 BINDING SITE is a target binding site found in the 5' untranslated region of mRNA encoded by LOC283241, corresponding to a target binding site such as BINDING SITE I, BINDING SITE II or BINDING SITE III of FIG. 8. Table 4 illustrates the complementarity of the nucleotide sequences of LOC283241 BINDING SITE, designated SEQ ID:8821, to the nucleotide sequence of GAM895 RNA, herein designated GAM RNA, also designated SEQ ID:379.

Another function of GAM895 is therefore inhibition of LOC283241 (Accession NP_787089.1). Accordingly, utilities of GAM895 include diagnosis, prevention and treatment of diseases and clinical conditions associated with LOC283241.

LOC283248 (Accession NP_775858.1) is another GAM895 target gene, herein designated TARGET GENE. LOC283248 BINDING SITE is a target binding site found in the 3' untranslated region of mRNA encoded by LOC283248, corresponding to a target binding site such as BINDING SITE I, BINDING SITE II or BINDING SITE III of FIG. 8. Table 4 illustrates the complementarity of the nucleotide sequences of LOC283248 BINDING SITE, designated SEQ ID:18722, to the nucleotide sequence of GAM895 RNA, herein designated GAM RNA, also designated SEQ ID:379.

Another function of GAM895 is therefore inhibition of LOC283248 (Accession NP_775858.1). Accordingly, utilities of GAM895 include diagnosis, prevention and treatment of diseases and clinical conditions associated with LOC283248.

LOC283425 (Accession XP_208665.1) is another GAM895 target gene, herein designated TARGET GENE. LOC283425 BINDING SITE is a target binding site found in the 3' untranslated region of mRNA encoded by LOC283425, corresponding to a target binding site such as BINDING SITE I, BINDING SITE II or BINDING SITE III of FIG. 8. Table 4 illustrates the complementarity of the nucleotide sequences of LOC283425 BINDING SITE, designated SEQ ID:2908, to the nucleotide sequence of GAM895 RNA, herein designated GAM RNA, also designated SEQ ID:379.

Another function of GAM895 is therefore inhibition of LOC283425 (Accession XP_208665.1). Accordingly, utilities of GAM895 include diagnosis, prevention and treatment of diseases and clinical conditions associated with LOC283425.

LOC283578 (Accession XP_208746.1) is another GAM895 target gene, herein designated TARGET GENE. LOC283578 BINDING SITE is a target binding site found in the 3' untranslated region of mRNA encoded by LOC283578, corresponding to a target binding site such as BINDING SITE I, BINDING SITE II or BINDING SITE III of FIG. 8. Table 4 illustrates the complementarity of the nucleotide sequences of LOC283578 BINDING SITE, designated SEQ ID:14912, to the nucleotide sequence of GAM895 RNA, herein designated GAM RNA, also designated SEQ ID:379.

Another function of GAM895 is therefore inhibition of LOC283578 (Accession XP_208746.1). Accordingly, utilities of GAM895 include diagnosis, prevention and treatment of diseases and clinical conditions associated with LOC283578.

LOC284018 (Accession XP_211303.1) is another GAM895 target gene, herein designated TARGET GENE. LOC284018 BINDING SITE is a target binding site found in the 3' untranslated region of mRNA encoded by LOC284018, corresponding to a target binding site such as BINDING SITE I, BINDING SITE II or BINDING SITE III of FIG. 8. Table 4 illustrates the complementarity of the nucleotide sequences of LOC284018 BINDING SITE, designated SEQ ID:12876, to the nucleotide sequence of GAM895 RNA, herein designated GAM RNA, also designated SEQ ID:379.

Another function of GAM895 is therefore inhibition of LOC284018 (Accession XP_211303.1). Accordingly, utilities of GAM895 include diagnosis, prevention and treatment of diseases and clinical conditions associated with LOC284018.

LOC284433 (Accession XP_210787.1) is another GAM895 target gene, herein designated TARGET GENE. LOC284433 BINDING SITE is a target binding site found in the 5' untranslated region of mRNA encoded by LOC284433, corresponding to a target binding site such as BINDING SITE I, BINDING SITE II or BINDING SITE III of FIG. 8. Table 4 illustrates the complementarity of the nucleotide sequences of LOC284433 BINDING SITE, designated SEQ ID:6998, to the nucleotide sequence of GAM895 RNA, herein designated GAM RNA, also designated SEQ ID:379.

Another function of GAM895 is therefore inhibition of LOC284433 (Accession XP_210787.1). Accordingly, utilities of GAM895 include diagnosis, prevention and treatment of diseases and clinical conditions associated with LOC284433.

LOC284440 (Accession XP_209210.1) is another GAM895 target gene, herein designated TARGET GENE.

LOC284440 BINDING SITE is a target binding site found in the 3' untranslated region of mRNA encoded by LOC284440, corresponding to a target binding site such as BINDING SITE I, BINDING SITE II or BINDING SITE III of FIG. 8. Table 4 illustrates the complementarity of the nucleotide sequences of LOC284440 BINDING SITE, designated SEQ ID:14287, to the nucleotide sequence of GAM895 RNA, herein designated GAM RNA, also designated SEQ ID:379.

Another function of GAM895 is therefore inhibition of LOC284440 (Accession XP_209210.1). Accordingly, utilities of GAM895 include diagnosis, prevention and treatment of diseases and clinical conditions associated with LOC284440.

LOC284530 (Accession XP_211512.1) is another GAM895 target gene, herein designated TARGET GENE. LOC284530 BINDING SITE is a target binding site found in the 3' untranslated region of mRNA encoded by LOC284530, corresponding to a target binding site such as BINDING SITE I, BINDING SITE II or BINDING SITE III of FIG. 8. Table 4 illustrates the complementarity of the nucleotide sequences of LOC284530 BINDING SITE, designated SEQ ID:11717, to the nucleotide sequence of GAM895 RNA, herein designated GAM RNA, also designated SEQ ID:379.

Another function of GAM895 is therefore inhibition of LOC284530 (Accession XP_211512.1). Accordingly, utilities of GAM895 include diagnosis, prevention and treatment of diseases and clinical conditions associated with LOC284530.

LOC284840 (Accession XP_211657.1) is another GAM895 target gene, herein designated TARGET GENE. LOC284840 BINDING SITE is a target binding site found in the 5' untranslated region of mRNA encoded by LOC284840, corresponding to a target binding site such as BINDING SITE I, BINDING SITE II or BINDING SITE III of FIG. 8. Table 4 illustrates the complementarity of the nucleotide sequences of LOC284840 BINDING SITE, designated SEQ ID:14102, to the nucleotide sequence of GAM895 RNA, herein designated GAM RNA, also designated SEQ ID:379.

Another function of GAM895 is therefore inhibition of LOC284840 (Accession XP_211657.1). Accordingly, utilities of GAM895 include diagnosis, prevention and treatment of diseases and clinical conditions associated with LOC284840.

LOC284950 (Accession XP_211703.1) is another GAM895 target gene, herein designated TARGET GENE. LOC284950 BINDING SITE is a target binding site found in the 5' untranslated region of mRNA encoded by LOC284950, corresponding to a target binding site such as BINDING SITE I, BINDING SITE II or BINDING SITE III of FIG. 8. Table 4 illustrates the complementarity of the nucleotide sequences of LOC284950 BINDING SITE, designated SEQ ID:13512, to the nucleotide sequence of GAM895 RNA, herein designated GAM RNA, also designated SEQ ID:379.

Another function of GAM895 is therefore inhibition of LOC284950 (Accession XP_211703.1). Accordingly, utilities of GAM895 include diagnosis, prevention and treatment of diseases and clinical conditions associated with LOC284950.

LOC285167 (Accession XP_211790.1) is another GAM895 target gene, herein designated TARGET GENE. LOC285167 BINDING SITE is a target binding site found in the 3' untranslated region of mRNA encoded by LOC285167, corresponding to a target binding site such as BINDING SITE I, BINDING SITE II or BINDING SITE III of FIG. 8. Table 4 illustrates the complementarity of the nucleotide sequences of LOC285167 BINDING SITE, designated SEQ ID:13845, to the nucleotide sequence of GAM895 RNA, herein designated GAM RNA, also designated SEQ ID:379.

Another function of GAM895 is therefore inhibition of LOC285167 (Accession XP_211790.1). Accordingly, utilities of GAM895 include diagnosis, prevention and treatment of diseases and clinical conditions associated with LOC285167.

LOC285256 (Accession XP_211818.1) is another GAM895 target gene, herein designated TARGET GENE. LOC285256 BINDING SITE is a target binding site found in the 3' untranslated region of mRNA encoded by LOC285256, corresponding to a target binding site such as BINDING SITE I, BINDING SITE II or BINDING SITE III of FIG. 8. Table 4 illustrates the complementarity of the nucleotide sequences of LOC285256 BINDING SITE, designated SEQ ID:18929, to the nucleotide sequence of GAM895 RNA, herein designated GAM RNA, also designated SEQ ID:379.

Another function of GAM895 is therefore inhibition of LOC285256 (Accession XP_211818.1). Accordingly, utilities of GAM895 include diagnosis, prevention and treatment of diseases and clinical conditions associated with LOC285256.

LOC285500 (Accession XP_209639.1) is another GAM895 target gene, herein designated TARGET GENE. LOC285500 BINDING SITE is a target binding site found in the 5' untranslated region of mRNA encoded by LOC285500, corresponding to a target binding site such as BINDING SITE I, BINDING SITE II or BINDING SITE III of FIG. 8. Table 4 illustrates the complementarity of the nucleotide sequences of LOC285500 BINDING SITE, designated SEQ ID:17122, to the nucleotide sequence of GAM895 RNA, herein designated GAM RNA, also designated SEQ ID:379.

Another function of GAM895 is therefore inhibition of LOC285500 (Accession XP_209639.1). Accordingly, utilities of GAM895 include diagnosis, prevention and treatment of diseases and clinical conditions associated with LOC285500.

LOC285595 (Accession XP_211948.1) is another GAM895 target gene, herein designated TARGET GENE. LOC285595 BINDING SITE is a target binding site found in the 3' untranslated region of mRNA encoded by LOC285595, corresponding to a target binding site such as BINDING SITE I, BINDING SITE II or BINDING SITE III of FIG. 8. Table 4 illustrates the complementarity of the nucleotide sequences of LOC285595 BINDING SITE, designated SEQ ID:14073, to the nucleotide sequence of GAM895 RNA, herein designated GAM RNA, also designated SEQ ID:379.

Another function of GAM895 is therefore inhibition of LOC285595 (Accession XP_211948.1). Accordingly, utilities of GAM895 include diagnosis, prevention and treatment of diseases and clinical conditions associated with LOC285595.

LOC285656 (Accession XP_211976.2) is another GAM895 target gene, herein designated TARGET GENE. LOC285656 BINDING SITE is a target binding site found in the 3' untranslated region of mRNA encoded by LOC285656, corresponding to a target binding site such as BINDING SITE I, BINDING SITE II or BINDING SITE III of FIG. 8. Table 4 illustrates the complementarity of the nucleotide sequences of LOC285656 BINDING SITE, designated SEQ ID:14073, to the nucleotide sequence of GAM895 RNA, herein designated GAM RNA, also designated SEQ ID:379.

Another function of GAM895 is therefore inhibition of LOC285656 (Accession XP_211976.2). Accordingly, utilities of GAM895 include diagnosis, prevention and treatment of diseases and clinical conditions associated with LOC285656.

LOC285954 (Accession XP_212085.1) is another GAM895 target gene, herein designated TARGET GENE. LOC285954 BINDING SITE is a target binding site found in the 3' untranslated region of mRNA encoded by LOC285954, corresponding to a target binding site such as BINDING SITE I, BINDING SITE II or BINDING SITE III of FIG. 8. Table 4 illustrates the complementarity of the nucleotide sequences of LOC285954 BINDING SITE, designated SEQ ID:1096, to the nucleotide sequence of GAM895 RNA, herein designated GAM RNA, also designated SEQ ID:379.

Another function of GAM895 is therefore inhibition of LOC285954 (Accession XP_212085.1). Accordingly, utilities of GAM895 include diagnosis, prevention and treatment of diseases and clinical conditions associated with LOC285954.

LOC286177 (Accession XP_212215.3) is another GAM895 target gene, herein designated TARGET GENE. LOC286177 BINDING SITE is a target binding site found in the 3' untranslated region of mRNA encoded by LOC286177, corresponding to a target binding site such as BINDING SITE I, BINDING SITE II or BINDING SITE III of FIG. 8. Table 4 illustrates the complementarity of the nucleotide sequences of LOC286177 BINDING SITE, designated SEQ ID:3170, to the nucleotide sequence of GAM895 RNA, herein designated GAM RNA, also designated SEQ ID:379.

Another function of GAM895 is therefore inhibition of LOC286177 (Accession XP_212215.3). Accordingly, utilities of GAM895 include diagnosis, prevention and treatment of diseases and clinical conditions associated with LOC286177.

LOC286401 (Accession XP_212310.1) is another GAM895 target gene, herein designated TARGET GENE. LOC286401 BINDING SITE is a target binding site found in the 5' untranslated region of mRNA encoded by LOC286401, corresponding to a target binding site such as BINDING SITE I, BINDING SITE II or BINDING SITE III of FIG. 8. Table 4 illustrates the complementarity of the nucleotide sequences of LOC286401 BINDING SITE, designated SEQ ID:5918, to the nucleotide sequence of GAM895 RNA, herein designated GAM RNA, also designated SEQ ID:379.

Another function of GAM895 is therefore inhibition of LOC286401 (Accession XP_212310.1). Accordingly, utilities of GAM895 include diagnosis, prevention and treatment of diseases and clinical conditions associated with LOC286401.

LOC286437 (Accession XP_210050.1) is another GAM895 target gene, herein designated TARGET GENE. LOC286437 BINDING SITE is a target binding site found in the 3' untranslated region of mRNA encoded by LOC286437, corresponding to a target binding site such as BINDING SITE I, BINDING SITE II or BINDING SITE III of FIG. 8. Table 4 illustrates the complementarity of the nucleotide sequences of LOC286437 BINDING SITE, designated SEQ ID:17684, to the nucleotide sequence of GAM895 RNA, herein designated GAM RNA, also designated SEQ ID:379.

Another function of GAM895 is therefore inhibition of LOC286437 (Accession XP_210050.1). Accordingly, utilities of GAM895 include diagnosis, prevention and treatment of diseases and clinical conditions associated with LOC286437.

LOC286532 (Accession XP_210093.1) is another GAM895 target gene, herein designated TARGET GENE. LOC286532 BINDING SITE is a target binding site found in the 3' untranslated region of mRNA encoded by LOC286532, corresponding to a target binding site such as BINDING SITE I, BINDING SITE II or BINDING SITE III of FIG. 8. Table 4 illustrates the complementarity of the nucleotide sequences of LOC286532 BINDING SITE, designated SEQ ID:3346, to the nucleotide sequence of GAM895 RNA, herein designated GAM RNA, also designated SEQ ID:379.

Another function of GAM895 is therefore inhibition of LOC286532 (Accession XP_210093.1). Accordingly, utilities of GAM895 include diagnosis, prevention and treatment of diseases and clinical conditions associated with LOC286532.

LOC339299 (Accession XP_294904.1) is another GAM895 target gene, herein designated TARGET GENE. LOC339299 BINDING SITE is a target binding site found in the 5' untranslated region of mRNA encoded by LOC339299, corresponding to a target binding site such as BINDING SITE I, BINDING SITE II or BINDING SITE III of FIG. 8. Table 4 illustrates the complementarity of the nucleotide sequences of LOC339299 BINDING SITE, designated SEQ ID:4240, to the nucleotide sequence of GAM895 RNA, herein designated GAM RNA, also designated SEQ ID:379.

Another function of GAM895 is therefore inhibition of LOC339299 (Accession XP_294904.1). Accordingly, utilities of GAM895 include diagnosis, prevention and treatment of diseases and clinical conditions associated with LOC339299.

LOC339831 (Accession XP_295080.1) is another GAM895 target gene, herein designated TARGET GENE. LOC339831 BINDING SITE is a target binding site found in the 5' untranslated region of mRNA encoded by LOC339831, corresponding to a target binding site such as BINDING SITE I, BINDING SITE II or BINDING SITE III of FIG. 8. Table 4 illustrates the complementarity of the nucleotide sequences of LOC339831 BINDING SITE, designated SEQ ID:8112, to the nucleotide sequence of GAM895 RNA, herein designated GAM RNA, also designated SEQ ID:379.

Another function of GAM895 is therefore inhibition of LOC339831 (Accession XP_295080.1). Accordingly, utilities of GAM895 include diagnosis, prevention and treatment of diseases and clinical conditions associated with LOC339831.

LOC340327 (Accession XP_294325.1) is another GAM895 target gene, herein designated TARGET GENE. LOC340327 BINDING SITE is a target binding site found in the 5' untranslated region of mRNA encoded by LOC340327, corresponding to a target binding site such as BINDING SITE I, BINDING SITE II or BINDING SITE III of FIG. 8. Table 4 illustrates the complementarity of the nucleotide sequences of LOC340327 BINDING SITE, designated SEQ ID:3197, to the nucleotide sequence of GAM895 RNA, herein designated GAM RNA, also designated SEQ ID:379.

Another function of GAM895 is therefore inhibition of LOC340327 (Accession XP_294325.1). Accordingly, utilities of GAM895 include diagnosis, prevention and treatment of diseases and clinical conditions associated with LOC340327.

LOC340527 (Accession XP_291321.1) is another GAM895 target gene, herein designated TARGET GENE. LOC340527 BINDING SITE is a target binding site found in the 5' untranslated region of mRNA encoded by LOC340527, corresponding to a target binding site such as BINDING SITE I, BINDING SITE II or BINDING SITE III of FIG. 8. Table 4 illustrates the complementarity of the nucleotide sequences of LOC340527 BINDING SITE, designated SEQ ID:13494, to the nucleotide sequence of GAM895 RNA, herein designated GAM RNA, also designated SEQ ID:379.

Another function of GAM895 is therefore inhibition of LOC340527 (Accession XP_291321.1). Accordingly, utilities of GAM895 include diagnosis, prevention and treatment of diseases and clinical conditions associated with LOC340527.

LOC346259 (Accession XP_299387.1) is another GAM895 target gene, herein designated TARGET GENE. LOC346259 BINDING SITE is a target binding site found in the 5' untranslated region of mRNA encoded by LOC346259, corresponding to a target binding site such as BINDING SITE I, BINDING SITE II or BINDING SITE III of FIG. 8. Table 4 illustrates the complementarity of the nucleotide sequences of LOC346259 BINDING SITE, designated SEQ ID:8351, to the nucleotide sequence of GAM895 RNA, herein designated GAM RNA, also designated SEQ ID:379.

Another function of GAM895 is therefore inhibition of LOC346259 (Accession XP_299387.1). Accordingly, utilities of GAM895 include diagnosis, prevention and treatment of diseases and clinical conditions associated with LOC346259.

LOC348393 (Accession XP_302741.1) is another GAM895 target gene, herein designated TARGET GENE. LOC348393 BINDING SITE is a target binding site found in the 5' untranslated region of mRNA encoded by LOC348393, corresponding to a target binding site such as BINDING SITE I, BINDING SITE II or BINDING SITE III of FIG. 8. Table 4 illustrates the complementarity of the nucleotide sequences of LOC348393 BINDING SITE, designated SEQ ID:9564, to the nucleotide sequence of GAM895 RNA, herein designated GAM RNA, also designated SEQ ID:379.

Another function of GAM895 is therefore inhibition of LOC348393 (Accession XP_302741.1). Accordingly, utilities of GAM895 include diagnosis, prevention and treatment of diseases and clinical conditions associated with LOC348393.

LOC348475 (Accession XP_300748.1) is another GAM895 target gene, herein designated TARGET GENE. LOC348475 BINDING SITE is a target binding site found in the 3' untranslated region of mRNA encoded by LOC348475, corresponding to a target binding site such as BINDING SITE I, BINDING SITE II or BINDING SITE III of FIG. 8. Table 4 illustrates the complementarity of the nucleotide sequences of LOC348475 BINDING SITE, designated SEQ ID:18223, to the nucleotide sequence of GAM895 RNA, herein designated GAM RNA, also designated SEQ ID:379.

Another function of GAM895 is therefore inhibition of LOC348475 (Accession XP_300748.1). Accordingly, utilities of GAM895 include diagnosis, prevention and treatment of diseases and clinical conditions associated with LOC348475.

LOC348532 (Accession XP_302818.1) is another GAM895 target gene, herein designated TARGET GENE. LOC348532 BINDING SITE is a target binding site found in the 5' untranslated region of mRNA encoded by LOC348532, corresponding to a target binding site such as BINDING SITE I, BINDING SITE II or BINDING SITE III of FIG. 8. Table 4 illustrates the complementarity of the nucleotide sequences of LOC348532 BINDING SITE, designated SEQ ID:9564, to the nucleotide sequence of GAM895 RNA, herein designated GAM RNA, also designated SEQ ID:379.

Another function of GAM895 is therefore inhibition of LOC348532 (Accession XP_302818.1). Accordingly, utilities of GAM895 include diagnosis, prevention and treatment of diseases and clinical conditions associated with LOC348532.

LOC348989 (Accession XP_302935.1) is another GAM895 target gene, herein designated TARGET GENE. LOC348989 BINDING SITE is a target binding site found in the 3' untranslated region of mRNA encoded by LOC348989, corresponding to a target binding site such as BINDING SITE I, BINDING SITE II or BINDING SITE III of FIG. 8. Table 4 illustrates the complementarity of the nucleotide sequences of LOC348989 BINDING SITE, designated SEQ ID:14073, to the nucleotide sequence of GAM895 RNA, herein designated GAM RNA, also designated SEQ ID:379.

Another function of GAM895 is therefore inhibition of LOC348989 (Accession XP_302935.1). Accordingly, utilities of GAM895 include diagnosis, prevention and treatment of diseases and clinical conditions associated with LOC348989.

LOC349254 (Accession XP_300471.1) is another GAM895 target gene, herein designated TARGET GENE. LOC349254 BINDING SITE is a target binding site found in the 3' untranslated region of mRNA encoded by LOC349254, corresponding to a target binding site such as BINDING SITE I, BINDING SITE II or BINDING SITE III of FIG. 8. Table 4 illustrates the complementarity of the nucleotide sequences of LOC349254 BINDING SITE, designated SEQ ID:11021, to the nucleotide sequence of GAM895 RNA, herein designated GAM RNA, also designated SEQ ID:379.

Another function of GAM895 is therefore inhibition of LOC349254 (Accession XP_300471.1). Accordingly, utilities of GAM895 include diagnosis, prevention and treatment of diseases and clinical conditions associated with LOC349254.

LOC349327 (Accession XP_300483.1) is another GAM895 target gene, herein designated TARGET GENE. LOC349327 BINDING SITE is a target binding site found in the 3' untranslated region of mRNA encoded by LOC349327, corresponding to a target binding site such as BINDING SITE I, BINDING SITE II or BINDING SITE III of FIG. 8. Table 4 illustrates the complementarity of the nucleotide sequences of LOC349327 BINDING SITE, designated SEQ ID:11021, to the nucleotide sequence of GAM895 RNA, herein designated GAM RNA, also designated SEQ ID:379.

Another function of GAM895 is therefore inhibition of LOC349327 (Accession XP_300483.1). Accordingly, utilities of GAM895 include diagnosis, prevention and treatment of diseases and clinical conditions associated with LOC349327.

LOC92973 (Accession XP_048529.2) is another GAM895 target gene, herein designated TARGET GENE. LOC92973 BINDING SITE is a target binding site found in the 3' untranslated region of mRNA encoded by LOC92973, corresponding to a target binding site such as BINDING SITE I, BINDING SITE II or BINDING SITE III of FIG. 8. Table 4 illustrates the complementarity of the nucleotide sequences of LOC92973 BINDING SITE, designated SEQ ID:1682, to the nucleotide sequence of GAM895 RNA, herein designated GAM RNA, also designated SEQ ID:379.

Another function of GAM895 is therefore inhibition of LOC92973 (Accession XP_048529.2). Accordingly, utilities of GAM895 include diagnosis, prevention and treatment of diseases and clinical conditions associated with LOC92973.

LSM6 (Accession NP_009011.1) is another GAM895 target gene, herein designated TARGET GENE. LSM6 BINDING SITE is a target binding site found in the 3' untranslated region of mRNA encoded by LSM6, corresponding to a target binding site such as BINDING SITE I, BINDING SITE II or BINDING SITE III of FIG. 8. Table 4 illustrates the complementarity of the nucleotide sequences of LSM6 BINDING SITE, designated SEQ ID:8191, to the nucleotide sequence of GAM895 RNA, herein designated GAM RNA, also designated SEQ ID:379.

Another function of GAM895 is therefore inhibition of LSM6 (Accession NP_009011.1). Accordingly, utilities of GAM895 include diagnosis, prevention and treatment of diseases and clinical conditions associated with LSM6.

Melanoma antigen, family a, 12 (MAGEA12, Accession NP_005358.1) is another GAM895 target gene, herein designated TARGET GENE. MAGEA12 BINDING SITE is a target binding site found in the 3' untranslated region of mRNA encoded by MAGEA12, corresponding to a target binding site such as BINDING SITE I, BINDING SITE II or BINDING SITE III of FIG. 8. Table 4 illustrates the complementarity of the nucleotide sequences of MAGEA12 BINDING SITE, designated SEQ ID:14575, to the nucleotide sequence of GAM895 RNA, herein designated GAM RNA, also designated SEQ ID:379.

Another function of GAM895 is therefore inhibition of Melanoma antigen, family a, 12 (MAGEA12, Accession NP_005358.1), a gene which may play a role in tumor transformation or aspects of tumor progression and therefore may be associated with Melanoma. Accordingly, utilities of GAM895 include diagnosis, prevention and treatment of Melanoma, and of other diseases and clinical conditions associated with MAGEA12.

The function of MAGEA12 and its association with various diseases and clinical conditions, has been established by previous studies, as described hereinabove with reference to GAM499.2. Melanoma antigen, family a, 3 (MAGEA3, Accession NP_005353.1) is another GAM895 target gene, herein designated TARGET GENE. MAGEA3 BINDING SITE is a target binding site found in the 3' untranslated region of mRNA encoded by MAGEA3, corresponding to a target binding site such as BINDING SITE I, BINDING SITE II or BINDING SITE III of FIG. 8. Table 4 illustrates the complementarity of the nucleotide sequences of MAGEA3 BINDING SITE, designated SEQ ID:14575, to the nucleotide sequence of GAM895 RNA, herein designated GAM RNA, also designated SEQ ID:379.

Another function of GAM895 is therefore inhibition of Melanoma antigen, family a, 3 (MAGEA3, Accession NP_005353.1), a gene which may play a role in embryonal development and tumor transformation or aspects of tumor progression. antigen recognized on a melanoma by autologous cytolytic t lymphocytes. Accordingly, utilities of GAM895 include diagnosis, prevention and treatment of diseases and clinical conditions associated with MAGEA3.

The function of MAGEA3 and its association with various diseases and clinical conditions, has been established by previous studies, as described hereinabove with reference to GAM842.2. Melanoma antigen, family a, 6 (MAGEA6, Accession NP_787064.1) is another GAM895 target gene, herein designated TARGET GENE. MAGEA6 BINDING SITE is a target binding site found in the 3' untranslated region of multiple transcripts of mRNA encoded by MAGEA6, corresponding to a target binding site such as BINDING SITE I, BINDING SITE II or BINDING SITE III of FIG. 8. Table 4 illustrates the complementarity of the nucleotide sequences of MAGEA6 BINDING SITE, designated SEQ ID:14575, to the nucleotide sequence of GAM895 RNA, herein designated GAM RNA, also designated SEQ ID:379.

Another function of GAM895 is therefore inhibition of Melanoma antigen, family a, 6 (MAGEA6, Accession NP_787064.1). Accordingly, utilities of GAM895 include diagnosis, prevention and treatment of diseases and clinical conditions associated with MAGEA6.

Melanoma antigen, family a, 6 (MAGEA6, Accession NP_005354.1) is another GAM895 target gene, herein designated TARGET GENE. MAGEA6 BINDING SITE is a target binding site found in the 3' untranslated region of multiple transcripts of mRNA encoded by MAGEA6, corresponding to a target binding site such as BINDING SITE I, BINDING SITE II or BINDING SITE III of FIG. 8. Table 4 illustrates the complementarity of the nucleotide sequences of MAGEA6 BINDING SITE, designated SEQ ID:14575, to the nucleotide sequence of GAM895 RNA, herein designated GAM RNA, also designated SEQ ID:379.

Another function of GAM895 is therefore inhibition of Melanoma antigen, family a, 6 (MAGEA6, Accession NP_005354.1). Accordingly, utilities of GAM895 include diagnosis, prevention and treatment of diseases and clinical conditions associated with MAGEA6.

Melanoma antigen, family a, 9 (MAGEA9, Accession NP_005356.1) is another GAM895 target gene, herein designated TARGET GENE. MAGEA9 BINDING SITE is a target binding site found in the 3' untranslated region of mRNA encoded by MAGEA9, corresponding to a target binding site such as BINDING SITE I, BINDING SITE II or BINDING SITE III of FIG. 8. Table 4 illustrates the complementarity of the nucleotide sequences of MAGEA9 BINDING SITE, designated SEQ ID:7705, to the nucleotide sequence of GAM895 RNA, herein designated GAM RNA, also designated SEQ ID:379.

Another function of GAM895 is therefore inhibition of Melanoma antigen, family a, 9 (MAGEA9, Accession NP_005356.1), a gene which may play a role in embryonal development and tumor transformation or aspects of tumor progression. Accordingly, utilities of GAM895 include diagnosis, prevention and treatment of diseases and clinical conditions associated with MAGEA9.

The function of MAGEA9 and its association with various diseases and clinical conditions, has been established by previous studies, as described hereinabove with reference to GAM207.2. MDC1 (Accession NP_055456.1) is another GAM895 target gene, herein designated TARGET GENE. MDC1 BINDING SITE is a target binding site found in the 3' untranslated region of mRNA encoded by MDC1, corresponding to a target binding site such as BINDING SITE I, BINDING SITE II or BINDING SITE III of FIG. 8. Table 4 illustrates the complementarity of the nucleotide sequences of MDC1 BINDING SITE, designated SEQ ID:4580, to the nucleotide sequence of GAM895 RNA, herein designated GAM RNA, also designated SEQ ID:379.

Another function of GAM895 is therefore inhibition of MDC1 (Accession NP_055456.1). Accordingly, utilities of GAM895 include diagnosis, prevention and treatment of diseases and clinical conditions associated with MDC1.

Methyl cpg binding protein 2 (rett syndrome) (MECP2, Accession NP_004983.1) is another GAM895 target gene, herein designated TARGET GENE. MECP2 BINDING SITE is a target binding site found in the 3' untranslated region of mRNA encoded by MECP2, corresponding to a target binding site such as BINDING SITE I, BINDING SITE II or BINDING SITE III of FIG. 8. Table 4 illustrates the complementarity of the nucleotide sequences of MECP2 BINDING SITE, designated SEQ ID:534, to the nucleotide sequence of GAM895 RNA, herein designated GAM RNA, also designated SEQ ID:379.

Another function of GAM895 is therefore inhibition of Methyl cpg binding protein 2 (rett syndrome) (MECP2, Accession NP_004983.1). Accordingly, utilities of GAM895 include diagnosis, prevention and treatment of diseases and clinical conditions associated with MECP2.

MGC15827 (Accession NP_116271.1) is another GAM895 target gene, herein designated TARGET GENE.

MGC15827 BINDING SITE is a target binding site found in the 3' untranslated region of mRNA encoded by MGC15827, corresponding to a target binding site such as BINDING SITE I, BINDING SITE II or BINDING SITE III of FIG. 8. Table 4 illustrates the complementarity of the nucleotide sequences of MGC15827 BINDING SITE, designated SEQ ID:14513, to the nucleotide sequence of GAM895 RNA, herein designated GAM RNA, also designated SEQ ID:379.

Another function of GAM895 is therefore inhibition of MGC15827 (Accession NP_116271.1). Accordingly, utilities of GAM895 include diagnosis, prevention and treatment of diseases and clinical conditions associated with MGC15827.

MGC4562 (Accession NP_588616.1) is another GAM895 target gene, herein designated TARGET GENE. MGC4562 BINDING SITE is a target binding site found in the 3' untranslated region of mRNA encoded by MGC4562, corresponding to a target binding site such as BINDING SITE I, BINDING SITE II or BINDING SITE III of FIG. 8. Table 4 illustrates the complementarity of the nucleotide sequences of MGC4562 BINDING SITE, designated SEQ ID:4552, to the nucleotide sequence of GAM895 RNA, herein designated GAM RNA, also designated SEQ ID:379.

Another function of GAM895 is therefore inhibition of MGC4562 (Accession NP_588616.1). Accordingly, utilities of GAM895 include diagnosis, prevention and treatment of diseases and clinical conditions associated with MGC4562.

Myosin va (heavy polypeptide 12, myoxin) (MYO5A, Accession NP_000250.1) is another GAM895 target gene, herein designated TARGET GENE. MYO5A BINDING SITE is a target binding site found in the 3' untranslated region of mRNA encoded by MYO5A, corresponding to a target binding site such as BINDING SITE I, BINDING SITE II or BINDING SITE III of FIG. 8. Table 4 illustrates the complementarity of the nucleotide sequences of MYO5A BINDING SITE, designated SEQ ID:18843, to the nucleotide sequence of GAM895 RNA, herein designated GAM RNA, also designated SEQ ID:379.

Another function of GAM895 is therefore inhibition of Myosin va (heavy polypeptide 12, myoxin) (MYO5A, Accession NP_000250.1), a gene which may have a role in intracellular transport. and therefore may be associated with Griscelli syndrome. Accordingly, utilities of GAM895 include diagnosis, prevention and treatment of Griscelli syndrome., and of other diseases and clinical conditions associated with MYO5A.

The function of MYO5A has been established by previous studies. Engle and Kennett (1994) cloned the human homolog of the 'dilute' gene and assigned it to human chromosome 15 by Southern blot analysis of a panel of human/rodent somatic cell hybrids. The 'dilute' gene maps to mouse chromosome 9, distal to a group of 3 loci of which the human homologs are located in the region 15q22-q26. Engle and Kennett (1994) suggested Griscelli syndrome (OMIM Ref. No. 214450) and neuroectodermal melanolysosomal disease (OMIM Ref. No. 256710) as candidates for mutations in the myoxin gene. By somatic cell hybrid analysis and in situ hybridization, Moore et al. (1995) mapped the MYH12 gene to 15q21, thus extending distally the region of chromosome 15 with homology of synteny to mouse chromosome 9.

Animal model experiments lend further support to the function of MYO5A. The 'flailer' (flr) mouse exhibits a phenotype consisting of frequent falling, convulsive limb movements (leg flailing), and ataxia persistent into adulthood. The phenotype is similar to that of homozygotes for null alleles of Myo5a. Jones et al. (2000) determined that the flailer mouse expresses a novel gene combining the promoter and first 2 exons of guanine nucleotide-binding protein beta-5 (GNB5; 604447) with the C-terminal exons of the closely linked myosin- 5A (MyoVA) gene (Myo5a). Biochemical and genetic studies indicated that the flailer protein, which is expressed predominantly in brain, competes with wildtype MyoVA in vivo, preventing the localization of smooth endoplasmic reticulum vesicles in the dendritic spines of cerebellar Purkinje cells. The flailer protein thus has a dominant- negative mechanism of action with a recessive mode of inheritance due to the dependence of competitive binding on the ratio between mutant and wildtype proteins. The chromosomal arrangement of Myo5a upstream of Gnb5 is consistent with nonhomologous recombination as the mutational mechanism.

It is appreciated that the abovementioned animal model for MYO5A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jones, J. M.; Huang, J.-D.; Mermall, V.; Hamilton, B. A.; Mooseker, M. S.; Escay, A.; Copeland, N. G.; Jenkins, N. A.; Meisler, M. H.: The mouse neurological mutant flailer expresses a novel hybrid gene derived by exon shuffling between Gnb5 and Myo5a. Hum. Molec. Genet. 9:821-828, 2000; and Pastural, E.; Barrat, F. J.; Dufourcq-Lagelouse, R.; Certain, S.; Sanal, O.; Jabado, N.; Seger, R.; Griscelli, C.; Fischer, A.; de Saint Basile, G.: Griscelli disease maps to chromoso.

Further studies establishing the function and utilities of MYO5A are found in John Hopkins OMIM database record ID 160777, and in cited publications listed in Table 5, which are hereby incorporated by reference. Myozenin 3 (MYOZ3, Accession NP_588612.1) is another GAM895 target gene, herein designated TARGET GENE. MYOZ3 BINDING SITE is a target binding site found in the 3' untranslated region of mRNA encoded by MYOZ3, corresponding to a target binding site such as BINDING SITE I, BINDING SITE II or BINDING SITE III of FIG. 8. Table 4 illustrates the complementarity of the nucleotide sequences of MYOZ3 BINDING SITE, designated SEQ ID:11685, to the nucleotide sequence of GAM895 RNA, herein designated GAM RNA, also designated SEQ ID:379.

Another function of GAM895 is therefore inhibition of Myozenin 3 (MYOZ3, Accession NP_588612.1). Accordingly, utilities of GAM895 include diagnosis, prevention and treatment of diseases and clinical conditions associated with MYOZ3.

MYST2 (Accession NP_008998.1) is another GAM895 target gene, herein designated TARGET GENE. MYST2 BINDING SITE is a target binding site found in the 3' untranslated region of mRNA encoded by MYST2, corresponding to a target binding site such as BINDING SITE I, BINDING SITE II or BINDING SITE III of FIG. 8. Table 4 illustrates the complementarity of the nucleotide sequences of MYST2 BINDING SITE, designated SEQ ID:3346, to the nucleotide sequence of GAM895 RNA, herein designated GAM RNA, also designated SEQ ID:379.

Another function of GAM895 is therefore inhibition of MYST2 (Accession NP_008998.1). Accordingly, utilities of GAM895 include diagnosis, prevention and treatment of diseases and clinical conditions associated with MYST2.

Ndrg family member 4 (NDRG4, Accession NP_075061.1) is another GAM895 target gene, herein designated TARGET GENE. NDRG4 BINDING SITE is a target binding site found in the 3' untranslated region of multiple transcripts of mRNA encoded by NDRG4, corresponding to a target binding site such as BINDING SITE I, BINDING SITE II or BINDING SITE III of FIG. 8. Table 4 illustrates the complementarity of the nucleotide sequences of NDRG4 BINDING SITE, designated SEQ ID:12095, to the nucleotide sequence of GAM895 RNA, herein designated GAM RNA, also designated SEQ ID:379.

Another function of GAM895 is therefore inhibition of Ndrg family member 4 (NDRG4, Accession NP_075061.1). Accordingly, utilities of GAM895 include diagnosis, prevention and treatment of diseases and clinical conditions associated with NDRG4.

Ndrg family member 4 (NDRG4, Accession NP_065198.1) is another GAM895 target gene, herein designated TARGET GENE. NDRG4 BINDING SITE is a target binding site found in the 3' untranslated region of multiple transcripts of mRNA encoded by NDRG4, corresponding to a target binding site such as BINDING SITE I, BINDING SITE II or BINDING SITE III of FIG. 8. Table 4 illustrates the complementarity of the nucleotide sequences of NDRG4 BINDING SITE, designated SEQ ID:12095, to the nucleotide sequence of GAM895 RNA, herein designated GAM RNA, also designated SEQ ID:379.

Another function of GAM895 is therefore inhibition of Ndrg family member 4 (NDRG4, Accession NP_065198.1). Accordingly, utilities of GAM895 include diagnosis, prevention and treatment of diseases and clinical conditions associated with NDRG4.

Niemann-pick disease, type c2 (NPC2, Accession NP_006423.1) is another GAM895 target gene, herein designated TARGET GENE. NPC2 BINDING SITE is a target binding site found in the 5' untranslated region of mRNA encoded by NPC2, corresponding to a target binding site such as BINDING SITE I, BINDING SITE II or BINDING SITE III of FIG. 8. Table 4 illustrates the complementarity of the nucleotide sequences of NPC2 BINDING SITE, designated SEQ ID:10948, to the nucleotide sequence of GAM895 RNA, herein designated GAM RNA, also designated SEQ ID:379.

Another function of GAM895 is therefore inhibition of Niemann-pick disease, type c2 (NPC2, Accession NP_006423.1). Accordingly, utilities of GAM895 include diagnosis, prevention and treatment of diseases and clinical conditions associated with NPC2.

Nad(p)h dehydrogenase, quinone 1 (NQO1, Accession NP_000894.1) is another GAM895 target gene, herein designated TARGET GENE. NQO1 BINDING SITE is a target binding site found in the 3' untranslated region of mRNA encoded by NQO1, corresponding to a target binding site such as BINDING SITE I, BINDING SITE II or BINDING SITE III of FIG. 8. Table 4 illustrates the complementarity of the nucleotide sequences of NQO1 BINDING SITE, designated SEQ ID:13009, to the nucleotide sequence of GAM895 RNA, herein designated GAM RNA, also designated SEQ ID:379.

Another function of GAM895 is therefore inhibition of Nad(p)h dehydrogenase, quinone 1 (NQO1, Accession NP_000894.1), a gene which is cytochrome b5 reductase which reduces redox dyes and quinones. Accordingly, utilities of GAM895 include diagnosis, prevention and treatment of diseases and clinical conditions associated with NQO1.

The function of NQO1 and its association with various diseases and clinical conditions, has been established by previous studies, as described hereinabove with reference to GAM189.1. 5'-nucleotidase, ecto (cd73) (NT5E, Accession NP_002517.1) is another GAM895 target gene, herein designated TARGET GENE. NT5E BINDING SITE is a target binding site found in the 3' untranslated region of mRNA encoded by NT5E, corresponding to a target binding site such as BINDING SITE I, BINDING SITE II or BINDING SITE III of FIG. 8. Table 4 illustrates the complementarity of the nucleotide sequences of NT5E BINDING SITE, designated SEQ ID:17625, to the nucleotide sequence of GAM895 RNA, herein designated GAM RNA, also designated SEQ ID:379.

Another function of GAM895 is therefore inhibition of 5'-nucleotidase, ecto (cd73) (NT5E, Accession NP_002517.1). Accordingly, utilities of GAM895 include diagnosis, prevention and treatment of diseases and clinical conditions associated with NT5E.

P5 (Accession NP_005733.1) is another GAM895 target gene, herein designated TARGET GENE. P5 BINDING SITE is a target binding site found in the 3' untranslated region of mRNA encoded by P5, corresponding to a target binding site such as BINDING SITE I, BINDING SITE II or BINDING SITE III of FIG. 8. Table 4 illustrates the complementarity of the nucleotide sequences of P5 BINDING SITE, designated SEQ ID:17994, to the nucleotide sequence of GAM895 RNA, herein designated GAM RNA, also designated SEQ ID:379.

Another function of GAM895 is therefore inhibition of P5 (Accession NP_005733.1). Accordingly, utilities of GAM895 include diagnosis, prevention and treatment of diseases and clinical conditions associated with P5.

Protein phosphatase 3 (formerly 2b), catalytic subunit, alpha isoform (calcineurin a alpha) (PPP3CA, Accession NP_000935.1) is another GAM895 target gene, herein designated TARGET GENE. PPP3CA BINDING SITE is a target binding site found in the 3' untranslated region of mRNA encoded by PPP3CA, corresponding to a target binding site such as BINDING SITE I, BINDING SITE II or BINDING SITE III of FIG. 8. Table 4 illustrates the complementarity of the nucleotide sequences of PPP3CA BINDING SITE, designated SEQ ID:4752, to the nucleotide sequence of GAM895 RNA, herein designated GAM RNA, also designated SEQ ID:379.

Another function of GAM895 is therefore inhibition of Protein phosphatase 3 (formerly 2b), catalytic subunit, alpha isoform (calcineurin a alpha) (PPP3CA, Accession NP_000935.1), a gene which is the catalytic subunit of calcium-dependent, calmodulin-stimulated protein phosphatase. Accordingly, utilities of GAM895 include diagnosis, prevention and treatment of diseases and clinical conditions associated with PPP3CA.

The function of PPP3CA and its association with various diseases and clinical conditions, has been established by previous studies, as described hereinabove with reference to GAM451.1. Protein kinase, y-linked (PRKY, Accession NP_002751.1) is another GAM895 target gene, herein designated TARGET GENE. PRKY BINDING SITE is a target binding site found in the 3' untranslated region of mRNA encoded by PRKY, corresponding to a target binding site such as BINDING SITE I, BINDING SITE II or BINDING SITE III of FIG. 8. Table 4 illustrates the complementarity of the nucleotide sequences of PRKY BINDING SITE, designated SEQ ID:19311, to the nucleotide sequence of GAM895 RNA, herein designated GAM RNA, also designated SEQ ID:379.

Another function of GAM895 is therefore inhibition of Protein kinase, y-linked (PRKY, Accession NP_002751.1), a gene which is a putative protein kinase. Accordingly, utilities of GAM895 include diagnosis, prevention and treatment of diseases and clinical conditions associated with PRKY.

The function of PRKY and its association with various diseases and clinical conditions, has been established by previous studies, as described hereinabove with reference to GAM72.1. Protein s (alpha) (PROS1, Accession NP_000304.1) is another GAM895 target gene, herein designated TARGET GENE. PROS1 BINDING SITE is a target binding site found in the 3' untranslated region of mRNA encoded by PROS1, corresponding to a target binding site such as BINDING SITE I, BINDING SITE II or BINDING SITE III of FIG. 8. Table 4 illustrates the complementarity of the nucleotide sequences of PROS1 BINDING SITE, designated SEQ ID:1078, to the nucleotide sequence of GAM895 RNA, herein designated GAM RNA, also designated SEQ ID:379.

Another function of GAM895 is therefore inhibition of Protein s (alpha) (PROS1, Accession NP_000304.1). Accordingly, utilities of GAM895 include diagnosis, prevention and treatment of diseases and clinical conditions associated with PROS1.

Prostaglandin d2 receptor (dp) (PTGDR, Accession NP_000944.1) is another GAM895 target gene, herein designated TARGET GENE. PTGDR BINDING SITE is a target binding site found in the 3' untranslated region of mRNA encoded by PTGDR, corresponding to a target binding site such as BINDING SITE I, BINDING SITE II or BINDING SITE III of FIG. 8. Table 4 illustrates the complementarity of the nucleotide sequences of PTGDR BINDING SITE, designated SEQ ID:1012, to the nucleotide sequence of GAM895 RNA, herein designated GAM RNA, also designated SEQ ID:379.

Another function of GAM895 is therefore inhibition of Prostaglandin d2 receptor (dp) (PTGDR, Accession NP_000944.1). Accordingly, utilities of GAM895 include diagnosis, prevention and treatment of diseases and clinical conditions associated with PTGDR.

Peroxisomal farnesylated protein (PXF, Accession NP_002848.1) is another GAM895 target gene, herein designated TARGET GENE. PXF BINDING SITE is a target binding site found in the 3' untranslated region of mRNA encoded by PXF, corresponding to a target binding site such as BINDING SITE I, BINDING SITE II or BINDING SITE III of FIG. 8. Table 4 illustrates the complementarity of the nucleotide sequences of PXF BINDING SITE, designated SEQ ID:17226, to the nucleotide sequence of GAM895 RNA, herein designated GAM RNA, also designated SEQ ID:379.

Another function of GAM895 is therefore inhibition of Peroxisomal farnesylated protein (PXF, Accession NP_002848.1), a gene which may function in peroxisomal biogenesis or assembly and therefore may be associated with Peroxisome biogenesis disorder (pbd). Accordingly, utilities of GAM895 include diagnosis, prevention and treatment of Peroxisome biogenesis disorder (pbd), and of other diseases and clinical conditions associated with PXF.

The function of PXF and its association with various diseases and clinical conditions, has been established by previous studies, as described hereinabove with reference to GAM96.1. Rab5a, member ras oncogene family (RAB5A, Accession NP_004153.2) is another GAM895 target gene, herein designated TARGET GENE. RAB5A BINDING SITE is a target binding site found in the 3' untranslated region of mRNA encoded by RAB5A, corresponding to a target binding site such as BINDING SITE I, BINDING SITE II or BINDING SITE III of FIG. 8. Table 4 illustrates the complementarity of the nucleotide sequences of RAB5A BINDING SITE, designated SEQ ID:3629, to the nucleotide sequence of GAM895 RNA, herein designated GAM RNA, also designated SEQ ID:379.

Another function of GAM895 is therefore inhibition of Rab5a, member ras oncogene family (RAB5A, Accession NP_004153.2), a gene which is a rate-limiting component of the machinery regulating the kinetics of membrane traffic. Accordingly, utilities of GAM895 include diagnosis, prevention and treatment of diseases and clinical conditions associated with RAB5A.

The function of RAB5A and its association with various diseases and clinical conditions, has been established by previous studies, as described hereinabove with reference to GAM94.1. Rap2a, member of ras oncogene family (RAP2A, Accession NP_066361.1) is another GAM895 target gene, herein designated TARGET GENE. RAP2A BINDING SITE is a target binding site found in the 3' untranslated region of mRNA encoded by RAP2A, corresponding to a target binding site such as BINDING SITE I, BINDING SITE II or BINDING SITE III of FIG. 8. Table 4 illustrates the complementarity of the nucleotide sequences of RAP2A BINDING SITE, designated SEQ ID:8623, to the nucleotide sequence of GAM895 RNA, herein designated GAM RNA, also designated SEQ ID:379.

Another function of GAM895 is therefore inhibition of Rap2a, member of ras oncogene family (RAP2A, Accession NP_066361.1). Accordingly, utilities of GAM895 include diagnosis, prevention and treatment of diseases and clinical conditions associated with RAP2A.

Ras association (ralgds/af-6) domain family 2 (RASSF2, Accession NP_739580.1) is another GAM895 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:16173, to the nucleotide sequence of GAM895 RNA, herein designated GAM RNA, also designated SEQ ID:379.

Another function of GAM895 is therefore inhibition of Ras association (ralgds/af-6) domain family 2 (RASSF2, Accession NP_739580.1). Accordingly, utilities of GAM895 include diagnosis, prevention and treatment of diseases and clinical conditions associated with RASSF2.

Ras association (ralgds/af-6) domain family 2 (RASSF2, Accession NP_739579.1) is another GAM895 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:16173, to the nucleotide sequence of GAM895 RNA, herein designated GAM RNA, also designated SEQ ID:379.

Another function of GAM895 is therefore inhibition of Ras association (ralgds/af-6) domain family 2 (RASSF2, Accession NP_739579.1). Accordingly, utilities of GAM895 include diagnosis, prevention and treatment of diseases and clinical conditions associated with RASSF2.

Ras association (ralgds/af-6) domain family 2 (RASSF2, Accession NP_055552.1) is another GAM895 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:16173, to the nucleotide sequence of GAM895 RNA, herein designated GAM RNA, also designated SEQ ID:379.

Another function of GAM895 is therefore inhibition of Ras association (ralgds/af-6) domain family 2 (RASSF2, Accession NP_055552.1). Accordingly, utilities of GAM895 include diagnosis, prevention and treatment of diseases and clinical conditions associated with RASSF2.

Seryl-trna synthetase 2 (SARS2, Accession NP_060297.1) is another GAM895 target gene, herein designated TARGET GENE. SARS2 BINDING SITE is a target binding site found in the 3' untranslated region of mRNA encoded by SARS2, corresponding to a target binding site such as BINDING SITE I, BINDING SITE II or BINDING SITE III of FIG. 8. Table 4 illustrates the complementarity of the nucleotide sequences of SARS2 BINDING SITE, designated SEQ ID:3298, to the nucleotide sequence of GAM895 RNA, herein designated GAM RNA, also designated SEQ ID:379.

Another function of GAM895 is therefore inhibition of Seryl-trna synthetase 2 (SARS2, Accession NP_060297.1). Accordingly, utilities of GAM895 include diagnosis, prevention and treatment of diseases and clinical conditions associated with SARS2.

Sec23 homolog b (s. cerevisiae) (SEC23B, Accession NP_116781.1) is another GAM895 target gene, herein designated TARGET GENE. SEC23B BINDING SITE is a target binding site found in the 3' untranslated region of multiple transcripts of mRNA encoded by SEC23B, corresponding to a target binding site such as BINDING SITE I, BINDING SITE II or BINDING SITE III of FIG. 8. Table 4 illustrates the complementarity of the nucleotide sequences of SEC23B BINDING SITE, designated SEQ ID:505, to the nucleotide sequence of GAM895 RNA, herein designated GAM RNA, also designated SEQ ID:379.

Another function of GAM895 is therefore inhibition of Sec23 homolog b (s. cerevisiae) (SEC23B, Accession NP_116781.1). Accordingly, utilities of GAM895 include diagnosis, prevention and treatment of diseases and clinical conditions associated with SEC23B.

Sec23 homolog b (s. cerevisiae) (SEC23B, Accession NP_006354.2) is another GAM895 target gene, herein designated TARGET GENE. SEC23B BINDING SITE is a target binding site found in the 3' untranslated region of multiple transcripts of mRNA encoded by SEC23B, corresponding to a target binding site such as BINDING SITE I, BINDING SITE II or BINDING SITE III of FIG. 8. Table 4 illustrates the complementarity of the nucleotide sequences of SEC23B BINDING SITE, designated SEQ ID:505, to the nucleotide sequence of GAM895 RNA, herein designated GAM RNA, also designated SEQ ID:379.

Another function of GAM895 is therefore inhibition of Sec23 homolog b (s. cerevisiae) (SEC23B, Accession NP_006354.2). Accordingly, utilities of GAM895 include diagnosis, prevention and treatment of diseases and clinical conditions associated with SEC23B.

Sec23 homolog b (s. cerevisiae) (SEC23B, Accession NP_116780.1) is another GAM895 target gene, herein designated TARGET GENE. SEC23B BINDING SITE is a target binding site found in the 3' untranslated region of multiple transcripts of mRNA encoded by SEC23B, corresponding to a target binding site such as BINDING SITE I, BINDING SITE II or BINDING SITE III of FIG. 8. Table 4 illustrates the complementarity of the nucleotide sequences of SEC23B BINDING SITE, designated SEQ ID:505, to the nucleotide sequence of GAM895 RNA, herein designated GAM RNA, also designated SEQ ID:379.

Another function of GAM895 is therefore inhibition of Sec23 homolog b (s. cerevisiae) (SEC23B, Accession NP_116780.1). Accordingly, utilities of GAM895 include diagnosis, prevention and treatment of diseases and clinical conditions associated with SEC23B.

Sideroflexin 1 (SFXN1, Accession NP_073591.2) is another GAM895 target gene, herein designated TARGET GENE. SFXN1 BINDING SITE is a target binding site found in the 3' untranslated region of mRNA encoded by SFXN1, corresponding to a target binding site such as BINDING SITE I, BINDING SITE II or BINDING SITE III of FIG. 8. Table 4 illustrates the complementarity of the nucleotide sequences of SFXN1 BINDING SITE, designated SEQ ID:4597, to the nucleotide sequence of GAM895 RNA, herein designated GAM RNA, also designated SEQ ID:379.

Another function of GAM895 is therefore inhibition of Sideroflexin 1 (SFXN1, Accession NP_073591.2). Accordingly, utilities of GAM895 include diagnosis, prevention and treatment of diseases and clinical conditions associated with SFXN1.

Siat7c (Accession NP_694541.1) is another GAM895 target gene, herein designated TARGET GENE. Siat7c BINDING SITE is a target binding site found in the 3' untranslated region of mRNA encoded by Siat7c, corresponding to a target binding site such as BINDING SITE I, BINDING SITE II or BINDING SITE III of FIG. 8. Table 4 illustrates the complementarity of the nucleotide sequences of Siat7c BINDING SITE, designated SEQ ID:3113, to the nucleotide sequence of GAM895 RNA, herein designated GAM RNA, also designated SEQ ID:379.

Another function of GAM895 is therefore inhibition of Siat7c (Accession NP_694541.1). Accordingly, utilities of GAM895 include diagnosis, prevention and treatment of diseases and clinical conditions associated with Siat7c.

S-phase kinase-associated protein 1a (p19a) (SKP1A, Accession NP_008861.2) is another GAM895 target gene, herein designated TARGET GENE. SKP1A BINDING SITE is a target binding site found in the 3' untranslated region of multiple transcripts of mRNA encoded by SKP1A, corresponding to a target binding site such as BINDING SITE I, BINDING SITE II or BINDING SITE III of FIG. 8. Table 4 illustrates the complementarity of the nucleotide sequences of SKP1A BINDING SITE, designated SEQ ID:19958, to the nucleotide sequence of GAM895 RNA, herein designated GAM RNA, also designated SEQ ID:379.

Another function of GAM895 is therefore inhibition of S-phase kinase-associated protein 1a (p19a) (SKP1A, Accession NP_008861.2). Accordingly, utilities of GAM895 include diagnosis, prevention and treatment of diseases and clinical conditions associated with SKP1A.

S-phase kinase-associated protein 1a (p19a) (SKP1A, Accession NP_733779.1) is another GAM895 target gene, herein designated TARGET GENE. SKP1A BINDING SITE is a target binding site found in the 3' untranslated region of multiple transcripts of mRNA encoded by SKP1A, corresponding to a target binding site such as BINDING SITE I, BINDING SITE II or BINDING SITE III of FIG. 8. Table 4 illustrates the complementarity of the nucleotide sequences of SKP1A BINDING SITE, designated SEQ ID:19958, to the nucleotide sequence of GAM895 RNA, herein designated GAM RNA, also designated SEQ ID:379.

Another function of GAM895 is therefore inhibition of S-phase kinase-associated protein 1a (p19a) (SKP1A, Accession NP_733779.1). Accordingly, utilities of GAM895 include diagnosis, prevention and treatment of diseases and clinical conditions associated with SKP1A.

Spermatogenesis associated 2 (SPATA2, Accession NP_006029.1) is another GAM895 target gene, herein designated TARGET GENE. SPATA2 BINDING SITE is a target binding site found in the 3' untranslated region of mRNA encoded by SPATA2, corresponding to a target binding site such as BINDING SITE I, BINDING SITE II or BINDING SITE III of FIG. 8. Table 4 illustrates the complementarity of the nucleotide sequences of SPATA2 BINDING SITE, designated SEQ ID:17327, to the nucleotide sequence of GAM895 RNA, herein designated GAM RNA, also designated SEQ ID:379.

Another function of GAM895 is therefore inhibition of Spermatogenesis associated 2 (SPATA2, Accession NP_006029.1). Accordingly, utilities of GAM895 include diagnosis, prevention and treatment of diseases and clinical conditions associated with SPATA2.

SRGAP1 (Accession XP_051143.3) is another GAM895 target gene, herein designated TARGET GENE. SRGAP1 BINDING SITE is a target binding site found in the 5' untranslated region of mRNA encoded by SRGAP1, corresponding to a target binding site such as BINDING SITE I, BINDING SITE II or BINDING SITE III of FIG. 8. Table 4 illustrates the complementarity of the nucleotide sequences of SRGAP1 BINDING SITE, designated SEQ ID:6087, to the nucleotide sequence of GAM895 RNA, herein designated GAM RNA, also designated SEQ ID:379.

Another function of GAM895 is therefore inhibition of SRGAP1 (Accession XP_051143.3). Accordingly, utilities of GAM895 include diagnosis, prevention and treatment of diseases and clinical conditions associated with SRGAP1.

Signal transducer and activator of transcription 1, 91 kda (STAT1, Accession NP_009330.1) is another GAM895 target gene, herein designated TARGET GENE. STAT1 BINDING SITE is a target binding site found in the 3' untranslated region of multiple transcripts of mRNA encoded by STAT1, corresponding to a target binding site such as BINDING SITE I, BINDING SITE II or BINDING SITE III of FIG. 8. Table 4 illustrates the complementarity of the nucleotide sequences of STAT1 BINDING SITE, designated SEQ ID:14937, to the nucleotide sequence of GAM895 RNA, herein designated GAM RNA, also designated SEQ ID:379.

Another function of GAM895 is therefore inhibition of Signal transducer and activator of transcription 1, 91 kda (STAT1, Accession NP_009330.1), a gene which is involved in transcriptional regulation. Accordingly, utilities of GAM895 include diagnosis, prevention and treatment of diseases and clinical conditions associated with STAT1.

The function of STAT1 and its association with various diseases and clinical conditions, has been established by previous studies, as described hereinabove with reference to GAM44.1. Synaptotagmin vi (SYT6, Accession XP_086135.1) is another GAM895 target gene, herein designated TARGET GENE. SYT6 BINDING SITE is a target binding site found in the 3' untranslated region of mRNA encoded by SYT6, corresponding to a target binding site such as BINDING SITE I, BINDING SITE II or BINDING SITE III of FIG. 8. Table 4 illustrates the complementarity of the nucleotide sequences of SYT6 BINDING SITE, designated SEQ ID:9597, to the nucleotide sequence of GAM895 RNA, herein designated GAM RNA, also designated SEQ ID:379.

Another function of GAM895 is therefore inhibition of Synaptotagmin vi (SYT6, Accession XP_086135.1). Accordingly, utilities of GAM895 include diagnosis, prevention and treatment of diseases and clinical conditions associated with SYT6.

Tbc1 domain family, member 4 (TBC1D4, Accession NP_055647.1) is another GAM895 target gene, herein designated TARGET GENE. TBC1D4 BINDING SITE is a target binding site found in the 3' untranslated region of mRNA encoded by TBC1D4, corresponding to a target binding site such as BINDING SITE I, BINDING SITE II or BINDING SITE III of FIG. 8. Table 4 illustrates the complementarity of the nucleotide sequences of TBC1D4 BINDING SITE, designated SEQ ID:14754, to the nucleotide sequence of GAM895 RNA, herein designated GAM RNA, also designated SEQ ID:379.

Another function of GAM895 is therefore inhibition of Tbc1 domain family, member 4 (TBC1D4, Accession NP_055647.1). Accordingly, utilities of GAM895 include diagnosis, prevention and treatment of diseases and clinical conditions associated with TBC1D4.

T-cell leukemia/lymphoma 6 (TCL6, Accession NP_065575.1) is another GAM895 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:779 and SEQ ID:5137 respectively, to the nucleotide sequence of GAM895 RNA, herein designated GAM RNA, also designated SEQ ID:379.

Another function of GAM895 is therefore inhibition of T-cell leukemia/lymphoma 6 (TCL6, Accession NP_065575.1). Accordingly, utilities of GAM895 include diagnosis, prevention and treatment of diseases and clinical conditions associated with TCL6.

T-cell leukemia/lymphoma 6 (TCL6, Accession NP_055233.1) is another GAM895 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:5137 and SEQ ID:779 respectively, to the nucleotide sequence of GAM895 RNA, herein designated GAM RNA, also designated SEQ ID:379.

Another function of GAM895 is therefore inhibition of T-cell leukemia/lymphoma 6 (TCL6, Accession NP_055233.1). Accordingly, utilities of GAM895 include diagnosis, prevention and treatment of diseases and clinical conditions associated with TCL6.

T-cell leukemia/lymphoma 6 (TCL6, Accession NP_065577.2) is another GAM895 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:779 and SEQ ID:5137 respectively, to the nucleotide sequence of GAM895 RNA, herein designated GAM RNA, also designated SEQ ID:379.

Another function of GAM895 is therefore inhibition of T-cell leukemia/lymphoma 6 (TCL6, Accession NP_065577.2). Accordingly, utilities of GAM895 include diagnosis, prevention and treatment of diseases and clinical conditions associated with TCL6.

T-cell leukemia/lymphoma 6 (TCL6, Accession NP_036600.2) is another GAM895 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:5137 and SEQ ID:779 respectively, to the nucleotide sequence of GAM895 RNA, herein designated GAM RNA, also designated SEQ ID:379.

Another function of GAM895 is therefore inhibition of T-cell leukemia/lymphoma 6 (TCL6, Accession NP_036600.2). Accordingly, utilities of GAM895 include diagnosis, prevention and treatment of diseases and clinical conditions associated with TCL6.

TPT (Accession NP_055132.1) is another GAM895 target gene, herein designated TARGET GENE. TPT BINDING SITE is a target binding site found in the 3' untranslated region of mRNA encoded by TPT, corresponding to a target binding site such as BINDING SITE I, BINDING SITE II or BINDING SITE III of FIG. 8. Table 4 illustrates the complementarity of the nucleotide sequences of TPT BINDING SITE, designated SEQ ID:17162, to the nucleotide sequence of GAM895 RNA, herein designated GAM RNA, also designated SEQ ID:379.

Another function of GAM895 is therefore inhibition of TPT (Accession NP_055132.1), a gene which Moderately similar to decaprenyl diphosphate synthase (S. pombe dps) and therefore may be associated with Triphalangeal thumb-polysyndactyly syndrome. Accordingly, utilities of GAM895 include diagnosis, prevention and treatment of Triphalangeal thumb-polysyndactyly syndrome, and of other diseases and clinical conditions associated with TPT.

The function of TPT has been established by previous studies. Nicolai and Hamel (1988) described a large family in which multiple members exhibited a spectrum of pre- and postaxial anomalies of the limbs inherited as an autosomal dominant. In another study of this family, Tsukurov et al. (1994) found linkage of the malformation to a highly polymorphic locus containing a short tandem repeat sequence (STR), D7S550, located at 7q36; maximum lod score =6.85 at theta =0.0. This region is homologous to a segment of mouse chromosome 5 where 2 nonallelic mutations, 'hammer- toe' (Hm) and 'hemimelic extra toes' (Hx), have been mapped. In the family reported by Tsukurov et al. (1994), hand malformations were typically bilateral but usually asymmetric. Both pre- and postaxial polydactyly and syndactyly were present. In all affected individuals the thumb was triphalangeal and the index finger was normal. Malformations of the feet were present in some affected persons but were usually less severe than those observed in the hands. Variable expression of the disease gene was demonstrated by asymmetries in limb deformities of affected individuals and the differences observed between monozygotic twins. Heus et al. (1999) constructed a detailed physical map of the candidate region for this form of preaxial polydactyly. They used a combination of methods to identify and position 11 transcripts within this map. By recombination analysis on families with preaxial polydactyly, they reduced the candidate region to approximately 450 kb. Mapping to the refined candidate region were the homeo box gene HLXB9 (OMIM Ref. No. 142994), a putative receptor (C7ORF2; 605522), and 2 transcripts of unknown function. All 4 transcripts were analyzed and sequenced in patients with preaxial polydactyly, but no pathogenic mutations were identified. Balci et al. (1999) described a Turkish family with triphalangeal thumb-polysyndactyly syndrome. Characteristic findings in this family were triphalangeal thumb, webbing between third, fourth, and fifth fingers associated with bony synostosis in the distal phalanges of the same fingers, and pre- and postaxial polysyndactyly of the feet. Some affected members of the family showed a more severe phenotype with complete syndactyly of all fingers giving a 'cup-like' appearance to the hands. Genetic linkage studies demonstrated linkage to 7q36. Kantaputra and Chalidapong (2000) reported a Thai man who had triphalangeal thumb-polysyndactyly syndrome and his daughter who had tibial hemimelia-polysyndactyly-triphalangeal thumb syndrome (OMIM Ref. No. 188770). The authors proposed that these conditions are actually the same disorder with wide variability. They suggested this condition be called 'tibial hemimelia-polysyndactyly-triphalangeal thumbs syndrome.'

Full details of the abovementioned studies are described in the following publications, the disclosure of which are hereby incorporated by reference:

Kantaputra, P. N.; Chalidapong, P.: Are triphalangeal thumb-polysyndactyly syndrome (TPTPS) and tibial hemimelia-polysyndactyly-triphalangeal thumb syndrome (THPTTS) identical?: A father with TPTPS and his daughter with THPTTS in a Thai family. Am. J. Med. Genet. 93:126-131, 2000; and Nicolai, J.-P. A.; Hamel, B. C. J.: A family with complex bilateral polysyndactyly. J. Hand Surg. 13A:405-407, 1988.

Further studies establishing the function and utilities of TPT are found in John Hopkins OMIM database record ID 190605, and in cited publications listed in Table 5, which are hereby incorporated by reference. Unc-5 homolog d (c. elegans) (UNC5D, Accession NP_543148.1) is another GAM895 target gene, herein designated TARGET GENE. UNC5D BINDING SITE is a target binding site found in the 3' untranslated region of mRNA encoded by UNC5D, corresponding to a target binding site such as BINDING SITE I, BINDING SITE II or BINDING SITE III of FIG. 8. Table 4 illustrates the complementarity of the nucleotide sequences of UNC5D BINDING SITE, designated SEQ ID:20188, to the nucleotide sequence of GAM895 RNA, herein designated GAM RNA, also designated SEQ ID:379.

Another function of GAM895 is therefore inhibition of Unc-5 homolog d (c. elegans) (UNC5D, Accession NP_543148.1). Accordingly, utilities of GAM895 include diagnosis, prevention and treatment of diseases and clinical conditions associated with UNC5D.

Vent-like homeobox 2 (VENTX2, Accession NP_055283.1) is another GAM895 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:6385, to the nucleotide sequence of GAM895 RNA, herein designated GAM RNA, also designated SEQ ID:379.

Another function of GAM895 is therefore inhibition of Vent-like homeobox 2 (VENTX2, Accession NP_055283.1). Accordingly, utilities of GAM895 include diagnosis, prevention and treatment of diseases and clinical conditions associated with VENTX2.

ZNF-kaiso (Accession NP_006768.1) is another GAM895 target gene, herein designated TARGET GENE. ZNF-kaiso BINDING SITE is a target binding site found in the 3' untranslated region of mRNA encoded by ZNF-kaiso, corresponding to a target binding site such as BINDING SITE I, BINDING SITE II or BINDING SITE III of FIG. 8. Table 4 illustrates the complementarity of the nucleotide sequences of ZNF-kaiso BINDING SITE, designated SEQ ID:3272, to the nucleotide sequence of GAM895 RNA, herein designated GAM RNA, also designated SEQ ID:379.

Another function of GAM895 is therefore inhibition of ZNF-kaiso (Accession NP_006768.1). Accordingly, utilities of GAM895 include diagnosis, prevention and treatment of diseases and clinical conditions associated with ZNF-kaiso.

FIG. 8 further provides a conceptual description of a novel bioinformatically detected of the present invention, referred to here as Genomic Address Messenger 1032 (GAM1032), which modulates expression of respective target genes thereof, the function and utility of which target genes is known in the art.

GAM1032 is a novel bioinformatically detected regulatory, non protein coding, micro RNA (miRNA) gene. The method by which GAM1032 was detected is described hereinabove with reference to FIGS. 8-15.

GAM1032 gene, herein designated GAM GENE, and GAM1032 target gene, herein designated TARGET GENE, are human genes contained in the human genome.

GAM1032 gene encodes a GAM1032 precursor RNA, herein designated GAM PRECURSOR RNA. Similar to other miRNA genes, and unlike most ordinary genes, GAM1032 precursor RNA does not encode a protein. A nucleotide sequence identical or highly similar to the nucleotide sequence of GAM1032 precursor RNA is designated SEQ ID:169, and is provided hereinbelow with reference to the sequence listing part. Nucleotide sequence SEQ ID:169 is located at position 141427181 relative to chromosome 8.

GAM1032 precursor RNA folds onto itself, forming GAM1032 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM1032 precursor RNA folds onto itself, forming GAM1032 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM1032 precursor RNA, designated SEQ-ID:169, and a schematic representation of a predicted secondary folding of GAM1032 folded precursor RNA are further described with reference to Table 2, hereby incorporated by reference.

An enzyme complex designated DICER COMPLEX, 'dices' the GAM1032 folded precursor RNA into GAM1032 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM1032 RNA is designated SEQ ID:303, and is provided hereinbelow with references to the sequence listing part and Table 3, hereby incorporated by reference.

GAM1032 target gene, herein designated TARGET GENE, encodes a corresponding messenger RNA, GAM1032 target RNA, herein designated GAM TARGET RNA. GAM1032 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM1032 RNA, herein designated GAM RNA, binds complementarily to one or more target binding sites located in untranslated regions of GAM1032 target RNA, herein designated GAM TARGET RNA. This complementary binding is due to the fact that the nucleotide sequence of GAM1032 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM1032 RNA may have a different number of target binding sites in untranslated regions of a GAM1032 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM1032 RNA, herein designated GAM RNA, to target binding sites on GAM1032 target RNA, herein designated GAM TARGET RNA, such as BINDING SITE I, BINDING SITE II and BINDING SITE III, inhibits translation of GAM1032 target RNA into GAM1032 target protein, herein designated GAM TARGET PROTEIN. GAM target protein is therefore outlined by a broken line.

It is appreciated that GAM1032 target gene, herein designated TARGET GENE, in fact represents a plurality of GAM1032 target genes. The mRNA of each one of this plurality of GAM1032 target genes comprises one or more target binding sites, each having a nucleotide sequence which is at least partly complementary to GAM1032 RNA, herein designated GAM RNA, and which when bound by GAM1032 RNA causes inhibition of translation of respective one or more GAM1032 target proteins.

It is further appreciated by one skilled in the art that the mode of translational inhibition illustrated by FIG. 8 with specific reference to translational inhibition exerted by GAM1032 gene, herein designated GAM GENE, on one or more GAM1032 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM1032 correlate with, and may be deduced from, the identity of the target genes which GAM1032 binds and inhibits, and the function of these target genes, as elaborated hereinbelow.

Acid phosphatase 1, soluble (ACP1, Accession NP_004291.1) is a GAM1032 target gene, herein designated TARGET GENE. ACP1 BINDING SITE is a target binding site found in the 3' untranslated region of multiple transcripts of mRNA encoded by ACP1, corresponding to a target binding site such as BINDING SITE I, BINDING SITE II or BINDING SITE III of FIG. 8. Table 4 illustrates the complementarity of the nucleotide sequences of ACP1 BINDING SITE, designated SEQ ID:2659, to the nucleotide sequence of GAM1032 RNA, herein designated GAM RNA, also designated SEQ ID:303.

A function of GAM1032 is therefore inhibition of Acid phosphatase 1, soluble (ACP1, Accession NP_004291.1), a gene which as demonstrated in starch-gel electrophoresis. and therefore may be associated with Acid phosphatase 1, soluble, a/b polymorphism of. Accordingly, utilities of GAM1032 include diagnosis, prevention and treatment of Acid phosphatase 1, soluble, a/b polymorphism of, and of other diseases and clinical conditions associated with ACP1.

The function of ACP1 and its association with various diseases and clinical conditions, has been established by previous studies, as described hereinabove with reference to GAM63.1. Acid phosphatase 1, soluble (ACP1, Accession NP_009030.1) is another GAM1032 target gene, herein designated TARGET GENE. ACP1 BINDING SITE is a target binding site found in the 3' untranslated region of multiple transcripts of mRNA encoded by ACP1, corresponding to a target binding site such as BINDING SITE I, BINDING SITE II or BINDING SITE III of FIG. 8. Table 4 illustrates the complementarity of the nucleotide sequences of ACP1 BINDING SITE, designated SEQ ID:2659, to the nucleotide sequence of GAM1032 RNA, herein designated GAM RNA, also designated SEQ ID:303.

Another function of GAM1032 is therefore inhibition of Acid phosphatase 1, soluble (ACP1, Accession NP_009030.1), a gene which as demonstrated in starch-gel electrophoresis. and therefore may be associated with Acid phosphatase 1, soluble, a/b polymorphism of. Accordingly, utilities of GAM1032 include diagnosis, prevention and treatment of Acid phosphatase 1, soluble, a/b polymorphism of, and of other diseases and clinical conditions associated with ACP1.

The function of ACP1 and its association with various diseases and clinical conditions, has been established by previous studies, as described hereinabove with reference to GAM63.1. Acid phosphatase 1, soluble (ACP1, Accession NP_808222.1) is another GAM1032 target gene, herein designated TARGET GENE. ACP1 BINDING SITE is a target binding site found in the 3' untranslated region of multiple transcripts of mRNA encoded by ACP1, corresponding to a target binding site such as BINDING SITE I, BINDING SITE II or BINDING SITE III of FIG. 8. Table 4 illustrates the complementarity of the nucleotide sequences of ACP1 BINDING SITE, designated SEQ ID:2659, to the nucleotide sequence of GAM1032 RNA, herein designated GAM RNA, also designated SEQ ID:303.

Another function of GAM1032 is therefore inhibition of Acid phosphatase 1, soluble (ACP1, Accession NP_808222.1), a gene which as demonstrated in starch-gel electrophoresis. and therefore may be associated with Acid phosphatase 1, soluble, a/b polymorphism of. Accordingly, utilities of GAM1032 include diagnosis, prevention and treatment of Acid phosphatase 1, soluble, a/b polymorphism of, and of other diseases and clinical conditions associated with ACP1.

The function of ACP1 and its association with various diseases and clinical conditions, has been established by previous studies, as described hereinabove with reference to GAM63.1. Adenylate cyclase 1 (brain) (ADCY1, Accession NP_066939.1) is another GAM1032 target gene, herein designated TARGET GENE. ADCY1 BINDING SITE is a target binding site found in the 3' untranslated region of multiple transcripts of mRNA encoded by ADCY1, corresponding to a target binding site such as BINDING SITE I, BINDING SITE II or BINDING SITE III of FIG. 8. Table 4 illustrates the complementarity of the nucleotide sequences of ADCY1 BINDING SITE, designated SEQ ID:5742, to the nucleotide sequence of GAM1032 RNA, herein designated GAM RNA, also designated SEQ ID:303.

Another function of GAM1032 is therefore inhibition of Adenylate cyclase 1 (brain) (ADCY1, Accession NP_066939.1), a gene which a calmodulin-sensitive adenylyl cyclase. it may play a role in memory acquisition and learning. Accordingly, utilities of GAM1032 include diagnosis, prevention and treatment of diseases and clinical conditions associated with ADCY1.

The function of ADCY1 and its association with various diseases and clinical conditions, has been established by previous studies, as described hereinabove with reference to GAM144.1. Amyotrophic lateral sclerosis 2 (juvenile) (ALS2, Accession NP_065970.1) is another GAM1032 target gene, herein designated TARGET GENE. ALS2 BINDING SITE is a target binding site found in the 5' untranslated region of mRNA encoded by ALS2, corresponding to a target binding site such as BINDING SITE I, BINDING SITE II or BINDING SITE III of FIG. 8. Table 4 illustrates the complementarity of the nucleotide sequences of ALS2 BINDING SITE, designated SEQ ID:5747, to the nucleotide sequence of GAM1032 RNA, herein designated GAM RNA, also designated SEQ ID:303.

Another function of GAM1032 is therefore inhibition of Amyotrophic lateral sclerosis 2 (juvenile) (ALS2, Accession NP_065970.1). Accordingly, utilities of GAM1032 include diagnosis, prevention and treatment of diseases and clinical conditions associated with ALS2.

Angiomotin (AMOT, Accession NP_573572.1) is another GAM1032 target gene, herein designated TARGET GENE. AMOT BINDING SITE is a target binding site found in the 5' untranslated region of mRNA encoded by AMOT, corresponding to a target binding site such as BINDING SITE I, BINDING SITE II or BINDING SITE III of FIG. 8. Table 4 illustrates the complementarity of the nucleotide sequences of AMOT BINDING SITE, designated SEQ ID:4436, to the nucleotide sequence of GAM1032 RNA, herein designated GAM RNA, also designated SEQ ID:303.

Another function of GAM1032 is therefore inhibition of Angiomotin (AMOT, Accession NP_573572.1). Accordingly, utilities of GAM1032 include diagnosis, prevention and treatment of diseases and clinical conditions associated with AMOT.

ANKT (Accession NP_057443.1) is another GAM1032 target gene, herein designated TARGET GENE. ANKT BINDING SITE is a target binding site found in the 3' untranslated region of multiple transcripts of mRNA encoded by ANKT, corresponding to a target binding site such as BINDING SITE I, BINDING SITE II or BINDING SITE III of FIG. 8. Table 4 illustrates the complementarity of the nucleotide sequences of ANKT BINDING SITE, designated SEQ ID:15792, to the nucleotide sequence of GAM1032 RNA, herein designated GAM RNA, also designated SEQ ID:303.

Another function of GAM1032 is therefore inhibition of ANKT (Accession NP_057443.1). Accordingly, utilities of GAM1032 include diagnosis, prevention and treatment of diseases and clinical conditions associated with ANKT.

ANKT (Accession NP_060924.4) is another GAM1032 target gene, herein designated TARGET GENE. ANKT BINDING SITE is a target binding site found in the 3' untranslated region of multiple transcripts of mRNA encoded by ANKT, corresponding to a target binding site such as BINDING SITE I, BINDING SITE II or BINDING SITE III of FIG. 8. Table 4 illustrates the complementarity of the nucleotide sequences of ANKT BINDING SITE, designated SEQ ID:15792, to the nucleotide sequence of GAM1032 RNA, herein designated GAM RNA, also designated SEQ ID:303.

Another function of GAM1032 is therefore inhibition of ANKT (Accession NP_060924.4). Accordingly, utilities of GAM1032 include diagnosis, prevention and treatment of diseases and clinical conditions associated with ANKT.

Apolipoprotein l, 6 (APOL6, Accession NP_085144.1) is another GAM1032 target gene, herein designated TARGET GENE. APOL6 BINDING SITE is a target binding site found in the 3' untranslated region of mRNA encoded by APOL6, corresponding to a target binding site such as BINDING SITE I, BINDING SITE II or BINDING SITE III of FIG. 8. Table 4 illustrates the complementarity of the nucleotide sequences of APOL6 BINDING SITE, designated SEQ ID:19543, to the nucleotide sequence of GAM1032 RNA, herein designated GAM RNA, also designated SEQ ID:303.

Another function of GAM1032 is therefore inhibition of Apolipoprotein l, 6 (APOL6, Accession NP_085144.1). Accordingly, utilities of GAM1032 include diagnosis, prevention and treatment of diseases and clinical conditions associated with APOL6.

Bardet-biedl syndrome 4 (BBS4, Accession NP_149017.2) is another GAM1032 target gene, herein designated TARGET GENE. BBS4 BINDING SITE is a target binding site found in the 3' untranslated region of mRNA encoded by BBS4, corresponding to a target binding site such as BINDING SITE I, BINDING SITE II or BINDING SITE III of FIG. 8. Table 4 illustrates the complementarity of the nucleotide sequences of BBS4 BINDING SITE, designated SEQ ID:12747, to the nucleotide sequence of GAM1032 RNA, herein designated GAM RNA, also designated SEQ ID:303.

Another function of GAM1032 is therefore inhibition of Bardet-biedl syndrome 4 (BBS4, Accession NP_149017.2). Accordingly, utilities of GAM1032 include diagnosis, prevention and treatment of diseases and clinical conditions associated with BBS4.

BG1 (Accession NP_055977.3) is another GAM1032 target gene, herein designated TARGET GENE. BG1 BINDING SITE is a target binding site found in the 3' untranslated region of mRNA encoded by BG1, corresponding to a target binding site such as BINDING SITE I, BINDING SITE II or BINDING SITE III of FIG. 8. Table 4 illustrates the complementarity of the nucleotide sequences of BG1 BINDING SITE, designated SEQ ID:19594, to the nucleotide sequence of GAM1032 RNA, herein designated GAM RNA, also designated SEQ ID:303.

Another function of GAM1032 is therefore inhibition of BG1 (Accession NP_055977.3). Accordingly, utilities of GAM1032 include diagnosis, prevention and treatment of diseases and clinical conditions associated with BG1.

Biphenyl hydrolase-like (serine hydrolase; breast epithelial mucin-associated antigen) (BPHL, Accession NP_004323.1) is another GAM1032 target gene, herein designated TARGET GENE. BPHL BINDING SITE is a target binding site found in the 3' untranslated region of mRNA encoded by BPHL, corresponding to a target binding site such as BINDING SITE I, BINDING SITE II or BINDING SITE III of FIG. 8. Table 4 illustrates the complementarity of the nucleotide sequences of BPHL BINDING SITE, designated SEQ ID:4510, to the nucleotide sequence of GAM1032 RNA, herein designated GAM RNA, also designated SEQ ID:303.

Another function of GAM1032 is therefore inhibition of Biphenyl hydrolase-like (serine hydrolase; breast epithelial mucin-associated antigen) (BPHL, Accession NP_004323.1), a gene which involves in detoxification processes. Accordingly, utilities of GAM1032 include diagnosis, prevention and treatment of diseases and clinical conditions associated with BPHL.

The function of BPHL and its association with various diseases and clinical conditions, has been established by previous studies, as described hereinabove with reference to GAM72.1. Chromosome 15 open reading frame 12 (C15orf12, Accession NP_060755.1) is another GAM1032 target gene, herein designated TARGET GENE. C15orf12 BINDING SITE is a target binding site found in the 3' untranslated region of mRNA encoded by C15orf12, corresponding to a target binding site such as BINDING SITE I, BINDING SITE II or BINDING SITE III of FIG. 8. Table 4 illustrates the complementarity of the nucleotide sequences of C15orf12 BINDING SITE, designated SEQ ID:10592, to the nucleotide sequence of GAM1032 RNA, herein designated GAM RNA, also designated SEQ ID:303.

Another function of GAM1032 is therefore inhibition of Chromosome 15 open reading frame 12 (C15orf12, Accession NP_060755.1). Accordingly, utilities of GAM1032 include diagnosis, prevention and treatment of diseases and clinical conditions associated with C15orf12.

Chromosome 17 open reading frame 28 (C17orf28, Accession NP_085133.1) is another GAM1032 target gene, herein designated TARGET GENE. C17orf28 BINDING SITE is a target binding site found in the 3' untranslated region of mRNA encoded by C17orf28, corresponding to a target binding site such as BINDING SITE I, BINDING SITE II or BINDING SITE III of FIG. 8. Table 4 illustrates the complementarity of the nucleotide sequences of C17orf28 BINDING SITE, designated SEQ ID:6729, to the nucleotide sequence of GAM1032 RNA, herein designated GAM RNA, also designated SEQ ID:303.

Another function of GAM1032 is therefore inhibition of Chromosome 17 open reading frame 28 (C17orf28, Accession NP_085133.1). Accordingly, utilities of GAM1032 include diagnosis, prevention and treatment of diseases and clinical conditions associated with C17orf28.

Chromosome 1 open reading frame 21 (C1orf21, Accession NP_110433.1) is another GAM1032 target gene, herein designated TARGET GENE. C1orf21 BINDING SITE is a target binding site found in the 3' untranslated region of mRNA encoded by C1orf21, corresponding to a target binding site such as BINDING SITE I, BINDING SITE II or BINDING SITE III of FIG. 8. Table 4 illustrates the complementarity of the nucleotide sequences of C1orf21 BINDING SITE, designated SEQ ID:17052, to the nucleotide sequence of GAM1032 RNA, herein designated GAM RNA, also designated SEQ ID:303.

Another function of GAM1032 is therefore inhibition of Chromosome 1 open reading frame 21 (C1orf21, Accession NP_110433.1). Accordingly, utilities of GAM1032 include diagnosis, prevention and treatment of diseases and clinical conditions associated with C1orf21.

Chromosome 20 open reading frame 129 (C20orf129, Accession NP_112181.1) is another GAM1032 target gene, herein designated TARGET GENE. C20orf129 BINDING SITE is a target binding site found in the 3' untranslated region of mRNA encoded by C20orf129, corresponding to a target binding site such as BINDING SITE I, BINDING SITE II or BINDING SITE III of FIG. 8. Table 4 illustrates the complementarity of the nucleotide sequences of C20orf129 BINDING SITE, designated SEQ ID:11258, to the nucleotide sequence of GAM1032 RNA, herein designated GAM RNA, also designated SEQ ID:303.

Another function of GAM1032 is therefore inhibition of Chromosome 20 open reading frame 129 (C20orf129, Accession NP_112181.1). Accordingly, utilities of GAM1032 include diagnosis, prevention and treatment of diseases and clinical conditions associated with C20orf129.

Chromosome 20 open reading frame 161 (C20orf161, Accession NP_219489.1) is another GAM1032 target gene, herein designated TARGET GENE. C20orf161 BINDING SITE is a target binding site found in the 3' untranslated region of multiple transcripts of mRNA encoded by C20orf161, corresponding to a target binding site such as BINDING SITE I, BINDING SITE II or BINDING SITE III of FIG. 8. Table 4 illustrates the complementarity of the nucleotide sequences of C20orf161 BINDING SITE, designated SEQ ID:10164, to the nucleotide sequence of GAM1032 RNA, herein designated GAM RNA, also designated SEQ ID:303.

Another function of GAM1032 is therefore inhibition of Chromosome 20 open reading frame 161 (C20orf161, Accession NP_219489.1). Accordingly, utilities of GAM1032 include diagnosis, prevention and treatment of diseases and clinical conditions associated with C20orf161.

Chromosome 21 open reading frame 97 (C21orf97, Accession NP_068760.1) is another GAM1032 target gene, herein designated TARGET GENE. C21orf97 BINDING SITE is a target binding site found in the 3' untranslated region of mRNA encoded by C21orf97, corresponding to a target binding site such as BINDING SITE I, BINDING SITE II or BINDING SITE III of FIG. 8. Table 4 illustrates the complementarity of the nucleotide sequences of C21orf97 BINDING SITE, designated SEQ ID:5545, to the nucleotide sequence of GAM1032 RNA, herein designated GAM RNA, also designated SEQ ID:303.

Another function of GAM1032 is therefore inhibition of Chromosome 21 open reading frame 97 (C21orf97, Accession NP_068760.1). Accordingly, utilities of GAM1032 include diagnosis, prevention and treatment of diseases and clinical conditions associated with C21orf97.

Calcium/calmodulin-dependent protein kinase kinase 2, beta (CAMKK2, Accession NP_705720.1) is another GAM1032 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:7725, to the nucleotide sequence of GAM1032 RNA, herein designated GAM RNA, also designated SEQ ID:303.

Another function of GAM1032 is therefore inhibition of Calcium/calmodulin-dependent protein kinase kinase 2, beta (CAMKK2, Accession NP_705720.1). Accordingly, utilities of GAM1032 include diagnosis, prevention and treatment of diseases and clinical conditions associated with CAMKK2.

Calcium/calmodulin-dependent protein kinase kinase 2, beta (CAMKK2, Accession NP_757380.1) is another GAM1032 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:7725, to the nucleotide sequence of GAM1032 RNA, herein designated GAM RNA, also designated SEQ ID:303.

Another function of GAM1032 is therefore inhibition of Calcium/calmodulin-dependent protein kinase kinase 2, beta (CAMKK2, Accession NP_757380.1). Accordingly, utilities of GAM1032 include diagnosis, prevention and treatment of diseases and clinical conditions associated with CAMKK2.

Calcium/calmodulin-dependent protein kinase kinase 2, beta (CAMKK2, Accession NP_705719.2) is another GAM1032 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:7725, to the nucleotide sequence of GAM1032 RNA, herein designated GAM RNA, also designated SEQ ID:303.

Another function of GAM1032 is therefore inhibition of Calcium/calmodulin-dependent protein kinase kinase 2, beta (CAMKK2, Accession NP_705719.2). Accordingly, utilities of GAM1032 include diagnosis, prevention and treatment of diseases and clinical conditions associated with CAMKK2.

Calcium/calmodulin-dependent protein kinase kinase 2, beta (CAMKK2, Accession NP_757365.1) is another GAM1032 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:7725, to the nucleotide sequence of GAM1032 RNA, herein designated GAM RNA, also designated SEQ ID:303.

Another function of GAM1032 is therefore inhibition of Calcium/calmodulin-dependent protein kinase kinase 2, beta (CAMKK2, Accession NP_757365.1). Accordingly, utilities of GAM1032 include diagnosis, prevention and treatment of diseases and clinical conditions associated with CAMKK2.

Calcium/calmodulin-dependent protein kinase kinase 2, beta (CAMKK2, Accession NP_006540.3) is another GAM1032 target gene, herein designated TARGET GENE. CAMKK2 BINDING SITE is a target binding site found in the 3' untranslated region of multiple transcripts of mRNA encoded by CAMKK2, corresponding to a target binding site such as BINDING SITE I, BINDING SITE II or BINDING SITE III of FIG. 8. Table 4 illustrates the complementarity of the nucleotide sequences of CAMKK2 BINDING SITE, designated SEQ ID:7725, to the nucleotide sequence of GAM1032 RNA, herein designated GAM RNA, also designated SEQ ID:303.

Another function of GAM1032 is therefore inhibition of Calcium/calmodulin-dependent protein kinase kinase 2, beta (CAMKK2, Accession NP_006540.3). Accordingly, utilities of GAM1032 include diagnosis, prevention and treatment of diseases and clinical conditions associated with CAMKK2.

Caspase 4, apoptosis-related cysteine protease (CASP4, Accession NP_001216.1) is another GAM1032 target gene, herein designated TARGET GENE. CASP4 BINDING SITE is a target binding site found in the 3' untranslated region of multiple transcripts of mRNA encoded by CASP4, corresponding to a target binding site such as BINDING SITE I, BINDING SITE II or BINDING SITE III of FIG. 8. Table 4 illustrates the complementarity of the nucleotide sequences of CASP4 BINDING SITE, designated SEQ ID:3772, to the nucleotide sequence of GAM1032 RNA, herein designated GAM RNA, also designated SEQ ID:303.

Another function of GAM1032 is therefore inhibition of Caspase 4, apoptosis-related cysteine protease (CASP4, Accession NP_001216.1), a gene which is an apoptosis-related caspase and involves in the activation cascade of caspases responsible for apoptosis execution. Accordingly, utilities of GAM1032 include diagnosis, prevention and treatment of diseases and clinical conditions associated with CASP4.

The function of CASP4 and its association with various diseases and clinical conditions, has been established by previous studies, as described hereinabove with reference to GAM810.2. Caspase 4, apoptosis-related cysteine protease (CASP4, Accession NP_150650.1) is another GAM1032 target gene, herein designated TARGET GENE. CASP4 BINDING SITE is a target binding site found in the 3' untranslated region of multiple transcripts of mRNA encoded by CASP4, corresponding to a target binding site such as BINDING SITE I, BINDING SITE II or BINDING SITE III of FIG. 8. Table 4 illustrates the complementarity of the nucleotide sequences of CASP4 BINDING SITE, designated SEQ ID:3772, to the nucleotide sequence of GAM1032 RNA, herein designated GAM RNA, also designated SEQ ID:303.

Another function of GAM1032 is therefore inhibition of Caspase 4, apoptosis-related cysteine protease (CASP4, Accession NP_150650.1), a gene which is an apoptosis-related caspase and involves in the activation cascade of caspases responsible for apoptosis execution. Accordingly, utilities of GAM1032 include diagnosis, prevention and treatment of diseases and clinical conditions associated with CASP4.

The function of CASP4 and its association with various diseases and clinical conditions, has been established by previous studies, as described hereinabove with reference to GAM810.2. Caspase 4, apoptosis-related cysteine protease (CASP4, Accession NP_150649.1) is another GAM1032 target gene, herein designated TARGET GENE. CASP4 BINDING SITE is a target binding site found in the 3' untranslated region of multiple transcripts of mRNA encoded by CASP4, corresponding to a target binding site such as BINDING SITE I, BINDING SITE II or BINDING SITE III of FIG. 8. Table 4 illustrates the complementarity of the nucleotide sequences of CASP4 BINDING SITE, designated SEQ ID:3772, to the nucleotide sequence of GAM1032 RNA, herein designated GAM RNA, also designated SEQ ID:303.

Another function of GAM1032 is therefore inhibition of Caspase 4, apoptosis-related cysteine protease (CASP4, Accession NP_150649.1), a gene which is an apoptosis-related caspase and involves in the activation cascade of caspases responsible for apoptosis execution. Accordingly, utilities of GAM1032 include diagnosis, prevention and treatment of diseases and clinical conditions associated with CASP4.

The function of CASP4 and its association with various diseases and clinical conditions, has been established by previous studies, as described hereinabove with reference to GAM810.2. Cd1d antigen, d polypeptide (CD1D, Accession NP_001757.1) is another GAM1032 target gene, herein designated TARGET GENE. CD1D BINDING SITE is a target binding site found in the 3' untranslated region of mRNA encoded by CD1D, corresponding to a target binding site such as BINDING SITE I, BINDING SITE II or BINDING SITE III of FIG. 8. Table 4 illustrates the complementarity of the nucleotide sequences of CD1D BINDING SITE, designated SEQ ID:16191, to the nucleotide sequence of GAM1032 RNA, herein designated GAM RNA, also designated SEQ ID:303.

Another function of GAM1032 is therefore inhibition of Cd1d antigen, d polypeptide (CD1D, Accession NP_001757.1), a gene which is a member D of the CD1 family; involved in antigen presentation. Accordingly, utilities of GAM1032 include diagnosis, prevention and treatment of diseases and clinical conditions associated with CD1D.

The function of CD1D and its association with various diseases and clinical conditions, has been established by previous studies, as described hereinabove with reference to GAM550.1. Cell division cycle 25b (CDC25B, Accession NP_068658.1) is another GAM1032 target gene, herein designated TARGET GENE. CDC25B BINDING SITE is a target binding site found in the 3' untranslated region of multiple transcripts of mRNA encoded by CDC25B, corresponding to a target binding site such as BINDING SITE I, BINDING SITE II or BINDING SITE III of FIG. 8. Table 4 illustrates the complementarity of the nucleotide sequences of CDC25B BINDING SITE, designated SEQ ID:11047, to the nucleotide sequence of GAM1032 RNA, herein designated GAM RNA, also designated SEQ ID:303.

Another function of GAM1032 is therefore inhibition of Cell division cycle 25b (CDC25B, Accession NP_068658.1), a gene which is positively activated by dephosphorylation. Accordingly, utilities of GAM1032 include diagnosis, prevention and treatment of diseases and clinical conditions associated with CDC25B.

The function of CDC25B and its association with various diseases and clinical conditions, has been established by previous studies, as described hereinabove with reference to GAM504.2. Cell division cycle 25b (CDC25B, Accession NP_068660.1) is another GAM1032 target gene, herein designated TARGET GENE. CDC25B BINDING SITE is a target binding site found in the 3' untranslated region of multiple transcripts of mRNA encoded by CDC25B, corresponding to a target binding site such as BINDING SITE I, BINDING SITE II or BINDING SITE III of FIG. 8. Table 4 illustrates the complementarity of the nucleotide sequences of CDC25B BINDING SITE, designated SEQ ID:11047, to the nucleotide sequence of GAM1032 RNA, herein designated GAM RNA, also designated SEQ ID:303.

Another function of GAM1032 is therefore inhibition of Cell division cycle 25b (CDC25B, Accession NP_068660.1), a gene which is positively activated by dephosphorylation. Accordingly, utilities of GAM1032 include diagnosis, prevention and treatment of diseases and clinical conditions associated with CDC25B.

The function of CDC25B and its association with various diseases and clinical conditions, has been established by previous studies, as described hereinabove with reference to GAM504.2. Cell division cycle 25b (CDC25B, Accession NP_004349.1) is another GAM1032 target gene, herein designated TARGET GENE. CDC25B BINDING SITE is a target binding site found in the 3' untranslated region of multiple transcripts of mRNA encoded by CDC25B, corresponding to a target binding site such as BINDING SITE I, BINDING SITE II or BINDING SITE III of FIG. 8. Table 4 illustrates the complementarity of the nucleotide sequences of CDC25B BINDING SITE, designated SEQ ID:11047, to the nucleotide sequence of GAM1032 RNA, herein designated GAM RNA, also designated SEQ ID:303.

Another function of GAM1032 is therefore inhibition of Cell division cycle 25b (CDC25B, Accession NP_004349.1), a gene which is positively activated by dephosphorylation. Accordingly, utilities of GAM1032 include diagnosis, prevention and treatment of diseases and clinical conditions associated with CDC25B.

The function of CDC25B and its association with various diseases and clinical conditions, has been established by previous studies, as described hereinabove with reference to GAM504.2. Cell division cycle 25b (CDC25B, Accession NP_068659.1) is another GAM1032 target gene, herein designated TARGET GENE. CDC25B BINDING SITE is a target binding site found in the 3' untranslated region of multiple transcripts of mRNA encoded by CDC25B, corresponding to a target binding site such as BINDING SITE I, BINDING SITE II or BINDING SITE III of FIG. 8. Table 4 illustrates the complementarity of the nucleotide sequences of CDC25B BINDING SITE, designated SEQ ID:11047, to the nucleotide sequence of GAM1032 RNA, herein designated GAM RNA, also designated SEQ ID:303.

Another function of GAM1032 is therefore inhibition of Cell division cycle 25b (CDC25B, Accession NP_068659.1), a gene which is positively activated by dephosphorylation. Accordingly, utilities of GAM1032 include diagnosis, prevention and treatment of diseases and clinical conditions associated with CDC25B.

The function of CDC25B and its association with various diseases and clinical conditions, has been established by previous studies, as described hereinabove with reference to GAM504.2. Cofilin 2 (muscle) (CFL2, Accession NP_068733.1) is another GAM1032 target gene, herein designated TARGET GENE. CFL2 BINDING SITE is a target binding site found in the 3' untranslated region of mRNA encoded by CFL2, corresponding to a target binding site such as BINDING SITE I, BINDING SITE II or BINDING SITE III of FIG. 8. Table 4 illustrates the complementarity of the nucleotide sequences of CFL2 BINDING SITE, designated SEQ ID:16082, to the nucleotide sequence of GAM1032 RNA, herein designated GAM RNA, also designated SEQ ID:303.

Another function of GAM1032 is therefore inhibition of Cofilin 2 (muscle) (CFL2, Accession NP_068733.1). Accordingly, utilities of GAM1032 include diagnosis, prevention and treatment of diseases and clinical conditions associated with CFL2.

Chloride channel 1, skeletal muscle (thomsen disease, autosomal dominant) (CLCN1, Accession NP_000074.1) is another GAM1032 target gene, herein designated TARGET GENE. CLCN1 BINDING SITE is a target binding site found in the 5' untranslated region of mRNA encoded by CLCN1, corresponding to a target binding site such as BINDING SITE I, BINDING SITE II or BINDING SITE III of FIG. 8. Table 4 illustrates the complementarity of the nucleotide sequences of CLCN1 BINDING SITE, designated SEQ ID:7487, to the nucleotide sequence of GAM1032 RNA, herein designated GAM RNA, also designated SEQ ID:303.

Another function of GAM1032 is therefore inhibition of Chloride channel 1, skeletal muscle (thomsen disease, autosomal dominant) (CLCN1, Accession NP_000074.1). Accordingly, utilities of GAM1032 include diagnosis, prevention and treatment of diseases and clinical conditions associated with CLCN1.

Ceroid-lipofuscinosis, neuronal 8 (epilepsy, progressive with mental retardation) (CLN8, Accession NP_061764.2) is another GAM1032 target gene, herein designated TARGET GENE. CLN8 BINDING SITE is a target binding site found in the 3' untranslated region of mRNA encoded by CLN8, corresponding to a target binding site such as BINDING SITE I, BINDING SITE II or BINDING SITE III of FIG. 8. Table 4 illustrates the complementarity of the nucleotide sequences of CLN8 BINDING SITE, designated SEQ ID:17822, to the nucleotide sequence of GAM1032 RNA, herein designated GAM RNA, also designated SEQ ID:303.

Another function of GAM1032 is therefore inhibition of Ceroid-lipofuscinosis, neuronal 8 (epilepsy, progressive with mental retardation) (CLN8, Accession NP_061764.2). Accordingly, utilities of GAM1032 include diagnosis, prevention and treatment of diseases and clinical conditions associated with CLN8.

CLONE24945 (Accession NP_056498.1) is another GAM1032 target gene, herein designated TARGET GENE. CLONE24945 BINDING SITE is a target binding site found in the 3' untranslated region of mRNA encoded by CLONE24945, corresponding to a target binding site such as BINDING SITE I, BINDING SITE II or BINDING SITE III of FIG. 8. Table 4 illustrates the complementarity of the nucleotide sequences of CLONE24945 BINDING SITE, designated SEQ ID:7108, to the nucleotide sequence of GAM1032 RNA, herein designated GAM RNA, also designated SEQ ID:303.

Another function of GAM1032 is therefore inhibition of CLONE24945 (Accession NP_056498.1). Accordingly, utilities of GAM1032 include diagnosis, prevention and treatment of diseases and clinical conditions associated with CLONE24945.

Citrate lyase beta like (CLYBL, Accession NP_612124.2) is another GAM1032 target gene, herein designated TARGET GENE. CLYBL BINDING SITE is a target binding site found in the 3' untranslated region of mRNA encoded by CLYBL, corresponding to a target binding site such as BINDING SITE I, BINDING SITE II or BINDING SITE III of FIG. 8. Table 4 illustrates the complementarity of the nucleotide sequences of CLYBL BINDING SITE, designated SEQ ID:6231, to the nucleotide sequence of GAM1032 RNA, herein designated GAM RNA, also designated SEQ ID:303.

Another function of GAM1032 is therefore inhibition of Citrate lyase beta like (CLYBL, Accession NP_612124.2). Accordingly, utilities of GAM1032 include diagnosis, prevention and treatment of diseases and clinical conditions associated with CLYBL.

Collagen, type xix, alpha 1 (COL19A1, Accession NP_001849.1) is another GAM1032 target gene, herein designated TARGET GENE. COL19A1 BINDING SITE is a target binding site found in the 3' untranslated region of mRNA encoded by COL19A1, corresponding to a target binding site such as BINDING SITE I, BINDING SITE II or BINDING SITE III of FIG. 8. Table 4 illustrates the complementarity of the nucleotide sequences of COL19A1 BINDING SITE, designated SEQ ID:3270, to the nucleotide sequence of GAM1032 RNA, herein designated GAM RNA, also designated SEQ ID:303.

Another function of GAM1032 is therefore inhibition of Collagen, type xix, alpha 1 (COL19A1, Accession NP_001849.1), a gene which may act as a cross-bridge between fibrils and other extracellular matrix molecules. Accordingly, utilities of GAM1032 include diagnosis, prevention and treatment of diseases and clinical conditions associated with COL19A1.

The function of COL19A1 and its association with various diseases and clinical conditions, has been established by previous studies, as described hereinabove with reference to GAM94.1. Collagen, type iv, alpha 6 (COL4A6, Accession NP_378667.1) is another GAM1032 target gene, herein designated TARGET GENE. COL4A6 BINDING SITE1 and COL4A6 BINDING SITE2 are target binding sites found in untranslated regions of multiple transcripts of mRNA encoded by COL4A6, corresponding to target binding sites such as BINDING SITE I, BINDING SITE II or BINDING SITE III of FIG. 8. Table 4 illustrates the complementarity of the nucleotide sequences of COL4A6 BINDING SITE1 and COL4A6 BINDING SITE2, designated SEQ ID:13214 and SEQ ID:15255 respectively, to the nucleotide sequence of GAM1032 RNA, herein designated GAM RNA, also designated SEQ ID:303.

Another function of GAM1032 is therefore inhibition of Collagen, type iv, alpha 6 (COL4A6, Accession NP_378667.1). Accordingly, utilities of GAM1032 include diagnosis, prevention and treatment of diseases and clinical conditions associated with COL4A6.

CXYorf1 (Accession XP_088704.2) is another GAM1032 target gene, herein designated TARGET GENE. CXYorf1 BINDING SITE is a target binding site found in the 3' untranslated region of mRNA encoded by CXYorf1, corresponding to a target binding site such as BINDING SITE I, BINDING SITE II or BINDING SITE III of FIG. 8. Table 4 illustrates the complementarity of the nucleotide sequences of CXYorf1 BINDING SITE, designated SEQ ID:8588, to the nucleotide sequence of GAM1032 RNA, herein designated GAM RNA, also designated SEQ ID:303.

Another function of GAM1032 is therefore inhibition of CXYorf1 (Accession XP_088704.2). Accordingly, utilities of GAM1032 include diagnosis, prevention and treatment of diseases and clinical conditions associated with CXYorf1.

CYB5-M (Accession NP_085056.1) is another GAM1032 target gene, herein designated TARGET GENE. CYB5-M BINDING SITE is a target binding site found in the 3' untranslated region of mRNA encoded by CYB5-M, corresponding to a target binding site such as BINDING SITE I, BINDING SITE II or BINDING SITE III of FIG. 8. Table 4 illustrates the complementarity of the nucleotide sequences of CYB5-M BINDING SITE, designated SEQ ID:17320, to the nucleotide sequence of GAM1032 RNA, herein designated GAM RNA, also designated SEQ ID:303.

Another function of GAM1032 is therefore inhibition of CYB5-M (Accession NP_085056.1). Accordingly, utilities of GAM1032 include diagnosis, prevention and treatment of diseases and clinical conditions associated with CYB5-M.

DEPP (Accession NP_008952.1) is another GAM1032 target gene, herein designated TARGET GENE. DEPP BINDING SITE is a target binding site found in the 3' untranslated region of mRNA encoded by DEPP, corresponding to a target binding site such as BINDING SITE I, BINDING SITE II or BINDING SITE III of FIG. 8. Table 4 illustrates the complementarity of the nucleotide sequences of DEPP BINDING SITE, designated SEQ ID:10673, to the nucleotide sequence of GAM1032 RNA, herein designated GAM RNA, also designated SEQ ID:303.

Another function of GAM1032 is therefore inhibition of DEPP (Accession NP_008952.1). Accordingly, utilities of GAM1032 include diagnosis, prevention and treatment of diseases and clinical conditions associated with DEPP.

DIS3 (Accession NP_055768.2) is another GAM1032 target gene, herein designated TARGET GENE. DIS3 BINDING SITE is a target binding site found in the 3' untranslated region of mRNA encoded by DIS3, corresponding to a target binding site such as BINDING SITE I, BINDING SITE II or BINDING SITE III of FIG. 8. Table 4 illustrates the complementarity of the nucleotide sequences of DIS3 BINDING SITE, designated SEQ ID:16408, to the nucleotide sequence of GAM1032 RNA, herein designated GAM RNA, also designated SEQ ID:303.

Another function of GAM1032 is therefore inhibition of DIS3 (Accession NP_055768.2). Accordingly, utilities of GAM1032 include diagnosis, prevention and treatment of diseases and clinical conditions associated with DIS3.

DISPB (Accession NP_277045.1) is another GAM1032 target gene, herein designated TARGET GENE. DISPB BINDING SITE is a target binding site found in the 3' untranslated region of mRNA encoded by DISPB, corresponding to a target binding site such as BINDING SITE I, BINDING SITE II or BINDING SITE III of FIG. 8. Table 4 illustrates the complementarity of the nucleotide sequences of DISPB BINDING SITE, designated SEQ ID:17823, to the nucleotide sequence of GAM1032 RNA, herein designated GAM RNA, also designated SEQ ID:303.

Another function of GAM1032 is therefore inhibition of DISPB (Accession NP_277045.1). Accordingly, utilities of GAM1032 include diagnosis, prevention and treatment of diseases and clinical conditions associated with DISPB.

dJ383J4.3 (Accession XP_294938.1) is another GAM1032 target gene, herein designated TARGET GENE. dJ383J4.3 BINDING SITE is a target binding site found in the 5' untranslated region of mRNA encoded by dJ383J4.3, corresponding to a target binding site such as BINDING SITE I, BINDING SITE II or BINDING SITE III of FIG. 8. Table 4 illustrates the complementarity of the nucleotide sequences of dJ383J4.3 BINDING SITE, designated SEQ ID:9430, to the nucleotide sequence of GAM1032 RNA, herein designated GAM RNA, also designated SEQ ID:303.

Another function of GAM1032 is therefore inhibition of dJ383J4.3 (Accession XP_294938.1). Accordingly, utilities of GAM1032 include diagnosis, prevention and treatment of diseases and clinical conditions associated with dJ383J4.3.

DKFZP434C171 (Accession NP_056436.1) is another GAM1032 target gene, herein designated TARGET GENE. DKFZP434C171 BINDING SITE is a target binding site found in the 3' untranslated region of mRNA encoded by DKFZP434C171, corresponding to a target binding site such as BINDING SITE I, BINDING SITE II or BINDING SITE III of FIG. 8. Table 4 illustrates the complementarity of the nucleotide sequences of DKFZP434C171 BINDING SITE, designated SEQ ID:3164, to the nucleotide sequence of GAM1032 RNA, herein designated GAM RNA, also designated SEQ ID:303.

Another function of GAM1032 is therefore inhibition of DKFZP434C171 (Accession NP_056436.1). Accordingly, utilities of GAM1032 include diagnosis, prevention and treatment of diseases and clinical conditions associated with DKFZP434C171.

DKFZp434O0320 (Accession XP_097012.2) is another GAM1032 target gene, herein designated TARGET GENE. DKFZp434O0320 BINDING SITE is a target binding site found in the 3' untranslated region of mRNA encoded by DKFZp434O0320, corresponding to a target binding site such as BINDING SITE I, BINDING SITE II or BINDING SITE III of FIG. 8. Table 4 illustrates the complementarity of the nucleotide sequences of DKFZp434O0320 BINDING SITE, designated SEQ ID:12853, to the nucleotide sequence of GAM1032 RNA, herein designated GAM RNA, also designated SEQ ID:303.

Another function of GAM1032 is therefore inhibition of DKFZp434O0320 (Accession XP_097012.2). Accordingly, utilities of GAM1032 include diagnosis, prevention and treatment of diseases and clinical conditions associated with DKFZp434O0320.

DKFZp547B1713 (Accession NP_689592.1) is another GAM1032 target gene, herein designated TARGET GENE. DKFZp547B1713 BINDING SITE is a target binding site found in the 3' untranslated region of mRNA encoded by DKFZp547B1713, corresponding to a target binding site such as BINDING SITE I, BINDING SITE II or BINDING SITE III of FIG. 8. Table 4 illustrates the complementarity of the nucleotide sequences of DKFZp547B1713 BINDING SITE, designated SEQ ID:8359, to the nucleotide sequence of GAM1032 RNA, herein designated GAM RNA, also designated SEQ ID:303.

Another function of GAM1032 is therefore inhibition of DKFZp547B1713 (Accession NP_689592.1). Accordingly, utilities of GAM1032 include diagnosis, prevention and treatment of diseases and clinical conditions associated with DKFZp547B1713.

DKFZP566I1024 (Accession NP_056226.1) is another GAM1032 target gene, herein designated TARGET GENE. DKFZP566I1024 BINDING SITE is a target binding site found in the 3' untranslated region of mRNA encoded by DKFZP566I1024, corresponding to a target binding site such as BINDING SITE I, BINDING SITE II or BINDING SITE III of FIG. 8. Table 4 illustrates the complementarity of the nucleotide sequences of DKFZP566I1024 BINDING SITE, designated SEQ ID:7803, to the nucleotide sequence of GAM1032 RNA, herein designated GAM RNA, also designated SEQ ID:303.

Another function of GAM1032 is therefore inhibition of DKFZP566I1024 (Accession NP_056226.1). Accordingly, utilities of GAM1032 include diagnosis, prevention and treatment of diseases and clinical conditions associated with DKFZP566I1024.

DKFZp586F1019 (Accession NP_112159.1) is another GAM1032 target gene, herein designated TARGET GENE. DKFZp586F1019 BINDING SITE is a target binding site found in the 3' untranslated region of mRNA encoded by DKFZp586F1019, corresponding to a target binding site such as BINDING SITE I, BINDING SITE II or BINDING SITE III of FIG. 8. Table 4 illustrates the complementarity of the nucleotide sequences of DKFZp586F1019 BINDING SITE, designated SEQ ID:5132, to the nucleotide sequence of GAM1032 RNA, herein designated GAM RNA, also designated SEQ ID:303.

Another function of GAM1032 is therefore inhibition of DKFZp586F1019 (Accession NP_112159.1). Accordingly, utilities of GAM1032 include diagnosis, prevention and treatment of diseases and clinical conditions associated with DKFZp586F1019.

DKFZp686G052 (Accession XP_300559.1) is another GAM1032 target gene, herein designated TARGET GENE. DKFZp686G052 BINDING SITE is a target binding site found in the 3' untranslated region of mRNA encoded by DKFZp686G052, corresponding to a target binding site such as BINDING SITE I, BINDING SITE II or BINDING SITE III of FIG. 8. Table 4 illustrates the complementarity of the nucleotide sequences of DKFZp686G052 BINDING SITE, designated SEQ ID:11872, to the nucleotide sequence of GAM1032 RNA, herein designated GAM RNA, also designated SEQ ID:303.

Another function of GAM1032 is therefore inhibition of DKFZp686G052 (Accession XP_300559.1). Accordingly, utilities of GAM1032 include diagnosis, prevention and treatment of diseases and clinical conditions associated with DKFZp686G052.

Doublesex and mab-3 related transcription factor 2 (DMRT2, Accession NP_006548.1) is another GAM1032 target gene, herein designated TARGET GENE. DMRT2 BINDING SITE is a target binding site found in the 3' untranslated region of mRNA encoded by DMRT2, corresponding to a target binding site such as BINDING SITE I, BINDING SITE II or BINDING SITE III of FIG. 8. Table 4 illustrates the complementarity of the nucleotide sequences of DMRT2 BINDING SITE, designated SEQ ID:5107, to the nucleotide sequence of GAM1032 RNA, herein designated GAM RNA, also designated SEQ ID:303.

Another function of GAM1032 is therefore inhibition of Doublesex and mab-3 related transcription factor 2 (DMRT2, Accession NP_006548.1), a gene which May be involved in male sexual development. Accordingly, utilities of GAM1032 include diagnosis, prevention and treatment of diseases and clinical conditions associated with DMRT2.

The function of DMRT2 and its association with various diseases and clinical conditions, has been established by previous studies, as described hereinabove with reference to GAM439.1. Dmrt-like family c2 (DMRTC2, Accession NP_149041.1) is another GAM1032 target gene, herein designated TARGET GENE. DMRTC2 BINDING SITE is a target binding site found in the 3' untranslated region of mRNA encoded by DMRTC2, corresponding to a target binding site such as BINDING SITE I, BINDING SITE II or BINDING SITE III of FIG. 8. Table 4 illustrates the complementarity of the nucleotide sequences of DMRTC2 BINDING SITE, designated SEQ ID:9542, to the nucleotide sequence of GAM1032 RNA, herein designated GAM RNA, also designated SEQ ID:303.

Another function of GAM1032 is therefore inhibition of Dmrt-like family c2 (DMRTC2, Accession NP_149041.1). Accordingly, utilities of GAM1032 include diagnosis, prevention and treatment of diseases and clinical conditions associated with DMRTC2.

Dynamin 2 (DNM2, Accession NP_004936.1) is another GAM1032 target gene, herein designated TARGET GENE. DNM2 BINDING SITE is a target binding site found in the 3' untranslated region of mRNA encoded by DNM2, corresponding to a target binding site such as BINDING SITE I, BINDING SITE II or BINDING SITE III of FIG. 8. Table 4 illustrates the complementarity of the nucleotide sequences of DNM2 BINDING SITE, designated SEQ ID:19535, to the nucleotide sequence of GAM1032 RNA, herein designated GAM RNA, also designated SEQ ID:303.

Another function of GAM1032 is therefore inhibition of Dynamin 2 (DNM2, Accession NP_004936.1), a gene which regulates budding of endocytic vesicles. Accordingly, utilities of GAM1032 include diagnosis, prevention and treatment of diseases and clinical conditions associated with DNM2.

The function of DNM2 and its association with various diseases and clinical conditions, has been established by previous studies, as described hereinabove with reference to GAM223.1. Deltex homolog 2 (drosophila) (DTX2, Accession NP_065943.1) is another GAM1032 target gene, herein designated TARGET GENE. DTX2 BINDING SITE is a target binding site found in the 5' untranslated region of mRNA encoded by DTX2, corresponding to a target binding site such as BINDING SITE I, BINDING SITE II or BINDING SITE III of FIG. 8. Table 4 illustrates the complementarity of the nucleotide sequences of DTX2 BINDING SITE, designated SEQ ID:19806, to the nucleotide sequence of GAM1032 RNA, herein designated GAM RNA, also designated SEQ ID:303.

Another function of GAM1032 is therefore inhibition of Deltex homolog 2 (drosophila) (DTX2, Accession NP_065943.1). Accordingly, utilities of GAM1032 include diagnosis, prevention and treatment of diseases and clinical conditions associated with DTX2.

E2f transcription factor 3 (E2F3, Accession NP_001940.1) is another GAM1032 target gene, herein designated TARGET GENE. E2F3 BINDING SITE is a target binding site found in the 3' untranslated region of mRNA encoded by E2F3, corresponding to a target binding site such as BINDING SITE I, BINDING SITE II or BINDING SITE III of FIG. 8. Table 4 illustrates the complementarity of the nucleotide sequences of E2F3 BINDING SITE, designated SEQ ID:16241, to the nucleotide sequence of GAM1032 RNA, herein designated GAM RNA, also designated SEQ ID:303.

Another function of GAM1032 is therefore inhibition of E2f transcription factor 3 (E2F3, Accession NP_001940.1), a gene which binds dna and controls cell-cycle progression from g1 to s phase. and therefore may be associated with Hereditary autosomal dominant myoclonus dystonia. Accordingly, utilities of GAM1032 include diagnosis, prevention and treatment of Hereditary autosomal dominant myoclonus dystonia, and of other diseases and clinical conditions associated with E2F3.

The function of E2F3 and its association with various diseases and clinical conditions, has been established by previous studies, as described hereinabove with reference to GAM44.1. EDRF1 (Accession NP_056423.2) is another GAM1032 target gene, herein designated TARGET GENE. EDRF1 BINDING SITE is a target binding site found in the 3' untranslated region of mRNA encoded by EDRF1, corresponding to a target binding site such as BINDING SITE I, BINDING SITE II or BINDING SITE III of FIG. 8. Table 4 illustrates the complementarity of the nucleotide sequences of EDRF1 BINDING SITE, designated SEQ ID:5132, to the nucleotide sequence of GAM1032 RNA, herein designated GAM RNA, also designated SEQ ID:303.

Another function of GAM1032 is therefore inhibition of EDRF1 (Accession NP_056423.2). Accordingly, utilities of GAM1032 include diagnosis, prevention and treatment of diseases and clinical conditions associated with EDRF1.

Estrogen receptor 1 (ESR1, Accession NP_000116.1) is another GAM1032 target gene, herein designated TARGET GENE. ESR1 BINDING SITE is a target binding site found in the 3' untranslated region of mRNA encoded by ESR1, corresponding to a target binding site such as BINDING SITE I, BINDING SITE II or BINDING SITE III of FIG. 8. Table 4 illustrates the complementarity of the nucleotide sequences of ESR1 BINDING SITE, designated SEQ ID:11698, to the nucleotide sequence of GAM1032 RNA, herein designated GAM RNA, also designated SEQ ID:303.

Another function of GAM1032 is therefore inhibition of Estrogen receptor 1 (ESR1, Accession NP_000116.1), a gene which involved in hormone-mediated inhibition of gene expression. and therefore may be associated with Estrogen receptor mutant. Accordingly, utilities of GAM1032 include diagnosis, prevention and treatment of Estrogen receptor mutant, and of other diseases and clinical conditions associated with ESR1.

The function of ESR1 and its association with various diseases and clinical conditions, has been established by previous studies, as described hereinabove with reference to GAM289.1. F-box only protein 10 (FBXO10, Accession XP_291314.1) is another GAM1032 target gene, herein designated TARGET GENE. FBXO10 BINDING SITE is a target binding site found in the 3' untranslated region of mRNA encoded by FBXO10, corresponding to a target binding site such as BINDING SITE I, BINDING SITE II or BINDING SITE III of FIG. 8. Table 4 illustrates the complementarity of the nucleotide sequences of FBXO10 BINDING SITE, designated SEQ ID:1583, to the nucleotide sequence of GAM1032 RNA, herein designated GAM RNA, also designated SEQ ID:303.

Another function of GAM1032 is therefore inhibition of F-box only protein 10 (FBXO10, Accession XP_291314.1). Accordingly, utilities of GAM1032 include diagnosis, prevention and treatment of diseases and clinical conditions associated with FBXO10.

FLJ10496 (Accession NP_060584.2) is another GAM1032 target gene, herein designated TARGET GENE. FLJ10496 BINDING SITE is a target binding site found in the 3' untranslated region of mRNA encoded by FLJ10496, corresponding to a target binding site such as BINDING SITE I, BINDING SITE II or BINDING SITE III of FIG. 8. Table 4 illustrates the complementarity of the nucleotide sequences of FLJ10496 BINDING SITE, designated SEQ ID:6405, to the nucleotide sequence of GAM1032 RNA, herein designated GAM RNA, also designated SEQ ID:303.

Another function of GAM1032 is therefore inhibition of FLJ10496 (Accession NP_060584.2). Accordingly, utilities of GAM1032 include diagnosis, prevention and treatment of diseases and clinical conditions associated with FLJ10496.

FLJ10648 (Accession NP_060637.1) is another GAM1032 target gene, herein designated TARGET GENE. FLJ10648 BINDING SITE is a target binding site found in the 3' untranslated region of mRNA encoded by FLJ10648, corresponding to a target binding site such as BINDING SITE I, BINDING SITE II or BINDING SITE III of FIG. 8. Table 4 illustrates the complementarity of the nucleotide sequences of FLJ10648 BINDING SITE, designated SEQ ID:13957, to the nucleotide sequence of GAM1032 RNA, herein designated GAM RNA, also designated SEQ ID:303.

Another function of GAM1032 is therefore inhibition of FLJ10648 (Accession NP_060637.1). Accordingly, utilities of GAM1032 include diagnosis, prevention and treatment of diseases and clinical conditions associated with FLJ10648.

FLJ10932 (Accession NP_060747.1) is another GAM1032 target gene, herein designated TARGET GENE. FLJ10932 BINDING SITE is a target binding site found in the 3' untranslated region of mRNA encoded by FLJ10932, corresponding to a target binding site such as BINDING SITE I, BINDING SITE II or BINDING SITE III of FIG. 8. Table 4 illustrates the complementarity of the nucleotide sequences of FLJ10932 BINDING SITE, designated SEQ ID:2710, to the nucleotide sequence of GAM1032 RNA, herein designated GAM RNA, also designated SEQ ID:303.

Another function of GAM1032 is therefore inhibition of FLJ10932 (Accession NP_060747.1). Accordingly, utilities of GAM1032 include diagnosis, prevention and treatment of diseases and clinical conditions associated with FLJ10932.

FLJ11506 (Accession NP_078942.2) is another GAM1032 target gene, herein designated TARGET GENE. FLJ11506 BINDING SITE is a target binding site found in the 3' untranslated region of mRNA encoded by FLJ11506, corresponding to a target binding site such as BINDING SITE I, BINDING SITE II or BINDING SITE III of FIG. 8. Table 4 illustrates the complementarity of the nucleotide sequences of FLJ11506 BINDING SITE, designated SEQ ID:1155, to the nucleotide sequence of GAM1032 RNA, herein designated GAM RNA, also designated SEQ ID:303.

Another function of GAM1032 is therefore inhibition of FLJ11506 (Accession NP_078942.2). Accordingly, utilities of GAM1032 include diagnosis, prevention and treatment of diseases and clinical conditions associated with FLJ11506.

FLJ12439 (Accession NP_075565.1) is another GAM1032 target gene, herein designated TARGET GENE. FLJ12439 BINDING SITE is a target binding site found in the 3' untranslated region of mRNA encoded by FLJ12439, corresponding to a target binding site such as BINDING SITE I, BINDING SITE II or BINDING SITE III of FIG. 8. Table 4 illustrates the complementarity of the nucleotide sequences of FLJ12439 BINDING SITE, designated SEQ ID:14060, to the nucleotide sequence of GAM1032 RNA, herein designated GAM RNA, also designated SEQ ID:303.

Another function of GAM1032 is therefore inhibition of FLJ12439 (Accession NP_075565.1). Accordingly, utilities of GAM1032 include diagnosis, prevention and treatment of diseases and clinical conditions associated with FLJ12439.

FLJ13204 (Accession NP_079037.2) is another GAM1032 target gene, herein designated TARGET GENE. FLJ13204 BINDING SITE is a target binding site found in the 3' untranslated region of mRNA encoded by FLJ13204, corresponding to a target binding site such as BINDING SITE I, BINDING SITE II or BINDING SITE III of FIG. 8. Table 4 illustrates the complementarity of the nucleotide sequences of FLJ13204 BINDING SITE, designated SEQ ID:4441, to the nucleotide sequence of GAM1032 RNA, herein designated GAM RNA, also designated SEQ ID:303.

Another function of GAM1032 is therefore inhibition of FLJ13204 (Accession NP_079037.2). Accordingly, utilities of GAM1032 include diagnosis, prevention and treatment of diseases and clinical conditions associated with FLJ13204.

FLJ13769 (Accession NP_079288.1) is another GAM1032 target gene, herein designated TARGET GENE. FLJ13769 BINDING SITE is a target binding site found in the 3' untranslated region of mRNA encoded by FLJ13769, corresponding to a target binding site such as BINDING SITE I, BINDING SITE II or BINDING SITE III of FIG. 8. Table 4 illustrates the complementarity of the nucleotide sequences of FLJ13769 BINDING SITE, designated SEQ ID:2505, to the nucleotide sequence of GAM1032 RNA, herein designated GAM RNA, also designated SEQ ID:303.

Another function of GAM1032 is therefore inhibition of FLJ13769 (Accession NP_079288.1). Accordingly, utilities of GAM1032 include diagnosis, prevention and treatment of diseases and clinical conditions associated with FLJ13769.

FLJ14154 (Accession NP_079121.1) is another GAM1032 target gene, herein designated TARGET GENE. FLJ14154 BINDING SITE is a target binding site found in the 3' untranslated region of mRNA encoded by FLJ14154, corresponding to a target binding site such as BINDING SITE I, BINDING SITE II or BINDING SITE III of FIG. 8. Table 4 illustrates the complementarity of the nucleotide sequences of FLJ14154 BINDING SITE, designated SEQ ID:5645, to the nucleotide sequence of GAM1032 RNA, herein designated GAM RNA, also designated SEQ ID:303.

Another function of GAM1032 is therefore inhibition of FLJ14154 (Accession NP_079121.1). Accordingly, utilities of GAM1032 include diagnosis, prevention and treatment of diseases and clinical conditions associated with FLJ14154.

FLJ14166 (Accession NP_078841.1) is another GAM1032 target gene, herein designated TARGET GENE. FLJ14166 BINDING SITE is a target binding site found in the 5' untranslated region of mRNA encoded by FLJ14166, corresponding to a target binding site such as BINDING SITE I, BINDING SITE II or BINDING SITE III of FIG. 8. Table 4 illustrates the complementarity of the nucleotide sequences of FLJ14166 BINDING SITE, designated SEQ ID:2917, to the nucleotide sequence of GAM1032 RNA, herein designated GAM RNA, also designated SEQ ID:303.

Another function of GAM1032 is therefore inhibition of FLJ14166 (Accession NP_078841.1). Accordingly, utilities of GAM1032 include diagnosis, prevention and treatment of diseases and clinical conditions associated with FLJ14166.

FLJ20014 (Accession NP_060092.1) is another GAM1032 target gene, herein designated TARGET GENE. FLJ20014 BINDING SITE is a target binding site found in the 5' untranslated region of mRNA encoded by FLJ20014, corresponding to a target binding site such as BINDING SITE I, BINDING SITE II or BINDING SITE III of FIG. 8. Table 4 illustrates the complementarity of the nucleotide sequences of FLJ20014 BINDING SITE, designated SEQ ID:2766, to the nucleotide sequence of GAM1032 RNA, herein designated GAM RNA, also designated SEQ ID:303.

Another function of GAM1032 is therefore inhibition of FLJ20014 (Accession NP_060092.1). Accordingly, utilities of GAM1032 include diagnosis, prevention and treatment of diseases and clinical conditions associated with FLJ20014.

FLJ20401 (Accession NP_060275.1) is another GAM1032 target gene, herein designated TARGET GENE. FLJ20401 BINDING SITE is a target binding site found in the 5' untranslated region of mRNA encoded by FLJ20401, corresponding to a target binding site such as BINDING SITE I, BINDING SITE II or BINDING SITE III of FIG. 8. Table 4 illustrates the complementarity of the nucleotide sequences of FLJ20401 BINDING SITE, designated SEQ ID:4190, to the nucleotide sequence of GAM1032 RNA, herein designated GAM RNA, also designated SEQ ID:303.

Another function of GAM1032 is therefore inhibition of FLJ20401 (Accession NP_060275.1). Accordingly, utilities of GAM1032 include diagnosis, prevention and treatment of diseases and clinical conditions associated with FLJ20401.

FLJ20445 (Accession NP_060294.1) is another GAM1032 target gene, herein designated TARGET GENE. FLJ20445 BINDING SITE is a target binding site found in the 3' untranslated region of mRNA encoded by FLJ20445, corresponding to a target binding site such as BINDING SITE I, BINDING SITE II or BINDING SITE III of FIG. 8. Table 4 illustrates the complementarity of the nucleotide sequences of FLJ20445 BINDING SITE, designated SEQ ID:12035, to the nucleotide sequence of GAM1032 RNA, herein designated GAM RNA, also designated SEQ ID:303.

Another function of GAM1032 is therefore inhibition of FLJ20445 (Accession NP_060294.1). Accordingly, utilities of GAM1032 include diagnosis, prevention and treatment of diseases and clinical conditions associated with FLJ20445.

FLJ20584 (Accession NP_060361.1) is another GAM1032 target gene, herein designated TARGET GENE. FLJ20584 BINDING SITE is a target binding site found in the 3' untranslated region of mRNA encoded by FLJ20584, corresponding to a target binding site such as BINDING SITE I, BINDING SITE II or BINDING SITE III of FIG. 8. Table 4 illustrates the complementarity of the nucleotide sequences of FLJ20584 BINDING SITE, designated SEQ ID:8842, to the nucleotide sequence of GAM1032 RNA, herein designated GAM RNA, also designated SEQ ID:303.

Another function of GAM1032 is therefore inhibition of FLJ20584 (Accession NP_060361.1). Accordingly, utilities of GAM1032 include diagnosis, prevention and treatment of diseases and clinical conditions associated with FLJ20584.

FLJ21148 (Accession NP_079136.1) is another GAM1032 target gene, herein designated TARGET GENE. FLJ21148 BINDING SITE is a target binding site found in the 3' untranslated region of mRNA encoded by FLJ21148, corresponding to a target binding site such as BINDING SITE I, BINDING SITE II or BINDING SITE III of FIG. 8. Table 4 illustrates the complementarity of the nucleotide sequences of FLJ21148 BINDING SITE, designated SEQ ID:11110, to the nucleotide sequence of GAM1032 RNA, herein designated GAM RNA, also designated SEQ ID:303.

Another function of GAM1032 is therefore inhibition of FLJ21148 (Accession NP_079136.1). Accordingly, utilities of GAM1032 include diagnosis, prevention and treatment of diseases and clinical conditions associated with FLJ21148.

FLJ21240 (Accession NP_079123.1) is another GAM1032 target gene, herein designated TARGET GENE. FLJ21240 BINDING SITE is a target binding site found in the 3' untranslated region of mRNA encoded by FLJ21240, corresponding to a target binding site such as BINDING SITE I, BINDING SITE II or BINDING SITE III of FIG. 8. Table 4 illustrates the complementarity of the nucleotide sequences of FLJ21240 BINDING SITE, designated SEQ ID:6131, to the nucleotide sequence of GAM1032 RNA, herein designated GAM RNA, also designated SEQ ID:303.

Another function of GAM1032 is therefore inhibition of FLJ21240 (Accession NP_079123.1). Accordingly, utilities of GAM1032 include diagnosis, prevention and treatment of diseases and clinical conditions associated with FLJ21240.

FLJ21802 (Accession NP_078920.1) is another GAM1032 target gene, herein designated TARGET GENE. FLJ21802 BINDING SITE is a target binding site found in the 3' untranslated region of mRNA encoded by FLJ21802, corresponding to a target binding site such as BINDING SITE I, BINDING SITE II or BINDING SITE III of FIG. 8. Table 4 illustrates the complementarity of the nucleotide sequences of FLJ21802 BINDING SITE, designated SEQ ID:7802, to the nucleotide sequence of GAM1032 RNA, herein designated GAM RNA, also designated SEQ ID:303.

Another function of GAM1032 is therefore inhibition of FLJ21802 (Accession NP_078920.1). Accordingly, utilities of GAM1032 include diagnosis, prevention and treatment of diseases and clinical conditions associated with FLJ21802.

FLJ22639 (Accession NP_079072.1) is another GAM1032 target gene, herein designated TARGET GENE. FLJ22639 BINDING SITE is a target binding site found in the 3' untranslated region of mRNA encoded by FLJ22639, corresponding to a target binding site such as BINDING SITE I, BINDING SITE II or BINDING SITE III of FIG. 8. Table 4 illustrates the complementarity of the nucleotide sequences of FLJ22639 BINDING SITE, designated SEQ ID:2390, to the nucleotide sequence of GAM1032 RNA, herein designated GAM RNA, also designated SEQ ID:303.

Another function of GAM1032 is therefore inhibition of FLJ22639 (Accession NP_079072.1). Accordingly, utilities of GAM1032 include diagnosis, prevention and treatment of diseases and clinical conditions associated with FLJ22639.

FLJ25954 (Accession NP_775843.1) is another GAM1032 target gene, herein designated TARGET GENE. FLJ25954 BINDING SITE is a target binding site found in the 5' untranslated region of mRNA encoded by FLJ25954, corresponding to a target binding site such as BINDING SITE I, BINDING SITE II or BINDING SITE III of FIG. 8. Table 4 illustrates the complementarity of the nucleotide sequences of FLJ25954 BINDING SITE, designated SEQ ID:3762, to the nucleotide sequence of GAM1032 RNA, herein designated GAM RNA, also designated SEQ ID:303.

Another function of GAM1032 is therefore inhibition of FLJ25954 (Accession NP_775843.1). Accordingly, utilities of GAM1032 include diagnosis, prevention and treatment of diseases and clinical conditions associated with FLJ25954.

FLJ30567 (Accession NP_659459.1) is another GAM1032 target gene, herein designated TARGET GENE. FLJ30567 BINDING SITE is a target binding site found in the 3' untranslated region of mRNA encoded by FLJ30567, corresponding to a target binding site such as BINDING SITE I, BINDING SITE II or BINDING SITE III of FIG. 8. Table 4 illustrates the complementarity of the nucleotide sequences of FLJ30567 BINDING SITE, designated SEQ ID:12412, to the nucleotide sequence of GAM1032 RNA, herein designated GAM RNA, also designated SEQ ID:303.

Another function of GAM1032 is therefore inhibition of FLJ30567 (Accession NP_659459.1). Accordingly, utilities of GAM1032 include diagnosis, prevention and treatment of diseases and clinical conditions associated with FLJ30567.

FLJ30655 (Accession NP_653244.1) is another GAM1032 target gene, herein designated TARGET GENE. FLJ30655 BINDING SITE is a target binding site found in the 3' untranslated region of mRNA encoded by FLJ30655, corresponding to a target binding site such as BINDING SITE I, BINDING SITE II or BINDING SITE III of FIG. 8. Table 4 illustrates the complementarity of the nucleotide sequences of FLJ30655 BINDING SITE, designated SEQ ID:1102, to the nucleotide sequence of GAM1032 RNA, herein designated GAM RNA, also designated SEQ ID:303.

Another function of GAM1032 is therefore inhibition of FLJ30655 (Accession NP_653244.1). Accordingly, utilities of GAM1032 include diagnosis, prevention and treatment of diseases and clinical conditions associated with FLJ30655.

FLJ32112 (Accession NP_694580.1) is another GAM1032 target gene, herein designated TARGET GENE. FLJ32112 BINDING SITE is a target binding site found in the 3' untranslated region of mRNA encoded by FLJ32112, corresponding to a target binding site such as BINDING SITE I, BINDING SITE II or BINDING SITE III of FIG. 8. Table 4 illustrates the complementarity of the nucleotide sequences of FLJ32112 BINDING SITE, designated SEQ ID:13700, to the nucleotide sequence of GAM1032 RNA, herein designated GAM RNA, also designated SEQ ID:303.

Another function of GAM1032 is therefore inhibition of FLJ32112 (Accession NP_694580.1). Accordingly, utilities of GAM1032 include diagnosis, prevention and treatment of diseases and clinical conditions associated with FLJ32112.

FLJ35721 (Accession NP_775955.1) is another GAM1032 target gene, herein designated TARGET GENE. FLJ35721 BINDING SITE is a target binding site found in the 3' untranslated region of mRNA encoded by FLJ35721, corresponding to a target binding site such as BINDING SITE I, BINDING SITE II or BINDING SITE III of FIG. 8. Table 4 illustrates the complementarity of the nucleotide sequences of FLJ35721 BINDING SITE, designated SEQ ID:9904, to the nucleotide sequence of GAM1032 RNA, herein designated GAM RNA, also designated SEQ ID:303.

Another function of GAM1032 is therefore inhibition of FLJ35721 (Accession NP_775955.1). Accordingly, utilities of GAM1032 include diagnosis, prevention and treatment of diseases and clinical conditions associated with FLJ35721.

FLJ39249 (Accession NP_775935.1) is another GAM1032 target gene, herein designated TARGET GENE. FLJ39249 BINDING SITE is a target binding site found in the 3' untranslated region of mRNA encoded by FLJ39249, corresponding to a target binding site such as BINDING SITE I, BINDING SITE II or BINDING SITE III of FIG. 8. Table 4 illustrates the complementarity of the nucleotide sequences of FLJ39249 BINDING SITE, designated SEQ ID:6728, to the nucleotide sequence of GAM1032 RNA, herein designated GAM RNA, also designated SEQ ID:303.

Another function of GAM1032 is therefore inhibition of FLJ39249 (Accession NP_775935.1). Accordingly, utilities of GAM1032 include diagnosis, prevention and treatment of diseases and clinical conditions associated with FLJ39249.

FLJ39639 (Accession XP_290687.1) is another GAM1032 target gene, herein designated TARGET GENE. FLJ39639 BINDING SITE is a target binding site found in the 3' untranslated region of mRNA encoded by FLJ39639, corresponding to a target binding site such as BINDING SITE I, BINDING SITE II or BINDING SITE III of FIG. 8. Table 4 illustrates the complementarity of the nucleotide sequences of FLJ39639 BINDING SITE, designated SEQ ID:8387, to the nucleotide sequence of GAM1032 RNA, herein designated GAM RNA, also designated SEQ ID:303.

Another function of GAM1032 is therefore inhibition of FLJ39639 (Accession XP_290687.1). Accordingly, utilities of GAM1032 include diagnosis, prevention and treatment of diseases and clinical conditions associated with FLJ39639.

FLJ90013 (Accession NP_699196.1) is another GAM1032 target gene, herein designated TARGET GENE. FLJ90013 BINDING SITE is a target binding site found in the 3' untranslated region of mRNA encoded by FLJ90013, corresponding to a target binding site such as BINDING SITE I, BINDING SITE II or BINDING SITE III of FIG. 8. Table 4 illustrates the complementarity of the nucleotide sequences of FLJ90013 BINDING SITE, designated SEQ ID:4414, to the nucleotide sequence of GAM1032 RNA, herein designated GAM RNA, also designated SEQ ID:303.

Another function of GAM1032 is therefore inhibition of FLJ90013 (Accession NP_699196.1). Accordingly, utilities of GAM1032 include diagnosis, prevention and treatment of diseases and clinical conditions associated with FLJ90013.

GAF1 (Accession NP_056285.1) is another GAM1032 target gene, herein designated TARGET GENE. GAF1 BINDING SITE is a target binding site found in the 3' untranslated region of mRNA encoded by GAF1, corresponding to a target binding site such as BINDING SITE I, BINDING SITE II or BINDING SITE III of FIG. 8. Table 4 illustrates the complementarity of the nucleotide sequences of GAF1 BINDING SITE, designated SEQ ID:6004, to the nucleotide sequence of GAM1032 RNA, herein designated GAM RNA, also designated SEQ ID:303.

Another function of GAM1032 is therefore inhibition of GAF1 (Accession NP_056285.1). Accordingly, utilities of GAM1032 include diagnosis, prevention and treatment of diseases and clinical conditions associated with GAF1.

Golgi associated, gamma adaptin ear containing, arf binding protein 2 (GGA2, Accession NP_055859.1) is another GAM1032 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:3682, to the nucleotide sequence of GAM1032 RNA, herein designated GAM RNA, also designated SEQ ID:303.

Another function of GAM1032 is therefore inhibition of Golgi associated, gamma adaptin ear containing, arf binding protein 2 (GGA2, Accession NP_055859.1). Accordingly, utilities of GAM1032 include diagnosis, prevention and treatment of diseases and clinical conditions associated with GGA2.

Golgi associated, gamma adaptin ear containing, arf binding protein 2 (GGA2, Accession NP_619581.1) is another GAM1032 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:3682, to the nucleotide sequence of GAM1032 RNA, herein designated GAM RNA, also designated SEQ ID:303.

Another function of GAM1032 is therefore inhibition of Golgi associated, gamma adaptin ear containing, arf binding protein 2 (GGA2, Accession NP_619581.1). Accordingly, utilities of GAM1032 include diagnosis, prevention and treatment of diseases and clinical conditions associated with GGA2.

Glucocorticoid induced transcript 1 (GLCCI1, Accession XP_166529.2) is another GAM1032 target gene, herein designated TARGET GENE. GLCCI1 BINDING SITE is a target binding site found in the 3' untranslated region of mRNA encoded by GLCCI1, corresponding to a target binding site such as BINDING SITE I, BINDING SITE II or BINDING SITE III of FIG. 8. Table 4 illustrates the complementarity of the nucleotide sequences of GLCCI1 BINDING SITE, designated SEQ ID:15598, to the nucleotide sequence of GAM1032 RNA, herein designated GAM RNA, also designated SEQ ID:303.

Another function of GAM1032 is therefore inhibition of Glucocorticoid induced transcript 1 (GLCCI1, Accession XP_166529.2). Accordingly, utilities of GAM1032 include diagnosis, prevention and treatment of diseases and clinical conditions associated with GLCCI1.

Glucocorticoid modulatory element binding protein 2 (GMEB2, Accession NP_036516.1) is another GAM1032 target gene, herein designated TARGET GENE. GMEB2 BINDING SITE is a target binding site found in the 3' untranslated region of mRNA encoded by GMEB2, corresponding to a target binding site such as BINDING SITE I, BINDING SITE II or BINDING SITE III of FIG. 8. Table 4 illustrates the complementarity of the nucleotide sequences of GMEB2 BINDING SITE, designated SEQ ID:1427, to the nucleotide sequence of GAM1032 RNA, herein designated GAM RNA, also designated SEQ ID:303.

Another function of GAM1032 is therefore inhibition of Glucocorticoid modulatory element binding protein 2 (GMEB2, Accession NP_036516.1). Accordingly, utilities of GAM1032 include diagnosis, prevention and treatment of diseases and clinical conditions associated with GMEB2.

Guanine nucleotide binding protein (g protein), alpha 11 (gq class) (GNA11, Accession NP_002058.1) is another GAM1032 target gene, herein designated TARGET GENE. GNA11 BINDING SITE is a target binding site found in the 3' untranslated region of mRNA encoded by GNA11, corresponding to a target binding site such as BINDING SITE I, BINDING SITE II or BINDING SITE III of FIG. 8. Table 4 illustrates the complementarity of the nucleotide sequences of GNA11 BINDING SITE, designated SEQ ID:10253, to the nucleotide sequence of GAM1032 RNA, herein designated GAM RNA, also designated SEQ ID:303.

Another function of GAM1032 is therefore inhibition of Guanine nucleotide binding protein (g protein), alpha 11 (gq class) (GNA11, Accession NP_002058.1), a gene which acts as an activator of phospholipase c. Accordingly, utilities of GAM1032 include diagnosis, prevention and treatment of diseases and clinical conditions associated with GNA11.

The function of GNA11 has been established by previous studies. Strathmann and Simon (1991) described the Gna11 gene in the mouse. The human gene was cloned by Jiang et al. (1991) and found to be 359 amino acids long. Mouse Gna11 and Gna15 (OMIM Ref. No. 139314) are tandemly duplicated in a head- to - tail array. Davignon et al. (1996) showed that the upstream gene, Gna11, is ubiquitously expressed, whereas expression of the downstream gene, Gna15, is restricted to hematopoietic cells. There was no evidence for alternative splicing within the coding sequence of either gene.

Animal model experiments lend further support to the function of GNA11. Using gene targeting, Offermanns et al. (1998) generated Gna11-deficient mice that were viable and fertile with no apparent behavioral or morphologic defects. They bred Gnaq (OMIM Ref. No. 600998)-deficient mice with Gna11-deficient mice and observed gene dosage effects between Gnaq and Gna11. Embryos completely lacking both genes died in utero with heart malformations. Mice inheriting a single copy of either gene died within hours of birth with craniofacial and/or cardiac defects. Offermanns et al. (1998) concluded that at least 2 active alleles of these genes are required for extrauterine life. Genetic, morphologic, and pharmacologic analyses of intercross offspring inheriting different combinations of these 2 mutations indicated that Gnaq and Gna11 have overlapping functions in embryonic cardiomyocyte proliferation and craniofacial development.

It is appreciated that the abovementioned animal model for GNA11 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Offermanns, S.; Zhao, L.-P.; Gohla, A.; Sarosi, I.; Simon, M. I.; Wilkie, T. M.: Embryonic cardiomyocyte hypoplasia and craniofacial defects in G-alpha-q/G-alpha- 11-mutant mice. EMBO J. 17:4304-4312, 1998; and Strathmann, M. P.; Simon, M. I.: G-alpha-12 and G-alpha-13 subunits define a fourth class of G protein alpha subunits. Proc. Nat. Acad. Sci. 88:5582-5586, 1991.

Further studies establishing the function and utilities of GNA11 are found in John Hopkins OMIM database record ID 139313, and in cited publications listed in Table 5, which are hereby incorporated by reference. Guanine nucleotide binding protein (g protein), alpha transducing activity polypeptide 1 (GNAT1, Accession NP_000163.2) is another GAM1032 target gene, herein designated TARGET GENE. GNAT1 BINDING SITE is a target binding site found in the 3' untranslated region of multiple transcripts of mRNA encoded by GNAT1, corresponding to a target binding site such as BINDING SITE I, BINDING SITE II or BINDING SITE III of FIG. 8. Table 4 illustrates the complementarity of the nucleotide sequences of GNAT1 BINDING SITE, designated SEQ ID:13082, to the nucleotide sequence of GAM1032 RNA, herein designated GAM RNA, also designated SEQ ID:303.

Another function of GAM1032 is therefore inhibition of Guanine nucleotide binding protein (g protein), alpha transducing activity polypeptide 1 (GNAT1, Accession NP_000163.2). Accordingly, utilities of GAM1032 include diagnosis, prevention and treatment of diseases and clinical conditions associated with GNAT1.

Guanine nucleotide binding protein (g protein), alpha transducing activity polypeptide 1 (GNAT1, Accession NP_653082.1) is another GAM1032 target gene, herein designated TARGET GENE. GNAT1 BINDING SITE is a target binding site found in the 3' untranslated region of multiple transcripts of mRNA encoded by GNAT1, corresponding to a target binding site such as BINDING SITE I, BINDING SITE II or BINDING SITE III of FIG. 8. Table 4 illustrates the complementarity of the nucleotide sequences of GNAT1 BINDING SITE, designated SEQ ID:13082, to the nucleotide sequence of GAM1032 RNA, herein designated GAM RNA, also designated SEQ ID:303.

Another function of GAM1032 is therefore inhibition of Guanine nucleotide binding protein (g protein), alpha transducing activity polypeptide 1 (GNAT1, Accession NP_653082.1). Accordingly, utilities of GAM1032 include diagnosis, prevention and treatment of diseases and clinical conditions associated with GNAT1.

Guanylate cyclase 2c (heat stable enterotoxin receptor) (GUCY2C, Accession NP_004954.1) is another GAM1032 target gene, herein designated TARGET GENE. GUCY2C BINDING SITE is a target binding site found in the 3' untranslated region of mRNA encoded by GUCY2C, corresponding to a target binding site such as BINDING SITE I, BINDING SITE II or BINDING SITE III of FIG. 8. Table 4 illustrates the complementarity of the nucleotide sequences of GUCY2C BINDING SITE, designated SEQ ID:9622, to the nucleotide sequence of GAM1032 RNA, herein designated GAM RNA, also designated SEQ ID:303.

Another function of GAM1032 is therefore inhibition of Guanylate cyclase 2c (heat stable enterotoxin receptor) (GUCY2C, Accession NP_004954.1), a gene which is a receptor for the e.coli heat-stable enterotoxin and guanylate cyclase activated by the endogenous peptide guanylin. Accordingly, utilities of GAM1032 include diagnosis, prevention and treatment of diseases and clinical conditions associated with GUCY2C.

The function of GUCY2C has been established by previous studies. Mann et al. (1996) described guanylyl cyclase C (called GC-C by them) as a transmembrane receptor expressed primarily in the intestine that regulates chloride secretion via the cystic fibrosis transmembrane conductance regulator (OMIM Ref. No. 602421). Binding of GC-C to either the endogenous peptide guanylin (OMIM Ref. No. 139392) or the bacterially derived heat-stable enterotoxin STa, results in increased levels of cGMP and the stimulation of water and chloride secretion. In the case of exposure to STa, this leads to debilitating secretory diarrhea. From a human colonic cell line, Singh et al. (1991) isolated a cDNA whose predicted amino acid sequence is 81% homologous to the GC-C intestinal enterotoxin STa receptor in rat. After transient transfection of COS-7 cells with the human cDNA, the investigators observed a concentration-dependent response to STa in transfected cells as measured by intracellular cGMP accumulation. They referred to this human STa receptor as STaR. Similarly, de Sauvage et al. (1991) identified a human cDNA encoding an STa receptor. The receptor has an extracellular ligand-binding domain and a cytoplasmic guanylyl cyclase domain, as do members of the natriuretic peptide receptor family. They showed that stable mammalian cell lines overexpressing the STa receptor bind radioiodinated STa (with a K(d) in the nanomolar range) and exhibit a ligand-induced increase in the cellular cGMP level Full details of the abovementioned studies are described in the following publications, the disclosure of which are hereby incorporated by reference:

Mann, E. A.; Swenson, E. S.; Copeland, N. G.; Gilbert, D. J.; Jenkins, N. A.; Taguchi, T.; Testa, J. R.; Giannella, R. A.: Localization of the guanylyl cyclase C gene to mouse chromosome 6 and human chromosome 12p12. Genomics 34:265-267, 1996; and de Sauvage, F. J.; Camerato, T. R.; Goeddel, D. V.: Primary structure and functional expression of the human receptor for Escherichia coli heat-stable enterotoxin. J. Biol. Chem. 266: 1.

Further studies establishing the function and utilities of GUCY2C are found in John Hopkins OMIM database record ID 601330, and in cited publications listed in Table 5, which are hereby incorporated by reference. H63 (Accession NP_816929.1) is another GAM1032 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:3048, to the nucleotide sequence of GAM1032 RNA, herein designated GAM RNA, also designated SEQ ID:303.

Another function of GAM1032 is therefore inhibition of H63 (Accession NP_816929.1). Accordingly, utilities of GAM1032 include diagnosis, prevention and treatment of diseases and clinical conditions associated with H63.

H63 (Accession NP_612432.2) is another GAM1032 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:3048, to the nucleotide sequence of GAM1032 RNA, herein designated GAM RNA, also designated SEQ ID:303.

Another function of GAM1032 is therefore inhibition of H63 (Accession NP_612432.2). Accordingly, utilities of GAM1032 include diagnosis, prevention and treatment of diseases and clinical conditions associated with H63.

Hyaluronan synthase 1 (HAS1, Accession NP_001514.1) is another GAM1032 target gene, herein designated TARGET GENE. HAS1 BINDING SITE1 and HAS1 BINDING SITE2 are target binding sites found in untranslated regions of mRNA encoded by HAS1, corresponding to target binding sites such as BINDING SITE I, BINDING SITE II or BINDING SITE III of FIG. 8. Table 4 illustrates the complementarity of the nucleotide sequences of HAS1 BINDING SITE1 and HAS1 BINDING SITE2, designated SEQ ID:16698 and SEQ ID:3709 respectively, to the nucleotide sequence of GAM1032 RNA, herein designated GAM RNA, also designated SEQ ID:303.

Another function of GAM1032 is therefore inhibition of Hyaluronan synthase 1 (HAS1, Accession NP_001514.1), a gene which plays a role in hyaluronan/hyaluronic acid (ha) synthesis. also able to catalyze the synthesis of chito - oligosaccharide depending on the substrate. Accordingly, utilities of GAM1032 include diagnosis, prevention and treatment of diseases and clinical conditions associated with HAS1.

The function of HAS1 has been established by previous studies. Hyaluronan or hyaluronic acid (HA) is a high molecular weight unbranched polysaccharide, synthesized by a wide variety of organisms from bacteria to mammals, and found in the extracellular matrix. It consists of alternating glucuronic acid and N-acetylglucosamine residues that are linked by beta-1-3 and beta-1-4 glycosidic bonds. Watanabe and Yamaguchi (1996) noted that unlike other glycosaminoglycans, HA synthesis occurs at the inner surface of the plasma membrane and the chains are extruded through pore-like structures into the extracellular space. Hyaluronan serves a variety of functions, including space filling, lubrication of joints, and provision of a matrix through which cells can migrate. The interaction of HA with the leukocyte receptor CD44 (OMIM Ref. No. 107269) is important in tissue-specific homing by leukocytes and overexpression of HA receptors has been correlated with tumor metastasis (Hall et al., 1995). Itano and Kimata (1996) used a transient expression system in a mouse mammary carcinoma cell line that lacks HA expression to isolate cDNA clones capable of restoring HA synthesis activity. The mouse cDNA sequence identified predicted a 583-amino acid protein with similarity to the Xenopus DG42 protein and a bacterial HA synthase.

Full details of the abovementioned studies are described in the following publications, the disclosure of which are hereby incorporated by reference:

Watanabe, K.; Yamaguchi, Y.: Molecular identification of a putative human hyaluronan synthase. J. Biol. Chem. 271: 22945-22948, 1996; and Itano, N.; Kimata, K.: Expression cloning and molecular characterization of HAS protein, a eukaryotic hyaluronan synthase. J. Biol. Chem. 271:9875-9878, 1996.

Further studies establishing the function and utilities of HAS1 are found in John Hopkins OMIM database record ID 601463, and in cited publications listed in Table 5, which are hereby incorporated by reference. HCNGP (Accession NP_037392.1) is another GAM1032 target gene, herein designated TARGET GENE. HCNGP BINDING SITE is a target binding site found in the 3' untranslated region of mRNA encoded by HCNGP, corresponding to a target binding site such as BINDING SITE I, BINDING SITE II or BINDING SITE III of FIG. 8. Table 4 illustrates the complementarity of the nucleotide sequences of HCNGP BINDING SITE, designated SEQ ID:18142, to the nucleotide sequence of GAM1032 RNA, herein designated GAM RNA, also designated SEQ ID:303.

Another function of GAM1032 is therefore inhibition of HCNGP (Accession NP_037392.1). Accordingly, utilities of GAM1032 include diagnosis, prevention and treatment of diseases and clinical conditions associated with HCNGP.

HES2 (Accession XP_290879.1) is another GAM1032 target gene, herein designated TARGET GENE. HES2 BINDING SITE is a target binding site found in the 3' untranslated region of mRNA encoded by HES2, corresponding to a target binding site such as BINDING SITE I, BINDING SITE II or BINDING SITE III of FIG. 8. Table 4 illustrates the complementarity of the nucleotide sequences of HES2 BINDING SITE, designated SEQ ID:16768, to the nucleotide sequence of GAM1032 RNA, herein designated GAM RNA, also designated SEQ ID:303.

Another function of GAM1032 is therefore inhibition of HES2 (Accession XP_290879.1). Accordingly, utilities of GAM1032 include diagnosis, prevention and treatment of diseases and clinical conditions associated with HES2.

Human immunodeficiency virus type i enhancer binding protein 1 (HIVEP1, Accession NP_002105.1) is another GAM1032 target gene, herein designated TARGET GENE. HIVEP1 BINDING SITE is a target binding site found in the 3' untranslated region of mRNA encoded by HIVEP1, corresponding to a target binding site such as BINDING SITE I, BINDING SITE II or BINDING SITE III of FIG. 8. Table 4 illustrates the complementarity of the nucleotide sequences of HIVEP1 BINDING SITE, designated SEQ ID:6005, to the nucleotide sequence of GAM1032 RNA, herein designated GAM RNA, also designated SEQ ID:303.

Another function of GAM1032 is therefore inhibition of Human immunodeficiency virus type i enhancer binding protein 1 (HIVEP1, Accession NP_002105.1), a gene which specifically binds to the dna sequence 5'-gggactttcc-3' which is found in the enhancer elements of numerous viral promoters such as those of sv40, cmv, or hiv1. Accordingly, utilities of GAM1032 include diagnosis, prevention and treatment of diseases and clinical conditions associated with HIVEP1.

The function of HIVEP1 has been established by previous studies. The sequence GGGACTTTCC is found in the enhancer elements of numerous viral promoters, including those of simian virus 40 (SV40), cytomegalovirus (CMV), and the human immunodeficiency virus (HIV). In addition, related sequences are found in the enhancer elements of a number of cellular promoters, including those of the class I major histocompatibility gene complex (OMIM Ref. No. 142800), the kappa immunoglobulin gene (OMIM Ref. No. 147200), the interleukin-2 receptor gene (OMIM Ref. No. 147730), and the interferon-beta gene (OMIM Ref. No. 147640). Mutagenesis of these enhancer elements has indicated their role in the transcriptional regulation of both viral and cellular genes. Zinc finger protein-40, a protein that binds to these sequences, has a molecular mass of 298 kD and contains 2 widely separated zinc finger binding domains, each of which binds to the same DNA sequence. This protein has variously been known as HIV-EP1 (human immunodeficiency virus type 1 enhancer-binding protein-1), MBP-1 (major histocompatibility complex-binding protein-1), and PRDII-BF1 (positive regulatory domain II-binding factor 1). (See HIVEP2, 143054.) By Southern analysis of a panel of mouse/human somatic cell hybrid DNAs and by in situ hybridization, Gaynor et al. (1991) mapped the HIVEP1 gene to 6p24-p22.3. In the course of fine mapping of 39 ESTs on 6p24-p23, Olavesen et al. (1997) confirmed the assignment of ZNF40 to this region.

Full details of the abovementioned studies are described in the following publications, the disclosure of which are hereby incorporated by reference:

Gaynor, R. B.; Muchardt, C.; Diep, A.; Mohandas, T. K.; Sparkes, R. S.; Lusis, A. J.: Localization of the zinc finger DNA-binding protein HIV-EP1/MBP-1/PRDII-BF1 to human chromosome 6p22.3-p24. Genomics 9:758-761, 1991; and Olavesen, M. G.; Bentley, E.; Mason, R. V. F.; Stephens, R. J.; Ragoussis, J.: Fine mapping of 39 ESTs on human chromosome 6p23-p25. Genomics 46:303-306, 1997.

Further studies establishing the function and utilities of HIVEP1 are found in John Hopkins OMIM database record ID 194540, and in cited publications listed in Table 5, which are hereby incorporated by reference. Holocarboxylase synthetase (biotin-[proprionyl-coenzyme a-carboxylase (atp-hydrolysing)] ligase) (HLCS, Accession NP_000402.2) is another GAM1032 target gene, herein designated TARGET GENE. HLCS BINDING SITE is a target binding site found in the 3' untranslated region of mRNA encoded by HLCS, corresponding to a target binding site such as BINDING SITE I, BINDING SITE II or BINDING SITE III of FIG. 8. Table 4 illustrates the complementarity of the nucleotide sequences of HLCS BINDING SITE, designated SEQ ID:4592, to the nucleotide sequence of GAM1032 RNA, herein designated GAM RNA, also designated SEQ ID:303.

Another function of GAM1032 is therefore inhibition of Holocarboxylase synthetase (biotin-[proprionyl-coenzyme a-carboxylase (atp-hydrolysing)] ligase) (HLCS, Accession NP_000402.2). Accordingly, utilities of GAM1032 include diagnosis, prevention and treatment of diseases and clinical conditions associated with HLCS.

Heat shock 90 kda protein 1, alpha-like 3 (HSPCAL3, Accession XP_084514.3) is another GAM1032 target gene, herein designated TARGET GENE. HSPCAL3 BINDING SITE is a target binding site found in the 3' untranslated region of mRNA encoded by HSPCAL3, corresponding to a target binding site such as BINDING SITE I, BINDING SITE II or BINDING SITE III of FIG. 8. Table 4 illustrates the complementarity of the nucleotide sequences of HSPCAL3 BINDING SITE, designated SEQ ID:1703, to the nucleotide sequence of GAM1032 RNA, herein designated GAM RNA, also designated SEQ ID:303.

Another function of GAM1032 is therefore inhibition of Heat shock 90 kda protein 1, alpha-like 3 (HSPCAL3, Accession XP_084514.3). Accordingly, utilities of GAM1032 include diagnosis, prevention and treatment of diseases and clinical conditions associated with HSPCAL3.

Interleukin 18 receptor 1 (IL18R1, Accession NP_003846.1) is another GAM1032 target gene, herein designated TARGET GENE. IL18R1 BINDING SITE is a target binding site found in the 3' untranslated region of mRNA encoded by IL18R1, corresponding to a target binding site such as BINDING SITE I, BINDING SITE II or BINDING SITE III of FIG. 8. Table 4 illustrates the complementarity of the nucleotide sequences of IL18R1 BINDING SITE, designated SEQ ID:17153, to the nucleotide sequence of GAM1032 RNA, herein designated GAM RNA, also designated SEQ ID:303.

Another function of GAM1032 is therefore inhibition of Interleukin 18 receptor 1 (IL18R1, Accession NP_003846.1), a gene which is required for dorsal-ventral embryonic polarity and promotes heterophilic cellular adhesion. Accordingly, utilities of GAM1032 include diagnosis, prevention and treatment of diseases and clinical conditions associated with IL18R1.

The function of IL18R1 and its association with various diseases and clinical conditions, has been established by previous studies, as described hereinabove with reference to GAM190.1. Internexin neuronal intermediate filament protein, alpha (INA, Accession NP_116116.1) is another GAM1032 target gene, herein designated TARGET GENE. INA BINDING SITE is a target binding site found in the 3' untranslated region of mRNA encoded by INA, corresponding to a target binding site such as BINDING SITE I, BINDING SITE II or BINDING SITE III of FIG. 8. Table 4 illustrates the complementarity of the nucleotide sequences of INA BINDING SITE, designated SEQ ID:2428, to the nucleotide sequence of GAM1032 RNA, herein designated GAM RNA, also designated SEQ ID:303.

Another function of GAM1032 is therefore inhibition of Internexin neuronal intermediate filament protein, alpha (INA, Accession NP_116116.1). Accordingly, utilities of GAM1032 include diagnosis, prevention and treatment of diseases and clinical conditions associated with INA.

Inositol polyphosphate-5-phosphatase, 145 kda (INPP5D, Accession NP_005532.1) is another GAM1032 target gene, herein designated TARGET GENE. INPP5D BINDING SITE is a target binding site found in the 3' untranslated region of mRNA encoded by INPP5D, corresponding to a target binding site such as BINDING SITE I, BINDING SITE II or BINDING SITE III of FIG. 8. Table 4 illustrates the complementarity of the nucleotide sequences of INPP5D BINDING SITE, designated SEQ ID:8687, to the nucleotide sequence of GAM1032 RNA, herein designated GAM RNA, also designated SEQ ID:303.

Another function of GAM1032 is therefore inhibition of Inositol polyphosphate-5-phosphatase, 145 kda (INPP5D, Accession NP_005532.1), a gene which hydrolyzes Ins(1,3,4,5)P4 and PtdIns(3,4,5)P3; contains an SH2-domain and therefore may be associated with Severe osteoporosis. Accordingly, utilities of GAM1032 include diagnosis, prevention and treatment of Severe osteoporosis, and of other diseases and clinical conditions associated with INPP5D.

The function of INPP5D and its association with various diseases and clinical conditions, has been established by previous studies, as described hereinabove with reference to GAM347.1. Il2-inducible t-cell kinase (ITK, Accession NP_005537.3) is another GAM1032 target gene, herein designated TARGET GENE. ITK BINDING SITE is a target binding site found in the 3' untranslated region of mRNA encoded by ITK, corresponding to a target binding site such as BINDING SITE I, BINDING SITE II or BINDING SITE III of FIG. 8. Table 4 illustrates the complementarity of the nucleotide sequences of ITK BINDING SITE, designated SEQ ID:978, to the nucleotide sequence of GAM1032 RNA, herein designated GAM RNA, also designated SEQ ID:303.

Another function of GAM1032 is therefore inhibition of Il2-inducible t-cell kinase (ITK, Accession NP_005537.3), a gene which plays a role in t cell proliferation and differentiation. and therefore may be associated with Myelodysplastic syndrome. Accordingly, utilities of GAM1032 include diagnosis, prevention and treatment of Myelodysplastic syndrome, and of other diseases and clinical conditions associated with ITK.

The function of ITK and its association with various diseases and clinical conditions, has been established by previous studies, as described hereinabove with reference to GAM44.1. Kv channel interacting protein 2 (KCNIP2, Accession NP_775464.1) is another GAM1032 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:16093, to the nucleotide sequence of GAM1032 RNA, herein designated GAM RNA, also designated SEQ ID:303.

Another function of GAM1032 is therefore inhibition of Kv channel interacting protein 2 (KCNIP2, Accession NP_775464.1). Accordingly, utilities of GAM1032 include diagnosis, prevention and treatment of diseases and clinical conditions associated with KCNIP2.

KIAA0329 (Accession NP_055659.1) is another GAM1032 target gene, herein designated TARGET GENE. KIAA0329 BINDING SITE is a target binding site found in the 3' untranslated region of mRNA encoded by KIAA0329, corresponding to a target binding site such as BINDING SITE I, BINDING SITE II or BINDING SITE III of FIG. 8. Table 4 illustrates the complementarity of the nucleotide sequences of KIAA0329 BINDING SITE, designated SEQ ID:5874, to the nucleotide sequence of GAM1032 RNA, herein designated GAM RNA, also designated SEQ ID:303.

Another function of GAM1032 is therefore inhibition of KIAA0329 (Accession NP_055659.1). Accordingly, utilities of GAM1032 include diagnosis, prevention and treatment of diseases and clinical conditions associated with KIAA0329.

KIAA0377 (Accession NP_055474.1) is another GAM1032 target gene, herein designated TARGET GENE. KIAA0377 BINDING SITE is a target binding site found in the 3' untranslated region of mRNA encoded by KIAA0377, corresponding to a target binding site such as BINDING SITE I, BINDING SITE II or BINDING SITE III of FIG. 8. Table 4 illustrates the complementarity of the nucleotide sequences of KIAA0377 BINDING SITE, designated SEQ ID:17827, to the nucleotide sequence of GAM1032 RNA, herein designated GAM RNA, also designated SEQ ID:303.

Another function of GAM1032 is therefore inhibition of KIAA0377 (Accession NP_055474.1). Accordingly, utilities of GAM1032 include diagnosis, prevention and treatment of diseases and clinical conditions associated with KIAA0377.

KIAA0459 (Accession XP_027862.1) is another GAM1032 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:8436, to the nucleotide sequence of GAM1032 RNA, herein designated GAM RNA, also designated SEQ ID:303.

Another function of GAM1032 is therefore inhibition of KIAA0459 (Accession XP_027862.1). Accordingly, utilities of GAM1032 include diagnosis, prevention and treatment of diseases and clinical conditions associated with KIAA0459.

KIAA0694 (Accession XP_051970.2) is another GAM1032 target gene, herein designated TARGET GENE. KIAA0694 BINDING SITE is a target binding site found in the 5' untranslated region of mRNA encoded by KIAA0694, corresponding to a target binding site such as BINDING SITE I, BINDING SITE II or BINDING SITE III of FIG. 8. Table 4 illustrates the complementarity of the nucleotide sequences of KIAA0694 BINDING SITE, designated SEQ ID:10714, to the nucleotide sequence of GAM1032 RNA, herein designated GAM RNA, also designated SEQ ID:303.

Another function of GAM1032 is therefore inhibition of KIAA0694 (Accession XP_051970.2). Accordingly, utilities of GAM1032 include diagnosis, prevention and treatment of diseases and clinical conditions associated with KIAA0694.

KIAA1271 (Accession XP_045472.1) is another GAM1032 target gene, herein designated TARGET GENE. KIAA1271 BINDING SITE is a target binding site found in the 3' untranslated region of mRNA encoded by KIAA1271, corresponding to a target binding site such as BINDING SITE I, BINDING SITE II or BINDING SITE III of FIG. 8. Table 4 illustrates the complementarity of the nucleotide sequences of KIAA1271 BINDING SITE, designated SEQ ID:12182, to the nucleotide sequence of GAM1032 RNA, herein designated GAM RNA, also designated SEQ ID:303.

Another function of GAM1032 is therefore inhibition of KIAA1271 (Accession XP_045472.1). Accordingly, utilities of GAM1032 include diagnosis, prevention and treatment of diseases and clinical conditions associated with KIAA1271.

KIAA1465 (Accession XP_027396.4) is another GAM1032 target gene, herein designated TARGET GENE. KIAA1465 BINDING SITE is a target binding site found in the 3' untranslated region of mRNA encoded by KIAA1465, corresponding to a target binding site such as BINDING SITE I, BINDING SITE II or BINDING SITE III of FIG. 8. Table 4 illustrates the complementarity of the nucleotide sequences of KIAA1465 BINDING SITE, designated SEQ ID:18401, to the nucleotide sequence of GAM1032 RNA, herein designated GAM RNA, also designated SEQ ID:303.

Another function of GAM1032 is therefore inhibition of KIAA1465 (Accession XP_027396.4). Accordingly, utilities of GAM1032 include diagnosis, prevention and treatment of diseases and clinical conditions associated with KIAA1465.

KIAA1718 (Accession XP_034823.5) is another GAM1032 target gene, herein designated TARGET GENE. KIAA1718 BINDING SITE is a target binding site found in the 3' untranslated region of mRNA encoded by KIAA1718, corresponding to a target binding site such as BINDING SITE I, BINDING SITE II or BINDING SITE III of FIG. 8. Table 4 illustrates the complementarity of the nucleotide sequences of KIAA1718 BINDING SITE, designated SEQ ID:8259, to the nucleotide sequence of GAM1032 RNA, herein designated GAM RNA, also designated SEQ ID:303.

Another function of GAM1032 is therefore inhibition of KIAA1718 (Accession XP_034823.5). Accordingly, utilities of GAM1032 include diagnosis, prevention and treatment of diseases and clinical conditions associated with KIAA1718.

KIAA1879 (Accession XP_056635.1) is another GAM1032 target gene, herein designated TARGET GENE. KIAA1879 BINDING SITE is a target binding site found in the 5' untranslated region of mRNA encoded by KIAA1879, corresponding to a target binding site such as BINDING SITE I, BINDING SITE II or BINDING SITE III of FIG. 8. Table 4 illustrates the complementarity of the nucleotide sequences of KIAA1879 BINDING SITE, designated SEQ ID:16159, to the nucleotide sequence of GAM1032 RNA, herein designated GAM RNA, also designated SEQ ID:303.

Another function of GAM1032 is therefore inhibition of KIAA1879 (Accession XP_056635.1). Accordingly, utilities of GAM1032 include diagnosis, prevention and treatment of diseases and clinical conditions associated with KIAA1879.

KIF25 (Accession NP_085118.1) is another GAM1032 target gene, herein designated TARGET GENE. KIF25 BINDING SITE is a target binding site found in the 5' untranslated region of multiple transcripts of mRNA encoded by KIF25, corresponding to a target binding site such as BINDING SITE I, BINDING SITE II or BINDING SITE III of FIG. 8. Table 4 illustrates the complementarity of the nucleotide sequences of KIF25 BINDING SITE, designated SEQ ID:4138, to the nucleotide sequence of GAM1032 RNA, herein designated GAM RNA, also designated SEQ ID:303.

Another function of GAM1032 is therefore inhibition of KIF25 (Accession NP_085118.1). Accordingly, utilities of GAM1032 include diagnosis, prevention and treatment of diseases and clinical conditions associated with KIF25.

KIF25 (Accession NP_005346.2) is another GAM1032 target gene, herein designated TARGET GENE. KIF25 BINDING SITE is a target binding site found in the 5' untranslated region of multiple transcripts of mRNA encoded by KIF25, corresponding to a target binding site such as BINDING SITE I, BINDING SITE II or BINDING SITE III of FIG. 8. Table 4 illustrates the complementarity of the nucleotide sequences of KIF25 BINDING SITE, designated SEQ ID:4138, to the nucleotide sequence of GAM1032 RNA, herein designated GAM RNA, also designated SEQ ID:303.

Another function of GAM1032 is therefore inhibition of KIF25 (Accession NP_005346.2). Accordingly, utilities of GAM1032 include diagnosis, prevention and treatment of diseases and clinical conditions associated with KIF25.

Killer cell immunoglobulin-like receptor, two domains, long cytoplasmic tail, 1 (KIR2DL1, Accession NP_055033.1) is another GAM1032 target gene, herein designated TARGET GENE. KIR2DL1 BINDING SITE is a target binding site found in the 3' untranslated region of mRNA encoded by KIR2DL1, corresponding to a target binding site such as BINDING SITE I, BINDING SITE II or BINDING SITE III of FIG. 8. Table 4 illustrates the complementarity of the nucleotide sequences of KIR2DL1 BINDING SITE, designated SEQ ID:7645, to the nucleotide sequence of GAM1032 RNA, herein designated GAM RNA, also designated SEQ ID:303.

Another function of GAM1032 is therefore inhibition of Killer cell immunoglobulin-like receptor, two domains, long cytoplasmic tail, 1 (KIR2DL1, Accession NP_055033.1), a gene which inhibits the activity of nk cells thus preventing cell lysis. Accordingly, utilities of GAM1032 include diagnosis, prevention and treatment of diseases and clinical conditions associated with KIR2DL1.

The function of KIR2DL1 has been established by previous studies. The existence of human inhibitory natural killer (NK) cell receptors for MHC class I molecules (now designated killer cell Ig-like receptors, or KIRs), was inferred from the observation that NK cells killed HLA class I-deficient cell lines (Ljunggren and Karre, 1990). The inhibition could be disrupted by antibodies against membrane glycoproteins on NK cells that recognized HLA-A and HLA-C (OMIM Ref. No. 142840). Complementary DNA cloning of the receptors revealed a family of genes, designated the killer cell inhibitory receptors. Inhibitory KIRs are found in 3 distinct isoforms. KIRs that recognize HLA-C are usually monomeric glycoproteins of about 58 kD with 2 immunoglobulin-like domains (KIR2D). KIRs that are reactive with HLA-B are approximately 70-kD monomeric glycoproteins with 3 Ig-like domains (KIR3D). KIRs that are reactive with HLA-A also possess 3 extracellular Ig-like domains but are expressed as 2, approximately 70-kD disulfide-linked homodimer subunits. Molecular analysis of KIRs and other inhibitory receptors (e.g., LILRB1, 604811) has revealed a common cytoplasmic sequence (I/VxYxxL/V) called an ITIM (immunoreceptor tyrosine-based inhibitory motif). KIRs with a long cytoplasmic tail have 2 ITIMs (OMIM Ref. No. KIR2DL). Upon MHC I engagement and tyrosine phosphorylation of the ITIM, intracellular protein tyrosine phosphatases such as SHP1 (PTPN6; 176883) are recruited, and an inhibitory signal cascade ensues. Other receptors, of about 50 kD (p50s), with short cytoplasmic regions (KIR2DS and KIR3DS) without ITIMs have transmembrane regions containing a charged amino acid and initiate stimulatory cascades by association with DAP12 (TYROBP; 604142), a membrane receptor expressing ITAM (immunoreceptor tyrosine-based activation motif). For reviews of KIRs and other NK receptors, see Lanier (1997, 1998, 2000 KIR2D receptors are divided into 2 families based on their specificities for different HLA-C allotypes. KIR2DL1 has specificity for HLA-C alleles with asn77 and lys80, while KIR2DL2 (OMIM Ref. No. 604937) has specificity for HLA-C alleles with ser77 and asn80. Fan et al. (2001) described the crystal structure of KIR2DL1 and HLA-Cw4 at a resolution of 2.8 angstroms. They determined that met44 of KIR2DL1 is in a pocket that hosts, through both polar and hydrophobic interactions, lys80 of HLA-Cw4

Full details of the abovementioned studies are described in the following publications, the disclosure of which are hereby incorporated by reference:

Andre, P.; Biassoni, R.; Colonna, M.; Cosman, D.; Lanier, L. L.; Long, E. O.; Lopez-Botet, M.; Moretta, A.; Moretta, L.; Parham, P.; Trowsdale, J.; Vivier, E.; Wagtmann, N.; Wilson, M. J.: New nomenclature for MHC receptors. Nature Immun. 2:661 only, 2001; and Colonna, M.; Samaridis, J.: Cloning of immunoglobulin-superfamily members associated with HLA-C and HLA-B recognition by human natural killer cells. Science 268: 405-408, 1995.

Further studies establishing the function and utilities of KIR2DL1 are found in John Hopkins OMIM database record ID 604936, and in cited publications listed in Table 5, which are hereby incorporated by reference. Killer cell immunoglobulin-like receptor, two domains, long cytoplasmic tail, 2 (KIR2DL2, Accession NP_055034.1) is another GAM1032 target gene, herein designated TARGET GENE. KIR2DL2 BINDING SITE is a target binding site found in the 3' untranslated region of mRNA encoded by KIR2DL2, corresponding to a target binding site such as BINDING SITE I, BINDING SITE II or BINDING SITE III of FIG. 8. Table 4 illustrates the complementarity of the nucleotide sequences of KIR2DL2 BINDING SITE, designated SEQ ID:7645, to the nucleotide sequence of GAM1032 RNA, herein designated GAM RNA, also designated SEQ ID:303.

Another function of GAM1032 is therefore inhibition of Killer cell immunoglobulin-like receptor, two domains, long cytoplasmic tail, 2 (KIR2DL2, Accession NP_055034.1), a gene which is a receptor on natural killer cells and inhibits the activity of nk cells thus preventing cell lysis. Accordingly, utilities of GAM1032 include diagnosis, prevention and treatment of diseases and clinical conditions associated with KIR2DL2.

The function of KIR2DL2 has been established by previous studies. background information on the KIR family of natural killer (NK) cell Ig-like receptors, see KIR2DL1 (OMIM Ref. No. 604936). By screening NK cells with a KIR2DL3 cDNA probe, Wagtmann et al. (1995) isolated a KIR2DL2 cDNA, which they called clone 43 (CL43), encoding a deduced 348-amino acid type I transmembrane protein. Sequence analysis revealed a structure similar to that described for KIR2DL1, with 2 extracellular C2-type Ig-like domains, a transmembrane domain, and a long cytoplasmic tail with 2 ITIMs (immunoreceptor tyrosine-based inhibitory motifs). Dohring et al. (1996) also identified KIR2DL2, which they termed NKAT6. By analysis of somatic cell hybrids, Colonna and Samaridis (1995) and Wagtmann et al. (1995) mapped the KIR gene family to chromosome 19

Full details of the abovementioned studies are described in the following publications, the disclosure of which are hereby incorporated by reference:

Dohring, C.; Samaridis, J.; Colonna, M.: Alternatively spliced forms of human killer inhibitory receptors. Immunogenetics 44:227-230, 1996; and Wagtmann, N.; Biassoni, R.; Cantoni, C.; Verdiani, S.; Malnati, M. S.; Vitale, M.; Bottino, C.; Moretta, L.; Moretta, A.; Long, E. O.: Molecular clones of the p58 NK cell receptor reve.

Further studies establishing the function and utilities of KIR2DL2 are found in John Hopkins OMIM database record ID 604937, and in cited publications listed in Table 5, which are hereby incorporated by reference. LKAP (Accession NP_061954.1) is another GAM1032 target gene, herein designated TARGET GENE. LKAP BINDING SITE is a target binding site found in the 3' untranslated region of mRNA encoded by LKAP, corresponding to a target binding site such as BINDING SITE I, BINDING SITE II or BINDING SITE III of FIG. 8. Table 4 illustrates the complementarity of the nucleotide sequences of LKAP BINDING SITE, designated SEQ ID:13514, to the nucleotide sequence of GAM1032 RNA, herein designated GAM RNA, also designated SEQ ID:303.

Another function of GAM1032 is therefore inhibition of LKAP (Accession NP_061954.1). Accordingly, utilities of GAM1032 include diagnosis, prevention and treatment of diseases and clinical conditions associated with LKAP.

Ligand of numb-protein x (LNX, Accession NP_116011.1) is another GAM1032 target gene, herein designated TARGET GENE. LNX BINDING SITE is a target binding site found in the 5' untranslated region of mRNA encoded by LNX, corresponding to a target binding site such as BINDING SITE I, BINDING SITE II or BINDING SITE III of FIG. 8. Table 4 illustrates the complementarity of the nucleotide sequences of LNX BINDING SITE, designated SEQ ID:3987, to the nucleotide sequence of GAM1032 RNA, herein designated GAM RNA, also designated SEQ ID:303.

Another function of GAM1032 is therefore inhibition of Ligand of numb-protein x (LNX, Accession NP_116011.1). Accordingly, utilities of GAM1032 include diagnosis, prevention and treatment of diseases and clinical conditions associated with LNX.

LOC121498 (Accession XP_062669.7) is another GAM1032 target gene, herein designated TARGET GENE. LOC121498 BINDING SITE is a target binding site found in the 3' untranslated region of mRNA encoded by LOC121498, corresponding to a target binding site such as BINDING SITE I, BINDING SITE II or BINDING SITE III of FIG. 8. Table 4 illustrates the complementarity of the nucleotide sequences of LOC121498 BINDING SITE, designated SEQ ID:10999, to the nucleotide sequence of GAM1032 RNA, herein designated GAM RNA, also designated SEQ ID:303.

Another function of GAM1032 is therefore inhibition of LOC121498 (Accession XP_062669.7). Accordingly, utilities of GAM1032 include diagnosis, prevention and treatment of diseases and clinical conditions associated with LOC121498.

LOC132870 (Accession XP_059608.1) is another GAM1032 target gene, herein designated TARGET GENE. LOC132870 BINDING SITE is a target binding site found in the 5' untranslated region of mRNA encoded by LOC132870, corresponding to a target binding site such as BINDING SITE I, BINDING SITE II or BINDING SITE III of FIG. 8. Table 4 illustrates the complementarity of the nucleotide sequences of LOC132870 BINDING SITE, designated SEQ ID:17125, to the nucleotide sequence of GAM1032 RNA, herein designated GAM RNA, also designated SEQ ID:303.

Another function of GAM1032 is therefore inhibition of LOC132870 (Accession XP_059608.1). Accordingly, utilities of GAM1032 include diagnosis, prevention and treatment of diseases and clinical conditions associated with LOC132870.

LOC143188 (Accession XP_096387.1) is another GAM1032 target gene, herein designated TARGET GENE. LOC143188 BINDING SITE is a target binding site found in the 5' untranslated region of mRNA encoded by LOC143188, corresponding to a target binding site such as BINDING SITE I, BINDING SITE II or BINDING SITE III of FIG. 8. Table 4 illustrates the complementarity of the nucleotide sequences of LOC143188 BINDING SITE, designated SEQ ID:11783, to the nucleotide sequence of GAM1032 RNA, herein designated GAM RNA, also designated SEQ ID:303.

Another function of GAM1032 is therefore inhibition of LOC143188 (Accession XP_096387.1). Accordingly, utilities of GAM1032 include diagnosis, prevention and treatment of diseases and clinical conditions associated with LOC143188.

LOC146542 (Accession NP_660314.1) is another GAM1032 target gene, herein designated TARGET GENE. LOC146542 BINDING SITE is a target binding site found in the 3' untranslated region of mRNA encoded by LOC146542, corresponding to a target binding site such as BINDING SITE I, BINDING SITE II or BINDING SITE III of FIG. 8. Table 4 illustrates the complementarity of the nucleotide sequences of LOC146542 BINDING SITE, designated SEQ ID:16407, to the nucleotide sequence of GAM1032 RNA, herein designated GAM RNA, also designated SEQ ID:303.

Another function of GAM1032 is therefore inhibition of LOC146542 (Accession NP_660314.1). Accordingly, utilities of GAM1032 include diagnosis, prevention and treatment of diseases and clinical conditions associated with LOC146542.

LOC147622 (Accession XP_097255.1) is another GAM1032 target gene, herein designated TARGET GENE. LOC147622 BINDING SITE is a target binding site found in the 5' untranslated region of mRNA encoded by LOC147622, corresponding to a target binding site such as BINDING SITE I, BINDING SITE II or BINDING SITE III of FIG. 8. Table 4 illustrates the complementarity of the nucleotide sequences of LOC147622 BINDING SITE, designated SEQ ID:4440, to the nucleotide sequence of GAM1032 RNA, herein designated GAM RNA, also designated SEQ ID:303.

Another function of GAM1032 is therefore inhibition of LOC147622 (Accession XP_097255.1). Accordingly, utilities of GAM1032 include diagnosis, prevention and treatment of diseases and clinical conditions associated with LOC147622.

LOC147791 (Accession XP_097293.2) is another GAM1032 target gene, herein designated TARGET GENE. LOC147791 BINDING SITE is a target binding site found in the 3' untranslated region of mRNA encoded by LOC147791, corresponding to a target binding site such as BINDING SITE I, BINDING SITE II or BINDING SITE III of FIG. 8. Table 4 illustrates the complementarity of the nucleotide sequences of LOC147791 BINDING SITE, designated SEQ ID:4967, to the nucleotide sequence of GAM1032 RNA, herein designated GAM RNA, also designated SEQ ID:303.

Another function of GAM1032 is therefore inhibition of LOC147791 (Accession XP_097293.2). Accordingly, utilities of GAM1032 include diagnosis, prevention and treatment of diseases and clinical conditions associated with LOC147791.

LOC149271 (Accession XP_086475.1) is another GAM1032 target gene, herein designated TARGET GENE. LOC149271 BINDING SITE is a target binding site found in the 5' untranslated region of mRNA encoded by LOC149271, corresponding to a target binding site such as BINDING SITE I, BINDING SITE II or BINDING SITE III of FIG. 8. Table 4 illustrates the complementarity of the nucleotide sequences of LOC149271 BINDING SITE, designated SEQ ID:5890, to the nucleotide sequence of GAM1032 RNA, herein designated GAM RNA, also designated SEQ ID:303.

Another function of GAM1032 is therefore inhibition of LOC149271 (Accession XP_086475.1). Accordingly, utilities of GAM1032 include diagnosis, prevention and treatment of diseases and clinical conditions associated with LOC149271.

LOC149372 (Accession XP_086509.1) is another GAM1032 target gene, herein designated TARGET GENE. LOC149372 BINDING SITE is a target binding site found in the 3' untranslated region of mRNA encoded by LOC149372, corresponding to a target binding site such as BINDING SITE I, BINDING SITE II or BINDING SITE III of FIG. 8. Table 4 illustrates the complementarity of the nucleotide sequences of LOC149372 BINDING SITE, designated SEQ ID:19078, to the nucleotide sequence of GAM1032 RNA, herein designated GAM RNA, also designated SEQ ID:303.

Another function of GAM1032 is therefore inhibition of LOC149372 (Accession XP_086509.1). Accordingly, utilities of GAM1032 include diagnosis, prevention and treatment of diseases and clinical conditions associated with LOC149372.

LOC149386 (Accession XP_097631.1) is another GAM1032 target gene, herein designated TARGET GENE. LOC149386 BINDING SITE is a target binding site found in the 5' untranslated region of mRNA encoded by LOC149386, corresponding to a target binding site such as BINDING SITE I, BINDING SITE II or BINDING SITE III of FIG. 8. Table 4 illustrates the complementarity of the nucleotide sequences of LOC149386 BINDING SITE, designated SEQ ID:6026, to the nucleotide sequence of GAM1032 RNA, herein designated GAM RNA, also designated SEQ ID:303.

Another function of GAM1032 is therefore inhibition of LOC149386 (Accession XP_097631.1). Accordingly, utilities of GAM1032 include diagnosis, prevention and treatment of diseases and clinical conditions associated with LOC149386.

LOC150166 (Accession XP_097824.1) is another GAM1032 target gene, herein designated TARGET GENE. LOC150166 BINDING SITE is a target binding site found in the 3' untranslated region of mRNA encoded by LOC150166, corresponding to a target binding site such as BINDING SITE I, BINDING SITE II or BINDING SITE III of FIG. 8. Table 4 illustrates the complementarity of the nucleotide sequences of LOC150166 BINDING SITE, designated SEQ ID:11388, to the nucleotide sequence of GAM1032 RNA, herein designated GAM RNA, also designated SEQ ID:303.

Another function of GAM1032 is therefore inhibition of LOC150166 (Accession XP_097824.1). Accordingly, utilities of GAM1032 include diagnosis, prevention and treatment of diseases and clinical conditions associated with LOC150166.

LOC150225 (Accession XP_097870.1) is another GAM1032 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:18349, to the nucleotide sequence of GAM1032 RNA, herein designated GAM RNA, also designated SEQ ID:303.

Another function of GAM1032 is therefore inhibition of LOC150225 (Accession XP_097870.1). Accordingly, utilities of GAM1032 include diagnosis, prevention and treatment of diseases and clinical conditions associated with LOC150225.

LOC150946 (Accession XP_097977.2) is another GAM1032 target gene, herein designated TARGET GENE. LOC150946 BINDING SITE is a target binding site found in the 3' untranslated region of mRNA encoded by LOC150946, corresponding to a target binding site such as BINDING SITE I, BINDING SITE II or BINDING SITE III of FIG. 8. Table 4 illustrates the complementarity of the nucleotide sequences of LOC150946 BINDING SITE, designated SEQ ID:3747, to the nucleotide sequence of GAM1032 RNA, herein designated GAM RNA, also designated SEQ ID:303.

Another function of GAM1032 is therefore inhibition of LOC150946 (Accession XP_097977.2). Accordingly, utilities of GAM1032 include diagnosis, prevention and treatment of diseases and clinical conditions associated with LOC150946.

LOC151162 (Accession XP_098012.1) is another GAM1032 target gene, herein designated TARGET GENE. LOC151162 BINDING SITE is a target binding site found in the 5' untranslated region of mRNA encoded by LOC151162, corresponding to a target binding site such as BINDING SITE I, BINDING SITE II or BINDING SITE III of FIG. 8. Table 4 illustrates the complementarity of the nucleotide sequences of LOC151162 BINDING SITE, designated SEQ ID:17135, to the nucleotide sequence of GAM1032 RNA, herein designated GAM RNA, also designated SEQ ID:303.

Another function of GAM1032 is therefore inhibition of LOC151162 (Accession XP_098012.1). Accordingly, utilities of GAM1032 include diagnosis, prevention and treatment of diseases and clinical conditions associated with LOC151162.

LOC151647 (Accession XP_087261.1) is another GAM1032 target gene, herein designated TARGET GENE. LOC151647 BINDING SITE is a target binding site found in the 5' untranslated region of mRNA encoded by LOC151647, corresponding to a target binding site such as BINDING SITE I, BINDING SITE II or BINDING SITE III of FIG. 8. Table 4 illustrates the complementarity of the nucleotide sequences of LOC151647 BINDING SITE, designated SEQ ID:13917, to the nucleotide sequence of GAM1032 RNA, herein designated GAM RNA, also designated SEQ ID:303.

Another function of GAM1032 is therefore inhibition of LOC151647 (Accession XP_087261.1). Accordingly, utilities of GAM1032 include diagnosis, prevention and treatment of diseases and clinical conditions associated with LOC151647.

LOC152920 (Accession XP_087561.1) is another GAM1032 target gene, herein designated TARGET GENE. LOC152920 BINDING SITE is a target binding site found in the 5' untranslated region of mRNA encoded by LOC152920, corresponding to a target binding site such as BINDING SITE I, BINDING SITE II or BINDING SITE III of FIG. 8. Table 4 illustrates the complementarity of the nucleotide sequences of LOC152920 BINDING SITE, designated SEQ ID:10090, to the nucleotide sequence of GAM1032 RNA, herein designated GAM RNA, also designated SEQ ID:303.

Another function of GAM1032 is therefore inhibition of LOC152920 (Accession XP_087561.1). Accordingly, utilities of GAM1032 include diagnosis, prevention and treatment of diseases and clinical conditions associated with LOC152920.

LOC154184 (Accession XP_098488.2) is another GAM1032 target gene, herein designated TARGET GENE. LOC154184 BINDING SITE is a target binding site found in the 3' untranslated region of mRNA encoded by LOC154184, corresponding to a target binding site such as BINDING SITE I, BINDING SITE II or BINDING SITE III of FIG. 8. Table 4 illustrates the complementarity of the nucleotide sequences of LOC154184 BINDING SITE, designated SEQ ID:3687, to the nucleotide sequence of GAM1032 RNA, herein designated GAM RNA, also designated SEQ ID:303.

Another function of GAM1032 is therefore inhibition of LOC154184 (Accession XP_098488.2). Accordingly, utilities of GAM1032 include diagnosis, prevention and treatment of diseases and clinical conditions associated with LOC154184.

LOC157273 (Accession XP_098743.1) is another GAM1032 target gene, herein designated TARGET GENE. LOC157273 BINDING SITE is a target binding site found in the 3' untranslated region of mRNA encoded by LOC157273, corresponding to a target binding site such as BINDING SITE I, BINDING SITE II or BINDING SITE III of FIG. 8. Table 4 illustrates the complementarity of the nucleotide sequences of LOC157273 BINDING SITE, designated SEQ ID:626, to the nucleotide sequence of GAM1032 RNA, herein designated GAM RNA, also designated SEQ ID:303.

Another function of GAM1032 is therefore inhibition of LOC157273 (Accession XP_098743.1). Accordingly, utilities of GAM1032 include diagnosis, prevention and treatment of diseases and clinical conditions associated with LOC157273.

LOC157381 (Accession XP_098754.5) is another GAM1032 target gene, herein designated TARGET GENE. LOC157381 BINDING SITE is a target binding site found in the 5' untranslated region of mRNA encoded by LOC157381, corresponding to a target binding site such as BINDING SITE I, BINDING SITE II or BINDING SITE III of FIG. 8. Table 4 illustrates the complementarity of the nucleotide sequences of LOC157381 BINDING SITE, designated SEQ ID:15936, to the nucleotide sequence of GAM1032 RNA, herein designated GAM RNA, also designated SEQ ID:303.

Another function of GAM1032 is therefore inhibition of LOC157381 (Accession XP_098754.5). Accordingly, utilities of GAM1032 include diagnosis, prevention and treatment of diseases and clinical conditions associated with LOC157381.

LOC157627 (Accession XP_088347.2) is another GAM1032 target gene, herein designated TARGET GENE. LOC157627 BINDING SITE is a target binding site found in the 3' untranslated region of mRNA encoded by LOC157627, corresponding to a target binding site such as BINDING SITE I, BINDING SITE II or BINDING SITE III of FIG. 8. Table 4 illustrates the complementarity of the nucleotide sequences of LOC157627 BINDING SITE, designated SEQ ID:17425, to the nucleotide sequence of GAM1032 RNA, herein designated GAM RNA, also designated SEQ ID:303.

Another function of GAM1032 is therefore inhibition of LOC157627 (Accession XP_088347.2). Accordingly, utilities of GAM1032 include diagnosis, prevention and treatment of diseases and clinical conditions associated with LOC157627.

LOC157653 (Accession XP_088353.1) is another GAM1032 target gene, herein designated TARGET GENE. LOC157653 BINDING SITE is a target binding site found in the 5' untranslated region of mRNA encoded by LOC157653, corresponding to a target binding site such as BINDING SITE I, BINDING SITE II or BINDING SITE III of FIG. 8. Table 4 illustrates the complementarity of the nucleotide sequences of LOC157653 BINDING SITE, designated SEQ ID:3788, to the nucleotide sequence of GAM1032 RNA, herein designated GAM RNA, also designated SEQ ID:303.

Another function of GAM1032 is therefore inhibition of LOC157653 (Accession XP_088353.1). Accordingly, utilities of GAM1032 include diagnosis, prevention and treatment of diseases and clinical conditions associated with LOC157653.

LOC163182 (Accession XP_092058.1) is another GAM1032 target gene, herein designated TARGET GENE. LOC163182 BINDING SITE is a target binding site found in the 3' untranslated region of mRNA encoded by LOC163182, corresponding to a target binding site such as BINDING SITE I, BINDING SITE II or BINDING SITE III of FIG. 8. Table 4 illustrates the complementarity of the nucleotide sequences of LOC163182 BINDING SITE, designated SEQ ID:3542, to the nucleotide sequence of GAM1032 RNA, herein designated GAM RNA, also designated SEQ ID:303.

Another function of GAM1032 is therefore inhibition of LOC163182 (Accession XP_092058.1). Accordingly, utilities of GAM1032 include diagnosis, prevention and treatment of diseases and clinical conditions associated with LOC163182.

LOC163223 (Accession XP_092087.3) is another GAM1032 target gene, herein designated TARGET GENE. LOC163223 BINDING SITE is a target binding site found in the 3' untranslated region of mRNA encoded by LOC163223, corresponding to a target binding site such as BINDING SITE I, BINDING SITE II or BINDING SITE III of FIG. 8. Table 4 illustrates the complementarity of the nucleotide sequences of LOC163223 BINDING SITE, designated SEQ ID:12269, to the nucleotide sequence of GAM1032 RNA, herein designated GAM RNA, also designated SEQ ID:303.

Another function of GAM1032 is therefore inhibition of LOC163223 (Accession XP_092087.3). Accordingly, utilities of GAM1032 include diagnosis, prevention and treatment of diseases and clinical conditions associated with LOC163223.

LOC170106 (Accession XP_093106.2) is another GAM1032 target gene, herein designated TARGET GENE. LOC170106 BINDING SITE is a target binding site found in the 5' untranslated region of mRNA encoded by LOC170106, corresponding to a target binding site such as BINDING SITE I, BINDING SITE II or BINDING SITE III of FIG. 8. Table 4 illustrates the complementarity of the nucleotide sequences of LOC170106 BINDING SITE, designated SEQ ID:17459, to the nucleotide sequence of GAM1032 RNA, herein designated GAM RNA, also designated SEQ ID:303.

Another function of GAM1032 is therefore inhibition of LOC170106 (Accession XP_093106.2). Accordingly, utilities of GAM1032 include diagnosis, prevention and treatment of diseases and clinical conditions associated with LOC170106.

LOC200230 (Accession XP_114166.1) is another GAM1032 target gene, herein designated TARGET GENE. LOC200230 BINDING SITE is a target binding site found in the 3' untranslated region of mRNA encoded by LOC200230, corresponding to a target binding site such as BINDING SITE I, BINDING SITE II or BINDING SITE III of FIG. 8. Table 4 illustrates the complementarity of the nucleotide sequences of LOC200230 BINDING SITE, designated SEQ ID:18830, to the nucleotide sequence of GAM1032 RNA, herein designated GAM RNA, also designated SEQ ID:303.

Another function of GAM1032 is therefore inhibition of LOC200230 (Accession XP_114166.1). Accordingly, utilities of GAM1032 include diagnosis, prevention and treatment of diseases and clinical conditions associated with LOC200230.

LOC201292 (Accession NP_775818.1) is another GAM1032 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:8558, to the nucleotide sequence of GAM1032 RNA, herein designated GAM RNA, also designated SEQ ID:303.

Another function of GAM1032 is therefore inhibition of LOC201292 (Accession NP_775818.1). Accordingly, utilities of GAM1032 include diagnosis, prevention and treatment of diseases and clinical conditions associated with LOC201292.

LOC201868 (Accession XP_114393.1) is another GAM1032 target gene, herein designated TARGET GENE. LOC201868 BINDING SITE1 and LOC201868 BINDING SITE2 are target binding sites found in untranslated regions of mRNA encoded by LOC201868, corresponding to target binding sites such as BINDING SITE I, BINDING SITE II or BINDING SITE III of FIG. 8. Table 4 illustrates the complementarity of the nucleotide sequences of LOC201868 BINDING SITE1 and LOC201868 BINDING SITE2, designated SEQ ID:5434 and SEQ ID:13599 respectively, to the nucleotide sequence of GAM1032 RNA, herein designated GAM RNA, also designated SEQ ID:303.

Another function of GAM1032 is therefore inhibition of LOC201868 (Accession XP_114393.1). Accordingly, utilities of GAM1032 include diagnosis, prevention and treatment of diseases and clinical conditions associated with LOC201868.

LOC221922 (Accession XP_166555.2) is another GAM1032 target gene, herein designated TARGET GENE. LOC221922 BINDING SITE is a target binding site found in the 3' untranslated region of mRNA encoded by LOC221922, corresponding to a target binding site such as BINDING SITE I, BINDING SITE II or BINDING SITE III of FIG. 8. Table 4 illustrates the complementarity of the nucleotide sequences of LOC221922 BINDING SITE, designated SEQ ID:15583, to the nucleotide sequence of GAM1032 RNA, herein designated GAM RNA, also designated SEQ ID:303.

Another function of GAM1032 is therefore inhibition of LOC221922 (Accession XP_166555.2). Accordingly, utilities of GAM1032 include diagnosis, prevention and treatment of diseases and clinical conditions associated with LOC221922.

LOC253805 (Accession XP_172854.1) is another GAM1032 target gene, herein designated TARGET GENE. LOC253805 BINDING SITE is a target binding site found in the 3' untranslated region of mRNA encoded by LOC253805, corresponding to a target binding site such as BINDING SITE I, BINDING SITE II or BINDING SITE III of FIG. 8. Table 4 illustrates the complementarity of the nucleotide sequences of LOC253805 BINDING SITE, designated SEQ ID:4330, to the nucleotide sequence of GAM1032 RNA, herein designated GAM RNA, also designated SEQ ID:303.

Another function of GAM1032 is therefore inhibition of LOC253805 (Accession XP_172854.1). Accordingly, utilities of GAM1032 include diagnosis, prevention and treatment of diseases and clinical conditions associated with LOC253805.

LOC283442 (Accession XP_211037.1) is another GAM1032 target gene, herein designated TARGET GENE. LOC283442 BINDING SITE is a target binding site found in the 5' untranslated region of mRNA encoded by LOC283442, corresponding to a target binding site such as BINDING SITE I, BINDING SITE II or BINDING SITE III of FIG. 8. Table 4 illustrates the complementarity of the nucleotide sequences of LOC283442 BINDING SITE, designated SEQ ID:5721, to the nucleotide sequence of GAM1032 RNA, herein designated GAM RNA, also designated SEQ ID:303.

Another function of GAM1032 is therefore inhibition of LOC283442 (Accession XP_211037.1). Accordingly, utilities of GAM1032 include diagnosis, prevention and treatment of diseases and clinical conditions associated with LOC283442.

LOC283624 (Accession XP_211126.1) is another GAM1032 target gene, herein designated TARGET GENE. LOC283624 BINDING SITE is a target binding site found in the 5' untranslated region of mRNA encoded by LOC283624, corresponding to a target binding site such as BINDING SITE I, BINDING SITE II or BINDING SITE III of FIG. 8. Table 4 illustrates the complementarity of the nucleotide sequences of LOC283624 BINDING SITE, designated SEQ ID:953, to the nucleotide sequence of GAM1032 RNA, herein designated GAM RNA, also designated SEQ ID:303.

Another function of GAM1032 is therefore inhibition of LOC283624 (Accession XP_211126.1). Accordingly, utilities of GAM1032 include diagnosis, prevention and treatment of diseases and clinical conditions associated with LOC283624.

LOC283741 (Accession XP_208115.1) is another GAM1032 target gene, herein designated TARGET GENE. LOC283741 BINDING SITE is a target binding site found in the 3' untranslated region of mRNA encoded by LOC283741, corresponding to a target binding site such as BINDING SITE I, BINDING SITE II or BINDING SITE III of FIG. 8. Table 4 illustrates the complementarity of the nucleotide sequences of LOC283741 BINDING SITE, designated SEQ ID:12978, to the nucleotide sequence of GAM1032 RNA, herein designated GAM RNA, also designated SEQ ID:303.

Another function of GAM1032 is therefore inhibition of LOC283741 (Accession XP_208115.1). Accordingly, utilities of GAM1032 include diagnosis, prevention and treatment of diseases and clinical conditions associated with LOC283741.

LOC283753 (Accession XP_208821.1) is another GAM1032 target gene, herein designated TARGET GENE. LOC283753 BINDING SITE is a target binding site found in the 5' untranslated region of mRNA encoded by LOC283753, corresponding to a target binding site such as BINDING SITE I, BINDING SITE II or BINDING SITE III of FIG. 8. Table 4 illustrates the complementarity of the nucleotide sequences of LOC283753 BINDING SITE, designated SEQ ID:8981, to the nucleotide sequence of GAM1032 RNA, herein designated GAM RNA, also designated SEQ ID:303.

Another function of GAM1032 is therefore inhibition of LOC283753 (Accession XP_208821.1). Accordingly, utilities of GAM1032 include diagnosis, prevention and treatment of diseases and clinical conditions associated with LOC283753.

LOC283801 (Accession XP_208122.1) is another GAM1032 target gene, herein designated TARGET GENE. LOC283801 BINDING SITE is a target binding site found in the 5' untranslated region of mRNA encoded by LOC283801, corresponding to a target binding site such as BINDING SITE I, BINDING SITE II or BINDING SITE III of FIG. 8. Table 4 illustrates the complementarity of the nucleotide sequences of LOC283801 BINDING SITE, designated SEQ ID:15824, to the nucleotide sequence of GAM1032 RNA, herein designated GAM RNA, also designated SEQ ID:303.

Another function of GAM1032 is therefore inhibition of LOC283801 (Accession XP_208122.1). Accordingly, utilities of GAM1032 include diagnosis, prevention and treatment of diseases and clinical conditions associated with LOC283801.

LOC284173 (Accession XP_211362.1) is another GAM1032 target gene, herein designated TARGET GENE. LOC284173 BINDING SITE is a target binding site found in the 3' untranslated region of mRNA encoded by LOC284173, corresponding to a target binding site such as BINDING SITE I, BINDING SITE II or BINDING SITE III of FIG. 8. Table 4 illustrates the complementarity of the nucleotide sequences of LOC284173 BINDING SITE, designated SEQ ID:19059, to the nucleotide sequence of GAM1032 RNA, herein designated GAM RNA, also designated SEQ ID:303.

Another function of GAM1032 is therefore inhibition of LOC284173 (Accession XP_211362.1). Accordingly, utilities of GAM1032 include diagnosis, prevention and treatment of diseases and clinical conditions associated with LOC284173.

LOC284196 (Accession XP_209067.1) is another GAM1032 target gene, herein designated TARGET GENE. LOC284196 BINDING SITE is a target binding site found in the 3' untranslated region of mRNA encoded by LOC284196, corresponding to a target binding site such as BINDING SITE I, BINDING SITE II or BINDING SITE III of FIG. 8. Table 4 illustrates the complementarity of the nucleotide sequences of LOC284196 BINDING SITE, designated SEQ ID:15363, to the nucleotide sequence of GAM1032 RNA, herein designated GAM RNA, also designated SEQ ID:303.

Another function of GAM1032 is therefore inhibition of LOC284196 (Accession XP_209067.1). Accordingly, utilities of GAM1032 include diagnosis, prevention and treatment of diseases and clinical conditions associated with LOC284196.

LOC284266 (Accession XP_211403.1) is another GAM1032 target gene, herein designated TARGET GENE. LOC284266 BINDING SITE is a target binding site found in the 5' untranslated region of mRNA encoded by LOC284266, corresponding to a target binding site such as BINDING SITE I, BINDING SITE II or BINDING SITE III of FIG. 8. Table 4 illustrates the complementarity of the nucleotide sequences of LOC284266 BINDING SITE, designated SEQ ID:17603, to the nucleotide sequence of GAM1032 RNA, herein designated GAM RNA, also designated SEQ ID:303.

Another function of GAM1032 is therefore inhibition of LOC284266 (Accession XP_211403.1). Accordingly, utilities of GAM1032 include diagnosis, prevention and treatment of diseases and clinical conditions associated with LOC284266.

LOC284280 (Accession XP_211416.1) is another GAM1032 target gene, herein designated TARGET GENE. LOC284280 BINDING SITE is a target binding site found in the 3' untranslated region of mRNA encoded by LOC284280, corresponding to a target binding site such as BINDING SITE I, BINDING SITE II or BINDING SITE III of FIG. 8. Table 4 illustrates the complementarity of the nucleotide sequences of LOC284280 BINDING SITE, designated SEQ ID:6856, to the nucleotide sequence of GAM1032 RNA, herein designated GAM RNA, also designated SEQ ID:303.

Another function of GAM1032 is therefore inhibition of LOC284280 (Accession XP_211416.1). Accordingly, utilities of GAM1032 include diagnosis, prevention and treatment of diseases and clinical conditions associated with LOC284280.

LOC284542 (Accession XP_209254.1) is another GAM1032 target gene, herein designated TARGET GENE. LOC284542 BINDING SITE is a target binding site found in the 5' untranslated region of mRNA encoded by LOC284542, corresponding to a target binding site such as BINDING SITE I, BINDING SITE II or BINDING SITE III of FIG. 8. Table 4 illustrates the complementarity of the nucleotide sequences of LOC284542 BINDING SITE, designated SEQ ID:843, to the nucleotide sequence of GAM1032 RNA, herein designated GAM RNA, also designated SEQ ID:303.

Another function of GAM1032 is therefore inhibition of LOC284542 (Accession XP_209254.1). Accordingly, utilities of GAM1032 include diagnosis, prevention and treatment of diseases and clinical conditions associated with LOC284542.

LOC284595 (Accession XP_209280.3) is another GAM1032 target gene, herein designated TARGET GENE. LOC284595 BINDING SITE is a target binding site found in the 3' untranslated region of mRNA encoded by LOC284595, corresponding to a target binding site such as BINDING SITE I, BINDING SITE II or BINDING SITE III of FIG. 8. Table 4 illustrates the complementarity of the nucleotide sequences of LOC284595 BINDING SITE, designated SEQ ID:8588, to the nucleotide sequence of GAM1032 RNA, herein designated GAM RNA, also designated SEQ ID:303.

Another function of GAM1032 is therefore inhibition of LOC284595 (Accession XP_209280.3). Accordingly, utilities of GAM1032 include diagnosis, prevention and treatment of diseases and clinical conditions associated with LOC284595.

LOC284751 (Accession XP_211622.1) is another GAM1032 target gene, herein designated TARGET GENE. LOC284751 BINDING SITE is a target binding site found in the 3' untranslated region of mRNA encoded by LOC284751, corresponding to a target binding site such as BINDING SITE I, BINDING SITE II or BINDING SITE III of FIG. 8. Table 4 illustrates the complementarity of the nucleotide sequences of LOC284751 BINDING SITE, designated SEQ ID:10782, to the nucleotide sequence of GAM1032 RNA, herein designated GAM RNA, also designated SEQ ID:303.

Another function of GAM1032 is therefore inhibition of LOC284751 (Accession XP_211622.1). Accordingly, utilities of GAM1032 include diagnosis, prevention and treatment of diseases and clinical conditions associated with LOC284751.

LOC284829 (Accession XP_211645.1) is another GAM1032 target gene, herein designated TARGET GENE. LOC284829 BINDING SITE is a target binding site found in the 3' untranslated region of mRNA encoded by LOC284829, corresponding to a target binding site such as BINDING SITE I, BINDING SITE II or BINDING SITE III of FIG. 8. Table 4 illustrates the complementarity of the nucleotide sequences of LOC284829 BINDING SITE, designated SEQ ID:12531, to the nucleotide sequence of GAM1032 RNA, herein designated GAM RNA, also designated SEQ ID:303.

Another function of GAM1032 is therefore inhibition of LOC284829 (Accession XP_211645.1). Accordingly, utilities of GAM1032 include diagnosis, prevention and treatment of diseases and clinical conditions associated with LOC284829.

LOC284865 (Accession XP_211672.1) is another GAM1032 target gene, herein designated TARGET GENE. LOC284865 BINDING SITE is a target binding site found in the 3' untranslated region of mRNA encoded by LOC284865, corresponding to a target binding site such as BINDING SITE I, BINDING SITE II or BINDING SITE III of FIG. 8. Table 4 illustrates the complementarity of the nucleotide sequences of LOC284865 BINDING SITE, designated SEQ ID:7677, to the nucleotide sequence of GAM1032 RNA, herein designated GAM RNA, also designated SEQ ID:303.

Another function of GAM1032 is therefore inhibition of LOC284865 (Accession XP_211672.1). Accordingly, utilities of GAM1032 include diagnosis, prevention and treatment of diseases and clinical conditions associated with LOC284865.

LOC284965 (Accession XP_209425.1) is another GAM1032 target gene, herein designated TARGET GENE. LOC284965 BINDING SITE is a target binding site found in the 3' untranslated region of mRNA encoded by LOC284965, corresponding to a target binding site such as BINDING SITE I, BINDING SITE II or BINDING SITE III of FIG. 8. Table 4 illustrates the complementarity of the nucleotide sequences of LOC284965 BINDING SITE, designated SEQ ID:8588, to the nucleotide sequence of GAM1032 RNA, herein designated GAM RNA, also designated SEQ ID:303.

Another function of GAM1032 is therefore inhibition of LOC284965 (Accession XP_209425.1). Accordingly, utilities of GAM1032 include diagnosis, prevention and treatment of diseases and clinical conditions associated with LOC284965.

LOC284975 (Accession XP_211711.1) is another GAM1032 target gene, herein designated TARGET GENE. LOC284975 BINDING SITE is a target binding site found in the 3' untranslated region of mRNA encoded by LOC284975, corresponding to a target binding site such as BINDING SITE I, BINDING SITE II or BINDING SITE III of FIG. 8. Table 4 illustrates the complementarity of the nucleotide sequences of LOC284975 BINDING SITE, designated SEQ ID:7383, to the nucleotide sequence of GAM1032 RNA, herein designated GAM RNA, also designated SEQ ID:303.

Another function of GAM1032 is therefore inhibition of LOC284975 (Accession XP_211711.1). Accordingly, utilities of GAM1032 include diagnosis, prevention and treatment of diseases and clinical conditions associated with LOC284975.

LOC285123 (Accession XP_211773.1) is another GAM1032 target gene, herein designated TARGET GENE. LOC285123 BINDING SITE is a target binding site found in the 3' untranslated region of mRNA encoded by LOC285123, corresponding to a target binding site such as BINDING SITE I, BINDING SITE II or BINDING SITE III of FIG. 8. Table 4 illustrates the complementarity of the nucleotide sequences of LOC285123 BINDING SITE, designated SEQ ID:5205, to the nucleotide sequence of GAM1032 RNA, herein designated GAM RNA, also designated SEQ ID:303.

Another function of GAM1032 is therefore inhibition of LOC285123 (Accession XP_211773.1). Accordingly, utilities of GAM1032 include diagnosis, prevention and treatment of diseases and clinical conditions associated with LOC285123.

LOC285409 (Accession XP_209600.1) is another GAM1032 target gene, herein designated TARGET GENE. LOC285409 BINDING SITE is a target binding site found in the 3' untranslated region of mRNA encoded by LOC285409, corresponding to a target binding site such as BINDING SITE I, BINDING SITE II or BINDING SITE III of FIG. 8. Table 4 illustrates the complementarity of the nucleotide sequences of LOC285409 BINDING SITE, designated SEQ ID:5936, to the nucleotide sequence of GAM1032 RNA, herein designated GAM RNA, also designated SEQ ID:303.

Another function of GAM1032 is therefore inhibition of LOC285409 (Accession XP_209600.1). Accordingly, utilities of GAM1032 include diagnosis, prevention and treatment of diseases and clinical conditions associated with LOC285409.

LOC285442 (Accession XP_208320.1) is another GAM1032 target gene, herein designated TARGET GENE. LOC285442 BINDING SITE is a target binding site found in the 3' untranslated region of mRNA encoded by LOC285442, corresponding to a target binding site such as BINDING SITE I, BINDING SITE II or BINDING SITE III of FIG. 8. Table 4 illustrates the complementarity of the nucleotide sequences of LOC285442 BINDING SITE, designated SEQ ID:16068, to the nucleotide sequence of GAM1032 RNA, herein designated GAM RNA, also designated SEQ ID:303.

Another function of GAM1032 is therefore inhibition of LOC285442 (Accession XP_208320.1). Accordingly, utilities of GAM1032 include diagnosis, prevention and treatment of diseases and clinical conditions associated with LOC285442.

LOC285692 (Accession XP_211984.1) is another GAM1032 target gene, herein designated TARGET GENE. LOC285692 BINDING SITE is a target binding site found in the 3' untranslated region of mRNA encoded by LOC285692, corresponding to a target binding site such as BINDING SITE I, BINDING SITE II or BINDING SITE III of FIG. 8. Table 4 illustrates the complementarity of the nucleotide sequences of LOC285692 BINDING SITE, designated SEQ ID:4966, to the nucleotide sequence of GAM1032 RNA, herein designated GAM RNA, also designated SEQ ID:303.

Another function of GAM1032 is therefore inhibition of LOC285692 (Accession XP_211984.1). Accordingly, utilities of GAM1032 include diagnosis, prevention and treatment of diseases and clinical conditions associated with LOC285692.

LOC285735 (Accession XP_212002.1) is another GAM1032 target gene, herein designated TARGET GENE. LOC285735 BINDING SITE is a target binding site found in the 5' untranslated region of mRNA encoded by LOC285735, corresponding to a target binding site such as BINDING SITE I, BINDING SITE II or BINDING SITE III of FIG. 8. Table 4 illustrates the complementarity of the nucleotide sequences of LOC285735 BINDING SITE, designated SEQ ID:4051, to the nucleotide sequence of GAM1032 RNA, herein designated GAM RNA, also designated SEQ ID:303.

Another function of GAM1032 is therefore inhibition of LOC285735 (Accession XP_212002.1). Accordingly, utilities of GAM1032 include diagnosis, prevention and treatment of diseases and clinical conditions associated with LOC285735.

LOC285819 (Accession XP_212053.1) is another GAM1032 target gene, herein designated TARGET GENE.

LOC285819 BINDING SITE is a target binding site found in the 3' untranslated region of mRNA encoded by LOC285819, corresponding to a target binding site such as BINDING SITE I, BINDING SITE II or BINDING SITE III of FIG. 8. Table 4 illustrates the complementarity of the nucleotide sequences of LOC285819 BINDING SITE, designated SEQ ID:16977, to the nucleotide sequence of GAM1032 RNA, herein designated GAM RNA, also designated SEQ ID:303.

Another function of GAM1032 is therefore inhibition of LOC285819 (Accession XP_212053.1). Accordingly, utilities of GAM1032 include diagnosis, prevention and treatment of diseases and clinical conditions associated with LOC285819.

LOC285936 (Accession XP_209834.2) is another GAM1032 target gene, herein designated TARGET GENE. LOC285936 BINDING SITE is a target binding site found in the 5' untranslated region of mRNA encoded by LOC285936, corresponding to a target binding site such as BINDING SITE I, BINDING SITE II or BINDING SITE III of FIG. 8. Table 4 illustrates the complementarity of the nucleotide sequences of LOC285936 BINDING SITE, designated SEQ ID:3314, to the nucleotide sequence of GAM1032 RNA, herein designated GAM RNA, also designated SEQ ID:303.

Another function of GAM1032 is therefore inhibition of LOC285936 (Accession XP_209834.2). Accordingly, utilities of GAM1032 include diagnosis, prevention and treatment of diseases and clinical conditions associated with LOC285936.

LOC286101 (Accession XP_209902.1) is another GAM1032 target gene, herein designated TARGET GENE. LOC286101 BINDING SITE is a target binding site found in the 3' untranslated region of mRNA encoded by LOC286101, corresponding to a target binding site such as BINDING SITE I, BINDING SITE II or BINDING SITE III of FIG. 8. Table 4 illustrates the complementarity of the nucleotide sequences of LOC286101 BINDING SITE, designated SEQ ID:7174, to the nucleotide sequence of GAM1032 RNA, herein designated GAM RNA, also designated SEQ ID:303.

Another function of GAM1032 is therefore inhibition of LOC286101 (Accession XP_209902.1). Accordingly, utilities of GAM1032 include diagnosis, prevention and treatment of diseases and clinical conditions associated with LOC286101.

LOC286135 (Accession XP_212196.1) is another GAM1032 target gene, herein designated TARGET GENE. LOC286135 BINDING SITE is a target binding site found in the 5' untranslated region of mRNA encoded by LOC286135, corresponding to a target binding site such as BINDING SITE I, BINDING SITE II or BINDING SITE III of FIG. 8. Table 4 illustrates the complementarity of the nucleotide sequences of LOC286135 BINDING SITE, designated SEQ ID:5795, to the nucleotide sequence of GAM1032 RNA, herein designated GAM RNA, also designated SEQ ID:303.

Another function of GAM1032 is therefore inhibition of LOC286135 (Accession XP_212196.1). Accordingly, utilities of GAM1032 include diagnosis, prevention and treatment of diseases and clinical conditions associated with LOC286135.

LOC286221 (Accession XP_212233.1) is another GAM1032 target gene, herein designated TARGET GENE. LOC286221 BINDING SITE is a target binding site found in the 5' untranslated region of mRNA encoded by LOC286221, corresponding to a target binding site such as BINDING SITE I, BINDING SITE II or BINDING SITE III of FIG. 8. Table 4 illustrates the complementarity of the nucleotide sequences of LOC286221 BINDING SITE, designated SEQ ID:5769, to the nucleotide sequence of GAM1032 RNA, herein designated GAM RNA, also designated SEQ ID:303.

Another function of GAM1032 is therefore inhibition of LOC286221 (Accession XP_212233.1). Accordingly, utilities of GAM1032 include diagnosis, prevention and treatment of diseases and clinical conditions associated with LOC286221.

LOC286374 (Accession XP_212293.1) is another GAM1032 target gene, herein designated TARGET GENE. LOC286374 BINDING SITE is a target binding site found in the 5' untranslated region of mRNA encoded by LOC286374, corresponding to a target binding site such as BINDING SITE I, BINDING SITE II or BINDING SITE III of FIG. 8. Table 4 illustrates the complementarity of the nucleotide sequences of LOC286374 BINDING SITE, designated SEQ ID:14940, to the nucleotide sequence of GAM1032 RNA, herein designated GAM RNA, also designated SEQ ID:303.

Another function of GAM1032 is therefore inhibition of LOC286374 (Accession XP_212293.1). Accordingly, utilities of GAM1032 include diagnosis, prevention and treatment of diseases and clinical conditions associated with LOC286374.

LOC286545 (Accession XP_208450.1) is another GAM1032 target gene, herein designated TARGET GENE. LOC286545 BINDING SITE is a target binding site found in the 5' untranslated region of mRNA encoded by LOC286545, corresponding to a target binding site such as BINDING SITE I, BINDING SITE II or BINDING SITE III of FIG. 8. Table 4 illustrates the complementarity of the nucleotide sequences of LOC286545 BINDING SITE, designated SEQ ID:2448, to the nucleotide sequence of GAM1032 RNA, herein designated GAM RNA, also designated SEQ ID:303.

Another function of GAM1032 is therefore inhibition of LOC286545 (Accession XP_208450.1). Accordingly, utilities of GAM1032 include diagnosis, prevention and treatment of diseases and clinical conditions associated with LOC286545.

LOC338609 (Accession XP_294664.1) is another GAM1032 target gene, herein designated TARGET GENE. LOC338609 BINDING SITE is a target binding site found in the 3' untranslated region of mRNA encoded by LOC338609, corresponding to a target binding site such as BINDING SITE I, BINDING SITE II or BINDING SITE III of FIG. 8. Table 4 illustrates the complementarity of the nucleotide sequences of LOC338609 BINDING SITE, designated SEQ ID:15446, to the nucleotide sequence of GAM1032 RNA, herein designated GAM RNA, also designated SEQ ID:303.

Another function of GAM1032 is therefore inhibition of LOC338609 (Accession XP_294664.1). Accordingly, utilities of GAM1032 include diagnosis, prevention and treatment of diseases and clinical conditions associated with LOC338609.

LOC338862 (Accession XP_290601.1) is another GAM1032 target gene, herein designated TARGET GENE. LOC338862 BINDING SITE is a target binding site found in the 3' untranslated region of mRNA encoded by LOC338862, corresponding to a target binding site such as BINDING SITE I, BINDING SITE II or BINDING SITE III of FIG. 8. Table 4 illustrates the complementarity of the nucleotide sequences of LOC338862 BINDING SITE, designated SEQ ID:3752, to the nucleotide sequence of GAM1032 RNA, herein designated GAM RNA, also designated SEQ ID:303.

Another function of GAM1032 is therefore inhibition of LOC338862 (Accession XP_290601.1). Accordingly, utilities of GAM1032 include diagnosis, prevention and treatment of diseases and clinical conditions associated with LOC338862.

LOC339025 (Accession XP_294778.1) is another GAM1032 target gene, herein designated TARGET GENE. LOC339025 BINDING SITE is a target binding site found in the 3' untranslated region of mRNA encoded by LOC339025, corresponding to a target binding site such as BINDING SITE I, BINDING SITE II or BINDING SITE III of FIG. 8. Table 4 illustrates the complementarity of the nucleotide sequences of LOC339025 BINDING SITE, designated SEQ ID:10038, to the nucleotide sequence of GAM1032 RNA, herein designated GAM RNA, also designated SEQ ID:303.

Another function of GAM1032 is therefore inhibition of LOC339025 (Accession XP_294778.1). Accordingly, utilities of GAM1032 include diagnosis, prevention and treatment of diseases and clinical conditions associated with LOC339025.

LOC339062 (Accession XP_294795.1) is another GAM1032 target gene, herein designated TARGET GENE. LOC339062 BINDING SITE is a target binding site found in the 5' untranslated region of mRNA encoded by LOC339062, corresponding to a target binding site such as BINDING SITE I, BINDING SITE II or BINDING SITE III of FIG. 8. Table 4 illustrates the complementarity of the nucleotide sequences of LOC339062 BINDING SITE, designated SEQ ID:17771, to the nucleotide sequence of GAM1032 RNA, herein designated GAM RNA, also designated SEQ ID:303.

Another function of GAM1032 is therefore inhibition of LOC339062 (Accession XP_294795.1). Accordingly, utilities of GAM1032 include diagnosis, prevention and treatment of diseases and clinical conditions associated with LOC339062.

LOC339502 (Accession XP_294983.1) is another GAM1032 target gene, herein designated TARGET GENE. LOC339502 BINDING SITE is a target binding site found in the 5' untranslated region of mRNA encoded by LOC339502, corresponding to a target binding site such as BINDING SITE I, BINDING SITE II or BINDING SITE III of FIG. 8. Table 4 illustrates the complementarity of the nucleotide sequences of LOC339502 BINDING SITE, designated SEQ ID:20113, to the nucleotide sequence of GAM1032 RNA, herein designated GAM RNA, also designated SEQ ID:303.

Another function of GAM1032 is therefore inhibition of LOC339502 (Accession XP_294983.1). Accordingly, utilities of GAM1032 include diagnosis, prevention and treatment of diseases and clinical conditions associated with LOC339502.

LOC339581 (Accession XP_293116.2) is another GAM1032 target gene, herein designated TARGET GENE. LOC339581 BINDING SITE is a target binding site found in the 5' untranslated region of mRNA encoded by LOC339581, corresponding to a target binding site such as BINDING SITE I, BINDING SITE II or BINDING SITE III of FIG. 8. Table 4 illustrates the complementarity of the nucleotide sequences of LOC339581 BINDING SITE, designated SEQ ID:9113, to the nucleotide sequence of GAM1032 RNA, herein designated GAM RNA, also designated SEQ ID:303.

Another function of GAM1032 is therefore inhibition of LOC339581 (Accession XP_293116.2). Accordingly, utilities of GAM1032 include diagnosis, prevention and treatment of diseases and clinical conditions associated with LOC339581.

LOC339663 (Accession XP_295028.1) is another GAM1032 target gene, herein designated TARGET GENE. LOC339663 BINDING SITE is a target binding site found in the 5' untranslated region of mRNA encoded by LOC339663, corresponding to a target binding site such as BINDING SITE I, BINDING SITE II or BINDING SITE III of FIG. 8. Table 4 illustrates the complementarity of the nucleotide sequences of LOC339663 BINDING SITE, designated SEQ ID:14951, to the nucleotide sequence of GAM1032 RNA, herein designated GAM RNA, also designated SEQ ID:303.

Another function of GAM1032 is therefore inhibition of LOC339663 (Accession XP_295028.1). Accordingly, utilities of GAM1032 include diagnosis, prevention and treatment of diseases and clinical conditions associated with LOC339663.

LOC340064 (Accession XP_295144.1) is another GAM1032 target gene, herein designated TARGET GENE. LOC340064 BINDING SITE is a target binding site found in the 5' untranslated region of mRNA encoded by LOC340064, corresponding to a target binding site such as BINDING SITE I, BINDING SITE II or BINDING SITE III of FIG. 8. Table 4 illustrates the complementarity of the nucleotide sequences of LOC340064 BINDING SITE, designated SEQ ID:3820, to the nucleotide sequence of GAM1032 RNA, herein designated GAM RNA, also designated SEQ ID:303.

Another function of GAM1032 is therefore inhibition of LOC340064 (Accession XP_295144.1). Accordingly, utilities of GAM1032 include diagnosis, prevention and treatment of diseases and clinical conditions associated with LOC340064.

LOC340323 (Accession XP_291236.1) is another GAM1032 target gene, herein designated TARGET GENE. LOC340323 BINDING SITE is a target binding site found in the 3' untranslated region of mRNA encoded by LOC340323, corresponding to a target binding site such as BINDING SITE I, BINDING SITE II or BINDING SITE III of FIG. 8. Table 4 illustrates the complementarity of the nucleotide sequences of LOC340323 BINDING SITE, designated SEQ ID:5378, to the nucleotide sequence of GAM1032 RNA, herein designated GAM RNA, also designated SEQ ID:303.

Another function of GAM1032 is therefore inhibition of LOC340323 (Accession XP_291236.1). Accordingly, utilities of GAM1032 include diagnosis, prevention and treatment of diseases and clinical conditions associated with LOC340323.

LOC340428 (Accession XP_290420.1) is another GAM1032 target gene, herein designated TARGET GENE. LOC340428 BINDING SITE is a target binding site found in the 3' untranslated region of mRNA encoded by LOC340428, corresponding to a target binding site such as BINDING SITE I, BINDING SITE II or BINDING SITE III of FIG. 8. Table 4 illustrates the complementarity of the nucleotide sequences of LOC340428 BINDING SITE, designated SEQ ID:6280, to the nucleotide sequence of GAM1032 RNA, herein designated GAM RNA, also designated SEQ ID:303.

Another function of GAM1032 is therefore inhibition of LOC340428 (Accession XP_290420.1). Accordingly, utilities of GAM1032 include diagnosis, prevention and treatment of diseases and clinical conditions associated with LOC340428.

LOC344360 (Accession XP_297561.1) is another GAM1032 target gene, herein designated TARGET GENE. LOC344360 BINDING SITE is a target binding site found in the 5' untranslated region of mRNA encoded by LOC344360, corresponding to a target binding site such as BINDING SITE I, BINDING SITE II or BINDING SITE III of FIG. 8. Table 4 illustrates the complementarity of the nucleotide sequences of LOC344360 BINDING SITE, designated SEQ ID:15185, to the nucleotide sequence of GAM1032 RNA, herein designated GAM RNA, also designated SEQ ID:303.

Another function of GAM1032 is therefore inhibition of LOC344360 (Accession XP_297561.1). Accordingly, utilities of GAM1032 include diagnosis, prevention and treatment of diseases and clinical conditions associated with LOC344360.

LOC344563 (Accession XP_297716.1) is another GAM1032 target gene, herein designated TARGET GENE. LOC344563 BINDING SITE is a target binding site found in the 5' untranslated region of mRNA encoded by LOC344563, corresponding to a target binding site such as BINDING SITE I, BINDING SITE II or BINDING SITE III of FIG. 8. Table 4 illustrates the complementarity of the nucleotide sequences of LOC344563 BINDING SITE, designated SEQ ID:676, to the nucleotide sequence of GAM1032 RNA, herein designated GAM RNA, also designated SEQ ID:303.

Another function of GAM1032 is therefore inhibition of LOC344563 (Accession XP_297716.1). Accordingly, utilities of GAM1032 include diagnosis, prevention and treatment of diseases and clinical conditions associated with LOC344563.

LOC347240 (Accession XP_294563.2) is another GAM1032 target gene, herein designated TARGET GENE. LOC347240 BINDING SITE is a target binding site found in the 3' untranslated region of mRNA encoded by LOC347240, corresponding to a target binding site such as BINDING SITE I, BINDING SITE II or BINDING SITE III of FIG. 8. Table 4 illustrates the complementarity of the nucleotide sequences of LOC347240 BINDING SITE, designated SEQ ID:17210, to the nucleotide sequence of GAM1032 RNA, herein designated GAM RNA, also designated SEQ ID:303.

Another function of GAM1032 is therefore inhibition of LOC347240 (Accession XP_294563.2). Accordingly, utilities of GAM1032 include diagnosis, prevention and treatment of diseases and clinical conditions associated with LOC347240.

LOC347853 (Accession XP_300546.1) is another GAM1032 target gene, herein designated TARGET GENE. LOC347853 BINDING SITE is a target binding site found in the 3' untranslated region of mRNA encoded by LOC347853, corresponding to a target binding site such as BINDING SITE I, BINDING SITE II or BINDING SITE III of FIG. 8. Table 4 illustrates the complementarity of the nucleotide sequences of LOC347853 BINDING SITE, designated SEQ ID:8070, to the nucleotide sequence of GAM1032 RNA, herein designated GAM RNA, also designated SEQ ID:303.

Another function of GAM1032 is therefore inhibition of LOC347853 (Accession XP_300546.1). Accordingly, utilities of GAM1032 include diagnosis, prevention and treatment of diseases and clinical conditions associated with LOC347853.

LOC347905 (Accession XP_302624.1) is another GAM1032 target gene, herein designated TARGET GENE. LOC347905 BINDING SITE is a target binding site found in the 5' untranslated region of mRNA encoded by LOC347905, corresponding to a target binding site such as BINDING SITE I, BINDING SITE II or BINDING SITE III of FIG. 8. Table 4 illustrates the complementarity of the nucleotide sequences of LOC347905 BINDING SITE, designated SEQ ID:2888, to the nucleotide sequence of GAM1032 RNA, herein designated GAM RNA, also designated SEQ ID:303.

Another function of GAM1032 is therefore inhibition of LOC347905 (Accession XP_302624.1). Accordingly, utilities of GAM1032 include diagnosis, prevention and treatment of diseases and clinical conditions associated with LOC347905.

LOC347921 (Accession XP_300275.1) is another GAM1032 target gene, herein designated TARGET GENE. LOC347921 BINDING SITE is a target binding site found in the 5' untranslated region of mRNA encoded by LOC347921, corresponding to a target binding site such as BINDING SITE I, BINDING SITE II or BINDING SITE III of FIG. 8. Table 4 illustrates the complementarity of the nucleotide sequences of LOC347921 BINDING SITE, designated SEQ ID:10678, to the nucleotide sequence of GAM1032 RNA, herein designated GAM RNA, also designated SEQ ID:303.

Another function of GAM1032 is therefore inhibition of LOC347921 (Accession XP_300275.1). Accordingly, utilities of GAM1032 include diagnosis, prevention and treatment of diseases and clinical conditions associated with LOC347921.

LOC348378 (Accession XP_300723.1) is another GAM1032 target gene, herein designated TARGET GENE. LOC348378 BINDING SITE1 and LOC348378 BINDING SITE2 are target binding sites found in untranslated regions of mRNA encoded by LOC348378, corresponding to target binding sites such as BINDING SITE I, BINDING SITE II or BINDING SITE III of FIG. 8. Table 4 illustrates the complementarity of the nucleotide sequences of LOC348378 BINDING SITE1 and LOC348378 BINDING SITE2, designated SEQ ID:10330 and SEQ ID:6570 respectively, to the nucleotide sequence of GAM1032 RNA, herein designated GAM RNA, also designated SEQ ID:303.

Another function of GAM1032 is therefore inhibition of LOC348378 (Accession XP_300723.1). Accordingly, utilities of GAM1032 include diagnosis, prevention and treatment of diseases and clinical conditions associated with LOC348378.

LOC348454 (Accession XP_290909.1) is another GAM1032 target gene, herein designated TARGET GENE. LOC348454 BINDING SITE is a target binding site found in the 3' untranslated region of mRNA encoded by LOC348454, corresponding to a target binding site such as BINDING SITE I, BINDING SITE II or BINDING SITE III of FIG. 8. Table 4 illustrates the complementarity of the nucleotide sequences of LOC348454 BINDING SITE, designated SEQ ID:14041, to the nucleotide sequence of GAM1032 RNA, herein designated GAM RNA, also designated SEQ ID:303.

Another function of GAM1032 is therefore inhibition of LOC348454 (Accession XP_290909.1). Accordingly, utilities of GAM1032 include diagnosis, prevention and treatment of diseases and clinical conditions associated with LOC348454.

LOC348504 (Accession XP_300769.1) is another GAM1032 target gene, herein designated TARGET GENE. LOC348504 BINDING SITE is a target binding site found in the 5' untranslated region of mRNA encoded by LOC348504, corresponding to a target binding site such as BINDING SITE I, BINDING SITE II or BINDING SITE III of FIG. 8. Table 4 illustrates the complementarity of the nucleotide sequences of LOC348504 BINDING SITE, designated SEQ ID:5434, to the nucleotide sequence of GAM1032 RNA, herein designated GAM RNA, also designated SEQ ID:303.

Another function of GAM1032 is therefore inhibition of LOC348504 (Accession XP_300769.1). Accordingly, utilities of GAM1032 include diagnosis, prevention and treatment of diseases and clinical conditions associated with LOC348504.

LOC348529 (Accession XP_302813.1) is another GAM1032 target gene, herein designated TARGET GENE. LOC348529 BINDING SITE is a target binding site found in the 5' untranslated region of mRNA encoded by LOC348529, corresponding to a target binding site such as BINDING SITE I, BINDING SITE II or BINDING SITE III of FIG. 8. Table 4 illustrates the complementarity of the nucleotide sequences of LOC348529 BINDING SITE, designated SEQ ID:3393, to the nucleotide sequence of GAM1032 RNA, herein designated GAM RNA, also designated SEQ ID:303.

Another function of GAM1032 is therefore inhibition of LOC348529 (Accession XP_302813.1). Accordingly, utilities of GAM1032 include diagnosis, prevention and treatment of diseases and clinical conditions associated with LOC348529.

LOC348701 (Accession XP_300810.1) is another GAM1032 target gene, herein designated TARGET GENE. LOC348701 BINDING SITE is a target binding site found in the 3' untranslated region of mRNA encoded by LOC348701, corresponding to a target binding site such as BINDING SITE I, BINDING SITE II or BINDING SITE III of FIG. 8. Table 4 illustrates the complementarity of the nucleotide sequences of LOC348701 BINDING SITE, designated SEQ ID:5909, to the nucleotide sequence of GAM1032 RNA, herein designated GAM RNA, also designated SEQ ID:303.

Another function of GAM1032 is therefore inhibition of LOC348701 (Accession XP_300810.1). Accordingly, utilities of GAM1032 include diagnosis, prevention and treatment of diseases and clinical conditions associated with LOC348701.

LOC348704 (Accession XP_302859.1) is another GAM1032 target gene, herein designated TARGET GENE. LOC348704 BINDING SITE is a target binding site found in the 3' untranslated region of mRNA encoded by LOC348704, corresponding to a target binding site such as BINDING SITE I, BINDING SITE II or BINDING SITE III of FIG. 8. Table 4 illustrates the complementarity of the nucleotide sequences of LOC348704 BINDING SITE, designated SEQ ID:1119, to the nucleotide sequence of GAM1032 RNA, herein designated GAM RNA, also designated SEQ ID:303.

Another function of GAM1032 is therefore inhibition of LOC348704 (Accession XP_302859.1). Accordingly, utilities of GAM1032 include diagnosis, prevention and treatment of diseases and clinical conditions associated with LOC348704.

LOC348843 (Accession XP_302903.1) is another GAM1032 target gene, herein designated TARGET GENE. LOC348843 BINDING SITE is a target binding site found in the 3' untranslated region of mRNA encoded by LOC348843, corresponding to a target binding site such as BINDING SITE I, BINDING SITE II or BINDING SITE III of FIG. 8. Table 4 illustrates the complementarity of the nucleotide sequences of LOC348843 BINDING SITE, designated SEQ ID:13599, to the nucleotide sequence of GAM1032 RNA, herein designated GAM RNA, also designated SEQ ID:303.

Another function of GAM1032 is therefore inhibition of LOC348843 (Accession XP_302903.1). Accordingly, utilities of GAM1032 include diagnosis, prevention and treatment of diseases and clinical conditions associated with LOC348843.

LOC348929 (Accession XP_300881.1) is another GAM1032 target gene, herein designated TARGET GENE. LOC348929 BINDING SITE is a target binding site found in the 3' untranslated region of mRNA encoded by LOC348929, corresponding to a target binding site such as BINDING SITE I, BINDING SITE II or BINDING SITE III of FIG. 8. Table 4 illustrates the complementarity of the nucleotide sequences of LOC348929 BINDING SITE, designated SEQ ID:3253, to the nucleotide sequence of GAM1032 RNA, herein designated GAM RNA, also designated SEQ ID:303.

Another function of GAM1032 is therefore inhibition of LOC348929 (Accession XP_300881.1). Accordingly, utilities of GAM1032 include diagnosis, prevention and treatment of diseases and clinical conditions associated with LOC348929.

LOC349098 (Accession XP_300943.1) is another GAM1032 target gene, herein designated TARGET GENE. LOC349098 BINDING SITE is a target binding site found in the 3' untranslated region of mRNA encoded by LOC349098, corresponding to a target binding site such as BINDING SITE I, BINDING SITE II or BINDING SITE III of FIG. 8. Table 4 illustrates the complementarity of the nucleotide sequences of LOC349098 BINDING SITE, designated SEQ ID:5378, to the nucleotide sequence of GAM1032 RNA, herein designated GAM RNA, also designated SEQ ID:303.

Another function of GAM1032 is therefore inhibition of LOC349098 (Accession XP_300943.1). Accordingly, utilities of GAM1032 include diagnosis, prevention and treatment of diseases and clinical conditions associated with LOC349098.

LOC349303 (Accession XP_301018.1) is another GAM1032 target gene, herein designated TARGET GENE. LOC349303 BINDING SITE is a target binding site found in the 3' untranslated region of mRNA encoded by LOC349303, corresponding to a target binding site such as BINDING SITE I, BINDING SITE II or BINDING SITE III of FIG. 8. Table 4 illustrates the complementarity of the nucleotide sequences of LOC349303 BINDING SITE, designated SEQ ID:9235, to the nucleotide sequence of GAM1032 RNA, herein designated GAM RNA, also designated SEQ ID:303.

Another function of GAM1032 is therefore inhibition of LOC349303 (Accession XP_301018.1). Accordingly, utilities of GAM1032 include diagnosis, prevention and treatment of diseases and clinical conditions associated with LOC349303.

LOC349315 (Accession XP_301025.1) is another GAM1032 target gene, herein designated TARGET GENE. LOC349315 BINDING SITE is a target binding site found in the 3' untranslated region of mRNA encoded by LOC349315, corresponding to a target binding site such as BINDING SITE I, BINDING SITE II or BINDING SITE III of FIG. 8. Table 4 illustrates the complementarity of the nucleotide sequences of LOC349315 BINDING SITE, designated SEQ ID:9235, to the nucleotide sequence of GAM1032 RNA, herein designated GAM RNA, also designated SEQ ID:303.

Another function of GAM1032 is therefore inhibition of LOC349315 (Accession XP_301025.1). Accordingly, utilities of GAM1032 include diagnosis, prevention and treatment of diseases and clinical conditions associated with LOC349315.

LOC349317 (Accession XP_301026.1) is another GAM1032 target gene, herein designated TARGET GENE. LOC349317 BINDING SITE is a target binding site found in the 3' untranslated region of mRNA encoded by LOC349317, corresponding to a target binding site such as BINDING SITE I, BINDING SITE II or BINDING SITE III of FIG. 8. Table 4 illustrates the complementarity of the nucleotide sequences of LOC349317 BINDING SITE, designated SEQ ID:15717, to the nucleotide sequence of GAM1032 RNA, herein designated GAM RNA, also designated SEQ ID:303.

Another function of GAM1032 is therefore inhibition of LOC349317 (Accession XP_301026.1). Accordingly, utilities of GAM1032 include diagnosis, prevention and treatment of diseases and clinical conditions associated with LOC349317.

LOC349333 (Accession XP_301035.1) is another GAM1032 target gene, herein designated TARGET GENE. LOC349333 BINDING SITE is a target binding site found in the 3' untranslated region of mRNA encoded by LOC349333, corresponding to a target binding site such as BINDING SITE I, BINDING SITE II or BINDING SITE III of FIG. 8. Table 4 illustrates the complementarity of the nucleotide sequences of LOC349333 BINDING SITE, designated SEQ ID:15717, to the nucleotide sequence of GAM1032 RNA, herein designated GAM RNA, also designated SEQ ID:303.

Another function of GAM1032 is therefore inhibition of LOC349333 (Accession XP_301035.1). Accordingly, utilities of GAM1032 include diagnosis, prevention and treatment of diseases and clinical conditions associated with LOC349333.

LOC349338 (Accession XP_301040.1) is another GAM1032 target gene, herein designated TARGET GENE. LOC349338 BINDING SITE is a target binding site found in the 3' untranslated region of mRNA encoded by LOC349338, corresponding to a target binding site such as BINDING SITE I, BINDING SITE II or BINDING SITE III of FIG. 8. Table 4 illustrates the complementarity of the nucleotide sequences of LOC349338 BINDING SITE, designated SEQ ID:8588, to the nucleotide sequence of GAM1032 RNA, herein designated GAM RNA, also designated SEQ ID:303.

Another function of GAM1032 is therefore inhibition of LOC349338 (Accession XP_301040.1). Accordingly, utilities of GAM1032 include diagnosis, prevention and treatment of diseases and clinical conditions associated with LOC349338.

LOC350448 (Accession XP_304096.1) is another GAM1032 target gene, herein designated TARGET GENE. LOC350448 BINDING SITE is a target binding site found in the 5' untranslated region of mRNA encoded by LOC350448, corresponding to a target binding site such as BINDING SITE I, BINDING SITE II or BINDING SITE III of FIG. 8. Table 4 illustrates the complementarity of the nucleotide sequences of LOC350448 BINDING SITE, designated SEQ ID:10058, to the nucleotide sequence of GAM1032 RNA, herein designated GAM RNA, also designated SEQ ID:303.

Another function of GAM1032 is therefore inhibition of LOC350448 (Accession XP_304096.1). Accordingly, utilities of GAM1032 include diagnosis, prevention and treatment of diseases and clinical conditions associated with LOC350448.

LOC352386 (Accession XP_305612.1) is another GAM1032 target gene, herein designated TARGET GENE. LOC352386 BINDING SITE is a target binding site found in the 5' untranslated region of mRNA encoded by LOC352386, corresponding to a target binding site such as BINDING SITE I, BINDING SITE II or BINDING SITE III of FIG. 8. Table 4 illustrates the complementarity of the nucleotide sequences of LOC352386 BINDING SITE, designated SEQ ID:4515, to the nucleotide sequence of GAM1032 RNA, herein designated GAM RNA, also designated SEQ ID:303.

Another function of GAM1032 is therefore inhibition of LOC352386 (Accession XP_305612.1). Accordingly, utilities of GAM1032 include diagnosis, prevention and treatment of diseases and clinical conditions associated with LOC352386.

LOC352691 (Accession XP_302538.1) is another GAM1032 target gene, herein designated TARGET GENE. LOC352691 BINDING SITE is a target binding site found in the 3' untranslated region of mRNA encoded by LOC352691, corresponding to a target binding site such as BINDING SITE I, BINDING SITE II or BINDING SITE III of FIG. 8. Table 4 illustrates the complementarity of the nucleotide sequences of LOC352691 BINDING SITE, designated SEQ ID:17140, to the nucleotide sequence of GAM1032 RNA, herein designated GAM RNA, also designated SEQ ID:303.

Another function of GAM1032 is therefore inhibition of LOC352691 (Accession XP_302538.1). Accordingly, utilities of GAM1032 include diagnosis, prevention and treatment of diseases and clinical conditions associated with LOC352691.

LOC51333 (Accession NP_057727.1) is another GAM1032 target gene, herein designated TARGET GENE. LOC51333 BINDING SITE is a target binding site found in the 3' untranslated region of mRNA encoded by LOC51333, corresponding to a target binding site such as BINDING SITE I, BINDING SITE II or BINDING SITE III of FIG. 8. Table 4 illustrates the complementarity of the nucleotide sequences of LOC51333 BINDING SITE, designated SEQ ID:8816, to the nucleotide sequence of GAM1032 RNA, herein designated GAM RNA, also designated SEQ ID:303.

Another function of GAM1032 is therefore inhibition of LOC51333 (Accession NP_057727.1). Accordingly, utilities of GAM1032 include diagnosis, prevention and treatment of diseases and clinical conditions associated with LOC51333.

LOC90246 (Accession XP_030283.1) is another GAM1032 target gene, herein designated TARGET GENE. LOC90246 BINDING SITE is a target binding site found in the 5' untranslated region of mRNA encoded by LOC90246, corresponding to a target binding site such as BINDING SITE I, BINDING SITE II or BINDING SITE III of FIG. 8. Table 4 illustrates the complementarity of the nucleotide sequences of LOC90246 BINDING SITE, designated SEQ ID:4074, to the nucleotide sequence of GAM1032 RNA, herein designated GAM RNA, also designated SEQ ID:303.

Another function of GAM1032 is therefore inhibition of LOC90246 (Accession XP_030283.1). Accordingly, utilities of GAM1032 include diagnosis, prevention and treatment of diseases and clinical conditions associated with LOC90246.

LOC90785 (Accession XP_034110.1) is another GAM1032 target gene, herein designated TARGET GENE. LOC90785 BINDING SITE is a target binding site found in the 3' untranslated region of mRNA encoded by LOC90785, corresponding to a target binding site such as BINDING SITE I, BINDING SITE II or BINDING SITE III of FIG. 8. Table 4 illustrates the complementarity of the nucleotide sequences of LOC90785 BINDING SITE, designated SEQ ID:13538, to the nucleotide sequence of GAM1032 RNA, herein designated GAM RNA, also designated SEQ ID:303.

Another function of GAM1032 is therefore inhibition of LOC90785 (Accession XP_034110.1). Accordingly, utilities of GAM1032 include diagnosis, prevention and treatment of diseases and clinical conditions associated with LOC90785.

LOC91974 (Accession XP_041974.2) is another GAM1032 target gene, herein designated TARGET GENE. LOC91974 BINDING SITE is a target binding site found in the 5' untranslated region of mRNA encoded by LOC91974, corresponding to a target binding site such as BINDING SITE I, BINDING SITE II or BINDING SITE III of FIG. 8. Table 4 illustrates the complementarity of the nucleotide sequences of LOC91974 BINDING SITE, designated SEQ ID:16067, to the nucleotide sequence of GAM1032 RNA, herein designated GAM RNA, also designated SEQ ID:303.

Another function of GAM1032 is therefore inhibition of LOC91974 (Accession XP_041974.2). Accordingly, utilities of GAM1032 include diagnosis, prevention and treatment of diseases and clinical conditions associated with LOC91974.

Lipin 2 (LPIN2, Accession NP_055461.1) is another GAM1032 target gene, herein designated TARGET GENE. LPIN2 BINDING SITE is a target binding site found in the 3' untranslated region of mRNA encoded by LPIN2, corresponding to a target binding site such as BINDING SITE I, BINDING SITE II or BINDING SITE III of FIG. 8. Table 4 illustrates the complementarity of the nucleotide sequences of LPIN2 BINDING SITE, designated SEQ ID:1006, to the nucleotide sequence of GAM1032 RNA, herein designated GAM RNA, also designated SEQ ID:303.

Another function of GAM1032 is therefore inhibition of Lipin 2 (LPIN2, Accession NP_055461.1). Accordingly, utilities of GAM1032 include diagnosis, prevention and treatment of diseases and clinical conditions associated with LPIN2.

Leucine-rich repeats and immunoglobulin-like domains 1 (LRIG1, Accession NP_056356.1) is another GAM1032 target gene, herein designated TARGET GENE. LRIG1 BINDING SITE is a target binding site found in the 3' untranslated region of mRNA encoded by LRIG1, corresponding to a target binding site such as BINDING SITE I, BINDING SITE II or BINDING SITE III of FIG. 8. Table 4 illustrates the complementarity of the nucleotide sequences of LRIG1 BINDING SITE, designated SEQ ID:2045, to the nucleotide sequence of GAM1032 RNA, herein designated GAM RNA, also designated SEQ ID:303.

Another function of GAM1032 is therefore inhibition of Leucine-rich repeats and immunoglobulin-like domains 1 (LRIG1, Accession NP_056356.1). Accordingly, utilities of GAM1032 include diagnosis, prevention and treatment of diseases and clinical conditions associated with LRIG1.

Lanosterol synthase (2,3-oxidosqualene-lanosterol cyclase) (LSS, Accession NP_002331.2) is another GAM1032 target gene, herein designated TARGET GENE. LSS BINDING SITE is a target binding site found in the 3' untranslated region of mRNA encoded by LSS, corresponding to a target binding site such as BINDING SITE I, BINDING SITE II or BINDING SITE III of FIG. 8. Table 4 illustrates the complementarity of the nucleotide sequences of LSS BINDING SITE, designated SEQ ID:18091, to the nucleotide sequence of GAM1032 RNA, herein designated GAM RNA, also designated SEQ ID:303.

Another function of GAM1032 is therefore inhibition of Lanosterol synthase (2,3-oxidosqualene-lanosterol cyclase) (LSS, Accession NP_002331.2). Accordingly, utilities of GAM1032 include diagnosis, prevention and treatment of diseases and clinical conditions associated with LSS.

Methyl-cpg binding domain protein 2 (MBD2, Accession NP_056647.1) is another GAM1032 target gene, herein designated TARGET GENE. MBD2 BINDING SITE is a target binding site found in the 3' untranslated region of multiple transcripts of mRNA encoded by MBD2, corresponding to a target binding site such as BINDING SITE I, BINDING SITE II or BINDING SITE III of FIG. 8. Table 4 illustrates the complementarity of the nucleotide sequences of MBD2 BINDING SITE, designated SEQ ID:13083, to the nucleotide sequence of GAM1032 RNA, herein designated GAM RNA, also designated SEQ ID:303.

Another function of GAM1032 is therefore inhibition of Methyl-cpg binding domain protein 2 (MBD2, Accession NP_056647.1). Accordingly, utilities of GAM1032 include diagnosis, prevention and treatment of diseases and clinical conditions associated with MBD2.

Melanoma cell adhesion molecule (MCAM, Accession NP_006491.1) is another GAM1032 target gene, herein designated TARGET GENE. MCAM BINDING SITE is a target binding site found in the 3' untranslated region of mRNA encoded by MCAM, corresponding to a target binding site such as BINDING SITE I, BINDING SITE II or BINDING SITE III of FIG. 8. Table 4 illustrates the complementarity of the nucleotide sequences of MCAM BINDING SITE, designated SEQ ID:16374, to the nucleotide sequence of GAM1032 RNA, herein designated GAM RNA, also designated SEQ ID:303.

Another function of GAM1032 is therefore inhibition of Melanoma cell adhesion molecule (MCAM, Accession NP_006491.1). Accordingly, utilities of GAM1032 include diagnosis, prevention and treatment of diseases and clinical conditions associated with MCAM.

MGC10200 (Accession NP_659497.1) is another GAM1032 target gene, herein designated TARGET GENE. MGC10200 BINDING SITE is a target binding site found in the 3' untranslated region of mRNA encoded by MGC10200, corresponding to a target binding site such as BINDING SITE I, BINDING SITE II or BINDING SITE III of FIG. 8. Table 4 illustrates the complementarity of the nucleotide sequences of MGC10200 BINDING SITE, designated SEQ ID:18523, to the nucleotide sequence of GAM1032 RNA, herein designated GAM RNA, also designated SEQ ID:303.

Another function of GAM1032 is therefore inhibition of MGC10200 (Accession NP_659497.1). Accordingly, utilities of GAM1032 include diagnosis, prevention and treatment of diseases and clinical conditions associated with MGC10200.

MGC2574 (Accession NP_077003.1) is another GAM1032 target gene, herein designated TARGET GENE. MGC2574 BINDING SITE is a target binding site found in the 3' untranslated region of mRNA encoded by MGC2574, corresponding to a target binding site such as BINDING SITE I, BINDING SITE II or BINDING SITE III of FIG. 8. Table 4 illustrates the complementarity of the nucleotide sequences of MGC2574 BINDING SITE, designated SEQ ID:16697, to the nucleotide sequence of GAM1032 RNA, herein designated GAM RNA, also designated SEQ ID:303.

Another function of GAM1032 is therefore inhibition of MGC2574 (Accession NP_077003.1). Accordingly, utilities of GAM1032 include diagnosis, prevention and treatment of diseases and clinical conditions associated with MGC2574.

MGC34648 (Accession NP_689873.1) is another GAM1032 target gene, herein designated TARGET GENE. MGC34648 BINDING SITE is a target binding site found in the 3' untranslated region of mRNA encoded by MGC34648, corresponding to a target binding site such as BINDING SITE I, BINDING SITE II or BINDING SITE III of FIG. 8. Table 4 illustrates the complementarity of the nucleotide sequences of MGC34648 BINDING SITE, designated SEQ ID:14517, to the nucleotide sequence of GAM1032 RNA, herein designated GAM RNA, also designated SEQ ID:303.

Another function of GAM1032 is therefore inhibition of MGC34648 (Accession NP_689873.1). Accordingly, utilities of GAM1032 include diagnosis, prevention and treatment of diseases and clinical conditions associated with MGC34648.

MGC45441 (Accession NP_689712.1) is another GAM1032 target gene, herein designated TARGET GENE. MGC45441 BINDING SITE is a target binding site found in the 3' untranslated region of mRNA encoded by MGC45441, corresponding to a target binding site such as BINDING SITE I, BINDING SITE II or BINDING SITE III of FIG. 8. Table 4 illustrates the complementarity of the nucleotide sequences of MGC45441 BINDING SITE, designated SEQ ID:11172, to the nucleotide sequence of GAM1032 RNA, herein designated GAM RNA, also designated SEQ ID:303.

Another function of GAM1032 is therefore inhibition of MGC45441 (Accession NP_689712.1). Accordingly, utilities of GAM1032 include diagnosis, prevention and treatment of diseases and clinical conditions associated with MGC45441.

Antigen identified by monoclonal antibody ki-67 (MKI67, Accession NP_002408.2) is another GAM1032 target gene, herein designated TARGET GENE. MKI67 BINDING SITE is a target binding site found in the 3' untranslated region of mRNA encoded by MKI67, corresponding to a target binding site such as BINDING SITE I, BINDING SITE II or BINDING SITE III of FIG. 8. Table 4 illustrates the complementarity of the nucleotide sequences of MKI67 BINDING SITE, designated SEQ ID:7829, to the nucleotide sequence of GAM1032 RNA, herein designated GAM RNA, also designated SEQ ID:303.

Another function of GAM1032 is therefore inhibition of Antigen identified by monoclonal antibody ki-67 (MKI67, Accession NP_002408.2), a gene which thought to be required for maintaining cell proliferation. Accordingly, utilities of GAM1032 include diagnosis, prevention and treatment of diseases and clinical conditions associated with MKI67.

The function of MKI67 and its association with various diseases and clinical conditions, has been established by previous studies, as described hereinabove with reference to GAM330.2. Myeloperoxidase (MPO, Accession NP_000241.1) is another GAM1032 target gene, herein designated TARGET GENE. MPO BINDING SITE is a target binding site found in the 5' untranslated region of mRNA encoded by MPO, corresponding to a target binding site such as BINDING SITE I, BINDING SITE II or BINDING SITE III of FIG. 8. Table 4 illustrates the complementarity of the nucleotide sequences of MPO BINDING SITE, designated SEQ ID:14549, to the nucleotide sequence of GAM1032 RNA, herein designated GAM RNA, also designated SEQ ID:303.

Another function of GAM1032 is therefore inhibition of Myeloperoxidase (MPO, Accession NP_000241.1), a gene which is present in primary granules of neutrophilic granulocytes. and therefore is associated with Acute promyelocytic leukemia, alzheimer disease. Accordingly, utilities of GAM1032 include diagnosis, prevention and treatment of Acute promyelocytic leukemia, alzheimer disease, and of other diseases and clinical conditions associated with MPO.

The function of MPO and its association with various diseases and clinical conditions, has been established by previous studies, as described hereinabove with reference to GAM374.1. Membrane-spanning 4-domains, subfamily a, member 8b (MS4A8B, Accession NP_113645.1) is another GAM1032 target gene, herein designated TARGET GENE. MS4A8B BINDING SITE is a target binding site found in the 3' untranslated region of mRNA encoded by MS4A8B, corresponding to a target binding site such as BINDING SITE I, BINDING SITE II or BINDING SITE III of FIG. 8. Table 4 illustrates the complementarity of the nucleotide sequences of MS4A8B BINDING SITE, designated SEQ ID:7880, to the nucleotide sequence of GAM1032 RNA, herein designated GAM RNA, also designated SEQ ID:303.

Another function of GAM1032 is therefore inhibition of Membrane-spanning 4-domains, subfamily a, member 8b (MS4A8B, Accession NP_113645.1). Accordingly, utilities of GAM1032 include diagnosis, prevention and treatment of diseases and clinical conditions associated with MS4A8B.

5-methyltetrahydrofolate-homocysteine methyltransferase (MTR, Accession NP_000245.1) is another GAM1032 target gene, herein designated TARGET GENE. MTR BINDING SITE is a target binding site found in the 3' untranslated region of mRNA encoded by MTR, corresponding to a target binding site such as BINDING SITE I, BINDING SITE II or BINDING SITE III of FIG. 8. Table 4 illustrates the complementarity of the nucleotide sequences of MTR BINDING SITE, designated SEQ ID:12733, to the nucleotide sequence of GAM1032 RNA, herein designated GAM RNA, also designated SEQ ID:303.

Another function of GAM1032 is therefore inhibition of 5-methyltetrahydrofolate-homocysteine methyltransferase (MTR, Accession NP_000245.1). Accordingly, utilities of GAM1032 include diagnosis, prevention and treatment of diseases and clinical conditions associated with MTR.

MTRF1L (Accession NP_061914.2) is another GAM1032 target gene, herein designated TARGET GENE. MTRF1L BINDING SITE is a target binding site found in the 3' untranslated region of mRNA encoded by MTRF1L, corresponding to a target binding site such as BINDING SITE I, BINDING SITE II or BINDING SITE III of FIG. 8. Table 4 illustrates the complementarity of the nucleotide sequences of MTRF1L BINDING SITE, designated SEQ ID:16068, to the nucleotide sequence of GAM1032 RNA, herein designated GAM RNA, also designated SEQ ID:303.

Another function of GAM1032 is therefore inhibition of MTRF1L (Accession NP_061914.2). Accordingly, utilities of GAM1032 include diagnosis, prevention and treatment of diseases and clinical conditions associated with MTRF1L.

Nanog (Accession NP_079141.1) is another GAM1032 target gene, herein designated TARGET GENE. Nanog BINDING SITE is a target binding site found in the 3' untranslated region of mRNA encoded by Nanog, corresponding to a target binding site such as BINDING SITE I, BINDING SITE II or BINDING SITE III of FIG. 8. Table 4 illustrates the complementarity of the nucleotide sequences of Nanog BINDING SITE, designated SEQ ID:12978, to the nucleotide sequence of GAM1032 RNA, herein designated GAM RNA, also designated SEQ ID:303.

Another function of GAM1032 is therefore inhibition of Nanog (Accession NP_079141.1). Accordingly, utilities of GAM1032 include diagnosis, prevention and treatment of diseases and clinical conditions associated with Nanog.

Nuclear receptor coactivator 6 (NCOA6, Accession NP_054790.1) is another GAM1032 target gene, herein designated TARGET GENE. NCOA6 BINDING SITE is a target binding site found in the 5' untranslated region of mRNA encoded by NCOA6, corresponding to a target binding site such as BINDING SITE I, BINDING SITE II or BINDING SITE III of FIG. 8. Table 4 illustrates the complementarity of the nucleotide sequences of NCOA6 BINDING SITE, designated SEQ ID:10389, to the nucleotide sequence of GAM1032 RNA, herein designated GAM RNA, also designated SEQ ID:303.

Another function of GAM1032 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM1032 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Neural precursor cell expressed, developmentally down-regulated 4 (NEDD4, Accession XP_046129.4) is another GAM1032 target gene, herein designated TARGET GENE. NEDD4 BINDING SITE is a target binding site found in the 3' untranslated region of mRNA encoded by NEDD4, corresponding to a target binding site such as BINDING SITE I, BINDING SITE II or BINDING SITE III of FIG. 8. Table 4 illustrates the complementarity of the nucleotide sequences of NEDD4 BINDING SITE, designated SEQ ID:6062, to the nucleotide sequence of GAM1032 RNA, herein designated GAM RNA, also designated SEQ ID:303.

Another function of GAM1032 is therefore inhibition of Neural precursor cell expressed, developmentally down-regulated 4 (NEDD4, Accession XP_046129.4), a gene which ubiquitinates regulatory proteins involved in transcription. Accordingly, utilities of GAM1032 include diagnosis, prevention and treatment of diseases and clinical conditions associated with NEDD4.

The function of NEDD4 and its association with various diseases and clinical conditions, has been established by previous studies, as described hereinabove with reference to GAM48.2. Sialidase 3 (membrane sialidase) (NEU3, Accession NP_006647.2) is another GAM1032 target gene, herein designated TARGET GENE. NEU3 BINDING SITE is a target binding site found in the 3' untranslated region of mRNA encoded by NEU3, corresponding to a target binding site such as BINDING SITE I, BINDING SITE II or BINDING SITE III of FIG. 8. Table 4 illustrates the complementarity of the nucleotide sequences of NEU3 BINDING SITE, designated SEQ ID:12441, to the nucleotide sequence of GAM1032 RNA, herein designated GAM RNA, also designated SEQ ID:303.

Another function of GAM1032 is therefore inhibition of Sialidase 3 (membrane sialidase) (NEU3, Accession NP_006647.2). Accordingly, utilities of GAM1032 include diagnosis, prevention and treatment of diseases and clinical conditions associated with NEU3.

Notch homolog 3 (drosophila) (NOTCH3, Accession NP_000426.1) is another GAM1032 target gene, herein designated TARGET GENE. NOTCH3 BINDING SITE is a target binding site found in the 3' untranslated region of mRNA encoded by NOTCH3, corresponding to a target binding site such as BINDING SITE I, BINDING SITE II or BINDING SITE III of FIG. 8. Table 4 illustrates the complementarity of the nucleotide sequences of NOTCH3 BINDING SITE, designated SEQ ID:8237, to the nucleotide sequence of GAM1032 RNA, herein designated GAM RNA, also designated SEQ ID:303.

Another function of GAM1032 is therefore inhibition of Notch homolog 3 (drosophila) (NOTCH3, Accession NP_000426.1), a gene which may function in cell fate specification during development. and therefore may be associated with Cerebral autosomal dominant arteriopathy with subcortical infarcts and leukoencephalopathy (cadasil). Accordingly, utilities of GAM1032 include diagnosis, prevention and treatment of Cerebral autosomal dominant arteriopathy with subcortical infarcts and leukoencephalopathy (cadasil), and of other diseases and clinical conditions associated with NOTCH3.

The function of NOTCH3 and its association with various diseases and clinical conditions, has been established by previous studies, as described hereinabove with reference to GAM195.2. Olfactory receptor, family 2, subfamily h, member 1 (OR2H1, Accession NP_112145.1) is another GAM1032 target gene, herein designated TARGET GENE. OR2H1 BINDING SITE is a target binding site found in the 3' untranslated region of mRNA encoded by OR2H1, corresponding to a target binding site such as BINDING SITE I, BINDING SITE II or BINDING SITE III of FIG. 8. Table 4 illustrates the complementarity of the nucleotide sequences of OR2H1 BINDING SITE, designated SEQ ID:19602, to the nucleotide sequence of GAM1032 RNA, herein designated GAM RNA, also designated SEQ ID:303.

Another function of GAM1032 is therefore inhibition of Olfactory receptor, family 2, subfamily h, member 1 (OR2H1, Accession NP_112145.1). Accordingly, utilities of GAM1032 include diagnosis, prevention and treatment of diseases and clinical conditions associated with OR2H1.

Phosphoinositide-3-kinase, catalytic, gamma polypeptide (PIK3CG, Accession NP_002640.2) is another GAM1032 target gene, herein designated TARGET GENE. PIK3CG BINDING SITE is a target binding site found in the 3' untranslated region of mRNA encoded by PIK3CG, corresponding to a target binding site such as BINDING SITE I, BINDING SITE II or BINDING SITE III of FIG. 8. Table 4 illustrates the complementarity of the nucleotide sequences of PIK3CG BINDING SITE, designated SEQ ID:6205, to the nucleotide sequence of GAM1032 RNA, herein designated GAM RNA, also designated SEQ ID:303.

Another function of GAM1032 is therefore inhibition of Phosphoinositide-3-kinase, catalytic, gamma polypeptide (PIK3CG, Accession NP_002640.2), a gene which regulating cell growth. Accordingly, utilities of GAM1032 include diagnosis, prevention and treatment of diseases and clinical conditions associated with PIK3CG.

The function of PIK3CG and its association with various diseases and clinical conditions, has been established by previous studies, as described hereinabove with reference to GAM347.1. Proteolipid protein 1 (pelizaeus-merzbacher disease, spastic paraplegia 2, uncomplicated) (PLP1, Accession NP_000524.2) is another GAM1032 target gene, herein designated TARGET GENE. PLP1 BINDING SITE is a target binding site found in the 3' untranslated region of mRNA encoded by PLP1, corresponding to a target binding site such as BINDING SITE I, BINDING SITE II or BINDING SITE III of FIG. 8. Table 4 illustrates the complementarity of the nucleotide sequences of PLP1 BINDING SITE, designated SEQ ID:17932, to the nucleotide sequence of GAM1032 RNA, herein designated GAM RNA, also designated SEQ ID:303.

Another function of GAM1032 is therefore inhibition of Proteolipid protein 1 (pelizaeus-merzbacher disease, spastic paraplegia 2, uncomplicated) (PLP1, Accession NP_000524.2). Accordingly, utilities of GAM1032 include diagnosis, prevention and treatment of diseases and clinical conditions associated with PLP1.

Paraneoplastic antigen ma2 (PNMA2, Accession NP_009188.1) is another GAM1032 target gene, herein designated TARGET GENE. PNMA2 BINDING SITE is a target binding site found in the 3' untranslated region of mRNA encoded by PNMA2, corresponding to a target binding site such as BINDING SITE I, BINDING SITE II or BINDING SITE III of FIG. 8. Table 4 illustrates the complementarity of the nucleotide sequences of PNMA2 BINDING SITE, designated SEQ ID:15213, to the nucleotide sequence of GAM1032 RNA, herein designated GAM RNA, also designated SEQ ID:303.

Another function of GAM1032 is therefore inhibition of Paraneoplastic antigen ma2 (PNMA2, Accession NP_009188.1). Accordingly, utilities of GAM1032 include diagnosis, prevention and treatment of diseases and clinical conditions associated with PNMA2.

Protein o-fucosyltransferase 1 (POFUT1, Accession NP_056167.1) is another GAM1032 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:3733, to the nucleotide sequence of GAM1032 RNA, herein designated GAM RNA, also designated SEQ ID:303.

Another function of GAM1032 is therefore inhibition of Protein o-fucosyltransferase 1 (POFUT1, Accession NP_056167.1). Accordingly, utilities of GAM1032 include diagnosis, prevention and treatment of diseases and clinical conditions associated with POFUT1.

Polymerase (dna directed), gamma (POLG, Accession NP_002684.1) is another GAM1032 target gene, herein designated TARGET GENE. POLG BINDING SITE is a target binding site found in the 3' untranslated region of mRNA encoded by POLG, corresponding to a target binding site such as BINDING SITE I, BINDING SITE II or BINDING SITE III of FIG. 8. Table 4 illustrates the complementarity of the nucleotide sequences of POLG BINDING SITE, designated SEQ ID:10516, to the nucleotide sequence of GAM1032 RNA, herein designated GAM RNA, also designated SEQ ID:303.

Another function of GAM1032 is therefore inhibition of Polymerase (dna directed), gamma (POLG, Accession NP_002684.1). Accordingly, utilities of GAM1032 include diagnosis, prevention and treatment of diseases and clinical conditions associated with POLG.

Polymerase (dna directed), mu (POLM, Accession NP_037416.1) is another GAM1032 target gene, herein designated TARGET GENE. POLM BINDING SITE is a target binding site found in the 3' untranslated region of mRNA encoded by POLM, corresponding to a target binding site such as BINDING SITE I, BINDING SITE II or BINDING SITE III of FIG. 8. Table 4 illustrates the complementarity of the nucleotide sequences of POLM BINDING SITE, designated SEQ ID:6542, to the nucleotide sequence of GAM1032 RNA, herein designated GAM RNA, also designated SEQ ID:303.

Another function of GAM1032 is therefore inhibition of Polymerase (dna directed), mu (POLM, Accession NP_037416.1). Accordingly, utilities of GAM1032 include diagnosis, prevention and treatment of diseases and clinical conditions associated with POLM.

Peroxisome proliferative activated receptor, gamma, coactivator 1 (PPARGC1, Accession NP_037393.1) is another GAM1032 target gene, herein designated TARGET GENE. PPARGC1 BINDING SITE is a target binding site found in the 3' untranslated region of mRNA encoded by PPARGC1, corresponding to a target binding site such as BINDING SITE I, BINDING SITE II or BINDING SITE III of FIG. 8. Table 4 illustrates the complementarity of the nucleotide sequences of PPARGC1 BINDING SITE, designated SEQ ID:9562, to the nucleotide sequence of GAM1032 RNA, herein designated GAM RNA, also designated SEQ ID:303.

Another function of GAM1032 is therefore inhibition of Peroxisome proliferative activated receptor, gamma, coactivator 1 (PPARGC1, Accession NP_037393.1), a gene which may play a role in insulin sensitivity and thermogenesis and therefore may be associated with Familial partial lipodystrophy and type ii diabetes. Accordingly, utilities of GAM1032 include diagnosis, prevention and treatment of Familial partial lipodystrophy and type ii diabetes, and of other diseases and clinical conditions associated with PPARGC1.

The function of PPARGC1 and its association with various diseases and clinical conditions, has been established by previous studies, as described hereinabove with reference to GAM169.1. Protein phosphatase 1, regulatory (inhibitor) subunit 13b (PPP1R13B, Accession NP_056131.1) is another GAM1032 target gene, herein designated TARGET GENE. PPP1R13B BINDING SITE is a target binding site found in the 3' untranslated region of mRNA encoded by PPP1R13B, corresponding to a target binding site such as BINDING SITE I, BINDING SITE II or BINDING SITE III of FIG. 8. Table 4 illustrates the complementarity of the nucleotide sequences of PPP1R13B BINDING SITE, designated SEQ ID:10316, to the nucleotide sequence of GAM1032 RNA, herein designated GAM RNA, also designated SEQ ID:303.

Another function of GAM1032 is therefore inhibition of Protein phosphatase 1, regulatory (inhibitor) subunit 13b (PPP1R13B, Accession NP_056131.1). Accordingly, utilities of GAM1032 include diagnosis, prevention and treatment of diseases and clinical conditions associated with PPP1R13B.

Protein kinase c, mu (PRKCM, Accession NP_002733.1) is another GAM1032 target gene, herein designated TARGET GENE. PRKCM BINDING SITE is a target binding site found in the 3' untranslated region of mRNA encoded by PRKCM, corresponding to a target binding site such as BINDING SITE I, BINDING SITE II or BINDING SITE III of FIG. 8. Table 4 illustrates the complementarity of the nucleotide sequences of PRKCM BINDING SITE, designated SEQ ID:3896, to the nucleotide sequence of GAM1032 RNA, herein designated GAM RNA, also designated SEQ ID:303.

Another function of GAM1032 is therefore inhibition of Protein kinase c, mu (PRKCM, Accession NP_002733.1). Accordingly, utilities of GAM1032 include diagnosis, prevention and treatment of diseases and clinical conditions associated with PRKCM.

PRO0659 (Accession NP_054857.2) is another GAM1032 target gene, herein designated TARGET GENE. PRO0659 BINDING SITE is a target binding site found in the 5' untranslated region of mRNA encoded by PRO0659, corresponding to a target binding site such as BINDING SITE I, BINDING SITE II or BINDING SITE III of FIG. 8. Table 4 illustrates the complementarity of the nucleotide sequences of PRO0659 BINDING SITE, designated SEQ ID:18366, to the nucleotide sequence of GAM1032 RNA, herein designated GAM RNA, also designated SEQ ID:303.

Another function of GAM1032 is therefore inhibition of PRO0659 (Accession NP_054857.2). Accordingly, utilities of GAM1032 include diagnosis, prevention and treatment of diseases and clinical conditions associated with PRO0659.

Prostein (Accession NP_149093.1) is another GAM1032 target gene, herein designated TARGET GENE. Prostein BINDING SITE is a target binding site found in the 3' untranslated region of mRNA encoded by Prostein, corresponding to a target binding site such as BINDING SITE I, BINDING SITE II or BINDING SITE III of FIG. 8. Table 4 illustrates the complementarity of the nucleotide sequences of Prostein BINDING SITE, designated SEQ ID:12567, to the nucleotide sequence of GAM1032 RNA, herein designated GAM RNA, also designated SEQ ID:303.

Another function of GAM1032 is therefore inhibition of Prostein (Accession NP_149093.1). Accordingly, utilities of GAM1032 include diagnosis, prevention and treatment of diseases and clinical conditions associated with Prostein.

Psoriasis susceptibility 1 candidate 1 (PSORS1C1, Accession NP_054787.1) is another GAM1032 target gene, herein designated TARGET GENE. PSORS1C1 BINDING SITE is a target binding site found in the 3' untranslated region of mRNA encoded by PSORS1C1, corresponding to a target binding site such as BINDING SITE I, BINDING SITE II or BINDING SITE III of FIG. 8. Table 4 illustrates the complementarity of the nucleotide sequences of PSORS1C1 BINDING SITE, designated SEQ ID:11955, to the nucleotide sequence of GAM1032 RNA, herein designated GAM RNA, also designated SEQ ID:303.

Another function of GAM1032 is therefore inhibition of Psoriasis susceptibility 1 candidate 1 (PSORS1C1, Accession NP_054787.1). Accordingly, utilities of GAM1032 include diagnosis, prevention and treatment of diseases and clinical conditions associated with PSORS1C1.

PTP9Q22 (Accession NP_818931.1) is another GAM1032 target gene, herein designated TARGET GENE. PTP9Q22 BINDING SITE is a target binding site found in the 3' untranslated region of multiple transcripts of mRNA encoded by PTP9Q22, corresponding to a target binding site such as BINDING SITE I, BINDING SITE II or BINDING SITE III of FIG. 8. Table 4 illustrates the complementarity of the nucleotide sequences of PTP9Q22 BINDING SITE, designated SEQ ID:4253, to the nucleotide sequence of GAM1032 RNA, herein designated GAM RNA, also designated SEQ ID:303.

Another function of GAM1032 is therefore inhibition of PTP9Q22 (Accession NP_818931.1). Accordingly, utilities of GAM1032 include diagnosis, prevention and treatment of diseases and clinical conditions associated with PTP9Q22.

PTP9Q22 (Accession NP_689635.3) is another GAM1032 target gene, herein designated TARGET GENE. PTP9Q22 BINDING SITE is a target binding site found in the 3' untranslated region of multiple transcripts of mRNA encoded by PTP9Q22, corresponding to a target binding site such as BINDING SITE I, BINDING SITE II or BINDING SITE III of FIG. 8. Table 4 illustrates the complementarity of the nucleotide sequences of PTP9Q22 BINDING SITE, designated SEQ ID:4253, to the nucleotide sequence of GAM1032 RNA, herein designated GAM RNA, also designated SEQ ID:303.

Another function of GAM1032 is therefore inhibition of PTP9Q22 (Accession NP_689635.3). Accordingly, utilities of GAM1032 include diagnosis, prevention and treatment of diseases and clinical conditions associated with PTP9Q22.

Protein tyrosine phosphatase, receptor type, o (PTPRO, Accession NP_109595.1) is another GAM1032 target gene, herein designated TARGET GENE. PTPRO BINDING SITE is a target binding site found in the 3' untranslated region of multiple transcripts of mRNA encoded by PTPRO, corresponding to a target binding site such as BINDING SITE I, BINDING SITE II or BINDING SITE III of FIG. 8. Table 4 illustrates the complementarity of the nucleotide sequences of PTPRO BINDING SITE, designated SEQ ID:1369, to the nucleotide sequence of GAM1032 RNA, herein designated GAM RNA, also designated SEQ ID:303.

Another function of GAM1032 is therefore inhibition of Protein tyrosine phosphatase, receptor type, o (PTPRO, Accession NP_109595.1), a gene which may function as a cell contact receptor that mediates and controls cell-cell signals and therefore may be associated with Pancreatic carcinoma. Accordingly, utilities of GAM1032 include diagnosis, prevention and treatment of Pancreatic carcinoma, and of other diseases and clinical conditions associated with PTPRO.

The function of PTPRO and its association with various diseases and clinical conditions, has been established by previous studies, as described hereinabove with reference to GAM207.2. Protein tyrosine phosphatase, receptor type, o (PTPRO, Accession NP_109596.1) is another GAM1032 target gene, herein designated TARGET GENE. PTPRO BINDING SITE is a target binding site found in the 3' untranslated region of multiple transcripts of mRNA encoded by PTPRO, corresponding to a target binding site such as BINDING SITE I, BINDING SITE II or BINDING SITE III of FIG. 8. Table 4 illustrates the complementarity of the nucleotide sequences of PTPRO BINDING SITE, designated SEQ ID:1369, to the nucleotide sequence of GAM1032 RNA, herein designated GAM RNA, also designated SEQ ID:303.

Another function of GAM1032 is therefore inhibition of Protein tyrosine phosphatase, receptor type, o (PTPRO, Accession NP_109596.1), a gene which may function as a cell contact receptor that mediates and controls cell-cell signals and therefore may be associated with Pancreatic carcinoma. Accordingly, utilities of GAM1032 include diagnosis, prevention and treatment of Pancreatic carcinoma, and of other diseases and clinical conditions associated with PTPRO.

The function of PTPRO and its association with various diseases and clinical conditions, has been established by previous studies, as described hereinabove with reference to GAM207.2. Paxillin (PXN, Accession NP_002850.1) is another GAM1032 target gene, herein designated TARGET GENE. PXN BINDING SITE is a target binding site found in the 3' untranslated region of mRNA encoded by PXN, corresponding to a target binding site such as BINDING SITE I, BINDING SITE II or BINDING SITE III of FIG. 8. Table 4 illustrates the complementarity of the nucleotide sequences of PXN BINDING SITE, designated SEQ ID:16601, to the nucleotide sequence of GAM1032 RNA, herein designated GAM RNA, also designated SEQ ID:303.

Another function of GAM1032 is therefore inhibition of Paxillin (PXN, Accession NP_002850.1), a gene which may be involved in p53- dependent apoptosis and therefore may be associated with Cancer. Accordingly, utilities of GAM1032 include diagnosis, prevention and treatment of Cancer, and of other diseases and clinical conditions associated with PXN.

The function of PXN and its association with various diseases and clinical conditions, has been established by previous studies, as described hereinabove with reference to GAM47.1. Ran binding protein 17 (RANBP17, Accession NP_075048.1) is another GAM1032 target gene, herein designated TARGET GENE. RANBP17 BINDING SITE is a target binding site found in the 3' untranslated region of mRNA encoded by RANBP17, corresponding to a target binding site such as BINDING SITE I, BINDING SITE II or BINDING SITE III of FIG. 8. Table 4 illustrates the complementarity of the nucleotide sequences of RANBP17 BINDING SITE, designated SEQ ID:3335, to the nucleotide sequence of GAM1032 RNA, herein designated GAM RNA, also designated SEQ ID:303.

Another function of GAM1032 is therefore inhibition of Ran binding protein 17 (RANBP17, Accession NP_075048.1). Accordingly, utilities of GAM1032 include diagnosis, prevention and treatment of diseases and clinical conditions associated with RANBP17.

Retinoblastoma 1 (including osteosarcoma) (RB1, Accession NP_000312.1) is another GAM1032 target gene, herein designated TARGET GENE. RB1 BINDING SITE is a target binding site found in the 3' untranslated region of mRNA encoded by RB1, corresponding to a target binding site such as BINDING SITE I, BINDING SITE II or BINDING SITE III of FIG. 8. Table 4 illustrates the complementarity of the nucleotide sequences of RB1 BINDING SITE, designated SEQ ID:12895, to the nucleotide sequence of GAM1032 RNA, herein designated GAM RNA, also designated SEQ ID:303.

Another function of GAM1032 is therefore inhibition of Retinoblastoma 1 (including osteosarcoma) (RB1, Accession NP_000312.1), a gene which probably acts as a regulator of other genes and therefore is associated with Retinoblastoma. Accordingly, utilities of GAM1032 include diagnosis, prevention and treatment of Retinoblastoma, and of other diseases and clinical conditions associated with RB1.

The function of RB1 and its association with various diseases and clinical conditions, has been established by previous studies, as described hereinabove with reference to GAM519.1. Regulatory factor x, 5 (influences hla class ii expression) (RFX5, Accession NP_000440.1) is another GAM1032 target gene, herein designated TARGET GENE. RFX5 BINDING SITE is a target binding site found in the 3' untranslated region of mRNA encoded by RFX5, corresponding to a target binding site such as BINDING SITE I, BINDING SITE II or BINDING SITE III of FIG. 8. Table 4 illustrates the complementarity of the nucleotide sequences of RFX5 BINDING SITE, designated SEQ ID:16892, to the nucleotide sequence of GAM1032 RNA, herein designated GAM RNA, also designated SEQ ID:303.

Another function of GAM1032 is therefore inhibition of Regulatory factor x, 5 (influences hla class ii expression) (RFX5, Accession NP_000440.1), a gene which activates transcription from class ii mhc promoters. and therefore may be associated with Bare lymphocyte syndrome type ii complementation group c (or hla class ii-deficient combined immunodeficiency); a form of severe combined immunodeficiency disease (scid). Accordingly, utilities of GAM1032 include diagnosis, prevention and treatment of Bare lymphocyte syndrome type ii complementation group c (or hla class ii-deficient combined immunodeficiency); a form of severe combined immunodeficiency disease (scid), and of other diseases and clinical conditions associated with RFX5.

The function of RFX5 and its association with various diseases and clinical conditions, has been established by previous studies, as described hereinabove with reference to GAM329.1. Regulator of g-protein signalling 11 (RGS11, Accession NP_003825.1) is another GAM1032 target gene, herein designated TARGET GENE. RGS11 BINDING SITE is a target binding site found in the 3' untranslated region of mRNA encoded by RGS11, corresponding to a target binding site such as BINDING SITE I, BINDING SITE II or BINDING SITE III of FIG. 8. Table 4 illustrates the complementarity of the nucleotide sequences of RGS11 BINDING SITE, designated SEQ ID:1065, to the nucleotide sequence of GAM1032 RNA, herein designated GAM RNA, also designated SEQ ID:303.

Another function of GAM1032 is therefore inhibition of Regulator of g-protein signalling 11 (RGS11, Accession NP_003825.1). Accordingly, utilities of GAM1032 include diagnosis, prevention and treatment of diseases and clinical conditions associated with RGS11.

RINZF (Accession NP_076418.2) is another GAM1032 target gene, herein designated TARGET GENE. RINZF BINDING SITE is a target binding site found in the 3' untranslated region of mRNA encoded by RINZF, corresponding to a target binding site such as BINDING SITE I, BINDING SITE II or BINDING SITE III of FIG. 8. Table 4 illustrates the complementarity of the nucleotide sequences of RINZF BINDING SITE, designated SEQ ID:7593, to the nucleotide sequence of GAM1032 RNA, herein designated GAM RNA, also designated SEQ ID:303.

Another function of GAM1032 is therefore inhibition of RINZF (Accession NP_076418.2). Accordingly, utilities of GAM1032 include diagnosis, prevention and treatment of diseases and clinical conditions associated with RINZF.

RNASE3L (Accession NP_037367.2) is another GAM1032 target gene, herein designated TARGET GENE. RNASE3L BINDING SITE is a target binding site found in the 5' untranslated region of mRNA encoded by RNASE3L, corresponding to a target binding site such as BINDING SITE I, BINDING SITE II or BINDING SITE III of FIG. 8. Table 4 illustrates the complementarity of the nucleotide sequences of RNASE3L BINDING SITE, designated SEQ ID:16650, to the nucleotide sequence of GAM1032 RNA, herein designated GAM RNA, also designated SEQ ID:303.

Another function of GAM1032 is therefore inhibition of RNASE3L (Accession NP_037367.2). Accordingly, utilities of GAM1032 include diagnosis, prevention and treatment of diseases and clinical conditions associated with RNASE3L.

Ring finger protein (c3h2c3 type) 6 (RNF6, Accession NP_005968.1) is another GAM1032 target gene, herein designated TARGET GENE. RNF6 BINDING SITE is a target binding site found in the 5' untranslated region of mRNA encoded by RNF6, corresponding to a target binding site such as BINDING SITE I, BINDING SITE II or BINDING SITE III of FIG. 8. Table 4 illustrates the complementarity of the nucleotide sequences of RNF6 BINDING SITE, designated SEQ ID:3285, to the nucleotide sequence of GAM1032 RNA, herein designated GAM RNA, also designated SEQ ID:303.

Another function of GAM1032 is therefore inhibition of Ring finger protein (c3h2c3 type) 6 (RNF6, Accession NP_005968.1), a gene which is a RING finger protein, may be a tumor suppressor and therefore may be associated with Esophageal squamous cell carcinoma, somatic. Accordingly, utilities of GAM1032 include diagnosis, prevention and treatment of Esophageal squamous cell carcinoma, somatic, and of other diseases and clinical conditions associated with RNF6.

The function of RNF6 and its association with various diseases and clinical conditions, has been established by previous studies, as described hereinabove with reference to GAM515.1. Retinoid x receptor, alpha (RXRA, Accession NP_002948.1) is another GAM1032 target gene, herein designated TARGET GENE. RXRA BINDING SITE is a target binding site found in the 3' untranslated region of mRNA encoded by RXRA, corresponding to a target binding site such as BINDING SITE I, BINDING SITE II or BINDING SITE III of FIG. 8. Table 4 illustrates the complementarity of the nucleotide sequences of RXRA BINDING SITE, designated SEQ ID:11932, to the nucleotide sequence of GAM1032 RNA, herein designated GAM RNA, also designated SEQ ID:303.

Another function of GAM1032 is therefore inhibition of Retinoid x receptor, alpha (RXRA, Accession NP_002948.1), a gene which activates genes required for vitamin A metabolism, binds 9-cis retinoic acid. Accordingly, utilities of GAM1032 include diagnosis, prevention and treatment of diseases and clinical conditions associated with RXRA.

The function of RXRA and its association with various diseases and clinical conditions, has been established by previous studies, as described hereinabove with reference to GAM146.1. SBLF (Accession NP_006864.2) is another GAM1032 target gene, herein designated TARGET GENE. SBLF BINDING SITE is a target binding site found in the 3' untranslated region of mRNA encoded by SBLF, corresponding to a target binding site such as BINDING SITE I, BINDING SITE II or BINDING SITE III of FIG. 8. Table 4 illustrates the complementarity of the nucleotide sequences of SBLF BINDING SITE, designated SEQ ID:8023, to the nucleotide sequence of GAM1032 RNA, herein designated GAM RNA, also designated SEQ ID:303.

Another function of GAM1032 is therefore inhibition of SBLF (Accession NP_006864.2). Accordingly, utilities of GAM1032 include diagnosis, prevention and treatment of diseases and clinical conditions associated with SBLF.

Sodium channel, voltage-gated, type ii, beta polypeptide (SCN2B, Accession NP_004579.1) is another GAM1032 target gene, herein designated TARGET GENE. SCN2B BINDING SITE is a target binding site found in the 3' untranslated region of mRNA encoded by SCN2B, corresponding to a target binding site such as BINDING SITE I, BINDING SITE II or BINDING SITE III of FIG. 8. Table 4 illustrates the complementarity of the nucleotide sequences of SCN2B BINDING SITE, designated SEQ ID:635, to the nucleotide sequence of GAM1032 RNA, herein designated GAM RNA, also designated SEQ ID:303.

Another function of GAM1032 is therefore inhibition of Sodium channel, voltage-gated, type ii, beta polypeptide (SCN2B, Accession NP_004579.1), a gene which modulates channel properties. Accordingly, utilities of GAM1032 include diagnosis, prevention and treatment of diseases and clinical conditions associated with SCN2B.

The function of SCN2B and its association with various diseases and clinical conditions, has been established by previous studies, as described hereinabove with reference to GAM189.1. Serine (or cysteine) proteinase inhibitor, clade a (alpha-1 antiproteinase, antitrypsin), member 3 (SERPINA3, Accession NP_001076.1) is another GAM1032 target gene, herein designated TARGET GENE. SERPINA3 BINDING SITE is a target binding site found in the 3' untranslated region of mRNA encoded by SERPINA3, corresponding to a target binding site such as BINDING SITE I, BINDING SITE II or BINDING SITE III of FIG. 8. Table 4 illustrates the complementarity of the nucleotide sequences of SERPINA3 BINDING SITE, designated SEQ ID:2046, to the nucleotide sequence of GAM1032 RNA, herein designated GAM RNA, also designated SEQ ID:303.

Another function of GAM1032 is therefore inhibition of Serine (or cysteine) proteinase inhibitor, clade a (alpha-1 antiproteinase, antitrypsin), member 3 (SERPINA3, Accession NP_001076.1), a gene which is a member of the serpin family of serine protease inhibitors. and therefore may be associated with Chronic obstructive pulmonary disease (copd) or of occlusive cerebrovascular disease. Accordingly, utilities of GAM1032 include diagnosis, prevention and treatment of Chronic obstructive pulmonary disease (copd) or of occlusive cerebrovascular disease, and of other diseases and clinical conditions associated with SERPINA3.

The function of SERPINA3 has been established by previous studies. Alpha-1-antichymotrypsin is a plasma protease inhibitor synthesized in the liver. It is a single glycopeptide chain of about 68,000 daltons and belongs to the class of serine protease inhibitors. In man, the normal serum level is about one-tenth that of alpha-1-antitrypsin (PI; 107400), with which it shares nucleic acid and protein sequence homology (Chandra et al., 1983). Both are major acute phase reactants; their concentrations in plasma increase in response to trauma, surgery, and infection. Antithrombin III, which also is structurally similar to alpha-1-antitrypsin, shows less sequence homology to antichymotrypsin and is not an acute phase reactant. Kelsey et al. (1988) cloned and analyzed the AACT gene, partly because of the possibility that genetic variation in other protease inhibitors may influence the prognosis in AAT deficiency. They isolated the AACT gene on a series of cosmid clones, with restriction mapping of about 70 kb around the gene.

Full details of the abovementioned studies are described in the following publications, the disclosure of which are hereby incorporated by reference:

Chandra, T.; Stackhouse, R.; Kidd, V. J.; Robson, K. J. H.; Woo, S. L. C.: Sequence homology between human alpha-1-antichymotrypsin, alpha-1-antitrypsin, and antithrombin III. Biochemistry 22:5055-5061, 1983; and Kelsey, G. D.; Abeliovich, D.; McMahon, C. J.; Whitehouse, D.; Corney, G.; Povey, S.; Hopkinson, D. A.; Wolfe, J.; Mieli-Vergani, G.; Mowat, A. P.: Cloning of the human alpha-1 antichym.

Further studies establishing the function and utilities of SERPINA3 are found in John Hopkins OMIM database record ID 107280, and in cited publications listed in Table 5, which are hereby incorporated by reference. SF4 (Accession NP_066987.1) is another GAM1032 target gene, herein designated TARGET GENE. SF4 BINDING SITE is a target binding site found in the 3' untranslated region of mRNA encoded by SF4, corresponding to a target binding site such as BINDING SITE I, BINDING SITE II or BINDING SITE III of FIG. 8. Table 4 illustrates the complementarity of the nucleotide sequences of SF4 BINDING SITE, designated SEQ ID:860, to the nucleotide sequence of GAM1032 RNA, herein designated GAM RNA, also designated SEQ ID:303.

Another function of GAM1032 is therefore inhibition of SF4 (Accession NP_066987.1). Accordingly, utilities of GAM1032 include diagnosis, prevention and treatment of diseases and clinical conditions associated with SF4.

Sialyltransferase 1 (beta-galactoside alpha-2,6-sialytransferase) (SIAT1, Accession NP_775323.1) is another GAM1032 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:11766, to the nucleotide sequence of GAM1032 RNA, herein designated GAM RNA, also designated SEQ ID:303.

Another function of GAM1032 is therefore inhibition of Sialyltransferase 1 (beta-galactoside alpha-2,6-sialytransferase) (SIAT1, Accession NP_775323.1), a gene which transfers sialic acid from the donor of substrate cmp-sialic acid to galactose containing acceptor substrates. Accordingly, utilities of GAM1032 include diagnosis, prevention and treatment of diseases and clinical conditions associated with SIAT1.

The function of SIAT1 and its association with various diseases and clinical conditions, has been established by previous studies, as described hereinabove with reference to GAM40.2. Sialyltransferase 1 (beta-galactoside alpha-2,6-sialytransferase) (SIAT1, Accession NP_775324.1) is another GAM1032 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:11766, to the nucleotide sequence of GAM1032 RNA, herein designated GAM RNA, also designated SEQ ID:303.

Another function of GAM1032 is therefore inhibition of Sialyltransferase 1 (beta-galactoside alpha-2,6-sialytransferase) (SIAT1, Accession NP_775324.1), a gene which transfers sialic acid from the donor of substrate cmp-sialic acid to galactose containing acceptor substrates. Accordingly, utilities of GAM1032 include diagnosis, prevention and treatment of diseases and clinical conditions associated with SIAT1.

The function of SIAT1 and its association with various diseases and clinical conditions, has been established by previous studies, as described hereinabove with reference to GAM40.2. Sialyltransferase 1 (beta-galactoside alpha-2,6-sialytransferase) (SIAT1, Accession NP_003023.1) is another GAM1032 target gene, herein designated TARGET GENE. SIAT1 BINDING SITE is a target binding site found in the 3' untranslated region of multiple transcripts of mRNA encoded by SIAT1, corresponding to a target binding site such as BINDING SITE I, BINDING SITE II or BINDING SITE III of FIG. 8. Table 4 illustrates the complementarity of the nucleotide sequences of SIAT1 BINDING SITE, designated SEQ ID:11766, to the nucleotide sequence of GAM1032 RNA, herein designated GAM RNA, also designated SEQ ID:303.

Another function of GAM1032 is therefore inhibition of Sialyltransferase 1 (beta-galactoside alpha-2,6-sialytransferase) (SIAT1, Accession NP_003023.1), a gene which transfers sialic acid from the donor of substrate cmp-sialic acid to galactose containing acceptor substrates. Accordingly, utilities of GAM1032 include diagnosis, prevention and treatment of diseases and clinical conditions associated with SIAT1.

The function of SIAT1 and its association with various diseases and clinical conditions, has been established by previous studies, as described hereinabove with reference to GAM40.2. Solute carrier family 12 (potassium/chloride transporters), member 7 (SLC12A7, Accession NP_006589.1) is another GAM1032 target gene, herein designated TARGET GENE. SLC12A7 BINDING SITE is a target binding site found in the 3' untranslated region of mRNA encoded by SLC12A7, corresponding to a target binding site such as BINDING SITE I, BINDING SITE II or BINDING SITE III of FIG. 8. Table 4 illustrates the complementarity of the nucleotide sequences of SLC12A7 BINDING SITE, designated SEQ ID:17066, to the nucleotide sequence of GAM1032 RNA, herein designated GAM RNA, also designated SEQ ID:303.

Another function of GAM1032 is therefore inhibition of Solute carrier family 12 (potassium/chloride transporters), member 7 (SLC12A7, Accession NP_006589.1), a gene which is a potassium/chloride- cotransporter. Accordingly, utilities of GAM1032 include diagnosis, prevention and treatment of diseases and clinical conditions associated with SLC12A7.

The function of SLC12A7 and its association with various diseases and clinical conditions, has been established by previous studies, as described hereinabove with reference to GAM105.1. SLC35A4 (Accession NP_542401.1) is another GAM1032 target gene, herein designated TARGET GENE. SLC35A4 BINDING SITE is a target binding site found in the 5' untranslated region of mRNA encoded by SLC35A4, corresponding to a target binding site such as BINDING SITE I, BINDING SITE II or BINDING SITE III of FIG. 8. Table 4 illustrates the complementarity of the nucleotide sequences of SLC35A4 BINDING SITE, designated SEQ ID:5796, to the nucleotide sequence of GAM1032 RNA, herein designated GAM RNA, also designated SEQ ID:303.

Another function of GAM1032 is therefore inhibition of SLC35A4 (Accession NP_542401.1). Accordingly, utilities of GAM1032 include diagnosis, prevention and treatment of diseases and clinical conditions associated with SLC35A4.

SLC35E2 (Accession XP_049733.6) is another GAM1032 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:14041, to the nucleotide sequence of GAM1032 RNA, herein designated GAM RNA, also designated SEQ ID:303.

Another function of GAM1032 is therefore inhibition of SLC35E2 (Accession XP_049733.6). Accordingly, utilities of GAM1032 include diagnosis, prevention and treatment of diseases and clinical conditions associated with SLC35E2.

Smith-magenis syndrome chromosome region, candidate 5 (SMCR5, Accession NP_658987.1) is another GAM1032 target gene, herein designated TARGET GENE. SMCR5 BINDING SITE is a target binding site found in the 3' untranslated region of mRNA encoded by SMCR5, corresponding to a target binding site such as BINDING SITE I, BINDING SITE II or BINDING SITE III of FIG. 8. Table 4 illustrates the complementarity of the nucleotide sequences of SMCR5 BINDING SITE, designated SEQ ID:10482, to the nucleotide sequence of GAM1032 RNA, herein designated GAM RNA, also designated SEQ ID:303.

Another function of GAM1032 is therefore inhibition of Smith-magenis syndrome chromosome region, candidate 5 (SMCR5, Accession NP_658987.1). Accordingly, utilities of GAM1032 include diagnosis, prevention and treatment of diseases and clinical conditions associated with SMCR5.

SORCS2 (Accession NP_065828.1) is another GAM1032 target gene, herein designated TARGET GENE. SORCS2 BINDING SITE is a target binding site found in the 3' untranslated region of mRNA encoded by SORCS2, corresponding to a target binding site such as BINDING SITE I, BINDING SITE II or BINDING SITE III of FIG. 8. Table 4 illustrates the complementarity of the nucleotide sequences of SORCS2 BINDING SITE, designated SEQ ID:6379, to the nucleotide sequence of GAM1032 RNA, herein designated GAM RNA, also designated SEQ ID:303.

Another function of GAM1032 is therefore inhibition of SORCS2 (Accession NP_065828.1). Accordingly, utilities of GAM1032 include diagnosis, prevention and treatment of diseases and clinical conditions associated with SORCS2.

Sp7 transcription factor (SP7, Accession NP_690599.1) is another GAM1032 target gene, herein designated TARGET GENE. SP7 BINDING SITE is a target binding site found in the 3' untranslated region of mRNA encoded by SP7, corresponding to a target binding site such as BINDING SITE I, BINDING SITE II or BINDING SITE III of FIG. 8. Table 4 illustrates the complementarity of the nucleotide sequences of SP7 BINDING SITE, designated SEQ ID:20063, to the nucleotide sequence of GAM1032 RNA, herein designated GAM RNA, also designated SEQ ID:303.

Another function of GAM1032 is therefore inhibition of Sp7 transcription factor (SP7, Accession NP_690599.1). Accordingly, utilities of GAM1032 include diagnosis, prevention and treatment of diseases and clinical conditions associated with SP7.

Spondin 1, (f-spondin) extracellular matrix protein (SPON1, Accession NP_006099.1) is another GAM1032 target gene, herein designated TARGET GENE. SPON1 BINDING SITE is a target binding site found in the 3' untranslated region of mRNA encoded by SPON1, corresponding to a target binding site such as BINDING SITE I, BINDING SITE II or BINDING SITE III of FIG. 8. Table 4 illustrates the complementarity of the nucleotide sequences of SPON1 BINDING SITE, designated SEQ ID:14025, to the nucleotide sequence of GAM1032 RNA, herein designated GAM RNA, also designated SEQ ID:303.

Another function of GAM1032 is therefore inhibition of Spondin 1, (f-spondin) extracellular matrix protein (SPON1, Accession NP_006099.1). Accordingly, utilities of GAM1032 include diagnosis, prevention and treatment of diseases and clinical conditions associated with SPON1.

Sulfite oxidase (SUOX, Accession NP_000447.1) is another GAM1032 target gene, herein designated TARGET GENE. SUOX BINDING SITE is a target binding site found in the 5' untranslated region of mRNA encoded by SUOX, corresponding to a target binding site such as BINDING SITE I, BINDING SITE II or BINDING SITE III of FIG. 8. Table 4 illustrates the complementarity of the nucleotide sequences of SUOX BINDING SITE, designated SEQ ID:15310, to the nucleotide sequence of GAM1032 RNA, herein designated GAM RNA, also designated SEQ ID:303.

Another function of GAM1032 is therefore inhibition of Sulfite oxidase (SUOX, Accession NP_000447.1), a gene which sulfite oxidase deficiency and therefore is associated with Sulfite oxidase deficiency. Accordingly, utilities of GAM1032 include diagnosis, prevention and treatment of Sulfite oxidase deficiency, and of other diseases and clinical conditions associated with SUOX.

The function of SUOX and its association with various diseases and clinical conditions, has been established by previous studies, as described hereinabove with reference to GAM206.1. Tachykinin receptor 3 (TACR3, Accession NP_001050.1) is another GAM1032 target gene, herein designated TARGET GENE. TACR3 BINDING SITE is a target binding site found in the 3' untranslated region of mRNA encoded by TACR3, corresponding to a target binding site such as BINDING SITE I, BINDING SITE II or BINDING SITE III of FIG. 8. Table 4 illustrates the complementarity of the nucleotide sequences of TACR3 BINDING SITE, designated SEQ ID:15957, to the nucleotide sequence of GAM1032 RNA, herein designated GAM RNA, also designated SEQ ID:303.

Another function of GAM1032 is therefore inhibition of Tachykinin receptor 3 (TACR3, Accession NP_001050.1). Accordingly, utilities of GAM1032 include diagnosis, prevention and treatment of diseases and clinical conditions associated with TACR3.

T-box 18 (TBX18, Accession XP_291165.1) is another GAM1032 target gene, herein designated TARGET GENE. TBX18 BINDING SITE is a target binding site found in the 5' untranslated region of mRNA encoded by TBX18, corresponding to a target binding site such as BINDING SITE I, BINDING SITE II or BINDING SITE III of FIG. 8. Table 4 illustrates the complementarity of the nucleotide sequences of TBX18 BINDING SITE, designated SEQ ID:550, to the nucleotide sequence of GAM1032 RNA, herein designated GAM RNA, also designated SEQ ID:303.

Another function of GAM1032 is therefore inhibition of T-box 18 (TBX18, Accession XP_291165.1). Accordingly, utilities of GAM1032 include diagnosis, prevention and treatment of diseases and clinical conditions associated with TBX18.

Thymidine kinase 2, mitochondrial (TK2, Accession NP_004605.1) is another GAM1032 target gene, herein designated TARGET GENE. TK2 BINDING SITE is a target binding site found in the 3' untranslated region of mRNA encoded by TK2, corresponding to a target binding site such as BINDING SITE I, BINDING SITE II or BINDING SITE III of FIG. 8. Table 4 illustrates the complementarity of the nucleotide sequences of TK2 BINDING SITE, designated SEQ ID:17771, to the nucleotide sequence of GAM1032 RNA, herein designated GAM RNA, also designated SEQ ID:303.

Another function of GAM1032 is therefore inhibition of Thymidine kinase 2, mitochondrial (TK2, Accession NP_004605.1), a gene which phosphorylates thymidine, deoxycytidine, deoxyuridine, and also anti-viral and anti-cancer nucleoside analogs and therefore may be associated with Mitochondrial dna depletion myopathy. Accordingly, utilities of GAM1032 include diagnosis, prevention and treatment of Mitochondrial dna depletion myopathy, and of other diseases and clinical conditions associated with TK2.

The function of TK2 and its association with various diseases and clinical conditions, has been established by previous studies, as described hereinabove with reference to GAM281.1. Toll-like receptor 4 (TLR4, Accession NP_612566.1) is another GAM1032 target gene, herein designated TARGET GENE. TLR4 BINDING SITE is a target binding site found in the 3' untranslated region of multiple transcripts of mRNA encoded by TLR4, corresponding to a target binding site such as BINDING SITE I, BINDING SITE II or BINDING SITE III of FIG. 8. Table 4 illustrates the complementarity of the nucleotide sequences of TLR4 BINDING SITE, designated SEQ ID:10745, to the nucleotide sequence of GAM1032 RNA, herein designated GAM RNA, also designated SEQ ID:303.

Another function of GAM1032 is therefore inhibition of Toll-like receptor 4 (TLR4, Accession NP_612566.1). Accordingly, utilities of GAM1032 include diagnosis, prevention and treatment of diseases and clinical conditions associated with TLR4.

Toll-like receptor 4 (TLR4, Accession NP_612564.1) is another GAM1032 target gene, herein designated TARGET GENE. TLR4 BINDING SITE is a target binding site found in the 3' untranslated region of multiple transcripts of mRNA encoded by TLR4, corresponding to a target binding site such as BINDING SITE I, BINDING SITE II or BINDING SITE III of FIG. 8. Table 4 illustrates the complementarity of the nucleotide sequences of TLR4 BINDING SITE, designated SEQ ID:10745, to the nucleotide sequence of GAM1032 RNA, herein designated GAM RNA, also designated SEQ ID:303.

Another function of GAM1032 is therefore inhibition of Toll-like receptor 4 (TLR4, Accession NP_612564.1). Accordingly, utilities of GAM1032 include diagnosis, prevention and treatment of diseases and clinical conditions associated with TLR4.

Toll-like receptor 4 (TLR4, Accession NP_003257.1) is another GAM1032 target gene, herein designated TARGET GENE. TLR4 BINDING SITE is a target binding site found in the 3' untranslated region of multiple transcripts of mRNA encoded by TLR4, corresponding to a target binding site such as BINDING SITE I, BINDING SITE II or BINDING SITE III of FIG. 8. Table 4 illustrates the complementarity of the nucleotide sequences of TLR4 BINDING SITE, designated SEQ ID:10745, to the nucleotide sequence of GAM1032 RNA, herein designated GAM RNA, also designated SEQ ID:303.

Another function of GAM1032 is therefore inhibition of Toll-like receptor 4 (TLR4, Accession NP_003257.1). Accordingly, utilities of GAM1032 include diagnosis, prevention and treatment of diseases and clinical conditions associated with TLR4.

Toll-like receptor 4 (TLR4, Accession NP_612567.1) is another GAM1032 target gene, herein designated TARGET GENE. TLR4 BINDING SITE is a target binding site found in the 3' untranslated region of multiple transcripts of mRNA encoded by TLR4, corresponding to a target binding site such as BINDING SITE I, BINDING SITE II or BINDING SITE III of FIG. 8. Table 4 illustrates the complementarity of the nucleotide sequences of TLR4 BINDING SITE, designated SEQ ID:10745, to the nucleotide sequence of GAM1032 RNA, herein designated GAM RNA, also designated SEQ ID:303.

Another function of GAM1032 is therefore inhibition of Toll-like receptor 4 (TLR4, Accession NP_612567.1). Accordingly, utilities of GAM1032 include diagnosis, prevention and treatment of diseases and clinical conditions associated with TLR4.

Tumor necrosis factor receptor superfamily, member 6 (TNFRSF6, Accession NP_690616.1) is another GAM1032 target gene, herein designated TARGET GENE. TNFRSF6 BINDING SITE is a target binding site found in the 3' untranslated region of multiple transcripts of mRNA encoded by TNFRSF6, corresponding to a target binding site such as BINDING SITE I, BINDING SITE II or BINDING SITE III of FIG. 8. Table 4 illustrates the complementarity of the nucleotide sequences of TNFRSF6 BINDING SITE, designated SEQ ID:3084, to the nucleotide sequence of GAM1032 RNA, herein designated GAM RNA, also designated SEQ ID:303.

Another function of GAM1032 is therefore inhibition of Tumor necrosis factor receptor superfamily, member 6 (TNFRSF6, Accession NP_690616.1). Accordingly, utilities of GAM1032 include diagnosis, prevention and treatment of diseases and clinical conditions associated with TNFRSF6.

Tumor necrosis factor receptor superfamily, member 6 (TNFRSF6, Accession NP_690612.1) is another GAM1032 target gene, herein designated TARGET GENE. TNFRSF6 BINDING SITE is a target binding site found in the 3' untranslated region of multiple transcripts of mRNA encoded by TNFRSF6, corresponding to a target binding site such as BINDING SITE I, BINDING SITE II or BINDING SITE III of FIG. 8. Table 4 illustrates the complementarity of the nucleotide sequences of TNFRSF6 BINDING SITE, designated SEQ ID:3084, to the nucleotide sequence of GAM1032 RNA, herein designated GAM RNA, also designated SEQ ID:303.

Another function of GAM1032 is therefore inhibition of Tumor necrosis factor receptor superfamily, member 6 (TNFRSF6, Accession NP_690612.1). Accordingly, utilities of GAM1032 include diagnosis, prevention and treatment of diseases and clinical conditions associated with TNFRSF6.

Tumor necrosis factor receptor superfamily, member 6 (TNFRSF6, Accession NP_690615.1) is another GAM1032 target gene, herein designated TARGET GENE. TNFRSF6 BINDING SITE is a target binding site found in the 3' untranslated region of multiple transcripts of mRNA encoded by TNFRSF6, corresponding to a target binding site such as BINDING SITE I, BINDING SITE II or BINDING SITE III of FIG. 8. Table 4 illustrates the complementarity of the nucleotide sequences of TNFRSF6 BINDING SITE, designated SEQ ID:3084, to the nucleotide sequence of GAM1032 RNA, herein designated GAM RNA, also designated SEQ ID:303.

Another function of GAM1032 is therefore inhibition of Tumor necrosis factor receptor superfamily, member 6 (TNFRSF6, Accession NP_690615.1). Accordingly, utilities of GAM1032 include diagnosis, prevention and treatment of diseases and clinical conditions associated with TNFRSF6.

Tumor necrosis factor receptor superfamily, member 6 (TNFRSF6, Accession NP_690614.1) is another GAM1032 target gene, herein designated TARGET GENE. TNFRSF6 BINDING SITE is a target binding site found in the 3' untranslated region of multiple transcripts of mRNA encoded by TNFRSF6, corresponding to a target binding site such as BINDING SITE I, BINDING SITE II or BINDING SITE III of FIG. 8. Table 4 illustrates the complementarity of the nucleotide sequences of TNFRSF6 BINDING SITE, designated SEQ ID:3084, to the nucleotide sequence of GAM1032 RNA, herein designated GAM RNA, also designated SEQ ID:303.

Another function of GAM1032 is therefore inhibition of Tumor necrosis factor receptor superfamily, member 6 (TNFRSF6, Accession NP_690614.1). Accordingly, utilities of GAM1032 include diagnosis, prevention and treatment of diseases and clinical conditions associated with TNFRSF6.

Tumor necrosis factor receptor superfamily, member 6 (TNFRSF6, Accession NP_690611.1) is another GAM1032 target gene, herein designated TARGET GENE. TNFRSF6 BINDING SITE is a target binding site found in the 3' untranslated region of multiple transcripts of mRNA encoded by TNFRSF6, corresponding to a target binding site such as BINDING SITE I, BINDING SITE II or BINDING SITE III of FIG. 8. Table 4 illustrates the complementarity of the nucleotide sequences of TNFRSF6 BINDING SITE, designated SEQ ID:3084, to the nucleotide sequence of GAM1032 RNA, herein designated GAM RNA, also designated SEQ ID:303.

Another function of GAM1032 is therefore inhibition of Tumor necrosis factor receptor superfamily, member 6 (TNFRSF6, Accession NP_690611.1). Accordingly, utilities of GAM1032 include diagnosis, prevention and treatment of diseases and clinical conditions associated with TNFRSF6.

Tumor necrosis factor receptor superfamily, member 6 (TNFRSF6, Accession NP_690613.1) is another GAM1032 target gene, herein designated TARGET GENE. TNFRSF6 BINDING SITE is a target binding site found in the 3' untranslated region of multiple transcripts of mRNA encoded by TNFRSF6, corresponding to a target binding site such as BINDING SITE I, BINDING SITE II or BINDING SITE III of FIG. 8. Table 4 illustrates the complementarity of the nucleotide sequences of TNFRSF6 BINDING SITE, designated SEQ ID:3084, to the nucleotide sequence of GAM1032 RNA, herein designated GAM RNA, also designated SEQ ID:303.

Another function of GAM1032 is therefore inhibition of Tumor necrosis factor receptor superfamily, member 6 (TNFRSF6, Accession NP_690613.1). Accordingly, utilities of GAM1032 include diagnosis, prevention and treatment of diseases and clinical conditions associated with TNFRSF6.

TOLLIP (Accession NP_061882.2) is another GAM1032 target gene, herein designated TARGET GENE. TOLLIP BINDING SITE is a target binding site found in the 3' untranslated region of mRNA encoded by TOLLIP, corresponding to a target binding site such as BINDING SITE I, BINDING SITE II or BINDING SITE III of FIG. 8. Table 4 illustrates the complementarity of the nucleotide sequences of TOLLIP BINDING SITE, designated SEQ ID:13742, to the nucleotide sequence of GAM1032 RNA, herein designated GAM RNA, also designated SEQ ID:303.

Another function of GAM1032 is therefore inhibition of TOLLIP (Accession NP_061882.2). Accordingly, utilities of GAM1032 include diagnosis, prevention and treatment of diseases and clinical conditions associated with TOLLIP.

Tyrosinase-related protein 1 (TYRP1, Accession NP_000541.1) is another GAM1032 target gene, herein designated TARGET GENE. TYRP1 BINDING SITE is a target binding site found in the 5' untranslated region of mRNA encoded by TYRP1, corresponding to a target binding site such as BINDING SITE I, BINDING SITE II or BINDING SITE III of FIG. 8. Table 4 illustrates the complementarity of the nucleotide sequences of TYRP1 BINDING SITE, designated SEQ ID:11984, to the nucleotide sequence of GAM1032 RNA, herein designated GAM RNA, also designated SEQ ID:303.

Another function of GAM1032 is therefore inhibition of Tyrosinase-related protein 1 (TYRP1, Accession NP_000541.1). Accordingly, utilities of GAM1032 include diagnosis, prevention and treatment of diseases and clinical conditions associated with TYRP1.

USP12L1 (Accession XP_167944.1) is another GAM1032 target gene, herein designated TARGET GENE. USP12L1 BINDING SITE is a target binding site found in the 3' untranslated region of mRNA encoded by USP12L1, corresponding to a target binding site such as BINDING SITE I, BINDING SITE II or BINDING SITE III of FIG. 8. Table 4 illustrates the complementarity of the nucleotide sequences of USP12L1 BINDING SITE, designated SEQ ID:8209, to the nucleotide sequence of GAM1032 RNA, herein designated GAM RNA, also designated SEQ ID:303.

Another function of GAM1032 is therefore inhibition of USP12L1 (Accession XP_167944.1). Accordingly, utilities of GAM1032 include diagnosis, prevention and treatment of diseases and clinical conditions associated with USP12L1.

VIPL (Accession NP_110432.1) is another GAM1032 target gene, herein designated TARGET GENE. VIPL BINDING SITE is a target binding site found in the 3' untranslated region of mRNA encoded by VIPL, corresponding to a target binding site such as BINDING SITE I, BINDING SITE II or BINDING SITE III of FIG. 8. Table 4 illustrates the complementarity of the nucleotide sequences of VIPL BINDING SITE, designated SEQ ID:9897, to the nucleotide sequence of GAM1032 RNA, herein designated GAM RNA, also designated SEQ ID:303.

Another function of GAM1032 is therefore inhibition of VIPL (Accession NP_110432.1). Accordingly, utilities of GAM1032 include diagnosis, prevention and treatment of diseases and clinical conditions associated with VIPL.

Ww domain binding protein 2 (WBP2, Accession NP_036610.2) is another GAM1032 target gene, herein designated TARGET GENE. WBP2 BINDING SITE is a target binding site found in the 3' untranslated region of mRNA encoded by WBP2, corresponding to a target binding site such as BINDING SITE I, BINDING SITE II or BINDING SITE III of FIG. 8. Table 4 illustrates the complementarity of the nucleotide sequences of WBP2 BINDING SITE, designated SEQ ID:17972, to the nucleotide sequence of GAM1032 RNA, herein designated GAM RNA, also designated SEQ ID:303.

Another function of GAM1032 is therefore inhibition of Ww domain binding protein 2 (WBP2, Accession NP_036610.2), a gene which binds with high affinity to the WW domain contained in cancer, and Accordingly, utilities of GAM1032 include diagnosis, prevention and treatment of diseases and clinical conditions associated with WBP2.

The function of WBP2 and its association with various diseases and clinical conditions, has been established by previous studies, as described hereinabove with reference to GAM342.2. ZAK (Accession NP_598407.1) is another GAM1032 target gene, herein designated TARGET GENE. ZAK BINDING SITE is a target binding site found in the 3' untranslated region of multiple transcripts of mRNA encoded by ZAK, corresponding to a target binding site such as BINDING SITE I, BINDING SITE II or BINDING SITE III of FIG. 8. Table 4 illustrates the complementarity of the nucleotide sequences of ZAK BINDING SITE, designated SEQ ID:5951, to the nucleotide sequence of GAM1032 RNA, herein designated GAM RNA, also designated SEQ ID:303.

Another function of GAM1032 is therefore inhibition of ZAK (Accession NP_598407.1). Accordingly, utilities of GAM1032 include diagnosis, prevention and treatment of diseases and clinical conditions associated with ZAK.

FIG. 8 further provides a conceptual description of a novel bioinformatically detected of the present invention, referred to here as Genomic Address Messenger 1338 (GAM1338), which modulates expression of respective target genes thereof, the function and utility of which target genes is known in the art.

GAM1338 is a novel bioinformatically detected regulatory, non protein coding, micro RNA (miRNA) gene. The method by which GAM1338 was detected is described hereinabove with reference to FIGS. 8-15.

GAM1338 gene, herein designated GAM GENE, and GAM1338 target gene, herein designated TARGET GENE, are human genes contained in the human genome.

GAM1338 gene encodes a GAM1338 precursor RNA, herein designated GAM PRECURSOR RNA. Similar to other miRNA genes, and unlike most ordinary genes, GAM1338 precursor RNA does not encode a protein. A nucleotide sequence identical or highly similar to the nucleotide sequence of GAM1338 precursor RNA is designated SEQ ID:36, and is provided hereinbelow with reference to the sequence listing part.

GAM1338 precursor RNA folds onto itself, forming GAM1338 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM1338 precursor RNA folds onto itself, forming GAM1338 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM1338 precursor RNA, designated SEQ-ID:36, and a schematic representation of a predicted secondary folding of GAM1338 folded precursor RNA are further described with reference to Table 2, hereby incorporated by reference.

An enzyme complex designated DICER COMPLEX, 'dices' the GAM1338 folded precursor RNA into GAM1338 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM1338 RNA is designated SEQ ID:360, and is provided hereinbelow with references to the sequence listing part and Table 3, hereby incorporated by reference.

GAM1338 target gene, herein designated TARGET GENE, encodes a corresponding messenger RNA, GAM1338 target RNA, herein designated GAM TARGET RNA. GAM1338 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM1338 RNA, herein designated GAM RNA, binds complementarily to one or more target binding sites located in untranslated regions of GAM1338 target RNA, herein designated GAM TARGET RNA. This complementary binding is due to the fact that the nucleotide sequence of GAM1338 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM1338 RNA may have a different number of target binding sites in untranslated regions of a GAM1338 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM1338 RNA, herein designated GAM RNA, to target binding sites on GAM1338 target RNA, herein designated GAM TARGET RNA, such as BINDING SITE I, BINDING SITE II and BINDING SITE III, inhibits translation of GAM1338 target RNA into GAM1338 target protein, herein designated GAM TARGET PROTEIN. GAM target protein is therefore outlined by a broken line.

It is appreciated that GAM1338 target gene, herein designated TARGET GENE, in fact represents a plurality of GAM1338 target genes. The mRNA of each one of this plurality of GAM1338 target genes comprises one or more target binding sites, each having a nucleotide sequence which is at least partly complementary to GAM1338 RNA, herein designated GAM RNA, and which when bound by GAM1338 RNA causes inhibition of translation of respective one or more GAM1338 target proteins.

It is further appreciated by one skilled in the art that the mode of translational inhibition illustrated by FIG. 8 with specific reference to translational inhibition exerted by GAM1338 gene, herein designated GAM GENE, on one or more GAM1338 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM1338 correlate with, and may be deduced from, the identity of the target genes which GAM1338 binds and inhibits, and the function of these target genes, as elaborated hereinbelow.

15E1.2 (Accession XP_290596.1) is a GAM1338 target gene, herein designated TARGET GENE. 15E1.2 BINDING SITE is a target binding site found in the 3' untranslated region of mRNA encoded by 15E1.2, corresponding to a target binding site such as BINDING SITE I, BINDING SITE II or BINDING SITE III of FIG. 8. Table 4 illustrates the complementarity of the nucleotide sequences of 15E1.2 BINDING SITE, designated SEQ ID:13885, to the nucleotide sequence of GAM1338 RNA, herein designated GAM RNA, also designated SEQ ID:360.

A function of GAM1338 is therefore inhibition of 15E1.2 (Accession XP_290596.1). Accordingly, utilities of GAM1338 include diagnosis, prevention and treatment of diseases and clinical conditions associated with 15E1.2.

7h3 (Accession NP_149014.2) is another GAM1338 target gene, herein designated TARGET GENE. 7h3 BINDING SITE is a target binding site found in the 3' untranslated region of mRNA encoded by 7h3, corresponding to a target binding site such as BINDING SITE I, BINDING SITE II or BINDING SITE III of FIG. 8. Table 4 illustrates the complementarity of the nucleotide sequences of 7h3 BINDING SITE, designated SEQ ID:16813, to the nucleotide sequence of GAM1338 RNA, herein designated GAM RNA, also designated SEQ ID:360.

Another function of GAM1338 is therefore inhibition of 7h3 (Accession NP_149014.2). Accordingly, utilities of GAM1338 include diagnosis, prevention and treatment of diseases and clinical conditions associated with 7h3.

Alpha-1-b glycoprotein (A1BG, Accession NP_570602.2) is another GAM1338 target gene, herein designated TARGET GENE. A1BG BINDING SITE1 and A1BG BINDING SITE2 are target binding sites found in untranslated regions of mRNA encoded by A1BG, corresponding to target binding sites such as BINDING SITE I, BINDING SITE II or BINDING SITE III of FIG. 8. Table 4 illustrates the complementarity of the nucleotide sequences of A1BG BINDING SITE1 and A1BG BINDING SITE2, designated SEQ ID:10791 and SEQ ID:19693 respectively, to the nucleotide sequence of GAM1338 RNA, herein designated GAM RNA, also designated SEQ ID:360.

Another function of GAM1338 is therefore inhibition of Alpha-1-b glycoprotein (A1BG, Accession NP_570602.2), a gene which a plasma protein of unknown function. Accordingly, utilities of GAM1338 include diagnosis, prevention and treatment of diseases and clinical conditions associated with A1BG.

The function of A1BG and its association with various diseases and clinical conditions, has been established by previous studies, as described hereinabove with reference to GAM130.1. A2BP1 (Accession NP_061193.2) is another GAM1338 target gene, herein designated TARGET GENE. A2BP1 BINDING SITE is a target binding site found in the 5' untranslated region of multiple transcripts of mRNA encoded by A2BP1, corresponding to a target binding site such as BINDING SITE I, BINDING SITE II or BINDING SITE III of FIG. 8. Table 4 illustrates the complementarity of the nucleotide sequences of A2BP1 BINDING SITE, designated SEQ ID:1212, to the nucleotide sequence of GAM1338 RNA, herein designated GAM RNA, also designated SEQ ID:360.

Another function of GAM1338 is therefore inhibition of A2BP1 (Accession NP_061193.2). Accordingly, utilities of GAM1338 include diagnosis, prevention and treatment of diseases and clinical conditions associated with A2BP1.

Aminoadipate-semialdehyde synthase (AASS, Accession NP_005754.2) is another GAM1338 target gene, herein designated TARGET GENE. AASS BINDING SITE is a target binding site found in the 3' untranslated region of mRNA encoded by AASS, corresponding to a target binding site such as BINDING SITE I, BINDING SITE II or BINDING SITE III of FIG. 8. Table 4 illustrates the complementarity of the nucleotide sequences of AASS BINDING SITE, designated SEQ ID:18163, to the nucleotide sequence of GAM1338 RNA, herein designated GAM RNA, also designated SEQ ID:360.

Another function of GAM1338 is therefore inhibition of Aminoadipate-semialdehyde synthase (AASS, Accession NP_005754.2). Accordingly, utilities of GAM1338 include diagnosis, prevention and treatment of diseases and clinical conditions associated with AASS.

ABCA13 (Accession NP_689914.2) is another GAM1338 target gene, herein designated TARGET GENE.

ABCA13 BINDING SITE is a target binding site found in the 3' untranslated region of mRNA encoded by ABCA13, corresponding to a target binding site such as BINDING SITE I, BINDING SITE II or BINDING SITE III of FIG. 8. Table 4 illustrates the complementarity of the nucleotide sequences of ABCA13 BINDING SITE, designated SEQ ID:13800, to the nucleotide sequence of GAM1338 RNA, herein designated GAM RNA, also designated SEQ ID:360.

Another function of GAM1338 is therefore inhibition of ABCA13 (Accession NP_689914.2). Accordingly, utilities of GAM1338 include diagnosis, prevention and treatment of diseases and clinical conditions associated with ABCA13.

Atp-binding cassette, sub-family c (cftr/mrp), member 11 (ABCC11, Accession NP_149163.2) is another GAM1338 target gene, herein designated TARGET GENE. ABCC11 BINDING SITE is a target binding site found in the 5' untranslated region of multiple transcripts of mRNA encoded by ABCC11, corresponding to a target binding site such as BINDING SITE I, BINDING SITE II or BINDING SITE III of FIG. 8. Table 4 illustrates the complementarity of the nucleotide sequences of ABCC11 BINDING SITE, designated SEQ ID:18047, to the nucleotide sequence of GAM1338 RNA, herein designated GAM RNA, also designated SEQ ID:360.

Another function of GAM1338 is therefore inhibition of Atp-binding cassette, sub-family c (cftr/mrp), member 11 (ABCC11, Accession NP_149163.2), a gene which acts as a multispecific organic anion pump which can transport nucleotide analogs (by similarity). Accordingly, utilities of GAM1338 include diagnosis, prevention and treatment of diseases and clinical conditions associated with ABCC11.

The function of ABCC11 and its association with various diseases and clinical conditions, has been established by previous studies, as described hereinabove with reference to GAM189.1. Acyl-coenzyme a dehydrogenase, short/branched chain (ACADSB, Accession NP_001600.1) is another GAM1338 target gene, herein designated TARGET GENE. ACADSB BINDING SITE is a target binding site found in the 3' untranslated region of mRNA encoded by ACADSB, corresponding to a target binding site such as BINDING SITE I, BINDING SITE II or BINDING SITE III of FIG. 8. Table 4 illustrates the complementarity of the nucleotide sequences of ACADSB BINDING SITE, designated SEQ ID:14907, to the nucleotide sequence of GAM1338 RNA, herein designated GAM RNA, also designated SEQ ID:360.

Another function of GAM1338 is therefore inhibition of Acyl-coenzyme a dehydrogenase, short/branched chain (ACADSB, Accession NP_001600.1). Accordingly, utilities of GAM1338 include diagnosis, prevention and treatment of diseases and clinical conditions associated with ACADSB.

AGO4 (Accession NP_060099.2) is another GAM1338 target gene, herein designated TARGET GENE. AGO4 BINDING SITE is a target binding site found in the 3' untranslated region of mRNA encoded by AGO4, corresponding to a target binding site such as BINDING SITE I, BINDING SITE II or BINDING SITE III of FIG. 8. Table 4 illustrates the complementarity of the nucleotide sequences of AGO4 BINDING SITE, designated SEQ ID:13702, to the nucleotide sequence of GAM1338 RNA, herein designated GAM RNA, also designated SEQ ID:360.

Another function of GAM1338 is therefore inhibition of AGO4 (Accession NP_060099.2). Accordingly, utilities of GAM1338 include diagnosis, prevention and treatment of diseases and clinical conditions associated with AGO4.

Aryl hydrocarbon receptor (AHR, Accession NP_001612.1) is another GAM1338 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:9011, to the nucleotide sequence of GAM1338 RNA, herein designated GAM RNA, also designated SEQ ID:360.

Another function of GAM1338 is therefore inhibition of Aryl hydrocarbon receptor (AHR, Accession NP_001612.1), a gene which plays a role in modulating carcinogenesis through the induction of xenobiotic-metabolizing enzymes and therefore may be associated with Stomach tumors. Accordingly, utilities of GAM1338 include diagnosis, prevention and treatment of Stomach tumors, and of other diseases and clinical conditions associated with AHR.

The function of AHR and its association with various diseases and clinical conditions, has been established by previous studies, as described hereinabove with reference to GAM30.1. Absent in melanoma 1 (AIM1, Accession XP_166300.1) is another GAM1338 target gene, herein designated TARGET GENE. AIM1 BINDING SITE is a target binding site found in the 3' untranslated region of mRNA encoded by AIM1, corresponding to a target binding site such as BINDING SITE I, BINDING SITE II or BINDING SITE III of FIG. 8. Table 4 illustrates the complementarity of the nucleotide sequences of AIM1 BINDING SITE, designated SEQ ID:1383, to the nucleotide sequence of GAM1338 RNA, herein designated GAM RNA, also designated SEQ ID:360.

Another function of GAM1338 is therefore inhibition of Absent in melanoma 1 (AIM1, Accession XP_166300.1), a gene which is altered in association with tumor suppression in a model of human melanoma and therefore may be associated with Malignant melanoma. Accordingly, utilities of GAM1338 include diagnosis, prevention and treatment of Malignant melanoma, and of other diseases and clinical conditions associated with AIM1.

The function of AIM1 and its association with various diseases and clinical conditions, has been established by previous studies, as described hereinabove with reference to GAM136.1. A kinase (prka) anchor protein 8 (AKAP8, Accession NP_005849.1) is another GAM1338 target gene, herein designated TARGET GENE. AKAP8 BINDING SITE is a target binding site found in the 3' untranslated region of mRNA encoded by AKAP8, corresponding to a target binding site such as BINDING SITE I, BINDING SITE II or BINDING SITE III of FIG. 8. Table 4 illustrates the complementarity of the nucleotide sequences of AKAP8 BINDING SITE, designated SEQ ID:2643, to the nucleotide sequence of GAM1338 RNA, herein designated GAM RNA, also designated SEQ ID:360.

Another function of GAM1338 is therefore inhibition of A kinase (prka) anchor protein 8 (AKAP8, Accession NP_005849.1). Accordingly, utilities of GAM1338 include diagnosis, prevention and treatment of diseases and clinical conditions associated with AKAP8.

Aldehyde dehydrogenase 1 family, member b1 (ALDH1B1, Accession NP_000683.3) is another GAM1338 target gene, herein designated TARGET GENE. ALDH1B1 BINDING SITE is a target binding site found in the 3' untranslated region of mRNA encoded by ALDH1B1, corresponding to a target binding site such as BINDING SITE I, BINDING SITE II or BINDING SITE III of FIG. 8. Table 4 illustrates the complementarity of the nucleotide sequences of ALDH1B1 BINDING SITE, designated SEQ ID:19434, to the nucleotide sequence of GAM1338 RNA, herein designated GAM RNA, also designated SEQ ID:360.

Another function of GAM1338 is therefore inhibition of Aldehyde dehydrogenase 1 family, member b1 (ALDH1B1, Accession NP_000683.3). Accordingly, utilities of GAM1338 include diagnosis, prevention and treatment of diseases and clinical conditions associated with ALDH1B1.

Arachidonate 15-lipoxygenase (ALOX15, Accession NP_001131.1) is another GAM1338 target gene, herein designated TARGET GENE. ALOX15 BINDING SITE is a target binding site found in the 3' untranslated region of mRNA encoded by ALOX15, corresponding to a target binding site such as BINDING SITE I, BINDING SITE II or BINDING SITE III of FIG. 8. Table 4 illustrates the complementarity of the nucleotide sequences of ALOX15 BINDING SITE, designated SEQ ID:18901, to the nucleotide sequence of GAM1338 RNA, herein designated GAM RNA, also designated SEQ ID:360.

Another function of GAM1338 is therefore inhibition of Arachidonate 15-lipoxygenase (ALOX15, Accession NP_001131.1), a gene which converts arachidonic acid to 15s-hydroperoxyeicosatetraenoic acid. Accordingly, utilities of GAM1338 include diagnosis, prevention and treatment of diseases and clinical conditions associated with ALOX15.

The function of ALOX15 and its association with various diseases and clinical conditions, has been established by previous studies, as described hereinabove with reference to GAM189.1. AMID (Accession NP_116186.1) is another GAM1338 target gene, herein designated TARGET GENE. AMID BINDING SITE is a target binding site found in the 3' untranslated region of mRNA encoded by AMID, corresponding to a target binding site such as BINDING SITE I, BINDING SITE II or BINDING SITE III of FIG. 8. Table 4 illustrates the complementarity of the nucleotide sequences of AMID BINDING SITE, designated SEQ ID:2328, to the nucleotide sequence of GAM1338 RNA, herein designated GAM RNA, also designated SEQ ID:360.

Another function of GAM1338 is therefore inhibition of AMID (Accession NP_116186.1). Accordingly, utilities of GAM1338 include diagnosis, prevention and treatment of diseases and clinical conditions associated with AMID.

Ankyrin repeat domain 6 (ANKRD6, Accession NP_055757.1) is another GAM1338 target gene, herein designated TARGET GENE. ANKRD6 BINDING SITE is a target binding site found in the 3' untranslated region of mRNA encoded by ANKRD6, corresponding to a target binding site such as BINDING SITE I, BINDING SITE II or BINDING SITE III of FIG. 8. Table 4 illustrates the complementarity of the nucleotide sequences of ANKRD6 BINDING SITE, designated SEQ ID:11653, to the nucleotide sequence of GAM1338 RNA, herein designated GAM RNA, also designated SEQ ID:360.

Another function of GAM1338 is therefore inhibition of Ankyrin repeat domain 6 (ANKRD6, Accession NP_055757.1). Accordingly, utilities of GAM1338 include diagnosis, prevention and treatment of diseases and clinical conditions associated with ANKRD6.

AP1S3 (Accession XP_291023.1) is another GAM1338 target gene, herein designated TARGET GENE. AP1S3 BINDING SITE is a target binding site found in the 3' untranslated region of multiple transcripts of mRNA encoded by AP1S3, corresponding to a target binding site such as BINDING SITE I, BINDING SITE II or BINDING SITE III of FIG. 8. Table 4 illustrates the complementarity of the nucleotide sequences of AP1S3 BINDING SITE, designated SEQ ID:15779, to the nucleotide sequence of GAM1338 RNA, herein designated GAM RNA, also designated SEQ ID:360.

Another function of GAM1338 is therefore inhibition of AP1S3 (Accession XP_291023.1). Accordingly, utilities of GAM1338 include diagnosis, prevention and treatment of diseases and clinical conditions associated with AP1S3.

Adaptor-related protein complex 3, sigma 2 subunit (AP3S2, Accession NP_005820.1) is another GAM1338 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:6113, to the nucleotide sequence of GAM1338 RNA, herein designated GAM RNA, also designated SEQ ID:360.

Another function of GAM1338 is therefore inhibition of Adaptor-related protein complex 3, sigma 2 subunit (AP3S2, Accession NP_005820.1). Accordingly, utilities of GAM1338 include diagnosis, prevention and treatment of diseases and clinical conditions associated with AP3S2.

Apoptotic protease activating factor (APAF1, Accession NP_001151.1) is another GAM1338 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:803 and SEQ ID:803 respectively, to the nucleotide sequence of GAM1338 RNA, herein designated GAM RNA, also designated SEQ ID:360.

Another function of GAM1338 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM1338 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apoptotic protease activating factor (APAF1, Accession NP_001151.1) is another GAM1338 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:1306 and SEQ ID:1306 respectively, to the nucleotide sequence of GAM1338 RNA, herein designated GAM RNA, also designated SEQ ID:360.

Another function of GAM1338 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM1338 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. APM1 (Accession NP_004788.1) is another GAM1338 target gene, herein designated TARGET GENE. APM1 BINDING SITE1 through APM1 BINDING SITE3 are target binding sites found in untranslated regions of mRNA encoded by APM1, corresponding to target binding sites such as BINDING SITE I, BINDING SITE II or BINDING SITE III of FIG. 8. Table 4 illustrates the complementarity of the nucleotide sequences of APM1 BINDING SITE1 through APM1 BINDING SITE3, designated SEQ ID:13551, SEQ ID:1962 and SEQ ID:2268 respectively, to the nucleotide sequence of GAM1338 RNA, herein designated GAM RNA, also designated SEQ ID:360.

Another function of GAM1338 is therefore inhibition of APM1 (Accession NP_004788.1). Accordingly, utilities of GAM1338 include diagnosis, prevention and treatment of diseases and clinical conditions associated with APM1.

Apolipoprotein 1, 2 (APOL2, Accession NP_112092.1) is another GAM1338 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:16087, to the nucleotide sequence of GAM1338 RNA, herein designated GAM RNA, also designated SEQ ID:360.

Another function of GAM1338 is therefore inhibition of Apolipoprotein 1, 2 (APOL2, Accession NP_112092.1). Accordingly, utilities of GAM1338 include diagnosis, prevention and treatment of diseases and clinical conditions associated with APOL2.

Apolipoprotein 1, 2 (APOL2, Accession NP_663612.1) is another GAM1338 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:16087, to the nucleotide sequence of GAM1338 RNA, herein designated GAM RNA, also designated SEQ ID:360.

Another function of GAM1338 is therefore inhibition of Apolipoprotein 1, 2 (APOL2, Accession NP_663612.1). Accordingly, utilities of GAM1338 include diagnosis, prevention and treatment of diseases and clinical conditions associated with APOL2.

Amyloid beta precursor protein (cytoplasmic tail) binding protein 2 (APPBP2, Accession NP_006371.2) is another GAM1338 target gene, herein designated TARGET GENE. APPBP2 BINDING SITE is a target binding site found in the 3' untranslated region of mRNA encoded by APPBP2, corresponding to a target binding site such as BINDING SITE I, BINDING SITE II or BINDING SITE III of FIG. 8. Table 4 illustrates the complementarity of the nucleotide sequences of APPBP2 BINDING SITE, designated SEQ ID:20094, to the nucleotide sequence of GAM1338 RNA, herein designated GAM RNA, also designated SEQ ID:360.

Another function of GAM1338 is therefore inhibition of Amyloid beta precursor protein (cytoplasmic tail) binding protein 2 (APPBP2, Accession NP_006371.2), a gene which interacts with the basolateral sorting signal of amyloid precursor protein. and therefore may be associated with Alzheimer's disease. Accordingly, utilities of GAM1338 include diagnosis, prevention and treatment of Alzheimer's disease, and of other diseases and clinical conditions associated with APPBP2.

The function of APPBP2 and its association with various diseases and clinical conditions, has been established by previous studies, as described hereinabove with reference to GAM130.1. APPL (Accession NP_036228.1) is another GAM1338 target gene, herein designated TARGET GENE. APPL BINDING SITE is a target binding site found in the 3' untranslated region of mRNA encoded by APPL, corresponding to a target binding site such as BINDING SITE I, BINDING SITE II or BINDING SITE III of FIG. 8. Table 4 illustrates the complementarity of the nucleotide sequences of APPL BINDING SITE, designated SEQ ID:12386, to the nucleotide sequence of GAM1338 RNA, herein designated GAM RNA, also designated SEQ ID:360.

Another function of GAM1338 is therefore inhibition of APPL (Accession NP_036228.1). Accordingly, utilities of GAM1338 include diagnosis, prevention and treatment of diseases and clinical conditions associated with APPL.

Aquaporin 6, kidney specific (AQP6, Accession NP_445738.1) is another GAM1338 target gene, herein designated TARGET GENE. AQP6 BINDING SITE1 and AQP6 BINDING SITE2 are target binding sites found in untranslated regions of multiple transcripts of mRNA encoded by AQP6, corresponding to target binding sites such as BINDING SITE I, BINDING SITE II or BINDING SITE III of FIG. 8. Table 4 illustrates the complementarity of the nucleotide sequences of AQP6 BINDING SITE1 and AQP6 BINDING SITE2, designated SEQ ID:16104 and SEQ ID:2103 respectively, to the nucleotide sequence of GAM1338 RNA, herein designated GAM RNA, also designated SEQ ID:360.

Another function of GAM1338 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM1338 include diagnosis, prevention and treatment of diseases and clinical conditions associated with AQP6.

The function of AQP6 and its association with various diseases and clinical conditions, has been established by previous studies, as described hereinabove with reference to GAM51.1. Aquaporin 6, kidney specific (AQP6, Accession NP_001643.1) is another GAM1338 target gene, herein designated TARGET GENE. AQP6 BINDING SITE1 and AQP6 BINDING SITE2 are target binding sites found in untranslated regions of multiple transcripts of mRNA encoded by AQP6, corresponding to target binding sites such as BINDING SITE I, BINDING SITE II or BINDING SITE III of FIG. 8. Table 4 illustrates the complementarity of the nucleotide sequences of AQP6 BINDING SITE1 and AQP6 BINDING SITE2, designated SEQ ID:2103 and SEQ ID:13404 respectively, to the nucleotide sequence of GAM1338 RNA, herein designated GAM RNA, also designated SEQ ID:360.

Another function of GAM1338 is therefore inhibition of Aquaporin 6, kidney specific (AQP6, Accession NP_001643.1), a gene which participates in distinct physiologic function such as glomerular filtration, tubular endocytosis, and acid-base-metabolism. Accordingly, utilities of GAM1338 include diagnosis, prevention and treatment of diseases and clinical conditions associated with AQP6.

The function of AQP6 and its association with various diseases and clinical conditions, has been established by previous studies, as described hereinabove with reference to GAM51.1. Ras homolog gene family, member f (in filopodia) (ARHF, Accession NP_061907.1) is another GAM1338 target gene, herein designated TARGET GENE. ARHF BIND- ING SITE is a target binding site found in the 3' untranslated region of mRNA encoded by ARHF, corresponding to a target binding site such as BINDING SITE I, BINDING SITE II or BINDING SITE III of FIG. 8. Table 4 illustrates the complementarity of the nucleotide sequences of ARHF BINDING SITE, designated SEQ ID:3172, to the nucleotide sequence of GAM1338 RNA, herein designated GAM RNA, also designated SEQ ID:360.

Another function of GAM1338 is therefore inhibition of Ras homolog gene family, member f (in filopodia) (ARHF, Accession NP_061907.1). Accordingly, utilities of GAM1338 include diagnosis, prevention and treatment of diseases and clinical conditions associated with ARHF.

Rho gtpase activating protein 1 (ARHGAP1, Accession NP_004299.1) is another GAM1338 target gene, herein designated TARGET GENE. ARHGAP1 BINDING SITE is a target binding site found in the 3' untranslated region of mRNA encoded by ARHGAP1, corresponding to a target binding site such as BINDING SITE I, BINDING SITE II or BINDING SITE III of FIG. 8. Table 4 illustrates the complementarity of the nucleotide sequences of ARHGAP1 BINDING SITE, designated SEQ ID:8690, to the nucleotide sequence of GAM1338 RNA, herein designated GAM RNA, also designated SEQ ID:360.

Another function of GAM1338 is therefore inhibition of Rho gtpase activating protein 1 (ARHGAP1, Accession NP_004299.1). Accordingly, utilities of GAM1338 include diagnosis, prevention and treatment of diseases and clinical conditions associated with ARHGAP1.

ARHGAP11A (Accession NP_055598.1) is another GAM1338 target gene, herein designated TARGET GENE. ARHGAP11A BINDING SITE is a target binding site found in the 3' untranslated region of mRNA encoded by ARHGAP11A, corresponding to a target binding site such as BINDING SITE I, BINDING SITE II or BINDING SITE III of FIG. 8. Table 4 illustrates the complementarity of the nucleotide sequences of ARHGAP11A BINDING SITE, designated SEQ ID:7085, to the nucleotide sequence of GAM1338 RNA, herein designated GAM RNA, also designated SEQ ID:360.

Another function of GAM1338 is therefore inhibition of ARHGAP11A (Accession NP_055598.1). Accordingly, utilities of GAM1338 include diagnosis, prevention and treatment of diseases and clinical conditions associated with ARHGAP11A.

ARPP-19 (Accession NP_006619.1) is another GAM1338 target gene, herein designated TARGET GENE. ARPP-19 BINDING SITE is a target binding site found in the 3' untranslated region of mRNA encoded by ARPP-19, corresponding to a target binding site such as BINDING SITE I, BINDING SITE II or BINDING SITE III of FIG. 8. Table 4 illustrates the complementarity of the nucleotide sequences of ARPP-19 BINDING SITE, designated SEQ ID:18664, to the nucleotide sequence of GAM1338 RNA, herein designated GAM RNA, also designated SEQ ID:360.

Another function of GAM1338 is therefore inhibition of ARPP-19 (Accession NP_006619.1). Accordingly, utilities of GAM1338 include diagnosis, prevention and treatment of diseases and clinical conditions associated with ARPP-19.

Ankyrin repeat and socs box-containing 16 (ASB16, Accession NP_543139.4) is another GAM1338 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:11661, to the nucleotide sequence of GAM1338 RNA, herein designated GAM RNA, also designated SEQ ID:360.

Another function of GAM1338 is therefore inhibition of Ankyrin repeat and socs box-containing 16 (ASB16, Accession NP_543139.4). Accordingly, utilities of GAM1338 include diagnosis, prevention and treatment of diseases and clinical conditions associated with ASB16.

Ankyrin repeat and socs box-containing 6 (ASB6, Accession NP_821066.1) is another GAM1338 target gene, herein designated TARGET GENE. ASB6 BINDING SITE is a target binding site found in the 3' untranslated region of multiple transcripts of mRNA encoded by ASB6, corresponding to a target binding site such as BINDING SITE I, BINDING SITE II or BINDING SITE III of FIG. 8. Table 4 illustrates the complementarity of the nucleotide sequences of ASB6 BINDING SITE, designated SEQ ID:1654, to the nucleotide sequence of GAM1338 RNA, herein designated GAM RNA, also designated SEQ ID:360.

Another function of GAM1338 is therefore inhibition of Ankyrin repeat and socs box-containing 6 (ASB6, Accession NP_821066.1). Accordingly, utilities of GAM1338 include diagnosis, prevention and treatment of diseases and clinical conditions associated with ASB6.

Ankyrin repeat and socs box-containing 6 (ASB6, Accession NP_060343.1) is another GAM1338 target gene, herein designated TARGET GENE. ASB6 BINDING SITE is a target binding site found in the 3' untranslated region of multiple transcripts of mRNA encoded by ASB6, corresponding to a target binding site such as BINDING SITE I, BINDING SITE II or BINDING SITE III of FIG. 8. Table 4 illustrates the complementarity of the nucleotide sequences of ASB6 BINDING SITE, designated SEQ ID:1654, to the nucleotide sequence of GAM1338 RNA, herein designated GAM RNA, also designated SEQ ID:360.

Another function of GAM1338 is therefore inhibition of Ankyrin repeat and socs box-containing 6 (ASB6, Accession NP_060343.1). Accordingly, utilities of GAM1338 include diagnosis, prevention and treatment of diseases and clinical conditions associated with ASB6.

ASE-1 (Accession NP_036231.1) is another GAM1338 target gene, herein designated TARGET GENE. ASE-1 BINDING SITE1 and ASE-1 BINDING SITE2 are target binding sites found in untranslated regions of mRNA encoded by ASE-1, corresponding to target binding sites such as BINDING SITE I, BINDING SITE II or BINDING SITE III of FIG. 8. Table 4 illustrates the complementarity of the nucleotide sequences of ASE-1 BINDING SITE1 and ASE-1 BINDING SITE2, designated SEQ ID:9988 and SEQ ID:9101 respectively, to the nucleotide sequence of GAM1338 RNA, herein designated GAM RNA, also designated SEQ ID:360.

Another function of GAM1338 is therefore inhibition of ASE-1 (Accession NP_036231.1). Accordingly, utilities of GAM1338 include diagnosis, prevention and treatment of diseases and clinical conditions associated with ASE-1.

ATF7IP2 (Accession NP_079273.1) is another GAM1338 target gene, herein designated TARGET GENE. ATF7IP2 BINDING SITE is a target binding site found in the 3' untranslated region of mRNA encoded by ATF7IP2, corresponding to a target binding site such as BINDING SITE I, BINDING SITE II or BINDING SITE III of FIG. 8. Table 4 illustrates the complementarity of the nucleotide sequences of ATF7IP2 BINDING SITE, designated SEQ ID:12397, to the nucleotide sequence of GAM1338 RNA, herein designated GAM RNA, also designated SEQ ID:360.

Another function of GAM1338 is therefore inhibition of ATF7IP2 (Accession NP_079273.1). Accordingly, utilities of GAM1338 include diagnosis, prevention and treatment of diseases and clinical conditions associated with ATF7IP2.

Ataxia telangiectasia mutated (includes complementation groups a, c and d) (ATM, Accession NP_612150.1) is another GAM1338 target gene, herein designated TARGET GENE. ATM BINDING SITE is a target binding site found in the 3' untranslated region of multiple transcripts of mRNA encoded by ATM, corresponding to a target binding site such as BINDING SITE I, BINDING SITE II or BINDING SITE III of FIG. 8. Table 4 illustrates the complementarity of the nucleotide sequences of ATM BINDING SITE, designated SEQ ID:5585, to the nucleotide sequence of GAM1338 RNA, herein designated GAM RNA, also designated SEQ ID:360.

Another function of GAM1338 is therefore inhibition of Ataxia telangiectasia mutated (includes complementation groups a, c and d) (ATM, Accession NP_612150.1). Accordingly, utilities of GAM1338 include diagnosis, prevention and treatment of diseases and clinical conditions associated with ATM.

Atpase, na+/k+ transporting, beta 2 polypeptide (ATP1B2, Accession NP_001669.1) is another GAM1338 target gene, herein designated TARGET GENE. ATP1B2 BINDING SITE is a target binding site found in the 3' untranslated region of mRNA encoded by ATP1B2, corresponding to a target binding site such as BINDING SITE I, BINDING SITE II or BINDING SITE III of FIG. 8. Table 4 illustrates the complementarity of the nucleotide sequences of ATP1B2 BINDING SITE, designated SEQ ID:19749, to the nucleotide sequence of GAM1338 RNA, herein designated GAM RNA, also designated SEQ ID:360.

Another function of GAM1338 is therefore inhibition of Atpase, na+/k+ transporting, beta 2 polypeptide (ATP1B2, Accession NP_001669.1), a gene which catalyzes the hydrolysis of ATP coupled with the exchange of Na+/K+ ions across the plasma membrane. Accordingly, utilities of GAM1338 include diagnosis, prevention and treatment of diseases and clinical conditions associated with ATP1B2.

The function of ATP1B2 and its association with various diseases and clinical conditions, has been established by previous studies, as described hereinabove with reference to GAM130.1. Atpase, (na+)/k+ transporting, beta 4 polypeptide (ATP1B4, Accession NP_036201.1) is another GAM1338 target gene, herein designated TARGET GENE. ATP1B4 BINDING SITE is a target binding site found in the 3' untranslated region of mRNA encoded by ATP1B4, corresponding to a target binding site such as BINDING SITE I, BINDING SITE II or BINDING SITE III of FIG. 8. Table 4 illustrates the complementarity of the nucleotide sequences of ATP1B4 BINDING SITE, designated SEQ ID:15678, to the nucleotide sequence of GAM1338 RNA, herein designated GAM RNA, also designated SEQ ID:360.

Another function of GAM1338 is therefore inhibition of Atpase, (na+)/k+ transporting, beta 4 polypeptide (ATP1B4, Accession NP_036201.1). Accordingly, utilities of GAM1338 include diagnosis, prevention and treatment of diseases and clinical conditions associated with ATP1B4.

ATP6V1A (Accession NP_001681.2) is another GAM1338 target gene, herein designated TARGET GENE. ATP6V1A BINDING SITE is a target binding site found in the 3' untranslated region of mRNA encoded by ATP6V1A, corresponding to a target binding site such as BINDING SITE I, BINDING SITE II or BINDING SITE III of FIG. 8. Table 4 illustrates the complementarity of the nucleotide sequences of ATP6V1A BINDING SITE, designated SEQ ID:19693, to the nucleotide sequence of GAM1338 RNA, herein designated GAM RNA, also designated SEQ ID:360.

Another function of GAM1338 is therefore inhibition of ATP6V1A (Accession NP_001681.2). Accordingly, utilities of GAM1338 include diagnosis, prevention and treatment of diseases and clinical conditions associated with ATP6V1A.

Atpase, cu++ transporting, alpha polypeptide (menkes syndrome) (ATP7A, Accession NP_000043.1) is another GAM1338 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:19505, to the nucleotide sequence of GAM1338 RNA, herein designated GAM RNA, also designated SEQ ID:360.

Another function of GAM1338 is therefore inhibition of Atpase, cu++ transporting, alpha polypeptide (menkes syndrome) (ATP7A, Accession NP_000043.1). Accordingly, utilities of GAM1338 include diagnosis, prevention and treatment of diseases and clinical conditions associated with ATP7A.

Axl receptor tyrosine kinase (AXL, Accession NP_068713.2) is another GAM1338 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:5485, to the nucleotide sequence of GAM1338 RNA, herein designated GAM RNA, also designated SEQ ID:360.

Another function of GAM1338 is therefore inhibition of Axl receptor tyrosine kinase (AXL, Accession NP_068713.2). Accordingly, utilities of GAM1338 include diagnosis, prevention and treatment of diseases and clinical conditions associated with AXL.

Axl receptor tyrosine kinase (AXL, Accession NP_001690.2) is another GAM1338 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:5485, to the nucleotide sequence of GAM1338 RNA, herein designated GAM RNA, also designated SEQ ID:360.

Another function of GAM1338 is therefore inhibition of Axl receptor tyrosine kinase (AXL, Accession NP_001690.2). Accordingly, utilities of GAM1338 include diagnosis, prevention and treatment of diseases and clinical conditions associated with AXL.

BA108L7.2 (Accession NP_112233.2) is another GAM1338 target gene, herein designated TARGET GENE. BA108L7.2 BINDING SITE is a target binding site found in the 3' untranslated region of mRNA encoded by BA108L7.2, corresponding to a target binding site such as BINDING SITE I, BINDING SITE II or BINDING SITE III of FIG. 8. Table 4 illustrates the complementarity of the nucleotide sequences of BA108L7.2 BINDING SITE, designated SEQ ID:4652, to the nucleotide sequence of GAM1338 RNA, herein designated GAM RNA, also designated SEQ ID:360.

Another function of GAM1338 is therefore inhibition of BA108L7.2 (Accession NP_112233.2). Accordingly, utilities of GAM1338 include diagnosis, prevention and treatment of diseases and clinical conditions associated with BA108L7.2.

Bcl2-associated athanogene 5 (BAG5, Accession NP_004864.1) is another GAM1338 target gene, herein designated TARGET GENE. BAG5 BINDING SITE is a target binding site found in the 3' untranslated region of mRNA encoded by BAG5, corresponding to a target binding site such as BINDING SITE I, BINDING SITE II or BINDING SITE III of FIG. 8. Table 4 illustrates the complementarity of the nucleotide sequences of BAG5 BINDING SITE, designated SEQ ID:19878, to the nucleotide sequence of GAM1338 RNA, herein designated GAM RNA, also designated SEQ ID:360.

Another function of GAM1338 is therefore inhibition of Bcl2-associated athanogene 5 (BAG5, Accession NP_004864.1). Accordingly, utilities of GAM1338 include diagnosis, prevention and treatment of diseases and clinical conditions associated with BAG5.

Bromodomain adjacent to zinc finger domain, 2a (BAZ2A, Accession NP_038477.1) is another GAM1338 target gene, herein designated TARGET GENE. BAZ2A BINDING SITE is a target binding site found in the 5' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:16740, to the nucleotide sequence of GAM1338 RNA, herein designated GAM RNA, also designated SEQ ID:360.

Another function of GAM1338 is therefore inhibition of Bromodomain adjacent to zinc finger domain, 2a (BAZ2A, Accession NP_038477.1) . Accordingly, utilities of GAM1338 include diagnosis, prevention and treatment of diseases and clinical conditions associated with BAZ2A.

B-cell cll/lymphoma 10 (BCL10, Accession NP_003912.1) is another GAM1338 target gene, herein designated TARGET GENE. BCL10 BINDING SITE is a target binding site found in the 3' untranslated region of mRNA encoded by BCL10, corresponding to a target binding site such as BINDING SITE I, BINDING SITE II or BINDING SITE III of FIG. 8. Table 4 illustrates the complementarity of the nucleotide sequences of BCL10 BINDING SITE, designated SEQ ID:17565, to the nucleotide sequence of GAM1338 RNA, herein designated GAM RNA, also designated SEQ ID:360.

Another function of GAM1338 is therefore inhibition of B-cell cll/lymphoma 10 (BCL10, Accession NP_003912.1), a gene which is a positive regulator of lymphocyte proliferation, NF-kappaB activator. and therefore may be associated with Malt lymphoma, follicular lymphoma. Accordingly, utilities of GAM1338 include diagnosis, prevention and treatment of Malt lymphoma, follicular lymphoma, and of other diseases and clinical conditions associated with BCL10.

The function of BCL10 and its association with various diseases and clinical conditions, has been established by previous studies, as described hereinabove with reference to GAM136.1. Bradykinin receptor b1 (BDKRB1, Accession NP_000701.2) is another GAM1338 target gene, herein designated TARGET GENE. BDKRB1 BINDING SITE is a target binding site found in the 5' untranslated region of mRNA encoded by BDKRB1, corresponding to a target binding site such as BINDING SITE I, BINDING SITE II or BINDING SITE III of FIG. 8. Table 4 illustrates the complementarity of the nucleotide sequences of BDKRB1 BINDING SITE, designated SEQ ID:13940, to the nucleotide sequence of GAM1338 RNA, herein designated GAM RNA, also designated SEQ ID:360.

Another function of GAM1338 is therefore inhibition of Bradykinin receptor b1 (BDKRB1, Accession NP_000701.2), a gene which mediates intracellular calcium flux. Accordingly, utilities of GAM1338 include diagnosis, prevention and treatment of diseases and clinical conditions associated with BDKRB1.

The function of BDKRB1 and its association with various diseases and clinical conditions, has been established by previous studies, as described hereinabove with reference to GAM136.1. B double prime 1, subunit of rna polymerase iii transcription initiation factor iiib (BDP1, Accession NP_060899.1) is another GAM1338 target gene, herein designated TARGET GENE. BDP1 BINDING SITE is a target binding site found in the 3' untranslated region of mRNA encoded by BDP1, corresponding to a target binding site such as BINDING SITE I, BINDING SITE II or BINDING SITE III of FIG. 8. Table 4 illustrates the complementarity of the nucleotide sequences of BDP1 BINDING SITE, designated SEQ ID:4304, to the nucleotide sequence of GAM1338 RNA, herein designated GAM RNA, also designated SEQ ID:360.

Another function of GAM1338 is therefore inhibition of B double prime 1, subunit of rna polymerase iii transcription initiation factor iiib (BDP1, Accession NP_060899.1), a gene which activates RNA polymerase III transcription. Accordingly, utilities of GAM1338 include diagnosis, prevention and treatment of diseases and clinical conditions associated with BDP1.

The function of BDP1 and its association with various diseases and clinical conditions, has been established by previous studies, as described hereinabove with reference to GAM146.1. BENE (Accession NP_005425.1) is another GAM1338 target gene, herein designated TARGET GENE. BENE BINDING SITE is a target binding site found in the 3' untranslated region of mRNA encoded by BENE, corresponding to a target binding site such as BINDING SITE I, BINDING SITE II or BINDING SITE III of FIG. 8. Table 4 illustrates the complementarity of the nucleotide sequences of BENE BINDING SITE, designated SEQ ID:3688, to the nucleotide sequence of GAM1338 RNA, herein designated GAM RNA, also designated SEQ ID:360.

Another function of GAM1338 is therefore inhibition of BENE (Accession NP_005425.1). Accordingly, utilities of GAM1338 include diagnosis, prevention and treatment of diseases and clinical conditions associated with BENE.

BHD (Accession NP_659434.2) is another GAM1338 target gene, herein designated TARGET GENE. BHD BINDING SITE is a target binding site found in the 3' untranslated region of multiple transcripts of mRNA encoded by BHD, corresponding to a target binding site such as BINDING SITE I, BINDING SITE II or BINDING SITE III of FIG. 8. Table 4 illustrates the complementarity of the nucleotide sequences of BHD BINDING SITE, designated SEQ ID:13142, to the nucleotide sequence of GAM1338 RNA, herein designated GAM RNA, also designated SEQ ID:360.

Another function of GAM1338 is therefore inhibition of BHD (Accession NP_659434.2). Accordingly, utilities of GAM1338 include diagnosis, prevention and treatment of diseases and clinical conditions associated with BHD.

BNIP-S (Accession NP_612122.1) is another GAM1338 target gene, herein designated TARGET GENE. BNIP-S BINDING SITE is a target binding site found in the 3' untranslated region of multiple transcripts of mRNA encoded by BNIP-S, corresponding to a target binding site such as BINDING SITE I, BINDING SITE II or BINDING SITE III of FIG. 8. Table 4 illustrates the complementarity of the nucleotide sequences of BNIP-S BINDING SITE, designated SEQ ID:17763, to the nucleotide sequence of GAM1338 RNA, herein designated GAM RNA, also designated SEQ ID:360.

Another function of GAM1338 is therefore inhibition of BNIP-S (Accession NP_612122.1). Accordingly, utilities of GAM1338 include diagnosis, prevention and treatment of diseases and clinical conditions associated with BNIP-S.

BRIP1 (Accession NP_114432.1) is another GAM1338 target gene, herein designated TARGET GENE. BRIP1 BINDING SITE is a target binding site found in the 3' untranslated region of mRNA encoded by BRIP1, corresponding to a target binding site such as BINDING SITE I, BINDING SITE II or BINDING SITE III of FIG. 8. Table 4 illustrates the complementarity of the nucleotide sequences of BRIP1 BINDING SITE, designated SEQ ID:721, to the nucleotide sequence of GAM1338 RNA, herein designated GAM RNA, also designated SEQ ID:360.

Another function of GAM1338 is therefore inhibition of BRIP1 (Accession NP_114432.1). Accordingly, utilities of GAM1338 include diagnosis, prevention and treatment of diseases and clinical conditions associated with BRIP1.

Butyrophilin, subfamily 3, member a1 (BTN3A1, Accession NP_008979.2) is another GAM1338 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:17858, to the nucleotide sequence of GAM1338 RNA, herein designated GAM RNA, also designated SEQ ID:360.

Another function of GAM1338 is therefore inhibition of Butyrophilin, subfamily 3, member a1 (BTN3A1, Accession NP_008979.2). Accordingly, utilities of GAM1338 include diagnosis, prevention and treatment of diseases and clinical conditions associated with BTN3A1.

BXDC1 (Accession XP_166303.1) is another GAM1338 target gene, herein designated TARGET GENE. BXDC1 BINDING SITE1 and BXDC1 BINDING SITE2 are target binding sites found in untranslated regions of mRNA encoded by BXDC1, corresponding to target binding sites such as BINDING SITE I, BINDING SITE II or BINDING SITE III of FIG. 8. Table 4 illustrates the complementarity of the nucleotide sequences of BXDC1 BINDING SITE1 and BXDC1 BINDING SITE2, designated SEQ ID:711 and SEQ ID:7070 respectively, to the nucleotide sequence of GAM1338 RNA, herein designated GAM RNA, also designated SEQ ID:360.

Another function of GAM1338 is therefore inhibition of BXDC1 (Accession XP_166303.1). Accordingly, utilities of GAM1338 include diagnosis, prevention and treatment of diseases and clinical conditions associated with BXDC1.

BY55 (Accession NP_008984.1) is another GAM1338 target gene, herein designated TARGET GENE. BY55 BINDING SITE is a target binding site found in the 5' untranslated region of mRNA encoded by BY55, corresponding to a target binding site such as BINDING SITE I, BINDING SITE II or BINDING SITE III of FIG. 8. Table 4 illustrates the complementarity of the nucleotide sequences of BY55 BINDING SITE, designated SEQ ID:17712, to the nucleotide sequence of GAM1338 RNA, herein designated GAM RNA, also designated SEQ ID:360.

Another function of GAM1338 is therefore inhibition of BY55 (Accession NP_008984.1). Accordingly, utilities of GAM1338 include diagnosis, prevention and treatment of diseases and clinical conditions associated with BY55.

Chromosome 11 open reading frame 17 (C11orf17, Accession NP_065693.2) is another GAM1338 target gene, herein designated TARGET GENE. C11orf17 BINDING SITE is a target binding site found in the 3' untranslated region of mRNA encoded by C11orf17, corresponding to a target binding site such as BINDING SITE I, BINDING SITE II or BINDING SITE III of FIG. 8. Table 4 illustrates the complementarity of the nucleotide sequences of C11orf17 BINDING SITE, designated SEQ ID:13793, to the nucleotide sequence of GAM1338 RNA, herein designated GAM RNA, also designated SEQ ID:360.

Another function of GAM1338 is therefore inhibition of Chromosome 11 open reading frame 17 (C11orf17, Accession NP_065693.2). Accordingly, utilities of GAM1338 include diagnosis, prevention and treatment of diseases and clinical conditions associated with C11orf17.

Chromosome 13 open reading frame 1 (C13orf1, Accession NP_065189.1) is another GAM1338 target gene, herein designated TARGET GENE. C13orf1 BINDING SITE is a target binding site found in the 3' untranslated region of mRNA encoded by C13orf1, corresponding to a target binding site such as BINDING SITE I, BINDING SITE II or BINDING SITE III of FIG. 8. Table 4 illustrates the complementarity of the nucleotide sequences of C13orf1 BINDING SITE, designated SEQ ID:2596, to the nucleotide sequence of GAM1338 RNA, herein designated GAM RNA, also designated SEQ ID:360.

Another function of GAM1338 is therefore inhibition of Chromosome 13 open reading frame 1 (C13orf1, Accession NP_065189.1). Accordingly, utilities of GAM1338 include diagnosis, prevention and treatment of diseases and clinical conditions associated with C13orf1.

C14orf113 (Accession NP_060100.1) is another GAM1338 target gene, herein designated TARGET GENE. C14orf113 BINDING SITE is a target binding site found in the 3' untranslated region of mRNA encoded by C14orf113, corresponding to a target binding site such as BINDING SITE I, BINDING SITE II or BINDING SITE III of FIG. 8. Table 4 illustrates the complementarity of the nucleotide sequences of C14orf113 BINDING SITE, designated SEQ ID:19688, to the nucleotide sequence of GAM1338 RNA, herein designated GAM RNA, also designated SEQ ID:360.

Another function of GAM1338 is therefore inhibition of C14orf113 (Accession NP_060100.1). Accordingly, utilities of GAM1338 include diagnosis, prevention and treatment of diseases and clinical conditions associated with C14orf113.

C14orf143 (Accession NP_660274.1) is another GAM1338 target gene, herein designated TARGET GENE. C14orf143 BINDING SITE is a target binding site found in the 3' untranslated region of mRNA encoded by C14orf143, corresponding to a target binding site such as BINDING SITE I, BINDING SITE II or BINDING SITE III of FIG. 8. Table 4 illustrates the complementarity of the nucleotide sequences of C14orf143 BINDING SITE, designated SEQ ID:11599, to the nucleotide sequence of GAM1338 RNA, herein designated GAM RNA, also designated SEQ ID:360.

Another function of GAM1338 is therefore inhibition of C14orf143 (Accession NP_660274.1). Accordingly, utilities of GAM1338 include diagnosis, prevention and treatment of diseases and clinical conditions associated with C14orf143.

C14orf92 (Accession NP_055643.1) is another GAM1338 target gene, herein designated TARGET GENE. C14orf92 BINDING SITE is a target binding site found in the 3' untranslated region of mRNA encoded by C14orf92, corresponding to a target binding site such as BINDING SITE I, BINDING SITE II or BINDING SITE III of FIG. 8. Table 4 illustrates the complementarity of the nucleotide sequences of C14orf92 BINDING SITE, designated SEQ ID:18182, to the nucleotide sequence of GAM1338 RNA, herein designated GAM RNA, also designated SEQ ID:360.

Another function of GAM1338 is therefore inhibition of C14orf92 (Accession NP_055643.1). Accordingly, utilities of GAM1338 include diagnosis, prevention and treatment of diseases and clinical conditions associated with C14orf92.

Chromosome 1 open reading frame 24 (C1orf24, Accession NP_443198.1) is another GAM1338 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:601, to the nucleotide sequence of GAM1338 RNA, herein designated GAM RNA, also designated SEQ ID:360.

Another function of GAM1338 is therefore inhibition of Chromosome 1 open reading frame 24 (C1orf24, Accession NP_443198.1). Accordingly, utilities of GAM1338 include diagnosis, prevention and treatment of diseases and clinical conditions associated with C1orf24.

C1q and tumor necrosis factor related protein 6 (C1QTNF6, Accession NP_114116.2) is another GAM1338 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:18746, to the nucleotide sequence of GAM1338 RNA, herein designated GAM RNA, also designated SEQ ID:360.

Another function of GAM1338 is therefore inhibition of C1q and tumor necrosis factor related protein 6 (C1QTNF6, Accession NP_114116.2). Accordingly, utilities of GAM1338 include diagnosis, prevention and treatment of diseases and clinical conditions associated with C1QTNF6.

Chromosome 20 open reading frame 129 (C20orf129, Accession NP_112181.1) is another GAM1338 target gene, herein designated TARGET GENE. C20orf129 BINDING SITE is a target binding site found in the 3' untranslated region of mRNA encoded by C20orf129, corresponding to a target binding site such as BINDING SITE I, BINDING SITE II or BINDING SITE III of FIG. 8. Table 4 illustrates the complementarity of the nucleotide sequences of C20orf129 BINDING SITE, designated SEQ ID:13924, to the nucleotide sequence of GAM1338 RNA, herein designated GAM RNA, also designated SEQ ID:360.

Another function of GAM1338 is therefore inhibition of Chromosome 20 open reading frame 129 (C20orf129, Accession NP_112181.1). Accordingly, utilities of GAM1338 include diagnosis, prevention and treatment of diseases and clinical conditions associated with C20orf129.

Chromosome 22 open reading frame 19 (C22orf19, Accession NP_003669.2) is another GAM1338 target gene, herein designated TARGET GENE. C22orf19 BINDING SITE is a target binding site found in the 3' untranslated region of mRNA encoded by C22orf19, corresponding to a target binding site such as BINDING SITE I, BINDING SITE II or BINDING SITE III of FIG. 8. Table 4 illustrates the complementarity of the nucleotide sequences of C22orf19 BINDING SITE, designated SEQ ID:14748, to the nucleotide sequence of GAM1338 RNA, herein designated GAM RNA, also designated SEQ ID:360.

Another function of GAM1338 is therefore inhibition of Chromosome 22 open reading frame 19 (C22orf19, Accession NP_003669.2). Accordingly, utilities of GAM1338 include diagnosis, prevention and treatment of diseases and clinical conditions associated with C22orf19.

C4orf9 (Accession XP_035572.1) is another GAM1338 target gene, herein designated TARGET GENE. C4orf9 BINDING SITE is a target binding site found in the 3' untranslated region of mRNA encoded by C4orf9, corresponding to a target binding site such as BINDING SITE I, BINDING SITE II or BINDING SITE III of FIG. 8. Table 4 illustrates the complementarity of the nucleotide sequences of C4orf9 BINDING SITE, designated SEQ ID:13142, to the nucleotide sequence of GAM1338 RNA, herein designated GAM RNA, also designated SEQ ID:360.

Another function of GAM1338 is therefore inhibition of C4orf9 (Accession XP_035572.1). Accordingly, utilities of GAM1338 include diagnosis, prevention and treatment of diseases and clinical conditions associated with C4orf9.

Chromosome 6 open reading frame 33 (C6orf33, Accession NP_588608.1) is another GAM1338 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:7278, to the nucleotide sequence of GAM1338 RNA, herein designated GAM RNA, also designated SEQ ID:360.

Another function of GAM1338 is therefore inhibition of Chromosome 6 open reading frame 33 (C6orf33, Accession NP_588608.1). Accordingly, utilities of GAM1338 include diagnosis, prevention and treatment of diseases and clinical conditions associated with C6orf33.

C6orf5 (Accession NP_056339.2) is another GAM1338 target gene, herein designated TARGET GENE. C6orf5 BINDING SITE is a target binding site found in the 3' untranslated region of mRNA encoded by C6orf5, corresponding to a target binding site such as BINDING SITE I, BINDING SITE II or BINDING SITE III of FIG. 8. Table 4 illustrates the complementarity of the nucleotide sequences of C6orf5 BINDING SITE, designated SEQ ID:10778, to the nucleotide sequence of GAM1338 RNA, herein designated GAM RNA, also designated SEQ ID:360.

Another function of GAM1338 is therefore inhibition of C6orf5 (Accession NP_056339.2). Accordingly, utilities of GAM1338 include diagnosis, prevention and treatment of diseases and clinical conditions associated with C6orf5.

C6orf57 (Accession NP_660310.1) is another GAM1338 target gene, herein designated TARGET GENE. C6orf57 BINDING SITE is a target binding site found in the 3' untranslated region of mRNA encoded by C6orf57, corresponding to a target binding site such as BINDING SITE I, BINDING SITE II or BINDING SITE III of FIG. 8. Table 4 illustrates the complementarity of the nucleotide sequences of C6orf57 BINDING SITE, designated SEQ ID:6442, to the nucleotide sequence of GAM1338 RNA, herein designated GAM RNA, also designated SEQ ID:360.

Another function of GAM1338 is therefore inhibition of C6orf57 (Accession NP_660310.1). Accordingly, utilities of GAM1338 include diagnosis, prevention and treatment of diseases and clinical conditions associated with C6orf57.

Complement component 7 (C7, Accession NP_000578.1) is another GAM1338 target gene, herein designated TARGET GENE. C7 BINDING SITE is a target binding site found in the 3' untranslated region of mRNA encoded by C7, corresponding to a target binding site such as BINDING SITE I, BINDING SITE II or BINDING SITE III of FIG. 8. Table 4 illustrates the complementarity of the nucleotide sequences of C7 BINDING SITE, designated SEQ ID:11697, to the nucleotide sequence of GAM1338 RNA, herein designated GAM RNA, also designated SEQ ID:360.

Another function of GAM1338 is therefore inhibition of Complement component 7 (C7, Accession NP_000578.1). Accordingly, utilities of GAM1338 include diagnosis, prevention and treatment of diseases and clinical conditions associated with C7.

Chromosome 9 open reading frame 5 (C9orf5, Accession NP_114401.1) is another GAM1338 target gene, herein designated TARGET GENE. C9orf5 BINDING SITE is a target binding site found in the 3' untranslated region of mRNA encoded by C9orf5, corresponding to a target binding site such as BINDING SITE I, BINDING SITE II or BINDING SITE III of FIG. 8. Table 4 illustrates the complementarity of the nucleotide sequences of C9orf5 BINDING SITE, designated SEQ ID:15709, to the nucleotide sequence of GAM1338 RNA, herein designated GAM RNA, also designated SEQ ID:360.

Another function of GAM1338 is therefore inhibition of Chromosome 9 open reading frame 5 (C9orf5, Accession NP_114401.1). Accordingly, utilities of GAM1338 include diagnosis, prevention and treatment of diseases and clinical conditions associated with C9orf5.

Chromosome 9 open reading frame 9 (C9orf9, Accession NP_061829.2) is another GAM1338 target gene, herein designated TARGET GENE. C9orf9 BINDING SITE1 and C9orf9 BINDING SITE2 are target binding sites found in untranslated regions of mRNA encoded by C9orf9, corresponding to target binding sites such as BINDING SITE I, BINDING SITE II or BINDING SITE III of FIG. 8. Table 4 illustrates the complementarity of the nucleotide sequences of C9orf9 BINDING SITE1 and C9orf9 BINDING SITE2, designated SEQ ID:19273 and SEQ ID:13797 respectively, to the nucleotide sequence of GAM1338 RNA, herein designated GAM RNA, also designated SEQ ID:360.

Another function of GAM1338 is therefore inhibition of Chromosome 9 open reading frame 9 (C9orf9, Accession NP_061829.2). Accordingly, utilities of GAM1338 include diagnosis, prevention and treatment of diseases and clinical conditions associated with C9orf9.

Calcium modulating ligand (CAMLG, Accession NP_001736.1) is another GAM1338 target gene, herein designated TARGET GENE. CAMLG BINDING SITE is a target binding site found in the 3' untranslated region of mRNA encoded by CAMLG, corresponding to a target binding site such as BINDING SITE I, BINDING SITE II or BINDING SITE III of FIG. 8. Table 4 illustrates the complementarity of the nucleotide sequences of CAMLG BINDING SITE, designated SEQ ID:9364, to the nucleotide sequence of GAM1338 RNA, herein designated GAM RNA, also designated SEQ ID:360.

Another function of GAM1338 is therefore inhibition of Calcium modulating ligand (CAMLG, Accession NP_001736.1), a gene which is likely involved in the mobilization of calcium as a result of the tcr/cd3 complex interaction. Accordingly, utilities of GAM1338 include diagnosis, prevention and treatment of diseases and clinical conditions associated with CAMLG.

The function of CAMLG and its association with various diseases and clinical conditions, has been established by previous studies, as described hereinabove with reference to GAM130.1. CAPRI (Accession NP_008920.3) is another GAM1338 target gene, herein designated TARGET GENE. CAPRI BINDING SITE is a target binding site found in the 3' untranslated region of mRNA encoded by CAPRI, corresponding to a target binding site such as BINDING SITE I, BINDING SITE II or BINDING SITE III of FIG. 8. Table 4 illustrates the complementarity of the nucleotide sequences of CAPRI BINDING SITE, designated SEQ ID:12829, to the nucleotide sequence of GAM1338 RNA, herein designated GAM RNA, also designated SEQ ID:360.

Another function of GAM1338 is therefore inhibition of CAPRI (Accession NP_008920.3). Accordingly, utilities of GAM1338 include diagnosis, prevention and treatment of diseases and clinical conditions associated with CAPRI.

Caspase recruitment domain family, member 6 (CARD6, Accession NP_115976.2) is another GAM1338 target gene, herein designated TARGET GENE. CARD6 BINDING SITE is a target binding site found in the 3' untranslated region of mRNA encoded by CARD6, corresponding to a target binding site such as BINDING SITE I, BINDING SITE II or BINDING SITE III of FIG. 8. Table 4 illustrates the complementarity of the nucleotide sequences of CARD6 BINDING SITE, designated SEQ ID:13142, to the nucleotide sequence of GAM1338 RNA, herein designated GAM RNA, also designated SEQ ID:360.

Another function of GAM1338 is therefore inhibition of Caspase recruitment domain family, member 6 (CARD6, Accession NP_115976.2) . Accordingly, utilities of GAM1338 include diagnosis, prevention and treatment of diseases and clinical conditions associated with CARD6.

Caspase 2, apoptosis-related cysteine protease (neural precursor cell expressed, developmentally down-regulated 2) (CASP2, Accession NP_116766.1) is another GAM1338 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:18463, to the nucleotide sequence of GAM1338 RNA, herein designated GAM RNA, also designated SEQ ID:360.

Another function of GAM1338 is therefore inhibition of Caspase 2, apoptosis-related cysteine protease (neural precursor cell expressed, developmentally down-regulated 2) (CASP2, Accession NP_116766.1), a gene which involves in the activation cascade of caspases responsible for apoptosis execution. Accordingly, utilities of GAM1338 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116764.1) is another GAM1338 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:18463, to the nucleotide sequence of GAM1338 RNA, herein designated GAM RNA, also designated SEQ ID:360.

Another function of GAM1338 is therefore inhibition of Caspase 2, apoptosis-related cysteine protease (neural precursor cell expressed, developmentally down-regulated 2) (CASP2, Accession NP_116764.1), a gene which involves in the activation cascade of caspases responsible for apoptosis execution. Accordingly, utilities of GAM1338 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116765.1) is another GAM1338 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:18463, to the nucleotide sequence of GAM1338 RNA, herein designated GAM RNA, also designated SEQ ID:360.

Another function of GAM1338 is therefore inhibition of Caspase 2, apoptosis-related cysteine protease (neural precursor cell expressed, developmentally down-regulated 2) (CASP2, Accession NP_116765.1), a gene which involves in the activation cascade of caspases responsible for apoptosis execution. Accordingly, utilities of GAM1338 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_001215.1) is another GAM1338 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:18463, to the nucleotide sequence of GAM1338 RNA, herein designated GAM RNA, also designated SEQ ID:360.

Another function of GAM1338 is therefore inhibition of Caspase 2, apoptosis-related cysteine protease (neural precursor cell expressed, developmentally down-regulated 2) (CASP2, Accession NP_001215.1), a gene which involves in the activation cascade of caspases responsible for apoptosis execution. Accordingly, utilities of GAM1338 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 8, apoptosis-related cysteine protease (CASP8, Accession NP_001219.2) is another GAM1338 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:9100, to the nucleotide sequence of GAM1338 RNA, herein designated GAM RNA, also designated SEQ ID:360.

Another function of GAM1338 is therefore inhibition of Caspase 8, apoptosis-related cysteine protease (CASP8, Accession NP_001219.2), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM1338 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203520.1) is another GAM1338 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:9100, to the nucleotide sequence of GAM1338 RNA, herein designated GAM RNA, also designated SEQ ID:360.

Another function of GAM1338 is therefore inhibition of Caspase 8, apoptosis-related cysteine protease (CASP8, Accession NP_203520.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM1338 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203521.1) is another GAM1338 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:9100, to the nucleotide sequence of GAM1338 RNA, herein designated GAM RNA, also designated SEQ ID:360.

Another function of GAM1338 is therefore inhibition of Caspase 8, apoptosis-related cysteine protease (CASP8, Accession NP_203521.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM1338 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203519.1) is another GAM1338 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:9100, to the nucleotide sequence of GAM1338 RNA, herein designated GAM RNA, also designated SEQ ID:360.

Another function of GAM1338 is therefore inhibition of Caspase 8, apoptosis-related cysteine protease (CASP8, Accession NP_203519.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM1338 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Core-binding factor, runt domain, alpha subunit 2; translocated to, 2 (CBFA2T2, Accession NP_787060.1) is another GAM1338 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:3868, to the nucleotide sequence of GAM1338 RNA, herein designated GAM RNA, also designated SEQ ID:360.

Another function of GAM1338 is therefore inhibition of Core-binding factor, runt domain, alpha subunit 2; translocated to, 2 (CBFA2T2, Accession NP_787060.1), a gene which is a putative transcription factor. Accordingly, utilities of GAM1338 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Core-binding factor, runt domain, alpha subunit 2; translocated to, 2 (CBFA2T2, Accession NP_005084.1) is another GAM1338 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:3868, to the nucleotide sequence of GAM1338 RNA, herein designated GAM RNA, also designated SEQ ID:360.

Another function of GAM1338 is therefore inhibition of Core-binding factor, runt domain, alpha subunit 2; translocated to, 2 (CBFA2T2, Accession NP_005084.1), a gene which is a putative transcription factor. Accordingly, utilities of GAM1338 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Chemokine (c-c motif) ligand 16 (CCL16, Accession NP_004581.1) is another GAM1338 target gene, herein designated TARGET GENE. CCL16 BINDING SITE is a target binding site found in the 3' untranslated region of mRNA encoded by CCL16, corresponding to a target binding site such as BINDING SITE I, BINDING SITE II or BINDING SITE III of FIG. 8. Table 4 illustrates the complementarity of the nucleotide sequences of CCL16 BINDING SITE, designated SEQ ID:10633, to the nucleotide sequence of GAM1338 RNA, herein designated GAM RNA, also designated SEQ ID:360.

Another function of GAM1338 is therefore inhibition of Chemokine (c-c motif) ligand 16 (CCL16, Accession NP_004581.1). Accordingly, utilities of GAM1338 include diagnosis, prevention and treatment of diseases and clinical conditions associated with CCL16.

Chemokine (c-c motif) ligand 22 (CCL22, Accession NP_002981.2) is another GAM1338 target gene, herein designated TARGET GENE. CCL22 BINDING SITE is a target binding site found in the 3' untranslated region of mRNA encoded by CCL22, corresponding to a target binding site such as BINDING SITE I, BINDING SITE II or BINDING SITE III of FIG. 8. Table 4 illustrates the complementarity of the nucleotide sequences of CCL22 BINDING SITE, designated SEQ ID:11649, to the nucleotide sequence of GAM1338 RNA, herein designated GAM RNA, also designated SEQ ID:360.

Another function of GAM1338 is therefore inhibition of Chemokine (c-c motif) ligand 22 (CCL22, Accession NP_002981.2). Accordingly, utilities of GAM1338 include diagnosis, prevention and treatment of diseases and clinical conditions associated with CCL22.

Cyclin f (CCNF, Accession NP_001752.1) is another GAM1338 target gene, herein designated TARGET GENE. CCNF BINDING SITE is a target binding site found in the 3' untranslated region of mRNA encoded by CCNF, corresponding to a target binding site such as BINDING SITE I, BINDING SITE II or BINDING SITE III of FIG. 8. Table 4 illustrates the complementarity of the nucleotide sequences of CCNF BINDING SITE, designated SEQ ID:14395, to the nucleotide sequence of GAM1338 RNA, herein designated GAM RNA, also designated SEQ ID:360.

Another function of GAM1338 is therefore inhibition of Cyclin f (CCNF, Accession NP_001752.1), a gene which likely to be involved in the control of the cell cycle during s phase and g2. Accordingly, utilities of GAM1338 include diagnosis, prevention and treatment of diseases and clinical conditions associated with CCNF.

The function of CCNF and its association with various diseases and clinical conditions, has been established by previous studies, as described hereinabove with reference to GAM130.1. Ccr4 carbon catabolite repression 4-like (s. cerevisiae) (CCRN4L, Accession NP_036250.2) is another GAM1338 target gene, herein designated TARGET GENE. CCRN4L BINDING SITE is a target binding site found in the 3' untranslated region of mRNA encoded by CCRN4L, corresponding to a target binding site such as BINDING SITE I, BINDING SITE II or BINDING SITE III of FIG. 8. Table 4 illustrates the complementarity of the nucleotide sequences of CCRN4L BINDING SITE, designated SEQ ID:15829, to the nucleotide sequence of GAM1338 RNA, herein designated GAM RNA, also designated SEQ ID:360.

Another function of GAM1338 is therefore inhibition of Ccr4 carbon catabolite repression 4-like (s. cerevisiae) (CCRN4L, Accession NP_036250.2). Accordingly, utilities of GAM1338 include diagnosis, prevention and treatment of diseases and clinical conditions associated with CCRN4L.

Cd209 antigen (CD209, Accession NP_066978.1) is another GAM1338 target gene, herein designated TARGET GENE. CD209 BINDING SITE is a target binding site found in the 3' untranslated region of mRNA encoded by CD209, corresponding to a target binding site such as BINDING SITE I, BINDING SITE II or BINDING SITE III of FIG. 8. Table 4 illustrates the complementarity of the nucleotide sequences of CD209 BINDING SITE, designated SEQ ID:8229, to the nucleotide sequence of GAM1338 RNA, herein designated GAM RNA, also designated SEQ ID:360.

Another function of GAM1338 is therefore inhibition of Cd209 antigen (CD209, Accession NP_066978.1), a gene which may play an important role in the CD4-independent association of HIV with cells. Accordingly, utilities of GAM1338 include diagnosis, prevention and treatment of diseases and clinical conditions associated with CD209.

The function of CD209 and its association with various diseases and clinical conditions, has been established by previous studies, as described hereinabove with reference to GAM96.1. Cd24 antigen (small cell lung carcinoma cluster 4 antigen) (CD24, Accession NP_037362.1) is another GAM1338 target gene, herein designated TARGET GENE. CD24 BINDING SITE is a target binding site found in the 3' untranslated region of mRNA encoded by CD24, corresponding to a target binding site such as BINDING SITE I, BINDING SITE II or BINDING SITE III of FIG. 8. Table 4 illustrates the complementarity of the nucleotide sequences of CD24 BINDING SITE, designated SEQ ID:18593, to the nucleotide sequence of GAM1338 RNA, herein designated GAM RNA, also designated SEQ ID:360.

Another function of GAM1338 is therefore inhibition of Cd24 antigen (small cell lung carcinoma cluster 4 antigen) (CD24, Accession NP_037362.1). Accordingly, utilities of GAM1338 include diagnosis, prevention and treatment of diseases and clinical conditions associated with CD24.

Cdc14 cell division cycle 14 homolog b (s. cerevisiae) (CDC14B, Accession NP_201589.1) is another GAM1338 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:7919, to the nucleotide sequence of GAM1338 RNA, herein designated GAM RNA, also designated SEQ ID:360.

Another function of GAM1338 is therefore inhibition of Cdc14 cell division cycle 14 homolog b (s. cerevisiae) (CDC14B, Accession NP_201589.1). Accordingly, utilities of GAM1338 include diagnosis, prevention and treatment of diseases and clinical conditions associated with CDC14B.

Cdc6 cell division cycle 6 homolog (s. cerevisiae) (CDC6, Accession NP_001245.1) is another GAM1338 target gene, herein designated TARGET GENE. CDC6 BINDING SITE is a target binding site found in the 3' untranslated region of mRNA encoded by CDC6, corresponding to a target binding site such as BINDING SITE I, BINDING SITE II or BINDING SITE III of FIG. 8. Table 4 illustrates the complementarity of the nucleotide sequences of CDC6 BINDING SITE, designated SEQ ID:7495, to the nucleotide sequence of GAM1338 RNA, herein designated GAM RNA, also designated SEQ ID:360.

Another function of GAM1338 is therefore inhibition of Cdc6 cell division cycle 6 homolog (s. cerevisiae) (CDC6, Accession NP_001245.1), a gene which is a component of the origin recognition complex (orc) that binds origins of replication. Accordingly, utilities of GAM1338 include diagnosis, prevention and treatment of diseases and clinical conditions associated with CDC6.

The function of CDC6 and its association with various diseases and clinical conditions, has been established by previous studies, as described hereinabove with reference to GAM189.1. CDCP1 (Accession NP_073753.3) is another GAM1338 target gene, herein designated TARGET GENE. CDCP1 BINDING SITE is a target binding site found in the 3' untranslated region of multiple transcripts of mRNA encoded by CDCP1, corresponding to a target binding site such as BINDING SITE I, BINDING SITE II or BINDING SITE III of FIG. 8. Table 4 illustrates the complementarity of the nucleotide sequences of CDCP1 BINDING SITE, designated SEQ ID:20095, to the nucleotide sequence of GAM1338 RNA, herein designated GAM RNA, also designated SEQ ID:360.

Another function of GAM1338 is therefore inhibition of CDCP1 (Accession NP_073753.3). Accordingly, utilities of GAM1338 include diagnosis, prevention and treatment of diseases and clinical conditions associated with CDCP1.

Cadherin 1, type 1, e-cadherin (epithelial) (CDH1, Accession NP_004351.1) is another GAM1338 target gene, herein designated TARGET GENE. CDH1 BINDING SITE1 and CDH1 BINDING SITE2 are target binding sites found in untranslated regions of mRNA encoded by CDH1, corresponding to target binding sites such as BINDING SITE I, BINDING SITE II or BINDING SITE III of FIG. 8. Table 4 illustrates the complementarity of the nucleotide sequences of CDH1 BINDING SITE1 and CDH1 BINDING SITE2, designated SEQ ID:3667 and SEQ ID:5919 respectively, to the nucleotide sequence of GAM1338 RNA, herein designated GAM RNA, also designated SEQ ID:360.

Another function of GAM1338 is therefore inhibition of Cadherin 1, type 1, e-cadherin (epithelial) (CDH1, Accession NP_004351.1). Accordingly, utilities of GAM1338 include diagnosis, prevention and treatment of diseases and clinical conditions associated with CDH1.

Cadherin 17, li cadherin (liver-intestine) (CDH17, Accession NP_004054.2) is another GAM1338 target gene, herein designated TARGET GENE. CDH17 BINDING SITE is a target binding site found in the 3' untranslated region of mRNA encoded by CDH17, corresponding to a target binding site such as BINDING SITE I, BINDING SITE II or BINDING SITE III of FIG. 8. Table 4 illustrates the complementarity of the nucleotide sequences of CDH17 BINDING SITE, designated SEQ ID:5407, to the nucleotide sequence of GAM1338 RNA, herein designated GAM RNA, also designated SEQ ID:360.

Another function of GAM1338 is therefore inhibition of Cadherin 17, li cadherin (liver-intestine) (CDH17, Accession NP_004054.2), a gene which may have a role in the morphological organization of liver and intestine and involved in intestinal peptide transport. Accordingly, utilities of GAM1338 include diagnosis, prevention and treatment of diseases and clinical conditions associated with CDH17.

The function of CDH17 and its association with various diseases and clinical conditions, has been established by previous studies, as described hereinabove with reference to GAM161.1. CDK11 (Accession XP_166324.1) is another GAM1338 target gene, herein designated TARGET GENE. CDK11 BINDING SITE is a target binding site found in the 3' untranslated region of multiple transcripts of mRNA encoded by CDK11, corresponding to a target binding site such as BINDING SITE I, BINDING SITE II or BINDING SITE III of FIG. 8. Table 4 illustrates the complementarity of the nucleotide sequences of CDK11 BINDING SITE, designated SEQ ID:5408, to the nucleotide sequence of GAM1338 RNA, herein designated GAM RNA, also designated SEQ ID:360.

Another function of GAM1338 is therefore inhibition of CDK11 (Accession XP_166324.1). Accordingly, utilities of GAM1338 include diagnosis, prevention and treatment of diseases and clinical conditions associated with CDK11.

CDKAL1 (Accession NP_060244.1) is another GAM1338 target gene, herein designated TARGET GENE. CDKAL1 BINDING SITE is a target binding site found in the 3' untranslated region of mRNA encoded by CDKAL1, corresponding to a target binding site such as BINDING SITE I, BINDING SITE II or BINDING SITE III of FIG. 8. Table 4 illustrates the complementarity of the nucleotide sequences of CDKAL1 BINDING SITE, designated SEQ ID:12153, to the nucleotide sequence of GAM1338 RNA, herein designated GAM RNA, also designated SEQ ID:360.

Another function of GAM1338 is therefore inhibition of CDKAL1 (Accession NP_060244.1). Accordingly, utilities of GAM1338 include diagnosis, prevention and treatment of diseases and clinical conditions associated with CDKAL1.

Carcinoembryonic antigen-related cell adhesion molecule 8 (CEACAM8, Accession NP_001807.2) is another GAM1338 target gene, herein designated TARGET GENE. CEACAM8 BINDING SITE is a target binding site found in the 3' untranslated region of mRNA encoded by CEACAM8, corresponding to a target binding site such as BINDING SITE I, BINDING SITE II or BINDING SITE III of FIG. 8. Table 4 illustrates the complementarity of the nucleotide sequences of CEACAM8 BINDING SITE, designated SEQ ID:436, to the nucleotide sequence of GAM1338 RNA, herein designated GAM RNA, also designated SEQ ID:360.

Another function of GAM1338 is therefore inhibition of Carcinoembryonic antigen-related cell adhesion molecule 8 (CEACAM8, Accession NP_001807.2). Accordingly, utilities of GAM1338 include diagnosis, prevention and treatment of diseases and clinical conditions associated with CEACAM8.

Cat eye syndrome chromosome region, candidate 1 (CECR1, Accession NP_059120.2) is another GAM1338 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:15125 and SEQ ID:11209 respectively, to the nucleotide sequence of GAM1338 RNA, herein designated GAM RNA, also designated SEQ ID:360.

Another function of GAM1338 is therefore inhibition of Cat eye syndrome chromosome region, candidate 1 (CECR1, Accession NP_059120.2). Accordingly, utilities of GAM1338 include diagnosis, prevention and treatment of diseases and clinical conditions associated with CECR1.

Cat eye syndrome chromosome region, candidate 1 (CECR1, Accession NP_803124.1) is another GAM1338 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:11209 and SEQ ID:15125 respectively, to the nucleotide sequence of GAM1338 RNA, herein designated GAM RNA, also designated SEQ ID:360.

Another function of GAM1338 is therefore inhibition of Cat eye syndrome chromosome region, candidate 1 (CECR1, Accession NP_803124.1). Accordingly, utilities of GAM1338 include diagnosis, prevention and treatment of diseases and clinical conditions associated with CECR1.

Centromere protein h (CENPH, Accession NP_075060.1) is another GAM1338 target gene, herein designated TARGET GENE. CENPH BINDING SITE is a target binding site found in the 3' untranslated region of mRNA encoded by CENPH, corresponding to a target binding site such as BINDING SITE I, BINDING SITE II or BINDING SITE III of FIG. 8. Table 4 illustrates the complementarity of the nucleotide sequences of CENPH BINDING SITE, designated SEQ ID:7835, to the nucleotide sequence of GAM1338 RNA, herein designated GAM RNA, also designated SEQ ID:360.

Another function of GAM1338 is therefore inhibition of Centromere protein h (CENPH, Accession NP_075060.1). Accordingly, utilities of GAM1338 include diagnosis, prevention and treatment of diseases and clinical conditions associated with CENPH.

Centromere protein j (CENPJ, Accession NP_060921.2) is another GAM1338 target gene, herein designated TARGET GENE. CENPJ BINDING SITE is a target binding site found in the 5' untranslated region of mRNA encoded by CENPJ, corresponding to a target binding site such as BINDING SITE I, BINDING SITE II or BINDING SITE III of FIG. 8. Table 4 illustrates the complementarity of the nucleotide sequences of CENPJ BINDING SITE, designated SEQ ID:8802, to the nucleotide sequence of GAM1338 RNA, herein designated GAM RNA, also designated SEQ ID:360.

Another function of GAM1338 is therefore inhibition of Centromere protein j (CENPJ, Accession NP_060921.2). Accordingly, utilities of GAM1338 include diagnosis, prevention and treatment of diseases and clinical conditions associated with CENPJ.

CGI-150 (Accession NP_057164.1) is another GAM1338 target gene, herein designated TARGET GENE. CGI-150 BINDING SITE is a target binding site found in the 5' untranslated region of mRNA encoded by CGI-150, corresponding to a target binding site such as BINDING SITE I, BINDING SITE II or BINDING SITE III of FIG. 8. Table 4 illustrates the complementarity of the nucleotide sequences of CGI-150 BINDING SITE, designated SEQ ID:19951, to the nucleotide sequence of GAM1338 RNA, herein designated GAM RNA, also designated SEQ ID:360.

Another function of GAM1338 is therefore inhibition of CGI-150 (Accession NP_057164.1). Accordingly, utilities of GAM1338 include diagnosis, prevention and treatment of diseases and clinical conditions associated with CGI-150.

Chromatin accessibility complex 1 (CHRAC1, Accession NP_059140.1) is another GAM1338 target gene, herein designated TARGET GENE. CHRAC1 BINDING SITE is a target binding site found in the 3' untranslated region of mRNA encoded by CHRAC1, corresponding to a target binding site such as BINDING SITE I, BINDING SITE II or BINDING SITE III of FIG. 8. Table 4 illustrates the complementarity of the nucleotide sequences of CHRAC1 BINDING SITE, designated SEQ ID:18375, to the nucleotide sequence of GAM1338 RNA, herein designated GAM RNA, also designated SEQ ID:360.

Another function of GAM1338 is therefore inhibition of Chromatin accessibility complex 1 (CHRAC1, Accession NP_059140.1). Accordingly, utilities of GAM1338 include diagnosis, prevention and treatment of diseases and clinical conditions associated with CHRAC1.

Carbohydrate (chondroitin) synthase 1 (CHSY1, Accession NP_055733.2) is another GAM1338 target gene, herein designated TARGET GENE. CHSY1 BINDING SITE is a target binding site found in the 3' untranslated region of mRNA encoded by CHSY1, corresponding to a target binding site such as BINDING SITE I, BINDING SITE II or BINDING SITE III of FIG. 8. Table 4 illustrates the complementarity of the nucleotide sequences of CHSY1 BINDING SITE, designated SEQ ID:18370, to the nucleotide sequence of GAM1338 RNA, herein designated GAM RNA, also designated SEQ ID:360.

Another function of GAM1338 is therefore inhibition of Carbohydrate (chondroitin) synthase 1 (CHSY1, Accession NP_055733.2). Accordingly, utilities of GAM1338 include diagnosis, prevention and treatment of diseases and clinical conditions associated with CHSY1.

Cold autoinflammatory syndrome 1 (CIAS1, Accession NP_004886.2) is another GAM1338 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:7985, to the nucleotide sequence of GAM1338 RNA, herein designated GAM RNA, also designated SEQ ID:360.

Another function of GAM1338 is therefore inhibition of Cold autoinflammatory syndrome 1 (CIAS1, Accession NP_004886.2), a gene which may mediate protein-protein interactions; contains a leucine rich repeat and therefore may be associated with Familial cold autoinflammatory syndrome, muckle-wells syndrome. Accordingly, utilities of GAM1338 include diagnosis, prevention and treatment of Familial cold autoinflammatory syndrome, muckle-wells syndrome, and of other diseases and clinical conditions associated with CIAS1.

The function of CIAS1 and its association with various diseases and clinical conditions, has been established by previous studies, as described hereinabove with reference to GAM90.1. CIP29 (Accession NP_115740.3) is another GAM1338 target gene, herein designated TARGET GENE. CIP29 BINDING SITE1 and CIP29 BINDING SITE2 are target binding sites found in untranslated regions of mRNA encoded by CIP29, corresponding to target binding sites such as BINDING SITE I, BINDING SITE II or BINDING SITE III of FIG. 8. Table 4 illustrates the complementarity of the nucleotide sequences of CIP29 BINDING SITE1 and CIP29 BINDING SITE2, designated SEQ ID:11639 and SEQ ID:20120 respectively, to the nucleotide sequence of GAM1338 RNA, herein designated GAM RNA, also designated SEQ ID:360.

Another function of GAM1338 is therefore inhibition of CIP29 (Accession NP_115740.3). Accordingly, utilities of GAM1338 include diagnosis, prevention and treatment of diseases and clinical conditions associated with CIP29.

C-type (calcium dependent, carbohydrate-recognition domain) lectin, superfamily member 12 (CLECSF12, Accession NP_072092.2) is another GAM1338 target gene, herein designated TARGET GENE. CLECSF12 BINDING SITE1 and CLECSF12 BINDING SITE2 are target binding sites found in untranslated regions of mRNA encoded by CLECSF12, corresponding to target binding sites such as BINDING SITE I, BINDING SITE II or BINDING SITE III of FIG. 8. Table 4 illustrates the complementarity of the nucleotide sequences of CLECSF12 BINDING SITE1 and CLECSF12 BINDING SITE2, designated SEQ ID:1868 and SEQ ID:10233 respectively, to the nucleotide sequence of GAM1338 RNA, herein designated GAM RNA, also designated SEQ ID:360.

Another function of GAM1338 is therefore inhibition of C-type (calcium dependent, carbohydrate-recognition domain) lectin, superfamily member 12 (CLECSF12, Accession NP_072092.2), a gene which is a pattern- recognition receptor. Accordingly, utilities of GAM1338 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. Cell matrix adhesion regulator (CMAR, Accession NP_005191.2) is another GAM1338 target gene, herein designated TARGET GENE. CMAR BINDING SITE1 and CMAR BINDING SITE2 are target binding sites found in untranslated regions of mRNA encoded by CMAR, corresponding to target binding sites such as BINDING SITE I, BINDING SITE II or BINDING SITE III of FIG. 8. Table 4 illustrates the complementarity of the nucleotide sequences of CMAR BINDING SITE1 and CMAR BINDING SITE2, designated SEQ ID:6738 and SEQ ID:19999 respectively, to the nucleotide sequence of GAM1338 RNA, herein designated GAM RNA, also designated SEQ ID:360.

Another function of GAM1338 is therefore inhibition of Cell matrix adhesion regulator (CMAR, Accession NP_005191.2). Accordingly, utilities of GAM1338 include diagnosis, prevention and treatment of diseases and clinical conditions associated with CMAR.

Calponin 2 (CNN2, Accession NP_004359.1) is another GAM1338 target gene, herein designated TARGET GENE. CNN2 BINDING SITE is a target binding site found in the 3' untranslated region of mRNA encoded by CNN2, corresponding to a target binding site such as BINDING SITE I, BINDING SITE II or BINDING SITE III of FIG. 8. Table 4 illustrates the complementarity of the nucleotide sequences of CNN2 BINDING SITE, designated SEQ ID:6909, to the nucleotide sequence of GAM1338 RNA, herein designated GAM RNA, also designated SEQ ID:360.

Another function of GAM1338 is therefore inhibition of Calponin 2 (CNN2, Accession NP_004359.1), a gene which may be involved in the structural organization and/or anchorage of actin filaments. Accordingly, utilities of GAM1338 include diagnosis, prevention and treatment of diseases and clinical conditions associated with CNN2.

The function of CNN2 and its association with various diseases and clinical conditions, has been established by previous studies, as described hereinabove with reference to GAM136.1.2',3'-cyclic nucleotide 3' phosphodiesterase (CNP, Accession NP_149124.1) is another GAM1338 target gene, herein designated TARGET GENE. CNP BINDING SITE is a target binding site found in the 3' untranslated region of mRNA encoded by CNP, corresponding to a target binding site such as BINDING SITE I, BINDING SITE II or BINDING SITE III of FIG. 8. Table 4 illustrates the complementarity of the nucleotide sequences of CNP BINDING SITE, designated SEQ ID:5014, to the nucleotide sequence of GAM1338 RNA, herein designated GAM RNA, also designated SEQ ID:360.

Another function of GAM1338 is therefore inhibition of 2',3'-cyclic nucleotide 3' phosphodiesterase (CNP, Accession NP_149124.1), a gene which can link tubulin to membranes and may regulate cytoplasmic microtubule distribution.

Accordingly, utilities of GAM1338 include diagnosis, prevention and treatment of diseases and clinical conditions associated with CNP.

The function of CNP and its association with various diseases and clinical conditions, has been established by previous studies, as described hereinabove with reference to GAM189.1. Collectin sub-family member 12 (COLEC12, Accession NP_110408.2) is another GAM1338 target gene, herein designated TARGET GENE. COLEC12 BINDING SITE is a target binding site found in the 3' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:13793, to the nucleotide sequence of GAM1338 RNA, herein designated GAM RNA, also designated SEQ ID:360.

Another function of GAM1338 is therefore inhibition of Collectin sub-family member 12 (COLEC12, Accession NP_110408.2). Accordingly, utilities of GAM1338 include diagnosis, prevention and treatment of diseases and clinical conditions associated with COLEC12.

Coronin, actin binding protein, 1c (CORO1C, Accession NP_055140.1) is another GAM1338 target gene, herein designated TARGET GENE. CORO1C BINDING SITE is a target binding site found in the 3' untranslated region of mRNA encoded by CORO1C, corresponding to a target binding site such as BINDING SITE I, BINDING SITE II or BINDING SITE III of FIG. 8. Table 4 illustrates the complementarity of the nucleotide sequences of CORO1C BINDING SITE, designated SEQ ID:1439, to the nucleotide sequence of GAM1338 RNA, herein designated GAM RNA, also designated SEQ ID:360.

Another function of GAM1338 is therefore inhibition of Coronin, actin binding protein, 1c (CORO1C, Accession NP_055140.1). Accordingly, utilities of GAM1338 include diagnosis, prevention and treatment of diseases and clinical conditions associated with CORO1C.

Cox15 homolog, cytochrome c oxidase assembly protein (yeast) (COX15, Accession NP_510870.1) is another GAM1338 target gene, herein designated TARGET GENE. COX15 BINDING SITE is a target binding site found in the 3' untranslated region of multiple transcripts of mRNA encoded by COX15, corresponding to a target binding site such as BINDING SITE I, BINDING SITE II or BINDING SITE III of FIG. 8. Table 4 illustrates the complementarity of the nucleotide sequences of COX15 BINDING SITE, designated SEQ ID:18262, to the nucleotide sequence of GAM1338 RNA, herein designated GAM RNA, also designated SEQ ID:360.

Another function of GAM1338 is therefore inhibition of Cox15 homolog, cytochrome c oxidase assembly protein (yeast) (COX15, Accession NP_510870.1). Accordingly, utilities of GAM1338 include diagnosis, prevention and treatment of diseases and clinical conditions associated with COX15.

Carboxypeptidase a4 (CPA4, Accession NP_057436.1) is another GAM1338 target gene, herein designated TARGET GENE. CPA4 BINDING SITE is a target binding site found in the 3' untranslated region of mRNA encoded by CPA4, corresponding to a target binding site such as BINDING SITE I, BINDING SITE II or BINDING SITE III of FIG. 8. Table 4 illustrates the complementarity of the nucleotide sequences of CPA4 BINDING SITE, designated SEQ ID:10987, to the nucleotide sequence of GAM1338 RNA, herein designated GAM RNA, also designated SEQ ID:360.

Another function of GAM1338 is therefore inhibition of Carboxypeptidase a4 (CPA4, Accession NP_057436.1). Accordingly, utilities of GAM1338 include diagnosis, prevention and treatment of diseases and clinical conditions associated with CPA4.

CPR8 (Accession NP_065790.1) is another GAM1338 target gene, herein designated TARGET GENE. CPR8 BINDING SITE is a target binding site found in the 3' untranslated region of multiple transcripts of mRNA encoded by CPR8, corresponding to a target binding site such as BINDING SITE I, BINDING SITE II or BINDING SITE III of FIG. 8. Table 4 illustrates the complementarity of the nucleotide sequences of CPR8 BINDING SITE, designated SEQ ID:9163, to the nucleotide sequence of GAM1338 RNA, herein designated GAM RNA, also designated SEQ ID:360.

Another function of GAM1338 is therefore inhibition of CPR8 (Accession NP_065790.1). Accordingly, utilities of GAM1338 include diagnosis, prevention and treatment of diseases and clinical conditions associated with CPR8.

Carbamoyl-phosphate synthetase 1, mitochondrial (CPS1, Accession NP_001866.2) is another GAM1338 target gene, herein designated TARGET GENE. CPS1 BINDING SITE is a target binding site found in the 3' untranslated region of mRNA encoded by CPS1, corresponding to a target binding site such as BINDING SITE I, BINDING SITE II or BINDING SITE III of FIG. 8. Table 4 illustrates the complementarity of the nucleotide sequences of CPS1 BINDING SITE, designated SEQ ID:4147, to the nucleotide sequence of GAM1338 RNA, herein designated GAM RNA, also designated SEQ ID:360.

Another function of GAM1338 is therefore inhibition of Carbamoyl-phosphate synthetase 1, mitochondrial (CPS1, Accession NP_001866.2) . Accordingly, utilities of GAM1338 include diagnosis, prevention and treatment of diseases and clinical conditions associated with CPS1.

Cleavage and polyadenylation specific factor 2, 100 kda (CPSF2, Accession XP_029311.2) is another GAM1338 target gene, herein designated TARGET GENE. CPSF2 BINDING SITE1 and CPSF2 BINDING SITE2 are target binding sites found in untranslated regions of mRNA encoded by CPSF2, corresponding to target binding sites such as BINDING SITE I, BINDING SITE II or BINDING SITE III of FIG. 8. Table 4 illustrates the complementarity of the nucleotide sequences of CPSF2 BINDING SITE1 and CPSF2 BINDING SITE2, designated SEQ ID:6739 and SEQ ID:6347 respectively, to the nucleotide sequence of GAM1338 RNA, herein designated GAM RNA, also designated SEQ ID:360.

Another function of GAM1338 is therefore inhibition of Cleavage and polyadenylation specific factor 2, 100 kda (CPSF2, Accession XP_029311.2). Accordingly, utilities of GAM1338 include diagnosis, prevention and treatment of diseases and clinical conditions associated with CPSF2.

Complement component (3b/4b) receptor 1, including knops blood group system (CR1, Accession NP_000564.1) is another GAM1338 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:13868, to the nucleotide sequence of GAM1338 RNA, herein designated GAM RNA, also designated SEQ ID:360.

Another function of GAM1338 is therefore inhibition of Complement component (3b/4b) receptor 1, including knops blood group system (CR1, Accession NP_000564.1).

Accordingly, utilities of GAM1338 include diagnosis, prevention and treatment of diseases and clinical conditions associated with CR1.

Complement component (3b/4b) receptor 1, including knops blood group system (CR1, Accession NP_000642.2) is another GAM1338 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:13868, to the nucleotide sequence of GAM1338 RNA, herein designated GAM RNA, also designated SEQ ID:360.

Another function of GAM1338 is therefore inhibition of Complement component (3b/4b) receptor 1, including knops blood group system (CR1, Accession NP_000642.2). Accordingly, utilities of GAM1338 include diagnosis, prevention and treatment of diseases and clinical conditions associated with CR1.

Cytokine receptor-like factor 3 (CRLF3, Accession NP_057070.2) is another GAM1338 target gene, herein designated TARGET GENE. CRLF3 BINDING SITE is a target binding site found in the 3' untranslated region of mRNA encoded by CRLF3, corresponding to a target binding site such as BINDING SITE I, BINDING SITE II or BINDING SITE III of FIG. 8. Table 4 illustrates the complementarity of the nucleotide sequences of CRLF3 BINDING SITE, designated SEQ ID:9675, to the nucleotide sequence of GAM1338 RNA, herein designated GAM RNA, also designated SEQ ID:360.

Another function of GAM1338 is therefore inhibition of Cytokine receptor-like factor 3 (CRLF3, Accession NP_057070.2). Accordingly, utilities of GAM1338 include diagnosis, prevention and treatment of diseases and clinical conditions associated with CRLF3.

Cofactor required for sp1 transcriptional activation, subunit 6, 77 kda (CRSP6, Accession NP_004259.3) is another GAM1338 target gene, herein designated TARGET GENE. CRSP6 BINDING SITE is a target binding site found in the 3' untranslated region of mRNA encoded by CRSP6, corresponding to a target binding site such as BINDING SITE I, BINDING SITE II or BINDING SITE III of FIG. 8. Table 4 illustrates the complementarity of the nucleotide sequences of CRSP6 BINDING SITE, designated SEQ ID:12005, to the nucleotide sequence of GAM1338 RNA, herein designated GAM RNA, also designated SEQ ID:360.

Another function of GAM1338 is therefore inhibition of Cofactor required for sp1 transcriptional activation, subunit 6, 77 kda (CRSP6, Accession NP_004259.3), a gene which is required for Sp1 mediated transcriptional activation with TAF (II)s. Accordingly, utilities of GAM1338 include diagnosis, prevention and treatment of diseases and clinical conditions associated with CRSP6.

The function of CRSP6 and its association with various diseases and clinical conditions, has been established by previous studies, as described hereinabove with reference to GAM189.1. Cartilage associated protein (CRTAP, Accession NP_006362.1) is another GAM1338 target gene, herein designated TARGET GENE. CRTAP BINDING SITE is a target binding site found in the 3' untranslated region of mRNA encoded by CRTAP, corresponding to a target binding site such as BINDING SITE I, BINDING SITE II or BINDING SITE III of FIG. 8. Table 4 illustrates the complementarity of the nucleotide sequences of CRTAP BINDING SITE, designated SEQ ID:776, to the nucleotide sequence of GAM1338 RNA, herein designated GAM RNA, also designated SEQ ID:360.

Another function of GAM1338 is therefore inhibition of Cartilage associated protein (CRTAP, Accession NP_006362.1), a gene which is a novel developmentally regulated chick embryo protein. Accordingly, utilities of GAM1338 include diagnosis, prevention and treatment of diseases and clinical conditions associated with CRTAP.

The function of CRTAP and its association with various diseases and clinical conditions, has been established by previous studies, as described hereinabove with reference to GAM136.1. Crystallin, zeta (quinone reductase)-like 1 (CRYZL1, Accession NP_665857.1) is another GAM1338 target gene, herein designated TARGET GENE. CRYZL1 BINDING SITE is a target binding site found in the 3' untranslated region of multiple transcripts of mRNA encoded by CRYZL1, corresponding to a target binding site such as BINDING SITE I, BINDING SITE II or BINDING SITE III of FIG. 8. Table 4 illustrates the complementarity of the nucleotide sequences of CRYZL1 BINDING SITE, designated SEQ ID:2539, to the nucleotide sequence of GAM1338 RNA, herein designated GAM RNA, also designated SEQ ID:360.

Another function of GAM1338 is therefore inhibition of Crystallin, zeta (quinone reductase)-like 1 (CRYZL1, Accession NP_665857.1). Accordingly, utilities of GAM1338 include diagnosis, prevention and treatment of diseases and clinical conditions associated with CRYZL1.

Crystallin, zeta (quinone reductase)-like 1 (CRYZL1, Accession NP_660354.1) is another GAM1338 target gene, herein designated TARGET GENE. CRYZL1 BINDING SITE is a target binding site found in the 3' untranslated region of multiple transcripts of mRNA encoded by CRYZL1, corresponding to a target binding site such as BINDING SITE I, BINDING SITE II or BINDING SITE III of FIG. 8. Table 4 illustrates the complementarity of the nucleotide sequences of CRYZL1 BINDING SITE, designated SEQ ID:2539, to the nucleotide sequence of GAM1338 RNA, herein designated GAM RNA, also designated SEQ ID:360.

Another function of GAM1338 is therefore inhibition of Crystallin, zeta (quinone reductase)-like 1 (CRYZL1, Accession NP_660354.1). Accordingly, utilities of GAM1338 include diagnosis, prevention and treatment of diseases and clinical conditions associated with CRYZL1.

CSE-C (Accession NP_061851.1) is another GAM1338 target gene, herein designated TARGET GENE. CSE-C BINDING SITE is a target binding site found in the 5' untranslated region of multiple transcripts of mRNA encoded by CSE-C, corresponding to a target binding site such as BINDING SITE I, BINDING SITE II or BINDING SITE III of FIG. 8. Table 4 illustrates the complementarity of the nucleotide sequences of CSE-C BINDING SITE, designated SEQ ID:2336, to the nucleotide sequence of GAM1338 RNA, herein designated GAM RNA, also designated SEQ ID:360.

Another function of GAM1338 is therefore inhibition of CSE-C (Accession NP_061851.1). Accordingly, utilities of GAM1338 include diagnosis, prevention and treatment of diseases and clinical conditions associated with CSE-C.

Cse1 chromosome segregation 1-like (yeast) (CSE1L, Accession NP_803185.1) is another GAM1338 target gene, herein designated TARGET GENE. CSE1L BINDING SITE is a target binding site found in the 3' untranslated region of multiple transcripts of mRNA encoded by CSE1L, corresponding to a target binding site such as BINDING SITE I, BINDING SITE II or BINDING SITE III of FIG. 8. Table 4 illustrates the complementarity of the nucleotide sequences of CSE1L BINDING SITE, designated SEQ ID:3997, to the nucleotide sequence of GAM1338 RNA, herein designated GAM RNA, also designated SEQ ID:360.

Another function of GAM1338 is therefore inhibition of Cse1 chromosome segregation 1-like (yeast) (CSE1L, Accession NP_803185.1). Accordingly, utilities of GAM1338 include diagnosis, prevention and treatment of diseases and clinical conditions associated with CSE1L.

Casein kinase 2, alpha prime polypeptide (CSNK2A2, Accession NP_001887.1) is another GAM1338 target gene, herein designated TARGET GENE. CSNK2A2 BINDING SITE is a target binding site found in the 5' untranslated region of mRNA encoded by CSNK2A2, corresponding to a target binding site such as BINDING SITE I, BINDING SITE II or BINDING SITE III of FIG. 8. Table 4 illustrates the complementarity of the nucleotide sequences of CSNK2A2 BINDING SITE, designated SEQ ID:15382, to the nucleotide sequence of GAM1338 RNA, herein designated GAM RNA, also designated SEQ ID:360.

Another function of GAM1338 is therefore inhibition of Casein kinase 2, alpha prime polypeptide (CSNK2A2, Accession NP_001887.1), a gene which catalyzes the phosphorylation of serine or threonine residues in proteins. Accordingly, utilities of GAM1338 include diagnosis, prevention and treatment of diseases and clinical conditions associated with CSNK2A2.

The function of CSNK2A2 and its association with various diseases and clinical conditions, has been established by previous studies, as described hereinabove with reference to GAM189.1. Cardiotrophin 1 (CTF1, Accession NP_001321.1) is another GAM1338 target gene, herein designated TARGET GENE. CTF1 BINDING SITE is a target binding site found in the 3' untranslated region of mRNA encoded by CTF1, corresponding to a target binding site such as BINDING SITE I, BINDING SITE II or BINDING SITE III of FIG. 8. Table 4 illustrates the complementarity of the nucleotide sequences of CTF1 BINDING SITE, designated SEQ ID:6515, to the nucleotide sequence of GAM1338 RNA, herein designated GAM RNA, also designated SEQ ID:360.

Another function of GAM1338 is therefore inhibition of Cardiotrophin 1 (CTF1, Accession NP_001321.1), a gene which may play a role in cardiac hypertrophy. and therefore may be associated with Cardiac hypertrophy. Accordingly, utilities of GAM1338 include diagnosis, prevention and treatment of Cardiac hypertrophy, and of other diseases and clinical conditions associated with CTF1.

The function of CTF1 and its association with various diseases and clinical conditions, has been established by previous studies, as described hereinabove with reference to GAM189.1. Cathepsin s (CTSS, Accession NP_004070.3) is another GAM1338 target gene, herein designated TARGET GENE. CTSS BINDING SITE is a target binding site found in the 3' untranslated region of mRNA encoded by CTSS, corresponding to a target binding site such as BINDING SITE I, BINDING SITE II or BINDING SITE III of FIG. 8. Table 4 illustrates the complementarity of the nucleotide sequences of CTSS BINDING SITE, designated SEQ ID:7946, to the nucleotide sequence of GAM1338 RNA, herein designated GAM RNA, also designated SEQ ID:360.

Another function of GAM1338 is therefore inhibition of Cathepsin s (CTSS, Accession NP_004070.3), a gene which is a lysosomal cysteine (thiol) protease that cleaves elastin. Accordingly, utilities of GAM1338 include diagnosis, prevention and treatment of diseases and clinical conditions associated with CTSS.

The function of CTSS and its association with various diseases and clinical conditions, has been established by previous studies, as described hereinabove with reference to GAM72.1. Chemokine (c-x-c motif) ligand 16 (CXCL16, Accession NP_071342.1) is another GAM1338 target gene, herein designated TARGET GENE. CXCL16 BINDING SITE is a target binding site found in the 3' untranslated region of mRNA encoded by CXCL16, corresponding to a target binding site such as BINDING SITE I, BINDING SITE II or BINDING SITE III of FIG. 8. Table 4 illustrates the complementarity of the nucleotide sequences of CXCL16 BINDING SITE, designated SEQ ID:11701, to the nucleotide sequence of GAM1338 RNA, herein designated GAM RNA, also designated SEQ ID:360.

Another function of GAM1338 is therefore inhibition of Chemokine (c-x-c motif) ligand 16 (CXCL16, Accession NP_071342.1), a gene which induces calcium mobilization. Accordingly, utilities of GAM1338 include diagnosis, prevention and treatment of diseases and clinical conditions associated with CXCL16.

The function of CXCL16 and its association with various diseases and clinical conditions, has been established by previous studies, as described hereinabove with reference to GAM189.1. Chemokine (c-x-c motif) ligand 6 (granulocyte chemotactic protein 2) (CXCL6, Accession NP_002984.1) is another GAM1338 target gene, herein designated TARGET GENE. CXCL6 BINDING SITE is a target binding site found in the 3' untranslated region of mRNA encoded by CXCL6, corresponding to a target binding site such as BINDING SITE I, BINDING SITE II or BINDING SITE III of FIG. 8. Table 4 illustrates the complementarity of the nucleotide sequences of CXCL6 BINDING SITE, designated SEQ ID:7236, to the nucleotide sequence of GAM1338 RNA, herein designated GAM RNA, also designated SEQ ID:360.

Another function of GAM1338 is therefore inhibition of Chemokine (c-x-c motif) ligand 6 (granulocyte chemotactic protein 2) (CXCL6, Accession NP_002984.1), a gene which is chemotactic for neutrophil granulocytes. Accordingly, utilities of GAM1338 include diagnosis, prevention and treatment of diseases and clinical conditions associated with CXCL6.

The function of CXCL6 and its association with various diseases and clinical conditions, has been established by previous studies, as described hereinabove with reference to GAM281.1. CYCS (Accession NP_061820.1) is another GAM1338 target gene, herein designated TARGET GENE. CYCS BINDING SITE1 through CYCS BINDING SITE3 are target binding sites found in untranslated regions of mRNA encoded by CYCS, corresponding to target binding sites such as BINDING SITE I, BINDING SITE II or BINDING SITE III of FIG. 8. Table 4 illustrates the complementarity of the nucleotide sequences of CYCS BINDING SITE1 through CYCS BINDING SITE3, designated SEQ ID:15642, SEQ ID:14950 and SEQ ID:19693 respectively, to the nucleotide sequence of GAM1338 RNA, herein designated GAM RNA, also designated SEQ ID:360.

Another function of GAM1338 is therefore inhibition of CYCS (Accession NP_061820.1). Accordingly, utilities of GAM1338 include diagnosis, prevention and treatment of diseases and clinical conditions associated with CYCS.

Cylicin, basic protein of sperm head cytoskeleton 2 (CYLC2, Accession NP_001331.1) is another GAM1338 target gene, herein designated TARGET GENE. CYLC2 BINDING SITE is a target binding site found in the 3' untranslated region of mRNA encoded by CYLC2, corresponding to a target binding site such as BINDING SITE I, BINDING SITE II or BINDING SITE III of FIG. 8. Table 4 illustrates the complementarity of the nucleotide sequences of CYLC2 BINDING SITE, designated SEQ ID:12632, to the nucleotide sequence of GAM1338 RNA, herein designated GAM RNA, also designated SEQ ID:360.

Another function of GAM1338 is therefore inhibition of Cylicin, basic protein of sperm head cytoskeleton 2 (CYLC2, Accession NP_001331.1). Accordingly, utilities of GAM1338 include diagnosis, prevention and treatment of diseases and clinical conditions associated with CYLC2.

Cytochrome p450, subfamily i (aromatic compound-inducible), polypeptide 2 (CYP1A2, Accession NP_000752.1) is another GAM1338 target gene, herein designated TARGET GENE. CYP1A2 BINDING SITE1 through CYP1A2 BINDING SITE3 are target binding sites found in untranslated regions of mRNA encoded by CYP1A2, corresponding to target binding sites such as BINDING SITE I, BINDING SITE II or BINDING SITE III of FIG. 8. Table 4 illustrates the complementarity of the nucleotide sequences of CYP1A2 BINDING SITE1 through CYP1A2 BINDING SITE3, designated SEQ ID:6816, SEQ ID:8688 and SEQ ID:13973 respectively, to the nucleotide sequence of GAM1338 RNA, herein designated GAM RNA, also designated SEQ ID:360.

Another function of GAM1338 is therefore inhibition of Cytochrome p450, subfamily i (aromatic compound-inducible), polypeptide 2 (CYP1A2, Accession NP_000752.1), a gene which intervenes in an NADPH-dependent electron transport pathway. and therefore may be associated with Porphyria cutanea tarda. Accordingly, utilities of GAM1338 include diagnosis, prevention and treatment of Porphyria cutanea tarda, and of other diseases and clinical conditions associated with CYP1A2.

The function of CYP1A2 and its association with various diseases and clinical conditions, has been established by previous studies, as described hereinabove with reference to GAM30.1. Cytochrome p450, subfamily iib (phenobarbital-inducible), polypeptide 6 (CYP2B6, Accession NP_000758.1) is another GAM1338 target gene, herein designated TARGET GENE. CYP2B6 BINDING SITE1 and CYP2B6 BINDING SITE2 are target binding sites found in untranslated regions of mRNA encoded by CYP2B6, corresponding to target binding sites such as BINDING SITE I, BINDING SITE II or BINDING SITE III of FIG. 8. Table 4 illustrates the complementarity of the nucleotide sequences of CYP2B6 BINDING SITE1 and CYP2B6 BINDING SITE2, designated SEQ ID:3011 and SEQ ID:4525 respectively, to the nucleotide sequence of GAM1338 RNA, herein designated GAM RNA, also designated SEQ ID:360.

Another function of GAM1338 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM1338 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. Cytochrome p450, subfamily ivf, polypeptide 3 (leukotriene b4 omega hydroxylase) (CYP4F3, Accession NP_000887.1) is another GAM1338 target gene, herein designated TARGET GENE. CYP4F3 BINDING SITE is a target binding site found in the 3' untranslated region of mRNA encoded by CYP4F3, corresponding to a target binding site such as BINDING SITE I, BINDING SITE II or BINDING SITE III of FIG. 8. Table 4 illustrates the complementarity of the nucleotide sequences of CYP4F3 BINDING SITE, designated SEQ ID:1417, to the nucleotide sequence of GAM1338 RNA, herein designated GAM RNA, also designated SEQ ID:360.

Another function of GAM1338 is therefore inhibition of Cytochrome p450, subfamily ivf, polypeptide 3 (leukotriene b4 omega hydroxylase) (CYP4F3, Accession NP_000887.1), a gene which converts leukotriene B4 into the less active 20-hydroxy-leukotriene B4. Accordingly, utilities of GAM1338 include diagnosis, prevention and treatment of diseases and clinical conditions associated with CYP4F3.

The function of CYP4F3 and its association with various diseases and clinical conditions, has been established by previous studies, as described hereinabove with reference to GAM67.1. CYP51A1 (Accession NP_000777.1) is another GAM1338 target gene, herein designated TARGET GENE. CYP51A1 BINDING SITE is a target binding site found in the 3' untranslated region of mRNA encoded by CYP51A1, corresponding to a target binding site such as BINDING SITE I, BINDING SITE II or BINDING SITE III of FIG. 8. Table 4 illustrates the complementarity of the nucleotide sequences of CYP51A1 BINDING SITE, designated SEQ ID:10631, to the nucleotide sequence of GAM1338 RNA, herein designated GAM RNA, also designated SEQ ID:360.

Another function of GAM1338 is therefore inhibition of CYP51A1 (Accession NP_000777.1). Accordingly, utilities of GAM1338 include diagnosis, prevention and treatment of diseases and clinical conditions associated with CYP51A1.

Cytochrome p450, subfamily viiib (sterol 12-alpha-hydroxylase), polypeptide 1 (CYP8B1, Accession NP_004382.1) is another GAM1338 target gene, herein designated TARGET GENE. CYP8B1 BINDING SITE is a target binding site found in the 3' untranslated region of mRNA encoded by CYP8B1, corresponding to a target binding site such as BINDING SITE I, BINDING SITE II or BINDING SITE III of FIG. 8. Table 4 illustrates the complementarity of the nucleotide sequences of CYP8B1 BINDING SITE, designated SEQ ID:5584, to the nucleotide sequence of GAM1338 RNA, herein designated GAM RNA, also designated SEQ ID:360.

Another function of GAM1338 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM1338 include diagnosis, prevention and treatment of diseases and clinical conditions associated with CYP8B1.

The function of CYP8B1 and its association with various diseases and clinical conditions, has been established by previous studies, as described hereinabove with reference to GAM47.1. Doublecortex; lissencephaly, x-linked (doublecortin) (DCX, Accession NP_835365.1) is another GAM1338 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:6035, to the nucleotide sequence of GAM1338 RNA, herein designated GAM RNA, also designated SEQ ID:360.

Another function of GAM1338 is therefore inhibition of Doublecortex; lissencephaly, x-linked (doublecortin) (DCX, Accession NP_835365.1). Accordingly, utilities of GAM1338 include diagnosis, prevention and treatment of diseases and clinical conditions associated with DCX.

Doublecortex; lissencephaly, x-linked (doublecortin) (DCX, Accession NP_835366.1) is another GAM1338 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:6035, to the nucleotide sequence of GAM1338 RNA, herein designated GAM RNA, also designated SEQ ID:360.

Another function of GAM1338 is therefore inhibition of Doublecortex; lissencephaly, x-linked (doublecortin) (DCX, Accession NP_835366.1). Accordingly, utilities of GAM1338 include diagnosis, prevention and treatment of diseases and clinical conditions associated with DCX.

Doublecortex; lissencephaly, x-linked (doublecortin) (DCX, Accession NP_835364.1) is another GAM1338 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:6035, to the nucleotide sequence of GAM1338 RNA, herein designated GAM RNA, also designated SEQ ID:360.

Another function of GAM1338 is therefore inhibition of Doublecortex; lissencephaly, x-linked (doublecortin) (DCX, Accession NP_835364.1). Accordingly, utilities of GAM1338 include diagnosis, prevention and treatment of diseases and clinical conditions associated with DCX.

Doublecortex; lissencephaly, x-linked (doublecortin) (DCX, Accession NP_000546.2) is another GAM1338 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:6035, to the nucleotide sequence of GAM1338 RNA, herein designated GAM RNA, also designated SEQ ID:360.

Another function of GAM1338 is therefore inhibition of Doublecortex; lissencephaly, x-linked (doublecortin) (DCX, Accession NP_000546.2). Accordingly, utilities of GAM1338 include diagnosis, prevention and treatment of diseases and clinical conditions associated with DCX.

Dead/h (asp-glu-ala-asp/his) box polypeptide 31 (DDX31, Accession NP_619526.1) is another GAM1338 target gene, herein designated TARGET GENE. DDX31 BINDING SITE is a target binding site found in the 3' untranslated region of multiple transcripts of mRNA encoded by DDX31, corresponding to a target binding site such as BINDING SITE I, BINDING SITE II or BINDING SITE III of FIG. 8. Table 4 illustrates the complementarity of the nucleotide sequences of DDX31 BINDING SITE, designated SEQ ID:17894, to the nucleotide sequence of GAM1338 RNA, herein designated GAM RNA, also designated SEQ ID:360.

Another function of GAM1338 is therefore inhibition of Dead/h (asp-glu-ala-asp/his) box polypeptide 31 (DDX31, Accession NP_619526.1). Accordingly, utilities of GAM1338 include diagnosis, prevention and treatment of diseases and clinical conditions associated with DDX31.

Desmin (DES, Accession NP_001918.2) is another GAM1338 target gene, herein designated TARGET GENE. DES BINDING SITE is a target binding site found in the 3' untranslated region of mRNA encoded by DES, corresponding to a target binding site such as BINDING SITE I, BINDING SITE II or BINDING SITE III of FIG. 8. Table 4 illustrates the complementarity of the nucleotide sequences of DES BINDING SITE, designated SEQ ID:5111, to the nucleotide sequence of GAM1338 RNA, herein designated GAM RNA, also designated SEQ ID:360.

Another function of GAM1338 is therefore inhibition of Desmin (DES, Accession NP_001918.2). Accordingly, utilities of GAM1338 include diagnosis, prevention and treatment of diseases and clinical conditions associated with DES.

Dna fragmentation factor, 40 kda, beta polypeptide (caspase-activated dnase) (DFFB, Accession NP_004393.1) is another GAM1338 target gene, herein designated TARGET GENE. DFFB BINDING SITE1 and DFFB BINDING SITE2 are target binding sites found in untranslated regions of mRNA encoded by DFFB, corresponding to target binding sites such as BINDING SITE I, BINDING SITE II or BINDING SITE III of FIG. 8. Table 4 illustrates the complementarity of the nucleotide sequences of DFFB BINDING SITE1 and DFFB BINDING SITE2, designated SEQ ID:7574 and SEQ ID:7848 respectively, to the nucleotide sequence of GAM1338 RNA, herein designated GAM RNA, also designated SEQ ID:360.

Another function of GAM1338 is therefore inhibition of Dna fragmentation factor, 40 kda, beta polypeptide (caspase-activated dnase) (DFFB, Accession NP_004393.1), a gene which induces DNA fragmentation and chromatin condensation during apoptosis. Accordingly, utilities of GAM1338 include diagnosis, prevention and treatment of diseases and clinical conditions associated with DFFB.

The function of DFFB and its association with various diseases and clinical conditions, has been established by previous studies, as described hereinabove with reference to GAM130.1. Diaphanous homolog 2 (drosophila) (DIAPH2, Accession NP_006720.1) is another GAM1338 target gene, herein designated TARGET GENE. DIAPH2 BINDING SITE is a target binding site found in the 3' untranslated region of multiple transcripts of mRNA encoded by DIAPH2, corresponding to a target binding site such as BINDING SITE I, BINDING SITE II or BINDING SITE III of FIG. 8. Table 4 illustrates the complementarity of the nucleotide sequences of DIAPH2 BINDING SITE, designated SEQ ID:12586, to the nucleotide sequence of GAM1338 RNA, herein designated GAM RNA, also designated SEQ ID:360.

Another function of GAM1338 is therefore inhibition of Diaphanous homolog 2 (drosophila) (DIAPH2, Accession NP_006720.1), a gene which may affect in oogenesis and therefore may be associated with Premature ovarian failure. Accordingly, utilities of GAM1338 include diagnosis, prevention and treatment of Premature ovarian failure., and of other diseases and clinical conditions associated with DIAPH2.

The function of DIAPH2 and its association with various diseases and clinical conditions, has been established by previous studies, as described hereinabove with reference to GAM66.1. Disrupted in schizophrenia 1 (DISC1, Accession NP_061132.1) is another GAM1338 target gene, herein designated TARGET GENE. DISC1 BINDING SITE is a target binding site found in the 3' untranslated region of mRNA encoded by DISC1, corresponding to a target binding site such as BINDING SITE I, BINDING SITE II or BINDING SITE III of FIG. 8. Table 4 illustrates the complementarity of the nucleotide sequences of DISC1 BINDING SITE, designated SEQ ID:13620, to the nucleotide sequence of GAM1338 RNA, herein designated GAM RNA, also designated SEQ ID:360.

Another function of GAM1338 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM1338 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. DKFZP434B044 (Accession NP_113664.1) is another GAM1338 target gene, herein designated TARGET GENE. DKFZP434B044 BINDING SITE is a target binding site found in the 3' untranslated region of mRNA encoded by DKFZP434B044, corresponding to a target binding site such as BINDING SITE I, BINDING SITE II or BINDING SITE III of FIG. 8. Table 4 illustrates the complementarity of the nucleotide sequences of DKFZP434B044 BINDING SITE, designated SEQ ID:11474, to the nucleotide sequence of GAM1338 RNA, herein designated GAM RNA, also designated SEQ ID:360.

Another function of GAM1338 is therefore inhibition of DKFZP434B044 (Accession NP_113664.1). Accordingly, utilities of GAM1338 include diagnosis, prevention and treatment of diseases and clinical conditions associated with DKFZP434B044.

DKFZP434B1727 (Accession NP_115519.1) is another GAM1338 target gene, herein designated TARGET GENE. DKFZP434B1727 BINDING SITE is a target binding site found in the 3' untranslated region of mRNA encoded by DKFZP434B1727, corresponding to a target binding site such as BINDING SITE I, BINDING SITE II or BINDING SITE III of FIG. 8. Table 4 illustrates the complementarity of the nucleotide sequences of DKFZP434B1727 BINDING SITE, designated SEQ ID:1107, to the nucleotide sequence of GAM1338 RNA, herein designated GAM RNA, also designated SEQ ID:360.

Another function of GAM1338 is therefore inhibition of DKFZP434B1727 (Accession NP_115519.1). Accordingly, utilities of GAM1338 include diagnosis, prevention and treatment of diseases and clinical conditions associated with DKFZP434B1727.

DKFZp434C0923 (Accession NP_060068.1) is another GAM1338 target gene, herein designated TARGET GENE. DKFZp434C0923 BINDING SITE is a target binding site found in the 3' untranslated region of mRNA encoded by DKFZp434C0923, corresponding to a target binding site such as BINDING SITE I, BINDING SITE II or BINDING SITE III of FIG. 8. Table 4 illustrates the complementarity of the nucleotide sequences of DKFZp434C0923 BINDING SITE, designated SEQ ID:7947, to the nucleotide sequence of GAM1338 RNA, herein designated GAM RNA, also designated SEQ ID:360.

Another function of GAM1338 is therefore inhibition of DKFZp434C0923 (Accession NP_060068.1). Accordingly, utilities of GAM1338 include diagnosis, prevention and treatment of diseases and clinical conditions associated with DKFZp434C0923.

DKFZP434C212 (Accession XP_044196.3) is another GAM1338 target gene, herein designated TARGET GENE. DKFZP434C212 BINDING SITE is a target binding site found in the 3' untranslated region of mRNA encoded by DKFZP434C212, corresponding to a target binding site such as BINDING SITE I, BINDING SITE II or BINDING SITE III of FIG. 8. Table 4 illustrates the complementarity of the nucleotide sequences of DKFZP434C212 BINDING SITE, designated SEQ ID:5299, to the nucleotide sequence of GAM1338 RNA, herein designated GAM RNA, also designated SEQ ID:360.

Another function of GAM1338 is therefore inhibition of DKFZP434C212 (Accession XP_044196.3). Accordingly, utilities of GAM1338 include diagnosis, prevention and treatment of diseases and clinical conditions associated with DKFZP434C212.

DKFZP434D146 (Accession NP_056410.2) is another GAM1338 target gene, herein designated TARGET GENE. DKFZP434D146 BINDING SITE is a target binding site found in the 3' untranslated region of mRNA encoded by DKFZP434D146, corresponding to a target binding site such as BINDING SITE I, BINDING SITE II or BINDING SITE III of FIG. 8. Table 4 illustrates the complementarity of the nucleotide sequences of DKFZP434D146 BINDING SITE, designated SEQ ID:4843, to the nucleotide sequence of GAM1338 RNA, herein designated GAM RNA, also designated SEQ ID:360.

Another function of GAM1338 is therefore inhibition of DKFZP434D146 (Accession NP_056410.2). Accordingly, utilities of GAM1338 include diagnosis, prevention and treatment of diseases and clinical conditions associated with DKFZP434D146.

DKFZp434E2220 (Accession NP_060082.1) is another GAM1338 target gene, herein designated TARGET GENE. DKFZp434E2220 BINDING SITE is a target binding site found in the 5' untranslated region of mRNA encoded by DKFZp434E2220, corresponding to a target binding site such as BINDING SITE I, BINDING SITE II or BINDING SITE III of FIG. 8. Table 4 illustrates the complementarity of the nucleotide sequences of DKFZp434E2220 BINDING SITE, designated SEQ ID:18031, to the nucleotide sequence of GAM1338 RNA, herein designated GAM RNA, also designated SEQ ID:360.

Another function of GAM1338 is therefore inhibition of DKFZp434E2220 (Accession NP_060082.1). Accordingly, utilities of GAM1338 include diagnosis, prevention and treatment of diseases and clinical conditions associated with DKFZp434E2220.

DKFZP434F0318 (Accession NP_110444.1) is another GAM1338 target gene, herein designated TARGET GENE. DKFZP434F0318 BINDING SITE is a target binding site found in the 3' untranslated region of mRNA encoded by DKFZP434F0318, corresponding to a target binding site such as BINDING SITE I, BINDING SITE II or BINDING SITE III of FIG. 8. Table 4 illustrates the complementarity of the nucleotide sequences of DKFZP434F0318 BINDING SITE, designated SEQ ID:14671, to the nucleotide sequence of GAM1338 RNA, herein designated GAM RNA, also designated SEQ ID:360.

Another function of GAM1338 is therefore inhibition of DKFZP434F0318 (Accession NP_110444.1). Accordingly, utilities of GAM1338 include diagnosis, prevention and treatment of diseases and clinical conditions associated with DKFZP434F0318.

DKFZp434F1719 (Accession NP_115624.1) is another GAM1338 target gene, herein designated TARGET GENE. DKFZp434F1719 BINDING SITE is a target binding site found in the 3' untranslated region of mRNA encoded by DKFZp434F1719, corresponding to a target binding site such as BINDING SITE I, BINDING SITE II or BINDING SITE III of FIG. 8. Table 4 illustrates the complementarity of the nucleotide sequences of DKFZp434F1719 BINDING SITE, designated SEQ ID:4173, to the nucleotide sequence of GAM1338 RNA, herein designated GAM RNA, also designated SEQ ID:360.

Another function of GAM1338 is therefore inhibition of DKFZp434F1719 (Accession NP_115624.1). Accordingly, utilities of GAM1338 include diagnosis, prevention and treatment of diseases and clinical conditions associated with DKFZp434F1719.

DKFZp547H025 (Accession NP_064546.1) is another GAM1338 target gene, herein designated TARGET GENE. DKFZp547H025 BINDING SITE is a target binding site found in the 3' untranslated region of mRNA encoded by DKFZp547H025, corresponding to a target binding site such as BINDING SITE I, BINDING SITE II or BINDING SITE III of FIG. 8. Table 4 illustrates the complementarity of the nucleotide sequences of DKFZp547H025 BINDING SITE, designated SEQ ID:1994, to the nucleotide sequence of GAM1338 RNA, herein designated GAM RNA, also designated SEQ ID:360.

Another function of GAM1338 is therefore inhibition of DKFZp547H025 (Accession NP_064546.1). Accordingly, utilities of GAM1338 include diagnosis, prevention and treatment of diseases and clinical conditions associated with DKFZp547H025.

DKFZp547P234 (Accession NP_694590.1) is another GAM1338 target gene, herein designated TARGET GENE. DKFZp547P234 BINDING SITE is a target binding site found in the 3' untranslated region of mRNA encoded by DKFZp547P234, corresponding to a target binding site such as BINDING SITE I, BINDING SITE II or BINDING SITE III of FIG. 8. Table 4 illustrates the complementarity of the nucleotide sequences of DKFZp547P234 BINDING SITE, designated SEQ ID:3007, to the nucleotide sequence of GAM1338 RNA, herein designated GAM RNA, also designated SEQ ID:360.

Another function of GAM1338 is therefore inhibition of DKFZp547P234 (Accession NP_694590.1). Accordingly, utilities of GAM1338 include diagnosis, prevention and treatment of diseases and clinical conditions associated with DKFZp547P234.

DKFZP564D166 (Accession NP_108648.1) is another GAM1338 target gene, herein designated TARGET GENE. DKFZP564D166 BINDING SITE is a target binding site found in the 3' untranslated region of multiple transcripts of mRNA encoded by DKFZP564D166, corresponding to a target binding site such as BINDING SITE I, BINDING SITE II or BINDING SITE III of FIG. 8. Table 4 illustrates the complementarity of the nucleotide sequences of DKFZP564D166 BINDING SITE, designated SEQ ID:13202, to the nucleotide sequence of GAM1338 RNA, herein designated GAM RNA, also designated SEQ ID:360.

Another function of GAM1338 is therefore inhibition of DKFZP564D166 (Accession NP_108648.1). Accordingly, utilities of GAM1338 include diagnosis, prevention and treatment of diseases and clinical conditions associated with DKFZP564D166.

DKFZP564G092 (Accession NP_056416.1) is another GAM1338 target gene, herein designated TARGET GENE. DKFZP564G092 BINDING SITE is a target binding site found in the 5' untranslated region of mRNA encoded by DKFZP564G092, corresponding to a target binding site such as BINDING SITE I, BINDING SITE II or BINDING SITE III of FIG. 8. Table 4 illustrates the complementarity of the nucleotide sequences of DKFZP564G092 BINDING SITE, designated SEQ ID:519, to the nucleotide sequence of GAM1338 RNA, herein designated GAM RNA, also designated SEQ ID:360.

Another function of GAM1338 is therefore inhibition of DKFZP564G092 (Accession NP_056416.1). Accordingly, utilities of GAM1338 include diagnosis, prevention and treatment of diseases and clinical conditions associated with DKFZP564G092.

DKFZP564I122 (Accession XP_032397.1) is another GAM1338 target gene, herein designated TARGET GENE. DKFZP564I122 BINDING SITE is a target binding site found in the 3' untranslated region of mRNA encoded by DKFZP564I122, corresponding to a target binding site such as BINDING SITE I, BINDING SITE II or BINDING SITE III of FIG. 8. Table 4 illustrates the complementarity of the nucleotide sequences of DKFZP564I122 BINDING SITE, designated SEQ ID:19815, to the nucleotide sequence of GAM1338 RNA, herein designated GAM RNA, also designated SEQ ID:360.

Another function of GAM1338 is therefore inhibition of DKFZP564I122 (Accession XP_032397.1). Accordingly, utilities of GAM1338 include diagnosis, prevention and treatment of diseases and clinical conditions associated with DKFZP564I122.

DKFZP564J0863 (Accession NP_056274.1) is another GAM1338 target gene, herein designated TARGET GENE. DKFZP564J0863 BINDING SITE is a target binding site found in the 3' untranslated region of mRNA encoded by DKFZP564J0863, corresponding to a target binding site such as BINDING SITE I, BINDING SITE II or BINDING SITE III of FIG. 8. Table 4 illustrates the complementarity of the nucleotide sequences of DKFZP564J0863 BINDING SITE, designated SEQ ID:18946, to the nucleotide sequence of GAM1338 RNA, herein designated GAM RNA, also designated SEQ ID:360.

Another function of GAM1338 is therefore inhibition of DKFZP564J0863 (Accession NP_056274.1). Accordingly, utilities of GAM1338 include diagnosis, prevention and treatment of diseases and clinical conditions associated with DKFZP564J0863.

DKFZP564K0322 (Accession NP_114429.1) is another GAM1338 target gene, herein designated TARGET GENE. DKFZP564K0322 BINDING SITE is a target binding site found in the 3' untranslated region of mRNA encoded by DKFZP564K0322, corresponding to a target binding site such as BINDING SITE I, BINDING SITE II or BINDING SITE III of FIG. 8. Table 4 illustrates the complementarity of the nucleotide sequences of DKFZP564K0322 BINDING SITE, designated SEQ ID:1414, to the nucleotide sequence of GAM1338 RNA, herein designated GAM RNA, also designated SEQ ID:360.

Another function of GAM1338 is therefore inhibition of DKFZP564K0322 (Accession NP_114429.1). Accordingly, utilities of GAM1338 include diagnosis, prevention and treatment of diseases and clinical conditions associated with DKFZP564K0322.

DKFZp564K142 (Accession NP_115497.2) is another GAM1338 target gene, herein designated TARGET GENE. DKFZp564K142 BINDING SITE is a target binding site found in the 3' untranslated region of mRNA encoded by DKFZp564K142, corresponding to a target binding site such as BINDING SITE I, BINDING SITE II or BINDING SITE III of FIG. 8. Table 4 illustrates the complementarity of the nucleotide sequences of DKFZp564K142 BINDING SITE, designated SEQ ID:811, to the nucleotide sequence of GAM1338 RNA, herein designated GAM RNA, also designated SEQ ID:360.

Another function of GAM1338 is therefore inhibition of DKFZp564K142 (Accession NP_115497.2). Accordingly, utilities of GAM1338 include diagnosis, prevention and treatment of diseases and clinical conditions associated with DKFZp564K142.

DKFZP564O0523 (Accession NP_115496.1) is another GAM1338 target gene, herein designated TARGET GENE. DKFZP564O0523 BINDING SITE is a target binding site found in the 3' untranslated region of mRNA encoded by DKFZP564O0523, corresponding to a target binding site such as BINDING SITE I, BINDING SITE II or BINDING SITE III of FIG. 8. Table 4 illustrates the complementarity of the nucleotide sequences of DKFZP564O0523 BINDING SITE, designated SEQ ID:1963, to the nucleotide sequence of GAM1338 RNA, herein designated GAM RNA, also designated SEQ ID:360.

Another function of GAM1338 is therefore inhibition of DKFZP564O0523 (Accession NP_115496.1). Accordingly, utilities of GAM1338 include diagnosis, prevention and treatment of diseases and clinical conditions associated with DKFZP564O0523.

DKFZP566D1346 (Accession NP_110443.1) is another GAM1338 target gene, herein designated TARGET GENE. DKFZP566D1346 BINDING SITE is a target binding site found in the 5' untranslated region of mRNA encoded by DKFZP566D1346, corresponding to a target binding site such as BINDING SITE I, BINDING SITE II or BINDING SITE III of FIG. 8. Table 4 illustrates the complementarity of the nucleotide sequences of DKFZP566D1346 BINDING SITE, designated SEQ ID:12834, to the nucleotide sequence of GAM1338 RNA, herein designated GAM RNA, also designated SEQ ID:360.

Another function of GAM1338 is therefore inhibition of DKFZP566D1346 (Accession NP_110443.1). Accordingly, utilities of GAM1338 include diagnosis, prevention and treatment of diseases and clinical conditions associated with DKFZP566D1346.

DKFZP566I1024 (Accession NP_056226.1) is another GAM1338 target gene, herein designated TARGET GENE. DKFZP566I1024 BINDING SITE is a target binding site found in the 3' untranslated region of mRNA encoded by DKFZP566I1024, corresponding to a target binding site such as BINDING SITE I, BINDING SITE II or BINDING SITE III of FIG. 8. Table 4 illustrates the complementarity of the nucleotide sequences of DKFZP566I1024 BINDING SITE, designated SEQ ID:2402, to the nucleotide sequence of GAM1338 RNA, herein designated GAM RNA, also designated SEQ ID:360.

Another function of GAM1338 is therefore inhibition of DKFZP566I1024 (Accession NP_056226.1). Accordingly, utilities of GAM1338 include diagnosis, prevention and treatment of diseases and clinical conditions associated with DKFZP566I1024.

DKFZP586D0919 (Accession NP_056248.1) is another GAM1338 target gene, herein designated TARGET GENE. DKFZP586D0919 BINDING SITE is a target binding site found in the 3' untranslated region of mRNA encoded by DKFZP586D0919, corresponding to a target binding site such as BINDING SITE I, BINDING SITE II or BINDING SITE III of FIG. 8. Table 4 illustrates the complementarity of the nucleotide sequences of DKFZP586D0919 BINDING SITE, designated SEQ ID:5664, to the nucleotide sequence of GAM1338 RNA, herein designated GAM RNA, also designated SEQ ID:360.

Another function of GAM1338 is therefore inhibition of DKFZP586D0919 (Accession NP_056248.1). Accordingly, utilities of GAM1338 include diagnosis, prevention and treatment of diseases and clinical conditions associated with DKFZP586D0919.

DKFZp667B1218 (Accession NP_808881.1) is another GAM1338 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:13142, to the nucleotide sequence of GAM1338 RNA, herein designated GAM RNA, also designated SEQ ID:360.

Another function of GAM1338 is therefore inhibition of DKFZp667B1218 (Accession NP_808881.1). Accordingly, utilities of GAM1338 include diagnosis, prevention and treatment of diseases and clinical conditions associated with DKFZp667B1218.

DKFZp667E0512 (Accession XP_117353.1) is another GAM1338 target gene, herein designated TARGET GENE. DKFZp667E0512 BINDING SITE1 and DKFZp667E0512 BINDING SITE2 are target binding sites found in untranslated regions of mRNA encoded by DKFZp667E0512, corresponding to target binding sites such as BINDING SITE I, BINDING SITE II or BINDING SITE III of FIG. 8. Table 4 illustrates the complementarity of the nucleotide sequences of DKFZp667E0512 BINDING SITE1 and DKFZp667E0512 BINDING SITE2, designated SEQ ID:17043 and SEQ ID:9198 respectively, to the nucleotide sequence of GAM1338 RNA, herein designated GAM RNA, also designated SEQ ID:360.

Another function of GAM1338 is therefore inhibition of DKFZp667E0512 (Accession XP_117353.1). Accordingly, utilities of GAM1338 include diagnosis, prevention and treatment of diseases and clinical conditions associated with DKFZp667E0512.

DKFZp761B107 (Accession NP_775734.1) is another GAM1338 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:5298, to the nucleotide sequence of GAM1338 RNA, herein designated GAM RNA, also designated SEQ ID:360.

Another function of GAM1338 is therefore inhibition of DKFZp761B107 (Accession NP_775734.1). Accordingly, utilities of GAM1338 include diagnosis, prevention and treatment of diseases and clinical conditions associated with DKFZp761B107.

DKFZp761B128 (Accession NP_689650.1) is another GAM1338 target gene, herein designated TARGET GENE. DKFZp761B128 BINDING SITE is a target binding site found in the 5' untranslated region of mRNA encoded by DKFZp761B128, corresponding to a target binding site such as BINDING SITE I, BINDING SITE II or BINDING SITE III of FIG. 8. Table 4 illustrates the complementarity of the nucleotide sequences of DKFZp761B128 BINDING SITE, designated SEQ ID:436, to the nucleotide sequence of GAM1338 RNA, herein designated GAM RNA, also designated SEQ ID:360.

Another function of GAM1338 is therefore inhibition of DKFZp761B128 (Accession NP_689650.1). Accordingly, utilities of GAM1338 include diagnosis, prevention and treatment of diseases and clinical conditions associated with DKFZp761B128.

DKFZp761H039 (Accession NP_061181.1) is another GAM1338 target gene, herein designated TARGET GENE. DKFZp761H039 BINDING SITE is a target binding site found in the 3' untranslated region of mRNA encoded by DKFZp761H039, corresponding to a target binding site such as BINDING SITE I, BINDING SITE II or BINDING SITE III of FIG. 8. Table 4 illustrates the complementarity of the nucleotide sequences of DKFZp761H039 BINDING SITE, designated SEQ ID:12709, to the nucleotide sequence of GAM1338 RNA, herein designated GAM RNA, also designated SEQ ID:360.

Another function of GAM1338 is therefore inhibition of DKFZp761H039 (Accession NP_061181.1). Accordingly, utilities of GAM1338 include diagnosis, prevention and treatment of diseases and clinical conditions associated with DKFZp761H039.

DKFZp761J139 (Accession NP_115656.1) is another GAM1338 target gene, herein designated TARGET GENE. DKFZp761J139 BINDING SITE is a target binding site found in the 5' untranslated region of mRNA encoded by DKFZp761J139, corresponding to a target binding site such as BINDING SITE I, BINDING SITE II or BINDING SITE III of FIG. 8. Table 4 illustrates the complementarity of the nucleotide sequences of DKFZp761J139 BINDING SITE, designated SEQ ID:969, to the nucleotide sequence of GAM1338 RNA, herein designated GAM RNA, also designated SEQ ID:360.

Another function of GAM1338 is therefore inhibition of DKFZp761J139 (Accession NP_115656.1). Accordingly, utilities of GAM1338 include diagnosis, prevention and treatment of diseases and clinical conditions associated with DKFZp761J139.

DKFZp761N1114 (Accession XP_086327.6) is another GAM1338 target gene, herein designated TARGET GENE. DKFZp761N1114 BINDING SITE is a target binding site found in the 3' untranslated region of mRNA encoded by DKFZp761N1114, corresponding to a target binding site such as BINDING SITE I, BINDING SITE II or BINDING SITE III of FIG. 8. Table 4 illustrates the complementarity of the nucleotide sequences of DKFZp761N1114 BINDING SITE, designated SEQ ID:10882, to the nucleotide sequence of GAM1338 RNA, herein designated GAM RNA, also designated SEQ ID:360.

Another function of GAM1338 is therefore inhibition of DKFZp761N1114 (Accession XP_086327.6). Accordingly, utilities of GAM1338 include diagnosis, prevention and treatment of diseases and clinical conditions associated with DKFZp761N1114.

DKFZp761O0113 (Accession NP_060879.1) is another GAM1338 target gene, herein designated TARGET GENE. DKFZp761O0113 BINDING SITE is a target binding site found in the 5' untranslated region of mRNA encoded by DKFZp761O0113, corresponding to a target binding site such as BINDING SITE I, BINDING SITE II or BINDING SITE III of FIG. 8. Table 4 illustrates the complementarity of the nucleotide sequences of DKFZp761O0113 BINDING SITE, designated SEQ ID:11194, to the nucleotide sequence of GAM1338 RNA, herein designated GAM RNA, also designated SEQ ID:360.

Another function of GAM1338 is therefore inhibition of DKFZp761O0113 (Accession NP_060879.1). Accordingly, utilities of GAM1338 include diagnosis, prevention and treatment of diseases and clinical conditions associated with DKFZp761O0113.

DKFZp761P1121 (Accession NP_690870.1) is another GAM1338 target gene, herein designated TARGET GENE. DKFZp761P1121 BINDING SITE is a target binding site found in the 3' untranslated region of mRNA encoded by DKFZp761P1121, corresponding to a target binding site such as BINDING SITE I, BINDING SITE II or BINDING SITE III of FIG. 8. Table 4 illustrates the complementarity of the nucleotide sequences of DKFZp761P1121 BINDING SITE, designated SEQ ID:1413, to the nucleotide sequence of GAM1338 RNA, herein designated GAM RNA, also designated SEQ ID:360.

Another function of GAM1338 is therefore inhibition of DKFZp761P1121 (Accession NP_690870.1). Accordingly, utilities of GAM1338 include diagnosis, prevention and treatment of diseases and clinical conditions associated with DKFZp761P1121.

DKFZp762C2414 (Accession NP_848637.1) is another GAM1338 target gene, herein designated TARGET GENE. DKFZp762C2414 BINDING SITE is a target binding site found in the 3' untranslated region of mRNA encoded by DKFZp762C2414, corresponding to a target binding site such as BINDING SITE I, BINDING SITE II or BINDING SITE III of FIG. 8. Table 4 illustrates the complementarity of the nucleotide sequences of DKFZp762C2414 BINDING SITE, designated SEQ ID:11830, to the nucleotide sequence of GAM1338 RNA, herein designated GAM RNA, also designated SEQ ID:360.

Another function of GAM1338 is therefore inhibition of DKFZp762C2414 (Accession NP_848637.1). Accordingly, utilities of GAM1338 include diagnosis, prevention and treatment of diseases and clinical conditions associated with DKFZp762C2414.

DKFZp762H185 (Accession XP_172976.2) is another GAM1338 target gene, herein designated TARGET GENE. DKFZp762H185 BINDING SITE is a target binding site found in the 3' untranslated region of mRNA encoded by DKFZp762H185, corresponding to a target binding site such as BINDING SITE I, BINDING SITE II or BINDING SITE III of FIG. 8. Table 4 illustrates the complementarity of the nucleotide sequences of DKFZp762H185 BINDING SITE, designated SEQ ID:2137, to the nucleotide sequence of GAM1338 RNA, herein designated GAM RNA, also designated SEQ ID:360.

Another function of GAM1338 is therefore inhibition of DKFZp762H185 (Accession XP_172976.2). Accordingly, utilities of GAM1338 include diagnosis, prevention and treatment of diseases and clinical conditions associated with DKFZp762H185.

DKFZp762I137 (Accession NP_689624.1) is another GAM1338 target gene, herein designated TARGET GENE. DKFZp762I137 BINDING SITE is a target binding site found in the 3' untranslated region of mRNA encoded by DKFZp762I137, corresponding to a target binding site such as BINDING SITE I, BINDING SITE II or BINDING SITE III of FIG. 8. Table 4 illustrates the complementarity of the nucleotide sequences of DKFZp762I137 BINDING SITE, designated SEQ ID:11659, to the nucleotide sequence of GAM1338 RNA, herein designated GAM RNA, also designated SEQ ID:360.

Another function of GAM1338 is therefore inhibition of DKFZp762I137 (Accession NP_689624.1). Accordingly, utilities of GAM1338 include diagnosis, prevention and treatment of diseases and clinical conditions associated with DKFZp762I137.

DKFZp762I194 (Accession NP_689597.1) is another GAM1338 target gene, herein designated TARGET GENE. DKFZp762I194 BINDING SITE is a target binding site found in the 3' untranslated region of mRNA encoded by DKFZp762I194, corresponding to a target binding site such as BINDING SITE I, BINDING SITE II or BINDING SITE III of FIG. 8. Table 4 illustrates the complementarity of the nucleotide sequences of DKFZp762I194 BINDING SITE, designated SEQ ID:19272, to the nucleotide sequence of GAM1338 RNA, herein designated GAM RNA, also designated SEQ ID:360.

Another function of GAM1338 is therefore inhibition of DKFZp762I194 (Accession NP_689597.1). Accordingly, utilities of GAM1338 include diagnosis, prevention and treatment of diseases and clinical conditions associated with DKFZp762I194.

DKFZp762L0311 (Accession NP_061189.2) is another GAM1338 target gene, herein designated TARGET GENE. DKFZp762L0311 BINDING SITE is a target binding site found in the 3' untranslated region of mRNA encoded by DKFZp762L0311, corresponding to a target binding site such as BINDING SITE I, BINDING SITE II or BINDING SITE III of FIG. 8. Table 4 illustrates the complementarity of the nucleotide sequences of DKFZp762L0311 BINDING SITE, designated SEQ ID:13546, to the nucleotide sequence of GAM1338 RNA, herein designated GAM RNA, also designated SEQ ID:360.

Another function of GAM1338 is therefore inhibition of DKFZp762L0311 (Accession NP_061189.2). Accordingly, utilities of GAM1338 include diagnosis, prevention and treatment of diseases and clinical conditions associated with DKFZp762L0311.

Dynein, axonemal, heavy polypeptide 11 (DNAH11, Accession NP_003768.1) is another GAM1338 target gene, herein designated TARGET GENE. DNAH11 BINDING SITE is a target binding site found in the 3' untranslated region of mRNA encoded by DNAH11, corresponding to a target binding site such as BINDING SITE I, BINDING SITE II or BINDING SITE III of FIG. 8. Table 4 illustrates the complementarity of the nucleotide sequences of DNAH11 BINDING SITE, designated SEQ ID:18338, to the nucleotide sequence of GAM1338 RNA, herein designated GAM RNA, also designated SEQ ID:360.

Another function of GAM1338 is therefore inhibition of Dynein, axonemal, heavy polypeptide 11 (DNAH11, Accession NP_003768.1), a gene which may function as a motor protein. Accordingly, utilities of GAM1338 include diagnosis, prevention and treatment of diseases and clinical conditions associated with DNAH11.

The function of DNAH11 and its association with various diseases and clinical conditions, has been established by previous studies, as described hereinabove with reference to GAM189.1. DRIM (Accession NP_055318.1) is another GAM1338 target gene, herein designated TARGET GENE. DRIM BINDING SITE is a target binding site found in the 3' untranslated region of mRNA encoded by DRIM, corresponding to a target binding site such as BINDING SITE I, BINDING SITE II or BINDING SITE III of FIG. 8. Table 4 illustrates the complementarity of the nucleotide sequences of DRIM BINDING SITE, designated SEQ ID:2324, to the nucleotide sequence of GAM1338 RNA, herein designated GAM RNA, also designated SEQ ID:360.

Another function of GAM1338 is therefore inhibition of DRIM (Accession NP_055318.1). Accordingly, utilities of GAM1338 include diagnosis, prevention and treatment of diseases and clinical conditions associated with DRIM.

Dentatorubral-pallidoluysian atrophy (atrophin-1) (DRPLA, Accession NP_001931.1) is another GAM1338 target gene, herein designated TARGET GENE. DRPLA BINDING SITE is a target binding site found in the 5' untranslated region of mRNA encoded by DRPLA, corresponding to a target binding site such as BINDING SITE I, BINDING SITE II or BINDING SITE III of FIG. 8. Table 4 illustrates the complementarity of the nucleotide sequences of DRPLA BINDING SITE, designated SEQ ID:8154, to the nucleotide sequence of GAM1338 RNA, herein designated GAM RNA, also designated SEQ ID:360.

Another function of GAM1338 is therefore inhibition of Dentatorubral-pallidoluysian atrophy (atrophin-1) (DRPLA, Accession NP_001931.1). Accordingly, utilities of GAM1338 include diagnosis, prevention and treatment of diseases and clinical conditions associated with DRPLA.

Desmocollin 3 (DSC3, Accession NP_001932.1) is another GAM1338 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:2085, to the nucleotide sequence of GAM1338 RNA, herein designated GAM RNA, also designated SEQ ID:360.

Another function of GAM1338 is therefore inhibition of Desmocollin 3 (DSC3, Accession NP_001932.1), a gene which is a component of intercellular desmosome junctions. Accordingly, utilities of GAM1338 include diagnosis, prevention and treatment of diseases and clinical conditions associated with DSC3.

The function of DSC3 and its association with various diseases and clinical conditions, has been established by previous studies, as described hereinabove with reference to GAM30.1. Desmocollin 3 (DSC3, Accession NP_077741.1) is another GAM1338 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:2085, to the nucleotide sequence of GAM1338 RNA, herein designated GAM RNA, also designated SEQ ID:360.

Another function of GAM1338 is therefore inhibition of Desmocollin 3 (DSC3, Accession NP_077741.1), a gene which is a component of intercellular desmosome junctions. Accordingly, utilities of GAM1338 include diagnosis, prevention and treatment of diseases and clinical conditions associated with DSC3.

The function of DSC3 and its association with various diseases and clinical conditions, has been established by previous studies, as described hereinabove with reference to GAM30.1. Down syndrome critical region gene 6 (DSCR6, Accession NP_061835.1) is another GAM1338 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:17339, to the nucleotide sequence of GAM1338 RNA, herein designated GAM RNA, also designated SEQ ID:360.

Another function of GAM1338 is therefore inhibition of Down syndrome critical region gene 6 (DSCR6, Accession NP_061835.1). Accordingly, utilities of GAM1338 include diagnosis, prevention and treatment of diseases and clinical conditions associated with DSCR6.

DUPLIN (Accession XP_208760.3) is another GAM1338 target gene, herein designated TARGET GENE. DUPLIN BINDING SITE is a target binding site found in the 3' untranslated region of mRNA encoded by DUPLIN, corresponding to a target binding site such as BINDING SITE I, BINDING SITE II or BINDING SITE III of FIG. 8. Table 4 illustrates the complementarity of the nucleotide sequences of DUPLIN BINDING SITE, designated SEQ ID:2517, to the nucleotide sequence of GAM1338 RNA, herein designated GAM RNA, also designated SEQ ID:360.

Another function of GAM1338 is therefore inhibition of DUPLIN (Accession XP_208760.3). Accordingly, utilities of GAM1338 include diagnosis, prevention and treatment of diseases and clinical conditions associated with DUPLIN.

DUSP18 (Accession NP_689724.2) is another GAM1338 target gene, herein designated TARGET GENE. DUSP18 BINDING SITE is a target binding site found in the 3' untranslated region of mRNA encoded by DUSP18, corresponding to a target binding site such as BINDING SITE I, BINDING SITE II or BINDING SITE III of FIG. 8. Table 4 illustrates the complementarity of the nucleotide sequences of DUSP18 BINDING SITE, designated SEQ ID:19123, to the nucleotide sequence of GAM1338 RNA, herein designated GAM RNA, also designated SEQ ID:360.

Another function of GAM1338 is therefore inhibition of DUSP18 (Accession NP_689724.2). Accordingly, utilities of GAM1338 include diagnosis, prevention and treatment of diseases and clinical conditions associated with DUSP18.

Dual specificity phosphatase 19 (DUSP19, Accession NP_543152.1) is another GAM1338 target gene, herein designated TARGET GENE. DUSP19 BINDING SITE1 and DUSP19 BINDING SITE2 are target binding sites found in untranslated regions of mRNA encoded by DUSP19, corresponding to target binding sites such as BINDING SITE I, BINDING SITE II or BINDING SITE III of FIG. 8. Table 4 illustrates the complementarity of the nucleotide sequences of DUSP19 BINDING SITE1 and DUSP19 BINDING SITE2, designated SEQ ID:710 and SEQ ID:969 respectively, to the nucleotide sequence of GAM1338 RNA, herein designated GAM RNA, also designated SEQ ID:360.

Another function of GAM1338 is therefore inhibition of Dual specificity phosphatase 19 (DUSP19, Accession NP_543152.1). Accordingly, utilities of GAM1338 include diagnosis, prevention and treatment of diseases and clinical conditions associated with DUSP19.

Dual-specificity tyrosine-(y)-phosphorylation regulated kinase 1a (DYRK1A, Accession NP_567824.1) is another GAM1338 target gene, herein designated TARGET GENE. DYRK1A BINDING SITE is a target binding site found in the 5' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:14469, to the nucleotide sequence of GAM1338 RNA, herein designated GAM RNA, also designated SEQ ID:360.

Another function of GAM1338 is therefore inhibition of Dual-specificity tyrosine-(y)-phosphorylation regulated kinase 1a (DYRK1A, Accession NP_567824.1), a gene which regulates cell proliferation and may be involved in brain development . and therefore may be associated with Down syndrome. Accordingly, utilities of GAM1338 include diagnosis, prevention and treatment of Down syndrome, and of other diseases and clinical conditions associated with DYRK1A.

The function of DYRK1A and its association with various diseases and clinical conditions, has been established by previous studies, as described hereinabove with reference to GAM63.1. Endometrial bleeding associated factor (left-right determination, factor a; transforming growth factor beta superfamily) (EBAF, Accession NP_003231.2) is another GAM1338 target gene, herein designated TARGET GENE. EBAF BINDING SITE is a target binding site found in the 3' untranslated region of mRNA encoded by EBAF, corresponding to a target binding site such as BINDING SITE I, BINDING SITE II or BINDING SITE III of FIG. 8. Table 4 illustrates the complementarity of the nucleotide sequences of EBAF BINDING SITE, designated SEQ ID:7720, to the nucleotide sequence of GAM1338 RNA, herein designated GAM RNA, also designated SEQ ID:360.

Another function of GAM1338 is therefore inhibition of Endometrial bleeding associated factor (left-right determination, factor a; transforming growth factor beta superfamily) (EBAF, Accession NP_003231.2), a gene which LEFT-RIGHT AXIS MALFORMATIONS and therefore is associated with Left-right axis malformations. Accordingly, utilities of GAM1338 include diagnosis, prevention and treatment of Left-right axis malformations, and of other diseases and clinical conditions associated with EBAF.

The function of EBAF and its association with various diseases and clinical conditions, has been established by previous studies, as described hereinabove with reference to GAM189.1. EEF2K (Accession NP_037434.1) is another GAM1338 target gene, herein designated TARGET GENE. EEF2K BINDING SITE is a target binding site found in the 3' untranslated region of mRNA encoded by EEF2K, corresponding to a target binding site such as BINDING SITE I, BINDING SITE II or BINDING SITE III of FIG. 8. Table 4 illustrates the complementarity of the nucleotide sequences of EEF2K BINDING SITE, designated SEQ ID:11618, to the nucleotide sequence of GAM1338 RNA, herein designated GAM RNA, also designated SEQ ID:360.

Another function of GAM1338 is therefore inhibition of EEF2K (Accession NP_037434.1), a gene which phosphorylates serine or threonine on the eukaryotic elongation factor-2 and therefore may be associated with Systemic lupus erythematosus and cancer. Accordingly, utilities of GAM1338 include diagnosis, prevention and treatment of Systemic lupus erythematosus and cancer, and of other diseases and clinical conditions associated with EEF2K.

The function of EEF2K and its association with various diseases and clinical conditions, has been established by previous studies, as described hereinabove with reference to GAM189.1. Eh-domain containing 1 (EHD1, Accession NP_006786.2) is another GAM1338 target gene, herein designated TARGET GENE. EHD1 BINDING SITE is a target binding site found in the 3' untranslated region of mRNA encoded by EHD1, corresponding to a target binding site such as BINDING SITE I, BINDING SITE II or BINDING SITE III of FIG. 8. Table 4 illustrates the complementarity of the nucleotide sequences of EHD1 BINDING SITE, designated SEQ ID:14949, to the nucleotide sequence of GAM1338 RNA, herein designated GAM RNA, also designated SEQ ID:360.

Another function of GAM1338 is therefore inhibition of Eh-domain containing 1 (EHD1, Accession NP_006786.2), a gene which may be involved in ligand-initiated endocytosis. Accordingly, utilities of GAM1338 include diagnosis, prevention and treatment of diseases and clinical conditions associated with EHD1.

The function of EHD1 and its association with various diseases and clinical conditions, has been established by previous studies, as described hereinabove with reference to GAM65.1. Eh-domain containing 2 (EHD2, Accession NP_055416.2) is another GAM1338 target gene, herein designated TARGET GENE. EHD2 BINDING SITE is a target binding site found in the 3' untranslated region of mRNA encoded by EHD2, corresponding to a target binding site such as BINDING SITE I, BINDING SITE II or BINDING SITE III of FIG. 8. Table 4 illustrates the complementarity of the nucleotide sequences of EHD2 BINDING SITE, designated SEQ ID:6934, to the nucleotide sequence of GAM1338 RNA, herein designated GAM RNA, also designated SEQ ID:360.

Another function of GAM1338 is therefore inhibition of Eh-domain containing 2 (EHD2, Accession NP_055416.2). Accordingly, utilities of GAM1338 include diagnosis, prevention and treatment of diseases and clinical conditions associated with EHD2.

Eukaryotic translation initiation factor 2, subunit 3 gamma, 52 kda (EIF2S3, Accession NP_001406.1) is another GAM1338 target gene, herein designated TARGET GENE. EIF2S3 BINDING SITE is a target binding site found in the 3' untranslated region of mRNA encoded by EIF2S3, corresponding to a target binding site such as BINDING SITE I, BINDING SITE II or BINDING SITE III of FIG. 8. Table 4 illustrates the complementarity of the nucleotide sequences of EIF2S3 BINDING SITE, designated SEQ ID:11659, to the nucleotide sequence of GAM1338 RNA, herein designated GAM RNA, also designated SEQ ID:360.

Another function of GAM1338 is therefore inhibition of Eukaryotic translation initiation factor 2, subunit 3 gamma, 52 kda (EIF2S3, Accession NP_001406.1), a gene which functions in the early steps of protein synthesis. Accordingly, utilities of GAM1338 include diagnosis, prevention and treatment of diseases and clinical conditions associated with EIF2S3.

The function of EIF2S3 and its association with various diseases and clinical conditions, has been established by previous studies, as described hereinabove with reference to GAM189.1. Eukaryotic translation initiation factor 5a2 (EIF5A2, Accession NP_065123.1) is another GAM1338 target gene, herein designated TARGET GENE. EIF5A2 BINDING SITE is a target binding site found in the 3' untranslated region of mRNA encoded by EIF5A2, corresponding to a target binding site such as BINDING SITE I, BINDING SITE II or BINDING SITE III of FIG. 8. Table 4 illustrates the complementarity of the nucleotide sequences of EIF5A2 BINDING SITE, designated SEQ ID:1333, to the nucleotide sequence of GAM1338 RNA, herein designated GAM RNA, also designated SEQ ID:360.

Another function of GAM1338 is therefore inhibition of Eukaryotic translation initiation factor 5a2 (EIF5A2, Accession NP_065123.1). Accordingly, utilities of GAM1338 include diagnosis, prevention and treatment of diseases and clinical conditions associated with EIF5A2.

ELP3 (Accession NP_060561.3) is another GAM1338 target gene, herein designated TARGET GENE. ELP3 BINDING SITE is a target binding site found in the 3' untranslated region of mRNA encoded by ELP3, corresponding to a target binding site such as BINDING SITE I, BINDING SITE II or BINDING SITE III of FIG. 8. Table 4 illustrates the complementarity of the nucleotide sequences of ELP3 BINDING SITE, designated SEQ ID:6182, to the nucleotide sequence of GAM1338 RNA, herein designated GAM RNA, also designated SEQ ID:360.

Another function of GAM1338 is therefore inhibition of ELP3 (Accession NP_060561.3). Accordingly, utilities of GAM1338 include diagnosis, prevention and treatment of diseases and clinical conditions associated with ELP3.

Egf-like module containing, mucin-like, hormone receptor-like sequence 2 (EMR2, Accession NP_690882.1) is another GAM1338 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM1338 RNA, herein designated GAM RNA, also designated SEQ ID:360.

Another function of GAM1338 is therefore inhibition of Egf-like module containing, mucin-like, hormone receptor-like sequence 2 (EMR2, Accession NP_690882.1). Accordingly, utilities of GAM1338 include diagnosis, prevention and treatment of diseases and clinical conditions associated with EMR2.

Egf-like module containing, mucin-like, hormone receptor-like sequence 2 (EMR2, Accession NP_038475.2) is another GAM1338 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM1338 RNA, herein designated GAM RNA, also designated SEQ ID:360.

Another function of GAM1338 is therefore inhibition of Egf-like module containing, mucin-like, hormone receptor-like sequence 2 (EMR2, Accession NP_038475.2). Accordingly, utilities of GAM1338 include diagnosis, prevention and treatment of diseases and clinical conditions associated with EMR2.

Egf-like module containing, mucin-like, hormone receptor-like sequence 2 (EMR2, Accession NP_690883.1) is another GAM1338 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM1338 RNA, herein designated GAM RNA, also designated SEQ ID:360.

Another function of GAM1338 is therefore inhibition of Egf-like module containing, mucin-like, hormone receptor-like sequence 2 (EMR2, Accession NP_690883.1). Accordingly, utilities of GAM1338 include diagnosis, prevention and treatment of diseases and clinical conditions associated with EMR2.

Egf-like module containing, mucin-like, hormone receptor-like sequence 2 (EMR2, Accession NP_690885.1) is another GAM1338 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM1338 RNA, herein designated GAM RNA, also designated SEQ ID:360.

Another function of GAM1338 is therefore inhibition of Egf-like module containing, mucin-like, hormone receptor-like sequence 2 (EMR2, Accession NP_690885.1). Accordingly, utilities of GAM1338 include diagnosis, prevention and treatment of diseases and clinical conditions associated with EMR2.

Egf-like module containing, mucin-like, hormone receptor-like sequence 2 (EMR2, Accession NP_690880.1) is another GAM1338 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM1338 RNA, herein designated GAM RNA, also designated SEQ ID:360.

Another function of GAM1338 is therefore inhibition of Egf-like module containing, mucin-like, hormone receptor-like sequence 2 (EMR2, Accession NP_690880.1). Accordingly, utilities of GAM1338 include diagnosis, prevention and treatment of diseases and clinical conditions associated with EMR2.

Egf-like module containing, mucin-like, hormone receptor-like sequence 2 (EMR2, Accession NP_690881.1) is another GAM1338 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM1338 RNA, herein designated GAM RNA, also designated SEQ ID:360.

Another function of GAM1338 is therefore inhibition of Egf-like module containing, mucin-like, hormone receptor-like sequence 2 (EMR2, Accession NP_690881.1). Accordingly, utilities of GAM1338 include diagnosis, prevention and treatment of diseases and clinical conditions associated with EMR2.

Egf-like module containing, mucin-like, hormone receptor-like sequence 2 (EMR2, Accession NP_690884.1) is another GAM1338 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM1338 RNA, herein designated GAM RNA, also designated SEQ ID:360.

Another function of GAM1338 is therefore inhibition of Egf-like module containing, mucin-like, hormone receptor-like sequence 2 (EMR2, Accession NP_690884.1). Accordingly, utilities of GAM1338 include diagnosis, prevention and treatment of diseases and clinical conditions associated with EMR2.

Endonuclease g-like 1 (ENDOGL1, Accession NP_005098.1) is another GAM1338 target gene, herein designated TARGET GENE. ENDOGL1 BINDING SITE is a target binding site found in the 3' untranslated region of mRNA encoded by ENDOGL1, corresponding to a target binding site such as BINDING SITE I, BINDING SITE II or BINDING SITE III of FIG. 8. Table 4 illustrates the complementarity of the nucleotide sequences of ENDOGL1 BINDING SITE, designated SEQ ID:4223, to the nucleotide sequence of GAM1338 RNA, herein designated GAM RNA, also designated SEQ ID:360.

Another function of GAM1338 is therefore inhibition of Endonuclease g-like 1 (ENDOGL1, Accession NP_005098.1). Accordingly, utilities of GAM1338 include diagnosis, prevention and treatment of diseases and clinical conditions associated with ENDOGL1.

Epiregulin (EREG, Accession NP_001423.1) is another GAM1338 target gene, herein designated TARGET GENE. EREG BINDING SITE is a target binding site found in the 3' untranslated region of mRNA encoded by EREG, corresponding to a target binding site such as BINDING SITE I, BINDING SITE II or BINDING SITE III of FIG. 8. Table 4 illustrates the complementarity of the nucleotide sequences of EREG BINDING SITE, designated SEQ ID:430, to the nucleotide sequence of GAM1338 RNA, herein designated GAM RNA, also designated SEQ ID:360.

Another function of GAM1338 is therefore inhibition of Epiregulin (EREG, Accession NP_001423.1). Accordingly, utilities of GAM1338 include diagnosis, prevention and treatment of diseases and clinical conditions associated with EREG.

ET(B)R-LP-2 (Accession NP_004758.2) is another GAM1338 target gene, herein designated TARGET GENE. ET(B)R-LP-2 BINDING SITE is a target binding site found in the 3' untranslated region of mRNA encoded by ET(B)R-LP-2, corresponding to a target binding site such as BINDING SITE I, BINDING SITE II or BINDING SITE III of FIG. 8. Table 4 illustrates the complementarity of the nucleotide sequences of ET(B)R-LP-2 BINDING SITE, designated SEQ ID:6465, to the nucleotide sequence of GAM1338 RNA, herein designated GAM RNA, also designated SEQ ID:360.

Another function of GAM1338 is therefore inhibition of ET(B)R-LP-2 (Accession NP_004758.2). Accordingly, utilities of GAM1338 include diagnosis, prevention and treatment of diseases and clinical conditions associated with ET(B)R-LP-2.

Ellis van creveld syndrome (EVC, Accession NP_714928.1) is another GAM1338 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:4148, to the nucleotide sequence of GAM1338 RNA, herein designated GAM RNA, also designated SEQ ID:360.

Another function of GAM1338 is therefore inhibition of Ellis van creveld syndrome (EVC, Accession NP_714928.1). Accordingly, utilities of GAM1338 include diagnosis, prevention and treatment of diseases and clinical conditions associated with EVC.

Ellis van creveld syndrome (EVC, Accession NP_055371.1) is another GAM1338 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:4148, to the nucleotide sequence of GAM1338 RNA, herein designated GAM RNA, also designated SEQ ID:360.

Another function of GAM1338 is therefore inhibition of Ellis van creveld syndrome (EVC, Accession NP_055371.1). Accordingly, utilities of GAM1338 include diagnosis, prevention and treatment of diseases and clinical conditions associated with EVC.

Ecotropic viral integration site 5 (EVI5, Accession NP_005656.2) is another GAM1338 target gene, herein designated TARGET GENE. EVI5 BINDING SITE1 and EVI5 BINDING SITE2 are target binding sites found in untranslated regions of mRNA encoded by EVI5, corresponding to target binding sites such as BINDING SITE I, BINDING SITE II or BINDING SITE III of FIG. 8. Table 4 illustrates the complementarity of the nucleotide sequences of EVI5 BINDING SITE1 and EVI5 BINDING SITE2, designated SEQ ID:16074 and SEQ ID:18007 respectively, to the nucleotide sequence of GAM1338 RNA, herein designated GAM RNA, also designated SEQ ID:360.

Another function of GAM1338 is therefore inhibition of Ecotropic viral integration site 5 (EVI5, Accession NP_005656.2). Accordingly, utilities of GAM1338 include diagnosis, prevention and treatment of diseases and clinical conditions associated with EVI5.

F11R (Accession NP_653085.1) is another GAM1338 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:16292, to the nucleotide sequence of GAM1338 RNA, herein designated GAM RNA, also designated SEQ ID:360.

Another function of GAM1338 is therefore inhibition of F11R (Accession NP_653085.1). Accordingly, utilities of GAM1338 include diagnosis, prevention and treatment of diseases and clinical conditions associated with F11R.

F11R (Accession NP_653087.1) is another GAM1338 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:16292, to the nucleotide sequence of GAM1338 RNA, herein designated GAM RNA, also designated SEQ ID:360.

Another function of GAM1338 is therefore inhibition of F11R (Accession NP_653087.1). Accordingly, utilities of GAM1338 include diagnosis, prevention and treatment of diseases and clinical conditions associated with F11R.

F11R (Accession NP_058642.1) is another GAM1338 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:16292, to the nucleotide sequence of GAM1338 RNA, herein designated GAM RNA, also designated SEQ ID:360.

Another function of GAM1338 is therefore inhibition of F11R (Accession NP_058642.1). Accordingly, utilities of GAM1338 include diagnosis, prevention and treatment of diseases and clinical conditions associated with F11R.

F11R (Accession NP_653086.1) is another GAM1338 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:16292, to the nucleotide sequence of GAM1338 RNA, herein designated GAM RNA, also designated SEQ ID:360.

Another function of GAM1338 is therefore inhibition of F11R (Accession NP_653086.1). Accordingly, utilities of GAM1338 include diagnosis, prevention and treatment of diseases and clinical conditions associated with F11R.

Coagulation factor ii (thrombin) receptor-like 3 (F2RL3, Accession NP_003941.1) is another GAM1338 target gene, herein designated TARGET GENE. F2RL3 BINDING SITE is a target binding site found in the 3' untranslated region of mRNA encoded by F2RL3, corresponding to a target binding site such as BINDING SITE I, BINDING SITE II or BINDING SITE III of FIG. 8. Table 4 illustrates the complementarity of the nucleotide sequences of F2RL3 BINDING SITE, designated SEQ ID:13324, to the nucleotide sequence of GAM1338 RNA, herein designated GAM RNA, also designated SEQ ID:360.

Another function of GAM1338 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM1338 include diagnosis, prevention and treatment of diseases and clinical conditions associated with F2RL3.

The function of F2RL3 and its association with various diseases and clinical conditions, has been established by previous studies, as described hereinabove with reference to GAM72.1. Coagulation factor iii (thromboplastin, tissue factor) (F3, Accession NP_001984.1) is another GAM1338 target gene, herein designated TARGET GENE. F3 BINDING SITE is a target binding site found in the 3' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:15547, to the nucleotide sequence of GAM1338 RNA, herein designated GAM RNA, also designated SEQ ID:360.

Another function of GAM1338 is therefore inhibition of Coagulation factor iii (thromboplastin, tissue factor) (F3, Accession NP_001984.1), a gene which functions in normal hemostasis. Accordingly, utilities of GAM1338 include diagnosis, prevention and treatment of diseases and clinical conditions associated with F3.

The function of F3 and its association with various diseases and clinical conditions, has been established by previous studies, as described hereinabove with reference to GAM136.1. Coagulation factor v (proaccelerin, labile factor) (F5, Accession NP_000121.1) is another GAM1338 target gene, herein designated TARGET GENE. F5 BINDING SITE is a target binding site found in the 5' untranslated region of mRNA encoded by F5, corresponding to a target binding site such as BINDING SITE I, BINDING SITE II or BINDING SITE III of FIG. 8. Table 4 illustrates the complementarity of the nucleotide sequences of F5 BINDING SITE, designated SEQ ID:4594, to the nucleotide sequence of GAM1338 RNA, herein designated GAM RNA, also designated SEQ ID:360.

Another function of GAM1338 is therefore inhibition of Coagulation factor v (proaccelerin, labile factor) (F5, Accession NP_000121.1). Accordingly, utilities of GAM1338 include diagnosis, prevention and treatment of diseases and clinical conditions associated with F5.

Coagulation factor viii-associated (intronic transcript) (F8A, Accession NP_036283.2) is another GAM1338 target gene, herein designated TARGET GENE. F8A BINDING SITE is a target binding site found in the 3' untranslated region of mRNA encoded by F8A, corresponding to a target binding site such as BINDING SITE I, BINDING SITE II or BINDING SITE III of FIG. 8. Table 4 illustrates the complementarity of the nucleotide sequences of F8A BINDING SITE, designated SEQ ID:16334, to the nucleotide sequence of GAM1338 RNA, herein designated GAM RNA, also designated SEQ ID:360.

Another function of GAM1338 is therefore inhibition of Coagulation factor viii-associated (intronic transcript) (F8A, Accession NP_036283.2), a gene which has a possible housekeeping role. and therefore may be associated with Huntington disease. Accordingly, utilities of GAM1338 include diagnosis, prevention and treatment of Huntington disease, and of other diseases and clinical conditions associated with F8A.

The function of F8A and its association with various diseases and clinical conditions, has been established by previous studies, as described hereinabove with reference to GAM689.1. Family with sequence similarity 13, member a1 (FAM13A1, Accession NP_055698.1) is another GAM1338 target gene, herein designated TARGET GENE. FAM13A1 BINDING SITE is a target binding site found in the 3' untranslated region of mRNA encoded by FAM13A1, corresponding to a target binding site such as BINDING SITE I, BINDING SITE II or BINDING SITE III of FIG. 8. Table 4 illustrates the complementarity of the nucleotide sequences of FAM13A1 BINDING SITE, designated SEQ ID:17686, to the nucleotide sequence of GAM1338 RNA, herein designated GAM RNA, also designated SEQ ID:360.

Another function of GAM1338 is therefore inhibition of Family with sequence similarity 13, member a1 (FAM13A1, Accession NP_055698.1). Accordingly, utilities of GAM1338 include diagnosis, prevention and treatment of diseases and clinical conditions associated with FAM13A1.

Fanconi anemia, complementation group e (FANCE, Accession NP_068741.1) is another GAM1338 target gene, herein designated TARGET GENE. FANCE BINDING SITE is a target binding site found in the 3' untranslated region of mRNA encoded by FANCE, corresponding to a target binding site such as BINDING SITE I, BINDING SITE II or BINDING SITE III of FIG. 8. Table 4 illustrates the complementarity of the nucleotide sequences of FANCE BINDING SITE, designated SEQ ID:16751, to the nucleotide sequence of GAM1338 RNA, herein designated GAM RNA, also designated SEQ ID:360.

Another function of GAM1338 is therefore inhibition of Fanconi anemia, complementation group e (FANCE, Accession NP_068741.1), a gene which is a possible regulator of lymphocyte and platelet function. and therefore is associated with Fanconi anemia, complementation group e. Accordingly, utilities of GAM1338 include diagnosis, prevention and treatment of Fanconi anemia, complementation group e., and of other diseases and clinical conditions associated with FANCE.

The function of FANCE and its association with various diseases and clinical conditions, has been established by previous studies, as described hereinabove with reference to GAM189.1. Fanconi anemia, complementation group f (FANCF, Accession NP_073562.1) is another GAM1338 target gene, herein designated TARGET GENE. FANCF BINDING SITE is a target binding site found in the 3' untranslated region of mRNA encoded by FANCF, corresponding to a target binding site such as BINDING SITE I, BINDING SITE II or BINDING SITE III of FIG. 8. Table 4 illustrates the complementarity of the nucleotide sequences of FANCF BINDING SITE, designated SEQ ID:14445, to the nucleotide sequence of GAM1338 RNA, herein designated GAM RNA, also designated SEQ ID:360.

Another function of GAM1338 is therefore inhibition of Fanconi anemia, complementation group f (FANCF, Accession NP_073562.1). Accordingly, utilities of GAM1338 include diagnosis, prevention and treatment of diseases and clinical conditions associated with FANCF.

F-box and leucine-rich repeat protein 7 (FBXL7, Accession NP_036436.1) is another GAM1338 target gene, herein designated TARGET GENE. FBXL7 BINDING SITE is a target binding site found in the 3' untranslated region of mRNA encoded by FBXL7, corresponding to a target binding site such as BINDING SITE I, BINDING SITE II or BINDING SITE III of FIG. 8. Table 4 illustrates the complementarity of the nucleotide sequences of FBXL7 BINDING SITE, designated SEQ ID:10986, to the nucleotide sequence of GAM1338 RNA, herein designated GAM RNA, also designated SEQ ID:360.

Another function of GAM1338 is therefore inhibition of F-box and leucine-rich repeat protein 7 (FBXL7, Accession NP_036436.1), a gene which may be involved in in phosphorylation-dependent ubiquitination. Accordingly, utilities of GAM1338 include diagnosis, prevention and treatment of diseases and clinical conditions associated with FBXL7.

The function of FBXL7 and its association with various diseases and clinical conditions, has been established by previous studies, as described hereinabove with reference to GAM40.1. Fc fragment of iga, receptor for (FCAR, Accession NP_001991.1) is another GAM1338 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10505, SEQ ID:18209 and SEQ ID:18209 respectively, to the nucleotide sequence of GAM1338 RNA, herein designated GAM RNA, also designated SEQ ID:360.

Another function of GAM1338 is therefore inhibition of Fc fragment of iga, receptor for (FCAR, Accession NP_001991.1), a gene which binds to the fc region of immunoglobulins alpha and mediates several functions including cytokine production. and therefore may be associated with Iga nephropathy. Accordingly, utilities of GAM1338 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579812.1) is another GAM1338 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:18209, SEQ ID:441 and SEQ ID:18209 respectively, to the nucleotide sequence of GAM1338 RNA, herein designated GAM RNA, also designated SEQ ID:360.

Another function of GAM1338 is therefore inhibition of Fc fragment of iga, receptor for (FCAR, Accession NP_579812.1), a gene which binds to the fc region of immunoglobulins alpha and mediates several functions including cytokine production. and therefore may be associated with Iga nephropathy. Accordingly, utilities of GAM1338 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP__579813.1) is another GAM1338 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:441, SEQ ID:18209 and SEQ ID:18209 respectively, to the nucleotide sequence of GAM1338 RNA, herein designated GAM RNA, also designated SEQ ID:360.

Another function of GAM1338 is therefore inhibition of Fc fragment of iga, receptor for (FCAR, Accession NP__579813.1), a gene which binds to the fc region of immunoglobulins alpha and mediates several functions including cytokine production. and therefore may be associated with Iga nephropathy. Accordingly, utilities of GAM1338 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP__579811.1) is another GAM1338 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:18209, SEQ ID:10188 and SEQ ID:1759 respectively, to the nucleotide sequence of GAM1338 RNA, herein designated GAM RNA, also designated SEQ ID:360.

Another function of GAM1338 is therefore inhibition of Fc fragment of iga, receptor for (FCAR, Accession NP__579811.1), a gene which binds to the fc region of immunoglobulins alpha and mediates several functions including cytokine production. and therefore may be associated with Iga nephropathy. Accordingly, utilities of GAM1338 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fer-1-like 4 (c. elegans) (FER1L4, Accession XP__300246.1) is another GAM1338 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:1759, to the nucleotide sequence of GAM1338 RNA, herein designated GAM RNA, also designated SEQ ID:360.

Another function of GAM1338 is therefore inhibition of Fer-1-like 4 (c. elegans) (FER1L4, Accession XP__300246.1). Accordingly, utilities of GAM1338 include diagnosis, prevention and treatment of diseases and clinical conditions associated with FER1L4.

Fgd1 family, member 2 (FGD2, Accession NP__775829.1) is another GAM1338 target gene, herein designated TARGET GENE. FGD2 BINDING SITE is a target binding site found in the 3' untranslated region of mRNA encoded by FGD2, corresponding to a target binding site such as BINDING SITE I, BINDING SITE II or BINDING SITE III of FIG. 8. Table 4 illustrates the complementarity of the nucleotide sequences of FGD2 BINDING SITE, designated SEQ ID:14487, to the nucleotide sequence of GAM1338 RNA, herein designated GAM RNA, also designated SEQ ID:360.

Another function of GAM1338 is therefore inhibition of Fgd1 family, member 2 (FGD2, Accession NP__775829.1). Accordingly, utilities of GAM1338 include diagnosis, prevention and treatment of diseases and clinical conditions associated with FGD2.

Fibroblast growth factor 5 (FGF5, Accession NP__149134.1) is another GAM1338 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:3375, to the nucleotide sequence of GAM1338 RNA, herein designated GAM RNA, also designated SEQ ID:360.

Another function of GAM1338 is therefore inhibition of Fibroblast growth factor 5 (FGF5, Accession NP__149134.1), a gene which induces transformation and may regulate neuronal differentiation. Accordingly, utilities of GAM1338 include diagnosis, prevention and treatment of diseases and clinical conditions associated with FGF5.

The function of FGF5 and its association with various diseases and clinical conditions, has been established by previous studies, as described hereinabove with reference to GAM106.1. Fibroblast growth factor 5 (FGF5, Accession NP__004455.1) is another GAM1338 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:3375, to the nucleotide sequence of GAM1338 RNA, herein designated GAM RNA, also designated SEQ ID:360.

Another function of GAM1338 is therefore inhibition of Fibroblast growth factor 5 (FGF5, Accession NP__004455.1), a gene which induces transformation and may regulate neuronal differentiation. Accordingly, utilities of GAM1338 include diagnosis, prevention and treatment of diseases and clinical conditions associated with FGF5.

The function of FGF5 and its association with various diseases and clinical conditions, has been established by previous studies, as described hereinabove with reference to GAM106.1. Four and a half lim domains 2 (FHL2, Accession NP__001441.2) is another GAM1338 target gene, herein designated TARGET GENE. FHL2 BINDING SITE is a target binding site found in the 5' untranslated region of mRNA encoded by FHL2, corresponding to a target binding site such as BINDING SITE I, BINDING SITE II or BINDING SITE III of FIG. 8. Table 4 illustrates the complementarity of the nucleotide sequences of FHL2 BINDING SITE, designated SEQ ID:19820, to the nucleotide sequence of GAM1338 RNA, herein designated GAM RNA, also designated SEQ ID:360.

Another function of GAM1338 is therefore inhibition of Four and a half lim domains 2 (FHL2, Accession NP_001441.2), a gene which Contains four LIM domains and an additional zinc finger. Accordingly, utilities of GAM1338 include diagnosis, prevention and treatment of diseases and clinical conditions associated with FHL2.

The function of FHL2 and its association with various diseases and clinical conditions, has been established by previous studies, as described hereinabove with reference to GAM189.1. FISH (Accession NP_055446.1) is another GAM1338 target gene, herein designated TARGET GENE. FISH BINDING SITE is a target binding site found in the 5' untranslated region of mRNA encoded by FISH, corresponding to a target binding site such as BINDING SITE I, BINDING SITE II or BINDING SITE III of FIG. 8. Table 4 illustrates the complementarity of the nucleotide sequences of FISH BINDING SITE, designated SEQ ID:16564, to the nucleotide sequence of GAM1338 RNA, herein designated GAM RNA, also designated SEQ ID:360.

Another function of GAM1338 is therefore inhibition of FISH (Accession NP_055446.1). Accordingly, utilities of GAM1338 include diagnosis, prevention and treatment of diseases and clinical conditions associated with FISH.

Fk506 binding protein 9, 63 kda (FKBP9, Accession NP_009201.1) is another GAM1338 target gene, herein designated TARGET GENE. FKBP9 BINDING SITE is a target binding site found in the 3' untranslated region of mRNA encoded by FKBP9, corresponding to a target binding site such as BINDING SITE I, BINDING SITE II or BINDING SITE III of FIG. 8. Table 4 illustrates the complementarity of the nucleotide sequences of FKBP9 BINDING SITE, designated SEQ ID:2718, to the nucleotide sequence of GAM1338 RNA, herein designated GAM RNA, also designated SEQ ID:360.

Another function of GAM1338 is therefore inhibition of Fk506 binding protein 9, 63 kda (FKBP9, Accession NP_009201.1). Accordingly, utilities of GAM1338 include diagnosis, prevention and treatment of diseases and clinical conditions associated with FKBP9.

FLJ00060 (Accession XP_028154.1) is another GAM1338 target gene, herein designated TARGET GENE. FLJ00060 BINDING SITE is a target binding site found in the 5' untranslated region of mRNA encoded by FLJ00060, corresponding to a target binding site such as BINDING SITE I, BINDING SITE II or BINDING SITE III of FIG. 8. Table 4 illustrates the complementarity of the nucleotide sequences of FLJ00060 BINDING SITE, designated SEQ ID:13800, to the nucleotide sequence of GAM1338 RNA, herein designated GAM RNA, also designated SEQ ID:360.

Another function of GAM1338 is therefore inhibition of FLJ00060 (Accession XP_028154.1). Accordingly, utilities of GAM1338 include diagnosis, prevention and treatment of diseases and clinical conditions associated with FLJ00060.

FLJ10101 (Accession NP_078994.1) is another GAM1338 target gene, herein designated TARGET GENE. FLJ10101 BINDING SITE1 and FLJ10101 BINDING SITE2 are target binding sites found in untranslated regions of mRNA encoded by FLJ10101, corresponding to target binding sites such as BINDING SITE I, BINDING SITE II or BINDING SITE III of FIG. 8. Table 4 illustrates the complementarity of the nucleotide sequences of FLJ10101 BINDING SITE1 and FLJ10101 BINDING SITE2, designated SEQ ID:10153 and SEQ ID:9878 respectively, to the nucleotide sequence of GAM1338 RNA, herein designated GAM RNA, also designated SEQ ID:360.

Another function of GAM1338 is therefore inhibition of FLJ10101 (Accession NP_078994.1). Accordingly, utilities of GAM1338 include diagnosis, prevention and treatment of diseases and clinical conditions associated with FLJ10101.

FLJ10298 (Accession NP_060520.2) is another GAM1338 target gene, herein designated TARGET GENE. FLJ10298 BINDING SITE is a target binding site found in the 3' untranslated region of mRNA encoded by FLJ10298, corresponding to a target binding site such as BINDING SITE I, BINDING SITE II or BINDING SITE III of FIG. 8. Table 4 illustrates the complementarity of the nucleotide sequences of FLJ10298 BINDING SITE, designated SEQ ID:468, to the nucleotide sequence of GAM1338 RNA, herein designated GAM RNA, also designated SEQ ID:360.

Another function of GAM1338 is therefore inhibition of FLJ10298 (Accession NP_060520.2). Accordingly, utilities of GAM1338 include diagnosis, prevention and treatment of diseases and clinical conditions associated with FLJ10298.

FLJ10346 (Accession NP_060535.1) is another GAM1338 target gene, herein designated TARGET GENE. FLJ10346 BINDING SITE is a target binding site found in the 5' untranslated region of mRNA encoded by FLJ10346, corresponding to a target binding site such as BINDING SITE I, BINDING SITE II or BINDING SITE III of FIG. 8. Table 4 illustrates the complementarity of the nucleotide sequences of FLJ10346 BINDING SITE, designated SEQ ID:7836, to the nucleotide sequence of GAM1338 RNA, herein designated GAM RNA, also designated SEQ ID:360.

Another function of GAM1338 is therefore inhibition of FLJ10346 (Accession NP_060535.1). Accordingly, utilities of GAM1338 include diagnosis, prevention and treatment of diseases and clinical conditions associated with FLJ10346.

FLJ10520 (Accession NP_060594.2) is another GAM1338 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:8795, to the nucleotide sequence of GAM1338 RNA, herein designated GAM RNA, also designated SEQ ID:360.

Another function of GAM1338 is therefore inhibition of FLJ10520 (Accession NP_060594.2). Accordingly, utilities of GAM1338 include diagnosis, prevention and treatment of diseases and clinical conditions associated with FLJ10520.

FLJ10535 (Accession NP_060599.1) is another GAM1338 target gene, herein designated TARGET GENE. FLJ10535 BINDING SITE is a target binding site found in the 3' untranslated region of mRNA encoded by FLJ10535, corresponding to a target binding site such as BINDING SITE I, BINDING SITE II or BINDING SITE III of FIG. 8. Table 4 illustrates the complementarity of the nucleotide sequences of FLJ10535 BINDING SITE, designated SEQ ID:10633, to the nucleotide sequence of GAM1338 RNA, herein designated GAM RNA, also designated SEQ ID:360.

Another function of GAM1338 is therefore inhibition of FLJ10535 (Accession NP_060599.1). Accordingly, utilities of GAM1338 include diagnosis, prevention and treatment of diseases and clinical conditions associated with FLJ10535.

FLJ10560 (Accession NP_060608.1) is another GAM1338 target gene, herein designated TARGET GENE.

FLJ10560 BINDING SITE is a target binding site found in the 3' untranslated region of mRNA encoded by FLJ10560, corresponding to a target binding site such as BINDING SITE I, BINDING SITE II or BINDING SITE III of FIG. 8. Table 4 illustrates the complementarity of the nucleotide sequences of FLJ10560 BINDING SITE, designated SEQ ID:16115, to the nucleotide sequence of GAM1338 RNA, herein designated GAM RNA, also designated SEQ ID:360.

Another function of GAM1338 is therefore inhibition of FLJ10560 (Accession NP_060608.1). Accordingly, utilities of GAM1338 include diagnosis, prevention and treatment of diseases and clinical conditions associated with FLJ10560.

FLJ10569 (Accession NP_060612.1) is another GAM1338 target gene, herein designated TARGET GENE. FLJ10569 BINDING SITE is a target binding site found in the 5' untranslated region of mRNA encoded by FLJ10569, corresponding to a target binding site such as BINDING SITE I, BINDING SITE II or BINDING SITE III of FIG. 8. Table 4 illustrates the complementarity of the nucleotide sequences of FLJ10569 BINDING SITE, designated SEQ ID:7662, to the nucleotide sequence of GAM1338 RNA, herein designated GAM RNA, also designated SEQ ID:360.

Another function of GAM1338 is therefore inhibition of FLJ10569 (Accession NP_060612.1). Accordingly, utilities of GAM1338 include diagnosis, prevention and treatment of diseases and clinical conditions associated with FLJ10569.

FLJ10640 (Accession NP_061896.1) is another GAM1338 target gene, herein designated TARGET GENE. FLJ10640 BINDING SITE is a target binding site found in the 5' untranslated region of mRNA encoded by FLJ10640, corresponding to a target binding site such as BINDING SITE I, BINDING SITE II or BINDING SITE III of FIG. 8. Table 4 illustrates the complementarity of the nucleotide sequences of FLJ10640 BINDING SITE, designated SEQ ID:16789, to the nucleotide sequence of GAM1338 RNA, herein designated GAM RNA, also designated SEQ ID:360.

Another function of GAM1338 is therefore inhibition of FLJ10640 (Accession NP_061896.1). Accordingly, utilities of GAM1338 include diagnosis, prevention and treatment of diseases and clinical conditions associated with FLJ10640.

FLJ10713 (Accession NP_060659.1) is another GAM1338 target gene, herein designated TARGET GENE. FLJ10713 BINDING SITE is a target binding site found in the 3' untranslated region of mRNA encoded by FLJ10713, corresponding to a target binding site such as BINDING SITE I, BINDING SITE II or BINDING SITE III of FIG. 8. Table 4 illustrates the complementarity of the nucleotide sequences of FLJ10713 BINDING SITE, designated SEQ ID:12092, to the nucleotide sequence of GAM1338 RNA, herein designated GAM RNA, also designated SEQ ID:360.

Another function of GAM1338 is therefore inhibition of FLJ10713 (Accession NP_060659.1). Accordingly, utilities of GAM1338 include diagnosis, prevention and treatment of diseases and clinical conditions associated with FLJ10713.

FLJ10743 (Accession NP_060671.2) is another GAM1338 target gene, herein designated TARGET GENE. FLJ10743 BINDING SITE is a target binding site found in the 3' untranslated region of mRNA encoded by FLJ10743, corresponding to a target binding site such as BINDING SITE I, BINDING SITE II or BINDING SITE III of FIG. 8. Table 4 illustrates the complementarity of the nucleotide sequences of FLJ10743 BINDING SITE, designated SEQ ID:2269, to the nucleotide sequence of GAM1338 RNA, herein designated GAM RNA, also designated SEQ ID:360.

Another function of GAM1338 is therefore inhibition of FLJ10743 (Accession NP_060671.2). Accordingly, utilities of GAM1338 include diagnosis, prevention and treatment of diseases and clinical conditions associated with FLJ10743.

FLJ10846 (Accession NP_060711.1) is another GAM1338 target gene, herein designated TARGET GENE. FLJ10846 BINDING SITE is a target binding site found in the 3' untranslated region of mRNA encoded by FLJ10846, corresponding to a target binding site such as BINDING SITE I, BINDING SITE II or BINDING SITE III of FIG. 8. Table 4 illustrates the complementarity of the nucleotide sequences of FLJ10846 BINDING SITE, designated SEQ ID:13800, to the nucleotide sequence of GAM1338 RNA, herein designated GAM RNA, also designated SEQ ID:360.

Another function of GAM1338 is therefore inhibition of FLJ10846 (Accession NP_060711.1). Accordingly, utilities of GAM1338 include diagnosis, prevention and treatment of diseases and clinical conditions associated with FLJ10846.

FLJ10847 (Accession NP_060712.2) is another GAM1338 target gene, herein designated TARGET GENE. FLJ10847 BINDING SITE is a target binding site found in the 3' untranslated region of mRNA encoded by FLJ10847, corresponding to a target binding site such as BINDING SITE I, BINDING SITE II or BINDING SITE III of FIG. 8. Table 4 illustrates the complementarity of the nucleotide sequences of FLJ10847 BINDING SITE, designated SEQ ID:18108, to the nucleotide sequence of GAM1338 RNA, herein designated GAM RNA, also designated SEQ ID:360.

Another function of GAM1338 is therefore inhibition of FLJ10847 (Accession NP_060712.2). Accordingly, utilities of GAM1338 include diagnosis, prevention and treatment of diseases and clinical conditions associated with FLJ10847.

FLJ10901 (Accession NP_060735.1) is another GAM1338 target gene, herein designated TARGET GENE. FLJ10901 BINDING SITE is a target binding site found in the 3' untranslated region of mRNA encoded by FLJ10901, corresponding to a target binding site such as BINDING SITE I, BINDING SITE II or BINDING SITE III of FIG. 8. Table 4 illustrates the complementarity of the nucleotide sequences of FLJ10901 BINDING SITE, designated SEQ ID:13292, to the nucleotide sequence of GAM1338 RNA, herein designated GAM RNA, also designated SEQ ID:360.

Another function of GAM1338 is therefore inhibition of FLJ10901 (Accession NP_060735.1). Accordingly, utilities of GAM1338 include diagnosis, prevention and treatment of diseases and clinical conditions associated with FLJ10901.

FLJ10922 (Accession NP_060743.1) is another GAM1338 target gene, herein designated TARGET GENE. FLJ10922 BINDING SITE is a target binding site found in the 3' untranslated region of mRNA encoded by FLJ10922, corresponding to a target binding site such as BINDING SITE I, BINDING SITE II or BINDING SITE III of FIG. 8. Table 4 illustrates the complementarity of the nucleotide sequences of FLJ10922 BINDING SITE, designated SEQ ID:6574, to the nucleotide sequence of GAM1338 RNA, herein designated GAM RNA, also designated SEQ ID:360.

Another function of GAM1338 is therefore inhibition of FLJ10922 (Accession NP_060743.1). Accordingly, utilities of GAM1338 include diagnosis, prevention and treatment of diseases and clinical conditions associated with FLJ10922.

FLJ11274 (Accession NP_060845.1) is another GAM1338 target gene, herein designated TARGET GENE. FLJ11274 BINDING SITE is a target binding site found in the 5' untranslated region of mRNA encoded by FLJ11274, corresponding to a target binding site such as BINDING SITE I, BINDING SITE II or BINDING SITE III of FIG. 8. Table 4 illustrates the complementarity of the nucleotide sequences of FLJ11274 BINDING SITE, designated SEQ ID:7307, to the nucleotide sequence of GAM1338 RNA, herein designated GAM RNA, also designated SEQ ID:360.

Another function of GAM1338 is therefore inhibition of FLJ11274 (Accession NP_060845.1). Accordingly, utilities of GAM1338 include diagnosis, prevention and treatment of diseases and clinical conditions associated with FLJ11274.

FLJ11323 (Accession NP_060860.1) is another GAM1338 target gene, herein designated TARGET GENE. FLJ11323 BINDING SITE is a target binding site found in the 3' untranslated region of multiple transcripts of mRNA encoded by FLJ11323, corresponding to a target binding site such as BINDING SITE I, BINDING SITE II or BINDING SITE III of FIG. 8. Table 4 illustrates the complementarity of the nucleotide sequences of FLJ11323 BINDING SITE, designated SEQ ID:13280, to the nucleotide sequence of GAM1338 RNA, herein designated GAM RNA, also designated SEQ ID:360.

Another function of GAM1338 is therefore inhibition of FLJ11323 (Accession NP_060860.1). Accordingly, utilities of GAM1338 include diagnosis, prevention and treatment of diseases and clinical conditions associated with FLJ11323.

FLJ11467 (Accession NP_079239.2) is another GAM1338 target gene, herein designated TARGET GENE. FLJ11467 BINDING SITE is a target binding site found in the 3' untranslated region of mRNA encoded by FLJ11467, corresponding to a target binding site such as BINDING SITE I, BINDING SITE II or BINDING SITE III of FIG. 8. Table 4 illustrates the complementarity of the nucleotide sequences of FLJ11467 BINDING SITE, designated SEQ ID:9552, to the nucleotide sequence of GAM1338 RNA, herein designated GAM RNA, also designated SEQ ID:360.

Another function of GAM1338 is therefore inhibition of FLJ11467 (Accession NP_079239.2). Accordingly, utilities of GAM1338 include diagnosis, prevention and treatment of diseases and clinical conditions associated with FLJ11467.

FLJ11710 (Accession NP_079122.1) is another GAM1338 target gene, herein designated TARGET GENE. FLJ11710 BINDING SITE is a target binding site found in the 3' untranslated region of mRNA encoded by FLJ11710, corresponding to a target binding site such as BINDING SITE I, BINDING SITE II or BINDING SITE III of FIG. 8. Table 4 illustrates the complementarity of the nucleotide sequences of FLJ11710 BINDING SITE, designated SEQ ID:6034, to the nucleotide sequence of GAM1338 RNA, herein designated GAM RNA, also designated SEQ ID:360.

Another function of GAM1338 is therefore inhibition of FLJ11710 (Accession NP_079122.1). Accordingly, utilities of GAM1338 include diagnosis, prevention and treatment of diseases and clinical conditions associated with FLJ11710.

FLJ11715 (Accession NP_078840.1) is another GAM1338 target gene, herein designated TARGET GENE. FLJ11715 BINDING SITE is a target binding site found in the 3' untranslated region of mRNA encoded by FLJ11715, corresponding to a target binding site such as BINDING SITE I, BINDING SITE II or BINDING SITE III of FIG. 8. Table 4 illustrates the complementarity of the nucleotide sequences of FLJ11715 BINDING SITE, designated SEQ ID:4281, to the nucleotide sequence of GAM1338 RNA, herein designated GAM RNA, also designated SEQ ID:360.

Another function of GAM1338 is therefore inhibition of FLJ11715 (Accession NP_078840.1). Accordingly, utilities of GAM1338 include diagnosis, prevention and treatment of diseases and clinical conditions associated with FLJ11715.

FLJ11783 (Accession NP_079167.1) is another GAM1338 target gene, herein designated TARGET GENE. FLJ11783 BINDING SITE is a target binding site found in the 3' untranslated region of mRNA encoded by FLJ11783, corresponding to a target binding site such as BINDING SITE I, BINDING SITE II or BINDING SITE III of FIG. 8. Table 4 illustrates the complementarity of the nucleotide sequences of FLJ11783 BINDING SITE, designated SEQ ID:11128, to the nucleotide sequence of GAM1338 RNA, herein designated GAM RNA, also designated SEQ ID:360.

Another function of GAM1338 is therefore inhibition of FLJ11783 (Accession NP_079167.1). Accordingly, utilities of GAM1338 include diagnosis, prevention and treatment of diseases and clinical conditions associated with FLJ11783.

FLJ11800 (Accession NP_079250.1) is another GAM1338 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:17222, to the nucleotide sequence of GAM1338 RNA, herein designated GAM RNA, also designated SEQ ID:360.

Another function of GAM1338 is therefore inhibition of FLJ11800 (Accession NP_079250.1). Accordingly, utilities of GAM1338 include diagnosis, prevention and treatment of diseases and clinical conditions associated with FLJ11800.

FLJ12363 (Accession NP_115543.1) is another GAM1338 target gene, herein designated TARGET GENE. FLJ12363 BINDING SITE is a target binding site found in the 3' untranslated region of mRNA encoded by FLJ12363, corresponding to a target binding site such as BINDING SITE I, BINDING SITE II or BINDING SITE III of FIG. 8. Table 4 illustrates the complementarity of the nucleotide sequences of FLJ12363 BINDING SITE, designated SEQ ID:14486, to the nucleotide sequence of GAM1338 RNA, herein designated GAM RNA, also designated SEQ ID:360.

Another function of GAM1338 is therefore inhibition of FLJ12363 (Accession NP_115543.1). Accordingly, utilities of GAM1338 include diagnosis, prevention and treatment of diseases and clinical conditions associated with FLJ12363.

FLJ12409 (Accession NP_079381.1) is another GAM1338 target gene, herein designated TARGET GENE. FLJ12409 BINDING SITE is a target binding site found in the 3' untranslated region of mRNA encoded by FLJ12409, corresponding to a target binding site such as BINDING SITE I, BINDING SITE II or BINDING SITE III of FIG. 8. Table 4 illustrates the complementarity of the nucleotide sequences of FLJ12409 BINDING SITE, designated SEQ ID:19506, to the nucleotide sequence of GAM1338 RNA, herein designated GAM RNA, also designated SEQ ID:360.

Another function of GAM1338 is therefore inhibition of FLJ12409 (Accession NP_079381.1). Accordingly, utilities of GAM1338 include diagnosis, prevention and treatment of diseases and clinical conditions associated with FLJ12409.

FLJ12572 (Accession NP_075056.2) is another GAM1338 target gene, herein designated TARGET GENE. FLJ12572 BINDING SITE is a target binding site found in the 5' untranslated region of mRNA encoded by FLJ12572, corresponding to a target binding site such as BINDING SITE I, BINDING SITE II or BINDING SITE III of FIG. 8. Table 4 illustrates the complementarity of the nucleotide sequences of FLJ12572 BINDING SITE, designated SEQ ID:14282, to the nucleotide sequence of GAM1338 RNA, herein designated GAM RNA, also designated SEQ ID:360.

Another function of GAM1338 is therefore inhibition of FLJ12572 (Accession NP_075056.2). Accordingly, utilities of GAM1338 include diagnosis, prevention and treatment of diseases and clinical conditions associated with FLJ12572.

FLJ12586 (Accession NP_078896.2) is another GAM1338 target gene, herein designated TARGET GENE. FLJ12586 BINDING SITE is a target binding site found in the 5' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:13509, to the nucleotide sequence of GAM1338 RNA, herein designated GAM RNA, also designated SEQ ID:360.

Another function of GAM1338 is therefore inhibition of FLJ12586 (Accession NP_078896.2). Accordingly, utilities of GAM1338 include diagnosis, prevention and treatment of diseases and clinical conditions associated with FLJ12586.

FLJ12649 (Accession XP_291344.1) is another GAM1338 target gene, herein designated TARGET GENE. FLJ12649 BINDING SITE is a target binding site found in the 3' untranslated region of mRNA encoded by FLJ12649, corresponding to a target binding site such as BINDING SITE I, BINDING SITE II or BINDING SITE III of FIG. 8. Table 4 illustrates the complementarity of the nucleotide sequences of FLJ12649 BINDING SITE, designated SEQ ID:1963, to the nucleotide sequence of GAM1338 RNA, herein designated GAM RNA, also designated SEQ ID:360.

Another function of GAM1338 is therefore inhibition of FLJ12649 (Accession XP_291344.1). Accordingly, utilities of GAM1338 include diagnosis, prevention and treatment of diseases and clinical conditions associated with FLJ12649.

FLJ12687 (Accession NP_079193.2) is another GAM1338 target gene, herein designated TARGET GENE. FLJ12687 BINDING SITE is a target binding site found in the 3' untranslated region of mRNA encoded by FLJ12687, corresponding to a target binding site such as BINDING SITE I, BINDING SITE II or BINDING SITE III of FIG. 8. Table 4 illustrates the complementarity of the nucleotide sequences of FLJ12687 BINDING SITE, designated SEQ ID:4553, to the nucleotide sequence of GAM1338 RNA, herein designated GAM RNA, also designated SEQ ID:360.

Another function of GAM1338 is therefore inhibition of FLJ12687 (Accession NP_079193.2). Accordingly, utilities of GAM1338 include diagnosis, prevention and treatment of diseases and clinical conditions associated with FLJ12687.

FLJ12787 (Accession NP_115551.1) is another GAM1338 target gene, herein designated TARGET GENE. FLJ12787 BINDING SITE is a target binding site found in the 3' untranslated region of mRNA encoded by FLJ12787, corresponding to a target binding site such as BINDING SITE I, BINDING SITE II or BINDING SITE III of FIG. 8. Table 4 illustrates the complementarity of the nucleotide sequences of FLJ12787 BINDING SITE, designated SEQ ID:8076, to the nucleotide sequence of GAM1338 RNA, herein designated GAM RNA, also designated SEQ ID:360.

Another function of GAM1338 is therefore inhibition of FLJ12787 (Accession NP_115551.1). Accordingly, utilities of GAM1338 include diagnosis, prevention and treatment of diseases and clinical conditions associated with FLJ12787.

FLJ12800 (Accession NP_075054.1) is another GAM1338 target gene, herein designated TARGET GENE. FLJ12800 BINDING SITE is a target binding site found in the 3' untranslated region of mRNA encoded by FLJ12800, corresponding to a target binding site such as BINDING SITE I, BINDING SITE II or BINDING SITE III of FIG. 8. Table 4 illustrates the complementarity of the nucleotide sequences of FLJ12800 BINDING SITE, designated SEQ ID:3651, to the nucleotide sequence of GAM1338 RNA, herein designated GAM RNA, also designated SEQ ID:360.

Another function of GAM1338 is therefore inhibition of FLJ12800 (Accession NP_075054.1). Accordingly, utilities of GAM1338 include diagnosis, prevention and treatment of diseases and clinical conditions associated with FLJ12800.

FLJ12888 (Accession NP_079221.1) is another GAM1338 target gene, herein designated TARGET GENE. FLJ12888 BINDING SITE is a target binding site found in the 3' untranslated region of mRNA encoded by FLJ12888, corresponding to a target binding site such as BINDING SITE I, BINDING SITE II or BINDING SITE III of FIG. 8. Table 4 illustrates the complementarity of the nucleotide sequences of FLJ12888 BINDING SITE, designated SEQ ID:1302, to the nucleotide sequence of GAM1338 RNA, herein designated GAM RNA, also designated SEQ ID:360.

Another function of GAM1338 is therefore inhibition of FLJ12888 (Accession NP_079221.1). Accordingly, utilities of GAM1338 include diagnosis, prevention and treatment of diseases and clinical conditions associated with FLJ12888.

FLJ12903 (Accession NP_073590.1) is another GAM1338 target gene, herein designated TARGET GENE. FLJ12903 BINDING SITE is a target binding site found in the 3' untranslated region of mRNA encoded by FLJ12903, corresponding to a target binding site such as BINDING SITE I, BINDING SITE II or BINDING SITE III of FIG. 8. Table 4 illustrates the complementarity of the nucleotide sequences of FLJ12903 BINDING SITE, designated SEQ ID:15276, to the nucleotide sequence of GAM1338 RNA, herein designated GAM RNA, also designated SEQ ID:360.

Another function of GAM1338 is therefore inhibition of FLJ12903 (Accession NP_073590.1). Accordingly, utilities of GAM1338 include diagnosis, prevention and treatment of diseases and clinical conditions associated with FLJ12903.

FLJ12960 (Accession NP_078914.1) is another GAM1338 target gene, herein designated TARGET GENE. FLJ12960 BINDING SITE is a target binding site found in the 3' untranslated region of mRNA encoded by FLJ12960, corresponding to a target binding site such as BINDING SITE I, BINDING SITE II or BINDING SITE III of FIG. 8. Table 4 illustrates the complementarity of the nucleotide sequences of FLJ12960 BINDING SITE, designated SEQ ID:3109, to the nucleotide sequence of GAM1338 RNA, herein designated GAM RNA, also designated SEQ ID:360.

Another function of GAM1338 is therefore inhibition of FLJ12960 (Accession NP_078914.1). Accordingly, utilities of GAM1338 include diagnosis, prevention and treatment of diseases and clinical conditions associated with FLJ12960.

FLJ12973 (Accession NP_079184.1) is another GAM1338 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:14027, to the nucleotide sequence of GAM1338 RNA, herein designated GAM RNA, also designated SEQ ID:360.

Another function of GAM1338 is therefore inhibition of FLJ12973 (Accession NP_079184.1). Accordingly, utilities of GAM1338 include diagnosis, prevention and treatment of diseases and clinical conditions associated with FLJ12973.

FLJ12975 (Accession NP_079085.2) is another GAM1338 target gene, herein designated TARGET GENE. FLJ12975 BINDING SITE is a target binding site found in the 3' untranslated region of mRNA encoded by FLJ12975, corresponding to a target binding site such as BINDING SITE I, BINDING SITE II or BINDING SITE III of FIG. 8. Table 4 illustrates the complementarity of the nucleotide sequences of FLJ12975 BINDING SITE, designated SEQ ID:836, to the nucleotide sequence of GAM1338 RNA, herein designated GAM RNA, also designated SEQ ID:360.

Another function of GAM1338 is therefore inhibition of FLJ12975 (Accession NP_079085.2). Accordingly, utilities of GAM1338 include diagnosis, prevention and treatment of diseases and clinical conditions associated with FLJ12975.

FLJ12986 (Accession XP_290685.1) is another GAM1338 target gene, herein designated TARGET GENE. FLJ12986 BINDING SITE is a target binding site found in the 3' untranslated region of mRNA encoded by FLJ12986, corresponding to a target binding site such as BINDING SITE I, BINDING SITE II or BINDING SITE III of FIG. 8. Table 4 illustrates the complementarity of the nucleotide sequences of FLJ12986 BINDING SITE, designated SEQ ID:6642, to the nucleotide sequence of GAM1338 RNA, herein designated GAM RNA, also designated SEQ ID:360.

Another function of GAM1338 is therefore inhibition of FLJ12986 (Accession XP_290685.1). Accordingly, utilities of GAM1338 include diagnosis, prevention and treatment of diseases and clinical conditions associated with FLJ12986.

FLJ13072 (Accession XP_117117.2) is another GAM1338 target gene, herein designated TARGET GENE. FLJ13072 BINDING SITE is a target binding site found in the 3' untranslated region of mRNA encoded by FLJ13072, corresponding to a target binding site such as BINDING SITE I, BINDING SITE II or BINDING SITE III of FIG. 8. Table 4 illustrates the complementarity of the nucleotide sequences of FLJ13072 BINDING SITE, designated SEQ ID:6870, to the nucleotide sequence of GAM1338 RNA, herein designated GAM RNA, also designated SEQ ID:360.

Another function of GAM1338 is therefore inhibition of FLJ13072 (Accession XP_117117.2). Accordingly, utilities of GAM1338 include diagnosis, prevention and treatment of diseases and clinical conditions associated with FLJ13072.

FLJ13114 (Accession NP_078817.1) is another GAM1338 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:7621, to the nucleotide sequence of GAM1338 RNA, herein designated GAM RNA, also designated SEQ ID:360.

Another function of GAM1338 is therefore inhibition of FLJ13114 (Accession NP_078817.1). Accordingly, utilities of GAM1338 include diagnosis, prevention and treatment of diseases and clinical conditions associated with FLJ13114.

FLJ13188 (Accession NP_071346.1) is another GAM1338 target gene, herein designated TARGET GENE. FLJ13188 BINDING SITE is a target binding site found in the 3' untranslated region of mRNA encoded by FLJ13188, corresponding to a target binding site such as BINDING SITE I, BINDING SITE II or BINDING SITE III of FIG. 8. Table 4 illustrates the complementarity of the nucleotide sequences of FLJ13188 BINDING SITE, designated SEQ ID:12816, to the nucleotide sequence of GAM1338 RNA, herein designated GAM RNA, also designated SEQ ID:360.

Another function of GAM1338 is therefore inhibition of FLJ13188 (Accession NP_071346.1). Accordingly, utilities of GAM1338 include diagnosis, prevention and treatment of diseases and clinical conditions associated with FLJ13188.

FLJ13189 (Accession NP_079158.1) is another GAM1338 target gene, herein designated TARGET GENE. FLJ13189 BINDING SITE is a target binding site found in the 3' untranslated region of mRNA encoded by FLJ13189, corresponding to a target binding site such as BINDING SITE I, BINDING SITE II or BINDING SITE III of FIG. 8. Table 4 illustrates the complementarity of the nucleotide sequences of FLJ13189 BINDING SITE, designated SEQ ID:11334, to the nucleotide sequence of GAM1338 RNA, herein designated GAM RNA, also designated SEQ ID:360.

Another function of GAM1338 is therefore inhibition of FLJ13189 (Accession NP_079158.1). Accordingly, utilities of GAM1338 include diagnosis, prevention and treatment of diseases and clinical conditions associated with FLJ13189.

FLJ13197 (Accession NP_078890.1) is another GAM1338 target gene, herein designated TARGET GENE. FLJ13197 BINDING SITE is a target binding site found in the 3' untranslated region of mRNA encoded by FLJ13197, corresponding to a target binding site such as BINDING SITE I, BINDING SITE II or BINDING SITE III of FIG. 8. Table 4 illustrates the complementarity of the nucleotide sequences of FLJ13197 BINDING SITE, designated SEQ ID:7946, to the nucleotide sequence of GAM1338 RNA, herein designated GAM RNA, also designated SEQ ID:360.

Another function of GAM1338 is therefore inhibition of FLJ13197 (Accession NP_078890.1). Accordingly, utilities of GAM1338 include diagnosis, prevention and treatment of diseases and clinical conditions associated with FLJ13197.

FLJ13263 (Accession NP_079401.2) is another GAM1338 target gene, herein designated TARGET GENE. FLJ13263 BINDING SITE is a target binding site found in the 3' untranslated region of mRNA encoded by FLJ13263, corresponding to a target binding site such as BINDING SITE I, BINDING SITE II or BINDING SITE III of FIG. 8. Table 4 illustrates the complementarity of the nucleotide sequences of FLJ13263 BINDING SITE, designated SEQ ID:1789, to the nucleotide sequence of GAM1338 RNA, herein designated GAM RNA, also designated SEQ ID:360.

Another function of GAM1338 is therefore inhibition of FLJ13263 (Accession NP_079401.2). Accordingly, utilities of GAM1338 include diagnosis, prevention and treatment of diseases and clinical conditions associated with FLJ13263.

FLJ13456 (Accession XP_038291.5) is another GAM1338 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:5409, to the nucleotide sequence of GAM1338 RNA, herein designated GAM RNA, also designated SEQ ID:360.

Another function of GAM1338 is therefore inhibition of FLJ13456 (Accession XP_038291.5). Accordingly, utilities of GAM1338 include diagnosis, prevention and treatment of diseases and clinical conditions associated with FLJ13456.

FLJ13590 (Accession NP_079116.2) is another GAM1338 target gene, herein designated TARGET GENE. FLJ13590 BINDING SITE is a target binding site found in the 5' untranslated region of mRNA encoded by FLJ13590, corresponding to a target binding site such as BINDING SITE I, BINDING SITE II or BINDING SITE III of FIG. 8. Table 4 illustrates the complementarity of the nucleotide sequences of FLJ13590 BINDING SITE, designated SEQ ID:6935, to the nucleotide sequence of GAM1338 RNA, herein designated GAM RNA, also designated SEQ ID:360.

Another function of GAM1338 is therefore inhibition of FLJ13590 (Accession NP_079116.2). Accordingly, utilities of GAM1338 include diagnosis, prevention and treatment of diseases and clinical conditions associated with FLJ13590.

FLJ13769 (Accession NP_079288.1) is another GAM1338 target gene, herein designated TARGET GENE. FLJ13769 BINDING SITE is a target binding site found in the 3' untranslated region of mRNA encoded by FLJ13769, corresponding to a target binding site such as BINDING SITE I, BINDING SITE II or BINDING SITE III of FIG. 8. Table 4 illustrates the complementarity of the nucleotide sequences of FLJ13769 BINDING SITE, designated SEQ ID:4401, to the nucleotide sequence of GAM1338 RNA, herein designated GAM RNA, also designated SEQ ID:360.

Another function of GAM1338 is therefore inhibition of FLJ13769 (Accession NP_079288.1). Accordingly, utilities of GAM1338 include diagnosis, prevention and treatment of diseases and clinical conditions associated with FLJ13769.

FLJ13910 (Accession NP_073617.1) is another GAM1338 target gene, herein designated TARGET GENE. FLJ13910 BINDING SITE is a target binding site found in the 3' untranslated region of mRNA encoded by FLJ13910, corresponding to a target binding site such as BINDING SITE I, BINDING SITE II or BINDING SITE III of FIG. 8. Table 4 illustrates the complementarity of the nucleotide sequences of FLJ13910 BINDING SITE, designated SEQ ID:8349, to the nucleotide sequence of GAM1338 RNA, herein designated GAM RNA, also designated SEQ ID:360.

Another function of GAM1338 is therefore inhibition of FLJ13910 (Accession NP_073617.1). Accordingly, utilities of GAM1338 include diagnosis, prevention and treatment of diseases and clinical conditions associated with FLJ13910.

FLJ13984 (Accession NP_079046.1) is another GAM1338 target gene, herein designated TARGET GENE. FLJ13984 BINDING SITE is a target binding site found in the 5' untranslated region of mRNA encoded by FLJ13984, corresponding to a target binding site such as BINDING SITE I, BINDING SITE II or BINDING SITE III of FIG. 8. Table 4 illustrates the complementarity of the nucleotide sequences of FLJ13984 BINDING SITE, designated SEQ ID:16972, to the nucleotide sequence of GAM1338 RNA, herein designated GAM RNA, also designated SEQ ID:360.

Another function of GAM1338 is therefore inhibition of FLJ13984 (Accession NP_079046.1). Accordingly, utilities of GAM1338 include diagnosis, prevention and treatment of diseases and clinical conditions associated with FLJ13984.

FLJ14327 (Accession NP_079188.1) is another GAM1338 target gene, herein designated TARGET GENE. FLJ14327 BINDING SITE is a target binding site found in the 3' untranslated region of mRNA encoded by FLJ14327, corresponding to a target binding site such as BINDING SITE I, BINDING SITE II or BINDING SITE III of FIG. 8. Table 4 illustrates the complementarity of the nucleotide sequences of FLJ14327 BINDING SITE, designated SEQ ID:14346, to the nucleotide sequence of GAM1338 RNA, herein designated GAM RNA, also designated SEQ ID:360.

Another function of GAM1338 is therefore inhibition of FLJ14327 (Accession NP_079188.1). Accordingly, utilities of GAM1338 include diagnosis, prevention and treatment of diseases and clinical conditions associated with FLJ14327.

FLJ14351 (Accession NP_079008.1) is another GAM1338 target gene, herein designated TARGET GENE. FLJ14351 BINDING SITE is a target binding site found in the 3' untranslated region of mRNA encoded by FLJ14351, corresponding to a target binding site such as BINDING SITE I, BINDING SITE II or BINDING SITE III of FIG. 8. Table 4 illustrates the complementarity of the nucleotide sequences of FLJ14351 BINDING SITE, designated SEQ ID:8244, to the nucleotide sequence of GAM1338 RNA, herein designated GAM RNA, also designated SEQ ID:360.

Another function of GAM1338 is therefore inhibition of FLJ14351 (Accession NP_079008.1). Accordingly, utilities of GAM1338 include diagnosis, prevention and treatment of diseases and clinical conditions associated with FLJ14351.

FLJ14442 (Accession NP_116174.1) is another GAM1338 target gene, herein designated TARGET GENE. FLJ14442 BINDING SITE is a target binding site found in the 3' untranslated region of mRNA encoded by FLJ14442, corresponding to a target binding site such as BINDING SITE I, BINDING SITE II or BINDING SITE III of FIG. 8. Table 4 illustrates the complementarity of the nucleotide sequences of FLJ14442 BINDING SITE, designated SEQ ID:16517, to the nucleotide sequence of GAM1338 RNA, herein designated GAM RNA, also designated SEQ ID:360.

Another function of GAM1338 is therefore inhibition of FLJ14442 (Accession NP_116174.1). Accordingly, utilities of GAM1338 include diagnosis, prevention and treatment of diseases and clinical conditions associated with FLJ14442.

FLJ14803 (Accession NP_116231.1) is another GAM1338 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:3409, to the nucleotide sequence of GAM1338 RNA, herein designated GAM RNA, also designated SEQ ID:360.

Another function of GAM1338 is therefore inhibition of FLJ14803 (Accession NP_116231.1). Accordingly, utilities of GAM1338 include diagnosis, prevention and treatment of diseases and clinical conditions associated with FLJ14803.

FLJ14957 (Accession NP_116255.1) is another GAM1338 target gene, herein designated TARGET GENE. FLJ14957 BINDING SITE is a target binding site found in the 3' untranslated region of mRNA encoded by FLJ14957, corresponding to a target binding site such as BINDING SITE I, BINDING SITE II or BINDING SITE III of FIG. 8. Table 4 illustrates the complementarity of the nucleotide sequences of FLJ14957 BINDING SITE, designated SEQ ID:13179, to the nucleotide sequence of GAM1338 RNA, herein designated GAM RNA, also designated SEQ ID:360.

Another function of GAM1338 is therefore inhibition of FLJ14957 (Accession NP_116255.1). Accordingly, utilities of GAM1338 include diagnosis, prevention and treatment of diseases and clinical conditions associated with FLJ14957.

FLJ20045 (Accession NP_060108.1) is another GAM1338 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:19070, to the nucleotide sequence of GAM1338 RNA, herein designated GAM RNA, also designated SEQ ID:360.

Another function of GAM1338 is therefore inhibition of FLJ20045 (Accession NP_060108.1). Accordingly, utilities of GAM1338 include diagnosis, prevention and treatment of diseases and clinical conditions associated with FLJ20045.

FLJ20079 (Accession NP_060126.1) is another GAM1338 target gene, herein designated TARGET GENE. FLJ20079 BINDING SITE is a target binding site found in the 3' untranslated region of mRNA encoded by FLJ20079, corresponding to a target binding site such as BINDING SITE I, BINDING SITE II or BINDING SITE III of FIG. 8. Table 4 illustrates the complementarity of the nucleotide sequences of FLJ20079 BINDING SITE, designated SEQ ID:6780, to the nucleotide sequence of GAM1338 RNA, herein designated GAM RNA, also designated SEQ ID:360.

Another function of GAM1338 is therefore inhibition of FLJ20079 (Accession NP_060126.1). Accordingly, utilities of GAM1338 include diagnosis, prevention and treatment of diseases and clinical conditions associated with FLJ20079.

FLJ20095 (Accession NP_060136.1) is another GAM1338 target gene, herein designated TARGET GENE. FLJ20095 BINDING SITE is a target binding site found in the 3' untranslated region of mRNA encoded by FLJ20095, corresponding to a target binding site such as BINDING SITE I, BINDING SITE II or BINDING SITE III of FIG. 8. Table 4 illustrates the complementarity of the nucleotide sequences of FLJ20095 BINDING SITE, designated SEQ ID:13800, to the nucleotide sequence of GAM1338 RNA, herein designated GAM RNA, also designated SEQ ID:360.

Another function of GAM1338 is therefore inhibition of FLJ20095 (Accession NP_060136.1). Accordingly, utilities of GAM1338 include diagnosis, prevention and treatment of diseases and clinical conditions associated with FLJ20095.

FLJ20136 (Accession NP_060154.1) is another GAM1338 target gene, herein designated TARGET GENE. FLJ20136 BINDING SITE is a target binding site found in the 3' untranslated region of mRNA encoded by FLJ20136, corresponding to a target binding site such as BINDING SITE I, BINDING SITE II or BINDING SITE III of FIG. 8. Table 4 illustrates the complementarity of the nucleotide sequences of FLJ20136 BINDING SITE, designated SEQ ID:15523, to the nucleotide sequence of GAM1338 RNA, herein designated GAM RNA, also designated SEQ ID:360.

Another function of GAM1338 is therefore inhibition of FLJ20136 (Accession NP_060154.1). Accordingly, utilities of GAM1338 include diagnosis, prevention and treatment of diseases and clinical conditions associated with FLJ20136.

FLJ20147 (Accession NP_060157.1) is another GAM1338 target gene, herein designated TARGET GENE. FLJ20147 BINDING SITE is a target binding site found in the 3' untranslated region of mRNA encoded by FLJ20147, corresponding to a target binding site such as BINDING SITE I, BINDING SITE II or BINDING SITE III of FIG. 8. Table 4 illustrates the complementarity of the nucleotide sequences of FLJ20147 BINDING SITE, designated SEQ ID:11745, to the nucleotide sequence of GAM1338 RNA, herein designated GAM RNA, also designated SEQ ID:360.

Another function of GAM1338 is therefore inhibition of FLJ20147 (Accession NP_060157.1). Accordingly, utilities of GAM1338 include diagnosis, prevention and treatment of diseases and clinical conditions associated with FLJ20147.

FLJ20245 (Accession NP_060193.1) is another GAM1338 target gene, herein designated TARGET GENE. FLJ20245 BINDING SITE is a target binding site found in the 3' untranslated region of mRNA encoded by FLJ20245, corresponding to a target binding site such as BINDING SITE I, BINDING SITE II or BINDING SITE III of FIG. 8. Table 4 illustrates the complementarity of the nucleotide sequences of FLJ20245 BINDING SITE, designated SEQ ID:19728, to the nucleotide sequence of GAM1338 RNA, herein designated GAM RNA, also designated SEQ ID:360.

Another function of GAM1338 is therefore inhibition of FLJ20245 (Accession NP_060193.1). Accordingly, utilities of GAM1338 include diagnosis, prevention and treatment of diseases and clinical conditions associated with FLJ20245.

FLJ20308 (Accession NP_060228.1) is another GAM1338 target gene, herein designated TARGET GENE. FLJ20308 BINDING SITE is a target binding site found in the 3' untranslated region of mRNA encoded by FLJ20308, corresponding to a target binding site such as BINDING SITE I, BINDING SITE II or BINDING SITE III of FIG. 8. Table 4 illustrates the complementarity of the nucleotide sequences of FLJ20308 BINDING SITE, designated SEQ ID:5707, to the nucleotide sequence of GAM1338 RNA, herein designated GAM RNA, also designated SEQ ID:360.

Another function of GAM1338 is therefore inhibition of FLJ20308 (Accession NP_060228.1). Accordingly, utilities of GAM1338 include diagnosis, prevention and treatment of diseases and clinical conditions associated with FLJ20308.

FLJ20309 (Accession NP_060229.1) is another GAM1338 target gene, herein designated TARGET GENE. FLJ20309 BINDING SITE is a target binding site found in the 3' untranslated region of mRNA encoded by FLJ20309, corresponding to a target binding site such as BINDING SITE I, BINDING SITE II or BINDING SITE III of FIG. 8. Table 4 illustrates the complementarity of the nucleotide sequences of FLJ20309 BINDING SITE, designated SEQ ID:2478, to the nucleotide sequence of GAM1338 RNA, herein designated GAM RNA, also designated SEQ ID:360.

Another function of GAM1338 is therefore inhibition of FLJ20309 (Accession NP_060229.1). Accordingly, utilities of GAM1338 include diagnosis, prevention and treatment of diseases and clinical conditions associated with FLJ20309.

FLJ20320 (Accession NP_060235.1) is another GAM1338 target gene, herein designated TARGET GENE. FLJ20320 BINDING SITE is a target binding site found in the 3' untranslated region of mRNA encoded by FLJ20320, corresponding to a target binding site such as BINDING SITE I, BINDING SITE II or BINDING SITE III of FIG. 8. Table 4 illustrates the complementarity of the nucleotide sequences of FLJ20320 BINDING SITE, designated SEQ ID:9740, to the nucleotide sequence of GAM1338 RNA, herein designated GAM RNA, also designated SEQ ID:360.

Another function of GAM1338 is therefore inhibition of FLJ20320 (Accession NP_060235.1). Accordingly, utilities of GAM1338 include diagnosis, prevention and treatment of diseases and clinical conditions associated with FLJ20320.

FLJ20502 (Accession NP_060315.1) is another GAM1338 target gene, herein designated TARGET GENE. FLJ20502 BINDING SITE is a target binding site found in the 3' untranslated region of mRNA encoded by FLJ20502, corresponding to a target binding site such as BINDING SITE I, BINDING SITE II or BINDING SITE III of FIG. 8. Table 4 illustrates the complementarity of the nucleotide sequences of FLJ20502 BINDING SITE, designated SEQ ID:2719, to the nucleotide sequence of GAM1338 RNA, herein designated GAM RNA, also designated SEQ ID:360.

Another function of GAM1338 is therefore inhibition of FLJ20502 (Accession NP_060315.1). Accordingly, utilities of GAM1338 include diagnosis, prevention and treatment of diseases and clinical conditions associated with FLJ20502.

FLJ20511 (Accession NP_060323.1) is another GAM1338 target gene, herein designated TARGET GENE. FLJ20511 BINDING SITE is a target binding site found in the 3' untranslated region of mRNA encoded by FLJ20511, corresponding to a target binding site such as BINDING SITE I, BINDING SITE II or BINDING SITE III of FIG. 8. Table 4 illustrates the complementarity of the nucleotide sequences of FLJ20511 BINDING SITE, designated SEQ ID:969, to the nucleotide sequence of GAM1338 RNA, herein designated GAM RNA, also designated SEQ ID:360.

Another function of GAM1338 is therefore inhibition of FLJ20511 (Accession NP_060323.1). Accordingly, utilities of GAM1338 include diagnosis, prevention and treatment of diseases and clinical conditions associated with FLJ20511.

FLJ20671 (Accession NP_060394.1) is another GAM1338 target gene, herein designated TARGET GENE. FLJ20671 BINDING SITE1 and FLJ20671 BINDING SITE2 are target binding sites found in untranslated regions of mRNA encoded by FLJ20671, corresponding to target binding sites such as BINDING SITE I, BINDING SITE II or BINDING SITE III of FIG. 8. Table 4 illustrates the complementarity of the nucleotide sequences of FLJ20671 BINDING SITE1 and FLJ20671 BINDING SITE2, designated SEQ ID:13745 and SEQ ID:10861 respectively, to the nucleotide sequence of GAM1338 RNA, herein designated GAM RNA, also designated SEQ ID:360.

Another function of GAM1338 is therefore inhibition of FLJ20671 (Accession NP_060394.1). Accordingly, utilities of GAM1338 include diagnosis, prevention and treatment of diseases and clinical conditions associated with FLJ20671.

FLJ20700 (Accession NP_060402.1) is another GAM1338 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:20156, to the nucleotide sequence of GAM1338 RNA, herein designated GAM RNA, also designated SEQ ID:360.

Another function of GAM1338 is therefore inhibition of FLJ20700 (Accession NP_060402.1). Accordingly, utilities of GAM1338 include diagnosis, prevention and treatment of diseases and clinical conditions associated with FLJ20700.

FLJ20813 (Accession NP_060431.1) is another GAM1338 target gene, herein designated TARGET GENE. FLJ20813 BINDING SITE is a target binding site found in the 3' untranslated region of mRNA encoded by FLJ20813, corresponding to a target binding site such as BINDING SITE I, BINDING SITE II or BINDING SITE III of FIG. 8. Table 4 illustrates the complementarity of the nucleotide sequences of FLJ20813 BINDING SITE, designated SEQ ID:18464, to the nucleotide sequence of GAM1338 RNA, herein designated GAM RNA, also designated SEQ ID:360.

Another function of GAM1338 is therefore inhibition of FLJ20813 (Accession NP_060431.1). Accordingly, utilities of GAM1338 include diagnosis, prevention and treatment of diseases and clinical conditions associated with FLJ20813.

FLJ20886 (Accession NP_079475.1) is another GAM1338 target gene, herein designated TARGET GENE. FLJ20886 BINDING SITE is a target binding site found in the 5' untranslated region of mRNA encoded by FLJ20886, corresponding to a target binding site such as BINDING SITE I, BINDING SITE II or BINDING SITE III of FIG. 8. Table 4 illustrates the complementarity of the nucleotide sequences of FLJ20886 BINDING SITE, designated SEQ ID:6236, to the nucleotide sequence of GAM1338 RNA, herein designated GAM RNA, also designated SEQ ID:360.

Another function of GAM1338 is therefore inhibition of FLJ20886 (Accession NP_079475.1). Accordingly, utilities of GAM1338 include diagnosis, prevention and treatment of diseases and clinical conditions associated with FLJ20886.

FLJ21302 (Accession NP_075052.1) is another GAM1338 target gene, herein designated TARGET GENE. FLJ21302 BINDING SITE is a target binding site found in the 3' untranslated region of mRNA encoded by FLJ21302, corresponding to a target binding site such as BINDING SITE I, BINDING SITE II or BINDING SITE III of FIG. 8. Table 4 illustrates the complementarity of the nucleotide sequences of FLJ21302 BINDING SITE, designated SEQ ID:11446, to the nucleotide sequence of GAM1338 RNA, herein designated GAM RNA, also designated SEQ ID:360.

Another function of GAM1338 is therefore inhibition of FLJ21302 (Accession NP_075052.1). Accordingly, utilities of GAM1338 include diagnosis, prevention and treatment of diseases and clinical conditions associated with FLJ21302.

FLJ21603 (Accession NP_079038.1) is another GAM1338 target gene, herein designated TARGET GENE. FLJ21603 BINDING SITE is a target binding site found in the 3' untranslated region of mRNA encoded by FLJ21603, corresponding to a target binding site such as BINDING SITE I, BINDING SITE II or BINDING SITE III of FIG. 8. Table 4 illustrates the complementarity of the nucleotide sequences of FLJ21603 BINDING SITE, designated SEQ ID:11662, to the nucleotide sequence of GAM1338 RNA, herein designated GAM RNA, also designated SEQ ID:360.

Another function of GAM1338 is therefore inhibition of FLJ21603 (Accession NP_079038.1). Accordingly, utilities of GAM1338 include diagnosis, prevention and treatment of diseases and clinical conditions associated with FLJ21603.

FLJ21673 (Accession NP_112160.1) is another GAM1338 target gene, herein designated TARGET GENE. FLJ21673 BINDING SITE is a target binding site found in the 5' untranslated region of mRNA encoded by FLJ21673, corresponding to a target binding site such as BINDING SITE I, BINDING SITE II or BINDING SITE III of FIG. 8. Table 4 illustrates the complementarity of the nucleotide sequences of FLJ21673 BINDING SITE, designated SEQ ID:1926, to the nucleotide sequence of GAM1338 RNA, herein designated GAM RNA, also designated SEQ ID:360.

Another function of GAM1338 is therefore inhibition of FLJ21673 (Accession NP_112160.1). Accordingly, utilities of GAM1338 include diagnosis, prevention and treatment of diseases and clinical conditions associated with FLJ21673.

FLJ21841 (Accession NP_078885.1) is another GAM1338 target gene, herein designated TARGET GENE. FLJ21841 BINDING SITE is a target binding site found in the 3' untranslated region of mRNA encoded by FLJ21841, corresponding to a target binding site such as BINDING SITE I, BINDING SITE II or BINDING SITE III of FIG. 8. Table 4 illustrates the complementarity of the nucleotide sequences of FLJ21841 BINDING SITE, designated SEQ ID:5009, to the nucleotide sequence of GAM1338 RNA, herein designated GAM RNA, also designated SEQ ID:360.

Another function of GAM1338 is therefore inhibition of FLJ21841 (Accession NP_078885.1). Accordingly, utilities of GAM1338 include diagnosis, prevention and treatment of diseases and clinical conditions associated with FLJ21841.

FLJ22029 (Accession NP_079225.2) is another GAM1338 target gene, herein designated TARGET GENE. FLJ22029 BINDING SITE is a target binding site found in the 3' untranslated region of mRNA encoded by FLJ22029, corresponding to a target binding site such as BINDING SITE I, BINDING SITE II or BINDING SITE III of FIG. 8. Table 4 illustrates the complementarity of the nucleotide sequences of FLJ22029 BINDING SITE, designated SEQ ID:10676, to the nucleotide sequence of GAM1338 RNA, herein designated GAM RNA, also designated SEQ ID:360.

Another function of GAM1338 is therefore inhibition of FLJ22029 (Accession NP_079225.2). Accordingly, utilities of GAM1338 include diagnosis, prevention and treatment of diseases and clinical conditions associated with FLJ22029.

FLJ22167 (Accession NP_078809.2) is another GAM1338 target gene, herein designated TARGET GENE. FLJ22167 BINDING SITE is a target binding site found in the 5' untranslated region of mRNA encoded by FLJ22167, corresponding to a target binding site such as BINDING SITE I, BINDING SITE II or BINDING SITE III of FIG. 8. Table 4 illustrates the complementarity of the nucleotide sequences of FLJ22167 BINDING SITE, designated SEQ ID:2733, to the nucleotide sequence of GAM1338 RNA, herein designated GAM RNA, also designated SEQ ID:360.

Another function of GAM1338 is therefore inhibition of FLJ22167 (Accession NP_078809.2). Accordingly, utilities of GAM1338 include diagnosis, prevention and treatment of diseases and clinical conditions associated with FLJ22167.

FLJ22329 (Accession NP_078932.2) is another GAM1338 target gene, herein designated TARGET GENE. FLJ22329 BINDING SITE is a target binding site found in the 3' untranslated region of mRNA encoded by FLJ22329, corresponding to a target binding site such as BINDING SITE I, BINDING SITE II or BINDING SITE III of FIG. 8. Table 4 illustrates the complementarity of the nucleotide sequences of FLJ22329 BINDING SITE, designated SEQ ID:10803, to the nucleotide sequence of GAM1338 RNA, herein designated GAM RNA, also designated SEQ ID:360.

Another function of GAM1338 is therefore inhibition of FLJ22329 (Accession NP_078932.2). Accordingly, utilities of GAM1338 include diagnosis, prevention and treatment of diseases and clinical conditions associated with FLJ22329.

FLJ22531 (Accession NP_078926.2) is another GAM1338 target gene, herein designated TARGET GENE. FLJ22531 BINDING SITE is a target binding site found in the 5' untranslated region of mRNA encoded by FLJ22531, corresponding to a target binding site such as BINDING SITE I, BINDING SITE II or BINDING SITE III of FIG. 8. Table 4 illustrates the complementarity of the nucleotide sequences of FLJ22531 BINDING SITE, designated SEQ ID:3548, to the nucleotide sequence of GAM1338 RNA, herein designated GAM RNA, also designated SEQ ID:360.

Another function of GAM1338 is therefore inhibition of FLJ22531 (Accession NP_078926.2). Accordingly, utilities of GAM1338 include diagnosis, prevention and treatment of diseases and clinical conditions associated with FLJ22531.

FLJ22965 (Accession NP_071384.1) is another GAM1338 target gene, herein designated TARGET GENE. FLJ22965 BINDING SITE is a target binding site found in the 3' untranslated region of mRNA encoded by FLJ22965, corresponding to a target binding site such as BINDING SITE I, BINDING SITE II or BINDING SITE III of FIG. 8. Table 4 illustrates the complementarity of the nucleotide sequences of FLJ22965 BINDING SITE, designated SEQ ID:9754, to the nucleotide sequence of GAM1338 RNA, herein designated GAM RNA, also designated SEQ ID:360.

Another function of GAM1338 is therefore inhibition of FLJ22965 (Accession NP_071384.1). Accordingly, utilities of GAM1338 include diagnosis, prevention and treatment of diseases and clinical conditions associated with FLJ22965.

FLJ23053 (Accession NP_075058.1) is another GAM1338 target gene, herein designated TARGET GENE. FLJ23053 BINDING SITE is a target binding site found in the 3' untranslated region of mRNA encoded by FLJ23053, corresponding to a target binding site such as BINDING SITE I, BINDING SITE II or BINDING SITE III of FIG. 8. Table 4 illustrates the complementarity of the nucleotide sequences of FLJ23053 BINDING SITE, designated SEQ ID:16973, to the nucleotide sequence of GAM1338 RNA, herein designated GAM RNA, also designated SEQ ID:360.

Another function of GAM1338 is therefore inhibition of FLJ23053 (Accession NP_075058.1). Accordingly, utilities of GAM1338 include diagnosis, prevention and treatment of diseases and clinical conditions associated with FLJ23053.

FLJ23186 (Accession NP_078892.1) is another GAM1338 target gene, herein designated TARGET GENE. FLJ23186 BINDING SITE is a target binding site found in the 3' untranslated region of mRNA encoded by FLJ23186, corresponding to a target binding site such as BINDING SITE I, BINDING SITE II or BINDING SITE III of FIG. 8. Table 4 illustrates the complementarity of the nucleotide sequences of FLJ23186 BINDING SITE, designated SEQ ID:10010, to the nucleotide sequence of GAM1338 RNA, herein designated GAM RNA, also designated SEQ ID:360.

Another function of GAM1338 is therefore inhibition of FLJ23186 (Accession NP_078892.1). Accordingly, utilities of GAM1338 include diagnosis, prevention and treatment of diseases and clinical conditions associated with FLJ23186.

FLJ23263 (Accession NP_079391.1) is another GAM1338 target gene, herein designated TARGET GENE. FLJ23263 BINDING SITE is a target binding site found in the 5' untranslated region of mRNA encoded by FLJ23263, corresponding to a target binding site such as BINDING SITE I, BINDING SITE II or BINDING SITE III of FIG. 8. Table 4 illustrates the complementarity of the nucleotide sequences of FLJ23263 BINDING SITE, designated SEQ ID:13801, to the nucleotide sequence of GAM1338 RNA, herein designated GAM RNA, also designated SEQ ID:360.

Another function of GAM1338 is therefore inhibition of FLJ23263 (Accession NP_079391.1). Accordingly, utilities of GAM1338 include diagnosis, prevention and treatment of diseases and clinical conditions associated with FLJ23263.

FLJ23356 (Accession NP_115613.1) is another GAM1338 target gene, herein designated TARGET GENE. FLJ23356 BINDING SITE is a target binding site found in the 3' untranslated region of mRNA encoded by FLJ23356, corresponding to a target binding site such as BINDING SITE I, BINDING SITE II or BINDING SITE III of FIG. 8. Table 4 illustrates the complementarity of the nucleotide sequences of FLJ23356 BINDING SITE, designated SEQ ID:14440, to the nucleotide sequence of GAM1338 RNA, herein designated GAM RNA, also designated SEQ ID:360.

Another function of GAM1338 is therefore inhibition of FLJ23356 (Accession NP_115613.1). Accordingly, utilities of GAM1338 include diagnosis, prevention and treatment of diseases and clinical conditions associated with FLJ23356.

FLJ23392 (Accession NP_079060.1) is another GAM1338 target gene, herein designated TARGET GENE. FLJ23392 BINDING SITE1 through FLJ23392 BINDING SITE3 are target binding sites found in untranslated regions of mRNA encoded by FLJ23392, corresponding to target binding sites such as BINDING SITE I, BINDING SITE II or BINDING SITE III of FIG. 8. Table 4 illustrates the complementarity of the nucleotide sequences of FLJ23392 BINDING SITE1 through FLJ23392 BINDING SITE3, designated SEQ ID:431, SEQ ID:4022 and SEQ ID:11425 respectively, to the nucleotide sequence of GAM1338 RNA, herein designated GAM RNA, also designated SEQ ID:360.

Another function of GAM1338 is therefore inhibition of FLJ23392 (Accession NP_079060.1). Accordingly, utilities of GAM1338 include diagnosis, prevention and treatment of diseases and clinical conditions associated with FLJ23392.

FLJ23416 (Accession NP_115614.1) is another GAM1338 target gene, herein designated TARGET GENE. FLJ23416 BINDING SITE is a target binding site found in the 3' untranslated region of mRNA encoded by FLJ23416, corresponding to a target binding site such as BINDING SITE I, BINDING SITE II or BINDING SITE III of FIG. 8. Table 4 illustrates the complementarity of the nucleotide sequences of FLJ23416 BINDING SITE, designated SEQ ID:4771, to the nucleotide sequence of GAM1338 RNA, herein designated GAM RNA, also designated SEQ ID:360.

Another function of GAM1338 is therefore inhibition of FLJ23416 (Accession NP_115614.1). Accordingly, utilities of GAM1338 include diagnosis, prevention and treatment of diseases and clinical conditions associated with FLJ23416.

FLJ23556 (Accession NP_079156.1) is another GAM1338 target gene, herein designated TARGET GENE. FLJ23556 BINDING SITE is a target binding site found in the 3' untranslated region of mRNA encoded by FLJ23556, corresponding to a target binding site such as BINDING SITE I, BINDING SITE II or BINDING SITE III of FIG. 8. Table 4 illustrates the complementarity of the nucleotide sequences of FLJ23556 BINDING SITE, designated SEQ ID:436, to the nucleotide sequence of GAM1338 RNA, herein designated GAM RNA, also designated SEQ ID:360.

Another function of GAM1338 is therefore inhibition of FLJ23556 (Accession NP_079156.1). Accordingly, utilities of GAM1338 include diagnosis, prevention and treatment of diseases and clinical conditions associated with FLJ23556.

FLJ23563 (Accession XP_041701.4) is another GAM1338 target gene, herein designated TARGET GENE. FLJ23563 BINDING SITE is a target binding site found in the 3' untranslated region of mRNA encoded by FLJ23563, corresponding to a target binding site such as BINDING SITE I, BINDING SITE II or BINDING SITE III of FIG. 8. Table 4 illustrates the complementarity of the nucleotide sequences of FLJ23563 BINDING SITE, designated SEQ ID:12755, to the nucleotide sequence of GAM1338 RNA, herein designated GAM RNA, also designated SEQ ID:360.

Another function of GAM1338 is therefore inhibition of FLJ23563 (Accession XP_041701.4). Accordingly, utilities of GAM1338 include diagnosis, prevention and treatment of diseases and clinical conditions associated with FLJ23563.

FLJ25795 (Accession NP_689633.1) is another GAM1338 target gene, herein designated TARGET GENE. FLJ25795 BINDING SITE is a target binding site found in the 3' untranslated region of mRNA encoded by FLJ25795, corresponding to a target binding site such as BINDING SITE I, BINDING SITE II or BINDING SITE III of FIG. 8. Table 4 illustrates the complementarity of the nucleotide sequences of FLJ25795 BINDING SITE, designated SEQ ID:18075, to the nucleotide sequence of GAM1338 RNA, herein designated GAM RNA, also designated SEQ ID:360.

Another function of GAM1338 is therefore inhibition of FLJ25795 (Accession NP_689633.1). Accordingly, utilities of GAM1338 include diagnosis, prevention and treatment of diseases and clinical conditions associated with FLJ25795.

FLJ30507 (Accession NP_694555.1) is another GAM1338 target gene, herein designated TARGET GENE. FLJ30507 BINDING SITE is a target binding site found in the 5' untranslated region of mRNA encoded by FLJ30507, corresponding to a target binding site such as BINDING SITE I, BINDING SITE II or BINDING SITE III of FIG. 8. Table 4 illustrates the complementarity of the nucleotide sequences of FLJ30507 BINDING SITE, designated SEQ ID:15050, to the nucleotide sequence of GAM1338 RNA, herein designated GAM RNA, also designated SEQ ID:360.

Another function of GAM1338 is therefore inhibition of FLJ30507 (Accession NP_694555.1). Accordingly, utilities of GAM1338 include diagnosis, prevention and treatment of diseases and clinical conditions associated with FLJ30507.

FLJ30532 (Accession NP_653325.1) is another GAM1338 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:15898, to the nucleotide sequence of GAM1338 RNA, herein designated GAM RNA, also designated SEQ ID:360.

Another function of GAM1338 is therefore inhibition of FLJ30532 (Accession NP_653325.1). Accordingly, utilities of GAM1338 include diagnosis, prevention and treatment of diseases and clinical conditions associated with FLJ30532.

FLJ31139 (Accession NP_775928.1) is another GAM1338 target gene, herein designated TARGET GENE. FLJ31139 BINDING SITE1 through FLJ31139 BINDING SITE3 are target binding sites found in untranslated regions of mRNA encoded by FLJ31139, corresponding to target binding sites such as BINDING SITE I, BINDING SITE II or BINDING SITE III of FIG. 8. Table 4 illustrates the complementarity of the nucleotide sequences of FLJ31139 BINDING SITE1 through FLJ31139 BINDING SITE3, designated SEQ ID:7279, SEQ ID:1817 and SEQ ID:19693 respectively, to the nucleotide sequence of GAM1338 RNA, herein designated GAM RNA, also designated SEQ ID:360.

Another function of GAM1338 is therefore inhibition of FLJ31139 (Accession NP_775928.1). Accordingly, utilities of GAM1338 include diagnosis, prevention and treatment of diseases and clinical conditions associated with FLJ31139.

FLJ31153 (Accession NP_653201.1) is another GAM1338 target gene, herein designated TARGET GENE. FLJ31153 BINDING SITE is a target binding site found in the 3' untranslated region of mRNA encoded by FLJ31153, corresponding to a target binding site such as BINDING SITE I, BINDING SITE II or BINDING SITE III of FIG. 8. Table 4 illustrates the complementarity of the nucleotide sequences of FLJ31153 BINDING SITE, designated SEQ ID:13799, to the nucleotide sequence of GAM1338 RNA, herein designated GAM RNA, also designated SEQ ID:360.

Another function of GAM1338 is therefore inhibition of FLJ31153 (Accession NP_653201.1). Accordingly, utilities of GAM1338 include diagnosis, prevention and treatment of diseases and clinical conditions associated with FLJ31153.

FLJ31338 (Accession NP_689682.1) is another GAM1338 target gene, herein designated TARGET GENE. FLJ31338 BINDING SITE is a target binding site found in the 3' untranslated region of mRNA encoded by FLJ31338, corresponding to a target binding site such as BINDING SITE I, BINDING SITE II or BINDING SITE III of FIG. 8. Table 4 illustrates the complementarity of the nucleotide sequences of FLJ31338 BINDING SITE, designated SEQ ID:7114, to the nucleotide sequence of GAM1338 RNA, herein designated GAM RNA, also designated SEQ ID:360.

Another function of GAM1338 is therefore inhibition of FLJ31338 (Accession NP_689682.1). Accordingly, utilities of GAM1338 include diagnosis, prevention and treatment of diseases and clinical conditions associated with FLJ31338.

FLJ31393 (Accession NP_694569.1) is another GAM1338 target gene, herein designated TARGET GENE. FLJ31393 BINDING SITE is a target binding site found in the 5' untranslated region of mRNA encoded by FLJ31393, corresponding to a target binding site such as BINDING SITE I, BINDING SITE II or BINDING SITE III of FIG. 8. Table 4 illustrates the complementarity of the nucleotide sequences of FLJ31393 BINDING SITE, designated SEQ ID:7878, to the nucleotide sequence of GAM1338 RNA, herein designated GAM RNA, also designated SEQ ID:360.

Another function of GAM1338 is therefore inhibition of FLJ31393 (Accession NP_694569.1). Accordingly, utilities of GAM1338 include diagnosis, prevention and treatment of diseases and clinical conditions associated with FLJ31393.

FLJ31401 (Accession NP_689877.1) is another GAM1338 target gene, herein designated TARGET GENE.

FLJ31401 BINDING SITE is a target binding site found in the 3' untranslated region of mRNA encoded by FLJ31401, corresponding to a target binding site such as BINDING SITE I, BINDING SITE II or BINDING SITE III of FIG. 8. Table 4 illustrates the complementarity of the nucleotide sequences of FLJ31401 BINDING SITE, designated SEQ ID:11498, to the nucleotide sequence of GAM1338 RNA, herein designated GAM RNA, also designated SEQ ID:360.

Another function of GAM1338 is therefore inhibition of FLJ31401 (Accession NP_689877.1). Accordingly, utilities of GAM1338 include diagnosis, prevention and treatment of diseases and clinical conditions associated with FLJ31401.

FLJ31821 (Accession NP_694574.1) is another GAM1338 target gene, herein designated TARGET GENE. FLJ31821 BINDING SITE is a target binding site found in the 5' untranslated region of mRNA encoded by FLJ31821, corresponding to a target binding site such as BINDING SITE I, BINDING SITE II or BINDING SITE III of FIG. 8. Table 4 illustrates the complementarity of the nucleotide sequences of FLJ31821 BINDING SITE, designated SEQ ID:17212, to the nucleotide sequence of GAM1338 RNA, herein designated GAM RNA, also designated SEQ ID:360.

Another function of GAM1338 is therefore inhibition of FLJ31821 (Accession NP_694574.1). Accordingly, utilities of GAM1338 include diagnosis, prevention and treatment of diseases and clinical conditions associated with FLJ31821.

FLJ32096 (Accession NP_776156.1) is another GAM1338 target gene, herein designated TARGET GENE. FLJ32096 BINDING SITE1 and FLJ32096 BINDING SITE2 are target binding sites found in untranslated regions of mRNA encoded by FLJ32096, corresponding to target binding sites such as BINDING SITE I, BINDING SITE II or BINDING SITE III of FIG. 8. Table 4 illustrates the complementarity of the nucleotide sequences of FLJ32096 BINDING SITE1 and FLJ32096 BINDING SITE2, designated SEQ ID:11067 and SEQ ID:20189 respectively, to the nucleotide sequence of GAM1338 RNA, herein designated GAM RNA, also designated SEQ ID:360.

Another function of GAM1338 is therefore inhibition of FLJ32096 (Accession NP_776156.1). Accordingly, utilities of GAM1338 include diagnosis, prevention and treatment of diseases and clinical conditions associated with FLJ32096.

FLJ32130 (Accession NP_689671.2) is another GAM1338 target gene, herein designated TARGET GENE. FLJ32130 BINDING SITE1 through FLJ32130 BINDING SITE3 are target binding sites found in untranslated regions of mRNA encoded by FLJ32130, corresponding to target binding sites such as BINDING SITE I, BINDING SITE II or BINDING SITE III of FIG. 8. Table 4 illustrates the complementarity of the nucleotide sequences of FLJ32130 BINDING SITE1 through FLJ32130 BINDING SITE3, designated SEQ ID:17307, SEQ ID:9100 and SEQ ID:5404 respectively, to the nucleotide sequence of GAM1338 RNA, herein designated GAM RNA, also designated SEQ ID:360.

Another function of GAM1338 is therefore inhibition of FLJ32130 (Accession NP_689671.2). Accordingly, utilities of GAM1338 include diagnosis, prevention and treatment of diseases and clinical conditions associated with FLJ32130.

FLJ32206 (Accession NP_689710.1) is another GAM1338 target gene, herein designated TARGET GENE. FLJ32206 BINDING SITE is a target binding site found in the 3' untranslated region of mRNA encoded by FLJ32206, corresponding to a target binding site such as BINDING SITE I, BINDING SITE II or BINDING SITE III of FIG. 8. Table 4 illustrates the complementarity of the nucleotide sequences of FLJ32206 BINDING SITE, designated SEQ ID:14825, to the nucleotide sequence of GAM1338 RNA, herein designated GAM RNA, also designated SEQ ID:360.

Another function of GAM1338 is therefore inhibition of FLJ32206 (Accession NP_689710.1). Accordingly, utilities of GAM1338 include diagnosis, prevention and treatment of diseases and clinical conditions associated with FLJ32206.

FLJ32499 (Accession NP_653208.1) is another GAM1338 target gene, herein designated TARGET GENE. FLJ32499 BINDING SITE is a target binding site found in the 3' untranslated region of mRNA encoded by FLJ32499, corresponding to a target binding site such as BINDING SITE I, BINDING SITE II or BINDING SITE III of FIG. 8. Table 4 illustrates the complementarity of the nucleotide sequences of FLJ32499 BINDING SITE, designated SEQ ID:2883, to the nucleotide sequence of GAM1338 RNA, herein designated GAM RNA, also designated SEQ ID:360.

Another function of GAM1338 is therefore inhibition of FLJ32499 (Accession NP_653208.1). Accordingly, utilities of GAM1338 include diagnosis, prevention and treatment of diseases and clinical conditions associated with FLJ32499.

FLJ32731 (Accession NP_689632.1) is another GAM1338 target gene, herein designated TARGET GENE. FLJ32731 BINDING SITE is a target binding site found in the 3' untranslated region of mRNA encoded by FLJ32731, corresponding to a target binding site such as BINDING SITE I, BINDING SITE II or BINDING SITE III of FIG. 8. Table 4 illustrates the complementarity of the nucleotide sequences of FLJ32731 BINDING SITE, designated SEQ ID:7308, to the nucleotide sequence of GAM1338 RNA, herein designated GAM RNA, also designated SEQ ID:360.

Another function of GAM1338 is therefore inhibition of FLJ32731 (Accession NP_689632.1). Accordingly, utilities of GAM1338 include diagnosis, prevention and treatment of diseases and clinical conditions associated with FLJ32731.

FLJ32803 (Accession NP_694584.1) is another GAM1338 target gene, herein designated TARGET GENE. FLJ32803 BINDING SITE is a target binding site found in the 3' untranslated region of mRNA encoded by FLJ32803, corresponding to a target binding site such as BINDING SITE I, BINDING SITE II or BINDING SITE III of FIG. 8. Table 4 illustrates the complementarity of the nucleotide sequences of FLJ32803 BINDING SITE, designated SEQ ID:7824, to the nucleotide sequence of GAM1338 RNA, herein designated GAM RNA, also designated SEQ ID:360.

Another function of GAM1338 is therefore inhibition of FLJ32803 (Accession NP_694584.1). Accordingly, utilities of GAM1338 include diagnosis, prevention and treatment of diseases and clinical conditions associated with FLJ32803.

FLJ32894 (Accession NP_653268.1) is another GAM1338 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:3716, to the nucleotide sequence of GAM1338 RNA, herein designated GAM RNA, also designated SEQ ID:360.

Another function of GAM1338 is therefore inhibition of FLJ32894 (Accession NP_653268.1). Accordingly, utilities of GAM1338 include diagnosis, prevention and treatment of diseases and clinical conditions associated with FLJ32894.

FLJ32932 (Accession NP_690873.1) is another GAM1338 target gene, herein designated TARGET GENE. FLJ32932 BINDING SITE is a target binding site found in the 3' untranslated region of mRNA encoded by FLJ32932, corresponding to a target binding site such as BINDING SITE I, BINDING SITE II or BINDING SITE III of FIG. 8. Table 4 illustrates the complementarity of the nucleotide sequences of FLJ32932 BINDING SITE, designated SEQ ID:4748, to the nucleotide sequence of GAM1338 RNA, herein designated GAM RNA, also designated SEQ ID:360.

Another function of GAM1338 is therefore inhibition of FLJ32932 (Accession NP_690873.1). Accordingly, utilities of GAM1338 include diagnosis, prevention and treatment of diseases and clinical conditions associated with FLJ32932.

FLJ33318 (Accession NP_694961.1) is another GAM1338 target gene, herein designated TARGET GENE. FLJ33318 BINDING SITE is a target binding site found in the 3' untranslated region of mRNA encoded by FLJ33318, corresponding to a target binding site such as BINDING SITE I, BINDING SITE II or BINDING SITE III of FIG. 8. Table 4 illustrates the complementarity of the nucleotide sequences of FLJ33318 BINDING SITE, designated SEQ ID:17978, to the nucleotide sequence of GAM1338 RNA, herein designated GAM RNA, also designated SEQ ID:360.

Another function of GAM1338 is therefore inhibition of FLJ33318 (Accession NP_694961.1). Accordingly, utilities of GAM1338 include diagnosis, prevention and treatment of diseases and clinical conditions associated with FLJ33318.

FLJ33505 (Accession NP_689530.1) is another GAM1338 target gene, herein designated TARGET GENE. FLJ33505 BINDING SITE is a target binding site found in the 3' untranslated region of mRNA encoded by FLJ33505, corresponding to a target binding site such as BINDING SITE I, BINDING SITE II or BINDING SITE III of FIG. 8. Table 4 illustrates the complementarity of the nucleotide sequences of FLJ33505 BINDING SITE, designated SEQ ID:2450, to the nucleotide sequence of GAM1338 RNA, herein designated GAM RNA, also designated SEQ ID:360.

Another function of GAM1338 is therefore inhibition of FLJ33505 (Accession NP_689530.1). Accordingly, utilities of GAM1338 include diagnosis, prevention and treatment of diseases and clinical conditions associated with FLJ33505.

FLJ33655 (Accession NP_775912.1) is another GAM1338 target gene, herein designated TARGET GENE. FLJ33655 BINDING SITE is a target binding site found in the 3' untranslated region of mRNA encoded by FLJ33655, corresponding to a target binding site such as BINDING SITE I, BINDING SITE II or BINDING SITE III of FIG. 8. Table 4 illustrates the complementarity of the nucleotide sequences of FLJ33655 BINDING SITE, designated SEQ ID:6177, to the nucleotide sequence of GAM1338 RNA, herein designated GAM RNA, also designated SEQ ID:360.

Another function of GAM1338 is therefore inhibition of FLJ33655 (Accession NP_775912.1). Accordingly, utilities of GAM1338 include diagnosis, prevention and treatment of diseases and clinical conditions associated with FLJ33655.

FLJ34817 (Accession NP_689516.1) is another GAM1338 target gene, herein designated TARGET GENE. FLJ34817 BINDING SITE1 and FLJ34817 BINDING SITE2 are target binding sites found in untranslated regions of mRNA encoded by FLJ34817, corresponding to target binding sites such as BINDING SITE I, BINDING SITE II or BINDING SITE III of FIG. 8. Table 4 illustrates the complementarity of the nucleotide sequences of FLJ34817 BINDING SITE1 and FLJ34817 BINDING SITE2, designated SEQ ID:434 and SEQ ID:10174 respectively, to the nucleotide sequence of GAM1338 RNA, herein designated GAM RNA, also designated SEQ ID:360.

Another function of GAM1338 is therefore inhibition of FLJ34817 (Accession NP_689516.1). Accordingly, utilities of GAM1338 include diagnosis, prevention and treatment of diseases and clinical conditions associated with FLJ34817.

FLJ34922 (Accession NP_689483.1) is another GAM1338 target gene, herein designated TARGET GENE. FLJ34922 BINDING SITE is a target binding site found in the 5' untranslated region of mRNA encoded by FLJ34922, corresponding to a target binding site such as BINDING SITE I, BINDING SITE II or BINDING SITE III of FIG. 8. Table 4 illustrates the complementarity of the nucleotide sequences of FLJ34922 BINDING SITE, designated SEQ ID:14214, to the nucleotide sequence of GAM1338 RNA, herein designated GAM RNA, also designated SEQ ID:360.

Another function of GAM1338 is therefore inhibition of FLJ34922 (Accession NP_689483.1). Accordingly, utilities of GAM1338 include diagnosis, prevention and treatment of diseases and clinical conditions associated with FLJ34922.

FLJ34969 (Accession XP_114353.1) is another GAM1338 target gene, herein designated TARGET GENE. FLJ34969 BINDING SITE is a target binding site found in the 3' untranslated region of mRNA encoded by FLJ34969, corresponding to a target binding site such as BINDING SITE I, BINDING SITE II or BINDING SITE III of FIG. 8. Table 4 illustrates the complementarity of the nucleotide sequences of FLJ34969 BINDING SITE, designated SEQ ID:6348, to the nucleotide sequence of GAM1338 RNA, herein designated GAM RNA, also designated SEQ ID:360.

Another function of GAM1338 is therefore inhibition of FLJ34969 (Accession XP_114353.1). Accordingly, utilities of GAM1338 include diagnosis, prevention and treatment of diseases and clinical conditions associated with FLJ34969.

FLJ35105 (Accession NP_689890.1) is another GAM1338 target gene, herein designated TARGET GENE. FLJ35105 BINDING SITE is a target binding site found in the 5' untranslated region of mRNA encoded by FLJ35105, corresponding to a target binding site such as BINDING SITE I, BINDING SITE II or BINDING SITE III of FIG. 8. Table 4 illustrates the complementarity of the nucleotide sequences of FLJ35105 BINDING SITE, designated SEQ ID:6840, to the nucleotide sequence of GAM1338 RNA, herein designated GAM RNA, also designated SEQ ID:360.

Another function of GAM1338 is therefore inhibition of FLJ35105 (Accession NP_689890.1). Accordingly, utilities of GAM1338 include diagnosis, prevention and treatment of diseases and clinical conditions associated with FLJ35105.

FLJ35681 (Accession NP_787096.1) is another GAM1338 target gene, herein designated TARGET GENE. FLJ35681 BINDING SITE1 and FLJ35681 BINDING SITE2 are target binding sites found in untranslated regions of mRNA encoded by FLJ35681, corresponding to target binding sites such as BINDING SITE I, BINDING SITE II or BINDING SITE III of FIG. 8. Table 4 illustrates the complementarity of the nucleotide sequences of FLJ35681 BINDING SITE1 and FLJ35681 BINDING SITE2, designated SEQ ID:3105 and SEQ ID:10703 respectively, to the nucleotide sequence of GAM1338 RNA, herein designated GAM RNA, also designated SEQ ID:360.

Another function of GAM1338 is therefore inhibition of FLJ35681 (Accession NP_787096.1). Accordingly, utilities of GAM1338 include diagnosis, prevention and treatment of diseases and clinical conditions associated with FLJ35681.

FLJ35848 (Accession XP_290755.1) is another GAM1338 target gene, herein designated TARGET GENE. FLJ35848 BINDING SITE is a target binding site found in the 3' untranslated region of mRNA encoded by FLJ35848, corresponding to a target binding site such as BINDING SITE I, BINDING SITE II or BINDING SITE III of FIG. 8. Table 4 illustrates the complementarity of the nucleotide sequences of FLJ35848 BINDING SITE, designated SEQ ID:12720, to the nucleotide sequence of GAM1338 RNA, herein designated GAM RNA, also designated SEQ ID:360.

Another function of GAM1338 is therefore inhibition of FLJ35848 (Accession XP_290755.1). Accordingly, utilities of GAM1338 include diagnosis, prevention and treatment of diseases and clinical conditions associated with FLJ35848.

FLJ36445 (Accession NP_694965.1) is another GAM1338 target gene, herein designated TARGET GENE. FLJ36445 BINDING SITE is a target binding site found in the 3' untranslated region of mRNA encoded by FLJ36445, corresponding to a target binding site such as BINDING SITE I, BINDING SITE II or BINDING SITE III of FIG. 8. Table 4 illustrates the complementarity of the nucleotide sequences of FLJ36445 BINDING SITE, designated SEQ ID:10632, to the nucleotide sequence of GAM1338 RNA, herein designated GAM RNA, also designated SEQ ID:360.

Another function of GAM1338 is therefore inhibition of FLJ36445 (Accession NP_694965.1). Accordingly, utilities of GAM1338 include diagnosis, prevention and treatment of diseases and clinical conditions associated with FLJ36445.

FLJ37045 (Accession NP_787085.1) is another GAM1338 target gene, herein designated TARGET GENE. FLJ37045 BINDING SITE is a target binding site found in the 3' untranslated region of mRNA encoded by FLJ37045, corresponding to a target binding site such as BINDING SITE I, BINDING SITE II or BINDING SITE III of FIG. 8. Table 4 illustrates the complementarity of the nucleotide sequences of FLJ37045 BINDING SITE, designated SEQ ID:6414, to the nucleotide sequence of GAM1338 RNA, herein designated GAM RNA, also designated SEQ ID:360.

Another function of GAM1338 is therefore inhibition of FLJ37045 (Accession NP_787085.1). Accordingly, utilities of GAM1338 include diagnosis, prevention and treatment of diseases and clinical conditions associated with FLJ37045.

FLJ37078 (Accession NP_694588.1) is another GAM1338 target gene, herein designated TARGET GENE. FLJ37078 BINDING SITE is a target binding site found in the 5' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:3106, to the nucleotide sequence of GAM1338 RNA, herein designated GAM RNA, also designated SEQ ID:360.

Another function of GAM1338 is therefore inhibition of FLJ37078 (Accession NP_694588.1). Accordingly, utilities of GAM1338 include diagnosis, prevention and treatment of diseases and clinical conditions associated with FLJ37078.

FLJ37266 (Accession NP_787088.1) is another GAM1338 target gene, herein designated TARGET GENE. FLJ37266 BINDING SITE is a target binding site found in the 3' untranslated region of mRNA encoded by FLJ37266, corresponding to a target binding site such as BINDING SITE I, BINDING SITE II or BINDING SITE III of FIG. 8. Table 4 illustrates the complementarity of the nucleotide sequences of FLJ37266 BINDING SITE, designated SEQ ID:9900, to the nucleotide sequence of GAM1338 RNA, herein designated GAM RNA, also designated SEQ ID:360.

Another function of GAM1338 is therefore inhibition of FLJ37266 (Accession NP_787088.1). Accordingly, utilities of GAM1338 include diagnosis, prevention and treatment of diseases and clinical conditions associated with FLJ37266.

FLJ37300 (Accession NP_694941.1) is another GAM1338 target gene, herein designated TARGET GENE. FLJ37300 BINDING SITE is a target binding site found in the 3' untranslated region of mRNA encoded by FLJ37300, corresponding to a target binding site such as BINDING SITE I, BINDING SITE II or BINDING SITE III of FIG. 8. Table 4 illustrates the complementarity of the nucleotide sequences of FLJ37300 BINDING SITE, designated SEQ ID:11542, to the nucleotide sequence of GAM1338 RNA, herein designated GAM RNA, also designated SEQ ID:360.

Another function of GAM1338 is therefore inhibition of FLJ37300 (Accession NP_694941.1). Accordingly, utilities of GAM1338 include diagnosis, prevention and treatment of diseases and clinical conditions associated with FLJ37300.

FLJ37433 (Accession NP_848612.1) is another GAM1338 target gene, herein designated TARGET GENE. FLJ37433 BINDING SITE is a target binding site found in the 3' untranslated region of mRNA encoded by FLJ37433, corresponding to a target binding site such as BINDING SITE I, BINDING SITE II or BINDING SITE III of FIG. 8. Table 4 illustrates the complementarity of the nucleotide sequences of FLJ37433 BINDING SITE, designated SEQ ID:18178, to the nucleotide sequence of GAM1338 RNA, herein designated GAM RNA, also designated SEQ ID:360.

Another function of GAM1338 is therefore inhibition of FLJ37433 (Accession NP_848612.1). Accordingly, utilities of GAM1338 include diagnosis, prevention and treatment of diseases and clinical conditions associated with FLJ37433.

FLJ37543 (Accession NP_775938.1) is another GAM1338 target gene, herein designated TARGET GENE. FLJ37543 BINDING SITE is a target binding site found in the 3' untranslated region of mRNA encoded by FLJ37543, corresponding to a target binding site such as BINDING SITE I, BINDING SITE II or BINDING SITE III of FIG. 8. Table 4 illustrates the complementarity of the nucleotide sequences of FLJ37543 BINDING SITE, designated SEQ ID:435, to the nucleotide sequence of GAM1338 RNA, herein designated GAM RNA, also designated SEQ ID:360.

Another function of GAM1338 is therefore inhibition of FLJ37543 (Accession NP_775938.1). Accordingly, utilities of GAM1338 include diagnosis, prevention and treatment of diseases and clinical conditions associated with FLJ37543.

FLJ37970 (Accession XP_290514.1) is another GAM1338 target gene, herein designated TARGET GENE. FLJ37970 BINDING SITE is a target binding site found in the 3' untranslated region of mRNA encoded by FLJ37970, corresponding to a target binding site such as BINDING SITE I, BINDING SITE II or BINDING SITE III of FIG. 8. Table 4 illustrates the complementarity of the nucleotide sequences of FLJ37970 BINDING SITE, designated SEQ ID:13645, to the nucleotide sequence of GAM1338 RNA, herein designated GAM RNA, also designated SEQ ID:360.

Another function of GAM1338 is therefore inhibition of FLJ37970 (Accession XP_290514.1). Accordingly, utilities of GAM1338 include diagnosis, prevention and treatment of diseases and clinical conditions associated with FLJ37970.

FLJ38101 (Accession NP_694993.2) is another GAM1338 target gene, herein designated TARGET GENE. FLJ38101 BINDING SITE is a target binding site found in the 3' untranslated region of mRNA encoded by FLJ38101, corresponding to a target binding site such as BINDING SITE I, BINDING SITE II or BINDING SITE III of FIG. 8. Table 4 illustrates the complementarity of the nucleotide sequences of FLJ38101 BINDING SITE, designated SEQ ID:6516, to the nucleotide sequence of GAM1338 RNA, herein designated GAM RNA, also designated SEQ ID:360.

Another function of GAM1338 is therefore inhibition of FLJ38101 (Accession NP_694993.2). Accordingly, utilities of GAM1338 include diagnosis, prevention and treatment of diseases and clinical conditions associated with FLJ38101.

FLJ38149 (Accession XP_091919.5) is another GAM1338 target gene, herein designated TARGET GENE.

FLJ38149 BINDING SITE1 through FLJ38149 BINDING SITE3 are target binding sites found in untranslated regions of mRNA encoded by FLJ38149, corresponding to target binding sites such as BINDING SITE I, BINDING SITE II or BINDING SITE III of FIG. 8. Table 4 illustrates the complementarity of the nucleotide sequences of FLJ38149 BINDING SITE1 through FLJ38149 BINDING SITE3, designated SEQ ID:2644, SEQ ID:11661 and SEQ ID:12581 respectively, to the nucleotide sequence of GAM1338 RNA, herein designated GAM RNA, also designated SEQ ID:360.

Another function of GAM1338 is therefore inhibition of FLJ38149 (Accession XP_091919.5). Accordingly, utilities of GAM1338 include diagnosis, prevention and treatment of diseases and clinical conditions associated with FLJ38149.

FLJ38281 (Accession NP_689814.1) is another GAM1338 target gene, herein designated TARGET GENE. FLJ38281 BINDING SITE1 and FLJ38281 BINDING SITE2 are target binding sites found in untranslated regions of mRNA encoded by FLJ38281, corresponding to target binding sites such as BINDING SITE I, BINDING SITE II or BINDING SITE III of FIG. 8. Table 4 illustrates the complementarity of the nucleotide sequences of FLJ38281 BINDING SITE1 and FLJ38281 BINDING SITE2, designated SEQ ID:17962 and SEQ ID:19457 respectively, to the nucleotide sequence of GAM1338 RNA, herein designated GAM RNA, also designated SEQ ID:360.

Another function of GAM1338 is therefore inhibition of FLJ38281 (Accession NP_689814.1). Accordingly, utilities of GAM1338 include diagnosis, prevention and treatment of diseases and clinical conditions associated with FLJ38281.

FLJ38607 (Accession NP_689867.1) is another GAM1338 target gene, herein designated TARGET GENE. FLJ38607 BINDING SITE is a target binding site found in the 3' untranslated region of mRNA encoded by FLJ38607, corresponding to a target binding site such as BINDING SITE I, BINDING SITE II or BINDING SITE III of FIG. 8. Table 4 illustrates the complementarity of the nucleotide sequences of FLJ38607 BINDING SITE, designated SEQ ID:3109, to the nucleotide sequence of GAM1338 RNA, herein designated GAM RNA, also designated SEQ ID:360.

Another function of GAM1338 is therefore inhibition of FLJ38607 (Accession NP_689867.1). Accordingly, utilities of GAM1338 include diagnosis, prevention and treatment of diseases and clinical conditions associated with FLJ38607.

FLJ38792 (Accession NP_848615.1) is another GAM1338 target gene, herein designated TARGET GENE. FLJ38792 BINDING SITE is a target binding site found in the 3' untranslated region of mRNA encoded by FLJ38792, corresponding to a target binding site such as BINDING SITE I, BINDING SITE II or BINDING SITE III of FIG. 8. Table 4 illustrates the complementarity of the nucleotide sequences of FLJ38792 BINDING SITE, designated SEQ ID:18182, to the nucleotide sequence of GAM1338 RNA, herein designated GAM RNA, also designated SEQ ID:360.

Another function of GAM1338 is therefore inhibition of FLJ38792 (Accession NP_848615.1). Accordingly, utilities of GAM1338 include diagnosis, prevention and treatment of diseases and clinical conditions associated with FLJ38792.

FLJ38819 (Accession NP_665872.1) is another GAM1338 target gene, herein designated TARGET GENE. FLJ38819 BINDING SITE1 and FLJ38819 BINDING SITE2 are target binding sites found in untranslated regions of mRNA encoded by FLJ38819, corresponding to target binding sites such as BINDING SITE I, BINDING SITE II or BINDING SITE III of FIG. 8. Table 4 illustrates the complementarity of the nucleotide sequences of FLJ38819 BINDING SITE1 and FLJ38819 BINDING SITE2, designated SEQ ID:3726 and SEQ ID:3017 respectively, to the nucleotide sequence of GAM1338 RNA, herein designated GAM RNA, also designated SEQ ID:360.

Another function of GAM1338 is therefore inhibition of FLJ38819 (Accession NP_665872.1). Accordingly, utilities of GAM1338 include diagnosis, prevention and treatment of diseases and clinical conditions associated with FLJ38819.

FLJ38991 (Accession NP_776188.1) is another GAM1338 target gene, herein designated TARGET GENE. FLJ38991 BINDING SITE1 and FLJ38991 BINDING SITE2 are target binding sites found in untranslated regions of mRNA encoded by FLJ38991, corresponding to target binding sites such as BINDING SITE I, BINDING SITE II or BINDING SITE III of FIG. 8. Table 4 illustrates the complementarity of the nucleotide sequences of FLJ38991 BINDING SITE1 and FLJ38991 BINDING SITE2, designated SEQ ID:5383 and SEQ ID:7191 respectively, to the nucleotide sequence of GAM1338 RNA, herein designated GAM RNA, also designated SEQ ID:360.

Another function of GAM1338 is therefore inhibition of FLJ38991 (Accession NP_776188.1). Accordingly, utilities of GAM1338 include diagnosis, prevention and treatment of diseases and clinical conditions associated with FLJ38991.

FLJ39415 (Accession NP_775952.1) is another GAM1338 target gene, herein designated TARGET GENE. FLJ39415 BINDING SITE is a target binding site found in the 3' untranslated region of mRNA encoded by FLJ39415, corresponding to a target binding site such as BINDING SITE I, BINDING SITE II or BINDING SITE III of FIG. 8. Table 4 illustrates the complementarity of the nucleotide sequences of FLJ39415 BINDING SITE, designated SEQ ID:17781, to the nucleotide sequence of GAM1338 RNA, herein designated GAM RNA, also designated SEQ ID:360.

Another function of GAM1338 is therefore inhibition of FLJ39415 (Accession NP_775952.1). Accordingly, utilities of GAM1338 include diagnosis, prevention and treatment of diseases and clinical conditions associated with FLJ39415.

FLJ39599 (Accession NP_776164.1) is another GAM1338 target gene, herein designated TARGET GENE. FLJ39599 BINDING SITE1 through FLJ39599 BINDING SITE3 are target binding sites found in untranslated regions of mRNA encoded by FLJ39599, corresponding to target binding sites such as BINDING SITE I, BINDING SITE II or BINDING SITE III of FIG. 8. Table 4 illustrates the complementarity of the nucleotide sequences of FLJ39599 BINDING SITE1 through FLJ39599 BINDING SITE3, designated SEQ ID:16019, SEQ ID:16634 and SEQ ID:7948 respectively, to the nucleotide sequence of GAM1338 RNA, herein designated GAM RNA, also designated SEQ ID:360.

Another function of GAM1338 is therefore inhibition of FLJ39599 (Accession NP_776164.1). Accordingly, utilities of GAM1338 include diagnosis, prevention and treatment of diseases and clinical conditions associated with FLJ39599.

FLJ39639 (Accession XP_290687.1) is another GAM1338 target gene, herein designated TARGET GENE. FLJ39639 BINDING SITE1 and FLJ39639 BINDING SITE2 are target binding sites found in untranslated regions of mRNA encoded by FLJ39639, corresponding to target binding sites such as BINDING SITE I, BINDING SITE II or BINDING SITE III of FIG. 8. Table 4 illustrates the complementarity of the nucleotide sequences of FLJ39639 BINDING SITE1 and FLJ39639 BINDING SITE2, designated SEQ ID:7663 and SEQ ID:13371 respectively, to the nucleotide sequence of GAM1338 RNA, herein designated GAM RNA, also designated SEQ ID:360.

Another function of GAM1338 is therefore inhibition of FLJ39639 (Accession XP_290687.1). Accordingly, utilities of GAM1338 include diagnosis, prevention and treatment of diseases and clinical conditions associated with FLJ39639.

FLJ39821 (Accession NP_775971.1) is another GAM1338 target gene, herein designated TARGET GENE. FLJ39821 BINDING SITE1 and FLJ39821 BINDING SITE2 are target binding sites found in untranslated regions of mRNA encoded by FLJ39821, corresponding to target binding sites such as BINDING SITE I, BINDING SITE II or BINDING SITE III of FIG. 8. Table 4 illustrates the complementarity of the nucleotide sequences of FLJ39821 BINDING SITE1 and FLJ39821 BINDING SITE2, designated SEQ ID:8171 and SEQ ID:14284 respectively, to the nucleotide sequence of GAM1338 RNA, herein designated GAM RNA, also designated SEQ ID:360.

Another function of GAM1338 is therefore inhibition of FLJ39821 (Accession NP_775971.1). Accordingly, utilities of GAM1338 include diagnosis, prevention and treatment of diseases and clinical conditions associated with FLJ39821.

FLJ90231 (Accession NP_775852.1) is another GAM1338 target gene, herein designated TARGET GENE. FLJ90231 BINDING SITE is a target binding site found in the 3' untranslated region of mRNA encoded by FLJ90231, corresponding to a target binding site such as BINDING SITE I, BINDING SITE II or BINDING SITE III of FIG. 8. Table 4 illustrates the complementarity of the nucleotide sequences of FLJ90231 BINDING SITE, designated SEQ ID:18854, to the nucleotide sequence of GAM1338 RNA, herein designated GAM RNA, also designated SEQ ID:360.

Another function of GAM1338 is therefore inhibition of FLJ90231 (Accession NP_775852.1). Accordingly, utilities of GAM1338 include diagnosis, prevention and treatment of diseases and clinical conditions associated with FLJ90231.

FLJ90586 (Accession NP_699176.1) is another GAM1338 target gene, herein designated TARGET GENE. FLJ90586 BINDING SITE is a target binding site found in the 3' untranslated region of mRNA encoded by FLJ90586, corresponding to a target binding site such as BINDING SITE I, BINDING SITE II or BINDING SITE III of FIG. 8. Table 4 illustrates the complementarity of the nucleotide sequences of FLJ90586 BINDING SITE, designated SEQ ID:3767, to the nucleotide sequence of GAM1338 RNA, herein designated GAM RNA, also designated SEQ ID:360.

Another function of GAM1338 is therefore inhibition of FLJ90586 (Accession NP_699176.1). Accordingly, utilities of GAM1338 include diagnosis, prevention and treatment of diseases and clinical conditions associated with FLJ90586.

FLJ90723 (Accession NP_787115.1) is another GAM1338 target gene, herein designated TARGET GENE. FLJ90723 BINDING SITE is a target binding site found in the 3' untranslated region of mRNA encoded by FLJ90723, corresponding to a target binding site such as BINDING SITE I, BINDING SITE II or BINDING SITE III of FIG. 8. Table 4 illustrates the complementarity of the nucleotide sequences of FLJ90723 BINDING SITE, designated SEQ ID:16986, to the nucleotide sequence of GAM1338 RNA, herein designated GAM RNA, also designated SEQ ID:360.

Another function of GAM1338 is therefore inhibition of FLJ90723 (Accession NP_787115.1). Accordingly, utilities of GAM1338 include diagnosis, prevention and treatment of diseases and clinical conditions associated with FLJ90723.

Formin binding protein 1 (FNBP1, Accession XP_052666.3) is another GAM1338 target gene, herein designated TARGET GENE. FNBP1 BINDING SITE is a target binding site found in the 3' untranslated region of mRNA encoded by FNBP1, corresponding to a target binding site such as BINDING SITE I, BINDING SITE II or BINDING SITE III of FIG. 8. Table 4 illustrates the complementarity of the nucleotide sequences of FNBP1 BINDING SITE, designated SEQ ID:8560, to the nucleotide sequence of GAM1338 RNA, herein designated GAM RNA, also designated SEQ ID:360.

Another function of GAM1338 is therefore inhibition of Formin binding protein 1 (FNBP1, Accession XP_052666.3). Accordingly, utilities of GAM1338 include diagnosis, prevention and treatment of diseases and clinical conditions associated with FNBP1.

Fsh primary response (lrpr1 homolog, rat) 1 (FSHPRH1, Accession NP_006724.1) is another GAM1338 target gene, herein designated TARGET GENE. FSHPRH1 BINDING SITE is a target binding site found in the 5' untranslated region of mRNA encoded by FSHPRH1, corresponding to a target binding site such as BINDING SITE I, BINDING SITE II or BINDING SITE III of FIG. 8. Table 4 illustrates the complementarity of the nucleotide sequences of FSHPRH1 BINDING SITE, designated SEQ ID:13800, to the nucleotide sequence of GAM1338 RNA, herein designated GAM RNA, also designated SEQ ID:360.

Another function of GAM1338 is therefore inhibition of Fsh primary response (lrpr1 homolog, rat) 1 (FSHPRH1, Accession NP_006724.1), a gene which is involved in the response of gonadal tissues to follicle- stimulating hormone. and therefore may be associated with Hypergonadotropic ovarian dysgenesis (odg), x-linked disorders of gonadal development. Accordingly, utilities of GAM1338 include diagnosis, prevention and treatment of Hypergonadotropic ovarian dysgenesis (odg), x-linked disorders of gonadal development, and of other diseases and clinical conditions associated with FSHPRH1.

The function of FSHPRH1 and its association with various diseases and clinical conditions, has been established by previous studies, as described hereinabove with reference to GAM189.1. Follistatin-like 1 (FSTL1, Accession NP_009016.1) is another GAM1338 target gene, herein designated TARGET GENE. FSTL1 BINDING SITE is a target binding site found in the 3' untranslated region of mRNA encoded by FSTL1, corresponding to a target binding site such as BINDING SITE I, BINDING SITE II or BINDING SITE III of FIG. 8. Table 4 illustrates the complementarity of the nucleotide sequences of FSTL1 BINDING SITE, designated SEQ ID:3666, to the nucleotide sequence of GAM1338 RNA, herein designated GAM RNA, also designated SEQ ID:360.

Another function of GAM1338 is therefore inhibition of Follistatin-like 1 (FSTL1, Accession NP_009016.1), a gene which may modulate the action of some growth factors on cell proliferation and differentiation. and therefore may be associated with Rheumatoid arthritis. Accordingly, utilities of GAM1338 include diagnosis, prevention and treatment of Rheumatoid arthritis, and of other diseases and clinical conditions associated with FSTL1.

The function of FSTL1 and its association with various diseases and clinical conditions, has been established by previous studies, as described hereinabove with reference to GAM279.1. Fucosyltransferase 1 (galactoside 2-alpha-l-fucosyltransferase, bombay phenotype included) (FUT1, Accession NP_000139.1) is another GAM1338 target gene, herein designated TARGET GENE. FUT1 BINDING SITE1 and FUT1 BINDING SITE2 are target binding sites found in untranslated regions of mRNA encoded by FUT1, corresponding to target binding sites such as BINDING SITE I, BINDING SITE II or BINDING SITE III of FIG. 8. Table 4 illustrates the complementarity of the nucleotide sequences of FUT1 BINDING SITE1 and FUT1 BINDING SITE2, designated SEQ ID:3102 and SEQ ID:7472 respectively, to the nucleotide sequence of GAM1338 RNA, herein designated GAM RNA, also designated SEQ ID:360.

Another function of GAM1338 is therefore inhibition of Fucosyltransferase 1 (galactoside 2-alpha-l-fucosyltransferase, bombay phenotype included) (FUT1, Accession NP_000139.1). Accordingly, utilities of GAM1338 include diagnosis, prevention and treatment of diseases and clinical conditions associated with FUT1.

Interferon, alpha-inducible protein (clone ifi-6-16) (G1P3, Accession NP_075011.1) is another GAM1338 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:14496, to the nucleotide sequence of GAM1338 RNA, herein designated GAM RNA, also designated SEQ ID:360.

Another function of GAM1338 is therefore inhibition of Interferon, alpha-inducible protein (clone ifi-6-16) (G1P3, Accession NP_075011.1), a gene which is an interferon-stimulated gene (ISG). Accordingly, utilities of GAM1338 include diagnosis, prevention and treatment of diseases and clinical conditions associated with G1P3.

The function of G1P3 and its association with various diseases and clinical conditions, has been established by previous studies, as described hereinabove with reference to GAM234.1. Interferon, alpha-inducible protein (clone ifi-6-16) (G1P3, Accession NP_002029.3) is another GAM1338 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:14496, to the nucleotide sequence of GAM1338 RNA, herein designated GAM RNA, also designated SEQ ID:360.

Another function of GAM1338 is therefore inhibition of Interferon, alpha-inducible protein (clone ifi-6-16) (G1P3, Accession NP_002029.3), a gene which is an interferon-stimulated gene (ISG). Accordingly, utilities of GAM1338 include diagnosis, prevention and treatment of diseases and clinical conditions associated with G1P3.

The function of G1P3 and its association with various diseases and clinical conditions, has been established by previous studies, as described hereinabove with reference to GAM234.1. Interferon, alpha-inducible protein (clone ifi-6-16) (G1P3, Accession NP_075010.1) is another GAM1338 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:14496, to the nucleotide sequence of GAM1338 RNA, herein designated GAM RNA, also designated SEQ ID:360.

Another function of GAM1338 is therefore inhibition of Interferon, alpha-inducible protein (clone ifi-6-16) (G1P3, Accession NP_075010.1), a gene which is an interferon-stimulated gene (ISG). Accordingly, utilities of GAM1338 include diagnosis, prevention and treatment of diseases and clinical conditions associated with G1P3.

The function of G1P3 and its association with various diseases and clinical conditions, has been established by previous studies, as described hereinabove with reference to GAM234.1. G2A (Accession NP_037477.1) is another GAM1338 target gene, herein designated TARGET GENE. G2A BINDING SITE is a target binding site found in the 3' untranslated region of mRNA encoded by G2A, corresponding to a target binding site such as BINDING SITE I, BINDING SITE II or BINDING SITE III of FIG. 8. Table 4 illustrates the complementarity of the nucleotide sequences of G2A BINDING SITE, designated SEQ ID:8834, to the nucleotide sequence of GAM1338 RNA, herein designated GAM RNA, also designated SEQ ID:360.

Another function of GAM1338 is therefore inhibition of G2A (Accession NP_037477.1), a gene which may mediate some of the effects of extracellular atp on insulin secretion. and therefore may be associated with Autoimmune disease. Accordingly, utilities of GAM1338 include diagnosis, prevention and treatment of Autoimmune disease, and of other diseases and clinical conditions associated with G2A.

The function of G2A and its association with various diseases and clinical conditions, has been established by previous studies, as described hereinabove with reference to GAM189.1. Glucose-6-phosphatase, catalytic (glycogen storage disease type i, von gierke disease) (G6PC, Accession NP_000142.1) is another GAM1338 target gene, herein designated TARGET GENE. G6PC BINDING SITE is a target binding site found in the 3' untranslated region of mRNA encoded by G6PC, corresponding to a target binding site such as BINDING SITE I, BINDING SITE II or BINDING SITE III of FIG. 8. Table 4 illustrates the complementarity of the nucleotide sequences of G6PC BINDING SITE, designated SEQ ID:8902, to the nucleotide sequence of GAM1338 RNA, herein designated GAM RNA, also designated SEQ ID:360.

Another function of GAM1338 is therefore inhibition of Glucose-6-phosphatase, catalytic (glycogen storage disease type i, von gierke disease) (G6PC, Accession NP_000142.1). Accordingly, utilities of GAM1338 include diagnosis, prevention and treatment of diseases and clinical conditions associated with G6PC.

GAL3ST-4 (Accession NP_078913.3) is another GAM1338 target gene, herein designated TARGET GENE. GAL3ST-4 BINDING SITE is a target binding site found in the 3' untranslated region of mRNA encoded by GAL3ST-4, corresponding to a target binding site such as BINDING SITE I, BINDING SITE II or BINDING SITE III of FIG. 8. Table 4 illustrates the complementarity of the nucleotide sequences of GAL3ST-4 BINDING SITE, designated SEQ ID:13405, to the nucleotide sequence of GAM1338 RNA, herein designated GAM RNA, also designated SEQ ID:360.

Another function of GAM1338 is therefore inhibition of GAL3ST-4 (Accession NP_078913.3). Accordingly, utilities of GAM1338 include diagnosis, prevention and treatment of diseases and clinical conditions associated with GAL3ST-4.

GBP4 (Accession NP_443173.2) is another GAM1338 target gene, herein designated TARGET GENE. GBP4 BINDING SITE is a target binding site found in the 3' untranslated region of mRNA encoded by GBP4, corresponding to a target binding site such as BINDING SITE I, BINDING SITE II or BINDING SITE III of FIG. 8. Table 4 illustrates the complementarity of the nucleotide sequences of GBP4 BINDING SITE, designated SEQ ID:12569, to the nucleotide sequence of GAM1338 RNA, herein designated GAM RNA, also designated SEQ ID:360.

Another function of GAM1338 is therefore inhibition of GBP4 (Accession NP_443173.2). Accordingly, utilities of GAM1338 include diagnosis, prevention and treatment of diseases and clinical conditions associated with GBP4.

Golgi associated, gamma adaptin ear containing, arf binding protein 2 (GGA2, Accession NP_619581.1) is another GAM1338 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:520, to the nucleotide sequence of GAM1338 RNA, herein designated GAM RNA, also designated SEQ ID:360.

Another function of GAM1338 is therefore inhibition of Golgi associated, gamma adaptin ear containing, arf binding protein 2 (GGA2, Accession NP_619581.1). Accordingly, utilities of GAM1338 include diagnosis, prevention and treatment of diseases and clinical conditions associated with GGA2.

Golgi associated, gamma adaptin ear containing, arf binding protein 2 (GGA2, Accession NP_055859.1) is another GAM1338 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:520, to the nucleotide sequence of GAM1338 RNA, herein designated GAM RNA, also designated SEQ ID:360.

Another function of GAM1338 is therefore inhibition of Golgi associated, gamma adaptin ear containing, arf binding protein 2 (GGA2, Accession NP_055859.1). Accordingly, utilities of GAM1338 include diagnosis, prevention and treatment of diseases and clinical conditions associated with GGA2.

Glucagon-like peptide 1 receptor (GLP1R, Accession NP_002053.2) is another GAM1338 target gene, herein designated TARGET GENE. GLP1R BINDING SITE is a target binding site found in the 3' untranslated region of mRNA encoded by GLP1R, corresponding to a target binding site such as BINDING SITE I, BINDING SITE II or BINDING SITE III of FIG. 8. Table 4 illustrates the complementarity of the nucleotide sequences of GLP1R BINDING SITE, designated SEQ ID:13842, to the nucleotide sequence of GAM1338 RNA, herein designated GAM RNA, also designated SEQ ID:360.

Another function of GAM1338 is therefore inhibition of Glucagon-like peptide 1 receptor (GLP1R, Accession NP_002053.2), a gene which is mediated by g proteins which activate adenylyl cyclase. Accordingly, utilities of GAM1338 include diagnosis, prevention and treatment of diseases and clinical conditions associated with GLP1R.

The function of GLP1R and its association with various diseases and clinical conditions, has been established by previous studies, as described hereinabove with reference to GAM385.2. Gm2 ganglioside activator protein (GM2A, Accession NP_000396.1) is another GAM1338 target gene, herein designated TARGET GENE. GM2A BINDING SITE is a target binding site found in the 3' untranslated region of mRNA encoded by GM2A, corresponding to a target binding site such as BINDING SITE I, BINDING SITE II or BINDING SITE III of FIG. 8. Table 4 illustrates the complementarity of the nucleotide sequences of GM2A BINDING SITE, designated SEQ ID:2518, to the nucleotide sequence of GAM1338 RNA, herein designated GAM RNA, also designated SEQ ID:360.

Another function of GAM1338 is therefore inhibition of Gm2 ganglioside activator protein (GM2A, Accession NP_000396.1). Accordingly, utilities of GAM1338 include diagnosis, prevention and treatment of diseases and clinical conditions associated with GM2A.

GNE (Accession NP_005467.1) is another GAM1338 target gene, herein designated TARGET GENE. GNE BINDING SITE is a target binding site found in the 3' untranslated region of mRNA encoded by GNE, corresponding to a target binding site such as BINDING SITE I, BINDING SITE II or BINDING SITE III of FIG. 8. Table 4 illustrates the complementarity of the nucleotide sequences of GNE BINDING SITE, designated SEQ ID:7151, to the nucleotide sequence of GAM1338 RNA, herein designated GAM RNA, also designated SEQ ID:360.

Another function of GAM1338 is therefore inhibition of GNE (Accession NP_005467.1), a gene which has roles in sialic acid biosynthesis and regulates cell surface sialylation. Accordingly, utilities of GAM1338 include diagnosis, prevention and treatment of diseases and clinical conditions associated with GNE.

The function of GNE and its association with various diseases and clinical conditions, has been established by previous studies, as described hereinabove with reference to GAM189.1. GNPNAT1 (Accession XP_085119.1) is another GAM1338 target gene, herein designated TARGET GENE. GNPNAT1 BINDING SITE1 and GNPNAT1 BINDING SITE2 are target binding sites found in untranslated regions of mRNA encoded by GNPNAT1, corresponding to target binding sites such as BINDING SITE I, BINDING SITE II or BINDING SITE III of FIG. 8. Table 4 illustrates the complementarity of the nucleotide sequences of GNPNAT1 BINDING SITE1 and GNPNAT1 BINDING SITE2, designated SEQ ID:19027 and SEQ ID:10643 respectively, to the nucleotide sequence of GAM1338 RNA, herein designated GAM RNA, also designated SEQ ID:360.

Another function of GAM1338 is therefore inhibition of GNPNAT1 (Accession XP_085119.1). Accordingly, utilities of GAM1338 include diagnosis, prevention and treatment of diseases and clinical conditions associated with GNPNAT1.

GNRPX (Accession NP_060519.1) is another GAM1338 target gene, herein designated TARGET GENE. GNRPX BINDING SITE is a target binding site found in the 3' untranslated region of mRNA encoded by GNRPX, corresponding to a target binding site such as BINDING SITE I, BINDING SITE II or BINDING SITE III of FIG. 8. Table 4 illustrates the complementarity of the nucleotide sequences of GNRPX BINDING SITE, designated SEQ ID:17848, to the nucleotide sequence of GAM1338 RNA, herein designated GAM RNA, also designated SEQ ID:360.

Another function of GAM1338 is therefore inhibition of GNRPX (Accession NP_060519.1). Accordingly, utilities of GAM1338 include diagnosis, prevention and treatment of diseases and clinical conditions associated with GNRPX.

Golgi autoantigen, golgin subfamily a, 3 (GOLGA3, Accession NP_005886.2) is another GAM1338 target gene, herein designated TARGET GENE. GOLGA3 BINDING SITE is a target binding site found in the 3' untranslated region of multiple transcripts of mRNA encoded by GOLGA3, corresponding to a target binding site such as BINDING SITE I, BINDING SITE II or BINDING SITE III of FIG. 8. Table 4 illustrates the complementarity of the nucleotide sequences of GOLGA3 BINDING SITE, designated SEQ ID:9100, to the nucleotide sequence of GAM1338 RNA, herein designated GAM RNA, also designated SEQ ID:360.

Another function of GAM1338 is therefore inhibition of Golgi autoantigen, golgin subfamily a, 3 (GOLGA3, Accession NP_005886.2) . Accordingly, utilities of GAM1338 include diagnosis, prevention and treatment of diseases and clinical conditions associated with GOLGA3.

Glycoprotein v (platelet) (GP5, Accession NP_004479.1) is another GAM1338 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:18832, to the nucleotide sequence of GAM1338 RNA, herein designated GAM RNA, also designated SEQ ID:360.

Another function of GAM1338 is therefore inhibition of Glycoprotein v (platelet) (GP5, Accession NP_004479.1). Accordingly, utilities of GAM1338 include diagnosis, prevention and treatment of diseases and clinical conditions associated with GP5.

GPP34R (Accession NP_060648.2) is another GAM1338 target gene, herein designated TARGET GENE. GPP34R BINDING SITE is a target binding site found in the 3' untranslated region of mRNA encoded by GPP34R, corresponding to a target binding site such as BINDING SITE I, BINDING SITE II or BINDING SITE III of FIG. 8. Table 4 illustrates the complementarity of the nucleotide sequences of GPP34R BINDING SITE, designated SEQ ID:16162, to the nucleotide sequence of GAM1338 RNA, herein designated GAM RNA, also designated SEQ ID:360.

Another function of GAM1338 is therefore inhibition of GPP34R (Accession NP_060648.2). Accordingly, utilities of GAM1338 include diagnosis, prevention and treatment of diseases and clinical conditions associated with GPP34R.

G protein-coupled receptor 114 (GPR114, Accession NP_722579.1) is another GAM1338 target gene, herein designated TARGET GENE. GPR114 BINDING SITE is a target binding site found in the 3' untranslated region of mRNA encoded by GPR114, corresponding to a target binding site such as BINDING SITE I, BINDING SITE II or BINDING SITE III of FIG. 8. Table 4 illustrates the complementarity of the nucleotide sequences of GPR114 BINDING SITE, designated SEQ ID:13684, to the nucleotide sequence of GAM1338 RNA, herein designated GAM RNA, also designated SEQ ID:360.

Another function of GAM1338 is therefore inhibition of G protein-coupled receptor 114 (GPR114, Accession NP_722579.1). Accordingly, utilities of GAM1338 include diagnosis, prevention and treatment of diseases and clinical conditions associated with GPR114.

G protein-coupled receptor 26 (GPR26, Accession NP_703143.1) is another GAM1338 target gene, herein designated TARGET GENE. GPR26 BINDING SITE is a target binding site found in the 3' untranslated region of mRNA encoded by GPR26, corresponding to a target binding site such as BINDING SITE I, BINDING SITE II or BINDING SITE III of FIG. 8. Table 4 illustrates the complementarity of the nucleotide sequences of GPR26 BINDING SITE, designated SEQ ID:9581, to the nucleotide sequence of GAM1338 RNA, herein designated GAM RNA, also designated SEQ ID:360.

Another function of GAM1338 is therefore inhibition of G protein-coupled receptor 26 (GPR26, Accession NP_703143.1). Accordingly, utilities of GAM1338 include diagnosis, prevention and treatment of diseases and clinical conditions associated with GPR26.

G protein-coupled receptor 4 (GPR4, Accession NP_005273.1) is another GAM1338 target gene, herein designated TARGET GENE. GPR4 BINDING SITE1 and GPR4 BINDING SITE2 are target binding sites found in untranslated regions of mRNA encoded by GPR4, corresponding to target binding sites such as BINDING SITE I, BINDING SITE II or BINDING SITE III of FIG. 8. Table 4 illustrates the complementarity of the nucleotide sequences of GPR4 BINDING SITE1 and GPR4 BINDING SITE2, designated SEQ ID:16936 and SEQ ID:15917 respectively, to the nucleotide sequence of GAM1338 RNA, herein designated GAM RNA, also designated SEQ ID:360.

Another function of GAM1338 is therefore inhibition of G protein-coupled receptor 4 (GPR4, Accession NP_005273.1), a gene which stimulates to produce increased calcium by both SPC and LPC . Accordingly, utilities of GAM1338 include diagnosis, prevention and treatment of diseases and clinical conditions associated with GPR4.

The function of GPR4 and its association with various diseases and clinical conditions, has been established by previous studies, as described hereinabove with reference to GAM189.1. G protein-coupled receptor 56 (GPR56, Accession NP_005673.2) is another GAM1338 target gene, herein designated TARGET GENE. GPR56 BINDING SITE is a target binding site found in the 5' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:6235, to the nucleotide sequence of GAM1338 RNA, herein designated GAM RNA, also designated SEQ ID:360.

Another function of GAM1338 is therefore inhibition of G protein-coupled receptor 56 (GPR56, Accession NP_005673.2), a gene which transduces extracellular signals through heterotrimeric G proteins. Accordingly, utilities of GAM1338 include diagnosis, prevention and treatment of diseases and clinical conditions associated with GPR56.

The function of GPR56 and its association with various diseases and clinical conditions, has been established by previous studies, as described hereinabove with reference to GAM63.1. G protein-coupled receptor 66 (GPR66, Accession NP_006047.2) is another GAM1338 target gene, herein designated TARGET GENE. GPR66 BINDING SITE is a target binding site found in the 3' untranslated region of mRNA encoded by GPR66, corresponding to a target binding site such as BINDING SITE I, BINDING SITE II or BINDING SITE III of FIG. 8. Table 4 illustrates the complementarity of the nucleotide sequences of GPR66 BINDING SITE, designated SEQ ID:4149, to the nucleotide sequence of GAM1338 RNA, herein designated GAM RNA, also designated SEQ ID:360.

Another function of GAM1338 is therefore inhibition of G protein-coupled receptor 66 (GPR66, Accession NP_006047.2). Accordingly, utilities of GAM1338 include diagnosis, prevention and treatment of diseases and clinical conditions associated with GPR66.

G protein-coupled receptor 81 (GPR81, Accession NP_115943.1) is another GAM1338 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:9012, to the nucleotide sequence of GAM1338 RNA, herein designated GAM RNA, also designated SEQ ID:360.

Another function of GAM1338 is therefore inhibition of G protein-coupled receptor 81 (GPR81, Accession NP_115943.1). Accordingly, utilities of GAM1338 include diagnosis, prevention and treatment of diseases and clinical conditions associated with GPR81.

GR6 (Accession NP_031380.1) is another GAM1338 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:11621, to the nucleotide sequence of GAM1338 RNA, herein designated GAM RNA, also designated SEQ ID:360.

Another function of GAM1338 is therefore inhibition of GR6 (Accession NP_031380.1). Accordingly, utilities of GAM1338 include diagnosis, prevention and treatment of diseases and clinical conditions associated with GR6.

GRAF (Accession NP_055886.1) is another GAM1338 target gene, herein designated TARGET GENE. GRAF BINDING SITE is a target binding site found in the 3' untranslated region of mRNA encoded by GRAF, corresponding to a target binding site such as BINDING SITE I, BINDING SITE II or BINDING SITE III of FIG. 8. Table 4 illustrates the complementarity of the nucleotide sequences of GRAF BINDING SITE, designated SEQ ID:18118, to the nucleotide sequence of GAM1338 RNA, herein designated GAM RNA, also designated SEQ ID:360.

Another function of GAM1338 is therefore inhibition of GRAF (Accession NP_055886.1), a gene which ia a GTPase activating protein for p21-rac and therefore may be associated with Juvenile myelomonocytic leukemia. Accordingly, utilities of GAM1338 include diagnosis, prevention and treatment of Juvenile myelomonocytic leukemia, and of other diseases and clinical conditions associated with GRAF.

The function of GRAF and its association with various diseases and clinical conditions, has been established by previous studies, as described hereinabove with reference to GAM189.1. GREB1 (Accession NP_055483.2) is another GAM1338 target gene, herein designated TARGET GENE. GREB1 BINDING SITE1 and GREB1 BINDING SITE2 are target binding sites found in untranslated regions of multiple transcripts of mRNA encoded by GREB1, corresponding to target binding sites such as BINDING SITE I, BINDING SITE II or BINDING SITE III of FIG. 8. Table 4 illustrates the complementarity of the nucleotide sequences of GREB1 BINDING SITE1 and GREB1 BINDING SITE2, designated SEQ ID:18182 and SEQ ID:2321 respectively, to the nucleotide sequence of GAM1338 RNA, herein designated GAM RNA, also designated SEQ ID:360.

Another function of GAM1338 is therefore inhibition of GREB1 (Accession NP_055483.2). Accordingly, utilities of GAM1338 include diagnosis, prevention and treatment of diseases and clinical conditions associated with GREB1.

Glutamate receptor, ionotropic, delta 1 (GRID1, Accession XP_043613.8) is another GAM1338 target gene, herein designated TARGET GENE. GRID1 BINDING SITE is a target binding site found in the 3' untranslated region of mRNA encoded by GRID1, corresponding to a target binding site such as BINDING SITE I, BINDING SITE II or BINDING SITE III of FIG. 8. Table 4 illustrates the complementarity of the nucleotide sequences of GRID1 BINDING SITE, designated SEQ ID:12320, to the nucleotide sequence of GAM1338 RNA, herein designated GAM RNA, also designated SEQ ID:360.

Another function of GAM1338 is therefore inhibition of Glutamate receptor, ionotropic, delta 1 (GRID1, Accession XP_043613.8). Accordingly, utilities of GAM1338 include diagnosis, prevention and treatment of diseases and clinical conditions associated with GRID1.

Glutamate receptor, ionotropic, n-methyl d-aspartate-like 1a (GRINL1A, Accession NP_056347.1) is another GAM1338 target gene, herein designated TARGET GENE. GRINL1A BINDING SITE is a target binding site found in the 3' untranslated region of mRNA encoded by GRINL1A, corresponding to a target binding site such as BINDING SITE I, BINDING SITE II or BINDING SITE III of FIG. 8. Table 4 illustrates the complementarity of the nucleotide sequences of GRINL1A BINDING SITE, designated SEQ ID:17379, to the nucleotide sequence of GAM1338 RNA, herein designated GAM RNA, also designated SEQ ID:360.

Another function of GAM1338 is therefore inhibition of Glutamate receptor, ionotropic, n-methyl d-aspartate-like 1a (GRINL1A, Accession NP_056347.1), a gene which plays a role in the development and function of the mammalian brain. Accordingly, utilities of GAM1338 include diagnosis, prevention and treatment of diseases and clinical conditions associated with GRINL1A.

The function of GRINL1A and its association with various diseases and clinical conditions, has been established by previous studies, as described hereinabove with reference to GAM189.1. Glutamate receptor, metabotropic 6 (GRM6, Accession NP_000834.1) is another GAM1338 target gene, herein designated TARGET GENE. GRM6 BINDING SITE is a target binding site found in the 3' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:5942, to the nucleotide sequence of GAM1338 RNA, herein designated GAM RNA, also designated SEQ ID:360.

Another function of GAM1338 is therefore inhibition of Glutamate receptor, metabotropic 6 (GRM6, Accession NP_000834.1). Accordingly, utilities of GAM1338 include diagnosis, prevention and treatment of diseases and clinical conditions associated with GRM6.

GRWD (Accession NP_113673.2) is another GAM1338 target gene, herein designated TARGET GENE. GRWD BINDING SITE is a target binding site found in the 3' untranslated region of mRNA encoded by GRWD, corresponding to a target binding site such as BINDING SITE I, BINDING SITE II or BINDING SITE III of FIG. 8. Table 4 illustrates the complementarity of the nucleotide sequences of GRWD BINDING SITE, designated SEQ ID:6811, to the nucleotide sequence of GAM1338 RNA, herein designated GAM RNA, also designated SEQ ID:360.

Another function of GAM1338 is therefore inhibition of GRWD (Accession NP_113673.2). Accordingly, utilities of GAM1338 include diagnosis, prevention and treatment of diseases and clinical conditions associated with GRWD.

GSDM (Accession XP_209009.1) is another GAM1338 target gene, herein designated TARGET GENE. GSDM BINDING SITE1 and GSDM BINDING SITE2 are target binding sites found in untranslated regions of multiple transcripts of mRNA encoded by GSDM, corresponding to target binding sites such as BINDING SITE I, BINDING SITE II or BINDING SITE III of FIG. 8. Table 4 illustrates the complementarity of the nucleotide sequences of GSDM BINDING SITE1 and GSDM BINDING SITE2, designated SEQ ID:13197 and SEQ ID:3037 respectively, to the nucleotide sequence of GAM1338 RNA, herein designated GAM RNA, also designated SEQ ID:360.

Another function of GAM1338 is therefore inhibition of GSDM (Accession XP_209009.1). Accordingly, utilities of GAM1338 include diagnosis, prevention and treatment of diseases and clinical conditions associated with GSDM.

GTF2IRD2 (Accession NP_775808.1) is another GAM1338 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:3107, to the nucleotide sequence of GAM1338 RNA, herein designated GAM RNA, also designated SEQ ID:360.

Another function of GAM1338 is therefore inhibition of GTF2IRD2 (Accession NP_775808.1). Accordingly, utilities of GAM1338 include diagnosis, prevention and treatment of diseases and clinical conditions associated with GTF2IRD2.

GTF2IRD2 (Accession NP_115579.3) is another GAM1338 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:3107, to the nucleotide sequence of GAM1338 RNA, herein designated GAM RNA, also designated SEQ ID:360.

Another function of GAM1338 is therefore inhibition of GTF2IRD2 (Accession NP_115579.3). Accordingly, utilities of GAM1338 include diagnosis, prevention and treatment of diseases and clinical conditions associated with GTF2IRD2.

GTPBG3 (Accession NP_116009.1) is another GAM1338 target gene, herein designated TARGET GENE. GTPBG3 BINDING SITE1 and GTPBG3 BINDING SITE2 are target binding sites found in untranslated regions of mRNA encoded by GTPBG3, corresponding to target binding sites such as BINDING SITE I, BINDING SITE II or BINDING SITE III of FIG. 8. Table 4 illustrates the complementarity of the nucleotide sequences of GTPBG3 BINDING SITE1 and GTPBG3 BINDING SITE2, designated SEQ ID:15596 and SEQ ID:7742 respectively, to the nucleotide sequence of GAM1338 RNA, herein designated GAM RNA, also designated SEQ ID:360.

Another function of GAM1338 is therefore inhibition of GTPBG3 (Accession NP_116009.1). Accordingly, utilities of GAM1338 include diagnosis, prevention and treatment of diseases and clinical conditions associated with GTPBG3.

Glycogenin (Gy, Accession NP_004121.2) is another GAM1338 target gene, herein designated TARGET GENE. GYG BINDING SITE is a target binding site found in the 3' untranslated region of mRNA encoded by Gy, corresponding to a target binding site such as BINDING SITE I, BINDING SITE II or BINDING SITE III of FIG. 8. Table 4 illustrates the complementarity of the nucleotide sequences of GYG BINDING SITE, designated SEQ ID:10290, to the nucleotide sequence of GAM1338 RNA, herein designated GAM RNA, also designated SEQ ID:360.

Another function of GAM1338 is therefore inhibition of Glycogenin (Gy, Accession NP_004121.2), a gene which primes de novo glycogen synthesis. Accordingly, utilities of GAM1338 include diagnosis, prevention and treatment of diseases and clinical conditions associated with GYG.

The function of GYG and its association with various diseases and clinical conditions, has been established by previous studies, as described hereinabove with reference to GAM189.1. H-plk (Accession NP_056936.1) is another GAM1338 target gene, herein designated TARGET GENE. H-plk BINDING SITE is a target binding site found in the 5' untranslated region of mRNA encoded by H-plk, corresponding to a target binding site such as BINDING SITE I, BINDING SITE II or BINDING SITE III of FIG. 8. Table 4 illustrates the complementarity of the nucleotide sequences of H-plk BINDING SITE, designated SEQ ID:8288, to the nucleotide sequence of GAM1338 RNA, herein designated GAM RNA, also designated SEQ ID:360.

Another function of GAM1338 is therefore inhibition of H-plk (Accession NP_056936.1). Accordingly, utilities of GAM1338 include diagnosis, prevention and treatment of diseases and clinical conditions associated with H-plk.

H63 (Accession NP_816929.1) is another GAM1338 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:2008, to the nucleotide sequence of GAM1338 RNA, herein designated GAM RNA, also designated SEQ ID:360.

Another function of GAM1338 is therefore inhibition of H63 (Accession NP_816929.1). Accordingly, utilities of GAM1338 include diagnosis, prevention and treatment of diseases and clinical conditions associated with H63.

H63 (Accession NP_612432.2) is another GAM1338 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:2008, to the nucleotide sequence of GAM1338 RNA, herein designated GAM RNA, also designated SEQ ID:360.

Another function of GAM1338 is therefore inhibition of H63 (Accession NP_612432.2). Accordingly, utilities of GAM1338 include diagnosis, prevention and treatment of diseases and clinical conditions associated with H63.

Hepatitis a virus cellular receptor 2 (HAVCR2, Accession NP_116171.2) is another GAM1338 target gene, herein designated TARGET GENE. HAVCR2 BINDING SITE is a target binding site found in the 3' untranslated region of mRNA encoded by HAVCR2, corresponding to a target binding site such as BINDING SITE I, BINDING SITE II or BINDING SITE III of FIG. 8. Table 4 illustrates the complementarity of the nucleotide sequences of HAVCR2 BINDING SITE, designated SEQ ID:16518, to the nucleotide sequence of GAM1338 RNA, herein designated GAM RNA, also designated SEQ ID:360.

Another function of GAM1338 is therefore inhibition of Hepatitis a virus cellular receptor 2 (HAVCR2, Accession NP_116171.2). Accordingly, utilities of GAM1338 include diagnosis, prevention and treatment of diseases and clinical conditions associated with HAVCR2.

HE9 (Accession NP_741997.1) is another GAM1338 target gene, herein designated TARGET GENE. HE9 BINDING SITE is a target binding site found in the 3' untranslated region of mRNA encoded by HE9, corresponding to a target binding site such as BINDING SITE I, BINDING SITE II or BINDING SITE III of FIG. 8. Table 4 illustrates the complementarity of the nucleotide sequences of HE9 BINDING SITE, designated SEQ ID:13755, to the nucleotide sequence of GAM1338 RNA, herein designated GAM RNA, also designated SEQ ID:360.

Another function of GAM1338 is therefore inhibition of HE9 (Accession NP_741997.1). Accordingly, utilities of GAM1338 include diagnosis, prevention and treatment of diseases and clinical conditions associated with HE9.

HECA (Accession NP_057301.1) is another GAM1338 target gene, herein designated TARGET GENE. HECA BINDING SITE is a target binding site found in the 3' untranslated region of mRNA encoded by HECA, corresponding to a target binding site such as BINDING SITE I, BINDING SITE II or BINDING SITE III of FIG. 8. Table 4 illustrates the complementarity of the nucleotide sequences of HECA BINDING SITE, designated SEQ ID:6145, to the nucleotide sequence of GAM1338 RNA, herein designated GAM RNA, also designated SEQ ID:360.

Another function of GAM1338 is therefore inhibition of HECA (Accession NP_057301.1). Accordingly, utilities of GAM1338 include diagnosis, prevention and treatment of diseases and clinical conditions associated with HECA.

HEMK (Accession NP_057257.1) is another GAM1338 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:12517, to the nucleotide sequence of GAM1338 RNA, herein designated GAM RNA, also designated SEQ ID:360.

Another function of GAM1338 is therefore inhibition of HEMK (Accession NP_057257.1). Accordingly, utilities of GAM1338 include diagnosis, prevention and treatment of diseases and clinical conditions associated with HEMK.

Hephaestin (HEPH, Accession NP_055614.1) is another GAM1338 target gene, herein designated TARGET GENE. HEPH BINDING SITE is a target binding site found in the 5' untranslated region of multiple transcripts of mRNA encoded by HEPH, corresponding to a target binding site such as BINDING SITE I, BINDING SITE II or BINDING SITE III of FIG. 8. Table 4 illustrates the complementarity of the nucleotide sequences of HEPH BINDING SITE, designated SEQ ID:4303, to the nucleotide sequence of GAM1338 RNA, herein designated GAM RNA, also designated SEQ ID:360.

Another function of GAM1338 is therefore inhibition of Hephaestin (HEPH, Accession NP_055614.1), a gene which is thought to be a membrane-bound protein responsible for transport of dietary iron from epithelial cells of the intestinal lumen into the circulatory system. Accordingly, utilities of GAM1338 include diagnosis, prevention and treatment of diseases and clinical conditions associated with HEPH.

The function of HEPH and its association with various diseases and clinical conditions, has been established by previous studies, as described hereinabove with reference to GAM189.1. Holocarboxylase synthetase (biotin-[proprionyl-coenzyme a-carboxylase (atp-hydrolysing)] ligase) (HLCS, Accession NP_000402.2) is another GAM1338 target gene, herein designated TARGET GENE. HLCS BINDING SITE is a target binding site found in the 5' untranslated region of mRNA encoded by HLCS, corresponding to a target binding site such as BINDING SITE I, BINDING SITE II or BINDING SITE III of FIG. 8. Table 4 illustrates the complementarity of the nucleotide sequences of HLCS BINDING SITE, designated SEQ ID:10628, to the nucleotide sequence of GAM1338 RNA, herein designated GAM RNA, also designated SEQ ID:360.

Another function of GAM1338 is therefore inhibition of Holocarboxylase synthetase (biotin-[proprionyl-coenzyme a-carboxylase (atp-hydrolysing)] ligase) (HLCS, Accession NP_000402.2). Accordingly, utilities of GAM1338 include diagnosis, prevention and treatment of diseases and clinical conditions associated with HLCS.

High-mobility group 20a (HMG20A, Accession NP_060670.1) is another GAM1338 target gene, herein designated TARGET GENE. HMG20A BINDING SITE is a target binding site found in the 3' untranslated region of mRNA encoded by HMG20A, corresponding to a target binding site such as BINDING SITE I, BINDING SITE II or BINDING SITE III of FIG. 8. Table 4 illustrates the complementarity of the nucleotide sequences of HMG20A BINDING SITE, designated SEQ ID:19141, to the nucleotide sequence of GAM1338 RNA, herein designated GAM RNA, also designated SEQ ID:360.

Another function of GAM1338 is therefore inhibition of High-mobility group 20a (HMG20A, Accession NP_060670.1). Accordingly, utilities of GAM1338 include diagnosis, prevention and treatment of diseases and clinical conditions associated with HMG20A.

HPRN (Accession NP_071938.1) is another GAM1338 target gene, herein designated TARGET GENE. HPRN BINDING SITE is a target binding site found in the 3' untranslated region of mRNA encoded by HPRN, corresponding to a target binding site such as BINDING SITE I, BINDING SITE II or BINDING SITE III of FIG. 8. Table 4 illustrates the complementarity of the nucleotide sequences of HPRN BINDING SITE, designated SEQ ID:11574, to the nucleotide sequence of GAM1338 RNA, herein designated GAM RNA, also designated SEQ ID:360.

Another function of GAM1338 is therefore inhibition of HPRN (Accession NP_071938.1). Accordingly, utilities of GAM1338 include diagnosis, prevention and treatment of diseases and clinical conditions associated with HPRN.

Histamine receptor h4 (HRH4, Accession NP_067637.2) is another GAM1338 target gene, herein designated TARGET GENE. HRH4 BINDING SITE1 through HRH4 BINDING SITE3 are target binding sites found in untranslated regions of mRNA encoded by HRH4, corresponding to target binding sites such as BINDING SITE I, BINDING SITE II or BINDING SITE III of FIG. 8. Table 4 illustrates the complementarity of the nucleotide sequences of HRH4 BINDING SITE1 through HRH4 BINDING SITE3, designated SEQ ID:12079, SEQ ID:14595 and SEQ ID:5920 respectively, to the nucleotide sequence of GAM1338 RNA, herein designated GAM RNA, also designated SEQ ID:360.

Another function of GAM1338 is therefore inhibition of Histamine receptor h4 (HRH4, Accession NP_067637.2). Accordingly, utilities of GAM1338 include diagnosis, prevention and treatment of diseases and clinical conditions associated with HRH4.

HSD3B7 (Accession NP_079469.2) is another GAM1338 target gene, herein designated TARGET GENE. HSD3B7 BINDING SITE is a target binding site found in the 3' untranslated region of mRNA encoded by HSD3B7, corresponding to a target binding site such as BINDING SITE I, BINDING SITE II or BINDING SITE III of FIG. 8. Table 4 illustrates the complementarity of the nucleotide sequences of HSD3B7 BINDING SITE, designated SEQ ID:16293, to the nucleotide sequence of GAM1338 RNA, herein designated GAM RNA, also designated SEQ ID:360.

Another function of GAM1338 is therefore inhibition of HSD3B7 (Accession NP_079469.2). Accordingly, utilities of GAM1338 include diagnosis, prevention and treatment of diseases and clinical conditions associated with HSD3B7.

HSMPP8 (Accession XP_167894.1) is another GAM1338 target gene, herein designated TARGET GENE. HSMPP8 BINDING SITE is a target binding site found in the 3' untranslated region of mRNA encoded by HSMPP8, corresponding to a target binding site such as BINDING SITE I, BINDING SITE II or BINDING SITE III of FIG. 8. Table 4 illustrates the complementarity of the nucleotide sequences of HSMPP8 BINDING SITE, designated SEQ ID:19749, to the nucleotide sequence of GAM1338 RNA, herein designated GAM RNA, also designated SEQ ID:360.

Another function of GAM1338 is therefore inhibition of HSMPP8 (Accession XP_167894.1). Accordingly, utilities of GAM1338 include diagnosis, prevention and treatment of diseases and clinical conditions associated with HSMPP8.

HSPC065 (Accession NP_054876.2) is another GAM1338 target gene, herein designated TARGET GENE. HSPC065 BINDING SITE1 and HSPC065 BINDING SITE2 are target binding sites found in untranslated regions of mRNA encoded by HSPC065, corresponding to target binding sites such as BINDING SITE I, BINDING SITE II or BINDING SITE III of FIG. 8. Table 4 illustrates the complementarity of the nucleotide sequences of HSPC065 BINDING SITE1 and HSPC065 BINDING SITE2, designated SEQ ID:7511 and SEQ ID:10877 respectively, to the nucleotide sequence of GAM1338 RNA, herein designated GAM RNA, also designated SEQ ID:360.

Another function of GAM1338 is therefore inhibition of HSPC065 (Accession NP_054876.2). Accordingly, utilities of GAM1338 include diagnosis, prevention and treatment of diseases and clinical conditions associated with HSPC065.

5-hydroxytryptamine (serotonin) receptor 1d (HTR1D, Accession NP_000855.1) is another GAM1338 target gene, herein designated TARGET GENE. HTR1D BINDING SITE is a target binding site found in the 3' untranslated region of mRNA encoded by HTR1D, corresponding to a target binding site such as BINDING SITE I, BINDING SITE II or BINDING SITE III of FIG. 8. Table 4 illustrates the complementarity of the nucleotide sequences of HTR1D BINDING SITE, designated SEQ ID:14604, to the nucleotide sequence of GAM1338 RNA, herein designated GAM RNA, also designated SEQ ID:360.

Another function of GAM1338 is therefore inhibition of 5-hydroxytryptamine (serotonin) receptor 1d (HTR1D, Accession NP_000855.1), a gene which belongs to g-protein coupled receptor. Accordingly, utilities of GAM1338 include diagnosis, prevention and treatment of diseases and clinical conditions associated with HTR1D.

The function of HTR1D and its association with various diseases and clinical conditions, has been established by previous studies, as described hereinabove with reference to GAM189.1. 5-hydroxytryptamine (serotonin) receptor 1e (HTR1E, Accession NP_000856.1) is another GAM1338 target gene, herein designated TARGET GENE. HTR1E BINDING SITE is a target binding site found in the 5' untranslated region of mRNA encoded by HTR1E, corresponding to a target binding site such as BINDING SITE I, BINDING SITE II or BINDING SITE III of FIG. 8. Table 4 illustrates the complementarity of the nucleotide sequences of HTR1E BINDING SITE, designated SEQ ID:9063, to the nucleotide sequence of GAM1338 RNA, herein designated GAM RNA, also designated SEQ ID:360.

Another function of GAM1338 is therefore inhibition of 5-hydroxytryptamine (serotonin) receptor 1e (HTR1E, Accession NP_000856.1), a gene which belongs to g-protein coupled receptors. Accordingly, utilities of GAM1338 include diagnosis, prevention and treatment of diseases and clinical conditions associated with HTR1E.

The function of HTR1E and its association with various diseases and clinical conditions, has been established by previous studies, as described hereinabove with reference to GAM161.1. Hormonally upregulated neu-associated kinase (HUNK, Accession NP_055401.1) is another GAM1338 target gene, herein designated TARGET GENE. HUNK BINDING SITE is a target binding site found in the 3' untranslated region of mRNA encoded by HUNK, corresponding to a target binding site such as BINDING SITE I, BINDING SITE II or BINDING SITE III of FIG. 8. Table 4 illustrates the complementarity of the nucleotide sequences of HUNK BINDING SITE, designated SEQ ID:1413, to the nucleotide sequence of GAM1338 RNA, herein designated GAM RNA, also designated SEQ ID:360.

Another function of GAM1338 is therefore inhibition of Hormonally upregulated neu-associated kinase (HUNK, Accession NP_055401.1). Accordingly, utilities of GAM1338 include diagnosis, prevention and treatment of diseases and clinical conditions associated with HUNK.

Hus1 checkpoint homolog (s. pombe) (HUS1, Accession NP_004498.1) is another GAM1338 target gene, herein designated TARGET GENE. HUS1 BINDING SITE is a target binding site found in the 3' untranslated region of mRNA encoded by HUS1, corresponding to a target binding site such as BINDING SITE I, BINDING SITE II or BINDING SITE III of FIG. 8. Table 4 illustrates the complementarity of the nucleotide sequences of HUS1 BINDING SITE, designated SEQ ID:11161, to the nucleotide sequence of GAM1338 RNA, herein designated GAM RNA, also designated SEQ ID:360.

Another function of GAM1338 is therefore inhibition of Hus1 checkpoint homolog (s. pombe) (HUS1, Accession NP_004498.1), a gene which May form DNA damage-responsive protein complex. Accordingly, utilities of GAM1338 include diagnosis, prevention and treatment of diseases and clinical conditions associated with HUS1.

The function of HUS1 and its association with various diseases and clinical conditions, has been established by previous studies, as described hereinabove with reference to GAM189.1. Hyaluronoglucosaminidase 4 (HYAL4, Accession NP_036401.1) is another GAM1338 target gene, herein designated TARGET GENE. HYAL4 BINDING SITE is a target binding site found in the 5' untranslated region of mRNA encoded by HYAL4, corresponding to a target binding site such as BINDING SITE I, BINDING SITE II or BINDING SITE III of FIG. 8. Table 4 illustrates the complementarity of the nucleotide sequences of HYAL4 BINDING SITE, designated SEQ ID:19431, to the nucleotide sequence of GAM1338 RNA, herein designated GAM RNA, also designated SEQ ID:360.

Another function of GAM1338 is therefore inhibition of Hyaluronoglucosaminidase 4 (HYAL4, Accession NP_036401.1). Accordingly, utilities of GAM1338 include diagnosis, prevention and treatment of diseases and clinical conditions associated with HYAL4.

Intercellular adhesion molecule 1 (cd54), human rhinovirus receptor (ICAM1, Accession NP_000192.1) is another GAM1338 target gene, herein designated TARGET GENE. ICAM1 BINDING SITE is a target binding site found in the 3' untranslated region of mRNA encoded by ICAM1, corresponding to a target binding site such as BINDING SITE I, BINDING SITE II or BINDING SITE III of FIG. 8. Table 4 illustrates the complementarity of the nucleotide sequences of ICAM1 BINDING SITE, designated SEQ ID:18182, to the nucleotide sequence of GAM1338 RNA, herein designated GAM RNA, also designated SEQ ID:360.

Another function of GAM1338 is therefore inhibition of Intercellular adhesion molecule 1 (cd54), human rhinovirus receptor (ICAM1, Accession NP_000192.1), a gene which binds the integrin LFA-1 (ITGB2) and promotes adhesion; member of the immunoglobulin superfamily and therefore may be associated with Malaria, cerebral, susceptibility to. Accordingly, utilities of GAM1338 include diagnosis, prevention and treatment of Malaria, cerebral, susceptibility to, and of other diseases and clinical conditions associated with ICAM1.

The function of ICAM1 and its association with various diseases and clinical conditions, has been established by previous studies, as described hereinabove with reference to GAM189.1. ICK (Accession NP_055735.1) is another GAM1338 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:3106, to the nucleotide sequence of GAM1338 RNA, herein designated GAM RNA, also designated SEQ ID:360.

Another function of GAM1338 is therefore inhibition of ICK (Accession NP_055735.1). Accordingly, utilities of GAM1338 include diagnosis, prevention and treatment of diseases and clinical conditions associated with ICK.

ICK (Accession NP_057597.2) is another GAM1338 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:3106, to the nucleotide sequence of GAM1338 RNA, herein designated GAM RNA, also designated SEQ ID:360.

Another function of GAM1338 is therefore inhibition of ICK (Accession NP_057597.2). Accordingly, utilities of GAM1338 include diagnosis, prevention and treatment of diseases and clinical conditions associated with ICK.

Insulin-like growth factor 1 (somatomedin c) (IGF1, Accession NP_000609.1) is another GAM1338 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:8230, to the nucleotide sequence of GAM1338 RNA, herein designated GAM RNA, also designated SEQ ID:360.

Another function of GAM1338 is therefore inhibition of Insulin-like growth factor 1 (somatomedin c) (IGF1, Accession NP_000609.1), a gene which are structurally and functionally related to insulin but have a much higher growth-promoting activity and therefore may be associated with Growth retardation with sensorineural deafness and mental retardation. Accordingly, utilities of GAM1338 include diagnosis, prevention and treatment of Growth retardation with sensorineural deafness and mental retardation, and of other diseases and clinical conditions associated with IGF1.

The function of IGF1 and its association with various diseases and clinical conditions, has been established by previous studies, as described hereinabove with reference to GAM66.2. Interleukin 11 (IL11, Accession NP_000632.1) is another GAM1338 target gene, herein designated TARGET GENE. IL11 BINDING SITE is a target binding site found in the 3' untranslated region of mRNA encoded by IL11, corresponding to a target binding site such as BINDING SITE I, BINDING SITE II or BINDING SITE III of FIG. 8. Table 4 illustrates the complementarity of the nucleotide sequences of IL11 BINDING SITE, designated SEQ ID:17785, to the nucleotide sequence of GAM1338 RNA, herein designated GAM RNA, also designated SEQ ID:360.

Another function of GAM1338 is therefore inhibition of Interleukin 11 (IL11, Accession NP_000632.1), a gene which stimulates the proliferation of hematopoietic stem cells and megakaryocyte progenitor cells and induces megakaryocyte maturation. Accordingly, utilities of GAM1338 include diagnosis, prevention and treatment of diseases and clinical conditions associated with IL11.

The function of IL11 and its association with various diseases and clinical conditions, has been established by previous studies, as described hereinabove with reference to GAM41.1. Interleukin 16 (lymphocyte chemoattractant factor) (IL16, Accession NP_757366.1) is another GAM1338 target gene, herein designated TARGET GENE. IL16 BINDING SITE is a target binding site found in the 5' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:11272, to the nucleotide sequence of GAM1338 RNA, herein designated GAM RNA, also designated SEQ ID:360.

Another function of GAM1338 is therefore inhibition of Interleukin 16 (lymphocyte chemoattractant factor) (IL16, Accession NP_757366.1), a gene which modulates T-cell activation. Accordingly, utilities of GAM1338 include diagnosis, prevention and treatment of diseases and clinical conditions associated with IL16.

The function of IL16 and its association with various diseases and clinical conditions, has been established by previous studies, as described hereinabove with reference to GAM66.1. Interleukin 21 receptor (IL21R, Accession NP_851564.1) is another GAM1338 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:2012, to the nucleotide sequence of GAM1338 RNA, herein designated GAM RNA, also designated SEQ ID:360.

Another function of GAM1338 is therefore inhibition of Interleukin 21 receptor (IL21R, Accession NP_851564.1), a gene which is involved in receptor mediated endocytosis and transduces the mitogenic signals of il- 2. Accordingly, utilities of GAM1338 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 21 receptor (IL21R, Accession NP_068570.1) is another GAM1338 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:2012, to the nucleotide sequence of GAM1338 RNA, herein designated GAM RNA, also designated SEQ ID:360.

Another function of GAM1338 is therefore inhibition of Interleukin 21 receptor (IL21R, Accession NP_068570.1), a gene which is involved in receptor mediated endocytosis and transduces the mitogenic signals of il- 2. Accordingly, utilities of GAM1338 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 21 receptor (IL21R, Accession NP_851565.1) is another GAM1338 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:2012, to the nucleotide sequence of GAM1338 RNA, herein designated GAM RNA, also designated SEQ ID:360.

Another function of GAM1338 is therefore inhibition of Interleukin 21 receptor (IL21R, Accession NP_851565.1), a gene which is involved in receptor mediated endocytosis and transduces the mitogenic signals of il- 2. Accordingly, utilities of GAM1338 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 28 receptor, alpha (IL28RA, Accession NP_775088.1) is another GAM1338 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:17486, to the nucleotide sequence of GAM1338 RNA, herein designated GAM RNA, also designated SEQ ID:360.

Another function of GAM1338 is therefore inhibition of Interleukin 28 receptor, alpha (IL28RA, Accession NP_775088.1). Accordingly, utilities of GAM1338 include diagnosis, prevention and treatment of diseases and clinical conditions associated with IL28RA.

Interleukin 28 receptor, alpha (IL28RA, Accession NP_734464.1) is another GAM1338 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:17486, to the nucleotide sequence of GAM1338 RNA, herein designated GAM RNA, also designated SEQ ID:360.

Another function of GAM1338 is therefore inhibition of Interleukin 28 receptor, alpha (IL28RA, Accession NP_734464.1). Accordingly, utilities of GAM1338 include diagnosis, prevention and treatment of diseases and clinical conditions associated with IL28RA.

Interleukin 28 receptor, alpha (IL28RA, Accession NP_775087.1) is another GAM1338 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:17486, to the nucleotide sequence of GAM1338 RNA, herein designated GAM RNA, also designated SEQ ID:360.

Another function of GAM1338 is therefore inhibition of Interleukin 28 receptor, alpha (IL28RA, Accession NP_775087.1). Accordingly, utilities of GAM1338 include diagnosis, prevention and treatment of diseases and clinical conditions associated with IL28RA.

IMPACT (Accession NP_060909.1) is another GAM1338 target gene, herein designated TARGET GENE. IMPACT BINDING SITE is a target binding site found in the 3' untranslated region of mRNA encoded by IMPACT, corresponding to a target binding site such as BINDING SITE I, BINDING SITE II or BINDING SITE III of FIG. 8. Table 4 illustrates the complementarity of the nucleotide sequences of IMPACT BINDING SITE, designated SEQ ID:19846, to the nucleotide sequence of GAM1338 RNA, herein designated GAM RNA, also designated SEQ ID:360.

Another function of GAM1338 is therefore inhibition of IMPACT (Accession NP_060909.1). Accordingly, utilities of GAM1338 include diagnosis, prevention and treatment of diseases and clinical conditions associated with IMPACT.

Imp (inosine monophosphate) dehydrogenase 1 (IMPDH1, Accession NP_000874.1) is another GAM1338 target gene, herein designated TARGET GENE. IMPDH1 BINDING SITE is a target binding site found in the 5' untranslated region of mRNA encoded by IMPDH1, corresponding to a target binding site such as BINDING SITE I, BINDING SITE II or BINDING SITE III of FIG. 8. Table 4 illustrates the complementarity of the nucleotide sequences of IMPDH1 BINDING SITE, designated SEQ ID:15608, to the nucleotide sequence of GAM1338 RNA, herein designated GAM RNA, also designated SEQ ID:360.

Another function of GAM1338 is therefore inhibition of Imp (inosine monophosphate) dehydrogenase 1 (IMPDH1, Accession NP_000874.1). Accordingly, utilities of GAM1338 include diagnosis, prevention and treatment of diseases and clinical conditions associated with IMPDH1.

INHBE (Accession NP_113667.1) is another GAM1338 target gene, herein designated TARGET GENE. INHBE BINDING SITE is a target binding site found in the 3' untranslated region of mRNA encoded by INHBE, corresponding to a target binding site such as BINDING SITE I, BINDING SITE II or BINDING SITE III of FIG. 8. Table 4 illustrates the complementarity of the nucleotide sequences of INHBE BINDING SITE, designated SEQ ID:9633, to the nucleotide sequence of GAM1338 RNA, herein designated GAM RNA, also designated SEQ ID:360.

Another function of GAM1338 is therefore inhibition of INHBE (Accession NP_113667.1). Accordingly, utilities of GAM1338 include diagnosis, prevention and treatment of diseases and clinical conditions associated with INHBE.

Indolethylamine n-methyltransferase (INMT, Accession NP_006765.3) is another GAM1338 target gene, herein designated TARGET GENE. INMT BINDING SITE is a target binding site found in the 3' untranslated region of mRNA encoded by INMT, corresponding to a target binding site such as BINDING SITE I, BINDING SITE II or BINDING SITE III of FIG. 8. Table 4 illustrates the complementarity of the nucleotide sequences of INMT BINDING SITE, designated SEQ ID:3109, to the nucleotide sequence of GAM1338 RNA, herein designated GAM RNA, also designated SEQ ID:360.

Another function of GAM1338 is therefore inhibition of Indolethylamine n-methyltransferase (INMT, Accession NP_006765.3). Accordingly, utilities of GAM1338 include diagnosis, prevention and treatment of diseases and clinical conditions associated with INMT.

Interferon regulatory factor 4 (IRF4, Accession NP_002451.1) is another GAM1338 target gene, herein designated TARGET GENE. IRF4 BINDING SITE is a target binding site found in the 3' untranslated region of mRNA encoded by IRF4, corresponding to a target binding site such as BINDING SITE I, BINDING SITE II or BINDING SITE III of FIG. 8. Table 4 illustrates the complementarity of the nucleotide sequences of IRF4 BINDING SITE, designated SEQ ID:16311, to the nucleotide sequence of GAM1338 RNA, herein designated GAM RNA, also designated SEQ ID:360.

Another function of GAM1338 is therefore inhibition of Interferon regulatory factor 4 (IRF4, Accession NP_002451.1). Accordingly, utilities of GAM1338 include diagnosis, prevention and treatment of diseases and clinical conditions associated with IRF4.

IRTA1 (Accession NP_112572.1) is another GAM1338 target gene, herein designated TARGET GENE. IRTA1 BINDING SITE is a target binding site found in the 3' untranslated region of mRNA encoded by IRTA1, corresponding to a target binding site such as BINDING SITE I, BINDING SITE II or BINDING SITE III of FIG. 8. Table 4 illustrates the complementarity of the nucleotide sequences of IRTA1 BINDING SITE, designated SEQ ID:18021, to the nucleotide sequence of GAM1338 RNA, herein designated GAM RNA, also designated SEQ ID:360.

Another function of GAM1338 is therefore inhibition of IRTA1 (Accession NP_112572.1). Accordingly, utilities of GAM1338 include diagnosis, prevention and treatment of diseases and clinical conditions associated with IRTA1.

Iroquois homeobox protein 5 (IRX5, Accession NP_005844.1) is another GAM1338 target gene, herein designated TARGET GENE. IRX5 BINDING SITE is a target binding site found in the 5' untranslated region of mRNA encoded by IRX5, corresponding to a target binding site such as BINDING SITE I, BINDING SITE II or BINDING SITE III of FIG. 8. Table 4 illustrates the complementarity of the nucleotide sequences of IRX5 BINDING SITE, designated SEQ ID:5486, to the nucleotide sequence of GAM1338 RNA, herein designated GAM RNA, also designated SEQ ID:360.

Another function of GAM1338 is therefore inhibition of Iroquois homeobox protein 5 (IRX5, Accession NP_005844.1). Accordingly, utilities of GAM1338 include diagnosis, prevention and treatment of diseases and clinical conditions associated with IRX5.

Inositol 1,4,5-triphosphate receptor, type 2 (ITPR2, Accession NP_002214.1) is another GAM1338 target gene, herein designated TARGET GENE. ITPR2 BINDING SITE is a target binding site found in the 3' untranslated region of mRNA encoded by ITPR2, corresponding to a target binding site such as BINDING SITE I, BINDING SITE II or BINDING SITE III of FIG. 8. Table 4 illustrates the complementarity of the nucleotide sequences of ITPR2 BINDING SITE, designated SEQ ID:2513, to the nucleotide sequence of GAM1338 RNA, herein designated GAM RNA, also designated SEQ ID:360.

Another function of GAM1338 is therefore inhibition of Inositol 1,4,5-triphosphate receptor, type 2 (ITPR2, Accession NP_002214.1). Accordingly, utilities of GAM1338 include diagnosis, prevention and treatment of diseases and clinical conditions associated with ITPR2.

Janus kinase 3 (a protein tyrosine kinase, leukocyte) (JAK3, Accession NP_000206.1) is another GAM1338 target gene, herein designated TARGET GENE. JAK3 BINDING SITE is a target binding site found in the 3' untranslated region of mRNA encoded by JAK3, corresponding to a target binding site such as BINDING SITE I, BINDING SITE II or BINDING SITE III of FIG. 8. Table 4 illustrates the complementarity of the nucleotide sequences of JAK3 BINDING SITE, designated SEQ ID:6262, to the nucleotide sequence of GAM1338 RNA, herein designated GAM RNA, also designated SEQ ID:360.

Another function of GAM1338 is therefore inhibition of Janus kinase 3 (a protein tyrosine kinase, leukocyte) (JAK3, Accession NP_000206.1). Accordingly, utilities of GAM1338 include diagnosis, prevention and treatment of diseases and clinical conditions associated with JAK3.

JM11 (Accession NP_296375.1) is another GAM1338 target gene, herein designated TARGET GENE. JM11 BINDING SITE is a target binding site found in the 3' untranslated region of mRNA encoded by JM11, corresponding to a target binding site such as BINDING SITE I, BINDING SITE II or BINDING SITE III of FIG. 8. Table 4 illustrates the complementarity of the nucleotide sequences of JM11 BINDING SITE, designated SEQ ID:15361, to the nucleotide sequence of GAM1338 RNA, herein designated GAM RNA, also designated SEQ ID:360.

Another function of GAM1338 is therefore inhibition of JM11 (Accession NP_296375.1). Accordingly, utilities of GAM1338 include diagnosis, prevention and treatment of diseases and clinical conditions associated with JM11.

Jerky homolog (mouse) (JRK, Accession NP_003715.1) is another GAM1338 target gene, herein designated TARGET GENE. JRK BINDING SITE is a target binding site found in the 3' untranslated region of mRNA encoded by JRK, corresponding to a target binding site such as BINDING SITE I, BINDING SITE II or BINDING SITE III of FIG. 8. Table 4 illustrates the complementarity of the nucleotide sequences of JRK BINDING SITE, designated SEQ ID:1529, to the nucleotide sequence of GAM1338 RNA, herein designated GAM RNA, also designated SEQ ID:360.

Another function of GAM1338 is therefore inhibition of Jerky homolog (mouse) (JRK, Accession NP_003715.1), a gene which might function as a DNA- binding protein. and therefore may be associated with Absence epilepsy. Accordingly, utilities of GAM1338 include diagnosis, prevention and treatment of Absence epilepsy, and of other diseases and clinical conditions associated with JRK.

The function of JRK and its association with various diseases and clinical conditions, has been established by previous studies, as described hereinabove with reference to GAM65.2. Potassium voltage-gated channel, isk-related family, member 3 (KCNE3, Accession NP_005463.1) is another GAM1338 target gene, herein designated TARGET GENE. KCNE3 BINDING SITE is a target binding site found in the 3' untranslated region of mRNA encoded by KCNE3, corresponding to a target binding site such as BINDING SITE I, BINDING SITE II or BINDING SITE III of FIG. 8. Table 4 illustrates the complementarity of the nucleotide sequences of KCNE3 BINDING SITE, designated SEQ ID:6918, to the nucleotide sequence of GAM1338 RNA, herein designated GAM RNA, also designated SEQ ID:360.

Another function of GAM1338 is therefore inhibition of Potassium voltage-gated channel, isk-related family, member 3 (KCNE3, Accession NP_005463.1), a gene which ancillary protein that co-assemble with a potassium channel alpha-subunit to modulate the gating kinetics and enhance stability of the multimeric complex (by similarity). and therefore may be associated with Hypokalemic periodic paralysis. Accordingly, utilities of GAM1338 include diagnosis, prevention and treatment of Hypokalemic periodic paralysis, and of other diseases and clinical conditions associated with KCNE3.

The function of KCNE3 and its association with various diseases and clinical conditions, has been established by previous studies, as described hereinabove with reference to GAM234.1. Potassium inwardly-rectifying channel, subfamily j, member 11 (KCNJ11, Accession NP_000516.2) is another GAM1338 target gene, herein designated TARGET GENE. KCNJ11 BINDING SITE is a target binding site found in the 5' untranslated region of mRNA encoded by KCNJ11, corresponding to a target binding site such as BINDING SITE I, BINDING SITE II or BINDING SITE III of FIG. 8. Table 4 illustrates the complementarity of the nucleotide sequences of KCNJ11 BINDING SITE, designated SEQ ID:9100, to the nucleotide sequence of GAM1338 RNA, herein designated GAM RNA, also designated SEQ ID:360.

Another function of GAM1338 is therefore inhibition of Potassium inwardly-rectifying channel, subfamily j, member 11 (KCNJ11, Accession NP_000516.2), a gene which is controlled by g proteins. inward rectifier k+ channels are characterized by a greater tendency to allow potassium to flow into the cell rather than out of it. and therefore is associated with Persistent hyperinsulinemic hypoglycemia of infancy. Accordingly, utilities of GAM1338 include diagnosis, prevention and treatment of Persistent hyperinsulinemic hypoglycemia of infancy, and of other diseases and clinical conditions associated with KCNJ11.

The function of KCNJ11 and its association with various diseases and clinical conditions, has been established by previous studies, as described hereinabove with reference to GAM189.1. Potassium inwardly-rectifying channel, subfamily j, member 16 (KCNJ16, Accession NP_061128.1) is another GAM1338 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:10579, to the nucleotide sequence of GAM1338 RNA, herein designated GAM RNA, also designated SEQ ID:360.

Another function of GAM1338 is therefore inhibition of Potassium inwardly-rectifying channel, subfamily j, member 16 (KCNJ16, Accession NP_061128.1). Accordingly, utilities of GAM1338 include diagnosis, prevention and treatment of diseases and clinical conditions associated with KCNJ16.

Potassium inwardly-rectifying channel, subfamily j, member 16 (KCNJ16, Accession NP_733938.1) is another GAM1338 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:10579, to the nucleotide sequence of GAM1338 RNA, herein designated GAM RNA, also designated SEQ ID:360.

Another function of GAM1338 is therefore inhibition of Potassium inwardly-rectifying channel, subfamily j, member 16 (KCNJ16, Accession NP_733938.1). Accordingly, utilities of GAM1338 include diagnosis, prevention and treatment of diseases and clinical conditions associated with KCNJ16.

Potassium inwardly-rectifying channel, subfamily j, member 16 (KCNJ16, Accession NP_733937.1) is another GAM1338 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:10579, to the nucleotide sequence of GAM1338 RNA, herein designated GAM RNA, also designated SEQ ID:360.

Another function of GAM1338 is therefore inhibition of Potassium inwardly-rectifying channel, subfamily j, member 16 (KCNJ16, Accession NP_733937.1). Accordingly, utilities of GAM1338 include diagnosis, prevention and treatment of diseases and clinical conditions associated with KCNJ16.

KENAE (Accession NP_789786.1) is another GAM1338 target gene, herein designated TARGET GENE. KENAE BINDING SITE is a target binding site found in the 3' untranslated region of mRNA encoded by KENAE, corresponding to a target binding site such as BINDING SITE I, BINDING SITE II or BINDING SITE III of FIG. 8. Table 4 illustrates the complementarity of the nucleotide sequences of KENAE BINDING SITE, designated SEQ ID:18180, to the nucleotide sequence of GAM1338 RNA, herein designated GAM RNA, also designated SEQ ID:360.

Another function of GAM1338 is therefore inhibition of KENAE (Accession NP_789786.1). Accordingly, utilities of GAM1338 include diagnosis, prevention and treatment of diseases and clinical conditions associated with KENAE.

KIAA0063 (Accession NP_055691.1) is another GAM1338 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:13142, to the nucleotide sequence of GAM1338 RNA, herein designated GAM RNA, also designated SEQ ID:360.

Another function of GAM1338 is therefore inhibition of KIAA0063 (Accession NP_055691.1). Accordingly, utilities of GAM1338 include diagnosis, prevention and treatment of diseases and clinical conditions associated with KIAA0063.

KIAA0087 (Accession NP_055584.1) is another GAM1338 target gene, herein designated TARGET GENE. KIAA0087 BINDING SITE is a target binding site found in the 3' untranslated region of mRNA encoded by KIAA0087, corresponding to a target binding site such as BINDING SITE I, BINDING SITE II or BINDING SITE III of FIG. 8. Table 4 illustrates the complementarity of the nucleotide sequences of KIAA0087 BINDING SITE, designated SEQ ID:14875, to the nucleotide sequence of GAM1338 RNA, herein designated GAM RNA, also designated SEQ ID:360.

Another function of GAM1338 is therefore inhibition of KIAA0087 (Accession NP_055584.1). Accordingly, utilities of GAM1338 include diagnosis, prevention and treatment of diseases and clinical conditions associated with KIAA0087.

KIAA0117 (Accession XP_290939.1) is another GAM1338 target gene, herein designated TARGET GENE. KIAA0117 BINDING SITE is a target binding site found in the 3' untranslated region of mRNA encoded by KIAA0117, corresponding to a target binding site such as BINDING SITE I, BINDING SITE II or BINDING SITE III of FIG. 8. Table 4 illustrates the complementarity of the nucleotide sequences of KIAA0117 BINDING SITE, designated SEQ ID:1353, to the nucleotide sequence of GAM1338 RNA, herein designated GAM RNA, also designated SEQ ID:360.

Another function of GAM1338 is therefore inhibition of KIAA0117 (Accession XP_290939.1). Accordingly, utilities of GAM1338 include diagnosis, prevention and treatment of diseases and clinical conditions associated with KIAA0117.

KIAA0182 (Accession XP_050495.4) is another GAM1338 target gene, herein designated TARGET GENE. KIAA0182 BINDING SITE is a target binding site found in the 3' untranslated region of mRNA encoded by KIAA0182, corresponding to a target binding site such as BINDING SITE I, BINDING SITE II or BINDING SITE III of FIG. 8. Table 4 illustrates the complementarity of the nucleotide sequences of KIAA0182 BINDING SITE, designated SEQ ID:2720, to the nucleotide sequence of GAM1338 RNA, herein designated GAM RNA, also designated SEQ ID:360.

Another function of GAM1338 is therefore inhibition of KIAA0182 (Accession XP_050495.4). Accordingly, utilities of GAM1338 include diagnosis, prevention and treatment of diseases and clinical conditions associated with KIAA0182.

KIAA0186 (Accession NP_066545.1) is another GAM1338 target gene, herein designated TARGET GENE. KIAA0186 BINDING SITE is a target binding site found in the 3' untranslated region of mRNA encoded by KIAA0186, corresponding to a target binding site such as BINDING SITE I, BINDING SITE II or BINDING SITE III of FIG. 8. Table 4 illustrates the complementarity of the nucleotide sequences of KIAA0186 BINDING SITE, designated SEQ ID:6841, to the nucleotide sequence of GAM1338 RNA, herein designated GAM RNA, also designated SEQ ID:360.

Another function of GAM1338 is therefore inhibition of KIAA0186 (Accession NP_066545.1). Accordingly, utilities of GAM1338 include diagnosis, prevention and treatment of diseases and clinical conditions associated with KIAA0186.

KIAA0205 (Accession NP_055688.1) is another GAM1338 target gene, herein designated TARGET GENE. KIAA0205 BINDING SITE is a target binding site found in the 3' untranslated region of mRNA encoded by KIAA0205, corresponding to a target binding site such as BINDING SITE I, BINDING SITE II or BINDING SITE III of FIG. 8. Table 4 illustrates the complementarity of the nucleotide sequences of KIAA0205 BINDING SITE, designated SEQ ID:17371, to the nucleotide sequence of GAM1338 RNA, herein designated GAM RNA, also designated SEQ ID:360.

Another function of GAM1338 is therefore inhibition of KIAA0205 (Accession NP_055688.1). Accordingly, utilities of GAM1338 include diagnosis, prevention and treatment of diseases and clinical conditions associated with KIAA0205.

KIAA0237 (Accession NP_055562.1) is another GAM1338 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:4878, to the nucleotide sequence of GAM1338 RNA, herein designated GAM RNA, also designated SEQ ID:360.

Another function of GAM1338 is therefore inhibition of KIAA0237 (Accession NP_055562.1). Accordingly, utilities of GAM1338 include diagnosis, prevention and treatment of diseases and clinical conditions associated with KIAA0237.

KIAA0295 (Accession XP_042833.2) is another GAM1338 target gene, herein designated TARGET GENE. KIAA0295 BINDING SITE is a target binding site found in the 3' untranslated region of mRNA encoded by KIAA0295, corresponding to a target binding site such as BINDING SITE I, BINDING SITE II or BINDING SITE III of FIG. 8. Table 4 illustrates the complementarity of the nucleotide sequences of KIAA0295 BINDING SITE, designated SEQ ID:19689, to the nucleotide sequence of GAM1338 RNA, herein designated GAM RNA, also designated SEQ ID:360.

Another function of GAM1338 is therefore inhibition of KIAA0295 (Accession XP_042833.2). Accordingly, utilities of GAM1338 include diagnosis, prevention and treatment of diseases and clinical conditions associated with KIAA0295.

KIAA0435 (Accession NP_055616.1) is another GAM1338 target gene, herein designated TARGET GENE. KIAA0435 BINDING SITE is a target binding site found in the 5' untranslated region of mRNA encoded by KIAA0435, corresponding to a target binding site such as BINDING SITE I, BINDING SITE II or BINDING SITE III of FIG. 8. Table 4 illustrates the complementarity of the nucleotide sequences of KIAA0435 BINDING SITE, designated SEQ ID:14441, to the nucleotide sequence of GAM1338 RNA, herein designated GAM RNA, also designated SEQ ID:360.

Another function of GAM1338 is therefore inhibition of KIAA0435 (Accession NP_055616.1). Accordingly, utilities of GAM1338 include diagnosis, prevention and treatment of diseases and clinical conditions associated with KIAA0435.

KIAA0446 (Accession XP_044155.1) is another GAM1338 target gene, herein designated TARGET GENE. KIAA0446 BINDING SITE is a target binding site found in the 5' untranslated region of mRNA encoded by KIAA0446, corresponding to a target binding site such as BINDING SITE I, BINDING SITE II or BINDING SITE III of FIG. 8. Table 4 illustrates the complementarity of the nucleotide sequences of KIAA0446 BINDING SITE, designated SEQ ID:20115, to the nucleotide sequence of GAM1338 RNA, herein designated GAM RNA, also designated SEQ ID:360.

Another function of GAM1338 is therefore inhibition of KIAA0446 (Accession XP_044155.1). Accordingly, utilities of GAM1338 include diagnosis, prevention and treatment of diseases and clinical conditions associated with KIAA0446.

KIAA0459 (Accession XP_027862.1) is another GAM1338 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:3442, to the nucleotide sequence of GAM1338 RNA, herein designated GAM RNA, also designated SEQ ID:360.

Another function of GAM1338 is therefore inhibition of KIAA0459 (Accession XP_027862.1). Accordingly, utilities of GAM1338 include diagnosis, prevention and treatment of diseases and clinical conditions associated with KIAA0459.

KIAA0469 (Accession NP_055666.1) is another GAM1338 target gene, herein designated TARGET GENE. KIAA0469 BINDING SITE1 and KIAA0469 BINDING SITE2 are target binding sites found in untranslated regions of mRNA encoded by KIAA0469, corresponding to target binding sites such as BINDING SITE I, BINDING SITE II or BINDING SITE III of FIG. 8. Table 4 illustrates the complementarity of the nucleotide sequences of KIAA0469 BINDING SITE1 and KIAA0469 BINDING SITE2, designated SEQ ID:14283 and SEQ ID:1413 respectively, to the nucleotide sequence of GAM1338 RNA, herein designated GAM RNA, also designated SEQ ID:360.

Another function of GAM1338 is therefore inhibition of KIAA0469 (Accession NP_055666.1). Accordingly, utilities of GAM1338 include diagnosis, prevention and treatment of diseases and clinical conditions associated with KIAA0469.

KIAA0475 (Accession NP_055679.1) is another GAM1338 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:7946, to the nucleotide sequence of GAM1338 RNA, herein designated GAM RNA, also designated SEQ ID:360.

Another function of GAM1338 is therefore inhibition of KIAA0475 (Accession NP_055679.1). Accordingly, utilities of GAM1338 include diagnosis, prevention and treatment of diseases and clinical conditions associated with KIAA0475.

KIAA0493 (Accession XP_034717.1) is another GAM1338 target gene, herein designated TARGET GENE. KIAA0493 BINDING SITE is a target binding site found in the 5' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:6597, to the nucleotide sequence of GAM1338 RNA, herein designated GAM RNA, also designated SEQ ID:360.

Another function of GAM1338 is therefore inhibition of KIAA0493 (Accession XP_034717.1). Accordingly, utilities of GAM1338 include diagnosis, prevention and treatment of diseases and clinical conditions associated with KIAA0493.

KIAA0513 (Accession NP_055547.1) is another GAM1338 target gene, herein designated TARGET GENE. KIAA0513 BINDING SITE is a target binding site found in the 3' untranslated region of mRNA encoded by KIAA0513, corresponding to a target binding site such as BINDING SITE I, BINDING SITE II or BINDING SITE III of FIG. 8. Table 4 illustrates the complementarity of the nucleotide sequences of KIAA0513 BINDING SITE, designated SEQ ID:11210, to the nucleotide sequence of GAM1338 RNA, herein designated GAM RNA, also designated SEQ ID:360.

Another function of GAM1338 is therefore inhibition of KIAA0513 (Accession NP_055547.1). Accordingly, utilities of GAM1338 include diagnosis, prevention and treatment of diseases and clinical conditions associated with KIAA0513.

KIAA0527 (Accession XP_171054.1) is another GAM1338 target gene, herein designated TARGET GENE. KIAA0527 BINDING SITE is a target binding site found in the 3' untranslated region of mRNA encoded by KIAA0527, corresponding to a target binding site such as BINDING SITE I, BINDING SITE II or BINDING SITE III of FIG. 8. Table 4 illustrates the complementarity of the nucleotide sequences of KIAA0527 BINDING SITE, designated SEQ ID:19044, to the nucleotide sequence of GAM1338 RNA, herein designated GAM RNA, also designated SEQ ID:360.

Another function of GAM1338 is therefore inhibition of KIAA0527 (Accession XP_171054.1). Accordingly, utilities of GAM1338 include diagnosis, prevention and treatment of diseases and clinical conditions associated with KIAA0527.

KIAA0555 (Accession NP_055605.1) is another GAM1338 target gene, herein designated TARGET GENE. KIAA0555 BINDING SITE is a target binding site found in the 3' untranslated region of mRNA encoded by KIAA0555, corresponding to a target binding site such as BINDING SITE I, BINDING SITE II or BINDING SITE III of FIG. 8. Table 4 illustrates the complementarity of the nucleotide sequences of KIAA0555 BINDING SITE, designated SEQ ID:19623, to the nucleotide sequence of GAM1338 RNA, herein designated GAM RNA, also designated SEQ ID:360.

Another function of GAM1338 is therefore inhibition of KIAA0555 (Accession NP_055605.1). Accordingly, utilities of GAM1338 include diagnosis, prevention and treatment of diseases and clinical conditions associated with KIAA0555.

KIAA0561 (Accession XP_038150.2) is another GAM1338 target gene, herein designated TARGET GENE. KIAA0561 BINDING SITE is a target binding site found in the 3' untranslated region of mRNA encoded by KIAA0561, corresponding to a target binding site such as BINDING SITE I, BINDING SITE II or BINDING SITE III of FIG. 8. Table 4 illustrates the complementarity of the nucleotide sequences of KIAA0561 BINDING SITE, designated SEQ ID:12972, to the nucleotide sequence of GAM1338 RNA, herein designated GAM RNA, also designated SEQ ID:360.

Another function of GAM1338 is therefore inhibition of KIAA0561 (Accession XP_038150.2). Accordingly, utilities of GAM1338 include diagnosis, prevention and treatment of diseases and clinical conditions associated with KIAA0561.

KIAA0562 (Accession NP_055519.1) is another GAM1338 target gene, herein designated TARGET GENE. KIAA0562 BINDING SITE is a target binding site found in the 3' untranslated region of mRNA encoded by KIAA0562, corresponding to a target binding site such as BINDING SITE I, BINDING SITE II or BINDING SITE III of FIG. 8. Table 4 illustrates the complementarity of the nucleotide sequences of KIAA0562 BINDING SITE, designated SEQ ID:10458, to the nucleotide sequence of GAM1338 RNA, herein designated GAM RNA, also designated SEQ ID:360.

Another function of GAM1338 is therefore inhibition of KIAA0562 (Accession NP_055519.1). Accordingly, utilities of GAM1338 include diagnosis, prevention and treatment of diseases and clinical conditions associated with KIAA0562.

KIAA0563 (Accession NP_055649.1) is another GAM1338 target gene, herein designated TARGET GENE. KIAA0563 BINDING SITE is a target binding site found in the 5' untranslated region of mRNA encoded by KIAA0563, corresponding to a target binding site such as BINDING SITE I, BINDING SITE II or BINDING SITE III of FIG. 8. Table 4 illustrates the complementarity of the nucleotide sequences of KIAA0563 BINDING SITE, designated SEQ ID:19679, to the nucleotide sequence of GAM1338 RNA, herein designated GAM RNA, also designated SEQ ID:360.

Another function of GAM1338 is therefore inhibition of KIAA0563 (Accession NP_055649.1). Accordingly, utilities of GAM1338 include diagnosis, prevention and treatment of diseases and clinical conditions associated with KIAA0563.

KIAA0682 (Accession NP_055667.1) is another GAM1338 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:2671, to the nucleotide sequence of GAM1338 RNA, herein designated GAM RNA, also designated SEQ ID:360.

Another function of GAM1338 is therefore inhibition of KIAA0682 (Accession NP_055667.1). Accordingly, utilities of GAM1338 include diagnosis, prevention and treatment of diseases and clinical conditions associated with KIAA0682.

KIAA0831 (Accession NP_055739.1) is another GAM1338 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:16264, to the nucleotide sequence of GAM1338 RNA, herein designated GAM RNA, also designated SEQ ID:360.

Another function of GAM1338 is therefore inhibition of KIAA0831 (Accession NP_055739.1). Accordingly, utilities of GAM1338 include diagnosis, prevention and treatment of diseases and clinical conditions associated with KIAA0831.

KIAA0841 (Accession XP_049237.1) is another GAM1338 target gene, herein designated TARGET GENE. KIAA0841 BINDING SITE1 and KIAA0841 BINDING SITE2 are target binding sites found in untranslated regions of mRNA encoded by KIAA0841, corresponding to target binding sites such as BINDING SITE I, BINDING SITE II or BINDING SITE III of FIG. 8. Table 4 illustrates the complementarity of the nucleotide sequences of KIAA0841 BINDING SITE1 and KIAA0841 BINDING SITE2, designated SEQ ID:1519 and SEQ ID:901 respectively, to the nucleotide sequence of GAM1338 RNA, herein designated GAM RNA, also designated SEQ ID:360.

Another function of GAM1338 is therefore inhibition of KIAA0841 (Accession XP_049237.1). Accordingly, utilities of GAM1338 include diagnosis, prevention and treatment of diseases and clinical conditions associated with KIAA0841.

KIAA0861 (Accession NP_055893.2) is another GAM1338 target gene, herein designated TARGET GENE. KIAA0861 BINDING SITE is a target binding site found in the 3' untranslated region of mRNA encoded by KIAA0861, corresponding to a target binding site such as BINDING SITE I, BINDING SITE II or BINDING SITE III of FIG. 8. Table 4 illustrates the complementarity of the nucleotide sequences of KIAA0861 BINDING SITE, designated SEQ ID:10629, to the nucleotide sequence of GAM1338 RNA, herein designated GAM RNA, also designated SEQ ID:360.

Another function of GAM1338 is therefore inhibition of KIAA0861 (Accession NP_055893.2). Accordingly, utilities of GAM1338 include diagnosis, prevention and treatment of diseases and clinical conditions associated with KIAA0861.

KIAA0924 (Accession NP_055712.1) is another GAM1338 target gene, herein designated TARGET GENE. KIAA0924 BINDING SITE1 and KIAA0924 BINDING SITE2 are target binding sites found in untranslated regions of mRNA encoded by KIAA0924, corresponding to target binding sites such as BINDING SITE I, BINDING SITE II or BINDING SITE III of FIG. 8. Table 4 illustrates the complementarity of the nucleotide sequences of KIAA0924 BINDING SITE1 and KIAA0924 BINDING SITE2, designated SEQ ID:19935 and SEQ ID:864 respectively, to the nucleotide sequence of GAM1338 RNA, herein designated GAM RNA, also designated SEQ ID:360.

Another function of GAM1338 is therefore inhibition of KIAA0924 (Accession NP_055712.1). Accordingly, utilities of GAM1338 include diagnosis, prevention and treatment of diseases and clinical conditions associated with KIAA0924.

KIAA0935 (Accession XP_052620.6) is another GAM1338 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:10957, to the nucleotide sequence of GAM1338 RNA, herein designated GAM RNA, also designated SEQ ID:360.

Another function of GAM1338 is therefore inhibition of KIAA0935 (Accession XP_052620.6). Accordingly, utilities of GAM1338 include diagnosis, prevention and treatment of diseases and clinical conditions associated with KIAA0935.

KIAA1002 (Accession XP_290584.1) is another GAM1338 target gene, herein designated TARGET GENE. KIAA1002 BINDING SITE1 and KIAA1002 BINDING SITE2 are target binding sites found in untranslated regions of mRNA encoded by KIAA1002, corresponding to target binding sites such as BINDING SITE I, BINDING SITE II or BINDING SITE III of FIG. 8. Table 4 illustrates the complementarity of the nucleotide sequences of KIAA1002 BINDING SITE1 and KIAA1002 BINDING SITE2, designated SEQ ID:12518 and SEQ ID:8660 respectively, to the nucleotide sequence of GAM1338 RNA, herein designated GAM RNA, also designated SEQ ID:360.

Another function of GAM1338 is therefore inhibition of KIAA1002 (Accession XP_290584.1). Accordingly, utilities of GAM1338 include diagnosis, prevention and treatment of diseases and clinical conditions associated with KIAA1002.

KIAA1040 (Accession XP_051091.3) is another GAM1338 target gene, herein designated TARGET GENE. KIAA1040 BINDING SITE is a target binding site found in the 3' untranslated region of mRNA encoded by KIAA1040, corresponding to a target binding site such as BINDING SITE I, BINDING SITE II or BINDING SITE III of FIG. 8. Table 4 illustrates the complementarity of the nucleotide sequences of KIAA1040 BINDING SITE, designated SEQ ID:5138, to the nucleotide sequence of GAM1338 RNA, herein designated GAM RNA, also designated SEQ ID:360.

Another function of GAM1338 is therefore inhibition of KIAA1040 (Accession XP_051091.3). Accordingly, utilities of GAM1338 include diagnosis, prevention and treatment of diseases and clinical conditions associated with KIAA1040.

KIAA1041 (Accession NP_055762.1) is another GAM1338 target gene, herein designated TARGET GENE. KIAA1041 BINDING SITE is a target binding site found in the 3' untranslated region of mRNA encoded by KIAA1041, corresponding to a target binding site such as BINDING SITE I, BINDING SITE II or BINDING SITE III of FIG. 8. Table 4 illustrates the complementarity of the nucleotide sequences of KIAA1041 BINDING SITE, designated SEQ ID:11112, to the nucleotide sequence of GAM1338 RNA, herein designated GAM RNA, also designated SEQ ID:360.

Another function of GAM1338 is therefore inhibition of KIAA1041 (Accession NP_055762.1). Accordingly, utilities of GAM1338 include diagnosis, prevention and treatment of diseases and clinical conditions associated with KIAA1041.

KIAA1052 (Accession NP_055771.1) is another GAM1338 target gene, herein designated TARGET GENE. KIAA1052 BINDING SITE is a target binding site found in the 5' untranslated region of mRNA encoded by KIAA1052, corresponding to a target binding site such as BINDING SITE I, BINDING SITE II or BINDING SITE III of FIG. 8. Table 4 illustrates the complementarity of the nucleotide sequences of KIAA1052 BINDING SITE, designated SEQ ID:1530, to the nucleotide sequence of GAM1338 RNA, herein designated GAM RNA, also designated SEQ ID:360.

Another function of GAM1338 is therefore inhibition of KIAA1052 (Accession NP_055771.1). Accordingly, utilities of GAM1338 include diagnosis, prevention and treatment of diseases and clinical conditions associated with KIAA1052.

KIAA1054 (Accession XP_043493.5) is another GAM1338 target gene, herein designated TARGET GENE. KIAA1054 BINDING SITE is a target binding site found in the 3' untranslated region of mRNA encoded by KIAA1054, corresponding to a target binding site such as BINDING SITE I, BINDING SITE II or BINDING SITE III of FIG. 8. Table 4 illustrates the complementarity of the nucleotide sequences of KIAA1054 BINDING SITE, designated SEQ ID:7973, to the nucleotide sequence of GAM1338 RNA, herein designated GAM RNA, also designated SEQ ID:360.

Another function of GAM1338 is therefore inhibition of KIAA1054 (Accession XP_043493.5). Accordingly, utilities of GAM1338 include diagnosis, prevention and treatment of diseases and clinical conditions associated with KIAA1054.

KIAA1128 (Accession NP_061872.1) is another GAM1338 target gene, herein designated TARGET GENE. KIAA1128 BINDING SITE is a target binding site found in the 3' untranslated region of mRNA encoded by KIAA1128, corresponding to a target binding site such as BINDING SITE I, BINDING SITE II or BINDING SITE III of FIG. 8. Table 4 illustrates the complementarity of the nucleotide sequences of KIAA1128 BINDING SITE, designated SEQ ID:8868, to the nucleotide sequence of GAM1338 RNA, herein designated GAM RNA, also designated SEQ ID:360.

Another function of GAM1338 is therefore inhibition of KIAA1128 (Accession NP_061872.1). Accordingly, utilities of GAM1338 include diagnosis, prevention and treatment of diseases and clinical conditions associated with KIAA1128.

KIAA1143 (Accession XP_044014.1) is another GAM1338 target gene, herein designated TARGET GENE. KIAA1143 BINDING SITE is a target binding site found in the 3' untranslated region of mRNA encoded by KIAA1143, corresponding to a target binding site such as BINDING SITE I, BINDING SITE II or BINDING SITE III of FIG. 8. Table 4 illustrates the complementarity of the nucleotide sequences of KIAA1143 BINDING SITE, designated SEQ ID:13800, to the nucleotide sequence of GAM1338 RNA, herein designated GAM RNA, also designated SEQ ID:360.

Another function of GAM1338 is therefore inhibition of KIAA1143 (Accession XP_044014.1). Accordingly, utilities of GAM1338 include diagnosis, prevention and treatment of diseases and clinical conditions associated with KIAA1143.

KIAA1155 (Accession XP_030864.2) is another GAM1338 target gene, herein designated TARGET GENE. KIAA1155 BINDING SITE is a target binding site found in the 3' untranslated region of mRNA encoded by KIAA1155, corresponding to a target binding site such as BINDING SITE I, BINDING SITE II or BINDING SITE III of FIG. 8. Table 4 illustrates the complementarity of the nucleotide sequences of KIAA1155 BINDING SITE, designated SEQ ID:5405, to the nucleotide sequence of GAM1338 RNA, herein designated GAM RNA, also designated SEQ ID:360.

Another function of GAM1338 is therefore inhibition of KIAA1155 (Accession XP_030864.2). Accordingly, utilities of GAM1338 include diagnosis, prevention and treatment of diseases and clinical conditions associated with KIAA1155.

KIAA1170 (Accession XP_045907.2) is another GAM1338 target gene, herein designated TARGET GENE. KIAA1170 BINDING SITE is a target binding site found in the 3' untranslated region of mRNA encoded by KIAA1170, corresponding to a target binding site such as BINDING SITE I, BINDING SITE II or BINDING SITE III of FIG. 8. Table 4 illustrates the complementarity of the nucleotide sequences of KIAA1170 BINDING SITE, designated SEQ ID:7575, to the nucleotide sequence of GAM1338 RNA, herein designated GAM RNA, also designated SEQ ID:360.

Another function of GAM1338 is therefore inhibition of KIAA1170 (Accession XP_045907.2). Accordingly, utilities of GAM1338 include diagnosis, prevention and treatment of diseases and clinical conditions associated with KIAA1170.

KIAA1185 (Accession NP_065761.1) is another GAM1338 target gene, herein designated TARGET GENE. KIAA1185 BINDING SITE is a target binding site found in the 3' untranslated region of mRNA encoded by KIAA1185, corresponding to a target binding site such as BINDING SITE I, BINDING SITE II or BINDING SITE III of FIG. 8. Table 4 illustrates the complementarity of the nucleotide sequences of KIAA1185 BINDING SITE, designated SEQ ID:9213, to the nucleotide sequence of GAM1338 RNA, herein designated GAM RNA, also designated SEQ ID:360.

Another function of GAM1338 is therefore inhibition of KIAA1185 (Accession NP_065761.1). Accordingly, utilities of GAM1338 include diagnosis, prevention and treatment of diseases and clinical conditions associated with KIAA1185.

KIAA1193 (Accession XP_041843.1) is another GAM1338 target gene, herein designated TARGET GENE. KIAA1193 BINDING SITE is a target binding site found in the 3' untranslated region of mRNA encoded by KIAA1193, corresponding to a target binding site such as BINDING SITE I, BINDING SITE II or BINDING SITE III of FIG. 8. Table 4 illustrates the complementarity of the nucleotide sequences of KIAA1193 BINDING SITE, designated SEQ ID:1683, to the nucleotide sequence of GAM1338 RNA, herein designated GAM RNA, also designated SEQ ID:360.

Another function of GAM1338 is therefore inhibition of KIAA1193 (Accession XP_041843.1). Accordingly, utilities of GAM1338 include diagnosis, prevention and treatment of diseases and clinical conditions associated with KIAA1193.

KIAA1198 (Accession NP_065765.1) is another GAM1338 target gene, herein designated TARGET GENE. KIAA1198 BINDING SITE1 through KIAA1198 BINDING SITE5 are target binding sites found in untranslated regions of mRNA encoded by KIAA1198, corresponding to target binding sites such as BINDING SITE I, BINDING SITE II or BINDING SITE III of FIG. 8. Table 4 illustrates the complementarity of the nucleotide sequences of KIAA1198 BINDING SITE1 through KIAA1198 BINDING SITE5, designated SEQ ID:17224, SEQ ID:17617, SEQ ID:17786, SEQ ID:8170 and SEQ ID:5522 respectively, to the nucleotide sequence of GAM1338 RNA, herein designated GAM RNA, also designated SEQ ID:360.

Another function of GAM1338 is therefore inhibition of KIAA1198 (Accession NP_065765.1). Accordingly, utilities of GAM1338 include diagnosis, prevention and treatment of diseases and clinical conditions associated with KIAA1198.

KIAA1209 (Accession XP_027307.2) is another GAM1338 target gene, herein designated TARGET GENE. KIAA1209 BINDING SITE is a target binding site found in the 3' untranslated region of mRNA encoded by KIAA1209, corresponding to a target binding site such as BINDING SITE I, BINDING SITE II or BINDING SITE III of FIG. 8. Table 4 illustrates the complementarity of the nucleotide sequences of KIAA1209 BINDING SITE, designated SEQ ID:10878, to the nucleotide sequence of GAM1338 RNA, herein designated GAM RNA, also designated SEQ ID:360.

Another function of GAM1338 is therefore inhibition of KIAA1209 (Accession XP_027307.2). Accordingly, utilities of GAM1338 include diagnosis, prevention and treatment of diseases and clinical conditions associated with KIAA1209.

KIAA1210 (Accession XP_172801.1) is another GAM1338 target gene, herein designated TARGET GENE. KIAA1210 BINDING SITE is a target binding site found in the 3' untranslated region of mRNA encoded by KIAA1210, corresponding to a target binding site such as BINDING SITE I, BINDING SITE II or BINDING SITE III of FIG. 8. Table 4 illustrates the complementarity of the nucleotide sequences of KIAA1210 BINDING SITE, designated SEQ ID:1409, to the nucleotide sequence of GAM1338 RNA, herein designated GAM RNA, also designated SEQ ID:360.

Another function of GAM1338 is therefore inhibition of KIAA1210 (Accession XP_172801.1). Accordingly, utilities of GAM1338 include diagnosis, prevention and treatment of diseases and clinical conditions associated with KIAA1210.

KIAA1257 (Accession XP_031577.2) is another GAM1338 target gene, herein designated TARGET GENE. KIAA1257 BINDING SITE1 through KIAA1257 BINDING SITE3 are target binding sites found in untranslated regions of mRNA encoded by KIAA1257, corresponding to target binding sites such as BINDING SITE I, BINDING SITE II or BINDING SITE III of FIG. 8. Table 4 illustrates the complementarity of the nucleotide sequences of KIAA1257 BINDING SITE1 through KIAA1257 BINDING SITE3, designated SEQ ID:14928, SEQ ID:3109 and SEQ ID:13137 respectively, to the nucleotide sequence of GAM1338 RNA, herein designated GAM RNA, also designated SEQ ID:360.

Another function of GAM1338 is therefore inhibition of KIAA1257 (Accession XP_031577.2). Accordingly, utilities of GAM1338 include diagnosis, prevention and treatment of diseases and clinical conditions associated with KIAA1257.

KIAA1268 (Accession XP_291055.1) is another GAM1338 target gene, herein designated TARGET GENE. KIAA1268 BINDING SITE is a target binding site found in the 3' untranslated region of mRNA encoded by KIAA1268, corresponding to a target binding site such as BINDING SITE I, BINDING SITE II or BINDING SITE III of FIG. 8. Table 4 illustrates the complementarity of the nucleotide sequences of KIAA1268 BINDING SITE, designated SEQ ID:6348, to the nucleotide sequence of GAM1338 RNA, herein designated GAM RNA, also designated SEQ ID:360.

Another function of GAM1338 is therefore inhibition of KIAA1268 (Accession XP_291055.1). Accordingly, utilities of GAM1338 include diagnosis, prevention and treatment of diseases and clinical conditions associated with KIAA1268.

KIAA1287 (Accession NP_065799.1) is another GAM1338 target gene, herein designated TARGET GENE. KIAA1287 BINDING SITE is a target binding site found in the 3' untranslated region of mRNA encoded by KIAA1287, corresponding to a target binding site such as BINDING SITE I, BINDING SITE II or BINDING SITE III of FIG. 8. Table 4 illustrates the complementarity of the nucleotide sequences of KIAA1287 BINDING SITE, designated SEQ ID:13685, to the nucleotide sequence of GAM1338 RNA, herein designated GAM RNA, also designated SEQ ID:360.

Another function of GAM1338 is therefore inhibition of KIAA1287 (Accession NP_065799.1). Accordingly, utilities of GAM1338 include diagnosis, prevention and treatment of diseases and clinical conditions associated with KIAA1287.

KIAA1393 (Accession XP_050793.2) is another GAM1338 target gene, herein designated TARGET GENE. KIAA1393 BINDING SITE is a target binding site found in the 3' untranslated region of mRNA encoded by KIAA1393, corresponding to a target binding site such as BINDING SITE I, BINDING SITE II or BINDING SITE III of FIG. 8. Table 4 illustrates the complementarity of the nucleotide sequences of KIAA1393 BINDING SITE, designated SEQ ID:6495, to the nucleotide sequence of GAM1338 RNA, herein designated GAM RNA, also designated SEQ ID:360.

Another function of GAM1338 is therefore inhibition of KIAA1393 (Accession XP_050793.2). Accordingly, utilities of GAM1338 include diagnosis, prevention and treatment of diseases and clinical conditions associated with KIAA1393.

KIAA1465 (Accession XP_027396.4) is another GAM1338 target gene, herein designated TARGET GENE. KIAA1465 BINDING SITE is a target binding site found in the 3' untranslated region of mRNA encoded by KIAA1465, corresponding to a target binding site such as BINDING SITE I, BINDING SITE II or BINDING SITE III of FIG. 8. Table 4 illustrates the complementarity of the nucleotide sequences of KIAA1465 BINDING SITE, designated SEQ ID:13306, to the nucleotide sequence of GAM1338 RNA, herein designated GAM RNA, also designated SEQ ID:360.

Another function of GAM1338 is therefore inhibition of KIAA1465 (Accession XP_027396.4). Accordingly, utilities of GAM1338 include diagnosis, prevention and treatment of diseases and clinical conditions associated with KIAA1465.

KIAA1493 (Accession XP_034415.1) is another GAM1338 target gene, herein designated TARGET GENE.

KIAA1493 BINDING SITE is a target binding site found in the 3' untranslated region of mRNA encoded by KIAA1493, corresponding to a target binding site such as BINDING SITE I, BINDING SITE II or BINDING SITE III of FIG. 8. Table 4 illustrates the complementarity of the nucleotide sequences of KIAA1493 BINDING SITE, designated SEQ ID:11663, to the nucleotide sequence of GAM1338 RNA, herein designated GAM RNA, also designated SEQ ID:360.

Another function of GAM1338 is therefore inhibition of KIAA1493 (Accession XP_034415.1). Accordingly, utilities of GAM1338 include diagnosis, prevention and treatment of diseases and clinical conditions associated with KIAA1493.

KIAA1518 (Accession XP_170889.1) is another GAM1338 target gene, herein designated TARGET GENE. KIAA1518 BINDING SITE is a target binding site found in the 3' untranslated region of multiple transcripts of mRNA encoded by KIAA1518, corresponding to a target binding site such as BINDING SITE I, BINDING SITE II or BINDING SITE III of FIG. 8. Table 4 illustrates the complementarity of the nucleotide sequences of KIAA1518 BINDING SITE, designated SEQ ID:17375, to the nucleotide sequence of GAM1338 RNA, herein designated GAM RNA, also designated SEQ ID:360.

Another function of GAM1338 is therefore inhibition of KIAA1518 (Accession XP_170889.1). Accordingly, utilities of GAM1338 include diagnosis, prevention and treatment of diseases and clinical conditions associated with KIAA1518.

KIAA1530 (Accession XP_042661.5) is another GAM1338 target gene, herein designated TARGET GENE. KIAA1530 BINDING SITE1 and KIAA1530 BINDING SITE2 are target binding sites found in untranslated regions of mRNA encoded by KIAA1530, corresponding to target binding sites such as BINDING SITE I, BINDING SITE II or BINDING SITE III of FIG. 8. Table 4 illustrates the complementarity of the nucleotide sequences of KIAA1530 BINDING SITE1 and KIAA1530 BINDING SITE2, designated SEQ ID:12345 and SEQ ID:6360 respectively, to the nucleotide sequence of GAM1338 RNA, herein designated GAM RNA, also designated SEQ ID:360.

Another function of GAM1338 is therefore inhibition of KIAA1530 (Accession XP_042661.5). Accordingly, utilities of GAM1338 include diagnosis, prevention and treatment of diseases and clinical conditions associated with KIAA1530.

KIAA1559 (Accession XP_054472.2) is another GAM1338 target gene, herein designated TARGET GENE. KIAA1559 BINDING SITE is a target binding site found in the 3' untranslated region of mRNA encoded by KIAA1559, corresponding to a target binding site such as BINDING SITE I, BINDING SITE II or BINDING SITE III of FIG. 8. Table 4 illustrates the complementarity of the nucleotide sequences of KIAA1559 BINDING SITE, designated SEQ ID:14408, to the nucleotide sequence of GAM1338 RNA, herein designated GAM RNA, also designated SEQ ID:360.

Another function of GAM1338 is therefore inhibition of KIAA1559 (Accession XP_054472.2). Accordingly, utilities of GAM1338 include diagnosis, prevention and treatment of diseases and clinical conditions associated with KIAA1559.

KIAA1571 (Accession XP_027744.1) is another GAM1338 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:13037, to the nucleotide sequence of GAM1338 RNA, herein designated GAM RNA, also designated SEQ ID:360.

Another function of GAM1338 is therefore inhibition of KIAA1571 (Accession XP_027744.1). Accordingly, utilities of GAM1338 include diagnosis, prevention and treatment of diseases and clinical conditions associated with KIAA1571.

KIAA1615 (Accession NP_066002.1) is another GAM1338 target gene, herein designated TARGET GENE. KIAA1615 BINDING SITE1 and KIAA1615 BINDING SITE2 are target binding sites found in untranslated regions of mRNA encoded by KIAA1615, corresponding to target binding sites such as BINDING SITE I, BINDING SITE II or BINDING SITE III of FIG. 8. Table 4 illustrates the complementarity of the nucleotide sequences of KIAA1615 BINDING SITE1 and KIAA1615 BINDING SITE2, designated SEQ ID:12534 and SEQ ID:8578 respectively, to the nucleotide sequence of GAM1338 RNA, herein designated GAM RNA, also designated SEQ ID:360.

Another function of GAM1338 is therefore inhibition of KIAA1615 (Accession NP_066002.1). Accordingly, utilities of GAM1338 include diagnosis, prevention and treatment of diseases and clinical conditions associated with KIAA1615.

KIAA1671 (Accession XP_037809.1) is another GAM1338 target gene, herein designated TARGET GENE. KIAA1671 BINDING SITE1 and KIAA1671 BINDING SITE2 are target binding sites found in untranslated regions of mRNA encoded by KIAA1671, corresponding to target binding sites such as BINDING SITE I, BINDING SITE II or BINDING SITE III of FIG. 8. Table 4 illustrates the complementarity of the nucleotide sequences of KIAA1671 BINDING SITE1 and KIAA1671 BINDING SITE2, designated SEQ ID:17814 and SEQ ID:6490 respectively, to the nucleotide sequence of GAM1338 RNA, herein designated GAM RNA, also designated SEQ ID:360.

Another function of GAM1338 is therefore inhibition of KIAA1671 (Accession XP_037809.1). Accordingly, utilities of GAM1338 include diagnosis, prevention and treatment of diseases and clinical conditions associated with KIAA1671.

KIAA1712 (Accession NP_085136.1) is another GAM1338 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:12038 and SEQ ID:12038 respectively, to the nucleotide sequence of GAM1338 RNA, herein designated GAM RNA, also designated SEQ ID:360.

Another function of GAM1338 is therefore inhibition of KIAA1712 (Accession NP_085136.1). Accordingly, utilities of GAM1338 include diagnosis, prevention and treatment of diseases and clinical conditions associated with KIAA1712.

KIAA1712 (Accession NP_085136.1) is another GAM1338 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:8796 and SEQ ID:8796 respectively, to the nucleotide sequence of GAM1338 RNA, herein designated GAM RNA, also designated SEQ ID:360.

Another function of GAM1338 is therefore inhibition of KIAA1712 (Accession NP_085136.1). Accordingly, utilities of GAM1338 include diagnosis, prevention and treatment of diseases and clinical conditions associated with KIAA1712.

KIAA1724 (Accession XP_040280.2) is another GAM1338 target gene, herein designated TARGET GENE. KIAA1724 BINDING SITE is a target binding site found in the 5' untranslated region of mRNA encoded by KIAA1724, corresponding to a target binding site such as BINDING SITE I, BINDING SITE II or BINDING SITE III of FIG. 8. Table 4 illustrates the complementarity of the nucleotide sequences of KIAA1724 BINDING SITE, designated SEQ ID:12049, to the nucleotide sequence of GAM1338 RNA, herein designated GAM RNA, also designated SEQ ID:360.

Another function of GAM1338 is therefore inhibition of KIAA1724 (Accession XP_040280.2). Accordingly, utilities of GAM1338 include diagnosis, prevention and treatment of diseases and clinical conditions associated with KIAA1724.

KIAA1737 (Accession NP_219494.1) is another GAM1338 target gene, herein designated TARGET GENE. KIAA1737 BINDING SITE1 and KIAA1737 BINDING SITE2 are target binding sites found in untranslated regions of mRNA encoded by KIAA1737, corresponding to target binding sites such as BINDING SITE I, BINDING SITE II or BINDING SITE III of FIG. 8. Table 4 illustrates the complementarity of the nucleotide sequences of KIAA1737 BINDING SITE1 and KIAA1737 BINDING SITE2, designated SEQ ID:12203 and SEQ ID:19235 respectively, to the nucleotide sequence of GAM1338 RNA, herein designated GAM RNA, also designated SEQ ID:360.

Another function of GAM1338 is therefore inhibition of KIAA1737 (Accession NP_219494.1). Accordingly, utilities of GAM1338 include diagnosis, prevention and treatment of diseases and clinical conditions associated with KIAA1737.

KIAA1784 (Accession NP_115820.1) is another GAM1338 target gene, herein designated TARGET GENE. KIAA1784 BINDING SITE is a target binding site found in the 3' untranslated region of mRNA encoded by KIAA1784, corresponding to a target binding site such as BINDING SITE I, BINDING SITE II or BINDING SITE III of FIG. 8. Table 4 illustrates the complementarity of the nucleotide sequences of KIAA1784 BINDING SITE, designated SEQ ID:18884, to the nucleotide sequence of GAM1338 RNA, herein designated GAM RNA, also designated SEQ ID:360.

Another function of GAM1338 is therefore inhibition of KIAA1784 (Accession NP_115820.1). Accordingly, utilities of GAM1338 include diagnosis, prevention and treatment of diseases and clinical conditions associated with KIAA1784.

KIAA1822 (Accession XP_041566.2) is another GAM1338 target gene, herein designated TARGET GENE. KIAA1822 BINDING SITE is a target binding site found in the 3' untranslated region of mRNA encoded by KIAA1822, corresponding to a target binding site such as BINDING SITE I, BINDING SITE II or BINDING SITE III of FIG. 8. Table 4 illustrates the complementarity of the nucleotide sequences of KIAA1822 BINDING SITE, designated SEQ ID:9237, to the nucleotide sequence of GAM1338 RNA, herein designated GAM RNA, also designated SEQ ID:360.

Another function of GAM1338 is therefore inhibition of KIAA1822 (Accession XP_041566.2). Accordingly, utilities of GAM1338 include diagnosis, prevention and treatment of diseases and clinical conditions associated with KIAA1822.

KIAA1827 (Accession XP_290834.1) is another GAM1338 target gene, herein designated TARGET GENE. KIAA1827 BINDING SITE1 and KIAA1827 BINDING SITE2 are target binding sites found in untranslated regions of mRNA encoded by KIAA1827, corresponding to target binding sites such as BINDING SITE I, BINDING SITE II or BINDING SITE III of FIG. 8. Table 4 illustrates the complementarity of the nucleotide sequences of KIAA1827 BINDING SITE1 and KIAA1827 BINDING SITE2, designated SEQ ID:2385 and SEQ ID:19431 respectively, to the nucleotide sequence of GAM1338 RNA, herein designated GAM RNA, also designated SEQ ID:360.

Another function of GAM1338 is therefore inhibition of KIAA1827 (Accession XP_290834.1). Accordingly, utilities of GAM1338 include diagnosis, prevention and treatment of diseases and clinical conditions associated with KIAA1827.

KIAA1829 (Accession XP_030378.2) is another GAM1338 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:12386, to the nucleotide sequence of GAM1338 RNA, herein designated GAM RNA, also designated SEQ ID:360.

Another function of GAM1338 is therefore inhibition of KIAA1829 (Accession XP_030378.2). Accordingly, utilities of GAM1338 include diagnosis, prevention and treatment of diseases and clinical conditions associated with KIAA1829.

KIAA1836 (Accession XP_114087.2) is another GAM1338 target gene, herein designated TARGET GENE. KIAA1836 BINDING SITE is a target binding site found in the 3' untranslated region of mRNA encoded by KIAA1836, corresponding to a target binding site such as BINDING SITE I, BINDING SITE II or BINDING SITE III of FIG. 8. Table 4 illustrates the complementarity of the nucleotide sequences of KIAA1836 BINDING SITE, designated SEQ ID:17519, to the nucleotide sequence of GAM1338 RNA, herein designated GAM RNA, also designated SEQ ID:360.

Another function of GAM1338 is therefore inhibition of KIAA1836 (Accession XP_114087.2). Accordingly, utilities of GAM1338 include diagnosis, prevention and treatment of diseases and clinical conditions associated with KIAA1836.

KIAA1892 (Accession NP_056212.1) is another GAM1338 target gene, herein designated TARGET GENE. KIAA1892 BINDING SITE is a target binding site found in the 3' untranslated region of mRNA encoded by KIAA1892, corresponding to a target binding site such as BINDING SITE I, BINDING SITE II or BINDING SITE III of FIG. 8. Table 4 illustrates the complementarity of the nucleotide sequences of KIAA1892 BINDING SITE, designated SEQ ID:19465, to the nucleotide sequence of GAM1338 RNA, herein designated GAM RNA, also designated SEQ ID:360.

Another function of GAM1338 is therefore inhibition of KIAA1892 (Accession NP_056212.1). Accordingly, utilities of GAM1338 include diagnosis, prevention and treatment of diseases and clinical conditions associated with KIAA1892.

KIAA1922 (Accession XP_057040.1) is another GAM1338 target gene, herein designated TARGET GENE. KIAA1922 BINDING SITE is a target binding site found in the 5' untranslated region of mRNA encoded by KIAA1922, corresponding to a target binding site such as BINDING SITE I, BINDING SITE II or BINDING SITE III of FIG. 8. Table 4 illustrates the complementarity of the nucleotide sequences of KIAA1922 BINDING SITE, designated SEQ ID:18258, to the nucleotide sequence of GAM1338 RNA, herein designated GAM RNA, also designated SEQ ID:360.

Another function of GAM1338 is therefore inhibition of KIAA1922 (Accession XP_057040.1). Accordingly, utilities of GAM1338 include diagnosis, prevention and treatment of diseases and clinical conditions associated with KIAA1922.

KIAA1924 (Accession NP_694971.2) is another GAM1338 target gene, herein designated TARGET GENE. KIAA1924 BINDING SITE1 and KIAA1924 BINDING SITE2 are target binding sites found in untranslated regions of mRNA encoded by KIAA1924, corresponding to target binding sites such as BINDING SITE I, BINDING SITE II or BINDING SITE III of FIG. 8. Table 4 illustrates the complementarity of the nucleotide sequences of KIAA1924 BINDING SITE1 and KIAA1924 BINDING SITE2, designated SEQ ID:12570 and SEQ ID:7825 respectively, to the nucleotide sequence of GAM1338 RNA, herein designated GAM RNA, also designated SEQ ID:360.

Another function of GAM1338 is therefore inhibition of KIAA1924 (Accession NP_694971.2). Accordingly, utilities of GAM1338 include diagnosis, prevention and treatment of diseases and clinical conditions associated with KIAA1924.

KIAA1971 (Accession XP_058720.4) is another GAM1338 target gene, herein designated TARGET GENE. KIAA1971 BINDING SITE1 through KIAA1971 BINDING SITE3 are target binding sites found in untranslated regions of mRNA encoded by KIAA1971, corresponding to target binding sites such as BINDING SITE I, BINDING SITE II or BINDING SITE III of FIG. 8. Table 4 illustrates the complementarity of the nucleotide sequences of KIAA1971 BINDING SITE1 through KIAA1971 BINDING SITE3, designated SEQ ID:19552, SEQ ID:4023 and SEQ ID:13441 respectively, to the nucleotide sequence of GAM1338 RNA, herein designated GAM RNA, also designated SEQ ID:360.

Another function of GAM1338 is therefore inhibition of KIAA1971 (Accession XP_058720.4). Accordingly, utilities of GAM1338 include diagnosis, prevention and treatment of diseases and clinical conditions associated with KIAA1971.

KIAA1987 (Accession XP_113870.1) is another GAM1338 target gene, herein designated TARGET GENE. KIAA1987 BINDING SITE is a target binding site found in the 5' untranslated region of mRNA encoded by KIAA1987, corresponding to a target binding site such as BINDING SITE I, BINDING SITE II or BINDING SITE III of FIG. 8. Table 4 illustrates the complementarity of the nucleotide sequences of KIAA1987 BINDING SITE, designated SEQ ID:18263, to the nucleotide sequence of GAM1338 RNA, herein designated GAM RNA, also designated SEQ ID:360.

Another function of GAM1338 is therefore inhibition of KIAA1987 (Accession XP_113870.1). Accordingly, utilities of GAM1338 include diagnosis, prevention and treatment of diseases and clinical conditions associated with KIAA1987.

KIAA2028 (Accession XP_059415.2) is another GAM1338 target gene, herein designated TARGET GENE. KIAA2028 BINDING SITE is a target binding site found in the 3' untranslated region of mRNA encoded by KIAA2028, corresponding to a target binding site such as BINDING SITE I, BINDING SITE II or BINDING SITE III of FIG. 8. Table 4 illustrates the complementarity of the nucleotide sequences of KIAA2028 BINDING SITE, designated SEQ ID:11722, to the nucleotide sequence of GAM1338 RNA, herein designated GAM RNA, also designated SEQ ID:360.

Another function of GAM1338 is therefore inhibition of KIAA2028 (Accession XP_059415.2). Accordingly, utilities of GAM1338 include diagnosis, prevention and treatment of diseases and clinical conditions associated with KIAA2028.

Kruppel-like factor 12 (KLF12, Accession NP_009180.3) is another GAM1338 target gene, herein designated TARGET GENE. KLF12 BINDING SITE is a target binding site found in the 3' untranslated region of multiple transcripts of mRNA encoded by KLF12, corresponding to a target binding site such as BINDING SITE I, BINDING SITE II or BINDING SITE III of FIG. 8. Table 4 illustrates the complementarity of the nucleotide sequences of KLF12 BINDING SITE, designated SEQ ID:7570, to the nucleotide sequence of GAM1338 RNA, herein designated GAM RNA, also designated SEQ ID:360.

Another function of GAM1338 is therefore inhibition of Kruppel-like factor 12 (KLF12, Accession NP_009180.3). Accordingly, utilities of GAM1338 include diagnosis, prevention and treatment of diseases and clinical conditions associated with KLF12.

Killer cell lectin-like receptor subfamily d, member 1 (KLRD1, Accession NP_002253.1) is another GAM1338 target gene, herein designated TARGET GENE. KLRD1 BINDING SITE is a target binding site found in the 3' untranslated region of multiple transcripts of mRNA encoded by KLRD1, corresponding to a target binding site such as BINDING SITE I, BINDING SITE II or BINDING SITE III of FIG. 8. Table 4 illustrates the complementarity of the nucleotide sequences of KLRD1 BINDING SITE, designated SEQ ID:8689, to the nucleotide sequence of GAM1338 RNA, herein designated GAM RNA, also designated SEQ ID:360.

Another function of GAM1338 is therefore inhibition of Killer cell lectin-like receptor subfamily d, member 1 (KLRD1, Accession NP_002253.1), a gene which is a receptor for the recognition of mhc class i hla- e molecules by nk cells and some cytotoxic t-cells. Accordingly, utilities of GAM1338 include diagnosis, prevention and treatment of diseases and clinical conditions associated with KLRD1.

The function of KLRD1 and its association with various diseases and clinical conditions, has been established by previous studies, as described hereinabove with reference to GAM189.1. Killer cell lectin-like receptor subfamily d, member 1 (KLRD1, Accession NP_031360.1) is another GAM1338 target gene, herein designated TARGET GENE. KLRD1 BINDING SITE is a target binding site found in the 3' untranslated region of multiple transcripts of mRNA encoded by KLRD1, corresponding to a target binding site such as BINDING SITE I, BINDING SITE II or BINDING SITE III of FIG. 8. Table 4 illustrates the complementarity of the nucleotide sequences of KLRD1 BINDING SITE, designated SEQ ID:8689, to the nucleotide sequence of GAM1338 RNA, herein designated GAM RNA, also designated SEQ ID:360.

Another function of GAM1338 is therefore inhibition of Killer cell lectin-like receptor subfamily d, member 1 (KLRD1, Accession NP_031360.1), a gene which is a receptor for the recognition of mhc class i hla- e molecules by nk cells and some cytotoxic t-cells. Accordingly, utilities of GAM1338 include diagnosis, prevention and treatment of diseases and clinical conditions associated with KLRD1.

The function of KLRD1 and its association with various diseases and clinical conditions, has been established by previous studies, as described hereinabove with reference to GAM189.1. Kynurenine 3-monooxygenase (kynurenine 3-hydroxylase) (KMO, Accession NP_003670.1) is another GAM1338 target gene, herein designated TARGET GENE. KMO BINDING SITE is a target binding site found in the 3' untranslated region of mRNA encoded by KMO, corresponding to a target binding site such as BINDING SITE I, BINDING SITE II or BINDING SITE III of FIG. 8. Table 4 illustrates the complementarity of the nucleotide sequences of KMO BINDING SITE, designated SEQ ID:5730, to the nucleotide sequence of GAM1338 RNA, herein designated GAM RNA, also designated SEQ ID:360.

Another function of GAM1338 is therefore inhibition of Kynurenine 3-monooxygenase (kynurenine 3-hydroxylase) (KMO, Accession NP_003670.1), a gene which may play a role in encephalic photoreception. Accordingly, utilities of GAM1338 include diagnosis, prevention and treatment of diseases and clinical conditions associated with KMO.

The function of KMO and its association with various diseases and clinical conditions, has been established by previous studies, as described hereinabove with reference to GAM30.1. Kinase suppressor of ras (KSR, Accession XP_290793.1) is another GAM1338 target gene, herein designated TARGET GENE. KSR BINDING SITE is a target binding site found in the 5' untranslated region of mRNA encoded by KSR, corresponding to a target binding site such as BINDING SITE I, BINDING SITE II or BINDING SITE III of FIG. 8. Table 4 illustrates the complementarity of the nucleotide sequences of KSR BINDING SITE, designated SEQ ID:15951, to the nucleotide sequence of GAM1338 RNA, herein designated GAM RNA, also designated SEQ ID:360.

Another function of GAM1338 is therefore inhibition of Kinase suppressor of ras (KSR, Accession XP_290793.1). Accordingly, utilities of GAM1338 include diagnosis, prevention and treatment of diseases and clinical conditions associated with KSR.

Lysosomal-associated membrane protein 3 (LAMP3, Accession NP_055213.1) is another GAM1338 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:970, to the nucleotide sequence of GAM1338 RNA, herein designated GAM RNA, also designated SEQ ID:360.

Another function of GAM1338 is therefore inhibition of Lysosomal-associated membrane protein 3 (LAMP3, Accession NP_055213.1). Accordingly, utilities of GAM1338 include diagnosis, prevention and treatment of diseases and clinical conditions associated with LAMP3.

Lipocalin 7 (LCN7, Accession NP_071447.1) is another GAM1338 target gene, herein designated TARGET GENE. LCN7 BINDING SITE is a target binding site found in the 3' untranslated region of mRNA encoded by LCN7, corresponding to a target binding site such as BINDING SITE I, BINDING SITE II or BINDING SITE III of FIG. 8. Table 4 illustrates the complementarity of the nucleotide sequences of LCN7 BINDING SITE, designated SEQ ID:3972, to the nucleotide sequence of GAM1338 RNA, herein designated GAM RNA, also designated SEQ ID:360.

Another function of GAM1338 is therefore inhibition of Lipocalin 7 (LCN7, Accession NP_071447.1). Accordingly, utilities of GAM1338 include diagnosis, prevention and treatment of diseases and clinical conditions associated with LCN7.

LCX (Accession XP_167612.2) is another GAM1338 target gene, herein designated TARGET GENE. LCX BINDING SITE is a target binding site found in the 3' untranslated region of mRNA encoded by LCX, corresponding to a target binding site such as BINDING SITE I, BINDING SITE II or BINDING SITE III of FIG. 8. Table 4 illustrates the complementarity of the nucleotide sequences of LCX BINDING SITE, designated SEQ ID:7409, to the nucleotide sequence of GAM1338 RNA, herein designated GAM RNA, also designated SEQ ID:360.

Another function of GAM1338 is therefore inhibition of LCX (Accession XP_167612.2). Accordingly, utilities of GAM1338 include diagnosis, prevention and treatment of diseases and clinical conditions associated with LCX.

LGP1 (Accession NP_115873.1) is another GAM1338 target gene, herein designated TARGET GENE. LGP1 BINDING SITE is a target binding site found in the 5' untranslated region of mRNA encoded by LGP1, corresponding to a target binding site such as BINDING SITE I, BINDING SITE II or BINDING SITE III of FIG. 8. Table 4 illustrates the complementarity of the nucleotide sequences of LGP1 BINDING SITE, designated SEQ ID:20143, to the nucleotide sequence of GAM1338 RNA, herein designated GAM RNA, also designated SEQ ID:360.

Another function of GAM1338 is therefore inhibition of LGP1 (Accession NP_115873.1). Accordingly, utilities of GAM1338 include diagnosis, prevention and treatment of diseases and clinical conditions associated with LGP1.

LIN-28 (Accession NP_078950.1) is another GAM1338 target gene, herein designated TARGET GENE. LIN-28 BINDING SITE is a target binding site found in the 3' untranslated region of mRNA encoded by LIN-28, corresponding to a target binding site such as BINDING SITE I, BINDING SITE II or BINDING SITE III of FIG. 8. Table 4 illustrates the complementarity of the nucleotide sequences of LIN-28 BINDING SITE, designated SEQ ID:6030, to the nucleotide sequence of GAM1338 RNA, herein designated GAM RNA, also designated SEQ ID:360.

Another function of GAM1338 is therefore inhibition of LIN-28 (Accession NP_078950.1). Accordingly, utilities of GAM1338 include diagnosis, prevention and treatment of diseases and clinical conditions associated with LIN-28.

LNK (Accession NP_005466.1) is another GAM1338 target gene, herein designated TARGET GENE. LNK BINDING SITE is a target binding site found in the 3' untranslated region of mRNA encoded by LNK, corresponding to a target binding site such as BINDING SITE I, BINDING SITE II or BINDING SITE III of FIG. 8. Table 4 illustrates the complementarity of the nucleotide sequences of LNK BINDING SITE, designated SEQ ID:9510, to the nucleotide sequence of GAM1338 RNA, herein designated GAM RNA, also designated SEQ ID:360.

Another function of GAM1338 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM1338 include diagnosis, prevention and treatment of diseases and clinical conditions associated with LNK.

The function of LNK and its association with various diseases and clinical conditions, has been established by previous studies, as described hereinabove with reference to GAM130.1. LOC112687 (Accession XP_053145.1) is another GAM1338 target gene, herein designated TARGET GENE. LOC112687 BINDING SITE is a target binding site found in the 3' untranslated region of mRNA encoded by LOC112687, corresponding to a target binding site such as BINDING SITE I, BINDING SITE II or BINDING SITE III of FIG. 8. Table 4 illustrates the complementarity of the nucleotide sequences of LOC112687 BINDING SITE, designated SEQ ID:4875, to the nucleotide sequence of GAM1338 RNA, herein designated GAM RNA, also designated SEQ ID:360.

Another function of GAM1338 is therefore inhibition of LOC112687 (Accession XP_053145.1). Accordingly, utilities of GAM1338 include diagnosis, prevention and treatment of diseases and clinical conditions associated with LOC112687.

LOC113444 (Accession NP_612437.2) is another GAM1338 target gene, herein designated TARGET GENE. LOC113444 BINDING SITE1 through LOC113444 BINDING SITE3 are target binding sites found in untranslated regions of mRNA encoded by LOC113444, corresponding to target binding sites such as BINDING SITE I, BINDING SITE II or BINDING SITE III of FIG. 8. Table 4 illustrates the complementarity of the nucleotide sequences of LOC113444 BINDING SITE1 through LOC113444 BINDING SITE3, designated SEQ ID:14262, SEQ ID:15369 and SEQ ID:15847 respectively, to the nucleotide sequence of GAM1338 RNA, herein designated GAM RNA, also designated SEQ ID:360.

Another function of GAM1338 is therefore inhibition of LOC113444 (Accession NP_612437.2). Accordingly, utilities of GAM1338 include diagnosis, prevention and treatment of diseases and clinical conditions associated with LOC113444.

LOC115123 (Accession XP_055276.1) is another GAM1338 target gene, herein designated TARGET GENE. LOC115123 BINDING SITE is a target binding site found in the 5' untranslated region of mRNA encoded by LOC115123, corresponding to a target binding site such as BINDING SITE I, BINDING SITE II or BINDING SITE III of FIG. 8. Table 4 illustrates the complementarity of the nucleotide sequences of LOC115123 BINDING SITE, designated SEQ ID:8312, to the nucleotide sequence of GAM1338 RNA, herein designated GAM RNA, also designated SEQ ID:360.

Another function of GAM1338 is therefore inhibition of LOC115123 (Accession XP_055276.1). Accordingly, utilities of GAM1338 include diagnosis, prevention and treatment of diseases and clinical conditions associated with LOC115123.

LOC115129 (Accession XP_055292.1) is another GAM1338 target gene, herein designated TARGET GENE. LOC115129 BINDING SITE is a target binding site found in the 3' untranslated region of mRNA encoded by LOC115129, corresponding to a target binding site such as BINDING SITE I, BINDING SITE II or BINDING SITE III of FIG. 8. Table 4 illustrates the complementarity of the nucleotide sequences of LOC115129 BINDING SITE, designated SEQ ID:11459, to the nucleotide sequence of GAM1338 RNA, herein designated GAM RNA, also designated SEQ ID:360.

Another function of GAM1338 is therefore inhibition of LOC115129 (Accession XP_055292.1). Accordingly, utilities of GAM1338 include diagnosis, prevention and treatment of diseases and clinical conditions associated with LOC115129.

LOC115648 (Accession NP_663299.1) is another GAM1338 target gene, herein designated TARGET GENE. LOC115648 BINDING SITE is a target binding site found in the 3' untranslated region of mRNA encoded by LOC115648, corresponding to a target binding site such as BINDING SITE I, BINDING SITE II or BINDING SITE III of FIG. 8. Table 4 illustrates the complementarity of the nucleotide sequences of LOC115648 BINDING SITE, designated SEQ ID:6386, to the nucleotide sequence of GAM1338 RNA, herein designated GAM RNA, also designated SEQ ID:360.

Another function of GAM1338 is therefore inhibition of LOC115648 (Accession NP_663299.1). Accordingly, utilities of GAM1338 include diagnosis, prevention and treatment of diseases and clinical conditions associated with LOC115648.

LOC116411 (Accession XP_058095.1) is another GAM1338 target gene, herein designated TARGET GENE. LOC116411 BINDING SITE is a target binding site found in the 5' untranslated region of mRNA encoded by LOC116411, corresponding to a target binding site such as BINDING SITE I, BINDING SITE II or BINDING SITE III of FIG. 8. Table 4 illustrates the complementarity of the nucleotide sequences of LOC116411 BINDING SITE, designated SEQ ID:1487, to the nucleotide sequence of GAM1338 RNA, herein designated GAM RNA, also designated SEQ ID:360.

Another function of GAM1338 is therefore inhibition of LOC116411 (Accession XP_058095.1). Accordingly, utilities of GAM1338 include diagnosis, prevention and treatment of diseases and clinical conditions associated with LOC116411.

LOC118490 (Accession XP_060981.3) is another GAM1338 target gene, herein designated TARGET GENE. LOC118490 BINDING SITE is a target binding site found in the 3' untranslated region of mRNA encoded by LOC118490, corresponding to a target binding site such as BINDING SITE I, BINDING SITE II or BINDING SITE III of FIG. 8. Table 4 illustrates the complementarity of the nucleotide sequences of LOC118490 BINDING SITE, designated SEQ ID:11022, to the nucleotide sequence of GAM1338 RNA, herein designated GAM RNA, also designated SEQ ID:360.

Another function of GAM1338 is therefore inhibition of LOC118490 (Accession XP_060981.3). Accordingly, utilities of GAM1338 include diagnosis, prevention and treatment of diseases and clinical conditions associated with LOC118490.

LOC118812 (Accession NP_849154.1) is another GAM1338 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:7879, to the nucleotide sequence of GAM1338 RNA, herein designated GAM RNA, also designated SEQ ID:360.

Another function of GAM1338 is therefore inhibition of LOC118812 (Accession NP_849154.1). Accordingly, utilities of GAM1338 include diagnosis, prevention and treatment of diseases and clinical conditions associated with LOC118812.

LOC118812 (Accession XP_058346.2) is another GAM1338 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:7879, to the nucleotide sequence of GAM1338 RNA, herein designated GAM RNA, also designated SEQ ID:360.

Another function of GAM1338 is therefore inhibition of LOC118812 (Accession XP_058346.2). Accordingly, utilities of GAM1338 include diagnosis, prevention and treatment of diseases and clinical conditions associated with LOC118812.

LOC120526 (Accession XP_058475.1) is another GAM1338 target gene, herein designated TARGET GENE. LOC120526 BINDING SITE is a target binding site found in the 3' untranslated region of mRNA encoded by LOC120526, corresponding to a target binding site such as BINDING SITE I, BINDING SITE II or BINDING SITE III of FIG. 8. Table 4 illustrates the complementarity of the nucleotide sequences of LOC120526 BINDING SITE, designated SEQ ID:14215, to the nucleotide sequence of GAM1338 RNA, herein designated GAM RNA, also designated SEQ ID:360.

Another function of GAM1338 is therefore inhibition of LOC120526 (Accession XP_058475.1). Accordingly, utilities of GAM1338 include diagnosis, prevention and treatment of diseases and clinical conditions associated with LOC120526.

LOC121952 (Accession XP_062872.2) is another GAM1338 target gene, herein designated TARGET GENE. LOC121952 BINDING SITE is a target binding site found in the 5' untranslated region of mRNA encoded by LOC121952, corresponding to a target binding site such as BINDING SITE I, BINDING SITE II or BINDING SITE III of FIG. 8. Table 4 illustrates the complementarity of the nucleotide sequences of LOC121952 BINDING SITE, designated SEQ ID:17591, to the nucleotide sequence of GAM1338 RNA, herein designated GAM RNA, also designated SEQ ID:360.

Another function of GAM1338 is therefore inhibition of LOC121952 (Accession XP_062872.2). Accordingly, utilities of GAM1338 include diagnosis, prevention and treatment of diseases and clinical conditions associated with LOC121952.

LOC124221 (Accession XP_058785.3) is another GAM1338 target gene, herein designated TARGET GENE. LOC124221 BINDING SITE is a target binding site found in the 5' untranslated region of mRNA encoded by LOC124221, corresponding to a target binding site such as BINDING SITE I, BINDING SITE II or BINDING SITE III of FIG. 8. Table 4 illustrates the complementarity of the nucleotide sequences of LOC124221 BINDING SITE, designated SEQ ID:14470, to the nucleotide sequence of GAM1338 RNA, herein designated GAM RNA, also designated SEQ ID:360.

Another function of GAM1338 is therefore inhibition of LOC124221 (Accession XP_058785.3). Accordingly, utilities of GAM1338 include diagnosis, prevention and treatment of diseases and clinical conditions associated with LOC124221.

LOC124871 (Accession XP_058857.1) is another GAM1338 target gene, herein designated TARGET GENE. LOC124871 BINDING SITE is a target binding site found in the 3' untranslated region of mRNA encoded by LOC124871, corresponding to a target binding site such as BINDING SITE I, BINDING SITE II or BINDING SITE III of FIG. 8. Table 4 illustrates the complementarity of the nucleotide sequences of LOC124871 BINDING SITE, designated SEQ ID:1585, to the nucleotide sequence of GAM1338 RNA, herein designated GAM RNA, also designated SEQ ID:360.

Another function of GAM1338 is therefore inhibition of LOC124871 (Accession XP_058857.1). Accordingly, utilities of GAM1338 include diagnosis, prevention and treatment of diseases and clinical conditions associated with LOC124871.

LOC125061 (Accession XP_058889.3) is another GAM1338 target gene, herein designated TARGET GENE. LOC125061 BINDING SITE is a target binding site found in the 3' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:9098, to the nucleotide sequence of GAM1338 RNA, herein designated GAM RNA, also designated SEQ ID:360.

Another function of GAM1338 is therefore inhibition of LOC125061 (Accession XP_058889.3). Accordingly, utilities of GAM1338 include diagnosis, prevention and treatment of diseases and clinical conditions associated with LOC125061.

LOC126669 (Accession XP_060121.4) is another GAM1338 target gene, herein designated TARGET GENE. LOC126669 BINDING SITE is a target binding site found in the 3' untranslated region of mRNA encoded by LOC126669, corresponding to a target binding site such as BINDING SITE I, BINDING SITE II or BINDING SITE III of FIG. 8. Table 4 illustrates the complementarity of the nucleotide sequences of LOC126669 BINDING SITE, designated SEQ ID:8179, to the nucleotide sequence of GAM1338 RNA, herein designated GAM RNA, also designated SEQ ID:360.

Another function of GAM1338 is therefore inhibition of LOC126669 (Accession XP_060121.4). Accordingly, utilities of GAM1338 include diagnosis, prevention and treatment of diseases and clinical conditions associated with LOC126669.

LOC127253 (Accession XP_059122.1) is another GAM1338 target gene, herein designated TARGET GENE. LOC127253 BINDING SITE is a target binding site found in the 3' untranslated region of mRNA encoded by LOC127253, corresponding to a target binding site such as BINDING SITE I, BINDING SITE II or BINDING SITE III of FIG. 8. Table 4 illustrates the complementarity of the nucleotide sequences of LOC127253 BINDING SITE, designated SEQ ID:2617, to the nucleotide sequence of GAM1338 RNA, herein designated GAM RNA, also designated SEQ ID:360.

Another function of GAM1338 is therefore inhibition of LOC127253 (Accession XP_059122.1). Accordingly, utilities of GAM1338 include diagnosis, prevention and treatment of diseases and clinical conditions associated with LOC127253.

LOC127841 (Accession XP_059184.1) is another GAM1338 target gene, herein designated TARGET GENE. LOC127841 BINDING SITE is a target binding site found in the 5' untranslated region of mRNA encoded by LOC127841, corresponding to a target binding site such as BINDING SITE I, BINDING SITE II or BINDING SITE III of FIG. 8. Table 4 illustrates the complementarity of the nucleotide sequences of LOC127841 BINDING SITE, designated SEQ ID:5401, to the nucleotide sequence of GAM1338 RNA, herein designated GAM RNA, also designated SEQ ID:360.

Another function of GAM1338 is therefore inhibition of LOC127841 (Accession XP_059184.1). Accordingly, utilities of GAM1338 include diagnosis, prevention and treatment of diseases and clinical conditions associated with LOC127841.

LOC128387 (Accession XP_059243.2) is another GAM1338 target gene, herein designated TARGET GENE. LOC128387 BINDING SITE is a target binding site found in the 3' untranslated region of mRNA encoded by LOC128387, corresponding to a target binding site such as BINDING SITE I, BINDING SITE II or BINDING SITE III of FIG. 8. Table 4 illustrates the complementarity of the nucleotide sequences of LOC128387 BINDING SITE, designated SEQ ID:2302, to the nucleotide sequence of GAM1338 RNA, herein designated GAM RNA, also designated SEQ ID:360.

Another function of GAM1338 is therefore inhibition of LOC128387 (Accession XP_059243.2). Accordingly, utilities of GAM1338 include diagnosis, prevention and treatment of diseases and clinical conditions associated with LOC128387.

LOC132241 (Accession XP_059583.1) is another GAM1338 target gene, herein designated TARGET GENE. LOC132241 BINDING SITE is a target binding site found in the 5' untranslated region of mRNA encoded by LOC132241, corresponding to a target binding site such as BINDING SITE I, BINDING SITE II or BINDING SITE III of FIG. 8. Table 4 illustrates the complementarity of the nucleotide sequences of LOC132241 BINDING SITE, designated SEQ ID:13281, to the nucleotide sequence of GAM1338 RNA, herein designated GAM RNA, also designated SEQ ID:360.

Another function of GAM1338 is therefore inhibition of LOC132241 (Accession XP_059583.1). Accordingly, utilities of GAM1338 include diagnosis, prevention and treatment of diseases and clinical conditions associated with LOC132241.

LOC135293 (Accession XP_072402.4) is another GAM1338 target gene, herein designated TARGET GENE. LOC135293 BINDING SITE1 and LOC135293 BINDING SITE2 are target binding sites found in untranslated regions of mRNA encoded by LOC135293, corresponding to target binding sites such as BINDING SITE I, BINDING SITE II or BINDING SITE III of FIG. 8. Table 4 illustrates the complementarity of the nucleotide sequences of LOC135293 BINDING SITE1 and LOC135293 BINDING SITE2, designated SEQ ID:15178 and SEQ ID:11660 respectively, to the nucleotide sequence of GAM1338 RNA, herein designated GAM RNA, also designated SEQ ID:360.

Another function of GAM1338 is therefore inhibition of LOC135293 (Accession XP_072402.4). Accordingly, utilities of GAM1338 include diagnosis, prevention and treatment of diseases and clinical conditions associated with LOC135293.

LOC135763 (Accession NP_612639.1) is another GAM1338 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:14442, to the nucleotide sequence of GAM1338 RNA, herein designated GAM RNA, also designated SEQ ID:360.

Another function of GAM1338 is therefore inhibition of LOC135763 (Accession NP_612639.1). Accordingly, utilities of GAM1338 include diagnosis, prevention and treatment of diseases and clinical conditions associated with LOC135763.

LOC135818 (Accession XP_059804.4) is another GAM1338 target gene, herein designated TARGET GENE. LOC135818 BINDING SITE is a target binding site found in the 3' untranslated region of mRNA encoded by LOC135818, corresponding to a target binding site such as BINDING SITE I, BINDING SITE II or BINDING SITE III of FIG. 8. Table 4 illustrates the complementarity of the nucleotide sequences of LOC135818 BINDING SITE, designated SEQ ID:7348, to the nucleotide sequence of GAM1338 RNA, herein designated GAM RNA, also designated SEQ ID:360.

Another function of GAM1338 is therefore inhibition of LOC135818 (Accession XP_059804.4). Accordingly, utilities of GAM1338 include diagnosis, prevention and treatment of diseases and clinical conditions associated with LOC135818.

LOC137886 (Accession XP_059929.3) is another GAM1338 target gene, herein designated TARGET GENE. LOC137886 BINDING SITE is a target binding site found in the 3' untranslated region of mRNA encoded by LOC137886, corresponding to a target binding site such as BINDING SITE I, BINDING SITE II or BINDING SITE III of FIG. 8. Table 4 illustrates the complementarity of the nucleotide sequences of LOC137886 BINDING SITE, designated SEQ ID:18258, to the nucleotide sequence of GAM1338 RNA, herein designated GAM RNA, also designated SEQ ID:360.

Another function of GAM1338 is therefore inhibition of LOC137886 (Accession XP_059929.3). Accordingly, utilities of GAM1338 include diagnosis, prevention and treatment of diseases and clinical conditions associated with LOC137886.

LOC139422 (Accession XP_066687.2) is another GAM1338 target gene, herein designated TARGET GENE. LOC139422 BINDING SITE is a target binding site found in the 5' untranslated region of mRNA encoded by LOC139422, corresponding to a target binding site such as BINDING SITE I, BINDING SITE II or BINDING SITE III of FIG. 8. Table 4 illustrates the complementarity of the nucleotide sequences of LOC139422 BINDING SITE, designated SEQ ID:17958, to the nucleotide sequence of GAM1338 RNA, herein designated GAM RNA, also designated SEQ ID:360.

Another function of GAM1338 is therefore inhibition of LOC139422 (Accession XP_066687.2). Accordingly, utilities of GAM1338 include diagnosis, prevention and treatment of diseases and clinical conditions associated with LOC139422.

LOC143241 (Accession NP_620167.1) is another GAM1338 target gene, herein designated TARGET GENE. LOC143241 BINDING SITE is a target binding site found in the 5' untranslated region of mRNA encoded by LOC143241, corresponding to a target binding site such as BINDING SITE I, BINDING SITE II or BINDING SITE III of FIG. 8. Table 4 illustrates the complementarity of the nucleotide sequences of LOC143241 BINDING SITE, designated SEQ ID:13142, to the nucleotide sequence of GAM1338 RNA, herein designated GAM RNA, also designated SEQ ID:360.

Another function of GAM1338 is therefore inhibition of LOC143241 (Accession NP_620167.1). Accordingly, utilities of GAM1338 include diagnosis, prevention and treatment of diseases and clinical conditions associated with LOC143241.

LOC144404 (Accession XP_084852.6) is another GAM1338 target gene, herein designated TARGET GENE. LOC144404 BINDING SITE1 and LOC144404 BINDING SITE2 are target binding sites found in untranslated regions of mRNA encoded by LOC144404, corresponding to target binding sites such as BINDING SITE I, BINDING SITE II or BINDING SITE III of FIG. 8. Table 4 illustrates the complementarity of the nucleotide sequences of LOC144404 BINDING SITE1 and LOC144404 BINDING SITE2, designated SEQ ID:8561 and SEQ ID:11669 respectively, to the nucleotide sequence of GAM1338 RNA, also designated GAM RNA, also designated SEQ ID:360.

Another function of GAM1338 is therefore inhibition of LOC144404 (Accession XP_084852.6). Accordingly, utilities of GAM1338 include diagnosis, prevention and treatment of diseases and clinical conditions associated with LOC144404.

LOC144481 (Accession XP_096611.2) is another GAM1338 target gene, herein designated TARGET GENE. LOC144481 BINDING SITE1 and LOC144481 BINDING SITE2 are target binding sites found in untranslated regions of mRNA encoded by LOC144481, corresponding to target binding sites such as BINDING SITE I, BINDING SITE II or BINDING SITE III of FIG. 8. Table 4 illustrates the complementarity of the nucleotide sequences of LOC144481 BINDING SITE1 and LOC144481 BINDING SITE2, designated SEQ ID:17022 and SEQ ID:16400 respectively, to the nucleotide sequence of GAM1338 RNA, herein designated GAM RNA, also designated SEQ ID:360.

Another function of GAM1338 is therefore inhibition of LOC144481 (Accession XP_096611.2). Accordingly, utilities of GAM1338 include diagnosis, prevention and treatment of diseases and clinical conditions associated with LOC144481.

LOC144742 (Accession XP_084949.1) is another GAM1338 target gene, herein designated TARGET GENE. LOC144742 BINDING SITE is a target binding site found in the 5' untranslated region of mRNA encoded by LOC144742, corresponding to a target binding site such as BINDING SITE I, BINDING SITE II or BINDING SITE III of FIG. 8. Table 4 illustrates the complementarity of the nucleotide sequences of LOC144742 BINDING SITE, designated SEQ ID:15441, to the nucleotide sequence of GAM1338 RNA, herein designated GAM RNA, also designated SEQ ID:360.

Another function of GAM1338 is therefore inhibition of LOC144742 (Accession XP_084949.1). Accordingly, utilities of GAM1338 include diagnosis, prevention and treatment of diseases and clinical conditions associated with LOC144742.

LOC144766 (Accession XP_084963.2) is another GAM1338 target gene, herein designated TARGET GENE. LOC144766 BINDING SITE is a target binding site found in the 5' untranslated region of mRNA encoded by LOC144766, corresponding to a target binding site such as BINDING SITE I, BINDING SITE II or BINDING SITE III of FIG. 8. Table 4 illustrates the complementarity of the nucleotide sequences of LOC144766 BINDING SITE, designated SEQ ID:19847, to the nucleotide sequence of GAM1338 RNA, herein designated GAM RNA, also designated SEQ ID:360.

Another function of GAM1338 is therefore inhibition of LOC144766 (Accession XP_084963.2). Accordingly, utilities of GAM1338 include diagnosis, prevention and treatment of diseases and clinical conditions associated with LOC144766.

LOC144776 (Accession XP_084964.1) is another GAM1338 target gene, herein designated TARGET GENE. LOC144776 BINDING SITE1 and LOC144776 BINDING SITE2 are target binding sites found in untranslated regions of mRNA encoded by LOC144776, corresponding to target binding sites such as BINDING SITE I, BINDING SITE II or BINDING SITE III of FIG. 8. Table 4 illustrates the complementarity of the nucleotide sequences of LOC144776 BINDING SITE1 and LOC144776 BINDING SITE2, designated SEQ ID:14978 and SEQ ID:16958 respectively, to the nucleotide sequence of GAM1338 RNA, herein designated GAM RNA, also designated SEQ ID:360.

Another function of GAM1338 is therefore inhibition of LOC144776 (Accession XP_084964.1). Accordingly, utilities of GAM1338 include diagnosis, prevention and treatment of diseases and clinical conditions associated with LOC144776.

LOC144817 (Accession XP_084972.1) is another GAM1338 target gene, herein designated TARGET GENE. LOC144817 BINDING SITE is a target binding site found in the 5' untranslated region of mRNA encoded by LOC144817, corresponding to a target binding site such as BINDING SITE I, BINDING SITE II or BINDING SITE III of FIG. 8. Table 4 illustrates the complementarity of the nucleotide sequences of LOC144817 BINDING SITE, designated SEQ ID:12382, to the nucleotide sequence of GAM1338 RNA, herein designated GAM RNA, also designated SEQ ID:360.

Another function of GAM1338 is therefore inhibition of LOC144817 (Accession XP_084972.1). Accordingly, utilities of GAM1338 include diagnosis, prevention and treatment of diseases and clinical conditions associated with LOC144817.

LOC144871 (Accession XP_096698.1) is another GAM1338 target gene, herein designated TARGET GENE. LOC144871 BINDING SITE is a target binding site found in the 3' untranslated region of mRNA encoded by LOC144871, corresponding to a target binding site such as BINDING SITE I, BINDING SITE II or BINDING SITE III of FIG. 8. Table 4 illustrates the complementarity of the nucleotide sequences of LOC144871 BINDING SITE, designated SEQ ID:10644, to the nucleotide sequence of GAM1338 RNA, herein designated GAM RNA, also designated SEQ ID:360.

Another function of GAM1338 is therefore inhibition of LOC144871 (Accession XP_096698.1). Accordingly, utilities of GAM1338 include diagnosis, prevention and treatment of diseases and clinical conditions associated with LOC144871.

LOC145268 (Accession XP_085072.1) is another GAM1338 target gene, herein designated TARGET GENE. LOC145268 BINDING SITE is a target binding site found in the 5' untranslated region of mRNA encoded by LOC145268, corresponding to a target binding site such as BINDING SITE I, BINDING SITE II or BINDING SITE III of FIG. 8. Table 4 illustrates the complementarity of the nucleotide sequences of LOC145268 BINDING SITE, designated SEQ ID:15408, to the nucleotide sequence of GAM1338 RNA, herein designated GAM RNA, also designated SEQ ID:360.

Another function of GAM1338 is therefore inhibition of LOC145268 (Accession XP_085072.1). Accordingly, utilities of GAM1338 include diagnosis, prevention and treatment of diseases and clinical conditions associated with LOC145268.

LOC145453 (Accession XP_085120.1) is another GAM1338 target gene, herein designated TARGET GENE. LOC145453 BINDING SITE is a target binding site found in the 5' untranslated region of mRNA encoded by LOC145453, corresponding to a target binding site such as BINDING SITE I, BINDING SITE II or BINDING SITE III of FIG. 8. Table 4 illustrates the complementarity of the nucleotide sequences of LOC145453 BINDING SITE, designated SEQ ID:8486, to the nucleotide sequence of GAM1338 RNA, herein designated GAM RNA, also designated SEQ ID:360.

Another function of GAM1338 is therefore inhibition of LOC145453 (Accession XP_085120.1). Accordingly, utilities of GAM1338 include diagnosis, prevention and treatment of diseases and clinical conditions associated with LOC145453.

LOC145725 (Accession XP_085211.1) is another GAM1338 target gene, herein designated TARGET GENE. LOC145725 BINDING SITE is a target binding site found in the 3' untranslated region of mRNA encoded by LOC145725, corresponding to a target binding site such as BINDING SITE I, BINDING SITE II or BINDING SITE III of FIG. 8. Table 4 illustrates the complementarity of the nucleotide sequences of LOC145725 BINDING SITE, designated SEQ ID:418, to the nucleotide sequence of GAM1338 RNA, herein designated GAM RNA, also designated SEQ ID:360.

Another function of GAM1338 is therefore inhibition of LOC145725 (Accession XP_085211.1). Accordingly, utilities of GAM1338 include diagnosis, prevention and treatment of diseases and clinical conditions associated with LOC145725.

LOC145757 (Accession XP_085227.1) is another GAM1338 target gene, herein designated TARGET GENE. LOC145757 BINDING SITE1 and LOC145757 BINDING SITE2 are target binding sites found in untranslated regions of mRNA encoded by LOC145757, corresponding to target binding sites such as BINDING SITE I, BINDING SITE II or BINDING SITE III of FIG. 8. Table 4 illustrates the complementarity of the nucleotide sequences of LOC145757 BINDING SITE1 and LOC145757 BINDING SITE2, designated SEQ ID:13797 and SEQ ID:3109 respectively, to the nucleotide sequence of GAM1338 RNA, herein designated GAM RNA, also designated SEQ ID:360.

Another function of GAM1338 is therefore inhibition of LOC145757 (Accession XP_085227.1). Accordingly, utilities of GAM1338 include diagnosis, prevention and treatment of diseases and clinical conditions associated with LOC145757.

LOC145842 (Accession XP_085254.1) is another GAM1338 target gene, herein designated TARGET GENE. LOC145842 BINDING SITE is a target binding site found in the 5' untranslated region of mRNA encoded by LOC145842, corresponding to a target binding site such as BINDING SITE I, BINDING SITE II or BINDING SITE III of FIG. 8. Table 4 illustrates the complementarity of the nucleotide sequences of LOC145842 BINDING SITE, designated SEQ ID:16182, to the nucleotide sequence of GAM1338 RNA, herein designated GAM RNA, also designated SEQ ID:360.

Another function of GAM1338 is therefore inhibition of LOC145842 (Accession XP_085254.1). Accordingly, utilities of GAM1338 include diagnosis, prevention and treatment of diseases and clinical conditions associated with LOC145842.

LOC146177 (Accession NP_778229.1) is another GAM1338 target gene, herein designated TARGET GENE. LOC146177 BINDING SITE is a target binding site found in the 5' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:15157, to the nucleotide sequence of GAM1338 RNA, herein designated GAM RNA, also designated SEQ ID:360.

Another function of GAM1338 is therefore inhibition of LOC146177 (Accession NP_778229.1). Accordingly, utilities of GAM1338 include diagnosis, prevention and treatment of diseases and clinical conditions associated with LOC146177.

LOC146229 (Accession XP_085387.1) is another GAM1338 target gene, herein designated TARGET GENE. LOC146229 BINDING SITE1 through LOC146229 BINDING SITE4 are target binding sites found in untranslated regions of mRNA encoded by LOC146229, corresponding to target binding sites such as BINDING SITE I, BINDING SITE II or BINDING SITE III of FIG. 8. Table 4 illustrates the complementarity of the nucleotide sequences of LOC146229 BINDING SITE1 through LOC146229 BINDING SITE4, designated SEQ ID:3109, SEQ ID:8345, SEQ ID:13931 and SEQ ID:5010 respectively, to the nucleotide sequence of GAM1338 RNA, herein designated GAM RNA, also designated SEQ ID:360.

Another function of GAM1338 is therefore inhibition of LOC146229 (Accession XP_085387.1). Accordingly, utilities of GAM1338 include diagnosis, prevention and treatment of diseases and clinical conditions associated with LOC146229.

LOC146346 (Accession XP_085430.1) is another GAM1338 target gene, herein designated TARGET GENE. LOC146346 BINDING SITE1 and LOC146346 BINDING SITE2 are target binding sites found in untranslated regions of mRNA encoded by LOC146346, corresponding to target binding sites such as BINDING SITE I, BINDING SITE II or BINDING SITE III of FIG. 8. Table 4 illustrates the complementarity of the nucleotide sequences of LOC146346 BINDING SITE1 and LOC146346 BINDING SITE2, designated SEQ ID:6781 and SEQ ID:16312 respectively, to the nucleotide sequence of GAM1338 RNA, herein designated GAM RNA, also designated SEQ ID:360.

Another function of GAM1338 is therefore inhibition of LOC146346 (Accession XP_085430.1). Accordingly, utilities of GAM1338 include diagnosis, prevention and treatment of diseases and clinical conditions associated with LOC146346.

LOC146429 (Accession XP_096998.2) is another GAM1338 target gene, herein designated TARGET GENE. LOC146429 BINDING SITE1 and LOC146429 BINDING SITE2 are target binding sites found in untranslated regions of mRNA encoded by LOC146429, corresponding to target binding sites such as BINDING SITE I, BINDING SITE II or BINDING SITE III of FIG. 8. Table 4 illustrates the complementarity of the nucleotide sequences of LOC146429 BINDING SITE1 and LOC146429 BINDING SITE2, designated SEQ ID:13213 and SEQ ID:8579 respectively, to the nucleotide sequence of GAM1338 RNA, herein designated GAM RNA, also designated SEQ ID:360.

Another function of GAM1338 is therefore inhibition of LOC146429 (Accession XP_096998.2). Accordingly, utilities of GAM1338 include diagnosis, prevention and treatment of diseases and clinical conditions associated with LOC146429.

LOC146603 (Accession XP_085514.2) is another GAM1338 target gene, herein designated TARGET GENE. LOC146603 BINDING SITE is a target binding site found in the 5' untranslated region of mRNA encoded by LOC146603, corresponding to a target binding site such as BINDING SITE I, BINDING SITE II or BINDING SITE III of FIG. 8. Table 4 illustrates the complementarity of the nucleotide sequences of LOC146603 BINDING SITE, designated SEQ ID:3109, to the nucleotide sequence of GAM1338 RNA, herein designated GAM RNA, also designated SEQ ID:360.

Another function of GAM1338 is therefore inhibition of LOC146603 (Accession XP_085514.2). Accordingly, utilities of GAM1338 include diagnosis, prevention and treatment of diseases and clinical conditions associated with LOC146603.

LOC146784 (Accession XP_085588.1) is another GAM1338 target gene, herein designated TARGET GENE. LOC146784 BINDING SITE is a target binding site found in the 5' untranslated region of mRNA encoded by LOC146784, corresponding to a target binding site such as BINDING SITE I, BINDING SITE II or BINDING SITE III of FIG. 8. Table 4 illustrates the complementarity of the nucleotide sequences of LOC146784 BINDING SITE, designated SEQ ID:13452, to the nucleotide sequence of GAM1338 RNA, herein designated GAM RNA, also designated SEQ ID:360.

Another function of GAM1338 is therefore inhibition of LOC146784 (Accession XP_085588.1). Accordingly, utilities of GAM1338 include diagnosis, prevention and treatment of diseases and clinical conditions associated with LOC146784.

LOC146839 (Accession XP_097107.1) is another GAM1338 target gene, herein designated TARGET GENE. LOC146839 BINDING SITE is a target binding site found in the 3' untranslated region of mRNA encoded by LOC146839, corresponding to a target binding site such as BINDING SITE I, BINDING SITE II or BINDING SITE III of FIG. 8. Table 4 illustrates the complementarity of the nucleotide sequences of LOC146839 BINDING SITE, designated SEQ ID:11661, to the nucleotide sequence of GAM1338 RNA, herein designated GAM RNA, also designated SEQ ID:360.

Another function of GAM1338 is therefore inhibition of LOC146839 (Accession XP_097107.1). Accordingly, utilities of GAM1338 include diagnosis, prevention and treatment of diseases and clinical conditions associated with LOC146839.

LOC146894 (Accession NP_660316.1) is another GAM1338 target gene, herein designated TARGET GENE. LOC146894 BINDING SITE is a target binding site found in the 3' untranslated region of mRNA encoded by LOC146894, corresponding to a target binding site such as BINDING SITE I, BINDING SITE II or BINDING SITE III of FIG. 8. Table 4 illustrates the complementarity of the nucleotide sequences of LOC146894 BINDING SITE, designated SEQ ID:2386, to the nucleotide sequence of GAM1338 RNA, herein designated GAM RNA, also designated SEQ ID:360.

Another function of GAM1338 is therefore inhibition of LOC146894 (Accession NP_660316.1). Accordingly, utilities of GAM1338 include diagnosis, prevention and treatment of diseases and clinical conditions associated with LOC146894.

LOC146895 (Accession XP_097120.1) is another GAM1338 target gene, herein designated TARGET GENE. LOC146895 BINDING SITE is a target binding site found in the 5' untranslated region of mRNA encoded by LOC146895, corresponding to a target binding site such as BINDING SITE I, BINDING SITE II or BINDING SITE III of FIG. 8. Table 4 illustrates the complementarity of the nucleotide sequences of LOC146895 BINDING SITE, designated SEQ ID:8862, to the nucleotide sequence of GAM1338 RNA, herein designated GAM RNA, also designated SEQ ID:360.

Another function of GAM1338 is therefore inhibition of LOC146895 (Accession XP_097120.1). Accordingly, utilities of GAM1338 include diagnosis, prevention and treatment of diseases and clinical conditions associated with LOC146895.

LOC146901 (Accession XP_097121.1) is another GAM1338 target gene, herein designated TARGET GENE. LOC146901 BINDING SITE is a target binding site found in the 3' untranslated region of mRNA encoded by LOC146901, corresponding to a target binding site such as BINDING SITE I, BINDING SITE II or BINDING SITE III of FIG. 8. Table 4 illustrates the complementarity of the nucleotide sequences of LOC146901 BINDING SITE, designated SEQ ID:12152, to the nucleotide sequence of GAM1338 RNA, herein designated GAM RNA, also designated SEQ ID:360.

Another function of GAM1338 is therefore inhibition of LOC146901 (Accession XP_097121.1). Accordingly, utilities of GAM1338 include diagnosis, prevention and treatment of diseases and clinical conditions associated with LOC146901.

LOC146909 (Accession XP_085634.2) is another GAM1338 target gene, herein designated TARGET GENE. LOC146909 BINDING SITE1 and LOC146909 BINDING SITE2 are target binding sites found in untranslated regions of mRNA encoded by LOC146909, corresponding to target binding sites such as BINDING SITE I, BINDING SITE II or BINDING SITE III of FIG. 8. Table 4 illustrates the complementarity of the nucleotide sequences of LOC146909 BINDING SITE1 and LOC146909 BINDING SITE2, designated SEQ ID:14280 and SEQ ID:20010 respectively, to the nucleotide sequence of GAM1338 RNA, herein designated GAM RNA, also designated SEQ ID:360.

Another function of GAM1338 is therefore inhibition of LOC146909 (Accession XP_085634.2). Accordingly, utilities of GAM1338 include diagnosis, prevention and treatment of diseases and clinical conditions associated with LOC146909.

LOC147071 (Accession XP_054031.5) is another GAM1338 target gene, herein designated TARGET GENE. LOC147071 BINDING SITE is a target binding site found in the 5' untranslated region of mRNA encoded by LOC147071, corresponding to a target binding site such as BINDING SITE I, BINDING SITE II or BINDING SITE III of FIG. 8. Table 4 illustrates the complementarity of the nucleotide sequences of LOC147071 BINDING SITE, designated SEQ ID:6735, to the nucleotide sequence of GAM1338 RNA, herein designated GAM RNA, also designated SEQ ID:360.

Another function of GAM1338 is therefore inhibition of LOC147071 (Accession XP_054031.5). Accordingly, utilities of GAM1338 include diagnosis, prevention and treatment of diseases and clinical conditions associated with LOC147071.

LOC147080 (Accession XP_097182.1) is another GAM1338 target gene, herein designated TARGET GENE. LOC147080 BINDING SITE is a target binding site found in the 5' untranslated region of mRNA encoded by LOC147080, corresponding to a target binding site such as BINDING SITE I, BINDING SITE II or BINDING SITE III of FIG. 8. Table 4 illustrates the complementarity of the nucleotide sequences of LOC147080 BINDING SITE, designated SEQ ID:18093, to the nucleotide sequence of GAM1338 RNA, herein designated GAM RNA, also designated SEQ ID:360.

Another function of GAM1338 is therefore inhibition of LOC147080 (Accession XP_097182.1). Accordingly, utilities of GAM1338 include diagnosis, prevention and treatment of diseases and clinical conditions associated with LOC147080.

LOC147166 (Accession XP_085722.2) is another GAM1338 target gene, herein designated TARGET GENE. LOC147166 BINDING SITE is a target binding site found in the 3' untranslated region of mRNA encoded by LOC147166, corresponding to a target binding site such as BINDING SITE I, BINDING SITE II or BINDING SITE III of FIG. 8. Table 4 illustrates the complementarity of the nucleotide sequences of LOC147166 BINDING SITE, designated SEQ ID:546, to the nucleotide sequence of GAM1338 RNA, herein designated GAM RNA, also designated SEQ ID:360.

Another function of GAM1338 is therefore inhibition of LOC147166 (Accession XP_085722.2). Accordingly, utilities of GAM1338 include diagnosis, prevention and treatment of diseases and clinical conditions associated with LOC147166.

LOC147343 (Accession XP_097225.1) is another GAM1338 target gene, herein designated TARGET GENE. LOC147343 BINDING SITE is a target binding site found in the 5' untranslated region of mRNA encoded by LOC147343, corresponding to a target binding site such as BINDING SITE I, BINDING SITE II or BINDING SITE III of FIG. 8. Table 4 illustrates the complementarity of the nucleotide sequences of LOC147343 BINDING SITE, designated SEQ ID:15088, to the nucleotide sequence of GAM1338 RNA, herein designated GAM RNA, also designated SEQ ID:360.

Another function of GAM1338 is therefore inhibition of LOC147343 (Accession XP_097225.1). Accordingly, utilities of GAM1338 include diagnosis, prevention and treatment of diseases and clinical conditions associated with LOC147343.

LOC147407 (Accession XP_084000.1) is another GAM1338 target gene, herein designated TARGET GENE. LOC147407 BINDING SITE is a target binding site found in the 3' untranslated region of mRNA encoded by LOC147407, corresponding to a target binding site such as BINDING SITE I, BINDING SITE II or BINDING SITE III of FIG. 8. Table 4 illustrates the complementarity of the nucleotide sequences of LOC147407 BINDING SITE, designated SEQ ID:12382, to the nucleotide sequence of GAM1338 RNA, herein designated GAM RNA, also designated SEQ ID:360.

Another function of GAM1338 is therefore inhibition of LOC147407 (Accession XP_084000.1). Accordingly, utilities of GAM1338 include diagnosis, prevention and treatment of diseases and clinical conditions associated with LOC147407.

LOC147622 (Accession XP_097255.1) is another GAM1338 target gene, herein designated TARGET GENE. LOC147622 BINDING SITE is a target binding site found in the 3' untranslated region of mRNA encoded by LOC147622, corresponding to a target binding site such as BINDING SITE I, BINDING SITE II or BINDING SITE III of FIG. 8. Table 4 illustrates the complementarity of the nucleotide sequences of LOC147622 BINDING SITE, designated SEQ ID:10349, to the nucleotide sequence of GAM1338 RNA, herein designated GAM RNA, also designated SEQ ID:360.

Another function of GAM1338 is therefore inhibition of LOC147622 (Accession XP_097255.1). Accordingly, utilities of GAM1338 include diagnosis, prevention and treatment of diseases and clinical conditions associated with LOC147622.

LOC147841 (Accession XP_085924.2) is another GAM1338 target gene, herein designated TARGET GENE. LOC147841 BINDING SITE1 and LOC147841 BINDING SITE2 are target binding sites found in untranslated regions of mRNA encoded by LOC147841, corresponding to target binding sites such as BINDING SITE I, BINDING SITE II or BINDING SITE III of FIG. 8. Table 4 illustrates the complementarity of the nucleotide sequences of LOC147841 BINDING SITE1 and LOC147841 BINDING SITE2, designated SEQ ID:18175 and SEQ ID:15453 respectively, to the nucleotide sequence of GAM1338 RNA, herein designated GAM RNA, also designated SEQ ID:360.

Another function of GAM1338 is therefore inhibition of LOC147841 (Accession XP_085924.2). Accordingly, utilities of GAM1338 include diagnosis, prevention and treatment of diseases and clinical conditions associated with LOC147841.

LOC147947 (Accession XP_085974.1) is another GAM1338 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:438, to the nucleotide sequence of GAM1338 RNA, herein designated GAM RNA, also designated SEQ ID:360.

Another function of GAM1338 is therefore inhibition of LOC147947 (Accession XP_085974.1). Accordingly, utilities of GAM1338 include diagnosis, prevention and treatment of diseases and clinical conditions associated with LOC147947.

LOC148137 (Accession NP_653293.1) is another GAM1338 target gene, herein designated TARGET GENE. LOC148137 BINDING SITE is a target binding site found in the 3' untranslated region of mRNA encoded by LOC148137, corresponding to a target binding site such as BINDING SITE I, BINDING SITE II or BINDING SITE III of FIG. 8. Table 4 illustrates the complementarity of the nucleotide sequences of LOC148137 BINDING SITE, designated SEQ ID:13130, to the nucleotide sequence of GAM1338 RNA, herein designated GAM RNA, also designated SEQ ID:360.

Another function of GAM1338 is therefore inhibition of LOC148137 (Accession NP_653293.1). Accordingly, utilities of GAM1338 include diagnosis, prevention and treatment of diseases and clinical conditions associated with LOC148137.

LOC148198 (Accession XP_047554.4) is another GAM1338 target gene, herein designated TARGET GENE. LOC148198 BINDING SITE is a target binding site found in the 3' untranslated region of mRNA encoded by LOC148198, corresponding to a target binding site such as BINDING SITE I, BINDING SITE II or BINDING SITE III of FIG. 8. Table 4 illustrates the complementarity of the nucleotide sequences of LOC148198 BINDING SITE, designated SEQ ID:7524, to the nucleotide sequence of GAM1338 RNA, herein designated GAM RNA, also designated SEQ ID:360.

Another function of GAM1338 is therefore inhibition of LOC148198 (Accession XP_047554.4). Accordingly, utilities of GAM1338 include diagnosis, prevention and treatment of diseases and clinical conditions associated with LOC148198.

LOC148708 (Accession XP_086286.4) is another GAM1338 target gene, herein designated TARGET GENE. LOC148708 BINDING SITE is a target binding site found in the 3' untranslated region of mRNA encoded by LOC148708, corresponding to a target binding site such as BINDING SITE I, BINDING SITE II or BINDING SITE III of FIG. 8. Table 4 illustrates the complementarity of the nucleotide sequences of LOC148708 BINDING SITE, designated SEQ ID:18164, to the nucleotide sequence of GAM1338 RNA, herein designated GAM RNA, also designated SEQ ID:360.

Another function of GAM1338 is therefore inhibition of LOC148708 (Accession XP_086286.4). Accordingly, utilities of GAM1338 include diagnosis, prevention and treatment of diseases and clinical conditions associated with LOC148708.

LOC148709 (Accession XP_086281.1) is another GAM1338 target gene, herein designated TARGET GENE. LOC148709 BINDING SITE is a target binding site found in the 5' untranslated region of mRNA encoded by LOC148709, corresponding to a target binding site such as BINDING SITE I, BINDING SITE II or BINDING SITE III of FIG. 8. Table 4 illustrates the complementarity of the nucleotide sequences of LOC148709 BINDING SITE, designated SEQ ID:8427, to the nucleotide sequence of GAM1338 RNA, herein designated GAM RNA, also designated SEQ ID:360.

Another function of GAM1338 is therefore inhibition of LOC148709 (Accession XP_086281.1). Accordingly, utilities of GAM1338 include diagnosis, prevention and treatment of diseases and clinical conditions associated with LOC148709.

LOC149149 (Accession XP_097598.1) is another GAM1338 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:9725, to the nucleotide sequence of GAM1338 RNA, herein designated GAM RNA, also designated SEQ ID:360.

Another function of GAM1338 is therefore inhibition of LOC149149 (Accession XP_097598.1). Accordingly, utilities of GAM1338 include diagnosis, prevention and treatment of diseases and clinical conditions associated with LOC149149.

LOC149371 (Accession NP_787072.1) is another GAM1338 target gene, herein designated TARGET GENE. LOC149371 BINDING SITE is a target binding site found in the 3' untranslated region of mRNA encoded by LOC149371, corresponding to a target binding site such as BINDING SITE I, BINDING SITE II or BINDING SITE III of FIG. 8. Table 4 illustrates the complementarity of the nucleotide sequences of LOC149371 BINDING SITE, designated SEQ ID:14762, to the nucleotide sequence of GAM1338 RNA, herein designated GAM RNA, also designated SEQ ID:360.

Another function of GAM1338 is therefore inhibition of LOC149371 (Accession NP_787072.1). Accordingly, utilities of GAM1338 include diagnosis, prevention and treatment of diseases and clinical conditions associated with LOC149371.

LOC149464 (Accession XP_097645.1) is another GAM1338 target gene, herein designated TARGET GENE. LOC149464 BINDING SITE is a target binding site found in the 5' untranslated region of mRNA encoded by LOC149464, corresponding to a target binding site such as BINDING SITE I, BINDING SITE II or BINDING SITE III of FIG. 8. Table 4 illustrates the complementarity of the nucleotide sequences of LOC149464 BINDING SITE, designated SEQ ID:14821, to the nucleotide sequence of GAM1338 RNA, herein designated GAM RNA, also designated SEQ ID:360.

Another function of GAM1338 is therefore inhibition of LOC149464 (Accession XP_097645.1). Accordingly, utilities of GAM1338 include diagnosis, prevention and treatment of diseases and clinical conditions associated with LOC149464.

LOC149466 (Accession XP_086546.1) is another GAM1338 target gene, herein designated TARGET GENE. LOC149466 BINDING SITE is a target binding site found in the 3' untranslated region of mRNA encoded by LOC149466, corresponding to a target binding site such as BINDING SITE I, BINDING SITE II or BINDING SITE III of FIG. 8. Table 4 illustrates the complementarity of the nucleotide sequences of LOC149466 BINDING SITE, designated SEQ ID:982, to the nucleotide sequence of GAM1338 RNA, herein designated GAM RNA, also designated SEQ ID:360.

Another function of GAM1338 is therefore inhibition of LOC149466 (Accession XP_086546.1). Accordingly, utilities of GAM1338 include diagnosis, prevention and treatment of diseases and clinical conditions associated with LOC149466.

LOC149478 (Accession XP_086536.1) is another GAM1338 target gene, herein designated TARGET GENE. LOC149478 BINDING SITE is a target binding site found in the 3' untranslated region of mRNA encoded by LOC149478, corresponding to a target binding site such as BINDING SITE I, BINDING SITE II or BINDING SITE III of FIG. 8. Table 4 illustrates the complementarity of the nucleotide sequences of LOC149478 BINDING SITE, designated SEQ ID:2514, to the nucleotide sequence of GAM1338 RNA, herein designated GAM RNA, also designated SEQ ID:360.

Another function of GAM1338 is therefore inhibition of LOC149478 (Accession XP_086536.1). Accordingly, utilities of GAM1338 include diagnosis, prevention and treatment of diseases and clinical conditions associated with LOC149478.

LOC149506 (Accession XP_097661.1) is another GAM1338 target gene, herein designated TARGET GENE. LOC149506 BINDING SITE1 and LOC149506 BINDING SITE2 are target binding sites found in untranslated regions of mRNA encoded by LOC149506, corresponding to target binding sites such as BINDING SITE I, BINDING SITE II or BINDING SITE III of FIG. 8. Table 4 illustrates the complementarity of the nucleotide sequences of LOC149506 BINDING SITE1 and LOC149506 BINDING SITE2, designated SEQ ID:17503 and SEQ ID:5777 respectively, to the nucleotide sequence of GAM1338 RNA, herein designated GAM RNA, also designated SEQ ID:360.

Another function of GAM1338 is therefore inhibition of LOC149506 (Accession XP_097661.1). Accordingly, utilities of GAM1338 include diagnosis, prevention and treatment of diseases and clinical conditions associated with LOC149506.

LOC149692 (Accession XP_097706.1) is another GAM1338 target gene, herein designated TARGET GENE. LOC149692 BINDING SITE is a target binding site found in the 3' untranslated region of mRNA encoded by LOC149692, corresponding to a target binding site such as BINDING SITE I, BINDING SITE II or BINDING SITE III of FIG. 8. Table 4 illustrates the complementarity of the nucleotide sequences of LOC149692 BINDING SITE, designated SEQ ID:13800, to the nucleotide sequence of GAM1338 RNA, herein designated GAM RNA, also designated SEQ ID:360.

Another function of GAM1338 is therefore inhibition of LOC149692 (Accession XP_097706.1). Accordingly, utilities of GAM1338 include diagnosis, prevention and treatment of diseases and clinical conditions associated with LOC149692.

LOC149703 (Accession XP_097719.1) is another GAM1338 target gene, herein designated TARGET GENE. LOC149703 BINDING SITE is a target binding site found in the 5' untranslated region of mRNA encoded by LOC149703, corresponding to a target binding site such as BINDING SITE I, BINDING SITE II or BINDING SITE III of FIG. 8. Table 4 illustrates the complementarity of the nucleotide sequences of LOC149703 BINDING SITE, designated SEQ ID:19805, to the nucleotide sequence of GAM1338 RNA, herein designated GAM RNA, also designated SEQ ID:360.

Another function of GAM1338 is therefore inhibition of LOC149703 (Accession XP_097719.1). Accordingly, utilities of GAM1338 include diagnosis, prevention and treatment of diseases and clinical conditions associated with LOC149703.

LOC150054 (Accession XP_097797.1) is another GAM1338 target gene, herein designated TARGET GENE. LOC150054 BINDING SITE is a target binding site found in the 5' untranslated region of mRNA encoded by LOC150054, corresponding to a target binding site such as BINDING SITE I, BINDING SITE II or BINDING SITE III of FIG. 8. Table 4 illustrates the complementarity of the nucleotide sequences of LOC150054 BINDING SITE, designated SEQ ID:18175, to the nucleotide sequence of GAM1338 RNA, herein designated GAM RNA, also designated SEQ ID:360.

Another function of GAM1338 is therefore inhibition of LOC150054 (Accession XP_097797.1). Accordingly, utilities of GAM1338 include diagnosis, prevention and treatment of diseases and clinical conditions associated with LOC150054.

LOC150225 (Accession XP_097870.1) is another GAM1338 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:1664, to the nucleotide sequence of GAM1338 RNA, herein designated GAM RNA, also designated SEQ ID:360.

Another function of GAM1338 is therefore inhibition of LOC150225 (Accession XP_097870.1). Accordingly, utilities of GAM1338 include diagnosis, prevention and treatment of diseases and clinical conditions associated with LOC150225.

LOC150356 (Accession XP_086884.2) is another GAM1338 target gene, herein designated TARGET GENE. LOC150356 BINDING SITE is a target binding site found in the 5' untranslated region of mRNA encoded by LOC150356, corresponding to a target binding site such as BINDING SITE I, BINDING SITE II or BINDING SITE III of FIG. 8. Table 4 illustrates the complementarity of the nucleotide sequences of LOC150356 BINDING SITE, designated SEQ ID:19150, to the nucleotide sequence of GAM1338 RNA, herein designated GAM RNA, also designated SEQ ID:360.

Another function of GAM1338 is therefore inhibition of LOC150356 (Accession XP_086884.2). Accordingly, utilities of GAM1338 include diagnosis, prevention and treatment of diseases and clinical conditions associated with LOC150356.

LOC150407 (Accession XP_086906.1) is another GAM1338 target gene, herein designated TARGET GENE. LOC150407 BINDING SITE is a target binding site found in the 3' untranslated region of mRNA encoded by LOC150407, corresponding to a target binding site such as BINDING SITE I, BINDING SITE II or BINDING SITE III of FIG. 8. Table 4 illustrates the complementarity of the nucleotide sequences of LOC150407 BINDING SITE, designated SEQ ID:2430, to the nucleotide sequence of GAM1338 RNA, herein designated GAM RNA, also designated SEQ ID:360.

Another function of GAM1338 is therefore inhibition of LOC150407 (Accession XP_086906.1). Accordingly, utilities of GAM1338 include diagnosis, prevention and treatment of diseases and clinical conditions associated with LOC150407.

LOC150587 (Accession XP_097917.1) is another GAM1338 target gene, herein designated TARGET GENE. LOC150587 BINDING SITE is a target binding site found in the 5' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:8861, to the nucleotide sequence of GAM1338 RNA, herein designated GAM RNA, also designated SEQ ID:360.

Another function of GAM1338 is therefore inhibition of LOC150587 (Accession XP_097917.1). Accordingly, utilities of GAM1338 include diagnosis, prevention and treatment of diseases and clinical conditions associated with LOC150587.

LOC151057 (Accession XP_097998.1) is another GAM1338 target gene, herein designated TARGET GENE. LOC151057 BINDING SITE is a target binding site found in the 3' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:5519, to the nucleotide sequence of GAM1338 RNA, herein designated GAM RNA, also designated SEQ ID:360.

Another function of GAM1338 is therefore inhibition of LOC151057 (Accession XP_097998.1). Accordingly, utilities of GAM1338 include diagnosis, prevention and treatment of diseases and clinical conditions associated with LOC151057.

LOC151124 (Accession XP_098006.1) is another GAM1338 target gene, herein designated TARGET GENE. LOC151124 BINDING SITE is a target binding site found in the 5' untranslated region of mRNA encoded by LOC151124, corresponding to a target binding site such as BINDING SITE I, BINDING SITE II or BINDING SITE III of FIG. 8. Table 4 illustrates the complementarity of the nucleotide sequences of LOC151124 BINDING SITE, designated SEQ ID:13932, to the nucleotide sequence of GAM1338 RNA, herein designated GAM RNA, also designated SEQ ID:360.

Another function of GAM1338 is therefore inhibition of LOC151124 (Accession XP_098006.1). Accordingly, utilities of GAM1338 include diagnosis, prevention and treatment of diseases and clinical conditions associated with LOC151124.

LOC151196 (Accession XP_098019.1) is another GAM1338 target gene, herein designated TARGET GENE. LOC151196 BINDING SITE is a target binding site found in the 3' untranslated region of mRNA encoded by LOC151196, corresponding to a target binding site such as BINDING SITE I, BINDING SITE II or BINDING SITE III of FIG. 8. Table 4 illustrates the complementarity of the nucleotide sequences of LOC151196 BINDING SITE, designated SEQ ID:12600, to the nucleotide sequence of GAM1338 RNA, herein designated GAM RNA, also designated SEQ ID:360.

Another function of GAM1338 is therefore inhibition of LOC151196 (Accession XP_098019.1). Accordingly, utilities of GAM1338 include diagnosis, prevention and treatment of diseases and clinical conditions associated with LOC151196.

LOC151201 (Accession XP_098021.1) is another GAM1338 target gene, herein designated TARGET GENE. LOC151201 BINDING SITE is a target binding site found in the 3' untranslated region of mRNA encoded by LOC151201, corresponding to a target binding site such as BINDING SITE I, BINDING SITE II or BINDING SITE III of FIG. 8. Table 4 illustrates the complementarity of the nucleotide sequences of LOC151201 BINDING SITE, designated SEQ ID:11934, to the nucleotide sequence of GAM1338 RNA, herein designated GAM RNA, also designated SEQ ID:360.

Another function of GAM1338 is therefore inhibition of LOC151201 (Accession XP_098021.1). Accordingly, utilities of GAM1338 include diagnosis, prevention and treatment of diseases and clinical conditions associated with LOC151201.

LOC151475 (Accession XP_098063.1) is another GAM1338 target gene, herein designated TARGET GENE. LOC151475 BINDING SITE1 and LOC151475 BINDING SITE2 are target binding sites found in untranslated regions of mRNA encoded by LOC151475, corresponding to target binding sites such as BINDING SITE I, BINDING SITE II or BINDING SITE III of FIG. 8. Table 4 illustrates the complementarity of the nucleotide sequences of LOC151475 BINDING SITE1 and LOC151475 BINDING SITE2, designated SEQ ID:7086 and SEQ ID:15680 respectively, to the nucleotide sequence of GAM1338 RNA, herein designated GAM RNA, also designated SEQ ID:360.

Another function of GAM1338 is therefore inhibition of LOC151475 (Accession XP_098063.1). Accordingly, utilities of GAM1338 include diagnosis, prevention and treatment of diseases and clinical conditions associated with LOC151475.

LOC151636 (Accession NP_612144.1) is another GAM1338 target gene, herein designated TARGET GENE. LOC151636 BINDING SITE1 through LOC151636 BINDING SITE3 are target binding sites found in untranslated regions of mRNA encoded by LOC151636, corresponding to target binding sites such as BINDING SITE I, BINDING SITE II or BINDING SITE III of FIG. 8. Table 4 illustrates the complementarity of the nucleotide sequences of LOC151636 BINDING SITE1 through LOC151636 BINDING SITE3, designated SEQ ID:19982, SEQ ID:896 and SEQ ID:2479 respectively, to the nucleotide sequence of GAM1338 RNA, herein designated GAM RNA, also designated SEQ ID:360.

Another function of GAM1338 is therefore inhibition of LOC151636 (Accession NP_612144.1). Accordingly, utilities of GAM1338 include diagnosis, prevention and treatment of diseases and clinical conditions associated with LOC151636.

LOC151979 (Accession XP_087354.5) is another GAM1338 target gene, herein designated TARGET GENE. LOC151979 BINDING SITE is a target binding site found in the 5' untranslated region of mRNA encoded by LOC151979, corresponding to a target binding site such as BINDING SITE I, BINDING SITE II or BINDING SITE III of FIG. 8. Table 4 illustrates the complementarity of the nucleotide sequences of LOC151979 BINDING SITE, designated SEQ ID:2865, to the nucleotide sequence of GAM1338 RNA, herein designated GAM RNA, also designated SEQ ID:360.

Another function of GAM1338 is therefore inhibition of LOC151979 (Accession XP_087354.5). Accordingly, utilities of GAM1338 include diagnosis, prevention and treatment of diseases and clinical conditions associated with LOC151979.

LOC152245 (Accession XP_098182.1) is another GAM1338 target gene, herein designated TARGET GENE. LOC152245 BINDING SITE1 and LOC152245 BINDING SITE2 are target binding sites found in untranslated regions of mRNA encoded by LOC152245, corresponding to target binding sites such as BINDING SITE I, BINDING SITE II or BINDING SITE III of FIG. 8. Table 4 illustrates the complementarity of the nucleotide sequences of LOC152245 BINDING SITE1 and LOC152245 BINDING SITE2, designated SEQ ID:19257 and SEQ ID:1714 respectively, to the nucleotide sequence of GAM1338 RNA, herein designated GAM RNA, also designated SEQ ID:360.

Another function of GAM1338 is therefore inhibition of LOC152245 (Accession XP_098182.1). Accordingly, utilities of GAM1338 include diagnosis, prevention and treatment of diseases and clinical conditions associated with LOC152245.

LOC152445 (Accession XP_098231.1) is another GAM1338 target gene, herein designated TARGET GENE. LOC152445 BINDING SITE is a target binding site found in the 3' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:13905, to the nucleotide sequence of GAM1338 RNA, herein designated GAM RNA, also designated SEQ ID:360.

Another function of GAM1338 is therefore inhibition of LOC152445 (Accession XP_098231.1). Accordingly, utilities of GAM1338 include diagnosis, prevention and treatment of diseases and clinical conditions associated with LOC152445.

LOC152620 (Accession XP_011108.2) is another GAM1338 target gene, herein designated TARGET GENE. LOC152620 BINDING SITE is a target binding site found in the 3' untranslated region of mRNA encoded by LOC152620, corresponding to a target binding site such as BINDING SITE I, BINDING SITE II or BINDING SITE III of FIG. 8. Table 4 illustrates the complementarity of the nucleotide sequences of LOC152620 BINDING SITE, designated SEQ ID:13870, to the nucleotide sequence of GAM1338 RNA, herein designated GAM RNA, also designated SEQ ID:360.

Another function of GAM1338 is therefore inhibition of LOC152620 (Accession XP_011108.2). Accordingly, utilities of GAM1338 include diagnosis, prevention and treatment of diseases and clinical conditions associated with LOC152620.

LOC152719 (Accession XP_098257.1) is another GAM1338 target gene, herein designated TARGET GENE. LOC152719 BINDING SITE1 and LOC152719 BINDING SITE2 are target binding sites found in untranslated regions of mRNA encoded by LOC152719, corresponding to target binding sites such as BINDING SITE I, BINDING SITE II or BINDING SITE III of FIG. 8. Table 4 illustrates the complementarity of the nucleotide sequences of LOC152719 BINDING SITE1 and LOC152719 BINDING SITE2, designated SEQ ID:1141 and SEQ ID:7621 respectively, to the nucleotide sequence of GAM1338 RNA, herein designated GAM RNA, also designated SEQ ID:360.

Another function of GAM1338 is therefore inhibition of LOC152719 (Accession XP_098257.1). Accordingly, utilities of GAM1338 include diagnosis, prevention and treatment of diseases and clinical conditions associated with LOC152719.

LOC152794 (Accession XP_087525.1) is another GAM1338 target gene, herein designated TARGET GENE. LOC152794 BINDING SITE is a target binding site found in the 5' untranslated region of mRNA encoded by LOC152794, corresponding to a target binding site such as BINDING SITE I, BINDING SITE II or BINDING SITE III of FIG. 8. Table 4 illustrates the complementarity of the nucleotide sequences of LOC152794 BINDING SITE, designated SEQ ID:3556, to the nucleotide sequence of GAM1338 RNA, herein designated GAM RNA, also designated SEQ ID:360.

Another function of GAM1338 is therefore inhibition of LOC152794 (Accession XP_087525.1). Accordingly, utilities of GAM1338 include diagnosis, prevention and treatment of diseases and clinical conditions associated with LOC152794.

LOC152804 (Accession XP_098266.2) is another GAM1338 target gene, herein designated TARGET GENE. LOC152804 BINDING SITE is a target binding site found in the 3' untranslated region of mRNA encoded by LOC152804, corresponding to a target binding site such as BINDING SITE I, BINDING SITE II or BINDING SITE III of FIG. 8. Table 4 illustrates the complementarity of the nucleotide sequences of LOC152804 BINDING SITE, designated SEQ ID:8155, to the nucleotide sequence of GAM1338 RNA, herein designated GAM RNA, also designated SEQ ID:360.

Another function of GAM1338 is therefore inhibition of LOC152804 (Accession XP_098266.2). Accordingly, utilities of GAM1338 include diagnosis, prevention and treatment of diseases and clinical conditions associated with LOC152804.

LOC153077 (Accession XP_098307.1) is another GAM1338 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:19370, to the nucleotide sequence of GAM1338 RNA, herein designated GAM RNA, also designated SEQ ID:360.

Another function of GAM1338 is therefore inhibition of LOC153077 (Accession XP_098307.1). Accordingly, utilities of GAM1338 include diagnosis, prevention and treatment of diseases and clinical conditions associated with LOC153077.

LOC153811 (Accession XP_087779.2) is another GAM1338 target gene, herein designated TARGET GENE. LOC153811 BINDING SITE1 through LOC153811 BINDING SITE4 are target binding sites found in untranslated regions of mRNA encoded by LOC153811, corresponding to target binding sites such as BINDING SITE I, BINDING SITE II or BINDING SITE III of FIG. 8. Table 4 illustrates the complementarity of the nucleotide sequences of LOC153811 BINDING SITE1 through LOC153811 BINDING SITE4, designated SEQ ID:15030, SEQ ID:10119, SEQ ID:6031 and SEQ ID:14281 respectively, to the nucleotide sequence of GAM1338 RNA, herein designated GAM RNA, also designated SEQ ID:360.

Another function of GAM1338 is therefore inhibition of LOC153811 (Accession XP_087779.2). Accordingly, utilities of GAM1338 include diagnosis, prevention and treatment of diseases and clinical conditions associated with LOC153811.

LOC153883 (Accession XP_087798.1) is another GAM1338 target gene, herein designated TARGET GENE. LOC153883 BINDING SITE is a target binding site found in the 5' untranslated region of mRNA encoded by LOC153883, corresponding to a target binding site such as BINDING SITE I, BINDING SITE II or BINDING SITE III of FIG. 8. Table 4 illustrates the complementarity of the nucleotide sequences of LOC153883 BINDING SITE, designated SEQ ID:3293, to the nucleotide sequence of GAM1338 RNA, herein designated GAM RNA, also designated SEQ ID:360.

Another function of GAM1338 is therefore inhibition of LOC153883 (Accession XP_087798.1). Accordingly, utilities of GAM1338 include diagnosis, prevention and treatment of diseases and clinical conditions associated with LOC153883.

LOC153910 (Accession XP_087801.1) is another GAM1338 target gene, herein designated TARGET GENE. LOC153910 BINDING SITE is a target binding site found in the 5' untranslated region of mRNA encoded by LOC153910, corresponding to a target binding site such as BINDING SITE I, BINDING SITE II or BINDING SITE III of FIG. 8. Table 4 illustrates the complementarity of the nucleotide sequences of LOC153910 BINDING SITE, designated SEQ ID:7292, to the nucleotide sequence of GAM1338 RNA, herein designated GAM RNA, also designated SEQ ID:360.

Another function of GAM1338 is therefore inhibition of LOC153910 (Accession XP_087801.1). Accordingly, utilities of GAM1338 include diagnosis, prevention and treatment of diseases and clinical conditions associated with LOC153910.

LOC154282 (Accession XP_098505.1) is another GAM1338 target gene, herein designated TARGET GENE. LOC154282 BINDING SITE is a target binding site found in the 5' untranslated region of mRNA encoded by LOC154282, corresponding to a target binding site such as BINDING SITE I, BINDING SITE II or BINDING SITE III of FIG. 8. Table 4 illustrates the complementarity of the nucleotide sequences of LOC154282 BINDING SITE, designated SEQ ID:14848, to the nucleotide sequence of GAM1338 RNA, herein designated GAM RNA, also designated SEQ ID:360.

Another function of GAM1338 is therefore inhibition of LOC154282 (Accession XP_098505.1). Accordingly, utilities of GAM1338 include diagnosis, prevention and treatment of diseases and clinical conditions associated with LOC154282.

LOC154822 (Accession XP_098618.3) is another GAM1338 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:3008, to the nucleotide sequence of GAM1338 RNA, herein designated GAM RNA, also designated SEQ ID:360.

Another function of GAM1338 is therefore inhibition of LOC154822 (Accession XP_098618.3). Accordingly, utilities of GAM1338 include diagnosis, prevention and treatment of diseases and clinical conditions associated with LOC154822.

LOC154877 (Accession XP_098626.1) is another GAM1338 target gene, herein designated TARGET GENE. LOC154877 BINDING SITE1 through LOC154877 BINDING SITE4 are target binding sites found in untranslated regions of mRNA encoded by LOC154877, corresponding to target binding sites such as BINDING SITE I, BINDING SITE II or BINDING SITE III of FIG. 8. Table 4 illustrates the complementarity of the nucleotide sequences of LOC154877 BINDING SITE1 through LOC154877 BINDING SITE4, designated SEQ ID:3038, SEQ ID:15947, SEQ ID:14342 and SEQ ID:14885 respectively, to the nucleotide sequence of GAM1338 RNA, herein designated GAM RNA, also designated SEQ ID:360.

Another function of GAM1338 is therefore inhibition of LOC154877 (Accession XP_098626.1). Accordingly, utilities of GAM1338 include diagnosis, prevention and treatment of diseases and clinical conditions associated with LOC154877.

LOC155066 (Accession XP_088142.4) is another GAM1338 target gene, herein designated TARGET GENE. LOC155066 BINDING SITE is a target binding site found in the 3' untranslated region of mRNA encoded by LOC155066, corresponding to a target binding site such as BINDING SITE I, BINDING SITE II or BINDING SITE III of FIG. 8. Table 4 illustrates the complementarity of the nucleotide sequences of LOC155066 BINDING SITE, designated SEQ ID:13906, to the nucleotide sequence of GAM1338 RNA, herein designated GAM RNA, also designated SEQ ID:360.

Another function of GAM1338 is therefore inhibition of LOC155066 (Accession XP_088142.4). Accordingly, utilities of GAM1338 include diagnosis, prevention and treatment of diseases and clinical conditions associated with LOC155066.

LOC158014 (Accession XP_088442.1) is another GAM1338 target gene, herein designated TARGET GENE. LOC158014 BINDING SITE is a target binding site found in the 5' untranslated region of mRNA encoded by LOC158014, corresponding to a target binding site such as BINDING SITE I, BINDING SITE II or BINDING SITE III of FIG. 8. Table 4 illustrates the complementarity of the nucleotide sequences of LOC158014 BINDING SITE, designated SEQ ID:12285, to the nucleotide sequence of GAM1338 RNA, herein designated GAM RNA, also designated SEQ ID:360.

Another function of GAM1338 is therefore inhibition of LOC158014 (Accession XP_088442.1). Accordingly, utilities of GAM1338 include diagnosis, prevention and treatment of diseases and clinical conditions associated with LOC158014.

LOC158228 (Accession XP_098903.4) is another GAM1338 target gene, herein designated TARGET GENE. LOC158228 BINDING SITE is a target binding site found in the 3' untranslated region of mRNA encoded by LOC158228, corresponding to a target binding site such as BINDING SITE I, BINDING SITE II or BINDING SITE III of FIG. 8. Table 4 illustrates the complementarity of the nucleotide sequences of LOC158228 BINDING SITE, designated SEQ ID:8757, to the nucleotide sequence of GAM1338 RNA, herein designated GAM RNA, also designated SEQ ID:360.

Another function of GAM1338 is therefore inhibition of LOC158228 (Accession XP_098903.4). Accordingly, utilities of GAM1338 include diagnosis, prevention and treatment of diseases and clinical conditions associated with LOC158228.

LOC158310 (Accession XP_098919.1) is another GAM1338 target gene, herein designated TARGET GENE. LOC158310 BINDING SITE is a target binding site found in the 5' untranslated region of mRNA encoded by LOC158310, corresponding to a target binding site such as BINDING SITE I, BINDING SITE II or BINDING SITE III of FIG. 8. Table 4 illustrates the complementarity of the nucleotide sequences of LOC158310 BINDING SITE, designated SEQ ID:18175, to the nucleotide sequence of GAM1338 RNA, herein designated GAM RNA, also designated SEQ ID:360.

Another function of GAM1338 is therefore inhibition of LOC158310 (Accession XP_098919.1). Accordingly, utilities of GAM1338 include diagnosis, prevention and treatment of diseases and clinical conditions associated with LOC158310.

LOC158402 (Accession XP_098936.1) is another GAM1338 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:1414, to the nucleotide sequence of GAM1338 RNA, herein designated GAM RNA, also designated SEQ ID:360.

Another function of GAM1338 is therefore inhibition of LOC158402 (Accession XP_098936.1). Accordingly, utilities of GAM1338 include diagnosis, prevention and treatment of diseases and clinical conditions associated with LOC158402.

LOC158436 (Accession XP_098942.1) is another GAM1338 target gene, herein designated TARGET GENE. LOC158436 BINDING SITE is a target binding site found in the 3' untranslated region of mRNA encoded by LOC158436, corresponding to a target binding site such as BINDING SITE I, BINDING SITE II or BINDING SITE III of FIG. 8. Table 4 illustrates the complementarity of the nucleotide sequences of LOC158436 BINDING SITE, designated SEQ ID:7071, to the nucleotide sequence of GAM1338 RNA, herein designated GAM RNA, also designated SEQ ID:360.

Another function of GAM1338 is therefore inhibition of LOC158436 (Accession XP_098942.1). Accordingly, utilities of GAM1338 include diagnosis, prevention and treatment of diseases and clinical conditions associated with LOC158436.

LOC158476 (Accession XP_098955.1) is another GAM1338 target gene, herein designated TARGET GENE. LOC158476 BINDING SITE1 and LOC158476 BINDING SITE2 are target binding sites found in untranslated regions of mRNA encoded by LOC158476, corresponding to target binding sites such as BINDING SITE I, BINDING SITE II or BINDING SITE III of FIG. 8. Table 4 illustrates the complementarity of the nucleotide sequences of LOC158476 BINDING SITE1 and LOC158476 BINDING SITE2, designated SEQ ID:1355 and SEQ ID:436 respectively, to the nucleotide sequence of GAM1338 RNA, herein designated GAM RNA, also designated SEQ ID:360.

Another function of GAM1338 is therefore inhibition of LOC158476 (Accession XP_098955.1). Accordingly, utilities of GAM1338 include diagnosis, prevention and treatment of diseases and clinical conditions associated with LOC158476.

LOC158668 (Accession XP_045161.1) is another GAM1338 target gene, herein designated TARGET GENE. LOC158668 BINDING SITE is a target binding site found in the 3' untranslated region of mRNA encoded by LOC158668, corresponding to a target binding site such as BINDING SITE I, BINDING SITE II or BINDING SITE III of FIG. 8. Table 4 illustrates the complementarity of the nucleotide sequences of LOC158668 BINDING SITE, designated SEQ ID:19124, to the nucleotide sequence of GAM1338 RNA, herein designated GAM RNA, also designated SEQ ID:360.

Another function of GAM1338 is therefore inhibition of LOC158668 (Accession XP_045161.1). Accordingly, utilities of GAM1338 include diagnosis, prevention and treatment of diseases and clinical conditions associated with LOC158668.

LOC160897 (Accession XP_090573.3) is another GAM1338 target gene, herein designated TARGET GENE. LOC160897 BINDING SITE is a target binding site found in the 5' untranslated region of mRNA encoded by LOC160897, corresponding to a target binding site such as BINDING SITE I, BINDING SITE II or BINDING SITE III of FIG. 8. Table 4 illustrates the complementarity of the nucleotide sequences of LOC160897 BINDING SITE, designated SEQ ID:14437, to the nucleotide sequence of GAM1338 RNA, herein designated GAM RNA, also designated SEQ ID:360.

Another function of GAM1338 is therefore inhibition of LOC160897 (Accession XP_090573.3). Accordingly, utilities of GAM1338 include diagnosis, prevention and treatment of diseases and clinical conditions associated with LOC160897.

LOC162427 (Accession NP_835227.1) is another GAM1338 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:1761 and SEQ ID:12386 respectively, to the nucleotide sequence of GAM1338 RNA, herein designated GAM RNA, also designated SEQ ID:360.

Another function of GAM1338 is therefore inhibition of LOC162427 (Accession NP_835227.1). Accordingly, utilities of GAM1338 include diagnosis, prevention and treatment of diseases and clinical conditions associated with LOC162427.

LOC162427 (Accession XP_091549.3) is another GAM1338 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:1761 and SEQ ID:12386 respectively, to the nucleotide sequence of GAM1338 RNA, herein designated GAM RNA, also designated SEQ ID:360.

Another function of GAM1338 is therefore inhibition of LOC162427 (Accession XP_091549.3). Accordingly, utilities of GAM1338 include diagnosis, prevention and treatment of diseases and clinical conditions associated with LOC162427.

LOC162962 (Accession XP_091886.7) is another GAM1338 target gene, herein designated TARGET GENE. LOC162962 BINDING SITE is a target binding site found in the 3' untranslated region of mRNA encoded by LOC162962, corresponding to a target binding site such as BINDING SITE I, BINDING SITE II or BINDING SITE III of FIG. 8. Table 4 illustrates the complementarity of the nucleotide sequences of LOC162962 BINDING SITE, designated SEQ ID:4276, to the nucleotide sequence of GAM1338 RNA, herein designated GAM RNA, also designated SEQ ID:360.

Another function of GAM1338 is therefore inhibition of LOC162962 (Accession XP_091886.7). Accordingly, utilities of GAM1338 include diagnosis, prevention and treatment of diseases and clinical conditions associated with LOC162962.

LOC162967 (Accession XP_091890.6) is another GAM1338 target gene, herein designated TARGET GENE. LOC162967 BINDING SITE is a target binding site found in the 3' untranslated region of mRNA encoded by LOC162967, corresponding to a target binding site such as BINDING SITE I, BINDING SITE II or BINDING SITE III of FIG. 8. Table 4 illustrates the complementarity of the nucleotide sequences of LOC162967 BINDING SITE, designated SEQ ID:3050, to the nucleotide sequence of GAM1338 RNA, herein designated GAM RNA, also designated SEQ ID:360.

Another function of GAM1338 is therefore inhibition of LOC162967 (Accession XP_091890.6). Accordingly, utilities of GAM1338 include diagnosis, prevention and treatment of diseases and clinical conditions associated with LOC162967.

LOC163227 (Accession NP_775802.1) is another GAM1338 target gene, herein designated TARGET GENE. LOC163227 BINDING SITE1 and LOC163227 BINDING SITE2 are target binding sites found in untranslated regions of mRNA encoded by LOC163227, corresponding to target binding sites such as BINDING SITE I, BINDING SITE II or BINDING SITE III of FIG. 8. Table 4 illustrates the complementarity of the nucleotide sequences of LOC163227 BINDING SITE1 and LOC163227 BINDING SITE2, designated SEQ ID:1413 and SEQ ID:9582 respectively, to the nucleotide sequence of GAM1338 RNA, herein designated GAM RNA, also designated SEQ ID:360.

Another function of GAM1338 is therefore inhibition of LOC163227 (Accession NP_775802.1). Accordingly, utilities of GAM1338 include diagnosis, prevention and treatment of diseases and clinical conditions associated with LOC163227.

LOC163233 (Accession XP_290865.1) is another GAM1338 target gene, herein designated TARGET GENE. LOC163233 BINDING SITE is a target binding site found in the 3' untranslated region of mRNA encoded by LOC163233, corresponding to a target binding site such as BINDING SITE I, BINDING SITE II or BINDING SITE III of FIG. 8. Table 4 illustrates the complementarity of the nucleotide sequences of LOC163233 BINDING SITE, designated SEQ ID:12968, to the nucleotide sequence of GAM1338 RNA, herein designated GAM RNA, also designated SEQ ID:360.

Another function of GAM1338 is therefore inhibition of LOC163233 (Accession XP_290865.1). Accordingly, utilities of GAM1338 include diagnosis, prevention and treatment of diseases and clinical conditions associated with LOC163233.

LOC167454 (Accession XP_094496.2) is another GAM1338 target gene, herein designated TARGET GENE. LOC167454 BINDING SITE is a target binding site found in the 3' untranslated region of mRNA encoded by LOC167454, corresponding to a target binding site such as BINDING SITE I, BINDING SITE II or BINDING SITE III of FIG. 8. Table 4 illustrates the complementarity of the nucleotide sequences of LOC167454 BINDING SITE, designated SEQ ID:10263, to the nucleotide sequence of GAM1338 RNA, herein designated GAM RNA, also designated SEQ ID:360.

Another function of GAM1338 is therefore inhibition of LOC167454 (Accession XP_094496.2). Accordingly, utilities of GAM1338 include diagnosis, prevention and treatment of diseases and clinical conditions associated with LOC167454.

LOC168451 (Accession XP_095114.2) is another GAM1338 target gene, herein designated TARGET GENE. LOC168451 BINDING SITE is a target binding site found in the 3' untranslated region of mRNA encoded by LOC168451, corresponding to a target binding site such as BINDING SITE I, BINDING SITE II or BINDING SITE III of FIG. 8. Table 4 illustrates the complementarity of the nucleotide sequences of LOC168451 BINDING SITE, designated SEQ ID:7426, to the nucleotide sequence of GAM1338 RNA, herein designated GAM RNA, also designated SEQ ID:360.

Another function of GAM1338 is therefore inhibition of LOC168451 (Accession XP_095114.2). Accordingly, utilities of GAM1338 include diagnosis, prevention and treatment of diseases and clinical conditions associated with LOC168451.

LOC196264 (Accession XP_113683.1) is another GAM1338 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:8574, to the nucleotide sequence of GAM1338 RNA, herein designated GAM RNA, also designated SEQ ID:360.

Another function of GAM1338 is therefore inhibition of LOC196264 (Accession XP_113683.1). Accordingly, utilities of GAM1338 include diagnosis, prevention and treatment of diseases and clinical conditions associated with LOC196264.

LOC196337 (Accession XP_113696.1) is another GAM1338 target gene, herein designated TARGET GENE. LOC196337 BINDING SITE is a target binding site found in the 3' untranslated region of mRNA encoded by LOC196337, corresponding to a target binding site such as BINDING SITE I, BINDING SITE II or BINDING SITE III of FIG. 8. Table 4 illustrates the complementarity of the nucleotide sequences of LOC196337 BINDING SITE, designated SEQ ID:6623, to the nucleotide sequence of GAM1338 RNA, herein designated GAM RNA, also designated SEQ ID:360.

Another function of GAM1338 is therefore inhibition of LOC196337 (Accession XP_113696.1). Accordingly, utilities of GAM1338 include diagnosis, prevention and treatment of diseases and clinical conditions associated with LOC196337.

LOC196540 (Accession XP_116933.1) is another GAM1338 target gene, herein designated TARGET GENE.

LOC196540 BINDING SITE is a target binding site found in the 3' untranslated region of mRNA encoded by LOC196540, corresponding to a target binding site such as BINDING SITE I, BINDING SITE II or BINDING SITE III of FIG. 8. Table 4 illustrates the complementarity of the nucleotide sequences of LOC196540 BINDING SITE, designated SEQ ID:12661, to the nucleotide sequence of GAM1338 RNA, herein designated GAM RNA, also designated SEQ ID:360.

Another function of GAM1338 is therefore inhibition of LOC196540 (Accession XP_116933.1). Accordingly, utilities of GAM1338 include diagnosis, prevention and treatment of diseases and clinical conditions associated with LOC196540.

LOC197358 (Accession XP_113872.2) is another GAM1338 target gene, herein designated TARGET GENE. LOC197358 BINDING SITE1 and LOC197358 BINDING SITE2 are target binding sites found in untranslated regions of mRNA encoded by LOC197358, corresponding to target binding sites such as BINDING SITE I, BINDING SITE II or BINDING SITE III of FIG. 8. Table 4 illustrates the complementarity of the nucleotide sequences of LOC197358 BINDING SITE1 and LOC197358 BINDING SITE2, designated SEQ ID:3887 and SEQ ID:5402 respectively, to the nucleotide sequence of GAM1338 RNA, herein designated GAM RNA, also designated SEQ ID:360.

Another function of GAM1338 is therefore inhibition of LOC197358 (Accession XP_113872.2). Accordingly, utilities of GAM1338 include diagnosis, prevention and treatment of diseases and clinical conditions associated with LOC197358.

LOC199899 (Accession XP_117153.1) is another GAM1338 target gene, herein designated TARGET GENE. LOC199899 BINDING SITE1 and LOC199899 BINDING SITE2 are target binding sites found in untranslated regions of mRNA encoded by LOC199899, corresponding to target binding sites such as BINDING SITE I, BINDING SITE II or BINDING SITE III of FIG. 8. Table 4 illustrates the complementarity of the nucleotide sequences of LOC199899 BINDING SITE1 and LOC199899 BINDING SITE2, designated SEQ ID:17148 and SEQ ID:5955 respectively, to the nucleotide sequence of GAM1338 RNA, herein designated GAM RNA, also designated SEQ ID:360.

Another function of GAM1338 is therefore inhibition of LOC199899 (Accession XP_117153.1). Accordingly, utilities of GAM1338 include diagnosis, prevention and treatment of diseases and clinical conditions associated with LOC199899.

LOC199906 (Accession XP_114052.1) is another GAM1338 target gene, herein designated TARGET GENE. LOC199906 BINDING SITE is a target binding site found in the 3' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:11637, to the nucleotide sequence of GAM1338 RNA, herein designated GAM RNA, also designated SEQ ID:360.

Another function of GAM1338 is therefore inhibition of LOC199906 (Accession XP_114052.1). Accordingly, utilities of GAM1338 include diagnosis, prevention and treatment of diseases and clinical conditions associated with LOC199906.

LOC200169 (Accession XP_117200.1) is another GAM1338 target gene, herein designated TARGET GENE. LOC200169 BINDING SITE1 and LOC200169 BINDING SITE2 are target binding sites found in untranslated regions of multiple transcripts of mRNA encoded by LOC200169, corresponding to target binding sites such as BINDING SITE I, BINDING SITE II or BINDING SITE III of FIG. 8. Table 4 illustrates the complementarity of the nucleotide sequences of LOC200169 BINDING SITE1 and LOC200169 BINDING SITE2, designated SEQ ID:6517 and SEQ ID:5066 respectively, to the nucleotide sequence of GAM1338 RNA, herein designated GAM RNA, also designated SEQ ID:360.

Another function of GAM1338 is therefore inhibition of LOC200169 (Accession XP_117200.1). Accordingly, utilities of GAM1338 include diagnosis, prevention and treatment of diseases and clinical conditions associated with LOC200169.

LOC200860 (Accession XP_117289.1) is another GAM1338 target gene, herein designated TARGET GENE. LOC200860 BINDING SITE1 and LOC200860 BINDING SITE2 are target binding sites found in untranslated regions of mRNA encoded by LOC200860, corresponding to target binding sites such as BINDING SITE I, BINDING SITE II or BINDING SITE III of FIG. 8. Table 4 illustrates the complementarity of the nucleotide sequences of LOC200860 BINDING SITE1 and LOC200860 BINDING SITE2, designated SEQ ID:15491 and SEQ ID:18182 respectively, to the nucleotide sequence of GAM1338 RNA, herein designated GAM RNA, also designated SEQ ID:360.

Another function of GAM1338 is therefore inhibition of LOC200860 (Accession XP_117289.1). Accordingly, utilities of GAM1338 include diagnosis, prevention and treatment of diseases and clinical conditions associated with LOC200860.

LOC200895 (Accession NP_789785.1) is another GAM1338 target gene, herein designated TARGET GENE. LOC200895 BINDING SITE1 and LOC200895 BINDING SITE2 are target binding sites found in untranslated regions of mRNA encoded by LOC200895, corresponding to target binding sites such as BINDING SITE I, BINDING SITE II or BINDING SITE III of FIG. 8. Table 4 illustrates the complementarity of the nucleotide sequences of LOC200895 BINDING SITE1 and LOC200895 BINDING SITE2, designated SEQ ID:3376 and SEQ ID:17681 respectively, to the nucleotide sequence of GAM1338 RNA, herein designated GAM RNA, also designated SEQ ID:360.

Another function of GAM1338 is therefore inhibition of LOC200895 (Accession NP_789785.1). Accordingly, utilities of GAM1338 include diagnosis, prevention and treatment of diseases and clinical conditions associated with LOC200895.

LOC200916 (Accession XP_114317.3) is another GAM1338 target gene, herein designated TARGET GENE. LOC200916 BINDING SITE is a target binding site found in the 3' untranslated region of mRNA encoded by LOC200916, corresponding to a target binding site such as BINDING SITE I, BINDING SITE II or BINDING SITE III of FIG. 8. Table 4 illustrates the complementarity of the nucleotide sequences of LOC200916 BINDING SITE, designated SEQ ID:873, to the nucleotide sequence of GAM1338 RNA, herein designated GAM RNA, also designated SEQ ID:360.

Another function of GAM1338 is therefore inhibition of LOC200916 (Accession XP_114317.3). Accordingly, utilities of GAM1338 include diagnosis, prevention and treatment of diseases and clinical conditions associated with LOC200916.

LOC201164 (Accession XP_290750.1) is another GAM1338 target gene, herein designated TARGET GENE. LOC201164 BINDING SITE1 and LOC201164 BINDING SITE2 are target binding sites found in untranslated regions of multiple transcripts of mRNA encoded by LOC201164, corresponding to target binding sites such as BINDING SITE I, BINDING SITE II or BINDING SITE III of FIG. 8. Table 4 illustrates the complementarity of the nucleotide sequences of LOC201164 BINDING SITE1 and LOC201164 BINDING SITE2, designated SEQ ID:13530 and SEQ ID:18118 respectively, to the nucleotide sequence of GAM1338 RNA, herein designated GAM RNA, also designated SEQ ID:360.

Another function of GAM1338 is therefore inhibition of LOC201164 (Accession XP_290750.1). Accordingly, utilities of GAM1338 include diagnosis, prevention and treatment of diseases and clinical conditions associated with LOC201164.

LOC201292 (Accession NP_775818.1) is another GAM1338 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:19674, to the nucleotide sequence of GAM1338 RNA, herein designated GAM RNA, also designated SEQ ID:360.

Another function of GAM1338 is therefore inhibition of LOC201292 (Accession NP_775818.1). Accordingly, utilities of GAM1338 include diagnosis, prevention and treatment of diseases and clinical conditions associated with LOC201292.

LOC201562 (Accession XP_114343.2) is another GAM1338 target gene, herein designated TARGET GENE. LOC201562 BINDING SITE is a target binding site found in the 3' untranslated region of mRNA encoded by LOC201562, corresponding to a target binding site such as BINDING SITE I, BINDING SITE II or BINDING SITE III of FIG. 8. Table 4 illustrates the complementarity of the nucleotide sequences of LOC201562 BINDING SITE, designated SEQ ID:9102, to the nucleotide sequence of GAM1338 RNA, herein designated GAM RNA, also designated SEQ ID:360.

Another function of GAM1338 is therefore inhibition of LOC201562 (Accession XP_114343.2). Accordingly, utilities of GAM1338 include diagnosis, prevention and treatment of diseases and clinical conditions associated with LOC201562.

LOC201725 (Accession XP_114370.1) is another GAM1338 target gene, herein designated TARGET GENE. LOC201725 BINDING SITE is a target binding site found in the 3' untranslated region of mRNA encoded by LOC201725, corresponding to a target binding site such as BINDING SITE I, BINDING SITE II or BINDING SITE III of FIG. 8. Table 4 illustrates the complementarity of the nucleotide sequences of LOC201725 BINDING SITE, designated SEQ ID:18941, to the nucleotide sequence of GAM1338 RNA, herein designated GAM RNA, also designated SEQ ID:360.

Another function of GAM1338 is therefore inhibition of LOC201725 (Accession XP_114370.1). Accordingly, utilities of GAM1338 include diagnosis, prevention and treatment of diseases and clinical conditions associated with LOC201725.

LOC202400 (Accession XP_117397.1) is another GAM1338 target gene, herein designated TARGET GENE. LOC202400 BINDING SITE is a target binding site found in the 5' untranslated region of mRNA encoded by LOC202400, corresponding to a target binding site such as BINDING SITE I, BINDING SITE II or BINDING SITE III of FIG. 8. Table 4 illustrates the complementarity of the nucleotide sequences of LOC202400 BINDING SITE, designated SEQ ID:436, to the nucleotide sequence of GAM1338 RNA, herein designated GAM RNA, also designated SEQ ID:360.

Another function of GAM1338 is therefore inhibition of LOC202400 (Accession XP_117397.1). Accordingly, utilities of GAM1338 include diagnosis, prevention and treatment of diseases and clinical conditions associated with LOC202400.

LOC202404 (Accession XP_114481.4) is another GAM1338 target gene, herein designated TARGET GENE. LOC202404 BINDING SITE is a target binding site found in the 3' untranslated region of mRNA encoded by LOC202404, corresponding to a target binding site such as BINDING SITE I, BINDING SITE II or BINDING SITE III of FIG. 8. Table 4 illustrates the complementarity of the nucleotide sequences of LOC202404 BINDING SITE, designated SEQ ID:15206, to the nucleotide sequence of GAM1338 RNA, herein designated GAM RNA, also designated SEQ ID:360.

Another function of GAM1338 is therefore inhibition of LOC202404 (Accession XP_114481.4). Accordingly, utilities of GAM1338 include diagnosis, prevention and treatment of diseases and clinical conditions associated with LOC202404.

LOC202460 (Accession XP_114493.1) is another GAM1338 target gene, herein designated TARGET GENE. LOC202460 BINDING SITE is a target binding site found in the 5' untranslated region of mRNA encoded by LOC202460, corresponding to a target binding site such as BINDING SITE I, BINDING SITE II or BINDING SITE III of FIG. 8. Table 4 illustrates the complementarity of the nucleotide sequences of LOC202460 BINDING SITE, designated SEQ ID:1278, to the nucleotide sequence of GAM1338 RNA, herein designated GAM RNA, also designated SEQ ID:360.

Another function of GAM1338 is therefore inhibition of LOC202460 (Accession XP_114493.1). Accordingly, utilities of GAM1338 include diagnosis, prevention and treatment of diseases and clinical conditions associated with LOC202460.

LOC202934 (Accession XP_117486.2) is another GAM1338 target gene, herein designated TARGET GENE. LOC202934 BINDING SITE1 and LOC202934 BINDING SITE2 are target binding sites found in untranslated regions of mRNA encoded by LOC202934, corresponding to target binding sites such as BINDING SITE I, BINDING SITE II or BINDING SITE III of FIG. 8. Table 4 illustrates the complementarity of the nucleotide sequences of LOC202934 BINDING SITE1 and LOC202934 BINDING SITE2, designated SEQ ID:9097 and SEQ ID:6782 respectively, to the nucleotide sequence of GAM1338 RNA, herein designated GAM RNA, also designated SEQ ID:360.

Another function of GAM1338 is therefore inhibition of LOC202934 (Accession XP_117486.2). Accordingly, utilities of GAM1338 include diagnosis, prevention and treatment of diseases and clinical conditions associated with LOC202934.

LOC203076 (Accession XP_114621.2) is another GAM1338 target gene, herein designated TARGET GENE. LOC203076 BINDING SITE is a target binding site found in the 5' untranslated region of mRNA encoded by LOC203076, corresponding to a target binding site such as BINDING SITE I, BINDING SITE II or BINDING SITE III of FIG. 8. Table 4 illustrates the complementarity of the nucleotide sequences of LOC203076 BINDING SITE, designated SEQ ID:8849, to the nucleotide sequence of GAM1338 RNA, herein designated GAM RNA, also designated SEQ ID:360.

Another function of GAM1338 is therefore inhibition of LOC203076 (Accession XP_114621.2). Accordingly, utilities of GAM1338 include diagnosis, prevention and treatment of diseases and clinical conditions associated with LOC203076.

LOC203547 (Accession XP_114719.1) is another GAM1338 target gene, herein designated TARGET GENE. LOC203547 BINDING SITE1 and LOC203547 BINDING SITE2 are target binding sites found in untranslated regions of mRNA encoded by LOC203547, corresponding to target binding sites such as BINDING SITE I, BINDING SITE II or BINDING SITE III of FIG. 8. Table 4 illustrates the complementarity of the nucleotide sequences of LOC203547 BINDING SITE1 and LOC203547 BINDING SITE2, designated SEQ ID:10631 and SEQ ID:2923 respectively, to the nucleotide sequence of GAM1338 RNA, herein designated GAM RNA, also designated SEQ ID:360.

Another function of GAM1338 is therefore inhibition of LOC203547 (Accession XP_114719.1). Accordingly, utilities of GAM1338 include diagnosis, prevention and treatment of diseases and clinical conditions associated with LOC203547.

LOC219293 (Accession XP_166599.2) is another GAM1338 target gene, herein designated TARGET GENE. LOC219293 BINDING SITE is a target binding site found in the 3' untranslated region of mRNA encoded by LOC219293, corresponding to a target binding site such as BINDING SITE I, BINDING SITE II or BINDING SITE III of FIG. 8. Table 4 illustrates the complementarity of the nucleotide sequences of LOC219293 BINDING SITE, designated SEQ ID:12080, to the nucleotide sequence of GAM1338 RNA, herein designated GAM RNA, also designated SEQ ID:360.

Another function of GAM1338 is therefore inhibition of LOC219293 (Accession XP_166599.2). Accordingly, utilities of GAM1338 include diagnosis, prevention and treatment of diseases and clinical conditions associated with LOC219293.

LOC219731 (Accession XP_167596.1) is another GAM1338 target gene, herein designated TARGET GENE. LOC219731 BINDING SITE1 and LOC219731 BINDING SITE2 are target binding sites found in untranslated regions of mRNA encoded by LOC219731, corresponding to target binding sites such as BINDING SITE I, BINDING SITE II or BINDING SITE III of FIG. 8. Table 4 illustrates the complementarity of the nucleotide sequences of LOC219731 BINDING SITE1 and LOC219731 BINDING SITE2, designated SEQ ID:10264 and SEQ ID:3320 respectively, to the nucleotide sequence of GAM1338 RNA, herein designated GAM RNA, also designated SEQ ID:360.

Another function of GAM1338 is therefore inhibition of LOC219731 (Accession XP_167596.1). Accordingly, utilities of GAM1338 include diagnosis, prevention and treatment of diseases and clinical conditions associated with LOC219731.

LOC219735 (Accession XP_167601.1) is another GAM1338 target gene, herein designated TARGET GENE. LOC219735 BINDING SITE is a target binding site found in the 3' untranslated region of mRNA encoded by LOC219735, corresponding to a target binding site such as BINDING SITE I, BINDING SITE II or BINDING SITE III of FIG. 8. Table 4 illustrates the complementarity of the nucleotide sequences of LOC219735 BINDING SITE, designated SEQ ID:3675, to the nucleotide sequence of GAM1338 RNA, herein designated GAM RNA, also designated SEQ ID:360.

Another function of GAM1338 is therefore inhibition of LOC219735 (Accession XP_167601.1). Accordingly, utilities of GAM1338 include diagnosis, prevention and treatment of diseases and clinical conditions associated with LOC219735.

LOC219894 (Accession XP_167782.1) is another GAM1338 target gene, herein designated TARGET GENE. LOC219894 BINDING SITE is a target binding site found in the 3' untranslated region of mRNA encoded by LOC219894, corresponding to a target binding site such as BINDING SITE I, BINDING SITE II or BINDING SITE III of FIG. 8. Table 4 illustrates the complementarity of the nucleotide sequences of LOC219894 BINDING SITE, designated SEQ ID:7138, to the nucleotide sequence of GAM1338 RNA, herein designated GAM RNA, also designated SEQ ID:360.

Another function of GAM1338 is therefore inhibition of LOC219894 (Accession XP_167782.1). Accordingly, utilities of GAM1338 include diagnosis, prevention and treatment of diseases and clinical conditions associated with LOC219894.

LOC220074 (Accession NP_660352.1) is another GAM1338 target gene, herein designated TARGET GENE. LOC220074 BINDING SITE1 through LOC220074 BINDING SITE3 are target binding sites found in untranslated regions of mRNA encoded by LOC220074, corresponding to target binding sites such as BINDING SITE I, BINDING SITE II or BINDING SITE III of FIG. 8. Table 4 illustrates the complementarity of the nucleotide sequences of LOC220074 BINDING SITE1 through LOC220074 BINDING SITE3, designated SEQ ID:1413, SEQ ID:4396 and SEQ ID:2086 respectively, to the nucleotide sequence of GAM1338 RNA, herein designated GAM RNA, also designated SEQ ID:360.

Another function of GAM1338 is therefore inhibition of LOC220074 (Accession NP_660352.1). Accordingly, utilities of GAM1338 include diagnosis, prevention and treatment of diseases and clinical conditions associated with LOC220074.

LOC221362 (Accession XP_168093.1) is another GAM1338 target gene, herein designated TARGET GENE. LOC221362 BINDING SITE is a target binding site found in the 5' untranslated region of mRNA encoded by LOC221362, corresponding to a target binding site such as BINDING SITE I, BINDING SITE II or BINDING SITE III of FIG. 8. Table 4 illustrates the complementarity of the nucleotide sequences of LOC221362 BINDING SITE, designated SEQ ID:15454, to the nucleotide sequence of GAM1338 RNA, herein designated GAM RNA, also designated SEQ ID:360.

Another function of GAM1338 is therefore inhibition of LOC221362 (Accession XP_168093.1). Accordingly, utilities of GAM1338 include diagnosis, prevention and treatment of diseases and clinical conditions associated with LOC221362.

LOC221663 (Accession XP_168131.1) is another GAM1338 target gene, herein designated TARGET GENE. LOC221663 BINDING SITE is a target binding site found in the 5' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:10616, to the nucleotide sequence of GAM1338 RNA, herein designated GAM RNA, also designated SEQ ID:360.

Another function of GAM1338 is therefore inhibition of LOC221663 (Accession XP_168131.1). Accordingly, utilities of GAM1338 include diagnosis, prevention and treatment of diseases and clinical conditions associated with LOC221663.

LOC221946 (Accession XP_168340.1) is another GAM1338 target gene, herein designated TARGET GENE. LOC221946 BINDING SITE is a target binding site found in the 3' untranslated region of mRNA encoded by LOC221946, corresponding to a target binding site such as BINDING SITE I, BINDING SITE II or BINDING SITE III of FIG. 8. Table 4 illustrates the complementarity of the nucleotide sequences of LOC221946 BINDING SITE, designated SEQ ID:3294, to the nucleotide sequence of GAM1338 RNA, herein designated GAM RNA, also designated SEQ ID:360.

Another function of GAM1338 is therefore inhibition of LOC221946 (Accession XP_168340.1). Accordingly, utilities of GAM1338 include diagnosis, prevention and treatment of diseases and clinical conditions associated with LOC221946.

LOC221964 (Accession XP_168342.1) is another GAM1338 target gene, herein designated TARGET GENE. LOC221964 BINDING SITE is a target binding site found in the 3' untranslated region of mRNA encoded by LOC221964, corresponding to a target binding site such as BINDING SITE I, BINDING SITE II or BINDING SITE III of FIG. 8. Table 4 illustrates the complementarity of the nucleotide sequences of LOC221964 BINDING SITE, designated SEQ ID:5581, to the nucleotide sequence of GAM1338 RNA, herein designated GAM RNA, also designated SEQ ID:360.

Another function of GAM1338 is therefore inhibition of LOC221964 (Accession XP_168342.1). Accordingly, utilities of GAM1338 include diagnosis, prevention and treatment of diseases and clinical conditions associated with LOC221964.

LOC222057 (Accession XP_166594.2) is another GAM1338 target gene, herein designated TARGET GENE. LOC222057 BINDING SITE is a target binding site found in the 5' untranslated region of mRNA encoded by LOC222057, corresponding to a target binding site such as BINDING SITE I, BINDING SITE II or BINDING SITE III of FIG. 8. Table 4 illustrates the complementarity of the nucleotide sequences of LOC222057 BINDING SITE, designated SEQ ID:902, to the nucleotide sequence of GAM1338 RNA, herein designated GAM RNA, also designated SEQ ID:360.

Another function of GAM1338 is therefore inhibition of LOC222057 (Accession XP_166594.2). Accordingly, utilities of GAM1338 include diagnosis, prevention and treatment of diseases and clinical conditions associated with LOC222057.

LOC222159 (Accession XP_212100.1) is another GAM1338 target gene, herein designated TARGET GENE. LOC222159 BINDING SITE is a target binding site found in the 5' untranslated region of multiple transcripts of mRNA encoded by LOC222159, corresponding to a target binding site such as BINDING SITE I, BINDING SITE II or BINDING SITE III of FIG. 8. Table 4 illustrates the complementarity of the nucleotide sequences of LOC222159 BINDING SITE, designated SEQ ID:563, to the nucleotide sequence of GAM1338 RNA, herein designated GAM RNA, also designated SEQ ID:360.

Another function of GAM1338 is therefore inhibition of LOC222159 (Accession XP_212100.1). Accordingly, utilities of GAM1338 include diagnosis, prevention and treatment of diseases and clinical conditions associated with LOC222159.

LOC253612 (Accession XP_172985.2) is another GAM1338 target gene, herein designated TARGET GENE. LOC253612 BINDING SITE is a target binding site found in the 5' untranslated region of mRNA encoded by LOC253612, corresponding to a target binding site such as BINDING SITE I, BINDING SITE II or BINDING SITE III of FIG. 8. Table 4 illustrates the complementarity of the nucleotide sequences of LOC253612 BINDING SITE, designated SEQ ID:19268, to the nucleotide sequence of GAM1338 RNA, herein designated GAM RNA, also designated SEQ ID:360.

Another function of GAM1338 is therefore inhibition of LOC253612 (Accession XP_172985.2). Accordingly, utilities of GAM1338 include diagnosis, prevention and treatment of diseases and clinical conditions associated with LOC253612.

LOC253805 (Accession XP_172854.1) is another GAM1338 target gene, herein designated TARGET GENE. LOC253805 BINDING SITE is a target binding site found in the 3' untranslated region of mRNA encoded by LOC253805, corresponding to a target binding site such as BINDING SITE I, BINDING SITE II or BINDING SITE III of FIG. 8. Table 4 illustrates the complementarity of the nucleotide sequences of LOC253805 BINDING SITE, designated SEQ ID:7275, to the nucleotide sequence of GAM1338 RNA, herein designated GAM RNA, also designated SEQ ID:360.

Another function of GAM1338 is therefore inhibition of LOC253805 (Accession XP_172854.1). Accordingly, utilities of GAM1338 include diagnosis, prevention and treatment of diseases and clinical conditions associated with LOC253805.

LOC254875 (Accession XP_171170.1) is another GAM1338 target gene, herein designated TARGET GENE. LOC254875 BINDING SITE is a target binding site found in the 3' untranslated region of mRNA encoded by LOC254875, corresponding to a target binding site such as BINDING SITE I, BINDING SITE II or BINDING SITE III of FIG. 8. Table 4 illustrates the complementarity of the nucleotide sequences of LOC254875 BINDING SITE, designated SEQ ID:14560, to the nucleotide sequence of GAM1338 RNA, herein designated GAM RNA, also designated SEQ ID:360.

Another function of GAM1338 is therefore inhibition of LOC254875 (Accession XP_171170.1). Accordingly, utilities of GAM1338 include diagnosis, prevention and treatment of diseases and clinical conditions associated with LOC254875.

LOC255031 (Accession XP_173187.1) is another GAM1338 target gene, herein designated TARGET GENE. LOC255031 BINDING SITE1 and LOC255031 BINDING SITE2 are target binding sites found in untranslated regions of mRNA encoded by LOC255031, corresponding to target binding sites such as BINDING SITE I, BINDING SITE II or BINDING SITE III of FIG. 8. Table 4 illustrates the complementarity of the nucleotide sequences of LOC255031 BINDING SITE1 and LOC255031 BINDING SITE2, designated SEQ ID:11416 and SEQ ID:19099 respectively, to the nucleotide sequence of GAM1338 RNA, herein designated GAM RNA, also designated SEQ ID:360.

Another function of GAM1338 is therefore inhibition of LOC255031 (Accession XP_173187.1). Accordingly, utilities of GAM1338 include diagnosis, prevention and treatment of diseases and clinical conditions associated with LOC255031.

LOC255177 (Accession XP_172941.1) is another GAM1338 target gene, herein designated TARGET GENE. LOC255177 BINDING SITE is a target binding site found in the 3' untranslated region of mRNA encoded by LOC255177, corresponding to a target binding site such as BINDING SITE I, BINDING SITE II or BINDING SITE III of FIG. 8. Table 4 illustrates the complementarity of the nucleotide sequences of LOC255177 BINDING SITE, designated SEQ ID:2303, to the nucleotide sequence of GAM1338 RNA, herein designated GAM RNA, also designated SEQ ID:360.

Another function of GAM1338 is therefore inhibition of LOC255177 (Accession XP_172941.1). Accordingly, utilities of GAM1338 include diagnosis, prevention and treatment of diseases and clinical conditions associated with LOC255177.

LOC255458 (Accession XP_173150.1) is another GAM1338 target gene, herein designated TARGET GENE.

LOC255458 BINDING SITE is a target binding site found in the 5' untranslated region of mRNA encoded by LOC255458, corresponding to a target binding site such as BINDING SITE I, BINDING SITE II or BINDING SITE III of FIG. 8. Table 4 illustrates the complementarity of the nucleotide sequences of LOC255458 BINDING SITE, designated SEQ ID:9251, to the nucleotide sequence of GAM1338 RNA, herein designated GAM RNA, also designated SEQ ID:360.

Another function of GAM1338 is therefore inhibition of LOC255458 (Accession XP_173150.1). Accordingly, utilities of GAM1338 include diagnosis, prevention and treatment of diseases and clinical conditions associated with LOC255458.

LOC255488 (Accession XP_172581.2) is another GAM1338 target gene, herein designated TARGET GENE. LOC255488 BINDING SITE is a target binding site found in the 3' untranslated region of mRNA encoded by LOC255488, corresponding to a target binding site such as BINDING SITE I, BINDING SITE II or BINDING SITE III of FIG. 8. Table 4 illustrates the complementarity of the nucleotide sequences of LOC255488 BINDING SITE, designated SEQ ID:18594, to the nucleotide sequence of GAM1338 RNA, herein designated GAM RNA, also designated SEQ ID:360.

Another function of GAM1338 is therefore inhibition of LOC255488 (Accession XP_172581.2). Accordingly, utilities of GAM1338 include diagnosis, prevention and treatment of diseases and clinical conditions associated with LOC255488.

LOC255975 (Accession XP_171083.2) is another GAM1338 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:902, to the nucleotide sequence of GAM1338 RNA, herein designated GAM RNA, also designated SEQ ID:360.

Another function of GAM1338 is therefore inhibition of LOC255975 (Accession XP_171083.2). Accordingly, utilities of GAM1338 include diagnosis, prevention and treatment of diseases and clinical conditions associated with LOC255975.

LOC256401 (Accession XP_171149.1) is another GAM1338 target gene, herein designated TARGET GENE. LOC256401 BINDING SITE is a target binding site found in the 3' untranslated region of mRNA encoded by LOC256401, corresponding to a target binding site such as BINDING SITE I, BINDING SITE II or BINDING SITE III of FIG. 8. Table 4 illustrates the complementarity of the nucleotide sequences of LOC256401 BINDING SITE, designated SEQ ID:9741, to the nucleotide sequence of GAM1338 RNA, herein designated GAM RNA, also designated SEQ ID:360.

Another function of GAM1338 is therefore inhibition of LOC256401 (Accession XP_171149.1). Accordingly, utilities of GAM1338 include diagnosis, prevention and treatment of diseases and clinical conditions associated with LOC256401.

LOC256614 (Accession XP_172864.1) is another GAM1338 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:3106, to the nucleotide sequence of GAM1338 RNA, herein designated GAM RNA, also designated SEQ ID:360.

Another function of GAM1338 is therefore inhibition of LOC256614 (Accession XP_172864.1). Accordingly, utilities of GAM1338 include diagnosis, prevention and treatment of diseases and clinical conditions associated with LOC256614.

LOC282972 (Accession XP_210837.1) is another GAM1338 target gene, herein designated TARGET GENE. LOC282972 BINDING SITE is a target binding site found in the 3' untranslated region of mRNA encoded by LOC282972, corresponding to a target binding site such as BINDING SITE I, BINDING SITE II or BINDING SITE III of FIG. 8. Table 4 illustrates the complementarity of the nucleotide sequences of LOC282972 BINDING SITE, designated SEQ ID:1691, to the nucleotide sequence of GAM1338 RNA, herein designated GAM RNA, also designated SEQ ID:360.

Another function of GAM1338 is therefore inhibition of LOC282972 (Accession XP_210837.1). Accordingly, utilities of GAM1338 include diagnosis, prevention and treatment of diseases and clinical conditions associated with LOC282972.

LOC282987 (Accession XP_210845.1) is another GAM1338 target gene, herein designated TARGET GENE. LOC282987 BINDING SITE1 and LOC282987 BINDING SITE2 are target binding sites found in untranslated regions of mRNA encoded by LOC282987, corresponding to target binding sites such as BINDING SITE I, BINDING SITE II or BINDING SITE III of FIG. 8. Table 4 illustrates the complementarity of the nucleotide sequences of LOC282987 BINDING SITE1 and LOC282987 BINDING SITE2, designated SEQ ID:12386 and SEQ ID:10460 respectively, to the nucleotide sequence of GAM1338 RNA, herein designated GAM RNA, also designated SEQ ID:360.

Another function of GAM1338 is therefore inhibition of LOC282987 (Accession XP_210845.1). Accordingly, utilities of GAM1338 include diagnosis, prevention and treatment of diseases and clinical conditions associated with LOC282987.

LOC282997 (Accession XP_208473.1) is another GAM1338 target gene, herein designated TARGET GENE. LOC282997 BINDING SITE is a target binding site found in the 3' untranslated region of mRNA encoded by LOC282997, corresponding to a target binding site such as BINDING SITE I, BINDING SITE II or BINDING SITE III of FIG. 8. Table 4 illustrates the complementarity of the nucleotide sequences of LOC282997 BINDING SITE, designated SEQ ID:5482, to the nucleotide sequence of GAM1338 RNA, herein designated GAM RNA, also designated SEQ ID:360.

Another function of GAM1338 is therefore inhibition of LOC282997 (Accession XP_208473.1). Accordingly, utilities of GAM1338 include diagnosis, prevention and treatment of diseases and clinical conditions associated with LOC282997.

LOC283061 (Accession XP_210875.1) is another GAM1338 target gene, herein designated TARGET GENE. LOC283061 BINDING SITE is a target binding site found in the 3' untranslated region of mRNA encoded by LOC283061, corresponding to a target binding site such as BINDING SITE I, BINDING SITE II or BINDING SITE III of FIG. 8. Table 4 illustrates the complementarity of the nucleotide sequences of LOC283061 BINDING SITE, designated SEQ ID:18916, to the nucleotide sequence of GAM1338 RNA, herein designated GAM RNA, also designated SEQ ID:360.

Another function of GAM1338 is therefore inhibition of LOC283061 (Accession XP_210875.1). Accordingly, utilities of GAM1338 include diagnosis, prevention and treatment of diseases and clinical conditions associated with LOC283061.

LOC283087 (Accession XP_208509.1) is another GAM1338 target gene, herein designated TARGET GENE. LOC283087 BINDING SITE is a target binding site found in the 3' untranslated region of mRNA encoded by LOC283087, corresponding to a target binding site such as BINDING SITE I, BINDING SITE II or BINDING SITE III of FIG. 8. Table 4 illustrates the complementarity of the nucleotide sequences of LOC283087 BINDING SITE, designated SEQ ID:6936, to the nucleotide sequence of GAM1338 RNA, herein designated GAM RNA, also designated SEQ ID:360.

Another function of GAM1338 is therefore inhibition of LOC283087 (Accession XP_208509.1). Accordingly, utilities of GAM1338 include diagnosis, prevention and treatment of diseases and clinical conditions associated with LOC283087.

LOC283089 (Accession XP_210885.1) is another GAM1338 target gene, herein designated TARGET GENE. LOC283089 BINDING SITE is a target binding site found in the 5' untranslated region of mRNA encoded by LOC283089, corresponding to a target binding site such as BINDING SITE I, BINDING SITE II or BINDING SITE III of FIG. 8. Table 4 illustrates the complementarity of the nucleotide sequences of LOC283089 BINDING SITE, designated SEQ ID:6866, to the nucleotide sequence of GAM1338 RNA, herein designated GAM RNA, also designated SEQ ID:360.

Another function of GAM1338 is therefore inhibition of LOC283089 (Accession XP_210885.1). Accordingly, utilities of GAM1338 include diagnosis, prevention and treatment of diseases and clinical conditions associated with LOC283089.

LOC283119 (Accession XP_210895.1) is another GAM1338 target gene, herein designated TARGET GENE. LOC283119 BINDING SITE is a target binding site found in the 3' untranslated region of mRNA encoded by LOC283119, corresponding to a target binding site such as BINDING SITE I, BINDING SITE II or BINDING SITE III of FIG. 8. Table 4 illustrates the complementarity of the nucleotide sequences of LOC283119 BINDING SITE, designated SEQ ID:1505, to the nucleotide sequence of GAM1338 RNA, herein designated GAM RNA, also designated SEQ ID:360.

Another function of GAM1338 is therefore inhibition of LOC283119 (Accession XP_210895.1). Accordingly, utilities of GAM1338 include diagnosis, prevention and treatment of diseases and clinical conditions associated with LOC283119.

LOC283130 (Accession XP_208525.3) is another GAM1338 target gene, herein designated TARGET GENE. LOC283130 BINDING SITE is a target binding site found in the 3' untranslated region of mRNA encoded by LOC283130, corresponding to a target binding site such as BINDING SITE I, BINDING SITE II or BINDING SITE III of FIG. 8. Table 4 illustrates the complementarity of the nucleotide sequences of LOC283130 BINDING SITE, designated SEQ ID:469, to the nucleotide sequence of GAM1338 RNA, herein designated GAM RNA, also designated SEQ ID:360.

Another function of GAM1338 is therefore inhibition of LOC283130 (Accession XP_208525.3). Accordingly, utilities of GAM1338 include diagnosis, prevention and treatment of diseases and clinical conditions associated with LOC283130.

LOC283140 (Accession XP_210911.1) is another GAM1338 target gene, herein designated TARGET GENE. LOC283140 BINDING SITE is a target binding site found in the 3' untranslated region of mRNA encoded by LOC283140, corresponding to a target binding site such as BINDING SITE I, BINDING SITE II or BINDING SITE III of FIG. 8. Table 4 illustrates the complementarity of the nucleotide sequences of LOC283140 BINDING SITE, designated SEQ ID:15581, to the nucleotide sequence of GAM1338 RNA, herein designated GAM RNA, also designated SEQ ID:360.

Another function of GAM1338 is therefore inhibition of LOC283140 (Accession XP_210911.1). Accordingly, utilities of GAM1338 include diagnosis, prevention and treatment of diseases and clinical conditions associated with LOC283140.

LOC283143 (Accession XP_210920.1) is another GAM1338 target gene, herein designated TARGET GENE. LOC283143 BINDING SITE is a target binding site found in the 3' untranslated region of mRNA encoded by LOC283143, corresponding to a target binding site such as BINDING SITE I, BINDING SITE II or BINDING SITE III of FIG. 8. Table 4 illustrates the complementarity of the nucleotide sequences of LOC283143 BINDING SITE, designated SEQ ID:14843, to the nucleotide sequence of GAM1338 RNA, herein designated GAM RNA, also designated SEQ ID:360.

Another function of GAM1338 is therefore inhibition of LOC283143 (Accession XP_210920.1). Accordingly, utilities of GAM1338 include diagnosis, prevention and treatment of diseases and clinical conditions associated with LOC283143.

LOC283152 (Accession XP_210917.2) is another GAM1338 target gene, herein designated TARGET GENE. LOC283152 BINDING SITE is a target binding site found in the 5' untranslated region of mRNA encoded by LOC283152, corresponding to a target binding site such as BINDING SITE I, BINDING SITE II or BINDING SITE III of FIG. 8. Table 4 illustrates the complementarity of the nucleotide sequences of LOC283152 BINDING SITE, designated SEQ ID:17431, to the nucleotide sequence of GAM1338 RNA, herein designated GAM RNA, also designated SEQ ID:360.

Another function of GAM1338 is therefore inhibition of LOC283152 (Accession XP_210917.2). Accordingly, utilities of GAM1338 include diagnosis, prevention and treatment of diseases and clinical conditions associated with LOC283152.

LOC283170 (Accession XP_208535.1) is another GAM1338 target gene, herein designated TARGET GENE. LOC283170 BINDING SITE is a target binding site found in the 3' untranslated region of mRNA encoded by LOC283170, corresponding to a target binding site such as BINDING SITE I, BINDING SITE II or BINDING SITE III of FIG. 8. Table 4 illustrates the complementarity of the nucleotide sequences of LOC283170 BINDING SITE, designated SEQ ID:19643, to the nucleotide sequence of GAM1338 RNA, herein designated GAM RNA, also designated SEQ ID:360.

Another function of GAM1338 is therefore inhibition of LOC283170 (Accession XP_208535.1). Accordingly, utilities of GAM1338 include diagnosis, prevention and treatment of diseases and clinical conditions associated with LOC283170.

LOC283177 (Accession XP_210903.1) is another GAM1338 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:13142, to the nucleotide sequence of GAM1338 RNA, herein designated GAM RNA, also designated SEQ ID:360.

Another function of GAM1338 is therefore inhibition of LOC283177 (Accession XP_210903.1). Accordingly, utilities of GAM1338 include diagnosis, prevention and treatment of diseases and clinical conditions associated with LOC283177.

LOC283215 (Accession XP_208555.2) is another GAM1338 target gene, herein designated TARGET GENE. LOC283215 BINDING SITE is a target binding site found in the 3' untranslated region of mRNA encoded by LOC283215, corresponding to a target binding site such as BINDING SITE I, BINDING SITE II or BINDING SITE III of FIG. 8. Table 4 illustrates the complementarity of the nucleotide sequences of LOC283215 BINDING SITE, designated SEQ ID:15736, to the nucleotide sequence of GAM1338 RNA, herein designated GAM RNA, also designated SEQ ID:360.

Another function of GAM1338 is therefore inhibition of LOC283215 (Accession XP_208555.2). Accordingly, utilities of GAM1338 include diagnosis, prevention and treatment of diseases and clinical conditions associated with LOC283215.

LOC283241 (Accession NP_787089.1) is another GAM1338 target gene, herein designated TARGET GENE. LOC283241 BINDING SITE is a target binding site found in the 5' untranslated region of mRNA encoded by LOC283241, corresponding to a target binding site such as BINDING SITE I, BINDING SITE II or BINDING SITE III of FIG. 8. Table 4 illustrates the complementarity of the nucleotide sequences of LOC283241 BINDING SITE, designated SEQ ID:10625, to the nucleotide sequence of GAM1338 RNA, herein designated GAM RNA, also designated SEQ ID:360.

Another function of GAM1338 is therefore inhibition of LOC283241 (Accession NP_787089.1). Accordingly, utilities of GAM1338 include diagnosis, prevention and treatment of diseases and clinical conditions associated with LOC283241.

LOC283278 (Accession XP_210961.1) is another GAM1338 target gene, herein designated TARGET GENE. LOC283278 BINDING SITE is a target binding site found in the 3' untranslated region of mRNA encoded by LOC283278, corresponding to a target binding site such as BINDING SITE I, BINDING SITE II or BINDING SITE III of FIG. 8. Table 4 illustrates the complementarity of the nucleotide sequences of LOC283278 BINDING SITE, designated SEQ ID:13142, to the nucleotide sequence of GAM1338 RNA, herein designated GAM RNA, also designated SEQ ID:360.

Another function of GAM1338 is therefore inhibition of LOC283278 (Accession XP_210961.1). Accordingly, utilities of GAM1338 include diagnosis, prevention and treatment of diseases and clinical conditions associated with LOC283278.

LOC283293 (Accession XP_210962.1) is another GAM1338 target gene, herein designated TARGET GENE. LOC283293 BINDING SITE is a target binding site found in the 3' untranslated region of mRNA encoded by LOC283293, corresponding to a target binding site such as BINDING SITE I, BINDING SITE II or BINDING SITE III of FIG. 8. Table 4 illustrates the complementarity of the nucleotide sequences of LOC283293 BINDING SITE, designated SEQ ID:438, to the nucleotide sequence of GAM1338 RNA, herein designated GAM RNA, also designated SEQ ID:360.

Another function of GAM1338 is therefore inhibition of LOC283293 (Accession XP_210962.1). Accordingly, utilities of GAM1338 include diagnosis, prevention and treatment of diseases and clinical conditions associated with LOC283293.

LOC283323 (Accession XP_210973.1) is another GAM1338 target gene, herein designated TARGET GENE. LOC283323 BINDING SITE is a target binding site found in the 3' untranslated region of mRNA encoded by LOC283323, corresponding to a target binding site such as BINDING SITE I, BINDING SITE II or BINDING SITE III of FIG. 8. Table 4 illustrates the complementarity of the nucleotide sequences of LOC283323 BINDING SITE, designated SEQ ID:2314, to the nucleotide sequence of GAM1338 RNA, herein designated GAM RNA, also designated SEQ ID:360.

Another function of GAM1338 is therefore inhibition of LOC283323 (Accession XP_210973.1). Accordingly, utilities of GAM1338 include diagnosis, prevention and treatment of diseases and clinical conditions associated with LOC283323.

LOC283335 (Accession XP_210981.1) is another GAM1338 target gene, herein designated TARGET GENE. LOC283335 BINDING SITE1 and LOC283335 BINDING SITE2 are target binding sites found in untranslated regions of mRNA encoded by LOC283335, corresponding to target binding sites such as BINDING SITE I, BINDING SITE II or BINDING SITE III of FIG. 8. Table 4 illustrates the complementarity of the nucleotide sequences of LOC283335 BINDING SITE1 and LOC283335 BINDING SITE2, designated SEQ ID:9238 and SEQ ID:10626 respectively, to the nucleotide sequence of GAM1338 RNA, herein designated GAM RNA, also designated SEQ ID:360.

Another function of GAM1338 is therefore inhibition of LOC283335 (Accession XP_210981.1). Accordingly, utilities of GAM1338 include diagnosis, prevention and treatment of diseases and clinical conditions associated with LOC283335.

LOC283377 (Accession XP_208647.1) is another GAM1338 target gene, herein designated TARGET GENE. LOC283377 BINDING SITE is a target binding site found in the 3' untranslated region of mRNA encoded by LOC283377, corresponding to a target binding site such as BINDING SITE I, BINDING SITE II or BINDING SITE III of FIG. 8. Table 4 illustrates the complementarity of the nucleotide sequences of LOC283377 BINDING SITE, designated SEQ ID:8862, to the nucleotide sequence of GAM1338 RNA, herein designated GAM RNA, also designated SEQ ID:360.

Another function of GAM1338 is therefore inhibition of LOC283377 (Accession XP_208647.1). Accordingly, utilities of GAM1338 include diagnosis, prevention and treatment of diseases and clinical conditions associated with LOC283377.

LOC283387 (Accession XP_211007.1) is another GAM1338 target gene, herein designated TARGET GENE. LOC283387 BINDING SITE is a target binding site found in the 3' untranslated region of mRNA encoded by LOC283387, corresponding to a target binding site such as BINDING SITE I, BINDING SITE II or BINDING SITE III of FIG. 8. Table 4 illustrates the complementarity of the nucleotide sequences of LOC283387 BINDING SITE, designated SEQ ID:7011, to the nucleotide sequence of GAM1338 RNA, herein designated GAM RNA, also designated SEQ ID:360.

Another function of GAM1338 is therefore inhibition of LOC283387 (Accession XP_211007.1). Accordingly, utilities of GAM1338 include diagnosis, prevention and treatment of diseases and clinical conditions associated with LOC283387.

LOC283394 (Accession XP_211021.1) is another GAM1338 target gene, herein designated TARGET GENE. LOC283394 BINDING SITE is a target binding site found in the 5' untranslated region of mRNA encoded by LOC283394, corresponding to a target binding site such as BINDING SITE I, BINDING SITE II or BINDING SITE III of FIG. 8. Table 4 illustrates the complementarity of the nucleotide sequences of LOC283394 BINDING SITE, designated SEQ ID:11655, to the nucleotide sequence of GAM1338 RNA, herein designated GAM RNA, also designated SEQ ID:360.

Another function of GAM1338 is therefore inhibition of LOC283394 (Accession XP_211021.1). Accordingly, utilities of GAM1338 include diagnosis, prevention and treatment of diseases and clinical conditions associated with LOC283394.

LOC283395 (Accession XP_211020.1) is another GAM1338 target gene, herein designated TARGET GENE. LOC283395 BINDING SITE is a target binding site found in the 3' untranslated region of mRNA encoded by LOC283395, corresponding to a target binding site such as BINDING SITE I, BINDING SITE II or BINDING SITE III of FIG. 8. Table 4 illustrates the complementarity of the nucleotide sequences of LOC283395 BINDING SITE, designated SEQ ID:13838, to the nucleotide sequence of GAM1338 RNA, herein designated GAM RNA, also designated SEQ ID:360.

Another function of GAM1338 is therefore inhibition of LOC283395 (Accession XP_211020.1). Accordingly, utilities of GAM1338 include diagnosis, prevention and treatment of diseases and clinical conditions associated with LOC283395.

LOC283432 (Accession XP_211032.1) is another GAM1338 target gene, herein designated TARGET GENE. LOC283432 BINDING SITE is a target binding site found in the 5' untranslated region of mRNA encoded by LOC283432, corresponding to a target binding site such as BINDING SITE I, BINDING SITE II or BINDING SITE III of FIG. 8. Table 4 illustrates the complementarity of the nucleotide sequences of LOC283432 BINDING SITE, designated SEQ ID:6836, to the nucleotide sequence of GAM1338 RNA, herein designated GAM RNA, also designated SEQ ID:360.

Another function of GAM1338 is therefore inhibition of LOC283432 (Accession XP_211032.1). Accordingly, utilities of GAM1338 include diagnosis, prevention and treatment of diseases and clinical conditions associated with LOC283432.

LOC283434 (Accession XP_211034.1) is another GAM1338 target gene, herein designated TARGET GENE. LOC283434 BINDING SITE is a target binding site found in the 5' untranslated region of mRNA encoded by LOC283434, corresponding to a target binding site such as BINDING SITE I, BINDING SITE II or BINDING SITE III of FIG. 8. Table 4 illustrates the complementarity of the nucleotide sequences of LOC283434 BINDING SITE, designated SEQ ID:16416, to the nucleotide sequence of GAM1338 RNA, herein designated GAM RNA, also designated SEQ ID:360.

Another function of GAM1338 is therefore inhibition of LOC283434 (Accession XP_211034.1). Accordingly, utilities of GAM1338 include diagnosis, prevention and treatment of diseases and clinical conditions associated with LOC283434.

LOC283441 (Accession XP_211043.1) is another GAM1338 target gene, herein designated TARGET GENE. LOC283441 BINDING SITE is a target binding site found in the 3' untranslated region of mRNA encoded by LOC283441, corresponding to a target binding site such as BINDING SITE I, BINDING SITE II or BINDING SITE III of FIG. 8. Table 4 illustrates the complementarity of the nucleotide sequences of LOC283441 BINDING SITE, designated SEQ ID:5582, to the nucleotide sequence of GAM1338 RNA, herein designated GAM RNA, also designated SEQ ID:360.

Another function of GAM1338 is therefore inhibition of LOC283441 (Accession XP_211043.1). Accordingly, utilities of GAM1338 include diagnosis, prevention and treatment of diseases and clinical conditions associated with LOC283441.

LOC283442 (Accession XP_211037.1) is another GAM1338 target gene, herein designated TARGET GENE. LOC283442 BINDING SITE is a target binding site found in the 5' untranslated region of mRNA encoded by LOC283442, corresponding to a target binding site such as BINDING SITE I, BINDING SITE II or BINDING SITE III of FIG. 8. Table 4 illustrates the complementarity of the nucleotide sequences of LOC283442 BINDING SITE, designated SEQ ID:4817, to the nucleotide sequence of GAM1338 RNA, herein designated GAM RNA, also designated SEQ ID:360.

Another function of GAM1338 is therefore inhibition of LOC283442 (Accession XP_211037.1). Accordingly, utilities of GAM1338 include diagnosis, prevention and treatment of diseases and clinical conditions associated with LOC283442.

LOC283445 (Accession XP_211044.1) is another GAM1338 target gene, herein designated TARGET GENE. LOC283445 BINDING SITE is a target binding site found in the 5' untranslated region of mRNA encoded by LOC283445, corresponding to a target binding site such as BINDING SITE I, BINDING SITE II or BINDING SITE III of FIG. 8. Table 4 illustrates the complementarity of the nucleotide sequences of LOC283445 BINDING SITE, designated SEQ ID:9159, to the nucleotide sequence of GAM1338 RNA, herein designated GAM RNA, also designated SEQ ID:360.

Another function of GAM1338 is therefore inhibition of LOC283445 (Accession XP_211044.1). Accordingly, utilities of GAM1338 include diagnosis, prevention and treatment of diseases and clinical conditions associated with LOC283445.

LOC283452 (Accession XP_208679.1) is another GAM1338 target gene, herein designated TARGET GENE. LOC283452 BINDING SITE is a target binding site found in the 5' untranslated region of mRNA encoded by LOC283452, corresponding to a target binding site such as BINDING SITE I, BINDING SITE II or BINDING SITE III of FIG. 8. Table 4 illustrates the complementarity of the nucleotide sequences of LOC283452 BINDING SITE, designated SEQ ID:3497, to the nucleotide sequence of GAM1338 RNA, herein designated GAM RNA, also designated SEQ ID:360.

Another function of GAM1338 is therefore inhibition of LOC283452 (Accession XP_208679.1). Accordingly, utilities of GAM1338 include diagnosis, prevention and treatment of diseases and clinical conditions associated with LOC283452.

LOC283454 (Accession XP_211049.1) is another GAM1338 target gene, herein designated TARGET GENE. LOC283454 BINDING SITE is a target binding site found in the 5' untranslated region of mRNA encoded by LOC283454, corresponding to a target binding site such as BINDING SITE I, BINDING SITE II or BINDING SITE III of FIG. 8. Table 4 illustrates the complementarity of the nucleotide sequences of LOC283454 BINDING SITE, designated SEQ ID:12385, to the nucleotide sequence of GAM1338 RNA, herein designated GAM RNA, also designated SEQ ID:360.

Another function of GAM1338 is therefore inhibition of LOC283454 (Accession XP_211049.1). Accordingly, utilities of GAM1338 include diagnosis, prevention and treatment of diseases and clinical conditions associated with LOC283454.

LOC283467 (Accession XP_211050.1) is another GAM1338 target gene, herein designated TARGET GENE. LOC283467 BINDING SITE is a target binding site found in the 3' untranslated region of mRNA encoded by LOC283467, corresponding to a target binding site such as BINDING SITE I, BINDING SITE II or BINDING SITE III of FIG. 8. Table 4 illustrates the complementarity of the nucleotide sequences of LOC283467 BINDING SITE, designated SEQ ID:3857, to the nucleotide sequence of GAM1338 RNA, herein designated GAM RNA, also designated SEQ ID:360.

Another function of GAM1338 is therefore inhibition of LOC283467 (Accession XP_211050.1). Accordingly, utilities of GAM1338 include diagnosis, prevention and treatment of diseases and clinical conditions associated with LOC283467.

LOC283475 (Accession XP_211056.1) is another GAM1338 target gene, herein designated TARGET GENE. LOC283475 BINDING SITE is a target binding site found in the 3' untranslated region of mRNA encoded by LOC283475, corresponding to a target binding site such as BINDING SITE I, BINDING SITE II or BINDING SITE III of FIG. 8. Table 4 illustrates the complementarity of the nucleotide sequences of LOC283475 BINDING SITE, designated SEQ ID:12806, to the nucleotide sequence of GAM1338 RNA, herein designated GAM RNA, also designated SEQ ID:360.

Another function of GAM1338 is therefore inhibition of LOC283475 (Accession XP_211056.1). Accordingly, utilities of GAM1338 include diagnosis, prevention and treatment of diseases and clinical conditions associated with LOC283475.

LOC283507 (Accession XP_211075.1) is another GAM1338 target gene, herein designated TARGET GENE. LOC283507 BINDING SITE is a target binding site found in the 3' untranslated region of mRNA encoded by LOC283507, corresponding to a target binding site such as BINDING SITE I, BINDING SITE II or BINDING SITE III of FIG. 8. Table 4 illustrates the complementarity of the nucleotide sequences of LOC283507 BINDING SITE, designated SEQ ID:18182, to the nucleotide sequence of GAM1338 RNA, herein designated GAM RNA, also designated SEQ ID:360.

Another function of GAM1338 is therefore inhibition of LOC283507 (Accession XP_211075.1). Accordingly, utilities of GAM1338 include diagnosis, prevention and treatment of diseases and clinical conditions associated with LOC283507.

LOC283514 (Accession XP_210264.2) is another GAM1338 target gene, herein designated TARGET GENE. LOC283514 BINDING SITE is a target binding site found in the 3' untranslated region of mRNA encoded by LOC283514, corresponding to a target binding site such as BINDING SITE I, BINDING SITE II or BINDING SITE III of FIG. 8. Table 4 illustrates the complementarity of the nucleotide sequences of LOC283514 BINDING SITE, designated SEQ ID:6317, to the nucleotide sequence of GAM1338 RNA, herein designated GAM RNA, also designated SEQ ID:360.

Another function of GAM1338 is therefore inhibition of LOC283514 (Accession XP_210264.2). Accordingly, utilities of GAM1338 include diagnosis, prevention and treatment of diseases and clinical conditions associated with LOC283514.

LOC283534 (Accession XP_211083.1) is another GAM1338 target gene, herein designated TARGET GENE. LOC283534 BINDING SITE is a target binding site found in the 3' untranslated region of mRNA encoded by LOC283534, corresponding to a target binding site such as BINDING SITE I, BINDING SITE II or BINDING SITE III of FIG. 8. Table 4 illustrates the complementarity of the nucleotide sequences of LOC283534 BINDING SITE, designated SEQ ID:13197, to the nucleotide sequence of GAM1338 RNA, herein designated GAM RNA, also designated SEQ ID:360.

Another function of GAM1338 is therefore inhibition of LOC283534 (Accession XP_211083.1). Accordingly, utilities of GAM1338 include diagnosis, prevention and treatment of diseases and clinical conditions associated with LOC283534.

LOC283551 (Accession XP_211110.1) is another GAM1338 target gene, herein designated TARGET GENE. LOC283551 BINDING SITE is a target binding site found in the 3' untranslated region of mRNA encoded by LOC283551, corresponding to a target binding site such as BINDING SITE I, BINDING SITE II or BINDING SITE III of FIG. 8. Table 4 illustrates the complementarity of the nucleotide sequences of LOC283551 BINDING SITE, designated SEQ ID:10790, to the nucleotide sequence of GAM1338 RNA, herein designated GAM RNA, also designated SEQ ID:360.

Another function of GAM1338 is therefore inhibition of LOC283551 (Accession XP_211110.1). Accordingly, utilities of GAM1338 include diagnosis, prevention and treatment of diseases and clinical conditions associated with LOC283551.

LOC283575 (Accession XP_211095.1) is another GAM1338 target gene, herein designated TARGET GENE. LOC283575 BINDING SITE1 and LOC283575 BINDING SITE2 are target binding sites found in untranslated regions of mRNA encoded by LOC283575, corresponding to target binding sites such as BINDING SITE I, BINDING SITE II or BINDING SITE III of FIG. 8. Table 4 illustrates the complementarity of the nucleotide sequences of LOC283575 BINDING SITE1 and LOC283575 BINDING SITE2, designated SEQ ID:8540 and SEQ ID:13153 respectively, to the nucleotide sequence of GAM1338 RNA, herein designated GAM RNA, also designated SEQ ID:360.

Another function of GAM1338 is therefore inhibition of LOC283575 (Accession XP_211095.1). Accordingly, utilities of GAM1338 include diagnosis, prevention and treatment of diseases and clinical conditions associated with LOC283575.

LOC283588 (Accession NP_787093.1) is another GAM1338 target gene, herein designated TARGET GENE. LOC283588 BINDING SITE is a target binding site found in the 3' untranslated region of mRNA encoded by LOC283588, corresponding to a target binding site such as BINDING SITE I, BINDING SITE II or BINDING SITE III of FIG. 8. Table 4 illustrates the complementarity of the nucleotide sequences of LOC283588 BINDING SITE, designated SEQ ID:14938, to the nucleotide sequence of GAM1338 RNA, herein designated GAM RNA, also designated SEQ ID:360.

Another function of GAM1338 is therefore inhibition of LOC283588 (Accession NP_787093.1). Accordingly, utilities of GAM1338 include diagnosis, prevention and treatment of diseases and clinical conditions associated with LOC283588.

LOC283624 (Accession XP_211126.1) is another GAM1338 target gene, herein designated TARGET GENE. LOC283624 BINDING SITE1 and LOC283624 BINDING SITE2 are target binding sites found in untranslated regions of mRNA encoded by LOC283624, corresponding to target binding sites such as BINDING SITE I, BINDING SITE II or BINDING SITE III of FIG. 8. Table 4 illustrates the complementarity of the nucleotide sequences of LOC283624 BINDING SITE1 and LOC283624 BINDING SITE2, designated SEQ ID:13972 and SEQ ID:1137 respectively, to the nucleotide sequence of GAM1338 RNA, herein designated GAM RNA, also designated SEQ ID:360.

Another function of GAM1338 is therefore inhibition of LOC283624 (Accession XP_211126.1). Accordingly, utilities of GAM1338 include diagnosis, prevention and treatment of diseases and clinical conditions associated with LOC283624.

LOC283637 (Accession XP_211134.1) is another GAM1338 target gene, herein designated TARGET GENE. LOC283637 BINDING SITE1 and LOC283637 BINDING SITE2 are target binding sites found in untranslated regions of mRNA encoded by LOC283637, corresponding to target binding sites such as BINDING SITE I, BINDING SITE II or BINDING SITE III of FIG. 8. Table 4 illustrates the complementarity of the nucleotide sequences of LOC283637 BINDING SITE1 and LOC283637 BINDING SITE2, designated SEQ ID:3786 and SEQ ID:12382 respectively, to the nucleotide sequence of GAM1338 RNA, herein designated GAM RNA, also designated SEQ ID:360.

Another function of GAM1338 is therefore inhibition of LOC283637 (Accession XP_211134.1). Accordingly, utilities of GAM1338 include diagnosis, prevention and treatment of diseases and clinical conditions associated with LOC283637.

LOC283641 (Accession XP_208764.1) is another GAM1338 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:435, to the nucleotide sequence of GAM1338 RNA, herein designated GAM RNA, also designated SEQ ID:360.

Another function of GAM1338 is therefore inhibition of LOC283641 (Accession XP_208764.1). Accordingly, utilities of GAM1338 include diagnosis, prevention and treatment of diseases and clinical conditions associated with LOC283641.

LOC283672 (Accession XP_211152.1) is another GAM1338 target gene, herein designated TARGET GENE. LOC283672 BINDING SITE is a target binding site found in the 5' untranslated region of mRNA encoded by LOC283672, corresponding to a target binding site such as BINDING SITE I, BINDING SITE II or BINDING SITE III of FIG. 8. Table 4 illustrates the complementarity of the nucleotide sequences of LOC283672 BINDING SITE, designated SEQ ID:11655, to the nucleotide sequence of GAM1338 RNA, herein designated GAM RNA, also designated SEQ ID:360.

Another function of GAM1338 is therefore inhibition of LOC283672 (Accession XP_211152.1). Accordingly, utilities of GAM1338 include diagnosis, prevention and treatment of diseases and clinical conditions associated with LOC283672.

LOC283693 (Accession XP_208788.1) is another GAM1338 target gene, herein designated TARGET GENE. LOC283693 BINDING SITE is a target binding site found in the 3' untranslated region of mRNA encoded by LOC283693, corresponding to a target binding site such as BINDING SITE I, BINDING SITE II or BINDING SITE III of FIG. 8. Table 4 illustrates the complementarity of the nucleotide sequences of LOC283693 BINDING SITE, designated SEQ ID:16069, to the nucleotide sequence of GAM1338 RNA, herein designated GAM RNA, also designated SEQ ID:360.

Another function of GAM1338 is therefore inhibition of LOC283693 (Accession XP_208788.1). Accordingly, utilities of GAM1338 include diagnosis, prevention and treatment of diseases and clinical conditions associated with LOC283693.

LOC283701 (Accession XP_211170.3) is another GAM1338 target gene, herein designated TARGET GENE. LOC283701 BINDING SITE1 and LOC283701 BINDING SITE2 are target binding sites found in untranslated regions of mRNA encoded by LOC283701, corresponding to target binding sites such as BINDING SITE I, BINDING SITE II or BINDING SITE III of FIG. 8. Table 4 illustrates the complementarity of the nucleotide sequences of LOC283701 BINDING SITE1 and LOC283701 BINDING SITE2, designated SEQ ID:777 and SEQ ID:6491 respectively, to the nucleotide sequence of GAM1338 RNA, herein designated GAM RNA, also designated SEQ ID:360.

Another function of GAM1338 is therefore inhibition of LOC283701 (Accession XP_211170.3). Accordingly, utilities of GAM1338 include diagnosis, prevention and treatment of diseases and clinical conditions associated with LOC283701.

LOC283741 (Accession XP_208115.1) is another GAM1338 target gene, herein designated TARGET GENE. LOC283741 BINDING SITE is a target binding site found in the 3' untranslated region of mRNA encoded by LOC283741, corresponding to a target binding site such as BINDING SITE I, BINDING SITE II or BINDING SITE III of FIG. 8. Table 4 illustrates the complementarity of the nucleotide sequences of LOC283741 BINDING SITE, designated SEQ ID:3109, to the nucleotide sequence of GAM1338 RNA, herein designated GAM RNA, also designated SEQ ID:360.

Another function of GAM1338 is therefore inhibition of LOC283741 (Accession XP_208115.1). Accordingly, utilities of GAM1338 include diagnosis, prevention and treatment of diseases and clinical conditions associated with LOC283741.

LOC283767 (Accession XP_208835.1) is another GAM1338 target gene, herein designated TARGET GENE. LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:3888, to the nucleotide sequence of GAM1338 RNA, herein designated GAM RNA, also designated SEQ ID:360.

Another function of GAM1338 is therefore inhibition of LOC283767 (Accession XP_208835.1). Accordingly, utilities of GAM1338 include diagnosis, prevention and treatment of diseases and clinical conditions associated with LOC283767.

LOC283778 (Accession XP_211199.1) is another GAM1338 target gene, herein designated TARGET GENE. LOC283778 BINDING SITE is a target binding site found in the 5' untranslated region of mRNA encoded by LOC283778, corresponding to a target binding site such as BINDING SITE I, BINDING SITE II or BINDING SITE III of FIG. 8. Table 4 illustrates the complementarity of the nucleotide sequences of LOC283778 BINDING SITE, designated SEQ ID:15679, to the nucleotide sequence of GAM1338 RNA, herein designated GAM RNA, also designated SEQ ID:360.

Another function of GAM1338 is therefore inhibition of LOC283778 (Accession XP_211199.1). Accordingly, utilities of GAM1338 include diagnosis, prevention and treatment of diseases and clinical conditions associated with LOC283778.

LOC283801 (Accession XP_208122.1) is another GAM1338 target gene, herein designated TARGET GENE. LOC283801 BINDING SITE is a target binding site found in the 3' untranslated region of mRNA encoded by LOC283801, corresponding to a target binding site such as BINDING SITE I, BINDING SITE II or BINDING SITE III of FIG. 8. Table 4 illustrates the complementarity of the nucleotide sequences of LOC283801 BINDING SITE, designated SEQ ID:11237, to the nucleotide sequence of GAM1338 RNA, herein designated GAM RNA, also designated SEQ ID:360.

Another function of GAM1338 is therefore inhibition of LOC283801 (Accession XP_208122.1). Accordingly, utilities of GAM1338 include diagnosis, prevention and treatment of diseases and clinical conditions associated with LOC283801.

LOC283802 (Accession XP_208850.1) is another GAM1338 target gene, herein designated TARGET GENE. LOC283802 BINDING SITE is a target binding site found in the 3' untranslated region of mRNA encoded by LOC283802, corresponding to a target binding site such as BINDING SITE I, BINDING SITE II or BINDING SITE III of FIG. 8. Table 4 illustrates the complementarity of the nucleotide sequences of LOC283802 BINDING SITE, designated SEQ ID:16635, to the nucleotide sequence of GAM1338 RNA, herein designated GAM RNA, also designated SEQ ID:360.

Another function of GAM1338 is therefore inhibition of LOC283802 (Accession XP_208850.1). Accordingly, utilities of GAM1338 include diagnosis, prevention and treatment of diseases and clinical conditions associated with LOC283802.

LOC283818 (Accession XP_211218.1) is another GAM1338 target gene, herein designated TARGET GENE. LOC283818 BINDING SITE is a target binding site found in the 3' untranslated region of mRNA encoded by LOC283818, corresponding to a target binding site such as BINDING SITE I, BINDING SITE II or BINDING SITE III of FIG. 8. Table 4 illustrates the complementarity of the nucleotide sequences of LOC283818 BINDING SITE, designated SEQ ID:3834, to the nucleotide sequence of GAM1338 RNA, herein designated GAM RNA, also designated SEQ ID:360.

Another function of GAM1338 is therefore inhibition of LOC283818 (Accession XP_211218.1). Accordingly, utilities of GAM1338 include diagnosis, prevention and treatment of diseases and clinical conditions associated with LOC283818.

LOC283849 (Accession XP_208870.1) is another GAM1338 target gene, herein designated TARGET GENE. LOC283849 BINDING SITE is a target binding site found in the 5' untranslated region of multiple transcripts of mRNA encoded by LOC283849, corresponding to a target binding site such as BINDING SITE I, BINDING SITE II or BINDING SITE III of FIG. 8. Table 4 illustrates the complementarity of the nucleotide sequences of LOC283849 BINDING SITE, designated SEQ ID:2515, to the nucleotide sequence of GAM1338 RNA, herein designated GAM RNA, also designated SEQ ID:360.

Another function of GAM1338 is therefore inhibition of LOC283849 (Accession XP_208870.1). Accordingly, utilities of GAM1338 include diagnosis, prevention and treatment of diseases and clinical conditions associated with LOC283849.

LOC283849 (Accession NP_848611.1) is another GAM1338 target gene, herein designated TARGET GENE. LOC283849 BINDING SITE is a target binding site found in the 5' untranslated region of multiple transcripts of mRNA encoded by LOC283849, corresponding to a target binding site such as BINDING SITE I, BINDING SITE II or BINDING SITE III of FIG. 8. Table 4 illustrates the complementarity of the nucleotide sequences of LOC283849 BINDING SITE, designated SEQ ID:2515, to the nucleotide sequence of GAM1338 RNA, herein designated GAM RNA, also designated SEQ ID:360.

Another function of GAM1338 is therefore inhibition of LOC283849 (Accession NP_848611.1). Accordingly, utilities of GAM1338 include diagnosis, prevention and treatment of diseases and clinical conditions associated with LOC283849.

LOC283851 (Accession XP_211229.1) is another GAM1338 target gene, herein designated TARGET GENE. LOC283851 BINDING SITE is a target binding site found in the 3' untranslated region of mRNA encoded by LOC283851, corresponding to a target binding site such as BINDING SITE I, BINDING SITE II or BINDING SITE III of FIG. 8. Table 4 illustrates the complementarity of the nucleotide sequences of LOC283851 BINDING SITE, designated SEQ ID:12708, to the nucleotide sequence of GAM1338 RNA, herein designated GAM RNA, also designated SEQ ID:360.

Another function of GAM1338 is therefore inhibition of LOC283851 (Accession XP_211229.1). Accordingly, utilities of GAM1338 include diagnosis, prevention and treatment of diseases and clinical conditions associated with LOC283851.

LOC283856 (Accession XP_211233.1) is another GAM1338 target gene, herein designated TARGET GENE. LOC283856 BINDING SITE is a target binding site found in the 3' untranslated region of mRNA encoded by LOC283856, corresponding to a target binding site such as BINDING SITE I, BINDING SITE II or BINDING SITE III of FIG. 8. Table 4 illustrates the complementarity of the nucleotide sequences of LOC283856 BINDING SITE, designated SEQ ID:11601, to the nucleotide sequence of GAM1338 RNA, herein designated GAM RNA, also designated SEQ ID:360.

Another function of GAM1338 is therefore inhibition of LOC283856 (Accession XP_211233.1). Accordingly, utilities of GAM1338 include diagnosis, prevention and treatment of diseases and clinical conditions associated with LOC283856.

LOC283861 (Accession NP_787095.1) is another GAM1338 target gene, herein designated TARGET GENE. LOC283861 BINDING SITE1 and LOC283861 BINDING SITE2 are target binding sites found in untranslated regions of mRNA encoded by LOC283861, corresponding to target binding sites such as BINDING SITE I, BINDING SITE II or BINDING SITE III of FIG. 8. Table 4 illustrates the complementarity of the nucleotide sequences of LOC283861 BINDING SITE1 and LOC283861 BINDING SITE2, designated SEQ ID:8996 and SEQ ID:10879 respectively, to the nucleotide sequence of GAM1338 RNA, herein designated GAM RNA, also designated SEQ ID:360.

Another function of GAM1338 is therefore inhibition of LOC283861 (Accession NP_787095.1). Accordingly, utilities of GAM1338 include diagnosis, prevention and treatment of diseases and clinical conditions associated with LOC283861.

LOC283863 (Accession XP_208875.1) is another GAM1338 target gene, herein designated TARGET GENE. LOC283863 BINDING SITE is a target binding site found in the 3' untranslated region of mRNA encoded by LOC283863, corresponding to a target binding site such as BINDING SITE I, BINDING SITE II or BINDING SITE III of FIG. 8. Table 4 illustrates the complementarity of the nucleotide sequences of LOC283863 BINDING SITE, designated SEQ ID:14614, to the nucleotide sequence of GAM1338 RNA, herein designated GAM RNA, also designated SEQ ID:360.

Another function of GAM1338 is therefore inhibition of LOC283863 (Accession XP_208875.1). Accordingly, utilities of GAM1338 include diagnosis, prevention and treatment of diseases and clinical conditions associated with LOC283863.

LOC283887 (Accession XP_211248.2) is another GAM1338 target gene, herein designated TARGET GENE.

LOC283887 BINDING SITE is a target binding site found in the 5' untranslated region of mRNA encoded by LOC283887, corresponding to a target binding site such as BINDING SITE I, BINDING SITE II or BINDING SITE III of FIG. 8. Table 4 illustrates the complementarity of the nucleotide sequences of LOC283887 BINDING SITE, designated SEQ ID:9775, to the nucleotide sequence of GAM1338 RNA, herein designated GAM RNA, also designated SEQ ID:360.

Another function of GAM1338 is therefore inhibition of LOC283887 (Accession XP_211248.2). Accordingly, utilities of GAM1338 include diagnosis, prevention and treatment of diseases and clinical conditions associated with LOC283887.

LOC283888 (Accession XP_211249.1) is another GAM1338 target gene, herein designated TARGET GENE. LOC283888 BINDING SITE1 and LOC283888 BINDING SITE2 are target binding sites found in untranslated regions of mRNA encoded by LOC283888, corresponding to target binding sites such as BINDING SITE I, BINDING SITE II or BINDING SITE III of FIG. 8. Table 4 illustrates the complementarity of the nucleotide sequences of LOC283888 BINDING SITE1 and LOC283888 BINDING SITE2, designated SEQ ID:2692 and SEQ ID:5011 respectively, to the nucleotide sequence of GAM1338 RNA, herein designated GAM RNA, also designated SEQ ID:360.

Another function of GAM1338 is therefore inhibition of LOC283888 (Accession XP_211249.1). Accordingly, utilities of GAM1338 include diagnosis, prevention and treatment of diseases and clinical conditions associated with LOC283888.

LOC283889 (Accession XP_208899.1) is another GAM1338 target gene, herein designated TARGET GENE. LOC283889 BINDING SITE is a target binding site found in the 3' untranslated region of mRNA encoded by LOC283889, corresponding to a target binding site such as BINDING SITE I, BINDING SITE II or BINDING SITE III of FIG. 8. Table 4 illustrates the complementarity of the nucleotide sequences of LOC283889 BINDING SITE, designated SEQ ID:13686, to the nucleotide sequence of GAM1338 RNA, herein designated GAM RNA, also designated SEQ ID:360.

Another function of GAM1338 is therefore inhibition of LOC283889 (Accession XP_208899.1). Accordingly, utilities of GAM1338 include diagnosis, prevention and treatment of diseases and clinical conditions associated with LOC283889.

LOC283928 (Accession XP_208909.1) is another GAM1338 target gene, herein designated TARGET GENE. LOC283928 BINDING SITE1 and LOC283928 BINDING SITE2 are target binding sites found in untranslated regions of mRNA encoded by LOC283928, corresponding to target binding sites such as BINDING SITE I, BINDING SITE II or BINDING SITE III of FIG. 8. Table 4 illustrates the complementarity of the nucleotide sequences of LOC283928 BINDING SITE1 and LOC283928 BINDING SITE2, designated SEQ ID:13293 and SEQ ID:3604 respectively, to the nucleotide sequence of GAM1338 RNA, herein designated GAM RNA, also designated SEQ ID:360.

Another function of GAM1338 is therefore inhibition of LOC283928 (Accession XP_208909.1). Accordingly, utilities of GAM1338 include diagnosis, prevention and treatment of diseases and clinical conditions associated with LOC283928.

LOC283929 (Accession XP_208905.2) is another GAM1338 target gene, herein designated TARGET GENE. LOC283929 BINDING SITE is a target binding site found in the 5' untranslated region of mRNA encoded by LOC283929, corresponding to a target binding site such as BINDING SITE I, BINDING SITE II or BINDING SITE III of FIG. 8. Table 4 illustrates the complementarity of the nucleotide sequences of LOC283929 BINDING SITE, designated SEQ ID:10232, to the nucleotide sequence of GAM1338 RNA, herein designated GAM RNA, also designated SEQ ID:360.

Another function of GAM1338 is therefore inhibition of LOC283929 (Accession XP_208905.2). Accordingly, utilities of GAM1338 include diagnosis, prevention and treatment of diseases and clinical conditions associated with LOC283929.

LOC283964 (Accession XP_208145.2) is another GAM1338 target gene, herein designated TARGET GENE. LOC283964 BINDING SITE is a target binding site found in the 3' untranslated region of mRNA encoded by LOC283964, corresponding to a target binding site such as BINDING SITE I, BINDING SITE II or BINDING SITE III of FIG. 8. Table 4 illustrates the complementarity of the nucleotide sequences of LOC283964 BINDING SITE, designated SEQ ID:1384, to the nucleotide sequence of GAM1338 RNA, herein designated GAM RNA, also designated SEQ ID:360.

Another function of GAM1338 is therefore inhibition of LOC283964 (Accession XP_208145.2). Accordingly, utilities of GAM1338 include diagnosis, prevention and treatment of diseases and clinical conditions associated with LOC283964.

LOC284016 (Accession XP_211298.1) is another GAM1338 target gene, herein designated TARGET GENE. LOC284016 BINDING SITE is a target binding site found in the 3' untranslated region of mRNA encoded by LOC284016, corresponding to a target binding site such as BINDING SITE I, BINDING SITE II or BINDING SITE III of FIG. 8. Table 4 illustrates the complementarity of the nucleotide sequences of LOC284016 BINDING SITE, designated SEQ ID:795, to the nucleotide sequence of GAM1338 RNA, herein designated GAM RNA, also designated SEQ ID:360.

Another function of GAM1338 is therefore inhibition of LOC284016 (Accession XP_211298.1). Accordingly, utilities of GAM1338 include diagnosis, prevention and treatment of diseases and clinical conditions associated with LOC284016.

LOC284017 (Accession XP_208961.1) is another GAM1338 target gene, herein designated TARGET GENE. LOC284017 BINDING SITE is a target binding site found in the 3' untranslated region of mRNA encoded by LOC284017, corresponding to a target binding site such as BINDING SITE I, BINDING SITE II or BINDING SITE III of FIG. 8. Table 4 illustrates the complementarity of the nucleotide sequences of LOC284017 BINDING SITE, designated SEQ ID:3858, to the nucleotide sequence of GAM1338 RNA, herein designated GAM RNA, also designated SEQ ID:360.

Another function of GAM1338 is therefore inhibition of LOC284017 (Accession XP_208961.1). Accordingly, utilities of GAM1338 include diagnosis, prevention and treatment of diseases and clinical conditions associated with LOC284017.

LOC284019 (Accession XP_211302.1) is another GAM1338 target gene, herein designated TARGET GENE. LOC284019 BINDING SITE is a target binding site found in the 3' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:19482, to the nucleotide sequence of GAM1338 RNA, herein designated GAM RNA, also designated SEQ ID:360.

Another function of GAM1338 is therefore inhibition of LOC284019 (Accession XP_211302.1). Accordingly, utilities of GAM1338 include diagnosis, prevention and treatment of diseases and clinical conditions associated with LOC284019.

LOC284023 (Accession XP_208983.3) is another GAM1338 target gene, herein designated TARGET GENE. LOC284023 BINDING SITE1 and LOC284023 BINDING SITE2 are target binding sites found in untranslated regions of mRNA encoded by LOC284023, corresponding to target binding sites such as BINDING SITE I, BINDING SITE II or BINDING SITE III of FIG. 8. Table 4 illustrates the complementarity of the nucleotide sequences of LOC284023 BINDING SITE1 and LOC284023 BINDING SITE2, designated SEQ ID:5520 and SEQ ID:429 respectively, to the nucleotide sequence of GAM1338 RNA, herein designated GAM RNA, also designated SEQ ID:360.

Another function of GAM1338 is therefore inhibition of LOC284023 (Accession XP_208983.3). Accordingly, utilities of GAM1338 include diagnosis, prevention and treatment of diseases and clinical conditions associated with LOC284023.

LOC284048 (Accession XP_208152.1) is another GAM1338 target gene, herein designated TARGET GENE. LOC284048 BINDING SITE is a target binding site found in the 3' untranslated region of mRNA encoded by LOC284048, corresponding to a target binding site such as BINDING SITE I, BINDING SITE II or BINDING SITE III of FIG. 8. Table 4 illustrates the complementarity of the nucleotide sequences of LOC284048 BINDING SITE, designated SEQ ID:17222, to the nucleotide sequence of GAM1338 RNA, herein designated GAM RNA, also designated SEQ ID:360.

Another function of GAM1338 is therefore inhibition of LOC284048 (Accession XP_208152.1). Accordingly, utilities of GAM1338 include diagnosis, prevention and treatment of diseases and clinical conditions associated with LOC284048.

LOC284063 (Accession XP_208992.1) is another GAM1338 target gene, herein designated TARGET GENE. LOC284063 BINDING SITE is a target binding site found in the 3' untranslated region of mRNA encoded by LOC284063, corresponding to a target binding site such as BINDING SITE I, BINDING SITE II or BINDING SITE III of FIG. 8. Table 4 illustrates the complementarity of the nucleotide sequences of LOC284063 BINDING SITE, designated SEQ ID:17713, to the nucleotide sequence of GAM1338 RNA, herein designated GAM RNA, also designated SEQ ID:360.

Another function of GAM1338 is therefore inhibition of LOC284063 (Accession XP_208992.1). Accordingly, utilities of GAM1338 include diagnosis, prevention and treatment of diseases and clinical conditions associated with LOC284063.

LOC284074 (Accession XP_211321.1) is another GAM1338 target gene, herein designated TARGET GENE. LOC284074 BINDING SITE1 and LOC284074 BINDING SITE2 are target binding sites found in untranslated regions of mRNA encoded by LOC284074, corresponding to target binding sites such as BINDING SITE I, BINDING SITE II or BINDING SITE III of FIG. 8. Table 4 illustrates the complementarity of the nucleotide sequences of LOC284074 BINDING SITE1 and LOC284074 BINDING SITE2, designated SEQ ID:18547 and SEQ ID:5751 respectively, to the nucleotide sequence of GAM1338 RNA, herein designated GAM RNA, also designated SEQ ID:360.

Another function of GAM1338 is therefore inhibition of LOC284074 (Accession XP_211321.1). Accordingly, utilities of GAM1338 include diagnosis, prevention and treatment of diseases and clinical conditions associated with LOC284074.

LOC284082 (Accession XP_211323.1) is another GAM1338 target gene, herein designated TARGET GENE. LOC284082 BINDING SITE is a target binding site found in the 3' untranslated region of mRNA encoded by LOC284082, corresponding to a target binding site such as BINDING SITE I, BINDING SITE II or BINDING SITE III of FIG. 8. Table 4 illustrates the complementarity of the nucleotide sequences of LOC284082 BINDING SITE, designated SEQ ID:18527, to the nucleotide sequence of GAM1338 RNA, herein designated GAM RNA, also designated SEQ ID:360.

Another function of GAM1338 is therefore inhibition of LOC284082 (Accession XP_211323.1). Accordingly, utilities of GAM1338 include diagnosis, prevention and treatment of diseases and clinical conditions associated with LOC284082.

LOC284095 (Accession XP_211324.1) is another GAM1338 target gene, herein designated TARGET GENE. LOC284095 BINDING SITE1 through LOC284095 BINDING SITE3 are target binding sites found in untranslated regions of mRNA encoded by LOC284095, corresponding to target binding sites such as BINDING SITE I, BINDING SITE II or BINDING SITE III of FIG. 8. Table 4 illustrates the complementarity of the nucleotide sequences of LOC284095 BINDING SITE1 through LOC284095 BINDING SITE3, designated SEQ ID:18259, SEQ ID:19595 and SEQ ID:16884 respectively, to the nucleotide sequence of GAM1338 RNA, herein designated GAM RNA, also designated SEQ ID:360.

Another function of GAM1338 is therefore inhibition of LOC284095 (Accession XP_211324.1). Accordingly, utilities of GAM1338 include diagnosis, prevention and treatment of diseases and clinical conditions associated with LOC284095.

LOC284098 (Accession XP_209008.3) is another GAM1338 target gene, herein designated TARGET GENE. LOC284098 BINDING SITE is a target binding site found in the 3' untranslated region of mRNA encoded by LOC284098, corresponding to a target binding site such as BINDING SITE I, BINDING SITE II or BINDING SITE III of FIG. 8. Table 4 illustrates the complementarity of the nucleotide sequences of LOC284098 BINDING SITE, designated SEQ ID:18178, to the nucleotide sequence of GAM1338 RNA, herein designated GAM RNA, also designated SEQ ID:360.

Another function of GAM1338 is therefore inhibition of LOC284098 (Accession XP_209008.3). Accordingly, utilities of GAM1338 include diagnosis, prevention and treatment of diseases and clinical conditions associated with LOC284098.

LOC284100 (Accession XP_209015.1) is another GAM1338 target gene, herein designated TARGET GENE. LOC284100 BINDING SITE is a target binding site found in the 3' untranslated region of mRNA encoded by LOC284100, corresponding to a target binding site such as BINDING SITE I, BINDING SITE II or BINDING SITE III of FIG. 8. Table 4 illustrates the complementarity of the nucleotide sequences of LOC284100 BINDING SITE, designated SEQ ID:11656, to the nucleotide sequence of GAM1338 RNA, herein designated GAM RNA, also designated SEQ ID:360.

Another function of GAM1338 is therefore inhibition of LOC284100 (Accession XP_209015.1). Accordingly, utilities of GAM1338 include diagnosis, prevention and treatment of diseases and clinical conditions associated with LOC284100.

LOC284101 (Accession XP_209019.1) is another GAM1338 target gene, herein designated TARGET GENE. LOC284101 BINDING SITE is a target binding site found in the 5' untranslated region of mRNA encoded by LOC284101, corresponding to a target binding site such as BINDING SITE I, BINDING SITE II or BINDING SITE III of FIG. 8. Table 4 illustrates the complementarity of the nucleotide sequences of LOC284101 BINDING SITE, designated SEQ ID:4581, to the nucleotide sequence of GAM1338 RNA, herein designated GAM RNA, also designated SEQ ID:360.

Another function of GAM1338 is therefore inhibition of LOC284101 (Accession XP_209019.1). Accordingly, utilities of GAM1338 include diagnosis, prevention and treatment of diseases and clinical conditions associated with LOC284101.

LOC284102 (Accession XP_211327.3) is another GAM1338 target gene, herein designated TARGET GENE. LOC284102 BINDING SITE1 through LOC284102 BINDING SITE3 are target binding sites found in untranslated regions of mRNA encoded by LOC284102, corresponding to target binding sites such as BINDING SITE I, BINDING SITE II or BINDING SITE III of FIG. 8. Table 4 illustrates the complementarity of the nucleotide sequences of LOC284102 BINDING SITE1 through LOC284102 BINDING SITE3, designated SEQ ID:8270, SEQ ID:17111 and SEQ ID:6349 respectively, to the nucleotide sequence of GAM1338 RNA, herein designated GAM RNA, also designated SEQ ID:360.

Another function of GAM1338 is therefore inhibition of LOC284102 (Accession XP_211327.3). Accordingly, utilities of GAM1338 include diagnosis, prevention and treatment of diseases and clinical conditions associated with LOC284102.

LOC284117 (Accession XP_209024.1) is another GAM1338 target gene, herein designated TARGET GENE. LOC284117 BINDING SITE is a target binding site found in the 3' untranslated region of mRNA encoded by LOC284117, corresponding to a target binding site such as BINDING SITE I, BINDING SITE II or BINDING SITE III of FIG. 8. Table 4 illustrates the complementarity of the nucleotide sequences of LOC284117 BINDING SITE, designated SEQ ID:11347, to the nucleotide sequence of GAM1338 RNA, herein designated GAM RNA, also designated SEQ ID:360.

Another function of GAM1338 is therefore inhibition of LOC284117 (Accession XP_209024.1). Accordingly, utilities of GAM1338 include diagnosis, prevention and treatment of diseases and clinical conditions associated with LOC284117.

LOC284128 (Accession XP_211342.1) is another GAM1338 target gene, herein designated TARGET GENE. LOC284128 BINDING SITE is a target binding site found in the 3' untranslated region of mRNA encoded by LOC284128, corresponding to a target binding site such as BINDING SITE I, BINDING SITE II or BINDING SITE III of FIG. 8. Table 4 illustrates the complementarity of the nucleotide sequences of LOC284128 BINDING SITE, designated SEQ ID:17271, to the nucleotide sequence of GAM1338 RNA, herein designated GAM RNA, also designated SEQ ID:360.

Another function of GAM1338 is therefore inhibition of LOC284128 (Accession XP_211342.1). Accordingly, utilities of GAM1338 include diagnosis, prevention and treatment of diseases and clinical conditions associated with LOC284128.

LOC284135 (Accession XP_209032.1) is another GAM1338 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:5319, to the nucleotide sequence of GAM1338 RNA, herein designated GAM RNA, also designated SEQ ID:360.

Another function of GAM1338 is therefore inhibition of LOC284135 (Accession XP_209032.1). Accordingly, utilities of GAM1338 include diagnosis, prevention and treatment of diseases and clinical conditions associated with LOC284135.

LOC284183 (Accession XP_209059.1) is another GAM1338 target gene, herein designated TARGET GENE. LOC284183 BINDING SITE1 and LOC284183 BINDING SITE2 are target binding sites found in untranslated regions of mRNA encoded by LOC284183, corresponding to target binding sites such as BINDING SITE I, BINDING SITE II or BINDING SITE III of FIG. 8. Table 4 illustrates the complementarity of the nucleotide sequences of LOC284183 BINDING SITE1 and LOC284183 BINDING SITE2, designated SEQ ID:8524 and SEQ ID:11460 respectively, to the nucleotide sequence of GAM1338 RNA, herein designated GAM RNA, also designated SEQ ID:360.

Another function of GAM1338 is therefore inhibition of LOC284183 (Accession XP_209059.1). Accordingly, utilities of GAM1338 include diagnosis, prevention and treatment of diseases and clinical conditions associated with LOC284183.

LOC284186 (Accession XP_209060.2) is another GAM1338 target gene, herein designated TARGET GENE. LOC284186 BINDING SITE is a target binding site found in the 3' untranslated region of mRNA encoded by LOC284186, corresponding to a target binding site such as BINDING SITE I, BINDING SITE II or BINDING SITE III of FIG. 8. Table 4 illustrates the complementarity of the nucleotide sequences of LOC284186 BINDING SITE, designated SEQ ID:18182, to the nucleotide sequence of GAM1338 RNA, herein designated GAM RNA, also designated SEQ ID:360.

Another function of GAM1338 is therefore inhibition of LOC284186 (Accession XP_209060.2). Accordingly, utilities of GAM1338 include diagnosis, prevention and treatment of diseases and clinical conditions associated with LOC284186.

LOC284286 (Accession XP_211419.1) is another GAM1338 target gene, herein designated TARGET GENE. LOC284286 BINDING SITE is a target binding site found in the 3' untranslated region of mRNA encoded by LOC284286, corresponding to a target binding site such as BINDING SITE I, BINDING SITE II or BINDING SITE III of FIG. 8. Table 4 illustrates the complementarity of the nucleotide sequences of LOC284286 BINDING SITE, designated SEQ ID:5521, to the nucleotide sequence of GAM1338 RNA, herein designated GAM RNA, also designated SEQ ID:360.

Another function of GAM1338 is therefore inhibition of LOC284286 (Accession XP_211419.1). Accordingly, utilities of GAM1338 include diagnosis, prevention and treatment of diseases and clinical conditions associated with LOC284286.

LOC284289 (Accession XP_209105.1) is another GAM1338 target gene, herein designated TARGET GENE. LOC284289 BINDING SITE is a target binding site found in the 3' untranslated region of mRNA encoded by LOC284289, corresponding to a target binding site such as BINDING SITE I, BINDING SITE II or BINDING SITE III of FIG. 8. Table 4 illustrates the complementarity of the nucleotide sequences of LOC284289 BINDING SITE, designated SEQ ID:7635, to the nucleotide sequence of GAM1338 RNA, herein designated GAM RNA, also designated SEQ ID:360.

Another function of GAM1338 is therefore inhibition of LOC284289 (Accession XP_209105.1). Accordingly, utilities of GAM1338 include diagnosis, prevention and treatment of diseases and clinical conditions associated with LOC284289.

LOC284304 (Accession XP_211426.1) is another GAM1338 target gene, herein designated TARGET GENE. LOC284304 BINDING SITE is a target binding site found in the 3' untranslated region of mRNA encoded by LOC284304, corresponding to a target binding site such as BINDING SITE I, BINDING SITE II or BINDING SITE III of FIG. 8. Table 4 illustrates the complementarity of the nucleotide sequences of LOC284304 BINDING SITE, designated SEQ ID:16163, to the nucleotide sequence of GAM1338 RNA, herein designated GAM RNA, also designated SEQ ID:360.

Another function of GAM1338 is therefore inhibition of LOC284304 (Accession XP_211426.1). Accordingly, utilities of GAM1338 include diagnosis, prevention and treatment of diseases and clinical conditions associated with LOC284304.

LOC284317 (Accession XP_209162.1) is another GAM1338 target gene, herein designated TARGET GENE. LOC284317 BINDING SITE1 and LOC284317 BINDING SITE2 are target binding sites found in untranslated regions of mRNA encoded by LOC284317, corresponding to target binding sites such as BINDING SITE I, BINDING SITE II or BINDING SITE III of FIG. 8. Table 4 illustrates the complementarity of the nucleotide sequences of LOC284317 BINDING SITE1 and LOC284317 BINDING SITE2, designated SEQ ID:5320 and SEQ ID:11486 respectively, to the nucleotide sequence of GAM1338 RNA, herein designated GAM RNA, also designated SEQ ID:360.

Another function of GAM1338 is therefore inhibition of LOC284317 (Accession XP_209162.1). Accordingly, utilities of GAM1338 include diagnosis, prevention and treatment of diseases and clinical conditions associated with LOC284317.

LOC284325 (Accession XP_209143.1) is another GAM1338 target gene, herein designated TARGET GENE. LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:11657, to the nucleotide sequence of GAM1338 RNA, herein designated GAM RNA, also designated SEQ ID:360.

Another function of GAM1338 is therefore inhibition of LOC284325 (Accession XP_209143.1). Accordingly, utilities of GAM1338 include diagnosis, prevention and treatment of diseases and clinical conditions associated with LOC284325.

LOC284362 (Accession XP_211435.1) is another GAM1338 target gene, herein designated TARGET GENE. LOC284362 BINDING SITE is a target binding site found in the 3' untranslated region of mRNA encoded by LOC284362, corresponding to a target binding site such as BINDING SITE I, BINDING SITE II or BINDING SITE III of FIG. 8. Table 4 illustrates the complementarity of the nucleotide sequences of LOC284362 BINDING SITE, designated SEQ ID:10666, to the nucleotide sequence of GAM1338 RNA, herein designated GAM RNA, also designated SEQ ID:360.

Another function of GAM1338 is therefore inhibition of LOC284362 (Accession XP_211435.1). Accordingly, utilities of GAM1338 include diagnosis, prevention and treatment of diseases and clinical conditions associated with LOC284362.

LOC284373 (Accession XP_211439.1) is another GAM1338 target gene, herein designated TARGET GENE. LOC284373 BINDING SITE is a target binding site found in the 5' untranslated region of mRNA encoded by LOC284373, corresponding to a target binding site such as BINDING SITE I, BINDING SITE II or BINDING SITE III of FIG. 8. Table 4 illustrates the complementarity of the nucleotide sequences of LOC284373 BINDING SITE, designated SEQ ID:3968, to the nucleotide sequence of GAM1338 RNA, herein designated GAM RNA, also designated SEQ ID:360.

Another function of GAM1338 is therefore inhibition of LOC284373 (Accession XP_211439.1). Accordingly, utilities of GAM1338 include diagnosis, prevention and treatment of diseases and clinical conditions associated with LOC284373.

LOC284375 (Accession XP_209154.1) is another GAM1338 target gene, herein designated TARGET GENE. LOC284375 BINDING SITE is a target binding site found in the 3' untranslated region of mRNA encoded by LOC284375, corresponding to a target binding site such as BINDING SITE I, BINDING SITE II or BINDING SITE III of FIG. 8. Table 4 illustrates the complementarity of the nucleotide sequences of LOC284375 BINDING SITE, designated SEQ ID:13618, to the nucleotide sequence of GAM1338 RNA, herein designated GAM RNA, also designated SEQ ID:360.

Another function of GAM1338 is therefore inhibition of LOC284375 (Accession XP_209154.1). Accordingly, utilities of GAM1338 include diagnosis, prevention and treatment of diseases and clinical conditions associated with LOC284375.

LOC284376 (Accession XP_209157.1) is another GAM1338 target gene, herein designated TARGET GENE. LOC284376 BINDING SITE1 and LOC284376 BINDING SITE2 are target binding sites found in untranslated regions of mRNA encoded by LOC284376, corresponding to target binding sites such as BINDING SITE I, BINDING SITE II or BINDING SITE III of FIG. 8. Table 4 illustrates the complementarity of the nucleotide sequences of LOC284376 BINDING SITE1 and LOC284376 BINDING SITE2, designated SEQ ID:3410 and SEQ ID:9328 respectively, to the nucleotide sequence of GAM1338 RNA, herein designated GAM RNA, also designated SEQ ID:360.

Another function of GAM1338 is therefore inhibition of LOC284376 (Accession XP_209157.1). Accordingly, utilities of GAM1338 include diagnosis, prevention and treatment of diseases and clinical conditions associated with LOC284376.

LOC284379 (Accession XP_209163.1) is another GAM1338 target gene, herein designated TARGET GENE. LOC284379 BINDING SITE is a target binding site found in the 3' untranslated region of mRNA encoded by LOC284379, corresponding to a target binding site such as BINDING SITE I, BINDING SITE II or BINDING SITE III of FIG. 8. Table 4 illustrates the complementarity of the nucleotide sequences of LOC284379 BINDING SITE, designated SEQ ID:2198, to the nucleotide sequence of GAM1338 RNA, herein designated GAM RNA, also designated SEQ ID:360.

Another function of GAM1338 is therefore inhibition of LOC284379 (Accession XP_209163.1). Accordingly, utilities of GAM1338 include diagnosis, prevention and treatment of diseases and clinical conditions associated with LOC284379.

LOC284396 (Accession XP_211452.1) is another GAM1338 target gene, herein designated TARGET GENE. LOC284396 BINDING SITE is a target binding site found in the 3' untranslated region of mRNA encoded by LOC284396, corresponding to a target binding site such as BINDING SITE I, BINDING SITE II or BINDING SITE III of FIG. 8. Table 4 illustrates the complementarity of the nucleotide sequences of LOC284396 BINDING SITE, designated SEQ ID:2360, to the nucleotide sequence of GAM1338 RNA, herein designated GAM RNA, also designated SEQ ID:360.

Another function of GAM1338 is therefore inhibition of LOC284396 (Accession XP_211452.1). Accordingly, utilities of GAM1338 include diagnosis, prevention and treatment of diseases and clinical conditions associated with LOC284396.

LOC284408 (Accession XP_211443.1) is another GAM1338 target gene, herein designated TARGET GENE. LOC284408 BINDING SITE is a target binding site found in the 5' untranslated region of mRNA encoded by LOC284408, corresponding to a target binding site such as BINDING SITE I, BINDING SITE II or BINDING SITE III of FIG. 8. Table 4 illustrates the complementarity of the nucleotide sequences of LOC284408 BINDING SITE, designated SEQ ID:10732, to the nucleotide sequence of GAM1338 RNA, herein designated GAM RNA, also designated SEQ ID:360.

Another function of GAM1338 is therefore inhibition of LOC284408 (Accession XP_211443.1). Accordingly, utilities of GAM1338 include diagnosis, prevention and treatment of diseases and clinical conditions associated with LOC284408.

LOC284410 (Accession XP_211449.1) is another GAM1338 target gene, herein designated TARGET GENE. LOC284410 BINDING SITE is a target binding site found in the 3' untranslated region of mRNA encoded by LOC284410, corresponding to a target binding site such as BINDING SITE I, BINDING SITE II or BINDING SITE III of FIG. 8. Table 4 illustrates the complementarity of the nucleotide sequences of LOC284410 BINDING SITE, designated SEQ ID:7072, to the nucleotide sequence of GAM1338 RNA, herein designated GAM RNA, also designated SEQ ID:360.

Another function of GAM1338 is therefore inhibition of LOC284410 (Accession XP_211449.1). Accordingly, utilities of GAM1338 include diagnosis, prevention and treatment of diseases and clinical conditions associated with LOC284410.

LOC284421 (Accession XP_209200.1) is another GAM1338 target gene, herein designated TARGET GENE. LOC284421 BINDING SITE1 through LOC284421 BINDING SITE3 are target binding sites found in untranslated regions of mRNA encoded by LOC284421, corresponding to target binding sites such as BINDING SITE I, BINDING SITE II or BINDING SITE III of FIG. 8. Table 4 illustrates the complementarity of the nucleotide sequences of LOC284421 BINDING SITE1 through LOC284421 BINDING SITE3, designated SEQ ID:15524, SEQ ID:3295 and SEQ ID:2985 respectively, to the nucleotide sequence of GAM1338 RNA, herein designated GAM RNA, also designated SEQ ID:360.

Another function of GAM1338 is therefore inhibition of LOC284421 (Accession XP_209200.1). Accordingly, utilities of GAM1338 include diagnosis, prevention and treatment of diseases and clinical conditions associated with LOC284421.

LOC284421 (Accession XP_209200.1) is another GAM1338 target gene, herein designated TARGET GENE. LOC284421 BINDING SITE1 through LOC284421 BINDING SITE3 are target binding sites found in untranslated regions of mRNA encoded by LOC284421, corresponding to target binding sites such as BINDING SITE I, BINDING SITE II or BINDING SITE III of FIG. 8. Table 4 illustrates the complementarity of the nucleotide sequences of LOC284421 BINDING SITE1 through LOC284421 BINDING SITE3, designated SEQ ID:3295, SEQ ID:932 and SEQ ID:19419 respectively, to the nucleotide sequence of GAM1338 RNA, herein designated GAM RNA, also designated SEQ ID:360.

Another function of GAM1338 is therefore inhibition of LOC284421 (Accession XP_209200.1). Accordingly, utilities of GAM1338 include diagnosis, prevention and treatment of diseases and clinical conditions associated with LOC284421.

LOC284436 (Accession XP_290862.1) is another GAM1338 target gene, herein designated TARGET GENE. LOC284436 BINDING SITE is a target binding site found in the 3' untranslated region of mRNA encoded by LOC284436, corresponding to a target binding site such as BINDING SITE I, BINDING SITE II or BINDING SITE III of FIG. 8. Table 4 illustrates the complementarity of the nucleotide sequences of LOC284436 BINDING SITE, designated SEQ ID:6140, to the nucleotide sequence of GAM1338 RNA, herein designated GAM RNA, also designated SEQ ID:360.

Another function of GAM1338 is therefore inhibition of LOC284436 (Accession XP_290862.1). Accordingly, utilities of GAM1338 include diagnosis, prevention and treatment of diseases and clinical conditions associated with LOC284436.

LOC284440 (Accession XP_209210.1) is another GAM1338 target gene, herein designated TARGET GENE. LOC284440 BINDING SITE is a target binding site found in the 3' untranslated region of mRNA encoded by LOC284440, corresponding to a target binding site such as BINDING SITE I, BINDING SITE II or BINDING SITE III of FIG. 8. Table 4 illustrates the complementarity of the nucleotide sequences of LOC284440 BINDING SITE, designated SEQ ID:12050, to the nucleotide sequence of GAM1338 RNA, herein designated GAM RNA, also designated SEQ ID:360.

Another function of GAM1338 is therefore inhibition of LOC284440 (Accession XP_209210.1). Accordingly, utilities of GAM1338 include diagnosis, prevention and treatment of diseases and clinical conditions associated with LOC284440.

LOC284454 (Accession XP_209216.1) is another GAM1338 target gene, herein designated TARGET GENE. LOC284454 BINDING SITE is a target binding site found in the 5' untranslated region of mRNA encoded by LOC284454, corresponding to a target binding site such as BINDING SITE I, BINDING SITE II or BINDING SITE III of FIG. 8. Table 4 illustrates the complementarity of the nucleotide sequences of LOC284454 BINDING SITE, designated SEQ ID:18896, to the nucleotide sequence of GAM1338 RNA, herein designated GAM RNA, also designated SEQ ID:360.

Another function of GAM1338 is therefore inhibition of LOC284454 (Accession XP_209216.1). Accordingly, utilities of GAM1338 include diagnosis, prevention and treatment of diseases and clinical conditions associated with LOC284454.

LOC284456 (Accession XP_211470.1) is another GAM1338 target gene, herein designated TARGET GENE. LOC284456 BINDING SITE1 and LOC284456 BINDING SITE2 are target binding sites found in untranslated regions of mRNA encoded by LOC284456, corresponding to target binding sites such as BINDING SITE I, BINDING SITE II or BINDING SITE III of FIG. 8. Table 4 illustrates the complementarity of the nucleotide sequences of LOC284456 BINDING SITE1 and LOC284456 BINDING SITE2, designated SEQ ID:10594 and SEQ ID:6643 respectively, to the nucleotide sequence of GAM1338 RNA, herein designated GAM RNA, also designated SEQ ID:360.

Another function of GAM1338 is therefore inhibition of LOC284456 (Accession XP_211470.1). Accordingly, utilities of GAM1338 include diagnosis, prevention and treatment of diseases and clinical conditions associated with LOC284456.

LOC284471 (Accession XP_209225.1) is another GAM1338 target gene, herein designated TARGET GENE. LOC284471 BINDING SITE is a target binding site found in the 3' untranslated region of mRNA encoded by LOC284471, corresponding to a target binding site such as BINDING SITE I, BINDING SITE II or BINDING SITE III of FIG. 8. Table 4 illustrates the complementarity of the nucleotide sequences of LOC284471 BINDING SITE, designated SEQ ID:4926, to the nucleotide sequence of GAM1338 RNA, herein designated GAM RNA, also designated SEQ ID:360.

Another function of GAM1338 is therefore inhibition of LOC284471 (Accession XP_209225.1). Accordingly, utilities of GAM1338 include diagnosis, prevention and treatment of diseases and clinical conditions associated with LOC284471.

LOC284475 (Accession XP_211478.1) is another GAM1338 target gene, herein designated TARGET GENE. LOC284475 BINDING SITE is a target binding site found in the 5' untranslated region of mRNA encoded by LOC284475, corresponding to a target binding site such as BINDING SITE I, BINDING SITE II or BINDING SITE III of FIG. 8. Table 4 illustrates the complementarity of the nucleotide sequences of LOC284475 BINDING SITE, designated SEQ ID:17171, to the nucleotide sequence of GAM1338 RNA, herein designated GAM RNA, also designated SEQ ID:360.

Another function of GAM1338 is therefore inhibition of LOC284475 (Accession XP_211478.1). Accordingly, utilities of GAM1338 include diagnosis, prevention and treatment of diseases and clinical conditions associated with LOC284475.

LOC284512 (Accession XP_211500.1) is another GAM1338 target gene, herein designated TARGET GENE. LOC284512 BINDING SITE is a target binding site found in the 3' untranslated region of mRNA encoded by LOC284512, corresponding to a target binding site such as BINDING SITE I, BINDING SITE II or BINDING SITE III of FIG. 8. Table 4 illustrates the complementarity of the nucleotide sequences of LOC284512 BINDING SITE, designated SEQ ID:16234, to the nucleotide sequence of GAM1338 RNA, herein designated GAM RNA, also designated SEQ ID:360.

Another function of GAM1338 is therefore inhibition of LOC284512 (Accession XP_211500.1). Accordingly, utilities of GAM1338 include diagnosis, prevention and treatment of diseases and clinical conditions associated with LOC284512.

LOC284513 (Accession XP_211502.1) is another GAM1338 target gene, herein designated TARGET GENE. LOC284513 BINDING SITE is a target binding site found in the 5' untranslated region of mRNA encoded by LOC284513, corresponding to a target binding site such as BINDING SITE I, BINDING SITE II or BINDING SITE III of FIG. 8. Table 4 illustrates the complementarity of the nucleotide sequences of LOC284513 BINDING SITE, designated SEQ ID:19066, to the nucleotide sequence of GAM1338 RNA, herein designated GAM RNA, also designated SEQ ID:360.

Another function of GAM1338 is therefore inhibition of LOC284513 (Accession XP_211502.1). Accordingly, utilities of GAM1338 include diagnosis, prevention and treatment of diseases and clinical conditions associated with LOC284513.

LOC284531 (Accession XP_211513.1) is another GAM1338 target gene, herein designated TARGET GENE. LOC284531 BINDING SITE is a target binding site found in the 5' untranslated region of mRNA encoded by LOC284531, corresponding to a target binding site such as BINDING SITE I, BINDING SITE II or BINDING SITE III of FIG. 8. Table 4 illustrates the complementarity of the nucleotide sequences of LOC284531 BINDING SITE, designated SEQ ID:2846, to the nucleotide sequence of GAM1338 RNA, herein designated GAM RNA, also designated SEQ ID:360.

Another function of GAM1338 is therefore inhibition of LOC284531 (Accession XP_211513.1). Accordingly, utilities of GAM1338 include diagnosis, prevention and treatment of diseases and clinical conditions associated with LOC284531.

LOC284551 (Accession XP_211515.1) is another GAM1338 target gene, herein designated TARGET GENE. LOC284551 BINDING SITE is a target binding site found in the 3' untranslated region of mRNA encoded by LOC284551, corresponding to a target binding site such as BINDING SITE I, BINDING SITE II or BINDING SITE III of FIG. 8. Table 4 illustrates the complementarity of the nucleotide sequences of LOC284551 BINDING SITE, designated SEQ ID:17959, to the nucleotide sequence of GAM1338 RNA, herein designated GAM RNA, also designated SEQ ID:360.

Another function of GAM1338 is therefore inhibition of LOC284551 (Accession XP_211515.1). Accordingly, utilities of GAM1338 include diagnosis, prevention and treatment of diseases and clinical conditions associated with LOC284551.

LOC284577 (Accession XP_211522.1) is another GAM1338 target gene, herein designated TARGET GENE. LOC284577 BINDING SITE is a target binding site found in the 3' untranslated region of mRNA encoded by LOC284577, corresponding to a target binding site such as BINDING SITE I, BINDING SITE II or BINDING SITE III of FIG. 8. Table 4 illustrates the complementarity of the nucleotide sequences of LOC284577 BINDING SITE, designated SEQ ID:11682, to the nucleotide sequence of GAM1338 RNA, herein designated GAM RNA, also designated SEQ ID:360.

Another function of GAM1338 is therefore inhibition of LOC284577 (Accession XP_211522.1). Accordingly, utilities of GAM1338 include diagnosis, prevention and treatment of diseases and clinical conditions associated with LOC284577.

LOC284587 (Accession XP_209278.3) is another GAM1338 target gene, herein designated TARGET GENE. LOC284587 BINDING SITE is a target binding site found in the 5' untranslated region of mRNA encoded by LOC284587, corresponding to a target binding site such as BINDING SITE I, BINDING SITE II or BINDING SITE III of FIG. 8. Table 4 illustrates the complementarity of the nucleotide sequences of LOC284587 BINDING SITE, designated SEQ ID:902, to the nucleotide sequence of GAM1338 RNA, herein designated GAM RNA, also designated SEQ ID:360.

Another function of GAM1338 is therefore inhibition of LOC284587 (Accession XP_209278.3). Accordingly, utilities of GAM1338 include diagnosis, prevention and treatment of diseases and clinical conditions associated with LOC284587.

LOC284611 (Accession XP_211552.1) is another GAM1338 target gene, herein designated TARGET GENE. LOC284611 BINDING SITE is a target binding site found in the 3' untranslated region of mRNA encoded by LOC284611, corresponding to a target binding site such as BINDING SITE I, BINDING SITE II or BINDING SITE III of FIG. 8. Table 4 illustrates the complementarity of the nucleotide sequences of LOC284611 BINDING SITE, designated SEQ ID:11652, to the nucleotide sequence of GAM1338 RNA, herein designated GAM RNA, also designated SEQ ID:360.

Another function of GAM1338 is therefore inhibition of LOC284611 (Accession XP_211552.1). Accordingly, utilities of GAM1338 include diagnosis, prevention and treatment of diseases and clinical conditions associated with LOC284611.

LOC284628 (Accession XP_211561.1) is another GAM1338 target gene, herein designated TARGET GENE. LOC284628 BINDING SITE is a target binding site found in the 5' untranslated region of mRNA encoded by LOC284628, corresponding to a target binding site such as BINDING SITE I, BINDING SITE II or BINDING SITE III of FIG. 8. Table 4 illustrates the complementarity of the nucleotide sequences of LOC284628 BINDING SITE, designated SEQ ID:20050, to the nucleotide sequence of GAM1338 RNA, herein designated GAM RNA, also designated SEQ ID:360.

Another function of GAM1338 is therefore inhibition of LOC284628 (Accession XP_211561.1). Accordingly, utilities of GAM1338 include diagnosis, prevention and treatment of diseases and clinical conditions associated with LOC284628.

LOC284668 (Accession XP_211583.1) is another GAM1338 target gene, herein designated TARGET GENE. LOC284668 BINDING SITE is a target binding site found in the 3' untranslated region of mRNA encoded by LOC284668, corresponding to a target binding site such as BINDING SITE I, BINDING SITE II or BINDING SITE III of FIG. 8. Table 4 illustrates the complementarity of the nucleotide sequences of LOC284668 BINDING SITE, designated SEQ ID:19894, to the nucleotide sequence of GAM1338 RNA, herein designated GAM RNA, also designated SEQ ID:360.

Another function of GAM1338 is therefore inhibition of LOC284668 (Accession XP_211583.1). Accordingly, utilities of GAM1338 include diagnosis, prevention and treatment of diseases and clinical conditions associated with LOC284668.

LOC284675 (Accession XP_209319.1) is another GAM1338 target gene, herein designated TARGET GENE. LOC284675 BINDING SITE is a target binding site found in the 5' untranslated region of mRNA encoded by LOC284675, corresponding to a target binding site such as BINDING SITE I, BINDING SITE II or BINDING SITE III of FIG. 8. Table 4 illustrates the complementarity of the nucleotide sequences of LOC284675 BINDING SITE, designated SEQ ID:8487, to the nucleotide sequence of GAM1338 RNA, herein designated GAM RNA, also designated SEQ ID:360.

Another function of GAM1338 is therefore inhibition of LOC284675 (Accession XP_209319.1). Accordingly, utilities of GAM1338 include diagnosis, prevention and treatment of diseases and clinical conditions associated with LOC284675.

LOC284701 (Accession XP_294994.1) is another GAM1338 target gene, herein designated TARGET GENE. LOC284701 BINDING SITE is a target binding site found in the 5' untranslated region of mRNA encoded by LOC284701, corresponding to a target binding site such as BINDING SITE I, BINDING SITE II or BINDING SITE III of FIG. 8. Table 4 illustrates the complementarity of the nucleotide sequences of LOC284701 BINDING SITE, designated SEQ ID:902, to the nucleotide sequence of GAM1338 RNA, herein designated GAM RNA, also designated SEQ ID:360.

Another function of GAM1338 is therefore inhibition of LOC284701 (Accession XP_294994.1). Accordingly, utilities of GAM1338 include diagnosis, prevention and treatment of diseases and clinical conditions associated with LOC284701.

LOC284708 (Accession XP_209332.1) is another GAM1338 target gene, herein designated TARGET GENE. LOC284708 BINDING SITE is a target binding site found in the 3' untranslated region of mRNA encoded by LOC284708, corresponding to a target binding site such as BINDING SITE I, BINDING SITE II or BINDING SITE III of FIG. 8. Table 4 illustrates the complementarity of the nucleotide sequences of LOC284708 BINDING SITE, designated SEQ ID:12721, to the nucleotide sequence of GAM1338 RNA, herein designated GAM RNA, also designated SEQ ID:360.

Another function of GAM1338 is therefore inhibition of LOC284708 (Accession XP_209332.1). Accordingly, utilities of GAM1338 include diagnosis, prevention and treatment of diseases and clinical conditions associated with LOC284708.

LOC284723 (Accession XP_211602.1) is another GAM1338 target gene, herein designated TARGET GENE. LOC284723 BINDING SITE1 and LOC284723 BINDING SITE2 are target binding sites found in untranslated regions of mRNA encoded by LOC284723, corresponding to target binding sites such as BINDING SITE I, BINDING SITE II or BINDING SITE III of FIG. 8. Table 4 illustrates the complementarity of the nucleotide sequences of LOC284723 BINDING SITE1 and LOC284723 BINDING SITE2, designated SEQ ID:6492 and SEQ ID:17106 respectively, to the nucleotide sequence of GAM1338 RNA, herein designated GAM RNA, also designated SEQ ID:360.

Another function of GAM1338 is therefore inhibition of LOC284723 (Accession XP_211602.1). Accordingly, utilities of GAM1338 include diagnosis, prevention and treatment of diseases and clinical conditions associated with LOC284723.

LOC284805 (Accession XP_209371.1) is another GAM1338 target gene, herein designated TARGET GENE. LOC284805 BINDING SITE1 through LOC284805 BINDING SITE3 are target binding sites found in untranslated regions of mRNA encoded by LOC284805, corresponding to target binding sites such as BINDING SITE I, BINDING SITE II or BINDING SITE III of FIG. 8. Table 4 illustrates the complementarity of the nucleotide sequences of LOC284805 BINDING SITE1 through LOC284805 BINDING SITE3, designated SEQ ID:18781, SEQ ID:11447 and SEQ ID:17164 respectively, to the nucleotide sequence of GAM1338 RNA, herein designated GAM RNA, also designated SEQ ID:360.

Another function of GAM1338 is therefore inhibition of LOC284805 (Accession XP_209371.1). Accordingly, utilities of GAM1338 include diagnosis, prevention and treatment of diseases and clinical conditions associated with LOC284805.

LOC284839 (Accession XP_211661.1) is another GAM1338 target gene, herein designated TARGET GENE. LOC284839 BINDING SITE is a target binding site found in the 5' untranslated region of mRNA encoded by LOC284839, corresponding to a target binding site such as BINDING SITE I, BINDING SITE II or BINDING SITE III of FIG. 8. Table 4 illustrates the complementarity of the nucleotide sequences of LOC284839 BINDING SITE, designated SEQ ID:4527, to the nucleotide sequence of GAM1338 RNA, herein designated GAM RNA, also designated SEQ ID:360.

Another function of GAM1338 is therefore inhibition of LOC284839 (Accession XP_211661.1). Accordingly, utilities of GAM1338 include diagnosis, prevention and treatment of diseases and clinical conditions associated with LOC284839.

LOC284865 (Accession XP_211672.1) is another GAM1338 target gene, herein designated TARGET GENE. LOC284865 BINDING SITE is a target binding site found in the 3' untranslated region of mRNA encoded by LOC284865, corresponding to a target binding site such as BINDING SITE I, BINDING SITE II or BINDING SITE III of FIG. 8. Table 4 illustrates the complementarity of the nucleotide sequences of LOC284865 BINDING SITE, designated SEQ ID:1299, to the nucleotide sequence of GAM1338 RNA, herein designated GAM RNA, also designated SEQ ID:360.

Another function of GAM1338 is therefore inhibition of LOC284865 (Accession XP_211672.1). Accordingly, utilities of GAM1338 include diagnosis, prevention and treatment of diseases and clinical conditions associated with LOC284865.

LOC284874 (Accession XP_209394.1) is another GAM1338 target gene, herein designated TARGET GENE. LOC284874 BINDING SITE1 and LOC284874 BINDING SITE2 are target binding sites found in untranslated regions of mRNA encoded by LOC284874, corresponding to target binding sites such as BINDING SITE I, BINDING SITE II or BINDING SITE III of FIG. 8. Table 4 illustrates the complementarity of the nucleotide sequences of LOC284874 BINDING SITE1 and LOC284874 BINDING SITE2, designated SEQ ID:14015 and SEQ ID:2751 respectively, to the nucleotide sequence of GAM1338 RNA, herein designated GAM RNA, also designated SEQ ID:360.

Another function of GAM1338 is therefore inhibition of LOC284874 (Accession XP_209394.1). Accordingly, utilities of GAM1338 include diagnosis, prevention and treatment of diseases and clinical conditions associated with LOC284874.

LOC284934 (Accession XP_211696.1) is another GAM1338 target gene, herein designated TARGET GENE. LOC284934 BINDING SITE is a target binding site found in the 5' untranslated region of mRNA encoded by LOC284934, corresponding to a target binding site such as BINDING SITE I, BINDING SITE II or BINDING SITE III of FIG. 8. Table 4 illustrates the complementarity of the nucleotide sequences of LOC284934 BINDING SITE, designated SEQ ID:17477, to the nucleotide sequence of GAM1338 RNA, herein designated GAM RNA, also designated SEQ ID:360.

Another function of GAM1338 is therefore inhibition of LOC284934 (Accession XP_211696.1). Accordingly, utilities of GAM1338 include diagnosis, prevention and treatment of diseases and clinical conditions associated with LOC284934.

LOC284947 (Accession XP_211705.1) is another GAM1338 target gene, herein designated TARGET GENE. LOC284947 BINDING SITE is a target binding site found in the 3' untranslated region of mRNA encoded by LOC284947, corresponding to a target binding site such as BINDING SITE I, BINDING SITE II or BINDING SITE III of FIG. 8. Table 4 illustrates the complementarity of the nucleotide sequences of LOC284947 BINDING SITE, designated SEQ ID:5006, to the nucleotide sequence of GAM1338 RNA, herein designated GAM RNA, also designated SEQ ID:360.

Another function of GAM1338 is therefore inhibition of LOC284947 (Accession XP_211705.1). Accordingly, utilities of GAM1338 include diagnosis, prevention and treatment of diseases and clinical conditions associated with LOC284947.

LOC284950 (Accession XP_211703.1) is another GAM1338 target gene, herein designated TARGET GENE. LOC284950 BINDING SITE is a target binding site found in the 3' untranslated region of mRNA encoded by LOC284950, corresponding to a target binding site such as BINDING SITE I, BINDING SITE II or BINDING SITE III of FIG. 8. Table 4 illustrates the complementarity of the nucleotide sequences of LOC284950 BINDING SITE, designated SEQ ID:6753, to the nucleotide sequence of GAM1338 RNA, herein designated GAM RNA, also designated SEQ ID:360.

Another function of GAM1338 is therefore inhibition of LOC284950 (Accession XP_211703.1). Accordingly, utilities of GAM1338 include diagnosis, prevention and treatment of diseases and clinical conditions associated with LOC284950.

LOC284960 (Accession XP_211715.1) is another GAM1338 target gene, herein designated TARGET GENE. LOC284960 BINDING SITE is a target binding site found in the 5' untranslated region of mRNA encoded by LOC284960, corresponding to a target binding site such as BINDING SITE I, BINDING SITE II or BINDING SITE III of FIG. 8. Table 4 illustrates the complementarity of the nucleotide sequences of LOC284960 BINDING SITE, designated SEQ ID:8699, to the nucleotide sequence of GAM1338 RNA, herein designated GAM RNA, also designated SEQ ID:360.

Another function of GAM1338 is therefore inhibition of LOC284960 (Accession XP_211715.1). Accordingly, utilities of GAM1338 include diagnosis, prevention and treatment of diseases and clinical conditions associated with LOC284960.

LOC285026 (Accession XP_209440.1) is another GAM1338 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:14276, to the nucleotide sequence of GAM1338 RNA, herein designated GAM RNA, also designated SEQ ID:360.

Another function of GAM1338 is therefore inhibition of LOC285026 (Accession XP_209440.1). Accordingly, utilities of GAM1338 include diagnosis, prevention and treatment of diseases and clinical conditions associated with LOC285026.

LOC285032 (Accession XP_211740.1) is another GAM1338 target gene, herein designated TARGET GENE. LOC285032 BINDING SITE is a target binding site found in the 5' untranslated region of mRNA encoded by LOC285032, corresponding to a target binding site such as BINDING SITE I, BINDING SITE II or BINDING SITE III of FIG. 8. Table 4 illustrates the complementarity of the nucleotide sequences of LOC285032 BINDING SITE, designated SEQ ID:5725, to the nucleotide sequence of GAM1338 RNA, herein designated GAM RNA, also designated SEQ ID:360.

Another function of GAM1338 is therefore inhibition of LOC285032 (Accession XP_211740.1). Accordingly, utilities of GAM1338 include diagnosis, prevention and treatment of diseases and clinical conditions associated with LOC285032.

LOC285083 (Accession XP_209464.1) is another GAM1338 target gene, herein designated TARGET GENE. LOC285083 BINDING SITE is a target binding site found in the 3' untranslated region of mRNA encoded by LOC285083, corresponding to a target binding site such as BINDING SITE I, BINDING SITE II or BINDING SITE III of FIG. 8. Table 4 illustrates the complementarity of the nucleotide sequences of LOC285083 BINDING SITE, designated SEQ ID:18085, to the nucleotide sequence of GAM1338 RNA, herein designated GAM RNA, also designated SEQ ID:360.

Another function of GAM1338 is therefore inhibition of LOC285083 (Accession XP_209464.1). Accordingly, utilities of GAM1338 include diagnosis, prevention and treatment of diseases and clinical conditions associated with LOC285083.

LOC285088 (Accession XP_209465.1) is another GAM1338 target gene, herein designated TARGET GENE.

LOC285088 BINDING SITE is a target binding site found in the 3' untranslated region of mRNA encoded by LOC285088, corresponding to a target binding site such as BINDING SITE I, BINDING SITE II or BINDING SITE III of FIG. 8. Table 4 illustrates the complementarity of the nucleotide sequences of LOC285088 BINDING SITE, designated SEQ ID:20100, to the nucleotide sequence of GAM1338 RNA, herein designated GAM RNA, also designated SEQ ID:360.

Another function of GAM1338 is therefore inhibition of LOC285088 (Accession XP_209465.1). Accordingly, utilities of GAM1338 include diagnosis, prevention and treatment of diseases and clinical conditions associated with LOC285088.

LOC285123 (Accession XP_211773.1) is another GAM1338 target gene, herein designated TARGET GENE. LOC285123 BINDING SITE is a target binding site found in the 3' untranslated region of mRNA encoded by LOC285123, corresponding to a target binding site such as BINDING SITE I, BINDING SITE II or BINDING SITE III of FIG. 8. Table 4 illustrates the complementarity of the nucleotide sequences of LOC285123 BINDING SITE, designated SEQ ID:4218, to the nucleotide sequence of GAM1338 RNA, herein designated GAM RNA, also designated SEQ ID:360.

Another function of GAM1338 is therefore inhibition of LOC285123 (Accession XP_211773.1). Accordingly, utilities of GAM1338 include diagnosis, prevention and treatment of diseases and clinical conditions associated with LOC285123.

LOC285127 (Accession XP_211771.1) is another GAM1338 target gene, herein designated TARGET GENE. LOC285127 BINDING SITE1 and LOC285127 BINDING SITE2 are target binding sites found in untranslated regions of mRNA encoded by LOC285127, corresponding to target binding sites such as BINDING SITE I, BINDING SITE II or BINDING SITE III of FIG. 8. Table 4 illustrates the complementarity of the nucleotide sequences of LOC285127 BINDING SITE1 and LOC285127 BINDING SITE2, designated SEQ ID:19204 and SEQ ID:3106 respectively, to the nucleotide sequence of GAM1338 RNA, herein designated GAM RNA, also designated SEQ ID:360.

Another function of GAM1338 is therefore inhibition of LOC285127 (Accession XP_211771.1). Accordingly, utilities of GAM1338 include diagnosis, prevention and treatment of diseases and clinical conditions associated with LOC285127.

LOC285166 (Accession XP_211791.1) is another GAM1338 target gene, herein designated TARGET GENE. LOC285166 BINDING SITE is a target binding site found in the 3' untranslated region of mRNA encoded by LOC285166, corresponding to a target binding site such as BINDING SITE I, BINDING SITE II or BINDING SITE III of FIG. 8. Table 4 illustrates the complementarity of the nucleotide sequences of LOC285166 BINDING SITE, designated SEQ ID:19378, to the nucleotide sequence of GAM1338 RNA, herein designated GAM RNA, also designated SEQ ID:360.

Another function of GAM1338 is therefore inhibition of LOC285166 (Accession XP_211791.1). Accordingly, utilities of GAM1338 include diagnosis, prevention and treatment of diseases and clinical conditions associated with LOC285166.

LOC285176 (Accession XP_209500.1) is another GAM1338 target gene, herein designated TARGET GENE. LOC285176 BINDING SITE is a target binding site found in the 3' untranslated region of mRNA encoded by LOC285176, corresponding to a target binding site such as BINDING SITE I, BINDING SITE II or BINDING SITE III of FIG. 8. Table 4 illustrates the complementarity of the nucleotide sequences of LOC285176 BINDING SITE, designated SEQ ID:12167, to the nucleotide sequence of GAM1338 RNA, herein designated GAM RNA, also designated SEQ ID:360.

Another function of GAM1338 is therefore inhibition of LOC285176 (Accession XP_209500.1). Accordingly, utilities of GAM1338 include diagnosis, prevention and treatment of diseases and clinical conditions associated with LOC285176.

LOC285193 (Accession XP_209509.1) is another GAM1338 target gene, herein designated TARGET GENE. LOC285193 BINDING SITE is a target binding site found in the 3' untranslated region of mRNA encoded by LOC285193, corresponding to a target binding site such as BINDING SITE I, BINDING SITE II or BINDING SITE III of FIG. 8. Table 4 illustrates the complementarity of the nucleotide sequences of LOC285193 BINDING SITE, designated SEQ ID:13870, to the nucleotide sequence of GAM1338 RNA, herein designated GAM RNA, also designated SEQ ID:360.

Another function of GAM1338 is therefore inhibition of LOC285193 (Accession XP_209509.1). Accordingly, utilities of GAM1338 include diagnosis, prevention and treatment of diseases and clinical conditions associated with LOC285193.

LOC285221 (Accession XP_209521.1) is another GAM1338 target gene, herein designated TARGET GENE. LOC285221 BINDING SITE is a target binding site found in the 5' untranslated region of mRNA encoded by LOC285221, corresponding to a target binding site such as BINDING SITE I, BINDING SITE II or BINDING SITE III of FIG. 8. Table 4 illustrates the complementarity of the nucleotide sequences of LOC285221 BINDING SITE, designated SEQ ID:15365, to the nucleotide sequence of GAM1338 RNA, herein designated GAM RNA, also designated SEQ ID:360.

Another function of GAM1338 is therefore inhibition of LOC285221 (Accession XP_209521.1). Accordingly, utilities of GAM1338 include diagnosis, prevention and treatment of diseases and clinical conditions associated with LOC285221.

LOC285231 (Accession XP_211813.1) is another GAM1338 target gene, herein designated TARGET GENE. LOC285231 BINDING SITE1 and LOC285231 BINDING SITE2 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231 BINDING SITE1 and LOC285231 BINDING SITE2, designated SEQ ID:11238 and SEQ ID:13069 respectively, to the nucleotide sequence of GAM1338 RNA, herein designated GAM RNA, also designated SEQ ID:360.

Another function of GAM1338 is therefore inhibition of LOC285231 (Accession XP_211813.1). Accordingly, utilities of GAM1338 include diagnosis, prevention and treatment of diseases and clinical conditions associated with LOC285231.

LOC285281 (Accession XP_211829.1) is another GAM1338 target gene, herein designated TARGET GENE. LOC285281 BINDING SITE is a target binding site found in the 5' untranslated region of mRNA encoded by LOC285281, corresponding to a target binding site such as BINDING SITE I, BINDING SITE II or BINDING SITE III of FIG. 8. Table 4 illustrates the complementarity of the nucleotide sequences of LOC285281 BINDING SITE, designated SEQ ID:7766, to the nucleotide sequence of GAM1338 RNA, herein designated GAM RNA, also designated SEQ ID:360.

Another function of GAM1338 is therefore inhibition of LOC285281 (Accession XP_211829.1). Accordingly, utilities of GAM1338 include diagnosis, prevention and treatment of diseases and clinical conditions associated with LOC285281.

LOC285299 (Accession XP_209554.1) is another GAM1338 target gene, herein designated TARGET GENE. LOC285299 BINDING SITE is a target binding site found in the 3' untranslated region of mRNA encoded by LOC285299, corresponding to a target binding site such as BINDING SITE I, BINDING SITE II or BINDING SITE III of FIG. 8. Table 4 illustrates the complementarity of the nucleotide sequences of LOC285299 BINDING SITE, designated SEQ ID:15961, to the nucleotide sequence of GAM1338 RNA, herein designated GAM RNA, also designated SEQ ID:360.

Another function of GAM1338 is therefore inhibition of LOC285299 (Accession XP_209554.1). Accordingly, utilities of GAM1338 include diagnosis, prevention and treatment of diseases and clinical conditions associated with LOC285299.

LOC285334 (Accession XP_211844.1) is another GAM1338 target gene, herein designated TARGET GENE. LOC285334 BINDING SITE is a target binding site found in the 3' untranslated region of mRNA encoded by LOC285334, corresponding to a target binding site such as BINDING SITE I, BINDING SITE II or BINDING SITE III of FIG. 8. Table 4 illustrates the complementarity of the nucleotide sequences of LOC285334 BINDING SITE, designated SEQ ID:17006, to the nucleotide sequence of GAM1338 RNA, herein designated GAM RNA, also designated SEQ ID:360.

Another function of GAM1338 is therefore inhibition of LOC285334 (Accession XP_211844.1). Accordingly, utilities of GAM1338 include diagnosis, prevention and treatment of diseases and clinical conditions associated with LOC285334.

LOC285345 (Accession XP_211854.1) is another GAM1338 target gene, herein designated TARGET GENE. LOC285345 BINDING SITE1 and LOC285345 BINDING SITE2 are target binding sites found in untranslated regions of mRNA encoded by LOC285345, corresponding to target binding sites such as BINDING SITE I, BINDING SITE II or BINDING SITE III of FIG. 8. Table 4 illustrates the complementarity of the nucleotide sequences of LOC285345 BINDING SITE1 and LOC285345 BINDING SITE2, designated SEQ ID:11821 and SEQ ID:13276 respectively, to the nucleotide sequence of GAM1338 RNA, herein designated GAM RNA, also designated SEQ ID:360.

Another function of GAM1338 is therefore inhibition of LOC285345 (Accession XP_211854.1). Accordingly, utilities of GAM1338 include diagnosis, prevention and treatment of diseases and clinical conditions associated with LOC285345.

LOC285366 (Accession XP_209581.1) is another GAM1338 target gene, herein designated TARGET GENE. LOC285366 BINDING SITE is a target binding site found in the 3' untranslated region of mRNA encoded by LOC285366, corresponding to a target binding site such as BINDING SITE I, BINDING SITE II or BINDING SITE III of FIG. 8. Table 4 illustrates the complementarity of the nucleotide sequences of LOC285366 BINDING SITE, designated SEQ ID:4019, to the nucleotide sequence of GAM1338 RNA, herein designated GAM RNA, also designated SEQ ID:360.

Another function of GAM1338 is therefore inhibition of LOC285366 (Accession XP_209581.1). Accordingly, utilities of GAM1338 include diagnosis, prevention and treatment of diseases and clinical conditions associated with LOC285366.

LOC285369 (Accession XP_211861.3) is another GAM1338 target gene, herein designated TARGET GENE. LOC285369 BINDING SITE is a target binding site found in the 3' untranslated region of mRNA encoded by LOC285369, corresponding to a target binding site such as BINDING SITE I, BINDING SITE II or BINDING SITE III of FIG. 8. Table 4 illustrates the complementarity of the nucleotide sequences of LOC285369 BINDING SITE, designated SEQ ID:19816, to the nucleotide sequence of GAM1338 RNA, herein designated GAM RNA, also designated SEQ ID:360.

Another function of GAM1338 is therefore inhibition of LOC285369 (Accession XP_211861.3). Accordingly, utilities of GAM1338 include diagnosis, prevention and treatment of diseases and clinical conditions associated with LOC285369.

LOC285389 (Accession XP_211873.1) is another GAM1338 target gene, herein designated TARGET GENE. LOC285389 BINDING SITE is a target binding site found in the 3' untranslated region of mRNA encoded by LOC285389, corresponding to a target binding site such as BINDING SITE I, BINDING SITE II or BINDING SITE III of FIG. 8. Table 4 illustrates the complementarity of the nucleotide sequences of LOC285389 BINDING SITE, designated SEQ ID:7025, to the nucleotide sequence of GAM1338 RNA, herein designated GAM RNA, also designated SEQ ID:360.

Another function of GAM1338 is therefore inhibition of LOC285389 (Accession XP_211873.1). Accordingly, utilities of GAM1338 include diagnosis, prevention and treatment of diseases and clinical conditions associated with LOC285389.

LOC285392 (Accession XP_211879.1) is another GAM1338 target gene, herein designated TARGET GENE. LOC285392 BINDING SITE1 and LOC285392 BINDING SITE2 are target binding sites found in untranslated regions of mRNA encoded by LOC285392, corresponding to target binding sites such as BINDING SITE I, BINDING SITE II or BINDING SITE III of FIG. 8. Table 4 illustrates the complementarity of the nucleotide sequences of LOC285392 BINDING SITE1 and LOC285392 BINDING SITE2, designated SEQ ID:6034 and SEQ ID:436 respectively, to the nucleotide sequence of GAM1338 RNA, herein designated GAM RNA, also designated SEQ ID:360.

Another function of GAM1338 is therefore inhibition of LOC285392 (Accession XP_211879.1). Accordingly, utilities of GAM1338 include diagnosis, prevention and treatment of diseases and clinical conditions associated with LOC285392.

LOC285398 (Accession XP_209593.1) is another GAM1338 target gene, herein designated TARGET GENE. LOC285398 BINDING SITE1 and LOC285398 BINDING SITE2 are target binding sites found in untranslated regions of mRNA encoded by LOC285398, corresponding to target binding sites such as BINDING SITE I, BINDING SITE II or BINDING SITE III of FIG. 8. Table 4 illustrates the complementarity of the nucleotide sequences of LOC285398 BINDING SITE1 and LOC285398 BINDING SITE2, designated SEQ ID:4020 and SEQ ID:3701 respectively, to the nucleotide sequence of GAM1338 RNA, herein designated GAM RNA, also designated SEQ ID:360.

Another function of GAM1338 is therefore inhibition of LOC285398 (Accession XP_209593.1). Accordingly, utilities of GAM1338 include diagnosis, prevention and treatment of diseases and clinical conditions associated with LOC285398.

LOC285429 (Accession XP_209607.3) is another GAM1338 target gene, herein designated TARGET GENE. LOC285429 BINDING SITE is a target binding site found in the 3' untranslated region of mRNA encoded by LOC285429, corresponding to a target binding site such as BINDING SITE I, BINDING SITE II or BINDING SITE III of FIG. 8. Table 4 illustrates the complementarity of the nucleotide sequences of LOC285429 BINDING SITE, designated SEQ ID:4870, to the nucleotide sequence of GAM1338 RNA, herein designated GAM RNA, also designated SEQ ID:360.

Another function of GAM1338 is therefore inhibition of LOC285429 (Accession XP_209607.3). Accordingly, utilities of GAM1338 include diagnosis, prevention and treatment of diseases and clinical conditions associated with LOC285429.

LOC285488 (Accession XP_211914.1) is another GAM1338 target gene, herein designated TARGET GENE. LOC285488 BINDING SITE is a target binding site found in the 5' untranslated region of mRNA encoded by LOC285488, corresponding to a target binding site such as BINDING SITE I, BINDING SITE II or BINDING SITE III of FIG. 8. Table 4 illustrates the complementarity of the nucleotide sequences of LOC285488 BINDING SITE, designated SEQ ID:11093, to the nucleotide sequence of GAM1338 RNA, herein designated GAM RNA, also designated SEQ ID:360.

Another function of GAM1338 is therefore inhibition of LOC285488 (Accession XP_211914.1). Accordingly, utilities of GAM1338 include diagnosis, prevention and treatment of diseases and clinical conditions associated with LOC285488.

LOC285491 (Accession XP_211917.1) is another GAM1338 target gene, herein designated TARGET GENE. LOC285491 BINDING SITE is a target binding site found in the 3' untranslated region of mRNA encoded by LOC285491, corresponding to a target binding site such as BINDING SITE I, BINDING SITE II or BINDING SITE III of FIG. 8. Table 4 illustrates the complementarity of the nucleotide sequences of LOC285491 BINDING SITE, designated SEQ ID:8951, to the nucleotide sequence of GAM1338 RNA, herein designated GAM RNA, also designated SEQ ID:360.

Another function of GAM1338 is therefore inhibition of LOC285491 (Accession XP_211917.1). Accordingly, utilities of GAM1338 include diagnosis, prevention and treatment of diseases and clinical conditions associated with LOC285491.

LOC285509 (Accession XP_211923.1) is another GAM1338 target gene, herein designated TARGET GENE. LOC285509 BINDING SITE is a target binding site found in the 5' untranslated region of mRNA encoded by LOC285509, corresponding to a target binding site such as BINDING SITE I, BINDING SITE II or BINDING SITE III of FIG. 8. Table 4 illustrates the complementarity of the nucleotide sequences of LOC285509 BINDING SITE, designated SEQ ID:11997, to the nucleotide sequence of GAM1338 RNA, herein designated GAM RNA, also designated SEQ ID:360.

Another function of GAM1338 is therefore inhibition of LOC285509 (Accession XP_211923.1). Accordingly, utilities of GAM1338 include diagnosis, prevention and treatment of diseases and clinical conditions associated with LOC285509.

LOC285540 (Accession XP_209654.1) is another GAM1338 target gene, herein designated TARGET GENE. LOC285540 BINDING SITE1 and LOC285540 BINDING SITE2 are target binding sites found in untranslated regions of mRNA encoded by LOC285540, corresponding to target binding sites such as BINDING SITE I, BINDING SITE II or BINDING SITE III of FIG. 8. Table 4 illustrates the complementarity of the nucleotide sequences of LOC285540 BINDING SITE1 and LOC285540 BINDING SITE2, designated SEQ ID:5384 and SEQ ID:19426 respectively, to the nucleotide sequence of GAM1338 RNA, herein designated GAM RNA, also designated SEQ ID:360.

Another function of GAM1338 is therefore inhibition of LOC285540 (Accession XP_209654.1). Accordingly, utilities of GAM1338 include diagnosis, prevention and treatment of diseases and clinical conditions associated with LOC285540.

LOC285560 (Accession XP_209660.1) is another GAM1338 target gene, herein designated TARGET GENE. LOC285560 BINDING SITE is a target binding site found in the 3' untranslated region of mRNA encoded by LOC285560, corresponding to a target binding site such as BINDING SITE I, BINDING SITE II or BINDING SITE III of FIG. 8. Table 4 illustrates the complementarity of the nucleotide sequences of LOC285560 BINDING SITE, designated SEQ ID:7821, to the nucleotide sequence of GAM1338 RNA, herein designated GAM RNA, also designated SEQ ID:360.

Another function of GAM1338 is therefore inhibition of LOC285560 (Accession XP_209660.1). Accordingly, utilities of GAM1338 include diagnosis, prevention and treatment of diseases and clinical conditions associated with LOC285560.

LOC285589 (Accession XP_209671.1) is another GAM1338 target gene, herein designated TARGET GENE. LOC285589 BINDING SITE1 and LOC285589 BINDING SITE2 are target binding sites found in untranslated regions of mRNA encoded by LOC285589, corresponding to target binding sites such as BINDING SITE I, BINDING SITE II or BINDING SITE III of FIG. 8. Table 4 illustrates the complementarity of the nucleotide sequences of LOC285589 BINDING SITE1 and LOC285589 BINDING SITE2, designated SEQ ID:3782 and SEQ ID:14069 respectively, to the nucleotide sequence of GAM1338 RNA, herein designated GAM RNA, also designated SEQ ID:360.

Another function of GAM1338 is therefore inhibition of LOC285589 (Accession XP_209671.1). Accordingly, utilities of GAM1338 include diagnosis, prevention and treatment of diseases and clinical conditions associated with LOC285589.

LOC285626 (Accession XP_211959.1) is another GAM1338 target gene, herein designated TARGET GENE. LOC285626 BINDING SITE is a target binding site found in the 5' untranslated region of mRNA encoded by LOC285626, corresponding to a target binding site such as BINDING SITE I, BINDING SITE II or BINDING SITE III of FIG. 8. Table 4 illustrates the complementarity of the nucleotide sequences of LOC285626 BINDING SITE, designated SEQ ID:16288, to the nucleotide sequence of GAM1338 RNA, herein designated GAM RNA, also designated SEQ ID:360.

Another function of GAM1338 is therefore inhibition of LOC285626 (Accession XP_211959.1). Accordingly, utilities of GAM1338 include diagnosis, prevention and treatment of diseases and clinical conditions associated with LOC285626.

LOC285638 (Accession XP_209693.1) is another GAM1338 target gene, herein designated TARGET GENE. LOC285638 BINDING SITE is a target binding site found in the 5' untranslated region of mRNA encoded by LOC285638, corresponding to a target binding site such as BINDING SITE I, BINDING SITE II or BINDING SITE III of FIG. 8. Table 4 illustrates the complementarity of the nucleotide sequences of LOC285638 BINDING SITE, designated SEQ ID:13619, to the nucleotide sequence of GAM1338 RNA, herein designated GAM RNA, also designated SEQ ID:360.

Another function of GAM1338 is therefore inhibition of LOC285638 (Accession XP_209693.1). Accordingly, utilities of GAM1338 include diagnosis, prevention and treatment of diseases and clinical conditions associated with LOC285638.

LOC285678 (Accession XP_209717.1) is another GAM1338 target gene, herein designated TARGET GENE. LOC285678 BINDING SITE is a target binding site found in the 5' untranslated region of mRNA encoded by LOC285678, corresponding to a target binding site such as BINDING SITE I, BINDING SITE II or BINDING SITE III of FIG. 8. Table 4 illustrates the complementarity of the nucleotide sequences of LOC285678 BINDING SITE, designated SEQ ID:16507, to the nucleotide sequence of GAM1338 RNA, herein designated GAM RNA, also designated SEQ ID:360.

Another function of GAM1338 is therefore inhibition of LOC285678 (Accession XP_209717.1). Accordingly, utilities of GAM1338 include diagnosis, prevention and treatment of diseases and clinical conditions associated with LOC285678.

LOC285679 (Accession XP_209719.2) is another GAM1338 target gene, herein designated TARGET GENE. LOC285679 BINDING SITE is a target binding site found in the 3' untranslated region of mRNA encoded by LOC285679, corresponding to a target binding site such as BINDING SITE I, BINDING SITE II or BINDING SITE III of FIG. 8. Table 4 illustrates the complementarity of the nucleotide sequences of LOC285679 BINDING SITE, designated SEQ ID:15031, to the nucleotide sequence of GAM1338 RNA, herein designated GAM RNA, also designated SEQ ID:360.

Another function of GAM1338 is therefore inhibition of LOC285679 (Accession XP_209719.2). Accordingly, utilities of GAM1338 include diagnosis, prevention and treatment of diseases and clinical conditions associated with LOC285679.

LOC285683 (Accession XP_211980.1) is another GAM1338 target gene, herein designated TARGET GENE. LOC285683 BINDING SITE is a target binding site found in the 5' untranslated region of mRNA encoded by LOC285683, corresponding to a target binding site such as BINDING SITE I, BINDING SITE II or BINDING SITE III of FIG. 8. Table 4 illustrates the complementarity of the nucleotide sequences of LOC285683 BINDING SITE, designated SEQ ID:5151, to the nucleotide sequence of GAM1338 RNA, herein designated GAM RNA, also designated SEQ ID:360.

Another function of GAM1338 is therefore inhibition of LOC285683 (Accession XP_211980.1). Accordingly, utilities of GAM1338 include diagnosis, prevention and treatment of diseases and clinical conditions associated with LOC285683.

LOC285687 (Accession XP_211985.1) is another GAM1338 target gene, herein designated TARGET GENE. LOC285687 BINDING SITE is a target binding site found in the 3' untranslated region of mRNA encoded by LOC285687, corresponding to a target binding site such as BINDING SITE I, BINDING SITE II or BINDING SITE III of FIG. 8. Table 4 illustrates the complementarity of the nucleotide sequences of LOC285687 BINDING SITE, designated SEQ ID:10580, to the nucleotide sequence of GAM1338 RNA, herein designated GAM RNA, also designated SEQ ID:360.

Another function of GAM1338 is therefore inhibition of LOC285687 (Accession XP_211985.1). Accordingly, utilities of GAM1338 include diagnosis, prevention and treatment of diseases and clinical conditions associated with LOC285687.

LOC285689 (Accession XP_209724.1) is another GAM1338 target gene, herein designated TARGET GENE. LOC285689 BINDING SITE is a target binding site found in the 3' untranslated region of mRNA encoded by LOC285689, corresponding to a target binding site such as BINDING SITE I, BINDING SITE II or BINDING SITE III of FIG. 8. Table 4 illustrates the complementarity of the nucleotide sequences of LOC285689 BINDING SITE, designated SEQ ID:4452, to the nucleotide sequence of GAM1338 RNA, herein designated GAM RNA, also designated SEQ ID:360.

Another function of GAM1338 is therefore inhibition of LOC285689 (Accession XP_209724.1). Accordingly, utilities of GAM1338 include diagnosis, prevention and treatment of diseases and clinical conditions associated with LOC285689.

LOC285693 (Accession XP_211981.1) is another GAM1338 target gene, herein designated TARGET GENE. LOC285693 BINDING SITE is a target binding site found in the 5' untranslated region of mRNA encoded by LOC285693, corresponding to a target binding site such as BINDING SITE I, BINDING SITE II or BINDING SITE III of FIG. 8. Table 4 illustrates the complementarity of the nucleotide sequences of LOC285693 BINDING SITE, designated SEQ ID:7946, to the nucleotide sequence of GAM1338 RNA, herein designated GAM RNA, also designated SEQ ID:360.

Another function of GAM1338 is therefore inhibition of LOC285693 (Accession XP_211981.1). Accordingly, utilities of GAM1338 include diagnosis, prevention and treatment of diseases and clinical conditions associated with LOC285693.

LOC285713 (Accession XP_211992.1) is another GAM1338 target gene, herein designated TARGET GENE. LOC285713 BINDING SITE is a target binding site found in the 3' untranslated region of mRNA encoded by LOC285713, corresponding to a target binding site such as BINDING SITE I, BINDING SITE II or BINDING SITE III of FIG. 8. Table 4 illustrates the complementarity of the nucleotide sequences of LOC285713 BINDING SITE, designated SEQ ID:6411, to the nucleotide sequence of GAM1338 RNA, herein designated GAM RNA, also designated SEQ ID:360.

Another function of GAM1338 is therefore inhibition of LOC285713 (Accession XP_211992.1). Accordingly, utilities of GAM1338 include diagnosis, prevention and treatment of diseases and clinical conditions associated with LOC285713.

LOC285722 (Accession XP_211997.1) is another GAM1338 target gene, herein designated TARGET GENE. LOC285722 BINDING SITE is a target binding site found in the 5' untranslated region of mRNA encoded by LOC285722, corresponding to a target binding site such as BINDING SITE I, BINDING SITE II or BINDING SITE III of FIG. 8. Table 4 illustrates the complementarity of the nucleotide sequences of LOC285722 BINDING SITE, designated SEQ ID:19494, to the nucleotide sequence of GAM1338 RNA, herein designated GAM RNA, also designated SEQ ID:360.

Another function of GAM1338 is therefore inhibition of LOC285722 (Accession XP_211997.1). Accordingly, utilities of GAM1338 include diagnosis, prevention and treatment of diseases and clinical conditions associated with LOC285722.

LOC285744 (Accession XP_209743.1) is another GAM1338 target gene, herein designated TARGET GENE. LOC285744 BINDING SITE is a target binding site found in the 3' untranslated region of mRNA encoded by LOC285744, corresponding to a target binding site such as BINDING SITE I, BINDING SITE II or BINDING SITE III of FIG. 8. Table 4 illustrates the complementarity of the nucleotide sequences of LOC285744 BINDING SITE, designated SEQ ID:11603, to the nucleotide sequence of GAM1338 RNA, herein designated GAM RNA, also designated SEQ ID:360.

Another function of GAM1338 is therefore inhibition of LOC285744 (Accession XP_209743.1). Accordingly, utilities of GAM1338 include diagnosis, prevention and treatment of diseases and clinical conditions associated with LOC285744.

LOC285747 (Accession XP_209742.1) is another GAM1338 target gene, herein designated TARGET GENE. LOC285747 BINDING SITE1 and LOC285747 BINDING SITE2 are target binding sites found in untranslated regions of mRNA encoded by LOC285747, corresponding to target binding sites such as BINDING SITE I, BINDING SITE II or BINDING SITE III of FIG. 8. Table 4 illustrates the complementarity of the nucleotide sequences of LOC285747 BINDING SITE1 and LOC285747 BINDING SITE2, designated SEQ ID:13800 and SEQ ID:9553 respectively, to the nucleotide sequence of GAM1338 RNA, herein designated GAM RNA, also designated SEQ ID:360.

Another function of GAM1338 is therefore inhibition of LOC285747 (Accession XP_209742.1). Accordingly, utilities of GAM1338 include diagnosis, prevention and treatment of diseases and clinical conditions associated with LOC285747.

LOC285760 (Accession XP_209750.1) is another GAM1338 target gene, herein designated TARGET GENE. LOC285760 BINDING SITE is a target binding site found in the 3' untranslated region of mRNA encoded by LOC285760, corresponding to a target binding site such as BINDING SITE I, BINDING SITE II or BINDING SITE III of FIG. 8. Table 4 illustrates the complementarity of the nucleotide sequences of LOC285760 BINDING SITE, designated SEQ ID:13064, to the nucleotide sequence of GAM1338 RNA, herein designated GAM RNA, also designated SEQ ID:360.

Another function of GAM1338 is therefore inhibition of LOC285760 (Accession XP_209750.1). Accordingly, utilities of GAM1338 include diagnosis, prevention and treatment of diseases and clinical conditions associated with LOC285760.

LOC285813 (Accession XP_212036.1) is another GAM1338 target gene, herein designated TARGET GENE. LOC285813 BINDING SITE is a target binding site found in the 5' untranslated region of mRNA encoded by LOC285813, corresponding to a target binding site such as BINDING SITE I, BINDING SITE II or BINDING SITE III of FIG. 8. Table 4 illustrates the complementarity of the nucleotide sequences of LOC285813 BINDING SITE, designated SEQ ID:17617, to the nucleotide sequence of GAM1338 RNA, herein designated GAM RNA, also designated SEQ ID:360.

Another function of GAM1338 is therefore inhibition of LOC285813 (Accession XP_212036.1). Accordingly, utilities of GAM1338 include diagnosis, prevention and treatment of diseases and clinical conditions associated with LOC285813.

LOC285822 (Accession XP_209777.1) is another GAM1338 target gene, herein designated TARGET GENE. LOC285822 BINDING SITE1 and LOC285822 BINDING SITE2 are target binding sites found in untranslated regions of mRNA encoded by LOC285822, corresponding to target binding sites such as BINDING SITE I, BINDING SITE II or BINDING SITE III of FIG. 8. Table 4 illustrates the complementarity of the nucleotide sequences of LOC285822 BINDING SITE1 and LOC285822 BINDING SITE2, designated SEQ ID:6178 and SEQ ID:6011 respectively, to the nucleotide sequence of GAM1338 RNA, herein designated GAM RNA, also designated SEQ ID:360.

Another function of GAM1338 is therefore inhibition of LOC285822 (Accession XP_209777.1). Accordingly, utilities of GAM1338 include diagnosis, prevention and treatment of diseases and clinical conditions associated with LOC285822.

LOC285843 (Accession XP_212034.1) is another GAM1338 target gene, herein designated TARGET GENE. LOC285843 BINDING SITE1 and LOC285843 BINDING SITE2 are target binding sites found in untranslated regions of mRNA encoded by LOC285843, corresponding to target binding sites such as BINDING SITE I, BINDING SITE II or BINDING SITE III of FIG. 8. Table 4 illustrates the complementarity of the nucleotide sequences of LOC285843 BINDING SITE1 and LOC285843 BINDING SITE2, designated SEQ ID:1414 and SEQ ID:11782 respectively, to the nucleotide sequence of GAM1338 RNA, herein designated GAM RNA, also designated SEQ ID:360.

Another function of GAM1338 is therefore inhibition of LOC285843 (Accession XP_212034.1). Accordingly, utilities of GAM1338 include diagnosis, prevention and treatment of diseases and clinical conditions associated with LOC285843.

LOC285847 (Accession XP_212045.1) is another GAM1338 target gene, herein designated TARGET GENE. LOC285847 BINDING SITE is a target binding site found in the 5' untranslated region of mRNA encoded by LOC285847, corresponding to a target binding site such as BINDING SITE I, BINDING SITE II or BINDING SITE III of FIG. 8. Table 4 illustrates the complementarity of the nucleotide sequences of LOC285847 BINDING SITE, designated SEQ ID:7212, to the nucleotide sequence of GAM1338 RNA, herein designated GAM RNA, also designated SEQ ID:360.

Another function of GAM1338 is therefore inhibition of LOC285847 (Accession XP_212045.1). Accordingly, utilities of GAM1338 include diagnosis, prevention and treatment of diseases and clinical conditions associated with LOC285847.

LOC285872 (Accession XP_212061.1) is another GAM1338 target gene, herein designated TARGET GENE. LOC285872 BINDING SITE is a target binding site found in the 3' untranslated region of mRNA encoded by LOC285872, corresponding to a target binding site such as BINDING SITE I, BINDING SITE II or BINDING SITE III of FIG. 8. Table 4 illustrates the complementarity of the nucleotide sequences of LOC285872 BINDING SITE, designated SEQ ID:7986, to the nucleotide sequence of GAM1338 RNA, herein designated GAM RNA, also designated SEQ ID:360.

Another function of GAM1338 is therefore inhibition of LOC285872 (Accession XP_212061.1). Accordingly, utilities of GAM1338 include diagnosis, prevention and treatment of diseases and clinical conditions associated with LOC285872.

LOC285896 (Accession XP_209806.1) is another GAM1338 target gene, herein designated TARGET GENE. LOC285896 BINDING SITE is a target binding site found in the 3' untranslated region of mRNA encoded by LOC285896, corresponding to a target binding site such as BINDING SITE I, BINDING SITE II or BINDING SITE III of FIG. 8. Table 4 illustrates the complementarity of the nucleotide sequences of LOC285896 BINDING SITE, designated SEQ ID:4795, to the nucleotide sequence of GAM1338 RNA, herein designated GAM RNA, also designated SEQ ID:360.

Another function of GAM1338 is therefore inhibition of LOC285896 (Accession XP_209806.1). Accordingly, utilities of GAM1338 include diagnosis, prevention and treatment of diseases and clinical conditions associated with LOC285896.

LOC285899 (Accession XP_209807.1) is another GAM1338 target gene, herein designated TARGET GENE. LOC285899 BINDING SITE is a target binding site found in the 3' untranslated region of mRNA encoded by LOC285899, corresponding to a target binding site such as BINDING SITE I, BINDING SITE II or BINDING SITE III of FIG. 8. Table 4 illustrates the complementarity of the nucleotide sequences of LOC285899 BINDING SITE, designated SEQ ID:10004, to the nucleotide sequence of GAM1338 RNA, herein designated GAM RNA, also designated SEQ ID:360.

Another function of GAM1338 is therefore inhibition of LOC285899 (Accession XP_209807.1). Accordingly, utilities of GAM1338 include diagnosis, prevention and treatment of diseases and clinical conditions associated with LOC285899.

LOC285914 (Accession XP_209810.1) is another GAM1338 target gene, herein designated TARGET GENE. LOC285914 BINDING SITE is a target binding site found in the 3' untranslated region of mRNA encoded by LOC285914, corresponding to a target binding site such as BINDING SITE I, BINDING SITE II or BINDING SITE III of FIG. 8. Table 4 illustrates the complementarity of the nucleotide sequences of LOC285914 BINDING SITE, designated SEQ ID:14560, to the nucleotide sequence of GAM1338 RNA, herein designated GAM RNA, also designated SEQ ID:360.

Another function of GAM1338 is therefore inhibition of LOC285914 (Accession XP_209810.1). Accordingly, utilities of GAM1338 include diagnosis, prevention and treatment of diseases and clinical conditions associated with LOC285914.

LOC285922 (Accession XP_209822.1) is another GAM1338 target gene, herein designated TARGET GENE. LOC285922 BINDING SITE is a target binding site found in the 3' untranslated region of mRNA encoded by LOC285922, corresponding to a target binding site such as BINDING SITE I, BINDING SITE II or BINDING SITE III of FIG. 8. Table 4 illustrates the complementarity of the nucleotide sequences of LOC285922 BINDING SITE, designated SEQ ID:4795, to the nucleotide sequence of GAM1338 RNA, herein designated GAM RNA, also designated SEQ ID:360.

Another function of GAM1338 is therefore inhibition of LOC285922 (Accession XP_209822.1). Accordingly, utilities of GAM1338 include diagnosis, prevention and treatment of diseases and clinical conditions associated with LOC285922.

LOC285923 (Accession XP_212104.1) is another GAM1338 target gene, herein designated TARGET GENE. LOC285923 BINDING SITE is a target binding site found in the 3' untranslated region of mRNA encoded by LOC285923, corresponding to a target binding site such as BINDING SITE I, BINDING SITE II or BINDING SITE III of FIG. 8. Table 4 illustrates the complementarity of the nucleotide sequences of LOC285923 BINDING SITE, designated SEQ ID:16934, to the nucleotide sequence of GAM1338 RNA, herein designated GAM RNA, also designated SEQ ID:360.

Another function of GAM1338 is therefore inhibition of LOC285923 (Accession XP_212104.1). Accordingly, utilities of GAM1338 include diagnosis, prevention and treatment of diseases and clinical conditions associated with LOC285923.

LOC285945 (Accession XP_212092.1) is another GAM1338 target gene, herein designated TARGET GENE. LOC285945 BINDING SITE is a target binding site found in the 5' untranslated region of mRNA encoded by LOC285945, corresponding to a target binding site such as BINDING SITE I, BINDING SITE II or BINDING SITE III of FIG. 8. Table 4 illustrates the complementarity of the nucleotide sequences of LOC285945 BINDING SITE, designated SEQ ID:12385, to the nucleotide sequence of GAM1338 RNA, herein designated GAM RNA, also designated SEQ ID:360.

Another function of GAM1338 is therefore inhibition of LOC285945 (Accession XP_212092.1). Accordingly, utilities of GAM1338 include diagnosis, prevention and treatment of diseases and clinical conditions associated with LOC285945.

LOC285950 (Accession XP_212089.1) is another GAM1338 target gene, herein designated TARGET GENE. LOC285950 BINDING SITE is a target binding site found in the 3' untranslated region of mRNA encoded by LOC285950, corresponding to a target binding site such as BINDING SITE I, BINDING SITE II or BINDING SITE III of FIG. 8. Table 4 illustrates the complementarity of the nucleotide sequences of LOC285950 BINDING SITE, designated SEQ ID:11638, to the nucleotide sequence of GAM1338 RNA, herein designated GAM RNA, also designated SEQ ID:360.

Another function of GAM1338 is therefore inhibition of LOC285950 (Accession XP_212089.1). Accordingly, utilities of GAM1338 include diagnosis, prevention and treatment of diseases and clinical conditions associated with LOC285950.

LOC285952 (Accession XP_209821.1) is another GAM1338 target gene, herein designated TARGET GENE. LOC285952 BINDING SITE is a target binding site found in the 3' untranslated region of mRNA encoded by LOC285952, corresponding to a target binding site such as BINDING SITE I, BINDING SITE II or BINDING SITE III of FIG. 8. Table 4 illustrates the complementarity of the nucleotide sequences of LOC285952 BINDING SITE, designated SEQ ID:2758, to the nucleotide sequence of GAM1338 RNA, herein designated GAM RNA, also designated SEQ ID:360.

Another function of GAM1338 is therefore inhibition of LOC285952 (Accession XP_209821.1). Accordingly, utilities of GAM1338 include diagnosis, prevention and treatment of diseases and clinical conditions associated with LOC285952.

LOC285961 (Accession XP_209833.1) is another GAM1338 target gene, herein designated TARGET GENE. LOC285961 BINDING SITE is a target binding site found in the 5' untranslated region of mRNA encoded by LOC285961, corresponding to a target binding site such as BINDING SITE I, BINDING SITE II or BINDING SITE III of FIG. 8. Table 4 illustrates the complementarity of the nucleotide sequences of LOC285961 BINDING SITE, designated SEQ ID:11621, to the nucleotide sequence of GAM1338 RNA, herein designated GAM RNA, also designated SEQ ID:360.

Another function of GAM1338 is therefore inhibition of LOC285961 (Accession XP_209833.1). Accordingly, utilities of GAM1338 include diagnosis, prevention and treatment of diseases and clinical conditions associated with LOC285961.

LOC285972 (Accession XP_212105.1) is another GAM1338 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:8156, to the nucleotide sequence of GAM1338 RNA, herein designated GAM RNA, also designated SEQ ID:360.

Another function of GAM1338 is therefore inhibition of LOC285972 (Accession XP_212105.1). Accordingly, utilities of GAM1338 include diagnosis, prevention and treatment of diseases and clinical conditions associated with LOC285972.

LOC285979 (Accession XP_212117.1) is another GAM1338 target gene, herein designated TARGET GENE. LOC285979 BINDING SITE is a target binding site found in the 5' untranslated region of mRNA encoded by LOC285979, corresponding to a target binding site such as BINDING SITE I, BINDING SITE II or BINDING SITE III of FIG. 8. Table 4 illustrates the complementarity of the nucleotide sequences of LOC285979 BINDING SITE, designated SEQ ID:13228, to the nucleotide sequence of GAM1338 RNA, herein designated GAM RNA, also designated SEQ ID:360.

Another function of GAM1338 is therefore inhibition of LOC285979 (Accession XP_212117.1). Accordingly, utilities of GAM1338 include diagnosis, prevention and treatment of diseases and clinical conditions associated with LOC285979.

LOC285989 (Accession XP_212111.1) is another GAM1338 target gene, herein designated TARGET GENE. LOC285989 BINDING SITE is a target binding site found in the 3' untranslated region of mRNA encoded by LOC285989, corresponding to a target binding site such as BINDING SITE I, BINDING SITE II or BINDING SITE III of FIG. 8. Table 4 illustrates the complementarity of the nucleotide sequences of LOC285989 BINDING SITE, designated SEQ ID:19067, to the nucleotide sequence of GAM1338 RNA, herein designated GAM RNA, also designated SEQ ID:360.

Another function of GAM1338 is therefore inhibition of LOC285989 (Accession XP_212111.1). Accordingly, utilities of GAM1338 include diagnosis, prevention and treatment of diseases and clinical conditions associated with LOC285989.

LOC285999 (Accession XP_212120.1) is another GAM1338 target gene, herein designated TARGET GENE. LOC285999 BINDING SITE is a target binding site found in the 3' untranslated region of mRNA encoded by LOC285999, corresponding to a target binding site such as BINDING SITE I, BINDING SITE II or BINDING SITE III of FIG. 8. Table 4 illustrates the complementarity of the nucleotide sequences of LOC285999 BINDING SITE, designated SEQ ID:18120, to the nucleotide sequence of GAM1338 RNA, herein designated GAM RNA, also designated SEQ ID:360.

Another function of GAM1338 is therefore inhibition of LOC285999 (Accession XP_212120.1). Accordingly, utilities of GAM1338 include diagnosis, prevention and treatment of diseases and clinical conditions associated with LOC285999.

LOC286030 (Accession XP_209868.1) is another GAM1338 target gene, herein designated TARGET GENE. LOC286030 BINDING SITE is a target binding site found in the 5' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:10050, to the nucleotide sequence of GAM1338 RNA, herein designated GAM RNA, also designated SEQ ID:360.

Another function of GAM1338 is therefore inhibition of LOC286030 (Accession XP_209868.1). Accordingly, utilities of GAM1338 include diagnosis, prevention and treatment of diseases and clinical conditions associated with LOC286030.

LOC286032 (Accession XP_209867.2) is another GAM1338 target gene, herein designated TARGET GENE. LOC286032 BINDING SITE is a target binding site found in the 3' untranslated region of mRNA encoded by LOC286032, corresponding to a target binding site such as BINDING SITE I, BINDING SITE II or BINDING SITE III of FIG. 8. Table 4 illustrates the complementarity of the nucleotide sequences of LOC286032 BINDING SITE, designated SEQ ID:1208, to the nucleotide sequence of GAM1338 RNA, herein designated GAM RNA, also designated SEQ ID:360.

Another function of GAM1338 is therefore inhibition of LOC286032 (Accession XP_209867.2). Accordingly, utilities of GAM1338 include diagnosis, prevention and treatment of diseases and clinical conditions associated with LOC286032.

LOC286039 (Accession XP_209873.1) is another GAM1338 target gene, herein designated TARGET GENE. LOC286039 BINDING SITE is a target binding site found in the 5' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:17647, to the nucleotide sequence of GAM1338 RNA, herein designated GAM RNA, also designated SEQ ID:360.

Another function of GAM1338 is therefore inhibition of LOC286039 (Accession XP_209873.1). Accordingly, utilities of GAM1338 include diagnosis, prevention and treatment of diseases and clinical conditions associated with LOC286039.

LOC286052 (Accession XP_212152.1) is another GAM1338 target gene, herein designated TARGET GENE. LOC286052 BINDING SITE is a target binding site found in the 3' untranslated region of mRNA encoded by LOC286052, corresponding to a target binding site such as BINDING SITE I, BINDING SITE II or BINDING SITE III of FIG. 8. Table 4 illustrates the complementarity of the nucleotide sequences of LOC286052 BINDING SITE, designated SEQ ID:14748, to the nucleotide sequence of GAM1338 RNA, herein designated GAM RNA, also designated SEQ ID:360.

Another function of GAM1338 is therefore inhibition of LOC286052 (Accession XP_212152.1). Accordingly, utilities of GAM1338 include diagnosis, prevention and treatment of diseases and clinical conditions associated with LOC286052.

LOC286075 (Accession NP_776192.1) is another GAM1338 target gene, herein designated TARGET GENE. LOC286075 BINDING SITE is a target binding site found in the 5' untranslated region of mRNA encoded by LOC286075, corresponding to a target binding site such as BINDING SITE I, BINDING SITE II or BINDING SITE III of FIG. 8. Table 4 illustrates the complementarity of the nucleotide sequences of LOC286075 BINDING SITE, designated SEQ ID:1410, to the nucleotide sequence of GAM1338 RNA, herein designated GAM RNA, also designated SEQ ID:360.

Another function of GAM1338 is therefore inhibition of LOC286075 (Accession NP_776192.1). Accordingly, utilities of GAM1338 include diagnosis, prevention and treatment of diseases and clinical conditions associated with LOC286075.

LOC286077 (Accession XP_209892.1) is another GAM1338 target gene, herein designated TARGET GENE. LOC286077 BINDING SITE is a target binding site found in the 3' untranslated region of mRNA encoded by LOC286077, corresponding to a target binding site such as BINDING SITE I, BINDING SITE II or BINDING SITE III of FIG. 8. Table 4 illustrates the complementarity of the nucleotide sequences of LOC286077 BINDING SITE, designated SEQ ID:3388, to the nucleotide sequence of GAM1338 RNA, herein designated GAM RNA, also designated SEQ ID:360.

Another function of GAM1338 is therefore inhibition of LOC286077 (Accession XP_209892.1). Accordingly, utilities of GAM1338 include diagnosis, prevention and treatment of diseases and clinical conditions associated with LOC286077.

LOC286078 (Accession XP_212163.1) is another GAM1338 target gene, herein designated TARGET GENE.

LOC286078 BINDING SITE1 through LOC286078 BINDING SITE4 are target binding sites found in untranslated regions of mRNA encoded by LOC286078, corresponding to target binding sites such as BINDING SITE I, BINDING SITE II or BINDING SITE III of FIG. 8. Table 4 illustrates the complementarity of the nucleotide sequences of LOC286078 BINDING SITE1 through LOC286078 BINDING SITE4, designated SEQ ID:13798, SEQ ID:12045, SEQ ID:8139 and SEQ ID:9300 respectively, to the nucleotide sequence of GAM1338 RNA, herein designated GAM RNA, also designated SEQ ID:360.

Another function of GAM1338 is therefore inhibition of LOC286078 (Accession XP_212163.1). Accordingly, utilities of GAM1338 include diagnosis, prevention and treatment of diseases and clinical conditions associated with LOC286078.

LOC286103 (Accession NP_848630.1) is another GAM1338 target gene, herein designated TARGET GENE. LOC286103 BINDING SITE is a target binding site found in the 3' untranslated region of multiple transcripts of mRNA encoded by LOC286103, corresponding to a target binding site such as BINDING SITE I, BINDING SITE II or BINDING SITE III of FIG. 8. Table 4 illustrates the complementarity of the nucleotide sequences of LOC286103 BINDING SITE, designated SEQ ID:15670, to the nucleotide sequence of GAM1338 RNA, herein designated GAM RNA, also designated SEQ ID:360.

Another function of GAM1338 is therefore inhibition of LOC286103 (Accession NP_848630.1). Accordingly, utilities of GAM1338 include diagnosis, prevention and treatment of diseases and clinical conditions associated with LOC286103.

LOC286103 (Accession XP_209897.1) is another GAM1338 target gene, herein designated TARGET GENE. LOC286103 BINDING SITE is a target binding site found in the 3' untranslated region of multiple transcripts of mRNA encoded by LOC286103, corresponding to a target binding site such as BINDING SITE I, BINDING SITE II or BINDING SITE III of FIG. 8. Table 4 illustrates the complementarity of the nucleotide sequences of LOC286103 BINDING SITE, designated SEQ ID:15670, to the nucleotide sequence of GAM1338 RNA, herein designated GAM RNA, also designated SEQ ID:360.

Another function of GAM1338 is therefore inhibition of LOC286103 (Accession XP_209897.1). Accordingly, utilities of GAM1338 include diagnosis, prevention and treatment of diseases and clinical conditions associated with LOC286103.

LOC286121 (Accession XP_212184.3) is another GAM1338 target gene, herein designated TARGET GENE. LOC286121 BINDING SITE is a target binding site found in the 3' untranslated region of mRNA encoded by LOC286121, corresponding to a target binding site such as BINDING SITE I, BINDING SITE II or BINDING SITE III of FIG. 8. Table 4 illustrates the complementarity of the nucleotide sequences of LOC286121 BINDING SITE, designated SEQ ID:663, to the nucleotide sequence of GAM1338 RNA, herein designated GAM RNA, also designated SEQ ID:360.

Another function of GAM1338 is therefore inhibition of LOC286121 (Accession XP_212184.3). Accordingly, utilities of GAM1338 include diagnosis, prevention and treatment of diseases and clinical conditions associated with LOC286121.

LOC286126 (Accession XP_212185.1) is another GAM1338 target gene, herein designated TARGET GENE. LOC286126 BINDING SITE is a target binding site found in the 3' untranslated region of mRNA encoded by LOC286126, corresponding to a target binding site such as BINDING SITE I, BINDING SITE II or BINDING SITE III of FIG. 8. Table 4 illustrates the complementarity of the nucleotide sequences of LOC286126 BINDING SITE, designated SEQ ID:8950, to the nucleotide sequence of GAM1338 RNA, herein designated GAM RNA, also designated SEQ ID:360.

Another function of GAM1338 is therefore inhibition of LOC286126 (Accession XP_212185.1). Accordingly, utilities of GAM1338 include diagnosis, prevention and treatment of diseases and clinical conditions associated with LOC286126.

LOC286132 (Accession XP_212194.1) is another GAM1338 target gene, herein designated TARGET GENE. LOC286132 BINDING SITE is a target binding site found in the 5' untranslated region of mRNA encoded by LOC286132, corresponding to a target binding site such as BINDING SITE I, BINDING SITE II or BINDING SITE III of FIG. 8. Table 4 illustrates the complementarity of the nucleotide sequences of LOC286132 BINDING SITE, designated SEQ ID:2266, to the nucleotide sequence of GAM1338 RNA, herein designated GAM RNA, also designated SEQ ID:360.

Another function of GAM1338 is therefore inhibition of LOC286132 (Accession XP_212194.1). Accordingly, utilities of GAM1338 include diagnosis, prevention and treatment of diseases and clinical conditions associated with LOC286132.

LOC286166 (Accession XP_209925.1) is another GAM1338 target gene, herein designated TARGET GENE. LOC286166 BINDING SITE is a target binding site found in the 5' untranslated region of mRNA encoded by LOC286166, corresponding to a target binding site such as BINDING SITE I, BINDING SITE II or BINDING SITE III of FIG. 8. Table 4 illustrates the complementarity of the nucleotide sequences of LOC286166 BINDING SITE, designated SEQ ID:1529, to the nucleotide sequence of GAM1338 RNA, herein designated GAM RNA, also designated SEQ ID:360.

Another function of GAM1338 is therefore inhibition of LOC286166 (Accession XP_209925.1). Accordingly, utilities of GAM1338 include diagnosis, prevention and treatment of diseases and clinical conditions associated with LOC286166.

LOC286170 (Accession XP_212211.1) is another GAM1338 target gene, herein designated TARGET GENE. LOC286170 BINDING SITE is a target binding site found in the 5' untranslated region of mRNA encoded by LOC286170, corresponding to a target binding site such as BINDING SITE I, BINDING SITE II or BINDING SITE III of FIG. 8. Table 4 illustrates the complementarity of the nucleotide sequences of LOC286170 BINDING SITE, designated SEQ ID:14196, to the nucleotide sequence of GAM1338 RNA, herein designated GAM RNA, also designated SEQ ID:360.

Another function of GAM1338 is therefore inhibition of LOC286170 (Accession XP_212211.1). Accordingly, utilities of GAM1338 include diagnosis, prevention and treatment of diseases and clinical conditions associated with LOC286170.

LOC286186 (Accession XP_212219.1) is another GAM1338 target gene, herein designated TARGET GENE. LOC286186 BINDING SITE1 and LOC286186 BINDING SITE2 are target binding sites found in untranslated regions of mRNA encoded by LOC286186, corresponding to target binding sites such as BINDING SITE I, BINDING SITE II or BINDING SITE III of FIG. 8. Table 4 illustrates the complementarity of the nucleotide sequences of LOC286186 BINDING SITE1 and LOC286186 BINDING SITE2, designated SEQ ID:15317 and SEQ ID:13117 respectively, to the nucleotide sequence of GAM1338 RNA, herein designated GAM RNA, also designated SEQ ID:360.

Another function of GAM1338 is therefore inhibition of LOC286186 (Accession XP_212219.1). Accordingly, utilities of GAM1338 include diagnosis, prevention and treatment of diseases and clinical conditions associated with LOC286186.

LOC286206 (Accession XP_209953.1) is another GAM1338 target gene, herein designated TARGET GENE. LOC286206 BINDING SITE is a target binding site found in the 3' untranslated region of mRNA encoded by LOC286206, corresponding to a target binding site such as BINDING SITE I, BINDING SITE II or BINDING SITE III of FIG. 8. Table 4 illustrates the complementarity of the nucleotide sequences of LOC286206 BINDING SITE, designated SEQ ID:19418, to the nucleotide sequence of GAM1338 RNA, herein designated GAM RNA, also designated SEQ ID:360.

Another function of GAM1338 is therefore inhibition of LOC286206 (Accession XP_209953.1). Accordingly, utilities of GAM1338 include diagnosis, prevention and treatment of diseases and clinical conditions associated with LOC286206.

LOC286207 (Accession XP_209941.1) is another GAM1338 target gene, herein designated TARGET GENE. LOC286207 BINDING SITE is a target binding site found in the 3' untranslated region of mRNA encoded by LOC286207, corresponding to a target binding site such as BINDING SITE I, BINDING SITE II or BINDING SITE III of FIG. 8. Table 4 illustrates the complementarity of the nucleotide sequences of LOC286207 BINDING SITE, designated SEQ ID:16987, to the nucleotide sequence of GAM1338 RNA, herein designated GAM RNA, also designated SEQ ID:360.

Another function of GAM1338 is therefore inhibition of LOC286207 (Accession XP_209941.1). Accordingly, utilities of GAM1338 include diagnosis, prevention and treatment of diseases and clinical conditions associated with LOC286207.

LOC286208 (Accession XP_212230.1) is another GAM1338 target gene, herein designated TARGET GENE. LOC286208 BINDING SITE1 through LOC286208 BINDING SITE3 are target binding sites found in untranslated regions of mRNA encoded by LOC286208, corresponding to target binding sites such as BINDING SITE I, BINDING SITE II or BINDING SITE III of FIG. 8. Table 4 illustrates the complementarity of the nucleotide sequences of LOC286208 BINDING SITE1 through LOC286208 BINDING SITE3, designated SEQ ID:16222, SEQ ID:12039 and SEQ ID:14347 respectively, to the nucleotide sequence of GAM1338 RNA, herein designated GAM RNA, also designated SEQ ID:360.

Another function of GAM1338 is therefore inhibition of LOC286208 (Accession XP_212230.1). Accordingly, utilities of GAM1338 include diagnosis, prevention and treatment of diseases and clinical conditions associated with LOC286208.

LOC286223 (Accession XP_209956.1) is another GAM1338 target gene, herein designated TARGET GENE. LOC286223 BINDING SITE is a target binding site found in the 3' untranslated region of mRNA encoded by LOC286223, corresponding to a target binding site such as BINDING SITE I, BINDING SITE II or BINDING SITE III of FIG. 8. Table 4 illustrates the complementarity of the nucleotide sequences of LOC286223 BINDING SITE, designated SEQ ID:13388, to the nucleotide sequence of GAM1338 RNA, herein designated GAM RNA, also designated SEQ ID:360.

Another function of GAM1338 is therefore inhibition of LOC286223 (Accession XP_209956.1). Accordingly, utilities of GAM1338 include diagnosis, prevention and treatment of diseases and clinical conditions associated with LOC286223.

LOC286245 (Accession XP_212244.1) is another GAM1338 target gene, herein designated TARGET GENE. LOC286245 BINDING SITE is a target binding site found in the 5' untranslated region of mRNA encoded by LOC286245, corresponding to a target binding site such as BINDING SITE I, BINDING SITE II or BINDING SITE III of FIG. 8. Table 4 illustrates the complementarity of the nucleotide sequences of LOC286245 BINDING SITE, designated SEQ ID:18995, to the nucleotide sequence of GAM1338 RNA, herein designated GAM RNA, also designated SEQ ID:360.

Another function of GAM1338 is therefore inhibition of LOC286245 (Accession XP_212244.1). Accordingly, utilities of GAM1338 include diagnosis, prevention and treatment of diseases and clinical conditions associated with LOC286245.

LOC286341 (Accession XP_212278.1) is another GAM1338 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:14403, to the nucleotide sequence of GAM1338 RNA, herein designated GAM RNA, also designated SEQ ID:360.

Another function of GAM1338 is therefore inhibition of LOC286341 (Accession XP_212278.1). Accordingly, utilities of GAM1338 include diagnosis, prevention and treatment of diseases and clinical conditions associated with LOC286341.

LOC286354 (Accession XP_212286.1) is another GAM1338 target gene, herein designated TARGET GENE. LOC286354 BINDING SITE is a target binding site found in the 5' untranslated region of mRNA encoded by LOC286354, corresponding to a target binding site such as BINDING SITE I, BINDING SITE II or BINDING SITE III of FIG. 8. Table 4 illustrates the complementarity of the nucleotide sequences of LOC286354 BINDING SITE, designated SEQ ID:20172, to the nucleotide sequence of GAM1338 RNA, herein designated GAM RNA, also designated SEQ ID:360.

Another function of GAM1338 is therefore inhibition of LOC286354 (Accession XP_212286.1). Accordingly, utilities of GAM1338 include diagnosis, prevention and treatment of diseases and clinical conditions associated with LOC286354.

LOC286356 (Accession XP_212290.1) is another GAM1338 target gene, herein designated TARGET GENE. LOC286356 BINDING SITE1 and LOC286356 BINDING SITE2 are target binding sites found in untranslated regions of mRNA encoded by LOC286356, corresponding to target binding sites such as BINDING SITE I, BINDING SITE II or BINDING SITE III of FIG. 8. Table 4 illustrates the complementarity of the nucleotide sequences of LOC286356 BINDING SITE1 and LOC286356 BINDING SITE2, designated SEQ ID:13800 and SEQ ID:3910 respectively, to the nucleotide sequence of GAM1338 RNA, herein designated GAM RNA, also designated SEQ ID:360.

Another function of GAM1338 is therefore inhibition of LOC286356 (Accession XP_212290.1). Accordingly, utilities of GAM1338 include diagnosis, prevention and treatment of diseases and clinical conditions associated with LOC286356.

LOC286357 (Accession XP_212285.1) is another GAM1338 target gene, herein designated TARGET GENE.

LOC286357 BINDING SITE is a target binding site found in the 5' untranslated region of mRNA encoded by LOC286357, corresponding to a target binding site such as BINDING SITE I, BINDING SITE II or BINDING SITE III of FIG. 8. Table 4 illustrates the complementarity of the nucleotide sequences of LOC286357 BINDING SITE, designated SEQ ID:13894, to the nucleotide sequence of GAM1338 RNA, herein designated GAM RNA, also designated SEQ ID:360.

Another function of GAM1338 is therefore inhibition of LOC286357 (Accession XP_212285.1). Accordingly, utilities of GAM1338 include diagnosis, prevention and treatment of diseases and clinical conditions associated with LOC286357.

LOC286395 (Accession XP_212308.1) is another GAM1338 target gene, herein designated TARGET GENE. LOC286395 BINDING SITE is a target binding site found in the 5' untranslated region of mRNA encoded by LOC286395, corresponding to a target binding site such as BINDING SITE I, BINDING SITE II or BINDING SITE III of FIG. 8. Table 4 illustrates the complementarity of the nucleotide sequences of LOC286395 BINDING SITE, designated SEQ ID:18548, to the nucleotide sequence of GAM1338 RNA, herein designated GAM RNA, also designated SEQ ID:360.

Another function of GAM1338 is therefore inhibition of LOC286395 (Accession XP_212308.1). Accordingly, utilities of GAM1338 include diagnosis, prevention and treatment of diseases and clinical conditions associated with LOC286395.

LOC286404 (Accession XP_210036.1) is another GAM1338 target gene, herein designated TARGET GENE. LOC286404 BINDING SITE is a target binding site found in the 3' untranslated region of multiple transcripts of mRNA encoded by LOC286404, corresponding to a target binding site such as BINDING SITE I, BINDING SITE II or BINDING SITE III of FIG. 8. Table 4 illustrates the complementarity of the nucleotide sequences of LOC286404 BINDING SITE, designated SEQ ID:16900, to the nucleotide sequence of GAM1338 RNA, herein designated GAM RNA, also designated SEQ ID:360.

Another function of GAM1338 is therefore inhibition of LOC286404 (Accession XP_210036.1). Accordingly, utilities of GAM1338 include diagnosis, prevention and treatment of diseases and clinical conditions associated with LOC286404.

LOC286441 (Accession XP_212319.1) is another GAM1338 target gene, herein designated TARGET GENE. LOC286441 BINDING SITE is a target binding site found in the 3' untranslated region of mRNA encoded by LOC286441, corresponding to a target binding site such as BINDING SITE I, BINDING SITE II or BINDING SITE III of FIG. 8. Table 4 illustrates the complementarity of the nucleotide sequences of LOC286441 BINDING SITE, designated SEQ ID:643, to the nucleotide sequence of GAM1338 RNA, herein designated GAM RNA, also designated SEQ ID:360.

Another function of GAM1338 is therefore inhibition of LOC286441 (Accession XP_212319.1). Accordingly, utilities of GAM1338 include diagnosis, prevention and treatment of diseases and clinical conditions associated with LOC286441.

LOC286467 (Accession XP_210063.1) is another GAM1338 target gene, herein designated TARGET GENE. LOC286467 BINDING SITE is a target binding site found in the 3' untranslated region of mRNA encoded by LOC286467, corresponding to a target binding site such as BINDING SITE I, BINDING SITE II or BINDING SITE III of FIG. 8. Table 4 illustrates the complementarity of the nucleotide sequences of LOC286467 BINDING SITE, designated SEQ ID:12807, to the nucleotide sequence of GAM1338 RNA, herein designated GAM RNA, also designated SEQ ID:360.

Another function of GAM1338 is therefore inhibition of LOC286467 (Accession XP_210063.1). Accordingly, utilities of GAM1338 include diagnosis, prevention and treatment of diseases and clinical conditions associated with LOC286467.

LOC286553 (Accession XP_212340.1) is another GAM1338 target gene, herein designated TARGET GENE. LOC286553 BINDING SITE is a target binding site found in the 3' untranslated region of mRNA encoded by LOC286553, corresponding to a target binding site such as BINDING SITE I, BINDING SITE II or BINDING SITE III of FIG. 8. Table 4 illustrates the complementarity of the nucleotide sequences of LOC286553 BINDING SITE, designated SEQ ID:17107, to the nucleotide sequence of GAM1338 RNA, herein designated GAM RNA, also designated SEQ ID:360.

Another function of GAM1338 is therefore inhibition of LOC286553 (Accession XP_212340.1). Accordingly, utilities of GAM1338 include diagnosis, prevention and treatment of diseases and clinical conditions associated with LOC286553.

LOC286558 (Accession XP_210106.1) is another GAM1338 target gene, herein designated TARGET GENE. LOC286558 BINDING SITE is a target binding site found in the 3' untranslated region of mRNA encoded by LOC286558, corresponding to a target binding site such as BINDING SITE I, BINDING SITE II or BINDING SITE III of FIG. 8. Table 4 illustrates the complementarity of the nucleotide sequences of LOC286558 BINDING SITE, designated SEQ ID:14505, to the nucleotide sequence of GAM1338 RNA, herein designated GAM RNA, also designated SEQ ID:360.

Another function of GAM1338 is therefore inhibition of LOC286558 (Accession XP_210106.1). Accordingly, utilities of GAM1338 include diagnosis, prevention and treatment of diseases and clinical conditions associated with LOC286558.

LOC286564 (Accession XP_210108.1) is another GAM1338 target gene, herein designated TARGET GENE. LOC286564 BINDING SITE is a target binding site found in the 3' untranslated region of mRNA encoded by LOC286564, corresponding to a target binding site such as BINDING SITE I, BINDING SITE II or BINDING SITE III of FIG. 8. Table 4 illustrates the complementarity of the nucleotide sequences of LOC286564 BINDING SITE, designated SEQ ID:14505, to the nucleotide sequence of GAM1338 RNA, herein designated GAM RNA, also designated SEQ ID:360.

Another function of GAM1338 is therefore inhibition of LOC286564 (Accession XP_210108.1). Accordingly, utilities of GAM1338 include diagnosis, prevention and treatment of diseases and clinical conditions associated with LOC286564.

LOC338562 (Accession XP_294654.1) is another GAM1338 target gene, herein designated TARGET GENE. LOC338562 BINDING SITE is a target binding site found in the 3' untranslated region of mRNA encoded by LOC338562, corresponding to a target binding site such as BINDING SITE I, BINDING SITE II or BINDING SITE III of FIG. 8. Table 4 illustrates the complementarity of the nucleotide sequences of LOC338562 BINDING SITE, designated SEQ ID:17586, to the nucleotide sequence of GAM1338 RNA, herein designated GAM RNA, also designated SEQ ID:360.

Another function of GAM1338 is therefore inhibition of LOC338562 (Accession XP_294654.1). Accordingly, utilities of GAM1338 include diagnosis, prevention and treatment of diseases and clinical conditions associated with LOC338562.

LOC338565 (Accession XP_294653.1) is another GAM1338 target gene, herein designated TARGET GENE. LOC338565 BINDING SITE is a target binding site found in the 3' untranslated region of mRNA encoded by LOC338565, corresponding to a target binding site such as BINDING SITE I, BINDING SITE II or BINDING SITE III of FIG. 8. Table 4 illustrates the complementarity of the nucleotide sequences of LOC338565 BINDING SITE, designated SEQ ID:12519, to the nucleotide sequence of GAM1338 RNA, herein designated GAM RNA, also designated SEQ ID:360.

Another function of GAM1338 is therefore inhibition of LOC338565 (Accession XP_294653.1). Accordingly, utilities of GAM1338 include diagnosis, prevention and treatment of diseases and clinical conditions associated with LOC338565.

LOC338645 (Accession XP_290494.1) is another GAM1338 target gene, herein designated TARGET GENE. LOC338645 BINDING SITE is a target binding site found in the 3' untranslated region of mRNA encoded by LOC338645, corresponding to a target binding site such as BINDING SITE I, BINDING SITE II or BINDING SITE III of FIG. 8. Table 4 illustrates the complementarity of the nucleotide sequences of LOC338645 BINDING SITE, designated SEQ ID:6141, to the nucleotide sequence of GAM1338 RNA, herein designated GAM RNA, also designated SEQ ID:360.

Another function of GAM1338 is therefore inhibition of LOC338645 (Accession XP_290494.1). Accordingly, utilities of GAM1338 include diagnosis, prevention and treatment of diseases and clinical conditions associated with LOC338645.

LOC338709 (Accession XP_211595.2) is another GAM1338 target gene, herein designated TARGET GENE. LOC338709 BINDING SITE is a target binding site found in the 5' untranslated region of mRNA encoded by LOC338709, corresponding to a target binding site such as BINDING SITE I, BINDING SITE II or BINDING SITE III of FIG. 8. Table 4 illustrates the complementarity of the nucleotide sequences of LOC338709 BINDING SITE, designated SEQ ID:902, to the nucleotide sequence of GAM1338 RNA, herein designated GAM RNA, also designated SEQ ID:360.

Another function of GAM1338 is therefore inhibition of LOC338709 (Accession XP_211595.2). Accordingly, utilities of GAM1338 include diagnosis, prevention and treatment of diseases and clinical conditions associated with LOC338709.

LOC338739 (Accession XP_294690.1) is another GAM1338 target gene, herein designated TARGET GENE. LOC338739 BINDING SITE1 and LOC338739 BINDING SITE2 are target binding sites found in untranslated regions of mRNA encoded by LOC338739, corresponding to target binding sites such as BINDING SITE I, BINDING SITE II or BINDING SITE III of FIG. 8. Table 4 illustrates the complementarity of the nucleotide sequences of LOC338739 BINDING SITE1 and LOC338739 BINDING SITE2, designated SEQ ID:17520 and SEQ ID:11661 respectively, to the nucleotide sequence of GAM1338 RNA, herein designated GAM RNA, also designated SEQ ID:360.

Another function of GAM1338 is therefore inhibition of LOC338739 (Accession XP_294690.1). Accordingly, utilities of GAM1338 include diagnosis, prevention and treatment of diseases and clinical conditions associated with LOC338739.

LOC338773 (Accession XP_290570.1) is another GAM1338 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:17388, to the nucleotide sequence of GAM1338 RNA, herein designated GAM RNA, also designated SEQ ID:360.

Another function of GAM1338 is therefore inhibition of LOC338773 (Accession XP_290570.1). Accordingly, utilities of GAM1338 include diagnosis, prevention and treatment of diseases and clinical conditions associated with LOC338773.

LOC338817 (Accession XP_290588.1) is another GAM1338 target gene, herein designated TARGET GENE. LOC338817 BINDING SITE is a target binding site found in the 3' untranslated region of mRNA encoded by LOC338817, corresponding to a target binding site such as BINDING SITE I, BINDING SITE II or BINDING SITE III of FIG. 8. Table 4 illustrates the complementarity of the nucleotide sequences of LOC338817 BINDING SITE, designated SEQ ID:11448, to the nucleotide sequence of GAM1338 RNA, herein designated GAM RNA, also designated SEQ ID:360.

Another function of GAM1338 is therefore inhibition of LOC338817 (Accession XP_290588.1). Accordingly, utilities of GAM1338 include diagnosis, prevention and treatment of diseases and clinical conditions associated with LOC338817.

LOC338923 (Accession XP_294742.1) is another GAM1338 target gene, herein designated TARGET GENE. LOC338923 BINDING SITE1 and LOC338923 BINDING SITE2 are target binding sites found in untranslated regions of mRNA encoded by LOC338923, corresponding to target binding sites such as BINDING SITE I, BINDING SITE II or BINDING SITE III of FIG. 8. Table 4 illustrates the complementarity of the nucleotide sequences of LOC338923 BINDING SITE1 and LOC338923 BINDING SITE2, designated SEQ ID:14847 and SEQ ID:3243 respectively, to the nucleotide sequence of GAM1338 RNA, herein designated GAM RNA, also designated SEQ ID:360.

Another function of GAM1338 is therefore inhibition of LOC338923 (Accession XP_294742.1). Accordingly, utilities of GAM1338 include diagnosis, prevention and treatment of diseases and clinical conditions associated with LOC338923.

LOC338991 (Accession XP_290663.1) is another GAM1338 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:3888, to the nucleotide sequence of GAM1338 RNA, herein designated GAM RNA, also designated SEQ ID:360.

Another function of GAM1338 is therefore inhibition of LOC338991 (Accession XP_290663.1). Accordingly, utilities of GAM1338 include diagnosis, prevention and treatment of diseases and clinical conditions associated with LOC338991.

LOC338999 (Accession XP_290659.1) is another GAM1338 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:3888, to the nucleotide sequence of GAM1338 RNA, herein designated GAM RNA, also designated SEQ ID:360.

Another function of GAM1338 is therefore inhibition of LOC338999 (Accession XP_290659.1). Accordingly, utilities of GAM1338 include diagnosis, prevention and treatment of diseases and clinical conditions associated with LOC338999.

LOC339044 (Accession XP_294781.1) is another GAM1338 target gene, herein designated TARGET GENE. LOC339044 BINDING SITE is a target binding site found in the 3' untranslated region of mRNA encoded by LOC339044, corresponding to a target binding site such as BINDING SITE I, BINDING SITE II or BINDING SITE III of FIG. 8. Table 4 illustrates the complementarity of the nucleotide sequences of LOC339044 BINDING SITE, designated SEQ ID:11283, to the nucleotide sequence of GAM1338 RNA, herein designated GAM RNA, also designated SEQ ID:360.

Another function of GAM1338 is therefore inhibition of LOC339044 (Accession XP_294781.1). Accordingly, utilities of GAM1338 include diagnosis, prevention and treatment of diseases and clinical conditions associated with LOC339044.

LOC339078 (Accession XP_290692.1) is another GAM1338 target gene, herein designated TARGET GENE. LOC339078 BINDING SITE is a target binding site found in the 3' untranslated region of mRNA encoded by LOC339078, corresponding to a target binding site such as BINDING SITE I, BINDING SITE II or BINDING SITE III of FIG. 8. Table 4 illustrates the complementarity of the nucleotide sequences of LOC339078 BINDING SITE, designated SEQ ID:19426, to the nucleotide sequence of GAM1338 RNA, herein designated GAM RNA, also designated SEQ ID:360.

Another function of GAM1338 is therefore inhibition of LOC339078 (Accession XP_290692.1). Accordingly, utilities of GAM1338 include diagnosis, prevention and treatment of diseases and clinical conditions associated with LOC339078.

LOC339146 (Accession XP_294825.1) is another GAM1338 target gene, herein designated TARGET GENE. LOC339146 BINDING SITE is a target binding site found in the 5' untranslated region of mRNA encoded by LOC339146, corresponding to a target binding site such as BINDING SITE I, BINDING SITE II or BINDING SITE III of FIG. 8. Table 4 illustrates the complementarity of the nucleotide sequences of LOC339146 BINDING SITE, designated SEQ ID:822, to the nucleotide sequence of GAM1338 RNA, herein designated GAM RNA, also designated SEQ ID:360.

Another function of GAM1338 is therefore inhibition of LOC339146 (Accession XP_294825.1). Accordingly, utilities of GAM1338 include diagnosis, prevention and treatment of diseases and clinical conditions associated with LOC339146.

LOC339192 (Accession XP_294848.1) is another GAM1338 target gene, herein designated TARGET GENE. LOC339192 BINDING SITE is a target binding site found in the 3' untranslated region of mRNA encoded by LOC339192, corresponding to a target binding site such as BINDING SITE I, BINDING SITE II or BINDING SITE III of FIG. 8. Table 4 illustrates the complementarity of the nucleotide sequences of LOC339192 BINDING SITE, designated SEQ ID:4453, to the nucleotide sequence of GAM1338 RNA, herein designated GAM RNA, also designated SEQ ID:360.

Another function of GAM1338 is therefore inhibition of LOC339192 (Accession XP_294848.1). Accordingly, utilities of GAM1338 include diagnosis, prevention and treatment of diseases and clinical conditions associated with LOC339192.

LOC339201 (Accession XP_290756.1) is another GAM1338 target gene, herein designated TARGET GENE. LOC339201 BINDING SITE is a target binding site found in the 3' untranslated region of mRNA encoded by LOC339201, corresponding to a target binding site such as BINDING SITE I, BINDING SITE II or BINDING SITE III of FIG. 8. Table 4 illustrates the complementarity of the nucleotide sequences of LOC339201 BINDING SITE, designated SEQ ID:11830, to the nucleotide sequence of GAM1338 RNA, herein designated GAM RNA, also designated SEQ ID:360.

Another function of GAM1338 is therefore inhibition of LOC339201 (Accession XP_290756.1). Accordingly, utilities of GAM1338 include diagnosis, prevention and treatment of diseases and clinical conditions associated with LOC339201.

LOC339216 (Accession XP_290762.2) is another GAM1338 target gene, herein designated TARGET GENE. LOC339216 BINDING SITE is a target binding site found in the 5' untranslated region of mRNA encoded by LOC339216, corresponding to a target binding site such as BINDING SITE I, BINDING SITE II or BINDING SITE III of FIG. 8. Table 4 illustrates the complementarity of the nucleotide sequences of LOC339216 BINDING SITE, designated SEQ ID:4581, to the nucleotide sequence of GAM1338 RNA, herein designated GAM RNA, also designated SEQ ID:360.

Another function of GAM1338 is therefore inhibition of LOC339216 (Accession XP_290762.2). Accordingly, utilities of GAM1338 include diagnosis, prevention and treatment of diseases and clinical conditions associated with LOC339216.

LOC339282 (Accession XP_294900.2) is another GAM1338 target gene, herein designated TARGET GENE. LOC339282 BINDING SITE is a target binding site found in the 5' untranslated region of mRNA encoded by LOC339282, corresponding to a target binding site such as BINDING SITE I, BINDING SITE II or BINDING SITE III of FIG. 8. Table 4 illustrates the complementarity of the nucleotide sequences of LOC339282 BINDING SITE, designated SEQ ID:4581, to the nucleotide sequence of GAM1338 RNA, herein designated GAM RNA, also designated SEQ ID:360.

Another function of GAM1338 is therefore inhibition of LOC339282 (Accession XP_294900.2). Accordingly, utilities of GAM1338 include diagnosis, prevention and treatment of diseases and clinical conditions associated with LOC339282.

LOC339283 (Accession XP_294899.2) is another GAM1338 target gene, herein designated TARGET GENE. LOC339283 BINDING SITE is a target binding site found in the 5' untranslated region of mRNA encoded by LOC339283, corresponding to a target binding site such as BINDING SITE I, BINDING SITE II or BINDING SITE III of FIG. 8. Table 4 illustrates the complementarity of the nucleotide sequences of LOC339283 BINDING SITE, designated SEQ ID:15442, to the nucleotide sequence of GAM1338 RNA, herein designated GAM RNA, also designated SEQ ID:360.

Another function of GAM1338 is therefore inhibition of LOC339283 (Accession XP_294899.2). Accordingly, utilities of GAM1338 include diagnosis, prevention and treatment of diseases and clinical conditions associated with LOC339283.

LOC339324 (Accession XP_290838.1) is another GAM1338 target gene, herein designated TARGET GENE. LOC339324 BINDING SITE is a target binding site found in the 3' untranslated region of mRNA encoded by LOC339324, corresponding to a target binding site such as BINDING SITE I, BINDING SITE II or BINDING SITE III of FIG. 8. Table 4 illustrates the complementarity of the nucleotide sequences of LOC339324 BINDING SITE, designated SEQ ID:11623, to the nucleotide sequence of GAM1338 RNA, herein designated GAM RNA, also designated SEQ ID:360.

Another function of GAM1338 is therefore inhibition of LOC339324 (Accession XP_290838.1). Accordingly, utilities of GAM1338 include diagnosis, prevention and treatment of diseases and clinical conditions associated with LOC339324.

LOC339325 (Accession XP_290830.1) is another GAM1338 target gene, herein designated TARGET GENE. LOC339325 BINDING SITE is a target binding site found in the 3' untranslated region of mRNA encoded by LOC339325, corresponding to a target binding site such as BINDING SITE I, BINDING SITE II or BINDING SITE III of FIG. 8. Table 4 illustrates the complementarity of the nucleotide sequences of LOC339325 BINDING SITE, designated SEQ ID:7946, to the nucleotide sequence of GAM1338 RNA, herein designated GAM RNA, also designated SEQ ID:360.

Another function of GAM1338 is therefore inhibition of LOC339325 (Accession XP_290830.1). Accordingly, utilities of GAM1338 include diagnosis, prevention and treatment of diseases and clinical conditions associated with LOC339325.

LOC339400 (Accession XP_294926.1) is another GAM1338 target gene, herein designated TARGET GENE. LOC339400 BINDING SITE1 and LOC339400 BINDING SITE2 are target binding sites found in untranslated regions of mRNA encoded by LOC339400, corresponding to target binding sites such as BINDING SITE I, BINDING SITE II or BINDING SITE III of FIG. 8. Table 4 illustrates the complementarity of the nucleotide sequences of LOC339400 BINDING SITE1 and LOC339400 BINDING SITE2, designated SEQ ID:14822 and SEQ ID:17314 respectively, to the nucleotide sequence of GAM1338 RNA, herein designated GAM RNA, also designated SEQ ID:360.

Another function of GAM1338 is therefore inhibition of LOC339400 (Accession XP_294926.1). Accordingly, utilities of GAM1338 include diagnosis, prevention and treatment of diseases and clinical conditions associated with LOC339400.

LOC339417 (Accession XP_294944.1) is another GAM1338 target gene, herein designated TARGET GENE. LOC339417 BINDING SITE is a target binding site found in the 5' untranslated region of mRNA encoded by LOC339417, corresponding to a target binding site such as BINDING SITE I, BINDING SITE II or BINDING SITE III of FIG. 8. Table 4 illustrates the complementarity of the nucleotide sequences of LOC339417 BINDING SITE, designated SEQ ID:4497, to the nucleotide sequence of GAM1338 RNA, herein designated GAM RNA, also designated SEQ ID:360.

Another function of GAM1338 is therefore inhibition of LOC339417 (Accession XP_294944.1). Accordingly, utilities of GAM1338 include diagnosis, prevention and treatment of diseases and clinical conditions associated with LOC339417.

LOC339458 (Accession XP_290911.1) is another GAM1338 target gene, herein designated TARGET GENE. LOC339458 BINDING SITE is a target binding site found in the 3' untranslated region of mRNA encoded by LOC339458, corresponding to a target binding site such as BINDING SITE I, BINDING SITE II or BINDING SITE III of FIG. 8. Table 4 illustrates the complementarity of the nucleotide sequences of LOC339458 BINDING SITE, designated SEQ ID:436, to the nucleotide sequence of GAM1338 RNA, herein designated GAM RNA, also designated SEQ ID:360.

Another function of GAM1338 is therefore inhibition of LOC339458 (Accession XP_290911.1). Accordingly, utilities of GAM1338 include diagnosis, prevention and treatment of diseases and clinical conditions associated with LOC339458.

LOC339459 (Accession XP_290907.2) is another GAM1338 target gene, herein designated TARGET GENE. LOC339459 BINDING SITE is a target binding site found in the 3' untranslated region of mRNA encoded by LOC339459, corresponding to a target binding site such as BINDING SITE I, BINDING SITE II or BINDING SITE III of FIG. 8. Table 4 illustrates the complementarity of the nucleotide sequences of LOC339459 BINDING SITE, designated SEQ ID:13345, to the nucleotide sequence of GAM1338 RNA, herein designated GAM RNA, also designated SEQ ID:360.

Another function of GAM1338 is therefore inhibition of LOC339459 (Accession XP_290907.2). Accordingly, utilities of GAM1338 include diagnosis, prevention and treatment of diseases and clinical conditions associated with LOC339459.

LOC339492 (Accession XP_290919.1) is another GAM1338 target gene, herein designated TARGET GENE. LOC339492 BINDING SITE1 and LOC339492 BINDING SITE2 are target binding sites found in untranslated regions of mRNA encoded by LOC339492, corresponding to target binding sites such as BINDING SITE I, BINDING SITE II or BINDING SITE III of FIG. 8. Table 4 illustrates the complementarity of the nucleotide sequences of LOC339492 BINDING SITE1 and LOC339492 BINDING SITE2, designated SEQ ID:13601 and SEQ ID:19744 respectively, to the nucleotide sequence of GAM1338 RNA, herein designated GAM RNA, also designated SEQ ID:360.

Another function of GAM1338 is therefore inhibition of LOC339492 (Accession XP_290919.1). Accordingly, utilities of GAM1338 include diagnosis, prevention and treatment of diseases and clinical conditions associated with LOC339492.

LOC339577 (Accession XP_295005.1) is another GAM1338 target gene, herein designated TARGET GENE. LOC339577 BINDING SITE1 and LOC339577 BINDING SITE2 are target binding sites found in untranslated regions of mRNA encoded by LOC339577, corresponding to target binding sites such as BINDING SITE I, BINDING SITE II or BINDING SITE III of FIG. 8. Table 4 illustrates the complementarity of the nucleotide sequences of LOC339577 BINDING SITE1 and LOC339577 BINDING SITE2, designated SEQ ID:18182 and SEQ ID:9239 respectively, to the nucleotide sequence of GAM1338 RNA, herein designated GAM RNA, also designated SEQ ID:360.

Another function of GAM1338 is therefore inhibition of LOC339577 (Accession XP_295005.1). Accordingly, utilities of GAM1338 include diagnosis, prevention and treatment of diseases and clinical conditions associated with LOC339577.

LOC339600 (Accession XP_295014.1) is another GAM1338 target gene, herein designated TARGET GENE. LOC339600 BINDING SITE is a target binding site found in the 3' untranslated region of mRNA encoded by LOC339600, corresponding to a target binding site such as BINDING SITE I, BINDING SITE II or BINDING SITE III of FIG. 8. Table 4 illustrates the complementarity of the nucleotide sequences of LOC339600 BINDING SITE, designated SEQ ID:15466, to the nucleotide sequence of GAM1338 RNA, herein designated GAM RNA, also designated SEQ ID:360.

Another function of GAM1338 is therefore inhibition of LOC339600 (Accession XP_295014.1). Accordingly, utilities of GAM1338 include diagnosis, prevention and treatment of diseases and clinical conditions associated with LOC339600.

LOC339659 (Accession XP_290981.1) is another GAM1338 target gene, herein designated TARGET GENE. LOC339659 BINDING SITE is a target binding site found in the 3' untranslated region of mRNA encoded by LOC339659, corresponding to a target binding site such as BINDING SITE I, BINDING SITE II or BINDING SITE III of FIG. 8. Table 4 illustrates the complementarity of the nucleotide sequences of LOC339659 BINDING SITE, designated SEQ ID:18371, to the nucleotide sequence of GAM1338 RNA, herein designated GAM RNA, also designated SEQ ID:360.

Another function of GAM1338 is therefore inhibition of LOC339659 (Accession XP_290981.1). Accordingly, utilities of GAM1338 include diagnosis, prevention and treatment of diseases and clinical conditions associated with LOC339659.

LOC339685 (Accession XP_295032.1) is another GAM1338 target gene, herein designated TARGET GENE. LOC339685 BINDING SITE is a target binding site found in the 5' untranslated region of mRNA encoded by LOC339685, corresponding to a target binding site such as BINDING SITE I, BINDING SITE II or BINDING SITE III of FIG. 8. Table 4 illustrates the complementarity of the nucleotide sequences of LOC339685 BINDING SITE, designated SEQ ID:7793, to the nucleotide sequence of GAM1338 RNA, herein designated GAM RNA, also designated SEQ ID:360.

Another function of GAM1338 is therefore inhibition of LOC339685 (Accession XP_295032.1). Accordingly, utilities of GAM1338 include diagnosis, prevention and treatment of diseases and clinical conditions associated with LOC339685.

LOC339711 (Accession XP_295038.1) is another GAM1338 target gene, herein designated TARGET GENE. LOC339711 BINDING SITE is a target binding site found in the 3' untranslated region of mRNA encoded by LOC339711, corresponding to a target binding site such as BINDING SITE I, BINDING SITE II or BINDING SITE III of FIG. 8. Table 4 illustrates the complementarity of the nucleotide sequences of LOC339711 BINDING SITE, designated SEQ ID:3106, to the nucleotide sequence of GAM1338 RNA, herein designated GAM RNA, also designated SEQ ID:360.

Another function of GAM1338 is therefore inhibition of LOC339711 (Accession XP_295038.1). Accordingly, utilities of GAM1338 include diagnosis, prevention and treatment of diseases and clinical conditions associated with LOC339711.

LOC339720 (Accession XP_295041.1) is another GAM1338 target gene, herein designated TARGET GENE. LOC339720 BINDING SITE is a target binding site found in the 5' untranslated region of mRNA encoded by LOC339720, corresponding to a target binding site such as BINDING SITE I, BINDING SITE II or BINDING SITE III of FIG. 8. Table 4 illustrates the complementarity of the nucleotide sequences of LOC339720 BINDING SITE, designated SEQ ID:7943, to the nucleotide sequence of GAM1338 RNA, herein designated GAM RNA, also designated SEQ ID:360.

Another function of GAM1338 is therefore inhibition of LOC339720 (Accession XP_295041.1). Accordingly, utilities of GAM1338 include diagnosis, prevention and treatment of diseases and clinical conditions associated with LOC339720.

LOC339803 (Accession XP_295072.1) is another GAM1338 target gene, herein designated TARGET GENE. LOC339803 BINDING SITE is a target binding site found in the 3' untranslated region of mRNA encoded by LOC339803, corresponding to a target binding site such as BINDING SITE I, BINDING SITE II or BINDING SITE III of FIG. 8. Table 4 illustrates the complementarity of the nucleotide sequences of LOC339803 BINDING SITE, designated SEQ ID:2943, to the nucleotide sequence of GAM1338 RNA, herein designated GAM RNA, also designated SEQ ID:360.

Another function of GAM1338 is therefore inhibition of LOC339803 (Accession XP_295072.1). Accordingly, utilities of GAM1338 include diagnosis, prevention and treatment of diseases and clinical conditions associated with LOC339803.

LOC339809 (Accession XP_291020.1) is another GAM1338 target gene, herein designated TARGET GENE. LOC339809 BINDING SITE1 and LOC339809 BINDING SITE2 are target binding sites found in untranslated regions of mRNA encoded by LOC339809, corresponding to target binding sites such as BINDING SITE I, BINDING SITE II or BINDING SITE III of FIG. 8. Table 4 illustrates the complementarity of the nucleotide sequences of LOC339809 BINDING SITE1 and LOC339809 BINDING SITE2, designated SEQ ID:8744 and SEQ ID:9098 respectively, to the nucleotide sequence of GAM1338 RNA, herein designated GAM RNA, also designated SEQ ID:360.

Another function of GAM1338 is therefore inhibition of LOC339809 (Accession XP_291020.1). Accordingly, utilities of GAM1338 include diagnosis, prevention and treatment of diseases and clinical conditions associated with LOC339809.

LOC339833 (Accession XP_291031.1) is another GAM1338 target gene, herein designated TARGET GENE. LOC339833 BINDING SITE1 and LOC339833 BINDING SITE2 are target binding sites found in untranslated regions of mRNA encoded by LOC339833, corresponding to target binding sites such as BINDING SITE I, BINDING SITE II or BINDING SITE III of FIG. 8. Table 4 illustrates the complementarity of the nucleotide sequences of LOC339833 BINDING SITE1 and LOC339833 BINDING SITE2, designated SEQ ID:8180 and SEQ ID:10061 respectively, to the nucleotide sequence of GAM1338 RNA, herein designated GAM RNA, also designated SEQ ID:360.

Another function of GAM1338 is therefore inhibition of LOC339833 (Accession XP_291031.1). Accordingly, utilities of GAM1338 include diagnosis, prevention and treatment of diseases and clinical conditions associated with LOC339833.

LOC339834 (Accession XP_291033.1) is another GAM1338 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:2474, to the nucleotide sequence of GAM1338 RNA, herein designated GAM RNA, also designated SEQ ID:360.

Another function of GAM1338 is therefore inhibition of LOC339834 (Accession XP_291033.1). Accordingly, utilities of GAM1338 include diagnosis, prevention and treatment of diseases and clinical conditions associated with LOC339834.

LOC339834 (Accession NP_835467.1) is another GAM1338 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:2474, to the nucleotide sequence of GAM1338 RNA, herein designated GAM RNA, also designated SEQ ID:360.

Another function of GAM1338 is therefore inhibition of LOC339834 (Accession NP_835467.1). Accordingly, utilities of GAM1338 include diagnosis, prevention and treatment of diseases and clinical conditions associated with LOC339834.

LOC339872 (Accession XP_291050.1) is another GAM1338 target gene, herein designated TARGET GENE. LOC339872 BINDING SITE1 through LOC339872 BINDING SITE3 are target binding sites found in untranslated regions of mRNA encoded by LOC339872, corresponding to target binding sites such as BINDING SITE I, BINDING SITE II or BINDING SITE III of FIG. 8. Table 4 illustrates the complementarity of the nucleotide sequences of LOC339872 BINDING SITE1 through LOC339872 BINDING SITE3, designated SEQ ID:15990, SEQ ID:6179 and SEQ ID:10908 respectively, to the nucleotide sequence of GAM1338 RNA, herein designated GAM RNA, also designated SEQ ID:360.

Another function of GAM1338 is therefore inhibition of LOC339872 (Accession XP_291050.1). Accordingly, utilities of GAM1338 include diagnosis, prevention and treatment of diseases and clinical conditions associated with LOC339872.

LOC339894 (Accession XP_295095.1) is another GAM1338 target gene, herein designated TARGET GENE. LOC339894 BINDING SITE is a target binding site found in the 5' untranslated region of mRNA encoded by LOC339894, corresponding to a target binding site such as BINDING SITE I, BINDING SITE II or BINDING SITE III of FIG. 8. Table 4 illustrates the complementarity of the nucleotide sequences of LOC339894 BINDING SITE, designated SEQ ID:11426, to the nucleotide sequence of GAM1338 RNA, herein designated GAM RNA, also designated SEQ ID:360.

Another function of GAM1338 is therefore inhibition of LOC339894 (Accession XP_295095.1). Accordingly, utilities of GAM1338 include diagnosis, prevention and treatment of diseases and clinical conditions associated with LOC339894.

LOC339896 (Accession XP_291059.1) is another GAM1338 target gene, herein designated TARGET GENE. LOC339896 BINDING SITE is a target binding site found in the 3' untranslated region of mRNA encoded by LOC339896, corresponding to a target binding site such as BINDING SITE I, BINDING SITE II or BINDING SITE III of FIG. 8. Table 4 illustrates the complementarity of the nucleotide sequences of LOC339896 BINDING SITE, designated SEQ ID:11602, to the nucleotide sequence of GAM1338 RNA, herein designated GAM RNA, also designated SEQ ID:360.

Another function of GAM1338 is therefore inhibition of LOC339896 (Accession XP_291059.1). Accordingly, utilities of GAM1338 include diagnosis, prevention and treatment of diseases and clinical conditions associated with LOC339896.

LOC339907 (Accession XP_291065.1) is another GAM1338 target gene, herein designated TARGET GENE. LOC339907 BINDING SITE is a target binding site found in the 3' untranslated region of mRNA encoded by LOC339907, corresponding to a target binding site such as BINDING SITE I, BINDING SITE II or BINDING SITE III of FIG. 8. Table 4 illustrates the complementarity of the nucleotide sequences of LOC339907 BINDING SITE, designated SEQ ID:1531, to the nucleotide sequence of GAM1338 RNA, herein designated GAM RNA, also designated SEQ ID:360.

Another function of GAM1338 is therefore inhibition of LOC339907 (Accession XP_291065.1). Accordingly, utilities of GAM1338 include diagnosis, prevention and treatment of diseases and clinical conditions associated with LOC339907.

LOC339909 (Accession XP_291069.1) is another GAM1338 target gene, herein designated TARGET GENE. LOC339909 BINDING SITE is a target binding site found in the 5' untranslated region of mRNA encoded by LOC339909, corresponding to a target binding site such as BINDING SITE I, BINDING SITE II or BINDING SITE III of FIG. 8. Table 4 illustrates the complementarity of the nucleotide sequences of LOC339909 BINDING SITE, designated SEQ ID:9102, to the nucleotide sequence of GAM1338 RNA, herein designated GAM RNA, also designated SEQ ID:360.

Another function of GAM1338 is therefore inhibition of LOC339909 (Accession XP_291069.1). Accordingly, utilities of GAM1338 include diagnosis, prevention and treatment of diseases and clinical conditions associated with LOC339909.

LOC339942 (Accession XP_295107.1) is another GAM1338 target gene, herein designated TARGET GENE. LOC339942 BINDING SITE is a target binding site found in the 5' untranslated region of mRNA encoded by LOC339942, corresponding to a target binding site such as BINDING SITE I, BINDING SITE II or BINDING SITE III of FIG. 8. Table 4 illustrates the complementarity of the nucleotide sequences of LOC339942 BINDING SITE, designated SEQ ID:11079, to the nucleotide sequence of GAM1338 RNA, herein designated GAM RNA, also designated SEQ ID:360.

Another function of GAM1338 is therefore inhibition of LOC339942 (Accession XP_295107.1). Accordingly, utilities of GAM1338 include diagnosis, prevention and treatment of diseases and clinical conditions associated with LOC339942.

LOC339970 (Accession XP_291095.1) is another GAM1338 target gene, herein designated TARGET GENE. LOC339970 BINDING SITE is a target binding site found in the 3' untranslated region of mRNA encoded by LOC339970, corresponding to a target binding site such as BINDING SITE I, BINDING SITE II or BINDING SITE III of FIG. 8. Table 4 illustrates the complementarity of the nucleotide sequences of LOC339970 BINDING SITE, designated SEQ ID:8858, to the nucleotide sequence of GAM1338 RNA, herein designated GAM RNA, also designated SEQ ID:360.

Another function of GAM1338 is therefore inhibition of LOC339970 (Accession XP_291095.1). Accordingly, utilities of GAM1338 include diagnosis, prevention and treatment of diseases and clinical conditions associated with LOC339970.

LOC340037 (Accession XP_295137.1) is another GAM1338 target gene, herein designated TARGET GENE. LOC340037 BINDING SITE is a target binding site found in the 3' untranslated region of mRNA encoded by LOC340037, corresponding to a target binding site such as BINDING SITE I, BINDING SITE II or BINDING SITE III of FIG. 8. Table 4 illustrates the complementarity of the nucleotide sequences of LOC340037 BINDING SITE, designated SEQ ID:664, to the nucleotide sequence of GAM1338 RNA, herein designated GAM RNA, also designated SEQ ID:360.

Another function of GAM1338 is therefore inhibition of LOC340037 (Accession XP_295137.1). Accordingly, utilities of GAM1338 include diagnosis, prevention and treatment of diseases and clinical conditions associated with LOC340037.

LOC340125 (Accession XP_291150.1) is another GAM1338 target gene, herein designated TARGET GENE. LOC340125 BINDING SITE is a target binding site found in the 5' untranslated region of mRNA encoded by LOC340125, corresponding to a target binding site such as BINDING SITE I, BINDING SITE II or BINDING SITE III of FIG. 8. Table 4 illustrates the complementarity of the nucleotide sequences of LOC340125 BINDING SITE, designated SEQ ID:902, to the nucleotide sequence of GAM1338 RNA, herein designated GAM RNA, also designated SEQ ID:360.

Another function of GAM1338 is therefore inhibition of LOC340125 (Accession XP_291150.1). Accordingly, utilities of GAM1338 include diagnosis, prevention and treatment of diseases and clinical conditions associated with LOC340125.

LOC340156 (Accession XP_291158.1) is another GAM1338 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:8575, to the nucleotide sequence of GAM1338 RNA, herein designated GAM RNA, also designated SEQ ID:360.

Another function of GAM1338 is therefore inhibition of LOC340156 (Accession XP_291158.1). Accordingly, utilities of GAM1338 include diagnosis, prevention and treatment of diseases and clinical conditions associated with LOC340156.

LOC340227 (Accession XP_291203.1) is another GAM1338 target gene, herein designated TARGET GENE. LOC340227 BINDING SITE is a target binding site found in the 5' untranslated region of mRNA encoded by LOC340227, corresponding to a target binding site such as BINDING SITE I, BINDING SITE II or BINDING SITE III of FIG. 8. Table 4 illustrates the complementarity of the nucleotide sequences of LOC340227 BINDING SITE, designated SEQ ID:902, to the nucleotide sequence of GAM1338 RNA, herein designated GAM RNA, also designated SEQ ID:360.

Another function of GAM1338 is therefore inhibition of LOC340227 (Accession XP_291203.1). Accordingly, utilities of GAM1338 include diagnosis, prevention and treatment of diseases and clinical conditions associated with LOC340227.

LOC340290 (Accession XP_291214.1) is another GAM1338 target gene, herein designated TARGET GENE. LOC340290 BINDING SITE is a target binding site found in the 5' untranslated region of mRNA encoded by LOC340290, corresponding to a target binding site such as BINDING SITE I, BINDING SITE II or BINDING SITE III of FIG. 8. Table 4 illustrates the complementarity of the nucleotide sequences of LOC340290 BINDING SITE, designated SEQ ID:15164, to the nucleotide sequence of GAM1338 RNA, herein designated GAM RNA, also designated SEQ ID:360.

Another function of GAM1338 is therefore inhibition of LOC340290 (Accession XP_291214.1). Accordingly, utilities of GAM1338 include diagnosis, prevention and treatment of diseases and clinical conditions associated with LOC340290.

LOC340390 (Accession XP_291269.1) is another GAM1338 target gene, herein designated TARGET GENE. LOC340390 BINDING SITE is a target binding site found in the 3' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:3427, to the nucleotide sequence of GAM1338 RNA, herein designated GAM RNA, also designated SEQ ID:360.

Another function of GAM1338 is therefore inhibition of LOC340390 (Accession XP_291269.1). Accordingly, utilities of GAM1338 include diagnosis, prevention and treatment of diseases and clinical conditions associated with LOC340390.

LOC340408 (Accession XP_291274.1) is another GAM1338 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:564, to the nucleotide sequence of GAM1338 RNA, herein designated GAM RNA, also designated SEQ ID:360.

Another function of GAM1338 is therefore inhibition of LOC340408 (Accession XP_291274.1). Accordingly, utilities of GAM1338 include diagnosis, prevention and treatment of diseases and clinical conditions associated with LOC340408.

LOC340414 (Accession XP_295240.1) is another GAM1338 target gene, herein designated TARGET GENE. LOC340414 BINDING SITE is a target binding site found in the 3' untranslated region of mRNA encoded by LOC340414, corresponding to a target binding site such as BINDING SITE I, BINDING SITE II or BINDING SITE III of FIG. 8. Table 4 illustrates the complementarity of the nucleotide sequences of LOC340414 BINDING SITE, designated SEQ ID:11659, to the nucleotide sequence of GAM1338 RNA, herein designated GAM RNA, also designated SEQ ID:360.

Another function of GAM1338 is therefore inhibition of LOC340414 (Accession XP_295240.1). Accordingly, utilities of GAM1338 include diagnosis, prevention and treatment of diseases and clinical conditions associated with LOC340414.

LOC340450 (Accession XP_295252.1) is another GAM1338 target gene, herein designated TARGET GENE. LOC340450 BINDING SITE is a target binding site found in the 5' untranslated region of mRNA encoded by LOC340450, corresponding to a target binding site such as BINDING SITE I, BINDING SITE II or BINDING SITE III of FIG. 8. Table 4 illustrates the complementarity of the nucleotide sequences of LOC340450 BINDING SITE, designated SEQ ID:4971, to the nucleotide sequence of GAM1338 RNA, herein designated GAM RNA, also designated SEQ ID:360.

Another function of GAM1338 is therefore inhibition of LOC340450 (Accession XP_295252.1). Accordingly, utilities of GAM1338 include diagnosis, prevention and treatment of diseases and clinical conditions associated with LOC340450.

LOC342926 (Accession XP_292790.2) is another GAM1338 target gene, herein designated TARGET GENE. LOC342926 BINDING SITE is a target binding site found in the 3' untranslated region of mRNA encoded by LOC342926, corresponding to a target binding site such as BINDING SITE I, BINDING SITE II or BINDING SITE III of FIG. 8. Table 4 illustrates the complementarity of the nucleotide sequences of LOC342926 BINDING SITE, designated SEQ ID:1413, to the nucleotide sequence of GAM1338 RNA, herein designated GAM RNA, also designated SEQ ID:360.

Another function of GAM1338 is therefore inhibition of LOC342926 (Accession XP_292790.2). Accordingly, utilities of GAM1338 include diagnosis, prevention and treatment of diseases and clinical conditions associated with LOC342926.

LOC345275 (Accession NP_835236.1) is another GAM1338 target gene, herein designated TARGET GENE.

LOC345275 BINDING SITE is a target binding site found in the 3' untranslated region of multiple transcripts of mRNA encoded by LOC345275, corresponding to a target binding site such as BINDING SITE I, BINDING SITE II or BINDING SITE III of FIG. 8. Table 4 illustrates the complementarity of the nucleotide sequences of LOC345275 BINDING SITE, designated SEQ ID:14511, to the nucleotide sequence of GAM1338 RNA, herein designated GAM RNA, also designated SEQ ID:360.

Another function of GAM1338 is therefore inhibition of LOC345275 (Accession NP_835236.1). Accordingly, utilities of GAM1338 include diagnosis, prevention and treatment of diseases and clinical conditions associated with LOC345275.

LOC346653 (Accession XP_294357.2) is another GAM1338 target gene, herein designated TARGET GENE. LOC346653 BINDING SITE1 and LOC346653 BINDING SITE2 are target binding sites found in untranslated regions of mRNA encoded by LOC346653, corresponding to target binding sites such as BINDING SITE I, BINDING SITE II or BINDING SITE III of FIG. 8. Table 4 illustrates the complementarity of the nucleotide sequences of LOC346653 BINDING SITE1 and LOC346653 BINDING SITE2, designated SEQ ID:4277 and SEQ ID:14945 respectively, to the nucleotide sequence of GAM1338 RNA, herein designated GAM RNA, also designated SEQ ID:360.

Another function of GAM1338 is therefore inhibition of LOC346653 (Accession XP_294357.2). Accordingly, utilities of GAM1338 include diagnosis, prevention and treatment of diseases and clinical conditions associated with LOC346653.

LOC347918 (Accession XP_300565.1) is another GAM1338 target gene, herein designated TARGET GENE. LOC347918 BINDING SITE is a target binding site found in the 5' untranslated region of mRNA encoded by LOC347918, corresponding to a target binding site such as BINDING SITE I, BINDING SITE II or BINDING SITE III of FIG. 8. Table 4 illustrates the complementarity of the nucleotide sequences of LOC347918 BINDING SITE, designated SEQ ID:983, to the nucleotide sequence of GAM1338 RNA, herein designated GAM RNA, also designated SEQ ID:360.

Another function of GAM1338 is therefore inhibition of LOC347918 (Accession XP_300565.1). Accordingly, utilities of GAM1338 include diagnosis, prevention and treatment of diseases and clinical conditions associated with LOC347918.

LOC348075 (Accession XP_302653.1) is another GAM1338 target gene, herein designated TARGET GENE. LOC348075 BINDING SITE1 and LOC348075 BINDING SITE2 are target binding sites found in untranslated regions of mRNA encoded by LOC348075, corresponding to target binding sites such as BINDING SITE I, BINDING SITE II or BINDING SITE III of FIG. 8. Table 4 illustrates the complementarity of the nucleotide sequences of LOC348075 BINDING SITE1 and LOC348075 BINDING SITE2, designated SEQ ID:6491 and SEQ ID:777 respectively, to the nucleotide sequence of GAM1338 RNA, herein designated GAM RNA, also designated SEQ ID:360.

Another function of GAM1338 is therefore inhibition of LOC348075 (Accession XP_302653.1). Accordingly, utilities of GAM1338 include diagnosis, prevention and treatment of diseases and clinical conditions associated with LOC348075.

LOC348113 (Accession XP_300623.1) is another GAM1338 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:3888, to the nucleotide sequence of GAM1338 RNA, herein designated GAM RNA, also designated SEQ ID:360.

Another function of GAM1338 is therefore inhibition of LOC348113 (Accession XP_300623.1). Accordingly, utilities of GAM1338 include diagnosis, prevention and treatment of diseases and clinical conditions associated with LOC348113.

LOC348115 (Accession XP_300626.1) is another GAM1338 target gene, herein designated TARGET GENE. LOC348115 BINDING SITE is a target binding site found in the 5' untranslated region of mRNA encoded by LOC348115, corresponding to a target binding site such as BINDING SITE I, BINDING SITE II or BINDING SITE III of FIG. 8. Table 4 illustrates the complementarity of the nucleotide sequences of LOC348115 BINDING SITE, designated SEQ ID:12601, to the nucleotide sequence of GAM1338 RNA, herein designated GAM RNA, also designated SEQ ID:360.

Another function of GAM1338 is therefore inhibition of LOC348115 (Accession XP_300626.1). Accordingly, utilities of GAM1338 include diagnosis, prevention and treatment of diseases and clinical conditions associated with LOC348115.

LOC348137 (Accession XP_300635.1) is another GAM1338 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:3888, to the nucleotide sequence of GAM1338 RNA, herein designated GAM RNA, also designated SEQ ID:360.

Another function of GAM1338 is therefore inhibition of LOC348137 (Accession XP_300635.1). Accordingly, utilities of GAM1338 include diagnosis, prevention and treatment of diseases and clinical conditions associated with LOC348137.

LOC348142 (Accession XP_300636.1) is another GAM1338 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:3888, to the nucleotide sequence of GAM1338 RNA, herein designated GAM RNA, also designated SEQ ID:360.

Another function of GAM1338 is therefore inhibition of LOC348142 (Accession XP_300636.1). Accordingly, utilities of GAM1338 include diagnosis, prevention and treatment of diseases and clinical conditions associated with LOC348142.

LOC348161 (Accession XP_208864.1) is another GAM1338 target gene, herein designated TARGET GENE. LOC348161 BINDING SITE is a target binding site found in the 3' untranslated region of mRNA encoded by LOC348161, corresponding to a target binding site such as BINDING SITE I, BINDING SITE II or BINDING SITE III of FIG. 8. Table 4 illustrates the complementarity of the nucleotide sequences of LOC348161 BINDING SITE, designated SEQ ID:8803, to the nucleotide sequence of GAM1338 RNA, herein designated GAM RNA, also designated SEQ ID:360.

Another function of GAM1338 is therefore inhibition of LOC348161 (Accession XP_208864.1). Accordingly, utilities of GAM1338 include diagnosis, prevention and treatment of diseases and clinical conditions associated with LOC348161.

LOC348235 (Accession XP_300670.1) is another GAM1338 target gene, herein designated TARGET GENE. LOC348235 BINDING SITE is a target binding site found in the 3' untranslated region of mRNA encoded by LOC348235, corresponding to a target binding site such as BINDING SITE I, BINDING SITE II or BINDING SITE III of FIG. 8. Table 4 illustrates the complementarity of the nucleotide sequences of LOC348235 BINDING SITE, designated SEQ ID:11248, to the nucleotide sequence of GAM1338 RNA, herein designated GAM RNA, also designated SEQ ID:360.

Another function of GAM1338 is therefore inhibition of LOC348235 (Accession XP_300670.1). Accordingly, utilities of GAM1338 include diagnosis, prevention and treatment of diseases and clinical conditions associated with LOC348235.

LOC348262 (Accession XP_300683.1) is another GAM1338 target gene, herein designated TARGET GENE. LOC348262 BINDING SITE is a target binding site found in the 5' untranslated region of mRNA encoded by LOC348262, corresponding to a target binding site such as BINDING SITE I, BINDING SITE II or BINDING SITE III of FIG. 8. Table 4 illustrates the complementarity of the nucleotide sequences of LOC348262 BINDING SITE, designated SEQ ID:7914, to the nucleotide sequence of GAM1338 RNA, herein designated GAM RNA, also designated SEQ ID:360.

Another function of GAM1338 is therefore inhibition of LOC348262 (Accession XP_300683.1). Accordingly, utilities of GAM1338 include diagnosis, prevention and treatment of diseases and clinical conditions associated with LOC348262.

LOC348314 (Accession XP_302716.1) is another GAM1338 target gene, herein designated TARGET GENE. LOC348314 BINDING SITE is a target binding site found in the 5' untranslated region of mRNA encoded by LOC348314, corresponding to a target binding site such as BINDING SITE I, BINDING SITE II or BINDING SITE III of FIG. 8. Table 4 illustrates the complementarity of the nucleotide sequences of LOC348314 BINDING SITE, designated SEQ ID:9161, to the nucleotide sequence of GAM1338 RNA, herein designated GAM RNA, also designated SEQ ID:360.

Another function of GAM1338 is therefore inhibition of LOC348314 (Accession XP_302716.1). Accordingly, utilities of GAM1338 include diagnosis, prevention and treatment of diseases and clinical conditions associated with LOC348314.

LOC348326 (Accession XP_300696.1) is another GAM1338 target gene, herein designated TARGET GENE. LOC348326 BINDING SITE is a target binding site found in the 3' untranslated region of mRNA encoded by LOC348326, corresponding to a target binding site such as BINDING SITE I, BINDING SITE II or BINDING SITE III of FIG. 8. Table 4 illustrates the complementarity of the nucleotide sequences of LOC348326 BINDING SITE, designated SEQ ID:1995, to the nucleotide sequence of GAM1338 RNA, herein designated GAM RNA, also designated SEQ ID:360.

Another function of GAM1338 is therefore inhibition of LOC348326 (Accession XP_300696.1). Accordingly, utilities of GAM1338 include diagnosis, prevention and treatment of diseases and clinical conditions associated with LOC348326.

LOC348393 (Accession XP_302741.1) is another GAM1338 target gene, herein designated TARGET GENE. LOC348393 BINDING SITE1 and LOC348393 BINDING SITE2 are target binding sites found in untranslated regions of mRNA encoded by LOC348393, corresponding to target binding sites such as BINDING SITE I, BINDING SITE II or BINDING SITE III of FIG. 8. Table 4 illustrates the complementarity of the nucleotide sequences of LOC348393 BINDING SITE1 and LOC348393 BINDING SITE2, designated SEQ ID:16960 and SEQ ID:20185 respectively, to the nucleotide sequence of GAM1338 RNA, herein designated GAM RNA, also designated SEQ ID:360.

Another function of GAM1338 is therefore inhibition of LOC348393 (Accession XP_302741.1). Accordingly, utilities of GAM1338 include diagnosis, prevention and treatment of diseases and clinical conditions associated with LOC348393.

LOC348396 (Accession XP_300729.1) is another GAM1338 target gene, herein designated TARGET GENE. LOC348396 BINDING SITE1 and LOC348396 BINDING SITE2 are target binding sites found in untranslated regions of mRNA encoded by LOC348396, corresponding to target binding sites such as BINDING SITE I, BINDING SITE II or BINDING SITE III of FIG. 8. Table 4 illustrates the complementarity of the nucleotide sequences of LOC348396 BINDING SITE1 and LOC348396 BINDING SITE2, designated SEQ ID:1615 and SEQ ID:10631 respectively, to the nucleotide sequence of GAM1338 RNA, herein designated GAM RNA, also designated SEQ ID:360.

Another function of GAM1338 is therefore inhibition of LOC348396 (Accession XP_300729.1). Accordingly, utilities of GAM1338 include diagnosis, prevention and treatment of diseases and clinical conditions associated with LOC348396.

LOC348402 (Accession XP_300730.1) is another GAM1338 target gene, herein designated TARGET GENE. LOC348402 BINDING SITE1 and LOC348402 BINDING SITE2 are target binding sites found in untranslated regions of mRNA encoded by LOC348402, corresponding to target binding sites such as BINDING SITE I, BINDING SITE II or BINDING SITE III of FIG. 8. Table 4 illustrates the complementarity of the nucleotide sequences of LOC348402 BINDING SITE1 and LOC348402 BINDING SITE2, designated SEQ ID:13601 and SEQ ID:19744 respectively, to the nucleotide sequence of GAM1338 RNA, herein designated GAM RNA, also designated SEQ ID:360.

Another function of GAM1338 is therefore inhibition of LOC348402 (Accession XP_300730.1). Accordingly, utilities of GAM1338 include diagnosis, prevention and treatment of diseases and clinical conditions associated with LOC348402.

LOC348445 (Accession XP_300738.1) is another GAM1338 target gene, herein designated TARGET GENE. LOC348445 BINDING SITE is a target binding site found in the 3' untranslated region of mRNA encoded by LOC348445, corresponding to a target binding site such as BINDING SITE I, BINDING SITE II or BINDING SITE III of FIG. 8. Table 4 illustrates the complementarity of the nucleotide sequences of LOC348445 BINDING SITE, designated SEQ ID:1995, to the nucleotide sequence of GAM1338 RNA, herein designated GAM RNA, also designated SEQ ID:360.

Another function of GAM1338 is therefore inhibition of LOC348445 (Accession XP_300738.1). Accordingly, utilities of GAM1338 include diagnosis, prevention and treatment of diseases and clinical conditions associated with LOC348445.

LOC348455 (Accession XP_302760.1) is another GAM1338 target gene, herein designated TARGET GENE. LOC348455 BINDING SITE is a target binding site found in the 3' untranslated region of mRNA encoded by LOC348455, corresponding to a target binding site such as BINDING SITE I, BINDING SITE II or BINDING SITE III of FIG. 8. Table 4 illustrates the complementarity of the nucleotide sequences of LOC348455 BINDING SITE, designated SEQ ID:9100, to the nucleotide sequence of GAM1338 RNA, herein designated GAM RNA, also designated SEQ ID:360.

Another function of GAM1338 is therefore inhibition of LOC348455 (Accession XP_302760.1). Accordingly, utilities of GAM1338 include diagnosis, prevention and treatment of diseases and clinical conditions associated with LOC348455.

LOC348460 (Accession XP_300743.1) is another GAM1338 target gene, herein designated TARGET GENE. LOC348460 BINDING SITE is a target binding site found in the 3' untranslated region of mRNA encoded by LOC348460, corresponding to a target binding site such as BINDING SITE I, BINDING SITE II or BINDING SITE III of FIG. 8. Table 4 illustrates the complementarity of the nucleotide sequences of LOC348460 BINDING SITE, designated SEQ ID:8756, to the nucleotide sequence of GAM1338 RNA, herein designated GAM RNA, also designated SEQ ID:360.

Another function of GAM1338 is therefore inhibition of LOC348460 (Accession XP_300743.1). Accordingly, utilities of GAM1338 include diagnosis, prevention and treatment of diseases and clinical conditions associated with LOC348460.

LOC348474 (Accession XP_209299.2) is another GAM1338 target gene, herein designated TARGET GENE. LOC348474 BINDING SITE is a target binding site found in the 3' untranslated region of mRNA encoded by LOC348474, corresponding to a target binding site such as BINDING SITE I, BINDING SITE II or BINDING SITE III of FIG. 8. Table 4 illustrates the complementarity of the nucleotide sequences of LOC348474 BINDING SITE, designated SEQ ID:6597, to the nucleotide sequence of GAM1338 RNA, herein designated GAM RNA, also designated SEQ ID:360.

Another function of GAM1338 is therefore inhibition of LOC348474 (Accession XP_209299.2). Accordingly, utilities of GAM1338 include diagnosis, prevention and treatment of diseases and clinical conditions associated with LOC348474.

LOC348503 (Accession XP_300762.1) is another GAM1338 target gene, herein designated TARGET GENE. LOC348503 BINDING SITE is a target binding site found in the 3' untranslated region of mRNA encoded by LOC348503, corresponding to a target binding site such as BINDING SITE I, BINDING SITE II or BINDING SITE III of FIG. 8. Table 4 illustrates the complementarity of the nucleotide sequences of LOC348503 BINDING SITE, designated SEQ ID:12080, to the nucleotide sequence of GAM1338 RNA, herein designated GAM RNA, also designated SEQ ID:360.

Another function of GAM1338 is therefore inhibition of LOC348503 (Accession XP_300762.1). Accordingly, utilities of GAM1338 include diagnosis, prevention and treatment of diseases and clinical conditions associated with LOC348503.

LOC348508 (Accession XP_302806.1) is another GAM1338 target gene, herein designated TARGET GENE. LOC348508 BINDING SITE is a target binding site found in the 5' untranslated region of mRNA encoded by LOC348508, corresponding to a target binding site such as BINDING SITE I, BINDING SITE II or BINDING SITE III of FIG. 8. Table 4 illustrates the complementarity of the nucleotide sequences of LOC348508 BINDING SITE, designated SEQ ID:902, to the nucleotide sequence of GAM1338 RNA, herein designated GAM RNA, also designated SEQ ID:360.

Another function of GAM1338 is therefore inhibition of LOC348508 (Accession XP_302806.1). Accordingly, utilities of GAM1338 include diagnosis, prevention and treatment of diseases and clinical conditions associated with LOC348508.

LOC348525 (Accession XP_300778.1) is another GAM1338 target gene, herein designated TARGET GENE. LOC348525 BINDING SITE is a target binding site found in the 3' untranslated region of mRNA encoded by LOC348525, corresponding to a target binding site such as BINDING SITE I, BINDING SITE II or BINDING SITE III of FIG. 8. Table 4 illustrates the complementarity of the nucleotide sequences of LOC348525 BINDING SITE, designated SEQ ID:436, to the nucleotide sequence of GAM1338 RNA, herein designated GAM RNA, also designated SEQ ID:360.

Another function of GAM1338 is therefore inhibition of LOC348525 (Accession XP_300778.1). Accordingly, utilities of GAM1338 include diagnosis, prevention and treatment of diseases and clinical conditions associated with LOC348525.

LOC348532 (Accession XP_302818.1) is another GAM1338 target gene, herein designated TARGET GENE. LOC348532 BINDING SITE1 and LOC348532 BINDING SITE2 are target binding sites found in untranslated regions of mRNA encoded by LOC348532, corresponding to target binding sites such as BINDING SITE I, BINDING SITE II or BINDING SITE III of FIG. 8. Table 4 illustrates the complementarity of the nucleotide sequences of LOC348532 BINDING SITE1 and LOC348532 BINDING SITE2, designated SEQ ID:16960 and SEQ ID:20185 respectively, to the nucleotide sequence of GAM1338 RNA, herein designated GAM RNA, also designated SEQ ID:360.

Another function of GAM1338 is therefore inhibition of LOC348532 (Accession XP_302818.1). Accordingly, utilities of GAM1338 include diagnosis, prevention and treatment of diseases and clinical conditions associated with LOC348532.

LOC348702 (Accession XP_300808.1) is another GAM1338 target gene, herein designated TARGET GENE. LOC348702 BINDING SITE is a target binding site found in the 5' untranslated region of mRNA encoded by LOC348702, corresponding to a target binding site such as BINDING SITE I, BINDING SITE II or BINDING SITE III of FIG. 8. Table 4 illustrates the complementarity of the nucleotide sequences of LOC348702 BINDING SITE, designated SEQ ID:3103, to the nucleotide sequence of GAM1338 RNA, herein designated GAM RNA, also designated SEQ ID:360.

Another function of GAM1338 is therefore inhibition of LOC348702 (Accession XP_300808.1). Accordingly, utilities of GAM1338 include diagnosis, prevention and treatment of diseases and clinical conditions associated with LOC348702.

LOC348790 (Accession XP_300843.1) is another GAM1338 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:11124, to the nucleotide sequence of GAM1338 RNA, herein designated GAM RNA, also designated SEQ ID:360.

Another function of GAM1338 is therefore inhibition of LOC348790 (Accession XP_300843.1). Accordingly, utilities of GAM1338 include diagnosis, prevention and treatment of diseases and clinical conditions associated with LOC348790.

LOC348797 (Accession XP_302888.1) is another GAM1338 target gene, herein designated TARGET GENE. LOC348797 BINDING SITE is a target binding site found in the 3' untranslated region of mRNA encoded by LOC348797, corresponding to a target binding site such as BINDING SITE I, BINDING SITE II or BINDING SITE III of FIG. 8. Table 4 illustrates the complementarity of the nucleotide sequences of LOC348797 BINDING SITE, designated SEQ ID:4796, to the nucleotide sequence of GAM1338 RNA, herein designated GAM RNA, also designated SEQ ID:360.

Another function of GAM1338 is therefore inhibition of LOC348797 (Accession XP_302888.1). Accordingly, utilities of GAM1338 include diagnosis, prevention and treatment of diseases and clinical conditions associated with LOC348797.

LOC348798 (Accession XP_300845.1) is another GAM1338 target gene, herein designated TARGET GENE. LOC348798 BINDING SITE is a target binding site found in the 5' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:5915, to the nucleotide sequence of GAM1338 RNA, herein designated GAM RNA, also designated SEQ ID:360.

Another function of GAM1338 is therefore inhibition of LOC348798 (Accession XP_300845.1). Accordingly, utilities of GAM1338 include diagnosis, prevention and treatment of diseases and clinical conditions associated with LOC348798.

LOC348825 (Accession XP_300853.1) is another GAM1338 target gene, herein designated TARGET GENE. LOC348825 BINDING SITE1 and LOC348825 BINDING SITE2 are target binding sites found in untranslated regions of mRNA encoded by LOC348825, corresponding to target binding sites such as BINDING SITE I, BINDING SITE II or BINDING SITE III of FIG. 8. Table 4 illustrates the complementarity of the nucleotide sequences of LOC348825 BINDING SITE1 and LOC348825 BINDING SITE2, designated SEQ ID:2639 and SEQ ID:10307 respectively, to the nucleotide sequence of GAM1338 RNA, herein designated GAM RNA, also designated SEQ ID:360.

Another function of GAM1338 is therefore inhibition of LOC348825 (Accession XP_300853.1). Accordingly, utilities of GAM1338 include diagnosis, prevention and treatment of diseases and clinical conditions associated with LOC348825.

LOC348842 (Accession XP_300861.1) is another GAM1338 target gene, herein designated TARGET GENE. LOC348842 BINDING SITE is a target binding site found in the 5' untranslated region of mRNA encoded by LOC348842, corresponding to a target binding site such as BINDING SITE I, BINDING SITE II or BINDING SITE III of FIG. 8. Table 4 illustrates the complementarity of the nucleotide sequences of LOC348842 BINDING SITE, designated SEQ ID:902, to the nucleotide sequence of GAM1338 RNA, herein designated GAM RNA, also designated SEQ ID:360.

Another function of GAM1338 is therefore inhibition of LOC348842 (Accession XP_300861.1). Accordingly, utilities of GAM1338 include diagnosis, prevention and treatment of diseases and clinical conditions associated with LOC348842.

LOC348995 (Accession XP_300434.1) is another GAM1338 target gene, herein designated TARGET GENE. LOC348995 BINDING SITE is a target binding site found in the 3' untranslated region of mRNA encoded by LOC348995, corresponding to a target binding site such as BINDING SITE I, BINDING SITE II or BINDING SITE III of FIG. 8. Table 4 illustrates the complementarity of the nucleotide sequences of LOC348995 BINDING SITE, designated SEQ ID:9379, to the nucleotide sequence of GAM1338 RNA, herein designated GAM RNA, also designated SEQ ID:360.

Another function of GAM1338 is therefore inhibition of LOC348995 (Accession XP_300434.1). Accordingly, utilities of GAM1338 include diagnosis, prevention and treatment of diseases and clinical conditions associated with LOC348995.

LOC349024 (Accession XP_300250.1) is another GAM1338 target gene, herein designated TARGET GENE. LOC349024 BINDING SITE1 and LOC349024 BINDING SITE2 are target binding sites found in untranslated regions of mRNA encoded by LOC349024, corresponding to target binding sites such as BINDING SITE I, BINDING SITE II or BINDING SITE III of FIG. 8. Table 4 illustrates the complementarity of the nucleotide sequences of LOC349024 BINDING SITE1 and LOC349024 BINDING SITE2, designated SEQ ID:4753 and SEQ ID:11653 respectively, to the nucleotide sequence of GAM1338 RNA, herein designated GAM RNA, also designated SEQ ID:360.

Another function of GAM1338 is therefore inhibition of LOC349024 (Accession XP_300250.1). Accordingly, utilities of GAM1338 include diagnosis, prevention and treatment of diseases and clinical conditions associated with LOC349024.

LOC349075 (Accession XP_300932.1) is another GAM1338 target gene, herein designated TARGET GENE. LOC349075 BINDING SITE is a target binding site found in the 3' untranslated region of mRNA encoded by LOC349075, corresponding to a target binding site such as BINDING SITE I, BINDING SITE II or BINDING SITE III of FIG. 8. Table 4 illustrates the complementarity of the nucleotide sequences of LOC349075 BINDING SITE, designated SEQ ID:9465, to the nucleotide sequence of GAM1338 RNA, herein designated GAM RNA, also designated SEQ ID:360.

Another function of GAM1338 is therefore inhibition of LOC349075 (Accession XP_300932.1). Accordingly, utilities of GAM1338 include diagnosis, prevention and treatment of diseases and clinical conditions associated with LOC349075.

LOC349096 (Accession XP_300937.1) is another GAM1338 target gene, herein designated TARGET GENE. LOC349096 BINDING SITE is a target binding site found in the 3' untranslated region of mRNA encoded by LOC349096, corresponding to a target binding site such as BINDING SITE I, BINDING SITE II or BINDING SITE III of FIG. 8. Table 4 illustrates the complementarity of the nucleotide sequences of LOC349096 BINDING SITE, designated SEQ ID:14560, to the nucleotide sequence of GAM1338 RNA, herein designated GAM RNA, also designated SEQ ID:360.

Another function of GAM1338 is therefore inhibition of LOC349096 (Accession XP_300937.1). Accordingly, utilities of GAM1338 include diagnosis, prevention and treatment of diseases and clinical conditions associated with LOC349096.

LOC349114 (Accession XP_302960.1) is another GAM1338 target gene, herein designated TARGET GENE. LOC349114 BINDING SITE is a target binding site found in the 5' untranslated region of mRNA encoded by LOC349114, corresponding to a target binding site such as BINDING SITE I, BINDING SITE II or BINDING SITE III of FIG. 8. Table 4 illustrates the complementarity of the nucleotide sequences of LOC349114 BINDING SITE, designated SEQ ID:902, to the nucleotide sequence of GAM1338 RNA, herein designated GAM RNA, also designated SEQ ID:360.

Another function of GAM1338 is therefore inhibition of LOC349114 (Accession XP_302960.1). Accordingly, utilities of GAM1338 include diagnosis, prevention and treatment of diseases and clinical conditions associated with LOC349114.

LOC349170 (Accession XP_300969.1) is another GAM1338 target gene, herein designated TARGET GENE. LOC349170 BINDING SITE1 through LOC349170 BINDING SITE3 are target binding sites found in untranslated regions of mRNA encoded by LOC349170, corresponding to target binding sites such as BINDING SITE I, BINDING SITE II or BINDING SITE III of FIG. 8. Table 4 illustrates the complementarity of the nucleotide sequences of LOC349170 BINDING SITE1 through LOC349170 BINDING SITE3, designated SEQ ID:19429, SEQ ID:4197 and SEQ ID:13839 respectively, to the nucleotide sequence of GAM1338 RNA, herein designated GAM RNA, also designated SEQ ID:360.

Another function of GAM1338 is therefore inhibition of LOC349170 (Accession XP_300969.1). Accordingly, utilities of GAM1338 include diagnosis, prevention and treatment of diseases and clinical conditions associated with LOC349170.

LOC349360 (Accession XP_088528.1) is another GAM1338 target gene, herein designated TARGET GENE. LOC349360 BINDING SITE is a target binding site found in the 5' untranslated region of mRNA encoded by LOC349360, corresponding to a target binding site such as BINDING SITE I, BINDING SITE II or BINDING SITE III of FIG. 8. Table 4 illustrates the complementarity of the nucleotide sequences of LOC349360 BINDING SITE, designated SEQ ID:13307, to the nucleotide sequence of GAM1338 RNA, herein designated GAM RNA, also designated SEQ ID:360.

Another function of GAM1338 is therefore inhibition of LOC349360 (Accession XP_088528.1). Accordingly, utilities of GAM1338 include diagnosis, prevention and treatment of diseases and clinical conditions associated with LOC349360.

LOC349408 (Accession XP_303044.1) is another GAM1338 target gene, herein designated TARGET GENE. LOC349408 BINDING SITE is a target binding site found in the 5' untranslated region of mRNA encoded by LOC349408, corresponding to a target binding site such as BINDING SITE I, BINDING SITE II or BINDING SITE III of FIG. 8. Table 4 illustrates the complementarity of the nucleotide sequences of LOC349408 BINDING SITE, designated SEQ ID:12395, to the nucleotide sequence of GAM1338 RNA, herein designated GAM RNA, also designated SEQ ID:360.

Another function of GAM1338 is therefore inhibition of LOC349408 (Accession XP_303044.1). Accordingly, utilities of GAM1338 include diagnosis, prevention and treatment of diseases and clinical conditions associated with LOC349408.

LOC349440 (Accession XP_300513.1) is another GAM1338 target gene, herein designated TARGET GENE. LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:19505, to the nucleotide sequence of GAM1338 RNA, herein designated GAM RNA, also designated SEQ ID:360.

Another function of GAM1338 is therefore inhibition of LOC349440 (Accession XP_300513.1). Accordingly, utilities of GAM1338 include diagnosis, prevention and treatment of diseases and clinical conditions associated with LOC349440.

LOC349613 (Accession XP_303409.1) is another GAM1338 target gene, herein designated TARGET GENE. LOC349613 BINDING SITE is a target binding site found in the 5' untranslated region of mRNA encoded by LOC349613, corresponding to a target binding site such as BINDING SITE I, BINDING SITE II or BINDING SITE III of FIG. 8. Table 4 illustrates the complementarity of the nucleotide sequences of LOC349613 BINDING SITE, designated SEQ ID:17346, to the nucleotide sequence of GAM1338 RNA, herein designated GAM RNA, also designated SEQ ID:360.

Another function of GAM1338 is therefore inhibition of LOC349613 (Accession XP_303409.1). Accordingly, utilities of GAM1338 include diagnosis, prevention and treatment of diseases and clinical conditions associated with LOC349613.

LOC350106 (Accession XP_303810.1) is another GAM1338 target gene, herein designated TARGET GENE. LOC350106 BINDING SITE is a target binding site found in the 5' untranslated region of mRNA encoded by LOC350106, corresponding to a target binding site such as BINDING SITE I, BINDING SITE II or BINDING SITE III of FIG. 8. Table 4 illustrates the complementarity of the nucleotide sequences of LOC350106 BINDING SITE, designated SEQ ID:20158, to the nucleotide sequence of GAM1338 RNA, herein designated GAM RNA, also designated SEQ ID:360.

Another function of GAM1338 is therefore inhibition of LOC350106 (Accession XP_303810.1). Accordingly, utilities of GAM1338 include diagnosis, prevention and treatment of diseases and clinical conditions associated with LOC350106.

LOC51193 (Accession NP_057415.1) is another GAM1338 target gene, herein designated TARGET GENE. LOC51193 BINDING SITE1 and LOC51193 BINDING SITE2 are target binding sites found in untranslated regions of mRNA encoded by LOC51193, corresponding to target binding sites such as BINDING SITE I, BINDING SITE II or BINDING SITE III of FIG. 8. Table 4 illustrates the complementarity of the nucleotide sequences of LOC51193 BINDING SITE1 and LOC51193 BINDING SITE2, designated SEQ ID:6858 and SEQ ID:6812 respectively, to the nucleotide sequence of GAM1338 RNA, herein designated GAM RNA, also designated SEQ ID:360.

Another function of GAM1338 is therefore inhibition of LOC51193 (Accession NP_057415.1). Accordingly, utilities of GAM1338 include diagnosis, prevention and treatment of diseases and clinical conditions associated with LOC51193.

LOC51257 (Accession NP_057580.2) is another GAM1338 target gene, herein designated TARGET GENE. LOC51257 BINDING SITE is a target binding site found in the 5' untranslated region of mRNA encoded by LOC51257, corresponding to a target binding site such as BINDING SITE I, BINDING SITE II or BINDING SITE III of FIG. 8. Table 4 illustrates the complementarity of the nucleotide sequences of LOC51257 BINDING SITE, designated SEQ ID:18183, to the nucleotide sequence of GAM1338 RNA, herein designated GAM RNA, also designated SEQ ID:360.

Another function of GAM1338 is therefore inhibition of LOC51257 (Accession NP_057580.2). Accordingly, utilities of GAM1338 include diagnosis, prevention and treatment of diseases and clinical conditions associated with LOC51257.

LOC51334 (Accession NP_057728.1) is another GAM1338 target gene, herein designated TARGET GENE. LOC51334 BINDING SITE is a target binding site found in the 5' untranslated region of mRNA encoded by LOC51334, corresponding to a target binding site such as BINDING SITE I, BINDING SITE II or BINDING SITE III of FIG. 8. Table 4 illustrates the complementarity of the nucleotide sequences of LOC51334 BINDING SITE, designated SEQ ID:7944, to the nucleotide sequence of GAM1338 RNA, herein designated GAM RNA, also designated SEQ ID:360.

Another function of GAM1338 is therefore inhibition of LOC51334 (Accession NP_057728.1). Accordingly, utilities of GAM1338 include diagnosis, prevention and treatment of diseases and clinical conditions associated with LOC51334.

LOC51336 (Accession NP_057730.1) is another GAM1338 target gene, herein designated TARGET GENE. LOC51336 BINDING SITE is a target binding site found in the 3' untranslated region of mRNA encoded by LOC51336, corresponding to a target binding site such as BINDING SITE I, BINDING SITE II or BINDING SITE III of FIG. 8. Table 4 illustrates the complementarity of the nucleotide sequences of LOC51336 BINDING SITE, designated SEQ ID:18609, to the nucleotide sequence of GAM1338 RNA, herein designated GAM RNA, also designated SEQ ID:360.

Another function of GAM1338 is therefore inhibition of LOC51336 (Accession NP_057730.1). Accordingly, utilities of GAM1338 include diagnosis, prevention and treatment of diseases and clinical conditions associated with LOC51336.

LOC55954 (Accession NP_061976.1) is another GAM1338 target gene, herein designated TARGET GENE. LOC55954 BINDING SITE is a target binding site found in the 5' untranslated region of mRNA encoded by LOC55954, corresponding to a target binding site such as BINDING SITE I, BINDING SITE II or BINDING SITE III of FIG. 8. Table 4 illustrates the complementarity of the nucleotide sequences of LOC55954 BINDING SITE, designated SEQ ID:17853, to the nucleotide sequence of GAM1338 RNA, herein designated GAM RNA, also designated SEQ ID:360.

Another function of GAM1338 is therefore inhibition of LOC55954 (Accession NP_061976.1). Accordingly, utilities of GAM1338 include diagnosis, prevention and treatment of diseases and clinical conditions associated with LOC55954.

LOC56902 (Accession NP_064528.1) is another GAM1338 target gene, herein designated TARGET GENE. LOC56902 BINDING SITE is a target binding site found in the 3' untranslated region of mRNA encoded by LOC56902, corresponding to a target binding site such as BINDING SITE I, BINDING SITE II or BINDING SITE III of FIG. 8. Table 4 illustrates the complementarity of the nucleotide sequences of LOC56902 BINDING SITE, designated SEQ ID:8077, to the nucleotide sequence of GAM1338 RNA, herein designated GAM RNA, also designated SEQ ID:360.

Another function of GAM1338 is therefore inhibition of LOC56902 (Accession NP_064528.1). Accordingly, utilities of GAM1338 include diagnosis, prevention and treatment of diseases and clinical conditions associated with LOC56902.

LOC57107 (Accession NP_065114.2) is another GAM1338 target gene, herein designated TARGET GENE. LOC57107 BINDING SITE1 and LOC57107 BINDING SITE2 are target binding sites found in untranslated regions of mRNA encoded by LOC57107, corresponding to target binding sites such as BINDING SITE I, BINDING SITE II or BINDING SITE III of FIG. 8. Table 4 illustrates the complementarity of the nucleotide sequences of LOC57107 BINDING SITE1 and LOC57107 BINDING SITE2, designated SEQ ID:19749 and SEQ ID:12670 respectively, to the nucleotide sequence of GAM1338 RNA, herein designated GAM RNA, also designated SEQ ID:360.

Another function of GAM1338 is therefore inhibition of LOC57107 (Accession NP_065114.2). Accordingly, utilities of GAM1338 include diagnosis, prevention and treatment of diseases and clinical conditions associated with LOC57107.

LOC57146 (Accession NP_065155.2) is another GAM1338 target gene, herein designated TARGET GENE. LOC57146 BINDING SITE is a target binding site found in the 3' untranslated region of mRNA encoded by LOC57146, corresponding to a target binding site such as BINDING SITE I, BINDING SITE II or BINDING SITE III of FIG. 8. Table 4 illustrates the complementarity of the nucleotide sequences of LOC57146 BINDING SITE, designated SEQ ID:17648, to the nucleotide sequence of GAM1338 RNA, herein designated GAM RNA, also designated SEQ ID:360.

Another function of GAM1338 is therefore inhibition of LOC57146 (Accession NP_065155.2). Accordingly, utilities of GAM1338 include diagnosis, prevention and treatment of diseases and clinical conditions associated with LOC57146.

LOC90408 (Accession XP_031517.1) is another GAM1338 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:2729, to the nucleotide sequence of GAM1338 RNA, herein designated GAM RNA, also designated SEQ ID:360.

Another function of GAM1338 is therefore inhibition of LOC90408 (Accession XP_031517.1). Accordingly, utilities of GAM1338 include diagnosis, prevention and treatment of diseases and clinical conditions associated with LOC90408.

LOC90485 (Accession XP_032059.1) is another GAM1338 target gene, herein designated TARGET GENE. LOC90485 BINDING SITE1 and LOC90485 BINDING SITE2 are target binding sites found in untranslated regions of mRNA encoded by LOC90485, corresponding to target binding sites such as BINDING SITE I, BINDING SITE II or BINDING SITE III of FIG. 8. Table 4 illustrates the complementarity of the nucleotide sequences of LOC90485 BINDING SITE1 and LOC90485 BINDING SITE2, designated SEQ ID:15525 and SEQ ID:10103 respectively, to the nucleotide sequence of GAM1338 RNA, herein designated GAM RNA, also designated SEQ ID:360.

Another function of GAM1338 is therefore inhibition of LOC90485 (Accession XP_032059.1). Accordingly, utilities of GAM1338 include diagnosis, prevention and treatment of diseases and clinical conditions associated with LOC90485.

LOC90999 (Accession XP_035410.1) is another GAM1338 target gene, herein designated TARGET GENE. LOC90999 BINDING SITE is a target binding site found in the 3' untranslated region of mRNA encoded by LOC90999, corresponding to a target binding site such as BINDING SITE I, BINDING SITE II or BINDING SITE III of FIG. 8. Table 4 illustrates the complementarity of the nucleotide sequences of LOC90999 BINDING SITE, designated SEQ ID:11655, to the nucleotide sequence of GAM1338 RNA, herein designated GAM RNA, also designated SEQ ID:360.

Another function of GAM1338 is therefore inhibition of LOC90999 (Accession XP_035410.1). Accordingly, utilities of GAM1338 include diagnosis, prevention and treatment of diseases and clinical conditions associated with LOC90999.

LOC91115 (Accession XP_036218.1) is another GAM1338 target gene, herein designated TARGET GENE. LOC91115 BINDING SITE1 and LOC91115 BINDING SITE2 are target binding sites found in untranslated regions of mRNA encoded by LOC91115, corresponding to target binding sites such as BINDING SITE I, BINDING SITE II or BINDING SITE III of FIG. 8. Table 4 illustrates the complementarity of the nucleotide sequences of LOC91115 BINDING SITE1 and LOC91115 BINDING SITE2, designated SEQ ID:17070 and SEQ ID:18042 respectively, to the nucleotide sequence of GAM1338 RNA, herein designated GAM RNA, also designated SEQ ID:360.

Another function of GAM1338 is therefore inhibition of LOC91115 (Accession XP_036218.1). Accordingly, utilities of GAM1338 include diagnosis, prevention and treatment of diseases and clinical conditions associated with LOC91115.

LOC91170 (Accession XP_036612.1) is another GAM1338 target gene, herein designated TARGET GENE. LOC91170 BINDING SITE is a target binding site found in the 5' untranslated region of mRNA encoded by LOC91170, corresponding to a target binding site such as BINDING SITE I, BINDING SITE II or BINDING SITE III of FIG. 8. Table 4 illustrates the complementarity of the nucleotide sequences of LOC91170 BINDING SITE, designated SEQ ID:3969, to the nucleotide sequence of GAM1338 RNA, herein designated GAM RNA, also designated SEQ ID:360.

Another function of GAM1338 is therefore inhibition of LOC91170 (Accession XP_036612.1). Accordingly, utilities of GAM1338 include diagnosis, prevention and treatment of diseases and clinical conditions associated with LOC91170.

LOC91266 (Accession XP_037268.1) is another GAM1338 target gene, herein designated TARGET GENE. LOC91266 BINDING SITE is a target binding site found in the 5' untranslated region of mRNA encoded by LOC91266, corresponding to a target binding site such as BINDING SITE I, BINDING SITE II or BINDING SITE III of FIG. 8. Table 4 illustrates the complementarity of the nucleotide sequences of LOC91266 BINDING SITE, designated SEQ ID:9160, to the nucleotide sequence of GAM1338 RNA, herein designated GAM RNA, also designated SEQ ID:360.

Another function of GAM1338 is therefore inhibition of LOC91266 (Accession XP_037268.1). Accordingly, utilities of GAM1338 include diagnosis, prevention and treatment of diseases and clinical conditions associated with LOC91266.

LOC91373 (Accession XP_038063.5) is another GAM1338 target gene, herein designated TARGET GENE. LOC91373 BINDING SITE is a target binding site found in the 3' untranslated region of mRNA encoded by LOC91373, corresponding to a target binding site such as BINDING SITE I, BINDING SITE II or BINDING SITE III of FIG. 8. Table 4 illustrates the complementarity of the nucleotide sequences of LOC91373 BINDING SITE, designated SEQ ID:5516, to the nucleotide sequence of GAM1338 RNA, herein designated GAM RNA, also designated SEQ ID:360.

Another function of GAM1338 is therefore inhibition of LOC91373 (Accession XP_038063.5). Accordingly, utilities of GAM1338 include diagnosis, prevention and treatment of diseases and clinical conditions associated with LOC91373.

LOC91663 (Accession NP_612382.1) is another GAM1338 target gene, herein designated TARGET GENE. LOC91663 BINDING SITE is a target binding site found in the 3' untranslated region of mRNA encoded by LOC91663, corresponding to a target binding site such as BINDING SITE I, BINDING SITE II or BINDING SITE III of FIG. 8. Table 4 illustrates the complementarity of the nucleotide sequences of LOC91663 BINDING SITE, designated SEQ ID:13779, to the nucleotide sequence of GAM1338 RNA, herein designated GAM RNA, also designated SEQ ID:360.

Another function of GAM1338 is therefore inhibition of LOC91663 (Accession NP_612382.1). Accordingly, utilities of GAM1338 include diagnosis, prevention and treatment of diseases and clinical conditions associated with LOC91663.

LOC91893 (Accession XP_041340.1) is another GAM1338 target gene, herein designated TARGET GENE. LOC91893 BINDING SITE is a target binding site found in the 3' untranslated region of mRNA encoded by LOC91893, corresponding to a target binding site such as BINDING SITE I, BINDING SITE II or BINDING SITE III of FIG. 8. Table 4 illustrates the complementarity of the nucleotide sequences of LOC91893 BINDING SITE, designated SEQ ID:9129, to the nucleotide sequence of GAM1338 RNA, herein designated GAM RNA, also designated SEQ ID:360.

Another function of GAM1338 is therefore inhibition of LOC91893 (Accession XP_041340.1). Accordingly, utilities of GAM1338 include diagnosis, prevention and treatment of diseases and clinical conditions associated with LOC91893.

LOC92148 (Accession XP_043160.1) is another GAM1338 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:16536, to the nucleotide sequence of GAM1338 RNA, herein designated GAM RNA, also designated SEQ ID:360.

Another function of GAM1338 is therefore inhibition of LOC92148 (Accession XP_043160.1). Accordingly, utilities of GAM1338 include diagnosis, prevention and treatment of diseases and clinical conditions associated with LOC92148.

LOC92597 (Accession NP_775739.1) is another GAM1338 target gene, herein designated TARGET GENE. LOC92597 BINDING SITE is a target binding site found in the 3' untranslated region of mRNA encoded by LOC92597, corresponding to a target binding site such as BINDING SITE I, BINDING SITE II or BINDING SITE III of FIG. 8. Table 4 illustrates the complementarity of the nucleotide sequences of LOC92597 BINDING SITE, designated SEQ ID:19028, to the nucleotide sequence of GAM1338 RNA, herein designated GAM RNA, also designated SEQ ID:360.

Another function of GAM1338 is therefore inhibition of LOC92597 (Accession NP_775739.1). Accordingly, utilities of GAM1338 include diagnosis, prevention and treatment of diseases and clinical conditions associated with LOC92597.

LOC93132 (Accession XP_049396.1) is another GAM1338 target gene, herein designated TARGET GENE. LOC93132 BINDING SITE is a target binding site found in the 5' untranslated region of mRNA encoded by LOC93132, corresponding to a target binding site such as BINDING SITE I, BINDING SITE II or BINDING SITE III of FIG. 8. Table 4 illustrates the complementarity of the nucleotide sequences of LOC93132 BINDING SITE, designated SEQ ID:14290, to the nucleotide sequence of GAM1338 RNA, herein designated GAM RNA, also designated SEQ ID:360.

Another function of GAM1338 is therefore inhibition of LOC93132 (Accession XP_049396.1). Accordingly, utilities of GAM1338 include diagnosis, prevention and treatment of diseases and clinical conditions associated with LOC93132.

Leukotriene b4 receptor (LTB4R, Accession NP_000743.1) is another GAM1338 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:19595, to the nucleotide sequence of GAM1338 RNA, herein designated GAM RNA, also designated SEQ ID:360.

Another function of GAM1338 is therefore inhibition of Leukotriene b4 receptor (LTB4R, Accession NP_000743.1), a gene which may be the cardiac p2y receptor involved in the regulation of cardiac muscle contraction through modulation of l-type calcium currents. Accordingly, utilities of GAM1338 include diagnosis, prevention and treatment of diseases and clinical conditions associated with LTB4R.

The function of LTB4R and its association with various diseases and clinical conditions, has been established by previous studies, as described hereinabove with reference to GAM30.1. Lymphocyte antigen 75 (LY75, Accession NP_002340.1) is another GAM1338 target gene, herein designated TARGET GENE. LY75 BINDING SITE is a target binding site found in the 3' untranslated region of mRNA encoded by LY75, corresponding to a target binding site such as BINDING SITE I, BINDING SITE II or BINDING SITE III of FIG. 8. Table 4 illustrates the complementarity of the nucleotide sequences of LY75 BINDING SITE, designated SEQ ID:4451, to the nucleotide sequence of GAM1338 RNA, herein designated GAM RNA, also designated SEQ ID:360.

Another function of GAM1338 is therefore inhibition of Lymphocyte antigen 75 (LY75, Accession NP_002340.1). Accordingly, utilities of GAM1338 include diagnosis, prevention and treatment of diseases and clinical conditions associated with LY75.

Lysozyme (renal amyloidosis) (Ly, Accession NP_000230.1) is another GAM1338 target gene, herein designated TARGET GENE. LYZ BINDING SITE is a target binding site found in the 3' untranslated region of mRNA encoded by Ly, corresponding to a target binding site such as BINDING SITE I, BINDING SITE II or BINDING SITE III of FIG. 8. Table 4 illustrates the complementarity of the nucleotide sequences of LYZ BINDING SITE, designated SEQ ID:3109, to the nucleotide sequence of GAM1338 RNA, herein designated GAM RNA, also designated SEQ ID:360.

Another function of GAM1338 is therefore inhibition of Lysozyme (renal amyloidosis) (Ly, Accession NP_000230.1), a gene which a bacteriolytic enzyme. and therefore may be associated with Renal amyloidosis. Accordingly, utilities of GAM1338 include diagnosis, prevention and treatment of Renal amyloidosis, and of other diseases and clinical conditions associated with LYZ.

The function of LYZ and its association with various diseases and clinical conditions, has been established by previous studies, as described hereinabove with reference to GAM189.1. Leucine zipper, putative tumor suppressor 1 (LZTS1, Accession NP_066300.1) is another GAM1338 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:13405, to the nucleotide sequence of GAM1338 RNA, herein designated GAM RNA, also designated SEQ ID:360.

Another function of GAM1338 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM1338 include diagnosis, prevention and treatment of diseases and clinical conditions associated with LZTS1.

The function of LZTS1 and its association with various diseases and clinical conditions, has been established by previous studies, as described hereinabove with reference to GAM130.1. MAC30 (Accession XP_031536.2) is another GAM1338 target gene, herein designated TARGET GENE. MAC30 BINDING SITE is a target binding site found in the 3' untranslated region of mRNA encoded by MAC30, corresponding to a target binding site such as BINDING SITE I, BINDING SITE II or BINDING SITE III of FIG. 8. Table 4 illustrates the complementarity of the nucleotide sequences of MAC30 BINDING SITE, designated SEQ ID:13959, to the nucleotide sequence of GAM1338 RNA, herein designated GAM RNA, also designated SEQ ID:360.

Another function of GAM1338 is therefore inhibition of MAC30 (Accession XP_031536.2). Accordingly, utilities of GAM1338 include diagnosis, prevention and treatment of diseases and clinical conditions associated with MAC30.

Male germ cell-associated kinase (MAK, Accession NP_005897.1) is another GAM1338 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:11208, to the nucleotide sequence of GAM1338 RNA, herein designated GAM RNA, also designated SEQ ID:360.

Another function of GAM1338 is therefore inhibition of Male germ cell-associated kinase (MAK, Accession NP_005897.1), a gene which plays an important role in spermatogenesis. Accordingly, utilities of GAM1338 include diagnosis, prevention and treatment of diseases and clinical conditions associated with MAK.

The function of MAK and its association with various diseases and clinical conditions, has been established by previous studies, as described hereinabove with reference to GAM30.1. Mastermind-like 1 (drosophila) (MAML1, Accession NP_055572.1) is another GAM1338 target gene, herein designated TARGET GENE. MAML1 BINDING SITE is a target binding site found in the 3' untranslated region of mRNA encoded by MAML1, corresponding to a target binding site such as BINDING SITE I, BINDING SITE II or BINDING SITE III of FIG. 8. Table 4 illustrates the complementarity of the nucleotide sequences of MAML1 BINDING SITE, designated SEQ ID:5648, to the nucleotide sequence of GAM1338 RNA, herein designated GAM RNA, also designated SEQ ID:360.

Another function of GAM1338 is therefore inhibition of Mastermind-like 1 (drosophila) (MAML1, Accession NP_055572.1), a gene which MAML1 functions as a transcriptional coactivator for Notch signaling. Accordingly, utilities of GAM1338 include diagnosis, prevention and treatment of diseases and clinical conditions associated with MAML1.

The function of MAML1 and its association with various diseases and clinical conditions, has been established by previous studies, as described hereinabove with reference to GAM65.1. Microtubule-associated protein, rp/eb family, member 1 (MAPRE1, Accession NP_036457.1) is another GAM1338 target gene, herein designated TARGET GENE. MAPRE1 BINDING SITE is a target binding site found in the 3' untranslated region of mRNA encoded by MAPRE1, corresponding to a target binding site such as BINDING SITE I, BINDING SITE II or BINDING SITE III of FIG. 8. Table 4 illustrates the complementarity of the nucleotide sequences of MAPRE1 BINDING SITE, designated SEQ ID:6409, to the nucleotide sequence of GAM1338 RNA, herein designated GAM RNA, also designated SEQ ID:360.

Another function of GAM1338 is therefore inhibition of Microtubule-associated protein, rp/eb family, member 1 (MAPRE1, Accession NP_036457.1). Accordingly, utilities of GAM1338 include diagnosis, prevention and treatment of diseases and clinical conditions associated with MAPRE1.

MCLC (Accession NP_055942.1) is another GAM1338 target gene, herein designated TARGET GENE. MCLC BINDING SITE is a target binding site found in the 3' untranslated region of mRNA encoded by MCLC, corresponding to a target binding site such as BINDING SITE I, BINDING SITE II or BINDING SITE III of FIG. 8. Table 4 illustrates the complementarity of the nucleotide sequences of MCLC BINDING SITE, designated SEQ ID:4526, to the nucleotide sequence of GAM1338 RNA, herein designated GAM RNA, also designated SEQ ID:360.

Another function of GAM1338 is therefore inhibition of MCLC (Accession NP_055942.1). Accordingly, utilities of GAM1338 include diagnosis, prevention and treatment of diseases and clinical conditions associated with MCLC.

Mcm10 minichromosome maintenance deficient 10 (s. cerevisiae) (MCM10, Accession NP_060988.2) is another GAM1338 target gene, herein designated TARGET GENE. MCM10 BINDING SITE is a target binding site found in the 3' untranslated region of mRNA encoded by MCM10, corresponding to a target binding site such as BINDING SITE I, BINDING SITE II or BINDING SITE III of FIG. 8. Table 4 illustrates the complementarity of the nucleotide sequences of MCM10 BINDING SITE, designated SEQ ID:4821, to the nucleotide sequence of GAM1338 RNA, herein designated GAM RNA, also designated SEQ ID:360.

Another function of GAM1338 is therefore inhibition of Mcm10 minichromosome maintenance deficient 10 (s. cerevisiae) (MCM10, Accession NP_060988.2). Accordingly, utilities of GAM1338 include diagnosis, prevention and treatment of diseases and clinical conditions associated with MCM10.

Mdm2, transformed 3t3 cell double minute 2, p53 binding protein (mouse) (MDM2, Accession NP_002383.1) is another GAM1338 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM1338 RNA, herein designated GAM RNA, also designated SEQ ID:360.

Another function of GAM1338 is therefore inhibition of Mdm2, transformed 3t3 cell double minute 2, p53 binding protein (mouse) (MDM2, Accession NP_002383.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM1338 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006872.1) is another GAM1338 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM1338 RNA, herein designated GAM RNA, also designated SEQ ID:360.

Another function of GAM1338 is therefore inhibition of Mdm2, transformed 3t3 cell double minute 2, p53 binding protein (mouse) (MDM2, Accession NP_006872.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM1338 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006869.1) is another GAM1338 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM1338 RNA, herein designated GAM RNA, also designated SEQ ID:360.

Another function of GAM1338 is therefore inhibition of Mdm2, transformed 3t3 cell double minute 2, p53 binding protein (mouse) (MDM2, Accession NP_006869.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM1338 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006871.1) is another GAM1338 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM1338 RNA, herein designated GAM RNA, also designated SEQ ID:360.

Another function of GAM1338 is therefore inhibition of Mdm2, transformed 3t3 cell double minute 2, p53 binding protein (mouse) (MDM2, Accession NP_006871.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM1338 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006873.1) is another GAM1338 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM1338 RNA, herein designated GAM RNA, also designated SEQ ID:360.

Another function of GAM1338 is therefore inhibition of Mdm2, transformed 3t3 cell double minute 2, p53 binding protein (mouse) (MDM2, Accession NP_006873.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM1338 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006870.1) is another GAM1338 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM1338 RNA, herein designated GAM RNA, also designated SEQ ID:360.

Another function of GAM1338 is therefore inhibition of Mdm2, transformed 3t3 cell double minute 2, p53 binding protein (mouse) (MDM2, Accession NP_006870.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM1338 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm4, transformed 3t3 cell double minute 4, p53 binding protein (mouse) (MDM4, Accession NP_002384.1) is another GAM1338 target gene, herein designated TARGET GENE. MDM4 BINDING SITE is a target binding site found in the 3' untranslated region of mRNA encoded by MDM4, corresponding to a target binding site such as BINDING SITE I, BINDING SITE II or BINDING SITE III of FIG. 8. Table 4 illustrates the complementarity of the nucleotide sequences of MDM4 BINDING SITE, designated SEQ ID:19527, to the nucleotide sequence of GAM1338 RNA, herein designated GAM RNA, also designated SEQ ID:360.

Another function of GAM1338 is therefore inhibition of Mdm4, transformed 3t3 cell double minute 4, p53 binding protein (mouse) (MDM4, Accession NP_002384.1), a gene which Strongly similar to murine Mdm4; may interact with p53. Accordingly, utilities of GAM1338 include diagnosis, prevention and treatment of diseases and clinical conditions associated with MDM4.

The function of MDM4 and its association with various diseases and clinical conditions, has been established by previous studies, as described hereinabove with reference to GAM189.1. Mediterranean fever (MEFV, Accession NP_000234.1) is another GAM1338 target gene, herein designated TARGET GENE. MEFV BINDING SITE1 and MEFV BINDING SITE2 are target binding sites found in untranslated regions of mRNA encoded by MEFV, corresponding to target binding sites such as BINDING SITE I, BINDING SITE II or BINDING SITE III of FIG. 8. Table 4 illustrates the complementarity of the nucleotide sequences of MEFV BINDING SITE1 and MEFV BINDING SITE2, designated SEQ ID:12284 and SEQ ID:17376 respectively, to the nucleotide sequence of GAM1338 RNA, herein designated GAM RNA, also designated SEQ ID:360.

Another function of GAM1338 is therefore inhibition of Mediterranean fever (MEFV, Accession NP_000234.1). Accordingly, utilities of GAM1338 include diagnosis, prevention and treatment of diseases and clinical conditions associated with MEFV.

Mesoderm development candidate 2 (MESDC2, Accession XP_051854.1) is another GAM1338 target gene, herein designated TARGET GENE. MESDC2 BINDING SITE is a target binding site found in the 3' untranslated region of mRNA encoded by MESDC2, corresponding to a target binding site such as BINDING SITE I, BINDING SITE II or BINDING SITE III of FIG. 8. Table 4 illustrates the complementarity of the nucleotide sequences of MESDC2 BINDING SITE, designated SEQ ID:17209, to the nucleotide sequence of GAM1338 RNA, herein designated GAM RNA, also designated SEQ ID:360.

Another function of GAM1338 is therefore inhibition of Mesoderm development candidate 2 (MESDC2, Accession XP_051854.1). Accordingly, utilities of GAM1338 include diagnosis, prevention and treatment of diseases and clinical conditions associated with MESDC2.

MFTC (Accession NP_110407.2) is another GAM1338 target gene, herein designated TARGET GENE. MFTC BINDING SITE is a target binding site found in the 3' untranslated region of mRNA encoded by MFTC, corresponding to a target binding site such as BINDING SITE I, BINDING SITE II or BINDING SITE III of FIG. 8. Table 4 illustrates the complementarity of the nucleotide sequences of MFTC BINDING SITE, designated SEQ ID:10459, to the nucleotide sequence of GAM1338 RNA, herein designated GAM RNA, also designated SEQ ID:360.

Another function of GAM1338 is therefore inhibition of MFTC (Accession NP__110407.2). Accordingly, utilities of GAM1338 include diagnosis, prevention and treatment of diseases and clinical conditions associated with MFTC.

Mannosyl (alpha-1,6-)-glycoprotein beta-1,2-n-acetylglucosaminyltransferase (MGAT2, Accession NP__079374.1) is another GAM1338 target gene, herein designated TARGET GENE. MGAT2 BINDING SITE is a target binding site found in the 3' untranslated region of multiple transcripts of mRNA encoded by MGAT2, corresponding to a target binding site such as BINDING SITE I, BINDING SITE II or BINDING SITE III of FIG. 8. Table 4 illustrates the complementarity of the nucleotide sequences of MGAT2 BINDING SITE, designated SEQ ID:18270, to the nucleotide sequence of GAM1338 RNA, herein designated GAM RNA, also designated SEQ ID:360.

Another function of GAM1338 is therefore inhibition of Mannosyl (alpha-1,6-)-glycoprotein beta-1,2-n-acetylglucosaminyltransferase (MGAT2, Accession NP__079374.1). Accordingly, utilities of GAM1338 include diagnosis, prevention and treatment of diseases and clinical conditions associated with MGAT2.

MGC10200 (Accession NP__659497.1) is another GAM1338 target gene, herein designated TARGET GENE. MGC10200 BINDING SITE is a target binding site found in the 3' untranslated region of mRNA encoded by MGC10200, corresponding to a target binding site such as BINDING SITE I, BINDING SITE II or BINDING SITE III of FIG. 8. Table 4 illustrates the complementarity of the nucleotide sequences of MGC10200 BINDING SITE, designated SEQ ID:13048, to the nucleotide sequence of GAM1338 RNA, herein designated GAM RNA, also designated SEQ ID:360.

Another function of GAM1338 is therefore inhibition of MGC10200 (Accession NP__659497.1). Accordingly, utilities of GAM1338 include diagnosis, prevention and treatment of diseases and clinical conditions associated with MGC10200.

MGC11102 (Accession NP__115701.2) is another GAM1338 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:14977, to the nucleotide sequence of GAM1338 RNA, herein designated GAM RNA, also designated SEQ ID:360.

Another function of GAM1338 is therefore inhibition of MGC11102 (Accession NP__115701.2). Accordingly, utilities of GAM1338 include diagnosis, prevention and treatment of diseases and clinical conditions associated with MGC11102.

MGC11115 (Accession NP__115686.2) is another GAM1338 target gene, herein designated TARGET GENE. MGC11115 BINDING SITE is a target binding site found in the 3' untranslated region of mRNA encoded by MGC11115, corresponding to a target binding site such as BINDING SITE I, BINDING SITE II or BINDING SITE III of FIG. 8. Table 4 illustrates the complementarity of the nucleotide sequences of MGC11115 BINDING SITE, designated SEQ ID:5608, to the nucleotide sequence of GAM1338 RNA, herein designated GAM RNA, also designated SEQ ID:360.

Another function of GAM1338 is therefore inhibition of MGC11115 (Accession NP__115686.2). Accordingly, utilities of GAM1338 include diagnosis, prevention and treatment of diseases and clinical conditions associated with MGC11115.

MGC12262 (Accession NP__116085.1) is another GAM1338 target gene, herein designated TARGET GENE. MGC12262 BINDING SITE is a target binding site found in the 5' untranslated region of mRNA encoded by MGC12262, corresponding to a target binding site such as BINDING SITE I, BINDING SITE II or BINDING SITE III of FIG. 8. Table 4 illustrates the complementarity of the nucleotide sequences of MGC12262 BINDING SITE, designated SEQ ID:6361, to the nucleotide sequence of GAM1338 RNA, herein designated GAM RNA, also designated SEQ ID:360.

Another function of GAM1338 is therefore inhibition of MGC12262 (Accession NP__116085.1). Accordingly, utilities of GAM1338 include diagnosis, prevention and treatment of diseases and clinical conditions associated with MGC12262.

MGC12518 (Accession NP__291026.1) is another GAM1338 target gene, herein designated TARGET GENE. MGC12518 BINDING SITE is a target binding site found in the 3' untranslated region of mRNA encoded by MGC12518, corresponding to a target binding site such as BINDING SITE I, BINDING SITE II or BINDING SITE III of FIG. 8. Table 4 illustrates the complementarity of the nucleotide sequences of MGC12518 BINDING SITE, designated SEQ ID:18251, to the nucleotide sequence of GAM1338 RNA, herein designated GAM RNA, also designated SEQ ID:360.

Another function of GAM1338 is therefore inhibition of MGC12518 (Accession NP__291026.1). Accordingly, utilities of GAM1338 include diagnosis, prevention and treatment of diseases and clinical conditions associated with MGC12518.

MGC12760 (Accession NP__116112.1) is another GAM1338 target gene, herein designated TARGET GENE. MGC12760 BINDING SITE is a target binding site found in the 5' untranslated region of mRNA encoded by MGC12760, corresponding to a target binding site such as BINDING SITE I, BINDING SITE II or BINDING SITE III of FIG. 8. Table 4 illustrates the complementarity of the nucleotide sequences of MGC12760 BINDING SITE, designated SEQ ID:5586, to the nucleotide sequence of GAM1338 RNA, herein designated GAM RNA, also designated SEQ ID:360.

Another function of GAM1338 is therefore inhibition of MGC12760 (Accession NP__116112.1). Accordingly, utilities of GAM1338 include diagnosis, prevention and treatment of diseases and clinical conditions associated with MGC12760.

MGC13017 (Accession NP__542387.1) is another GAM1338 target gene, herein designated TARGET GENE. MGC13017 BINDING SITE is a target binding site found in the 3' untranslated region of mRNA encoded by MGC13017, corresponding to a target binding site such as BINDING SITE I, BINDING SITE II or BINDING SITE III of FIG. 8. Table 4 illustrates the complementarity of the nucleotide sequences of MGC13017 BINDING SITE, designated SEQ ID:18970, to the nucleotide sequence of GAM1338 RNA, herein designated GAM RNA, also designated SEQ ID:360.

Another function of GAM1338 is therefore inhibition of MGC13017 (Accession NP__542387.1). Accordingly, utilities of GAM1338 include diagnosis, prevention and treatment of diseases and clinical conditions associated with MGC13017.

MGC13024 (Accession NP__689501.1) is another GAM1338 target gene, herein designated TARGET GENE.

MGC13024 BINDING SITE is a target binding site found in the 3' untranslated region of mRNA encoded by MGC13024, corresponding to a target binding site such as BINDING SITE I, BINDING SITE II or BINDING SITE III of FIG. 8. Table 4 illustrates the complementarity of the nucleotide sequences of MGC13024 BINDING SITE, designated SEQ ID:15630, to the nucleotide sequence of GAM1338 RNA, herein designated GAM RNA, also designated SEQ ID:360.

Another function of GAM1338 is therefore inhibition of MGC13024 (Accession NP_689501.1). Accordingly, utilities of GAM1338 include diagnosis, prevention and treatment of diseases and clinical conditions associated with MGC13024.

MGC13138 (Accession NP_219363.1) is another GAM1338 target gene, herein designated TARGET GENE. MGC13138 BINDING SITE1 and MGC13138 BINDING SITE2 are target binding sites found in untranslated regions of mRNA encoded by MGC13138, corresponding to target binding sites such as BINDING SITE I, BINDING SITE II or BINDING SITE III of FIG. 8. Table 4 illustrates the complementarity of the nucleotide sequences of MGC13138 BINDING SITE1 and MGC13138 BINDING SITE2, designated SEQ ID:19426 and SEQ ID:14027 respectively, to the nucleotide sequence of GAM1338 RNA, herein designated GAM RNA, also designated SEQ ID:360.

Another function of GAM1338 is therefore inhibition of MGC13138 (Accession NP_219363.1). Accordingly, utilities of GAM1338 include diagnosis, prevention and treatment of diseases and clinical conditions associated with MGC13138.

MGC13170 (Accession NP_116101.1) is another GAM1338 target gene, herein designated TARGET GENE. MGC13170 BINDING SITE is a target binding site found in the 3' untranslated region of mRNA encoded by MGC13170, corresponding to a target binding site such as BINDING SITE I, BINDING SITE II or BINDING SITE III of FIG. 8. Table 4 illustrates the complementarity of the nucleotide sequences of MGC13170 BINDING SITE, designated SEQ ID:12394, to the nucleotide sequence of GAM1338 RNA, herein designated GAM RNA, also designated SEQ ID:360.

Another function of GAM1338 is therefore inhibition of MGC13170 (Accession NP_116101.1). Accordingly, utilities of GAM1338 include diagnosis, prevention and treatment of diseases and clinical conditions associated with MGC13170.

MGC13204 (Accession NP_113653.1) is another GAM1338 target gene, herein designated TARGET GENE. MGC13204 BINDING SITE is a target binding site found in the 3' untranslated region of mRNA encoded by MGC13204, corresponding to a target binding site such as BINDING SITE I, BINDING SITE II or BINDING SITE III of FIG. 8. Table 4 illustrates the complementarity of the nucleotide sequences of MGC13204 BINDING SITE, designated SEQ ID:17963, to the nucleotide sequence of GAM1338 RNA, herein designated GAM RNA, also designated SEQ ID:360.

Another function of GAM1338 is therefore inhibition of MGC13204 (Accession NP_113653.1). Accordingly, utilities of GAM1338 include diagnosis, prevention and treatment of diseases and clinical conditions associated with MGC13204.

MGC14289 (Accession NP_542391.1) is another GAM1338 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:1959, to the nucleotide sequence of GAM1338 RNA, herein designated GAM RNA, also designated SEQ ID:360.

Another function of GAM1338 is therefore inhibition of MGC14289 (Accession NP_542391.1). Accordingly, utilities of GAM1338 include diagnosis, prevention and treatment of diseases and clinical conditions associated with MGC14289.

MGC14836 (Accession NP_219480.1) is another GAM1338 target gene, herein designated TARGET GENE. MGC14836 BINDING SITE is a target binding site found in the 3' untranslated region of mRNA encoded by MGC14836, corresponding to a target binding site such as BINDING SITE I, BINDING SITE II or BINDING SITE III of FIG. 8. Table 4 illustrates the complementarity of the nucleotide sequences of MGC14836 BINDING SITE, designated SEQ ID:9102, to the nucleotide sequence of GAM1338 RNA, herein designated GAM RNA, also designated SEQ ID:360.

Another function of GAM1338 is therefore inhibition of MGC14836 (Accession NP_219480.1). Accordingly, utilities of GAM1338 include diagnosis, prevention and treatment of diseases and clinical conditions associated with MGC14836.

MGC15606 (Accession NP_659474.1) is another GAM1338 target gene, herein designated TARGET GENE. MGC15606 BINDING SITE is a target binding site found in the 5' untranslated region of mRNA encoded by MGC15606, corresponding to a target binding site such as BINDING SITE I, BINDING SITE II or BINDING SITE III of FIG. 8. Table 4 illustrates the complementarity of the nucleotide sequences of MGC15606 BINDING SITE, designated SEQ ID:6622, to the nucleotide sequence of GAM1338 RNA, herein designated GAM RNA, also designated SEQ ID:360.

Another function of GAM1338 is therefore inhibition of MGC15606 (Accession NP_659474.1). Accordingly, utilities of GAM1338 include diagnosis, prevention and treatment of diseases and clinical conditions associated with MGC15606.

MGC15668 (Accession NP_116145.1) is another GAM1338 target gene, herein designated TARGET GENE. MGC15668 BINDING SITE is a target binding site found in the 3' untranslated region of mRNA encoded by MGC15668, corresponding to a target binding site such as BINDING SITE I, BINDING SITE II or BINDING SITE III of FIG. 8. Table 4 illustrates the complementarity of the nucleotide sequences of MGC15668 BINDING SITE, designated SEQ ID:15177, to the nucleotide sequence of GAM1338 RNA, herein designated GAM RNA, also designated SEQ ID:360.

Another function of GAM1338 is therefore inhibition of MGC15668 (Accession NP_116145.1). Accordingly, utilities of GAM1338 include diagnosis, prevention and treatment of diseases and clinical conditions associated with MGC15668.

MGC15705 (Accession NP_116146.1) is another GAM1338 target gene, herein designated TARGET GENE. MGC15705 BINDING SITE is a target binding site found in the 3' untranslated region of mRNA encoded by MGC15705, corresponding to a target binding site such as BINDING SITE I, BINDING SITE II or BINDING SITE III of FIG. 8. Table 4 illustrates the complementarity of the nucleotide sequences of MGC15705 BINDING SITE, designated SEQ ID:6734, to the nucleotide sequence of GAM1338 RNA, herein designated GAM RNA, also designated SEQ ID:360.

Another function of GAM1338 is therefore inhibition of MGC15705 (Accession NP_116146.1). Accordingly, utilities of GAM1338 include diagnosis, prevention and treatment of diseases and clinical conditions associated with MGC15705.

MGC15873 (Accession NP_116309.1) is another GAM1338 target gene, herein designated TARGET GENE. MGC15873 BINDING SITE is a target binding site found in the 5' untranslated region of mRNA encoded by MGC15873, corresponding to a target binding site such as BINDING SITE I, BINDING SITE II or BINDING SITE III of FIG. 8. Table 4 illustrates the complementarity of the nucleotide sequences of MGC15873 BINDING SITE, designated SEQ ID:9079, to the nucleotide sequence of GAM1338 RNA, herein designated GAM RNA, also designated SEQ ID:360.

Another function of GAM1338 is therefore inhibition of MGC15873 (Accession NP_116309.1). Accordingly, utilities of GAM1338 include diagnosis, prevention and treatment of diseases and clinical conditions associated with MGC15873.

MGC17839 (Accession NP_777586.1) is another GAM1338 target gene, herein designated TARGET GENE. MGC17839 BINDING SITE is a target binding site found in the 5' untranslated region of mRNA encoded by MGC17839, corresponding to a target binding site such as BINDING SITE I, BINDING SITE II or BINDING SITE III of FIG. 8. Table 4 illustrates the complementarity of the nucleotide sequences of MGC17839 BINDING SITE, designated SEQ ID:18441, to the nucleotide sequence of GAM1338 RNA, herein designated GAM RNA, also designated SEQ ID:360.

Another function of GAM1338 is therefore inhibition of MGC17839 (Accession NP_777586.1). Accordingly, utilities of GAM1338 include diagnosis, prevention and treatment of diseases and clinical conditions associated with MGC17839.

MGC17919 (Accession NP_653222.2) is another GAM1338 target gene, herein designated TARGET GENE. MGC17919 BINDING SITE is a target binding site found in the 3' untranslated region of mRNA encoded by MGC17919, corresponding to a target binding site such as BINDING SITE I, BINDING SITE II or BINDING SITE III of FIG. 8. Table 4 illustrates the complementarity of the nucleotide sequences of MGC17919 BINDING SITE, designated SEQ ID:1588, to the nucleotide sequence of GAM1338 RNA, herein designated GAM RNA, also designated SEQ ID:360.

Another function of GAM1338 is therefore inhibition of MGC17919 (Accession NP_653222.2). Accordingly, utilities of GAM1338 include diagnosis, prevention and treatment of diseases and clinical conditions associated with MGC17919.

MGC1842 (Accession XP_037797.2) is another GAM1338 target gene, herein designated TARGET GENE. MGC1842 BINDING SITE is a target binding site found in the 3' untranslated region of mRNA encoded by MGC1842, corresponding to a target binding site such as BINDING SITE I, BINDING SITE II or BINDING SITE III of FIG. 8. Table 4 illustrates the complementarity of the nucleotide sequences of MGC1842 BINDING SITE, designated SEQ ID:11658, to the nucleotide sequence of GAM1338 RNA, herein designated GAM RNA, also designated SEQ ID:360.

Another function of GAM1338 is therefore inhibition of MGC1842 (Accession XP_037797.2). Accordingly, utilities of GAM1338 include diagnosis, prevention and treatment of diseases and clinical conditions associated with MGC1842.

MGC21675 (Accession NP_443093.1) is another GAM1338 target gene, herein designated TARGET GENE. MGC21675 BINDING SITE is a target binding site found in the 3' untranslated region of mRNA encoded by MGC21675, corresponding to a target binding site such as BINDING SITE I, BINDING SITE II or BINDING SITE III of FIG. 8. Table 4 illustrates the complementarity of the nucleotide sequences of MGC21675 BINDING SITE, designated SEQ ID:19749, to the nucleotide sequence of GAM1338 RNA, herein designated GAM RNA, also designated SEQ ID:360.

Another function of GAM1338 is therefore inhibition of MGC21675 (Accession NP_443093.1). Accordingly, utilities of GAM1338 include diagnosis, prevention and treatment of diseases and clinical conditions associated with MGC21675.

MGC2474 (Accession NP_076420.1) is another GAM1338 target gene, herein designated TARGET GENE. MGC2474 BINDING SITE1 and MGC2474 BINDING SITE2 are target binding sites found in untranslated regions of mRNA encoded by MGC2474, corresponding to target binding sites such as BINDING SITE I, BINDING SITE II or BINDING SITE III of FIG. 8. Table 4 illustrates the complementarity of the nucleotide sequences of MGC2474 BINDING SITE1 and MGC2474 BINDING SITE2, designated SEQ ID:18119 and SEQ ID:19749 respectively, to the nucleotide sequence of GAM1338 RNA, herein designated GAM RNA, also designated SEQ ID:360.

Another function of GAM1338 is therefore inhibition of MGC2474 (Accession NP_076420.1). Accordingly, utilities of GAM1338 include diagnosis, prevention and treatment of diseases and clinical conditions associated with MGC2474.

MGC2477 (Accession NP_077004.1) is another GAM1338 target gene, herein designated TARGET GENE. MGC2477 BINDING SITE1 through MGC2477 BINDING SITE3 are target binding sites found in untranslated regions of mRNA encoded by MGC2477, corresponding to target binding sites such as BINDING SITE I, BINDING SITE II or BINDING SITE III of FIG. 8. Table 4 illustrates the complementarity of the nucleotide sequences of MGC2477 BINDING SITE1 through MGC2477 BINDING SITE3, designated SEQ ID:12048, SEQ ID:19729 and SEQ ID:3973 respectively, to the nucleotide sequence of GAM1338 RNA, herein designated GAM RNA, also designated SEQ ID:360.

Another function of GAM1338 is therefore inhibition of MGC2477 (Accession NP_077004.1). Accordingly, utilities of GAM1338 include diagnosis, prevention and treatment of diseases and clinical conditions associated with MGC2477.

MGC2603 (Accession NP_076942.1) is another GAM1338 target gene, herein designated TARGET GENE. MGC2603 BINDING SITE is a target binding site found in the 3' untranslated region of mRNA encoded by MGC2603, corresponding to a target binding site such as BINDING SITE I, BINDING SITE II or BINDING SITE III of FIG. 8. Table 4 illustrates the complementarity of the nucleotide sequences of MGC2603 BINDING SITE, designated SEQ ID:17763, to the nucleotide sequence of GAM1338 RNA, herein designated GAM RNA, also designated SEQ ID:360.

Another function of GAM1338 is therefore inhibition of MGC2603 (Accession NP_076942.1). Accordingly, utilities of GAM1338 include diagnosis, prevention and treatment of diseases and clinical conditions associated with MGC2603.

MGC26484 (Accession NP_689840.1) is another GAM1338 target gene, herein designated TARGET GENE. MGC26484 BINDING SITE is a target binding site found in the 3' untranslated region of mRNA encoded by MGC26484, corresponding to a target binding site such as BINDING SITE I, BINDING SITE II or BINDING SITE III of FIG. 8. Table 4 illustrates the complementarity of the nucleotide sequences of MGC26484 BINDING SITE, designated SEQ ID:9741, to the nucleotide sequence of GAM1338 RNA, herein designated GAM RNA, also designated SEQ ID:360.

Another function of GAM1338 is therefore inhibition of MGC26484 (Accession NP_689840.1). Accordingly, utilities of GAM1338 include diagnosis, prevention and treatment of diseases and clinical conditions associated with MGC26484.

MGC26989 (Accession NP_689976.1) is another GAM1338 target gene, herein designated TARGET GENE. MGC26989 BINDING SITE is a target binding site found in the 3' untranslated region of mRNA encoded by MGC26989, corresponding to a target binding site such as BINDING SITE I, BINDING SITE II or BINDING SITE III of FIG. 8. Table 4 illustrates the complementarity of the nucleotide sequences of MGC26989 BINDING SITE, designated SEQ ID:14418, to the nucleotide sequence of GAM1338 RNA, herein designated GAM RNA, also designated SEQ ID:360.

Another function of GAM1338 is therefore inhibition of MGC26989 (Accession NP_689976.1). Accordingly, utilities of GAM1338 include diagnosis, prevention and treatment of diseases and clinical conditions associated with MGC26989.

MGC27345 (Accession XP_300964.1) is another GAM1338 target gene, herein designated TARGET GENE. MGC27345 BINDING SITE1 and MGC27345 BINDING SITE2 are target binding sites found in untranslated regions of multiple transcripts of mRNA encoded by MGC27345, corresponding to target binding sites such as BINDING SITE I, BINDING SITE II or BINDING SITE III of FIG. 8. Table 4 illustrates the complementarity of the nucleotide sequences of MGC27345 BINDING SITE1 and MGC27345 BINDING SITE2, designated SEQ ID:7706 and SEQ ID:18352 respectively, to the nucleotide sequence of GAM1338 RNA, herein designated GAM RNA, also designated SEQ ID:360.

Another function of GAM1338 is therefore inhibition of MGC27345 (Accession XP_300964.1). Accordingly, utilities of GAM1338 include diagnosis, prevention and treatment of diseases and clinical conditions associated with MGC27345.

MGC29891 (Accession NP_653219.1) is another GAM1338 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:18179, to the nucleotide sequence of GAM1338 RNA, herein designated GAM RNA, also designated SEQ ID:360.

Another function of GAM1338 is therefore inhibition of MGC29891 (Accession NP_653219.1). Accordingly, utilities of GAM1338 include diagnosis, prevention and treatment of diseases and clinical conditions associated with MGC29891.

MGC29898 (Accession NP_659485.1) is another GAM1338 target gene, herein designated TARGET GENE. MGC29898 BINDING SITE is a target binding site found in the 3' untranslated region of mRNA encoded by MGC29898, corresponding to a target binding site such as BINDING SITE I, BINDING SITE II or BINDING SITE III of FIG. 8. Table 4 illustrates the complementarity of the nucleotide sequences of MGC29898 BINDING SITE, designated SEQ ID:9164, to the nucleotide sequence of GAM1338 RNA, herein designated GAM RNA, also designated SEQ ID:360.

Another function of GAM1338 is therefore inhibition of MGC29898 (Accession NP_659485.1). Accordingly, utilities of GAM1338 include diagnosis, prevention and treatment of diseases and clinical conditions associated with MGC29898.

MGC3113 (Accession NP_076940.1) is another GAM1338 target gene, herein designated TARGET GENE. MGC3113 BINDING SITE is a target binding site found in the 3' untranslated region of mRNA encoded by MGC3113, corresponding to a target binding site such as BINDING SITE I, BINDING SITE II or BINDING SITE III of FIG. 8. Table 4 illustrates the complementarity of the nucleotide sequences of MGC3113 BINDING SITE, designated SEQ ID:15946, to the nucleotide sequence of GAM1338 RNA, herein designated GAM RNA, also designated SEQ ID:360.

Another function of GAM1338 is therefore inhibition of MGC3113 (Accession NP_076940.1). Accordingly, utilities of GAM1338 include diagnosis, prevention and treatment of diseases and clinical conditions associated with MGC3113.

MGC3195 (Accession NP_114111.2) is another GAM1338 target gene, herein designated TARGET GENE. MGC3195 BINDING SITE is a target binding site found in the 5' untranslated region of mRNA encoded by MGC3195, corresponding to a target binding site such as BINDING SITE I, BINDING SITE II or BINDING SITE III of FIG. 8. Table 4 illustrates the complementarity of the nucleotide sequences of MGC3195 BINDING SITE, designated SEQ ID:15735, to the nucleotide sequence of GAM1338 RNA, herein designated GAM RNA, also designated SEQ ID:360.

Another function of GAM1338 is therefore inhibition of MGC3195 (Accession NP_114111.2). Accordingly, utilities of GAM1338 include diagnosis, prevention and treatment of diseases and clinical conditions associated with MGC3195.

MGC3207 (Accession NP_115661.1) is another GAM1338 target gene, herein designated TARGET GENE. MGC3207 BINDING SITE1 and MGC3207 BINDING SITE2 are target binding sites found in untranslated regions of mRNA encoded by MGC3207, corresponding to target binding sites such as BINDING SITE I, BINDING SITE II or BINDING SITE III of FIG. 8. Table 4 illustrates the complementarity of the nucleotide sequences of MGC3207 BINDING SITE1 and MGC3207 BINDING SITE2, designated SEQ ID:12382 and SEQ ID:14723 respectively, to the nucleotide sequence of GAM1338 RNA, herein designated GAM RNA, also designated SEQ ID:360.

Another function of GAM1338 is therefore inhibition of MGC3207 (Accession NP_115661.1). Accordingly, utilities of GAM1338 include diagnosis, prevention and treatment of diseases and clinical conditions associated with MGC3207.

MGC3329 (Accession NP_076991.2) is another GAM1338 target gene, herein designated TARGET GENE. MGC3329 BINDING SITE is a target binding site found in the 3' untranslated region of mRNA encoded by MGC3329, corresponding to a target binding site such as BINDING SITE I, BINDING SITE II or BINDING SITE III of FIG. 8. Table 4 illustrates the complementarity of the nucleotide sequences of MGC3329 BINDING SITE, designated SEQ ID:4873, to the nucleotide sequence of GAM1338 RNA, herein designated GAM RNA, also designated SEQ ID:360.

Another function of GAM1338 is therefore inhibition of MGC3329 (Accession NP_076991.2). Accordingly, utilities of GAM1338 include diagnosis, prevention and treatment of diseases and clinical conditions associated with MGC3329.

MGC33637 (Accession NP_689809.1) is another GAM1338 target gene, herein designated TARGET GENE. MGC33637 BINDING SITE is a target binding site found in the 3' untranslated region of mRNA encoded by MGC33637, corresponding to a target binding site such as BINDING SITE I, BINDING SITE II or BINDING SITE III of FIG. 8. Table 4 illustrates the complementarity of the nucleotide sequences of MGC33637 BINDING SITE, designated SEQ ID:12383, to the nucleotide sequence of GAM1338 RNA, herein designated GAM RNA, also designated SEQ ID:360.

Another function of GAM1338 is therefore inhibition of MGC33637 (Accession NP_689809.1). Accordingly, utilities of GAM1338 include diagnosis, prevention and treatment of diseases and clinical conditions associated with MGC33637.

MGC34034 (Accession NP_694956.1) is another GAM1338 target gene, herein designated TARGET GENE. MGC34034 BINDING SITE is a target binding site found in the 5' untranslated region of mRNA encoded by MGC34034, corresponding to a target binding site such as BINDING SITE I, BINDING SITE II or BINDING SITE III of FIG. 8. Table 4 illustrates the complementarity of the nucleotide sequences of MGC34034 BINDING SITE, designated SEQ ID:9789, to the nucleotide sequence of GAM1338 RNA, herein designated GAM RNA, also designated SEQ ID:360.

Another function of GAM1338 is therefore inhibition of MGC34034 (Accession NP_694956.1). Accordingly, utilities of GAM1338 include diagnosis, prevention and treatment of diseases and clinical conditions associated with MGC34034.

MGC34079 (Accession NP_689688.1) is another GAM1338 target gene, herein designated TARGET GENE. MGC34079 BINDING SITE is a target binding site found in the 3' untranslated region of mRNA encoded by MGC34079, corresponding to a target binding site such as BINDING SITE I, BINDING SITE II or BINDING SITE III of FIG. 8. Table 4 illustrates the complementarity of the nucleotide sequences of MGC34079 BINDING SITE, designated SEQ ID:19879, to the nucleotide sequence of GAM1338 RNA, herein designated GAM RNA, also designated SEQ ID:360.

Another function of GAM1338 is therefore inhibition of MGC34079 (Accession NP_689688.1). Accordingly, utilities of GAM1338 include diagnosis, prevention and treatment of diseases and clinical conditions associated with MGC34079.

MGC34132 (Accession XP_291029.1) is another GAM1338 target gene, herein designated TARGET GENE. MGC34132 BINDING SITE1 and MGC34132 BINDING SITE2 are target binding sites found in untranslated regions of mRNA encoded by MGC34132, corresponding to target binding sites such as BINDING SITE I, BINDING SITE II or BINDING SITE III of FIG. 8. Table 4 illustrates the complementarity of the nucleotide sequences of MGC34132 BINDING SITE1 and MGC34132 BINDING SITE2, designated SEQ ID:9188 and SEQ ID:8862 respectively, to the nucleotide sequence of GAM1338 RNA, herein designated GAM RNA, also designated SEQ ID:360.

Another function of GAM1338 is therefore inhibition of MGC34132 (Accession XP_291029.1). Accordingly, utilities of GAM1338 include diagnosis, prevention and treatment of diseases and clinical conditions associated with MGC34132.

MGC35440 (Accession NP_694952.1) is another GAM1338 target gene, herein designated TARGET GENE. MGC35440 BINDING SITE1 and MGC35440 BINDING SITE2 are target binding sites found in untranslated regions of mRNA encoded by MGC35440, corresponding to target binding sites such as BINDING SITE I, BINDING SITE II or BINDING SITE III of FIG. 8. Table 4 illustrates the complementarity of the nucleotide sequences of MGC35440 BINDING SITE1 and MGC35440 BINDING SITE2, designated SEQ ID:15523 and SEQ ID:13796 respectively, to the nucleotide sequence of GAM1338 RNA, herein designated GAM RNA, also designated SEQ ID:360.

Another function of GAM1338 is therefore inhibition of MGC35440 (Accession NP_694952.1). Accordingly, utilities of GAM1338 include diagnosis, prevention and treatment of diseases and clinical conditions associated with MGC35440.

MGC35468 (Accession NP_694976.1) is another GAM1338 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:15490, to the nucleotide sequence of GAM1338 RNA, herein designated GAM RNA, also designated SEQ ID:360.

Another function of GAM1338 is therefore inhibition of MGC35468 (Accession NP_694976.1). Accordingly, utilities of GAM1338 include diagnosis, prevention and treatment of diseases and clinical conditions associated with MGC35468.

MGC39320 (Accession NP_689642.2) is another GAM1338 target gene, herein designated TARGET GENE. MGC39320 BINDING SITE is a target binding site found in the 3' untranslated region of mRNA encoded by MGC39320, corresponding to a target binding site such as BINDING SITE I, BINDING SITE II or BINDING SITE III of FIG. 8. Table 4 illustrates the complementarity of the nucleotide sequences of MGC39320 BINDING SITE, designated SEQ ID:2691, to the nucleotide sequence of GAM1338 RNA, herein designated GAM RNA, also designated SEQ ID:360.

Another function of GAM1338 is therefore inhibition of MGC39320 (Accession NP_689642.2). Accordingly, utilities of GAM1338 include diagnosis, prevention and treatment of diseases and clinical conditions associated with MGC39320.

MGC40157 (Accession NP_689563.1) is another GAM1338 target gene, herein designated TARGET GENE. MGC40157 BINDING SITE1 and MGC40157 BINDING SITE2 are target binding sites found in untranslated regions of mRNA encoded by MGC40157, corresponding to target binding sites such as BINDING SITE I, BINDING SITE II or BINDING SITE III of FIG. 8. Table 4 illustrates the complementarity of the nucleotide sequences of MGC40157 BINDING SITE1 and MGC40157 BINDING SITE2, designated SEQ ID:865 and SEQ ID:13547 respectively, to the nucleotide sequence of GAM1338 RNA, herein designated GAM RNA, also designated SEQ ID:360.

Another function of GAM1338 is therefore inhibition of MGC40157 (Accession NP_689563.1). Accordingly, utilities of GAM1338 include diagnosis, prevention and treatment of diseases and clinical conditions associated with MGC40157.

MGC40168 (Accession NP_714920.1) is another GAM1338 target gene, herein designated TARGET GENE. MGC40168 BINDING SITE is a target binding site found in the 5' untranslated region of mRNA encoded by MGC40168, corresponding to a target binding site such as BINDING SITE I, BINDING SITE II or BINDING SITE III of FIG. 8. Table 4 illustrates the complementarity of the nucleotide sequences of MGC40168 BINDING SITE, designated SEQ ID:3717, to the nucleotide sequence of GAM1338 RNA, herein designated GAM RNA, also designated SEQ ID:360.

Another function of GAM1338 is therefore inhibition of MGC40168 (Accession NP_714920.1). Accordingly, utilities of GAM1338 include diagnosis, prevention and treatment of diseases and clinical conditions associated with MGC40168.

MGC40579 (Accession NP_689989.1) is another GAM1338 target gene, herein designated TARGET GENE. MGC40579 BINDING SITE is a target binding site found in the 3' untranslated region of mRNA encoded by MGC40579, corresponding to a target binding site such as BINDING SITE I, BINDING SITE II or BINDING SITE III of FIG. 8. Table 4 illustrates the complementarity of the nucleotide sequences of MGC40579 BINDING SITE, designated SEQ ID:516, to the nucleotide sequence of GAM1338 RNA, herein designated GAM RNA, also designated SEQ ID:360.

Another function of GAM1338 is therefore inhibition of MGC40579 (Accession NP_689989.1). Accordingly, utilities of GAM1338 include diagnosis, prevention and treatment of diseases and clinical conditions associated with MGC40579.

MGC4248 (Accession NP_115709.2) is another GAM1338 target gene, herein designated TARGET GENE. MGC4248 BINDING SITE is a target binding site found in the 3' untranslated region of mRNA encoded by MGC4248, corresponding to a target binding site such as BINDING SITE I, BINDING SITE II or BINDING SITE III of FIG. 8. Table 4 illustrates the complementarity of the nucleotide sequences of MGC4248 BINDING SITE, designated SEQ ID:8539, to the nucleotide sequence of GAM1338 RNA, herein designated GAM RNA, also designated SEQ ID:360.

Another function of GAM1338 is therefore inhibition of MGC4248 (Accession NP_115709.2). Accordingly, utilities of GAM1338 include diagnosis, prevention and treatment of diseases and clinical conditions associated with MGC4248.

MGC50452 (Accession NP_775733.1) is another GAM1338 target gene, herein designated TARGET GENE. MGC50452 BINDING SITE is a target binding site found in the 3' untranslated region of mRNA encoded by MGC50452, corresponding to a target binding site such as BINDING SITE I, BINDING SITE II or BINDING SITE III of FIG. 8. Table 4 illustrates the complementarity of the nucleotide sequences of MGC50452 BINDING SITE, designated SEQ ID:8458, to the nucleotide sequence of GAM1338 RNA, herein designated GAM RNA, also designated SEQ ID:360.

Another function of GAM1338 is therefore inhibition of MGC50452 (Accession NP_775733.1). Accordingly, utilities of GAM1338 include diagnosis, prevention and treatment of diseases and clinical conditions associated with MGC50452.

MGC50559 (Accession NP_776163.1) is another GAM1338 target gene, herein designated TARGET GENE. MGC50559 BINDING SITE1 and MGC50559 BINDING SITE2 are target binding sites found in untranslated regions of mRNA encoded by MGC50559, corresponding to target binding sites such as BINDING SITE I, BINDING SITE II or BINDING SITE III of FIG. 8. Table 4 illustrates the complementarity of the nucleotide sequences of MGC50559 BINDING SITE1 and MGC50559 BINDING SITE2, designated SEQ ID:7831 and SEQ ID:5794 respectively, to the nucleotide sequence of GAM1338 RNA, herein designated GAM RNA, also designated SEQ ID:360.

Another function of GAM1338 is therefore inhibition of MGC50559 (Accession NP_776163.1). Accordingly, utilities of GAM1338 include diagnosis, prevention and treatment of diseases and clinical conditions associated with MGC50559.

MGC5149 (Accession XP_051200.2) is another GAM1338 target gene, herein designated TARGET GENE. MGC5149 BINDING SITE is a target binding site found in the 3' untranslated region of mRNA encoded by MGC5149, corresponding to a target binding site such as BINDING SITE I, BINDING SITE II or BINDING SITE III of FIG. 8. Table 4 illustrates the complementarity of the nucleotide sequences of MGC5149 BINDING SITE, designated SEQ ID:17590, to the nucleotide sequence of GAM1338 RNA, herein designated GAM RNA, also designated SEQ ID:360.

Another function of GAM1338 is therefore inhibition of MGC5149 (Accession XP_051200.2). Accordingly, utilities of GAM1338 include diagnosis, prevention and treatment of diseases and clinical conditions associated with MGC5149.

MGC9912 (Accession NP_542395.1) is another GAM1338 target gene, herein designated TARGET GENE. MGC9912 BINDING SITE is a target binding site found in the 3' untranslated region of mRNA encoded by MGC9912, corresponding to a target binding site such as BINDING SITE I, BINDING SITE II or BINDING SITE III of FIG. 8. Table 4 illustrates the complementarity of the nucleotide sequences of MGC9912 BINDING SITE, designated SEQ ID:11391, to the nucleotide sequence of GAM1338 RNA, herein designated GAM RNA, also designated SEQ ID:360.

Another function of GAM1338 is therefore inhibition of MGC9912 (Accession NP_542395.1). Accordingly, utilities of GAM1338 include diagnosis, prevention and treatment of diseases and clinical conditions associated with MGC9912.

MGRN1 (Accession XP_048119.4) is another GAM1338 target gene, herein designated TARGET GENE. MGRN1 BINDING SITE is a target binding site found in the 3' untranslated region of mRNA encoded by MGRN1, corresponding to a target binding site such as BINDING SITE I, BINDING SITE II or BINDING SITE III of FIG. 8. Table 4 illustrates the complementarity of the nucleotide sequences of MGRN1 BINDING SITE, designated SEQ ID:13807, to the nucleotide sequence of GAM1338 RNA, herein designated GAM RNA, also designated SEQ ID:360.

Another function of GAM1338 is therefore inhibition of MGRN1 (Accession XP_048119.4). Accordingly, utilities of GAM1338 include diagnosis, prevention and treatment of diseases and clinical conditions associated with MGRN1.

Mhc class ii transactivator (MHC2TA, Accession NP_000237.1) is another GAM1338 target gene, herein designated TARGET GENE. MHC2TA BINDING SITE1 through MHC2TA BINDING SITE3 are target binding sites found in untranslated regions of mRNA encoded by MHC2TA, corresponding to target binding sites such as BINDING SITE I, BINDING SITE II or BINDING SITE III of FIG. 8. Table 4 illustrates the complementarity of the nucleotide sequences of MHC2TA BINDING SITE1 through MHC2TA BINDING SITE3, designated SEQ ID:4816, SEQ ID:6437 and SEQ ID:9987 respectively, to the nucleotide sequence of GAM1338 RNA, herein designated GAM RNA, also designated SEQ ID:360.

Another function of GAM1338 is therefore inhibition of Mhc class ii transactivator (MHC2TA, Accession NP_000237.1). Accordingly, utilities of GAM1338 include diagnosis, prevention and treatment of diseases and clinical conditions associated with MHC2TA.

MIRAB13 (Accession XP_039236.6) is another GAM1338 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:3109, to the nucleotide sequence of GAM1338 RNA, herein designated GAM RNA, also designated SEQ ID:360.

Another function of GAM1338 is therefore inhibition of MIRAB13 (Accession XP_039236.6). Accordingly, utilities of GAM1338 include diagnosis, prevention and treatment of diseases and clinical conditions associated with MIRAB13.

MIRAB13 (Accession NP_203744.1) is another GAM1338 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:3109, to the nucleotide sequence of GAM1338 RNA, herein designated GAM RNA, also designated SEQ ID:360.

Another function of GAM1338 is therefore inhibition of MIRAB13 (Accession NP_203744.1). Accordingly, utilities of GAM1338 include diagnosis, prevention and treatment of diseases and clinical conditions associated with MIRAB13.

Makorin, ring finger protein, 4 (MKRN4, Accession NP_110384.1) is another GAM1338 target gene, herein designated TARGET GENE. MKRN4 BINDING SITE is a target binding site found in the 3' untranslated region of mRNA encoded by MKRN4, corresponding to a target binding site such as BINDING SITE I, BINDING SITE II or BINDING SITE III of FIG. 8. Table 4 illustrates the complementarity of the nucleotide sequences of MKRN4 BINDING SITE, designated SEQ ID:12385, to the nucleotide sequence of GAM1338 RNA, herein designated GAM RNA, also designated SEQ ID:360.

Another function of GAM1338 is therefore inhibition of Makorin, ring finger protein, 4 (MKRN4, Accession NP_110384.1). Accordingly, utilities of GAM1338 include diagnosis, prevention and treatment of diseases and clinical conditions associated with MKRN4.

Melan-a (MLANA, Accession NP_005502.1) is another GAM1338 target gene, herein designated TARGET GENE. MLANA BINDING SITE is a target binding site found in the 3' untranslated region of mRNA encoded by MLANA, corresponding to a target binding site such as BINDING SITE I, BINDING SITE II or BINDING SITE III of FIG. 8. Table 4 illustrates the complementarity of the nucleotide sequences of MLANA BINDING SITE, designated SEQ ID:17276, to the nucleotide sequence of GAM1338 RNA, herein designated GAM RNA, also designated SEQ ID:360.

Another function of GAM1338 is therefore inhibition of Melan-a (MLANA, Accession NP_005502.1). Accordingly, utilities of GAM1338 include diagnosis, prevention and treatment of diseases and clinical conditions associated with MLANA.

Melanoma-derived leucine zipper, extra-nuclear factor (MLZE, Accession NP_113603.1) is another GAM1338 target gene, herein designated TARGET GENE. MLZE BINDING SITE is a target binding site found in the 5' untranslated region of mRNA encoded by MLZE, corresponding to a target binding site such as BINDING SITE I, BINDING SITE II or BINDING SITE III of FIG. 8. Table 4 illustrates the complementarity of the nucleotide sequences of MLZE BINDING SITE, designated SEQ ID:11404, to the nucleotide sequence of GAM1338 RNA, herein designated GAM RNA, also designated SEQ ID:360.

Another function of GAM1338 is therefore inhibition of Melanoma-derived leucine zipper, extra-nuclear factor (MLZE, Accession NP_113603.1). Accordingly, utilities of GAM1338 include diagnosis, prevention and treatment of diseases and clinical conditions associated with MLZE.

MMAB (Accession NP_443077.1) is another GAM1338 target gene, herein designated TARGET GENE. MMAB BINDING SITE is a target binding site found in the 3' untranslated region of mRNA encoded by MMAB, corresponding to a target binding site such as BINDING SITE I, BINDING SITE II or BINDING SITE III of FIG. 8. Table 4 illustrates the complementarity of the nucleotide sequences of MMAB BINDING SITE, designated SEQ ID:11037, to the nucleotide sequence of GAM1338 RNA, herein designated GAM RNA, also designated SEQ ID:360.

Another function of GAM1338 is therefore inhibition of MMAB (Accession NP_443077.1). Accordingly, utilities of GAM1338 include diagnosis, prevention and treatment of diseases and clinical conditions associated with MMAB.

MO25 (Accession NP_057373.1) is another GAM1338 target gene, herein designated TARGET GENE. MO25 BINDING SITE is a target binding site found in the 3' untranslated region of mRNA encoded by MO25, corresponding to a target binding site such as BINDING SITE I, BINDING SITE II or BINDING SITE III of FIG. 8. Table 4 illustrates the complementarity of the nucleotide sequences of MO25 BINDING SITE, designated SEQ ID:6709, to the nucleotide sequence of GAM1338 RNA, herein designated GAM RNA, also designated SEQ ID:360.

Another function of GAM1338 is therefore inhibition of MO25 (Accession NP_057373.1). Accordingly, utilities of GAM1338 include diagnosis, prevention and treatment of diseases and clinical conditions associated with MO25.

Modulator of apoptosis 1 (MOAP1, Accession NP_071434.2) is another GAM1338 target gene, herein designated TARGET GENE. MOAP1 BINDING SITE is a target binding site found in the 3' untranslated region of mRNA encoded by MOAP1, corresponding to a target binding site such as BINDING SITE I, BINDING SITE II or BINDING SITE III of FIG. 8. Table 4 illustrates the complementarity of the nucleotide sequences of MOAP1 BINDING SITE, designated SEQ ID:11659, to the nucleotide sequence of GAM1338 RNA, herein designated GAM RNA, also designated SEQ ID:360.

Another function of GAM1338 is therefore inhibition of Modulator of apoptosis 1 (MOAP1, Accession NP_071434.2). Accordingly, utilities of GAM1338 include diagnosis, prevention and treatment of diseases and clinical conditions associated with MOAP1.

moblak (Accession NP_570719.1) is another GAM1338 target gene, herein designated TARGET GENE. moblak BINDING SITE is a target binding site found in the 3' untranslated region of mRNA encoded by moblak, corresponding to a target binding site such as BINDING SITE I, BINDING SITE II or BINDING SITE III of FIG. 8. Table 4 illustrates the complementarity of the nucleotide sequences of moblak BINDING SITE, designated SEQ ID:2270, to the nucleotide sequence of GAM1338 RNA, herein designated GAM RNA, also designated SEQ ID:360.

Another function of GAM1338 is therefore inhibition of moblak (Accession NP_570719.1). Accordingly, utilities of GAM1338 include diagnosis, prevention and treatment of diseases and clinical conditions associated with moblak.

Molybdenum cofactor synthesis 3 (MOCS3, Accession NP_055299.1) is another GAM1338 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:6108, to the nucleotide sequence of GAM1338 RNA, herein designated GAM RNA, also designated SEQ ID:360.

Another function of GAM1338 is therefore inhibition of Molybdenum cofactor synthesis 3 (MOCS3, Accession NP_055299.1). Accordingly, utilities of GAM1338 include diagnosis, prevention and treatment of diseases and clinical conditions associated with MOCS3.

Myeloproliferative leukemia virus oncogene (MPL, Accession NP_005364.1) is another GAM1338 target gene, herein designated TARGET GENE. MPL BINDING SITE is a target binding site found in the 3' untranslated region of mRNA encoded by MPL, corresponding to a target binding site such as BINDING SITE I, BINDING SITE II or BINDING SITE III of FIG. 8. Table 4 illustrates the complementarity of the nucleotide sequences of MPL BINDING SITE, designated SEQ ID:11909, to the nucleotide sequence of GAM1338 RNA, herein designated GAM RNA, also designated SEQ ID:360.

Another function of GAM1338 is therefore inhibition of Myeloproliferative leukemia virus oncogene (MPL, Accession NP_005364.1). Accordingly, utilities of GAM1338 include diagnosis, prevention and treatment of diseases and clinical conditions associated with MPL.

Mitochondrial ribosomal protein l10 (MRPL10, Accession NP_683685.1) is another GAM1338 target gene, herein designated TARGET GENE. MRPL10 BINDING SITE is a target binding site found in the 5' untranslated region of multiple transcripts of mRNA encoded by MRPL10, corresponding to a target binding site such as BINDING SITE I, BINDING SITE II or BINDING SITE III of FIG. 8. Table 4 illustrates the complementarity of the nucleotide sequences of MRPL10 BINDING SITE, designated SEQ ID:3339, to the nucleotide sequence of GAM1338 RNA, herein designated GAM RNA, also designated SEQ ID:360.

Another function of GAM1338 is therefore inhibition of Mitochondrial ribosomal protein l10 (MRPL10, Accession NP_683685.1). Accordingly, utilities of GAM1338 include diagnosis, prevention and treatment of diseases and clinical conditions associated with MRPL10.

Mitochondrial ribosomal protein l35 (MRPL35, Accession NP_057706.2) is another GAM1338 target gene, herein designated TARGET GENE. MRPL35 BINDING SITE is a target binding site found in the 3' untranslated region of multiple transcripts of mRNA encoded by MRPL35, corresponding to a target binding site such as BINDING SITE I, BINDING SITE II or BINDING SITE III of FIG. 8. Table 4 illustrates the complementarity of the nucleotide sequences of MRPL35 BINDING SITE, designated SEQ ID:10631, to the nucleotide sequence of GAM1338 RNA, herein designated GAM RNA, also designated SEQ ID:360.

Another function of GAM1338 is therefore inhibition of Mitochondrial ribosomal protein l35 (MRPL35, Accession NP_057706.2). Accordingly, utilities of GAM1338 include diagnosis, prevention and treatment of diseases and clinical conditions associated with MRPL35.

Mitochondrial ribosomal protein l44 (MRPL44, Accession NP_075066.1) is another GAM1338 target gene, herein designated TARGET GENE. MRPL44 BINDING SITE is a target binding site found in the 3' untranslated region of mRNA encoded by MRPL44, corresponding to a target binding site such as BINDING SITE I, BINDING SITE II or BINDING SITE III of FIG. 8. Table 4 illustrates the complementarity of the nucleotide sequences of MRPL44 BINDING SITE, designated SEQ ID:6410, to the nucleotide sequence of GAM1338 RNA, herein designated GAM RNA, also designated SEQ ID:360.

Another function of GAM1338 is therefore inhibition of Mitochondrial ribosomal protein l44 (MRPL44, Accession NP_075066.1). Accordingly, utilities of GAM1338 include diagnosis, prevention and treatment of diseases and clinical conditions associated with MRPL44.

Mitochondrial ribosomal protein l49 (MRPL49, Accession NP_004918.1) is another GAM1338 target gene, herein designated TARGET GENE. MRPL49 BINDING SITE is a target binding site found in the 3' untranslated region of mRNA encoded by MRPL49, corresponding to a target binding site such as BINDING SITE I, BINDING SITE II or BINDING SITE III of FIG. 8. Table 4 illustrates the complementarity of the nucleotide sequences of MRPL49 BINDING SITE, designated SEQ ID:13534, to the nucleotide sequence of GAM1338 RNA, herein designated GAM RNA, also designated SEQ ID:360.

Another function of GAM1338 is therefore inhibition of Mitochondrial ribosomal protein l49 (MRPL49, Accession NP_004918.1). Accordingly, utilities of GAM1338 include diagnosis, prevention and treatment of diseases and clinical conditions associated with MRPL49.

Mitochondrial ribosomal protein s27 (MRPS27, Accession NP_055899.1) is another GAM1338 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:13372, to the nucleotide sequence of GAM1338 RNA, herein designated GAM RNA, also designated SEQ ID:360.

Another function of GAM1338 is therefore inhibition of Mitochondrial ribosomal protein s27 (MRPS27, Accession NP_055899.1). Accordingly, utilities of GAM1338 include diagnosis, prevention and treatment of diseases and clinical conditions associated with MRPS27.

Male-specific lethal 3-like 1 (drosophila) (MSL3L1, Accession NP_523353.1) is another GAM1338 target gene, herein designated TARGET GENE. MSL3L1 BINDING SITE is a target binding site found in the 3' untranslated region of multiple transcripts of mRNA encoded by MSL3L1, corresponding to a target binding site such as BINDING SITE I, BINDING SITE II or BINDING SITE III of FIG. 8. Table 4 illustrates the complementarity of the nucleotide sequences of MSL3L1 BINDING SITE, designated SEQ ID:1303, to the nucleotide sequence of GAM1338 RNA, herein designated GAM RNA, also designated SEQ ID:360.

Another function of GAM1338 is therefore inhibition of Male-specific lethal 3-like 1 (drosophila) (MSL3L1, Accession NP_523353.1). Accordingly, utilities of GAM1338 include diagnosis, prevention and treatment of diseases and clinical conditions associated with MSL3L1.

Male-specific lethal 3-like 1 (drosophila) (MSL3L1, Accession NP_523354.1) is another GAM1338 target gene, herein designated TARGET GENE. MSL3L1 BINDING SITE is a target binding site found in the 3' untranslated region of multiple transcripts of mRNA encoded by MSL3L1, corresponding to a target binding site such as BINDING SITE I, BINDING SITE II or BINDING SITE III of FIG. 8. Table 4 illustrates the complementarity of the nucleotide sequences of MSL3L1 BINDING SITE, designated SEQ ID:1303, to the nucleotide sequence of GAM1338 RNA, herein designated GAM RNA, also designated SEQ ID:360.

Another function of GAM1338 is therefore inhibition of Male-specific lethal 3-like 1 (drosophila) (MSL3L1, Accession NP_523354.1). Accordingly, utilities of GAM1338 include diagnosis, prevention and treatment of diseases and clinical conditions associated with MSL3L1.

Male-specific lethal 3-like 1 (drosophila) (MSL3L1, Accession NP_006791.2) is another GAM1338 target gene, herein designated TARGET GENE. MSL3L1 BINDING SITE is a target binding site found in the 3' untranslated region of multiple transcripts of mRNA encoded by MSL3L1, corresponding to a target binding site such as BINDING SITE I, BINDING SITE II or BINDING SITE III of FIG. 8. Table 4 illustrates the complementarity of the nucleotide sequences of MSL3L1 BINDING SITE, designated SEQ ID:1303, to the nucleotide sequence of GAM1338 RNA, herein designated GAM RNA, also designated SEQ ID:360.

Another function of GAM1338 is therefore inhibition of Male-specific lethal 3-like 1 (drosophila) (MSL3L1, Accession NP_006791.2). Accordingly, utilities of GAM1338 include diagnosis, prevention and treatment of diseases and clinical conditions associated with MSL3L1.

MSTP028 (Accession NP_114160.1) is another GAM1338 target gene, herein designated TARGET GENE. MSTP028 BINDING SITE is a target binding site found in the 3' untranslated region of mRNA encoded by MSTP028, corresponding to a target binding site such as BINDING SITE I, BINDING SITE II or BINDING SITE III of FIG. 8. Table 4 illustrates the complementarity of the nucleotide sequences of MSTP028 BINDING SITE, designated SEQ ID:11359, to the nucleotide sequence of GAM1338 RNA, herein designated GAM RNA, also designated SEQ ID:360.

Another function of GAM1338 is therefore inhibition of MSTP028 (Accession NP_114160.1). Accordingly, utilities of GAM1338 include diagnosis, prevention and treatment of diseases and clinical conditions associated with MSTP028.

MTH2 (Accession NP_060753.1) is another GAM1338 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:12462, to the nucleotide sequence of GAM1338 RNA, herein designated GAM RNA, also designated SEQ ID:360.

Another function of GAM1338 is therefore inhibition of MTH2 (Accession NP_060753.1). Accordingly, utilities of GAM1338 include diagnosis, prevention and treatment of diseases and clinical conditions associated with MTH2.

5-methyltetrahydrofolate-homocysteine methyltransferase (MTR, Accession NP_000245.1) is another GAM1338 target gene, herein designated TARGET GENE. MTR BINDING SITE is a target binding site found in the 3' untranslated region of mRNA encoded by MTR, corresponding to a target binding site such as BINDING SITE I, BINDING SITE II or BINDING SITE III of FIG. 8. Table 4 illustrates the complementarity of the nucleotide sequences of MTR BINDING SITE, designated SEQ ID:13325, to the nucleotide sequence of GAM1338 RNA, herein designated GAM RNA, also designated SEQ ID:360.

Another function of GAM1338 is therefore inhibition of 5-methyltetrahydrofolate-homocysteine methyltransferase (MTR, Accession NP_000245.1). Accordingly, utilities of GAM1338 include diagnosis, prevention and treatment of diseases and clinical conditions associated with MTR.

Myosin id (MYO1D, Accession XP_050041.4) is another GAM1338 target gene, herein designated TARGET GENE. MYO1D BINDING SITE is a target binding site found in the 3' untranslated region of mRNA encoded by MYO1D, corresponding to a target binding site such as BINDING SITE I, BINDING SITE II or BINDING SITE III of FIG. 8. Table 4 illustrates the complementarity of the nucleotide sequences of MYO1D BINDING SITE, designated SEQ ID:2339, to the nucleotide sequence of GAM1338 RNA, herein designated GAM RNA, also designated SEQ ID:360.

Another function of GAM1338 is therefore inhibition of Myosin id (MYO1D, Accession XP_050041.4), a gene which is an unconventional myosin. Accordingly, utilities of GAM1338 include diagnosis, prevention and treatment of diseases and clinical conditions associated with MYO1D.

The function of MYO1D and its association with various diseases and clinical conditions, has been established by previous studies, as described hereinabove with reference to GAM227.1. Myosin 5c (MYO5C, Accession NP_061198.1) is another GAM1338 target gene, herein designated TARGET GENE. MYO5C BINDING SITE is a target binding site found in the 3' untranslated region of mRNA encoded by MYO5C, corresponding to a target binding site such as BINDING SITE I, BINDING SITE II or BINDING SITE III of FIG. 8. Table 4 illustrates the complementarity of the nucleotide sequences of MYO5C BINDING SITE, designated SEQ ID:14846, to the nucleotide sequence of GAM1338 RNA, herein designated GAM RNA, also designated SEQ ID:360.

Another function of GAM1338 is therefore inhibition of Myosin 5c (MYO5C, Accession NP_061198.1). Accordingly, utilities of GAM1338 include diagnosis, prevention and treatment of diseases and clinical conditions associated with MYO5C.

Nanog (Accession NP_079141.1) is another GAM1338 target gene, herein designated TARGET GENE. Nanog BINDING SITE is a target binding site found in the 3' untranslated region of mRNA encoded by Nanog, corresponding to a target binding site such as BINDING SITE I, BINDING SITE II or BINDING SITE III of FIG. 8. Table 4 illustrates the complementarity of the nucleotide sequences of Nanog BINDING SITE, designated SEQ ID:3109, to the nucleotide sequence of GAM1338 RNA, herein designated GAM RNA, also designated SEQ ID:360.

Another function of GAM1338 is therefore inhibition of Nanog (Accession NP_079141.1). Accordingly, utilities of GAM1338 include diagnosis, prevention and treatment of diseases and clinical conditions associated with Nanog.

NCAG1 (Accession NP_115536.1) is another GAM1338 target gene, herein designated TARGET GENE. NCAG1 BINDING SITE is a target binding site found in the 3' untranslated region of mRNA encoded by NCAG1, corresponding to a target binding site such as BINDING SITE I, BINDING SITE II or BINDING SITE III of FIG. 8. Table 4 illustrates the complementarity of the nucleotide sequences of NCAG1 BINDING SITE, designated SEQ ID:11436, to the nucleotide sequence of GAM1338 RNA, herein designated GAM RNA, also designated SEQ ID:360.

Another function of GAM1338 is therefore inhibition of NCAG1 (Accession NP_115536.1). Accordingly, utilities of GAM1338 include diagnosis, prevention and treatment of diseases and clinical conditions associated with NCAG1.

Nuclear receptor coactivator 6 (NCOA6, Accession NP_054790.1) is another GAM1338 target gene, herein designated TARGET GENE. NCOA6 BINDING SITE1 and NCOA6 BINDING SITE2 are target binding sites found in untranslated regions of mRNA encoded by NCOA6, corresponding to target binding sites such as BINDING SITE I, BINDING SITE II or BINDING SITE III of FIG. 8. Table 4 illustrates the complementarity of the nucleotide sequences of NCOA6 BINDING SITE1 and NCOA6 BINDING SITE2, designated SEQ ID:6181 and SEQ ID:5484 respectively, to the nucleotide sequence of GAM1338 RNA, herein designated GAM RNA, also designated SEQ ID:360.

Another function of GAM1338 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM1338 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Nuclear receptor coactivator 6 interacting protein (NCOA6IP, Accession NP_079107.5) is another GAM1338 target gene, herein designated TARGET GENE. NCOA6IP BINDING SITE1 and NCOA6IP BINDING SITE2 are target binding sites found in untranslated regions of mRNA encoded by NCOA6IP, corresponding to target binding sites such as BINDING SITE I, BINDING SITE II or BINDING SITE III of FIG. 8. Table 4 illustrates the complementarity of the nucleotide sequences of NCOA6IP BINDING SITE1 and NCOA6IP BINDING SITE2, designated SEQ ID:13249 and SEQ ID:3026 respectively, to the nucleotide sequence of GAM1338 RNA, herein designated GAM RNA, also designated SEQ ID:360.

Another function of GAM1338 is therefore inhibition of Nuclear receptor coactivator 6 interacting protein (NCOA6IP, Accession NP_079107.5). Accordingly, utilities of GAM1338 include diagnosis, prevention and treatment of diseases and clinical conditions associated with NCOA6IP.

Ndrg family member 3 (NDRG3, Accession NP_114402.1) is another GAM1338 target gene, herein designated TARGET GENE. NDRG3 BINDING SITE is a target binding site found in the 3' untranslated region of multiple transcripts of mRNA encoded by NDRG3, corresponding to a target binding site such as BINDING SITE I, BINDING SITE II or BINDING SITE III of FIG. 8. Table 4 illustrates the complementarity of the nucleotide sequences of NDRG3 BINDING SITE, designated SEQ ID:20109, to the nucleotide sequence of GAM1338 RNA, herein designated GAM RNA, also designated SEQ ID:360.

Another function of GAM1338 is therefore inhibition of Ndrg family member 3 (NDRG3, Accession NP_114402.1). Accordingly, utilities of GAM1338 include diagnosis, prevention and treatment of diseases and clinical conditions associated with NDRG3.

Nadh dehydrogenase (ubiquinone) 1, subcomplex unknown, 2, 14.5 kda (NDUFC2, Accession NP_004540.1) is another GAM1338 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:15362, to the nucleotide sequence of GAM1338 RNA, herein designated GAM RNA, also designated SEQ ID:360.

Another function of GAM1338 is therefore inhibition of Nadh dehydrogenase (ubiquinone) 1, subcomplex unknown, 2, 14.5 kda (NDUFC2, Accession NP_004540.1). Accordingly, utilities of GAM1338 include diagnosis, prevention and treatment of diseases and clinical conditions associated with NDUFC2.

Nadh dehydrogenase (ubiquinone) fe-s protein 1, 75 kda (nadh-coenzyme q reductase) (NDUFS1, Accession NP_004997.3) is another GAM1338 target gene, herein designated TARGET GENE. NDUFS1 BINDING SITE is a target binding site found in the 3' untranslated region of mRNA encoded by NDUFS1, corresponding to a target binding site such as BINDING SITE I, BINDING SITE II or BINDING SITE III of FIG. 8. Table 4 illustrates the complementarity of the nucleotide sequences of NDUFS1 BINDING SITE, designated SEQ ID:6109, to the nucleotide sequence of GAM1338 RNA, herein designated GAM RNA, also designated SEQ ID:360.

Another function of GAM1338 is therefore inhibition of Nadh dehydrogenase (ubiquinone) fe-s protein 1, 75 kda (nadh-coenzyme q reductase) (NDUFS1, Accession NP_004997.3). Accordingly, utilities of GAM1338 include diagnosis, prevention and treatment of diseases and clinical conditions associated with NDUFS1.

Sialidase 3 (membrane sialidase) (NEU3, Accession NP_006647.2) is another GAM1338 target gene, herein designated TARGET GENE. NEU3 BINDING SITE is a target binding site found in the 5' untranslated region of mRNA encoded by NEU3, corresponding to a target binding site such as BINDING SITE I, BINDING SITE II or BINDING SITE III of FIG. 8. Table 4 illustrates the complementarity of the nucleotide sequences of NEU3 BINDING SITE, designated SEQ ID:18182, to the nucleotide sequence of GAM1338 RNA, herein designated GAM RNA, also designated SEQ ID:360.

Another function of GAM1338 is therefore inhibition of Sialidase 3 (membrane sialidase) (NEU3, Accession NP_006647.2). Accordingly, utilities of GAM1338 include diagnosis, prevention and treatment of diseases and clinical conditions associated with NEU3.

Nucleolar protein 3 (apoptosis repressor with card domain) (NOL3, Accession NP_003937.1) is another GAM1338 target gene, herein designated TARGET GENE. NOL3 BINDING SITE is a target binding site found in the 3' untranslated region of mRNA encoded by NOL3, corresponding to a target binding site such as BINDING SITE I, BINDING SITE II or BINDING SITE III of FIG. 8. Table 4 illustrates the complementarity of the nucleotide sequences of NOL3 BINDING SITE, designated SEQ ID:18676, to the nucleotide sequence of GAM1338 RNA, herein designated GAM RNA, also designated SEQ ID:360.

Another function of GAM1338 is therefore inhibition of Nucleolar protein 3 (apoptosis repressor with card domain) (NOL3, Accession NP_003937.1), a gene which inhibits CASP2 and CASP8 and interacts with splicing factors. Accordingly, utilities of GAM1338 include diagnosis, prevention and treatment of diseases and clinical conditions associated with NOL3.

The function of NOL3 and its association with various diseases and clinical conditions, has been established by previous studies, as described hereinabove with reference to GAM47.1. Non-pou domain containing, octamer-binding (NONO, Accession NP_031389.2) is another GAM1338 target gene, herein designated TARGET GENE. NONO BINDING SITE is a target binding site found in the 3' untranslated region of mRNA encoded by NONO, corresponding to a target binding site such as BINDING SITE I, BINDING SITE II or BINDING SITE III of FIG. 8. Table 4 illustrates the complementarity of the nucleotide sequences of NONO BINDING SITE, designated SEQ ID:1412, to the nucleotide sequence of GAM1338 RNA, herein designated GAM RNA, also designated SEQ ID:360.

Another function of GAM1338 is therefore inhibition of Non-pou domain containing, octamer-binding (NONO, Accession NP_031389.2), a gene which is a nuclear protein which contains RNA recognition motifs. Accordingly, utilities of GAM1338 include diagnosis, prevention and treatment of diseases and clinical conditions associated with NONO.

The function of NONO and its association with various diseases and clinical conditions, has been established by previous studies, as described hereinabove with reference to GAM189.1. NOSIP (Accession NP_057037.1) is another GAM1338 target gene, herein designated TARGET GENE. NOSIP BINDING SITE is a target binding site found in the 5' untranslated region of mRNA encoded by NOSIP, corresponding to a target binding site such as BINDING SITE I, BINDING SITE II or BINDING SITE III of FIG. 8. Table 4 illustrates the complementarity of the nucleotide sequences of NOSIP BINDING SITE, designated SEQ ID:8269, to the nucleotide sequence of GAM1338 RNA, herein designated GAM RNA, also designated SEQ ID:360.

Another function of GAM1338 is therefore inhibition of NOSIP (Accession NP_057037.1). Accordingly, utilities of GAM1338 include diagnosis, prevention and treatment of diseases and clinical conditions associated with NOSIP.

Nadph oxidase, ef hand calcium-binding domain 5 (NOX5, Accession NP_078781.2) is another GAM1338 target gene, herein designated TARGET GENE. NOX5 BINDING SITE is a target binding site found in the 5' untranslated region of mRNA encoded by NOX5, corresponding to a target binding site such as BINDING SITE I, BINDING SITE II or BINDING SITE III of FIG. 8. Table 4 illustrates the complementarity of the nucleotide sequences of NOX5 BINDING SITE, designated SEQ ID:7634, to the nucleotide sequence of GAM1338 RNA, herein designated GAM RNA, also designated SEQ ID:360.

Another function of GAM1338 is therefore inhibition of Nadph oxidase, ef hand calcium-binding domain 5 (NOX5, Accession NP_078781.2). Accordingly, utilities of GAM1338 include diagnosis, prevention and treatment of diseases and clinical conditions associated with NOX5.

Neuronal pentraxin receptor (NPTXR, Accession NP_478058.1) is another GAM1338 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:17176, to the nucleotide sequence of GAM1338 RNA, herein designated GAM RNA, also designated SEQ ID:360.

Another function of GAM1338 is therefore inhibition of Neuronal pentraxin receptor (NPTXR, Accession NP_478058.1). Accordingly, utilities of GAM1338 include diagnosis, prevention and treatment of diseases and clinical conditions associated with NPTXR.

Neuronal pentraxin receptor (NPTXR, Accession NP_055108.2) is another GAM1338 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:17176, to the nucleotide sequence of GAM1338 RNA, herein designated GAM RNA, also designated SEQ ID:360.

Another function of GAM1338 is therefore inhibition of Neuronal pentraxin receptor (NPTXR, Accession NP_055108.2). Accordingly, utilities of GAM1338 include diagnosis, prevention and treatment of diseases and clinical conditions associated with NPTXR.

Nad(p)h dehydrogenase, quinone 1 (NQO1, Accession NP_000894.1) is another GAM1338 target gene, herein designated TARGET GENE. NQO1 BINDING SITE is a target binding site found in the 3' untranslated region of mRNA encoded by NQO1, corresponding to a target binding site such as BINDING SITE I, BINDING SITE II or BINDING SITE III of FIG. 8. Table 4 illustrates the complementarity of the nucleotide sequences of NQO1 BINDING SITE, designated SEQ ID:18183, to the nucleotide sequence of GAM1338 RNA, herein designated GAM RNA, also designated SEQ ID:360.

Another function of GAM1338 is therefore inhibition of Nad(p)h dehydrogenase, quinone 1 (NQO1, Accession NP_000894.1), a gene which is cytochrome b5 reductase which reduces redox dyes and quinones. Accordingly, utilities of GAM1338 include diagnosis, prevention and treatment of diseases and clinical conditions associated with NQO1.

The function of NQO1 and its association with various diseases and clinical conditions, has been established by previous studies, as described hereinabove with reference to GAM189.1. NRLN1 (Accession NP_660277.1) is another GAM1338 target gene, herein designated TARGET GENE. NRLN1 BINDING SITE is a target binding site found in the 5' untranslated region of mRNA encoded by NRLN1, corresponding to a target binding site such as BINDING SITE I, BINDING SITE II or BINDING SITE III of FIG. 8. Table 4 illustrates the complementarity of the nucleotide sequences of NRLN1 BINDING SITE, designated SEQ ID:15192, to the nucleotide sequence of GAM1338 RNA, herein designated GAM RNA, also designated SEQ ID:360.

Another function of GAM1338 is therefore inhibition of NRLN1 (Accession NP_660277.1). Accordingly, utilities of GAM1338 include diagnosis, prevention and treatment of diseases and clinical conditions associated with NRLN1.

5'-nucleotidase, cytosolic ii (NT5C2, Accession NP_036361.1) is another GAM1338 target gene, herein designated TARGET GENE. NT5C2 BINDING SITE is a target binding site found in the 5' untranslated region of mRNA encoded by NT5C2, corresponding to a target binding site such as BINDING SITE I, BINDING SITE II or BINDING SITE III of FIG. 8. Table 4 illustrates the complementarity of the nucleotide sequences of NT5C2 BINDING SITE, designated SEQ ID:15388, to the nucleotide sequence of GAM1338 RNA, herein designated GAM RNA, also designated SEQ ID:360.

Another function of GAM1338 is therefore inhibition of 5'-nucleotidase, cytosolic ii (NT5C2, Accession NP_036361.1). Accordingly, utilities of GAM1338 include diagnosis, prevention and treatment of diseases and clinical conditions associated with NT5C2.

NUP43 (Accession NP_078923.2) is another GAM1338 target gene, herein designated TARGET GENE. NUP43 BINDING SITE is a target binding site found in the 3' untranslated region of mRNA encoded by NUP43, corresponding to a target binding site such as BINDING SITE I, BINDING SITE II or BINDING SITE III of FIG. 8. Table 4 illustrates the complementarity of the nucleotide sequences of NUP43 BINDING SITE, designated SEQ ID:9379, to the nucleotide sequence of GAM1338 RNA, herein designated GAM RNA, also designated SEQ ID:360.

Another function of GAM1338 is therefore inhibition of NUP43 (Accession NP_078923.2). Accordingly, utilities of GAM1338 include diagnosis, prevention and treatment of diseases and clinical conditions associated with NUP43.

Nucleoredoxin (NXN, Accession NP_071908.1) is another GAM1338 target gene, herein designated TARGET GENE. NXN BINDING SITE is a target binding site found in the 3' untranslated region of mRNA encoded by NXN, corresponding to a target binding site such as BINDING SITE I, BINDING SITE II or BINDING SITE III of FIG. 8. Table 4 illustrates the complementarity of the nucleotide sequences of NXN BINDING SITE, designated SEQ ID:436, to the nucleotide sequence of GAM1338 RNA, herein designated GAM RNA, also designated SEQ ID:360.

Another function of GAM1338 is therefore inhibition of Nucleoredoxin (NXN, Accession NP_071908.1). Accordingly, utilities of GAM1338 include diagnosis, prevention and treatment of diseases and clinical conditions associated with NXN.

OIP106 (Accession NP_055780.1) is another GAM1338 target gene, herein designated TARGET GENE. OIP106 BINDING SITE is a target binding site found in the 5' untranslated region of mRNA encoded by OIP106, corresponding to a target binding site such as BINDING SITE I, BINDING SITE II or BINDING SITE III of FIG. 8. Table 4 illustrates the complementarity of the nucleotide sequences of OIP106 BINDING SITE, designated SEQ ID:10262, to the nucleotide sequence of GAM1338 RNA, herein designated GAM RNA, also designated SEQ ID:360.

Another function of GAM1338 is therefore inhibition of OIP106 (Accession NP_055780.1). Accordingly, utilities of GAM1338 include diagnosis, prevention and treatment of diseases and clinical conditions associated with OIP106.

Olfactory receptor, family 51, subfamily e, member 2 (OR51E2, Accession NP_110401.1) is another GAM1338 target gene, herein designated TARGET GENE. OR51E2 BINDING SITE is a target binding site found in the 3' untranslated region of mRNA encoded by OR51E2, corresponding to a target binding site such as BINDING SITE I, BINDING SITE II or BINDING SITE III of FIG. 8. Table 4 illustrates the complementarity of the nucleotide sequences of OR51E2 BINDING SITE, designated SEQ ID:8690, to the nucleotide sequence of GAM1338 RNA, herein designated GAM RNA, also designated SEQ ID:360.

Another function of GAM1338 is therefore inhibition of Olfactory receptor, family 51, subfamily e, member 2 (OR51E2, Accession NP_110401.1). Accordingly, utilities of GAM1338 include diagnosis, prevention and treatment of diseases and clinical conditions associated with OR51E2.

Origin recognition complex, subunit 1-like (yeast) (ORC1L, Accession NP_004144.1) is another GAM1338 target gene, herein designated TARGET GENE. ORC1L BINDING SITE is a target binding site found in the 3' untranslated region of mRNA encoded by ORC1L, corresponding to a target binding site such as BINDING SITE I, BINDING SITE II or BINDING SITE III of FIG. 8. Table 4 illustrates the complementarity of the nucleotide sequences of ORC1L BINDING SITE, designated SEQ ID:436, to the nucleotide sequence of GAM1338 RNA, herein designated GAM RNA, also designated SEQ ID:360.

Another function of GAM1338 is therefore inhibition of Origin recognition complex, subunit 1-like (yeast) (ORC1L, Accession NP_004144.1), a gene which may be required for initiation of DNA replication. Accordingly, utilities of GAM1338 include diagnosis, prevention and treatment of diseases and clinical conditions associated with ORC1L.

The function of ORC1L and its association with various diseases and clinical conditions, has been established by previous studies, as described hereinabove with reference to GAM136.1. Oxysterol binding protein-like 2 (OSBPL2, Accession NP_055650.1) is another GAM1338 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:18258, to the nucleotide sequence of GAM1338 RNA, herein designated GAM RNA, also designated SEQ ID:360.

Another function of GAM1338 is therefore inhibition of Oxysterol binding protein-like 2 (OSBPL2, Accession NP_055650.1). Accordingly, utilities of GAM1338 include diagnosis, prevention and treatment of diseases and clinical conditions associated with OSBPL2.

Oxysterol binding protein-like 2 (OSBPL2, Accession NP_653081.1) is another GAM1338 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:18258, to the nucleotide sequence of GAM1338 RNA, herein designated GAM RNA, also designated SEQ ID:360.

Another function of GAM1338 is therefore inhibition of Oxysterol binding protein-like 2 (OSBPL2, Accession NP_653081.1). Accordingly, utilities of GAM1338 include diagnosis, prevention and treatment of diseases and clinical conditions associated with OSBPL2.

Otoancorin (OTOA, Accession NP_733764.1) is another GAM1338 target gene, herein designated TARGET GENE. OTOA BINDING SITE is a target binding site found in the 5' untranslated region of multiple transcripts of mRNA encoded by OTOA, corresponding to a target binding site such as BINDING SITE I, BINDING SITE II or BINDING SITE III of FIG. 8. Table 4 illustrates the complementarity of the nucleotide sequences of OTOA BINDING SITE, designated SEQ ID:9822, to the nucleotide sequence of GAM1338 RNA, herein designated GAM RNA, also designated SEQ ID:360.

Another function of GAM1338 is therefore inhibition of Otoancorin (OTOA, Accession NP_733764.1). Accordingly, utilities of GAM1338 include diagnosis, prevention and treatment of diseases and clinical conditions associated with OTOA.

Purinergic receptor p2y, g-protein coupled, 11 (P2RY11, Accession NP_002557.2) is another GAM1338 target gene, herein designated TARGET GENE. P2RY11 BINDING SITE is a target binding site found in the 3' untranslated region of mRNA encoded by P2RY11, corresponding to a target binding site such as BINDING SITE I, BINDING SITE II or BINDING SITE III of FIG. 8. Table 4 illustrates the complementarity of the nucleotide sequences of P2RY11 BINDING SITE, designated SEQ ID:6710, to the nucleotide sequence of GAM1338 RNA, herein designated GAM RNA, also designated SEQ ID:360.

Another function of GAM1338 is therefore inhibition of Purinergic receptor p2y, g-protein coupled, 11 (P2RY11, Accession NP_002557.2). Accordingly, utilities of GAM1338 include diagnosis, prevention and treatment of diseases and clinical conditions associated with P2RY11.

Phosphoribosylaminoimidazole carboxylase, phosphoribosylaminoimidazole succinocarboxamide synthetase (PAICS, Accession NP_006443.1) is another GAM1338 target gene, herein designated TARGET GENE. PAICS BINDING SITE is a target binding site found in the 3' untranslated region of mRNA encoded by PAICS, corresponding to a target binding site such as BINDING SITE I, BINDING SITE II or BINDING SITE III of FIG. 8. Table 4 illustrates the complementarity of the nucleotide sequences of PAICS BINDING SITE, designated SEQ ID:11127, to the nucleotide sequence of GAM1338 RNA, herein designated GAM RNA, also designated SEQ ID:360.

Another function of GAM1338 is therefore inhibition of Phosphoribosylaminoimidazole carboxylase, phosphoribosylaminoimidazole succinocarboxamide synthetase (PAICS, Accession NP_006443.1), a gene which is required for purine biosynthesis. Accordingly, utilities of GAM1338 include diagnosis, prevention and treatment of diseases and clinical conditions associated with PAICS.

The function of PAICS and its association with various diseases and clinical conditions, has been established by previous studies, as described hereinabove with reference to GAM96.1. Pantothenate kinase 3 (PANK3, Accession NP_078870.1) is another GAM1338 target gene, herein designated TARGET GENE. PANK3 BINDING SITE is a target binding site found in the 3' untranslated region of mRNA encoded by PANK3, corresponding to a target binding site such as BINDING SITE I, BINDING SITE II or BINDING SITE III of FIG. 8. Table 4 illustrates the complementarity of the nucleotide sequences of PANK3 BINDING SITE, designated SEQ ID:18008, to the nucleotide sequence of GAM1338 RNA, herein designated GAM RNA, also designated SEQ ID:360.

Another function of GAM1338 is therefore inhibition of Pantothenate kinase 3 (PANK3, Accession NP_078870.1). Accordingly, utilities of GAM1338 include diagnosis, prevention and treatment of diseases and clinical conditions associated with PANK3.

Pas domain containing serine/threonine kinase (PASK, Accession NP_055963.1) is another GAM1338 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:3230, to the nucleotide sequence of GAM1338 RNA, herein designated GAM RNA, also designated SEQ ID:360.

Another function of GAM1338 is therefore inhibition of Pas domain containing serine/threonine kinase (PASK, Accession NP_055963.1). Accordingly, utilities of GAM1338 include diagnosis, prevention and treatment of diseases and clinical conditions associated with PASK.

Protocadherin alpha 9 (PCDHA9, Accession NP_054724.1) is another GAM1338 target gene, herein designated TARGET GENE. PCDHA9 BINDING SITE1 and PCDHA9 BINDING SITE2 are target binding sites found in untranslated regions of multiple transcripts of mRNA encoded by PCDHA9, corresponding to target binding sites such as BINDING SITE I, BINDING SITE II or BINDING SITE III of FIG. 8. Table 4 illustrates the complementarity of the nucleotide sequences of PCDHA9 BINDING SITE1 and PCDHA9 BINDING SITE2, designated SEQ ID:10631 and SEQ ID:11879 respectively, to the nucleotide sequence of GAM1338 RNA, herein designated GAM RNA, also designated SEQ ID:360.

Another function of GAM1338 is therefore inhibition of Protocadherin alpha 9 (PCDHA9, Accession NP_054724.1), a gene which is a calcium-dependent cell-adhesion protein. Accordingly, utilities of GAM1338 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Protocadherin beta 16 (PCDHB16, Accession NP_066008.1) is another GAM1338 target gene, herein designated TARGET GENE. PCDHB16 BINDING SITE is a target binding site found in the 3' untranslated region of mRNA encoded by PCDHB16, corresponding to a target binding site such as BINDING SITE I, BINDING SITE II or BINDING SITE III of FIG. 8. Table 4 illustrates the complementarity of the nucleotide sequences of PCDHB16 BINDING SITE, designated SEQ ID:4753, to the nucleotide sequence of GAM1338 RNA, herein designated GAM RNA, also designated SEQ ID:360.

Another function of GAM1338 is therefore inhibition of Protocadherin beta 16 (PCDHB16, Accession NP_066008.1), a gene which is a potential calcium-dependent cell-adhesion protein. Accordingly, utilities of GAM1338 include diagnosis, prevention and treatment of diseases and clinical conditions associated with PCDHB16.

The function of PCDHB16 and its association with various diseases and clinical conditions, has been established by previous studies, as described hereinabove with reference to GAM189.1. Protocadherin beta 9 (PCDHB9, Accession NP_061992.2) is another GAM1338 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:3109, to the nucleotide sequence of GAM1338 RNA, herein designated GAM RNA, also designated SEQ ID:360.

Another function of GAM1338 is therefore inhibition of Protocadherin beta 9 (PCDHB9, Accession NP_061992.2), a gene which is a potential calcium-dependent cell-adhesion protein. Accordingly, utilities of GAM1338 include diagnosis, prevention and treatment of diseases and clinical conditions associated with PCDHB9.

The function of PCDHB9 and its association with various diseases and clinical conditions, has been established by previous studies, as described hereinabove with reference to GAM72.1. Phosphodiesterase 6b, cgmp-specific, rod, beta (congenital stationary night blindness 3, autosomal dominant) (PDE6B, Accession NP_000274.1) is another GAM1338 target gene, herein designated TARGET GENE. PDE6B BINDING SITE is a target binding site found in the 3' untranslated region of mRNA encoded by PDE6B, corresponding to a target binding site such as BINDING SITE I, BINDING SITE II or BINDING SITE III of FIG. 8. Table 4 illustrates the complementarity of the nucleotide sequences of PDE6B BINDING SITE, designated SEQ ID:18070, to the nucleotide sequence of GAM1338 RNA, herein designated GAM RNA, also designated SEQ ID:360.

Another function of GAM1338 is therefore inhibition of Phosphodiesterase 6b, cgmp-specific, rod, beta (congenital stationary night blindness 3, autosomal dominant) (PDE6B, Accession NP_000274.1). Accordingly, utilities of GAM1338 include diagnosis, prevention and treatment of diseases and clinical conditions associated with PDE6B.

Platelet derived growth factor c (PDGFC, Accession NP_057289.1) is another GAM1338 target gene, herein designated TARGET GENE. PDGFC BINDING SITE1 and PDGFC BINDING SITE2 are target binding sites found in untranslated regions of mRNA encoded by PDGFC, corresponding to target binding sites such as BINDING SITE I, BINDING SITE II or BINDING SITE III of FIG. 8. Table 4 illustrates the complementarity of the nucleotide sequences of PDGFC BINDING SITE1 and PDGFC BINDING SITE2, designated SEQ ID:19767 and SEQ ID:3930 respectively, to the nucleotide sequence of GAM1338 RNA, herein designated GAM RNA, also designated SEQ ID:360.

Another function of GAM1338 is therefore inhibition of Platelet derived growth factor c (PDGFC, Accession NP_057289.1). Accordingly, utilities of GAM1338 include diagnosis, prevention and treatment of diseases and clinical conditions associated with PDGFC.

Pdz and lim domain 2 (mystique) (PDLIM2, Accession NP_789847.1) is another GAM1338 target gene, herein designated TARGET GENE. PDLIM2 BINDING SITE is a target binding site found in the 3' untranslated region of multiple transcripts of mRNA encoded by PDLIM2, corresponding to a target binding site such as BINDING SITE I, BINDING SITE II or BINDING SITE III of FIG. 8. Table 4 illustrates the complementarity of the nucleotide sequences of PDLIM2 BINDING SITE, designated SEQ ID:4874, to the nucleotide sequence of GAM1338 RNA, herein designated GAM RNA, also designated SEQ ID:360.

Another function of GAM1338 is therefore inhibition of Pdz and lim domain 2 (mystique) (PDLIM2, Accession NP_789847.1). Accordingly, utilities of GAM1338 include diagnosis, prevention and treatment of diseases and clinical conditions associated with PDLIM2.

Pdz domain containing 1 (PDZK1, Accession NP_002605.2) is another GAM1338 target gene, herein designated TARGET GENE. PDZK1 BINDING SITE is a target binding site found in the 5' untranslated region of mRNA encoded by PDZK1, corresponding to a target binding site such as BINDING SITE I, BINDING SITE II or BINDING SITE III of FIG. 8. Table 4 illustrates the complementarity of the nucleotide sequences of PDZK1 BINDING SITE, designated SEQ ID:11598, to the nucleotide sequence of GAM1338 RNA, herein designated GAM RNA, also designated SEQ ID:360.

Another function of GAM1338 is therefore inhibition of Pdz domain containing 1 (PDZK1, Accession NP_002605.2), a gene which is a contains PDZ interaction domains, interacts with MAP17, a protein involved in control of cell proliferation. and therefore may be associated with Autosomal dominant hypophosphatemic rickets. Accordingly, utilities of GAM1338 include diagnosis, prevention and treatment of Autosomal dominant hypophosphatemic rickets, and of other diseases and clinical conditions associated with PDZK1.

The function of PDZK1 and its association with various diseases and clinical conditions, has been established by previous studies, as described hereinabove with reference to GAM136.1. PDZRN1 (Accession NP_699202.1) is another GAM1338 target gene, herein designated TARGET GENE. PDZRN1 BINDING SITE is a target binding site found in the 3' untranslated region of mRNA encoded by PDZRN1, corresponding to a target binding site such as BINDING SITE I, BINDING SITE II or BINDING SITE III of FIG. 8. Table 4 illustrates the complementarity of the nucleotide sequences of PDZRN1 BINDING SITE, designated SEQ ID:17567, to the nucleotide sequence of GAM1338 RNA, herein designated GAM RNA, also designated SEQ ID:360.

Another function of GAM1338 is therefore inhibition of PDZRN1 (Accession NP_699202.1). Accordingly, utilities of GAM1338 include diagnosis, prevention and treatment of diseases and clinical conditions associated with PDZRN1.

Pellino homolog 1 (drosophila) (PELI1, Accession NP_065702.2) is another GAM1338 target gene, herein designated TARGET GENE. PELI1 BINDING SITE1 through PELI1 BINDING SITE3 are target binding sites found in untranslated regions of mRNA encoded by PELI1, corresponding to target binding sites such as BINDING SITE I, BINDING SITE II or BINDING SITE III of FIG. 8. Table 4 illustrates the complementarity of the nucleotide sequences of PELI1 BINDING SITE1 through PELI1 BINDING SITE3, designated SEQ ID:18182, SEQ ID:430 and SEQ ID:13801 respectively, to the nucleotide sequence of GAM1338 RNA, herein designated GAM RNA, also designated SEQ ID:360.

Another function of GAM1338 is therefore inhibition of Pellino homolog 1 (drosophila) (PELI1, Accession NP_065702.2). Accordingly, utilities of GAM1338 include diagnosis, prevention and treatment of diseases and clinical conditions associated with PELI1.

Period homolog 2 (drosophila) (PER2, Accession NP_073728.1) is another GAM1338 target gene, herein designated TARGET GENE. PER2 BINDING SITE is a target binding site found in the 3' untranslated region of multiple transcripts of mRNA encoded by PER2, corresponding to a target binding site such as BINDING SITE I, BINDING SITE II or BINDING SITE III of FIG. 8. Table 4 illustrates the complementarity of the nucleotide sequences of PER2 BINDING SITE, designated SEQ ID:6602, to the nucleotide sequence of GAM1338 RNA, herein designated GAM RNA, also designated SEQ ID:360.

Another function of GAM1338 is therefore inhibition of Period homolog 2 (drosophila) (PER2, Accession NP_073728.1), a gene which Period homolog 2; putative circadian clock protein; has a PAS dimerization domain and therefore may be associated with Familial advanced sleep-phase syndrome. Accordingly, utilities of GAM1338 include diagnosis, prevention and treatment of Familial advanced sleep-phase syndrome, and of other diseases and clinical conditions associated with PER2.

The function of PER2 and its association with various diseases and clinical conditions, has been established by previous studies, as described hereinabove with reference to GAM130.1. Peroxisome biogenesis factor 10 (PEX10, Accession NP_722540.1) is another GAM1338 target gene, herein designated TARGET GENE. PEX10 BINDING SITE is a target binding site found in the 3' untranslated region of multiple transcripts of mRNA encoded by PEX10, corresponding to a target binding site such as BINDING SITE I, BINDING SITE II or BINDING SITE III of FIG. 8. Table 4 illustrates the complementarity of the nucleotide sequences of PEX10 BINDING SITE, designated SEQ ID:7262, to the nucleotide sequence of GAM1338 RNA, herein designated GAM RNA, also designated SEQ ID:360.

Another function of GAM1338 is therefore inhibition of Peroxisome biogenesis factor 10 (PEX10, Accession NP_722540.1). Accordingly, utilities of GAM1338 include diagnosis, prevention and treatment of diseases and clinical conditions associated with PEX10.

Peroxisome biogenesis factor 10 (PEX10, Accession NP_002608.1) is another GAM1338 target gene, herein designated TARGET GENE. PEX10 BINDING SITE is a target binding site found in the 3' untranslated region of multiple transcripts of mRNA encoded by PEX10, corresponding to a target binding site such as BINDING SITE I, BINDING SITE II or BINDING SITE III of FIG. 8. Table 4 illustrates the complementarity of the nucleotide sequences of PEX10 BINDING SITE, designated SEQ ID:7262, to the nucleotide sequence of GAM1338 RNA, herein designated GAM RNA, also designated SEQ ID:360.

Another function of GAM1338 is therefore inhibition of Peroxisome biogenesis factor 10 (PEX10, Accession NP_002608.1). Accordingly, utilities of GAM1338 include diagnosis, prevention and treatment of diseases and clinical conditions associated with PEX10.

PHAX (Accession NP_115553.1) is another GAM1338 target gene, herein designated TARGET GENE. PHAX BINDING SITE is a target binding site found in the 3' untranslated region of mRNA encoded by PHAX, corresponding to a target binding site such as BINDING SITE I, BINDING SITE II or BINDING SITE III of FIG. 8. Table 4 illustrates the complementarity of the nucleotide sequences of PHAX BINDING SITE, designated SEQ ID:12387, to the nucleotide sequence of GAM1338 RNA, herein designated GAM RNA, also designated SEQ ID:360.

Another function of GAM1338 is therefore inhibition of PHAX (Accession NP_115553.1). Accordingly, utilities of GAM1338 include diagnosis, prevention and treatment of diseases and clinical conditions associated with PHAX.

Polymeric immunoglobulin receptor (PIGR, Accession NP_002635.2) is another GAM1338 target gene, herein designated TARGET GENE. PIGR BINDING SITE is a target binding site found in the 3' untranslated region of mRNA encoded by PIGR, corresponding to a target binding site such as BINDING SITE I, BINDING SITE II or BINDING SITE III of FIG. 8. Table 4 illustrates the complementarity of the nucleotide sequences of PIGR BINDING SITE, designated SEQ ID:8350, to the nucleotide sequence of GAM1338 RNA, herein designated GAM RNA, also designated SEQ ID:360.

Another function of GAM1338 is therefore inhibition of Polymeric immunoglobulin receptor (PIGR, Accession NP_002635.2). Accordingly, utilities of GAM1338 include diagnosis, prevention and treatment of diseases and clinical conditions associated with PIGR.

Phosphoinositide-3-kinase, class 2, beta polypeptide (PIK3C2B, Accession NP_002637.2) is another GAM1338 target gene, herein designated TARGET GENE. PIK3C2B BINDING SITE is a target binding site found in the 3' untranslated region of mRNA encoded by PIK3C2B, corresponding to a target binding site such as BINDING SITE I, BINDING SITE II or BINDING SITE III of FIG. 8. Table 4 illustrates the complementarity of the nucleotide sequences of PIK3C2B BINDING SITE, designated SEQ ID:15277, to the nucleotide sequence of GAM1338 RNA, herein designated GAM RNA, also designated SEQ ID:360.

Another function of GAM1338 is therefore inhibition of Phosphoinositide-3-kinase, class 2, beta polypeptide (PIK3C2B, Accession NP_002637.2). Accordingly, utilities of GAM1338 include diagnosis, prevention and treatment of diseases and clinical conditions associated with PIK3C2B.

Phosphoinositide-3-kinase, catalytic, delta polypeptide (PIK3CD, Accession NP_005017.2) is another GAM1338 target gene, herein designated TARGET GENE. PIK3CD BINDING SITE is a target binding site found in the 3' untranslated region of mRNA encoded by PIK3CD, corresponding to a target binding site such as BINDING SITE I, BINDING SITE II or BINDING SITE III of FIG. 8. Table 4 illustrates the complementarity of the nucleotide sequences of PIK3CD BINDING SITE, designated SEQ ID:4771, to the nucleotide sequence of GAM1338 RNA, herein designated GAM RNA, also designated SEQ ID:360.

Another function of GAM1338 is therefore inhibition of Phosphoinositide-3-kinase, catalytic, delta polypeptide (PIK3CD, Accession NP_005017.2), a gene which regulating cell growth. Accordingly, utilities of GAM1338 include diagnosis, prevention and treatment of diseases and clinical conditions associated with PIK3CD.

The function of PIK3CD and its association with various diseases and clinical conditions, has been established by previous studies, as described hereinabove with reference to GAM136.1. Pbx/knotted 1 homeobox 1 (PKNOX1, Accession NP_004562.2) is another GAM1338 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:11464, to the nucleotide sequence of GAM1338 RNA, herein designated GAM RNA, also designated SEQ ID:360.

Another function of GAM1338 is therefore inhibition of Pbx/knotted 1 homeobox 1 (PKNOX1, Accession NP_004562.2), a gene which may regulate gene expression and control cell differentiation. Accordingly, utilities of GAM1338 include diagnosis, prevention and treatment of diseases and clinical conditions associated with PKNOX1.

The function of PKNOX1 and its association with various diseases and clinical conditions, has been established by previous studies, as described hereinabove with reference to GAM55.1. Pro-melanin-concentrating hormone-like 1 (PMCHL1, Accession NP_114093.1) is another GAM1338 target gene, herein designated TARGET GENE. PMCHL1 BINDING SITE1 and PMCHL1 BINDING SITE2 are target binding sites found in untranslated regions of mRNA encoded by PMCHL1, corresponding to target binding sites such as BINDING SITE I, BINDING SITE II or BINDING SITE III of FIG. 8. Table 4 illustrates the complementarity of the nucleotide sequences of PMCHL1 BINDING SITE1 and PMCHL1 BINDING SITE2, designated SEQ ID:12367 and SEQ ID:982 respectively, to the nucleotide sequence of GAM1338 RNA, herein designated GAM RNA, also designated SEQ ID:360.

Another function of GAM1338 is therefore inhibition of Pro-melanin-concentrating hormone-like 1 (PMCHL1, Accession NP_114093.1). Accordingly, utilities of GAM1338 include diagnosis, prevention and treatment of diseases and clinical conditions associated with PMCHL1.

Pro-melanin-concentrating hormone-like 2 (PMCHL2, Accession NP_114094.1) is another GAM1338 target gene, herein designated TARGET GENE. PMCHL2 BINDING SITE1 and PMCHL2 BINDING SITE2 are target binding sites found in untranslated regions of mRNA encoded by PMCHL2, corresponding to target binding sites such as BINDING SITE I, BINDING SITE II or BINDING SITE III of FIG. 8. Table 4 illustrates the complementarity of the nucleotide sequences of PMCHL2 BINDING SITE1 and PMCHL2 BINDING SITE2, designated SEQ ID:12367 and SEQ ID:982 respectively, to the nucleotide sequence of GAM1338 RNA, herein designated GAM RNA, also designated SEQ ID:360.

Another function of GAM1338 is therefore inhibition of Pro-melanin-concentrating hormone-like 2 (PMCHL2, Accession NP_114094.1). Accordingly, utilities of GAM1338 include diagnosis, prevention and treatment of diseases and clinical conditions associated with PMCHL2.

PMPCA (Accession NP_055975.1) is another GAM1338 target gene, herein designated TARGET GENE. PMPCA BINDING SITE is a target binding site found in the 3' untranslated region of mRNA encoded by PMPCA, corresponding to a target binding site such as BINDING SITE I, BINDING SITE II or BINDING SITE III of FIG. 8. Table 4 illustrates the complementarity of the nucleotide sequences of PMPCA BINDING SITE, designated SEQ ID:7152, to the nucleotide sequence of GAM1338 RNA, herein designated GAM RNA, also designated SEQ ID:360.

Another function of GAM1338 is therefore inhibition of PMPCA (Accession NP_055975.1). Accordingly, utilities of GAM1338 include diagnosis, prevention and treatment of diseases and clinical conditions associated with PMPCA.

Paraneoplastic antigen ma2 (PNMA2, Accession NP_009188.1) is another GAM1338 target gene, herein designated TARGET GENE. PNMA2 BINDING SITE1 and PNMA2 BINDING SITE2 are target binding sites found in untranslated regions of mRNA encoded by PNMA2, corresponding to target binding sites such as BINDING SITE I, BINDING SITE II or BINDING SITE III of FIG. 8. Table 4 illustrates the complementarity of the nucleotide sequences of PNMA2 BINDING SITE1 and PNMA2 BINDING SITE2, designated SEQ ID:11236 and SEQ ID:11189 respectively, to the nucleotide sequence of GAM1338 RNA, herein designated GAM RNA, also designated SEQ ID:360.

Another function of GAM1338 is therefore inhibition of Paraneoplastic antigen ma2 (PNMA2, Accession NP_009188.1). Accordingly, utilities of GAM1338 include diagnosis, prevention and treatment of diseases and clinical conditions associated with PNMA2.

Protein o-fucosyltransferase 1 (POFUT1, Accession NP_056167.1) is another GAM1338 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:1760, to the nucleotide sequence of GAM1338 RNA, herein designated GAM RNA, also designated SEQ ID:360.

Another function of GAM1338 is therefore inhibition of Protein o-fucosyltransferase 1 (POFUT1, Accession NP_056167.1) . Accordingly, utilities of GAM1338 include diagnosis, prevention and treatment of diseases and clinical conditions associated with POFUT1.

Polymerase (dna directed), epsilon 3 (p17 subunit) (POLE3, Accession NP_059139.2) is another GAM1338 target gene, herein designated TARGET GENE. POLE3 BINDING SITE is a target binding site found in the 3' untranslated region of mRNA encoded by POLE3, corresponding to a target binding site such as BINDING SITE I, BINDING SITE II or BINDING SITE III of FIG. 8. Table 4 illustrates the complementarity of the nucleotide sequences of POLE3 BINDING SITE, designated SEQ ID:5665, to the nucleotide sequence of GAM1338 RNA, herein designated GAM RNA, also designated SEQ ID:360.

Another function of GAM1338 is therefore inhibition of Polymerase (dna directed), epsilon 3 (p17 subunit) (POLE3, Accession NP_059139.2). Accordingly, utilities of GAM1338 include diagnosis, prevention and treatment of diseases and clinical conditions associated with POLE3.

Polymerase (rna) ii (dna directed) polypeptide d (POLR2D, Accession NP_004796.1) is another GAM1338 target gene, herein designated TARGET GENE. POLR2D BINDING SITE1 and POLR2D BINDING SITE2 are target binding sites found in untranslated regions of mRNA encoded by POLR2D, corresponding to target binding sites such as BINDING SITE I, BINDING SITE II or BINDING SITE III of FIG. 8. Table 4 illustrates the complementarity of the nucleotide sequences of POLR2D BINDING SITE1 and POLR2D BINDING SITE2, designated SEQ ID:850 and SEQ ID:11282 respectively, to the nucleotide sequence of GAM1338 RNA, herein designated GAM RNA, also designated SEQ ID:360.

Another function of GAM1338 is therefore inhibition of Polymerase (rna) ii (dna directed) polypeptide d (POLR2D, Accession NP_004796.1). Accordingly, utilities of GAM1338 include diagnosis, prevention and treatment of diseases and clinical conditions associated with POLR2D.

Paraoxonase 1 (PON1, Accession NP_000437.3) is another GAM1338 target gene, herein designated TARGET GENE. PON1 BINDING SITE is a target binding site found in the 3' untranslated region of mRNA encoded by PON1, corresponding to a target binding site such as BINDING SITE I, BINDING SITE II or BINDING SITE III of FIG. 8. Table 4 illustrates the complementarity of the nucleotide sequences of PON1 BINDING SITE, designated SEQ ID:19429, to the nucleotide sequence of GAM1338 RNA, herein designated GAM RNA, also designated SEQ ID:360.

Another function of GAM1338 is therefore inhibition of Paraoxonase 1 (PON1, Accession NP_000437.3), a gene which hydrolyzes the toxic metabolites of a variety of organophosphorus insecticides. Accordingly, utilities of GAM1338 include diagnosis, prevention and treatment of diseases and clinical conditions associated with PON1.

The function of PON1 and its association with various diseases and clinical conditions, has been established by previous studies, as described hereinabove with reference to GAM189.1. Pou domain, class 2, associating factor 1 (POU2AF1, Accession NP_006226.1) is another GAM1338 target gene, herein designated TARGET GENE. POU2AF1 BINDING SITE is a target binding site found in the 3' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:4674, to the nucleotide sequence of GAM1338 RNA, herein designated GAM RNA, also designated SEQ ID:360.

Another function of GAM1338 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM1338 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. Pou domain, class 2, transcription factor 3 (POU2F3, Accession NP_055167.1) is another GAM1338 target gene, herein designated TARGET GENE. POU2F3 BINDING SITE is a target binding site found in the 3' untranslated region of mRNA encoded by POU2F3, corresponding to a target binding site such as BINDING SITE I, BINDING SITE II or BINDING SITE III of FIG. 8. Table 4 illustrates the complementarity of the nucleotide sequences of POU2F3 BINDING SITE, designated SEQ ID:7036, to the nucleotide sequence of GAM1338 RNA, herein designated GAM RNA, also designated SEQ ID:360.

Another function of GAM1338 is therefore inhibition of Pou domain, class 2, transcription factor 3 (POU2F3, Accession NP_055167.1). Accordingly, utilities of GAM1338 include diagnosis, prevention and treatment of diseases and clinical conditions associated with POU2F3.

Pou domain, class 3, transcription factor 1 (POU3F1, Accession NP_002690.2) is another GAM1338 target gene, herein designated TARGET GENE. POU3F1 BINDING SITE is a target binding site found in the 3' untranslated region of mRNA encoded by POU3F1, corresponding to a target binding site such as BINDING SITE I, BINDING SITE II or BINDING SITE III of FIG. 8. Table 4 illustrates the complementarity of the nucleotide sequences of POU3F1 BINDING SITE, designated SEQ ID:7918, to the nucleotide sequence of GAM1338 RNA, herein designated GAM RNA, also designated SEQ ID:360.

Another function of GAM1338 is therefore inhibition of Pou domain, class 3, transcription factor 1 (POU3F1, Accession NP_002690.2), a gene which involves in early embryogenesis and neurogenesis. Accordingly, utilities of GAM1338 include diagnosis, prevention and treatment of diseases and clinical conditions associated with POU3F1.

The function of POU3F1 and its association with various diseases and clinical conditions, has been established by previous studies, as described hereinabove with reference to GAM281.1. PP3856 (Accession NP_660202.1) is another GAM1338 target gene, herein designated TARGET GENE. PP3856 BINDING SITE is a target binding site found in the 5' untranslated region of mRNA encoded by PP3856, corresponding to a target binding site such as BINDING SITE I, BINDING SITE II or BINDING SITE III of FIG. 8. Table 4 illustrates the complementarity of the nucleotide sequences of PP3856 BINDING SITE, designated SEQ ID:6293, to the nucleotide sequence of GAM1338 RNA, herein designated GAM RNA, also designated SEQ ID:360.

Another function of GAM1338 is therefore inhibition of PP3856 (Accession NP_660202.1). Accordingly, utilities of GAM1338 include diagnosis, prevention and treatment of diseases and clinical conditions associated with PP3856.

Protein phosphatase, ef hand calcium-binding domain 2 (PPEF2, Accession NP_690911.1) is another GAM1338 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:568, to the nucleotide sequence of GAM1338 RNA, herein designated GAM RNA, also designated SEQ ID:360.

Another function of GAM1338 is therefore inhibition of Protein phosphatase, ef hand calcium-binding domain 2 (PPEF2, Accession NP_690911.1), a gene which is a homolog of Drosophila rdgC. Accordingly, utilities of GAM1338 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_690910.1) is another GAM1338 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:568, to the nucleotide sequence of GAM1338 RNA, herein designated GAM RNA, also designated SEQ ID:360.

Another function of GAM1338 is therefore inhibition of Protein phosphatase, ef hand calcium-binding domain 2 (PPEF2, Accession NP_690910.1), a gene which is a homolog of Drosophila rdgC. Accordingly, utilities of GAM1338 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_006230.2) is another GAM1338 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:568, to the nucleotide sequence of GAM1338 RNA, herein designated GAM RNA, also designated SEQ ID:360.

Another function of GAM1338 is therefore inhibition of Protein phosphatase, ef hand calcium-binding domain 2 (PPEF2, Accession NP_006230.2), a gene which is a homolog of Drosophila rdgC. Accordingly, utilities of GAM1338 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein tyrosine phosphatase, receptor type, f polypeptide (ptprf), interacting protein (liprin), alpha 4 (PPFIA4, Accession XP_046751.3) is another GAM1338 target gene, herein designated TARGET GENE. PPFIA4 BINDING SITE is a target binding site found in the 3' untranslated region of mRNA encoded by PPFIA4, corresponding to a target binding site such as BINDING SITE I, BINDING SITE II or BINDING SITE III of FIG. 8. Table 4 illustrates the complementarity of the nucleotide sequences of PPFIA4 BINDING SITE, designated SEQ ID:10102, to the nucleotide sequence of GAM1338 RNA, herein designated GAM RNA, also designated SEQ ID:360.

Another function of GAM1338 is therefore inhibition of Protein tyrosine phosphatase, receptor type, f polypeptide (ptprf), interacting protein (liprin), alpha 4 (PPFIA4, Accession XP_046751.3). Accordingly, utilities of GAM1338 include diagnosis, prevention and treatment of diseases and clinical conditions associated with PPFIA4.

Ptprf interacting protein, binding protein 1 (liprin beta 1) (PPFIBP1, Accession NP_003613.2) is another GAM1338 target gene, herein designated TARGET GENE. PPFIBP1 BINDING SITE1 and PPFIBP1 BINDING SITE2 are target binding sites found in untranslated regions of multiple transcripts of mRNA encoded by PPFIBP1, corresponding to target binding sites such as BINDING SITE I, BINDING SITE II or BINDING SITE III of FIG. 8. Table 4 illustrates the complementarity of the nucleotide sequences of PPFIBP1 BINDING SITE1 and PPFIBP1 BINDING SITE2, designated SEQ ID:8861 and SEQ ID:5523 respectively, to the nucleotide sequence of GAM1338 RNA, herein designated GAM RNA, also designated SEQ ID:360.

Another function of GAM1338 is therefore inhibition of Ptprf interacting protein, binding protein 1 (liprin beta 1) (PPFIBP1, Accession NP_003613.2). Accordingly, utilities of GAM1338 include diagnosis, prevention and treatment of diseases and clinical conditions associated with PPFIBP1.

Peptidylprolyl isomerase d (cyclophilin d) (PPID, Accession NP_005029.1) is another GAM1338 target gene, herein designated TARGET GENE. PPID BINDING SITE is a target binding site found in the 3' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:3110, to the nucleotide sequence of GAM1338 RNA, herein designated GAM RNA, also designated SEQ ID:360.

Another function of GAM1338 is therefore inhibition of Peptidylprolyl isomerase d (cyclophilin d) (PPID, Accession NP_005029.1), a gene which catalyzes the cis-trans isomerization of proline imidic peptide bonds in oligopeptides. Accordingly, utilities of GAM1338 include diagnosis, prevention and treatment of diseases and clinical conditions associated with PPID.

The function of PPID and its association with various diseases and clinical conditions, has been established by previous studies, as described hereinabove with reference to GAM136.1. Peptidylprolyl isomerase (cyclophilin)-like 2 (PPIL2, Accession NP_055152.1) is another GAM1338 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:18677, to the nucleotide sequence of GAM1338 RNA, herein designated GAM RNA, also designated SEQ ID:360.

Another function of GAM1338 is therefore inhibition of Peptidylprolyl isomerase (cyclophilin)-like 2 (PPIL2, Accession NP_055152.1). Accordingly, utilities of GAM1338 include diagnosis, prevention and treatment of diseases and clinical conditions associated with PPIL2.

Protein phosphatase 1, regulatory (inhibitor) subunit 12b (PPP1R12B, Accession NP_115288.1) is another GAM1338 target gene, herein designated TARGET GENE. PPP1R12B BINDING SITE1 and PPP1R12B BINDING SITE2 are target binding sites found in untranslated regions of multiple transcripts of mRNA encoded by PPP1R12B, corresponding to target binding sites such as BINDING SITE I, BINDING SITE II or BINDING SITE III of FIG. 8. Table 4 illustrates the complementarity of the nucleotide sequences of PPP1R12B BINDING SITE1 and PPP1R12B BINDING SITE2, designated SEQ ID:17555 and SEQ ID:14820 respectively, to the nucleotide sequence of GAM1338 RNA, herein designated GAM RNA, also designated SEQ ID:360.

Another function of GAM1338 is therefore inhibition of Protein phosphatase 1, regulatory (inhibitor) subunit 12b (PPP1R12B, Accession NP_115288.1). Accordingly, utilities of GAM1338 include diagnosis, prevention and treatment of diseases and clinical conditions associated with PPP1R12B.

Protein phosphatase 1, regulatory (inhibitor) subunit 12b (PPP1R12B, Accession NP_002472.1) is another GAM1338 target gene, herein designated TARGET GENE. PPP1R12B BINDING SITE1 and PPP1R12B BINDING SITE2 are target binding sites found in untranslated regions of multiple transcripts of mRNA encoded by PPP1R12B, corresponding to target binding sites such as BINDING SITE I, BINDING SITE II or BINDING SITE III of FIG. 8. Table 4 illustrates the complementarity of the nucleotide sequences of PPP1R12B BINDING SITE1 and PPP1R12B BINDING SITE2, designated SEQ ID:17555 and SEQ ID:14820 respectively, to the nucleotide sequence of GAM1338 RNA, herein designated GAM RNA, also designated SEQ ID:360.

Another function of GAM1338 is therefore inhibition of Protein phosphatase 1, regulatory (inhibitor) subunit 12b (PPP1R12B, Accession NP_002472.1). Accordingly, utilities of GAM1338 include diagnosis, prevention and treatment of diseases and clinical conditions associated with PPP1R12B.

Primase, polypeptide 2a, 58 kda (PRIM2A, Accession NP_000938.1) is another GAM1338 target gene, herein designated TARGET GENE. PRIM2A BINDING SITE is a target binding site found in the 3' untranslated region of mRNA encoded by PRIM2A, corresponding to a target binding site such as BINDING SITE I, BINDING SITE II or BINDING SITE III of FIG. 8. Table 4 illustrates the complementarity of the nucleotide sequences of PRIM2A BINDING SITE, designated SEQ ID:12707, to the nucleotide sequence of GAM1338 RNA, herein designated GAM RNA, also designated SEQ ID:360.

Another function of GAM1338 is therefore inhibition of Primase, polypeptide 2a, 58 kda (PRIM2A, Accession NP_000938.1). Accordingly, utilities of GAM1338 include diagnosis, prevention and treatment of diseases and clinical conditions associated with PRIM2A.

Protein kinase, interferon-inducible double stranded rna dependent (PRKR, Accession NP_002750.1) is another GAM1338 target gene, herein designated TARGET GENE. PRKR BINDING SITE is a target binding site found in the 3' untranslated region of mRNA encoded by PRKR, corresponding to a target binding site such as BINDING SITE I, BINDING SITE II or BINDING SITE III of FIG. 8. Table 4 illustrates the complementarity of the nucleotide sequences of PRKR BINDING SITE, designated SEQ ID:17566, to the nucleotide sequence of GAM1338 RNA, herein designated GAM RNA, also designated SEQ ID:360.

Another function of GAM1338 is therefore inhibition of Protein kinase, interferon-inducible double stranded rna dependent (PRKR, Accession NP_002750.1), a gene which catalyze the phosphorylation of the alpha subunit of eif2. and therefore may be associated with Huntington's disease. Accordingly, utilities of GAM1338 include diagnosis, prevention and treatment of Huntington's disease, and of other diseases and clinical conditions associated with PRKR.

The function of PRKR and its association with various diseases and clinical conditions, has been established by previous studies, as described hereinabove with reference to GAM136.1. Protein kinase, lysine deficient 3 (PRKWNK3, Accession NP_065973.1) is another GAM1338 target gene, herein designated TARGET GENE. PRKWNK3 BINDING SITE is a target binding site found in the 3' untranslated region of mRNA encoded by PRKWNK3, corresponding to a target binding site such as BINDING SITE I, BINDING SITE II or BINDING SITE III of FIG. 8. Table 4 illustrates the complementarity of the nucleotide sequences of PRKWNK3 BINDING SITE, designated SEQ ID:5524, to the nucleotide sequence of GAM1338 RNA, herein designated GAM RNA, also designated SEQ ID:360.

Another function of GAM1338 is therefore inhibition of Protein kinase, lysine deficient 3 (PRKWNK3, Accession NP_065973.1). Accordingly, utilities of GAM1338 include diagnosis, prevention and treatment of diseases and clinical conditions associated with PRKWNK3.

Prion protein 2 (dublet) (PRND, Accession NP_036541.1) is another GAM1338 target gene, herein designated TARGET GENE. PRND BINDING SITE1 and PRND BINDING SITE2 are target binding sites found in untranslated regions of mRNA encoded by PRND, corresponding to target binding sites such as BINDING SITE I, BINDING SITE II or BINDING SITE III of FIG. 8. Table 4 illustrates the complementarity of the nucleotide sequences of PRND BINDING SITE1 and PRND BINDING SITE2, designated SEQ ID:5776 and SEQ ID:7084 respectively, to the nucleotide sequence of GAM1338 RNA, herein designated GAM RNA, also designated SEQ ID:360.

Another function of GAM1338 is therefore inhibition of Prion protein 2 (dublet) (PRND, Accession NP_036541.1), a gene which is similar to prion protein PRNP. Accordingly, utilities of GAM1338 include diagnosis, prevention and treatment of diseases and clinical conditions associated with PRND.

The function of PRND and its association with various diseases and clinical conditions, has been established by previous studies, as described hereinabove with reference to GAM116.1. PRO0297 (Accession NP_054800.1) is another GAM1338 target gene, herein designated TARGET GENE. PRO0297 BINDING SITE is a target binding site found in the 5' untranslated region of mRNA encoded by PRO0297, corresponding to a target binding site such as BINDING SITE I, BINDING SITE II or BINDING SITE III of FIG. 8. Table 4 illustrates the complementarity of the nucleotide sequences of PRO0297 BINDING SITE, designated SEQ ID:1504, to the nucleotide sequence of GAM1338 RNA, herein designated GAM RNA, also designated SEQ ID:360.

Another function of GAM1338 is therefore inhibition of PRO0297 (Accession NP_054800.1). Accordingly, utilities of GAM1338 include diagnosis, prevention and treatment of diseases and clinical conditions associated with PRO0297.

PRO0365 (Accession NP_054845.1) is another GAM1338 target gene, herein designated TARGET GENE. PRO0365 BINDING SITE is a target binding site found in the 5' untranslated region of mRNA encoded by PRO0365, corresponding to a target binding site such as BINDING SITE I, BINDING SITE II or BINDING SITE III of FIG. 8. Table 4 illustrates the complementarity of the nucleotide sequences of PRO0365 BINDING SITE, designated SEQ ID:7958, to the nucleotide sequence of GAM1338 RNA, herein designated GAM RNA, also designated SEQ ID:360.

Another function of GAM1338 is therefore inhibition of PRO0365 (Accession NP_054845.1). Accordingly, utilities of GAM1338 include diagnosis, prevention and treatment of diseases and clinical conditions associated with PRO0365.

PRO1048 (Accession NP_060967.1) is another GAM1338 target gene, herein designated TARGET GENE. PRO1048 BINDING SITE is a target binding site found in the 3' untranslated region of mRNA encoded by PRO1048, corresponding to a target binding site such as BINDING SITE I, BINDING SITE II or BINDING SITE III of FIG. 8. Table 4 illustrates the complementarity of the nucleotide sequences of PRO1048 BINDING SITE, designated SEQ ID:2738, to the nucleotide sequence of GAM1338 RNA, herein designated GAM RNA, also designated SEQ ID:360.

Another function of GAM1338 is therefore inhibition of PRO1048 (Accession NP_060967.1). Accordingly, utilities of GAM1338 include diagnosis, prevention and treatment of diseases and clinical conditions associated with PRO1048.

PROM2 (Accession NP_653308.1) is another GAM1338 target gene, herein designated TARGET GENE. PROM2 BINDING SITE1 and PROM2 BINDING SITE2 are target binding sites found in untranslated regions of mRNA encoded by PROM2, corresponding to target binding sites such as BINDING SITE I, BINDING SITE II or BINDING SITE III of FIG. 8. Table 4 illustrates the complementarity of the nucleotide sequences of PROM2 BINDING SITE1 and PROM2 BINDING SITE2, designated SEQ ID:19427 and SEQ ID:6958 respectively, to the nucleotide sequence of GAM1338 RNA, herein designated GAM RNA, also designated SEQ ID:360.

Another function of GAM1338 is therefore inhibition of PROM2 (Accession NP_653308.1). Accordingly, utilities of GAM1338 include diagnosis, prevention and treatment of diseases and clinical conditions associated with PROM2.

Proteasome (prosome, macropain) 26s subunit, non-atpase, 9 (PSMD9, Accession NP_002804.2) is another GAM1338 target gene, herein designated TARGET GENE. PSMD9 BINDING SITE is a target binding site found in the 3' untranslated region of mRNA encoded by PSMD9, corresponding to a target binding site such as BINDING SITE I, BINDING SITE II or BINDING SITE III of FIG. 8. Table 4 illustrates the complementarity of the nucleotide sequences of PSMD9 BINDING SITE, designated SEQ ID:11654, to the nucleotide sequence of GAM1338 RNA, herein designated GAM RNA, also designated SEQ ID:360.

Another function of GAM1338 is therefore inhibition of Proteasome (prosome, macropain) 26s subunit, non-atpase, 9 (PSMD9, Accession NP_002804.2), a gene which acts as a regulatory subunit of the 26 proteasome. Accordingly, utilities of GAM1338 include diagnosis, prevention and treatment of diseases and clinical conditions associated with PSMD9.

The function of PSMD9 and its association with various diseases and clinical conditions, has been established by previous studies, as described hereinabove with reference to GAM30.1. Phosphoserine phosphatase (PSPH, Accession NP_004568.1) is another GAM1338 target gene, herein designated TARGET GENE. PSPH BINDING SITE is a target binding site found in the 3' untranslated region of mRNA encoded by PSPH, corresponding to a target binding site such as BINDING SITE I, BINDING SITE II or BINDING SITE III of FIG. 8. Table 4 illustrates the complementarity of the nucleotide sequences of PSPH BINDING SITE, designated SEQ ID:9102, to the nucleotide sequence of GAM1338 RNA, herein designated GAM RNA, also designated SEQ ID:360.

Another function of GAM1338 is therefore inhibition of Phosphoserine phosphatase (PSPH, Accession NP_004568.1). Accordingly, utilities of GAM1338 include diagnosis, prevention and treatment of diseases and clinical conditions associated with PSPH.

Proline-serine-threonine phosphatase interacting protein 2 (PSTPIP2, Accession NP_077748.2) is another GAM1338 target gene, herein designated TARGET GENE. PSTPIP2 BINDING SITE is a target binding site found in the 3' untranslated region of mRNA encoded by PSTPIP2, corresponding to a target binding site such as BINDING SITE I, BINDING SITE II or BINDING SITE III of FIG. 8. Table 4 illustrates the complementarity of the nucleotide sequences of PSTPIP2 BINDING SITE, designated SEQ ID:14086, to the nucleotide sequence of GAM1338 RNA, herein designated GAM RNA, also designated SEQ ID:360.

Another function of GAM1338 is therefore inhibition of Proline-serine-threonine phosphatase interacting protein 2 (PSTPIP2, Accession NP_077748.2). Accordingly, utilities of GAM1338 include diagnosis, prevention and treatment of diseases and clinical conditions associated with PSTPIP2.

Prostaglandin e synthase (PTGES, Accession NP_004869.1) is another GAM1338 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:11575, to the nucleotide sequence of GAM1338 RNA, herein designated GAM RNA, also designated SEQ ID:360.

Another function of GAM1338 is therefore inhibition of Prostaglandin e synthase (PTGES, Accession NP_004869.1). Accordingly, utilities of GAM1338 include diagnosis, prevention and treatment of diseases and clinical conditions associated with PTGES.

Prostaglandin i2 (prostacyclin) synthase (PTGIS, Accession NP_000952.1) is another GAM1338 target gene, herein designated TARGET GENE. PTGIS BINDING SITE1 and PTGIS BINDING SITE2 are target binding sites found in untranslated regions of mRNA encoded by PTGIS, corresponding to target binding sites such as BINDING SITE I, BINDING SITE II or BINDING SITE III of FIG. 8. Table 4 illustrates the complementarity of the nucleotide sequences of PTGIS BINDING SITE1 and PTGIS BINDING SITE2, designated SEQ ID:11917 and SEQ ID:13582 respectively, to the nucleotide sequence of GAM1338 RNA, herein designated GAM RNA, also designated SEQ ID:360.

Another function of GAM1338 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM1338 include diagnosis, prevention and treatment of diseases and clinical conditions associated with PTGIS.

The function of PTGIS and its association with various diseases and clinical conditions, has been established by previous studies, as described hereinabove with reference to GAM30.1. Ptk2 protein tyrosine kinase 2 (PTK2, Accession NP_005598.3) is another GAM1338 target gene, herein designated TARGET GENE. PTK2 BINDING SITE is a target binding site found in the 5' untranslated region of multiple transcripts of mRNA encoded by PTK2, corresponding to a target binding site such as BINDING SITE I, BINDING SITE II or BINDING SITE III of FIG. 8. Table 4 illustrates the complementarity of the nucleotide sequences of PTK2 BINDING SITE, designated SEQ ID:17374, to the nucleotide sequence of GAM1338 RNA, herein designated GAM RNA, also designated SEQ ID:360.

Another function of GAM1338 is therefore inhibition of Ptk2 protein tyrosine kinase 2 (PTK2, Accession NP_005598.3), a gene which involves in intracellular signal transduction pathway and is a putative homolog of chicken focal adhesion associated kinase. Accordingly, utilities of GAM1338 include diagnosis, prevention and treatment of diseases and clinical conditions associated with PTK2.

The function of PTK2 and its association with various diseases and clinical conditions, has been established by previous studies, as described hereinabove with reference to GAM65.2. Phosphorylase, glycogen; muscle (mcardle syndrome, glycogen storage disease type v) (PYGM, Accession NP_005600.1) is another GAM1338 target gene, herein designated TARGET GENE. PYGM BINDING SITE is a target binding site found in the 5' untranslated region of mRNA encoded by PYGM, corresponding to a target binding site such as BINDING SITE I, BINDING SITE II or BINDING SITE III of FIG. 8. Table 4 illustrates the complementarity of the nucleotide sequences of PYGM BINDING SITE, designated SEQ ID:4024, to the nucleotide sequence of GAM1338 RNA, herein designated GAM RNA, also designated SEQ ID:360.

Another function of GAM1338 is therefore inhibition of Phosphorylase, glycogen; muscle (mcardle syndrome, glycogen storage disease type v) (PYGM, Accession NP_005600.1). Accordingly, utilities of GAM1338 include diagnosis, prevention and treatment of diseases and clinical conditions associated with PYGM.

RAB11-FIP4 (Accession NP_116321.2) is another GAM1338 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:5406, to the nucleotide sequence of GAM1338 RNA, herein designated GAM RNA, also designated SEQ ID:360.

Another function of GAM1338 is therefore inhibition of RAB11-FIP4 (Accession NP_116321.2). Accordingly, utilities of GAM1338 include diagnosis, prevention and treatment of diseases and clinical conditions associated with RAB11-FIP4.

Rab31, member ras oncogene family (RAB31, Accession NP_006859.1) is another GAM1338 target gene, herein designated TARGET GENE. RAB31 BINDING SITE is a target binding site found in the 3' untranslated region of mRNA encoded by RAB31, corresponding to a target binding site such as BINDING SITE I, BINDING SITE II or BINDING SITE III of FIG. 8. Table 4 illustrates the complementarity of the nucleotide sequences of RAB31 BINDING SITE, designated SEQ ID:536, to the nucleotide sequence of GAM1338 RNA, herein designated GAM RNA, also designated SEQ ID:360.

Another function of GAM1338 is therefore inhibition of Rab31, member ras oncogene family (RAB31, Accession NP_006859.1), a gene which is an GTP-binding protein of the RAB family. Accordingly, utilities of GAM1338 include diagnosis, prevention and treatment of diseases and clinical conditions associated with RAB31.

The function of RAB31 and its association with various diseases and clinical conditions, has been established by previous studies, as described hereinabove with reference to GAM145.1. Rab33b, member ras oncogene family (RAB33B, Accession NP_112586.1) is another GAM1338 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:15333, to the nucleotide sequence of GAM1338 RNA, herein designated GAM RNA, also designated SEQ ID:360.

Another function of GAM1338 is therefore inhibition of Rab33b, member ras oncogene family (RAB33B, Accession NP_112586.1). Accordingly, utilities of GAM1338 include diagnosis, prevention and treatment of diseases and clinical conditions associated with RAB33B.

Rab36, member ras oncogene family (RAB36, Accession NP_004905.1) is another GAM1338 target gene, herein designated TARGET GENE. RAB36 BINDING SITE is a target binding site found in the 3' untranslated region of mRNA encoded by RAB36, corresponding to a target binding site such as BINDING SITE I, BINDING SITE II or BINDING SITE III of FIG. 8. Table 4 illustrates the complementarity of the nucleotide sequences of RAB36 BINDING SITE, designated SEQ ID:15649, to the nucleotide sequence of GAM1338 RNA, herein designated GAM RNA, also designated SEQ ID:360.

Another function of GAM1338 is therefore inhibition of Rab36, member ras oncogene family (RAB36, Accession NP_004905.1), a gene which is involved in protein transport.

Accordingly, utilities of GAM1338 include diagnosis, prevention and treatment of diseases and clinical conditions associated with RAB36.

The function of RAB36 and its association with various diseases and clinical conditions, has been established by previous studies, as described hereinabove with reference to GAM130.1. Rab39, member ras oncogene family (RAB39, Accession XP_084662.1) is another GAM1338 target gene, herein designated TARGET GENE. RAB39 BINDING SITE is a target binding site found in the 3' untranslated region of mRNA encoded by RAB39, corresponding to a target binding site such as BINDING SITE I, BINDING SITE II or BINDING SITE III of FIG. 8. Table 4 illustrates the complementarity of the nucleotide sequences of RAB39 BINDING SITE, designated SEQ ID:2158, to the nucleotide sequence of GAM1338 RNA, herein designated GAM RNA, also designated SEQ ID:360.

Another function of GAM1338 is therefore inhibition of Rab39, member ras oncogene family (RAB39, Accession XP_084662.1). Accordingly, utilities of GAM1338 include diagnosis, prevention and treatment of diseases and clinical conditions associated with RAB39.

Rab, member of ras oncogene family-like 2a (RABL2A, Accession NP_038198.1) is another GAM1338 target gene, herein designated TARGET GENE. RABL2A BINDING SITE is a target binding site found in the 3' untranslated region of multiple transcripts of mRNA encoded by RABL2A, corresponding to a target binding site such as BINDING SITE I, BINDING SITE II or BINDING SITE III of FIG. 8. Table 4 illustrates the complementarity of the nucleotide sequences of RABL2A BINDING SITE, designated SEQ ID:14847, to the nucleotide sequence of GAM1338 RNA, herein designated GAM RNA, also designated SEQ ID:360.

Another function of GAM1338 is therefore inhibition of Rab, member of ras oncogene family-like 2a (RABL2A, Accession NP_038198.1). Accordingly, utilities of GAM1338 include diagnosis, prevention and treatment of diseases and clinical conditions associated with RABL2A.

Rab, member of ras oncogene family-like 2b (RABL2B, Accession NP_009012.1) is another GAM1338 target gene, herein designated TARGET GENE. RABL2B BINDING SITE is a target binding site found in the 3' untranslated region of mRNA encoded by RABL2B, corresponding to a target binding site such as BINDING SITE I, BINDING SITE II or BINDING SITE III of FIG. 8. Table 4 illustrates the complementarity of the nucleotide sequences of RABL2B BINDING SITE, designated SEQ ID:14847, to the nucleotide sequence of GAM1338 RNA, herein designated GAM RNA, also designated SEQ ID:360.

Another function of GAM1338 is therefore inhibition of Rab, member of ras oncogene family-like 2b (RABL2B, Accession NP_009012.1). Accordingly, utilities of GAM1338 include diagnosis, prevention and treatment of diseases and clinical conditions associated with RABL2B.

RAI (Accession NP_006654.1) is another GAM1338 target gene, herein designated TARGET GENE. RAI BINDING SITE is a target binding site found in the 5' untranslated region of mRNA encoded by RAI, corresponding to a target binding site such as BINDING SITE I, BINDING SITE II or BINDING SITE III of FIG. 8. Table 4 illustrates the complementarity of the nucleotide sequences of RAI BINDING SITE, designated SEQ ID:17223, to the nucleotide sequence of GAM1338 RNA, herein designated GAM RNA, also designated SEQ ID:360.

Another function of GAM1338 is therefore inhibition of RAI (Accession NP_006654.1). Accordingly, utilities of GAM1338 include diagnosis, prevention and treatment of diseases and clinical conditions associated with RAI.

Retinoic acid induced 3 (RAI3, Accession NP_003970.1) is another GAM1338 target gene, herein designated TARGET GENE. RAI3 BINDING SITE is a target binding site found in the 3' untranslated region of mRNA encoded by RAI3, corresponding to a target binding site such as BINDING SITE I, BINDING SITE II or BINDING SITE III of FIG. 8. Table 4 illustrates the complementarity of the nucleotide sequences of RAI3 BINDING SITE, designated SEQ ID:16116, to the nucleotide sequence of GAM1338 RNA, herein designated GAM RNA, also designated SEQ ID:360.

Another function of GAM1338 is therefore inhibition of Retinoic acid induced 3 (RAI3, Accession NP_003970.1). Accordingly, utilities of GAM1338 include diagnosis, prevention and treatment of diseases and clinical conditions associated with RAI3.

RAP140 (Accession NP_056039.1) is another GAM1338 target gene, herein designated TARGET GENE. RAP140 BINDING SITE is a target binding site found in the 3' untranslated region of mRNA encoded by RAP140, corresponding to a target binding site such as BINDING SITE I, BINDING SITE II or BINDING SITE III of FIG. 8. Table 4 illustrates the complementarity of the nucleotide sequences of RAP140 BINDING SITE, designated SEQ ID:9663, to the nucleotide sequence of GAM1338 RNA, herein designated GAM RNA, also designated SEQ ID:360.

Another function of GAM1338 is therefore inhibition of RAP140 (Accession NP_056039.1). Accordingly, utilities of GAM1338 include diagnosis, prevention and treatment of diseases and clinical conditions associated with RAP140.

Retinoic acid receptor, gamma (RARG, Accession NP_000957.1) is another GAM1338 target gene, herein designated TARGET GENE. RARG BINDING SITE is a target binding site found in the 5' untranslated region of mRNA encoded by RARG, corresponding to a target binding site such as BINDING SITE I, BINDING SITE II or BINDING SITE III of FIG. 8. Table 4 illustrates the complementarity of the nucleotide sequences of RARG BINDING SITE, designated SEQ ID:18678, to the nucleotide sequence of GAM1338 RNA, herein designated GAM RNA, also designated SEQ ID:360.

Another function of GAM1338 is therefore inhibition of Retinoic acid receptor, gamma (RARG, Accession NP_000957.1). Accordingly, utilities of GAM1338 include diagnosis, prevention and treatment of diseases and clinical conditions associated with RARG.

Ras association (ralgds/af-6) domain family 2 (RASSF2, Accession NP_739579.1) is another GAM1338 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:7664, to the nucleotide sequence of GAM1338 RNA, herein designated GAM RNA, also designated SEQ ID:360.

Another function of GAM1338 is therefore inhibition of Ras association (ralgds/af-6) domain family 2 (RASSF2, Accession NP_739579.1). Accordingly, utilities of GAM1338 include diagnosis, prevention and treatment of diseases and clinical conditions associated with RASSF2.

Ras association (ralgds/af-6) domain family 2 (RASSF2, Accession NP_739580.1) is another GAM1338 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:7664, to the nucleotide sequence of GAM1338 RNA, herein designated GAM RNA, also designated SEQ ID:360.

Another function of GAM1338 is therefore inhibition of Ras association (ralgds/af-6) domain family 2 (RASSF2, Accession NP_739580.1). Accordingly, utilities of GAM1338 include diagnosis, prevention and treatment of diseases and clinical conditions associated with RASSF2.

Ras association (ralgds/af-6) domain family 2 (RASSF2, Accession NP_055552.1) is another GAM1338 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:7664, to the nucleotide sequence of GAM1338 RNA, herein designated GAM RNA, also designated SEQ ID:360.

Another function of GAM1338 is therefore inhibition of Ras association (ralgds/af-6) domain family 2 (RASSF2, Accession NP_055552.1). Accordingly, utilities of GAM1338 include diagnosis, prevention and treatment of diseases and clinical conditions associated with RASSF2.

Retinoblastoma binding protein 9 (RBBP9, Accession NP_006597.2) is another GAM1338 target gene, herein designated TARGET GENE. RBBP9 BINDING SITE is a target binding site found in the 3' untranslated region of multiple transcripts of mRNA encoded by RBBP9, corresponding to a target binding site such as BINDING SITE I, BINDING SITE II or BINDING SITE III of FIG. 8. Table 4 illustrates the complementarity of the nucleotide sequences of RBBP9 BINDING SITE, designated SEQ ID:2397, to the nucleotide sequence of GAM1338 RNA, herein designated GAM RNA, also designated SEQ ID:360.

Another function of GAM1338 is therefore inhibition of Retinoblastoma binding protein 9 (RBBP9, Accession NP_006597.2). Accordingly, utilities of GAM1338 include diagnosis, prevention and treatment of diseases and clinical conditions associated with RBBP9.

RCBTB1 (Accession NP_060661.2) is another GAM1338 target gene, herein designated TARGET GENE. RCBTB1 BINDING SITE is a target binding site found in the 5' untranslated region of mRNA encoded by RCBTB1, corresponding to a target binding site such as BINDING SITE I, BINDING SITE II or BINDING SITE III of FIG. 8. Table 4 illustrates the complementarity of the nucleotide sequences of RCBTB1 BINDING SITE, designated SEQ ID:3049, to the nucleotide sequence of GAM1338 RNA, herein designated GAM RNA, also designated SEQ ID:360.

Another function of GAM1338 is therefore inhibition of RCBTB1 (Accession NP_060661.2). Accordingly, utilities of GAM1338 include diagnosis, prevention and treatment of diseases and clinical conditions associated with RCBTB1.

RDH13 (Accession NP_612421.1) is another GAM1338 target gene, herein designated TARGET GENE. RDH13 BINDING SITE is a target binding site found in the 5' untranslated region of mRNA encoded by RDH13, corresponding to a target binding site such as BINDING SITE I, BINDING SITE II or BINDING SITE III of FIG. 8. Table 4 illustrates the complementarity of the nucleotide sequences of RDH13 BINDING SITE, designated SEQ ID:11485, to the nucleotide sequence of GAM1338 RNA, herein designated GAM RNA, also designated SEQ ID:360.

Another function of GAM1338 is therefore inhibition of RDH13 (Accession NP_612421.1). Accordingly, utilities of GAM1338 include diagnosis, prevention and treatment of diseases and clinical conditions associated with RDH13.

Arginine-glutamic acid dipeptide (re) repeats (RERE, Accession NP_036234.2) is another GAM1338 target gene, herein designated TARGET GENE. RERE BINDING SITE is a target binding site found in the 3' untranslated region of mRNA encoded by RERE, corresponding to a target binding site such as BINDING SITE I, BINDING SITE II or BINDING SITE III of FIG. 8. Table 4 illustrates the complementarity of the nucleotide sequences of RERE BINDING SITE, designated SEQ ID:8833, to the nucleotide sequence of GAM1338 RNA, herein designated GAM RNA, also designated SEQ ID:360.

Another function of GAM1338 is therefore inhibition of Arginine-glutamic acid dipeptide (re) repeats (RERE, Accession NP_036234.2), a gene which binds DRPLA and locates in the nucleus and therefore may be associated with Dentatorubral-pallidoluysian atrophy. Accordingly, utilities of GAM1338 include diagnosis, prevention and treatment of Dentatorubral-pallidoluysian atrophy, and of other diseases and clinical conditions associated with RERE.

The function of RERE and its association with various diseases and clinical conditions, has been established by previous studies, as described hereinabove with reference to GAM47.1. Regulator of g-protein signalling 3 (RGS3, Accession NP_570613.1) is another GAM1338 target gene, herein designated TARGET GENE. RGS3 BINDING SITE is a target binding site found in the 5' untranslated region of multiple transcripts of mRNA encoded by RGS3, corresponding to a target binding site such as BINDING SITE I, BINDING SITE II or BINDING SITE III of FIG. 8. Table 4 illustrates the complementarity of the nucleotide sequences of RGS3 BINDING SITE, designated SEQ ID:3826, to the nucleotide sequence of GAM1338 RNA, herein designated GAM RNA, also designated SEQ ID:360.

Another function of GAM1338 is therefore inhibition of Regulator of g-protein signalling 3 (RGS3, Accession NP_570613.1), a gene which negatively regulates G protein-coupled receptor signalling. Accordingly, utilities of GAM1338 include diagnosis, prevention and treatment of diseases and clinical conditions associated with RGS3.

The function of RGS3 and its association with various diseases and clinical conditions, has been established by previous studies, as described hereinabove with reference to GAM146.1. Rhesus blood group, d antigen (RHD, Accession NP_057208.2) is another GAM1338 target gene, herein designated TARGET GENE. RHD BINDING SITE is a target binding site found in the 3' untranslated region of multiple transcripts of mRNA encoded by RHD, corresponding to a target binding site such as BINDING SITE I, BINDING SITE II or BINDING SITE III of FIG. 8. Table 4 illustrates the complementarity of the nucleotide sequences of RHD BINDING SITE, designated SEQ ID:8756, to the nucleotide sequence of GAM1338 RNA, herein designated GAM RNA, also designated SEQ ID:360.

Another function of GAM1338 is therefore inhibition of Rhesus blood group, d antigen (RHD, Accession NP_057208.2), a gene which Major antigen of the RH system. Accordingly, utilities of GAM1338 include diagnosis, prevention and treatment of diseases and clinical conditions associated with RHD.

The function of RHD and its association with various diseases and clinical conditions, has been established by previous studies, as described hereinabove with reference to GAM161.1. Rhesus blood group, d antigen (RHD, Accession NP_057309.2) is another GAM1338 target gene, herein designated TARGET GENE. RHD BINDING SITE is a target binding site found in the 3' untranslated region of multiple transcripts of mRNA encoded by RHD, corresponding to a target binding site such as BINDING SITE I, BINDING SITE II or BINDING SITE III of FIG. 8. Table 4 illustrates the complementarity of the nucleotide sequences of RHD BINDING SITE, designated SEQ ID:8756, to the nucleotide sequence of GAM1338 RNA, herein designated GAM RNA, also designated SEQ ID:360.

Another function of GAM1338 is therefore inhibition of Rhesus blood group, d antigen (RHD, Accession NP_057309.2), a gene which Major antigen of the RH system. Accordingly, utilities of GAM1338 include diagnosis, prevention and treatment of diseases and clinical conditions associated with RHD.

The function of RHD and its association with various diseases and clinical conditions, has been established by previous studies, as described hereinabove with reference to GAM161.1. RHPN2 (Accession NP_149094.2) is another GAM1338 target gene, herein designated TARGET GENE. RHPN2 BINDING SITE is a target binding site found in the 3' untranslated region of mRNA encoded by RHPN2, corresponding to a target binding site such as BINDING SITE I, BINDING SITE II or BINDING SITE III of FIG. 8. Table 4 illustrates the complementarity of the nucleotide sequences of RHPN2 BINDING SITE, designated SEQ ID:5481, to the nucleotide sequence of GAM1338 RNA, herein designated GAM RNA, also designated SEQ ID:360.

Another function of GAM1338 is therefore inhibition of RHPN2 (Accession NP_149094.2). Accordingly, utilities of GAM1338 include diagnosis, prevention and treatment of diseases and clinical conditions associated with RHPN2.

RNAC (Accession NP_005763.2) is another GAM1338 target gene, herein designated TARGET GENE. RNAC BINDING SITE is a target binding site found in the 3' untranslated region of mRNA encoded by RNAC, corresponding to a target binding site such as BINDING SITE I, BINDING SITE II or BINDING SITE III of FIG. 8. Table 4 illustrates the complementarity of the nucleotide sequences of RNAC BINDING SITE, designated SEQ ID:18459, to the nucleotide sequence of GAM1338 RNA, herein designated GAM RNA, also designated SEQ ID:360.

Another function of GAM1338 is therefore inhibition of RNAC (Accession NP_005763.2). Accordingly, utilities of GAM1338 include diagnosis, prevention and treatment of diseases and clinical conditions associated with RNAC.

RNF137 (Accession NP_060543.4) is another GAM1338 target gene, herein designated TARGET GENE. RNF137 BINDING SITE is a target binding site found in the 3' untranslated region of mRNA encoded by RNF137, corresponding to a target binding site such as BINDING SITE I, BINDING SITE II or BINDING SITE III of FIG. 8. Table 4 illustrates the complementarity of the nucleotide sequences of RNF137 BINDING SITE, designated SEQ ID:8861, to the nucleotide sequence of GAM1338 RNA, herein designated GAM RNA, also designated SEQ ID:360.

Another function of GAM1338 is therefore inhibition of RNF137 (Accession NP_060543.4). Accordingly, utilities of GAM1338 include diagnosis, prevention and treatment of diseases and clinical conditions associated with RNF137.

Ring finger protein (c3hc4 type) 8 (RNF8, Accession NP_003949.1) is another GAM1338 target gene, herein designated TARGET GENE. RNF8 BINDING SITE is a target binding site found in the 3' untranslated region of mRNA encoded by RNF8, corresponding to a target binding site such as BINDING SITE I, BINDING SITE II or BINDING SITE III of FIG. 8. Table 4 illustrates the complementarity of the nucleotide sequences of RNF8 BINDING SITE, designated SEQ ID:14570, to the nucleotide sequence of GAM1338 RNA, herein designated GAM RNA, also designated SEQ ID:360.

Another function of GAM1338 is therefore inhibition of Ring finger protein (c3hc4 type) 8 (RNF8, Accession NP_003949.1). Accordingly, utilities of GAM1338 include diagnosis, prevention and treatment of diseases and clinical conditions associated with RNF8.

Retinitis pigmentosa 2 (x-linked recessive) (RP2, Accession NP_008846.1) is another GAM1338 target gene, herein designated TARGET GENE. RP2 BINDING SITE is a target binding site found in the 3' untranslated region of mRNA encoded by RP2, corresponding to a target binding site such as BINDING SITE I, BINDING SITE II or BINDING SITE III of FIG. 8. Table 4 illustrates the complementarity of the nucleotide sequences of RP2 BINDING SITE, designated SEQ ID:6575, to the nucleotide sequence of GAM1338 RNA, herein designated GAM RNA, also designated SEQ ID:360.

Another function of GAM1338 is therefore inhibition of Retinitis pigmentosa 2 (x-linked recessive) (RP2, Accession NP_008846.1). Accordingly, utilities of GAM1338 include diagnosis, prevention and treatment of diseases and clinical conditions associated with RP2.

Rabphilin 3a-like (without c2 domains) (RPH3AL, Accession NP_008918.1) is another GAM1338 target gene, herein designated TARGET GENE. RPH3AL BINDING SITE is a target binding site found in the 3' untranslated region of mRNA encoded by RPH3AL, corresponding to a target binding site such as BINDING SITE I, BINDING SITE II or BINDING SITE III of FIG. 8. Table 4 illustrates the complementarity of the nucleotide sequences of RPH3AL BINDING SITE, designated SEQ ID:467, to the nucleotide sequence of GAM1338 RNA, herein designated GAM RNA, also designated SEQ ID:360.

Another function of GAM1338 is therefore inhibition of Rabphilin 3a-like (without c2 domains) (RPH3AL, Accession NP_008918.1), a gene which is a protein transporter. could play a role in neurotransmitter release by regulating membrane flow in the nerve terminal. Accordingly, utilities of GAM1338 include diagnosis, prevention and treatment of diseases and clinical conditions associated with RPH3AL.

The function of RPH3AL and its association with various diseases and clinical conditions, has been established by previous studies, as described hereinabove with reference to GAM189.1. RPP30 (Accession NP_006404.1) is another GAM1338 target gene, herein designated TARGET GENE. RPP30 BINDING SITE1 and RPP30 BINDING SITE2 are target binding sites found in untranslated regions of mRNA encoded by RPP30, corresponding to target binding sites such as BINDING SITE I, BINDING SITE II or BINDING SITE III of FIG. 8. Table 4 illustrates the complementarity of the nucleotide sequences of RPP30 BINDING SITE1 and RPP30 BINDING SITE2, designated SEQ ID:3259 and SEQ ID:13376 respectively, to the nucleotide sequence of GAM1338 RNA, herein designated GAM RNA, also designated SEQ ID:360.

Another function of GAM1338 is therefore inhibition of RPP30 (Accession NP_006404.1), a gene which is a component of ribonuclease p that processes 5' ends of precursor tRNAs. Accordingly, utilities of GAM1338 include diagnosis, prevention and treatment of diseases and clinical conditions associated with RPP30.

The function of RPP30 and its association with various diseases and clinical conditions, has been established by previous studies, as described hereinabove with reference to GAM136.1. S100A15 (Accession NP_789793.1) is another GAM1338 target gene, herein designated TARGET GENE. S100A15 BINDING SITE is a target binding site found in the 3' untranslated region of mRNA encoded by S100A15, corresponding to a target binding site such as BINDING SITE I, BINDING SITE II or BINDING SITE III of FIG. 8. Table 4 illustrates the complementarity of the nucleotide sequences of S100A15 BINDING SITE, designated SEQ ID:18561, to the nucleotide sequence of GAM1338 RNA, herein designated GAM RNA, also designated SEQ ID:360.

Another function of GAM1338 is therefore inhibition of S100A15 (Accession NP_789793.1). Accordingly, utilities of GAM1338 include diagnosis, prevention and treatment of diseases and clinical conditions associated with S100A15.

SARM1 (Accession NP_055892.1) is another GAM1338 target gene, herein designated TARGET GENE. SARM1 BINDING SITE is a target binding site found in the 3' untranslated region of mRNA encoded by SARM1, corresponding to a target binding site such as BINDING SITE I, BINDING SITE II or BINDING SITE III of FIG. 8. Table 4 illustrates the complementarity of the nucleotide sequences of SARM1 BINDING SITE, designated SEQ ID:16324, to the nucleotide sequence of GAM1338 RNA, herein designated GAM RNA, also designated SEQ ID:360.

Another function of GAM1338 is therefore inhibition of SARM1 (Accession NP_055892.1). Accordingly, utilities of GAM1338 include diagnosis, prevention and treatment of diseases and clinical conditions associated with SARM1.

Sarcoma amplified sequence (SAS, Accession NP_005972.1) is another GAM1338 target gene, herein designated TARGET GENE. SAS BINDING SITE is a target binding site found in the 3' untranslated region of mRNA encoded by SAS, corresponding to a target binding site such as BINDING SITE I, BINDING SITE II or BINDING SITE III of FIG. 8. Table 4 illustrates the complementarity of the nucleotide sequences of SAS BINDING SITE, designated SEQ ID:1301, to the nucleotide sequence of GAM1338 RNA, herein designated GAM RNA, also designated SEQ ID:360.

Another function of GAM1338 is therefore inhibition of Sarcoma amplified sequence (SAS, Accession NP_005972.1), a gene which is a member of the transmembrane 4 superfamily (TM4SF) and may be involved in growth-related cellular processes T. Accordingly, utilities of GAM1338 include diagnosis, prevention and treatment of diseases and clinical conditions associated with SAS.

The function of SAS and its association with various diseases and clinical conditions, has been established by previous studies, as described hereinabove with reference to GAM88.1. SBLF (Accession NP_006864.2) is another GAM1338 target gene, herein designated TARGET GENE. SBLF BINDING SITE is a target binding site found in the 3' untranslated region of mRNA encoded by SBLF, corresponding to a target binding site such as BINDING SITE I, BINDING SITE II or BINDING SITE III of FIG. 8. Table 4 illustrates the complementarity of the nucleotide sequences of SBLF BINDING SITE, designated SEQ ID:14250, to the nucleotide sequence of GAM1338 RNA, herein designated GAM RNA, also designated SEQ ID:360.

Another function of GAM1338 is therefore inhibition of SBLF (Accession NP_006864.2). Accordingly, utilities of GAM1338 include diagnosis, prevention and treatment of diseases and clinical conditions associated with SBLF.

SCAMP-4 (Accession NP_524558.1) is another GAM1338 target gene, herein designated TARGET GENE. SCAMP-4 BINDING SITE is a target binding site found in the 3' untranslated region of mRNA encoded by SCAMP-4, corresponding to a target binding site such as BINDING SITE I, BINDING SITE II or BINDING SITE III of FIG. 8. Table 4 illustrates the complementarity of the nucleotide sequences of SCAMP-4 BINDING SITE, designated SEQ ID:19434, to the nucleotide sequence of GAM1338 RNA, herein designated GAM RNA, also designated SEQ ID:360.

Another function of GAM1338 is therefore inhibition of SCAMP-4 (Accession NP_524558.1). Accordingly, utilities of GAM1338 include diagnosis, prevention and treatment of diseases and clinical conditions associated with SCAMP-4.

Scan domain containing 2 (SCAND2, Accession NP_071333.2) is another GAM1338 target gene, herein designated TARGET GENE. SCAND2 BINDING SITE is a target binding site found in the 3' untranslated region of multiple transcripts of mRNA encoded by SCAND2, corresponding to a target binding site such as BINDING SITE I, BINDING SITE II or BINDING SITE III of FIG. 8. Table 4 illustrates the complementarity of the nucleotide sequences of SCAND2 BINDING SITE, designated SEQ ID:16790, to the nucleotide sequence of GAM1338 RNA, herein designated GAM RNA, also designated SEQ ID:360.

Another function of GAM1338 is therefore inhibition of Scan domain containing 2 (SCAND2, Accession NP_071333.2). Accordingly, utilities of GAM1338 include diagnosis, prevention and treatment of diseases and clinical conditions associated with SCAND2.

Scavenger receptor class f, member 1 (SCARF1, Accession NP_003684.1) is another GAM1338 target gene, herein designated TARGET GENE. SCARF1 BINDING SITE1 and SCARF1 BINDING SITE2 are target binding sites found in untranslated regions of mRNA encoded by SCARF1, corresponding to target binding sites such as BINDING SITE I, BINDING SITE II or BINDING SITE III of FIG. 8. Table 4 illustrates the complementarity of the nucleotide sequences of SCARF1 BINDING SITE1 and SCARF1 BINDING SITE2, designated SEQ ID:9540 and SEQ ID:12384 respectively, to the nucleotide sequence of GAM1338 RNA, herein designated GAM RNA, also designated SEQ ID:360.

Another function of GAM1338 is therefore inhibition of Scavenger receptor class f, member 1 (SCARF1, Accession NP_003684.1). Accordingly, utilities of GAM1338 include diagnosis, prevention and treatment of diseases and clinical conditions associated with SCARF1.

SCMH1 (Accession NP_036368.1) is another GAM1338 target gene, herein designated TARGET GENE. SCMH1 BINDING SITE is a target binding site found in the 3' untranslated region of mRNA encoded by SCMH1, corresponding to a target binding site such as BINDING SITE I, BINDING SITE II or BINDING SITE III of FIG. 8. Table 4 illustrates the complementarity of the nucleotide sequences of SCMH1 BINDING SITE, designated SEQ ID:9755, to the nucleotide sequence of GAM1338 RNA, herein designated GAM RNA, also designated SEQ ID:360.

Another function of GAM1338 is therefore inhibition of SCMH1 (Accession NP_036368.1). Accordingly, utilities of GAM1338 include diagnosis, prevention and treatment of diseases and clinical conditions associated with SCMH1.

Sex comb on midleg-like 2 (drosophila) (SCML2, Accession NP_006080.1) is another GAM1338 target gene, herein designated TARGET GENE. SCML2 BINDING SITE is a target binding site found in the 3' untranslated region of mRNA encoded by SCML2, corresponding to a target binding site such as BINDING SITE I, BINDING SITE II or BINDING SITE III of FIG. 8. Table 4 illustrates the complementarity of the nucleotide sequences of SCML2 BINDING SITE, designated SEQ ID:9058, to the nucleotide sequence of GAM1338 RNA, herein designated GAM RNA, also designated SEQ ID:360.

Another function of GAM1338 is therefore inhibition of Sex comb on midleg-like 2 (drosophila) (SCML2, Accession NP_006080.1). Accordingly, utilities of GAM1338 include diagnosis, prevention and treatment of diseases and clinical conditions associated with SCML2.

SCN3B (Accession NP_060870.1) is another GAM1338 target gene, herein designated TARGET GENE. SCN3B BINDING SITE1 and SCN3B BINDING SITE2 are target binding sites found in untranslated regions of mRNA encoded by SCN3B, corresponding to target binding sites such as BINDING SITE I, BINDING SITE II or BINDING SITE III of FIG. 8. Table 4 illustrates the complementarity of the nucleotide sequences of SCN3B BINDING SITE1 and SCN3B BINDING SITE2, designated SEQ ID:9932 and SEQ ID:1471 respectively, to the nucleotide sequence of GAM1338 RNA, herein designated GAM RNA, also designated SEQ ID:360.

Another function of GAM1338 is therefore inhibition of SCN3B (Accession NP_060870.1). Accordingly, utilities of GAM1338 include diagnosis, prevention and treatment of diseases and clinical conditions associated with SCN3B.

SDS-RS1 (Accession NP_612441.1) is another GAM1338 target gene, herein designated TARGET GENE. SDS-RS1 BINDING SITE1 and SDS-RS1 BINDING SITE2 are target binding sites found in untranslated regions of mRNA encoded by SDS-RS1, corresponding to target binding sites such as BINDING SITE I, BINDING SITE II or BINDING SITE III of FIG. 8. Table 4 illustrates the complementarity of the nucleotide sequences of SDS-RS1 BINDING SITE1 and SDS-RS1 BINDING SITE2, designated SEQ ID:2100 and SEQ ID:6910 respectively, to the nucleotide sequence of GAM1338 RNA, herein designated GAM RNA, also designated SEQ ID:360.

Another function of GAM1338 is therefore inhibition of SDS-RS1 (Accession NP_612441.1). Accordingly, utilities of GAM1338 include diagnosis, prevention and treatment of diseases and clinical conditions associated with SDS-RS1.

SDS3 (Accession XP_045014.1) is another GAM1338 target gene, herein designated TARGET GENE. SDS3 BINDING SITE is a target binding site found in the 3' untranslated region of mRNA encoded by SDS3, corresponding to a target binding site such as BINDING SITE I, BINDING SITE II or BINDING SITE III of FIG. 8. Table 4 illustrates the complementarity of the nucleotide sequences of SDS3 BINDING SITE, designated SEQ ID:8869, to the nucleotide sequence of GAM1338 RNA, herein designated GAM RNA, also designated SEQ ID:360.

Another function of GAM1338 is therefore inhibition of SDS3 (Accession XP_045014.1). Accordingly, utilities of GAM1338 include diagnosis, prevention and treatment of diseases and clinical conditions associated with SDS3.

Spondyloepiphyseal dysplasia, late (SEDL, Accession NP_055378.1) is another GAM1338 target gene, herein designated TARGET GENE. SEDL BINDING SITE1 through SEDL BINDING SITE4 are target binding sites found in untranslated regions of mRNA encoded by SEDL, corresponding to target binding sites such as BINDING SITE I, BINDING SITE II or BINDING SITE III of FIG. 8. Table 4 illustrates the complementarity of the nucleotide sequences of SEDL BINDING SITE1 through SEDL BINDING SITE4, designated SEQ ID:13872, SEQ ID:16842, SEQ ID:7261 and SEQ ID:13400 respectively, to the nucleotide sequence of GAM1338 RNA, herein designated GAM RNA, also designated SEQ ID:360.

Another function of GAM1338 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM1338 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. Small edrk-rich factor 1a (telomeric) (SERF1A, Accession NP_068802.1) is another GAM1338 target gene, herein designated TARGET GENE. SERF1A BINDING SITE1 and SERF1A BINDING SITE2 are target binding sites found in untranslated regions of mRNA encoded by SERF1A, corresponding to target binding sites such as BINDING SITE I, BINDING SITE II or BINDING SITE III of FIG. 8. Table 4 illustrates the complementarity of the nucleotide sequences of SERF1A BINDING SITE1 and SERF1A BINDING SITE2, designated SEQ ID:14767 and SEQ ID:11123 respectively, to the nucleotide sequence of GAM1338 RNA, herein designated GAM RNA, also designated SEQ ID:360.

Another function of GAM1338 is therefore inhibition of Small edrk-rich factor 1a (telomeric) (SERF1A, Accession NP_068802.1). Accordingly, utilities of GAM1338 include diagnosis, prevention and treatment of diseases and clinical conditions associated with SERF1A.

Small edrk-rich factor 1b (centromeric) (SERF1B, Accession NP_075267.1) is another GAM1338 target gene, herein designated TARGET GENE. SERF1B BINDING SITE1 and SERF1B BINDING SITE2 are target binding sites found in untranslated regions of mRNA encoded by SERF1B, corresponding to target binding sites such as BINDING SITE I, BINDING SITE II or BINDING SITE III of FIG. 8. Table 4 illustrates the complementarity of the nucleotide sequences of SERF1B BINDING SITE1 and SERF1B BINDING SITE2, designated SEQ ID:11123 and SEQ ID:14767 respectively, to the nucleotide sequence of GAM1338 RNA, herein designated GAM RNA, also designated SEQ ID:360.

Another function of GAM1338 is therefore inhibition of Small edrk-rich factor 1b (centromeric) (SERF1B, Accession NP_075267.1). Accordingly, utilities of GAM1338 include diagnosis, prevention and treatment of diseases and clinical conditions associated with SERF1B.

Small edrk-rich factor 2 (SERF2, Accession NP_005761.2) is another GAM1338 target gene, herein designated TARGET GENE. SERF2 BINDING SITE is a target binding site found in the 5' untranslated region of mRNA encoded by SERF2, corresponding to a target binding site such as BINDING SITE I, BINDING SITE II or BINDING SITE III of FIG. 8. Table 4 illustrates the complementarity of the nucleotide sequences of SERF2 BINDING SITE, designated SEQ ID:13138, to the nucleotide sequence of GAM1338 RNA, herein designated GAM RNA, also designated SEQ ID:360.

Another function of GAM1338 is therefore inhibition of Small edrk-rich factor 2 (SERF2, Accession NP_005761.2). Accordingly, utilities of GAM1338 include diagnosis, prevention and treatment of diseases and clinical conditions associated with SERF2.

Serine (or cysteine) proteinase inhibitor, clade b (ovalbumin), member 9 (SERPINB9, Accession NP_004146.1) is another GAM1338 target gene, herein designated TARGET GENE. SERPINB9 BINDING SITE1 and SERPINB9

BINDING SITE2 are target binding sites found in untranslated regions of mRNA encoded by SERPINB9, corresponding to target binding sites such as BINDING SITE I, BINDING SITE II or BINDING SITE III of FIG. 8. Table 4 illustrates the complementarity of the nucleotide sequences of SERPINB9 BINDING SITE1 and SERPINB9 BINDING SITE2, designated SEQ ID:4057 and SEQ ID:437 respectively, to the nucleotide sequence of GAM1338 RNA, herein designated GAM RNA, also designated SEQ ID:360.

Another function of GAM1338 is therefore inhibition of Serine (or cysteine) proteinase inhibitor, clade b (ovalbumin), member 9 (SERPINB9, Accession NP_004146.1), a gene which may be a serpin serine protease inhibitor that interacts with granzyme B (GZMB). Accordingly, utilities of GAM1338 include diagnosis, prevention and treatment of diseases and clinical conditions associated with SERPINB9.

The function of SERPINB9 and its association with various diseases and clinical conditions, has been established by previous studies, as described hereinabove with reference to GAM88.2. Sideroflexin 2 (SFXN2, Accession XP_058359.2) is another GAM1338 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:1960, to the nucleotide sequence of GAM1338 RNA, herein designated GAM RNA, also designated SEQ ID:360.

Another function of GAM1338 is therefore inhibition of Sideroflexin 2 (SFXN2, Accession XP_058359.2). Accordingly, utilities of GAM1338 include diagnosis, prevention and treatment of diseases and clinical conditions associated with SFXN2.

Sideroflexin 2 (SFXN2, Accession NP_849189.1) is another GAM1338 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:1960, to the nucleotide sequence of GAM1338 RNA, herein designated GAM RNA, also designated SEQ ID:360.

Another function of GAM1338 is therefore inhibition of Sideroflexin 2 (SFXN2, Accession NP_849189.1). Accordingly, utilities of GAM1338 include diagnosis, prevention and treatment of diseases and clinical conditions associated with SFXN2.

Sideroflexin 4 (SFXN4, Accession NP_849198.1) is another GAM1338 target gene, herein designated TARGET GENE. SFXN4 BINDING SITE is a target binding site found in the 3' untranslated region of multiple transcripts of mRNA encoded by SFXN4, corresponding to a target binding site such as BINDING SITE I, BINDING SITE II or BINDING SITE III of FIG. 8. Table 4 illustrates the complementarity of the nucleotide sequences of SFXN4 BINDING SITE, designated SEQ ID:6466, to the nucleotide sequence of GAM1338 RNA, herein designated GAM RNA, also designated SEQ ID:360.

Another function of GAM1338 is therefore inhibition of Sideroflexin 4 (SFXN4, Accession NP_849198.1). Accordingly, utilities of GAM1338 include diagnosis, prevention and treatment of diseases and clinical conditions associated with SFXN4.

Sideroflexin 4 (SFXN4, Accession XP_058406.1) is another GAM1338 target gene, herein designated TARGET GENE. SFXN4 BINDING SITE is a target binding site found in the 3' untranslated region of multiple transcripts of mRNA encoded by SFXN4, corresponding to a target binding site such as BINDING SITE I, BINDING SITE II or BINDING SITE III of FIG. 8. Table 4 illustrates the complementarity of the nucleotide sequences of SFXN4 BINDING SITE, designated SEQ ID:6466, to the nucleotide sequence of GAM1338 RNA, herein designated GAM RNA, also designated SEQ ID:360.

Another function of GAM1338 is therefore inhibition of Sideroflexin 4 (SFXN4, Accession XP_058406.1). Accordingly, utilities of GAM1338 include diagnosis, prevention and treatment of diseases and clinical conditions associated with SFXN4.

Sh3-domain binding protein 2 (SH3BP2, Accession NP_003014.2) is another GAM1338 target gene, herein designated TARGET GENE. SH3BP2 BINDING SITE is a target binding site found in the 5' untranslated region of mRNA encoded by SH3BP2, corresponding to a target binding site such as BINDING SITE I, BINDING SITE II or BINDING SITE III of FIG. 8. Table 4 illustrates the complementarity of the nucleotide sequences of SH3BP2 BINDING SITE, designated SEQ ID:18716, to the nucleotide sequence of GAM1338 RNA, herein designated GAM RNA, also designated SEQ ID:360.

Another function of GAM1338 is therefore inhibition of Sh3-domain binding protein 2 (SH3BP2, Accession NP_003014.2). Accordingly, utilities of GAM1338 include diagnosis, prevention and treatment of diseases and clinical conditions associated with SH3BP2.

Short stature homeobox (SHOX, Accession NP_000442.1) is another GAM1338 target gene, herein designated TARGET GENE. SHOX BINDING SITE is a target binding site found in the 3' untranslated region of multiple transcripts of mRNA encoded by SHOX, corresponding to a target binding site such as BINDING SITE I, BINDING SITE II or BINDING SITE III of FIG. 8. Table 4 illustrates the complementarity of the nucleotide sequences of SHOX BINDING SITE, designated SEQ ID:3808, to the nucleotide sequence of GAM1338 RNA, herein designated GAM RNA, also designated SEQ ID:360.

Another function of GAM1338 is therefore inhibition of Short stature homeobox (SHOX, Accession NP_000442.1). Accordingly, utilities of GAM1338 include diagnosis, prevention and treatment of diseases and clinical conditions associated with SHOX.

Sialic acid binding ig-like lectin 8 (SIGLEC8, Accession NP_055257.1) is another GAM1338 target gene, herein designated TARGET GENE. SIGLEC8 BINDING SITE is a target binding site found in the 3' untranslated region of mRNA encoded by SIGLEC8, corresponding to a target binding site such as BINDING SITE I, BINDING SITE II or BINDING SITE III of FIG. 8. Table 4 illustrates the complementarity of the nucleotide sequences of SIGLEC8 BINDING SITE, designated SEQ ID:3441, to the nucleotide sequence of GAM1338 RNA, herein designated GAM RNA, also designated SEQ ID:360.

Another function of GAM1338 is therefore inhibition of Sialic acid binding ig-like lectin 8 (SIGLEC8, Accession NP_055257.1), a gene which is a cell adhesion molecule for postnatal neural development. Accordingly, utilities of GAM1338 include diagnosis, prevention and treatment of diseases and clinical conditions associated with SIGLEC8.

The function of SIGLEC8 and its association with various diseases and clinical conditions, has been established by previous studies, as described hereinabove with reference to GAM63.1. Src-like-adaptor 2 (SLA2, Accession NP_778252.1) is another GAM1338 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:15357, to the nucleotide sequence of GAM1338 RNA, herein designated GAM RNA, also designated SEQ ID:360.

Another function of GAM1338 is therefore inhibition of Src-like-adaptor 2 (SLA2, Accession NP_778252.1). Accordingly, utilities of GAM1338 include diagnosis, prevention and treatment of diseases and clinical conditions associated with SLA2.

Src-like-adaptor 2 (SLA2, Accession NP_115590.1) is another GAM1338 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:15357, to the nucleotide sequence of GAM1338 RNA, herein designated GAM RNA, also designated SEQ ID:360.

Another function of GAM1338 is therefore inhibition of Src-like-adaptor 2 (SLA2, Accession NP_115590.1). Accordingly, utilities of GAM1338 include diagnosis, prevention and treatment of diseases and clinical conditions associated with SLA2.

Solute carrier family 11 (proton-coupled divalent metal ion transporters), member 2 (SLC11A2, Accession NP_000608.1) is another GAM1338 target gene, herein designated TARGET GENE. SLC11A2 BINDING SITE is a target binding site found in the 3' untranslated region of mRNA encoded by SLC11A2, corresponding to a target binding site such as BINDING SITE I, BINDING SITE II or BINDING SITE III of FIG. 8. Table 4 illustrates the complementarity of the nucleotide sequences of SLC11A2 BINDING SITE, designated SEQ ID:16731, to the nucleotide sequence of GAM1338 RNA, herein designated GAM RNA, also designated SEQ ID:360.

Another function of GAM1338 is therefore inhibition of Solute carrier family 11 (proton-coupled divalent metal ion transporters), member 2 (SLC11A2, Accession NP_000608.1). Accordingly, utilities of GAM1338 include diagnosis, prevention and treatment of diseases and clinical conditions associated with SLC11A2.

Solute carrier family 12 (potassium/chloride transporters), member 8 (SLC12A8, Accession NP_078904.1) is another GAM1338 target gene, herein designated TARGET GENE. SLC12A8 BINDING SITE is a target binding site found in the 3' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:18425, to the nucleotide sequence of GAM1338 RNA, herein designated GAM RNA, also designated SEQ ID:360.

Another function of GAM1338 is therefore inhibition of Solute carrier family 12 (potassium/chloride transporters), member 8 (SLC12A8, Accession NP_078904.1). Accordingly, utilities of GAM1338 include diagnosis, prevention and treatment of diseases and clinical conditions associated with SLC12A8.

Solute carrier family 13 (sodium/sulfate symporters), member 1 (SLC13A1, Accession NP_071889.2) is another GAM1338 target gene, herein designated TARGET GENE. SLC13A1 BINDING SITE is a target binding site found in the 3' untranslated region of mRNA encoded by SLC13A1, corresponding to a target binding site such as BINDING SITE I, BINDING SITE II or BINDING SITE III of FIG. 8. Table 4 illustrates the complementarity of the nucleotide sequences of SLC13A1 BINDING SITE, designated SEQ ID:15679, to the nucleotide sequence of GAM1338 RNA, herein designated GAM RNA, also designated SEQ ID:360.

Another function of GAM1338 is therefore inhibition of Solute carrier family 13 (sodium/sulfate symporters), member 1 (SLC13A1, Accession NP_071889.2). Accordingly, utilities of GAM1338 include diagnosis, prevention and treatment of diseases and clinical conditions associated with SLC13A1.

Solute carrier family 15 (oligopeptide transporter), member 1 (SLC15A1, Accession NP_005064.1) is another GAM1338 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:20019, to the nucleotide sequence of GAM1338 RNA, herein designated GAM RNA, also designated SEQ ID:360.

Another function of GAM1338 is therefore inhibition of Solute carrier family 15 (oligopeptide transporter), member 1 (SLC15A1, Accession NP_005064.1), a gene which is a H(+)-coupled peptide transporter. Accordingly, utilities of GAM1338 include diagnosis, prevention and treatment of diseases and clinical conditions associated with SLC15A1.

The function of SLC15A1 and its association with various diseases and clinical conditions, has been established by previous studies, as described hereinabove with reference to GAM30.1. Solute carrier family 16 (monocarboxylic acid transporters), member 4 (SLC16A4, Accession NP_004687.1) is another GAM1338 target gene, herein designated TARGET GENE. SLC16A4 BINDING SITE is a target binding site found in the 3' untranslated region of mRNA encoded by SLC16A4, corresponding to a target binding site such as BINDING SITE I, BINDING SITE II or BINDING SITE III of FIG. 8. Table 4 illustrates the complementarity of the nucleotide sequences of SLC16A4 BINDING SITE, designated SEQ ID:20157, to the nucleotide sequence of GAM1338 RNA, herein designated GAM RNA, also designated SEQ ID:360.

Another function of GAM1338 is therefore inhibition of Solute carrier family 16 (monocarboxylic acid transporters), member 4 (SLC16A4, Accession NP_004687.1). Accordingly, utilities of GAM1338 include diagnosis, prevention and treatment of diseases and clinical conditions associated with SLC16A4.

Solute carrier family 16 (monocarboxylic acid transporters), member 6 (SLC16A6, Accession NP_004685.1) is another GAM1338 target gene, herein designated TARGET GENE. SLC16A6 BINDING SITE is a target binding site found in the 5' untranslated region of mRNA encoded by SLC16A6, corresponding to a target binding site such as BINDING SITE I, BINDING SITE II or BINDING SITE III of FIG. 8. Table 4 illustrates the complementarity of the nucleotide sequences of SLC16A6 BINDING SITE, designated SEQ ID:517, to the nucleotide sequence of GAM1338 RNA, herein designated GAM RNA, also designated SEQ ID:360.

Another function of GAM1338 is therefore inhibition of Solute carrier family 16 (monocarboxylic acid transporters), member 6 (SLC16A6, Accession NP_004685.1). Accordingly, utilities of GAM1338 include diagnosis, prevention and treatment of diseases and clinical conditions associated with SLC16A6.

Solute carrier family 24 (sodium/potassium/calcium exchanger), member 1 (SLC24A1, Accession NP_004718.1) is another GAM1338 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:7931, to the nucleotide sequence of GAM1338 RNA, herein designated GAM RNA, also designated SEQ ID:360.

Another function of GAM1338 is therefore inhibition of Solute carrier family 24 (sodium/potassium/calcium exchanger), member 1 (SLC24A1, Accession NP_004718.1), a gene which is a critical component of the visual transduction cascade, controlling the calcium concentration of outer segments during light and darkness. Accordingly, utilities of GAM1338 include diagnosis, prevention and treatment of diseases and clinical conditions associated with SLC24A1.

The function of SLC24A1 and its association with various diseases and clinical conditions, has been established by previous studies, as described hereinabove with reference to GAM130.1. Solute carrier family 25 (mitochondrial carrier; dicarboxylate transporter), member 10 (SLC25A10, Accession NP_036272.2) is another GAM1338 target gene, herein designated TARGET GENE. SLC25A10 BINDING SITE is a target binding site found in the 3' untranslated region of mRNA encoded by SLC25A10, corresponding to a target binding site such as BINDING SITE I, BINDING SITE II or BINDING SITE III of FIG. 8. Table 4 illustrates the complementarity of the nucleotide sequences of SLC25A10 BINDING SITE, designated SEQ ID:1937, to the nucleotide sequence of GAM1338 RNA, herein designated GAM RNA, also designated SEQ ID:360.

Another function of GAM1338 is therefore inhibition of Solute carrier family 25 (mitochondrial carrier; dicarboxylate transporter), member 10 (SLC25A10, Accession NP_036272.2). Accordingly, utilities of GAM1338 include diagnosis, prevention and treatment of diseases and clinical conditions associated with SLC25A10.

SLC30A5 (Accession NP_076960.1) is another GAM1338 target gene, herein designated TARGET GENE. SLC30A5 BINDING SITE is a target binding site found in the 3' untranslated region of multiple transcripts of mRNA encoded by SLC30A5, corresponding to a target binding site such as BINDING SITE I, BINDING SITE II or BINDING SITE III of FIG. 8. Table 4 illustrates the complementarity of the nucleotide sequences of SLC30A5 BINDING SITE, designated SEQ ID:1341, to the nucleotide sequence of GAM1338 RNA, herein designated GAM RNA, also designated SEQ ID:360.

Another function of GAM1338 is therefore inhibition of SLC30A5 (Accession NP_076960.1). Accordingly, utilities of GAM1338 include diagnosis, prevention and treatment of diseases and clinical conditions associated with SLC30A5.

SLC30A6 (Accession NP_060434.2) is another GAM1338 target gene, herein designated TARGET GENE. SLC30A6 BINDING SITE is a target binding site found in the 3' untranslated region of mRNA encoded by SLC30A6, corresponding to a target binding site such as BINDING SITE I, BINDING SITE II or BINDING SITE III of FIG. 8. Table 4 illustrates the complementarity of the nucleotide sequences of SLC30A6 BINDING SITE, designated SEQ ID:11622, to the nucleotide sequence of GAM1338 RNA, herein designated GAM RNA, also designated SEQ ID:360.

Another function of GAM1338 is therefore inhibition of SLC30A6 (Accession NP_060434.2). Accordingly, utilities of GAM1338 include diagnosis, prevention and treatment of diseases and clinical conditions associated with SLC30A6.

SLC35E2 (Accession XP_049733.6) is another GAM1338 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:12300, to the nucleotide sequence of GAM1338 RNA, herein designated GAM RNA, also designated SEQ ID:360.

Another function of GAM1338 is therefore inhibition of SLC35E2 (Accession XP_049733.6). Accordingly, utilities of GAM1338 include diagnosis, prevention and treatment of diseases and clinical conditions associated with SLC35E2.

Solute carrier family 39 (zinc transporter), member 1 (SLC39A1, Accession NP_055252.2) is another GAM1338 target gene, herein designated TARGET GENE. SLC39A1 BINDING SITE is a target binding site found in the 5' untranslated region of mRNA encoded by SLC39A1, corresponding to a target binding site such as BINDING SITE I, BINDING SITE II or BINDING SITE III of FIG. 8. Table 4 illustrates the complementarity of the nucleotide sequences of SLC39A1 BINDING SITE, designated SEQ ID:19430, to the nucleotide sequence of GAM1338 RNA, herein designated GAM RNA, also designated SEQ ID:360.

Another function of GAM1338 is therefore inhibition of Solute carrier family 39 (zinc transporter), member 1 (SLC39A1, Accession NP_055252.2), a gene which is a divalent (zinc/iron) metal ion transporter. Accordingly, utilities of GAM1338 include diagnosis, prevention and treatment of diseases and clinical conditions associated with SLC39A1.

The function of SLC39A1 and its association with various diseases and clinical conditions, has been established by previous studies, as described hereinabove with reference to GAM175.1. Solute carrier family 6 (neurotransmitter transporter), member 14 (SLC6A14, Accession NP_009162.1) is another GAM1338 target gene, herein designated TARGET GENE. SLC6A14 BINDING SITE is a target binding site found in the 3' untranslated region of mRNA encoded by SLC6A14, corresponding to a target binding site such as BINDING SITE I, BINDING SITE II or BINDING SITE III of FIG. 8. Table 4 illustrates the complementarity of the nucleotide sequences of SLC6A14 BINDING SITE, designated SEQ ID:16741, to the nucleotide sequence of GAM1338 RNA, herein designated GAM RNA, also designated SEQ ID:360.

Another function of GAM1338 is therefore inhibition of Solute carrier family 6 (neurotransmitter transporter), member 14 (SLC6A14, Accession NP_009162.1). Accordingly, utilities of GAM1338 include diagnosis, prevention and treatment of diseases and clinical conditions associated with SLC6A14.

SMAC (Accession NP__620308.1) is another GAM1338 target gene, herein designated TARGET GENE. SMAC BINDING SITE1 and SMAC BINDING SITE2 are target binding sites found in untranslated regions of multiple transcripts of mRNA encoded by SMAC, corresponding to target binding sites such as BINDING SITE I, BINDING SITE II or BINDING SITE III of FIG. 8. Table 4 illustrates the complementarity of the nucleotide sequences of SMAC BINDING SITE1 and SMAC BINDING SITE2, designated SEQ ID:15275 and SEQ ID:1245 respectively, to the nucleotide sequence of GAM1338 RNA, herein designated GAM RNA, also designated SEQ ID:360.

Another function of GAM1338 is therefore inhibition of SMAC (Accession NP__620308.1), a gene which promotes apoptosis via caspase activation. Accordingly, utilities of GAM1338 include diagnosis, prevention and treatment of diseases and clinical conditions associated with SMAC.

The function of SMAC and its association with various diseases and clinical conditions, has been established by previous studies, as described hereinabove with reference to GAM136.1. Synaptosomal-associated protein, 23 kda (SNAP23, Accession NP__003816.2) is another GAM1338 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:14270, to the nucleotide sequence of GAM1338 RNA, herein designated GAM RNA, also designated SEQ ID:360.

Another function of GAM1338 is therefore inhibition of Synaptosomal-associated protein, 23 kda (SNAP23, Accession NP__003816.2), a gene which is essential component of the high affinity receptor for the general membrane fusion machinery. Accordingly, utilities of GAM1338 include diagnosis, prevention and treatment of diseases and clinical conditions associated with SNAP23.

The function of SNAP23 and its association with various diseases and clinical conditions, has been established by previous studies, as described hereinabove with reference to GAM30.1. Synaptosomal-associated protein, 23 kda (SNAP23, Accession NP__570710.1) is another GAM1338 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:14270, to the nucleotide sequence of GAM1338 RNA, herein designated GAM RNA, also designated SEQ ID:360.

Another function of GAM1338 is therefore inhibition of Synaptosomal-associated protein, 23 kda (SNAP23, Accession NP__570710.1), a gene which is essential component of the high affinity receptor for the general membrane fusion machinery. Accordingly, utilities of GAM1338 include diagnosis, prevention and treatment of diseases and clinical conditions associated with SNAP23.

The function of SNAP23 and its association with various diseases and clinical conditions, has been established by previous studies, as described hereinabove with reference to GAM30.1. Syntaphilin (SNPH, Accession NP__055538.1) is another GAM1338 target gene, herein designated TARGET GENE. SNPH BINDING SITE is a target binding site found in the 3' untranslated region of mRNA encoded by SNPH, corresponding to a target binding site such as BINDING SITE I, BINDING SITE II or BINDING SITE III of FIG. 8. Table 4 illustrates the complementarity of the nucleotide sequences of SNPH BINDING SITE, designated SEQ ID:1354, to the nucleotide sequence of GAM1338 RNA, herein designated GAM RNA, also designated SEQ ID:360.

Another function of GAM1338 is therefore inhibition of Syntaphilin (SNPH, Accession NP__055538.1). Accordingly, utilities of GAM1338 include diagnosis, prevention and treatment of diseases and clinical conditions associated with SNPH.

Sorting nexin 15 (SNX15, Accession NP__037438.2) is another GAM1338 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:2728, to the nucleotide sequence of GAM1338 RNA, herein designated GAM RNA, also designated SEQ ID:360.

Another function of GAM1338 is therefore inhibition of Sorting nexin 15 (SNX15, Accession NP__037438.2). Accordingly, utilities of GAM1338 include diagnosis, prevention and treatment of diseases and clinical conditions associated with SNX15.

Sorting nexin 15 (SNX15, Accession NP__680086.1) is another GAM1338 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:2728, to the nucleotide sequence of GAM1338 RNA, herein designated GAM RNA, also designated SEQ ID:360.

Another function of GAM1338 is therefore inhibition of Sorting nexin 15 (SNX15, Accession NP__680086.1). Accordingly, utilities of GAM1338 include diagnosis, prevention and treatment of diseases and clinical conditions associated with SNX15.

SNX22 (Accession NP__079074.1) is another GAM1338 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:11205, to the nucleotide sequence of GAM1338 RNA, herein designated GAM RNA, also designated SEQ ID:360.

Another function of GAM1338 is therefore inhibition of SNX22 (Accession NP__079074.1). Accordingly, utilities of GAM1338 include diagnosis, prevention and treatment of diseases and clinical conditions associated with SNX22.

SNX27 (Accession NP__112180.4) is another GAM1338 target gene, herein designated TARGET GENE. SNX27 BINDING SITE is a target binding site found in the 3' untranslated region of mRNA encoded by SNX27, corresponding to a target binding site such as BINDING SITE I, BINDING SITE II or BINDING SITE III of FIG. 8. Table 4 illustrates the complementarity of the nucleotide sequences of SNX27 BINDING SITE, designated SEQ ID:8857, to the nucleotide sequence of GAM1338 RNA, herein designated GAM RNA, also designated SEQ ID:360.

Another function of GAM1338 is therefore inhibition of SNX27 (Accession NP_112180.4). Accordingly, utilities of GAM1338 include diagnosis, prevention and treatment of diseases and clinical conditions associated with SNX27.

Speckle-type poz protein (SPOP, Accession NP_003554.1) is another GAM1338 target gene, herein designated TARGET GENE. SPOP BINDING SITE is a target binding site found in the 5' untranslated region of mRNA encoded by SPOP, corresponding to a target binding site such as BINDING SITE I, BINDING SITE II or BINDING SITE III of FIG. 8. Table 4 illustrates the complementarity of the nucleotide sequences of SPOP BINDING SITE, designated SEQ ID:7212, to the nucleotide sequence of GAM1338 RNA, herein designated GAM RNA, also designated SEQ ID:360.

Another function of GAM1338 is therefore inhibition of Speckle-type poz protein (SPOP, Accession NP_003554.1). Accordingly, utilities of GAM1338 include diagnosis, prevention and treatment of diseases and clinical conditions associated with SPOP.

SQV7L (Accession XP_047287.1) is another GAM1338 target gene, herein designated TARGET GENE. SQV7L BINDING SITE is a target binding site found in the 5' untranslated region of mRNA encoded by SQV7L, corresponding to a target binding site such as BINDING SITE I, BINDING SITE II or BINDING SITE III of FIG. 8. Table 4 illustrates the complementarity of the nucleotide sequences of SQV7L BINDING SITE, designated SEQ ID:15016, to the nucleotide sequence of GAM1338 RNA, herein designated GAM RNA, also designated SEQ ID:360.

Another function of GAM1338 is therefore inhibition of SQV7L (Accession XP_047287.1). Accordingly, utilities of GAM1338 include diagnosis, prevention and treatment of diseases and clinical conditions associated with SQV7L.

SRISNF2L (Accession NP_055921.1) is another GAM1338 target gene, herein designated TARGET GENE. SRISNF2L BINDING SITE is a target binding site found in the 3' untranslated region of mRNA encoded by SRISNF2L, corresponding to a target binding site such as BINDING SITE I, BINDING SITE II or BINDING SITE III of FIG. 8. Table 4 illustrates the complementarity of the nucleotide sequences of SRISNF2L BINDING SITE, designated SEQ ID:9707, to the nucleotide sequence of GAM1338 RNA, herein designated GAM RNA, also designated SEQ ID:360.

Another function of GAM1338 is therefore inhibition of SRISNF2L (Accession NP_055921.1). Accordingly, utilities of GAM1338 include diagnosis, prevention and treatment of diseases and clinical conditions associated with SRISNF2L.

Sarcalumenin (SRL, Accession XP_064152.3) is another GAM1338 target gene, herein designated TARGET GENE. SRL BINDING SITE1 and SRL BINDING SITE2 are target binding sites found in untranslated regions of mRNA encoded by SRL, corresponding to target binding sites such as BINDING SITE I, BINDING SITE II or BINDING SITE III of FIG. 8. Table 4 illustrates the complementarity of the nucleotide sequences of SRL BINDING SITE1 and SRL BINDING SITE2, designated SEQ ID:7583 and SEQ ID:9910 respectively, to the nucleotide sequence of GAM1338 RNA, herein designated GAM RNA, also designated SEQ ID:360.

Another function of GAM1338 is therefore inhibition of Sarcalumenin (SRL, Accession XP_064152.3). Accordingly, utilities of GAM1338 include diagnosis, prevention and treatment of diseases and clinical conditions associated with SRL.

Serine/arginine repetitive matrix 2 (SRRM2, Accession NP_057417.2) is another GAM1338 target gene, herein designated TARGET GENE. SRRM2 BINDING SITE is a target binding site found in the 5' untranslated region of mRNA encoded by SRRM2, corresponding to a target binding site such as BINDING SITE I, BINDING SITE II or BINDING SITE III of FIG. 8. Table 4 illustrates the complementarity of the nucleotide sequences of SRRM2 BINDING SITE, designated SEQ ID:18975, to the nucleotide sequence of GAM1338 RNA, herein designated GAM RNA, also designated SEQ ID:360.

Another function of GAM1338 is therefore inhibition of Serine/arginine repetitive matrix 2 (SRRM2, Accession NP_057417.2), a gene which RELATED NUCLEAR MATRIX PROTEIN. Accordingly, utilities of GAM1338 include diagnosis, prevention and treatment of diseases and clinical conditions associated with SRRM2.

The function of SRRM2 and its association with various diseases and clinical conditions, has been established by previous studies, as described hereinabove with reference to GAM189.1. Synovial sarcoma translocation, chromosome 18 (SS18, Accession NP_005628.1) is another GAM1338 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:10975, to the nucleotide sequence of GAM1338 RNA, herein designated GAM RNA, also designated SEQ ID:360.

Another function of GAM1338 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM1338 include diagnosis, prevention and treatment of Human synovial sarcomas, and of other diseases and clinical conditions associated with SS18.

The function of SS18 and its association with various diseases and clinical conditions, has been established by previous studies, as described hereinabove with reference to GAM130.1. Signal transducing adaptor molecule (sh3 domain and itam motif) 2 (STAM2, Accession NP_005834.3) is another GAM1338 target gene, herein designated TARGET GENE. STAM2 BINDING SITE is a target binding site found in the 3' untranslated region of mRNA encoded by STAM2, corresponding to a target binding site such as BINDING SITE I, BINDING SITE II or BINDING SITE III of FIG. 8. Table 4 illustrates the complementarity of the nucleotide sequences of STAM2 BINDING SITE, designated SEQ ID:5920, to the nucleotide sequence of GAM1338 RNA, herein designated GAM RNA, also designated SEQ ID:360.

Another function of GAM1338 is therefore inhibition of Signal transducing adaptor molecule (sh3 domain and itam motif) 2 (STAM2, Accession NP_005834.3). Accordingly, utilities of GAM1338 include diagnosis, prevention and treatment of diseases and clinical conditions associated with STAM2.

Start domain containing 4, sterol regulated (STARD4, Accession NP_631903.1) is another GAM1338 target gene, herein designated TARGET GENE. STARD4 BINDING SITE is a target binding site found in the 3' untranslated region of mRNA encoded by STARD4, corresponding to a target binding site such as BINDING SITE I, BINDING SITE II or BINDING SITE III of FIG. 8. Table 4 illustrates the complementarity of the nucleotide sequences of STARD4 BINDING SITE, designated SEQ ID:14279, to the nucleotide sequence of GAM1338 RNA, herein designated GAM RNA, also designated SEQ ID:360.

Another function of GAM1338 is therefore inhibition of Start domain containing 4, sterol regulated (STARD4, Accession NP_631903.1). Accordingly, utilities of GAM1338 include diagnosis, prevention and treatment of diseases and clinical conditions associated with STARD4.

Staufen, rna binding protein (drosophila) (STAU, Accession NP_004593.1) is another GAM1338 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:9365, to the nucleotide sequence of GAM1338 RNA, herein designated GAM RNA, also designated SEQ ID:360.

Another function of GAM1338 is therefore inhibition of Staufen, rna binding protein (drosophila) (STAU, Accession NP_004593.1), a gene which may play a role in specific positioning of mrnas at given sites in the cell and in stimulating their translation at the site. Accordingly, utilities of GAM1338 include diagnosis, prevention and treatment of diseases and clinical conditions associated with STAU.

The function of STAU and its association with various diseases and clinical conditions, has been established by previous studies, as described hereinabove with reference to GAM37.1. Sulfotransferase, estrogen-preferring (STE, Accession NP_005411.1) is another GAM1338 target gene, herein designated TARGET GENE. STE BINDING SITE is a target binding site found in the 3' untranslated region of mRNA encoded by STE, corresponding to a target binding site such as BINDING SITE I, BINDING SITE II or BINDING SITE III of FIG. 8. Table 4 illustrates the complementarity of the nucleotide sequences of STE BINDING SITE, designated SEQ ID:13898, to the nucleotide sequence of GAM1338 RNA, herein designated GAM RNA, also designated SEQ ID:360.

Another function of GAM1338 is therefore inhibition of Sulfotransferase, estrogen-preferring (STE, Accession NP_005411.1), a gene which sulfates estrone and dehydroepiandrosterone, but not dopamine. Accordingly, utilities of GAM1338 include diagnosis, prevention and treatment of diseases and clinical conditions associated with STE.

The function of STE and its association with various diseases and clinical conditions, has been established by previous studies, as described hereinabove with reference to GAM189.1. Six transmembrane epithelial antigen of prostate 2 (STEAP2, Accession NP_694544.1) is another GAM1338 target gene, herein designated TARGET GENE. STEAP2 BINDING SITE is a target binding site found in the 3' untranslated region of mRNA encoded by STEAP2, corresponding to a target binding site such as BINDING SITE I, BINDING SITE II or BINDING SITE III of FIG. 8. Table 4 illustrates the complementarity of the nucleotide sequences of STEAP2 BINDING SITE, designated SEQ ID:1413, to the nucleotide sequence of GAM1338 RNA, herein designated GAM RNA, also designated SEQ ID:360.

Another function of GAM1338 is therefore inhibition of Six transmembrane epithelial antigen of prostate 2 (STEAP2, Accession NP_694544.1). Accordingly, utilities of GAM1338 include diagnosis, prevention and treatment of diseases and clinical conditions associated with STEAP2.

Stomatin (STOM, Accession NP_004090.3) is another GAM1338 target gene, herein designated TARGET GENE. STOM BINDING SITE is a target binding site found in the 3' untranslated region of mRNA encoded by STOM, corresponding to a target binding site such as BINDING SITE I, BINDING SITE II or BINDING SITE III of FIG. 8. Table 4 illustrates the complementarity of the nucleotide sequences of STOM BINDING SITE, designated SEQ ID:4144, to the nucleotide sequence of GAM1338 RNA, herein designated GAM RNA, also designated SEQ ID:360.

Another function of GAM1338 is therefore inhibition of Stomatin (STOM, Accession NP_004090.3). Accordingly, utilities of GAM1338 include diagnosis, prevention and treatment of diseases and clinical conditions associated with STOM.

Syntaxin binding protein 6 (amisyn) (STXBP6, Accession NP_054897.4) is another GAM1338 target gene, herein designated TARGET GENE. STXBP6 BINDING SITE is a target binding site found in the 5' untranslated region of mRNA encoded by STXBP6, corresponding to a target binding site such as BINDING SITE I, BINDING SITE II or BINDING SITE III of FIG. 8. Table 4 illustrates the complementarity of the nucleotide sequences of STXBP6 BINDING SITE, designated SEQ ID:11916, to the nucleotide sequence of GAM1338 RNA, herein designated GAM RNA, also designated SEQ ID:360.

Another function of GAM1338 is therefore inhibition of Syntaxin binding protein 6 (amisyn) (STXBP6, Accession NP_054897.4). Accordingly, utilities of GAM1338 include diagnosis, prevention and treatment of diseases and clinical conditions associated with STXBP6.

Synaptotagmin xi (SYT11, Accession NP_689493.2) is another GAM1338 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:1690, to the nucleotide sequence of GAM1338 RNA, herein designated GAM RNA, also designated SEQ ID:360.

Another function of GAM1338 is therefore inhibition of Synaptotagmin xi (SYT11, Accession NP_689493.2). Accordingly, utilities of GAM1338 include diagnosis, prevention and treatment of diseases and clinical conditions associated with SYT11.

Synaptotagmin xiii (SYT13, Accession NP_065877.1) is another GAM1338 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:19065, to the nucleotide sequence of GAM1338 RNA, herein designated GAM RNA, also designated SEQ ID:360.

Another function of GAM1338 is therefore inhibition of Synaptotagmin xiii (SYT13, Accession NP_065877.1). Accordingly, utilities of GAM1338 include diagnosis, prevention and treatment of diseases and clinical conditions associated with SYT13.

TADA3L (Accession NP_597814.1) is another GAM1338 target gene, herein designated TARGET GENE. TADA3L BINDING SITE is a target binding site found in the 3' untranslated region of multiple transcripts of mRNA encoded by TADA3L, corresponding to a target binding site such as BINDING SITE I, BINDING SITE II or BINDING SITE III of FIG. 8. Table 4 illustrates the complementarity of the nucleotide sequences of TADA3L BINDING SITE, designated SEQ ID:10415, to the nucleotide sequence of GAM1338 RNA, herein designated GAM RNA, also designated SEQ ID:360.

Another function of GAM1338 is therefore inhibition of TADA3L (Accession NP_597814.1). Accordingly, utilities of GAM1338 include diagnosis, prevention and treatment of diseases and clinical conditions associated with TADA3L.

T-cell acute lymphocytic leukemia 1 (TAL1, Accession NP_003180.1) is another GAM1338 target gene, herein designated TARGET GENE. TAL1 BINDING SITE1 and TAL1 BINDING SITE2 are target binding sites found in untranslated regions of mRNA encoded by TAL1, corresponding to target binding sites such as BINDING SITE I, BINDING SITE II or BINDING SITE III of FIG. 8. Table 4 illustrates the complementarity of the nucleotide sequences of TAL1 BINDING SITE1 and TAL1 BINDING SITE2, designated SEQ ID:7347 and SEQ ID:19155 respectively, to the nucleotide sequence of GAM1338 RNA, herein designated GAM RNA, also designated SEQ ID:360.

Another function of GAM1338 is therefore inhibition of T-cell acute lymphocytic leukemia 1 (TAL1, Accession NP_003180.1), a gene which may help control cell growth and differentiation. Accordingly, utilities of GAM1338 include diagnosis, prevention and treatment of diseases and clinical conditions associated with TAL1.

The function of TAL1 and its association with various diseases and clinical conditions, has been established by previous studies, as described hereinabove with reference to GAM30.1. Tap binding protein (tapasin) (TAPBP, Accession NP_003181.3) is another GAM1338 target gene, herein designated TARGET GENE. TAPBP BINDING SITE1 through TAPBP BINDING SITE3 are target binding sites found in untranslated regions of multiple transcripts of mRNA encoded by TAPBP, corresponding to target binding sites such as BINDING SITE I, BINDING SITE II or BINDING SITE III of FIG. 8. Table 4 illustrates the complementarity of the nucleotide sequences of TAPBP BINDING SITE1 through TAPBP BINDING SITE3, designated SEQ ID:6086, SEQ ID:8861 and SEQ ID:3109 respectively, to the nucleotide sequence of GAM1338 RNA, herein designated GAM RNA, also designated SEQ ID:360.

Another function of GAM1338 is therefore inhibition of Tap binding protein (tapasin) (TAPBP, Accession NP_003181.3), a gene which is involved in MHC class I-restricted antigen processing. Accordingly, utilities of GAM1338 include diagnosis, prevention and treatment of diseases and clinical conditions associated with TAPBP.

The function of TAPBP and its association with various diseases and clinical conditions, has been established by previous studies, as described hereinabove with reference to GAM136.1. Tyrosine aminotransferase (TAT, Accession NP_000344.1) is another GAM1338 target gene, herein designated TARGET GENE. TAT BINDING SITE is a target binding site found in the 3' untranslated region of mRNA encoded by TAT, corresponding to a target binding site such as BINDING SITE I, BINDING SITE II or BINDING SITE III of FIG. 8. Table 4 illustrates the complementarity of the nucleotide sequences of TAT BINDING SITE, designated SEQ ID:20161, to the nucleotide sequence of GAM1338 RNA, herein designated GAM RNA, also designated SEQ ID:360.

Another function of GAM1338 is therefore inhibition of Tyrosine aminotransferase (TAT, Accession NP_000344.1), a gene which is tyrosine aminotransferase and strongly similar to rat Rn.9947, which plays a role in gluconeogenesis.

Accordingly, utilities of GAM1338 include diagnosis, prevention and treatment of diseases and clinical conditions associated with TAT.

The function of TAT and its association with various diseases and clinical conditions, has been established by previous studies, as described hereinabove with reference to GAM189.1. Tafazzin (cardiomyopathy, dilated 3a (x-linked); endocardial fibroelastosis 2; barth syndrome) (TAZ, Accession NP_851831.1) is another GAM1338 target gene, herein designated TARGET GENE. TAZ BINDING SITE is a target binding site found in the 3' untranslated region of multiple transcripts of mRNA encoded by TAZ, corresponding to a target binding site such as BINDING SITE I, BINDING SITE II or BINDING SITE III of FIG. 8. Table 4 illustrates the complementarity of the nucleotide sequences of TAZ BINDING SITE, designated SEQ ID:14872, to the nucleotide sequence of GAM1338 RNA, herein designated GAM RNA, also designated SEQ ID:360.

Another function of GAM1338 is therefore inhibition of Tafazzin (cardiomyopathy, dilated 3a (x-linked); endocardial fibroelastosis 2; barth syndrome) (TAZ, Accession NP_851831.1). Accordingly, utilities of GAM1338 include diagnosis, prevention and treatment of diseases and clinical conditions associated with TAZ.

Tbc1 domain family, member 5 (TBC1D5, Accession NP_055559.1) is another GAM1338 target gene, herein designated TARGET GENE. TBC1D5 BINDING SITE is a target binding site found in the 5' untranslated region of mRNA encoded by TBC1D5, corresponding to a target binding site such as BINDING SITE I, BINDING SITE II or BINDING SITE III of FIG. 8. Table 4 illustrates the complementarity of the nucleotide sequences of TBC1D5 BINDING SITE, designated SEQ ID:12382, to the nucleotide sequence of GAM1338 RNA, herein designated GAM RNA, also designated SEQ ID:360.

Another function of GAM1338 is therefore inhibition of Tbc1 domain family, member 5 (TBC1D5, Accession NP_055559.1). Accordingly, utilities of GAM1338 include diagnosis, prevention and treatment of diseases and clinical conditions associated with TBC1D5.

Titin-cap (telethonin) (TCAP, Accession NP_003664.1) is another GAM1338 target gene, herein designated TARGET GENE. TCAP BINDING SITE is a target binding site found in the 3' untranslated region of mRNA encoded by TCAP, corresponding to a target binding site such as BINDING SITE I, BINDING SITE II or BINDING SITE III of FIG. 8. Table 4 illustrates the complementarity of the nucleotide sequences of TCAP BINDING SITE, designated SEQ ID:19403, to the nucleotide sequence of GAM1338 RNA, herein designated GAM RNA, also designated SEQ ID:360.

Another function of GAM1338 is therefore inhibition of Titin-cap (telethonin) (TCAP, Accession NP_003664.1). Accordingly, utilities of GAM1338 include diagnosis, prevention and treatment of diseases and clinical conditions associated with TCAP.

Transcription factor 2, hepatic; lf-b3; variant hepatic nuclear factor (TCF2, Accession NP_006472.1) is another GAM1338 target gene, herein designated TARGET GENE. TCF2 BINDING SITE is a target binding site found in the 3' untranslated region of multiple transcripts of mRNA encoded by TCF2, corresponding to a target binding site such as BINDING SITE I, BINDING SITE II or BINDING SITE III of FIG. 8. Table 4 illustrates the complementarity of the nucleotide sequences of TCF2 BINDING SITE, designated SEQ ID:401, to the nucleotide sequence of GAM1338 RNA, herein designated GAM RNA, also designated SEQ ID:360.

Another function of GAM1338 is therefore inhibition of Transcription factor 2, hepatic; lf-b3; variant hepatic nuclear factor (TCF2, Accession NP_006472.1), a gene which probably binds to the inverted palindrome 5'-gttaatnattaac-3'. and therefore is associated with Maturity-onset diabetes of the young type 5 (mody5), familial hypoplastic glomerulocystic kidney disease (gckd). Accordingly, utilities of GAM1338 include diagnosis, prevention and treatment of Maturity-onset diabetes of the young type 5 (mody5), familial hypoplastic glomerulocystic kidney disease (gckd), and of other diseases and clinical conditions associated with TCF2.

The function of TCF2 and its association with various diseases and clinical conditions, has been established by previous studies, as described hereinabove with reference to GAM144.1. T-cell, immune regulator 1, atpase, h+ transporting, lysosomal v0 protein a isoform 3 (TCIRG1, Accession NP_006010.2) is another GAM1338 target gene, herein designated TARGET GENE. TCIRG1 BINDING SITE is a target binding site found in the 5' untranslated region of multiple transcripts of mRNA encoded by TCIRG1, corresponding to a target binding site such as BINDING SITE I, BINDING SITE II or BINDING SITE III of FIG. 8. Table 4 illustrates the complementarity of the nucleotide sequences of TCIRG1 BINDING SITE, designated SEQ ID:7780, to the nucleotide sequence of GAM1338 RNA, herein designated GAM RNA, also designated SEQ ID:360.

Another function of GAM1338 is therefore inhibition of T-cell, immune regulator 1, atpase, h+ transporting, lysosomal v0 protein a isoform 3 (TCIRG1, Accession NP_006010.2), a gene which seems to be directly involved in t cell activation. Accordingly, utilities of GAM1338 include diagnosis, prevention and treatment of diseases and clinical conditions associated with TCIRG1.

The function of TCIRG1 and its association with various diseases and clinical conditions, has been established by previous studies, as described hereinabove with reference to GAM223.1. T-cell leukemia/lymphoma 6 (TCL6, Accession NP_036600.2) is another GAM1338 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:12973 and SEQ ID:12973 respectively, to the nucleotide sequence of GAM1338 RNA, herein designated GAM RNA, also designated SEQ ID:360.

Another function of GAM1338 is therefore inhibition of T-cell leukemia/lymphoma 6 (TCL6, Accession NP_036600.2). Accordingly, utilities of GAM1338 include diagnosis, prevention and treatment of diseases and clinical conditions associated with TCL6.

T-cell leukemia/lymphoma 6 (TCL6, Accession NP_065579.2) is another GAM1338 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:6911 and SEQ ID:12973 respectively, to the nucleotide sequence of GAM1338 RNA, herein designated GAM RNA, also designated SEQ ID:360.

Another function of GAM1338 is therefore inhibition of T-cell leukemia/lymphoma 6 (TCL6, Accession NP_065579.2). Accordingly, utilities of GAM1338 include diagnosis, prevention and treatment of diseases and clinical conditions associated with TCL6.

T-cell leukemia/lymphoma 6 (TCL6, Accession NP_065578.2) is another GAM1338 target gene, herein designated TARGET GENE. TCL6 BINDING SITE1 and TCL6 BINDING SITE2 are target binding sites found in untranslated regions of multiple transcripts of mRNA encoded by TCL6, corresponding to target binding sites such as BINDING SITE I, BINDING SITE II or BINDING SITE III of FIG. 8. Table 4 illustrates the complementarity of the nucleotide sequences of TCL6 BINDING SITE1 and TCL6 BINDING SITE2, designated SEQ ID:6911 and SEQ ID:12973 respectively, to the nucleotide sequence of GAM1338 RNA, herein designated GAM RNA, also designated SEQ ID:360.

Another function of GAM1338 is therefore inhibition of T-cell leukemia/lymphoma 6 (TCL6, Accession NP_065578.2). Accordingly, utilities of GAM1338 include diagnosis, prevention and treatment of diseases and clinical conditions associated with TCL6.

TERA (Accession NP_067061.1) is another GAM1338 target gene, herein designated TARGET GENE. TERA BINDING SITE is a target binding site found in the 3' untranslated region of mRNA encoded by TERA, corresponding to a target binding site such as BINDING SITE I, BINDING SITE II or BINDING SITE III of FIG. 8. Table 4 illustrates the complementarity of the nucleotide sequences of TERA BINDING SITE, designated SEQ ID:971, to the nucleotide sequence of GAM1338 RNA, herein designated GAM RNA, also designated SEQ ID:360.

Another function of GAM1338 is therefore inhibition of TERA (Accession NP_067061.1). Accordingly, utilities of GAM1338 include diagnosis, prevention and treatment of diseases and clinical conditions associated with TERA.

Telomeric repeat binding factor (nima-interacting) 1 (TERF1, Accession NP_003209.1) is another GAM1338 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:13870, to the nucleotide sequence of GAM1338 RNA, herein designated GAM RNA, also designated SEQ ID:360.

Another function of GAM1338 is therefore inhibition of Telomeric repeat binding factor (nima-interacting) 1 (TERF1, Accession NP_003209.1), a gene which negatively regulates telomere length, involves in regulation of the mitotic spindle. Accordingly, utilities of GAM1338 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor (nima-interacting) 1 (TERF1, Accession NP_059523.1) is another GAM1338 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:13870, to the nucleotide sequence of GAM1338 RNA, herein designated GAM RNA, also designated SEQ ID:360.

Another function of GAM1338 is therefore inhibition of Telomeric repeat binding factor (nima-interacting) 1 (TERF1, Accession NP_059523.1), a gene which negatively regulates telomere length, involves in regulation of the mitotic spindle. Accordingly, utilities of GAM1338 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor 2 (TERF2, Accession NP_005643.1) is another GAM1338 target gene, herein designated TARGET GENE. TERF2 BINDING SITE is a target binding site found in the 3' untranslated region of mRNA encoded by TERF2, corresponding to a target binding site such as BINDING SITE I, BINDING SITE II or BINDING SITE III of FIG. 8. Table 4 illustrates the complementarity of the nucleotide sequences of TERF2 BINDING SITE, designated SEQ ID:11659, to the nucleotide sequence of GAM1338 RNA, herein designated GAM RNA, also designated SEQ ID:360.

Another function of GAM1338 is therefore inhibition of Telomeric repeat binding factor 2 (TERF2, Accession NP_005643.1), a gene which plays a key role in the protective activity of telomeres. Accordingly, utilities of GAM1338 include diagnosis, prevention and treatment of diseases and clinical conditions associated with TERF2.

The function of TERF2 and its association with various diseases and clinical conditions, has been established by previous studies, as described hereinabove with reference to GAM133.2. Tgfb-induced factor 2 (tale family homeobox) (TGIF2, Accession NP_068581.1) is another GAM1338 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:7274, to the nucleotide sequence of GAM1338 RNA, herein designated GAM RNA, also designated SEQ ID:360.

Another function of GAM1338 is therefore inhibition of Tgfb-induced factor 2 (tale family homeobox) (TGIF2, Accession NP_068581.1). Accordingly, utilities of GAM1338 include diagnosis, prevention and treatment of diseases and clinical conditions associated with TGIF2.

Tigger transposable element derived 6 (TIGD6, Accession NP_112215.1) is another GAM1338 target gene, herein designated TARGET GENE. TIGD6 BINDING SITE is a target binding site found in the 3' untranslated region of mRNA encoded by TIGD6, corresponding to a target binding site such as BINDING SITE I, BINDING SITE II or BINDING SITE III of FIG. 8. Table 4 illustrates the complementarity of the nucleotide sequences of TIGD6 BINDING SITE, designated SEQ ID:17302, to the nucleotide sequence of GAM1338 RNA, herein designated GAM RNA, also designated SEQ ID:360.

Another function of GAM1338 is therefore inhibition of Tigger transposable element derived 6 (TIGD6, Accession NP_112215.1). Accordingly, utilities of GAM1338 include diagnosis, prevention and treatment of diseases and clinical conditions associated with TIGD6.

TIM50L (Accession XP_053074.2) is another GAM1338 target gene, herein designated TARGET GENE. TIM50L BINDING SITE1 and TIM50L BINDING SITE2 are target binding sites found in untranslated regions of mRNA encoded by TIM50L, corresponding to target binding sites such as BINDING SITE I, BINDING SITE II or BINDING SITE III of FIG. 8. Table 4 illustrates the complementarity of the nucleotide sequences of TIM50L BINDING SITE1 and TIM50L BINDING SITE2, designated SEQ ID:7201 and SEQ ID:7571 respectively, to the nucleotide sequence of GAM1338 RNA, herein designated GAM RNA, also designated SEQ ID:360.

Another function of GAM1338 is therefore inhibition of TIM50L (Accession XP_053074.2). Accordingly, utilities of GAM1338 include diagnosis, prevention and treatment of diseases and clinical conditions associated with TIM50L.

Toll-like receptor 5 (TLR5, Accession NP_003259.2) is another GAM1338 target gene, herein designated TARGET GENE. TLR5 BINDING SITE is a target binding site found in the 5' untranslated region of mRNA encoded by TLR5, corresponding to a target binding site such as BINDING SITE I, BINDING SITE II or BINDING SITE III of FIG. 8. Table 4 illustrates the complementarity of the nucleotide sequences of TLR5 BINDING SITE, designated SEQ ID:16358, to the nucleotide sequence of GAM1338 RNA, herein designated GAM RNA, also designated SEQ ID:360.

Another function of GAM1338 is therefore inhibition of Toll-like receptor 5 (TLR5, Accession NP_003259.2), a gene which participates in the innate immune response to bacterial flagellins. Accordingly, utilities of GAM1338 include diagnosis, prevention and treatment of diseases and clinical conditions associated with TLR5.

The function of TLR5 and its association with various diseases and clinical conditions, has been established by previous studies, as described hereinabove with reference to GAM40.1. Transmembrane, cochlear expressed, 1 (TMC1, Accession NP_619636.2) is another GAM1338 target gene, herein designated TARGET GENE. TMC1 BINDING SITE is a target binding site found in the 5' untranslated region of mRNA encoded by TMC1, corresponding to a target binding site such as BINDING SITE I, BINDING SITE II or BINDING SITE III of FIG. 8. Table 4 illustrates the complementarity of the nucleotide sequences of TMC1 BINDING SITE, designated SEQ ID:19429, to the nucleotide sequence of GAM1338 RNA, herein designated GAM RNA, also designated SEQ ID:360.

Another function of GAM1338 is therefore inhibition of Transmembrane, cochlear expressed, 1 (TMC1, Accession NP_619636.2), a gene which is required for normal function of cochlear hair cells and therefore may be associated with Autosomal recessive nonsyndromic neurosensory deafness and autosomal dominant nonsyndromic sensorineural hearing loss. Accordingly, utilities of GAM1338 include diagnosis, prevention and treatment of Autosomal recessive nonsyndromic neurosensory deafness and autosomal dominant nonsyndromic sensorineural hearing loss ., and of other diseases and clinical conditions associated with TMC1.

The function of TMC1 and its association with various diseases and clinical conditions, has been established by previous studies, as described hereinabove with reference to GAM136.1. TMEM14A (Accession NP_054770.1) is another GAM1338 target gene, herein designated TARGET GENE. TMEM14A BINDING SITE is a target binding site found in the 5' untranslated region of mRNA encoded by TMEM14A, corresponding to a target binding site such as BINDING SITE I, BINDING SITE II or BINDING SITE III of FIG. 8. Table 4 illustrates the complementarity of the nucleotide sequences of TMEM14A BINDING SITE, designated SEQ ID:7622, to the nucleotide sequence of GAM1338 RNA, herein designated GAM RNA, also designated SEQ ID:360.

Another function of GAM1338 is therefore inhibition of TMEM14A (Accession NP_054770.1). Accordingly, utilities of GAM1338 include diagnosis, prevention and treatment of diseases and clinical conditions associated with TMEM14A.

Transmembrane protease, serine 3 (TMPRSS3, Accession NP_115780.1) is another GAM1338 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:15133, to the nucleotide sequence of GAM1338 RNA, herein designated GAM RNA, also designated SEQ ID:360.

Another function of GAM1338 is therefore inhibition of Transmembrane protease, serine 3 (TMPRSS3, Accession NP_115780.1). Accordingly, utilities of GAM1338 include diagnosis, prevention and treatment of diseases and clinical conditions associated with TMPRSS3.

Transmembrane protease, serine 3 (TMPRSS3, Accession NP_076927.1) is another GAM1338 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:15133, to the nucleotide sequence of GAM1338 RNA, herein designated GAM RNA, also designated SEQ ID:360.

Another function of GAM1338 is therefore inhibition of Transmembrane protease, serine 3 (TMPRSS3, Accession NP_076927.1). Accordingly, utilities of GAM1338 include diagnosis, prevention and treatment of diseases and clinical conditions associated with TMPRSS3.

Transmembrane protease, serine 3 (TMPRSS3, Accession NP_115777.1) is another GAM1338 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:15133, to the nucleotide sequence of GAM1338 RNA, herein designated GAM RNA, also designated SEQ ID:360.

Another function of GAM1338 is therefore inhibition of Transmembrane protease, serine 3 (TMPRSS3, Accession NP_115777.1). Accordingly, utilities of GAM1338 include diagnosis, prevention and treatment of diseases and clinical conditions associated with TMPRSS3.

Tumor necrosis factor, alpha-induced protein 2 (TNFAIP2, Accession NP_006282.2) is another GAM1338 target gene, herein designated TARGET GENE. TNFAIP2 BINDING SITE is a target binding site found in the 3' untranslated region of mRNA encoded by TNFAIP2, corresponding to a target binding site such as BINDING SITE I, BINDING SITE II or BINDING SITE III of FIG. 8. Table 4 illustrates the complementarity of the nucleotide sequences of TNFAIP2 BINDING SITE, designated SEQ ID:14228, to the nucleotide sequence of GAM1338 RNA, herein designated GAM RNA, also designated SEQ ID:360.

Another function of GAM1338 is therefore inhibition of Tumor necrosis factor, alpha-induced protein 2 (TNFAIP2, Accession NP_006282.2). Accordingly, utilities of GAM1338 include diagnosis, prevention and treatment of diseases and clinical conditions associated with TNFAIP2.

Tumor necrosis factor receptor superfamily, member 10b (TNFRSF10B, Accession NP_003833.3) is another GAM1338 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:9933, to the nucleotide sequence of GAM1338 RNA, herein designated GAM RNA, also designated SEQ ID:360.

Another function of GAM1338 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM1338 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 10b (TNFRSF10B, Accession NP_671716.1) is another GAM1338 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:9933, to the nucleotide sequence of GAM1338 RNA, herein designated GAM RNA, also designated SEQ ID:360.

Another function of GAM1338 is therefore inhibition of Tumor necrosis factor receptor superfamily, member 10b (TNFRSF10B, Accession NP_671716.1), a gene which forms complex that induces apoptosis. and therefore may be associated with Squamous cell carcinoma. Accordingly, utilities of GAM1338 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 11a, activator of nfkb (TNFRSF11A, Accession NP_003830.1) is another GAM1338 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:11190, to the nucleotide sequence of GAM1338 RNA, herein designated GAM RNA, also designated SEQ ID:360.

Another function of GAM1338 is therefore inhibition of Tumor necrosis factor receptor superfamily, member 11a, activator of nfkb (TNFRSF11A, Accession NP_003830.1). Accordingly, utilities of GAM1338 include diagnosis, prevention and treatment of diseases and clinical conditions associated with TNFRSF11A.

Tumor necrosis factor receptor superfamily, member 9 (TNFRSF9, Accession NP_001552.2) is another GAM1338 target gene, herein designated TARGET GENE. TNFRSF9 BINDING SITE is a target binding site found in the 3' untranslated region of mRNA encoded by TNFRSF9, corresponding to a target binding site such as BINDING SITE I, BINDING SITE II or BINDING SITE III of FIG. 8. Table 4 illustrates the complementarity of the nucleotide sequences of TNFRSF9 BINDING SITE, designated SEQ ID:438, to the nucleotide sequence of GAM1338 RNA, herein designated GAM RNA, also designated SEQ ID:360.

Another function of GAM1338 is therefore inhibition of Tumor necrosis factor receptor superfamily, member 9 (TNFRSF9, Accession NP_001552.2), a gene which inhibits proliferation of activated T lymphocytes. Accordingly, utilities of GAM1338 include diagnosis, prevention and treatment of diseases and clinical conditions associated with TNFRSF9.

The function of TNFRSF9 and its association with various diseases and clinical conditions, has been established by previous studies, as described hereinabove with reference to GAM189.1. Torsin family 1, member b (torsin b) (TOR1B, Accession NP_055321.1) is another GAM1338 target gene, herein designated TARGET GENE. TOR1B BINDING SITE is a target binding site found in the 3' untranslated region of mRNA encoded by TOR1B, corresponding to a target binding site such as BINDING SITE I, BINDING SITE II or BINDING SITE III of FIG. 8. Table 4 illustrates the complementarity of the nucleotide sequences of TOR1B BINDING SITE, designated SEQ ID:2429, to the nucleotide sequence of GAM1338 RNA, herein designated GAM RNA, also designated SEQ ID:360.

Another function of GAM1338 is therefore inhibition of Torsin family 1, member b (torsin b) (TOR1B, Accession NP_055321.1). Accordingly, utilities of GAM1338 include diagnosis, prevention and treatment of diseases and clinical conditions associated with TOR1B.

Tumor protein p53 (li-fraumeni syndrome) (TP53, Accession NP_000537.2) is another GAM1338 target gene, herein designated TARGET GENE. TP53 BINDING SITE is a target binding site found in the 3' untranslated region of mRNA encoded by TP53, corresponding to a target binding site such as BINDING SITE I, BINDING SITE II or BINDING SITE III of FIG. 8. Table 4 illustrates the complementarity of the nucleotide sequences of TP53 BINDING SITE, designated SEQ ID:2118, to the nucleotide sequence of GAM1338 RNA, herein designated GAM RNA, also designated SEQ ID:360.

Another function of GAM1338 is therefore inhibition of Tumor protein p53 (li-fraumeni syndrome) (TP53, Accession NP_000537.2). Accordingly, utilities of GAM1338 include diagnosis, prevention and treatment of diseases and clinical conditions associated with TP53.

Thiopurine s-methyltransferase (TPMT, Accession NP_000358.1) is another GAM1338 target gene, herein designated TARGET GENE. TPMT BINDING SITE is a target binding site found in the 3' untranslated region of mRNA encoded by TPMT, corresponding to a target binding site such as BINDING SITE I, BINDING SITE II or BINDING SITE III of FIG. 8. Table 4 illustrates the complementarity of the nucleotide sequences of TPMT BINDING SITE, designated SEQ ID:10218, to the nucleotide sequence of GAM1338 RNA, herein designated GAM RNA, also designated SEQ ID:360.

Another function of GAM1338 is therefore inhibition of Thiopurine s-methyltransferase (TPMT, Accession NP_000358.1), a gene which catalyzes the s-methylation of thiopurine drugs such as 6-mercaptopurine. and therefore may be associated with Thiopurine s-methyltransferase polymorphism. Accordingly, utilities of GAM1338 include diagnosis, prevention and treatment of Thiopurine s-methyltransferase polymorphism, and of other diseases and clinical conditions associated with TPMT.

The function of TPMT and its association with various diseases and clinical conditions, has been established by previous studies, as described hereinabove with reference to GAM130.1. Tnf receptor-associated factor 5 (TRAF5, Accession NP_665702.1) is another GAM1338 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:10175, to the nucleotide sequence of GAM1338 RNA, herein designated GAM RNA, also designated SEQ ID:360.

Another function of GAM1338 is therefore inhibition of Tnf receptor-associated factor 5 (TRAF5, Accession NP_665702.1), a gene which Member of a family of proteins that interact with TNF receptors; binds the lymphotoxin beta receptor (LTBR). Accordingly, utilities of GAM1338 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tnf receptor-associated factor 5 (TRAF5, Accession NP_004610.1) is another GAM1338 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:10175, to the nucleotide sequence of GAM1338 RNA, herein designated GAM RNA, also designated SEQ ID:360.

Another function of GAM1338 is therefore inhibition of Tnf receptor-associated factor 5 (TRAF5, Accession NP_004610.1), a gene which Member of a family of proteins that interact with TNF receptors; binds the lymphotoxin beta receptor (LTBR). Accordingly, utilities of GAM1338 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tripartite motif-containing 16 (TRIM16, Accession NP_006461.2) is another GAM1338 target gene, herein designated TARGET GENE. TRIM16 BINDING SITE is a target binding site found in the 3' untranslated region of mRNA encoded by TRIM16, corresponding to a target binding site such as BINDING SITE I, BINDING SITE II or BINDING SITE III of FIG. 8. Table 4 illustrates the complementarity of the nucleotide sequences of TRIM16 BINDING SITE, designated SEQ ID:13321, to the nucleotide sequence of GAM1338 RNA, herein designated GAM RNA, also designated SEQ ID:360.

Another function of GAM1338 is therefore inhibition of Tripartite motif-containing 16 (TRIM16, Accession NP_006461.2). Accordingly, utilities of GAM1338 include diagnosis, prevention and treatment of diseases and clinical conditions associated with TRIM16.

Tripartite motif-containing 5 (TRIM5, Accession NP_149023.1) is another GAM1338 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:9916, to the nucleotide sequence of GAM1338 RNA, herein designated GAM RNA, also designated SEQ ID:360.

Another function of GAM1338 is therefore inhibition of Tripartite motif-containing 5 (TRIM5, Accession NP_149023.1). Accordingly, utilities of GAM1338 include diagnosis, prevention and treatment of diseases and clinical conditions associated with TRIM5.

Transient receptor potential cation channel, subfamily v, member 1 (TRPV1, Accession NP_542437.1) is another GAM1338 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:1587 and SEQ ID:15897 respectively, to the nucleotide sequence of GAM1338 RNA, herein designated GAM RNA, also designated SEQ ID:360.

Another function of GAM1338 is therefore inhibition of Transient receptor potential cation channel, subfamily v, member 1 (TRPV1, Accession NP_542437.1), a gene which functions as a receptor for capsaicin. Accordingly, utilities of GAM1338 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542437.1) is another GAM1338 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:15897 and SEQ ID:15897 respectively, to the nucleotide sequence of GAM1338 RNA, herein designated GAM RNA, also designated SEQ ID:360.

Another function of GAM1338 is therefore inhibition of Transient receptor potential cation channel, subfamily v, member 1 (TRPV1, Accession NP_542437.1), a gene which functions as a receptor for capsaicin. Accordingly, utilities of GAM1338 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_061197.3) is another GAM1338 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:15897 and SEQ ID:1587 respectively, to the nucleotide sequence of GAM1338 RNA, herein designated GAM RNA, also designated SEQ ID:360.

Another function of GAM1338 is therefore inhibition of Transient receptor potential cation channel, subfamily v, member 1 (TRPV1, Accession NP_061197.3), a gene which functions as a receptor for capsaicin. Accordingly, utilities of GAM1338 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542436.1) is another GAM1338 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:1587 and SEQ ID:1587 respectively, to the nucleotide sequence of GAM1338 RNA, herein designated GAM RNA, also designated SEQ ID:360.

Another function of GAM1338 is therefore inhibition of Transient receptor potential cation channel, subfamily v, member 1 (TRPV1, Accession NP_542436.1), a gene which functions as a receptor for capsaicin. Accordingly, utilities of GAM1338 include diagnosis, prevention and treatment of diseases and clinical conditions associated with TRPV1.

The function of TRPV1 and its association with various diseases and clinical conditions, has been established by previous studies, as described hereinabove with reference to GAM130.1. Tspy-like (TSPy, Accession XP_166325.1) is another GAM1338 target gene, herein designated TARGET GENE. TSPYL BINDING SITE is a target binding site found in the 3' untranslated region of mRNA encoded by TSPy, corresponding to a target binding site such as BINDING SITE I, BINDING SITE II or BINDING SITE III of FIG. 8. Table 4 illustrates the complementarity of the nucleotide sequences of TSPYL BINDING SITE, designated SEQ ID:9101, to the nucleotide sequence of GAM1338 RNA, herein designated GAM RNA, also designated SEQ ID:360.

Another function of GAM1338 is therefore inhibition of Tspy-like (TSPy, Accession XP_166325.1). Accordingly, utilities of GAM1338 include diagnosis, prevention and treatment of diseases and clinical conditions associated with TSPYL.

TTY7 (Accession NP_114132.1) is another GAM1338 target gene, herein designated TARGET GENE. TTY7 BINDING SITE is a target binding site found in the 5' untranslated region of mRNA encoded by TTY7, corresponding to a target binding site such as BINDING SITE I, BINDING SITE II or BINDING SITE III of FIG. 8. Table 4 illustrates the complementarity of the nucleotide sequences of TTY7 BINDING SITE, designated SEQ ID:16664, to the nucleotide sequence of GAM1338 RNA, herein designated GAM RNA, also designated SEQ ID:360.

Another function of GAM1338 is therefore inhibition of TTY7 (Accession NP_114132.1). Accordingly, utilities of GAM1338 include diagnosis, prevention and treatment of diseases and clinical conditions associated with TTY7.

TU12B1-TY (Accession NP_057659.1) is another GAM1338 target gene, herein designated TARGET GENE. TU12B1-TY BINDING SITE1 through TU12B1-TY BINDING SITE3 are target binding sites found in untranslated regions of mRNA encoded by TU12B1-TY, corresponding to target binding sites such as BINDING SITE I, BINDING SITE II or BINDING SITE III of FIG. 8. Table 4 illustrates the complementarity of the nucleotide sequences of TU12B1-TY BINDING SITE1 through TU12B1-TY BINDING SITE3, designated SEQ ID:7327, SEQ ID:12270 and SEQ ID:17849 respectively, to the nucleotide sequence of GAM1338 RNA, herein designated GAM RNA, also designated SEQ ID:360.

Another function of GAM1338 is therefore inhibition of TU12B1-TY (Accession NP_057659.1). Accordingly, utilities of GAM1338 include diagnosis, prevention and treatment of diseases and clinical conditions associated with TU12B1-TY.

Tubby homolog (mouse) (TUB, Accession NP_813977.1) is another GAM1338 target gene, herein designated TARGET GENE. TUB BINDING SITE is a target binding site found in the 3' untranslated region of multiple transcripts of mRNA encoded by TUB, corresponding to a target binding site such as BINDING SITE I, BINDING SITE II or BINDING SITE III of FIG. 8. Table 4 illustrates the complementarity of the nucleotide sequences of TUB BINDING SITE, designated SEQ ID:10826, to the nucleotide sequence of GAM1338 RNA, herein designated GAM RNA, also designated SEQ ID:360.

Another function of GAM1338 is therefore inhibition of Tubby homolog (mouse) (TUB, Accession NP_813977.1). Accordingly, utilities of GAM1338 include diagnosis, prevention and treatment of diseases and clinical conditions associated with TUB.

Tubby homolog (mouse) (TUB, Accession NP_003311.2) is another GAM1338 target gene, herein designated TARGET GENE. TUB BINDING SITE is a target binding site found in the 3' untranslated region of multiple transcripts of mRNA encoded by TUB, corresponding to a target binding site such as BINDING SITE I, BINDING SITE II or BINDING SITE III of FIG. 8. Table 4 illustrates the complementarity of the nucleotide sequences of TUB BINDING SITE, designated SEQ ID:10826, to the nucleotide sequence of GAM1338 RNA, herein designated GAM RNA, also designated SEQ ID:360.

Another function of GAM1338 is therefore inhibition of Tubby homolog (mouse) (TUB, Accession NP_003311.2). Accordingly, utilities of GAM1338 include diagnosis, prevention and treatment of diseases and clinical conditions associated with TUB.

TUCAN (Accession NP_055774.1) is another GAM1338 target gene, herein designated TARGET GENE. TUCAN BINDING SITE1 and TUCAN BINDING SITE2 are target binding sites found in untranslated regions of mRNA encoded by TUCAN, corresponding to target binding sites such as BINDING SITE I, BINDING SITE II or BINDING SITE III of FIG. 8. Table 4 illustrates the complementarity of the nucleotide sequences of TUCAN BINDING SITE1 and TUCAN BINDING SITE2, designated SEQ ID:2265 and SEQ ID:10630 respectively, to the nucleotide sequence of GAM1338 RNA, herein designated GAM RNA, also designated SEQ ID:360.

Another function of GAM1338 is therefore inhibition of TUCAN (Accession NP_055774.1). Accordingly, utilities of GAM1338 include diagnosis, prevention and treatment of diseases and clinical conditions associated with TUCAN.

Tuftelin 1 (TUFT1, Accession NP_064512.1) is another GAM1338 target gene, herein designated TARGET GENE. TUFT1 BINDING SITE is a target binding site found in the 3' untranslated region of mRNA encoded by TUFT1, corresponding to a target binding site such as BINDING SITE I, BINDING SITE II or BINDING SITE III of FIG. 8. Table 4 illustrates the complementarity of the nucleotide sequences of TUFT1 BINDING SITE, designated SEQ ID:19342, to the nucleotide sequence of GAM1338 RNA, herein designated GAM RNA, also designated SEQ ID:360.

Another function of GAM1338 is therefore inhibition of Tuftelin 1 (TUFT1, Accession NP_064512.1), a gene which appears to play a role in cytokinesis, cell shape, and specialized functions such as secretion and capping. Accordingly, utilities of GAM1338 include diagnosis, prevention and treatment of diseases and clinical conditions associated with TUFT1.

The function of TUFT1 and its association with various diseases and clinical conditions, has been established by previous studies, as described hereinabove with reference to GAM136.1. TXL-2 (Accession NP_835231.1) is another GAM1338 target gene, herein designated TARGET GENE. TXL-2 BINDING SITE is a target binding site found in the 5' untranslated region of mRNA encoded by TXL-2, corresponding to a target binding site such as BINDING SITE I, BINDING SITE II or BINDING SITE III of FIG. 8. Table 4 illustrates the complementarity of the nucleotide sequences of TXL-2 BINDING SITE, designated SEQ ID:7572, to the nucleotide sequence of GAM1338 RNA, herein designated GAM RNA, also designated SEQ ID:360.

Another function of GAM1338 is therefore inhibition of TXL-2 (Accession NP_835231.1). Accordingly, utilities of GAM1338 include diagnosis, prevention and treatment of diseases and clinical conditions associated with TXL-2.

Thioredoxin-like 2 (TXNL2, Accession NP_006532.1) is another GAM1338 target gene, herein designated TARGET GENE. TXNL2 BINDING SITE is a target binding site found in the 3' untranslated region of mRNA encoded by TXNL2, corresponding to a target binding site such as BINDING SITE I, BINDING SITE II or BINDING SITE III of FIG. 8. Table 4 illustrates the complementarity of the nucleotide sequences of TXNL2 BINDING SITE, designated SEQ ID:1413, to the nucleotide sequence of GAM1338 RNA, herein designated GAM RNA, also designated SEQ ID:360.

Another function of GAM1338 is therefore inhibition of Thioredoxin-like 2 (TXNL2, Accession NP_006532.1). Accordingly, utilities of GAM1338 include diagnosis, prevention and treatment of diseases and clinical conditions associated with TXNL2.

U1SNRNPBP (Accession NP_851034.1) is another GAM1338 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:18791, to the nucleotide sequence of GAM1338 RNA, herein designated GAM RNA, also designated SEQ ID:360.

Another function of GAM1338 is therefore inhibition of U1SNRNPBP (Accession NP_851034.1). Accordingly, utilities of GAM1338 include diagnosis, prevention and treatment of diseases and clinical conditions associated with U1SNRNPBP.

U1SNRNPBP (Accession NP_851030.1) is another GAM1338 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:18791, to the nucleotide sequence of GAM1338 RNA, herein designated GAM RNA, also designated SEQ ID:360.

Another function of GAM1338 is therefore inhibition of U1SNRNPBP (Accession NP_851030.1). Accordingly, utilities of GAM1338 include diagnosis, prevention and treatment of diseases and clinical conditions associated with U1SNRNPBP.

U1SNRNPBP (Accession NP_008951.1) is another GAM1338 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:18791, to the nucleotide sequence of GAM1338 RNA, herein designated GAM RNA, also designated SEQ ID:360.

Another function of GAM1338 is therefore inhibition of U1SNRNPBP (Accession NP_008951.1). Accordingly, utilities of GAM1338 include diagnosis, prevention and treatment of diseases and clinical conditions associated with U1SNRNPBP.

UBCE7IP5 (Accession NP_055763.1) is another GAM1338 target gene, herein designated TARGET GENE. UBCE7IP5 BINDING SITE is a target binding site found in the 3' untranslated region of mRNA encoded by UBCE7IP5, corresponding to a target binding site such as BINDING SITE I, BINDING SITE II or BINDING SITE III of FIG. 8. Table 4 illustrates the complementarity of the nucleotide sequences of UBCE7IP5 BINDING SITE, designated SEQ ID:2287, to the nucleotide sequence of GAM1338 RNA, herein designated GAM RNA, also designated SEQ ID:360.

Another function of GAM1338 is therefore inhibition of UBCE7IP5 (Accession NP_055763.1). Accordingly, utilities of GAM1338 include diagnosis, prevention and treatment of diseases and clinical conditions associated with UBCE7IP5.

Ubiquitin-conjugating enzyme e2l 3 (UBE2L3, Accession NP_003338.1) is another GAM1338 target gene, herein designated TARGET GENE. UBE2L3 BINDING SITE is a target binding site found in the 3' untranslated region of mRNA encoded by UBE2L3, corresponding to a target binding site such as BINDING SITE I, BINDING SITE II or BINDING SITE III of FIG. 8. Table 4 illustrates the complementarity of the nucleotide sequences of UBE2L3 BINDING SITE, designated SEQ ID:11811, to the nucleotide sequence of GAM1338 RNA, herein designated GAM RNA, also designated SEQ ID:360.

Another function of GAM1338 is therefore inhibition of Ubiquitin-conjugating enzyme e2l 3 (UBE2L3, Accession NP_003338.1), a gene which catalyzes the covalent attachment of ubiquitin to other proteins. and therefore may be associated with Parkinson disease. Accordingly, utilities of GAM1338 include diagnosis, prevention and treatment of Parkinson disease, and of other diseases and clinical conditions associated with UBE2L3.

The function of UBE2L3 and its association with various diseases and clinical conditions, has been established by previous studies, as described hereinabove with reference to GAM169.1. Udp-glucose dehydrogenase (UGDH, Accession NP_003350.1) is another GAM1338 target gene, herein designated TARGET GENE. UGDH BINDING SITE is a target binding site found in the 3' untranslated region of mRNA encoded by UGDH, corresponding to a target binding site such as BINDING SITE I, BINDING SITE II or BINDING SITE III of FIG. 8. Table 4 illustrates the complementarity of the nucleotide sequences of UGDH BINDING SITE, designated SEQ ID:12092, to the nucleotide sequence of GAM1338 RNA, herein designated GAM RNA, also designated SEQ ID:360.

Another function of GAM1338 is therefore inhibition of Udp-glucose dehydrogenase (UGDH, Accession NP_003350.1), a gene which is an UDP- glucose dehydrogenase. Accordingly, utilities of GAM1338 include diagnosis, prevention and treatment of diseases and clinical conditions associated with UGDH.

The function of UGDH and its association with various diseases and clinical conditions, has been established by previous studies, as described hereinabove with reference to GAM69.2. Uridine monophosphate synthetase (orotate phosphoribosyl transferase and orotidine-5'-decarboxylase) (UMPS, Accession NP_000364.1) is another GAM1338 target gene, herein designated TARGET GENE. UMPS BINDING SITE is a target binding site found in the 3' untranslated region of mRNA encoded by UMPS, corresponding to a target binding site such as BINDING SITE I, BINDING SITE II or BINDING SITE III of FIG. 8. Table 4 illustrates the complementarity of the nucleotide sequences of UMPS BINDING SITE, designated SEQ ID:19428, to the nucleotide sequence of GAM1338 RNA, herein designated GAM RNA, also designated SEQ ID:360.

Another function of GAM1338 is therefore inhibition of Uridine monophosphate synthetase (orotate phosphoribosyl transferase and orotidine-5'-decarboxylase) (UMPS, Accession NP_000364.1). Accordingly, utilities of GAM1338 include diagnosis, prevention and treatment of diseases and clinical conditions associated with UMPS.

Ubiquitin specific protease 22 (USP22, Accession XP_042698.2) is another GAM1338 target gene, herein designated TARGET GENE. USP22 BINDING SITE is a target binding site found in the 3' untranslated region of mRNA encoded by USP22, corresponding to a target binding site such as BINDING SITE I, BINDING SITE II or BINDING SITE III of FIG. 8. Table 4 illustrates the complementarity of the nucleotide sequences of USP22 BINDING SITE, designated SEQ ID:20055, to the nucleotide sequence of GAM1338 RNA, herein designated GAM RNA, also designated SEQ ID:360.

Another function of GAM1338 is therefore inhibition of Ubiquitin specific protease 22 (USP22, Accession XP_042698.2). Accordingly, utilities of GAM1338 include diagnosis, prevention and treatment of diseases and clinical conditions associated with USP22.

VDU1 (Accession NP_055832.2) is another GAM1338 target gene, herein designated TARGET GENE. VDU1 BINDING SITE is a target binding site found in the 3' untranslated region of mRNA encoded by VDU1, corresponding to a target binding site such as BINDING SITE I, BINDING SITE II or BINDING SITE III of FIG. 8. Table 4 illustrates the complementarity of the nucleotide sequences of VDU1 BINDING SITE, designated SEQ ID:794, to the nucleotide sequence of GAM1338 RNA, herein designated GAM RNA, also designated SEQ ID:360.

Another function of GAM1338 is therefore inhibition of VDU1 (Accession NP_055832.2). Accordingly, utilities of GAM1338 include diagnosis, prevention and treatment of diseases and clinical conditions associated with VDU1.

Von hippel-lindau syndrome (VHL, Accession NP_000542.1) is another GAM1338 target gene, herein designated TARGET GENE. VHL BINDING SITE1 and VHL BINDING SITE2 are target binding sites found in untranslated regions of mRNA encoded by VHL, corresponding to target binding sites such as BINDING SITE I, BINDING SITE II or BINDING SITE III of FIG. 8. Table 4 illustrates the complementarity of the nucleotide sequences of VHL BINDING SITE1 and VHL BINDING SITE2, designated SEQ ID:19946 and SEQ ID:969 respectively, to the nucleotide sequence of GAM1338 RNA, herein designated GAM RNA, also designated SEQ ID:360.

Another function of GAM1338 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM1338 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. Vasoactive intestinal peptide receptor 2 (VIPR2, Accession NP_003373.2) is another GAM1338 target gene, herein designated TARGET GENE. VIPR2 BINDING SITE is a target binding site found in the 3' untranslated region of mRNA encoded by VIPR2, corresponding to a target binding site such as BINDING SITE I, BINDING SITE II or BINDING SITE III of FIG. 8. Table 4 illustrates the complementarity of the nucleotide sequences of VIPR2 BINDING SITE, designated SEQ ID:861, to the nucleotide sequence of GAM1338 RNA, herein designated GAM RNA, also designated SEQ ID:360.

Another function of GAM1338 is therefore inhibition of Vasoactive intestinal peptide receptor 2 (VIPR2, Accession NP_003373.2). Accordingly, utilities of GAM1338 include diagnosis, prevention and treatment of diseases and clinical conditions associated with VIPR2.

Vesicle transport through interaction with t-snares homolog 1a (yeast) (VTI1A, Accession NP_660207.1) is another GAM1338 target gene, herein designated TARGET GENE. VTI1A BINDING SITE is a target binding site found in the 3' untranslated region of mRNA encoded by VTI1A, corresponding to a target binding site such as BINDING SITE I, BINDING SITE II or BINDING SITE III of FIG. 8. Table 4 illustrates the complementarity of the nucleotide sequences of VTI1A BINDING SITE, designated SEQ ID:1472, to the nucleotide sequence of GAM1338 RNA, herein designated GAM RNA, also designated SEQ ID:360.

Another function of GAM1338 is therefore inhibition of Vesicle transport through interaction with t-snares homolog 1a (yeast) (VTI1A, Accession NP_660207.1). Accordingly, utilities of GAM1338 include diagnosis, prevention and treatment of diseases and clinical conditions associated with VTI1A.

Williams beuren syndrome chromosome region 18 (WBSCR18, Accession NP_115693.2) is another GAM1338 target gene, herein designated TARGET GENE. WBSCR18 BINDING SITE is a target binding site found in the 3' untranslated region of mRNA encoded by WBSCR18, corresponding to a target binding site such as BINDING SITE I, BINDING SITE II or BINDING SITE III of FIG. 8. Table 4 illustrates the complementarity of the nucleotide sequences of WBSCR18 BINDING SITE, designated SEQ ID:10631, to the nucleotide sequence of GAM1338 RNA, herein designated GAM RNA, also designated SEQ ID:360.

Another function of GAM1338 is therefore inhibition of Williams beuren syndrome chromosome region 18 (WBSCR18, Accession NP_115693.2). Accordingly, utilities of GAM1338 include diagnosis, prevention and treatment of diseases and clinical conditions associated with WBSCR18.

Wolf-hirschhorn syndrome candidate 1 (WHSC1, Accession NP_579889.1) is another GAM1338 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:12602, to the nucleotide sequence of GAM1338 RNA, herein designated GAM RNA, also designated SEQ ID:360.

Another function of GAM1338 is therefore inhibition of Wolf-hirschhorn syndrome candidate 1 (WHSC1, Accession NP_579889.1), a gene which binds covalently to and repairs g/t mismatches. and therefore may be associated with Wolf-hirschhorn syndrome. Accordingly, utilities of GAM1338 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. X-ray repair complementing defective repair in chinese hamster cells 2 (XRCC2, Accession NP_005422.1) is another GAM1338 target gene, herein designated TARGET GENE. XRCC2 BINDING SITE1 through XRCC2 BINDING SITE3 are target binding sites found in untranslated regions of mRNA encoded by XRCC2, corresponding to target binding sites such as BINDING SITE I, BINDING SITE II or BINDING SITE III of FIG. 8. Table 4 illustrates the complementarity of the nucleotide sequences of XRCC2 BINDING SITE1 through XRCC2 BINDING SITE3, designated SEQ ID:16920, SEQ ID:19967 and SEQ ID:6034 respectively, to the nucleotide sequence of GAM1338 RNA, herein designated GAM RNA, also designated SEQ ID:360.

Another function of GAM1338 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM1338 include diagnosis, prevention and treatment of diseases and clinical conditions associated with XRCC2.

The function of XRCC2 and its association with various diseases and clinical conditions, has been established by previous studies, as described hereinabove with reference to GAM72.1. V-yes-1 yamaguchi sarcoma viral oncogene homolog 1 (YES1, Accession NP_005424.1) is another GAM1338 target gene, herein designated TARGET GENE. YES1 BINDING SITE is a target binding site found in the 3' untranslated region of mRNA encoded by YES1, corresponding to a target binding site such as BINDING SITE I, BINDING SITE II or BINDING SITE III of FIG. 8. Table 4 illustrates the complementarity of the nucleotide sequences of YES1 BINDING SITE, designated SEQ ID:18699, to the nucleotide sequence of GAM1338 RNA, herein designated GAM RNA, also designated SEQ ID:360.

Another function of GAM1338 is therefore inhibition of V-yes-1 yamaguchi sarcoma viral oncogene homolog 1 (YES1, Accession NP_005424.1), a gene which is a putative protein-tyrosine kinase. Accordingly, utilities of GAM1338 include diagnosis, prevention and treatment of diseases and clinical conditions associated with YES1.

The function of YES1 and its association with various diseases and clinical conditions, has been established by previous studies, as described hereinabove with reference to GAM30.1. ZAP (Accession NP_064504.2) is another GAM1338 target gene, herein designated TARGET GENE. ZAP BINDING SITE is a target binding site found in the 3' untranslated region of multiple transcripts of mRNA encoded by ZAP, corresponding to a target binding site such as BINDING SITE I, BINDING SITE II or BINDING SITE III of FIG. 8. Table 4 illustrates the complementarity of the nucleotide sequences of ZAP BINDING SITE, designated SEQ ID:19083, to the nucleotide sequence of GAM1338 RNA, herein designated GAM RNA, also designated SEQ ID:360.

Another function of GAM1338 is therefore inhibition of ZAP (Accession NP_064504.2). Accordingly, utilities of GAM1338 include diagnosis, prevention and treatment of diseases and clinical conditions associated with ZAP.

ZFP30 (Accession NP_055713.1) is another GAM1338 target gene, herein designated TARGET GENE. ZFP30 BINDING SITE is a target binding site found in the 3' untranslated region of mRNA encoded by ZFP30, corresponding to a target binding site such as BINDING SITE I, BINDING SITE II or BINDING SITE III of FIG. 8. Table 4 illustrates the complementarity of the nucleotide sequences of ZFP30 BINDING SITE, designated SEQ ID:432, to the nucleotide sequence of GAM1338 RNA, herein designated GAM RNA, also designated SEQ ID:360.

Another function of GAM1338 is therefore inhibition of ZFP30 (Accession NP_055713.1). Accordingly, utilities of GAM1338 include diagnosis, prevention and treatment of diseases and clinical conditions associated with ZFP30.

ZFP42 (Accession NP_777560.1) is another GAM1338 target gene, herein designated TARGET GENE. ZFP42 BINDING SITE is a target binding site found in the 3' untranslated region of mRNA encoded by ZFP42, corresponding to a target binding site such as BINDING SITE I, BINDING SITE II or BINDING SITE III of FIG. 8. Table 4 illustrates the complementarity of the nucleotide sequences of ZFP42 BINDING SITE, designated SEQ ID:6576, to the nucleotide sequence of GAM1338 RNA, herein designated GAM RNA, also designated SEQ ID:360.

Another function of GAM1338 is therefore inhibition of ZFP42 (Accession NP_777560.1). Accordingly, utilities of GAM1338 include diagnosis, prevention and treatment of diseases and clinical conditions associated with ZFP42.

Zinc finger protein 64 homolog (mouse) (ZFP64, Accession NP_071371.2) is another GAM1338 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:13869, to the nucleotide sequence of GAM1338 RNA, herein designated GAM RNA, also designated SEQ ID:360.

Another function of GAM1338 is therefore inhibition of Zinc finger protein 64 homolog (mouse) (ZFP64, Accession NP_071371.2). Accordingly, utilities of GAM1338 include diagnosis, prevention and treatment of diseases and clinical conditions associated with ZFP64.

Zinc finger protein 64 homolog (mouse) (ZFP64, Accession NP_060667.1) is another GAM1338 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:13869, to the nucleotide sequence of GAM1338 RNA, herein designated GAM RNA, also designated SEQ ID:360.

Another function of GAM1338 is therefore inhibition of Zinc finger protein 64 homolog (mouse) (ZFP64, Accession NP_060667.1). Accordingly, utilities of GAM1338 include diagnosis, prevention and treatment of diseases and clinical conditions associated with ZFP64.

ZMYND17 (Accession NP_848546.1) is another GAM1338 target gene, herein designated TARGET GENE. ZMYND17 BINDING SITE is a target binding site found in the 3' untranslated region of mRNA encoded by ZMYND17, corresponding to a target binding site such as BINDING SITE I, BINDING SITE II or BINDING SITE III of FIG. 8. Table 4 illustrates the complementarity of the nucleotide sequences of ZMYND17 BINDING SITE, designated SEQ ID:11022, to the nucleotide sequence of GAM1338 RNA, herein designated GAM RNA, also designated SEQ ID:360.

Another function of GAM1338 is therefore inhibition of ZMYND17 (Accession NP_848546.1). Accordingly, utilities of GAM1338 include diagnosis, prevention and treatment of diseases and clinical conditions associated with ZMYND17.

Zinc finger protein 264 (ZNF264, Accession NP_003408.1) is another GAM1338 target gene, herein designated TARGET GENE. ZNF264 BINDING SITE is a target binding site found in the 3' untranslated region of mRNA encoded by ZNF264, corresponding to a target binding site such as BINDING SITE I, BINDING SITE II or BINDING SITE III of FIG. 8. Table 4 illustrates the complementarity of the nucleotide sequences of ZNF264 BINDING SITE, designated SEQ ID:438, to the nucleotide sequence of GAM1338 RNA, herein designated GAM RNA, also designated SEQ ID:360.

Another function of GAM1338 is therefore inhibition of Zinc finger protein 264 (ZNF264, Accession NP_003408.1). Accordingly, utilities of GAM1338 include diagnosis, prevention and treatment of diseases and clinical conditions associated with ZNF264.

Zinc finger protein 273 (ZNF273, Accession XP_088082.1) is another GAM1338 target gene, herein designated TARGET GENE. ZNF273 BINDING SITE is a target binding site found in the 3' untranslated region of mRNA encoded by ZNF273, corresponding to a target binding site such as BINDING SITE I, BINDING SITE II or BINDING SITE III of FIG. 8. Table 4 illustrates the complementarity of the nucleotide sequences of ZNF273 BINDING SITE, designated SEQ ID:19693, to the nucleotide sequence of GAM1338 RNA, herein designated GAM RNA, also designated SEQ ID:360.

Another function of GAM1338 is therefore inhibition of Zinc finger protein 273 (ZNF273, Accession XP_088082.1). Accordingly, utilities of GAM1338 include diagnosis, prevention and treatment of diseases and clinical conditions associated with ZNF273.

Zinc finger protein 339 (ZNF339, Accession NP_067043.1) is another GAM1338 target gene, herein designated TARGET GENE. ZNF339 BINDING SITE is a target binding site found in the 3' untranslated region of mRNA encoded by ZNF339, corresponding to a target binding site such as BINDING SITE I, BINDING SITE II or BINDING SITE III of FIG. 8. Table 4 illustrates the complementarity of the nucleotide sequences of ZNF339 BINDING SITE, designated SEQ ID:9097, to the nucleotide sequence of GAM1338 RNA, herein designated GAM RNA, also designated SEQ ID:360.

Another function of GAM1338 is therefore inhibition of Zinc finger protein 339 (ZNF339, Accession NP_067043.1). Accordingly, utilities of GAM1338 include diagnosis, prevention and treatment of diseases and clinical conditions associated with ZNF339.

Zinc finger protein 345 (ZNF345, Accession NP_003410.1) is another GAM1338 target gene, herein designated TARGET GENE. ZNF345 BINDING SITE is a target binding site found in the 3' untranslated region of mRNA encoded by ZNF345, corresponding to a target binding site such as BINDING SITE I, BINDING SITE II or BINDING SITE III of FIG. 8. Table 4 illustrates the complementarity of the nucleotide sequences of ZNF345 BINDING SITE, designated SEQ ID:11758, to the nucleotide sequence of GAM1338 RNA, herein designated GAM RNA, also designated SEQ ID:360.

Another function of GAM1338 is therefore inhibition of Zinc finger protein 345 (ZNF345, Accession NP_003410.1). Accordingly, utilities of GAM1338 include diagnosis, prevention and treatment of diseases and clinical conditions associated with ZNF345.

Zinc finger protein 398 (ZNF398, Accession NP_065832.1) is another GAM1338 target gene, herein designated TARGET GENE. ZNF398 BINDING SITE is a target binding site found in the 5' untranslated region of multiple transcripts of mRNA encoded by ZNF398, corresponding to a target binding site such as BINDING SITE I, BINDING SITE II or BINDING SITE III of FIG. 8. Table 4 illustrates the complementarity of the nucleotide sequences of ZNF398 BINDING SITE, designated SEQ ID:9774, to the nucleotide sequence of GAM1338 RNA, herein designated GAM RNA, also designated SEQ ID:360.

Another function of GAM1338 is therefore inhibition of Zinc finger protein 398 (ZNF398, Accession NP_065832.1). Accordingly, utilities of GAM1338 include diagnosis, prevention and treatment of diseases and clinical conditions associated with ZNF398.

ZNF432 (Accession NP_055465.1) is another GAM1338 target gene, herein designated TARGET GENE. ZNF432 BINDING SITE is a target binding site found in the 3' untranslated region of mRNA encoded by ZNF432, corresponding to a target binding site such as BINDING SITE I, BINDING SITE II or BINDING SITE III of FIG. 8. Table 4 illustrates the complementarity of the nucleotide sequences of ZNF432 BINDING SITE, designated SEQ ID:7826, to the nucleotide sequence of GAM1338 RNA, herein designated GAM RNA, also designated SEQ ID:360.

Another function of GAM1338 is therefore inhibition of ZNF432 (Accession NP_055465.1). Accordingly, utilities of GAM1338 include diagnosis, prevention and treatment of diseases and clinical conditions associated with ZNF432.

ZNF440 (Accession NP_689570.1) is another GAM1338 target gene, herein designated TARGET GENE. ZNF440 BINDING SITE is a target binding site found in the 3' untranslated region of mRNA encoded by ZNF440, corresponding to a target binding site such as BINDING SITE I, BINDING SITE II or BINDING SITE III of FIG. 8. Table 4 illustrates the complementarity of the nucleotide sequences of ZNF440 BINDING SITE, designated SEQ ID:11659, to the nucleotide sequence of GAM1338 RNA, herein designated GAM RNA, also designated SEQ ID:360.

Another function of GAM1338 is therefore inhibition of ZNF440 (Accession NP_689570.1). Accordingly, utilities of GAM1338 include diagnosis, prevention and treatment of diseases and clinical conditions associated with ZNF440.

Zinc finger protein 70 (cos17) (ZNF70, Accession NP_852101.1) is another GAM1338 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:18371, to the nucleotide sequence of GAM1338 RNA, herein designated GAM RNA, also designated SEQ ID:360.

Another function of GAM1338 is therefore inhibition of Zinc finger protein 70 (cos17) (ZNF70, Accession NP_852101.1). Accordingly, utilities of GAM1338 include diagnosis, prevention and treatment of diseases and clinical conditions associated with ZNF70.

Zinc finger protein 70 (cos17) (ZNF70, Accession NP_068735.1) is another GAM1338 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:18371, to the nucleotide sequence of GAM1338 RNA, herein designated GAM RNA, also designated SEQ ID:360.

Another function of GAM1338 is therefore inhibition of Zinc finger protein 70 (cos17) (ZNF70, Accession NP_068735.1). Accordingly, utilities of GAM1338 include diagnosis, prevention and treatment of diseases and clinical conditions associated with ZNF70.

FIG. 8 further provides a conceptual description of a novel bioinformatically detected of the present invention, referred to here as Genomic Address Messenger 2033 (GAM2033), which modulates expression of respective target genes thereof, the function and utility of which target genes is known in the art.

GAM2033 is a novel bioinformatically detected regulatory, non protein coding, micro RNA (miRNA) gene. The method by which GAM2033 was detected is described hereinabove with reference to FIGS. 8-15.

GAM2033 gene, herein designated GAM GENE, and GAM2033 target gene, herein designated TARGET GENE, are human genes contained in the human genome.

GAM2033 gene encodes a GAM2033 precursor RNA, herein designated GAM PRECURSOR RNA. Similar to other miRNA genes, and unlike most ordinary genes, GAM2033 precursor RNA does not encode a protein. A nucleotide sequence identical or highly similar to the nucleotide sequence of GAM2033 precursor RNA is designated SEQ ID:117, and is provided hereinbelow with reference to the sequence listing part.

GAM2033 precursor RNA folds onto itself, forming GAM2033 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM2033 precursor RNA folds onto itself, forming GAM2033 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM2033 precursor RNA, designated SEQ-ID:117, and a schematic representation of a predicted secondary folding of GAM2033 folded precursor RNA are further described with reference to Table 2, hereby incorporated by reference.

An enzyme complex designated DICER COMPLEX, 'dices' the GAM2033 folded precursor RNA into GAM2033 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM2033 RNA is designated SEQ ID:305, and is provided hereinbelow with references to the sequence listing part and Table 3, hereby incorporated by reference.

GAM2033 target gene, herein designated TARGET GENE, encodes a corresponding messenger RNA, GAM2033 target RNA, herein designated GAM TARGET RNA. GAM2033 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM2033 RNA, herein designated GAM RNA, binds complementarily to one or more target binding sites located in untranslated regions of GAM2033 target RNA, herein designated GAM TARGET RNA. This complementary binding is due to the fact that the nucleotide sequence of GAM2033 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM2033 RNA may have a different number of target binding sites in untranslated regions of a GAM2033 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM2033 RNA, herein designated GAM RNA, to target binding sites on GAM2033 target RNA, herein designated GAM TARGET RNA, such as BINDING SITE I, BINDING SITE II and BINDING SITE III, inhibits translation of GAM2033 target RNA into GAM2033 target protein, herein designated GAM TARGET PROTEIN. GAM target protein is therefore outlined by a broken line.

It is appreciated that GAM2033 target gene, herein designated TARGET GENE, in fact represents a plurality of GAM2033 target genes. The mRNA of each one of this plurality of GAM2033 target genes comprises one or more target binding sites, each having a nucleotide sequence which is at least partly complementary to GAM2033 RNA, herein designated GAM RNA, and which when bound by GAM2033 RNA causes inhibition of translation of respective one or more GAM2033 target proteins.

It is further appreciated by one skilled in the art that the mode of translational inhibition illustrated by FIG. 8 with specific reference to translational inhibition exerted by GAM2033 gene, herein designated GAM GENE, on one or more GAM2033 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM2033 correlate with, and may be deduced from, the identity of the target genes which GAM2033 binds and inhibits, and the function of these target genes, as elaborated hereinbelow.

AGS3 (Accession XP_054763.1) is a GAM2033 target gene, herein designated TARGET GENE. AGS3 BINDING SITE is a target binding site found in the 5' untranslated region of multiple transcripts of mRNA encoded by AGS3, corresponding to a target binding site such as BINDING SITE I, BINDING SITE II or BINDING SITE III of FIG. 8. Table 4 illustrates the complementarity of the nucleotide sequences of AGS3 BINDING SITE, designated SEQ ID:749, to the nucleotide sequence of GAM2033 RNA, herein designated GAM RNA, also designated SEQ ID:305.

A function of GAM2033 is therefore inhibition of AGS3 (Accession XP_054763.1). Accordingly, utilities of GAM2033 include diagnosis, prevention and treatment of diseases and clinical conditions associated with AGS3.

Adenylate kinase 5 (AK5, Accession NP_036225.2) is another GAM2033 target gene, herein designated TARGET GENE. AK5 BINDING SITE is a target binding site found in the 5' untranslated region of multiple transcripts of mRNA encoded by AK5, corresponding to a target binding site such as BINDING SITE I, BINDING SITE II or BINDING SITE III of FIG. 8. Table 4 illustrates the complementarity of the nucleotide sequences of AK5 BINDING SITE, designated SEQ ID:8265, to the nucleotide sequence of GAM2033 RNA, herein designated GAM RNA, also designated SEQ ID:305.

Another function of GAM2033 is therefore inhibition of Adenylate kinase 5 (AK5, Accession NP_036225.2). Accordingly, utilities of GAM2033 include diagnosis, prevention and treatment of diseases and clinical conditions associated with AK5.

Amyotrophic lateral sclerosis 2 (juvenile) chromosome region, candidate 3 (ALS2CR3, Accession NP_055864.1) is another GAM2033 target gene, herein designated TARGET GENE. ALS2CR3 BINDING SITE is a target binding site found in the 3' untranslated region of mRNA encoded by ALS2CR3, corresponding to a target binding site such as BINDING SITE I, BINDING SITE II or BINDING SITE III of FIG. 8. Table 4 illustrates the complementarity of the nucleotide sequences of ALS2CR3 BINDING SITE, designated SEQ ID:735, to the nucleotide sequence of GAM2033 RNA, herein designated GAM RNA, also designated SEQ ID:305.

Another function of GAM2033 is therefore inhibition of Amyotrophic lateral sclerosis 2 (juvenile) chromosome region, candidate 3 (ALS2CR3, Accession NP_055864.1).

Accordingly, utilities of GAM2033 include diagnosis, prevention and treatment of diseases and clinical conditions associated with ALS2CR3.

Angiopoietin 1 (ANGPT1, Accession NP_001137.2) is another GAM2033 target gene, herein designated TARGET GENE. ANGPT1 BINDING SITE is a target binding site found in the 5' untranslated region of multiple transcripts of mRNA encoded by ANGPT1, corresponding to a target binding site such as BINDING SITE I, BINDING SITE II or BINDING SITE III of FIG. 8. Table 4 illustrates the complementarity of the nucleotide sequences of ANGPT1 BINDING SITE, designated SEQ ID:19390, to the nucleotide sequence of GAM2033 RNA, herein designated GAM RNA, also designated SEQ ID:305.

Another function of GAM2033 is therefore inhibition of Angiopoietin 1 (ANGPT1, Accession NP_001137.2), a gene which binds and activates tie2 receptor by inducing its tyrosine phosphorylation. and therefore may be associated with Tumor. Accordingly, utilities of GAM2033 include diagnosis, prevention and treatment of Tumor., and of other diseases and clinical conditions associated with ANGPT1.

The function of ANGPT1 and its association with various diseases and clinical conditions, has been established by previous studies, as described hereinabove with reference to GAM205.2. Angiopoietin 1 (ANGPT1, Accession NP_647451.1) is another GAM2033 target gene, herein designated TARGET GENE. ANGPT1 BINDING SITE is a target binding site found in the 5' untranslated region of multiple transcripts of mRNA encoded by ANGPT1, corresponding to a target binding site such as BINDING SITE I, BINDING SITE II or BINDING SITE III of FIG. 8. Table 4 illustrates the complementarity of the nucleotide sequences of ANGPT1 BINDING SITE, designated SEQ ID:19390, to the nucleotide sequence of GAM2033 RNA, herein designated GAM RNA, also designated SEQ ID:305.

Another function of GAM2033 is therefore inhibition of Angiopoietin 1 (ANGPT1, Accession NP_647451.1), a gene which binds and activates tie2 receptor by inducing its tyrosine phosphorylation. and therefore may be associated with Tumor. Accordingly, utilities of GAM2033 include diagnosis, prevention and treatment of Tumor., and of other diseases and clinical conditions associated with ANGPT1.

The function of ANGPT1 and its association with various diseases and clinical conditions, has been established by previous studies, as described hereinabove with reference to GAM205.2. ANKFY1 (Accession NP_057460.2) is another GAM2033 target gene, herein designated TARGET GENE. ANKFY1 BINDING SITE is a target binding site found in the 3' untranslated region of multiple transcripts of mRNA encoded by ANKFY1, corresponding to a target binding site such as BINDING SITE I, BINDING SITE II or BINDING SITE III of FIG. 8. Table 4 illustrates the complementarity of the nucleotide sequences of ANKFY1 BINDING SITE, designated SEQ ID:1403, to the nucleotide sequence of GAM2033 RNA, herein designated GAM RNA, also designated SEQ ID:305.

Another function of GAM2033 is therefore inhibition of ANKFY1 (Accession NP_057460.2). Accordingly, utilities of GAM2033 include diagnosis, prevention and treatment of diseases and clinical conditions associated with ANKFY1.

Aquaporin 6, kidney specific (AQP6, Accession NP_001643.1) is another GAM2033 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:1506, to the nucleotide sequence of GAM2033 RNA, herein designated GAM RNA, also designated SEQ ID:305.

Another function of GAM2033 is therefore inhibition of Aquaporin 6, kidney specific (AQP6, Accession NP_001643.1), a gene which participates in distinct physiologic function such as glomerular filtration, tubular endocytosis, and acid-base-metabolism. Accordingly, utilities of GAM2033 include diagnosis, prevention and treatment of diseases and clinical conditions associated with AQP6.

The function of AQP6 and its association with various diseases and clinical conditions, has been established by previous studies, as described hereinabove with reference to GAM51.1. Aquaporin 6, kidney specific (AQP6, Accession NP_445738.1) is another GAM2033 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:1506, to the nucleotide sequence of GAM2033 RNA, herein designated GAM RNA, also designated SEQ ID:305.

Another function of GAM2033 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM2033 include diagnosis, prevention and treatment of diseases and clinical conditions associated with AQP6.

The function of AQP6 and its association with various diseases and clinical conditions, has been established by previous studies, as described hereinabove with reference to GAM51.1. B7-H4 (Accession NP_078902.1) is another GAM2033 target gene, herein designated TARGET GENE. B7-H4 BINDING SITE is a target binding site found in the 3' untranslated region of mRNA encoded by B7-H4, corresponding to a target binding site such as BINDING SITE I, BINDING SITE II or BINDING SITE III of FIG. 8. Table 4 illustrates the complementarity of the nucleotide sequences of B7-H4 BINDING SITE, designated SEQ ID:13436, to the nucleotide sequence of GAM2033 RNA, herein designated GAM RNA, also designated SEQ ID:305.

Another function of GAM2033 is therefore inhibition of B7-H4 (Accession NP_078902.1). Accordingly, utilities of GAM2033 include diagnosis, prevention and treatment of diseases and clinical conditions associated with B7-H4.

Breast carcinoma amplified sequence 1 (BCAS1, Accession NP_003648.1) is another GAM2033 target gene, herein designated TARGET GENE. BCAS1 BINDING SITE is a target binding site found in the 3' untranslated region of mRNA encoded by BCAS1, corresponding to a target binding site such as BINDING SITE I, BINDING SITE II or BINDING SITE III of FIG. 8. Table 4 illustrates the complementarity of the nucleotide sequences of BCAS1 BINDING SITE, designated SEQ ID:8961, to the nucleotide sequence of GAM2033 RNA, herein designated GAM RNA, also designated SEQ ID:305.

Another function of GAM2033 is therefore inhibition of Breast carcinoma amplified sequence 1 (BCAS1, Accession NP_003648.1). Accordingly, utilities of GAM2033 include diagnosis, prevention and treatment of diseases and clinical conditions associated with BCAS1.

Basic, immunoglobulin-like variable motif containing (BIVM, Accession NP_060163.2) is another GAM2033 target gene, herein designated TARGET GENE. BIVM BINDING SITE is a target binding site found in the 5' untranslated region of mRNA encoded by BIVM, corresponding to a target binding site such as BINDING SITE I, BINDING SITE II or BINDING SITE III of FIG. 8. Table 4 illustrates the complementarity of the nucleotide sequences of BIVM BINDING SITE, designated SEQ ID:19466, to the nucleotide sequence of GAM2033 RNA, herein designated GAM RNA, also designated SEQ ID:305.

Another function of GAM2033 is therefore inhibition of Basic, immunoglobulin-like variable motif containing (BIVM, Accession NP_060163.2). Accordingly, utilities of GAM2033 include diagnosis, prevention and treatment of diseases and clinical conditions associated with BIVM.

C13orf17 (Accession NP_060655.1) is another GAM2033 target gene, herein designated TARGET GENE. C13orf17 BINDING SITE is a target binding site found in the 3' untranslated region of mRNA encoded by C13orf17, corresponding to a target binding site such as BINDING SITE I, BINDING SITE II or BINDING SITE III of FIG. 8. Table 4 illustrates the complementarity of the nucleotide sequences of C13orf17 BINDING SITE, designated SEQ ID:5972, to the nucleotide sequence of GAM2033 RNA, herein designated GAM RNA, also designated SEQ ID:305.

Another function of GAM2033 is therefore inhibition of C13orf17 (Accession NP_060655.1). Accordingly, utilities of GAM2033 include diagnosis, prevention and treatment of diseases and clinical conditions associated with C13orf17.

Chromosome 20 open reading frame 110 (C20orf110, Accession XP_086728.2) is another GAM2033 target gene, herein designated TARGET GENE. C20orf110 BINDING SITE is a target binding site found in the 3' untranslated region of mRNA encoded by C20orf110, corresponding to a target binding site such as BINDING SITE I, BINDING SITE II or BINDING SITE III of FIG. 8. Table 4 illustrates the complementarity of the nucleotide sequences of C20orf110 BINDING SITE, designated SEQ ID:2658, to the nucleotide sequence of GAM2033 RNA, herein designated GAM RNA, also designated SEQ ID:305.

Another function of GAM2033 is therefore inhibition of Chromosome 20 open reading frame 110 (C20orf110, Accession XP_086728.2). Accordingly, utilities of GAM2033 include diagnosis, prevention and treatment of diseases and clinical conditions associated with C20orf110.

Chromosome 2 open reading frame 7 (C2orf7, Accession NP_115695.1) is another GAM2033 target gene, herein designated TARGET GENE. C2orf7 BINDING SITE is a target binding site found in the 3' untranslated region of mRNA encoded by C2orf7, corresponding to a target binding site such as BINDING SITE I, BINDING SITE II or BINDING SITE III of FIG. 8. Table 4 illustrates the complementarity of the nucleotide sequences of C2orf7 BINDING SITE, designated SEQ ID:7328, to the nucleotide sequence of GAM2033 RNA, herein designated GAM RNA, also designated SEQ ID:305.

Another function of GAM2033 is therefore inhibition of Chromosome 2 open reading frame 7 (C2orf7, Accession NP_115695.1). Accordingly, utilities of GAM2033 include diagnosis, prevention and treatment of diseases and clinical conditions associated with C2orf7.

C6orf69 (Accession NP_775833.1) is another GAM2033 target gene, herein designated TARGET GENE. C6orf69 BINDING SITE is a target binding site found in the 3' untranslated region of mRNA encoded by C6orf69, corresponding to a target binding site such as BINDING SITE I, BINDING SITE II or BINDING SITE III of FIG. 8. Table 4 illustrates the complementarity of the nucleotide sequences of C6orf69 BINDING SITE, designated SEQ ID:2839, to the nucleotide sequence of GAM2033 RNA, herein designated GAM RNA, also designated SEQ ID:305.

Another function of GAM2033 is therefore inhibition of C6orf69 (Accession NP_775833.1). Accordingly, utilities of GAM2033 include diagnosis, prevention and treatment of diseases and clinical conditions associated with C6orf69.

C6orf76 (Accession NP_079083.1) is another GAM2033 target gene, herein designated TARGET GENE. C6orf76 BINDING SITE is a target binding site found in the 3' untranslated region of mRNA encoded by C6orf76, corresponding to a target binding site such as BINDING SITE I, BINDING SITE II or BINDING SITE III of FIG. 8. Table 4 illustrates the complementarity of the nucleotide sequences of C6orf76 BINDING SITE, designated SEQ ID:6766, to the nucleotide sequence of GAM2033 RNA, herein designated GAM RNA, also designated SEQ ID:305.

Another function of GAM2033 is therefore inhibition of C6orf76 (Accession NP_079083.1). Accordingly, utilities of GAM2033 include diagnosis, prevention and treatment of diseases and clinical conditions associated with C6orf76.

Reserved (C8orf6, Accession NP_663631.1) is another GAM2033 target gene, herein designated TARGET GENE. C8orf6 BINDING SITE is a target binding site found in the 5' untranslated region of mRNA encoded by C8orf6, corresponding to a target binding site such as BINDING SITE I, BINDING SITE II or BINDING SITE III of FIG. 8. Table 4 illustrates the complementarity of the nucleotide sequences of C8orf6 BINDING SITE, designated SEQ ID:2293, to the nucleotide sequence of GAM2033 RNA, herein designated GAM RNA, also designated SEQ ID:305.

Another function of GAM2033 is therefore inhibition of Reserved (C8orf6, Accession NP_663631.1). Accordingly, utilities of GAM2033 include diagnosis, prevention and treatment of diseases and clinical conditions associated with C8orf6.

Cas-br-m (murine) ecotropic retroviral transforming sequence (CBL, Accession NP_005179.1) is another GAM2033 target gene, herein designated TARGET GENE. CBL BINDING SITE is a target binding site found in the 3' untranslated region of mRNA encoded by CBL, corresponding to a target binding site such as BINDING SITE I, BINDING SITE II or BINDING SITE III of FIG. 8. Table 4 illustrates the complementarity of the nucleotide sequences of CBL BINDING SITE, designated SEQ ID:1024, to the nucleotide sequence of GAM2033 RNA, herein designated GAM RNA, also designated SEQ ID:305.

Another function of GAM2033 is therefore inhibition of Cas-br-m (murine) ecotropic retroviral transforming sequence (CBL, Accession NP_005179.1), a gene which may modify receptor tyrosine kinase-mediated signal transduction. and therefore may be associated with B-lineage lymphomas. Accordingly, utilities of GAM2033 include diagnosis, prevention and treatment of B-lineage lymphomas, and of other diseases and clinical conditions associated with CBL.

The function of CBL and its association with various diseases and clinical conditions, has been established by previous studies, as described hereinabove with reference to GAM767.1. Chromobox homolog 8 (pc class homolog, drosophila) (CBX8, Accession NP_065700.1) is another GAM2033 target gene, herein designated TARGET GENE. CBX8 BINDING SITE is a target binding site found in the 3' untranslated region of mRNA encoded by CBX8, corresponding to a target binding site such as BINDING SITE I, BINDING SITE II or BINDING SITE III of FIG. 8. Table 4 illustrates the complementarity of the nucleotide sequences of CBX8 BINDING SITE, designated SEQ ID:14537, to the nucleotide sequence of GAM2033 RNA, herein designated GAM RNA, also designated SEQ ID:305.

Another function of GAM2033 is therefore inhibition of Chromobox homolog 8 (pc class homolog, drosophila) (CBX8, Accession NP_065700.1). Accordingly, utilities of GAM2033 include diagnosis, prevention and treatment of diseases and clinical conditions associated with CBX8.

Cholecystokinin a receptor (CCKAR, Accession NP_000721.1) is another GAM2033 target gene, herein designated TARGET GENE. CCKAR BINDING SITE is a target binding site found in the 5' untranslated region of mRNA encoded by CCKAR, corresponding to a target binding site such as BINDING SITE I, BINDING SITE II or BINDING SITE III of FIG. 8. Table 4 illustrates the complementarity of the nucleotide sequences of CCKAR BINDING SITE, designated SEQ ID:7362, to the nucleotide sequence of GAM2033 RNA, herein designated GAM RNA, also designated SEQ ID:305.

Another function of GAM2033 is therefore inhibition of Cholecystokinin a receptor (CCKAR, Accession NP_000721.1), a gene which Cholecystokinin A receptor, a G protein-coupled receptor; regulates gallbladder contraction and secretion of pancreatic enzymes. and therefore may be associated with Diabetes and obesity. Accordingly, utilities of GAM2033 include diagnosis, prevention and treatment of Diabetes and obesity, and of other diseases and clinical conditions associated with CCKAR.

The function of CCKAR and its association with various diseases and clinical conditions, has been established by previous studies, as described hereinabove with reference to GAM401.1. Cd8 antigen, beta polypeptide 1 (p37) (CD8B1, Accession NP_742097.1) is another GAM2033 target gene, herein designated TARGET GENE. CD8B1 BINDING SITE is a target binding site found in the 3' untranslated region of multiple transcripts of mRNA encoded by CD8B1, corresponding to a target binding site such as BINDING SITE I, BINDING SITE II or BINDING SITE III of FIG. 8. Table 4 illustrates the complementarity of the nucleotide sequences of CD8B1 BINDING SITE, designated SEQ ID:16062, to the nucleotide sequence of GAM2033 RNA, herein designated GAM RNA, also designated SEQ ID:305.

Another function of GAM2033 is therefore inhibition of Cd8 antigen, beta polypeptide 1 (p37) (CD8B1, Accession NP_742097.1). Accordingly, utilities of GAM2033 include diagnosis, prevention and treatment of diseases and clinical conditions associated with CD8B1.

Cd8 antigen, beta polypeptide 1 (p37) (CD8B1, Accession NP_004922.1) is another GAM2033 target gene, herein designated TARGET GENE. CD8B1 BINDING SITE is a target binding site found in the 3' untranslated region of multiple transcripts of mRNA encoded by CD8B1, corresponding to a target binding site such as BINDING SITE I, BINDING SITE II or BINDING SITE III of FIG. 8. Table 4 illustrates the complementarity of the nucleotide sequences of CD8B1 BINDING SITE, designated SEQ ID:16062, to the nucleotide sequence of GAM2033 RNA, herein designated GAM RNA, also designated SEQ ID:305.

Another function of GAM2033 is therefore inhibition of Cd8 antigen, beta polypeptide 1 (p37) (CD8B1, Accession NP_004922.1). Accordingly, utilities of GAM2033 include diagnosis, prevention and treatment of diseases and clinical conditions associated with CD8B1.

Cadherin 3, type 1, p-cadherin (placental) (CDH3, Accession NP_001784.2) is another GAM2033 target gene, herein designated TARGET GENE. CDH3 BINDING SITE is a target binding site found in the 3' untranslated region of mRNA encoded by CDH3, corresponding to a target binding site such as BINDING SITE I, BINDING SITE II or BINDING SITE III of FIG. 8. Table 4 illustrates the complementarity of the nucleotide sequences of CDH3 BINDING SITE, designated SEQ ID:19023, to the nucleotide sequence of GAM2033 RNA, herein designated GAM RNA, also designated SEQ ID:305.

Another function of GAM2033 is therefore inhibition of Cadherin 3, type 1, p-cadherin (placental) (CDH3, Accession NP_001784.2), a gene which is a calcium dependent cell adhesion protein. Accordingly, utilities of GAM2033 include diagnosis, prevention and treatment of diseases and clinical conditions associated with CDH3.

The function of CDH3 and its association with various diseases and clinical conditions, has been established by previous studies, as described hereinabove with reference to GAM385.2. Cadherin 6, type 2, k-cadherin (fetal kidney) (CDH6, Accession NP_004923.1) is another GAM2033 target gene, herein designated TARGET GENE. CDH6 BINDING SITE is a target binding site found in the 5' untranslated region of mRNA encoded by CDH6, corresponding to a target binding site such as BINDING SITE I, BINDING SITE II or BINDING SITE III of FIG. 8. Table 4 illustrates the complementarity of the nucleotide sequences of CDH6 BINDING SITE, designated SEQ ID:19553, to the nucleotide sequence of GAM2033 RNA, herein designated GAM RNA, also designated SEQ ID:305.

Another function of GAM2033 is therefore inhibition of Cadherin 6, type 2, k-cadherin (fetal kidney) (CDH6, Accession NP_004923.1), a gene which is a calcium dependent cell adhesion protein. Accordingly, utilities of GAM2033 include diagnosis, prevention and treatment of diseases and clinical conditions associated with CDH6.

The function of CDH6 and its association with various diseases and clinical conditions, has been established by previous studies, as described hereinabove with reference to GAM282.2. CG012 (Accession XP_096710.1) is another GAM2033 target gene, herein designated TARGET GENE. CG012 BINDING SITE is a target binding site found in the 5' untranslated region of mRNA encoded by CG012, corresponding to a target binding site such as BINDING SITE I, BINDING SITE II or BINDING SITE III of FIG. 8. Table 4 illustrates the complementarity of the nucleotide sequences of CG012 BINDING SITE, designated SEQ ID:7096, to the nucleotide sequence of GAM2033 RNA, herein designated GAM RNA, also designated SEQ ID:305.

Another function of GAM2033 is therefore inhibition of CG012 (Accession XP_096710.1). Accordingly, utilities of GAM2033 include diagnosis, prevention and treatment of diseases and clinical conditions associated with CG012.

CGI-19 (Accession NP_057032.2) is another GAM2033 target gene, herein designated TARGET GENE. CGI-19 BINDING SITE is a target binding site found in the 5' untranslated region of mRNA encoded by CGI-19, corresponding to a target binding site such as BINDING SITE I, BINDING SITE II or BINDING SITE III of FIG. 8. Table 4 illustrates the complementarity of the nucleotide sequences of CGI-19 BINDING SITE, designated SEQ ID:12830, to the nucleotide sequence of GAM2033 RNA, herein designated GAM RNA, also designated SEQ ID:305.

Another function of GAM2033 is therefore inhibition of CGI-19 (Accession NP_057032.2). Accordingly, utilities of GAM2033 include diagnosis, prevention and treatment of diseases and clinical conditions associated with CGI-19.

CGI-37 (Accession NP_057185.1) is another GAM2033 target gene, herein designated TARGET GENE. CGI-37 BINDING SITE is a target binding site found in the 3' untranslated region of mRNA encoded by CGI-37, corresponding to a target binding site such as BINDING SITE I, BINDING SITE II or BINDING SITE III of FIG. 8. Table 4 illustrates the complementarity of the nucleotide sequences of CGI-37 BINDING SITE, designated SEQ ID:13579, to the nucleotide sequence of GAM2033 RNA, herein designated GAM RNA, also designated SEQ ID:305.

Another function of GAM2033 is therefore inhibition of CGI-37 (Accession NP_057185.1). Accordingly, utilities of GAM2033 include diagnosis, prevention and treatment of diseases and clinical conditions associated with CGI-37.

Claudin 14 (CLDN14, Accession NP_652763.1) is another GAM2033 target gene, herein designated TARGET GENE. CLDN14 BINDING SITE is a target binding site found in the 5' untranslated region of multiple transcripts of mRNA encoded by CLDN14, corresponding to a target binding site such as BINDING SITE I, BINDING SITE II or BINDING SITE III of FIG. 8. Table 4 illustrates the complementarity of the nucleotide sequences of CLDN14 BINDING SITE, designated SEQ ID:13780, to the nucleotide sequence of GAM2033 RNA, herein designated GAM RNA, also designated SEQ ID:305.

Another function of GAM2033 is therefore inhibition of Claudin 14 (CLDN14, Accession NP_652763.1), a gene which provides structural support for the auditory neuroepithelium. and therefore is associated with Deafness. Accordingly, utilities of GAM2033 include diagnosis, prevention and treatment of Deafness, and of other diseases and clinical conditions associated with CLDN14.

The function of CLDN14 and its association with various diseases and clinical conditions, has been established by previous studies, as described hereinabove with reference to GAM94.1. Contactin 5 (CNTN5, Accession NP_055176.1) is another GAM2033 target gene, herein designated TARGET GENE. CNTN5 BINDING SITE is a target binding site found in the 3' untranslated region of multiple transcripts of mRNA encoded by CNTN5, corresponding to a target binding site such as BINDING SITE I, BINDING SITE II or BINDING SITE III of FIG. 8. Table 4 illustrates the complementarity of the nucleotide sequences of CNTN5 BINDING SITE, designated SEQ ID:14059, to the nucleotide sequence of GAM2033 RNA, herein designated GAM RNA, also designated SEQ ID:305.

Another function of GAM2033 is therefore inhibition of Contactin 5 (CNTN5, Accession NP_055176.1). Accordingly, utilities of GAM2033 include diagnosis, prevention and treatment of diseases and clinical conditions associated with CNTN5.

Contactin 5 (CNTN5, Accession NP_780775.1) is another GAM2033 target gene, herein designated TARGET GENE. CNTN5 BINDING SITE is a target binding site found in the 3' untranslated region of multiple transcripts of mRNA encoded by CNTN5, corresponding to a target binding site such as BINDING SITE I, BINDING SITE II or BINDING SITE III of FIG. 8. Table 4 illustrates the complementarity of the nucleotide sequences of CNTN5 BINDING SITE, designated SEQ ID:14059, to the nucleotide sequence of GAM2033 RNA, herein designated GAM RNA, also designated SEQ ID:305.

Another function of GAM2033 is therefore inhibition of Contactin 5 (CNTN5, Accession NP_780775.1). Accordingly, utilities of GAM2033 include diagnosis, prevention and treatment of diseases and clinical conditions associated with CNTN5.

Dihydrolipoamide branched chain transacylase (e2 component of branched chain keto acid dehydrogenase complex; maple syrup urine disease) (DBT, Accession NP_001909.1) is another GAM2033 target gene, herein designated TARGET GENE. DBT BINDING SITE is a target binding site found in the 3' untranslated region of mRNA encoded by DBT, corresponding to a target binding site such as BINDING SITE I, BINDING SITE II or BINDING SITE III of FIG. 8. Table 4 illustrates the complementarity of the nucleotide sequences of DBT BINDING SITE, designated SEQ ID:4072, to the nucleotide sequence of GAM2033 RNA, herein designated GAM RNA, also designated SEQ ID:305.

Another function of GAM2033 is therefore inhibition of Dihydrolipoamide branched chain transacylase (e2 component of branched chain keto acid dehydrogenase complex; maple syrup urine disease) (DBT, Accession NP_001909.1). Accordingly, utilities of GAM2033 include diagnosis, prevention and treatment of diseases and clinical conditions associated with DBT.

Doublecortin and cam kinase-like 1 (DCAMKL1, Accession NP_004725.1) is another GAM2033 target gene, herein designated TARGET GENE. DCAMKL1 BINDING SITE is a target binding site found in the 3' untranslated region of mRNA encoded by DCAMKL1, corresponding to a target binding site such as BINDING SITE I, BINDING SITE II or BINDING SITE III of FIG. 8. Table 4 illustrates the complementarity of the nucleotide sequences of DCAMKL1 BINDING SITE, designated SEQ ID:17620, to the nucleotide sequence of GAM2033 RNA, herein designated GAM RNA, also designated SEQ ID:305.

Another function of GAM2033 is therefore inhibition of Doublecortin and cam kinase-like 1 (DCAMKL1, Accession NP_004725.1). Accordingly, utilities of GAM2033 include diagnosis, prevention and treatment of diseases and clinical conditions associated with DCAMKL1.

DKFZp434F1719 (Accession NP_115624.1) is another GAM2033 target gene, herein designated TARGET GENE. DKFZp434F1719 BINDING SITE is a target binding site found in the 3' untranslated region of mRNA encoded by DKFZp434F1719, corresponding to a target binding site such as BINDING SITE I, BINDING SITE II or BINDING SITE III of FIG. 8. Table 4 illustrates the complementarity of the nucleotide sequences of DKFZp434F1719 BINDING SITE, designated SEQ ID:12168, to the nucleotide sequence of GAM2033 RNA, herein designated GAM RNA, also designated SEQ ID:305.

Another function of GAM2033 is therefore inhibition of DKFZp434F1719 (Accession NP_115624.1). Accordingly, utilities of GAM2033 include diagnosis, prevention and treatment of diseases and clinical conditions associated with DKFZp434F1719.

DKFZp434H247 (Accession XP_290829.1) is another GAM2033 target gene, herein designated TARGET GENE. DKFZp434H247 BINDING SITE is a target binding site found in the 3' untranslated region of mRNA encoded by DKFZp434H247, corresponding to a target binding site such as BINDING SITE I, BINDING SITE II or BINDING SITE III of FIG. 8. Table 4 illustrates the complementarity of the nucleotide sequences of DKFZp434H247 BINDING SITE, designated SEQ ID:5311, to the nucleotide sequence of GAM2033 RNA, herein designated GAM RNA, also designated SEQ ID:305.

Another function of GAM2033 is therefore inhibition of DKFZp434H247 (Accession XP_290829.1). Accordingly, utilities of GAM2033 include diagnosis, prevention and treatment of diseases and clinical conditions associated with DKFZp434H247.

DKFZP566M114 (Accession NP_115504.1) is another GAM2033 target gene, herein designated TARGET GENE. DKFZP566M114 BINDING SITE is a target binding site found in the 5' untranslated region of mRNA encoded by DKFZP566M114, corresponding to a target binding site such as BINDING SITE I, BINDING SITE II or BINDING SITE III of FIG. 8. Table 4 illustrates the complementarity of the nucleotide sequences of DKFZP566M114 BINDING SITE, designated SEQ ID:4512, to the nucleotide sequence of GAM2033 RNA, herein designated GAM RNA, also designated SEQ ID:305.

Another function of GAM2033 is therefore inhibition of DKFZP566M114 (Accession NP__115504.1). Accordingly, utilities of GAM2033 include diagnosis, prevention and treatment of diseases and clinical conditions associated with DKFZP566M114.

DPCR1 (Accession NP__543146.1) is another GAM2033 target gene, herein designated TARGET GENE. DPCR1 BINDING SITE is a target binding site found in the 3' untranslated region of mRNA encoded by DPCR1, corresponding to a target binding site such as BINDING SITE I, BINDING SITE II or BINDING SITE III of FIG. 8. Table 4 illustrates the complementarity of the nucleotide sequences of DPCR1 BINDING SITE, designated SEQ ID:18332, to the nucleotide sequence of GAM2033 RNA, herein designated GAM RNA, also designated SEQ ID:305.

Another function of GAM2033 is therefore inhibition of DPCR1 (Accession NP__543146.1). Accordingly, utilities of GAM2033 include diagnosis, prevention and treatment of diseases and clinical conditions associated with DPCR1.

Eh-domain containing 3 (EHD3, Accession NP__055415.1) is another GAM2033 target gene, herein designated TARGET GENE. EHD3 BINDING SITE is a target binding site found in the 3' untranslated region of mRNA encoded by EHD3, corresponding to a target binding site such as BINDING SITE I, BINDING SITE II or BINDING SITE III of FIG. 8. Table 4 illustrates the complementarity of the nucleotide sequences of EHD3 BINDING SITE, designated SEQ ID:11360, to the nucleotide sequence of GAM2033 RNA, herein designated GAM RNA, also designated SEQ ID:305.

Another function of GAM2033 is therefore inhibition of Eh-domain containing 3 (EHD3, Accession NP__055415.1). Accordingly, utilities of GAM2033 include diagnosis, prevention and treatment of diseases and clinical conditions associated with EHD3.

V-erb-b2 erythroblastic leukemia viral oncogene homolog 3 (avian) (ERBB3, Accession NP__001973.1) is another GAM2033 target gene, herein designated TARGET GENE. ERBB3 BINDING SITE is a target binding site found in the 3' untranslated region of mRNA encoded by ERBB3, corresponding to a target binding site such as BINDING SITE I, BINDING SITE II or BINDING SITE III of FIG. 8. Table 4 illustrates the complementarity of the nucleotide sequences of ERBB3 BINDING SITE, designated SEQ ID:2087, to the nucleotide sequence of GAM2033 RNA, herein designated GAM RNA, also designated SEQ ID:305.

Another function of GAM2033 is therefore inhibition of V-erb-b2 erythroblastic leukemia viral oncogene homolog 3 (avian) (ERBB3, Accession NP__001973.1), a gene which binds and is activated by neuregulins and ntak. Accordingly, utilities of GAM2033 include diagnosis, prevention and treatment of diseases and clinical conditions associated with ERBB3.

The function of ERBB3 and its association with various diseases and clinical conditions, has been established by previous studies, as described hereinabove with reference to GAM63.1. ERdj5 (Accession NP__061854.1) is another GAM2033 target gene, herein designated TARGET GENE. ERdj5 BINDING SITE is a target binding site found in the 5' untranslated region of mRNA encoded by ERdj5, corresponding to a target binding site such as BINDING SITE I, BINDING SITE II or BINDING SITE III of FIG. 8. Table 4 illustrates the complementarity of the nucleotide sequences of ERdj5 BINDING SITE, designated SEQ ID:7721, to the nucleotide sequence of GAM2033 RNA, herein designated GAM RNA, also designated SEQ ID:305.

Another function of GAM2033 is therefore inhibition of ERdj5 (Accession NP__061854.1). Accordingly, utilities of GAM2033 include diagnosis, prevention and treatment of diseases and clinical conditions associated with ERdj5.

Estrogen-related receptor beta (ESRRB, Accession NP__004443.2) is another GAM2033 target gene, herein designated TARGET GENE. ESRRB BINDING SITE is a target binding site found in the 5' untranslated region of mRNA encoded by ESRRB, corresponding to a target binding site such as BINDING SITE I, BINDING SITE II or BINDING SITE III of FIG. 8. Table 4 illustrates the complementarity of the nucleotide sequences of ESRRB BINDING SITE, designated SEQ ID:8932, to the nucleotide sequence of GAM2033 RNA, herein designated GAM RNA, also designated SEQ ID:305.

Another function of GAM2033 is therefore inhibition of Estrogen-related receptor beta (ESRRB, Accession NP__004443.2), a gene which Estrogen- related receptor beta; member of the nuclear hormone receptor family. Accordingly, utilities of GAM2033 include diagnosis, prevention and treatment of diseases and clinical conditions associated with ESRRB.

The function of ESRRB and its association with various diseases and clinical conditions, has been established by previous studies, as described hereinabove with reference to GAM607.2. F-box and leucine-rich repeat protein 7 (FBXL7, Accession NP__036436.1) is another GAM2033 target gene, herein designated TARGET GENE. FBXL7 BINDING SITE is a target binding site found in the 3' untranslated region of mRNA encoded by FBXL7, corresponding to a target binding site such as BINDING SITE I, BINDING SITE II or BINDING SITE III of FIG. 8. Table 4 illustrates the complementarity of the nucleotide sequences of FBXL7 BINDING SITE, designated SEQ ID:3073, to the nucleotide sequence of GAM2033 RNA, herein designated GAM RNA, also designated SEQ ID:305.

Another function of GAM2033 is therefore inhibition of F-box and leucine-rich repeat protein 7 (FBXL7, Accession NP__036436.1), a gene which may be involved in in phosphorylation-dependent ubiquitination. Accordingly, utilities of GAM2033 include diagnosis, prevention and treatment of diseases and clinical conditions associated with FBXL7.

The function of FBXL7 and its association with various diseases and clinical conditions, has been established by previous studies, as described hereinabove with reference to GAM40.1. FLJ10618 (Accession NP__060625.1) is another GAM2033 target gene, herein designated TARGET GENE. FLJ10618 BINDING SITE is a target binding site found in the 5' untranslated region of mRNA encoded by FLJ10618, corresponding to a target binding site such as BINDING SITE I, BINDING SITE II or BINDING SITE III of FIG. 8. Table 4 illustrates the complementarity of the nucleotide sequences of FLJ10618 BINDING SITE, designated SEQ ID:12018, to the nucleotide sequence of GAM2033 RNA, herein designated GAM RNA, also designated SEQ ID:305.

Another function of GAM2033 is therefore inhibition of FLJ10618 (Accession NP__060625.1). Accordingly, utilities of GAM2033 include diagnosis, prevention and treatment of diseases and clinical conditions associated with FLJ10618.

FLJ10916 (Accession NP__060741.1) is another GAM2033 target gene, herein designated TARGET GENE.

FLJ10916 BINDING SITE is a target binding site found in the 5' untranslated region of mRNA encoded by FLJ10916, corresponding to a target binding site such as BINDING SITE I, BINDING SITE II or BINDING SITE III of FIG. 8. Table 4 illustrates the complementarity of the nucleotide sequences of FLJ10916 BINDING SITE, designated SEQ ID:976, to the nucleotide sequence of GAM2033 RNA, herein designated GAM RNA, also designated SEQ ID:305.

Another function of GAM2033 is therefore inhibition of FLJ10916 (Accession NP_060741.1). Accordingly, utilities of GAM2033 include diagnosis, prevention and treatment of diseases and clinical conditions associated with FLJ10916.

FLJ10996 (Accession NP_061917.2) is another GAM2033 target gene, herein designated TARGET GENE. FLJ10996 BINDING SITE is a target binding site found in the 5' untranslated region of mRNA encoded by FLJ10996, corresponding to a target binding site such as BINDING SITE I, BINDING SITE II or BINDING SITE III of FIG. 8. Table 4 illustrates the complementarity of the nucleotide sequences of FLJ10996 BINDING SITE, designated SEQ ID:12447, to the nucleotide sequence of GAM2033 RNA, herein designated GAM RNA, also designated SEQ ID:305.

Another function of GAM2033 is therefore inhibition of FLJ10996 (Accession NP_061917.2). Accordingly, utilities of GAM2033 include diagnosis, prevention and treatment of diseases and clinical conditions associated with FLJ10996.

FLJ11565 (Accession NP_078933.2) is another GAM2033 target gene, herein designated TARGET GENE. FLJ11565 BINDING SITE is a target binding site found in the 3' untranslated region of mRNA encoded by FLJ11565, corresponding to a target binding site such as BINDING SITE I, BINDING SITE II or BINDING SITE III of FIG. 8. Table 4 illustrates the complementarity of the nucleotide sequences of FLJ11565 BINDING SITE, designated SEQ ID:7659, to the nucleotide sequence of GAM2033 RNA, herein designated GAM RNA, also designated SEQ ID:305.

Another function of GAM2033 is therefore inhibition of FLJ11565 (Accession NP_078933.2). Accordingly, utilities of GAM2033 include diagnosis, prevention and treatment of diseases and clinical conditions associated with FLJ11565.

FLJ13491 (Accession NP_078899.1) is another GAM2033 target gene, herein designated TARGET GENE. FLJ13491 BINDING SITE is a target binding site found in the 5' untranslated region of mRNA encoded by FLJ13491, corresponding to a target binding site such as BINDING SITE I, BINDING SITE II or BINDING SITE III of FIG. 8. Table 4 illustrates the complementarity of the nucleotide sequences of FLJ13491 BINDING SITE, designated SEQ ID:8459, to the nucleotide sequence of GAM2033 RNA, herein designated GAM RNA, also designated SEQ ID:305.

Another function of GAM2033 is therefore inhibition of FLJ13491 (Accession NP_078899.1). Accordingly, utilities of GAM2033 include diagnosis, prevention and treatment of diseases and clinical conditions associated with FLJ13491.

FLJ14167 (Accession XP_042704.1) is another GAM2033 target gene, herein designated TARGET GENE. FLJ14167 BINDING SITE is a target binding site found in the 3' untranslated region of mRNA encoded by FLJ14167, corresponding to a target binding site such as BINDING SITE I, BINDING SITE II or BINDING SITE III of FIG. 8. Table 4 illustrates the complementarity of the nucleotide sequences of FLJ14167 BINDING SITE, designated SEQ ID:3447, to the nucleotide sequence of GAM2033 RNA, herein designated GAM RNA, also designated SEQ ID:305.

Another function of GAM2033 is therefore inhibition of FLJ14167 (Accession XP_042704.1). Accordingly, utilities of GAM2033 include diagnosis, prevention and treatment of diseases and clinical conditions associated with FLJ14167.

FLJ14260 (Accession NP_079303.2) is another GAM2033 target gene, herein designated TARGET GENE. FLJ14260 BINDING SITE is a target binding site found in the 5' untranslated region of mRNA encoded by FLJ14260, corresponding to a target binding site such as BINDING SITE I, BINDING SITE II or BINDING SITE III of FIG. 8. Table 4 illustrates the complementarity of the nucleotide sequences of FLJ14260 BINDING SITE, designated SEQ ID:18009, to the nucleotide sequence of GAM2033 RNA, herein designated GAM RNA, also designated SEQ ID:305.

Another function of GAM2033 is therefore inhibition of FLJ14260 (Accession NP_079303.2). Accordingly, utilities of GAM2033 include diagnosis, prevention and treatment of diseases and clinical conditions associated with FLJ14260.

FLJ14442 (Accession NP_116174.1) is another GAM2033 target gene, herein designated TARGET GENE. FLJ14442 BINDING SITE is a target binding site found in the 3' untranslated region of mRNA encoded by FLJ14442, corresponding to a target binding site such as BINDING SITE I, BINDING SITE II or BINDING SITE III of FIG. 8. Table 4 illustrates the complementarity of the nucleotide sequences of FLJ14442 BINDING SITE, designated SEQ ID:7173, to the nucleotide sequence of GAM2033 RNA, herein designated GAM RNA, also designated SEQ ID:305.

Another function of GAM2033 is therefore inhibition of FLJ14442 (Accession NP_116174.1). Accordingly, utilities of GAM2033 include diagnosis, prevention and treatment of diseases and clinical conditions associated with FLJ14442.

FLJ14871 (Accession NP_116243.1) is another GAM2033 target gene, herein designated TARGET GENE. FLJ14871 BINDING SITE is a target binding site found in the 3' untranslated region of mRNA encoded by FLJ14871, corresponding to a target binding site such as BINDING SITE I, BINDING SITE II or BINDING SITE III of FIG. 8. Table 4 illustrates the complementarity of the nucleotide sequences of FLJ14871 BINDING SITE, designated SEQ ID:13495, to the nucleotide sequence of GAM2033 RNA, herein designated GAM RNA, also designated SEQ ID:305.

Another function of GAM2033 is therefore inhibition of FLJ14871 (Accession NP_116243.1). Accordingly, utilities of GAM2033 include diagnosis, prevention and treatment of diseases and clinical conditions associated with FLJ14871.

FLJ20139 (Accession NP_060155.1) is another GAM2033 target gene, herein designated TARGET GENE. FLJ20139 BINDING SITE is a target binding site found in the 3' untranslated region of mRNA encoded by FLJ20139, corresponding to a target binding site such as BINDING SITE I, BINDING SITE II or BINDING SITE III of FIG. 8. Table 4 illustrates the complementarity of the nucleotide sequences of FLJ20139 BINDING SITE, designated SEQ ID:12404, to the nucleotide sequence of GAM2033 RNA, herein designated GAM RNA, also designated SEQ ID:305.

Another function of GAM2033 is therefore inhibition of FLJ20139 (Accession NP_060155.1). Accordingly, utilities of GAM2033 include diagnosis, prevention and treatment of diseases and clinical conditions associated with FLJ20139.

FLJ20232 (Accession NP_061881.2) is another GAM2033 target gene, herein designated TARGET GENE. FLJ20232 BINDING SITE is a target binding site found in the 3' untranslated region of mRNA encoded by FLJ20232, corresponding to a target binding site such as BINDING SITE I, BINDING SITE II or BINDING SITE III of FIG. 8. Table 4 illustrates the complementarity of the nucleotide sequences of FLJ20232 BINDING SITE, designated SEQ ID:17612, to the nucleotide sequence of GAM2033 RNA, herein designated GAM RNA, also designated SEQ ID:305.

Another function of GAM2033 is therefore inhibition of FLJ20232 (Accession NP_061881.2). Accordingly, utilities of GAM2033 include diagnosis, prevention and treatment of diseases and clinical conditions associated with FLJ20232.

FLJ20625 (Accession NP_060377.1) is another GAM2033 target gene, herein designated TARGET GENE. FLJ20625 BINDING SITE is a target binding site found in the 3' untranslated region of mRNA encoded by FLJ20625, corresponding to a target binding site such as BINDING SITE I, BINDING SITE II or BINDING SITE III of FIG. 8. Table 4 illustrates the complementarity of the nucleotide sequences of FLJ20625 BINDING SITE, designated SEQ ID:9074, to the nucleotide sequence of GAM2033 RNA, herein designated GAM RNA, also designated SEQ ID:305.

Another function of GAM2033 is therefore inhibition of FLJ20625 (Accession NP_060377.1). Accordingly, utilities of GAM2033 include diagnosis, prevention and treatment of diseases and clinical conditions associated with FLJ20625.

FLJ23309 (Accession XP_291315.1) is another GAM2033 target gene, herein designated TARGET GENE. FLJ23309 BINDING SITE is a target binding site found in the 3' untranslated region of mRNA encoded by FLJ23309, corresponding to a target binding site such as BINDING SITE I, BINDING SITE II or BINDING SITE III of FIG. 8. Table 4 illustrates the complementarity of the nucleotide sequences of FLJ23309 BINDING SITE, designated SEQ ID:19596, to the nucleotide sequence of GAM2033 RNA, herein designated GAM RNA, also designated SEQ ID:305.

Another function of GAM2033 is therefore inhibition of FLJ23309 (Accession XP_291315.1). Accordingly, utilities of GAM2033 include diagnosis, prevention and treatment of diseases and clinical conditions associated with FLJ23309.

FLJ31951 (Accession NP_653327.1) is another GAM2033 target gene, herein designated TARGET GENE. FLJ31951 BINDING SITE is a target binding site found in the 3' untranslated region of mRNA encoded by FLJ31951, corresponding to a target binding site such as BINDING SITE I, BINDING SITE II or BINDING SITE III of FIG. 8. Table 4 illustrates the complementarity of the nucleotide sequences of FLJ31951 BINDING SITE, designated SEQ ID:18405, to the nucleotide sequence of GAM2033 RNA, herein designated GAM RNA, also designated SEQ ID:305.

Another function of GAM2033 is therefore inhibition of FLJ31951 (Accession NP_653327.1). Accordingly, utilities of GAM2033 include diagnosis, prevention and treatment of diseases and clinical conditions associated with FLJ31951.

GALNACT-2 (Accession NP_061060.3) is another GAM2033 target gene, herein designated TARGET GENE. GALNACT-2 BINDING SITE is a target binding site found in the 3' untranslated region of mRNA encoded by GALNACT-2, corresponding to a target binding site such as BINDING SITE I, BINDING SITE II or BINDING SITE III of FIG. 8. Table 4 illustrates the complementarity of the nucleotide sequences of GALNACT-2 BINDING SITE, designated SEQ ID:14291, to the nucleotide sequence of GAM2033 RNA, herein designated GAM RNA, also designated SEQ ID:305.

Another function of GAM2033 is therefore inhibition of GALNACT-2 (Accession NP_061060.3). Accordingly, utilities of GAM2033 include diagnosis, prevention and treatment of diseases and clinical conditions associated with GALNACT-2.

Gata binding protein 5 (GATA5, Accession NP_536721.1) is another GAM2033 target gene, herein designated TARGET GENE. GATA5 BINDING SITE is a target binding site found in the 3' untranslated region of mRNA encoded by GATA5, corresponding to a target binding site such as BINDING SITE I, BINDING SITE II or BINDING SITE III of FIG. 8. Table 4 illustrates the complementarity of the nucleotide sequences of GATA5 BINDING SITE, designated SEQ ID:18782, to the nucleotide sequence of GAM2033 RNA, herein designated GAM RNA, also designated SEQ ID:305.

Another function of GAM2033 is therefore inhibition of Gata binding protein 5 (GATA5, Accession NP_536721.1). Accordingly, utilities of GAM2033 include diagnosis, prevention and treatment of diseases and clinical conditions associated with GATA5.

Glia maturation factor, beta (GMFB, Accession NP_004115.1) is another GAM2033 target gene, herein designated TARGET GENE. GMFB BINDING SITE is a target binding site found in the 3' untranslated region of mRNA encoded by GMFB, corresponding to a target binding site such as BINDING SITE I, BINDING SITE II or BINDING SITE III of FIG. 8. Table 4 illustrates the complementarity of the nucleotide sequences of GMFB BINDING SITE, designated SEQ ID:7743, to the nucleotide sequence of GAM2033 RNA, herein designated GAM RNA, also designated SEQ ID:305.

Another function of GAM2033 is therefore inhibition of Glia maturation factor, beta (GMFB, Accession NP_004115.1). Accordingly, utilities of GAM2033 include diagnosis, prevention and treatment of diseases and clinical conditions associated with GMFB.

Guanine nucleotide binding protein (g protein), beta polypeptide 1 (GNB1, Accession NP_002065.1) is another GAM2033 target gene, herein designated TARGET GENE. GNB1 BINDING SITE is a target binding site found in the 5' untranslated region of mRNA encoded by GNB1, corresponding to a target binding site such as BINDING SITE I, BINDING SITE II or BINDING SITE III of FIG. 8. Table 4 illustrates the complementarity of the nucleotide sequences of GNB1 BINDING SITE, designated SEQ ID:18436, to the nucleotide sequence of GAM2033 RNA, herein designated GAM RNA, also designated SEQ ID:305.

Another function of GAM2033 is therefore inhibition of Guanine nucleotide binding protein (g protein), beta polypeptide 1 (GNB1, Accession NP_002065.1). Accordingly, utilities of GAM2033 include diagnosis, prevention and treatment of diseases and clinical conditions associated with GNB1.

Glutamate receptor, ionotropic, n-methyl d-aspartate 2b (GRIN2B, Accession NP_000825.1) is another GAM2033 target gene, herein designated TARGET GENE. GRIN2B BINDING SITE is a target binding site found in the 3' untranslated region of mRNA encoded by GRIN2B, corresponding to a target binding site such as BINDING SITE I, BINDING SITE II or BINDING SITE III of FIG. 8. Table 4 illustrates the complementarity of the nucleotide sequences of GRIN2B BINDING SITE, designated SEQ ID:13520, to the nucleotide sequence of GAM2033 RNA, herein designated GAM RNA, also designated SEQ ID:305.

Another function of GAM2033 is therefore inhibition of Glutamate receptor, ionotropic, n-methyl d-aspartate 2b (GRIN2B, Accession NP_000825.1). Accordingly, utilities of GAM2033 include diagnosis, prevention and treatment of diseases and clinical conditions associated with GRIN2B.

General transcription factor iie, polypeptide 1, alpha 56 kda (GTF2E1, Accession NP_005504.1) is another GAM2033 target gene, herein designated TARGET GENE. GTF2E1 BINDING SITE is a target binding site found in the 3' untranslated region of mRNA encoded by GTF2E1, corresponding to a target binding site such as BINDING SITE I, BINDING SITE II or BINDING SITE III of FIG. 8. Table 4 illustrates the complementarity of the nucleotide sequences of GTF2E1 BINDING SITE, designated SEQ ID:994, to the nucleotide sequence of GAM2033 RNA, herein designated GAM RNA, also designated SEQ ID:305.

Another function of GAM2033 is therefore inhibition of General transcription factor iie, polypeptide 1, alpha 56 kda (GTF2E1, Accession NP_005504.1). Accordingly, utilities of GAM2033 include diagnosis, prevention and treatment of diseases and clinical conditions associated with GTF2E1.

Host cell factor c1 (vp16-accessory protein) (HCFC1, Accession NP_005325.1) is another GAM2033 target gene, herein designated TARGET GENE. HCFC1 BINDING SITE is a target binding site found in the 3' untranslated region of mRNA encoded by HCFC1, corresponding to a target binding site such as BINDING SITE I, BINDING SITE II or BINDING SITE III of FIG. 8. Table 4 illustrates the complementarity of the nucleotide sequences of HCFC1 BINDING SITE, designated SEQ ID:18043, to the nucleotide sequence of GAM2033 RNA, herein designated GAM RNA, also designated SEQ ID:305.

Another function of GAM2033 is therefore inhibition of Host cell factor c1 (vp16-accessory protein) (HCFC1, Accession NP_005325.1), a gene which is a host cell factor, has a role in cell proliferation and can form a complex with HSV VP16. Accordingly, utilities of GAM2033 include diagnosis, prevention and treatment of diseases and clinical conditions associated with HCFC1.

The function of HCFC1 and its association with various diseases and clinical conditions, has been established by previous studies, as described hereinabove with reference to GAM385.2. Hexokinase 2 (HK2, Accession NP_000180.2) is another GAM2033 target gene, herein designated TARGET GENE. HK2 BINDING SITE is a target binding site found in the 3' untranslated region of mRNA encoded by HK2, corresponding to a target binding site such as BINDING SITE I, BINDING SITE II or BINDING SITE III of FIG. 8. Table 4 illustrates the complementarity of the nucleotide sequences of HK2 BINDING SITE, designated SEQ ID:11683, to the nucleotide sequence of GAM2033 RNA, herein designated GAM RNA, also designated SEQ ID:305.

Another function of GAM2033 is therefore inhibition of Hexokinase 2 (HK2, Accession NP_000180.2), a gene which plays an important role in intracellular glucose metabolism by catalyzing the conversion of glucose to glucose-6-phosphate. and therefore may be associated with Noninsulin-dependent diabetes mellitus. Accordingly, utilities of GAM2033 include diagnosis, prevention and treatment of Noninsulin-dependent diabetes mellitus ., and of other diseases and clinical conditions associated with HK2.

The function of HK2 and its association with various diseases and clinical conditions, has been established by previous studies, as described hereinabove with reference to GAM1664.1. Homeo box c4 (HOXC4, Accession NP_055435.2) is another GAM2033 target gene, herein designated TARGET GENE. HOXC4 BINDING SITE is a target binding site found in the 5' untranslated region of multiple transcripts of mRNA encoded by HOXC4, corresponding to a target binding site such as BINDING SITE I, BINDING SITE II or BINDING SITE III of FIG. 8. Table 4 illustrates the complementarity of the nucleotide sequences of HOXC4 BINDING SITE, designated SEQ ID:19800, to the nucleotide sequence of GAM2033 RNA, herein designated GAM RNA, also designated SEQ ID:305.

Another function of GAM2033 is therefore inhibition of Homeo box c4 (HOXC4, Accession NP_055435.2), a gene which is part of a developmental regulatory system that provides cells with specific positional identities on the anterior-posterior axis. Accordingly, utilities of GAM2033 include diagnosis, prevention and treatment of diseases and clinical conditions associated with HOXC4.

The function of HOXC4 and its association with various diseases and clinical conditions, has been established by previous studies, as described hereinabove with reference to GAM94.1. Homeo box c6 (HOXC6, Accession NP_710160.1) is another GAM2033 target gene, herein designated TARGET GENE. HOXC6 BINDING SITE is a target binding site found in the 5' untranslated region of multiple transcripts of mRNA encoded by HOXC6, corresponding to a target binding site such as BINDING SITE I, BINDING SITE II or BINDING SITE III of FIG. 8. Table 4 illustrates the complementarity of the nucleotide sequences of HOXC6 BINDING SITE, designated SEQ ID:19800, to the nucleotide sequence of GAM2033 RNA, herein designated GAM RNA, also designated SEQ ID:305.

Another function of GAM2033 is therefore inhibition of Homeo box c6 (HOXC6, Accession NP_710160.1), a gene which is part of a developmental regulatory system. Accordingly, utilities of GAM2033 include diagnosis, prevention and treatment of diseases and clinical conditions associated with HOXC6.

The function of HOXC6 and its association with various diseases and clinical conditions, has been established by previous studies, as described hereinabove with reference to GAM94.1. Harakiri, bcl2 interacting protein (contains only bh3 domain) (HRK, Accession NP_003797.1) is another GAM2033 target gene, herein designated TARGET GENE. HRK BINDING SITE is a target binding site found in the 3' untranslated region of mRNA encoded by HRK, corresponding to a target binding site such as BINDING SITE I, BINDING SITE II or BINDING SITE III of FIG. 8. Table 4 illustrates the complementarity of the nucleotide sequences of HRK BINDING SITE, designated SEQ ID:11032, to the nucleotide sequence of GAM2033 RNA, herein designated GAM RNA, also designated SEQ ID:305.

Another function of GAM2033 is therefore inhibition of Harakiri, bcl2 interacting protein (contains only bh3 domain) (HRK, Accession NP_003797.1). Accordingly, utilities of GAM2033 include diagnosis, prevention and treatment of diseases and clinical conditions associated with HRK.

Heat shock 70 kda protein 9b (mortalin-2) (HSPA9B, Accession NP_004125.3) is another GAM2033 target gene, herein designated TARGET GENE. HSPA9B BINDING SITE is a target binding site found in the 3' untranslated region of mRNA encoded by HSPA9B, corresponding to a target binding site such as BINDING SITE I, BINDING SITE II or BINDING SITE III of FIG. 8. Table 4 illustrates the complementarity of the nucleotide sequences of HSPA9B BINDING SITE, designated SEQ ID:9911, to the nucleotide sequence of GAM2033 RNA, herein designated GAM RNA, also designated SEQ ID:305.

Another function of GAM2033 is therefore inhibition of Heat shock 70 kda protein 9b (mortalin-2) (HSPA9B, Accession NP_004125.3). Accordingly, utilities of GAM2033 include diagnosis, prevention and treatment of diseases and clinical conditions associated with HSPA9B.

Inhibin, beta a (activin a, activin ab alpha polypeptide) (INHBA, Accession NP_002183.1) is another GAM2033 target gene, herein designated TARGET GENE. INHBA BINDING SITE is a target binding site found in the 3' untranslated region of mRNA encoded by INHBA, corresponding to a target binding site such as BINDING SITE I, BINDING SITE II or BINDING SITE III of FIG. 8. Table 4 illustrates the complementarity of the nucleotide sequences of INHBA BINDING SITE, designated SEQ ID:18996, to the nucleotide sequence of GAM2033 RNA, herein designated GAM RNA, also designated SEQ ID:305.

Another function of GAM2033 is therefore inhibition of Inhibin, beta a (activin a, activin ab alpha polypeptide) (IN-HBA, Accession NP_002183.1), a gene which inhibit respectively the secretion of follitropin by the pituitary gland. Accordingly, utilities of GAM2033 include diagnosis, prevention and treatment of diseases and clinical conditions associated with INHBA.

The function of INHBA and its association with various diseases and clinical conditions, has been established by previous studies, as described hereinabove with reference to GAM1033.2. Potassium voltage-gated channel, shaker-related subfamily, member 7 (KCNA7, Accession NP_114092.2) is another GAM2033 target gene, herein designated TARGET GENE. KCNA7 BINDING SITE is a target binding site found in the 3' untranslated region of mRNA encoded by KCNA7, corresponding to a target binding site such as BINDING SITE I, BINDING SITE II or BINDING SITE III of FIG. 8. Table 4 illustrates the complementarity of the nucleotide sequences of KCNA7 BINDING SITE, designated SEQ ID:8004, to the nucleotide sequence of GAM2033 RNA, herein designated GAM RNA, also designated SEQ ID:305.

Another function of GAM2033 is therefore inhibition of Potassium voltage-gated channel, shaker-related subfamily, member 7 (KCNA7, Accession NP_114092.2), a gene which allows nerve cells to efficiently repolarize following an action potential. Accordingly, utilities of GAM2033 include diagnosis, prevention and treatment of diseases and clinical conditions associated with KCNA7.

The function of KCNA7 and its association with various diseases and clinical conditions, has been established by previous studies, as described hereinabove with reference to GAM72.1. KIAA0711 (Accession NP_055682.1) is another GAM2033 target gene, herein designated TARGET GENE. KIAA0711 BINDING SITE is a target binding site found in the 3' untranslated region of mRNA encoded by KIAA0711, corresponding to a target binding site such as BINDING SITE I, BINDING SITE II or BINDING SITE III of FIG. 8. Table 4 illustrates the complementarity of the nucleotide sequences of KIAA0711 BINDING SITE, designated SEQ ID:10051, to the nucleotide sequence of GAM2033 RNA, herein designated GAM RNA, also designated SEQ ID:305.

Another function of GAM2033 is therefore inhibition of KIAA0711 (Accession NP_055682.1). Accordingly, utilities of GAM2033 include diagnosis, prevention and treatment of diseases and clinical conditions associated with KIAA0711.

KIAA1237 (Accession XP_087386.3) is another GAM2033 target gene, herein designated TARGET GENE. KIAA1237 BINDING SITE is a target binding site found in the 3' untranslated region of mRNA encoded by KIAA1237, corresponding to a target binding site such as BINDING SITE I, BINDING SITE II or BINDING SITE III of FIG. 8. Table 4 illustrates the complementarity of the nucleotide sequences of KIAA1237 BINDING SITE, designated SEQ ID:17086, to the nucleotide sequence of GAM2033 RNA, herein designated GAM RNA, also designated SEQ ID:305.

Another function of GAM2033 is therefore inhibition of KIAA1237 (Accession XP_087386.3). Accordingly, utilities of GAM2033 include diagnosis, prevention and treatment of diseases and clinical conditions associated with KIAA1237.

KIAA1240 (Accession XP_039676.1) is another GAM2033 target gene, herein designated TARGET GENE. KIAA1240 BINDING SITE is a target binding site found in the 3' untranslated region of mRNA encoded by KIAA1240, corresponding to a target binding site such as BINDING SITE I, BINDING SITE II or BINDING SITE III of FIG. 8. Table 4 illustrates the complementarity of the nucleotide sequences of KIAA1240 BINDING SITE, designated SEQ ID:3069, to the nucleotide sequence of GAM2033 RNA, herein designated GAM RNA, also designated SEQ ID:305.

Another function of GAM2033 is therefore inhibition of KIAA1240 (Accession XP_039676.1). Accordingly, utilities of GAM2033 include diagnosis, prevention and treatment of diseases and clinical conditions associated with KIAA1240.

KIAA1399 (Accession XP_046685.4) is another GAM2033 target gene, herein designated TARGET GENE. KIAA1399 BINDING SITE is a target binding site found in the 3' untranslated region of mRNA encoded by KIAA1399, corresponding to a target binding site such as BINDING SITE I, BINDING SITE II or BINDING SITE III of FIG. 8. Table 4 illustrates the complementarity of the nucleotide sequences of KIAA1399 BINDING SITE, designated SEQ ID:18176, to the nucleotide sequence of GAM2033 RNA, herein designated GAM RNA, also designated SEQ ID:305.

Another function of GAM2033 is therefore inhibition of KIAA1399 (Accession XP_046685.4). Accordingly, utilities of GAM2033 include diagnosis, prevention and treatment of diseases and clinical conditions associated with KIAA1399.

KIAA1518 (Accession NP_056308.2) is another GAM2033 target gene, herein designated TARGET GENE. KIAA1518 BINDING SITE is a target binding site found in the 3' untranslated region of multiple transcripts of mRNA encoded by KIAA1518, corresponding to a target binding site such as BINDING SITE I, BINDING SITE II or BINDING SITE III of FIG. 8. Table 4 illustrates the complementarity of the nucleotide sequences of KIAA1518 BINDING SITE, designated SEQ ID:1300, to the nucleotide sequence of GAM2033 RNA, herein designated GAM RNA, also designated SEQ ID:305.

Another function of GAM2033 is therefore inhibition of KIAA1518 (Accession NP_056308.2). Accordingly, utilities of GAM2033 include diagnosis, prevention and treatment of diseases and clinical conditions associated with KIAA1518.

KIAA1706 (Accession NP_085139.1) is another GAM2033 target gene, herein designated TARGET GENE. KIAA1706 BINDING SITE is a target binding site found in the 3' untranslated region of mRNA encoded by KIAA1706, corresponding to a target binding site such as BINDING SITE I, BINDING SITE II or BINDING SITE III of FIG. 8. Table 4 illustrates the complementarity of the nucleotide sequences of KIAA1706 BINDING SITE, designated SEQ ID:17708, to the nucleotide sequence of GAM2033 RNA, herein designated GAM RNA, also designated SEQ ID:305.

Another function of GAM2033 is therefore inhibition of KIAA1706 (Accession NP_085139.1). Accordingly, utilities of GAM2033 include diagnosis, prevention and treatment of diseases and clinical conditions associated with KIAA1706.

KIAA1728 (Accession XP_043492.2) is another GAM2033 target gene, herein designated TARGET GENE. KIAA1728 BINDING SITE is a target binding site found in the 3' untranslated region of mRNA encoded by KIAA1728, corresponding to a target binding site such as BINDING SITE I, BINDING SITE II or BINDING SITE III of FIG. 8. Table 4 illustrates the complementarity of the nucleotide sequences of KIAA1728 BINDING SITE, designated SEQ ID:6209, to the nucleotide sequence of GAM2033 RNA, herein designated GAM RNA, also designated SEQ ID:305.

Another function of GAM2033 is therefore inhibition of KIAA1728 (Accession XP_043492.2). Accordingly, utilities of GAM2033 include diagnosis, prevention and treatment of diseases and clinical conditions associated with KIAA1728.

Laminin, gamma 2 (LAMC2, Accession NP_061486.1) is another GAM2033 target gene, herein designated TARGET GENE. LAMC2 BINDING SITE is a target binding site found in the 3' untranslated region of multiple transcripts of mRNA encoded by LAMC2, corresponding to a target binding site such as BINDING SITE I, BINDING SITE II or BINDING SITE III of FIG. 8. Table 4 illustrates the complementarity of the nucleotide sequences of LAMC2 BINDING SITE, designated SEQ ID:15830, to the nucleotide sequence of GAM2033 RNA, herein designated GAM RNA, also designated SEQ ID:305.

Another function of GAM2033 is therefore inhibition of Laminin, gamma 2 (LAMC2, Accession NP_061486.1). Accordingly, utilities of GAM2033 include diagnosis, prevention and treatment of diseases and clinical conditions associated with LAMC2.

LOC116228 (Accession XP_300752.1) is another GAM2033 target gene, herein designated TARGET GENE. LOC116228 BINDING SITE is a target binding site found in the 3' untranslated region of mRNA encoded by LOC116228, corresponding to a target binding site such as BINDING SITE I, BINDING SITE II or BINDING SITE III of FIG. 8. Table 4 illustrates the complementarity of the nucleotide sequences of LOC116228 BINDING SITE, designated SEQ ID:878, to the nucleotide sequence of GAM2033 RNA, herein designated GAM RNA, also designated SEQ ID:305.

Another function of GAM2033 is therefore inhibition of LOC116228 (Accession XP_300752.1). Accordingly, utilities of GAM2033 include diagnosis, prevention and treatment of diseases and clinical conditions associated with LOC116228.

LOC130026 (Accession NP_612477.3) is another GAM2033 target gene, herein designated TARGET GENE. LOC130026 BINDING SITE is a target binding site found in the 3' untranslated region of mRNA encoded by LOC130026, corresponding to a target binding site such as BINDING SITE I, BINDING SITE II or BINDING SITE III of FIG. 8. Table 4 illustrates the complementarity of the nucleotide sequences of LOC130026 BINDING SITE, designated SEQ ID:9829, to the nucleotide sequence of GAM2033 RNA, herein designated GAM RNA, also designated SEQ ID:305.

Another function of GAM2033 is therefore inhibition of LOC130026 (Accession NP_612477.3). Accordingly, utilities of GAM2033 include diagnosis, prevention and treatment of diseases and clinical conditions associated with LOC130026.

LOC143381 (Accession XP_084501.1) is another GAM2033 target gene, herein designated TARGET GENE. LOC143381 BINDING SITE is a target binding site found in the 3' untranslated region of mRNA encoded by LOC143381, corresponding to a target binding site such as BINDING SITE I, BINDING SITE II or BINDING SITE III of FIG. 8. Table 4 illustrates the complementarity of the nucleotide sequences of LOC143381 BINDING SITE, designated SEQ ID:8460, to the nucleotide sequence of GAM2033 RNA, herein designated GAM RNA, also designated SEQ ID:305.

Another function of GAM2033 is therefore inhibition of LOC143381 (Accession XP_084501.1). Accordingly, utilities of GAM2033 include diagnosis, prevention and treatment of diseases and clinical conditions associated with LOC143381.

LOC146013 (Accession XP_096919.1) is another GAM2033 target gene, herein designated TARGET GENE. LOC146013 BINDING SITE is a target binding site found in the 3' untranslated region of mRNA encoded by LOC146013, corresponding to a target binding site such as BINDING SITE I, BINDING SITE II or BINDING SITE III of FIG. 8. Table 4 illustrates the complementarity of the nucleotide sequences of LOC146013 BINDING SITE, designated SEQ ID:7781, to the nucleotide sequence of GAM2033 RNA, herein designated GAM RNA, also designated SEQ ID:305.

Another function of GAM2033 is therefore inhibition of LOC146013 (Accession XP_096919.1). Accordingly, utilities of GAM2033 include diagnosis, prevention and treatment of diseases and clinical conditions associated with LOC146013.

LOC146599 (Accession XP_085517.1) is another GAM2033 target gene, herein designated TARGET GENE. LOC146599 BINDING SITE is a target binding site found in the 5' untranslated region of mRNA encoded by LOC146599, corresponding to a target binding site such as BINDING SITE I, BINDING SITE II or BINDING SITE III of FIG. 8. Table 4 illustrates the complementarity of the nucleotide sequences of LOC146599 BINDING SITE, designated SEQ ID:15848, to the nucleotide sequence of GAM2033 RNA, herein designated GAM RNA, also designated SEQ ID:305.

Another function of GAM2033 is therefore inhibition of LOC146599 (Accession XP_085517.1). Accordingly, utilities of GAM2033 include diagnosis, prevention and treatment of diseases and clinical conditions associated with LOC146599.

LOC150311 (Accession XP_086858.1) is another GAM2033 target gene, herein designated TARGET GENE. LOC150311 BINDING SITE is a target binding site found in the 5' untranslated region of mRNA encoded by LOC150311, corresponding to a target binding site such as BINDING SITE I, BINDING SITE II or BINDING SITE III of FIG. 8. Table 4 illustrates the complementarity of the nucleotide sequences of LOC150311 BINDING SITE, designated SEQ ID:6767, to the nucleotide sequence of GAM2033 RNA, herein designated GAM RNA, also designated SEQ ID:305.

Another function of GAM2033 is therefore inhibition of LOC150311 (Accession XP_086858.1). Accordingly, utilities of GAM2033 include diagnosis, prevention and treatment of diseases and clinical conditions associated with LOC150311.

LOC150397 (Accession XP_086907.1) is another GAM2033 target gene, herein designated TARGET GENE. LOC150397 BINDING SITE is a target binding site found in the 3' untranslated region of mRNA encoded by LOC150397, corresponding to a target binding site such as BINDING SITE I, BINDING SITE II or BINDING SITE III of FIG. 8. Table 4 illustrates the complementarity of the nucleotide sequences of LOC150397 BINDING SITE, designated SEQ ID:9075, to the nucleotide sequence of GAM2033 RNA, herein designated GAM RNA, also designated SEQ ID:305.

Another function of GAM2033 is therefore inhibition of LOC150397 (Accession XP_086907.1). Accordingly, utilities of GAM2033 include diagnosis, prevention and treatment of diseases and clinical conditions associated with LOC150397.

LOC151636 (Accession NP_612144.1) is another GAM2033 target gene, herein designated TARGET GENE. LOC151636 BINDING SITE is a target binding site found in the 3' untranslated region of mRNA encoded by LOC151636, corresponding to a target binding site such as BINDING SITE I, BINDING SITE II or BINDING SITE III of FIG. 8. Table 4 illustrates the complementarity of the nucleotide sequences of LOC151636 BINDING SITE, designated SEQ ID:18792, to the nucleotide sequence of GAM2033 RNA, herein designated GAM RNA, also designated SEQ ID:305.

Another function of GAM2033 is therefore inhibition of LOC151636 (Accession NP_612144.1). Accordingly, utilities of GAM2033 include diagnosis, prevention and treatment of diseases and clinical conditions associated with LOC151636.

LOC152794 (Accession XP_087525.1) is another GAM2033 target gene, herein designated TARGET GENE. LOC152794 BINDING SITE1 and LOC152794 BINDING SITE2 are target binding sites found in untranslated regions of mRNA encoded by LOC152794, corresponding to target binding sites such as BINDING SITE I, BINDING SITE II or BINDING SITE III of FIG. 8. Table 4 illustrates the complementarity of the nucleotide sequences of LOC152794 BINDING SITE1 and LOC152794 BINDING SITE2, designated SEQ ID:11273 and SEQ ID:13308 respectively, to the nucleotide sequence of GAM2033 RNA, herein designated GAM RNA, also designated SEQ ID:305.

Another function of GAM2033 is therefore inhibition of LOC152794 (Accession XP_087525.1). Accordingly, utilities of GAM2033 include diagnosis, prevention and treatment of diseases and clinical conditions associated with LOC152794.

LOC153442 (Accession XP_098373.1) is another GAM2033 target gene, herein designated TARGET GENE. LOC153442 BINDING SITE is a target binding site found in the 3' untranslated region of mRNA encoded by LOC153442, corresponding to a target binding site such as BINDING SITE I, BINDING SITE II or BINDING SITE III of FIG. 8. Table 4 illustrates the complementarity of the nucleotide sequences of LOC153442 BINDING SITE, designated SEQ ID:482, to the nucleotide sequence of GAM2033 RNA, herein designated GAM RNA, also designated SEQ ID:305.

Another function of GAM2033 is therefore inhibition of LOC153442 (Accession XP_098373.1). Accordingly, utilities of GAM2033 include diagnosis, prevention and treatment of diseases and clinical conditions associated with LOC153442.

LOC154222 (Accession XP_098497.1) is another GAM2033 target gene, herein designated TARGET GENE. LOC154222 BINDING SITE is a target binding site found in the 3' untranslated region of mRNA encoded by LOC154222, corresponding to a target binding site such as BINDING SITE I, BINDING SITE II or BINDING SITE III of FIG. 8. Table 4 illustrates the complementarity of the nucleotide sequences of LOC154222 BINDING SITE, designated SEQ ID:16834, to the nucleotide sequence of GAM2033 RNA, herein designated GAM RNA, also designated SEQ ID:305.

Another function of GAM2033 is therefore inhibition of LOC154222 (Accession XP_098497.1). Accordingly, utilities of GAM2033 include diagnosis, prevention and treatment of diseases and clinical conditions associated with LOC154222.

LOC220038 (Accession XP_166257.1) is another GAM2033 target gene, herein designated TARGET GENE. LOC220038 BINDING SITE is a target binding site found in the 5' untranslated region of mRNA encoded by LOC220038, corresponding to a target binding site such as BINDING SITE I, BINDING SITE II or BINDING SITE III of FIG. 8. Table 4 illustrates the complementarity of the nucleotide sequences of LOC220038 BINDING SITE, designated SEQ ID:3435, to the nucleotide sequence of GAM2033 RNA, herein designated GAM RNA, also designated SEQ ID:305.

Another function of GAM2033 is therefore inhibition of LOC220038 (Accession XP_166257.1). Accordingly, utilities of GAM2033 include diagnosis, prevention and treatment of diseases and clinical conditions associated with LOC220038.

LOC220739 (Accession XP_167548.3) is another GAM2033 target gene, herein designated TARGET GENE. LOC220739 BINDING SITE is a target binding site found in the 5' untranslated region of mRNA encoded by LOC220739, corresponding to a target binding site such as BINDING SITE I, BINDING SITE II or BINDING SITE III of FIG. 8. Table 4 illustrates the complementarity of the nucleotide sequences of LOC220739 BINDING SITE, designated SEQ ID:4991, to the nucleotide sequence of GAM2033 RNA, herein designated GAM RNA, also designated SEQ ID:305.

Another function of GAM2033 is therefore inhibition of LOC220739 (Accession XP_167548.3). Accordingly, utilities of GAM2033 include diagnosis, prevention and treatment of diseases and clinical conditions associated with LOC220739.

LOC221889 (Accession XP_166513.1) is another GAM2033 target gene, herein designated TARGET GENE. LOC221889 BINDING SITE is a target binding site found in the 3' untranslated region of mRNA encoded by LOC221889, corresponding to a target binding site such as BINDING SITE I, BINDING SITE II or BINDING SITE III of FIG. 8. Table 4 illustrates the complementarity of the nucleotide sequences of LOC221889 BINDING SITE, designated SEQ ID:12817, to the nucleotide sequence of GAM2033 RNA, herein designated GAM RNA, also designated SEQ ID:305.

Another function of GAM2033 is therefore inhibition of LOC221889 (Accession XP_166513.1). Accordingly, utilities of GAM2033 include diagnosis, prevention and treatment of diseases and clinical conditions associated with LOC221889.

LOC254826 (Accession XP_173188.1) is another GAM2033 target gene, herein designated TARGET GENE. LOC254826 BINDING SITE is a target binding site found in the 3' untranslated region of mRNA encoded by LOC254826, corresponding to a target binding site such as BINDING SITE I, BINDING SITE II or BINDING SITE III of FIG. 8. Table 4 illustrates the complementarity of the nucleotide sequences of LOC254826 BINDING SITE, designated SEQ ID:647, to the nucleotide sequence of GAM2033 RNA, herein designated GAM RNA, also designated SEQ ID:305.

Another function of GAM2033 is therefore inhibition of LOC254826 (Accession XP_173188.1). Accordingly, utilities of GAM2033 include diagnosis, prevention and treatment of diseases and clinical conditions associated with LOC254826.

LOC283050 (Accession XP_210872.1) is another GAM2033 target gene, herein designated TARGET GENE. LOC283050 BINDING SITE is a target binding site found in the 3' untranslated region of mRNA encoded by LOC283050, corresponding to a target binding site such as BINDING SITE I, BINDING SITE II or BINDING SITE III of FIG. 8. Table 4 illustrates the complementarity of the nucleotide sequences of LOC283050 BINDING SITE, designated SEQ ID:10331, to the nucleotide sequence of GAM2033 RNA, herein designated GAM RNA, also designated SEQ ID:305.

Another function of GAM2033 is therefore inhibition of LOC283050 (Accession XP_210872.1). Accordingly, utilities of GAM2033 include diagnosis, prevention and treatment of diseases and clinical conditions associated with LOC283050.

LOC283386 (Accession XP_208656.1) is another GAM2033 target gene, herein designated TARGET GENE. LOC283386 BINDING SITE is a target binding site found in the 3' untranslated region of mRNA encoded by LOC283386, corresponding to a target binding site such as BINDING SITE I, BINDING SITE II or BINDING SITE III of FIG. 8. Table 4 illustrates the complementarity of the nucleotide sequences of LOC283386 BINDING SITE, designated SEQ ID:6632, to the nucleotide sequence of GAM2033 RNA, herein designated GAM RNA, also designated SEQ ID:305.

Another function of GAM2033 is therefore inhibition of LOC283386 (Accession XP_208656.1). Accordingly, utilities of GAM2033 include diagnosis, prevention and treatment of diseases and clinical conditions associated with LOC283386.

LOC283403 (Accession XP_211028.1) is another GAM2033 target gene, herein designated TARGET GENE. LOC283403 BINDING SITE is a target binding site found in the 5' untranslated region of mRNA encoded by LOC283403, corresponding to a target binding site such as BINDING SITE I, BINDING SITE II or BINDING SITE III of FIG. 8. Table 4 illustrates the complementarity of the nucleotide sequences of LOC283403 BINDING SITE, designated SEQ ID:5737, to the nucleotide sequence of GAM2033 RNA, herein designated GAM RNA, also designated SEQ ID:305.

Another function of GAM2033 is therefore inhibition of LOC283403 (Accession XP_211028.1). Accordingly, utilities of GAM2033 include diagnosis, prevention and treatment of diseases and clinical conditions associated with LOC283403.

LOC283452 (Accession XP_208679.1) is another GAM2033 target gene, herein designated TARGET GENE. LOC283452 BINDING SITE is a target binding site found in the 3' untranslated region of mRNA encoded by LOC283452, corresponding to a target binding site such as BINDING SITE I, BINDING SITE II or BINDING SITE III of FIG. 8. Table 4 illustrates the complementarity of the nucleotide sequences of LOC283452 BINDING SITE, designated SEQ ID:10804, to the nucleotide sequence of GAM2033 RNA, herein designated GAM RNA, also designated SEQ ID:305.

Another function of GAM2033 is therefore inhibition of LOC283452 (Accession XP_208679.1). Accordingly, utilities of GAM2033 include diagnosis, prevention and treatment of diseases and clinical conditions associated with LOC283452.

LOC283588 (Accession NP_787093.1) is another GAM2033 target gene, herein designated TARGET GENE. LOC283588 BINDING SITE is a target binding site found in the 3' untranslated region of mRNA encoded by LOC283588, corresponding to a target binding site such as BINDING SITE I, BINDING SITE II or BINDING SITE III of FIG. 8. Table 4 illustrates the complementarity of the nucleotide sequences of LOC283588 BINDING SITE, designated SEQ ID:1881, to the nucleotide sequence of GAM2033 RNA, herein designated GAM RNA, also designated SEQ ID:305.

Another function of GAM2033 is therefore inhibition of LOC283588 (Accession NP_787093.1). Accordingly, utilities of GAM2033 include diagnosis, prevention and treatment of diseases and clinical conditions associated with LOC283588.

LOC283818 (Accession XP_211218.1) is another GAM2033 target gene, herein designated TARGET GENE. LOC283818 BINDING SITE is a target binding site found in the 5' untranslated region of mRNA encoded by LOC283818, corresponding to a target binding site such as BINDING SITE I, BINDING SITE II or BINDING SITE III of FIG. 8. Table 4 illustrates the complementarity of the nucleotide sequences of LOC283818 BINDING SITE, designated SEQ ID:11219, to the nucleotide sequence of GAM2033 RNA, herein designated GAM RNA, also designated SEQ ID:305.

Another function of GAM2033 is therefore inhibition of LOC283818 (Accession XP_211218.1). Accordingly, utilities of GAM2033 include diagnosis, prevention and treatment of diseases and clinical conditions associated with LOC283818.

LOC284117 (Accession XP_209024.1) is another GAM2033 target gene, herein designated TARGET GENE. LOC284117 BINDING SITE is a target binding site found in the 5' untranslated region of mRNA encoded by LOC284117, corresponding to a target binding site such as BINDING SITE I, BINDING SITE II or BINDING SITE III of FIG. 8. Table 4 illustrates the complementarity of the nucleotide sequences of LOC284117 BINDING SITE, designated SEQ ID:3307, to the nucleotide sequence of GAM2033 RNA, herein designated GAM RNA, also designated SEQ ID:305.

Another function of GAM2033 is therefore inhibition of LOC284117 (Accession XP_209024.1). Accordingly, utilities of GAM2033 include diagnosis, prevention and treatment of diseases and clinical conditions associated with LOC284117.

LOC284515 (Accession XP_208210.1) is another GAM2033 target gene, herein designated TARGET GENE. LOC284515 BINDING SITE is a target binding site found in the 3' untranslated region of mRNA encoded by LOC284515, corresponding to a target binding site such as BINDING SITE I, BINDING SITE II or BINDING SITE III of FIG. 8. Table 4 illustrates the complementarity of the nucleotide sequences of LOC284515 BINDING SITE, designated SEQ ID:13346, to the nucleotide sequence of GAM2033 RNA, herein designated GAM RNA, also designated SEQ ID:305.

Another function of GAM2033 is therefore inhibition of LOC284515 (Accession XP_208210.1). Accordingly, utilities of GAM2033 include diagnosis, prevention and treatment of diseases and clinical conditions associated with LOC284515.

LOC285123 (Accession XP_211773.1) is another GAM2033 target gene, herein designated TARGET GENE. LOC285123 BINDING SITE is a target binding site found in the 3' untranslated region of mRNA encoded by LOC285123, corresponding to a target binding site such as BINDING SITE I, BINDING SITE II or BINDING SITE III of FIG. 8. Table 4 illustrates the complementarity of the nucleotide sequences of LOC285123 BINDING SITE, designated SEQ ID:18981, to the nucleotide sequence of GAM2033 RNA, herein designated GAM RNA, also designated SEQ ID:305.

Another function of GAM2033 is therefore inhibition of LOC285123 (Accession XP_211773.1). Accordingly, utilities of GAM2033 include diagnosis, prevention and treatment of diseases and clinical conditions associated with LOC285123.

LOC285399 (Accession XP_211880.1) is another GAM2033 target gene, herein designated TARGET GENE. LOC285399 BINDING SITE is a target binding site found in the 3' untranslated region of mRNA encoded by LOC285399, corresponding to a target binding site such as BINDING SITE I, BINDING SITE II or BINDING SITE III of FIG. 8. Table 4 illustrates the complementarity of the nucleotide sequences of LOC285399 BINDING SITE, designated SEQ ID:9690, to the nucleotide sequence of GAM2033 RNA, herein designated GAM RNA, also designated SEQ ID:305.

Another function of GAM2033 is therefore inhibition of LOC285399 (Accession XP_211880.1). Accordingly, utilities of GAM2033 include diagnosis, prevention and treatment of diseases and clinical conditions associated with LOC285399.

LOC285735 (Accession XP_212002.1) is another GAM2033 target gene, herein designated TARGET GENE. LOC285735 BINDING SITE is a target binding site found in the 5' untranslated region of mRNA encoded by LOC285735, corresponding to a target binding site such as BINDING SITE I, BINDING SITE II or BINDING SITE III of FIG. 8. Table 4 illustrates the complementarity of the nucleotide sequences of LOC285735 BINDING SITE, designated SEQ ID:11051, to the nucleotide sequence of GAM2033 RNA, herein designated GAM RNA, also designated SEQ ID:305.

Another function of GAM2033 is therefore inhibition of LOC285735 (Accession XP_212002.1). Accordingly, utilities of GAM2033 include diagnosis, prevention and treatment of diseases and clinical conditions associated with LOC285735.

LOC285805 (Accession XP_212027.1) is another GAM2033 target gene, herein designated TARGET GENE. LOC285805 BINDING SITE is a target binding site found in the 5' untranslated region of mRNA encoded by LOC285805, corresponding to a target binding site such as BINDING SITE I, BINDING SITE II or BINDING SITE III of FIG. 8. Table 4 illustrates the complementarity of the nucleotide sequences of LOC285805 BINDING SITE, designated SEQ ID:16704, to the nucleotide sequence of GAM2033 RNA, herein designated GAM RNA, also designated SEQ ID:305.

Another function of GAM2033 is therefore inhibition of LOC285805 (Accession XP_212027.1). Accordingly, utilities of GAM2033 include diagnosis, prevention and treatment of diseases and clinical conditions associated with LOC285805.

LOC285950 (Accession XP_212089.1) is another GAM2033 target gene, herein designated TARGET GENE. LOC285950 BINDING SITE is a target binding site found in the 5' untranslated region of mRNA encoded by LOC285950, corresponding to a target binding site such as BINDING SITE I, BINDING SITE II or BINDING SITE III of FIG. 8. Table 4 illustrates the complementarity of the nucleotide sequences of LOC285950 BINDING SITE, designated SEQ ID:19398, to the nucleotide sequence of GAM2033 RNA, herein designated GAM RNA, also designated SEQ ID:305.

Another function of GAM2033 is therefore inhibition of LOC285950 (Accession XP_212089.1). Accordingly, utilities of GAM2033 include diagnosis, prevention and treatment of diseases and clinical conditions associated with LOC285950.

LOC286184 (Accession XP_212216.1) is another GAM2033 target gene, herein designated TARGET GENE. LOC286184 BINDING SITE is a target binding site found in the 3' untranslated region of mRNA encoded by LOC286184, corresponding to a target binding site such as BINDING SITE I, BINDING SITE II or BINDING SITE III of FIG. 8. Table 4 illustrates the complementarity of the nucleotide sequences of LOC286184 BINDING SITE, designated SEQ ID:12741, to the nucleotide sequence of GAM2033 RNA, herein designated GAM RNA, also designated SEQ ID:305.

Another function of GAM2033 is therefore inhibition of LOC286184 (Accession XP_212216.1). Accordingly, utilities of GAM2033 include diagnosis, prevention and treatment of diseases and clinical conditions associated with LOC286184.

LOC286197 (Accession XP_209940.1) is another GAM2033 target gene, herein designated TARGET GENE. LOC286197 BINDING SITE is a target binding site found in the 3' untranslated region of mRNA encoded by LOC286197, corresponding to a target binding site such as BINDING SITE I, BINDING SITE II or BINDING SITE III of FIG. 8. Table 4 illustrates the complementarity of the nucleotide sequences of LOC286197 BINDING SITE, designated SEQ ID:17366, to the nucleotide sequence of GAM2033 RNA, herein designated GAM RNA, also designated SEQ ID:305.

Another function of GAM2033 is therefore inhibition of LOC286197 (Accession XP_209940.1). Accordingly, utilities of GAM2033 include diagnosis, prevention and treatment of diseases and clinical conditions associated with LOC286197.

LOC286211 (Accession XP_209949.1) is another GAM2033 target gene, herein designated TARGET GENE. LOC286211 BINDING SITE is a target binding site found in the 3' untranslated region of mRNA encoded by LOC286211, corresponding to a target binding site such as BINDING SITE I, BINDING SITE II or BINDING SITE III of FIG. 8. Table 4 illustrates the complementarity of the nucleotide sequences of LOC286211 BINDING SITE, designated SEQ ID:9029, to the nucleotide sequence of GAM2033 RNA, herein designated GAM RNA, also designated SEQ ID:305.

Another function of GAM2033 is therefore inhibition of LOC286211 (Accession XP_209949.1). Accordingly, utilities of GAM2033 include diagnosis, prevention and treatment of diseases and clinical conditions associated with LOC286211.

LOC286438 (Accession XP_208421.1) is another GAM2033 target gene, herein designated TARGET GENE. LOC286438 BINDING SITE is a target binding site found in the 3' untranslated region of mRNA encoded by LOC286438, corresponding to a target binding site such as BINDING SITE I, BINDING SITE II or BINDING SITE III of FIG. 8. Table 4 illustrates the complementarity of the nucleotide sequences of LOC286438 BINDING SITE, designated SEQ ID:14291, to the nucleotide sequence of GAM2033 RNA, herein designated GAM RNA, also designated SEQ ID:305.

Another function of GAM2033 is therefore inhibition of LOC286438 (Accession XP_208421.1). Accordingly, utilities of GAM2033 include diagnosis, prevention and treatment of diseases and clinical conditions associated with LOC286438.

LOC339212 (Accession XP_290271.2) is another GAM2033 target gene, herein designated TARGET GENE. LOC339212 BINDING SITE is a target binding site found in the 3' untranslated region of mRNA encoded by LOC339212, corresponding to a target binding site such as BINDING SITE I, BINDING SITE II or BINDING SITE III of FIG. 8. Table 4 illustrates the complementarity of the nucleotide sequences of LOC339212 BINDING SITE, designated SEQ ID:19779, to the nucleotide sequence of GAM2033 RNA, herein designated GAM RNA, also designated SEQ ID:305.

Another function of GAM2033 is therefore inhibition of LOC339212 (Accession XP_290271.2). Accordingly, utilities of GAM2033 include diagnosis, prevention and treatment of diseases and clinical conditions associated with LOC339212.

LOC339414 (Accession XP_170914.2) is another GAM2033 target gene, herein designated TARGET GENE. LOC339414 BINDING SITE is a target binding site found in the 3' untranslated region of mRNA encoded by LOC339414, corresponding to a target binding site such as BINDING SITE I, BINDING SITE II or BINDING SITE III of FIG. 8. Table 4 illustrates the complementarity of the nucleotide sequences of LOC339414 BINDING SITE, designated SEQ ID:16199, to the nucleotide sequence of GAM2033 RNA, herein designated GAM RNA, also designated SEQ ID:305.

Another function of GAM2033 is therefore inhibition of LOC339414 (Accession XP_170914.2). Accordingly, utilities of GAM2033 include diagnosis, prevention and treatment of diseases and clinical conditions associated with LOC339414.

LOC339846 (Accession XP_295084.1) is another GAM2033 target gene, herein designated TARGET GENE. LOC339846 BINDING SITE is a target binding site found in the 3' untranslated region of mRNA encoded by LOC339846, corresponding to a target binding site such as BINDING SITE I, BINDING SITE II or BINDING SITE III of FIG. 8. Table 4 illustrates the complementarity of the nucleotide sequences of LOC339846 BINDING SITE, designated SEQ ID:1411, to the nucleotide sequence of GAM2033 RNA, herein designated GAM RNA, also designated SEQ ID:305.

Another function of GAM2033 is therefore inhibition of LOC339846 (Accession XP_295084.1). Accordingly, utilities of GAM2033 include diagnosis, prevention and treatment of diseases and clinical conditions associated with LOC339846.

LOC339865 (Accession XP_295089.1) is another GAM2033 target gene, herein designated TARGET GENE. LOC339865 BINDING SITE is a target binding site found in the 5' untranslated region of mRNA encoded by LOC339865, corresponding to a target binding site such as BINDING SITE I, BINDING SITE II or BINDING SITE III of FIG. 8. Table 4 illustrates the complementarity of the nucleotide sequences of LOC339865 BINDING SITE, designated SEQ ID:3018, to the nucleotide sequence of GAM2033 RNA, herein designated GAM RNA, also designated SEQ ID:305.

Another function of GAM2033 is therefore inhibition of LOC339865 (Accession XP_295089.1). Accordingly, utilities of GAM2033 include diagnosis, prevention and treatment of diseases and clinical conditions associated with LOC339865.

LOC339894 (Accession XP_295095.1) is another GAM2033 target gene, herein designated TARGET GENE. LOC339894 BINDING SITE is a target binding site found in the 5' untranslated region of mRNA encoded by LOC339894, corresponding to a target binding site such as BINDING SITE I, BINDING SITE II or BINDING SITE III of FIG. 8. Table 4 illustrates the complementarity of the nucleotide sequences of LOC339894 BINDING SITE, designated SEQ ID:3796, to the nucleotide sequence of GAM2033 RNA, herein designated GAM RNA, also designated SEQ ID:305.

Another function of GAM2033 is therefore inhibition of LOC339894 (Accession XP_295095.1). Accordingly, utilities of GAM2033 include diagnosis, prevention and treatment of diseases and clinical conditions associated with LOC339894.

LOC339975 (Accession XP_295115.1) is another GAM2033 target gene, herein designated TARGET GENE. LOC339975 BINDING SITE is a target binding site found in the 5' untranslated region of mRNA encoded by LOC339975, corresponding to a target binding site such as BINDING SITE I, BINDING SITE II or BINDING SITE III of FIG. 8. Table 4 illustrates the complementarity of the nucleotide sequences of LOC339975 BINDING SITE, designated SEQ ID:1577, to the nucleotide sequence of GAM2033 RNA, herein designated GAM RNA, also designated SEQ ID:305.

Another function of GAM2033 is therefore inhibition of LOC339975 (Accession XP_295115.1). Accordingly, utilities of GAM2033 include diagnosis, prevention and treatment of diseases and clinical conditions associated with LOC339975.

LOC348259 (Accession XP_302702.1) is another GAM2033 target gene, herein designated TARGET GENE. LOC348259 BINDING SITE is a target binding site found in the 5' untranslated region of mRNA encoded by LOC348259, corresponding to a target binding site such as BINDING SITE I, BINDING SITE II or BINDING SITE III of FIG. 8. Table 4 illustrates the complementarity of the nucleotide sequences of LOC348259 BINDING SITE, designated SEQ ID:562, to the nucleotide sequence of GAM2033 RNA, herein designated GAM RNA, also designated SEQ ID:305.

Another function of GAM2033 is therefore inhibition of LOC348259 (Accession XP_302702.1). Accordingly, utilities of GAM2033 include diagnosis, prevention and treatment of diseases and clinical conditions associated with LOC348259.

LOC348442 (Accession XP_057659.1) is another GAM2033 target gene, herein designated TARGET GENE. LOC348442 BINDING SITE is a target binding site found in the 3' untranslated region of mRNA encoded by LOC348442, corresponding to a target binding site such as BINDING SITE I, BINDING SITE II or BINDING SITE III of FIG. 8. Table 4 illustrates the complementarity of the nucleotide sequences of LOC348442 BINDING SITE, designated SEQ ID:878, to the nucleotide sequence of GAM2033 RNA, herein designated GAM RNA, also designated SEQ ID:305.

Another function of GAM2033 is therefore inhibition of LOC348442 (Accession XP_057659.1). Accordingly, utilities of GAM2033 include diagnosis, prevention and treatment of diseases and clinical conditions associated with LOC348442.

LOC349059 (Accession XP_302946.1) is another GAM2033 target gene, herein designated TARGET GENE. LOC349059 BINDING SITE is a target binding site found in the 3' untranslated region of mRNA encoded by LOC349059, corresponding to a target binding site such as BINDING SITE I, BINDING SITE II or BINDING SITE III of FIG. 8. Table 4 illustrates the complementarity of the nucleotide sequences of LOC349059 BINDING SITE, designated SEQ ID:16834, to the nucleotide sequence of GAM2033 RNA, herein designated GAM RNA, also designated SEQ ID:305.

Another function of GAM2033 is therefore inhibition of LOC349059 (Accession XP_302946.1). Accordingly, utilities of GAM2033 include diagnosis, prevention and treatment of diseases and clinical conditions associated with LOC349059.

LOC83468 (Accession NP_112592.1) is another GAM2033 target gene, herein designated TARGET GENE. LOC83468 BINDING SITE is a target binding site found in the 5' untranslated region of mRNA encoded by LOC83468, corresponding to a target binding site such as BINDING SITE I, BINDING SITE II or BINDING SITE III of FIG. 8. Table 4 illustrates the complementarity of the nucleotide sequences of LOC83468 BINDING SITE, designated SEQ ID:17323, to the nucleotide sequence of GAM2033 RNA, herein designated GAM RNA, also designated SEQ ID:305.

Another function of GAM2033 is therefore inhibition of LOC83468 (Accession NP_112592.1). Accordingly, utilities of GAM2033 include diagnosis, prevention and treatment of diseases and clinical conditions associated with LOC83468.

LOC84549 (Accession NP_115898.2) is another GAM2033 target gene, herein designated TARGET GENE. LOC84549 BINDING SITE is a target binding site found in the 3' untranslated region of mRNA encoded by LOC84549, corresponding to a target binding site such as BINDING SITE I, BINDING SITE II or BINDING SITE III of FIG. 8. Table 4 illustrates the complementarity of the nucleotide sequences of LOC84549 BINDING SITE, designated SEQ ID:19084, to the nucleotide sequence of GAM2033 RNA, herein designated GAM RNA, also designated SEQ ID:305.

Another function of GAM2033 is therefore inhibition of LOC84549 (Accession NP_115898.2). Accordingly, utilities of GAM2033 include diagnosis, prevention and treatment of diseases and clinical conditions associated with LOC84549.

LOC90110 (Accession XP_029046.1) is another GAM2033 target gene, herein designated TARGET GENE. LOC90110 BINDING SITE is a target binding site found in the 5' untranslated region of mRNA encoded by LOC90110, corresponding to a target binding site such as BINDING SITE I, BINDING SITE II or BINDING SITE III of FIG. 8. Table 4 illustrates the complementarity of the nucleotide sequences of LOC90110 BINDING SITE, designated SEQ ID:19624, to the nucleotide sequence of GAM2033 RNA, herein designated GAM RNA, also designated SEQ ID:305.

Another function of GAM2033 is therefore inhibition of LOC90110 (Accession XP_029046.1). Accordingly, utilities of GAM2033 include diagnosis, prevention and treatment of diseases and clinical conditions associated with LOC90110.

LOC91565 (Accession XP_039231.1) is another GAM2033 target gene, herein designated TARGET GENE. LOC91565 BINDING SITE is a target binding site found in the 3' untranslated region of mRNA encoded by LOC91565, corresponding to a target binding site such as BINDING SITE I, BINDING SITE II or BINDING SITE III of FIG. 8. Table 4 illustrates the complementarity of the nucleotide sequences of LOC91565 BINDING SITE, designated SEQ ID:12984, to the nucleotide sequence of GAM2033 RNA, herein designated GAM RNA, also designated SEQ ID:305.

Another function of GAM2033 is therefore inhibition of LOC91565 (Accession XP_039231.1). Accordingly, utilities of GAM2033 include diagnosis, prevention and treatment of diseases and clinical conditions associated with LOC91565.

LOC92235 (Accession XP_043739.2) is another GAM2033 target gene, herein designated TARGET GENE. LOC92235 BINDING SITE is a target binding site found in the 3' untranslated region of mRNA encoded by LOC92235, corresponding to a target binding site such as BINDING SITE I, BINDING SITE II or BINDING SITE III of FIG. 8. Table 4 illustrates the complementarity of the nucleotide sequences of LOC92235 BINDING SITE, designated SEQ ID:11714, to the nucleotide sequence of GAM2033 RNA, herein designated GAM RNA, also designated SEQ ID:305.

Another function of GAM2033 is therefore inhibition of LOC92235 (Accession XP_043739.2). Accordingly, utilities of GAM2033 include diagnosis, prevention and treatment of diseases and clinical conditions associated with LOC92235.

Loss of heterozygosity, 11, chromosomal region 2, gene a (LOH11CR2A, Accession NP_055437.1) is another GAM2033 target gene, herein designated TARGET GENE. LOH11CR2A BINDING SITE is a target binding site found in the 3' untranslated region of mRNA encoded by LOH11CR2A, corresponding to a target binding site such as BINDING SITE I, BINDING SITE II or BINDING SITE III of FIG. 8. Table 4 illustrates the complementarity of the nucleotide sequences of LOH11CR2A BINDING SITE, designated SEQ ID:9708, to the nucleotide sequence of GAM2033 RNA, herein designated GAM RNA, also designated SEQ ID:305.

Another function of GAM2033 is therefore inhibition of Loss of heterozygosity, 11, chromosomal region 2, gene a (LOH11CR2A, Accession NP_055437.1). Accordingly, utilities of GAM2033 include diagnosis, prevention and treatment of diseases and clinical conditions associated with LOH11CR2A.

LRP15 (Accession NP_443185.1) is another GAM2033 target gene, herein designated TARGET GENE. LRP15 BINDING SITE is a target binding site found in the 5' untranslated region of mRNA encoded by LRP15, corresponding to a target binding site such as BINDING SITE I, BINDING SITE II or BINDING SITE III of FIG. 8. Table 4 illustrates the complementarity of the nucleotide sequences of LRP15 BINDING SITE, designated SEQ ID:18470, to the nucleotide sequence of GAM2033 RNA, herein designated GAM RNA, also designated SEQ ID:305.

Another function of GAM2033 is therefore inhibition of LRP15 (Accession NP_443185.1). Accordingly, utilities of GAM2033 include diagnosis, prevention and treatment of diseases and clinical conditions associated with LRP15.

MGC10765 (Accession NP_077321.1) is another GAM2033 target gene, herein designated TARGET GENE. MGC10765 BINDING SITE is a target binding site found in the 3' untranslated region of mRNA encoded by MGC10765, corresponding to a target binding site such as BINDING SITE I, BINDING SITE II or BINDING SITE III of FIG. 8. Table 4 illustrates the complementarity of the nucleotide sequences of MGC10765 BINDING SITE, designated SEQ ID:4067, to the nucleotide sequence of GAM2033 RNA, herein designated GAM RNA, also designated SEQ ID:305.

Another function of GAM2033 is therefore inhibition of MGC10765 (Accession NP_077321.1). Accordingly, utilities of GAM2033 include diagnosis, prevention and treatment of diseases and clinical conditions associated with MGC10765.

MGC13017 (Accession NP_542387.1) is another GAM2033 target gene, herein designated TARGET GENE. MGC13017 BINDING SITE is a target binding site found in the 3' untranslated region of mRNA encoded by MGC13017, corresponding to a target binding site such as BINDING SITE I, BINDING SITE II or BINDING SITE III of FIG. 8. Table 4 illustrates the complementarity of the nucleotide sequences of MGC13017 BINDING SITE, designated SEQ ID:878, to the nucleotide sequence of GAM2033 RNA, herein designated GAM RNA, also designated SEQ ID:305.

Another function of GAM2033 is therefore inhibition of MGC13017 (Accession NP_542387.1). Accordingly, utilities of GAM2033 include diagnosis, prevention and treatment of diseases and clinical conditions associated with MGC13017.

MGC39662 (Accession NP_689607.1) is another GAM2033 target gene, herein designated TARGET GENE. MGC39662 BINDING SITE is a target binding site found in the 5' untranslated region of mRNA encoded by MGC39662, corresponding to a target binding site such as BINDING SITE I, BINDING SITE II or BINDING SITE III of FIG. 8. Table 4 illustrates the complementarity of the nucleotide sequences of MGC39662 BINDING SITE, designated SEQ ID:12535, to the nucleotide sequence of GAM2033 RNA, herein designated GAM RNA, also designated SEQ ID:305.

Another function of GAM2033 is therefore inhibition of MGC39662 (Accession NP_689607.1). Accordingly, utilities of GAM2033 include diagnosis, prevention and treatment of diseases and clinical conditions associated with MGC39662.

MGC46336 (Accession XP_290712.1) is another GAM2033 target gene, herein designated TARGET GENE. MGC46336 BINDING SITE is a target binding site found in the 5' untranslated region of mRNA encoded by MGC46336, corresponding to a target binding site such as BINDING SITE I, BINDING SITE II or BINDING SITE III of FIG. 8. Table 4 illustrates the complementarity of the nucleotide sequences of MGC46336 BINDING SITE, designated SEQ ID:20034, to the nucleotide sequence of GAM2033 RNA, herein designated GAM RNA, also designated SEQ ID:305.

Another function of GAM2033 is therefore inhibition of MGC46336 (Accession XP_290712.1). Accordingly, utilities of GAM2033 include diagnosis, prevention and treatment of diseases and clinical conditions associated with MGC46336.

MGC46680 (Accession NP_776169.1) is another GAM2033 target gene, herein designated TARGET GENE. MGC46680 BINDING SITE is a target binding site found in the 3' untranslated region of mRNA encoded by MGC46680, corresponding to a target binding site such as BINDING SITE I, BINDING SITE II or BINDING SITE III of FIG. 8. Table 4 illustrates the complementarity of the nucleotide sequences of MGC46680 BINDING SITE, designated SEQ ID:3484, to the nucleotide sequence of GAM2033 RNA, herein designated GAM RNA, also designated SEQ ID:305.

Another function of GAM2033 is therefore inhibition of MGC46680 (Accession NP_776169.1). Accordingly, utilities of GAM2033 include diagnosis, prevention and treatment of diseases and clinical conditions associated with MGC46680.

Mov10, moloney leukemia virus 10, homolog (mouse) (MOV10, Accession NP_066014.1) is another GAM2033 target gene, herein designated TARGET GENE. MOV10 BINDING SITE is a target binding site found in the 3' untranslated region of mRNA encoded by MOV10, corresponding to a target binding site such as BINDING SITE I, BINDING SITE II or BINDING SITE III of FIG. 8. Table 4 illustrates the complementarity of the nucleotide sequences of MOV10 BINDING SITE, designated SEQ ID:13490, to the nucleotide sequence of GAM2033 RNA, herein designated GAM RNA, also designated SEQ ID:305.

Another function of GAM2033 is therefore inhibition of Mov10, moloney leukemia virus 10, homolog (mouse) (MOV10, Accession NP_066014.1). Accordingly, utilities of GAM2033 include diagnosis, prevention and treatment of diseases and clinical conditions associated with MOV10.

Mitochondrial ribosomal protein s15 (MRPS15, Accession NP_112570.2) is another GAM2033 target gene, herein designated TARGET GENE. MRPS15 BINDING SITE is a target binding site found in the 5' untranslated region of mRNA encoded by MRPS15, corresponding to a target binding site such as BINDING SITE I, BINDING SITE II or BINDING SITE III of FIG. 8. Table 4 illustrates the complementarity of the nucleotide sequences of MRPS15 BINDING SITE, designated SEQ ID:14750, to the nucleotide sequence of GAM2033 RNA, herein designated GAM RNA, also designated SEQ ID:305.

Another function of GAM2033 is therefore inhibition of Mitochondrial ribosomal protein s15 (MRPS15, Accession NP_112570.2). Accordingly, utilities of GAM2033 include diagnosis, prevention and treatment of diseases and clinical conditions associated with MRPS15.

N-deacetylase/n-sulfotransferase (heparan glucosaminyl) 2 (NDST2, Accession NP_003626.1) is another GAM2033 target gene, herein designated TARGET GENE. NDST2 BINDING SITE is a target binding site found in the 3' untranslated region of mRNA encoded by NDST2, corresponding to a target binding site such as BINDING SITE I, BINDING SITE II or BINDING SITE III of FIG. 8. Table 4 illustrates the complementarity of the nucleotide sequences of NDST2 BINDING SITE, designated SEQ ID:17608, to the nucleotide sequence of GAM2033 RNA, herein designated GAM RNA, also designated SEQ ID:305.

Another function of GAM2033 is therefore inhibition of N-deacetylase/n-sulfotransferase (heparan glucosaminyl) 2 (NDST2, Accession NP_003626.1), a gene which catalyses the n-sulfation and n-deacetylation of glucosamine of the glycosaminoglycan in heparin sulfate. Accordingly, utilities of GAM2033 include diagnosis, prevention and treatment of diseases and clinical conditions associated with NDST2.

The function of NDST2 and its association with various diseases and clinical conditions, has been established by previous studies, as described hereinabove with reference to GAM282.2. Nima (never in mitosis gene a)-related kinase 3 (NEK3, Accession NP_002489.1) is another GAM2033 target gene, herein designated TARGET GENE. NEK3 BINDING SITE is a target binding site found in the 3' untranslated region of multiple transcripts of mRNA encoded by NEK3, corresponding to a target binding site such as BINDING SITE I, BINDING SITE II or BINDING SITE III of FIG. 8. Table 4 illustrates the complementarity of the nucleotide sequences of NEK3 BINDING SITE, designated SEQ ID:3534, to the nucleotide sequence of GAM2033 RNA, herein designated GAM RNA, also designated SEQ ID:305.

Another function of GAM2033 is therefore inhibition of Nima (never in mitosis gene a)-related kinase 3 (NEK3, Accession NP_002489.1) . Accordingly, utilities of GAM2033 include diagnosis, prevention and treatment of diseases and clinical conditions associated with NEK3.

Nima (never in mitosis gene a)-related kinase 3 (NEK3, Accession NP_689933.1) is another GAM2033 target gene, herein designated TARGET GENE. NEK3 BINDING SITE is a target binding site found in the 3' untranslated region of multiple transcripts of mRNA encoded by NEK3, corresponding to a target binding site such as BINDING SITE I, BINDING SITE II or BINDING SITE III of FIG. 8. Table 4 illustrates the complementarity of the nucleotide sequences of NEK3 BINDING SITE, designated SEQ ID:3534, to the nucleotide sequence of GAM2033 RNA, herein designated GAM RNA, also designated SEQ ID:305.

Another function of GAM2033 is therefore inhibition of Nima (never in mitosis gene a)-related kinase 3 (NEK3, Accession NP_689933.1) . Accordingly, utilities of GAM2033 include diagnosis, prevention and treatment of diseases and clinical conditions associated with NEK3.

Nescient helix loop helix 1 (NHLH1, Accession NP_005589.1) is another GAM2033 target gene, herein designated TARGET GENE. NHLH1 BINDING SITE is a target binding site found in the 3' untranslated region of mRNA encoded by NHLH1, corresponding to a target binding site such as BINDING SITE I, BINDING SITE II or BINDING SITE III of FIG. 8. Table 4 illustrates the complementarity of the nucleotide sequences of NHLH1 BINDING SITE, designated SEQ ID:2657, to the nucleotide sequence of GAM2033 RNA, herein designated GAM RNA, also designated SEQ ID:305.

Another function of GAM2033 is therefore inhibition of Nescient helix loop helix 1 (NHLH1, Accession NP_005589.1), a gene which may have a role in development of the nervous system. Accordingly, utilities of GAM2033 include diagnosis, prevention and treatment of diseases and clinical conditions associated with NHLH1.

The function of NHLH1 and its association with various diseases and clinical conditions, has been established by previous studies, as described hereinabove with reference to GAM354.1. NYD-SP15 (Accession NP_112173.1) is another GAM2033 target gene, herein designated TARGET GENE. NYD-SP15 BINDING SITE is a target binding site found in the 3' untranslated region of mRNA encoded by NYD-SP15, corresponding to a target binding site such as BINDING SITE I, BINDING SITE II or BINDING SITE III of FIG. 8. Table 4 illustrates the complementarity of the nucleotide sequences of NYD-SP15 BINDING SITE, designated SEQ ID:12731, to the nucleotide sequence of GAM2033 RNA, herein designated GAM RNA, also designated SEQ ID:305.

Another function of GAM2033 is therefore inhibition of NYD-SP15 (Accession NP_112173.1). Accordingly, utilities of GAM2033 include diagnosis, prevention and treatment of diseases and clinical conditions associated with NYD-SP15.

Opiate receptor-like 1 (OPRL1, Accession NP_000904.1) is another GAM2033 target gene, herein designated TARGET GENE. OPRL1 BINDING SITE is a target binding site found in the 5' untranslated region of mRNA encoded by OPRL1, corresponding to a target binding site such as BINDING SITE I, BINDING SITE II or BINDING SITE III of FIG. 8. Table 4 illustrates the complementarity of the nucleotide sequences of OPRL1 BINDING SITE, designated SEQ ID:6428, to the nucleotide sequence of GAM2033 RNA, herein designated GAM RNA, also designated SEQ ID:305.

Another function of GAM2033 is therefore inhibition of Opiate receptor-like 1 (OPRL1, Accession NP_000904.1). Accordingly, utilities of GAM2033 include diagnosis, prevention and treatment of diseases and clinical conditions associated with OPRL1.

OS4 (Accession NP_005721.2) is another GAM2033 target gene, herein designated TARGET GENE. OS4 BINDING SITE is a target binding site found in the 3' untranslated region of mRNA encoded by OS4, corresponding to a target binding site such as BINDING SITE I, BINDING SITE II or BINDING SITE III of FIG. 8. Table 4 illustrates the complementarity of the nucleotide sequences of OS4 BINDING SITE, designated SEQ ID:16829, to the nucleotide sequence of GAM2033 RNA, herein designated GAM RNA, also designated SEQ ID:305.

Another function of GAM2033 is therefore inhibition of OS4 (Accession NP_005721.2). Accordingly, utilities of GAM2033 include diagnosis, prevention and treatment of diseases and clinical conditions associated with OS4.

Pyrimidinergic receptor p2y, g-protein coupled, 6 (P2RY6, Accession NP_004145.1) is another GAM2033 target gene, herein designated TARGET GENE. P2RY6 BINDING SITE is a target binding site found in the 3' untranslated region of multiple transcripts of mRNA encoded by P2RY6, corresponding to a target binding site such as BINDING SITE I, BINDING SITE II or BINDING SITE III of FIG. 8. Table 4 illustrates the complementarity of the nucleotide sequences of P2RY6 BINDING SITE, designated SEQ ID:999, to the nucleotide sequence of GAM2033 RNA, herein designated GAM RNA, also designated SEQ ID:305.

Another function of GAM2033 is therefore inhibition of Pyrimidinergic receptor p2y, g-protein coupled, 6 (P2RY6, Accession NP_004145.1), a gene which mediates cellular responses to nucleotides. Accordingly, utilities of GAM2033 include diagnosis, prevention and treatment of diseases and clinical conditions associated with P2RY6.

The function of P2RY6 and its association with various diseases and clinical conditions, has been established by previous studies, as described hereinabove with reference to GAM72.1. Protocadherin 10 (PCDH10, Accession NP_116586.1) is another GAM2033 target gene, herein designated TARGET GENE. PCDH10 BINDING SITE is a target binding site found in the 5' untranslated region of multiple transcripts of mRNA encoded by PCDH10, corresponding to a target binding site such as BINDING SITE I, BINDING SITE II or BINDING SITE III of FIG. 8. Table 4 illustrates the complementarity of the nucleotide sequences of PCDH10 BINDING SITE, designated SEQ ID:12871, to the nucleotide sequence of GAM2033 RNA, herein designated GAM RNA, also designated SEQ ID:305.

Another function of GAM2033 is therefore inhibition of Protocadherin 10 (PCDH10, Accession NP_116586.1). Accordingly, utilities of GAM2033 include diagnosis, prevention and treatment of diseases and clinical conditions associated with PCDH10.

Protocadherin 10 (PCDH10, Accession NP_065866.1) is another GAM2033 target gene, herein designated TARGET GENE. PCDH10 BINDING SITE is a target binding site found in the 5' untranslated region of multiple transcripts of mRNA encoded by PCDH10, corresponding to a target binding site such as BINDING SITE I, BINDING SITE II or BINDING SITE III of FIG. 8. Table 4 illustrates the complementarity of the nucleotide sequences of PCDH10 BINDING SITE, designated SEQ ID:12871, to the nucleotide sequence of GAM2033 RNA, herein designated GAM RNA, also designated SEQ ID:305.

Another function of GAM2033 is therefore inhibition of Protocadherin 10 (PCDH10, Accession NP_065866.1). Accordingly, utilities of GAM2033 include diagnosis, prevention and treatment of diseases and clinical conditions associated with PCDH10.

PJA2 (Accession NP_055634.1) is another GAM2033 target gene, herein designated TARGET GENE. PJA2 BINDING SITE is a target binding site found in the 3' untranslated region of mRNA encoded by PJA2, corresponding to a target binding site such as BINDING SITE I, BINDING SITE II or BINDING SITE III of FIG. 8. Table 4 illustrates the complementarity of the nucleotide sequences of PJA2 BINDING SITE, designated SEQ ID:8114, to the nucleotide sequence of GAM2033 RNA, herein designated GAM RNA, also designated SEQ ID:305.

Another function of GAM2033 is therefore inhibition of PJA2 (Accession NP_055634.1). Accordingly, utilities of GAM2033 include diagnosis, prevention and treatment of diseases and clinical conditions associated with PJA2.

Peripheral myelin protein 2 (PMP2, Accession NP_002668.1) is another GAM2033 target gene, herein designated TARGET GENE. PMP2 BINDING SITE is a target binding site found in the 3' untranslated region of mRNA encoded by PMP2, corresponding to a target binding site such as BINDING SITE I, BINDING SITE II or BINDING SITE III of FIG. 8. Table 4 illustrates the complementarity of the nucleotide sequences of PMP2 BINDING SITE, designated SEQ ID:3068, to the nucleotide sequence of GAM2033 RNA, herein designated GAM RNA, also designated SEQ ID:305.

Another function of GAM2033 is therefore inhibition of Peripheral myelin protein 2 (PMP2, Accession NP_002668.1), a gene which is a lipid transport protein in schwann cells. Accordingly, utilities of GAM2033 include diagnosis, prevention and treatment of diseases and clinical conditions associated with PMP2.

The function of PMP2 and its association with various diseases and clinical conditions, has been established by previous studies, as described hereinabove with reference to GAM402.1. Pou domain, class 2, associating factor 1 (POU2AF1, Accession NP_006226.1) is another GAM2033 target gene, herein designated TARGET GENE. POU2AF1 BINDING SITE is a target binding site found in the 3' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:17878, to the nucleotide sequence of GAM2033 RNA, herein designated GAM RNA, also designated SEQ ID:305.

Another function of GAM2033 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM2033 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. Protein phosphatase 1, regulatory subunit 10 (PPP1R10, Accession NP_002705.2) is another GAM2033 target gene, herein designated TARGET GENE. PPP1R10 BINDING SITE is a target binding site found in the 3' untranslated region of mRNA encoded by PPP1R10, corresponding to a target binding site such as BINDING SITE I, BINDING SITE II or BINDING SITE III of FIG. 8. Table 4 illustrates the complementarity of the nucleotide sequences of PPP1R10 BINDING SITE, designated SEQ ID:17303, to the nucleotide sequence of GAM2033 RNA, herein designated GAM RNA, also designated SEQ ID:305.

Another function of GAM2033 is therefore inhibition of Protein phosphatase 1, regulatory subunit 10 (PPP1R10, Accession NP_002705.2). Accordingly, utilities of GAM2033 include diagnosis, prevention and treatment of diseases and clinical conditions associated with PPP1R10.

Protein phosphatase 1, regulatory (inhibitor) subunit 12b (PPP1R12B, Accession NP_002472.1) is another GAM2033 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:18058, to the nucleotide sequence of GAM2033 RNA, herein designated GAM RNA, also designated SEQ ID:305.

Another function of GAM2033 is therefore inhibition of Protein phosphatase 1, regulatory (inhibitor) subunit 12b (PPP1R12B, Accession NP_002472.1). Accordingly, utilities of GAM2033 include diagnosis, prevention and treatment of diseases and clinical conditions associated with PPP1R12B.

Protein phosphatase 1, regulatory (inhibitor) subunit 12b (PPP1R12B, Accession NP_115288.1) is another GAM2033 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:18058, to the nucleotide sequence of GAM2033 RNA, herein designated GAM RNA, also designated SEQ ID:305.

Another function of GAM2033 is therefore inhibition of Protein phosphatase 1, regulatory (inhibitor) subunit 12b (PPP1R12B, Accession NP_115288.1). Accordingly, utilities of GAM2033 include diagnosis, prevention and treatment of diseases and clinical conditions associated with PPP1R12B.

Rab13, member ras oncogene family (RAB13, Accession NP_002861.1) is another GAM2033 target gene, herein designated TARGET GENE. RAB13 BINDING SITE is a target binding site found in the 3' untranslated region of mRNA encoded by RAB13, corresponding to a target binding site such as BINDING SITE I, BINDING SITE II or BINDING SITE III of FIG. 8. Table 4 illustrates the complementarity of the nucleotide sequences of RAB13 BINDING SITE, designated SEQ ID:5259, to the nucleotide sequence of GAM2033 RNA, herein designated GAM RNA, also designated SEQ ID:305.

Another function of GAM2033 is therefore inhibition of Rab13, member ras oncogene family (RAB13, Accession NP_002861.1), a gene which is a member of the RAB family of small GTPases. Accordingly, utilities of GAM2033 include diagnosis, prevention and treatment of diseases and clinical conditions associated with RAB13.

The function of RAB13 and its association with various diseases and clinical conditions, has been established by previous studies, as described hereinabove with reference to GAM94.1. Rab7, member ras oncogene family-like 1 (RAB7L1, Accession NP_003920.1) is another GAM2033 target gene, herein designated TARGET GENE. RAB7L1 BINDING SITE is a target binding site found in the 3' untranslated region of mRNA encoded by RAB7L1, corresponding to a target binding site such as BINDING SITE I, BINDING SITE II or BINDING SITE III of FIG. 8. Table 4 illustrates the complementarity of the nucleotide sequences of RAB7L1 BINDING SITE, designated SEQ ID:9099, to the nucleotide sequence of GAM2033 RNA, herein designated GAM RNA, also designated SEQ ID:305.

Another function of GAM2033 is therefore inhibition of Rab7, member ras oncogene family-like 1 (RAB7L1, Accession NP_003920.1). Accordingly, utilities of GAM2033 include diagnosis, prevention and treatment of diseases and clinical conditions associated with RAB7L1.

RBT1 (Accession NP_037500.2) is another GAM2033 target gene, herein designated TARGET GENE. RBT1 BINDING SITE is a target binding site found in the 5' untranslated region of mRNA encoded by RBT1, corresponding to a target binding site such as BINDING SITE I, BINDING SITE II or BINDING SITE III of FIG. 8. Table 4 illustrates the complementarity of the nucleotide sequences of RBT1 BINDING SITE, designated SEQ ID:11335, to the nucleotide sequence of GAM2033 RNA, herein designated GAM RNA, also designated SEQ ID:305.

Another function of GAM2033 is therefore inhibition of RBT1 (Accession NP_037500.2). Accordingly, utilities of GAM2033 include diagnosis, prevention and treatment of diseases and clinical conditions associated with RBT1.

Rho-related btb domain containing 2 (RHOBTB2, Accession NP_055993.1) is another GAM2033 target gene, herein designated TARGET GENE. RHOBTB2 BINDING SITE is a target binding site found in the 3' untranslated region of mRNA encoded by RHOBTB2, corresponding to a target binding site such as BINDING SITE I, BINDING SITE II or BINDING SITE III of FIG. 8. Table 4 illustrates the complementarity of the nucleotide sequences of RHOBTB2 BINDING SITE, designated SEQ ID:4604, to the nucleotide sequence of GAM2033 RNA, herein designated GAM RNA, also designated SEQ ID:305.

Another function of GAM2033 is therefore inhibition of Rho-related btb domain containing 2 (RHOBTB2, Accession NP_055993.1). Accordingly, utilities of GAM2033 include diagnosis, prevention and treatment of diseases and clinical conditions associated with RHOBTB2.

Receptor tyrosine kinase-like orphan receptor 1 (ROR1, Accession NP_005003.1) is another GAM2033 target gene, herein designated TARGET GENE. ROR1 BINDING SITE is a target binding site found in the 5' untranslated region of mRNA encoded by ROR1, corresponding to a target binding site such as BINDING SITE I, BINDING SITE II or BINDING SITE III of FIG. 8. Table 4 illustrates the complementarity of the nucleotide sequences of ROR1 BINDING SITE, designated SEQ ID:5888, to the nucleotide sequence of GAM2033 RNA, herein designated GAM RNA, also designated SEQ ID:305.

Another function of GAM2033 is therefore inhibition of Receptor tyrosine kinase-like orphan receptor 1 (ROR1, Accession NP_005003.1), a gene which is of unknown function. Accordingly, utilities of GAM2033 include diagnosis, prevention and treatment of diseases and clinical conditions associated with ROR1.

The function of ROR1 and its association with various diseases and clinical conditions, has been established by previous studies, as described hereinabove with reference to GAM767.2. Reticulon 2 (RTN2, Accession NP_005610.1) is another GAM2033 target gene, herein designated TARGET GENE. RTN2 BINDING SITE is a target binding site found in the 3' untranslated region of mRNA encoded by RTN2, corresponding to a target binding site such as BINDING SITE I, BINDING SITE II or BINDING SITE III of FIG. 8. Table 4 illustrates the complementarity of the nucleotide sequences of RTN2 BINDING SITE, designated SEQ ID:8997, to the nucleotide sequence of GAM2033 RNA, herein designated GAM RNA, also designated SEQ ID:305.

Another function of GAM2033 is therefore inhibition of Reticulon 2 (RTN2, Accession NP_005610.1), a gene which is a member of the reticulon (neuroendocrine-specific, NSP) family. Accordingly, utilities of GAM2033 include diagnosis, prevention and treatment of diseases and clinical conditions associated with RTN2.

The function of RTN2 has been established by previous studies. Roebroek et al. (1998) identified 3 novel homologs of RTN1 (OMIM Ref. No. 600865) in DNA sequence databases. RTN2 sequences were found in a 106-kb genomic region around the ERCC1 (OMIM Ref. No. 126380) locus sequenced by Martin-Gallardo et al. (1992); thus, the RTN2 gene is localized to human chromosome 19q13.3. The gene consists of 11 exons spanning approximately 12 kb. Northern blots of several cell lines showed RTN2 expression as mRNAs of 1.3 and 2.3 kb. RT-PCR analysis demonstrated that these bands are produced by 3 alternatively spliced cDNA variants: RTN2A (545 amino acids), RTN2B (472 amino acids), and RTN2C (205 amino acids). Northern blot analysis of human tissues revealed that the RTN2 gene is expressed in a variety of tissues, with strikingly high expression of the 1.3-kb mRNA in skeletal muscle Full details of the abovementioned studies are described in the following publications, the disclosure of which are hereby incorporated by reference:

Roebroek, A. J. M.; Contreras, B.; Pauli, I. G. L.; Van de Ven, W. J. M.: cDNA cloning, genomic organization, and expression of the human RTN2 gene, a member of a gene family encoding reticulons. Genomics 51:98-106, 1998; and Martin-Gallardo, A.; McCombie, W. R.; Gocayne, J. D.; FitzGerald, M. G.; Wallace, S.; Lee, B. M. B.; Lamerdin, J.; Trapp, S.; Kelley, J. M.; Liu, L.-I.; Dubnick, M.; Johnston-Dow, L. A.; Ke.

Further studies establishing the function and utilities of RTN2 are found in John Hopkins OMIM database record ID 603183, and in cited publications listed in Table 5, which are hereby incorporated by reference. Splicing factor 3b, subunit 1, 155 kda (SF3B1, Accession NP_036565.1) is another GAM2033 target gene, herein designated TARGET GENE. SF3B1 BINDING SITE is a target binding site found in the 3' untranslated region of mRNA encoded by SF3B1, corresponding to a target binding site such as BINDING SITE I, BINDING SITE II or BINDING SITE III of FIG. 8. Table 4 illustrates the complementarity of the nucleotide sequences of SF3B1 BINDING SITE, designated SEQ ID:13074, to the nucleotide sequence of GAM2033 RNA, herein designated GAM RNA, also designated SEQ ID:305.

Another function of GAM2033 is therefore inhibition of Splicing factor 3b, subunit 1, 155 kda (SF3B1, Accession NP_036565.1). Accordingly, utilities of GAM2033 include diagnosis, prevention and treatment of diseases and clinical conditions associated with SF3B1.

Surfactant, pulmonary-associated protein a2 (SFTPA2, Accession NP_008857.1) is another GAM2033 target gene, herein designated TARGET GENE. SFTPA2 BINDING SITE is a target binding site found in the 3' untranslated region of mRNA encoded by SFTPA2, corresponding to a target binding site such as BINDING SITE I, BINDING SITE II or BINDING SITE III of FIG. 8. Table 4 illustrates the complementarity of the nucleotide sequences of SFTPA2 BINDING SITE, designated SEQ ID:11609, to the nucleotide sequence of GAM2033 RNA, herein designated GAM RNA, also designated SEQ ID:305.

Another function of GAM2033 is therefore inhibition of Surfactant, pulmonary-associated protein a2 (SFTPA2, Accession NP_008857.1), a gene which plays a role in innate host defense in the lung. Accordingly, utilities of GAM2033 include diagnosis, prevention and treatment of diseases and clinical conditions associated with SFTPA2.

The function of SFTPA2 and its association with various diseases and clinical conditions, has been established by previous studies, as described hereinabove with reference to GAM240.1. N-sulfoglucosamine sulfohydrolase (sulfamidase) (SGSH, Accession NP_000190.1) is another GAM2033 target gene, herein designated TARGET GENE. SGSH BINDING SITE is a target binding site found in the 3' untranslated region of mRNA encoded by SGSH, corresponding to a target binding site such as BINDING SITE I, BINDING SITE II or BINDING SITE III of FIG. 8. Table 4 illustrates the complementarity of the nucleotide sequences of SGSH BINDING SITE, designated SEQ ID:2077, to the nucleotide sequence of GAM2033 RNA, herein designated GAM RNA, also designated SEQ ID:305.

Another function of GAM2033 is therefore inhibition of N-sulfoglucosamine sulfohydrolase (sulfamidase) (SGSH, Accession NP_000190.1). Accordingly, utilities of GAM2033 include diagnosis, prevention and treatment of diseases and clinical conditions associated with SGSH.

Solute carrier family 26, member 7 (SLC26A7, Accession NP_439897.1) is another GAM2033 target gene, herein designated TARGET GENE. SLC26A7 BINDING SITE1 and SLC26A7 BINDING SITE2 are target binding sites found in untranslated regions of multiple transcripts of mRNA encoded by SLC26A7, corresponding to target binding sites such as BINDING SITE I, BINDING SITE II or BINDING SITE III of FIG. 8. Table 4 illustrates the complementarity of the nucleotide sequences of SLC26A7 BINDING SITE1 and SLC26A7 BINDING SITE2, designated SEQ ID:1641 and SEQ ID:16968 respectively, to the nucleotide sequence of GAM2033 RNA, herein designated GAM RNA, also designated SEQ ID:305.

Another function of GAM2033 is therefore inhibition of Solute carrier family 26, member 7 (SLC26A7, Accession NP_439897.1). Accordingly, utilities of GAM2033 include diagnosis, prevention and treatment of diseases and clinical conditions associated with SLC26A7.

Solute carrier family 2 (facilitated glucose transporter), member 6 (SLC2A6, Accession NP_060055.1) is another GAM2033 target gene, herein designated TARGET GENE. SLC2A6 BINDING SITE is a target binding site found in the 3' untranslated region of mRNA encoded by SLC2A6, corresponding to a target binding site such as BINDING SITE I, BINDING SITE II or BINDING SITE III of FIG. 8. Table 4 illustrates the complementarity of the nucleotide sequences of SLC2A6 BINDING SITE, designated SEQ ID:10370, to the nucleotide sequence of GAM2033 RNA, herein designated GAM RNA, also designated SEQ ID:305.

Another function of GAM2033 is therefore inhibition of Solute carrier family 2 (facilitated glucose transporter), member 6 (SLC2A6, Accession NP_060055.1). Accordingly, utilities of GAM2033 include diagnosis, prevention and treatment of diseases and clinical conditions associated with SLC2A6.

SMYD2 (Accession NP_064582.1) is another GAM2033 target gene, herein designated TARGET GENE. SMYD2 BINDING SITE is a target binding site found in the 3' untranslated region of mRNA encoded by SMYD2, corresponding to a target binding site such as BINDING SITE I, BINDING SITE II or BINDING SITE III of FIG. 8. Table 4 illustrates the complementarity of the nucleotide sequences of SMYD2 BINDING SITE, designated SEQ ID:8651, to the nucleotide sequence of GAM2033 RNA, herein designated GAM RNA, also designated SEQ ID:305.

Another function of GAM2033 is therefore inhibition of SMYD2 (Accession NP_064582.1). Accordingly, utilities of GAM2033 include diagnosis, prevention and treatment of diseases and clinical conditions associated with SMYD2.

Surfeit 5 (SURF5, Accession NP_852468.1) is another GAM2033 target gene, herein designated TARGET GENE. SURF5 BINDING SITE is a target binding site found in the 3' untranslated region of multiple transcripts of mRNA encoded by SURF5, corresponding to a target binding site such as BINDING SITE I, BINDING SITE II or BINDING SITE III of FIG. 8. Table 4 illustrates the complementarity of the nucleotide sequences of SURF5 BINDING SITE, designated SEQ ID:16437, to the nucleotide sequence of GAM2033 RNA, herein designated GAM RNA, also designated SEQ ID:305.

Another function of GAM2033 is therefore inhibition of Surfeit 5 (SURF5, Accession NP_852468.1). Accordingly, utilities of GAM2033 include diagnosis, prevention and treatment of diseases and clinical conditions associated with SURF5.

Surfeit 6 (SURF6, Accession NP_006744.2) is another GAM2033 target gene, herein designated TARGET GENE. SURF6 BINDING SITE is a target binding site found in the 3' untranslated region of mRNA encoded by SURF6, corresponding to a target binding site such as BINDING SITE I, BINDING SITE II or BINDING SITE III of FIG. 8. Table 4 illustrates the complementarity of the nucleotide sequences of SURF6 BINDING SITE, designated SEQ ID:16547, to the nucleotide sequence of GAM2033 RNA, herein designated GAM RNA, also designated SEQ ID:305.

Another function of GAM2033 is therefore inhibition of Surfeit 6 (SURF6, Accession NP_006744.2). Accordingly, utilities of GAM2033 include diagnosis, prevention and treatment of diseases and clinical conditions associated with SURF6.

Tyrosyl-dna phosphodiesterase 1 (TDP1, Accession NP_060789.2) is another GAM2033 target gene, herein designated TARGET GENE. TDP1 BINDING SITE is a target binding site found in the 5' untranslated region of mRNA encoded by TDP1, corresponding to a target binding site such as BINDING SITE I, BINDING SITE II or BINDING SITE III of FIG. 8. Table 4 illustrates the complementarity of the nucleotide sequences of TDP1 BINDING SITE, designated SEQ ID:12885, to the nucleotide sequence of GAM2033 RNA, herein designated GAM RNA, also designated SEQ ID:305.

Another function of GAM2033 is therefore inhibition of Tyrosyl-dna phosphodiesterase 1 (TDP1, Accession NP_060789.2). Accordingly, utilities of GAM2033 include diagnosis, prevention and treatment of diseases and clinical conditions associated with TDP1.

Telomerase-associated protein 1 (TEP1, Accession NP_009041.2) is another GAM2033 target gene, herein designated TARGET GENE. TEP1 BINDING SITE is a target binding site found in the 3' untranslated region of mRNA encoded by TEP1, corresponding to a target binding site such as BINDING SITE I, BINDING SITE II or BINDING SITE III of FIG. 8. Table 4 illustrates the complementarity of the nucleotide sequences of TEP1 BINDING SITE, designated SEQ ID:10717, to the nucleotide sequence of GAM2033 RNA, herein designated GAM RNA, also designated SEQ ID:305.

Another function of GAM2033 is therefore inhibition of Telomerase-associated protein 1 (TEP1, Accession NP_009041.2), a gene which interacts with active telomerase RNA. Accordingly, utilities of GAM2033 include diagnosis, prevention and treatment of diseases and clinical conditions associated with TEP1.

The function of TEP1 and its association with various diseases and clinical conditions, has been established by previous studies, as described hereinabove with reference to GAM72.1. Transforming growth factor, alpha (TGFA, Accession NP_003227.1) is another GAM2033 target gene, herein designated TARGET GENE. TGFA BINDING SITE is a target binding site found in the 3' untranslated region of mRNA encoded by TGFA, corresponding to a target binding site such as BINDING SITE I, BINDING SITE II or BINDING SITE III of FIG. 8. Table 4 illustrates the complementarity of the nucleotide sequences of TGFA BINDING SITE, designated SEQ ID:16678, to the nucleotide sequence of GAM2033 RNA, herein designated GAM RNA, also designated SEQ ID:305.

Another function of GAM2033 is therefore inhibition of Transforming growth factor, alpha (TGFA, Accession NP_003227.1), a gene which is able to bind to the egf receptor and to act synergistically with tgf beta to promote anchorage-independent cell proliferation in soft agar. Accordingly, utilities of GAM2033 include diagnosis, prevention and treatment of diseases and clinical conditions associated with TGFA.

The function of TGFA and its association with various diseases and clinical conditions, has been established by previous studies, as described hereinabove with reference to GAM94.1. Transforming growth factor, beta 3 (TGFB3, Accession NP_003230.1) is another GAM2033 target gene, herein designated TARGET GENE. TGFB3 BINDING SITE is a target binding site found in the 3' untranslated region of mRNA encoded by TGFB3, corresponding to a target binding site such as BINDING SITE I, BINDING SITE II or BINDING SITE III of FIG. 8. Table 4 illustrates the complementarity of the nucleotide sequences of TGFB3 BINDING SITE, designated SEQ ID:16004, to the nucleotide sequence of GAM2033 RNA, herein designated GAM RNA, also designated SEQ ID:305.

Another function of GAM2033 is therefore inhibition of Transforming growth factor, beta 3 (TGFB3, Accession NP_003230.1), a gene which is involved in embryogenesis and cell differentiation. Accordingly, utilities of GAM2033 include diagnosis, prevention and treatment of diseases and clinical conditions associated with TGFB3.

The function of TGFB3 and its association with various diseases and clinical conditions, has been established by previous studies, as described hereinabove with reference to GAM483.1. Tousled-like kinase 2 (TLK2, Accession NP_006843.1) is another GAM2033 target gene, herein designated TARGET GENE. TLK2 BINDING SITE is a target binding site found in the 3' untranslated region of mRNA encoded by TLK2, corresponding to a target binding site such as BINDING SITE I, BINDING SITE II or BINDING SITE III of FIG. 8. Table 4 illustrates the complementarity of the nucleotide sequences of TLK2 BINDING SITE, designated SEQ ID:19779, to the nucleotide sequence of GAM2033 RNA, herein designated GAM RNA, also designated SEQ ID:305.

Another function of GAM2033 is therefore inhibition of Tousled-like kinase 2 (TLK2, Accession NP_006843.1). Accordingly, utilities of GAM2033 include diagnosis, prevention and treatment of diseases and clinical conditions associated with TLK2.

Tumor necrosis factor (ligand) superfamily, member 4 (tax-transcriptionally activated glycoprotein 1, 34 kda) (TNFSF4, Accession NP_003317.1) is another GAM2033 target gene, herein designated TARGET GENE. TNFSF4 BINDING SITE is a target binding site found in the 3' untranslated region of mRNA encoded by TNFSF4, corresponding to a target binding site such as BINDING SITE I, BINDING SITE II or BINDING SITE III of FIG. 8. Table 4 illustrates the complementarity of the nucleotide sequences of TNFSF4 BINDING SITE, designated SEQ ID:1426, to the nucleotide sequence of GAM2033 RNA, herein designated GAM RNA, also designated SEQ ID:305.

Another function of GAM2033 is therefore inhibition of Tumor necrosis factor (ligand) superfamily, member 4 (tax-transcriptionally activated glycoprotein 1, 34 kda) (TNFSF4, Accession NP_003317.1), a gene which co-stimulates t cell proliferation and cytokine production. Accordingly, utilities of GAM2033 include diagnosis, prevention and treatment of diseases and clinical conditions associated with TNFSF4.

The function of TNFSF4 and its association with various diseases and clinical conditions, has been established by previous studies, as described hereinabove with reference to GAM841.1. Tumor protein p53 inducible nuclear protein 1 (TP53INP1, Accession NP_150601.1) is another GAM2033 target gene, herein designated TARGET GENE. TP53INP1 BINDING SITE is a target binding site found in the 3' untranslated region of mRNA encoded by TP53INP1, corresponding to a target binding site such as BINDING SITE I, BINDING SITE II or BINDING SITE III of FIG. 8. Table 4 illustrates the complementarity of the nucleotide sequences of TP53INP1 BINDING SITE, designated SEQ ID:15816, to the nucleotide sequence of GAM2033 RNA, herein designated GAM RNA, also designated SEQ ID:305.

Another function of GAM2033 is therefore inhibition of Tumor protein p53 inducible nuclear protein 1 (TP53INP1, Accession NP_150601.1). Accordingly, utilities of GAM2033 include diagnosis, prevention and treatment of diseases and clinical conditions associated with TP53INP1.

TRA16 (Accession NP_795361.1) is another GAM2033 target gene, herein designated TARGET GENE. TRA16 BINDING SITE is a target binding site found in the 3' untranslated region of mRNA encoded by TRA16, corresponding to a target binding site such as BINDING SITE I, BINDING SITE II or BINDING SITE III of FIG. 8. Table 4 illustrates the complementarity of the nucleotide sequences of TRA16 BINDING SITE, designated SEQ ID:1186, to the nucleotide sequence of GAM2033 RNA, herein designated GAM RNA, also designated SEQ ID:305.

Another function of GAM2033 is therefore inhibition of TRA16 (Accession NP_795361.1). Accordingly, utilities of GAM2033 include diagnosis, prevention and treatment of diseases and clinical conditions associated with TRA16.

Tripartite motif-containing 9 (TRIM9, Accession NP_055978.2) is another GAM2033 target gene, herein designated TARGET GENE. TRIM9 BINDING SITE is a target binding site found in the 3' untranslated region of multiple transcripts of mRNA encoded by TRIM9, corresponding to a target binding site such as BINDING SITE I, BINDING SITE II or BINDING SITE III of FIG. 8. Table 4 illustrates the complementarity of the nucleotide sequences of TRIM9 BINDING SITE, designated SEQ ID:1798, to the nucleotide sequence of GAM2033 RNA, herein designated GAM RNA, also designated SEQ ID:305.

Another function of GAM2033 is therefore inhibition of Tripartite motif-containing 9 (TRIM9, Accession NP_055978.2), a gene which may function as a positive regulator for mannosylphosphate transferase and is required to mediate mannosylphosphate transfer in both the core and outer chain portions of n-linked. oligosaccharides. Accordingly, utilities of GAM2033 include diagnosis, prevention and treatment of diseases and clinical conditions associated with TRIM9.

The function of TRIM9 and its association with various diseases and clinical conditions, has been established by previous studies, as described hereinabove with reference to GAM72.1. Translin (TSN, Accession NP_004613.1) is another GAM2033 target gene, herein designated TARGET GENE. TSN BINDING SITE is a target binding site found in the 3' untranslated region of mRNA encoded by TSN, corresponding to a target binding site such as BINDING SITE I, BINDING SITE II or BINDING SITE III of FIG. 8. Table 4 illustrates the complementarity of the nucleotide sequences of TSN BINDING SITE, designated SEQ ID:7612, to the nucleotide sequence of GAM2033 RNA, herein designated GAM RNA, also designated SEQ ID:305.

Another function of GAM2033 is therefore inhibition of Translin (TSN, Accession NP_004613.1), a gene which is a DNA binding protein and involved in DNA repair, replication, or recombination. Accordingly, utilities of GAM2033 include diagnosis, prevention and treatment of diseases and clinical conditions associated with TSN.

The function of TSN and its association with various diseases and clinical conditions, has been established by previous studies, as described hereinabove with reference to GAM72.1. Williams-beuren syndrome chromosome region 1 (WBSCR1, Accession NP_114381.1) is another GAM2033 target gene, herein designated TARGET GENE. WBSCR1 BINDING SITE is a target binding site found in the 3' untranslated region of multiple transcripts of mRNA encoded by WBSCR1, corresponding to a target binding site such as BINDING SITE I, BINDING SITE II or BINDING SITE III of FIG. 8. Table 4 illustrates the complementarity of the nucleotide sequences of WBSCR1 BINDING SITE, designated SEQ ID:12817, to the nucleotide sequence of GAM2033 RNA, herein designated GAM RNA, also designated SEQ ID:305.

Another function of GAM2033 is therefore inhibition of Williams-beuren syndrome chromosome region 1 (WBSCR1, Accession NP_114381.1), a gene which stimulates protein translation and therefore may be associated with Williams syndrome. Accordingly, utilities of GAM2033 include diagnosis, prevention and treatment of Williams syndrome, and of other diseases and clinical conditions associated with WBSCR1.

The function of WBSCR1 and its association with various diseases and clinical conditions, has been established by previous studies, as described hereinabove with reference to GAM47.1. Williams-beuren syndrome chromosome region 1 (WBSCR1, Accession NP_071496.1) is another GAM2033 target gene, herein designated TARGET GENE. WBSCR1 BINDING SITE is a target binding site found in the 3' untranslated region of multiple transcripts of mRNA encoded by WBSCR1, corresponding to a target binding site such as BINDING SITE I, BINDING SITE II or BINDING SITE III of FIG. 8. Table 4 illustrates the complementarity of the nucleotide sequences of WBSCR1 BINDING SITE, designated SEQ ID:12817, to the nucleotide sequence of GAM2033 RNA, herein designated GAM RNA, also designated SEQ ID:305.

Another function of GAM2033 is therefore inhibition of Williams-beuren syndrome chromosome region 1 (WBSCR1, Accession NP_071496.1), a gene which stimulates protein translation and therefore may be associated with Williams syndrome. Accordingly, utilities of GAM2033 include diagnosis, prevention and treatment of Williams syndrome, and of other diseases and clinical conditions associated with WBSCR1.

The function of WBSCR1 and its association with various diseases and clinical conditions, has been established by previous studies, as described hereinabove with reference to GAM47.1.

FIG. 8 further provides a conceptual description of a novel bioinformatically detected of the present invention, referred to here as Genomic Address Messenger 2071 (GAM2071), which modulates expression of respective target genes thereof, the function and utility of which target genes is known in the art.

GAM2071 is a novel bioinformatically detected regulatory, non protein coding, micro RNA (miRNA) gene. The method by which GAM2071 was detected is described hereinabove with reference to FIGS. 8-15.

GAM2071 gene, herein designated GAM GENE, and GAM2071 target gene, herein designated TARGET GENE, are human genes contained in the human genome.

GAM2071 gene encodes a GAM2071 precursor RNA, herein designated GAM PRECURSOR RNA. Similar to other miRNA genes, and unlike most ordinary genes, GAM2071 precursor RNA does not encode a protein. A nucleotide sequence identical or highly similar to the nucleotide sequence of GAM2071 precursor RNA is designated SEQ ID:102, and is provided hereinbelow with reference to the sequence listing part.

GAM2071 precursor RNA folds onto itself, forming GAM2071 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM2071 precursor RNA folds onto itself, forming GAM2071 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM2071 precursor RNA, designated SEQ-ID:102, and a schematic representation of a predicted secondary folding of GAM2071 folded precursor RNA are further described with reference to Table 2, hereby incorporated by reference.

An enzyme complex designated DICER COMPLEX, 'dices' the GAM2071 folded precursor RNA into GAM2071 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM2071 RNA is designated SEQ ID:371, and is provided hereinbelow with references to the sequence listing part and Table 3, hereby incorporated by reference.

GAM2071 target gene, herein designated TARGET GENE, encodes a corresponding messenger RNA, GAM2071 target RNA, herein designated GAM TARGET RNA. GAM2071 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM2071 RNA, herein designated GAM RNA, binds complementarily to one or more target binding sites located in untranslated regions of GAM2071 target RNA, herein designated GAM TARGET RNA. This complementary binding is due to the fact that the nucleotide sequence of GAM2071 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM2071 RNA may have a different number of target binding sites in untranslated regions of a GAM2071 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM2071 RNA, herein designated GAM RNA, to target binding sites on GAM2071 target RNA, herein designated GAM TARGET RNA, such as BINDING SITE I, BINDING SITE II and BINDING SITE III, inhibits translation of GAM2071 target RNA into GAM2071 target protein, herein designated GAM TARGET PROTEIN. GAM target protein is therefore outlined by a broken line.

It is appreciated that GAM2071 target gene, herein designated TARGET GENE, in fact represents a plurality of GAM2071 target genes. The mRNA of each one of this plurality of GAM2071 target genes comprises one or more target binding sites, each having a nucleotide sequence which is at least partly complementary to GAM2071 RNA, herein designated GAM RNA, and which when bound by GAM2071 RNA causes inhibition of translation of respective one or more GAM2071 target proteins.

It is further appreciated by one skilled in the art that the mode of translational inhibition illustrated by FIG. 8 with specific reference to translational inhibition exerted by GAM2071 gene, herein designated GAM GENE, on one or more GAM2071 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM2071 correlate with, and may be deduced from, the identity of the target genes which GAM2071 binds and inhibits, and the function of these target genes, as elaborated hereinbelow.

15E1.2 (Accession XP_290596.1) is a GAM2071 target gene, herein designated TARGET GENE. 15E1.2 BINDING SITE is a target binding site found in the 3' untranslated region of mRNA encoded by 15E1.2, corresponding to a target binding site such as BINDING SITE I, BINDING SITE II or BINDING SITE III of FIG. 8. Table 4 illustrates the complementarity of the nucleotide sequences of 15E1.2 BINDING SITE, designated SEQ ID:13885, to the nucleotide sequence of GAM2071 RNA, herein designated GAM RNA, also designated SEQ ID:371.

A function of GAM2071 is therefore inhibition of 15E1.2 (Accession XP_290596.1). Accordingly, utilities of GAM2071 include diagnosis, prevention and treatment of diseases and clinical conditions associated with 15E1.2.

Alpha-1-b glycoprotein (A1BG, Accession NP_570602.2) is another GAM2071 target gene, herein designated TARGET GENE. A1BG BINDING SITE is a target binding site found in the 3' untranslated region of mRNA encoded by A1BG, corresponding to a target binding site such as BINDING SITE I, BINDING SITE II or BINDING SITE III of FIG. 8. Table 4 illustrates the complementarity of the nucleotide sequences of A1BG BINDING SITE, designated SEQ ID:10791, to the nucleotide sequence of GAM2071 RNA, herein designated GAM RNA, also designated SEQ ID:371.

Another function of GAM2071 is therefore inhibition of Alpha-1-b glycoprotein (A1BG, Accession NP_570602.2), a gene which a plasma protein of unknown function. Accordingly, utilities of GAM2071 include diagnosis, prevention and treatment of diseases and clinical conditions associated with A1BG.

The function of A1BG and its association with various diseases and clinical conditions, has been established by previous studies, as described hereinabove with reference to GAM130.1. Aminoadipate-semialdehyde synthase (AASS, Accession NP_005754.2) is another GAM2071 target gene, herein designated TARGET GENE. AASS BINDING SITE is a target binding site found in the 3' untranslated region of mRNA encoded by AASS, corresponding to a target binding site such as BINDING SITE I, BINDING SITE II or BINDING SITE III of FIG. 8. Table 4 illustrates the complementarity of the nucleotide sequences of AASS BINDING SITE, designated SEQ ID:18163, to the nucleotide sequence of GAM2071 RNA, herein designated GAM RNA, also designated SEQ ID:371.

Another function of GAM2071 is therefore inhibition of Aminoadipate-semialdehyde synthase (AASS, Accession NP_005754.2). Accordingly, utilities of GAM2071 include diagnosis, prevention and treatment of diseases and clinical conditions associated with AASS.

ABCA13 (Accession NP_689914.2) is another GAM2071 target gene, herein designated TARGET GENE. ABCA13 BINDING SITE is a target binding site found in the 3' untranslated region of mRNA encoded by ABCA13, corresponding to a target binding site such as BINDING SITE I, BINDING SITE II or BINDING SITE III of FIG. 8. Table 4 illustrates the complementarity of the nucleotide sequences of ABCA13 BINDING SITE, designated SEQ ID:13800, to the nucleotide sequence of GAM2071 RNA, herein designated GAM RNA, also designated SEQ ID:371.

Another function of GAM2071 is therefore inhibition of ABCA13 (Accession NP_689914.2). Accordingly, utilities of GAM2071 include diagnosis, prevention and treatment of diseases and clinical conditions associated with ABCA13.

Actin binding lim protein 1 (ABLIM1, Accession NP_006710.2) is another GAM2071 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:13022, to the nucleotide sequence of GAM2071 RNA, herein designated GAM RNA, also designated SEQ ID:371.

Another function of GAM2071 is therefore inhibition of Actin binding lim protein 1 (ABLIM1, Accession NP_006710.2). Accordingly, utilities of GAM2071 include diagnosis, prevention and treatment of diseases and clinical conditions associated with ABLIM1.

Actin binding lim protein 1 (ABLIM1, Accession NP_002304.2) is another GAM2071 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:13022, to the nucleotide sequence of GAM2071 RNA, herein designated GAM RNA, also designated SEQ ID:371.

Another function of GAM2071 is therefore inhibition of Actin binding lim protein 1 (ABLIM1, Accession NP_002304.2). Accordingly, utilities of GAM2071 include diagnosis, prevention and treatment of diseases and clinical conditions associated with ABLIM1.

Actin binding lim protein 1 (ABLIM1, Accession NP_006711.2) is another GAM2071 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:13022, to the nucleotide sequence of GAM2071 RNA, herein designated GAM RNA, also designated SEQ ID:371.

Another function of GAM2071 is therefore inhibition of Actin binding lim protein 1 (ABLIM1, Accession NP_006711.2). Accordingly, utilities of GAM2071 include diagnosis, prevention and treatment of diseases and clinical conditions associated with ABLIM1.

Acyl-coenzyme a dehydrogenase, short/branched chain (ACADSB, Accession NP_001600.1) is another GAM2071 target gene, herein designated TARGET GENE. ACADSB BINDING SITE is a target binding site found in the 3' untranslated region of mRNA encoded by ACADSB, corresponding to a target binding site such as BINDING SITE I, BINDING SITE II or BINDING SITE III of FIG. 8. Table 4 illustrates the complementarity of the nucleotide sequences of ACADSB BINDING SITE, designated SEQ ID:14907, to the nucleotide sequence of GAM2071 RNA, herein designated GAM RNA, also designated SEQ ID:371.

Another function of GAM2071 is therefore inhibition of Acyl-coenzyme a dehydrogenase, short/branched chain (ACADSB, Accession NP_001600.1). Accordingly, utilities of GAM2071 include diagnosis, prevention and treatment of diseases and clinical conditions associated with ACADSB.

A disintegrin-like and metalloprotease (reprolysin type) with thrombospondin type 1 motif, 4 (ADAMTS4, Accession NP_005090.1) is another GAM2071 target gene, herein designated TARGET GENE. ADAMTS4 BINDING SITE is a target binding site found in the 3' untranslated region of mRNA encoded by ADAMTS4, corresponding to a target binding site such as BINDING SITE I, BINDING SITE II or BINDING SITE III of FIG. 8. Table 4 illustrates the complementarity of the nucleotide sequences of ADAMTS4 BINDING SITE, designated SEQ ID:1318, to the nucleotide sequence of GAM2071 RNA, herein designated GAM RNA, also designated SEQ ID:371.

Another function of GAM2071 is therefore inhibition of A disintegrin-like and metalloprotease (reprolysin type) with thrombospondin type 1 motif, 4 (ADAMTS4, Accession NP_005090.1), a gene which cleaves aggrecan, a cartilage proteoglycan, and may be involved in its turnover. Accordingly, utilities of GAM2071 include diagnosis, prevention and treatment of diseases and clinical conditions associated with ADAMTS4.

The function of ADAMTS4 and its association with various diseases and clinical conditions, has been established by previous studies, as described hereinabove with reference to GAM189.1. Adenylate cyclase 5 (ADCY5, Accession XP_171048.2) is another GAM2071 target gene, herein designated TARGET GENE. ADCY5 BINDING SITE is a target binding site found in the 3' untranslated region of mRNA encoded by ADCY5, corresponding to a target binding site such as BINDING SITE I, BINDING SITE II or BINDING SITE III of FIG. 8. Table 4 illustrates the complementarity of the nucleotide sequences of ADCY5 BINDING SITE, designated SEQ ID:19656, to the nucleotide sequence of GAM2071 RNA, herein designated GAM RNA, also designated SEQ ID:371.

Another function of GAM2071 is therefore inhibition of Adenylate cyclase 5 (ADCY5, Accession XP_171048.2). Accordingly, utilities of GAM2071 include diagnosis, prevention and treatment of diseases and clinical conditions associated with ADCY5.

Adenylate cyclase 6 (ADCY6, Accession NP_056085.1) is another GAM2071 target gene, herein designated TARGET GENE. ADCY6 BINDING SITE is a target binding site found in the 5' untranslated region of multiple transcripts of mRNA encoded by ADCY6, corresponding to a target binding site such as BINDING SITE I, BINDING SITE II or BINDING SITE III of FIG. 8. Table 4 illustrates the complementarity of the nucleotide sequences of ADCY6 BINDING SITE, designated SEQ ID:14908, to the nucleotide sequence of GAM2071 RNA, herein designated GAM RNA, also designated SEQ ID:371.

Another function of GAM2071 is therefore inhibition of Adenylate cyclase 6 (ADCY6, Accession NP_056085.1), a gene which this a membrane-bound, ca(2+)-inhibitable adenylyl cyclase (by similarity). Accordingly, utilities of GAM2071 include diagnosis, prevention and treatment of diseases and clinical conditions associated with ADCY6.

The function of ADCY6 and its association with various diseases and clinical conditions, has been established by previous studies, as described hereinabove with reference to GAM67.2. Agmatine ureohydrolase (agmatinase) (AGMAT, Accession NP_079034.2) is another GAM2071 target gene, herein designated TARGET GENE. AGMAT BINDING SITE is a target binding site found in the 3' untranslated region of mRNA encoded by AGMAT, corresponding to a target binding site such as BINDING SITE I, BINDING SITE II or BINDING SITE III of FIG. 8. Table 4 illustrates the complementarity of the nucleotide sequences of AGMAT BINDING SITE, designated SEQ ID:2112, to the nucleotide sequence of GAM2071 RNA, herein designated GAM RNA, also designated SEQ ID:371.

Another function of GAM2071 is therefore inhibition of Agmatine ureohydrolase (agmatinase) (AGMAT, Accession NP_079034.2). Accordingly, utilities of GAM2071 include diagnosis, prevention and treatment of diseases and clinical conditions associated with AGMAT.

Aryl hydrocarbon receptor (AHR, Accession NP_001612.1) is another GAM2071 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:9011, to the nucleotide sequence of GAM2071 RNA, herein designated GAM RNA, also designated SEQ ID:371.

Another function of GAM2071 is therefore inhibition of Aryl hydrocarbon receptor (AHR, Accession NP_001612.1), a gene which plays a role in modulating carcinogenesis through the induction of xenobiotic-metabolizing enzymes and therefore may be associated with Stomach tumors. Accordingly, utilities of GAM2071 include diagnosis, prevention and treatment of Stomach tumors, and of other diseases and clinical conditions associated with AHR.

The function of AHR and its association with various diseases and clinical conditions, has been established by previous studies, as described hereinabove with reference to GAM30.1. Absent in melanoma 1 (AIM1, Accession XP_166300.1) is another GAM2071 target gene, herein designated TARGET GENE. AIM1 BINDING SITE is a target binding site found in the 3' untranslated region of mRNA encoded by AIM1, corresponding to a target binding site such as BINDING SITE I, BINDING SITE II or BINDING SITE III of FIG. 8. Table 4 illustrates the complementarity of the nucleotide sequences of AIM1 BINDING SITE, designated SEQ ID:1383, to the nucleotide sequence of GAM2071 RNA, herein designated GAM RNA, also designated SEQ ID:371.

Another function of GAM2071 is therefore inhibition of Absent in melanoma 1 (AIM1, Accession XP_166300.1), a gene which is altered in association with tumor suppression in a model of human melanoma and therefore may be associated with Malignant melanoma. Accordingly, utilities of GAM2071 include diagnosis, prevention and treatment of Malignant melanoma, and of other diseases and clinical conditions associated with AIM1.

The function of AIM1 and its association with various diseases and clinical conditions, has been established by previous studies, as described hereinabove with reference to GAM136.1. Aldehyde dehydrogenase 1 family, member b1 (ALDH1B1, Accession NP_000683.3) is another GAM2071 target gene, herein designated TARGET GENE. ALDH1B1 BINDING SITE is a target binding site found in the 3' untranslated region of mRNA encoded by ALDH1B1, corresponding to a target binding site such as BINDING SITE I, BINDING SITE II or BINDING SITE III of FIG. 8. Table 4 illustrates the complementarity of the nucleotide sequences of ALDH1B1 BINDING SITE, designated SEQ ID:19434, to the nucleotide sequence of GAM2071 RNA, herein designated GAM RNA, also designated SEQ ID:371.

Another function of GAM2071 is therefore inhibition of Aldehyde dehydrogenase 1 family, member b1 (ALDH1B1, Accession NP_000683.3). Accordingly, utilities of GAM2071 include diagnosis, prevention and treatment of diseases and clinical conditions associated with ALDH1B1.

Arachidonate 15-lipoxygenase (ALOX15, Accession NP_001131.1) is another GAM2071 target gene, herein designated TARGET GENE. ALOX15 BINDING SITE is a target binding site found in the 3' untranslated region of mRNA encoded by ALOX15, corresponding to a target binding site such as BINDING SITE I, BINDING SITE II or BINDING SITE III of FIG. 8. Table 4 illustrates the complementarity of the nucleotide sequences of ALOX15 BINDING SITE, designated SEQ ID:18901, to the nucleotide sequence of GAM2071 RNA, herein designated GAM RNA, also designated SEQ ID:371.

Another function of GAM2071 is therefore inhibition of Arachidonate 15-lipoxygenase (ALOX15, Accession NP_001131.1), a gene which converts arachidonic acid to 15s-hydroperoxyeicosatetraenoic acid. Accordingly, utilities of GAM2071 include diagnosis, prevention and treatment of diseases and clinical conditions associated with ALOX15.

The function of ALOX15 and its association with various diseases and clinical conditions, has been established by previous studies, as described hereinabove with reference to GAM189.1. AMID (Accession NP_116186.1) is another GAM2071 target gene, herein designated TARGET GENE. AMID BINDING SITE is a target binding site found in the 3' untranslated region of mRNA encoded by AMID, corresponding to a target binding site such as BINDING SITE I, BINDING SITE II or BINDING SITE III of FIG. 8. Table 4 illustrates the complementarity of the nucleotide sequences of AMID BINDING SITE, designated SEQ ID:2328, to the nucleotide sequence of GAM2071 RNA, herein designated GAM RNA, also designated SEQ ID:371.

Another function of GAM2071 is therefore inhibition of AMID (Accession NP_116186.1). Accordingly, utilities of GAM2071 include diagnosis, prevention and treatment of diseases and clinical conditions associated with AMID.

Angiomotin like 1 (AMOTL1, Accession NP_570899.1) is another GAM2071 target gene, herein designated TARGET GENE. AMOTL1 BINDING SITE is a target binding site found in the 3' untranslated region of mRNA encoded by AMOTL1, corresponding to a target binding site such as BINDING SITE I, BINDING SITE II or BINDING SITE III of FIG. 8. Table 4 illustrates the complementarity of the nucleotide sequences of AMOTL1 BINDING SITE, designated SEQ ID:18210, to the nucleotide sequence of GAM2071 RNA, herein designated GAM RNA, also designated SEQ ID:371.

Another function of GAM2071 is therefore inhibition of Angiomotin like 1 (AMOTL1, Accession NP_570899.1). Accordingly, utilities of GAM2071 include diagnosis, prevention and treatment of diseases and clinical conditions associated with AMOTL1.

Ankyrin repeat domain 6 (ANKRD6, Accession NP_055757.1) is another GAM2071 target gene, herein designated TARGET GENE. ANKRD6 BINDING SITE is a target binding site found in the 3' untranslated region of mRNA encoded by ANKRD6, corresponding to a target binding site such as BINDING SITE I, BINDING SITE II or BINDING SITE III of FIG. 8. Table 4 illustrates the complementarity of the nucleotide sequences of ANKRD6 BINDING SITE, designated SEQ ID:11653, to the nucleotide sequence of GAM2071 RNA, herein designated GAM RNA, also designated SEQ ID:371.

Another function of GAM2071 is therefore inhibition of Ankyrin repeat domain 6 (ANKRD6, Accession NP_055757.1). Accordingly, utilities of GAM2071 include diagnosis, prevention and treatment of diseases and clinical conditions associated with ANKRD6.

AP1S3 (Accession XP_291023.1) is another GAM2071 target gene, herein designated TARGET GENE. AP1S3 BINDING SITE is a target binding site found in the 3' untranslated region of multiple transcripts of mRNA encoded by AP1S3, corresponding to a target binding site such as BINDING SITE I, BINDING SITE II or BINDING SITE III of FIG. 8. Table 4 illustrates the complementarity of the nucleotide sequences of AP1S3 BINDING SITE, designated SEQ ID:15779, to the nucleotide sequence of GAM2071 RNA, herein designated GAM RNA, also designated SEQ ID:371.

Another function of GAM2071 is therefore inhibition of AP1S3 (Accession XP_291023.1). Accordingly, utilities of GAM2071 include diagnosis, prevention and treatment of diseases and clinical conditions associated with AP1S3.

Adaptor-related protein complex 3, sigma 2 subunit (AP3S2, Accession NP_005820.1) is another GAM2071 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:6113, to the nucleotide sequence of GAM2071 RNA, herein designated GAM RNA, also designated SEQ ID:371.

Another function of GAM2071 is therefore inhibition of Adaptor-related protein complex 3, sigma 2 subunit (AP3S2, Accession NP_005820.1). Accordingly, utilities of GAM2071 include diagnosis, prevention and treatment of diseases and clinical conditions associated with AP3S2.

Apoptotic protease activating factor (APAF1, Accession NP_001151.1) is another GAM2071 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:1306 and SEQ ID:803 respectively, to the nucleotide sequence of GAM2071 RNA, herein designated GAM RNA, also designated SEQ ID:371.

Another function of GAM2071 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM2071 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apoptotic protease activating factor (APAF1, Accession NP_001151.1) is another GAM2071 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:803 and SEQ ID:1306 respectively, to the nucleotide sequence of GAM2071 RNA, herein designated GAM RNA, also designated SEQ ID:371.

Another function of GAM2071 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM2071 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. APM1 (Accession NP_004788.1) is another GAM2071 target gene, herein designated TARGET GENE. APM1 BINDING SITE1 and APM1 BINDING SITE2 are target binding sites found in untranslated regions of mRNA encoded by APM1, corresponding to target binding sites such as BINDING SITE I, BINDING SITE II or BINDING SITE III of FIG. 8. Table 4 illustrates the complementarity of the nucleotide sequences of APM1 BINDING SITE1 and APM1 BINDING SITE2, designated SEQ ID:13551 and SEQ ID:1962 respectively, to the nucleotide sequence of GAM2071 RNA, herein designated GAM RNA, also designated SEQ ID:371.

Another function of GAM2071 is therefore inhibition of APM1 (Accession NP_004788.1). Accordingly, utilities of GAM2071 include diagnosis, prevention and treatment of diseases and clinical conditions associated with APM1.

Apolipoprotein b mrna editing enzyme, catalytic polypeptide-like 3f (APOBEC3F, Accession NP_660341.2) is another GAM2071 target gene, herein designated TARGET GENE. APOBEC3F BINDING SITE is a target binding site found in the 3' untranslated region of mRNA encoded by APOBEC3F, corresponding to a target binding site such as BINDING SITE I, BINDING SITE II or BINDING SITE III of FIG. 8. Table 4 illustrates the complementarity of the nucleotide sequences of APOBEC3F BINDING SITE, designated SEQ ID:5126, to the nucleotide sequence of GAM2071 RNA, herein designated GAM RNA, also designated SEQ ID:371.

Another function of GAM2071 is therefore inhibition of Apolipoprotein b mrna editing enzyme, catalytic polypeptide-like 3f (APOBEC3F, Accession NP_660341.2). Accordingly, utilities of GAM2071 include diagnosis, prevention and treatment of diseases and clinical conditions associated with APOBEC3F.

Apolipoprotein l, 2 (APOL2, Accession NP_112092.1) is another GAM2071 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:16087, to the nucleotide sequence of GAM2071 RNA, herein designated GAM RNA, also designated SEQ ID:371.

Another function of GAM2071 is therefore inhibition of Apolipoprotein l, 2 (APOL2, Accession NP_112092.1). Accordingly, utilities of GAM2071 include diagnosis, prevention and treatment of diseases and clinical conditions associated with APOL2.

Apolipoprotein l, 2 (APOL2, Accession NP_663612.1) is another GAM2071 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:16087, to the nucleotide sequence of GAM2071 RNA, herein designated GAM RNA, also designated SEQ ID:371.

Another function of GAM2071 is therefore inhibition of Apolipoprotein l, 2 (APOL2, Accession NP_663612.1). Accordingly, utilities of GAM2071 include diagnosis, prevention and treatment of diseases and clinical conditions associated with APOL2.

APPL (Accession NP_036228.1) is another GAM2071 target gene, herein designated TARGET GENE. APPL BINDING SITE is a target binding site found in the 3' untranslated region of mRNA encoded by APPL, corresponding to a target binding site such as BINDING SITE I, BINDING SITE II or BINDING SITE III of FIG. 8. Table 4 illustrates the complementarity of the nucleotide sequences of APPL BINDING SITE, designated SEQ ID:12386, to the nucleotide sequence of GAM2071 RNA, herein designated GAM RNA, also designated SEQ ID:371.

Another function of GAM2071 is therefore inhibition of APPL (Accession NP_036228.1). Accordingly, utilities of GAM2071 include diagnosis, prevention and treatment of diseases and clinical conditions associated with APPL.

Aquaporin 6, kidney specific (AQP6, Accession NP_001643.1) is another GAM2071 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:2103, to the nucleotide sequence of GAM2071 RNA, herein designated GAM RNA, also designated SEQ ID:371.

Another function of GAM2071 is therefore inhibition of Aquaporin 6, kidney specific (AQP6, Accession NP_001643.1), a gene which participates in distinct physiologic function such as glomerular filtration, tubular endocytosis, and acid-base-metabolism. Accordingly, utilities of GAM2071 include diagnosis, prevention and treatment of diseases and clinical conditions associated with AQP6.

The function of AQP6 and its association with various diseases and clinical conditions, has been established by previous studies, as described hereinabove with reference to GAM51.1. Aquaporin 6, kidney specific (AQP6, Accession NP_445738.1) is another GAM2071 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:2103, to the nucleotide sequence of GAM2071 RNA, herein designated GAM RNA, also designated SEQ ID:371.

Another function of GAM2071 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM2071 include diagnosis, prevention and treatment of diseases and clinical conditions associated with AQP6.

The function of AQP6 and its association with various diseases and clinical conditions, has been established by previous studies, as described hereinabove with reference to GAM51.1. Adp-ribosylation factor 4-like (ARF4L, Accession NP_001652.1) is another GAM2071 target gene, herein designated TARGET GENE. ARF4L BINDING SITE is a target binding site found in the 3' untranslated region of mRNA encoded by ARF4L, corresponding to a target binding site such as BINDING SITE I, BINDING SITE II or BINDING SITE III of FIG. 8. Table 4 illustrates the complementarity of the nucleotide sequences of ARF4L BINDING SITE, designated SEQ ID:16932, to the nucleotide sequence of GAM2071 RNA, herein designated GAM RNA, also designated SEQ ID:371.

Another function of GAM2071 is therefore inhibition of Adp-ribosylation factor 4-like (ARF4L, Accession NP_001652.1). Accordingly, utilities of GAM2071 include diagnosis, prevention and treatment of diseases and clinical conditions associated with ARF4L.

Ras homolog gene family, member a (ARHA, Accession NP_001655.1) is another GAM2071 target gene, herein designated TARGET GENE. ARHA BINDING SITE is a target binding site found in the 3' untranslated region of mRNA encoded by ARHA, corresponding to a target binding site such as BINDING SITE I, BINDING SITE II or BINDING SITE III of FIG. 8. Table 4 illustrates the complementarity of the nucleotide sequences of ARHA BINDING SITE, designated SEQ ID:2467, to the nucleotide sequence of GAM2071 RNA, herein designated GAM RNA, also designated SEQ ID:371.

Another function of GAM2071 is therefore inhibition of Ras homolog gene family, member a (ARHA, Accession NP_001655.1), a gene which regulates remodeling of the actin cytoskeleton during cell morphogenesis and motility. Accordingly, utilities of GAM2071 include diagnosis, prevention and treatment of diseases and clinical conditions associated with ARHA.

The function of ARHA and its association with various diseases and clinical conditions, has been established by previous studies, as described hereinabove with reference to GAM223.1. Ras homolog gene family, member f (in filopodia) (ARHF, Accession NP_061907.1) is another GAM2071 target gene, herein designated TARGET GENE. ARHF BINDING SITE is a target binding site found in the 3' untranslated region of mRNA encoded by ARHF, corresponding to a target binding site such as BINDING SITE I, BINDING SITE II or BINDING SITE III of FIG. 8. Table 4 illustrates the complementarity of the nucleotide sequences of ARHF BINDING SITE, designated SEQ ID:3172, to the nucleotide sequence of GAM2071 RNA, herein designated GAM RNA, also designated SEQ ID:371.

Another function of GAM2071 is therefore inhibition of Ras homolog gene family, member f (in filopodia) (ARHF, Accession NP_061907.1). Accordingly, utilities of GAM2071 include diagnosis, prevention and treatment of diseases and clinical conditions associated with ARHF.

Rho gtpase activating protein 1 (ARHGAP1, Accession NP_004299.1) is another GAM2071 target gene, herein designated TARGET GENE. ARHGAP1 BINDING SITE is a target binding site found in the 3' untranslated region of mRNA encoded by ARHGAP1, corresponding to a target binding site such as BINDING SITE I, BINDING SITE II or BINDING SITE III of FIG. 8. Table 4 illustrates the complementarity of the nucleotide sequences of ARHGAP1 BINDING SITE, designated SEQ ID:8690, to the nucleotide sequence of GAM2071 RNA, herein designated GAM RNA, also designated SEQ ID:371.

Another function of GAM2071 is therefore inhibition of Rho gtpase activating protein 1 (ARHGAP1, Accession NP_004299.1). Accordingly, utilities of GAM2071 include diagnosis, prevention and treatment of diseases and clinical conditions associated with ARHGAP1.

ARHGAP11A (Accession NP_055598.1) is another GAM2071 target gene, herein designated TARGET GENE. ARHGAP11A BINDING SITE is a target binding site found in the 3' untranslated region of mRNA encoded by ARHGAP11A, corresponding to a target binding site such as BINDING SITE I, BINDING SITE II or BINDING SITE III of FIG. 8. Table 4 illustrates the complementarity of the nucleotide sequences of ARHGAP11A BINDING SITE, designated SEQ ID:7085, to the nucleotide sequence of GAM2071 RNA, herein designated GAM RNA, also designated SEQ ID:371.

Another function of GAM2071 is therefore inhibition of ARHGAP11A (Accession NP_055598.1). Accordingly, utilities of GAM2071 include diagnosis, prevention and treatment of diseases and clinical conditions associated with ARHGAP11A.

ARPP-19 (Accession NP_006619.1) is another GAM2071 target gene, herein designated TARGET GENE. ARPP-19 BINDING SITE1 and ARPP-19 BINDING SITE2 are target binding sites found in untranslated regions of mRNA encoded by ARPP-19, corresponding to target binding sites such as BINDING SITE I, BINDING SITE II or BINDING SITE III of FIG. 8. Table 4 illustrates the complementarity of the nucleotide sequences of ARPP-19 BINDING SITE1 and ARPP-19 BINDING SITE2, designated SEQ ID:18664 and SEQ ID:5121 respectively, to the nucleotide sequence of GAM2071 RNA, herein designated GAM RNA, also designated SEQ ID:371.

Another function of GAM2071 is therefore inhibition of ARPP-19 (Accession NP_006619.1). Accordingly, utilities of GAM2071 include diagnosis, prevention and treatment of diseases and clinical conditions associated with ARPP-19.

Ankyrin repeat and socs box-containing 16 (ASB16, Accession NP_543139.4) is another GAM2071 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:11661, to the nucleotide sequence of GAM2071 RNA, herein designated GAM RNA, also designated SEQ ID:371.

Another function of GAM2071 is therefore inhibition of Ankyrin repeat and socs box-containing 16 (ASB16, Accession NP_543139.4) . Accordingly, utilities of GAM2071 include diagnosis, prevention and treatment of diseases and clinical conditions associated with ASB16.

Ankyrin repeat and socs box-containing 6 (ASB6, Accession NP_060343.1) is another GAM2071 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:20186 and SEQ ID:1654 respectively, to the nucleotide sequence of GAM2071 RNA, herein designated GAM RNA, also designated SEQ ID:371.

Another function of GAM2071 is therefore inhibition of Ankyrin repeat and socs box-containing 6 (ASB6, Accession NP_060343.1). Accordingly, utilities of GAM2071 include diagnosis, prevention and treatment of diseases and clinical conditions associated with ASB6.

Ankyrin repeat and socs box-containing 6 (ASB6, Accession NP_821066.1) is another GAM2071 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:20186 and SEQ ID:1654 respectively, to the nucleotide sequence of GAM2071 RNA, herein designated GAM RNA, also designated SEQ ID:371.

Another function of GAM2071 is therefore inhibition of Ankyrin repeat and socs box-containing 6 (ASB6, Accession NP_821066.1). Accordingly, utilities of GAM2071 include diagnosis, prevention and treatment of diseases and clinical conditions associated with ASB6.

ASE-1 (Accession NP_036231.1) is another GAM2071 target gene, herein designated TARGET GENE. ASE-1 BINDING SITE1 and ASE-1 BINDING SITE2 are target binding sites found in untranslated regions of mRNA encoded by ASE-1, corresponding to target binding sites such as BINDING SITE I, BINDING SITE II or BINDING SITE III of FIG. 8. Table 4 illustrates the complementarity of the nucleotide sequences of ASE-1 BINDING SITE1 and ASE-1 BINDING SITE2, designated SEQ ID:9101 and SEQ ID:9988 respectively, to the nucleotide sequence of GAM2071 RNA, herein designated GAM RNA, also designated SEQ ID:371.

Another function of GAM2071 is therefore inhibition of ASE-1 (Accession NP_036231.1). Accordingly, utilities of GAM2071 include diagnosis, prevention and treatment of diseases and clinical conditions associated with ASE-1.

Atpase, (na+)/k+ transporting, beta 4 polypeptide (ATP1B4, Accession NP_036201.1) is another GAM2071 target gene, herein designated TARGET GENE. ATP1B4 BINDING SITE is a target binding site found in the 3' untranslated region of mRNA encoded by ATP1B4, corresponding to a target binding site such as BINDING SITE I, BINDING SITE II or BINDING SITE III of FIG. 8. Table 4 illustrates the complementarity of the nucleotide sequences of ATP1B4 BINDING SITE, designated SEQ ID:15678, to the nucleotide sequence of GAM2071 RNA, herein designated GAM RNA, also designated SEQ ID:371.

Another function of GAM2071 is therefore inhibition of Atpase, (na+)/k+ transporting, beta 4 polypeptide (ATP1B4, Accession NP_036201.1). Accordingly, utilities of GAM2071 include diagnosis, prevention and treatment of diseases and clinical conditions associated with ATP1B4.

Atpase, ca++ transporting, type 2c, member 1 (ATP2C1, Accession NP_055197.1) is another GAM2071 target gene, herein designated TARGET GENE. ATP2C1 BINDING SITE is a target binding site found in the 5' untranslated region of mRNA encoded by ATP2C1, corresponding to a target binding site such as BINDING SITE I, BINDING SITE II or BINDING SITE III of FIG. 8. Table 4 illustrates the complementarity of the nucleotide sequences of ATP2C1 BINDING SITE, designated SEQ ID:4782, to the nucleotide sequence of GAM2071 RNA, herein designated GAM RNA, also designated SEQ ID:371.

Another function of GAM2071 is therefore inhibition of Atpase, ca++ transporting, type 2c, member 1 (ATP2C1, Accession NP_055197.1). Accordingly, utilities of GAM2071 include diagnosis, prevention and treatment of diseases and clinical conditions associated with ATP2C1.

Atpase, h+ transporting, lysosomal 38 kda, v0 subunit d isoform 2 (ATP6V0D2, Accession NP_689778.1) is another GAM2071 target gene, herein designated TARGET GENE. ATP6V0D2 BINDING SITE is a target binding site found in the 3' untranslated region of mRNA encoded by ATP6V0D2, corresponding to a target binding site such as BINDING SITE I, BINDING SITE II or BINDING SITE III of FIG. 8. Table 4 illustrates the complementarity of the nucleotide sequences of ATP6V0D2 BINDING SITE, designated SEQ ID:7490, to the nucleotide sequence of GAM2071 RNA, herein designated GAM RNA, also designated SEQ ID:371.

Another function of GAM2071 is therefore inhibition of Atpase, h+ transporting, lysosomal 38 kda, v0 subunit d isoform 2 (ATP6V0D2, Accession NP_689778.1). Accordingly, utilities of GAM2071 include diagnosis, prevention and treatment of diseases and clinical conditions associated with ATP6V0D2.

Atpase, cu++ transporting, alpha polypeptide (menkes syndrome) (ATP7A, Accession NP_000043.1) is another GAM2071 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:19505, to the nucleotide sequence of GAM2071 RNA, herein designated GAM RNA, also designated SEQ ID:371.

Another function of GAM2071 is therefore inhibition of Atpase, cu++ transporting, alpha polypeptide (menkes syndrome) (ATP7A, Accession NP_000043.1). Accordingly, utilities of GAM2071 include diagnosis, prevention and treatment of diseases and clinical conditions associated with ATP7A.

Axl receptor tyrosine kinase (AXL, Accession NP_068713.2) is another GAM2071 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:5485, to the nucleotide sequence of GAM2071 RNA, herein designated GAM RNA, also designated SEQ ID:371.

Another function of GAM2071 is therefore inhibition of Axl receptor tyrosine kinase (AXL, Accession NP_068713.2). Accordingly, utilities of GAM2071 include diagnosis, prevention and treatment of diseases and clinical conditions associated with AXL.

Axl receptor tyrosine kinase (AXL, Accession NP_001690.2) is another GAM2071 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:5485, to the nucleotide sequence of GAM2071 RNA, herein designated GAM RNA, also designated SEQ ID:371.

Another function of GAM2071 is therefore inhibition of Axl receptor tyrosine kinase (AXL, Accession NP_001690.2). Accordingly, utilities of GAM2071 include diagnosis, prevention and treatment of diseases and clinical conditions associated with AXL.

Udp-gal:betaglcnac beta 1,4-galactosyltransferase, polypeptide 5 (B4GALT5, Accession NP_004767.1) is another GAM2071 target gene, herein designated TARGET GENE. B4GALT5 BINDING SITE is a target binding site found in the 3' untranslated region of mRNA encoded by B4GALT5, corresponding to a target binding site such as BINDING SITE I, BINDING SITE II or BINDING SITE III of FIG. 8. Table 4 illustrates the complementarity of the nucleotide sequences of B4GALT5 BINDING SITE, designated SEQ ID:10889, to the nucleotide sequence of GAM2071 RNA, herein designated GAM RNA, also designated SEQ ID:371.

Another function of GAM2071 is therefore inhibition of Udp-gal:betaglcnac beta 1,4-galactosyltransferase, polypeptide 5 (B4GALT5, Accession NP_004767.1). Accordingly, utilities of GAM2071 include diagnosis, prevention and treatment of diseases and clinical conditions associated with B4GALT5.

Btb and cnc homology 1, basic leucine zipper transcription factor 1 (BACH1, Accession NP_001177.1) is another GAM2071 target gene, herein designated TARGET GENE. BACH1 BINDING SITE is a target binding site found in the 3' untranslated region of mRNA encoded by BACH1, corresponding to a target binding site such as BINDING SITE I, BINDING SITE II or BINDING SITE III of FIG. 8. Table 4 illustrates the complementarity of the nucleotide sequences of BACH1 BINDING SITE, designated SEQ ID:2969, to the nucleotide sequence of GAM2071 RNA, herein designated GAM RNA, also designated SEQ ID:371.

Another function of GAM2071 is therefore inhibition of Btb and cnc homology 1, basic leucine zipper transcription factor 1 (BACH1, Accession NP_001177.1), a gene which acts as repressor or activator, binds to nf-e2 binding sites. Accordingly, utilities of GAM2071 include diagnosis, prevention and treatment of diseases and clinical conditions associated with BACH1.

The function of BACH1 and its association with various diseases and clinical conditions, has been established by previous studies, as described hereinabove with reference to GAM100.1. Bcl2-associated athanogene 5 (BAG5, Accession NP_004864.1) is another GAM2071 target gene, herein designated TARGET GENE. BAG5 BINDING SITE is a target binding site found in the 3' untranslated region of mRNA encoded by BAG5, corresponding to a target binding site such as BINDING SITE I, BINDING SITE II or BINDING SITE III of FIG. 8. Table 4 illustrates the complementarity of the nucleotide sequences of BAG5 BINDING SITE, designated SEQ ID:19878, to the nucleotide sequence of GAM2071 RNA, herein designated GAM RNA, also designated SEQ ID:371.

Another function of GAM2071 is therefore inhibition of Bcl2-associated athanogene 5 (BAG5, Accession NP_004864.1). Accordingly, utilities of GAM2071 include diagnosis, prevention and treatment of diseases and clinical conditions associated with BAG5.

Bai1-associated protein 3 (BAIAP3, Accession NP_003924.2) is another GAM2071 target gene, herein designated TARGET GENE. BAIAP3 BINDING SITE is a target binding site found in the 3' untranslated region of mRNA encoded by BAIAP3, corresponding to a target binding site such as BINDING SITE I, BINDING SITE II or BINDING SITE III of FIG. 8. Table 4 illustrates the complementarity of the nucleotide sequences of BAIAP3 BINDING SITE, designated SEQ ID:14634, to the nucleotide sequence of GAM2071 RNA, herein designated GAM RNA, also designated SEQ ID:371.

Another function of GAM2071 is therefore inhibition of Bai1-associated protein 3 (BAIAP3, Accession NP_003924.2). Accordingly, utilities of GAM2071 include diagnosis, prevention and treatment of diseases and clinical conditions associated with BAIAP3.

B-cell cll/lymphoma 10 (BCL10, Accession NP_003912.1) is another GAM2071 target gene, herein designated TARGET GENE. BCL10 BINDING SITE is a target binding site found in the 3' untranslated region of mRNA encoded by BCL10, corresponding to a target binding site such as BINDING SITE I, BINDING SITE II or BINDING SITE III of FIG. 8. Table 4 illustrates the complementarity of the nucleotide sequences of BCL10 BINDING SITE, designated SEQ ID:17565, to the nucleotide sequence of GAM2071 RNA, herein designated GAM RNA, also designated SEQ ID:371.

Another function of GAM2071 is therefore inhibition of B-cell cll/lymphoma 10 (BCL10, Accession NP_003912.1), a gene which is a positive regulator of lymphocyte proliferation, NF-kappaB activator. and therefore may be associated with Malt lymphoma, follicular lymphoma. Accordingly, utilities of GAM2071 include diagnosis, prevention and treatment of Malt lymphoma, follicular lymphoma, and of other diseases and clinical conditions associated with BCL10.

The function of BCL10 and its association with various diseases and clinical conditions, has been established by previous studies, as described hereinabove with reference to GAM136.1. Bradykinin receptor b1 (BDKRB1, Accession NP_000701.2) is another GAM2071 target gene, herein designated TARGET GENE. BDKRB1 BINDING SITE is a target binding site found in the 5' untranslated region of mRNA encoded by BDKRB1, corresponding to a target binding site such as BINDING SITE I, BINDING SITE II or BINDING SITE III of FIG. 8. Table 4 illustrates the complementarity of the nucleotide sequences of BDKRB1 BINDING SITE, designated SEQ ID:13940, to the nucleotide sequence of GAM2071 RNA, herein designated GAM RNA, also designated SEQ ID:371.

Another function of GAM2071 is therefore inhibition of Bradykinin receptor b1 (BDKRB1, Accession NP_000701.2), a gene which mediates intracellular calcium flux. Accordingly, utilities of GAM2071 include diagnosis, prevention and treatment of diseases and clinical conditions associated with BDKRB1.

The function of BDKRB1 and its association with various diseases and clinical conditions, has been established by previous studies, as described hereinabove with reference to GAM136.1. B double prime 1, subunit of rna polymerase iii transcription initiation factor iiib (BDP1, Accession NP_060899.1) is another GAM2071 target gene, herein designated TARGET GENE. BDP1 BINDING SITE is a target binding site found in the 3' untranslated region of mRNA encoded by BDP1, corresponding to a target binding site such as BINDING SITE I, BINDING SITE II or BINDING SITE III of FIG. 8. Table 4 illustrates the complementarity of the nucleotide sequences of BDP1 BINDING SITE, designated SEQ ID:4304, to the nucleotide sequence of GAM2071 RNA, herein designated GAM RNA, also designated SEQ ID:371.

Another function of GAM2071 is therefore inhibition of B double prime 1, subunit of rna polymerase iii transcription initiation factor iiib (BDP1, Accession NP_060899.1), a gene which activates RNA polymerase III transcription. Accordingly, utilities of GAM2071 include diagnosis, prevention and treatment of diseases and clinical conditions associated with BDP1.

The function of BDP1 and its association with various diseases and clinical conditions, has been established by previous studies, as described hereinabove with reference to GAM146.1. BENE (Accession NP_005425.1) is another GAM2071 target gene, herein designated TARGET GENE. BENE BINDING SITE is a target binding site found in the 3' untranslated region of mRNA encoded by BENE, corresponding to a target binding site such as BINDING SITE I, BINDING SITE II or BINDING SITE III of FIG. 8. Table 4 illustrates the complementarity of the nucleotide sequences of BENE BINDING SITE, designated SEQ ID:3688, to the nucleotide sequence of GAM2071 RNA, herein designated GAM RNA, also designated SEQ ID:371.

Another function of GAM2071 is therefore inhibition of BENE (Accession NP_005425.1). Accordingly, utilities of GAM2071 include diagnosis, prevention and treatment of diseases and clinical conditions associated with BENE.

Bone morphogenetic protein 1 (BMP1, Accession NP_006120.1) is another GAM2071 target gene, herein designated TARGET GENE. BMP1 BINDING SITE is a target binding site found in the 3' untranslated region of multiple transcripts of mRNA encoded by BMP1, corresponding to a target binding site such as BINDING SITE I, BINDING SITE II or BINDING SITE III of FIG. 8. Table 4 illustrates the complementarity of the nucleotide sequences of BMP1 BINDING SITE, designated SEQ ID:769, to the nucleotide sequence of GAM2071 RNA, herein designated GAM RNA, also designated SEQ ID:371.

Another function of GAM2071 is therefore inhibition of Bone morphogenetic protein 1 (BMP1, Accession NP_006120.1), a gene which cleaves procollagens leading to formation of extracellular matrix. Accordingly, utilities of GAM2071 include diagnosis, prevention and treatment of diseases and clinical conditions associated with BMP1.

The function of BMP1 and its association with various diseases and clinical conditions, has been established by previous studies, as described hereinabove with reference to GAM51.1. BNIP-S (Accession NP_612122.1) is another GAM2071 target gene, herein designated TARGET GENE. BNIP-S BINDING SITE is a target binding site found in the 3' untranslated region of multiple transcripts of mRNA encoded by BNIP-S, corresponding to a target binding site such as BINDING SITE I, BINDING SITE II or BINDING SITE III of FIG. 8. Table 4 illustrates the complementarity of the nucleotide sequences of BNIP-S BINDING SITE, designated SEQ ID:17763, to the nucleotide sequence of GAM2071 RNA, herein designated GAM RNA, also designated SEQ ID:371.

Another function of GAM2071 is therefore inhibition of BNIP-S (Accession NP_612122.1). Accordingly, utilities of GAM2071 include diagnosis, prevention and treatment of diseases and clinical conditions associated with BNIP-S.

Butyrophilin, subfamily 3, member a1 (BTN3A1, Accession NP_008979.2) is another GAM2071 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:17858, to the nucleotide sequence of GAM2071 RNA, herein designated GAM RNA, also designated SEQ ID:371.

Another function of GAM2071 is therefore inhibition of Butyrophilin, subfamily 3, member a1 (BTN3A1, Accession NP_008979.2). Accordingly, utilities of GAM2071 include diagnosis, prevention and treatment of diseases and clinical conditions associated with BTN3A1.

BXDC1 (Accession XP_166303.1) is another GAM2071 target gene, herein designated TARGET GENE. BXDC1 BINDING SITE1 and BXDC1 BINDING SITE2 are target binding sites found in untranslated regions of mRNA encoded by BXDC1, corresponding to target binding sites such as BINDING SITE I, BINDING SITE II or BINDING SITE III of FIG. 8. Table 4 illustrates the complementarity of the nucleotide sequences of BXDC1 BINDING SITE1 and BXDC1 BINDING SITE2, designated SEQ ID:711 and SEQ ID:7070 respectively, to the nucleotide sequence of GAM2071 RNA, herein designated GAM RNA, also designated SEQ ID:371.

Another function of GAM2071 is therefore inhibition of BXDC1 (Accession XP_166303.1). Accordingly, utilities of GAM2071 include diagnosis, prevention and treatment of diseases and clinical conditions associated with BXDC1.

BY55 (Accession NP_008984.1) is another GAM2071 target gene, herein designated TARGET GENE. BY55 BINDING SITE is a target binding site found in the 5' untranslated region of mRNA encoded by BY55, corresponding to a target binding site such as BINDING SITE I, BINDING SITE II or BINDING SITE III of FIG. 8. Table 4 illustrates the complementarity of the nucleotide sequences of BY55 BINDING SITE, designated SEQ ID:17712, to the nucleotide sequence of GAM2071 RNA, herein designated GAM RNA, also designated SEQ ID:371.

Another function of GAM2071 is therefore inhibition of BY55 (Accession NP_008984.1). Accordingly, utilities of GAM2071 include diagnosis, prevention and treatment of diseases and clinical conditions associated with BY55.

Chromosome 11 open reading frame 17 (C11orf17, Accession NP_065693.2) is another GAM2071 target gene, herein designated TARGET GENE. C11orf17 BINDING SITE is a target binding site found in the 3' untranslated region of mRNA encoded by C11orf17, corresponding to a target binding site such as BINDING SITE I, BINDING SITE II or BINDING SITE III of FIG. 8. Table 4 illustrates the complementarity of the nucleotide sequences of C11orf17 BINDING SITE, designated SEQ ID:13793, to the nucleotide sequence of GAM2071 RNA, herein designated GAM RNA, also designated SEQ ID:371.

Another function of GAM2071 is therefore inhibition of Chromosome 11 open reading frame 17 (C11orf17, Accession NP_065693.2). Accordingly, utilities of GAM2071 include diagnosis, prevention and treatment of diseases and clinical conditions associated with C11orf17.

Chromosome 11 open reading frame 9 (C11orf9, Accession NP_037411.1) is another GAM2071 target gene, herein designated TARGET GENE. C11orf9 BINDING SITE is a target binding site found in the 3' untranslated region of mRNA encoded by C11orf9, corresponding to a target binding site such as BINDING SITE I, BINDING SITE II or BINDING SITE III of FIG. 8. Table 4 illustrates the complementarity of the nucleotide sequences of C11orf9 BINDING SITE, designated SEQ ID:5710, to the nucleotide sequence of GAM2071 RNA, herein designated GAM RNA, also designated SEQ ID:371.

Another function of GAM2071 is therefore inhibition of Chromosome 11 open reading frame 9 (C11orf9, Accession NP_037411.1). Accordingly, utilities of GAM2071 include diagnosis, prevention and treatment of diseases and clinical conditions associated with C11orf9.

Chromosome 13 open reading frame 1 (C13orf1, Accession NP_065189.1) is another GAM2071 target gene, herein designated TARGET GENE. C13orf1 BINDING SITE is a target binding site found in the 3' untranslated region of mRNA encoded by C13orf1, corresponding to a target binding site such as BINDING SITE I, BINDING SITE II or BINDING SITE III of FIG. 8. Table 4 illustrates the complementarity of the nucleotide sequences of C13orf1 BINDING SITE, designated SEQ ID:2596, to the nucleotide sequence of GAM2071 RNA, herein designated GAM RNA, also designated SEQ ID:371.

Another function of GAM2071 is therefore inhibition of Chromosome 13 open reading frame 1 (C13orf1, Accession NP_065189.1). Accordingly, utilities of GAM2071 include diagnosis, prevention and treatment of diseases and clinical conditions associated with C13orf1.

Chromosome 14 open reading frame 1 (C14orf1, Accession NP_009107.1) is another GAM2071 target gene, herein designated TARGET GENE. C14orf1 BINDING SITE is a target binding site found in the 3' untranslated region of mRNA encoded by C14orf1, corresponding to a target binding site such as BINDING SITE I, BINDING SITE II or BINDING SITE III of FIG. 8. Table 4 illustrates the complementarity of the nucleotide sequences of C14orf1 BINDING SITE, designated SEQ ID:2950, to the nucleotide sequence of GAM2071 RNA, herein designated GAM RNA, also designated SEQ ID:371.

Another function of GAM2071 is therefore inhibition of Chromosome 14 open reading frame 1 (C14orf1, Accession NP_009107.1). Accordingly, utilities of GAM2071 include diagnosis, prevention and treatment of diseases and clinical conditions associated with C14orf1.

C14orf143 (Accession NP_660274.1) is another GAM2071 target gene, herein designated TARGET GENE. C14orf143 BINDING SITE is a target binding site found in the 3' untranslated region of mRNA encoded by C14orf143, corresponding to a target binding site such as BINDING SITE I, BINDING SITE II or BINDING SITE III of FIG. 8. Table 4 illustrates the complementarity of the nucleotide sequences of C14orf143 BINDING SITE, designated SEQ ID:11599, to the nucleotide sequence of GAM2071 RNA, herein designated GAM RNA, also designated SEQ ID:371.

Another function of GAM2071 is therefore inhibition of C14orf143 (Accession NP_660274.1). Accordingly, utilities of GAM2071 include diagnosis, prevention and treatment of diseases and clinical conditions associated with C14orf143.

C14orf92 (Accession NP_055643.1) is another GAM2071 target gene, herein designated TARGET GENE. C14orf92 BINDING SITE is a target binding site found in the 3' untranslated region of mRNA encoded by C14orf92, corresponding to a target binding site such as BINDING SITE I, BINDING SITE II or BINDING SITE III of FIG. 8. Table 4 illustrates the complementarity of the nucleotide sequences of C14orf92 BINDING SITE, designated SEQ ID:18182, to the nucleotide sequence of GAM2071 RNA, herein designated GAM RNA, also designated SEQ ID:371.

Another function of GAM2071 is therefore inhibition of C14orf92 (Accession NP_055643.1). Accordingly, utilities of GAM2071 include diagnosis, prevention and treatment of diseases and clinical conditions associated with C14orf92.

Chromosome 1 open reading frame 24 (C1orf24, Accession NP_443198.1) is another GAM2071 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:601, to the nucleotide sequence of GAM2071 RNA, herein designated GAM RNA, also designated SEQ ID:371.

Another function of GAM2071 is therefore inhibition of Chromosome 1 open reading frame 24 (C1orf24, Accession NP_443198.1). Accordingly, utilities of GAM2071 include diagnosis, prevention and treatment of diseases and clinical conditions associated with C1orf24.

C1q and tumor necrosis factor related protein 6 (C1QTNF6, Accession NP_114116.2) is another GAM2071 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:18746, to the nucleotide sequence of GAM2071 RNA, herein designated GAM RNA, also designated SEQ ID:371.

Another function of GAM2071 is therefore inhibition of C1q and tumor necrosis factor related protein 6 (C1QTNF6, Accession NP_114116.2). Accordingly, utilities of GAM2071 include diagnosis, prevention and treatment of diseases and clinical conditions associated with C1QTNF6.

Chromosome 21 open reading frame 108 (C21orf108, Accession XP_114191.2) is another GAM2071 target gene, herein designated TARGET GENE. C21orf108 BINDING SITE is a target binding site found in the 3' untranslated region of mRNA encoded by C21orf108, corresponding to a target binding site such as BINDING SITE I, BINDING SITE II or BINDING SITE III of FIG. 8. Table 4 illustrates the complementarity of the nucleotide sequences of C21orf108 BINDING SITE, designated SEQ ID:2886, to the nucleotide sequence of GAM2071 RNA, herein designated GAM RNA, also designated SEQ ID:371.

Another function of GAM2071 is therefore inhibition of Chromosome 21 open reading frame 108 (C21orf108, Accession XP_114191.2). Accordingly, utilities of GAM2071 include diagnosis, prevention and treatment of diseases and clinical conditions associated with C21orf108.

Chromosome 22 open reading frame 19 (C22orf19, Accession NP_003669.2) is another GAM2071 target gene, herein designated TARGET GENE. C22orf19 BINDING SITE1 and C22orf19 BINDING SITE2 are target binding sites found in untranslated regions of mRNA encoded by C22orf19, corresponding to target binding sites such as BINDING SITE I, BINDING SITE II or BINDING SITE III of FIG. 8. Table 4 illustrates the complementarity of the nucleotide sequences of C22orf19 BINDING SITE1 and C22orf19 BINDING SITE2, designated SEQ ID:16921 and SEQ ID:14748 respectively, to the nucleotide sequence of GAM2071 RNA, herein designated GAM RNA, also designated SEQ ID:371.

Another function of GAM2071 is therefore inhibition of Chromosome 22 open reading frame 19 (C22orf19, Accession NP_003669.2). Accordingly, utilities of GAM2071 include diagnosis, prevention and treatment of diseases and clinical conditions associated with C22orf19.

C3F (Accession NP_005759.2) is another GAM2071 target gene, herein designated TARGET GENE. C3F BINDING SITE is a target binding site found in the 3' untranslated region of mRNA encoded by C3F, corresponding to a target binding site such as BINDING SITE I, BINDING SITE II or BINDING SITE III of FIG. 8. Table 4 illustrates the complementarity of the nucleotide sequences of C3F BINDING SITE, designated SEQ ID:15743, to the nucleotide sequence of GAM2071 RNA, herein designated GAM RNA, also designated SEQ ID:371.

Another function of GAM2071 is therefore inhibition of C3F (Accession NP_005759.2). Accordingly, utilities of GAM2071 include diagnosis, prevention and treatment of diseases and clinical conditions associated with C3F.

Chromosome 5 open reading frame 4 (C5orf4, Accession NP_115761.1) is another GAM2071 target gene, herein designated TARGET GENE. C5orf4 BINDING SITE is a target binding site found in the 3' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:10925, to the nucleotide sequence of GAM2071 RNA, herein designated GAM RNA, also designated SEQ ID:371.

Another function of GAM2071 is therefore inhibition of Chromosome 5 open reading frame 4 (C5orf4, Accession NP_115761.1). Accordingly, utilities of GAM2071 include diagnosis, prevention and treatment of diseases and clinical conditions associated with C5orf4.

Chromosome 5 open reading frame 4 (C5orf4, Accession NP_057432.1) is another GAM2071 target gene, herein designated TARGET GENE. C5orf4 BINDING SITE is a target binding site found in the 3' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:10925, to the nucleotide sequence of GAM2071 RNA, herein designated GAM RNA, also designated SEQ ID:371.

Another function of GAM2071 is therefore inhibition of Chromosome 5 open reading frame 4 (C5orf4, Accession NP_057432.1). Accordingly, utilities of GAM2071 include diagnosis, prevention and treatment of diseases and clinical conditions associated with C5orf4.

Chromosome 5 open reading frame 7 (C5orf7, Accession NP_057688.1) is another GAM2071 target gene, herein designated TARGET GENE. C5orf7 BINDING SITE is a target binding site found in the 3' untranslated region of mRNA encoded by C5orf7, corresponding to a target binding site such as BINDING SITE I, BINDING SITE II or BINDING SITE III of FIG. 8. Table 4 illustrates the complementarity of the nucleotide sequences of C5orf7 BINDING SITE, designated SEQ ID:7567, to the nucleotide sequence of GAM2071 RNA, herein designated GAM RNA, also designated SEQ ID:371.

Another function of GAM2071 is therefore inhibition of Chromosome 5 open reading frame 7 (C5orf7, Accession NP_057688.1). Accordingly, utilities of GAM2071 include diagnosis, prevention and treatment of diseases and clinical conditions associated with C5orf7.

C6orf141 (Accession NP_699175.1) is another GAM2071 target gene, herein designated TARGET GENE. C6orf141 BINDING SITE is a target binding site found in the 3' untranslated region of mRNA encoded by C6orf141, corresponding to a target binding site such as BINDING SITE I, BINDING SITE II or BINDING SITE III of FIG. 8. Table 4 illustrates the complementarity of the nucleotide sequences of C6orf141 BINDING SITE, designated SEQ ID:12169, to the nucleotide sequence of GAM2071 RNA, herein designated GAM RNA, also designated SEQ ID:371.

Another function of GAM2071 is therefore inhibition of C6orf141 (Accession NP_699175.1). Accordingly, utilities of GAM2071 include diagnosis, prevention and treatment of diseases and clinical conditions associated with C6orf141.

Chromosome 6 open reading frame 33 (C6orf33, Accession NP_588608.1) is another GAM2071 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:7278, to the nucleotide sequence of GAM2071 RNA, herein designated GAM RNA, also designated SEQ ID:371.

Another function of GAM2071 is therefore inhibition of Chromosome 6 open reading frame 33 (C6orf33, Accession NP_588608.1). Accordingly, utilities of GAM2071 include diagnosis, prevention and treatment of diseases and clinical conditions associated with C6orf33.

C6orf5 (Accession NP_056339.2) is another GAM2071 target gene, herein designated TARGET GENE. C6orf5 BINDING SITE is a target binding site found in the 3' untranslated region of mRNA encoded by C6orf5, corresponding to a target binding site such as BINDING SITE I, BINDING SITE II or BINDING SITE III of FIG. 8. Table 4 illustrates the complementarity of the nucleotide sequences of C6orf5 BINDING SITE, designated SEQ ID:10778, to the nucleotide sequence of GAM2071 RNA, herein designated GAM RNA, also designated SEQ ID:371.

Another function of GAM2071 is therefore inhibition of C6orf5 (Accession NP_056339.2). Accordingly, utilities of GAM2071 include diagnosis, prevention and treatment of diseases and clinical conditions associated with C6orf5.

C6orf57 (Accession NP_660310.1) is another GAM2071 target gene, herein designated TARGET GENE. C6orf57 BINDING SITE is a target binding site found in the 3' untranslated region of mRNA encoded by C6orf57, corresponding to a target binding site such as BINDING SITE I, BINDING SITE II or BINDING SITE III of FIG. 8. Table 4 illustrates the complementarity of the nucleotide sequences of C6orf57 BINDING SITE, designated SEQ ID:6442, to the nucleotide sequence of GAM2071 RNA, herein designated GAM RNA, also designated SEQ ID:371.

Another function of GAM2071 is therefore inhibition of C6orf57 (Accession NP_660310.1). Accordingly, utilities of GAM2071 include diagnosis, prevention and treatment of diseases and clinical conditions associated with C6orf57.

Chromosome 9 open reading frame 9 (C9orf9, Accession NP_061829.2) is another GAM2071 target gene, herein designated TARGET GENE. C9orf9 BINDING SITE1 and C9orf9 BINDING SITE2 are target binding sites found in untranslated regions of mRNA encoded by C9orf9, corresponding to target binding sites such as BINDING SITE I, BINDING SITE II or BINDING SITE III of FIG. 8. Table 4 illustrates the complementarity of the nucleotide sequences of C9orf9 BINDING SITE1 and C9orf9 BINDING SITE2, designated SEQ ID:13797 and SEQ ID:19273 respectively, to the nucleotide sequence of GAM2071 RNA, herein designated GAM RNA, also designated SEQ ID:371.

Another function of GAM2071 is therefore inhibition of Chromosome 9 open reading frame 9 (C9orf9, Accession NP_061829.2). Accordingly, utilities of GAM2071 include diagnosis, prevention and treatment of diseases and clinical conditions associated with C9orf9.

Carbonic anhydrase va, mitochondrial (CA5A, Accession NP_001730.1) is another GAM2071 target gene, herein designated TARGET GENE. CA5A BINDING SITE is a target binding site found in the 5' untranslated region of mRNA encoded by CA5A, corresponding to a target binding site such as BINDING SITE I, BINDING SITE II or BINDING SITE III of FIG. 8. Table 4 illustrates the complementarity of the nucleotide sequences of CA5A BINDING SITE, designated SEQ ID:6692, to the nucleotide sequence of GAM2071 RNA, herein designated GAM RNA, also designated SEQ ID:371.

Another function of GAM2071 is therefore inhibition of Carbonic anhydrase va, mitochondrial (CA5A, Accession NP_001730.1). Accordingly, utilities of GAM2071 include diagnosis, prevention and treatment of diseases and clinical conditions associated with CA5A.

Caspase 8, apoptosis-related cysteine protease (CASP8, Accession NP_203519.1) is another GAM2071 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:9100, to the nucleotide sequence of GAM2071 RNA, herein designated GAM RNA, also designated SEQ ID:371.

Another function of GAM2071 is therefore inhibition of Caspase 8, apoptosis-related cysteine protease (CASP8, Accession NP_203519.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM2071 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203520.1) is another GAM2071 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:9100, to the nucleotide sequence of GAM2071 RNA, herein designated GAM RNA, also designated SEQ ID:371.

Another function of GAM2071 is therefore inhibition of Caspase 8, apoptosis-related cysteine protease (CASP8, Accession NP_203520.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM2071 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_001219.2) is another GAM2071 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:9100, to the nucleotide sequence of GAM2071 RNA, herein designated GAM RNA, also designated SEQ ID:371.

Another function of GAM2071 is therefore inhibition of Caspase 8, apoptosis-related cysteine protease (CASP8, Accession NP_001219.2), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM2071 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203521.1) is another GAM2071 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:9100, to the nucleotide sequence of GAM2071 RNA, herein designated GAM RNA, also designated SEQ ID:371.

Another function of GAM2071 is therefore inhibition of Caspase 8, apoptosis-related cysteine protease (CASP8, Accession NP_203521.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM2071 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Core-binding factor, runt domain, alpha subunit 2; translocated to, 2 (CBFA2T2, Accession NP_005084.1) is another GAM2071 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:3868, to the nucleotide sequence of GAM2071 RNA, herein designated GAM RNA, also designated SEQ ID:371.

Another function of GAM2071 is therefore inhibition of Core-binding factor, runt domain, alpha subunit 2; translocated to, 2 (CBFA2T2, Accession NP_005084.1), a gene which is a putative transcription factor. Accordingly, utilities of GAM2071 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Core-binding factor, runt domain, alpha subunit 2; translocated to, 2 (CBFA2T2, Accession NP_787060.1) is another GAM2071 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:3868, to the nucleotide sequence of GAM2071 RNA, herein designated GAM RNA, also designated SEQ ID:371.

Another function of GAM2071 is therefore inhibition of Core-binding factor, runt domain, alpha subunit 2; translocated to, 2 (CBFA2T2, Accession NP_787060.1), a gene which is a putative transcription factor. Accordingly, utilities of GAM2071 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Chemokine (c-c motif) ligand 16 (CCL16, Accession NP_004581.1) is another GAM2071 target gene, herein designated TARGET GENE. CCL16 BINDING SITE is a target binding site found in the 3' untranslated region of mRNA encoded by CCL16, corresponding to a target binding site such as BINDING SITE I, BINDING SITE II or BINDING SITE III of FIG. 8. Table 4 illustrates the complementarity of the nucleotide sequences of CCL16 BINDING SITE, designated SEQ ID:10633, to the nucleotide sequence of GAM2071 RNA, herein designated GAM RNA, also designated SEQ ID:371.

Another function of GAM2071 is therefore inhibition of Chemokine (c-c motif) ligand 16 (CCL16, Accession NP_004581.1). Accordingly, utilities of GAM2071 include diagnosis, prevention and treatment of diseases and clinical conditions associated with CCL16.

Chemokine (c-c motif) ligand 22 (CCL22, Accession NP_002981.2) is another GAM2071 target gene, herein designated TARGET GENE. CCL22 BINDING SITE1 and CCL22 BINDING SITE2 are target binding sites found in untranslated regions of mRNA encoded by CCL22, corresponding to target binding sites such as BINDING SITE I, BINDING SITE II or BINDING SITE III of FIG. 8. Table 4 illustrates the complementarity of the nucleotide sequences of CCL22 BINDING SITE1 and CCL22 BINDING SITE2, designated SEQ ID:16005 and SEQ ID:11649 respectively, to the nucleotide sequence of GAM2071 RNA, herein designated GAM RNA, also designated SEQ ID:371.

Another function of GAM2071 is therefore inhibition of Chemokine (c-c motif) ligand 22 (CCL22, Accession NP_002981.2). Accordingly, utilities of GAM2071 include diagnosis, prevention and treatment of diseases and clinical conditions associated with CCL22.

Cyclin f (CCNF, Accession NP_001752.1) is another GAM2071 target gene, herein designated TARGET GENE. CCNF BINDING SITE is a target binding site found in the 3' untranslated region of mRNA encoded by CCNF, corresponding to a target binding site such as BINDING SITE I, BINDING SITE II or BINDING SITE III of FIG. 8. Table 4 illustrates the complementarity of the nucleotide sequences of CCNF BINDING SITE, designated SEQ ID:14395, to the nucleotide sequence of GAM2071 RNA, herein designated GAM RNA, also designated SEQ ID:371.

Another function of GAM2071 is therefore inhibition of Cyclin f (CCNF, Accession NP_001752.1), a gene which likely to be involved in the control of the cell cycle during s phase and g2. Accordingly, utilities of GAM2071 include diagnosis, prevention and treatment of diseases and clinical conditions associated with CCNF.

The function of CCNF and its association with various diseases and clinical conditions, has been established by previous studies, as described hereinabove with reference to GAM130.1. Chemokine (c-c motif) receptor 5 (CCR5, Accession NP_000570.1) is another GAM2071 target gene, herein designated TARGET GENE. CCR5 BINDING SITE is a target binding site found in the 3' untranslated region of mRNA encoded by CCR5, corresponding to a target binding site such as BINDING SITE I, BINDING SITE II or BINDING SITE III of FIG. 8. Table 4 illustrates the complementarity of the nucleotide sequences of CCR5 BINDING SITE, designated SEQ ID:17905, to the nucleotide sequence of GAM2071 RNA, herein designated GAM RNA, also designated SEQ ID:371.

Another function of GAM2071 is therefore inhibition of Chemokine (c-c motif) receptor 5 (CCR5, Accession NP_000570.1). Accordingly, utilities of GAM2071 include diagnosis, prevention and treatment of diseases and clinical conditions associated with CCR5.

Cd209 antigen (CD209, Accession NP_066978.1) is another GAM2071 target gene, herein designated TARGET GENE. CD209 BINDING SITE is a target binding site found in the 3' untranslated region of mRNA encoded by CD209, corresponding to a target binding site such as BINDING SITE I, BINDING SITE II or BINDING SITE III of FIG. 8. Table 4 illustrates the complementarity of the nucleotide sequences of CD209 BINDING SITE, designated SEQ ID:8229, to the nucleotide sequence of GAM2071 RNA, herein designated GAM RNA, also designated SEQ ID:371.

Another function of GAM2071 is therefore inhibition of Cd209 antigen (CD209, Accession NP_066978.1), a gene which may play an important role in the CD4-independent association of HIV with cells. Accordingly, utilities of GAM2071 include diagnosis, prevention and treatment of diseases and clinical conditions associated with CD209.

The function of CD209 and its association with various diseases and clinical conditions, has been established by previous studies, as described hereinabove with reference to GAM96.1. Cd24 antigen (small cell lung carcinoma cluster 4 antigen) (CD24, Accession NP_037362.1) is another GAM2071 target gene, herein designated TARGET GENE. CD24 BINDING SITE is a target binding site found in the 3' untranslated region of mRNA encoded by CD24, corresponding to a target binding site such as BINDING SITE I, BINDING SITE II or BINDING SITE III of FIG. 8. Table 4 illustrates the complementarity of the nucleotide sequences of CD24 BINDING SITE, designated SEQ ID:18593, to the nucleotide sequence of GAM2071 RNA, herein designated GAM RNA, also designated SEQ ID:371.

Another function of GAM2071 is therefore inhibition of Cd24 antigen (small cell lung carcinoma cluster 4 antigen) (CD24, Accession NP_037362.1). Accordingly, utilities of GAM2071 include diagnosis, prevention and treatment of diseases and clinical conditions associated with CD24.

Cdc14 cell division cycle 14 homolog b (s. cerevisiae) (CDC14B, Accession NP_201589.1) is another GAM2071 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:7919, to the nucleotide sequence of GAM2071 RNA, herein designated GAM RNA, also designated SEQ ID:371.

Another function of GAM2071 is therefore inhibition of Cdc14 cell division cycle 14 homolog b (s. cerevisiae) (CDC14B, Accession NP_201589.1). Accordingly, utilities of GAM2071 include diagnosis, prevention and treatment of diseases and clinical conditions associated with CDC14B.

Cell division cycle 2-like 2 (CDC2L2, Accession NP_296370.1) is another GAM2071 target gene, herein designated TARGET GENE. CDC2L2 BINDING SITE is a target binding site found in the 5' untranslated region of multiple transcripts of mRNA encoded by CDC2L2, corresponding to a target binding site such as BINDING SITE I, BINDING SITE II or BINDING SITE III of FIG. 8. Table 4 illustrates the complementarity of the nucleotide sequences of CDC2L2 BINDING SITE, designated SEQ ID:8250, to the nucleotide sequence of GAM2071 RNA, herein designated GAM RNA, also designated SEQ ID:371.

Another function of GAM2071 is therefore inhibition of Cell division cycle 2-like 2 (CDC2L2, Accession NP_296370.1). Accordingly, utilities of GAM2071 include diagnosis, prevention and treatment of diseases and clinical conditions associated with CDC2L2.

CDCP1 (Accession NP_073753.3) is another GAM2071 target gene, herein designated TARGET GENE. CDCP1 BINDING SITE is a target binding site found in the 3' untranslated region of multiple transcripts of mRNA encoded by CDCP1, corresponding to a target binding site such as BINDING SITE I, BINDING SITE II or BINDING SITE III of FIG. 8. Table 4 illustrates the complementarity of the nucleotide sequences of CDCP1 BINDING SITE, designated SEQ ID:20095, to the nucleotide sequence of GAM2071 RNA, herein designated GAM RNA, also designated SEQ ID:371.

Another function of GAM2071 is therefore inhibition of CDCP1 (Accession NP_073753.3). Accordingly, utilities of GAM2071 include diagnosis, prevention and treatment of diseases and clinical conditions associated with CDCP1.

Cadherin 1, type 1, e-cadherin (epithelial) (CDH1, Accession NP_004351.1) is another GAM2071 target gene, herein designated TARGET GENE. CDH1 BINDING SITE is a target binding site found in the 3' untranslated region of mRNA encoded by CDH1, corresponding to a target binding site such as BINDING SITE I, BINDING SITE II or BINDING SITE III of FIG. 8. Table 4 illustrates the complementarity of the nucleotide sequences of CDH1 BINDING SITE, designated SEQ ID:3667, to the nucleotide sequence of GAM2071 RNA, herein designated GAM RNA, also designated SEQ ID:371.

Another function of GAM2071 is therefore inhibition of Cadherin 1, type 1, e-cadherin (epithelial) (CDH1, Accession NP_004351.1). Accordingly, utilities of GAM2071 include diagnosis, prevention and treatment of diseases and clinical conditions associated with CDH1.

CDK11 (Accession XP_166324.1) is another GAM2071 target gene, herein designated TARGET GENE. CDK11 BINDING SITE is a target binding site found in the 3' untranslated region of multiple transcripts of mRNA encoded by CDK11, corresponding to a target binding site such as BINDING SITE I, BINDING SITE II or BINDING SITE III of FIG. 8. Table 4 illustrates the complementarity of the nucleotide sequences of CDK11 BINDING SITE, designated SEQ ID:5408, to the nucleotide sequence of GAM2071 RNA, herein designated GAM RNA, also designated SEQ ID:371.

Another function of GAM2071 is therefore inhibition of CDK11 (Accession XP_166324.1). Accordingly, utilities of GAM2071 include diagnosis, prevention and treatment of diseases and clinical conditions associated with CDK11.

CDKAL1 (Accession NP_060244.1) is another GAM2071 target gene, herein designated TARGET GENE. CDKAL1 BINDING SITE is a target binding site found in the 3' untranslated region of mRNA encoded by CDKAL1, corresponding to a target binding site such as BINDING SITE I, BINDING SITE II or BINDING SITE III of FIG. 8. Table 4 illustrates the complementarity of the nucleotide sequences of CDKAL1 BINDING SITE, designated SEQ ID:12153, to the nucleotide sequence of GAM2071 RNA, herein designated GAM RNA, also designated SEQ ID:371.

Another function of GAM2071 is therefore inhibition of CDKAL1 (Accession NP_060244.1). Accordingly, utilities of GAM2071 include diagnosis, prevention and treatment of diseases and clinical conditions associated with CDKAL1.

Carcinoembryonic antigen-related cell adhesion molecule 8 (CEACAM8, Accession NP_001807.2) is another GAM2071 target gene, herein designated TARGET GENE. CEACAM8 BINDING SITE is a target binding site found in the 3' untranslated region of mRNA encoded by CEACAM8, corresponding to a target binding site such as BINDING SITE I, BINDING SITE II or BINDING SITE III of FIG. 8. Table 4 illustrates the complementarity of the nucleotide sequences of CEACAM8 BINDING SITE, designated SEQ ID:436, to the nucleotide sequence of GAM2071 RNA, herein designated GAM RNA, also designated SEQ ID:371.

Another function of GAM2071 is therefore inhibition of Carcinoembryonic antigen-related cell adhesion molecule 8 (CEACAM8, Accession NP_001807.2). Accordingly, utilities of GAM2071 include diagnosis, prevention and treatment of diseases and clinical conditions associated with CEACAM8.

Centromere protein h (CENPH, Accession NP_075060.1) is another GAM2071 target gene, herein designated TARGET GENE. CENPH BINDING SITE is a target binding site found in the 3' untranslated region of mRNA encoded by CENPH, corresponding to a target binding site such as BINDING SITE I, BINDING SITE II or BINDING SITE III of FIG. 8. Table 4 illustrates the complementarity of the nucleotide sequences of CENPH BINDING SITE, designated SEQ ID:7835, to the nucleotide sequence of GAM2071 RNA, herein designated GAM RNA, also designated SEQ ID:371.

Another function of GAM2071 is therefore inhibition of Centromere protein h (CENPH, Accession NP_075060.1). Accordingly, utilities of GAM2071 include diagnosis, prevention and treatment of diseases and clinical conditions associated with CENPH.

CGI-150 (Accession NP_057164.1) is another GAM2071 target gene, herein designated TARGET GENE. CGI-150 BINDING SITE is a target binding site found in the 5' untranslated region of mRNA encoded by CGI-150, corresponding to a target binding site such as BINDING SITE I, BINDING SITE II or BINDING SITE III of FIG. 8. Table 4 illustrates the complementarity of the nucleotide sequences of CGI-150 BINDING SITE, designated SEQ ID:19951, to the nucleotide sequence of GAM2071 RNA, herein designated GAM RNA, also designated SEQ ID:371.

Another function of GAM2071 is therefore inhibition of CGI-150 (Accession NP_057164.1). Accordingly, utilities of GAM2071 include diagnosis, prevention and treatment of diseases and clinical conditions associated with CGI-150.

Cold autoinflammatory syndrome 1 (CIAS1, Accession NP_004886.2) is another GAM2071 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:7985, to the nucleotide sequence of GAM2071 RNA, herein designated GAM RNA, also designated SEQ ID:371.

Another function of GAM2071 is therefore inhibition of Cold autoinflammatory syndrome 1 (CIAS1, Accession NP_004886.2), a gene which may mediate protein-protein interactions; contains a leucine rich repeat and therefore may be associated with Familial cold autoinflammatory syndrome, muckle-wells syndrome. Accordingly, utilities of GAM2071 include diagnosis, prevention and treatment of Familial cold autoinflammatory syndrome, muckle-wells syndrome, and of other diseases and clinical conditions associated with CIAS1.

The function of CIAS1 and its association with various diseases and clinical conditions, has been established by previous studies, as described hereinabove with reference to GAM90.1. CIP29 (Accession NP_115740.3) is another GAM2071 target gene, herein designated TARGET GENE. CIP29 BINDING SITE is a target binding site found in the 3' untranslated region of mRNA encoded by CIP29, corresponding to a target binding site such as BINDING SITE I, BINDING SITE II or BINDING SITE III of FIG. 8. Table 4 illustrates the complementarity of the nucleotide sequences of CIP29 BINDING SITE, designated SEQ ID:11639, to the nucleotide sequence of GAM2071 RNA, herein designated GAM RNA, also designated SEQ ID:371.

Another function of GAM2071 is therefore inhibition of CIP29 (Accession NP_115740.3). Accordingly, utilities of GAM2071 include diagnosis, prevention and treatment of diseases and clinical conditions associated with CIP29.

C-type (calcium dependent, carbohydrate-recognition domain) lectin, superfamily member 12 (CLECSF12, Accession NP_072092.2) is another GAM2071 target gene, herein designated TARGET GENE. CLECSF12 BINDING SITE is a target binding site found in the 3' untranslated region of mRNA encoded by CLECSF12, corresponding to a target binding site such as BINDING SITE I, BINDING SITE II or BINDING SITE III of FIG. 8. Table 4 illustrates the complementarity of the nucleotide sequences of CLECSF12 BINDING SITE, designated SEQ ID:10233, to the nucleotide sequence of GAM2071 RNA, herein designated GAM RNA, also designated SEQ ID:371.

Another function of GAM2071 is therefore inhibition of C-type (calcium dependent, carbohydrate-recognition domain) lectin, superfamily member 12 (CLECSF12, Accession NP_072092.2), a gene which is a pattern- recognition receptor . Accordingly, utilities of GAM2071 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. Chloride channel, nucleotide-sensitive, 1a (CLNS1A, Accession NP_001284.1) is another GAM2071 target gene, herein designated TARGET GENE. CLNS1A BINDING SITE is a target binding site found in the 3' untranslated region of mRNA encoded by CLNS1A, corresponding to a target binding site such as BINDING SITE I, BINDING SITE II or BINDING SITE III of FIG. 8. Table 4 illustrates the complementarity of the nucleotide sequences of CLNS1A BINDING SITE, designated SEQ ID:8322, to the nucleotide sequence of GAM2071 RNA, herein designated GAM RNA, also designated SEQ ID:371.

Another function of GAM2071 is therefore inhibition of Chloride channel, nucleotide-sensitive, 1a (CLNS1A, Accession NP_001284.1), a gene which may participate in cellular volume control. Accordingly, utilities of GAM2071 include diagnosis, prevention and treatment of diseases and clinical conditions associated with CLNS1A.

The function of CLNS1A and its association with various diseases and clinical conditions, has been established by previous studies, as described hereinabove with reference to GAM96.1. Cell matrix adhesion regulator (CMAR, Accession NP_005191.2) is another GAM2071 target gene, herein designated TARGET GENE. CMAR BINDING SITE is a target binding site found in the 5' untranslated region of mRNA encoded by CMAR, corresponding to a target binding site such as BINDING SITE I, BINDING SITE II or BINDING SITE III of FIG. 8. Table 4 illustrates the complementarity of the nucleotide sequences of CMAR BINDING SITE, designated SEQ ID:19999, to the nucleotide sequence of GAM2071 RNA, herein designated GAM RNA, also designated SEQ ID:371.

Another function of GAM2071 is therefore inhibition of Cell matrix adhesion regulator (CMAR, Accession NP_005191.2). Accordingly, utilities of GAM2071 include diagnosis, prevention and treatment of diseases and clinical conditions associated with CMAR.

Calponin 2 (CNN2, Accession NP_004359.1) is another GAM2071 target gene, herein designated TARGET GENE. CNN2 BINDING SITE is a target binding site found in the 3' untranslated region of mRNA encoded by CNN2, corresponding to a target binding site such as BINDING SITE I, BINDING SITE II or BINDING SITE III of FIG. 8. Table 4 illustrates the complementarity of the nucleotide sequences of CNN2 BINDING SITE, designated SEQ ID:6909, to the nucleotide sequence of GAM2071 RNA, herein designated GAM RNA, also designated SEQ ID:371.

Another function of GAM2071 is therefore inhibition of Calponin 2 (CNN2, Accession NP_004359.1), a gene which may be involved in the structural organization and/or anchorage of actin filaments. Accordingly, utilities of GAM2071 include diagnosis, prevention and treatment of diseases and clinical conditions associated with CNN2.

The function of CNN2 and its association with various diseases and clinical conditions, has been established by previous studies, as described hereinabove with reference to GAM136.1. Cyclin m3 (CNNM3, Accession NP_060093.2) is another GAM2071 target gene, herein designated TARGET GENE. CNNM3 BINDING SITE is a target binding site found in the 3' untranslated region of mRNA encoded by CNNM3, corresponding to a target binding site such as BINDING SITE I, BINDING SITE II or BINDING SITE III of FIG. 8. Table 4 illustrates the complementarity of the nucleotide sequences of CNNM3 BINDING SITE, designated SEQ ID:3981, to the nucleotide sequence of GAM2071 RNA, herein designated GAM RNA, also designated SEQ ID:371.

Another function of GAM2071 is therefore inhibition of Cyclin m3 (CNNM3, Accession NP_060093.2). Accordingly, utilities of GAM2071 include diagnosis, prevention and treatment of diseases and clinical conditions associated with CNNM3.

2',3'-cyclic nucleotide 3' phosphodiesterase (CNP, Accession NP__149124.1) is another GAM2071 target gene, herein designated TARGET GENE. CNP BINDING SITE is a target binding site found in the 3' untranslated region of mRNA encoded by CNP, corresponding to a target binding site such as BINDING SITE I, BINDING SITE II or BINDING SITE III of FIG. 8. Table 4 illustrates the complementarity of the nucleotide sequences of CNP BINDING SITE, designated SEQ ID:5014, to the nucleotide sequence of GAM2071 RNA, herein designated GAM RNA, also designated SEQ ID:371.

Another function of GAM2071 is therefore inhibition of 2',3'-cyclic nucleotide 3' phosphodiesterase (CNP, Accession NP__149124.1), a gene which can link tubulin to membranes and may regulate cytoplasmic microtubule distribution. Accordingly, utilities of GAM2071 include diagnosis, prevention and treatment of diseases and clinical conditions associated with CNP.

The function of CNP and its association with various diseases and clinical conditions, has been established by previous studies, as described hereinabove with reference to GAM189.1. Collectin sub-family member 12 (COLEC12, Accession NP__110408.2) is another GAM2071 target gene, herein designated TARGET GENE. COLEC12 BINDING SITE is a target binding site found in the 3' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:13793, to the nucleotide sequence of GAM2071 RNA, herein designated GAM RNA, also designated SEQ ID:371.

Another function of GAM2071 is therefore inhibition of Collectin sub-family member 12 (COLEC12, Accession NP__110408.2). Accordingly, utilities of GAM2071 include diagnosis, prevention and treatment of diseases and clinical conditions associated with COLEC12.

Cop9 constitutive photomorphogenic homolog subunit 7a (arabidopsis) (COPS7A, Accession NP__057403.1) is another GAM2071 target gene, herein designated TARGET GENE. COPS7A BINDING SITE is a target binding site found in the 5' untranslated region of mRNA encoded by COPS7A, corresponding to a target binding site such as BINDING SITE I, BINDING SITE II or BINDING SITE III of FIG. 8. Table 4 illustrates the complementarity of the nucleotide sequences of COPS7A BINDING SITE, designated SEQ ID:5715, to the nucleotide sequence of GAM2071 RNA, herein designated GAM RNA, also designated SEQ ID:371.

Another function of GAM2071 is therefore inhibition of Cop9 constitutive photomorphogenic homolog subunit 7a (arabidopsis) (COPS7A, Accession NP__057403.1). Accordingly, utilities of GAM2071 include diagnosis, prevention and treatment of diseases and clinical conditions associated with COPS7A.

CPR8 (Accession NP__065790.1) is another GAM2071 target gene, herein designated TARGET GENE. CPR8 BINDING SITE is a target binding site found in the 3' untranslated region of multiple transcripts of mRNA encoded by CPR8, corresponding to a target binding site such as BINDING SITE I, BINDING SITE II or BINDING SITE III of FIG. 8. Table 4 illustrates the complementarity of the nucleotide sequences of CPR8 BINDING SITE, designated SEQ ID:9163, to the nucleotide sequence of GAM2071 RNA, herein designated GAM RNA, also designated SEQ ID:371.

Another function of GAM2071 is therefore inhibition of CPR8 (Accession NP__065790.1). Accordingly, utilities of GAM2071 include diagnosis, prevention and treatment of diseases and clinical conditions associated with CPR8.

Carbamoyl-phosphate synthetase 1, mitochondrial (CPS1, Accession NP__001866.2) is another GAM2071 target gene, herein designated TARGET GENE. CPS1 BINDING SITE is a target binding site found in the 3' untranslated region of mRNA encoded by CPS1, corresponding to a target binding site such as BINDING SITE I, BINDING SITE II or BINDING SITE III of FIG. 8. Table 4 illustrates the complementarity of the nucleotide sequences of CPS1 BINDING SITE, designated SEQ ID:4147, to the nucleotide sequence of GAM2071 RNA, herein designated GAM RNA, also designated SEQ ID:371.

Another function of GAM2071 is therefore inhibition of Carbamoyl-phosphate synthetase 1, mitochondrial (CPS1, Accession NP__001866.2) . Accordingly, utilities of GAM2071 include diagnosis, prevention and treatment of diseases and clinical conditions associated with CPS1.

Cleavage and polyadenylation specific factor 2, 100 kda (CPSF2, Accession XP__029311.2) is another GAM2071 target gene, herein designated TARGET GENE. CPSF2 BINDING SITE1 and CPSF2 BINDING SITE2 are target binding sites found in untranslated regions of mRNA encoded by CPSF2, corresponding to target binding sites such as BINDING SITE I, BINDING SITE II or BINDING SITE III of FIG. 8. Table 4 illustrates the complementarity of the nucleotide sequences of CPSF2 BINDING SITE1 and CPSF2 BINDING SITE2, designated SEQ ID:6739 and SEQ ID:6347 respectively, to the nucleotide sequence of GAM2071 RNA, herein designated GAM RNA, also designated SEQ ID:371.

Another function of GAM2071 is therefore inhibition of Cleavage and polyadenylation specific factor 2, 100 kda (CPSF2, Accession XP__029311.2). Accordingly, utilities of GAM2071 include diagnosis, prevention and treatment of diseases and clinical conditions associated with CPSF2.

Complement component (3b/4b) receptor 1, including knops blood group system (CR1, Accession NP__000642.2) is another GAM2071 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:13868, to the nucleotide sequence of GAM2071 RNA, herein designated GAM RNA, also designated SEQ ID:371.

Another function of GAM2071 is therefore inhibition of Complement component (3b/4b) receptor 1, including knops blood group system (CR1, Accession NP__000642.2). Accordingly, utilities of GAM2071 include diagnosis, prevention and treatment of diseases and clinical conditions associated with CR1.

Complement component (3b/4b) receptor 1, including knops blood group system (CR1, Accession NP__000564.1) is another GAM2071 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:13868, to the nucleotide sequence of GAM2071 RNA, herein designated GAM RNA, also designated SEQ ID:371.

Another function of GAM2071 is therefore inhibition of Complement component (3b/4b) receptor 1, including knops blood group system (CR1, Accession NP_000564.1). Accordingly, utilities of GAM2071 include diagnosis, prevention and treatment of diseases and clinical conditions associated with CR1.

Cytokine receptor-like factor 3 (CRLF3, Accession NP_057070.2) is another GAM2071 target gene, herein designated TARGET GENE. CRLF3 BINDING SITE is a target binding site found in the 3' untranslated region of mRNA encoded by CRLF3, corresponding to a target binding site such as BINDING SITE I, BINDING SITE II or BINDING SITE III of FIG. 8. Table 4 illustrates the complementarity of the nucleotide sequences of CRLF3 BINDING SITE, designated SEQ ID:9675, to the nucleotide sequence of GAM2071 RNA, herein designated GAM RNA, also designated SEQ ID:371.

Another function of GAM2071 is therefore inhibition of Cytokine receptor-like factor 3 (CRLF3, Accession NP_057070.2). Accordingly, utilities of GAM2071 include diagnosis, prevention and treatment of diseases and clinical conditions associated with CRLF3.

Cofactor required for sp1 transcriptional activation, subunit 6, 77 kda (CRSP6, Accession NP_004259.3) is another GAM2071 target gene, herein designated TARGET GENE. CRSP6 BINDING SITE is a target binding site found in the 3' untranslated region of mRNA encoded by CRSP6, corresponding to a target binding site such as BINDING SITE I, BINDING SITE II or BINDING SITE III of FIG. 8. Table 4 illustrates the complementarity of the nucleotide sequences of CRSP6 BINDING SITE, designated SEQ ID:12005, to the nucleotide sequence of GAM2071 RNA, herein designated GAM RNA, also designated SEQ ID:371.

Another function of GAM2071 is therefore inhibition of Cofactor required for sp1 transcriptional activation, subunit 6, 77 kda (CRSP6, Accession NP_004259.3), a gene which is required for Sp1 mediated transcriptional activation with TAF (II)s. Accordingly, utilities of GAM2071 include diagnosis, prevention and treatment of diseases and clinical conditions associated with CRSP6.

The function of CRSP6 and its association with various diseases and clinical conditions, has been established by previous studies, as described hereinabove with reference to GAM189.1. CSE-C (Accession NP_061851.1) is another GAM2071 target gene, herein designated TARGET GENE. CSE-C BINDING SITE is a target binding site found in the 5' untranslated region of multiple transcripts of mRNA encoded by CSE-C, corresponding to a target binding site such as BINDING SITE I, BINDING SITE II or BINDING SITE III of FIG. 8. Table 4 illustrates the complementarity of the nucleotide sequences of CSE-C BINDING SITE, designated SEQ ID:2336, to the nucleotide sequence of GAM2071 RNA, herein designated GAM RNA, also designated SEQ ID:371.

Another function of GAM2071 is therefore inhibition of CSE-C (Accession NP_061851.1). Accordingly, utilities of GAM2071 include diagnosis, prevention and treatment of diseases and clinical conditions associated with CSE-C.

Cse1 chromosome segregation 1-like (yeast) (CSE1L, Accession NP_803185.1) is another GAM2071 target gene, herein designated TARGET GENE. CSE1L BINDING SITE is a target binding site found in the 3' untranslated region of multiple transcripts of mRNA encoded by CSE1L, corresponding to a target binding site such as BINDING SITE I, BINDING SITE II or BINDING SITE III of FIG. 8. Table 4 illustrates the complementarity of the nucleotide sequences of CSE1L BINDING SITE, designated SEQ ID:3997, to the nucleotide sequence of GAM2071 RNA, herein designated GAM RNA, also designated SEQ ID:371.

Another function of GAM2071 is therefore inhibition of Cse1 chromosome segregation 1-like (yeast) (CSE1L, Accession NP_803185.1). Accordingly, utilities of GAM2071 include diagnosis, prevention and treatment of diseases and clinical conditions associated with CSE1L.

Calsenilin, presenilin binding protein, ef hand transcription factor (CSEN, Accession NP_038462.1) is another GAM2071 target gene, herein designated TARGET GENE. CSEN BINDING SITE is a target binding site found in the 3' untranslated region of mRNA encoded by CSEN, corresponding to a target binding site such as BINDING SITE I, BINDING SITE II or BINDING SITE III of FIG. 8. Table 4 illustrates the complementarity of the nucleotide sequences of CSEN BINDING SITE, designated SEQ ID:14933, to the nucleotide sequence of GAM2071 RNA, herein designated GAM RNA, also designated SEQ ID:371.

Another function of GAM2071 is therefore inhibition of Calsenilin, presenilin binding protein, ef hand transcription factor (CSEN, Accession NP_038462.1). Accordingly, utilities of GAM2071 include diagnosis, prevention and treatment of diseases and clinical conditions associated with CSEN.

Casein kinase 2, alpha prime polypeptide (CSNK2A2, Accession NP_001887.1) is another GAM2071 target gene, herein designated TARGET GENE. CSNK2A2 BINDING SITE is a target binding site found in the 5' untranslated region of mRNA encoded by CSNK2A2, corresponding to a target binding site such as BINDING SITE I, BINDING SITE II or BINDING SITE III of FIG. 8. Table 4 illustrates the complementarity of the nucleotide sequences of CSNK2A2 BINDING SITE, designated SEQ ID:15382, to the nucleotide sequence of GAM2071 RNA, herein designated GAM RNA, also designated SEQ ID:371.

Another function of GAM2071 is therefore inhibition of Casein kinase 2, alpha prime polypeptide (CSNK2A2, Accession NP_001887.1), a gene which catalyzes the phosphorylation of serine or threonine residues in proteins. Accordingly, utilities of GAM2071 include diagnosis, prevention and treatment of diseases and clinical conditions associated with CSNK2A2.

The function of CSNK2A2 and its association with various diseases and clinical conditions, has been established by previous studies, as described hereinabove with reference to GAM189.1. CST (Accession NP_004852.1) is another GAM2071 target gene, herein designated TARGET GENE. CST BINDING SITE is a target binding site found in the 5' untranslated region of mRNA encoded by CST, corresponding to a target binding site such as BINDING SITE I, BINDING SITE II or BINDING SITE III of FIG. 8. Table 4 illustrates the complementarity of the nucleotide sequences of CST BINDING SITE, designated SEQ ID:3944, to the nucleotide sequence of GAM2071 RNA, herein designated GAM RNA, also designated SEQ ID:371.

Another function of GAM2071 is therefore inhibition of CST (Accession NP_004852.1), a gene which nucleotide-sugar transporter. Accordingly, utilities of GAM2071 include diagnosis, prevention and treatment of diseases and clinical conditions associated with CST.

The function of CST and its association with various diseases and clinical conditions, has been established by previous studies, as described hereinabove with reference to GAM221.1. CTEN (Accession NP_116254.3) is another GAM2071 target gene, herein designated TARGET GENE. CTEN BINDING SITE is a target binding site found in the 3' untranslated region of mRNA encoded by CTEN, corresponding to a target binding site such as BINDING SITE I, BINDING SITE II or BINDING SITE III of FIG. 8. Table 4 illustrates the complementarity of the nucleotide sequences of CTEN BINDING SITE, designated SEQ ID:14087, to the nucleotide sequence of GAM2071 RNA, herein designated GAM RNA, also designated SEQ ID:371.

Another function of GAM2071 is therefore inhibition of CTEN (Accession NP_116254.3). Accordingly, utilities of GAM2071 include diagnosis, prevention and treatment of diseases and clinical conditions associated with CTEN.

Cathepsin s (CTSS, Accession NP_004070.3) is another GAM2071 target gene, herein designated TARGET GENE. CTSS BINDING SITE is a target binding site found in the 3' untranslated region of mRNA encoded by CTSS, corresponding to a target binding site such as BINDING SITE I, BINDING SITE II or BINDING SITE III of FIG. 8. Table 4 illustrates the complementarity of the nucleotide sequences of CTSS BINDING SITE, designated SEQ ID:7946, to the nucleotide sequence of GAM2071 RNA, herein designated GAM RNA, also designated SEQ ID:371.

Another function of GAM2071 is therefore inhibition of Cathepsin s (CTSS, Accession NP_004070.3), a gene which is a lysosomal cysteine (thiol) protease that cleaves elastin. Accordingly, utilities of GAM2071 include diagnosis, prevention and treatment of diseases and clinical conditions associated with CTSS.

The function of CTSS and its association with various diseases and clinical conditions, has been established by previous studies, as described hereinabove with reference to GAM72.1. Chemokine (c-x-c motif) ligand 16 (CXCL16, Accession NP_071342.1) is another GAM2071 target gene, herein designated TARGET GENE. CXCL16 BINDING SITE is a target binding site found in the 3' untranslated region of mRNA encoded by CXCL16, corresponding to a target binding site such as BINDING SITE I, BINDING SITE II or BINDING SITE III of FIG. 8. Table 4 illustrates the complementarity of the nucleotide sequences of CXCL16 BINDING SITE, designated SEQ ID:11701, to the nucleotide sequence of GAM2071 RNA, herein designated GAM RNA, also designated SEQ ID:371.

Another function of GAM2071 is therefore inhibition of Chemokine (c-x-c motif) ligand 16 (CXCL16, Accession NP_071342.1), a gene which induces calcium mobilization. Accordingly, utilities of GAM2071 include diagnosis, prevention and treatment of diseases and clinical conditions associated with CXCL16.

The function of CXCL16 and its association with various diseases and clinical conditions, has been established by previous studies, as described hereinabove with reference to GAM189.1. CXYorf1 (Accession XP_088704.2) is another GAM2071 target gene, herein designated TARGET GENE. CXYorf1 BINDING SITE is a target binding site found in the 5' untranslated region of mRNA encoded by CXYorf1, corresponding to a target binding site such as BINDING SITE I, BINDING SITE II or BINDING SITE III of FIG. 8. Table 4 illustrates the complementarity of the nucleotide sequences of CXYorf1 BINDING SITE, designated SEQ ID:6801, to the nucleotide sequence of GAM2071 RNA, herein designated GAM RNA, also designated SEQ ID:371.

Another function of GAM2071 is therefore inhibition of CXYorf1 (Accession XP_088704.2). Accordingly, utilities of GAM2071 include diagnosis, prevention and treatment of diseases and clinical conditions associated with CXYorf1.

CYCS (Accession NP_061820.1) is another GAM2071 target gene, herein designated TARGET GENE. CYCS BINDING SITE is a target binding site found in the 3' untranslated region of mRNA encoded by CYCS, corresponding to a target binding site such as BINDING SITE I, BINDING SITE II or BINDING SITE III of FIG. 8. Table 4 illustrates the complementarity of the nucleotide sequences of CYCS BINDING SITE, designated SEQ ID:14950, to the nucleotide sequence of GAM2071 RNA, herein designated GAM RNA, also designated SEQ ID:371.

Another function of GAM2071 is therefore inhibition of CYCS (Accession NP_061820.1). Accordingly, utilities of GAM2071 include diagnosis, prevention and treatment of diseases and clinical conditions associated with CYCS.

Cytochrome p450, subfamily i (aromatic compound-inducible), polypeptide 2 (CYP1A2, Accession NP_000752.1) is another GAM2071 target gene, herein designated TARGET GENE. CYP1A2 BINDING SITE1 through CYP1A2 BINDING SITE3 are target binding sites found in untranslated regions of mRNA encoded by CYP1A2, corresponding to target binding sites such as BINDING SITE I, BINDING SITE II or BINDING SITE III of FIG. 8. Table 4 illustrates the complementarity of the nucleotide sequences of CYP1A2 BINDING SITE1 through CYP1A2 BINDING SITE3, designated SEQ ID:8688, SEQ ID:6816 and SEQ ID:13973 respectively, to the nucleotide sequence of GAM2071 RNA, herein designated GAM RNA, also designated SEQ ID:371.

Another function of GAM2071 is therefore inhibition of Cytochrome p450, subfamily i (aromatic compound-inducible), polypeptide 2 (CYP1A2, Accession NP_000752.1), a gene which intervenes in an NADPH-dependent electron transport pathway. and therefore may be associated with Porphyria cutanea tarda. Accordingly, utilities of GAM2071 include diagnosis, prevention and treatment of Porphyria cutanea tarda, and of other diseases and clinical conditions associated with CYP1A2.

The function of CYP1A2 and its association with various diseases and clinical conditions, has been established by previous studies, as described hereinabove with reference to GAM30.1. Cytochrome p450, subfamily iib (phenobarbital-inducible), polypeptide 6 (CYP2B6, Accession NP_000758.1) is another GAM2071 target gene, herein designated TARGET GENE. CYP2B6 BINDING SITE1 and CYP2B6 BINDING SITE2 are target binding sites found in untranslated regions of mRNA encoded by CYP2B6, corresponding to target binding sites such as BINDING SITE I, BINDING SITE II or BINDING SITE III of FIG. 8. Table 4 illustrates the complementarity of the nucleotide sequences of CYP2B6 BINDING SITE1 and CYP2B6 BINDING SITE2, designated SEQ ID:9252 and SEQ ID:3011 respectively, to the nucleotide sequence of GAM2071 RNA, herein designated GAM RNA, also designated SEQ ID:371.

Another function of GAM2071 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM2071 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. Cytochrome p450, subfamily ivf, polypeptide 3 (leukotriene b4 omega hydroxylase) (CYP4F3, Accession NP_000887.1) is another GAM2071 target gene, herein designated TARGET GENE. CYP4F3 BINDING SITE is a target binding site found in the 3' untranslated region of mRNA encoded by CYP4F3, corresponding to a target binding site such as BINDING SITE I, BINDING SITE II or BINDING SITE III of FIG. 8. Table 4 illustrates the complementarity of the nucleotide sequences of CYP4F3 BINDING SITE, designated SEQ ID:1417, to the nucleotide sequence of GAM2071 RNA, herein designated GAM RNA, also designated SEQ ID:371.

Another function of GAM2071 is therefore inhibition of Cytochrome p450, subfamily ivf, polypeptide 3 (leukotriene b4 omega hydroxylase) (CYP4F3, Accession NP_000887.1), a gene which converts leukotriene B4 into the less active 20-hydroxy-leukotriene B4. Accordingly, utilities of GAM2071 include diagnosis, prevention and treatment of diseases and clinical conditions associated with CYP4F3.

The function of CYP4F3 and its association with various diseases and clinical conditions, has been established by previous studies, as described hereinabove with reference to GAM67.1. CYP51A1 (Accession NP_000777.1) is another GAM2071 target gene, herein designated TARGET GENE. CYP51A1 BINDING SITE is a target binding site found in the 3' untranslated region of mRNA encoded by CYP51A1, corresponding to a target binding site such as BINDING SITE I, BINDING SITE II or BINDING SITE III of FIG. 8. Table 4 illustrates the complementarity of the nucleotide sequences of CYP51A1 BINDING SITE, designated SEQ ID:10631, to the nucleotide sequence of GAM2071 RNA, herein designated GAM RNA, also designated SEQ ID:371.

Another function of GAM2071 is therefore inhibition of CYP51A1 (Accession NP_000777.1). Accordingly, utilities of GAM2071 include diagnosis, prevention and treatment of diseases and clinical conditions associated with CYP51A1.

Cytochrome p450, subfamily viiib (sterol 12-alpha-hydroxylase), polypeptide 1 (CYP8B1, Accession NP_004382.1) is another GAM2071 target gene, herein designated TARGET GENE. CYP8B1 BINDING SITE is a target binding site found in the 3' untranslated region of mRNA encoded by CYP8B1, corresponding to a target binding site such as BINDING SITE I, BINDING SITE II or BINDING SITE III of FIG. 8. Table 4 illustrates the complementarity of the nucleotide sequences of CYP8B1 BINDING SITE, designated SEQ ID:5584, to the nucleotide sequence of GAM2071 RNA, herein designated GAM RNA, also designated SEQ ID:371.

Another function of GAM2071 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM2071 include diagnosis, prevention and treatment of diseases and clinical conditions associated with CYP8B1.

The function of CYP8B1 and its association with various diseases and clinical conditions, has been established by previous studies, as described hereinabove with reference to GAM47.1. Debranching enzyme homolog 1 (s. cerevisiae) (DBR1, Accession NP_057300.1) is another GAM2071 target gene, herein designated TARGET GENE. DBR1 BINDING SITE is a target binding site found in the 3' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:1031, to the nucleotide sequence of GAM2071 RNA, herein designated GAM RNA, also designated SEQ ID:371.

Another function of GAM2071 is therefore inhibition of Debranching enzyme homolog 1 (s. cerevisiae) (DBR1, Accession NP_057300.1). Accordingly, utilities of GAM2071 include diagnosis, prevention and treatment of diseases and clinical conditions associated with DBR1.

Doublecortin and cam kinase-like 1 (DCAMKL1, Accession NP_004725.1) is another GAM2071 target gene, herein designated TARGET GENE. DCAMKL1 BINDING SITE is a target binding site found in the 3' untranslated region of mRNA encoded by DCAMKL1, corresponding to a target binding site such as BINDING SITE I, BINDING SITE II or BINDING SITE III of FIG. 8. Table 4 illustrates the complementarity of the nucleotide sequences of DCAMKL1 BINDING SITE, designated SEQ ID:4605, to the nucleotide sequence of GAM2071 RNA, herein designated GAM RNA, also designated SEQ ID:371.

Another function of GAM2071 is therefore inhibition of Doublecortin and cam kinase-like 1 (DCAMKL1, Accession NP_004725.1). Accordingly, utilities of GAM2071 include diagnosis, prevention and treatment of diseases and clinical conditions associated with DCAMKL1.

Doublecortex; lissencephaly, x-linked (doublecortin) (DCX, Accession NP_835364.1) is another GAM2071 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:6035, to the nucleotide sequence of GAM2071 RNA, herein designated GAM RNA, also designated SEQ ID:371.

Another function of GAM2071 is therefore inhibition of Doublecortex; lissencephaly, x-linked (doublecortin) (DCX, Accession NP_835364.1). Accordingly, utilities of GAM2071 include diagnosis, prevention and treatment of diseases and clinical conditions associated with DCX.

Doublecortex; lissencephaly, x-linked (doublecortin) (DCX, Accession NP_835366.1) is another GAM2071 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:6035, to the nucleotide sequence of GAM2071 RNA, herein designated GAM RNA, also designated SEQ ID:371.

Another function of GAM2071 is therefore inhibition of Doublecortex; lissencephaly, x-linked (doublecortin) (DCX, Accession NP_835366.1). Accordingly, utilities of GAM2071 include diagnosis, prevention and treatment of diseases and clinical conditions associated with DCX.

Doublecortex; lissencephaly, x-linked (doublecortin) (DCX, Accession NP_835365.1) is another GAM2071 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:6035, to the nucleotide sequence of GAM2071 RNA, herein designated GAM RNA, also designated SEQ ID:371.

Another function of GAM2071 is therefore inhibition of Doublecortex; lissencephaly, x-linked (doublecortin) (DCX, Accession NP_835365.1). Accordingly, utilities of GAM2071 include diagnosis, prevention and treatment of diseases and clinical conditions associated with DCX.

Doublecortex; lissencephaly, x-linked (doublecortin) (DCX, Accession NP_000546.2) is another GAM2071 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:6035, to the nucleotide sequence of GAM2071 RNA, herein designated GAM RNA, also designated SEQ ID:371.

Another function of GAM2071 is therefore inhibition of Doublecortex; lissencephaly, x-linked (doublecortin) (DCX, Accession NP_000546.2). Accordingly, utilities of GAM2071 include diagnosis, prevention and treatment of diseases and clinical conditions associated with DCX.

Dead/h (asp-glu-ala-asp/his) box polypeptide 31 (DDX31, Accession NP_619526.1) is another GAM2071 target gene, herein designated TARGET GENE. DDX31 BINDING SITE is a target binding site found in the 3' untranslated region of multiple transcripts of mRNA encoded by DDX31, corresponding to a target binding site such as BINDING SITE I, BINDING SITE II or BINDING SITE III of FIG. 8. Table 4 illustrates the complementarity of the nucleotide sequences of DDX31 BINDING SITE, designated SEQ ID:17894, to the nucleotide sequence of GAM2071 RNA, herein designated GAM RNA, also designated SEQ ID:371.

Another function of GAM2071 is therefore inhibition of Dead/h (asp-glu-ala-asp/his) box polypeptide 31 (DDX31, Accession NP_619526.1). Accordingly, utilities of GAM2071 include diagnosis, prevention and treatment of diseases and clinical conditions associated with DDX31.

Dna fragmentation factor, 40 kda, beta polypeptide (caspase-activated dnase) (DFFB, Accession NP_004393.1) is another GAM2071 target gene, herein designated TARGET GENE. DFFB BINDING SITE1 and DFFB BINDING SITE2 are target binding sites found in untranslated regions of mRNA encoded by DFFB, corresponding to target binding sites such as BINDING SITE I, BINDING SITE II or BINDING SITE III of FIG. 8. Table 4 illustrates the complementarity of the nucleotide sequences of DFFB BINDING SITE1 and DFFB BINDING SITE2, designated SEQ ID:7574 and SEQ ID:7848 respectively, to the nucleotide sequence of GAM2071 RNA, herein designated GAM RNA, also designated SEQ ID:371.

Another function of GAM2071 is therefore inhibition of Dna fragmentation factor, 40 kda, beta polypeptide (caspase-activated dnase) (DFFB, Accession NP_004393.1), a gene which induces DNA fragmentation and chromatin condensation during apoptosis. Accordingly, utilities of GAM2071 include diagnosis, prevention and treatment of diseases and clinical conditions associated with DFFB.

The function of DFFB and its association with various diseases and clinical conditions, has been established by previous studies, as described hereinabove with reference to GAM130.1. Diaphanous homolog 2 (drosophila) (DIAPH2, Accession NP_006720.1) is another GAM2071 target gene, herein designated TARGET GENE. DIAPH2 BINDING SITE is a target binding site found in the 3' untranslated region of multiple transcripts of mRNA encoded by DIAPH2, corresponding to a target binding site such as BINDING SITE I, BINDING SITE II or BINDING SITE III of FIG. 8. Table 4 illustrates the complementarity of the nucleotide sequences of DIAPH2 BINDING SITE, designated SEQ ID:12586, to the nucleotide sequence of GAM2071 RNA, herein designated GAM RNA, also designated SEQ ID:371.

Another function of GAM2071 is therefore inhibition of Diaphanous homolog 2 (drosophila) (DIAPH2, Accession NP_006720.1), a gene which may affect in oogenesis and therefore may be associated with Premature ovarian failure. Accordingly, utilities of GAM2071 include diagnosis, prevention and treatment of Premature ovarian failure., and of other diseases and clinical conditions associated with DIAPH2.

The function of DIAPH2 and its association with various diseases and clinical conditions, has been established by previous studies, as described hereinabove with reference to GAM66.1. Disrupted in schizophrenia 1 (DISC1, Accession NP_061132.1) is another GAM2071 target gene, herein designated TARGET GENE. DISC1 BINDING SITE1 through DISC1 BINDING SITE4 are target binding sites found in untranslated regions of mRNA encoded by DISC1, corresponding to target binding sites such as BINDING SITE I, BINDING SITE II or BINDING SITE III of FIG. 8. Table 4 illustrates the complementarity of the nucleotide sequences of DISC1 BINDING SITE1 through DISC1 BINDING SITE4, designated SEQ ID:5967, SEQ ID:6590, SEQ ID:13620 and SEQ ID:10777 respectively, to the nucleotide sequence of GAM2071 RNA, herein designated GAM RNA, also designated SEQ ID:371.

Another function of GAM2071 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM2071 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. Disrupted in schizophrenia 1 (DISC1, Accession NP_061132.1) is another GAM2071 target gene, herein designated TARGET GENE. DISC1 BINDING SITE1 through DISC1 BINDING SITE4 are target binding sites found in untranslated regions of mRNA encoded by DISC1, corresponding to target binding sites such as BINDING SITE I, BINDING SITE II or BINDING SITE III of FIG. 8. Table 4 illustrates the complementarity of the nucleotide sequences of DISC1 BINDING SITE1 through DISC1 BINDING SITE4, designated SEQ ID:6590, SEQ ID:11474, SEQ ID:7947 and SEQ ID:18031 respectively, to the nucleotide sequence of GAM2071 RNA, herein designated GAM RNA, also designated SEQ ID:371.

Another function of GAM2071 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM2071 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. DKFZp434O0320 (Accession XP_097012.2) is another GAM2071 target gene, herein designated TARGET GENE. DKFZp434O0320 BINDING SITE is a target binding site found in the 3' untranslated region of mRNA encoded by DKFZp434O0320, corresponding to a target binding site such as BINDING SITE I, BINDING SITE II or BINDING SITE III of FIG. 8. Table 4 illustrates the complementarity of the nucleotide sequences of DKFZp434O0320 BINDING SITE, designated SEQ ID:3669, to the nucleotide sequence of GAM2071 RNA, herein designated GAM RNA, also designated SEQ ID:371.

Another function of GAM2071 is therefore inhibition of DKFZp434O0320 (Accession XP_097012.2). Accordingly, utilities of GAM2071 include diagnosis, prevention and treatment of diseases and clinical conditions associated with DKFZp434O0320.

DKFZp547P234 (Accession NP_694590.1) is another GAM2071 target gene, herein designated TARGET GENE. DKFZp547P234 BINDING SITE is a target binding site found in the 3' untranslated region of mRNA encoded by DKFZp547P234, corresponding to a target binding site such as BINDING SITE I, BINDING SITE II or BINDING SITE III of FIG. 8. Table 4 illustrates the complementarity of the nucleotide sequences of DKFZp547P234 BINDING SITE, designated SEQ ID:3007, to the nucleotide sequence of GAM2071 RNA, herein designated GAM RNA, also designated SEQ ID:371.

Another function of GAM2071 is therefore inhibition of DKFZp547P234 (Accession NP_694590.1). Accordingly, utilities of GAM2071 include diagnosis, prevention and treatment of diseases and clinical conditions associated with DKFZp547P234.

DKFZP564D166 (Accession NP_108648.1) is another GAM2071 target gene, herein designated TARGET GENE. DKFZP564D166 BINDING SITE is a target binding site found in the 3' untranslated region of multiple transcripts of mRNA encoded by DKFZP564D166, corresponding to a target binding site such as BINDING SITE I, BINDING SITE II or BINDING SITE III of FIG. 8. Table 4 illustrates the complementarity of the nucleotide sequences of DKFZP564D166 BINDING SITE, designated SEQ ID:13202, to the nucleotide sequence of GAM2071 RNA, herein designated GAM RNA, also designated SEQ ID:371.

Another function of GAM2071 is therefore inhibition of DKFZP564D166 (Accession NP_108648.1). Accordingly, utilities of GAM2071 include diagnosis, prevention and treatment of diseases and clinical conditions associated with DKFZP564D166.

DKFZP564G092 (Accession NP_056416.1) is another GAM2071 target gene, herein designated TARGET GENE. DKFZP564G092 BINDING SITE is a target binding site found in the 5' untranslated region of mRNA encoded by DKFZP564G092, corresponding to a target binding site such as BINDING SITE I, BINDING SITE II or BINDING SITE III of FIG. 8. Table 4 illustrates the complementarity of the nucleotide sequences of DKFZP564G092 BINDING SITE, designated SEQ ID:519, to the nucleotide sequence of GAM2071 RNA, herein designated GAM RNA, also designated SEQ ID:371.

Another function of GAM2071 is therefore inhibition of DKFZP564G092 (Accession NP_056416.1). Accordingly, utilities of GAM2071 include diagnosis, prevention and treatment of diseases and clinical conditions associated with DKFZP564G092.

DKFZP564I122 (Accession XP_032397.1) is another GAM2071 target gene, herein designated TARGET GENE. DKFZP564I122 BINDING SITE is a target binding site found in the 3' untranslated region of mRNA encoded by DKFZP564I122, corresponding to a target binding site such as BINDING SITE I, BINDING SITE II or BINDING SITE III of FIG. 8. Table 4 illustrates the complementarity of the nucleotide sequences of DKFZP564I122 BINDING SITE, designated SEQ ID:19815, to the nucleotide sequence of GAM2071 RNA, herein designated GAM RNA, also designated SEQ ID:371.

Another function of GAM2071 is therefore inhibition of DKFZP564I122 (Accession XP_032397.1). Accordingly, utilities of GAM2071 include diagnosis, prevention and treatment of diseases and clinical conditions associated with DKFZP564I122.

DKFZP564J0863 (Accession NP_056274.1) is another GAM2071 target gene, herein designated TARGET GENE. DKFZP564J0863 BINDING SITE is a target binding site found in the 3' untranslated region of mRNA encoded by DKFZP564J0863, corresponding to a target binding site such as BINDING SITE I, BINDING SITE II or BINDING SITE III of FIG. 8. Table 4 illustrates the complementarity of the nucleotide sequences of DKFZP564J0863 BINDING SITE, designated SEQ ID:18946, to the nucleotide sequence of GAM2071 RNA, herein designated GAM RNA, also designated SEQ ID:371.

Another function of GAM2071 is therefore inhibition of DKFZP564J0863 (Accession NP_056274.1). Accordingly, utilities of GAM2071 include diagnosis, prevention and treatment of diseases and clinical conditions associated with DKFZP564J0863.

DKFZP564K0322 (Accession NP_114429.1) is another GAM2071 target gene, herein designated TARGET GENE. DKFZP564K0322 BINDING SITE is a target binding site found in the 3' untranslated region of mRNA encoded by DKFZP564K0322, corresponding to a target binding site such as BINDING SITE I, BINDING SITE II or BINDING SITE III of FIG. 8. Table 4 illustrates the complementarity of the nucleotide sequences of DKFZP564K0322 BINDING SITE, designated SEQ ID:1414, to the nucleotide sequence of GAM2071 RNA, herein designated GAM RNA, also designated SEQ ID:371.

Another function of GAM2071 is therefore inhibition of DKFZP564K0322 (Accession NP_114429.1). Accordingly, utilities of GAM2071 include diagnosis, prevention and treatment of diseases and clinical conditions associated with DKFZP564K0322.

DKFZp564K142 (Accession NP_115497.2) is another GAM2071 target gene, herein designated TARGET GENE. DKFZp564K142 BINDING SITE is a target binding site found in the 3' untranslated region of mRNA encoded by DKFZp564K142, corresponding to a target binding site such as BINDING SITE I, BINDING SITE II or BINDING SITE III of FIG. 8. Table 4 illustrates the complementarity of the nucleotide sequences of DKFZp564K142 BINDING SITE, designated SEQ ID:811, to the nucleotide sequence of GAM2071 RNA, herein designated GAM RNA, also designated SEQ ID:371.

Another function of GAM2071 is therefore inhibition of DKFZp564K142 (Accession NP_115497.2). Accordingly, utilities of GAM2071 include diagnosis, prevention and treatment of diseases and clinical conditions associated with DKFZp564K142.

DKFZP566K1924 (Accession NP_056278.1) is another GAM2071 target gene, herein designated TARGET GENE. DKFZP566K1924 BINDING SITE is a target binding site found in the 3' untranslated region of mRNA encoded by DKFZP566K1924, corresponding to a target binding site such as BINDING SITE I, BINDING SITE II or BINDING SITE III of FIG. 8. Table 4 illustrates the complementarity of the nucleotide sequences of DKFZP566K1924 BINDING SITE, designated SEQ ID:9020, to the nucleotide sequence of GAM2071 RNA, herein designated GAM RNA, also designated SEQ ID:371.

Another function of GAM2071 is therefore inhibition of DKFZP566K1924 (Accession NP_056278.1). Accordingly, utilities of GAM2071 include diagnosis, prevention and treatment of diseases and clinical conditions associated with DKFZP566K1924.

DKFZP566M114 (Accession NP_115504.1) is another GAM2071 target gene, herein designated TARGET GENE. DKFZP566M114 BINDING SITE is a target binding site found in the 3' untranslated region of mRNA encoded by DKFZP566M114, corresponding to a target binding site such as BINDING SITE I, BINDING SITE II or BINDING SITE III of FIG. 8. Table 4 illustrates the complementarity of the nucleotide sequences of DKFZP566M114 BINDING SITE, designated SEQ ID:1708, to the nucleotide sequence of GAM2071 RNA, herein designated GAM RNA, also designated SEQ ID:371.

Another function of GAM2071 is therefore inhibition of DKFZP566M114 (Accession NP_115504.1). Accordingly, utilities of GAM2071 include diagnosis, prevention and treatment of diseases and clinical conditions associated with DKFZP566M114.

DKFZP586B1621 (Accession NP_056348.2) is another GAM2071 target gene, herein designated TARGET GENE. DKFZP586B1621 BINDING SITE1 and DKFZP586B1621 BINDING SITE2 are target binding sites found in untranslated regions of mRNA encoded by DKFZP586B1621, corresponding to target binding sites such as BINDING SITE I, BINDING SITE II or BINDING SITE III of FIG. 8. Table 4 illustrates the complementarity of the nucleotide sequences of DKFZP586B1621 BINDING SITE1 and DKFZP586B1621 BINDING SITE2, designated SEQ ID:20110 and SEQ ID:4762 respectively, to the nucleotide sequence of GAM2071 RNA, herein designated GAM RNA, also designated SEQ ID:371.

Another function of GAM2071 is therefore inhibition of DKFZP586B1621 (Accession NP_056348.2). Accordingly, utilities of GAM2071 include diagnosis, prevention and treatment of diseases and clinical conditions associated with DKFZP586B1621.

DKFZp586C0721 (Accession XP_098416.1) is another GAM2071 target gene, herein designated TARGET GENE. DKFZp586C0721 BINDING SITE is a target binding site found in the 3' untranslated region of mRNA encoded by DKFZp586C0721, corresponding to a target binding site such as BINDING SITE I, BINDING SITE II or BINDING SITE III of FIG. 8. Table 4 illustrates the complementarity of the nucleotide sequences of DKFZp586C0721 BINDING SITE, designated SEQ ID:14672, to the nucleotide sequence of GAM2071 RNA, herein designated GAM RNA, also designated SEQ ID:371.

Another function of GAM2071 is therefore inhibition of DKFZp586C0721 (Accession XP_098416.1). Accordingly, utilities of GAM2071 include diagnosis, prevention and treatment of diseases and clinical conditions associated with DKFZp586C0721.

DKFZP586D0919 (Accession NP_056248.1) is another GAM2071 target gene, herein designated TARGET GENE. DKFZP586D0919 BINDING SITE is a target binding site found in the 3' untranslated region of mRNA encoded by DKFZP586D0919, corresponding to a target binding site such as BINDING SITE I, BINDING SITE II or BINDING SITE III of FIG. 8. Table 4 illustrates the complementarity of the nucleotide sequences of DKFZP586D0919 BINDING SITE, designated SEQ ID:5664, to the nucleotide sequence of GAM2071 RNA, herein designated GAM RNA, also designated SEQ ID:371.

Another function of GAM2071 is therefore inhibition of DKFZP586D0919 (Accession NP_056248.1). Accordingly, utilities of GAM2071 include diagnosis, prevention and treatment of diseases and clinical conditions associated with DKFZP586D0919.

DKFZp667B1218 (Accession NP_808881.1) is another GAM2071 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:4387, to the nucleotide sequence of GAM2071 RNA, herein designated GAM RNA, also designated SEQ ID:371.

Another function of GAM2071 is therefore inhibition of DKFZp667B1218 (Accession NP_808881.1). Accordingly, utilities of GAM2071 include diagnosis, prevention and treatment of diseases and clinical conditions associated with DKFZp667B1218.

DKFZp667E0512 (Accession XP_117353.1) is another GAM2071 target gene, herein designated TARGET GENE. DKFZp667E0512 BINDING SITE is a target binding site found in the 3' untranslated region of mRNA encoded by DKFZp667E0512, corresponding to a target binding site such as BINDING SITE I, BINDING SITE II or BINDING SITE III of FIG. 8. Table 4 illustrates the complementarity of the nucleotide sequences of DKFZp667E0512 BINDING SITE, designated SEQ ID:9198, to the nucleotide sequence of GAM2071 RNA, herein designated GAM RNA, also designated SEQ ID:371.

Another function of GAM2071 is therefore inhibition of DKFZp667E0512 (Accession XP_117353.1). Accordingly, utilities of GAM2071 include diagnosis, prevention and treatment of diseases and clinical conditions associated with DKFZp667E0512.

DKFZp761B107 (Accession NP_775734.1) is another GAM2071 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:5298, to the nucleotide sequence of GAM2071 RNA, herein designated GAM RNA, also designated SEQ ID:371.

Another function of GAM2071 is therefore inhibition of DKFZp761B107 (Accession NP_775734.1). Accordingly, utilities of GAM2071 include diagnosis, prevention and treatment of diseases and clinical conditions associated with DKFZp761B107.

DKFZp761B128 (Accession NP_689650.1) is another GAM2071 target gene, herein designated TARGET GENE. DKFZp761B128 BINDING SITE is a target binding site found in the 5' untranslated region of mRNA encoded by DKFZp761B128, corresponding to a target binding site such as BINDING SITE I, BINDING SITE II or BINDING SITE III of FIG. 8. Table 4 illustrates the complementarity of the nucleotide sequences of DKFZp761B128 BINDING SITE, designated SEQ ID:436, to the nucleotide sequence of GAM2071 RNA, herein designated GAM RNA, also designated SEQ ID:371.

Another function of GAM2071 is therefore inhibition of DKFZp761B128 (Accession NP_689650.1). Accordingly, utilities of GAM2071 include diagnosis, prevention and treatment of diseases and clinical conditions associated with DKFZp761B128.

DKFZp761H039 (Accession NP_061181.1) is another GAM2071 target gene, herein designated TARGET GENE. DKFZp761H039 BINDING SITE is a target binding site found in the 3' untranslated region of mRNA encoded by DKFZp761H039, corresponding to a target binding site such as BINDING SITE I, BINDING SITE II or BINDING SITE III of FIG. 8. Table 4 illustrates the complementarity of the nucleotide sequences of DKFZp761H039 BINDING SITE, designated SEQ ID:12709, to the nucleotide sequence of GAM2071 RNA, herein designated GAM RNA, also designated SEQ ID:371.

Another function of GAM2071 is therefore inhibition of DKFZp761H039 (Accession NP_061181.1). Accordingly, utilities of GAM2071 include diagnosis, prevention and treatment of diseases and clinical conditions associated with DKFZp761H039.

DKFZp761J139 (Accession NP_115656.1) is another GAM2071 target gene, herein designated TARGET GENE. DKFZp761J139 BINDING SITE is a target binding site found in the 5' untranslated region of mRNA encoded by DKFZp761J139, corresponding to a target binding site such as BINDING SITE I, BINDING SITE II or BINDING SITE III of FIG. 8. Table 4 illustrates the complementarity of the nucleotide sequences of DKFZp761J139 BINDING SITE, designated SEQ ID:969, to the nucleotide sequence of GAM2071 RNA, herein designated GAM RNA, also designated SEQ ID:371.

Another function of GAM2071 is therefore inhibition of DKFZp761J139 (Accession NP_115656.1). Accordingly, utilities of GAM2071 include diagnosis, prevention and treatment of diseases and clinical conditions associated with DKFZp761J139.

DKFZp761O0113 (Accession NP_060879.1) is another GAM2071 target gene, herein designated TARGET GENE. DKFZp761O0113 BINDING SITE is a target binding site found in the 5' untranslated region of mRNA encoded by DKFZp761O0113, corresponding to a target binding site such as BINDING SITE I, BINDING SITE II or BINDING SITE III of FIG. 8. Table 4 illustrates the complementarity of the nucleotide sequences of DKFZp761O0113 BINDING SITE, designated SEQ ID:11194, to the nucleotide sequence of GAM2071 RNA, herein designated GAM RNA, also designated SEQ ID:371.

Another function of GAM2071 is therefore inhibition of DKFZp761O0113 (Accession NP_060879.1). Accordingly, utilities of GAM2071 include diagnosis, prevention and treatment of diseases and clinical conditions associated with DKFZp761O0113.

DKFZp761P1121 (Accession NP_690870.1) is another GAM2071 target gene, herein designated TARGET GENE. DKFZp761P1121 BINDING SITE is a target binding site found in the 3' untranslated region of mRNA encoded by DKFZp761P1121, corresponding to a target binding site such as BINDING SITE I, BINDING SITE II or BINDING SITE III of FIG. 8. Table 4 illustrates the complementarity of the nucleotide sequences of DKFZp761P1121 BINDING SITE, designated SEQ ID:1413, to the nucleotide sequence of GAM2071 RNA, herein designated GAM RNA, also designated SEQ ID:371.

Another function of GAM2071 is therefore inhibition of DKFZp761P1121 (Accession NP_690870.1). Accordingly, utilities of GAM2071 include diagnosis, prevention and treatment of diseases and clinical conditions associated with DKFZp761P1121.

DKFZp762C2414 (Accession NP_848637.1) is another GAM2071 target gene, herein designated TARGET GENE. DKFZp762C2414 BINDING SITE is a target binding site found in the 3' untranslated region of mRNA encoded by DKFZp762C2414, corresponding to a target binding site such as BINDING SITE I, BINDING SITE II or BINDING SITE III of FIG. 8. Table 4 illustrates the complementarity of the nucleotide sequences of DKFZp762C2414 BINDING SITE, designated SEQ ID:11830, to the nucleotide sequence of GAM2071 RNA, herein designated GAM RNA, also designated SEQ ID:371.

Another function of GAM2071 is therefore inhibition of DKFZp762C2414 (Accession NP_848637.1). Accordingly, utilities of GAM2071 include diagnosis, prevention and treatment of diseases and clinical conditions associated with DKFZp762C2414.

DKFZp762H185 (Accession XP_172976.2) is another GAM2071 target gene, herein designated TARGET GENE. DKFZp762H185 BINDING SITE is a target binding site found in the 3' untranslated region of mRNA encoded by DKFZp762H185, corresponding to a target binding site such as BINDING SITE I, BINDING SITE II or BINDING SITE III of FIG. 8. Table 4 illustrates the complementarity of the nucleotide sequences of DKFZp762H185 BINDING SITE, designated SEQ ID:2137, to the nucleotide sequence of GAM2071 RNA, herein designated GAM RNA, also designated SEQ ID:371.

Another function of GAM2071 is therefore inhibition of DKFZp762H185 (Accession XP_172976.2). Accordingly, utilities of GAM2071 include diagnosis, prevention and treatment of diseases and clinical conditions associated with DKFZp762H185.

DKFZp762I137 (Accession NP_689624.1) is another GAM2071 target gene, herein designated TARGET GENE. DKFZp762I137 BINDING SITE is a target binding site found in the 3' untranslated region of mRNA encoded by DKFZp762I137, corresponding to a target binding site such as BINDING SITE I, BINDING SITE II or BINDING SITE III of FIG. 8. Table 4 illustrates the complementarity of the nucleotide sequences of DKFZp762I137 BINDING SITE, designated SEQ ID:11659, to the nucleotide sequence of GAM2071 RNA, herein designated GAM RNA, also designated SEQ ID:371.

Another function of GAM2071 is therefore inhibition of DKFZp762I137 (Accession NP_689624.1). Accordingly, utilities of GAM2071 include diagnosis, prevention and treatment of diseases and clinical conditions associated with DKFZp762I137.

DKFZp762I194 (Accession NP_689597.1) is another GAM2071 target gene, herein designated TARGET GENE. DKFZp762I194 BINDING SITE is a target binding site found in the 3' untranslated region of mRNA encoded by DKFZp762I194, corresponding to a target binding site such as BINDING SITE I, BINDING SITE II or BINDING SITE III of FIG. 8. Table 4 illustrates the complementarity of the nucleotide sequences of DKFZp762I194 BINDING SITE, designated SEQ ID:19272, to the nucleotide sequence of GAM2071 RNA, herein designated GAM RNA, also designated SEQ ID:371.

Another function of GAM2071 is therefore inhibition of DKFZp762I194 (Accession NP_689597.1). Accordingly, utilities of GAM2071 include diagnosis, prevention and treatment of diseases and clinical conditions associated with DKFZp762I194.

DKFZp762L0311 (Accession NP_061189.2) is another GAM2071 target gene, herein designated TARGET GENE. DKFZp762L0311 BINDING SITE is a target binding site found in the 3' untranslated region of mRNA encoded by DKFZp762L0311, corresponding to a target binding site such as BINDING SITE I, BINDING SITE II or BINDING SITE III of FIG. 8. Table 4 illustrates the complementarity of the nucleotide sequences of DKFZp762L0311 BINDING SITE, designated SEQ ID:13546, to the nucleotide sequence of GAM2071 RNA, herein designated GAM RNA, also designated SEQ ID:371.

Another function of GAM2071 is therefore inhibition of DKFZp762L0311 (Accession NP_061189.2). Accordingly, utilities of GAM2071 include diagnosis, prevention and treatment of diseases and clinical conditions associated with DKFZp762L0311.

Dystrophia myotonica-containing wd repeat motif (DMWD, Accession XP_027569.1) is another GAM2071 target gene, herein designated TARGET GENE. DMWD BINDING SITE is a target binding site found in the 3' untranslated region of mRNA encoded by DMWD, corresponding to a target binding site such as BINDING SITE I, BINDING SITE II or BINDING SITE III of FIG. 8. Table 4 illustrates the complementarity of the nucleotide sequences of DMWD BINDING SITE, designated SEQ ID:10543, to the nucleotide sequence of GAM2071 RNA, herein designated GAM RNA, also designated SEQ ID:371.

Another function of GAM2071 is therefore inhibition of Dystrophia myotonica-containing wd repeat motif (DMWD, Accession XP_027569.1). Accordingly, utilities of GAM2071 include diagnosis, prevention and treatment of diseases and clinical conditions associated with DMWD.

DRIM (Accession NP_055318.1) is another GAM2071 target gene, herein designated TARGET GENE. DRIM BINDING SITE is a target binding site found in the 3' untranslated region of mRNA encoded by DRIM, corresponding to a target binding site such as BINDING SITE I, BINDING SITE II or BINDING SITE III of FIG. 8. Table 4 illustrates the complementarity of the nucleotide sequences of DRIM BINDING SITE, designated SEQ ID:2324, to the nucleotide sequence of GAM2071 RNA, herein designated GAM RNA, also designated SEQ ID:371.

Another function of GAM2071 is therefore inhibition of DRIM (Accession NP_055318.1). Accordingly, utilities of GAM2071 include diagnosis, prevention and treatment of diseases and clinical conditions associated with DRIM.

Desmocollin 3 (DSC3, Accession NP_001932.1) is another GAM2071 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:2085, to the nucleotide sequence of GAM2071 RNA, herein designated GAM RNA, also designated SEQ ID:371.

Another function of GAM2071 is therefore inhibition of Desmocollin 3 (DSC3, Accession NP_001932.1), a gene which is a component of intercellular desmosome junctions. Accordingly, utilities of GAM2071 include diagnosis, prevention and treatment of diseases and clinical conditions associated with DSC3.

The function of DSC3 and its association with various diseases and clinical conditions, has been established by previous studies, as described hereinabove with reference to GAM30.1. Desmocollin 3 (DSC3, Accession NP_077741.1) is another GAM2071 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:2085, to the nucleotide sequence of GAM2071 RNA, herein designated GAM RNA, also designated SEQ ID:371.

Another function of GAM2071 is therefore inhibition of Desmocollin 3 (DSC3, Accession NP_077741.1), a gene which is a component of intercellular desmosome junctions. Accordingly, utilities of GAM2071 include diagnosis, prevention and treatment of diseases and clinical conditions associated with DSC3.

The function of DSC3 and its association with various diseases and clinical conditions, has been established by previous studies, as described hereinabove with reference to GAM30.1. Down syndrome critical region gene 3 (DSCR3, Accession NP_006043.1) is another GAM2071 target gene, herein designated TARGET GENE. DSCR3 BINDING SITE is a target binding site found in the 3' untranslated region of mRNA encoded by DSCR3, corresponding to a target binding site such as BINDING SITE I, BINDING SITE II or BINDING SITE III of FIG. 8. Table 4 illustrates the complementarity of the nucleotide sequences of DSCR3 BINDING SITE, designated SEQ ID:13453, to the nucleotide sequence of GAM2071 RNA, herein designated GAM RNA, also designated SEQ ID:371.

Another function of GAM2071 is therefore inhibition of Down syndrome critical region gene 3 (DSCR3, Accession NP_006043.1). Accordingly, utilities of GAM2071 include diagnosis, prevention and treatment of diseases and clinical conditions associated with DSCR3.

Down syndrome critical region gene 6 (DSCR6, Accession NP_061835.1) is another GAM2071 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:17339, to the nucleotide sequence of GAM2071 RNA, herein designated GAM RNA, also designated SEQ ID:371.

Another function of GAM2071 is therefore inhibition of Down syndrome critical region gene 6 (DSCR6, Accession NP_061835.1). Accordingly, utilities of GAM2071 include diagnosis, prevention and treatment of diseases and clinical conditions associated with DSCR6.

DUPLIN (Accession XP_208760.3) is another GAM2071 target gene, herein designated TARGET GENE. DUPLIN BINDING SITE1 and DUPLIN BINDING SITE2 are target binding sites found in untranslated regions of mRNA encoded by DUPLIN, corresponding to target binding sites such as BINDING SITE I, BINDING SITE II or BINDING SITE III of FIG. 8. Table 4 illustrates the complementarity of the nucleotide sequences of DUPLIN BINDING SITE1 and DUPLIN BINDING SITE2, designated SEQ ID:2517 and SEQ ID:13723 respectively, to the nucleotide sequence of GAM2071 RNA, herein designated GAM RNA, also designated SEQ ID:371.

Another function of GAM2071 is therefore inhibition of DUPLIN (Accession XP_208760.3). Accordingly, utilities of GAM2071 include diagnosis, prevention and treatment of diseases and clinical conditions associated with DUPLIN.

DUSP18 (Accession NP_689724.2) is another GAM2071 target gene, herein designated TARGET GENE. DUSP18 BINDING SITE is a target binding site found in the 3' untranslated region of mRNA encoded by DUSP18, corresponding to a target binding site such as BINDING SITE I, BINDING SITE II or BINDING SITE III of FIG. 8. Table 4 illustrates the complementarity of the nucleotide sequences of DUSP18 BINDING SITE, designated SEQ ID:19123, to the nucleotide sequence of GAM2071 RNA, herein designated GAM RNA, also designated SEQ ID:371.

Another function of GAM2071 is therefore inhibition of DUSP18 (Accession NP_689724.2). Accordingly, utilities of GAM2071 include diagnosis, prevention and treatment of diseases and clinical conditions associated with DUSP18.

Dual specificity phosphatase 19 (DUSP19, Accession NP_543152.1) is another GAM2071 target gene, herein designated TARGET GENE. DUSP19 BINDING SITE1 and DUSP19 BINDING SITE2 are target binding sites found in untranslated regions of mRNA encoded by DUSP19, corresponding to target binding sites such as BINDING SITE I, BINDING SITE II or BINDING SITE III of FIG. 8. Table 4 illustrates the complementarity of the nucleotide sequences of DUSP19 BINDING SITE1 and DUSP19 BINDING SITE2, designated SEQ ID:710 and SEQ ID:969 respectively, to the nucleotide sequence of GAM2071 RNA, herein designated GAM RNA, also designated SEQ ID:371.

Another function of GAM2071 is therefore inhibition of Dual specificity phosphatase 19 (DUSP19, Accession NP_543152.1). Accordingly, utilities of GAM2071 include diagnosis, prevention and treatment of diseases and clinical conditions associated with DUSP19.

Dual-specificity tyrosine-(y)-phosphorylation regulated kinase 1a (DYRK1A, Accession NP_567824.1) is another GAM2071 target gene, herein designated TARGET GENE. DYRK1A BINDING SITE is a target binding site found in the 5' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:14469, to the nucleotide sequence of GAM2071 RNA, herein designated GAM RNA, also designated SEQ ID:371.

Another function of GAM2071 is therefore inhibition of Dual-specificity tyrosine-(y)-phosphorylation regulated kinase 1a (DYRK1A, Accession NP_567824.1), a gene which regulates cell proliferation and may be involved in brain development . and therefore may be associated with Down syndrome. Accordingly, utilities of GAM2071 include diagnosis, prevention and treatment of Down syndrome, and of other diseases and clinical conditions associated with DYRK1A.

The function of DYRK1A and its association with various diseases and clinical conditions, has been established by previous studies, as described hereinabove with reference to GAM63.1. Endothelial differentiation, sphingolipid g-protein-coupled receptor, 8 (EDG8, Accession NP_110387.1) is another GAM2071 target gene, herein designated TARGET GENE. EDG8 BINDING SITE is a target binding site found in the 3' untranslated region of mRNA encoded by EDG8, corresponding to a target binding site such as BINDING SITE I, BINDING SITE II or BINDING SITE III of FIG. 8. Table 4 illustrates the complementarity of the nucleotide sequences of EDG8 BINDING SITE, designated SEQ ID:11935, to the nucleotide sequence of GAM2071 RNA, herein designated GAM RNA, also designated SEQ ID:371.

Another function of GAM2071 is therefore inhibition of Endothelial differentiation, sphingolipid g-protein-coupled receptor, 8 (EDG8, Accession NP_110387.1). Accordingly, utilities of GAM2071 include diagnosis, prevention and treatment of diseases and clinical conditions associated with EDG8.

EEF2K (Accession NP_037434.1) is another GAM2071 target gene, herein designated TARGET GENE. EEF2K BINDING SITE is a target binding site found in the 3' untranslated region of mRNA encoded by EEF2K, corresponding to a target binding site such as BINDING SITE I, BINDING SITE II or BINDING SITE III of FIG. 8. Table 4 illustrates the complementarity of the nucleotide sequences of EEF2K BINDING SITE, designated SEQ ID:11618, to the nucleotide sequence of GAM2071 RNA, herein designated GAM RNA, also designated SEQ ID:371.

Another function of GAM2071 is therefore inhibition of EEF2K (Accession NP_037434.1), a gene which phosphorylates serine or threonine on the eukaryotic elongation factor-2 and therefore may be associated with Systemic lupus erythematosus and cancer. Accordingly, utilities of GAM2071 include diagnosis, prevention and treatment of Systemic lupus erythematosus and cancer, and of other diseases and clinical conditions associated with EEF2K.

The function of EEF2K and its association with various diseases and clinical conditions, has been established by previous studies, as described hereinabove with reference to GAM189.1. Eh-domain containing 2 (EHD2, Accession NP_055416.2) is another GAM2071 target gene, herein designated TARGET GENE. EHD2 BINDING SITE is a target binding site found in the 3' untranslated region of mRNA encoded by EHD2, corresponding to a target binding site such as BINDING SITE I, BINDING SITE II or BINDING SITE III of FIG. 8. Table 4 illustrates the complementarity of the nucleotide sequences of EHD2 BINDING SITE, designated SEQ ID:6934, to the nucleotide sequence of GAM2071 RNA, herein designated GAM RNA, also designated SEQ ID:371.

Another function of GAM2071 is therefore inhibition of Eh-domain containing 2 (EHD2, Accession NP_055416.2). Accordingly, utilities of GAM2071 include diagnosis, prevention and treatment of diseases and clinical conditions associated with EHD2.

Eukaryotic translation initiation factor 2, subunit 3 gamma, 52 kda (EIF2S3, Accession NP_001406.1) is another GAM2071 target gene, herein designated TARGET GENE. EIF2S3 BINDING SITE is a target binding site found in the 3' untranslated region of mRNA encoded by EIF2S3, corresponding to a target binding site such as BINDING SITE I, BINDING SITE II or BINDING SITE III of FIG. 8. Table 4 illustrates the complementarity of the nucleotide sequences of EIF2S3 BINDING SITE, designated SEQ ID:11659, to the nucleotide sequence of GAM2071 RNA, herein designated GAM RNA, also designated SEQ ID:371.

Another function of GAM2071 is therefore inhibition of Eukaryotic translation initiation factor 2, subunit 3 gamma, 52 kda (EIF2S3, Accession NP_001406.1), a gene which functions in the early steps of protein synthesis. Accordingly, utilities of GAM2071 include diagnosis, prevention and treatment of diseases and clinical conditions associated with EIF2S3.

The function of EIF2S3 and its association with various diseases and clinical conditions, has been established by previous studies, as described hereinabove with reference to GAM189.1. Eukaryotic translation initiation factor 5a2 (EIF5A2, Accession NP_065123.1) is another GAM2071 target gene, herein designated TARGET GENE. EIF5A2 BINDING SITE is a target binding site found in the 3' untranslated region of mRNA encoded by EIF5A2, corresponding to a target binding site such as BINDING SITE I, BINDING SITE II or BINDING SITE III of FIG. 8. Table 4 illustrates the complementarity of the nucleotide sequences of EIF5A2 BINDING SITE, designated SEQ ID:1333, to the nucleotide sequence of GAM2071 RNA, herein designated GAM RNA, also designated SEQ ID:371.

Another function of GAM2071 is therefore inhibition of Eukaryotic translation initiation factor 5a2 (EIF5A2, Accession NP_065123.1). Accordingly, utilities of GAM2071 include diagnosis, prevention and treatment of diseases and clinical conditions associated with EIF5A2.

ELP3 (Accession NP_060561.3) is another GAM2071 target gene, herein designated TARGET GENE. ELP3 BINDING SITE is a target binding site found in the 3' untranslated region of mRNA encoded by ELP3, corresponding to a target binding site such as BINDING SITE I, BINDING SITE II or BINDING SITE III of FIG. 8. Table 4 illustrates the complementarity of the nucleotide sequences of ELP3 BINDING SITE, designated SEQ ID:6182, to the nucleotide sequence of GAM2071 RNA, herein designated GAM RNA, also designated SEQ ID:371.

Another function of GAM2071 is therefore inhibition of ELP3 (Accession NP_060561.3). Accordingly, utilities of GAM2071 include diagnosis, prevention and treatment of diseases and clinical conditions associated with ELP3.

Egf-like module containing, mucin-like, hormone receptor-like sequence 2 (EMR2, Accession NP_690883.1) is another GAM2071 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM2071 RNA, herein designated GAM RNA, also designated SEQ ID:371.

Another function of GAM2071 is therefore inhibition of Egf-like module containing, mucin-like, hormone receptor-like sequence 2 (EMR2, Accession NP_690883.1). Accordingly, utilities of GAM2071 include diagnosis, prevention and treatment of diseases and clinical conditions associated with EMR2.

Egf-like module containing, mucin-like, hormone receptor-like sequence 2 (EMR2, Accession NP_038475.2) is another GAM2071 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM2071 RNA, herein designated GAM RNA, also designated SEQ ID:371.

Another function of GAM2071 is therefore inhibition of Egf-like module containing, mucin-like, hormone receptor-like sequence 2 (EMR2, Accession NP_038475.2). Accordingly, utilities of GAM2071 include diagnosis, prevention and treatment of diseases and clinical conditions associated with EMR2.

Egf-like module containing, mucin-like, hormone receptor-like sequence 2 (EMR2, Accession NP_690882.1) is another GAM2071 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM2071 RNA, herein designated GAM RNA, also designated SEQ ID:371.

Another function of GAM2071 is therefore inhibition of Egf-like module containing, mucin-like, hormone receptor-like sequence 2 (EMR2, Accession NP_690882.1). Accordingly, utilities of GAM2071 include diagnosis, prevention and treatment of diseases and clinical conditions associated with EMR2.

Egf-like module containing, mucin-like, hormone receptor-like sequence 2 (EMR2, Accession NP_690884.1) is another GAM2071 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM2071 RNA, herein designated GAM RNA, also designated SEQ ID:371.

Another function of GAM2071 is therefore inhibition of Egf-like module containing, mucin-like, hormone receptor-like sequence 2 (EMR2, Accession NP_690884.1). Accordingly, utilities of GAM2071 include diagnosis, prevention and treatment of diseases and clinical conditions associated with EMR2.

Egf-like module containing, mucin-like, hormone receptor-like sequence 2 (EMR2, Accession NP_690881.1) is another GAM2071 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM2071 RNA, herein designated GAM RNA, also designated SEQ ID:371.

Another function of GAM2071 is therefore inhibition of Egf-like module containing, mucin-like, hormone receptor-like sequence 2 (EMR2, Accession NP_690881.1). Accordingly, utilities of GAM2071 include diagnosis, prevention and treatment of diseases and clinical conditions associated with EMR2.

Egf-like module containing, mucin-like, hormone receptor-like sequence 2 (EMR2, Accession NP_690885.1) is another GAM2071 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM2071 RNA, herein designated GAM RNA, also designated SEQ ID:371.

Another function of GAM2071 is therefore inhibition of Egf-like module containing, mucin-like, hormone receptor-like sequence 2 (EMR2, Accession NP_690885.1). Accordingly, utilities of GAM2071 include diagnosis, prevention and treatment of diseases and clinical conditions associated with EMR2.

Egf-like module containing, mucin-like, hormone receptor-like sequence 2 (EMR2, Accession NP_690880.1) is another GAM2071 target gene, herein designated TARGET GENE. EMR2 BINDING SITE is a target binding site found in the 5' untranslated region of multiple transcripts of mRNA encoded by EMR2, corresponding to a target binding site such as BINDING SITE I, BINDING SITE II or BINDING SITE III of FIG. 8. Table 4 illustrates the complementarity of the nucleotide sequences of EMR2 BINDING SITE, designated SEQ ID:433, to the nucleotide sequence of GAM2071 RNA, herein designated GAM RNA, also designated SEQ ID:371.

Another function of GAM2071 is therefore inhibition of Egf-like module containing, mucin-like, hormone receptor-like sequence 2 (EMR2, Accession NP_690880.1). Accordingly, utilities of GAM2071 include diagnosis, prevention and treatment of diseases and clinical conditions associated with EMR2.

Endonuclease g-like 1 (ENDOGL1, Accession NP_005098.1) is another GAM2071 target gene, herein designated TARGET GENE. ENDOGL1 BINDING SITE is a target binding site found in the 3' untranslated region of mRNA encoded by ENDOGL1, corresponding to a target binding site such as BINDING SITE I, BINDING SITE II or BINDING SITE III of FIG. 8. Table 4 illustrates the complementarity of the nucleotide sequences of ENDOGL1 BINDING SITE, designated SEQ ID:4223, to the nucleotide sequence of GAM2071 RNA, herein designated GAM RNA, also designated SEQ ID:371.

Another function of GAM2071 is therefore inhibition of Endonuclease g-like 1 (ENDOGL1, Accession NP_005098.1). Accordingly, utilities of GAM2071 include diagnosis, prevention and treatment of diseases and clinical conditions associated with ENDOGL1.

Ephb6 (EPHB6, Accession NP_004436.1) is another GAM2071 target gene, herein designated TARGET GENE. EPHB6 BINDING SITE is a target binding site found in the 5' untranslated region of mRNA encoded by EPHB6, corresponding to a target binding site such as BINDING SITE I, BINDING SITE II or BINDING SITE III of FIG. 8. Table 4 illustrates the complementarity of the nucleotide sequences of EPHB6 BINDING SITE, designated SEQ ID:19635, to the nucleotide sequence of GAM2071 RNA, herein designated GAM RNA, also designated SEQ ID:371.

Another function of GAM2071 is therefore inhibition of Ephb6 (EPHB6, Accession NP_004436.1), a gene which Putative Eph-related receptor tyrosine kinase B6. Accordingly, utilities of GAM2071 include diagnosis, prevention and treatment of diseases and clinical conditions associated with EPHB6.

The function of EPHB6 and its association with various diseases and clinical conditions, has been established by previous studies, as described hereinabove with reference to GAM55.1. Epsin 2 (EPN2, Accession NP_683723.1) is another GAM2071 target gene, herein designated TARGET GENE. EPN2 BINDING SITE is a target binding site found in the 3' untranslated region of multiple transcripts of mRNA encoded by EPN2, corresponding to a target binding site such as BINDING SITE I, BINDING SITE II or BINDING SITE III of FIG. 8. Table 4 illustrates the complementarity of the nucleotide sequences of EPN2 BINDING SITE, designated SEQ ID:4430, to the nucleotide sequence of GAM2071 RNA, herein designated GAM RNA, also designated SEQ ID:371.

Another function of GAM2071 is therefore inhibition of Epsin 2 (EPN2, Accession NP_683723.1). Accordingly, utilities of GAM2071 include diagnosis, prevention and treatment of diseases and clinical conditions associated with EPN2.

Epsin 2 (EPN2, Accession NP_055779.1) is another GAM2071 target gene, herein designated TARGET GENE. EPN2 BINDING SITE is a target binding site found in the 3' untranslated region of multiple transcripts of mRNA encoded by EPN2, corresponding to a target binding site such as BINDING SITE I, BINDING SITE II or BINDING SITE III of FIG. 8. Table 4 illustrates the complementarity of the nucleotide sequences of EPN2 BINDING SITE, designated SEQ ID:4430, to the nucleotide sequence of GAM2071 RNA, herein designated GAM RNA, also designated SEQ ID:371.

Another function of GAM2071 is therefore inhibition of Epsin 2 (EPN2, Accession NP_055779.1). Accordingly, utilities of GAM2071 include diagnosis, prevention and treatment of diseases and clinical conditions associated with EPN2.

Epiregulin (EREG, Accession NP_001423.1) is another GAM2071 target gene, herein designated TARGET GENE. EREG BINDING SITE is a target binding site found in the 3' untranslated region of mRNA encoded by EREG, corresponding to a target binding site such as BINDING SITE I, BINDING SITE II or BINDING SITE III of FIG. 8. Table 4 illustrates the complementarity of the nucleotide sequences of EREG BINDING SITE, designated SEQ ID:430, to the nucleotide sequence of GAM2071 RNA, herein designated GAM RNA, also designated SEQ ID:371.

Another function of GAM2071 is therefore inhibition of Epiregulin (EREG, Accession NP_001423.1). Accordingly, utilities of GAM2071 include diagnosis, prevention and treatment of diseases and clinical conditions associated with EREG.

Ellis van creveld syndrome (EVC, Accession NP_055371.1) is another GAM2071 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:4148, to the nucleotide sequence of GAM2071 RNA, herein designated GAM RNA, also designated SEQ ID:371.

Another function of GAM2071 is therefore inhibition of Ellis van creveld syndrome (EVC, Accession NP_055371.1). Accordingly, utilities of GAM2071 include diagnosis, prevention and treatment of diseases and clinical conditions associated with EVC.

Ellis van creveld syndrome (EVC, Accession NP_714928.1) is another GAM2071 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:4148, to the nucleotide sequence of GAM2071 RNA, herein designated GAM RNA, also designated SEQ ID:371.

Another function of GAM2071 is therefore inhibition of Ellis van creveld syndrome (EVC, Accession NP_714928.1). Accordingly, utilities of GAM2071 include diagnosis, prevention and treatment of diseases and clinical conditions associated with EVC.

Ecotropic viral integration site 5 (EVI5, Accession NP_005656.2) is another GAM2071 target gene, herein designated TARGET GENE. EVI5 BINDING SITE1 and EVI5 BINDING SITE2 are target binding sites found in untranslated regions of mRNA encoded by EVI5, corresponding to target binding sites such as BINDING SITE I, BINDING SITE II or BINDING SITE III of FIG. 8. Table 4 illustrates the complementarity of the nucleotide sequences of EVI5 BINDING SITE1 and EVI5 BINDING SITE2, designated SEQ ID:16074 and SEQ ID:18007 respectively, to the nucleotide sequence of GAM2071 RNA, herein designated GAM RNA, also designated SEQ ID:371.

Another function of GAM2071 is therefore inhibition of Ecotropic viral integration site 5 (EVI5, Accession NP_005656.2). Accordingly, utilities of GAM2071 include diagnosis, prevention and treatment of diseases and clinical conditions associated with EVI5.

F11R (Accession NP_058642.1) is another GAM2071 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:16292, to the nucleotide sequence of GAM2071 RNA, herein designated GAM RNA, also designated SEQ ID:371.

Another function of GAM2071 is therefore inhibition of F11R (Accession NP_058642.1). Accordingly, utilities of GAM2071 include diagnosis, prevention and treatment of diseases and clinical conditions associated with F11R.

F11R (Accession NP_653085.1) is another GAM2071 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:16292, to the nucleotide sequence of GAM2071 RNA, herein designated GAM RNA, also designated SEQ ID:371.

Another function of GAM2071 is therefore inhibition of F11R (Accession NP_653085.1). Accordingly, utilities of GAM2071 include diagnosis, prevention and treatment of diseases and clinical conditions associated with F11R.

F11R (Accession NP_653087.1) is another GAM2071 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:16292, to the nucleotide sequence of GAM2071 RNA, herein designated GAM RNA, also designated SEQ ID:371.

Another function of GAM2071 is therefore inhibition of F11R (Accession NP_653087.1). Accordingly, utilities of GAM2071 include diagnosis, prevention and treatment of diseases and clinical conditions associated with F11R.

F11R (Accession NP_653086.1) is another GAM2071 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:16292, to the nucleotide sequence of GAM2071 RNA, herein designated GAM RNA, also designated SEQ ID:371.

Another function of GAM2071 is therefore inhibition of F11R (Accession NP_653086.1). Accordingly, utilities of GAM2071 include diagnosis, prevention and treatment of diseases and clinical conditions associated with F11R.

Coagulation factor ii (thrombin) receptor-like 2 (F2RL2, Accession NP_004092.1) is another GAM2071 target gene, herein designated TARGET GENE. F2RL2 BINDING SITE is a target binding site found in the 3' untranslated region of mRNA encoded by F2RL2, corresponding to a target binding site such as BINDING SITE I, BINDING SITE II or BINDING SITE III of FIG. 8. Table 4 illustrates the complementarity of the nucleotide sequences of F2RL2 BINDING SITE, designated SEQ ID:5026, to the nucleotide sequence of GAM2071 RNA, herein designated GAM RNA, also designated SEQ ID:371.

Another function of GAM2071 is therefore inhibition of Coagulation factor ii (thrombin) receptor-like 2 (F2RL2, Accession NP_004092.1), a gene which receptor for activated thrombin coupled to g proteins that stimulate phosphoinositide hydrolysis. Accordingly, utilities of GAM2071 include diagnosis, prevention and treatment of diseases and clinical conditions associated with F2RL2.

The function of F2RL2 and its association with various diseases and clinical conditions, has been established by previous studies, as described hereinabove with reference to GAM136.1. Coagulation factor ii (thrombin) receptor-like 3 (F2RL3, Accession NP_003941.1) is another GAM2071 target gene, herein designated TARGET GENE. F2RL3 BINDING SITE is a target binding site found in the 3' untranslated region of mRNA encoded by F2RL3, corresponding to a target binding site such as BINDING SITE I, BINDING SITE II or BINDING SITE III of FIG. 8. Table 4 illustrates the complementarity of the nucleotide sequences of F2RL3 BINDING SITE, designated SEQ ID:13324, to the nucleotide sequence of GAM2071 RNA, herein designated GAM RNA, also designated SEQ ID:371.

Another function of GAM2071 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM2071 include diagnosis, prevention and treatment of diseases and clinical conditions associated with F2RL3.

The function of F2RL3 and its association with various diseases and clinical conditions, has been established by previous studies, as described hereinabove with reference to GAM72.1. Coagulation factor iii (thromboplastin, tissue factor) (F3, Accession NP_001984.1) is another GAM2071 target gene, herein designated TARGET GENE. F3 BINDING SITE is a target binding site found in the 3' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:15547, to the nucleotide sequence of GAM2071 RNA, herein designated GAM RNA, also designated SEQ ID:371.

Another function of GAM2071 is therefore inhibition of Coagulation factor iii (thromboplastin, tissue factor) (F3, Accession NP_001984.1), a gene which functions in normal hemostasis. Accordingly, utilities of GAM2071 include diagnosis, prevention and treatment of diseases and clinical conditions associated with F3.

The function of F3 and its association with various diseases and clinical conditions, has been established by previous studies, as described hereinabove with reference to GAM136.1. Family with sequence similarity 13, member a1 (FAM13A1, Accession NP_055698.1) is another GAM2071 target gene, herein designated TARGET GENE. FAM13A1 BINDING SITE is a target binding site found in the 3' untranslated region of mRNA encoded by FAM13A1, corresponding to a target binding site such as BINDING SITE I, BINDING SITE II or BINDING SITE III of FIG. 8. Table 4 illustrates the complementarity of the nucleotide sequences of FAM13A1 BINDING SITE, designated SEQ ID:17686, to the nucleotide sequence of GAM2071 RNA, herein designated GAM RNA, also designated SEQ ID:371.

Another function of GAM2071 is therefore inhibition of Family with sequence similarity 13, member a1 (FAM13A1, Accession NP_055698.1). Accordingly, utilities of GAM2071 include diagnosis, prevention and treatment of diseases and clinical conditions associated with FAM13A1.

Fanconi anemia, complementation group e (FANCE, Accession NP_068741.1) is another GAM2071 target gene, herein designated TARGET GENE. FANCE BINDING SITE is a target binding site found in the 3' untranslated region of mRNA encoded by FANCE, corresponding to a target binding site such as BINDING SITE I, BINDING SITE II or BINDING SITE III of FIG. 8. Table 4 illustrates the complementarity of the nucleotide sequences of FANCE BINDING SITE, designated SEQ ID:16751, to the nucleotide sequence of GAM2071 RNA, herein designated GAM RNA, also designated SEQ ID:371.

Another function of GAM2071 is therefore inhibition of Fanconi anemia, complementation group e (FANCE, Accession NP_068741.1), a gene which is a possible regulator of lymphocyte and platelet function. and therefore is associated with Fanconi anemia, complementation group e. Accordingly, utilities of GAM2071 include diagnosis, prevention and treatment of Fanconi anemia, complementation group e., and of other diseases and clinical conditions associated with FANCE.

The function of FANCE and its association with various diseases and clinical conditions, has been established by previous studies, as described hereinabove with reference to GAM189.1. Fanconi anemia, complementation group f (FANCF, Accession NP_073562.1) is another GAM2071 target gene, herein designated TARGET GENE. FANCF BINDING SITE is a target binding site found in the 3' untranslated region of mRNA encoded by FANCF, corresponding to a target binding site such as BINDING SITE I, BINDING SITE II or BINDING SITE III of FIG. 8. Table 4 illustrates the complementarity of the nucleotide sequences of FANCF BINDING SITE, designated SEQ ID:14445, to the nucleotide sequence of GAM2071 RNA, herein designated GAM RNA, also designated SEQ ID:371.

Another function of GAM2071 is therefore inhibition of Fanconi anemia, complementation group f (FANCF, Accession NP_073562.1). Accordingly, utilities of GAM2071 include diagnosis, prevention and treatment of diseases and clinical conditions associated with FANCF.

FAT3 (Accession XP_061871.5) is another GAM2071 target gene, herein designated TARGET GENE. FAT3 BINDING SITE is a target binding site found in the 3' untranslated region of mRNA encoded by FAT3, corresponding to a target binding site such as BINDING SITE I, BINDING SITE II or BINDING SITE III of FIG. 8. Table 4 illustrates the complementarity of the nucleotide sequences of FAT3 BINDING SITE, designated SEQ ID:7945, to the nucleotide sequence of GAM2071 RNA, herein designated GAM RNA, also designated SEQ ID:371.

Another function of GAM2071 is therefore inhibition of FAT3 (Accession XP_061871.5). Accordingly, utilities of GAM2071 include diagnosis, prevention and treatment of diseases and clinical conditions associated with FAT3.

Fibulin 1 (FBLN1, Accession NP_006476.1) is another GAM2071 target gene, herein designated TARGET GENE. FBLN1 BINDING SITE is a target binding site found in the 3' untranslated region of multiple transcripts of mRNA encoded by FBLN1, corresponding to a target binding site such as BINDING SITE I, BINDING SITE II or BINDING SITE III of FIG. 8. Table 4 illustrates the complementarity of the nucleotide sequences of FBLN1 BINDING SITE, designated SEQ ID:2764, to the nucleotide sequence of GAM2071 RNA, herein designated GAM RNA, also designated SEQ ID:371.

Another function of GAM2071 is therefore inhibition of Fibulin 1 (FBLN1, Accession NP_006476.1), a gene which secreted glycoprotein; has EGF-like repeats, similar to anaphylatoxins C3a, C4a, and C5a. Accordingly, utilities of GAM2071 include diagnosis, prevention and treatment of diseases and clinical conditions associated with FBLN1.

The function of FBLN1 and its association with various diseases and clinical conditions, has been established by previous studies, as described hereinabove with reference to GAM179.1. FBXW8 (Accession NP_036306.1) is another GAM2071 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:20011, to the nucleotide sequence of GAM2071 RNA, herein designated GAM RNA, also designated SEQ ID:371.

Another function of GAM2071 is therefore inhibition of FBXW8 (Accession NP_036306.1). Accordingly, utilities of GAM2071 include diagnosis, prevention and treatment of diseases and clinical conditions associated with FBXW8.

FBXW8 (Accession NP_699179.2) is another GAM2071 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:20011, to the nucleotide sequence of GAM2071 RNA, herein designated GAM RNA, also designated SEQ ID:371.

Another function of GAM2071 is therefore inhibition of FBXW8 (Accession NP_699179.2). Accordingly, utilities of GAM2071 include diagnosis, prevention and treatment of diseases and clinical conditions associated with FBXW8.

Fc fragment of iga, receptor for (FCAR, Accession NP_579812.1) is another GAM2071 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:18209, SEQ ID:18209 and SEQ ID:10505 respectively, to the nucleotide sequence of GAM2071 RNA, herein designated GAM RNA, also designated SEQ ID:371.

Another function of GAM2071 is therefore inhibition of Fc fragment of iga, receptor for (FCAR, Accession NP_579812.1), a gene which binds to the fc region of immunoglobulins alpha and mediates several functions including cytokine production. and therefore may be associated with Iga nephropathy. Accordingly, utilities of GAM2071 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579808.1) is another GAM2071 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:18209, SEQ ID:18209 and SEQ ID:441 respectively, to the nucleotide sequence of GAM2071 RNA, herein designated GAM RNA, also designated SEQ ID:371.

Another function of GAM2071 is therefore inhibition of Fc fragment of iga, receptor for (FCAR, Accession NP_579808.1), a gene which binds to the fc region of immunoglobulins alpha and mediates several functions including cytokine production. and therefore may be associated with Iga nephropathy. Accordingly, utilities of GAM2071 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579806.1) is another GAM2071 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:18209, SEQ ID:441 and SEQ ID:18209 respectively, to the nucleotide sequence of GAM2071 RNA, herein designated GAM RNA, also designated SEQ ID:371.

Another function of GAM2071 is therefore inhibition of Fc fragment of iga, receptor for (FCAR, Accession NP_579806.1), a gene which binds to the fc region of immunoglobulins alpha and mediates several functions including cytokine production. and therefore may be associated with Iga nephropathy. Accordingly, utilities of GAM2071 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579807.1) is another GAM2071 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:18209, SEQ ID:10188 and SEQ ID:1759 respectively, to the nucleotide sequence of GAM2071 RNA, herein designated GAM RNA, also designated SEQ ID:371.

Another function of GAM2071 is therefore inhibition of Fc fragment of iga, receptor for (FCAR, Accession NP_579807.1), a gene which binds to the fc region of immunoglobulins alpha and mediates several functions including cytokine production. and therefore may be associated with Iga nephropathy. Accordingly, utilities of GAM2071 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fer-1-like 4 (c. elegans) (FER1L4, Accession XP_300246.1) is another GAM2071 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:1759, to the nucleotide sequence of GAM2071 RNA, herein designated GAM RNA, also designated SEQ ID:371.

Another function of GAM2071 is therefore inhibition of Fer-1-like 4 (c. elegans) (FER1L4, Accession XP_300246.1). Accordingly, utilities of GAM2071 include diagnosis, prevention and treatment of diseases and clinical conditions associated with FER1L4.

Fasciculation and elongation protein zeta 1 (zygin i) (FEZ1, Accession NP_072043.1) is another GAM2071 target gene, herein designated TARGET GENE. FEZ1 BINDING SITE is a target binding site found in the 3' untranslated region of multiple transcripts of mRNA encoded by FEZ1, corresponding to a target binding site such as BINDING SITE I, BINDING SITE II or BINDING SITE III of FIG. 8. Table 4 illustrates the complementarity of the nucleotide sequences of FEZ1 BINDING SITE, designated SEQ ID:659, to the nucleotide sequence of GAM2071 RNA, herein designated GAM RNA, also designated SEQ ID:371.

Another function of GAM2071 is therefore inhibition of Fasciculation and elongation protein zeta 1 (zygin i) (FEZ1, Accession NP_072043.1), a gene which Zygin 1; may have a role in axonal outgrowth; has similarity to C. elegans UNC-76. Accordingly, utilities of GAM2071 include diagnosis, prevention and treatment of diseases and clinical conditions associated with FEZ1.

The function of FEZ1 and its association with various diseases and clinical conditions, has been established by previous studies, as described hereinabove with reference to GAM30.1. Fibroblast growth factor 5 (FGF5, Accession NP_149134.1) is another GAM2071 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:3375, to the nucleotide sequence of GAM2071 RNA, herein designated GAM RNA, also designated SEQ ID:371.

Another function of GAM2071 is therefore inhibition of Fibroblast growth factor 5 (FGF5, Accession NP_149134.1), a gene which induces transformation and may regulate neuronal differentiation. Accordingly, utilities of GAM2071 include diagnosis, prevention and treatment of diseases and clinical conditions associated with FGF5.

The function of FGF5 and its association with various diseases and clinical conditions, has been established by previous studies, as described hereinabove with reference to GAM106.1. Fibroblast growth factor 5 (FGF5, Accession NP_004455.1) is another GAM2071 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:3375, to the nucleotide sequence of GAM2071 RNA, herein designated GAM RNA, also designated SEQ ID:371.

Another function of GAM2071 is therefore inhibition of Fibroblast growth factor 5 (FGF5, Accession NP_004455.1), a gene which induces transformation and may regulate neuronal differentiation. Accordingly, utilities of GAM2071 include diagnosis, prevention and treatment of diseases and clinical conditions associated with FGF5.

The function of FGF5 and its association with various diseases and clinical conditions, has been established by previous studies, as described hereinabove with reference to GAM106.1. Four and a half lim domains 2 (FHL2, Accession NP_001441.2) is another GAM2071 target gene, herein designated TARGET GENE. FHL2 BINDING SITE is a target binding site found in the 5' untranslated region of mRNA encoded by FHL2, corresponding to a target binding site such as BINDING SITE I, BINDING SITE II or BINDING SITE III of FIG. 8. Table 4 illustrates the complementarity of the nucleotide sequences of FHL2 BINDING SITE, designated SEQ ID:19820, to the nucleotide sequence of GAM2071 RNA, herein designated GAM RNA, also designated SEQ ID:371.

Another function of GAM2071 is therefore inhibition of Four and a half lim domains 2 (FHL2, Accession NP_001441.2), a gene which Contains four LIM domains and an additional zinc finger. Accordingly, utilities of GAM2071 include diagnosis, prevention and treatment of diseases and clinical conditions associated with FHL2.

The function of FHL2 and its association with various diseases and clinical conditions, has been established by previous studies, as described hereinabove with reference to GAM189.1. Fk506 binding protein 9, 63 kda (FKBP9, Accession NP_009201.1) is another GAM2071 target gene, herein designated TARGET GENE. FKBP9 BINDING SITE is a target binding site found in the 3' untranslated region of mRNA encoded by FKBP9, corresponding to a target binding site such as BINDING SITE I, BINDING SITE II or BINDING SITE III of FIG. 8. Table 4 illustrates the complementarity of the nucleotide sequences of FKBP9 BINDING SITE, designated SEQ ID:2718, to the nucleotide sequence of GAM2071 RNA, herein designated GAM RNA, also designated SEQ ID:371.

Another function of GAM2071 is therefore inhibition of Fk506 binding protein 9, 63 kda (FKBP9, Accession NP_009201.1). Accordingly, utilities of GAM2071 include diagnosis, prevention and treatment of diseases and clinical conditions associated with FKBP9.

FLJ00060 (Accession XP_028154.1) is another GAM2071 target gene, herein designated TARGET GENE. FLJ00060 BINDING SITE is a target binding site found in the 5' untranslated region of mRNA encoded by FLJ00060, corresponding to a target binding site such as BINDING SITE I, BINDING SITE II or BINDING SITE III of FIG. 8. Table 4 illustrates the complementarity of the nucleotide sequences of FLJ00060 BINDING SITE, designated SEQ ID:13800, to the nucleotide sequence of GAM2071 RNA, herein designated GAM RNA, also designated SEQ ID:371.

Another function of GAM2071 is therefore inhibition of FLJ00060 (Accession XP_028154.1). Accordingly, utilities of GAM2071 include diagnosis, prevention and treatment of diseases and clinical conditions associated with FLJ00060.

FLJ10101 (Accession NP_078994.1) is another GAM2071 target gene, herein designated TARGET GENE. FLJ10101 BINDING SITE is a target binding site found in the 3' untranslated region of mRNA encoded by FLJ10101, corresponding to a target binding site such as BINDING SITE I, BINDING SITE II or BINDING SITE III of FIG. 8. Table 4 illustrates the complementarity of the nucleotide sequences of FLJ10101 BINDING SITE, designated SEQ ID:10153, to the nucleotide sequence of GAM2071 RNA, herein designated GAM RNA, also designated SEQ ID:371.

Another function of GAM2071 is therefore inhibition of FLJ10101 (Accession NP_078994.1). Accordingly, utilities of GAM2071 include diagnosis, prevention and treatment of diseases and clinical conditions associated with FLJ10101.

FLJ10232 (Accession NP_060503.1) is another GAM2071 target gene, herein designated TARGET GENE. FLJ10232 BINDING SITE is a target binding site found in the 3' untranslated region of mRNA encoded by FLJ10232, corresponding to a target binding site such as BINDING SITE I, BINDING SITE II or BINDING SITE III of FIG. 8. Table 4 illustrates the complementarity of the nucleotide sequences of FLJ10232 BINDING SITE, designated SEQ ID:14903, to the nucleotide sequence of GAM2071 RNA, herein designated GAM RNA, also designated SEQ ID:371.

Another function of GAM2071 is therefore inhibition of FLJ10232 (Accession NP_060503.1). Accordingly, utilities of GAM2071 include diagnosis, prevention and treatment of diseases and clinical conditions associated with FLJ10232.

FLJ10298 (Accession NP_060520.2) is another GAM2071 target gene, herein designated TARGET GENE. FLJ10298 BINDING SITE is a target binding site found in the 3' untranslated region of mRNA encoded by FLJ10298, corresponding to a target binding site such as BINDING SITE I, BINDING SITE II or BINDING SITE III of FIG. 8. Table 4 illustrates the complementarity of the nucleotide sequences of FLJ10298 BINDING SITE, designated SEQ ID:468, to the nucleotide sequence of GAM2071 RNA, herein designated GAM RNA, also designated SEQ ID:371.

Another function of GAM2071 is therefore inhibition of FLJ10298 (Accession NP_060520.2). Accordingly, utilities of GAM2071 include diagnosis, prevention and treatment of diseases and clinical conditions associated with FLJ10298.

FLJ10346 (Accession NP_060535.1) is another GAM2071 target gene, herein designated TARGET GENE. FLJ10346 BINDING SITE is a target binding site found in the 5' untranslated region of mRNA encoded by FLJ10346, corresponding to a target binding site such as BINDING SITE I, BINDING SITE II or BINDING SITE III of FIG. 8. Table 4 illustrates the complementarity of the nucleotide sequences of FLJ10346 BINDING SITE, designated SEQ ID:7836, to the nucleotide sequence of GAM2071 RNA, herein designated GAM RNA, also designated SEQ ID:371.

Another function of GAM2071 is therefore inhibition of FLJ10346 (Accession NP_060535.1). Accordingly, utilities of GAM2071 include diagnosis, prevention and treatment of diseases and clinical conditions associated with FLJ10346.

FLJ10535 (Accession NP_060599.1) is another GAM2071 target gene, herein designated TARGET GENE. FLJ10535 BINDING SITE is a target binding site found in the 3' untranslated region of mRNA encoded by FLJ10535, corresponding to a target binding site such as BINDING SITE I, BINDING SITE II or BINDING SITE III of FIG. 8. Table 4 illustrates the complementarity of the nucleotide sequences of FLJ10535 BINDING SITE, designated SEQ ID:10633, to the nucleotide sequence of GAM2071 RNA, herein designated GAM RNA, also designated SEQ ID:371.

Another function of GAM2071 is therefore inhibition of FLJ10535 (Accession NP_060599.1). Accordingly, utilities of GAM2071 include diagnosis, prevention and treatment of diseases and clinical conditions associated with FLJ10535.

FLJ10640 (Accession NP_061896.1) is another GAM2071 target gene, herein designated TARGET GENE. FLJ10640 BINDING SITE is a target binding site found in the 5' untranslated region of mRNA encoded by FLJ10640, corresponding to a target binding site such as BINDING SITE I, BINDING SITE II or BINDING SITE III of FIG. 8. Table 4 illustrates the complementarity of the nucleotide sequences of FLJ10640 BINDING SITE, designated SEQ ID:16789, to the nucleotide sequence of GAM2071 RNA, herein designated GAM RNA, also designated SEQ ID:371.

Another function of GAM2071 is therefore inhibition of FLJ10640 (Accession NP_061896.1). Accordingly, utilities of GAM2071 include diagnosis, prevention and treatment of diseases and clinical conditions associated with FLJ10640.

FLJ10713 (Accession NP_060659.1) is another GAM2071 target gene, herein designated TARGET GENE. FLJ10713 BINDING SITE is a target binding site found in the 3' untranslated region of mRNA encoded by FLJ10713, corresponding to a target binding site such as BINDING SITE I, BINDING SITE II or BINDING SITE III of FIG. 8. Table 4 illustrates the complementarity of the nucleotide sequences of FLJ10713 BINDING SITE, designated SEQ ID:12092, to the nucleotide sequence of GAM2071 RNA, herein designated GAM RNA, also designated SEQ ID:371.

Another function of GAM2071 is therefore inhibition of FLJ10713 (Accession NP_060659.1). Accordingly, utilities of GAM2071 include diagnosis, prevention and treatment of diseases and clinical conditions associated with FLJ10713.

FLJ10737 (Accession NP_060668.1) is another GAM2071 target gene, herein designated TARGET GENE. FLJ10737 BINDING SITE is a target binding site found in the 3' untranslated region of mRNA encoded by FLJ10737, corresponding to a target binding site such as BINDING SITE I, BINDING SITE II or BINDING SITE III of FIG. 8. Table 4 illustrates the complementarity of the nucleotide sequences of FLJ10737 BINDING SITE, designated SEQ ID:2224, to the nucleotide sequence of GAM2071 RNA, herein designated GAM RNA, also designated SEQ ID:371.

Another function of GAM2071 is therefore inhibition of FLJ10737 (Accession NP_060668.1). Accordingly, utilities of GAM2071 include diagnosis, prevention and treatment of diseases and clinical conditions associated with FLJ10737.

FLJ10846 (Accession NP_060711.1) is another GAM2071 target gene, herein designated TARGET GENE. FLJ10846 BINDING SITE is a target binding site found in the 3' untranslated region of mRNA encoded by FLJ10846, corresponding to a target binding site such as BINDING SITE I, BINDING SITE II or BINDING SITE III of FIG. 8. Table 4 illustrates the complementarity of the nucleotide sequences of FLJ10846 BINDING SITE, designated SEQ ID:13800, to the nucleotide sequence of GAM2071 RNA, herein designated GAM RNA, also designated SEQ ID:371.

Another function of GAM2071 is therefore inhibition of FLJ10846 (Accession NP_060711.1). Accordingly, utilities of GAM2071 include diagnosis, prevention and treatment of diseases and clinical conditions associated with FLJ10846.

FLJ10847 (Accession NP_060712.2) is another GAM2071 target gene, herein designated TARGET GENE. FLJ10847 BINDING SITE is a target binding site found in the 3' untranslated region of mRNA encoded by FLJ10847, corresponding to a target binding site such as BINDING SITE I, BINDING SITE II or BINDING SITE III of FIG. 8. Table 4 illustrates the complementarity of the nucleotide sequences of FLJ10847 BINDING SITE, designated SEQ ID:18108, to the nucleotide sequence of GAM2071 RNA, herein designated GAM RNA, also designated SEQ ID:371.

Another function of GAM2071 is therefore inhibition of FLJ10847 (Accession NP_060712.2). Accordingly, utilities of GAM2071 include diagnosis, prevention and treatment of diseases and clinical conditions associated with FLJ10847.

FLJ10998 (Accession NP_060764.2) is another GAM2071 target gene, herein designated TARGET GENE. FLJ10998 BINDING SITE is a target binding site found in the 3' untranslated region of mRNA encoded by FLJ10998, corresponding to a target binding site such as BINDING SITE I, BINDING SITE II or BINDING SITE III of FIG. 8. Table 4 illustrates the complementarity of the nucleotide sequences of FLJ10998 BINDING SITE, designated SEQ ID:20020, to the nucleotide sequence of GAM2071 RNA, herein designated GAM RNA, also designated SEQ ID:371.

Another function of GAM2071 is therefore inhibition of FLJ10998 (Accession NP_060764.2). Accordingly, utilities of GAM2071 include diagnosis, prevention and treatment of diseases and clinical conditions associated with FLJ10998.

FLJ11274 (Accession NP_060845.1) is another GAM2071 target gene, herein designated TARGET GENE. FLJ11274 BINDING SITE is a target binding site found in the 5' untranslated region of mRNA encoded by FLJ11274, corresponding to a target binding site such as BINDING SITE I, BINDING SITE II or BINDING SITE III of FIG. 8. Table 4 illustrates the complementarity of the nucleotide sequences of FLJ11274 BINDING SITE, designated SEQ ID:7307, to the nucleotide sequence of GAM2071 RNA, herein designated GAM RNA, also designated SEQ ID:371.

Another function of GAM2071 is therefore inhibition of FLJ11274 (Accession NP_060845.1). Accordingly, utilities of GAM2071 include diagnosis, prevention and treatment of diseases and clinical conditions associated with FLJ11274.

FLJ11323 (Accession NP_060860.1) is another GAM2071 target gene, herein designated TARGET GENE. FLJ11323 BINDING SITE is a target binding site found in the 3' untranslated region of multiple transcripts of mRNA encoded by FLJ11323, corresponding to a target binding site such as BINDING SITE I, BINDING SITE II or BINDING SITE III of FIG. 8. Table 4 illustrates the complementarity of the nucleotide sequences of FLJ11323 BINDING SITE, designated SEQ ID:13280, to the nucleotide sequence of GAM2071 RNA, herein designated GAM RNA, also designated SEQ ID:371.

Another function of GAM2071 is therefore inhibition of FLJ11323 (Accession NP_060860.1). Accordingly, utilities of GAM2071 include diagnosis, prevention and treatment of diseases and clinical conditions associated with FLJ11323.

FLJ11467 (Accession NP_079239.2) is another GAM2071 target gene, herein designated TARGET GENE. FLJ11467 BINDING SITE is a target binding site found in the 3' untranslated region of mRNA encoded by FLJ11467, corresponding to a target binding site such as BINDING SITE I, BINDING SITE II or BINDING SITE III of FIG. 8. Table 4 illustrates the complementarity of the nucleotide sequences of FLJ11467 BINDING SITE, designated SEQ ID:9552, to the nucleotide sequence of GAM2071 RNA, herein designated GAM RNA, also designated SEQ ID:371.

Another function of GAM2071 is therefore inhibition of FLJ11467 (Accession NP_079239.2). Accordingly, utilities of GAM2071 include diagnosis, prevention and treatment of diseases and clinical conditions associated with FLJ11467.

FLJ11710 (Accession NP_079122.1) is another GAM2071 target gene, herein designated TARGET GENE. FLJ11710 BINDING SITE is a target binding site found in the 3' untranslated region of mRNA encoded by FLJ11710, corresponding to a target binding site such as BINDING SITE I, BINDING SITE II or BINDING SITE III of FIG. 8. Table 4 illustrates the complementarity of the nucleotide sequences of FLJ11710 BINDING SITE, designated SEQ ID:6034, to the nucleotide sequence of GAM2071 RNA, herein designated GAM RNA, also designated SEQ ID:371.

Another function of GAM2071 is therefore inhibition of FLJ11710 (Accession NP_079122.1). Accordingly, utilities of GAM2071 include diagnosis, prevention and treatment of diseases and clinical conditions associated with FLJ11710.

FLJ11800 (Accession NP_079250.1) is another GAM2071 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:17222, to the nucleotide sequence of GAM2071 RNA, herein designated GAM RNA, also designated SEQ ID:371.

Another function of GAM2071 is therefore inhibition of FLJ11800 (Accession NP_079250.1). Accordingly, utilities of GAM2071 include diagnosis, prevention and treatment of diseases and clinical conditions associated with FLJ11800.

FLJ12363 (Accession NP_115543.1) is another GAM2071 target gene, herein designated TARGET GENE. FLJ12363 BINDING SITE is a target binding site found in the 3' untranslated region of mRNA encoded by FLJ12363, corresponding to a target binding site such as BINDING SITE I, BINDING SITE II or BINDING SITE III of FIG. 8. Table 4 illustrates the complementarity of the nucleotide sequences of FLJ12363 BINDING SITE, designated SEQ ID:14486, to the nucleotide sequence of GAM2071 RNA, herein designated GAM RNA, also designated SEQ ID:371.

Another function of GAM2071 is therefore inhibition of FLJ12363 (Accession NP_115543.1). Accordingly, utilities of GAM2071 include diagnosis, prevention and treatment of diseases and clinical conditions associated with FLJ12363.

FLJ12572 (Accession NP_075056.2) is another GAM2071 target gene, herein designated TARGET GENE. FLJ12572 BINDING SITE is a target binding site found in the 5' untranslated region of mRNA encoded by FLJ12572, corresponding to a target binding site such as BINDING SITE I, BINDING SITE II or BINDING SITE III of FIG. 8. Table 4 illustrates the complementarity of the nucleotide sequences of FLJ12572 BINDING SITE, designated SEQ ID:14282, to the nucleotide sequence of GAM2071 RNA, herein designated GAM RNA, also designated SEQ ID:371.

Another function of GAM2071 is therefore inhibition of FLJ12572 (Accession NP_075056.2). Accordingly, utilities of GAM2071 include diagnosis, prevention and treatment of diseases and clinical conditions associated with FLJ12572.

FLJ12586 (Accession NP_078896.2) is another GAM2071 target gene, herein designated TARGET GENE. FLJ12586 BINDING SITE is a target binding site found in the 5' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:13509, to the nucleotide sequence of GAM2071 RNA, herein designated GAM RNA, also designated SEQ ID:371.

Another function of GAM2071 is therefore inhibition of FLJ12586 (Accession NP_078896.2). Accordingly, utilities of GAM2071 include diagnosis, prevention and treatment of diseases and clinical conditions associated with FLJ12586.

FLJ12747 (Accession XP_290972.1) is another GAM2071 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:8373, to the nucleotide sequence of GAM2071 RNA, herein designated GAM RNA, also designated SEQ ID:371.

Another function of GAM2071 is therefore inhibition of FLJ12747 (Accession XP_290972.1). Accordingly, utilities of GAM2071 include diagnosis, prevention and treatment of diseases and clinical conditions associated with FLJ12747.

FLJ12888 (Accession NP_079221.1) is another GAM2071 target gene, herein designated TARGET GENE. FLJ12888 BINDING SITE is a target binding site found in the 3' untranslated region of mRNA encoded by FLJ12888, corresponding to a target binding site such as BINDING SITE I, BINDING SITE II or BINDING SITE III of FIG. 8. Table 4 illustrates the complementarity of the nucleotide sequences of FLJ12888 BINDING SITE, designated SEQ ID:1302, to the nucleotide sequence of GAM2071 RNA, herein designated GAM RNA, also designated SEQ ID:371.

Another function of GAM2071 is therefore inhibition of FLJ12888 (Accession NP_079221.1). Accordingly, utilities of GAM2071 include diagnosis, prevention and treatment of diseases and clinical conditions associated with FLJ12888.

FLJ12891 (Accession NP_079226.1) is another GAM2071 target gene, herein designated TARGET GENE. FLJ12891 BINDING SITE is a target binding site found in the 3' untranslated region of mRNA encoded by FLJ12891, corresponding to a target binding site such as BINDING SITE I, BINDING SITE II or BINDING SITE III of FIG. 8. Table 4 illustrates the complementarity of the nucleotide sequences of FLJ12891 BINDING SITE, designated SEQ ID:13646, to the nucleotide sequence of GAM2071 RNA, herein designated GAM RNA, also designated SEQ ID:371.

Another function of GAM2071 is therefore inhibition of FLJ12891 (Accession NP_079226.1). Accordingly, utilities of GAM2071 include diagnosis, prevention and treatment of diseases and clinical conditions associated with FLJ12891.

FLJ12903 (Accession NP_073590.1) is another GAM2071 target gene, herein designated TARGET GENE. FLJ12903 BINDING SITE is a target binding site found in the 3' untranslated region of mRNA encoded by FLJ12903, corresponding to a target binding site such as BINDING SITE I, BINDING SITE II or BINDING SITE III of FIG. 8. Table 4 illustrates the complementarity of the nucleotide sequences of FLJ12903 BINDING SITE, designated SEQ ID:4783, to the nucleotide sequence of GAM2071 RNA, herein designated GAM RNA, also designated SEQ ID:371.

Another function of GAM2071 is therefore inhibition of FLJ12903 (Accession NP_073590.1). Accordingly, utilities of GAM2071 include diagnosis, prevention and treatment of diseases and clinical conditions associated with FLJ12903.

FLJ12960 (Accession NP_078914.1) is another GAM2071 target gene, herein designated TARGET GENE. FLJ12960 BINDING SITE is a target binding site found in the 3' untranslated region of mRNA encoded by FLJ12960, corresponding to a target binding site such as BINDING SITE I, BINDING SITE II or BINDING SITE III of FIG. 8. Table 4 illustrates the complementarity of the nucleotide sequences of FLJ12960 BINDING SITE, designated SEQ ID:3109, to the nucleotide sequence of GAM2071 RNA, herein designated GAM RNA, also designated SEQ ID:371.

Another function of GAM2071 is therefore inhibition of FLJ12960 (Accession NP_078914.1). Accordingly, utilities of GAM2071 include diagnosis, prevention and treatment of diseases and clinical conditions associated with FLJ12960.

FLJ12975 (Accession NP_079085.2) is another GAM2071 target gene, herein designated TARGET GENE. FLJ12975 BINDING SITE is a target binding site found in the 3' untranslated region of mRNA encoded by FLJ12975, corresponding to a target binding site such as BINDING SITE I, BINDING SITE II or BINDING SITE III of FIG. 8. Table 4 illustrates the complementarity of the nucleotide sequences of FLJ12975 BINDING SITE, designated SEQ ID:836, to the nucleotide sequence of GAM2071 RNA, herein designated GAM RNA, also designated SEQ ID:371.

Another function of GAM2071 is therefore inhibition of FLJ12975 (Accession NP_079085.2). Accordingly, utilities of GAM2071 include diagnosis, prevention and treatment of diseases and clinical conditions associated with FLJ12975.

FLJ13072 (Accession XP_117117.2) is another GAM2071 target gene, herein designated TARGET GENE. FLJ13072 BINDING SITE is a target binding site found in the 3' untranslated region of mRNA encoded by FLJ13072, corresponding to a target binding site such as BINDING SITE I, BINDING SITE II or BINDING SITE III of FIG. 8. Table 4 illustrates the complementarity of the nucleotide sequences of FLJ13072 BINDING SITE, designated SEQ ID:6870, to the nucleotide sequence of GAM2071 RNA, herein designated GAM RNA, also designated SEQ ID:371.

Another function of GAM2071 is therefore inhibition of FLJ13072 (Accession XP_117117.2). Accordingly, utilities of GAM2071 include diagnosis, prevention and treatment of diseases and clinical conditions associated with FLJ13072.

FLJ13081 (Accession NP_079110.1) is another GAM2071 target gene, herein designated TARGET GENE. FLJ13081 BINDING SITE is a target binding site found in the 3' untranslated region of mRNA encoded by FLJ13081, corresponding to a target binding site such as BINDING SITE I, BINDING SITE II or BINDING SITE III of FIG. 8. Table 4 illustrates the complementarity of the nucleotide sequences of FLJ13081 BINDING SITE, designated SEQ ID:3389, to the nucleotide sequence of GAM2071 RNA, herein designated GAM RNA, also designated SEQ ID:371.

Another function of GAM2071 is therefore inhibition of FLJ13081 (Accession NP_079110.1). Accordingly, utilities of GAM2071 include diagnosis, prevention and treatment of diseases and clinical conditions associated with FLJ13081.

FLJ13188 (Accession NP_071346.1) is another GAM2071 target gene, herein designated TARGET GENE. FLJ13188 BINDING SITE is a target binding site found in the 3' untranslated region of mRNA encoded by FLJ13188, corresponding to a target binding site such as BINDING SITE I, BINDING SITE II or BINDING SITE III of FIG. 8. Table 4 illustrates the complementarity of the nucleotide sequences of FLJ13188 BINDING SITE, designated SEQ ID:12816, to the nucleotide sequence of GAM2071 RNA, herein designated GAM RNA, also designated SEQ ID:371.

Another function of GAM2071 is therefore inhibition of FLJ13188 (Accession NP_071346.1). Accordingly, utilities of GAM2071 include diagnosis, prevention and treatment of diseases and clinical conditions associated with FLJ13188.

FLJ13197 (Accession NP_078890.1) is another GAM2071 target gene, herein designated TARGET GENE. FLJ13197 BINDING SITE is a target binding site found in the 3' untranslated region of mRNA encoded by FLJ13197, corresponding to a target binding site such as BINDING SITE I, BINDING SITE II or BINDING SITE III of FIG. 8. Table 4 illustrates the complementarity of the nucleotide sequences of FLJ13197 BINDING SITE, designated SEQ ID:7946, to the nucleotide sequence of GAM2071 RNA, herein designated GAM RNA, also designated SEQ ID:371.

Another function of GAM2071 is therefore inhibition of FLJ13197 (Accession NP_078890.1). Accordingly, utilities of GAM2071 include diagnosis, prevention and treatment of diseases and clinical conditions associated with FLJ13197.

FLJ13456 (Accession XP_038291.5) is another GAM2071 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:5409, to the nucleotide sequence of GAM2071 RNA, herein designated GAM RNA, also designated SEQ ID:371.

Another function of GAM2071 is therefore inhibition of FLJ13456 (Accession XP_038291.5). Accordingly, utilities of GAM2071 include diagnosis, prevention and treatment of diseases and clinical conditions associated with FLJ13456.

FLJ13590 (Accession NP_079116.2) is another GAM2071 target gene, herein designated TARGET GENE. FLJ13590 BINDING SITE is a target binding site found in the 5' untranslated region of mRNA encoded by FLJ13590, corresponding to a target binding site such as BINDING SITE I, BINDING SITE II or BINDING SITE III of FIG. 8. Table 4 illustrates the complementarity of the nucleotide sequences of FLJ13590 BINDING SITE, designated SEQ ID:6935, to the nucleotide sequence of GAM2071 RNA, herein designated GAM RNA, also designated SEQ ID:371.

Another function of GAM2071 is therefore inhibition of FLJ13590 (Accession NP_079116.2). Accordingly, utilities of GAM2071 include diagnosis, prevention and treatment of diseases and clinical conditions associated with FLJ13590.

FLJ13639 (Accession NP_078981.1) is another GAM2071 target gene, herein designated TARGET GENE. FLJ13639 BINDING SITE is a target binding site found in the 3' untranslated region of mRNA encoded by FLJ13639, corresponding to a target binding site such as BINDING SITE I, BINDING SITE II or BINDING SITE III of FIG. 8. Table 4 illustrates the complementarity of the nucleotide sequences of FLJ13639 BINDING SITE, designated SEQ ID:1788, to the nucleotide sequence of GAM2071 RNA, herein designated GAM RNA, also designated SEQ ID:371.

Another function of GAM2071 is therefore inhibition of FLJ13639 (Accession NP_078981.1). Accordingly, utilities of GAM2071 include diagnosis, prevention and treatment of diseases and clinical conditions associated with FLJ13639.

FLJ13984 (Accession NP_079046.1) is another GAM2071 target gene, herein designated TARGET GENE. FLJ13984 BINDING SITE is a target binding site found in the 5' untranslated region of mRNA encoded by FLJ13984, corresponding to a target binding site such as BINDING SITE I, BINDING SITE II or BINDING SITE III of FIG. 8. Table 4 illustrates the complementarity of the nucleotide sequences of FLJ13984 BINDING SITE, designated SEQ ID:16972, to the nucleotide sequence of GAM2071 RNA, herein designated GAM RNA, also designated SEQ ID:371.

Another function of GAM2071 is therefore inhibition of FLJ13984 (Accession NP_079046.1). Accordingly, utilities of GAM2071 include diagnosis, prevention and treatment of diseases and clinical conditions associated with FLJ13984.

FLJ14351 (Accession NP_079008.1) is another GAM2071 target gene, herein designated TARGET GENE. FLJ14351 BINDING SITE is a target binding site found in the 3' untranslated region of mRNA encoded by FLJ14351, corresponding to a target binding site such as BINDING SITE I, BINDING SITE II or BINDING SITE III of FIG. 8. Table 4 illustrates the complementarity of the nucleotide sequences of FLJ14351 BINDING SITE, designated SEQ ID:8244, to the nucleotide sequence of GAM2071 RNA, herein designated GAM RNA, also designated SEQ ID:371.

Another function of GAM2071 is therefore inhibition of FLJ14351 (Accession NP_079008.1). Accordingly, utilities of GAM2071 include diagnosis, prevention and treatment of diseases and clinical conditions associated with FLJ14351.

FLJ14641 (Accession NP_116206.1) is another GAM2071 target gene, herein designated TARGET GENE. FLJ14641 BINDING SITE is a target binding site found in the 3' untranslated region of mRNA encoded by FLJ14641, corresponding to a target binding site such as BINDING SITE I, BINDING SITE II or BINDING SITE III of FIG. 8. Table 4 illustrates the complementarity of the nucleotide sequences of FLJ14641 BINDING SITE, designated SEQ ID:18641, to the nucleotide sequence of GAM2071 RNA, herein designated GAM RNA, also designated SEQ ID:371.

Another function of GAM2071 is therefore inhibition of FLJ14641 (Accession NP_116206.1). Accordingly, utilities of GAM2071 include diagnosis, prevention and treatment of diseases and clinical conditions associated with FLJ14641.

FLJ14803 (Accession NP_116231.1) is another GAM2071 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:3409, to the nucleotide sequence of GAM2071 RNA, herein designated GAM RNA, also designated SEQ ID:371.

Another function of GAM2071 is therefore inhibition of FLJ14803 (Accession NP_116231.1). Accordingly, utilities of GAM2071 include diagnosis, prevention and treatment of diseases and clinical conditions associated with FLJ14803.

FLJ20045 (Accession NP_060108.1) is another GAM2071 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:19070, to the nucleotide sequence of GAM2071 RNA, herein designated GAM RNA, also designated SEQ ID:371.

Another function of GAM2071 is therefore inhibition of FLJ20045 (Accession NP_060108.1). Accordingly, utilities of GAM2071 include diagnosis, prevention and treatment of diseases and clinical conditions associated with FLJ20045.

FLJ20095 (Accession NP_060136.1) is another GAM2071 target gene, herein designated TARGET GENE. FLJ20095 BINDING SITE is a target binding site found in the 3' untranslated region of mRNA encoded by FLJ20095, corresponding to a target binding site such as BINDING SITE I, BINDING SITE II or BINDING SITE III of FIG. 8. Table 4 illustrates the complementarity of the nucleotide sequences of FLJ20095 BINDING SITE, designated SEQ ID:13800, to the nucleotide sequence of GAM2071 RNA, herein designated GAM RNA, also designated SEQ ID:371.

Another function of GAM2071 is therefore inhibition of FLJ20095 (Accession NP_060136.1). Accordingly, utilities of GAM2071 include diagnosis, prevention and treatment of diseases and clinical conditions associated with FLJ20095.

FLJ20344 (Accession NP_060246.1) is another GAM2071 target gene, herein designated TARGET GENE. FLJ20344 BINDING SITE is a target binding site found in the 3' untranslated region of mRNA encoded by FLJ20344, corresponding to a target binding site such as BINDING SITE I, BINDING SITE II or BINDING SITE III of FIG. 8. Table 4 illustrates the complementarity of the nucleotide sequences of FLJ20344 BINDING SITE, designated SEQ ID:8639, to the nucleotide sequence of GAM2071 RNA, herein designated GAM RNA, also designated SEQ ID:371.

Another function of GAM2071 is therefore inhibition of FLJ20344 (Accession NP_060246.1). Accordingly, utilities of GAM2071 include diagnosis, prevention and treatment of diseases and clinical conditions associated with FLJ20344.

FLJ20507 (Accession NP_060319.1) is another GAM2071 target gene, herein designated TARGET GENE. FLJ20507 BINDING SITE is a target binding site found in the 3' untranslated region of mRNA encoded by FLJ20507, corresponding to a target binding site such as BINDING SITE I, BINDING SITE II or BINDING SITE III of FIG. 8. Table 4 illustrates the complementarity of the nucleotide sequences of FLJ20507 BINDING SITE, designated SEQ ID:12154, to the nucleotide sequence of GAM2071 RNA, herein designated GAM RNA, also designated SEQ ID:371.

Another function of GAM2071 is therefore inhibition of FLJ20507 (Accession NP_060319.1). Accordingly, utilities of GAM2071 include diagnosis, prevention and treatment of diseases and clinical conditions associated with FLJ20507.

FLJ20511 (Accession NP_060323.1) is another GAM2071 target gene, herein designated TARGET GENE. FLJ20511 BINDING SITE is a target binding site found in the 3' untranslated region of mRNA encoded by FLJ20511, corresponding to a target binding site such as BINDING SITE I, BINDING SITE II or BINDING SITE III of FIG. 8. Table 4 illustrates the complementarity of the nucleotide sequences of FLJ20511 BINDING SITE, designated SEQ ID:969, to the nucleotide sequence of GAM2071 RNA, herein designated GAM RNA, also designated SEQ ID:371.

Another function of GAM2071 is therefore inhibition of FLJ20511 (Accession NP_060323.1). Accordingly, utilities of GAM2071 include diagnosis, prevention and treatment of diseases and clinical conditions associated with FLJ20511.

FLJ20671 (Accession NP_060394.1) is another GAM2071 target gene, herein designated TARGET GENE. FLJ20671 BINDING SITE1 and FLJ20671 BINDING SITE2 are target binding sites found in untranslated regions of mRNA encoded by FLJ20671, corresponding to target binding sites such as BINDING SITE I, BINDING SITE II or BINDING SITE III of FIG. 8. Table 4 illustrates the complementarity of the nucleotide sequences of FLJ20671 BINDING SITE1 and FLJ20671 BINDING SITE2, designated SEQ ID:13745 and SEQ ID:10861 respectively, to the nucleotide sequence of GAM2071 RNA, herein designated GAM RNA, also designated SEQ ID:371.

Another function of GAM2071 is therefore inhibition of FLJ20671 (Accession NP_060394.1). Accordingly, utilities of GAM2071 include diagnosis, prevention and treatment of diseases and clinical conditions associated with FLJ20671.

FLJ20700 (Accession NP_060402.1) is another GAM2071 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:20156, to the nucleotide sequence of GAM2071 RNA, herein designated GAM RNA, also designated SEQ ID:371.

Another function of GAM2071 is therefore inhibition of FLJ20700 (Accession NP_060402.1). Accordingly, utilities of GAM2071 include diagnosis, prevention and treatment of diseases and clinical conditions associated with FLJ20700.

FLJ20813 (Accession NP_060431.1) is another GAM2071 target gene, herein designated TARGET GENE. FLJ20813 BINDING SITE is a target binding site found in the 3' untranslated region of mRNA encoded by FLJ20813, corresponding to a target binding site such as BINDING SITE I, BINDING SITE II or BINDING SITE III of FIG. 8. Table 4 illustrates the complementarity of the nucleotide sequences of FLJ20813 BINDING SITE, designated SEQ ID:18464, to the nucleotide sequence of GAM2071 RNA, herein designated GAM RNA, also designated SEQ ID:371.

Another function of GAM2071 is therefore inhibition of FLJ20813 (Accession NP_060431.1). Accordingly, utilities of GAM2071 include diagnosis, prevention and treatment of diseases and clinical conditions associated with FLJ20813.

FLJ21603 (Accession NP_079038.1) is another GAM2071 target gene, herein designated TARGET GENE. FLJ21603 BINDING SITE is a target binding site found in the 3' untranslated region of mRNA encoded by FLJ21603, corresponding to a target binding site such as BINDING SITE I, BINDING SITE II or BINDING SITE III of FIG. 8. Table 4 illustrates the complementarity of the nucleotide sequences of FLJ21603 BINDING SITE, designated SEQ ID:11662, to the nucleotide sequence of GAM2071 RNA, herein designated GAM RNA, also designated SEQ ID:371.

Another function of GAM2071 is therefore inhibition of FLJ21603 (Accession NP_079038.1). Accordingly, utilities of GAM2071 include diagnosis, prevention and treatment of diseases and clinical conditions associated with FLJ21603.

FLJ21673 (Accession NP_112160.1) is another GAM2071 target gene, herein designated TARGET GENE. FLJ21673 BINDING SITE is a target binding site found in the 5' untranslated region of mRNA encoded by FLJ21673, corresponding to a target binding site such as BINDING SITE I, BINDING SITE II or BINDING SITE III of FIG. 8. Table 4 illustrates the complementarity of the nucleotide sequences of FLJ21673 BINDING SITE, designated SEQ ID:1926, to the nucleotide sequence of GAM2071 RNA, herein designated GAM RNA, also designated SEQ ID:371.

Another function of GAM2071 is therefore inhibition of FLJ21673 (Accession NP_112160.1). Accordingly, utilities of GAM2071 include diagnosis, prevention and treatment of diseases and clinical conditions associated with FLJ21673.

FLJ21777 (Accession NP_115585.1) is another GAM2071 target gene, herein designated TARGET GENE. FLJ21777 BINDING SITE is a target binding site found in the 3' untranslated region of mRNA encoded by FLJ21777, corresponding to a target binding site such as BINDING SITE I, BINDING SITE II or BINDING SITE III of FIG. 8. Table 4 illustrates the complementarity of the nucleotide sequences of FLJ21777 BINDING SITE, designated SEQ ID:13303, to the nucleotide sequence of GAM2071 RNA, herein designated GAM RNA, also designated SEQ ID:371.

Another function of GAM2071 is therefore inhibition of FLJ21777 (Accession NP_115585.1). Accordingly, utilities of GAM2071 include diagnosis, prevention and treatment of diseases and clinical conditions associated with FLJ21777.

FLJ22167 (Accession NP_078809.2) is another GAM2071 target gene, herein designated TARGET GENE. FLJ22167 BINDING SITE is a target binding site found in the 5' untranslated region of mRNA encoded by FLJ22167, corresponding to a target binding site such as BINDING SITE I, BINDING SITE II or BINDING SITE III of FIG. 8. Table 4 illustrates the complementarity of the nucleotide sequences of FLJ22167 BINDING SITE, designated SEQ ID:2733, to the nucleotide sequence of GAM2071 RNA, herein designated GAM RNA, also designated SEQ ID:371.

Another function of GAM2071 is therefore inhibition of FLJ22167 (Accession NP_078809.2). Accordingly, utilities of GAM2071 include diagnosis, prevention and treatment of diseases and clinical conditions associated with FLJ22167.

FLJ22329 (Accession NP_078932.2) is another GAM2071 target gene, herein designated TARGET GENE. FLJ22329 BINDING SITE is a target binding site found in the 3' untranslated region of mRNA encoded by FLJ22329, corresponding to a target binding site such as BINDING SITE I, BINDING SITE II or BINDING SITE III of FIG. 8. Table 4 illustrates the complementarity of the nucleotide sequences of FLJ22329 BINDING SITE, designated SEQ ID:10803, to the nucleotide sequence of GAM2071 RNA, herein designated GAM RNA, also designated SEQ ID:371.

Another function of GAM2071 is therefore inhibition of FLJ22329 (Accession NP_078932.2). Accordingly, utilities of GAM2071 include diagnosis, prevention and treatment of diseases and clinical conditions associated with FLJ22329.

FLJ22531 (Accession NP_078926.2) is another GAM2071 target gene, herein designated TARGET GENE. FLJ22531 BINDING SITE is a target binding site found in the 5' untranslated region of mRNA encoded by FLJ22531, corresponding to a target binding site such as BINDING SITE I, BINDING SITE II or BINDING SITE III of FIG. 8. Table 4 illustrates the complementarity of the nucleotide sequences of FLJ22531 BINDING SITE, designated SEQ ID:3548, to the nucleotide sequence of GAM2071 RNA, herein designated GAM RNA, also designated SEQ ID:371.

Another function of GAM2071 is therefore inhibition of FLJ22531 (Accession NP_078926.2). Accordingly, utilities of GAM2071 include diagnosis, prevention and treatment of diseases and clinical conditions associated with FLJ22531.

FLJ22965 (Accession NP_071384.1) is another GAM2071 target gene, herein designated TARGET GENE. FLJ22965 BINDING SITE is a target binding site found in the 3' untranslated region of mRNA encoded by FLJ22965, corresponding to a target binding site such as BINDING SITE I, BINDING SITE II or BINDING SITE III of FIG. 8. Table 4 illustrates the complementarity of the nucleotide sequences of FLJ22965 BINDING SITE, designated SEQ ID:9754, to the nucleotide sequence of GAM2071 RNA, herein designated GAM RNA, also designated SEQ ID:371.

Another function of GAM2071 is therefore inhibition of FLJ22965 (Accession NP_071384.1). Accordingly, utilities of GAM2071 include diagnosis, prevention and treatment of diseases and clinical conditions associated with FLJ22965.

FLJ23022 (Accession NP_079327.1) is another GAM2071 target gene, herein designated TARGET GENE. FLJ23022 BINDING SITE is a target binding site found in the 3' untranslated region of mRNA encoded by FLJ23022, corresponding to a target binding site such as BINDING SITE I, BINDING SITE II or BINDING SITE III of FIG. 8. Table 4 illustrates the complementarity of the nucleotide sequences of FLJ23022 BINDING SITE, designated SEQ ID:541, to the nucleotide sequence of GAM2071 RNA, herein designated GAM RNA, also designated SEQ ID:371.

Another function of GAM2071 is therefore inhibition of FLJ23022 (Accession NP_079327.1). Accordingly, utilities of GAM2071 include diagnosis, prevention and treatment of diseases and clinical conditions associated with FLJ23022.

FLJ23040 (Accession NP_079450.1) is another GAM2071 target gene, herein designated TARGET GENE. FLJ23040 BINDING SITE is a target binding site found in the 3' untranslated region of mRNA encoded by FLJ23040, corresponding to a target binding site such as BINDING SITE I, BINDING SITE II or BINDING SITE III of FIG. 8. Table 4 illustrates the complementarity of the nucleotide sequences of FLJ23040 BINDING SITE, designated SEQ ID:12648, to the nucleotide sequence of GAM2071 RNA, herein designated GAM RNA, also designated SEQ ID:371.

Another function of GAM2071 is therefore inhibition of FLJ23040 (Accession NP_079450.1). Accordingly, utilities of GAM2071 include diagnosis, prevention and treatment of diseases and clinical conditions associated with FLJ23040.

FLJ23053 (Accession NP_075058.1) is another GAM2071 target gene, herein designated TARGET GENE. FLJ23053 BINDING SITE is a target binding site found in the 3' untranslated region of mRNA encoded by FLJ23053, corresponding to a target binding site such as BINDING SITE I, BINDING SITE II or BINDING SITE III of FIG. 8. Table 4 illustrates the complementarity of the nucleotide sequences of FLJ23053 BINDING SITE, designated SEQ ID:16973, to the nucleotide sequence of GAM2071 RNA, herein designated GAM RNA, also designated SEQ ID:371.

Another function of GAM2071 is therefore inhibition of FLJ23053 (Accession NP_075058.1). Accordingly, utilities of GAM2071 include diagnosis, prevention and treatment of diseases and clinical conditions associated with FLJ23053.

FLJ23186 (Accession NP_078892.1) is another GAM2071 target gene, herein designated TARGET GENE. FLJ23186 BINDING SITE is a target binding site found in the 3' untranslated region of mRNA encoded by FLJ23186, corresponding to a target binding site such as BINDING SITE I, BINDING SITE II or BINDING SITE III of FIG. 8. Table 4 illustrates the complementarity of the nucleotide sequences of FLJ23186 BINDING SITE, designated SEQ ID:10010, to the nucleotide sequence of GAM2071 RNA, herein designated GAM RNA, also designated SEQ ID:371.

Another function of GAM2071 is therefore inhibition of FLJ23186 (Accession NP_078892.1). Accordingly, utilities of GAM2071 include diagnosis, prevention and treatment of diseases and clinical conditions associated with FLJ23186.

FLJ23263 (Accession NP_079391.1) is another GAM2071 target gene, herein designated TARGET GENE. FLJ23263 BINDING SITE is a target binding site found in the 5' untranslated region of mRNA encoded by FLJ23263, corresponding to a target binding site such as BINDING SITE I, BINDING SITE II or BINDING SITE III of FIG. 8. Table 4 illustrates the complementarity of the nucleotide sequences of FLJ23263 BINDING SITE, designated SEQ ID:13801, to the nucleotide sequence of GAM2071 RNA, herein designated GAM RNA, also designated SEQ ID:371.

Another function of GAM2071 is therefore inhibition of FLJ23263 (Accession NP_079391.1). Accordingly, utilities of GAM2071 include diagnosis, prevention and treatment of diseases and clinical conditions associated with FLJ23263.

FLJ23356 (Accession NP_115613.1) is another GAM2071 target gene, herein designated TARGET GENE. FLJ23356 BINDING SITE is a target binding site found in the 3' untranslated region of mRNA encoded by FLJ23356, corresponding to a target binding site such as BINDING SITE I, BINDING SITE II or BINDING SITE III of FIG. 8. Table 4 illustrates the complementarity of the nucleotide sequences of FLJ23356 BINDING SITE, designated SEQ ID:14440, to the nucleotide sequence of GAM2071 RNA, herein designated GAM RNA, also designated SEQ ID:371.

Another function of GAM2071 is therefore inhibition of FLJ23356 (Accession NP_115613.1). Accordingly, utilities of GAM2071 include diagnosis, prevention and treatment of diseases and clinical conditions associated with FLJ23356.

FLJ23392 (Accession NP_079060.1) is another GAM2071 target gene, herein designated TARGET GENE. FLJ23392 BINDING SITE1 through FLJ23392 BINDING SITE3 are target binding sites found in untranslated regions of mRNA encoded by FLJ23392, corresponding to target binding sites such as BINDING SITE I, BINDING SITE II or BINDING SITE III of FIG. 8. Table 4 illustrates the complementarity of the nucleotide sequences of FLJ23392 BINDING SITE1 through FLJ23392 BINDING SITE3, designated SEQ ID:11425, SEQ ID:4022 and SEQ ID:431 respectively, to the nucleotide sequence of GAM2071 RNA, herein designated GAM RNA, also designated SEQ ID:371.

Another function of GAM2071 is therefore inhibition of FLJ23392 (Accession NP_079060.1). Accordingly, utilities of GAM2071 include diagnosis, prevention and treatment of diseases and clinical conditions associated with FLJ23392.

FLJ23416 (Accession NP_115614.1) is another GAM2071 target gene, herein designated TARGET GENE. FLJ23416 BINDING SITE is a target binding site found in the 3' untranslated region of mRNA encoded by FLJ23416, corresponding to a target binding site such as BINDING SITE I, BINDING SITE II or BINDING SITE III of FIG. 8. Table 4 illustrates the complementarity of the nucleotide sequences of FLJ23416 BINDING SITE, designated SEQ ID:4771, to the nucleotide sequence of GAM2071 RNA, herein designated GAM RNA, also designated SEQ ID:371.

Another function of GAM2071 is therefore inhibition of FLJ23416 (Accession NP_115614.1). Accordingly, utilities of GAM2071 include diagnosis, prevention and treatment of diseases and clinical conditions associated with FLJ23416.

FLJ23556 (Accession NP_079156.1) is another GAM2071 target gene, herein designated TARGET GENE. FLJ23556 BINDING SITE1 and FLJ23556 BINDING SITE2 are target binding sites found in untranslated regions of mRNA encoded by FLJ23556, corresponding to target binding sites such as BINDING SITE I, BINDING SITE II or BINDING SITE III of FIG. 8. Table 4 illustrates the complementarity of the nucleotide sequences of FLJ23556 BINDING SITE1 and FLJ23556 BINDING SITE2, designated SEQ ID:6906 and SEQ ID:436 respectively, to the nucleotide sequence of GAM2071 RNA, herein designated GAM RNA, also designated SEQ ID:371.

Another function of GAM2071 is therefore inhibition of FLJ23556 (Accession NP_079156.1). Accordingly, utilities of GAM2071 include diagnosis, prevention and treatment of diseases and clinical conditions associated with FLJ23556.

FLJ23834 (Accession NP_689963.1) is another GAM2071 target gene, herein designated TARGET GENE. FLJ23834 BINDING SITE is a target binding site found in the 3' untranslated region of mRNA encoded by FLJ23834, corresponding to a target binding site such as BINDING SITE I, BINDING SITE II or BINDING SITE III of FIG. 8. Table 4 illustrates the complementarity of the nucleotide sequences of FLJ23834 BINDING SITE, designated SEQ ID:14133, to the nucleotide sequence of GAM2071 RNA, herein designated GAM RNA, also designated SEQ ID:371.

Another function of GAM2071 is therefore inhibition of FLJ23834 (Accession NP_689963.1). Accordingly, utilities of GAM2071 include diagnosis, prevention and treatment of diseases and clinical conditions associated with FLJ23834.

FLJ25416 (Accession NP_659455.2) is another GAM2071 target gene, herein designated TARGET GENE. FLJ25416 BINDING SITE is a target binding site found in the 5' untranslated region of mRNA encoded by FLJ25416, corresponding to a target binding site such as BINDING SITE I, BINDING SITE II or BINDING SITE III of FIG. 8. Table 4 illustrates the complementarity of the nucleotide sequences of FLJ25416 BINDING SITE, designated SEQ ID:8998, to the nucleotide sequence of GAM2071 RNA, herein designated GAM RNA, also designated SEQ ID:371.

Another function of GAM2071 is therefore inhibition of FLJ25416 (Accession NP_659455.2). Accordingly, utilities of GAM2071 include diagnosis, prevention and treatment of diseases and clinical conditions associated with FLJ25416.

FLJ25795 (Accession NP_689633.1) is another GAM2071 target gene, herein designated TARGET GENE. FLJ25795 BINDING SITE is a target binding site found in the 3' untranslated region of mRNA encoded by FLJ25795, corresponding to a target binding site such as BINDING SITE I, BINDING SITE II or BINDING SITE III of FIG. 8. Table 4 illustrates the complementarity of the nucleotide sequences of FLJ25795 BINDING SITE, designated SEQ ID:18075, to the nucleotide sequence of GAM2071 RNA, herein designated GAM RNA, also designated SEQ ID:371.

Another function of GAM2071 is therefore inhibition of FLJ25795 (Accession NP_689633.1). Accordingly, utilities of GAM2071 include diagnosis, prevention and treatment of diseases and clinical conditions associated with FLJ25795.

FLJ31139 (Accession NP_775928.1) is another GAM2071 target gene, herein designated TARGET GENE. FLJ31139 BINDING SITE1 and FLJ31139 BINDING SITE2 are target binding sites found in untranslated regions of mRNA encoded by FLJ31139, corresponding to target binding sites such as BINDING SITE I, BINDING SITE II or BINDING SITE III of FIG. 8. Table 4 illustrates the complementarity of the nucleotide sequences of FLJ31139 BINDING SITE1 and FLJ31139 BINDING SITE2, designated SEQ ID:7279 and SEQ ID:1817 respectively, to the nucleotide sequence of GAM2071 RNA, herein designated GAM RNA, also designated SEQ ID:371.

Another function of GAM2071 is therefore inhibition of FLJ31139 (Accession NP_775928.1). Accordingly, utilities of GAM2071 include diagnosis, prevention and treatment of diseases and clinical conditions associated with FLJ31139.

FLJ31153 (Accession NP_653201.1) is another GAM2071 target gene, herein designated TARGET GENE. FLJ31153 BINDING SITE is a target binding site found in the 3' untranslated region of mRNA encoded by FLJ31153, corresponding to a target binding site such as BINDING SITE I, BINDING SITE II or BINDING SITE III of FIG. 8. Table 4 illustrates the complementarity of the nucleotide sequences of FLJ31153 BINDING SITE, designated SEQ ID:13799, to the nucleotide sequence of GAM2071 RNA, herein designated GAM RNA, also designated SEQ ID:371.

Another function of GAM2071 is therefore inhibition of FLJ31153 (Accession NP_653201.1). Accordingly, utilities of GAM2071 include diagnosis, prevention and treatment of diseases and clinical conditions associated with FLJ31153.

FLJ31401 (Accession NP_689877.1) is another GAM2071 target gene, herein designated TARGET GENE. FLJ31401 BINDING SITE is a target binding site found in the 3' untranslated region of mRNA encoded by FLJ31401, corresponding to a target binding site such as BINDING SITE I, BINDING SITE II or BINDING SITE III of FIG. 8. Table 4 illustrates the complementarity of the nucleotide sequences of FLJ31401 BINDING SITE, designated SEQ ID:11498, to the nucleotide sequence of GAM2071 RNA, herein designated GAM RNA, also designated SEQ ID:371.

Another function of GAM2071 is therefore inhibition of FLJ31401 (Accession NP_689877.1). Accordingly, utilities of GAM2071 include diagnosis, prevention and treatment of diseases and clinical conditions associated with FLJ31401.

FLJ31958 (Accession NP_694575.1) is another GAM2071 target gene, herein designated TARGET GENE. FLJ31958 BINDING SITE is a target binding site found in the 3' untranslated region of mRNA encoded by FLJ31958, corresponding to a target binding site such as BINDING SITE I, BINDING SITE II or BINDING SITE III of FIG. 8. Table 4 illustrates the complementarity of the nucleotide sequences of FLJ31958 BINDING SITE, designated SEQ ID:12975, to the nucleotide sequence of GAM2071 RNA, herein designated GAM RNA, also designated SEQ ID:371.

Another function of GAM2071 is therefore inhibition of FLJ31958 (Accession NP_694575.1). Accordingly, utilities of GAM2071 include diagnosis, prevention and treatment of diseases and clinical conditions associated with FLJ31958.

FLJ31978 (Accession NP_653270.1) is another GAM2071 target gene, herein designated TARGET GENE. FLJ31978 BINDING SITE is a target binding site found in the 3' untranslated region of mRNA encoded by FLJ31978, corresponding to a target binding site such as BINDING SITE I, BINDING SITE II or BINDING SITE III of FIG. 8. Table 4 illustrates the complementarity of the nucleotide sequences of FLJ31978 BINDING SITE, designated SEQ ID:10814, to the nucleotide sequence of GAM2071 RNA, herein designated GAM RNA, also designated SEQ ID:371.

Another function of GAM2071 is therefore inhibition of FLJ31978 (Accession NP_653270.1). Accordingly, utilities of GAM2071 include diagnosis, prevention and treatment of diseases and clinical conditions associated with FLJ31978.

FLJ32130 (Accession NP_689671.2) is another GAM2071 target gene, herein designated TARGET GENE. FLJ32130 BINDING SITE1 and FLJ32130 BINDING SITE2 are target binding sites found in untranslated regions of mRNA encoded by FLJ32130, corresponding to target binding sites such as BINDING SITE I, BINDING SITE II or BINDING SITE III of FIG. 8. Table 4 illustrates the complementarity of the nucleotide sequences of FLJ32130 BINDING SITE1 and FLJ32130 BINDING SITE2, designated SEQ ID:17307 and SEQ ID:9100 respectively, to the nucleotide sequence of GAM2071 RNA, herein designated GAM RNA, also designated SEQ ID:371.

Another function of GAM2071 is therefore inhibition of FLJ32130 (Accession NP_689671.2). Accordingly, utilities of GAM2071 include diagnosis, prevention and treatment of diseases and clinical conditions associated with FLJ32130.

FLJ32499 (Accession NP_653208.1) is another GAM2071 target gene, herein designated TARGET GENE. FLJ32499 BINDING SITE is a target binding site found in the 3' untranslated region of mRNA encoded by FLJ32499, corresponding to a target binding site such as BINDING SITE I, BINDING SITE II or BINDING SITE III of FIG. 8. Table 4 illustrates the complementarity of the nucleotide sequences of FLJ32499 BINDING SITE, designated SEQ ID:2883, to the nucleotide sequence of GAM2071 RNA, herein designated GAM RNA, also designated SEQ ID:371.

Another function of GAM2071 is therefore inhibition of FLJ32499 (Accession NP_653208.1). Accordingly, utilities of GAM2071 include diagnosis, prevention and treatment of diseases and clinical conditions associated with FLJ32499.

FLJ32803 (Accession NP_694584.1) is another GAM2071 target gene, herein designated TARGET GENE. FLJ32803 BINDING SITE is a target binding site found in the 3' untranslated region of mRNA encoded by FLJ32803, corresponding to a target binding site such as BINDING SITE I, BINDING SITE II or BINDING SITE III of FIG. 8. Table 4 illustrates the complementarity of the nucleotide sequences of FLJ32803 BINDING SITE, designated SEQ ID:7824, to the nucleotide sequence of GAM2071 RNA, herein designated GAM RNA, also designated SEQ ID:371.

Another function of GAM2071 is therefore inhibition of FLJ32803 (Accession NP_694584.1). Accordingly, utilities of GAM2071 include diagnosis, prevention and treatment of diseases and clinical conditions associated with FLJ32803.

FLJ32865 (Accession NP_653214.1) is another GAM2071 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:19864, to the nucleotide sequence of GAM2071 RNA, herein designated GAM RNA, also designated SEQ ID:371.

Another function of GAM2071 is therefore inhibition of FLJ32865 (Accession NP_653214.1). Accordingly, utilities of GAM2071 include diagnosis, prevention and treatment of diseases and clinical conditions associated with FLJ32865.

FLJ32894 (Accession NP_653268.1) is another GAM2071 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:3716, to the nucleotide sequence of GAM2071 RNA, herein designated GAM RNA, also designated SEQ ID:371.

Another function of GAM2071 is therefore inhibition of FLJ32894 (Accession NP_653268.1). Accordingly, utilities of GAM2071 include diagnosis, prevention and treatment of diseases and clinical conditions associated with FLJ32894.

FLJ32932 (Accession NP_690873.1) is another GAM2071 target gene, herein designated TARGET GENE. FLJ32932 BINDING SITE is a target binding site found in the 3' untranslated region of mRNA encoded by FLJ32932, corresponding to a target binding site such as BINDING SITE I, BINDING SITE II or BINDING SITE III of FIG. 8. Table 4 illustrates the complementarity of the nucleotide sequences of FLJ32932 BINDING SITE, designated SEQ ID:4748, to the nucleotide sequence of GAM2071 RNA, herein designated GAM RNA, also designated SEQ ID:371.

Another function of GAM2071 is therefore inhibition of FLJ32932 (Accession NP_690873.1). Accordingly, utilities of GAM2071 include diagnosis, prevention and treatment of diseases and clinical conditions associated with FLJ32932.

FLJ33505 (Accession NP_689530.1) is another GAM2071 target gene, herein designated TARGET GENE. FLJ33505 BINDING SITE is a target binding site found in the 3' untranslated region of mRNA encoded by FLJ33505, corresponding to a target binding site such as BINDING SITE I, BINDING SITE II or BINDING SITE III of FIG. 8. Table 4 illustrates the complementarity of the nucleotide sequences of FLJ33505 BINDING SITE, designated SEQ ID:2450, to the nucleotide sequence of GAM2071 RNA, herein designated GAM RNA, also designated SEQ ID:371.

Another function of GAM2071 is therefore inhibition of FLJ33505 (Accession NP_689530.1). Accordingly, utilities of GAM2071 include diagnosis, prevention and treatment of diseases and clinical conditions associated with FLJ33505.

FLJ34917 (Accession NP_694995.1) is another GAM2071 target gene, herein designated TARGET GENE. FLJ34917 BINDING SITE is a target binding site found in the 3' untranslated region of mRNA encoded by FLJ34917, corresponding to a target binding site such as BINDING SITE I, BINDING SITE II or BINDING SITE III of FIG. 8. Table 4 illustrates the complementarity of the nucleotide sequences of FLJ34917 BINDING SITE, designated SEQ ID:13154, to the nucleotide sequence of GAM2071 RNA, herein designated GAM RNA, also designated SEQ ID:371.

Another function of GAM2071 is therefore inhibition of FLJ34917 (Accession NP_694995.1). Accordingly, utilities of GAM2071 include diagnosis, prevention and treatment of diseases and clinical conditions associated with FLJ34917.

FLJ34922 (Accession NP_689483.1) is another GAM2071 target gene, herein designated TARGET GENE. FLJ34922 BINDING SITE is a target binding site found in the 5' untranslated region of mRNA encoded by FLJ34922, corresponding to a target binding site such as BINDING SITE I, BINDING SITE II or BINDING SITE III of FIG. 8. Table 4 illustrates the complementarity of the nucleotide sequences of FLJ34922 BINDING SITE, designated SEQ ID:14214, to the nucleotide sequence of GAM2071 RNA, herein designated GAM RNA, also designated SEQ ID:371.

Another function of GAM2071 is therefore inhibition of FLJ34922 (Accession NP_689483.1). Accordingly, utilities of GAM2071 include diagnosis, prevention and treatment of diseases and clinical conditions associated with FLJ34922.

FLJ35105 (Accession NP_689890.1) is another GAM2071 target gene, herein designated TARGET GENE. FLJ35105 BINDING SITE is a target binding site found in the 5' untranslated region of mRNA encoded by FLJ35105, corresponding to a target binding site such as BINDING SITE I, BINDING SITE II or BINDING SITE III of FIG. 8. Table 4 illustrates the complementarity of the nucleotide sequences of FLJ35105 BINDING SITE, designated SEQ ID:6840, to the nucleotide sequence of GAM2071 RNA, herein designated GAM RNA, also designated SEQ ID:371.

Another function of GAM2071 is therefore inhibition of FLJ35105 (Accession NP_689890.1). Accordingly, utilities of GAM2071 include diagnosis, prevention and treatment of diseases and clinical conditions associated with FLJ35105.

FLJ35283 (Accession NP_689915.1) is another GAM2071 target gene, herein designated TARGET GENE. FLJ35283 BINDING SITE is a target binding site found in the 3' untranslated region of mRNA encoded by FLJ35283, corresponding to a target binding site such as BINDING SITE I, BINDING SITE II or BINDING SITE III of FIG. 8. Table 4 illustrates the complementarity of the nucleotide sequences of FLJ35283 BINDING SITE, designated SEQ ID:7525, to the nucleotide sequence of GAM2071 RNA, herein designated GAM RNA, also designated SEQ ID:371.

Another function of GAM2071 is therefore inhibition of FLJ35283 (Accession NP_689915.1). Accordingly, utilities of GAM2071 include diagnosis, prevention and treatment of diseases and clinical conditions associated with FLJ35283.

FLJ35487 (Accession NP_776181.1) is another GAM2071 target gene, herein designated TARGET GENE. FLJ35487 BINDING SITE is a target binding site found in the 3' untranslated region of mRNA encoded by FLJ35487, corresponding to a target binding site such as BINDING SITE I, BINDING SITE II or BINDING SITE III of FIG. 8. Table 4 illustrates the complementarity of the nucleotide sequences of FLJ35487 BINDING SITE, designated SEQ ID:7675, to the nucleotide sequence of GAM2071 RNA, herein designated GAM RNA, also designated SEQ ID:371.

Another function of GAM2071 is therefore inhibition of FLJ35487 (Accession NP_776181.1). Accordingly, utilities of GAM2071 include diagnosis, prevention and treatment of diseases and clinical conditions associated with FLJ35487.

FLJ35681 (Accession NP_787096.1) is another GAM2071 target gene, herein designated TARGET GENE. FLJ35681 BINDING SITE is a target binding site found in the 3' untranslated region of mRNA encoded by FLJ35681, corresponding to a target binding site such as BINDING SITE I, BINDING SITE II or BINDING SITE III of FIG. 8. Table 4 illustrates the complementarity of the nucleotide sequences of FLJ35681 BINDING SITE, designated SEQ ID:3105, to the nucleotide sequence of GAM2071 RNA, herein designated GAM RNA, also designated SEQ ID:371.

Another function of GAM2071 is therefore inhibition of FLJ35681 (Accession NP_787096.1). Accordingly, utilities of GAM2071 include diagnosis, prevention and treatment of diseases and clinical conditions associated with FLJ35681.

FLJ35848 (Accession XP_290755.1) is another GAM2071 target gene, herein designated TARGET GENE. FLJ35848 BINDING SITE is a target binding site found in the 3' untranslated region of mRNA encoded by FLJ35848, corresponding to a target binding site such as BINDING SITE I, BINDING SITE II or BINDING SITE III of FIG. 8. Table 4 illustrates the complementarity of the nucleotide sequences of FLJ35848 BINDING SITE, designated SEQ ID:12720, to the nucleotide sequence of GAM2071 RNA, herein designated GAM RNA, also designated SEQ ID:371.

Another function of GAM2071 is therefore inhibition of FLJ35848 (Accession XP_290755.1). Accordingly, utilities of GAM2071 include diagnosis, prevention and treatment of diseases and clinical conditions associated with FLJ35848.

FLJ36032 (Accession XP_290874.1) is another GAM2071 target gene, herein designated TARGET GENE. FLJ36032 BINDING SITE is a target binding site found in the 5' untranslated region of mRNA encoded by FLJ36032, corresponding to a target binding site such as BINDING SITE I, BINDING SITE II or BINDING SITE III of FIG. 8. Table 4 illustrates the complementarity of the nucleotide sequences of FLJ36032 BINDING SITE, designated SEQ ID:17613, to the nucleotide sequence of GAM2071 RNA, herein designated GAM RNA, also designated SEQ ID:371.

Another function of GAM2071 is therefore inhibition of FLJ36032 (Accession XP_290874.1). Accordingly, utilities of GAM2071 include diagnosis, prevention and treatment of diseases and clinical conditions associated with FLJ36032.

FLJ36445 (Accession NP_694965.1) is another GAM2071 target gene, herein designated TARGET GENE. FLJ36445 BINDING SITE is a target binding site found in the 3' untranslated region of mRNA encoded by FLJ36445, corresponding to a target binding site such as BINDING SITE I, BINDING SITE II or BINDING SITE III of FIG. 8. Table 4 illustrates the complementarity of the nucleotide sequences of FLJ36445 BINDING SITE, designated SEQ ID:10632, to the nucleotide sequence of GAM2071 RNA, herein designated GAM RNA, also designated SEQ ID:371.

Another function of GAM2071 is therefore inhibition of FLJ36445 (Accession NP_694965.1). Accordingly, utilities of GAM2071 include diagnosis, prevention and treatment of diseases and clinical conditions associated with FLJ36445.

FLJ37078 (Accession NP_694588.1) is another GAM2071 target gene, herein designated TARGET GENE. FLJ37078 BINDING SITE is a target binding site found in the 5' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:3106, to the nucleotide sequence of GAM2071 RNA, herein designated GAM RNA, also designated SEQ ID:371.

Another function of GAM2071 is therefore inhibition of FLJ37078 (Accession NP_694588.1). Accordingly, utilities of GAM2071 include diagnosis, prevention and treatment of diseases and clinical conditions associated with FLJ37078.

FLJ37433 (Accession NP_848612.1) is another GAM2071 target gene, herein designated TARGET GENE. FLJ37433 BINDING SITE is a target binding site found in the 3' untranslated region of mRNA encoded by FLJ37433, corresponding to a target binding site such as BINDING SITE I, BINDING SITE II or BINDING SITE III of FIG. 8. Table 4 illustrates the complementarity of the nucleotide sequences of FLJ37433 BINDING SITE, designated SEQ ID:18178, to the nucleotide sequence of GAM2071 RNA, herein designated GAM RNA, also designated SEQ ID:371.

Another function of GAM2071 is therefore inhibition of FLJ37433 (Accession NP_848612.1). Accordingly, utilities of GAM2071 include diagnosis, prevention and treatment of diseases and clinical conditions associated with FLJ37433.

FLJ37543 (Accession NP_775938.1) is another GAM2071 target gene, herein designated TARGET GENE. FLJ37543 BINDING SITE is a target binding site found in the 3' untranslated region of mRNA encoded by FLJ37543, corresponding to a target binding site such as BINDING SITE I, BINDING SITE II or BINDING SITE III of FIG. 8. Table 4 illustrates the complementarity of the nucleotide sequences of FLJ37543 BINDING SITE, designated SEQ ID:435, to the nucleotide sequence of GAM2071 RNA, herein designated GAM RNA, also designated SEQ ID:371.

Another function of GAM2071 is therefore inhibition of FLJ37543 (Accession NP_775938.1). Accordingly, utilities of GAM2071 include diagnosis, prevention and treatment of diseases and clinical conditions associated with FLJ37543.

FLJ37940 (Accession NP_848629.1) is another GAM2071 target gene, herein designated TARGET GENE. FLJ37940 BINDING SITE is a target binding site found in the 3' untranslated region of mRNA encoded by FLJ37940, corresponding to a target binding site such as BINDING SITE I, BINDING SITE II or BINDING SITE III of FIG. 8. Table 4 illustrates the complementarity of the nucleotide sequences of FLJ37940 BINDING SITE, designated SEQ ID:7849, to the nucleotide sequence of GAM2071 RNA, herein designated GAM RNA, also designated SEQ ID:371.

Another function of GAM2071 is therefore inhibition of FLJ37940 (Accession NP_848629.1). Accordingly, utilities of GAM2071 include diagnosis, prevention and treatment of diseases and clinical conditions associated with FLJ37940.

FLJ38149 (Accession XP_091919.5) is another GAM2071 target gene, herein designated TARGET GENE. FLJ38149 BINDING SITE1 through FLJ38149 BINDING SITE4 are target binding sites found in untranslated regions of mRNA encoded by FLJ38149, corresponding to target binding sites such as BINDING SITE I, BINDING SITE II or BINDING SITE III of FIG. 8. Table 4 illustrates the complementarity of the nucleotide sequences of FLJ38149 BINDING SITE1 through FLJ38149 BINDING SITE4, designated SEQ ID:6194, SEQ ID:11661, SEQ ID:12581 and SEQ ID:2644 respectively, to the nucleotide sequence of GAM2071 RNA, herein designated GAM RNA, also designated SEQ ID:371.

Another function of GAM2071 is therefore inhibition of FLJ38149 (Accession XP_091919.5). Accordingly, utilities of GAM2071 include diagnosis, prevention and treatment of diseases and clinical conditions associated with FLJ38149.

FLJ38281 (Accession NP_689814.1) is another GAM2071 target gene, herein designated TARGET GENE. FLJ38281 BINDING SITE1 and FLJ38281 BINDING SITE2 are target binding sites found in untranslated regions of mRNA encoded by FLJ38281, corresponding to target binding sites such as BINDING SITE I, BINDING SITE II or BINDING SITE III of FIG. 8. Table 4 illustrates the complementarity of the nucleotide sequences of FLJ38281 BINDING SITE1 and FLJ38281 BINDING SITE2, designated SEQ ID:17962 and SEQ ID:19457 respectively, to the nucleotide sequence of GAM2071 RNA, herein designated GAM RNA, also designated SEQ ID:371.

Another function of GAM2071 is therefore inhibition of FLJ38281 (Accession NP_689814.1). Accordingly, utilities of GAM2071 include diagnosis, prevention and treatment of diseases and clinical conditions associated with FLJ38281.

FLJ38607 (Accession NP_689867.1) is another GAM2071 target gene, herein designated TARGET GENE. FLJ38607 BINDING SITE1 and FLJ38607 BINDING SITE2 are target binding sites found in untranslated regions of mRNA encoded by FLJ38607, corresponding to target binding sites such as BINDING SITE I, BINDING SITE II or BINDING SITE III of FIG. 8. Table 4 illustrates the complementarity of the nucleotide sequences of FLJ38607 BINDING SITE1 and FLJ38607 BINDING SITE2, designated SEQ ID:18917 and SEQ ID:3109 respectively, to the nucleotide sequence of GAM2071 RNA, herein designated GAM RNA, also designated SEQ ID:371.

Another function of GAM2071 is therefore inhibition of FLJ38607 (Accession NP_689867.1). Accordingly, utilities of GAM2071 include diagnosis, prevention and treatment of diseases and clinical conditions associated with FLJ38607.

FLJ38705 (Accession NP_776193.1) is another GAM2071 target gene, herein designated TARGET GENE. FLJ38705 BINDING SITE is a target binding site found in the 3' untranslated region of mRNA encoded by FLJ38705, corresponding to a target binding site such as BINDING SITE I, BINDING SITE II or BINDING SITE III of FIG. 8. Table 4 illustrates the complementarity of the nucleotide sequences of FLJ38705 BINDING SITE, designated SEQ ID:6867, to the nucleotide sequence of GAM2071 RNA, herein designated GAM RNA, also designated SEQ ID:371.

Another function of GAM2071 is therefore inhibition of FLJ38705 (Accession NP_776193.1). Accordingly, utilities of GAM2071 include diagnosis, prevention and treatment of diseases and clinical conditions associated with FLJ38705.

FLJ38792 (Accession NP_848615.1) is another GAM2071 target gene, herein designated TARGET GENE. FLJ38792 BINDING SITE is a target binding site found in the 3' untranslated region of mRNA encoded by FLJ38792, corresponding to a target binding site such as BINDING SITE I, BINDING SITE II or BINDING SITE III of FIG. 8. Table 4 illustrates the complementarity of the nucleotide sequences of FLJ38792 BINDING SITE, designated SEQ ID:18182, to the nucleotide sequence of GAM2071 RNA, herein designated GAM RNA, also designated SEQ ID:371.

Another function of GAM2071 is therefore inhibition of FLJ38792 (Accession NP_848615.1). Accordingly, utilities of GAM2071 include diagnosis, prevention and treatment of diseases and clinical conditions associated with FLJ38792.

FLJ38819 (Accession NP_665872.1) is another GAM2071 target gene, herein designated TARGET GENE. FLJ38819 BINDING SITE is a target binding site found in the 3' untranslated region of mRNA encoded by FLJ38819, corresponding to a target binding site such as BINDING SITE I, BINDING SITE II or BINDING SITE III of FIG. 8. Table 4 illustrates the complementarity of the nucleotide sequences of FLJ38819 BINDING SITE, designated SEQ ID:3726, to the nucleotide sequence of GAM2071 RNA, herein designated GAM RNA, also designated SEQ ID:371.

Another function of GAM2071 is therefore inhibition of FLJ38819 (Accession NP_665872.1). Accordingly, utilities of GAM2071 include diagnosis, prevention and treatment of diseases and clinical conditions associated with FLJ38819.

FLJ38991 (Accession NP_776188.1) is another GAM2071 target gene, herein designated TARGET GENE. FLJ38991 BINDING SITE1 and FLJ38991 BINDING SITE2 are target binding sites found in untranslated regions of mRNA encoded by FLJ38991, corresponding to target binding sites such as BINDING SITE I, BINDING SITE II or BINDING SITE III of FIG. 8. Table 4 illustrates the complementarity of the nucleotide sequences of FLJ38991 BINDING SITE1 and FLJ38991 BINDING SITE2, designated SEQ ID:5383 and SEQ ID:7191 respectively, to the nucleotide sequence of GAM2071 RNA, herein designated GAM RNA, also designated SEQ ID:371.

Another function of GAM2071 is therefore inhibition of FLJ38991 (Accession NP_776188.1). Accordingly, utilities of GAM2071 include diagnosis, prevention and treatment of diseases and clinical conditions associated with FLJ38991.

FLJ39415 (Accession NP_775952.1) is another GAM2071 target gene, herein designated TARGET GENE. FLJ39415 BINDING SITE is a target binding site found in the 3' untranslated region of mRNA encoded by FLJ39415, corresponding to a target binding site such as BINDING SITE I, BINDING SITE II or BINDING SITE III of FIG. 8. Table 4 illustrates the complementarity of the nucleotide sequences of FLJ39415 BINDING SITE, designated SEQ ID:17781, to the nucleotide sequence of GAM2071 RNA, herein designated GAM RNA, also designated SEQ ID:371.

Another function of GAM2071 is therefore inhibition of FLJ39415 (Accession NP_775952.1). Accordingly, utilities of GAM2071 include diagnosis, prevention and treatment of diseases and clinical conditions associated with FLJ39415.

FLJ39426 (Accession NP_775880.1) is another GAM2071 target gene, herein designated TARGET GENE. FLJ39426 BINDING SITE is a target binding site found in the 5' untranslated region of mRNA encoded by FLJ39426, corresponding to a target binding site such as BINDING SITE I, BINDING SITE II or BINDING SITE III of FIG. 8. Table 4 illustrates the complementarity of the nucleotide sequences of FLJ39426 BINDING SITE, designated SEQ ID:5369, to the nucleotide sequence of GAM2071 RNA, herein designated GAM RNA, also designated SEQ ID:371.

Another function of GAM2071 is therefore inhibition of FLJ39426 (Accession NP_775880.1). Accordingly, utilities of GAM2071 include diagnosis, prevention and treatment of diseases and clinical conditions associated with FLJ39426.

FLJ39599 (Accession NP_776164.1) is another GAM2071 target gene, herein designated TARGET GENE. FLJ39599 BINDING SITE is a target binding site found in the 3' untranslated region of mRNA encoded by FLJ39599, corresponding to a target binding site such as BINDING SITE I, BINDING SITE II or BINDING SITE III of FIG. 8. Table 4 illustrates the complementarity of the nucleotide sequences of FLJ39599 BINDING SITE, designated SEQ ID:7948, to the nucleotide sequence of GAM2071 RNA, herein designated GAM RNA, also designated SEQ ID:371.

Another function of GAM2071 is therefore inhibition of FLJ39599 (Accession NP_776164.1). Accordingly, utilities of GAM2071 include diagnosis, prevention and treatment of diseases and clinical conditions associated with FLJ39599.

FLJ39639 (Accession XP_290687.1) is another GAM2071 target gene, herein designated TARGET GENE.

FLJ39639 BINDING SITE1 and FLJ39639 BINDING SITE2 are target binding sites found in untranslated regions of mRNA encoded by FLJ39639, corresponding to target binding sites such as BINDING SITE I, BINDING SITE II or BINDING SITE III of FIG. 8. Table 4 illustrates the complementarity of the nucleotide sequences of FLJ39639 BINDING SITE1 and FLJ39639 BINDING SITE2, designated SEQ ID:13371 and SEQ ID:7663 respectively, to the nucleotide sequence of GAM2071 RNA, herein designated GAM RNA, also designated SEQ ID:371.

Another function of GAM2071 is therefore inhibition of FLJ39639 (Accession XP_290687.1). Accordingly, utilities of GAM2071 include diagnosis, prevention and treatment of diseases and clinical conditions associated with FLJ39639.

FLJ39821 (Accession NP_775971.1) is another GAM2071 target gene, herein designated TARGET GENE. FLJ39821 BINDING SITE1 and FLJ39821 BINDING SITE2 are target binding sites found in untranslated regions of mRNA encoded by FLJ39821, corresponding to target binding sites such as BINDING SITE I, BINDING SITE II or BINDING SITE III of FIG. 8. Table 4 illustrates the complementarity of the nucleotide sequences of FLJ39821 BINDING SITE1 and FLJ39821 BINDING SITE2, designated SEQ ID:14284 and SEQ ID:8171 respectively, to the nucleotide sequence of GAM2071 RNA, herein designated GAM RNA, also designated SEQ ID:371.

Another function of GAM2071 is therefore inhibition of FLJ39821 (Accession NP_775971.1). Accordingly, utilities of GAM2071 include diagnosis, prevention and treatment of diseases and clinical conditions associated with FLJ39821.

FLJ90231 (Accession NP_775852.1) is another GAM2071 target gene, herein designated TARGET GENE. FLJ90231 BINDING SITE is a target binding site found in the 3' untranslated region of mRNA encoded by FLJ90231, corresponding to a target binding site such as BINDING SITE I, BINDING SITE II or BINDING SITE III of FIG. 8. Table 4 illustrates the complementarity of the nucleotide sequences of FLJ90231 BINDING SITE, designated SEQ ID:18854, to the nucleotide sequence of GAM2071 RNA, herein designated GAM RNA, also designated SEQ ID:371.

Another function of GAM2071 is therefore inhibition of FLJ90231 (Accession NP_775852.1). Accordingly, utilities of GAM2071 include diagnosis, prevention and treatment of diseases and clinical conditions associated with FLJ90231.

FLJ90723 (Accession NP_787115.1) is another GAM2071 target gene, herein designated TARGET GENE. FLJ90723 BINDING SITE is a target binding site found in the 3' untranslated region of mRNA encoded by FLJ90723, corresponding to a target binding site such as BINDING SITE I, BINDING SITE II or BINDING SITE III of FIG. 8. Table 4 illustrates the complementarity of the nucleotide sequences of FLJ90723 BINDING SITE, designated SEQ ID:16986, to the nucleotide sequence of GAM2071 RNA, herein designated GAM RNA, also designated SEQ ID:371.

Another function of GAM2071 is therefore inhibition of FLJ90723 (Accession NP_787115.1). Accordingly, utilities of GAM2071 include diagnosis, prevention and treatment of diseases and clinical conditions associated with FLJ90723.

Formin binding protein 1 (FNBP1, Accession XP_052666.3) is another GAM2071 target gene, herein designated TARGET GENE. FNBP1 BINDING SITE is a target binding site found in the 3' untranslated region of mRNA encoded by FNBP1, corresponding to a target binding site such as BINDING SITE I, BINDING SITE II or BINDING SITE III of FIG. 8. Table 4 illustrates the complementarity of the nucleotide sequences of FNBP1 BINDING SITE, designated SEQ ID:8560, to the nucleotide sequence of GAM2071 RNA, herein designated GAM RNA, also designated SEQ ID:371.

Another function of GAM2071 is therefore inhibition of Formin binding protein 1 (FNBP1, Accession XP_052666.3). Accordingly, utilities of GAM2071 include diagnosis, prevention and treatment of diseases and clinical conditions associated with FNBP1.

Fsh primary response (lrpr1 homolog, rat) 1 (FSHPRH1, Accession NP_006724.1) is another GAM2071 target gene, herein designated TARGET GENE. FSHPRH1 BINDING SITE is a target binding site found in the 5' untranslated region of mRNA encoded by FSHPRH1, corresponding to a target binding site such as BINDING SITE I, BINDING SITE II or BINDING SITE III of FIG. 8. Table 4 illustrates the complementarity of the nucleotide sequences of FSHPRH1 BINDING SITE, designated SEQ ID:13800, to the nucleotide sequence of GAM2071 RNA, herein designated GAM RNA, also designated SEQ ID:371.

Another function of GAM2071 is therefore inhibition of Fsh primary response (lrpr1 homolog, rat) 1 (FSHPRH1, Accession NP_006724.1), a gene which is involved in the response of gonadal tissues to follicle-stimulating hormone. and therefore may be associated with Hypergonadotropic ovarian dysgenesis (odg), x-linked disorders of gonadal development. Accordingly, utilities of GAM2071 include diagnosis, prevention and treatment of Hypergonadotropic ovarian dysgenesis (odg), x-linked disorders of gonadal development, and of other diseases and clinical conditions associated with FSHPRH1.

The function of FSHPRH1 and its association with various diseases and clinical conditions, has been established by previous studies, as described hereinabove with reference to GAM189.1. Fucosyltransferase 1 (galactoside 2-alpha-l-fucosyltransferase, bombay phenotype included) (FUT1, Accession NP_000139.1) is another GAM2071 target gene, herein designated TARGET GENE. FUT1 BINDING SITE1 and FUT1 BINDING SITE2 are target binding sites found in untranslated regions of mRNA encoded by FUT1, corresponding to target binding sites such as BINDING SITE I, BINDING SITE II or BINDING SITE III of FIG. 8. Table 4 illustrates the complementarity of the nucleotide sequences of FUT1 BINDING SITE1 and FUT1 BINDING SITE2, designated SEQ ID:3102 and SEQ ID:7472 respectively, to the nucleotide sequence of GAM2071 RNA, herein designated GAM RNA, also designated SEQ ID:371.

Another function of GAM2071 is therefore inhibition of Fucosyltransferase 1 (galactoside 2-alpha-l-fucosyltransferase, bombay phenotype included) (FUT1, Accession NP_000139.1). Accordingly, utilities of GAM2071 include diagnosis, prevention and treatment of diseases and clinical conditions associated with FUT1.

Interferon, alpha-inducible protein (clone ifi-6-16) (G1P3, Accession NP_075010.1) is another GAM2071 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:14496, to the nucleotide sequence of GAM2071 RNA, herein designated GAM RNA, also designated SEQ ID:371.

Another function of GAM2071 is therefore inhibition of Interferon, alpha-inducible protein (clone ifi-6-16) (G1P3, Accession NP_075010.1), a gene which is an interferon-stimulated gene (ISG). Accordingly, utilities of GAM2071 include diagnosis, prevention and treatment of diseases and clinical conditions associated with G1P3.

The function of G1P3 and its association with various diseases and clinical conditions, has been established by previous studies, as described hereinabove with reference to GAM234.1. Interferon, alpha-inducible protein (clone ifi-6-16) (G1P3, Accession NP_075011.1) is another GAM2071 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:14496, to the nucleotide sequence of GAM2071 RNA, herein designated GAM RNA, also designated SEQ ID:371.

Another function of GAM2071 is therefore inhibition of Interferon, alpha-inducible protein (clone ifi-6-16) (G1P3, Accession NP_075011.1), a gene which is an interferon-stimulated gene (ISG). Accordingly, utilities of GAM2071 include diagnosis, prevention and treatment of diseases and clinical conditions associated with G1P3.

The function of G1P3 and its association with various diseases and clinical conditions, has been established by previous studies, as described hereinabove with reference to GAM234.1. Interferon, alpha-inducible protein (clone ifi-6-16) (G1P3, Accession NP_002029.3) is another GAM2071 target gene, herein designated TARGET GENE. G1P3 BINDING SITE is a target binding site found in the 3' untranslated region of multiple transcripts of mRNA encoded by G1P3, corresponding to a target binding site such as BINDING SITE I, BINDING SITE II or BINDING SITE III of FIG. 8. Table 4 illustrates the complementarity of the nucleotide sequences of G1P3 BINDING SITE, designated SEQ ID:14496, to the nucleotide sequence of GAM2071 RNA, herein designated GAM RNA, also designated SEQ ID:371.

Another function of GAM2071 is therefore inhibition of Interferon, alpha-inducible protein (clone ifi-6-16) (G1P3, Accession NP_002029.3), a gene which is an interferon-stimulated gene (ISG). Accordingly, utilities of GAM2071 include diagnosis, prevention and treatment of diseases and clinical conditions associated with G1P3.

The function of G1P3 and its association with various diseases and clinical conditions, has been established by previous studies, as described hereinabove with reference to GAM234.1. Glucose-6-phosphatase, catalytic (glycogen storage disease type i, von gierke disease) (G6PC, Accession NP_000142.1) is another GAM2071 target gene, herein designated TARGET GENE. G6PC BINDING SITE is a target binding site found in the 3' untranslated region of mRNA encoded by G6PC, corresponding to a target binding site such as BINDING SITE I, BINDING SITE II or BINDING SITE III of FIG. 8. Table 4 illustrates the complementarity of the nucleotide sequences of G6PC BINDING SITE, designated SEQ ID:8902, to the nucleotide sequence of GAM2071 RNA, herein designated GAM RNA, also designated SEQ ID:371.

Another function of GAM2071 is therefore inhibition of Glucose-6-phosphatase, catalytic (glycogen storage disease type i, von gierke disease) (G6PC, Accession NP_000142.1). Accordingly, utilities of GAM2071 include diagnosis, prevention and treatment of diseases and clinical conditions associated with G6PC.

GAL3ST-4 (Accession NP_078913.3) is another GAM2071 target gene, herein designated TARGET GENE. GAL3ST-4 BINDING SITE is a target binding site found in the 3' untranslated region of mRNA encoded by GAL3ST-4, corresponding to a target binding site such as BINDING SITE I, BINDING SITE II or BINDING SITE III of FIG. 8. Table 4 illustrates the complementarity of the nucleotide sequences of GAL3ST-4 BINDING SITE, designated SEQ ID:13405, to the nucleotide sequence of GAM2071 RNA, herein designated GAM RNA, also designated SEQ ID:371.

Another function of GAM2071 is therefore inhibition of GAL3ST-4 (Accession NP_078913.3). Accordingly, utilities of GAM2071 include diagnosis, prevention and treatment of diseases and clinical conditions associated with GAL3ST-4.

GBP4 (Accession NP_443173.2) is another GAM2071 target gene, herein designated TARGET GENE. GBP4 BINDING SITE is a target binding site found in the 3' untranslated region of mRNA encoded by GBP4, corresponding to a target binding site such as BINDING SITE I, BINDING SITE II or BINDING SITE III of FIG. 8. Table 4 illustrates the complementarity of the nucleotide sequences of GBP4 BINDING SITE, designated SEQ ID:12569, to the nucleotide sequence of GAM2071 RNA, herein designated GAM RNA, also designated SEQ ID:371.

Another function of GAM2071 is therefore inhibition of GBP4 (Accession NP_443173.2). Accordingly, utilities of GAM2071 include diagnosis, prevention and treatment of diseases and clinical conditions associated with GBP4.

GDEP (Accession NP_477516.1) is another GAM2071 target gene, herein designated TARGET GENE. GDEP BINDING SITE is a target binding site found in the 3' untranslated region of mRNA encoded by GDEP, corresponding to a target binding site such as BINDING SITE I, BINDING SITE II or BINDING SITE III of FIG. 8. Table 4 illustrates the complementarity of the nucleotide sequences of GDEP BINDING SITE, designated SEQ ID:14396, to the nucleotide sequence of GAM2071 RNA, herein designated GAM RNA, also designated SEQ ID:371.

Another function of GAM2071 is therefore inhibition of GDEP (Accession NP_477516.1). Accordingly, utilities of GAM2071 include diagnosis, prevention and treatment of diseases and clinical conditions associated with GDEP.

Golgi associated, gamma adaptin ear containing, arf binding protein 2 (GGA2, Accession NP_055859.1) is another GAM2071 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:520, to the nucleotide sequence of GAM2071 RNA, herein designated GAM RNA, also designated SEQ ID:371.

Another function of GAM2071 is therefore inhibition of Golgi associated, gamma adaptin ear containing, arf binding protein 2 (GGA2, Accession NP_055859.1). Accordingly, utilities of GAM2071 include diagnosis, prevention and treatment of diseases and clinical conditions associated with GGA2.

Golgi associated, gamma adaptin ear containing, arf binding protein 2 (GGA2, Accession NP_619581.1) is another GAM2071 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:520, to the nucleotide sequence of GAM2071 RNA, herein designated GAM RNA, also designated SEQ ID:371.

Another function of GAM2071 is therefore inhibition of Golgi associated, gamma adaptin ear containing, arf binding protein 2 (GGA2, Accession NP_619581.1). Accordingly, utilities of GAM2071 include diagnosis, prevention and treatment of diseases and clinical conditions associated with GGA2.

Gm2 ganglioside activator protein (GM2A, Accession NP_000396.1) is another GAM2071 target gene, herein designated TARGET GENE. GM2A BINDING SITE1 and GM2A BINDING SITE2 are target binding sites found in untranslated regions of mRNA encoded by GM2A, corresponding to target binding sites such as BINDING SITE I, BINDING SITE II or BINDING SITE III of FIG. 8. Table 4 illustrates the complementarity of the nucleotide sequences of GM2A BINDING SITE1 and GM2A BINDING SITE2, designated SEQ ID:17118 and SEQ ID:2518 respectively, to the nucleotide sequence of GAM2071 RNA, herein designated GAM RNA, also designated SEQ ID:371.

Another function of GAM2071 is therefore inhibition of Gm2 ganglioside activator protein (GM2A, Accession NP_000396.1). Accordingly, utilities of GAM2071 include diagnosis, prevention and treatment of diseases and clinical conditions associated with GM2A.

GNE (Accession NP_005467.1) is another GAM2071 target gene, herein designated TARGET GENE. GNE BINDING SITE is a target binding site found in the 3' untranslated region of mRNA encoded by GNE, corresponding to a target binding site such as BINDING SITE I, BINDING SITE II or BINDING SITE III of FIG. 8. Table 4 illustrates the complementarity of the nucleotide sequences of GNE BINDING SITE, designated SEQ ID:7151, to the nucleotide sequence of GAM2071 RNA, herein designated GAM RNA, also designated SEQ ID:371.

Another function of GAM2071 is therefore inhibition of GNE (Accession NP_005467.1), a gene which has roles in sialic acid biosynthesis and regulates cell surface sialylation. Accordingly, utilities of GAM2071 include diagnosis, prevention and treatment of diseases and clinical conditions associated with GNE.

The function of GNE and its association with various diseases and clinical conditions, has been established by previous studies, as described hereinabove with reference to GAM189.1. Guanine nucleotide binding protein (g protein), gamma 4 (GNG4, Accession NP_004476.1) is another GAM2071 target gene, herein designated TARGET GENE. GNG4 BINDING SITE is a target binding site found in the 3' untranslated region of mRNA encoded by GNG4, corresponding to a target binding site such as BINDING SITE I, BINDING SITE II or BINDING SITE III of FIG. 8. Table 4 illustrates the complementarity of the nucleotide sequences of GNG4 BINDING SITE, designated SEQ ID:11336, to the nucleotide sequence of GAM2071 RNA, herein designated GAM RNA, also designated SEQ ID:371.

Another function of GAM2071 is therefore inhibition of Guanine nucleotide binding protein (g protein), gamma 4 (GNG4, Accession NP_004476.1). Accordingly, utilities of GAM2071 include diagnosis, prevention and treatment of diseases and clinical conditions associated with GNG4.

GNPNAT1 (Accession XP_085119.1) is another GAM2071 target gene, herein designated TARGET GENE. GNPNAT1 BINDING SITE is a target binding site found in the 3' untranslated region of mRNA encoded by GNPNAT1, corresponding to a target binding site such as BINDING SITE I, BINDING SITE II or BINDING SITE III of FIG. 8. Table 4 illustrates the complementarity of the nucleotide sequences of GNPNAT1 BINDING SITE, designated SEQ ID:19027, to the nucleotide sequence of GAM2071 RNA, herein designated GAM RNA, also designated SEQ ID:371.

Another function of GAM2071 is therefore inhibition of GNPNAT1 (Accession XP_085119.1). Accordingly, utilities of GAM2071 include diagnosis, prevention and treatment of diseases and clinical conditions associated with GNPNAT1.

GNRPX (Accession NP_060519.1) is another GAM2071 target gene, herein designated TARGET GENE. GNRPX BINDING SITE is a target binding site found in the 3' untranslated region of mRNA encoded by GNRPX, corresponding to a target binding site such as BINDING SITE I, BINDING SITE II or BINDING SITE III of FIG. 8. Table 4 illustrates the complementarity of the nucleotide sequences of GNRPX BINDING SITE, designated SEQ ID:17848, to the nucleotide sequence of GAM2071 RNA, herein designated GAM RNA, also designated SEQ ID:371.

Another function of GAM2071 is therefore inhibition of GNRPX (Accession NP_060519.1). Accordingly, utilities of GAM2071 include diagnosis, prevention and treatment of diseases and clinical conditions associated with GNRPX.

Golgi autoantigen, golgin subfamily a, 3 (GOLGA3, Accession NP_005886.2) is another GAM2071 target gene, herein designated TARGET GENE. GOLGA3 BINDING SITE is a target binding site found in the 3' untranslated region of multiple transcripts of mRNA encoded by GOLGA3, corresponding to a target binding site such as BINDING SITE I, BINDING SITE II or BINDING SITE III of FIG. 8. Table 4 illustrates the complementarity of the nucleotide sequences of GOLGA3 BINDING SITE, designated SEQ ID:9100, to the nucleotide sequence of GAM2071 RNA, herein designated GAM RNA, also designated SEQ ID:371.

Another function of GAM2071 is therefore inhibition of Golgi autoantigen, golgin subfamily a, 3 (GOLGA3, Accession NP_005886.2) . Accordingly, utilities of GAM2071 include diagnosis, prevention and treatment of diseases and clinical conditions associated with GOLGA3.

GPR128 (Accession NP_116176.1) is another GAM2071 target gene, herein designated TARGET GENE. GPR128 BINDING SITE is a target binding site found in the 5' untranslated region of mRNA encoded by GPR128, corresponding to a target binding site such as BINDING SITE I, BINDING SITE II or BINDING SITE III of FIG. 8. Table 4 illustrates the complementarity of the nucleotide sequences of GPR128 BINDING SITE, designated SEQ ID:6503, to the nucleotide sequence of GAM2071 RNA, herein designated GAM RNA, also designated SEQ ID:371.

Another function of GAM2071 is therefore inhibition of GPR128 (Accession NP_116176.1). Accordingly, utilities of GAM2071 include diagnosis, prevention and treatment of diseases and clinical conditions associated with GPR128.

G protein-coupled receptor 4 (GPR4, Accession NP_005273.1) is another GAM2071 target gene, herein designated TARGET GENE. GPR4 BINDING SITE1 and GPR4 BINDING SITE2 are target binding sites found in untranslated regions of mRNA encoded by GPR4, corresponding to target binding sites such as BINDING SITE I, BINDING SITE II or BINDING SITE III of FIG. 8. Table 4 illustrates the complementarity of the nucleotide sequences of GPR4 BINDING SITE1 and GPR4 BINDING SITE2, designated SEQ ID:15917 and SEQ ID:16936 respectively, to the nucleotide sequence of GAM2071 RNA, herein designated GAM RNA, also designated SEQ ID:371.

Another function of GAM2071 is therefore inhibition of G protein-coupled receptor 4 (GPR4, Accession NP_005273.1), a gene which stimulates to produce increased calcium by both SPC and LPC. Accordingly, utilities of GAM2071 include diagnosis, prevention and treatment of diseases and clinical conditions associated with GPR4.

The function of GPR4 and its association with various diseases and clinical conditions, has been established by previous studies, as described hereinabove with reference to GAM189.1. G protein-coupled receptor 56 (GPR56, Accession NP_005673.2) is another GAM2071 target gene, herein designated TARGET GENE. GPR56 BINDING SITE is a target binding site found in the 5' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:6235, to the nucleotide sequence of GAM2071 RNA, herein designated GAM RNA, also designated SEQ ID:371.

Another function of GAM2071 is therefore inhibition of G protein-coupled receptor 56 (GPR56, Accession NP_005673.2), a gene which transduces extracellular signals through heterotrimeric G proteins. Accordingly, utilities of GAM2071 include diagnosis, prevention and treatment of diseases and clinical conditions associated with GPR56.

The function of GPR56 and its association with various diseases and clinical conditions, has been established by previous studies, as described hereinabove with reference to GAM63.1. G protein-coupled receptor 66 (GPR66, Accession NP_006047.2) is another GAM2071 target gene, herein designated TARGET GENE. GPR66 BINDING SITE is a target binding site found in the 3' untranslated region of mRNA encoded by GPR66, corresponding to a target binding site such as BINDING SITE I, BINDING SITE II or BINDING SITE III of FIG. 8. Table 4 illustrates the complementarity of the nucleotide sequences of GPR66 BINDING SITE, designated SEQ ID:4149, to the nucleotide sequence of GAM2071 RNA, herein designated GAM RNA, also designated SEQ ID:371.

Another function of GAM2071 is therefore inhibition of G protein-coupled receptor 66 (GPR66, Accession NP_006047.2). Accordingly, utilities of GAM2071 include diagnosis, prevention and treatment of diseases and clinical conditions associated with GPR66.

G protein-coupled receptor 81 (GPR81, Accession NP_115943.1) is another GAM2071 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:9012, to the nucleotide sequence of GAM2071 RNA, herein designated GAM RNA, also designated SEQ ID:371.

Another function of GAM2071 is therefore inhibition of G protein-coupled receptor 81 (GPR81, Accession NP_115943.1). Accordingly, utilities of GAM2071 include diagnosis, prevention and treatment of diseases and clinical conditions associated with GPR81.

GR6 (Accession NP_031380.1) is another GAM2071 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:11621, to the nucleotide sequence of GAM2071 RNA, herein designated GAM RNA, also designated SEQ ID:371.

Another function of GAM2071 is therefore inhibition of GR6 (Accession NP_031380.1). Accordingly, utilities of GAM2071 include diagnosis, prevention and treatment of diseases and clinical conditions associated with GR6.

GRAF (Accession NP_055886.1) is another GAM2071 target gene, herein designated TARGET GENE. GRAF BINDING SITE is a target binding site found in the 3' untranslated region of mRNA encoded by GRAF, corresponding to a target binding site such as BINDING SITE I, BINDING SITE II or BINDING SITE III of FIG. 8. Table 4 illustrates the complementarity of the nucleotide sequences of GRAF BINDING SITE, designated SEQ ID:18118, to the nucleotide sequence of GAM2071 RNA, herein designated GAM RNA, also designated SEQ ID:371.

Another function of GAM2071 is therefore inhibition of GRAF (Accession NP_055886.1), a gene which ia a GTPase activating protein for p21-rac and therefore may be associated with Juvenile myelomonocytic leukemia. Accordingly, utilities of GAM2071 include diagnosis, prevention and treatment of Juvenile myelomonocytic leukemia, and of other diseases and clinical conditions associated with GRAF.

The function of GRAF and its association with various diseases and clinical conditions, has been established by previous studies, as described hereinabove with reference to GAM189.1. GREB1 (Accession NP_055483.2) is another GAM2071 target gene, herein designated TARGET GENE. GREB1 BINDING SITE is a target binding site found in the 3' untranslated region of multiple transcripts of mRNA encoded by GREB1, corresponding to a target binding site such as BINDING SITE I, BINDING SITE II or BINDING SITE III of FIG. 8. Table 4 illustrates the complementarity of the nucleotide sequences of GREB1 BINDING SITE, designated SEQ ID:18182, to the nucleotide sequence of GAM2071 RNA, herein designated GAM RNA, also designated SEQ ID:371.

Another function of GAM2071 is therefore inhibition of GREB1 (Accession NP_055483.2). Accordingly, utilities of GAM2071 include diagnosis, prevention and treatment of diseases and clinical conditions associated with GREB1.

Glutamate receptor, ionotropic, n-methyl d-aspartate-like 1a (GRINL1A, Accession NP_056347.1) is another GAM2071 target gene, herein designated TARGET GENE. GRINL1A BINDING SITE is a target binding site found in the 3' untranslated region of mRNA encoded by GRINL1A, corresponding to a target binding site such as BINDING SITE I, BINDING SITE II or BINDING SITE III of FIG. 8. Table 4 illustrates the complementarity of the nucleotide sequences of GRINL1A BINDING SITE, designated SEQ ID:17379, to the nucleotide sequence of GAM2071 RNA, herein designated GAM RNA, also designated SEQ ID:371.

Another function of GAM2071 is therefore inhibition of Glutamate receptor, ionotropic, n-methyl d-aspartate-like 1a (GRINL1A, Accession NP_056347.1), a gene which plays a role in the development and function of the mammalian brain. Accordingly, utilities of GAM2071 include diagnosis, prevention and treatment of diseases and clinical conditions associated with GRINL1A.

The function of GRINL1A and its association with various diseases and clinical conditions, has been established by previous studies, as described hereinabove with reference to GAM189.1. Glutamate receptor, metabotropic 6 (GRM6, Accession NP_000834.1) is another GAM2071 target gene, herein designated TARGET GENE. GRM6 BINDING SITE is a target binding site found in the 3' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:5942, to the nucleotide sequence of GAM2071 RNA, herein designated GAM RNA, also designated SEQ ID:371.

Another function of GAM2071 is therefore inhibition of Glutamate receptor, metabotropic 6 (GRM6, Accession NP_000834.1). Accordingly, utilities of GAM2071 include diagnosis, prevention and treatment of diseases and clinical conditions associated with GRM6.

GRWD (Accession NP_113673.2) is another GAM2071 target gene, herein designated TARGET GENE. GRWD BINDING SITE is a target binding site found in the 3' untranslated region of mRNA encoded by GRWD, corresponding to a target binding site such as BINDING SITE I, BINDING SITE II or BINDING SITE III of FIG. 8. Table 4 illustrates the complementarity of the nucleotide sequences of GRWD BINDING SITE, designated SEQ ID:6811, to the nucleotide sequence of GAM2071 RNA, herein designated GAM RNA, also designated SEQ ID:371.

Another function of GAM2071 is therefore inhibition of GRWD (Accession NP_113673.2). Accordingly, utilities of GAM2071 include diagnosis, prevention and treatment of diseases and clinical conditions associated with GRWD.

GSDM (Accession XP_209009.1) is another GAM2071 target gene, herein designated TARGET GENE. GSDM BINDING SITE1 and GSDM BINDING SITE2 are target binding sites found in untranslated regions of multiple transcripts of mRNA encoded by GSDM, corresponding to target binding sites such as BINDING SITE I, BINDING SITE II or BINDING SITE III of FIG. 8. Table 4 illustrates the complementarity of the nucleotide sequences of GSDM BINDING SITE1 and GSDM BINDING SITE2, designated SEQ ID:13197 and SEQ ID:3037 respectively, to the nucleotide sequence of GAM2071 RNA, herein designated GAM RNA, also designated SEQ ID:371.

Another function of GAM2071 is therefore inhibition of GSDM (Accession XP_209009.1). Accordingly, utilities of GAM2071 include diagnosis, prevention and treatment of diseases and clinical conditions associated with GSDM.

GTF2IRD2 (Accession NP_775808.1) is another GAM2071 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:3107, to the nucleotide sequence of GAM2071 RNA, herein designated GAM RNA, also designated SEQ ID:371.

Another function of GAM2071 is therefore inhibition of GTF2IRD2 (Accession NP_775808.1). Accordingly, utilities of GAM2071 include diagnosis, prevention and treatment of diseases and clinical conditions associated with GTF2IRD2.

GTF2IRD2 (Accession NP_115579.3) is another GAM2071 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:3107, to the nucleotide sequence of GAM2071 RNA, herein designated GAM RNA, also designated SEQ ID:371.

Another function of GAM2071 is therefore inhibition of GTF2IRD2 (Accession NP_115579.3). Accordingly, utilities of GAM2071 include diagnosis, prevention and treatment of diseases and clinical conditions associated with GTF2IRD2.

GTPBG3 (Accession NP_116009.1) is another GAM2071 target gene, herein designated TARGET GENE. GTPBG3 BINDING SITE1 and GTPBG3 BINDING SITE2 are target binding sites found in untranslated regions of mRNA encoded by GTPBG3, corresponding to target binding sites such as BINDING SITE I, BINDING SITE II or BINDING SITE III of FIG. 8. Table 4 illustrates the complementarity of the nucleotide sequences of GTPBG3 BINDING SITE1 and GTPBG3 BINDING SITE2, designated SEQ ID:15596 and SEQ ID:7742 respectively, to the nucleotide sequence of GAM2071 RNA, herein designated GAM RNA, also designated SEQ ID:371.

Another function of GAM2071 is therefore inhibition of GTPBG3 (Accession NP_116009.1). Accordingly, utilities of GAM2071 include diagnosis, prevention and treatment of diseases and clinical conditions associated with GTPBG3.

H-plk (Accession NP_056936.1) is another GAM2071 target gene, herein designated TARGET GENE. H-plk BINDING SITE is a target binding site found in the 5' untranslated region of mRNA encoded by H-plk, corresponding to a target binding site such as BINDING SITE I, BINDING SITE II or BINDING SITE III of FIG. 8. Table 4 illustrates the complementarity of the nucleotide sequences of H-plk BINDING SITE, designated SEQ ID:8288, to the nucleotide sequence of GAM2071 RNA, herein designated GAM RNA, also designated SEQ ID:371.

Another function of GAM2071 is therefore inhibition of H-plk (Accession NP_056936.1). Accordingly, utilities of GAM2071 include diagnosis, prevention and treatment of diseases and clinical conditions associated with H-plk.

H2AV (Accession NP_619541.1) is another GAM2071 target gene, herein designated TARGET GENE. H2AV BINDING SITE is a target binding site found in the 3' untranslated region of multiple transcripts of mRNA encoded by H2AV, corresponding to a target binding site such as BINDING SITE I, BINDING SITE II or BINDING SITE III of FIG. 8. Table 4 illustrates the complementarity of the nucleotide sequences of H2AV BINDING SITE, designated SEQ ID:11005, to the nucleotide sequence of GAM2071 RNA, herein designated GAM RNA, also designated SEQ ID:371.

Another function of GAM2071 is therefore inhibition of H2AV (Accession NP_619541.1). Accordingly, utilities of GAM2071 include diagnosis, prevention and treatment of diseases and clinical conditions associated with H2AV.

HECA (Accession NP_057301.1) is another GAM2071 target gene, herein designated TARGET GENE. HECA BINDING SITE is a target binding site found in the 3' untranslated region of mRNA encoded by HECA, corresponding to a target binding site such as BINDING SITE I, BINDING SITE II or BINDING SITE III of FIG. 8. Table 4 illustrates the complementarity of the nucleotide sequences of HECA BINDING SITE, designated SEQ ID:6145, to the nucleotide sequence of GAM2071 RNA, herein designated GAM RNA, also designated SEQ ID:371.

Another function of GAM2071 is therefore inhibition of HECA (Accession NP_057301.1). Accordingly, utilities of GAM2071 include diagnosis, prevention and treatment of diseases and clinical conditions associated with HECA.

HEMK (Accession NP_057257.1) is another GAM2071 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:12517, to the nucleotide sequence of GAM2071 RNA, herein designated GAM RNA, also designated SEQ ID:371.

Another function of GAM2071 is therefore inhibition of HEMK (Accession NP_057257.1). Accordingly, utilities of GAM2071 include diagnosis, prevention and treatment of diseases and clinical conditions associated with HEMK.

HIP1R (Accession XP_290592.1) is another GAM2071 target gene, herein designated TARGET GENE. HIP1R BINDING SITE is a target binding site found in the 3' untranslated region of mRNA encoded by HIP1R, corresponding to a target binding site such as BINDING SITE I, BINDING SITE II or BINDING SITE III of FIG. 8. Table 4 illustrates the complementarity of the nucleotide sequences of HIP1R BINDING SITE, designated SEQ ID:4431, to the nucleotide sequence of GAM2071 RNA, herein designated GAM RNA, also designated SEQ ID:371.

Another function of GAM2071 is therefore inhibition of HIP1R (Accession XP_290592.1). Accordingly, utilities of GAM2071 include diagnosis, prevention and treatment of diseases and clinical conditions associated with HIP1R.

Holocarboxylase synthetase (biotin-[proprionyl-coenzyme a-carboxylase (atp-hydrolysing)] ligase) (HLCS, Accession NP_000402.2) is another GAM2071 target gene, herein designated TARGET GENE. HLCS BINDING SITE is a target binding site found in the 5' untranslated region of mRNA encoded by HLCS, corresponding to a target binding site such as BINDING SITE I, BINDING SITE II or BINDING SITE III of FIG. 8. Table 4 illustrates the complementarity of the nucleotide sequences of HLCS BINDING SITE, designated SEQ ID:10628, to the nucleotide sequence of GAM2071 RNA, herein designated GAM RNA, also designated SEQ ID:371.

Another function of GAM2071 is therefore inhibition of Holocarboxylase synthetase (biotin-[proprionyl-coenzyme a-carboxylase (atp-hydrolysing)] ligase) (HLCS, Accession NP_000402.2). Accordingly, utilities of GAM2071 include diagnosis, prevention and treatment of diseases and clinical conditions associated with HLCS.

High-mobility group 20a (HMG20A, Accession NP_060670.1) is another GAM2071 target gene, herein designated TARGET GENE. HMG20A BINDING SITE is a target binding site found in the 3' untranslated region of mRNA encoded by HMG20A, corresponding to a target binding site such as BINDING SITE I, BINDING SITE II or BINDING SITE III of FIG. 8. Table 4 illustrates the complementarity of the nucleotide sequences of HMG20A BINDING SITE, designated SEQ ID:19141, to the nucleotide sequence of GAM2071 RNA, herein designated GAM RNA, also designated SEQ ID:371.

Another function of GAM2071 is therefore inhibition of High-mobility group 20a (HMG20A, Accession NP_060670.1). Accordingly, utilities of GAM2071 include diagnosis, prevention and treatment of diseases and clinical conditions associated with HMG20A.

Histamine receptor h4 (HRH4, Accession NP_067637.2) is another GAM2071 target gene, herein designated TARGET GENE. HRH4 BINDING SITE1 and HRH4 BINDING SITE2 are target binding sites found in untranslated regions of mRNA encoded by HRH4, corresponding to target binding sites such as BINDING SITE I, BINDING SITE II or BINDING SITE III of FIG. 8. Table 4 illustrates the complementarity of the nucleotide sequences of HRH4 BINDING SITE1 and HRH4 BINDING SITE2, designated SEQ ID:12079 and SEQ ID:5920 respectively, to the nucleotide sequence of GAM2071 RNA, herein designated GAM RNA, also designated SEQ ID:371.

Another function of GAM2071 is therefore inhibition of Histamine receptor h4 (HRH4, Accession NP_067637.2). Accordingly, utilities of GAM2071 include diagnosis, prevention and treatment of diseases and clinical conditions associated with HRH4.

Heparan sulfate (glucosamine) 3-o-sulfotransferase 4 (HS3ST4, Accession XP_056254.4) is another GAM2071 target gene, herein designated TARGET GENE. HS3ST4 BINDING SITE is a target binding site found in the 3' untranslated region of mRNA encoded by HS3ST4, corresponding to a target binding site such as BINDING SITE I, BINDING SITE II or BINDING SITE III of FIG. 8. Table 4 illustrates the complementarity of the nucleotide sequences of HS3ST4 BINDING SITE, designated SEQ ID:2420, to the nucleotide sequence of GAM2071 RNA, herein designated GAM RNA, also designated SEQ ID:371.

Another function of GAM2071 is therefore inhibition of Heparan sulfate (glucosamine) 3-o-sulfotransferase 4 (HS3ST4, Accession XP_056254.4). Accordingly, utilities of GAM2071 include diagnosis, prevention and treatment of diseases and clinical conditions associated with HS3ST4.

HSA250839 (Accession NP_060871.1) is another GAM2071 target gene, herein designated TARGET GENE. HSA250839 BINDING SITE is a target binding site found in the 3' untranslated region of mRNA encoded by HSA250839, corresponding to a target binding site such as BINDING SITE I, BINDING SITE II or BINDING SITE III of FIG. 8. Table 4 illustrates the complementarity of the nucleotide sequences of HSA250839 BINDING SITE, designated SEQ ID:588, to the nucleotide sequence of GAM2071 RNA, herein designated GAM RNA, also designated SEQ ID:371.

Another function of GAM2071 is therefore inhibition of HSA250839 (Accession NP_060871.1). Accordingly, utilities of GAM2071 include diagnosis, prevention and treatment of diseases and clinical conditions associated with HSA250839.

HSD3B7 (Accession NP_079469.2) is another GAM2071 target gene, herein designated TARGET GENE. HSD3B7 BINDING SITE is a target binding site found in the 3' untranslated region of mRNA encoded by HSD3B7, corresponding to a target binding site such as BINDING SITE I, BINDING SITE II or BINDING SITE III of FIG. 8. Table 4 illustrates the complementarity of the nucleotide sequences of HSD3B7 BINDING SITE, designated SEQ ID:16293, to the nucleotide sequence of GAM2071 RNA, herein designated GAM RNA, also designated SEQ ID:371.

Another function of GAM2071 is therefore inhibition of HSD3B7 (Accession NP_079469.2). Accordingly, utilities of GAM2071 include diagnosis, prevention and treatment of diseases and clinical conditions associated with HSD3B7.

HSNOV1 (Accession NP_059985.2) is another GAM2071 target gene, herein designated TARGET GENE. HSNOV1 BINDING SITE is a target binding site found in the 3' untranslated region of mRNA encoded by HSNOV1, corresponding to a target binding site such as BINDING SITE I, BINDING SITE II or BINDING SITE III of FIG. 8. Table 4 illustrates the complementarity of the nucleotide sequences of HSNOV1 BINDING SITE, designated SEQ ID:1150, to the nucleotide sequence of GAM2071 RNA, herein designated GAM RNA, also designated SEQ ID:371.

Another function of GAM2071 is therefore inhibition of HSNOV1 (Accession NP_059985.2). Accordingly, utilities of GAM2071 include diagnosis, prevention and treatment of diseases and clinical conditions associated with HSNOV1.

HSPC065 (Accession NP_054876.2) is another GAM2071 target gene, herein designated TARGET GENE. HSPC065 BINDING SITE1 and HSPC065 BINDING SITE2 are target binding sites found in untranslated regions of mRNA encoded by HSPC065, corresponding to target binding sites such as BINDING SITE I, BINDING SITE II or BINDING SITE III of FIG. 8. Table 4 illustrates the complementarity of the nucleotide sequences of HSPC065 BINDING SITE1 and HSPC065 BINDING SITE2, designated SEQ ID:10877 and SEQ ID:7511 respectively, to the nucleotide sequence of GAM2071 RNA, herein designated GAM RNA, also designated SEQ ID:371.

Another function of GAM2071 is therefore inhibition of HSPC065 (Accession NP_054876.2). Accordingly, utilities of GAM2071 include diagnosis, prevention and treatment of diseases and clinical conditions associated with HSPC065.

5-hydroxytryptamine (serotonin) receptor 1d (HTR1D, Accession NP_000855.1) is another GAM2071 target gene, herein designated TARGET GENE. HTR1D BINDING SITE is a target binding site found in the 3' untranslated region of mRNA encoded by HTR1D, corresponding to a target binding site such as BINDING SITE I, BINDING SITE II or BINDING SITE III of FIG. 8. Table 4 illustrates the complementarity of the nucleotide sequences of HTR1D BINDING SITE, designated SEQ ID:14604, to the nucleotide sequence of GAM2071 RNA, herein designated GAM RNA, also designated SEQ ID:371.

Another function of GAM2071 is therefore inhibition of 5-hydroxytryptamine (serotonin) receptor 1d (HTR1D, Accession NP_000855.1), a gene which belongs to g-protein coupled receptor. Accordingly, utilities of GAM2071 include diagnosis, prevention and treatment of diseases and clinical conditions associated with HTR1D.

The function of HTR1D and its association with various diseases and clinical conditions, has been established by previous studies, as described hereinabove with reference to GAM189.1.5-hydroxytryptamine (serotonin) receptor 1e (HTR1E, Accession NP_000856.1) is another GAM2071 target gene, herein designated TARGET GENE. HTR1E BINDING SITE is a target binding site found in the 5' untranslated region of mRNA encoded by HTR1E, corresponding to a target binding site such as BINDING SITE I, BINDING SITE II or BINDING SITE III of FIG. 8. Table 4 illustrates the complementarity of the nucleotide sequences of HTR1E BINDING SITE, designated SEQ ID:9063, to the nucleotide sequence of GAM2071 RNA, herein designated GAM RNA, also designated SEQ ID:371.

Another function of GAM2071 is therefore inhibition of 5-hydroxytryptamine (serotonin) receptor 1e (HTR1E, Accession NP_000856.1), a gene which belongs to g-protein coupled receptors. Accordingly, utilities of GAM2071 include diagnosis, prevention and treatment of diseases and clinical conditions associated with HTR1E.

The function of HTR1E and its association with various diseases and clinical conditions, has been established by previous studies, as described hereinabove with reference to GAM161.1. Hormonally upregulated neu-associated kinase (HUNK, Accession NP_055401.1) is another GAM2071 target gene, herein designated TARGET GENE. HUNK BINDING SITE is a target binding site found in the 3' untranslated region of mRNA encoded by HUNK, corresponding to a target binding site such as BINDING SITE I, BINDING SITE II or BINDING SITE III of FIG. 8. Table 4 illustrates the complementarity of the nucleotide sequences of HUNK BINDING SITE, designated SEQ ID:1413, to the nucleotide sequence of GAM2071 RNA, herein designated GAM RNA, also designated SEQ ID:371.

Another function of GAM2071 is therefore inhibition of Hormonally upregulated neu-associated kinase (HUNK, Accession NP_055401.1). Accordingly, utilities of GAM2071 include diagnosis, prevention and treatment of diseases and clinical conditions associated with HUNK.

Hus1 checkpoint homolog (s. pombe) (HUS1, Accession NP_004498.1) is another GAM2071 target gene, herein designated TARGET GENE. HUS1 BINDING SITE is a target binding site found in the 3' untranslated region of mRNA encoded by HUS1, corresponding to a target binding site such as BINDING SITE I, BINDING SITE II or BINDING SITE III of FIG. 8. Table 4 illustrates the complementarity of the nucleotide sequences of HUS1 BINDING SITE, designated SEQ ID:11161, to the nucleotide sequence of GAM2071 RNA, herein designated GAM RNA, also designated SEQ ID:371.

Another function of GAM2071 is therefore inhibition of Hus1 checkpoint homolog (s. pombe) (HUS1, Accession NP_004498.1), a gene which May form DNA damage-responsive protein complex. Accordingly, utilities of GAM2071 include diagnosis, prevention and treatment of diseases and clinical conditions associated with HUS1.

The function of HUS1 and its association with various diseases and clinical conditions, has been established by previous studies, as described hereinabove with reference to GAM189.1. Hyaluronoglucosaminidase 4 (HYAL4, Accession NP_036401.1) is another GAM2071 target gene, herein designated TARGET GENE. HYAL4 BINDING SITE is a target binding site found in the 5' untranslated region of mRNA encoded by HYAL4, corresponding to a target binding site such as BINDING SITE I, BINDING SITE II or BINDING SITE III of FIG. 8. Table 4 illustrates the complementarity of the nucleotide sequences of HYAL4 BINDING SITE, designated SEQ ID:19431, to the nucleotide sequence of GAM2071 RNA, herein designated GAM RNA, also designated SEQ ID:371.

Another function of GAM2071 is therefore inhibition of Hyaluronoglucosaminidase 4 (HYAL4, Accession NP_036401.1). Accordingly, utilities of GAM2071 include diagnosis, prevention and treatment of diseases and clinical conditions associated with HYAL4.

HYPC (Accession NP_036404.1) is another GAM2071 target gene, herein designated TARGET GENE. HYPC BINDING SITE is a target binding site found in the 3' untranslated region of mRNA encoded by HYPC, corresponding to a target binding site such as BINDING SITE I, BINDING SITE II or BINDING SITE III of FIG. 8. Table 4 illustrates the complementarity of the nucleotide sequences of HYPC BINDING SITE, designated SEQ ID:10529, to the nucleotide sequence of GAM2071 RNA, herein designated GAM RNA, also designated SEQ ID:371.

Another function of GAM2071 is therefore inhibition of HYPC (Accession NP_036404.1). Accordingly, utilities of GAM2071 include diagnosis, prevention and treatment of diseases and clinical conditions associated with HYPC.

Intercellular adhesion molecule 1 (cd54), human rhinovirus receptor (ICAM1, Accession NP_000192.1) is another GAM2071 target gene, herein designated TARGET GENE. ICAM1 BINDING SITE is a target binding site found in the 3' untranslated region of mRNA encoded by ICAM1, corresponding to a target binding site such as BINDING SITE I, BINDING SITE II or BINDING SITE III of FIG. 8. Table 4 illustrates the complementarity of the nucleotide sequences of ICAM1 BINDING SITE, designated SEQ ID:18182, to the nucleotide sequence of GAM2071 RNA, herein designated GAM RNA, also designated SEQ ID:371.

Another function of GAM2071 is therefore inhibition of Intercellular adhesion molecule 1 (cd54), human rhinovirus receptor (ICAM1, Accession NP_000192.1), a gene which binds the integrin LFA-1 (ITGB2) and promotes adhesion; member of the immunoglobulin superfamily and therefore may be associated with Malaria, cerebral, susceptibility to. Accordingly, utilities of GAM2071 include diagnosis, prevention and treatment of Malaria, cerebral, susceptibility to, and of other diseases and clinical conditions associated with ICAM1.

The function of ICAM1 and its association with various diseases and clinical conditions, has been established by previous studies, as described hereinabove with reference to GAM189.1. ICK (Accession NP_057597.2) is another GAM2071 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:3106, to the nucleotide sequence of GAM2071 RNA, herein designated GAM RNA, also designated SEQ ID:371.

Another function of GAM2071 is therefore inhibition of ICK (Accession NP_057597.2). Accordingly, utilities of GAM2071 include diagnosis, prevention and treatment of diseases and clinical conditions associated with ICK.

ICK (Accession NP_055735.1) is another GAM2071 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:3106, to the nucleotide sequence of GAM2071 RNA, herein designated GAM RNA, also designated SEQ ID:371.

Another function of GAM2071 is therefore inhibition of ICK (Accession NP_055735.1). Accordingly, utilities of GAM2071 include diagnosis, prevention and treatment of diseases and clinical conditions associated with ICK.

Insulin-like growth factor 1 (somatomedin c) (IGF1, Accession NP_000609.1) is another GAM2071 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:8230, to the nucleotide sequence of GAM2071 RNA, herein designated GAM RNA, also designated SEQ ID:371.

Another function of GAM2071 is therefore inhibition of Insulin-like growth factor 1 (somatomedin c) (IGF1, Accession NP_000609.1), a gene which are structurally and functionally related to insulin but have a much higher growth-promoting activity and therefore may be associated with Growth retardation with sensorineural deafness and mental retardation. Accordingly, utilities of GAM2071 include diagnosis, prevention and treatment of Growth retardation with sensorineural deafness and mental retardation, and of other diseases and clinical conditions associated with IGF1.

The function of IGF1 and its association with various diseases and clinical conditions, has been established by previous studies, as described hereinabove with reference to GAM66.2. Interleukin 11 (IL11, Accession NP_000632.1) is another GAM2071 target gene, herein designated TARGET GENE. IL11 BINDING SITE1 and IL11 BINDING SITE2 are target binding sites found in untranslated regions of mRNA encoded by IL11, corresponding to target binding sites such as BINDING SITE I, BINDING SITE II or BINDING SITE III of FIG. 8. Table 4 illustrates the complementarity of the nucleotide sequences of IL11 BINDING SITE1 and IL11 BINDING SITE2, designated SEQ ID:6919 and SEQ ID:17785 respectively, to the nucleotide sequence of GAM2071 RNA, herein designated GAM RNA, also designated SEQ ID:371.

Another function of GAM2071 is therefore inhibition of Interleukin 11 (IL11, Accession NP_000632.1), a gene which stimulates the proliferation of hematopoietic stem cells and megakaryocyte progenitor cells and induces megakaryocyte maturation. Accordingly, utilities of GAM2071 include diagnosis, prevention and treatment of diseases and clinical conditions associated with IL11.

The function of IL11 and its association with various diseases and clinical conditions, has been established by previous studies, as described hereinabove with reference to GAM41.1. Interleukin 20 receptor, alpha (IL20RA, Accession NP_055247.2) is another GAM2071 target gene, herein designated TARGET GENE. IL20RA BINDING SITE is a target binding site found in the 3' untranslated region of mRNA encoded by IL20RA, corresponding to a target binding site such as BINDING SITE I, BINDING SITE II or BINDING SITE III of FIG. 8. Table 4 illustrates the complementarity of the nucleotide sequences of IL20RA BINDING SITE, designated SEQ ID:9137, to the nucleotide sequence of GAM2071 RNA, herein designated GAM RNA, also designated SEQ ID:371.

Another function of GAM2071 is therefore inhibition of Interleukin 20 receptor, alpha (IL20RA, Accession NP_055247.2), a gene which is the receptor for interleukin-20. Accordingly, utilities of GAM2071 include diagnosis, prevention and treatment of diseases and clinical conditions associated with IL20RA.

The function of IL20RA and its association with various diseases and clinical conditions, has been established by previous studies, as described hereinabove with reference to GAM316.1. Interleukin 28 receptor, alpha (IL28RA, Accession NP_775087.1) is another GAM2071 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:17486, to the nucleotide sequence of GAM2071 RNA, herein designated GAM RNA, also designated SEQ ID:371.

Another function of GAM2071 is therefore inhibition of Interleukin 28 receptor, alpha (IL28RA, Accession NP_775087.1). Accordingly, utilities of GAM2071 include diagnosis, prevention and treatment of diseases and clinical conditions associated with IL28RA.

Interleukin 28 receptor, alpha (IL28RA, Accession NP_734464.1) is another GAM2071 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:17486, to the nucleotide sequence of GAM2071 RNA, herein designated GAM RNA, also designated SEQ ID:371.

Another function of GAM2071 is therefore inhibition of Interleukin 28 receptor, alpha (IL28RA, Accession NP_734464.1). Accordingly, utilities of GAM2071 include diagnosis, prevention and treatment of diseases and clinical conditions associated with IL28RA.

Interleukin 28 receptor, alpha (IL28RA, Accession NP_775088.1) is another GAM2071 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:17486, to the nucleotide sequence of GAM2071 RNA, herein designated GAM RNA, also designated SEQ ID:371.

Another function of GAM2071 is therefore inhibition of Interleukin 28 receptor, alpha (IL28RA, Accession NP_775088.1). Accordingly, utilities of GAM2071 include diagnosis, prevention and treatment of diseases and clinical conditions associated with IL28RA.

IMPACT (Accession NP_060909.1) is another GAM2071 target gene, herein designated TARGET GENE. IMPACT BINDING SITE is a target binding site found in the 3' untranslated region of mRNA encoded by IMPACT, corresponding to a target binding site such as BINDING SITE I, BINDING SITE II or BINDING SITE III of FIG. 8. Table 4 illustrates the complementarity of the nucleotide sequences of IMPACT BINDING SITE, designated SEQ ID:19846, to the nucleotide sequence of GAM2071 RNA, herein designated GAM RNA, also designated SEQ ID:371.

Another function of GAM2071 is therefore inhibition of IMPACT (Accession NP_060909.1). Accordingly, utilities of GAM2071 include diagnosis, prevention and treatment of diseases and clinical conditions associated with IMPACT.

INHBE (Accession NP_113667.1) is another GAM2071 target gene, herein designated TARGET GENE. INHBE BINDING SITE is a target binding site found in the 3' untranslated region of mRNA encoded by INHBE, corresponding to a target binding site such as BINDING SITE I, BINDING SITE II or BINDING SITE III of FIG. 8. Table 4 illustrates the complementarity of the nucleotide sequences of INHBE BINDING SITE, designated SEQ ID:9633, to the nucleotide sequence of GAM2071 RNA, herein designated GAM RNA, also designated SEQ ID:371.

Another function of GAM2071 is therefore inhibition of INHBE (Accession NP_113667.1). Accordingly, utilities of GAM2071 include diagnosis, prevention and treatment of diseases and clinical conditions associated with INHBE.

Indolethylamine n-methyltransferase (INMT, Accession NP_006765.3) is another GAM2071 target gene, herein designated TARGET GENE. INMT BINDING SITE1 and INMT BINDING SITE2 are target binding sites found in untranslated regions of mRNA encoded by INMT, corresponding to target binding sites such as BINDING SITE I, BINDING SITE II or BINDING SITE III of FIG. 8. Table 4 illustrates the complementarity of the nucleotide sequences of INMT BINDING SITE1 and INMT BINDING SITE2, designated SEQ ID:3109 and SEQ ID:1421 respectively, to the nucleotide sequence of GAM2071 RNA, herein designated GAM RNA, also designated SEQ ID:371.

Another function of GAM2071 is therefore inhibition of Indolethylamine n-methyltransferase (INMT, Accession NP_006765.3). Accordingly, utilities of GAM2071 include diagnosis, prevention and treatment of diseases and clinical conditions associated with INMT.

IPO13 (Accession NP_055467.1) is another GAM2071 target gene, herein designated TARGET GENE. IPO13 BINDING SITE is a target binding site found in the 5' untranslated region of mRNA encoded by IPO13, corresponding to a target binding site such as BINDING SITE I, BINDING SITE II or BINDING SITE III of FIG. 8. Table 4 illustrates the complementarity of the nucleotide sequences of IPO13 BINDING SITE, designated SEQ ID:6877, to the nucleotide sequence of GAM2071 RNA, herein designated GAM RNA, also designated SEQ ID:371.

Another function of GAM2071 is therefore inhibition of IPO13 (Accession NP_055467.1). Accordingly, utilities of GAM2071 include diagnosis, prevention and treatment of diseases and clinical conditions associated with IPO13.

Interferon regulatory factor 4 (IRF4, Accession NP_002451.1) is another GAM2071 target gene, herein designated TARGET GENE. IRF4 BINDING SITE is a target binding site found in the 3' untranslated region of mRNA encoded by IRF4, corresponding to a target binding site such as BINDING SITE I, BINDING SITE II or BINDING SITE III of FIG. 8. Table 4 illustrates the complementarity of the nucleotide sequences of IRF4 BINDING SITE, designated SEQ ID:16311, to the nucleotide sequence of GAM2071 RNA, herein designated GAM RNA, also designated SEQ ID:371.

Another function of GAM2071 is therefore inhibition of Interferon regulatory factor 4 (IRF4, Accession NP_002451.1). Accordingly, utilities of GAM2071 include diagnosis, prevention and treatment of diseases and clinical conditions associated with IRF4.

Integrin, alpha l (antigen cd11a (p180), lymphocyte function-associated antigen 1; alpha polypeptide) (ITGAL, Accession NP_002200.1) is another GAM2071 target gene, herein designated TARGET GENE. ITGAL BINDING SITE is a target binding site found in the 3' untranslated region of mRNA encoded by ITGAL, corresponding to a target binding site such as BINDING SITE I, BINDING SITE II or BINDING SITE III of FIG. 8. Table 4 illustrates the complementarity of the nucleotide sequences of ITGAL BINDING SITE, designated SEQ ID:17682, to the nucleotide sequence of GAM2071 RNA, herein designated GAM RNA, also designated SEQ ID:371.

Another function of GAM2071 is therefore inhibition of Integrin, alpha l (antigen cd11a (p180), lymphocyte function-associated antigen 1; alpha polypeptide) (ITGAL, Accession NP_002200.1), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of GAM2071 include diagnosis, prevention and treatment of diseases and clinical conditions associated with ITGAL.

The function of ITGAL and its association with various diseases and clinical conditions, has been established by previous studies, as described hereinabove with reference to GAM148.1. Integrin, alpha x (antigen cd11c (p150), alpha polypeptide) (ITGAX, Accession NP_000878.1) is another GAM2071 target gene, herein designated TARGET GENE. ITGAX BINDING SITE is a target binding site found in the 3' untranslated region of mRNA encoded by ITGAX, corresponding to a target binding site such as BINDING SITE I, BINDING SITE II or BINDING SITE III of FIG. 8. Table 4 illustrates the complementarity of the nucleotide sequences of ITGAX BINDING SITE, designated SEQ ID:11336, to the nucleotide sequence of GAM2071 RNA, herein designated GAM RNA, also designated SEQ ID:371.

Another function of GAM2071 is therefore inhibition of Integrin, alpha x (antigen cd11c (p150), alpha polypeptide) (ITGAX, Accession NP_000878.1). Accordingly, utilities of GAM2071 include diagnosis, prevention and treatment of diseases and clinical conditions associated with ITGAX.

Janus kinase 3 (a protein tyrosine kinase, leukocyte) (JAK3, Accession NP_000206.1) is another GAM2071 target gene, herein designated TARGET GENE. JAK3 BINDING SITE is a target binding site found in the 3' untranslated region of mRNA encoded by JAK3, corresponding to a target binding site such as BINDING SITE I, BINDING SITE II or BINDING SITE III of FIG. 8. Table 4 illustrates the complementarity of the nucleotide sequences of JAK3 BINDING SITE, designated SEQ ID:6262, to the nucleotide sequence of GAM2071 RNA, herein designated GAM RNA, also designated SEQ ID:371.

Another function of GAM2071 is therefore inhibition of Janus kinase 3 (a protein tyrosine kinase, leukocyte) (JAK3, Accession NP_000206.1). Accordingly, utilities of GAM2071 include diagnosis, prevention and treatment of diseases and clinical conditions associated with JAK3.

JM11 (Accession NP_296375.1) is another GAM2071 target gene, herein designated TARGET GENE. JM11 BINDING SITE is a target binding site found in the 3' untranslated region of mRNA encoded by JM11, corresponding to a target binding site such as BINDING SITE I, BINDING SITE II or BINDING SITE III of FIG. 8. Table 4 illustrates the complementarity of the nucleotide sequences of JM11 BINDING SITE, designated SEQ ID:15361, to the nucleotide sequence of GAM2071 RNA, herein designated GAM RNA, also designated SEQ ID:371.

Another function of GAM2071 is therefore inhibition of JM11 (Accession NP_296375.1). Accordingly, utilities of GAM2071 include diagnosis, prevention and treatment of diseases and clinical conditions associated with JM11.

Jerky homolog (mouse) (JRK, Accession NP_003715.1) is another GAM2071 target gene, herein designated TARGET GENE. JRK BINDING SITE is a target binding site found in the 3' untranslated region of mRNA encoded by JRK, corresponding to a target binding site such as BINDING SITE I, BINDING SITE II or BINDING SITE III of FIG. 8. Table 4 illustrates the complementarity of the nucleotide sequences of JRK BINDING SITE, designated SEQ ID:1529, to the nucleotide sequence of GAM2071 RNA, herein designated GAM RNA, also designated SEQ ID:371.

Another function of GAM2071 is therefore inhibition of Jerky homolog (mouse) (JRK, Accession NP_003715.1), a gene which might function as a DNA- binding protein. and therefore may be associated with Absence epilepsy. Accordingly, utilities of GAM2071 include diagnosis, prevention and treatment of Absence epilepsy, and of other diseases and clinical conditions associated with JRK.

The function of JRK and its association with various diseases and clinical conditions, has been established by previous studies, as described hereinabove with reference to GAM65.2. Potassium voltage-gated channel, shaker-related subfamily, member 5 (KCNA5, Accession NP_002225.2) is another GAM2071 target gene, herein designated TARGET GENE. KCNA5 BINDING SITE is a target binding site found in the 3' untranslated region of mRNA encoded by KCNA5, corresponding to a target binding site such as BINDING SITE I, BINDING SITE II or BINDING SITE III of FIG. 8. Table 4 illustrates the complementarity of the nucleotide sequences of KCNA5 BINDING SITE, designated SEQ ID:18957, to the nucleotide sequence of GAM2071 RNA, herein designated GAM RNA, also designated SEQ ID:371.

Another function of GAM2071 is therefore inhibition of Potassium voltage-gated channel, shaker-related subfamily, member 5 (KCNA5, Accession NP_002225.2), a gene which mediates the voltage-dependent potassium ion permeability of excitable membranes. Accordingly, utilities of GAM2071 include diagnosis, prevention and treatment of diseases and clinical conditions associated with KCNA5.

The function of KCNA5 and its association with various diseases and clinical conditions, has been established by previous studies, as described hereinabove with reference to GAM391.1. Potassium voltage-gated channel, isk-related family, member 3 (KCNE3, Accession NP_005463.1) is another GAM2071 target gene, herein designated TARGET GENE. KCNE3 BINDING SITE is a target binding site found in the 3' untranslated region of mRNA encoded by KCNE3, corresponding to a target binding site such as BINDING SITE I, BINDING SITE II or BINDING SITE III of FIG. 8. Table 4 illustrates the complementarity of the nucleotide sequences of KCNE3 BINDING SITE, designated SEQ ID:6918, to the nucleotide sequence of GAM2071 RNA, herein designated GAM RNA, also designated SEQ ID:371.

Another function of GAM2071 is therefore inhibition of Potassium voltage-gated channel, isk-related family, member 3 (KCNE3, Accession NP_005463.1), a gene which ancillary protein that co-assemble with a potassium channel alpha-subunit to modulate the gating kinetics and enhance stability of the multimeric complex (by similarity). and therefore may be associated with Hypokalemic periodic paralysis. Accordingly, utilities of GAM2071 include diagnosis, prevention and treatment of Hypokalemic periodic paralysis, and of other diseases and clinical conditions associated with KCNE3.

The function of KCNE3 and its association with various diseases and clinical conditions, has been established by previous studies, as described hereinabove with reference to GAM234.1. Potassium inwardly-rectifying channel, subfamily j, member 11 (KCNJ11, Accession NP_000516.2) is another GAM2071 target gene, herein designated TARGET GENE. KCNJ11 BINDING SITE is a target binding site found in the 5' untranslated region of mRNA encoded by KCNJ11, corresponding to a target binding site such as BINDING SITE I, BINDING SITE II or BINDING SITE III of FIG. 8. Table 4 illustrates the complementarity of the nucleotide sequences of KCNJ11 BINDING SITE, designated SEQ ID:9100, to the nucleotide sequence of GAM2071 RNA, herein designated GAM RNA, also designated SEQ ID:371.

Another function of GAM2071 is therefore inhibition of Potassium inwardly-rectifying channel, subfamily j, member 11 (KCNJ11, Accession NP_000516.2), a gene which is controlled by g proteins. inward rectifier k+ channels are characterized by a greater tendency to allow potassium to flow into the cell rather than out of it. and therefore is associated with Persistent hyperinsulinemic hypoglycemia of infancy. Accordingly, utilities of GAM2071 include diagnosis, prevention and treatment of Persistent hyperinsulinemic hypoglycemia of infancy, and of other diseases and clinical conditions associated with KCNJ11.

The function of KCNJ11 and its association with various diseases and clinical conditions, has been established by previous studies, as described hereinabove with reference to GAM189.1. KENAE (Accession NP_789786.1) is another GAM2071 target gene, herein designated TARGET GENE. KENAE BINDING SITE is a target binding site found in the 3' untranslated region of mRNA encoded by KENAE, corresponding to a target binding site such as BINDING SITE I, BINDING SITE II or BINDING SITE III of FIG. 8. Table 4 illustrates the complementarity of the nucleotide sequences of KENAE BINDING SITE, designated SEQ ID:18180, to the nucleotide sequence of GAM2071 RNA, herein designated GAM RNA, also designated SEQ ID:371.

Another function of GAM2071 is therefore inhibition of KENAE (Accession NP_789786.1). Accordingly, utilities of GAM2071 include diagnosis, prevention and treatment of diseases and clinical conditions associated with KENAE.

KIAA0053 (Accession NP_055697.1) is another GAM2071 target gene, herein designated TARGET GENE. KIAA0053 BINDING SITE is a target binding site found in the 3' untranslated region of mRNA encoded by KIAA0053, corresponding to a target binding site such as BINDING SITE I, BINDING SITE II or BINDING SITE III of FIG. 8. Table 4 illustrates the complementarity of the nucleotide sequences of KIAA0053 BINDING SITE, designated SEQ ID:16223, to the nucleotide sequence of GAM2071 RNA, herein designated GAM RNA, also designated SEQ ID:371.

Another function of GAM2071 is therefore inhibition of KIAA0053 (Accession NP_055697.1). Accordingly, utilities of GAM2071 include diagnosis, prevention and treatment of diseases and clinical conditions associated with KIAA0053.

KIAA0087 (Accession NP_055584.1) is another GAM2071 target gene, herein designated TARGET GENE. KIAA0087 BINDING SITE is a target binding site found in the 3' untranslated region of mRNA encoded by KIAA0087, corresponding to a target binding site such as BINDING SITE I, BINDING SITE II or BINDING SITE III of FIG. 8. Table 4 illustrates the complementarity of the nucleotide sequences of KIAA0087 BINDING SITE, designated SEQ ID:14875, to the nucleotide sequence of GAM2071 RNA, herein designated GAM RNA, also designated SEQ ID:371.

Another function of GAM2071 is therefore inhibition of KIAA0087 (Accession NP_055584.1). Accordingly, utilities of GAM2071 include diagnosis, prevention and treatment of diseases and clinical conditions associated with KIAA0087.

KIAA0117 (Accession XP_290939.1) is another GAM2071 target gene, herein designated TARGET GENE. KIAA0117 BINDING SITE is a target binding site found in the 3' untranslated region of mRNA encoded by KIAA0117, corresponding to a target binding site such as BINDING SITE I, BINDING SITE II or BINDING SITE III of FIG. 8. Table 4 illustrates the complementarity of the nucleotide sequences of KIAA0117 BINDING SITE, designated SEQ ID:1353, to the nucleotide sequence of GAM2071 RNA, herein designated GAM RNA, also designated SEQ ID:371.

Another function of GAM2071 is therefore inhibition of KIAA0117 (Accession XP_290939.1). Accordingly, utilities of GAM2071 include diagnosis, prevention and treatment of diseases and clinical conditions associated with KIAA0117.

KIAA0186 (Accession NP_066545.1) is another GAM2071 target gene, herein designated TARGET GENE. KIAA0186 BINDING SITE is a target binding site found in the 3' untranslated region of mRNA encoded by KIAA0186, corresponding to a target binding site such as BINDING SITE I, BINDING SITE II or BINDING SITE III of FIG. 8. Table 4 illustrates the complementarity of the nucleotide sequences of KIAA0186 BINDING SITE, designated SEQ ID:6841, to the nucleotide sequence of GAM2071 RNA, herein designated GAM RNA, also designated SEQ ID:371.

Another function of GAM2071 is therefore inhibition of KIAA0186 (Accession NP_066545.1). Accordingly, utilities of GAM2071 include diagnosis, prevention and treatment of diseases and clinical conditions associated with KIAA0186.

KIAA0205 (Accession NP_055688.1) is another GAM2071 target gene, herein designated TARGET GENE. KIAA0205 BINDING SITE is a target binding site found in the 3' untranslated region of mRNA encoded by KIAA0205, corresponding to a target binding site such as BINDING SITE I, BINDING SITE II or BINDING SITE III of FIG. 8. Table 4 illustrates the complementarity of the nucleotide sequences of KIAA0205 BINDING SITE, designated SEQ ID:17371, to the nucleotide sequence of GAM2071 RNA, herein designated GAM RNA, also designated SEQ ID:371.

Another function of GAM2071 is therefore inhibition of KIAA0205 (Accession NP_055688.1). Accordingly, utilities of GAM2071 include diagnosis, prevention and treatment of diseases and clinical conditions associated with KIAA0205.

KIAA0350 (Accession XP_290667.1) is another GAM2071 target gene, herein designated TARGET GENE. KIAA0350 BINDING SITE is a target binding site found in the 3' untranslated region of mRNA encoded by KIAA0350, corresponding to a target binding site such as BINDING SITE I, BINDING SITE II or BINDING SITE III of FIG. 8. Table 4 illustrates the complementarity of the nucleotide sequences of KIAA0350 BINDING SITE, designated SEQ ID:12671, to the nucleotide sequence of GAM2071 RNA, herein designated GAM RNA, also designated SEQ ID:371.

Another function of GAM2071 is therefore inhibition of KIAA0350 (Accession XP_290667.1). Accordingly, utilities of GAM2071 include diagnosis, prevention and treatment of diseases and clinical conditions associated with KIAA0350.

KIAA0435 (Accession NP_055616.1) is another GAM2071 target gene, herein designated TARGET GENE. KIAA0435 BINDING SITE is a target binding site found in the 5' untranslated region of mRNA encoded by KIAA0435, corresponding to a target binding site such as BINDING SITE I, BINDING SITE II or BINDING SITE III of FIG. 8. Table 4 illustrates the complementarity of the nucleotide sequences of KIAA0435 BINDING SITE, designated SEQ ID:14441, to the nucleotide sequence of GAM2071 RNA, herein designated GAM RNA, also designated SEQ ID:371.

Another function of GAM2071 is therefore inhibition of KIAA0435 (Accession NP_055616.1). Accordingly, utilities of GAM2071 include diagnosis, prevention and treatment of diseases and clinical conditions associated with KIAA0435.

KIAA0446 (Accession XP_044155.1) is another GAM2071 target gene, herein designated TARGET GENE. KIAA0446 BINDING SITE is a target binding site found in the 5' untranslated region of mRNA encoded by KIAA0446, corresponding to a target binding site such as BINDING SITE I, BINDING SITE II or BINDING SITE III of FIG. 8. Table 4 illustrates the complementarity of the nucleotide sequences of KIAA0446 BINDING SITE, designated SEQ ID:20115, to the nucleotide sequence of GAM2071 RNA, herein designated GAM RNA, also designated SEQ ID:371.

Another function of GAM2071 is therefore inhibition of KIAA0446 (Accession XP_044155.1). Accordingly, utilities of GAM2071 include diagnosis, prevention and treatment of diseases and clinical conditions associated with KIAA0446.

KIAA0459 (Accession XP_027862.1) is another GAM2071 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:3442, to the nucleotide sequence of GAM2071 RNA, herein designated GAM RNA, also designated SEQ ID:371.

Another function of GAM2071 is therefore inhibition of KIAA0459 (Accession XP_027862.1). Accordingly, utilities of GAM2071 include diagnosis, prevention and treatment of diseases and clinical conditions associated with KIAA0459.

KIAA0469 (Accession NP_055666.1) is another GAM2071 target gene, herein designated TARGET GENE. KIAA0469 BINDING SITE1 and KIAA0469 BINDING SITE2 are target binding sites found in untranslated regions of mRNA encoded by KIAA0469, corresponding to target binding sites such as BINDING SITE I, BINDING SITE II or BINDING SITE III of FIG. 8. Table 4 illustrates the complementarity of the nucleotide sequences of KIAA0469 BINDING SITE1 and KIAA0469 BINDING SITE2, designated SEQ ID:14283 and SEQ ID:1413 respectively, to the nucleotide sequence of GAM2071 RNA, herein designated GAM RNA, also designated SEQ ID:371.

Another function of GAM2071 is therefore inhibition of KIAA0469 (Accession NP_055666.1). Accordingly, utilities of GAM2071 include diagnosis, prevention and treatment of diseases and clinical conditions associated with KIAA0469.

KIAA0471 (Accession NP_055672.1) is another GAM2071 target gene, herein designated TARGET GENE. KIAA0471 BINDING SITE is a target binding site found in the 5' untranslated region of mRNA encoded by KIAA0471, corresponding to a target binding site such as BINDING SITE I, BINDING SITE II or BINDING SITE III of FIG. 8. Table 4 illustrates the complementarity of the nucleotide sequences of KIAA0471 BINDING SITE, designated SEQ ID:16265, to the nucleotide sequence of GAM2071 RNA, herein designated GAM RNA, also designated SEQ ID:371.

Another function of GAM2071 is therefore inhibition of KIAA0471 (Accession NP_055672.1). Accordingly, utilities of GAM2071 include diagnosis, prevention and treatment of diseases and clinical conditions associated with KIAA0471.

KIAA0475 (Accession NP_055679.1) is another GAM2071 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:7946, to the nucleotide sequence of GAM2071 RNA, herein designated GAM RNA, also designated SEQ ID:371.

Another function of GAM2071 is therefore inhibition of KIAA0475 (Accession NP_055679.1). Accordingly, utilities of GAM2071 include diagnosis, prevention and treatment of diseases and clinical conditions associated with KIAA0475.

KIAA0478 (Accession NP_055685.1) is another GAM2071 target gene, herein designated TARGET GENE. KIAA0478 BINDING SITE is a target binding site found in the 3' untranslated region of mRNA encoded by KIAA0478, corresponding to a target binding site such as BINDING SITE I, BINDING SITE II or BINDING SITE III of FIG. 8. Table 4 illustrates the complementarity of the nucleotide sequences of KIAA0478 BINDING SITE, designated SEQ ID:11512, to the nucleotide sequence of GAM2071 RNA, herein designated GAM RNA, also designated SEQ ID:371.

Another function of GAM2071 is therefore inhibition of KIAA0478 (Accession NP_055685.1). Accordingly, utilities of GAM2071 include diagnosis, prevention and treatment of diseases and clinical conditions associated with KIAA0478.

KIAA0493 (Accession XP_034717.1) is another GAM2071 target gene, herein designated TARGET GENE. KIAA0493 BINDING SITE is a target binding site found in the 5' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:6597, to the nucleotide sequence of GAM2071 RNA, herein designated GAM RNA, also designated SEQ ID:371.

Another function of GAM2071 is therefore inhibition of KIAA0493 (Accession XP_034717.1). Accordingly, utilities of GAM2071 include diagnosis, prevention and treatment of diseases and clinical conditions associated with KIAA0493.

KIAA0495 (Accession XP_031397.1) is another GAM2071 target gene, herein designated TARGET GENE. KIAA0495 BINDING SITE is a target binding site found in the 3' untranslated region of mRNA encoded by KIAA0495, corresponding to a target binding site such as BINDING SITE I, BINDING SITE II or BINDING SITE III of FIG. 8. Table 4 illustrates the complementarity of the nucleotide sequences of KIAA0495 BINDING SITE, designated SEQ ID:5452, to the nucleotide sequence of GAM2071 RNA, herein designated GAM RNA, also designated SEQ ID:371.

Another function of GAM2071 is therefore inhibition of KIAA0495 (Accession XP_031397.1). Accordingly, utilities of GAM2071 include diagnosis, prevention and treatment of diseases and clinical conditions associated with KIAA0495.

KIAA0513 (Accession NP_055547.1) is another GAM2071 target gene, herein designated TARGET GENE. KIAA0513 BINDING SITE1 through KIAA0513 BINDING SITE3 are target binding sites found in untranslated regions of mRNA encoded by KIAA0513, corresponding to target binding sites such as BINDING SITE I, BINDING SITE II or BINDING SITE III of FIG. 8. Table 4 illustrates the complementarity of the nucleotide sequences of KIAA0513 BINDING SITE1 through KIAA0513 BINDING SITE3, designated SEQ ID:11210, SEQ ID:7613 and SEQ ID:12742 respectively, to the nucleotide sequence of GAM2071 RNA, herein designated GAM RNA, also designated SEQ ID:371.

Another function of GAM2071 is therefore inhibition of KIAA0513 (Accession NP_055547.1). Accordingly, utilities of GAM2071 include diagnosis, prevention and treatment of diseases and clinical conditions associated with KIAA0513.

KIAA0527 (Accession XP_171054.1) is another GAM2071 target gene, herein designated TARGET GENE. KIAA0527 BINDING SITE is a target binding site found in the 3' untranslated region of mRNA encoded by KIAA0527, corresponding to a target binding site such as BINDING SITE I, BINDING SITE II or BINDING SITE III of FIG. 8. Table 4 illustrates the complementarity of the nucleotide sequences of KIAA0527 BINDING SITE, designated SEQ ID:19044, to the nucleotide sequence of GAM2071 RNA, herein designated GAM RNA, also designated SEQ ID:371.

Another function of GAM2071 is therefore inhibition of KIAA0527 (Accession XP_171054.1). Accordingly, utilities of GAM2071 include diagnosis, prevention and treatment of diseases and clinical conditions associated with KIAA0527.

KIAA0532 (Accession XP_047659.6) is another GAM2071 target gene, herein designated TARGET GENE. KIAA0532 BINDING SITE is a target binding site found in the 3' untranslated region of mRNA encoded by KIAA0532, corresponding to a target binding site such as BINDING SITE I, BINDING SITE II or BINDING SITE III of FIG. 8. Table 4 illustrates the complementarity of the nucleotide sequences of KIAA0532 BINDING SITE, designated SEQ ID:483, to the nucleotide sequence of GAM2071 RNA, herein designated GAM RNA, also designated SEQ ID:371.

Another function of GAM2071 is therefore inhibition of KIAA0532 (Accession XP_047659.6). Accordingly, utilities of GAM2071 include diagnosis, prevention and treatment of diseases and clinical conditions associated with KIAA0532.

KIAA0557 (Accession XP_085507.1) is another GAM2071 target gene, herein designated TARGET GENE. KIAA0557 BINDING SITE is a target binding site found in the 3' untranslated region of mRNA encoded by KIAA0557, corresponding to a target binding site such as BINDING SITE I, BINDING SITE II or BINDING SITE III of FIG. 8. Table 4 illustrates the complementarity of the nucleotide sequences of KIAA0557 BINDING SITE, designated SEQ ID:16200, to the nucleotide sequence of GAM2071 RNA, herein designated GAM RNA, also designated SEQ ID:371.

Another function of GAM2071 is therefore inhibition of KIAA0557 (Accession XP_085507.1). Accordingly, utilities of GAM2071 include diagnosis, prevention and treatment of diseases and clinical conditions associated with KIAA0557.

KIAA0561 (Accession XP_038150.2) is another GAM2071 target gene, herein designated TARGET GENE. KIAA0561 BINDING SITE1 and KIAA0561 BINDING SITE2 are target binding sites found in untranslated regions of mRNA encoded by KIAA0561, corresponding to target binding sites such as BINDING SITE I, BINDING SITE II or BINDING SITE III of FIG. 8. Table 4 illustrates the complementarity of the nucleotide sequences of KIAA0561 BINDING SITE1 and KIAA0561 BINDING SITE2, designated SEQ ID:11513 and SEQ ID:12972 respectively, to the nucleotide sequence of GAM2071 RNA, herein designated GAM RNA, also designated SEQ ID:371.

Another function of GAM2071 is therefore inhibition of KIAA0561 (Accession XP_038150.2). Accordingly, utilities of GAM2071 include diagnosis, prevention and treatment of diseases and clinical conditions associated with KIAA0561.

KIAA0562 (Accession NP_055519.1) is another GAM2071 target gene, herein designated TARGET GENE. KIAA0562 BINDING SITE is a target binding site found in the 3' untranslated region of mRNA encoded by KIAA0562, corresponding to a target binding site such as BINDING SITE I, BINDING SITE II or BINDING SITE III of FIG. 8. Table 4 illustrates the complementarity of the nucleotide sequences of KIAA0562 BINDING SITE, designated SEQ ID:10458, to the nucleotide sequence of GAM2071 RNA, herein designated GAM RNA, also designated SEQ ID:371.

Another function of GAM2071 is therefore inhibition of KIAA0562 (Accession NP_055519.1). Accordingly, utilities of GAM2071 include diagnosis, prevention and treatment of diseases and clinical conditions associated with KIAA0562.

KIAA0563 (Accession NP_055649.1) is another GAM2071 target gene, herein designated TARGET GENE. KIAA0563 BINDING SITE is a target binding site found in the 5' untranslated region of mRNA encoded by KIAA0563, corresponding to a target binding site such as BINDING SITE I, BINDING SITE II or BINDING SITE III of FIG. 8. Table 4 illustrates the complementarity of the nucleotide sequences of KIAA0563 BINDING SITE, designated SEQ ID:19679, to the nucleotide sequence of GAM2071 RNA, herein designated GAM RNA, also designated SEQ ID:371.

Another function of GAM2071 is therefore inhibition of KIAA0563 (Accession NP_055649.1). Accordingly, utilities of GAM2071 include diagnosis, prevention and treatment of diseases and clinical conditions associated with KIAA0563.

KIAA0605 (Accession NP_055509.1) is another GAM2071 target gene, herein designated TARGET GENE. KIAA0605 BINDING SITE is a target binding site found in the 5' untranslated region of mRNA encoded by KIAA0605, corresponding to a target binding site such as BINDING SITE I, BINDING SITE II or BINDING SITE III of FIG. 8. Table 4 illustrates the complementarity of the nucleotide sequences of KIAA0605 BINDING SITE, designated SEQ ID:11045, to the nucleotide sequence of GAM2071 RNA, herein designated GAM RNA, also designated SEQ ID:371.

Another function of GAM2071 is therefore inhibition of KIAA0605 (Accession NP_055509.1). Accordingly, utilities of GAM2071 include diagnosis, prevention and treatment of diseases and clinical conditions associated with KIAA0605.

KIAA0682 (Accession NP_055667.1) is another GAM2071 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:2671, to the nucleotide sequence of GAM2071 RNA, herein designated GAM RNA, also designated SEQ ID:371.

Another function of GAM2071 is therefore inhibition of KIAA0682 (Accession NP_055667.1). Accordingly, utilities of GAM2071 include diagnosis, prevention and treatment of diseases and clinical conditions associated with KIAA0682.

KIAA0831 (Accession NP_055739.1) is another GAM2071 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:16264, to the nucleotide sequence of GAM2071 RNA, herein designated GAM RNA, also designated SEQ ID:371.

Another function of GAM2071 is therefore inhibition of KIAA0831 (Accession NP_055739.1). Accordingly, utilities of GAM2071 include diagnosis, prevention and treatment of diseases and clinical conditions associated with KIAA0831.

KIAA0841 (Accession XP_049237.1) is another GAM2071 target gene, herein designated TARGET GENE. KIAA0841 BINDING SITE1 and KIAA0841 BINDING SITE2 are target binding sites found in untranslated regions of mRNA encoded by KIAA0841, corresponding to target binding sites such as BINDING SITE I, BINDING SITE II or BINDING SITE III of FIG. 8. Table 4 illustrates the complementarity of the nucleotide sequences of KIAA0841 BIND- ING SITE1 and KIAA0841 BINDING SITE2, designated SEQ ID:901 and SEQ ID:1519 respectively, to the nucleotide sequence of GAM2071 RNA, herein designated GAM RNA, also designated SEQ ID:371.

Another function of GAM2071 is therefore inhibition of KIAA0841 (Accession XP_049237.1). Accordingly, utilities of GAM2071 include diagnosis, prevention and treatment of diseases and clinical conditions associated with KIAA0841.

KIAA0861 (Accession NP_055893.2) is another GAM2071 target gene, herein designated TARGET GENE. KIAA0861 BINDING SITE is a target binding site found in the 3' untranslated region of mRNA encoded by KIAA0861, corresponding to a target binding site such as BINDING SITE I, BINDING SITE II or BINDING SITE III of FIG. 8. Table 4 illustrates the complementarity of the nucleotide sequences of KIAA0861 BINDING SITE, designated SEQ ID:10629, to the nucleotide sequence of GAM2071 RNA, herein designated GAM RNA, also designated SEQ ID:371.

Another function of GAM2071 is therefore inhibition of KIAA0861 (Accession NP_055893.2). Accordingly, utilities of GAM2071 include diagnosis, prevention and treatment of diseases and clinical conditions associated with KIAA0861.

KIAA0924 (Accession NP_055712.1) is another GAM2071 target gene, herein designated TARGET GENE. KIAA0924 BINDING SITE1 and KIAA0924 BINDING SITE2 are target binding sites found in untranslated regions of mRNA encoded by KIAA0924, corresponding to target binding sites such as BINDING SITE I, BINDING SITE II or BINDING SITE III of FIG. 8. Table 4 illustrates the complementarity of the nucleotide sequences of KIAA0924 BINDING SITE1 and KIAA0924 BINDING SITE2, designated SEQ ID:19935 and SEQ ID:864 respectively, to the nucleotide sequence of GAM2071 RNA, herein designated GAM RNA, also designated SEQ ID:371.

Another function of GAM2071 is therefore inhibition of KIAA0924 (Accession NP_055712.1). Accordingly, utilities of GAM2071 include diagnosis, prevention and treatment of diseases and clinical conditions associated with KIAA0924.

KIAA0931 (Accession XP_041191.2) is another GAM2071 target gene, herein designated TARGET GENE. KIAA0931 BINDING SITE is a target binding site found in the 3' untranslated region of mRNA encoded by KIAA0931, corresponding to a target binding site such as BINDING SITE I, BINDING SITE II or BINDING SITE III of FIG. 8. Table 4 illustrates the complementarity of the nucleotide sequences of KIAA0931 BINDING SITE, designated SEQ ID:8504, to the nucleotide sequence of GAM2071 RNA, herein designated GAM RNA, also designated SEQ ID:371.

Another function of GAM2071 is therefore inhibition of KIAA0931 (Accession XP_041191.2). Accordingly, utilities of GAM2071 include diagnosis, prevention and treatment of diseases and clinical conditions associated with KIAA0931.

KIAA0935 (Accession XP_052620.6) is another GAM2071 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:10957, to the nucleotide sequence of GAM2071 RNA, herein designated GAM RNA, also designated SEQ ID:371.

Another function of GAM2071 is therefore inhibition of KIAA0935 (Accession XP_052620.6). Accordingly, utilities of GAM2071 include diagnosis, prevention and treatment of diseases and clinical conditions associated with KIAA0935.

KIAA0937 (Accession XP_166213.1) is another GAM2071 target gene, herein designated TARGET GENE. KIAA0937 BINDING SITE is a target binding site found in the 3' untranslated region of mRNA encoded by KIAA0937, corresponding to a target binding site such as BINDING SITE I, BINDING SITE II or BINDING SITE III of FIG. 8. Table 4 illustrates the complementarity of the nucleotide sequences of KIAA0937 BINDING SITE, designated SEQ ID:7974, to the nucleotide sequence of GAM2071 RNA, herein designated GAM RNA, also designated SEQ ID:371.

Another function of GAM2071 is therefore inhibition of KIAA0937 (Accession XP_166213.1). Accordingly, utilities of GAM2071 include diagnosis, prevention and treatment of diseases and clinical conditions associated with KIAA0937.

KIAA1002 (Accession XP_290584.1) is another GAM2071 target gene, herein designated TARGET GENE. KIAA1002 BINDING SITE is a target binding site found in the 3' untranslated region of mRNA encoded by KIAA1002, corresponding to a target binding site such as BINDING SITE I, BINDING SITE II or BINDING SITE III of FIG. 8. Table 4 illustrates the complementarity of the nucleotide sequences of KIAA1002 BINDING SITE, designated SEQ ID:8660, to the nucleotide sequence of GAM2071 RNA, herein designated GAM RNA, also designated SEQ ID:371.

Another function of GAM2071 is therefore inhibition of KIAA1002 (Accession XP_290584.1). Accordingly, utilities of GAM2071 include diagnosis, prevention and treatment of diseases and clinical conditions associated with KIAA1002.

KIAA1040 (Accession XP_051091.3) is another GAM2071 target gene, herein designated TARGET GENE. KIAA1040 BINDING SITE1 and KIAA1040 BINDING SITE2 are target binding sites found in untranslated regions of mRNA encoded by KIAA1040, corresponding to target binding sites such as BINDING SITE I, BINDING SITE II or BINDING SITE III of FIG. 8. Table 4 illustrates the complementarity of the nucleotide sequences of KIAA1040 BINDING SITE1 and KIAA1040 BINDING SITE2, designated SEQ ID:5138 and SEQ ID:5080 respectively, to the nucleotide sequence of GAM2071 RNA, herein designated GAM RNA, also designated SEQ ID:371.

Another function of GAM2071 is therefore inhibition of KIAA1040 (Accession XP_051091.3). Accordingly, utilities of GAM2071 include diagnosis, prevention and treatment of diseases and clinical conditions associated with KIAA1040.

KIAA1041 (Accession NP_055762.1) is another GAM2071 target gene, herein designated TARGET GENE. KIAA1041 BINDING SITE is a target binding site found in the 3' untranslated region of mRNA encoded by KIAA1041, corresponding to a target binding site such as BINDING SITE I, BINDING SITE II or BINDING SITE III of FIG. 8. Table 4 illustrates the complementarity of the nucleotide sequences of KIAA1041 BINDING SITE, designated SEQ ID:11112, to the nucleotide sequence of GAM2071 RNA, herein designated GAM RNA, also designated SEQ ID:371.

Another function of GAM2071 is therefore inhibition of KIAA1041 (Accession NP_055762.1). Accordingly, utilities of GAM2071 include diagnosis, prevention and treatment of diseases and clinical conditions associated with KIAA1041.

KIAA1043 (Accession NP_056096.1) is another GAM2071 target gene, herein designated TARGET GENE. KIAA1043 BINDING SITE is a target binding site found in the 3' untranslated region of mRNA encoded by KIAA1043, corresponding to a target binding site such as BINDING SITE I, BINDING SITE II or BINDING SITE III of FIG. 8. Table 4 illustrates the complementarity of the nucleotide sequences of KIAA1043 BINDING SITE, designated SEQ ID:18400, to the nucleotide sequence of GAM2071 RNA, herein designated GAM RNA, also designated SEQ ID:371.

Another function of GAM2071 is therefore inhibition of KIAA1043 (Accession NP_056096.1). Accordingly, utilities of GAM2071 include diagnosis, prevention and treatment of diseases and clinical conditions associated with KIAA1043.

KIAA1045 (Accession XP_048592.1) is another GAM2071 target gene, herein designated TARGET GENE. KIAA1045 BINDING SITE is a target binding site found in the 3' untranslated region of mRNA encoded by KIAA1045, corresponding to a target binding site such as BINDING SITE I, BINDING SITE II or BINDING SITE III of FIG. 8. Table 4 illustrates the complementarity of the nucleotide sequences of KIAA1045 BINDING SITE, designated SEQ ID:9634, to the nucleotide sequence of GAM2071 RNA, herein designated GAM RNA, also designated SEQ ID:371.

Another function of GAM2071 is therefore inhibition of KIAA1045 (Accession XP_048592.1). Accordingly, utilities of GAM2071 include diagnosis, prevention and treatment of diseases and clinical conditions associated with KIAA1045.

KIAA1052 (Accession NP_055771.1) is another GAM2071 target gene, herein designated TARGET GENE. KIAA1052 BINDING SITE is a target binding site found in the 5' untranslated region of mRNA encoded by KIAA1052, corresponding to a target binding site such as BINDING SITE I, BINDING SITE II or BINDING SITE III of FIG. 8. Table 4 illustrates the complementarity of the nucleotide sequences of KIAA1052 BINDING SITE, designated SEQ ID:1530, to the nucleotide sequence of GAM2071 RNA, herein designated GAM RNA, also designated SEQ ID:371.

Another function of GAM2071 is therefore inhibition of KIAA1052 (Accession NP_055771.1). Accordingly, utilities of GAM2071 include diagnosis, prevention and treatment of diseases and clinical conditions associated with KIAA1052.

KIAA1054 (Accession XP_043493.5) is another GAM2071 target gene, herein designated TARGET GENE. KIAA1054 BINDING SITE is a target binding site found in the 3' untranslated region of mRNA encoded by KIAA1054, corresponding to a target binding site such as BINDING SITE I, BINDING SITE II or BINDING SITE III of FIG. 8. Table 4 illustrates the complementarity of the nucleotide sequences of KIAA1054 BINDING SITE, designated SEQ ID:7973, to the nucleotide sequence of GAM2071 RNA, herein designated GAM RNA, also designated SEQ ID:371.

Another function of GAM2071 is therefore inhibition of KIAA1054 (Accession XP_043493.5). Accordingly, utilities of GAM2071 include diagnosis, prevention and treatment of diseases and clinical conditions associated with KIAA1054.

KIAA1126 (Accession XP_050325.1) is another GAM2071 target gene, herein designated TARGET GENE. KIAA1126 BINDING SITE is a target binding site found in the 3' untranslated region of mRNA encoded by KIAA1126, corresponding to a target binding site such as BINDING SITE I, BINDING SITE II or BINDING SITE III of FIG. 8. Table 4 illustrates the complementarity of the nucleotide sequences of KIAA1126 BINDING SITE, designated SEQ ID:6077, to the nucleotide sequence of GAM2071 RNA, herein designated GAM RNA, also designated SEQ ID:371.

Another function of GAM2071 is therefore inhibition of KIAA1126 (Accession XP_050325.1). Accordingly, utilities of GAM2071 include diagnosis, prevention and treatment of diseases and clinical conditions associated with KIAA1126.

KIAA1143 (Accession XP_044014.1) is another GAM2071 target gene, herein designated TARGET GENE. KIAA1143 BINDING SITE is a target binding site found in the 3' untranslated region of mRNA encoded by KIAA1143, corresponding to a target binding site such as BINDING SITE I, BINDING SITE II or BINDING SITE III of FIG. 8. Table 4 illustrates the complementarity of the nucleotide sequences of KIAA1143 BINDING SITE, designated SEQ ID:13800, to the nucleotide sequence of GAM2071 RNA, herein designated GAM RNA, also designated SEQ ID:371.

Another function of GAM2071 is therefore inhibition of KIAA1143 (Accession XP_044014.1). Accordingly, utilities of GAM2071 include diagnosis, prevention and treatment of diseases and clinical conditions associated with KIAA1143.

KIAA1155 (Accession XP_030864.2) is another GAM2071 target gene, herein designated TARGET GENE. KIAA1155 BINDING SITE is a target binding site found in the 3' untranslated region of mRNA encoded by KIAA1155, corresponding to a target binding site such as BINDING SITE I, BINDING SITE II or BINDING SITE III of FIG. 8. Table 4 illustrates the complementarity of the nucleotide sequences of KIAA1155 BINDING SITE, designated SEQ ID:5405, to the nucleotide sequence of GAM2071 RNA, herein designated GAM RNA, also designated SEQ ID:371.

Another function of GAM2071 is therefore inhibition of KIAA1155 (Accession XP_030864.2). Accordingly, utilities of GAM2071 include diagnosis, prevention and treatment of diseases and clinical conditions associated with KIAA1155.

KIAA1185 (Accession NP_065761.1) is another GAM2071 target gene, herein designated TARGET GENE. KIAA1185 BINDING SITE is a target binding site found in the 3' untranslated region of mRNA encoded by KIAA1185, corresponding to a target binding site such as BINDING SITE I, BINDING SITE II or BINDING SITE III of FIG. 8. Table 4 illustrates the complementarity of the nucleotide sequences of KIAA1185 BINDING SITE, designated SEQ ID:9213, to the nucleotide sequence of GAM2071 RNA, herein designated GAM RNA, also designated SEQ ID:371.

Another function of GAM2071 is therefore inhibition of KIAA1185 (Accession NP_065761.1). Accordingly, utilities of GAM2071 include diagnosis, prevention and treatment of diseases and clinical conditions associated with KIAA1185.

KIAA1193 (Accession XP_041843.1) is another GAM2071 target gene, herein designated TARGET GENE. KIAA1193 BINDING SITE is a target binding site found in the 3' untranslated region of mRNA encoded by KIAA1193, corresponding to a target binding site such as BINDING SITE I, BINDING SITE II or BINDING SITE III of FIG. 8. Table 4 illustrates the complementarity of the nucleotide sequences of KIAA1193 BINDING SITE, designated SEQ ID:1683, to the nucleotide sequence of GAM2071 RNA, herein designated GAM RNA, also designated SEQ ID:371.

Another function of GAM2071 is therefore inhibition of KIAA1193 (Accession XP_041843.1). Accordingly, utilities of GAM2071 include diagnosis, prevention and treatment of diseases and clinical conditions associated with KIAA1193.

KIAA1198 (Accession NP_065765.1) is another GAM2071 target gene, herein designated TARGET GENE. KIAA1198 BINDING SITE1 through KIAA1198 BINDING SITE6 are target binding sites found in untranslated regions of mRNA encoded by KIAA1198, corresponding to target binding sites such as BINDING SITE I, BINDING SITE II or BINDING SITE III of FIG. 8. Table 4 illustrates the complementarity of the nucleotide sequences of KIAA1198 BINDING SITE1 through KIAA1198 BINDING SITE6, designated SEQ ID:19094, SEQ ID:17786, SEQ ID:8170, SEQ ID:5522, SEQ ID:17617 and SEQ ID:17224 respectively, to the nucleotide sequence of GAM2071 RNA, herein designated GAM RNA, also designated SEQ ID:371.

Another function of GAM2071 is therefore inhibition of KIAA1198 (Accession NP_065765.1). Accordingly, utilities of GAM2071 include diagnosis, prevention and treatment of diseases and clinical conditions associated with KIAA1198.

KIAA1210 (Accession XP_172801.1) is another GAM2071 target gene, herein designated TARGET GENE. KIAA1210 BINDING SITE is a target binding site found in the 3' untranslated region of mRNA encoded by KIAA1210, corresponding to a target binding site such as BINDING SITE I, BINDING SITE II or BINDING SITE III of FIG. 8. Table 4 illustrates the complementarity of the nucleotide sequences of KIAA1210 BINDING SITE, designated SEQ ID:1409, to the nucleotide sequence of GAM2071 RNA, herein designated GAM RNA, also designated SEQ ID:371.

Another function of GAM2071 is therefore inhibition of KIAA1210 (Accession XP_172801.1). Accordingly, utilities of GAM2071 include diagnosis, prevention and treatment of diseases and clinical conditions associated with KIAA1210.

KIAA1257 (Accession XP_031577.2) is another GAM2071 target gene, herein designated TARGET GENE. KIAA1257 BINDING SITE1 and KIAA1257 BINDING SITE2 are target binding sites found in untranslated regions of mRNA encoded by KIAA1257, corresponding to target binding sites such as BINDING SITE I, BINDING SITE II or BINDING SITE III of FIG. 8. Table 4 illustrates the complementarity of the nucleotide sequences of KIAA1257 BINDING SITE1 and KIAA1257 BINDING SITE2, designated SEQ ID:14928 and SEQ ID:3109 respectively, to the nucleotide sequence of GAM2071 RNA, herein designated GAM RNA, also designated SEQ ID:371.

Another function of GAM2071 is therefore inhibition of KIAA1257 (Accession XP_031577.2). Accordingly, utilities of GAM2071 include diagnosis, prevention and treatment of diseases and clinical conditions associated with KIAA1257.

KIAA1272 (Accession XP_046600.7) is another GAM2071 target gene, herein designated TARGET GENE. KIAA1272 BINDING SITE is a target binding site found in the 5' untranslated region of mRNA encoded by KIAA1272, corresponding to a target binding site such as BINDING SITE I, BINDING SITE II or BINDING SITE III of FIG. 8. Table 4 illustrates the complementarity of the nucleotide sequences of KIAA1272 BINDING SITE, designated SEQ ID:15059, to the nucleotide sequence of GAM2071 RNA, herein designated GAM RNA, also designated SEQ ID:371.

Another function of GAM2071 is therefore inhibition of KIAA1272 (Accession XP_046600.7). Accordingly, utilities of GAM2071 include diagnosis, prevention and treatment of diseases and clinical conditions associated with KIAA1272.

KIAA1287 (Accession NP_065799.1) is another GAM2071 target gene, herein designated TARGET GENE. KIAA1287 BINDING SITE is a target binding site found in the 3' untranslated region of mRNA encoded by KIAA1287, corresponding to a target binding site such as BINDING SITE I, BINDING SITE II or BINDING SITE III of FIG. 8. Table 4 illustrates the complementarity of the nucleotide sequences of KIAA1287 BINDING SITE, designated SEQ ID:13685, to the nucleotide sequence of GAM2071 RNA, herein designated GAM RNA, also designated SEQ ID:371.

Another function of GAM2071 is therefore inhibition of KIAA1287 (Accession NP_065799.1). Accordingly, utilities of GAM2071 include diagnosis, prevention and treatment of diseases and clinical conditions associated with KIAA1287.

KIAA1393 (Accession XP_050793.2) is another GAM2071 target gene, herein designated TARGET GENE. KIAA1393 BINDING SITE is a target binding site found in the 3' untranslated region of mRNA encoded by KIAA1393, corresponding to a target binding site such as BINDING SITE I, BINDING SITE II or BINDING SITE III of FIG. 8. Table 4 illustrates the complementarity of the nucleotide sequences of KIAA1393 BINDING SITE, designated SEQ ID:6495, to the nucleotide sequence of GAM2071 RNA, herein designated GAM RNA, also designated SEQ ID:371.

Another function of GAM2071 is therefore inhibition of KIAA1393 (Accession XP_050793.2). Accordingly, utilities of GAM2071 include diagnosis, prevention and treatment of diseases and clinical conditions associated with KIAA1393.

KIAA1407 (Accession NP_065868.1) is another GAM2071 target gene, herein designated TARGET GENE. KIAA1407 BINDING SITE is a target binding site found in the 3' untranslated region of mRNA encoded by KIAA1407, corresponding to a target binding site such as BINDING SITE I, BINDING SITE II or BINDING SITE III of FIG. 8. Table 4 illustrates the complementarity of the nucleotide sequences of KIAA1407 BINDING SITE, designated SEQ ID:15873, to the nucleotide sequence of GAM2071 RNA, herein designated GAM RNA, also designated SEQ ID:371.

Another function of GAM2071 is therefore inhibition of KIAA1407 (Accession NP_065868.1). Accordingly, utilities of GAM2071 include diagnosis, prevention and treatment of diseases and clinical conditions associated with KIAA1407.

KIAA1456 (Accession XP_040100.3) is another GAM2071 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:13974, to the nucleotide sequence of GAM2071 RNA, herein designated GAM RNA, also designated SEQ ID:371.

Another function of GAM2071 is therefore inhibition of KIAA1456 (Accession XP_040100.3). Accordingly, utilities of GAM2071 include diagnosis, prevention and treatment of diseases and clinical conditions associated with KIAA1456.

KIAA1465 (Accession XP_027396.4) is another GAM2071 target gene, herein designated TARGET GENE. KIAA1465 BINDING SITE is a target binding site found in the 3' untranslated region of mRNA encoded by KIAA1465, corresponding to a target binding site such as BINDING SITE I, BINDING SITE II or BINDING SITE III of FIG. 8. Table 4 illustrates the complementarity of the nucleotide sequences of KIAA1465 BINDING SITE, designated SEQ ID:13306, to the nucleotide sequence of GAM2071 RNA, herein designated GAM RNA, also designated SEQ ID:371.

Another function of GAM2071 is therefore inhibition of KIAA1465 (Accession XP_027396.4). Accordingly, utilities of GAM2071 include diagnosis, prevention and treatment of diseases and clinical conditions associated with KIAA1465.

KIAA1508 (Accession XP_290952.1) is another GAM2071 target gene, herein designated TARGET GENE. KIAA1508 BINDING SITE is a target binding site found in the 3' untranslated region of mRNA encoded by KIAA1508, corresponding to a target binding site such as BINDING SITE I, BINDING SITE II or BINDING SITE III of FIG. 8. Table 4 illustrates the complementarity of the nucleotide sequences of KIAA1508 BINDING SITE, designated SEQ ID:16911, to the nucleotide sequence of GAM2071 RNA, herein designated GAM RNA, also designated SEQ ID:371.

Another function of GAM2071 is therefore inhibition of KIAA1508 (Accession XP_290952.1). Accordingly, utilities of GAM2071 include diagnosis, prevention and treatment of diseases and clinical conditions associated with KIAA1508.

KIAA1518 (Accession XP_170889.1) is another GAM2071 target gene, herein designated TARGET GENE. KIAA1518 BINDING SITE is a target binding site found in the 3' untranslated region of multiple transcripts of mRNA encoded by KIAA1518, corresponding to a target binding site such as BINDING SITE I, BINDING SITE II or BINDING SITE III of FIG. 8. Table 4 illustrates the complementarity of the nucleotide sequences of KIAA1518 BINDING SITE, designated SEQ ID:17375, to the nucleotide sequence of GAM2071 RNA, herein designated GAM RNA, also designated SEQ ID:371.

Another function of GAM2071 is therefore inhibition of KIAA1518 (Accession XP_170889.1). Accordingly, utilities of GAM2071 include diagnosis, prevention and treatment of diseases and clinical conditions associated with KIAA1518.

KIAA1530 (Accession XP_042661.5) is another GAM2071 target gene, herein designated TARGET GENE. KIAA1530 BINDING SITE1 and KIAA1530 BINDING SITE2 are target binding sites found in untranslated regions of mRNA encoded by KIAA1530, corresponding to target binding sites such as BINDING SITE I, BINDING SITE II or BINDING SITE III of FIG. 8. Table 4 illustrates the complementarity of the nucleotide sequences of KIAA1530 BINDING SITE1 and KIAA1530 BINDING SITE2, designated SEQ ID:12872 and SEQ ID:6360 respectively, to the nucleotide sequence of GAM2071 RNA, herein designated GAM RNA, also designated SEQ ID:371.

Another function of GAM2071 is therefore inhibition of KIAA1530 (Accession XP_042661.5). Accordingly, utilities of GAM2071 include diagnosis, prevention and treatment of diseases and clinical conditions associated with KIAA1530.

KIAA1553 (Accession XP_166320.1) is another GAM2071 target gene, herein designated TARGET GENE. KIAA1553 BINDING SITE is a target binding site found in the 3' untranslated region of mRNA encoded by KIAA1553, corresponding to a target binding site such as BINDING SITE I, BINDING SITE II or BINDING SITE III of FIG. 8. Table 4 illustrates the complementarity of the nucleotide sequences of KIAA1553 BINDING SITE, designated SEQ ID:3650, to the nucleotide sequence of GAM2071 RNA, herein designated GAM RNA, also designated SEQ ID:371.

Another function of GAM2071 is therefore inhibition of KIAA1553 (Accession XP_166320.1). Accordingly, utilities of GAM2071 include diagnosis, prevention and treatment of diseases and clinical conditions associated with KIAA1553.

KIAA1554 (Accession XP_290768.1) is another GAM2071 target gene, herein designated TARGET GENE. KIAA1554 BINDING SITE is a target binding site found in the 3' untranslated region of mRNA encoded by KIAA1554, corresponding to a target binding site such as BINDING SITE I, BINDING SITE II or BINDING SITE III of FIG. 8. Table 4 illustrates the complementarity of the nucleotide sequences of KIAA1554 BINDING SITE, designated SEQ ID:15297, to the nucleotide sequence of GAM2071 RNA, herein designated GAM RNA, also designated SEQ ID:371.

Another function of GAM2071 is therefore inhibition of KIAA1554 (Accession XP_290768.1). Accordingly, utilities of GAM2071 include diagnosis, prevention and treatment of diseases and clinical conditions associated with KIAA1554.

KIAA1559 (Accession XP_054472.2) is another GAM2071 target gene, herein designated TARGET GENE. KIAA1559 BINDING SITE is a target binding site found in the 3' untranslated region of mRNA encoded by KIAA1559, corresponding to a target binding site such as BINDING SITE I, BINDING SITE II or BINDING SITE III of FIG. 8. Table 4 illustrates the complementarity of the nucleotide sequences of KIAA1559 BINDING SITE, designated SEQ ID:14408, to the nucleotide sequence of GAM2071 RNA, herein designated GAM RNA, also designated SEQ ID:371.

Another function of GAM2071 is therefore inhibition of KIAA1559 (Accession XP_054472.2). Accordingly, utilities of GAM2071 include diagnosis, prevention and treatment of diseases and clinical conditions associated with KIAA1559.

KIAA1571 (Accession XP_027744.1) is another GAM2071 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:13037, to the nucleotide sequence of GAM2071 RNA, herein designated GAM RNA, also designated SEQ ID:371.

Another function of GAM2071 is therefore inhibition of KIAA1571 (Accession XP_027744.1). Accordingly, utilities of GAM2071 include diagnosis, prevention and treatment of diseases and clinical conditions associated with KIAA1571.

KIAA1615 (Accession NP_066002.1) is another GAM2071 target gene, herein designated TARGET GENE. KIAA1615 BINDING SITE1 and KIAA1615 BINDING SITE2 are target binding sites found in untranslated regions of mRNA encoded by KIAA1615, corresponding to target binding sites such as BINDING SITE I, BINDING SITE II or BINDING SITE III of FIG. 8. Table 4 illustrates the complementarity of the nucleotide sequences of KIAA1615 BINDING SITE1 and KIAA1615 BINDING SITE2, designated SEQ ID:8578 and SEQ ID:12534 respectively, to the nucleotide sequence of GAM2071 RNA, herein designated GAM RNA, also designated SEQ ID:371.

Another function of GAM2071 is therefore inhibition of KIAA1615 (Accession NP_066002.1). Accordingly, utilities of GAM2071 include diagnosis, prevention and treatment of diseases and clinical conditions associated with KIAA1615.

KIAA1671 (Accession XP_037809.1) is another GAM2071 target gene, herein designated TARGET GENE. KIAA1671 BINDING SITE is a target binding site found in the 3' untranslated region of mRNA encoded by KIAA1671, corresponding to a target binding site such as BINDING SITE I, BINDING SITE II or BINDING SITE III of FIG. 8. Table 4 illustrates the complementarity of the nucleotide sequences of KIAA1671 BINDING SITE, designated SEQ ID:17814, to the nucleotide sequence of GAM2071 RNA, herein designated GAM RNA, also designated SEQ ID:371.

Another function of GAM2071 is therefore inhibition of KIAA1671 (Accession XP_037809.1). Accordingly, utilities of GAM2071 include diagnosis, prevention and treatment of diseases and clinical conditions associated with KIAA1671.

KIAA1727 (Accession XP_034262.4) is another GAM2071 target gene, herein designated TARGET GENE. KIAA1727 BINDING SITE is a target binding site found in the 3' untranslated region of mRNA encoded by KIAA1727, corresponding to a target binding site such as BINDING SITE I, BINDING SITE II or BINDING SITE III of FIG. 8. Table 4 illustrates the complementarity of the nucleotide sequences of KIAA1727 BINDING SITE, designated SEQ ID:14415, to the nucleotide sequence of GAM2071 RNA, herein designated GAM RNA, also designated SEQ ID:371.

Another function of GAM2071 is therefore inhibition of KIAA1727 (Accession XP_034262.4). Accordingly, utilities of GAM2071 include diagnosis, prevention and treatment of diseases and clinical conditions associated with KIAA1727.

KIAA1784 (Accession NP_115820.1) is another GAM2071 target gene, herein designated TARGET GENE. KIAA1784 BINDING SITE is a target binding site found in the 3' untranslated region of mRNA encoded by KIAA1784, corresponding to a target binding site such as BINDING SITE I, BINDING SITE II or BINDING SITE III of FIG. 8. Table 4 illustrates the complementarity of the nucleotide sequences of KIAA1784 BINDING SITE, designated SEQ ID:18884, to the nucleotide sequence of GAM2071 RNA, herein designated GAM RNA, also designated SEQ ID:371.

Another function of GAM2071 is therefore inhibition of KIAA1784 (Accession NP_115820.1). Accordingly, utilities of GAM2071 include diagnosis, prevention and treatment of diseases and clinical conditions associated with KIAA1784.

KIAA1827 (Accession XP_290834.1) is another GAM2071 target gene, herein designated TARGET GENE. KIAA1827 BINDING SITE1 and KIAA1827 BINDING SITE2 are target binding sites found in untranslated regions of mRNA encoded by KIAA1827, corresponding to target binding sites such as BINDING SITE I, BINDING SITE II or BINDING SITE III of FIG. 8. Table 4 illustrates the complementarity of the nucleotide sequences of KIAA1827 BINDING SITE1 and KIAA1827 BINDING SITE2, designated SEQ ID:2385 and SEQ ID:19431 respectively, to the nucleotide sequence of GAM2071 RNA, herein designated GAM RNA, also designated SEQ ID:371.

Another function of GAM2071 is therefore inhibition of KIAA1827 (Accession XP_290834.1). Accordingly, utilities of GAM2071 include diagnosis, prevention and treatment of diseases and clinical conditions associated with KIAA1827.

KIAA1829 (Accession XP_030378.2) is another GAM2071 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:12386, to the nucleotide sequence of GAM2071 RNA, herein designated GAM RNA, also designated SEQ ID:371.

Another function of GAM2071 is therefore inhibition of KIAA1829 (Accession XP_030378.2). Accordingly, utilities of GAM2071 include diagnosis, prevention and treatment of diseases and clinical conditions associated with KIAA1829.

KIAA1836 (Accession XP_114087.2) is another GAM2071 target gene, herein designated TARGET GENE. KIAA1836 BINDING SITE is a target binding site found in the 3' untranslated region of mRNA encoded by KIAA1836, corresponding to a target binding site such as BINDING SITE I, BINDING SITE II or BINDING SITE III of FIG. 8. Table 4 illustrates the complementarity of the nucleotide sequences of KIAA1836 BINDING SITE, designated SEQ ID:17519, to the nucleotide sequence of GAM2071 RNA, herein designated GAM RNA, also designated SEQ ID:371.

Another function of GAM2071 is therefore inhibition of KIAA1836 (Accession XP_114087.2). Accordingly, utilities of GAM2071 include diagnosis, prevention and treatment of diseases and clinical conditions associated with KIAA1836.

KIAA1853 (Accession XP_045184.1) is another GAM2071 target gene, herein designated TARGET GENE. KIAA1853 BINDING SITE is a target binding site found in the 3' untranslated region of mRNA encoded by KIAA1853, corresponding to a target binding site such as BINDING SITE I, BINDING SITE II or BINDING SITE III of FIG. 8. Table 4 illustrates the complementarity of the nucleotide sequences of KIAA1853 BINDING SITE, designated SEQ ID:19842, to the nucleotide sequence of GAM2071 RNA, herein designated GAM RNA, also designated SEQ ID:371.

Another function of GAM2071 is therefore inhibition of KIAA1853 (Accession XP_045184.1). Accordingly, utilities of GAM2071 include diagnosis, prevention and treatment of diseases and clinical conditions associated with KIAA1853.

KIAA1924 (Accession NP_694971.2) is another GAM2071 target gene, herein designated TARGET GENE. KIAA1924 BINDING SITE is a target binding site found in the 3' untranslated region of mRNA encoded by KIAA1924, corresponding to a target binding site such as BINDING SITE I, BINDING SITE II or BINDING SITE III of FIG. 8. Table 4 illustrates the complementarity of the nucleotide sequences of KIAA1924 BINDING SITE, designated SEQ ID:7825, to the nucleotide sequence of GAM2071 RNA, herein designated GAM RNA, also designated SEQ ID:371.

Another function of GAM2071 is therefore inhibition of KIAA1924 (Accession NP_694971.2). Accordingly, utilities of GAM2071 include diagnosis, prevention and treatment of diseases and clinical conditions associated with KIAA1924.

KIAA1951 (Accession XP_057401.1) is another GAM2071 target gene, herein designated TARGET GENE. KIAA1951 BINDING SITE is a target binding site found in the 3' untranslated region of mRNA encoded by KIAA1951, corresponding to a target binding site such as BINDING SITE I, BINDING SITE II or BINDING SITE III of FIG. 8. Table 4 illustrates the complementarity of the nucleotide sequences of KIAA1951 BINDING SITE, designated SEQ ID:12956, to the nucleotide sequence of GAM2071 RNA, herein designated GAM RNA, also designated SEQ ID:371.

Another function of GAM2071 is therefore inhibition of KIAA1951 (Accession XP_057401.1). Accordingly, utilities of GAM2071 include diagnosis, prevention and treatment of diseases and clinical conditions associated with KIAA1951.

KIAA1971 (Accession XP_058720.4) is another GAM2071 target gene, herein designated TARGET GENE. KIAA1971 BINDING SITE is a target binding site found in the 3' untranslated region of mRNA encoded by KIAA1971, corresponding to a target binding site such as BINDING SITE I, BINDING SITE II or BINDING SITE III of FIG. 8. Table 4 illustrates the complementarity of the nucleotide sequences of KIAA1971 BINDING SITE, designated SEQ ID:19552, to the nucleotide sequence of GAM2071 RNA, herein designated GAM RNA, also designated SEQ ID:371.

Another function of GAM2071 is therefore inhibition of KIAA1971 (Accession XP_058720.4). Accordingly, utilities of GAM2071 include diagnosis, prevention and treatment of diseases and clinical conditions associated with KIAA1971.

KIAA1987 (Accession XP_113870.1) is another GAM2071 target gene, herein designated TARGET GENE. KIAA1987 BINDING SITE is a target binding site found in the 5' untranslated region of mRNA encoded by KIAA1987, corresponding to a target binding site such as BINDING SITE I, BINDING SITE II or BINDING SITE III of FIG. 8. Table 4 illustrates the complementarity of the nucleotide sequences of KIAA1987 BINDING SITE, designated SEQ ID:18263, to the nucleotide sequence of GAM2071 RNA, herein designated GAM RNA, also designated SEQ ID:371.

Another function of GAM2071 is therefore inhibition of KIAA1987 (Accession XP_113870.1). Accordingly, utilities of GAM2071 include diagnosis, prevention and treatment of diseases and clinical conditions associated with KIAA1987.

KIAA2028 (Accession XP_059415.2) is another GAM2071 target gene, herein designated TARGET GENE. KIAA2028 BINDING SITE is a target binding site found in the 3' untranslated region of mRNA encoded by KIAA2028, corresponding to a target binding site such as BINDING SITE I, BINDING SITE II or BINDING SITE III of FIG. 8. Table 4 illustrates the complementarity of the nucleotide sequences of KIAA2028 BINDING SITE, designated SEQ ID:11722, to the nucleotide sequence of GAM2071 RNA, herein designated GAM RNA, also designated SEQ ID:371.

Another function of GAM2071 is therefore inhibition of KIAA2028 (Accession XP_059415.2). Accordingly, utilities of GAM2071 include diagnosis, prevention and treatment of diseases and clinical conditions associated with KIAA2028.

Kruppel-like factor 5 (intestinal) (KLF5, Accession NP_001721.2) is another GAM2071 target gene, herein designated TARGET GENE. KLF5 BINDING SITE is a target binding site found in the 3' untranslated region of mRNA encoded by KLF5, corresponding to a target binding site such as BINDING SITE I, BINDING SITE II or BINDING SITE III of FIG. 8. Table 4 illustrates the complementarity of the nucleotide sequences of KLF5 BINDING SITE, designated SEQ ID:17531, to the nucleotide sequence of GAM2071 RNA, herein designated GAM RNA, also designated SEQ ID:371.

Another function of GAM2071 is therefore inhibition of Kruppel-like factor 5 (intestinal) (KLF5, Accession NP_001721.2). Accordingly, utilities of GAM2071 include diagnosis, prevention and treatment of diseases and clinical conditions associated with KLF5.

Kallikrein 10 (KLK10, Accession NP_665895.1) is another GAM2071 target gene, herein designated TARGET GENE. KLK10 BINDING SITE is a target binding site found in the 3' untranslated region of multiple transcripts of mRNA encoded by KLK10, corresponding to a target binding site such as BINDING SITE I, BINDING SITE II or BINDING SITE III of FIG. 8. Table 4 illustrates the complementarity of the nucleotide sequences of KLK10 BINDING SITE, designated SEQ ID:6691, to the nucleotide sequence of GAM2071 RNA, herein designated GAM RNA, also designated SEQ ID:371.

Another function of GAM2071 is therefore inhibition of Kallikrein 10 (KLK10, Accession NP_665895.1), a gene which has a tumor-suppressor role in breast and prostate cancer. Accordingly, utilities of GAM2071 include diagnosis, prevention and treatment of diseases and clinical conditions associated with KLK10.

The function of KLK10 and its association with various diseases and clinical conditions, has been established by previous studies, as described hereinabove with reference to GAM234.1. Kallikrein 10 (KLK10, Accession NP_002767.2) is another GAM2071 target gene, herein designated TARGET GENE. KLK10 BINDING SITE is a target binding site found in the 3' untranslated region of multiple transcripts of mRNA encoded by KLK10, corresponding to a target binding site such as BINDING SITE I, BINDING SITE II or BINDING SITE III of FIG. 8. Table 4 illustrates the complementarity of the nucleotide sequences of KLK10 BINDING SITE, designated SEQ ID:6691, to the nucleotide sequence of GAM2071 RNA, herein designated GAM RNA, also designated SEQ ID:371.

Another function of GAM2071 is therefore inhibition of Kallikrein 10 (KLK10, Accession NP_002767.2), a gene which has a tumor-suppressor role in breast and prostate cancer. Accordingly, utilities of GAM2071 include diagnosis, prevention and treatment of diseases and clinical conditions associated with KLK10.

The function of KLK10 and its association with various diseases and clinical conditions, has been established by previous studies, as described hereinabove with reference to GAM234.1. Kynurenine 3-monooxygenase (kynurenine 3-hydroxylase) (KMO, Accession NP_003670.1) is another GAM2071 target gene, herein designated TARGET GENE. KMO BINDING SITE is a target binding site found in the 3' untranslated region of mRNA encoded by KMO, corresponding to a target binding site such as BINDING SITE I, BINDING SITE II or BINDING SITE III of FIG. 8. Table 4 illustrates the complementarity of the nucleotide sequences of KMO BINDING SITE, designated SEQ ID:5730, to the nucleotide sequence of GAM2071 RNA, herein designated GAM RNA, also designated SEQ ID:371.

Another function of GAM2071 is therefore inhibition of Kynurenine 3-monooxygenase (kynurenine 3-hydroxylase) (KMO, Accession NP_003670.1), a gene which may play a role in encephalic photoreception. Accordingly, utilities of GAM2071 include diagnosis, prevention and treatment of diseases and clinical conditions associated with KMO.

The function of KMO and its association with various diseases and clinical conditions, has been established by previous studies, as described hereinabove with reference to GAM30.1. Kinase suppressor of ras (KSR, Accession XP_290793.1) is another GAM2071 target gene, herein designated TARGET GENE. KSR BINDING SITE is a target binding site found in the 5' untranslated region of mRNA encoded by KSR, corresponding to a target binding site such as BINDING SITE I, BINDING SITE II or BINDING SITE III of FIG. 8. Table 4 illustrates the complementarity of the nucleotide sequences of KSR BINDING SITE, designated SEQ ID:15951, to the nucleotide sequence of GAM2071 RNA, herein designated GAM RNA, also designated SEQ ID:371.

Another function of GAM2071 is therefore inhibition of Kinase suppressor of ras (KSR, Accession XP_290793.1). Accordingly, utilities of GAM2071 include diagnosis, prevention and treatment of diseases and clinical conditions associated with KSR.

Lysosomal-associated membrane protein 3 (LAMP3, Accession NP_055213.1) is another GAM2071 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:970, to the nucleotide sequence of GAM2071 RNA, herein designated GAM RNA, also designated SEQ ID:371.

Another function of GAM2071 is therefore inhibition of Lysosomal-associated membrane protein 3 (LAMP3, Accession NP_055213.1). Accordingly, utilities of GAM2071 include diagnosis, prevention and treatment of diseases and clinical conditions associated with LAMP3.

LANO (Accession NP_060684.1) is another GAM2071 target gene, herein designated TARGET GENE. LANO BINDING SITE is a target binding site found in the 3' untranslated region of multiple transcripts of mRNA encoded by LANO, corresponding to a target binding site such as BINDING SITE I, BINDING SITE II or BINDING SITE III of FIG. 8. Table 4 illustrates the complementarity of the nucleotide sequences of LANO BINDING SITE, designated SEQ ID:4507, to the nucleotide sequence of GAM2071 RNA, herein designated GAM RNA, also designated SEQ ID:371.

Another function of GAM2071 is therefore inhibition of LANO (Accession NP_060684.1). Accordingly, utilities of GAM2071 include diagnosis, prevention and treatment of diseases and clinical conditions associated with LANO.

Lipocalin 7 (LCN7, Accession NP_071447.1) is another GAM2071 target gene, herein designated TARGET GENE. LCN7 BINDING SITE is a target binding site found in the 3' untranslated region of mRNA encoded by LCN7, corresponding to a target binding site such as BINDING SITE I, BINDING SITE II or BINDING SITE III of FIG. 8. Table 4 illustrates the complementarity of the nucleotide sequences of LCN7 BINDING SITE, designated SEQ ID:3972, to the nucleotide sequence of GAM2071 RNA, herein designated GAM RNA, also designated SEQ ID:371.

Another function of GAM2071 is therefore inhibition of Lipocalin 7 (LCN7, Accession NP_071447.1). Accordingly, utilities of GAM2071 include diagnosis, prevention and treatment of diseases and clinical conditions associated with LCN7.

Lymphoid enhancer-binding factor 1 (LEF1, Accession NP_057353.1) is another GAM2071 target gene, herein designated TARGET GENE. LEF1 BINDING SITE is a target binding site found in the 3' untranslated region of mRNA encoded by LEF1, corresponding to a target binding site such as BINDING SITE I, BINDING SITE II or BINDING SITE III of FIG. 8. Table 4 illustrates the complementarity of the nucleotide sequences of LEF1 BINDING SITE, designated SEQ ID:11499, to the nucleotide sequence of GAM2071 RNA, herein designated GAM RNA, also designated SEQ ID:371.

Another function of GAM2071 is therefore inhibition of Lymphoid enhancer-binding factor 1 (LEF1, Accession NP_057353.1), a gene which plays an essential role in the formation of several organs and structures that require inductive tissue interactions. and therefore may be associated with Colon cancer. Accordingly, utilities of GAM2071 include diagnosis, prevention and treatment of Colon cancer, and of other diseases and clinical conditions associated with LEF1.

The function of LEF1 and its association with various diseases and clinical conditions, has been established by previous studies, as described hereinabove with reference to GAM272.1. Lipoma hmgic fusion partner (LHFP, Accession NP_005771.1) is another GAM2071 target gene, herein designated TARGET GENE. LHFP BINDING SITE is a target binding site found in the 3' untranslated region of mRNA encoded by LHFP, corresponding to a target binding site such as BINDING SITE I, BINDING SITE II or BINDING SITE III of FIG. 8. Table 4 illustrates the complementarity of the nucleotide sequences of LHFP BINDING SITE, designated SEQ ID:8128, to the nucleotide sequence of GAM2071 RNA, herein designated GAM RNA, also designated SEQ ID:371.

Another function of GAM2071 is therefore inhibition of Lipoma hmgic fusion partner (LHFP, Accession NP_005771.1). Accordingly, utilities of GAM2071 include diagnosis, prevention and treatment of diseases and clinical conditions associated with LHFP.

LIN-28 (Accession NP_078950.1) is another GAM2071 target gene, herein designated TARGET GENE. LIN-28 BINDING SITE is a target binding site found in the 3' untranslated region of mRNA encoded by LIN-28, corresponding to a target binding site such as BINDING SITE I, BINDING SITE II or BINDING SITE III of FIG. 8. Table 4 illustrates the complementarity of the nucleotide sequences of LIN-28 BINDING SITE, designated SEQ ID:6030, to the nucleotide sequence of GAM2071 RNA, herein designated GAM RNA, also designated SEQ ID:371.

Another function of GAM2071 is therefore inhibition of LIN-28 (Accession NP_078950.1). Accordingly, utilities of GAM2071 include diagnosis, prevention and treatment of diseases and clinical conditions associated with LIN-28.

LNK (Accession NP_005466.1) is another GAM2071 target gene, herein designated TARGET GENE. LNK BINDING SITE is a target binding site found in the 3' untranslated region of mRNA encoded by LNK, corresponding to a target binding site such as BINDING SITE I, BINDING SITE II or BINDING SITE III of FIG. 8. Table 4 illustrates the complementarity of the nucleotide sequences of LNK BINDING SITE, designated SEQ ID:9510, to the nucleotide sequence of GAM2071 RNA, herein designated GAM RNA, also designated SEQ ID:371.

Another function of GAM2071 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM2071 include diagnosis, prevention and treatment of diseases and clinical conditions associated with LNK.

The function of LNK and its association with various diseases and clinical conditions, has been established by previous studies, as described hereinabove with reference to GAM130.1. LOC112687 (Accession XP_053145.1) is another GAM2071 target gene, herein designated TARGET GENE. LOC112687 BINDING SITE is a target binding site found in the 3' untranslated region of mRNA encoded by LOC112687, corresponding to a target binding site such as BINDING SITE I, BINDING SITE II or BINDING SITE III of FIG. 8. Table 4 illustrates the complementarity of the nucleotide sequences of LOC112687 BINDING SITE, designated SEQ ID:4875, to the nucleotide sequence of GAM2071 RNA, herein designated GAM RNA, also designated SEQ ID:371.

Another function of GAM2071 is therefore inhibition of LOC112687 (Accession XP_053145.1). Accordingly, utilities of GAM2071 include diagnosis, prevention and treatment of diseases and clinical conditions associated with LOC112687.

LOC112817 (Accession NP_612422.2) is another GAM2071 target gene, herein designated TARGET GENE. LOC112817 BINDING SITE is a target binding site found in the 3' untranslated region of mRNA encoded by LOC112817, corresponding to a target binding site such as BINDING SITE I, BINDING SITE II or BINDING SITE III of FIG. 8. Table 4 illustrates the complementarity of the nucleotide sequences of LOC112817 BINDING SITE, designated SEQ ID:16516, to the nucleotide sequence of GAM2071 RNA, herein designated GAM RNA, also designated SEQ ID:371.

Another function of GAM2071 is therefore inhibition of LOC112817 (Accession NP_612422.2). Accordingly, utilities of GAM2071 include diagnosis, prevention and treatment of diseases and clinical conditions associated with LOC112817.

LOC113444 (Accession NP_612437.2) is another GAM2071 target gene, herein designated TARGET GENE. LOC113444 BINDING SITE1 through LOC113444 BINDING SITE3 are target binding sites found in untranslated regions of mRNA encoded by LOC113444, corresponding to target binding sites such as BINDING SITE I, BINDING SITE II or BINDING SITE III of FIG. 8. Table 4 illustrates the complementarity of the nucleotide sequences of LOC113444 BINDING SITE1 through LOC113444 BINDING SITE3, designated SEQ ID:15369, SEQ ID:15847 and SEQ ID:14262 respectively, to the nucleotide sequence of GAM2071 RNA, herein designated GAM RNA, also designated SEQ ID:371.

Another function of GAM2071 is therefore inhibition of LOC113444 (Accession NP_612437.2). Accordingly, utilities of GAM2071 include diagnosis, prevention and treatment of diseases and clinical conditions associated with LOC113444.

LOC115648 (Accession NP_663299.1) is another GAM2071 target gene, herein designated TARGET GENE. LOC115648 BINDING SITE is a target binding site found in the 3' untranslated region of mRNA encoded by LOC115648, corresponding to a target binding site such as BINDING SITE I, BINDING SITE II or BINDING SITE III of FIG. 8. Table 4 illustrates the complementarity of the nucleotide sequences of LOC115648 BINDING SITE, designated SEQ ID:6386, to the nucleotide sequence of GAM2071 RNA, herein designated GAM RNA, also designated SEQ ID:371.

Another function of GAM2071 is therefore inhibition of LOC115648 (Accession NP_663299.1). Accordingly, utilities of GAM2071 include diagnosis, prevention and treatment of diseases and clinical conditions associated with LOC115648.

LOC116411 (Accession XP_058095.1) is another GAM2071 target gene, herein designated TARGET GENE. LOC116411 BINDING SITE1 and LOC116411 BINDING SITE2 are target binding sites found in untranslated regions of mRNA encoded by LOC116411, corresponding to target binding sites such as BINDING SITE I, BINDING SITE II or BINDING SITE III of FIG. 8. Table 4 illustrates the complementarity of the nucleotide sequences of LOC116411 BINDING SITE1 and LOC116411 BINDING SITE2, designated SEQ ID:1487 and SEQ ID:13193 respectively, to the nucleotide sequence of GAM2071 RNA, herein designated GAM RNA, also designated SEQ ID:371.

Another function of GAM2071 is therefore inhibition of LOC116411 (Accession XP_058095.1). Accordingly, utilities of GAM2071 include diagnosis, prevention and treatment of diseases and clinical conditions associated with LOC116411.

LOC118490 (Accession XP_060981.3) is another GAM2071 target gene, herein designated TARGET GENE. LOC118490 BINDING SITE is a target binding site found in the 3' untranslated region of mRNA encoded by LOC118490, corresponding to a target binding site such as BINDING SITE I, BINDING SITE II or BINDING SITE III of FIG. 8. Table 4 illustrates the complementarity of the nucleotide sequences of LOC118490 BINDING SITE, designated SEQ ID:11022, to the nucleotide sequence of GAM2071 RNA, herein designated GAM RNA, also designated SEQ ID:371.

Another function of GAM2071 is therefore inhibition of LOC118490 (Accession XP_060981.3). Accordingly, utilities of GAM2071 include diagnosis, prevention and treatment of diseases and clinical conditions associated with LOC118490.

LOC118812 (Accession XP_058346.2) is another GAM2071 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:7879, to the nucleotide sequence of GAM2071 RNA, herein designated GAM RNA, also designated SEQ ID:371.

Another function of GAM2071 is therefore inhibition of LOC118812 (Accession XP_058346.2). Accordingly, utilities of GAM2071 include diagnosis, prevention and treatment of diseases and clinical conditions associated with LOC118812.

LOC118812 (Accession NP_849154.1) is another GAM2071 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:7879, to the nucleotide sequence of GAM2071 RNA, herein designated GAM RNA, also designated SEQ ID:371.

Another function of GAM2071 is therefore inhibition of LOC118812 (Accession NP_849154.1). Accordingly, utilities of GAM2071 include diagnosis, prevention and treatment of diseases and clinical conditions associated with LOC118812.

LOC120526 (Accession XP_058475.1) is another GAM2071 target gene, herein designated TARGET GENE. LOC120526 BINDING SITE is a target binding site found in the 3' untranslated region of mRNA encoded by LOC120526, corresponding to a target binding site such as BINDING SITE I, BINDING SITE II or BINDING SITE III of FIG. 8. Table 4 illustrates the complementarity of the nucleotide sequences of LOC120526 BINDING SITE, designated SEQ ID:14215, to the nucleotide sequence of GAM2071 RNA, herein designated GAM RNA, also designated SEQ ID:371.

Another function of GAM2071 is therefore inhibition of LOC120526 (Accession XP_058475.1). Accordingly, utilities of GAM2071 include diagnosis, prevention and treatment of diseases and clinical conditions associated with LOC120526.

LOC121498 (Accession XP_062669.7) is another GAM2071 target gene, herein designated TARGET GENE. LOC121498 BINDING SITE is a target binding site found in the 3' untranslated region of mRNA encoded by LOC121498, corresponding to a target binding site such as BINDING SITE I, BINDING SITE II or BINDING SITE III of FIG. 8. Table 4 illustrates the complementarity of the nucleotide sequences of LOC121498 BINDING SITE, designated SEQ ID:1850, to the nucleotide sequence of GAM2071 RNA, herein designated GAM RNA, also designated SEQ ID:371.

Another function of GAM2071 is therefore inhibition of LOC121498 (Accession XP_062669.7). Accordingly, utilities of GAM2071 include diagnosis, prevention and treatment of diseases and clinical conditions associated with LOC121498.

LOC121952 (Accession XP_062872.2) is another GAM2071 target gene, herein designated TARGET GENE. LOC121952 BINDING SITE is a target binding site found in the 5' untranslated region of mRNA encoded by LOC121952, corresponding to a target binding site such as BINDING SITE I, BINDING SITE II or BINDING SITE III of FIG. 8. Table 4 illustrates the complementarity of the nucleotide sequences of LOC121952 BINDING SITE, designated SEQ ID:17591, to the nucleotide sequence of GAM2071 RNA, herein designated GAM RNA, also designated SEQ ID:371.

Another function of GAM2071 is therefore inhibition of LOC121952 (Accession XP_062872.2). Accordingly, utilities of GAM2071 include diagnosis, prevention and treatment of diseases and clinical conditions associated with LOC121952.

LOC125061 (Accession XP_058889.3) is another GAM2071 target gene, herein designated TARGET GENE. LOC125061 BINDING SITE is a target binding site found in the 3' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:9098, to the nucleotide sequence of GAM2071 RNA, herein designated GAM RNA, also designated SEQ ID:371.

Another function of GAM2071 is therefore inhibition of LOC125061 (Accession XP_058889.3). Accordingly, utilities of GAM2071 include diagnosis, prevention and treatment of diseases and clinical conditions associated with LOC125061.

LOC127602 (Accession XP_059166.1) is another GAM2071 target gene, herein designated TARGET GENE. LOC127602 BINDING SITE is a target binding site found in the 3' untranslated region of mRNA encoded by LOC127602, corresponding to a target binding site such as BINDING SITE I, BINDING SITE II or BINDING SITE III of FIG. 8. Table 4 illustrates the complementarity of the nucleotide sequences of LOC127602 BINDING SITE, designated SEQ ID:14354, to the nucleotide sequence of GAM2071 RNA, herein designated GAM RNA, also designated SEQ ID:371.

Another function of GAM2071 is therefore inhibition of LOC127602 (Accession XP_059166.1). Accordingly, utilities of GAM2071 include diagnosis, prevention and treatment of diseases and clinical conditions associated with LOC127602.

LOC130813 (Accession XP_065904.1) is another GAM2071 target gene, herein designated TARGET GENE. LOC130813 BINDING SITE is a target binding site found in the 3' untranslated region of mRNA encoded by LOC130813, corresponding to a target binding site such as BINDING SITE I, BINDING SITE II or BINDING SITE III of FIG. 8. Table 4 illustrates the complementarity of the nucleotide sequences of LOC130813 BINDING SITE, designated SEQ ID:16452, to the nucleotide sequence of GAM2071 RNA, herein designated GAM RNA, also designated SEQ ID:371.

Another function of GAM2071 is therefore inhibition of LOC130813 (Accession XP_065904.1). Accordingly, utilities of GAM2071 include diagnosis, prevention and treatment of diseases and clinical conditions associated with LOC130813.

LOC131963 (Accession XP_067689.1) is another GAM2071 target gene, herein designated TARGET GENE. LOC131963 BINDING SITE is a target binding site found in the 3' untranslated region of mRNA encoded by LOC131963, corresponding to a target binding site such as BINDING SITE I, BINDING SITE II or BINDING SITE III of FIG. 8. Table 4 illustrates the complementarity of the nucleotide sequences of LOC131963 BINDING SITE, designated SEQ ID:5289, to the nucleotide sequence of GAM2071 RNA, herein designated GAM RNA, also designated SEQ ID:371.

Another function of GAM2071 is therefore inhibition of LOC131963 (Accession XP_067689.1). Accordingly, utilities of GAM2071 include diagnosis, prevention and treatment of diseases and clinical conditions associated with LOC131963.

LOC132241 (Accession XP_059583.1) is another GAM2071 target gene, herein designated TARGET GENE. LOC132241 BINDING SITE is a target binding site found in the 5' untranslated region of mRNA encoded by LOC132241, corresponding to a target binding site such as BINDING SITE I, BINDING SITE II or BINDING SITE III of FIG. 8. Table 4 illustrates the complementarity of the nucleotide sequences of LOC132241 BINDING SITE, designated SEQ ID:13281, to the nucleotide sequence of GAM2071 RNA, herein designated GAM RNA, also designated SEQ ID:371.

Another function of GAM2071 is therefore inhibition of LOC132241 (Accession XP_059583.1). Accordingly, utilities of GAM2071 include diagnosis, prevention and treatment of diseases and clinical conditions associated with LOC132241.

LOC134466 (Accession XP_068858.3) is another GAM2071 target gene, herein designated TARGET GENE. LOC134466 BINDING SITE is a target binding site found in the 5' untranslated region of mRNA encoded by LOC134466, corresponding to a target binding site such as BINDING SITE I, BINDING SITE II or BINDING SITE III of FIG. 8. Table 4 illustrates the complementarity of the nucleotide sequences of LOC134466 BINDING SITE, designated SEQ ID:11536, to the nucleotide sequence of GAM2071 RNA, herein designated GAM RNA, also designated SEQ ID:371.

Another function of GAM2071 is therefore inhibition of LOC134466 (Accession XP_068858.3). Accordingly, utilities of GAM2071 include diagnosis, prevention and treatment of diseases and clinical conditions associated with LOC134466.

LOC135293 (Accession XP_072402.4) is another GAM2071 target gene, herein designated TARGET GENE. LOC135293 BINDING SITE is a target binding site found in the 3' untranslated region of mRNA encoded by LOC135293, corresponding to a target binding site such as BINDING SITE I, BINDING SITE II or BINDING SITE III of FIG. 8. Table 4 illustrates the complementarity of the nucleotide sequences of LOC135293 BINDING SITE, designated SEQ ID:11660, to the nucleotide sequence of GAM2071 RNA, herein designated GAM RNA, also designated SEQ ID:371.

Another function of GAM2071 is therefore inhibition of LOC135293 (Accession XP_072402.4). Accordingly, utilities of GAM2071 include diagnosis, prevention and treatment of diseases and clinical conditions associated with LOC135293.

LOC135763 (Accession NP_612639.1) is another GAM2071 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:14442, to the nucleotide sequence of GAM2071 RNA, herein designated GAM RNA, also designated SEQ ID:371.

Another function of GAM2071 is therefore inhibition of LOC135763 (Accession NP_612639.1). Accordingly, utilities of GAM2071 include diagnosis, prevention and treatment of diseases and clinical conditions associated with LOC135763.

LOC139422 (Accession XP_066687.2) is another GAM2071 target gene, herein designated TARGET GENE. LOC139422 BINDING SITE is a target binding site found in the 5' untranslated region of mRNA encoded by LOC139422, corresponding to a target binding site such as BINDING SITE I, BINDING SITE II or BINDING SITE III of FIG. 8. Table 4 illustrates the complementarity of the nucleotide sequences of LOC139422 BINDING SITE, designated SEQ ID:17958, to the nucleotide sequence of GAM2071 RNA, herein designated GAM RNA, also designated SEQ ID:371.

Another function of GAM2071 is therefore inhibition of LOC139422 (Accession XP_066687.2). Accordingly, utilities of GAM2071 include diagnosis, prevention and treatment of diseases and clinical conditions associated with LOC139422.

LOC144248 (Accession XP_084786.1) is another GAM2071 target gene, herein designated TARGET GENE. LOC144248 BINDING SITE is a target binding site found in the 5' untranslated region of mRNA encoded by LOC144248, corresponding to a target binding site such as BINDING SITE I, BINDING SITE II or BINDING SITE III of FIG. 8. Table 4 illustrates the complementarity of the nucleotide sequences of LOC144248 BINDING SITE, designated SEQ ID:11361, to the nucleotide sequence of GAM2071 RNA, herein designated GAM RNA, also designated SEQ ID:371.

Another function of GAM2071 is therefore inhibition of LOC144248 (Accession XP_084786.1). Accordingly, utilities of GAM2071 include diagnosis, prevention and treatment of diseases and clinical conditions associated with LOC144248.

LOC144404 (Accession XP_084852.6) is another GAM2071 target gene, herein designated TARGET GENE. LOC144404 BINDING SITE1 and LOC144404 BINDING SITE2 are target binding sites found in untranslated regions of mRNA encoded by LOC144404, corresponding to target binding sites such as BINDING SITE I, BINDING SITE II or BINDING SITE III of FIG. 8. Table 4 illustrates the complementarity of the nucleotide sequences of LOC144404 BINDING SITE1 and LOC144404 BINDING SITE2, designated SEQ ID:8561 and SEQ ID:11669 respectively, to the nucleotide sequence of GAM2071 RNA, herein designated GAM RNA, also designated SEQ ID:371.

Another function of GAM2071 is therefore inhibition of LOC144404 (Accession XP_084852.6). Accordingly, utilities of GAM2071 include diagnosis, prevention and treatment of diseases and clinical conditions associated with LOC144404.

LOC144481 (Accession XP_096611.2) is another GAM2071 target gene, herein designated TARGET GENE. LOC144481 BINDING SITE is a target binding site found in the 3' untranslated region of mRNA encoded by LOC144481, corresponding to a target binding site such as BINDING SITE I, BINDING SITE II or BINDING SITE III of FIG. 8. Table 4 illustrates the complementarity of the nucleotide sequences of LOC144481 BINDING SITE, designated SEQ ID:17022, to the nucleotide sequence of GAM2071 RNA, herein designated GAM RNA, also designated SEQ ID:371.

Another function of GAM2071 is therefore inhibition of LOC144481 (Accession XP_096611.2). Accordingly, utilities of GAM2071 include diagnosis, prevention and treatment of diseases and clinical conditions associated with LOC144481.

LOC144766 (Accession XP_084963.2) is another GAM2071 target gene, herein designated TARGET GENE. LOC144766 BINDING SITE is a target binding site found in the 5' untranslated region of mRNA encoded by LOC144766, corresponding to a target binding site such as BINDING SITE I, BINDING SITE II or BINDING SITE III of FIG. 8. Table 4 illustrates the complementarity of the nucleotide sequences of LOC144766 BINDING SITE, designated SEQ ID:19847, to the nucleotide sequence of GAM2071 RNA, herein designated GAM RNA, also designated SEQ ID:371.

Another function of GAM2071 is therefore inhibition of LOC144766 (Accession XP_084963.2). Accordingly, utilities of GAM2071 include diagnosis, prevention and treatment of diseases and clinical conditions associated with LOC144766.

LOC144817 (Accession XP_084972.1) is another GAM2071 target gene, herein designated TARGET GENE. LOC144817 BINDING SITE is a target binding site found in the 5' untranslated region of mRNA encoded by LOC144817, corresponding to a target binding site such as BINDING SITE I, BINDING SITE II or BINDING SITE III of FIG. 8. Table 4 illustrates the complementarity of the nucleotide sequences of LOC144817 BINDING SITE, designated SEQ ID:12382, to the nucleotide sequence of GAM2071 RNA, herein designated GAM RNA, also designated SEQ ID:371.

Another function of GAM2071 is therefore inhibition of LOC144817 (Accession XP_084972.1). Accordingly, utilities of GAM2071 include diagnosis, prevention and treatment of diseases and clinical conditions associated with LOC144817.

LOC144871 (Accession XP_096698.1) is another GAM2071 target gene, herein designated TARGET GENE. LOC144871 BINDING SITE is a target binding site found in the 3' untranslated region of mRNA encoded by LOC144871, corresponding to a target binding site such as BINDING SITE I, BINDING SITE II or BINDING SITE III of FIG. 8. Table 4 illustrates the complementarity of the nucleotide sequences of LOC144871 BINDING SITE, designated SEQ ID:10644, to the nucleotide sequence of GAM2071 RNA, herein designated GAM RNA, also designated SEQ ID:371.

Another function of GAM2071 is therefore inhibition of LOC144871 (Accession XP_096698.1). Accordingly, utilities of GAM2071 include diagnosis, prevention and treatment of diseases and clinical conditions associated with LOC144871.

LOC145453 (Accession XP_085120.1) is another GAM2071 target gene, herein designated TARGET GENE. LOC145453 BINDING SITE is a target binding site found in the 5' untranslated region of mRNA encoded by LOC145453, corresponding to a target binding site such as BINDING SITE I, BINDING SITE II or BINDING SITE III of FIG. 8. Table 4 illustrates the complementarity of the nucleotide sequences of LOC145453 BINDING SITE, designated SEQ ID:8486, to the nucleotide sequence of GAM2071 RNA, herein designated GAM RNA, also designated SEQ ID:371.

Another function of GAM2071 is therefore inhibition of LOC145453 (Accession XP_085120.1). Accordingly, utilities of GAM2071 include diagnosis, prevention and treatment of diseases and clinical conditions associated with LOC145453.

LOC145676 (Accession XP_085202.1) is another GAM2071 target gene, herein designated TARGET GENE. LOC145676 BINDING SITE is a target binding site found in the 5' untranslated region of mRNA encoded by LOC145676, corresponding to a target binding site such as BINDING SITE I, BINDING SITE II or BINDING SITE III of FIG. 8. Table 4 illustrates the complementarity of the nucleotide sequences of LOC145676 BINDING SITE, designated SEQ ID:2964, to the nucleotide sequence of GAM2071 RNA, herein designated GAM RNA, also designated SEQ ID:371.

Another function of GAM2071 is therefore inhibition of LOC145676 (Accession XP_085202.1). Accordingly, utilities of GAM2071 include diagnosis, prevention and treatment of diseases and clinical conditions associated with LOC145676.

LOC145757 (Accession XP_085227.1) is another GAM2071 target gene, herein designated TARGET GENE. LOC145757 BINDING SITE1 and LOC145757 BINDING SITE2 are target binding sites found in untranslated regions of mRNA encoded by LOC145757, corresponding to target binding sites such as BINDING SITE I, BINDING SITE II or BINDING SITE III of FIG. 8. Table 4 illustrates the complementarity of the nucleotide sequences of LOC145757 BINDING SITE1 and LOC145757 BINDING SITE2, designated SEQ ID:13797 and SEQ ID:3109 respectively, to the nucleotide sequence of GAM2071 RNA, herein designated GAM RNA, also designated SEQ ID:371.

Another function of GAM2071 is therefore inhibition of LOC145757 (Accession XP_085227.1). Accordingly, utilities of GAM2071 include diagnosis, prevention and treatment of diseases and clinical conditions associated with LOC145757.

LOC145783 (Accession XP_085231.2) is another GAM2071 target gene, herein designated TARGET GENE. LOC145783 BINDING SITE is a target binding site found in the 5' untranslated region of mRNA encoded by LOC145783, corresponding to a target binding site such as BINDING SITE I, BINDING SITE II or BINDING SITE III of FIG. 8. Table 4 illustrates the complementarity of the nucleotide sequences of LOC145783 BINDING SITE, designated SEQ ID:6743, to the nucleotide sequence of GAM2071 RNA, herein designated GAM RNA, also designated SEQ ID:371.

Another function of GAM2071 is therefore inhibition of LOC145783 (Accession XP_085231.2). Accordingly, utilities of GAM2071 include diagnosis, prevention and treatment of diseases and clinical conditions associated with LOC145783.

LOC145813 (Accession XP_096873.1) is another GAM2071 target gene, herein designated TARGET GENE. LOC145813 BINDING SITE is a target binding site found in the 5' untranslated region of mRNA encoded by LOC145813, corresponding to a target binding site such as BINDING SITE I, BINDING SITE II or BINDING SITE III of FIG. 8. Table 4 illustrates the complementarity of the nucleotide sequences of LOC145813 BINDING SITE, designated SEQ ID:987, to the nucleotide sequence of GAM2071 RNA, herein designated GAM RNA, also designated SEQ ID:371.

Another function of GAM2071 is therefore inhibition of LOC145813 (Accession XP_096873.1). Accordingly, utilities of GAM2071 include diagnosis, prevention and treatment of diseases and clinical conditions associated with LOC145813.

LOC145988 (Accession XP_085290.3) is another GAM2071 target gene, herein designated TARGET GENE. LOC145988 BINDING SITE is a target binding site found in the 5' untranslated region of mRNA encoded by LOC145988, corresponding to a target binding site such as BINDING SITE I, BINDING SITE II or BINDING SITE III of FIG. 8. Table 4 illustrates the complementarity of the nucleotide sequences of LOC145988 BINDING SITE, designated SEQ ID:1945, to the nucleotide sequence of GAM2071 RNA, herein designated GAM RNA, also designated SEQ ID:371.

Another function of GAM2071 is therefore inhibition of LOC145988 (Accession XP_085290.3). Accordingly, utilities of GAM2071 include diagnosis, prevention and treatment of diseases and clinical conditions associated with LOC145988.

LOC146177 (Accession NP_778229.1) is another GAM2071 target gene, herein designated TARGET GENE. LOC146177 BINDING SITE is a target binding site found in the 5' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:15157, to the nucleotide sequence of GAM2071 RNA, herein designated GAM RNA, also designated SEQ ID:371.

Another function of GAM2071 is therefore inhibition of LOC146177 (Accession NP_778229.1). Accordingly, utilities of GAM2071 include diagnosis, prevention and treatment of diseases and clinical conditions associated with LOC146177.

LOC146229 (Accession XP_085387.1) is another GAM2071 target gene, herein designated TARGET GENE. LOC146229 BINDING SITE1 and LOC146229 BINDING SITE2 are target binding sites found in untranslated regions of mRNA encoded by LOC146229, corresponding to target binding sites such as BINDING SITE I, BINDING SITE II or BINDING SITE III of FIG. 8. Table 4 illustrates the complementarity of the nucleotide sequences of LOC146229 BINDING SITE1 and LOC146229 BINDING SITE2, designated SEQ ID:3109 and SEQ ID:8345 respectively, to the nucleotide sequence of GAM2071 RNA, herein designated GAM RNA, also designated SEQ ID:371.

Another function of GAM2071 is therefore inhibition of LOC146229 (Accession XP_085387.1). Accordingly, utilities of GAM2071 include diagnosis, prevention and treatment of diseases and clinical conditions associated with LOC146229.

LOC146336 (Accession XP_085421.2) is another GAM2071 target gene, herein designated TARGET GENE. LOC146336 BINDING SITE is a target binding site found in the 3' untranslated region of mRNA encoded by LOC146336, corresponding to a target binding site such as BINDING SITE I, BINDING SITE II or BINDING SITE III of FIG. 8. Table 4 illustrates the complementarity of the nucleotide sequences of LOC146336 BINDING SITE, designated SEQ ID:4132, to the nucleotide sequence of GAM2071 RNA, herein designated GAM RNA, also designated SEQ ID:371.

Another function of GAM2071 is therefore inhibition of LOC146336 (Accession XP_085421.2). Accordingly, utilities of GAM2071 include diagnosis, prevention and treatment of diseases and clinical conditions associated with LOC146336.

LOC146346 (Accession XP_085430.1) is another GAM2071 target gene, herein designated TARGET GENE.

LOC146346 BINDING SITE1 and LOC146346 BINDING SITE2 are target binding sites found in untranslated regions of mRNA encoded by LOC146346, corresponding to target binding sites such as BINDING SITE I, BINDING SITE II or BINDING SITE III of FIG. 8. Table 4 illustrates the complementarity of the nucleotide sequences of LOC146346 BINDING SITE1 and LOC146346 BINDING SITE2, designated SEQ ID:16312 and SEQ ID:6781 respectively, to the nucleotide sequence of GAM2071 RNA, herein designated GAM RNA, also designated SEQ ID:371.

Another function of GAM2071 is therefore inhibition of LOC146346 (Accession XP_085430.1). Accordingly, utilities of GAM2071 include diagnosis, prevention and treatment of diseases and clinical conditions associated with LOC146346.

LOC146429 (Accession XP_096998.2) is another GAM2071 target gene, herein designated TARGET GENE. LOC146429 BINDING SITE is a target binding site found in the 5' untranslated region of mRNA encoded by LOC146429, corresponding to a target binding site such as BINDING SITE I, BINDING SITE II or BINDING SITE III of FIG. 8. Table 4 illustrates the complementarity of the nucleotide sequences of LOC146429 BINDING SITE, designated SEQ ID:8579, to the nucleotide sequence of GAM2071 RNA, herein designated GAM RNA, also designated SEQ ID:371.

Another function of GAM2071 is therefore inhibition of LOC146429 (Accession XP_096998.2). Accordingly, utilities of GAM2071 include diagnosis, prevention and treatment of diseases and clinical conditions associated with LOC146429.

LOC146443 (Accession XP_085461.6) is another GAM2071 target gene, herein designated TARGET GENE. LOC146443 BINDING SITE is a target binding site found in the 5' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:5238, to the nucleotide sequence of GAM2071 RNA, herein designated GAM RNA, also designated SEQ ID:371.

Another function of GAM2071 is therefore inhibition of LOC146443 (Accession XP_085461.6). Accordingly, utilities of GAM2071 include diagnosis, prevention and treatment of diseases and clinical conditions associated with LOC146443.

LOC146603 (Accession XP_085514.2) is another GAM2071 target gene, herein designated TARGET GENE. LOC146603 BINDING SITE is a target binding site found in the 5' untranslated region of mRNA encoded by LOC146603, corresponding to a target binding site such as BINDING SITE I, BINDING SITE II or BINDING SITE III of FIG. 8. Table 4 illustrates the complementarity of the nucleotide sequences of LOC146603 BINDING SITE, designated SEQ ID:3109, to the nucleotide sequence of GAM2071 RNA, herein designated GAM RNA, also designated SEQ ID:371.

Another function of GAM2071 is therefore inhibition of LOC146603 (Accession XP_085514.2). Accordingly, utilities of GAM2071 include diagnosis, prevention and treatment of diseases and clinical conditions associated with LOC146603.

LOC146784 (Accession XP_085588.1) is another GAM2071 target gene, herein designated TARGET GENE. LOC146784 BINDING SITE is a target binding site found in the 5' untranslated region of mRNA encoded by LOC146784, corresponding to a target binding site such as BINDING SITE I, BINDING SITE II or BINDING SITE III of FIG. 8. Table 4 illustrates the complementarity of the nucleotide sequences of LOC146784 BINDING SITE, designated SEQ ID:13452, to the nucleotide sequence of GAM2071 RNA, herein designated GAM RNA, also designated SEQ ID:371.

Another function of GAM2071 is therefore inhibition of LOC146784 (Accession XP_085588.1). Accordingly, utilities of GAM2071 include diagnosis, prevention and treatment of diseases and clinical conditions associated with LOC146784.

LOC146839 (Accession XP_097107.1) is another GAM2071 target gene, herein designated TARGET GENE. LOC146839 BINDING SITE is a target binding site found in the 3' untranslated region of mRNA encoded by LOC146839, corresponding to a target binding site such as BINDING SITE I, BINDING SITE II or BINDING SITE III of FIG. 8. Table 4 illustrates the complementarity of the nucleotide sequences of LOC146839 BINDING SITE, designated SEQ ID:11661, to the nucleotide sequence of GAM2071 RNA, herein designated GAM RNA, also designated SEQ ID:371.

Another function of GAM2071 is therefore inhibition of LOC146839 (Accession XP_097107.1). Accordingly, utilities of GAM2071 include diagnosis, prevention and treatment of diseases and clinical conditions associated with LOC146839.

LOC146894 (Accession NP_660316.1) is another GAM2071 target gene, herein designated TARGET GENE. LOC146894 BINDING SITE is a target binding site found in the 3' untranslated region of mRNA encoded by LOC146894, corresponding to a target binding site such as BINDING SITE I, BINDING SITE II or BINDING SITE III of FIG. 8. Table 4 illustrates the complementarity of the nucleotide sequences of LOC146894 BINDING SITE, designated SEQ ID:2386, to the nucleotide sequence of GAM2071 RNA, herein designated GAM RNA, also designated SEQ ID:371.

Another function of GAM2071 is therefore inhibition of LOC146894 (Accession NP_660316.1). Accordingly, utilities of GAM2071 include diagnosis, prevention and treatment of diseases and clinical conditions associated with LOC146894.

LOC146895 (Accession XP_097120.1) is another GAM2071 target gene, herein designated TARGET GENE. LOC146895 BINDING SITE is a target binding site found in the 5' untranslated region of mRNA encoded by LOC146895, corresponding to a target binding site such as BINDING SITE I, BINDING SITE II or BINDING SITE III of FIG. 8. Table 4 illustrates the complementarity of the nucleotide sequences of LOC146895 BINDING SITE, designated SEQ ID:8862, to the nucleotide sequence of GAM2071 RNA, herein designated GAM RNA, also designated SEQ ID:371.

Another function of GAM2071 is therefore inhibition of LOC146895 (Accession XP_097120.1). Accordingly, utilities of GAM2071 include diagnosis, prevention and treatment of diseases and clinical conditions associated with LOC146895.

LOC146901 (Accession XP_097121.1) is another GAM2071 target gene, herein designated TARGET GENE. LOC146901 BINDING SITE is a target binding site found in the 3' untranslated region of mRNA encoded by LOC146901, corresponding to a target binding site such as BINDING SITE I, BINDING SITE II or BINDING SITE III of FIG. 8. Table 4 illustrates the complementarity of the nucleotide sequences of LOC146901 BINDING SITE, designated SEQ ID:12152, to the nucleotide sequence of GAM2071 RNA, herein designated GAM RNA, also designated SEQ ID:371.

Another function of GAM2071 is therefore inhibition of LOC146901 (Accession XP_097121.1). Accordingly, utilities of GAM2071 include diagnosis, prevention and treatment of diseases and clinical conditions associated with LOC146901.

LOC146909 (Accession XP_085634.2) is another GAM2071 target gene, herein designated TARGET GENE. LOC146909 BINDING SITE1 and LOC146909 BINDING SITE2 are target binding sites found in untranslated regions of mRNA encoded by LOC146909, corresponding to target binding sites such as BINDING SITE I, BINDING SITE II or BINDING SITE III of FIG. 8. Table 4 illustrates the complementarity of the nucleotide sequences of LOC146909 BINDING SITE1 and LOC146909 BINDING SITE2, designated SEQ ID:14280 and SEQ ID:20010 respectively, to the nucleotide sequence of GAM2071 RNA, herein designated GAM RNA, also designated SEQ ID:371.

Another function of GAM2071 is therefore inhibition of LOC146909 (Accession XP_085634.2). Accordingly, utilities of GAM2071 include diagnosis, prevention and treatment of diseases and clinical conditions associated with LOC146909.

LOC147080 (Accession XP_097182.1) is another GAM2071 target gene, herein designated TARGET GENE. LOC147080 BINDING SITE is a target binding site found in the 5' untranslated region of mRNA encoded by LOC147080, corresponding to a target binding site such as BINDING SITE I, BINDING SITE II or BINDING SITE III of FIG. 8. Table 4 illustrates the complementarity of the nucleotide sequences of LOC147080 BINDING SITE, designated SEQ ID:18093, to the nucleotide sequence of GAM2071 RNA, herein designated GAM RNA, also designated SEQ ID:371.

Another function of GAM2071 is therefore inhibition of LOC147080 (Accession XP_097182.1). Accordingly, utilities of GAM2071 include diagnosis, prevention and treatment of diseases and clinical conditions associated with LOC147080.

LOC147166 (Accession XP_085722.2) is another GAM2071 target gene, herein designated TARGET GENE. LOC147166 BINDING SITE is a target binding site found in the 3' untranslated region of mRNA encoded by LOC147166, corresponding to a target binding site such as BINDING SITE I, BINDING SITE II or BINDING SITE III of FIG. 8. Table 4 illustrates the complementarity of the nucleotide sequences of LOC147166 BINDING SITE, designated SEQ ID:546, to the nucleotide sequence of GAM2071 RNA, herein designated GAM RNA, also designated SEQ ID:371.

Another function of GAM2071 is therefore inhibition of LOC147166 (Accession XP_085722.2). Accordingly, utilities of GAM2071 include diagnosis, prevention and treatment of diseases and clinical conditions associated with LOC147166.

LOC147343 (Accession XP_097225.1) is another GAM2071 target gene, herein designated TARGET GENE. LOC147343 BINDING SITE is a target binding site found in the 5' untranslated region of mRNA encoded by LOC147343, corresponding to a target binding site such as BINDING SITE I, BINDING SITE II or BINDING SITE III of FIG. 8. Table 4 illustrates the complementarity of the nucleotide sequences of LOC147343 BINDING SITE, designated SEQ ID:14957, to the nucleotide sequence of GAM2071 RNA, herein designated GAM RNA, also designated SEQ ID:371.

Another function of GAM2071 is therefore inhibition of LOC147343 (Accession XP_097225.1). Accordingly, utilities of GAM2071 include diagnosis, prevention and treatment of diseases and clinical conditions associated with LOC147343.

LOC147407 (Accession XP_084000.1) is another GAM2071 target gene, herein designated TARGET GENE. LOC147407 BINDING SITE is a target binding site found in the 3' untranslated region of mRNA encoded by LOC147407, corresponding to a target binding site such as BINDING SITE I, BINDING SITE II or BINDING SITE III of FIG. 8. Table 4 illustrates the complementarity of the nucleotide sequences of LOC147407 BINDING SITE, designated SEQ ID:12382, to the nucleotide sequence of GAM2071 RNA, herein designated GAM RNA, also designated SEQ ID:371.

Another function of GAM2071 is therefore inhibition of LOC147407 (Accession XP_084000.1). Accordingly, utilities of GAM2071 include diagnosis, prevention and treatment of diseases and clinical conditions associated with LOC147407.

LOC147622 (Accession XP_097255.1) is another GAM2071 target gene, herein designated TARGET GENE. LOC147622 BINDING SITE is a target binding site found in the 3' untranslated region of mRNA encoded by LOC147622, corresponding to a target binding site such as BINDING SITE I, BINDING SITE II or BINDING SITE III of FIG. 8. Table 4 illustrates the complementarity of the nucleotide sequences of LOC147622 BINDING SITE, designated SEQ ID:10349, to the nucleotide sequence of GAM2071 RNA, herein designated GAM RNA, also designated SEQ ID:371.

Another function of GAM2071 is therefore inhibition of LOC147622 (Accession XP_097255.1). Accordingly, utilities of GAM2071 include diagnosis, prevention and treatment of diseases and clinical conditions associated with LOC147622.

LOC147817 (Accession XP_085903.1) is another GAM2071 target gene, herein designated TARGET GENE. LOC147817 BINDING SITE1 and LOC147817 BINDING SITE2 are target binding sites found in untranslated regions of mRNA encoded by LOC147817, corresponding to target binding sites such as BINDING SITE I, BINDING SITE II or BINDING SITE III of FIG. 8. Table 4 illustrates the complementarity of the nucleotide sequences of LOC147817 BINDING SITE1 and LOC147817 BINDING SITE2, designated SEQ ID:14003 and SEQ ID:11085 respectively, to the nucleotide sequence of GAM2071 RNA, herein designated GAM RNA, also designated SEQ ID:371.

Another function of GAM2071 is therefore inhibition of LOC147817 (Accession XP_085903.1). Accordingly, utilities of GAM2071 include diagnosis, prevention and treatment of diseases and clinical conditions associated with LOC147817.

LOC147841 (Accession XP_085924.2) is another GAM2071 target gene, herein designated TARGET GENE. LOC147841 BINDING SITE is a target binding site found in the 3' untranslated region of mRNA encoded by LOC147841, corresponding to a target binding site such as BINDING SITE I, BINDING SITE II or BINDING SITE III of FIG. 8. Table 4 illustrates the complementarity of the nucleotide sequences of LOC147841 BINDING SITE, designated SEQ ID:18175, to the nucleotide sequence of GAM2071 RNA, herein designated GAM RNA, also designated SEQ ID:371.

Another function of GAM2071 is therefore inhibition of LOC147841 (Accession XP_085924.2). Accordingly, utilities of GAM2071 include diagnosis, prevention and treatment of diseases and clinical conditions associated with LOC147841.

LOC147947 (Accession XP_085974.1) is another GAM2071 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:438, to the nucleotide sequence of GAM2071 RNA, herein designated GAM RNA, also designated SEQ ID:371.

Another function of GAM2071 is therefore inhibition of LOC147947 (Accession XP_085974.1). Accordingly, utilities of GAM2071 include diagnosis, prevention and treatment of diseases and clinical conditions associated with LOC147947.

LOC148137 (Accession NP_653293.1) is another GAM2071 target gene, herein designated TARGET GENE. LOC148137 BINDING SITE is a target binding site found in the 3' untranslated region of mRNA encoded by LOC148137, corresponding to a target binding site such as BINDING SITE I, BINDING SITE II or BINDING SITE III of FIG. 8. Table 4 illustrates the complementarity of the nucleotide sequences of LOC148137 BINDING SITE, designated SEQ ID:13130, to the nucleotide sequence of GAM2071 RNA, herein designated GAM RNA, also designated SEQ ID:371.

Another function of GAM2071 is therefore inhibition of LOC148137 (Accession NP_653293.1). Accordingly, utilities of GAM2071 include diagnosis, prevention and treatment of diseases and clinical conditions associated with LOC148137.

LOC148708 (Accession XP_086286.4) is another GAM2071 target gene, herein designated TARGET GENE. LOC148708 BINDING SITE is a target binding site found in the 3' untranslated region of mRNA encoded by LOC148708, corresponding to a target binding site such as BINDING SITE I, BINDING SITE II or BINDING SITE III of FIG. 8. Table 4 illustrates the complementarity of the nucleotide sequences of LOC148708 BINDING SITE, designated SEQ ID:18164, to the nucleotide sequence of GAM2071 RNA, herein designated GAM RNA, also designated SEQ ID:371.

Another function of GAM2071 is therefore inhibition of LOC148708 (Accession XP_086286.4). Accordingly, utilities of GAM2071 include diagnosis, prevention and treatment of diseases and clinical conditions associated with LOC148708.

LOC148709 (Accession XP_086281.1) is another GAM2071 target gene, herein designated TARGET GENE. LOC148709 BINDING SITE is a target binding site found in the 5' untranslated region of mRNA encoded by LOC148709, corresponding to a target binding site such as BINDING SITE I, BINDING SITE II or BINDING SITE III of FIG. 8. Table 4 illustrates the complementarity of the nucleotide sequences of LOC148709 BINDING SITE, designated SEQ ID:8427, to the nucleotide sequence of GAM2071 RNA, herein designated GAM RNA, also designated SEQ ID:371.

Another function of GAM2071 is therefore inhibition of LOC148709 (Accession XP_086281.1). Accordingly, utilities of GAM2071 include diagnosis, prevention and treatment of diseases and clinical conditions associated with LOC148709.

LOC149134 (Accession XP_097594.1) is another GAM2071 target gene, herein designated TARGET GENE. LOC149134 BINDING SITE is a target binding site found in the 5' untranslated region of mRNA encoded by LOC149134, corresponding to a target binding site such as BINDING SITE I, BINDING SITE II or BINDING SITE III of FIG. 8. Table 4 illustrates the complementarity of the nucleotide sequences of LOC149134 BINDING SITE, designated SEQ ID:16592, to the nucleotide sequence of GAM2071 RNA, herein designated GAM RNA, also designated SEQ ID:371.

Another function of GAM2071 is therefore inhibition of LOC149134 (Accession XP_097594.1). Accordingly, utilities of GAM2071 include diagnosis, prevention and treatment of diseases and clinical conditions associated with LOC149134.

LOC149149 (Accession XP_097598.1) is another GAM2071 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:9725, to the nucleotide sequence of GAM2071 RNA, herein designated GAM RNA, also designated SEQ ID:371.

Another function of GAM2071 is therefore inhibition of LOC149149 (Accession XP_097598.1). Accordingly, utilities of GAM2071 include diagnosis, prevention and treatment of diseases and clinical conditions associated with LOC149149.

LOC149371 (Accession NP_787072.1) is another GAM2071 target gene, herein designated TARGET GENE. LOC149371 BINDING SITE is a target binding site found in the 3' untranslated region of mRNA encoded by LOC149371, corresponding to a target binding site such as BINDING SITE I, BINDING SITE II or BINDING SITE III of FIG. 8. Table 4 illustrates the complementarity of the nucleotide sequences of LOC149371 BINDING SITE, designated SEQ ID:14762, to the nucleotide sequence of GAM2071 RNA, herein designated GAM RNA, also designated SEQ ID:371.

Another function of GAM2071 is therefore inhibition of LOC149371 (Accession NP_787072.1). Accordingly, utilities of GAM2071 include diagnosis, prevention and treatment of diseases and clinical conditions associated with LOC149371.

LOC149478 (Accession XP_086536.1) is another GAM2071 target gene, herein designated TARGET GENE. LOC149478 BINDING SITE is a target binding site found in the 3' untranslated region of mRNA encoded by LOC149478, corresponding to a target binding site such as BINDING SITE I, BINDING SITE II or BINDING SITE III of FIG. 8. Table 4 illustrates the complementarity of the nucleotide sequences of LOC149478 BINDING SITE, designated SEQ ID:2514, to the nucleotide sequence of GAM2071 RNA, herein designated GAM RNA, also designated SEQ ID:371.

Another function of GAM2071 is therefore inhibition of LOC149478 (Accession XP_086536.1). Accordingly, utilities of GAM2071 include diagnosis, prevention and treatment of diseases and clinical conditions associated with LOC149478.

LOC149506 (Accession XP_097661.1) is another GAM2071 target gene, herein designated TARGET GENE. LOC149506 BINDING SITE1 and LOC149506 BINDING SITE2 are target binding sites found in untranslated regions of mRNA encoded by LOC149506, corresponding to target binding sites such as BINDING SITE I, BINDING SITE II or BINDING SITE III of FIG. 8. Table 4 illustrates the complementarity of the nucleotide sequences of LOC149506 BINDING SITE1 and LOC149506 BINDING SITE2, designated SEQ ID:17503 and SEQ ID:5777 respectively, to the nucleotide sequence of GAM2071 RNA, herein designated GAM RNA, also designated SEQ ID:371.

Another function of GAM2071 is therefore inhibition of LOC149506 (Accession XP_097661.1). Accordingly, utilities of GAM2071 include diagnosis, prevention and treatment of diseases and clinical conditions associated with LOC149506.

LOC149692 (Accession XP_097706.1) is another GAM2071 target gene, herein designated TARGET GENE.

LOC149692 BINDING SITE is a target binding site found in the 3' untranslated region of mRNA encoded by LOC149692, corresponding to a target binding site such as BINDING SITE I, BINDING SITE II or BINDING SITE III of FIG. 8. Table 4 illustrates the complementarity of the nucleotide sequences of LOC149692 BINDING SITE, designated SEQ ID:13800, to the nucleotide sequence of GAM2071 RNA, herein designated GAM RNA, also designated SEQ ID:371.

Another function of GAM2071 is therefore inhibition of LOC149692 (Accession XP_097706.1). Accordingly, utilities of GAM2071 include diagnosis, prevention and treatment of diseases and clinical conditions associated with LOC149692.

LOC149703 (Accession XP_097719.1) is another GAM2071 target gene, herein designated TARGET GENE. LOC149703 BINDING SITE is a target binding site found in the 5' untranslated region of mRNA encoded by LOC149703, corresponding to a target binding site such as BINDING SITE I, BINDING SITE II or BINDING SITE III of FIG. 8. Table 4 illustrates the complementarity of the nucleotide sequences of LOC149703 BINDING SITE, designated SEQ ID:19805, to the nucleotide sequence of GAM2071 RNA, herein designated GAM RNA, also designated SEQ ID:371.

Another function of GAM2071 is therefore inhibition of LOC149703 (Accession XP_097719.1). Accordingly, utilities of GAM2071 include diagnosis, prevention and treatment of diseases and clinical conditions associated with LOC149703.

LOC150054 (Accession XP_097797.1) is another GAM2071 target gene, herein designated TARGET GENE. LOC150054 BINDING SITE is a target binding site found in the 5' untranslated region of mRNA encoded by LOC150054, corresponding to a target binding site such as BINDING SITE I, BINDING SITE II or BINDING SITE III of FIG. 8. Table 4 illustrates the complementarity of the nucleotide sequences of LOC150054 BINDING SITE, designated SEQ ID:18175, to the nucleotide sequence of GAM2071 RNA, herein designated GAM RNA, also designated SEQ ID:371.

Another function of GAM2071 is therefore inhibition of LOC150054 (Accession XP_097797.1). Accordingly, utilities of GAM2071 include diagnosis, prevention and treatment of diseases and clinical conditions associated with LOC150054.

LOC150225 (Accession XP_097870.1) is another GAM2071 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:1664, to the nucleotide sequence of GAM2071 RNA, herein designated GAM RNA, also designated SEQ ID:371.

Another function of GAM2071 is therefore inhibition of LOC150225 (Accession XP_097870.1). Accordingly, utilities of GAM2071 include diagnosis, prevention and treatment of diseases and clinical conditions associated with LOC150225.

LOC150407 (Accession XP_086906.1) is another GAM2071 target gene, herein designated TARGET GENE. LOC150407 BINDING SITE is a target binding site found in the 3' untranslated region of mRNA encoded by LOC150407, corresponding to a target binding site such as BINDING SITE I, BINDING SITE II or BINDING SITE III of FIG. 8. Table 4 illustrates the complementarity of the nucleotide sequences of LOC150407 BINDING SITE, designated SEQ ID:2430, to the nucleotide sequence of GAM2071 RNA, herein designated GAM RNA, also designated SEQ ID:371.

Another function of GAM2071 is therefore inhibition of LOC150407 (Accession XP_086906.1). Accordingly, utilities of GAM2071 include diagnosis, prevention and treatment of diseases and clinical conditions associated with LOC150407.

LOC150587 (Accession XP_097917.1) is another GAM2071 target gene, herein designated TARGET GENE. LOC150587 BINDING SITE1 and LOC150587 BINDING SITE2 are target binding sites found in untranslated regions of mRNA encoded by LOC150587, corresponding to target binding sites such as BINDING SITE I, BINDING SITE II or BINDING SITE III of FIG. 8. Table 4 illustrates the complementarity of the nucleotide sequences of LOC150587 BINDING SITE1 and LOC150587 BINDING SITE2, designated SEQ ID:15619 and SEQ ID:8861 respectively, to the nucleotide sequence of GAM2071 RNA, herein designated GAM RNA, also designated SEQ ID:371.

Another function of GAM2071 is therefore inhibition of LOC150587 (Accession XP_097917.1). Accordingly, utilities of GAM2071 include diagnosis, prevention and treatment of diseases and clinical conditions associated with LOC150587.

LOC151057 (Accession XP_097998.1) is another GAM2071 target gene, herein designated TARGET GENE. LOC151057 BINDING SITE is a target binding site found in the 3' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:5519, to the nucleotide sequence of GAM2071 RNA, herein designated GAM RNA, also designated SEQ ID:371.

Another function of GAM2071 is therefore inhibition of LOC151057 (Accession XP_097998.1). Accordingly, utilities of GAM2071 include diagnosis, prevention and treatment of diseases and clinical conditions associated with LOC151057.

LOC151201 (Accession XP_098021.1) is another GAM2071 target gene, herein designated TARGET GENE. LOC151201 BINDING SITE1 and LOC151201 BINDING SITE2 are target binding sites found in untranslated regions of mRNA encoded by LOC151201, corresponding to target binding sites such as BINDING SITE I, BINDING SITE II or BINDING SITE III of FIG. 8. Table 4 illustrates the complementarity of the nucleotide sequences of LOC151201 BINDING SITE1 and LOC151201 BINDING SITE2, designated SEQ ID:3299 and SEQ ID:11934 respectively, to the nucleotide sequence of GAM2071 RNA, herein designated GAM RNA, also designated SEQ ID:371.

Another function of GAM2071 is therefore inhibition of LOC151201 (Accession XP_098021.1). Accordingly, utilities of GAM2071 include diagnosis, prevention and treatment of diseases and clinical conditions associated with LOC151201.

LOC151475 (Accession XP_098063.1) is another GAM2071 target gene, herein designated TARGET GENE. LOC151475 BINDING SITE1 and LOC151475 BINDING SITE2 are target binding sites found in untranslated regions of mRNA encoded by LOC151475, corresponding to target binding sites such as BINDING SITE I, BINDING SITE II or BINDING SITE III of FIG. 8. Table 4 illustrates the complementarity of the nucleotide sequences of LOC151475 BINDING SITE1 and LOC151475 BINDING SITE2, designated SEQ ID:7086 and SEQ ID:15680 respectively, to the nucleotide sequence of GAM2071 RNA, herein designated GAM RNA, also designated SEQ ID:371.

Another function of GAM2071 is therefore inhibition of LOC151475 (Accession XP_098063.1). Accordingly, utilities of GAM2071 include diagnosis, prevention and treatment of diseases and clinical conditions associated with LOC151475.

LOC151636 (Accession NP_612144.1) is another GAM2071 target gene, herein designated TARGET GENE. LOC151636 BINDING SITE1 through LOC151636 BINDING SITE3 are target binding sites found in untranslated regions of mRNA encoded by LOC151636, corresponding to target binding sites such as BINDING SITE I, BINDING SITE II or BINDING SITE III of FIG. 8. Table 4 illustrates the complementarity of the nucleotide sequences of LOC151636 BINDING SITE1 through LOC151636 BINDING SITE3, designated SEQ ID:2479, SEQ ID:896 and SEQ ID:19982 respectively, to the nucleotide sequence of GAM2071 RNA, herein designated GAM RNA, also designated SEQ ID:371.

Another function of GAM2071 is therefore inhibition of LOC151636 (Accession NP_612144.1). Accordingly, utilities of GAM2071 include diagnosis, prevention and treatment of diseases and clinical conditions associated with LOC151636.

LOC152245 (Accession XP_098182.1) is another GAM2071 target gene, herein designated TARGET GENE. LOC152245 BINDING SITE is a target binding site found in the 3' untranslated region of mRNA encoded by LOC152245, corresponding to a target binding site such as BINDING SITE I, BINDING SITE II or BINDING SITE III of FIG. 8. Table 4 illustrates the complementarity of the nucleotide sequences of LOC152245 BINDING SITE, designated SEQ ID:19257, to the nucleotide sequence of GAM2071 RNA, herein designated GAM RNA, also designated SEQ ID:371.

Another function of GAM2071 is therefore inhibition of LOC152245 (Accession XP_098182.1). Accordingly, utilities of GAM2071 include diagnosis, prevention and treatment of diseases and clinical conditions associated with LOC152245.

LOC152445 (Accession XP_098231.1) is another GAM2071 target gene, herein designated TARGET GENE. LOC152445 BINDING SITE is a target binding site found in the 3' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:13905, to the nucleotide sequence of GAM2071 RNA, herein designated GAM RNA, also designated SEQ ID:371.

Another function of GAM2071 is therefore inhibition of LOC152445 (Accession XP_098231.1). Accordingly, utilities of GAM2071 include diagnosis, prevention and treatment of diseases and clinical conditions associated with LOC152445.

LOC152620 (Accession XP_011108.2) is another GAM2071 target gene, herein designated TARGET GENE. LOC152620 BINDING SITE is a target binding site found in the 3' untranslated region of mRNA encoded by LOC152620, corresponding to a target binding site such as BINDING SITE I, BINDING SITE II or BINDING SITE III of FIG. 8. Table 4 illustrates the complementarity of the nucleotide sequences of LOC152620 BINDING SITE, designated SEQ ID:13870, to the nucleotide sequence of GAM2071 RNA, herein designated GAM RNA, also designated SEQ ID:371.

Another function of GAM2071 is therefore inhibition of LOC152620 (Accession XP_011108.2). Accordingly, utilities of GAM2071 include diagnosis, prevention and treatment of diseases and clinical conditions associated with LOC152620.

LOC152719 (Accession XP_098257.1) is another GAM2071 target gene, herein designated TARGET GENE. LOC152719 BINDING SITE is a target binding site found in the 5' untranslated region of mRNA encoded by LOC152719, corresponding to a target binding site such as BINDING SITE I, BINDING SITE II or BINDING SITE III of FIG. 8. Table 4 illustrates the complementarity of the nucleotide sequences of LOC152719 BINDING SITE, designated SEQ ID:1141, to the nucleotide sequence of GAM2071 RNA, herein designated GAM RNA, also designated SEQ ID:371.

Another function of GAM2071 is therefore inhibition of LOC152719 (Accession XP_098257.1). Accordingly, utilities of GAM2071 include diagnosis, prevention and treatment of diseases and clinical conditions associated with LOC152719.

LOC152794 (Accession XP_087525.1) is another GAM2071 target gene, herein designated TARGET GENE. LOC152794 BINDING SITE is a target binding site found in the 5' untranslated region of mRNA encoded by LOC152794, corresponding to a target binding site such as BINDING SITE I, BINDING SITE II or BINDING SITE III of FIG. 8. Table 4 illustrates the complementarity of the nucleotide sequences of LOC152794 BINDING SITE, designated SEQ ID:3556, to the nucleotide sequence of GAM2071 RNA, herein designated GAM RNA, also designated SEQ ID:371.

Another function of GAM2071 is therefore inhibition of LOC152794 (Accession XP_087525.1). Accordingly, utilities of GAM2071 include diagnosis, prevention and treatment of diseases and clinical conditions associated with LOC152794.

LOC152804 (Accession XP_098266.2) is another GAM2071 target gene, herein designated TARGET GENE. LOC152804 BINDING SITE is a target binding site found in the 3' untranslated region of mRNA encoded by LOC152804, corresponding to a target binding site such as BINDING SITE I, BINDING SITE II or BINDING SITE III of FIG. 8. Table 4 illustrates the complementarity of the nucleotide sequences of LOC152804 BINDING SITE, designated SEQ ID:8155, to the nucleotide sequence of GAM2071 RNA, herein designated GAM RNA, also designated SEQ ID:371.

Another function of GAM2071 is therefore inhibition of LOC152804 (Accession XP_098266.2). Accordingly, utilities of GAM2071 include diagnosis, prevention and treatment of diseases and clinical conditions associated with LOC152804.

LOC153077 (Accession XP_098307.1) is another GAM2071 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:19370, to the nucleotide sequence of GAM2071 RNA, herein designated GAM RNA, also designated SEQ ID:371.

Another function of GAM2071 is therefore inhibition of LOC153077 (Accession XP_098307.1). Accordingly, utilities of GAM2071 include diagnosis, prevention and treatment of diseases and clinical conditions associated with LOC153077.

LOC153811 (Accession XP_087779.2) is another GAM2071 target gene, herein designated TARGET GENE. LOC153811 BINDING SITE1 through LOC153811 BINDING SITE3 are target binding sites found in untranslated regions of mRNA encoded by LOC153811, corresponding to target binding sites such as BINDING SITE I, BINDING SITE II or BINDING SITE III of FIG. 8. Table 4 illustrates the complementarity of the nucleotide sequences of LOC153811 BINDING SITE1 through LOC153811 BINDING SITE3, designated SEQ ID:6031, SEQ ID:14281 and SEQ ID:15030 respectively, to the nucleotide sequence of GAM2071 RNA, herein designated GAM RNA, also designated SEQ ID:371.

Another function of GAM2071 is therefore inhibition of LOC153811 (Accession XP_087779.2). Accordingly, utilities of GAM2071 include diagnosis, prevention and treatment of diseases and clinical conditions associated with LOC153811.

LOC153883 (Accession XP_087798.1) is another GAM2071 target gene, herein designated TARGET GENE. LOC153883 BINDING SITE is a target binding site found in the 5' untranslated region of mRNA encoded by LOC153883, corresponding to a target binding site such as BINDING SITE I, BINDING SITE II or BINDING SITE III of FIG. 8. Table 4 illustrates the complementarity of the nucleotide sequences of LOC153883 BINDING SITE, designated SEQ ID:3293, to the nucleotide sequence of GAM2071 RNA, herein designated GAM RNA, also designated SEQ ID:371.

Another function of GAM2071 is therefore inhibition of LOC153883 (Accession XP_087798.1). Accordingly, utilities of GAM2071 include diagnosis, prevention and treatment of diseases and clinical conditions associated with LOC153883.

LOC153910 (Accession XP_087801.1) is another GAM2071 target gene, herein designated TARGET GENE. LOC153910 BINDING SITE is a target binding site found in the 5' untranslated region of mRNA encoded by LOC153910, corresponding to a target binding site such as BINDING SITE I, BINDING SITE II or BINDING SITE III of FIG. 8. Table 4 illustrates the complementarity of the nucleotide sequences of LOC153910 BINDING SITE, designated SEQ ID:7292, to the nucleotide sequence of GAM2071 RNA, herein designated GAM RNA, also designated SEQ ID:371.

Another function of GAM2071 is therefore inhibition of LOC153910 (Accession XP_087801.1). Accordingly, utilities of GAM2071 include diagnosis, prevention and treatment of diseases and clinical conditions associated with LOC153910.

LOC154282 (Accession XP_098505.1) is another GAM2071 target gene, herein designated TARGET GENE. LOC154282 BINDING SITE is a target binding site found in the 5' untranslated region of mRNA encoded by LOC154282, corresponding to a target binding site such as BINDING SITE I, BINDING SITE II or BINDING SITE III of FIG. 8. Table 4 illustrates the complementarity of the nucleotide sequences of LOC154282 BINDING SITE, designated SEQ ID:14848, to the nucleotide sequence of GAM2071 RNA, herein designated GAM RNA, also designated SEQ ID:371.

Another function of GAM2071 is therefore inhibition of LOC154282 (Accession XP_098505.1). Accordingly, utilities of GAM2071 include diagnosis, prevention and treatment of diseases and clinical conditions associated with LOC154282.

LOC154822 (Accession XP_098618.3) is another GAM2071 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:3008, to the nucleotide sequence of GAM2071 RNA, herein designated GAM RNA, also designated SEQ ID:371.

Another function of GAM2071 is therefore inhibition of LOC154822 (Accession XP_098618.3). Accordingly, utilities of GAM2071 include diagnosis, prevention and treatment of diseases and clinical conditions associated with LOC154822.

LOC154877 (Accession XP_098626.1) is another GAM2071 target gene, herein designated TARGET GENE. LOC154877 BINDING SITE1 through LOC154877 BINDING SITE3 are target binding sites found in untranslated regions of mRNA encoded by LOC154877, corresponding to target binding sites such as BINDING SITE I, BINDING SITE II or BINDING SITE III of FIG. 8. Table 4 illustrates the complementarity of the nucleotide sequences of LOC154877 BINDING SITE1 through LOC154877 BINDING SITE3, designated SEQ ID:15947, SEQ ID:3038 and SEQ ID:14342 respectively, to the nucleotide sequence of GAM2071 RNA, herein designated GAM RNA, also designated SEQ ID:371.

Another function of GAM2071 is therefore inhibition of LOC154877 (Accession XP_098626.1). Accordingly, utilities of GAM2071 include diagnosis, prevention and treatment of diseases and clinical conditions associated with LOC154877.

LOC158014 (Accession XP_088442.1) is another GAM2071 target gene, herein designated TARGET GENE. LOC158014 BINDING SITE is a target binding site found in the 5' untranslated region of mRNA encoded by LOC158014, corresponding to a target binding site such as BINDING SITE I, BINDING SITE II or BINDING SITE III of FIG. 8. Table 4 illustrates the complementarity of the nucleotide sequences of LOC158014 BINDING SITE, designated SEQ ID:12285, to the nucleotide sequence of GAM2071 RNA, herein designated GAM RNA, also designated SEQ ID:371.

Another function of GAM2071 is therefore inhibition of LOC158014 (Accession XP_088442.1). Accordingly, utilities of GAM2071 include diagnosis, prevention and treatment of diseases and clinical conditions associated with LOC158014.

LOC158310 (Accession XP_098919.1) is another GAM2071 target gene, herein designated TARGET GENE. LOC158310 BINDING SITE is a target binding site found in the 5' untranslated region of mRNA encoded by LOC158310, corresponding to a target binding site such as BINDING SITE I, BINDING SITE II or BINDING SITE III of FIG. 8. Table 4 illustrates the complementarity of the nucleotide sequences of LOC158310 BINDING SITE, designated SEQ ID:18175, to the nucleotide sequence of GAM2071 RNA, herein designated GAM RNA, also designated SEQ ID:371.

Another function of GAM2071 is therefore inhibition of LOC158310 (Accession XP_098919.1). Accordingly, utilities of GAM2071 include diagnosis, prevention and treatment of diseases and clinical conditions associated with LOC158310.

LOC158402 (Accession XP_098936.1) is another GAM2071 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:1414, to the nucleotide sequence of GAM2071 RNA, herein designated GAM RNA, also designated SEQ ID:371.

Another function of GAM2071 is therefore inhibition of LOC158402 (Accession XP_098936.1). Accordingly, utilities of GAM2071 include diagnosis, prevention and treatment of diseases and clinical conditions associated with LOC158402.

LOC158436 (Accession XP_098942.1) is another GAM2071 target gene, herein designated TARGET GENE. LOC158436 BINDING SITE is a target binding site found in the 3' untranslated region of mRNA encoded by LOC158436, corresponding to a target binding site such as BINDING SITE I, BINDING SITE II or BINDING SITE III of FIG. 8. Table 4 illustrates the complementarity of the nucleotide sequences of LOC158436 BINDING SITE, designated SEQ ID:7071, to the nucleotide sequence of GAM2071 RNA, herein designated GAM RNA, also designated SEQ ID:371.

Another function of GAM2071 is therefore inhibition of LOC158436 (Accession XP_098942.1). Accordingly, utilities of GAM2071 include diagnosis, prevention and treatment of diseases and clinical conditions associated with LOC158436.

LOC158476 (Accession XP_098955.1) is another GAM2071 target gene, herein designated TARGET GENE. LOC158476 BINDING SITE is a target binding site found in the 3' untranslated region of mRNA encoded by LOC158476, corresponding to a target binding site such as BINDING SITE I, BINDING SITE II or BINDING SITE III of FIG. 8. Table 4 illustrates the complementarity of the nucleotide sequences of LOC158476 BINDING SITE, designated SEQ ID:436, to the nucleotide sequence of GAM2071 RNA, herein designated GAM RNA, also designated SEQ ID:371.

Another function of GAM2071 is therefore inhibition of LOC158476 (Accession XP_098955.1). Accordingly, utilities of GAM2071 include diagnosis, prevention and treatment of diseases and clinical conditions associated with LOC158476.

LOC158563 (Accession XP_088606.1) is another GAM2071 target gene, herein designated TARGET GENE. LOC158563 BINDING SITE is a target binding site found in the 5' untranslated region of mRNA encoded by LOC158563, corresponding to a target binding site such as BINDING SITE I, BINDING SITE II or BINDING SITE III of FIG. 8. Table 4 illustrates the complementarity of the nucleotide sequences of LOC158563 BINDING SITE, designated SEQ ID:9685, to the nucleotide sequence of GAM2071 RNA, herein designated GAM RNA, also designated SEQ ID:371.

Another function of GAM2071 is therefore inhibition of LOC158563 (Accession XP_088606.1). Accordingly, utilities of GAM2071 include diagnosis, prevention and treatment of diseases and clinical conditions associated with LOC158563.

LOC160897 (Accession XP_090573.3) is another GAM2071 target gene, herein designated TARGET GENE. LOC160897 BINDING SITE is a target binding site found in the 5' untranslated region of mRNA encoded by LOC160897, corresponding to a target binding site such as BINDING SITE I, BINDING SITE II or BINDING SITE III of FIG. 8. Table 4 illustrates the complementarity of the nucleotide sequences of LOC160897 BINDING SITE, designated SEQ ID:14437, to the nucleotide sequence of GAM2071 RNA, herein designated GAM RNA, also designated SEQ ID:371.

Another function of GAM2071 is therefore inhibition of LOC160897 (Accession XP_090573.3). Accordingly, utilities of GAM2071 include diagnosis, prevention and treatment of diseases and clinical conditions associated with LOC160897.

LOC162083 (Accession XP_091339.2) is another GAM2071 target gene, herein designated TARGET GENE. LOC162083 BINDING SITE is a target binding site found in the 5' untranslated region of mRNA encoded by LOC162083, corresponding to a target binding site such as BINDING SITE I, BINDING SITE II or BINDING SITE III of FIG. 8. Table 4 illustrates the complementarity of the nucleotide sequences of LOC162083 BINDING SITE, designated SEQ ID:17143, to the nucleotide sequence of GAM2071 RNA, herein designated GAM RNA, also designated SEQ ID:371.

Another function of GAM2071 is therefore inhibition of LOC162083 (Accession XP_091339.2). Accordingly, utilities of GAM2071 include diagnosis, prevention and treatment of diseases and clinical conditions associated with LOC162083.

LOC162427 (Accession XP_091549.3) is another GAM2071 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:1761 and SEQ ID:12386 respectively, to the nucleotide sequence of GAM2071 RNA, herein designated GAM RNA, also designated SEQ ID:371.

Another function of GAM2071 is therefore inhibition of LOC162427 (Accession XP_091549.3). Accordingly, utilities of GAM2071 include diagnosis, prevention and treatment of diseases and clinical conditions associated with LOC162427.

LOC162427 (Accession NP_835227.1) is another GAM2071 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:1761 and SEQ ID:12386 respectively, to the nucleotide sequence of GAM2071 RNA, herein designated GAM RNA, also designated SEQ ID:371.

Another function of GAM2071 is therefore inhibition of LOC162427 (Accession NP_835227.1). Accordingly, utilities of GAM2071 include diagnosis, prevention and treatment of diseases and clinical conditions associated with LOC162427.

LOC162967 (Accession XP_091890.6) is another GAM2071 target gene, herein designated TARGET GENE. LOC162967 BINDING SITE is a target binding site found in the 3' untranslated region of mRNA encoded by LOC162967, corresponding to a target binding site such as BINDING SITE I, BINDING SITE II or BINDING SITE III of FIG. 8. Table 4 illustrates the complementarity of the nucleotide sequences of LOC162967 BINDING SITE, designated SEQ ID:3050, to the nucleotide sequence of GAM2071 RNA, herein designated GAM RNA, also designated SEQ ID:371.

Another function of GAM2071 is therefore inhibition of LOC162967 (Accession XP_091890.6). Accordingly, utilities of GAM2071 include diagnosis, prevention and treatment of diseases and clinical conditions associated with LOC162967.

LOC163227 (Accession NP_775802.1) is another GAM2071 target gene, herein designated TARGET GENE. LOC163227 BINDING SITE1 and LOC163227 BINDING SITE2 are target binding sites found in untranslated regions of mRNA encoded by LOC163227, corresponding to target binding sites such as BINDING SITE I, BINDING SITE II or BINDING SITE III of FIG. 8. Table 4 illustrates the complementarity of the nucleotide sequences of LOC163227 BINDING SITE1 and LOC163227 BINDING SITE2, designated SEQ ID:1413 and SEQ ID:9582 respectively, to the nucleotide sequence of GAM2071 RNA, herein designated GAM RNA, also designated SEQ ID:371.

Another function of GAM2071 is therefore inhibition of LOC163227 (Accession NP_775802.1). Accordingly, utilities of GAM2071 include diagnosis, prevention and treatment of diseases and clinical conditions associated with LOC163227.

LOC168451 (Accession XP_095114.2) is another GAM2071 target gene, herein designated TARGET GENE. LOC168451 BINDING SITE is a target binding site found in the 3' untranslated region of mRNA encoded by LOC168451, corresponding to a target binding site such as BINDING SITE I, BINDING SITE II or BINDING SITE III of FIG. 8. Table 4 illustrates the complementarity of the nucleotide sequences of LOC168451 BINDING SITE, designated SEQ ID:7426, to the nucleotide sequence of GAM2071 RNA, herein designated GAM RNA, also designated SEQ ID:371.

Another function of GAM2071 is therefore inhibition of LOC168451 (Accession XP_095114.2). Accordingly, utilities of GAM2071 include diagnosis, prevention and treatment of diseases and clinical conditions associated with LOC168451.

LOC170409 (Accession XP_096330.1) is another GAM2071 target gene, herein designated TARGET GENE. LOC170409 BINDING SITE is a target binding site found in the 5' untranslated region of mRNA encoded by LOC170409, corresponding to a target binding site such as BINDING SITE I, BINDING SITE II or BINDING SITE III of FIG. 8. Table 4 illustrates the complementarity of the nucleotide sequences of LOC170409 BINDING SITE, designated SEQ ID:7616, to the nucleotide sequence of GAM2071 RNA, herein designated GAM RNA, also designated SEQ ID:371.

Another function of GAM2071 is therefore inhibition of LOC170409 (Accession XP_096330.1). Accordingly, utilities of GAM2071 include diagnosis, prevention and treatment of diseases and clinical conditions associated with LOC170409.

LOC196264 (Accession XP_113683.1) is another GAM2071 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:8574, to the nucleotide sequence of GAM2071 RNA, herein designated GAM RNA, also designated SEQ ID:371.

Another function of GAM2071 is therefore inhibition of LOC196264 (Accession XP_113683.1). Accordingly, utilities of GAM2071 include diagnosis, prevention and treatment of diseases and clinical conditions associated with LOC196264.

LOC196993 (Accession XP_116971.3) is another GAM2071 target gene, herein designated TARGET GENE. LOC196993 BINDING SITE is a target binding site found in the 5' untranslated region of mRNA encoded by LOC196993, corresponding to a target binding site such as BINDING SITE I, BINDING SITE II or BINDING SITE III of FIG. 8. Table 4 illustrates the complementarity of the nucleotide sequences of LOC196993 BINDING SITE, designated SEQ ID:7905, to the nucleotide sequence of GAM2071 RNA, herein designated GAM RNA, also designated SEQ ID:371.

Another function of GAM2071 is therefore inhibition of LOC196993 (Accession XP_116971.3). Accordingly, utilities of GAM2071 include diagnosis, prevention and treatment of diseases and clinical conditions associated with LOC196993.

LOC197336 (Accession NP_660337.1) is another GAM2071 target gene, herein designated TARGET GENE. LOC197336 BINDING SITE is a target binding site found in the 5' untranslated region of mRNA encoded by LOC197336, corresponding to a target binding site such as BINDING SITE I, BINDING SITE II or BINDING SITE III of FIG. 8. Table 4 illustrates the complementarity of the nucleotide sequences of LOC197336 BINDING SITE, designated SEQ ID:18551, to the nucleotide sequence of GAM2071 RNA, herein designated GAM RNA, also designated SEQ ID:371.

Another function of GAM2071 is therefore inhibition of LOC197336 (Accession NP_660337.1). Accordingly, utilities of GAM2071 include diagnosis, prevention and treatment of diseases and clinical conditions associated with LOC197336.

LOC197358 (Accession XP_113872.2) is another GAM2071 target gene, herein designated TARGET GENE. LOC197358 BINDING SITE1 and LOC197358 BINDING SITE2 are target binding sites found in untranslated regions of mRNA encoded by LOC197358, corresponding to target binding sites such as BINDING SITE I, BINDING SITE II or BINDING SITE III of FIG. 8. Table 4 illustrates the complementarity of the nucleotide sequences of LOC197358 BINDING SITE1 and LOC197358 BINDING SITE2, designated SEQ ID:3887 and SEQ ID:5402 respectively, to the nucleotide sequence of GAM2071 RNA, herein designated GAM RNA, also designated SEQ ID:371.

Another function of GAM2071 is therefore inhibition of LOC197358 (Accession XP_113872.2). Accordingly, utilities of GAM2071 include diagnosis, prevention and treatment of diseases and clinical conditions associated with LOC197358.

LOC199906 (Accession XP_114052.1) is another GAM2071 target gene, herein designated TARGET GENE. LOC199906 BINDING SITE is a target binding site found in the 3' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:11637, to the nucleotide sequence of GAM2071 RNA, herein designated GAM RNA, also designated SEQ ID:371.

Another function of GAM2071 is therefore inhibition of LOC199906 (Accession XP_114052.1). Accordingly, utilities of GAM2071 include diagnosis, prevention and treatment of diseases and clinical conditions associated with LOC199906.

LOC200169 (Accession XP_117200.1) is another GAM2071 target gene, herein designated TARGET GENE. LOC200169 BINDING SITE1 and LOC200169 BINDING SITE2 are target binding sites found in untranslated regions of multiple transcripts of mRNA encoded by LOC200169, corresponding to target binding sites such as BINDING SITE I, BINDING SITE II or BINDING SITE III of FIG. 8. Table 4 illustrates the complementarity of the nucleotide sequences of LOC200169 BINDING SITE1 and LOC200169 BINDING SITE2, designated SEQ ID:6517 and SEQ ID:5066 respectively, to the nucleotide sequence of GAM2071 RNA, herein designated GAM RNA, also designated SEQ ID:371.

Another function of GAM2071 is therefore inhibition of LOC200169 (Accession XP_117200.1). Accordingly, utilities of GAM2071 include diagnosis, prevention and treatment of diseases and clinical conditions associated with LOC200169.

LOC200860 (Accession XP_117289.1) is another GAM2071 target gene, herein designated TARGET GENE. LOC200860 BINDING SITE is a target binding site found in the 3' untranslated region of mRNA encoded by LOC200860, corresponding to a target binding site such as BINDING SITE I, BINDING SITE II or BINDING SITE III of FIG. 8. Table 4 illustrates the complementarity of the nucleotide sequences of LOC200860 BINDING SITE, designated SEQ ID:18182, to the nucleotide sequence of GAM2071 RNA, herein designated GAM RNA, also designated SEQ ID:371.

Another function of GAM2071 is therefore inhibition of LOC200860 (Accession XP_117289.1). Accordingly, utilities of GAM2071 include diagnosis, prevention and treatment of diseases and clinical conditions associated with LOC200860.

LOC200895 (Accession NP_789785.1) is another GAM2071 target gene, herein designated TARGET GENE. LOC200895 BINDING SITE is a target binding site found in the 3' untranslated region of mRNA encoded by LOC200895, corresponding to a target binding site such as BINDING SITE I, BINDING SITE II or BINDING SITE III of FIG. 8. Table 4 illustrates the complementarity of the nucleotide sequences of LOC200895 BINDING SITE, designated SEQ ID:3376, to the nucleotide sequence of GAM2071 RNA, herein designated GAM RNA, also designated SEQ ID:371.

Another function of GAM2071 is therefore inhibition of LOC200895 (Accession NP_789785.1). Accordingly, utilities of GAM2071 include diagnosis, prevention and treatment of diseases and clinical conditions associated with LOC200895.

LOC200916 (Accession XP_114317.3) is another GAM2071 target gene, herein designated TARGET GENE. LOC200916 BINDING SITE is a target binding site found in the 3' untranslated region of mRNA encoded by LOC200916, corresponding to a target binding site such as BINDING SITE I, BINDING SITE II or BINDING SITE III of FIG. 8. Table 4 illustrates the complementarity of the nucleotide sequences of LOC200916 BINDING SITE, designated SEQ ID:873, to the nucleotide sequence of GAM2071 RNA, herein designated GAM RNA, also designated SEQ ID:371.

Another function of GAM2071 is therefore inhibition of LOC200916 (Accession XP_114317.3). Accordingly, utilities of GAM2071 include diagnosis, prevention and treatment of diseases and clinical conditions associated with LOC200916.

LOC201164 (Accession NP_849158.1) is another GAM2071 target gene, herein designated TARGET GENE. LOC201164 BINDING SITE1 and LOC201164 BINDING SITE2 are target binding sites found in untranslated regions of multiple transcripts of mRNA encoded by LOC201164, corresponding to target binding sites such as BINDING SITE I, BINDING SITE II or BINDING SITE III of FIG. 8. Table 4 illustrates the complementarity of the nucleotide sequences of LOC201164 BINDING SITE1 and LOC201164 BINDING SITE2, designated SEQ ID:18118 and SEQ ID:13530 respectively, to the nucleotide sequence of GAM2071 RNA, herein designated GAM RNA, also designated SEQ ID:371.

Another function of GAM2071 is therefore inhibition of LOC201164 (Accession NP_849158.1). Accordingly, utilities of GAM2071 include diagnosis, prevention and treatment of diseases and clinical conditions associated with LOC201164.

LOC201292 (Accession NP_775818.1) is another GAM2071 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:14592, to the nucleotide sequence of GAM2071 RNA, herein designated GAM RNA, also designated SEQ ID:371.

Another function of GAM2071 is therefore inhibition of LOC201292 (Accession NP_775818.1). Accordingly, utilities of GAM2071 include diagnosis, prevention and treatment of diseases and clinical conditions associated with LOC201292.

LOC201510 (Accession XP_113972.1) is another GAM2071 target gene, herein designated TARGET GENE. LOC201510 BINDING SITE is a target binding site found in the 3' untranslated region of mRNA encoded by LOC201510, corresponding to a target binding site such as BINDING SITE I, BINDING SITE II or BINDING SITE III of FIG. 8. Table 4 illustrates the complementarity of the nucleotide sequences of LOC201510 BINDING SITE, designated SEQ ID:4316, to the nucleotide sequence of GAM2071 RNA, herein designated GAM RNA, also designated SEQ ID:371.

Another function of GAM2071 is therefore inhibition of LOC201510 (Accession XP_113972.1). Accordingly, utilities of GAM2071 include diagnosis, prevention and treatment of diseases and clinical conditions associated with LOC201510.

LOC201562 (Accession XP_114343.2) is another GAM2071 target gene, herein designated TARGET GENE. LOC201562 BINDING SITE is a target binding site found in the 3' untranslated region of mRNA encoded by LOC201562, corresponding to a target binding site such as BINDING SITE I, BINDING SITE II or BINDING SITE III of FIG. 8. Table 4 illustrates the complementarity of the nucleotide sequences of LOC201562 BINDING SITE, designated SEQ ID:9102, to the nucleotide sequence of GAM2071 RNA, herein designated GAM RNA, also designated SEQ ID:371.

Another function of GAM2071 is therefore inhibition of LOC201562 (Accession XP_114343.2). Accordingly, utilities of GAM2071 include diagnosis, prevention and treatment of diseases and clinical conditions associated with LOC201562.

LOC201725 (Accession XP_114370.1) is another GAM2071 target gene, herein designated TARGET GENE. LOC201725 BINDING SITE is a target binding site found in the 3' untranslated region of mRNA encoded by LOC201725, corresponding to a target binding site such as BINDING SITE I, BINDING SITE II or BINDING SITE III of FIG. 8. Table 4 illustrates the complementarity of the nucleotide sequences of LOC201725 BINDING SITE, designated SEQ ID:18941, to the nucleotide sequence of GAM2071 RNA, herein designated GAM RNA, also designated SEQ ID:371.

Another function of GAM2071 is therefore inhibition of LOC201725 (Accession XP_114370.1). Accordingly, utilities of GAM2071 include diagnosis, prevention and treatment of diseases and clinical conditions associated with LOC201725.

LOC202400 (Accession XP_117397.1) is another GAM2071 target gene, herein designated TARGET GENE. LOC202400 BINDING SITE is a target binding site found in the 5' untranslated region of mRNA encoded by LOC202400, corresponding to a target binding site such as BINDING SITE I, BINDING SITE II or BINDING SITE III of FIG. 8. Table 4 illustrates the complementarity of the nucleotide sequences of LOC202400 BINDING SITE, designated SEQ ID:436, to the nucleotide sequence of GAM2071 RNA, herein designated GAM RNA, also designated SEQ ID:371.

Another function of GAM2071 is therefore inhibition of LOC202400 (Accession XP_117397.1). Accordingly, utilities of GAM2071 include diagnosis, prevention and treatment of diseases and clinical conditions associated with LOC202400.

LOC202404 (Accession XP_114481.4) is another GAM2071 target gene, herein designated TARGET GENE. LOC202404 BINDING SITE is a target binding site found in the 3' untranslated region of mRNA encoded by LOC202404, corresponding to a target binding site such as BINDING SITE I, BINDING SITE II or BINDING SITE III of FIG. 8. Table 4 illustrates the complementarity of the nucleotide sequences of LOC202404 BINDING SITE, designated SEQ ID:15206, to the nucleotide sequence of GAM2071 RNA, herein designated GAM RNA, also designated SEQ ID:371.

Another function of GAM2071 is therefore inhibition of LOC202404 (Accession XP_114481.4). Accordingly, utilities of GAM2071 include diagnosis, prevention and treatment of diseases and clinical conditions associated with LOC202404.

LOC202460 (Accession XP_114493.1) is another GAM2071 target gene, herein designated TARGET GENE. LOC202460 BINDING SITE is a target binding site found in the 5' untranslated region of mRNA encoded by LOC202460, corresponding to a target binding site such as BINDING SITE I, BINDING SITE II or BINDING SITE III of FIG. 8. Table 4 illustrates the complementarity of the nucleotide sequences of LOC202460 BINDING SITE, designated SEQ ID:1278, to the nucleotide sequence of GAM2071 RNA, herein designated GAM RNA, also designated SEQ ID:371.

Another function of GAM2071 is therefore inhibition of LOC202460 (Accession XP_114493.1). Accordingly, utilities of GAM2071 include diagnosis, prevention and treatment of diseases and clinical conditions associated with LOC202460.

LOC202934 (Accession XP_117486.2) is another GAM2071 target gene, herein designated TARGET GENE. LOC202934 BINDING SITE1 and LOC202934 BINDING SITE2 are target binding sites found in untranslated regions of mRNA encoded by LOC202934, corresponding to target binding sites such as BINDING SITE I, BINDING SITE II or BINDING SITE III of FIG. 8. Table 4 illustrates the complementarity of the nucleotide sequences of LOC202934 BINDING SITE1 and LOC202934 BINDING SITE2, designated SEQ ID:9097 and SEQ ID:6782 respectively, to the nucleotide sequence of GAM2071 RNA, herein designated GAM RNA, also designated SEQ ID:371.

Another function of GAM2071 is therefore inhibition of LOC202934 (Accession XP_117486.2). Accordingly, utilities of GAM2071 include diagnosis, prevention and treatment of diseases and clinical conditions associated with LOC202934.

LOC203427 (Accession NP_660348.1) is another GAM2071 target gene, herein designated TARGET GENE. LOC203427 BINDING SITE is a target binding site found in the 3' untranslated region of mRNA encoded by LOC203427, corresponding to a target binding site such as BINDING SITE I, BINDING SITE II or BINDING SITE III of FIG. 8. Table 4 illustrates the complementarity of the nucleotide sequences of LOC203427 BINDING SITE, designated SEQ ID:11590, to the nucleotide sequence of GAM2071 RNA, herein designated GAM RNA, also designated SEQ ID:371.

Another function of GAM2071 is therefore inhibition of LOC203427 (Accession NP_660348.1). Accordingly, utilities of GAM2071 include diagnosis, prevention and treatment of diseases and clinical conditions associated with LOC203427.

LOC203547 (Accession XP_114719.1) is another GAM2071 target gene, herein designated TARGET GENE. LOC203547 BINDING SITE is a target binding site found in the 3' untranslated region of mRNA encoded by LOC203547, corresponding to a target binding site such as BINDING SITE I, BINDING SITE II or BINDING SITE III of FIG. 8. Table 4 illustrates the complementarity of the nucleotide sequences of LOC203547 BINDING SITE, designated SEQ ID:10631, to the nucleotide sequence of GAM2071 RNA, herein designated GAM RNA, also designated SEQ ID:371.

Another function of GAM2071 is therefore inhibition of LOC203547 (Accession XP_114719.1). Accordingly, utilities of GAM2071 include diagnosis, prevention and treatment of diseases and clinical conditions associated with LOC203547.

LOC219293 (Accession XP_166599.2) is another GAM2071 target gene, herein designated TARGET GENE. LOC219293 BINDING SITE is a target binding site found in the 3' untranslated region of mRNA encoded by LOC219293, corresponding to a target binding site such as BINDING SITE I, BINDING SITE II or BINDING SITE III of FIG. 8. Table 4 illustrates the complementarity of the nucleotide sequences of LOC219293 BINDING SITE, designated SEQ ID:12080, to the nucleotide sequence of GAM2071 RNA, herein designated GAM RNA, also designated SEQ ID:371.

Another function of GAM2071 is therefore inhibition of LOC219293 (Accession XP_166599.2). Accordingly, utilities of GAM2071 include diagnosis, prevention and treatment of diseases and clinical conditions associated with LOC219293.

LOC219731 (Accession XP_167596.1) is another GAM2071 target gene, herein designated TARGET GENE. LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:3320, to the nucleotide sequence of GAM2071 RNA, herein designated GAM RNA, also designated SEQ ID:371.

Another function of GAM2071 is therefore inhibition of LOC219731 (Accession XP_167596.1). Accordingly, utilities of GAM2071 include diagnosis, prevention and treatment of diseases and clinical conditions associated with LOC219731.

LOC219735 (Accession XP_167601.1) is another GAM2071 target gene, herein designated TARGET GENE. LOC219735 BINDING SITE is a target binding site found in the 3' untranslated region of mRNA encoded by LOC219735, corresponding to a target binding site such as BINDING SITE I, BINDING SITE II or BINDING SITE III of FIG. 8. Table 4 illustrates the complementarity of the nucleotide sequences of LOC219735 BINDING SITE, designated SEQ ID:3675, to the nucleotide sequence of GAM2071 RNA, herein designated GAM RNA, also designated SEQ ID:371.

Another function of GAM2071 is therefore inhibition of LOC219735 (Accession XP_167601.1). Accordingly, utilities of GAM2071 include diagnosis, prevention and treatment of diseases and clinical conditions associated with LOC219735.

LOC219894 (Accession XP_167782.1) is another GAM2071 target gene, herein designated TARGET GENE. LOC219894 BINDING SITE is a target binding site found in the 3' untranslated region of mRNA encoded by LOC219894, corresponding to a target binding site such as BINDING SITE I, BINDING SITE II or BINDING SITE III of FIG. 8. Table 4 illustrates the complementarity of the nucleotide sequences of LOC219894 BINDING SITE, designated SEQ ID:7138, to the nucleotide sequence of GAM2071 RNA, herein designated GAM RNA, also designated SEQ ID:371.

Another function of GAM2071 is therefore inhibition of LOC219894 (Accession XP_167782.1). Accordingly, utilities of GAM2071 include diagnosis, prevention and treatment of diseases and clinical conditions associated with LOC219894.

LOC220074 (Accession NP_660352.1) is another GAM2071 target gene, herein designated TARGET GENE. LOC220074 BINDING SITE1 through LOC220074 BINDING SITE3 are target binding sites found in untranslated regions of mRNA encoded by LOC220074, corresponding to target binding sites such as BINDING SITE I, BINDING SITE II or BINDING SITE III of FIG. 8. Table 4 illustrates the complementarity of the nucleotide sequences of LOC220074 BINDING SITE1 through LOC220074 BINDING SITE3, designated SEQ ID:1413, SEQ ID:2086 and SEQ ID:4396 respectively, to the nucleotide sequence of GAM2071 RNA, herein designated GAM RNA, also designated SEQ ID:371.

Another function of GAM2071 is therefore inhibition of LOC220074 (Accession NP_660352.1). Accordingly, utilities of GAM2071 include diagnosis, prevention and treatment of diseases and clinical conditions associated with LOC220074.

LOC220594 (Accession NP_665808.1) is another GAM2071 target gene, herein designated TARGET GENE. LOC220594 BINDING SITE is a target binding site found in the 5' untranslated region of mRNA encoded by LOC220594, corresponding to a target binding site such as BINDING SITE I, BINDING SITE II or BINDING SITE III of FIG. 8. Table 4 illustrates the complementarity of the nucleotide sequences of LOC220594 BINDING SITE, designated SEQ ID:6273, to the nucleotide sequence of GAM2071 RNA, herein designated GAM RNA, also designated SEQ ID:371.

Another function of GAM2071 is therefore inhibition of LOC220594 (Accession NP_665808.1). Accordingly, utilities of GAM2071 include diagnosis, prevention and treatment of diseases and clinical conditions associated with LOC220594.

LOC221663 (Accession XP_168131.1) is another GAM2071 target gene, herein designated TARGET GENE. LOC221663 BINDING SITE is a target binding site found in the 5' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:10616, to the nucleotide sequence of GAM2071 RNA, herein designated GAM RNA, also designated SEQ ID:371.

Another function of GAM2071 is therefore inhibition of LOC221663 (Accession XP_168131.1). Accordingly, utilities of GAM2071 include diagnosis, prevention and treatment of diseases and clinical conditions associated with LOC221663.

LOC221683 (Accession XP_168089.1) is another GAM2071 target gene, herein designated TARGET GENE. LOC221683 BINDING SITE is a target binding site found in the 5' untranslated region of mRNA encoded by LOC221683, corresponding to a target binding site such as BINDING SITE I, BINDING SITE II or BINDING SITE III of FIG. 8. Table 4 illustrates the complementarity of the nucleotide sequences of LOC221683 BINDING SITE, designated SEQ ID:1313, to the nucleotide sequence of GAM2071 RNA, herein designated GAM RNA, also designated SEQ ID:371.

Another function of GAM2071 is therefore inhibition of LOC221683 (Accession XP_168089.1). Accordingly, utilities of GAM2071 include diagnosis, prevention and treatment of diseases and clinical conditions associated with LOC221683.

LOC221814 (Accession XP_168226.1) is another GAM2071 target gene, herein designated TARGET GENE. LOC221814 BINDING SITE is a target binding site found in the 5' untranslated region of mRNA encoded by LOC221814, corresponding to a target binding site such as BINDING SITE I, BINDING SITE II or BINDING SITE III of FIG. 8. Table 4 illustrates the complementarity of the nucleotide sequences of LOC221814 BINDING SITE, designated SEQ ID:6429, to the nucleotide sequence of GAM2071 RNA, herein designated GAM RNA, also designated SEQ ID:371.

Another function of GAM2071 is therefore inhibition of LOC221814 (Accession XP_168226.1). Accordingly, utilities of GAM2071 include diagnosis, prevention and treatment of diseases and clinical conditions associated with LOC221814.

LOC221946 (Accession XP_168340.1) is another GAM2071 target gene, herein designated TARGET GENE. LOC221946 BINDING SITE is a target binding site found in the 3' untranslated region of mRNA encoded by LOC221946, corresponding to a target binding site such as BINDING SITE I, BINDING SITE II or BINDING SITE III of FIG. 8. Table 4 illustrates the complementarity of the nucleotide sequences of LOC221946 BINDING SITE, designated SEQ ID:3294, to the nucleotide sequence of GAM2071 RNA, herein designated GAM RNA, also designated SEQ ID:371.

Another function of GAM2071 is therefore inhibition of LOC221946 (Accession XP_168340.1). Accordingly, utilities of GAM2071 include diagnosis, prevention and treatment of diseases and clinical conditions associated with LOC221946.

LOC222057 (Accession XP_166594.2) is another GAM2071 target gene, herein designated TARGET GENE. LOC222057 BINDING SITE is a target binding site found in the 5' untranslated region of mRNA encoded by LOC222057, corresponding to a target binding site such as BINDING SITE I, BINDING SITE II or BINDING SITE III of FIG. 8. Table 4 illustrates the complementarity of the nucleotide sequences of LOC222057 BINDING SITE, designated SEQ ID:902, to the nucleotide sequence of GAM2071 RNA, herein designated GAM RNA, also designated SEQ ID:371.

Another function of GAM2071 is therefore inhibition of LOC222057 (Accession XP_166594.2). Accordingly, utilities of GAM2071 include diagnosis, prevention and treatment of diseases and clinical conditions associated with LOC222057.

LOC222068 (Accession XP_166556.1) is another GAM2071 target gene, herein designated TARGET GENE. LOC222068 BINDING SITE is a target binding site found in the 3' untranslated region of mRNA encoded by LOC222068, corresponding to a target binding site such as BINDING SITE I, BINDING SITE II or BINDING SITE III of FIG. 8. Table 4 illustrates the complementarity of the nucleotide sequences of LOC222068 BINDING SITE, designated SEQ ID:6331, to the nucleotide sequence of GAM2071 RNA, herein designated GAM RNA, also designated SEQ ID:371.

Another function of GAM2071 is therefore inhibition of LOC222068 (Accession XP_166556.1). Accordingly, utilities of GAM2071 include diagnosis, prevention and treatment of diseases and clinical conditions associated with LOC222068.

LOC252983 (Accession XP_170858.2) is another GAM2071 target gene, herein designated TARGET GENE. LOC252983 BINDING SITE is a target binding site found in the 3' untranslated region of mRNA encoded by LOC252983, corresponding to a target binding site such as BINDING SITE I, BINDING SITE II or BINDING SITE III of FIG. 8. Table 4 illustrates the complementarity of the nucleotide sequences of LOC252983 BINDING SITE, designated SEQ ID:8882, to the nucleotide sequence of GAM2071 RNA, herein designated GAM RNA, also designated SEQ ID:371.

Another function of GAM2071 is therefore inhibition of LOC252983 (Accession XP_170858.2). Accordingly, utilities of GAM2071 include diagnosis, prevention and treatment of diseases and clinical conditions associated with LOC252983.

LOC253216 (Accession XP_170765.2) is another GAM2071 target gene, herein designated TARGET GENE. LOC253216 BINDING SITE is a target binding site found in the 3' untranslated region of mRNA encoded by LOC253216, corresponding to a target binding site such as BINDING SITE I, BINDING SITE II or BINDING SITE III of FIG. 8. Table 4 illustrates the complementarity of the nucleotide sequences of LOC253216 BINDING SITE, designated SEQ ID:14534, to the nucleotide sequence of GAM2071 RNA, herein designated GAM RNA, also designated SEQ ID:371.

Another function of GAM2071 is therefore inhibition of LOC253216 (Accession XP_170765.2). Accordingly, utilities of GAM2071 include diagnosis, prevention and treatment of diseases and clinical conditions associated with LOC253216.

LOC253612 (Accession XP_172985.2) is another GAM2071 target gene, herein designated TARGET GENE. LOC253612 BINDING SITE is a target binding site found in the 5' untranslated region of mRNA encoded by LOC253612, corresponding to a target binding site such as BINDING SITE I, BINDING SITE II or BINDING SITE III of FIG. 8. Table 4 illustrates the complementarity of the nucleotide sequences of LOC253612 BINDING SITE, designated SEQ ID:19268, to the nucleotide sequence of GAM2071 RNA, herein designated GAM RNA, also designated SEQ ID:371.

Another function of GAM2071 is therefore inhibition of LOC253612 (Accession XP_172985.2). Accordingly, utilities of GAM2071 include diagnosis, prevention and treatment of diseases and clinical conditions associated with LOC253612.

LOC253805 (Accession XP_172854.1) is another GAM2071 target gene, herein designated TARGET GENE. LOC253805 BINDING SITE is a target binding site found in the 3' untranslated region of mRNA encoded by LOC253805, corresponding to a target binding site such as BINDING SITE I, BINDING SITE II or BINDING SITE III of FIG. 8. Table 4 illustrates the complementarity of the nucleotide sequences of LOC253805 BINDING SITE, designated SEQ ID:7275, to the nucleotide sequence of GAM2071 RNA, herein designated GAM RNA, also designated SEQ ID:371.

Another function of GAM2071 is therefore inhibition of LOC253805 (Accession XP_172854.1). Accordingly, utilities of GAM2071 include diagnosis, prevention and treatment of diseases and clinical conditions associated with LOC253805.

LOC255031 (Accession XP_173187.1) is another GAM2071 target gene, herein designated TARGET GENE. LOC255031 BINDING SITE is a target binding site found in the 3' untranslated region of mRNA encoded by LOC255031, corresponding to a target binding site such as BINDING SITE I, BINDING SITE II or BINDING SITE III of FIG. 8. Table 4 illustrates the complementarity of the nucleotide sequences of LOC255031 BINDING SITE, designated SEQ ID:11416, to the nucleotide sequence of GAM2071 RNA, herein designated GAM RNA, also designated SEQ ID:371.

Another function of GAM2071 is therefore inhibition of LOC255031 (Accession XP_173187.1). Accordingly, utilities of GAM2071 include diagnosis, prevention and treatment of diseases and clinical conditions associated with LOC255031.

LOC255488 (Accession XP_172581.2) is another GAM2071 target gene, herein designated TARGET GENE. LOC255488 BINDING SITE is a target binding site found in the 3' untranslated region of mRNA encoded by LOC255488, corresponding to a target binding site such as BINDING SITE I, BINDING SITE II or BINDING SITE III of FIG. 8. Table 4 illustrates the complementarity of the nucleotide sequences of LOC255488 BINDING SITE, designated SEQ ID:18594, to the nucleotide sequence of GAM2071 RNA, herein designated GAM RNA, also designated SEQ ID:371.

Another function of GAM2071 is therefore inhibition of LOC255488 (Accession XP_172581.2). Accordingly, utilities of GAM2071 include diagnosis, prevention and treatment of diseases and clinical conditions associated with LOC255488.

LOC255975 (Accession XP_171083.2) is another GAM2071 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:902, to the nucleotide sequence of GAM2071 RNA, herein designated GAM RNA, also designated SEQ ID:371.

Another function of GAM2071 is therefore inhibition of LOC255975 (Accession XP_171083.2). Accordingly, utilities of GAM2071 include diagnosis, prevention and treatment of diseases and clinical conditions associated with LOC255975.

LOC256614 (Accession XP_172864.1) is another GAM2071 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:3106, to the nucleotide sequence of GAM2071 RNA, herein designated GAM RNA, also designated SEQ ID:371.

Another function of GAM2071 is therefore inhibition of LOC256614 (Accession XP_172864.1). Accordingly, utilities of GAM2071 include diagnosis, prevention and treatment of diseases and clinical conditions associated with LOC256614.

LOC282905 (Accession XP_212606.1) is another GAM2071 target gene, herein designated TARGET GENE. LOC282905 BINDING SITE is a target binding site found in the 5' untranslated region of mRNA encoded by LOC282905, corresponding to a target binding site such as BINDING SITE I, BINDING SITE II or BINDING SITE III of FIG. 8. Table 4 illustrates the complementarity of the nucleotide sequences of LOC282905 BINDING SITE, designated SEQ ID:8939, to the nucleotide sequence of GAM2071 RNA, herein designated GAM RNA, also designated SEQ ID:371.

Another function of GAM2071 is therefore inhibition of LOC282905 (Accession XP_212606.1). Accordingly, utilities of GAM2071 include diagnosis, prevention and treatment of diseases and clinical conditions associated with LOC282905.

LOC282943 (Accession XP_212647.1) is another GAM2071 target gene, herein designated TARGET GENE.

LOC282943 BINDING SITE is a target binding site found in the 5' untranslated region of mRNA encoded by LOC282943, corresponding to a target binding site such as BINDING SITE I, BINDING SITE II or BINDING SITE III of FIG. 8. Table 4 illustrates the complementarity of the nucleotide sequences of LOC282943 BINDING SITE, designated SEQ ID:8939, to the nucleotide sequence of GAM2071 RNA, herein designated GAM RNA, also designated SEQ ID:371.

Another function of GAM2071 is therefore inhibition of LOC282943 (Accession XP_212647.1). Accordingly, utilities of GAM2071 include diagnosis, prevention and treatment of diseases and clinical conditions associated with LOC282943.

LOC282987 (Accession XP_210845.1) is another GAM2071 target gene, herein designated TARGET GENE. LOC282987 BINDING SITE1 and LOC282987 BINDING SITE2 are target binding sites found in untranslated regions of mRNA encoded by LOC282987, corresponding to target binding sites such as BINDING SITE I, BINDING SITE II or BINDING SITE III of FIG. 8. Table 4 illustrates the complementarity of the nucleotide sequences of LOC282987 BINDING SITE1 and LOC282987 BINDING SITE2, designated SEQ ID:12386 and SEQ ID:10460 respectively, to the nucleotide sequence of GAM2071 RNA, herein designated GAM RNA, also designated SEQ ID:371.

Another function of GAM2071 is therefore inhibition of LOC282987 (Accession XP_210845.1). Accordingly, utilities of GAM2071 include diagnosis, prevention and treatment of diseases and clinical conditions associated with LOC282987.

LOC283031 (Accession XP_210859.1) is another GAM2071 target gene, herein designated TARGET GENE. LOC283031 BINDING SITE is a target binding site found in the 3' untranslated region of mRNA encoded by LOC283031, corresponding to a target binding site such as BINDING SITE I, BINDING SITE II or BINDING SITE III of FIG. 8. Table 4 illustrates the complementarity of the nucleotide sequences of LOC283031 BINDING SITE, designated SEQ ID:654, to the nucleotide sequence of GAM2071 RNA, herein designated GAM RNA, also designated SEQ ID:371.

Another function of GAM2071 is therefore inhibition of LOC283031 (Accession XP_210859.1). Accordingly, utilities of GAM2071 include diagnosis, prevention and treatment of diseases and clinical conditions associated with LOC283031.

LOC283061 (Accession XP_210875.1) is another GAM2071 target gene, herein designated TARGET GENE. LOC283061 BINDING SITE is a target binding site found in the 3' untranslated region of mRNA encoded by LOC283061, corresponding to a target binding site such as BINDING SITE I, BINDING SITE II or BINDING SITE III of FIG. 8. Table 4 illustrates the complementarity of the nucleotide sequences of LOC283061 BINDING SITE, designated SEQ ID:18916, to the nucleotide sequence of GAM2071 RNA, herein designated GAM RNA, also designated SEQ ID:371.

Another function of GAM2071 is therefore inhibition of LOC283061 (Accession XP_210875.1). Accordingly, utilities of GAM2071 include diagnosis, prevention and treatment of diseases and clinical conditions associated with LOC283061.

LOC283067 (Accession XP_208501.1) is another GAM2071 target gene, herein designated TARGET GENE. LOC283067 BINDING SITE is a target binding site found in the 3' untranslated region of mRNA encoded by LOC283067, corresponding to a target binding site such as BINDING SITE I, BINDING SITE II or BINDING SITE III of FIG. 8. Table 4 illustrates the complementarity of the nucleotide sequences of LOC283067 BINDING SITE, designated SEQ ID:18641, to the nucleotide sequence of GAM2071 RNA, herein designated GAM RNA, also designated SEQ ID:371.

Another function of GAM2071 is therefore inhibition of LOC283067 (Accession XP_208501.1). Accordingly, utilities of GAM2071 include diagnosis, prevention and treatment of diseases and clinical conditions associated with LOC283067.

LOC283087 (Accession XP_208509.1) is another GAM2071 target gene, herein designated TARGET GENE. LOC283087 BINDING SITE is a target binding site found in the 3' untranslated region of mRNA encoded by LOC283087, corresponding to a target binding site such as BINDING SITE I, BINDING SITE II or BINDING SITE III of FIG. 8. Table 4 illustrates the complementarity of the nucleotide sequences of LOC283087 BINDING SITE, designated SEQ ID:6936, to the nucleotide sequence of GAM2071 RNA, herein designated GAM RNA, also designated SEQ ID:371.

Another function of GAM2071 is therefore inhibition of LOC283087 (Accession XP_208509.1). Accordingly, utilities of GAM2071 include diagnosis, prevention and treatment of diseases and clinical conditions associated with LOC283087.

LOC283089 (Accession XP_210885.1) is another GAM2071 target gene, herein designated TARGET GENE. LOC283089 BINDING SITE is a target binding site found in the 5' untranslated region of mRNA encoded by LOC283089, corresponding to a target binding site such as BINDING SITE I, BINDING SITE II or BINDING SITE III of FIG. 8. Table 4 illustrates the complementarity of the nucleotide sequences of LOC283089 BINDING SITE, designated SEQ ID:6866, to the nucleotide sequence of GAM2071 RNA, herein designated GAM RNA, also designated SEQ ID:371.

Another function of GAM2071 is therefore inhibition of LOC283089 (Accession XP_210885.1). Accordingly, utilities of GAM2071 include diagnosis, prevention and treatment of diseases and clinical conditions associated with LOC283089.

LOC283119 (Accession XP_210895.1) is another GAM2071 target gene, herein designated TARGET GENE. LOC283119 BINDING SITE is a target binding site found in the 3' untranslated region of mRNA encoded by LOC283119, corresponding to a target binding site such as BINDING SITE I, BINDING SITE II or BINDING SITE III of FIG. 8. Table 4 illustrates the complementarity of the nucleotide sequences of LOC283119 BINDING SITE, designated SEQ ID:1505, to the nucleotide sequence of GAM2071 RNA, herein designated GAM RNA, also designated SEQ ID:371.

Another function of GAM2071 is therefore inhibition of LOC283119 (Accession XP_210895.1). Accordingly, utilities of GAM2071 include diagnosis, prevention and treatment of diseases and clinical conditions associated with LOC283119.

LOC283130 (Accession XP_208525.3) is another GAM2071 target gene, herein designated TARGET GENE. LOC283130 BINDING SITE is a target binding site found in the 3' untranslated region of mRNA encoded by LOC283130, corresponding to a target binding site such as BINDING SITE I, BINDING SITE II or BINDING SITE III of FIG. 8. Table 4 illustrates the complementarity of the nucleotide sequences of LOC283130 BINDING SITE, designated SEQ ID:469, to the nucleotide sequence of GAM2071 RNA, herein designated GAM RNA, also designated SEQ ID:371.

Another function of GAM2071 is therefore inhibition of LOC283130 (Accession XP_208525.3). Accordingly, utilities of GAM2071 include diagnosis, prevention and treatment of diseases and clinical conditions associated with LOC283130.

LOC283143 (Accession XP_210920.1) is another GAM2071 target gene, herein designated TARGET GENE. LOC283143 BINDING SITE is a target binding site found in the 3' untranslated region of mRNA encoded by LOC283143, corresponding to a target binding site such as BINDING SITE I, BINDING SITE II or BINDING SITE III of FIG. 8. Table 4 illustrates the complementarity of the nucleotide sequences of LOC283143 BINDING SITE, designated SEQ ID:14843, to the nucleotide sequence of GAM2071 RNA, herein designated GAM RNA, also designated SEQ ID:371.

Another function of GAM2071 is therefore inhibition of LOC283143 (Accession XP_210920.1). Accordingly, utilities of GAM2071 include diagnosis, prevention and treatment of diseases and clinical conditions associated with LOC283143.

LOC283152 (Accession XP_210917.2) is another GAM2071 target gene, herein designated TARGET GENE. LOC283152 BINDING SITE is a target binding site found in the 5' untranslated region of mRNA encoded by LOC283152, corresponding to a target binding site such as BINDING SITE I, BINDING SITE II or BINDING SITE III of FIG. 8. Table 4 illustrates the complementarity of the nucleotide sequences of LOC283152 BINDING SITE, designated SEQ ID:17431, to the nucleotide sequence of GAM2071 RNA, herein designated GAM RNA, also designated SEQ ID:371.

Another function of GAM2071 is therefore inhibition of LOC283152 (Accession XP_210917.2). Accordingly, utilities of GAM2071 include diagnosis, prevention and treatment of diseases and clinical conditions associated with LOC283152.

LOC283170 (Accession XP_208535.1) is another GAM2071 target gene, herein designated TARGET GENE. LOC283170 BINDING SITE is a target binding site found in the 3' untranslated region of mRNA encoded by LOC283170, corresponding to a target binding site such as BINDING SITE I, BINDING SITE II or BINDING SITE III of FIG. 8. Table 4 illustrates the complementarity of the nucleotide sequences of LOC283170 BINDING SITE, designated SEQ ID:19643, to the nucleotide sequence of GAM2071 RNA, herein designated GAM RNA, also designated SEQ ID:371.

Another function of GAM2071 is therefore inhibition of LOC283170 (Accession XP_208535.1). Accordingly, utilities of GAM2071 include diagnosis, prevention and treatment of diseases and clinical conditions associated with LOC283170.

LOC283199 (Accession XP_210929.1) is another GAM2071 target gene, herein designated TARGET GENE. LOC283199 BINDING SITE1 and LOC283199 BINDING SITE2 are target binding sites found in untranslated regions of mRNA encoded by LOC283199, corresponding to target binding sites such as BINDING SITE I, BINDING SITE II or BINDING SITE III of FIG. 8. Table 4 illustrates the complementarity of the nucleotide sequences of LOC283199 BINDING SITE1 and LOC283199 BINDING SITE2, designated SEQ ID:20110 and SEQ ID:4762 respectively, to the nucleotide sequence of GAM2071 RNA, herein designated GAM RNA, also designated SEQ ID:371.

Another function of GAM2071 is therefore inhibition of LOC283199 (Accession XP_210929.1). Accordingly, utilities of GAM2071 include diagnosis, prevention and treatment of diseases and clinical conditions associated with LOC283199.

LOC283215 (Accession XP_208555.2) is another GAM2071 target gene, herein designated TARGET GENE. LOC283215 BINDING SITE is a target binding site found in the 3' untranslated region of mRNA encoded by LOC283215, corresponding to a target binding site such as BINDING SITE I, BINDING SITE II or BINDING SITE III of FIG. 8. Table 4 illustrates the complementarity of the nucleotide sequences of LOC283215 BINDING SITE, designated SEQ ID:14997, to the nucleotide sequence of GAM2071 RNA, herein designated GAM RNA, also designated SEQ ID:371.

Another function of GAM2071 is therefore inhibition of LOC283215 (Accession XP_208555.2). Accordingly, utilities of GAM2071 include diagnosis, prevention and treatment of diseases and clinical conditions associated with LOC283215.

LOC283241 (Accession NP_787089.1) is another GAM2071 target gene, herein designated TARGET GENE. LOC283241 BINDING SITE is a target binding site found in the 5' untranslated region of mRNA encoded by LOC283241, corresponding to a target binding site such as BINDING SITE I, BINDING SITE II or BINDING SITE III of FIG. 8. Table 4 illustrates the complementarity of the nucleotide sequences of LOC283241 BINDING SITE, designated SEQ ID:10625, to the nucleotide sequence of GAM2071 RNA, herein designated GAM RNA, also designated SEQ ID:371.

Another function of GAM2071 is therefore inhibition of LOC283241 (Accession NP_787089.1). Accordingly, utilities of GAM2071 include diagnosis, prevention and treatment of diseases and clinical conditions associated with LOC283241.

LOC283293 (Accession XP_210962.1) is another GAM2071 target gene, herein designated TARGET GENE. LOC283293 BINDING SITE is a target binding site found in the 3' untranslated region of mRNA encoded by LOC283293, corresponding to a target binding site such as BINDING SITE I, BINDING SITE II or BINDING SITE III of FIG. 8. Table 4 illustrates the complementarity of the nucleotide sequences of LOC283293 BINDING SITE, designated SEQ ID:438, to the nucleotide sequence of GAM2071 RNA, herein designated GAM RNA, also designated SEQ ID:371.

Another function of GAM2071 is therefore inhibition of LOC283293 (Accession XP_210962.1). Accordingly, utilities of GAM2071 include diagnosis, prevention and treatment of diseases and clinical conditions associated with LOC283293.

LOC283329 (Accession XP_210978.1) is another GAM2071 target gene, herein designated TARGET GENE. LOC283329 BINDING SITE is a target binding site found in the 5' untranslated region of mRNA encoded by LOC283329, corresponding to a target binding site such as BINDING SITE I, BINDING SITE II or BINDING SITE III of FIG. 8. Table 4 illustrates the complementarity of the nucleotide sequences of LOC283329 BINDING SITE, designated SEQ ID:6052, to the nucleotide sequence of GAM2071 RNA, herein designated GAM RNA, also designated SEQ ID:371.

Another function of GAM2071 is therefore inhibition of LOC283329 (Accession XP_210978.1). Accordingly, utilities of GAM2071 include diagnosis, prevention and treatment of diseases and clinical conditions associated with LOC283329.

LOC283335 (Accession XP_210981.1) is another GAM2071 target gene, herein designated TARGET GENE. LOC283335 BINDING SITE1 and LOC283335 BINDING SITE2 are target binding sites found in untranslated regions of mRNA encoded by LOC283335, corresponding to target binding sites such as BINDING SITE I, BINDING SITE II or BINDING SITE III of FIG. 8. Table 4 illustrates the complementarity of the nucleotide sequences of LOC283335 BINDING SITE1 and LOC283335 BINDING SITE2, designated SEQ ID:10626 and SEQ ID:9238 respectively, to the nucleotide sequence of GAM2071 RNA, herein designated GAM RNA, also designated SEQ ID:371.

Another function of GAM2071 is therefore inhibition of LOC283335 (Accession XP_210981.1). Accordingly, utilities of GAM2071 include diagnosis, prevention and treatment of diseases and clinical conditions associated with LOC283335.

LOC283377 (Accession XP_208647.1) is another GAM2071 target gene, herein designated TARGET GENE. LOC283377 BINDING SITE is a target binding site found in the 3' untranslated region of mRNA encoded by LOC283377, corresponding to a target binding site such as BINDING SITE I, BINDING SITE II or BINDING SITE III of FIG. 8. Table 4 illustrates the complementarity of the nucleotide sequences of LOC283377 BINDING SITE, designated SEQ ID:8862, to the nucleotide sequence of GAM2071 RNA, herein designated GAM RNA, also designated SEQ ID:371.

Another function of GAM2071 is therefore inhibition of LOC283377 (Accession XP_208647.1). Accordingly, utilities of GAM2071 include diagnosis, prevention and treatment of diseases and clinical conditions associated with LOC283377.

LOC283395 (Accession XP_211020.1) is another GAM2071 target gene, herein designated TARGET GENE. LOC283395 BINDING SITE is a target binding site found in the 3' untranslated region of mRNA encoded by LOC283395, corresponding to a target binding site such as BINDING SITE I, BINDING SITE II or BINDING SITE III of FIG. 8. Table 4 illustrates the complementarity of the nucleotide sequences of LOC283395 BINDING SITE, designated SEQ ID:13838, to the nucleotide sequence of GAM2071 RNA, herein designated GAM RNA, also designated SEQ ID:371.

Another function of GAM2071 is therefore inhibition of LOC283395 (Accession XP_211020.1). Accordingly, utilities of GAM2071 include diagnosis, prevention and treatment of diseases and clinical conditions associated with LOC283395.

LOC283432 (Accession XP_211032.1) is another GAM2071 target gene, herein designated TARGET GENE. LOC283432 BINDING SITE is a target binding site found in the 5' untranslated region of mRNA encoded by LOC283432, corresponding to a target binding site such as BINDING SITE I, BINDING SITE II or BINDING SITE III of FIG. 8. Table 4 illustrates the complementarity of the nucleotide sequences of LOC283432 BINDING SITE, designated SEQ ID:6836, to the nucleotide sequence of GAM2071 RNA, herein designated GAM RNA, also designated SEQ ID:371.

Another function of GAM2071 is therefore inhibition of LOC283432 (Accession XP_211032.1). Accordingly, utilities of GAM2071 include diagnosis, prevention and treatment of diseases and clinical conditions associated with LOC283432.

LOC283434 (Accession XP_211034.1) is another GAM2071 target gene, herein designated TARGET GENE. LOC283434 BINDING SITE is a target binding site found in the 5' untranslated region of mRNA encoded by LOC283434, corresponding to a target binding site such as BINDING SITE I, BINDING SITE II or BINDING SITE III of FIG. 8. Table 4 illustrates the complementarity of the nucleotide sequences of LOC283434 BINDING SITE, designated SEQ ID:16416, to the nucleotide sequence of GAM2071 RNA, herein designated GAM RNA, also designated SEQ ID:371.

Another function of GAM2071 is therefore inhibition of LOC283434 (Accession XP_211034.1). Accordingly, utilities of GAM2071 include diagnosis, prevention and treatment of diseases and clinical conditions associated with LOC283434.

LOC283445 (Accession XP_211044.1) is another GAM2071 target gene, herein designated TARGET GENE. LOC283445 BINDING SITE is a target binding site found in the 5' untranslated region of mRNA encoded by LOC283445, corresponding to a target binding site such as BINDING SITE I, BINDING SITE II or BINDING SITE III of FIG. 8. Table 4 illustrates the complementarity of the nucleotide sequences of LOC283445 BINDING SITE, designated SEQ ID:9159, to the nucleotide sequence of GAM2071 RNA, herein designated GAM RNA, also designated SEQ ID:371.

Another function of GAM2071 is therefore inhibition of LOC283445 (Accession XP_211044.1). Accordingly, utilities of GAM2071 include diagnosis, prevention and treatment of diseases and clinical conditions associated with LOC283445.

LOC283452 (Accession XP_208679.1) is another GAM2071 target gene, herein designated TARGET GENE. LOC283452 BINDING SITE is a target binding site found in the 5' untranslated region of mRNA encoded by LOC283452, corresponding to a target binding site such as BINDING SITE I, BINDING SITE II or BINDING SITE III of FIG. 8. Table 4 illustrates the complementarity of the nucleotide sequences of LOC283452 BINDING SITE, designated SEQ ID:17791, to the nucleotide sequence of GAM2071 RNA, herein designated GAM RNA, also designated SEQ ID:371.

Another function of GAM2071 is therefore inhibition of LOC283452 (Accession XP_208679.1). Accordingly, utilities of GAM2071 include diagnosis, prevention and treatment of diseases and clinical conditions associated with LOC283452.

LOC283454 (Accession XP_211049.1) is another GAM2071 target gene, herein designated TARGET GENE. LOC283454 BINDING SITE is a target binding site found in the 5' untranslated region of mRNA encoded by LOC283454, corresponding to a target binding site such as BINDING SITE I, BINDING SITE II or BINDING SITE III of FIG. 8. Table 4 illustrates the complementarity of the nucleotide sequences of LOC283454 BINDING SITE, designated SEQ ID:12385, to the nucleotide sequence of GAM2071 RNA, herein designated GAM RNA, also designated SEQ ID:371.

Another function of GAM2071 is therefore inhibition of LOC283454 (Accession XP_211049.1). Accordingly, utilities of GAM2071 include diagnosis, prevention and treatment of diseases and clinical conditions associated with LOC283454.

LOC283475 (Accession XP_211056.1) is another GAM2071 target gene, herein designated TARGET GENE. LOC283475 BINDING SITE1 and LOC283475 BINDING SITE2 are target binding sites found in untranslated regions of mRNA encoded by LOC283475, corresponding to target binding sites such as BINDING SITE I, BINDING SITE II or BINDING SITE III of FIG. 8. Table 4 illustrates the complementarity of the nucleotide sequences of LOC283475 BINDING SITE1 and LOC283475 BINDING SITE2, designated SEQ ID:8583 and SEQ ID:12806 respectively, to the nucleotide sequence of GAM2071 RNA, herein designated GAM RNA, also designated SEQ ID:371.

Another function of GAM2071 is therefore inhibition of LOC283475 (Accession XP_211056.1). Accordingly, utilities of GAM2071 include diagnosis, prevention and treatment of diseases and clinical conditions associated with LOC283475.

LOC283507 (Accession XP_211075.1) is another GAM2071 target gene, herein designated TARGET GENE.

LOC283507 BINDING SITE is a target binding site found in the 3' untranslated region of mRNA encoded by LOC283507, corresponding to a target binding site such as BINDING SITE I, BINDING SITE II or BINDING SITE III of FIG. 8. Table 4 illustrates the complementarity of the nucleotide sequences of LOC283507 BINDING SITE, designated SEQ ID:18182, to the nucleotide sequence of GAM2071 RNA, herein designated GAM RNA, also designated SEQ ID:371.

Another function of GAM2071 is therefore inhibition of LOC283507 (Accession XP_211075.1). Accordingly, utilities of GAM2071 include diagnosis, prevention and treatment of diseases and clinical conditions associated with LOC283507.

LOC283534 (Accession XP_211083.1) is another GAM2071 target gene, herein designated TARGET GENE. LOC283534 BINDING SITE is a target binding site found in the 3' untranslated region of mRNA encoded by LOC283534, corresponding to a target binding site such as BINDING SITE I, BINDING SITE II or BINDING SITE III of FIG. 8. Table 4 illustrates the complementarity of the nucleotide sequences of LOC283534 BINDING SITE, designated SEQ ID:13197, to the nucleotide sequence of GAM2071 RNA, herein designated GAM RNA, also designated SEQ ID:371.

Another function of GAM2071 is therefore inhibition of LOC283534 (Accession XP_211083.1). Accordingly, utilities of GAM2071 include diagnosis, prevention and treatment of diseases and clinical conditions associated with LOC283534.

LOC283565 (Accession XP_211100.1) is another GAM2071 target gene, herein designated TARGET GENE. LOC283565 BINDING SITE is a target binding site found in the 5' untranslated region of mRNA encoded by LOC283565, corresponding to a target binding site such as BINDING SITE I, BINDING SITE II or BINDING SITE III of FIG. 8. Table 4 illustrates the complementarity of the nucleotide sequences of LOC283565 BINDING SITE, designated SEQ ID:6104, to the nucleotide sequence of GAM2071 RNA, herein designated GAM RNA, also designated SEQ ID:371.

Another function of GAM2071 is therefore inhibition of LOC283565 (Accession XP_211100.1). Accordingly, utilities of GAM2071 include diagnosis, prevention and treatment of diseases and clinical conditions associated with LOC283565.

LOC283585 (Accession XP_294741.1) is another GAM2071 target gene, herein designated TARGET GENE. LOC283585 BINDING SITE is a target binding site found in the 5' untranslated region of mRNA encoded by LOC283585, corresponding to a target binding site such as BINDING SITE I, BINDING SITE II or BINDING SITE III of FIG. 8. Table 4 illustrates the complementarity of the nucleotide sequences of LOC283585 BINDING SITE, designated SEQ ID:3904, to the nucleotide sequence of GAM2071 RNA, herein designated GAM RNA, also designated SEQ ID:371.

Another function of GAM2071 is therefore inhibition of LOC283585 (Accession XP_294741.1). Accordingly, utilities of GAM2071 include diagnosis, prevention and treatment of diseases and clinical conditions associated with LOC283585.

LOC283588 (Accession NP_787093.1) is another GAM2071 target gene, herein designated TARGET GENE. LOC283588 BINDING SITE is a target binding site found in the 3' untranslated region of mRNA encoded by LOC283588, corresponding to a target binding site such as BINDING SITE I, BINDING SITE II or BINDING SITE III of FIG. 8. Table 4 illustrates the complementarity of the nucleotide sequences of LOC283588 BINDING SITE, designated SEQ ID:14938, to the nucleotide sequence of GAM2071 RNA, herein designated GAM RNA, also designated SEQ ID:371.

Another function of GAM2071 is therefore inhibition of LOC283588 (Accession NP_787093.1). Accordingly, utilities of GAM2071 include diagnosis, prevention and treatment of diseases and clinical conditions associated with LOC283588.

LOC283624 (Accession XP_211126.1) is another GAM2071 target gene, herein designated TARGET GENE. LOC283624 BINDING SITE is a target binding site found in the 5' untranslated region of mRNA encoded by LOC283624, corresponding to a target binding site such as BINDING SITE I, BINDING SITE II or BINDING SITE III of FIG. 8. Table 4 illustrates the complementarity of the nucleotide sequences of LOC283624 BINDING SITE, designated SEQ ID:13972, to the nucleotide sequence of GAM2071 RNA, herein designated GAM RNA, also designated SEQ ID:371.

Another function of GAM2071 is therefore inhibition of LOC283624 (Accession XP_211126.1). Accordingly, utilities of GAM2071 include diagnosis, prevention and treatment of diseases and clinical conditions associated with LOC283624.

LOC283637 (Accession XP_211134.1) is another GAM2071 target gene, herein designated TARGET GENE. LOC283637 BINDING SITE1 and LOC283637 BINDING SITE2 are target binding sites found in untranslated regions of mRNA encoded by LOC283637, corresponding to target binding sites such as BINDING SITE I, BINDING SITE II or BINDING SITE III of FIG. 8. Table 4 illustrates the complementarity of the nucleotide sequences of LOC283637 BINDING SITE1 and LOC283637 BINDING SITE2, designated SEQ ID:12382 and SEQ ID:3786 respectively, to the nucleotide sequence of GAM2071 RNA, herein designated GAM RNA, also designated SEQ ID:371.

Another function of GAM2071 is therefore inhibition of LOC283637 (Accession XP_211134.1). Accordingly, utilities of GAM2071 include diagnosis, prevention and treatment of diseases and clinical conditions associated with LOC283637.

LOC283641 (Accession XP_208764.1) is another GAM2071 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:435, to the nucleotide sequence of GAM2071 RNA, herein designated GAM RNA, also designated SEQ ID:371.

Another function of GAM2071 is therefore inhibition of LOC283641 (Accession XP_208764.1). Accordingly, utilities of GAM2071 include diagnosis, prevention and treatment of diseases and clinical conditions associated with LOC283641.

LOC283664 (Accession XP_208773.1) is another GAM2071 target gene, herein designated TARGET GENE. LOC283664 BINDING SITE is a target binding site found in the 5' untranslated region of mRNA encoded by LOC283664, corresponding to a target binding site such as BINDING SITE I, BINDING SITE II or BINDING SITE III of FIG. 8. Table 4 illustrates the complementarity of the nucleotide sequences of LOC283664 BINDING SITE, designated SEQ ID:11292, to the nucleotide sequence of GAM2071 RNA, herein designated GAM RNA, also designated SEQ ID:371.

Another function of GAM2071 is therefore inhibition of LOC283664 (Accession XP_208773.1). Accordingly, utilities of GAM2071 include diagnosis, prevention and treatment of diseases and clinical conditions associated with LOC283664.

LOC283679 (Accession XP_211157.1) is another GAM2071 target gene, herein designated TARGET GENE. LOC283679 BINDING SITE is a target binding site found in the 5' untranslated region of mRNA encoded by LOC283679, corresponding to a target binding site such as BINDING SITE I, BINDING SITE II or BINDING SITE III of FIG. 8. Table 4 illustrates the complementarity of the nucleotide sequences of LOC283679 BINDING SITE, designated SEQ ID:18582, to the nucleotide sequence of GAM2071 RNA, herein designated GAM RNA, also designated SEQ ID:371.

Another function of GAM2071 is therefore inhibition of LOC283679 (Accession XP_211157.1). Accordingly, utilities of GAM2071 include diagnosis, prevention and treatment of diseases and clinical conditions associated with LOC283679.

LOC283687 (Accession NP_787094.1) is another GAM2071 target gene, herein designated TARGET GENE. LOC283687 BINDING SITE is a target binding site found in the 3' untranslated region of mRNA encoded by LOC283687, corresponding to a target binding site such as BINDING SITE I, BINDING SITE II or BINDING SITE III of FIG. 8. Table 4 illustrates the complementarity of the nucleotide sequences of LOC283687 BINDING SITE, designated SEQ ID:5544, to the nucleotide sequence of GAM2071 RNA, herein designated GAM RNA, also designated SEQ ID:371.

Another function of GAM2071 is therefore inhibition of LOC283687 (Accession NP_787094.1). Accordingly, utilities of GAM2071 include diagnosis, prevention and treatment of diseases and clinical conditions associated with LOC283687.

LOC283701 (Accession XP_211170.3) is another GAM2071 target gene, herein designated TARGET GENE. LOC283701 BINDING SITE1 and LOC283701 BINDING SITE2 are target binding sites found in untranslated regions of mRNA encoded by LOC283701, corresponding to target binding sites such as BINDING SITE I, BINDING SITE II or BINDING SITE III of FIG. 8. Table 4 illustrates the complementarity of the nucleotide sequences of LOC283701 BINDING SITE1 and LOC283701 BINDING SITE2, designated SEQ ID:7650 and SEQ ID:777 respectively, to the nucleotide sequence of GAM2071 RNA, herein designated GAM RNA, also designated SEQ ID:371.

Another function of GAM2071 is therefore inhibition of LOC283701 (Accession XP_211170.3). Accordingly, utilities of GAM2071 include diagnosis, prevention and treatment of diseases and clinical conditions associated with LOC283701.

LOC283706 (Accession XP_208804.3) is another GAM2071 target gene, herein designated TARGET GENE. LOC283706 BINDING SITE is a target binding site found in the 3' untranslated region of mRNA encoded by LOC283706, corresponding to a target binding site such as BINDING SITE I, BINDING SITE II or BINDING SITE III of FIG. 8. Table 4 illustrates the complementarity of the nucleotide sequences of LOC283706 BINDING SITE, designated SEQ ID:16154, to the nucleotide sequence of GAM2071 RNA, herein designated GAM RNA, also designated SEQ ID:371.

Another function of GAM2071 is therefore inhibition of LOC283706 (Accession XP_208804.3). Accordingly, utilities of GAM2071 include diagnosis, prevention and treatment of diseases and clinical conditions associated with LOC283706.

LOC283741 (Accession XP_208115.1) is another GAM2071 target gene, herein designated TARGET GENE. LOC283741 BINDING SITE is a target binding site found in the 3' untranslated region of mRNA encoded by LOC283741, corresponding to a target binding site such as BINDING SITE I, BINDING SITE II or BINDING SITE III of FIG. 8. Table 4 illustrates the complementarity of the nucleotide sequences of LOC283741 BINDING SITE, designated SEQ ID:3109, to the nucleotide sequence of GAM2071 RNA, herein designated GAM RNA, also designated SEQ ID:371.

Another function of GAM2071 is therefore inhibition of LOC283741 (Accession XP_208115.1). Accordingly, utilities of GAM2071 include diagnosis, prevention and treatment of diseases and clinical conditions associated with LOC283741.

LOC283778 (Accession XP_211199.1) is another GAM2071 target gene, herein designated TARGET GENE. LOC283778 BINDING SITE is a target binding site found in the 5' untranslated region of mRNA encoded by LOC283778, corresponding to a target binding site such as BINDING SITE I, BINDING SITE II or BINDING SITE III of FIG. 8. Table 4 illustrates the complementarity of the nucleotide sequences of LOC283778 BINDING SITE, designated SEQ ID:15679, to the nucleotide sequence of GAM2071 RNA, herein designated GAM RNA, also designated SEQ ID:371.

Another function of GAM2071 is therefore inhibition of LOC283778 (Accession XP_211199.1). Accordingly, utilities of GAM2071 include diagnosis, prevention and treatment of diseases and clinical conditions associated with LOC283778.

LOC283801 (Accession XP_208122.1) is another GAM2071 target gene, herein designated TARGET GENE. LOC283801 BINDING SITE is a target binding site found in the 3' untranslated region of mRNA encoded by LOC283801, corresponding to a target binding site such as BINDING SITE I, BINDING SITE II or BINDING SITE III of FIG. 8. Table 4 illustrates the complementarity of the nucleotide sequences of LOC283801 BINDING SITE, designated SEQ ID:11237, to the nucleotide sequence of GAM2071 RNA, herein designated GAM RNA, also designated SEQ ID:371.

Another function of GAM2071 is therefore inhibition of LOC283801 (Accession XP_208122.1). Accordingly, utilities of GAM2071 include diagnosis, prevention and treatment of diseases and clinical conditions associated with LOC283801.

LOC283802 (Accession XP_208850.1) is another GAM2071 target gene, herein designated TARGET GENE. LOC283802 BINDING SITE is a target binding site found in the 3' untranslated region of mRNA encoded by LOC283802, corresponding to a target binding site such as BINDING SITE I, BINDING SITE II or BINDING SITE III of FIG. 8. Table 4 illustrates the complementarity of the nucleotide sequences of LOC283802 BINDING SITE, designated SEQ ID:16635, to the nucleotide sequence of GAM2071 RNA, herein designated GAM RNA, also designated SEQ ID:371.

Another function of GAM2071 is therefore inhibition of LOC283802 (Accession XP_208850.1). Accordingly, utilities of GAM2071 include diagnosis, prevention and treatment of diseases and clinical conditions associated with LOC283802.

LOC283818 (Accession XP_211218.1) is another GAM2071 target gene, herein designated TARGET GENE. LOC283818 BINDING SITE is a target binding site found in the 3' untranslated region of mRNA encoded by LOC283818, corresponding to a target binding site such as BINDING SITE I, BINDING SITE II or BINDING SITE III of FIG. 8. Table 4 illustrates the complementarity of the nucleotide sequences of LOC283818 BINDING SITE, designated SEQ ID:3834, to the nucleotide sequence of GAM2071 RNA, herein designated GAM RNA, also designated SEQ ID:371.

Another function of GAM2071 is therefore inhibition of LOC283818 (Accession XP_211218.1). Accordingly, utilities of GAM2071 include diagnosis, prevention and treatment of diseases and clinical conditions associated with LOC283818.

LOC283851 (Accession XP_211229.1) is another GAM2071 target gene, herein designated TARGET GENE. LOC283851 BINDING SITE is a target binding site found in the 3' untranslated region of mRNA encoded by LOC283851, corresponding to a target binding site such as BINDING SITE I, BINDING SITE II or BINDING SITE III of FIG. 8. Table 4 illustrates the complementarity of the nucleotide sequences of LOC283851 BINDING SITE, designated SEQ ID:12708, to the nucleotide sequence of GAM2071 RNA, herein designated GAM RNA, also designated SEQ ID:371.

Another function of GAM2071 is therefore inhibition of LOC283851 (Accession XP_211229.1). Accordingly, utilities of GAM2071 include diagnosis, prevention and treatment of diseases and clinical conditions associated with LOC283851.

LOC283861 (Accession NP_787095.1) is another GAM2071 target gene, herein designated TARGET GENE. LOC283861 BINDING SITE1 and LOC283861 BINDING SITE2 are target binding sites found in untranslated regions of mRNA encoded by LOC283861, corresponding to target binding sites such as BINDING SITE I, BINDING SITE II or BINDING SITE III of FIG. 8. Table 4 illustrates the complementarity of the nucleotide sequences of LOC283861 BINDING SITE1 and LOC283861 BINDING SITE2, designated SEQ ID:10879 and SEQ ID:8996 respectively, to the nucleotide sequence of GAM2071 RNA, herein designated GAM RNA, also designated SEQ ID:371.

Another function of GAM2071 is therefore inhibition of LOC283861 (Accession NP_787095.1). Accordingly, utilities of GAM2071 include diagnosis, prevention and treatment of diseases and clinical conditions associated with LOC283861.

LOC283887 (Accession XP_211248.2) is another GAM2071 target gene, herein designated TARGET GENE. LOC283887 BINDING SITE is a target binding site found in the 5' untranslated region of mRNA encoded by LOC283887, corresponding to a target binding site such as BINDING SITE I, BINDING SITE II or BINDING SITE III of FIG. 8. Table 4 illustrates the complementarity of the nucleotide sequences of LOC283887 BINDING SITE, designated SEQ ID:9775, to the nucleotide sequence of GAM2071 RNA, herein designated GAM RNA, also designated SEQ ID:371.

Another function of GAM2071 is therefore inhibition of LOC283887 (Accession XP_211248.2). Accordingly, utilities of GAM2071 include diagnosis, prevention and treatment of diseases and clinical conditions associated with LOC283887.

LOC283889 (Accession XP_208899.1) is another GAM2071 target gene, herein designated TARGET GENE. LOC283889 BINDING SITE is a target binding site found in the 3' untranslated region of mRNA encoded by LOC283889, corresponding to a target binding site such as BINDING SITE I, BINDING SITE II or BINDING SITE III of FIG. 8. Table 4 illustrates the complementarity of the nucleotide sequences of LOC283889 BINDING SITE, designated SEQ ID:13686, to the nucleotide sequence of GAM2071 RNA, herein designated GAM RNA, also designated SEQ ID:371.

Another function of GAM2071 is therefore inhibition of LOC283889 (Accession XP_208899.1). Accordingly, utilities of GAM2071 include diagnosis, prevention and treatment of diseases and clinical conditions associated with LOC283889.

LOC283928 (Accession XP_208909.1) is another GAM2071 target gene, herein designated TARGET GENE. LOC283928 BINDING SITE1 through LOC283928 BINDING SITE3 are target binding sites found in untranslated regions of mRNA encoded by LOC283928, corresponding to target binding sites such as BINDING SITE I, BINDING SITE II or BINDING SITE III of FIG. 8. Table 4 illustrates the complementarity of the nucleotide sequences of LOC283928 BINDING SITE1 through LOC283928 BINDING SITE3, designated SEQ ID:3604, SEQ ID:9603 and SEQ ID:13293 respectively, to the nucleotide sequence of GAM2071 RNA, herein designated GAM RNA, also designated SEQ ID:371.

Another function of GAM2071 is therefore inhibition of LOC283928 (Accession XP_208909.1). Accordingly, utilities of GAM2071 include diagnosis, prevention and treatment of diseases and clinical conditions associated with LOC283928.

LOC283929 (Accession XP_208905.2) is another GAM2071 target gene, herein designated TARGET GENE. LOC283929 BINDING SITE is a target binding site found in the 5' untranslated region of mRNA encoded by LOC283929, corresponding to a target binding site such as BINDING SITE I, BINDING SITE II or BINDING SITE III of FIG. 8. Table 4 illustrates the complementarity of the nucleotide sequences of LOC283929 BINDING SITE, designated SEQ ID:10232, to the nucleotide sequence of GAM2071 RNA, herein designated GAM RNA, also designated SEQ ID:371.

Another function of GAM2071 is therefore inhibition of LOC283929 (Accession XP_208905.2). Accordingly, utilities of GAM2071 include diagnosis, prevention and treatment of diseases and clinical conditions associated with LOC283929.

LOC283932 (Accession NP_787097.1) is another GAM2071 target gene, herein designated TARGET GENE. LOC283932 BINDING SITE is a target binding site found in the 3' untranslated region of mRNA encoded by LOC283932, corresponding to a target binding site such as BINDING SITE I, BINDING SITE II or BINDING SITE III of FIG. 8. Table 4 illustrates the complementarity of the nucleotide sequences of LOC283932 BINDING SITE, designated SEQ ID:15305, to the nucleotide sequence of GAM2071 RNA, herein designated GAM RNA, also designated SEQ ID:371.

Another function of GAM2071 is therefore inhibition of LOC283932 (Accession NP_787097.1). Accordingly, utilities of GAM2071 include diagnosis, prevention and treatment of diseases and clinical conditions associated with LOC283932.

LOC283964 (Accession XP_208145.2) is another GAM2071 target gene, herein designated TARGET GENE. LOC283964 BINDING SITE is a target binding site found in the 3' untranslated region of mRNA encoded by LOC283964, corresponding to a target binding site such as BINDING SITE I, BINDING SITE II or BINDING SITE III of FIG. 8. Table 4 illustrates the complementarity of the nucleotide sequences of LOC283964 BINDING SITE, designated SEQ ID:1384, to the nucleotide sequence of GAM2071 RNA, herein designated GAM RNA, also designated SEQ ID:371.

Another function of GAM2071 is therefore inhibition of LOC283964 (Accession XP_208145.2). Accordingly, utilities of GAM2071 include diagnosis, prevention and treatment of diseases and clinical conditions associated with LOC283964.

LOC284001 (Accession XP_208958.2) is another GAM2071 target gene, herein designated TARGET GENE.

LOC284001 BINDING SITE is a target binding site found in the 3' untranslated region of mRNA encoded by LOC284001, corresponding to a target binding site such as BINDING SITE I, BINDING SITE II or BINDING SITE III of FIG. 8. Table 4 illustrates the complementarity of the nucleotide sequences of LOC284001 BINDING SITE, designated SEQ ID:6195, to the nucleotide sequence of GAM2071 RNA, herein designated GAM RNA, also designated SEQ ID:371.

Another function of GAM2071 is therefore inhibition of LOC284001 (Accession XP_208958.2). Accordingly, utilities of GAM2071 include diagnosis, prevention and treatment of diseases and clinical conditions associated with LOC284001.

LOC284017 (Accession XP_208961.1) is another GAM2071 target gene, herein designated TARGET GENE. LOC284017 BINDING SITE is a target binding site found in the 3' untranslated region of mRNA encoded by LOC284017, corresponding to a target binding site such as BINDING SITE I, BINDING SITE II or BINDING SITE III of FIG. 8. Table 4 illustrates the complementarity of the nucleotide sequences of LOC284017 BINDING SITE, designated SEQ ID:3858, to the nucleotide sequence of GAM2071 RNA, herein designated GAM RNA, also designated SEQ ID:371.

Another function of GAM2071 is therefore inhibition of LOC284017 (Accession XP_208961.1). Accordingly, utilities of GAM2071 include diagnosis, prevention and treatment of diseases and clinical conditions associated with LOC284017.

LOC284023 (Accession XP_208983.3) is another GAM2071 target gene, herein designated TARGET GENE. LOC284023 BINDING SITE1 and LOC284023 BINDING SITE2 are target binding sites found in untranslated regions of mRNA encoded by LOC284023, corresponding to target binding sites such as BINDING SITE I, BINDING SITE II or BINDING SITE III of FIG. 8. Table 4 illustrates the complementarity of the nucleotide sequences of LOC284023 BINDING SITE1 and LOC284023 BINDING SITE2, designated SEQ ID:429 and SEQ ID:5520 respectively, to the nucleotide sequence of GAM2071 RNA, herein designated GAM RNA, also designated SEQ ID:371.

Another function of GAM2071 is therefore inhibition of LOC284023 (Accession XP_208983.3). Accordingly, utilities of GAM2071 include diagnosis, prevention and treatment of diseases and clinical conditions associated with LOC284023.

LOC284048 (Accession XP_208152.1) is another GAM2071 target gene, herein designated TARGET GENE. LOC284048 BINDING SITE is a target binding site found in the 3' untranslated region of mRNA encoded by LOC284048, corresponding to a target binding site such as BINDING SITE I, BINDING SITE II or BINDING SITE III of FIG. 8. Table 4 illustrates the complementarity of the nucleotide sequences of LOC284048 BINDING SITE, designated SEQ ID:17222, to the nucleotide sequence of GAM2071 RNA, herein designated GAM RNA, also designated SEQ ID:371.

Another function of GAM2071 is therefore inhibition of LOC284048 (Accession XP_208152.1). Accordingly, utilities of GAM2071 include diagnosis, prevention and treatment of diseases and clinical conditions associated with LOC284048.

LOC284063 (Accession XP_208992.1) is another GAM2071 target gene, herein designated TARGET GENE. LOC284063 BINDING SITE is a target binding site found in the 3' untranslated region of mRNA encoded by LOC284063, corresponding to a target binding site such as BINDING SITE I, BINDING SITE II or BINDING SITE III of FIG. 8. Table 4 illustrates the complementarity of the nucleotide sequences of LOC284063 BINDING SITE, designated SEQ ID:17713, to the nucleotide sequence of GAM2071 RNA, herein designated GAM RNA, also designated SEQ ID:371.

Another function of GAM2071 is therefore inhibition of LOC284063 (Accession XP_208992.1). Accordingly, utilities of GAM2071 include diagnosis, prevention and treatment of diseases and clinical conditions associated with LOC284063.

LOC284074 (Accession XP_211321.1) is another GAM2071 target gene, herein designated TARGET GENE. LOC284074 BINDING SITE1 and LOC284074 BINDING SITE2 are target binding sites found in untranslated regions of mRNA encoded by LOC284074, corresponding to target binding sites such as BINDING SITE I, BINDING SITE II or BINDING SITE III of FIG. 8. Table 4 illustrates the complementarity of the nucleotide sequences of LOC284074 BINDING SITE1 and LOC284074 BINDING SITE2, designated SEQ ID:18547 and SEQ ID:5751 respectively, to the nucleotide sequence of GAM2071 RNA, herein designated GAM RNA, also designated SEQ ID:371.

Another function of GAM2071 is therefore inhibition of LOC284074 (Accession XP_211321.1). Accordingly, utilities of GAM2071 include diagnosis, prevention and treatment of diseases and clinical conditions associated with LOC284074.

LOC284082 (Accession XP_211323.1) is another GAM2071 target gene, herein designated TARGET GENE. LOC284082 BINDING SITE is a target binding site found in the 3' untranslated region of mRNA encoded by LOC284082, corresponding to a target binding site such as BINDING SITE I, BINDING SITE II or BINDING SITE III of FIG. 8. Table 4 illustrates the complementarity of the nucleotide sequences of LOC284082 BINDING SITE, designated SEQ ID:18527, to the nucleotide sequence of GAM2071 RNA, herein designated GAM RNA, also designated SEQ ID:371.

Another function of GAM2071 is therefore inhibition of LOC284082 (Accession XP_211323.1). Accordingly, utilities of GAM2071 include diagnosis, prevention and treatment of diseases and clinical conditions associated with LOC284082.

LOC284095 (Accession XP_211324.1) is another GAM2071 target gene, herein designated TARGET GENE. LOC284095 BINDING SITE1 and LOC284095 BINDING SITE2 are target binding sites found in untranslated regions of mRNA encoded by LOC284095, corresponding to target binding sites such as BINDING SITE I, BINDING SITE II or BINDING SITE III of FIG. 8. Table 4 illustrates the complementarity of the nucleotide sequences of LOC284095 BINDING SITE1 and LOC284095 BINDING SITE2, designated SEQ ID:19595 and SEQ ID:16884 respectively, to the nucleotide sequence of GAM2071 RNA, herein designated GAM RNA, also designated SEQ ID:371.

Another function of GAM2071 is therefore inhibition of LOC284095 (Accession XP_211324.1). Accordingly, utilities of GAM2071 include diagnosis, prevention and treatment of diseases and clinical conditions associated with LOC284095.

LOC284098 (Accession XP_209008.3) is another GAM2071 target gene, herein designated TARGET GENE. LOC284098 BINDING SITE is a target binding site found in the 3' untranslated region of mRNA encoded by LOC284098, corresponding to a target binding site such as BINDING SITE I, BINDING SITE II or BINDING SITE III of FIG. 8. Table 4 illustrates the complementarity of the nucleotide sequences of LOC284098 BINDING SITE, designated SEQ ID:18178, to the nucleotide sequence of GAM2071 RNA, herein designated GAM RNA, also designated SEQ ID:371.

Another function of GAM2071 is therefore inhibition of LOC284098 (Accession XP_209008.3). Accordingly, utilities of GAM2071 include diagnosis, prevention and treatment of diseases and clinical conditions associated with LOC284098.

LOC284102 (Accession XP_211327.3) is another GAM2071 target gene, herein designated TARGET GENE. LOC284102 BINDING SITE is a target binding site found in the 5' untranslated region of mRNA encoded by LOC284102, corresponding to a target binding site such as BINDING SITE I, BINDING SITE II or BINDING SITE III of FIG. 8. Table 4 illustrates the complementarity of the nucleotide sequences of LOC284102 BINDING SITE, designated SEQ ID:17111, to the nucleotide sequence of GAM2071 RNA, herein designated GAM RNA, also designated SEQ ID:371.

Another function of GAM2071 is therefore inhibition of LOC284102 (Accession XP_211327.3). Accordingly, utilities of GAM2071 include diagnosis, prevention and treatment of diseases and clinical conditions associated with LOC284102.

LOC284106 (Accession XP_209004.1) is another GAM2071 target gene, herein designated TARGET GENE. LOC284106 BINDING SITE is a target binding site found in the 3' untranslated region of mRNA encoded by LOC284106, corresponding to a target binding site such as BINDING SITE I, BINDING SITE II or BINDING SITE III of FIG. 8. Table 4 illustrates the complementarity of the nucleotide sequences of LOC284106 BINDING SITE, designated SEQ ID:11925, to the nucleotide sequence of GAM2071 RNA, herein designated GAM RNA, also designated SEQ ID:371.

Another function of GAM2071 is therefore inhibition of LOC284106 (Accession XP_209004.1). Accordingly, utilities of GAM2071 include diagnosis, prevention and treatment of diseases and clinical conditions associated with LOC284106.

LOC284116 (Accession XP_211338.2) is another GAM2071 target gene, herein designated TARGET GENE. LOC284116 BINDING SITE is a target binding site found in the 5' untranslated region of mRNA encoded by LOC284116, corresponding to a target binding site such as BINDING SITE I, BINDING SITE II or BINDING SITE III of FIG. 8. Table 4 illustrates the complementarity of the nucleotide sequences of LOC284116 BINDING SITE, designated SEQ ID:1709, to the nucleotide sequence of GAM2071 RNA, herein designated GAM RNA, also designated SEQ ID:371.

Another function of GAM2071 is therefore inhibition of LOC284116 (Accession XP_211338.2). Accordingly, utilities of GAM2071 include diagnosis, prevention and treatment of diseases and clinical conditions associated with LOC284116.

LOC284117 (Accession XP_209024.1) is another GAM2071 target gene, herein designated TARGET GENE. LOC284117 BINDING SITE is a target binding site found in the 3' untranslated region of mRNA encoded by LOC284117, corresponding to a target binding site such as BINDING SITE I, BINDING SITE II or BINDING SITE III of FIG. 8. Table 4 illustrates the complementarity of the nucleotide sequences of LOC284117 BINDING SITE, designated SEQ ID:11347, to the nucleotide sequence of GAM2071 RNA, herein designated GAM RNA, also designated SEQ ID:371.

Another function of GAM2071 is therefore inhibition of LOC284117 (Accession XP_209024.1). Accordingly, utilities of GAM2071 include diagnosis, prevention and treatment of diseases and clinical conditions associated with LOC284117.

LOC284128 (Accession XP_211342.1) is another GAM2071 target gene, herein designated TARGET GENE. LOC284128 BINDING SITE1 and LOC284128 BINDING SITE2 are target binding sites found in untranslated regions of mRNA encoded by LOC284128, corresponding to target binding sites such as BINDING SITE I, BINDING SITE II or BINDING SITE III of FIG. 8. Table 4 illustrates the complementarity of the nucleotide sequences of LOC284128 BINDING SITE1 and LOC284128 BINDING SITE2, designated SEQ ID:17271 and SEQ ID:17792 respectively, to the nucleotide sequence of GAM2071 RNA, herein designated GAM RNA, also designated SEQ ID:371.

Another function of GAM2071 is therefore inhibition of LOC284128 (Accession XP_211342.1). Accordingly, utilities of GAM2071 include diagnosis, prevention and treatment of diseases and clinical conditions associated with LOC284128.

LOC284145 (Accession XP_211353.1) is another GAM2071 target gene, herein designated TARGET GENE. LOC284145 BINDING SITE is a target binding site found in the 5' untranslated region of mRNA encoded by LOC284145, corresponding to a target binding site such as BINDING SITE I, BINDING SITE II or BINDING SITE III of FIG. 8. Table 4 illustrates the complementarity of the nucleotide sequences of LOC284145 BINDING SITE, designated SEQ ID:8678, to the nucleotide sequence of GAM2071 RNA, herein designated GAM RNA, also designated SEQ ID:371.

Another function of GAM2071 is therefore inhibition of LOC284145 (Accession XP_211353.1). Accordingly, utilities of GAM2071 include diagnosis, prevention and treatment of diseases and clinical conditions associated with LOC284145.

LOC284171 (Accession XP_209051.1) is another GAM2071 target gene, herein designated TARGET GENE. LOC284171 BINDING SITE is a target binding site found in the 3' untranslated region of mRNA encoded by LOC284171, corresponding to a target binding site such as BINDING SITE I, BINDING SITE II or BINDING SITE III of FIG. 8. Table 4 illustrates the complementarity of the nucleotide sequences of LOC284171 BINDING SITE, designated SEQ ID:12420, to the nucleotide sequence of GAM2071 RNA, herein designated GAM RNA, also designated SEQ ID:371.

Another function of GAM2071 is therefore inhibition of LOC284171 (Accession XP_209051.1). Accordingly, utilities of GAM2071 include diagnosis, prevention and treatment of diseases and clinical conditions associated with LOC284171.

LOC284186 (Accession XP_209060.2) is another GAM2071 target gene, herein designated TARGET GENE. LOC284186 BINDING SITE is a target binding site found in the 3' untranslated region of mRNA encoded by LOC284186, corresponding to a target binding site such as BINDING SITE I, BINDING SITE II or BINDING SITE III of FIG. 8. Table 4 illustrates the complementarity of the nucleotide sequences of LOC284186 BINDING SITE, designated SEQ ID:18182, to the nucleotide sequence of GAM2071 RNA, herein designated GAM RNA, also designated SEQ ID:371.

Another function of GAM2071 is therefore inhibition of LOC284186 (Accession XP_209060.2). Accordingly, utilities of GAM2071 include diagnosis, prevention and treatment of diseases and clinical conditions associated with LOC284186.

LOC284191 (Accession XP_211377.1) is another GAM2071 target gene, herein designated TARGET GENE. LOC284191 BINDING SITE is a target binding site found in the 5' untranslated region of mRNA encoded by LOC284191, corresponding to a target binding site such as BINDING SITE I, BINDING SITE II or BINDING SITE III of FIG. 8. Table 4 illustrates the complementarity of the nucleotide sequences of LOC284191 BINDING SITE, designated SEQ ID:7923, to the nucleotide sequence of GAM2071 RNA, herein designated GAM RNA, also designated SEQ ID:371.

Another function of GAM2071 is therefore inhibition of LOC284191 (Accession XP_211377.1). Accordingly, utilities of GAM2071 include diagnosis, prevention and treatment of diseases and clinical conditions associated with LOC284191.

LOC284267 (Accession XP_211411.1) is another GAM2071 target gene, herein designated TARGET GENE. LOC284267 BINDING SITE is a target binding site found in the 5' untranslated region of mRNA encoded by LOC284267, corresponding to a target binding site such as BINDING SITE I, BINDING SITE II or BINDING SITE III of FIG. 8. Table 4 illustrates the complementarity of the nucleotide sequences of LOC284267 BINDING SITE, designated SEQ ID:5421, to the nucleotide sequence of GAM2071 RNA, herein designated GAM RNA, also designated SEQ ID:371.

Another function of GAM2071 is therefore inhibition of LOC284267 (Accession XP_211411.1). Accordingly, utilities of GAM2071 include diagnosis, prevention and treatment of diseases and clinical conditions associated with LOC284267.

LOC284276 (Accession XP_211412.1) is another GAM2071 target gene, herein designated TARGET GENE. LOC284276 BINDING SITE is a target binding site found in the 5' untranslated region of mRNA encoded by LOC284276, corresponding to a target binding site such as BINDING SITE I, BINDING SITE II or BINDING SITE III of FIG. 8. Table 4 illustrates the complementarity of the nucleotide sequences of LOC284276 BINDING SITE, designated SEQ ID:12113, to the nucleotide sequence of GAM2071 RNA, herein designated GAM RNA, also designated SEQ ID:371.

Another function of GAM2071 is therefore inhibition of LOC284276 (Accession XP_211412.1). Accordingly, utilities of GAM2071 include diagnosis, prevention and treatment of diseases and clinical conditions associated with LOC284276.

LOC284286 (Accession XP_211419.1) is another GAM2071 target gene, herein designated TARGET GENE. LOC284286 BINDING SITE is a target binding site found in the 3' untranslated region of mRNA encoded by LOC284286, corresponding to a target binding site such as BINDING SITE I, BINDING SITE II or BINDING SITE III of FIG. 8. Table 4 illustrates the complementarity of the nucleotide sequences of LOC284286 BINDING SITE, designated SEQ ID:5521, to the nucleotide sequence of GAM2071 RNA, herein designated GAM RNA, also designated SEQ ID:371.

Another function of GAM2071 is therefore inhibition of LOC284286 (Accession XP_211419.1). Accordingly, utilities of GAM2071 include diagnosis, prevention and treatment of diseases and clinical conditions associated with LOC284286.

LOC284289 (Accession XP_209105.1) is another GAM2071 target gene, herein designated TARGET GENE. LOC284289 BINDING SITE is a target binding site found in the 3' untranslated region of mRNA encoded by LOC284289, corresponding to a target binding site such as BINDING SITE I, BINDING SITE II or BINDING SITE III of FIG. 8. Table 4 illustrates the complementarity of the nucleotide sequences of LOC284289 BINDING SITE, designated SEQ ID:7635, to the nucleotide sequence of GAM2071 RNA, herein designated GAM RNA, also designated SEQ ID:371.

Another function of GAM2071 is therefore inhibition of LOC284289 (Accession XP_209105.1). Accordingly, utilities of GAM2071 include diagnosis, prevention and treatment of diseases and clinical conditions associated with LOC284289.

LOC284304 (Accession XP_211426.1) is another GAM2071 target gene, herein designated TARGET GENE. LOC284304 BINDING SITE is a target binding site found in the 3' untranslated region of mRNA encoded by LOC284304, corresponding to a target binding site such as BINDING SITE I, BINDING SITE II or BINDING SITE III of FIG. 8. Table 4 illustrates the complementarity of the nucleotide sequences of LOC284304 BINDING SITE, designated SEQ ID:16163, to the nucleotide sequence of GAM2071 RNA, herein designated GAM RNA, also designated SEQ ID:371.

Another function of GAM2071 is therefore inhibition of LOC284304 (Accession XP_211426.1). Accordingly, utilities of GAM2071 include diagnosis, prevention and treatment of diseases and clinical conditions associated with LOC284304.

LOC284305 (Accession XP_211425.1) is another GAM2071 target gene, herein designated TARGET GENE. LOC284305 BINDING SITE1 and LOC284305 BINDING SITE2 are target binding sites found in untranslated regions of mRNA encoded by LOC284305, corresponding to target binding sites such as BINDING SITE I, BINDING SITE II or BINDING SITE III of FIG. 8. Table 4 illustrates the complementarity of the nucleotide sequences of LOC284305 BINDING SITE1 and LOC284305 BINDING SITE2, designated SEQ ID:15706 and SEQ ID:12588 respectively, to the nucleotide sequence of GAM2071 RNA, herein designated GAM RNA, also designated SEQ ID:371.

Another function of GAM2071 is therefore inhibition of LOC284305 (Accession XP_211425.1). Accordingly, utilities of GAM2071 include diagnosis, prevention and treatment of diseases and clinical conditions associated with LOC284305.

LOC284317 (Accession XP_209162.1) is another GAM2071 target gene, herein designated TARGET GENE. LOC284317 BINDING SITE1 and LOC284317 BINDING SITE2 are target binding sites found in untranslated regions of mRNA encoded by LOC284317, corresponding to target binding sites such as BINDING SITE I, BINDING SITE II or BINDING SITE III of FIG. 8. Table 4 illustrates the complementarity of the nucleotide sequences of LOC284317 BINDING SITE1 and LOC284317 BINDING SITE2, designated SEQ ID:5320 and SEQ ID:11486 respectively, to the nucleotide sequence of GAM2071 RNA, herein designated GAM RNA, also designated SEQ ID:371.

Another function of GAM2071 is therefore inhibition of LOC284317 (Accession XP_209162.1). Accordingly, utilities of GAM2071 include diagnosis, prevention and treatment of diseases and clinical conditions associated with LOC284317.

LOC284321 (Accession XP_211432.1) is another GAM2071 target gene, herein designated TARGET GENE. LOC284321 BINDING SITE is a target binding site found in the 5' untranslated region of mRNA encoded by LOC284321, corresponding to a target binding site such as BINDING SITE I, BINDING SITE II or BINDING SITE III of FIG. 8. Table 4 illustrates the complementarity of the nucleotide sequences of LOC284321 BINDING SITE, designated SEQ ID:11129, to the nucleotide sequence of GAM2071 RNA, herein designated GAM RNA, also designated SEQ ID:371.

Another function of GAM2071 is therefore inhibition of LOC284321 (Accession XP_211432.1). Accordingly, utilities of GAM2071 include diagnosis, prevention and treatment of diseases and clinical conditions associated with LOC284321.

LOC284325 (Accession XP_209143.1) is another GAM2071 target gene, herein designated TARGET GENE. LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:11657, to the nucleotide sequence of GAM2071 RNA, herein designated GAM RNA, also designated SEQ ID:371.

Another function of GAM2071 is therefore inhibition of LOC284325 (Accession XP_209143.1). Accordingly, utilities of GAM2071 include diagnosis, prevention and treatment of diseases and clinical conditions associated with LOC284325.

LOC284362 (Accession XP_211435.1) is another GAM2071 target gene, herein designated TARGET GENE. LOC284362 BINDING SITE is a target binding site found in the 3' untranslated region of mRNA encoded by LOC284362, corresponding to a target binding site such as BINDING SITE I, BINDING SITE II or BINDING SITE III of FIG. 8. Table 4 illustrates the complementarity of the nucleotide sequences of LOC284362 BINDING SITE, designated SEQ ID:10666, to the nucleotide sequence of GAM2071 RNA, herein designated GAM RNA, also designated SEQ ID:371.

Another function of GAM2071 is therefore inhibition of LOC284362 (Accession XP_211435.1). Accordingly, utilities of GAM2071 include diagnosis, prevention and treatment of diseases and clinical conditions associated with LOC284362.

LOC284375 (Accession XP_209154.1) is another GAM2071 target gene, herein designated TARGET GENE. LOC284375 BINDING SITE is a target binding site found in the 3' untranslated region of mRNA encoded by LOC284375, corresponding to a target binding site such as BINDING SITE I, BINDING SITE II or BINDING SITE III of FIG. 8. Table 4 illustrates the complementarity of the nucleotide sequences of LOC284375 BINDING SITE, designated SEQ ID:13618, to the nucleotide sequence of GAM2071 RNA, herein designated GAM RNA, also designated SEQ ID:371.

Another function of GAM2071 is therefore inhibition of LOC284375 (Accession XP_209154.1). Accordingly, utilities of GAM2071 include diagnosis, prevention and treatment of diseases and clinical conditions associated with LOC284375.

LOC284376 (Accession XP_209157.1) is another GAM2071 target gene, herein designated TARGET GENE. LOC284376 BINDING SITE is a target binding site found in the 3' untranslated region of mRNA encoded by LOC284376, corresponding to a target binding site such as BINDING SITE I, BINDING SITE II or BINDING SITE III of FIG. 8. Table 4 illustrates the complementarity of the nucleotide sequences of LOC284376 BINDING SITE, designated SEQ ID:9328, to the nucleotide sequence of GAM2071 RNA, herein designated GAM RNA, also designated SEQ ID:371.

Another function of GAM2071 is therefore inhibition of LOC284376 (Accession XP_209157.1). Accordingly, utilities of GAM2071 include diagnosis, prevention and treatment of diseases and clinical conditions associated with LOC284376.

LOC284379 (Accession XP_209163.1) is another GAM2071 target gene, herein designated TARGET GENE. LOC284379 BINDING SITE is a target binding site found in the 3' untranslated region of mRNA encoded by LOC284379, corresponding to a target binding site such as BINDING SITE I, BINDING SITE II or BINDING SITE III of FIG. 8. Table 4 illustrates the complementarity of the nucleotide sequences of LOC284379 BINDING SITE, designated SEQ ID:2198, to the nucleotide sequence of GAM2071 RNA, herein designated GAM RNA, also designated SEQ ID:371.

Another function of GAM2071 is therefore inhibition of LOC284379 (Accession XP_209163.1). Accordingly, utilities of GAM2071 include diagnosis, prevention and treatment of diseases and clinical conditions associated with LOC284379.

LOC284405 (Accession XP_209183.2) is another GAM2071 target gene, herein designated TARGET GENE. LOC284405 BINDING SITE is a target binding site found in the 3' untranslated region of mRNA encoded by LOC284405, corresponding to a target binding site such as BINDING SITE I, BINDING SITE II or BINDING SITE III of FIG. 8. Table 4 illustrates the complementarity of the nucleotide sequences of LOC284405 BINDING SITE, designated SEQ ID:3894, to the nucleotide sequence of GAM2071 RNA, herein designated GAM RNA, also designated SEQ ID:371.

Another function of GAM2071 is therefore inhibition of LOC284405 (Accession XP_209183.2). Accordingly, utilities of GAM2071 include diagnosis, prevention and treatment of diseases and clinical conditions associated with LOC284405.

LOC284421 (Accession XP_209200.1) is another GAM2071 target gene, herein designated TARGET GENE. LOC284421 BINDING SITE1 and LOC284421 BINDING SITE2 are target binding sites found in untranslated regions of mRNA encoded by LOC284421, corresponding to target binding sites such as BINDING SITE I, BINDING SITE II or BINDING SITE III of FIG. 8. Table 4 illustrates the complementarity of the nucleotide sequences of LOC284421 BINDING SITE1 and LOC284421 BINDING SITE2, designated SEQ ID:2985 and SEQ ID:15524 respectively, to the nucleotide sequence of GAM2071 RNA, herein designated GAM RNA, also designated SEQ ID:371.

Another function of GAM2071 is therefore inhibition of LOC284421 (Accession XP_209200.1). Accordingly, utilities of GAM2071 include diagnosis, prevention and treatment of diseases and clinical conditions associated with LOC284421.

LOC284426 (Accession XP_209198.1) is another GAM2071 target gene, herein designated TARGET GENE. LOC284426 BINDING SITE1 and LOC284426 BINDING SITE2 are target binding sites found in untranslated regions of mRNA encoded by LOC284426, corresponding to target binding sites such as BINDING SITE I, BINDING SITE II or BINDING SITE III of FIG. 8. Table 4 illustrates the complementarity of the nucleotide sequences of LOC284426 BINDING SITE1 and LOC284426 BINDING SITE2, designated SEQ ID:19419 and SEQ ID:932 respectively, to the nucleotide sequence of GAM2071 RNA, herein designated GAM RNA, also designated SEQ ID:371.

Another function of GAM2071 is therefore inhibition of LOC284426 (Accession XP_209198.1). Accordingly, utilities of GAM2071 include diagnosis, prevention and treatment of diseases and clinical conditions associated with LOC284426.

LOC284436 (Accession XP_290862.1) is another GAM2071 target gene, herein designated TARGET GENE. LOC284436 BINDING SITE is a target binding site found in the 3' untranslated region of mRNA encoded by LOC284436, corresponding to a target binding site such as BINDING SITE I, BINDING SITE II or BINDING SITE III of FIG. 8. Table 4 illustrates the complementarity of the nucleotide sequences of LOC284436 BINDING SITE, designated SEQ ID:6140, to the nucleotide sequence of GAM2071 RNA, herein designated GAM RNA, also designated SEQ ID:371.

Another function of GAM2071 is therefore inhibition of LOC284436 (Accession XP_290862.1). Accordingly, utilities of GAM2071 include diagnosis, prevention and treatment of diseases and clinical conditions associated with LOC284436.

LOC284440 (Accession XP_209210.1) is another GAM2071 target gene, herein designated TARGET GENE. LOC284440 BINDING SITE is a target binding site found in the 3' untranslated region of mRNA encoded by LOC284440, corresponding to a target binding site such as BINDING SITE I, BINDING SITE II or BINDING SITE III of FIG. 8. Table 4 illustrates the complementarity of the nucleotide sequences of LOC284440 BINDING SITE, designated SEQ ID:12050, to the nucleotide sequence of GAM2071 RNA, herein designated GAM RNA, also designated SEQ ID:371.

Another function of GAM2071 is therefore inhibition of LOC284440 (Accession XP_209210.1). Accordingly, utilities of GAM2071 include diagnosis, prevention and treatment of diseases and clinical conditions associated with LOC284440.

LOC284454 (Accession XP_209216.1) is another GAM2071 target gene, herein designated TARGET GENE. LOC284454 BINDING SITE1 and LOC284454 BINDING SITE2 are target binding sites found in untranslated regions of mRNA encoded by LOC284454, corresponding to target binding sites such as BINDING SITE I, BINDING SITE II or BINDING SITE III of FIG. 8. Table 4 illustrates the complementarity of the nucleotide sequences of LOC284454 BINDING SITE1 and LOC284454 BINDING SITE2, designated SEQ ID:3963 and SEQ ID:18896 respectively, to the nucleotide sequence of GAM2071 RNA, herein designated GAM RNA, also designated SEQ ID:371.

Another function of GAM2071 is therefore inhibition of LOC284454 (Accession XP_209216.1). Accordingly, utilities of GAM2071 include diagnosis, prevention and treatment of diseases and clinical conditions associated with LOC284454.

LOC284456 (Accession XP_211470.1) is another GAM2071 target gene, herein designated TARGET GENE. LOC284456 BINDING SITE is a target binding site found in the 5' untranslated region of mRNA encoded by LOC284456, corresponding to a target binding site such as BINDING SITE I, BINDING SITE II or BINDING SITE III of FIG. 8. Table 4 illustrates the complementarity of the nucleotide sequences of LOC284456 BINDING SITE, designated SEQ ID:10594, to the nucleotide sequence of GAM2071 RNA, herein designated GAM RNA, also designated SEQ ID:371.

Another function of GAM2071 is therefore inhibition of LOC284456 (Accession XP_211470.1). Accordingly, utilities of GAM2071 include diagnosis, prevention and treatment of diseases and clinical conditions associated with LOC284456.

LOC284459 (Accession XP_290826.1) is another GAM2071 target gene, herein designated TARGET GENE. LOC284459 BINDING SITE is a target binding site found in the 3' untranslated region of mRNA encoded by LOC284459, corresponding to a target binding site such as BINDING SITE I, BINDING SITE II or BINDING SITE III of FIG. 8. Table 4 illustrates the complementarity of the nucleotide sequences of LOC284459 BINDING SITE, designated SEQ ID:1740, to the nucleotide sequence of GAM2071 RNA, herein designated GAM RNA, also designated SEQ ID:371.

Another function of GAM2071 is therefore inhibition of LOC284459 (Accession XP_290826.1). Accordingly, utilities of GAM2071 include diagnosis, prevention and treatment of diseases and clinical conditions associated with LOC284459.

LOC284471 (Accession XP_209225.1) is another GAM2071 target gene, herein designated TARGET GENE. LOC284471 BINDING SITE is a target binding site found in the 3' untranslated region of mRNA encoded by LOC284471, corresponding to a target binding site such as BINDING SITE I, BINDING SITE II or BINDING SITE III of FIG. 8. Table 4 illustrates the complementarity of the nucleotide sequences of LOC284471 BINDING SITE, designated SEQ ID:4926, to the nucleotide sequence of GAM2071 RNA, herein designated GAM RNA, also designated SEQ ID:371.

Another function of GAM2071 is therefore inhibition of LOC284471 (Accession XP_209225.1). Accordingly, utilities of GAM2071 include diagnosis, prevention and treatment of diseases and clinical conditions associated with LOC284471.

LOC284486 (Accession XP_209231.1) is another GAM2071 target gene, herein designated TARGET GENE. LOC284486 BINDING SITE is a target binding site found in the 3' untranslated region of mRNA encoded by LOC284486, corresponding to a target binding site such as BINDING SITE I, BINDING SITE II or BINDING SITE III of FIG. 8. Table 4 illustrates the complementarity of the nucleotide sequences of LOC284486 BINDING SITE, designated SEQ ID:10824, to the nucleotide sequence of GAM2071 RNA, herein designated GAM RNA, also designated SEQ ID:371.

Another function of GAM2071 is therefore inhibition of LOC284486 (Accession XP_209231.1). Accordingly, utilities of GAM2071 include diagnosis, prevention and treatment of diseases and clinical conditions associated with LOC284486.

LOC284513 (Accession XP_211502.1) is another GAM2071 target gene, herein designated TARGET GENE. LOC284513 BINDING SITE is a target binding site found in the 5' untranslated region of mRNA encoded by LOC284513, corresponding to a target binding site such as BINDING SITE I, BINDING SITE II or BINDING SITE III of FIG. 8. Table 4 illustrates the complementarity of the nucleotide sequences of LOC284513 BINDING SITE, designated SEQ ID:19066, to the nucleotide sequence of GAM2071 RNA, herein designated GAM RNA, also designated SEQ ID:371.

Another function of GAM2071 is therefore inhibition of LOC284513 (Accession XP_211502.1). Accordingly, utilities of GAM2071 include diagnosis, prevention and treatment of diseases and clinical conditions associated with LOC284513.

LOC284531 (Accession XP_211513.1) is another GAM2071 target gene, herein designated TARGET GENE. LOC284531 BINDING SITE is a target binding site found in the 5' untranslated region of mRNA encoded by LOC284531, corresponding to a target binding site such as BINDING SITE I, BINDING SITE II or BINDING SITE III of FIG. 8. Table 4 illustrates the complementarity of the nucleotide sequences of LOC284531 BINDING SITE, designated SEQ ID:2846, to the nucleotide sequence of GAM2071 RNA, herein designated GAM RNA, also designated SEQ ID:371.

Another function of GAM2071 is therefore inhibition of LOC284531 (Accession XP_211513.1). Accordingly, utilities of GAM2071 include diagnosis, prevention and treatment of diseases and clinical conditions associated with LOC284531.

LOC284551 (Accession XP_211515.1) is another GAM2071 target gene, herein designated TARGET GENE. LOC284551 BINDING SITE is a target binding site found in the 3' untranslated region of mRNA encoded by LOC284551, corresponding to a target binding site such as BINDING SITE I, BINDING SITE II or BINDING SITE III of FIG. 8. Table 4 illustrates the complementarity of the nucleotide sequences of LOC284551 BINDING SITE, designated SEQ ID:17959, to the nucleotide sequence of GAM2071 RNA, herein designated GAM RNA, also designated SEQ ID:371.

Another function of GAM2071 is therefore inhibition of LOC284551 (Accession XP_211515.1). Accordingly, utilities of GAM2071 include diagnosis, prevention and treatment of diseases and clinical conditions associated with LOC284551.

LOC284577 (Accession XP_211522.1) is another GAM2071 target gene, herein designated TARGET GENE. LOC284577 BINDING SITE is a target binding site found in the 3' untranslated region of mRNA encoded by LOC284577, corresponding to a target binding site such as BINDING SITE I, BINDING SITE II or BINDING SITE III of FIG. 8. Table 4 illustrates the complementarity of the nucleotide sequences of LOC284577 BINDING SITE, designated SEQ ID:11682, to the nucleotide sequence of GAM2071 RNA, herein designated GAM RNA, also designated SEQ ID:371.

Another function of GAM2071 is therefore inhibition of LOC284577 (Accession XP_211522.1). Accordingly, utilities of GAM2071 include diagnosis, prevention and treatment of diseases and clinical conditions associated with LOC284577.

LOC284587 (Accession XP_209278.3) is another GAM2071 target gene, herein designated TARGET GENE. LOC284587 BINDING SITE is a target binding site found in the 5' untranslated region of mRNA encoded by LOC284587, corresponding to a target binding site such as BINDING SITE I, BINDING SITE II or BINDING SITE III of FIG. 8. Table 4 illustrates the complementarity of the nucleotide sequences of LOC284587 BINDING SITE, designated SEQ ID:902, to the nucleotide sequence of GAM2071 RNA, herein designated GAM RNA, also designated SEQ ID:371.

Another function of GAM2071 is therefore inhibition of LOC284587 (Accession XP_209278.3). Accordingly, utilities of GAM2071 include diagnosis, prevention and treatment of diseases and clinical conditions associated with LOC284587.

LOC284611 (Accession XP_211552.1) is another GAM2071 target gene, herein designated TARGET GENE. LOC284611 BINDING SITE is a target binding site found in the 3' untranslated region of mRNA encoded by LOC284611, corresponding to a target binding site such as BINDING SITE I, BINDING SITE II or BINDING SITE III of FIG. 8. Table 4 illustrates the complementarity of the nucleotide sequences of LOC284611 BINDING SITE, designated SEQ ID:11652, to the nucleotide sequence of GAM2071 RNA, herein designated GAM RNA, also designated SEQ ID:371.

Another function of GAM2071 is therefore inhibition of LOC284611 (Accession XP_211552.1). Accordingly, utilities of GAM2071 include diagnosis, prevention and treatment of diseases and clinical conditions associated with LOC284611.

LOC284675 (Accession XP_209319.1) is another GAM2071 target gene, herein designated TARGET GENE. LOC284675 BINDING SITE is a target binding site found in the 5' untranslated region of mRNA encoded by LOC284675, corresponding to a target binding site such as BINDING SITE I, BINDING SITE II or BINDING SITE III of FIG. 8. Table 4 illustrates the complementarity of the nucleotide sequences of LOC284675 BINDING SITE, designated SEQ ID:8487, to the nucleotide sequence of GAM2071 RNA, herein designated GAM RNA, also designated SEQ ID:371.

Another function of GAM2071 is therefore inhibition of LOC284675 (Accession XP_209319.1). Accordingly, utilities of GAM2071 include diagnosis, prevention and treatment of diseases and clinical conditions associated with LOC284675.

LOC284701 (Accession XP_294994.1) is another GAM2071 target gene, herein designated TARGET GENE. LOC284701 BINDING SITE is a target binding site found in the 5' untranslated region of mRNA encoded by LOC284701, corresponding to a target binding site such as BINDING SITE I, BINDING SITE II or BINDING SITE III of FIG. 8. Table 4 illustrates the complementarity of the nucleotide sequences of LOC284701 BINDING SITE, designated SEQ ID:902, to the nucleotide sequence of GAM2071 RNA, herein designated GAM RNA, also designated SEQ ID:371.

Another function of GAM2071 is therefore inhibition of LOC284701 (Accession XP_294994.1). Accordingly, utilities of GAM2071 include diagnosis, prevention and treatment of diseases and clinical conditions associated with LOC284701.

LOC284723 (Accession XP_211602.1) is another GAM2071 target gene, herein designated TARGET GENE. LOC284723 BINDING SITE1 and LOC284723 BINDING SITE2 are target binding sites found in untranslated regions of mRNA encoded by LOC284723, corresponding to target binding sites such as BINDING SITE I, BINDING SITE II or BINDING SITE III of FIG. 8. Table 4 illustrates the complementarity of the nucleotide sequences of LOC284723 BINDING SITE1 and LOC284723 BINDING SITE2, designated SEQ ID:6492 and SEQ ID:17106 respectively, to the nucleotide sequence of GAM2071 RNA, herein designated GAM RNA, also designated SEQ ID:371.

Another function of GAM2071 is therefore inhibition of LOC284723 (Accession XP_211602.1). Accordingly, utilities of GAM2071 include diagnosis, prevention and treatment of diseases and clinical conditions associated with LOC284723.

LOC284805 (Accession XP_209371.1) is another GAM2071 target gene, herein designated TARGET GENE. LOC284805 BINDING SITE1 and LOC284805 BINDING SITE2 are target binding sites found in untranslated regions of mRNA encoded by LOC284805, corresponding to target binding sites such as BINDING SITE I, BINDING SITE II or BINDING SITE III of FIG. 8. Table 4 illustrates the complementarity of the nucleotide sequences of LOC284805 BINDING SITE1 and LOC284805 BINDING SITE2, designated SEQ ID:18781 and SEQ ID:11447 respectively, to the nucleotide sequence of GAM2071 RNA, herein designated GAM RNA, also designated SEQ ID:371.

Another function of GAM2071 is therefore inhibition of LOC284805 (Accession XP_209371.1). Accordingly, utilities of GAM2071 include diagnosis, prevention and treatment of diseases and clinical conditions associated with LOC284805.

LOC284845 (Accession XP_211663.1) is another GAM2071 target gene, herein designated TARGET GENE. LOC284845 BINDING SITE is a target binding site found in the 3' untranslated region of mRNA encoded by LOC284845, corresponding to a target binding site such as BINDING SITE I, BINDING SITE II or BINDING SITE III of FIG. 8. Table 4 illustrates the complementarity of the nucleotide sequences of LOC284845 BINDING SITE, designated SEQ ID:15141, to the nucleotide sequence of GAM2071 RNA, herein designated GAM RNA, also designated SEQ ID:371.

Another function of GAM2071 is therefore inhibition of LOC284845 (Accession XP_211663.1). Accordingly, utilities of GAM2071 include diagnosis, prevention and treatment of diseases and clinical conditions associated with LOC284845.

LOC284856 (Accession XP_302835.1) is another GAM2071 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:3436, to the nucleotide sequence of GAM2071 RNA, herein designated GAM RNA, also designated SEQ ID:371.

Another function of GAM2071 is therefore inhibition of LOC284856 (Accession XP_302835.1). Accordingly, utilities of GAM2071 include diagnosis, prevention and treatment of diseases and clinical conditions associated with LOC284856.

LOC284856 (Accession XP_211668.2) is another GAM2071 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:3436, to the nucleotide sequence of GAM2071 RNA, herein designated GAM RNA, also designated SEQ ID:371.

Another function of GAM2071 is therefore inhibition of LOC284856 (Accession XP_211668.2). Accordingly, utilities of GAM2071 include diagnosis, prevention and treatment of diseases and clinical conditions associated with LOC284856.

LOC284874 (Accession XP_209394.1) is another GAM2071 target gene, herein designated TARGET GENE. LOC284874 BINDING SITE is a target binding site found in the 3' untranslated region of mRNA encoded by LOC284874, corresponding to a target binding site such as BINDING SITE I, BINDING SITE II or BINDING SITE III of FIG. 8. Table 4 illustrates the complementarity of the nucleotide sequences of LOC284874 BINDING SITE, designated SEQ ID:2751, to the nucleotide sequence of GAM2071 RNA, herein designated GAM RNA, also designated SEQ ID:371.

Another function of GAM2071 is therefore inhibition of LOC284874 (Accession XP_209394.1). Accordingly, utilities of GAM2071 include diagnosis, prevention and treatment of diseases and clinical conditions associated with LOC284874.

LOC284934 (Accession XP_211696.1) is another GAM2071 target gene, herein designated TARGET GENE. LOC284934 BINDING SITE is a target binding site found in the 5' untranslated region of mRNA encoded by LOC284934, corresponding to a target binding site such as BINDING SITE I, BINDING SITE II or BINDING SITE III of FIG. 8. Table 4 illustrates the complementarity of the nucleotide sequences of LOC284934 BINDING SITE, designated SEQ ID:17477, to the nucleotide sequence of GAM2071 RNA, herein designated GAM RNA, also designated SEQ ID:371.

Another function of GAM2071 is therefore inhibition of LOC284934 (Accession XP_211696.1). Accordingly, utilities of GAM2071 include diagnosis, prevention and treatment of diseases and clinical conditions associated with LOC284934.

LOC284950 (Accession XP_211703.1) is another GAM2071 target gene, herein designated TARGET GENE. LOC284950 BINDING SITE1 and LOC284950 BINDING SITE2 are target binding sites found in untranslated regions of mRNA encoded by LOC284950, corresponding to target binding sites such as BINDING SITE I, BINDING SITE II or BINDING SITE III of FIG. 8. Table 4 illustrates the complementarity of the nucleotide sequences of LOC284950 BINDING SITE1 and LOC284950 BINDING SITE2, designated SEQ ID:1362 and SEQ ID:6753 respectively, to the nucleotide sequence of GAM2071 RNA, herein designated GAM RNA, also designated SEQ ID:371.

Another function of GAM2071 is therefore inhibition of LOC284950 (Accession XP_211703.1). Accordingly, utilities of GAM2071 include diagnosis, prevention and treatment of diseases and clinical conditions associated with LOC284950.

LOC284965 (Accession XP_209425.1) is another GAM2071 target gene, herein designated TARGET GENE. LOC284965 BINDING SITE is a target binding site found in the 5' untranslated region of mRNA encoded by LOC284965, corresponding to a target binding site such as BINDING SITE I, BINDING SITE II or BINDING SITE III of FIG. 8. Table 4 illustrates the complementarity of the nucleotide sequences of LOC284965 BINDING SITE, designated SEQ ID:6801, to the nucleotide sequence of GAM2071 RNA, herein designated GAM RNA, also designated SEQ ID:371.

Another function of GAM2071 is therefore inhibition of LOC284965 (Accession XP_209425.1). Accordingly, utilities of GAM2071 include diagnosis, prevention and treatment of diseases and clinical conditions associated with LOC284965.

LOC284976 (Accession XP_211714.1) is another GAM2071 target gene, herein designated TARGET GENE. LOC284976 BINDING SITE is a target binding site found in the 3' untranslated region of mRNA encoded by LOC284976, corresponding to a target binding site such as BINDING SITE I, BINDING SITE II or BINDING SITE III of FIG. 8. Table 4 illustrates the complementarity of the nucleotide sequences of LOC284976 BINDING SITE, designated SEQ ID:5711, to the nucleotide sequence of GAM2071 RNA, herein designated GAM RNA, also designated SEQ ID:371.

Another function of GAM2071 is therefore inhibition of LOC284976 (Accession XP_211714.1). Accordingly, utilities of GAM2071 include diagnosis, prevention and treatment of diseases and clinical conditions associated with LOC284976.

LOC285026 (Accession XP_209440.1) is another GAM2071 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:14276, to the nucleotide sequence of GAM2071 RNA, herein designated GAM RNA, also designated SEQ ID:371.

Another function of GAM2071 is therefore inhibition of LOC285026 (Accession XP_209440.1). Accordingly, utilities of GAM2071 include diagnosis, prevention and treatment of diseases and clinical conditions associated with LOC285026.

LOC285052 (Accession XP_211751.1) is another GAM2071 target gene, herein designated TARGET GENE. LOC285052 BINDING SITE is a target binding site found in the 3' untranslated region of mRNA encoded by LOC285052, corresponding to a target binding site such as BINDING SITE I, BINDING SITE II or BINDING SITE III of FIG. 8. Table 4 illustrates the complementarity of the nucleotide sequences of LOC285052 BINDING SITE, designated SEQ ID:5968, to the nucleotide sequence of GAM2071 RNA, herein designated GAM RNA, also designated SEQ ID:371.

Another function of GAM2071 is therefore inhibition of LOC285052 (Accession XP_211751.1). Accordingly, utilities of GAM2071 include diagnosis, prevention and treatment of diseases and clinical conditions associated with LOC285052.

LOC285058 (Accession XP_211753.1) is another GAM2071 target gene, herein designated TARGET GENE. LOC285058 BINDING SITE is a target binding site found in the 5' untranslated region of mRNA encoded by LOC285058, corresponding to a target binding site such as BINDING SITE I, BINDING SITE II or BINDING SITE III of FIG. 8. Table 4 illustrates the complementarity of the nucleotide sequences of LOC285058 BINDING SITE, designated SEQ ID:10836, to the nucleotide sequence of GAM2071 RNA, herein designated GAM RNA, also designated SEQ ID:371.

Another function of GAM2071 is therefore inhibition of LOC285058 (Accession XP_211753.1). Accordingly, utilities of GAM2071 include diagnosis, prevention and treatment of diseases and clinical conditions associated with LOC285058.

LOC285083 (Accession XP_209464.1) is another GAM2071 target gene, herein designated TARGET GENE. LOC285083 BINDING SITE is a target binding site found in the 3' untranslated region of mRNA encoded by LOC285083, corresponding to a target binding site such as BINDING SITE I, BINDING SITE II or BINDING SITE III of FIG. 8. Table 4 illustrates the complementarity of the nucleotide sequences of LOC285083 BINDING SITE, designated SEQ ID:18085, to the nucleotide sequence of GAM2071 RNA, herein designated GAM RNA, also designated SEQ ID:371.

Another function of GAM2071 is therefore inhibition of LOC285083 (Accession XP_209464.1). Accordingly, utilities of GAM2071 include diagnosis, prevention and treatment of diseases and clinical conditions associated with LOC285083.

LOC285094 (Accession XP_209471.1) is another GAM2071 target gene, herein designated TARGET GENE. LOC285094 BINDING SITE is a target binding site found in the 5' untranslated region of mRNA encoded by LOC285094, corresponding to a target binding site such as BINDING SITE I, BINDING SITE II or BINDING SITE III of FIG. 8. Table 4 illustrates the complementarity of the nucleotide sequences of LOC285094 BINDING SITE, designated SEQ ID:2931, to the nucleotide sequence of GAM2071 RNA, herein designated GAM RNA, also designated SEQ ID:371.

Another function of GAM2071 is therefore inhibition of LOC285094 (Accession XP_209471.1). Accordingly, utilities of GAM2071 include diagnosis, prevention and treatment of diseases and clinical conditions associated with LOC285094.

LOC285127 (Accession XP_211771.1) is another GAM2071 target gene, herein designated TARGET GENE. LOC285127 BINDING SITE1 and LOC285127 BINDING SITE2 are target binding sites found in untranslated regions of mRNA encoded by LOC285127, corresponding to target binding sites such as BINDING SITE I, BINDING SITE II or BINDING SITE III of FIG. 8. Table 4 illustrates the complementarity of the nucleotide sequences of LOC285127 BINDING SITE1 and LOC285127 BINDING SITE2, designated SEQ ID:19204 and SEQ ID:3106 respectively, to the nucleotide sequence of GAM2071 RNA, herein designated GAM RNA, also designated SEQ ID:371.

Another function of GAM2071 is therefore inhibition of LOC285127 (Accession XP_211771.1). Accordingly, utilities of GAM2071 include diagnosis, prevention and treatment of diseases and clinical conditions associated with LOC285127.

LOC285176 (Accession XP_209500.1) is another GAM2071 target gene, herein designated TARGET GENE. LOC285176 BINDING SITE is a target binding site found in the 3' untranslated region of mRNA encoded by LOC285176, corresponding to a target binding site such as BINDING SITE I, BINDING SITE II or BINDING SITE III of FIG. 8. Table 4 illustrates the complementarity of the nucleotide sequences of LOC285176 BINDING SITE, designated SEQ ID:12167, to the nucleotide sequence of GAM2071 RNA, herein designated GAM RNA, also designated SEQ ID:371.

Another function of GAM2071 is therefore inhibition of LOC285176 (Accession XP_209500.1). Accordingly, utilities of GAM2071 include diagnosis, prevention and treatment of diseases and clinical conditions associated with LOC285176.

LOC285193 (Accession XP_209509.1) is another GAM2071 target gene, herein designated TARGET GENE. LOC285193 BINDING SITE is a target binding site found in the 3' untranslated region of mRNA encoded by LOC285193, corresponding to a target binding site such as BINDING SITE I, BINDING SITE II or BINDING SITE III of FIG. 8. Table 4 illustrates the complementarity of the nucleotide sequences of LOC285193 BINDING SITE, designated SEQ ID:13870, to the nucleotide sequence of GAM2071 RNA, herein designated GAM RNA, also designated SEQ ID:371.

Another function of GAM2071 is therefore inhibition of LOC285193 (Accession XP_209509.1). Accordingly, utilities of GAM2071 include diagnosis, prevention and treatment of diseases and clinical conditions associated with LOC285193.

LOC285221 (Accession XP_209521.1) is another GAM2071 target gene, herein designated TARGET GENE. LOC285221 BINDING SITE is a target binding site found in the 5' untranslated region of mRNA encoded by LOC285221, corresponding to a target binding site such as BINDING SITE I, BINDING SITE II or BINDING SITE III of FIG. 8. Table 4 illustrates the complementarity of the nucleotide sequences of LOC285221 BINDING SITE, designated SEQ ID:15365, to the nucleotide sequence of GAM2071 RNA, herein designated GAM RNA, also designated SEQ ID:371.

Another function of GAM2071 is therefore inhibition of LOC285221 (Accession XP_209521.1). Accordingly, utilities of GAM2071 include diagnosis, prevention and treatment of diseases and clinical conditions associated with LOC285221.

LOC285231 (Accession XP_211813.1) is another GAM2071 target gene, herein designated TARGET GENE. LOC285231 BINDING SITE1 through LOC285231 BINDING SITE3 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231 BINDING SITE1 through LOC285231 BINDING SITE3, designated SEQ ID:3632, SEQ ID:11238 and SEQ ID:13069 respectively, to the nucleotide sequence of GAM2071 RNA, herein designated GAM RNA, also designated SEQ ID:371.

Another function of GAM2071 is therefore inhibition of LOC285231 (Accession XP_211813.1). Accordingly, utilities of GAM2071 include diagnosis, prevention and treatment of diseases and clinical conditions associated with LOC285231.

LOC285281 (Accession XP_211829.1) is another GAM2071 target gene, herein designated TARGET GENE. LOC285281 BINDING SITE is a target binding site found in the 5' untranslated region of mRNA encoded by LOC285281, corresponding to a target binding site such as BINDING SITE I, BINDING SITE II or BINDING SITE III of FIG. 8. Table 4 illustrates the complementarity of the nucleotide sequences of LOC285281 BINDING SITE, designated SEQ ID:7766, to the nucleotide sequence of GAM2071 RNA, herein designated GAM RNA, also designated SEQ ID:371.

Another function of GAM2071 is therefore inhibition of LOC285281 (Accession XP_211829.1). Accordingly, utilities of GAM2071 include diagnosis, prevention and treatment of diseases and clinical conditions associated with LOC285281.

LOC285299 (Accession XP_209554.1) is another GAM2071 target gene, herein designated TARGET GENE. LOC285299 BINDING SITE is a target binding site found in the 3' untranslated region of mRNA encoded by LOC285299, corresponding to a target binding site such as BINDING SITE I, BINDING SITE II or BINDING SITE III of FIG. 8. Table 4 illustrates the complementarity of the nucleotide sequences of LOC285299 BINDING SITE, designated SEQ ID:15961, to the nucleotide sequence of GAM2071 RNA, herein designated GAM RNA, also designated SEQ ID:371.

Another function of GAM2071 is therefore inhibition of LOC285299 (Accession XP_209554.1). Accordingly, utilities of GAM2071 include diagnosis, prevention and treatment of diseases and clinical conditions associated with LOC285299.

LOC285345 (Accession XP_211854.1) is another GAM2071 target gene, herein designated TARGET GENE. LOC285345 BINDING SITE1 and LOC285345 BINDING SITE2 are target binding sites found in untranslated regions of mRNA encoded by LOC285345, corresponding to target binding sites such as BINDING SITE I, BINDING SITE II or BINDING SITE III of FIG. 8. Table 4 illustrates the complementarity of the nucleotide sequences of LOC285345 BINDING SITE1 and LOC285345 BINDING SITE2, designated SEQ ID:11821 and SEQ ID:13276 respectively, to the nucleotide sequence of GAM2071 RNA, herein designated GAM RNA, also designated SEQ ID:371.

Another function of GAM2071 is therefore inhibition of LOC285345 (Accession XP_211854.1). Accordingly, utilities of GAM2071 include diagnosis, prevention and treatment of diseases and clinical conditions associated with LOC285345.

LOC285366 (Accession XP_209581.1) is another GAM2071 target gene, herein designated TARGET GENE. LOC285366 BINDING SITE is a target binding site found in the 3' untranslated region of mRNA encoded by LOC285366, corresponding to a target binding site such as BINDING SITE I, BINDING SITE II or BINDING SITE III of FIG. 8. Table 4 illustrates the complementarity of the nucleotide sequences of LOC285366 BINDING SITE, designated SEQ ID:4019, to the nucleotide sequence of GAM2071 RNA, herein designated GAM RNA, also designated SEQ ID:371.

Another function of GAM2071 is therefore inhibition of LOC285366 (Accession XP_209581.1). Accordingly, utilities of GAM2071 include diagnosis, prevention and treatment of diseases and clinical conditions associated with LOC285366.

LOC285369 (Accession XP_211861.3) is another GAM2071 target gene, herein designated TARGET GENE. LOC285369 BINDING SITE is a target binding site found in the 3' untranslated region of mRNA encoded by LOC285369, corresponding to a target binding site such as BINDING SITE I, BINDING SITE II or BINDING SITE III of FIG. 8. Table 4 illustrates the complementarity of the nucleotide sequences of LOC285369 BINDING SITE, designated SEQ ID:19816, to the nucleotide sequence of GAM2071 RNA, herein designated GAM RNA, also designated SEQ ID:371.

Another function of GAM2071 is therefore inhibition of LOC285369 (Accession XP_211861.3). Accordingly, utilities of GAM2071 include diagnosis, prevention and treatment of diseases and clinical conditions associated with LOC285369.

LOC285370 (Accession XP_211869.1) is another GAM2071 target gene, herein designated TARGET GENE. LOC285370 BINDING SITE is a target binding site found in the 3' untranslated region of mRNA encoded by LOC285370, corresponding to a target binding site such as BINDING SITE I, BINDING SITE II or BINDING SITE III of FIG. 8. Table 4 illustrates the complementarity of the nucleotide sequences of LOC285370 BINDING SITE, designated SEQ ID:5624, to the nucleotide sequence of GAM2071 RNA, herein designated GAM RNA, also designated SEQ ID:371.

Another function of GAM2071 is therefore inhibition of LOC285370 (Accession XP_211869.1). Accordingly, utilities of GAM2071 include diagnosis, prevention and treatment of diseases and clinical conditions associated with LOC285370.

LOC285389 (Accession XP_211873.1) is another GAM2071 target gene, herein designated TARGET GENE. LOC285389 BINDING SITE is a target binding site found in the 3' untranslated region of mRNA encoded by LOC285389, corresponding to a target binding site such as BINDING SITE I, BINDING SITE II or BINDING SITE III of FIG. 8. Table 4 illustrates the complementarity of the nucleotide sequences of LOC285389 BINDING SITE, designated SEQ ID:7025, to the nucleotide sequence of GAM2071 RNA, herein designated GAM RNA, also designated SEQ ID:371.

Another function of GAM2071 is therefore inhibition of LOC285389 (Accession XP_211873.1). Accordingly, utilities of GAM2071 include diagnosis, prevention and treatment of diseases and clinical conditions associated with LOC285389.

LOC285392 (Accession XP_211879.1) is another GAM2071 target gene, herein designated TARGET GENE. LOC285392 BINDING SITE1 and LOC285392 BINDING SITE2 are target binding sites found in untranslated regions of mRNA encoded by LOC285392, corresponding to target binding sites such as BINDING SITE I, BINDING SITE II or BINDING SITE III of FIG. 8. Table 4 illustrates the complementarity of the nucleotide sequences of LOC285392 BINDING SITE1 and LOC285392 BINDING SITE2, designated SEQ ID:436 and SEQ ID:6034 respectively, to the nucleotide sequence of GAM2071 RNA, herein designated GAM RNA, also designated SEQ ID:371.

Another function of GAM2071 is therefore inhibition of LOC285392 (Accession XP_211879.1). Accordingly, utilities of GAM2071 include diagnosis, prevention and treatment of diseases and clinical conditions associated with LOC285392.

LOC285398 (Accession XP_209593.1) is another GAM2071 target gene, herein designated TARGET GENE. LOC285398 BINDING SITE1 and LOC285398 BINDING SITE2 are target binding sites found in untranslated regions of mRNA encoded by LOC285398, corresponding to target binding sites such as BINDING SITE I, BINDING SITE II or BINDING SITE III of FIG. 8. Table 4 illustrates the complementarity of the nucleotide sequences of LOC285398 BINDING SITE1 and LOC285398 BINDING SITE2, designated SEQ ID:3701 and SEQ ID:4020 respectively, to the nucleotide sequence of GAM2071 RNA, herein designated GAM RNA, also designated SEQ ID:371.

Another function of GAM2071 is therefore inhibition of LOC285398 (Accession XP_209593.1). Accordingly, utilities of GAM2071 include diagnosis, prevention and treatment of diseases and clinical conditions associated with LOC285398.

LOC285400 (Accession XP_209596.1) is another GAM2071 target gene, herein designated TARGET GENE. LOC285400 BINDING SITE is a target binding site found in the 3' untranslated region of mRNA encoded by LOC285400, corresponding to a target binding site such as BINDING SITE I, BINDING SITE II or BINDING SITE III of FIG. 8. Table 4 illustrates the complementarity of the nucleotide sequences of LOC285400 BINDING SITE, designated SEQ ID:3267, to the nucleotide sequence of GAM2071 RNA, herein designated GAM RNA, also designated SEQ ID:371.

Another function of GAM2071 is therefore inhibition of LOC285400 (Accession XP_209596.1). Accordingly, utilities of GAM2071 include diagnosis, prevention and treatment of diseases and clinical conditions associated with LOC285400.

LOC285409 (Accession XP_209600.1) is another GAM2071 target gene, herein designated TARGET GENE. LOC285409 BINDING SITE is a target binding site found in the 3' untranslated region of mRNA encoded by LOC285409, corresponding to a target binding site such as BINDING SITE I, BINDING SITE II or BINDING SITE III of FIG. 8. Table 4 illustrates the complementarity of the nucleotide sequences of LOC285409 BINDING SITE, designated SEQ ID:1914, to the nucleotide sequence of GAM2071 RNA, herein designated GAM RNA, also designated SEQ ID:371.

Another function of GAM2071 is therefore inhibition of LOC285409 (Accession XP_209600.1). Accordingly, utilities of GAM2071 include diagnosis, prevention and treatment of diseases and clinical conditions associated with LOC285409.

LOC285429 (Accession XP_209607.3) is another GAM2071 target gene, herein designated TARGET GENE. LOC285429 BINDING SITE is a target binding site found in the 3' untranslated region of mRNA encoded by LOC285429, corresponding to a target binding site such as BINDING SITE I, BINDING SITE II or BINDING SITE III of FIG. 8. Table 4 illustrates the complementarity of the nucleotide sequences of LOC285429 BINDING SITE, designated SEQ ID:4870, to the nucleotide sequence of GAM2071 RNA, herein designated GAM RNA, also designated SEQ ID:371.

Another function of GAM2071 is therefore inhibition of LOC285429 (Accession XP_209607.3). Accordingly, utilities of GAM2071 include diagnosis, prevention and treatment of diseases and clinical conditions associated with LOC285429.

LOC285488 (Accession XP_211914.1) is another GAM2071 target gene, herein designated TARGET GENE. LOC285488 BINDING SITE is a target binding site found in the 5' untranslated region of mRNA encoded by LOC285488, corresponding to a target binding site such as BINDING SITE I, BINDING SITE II or BINDING SITE III of FIG. 8. Table 4 illustrates the complementarity of the nucleotide sequences of LOC285488 BINDING SITE, designated SEQ ID:11093, to the nucleotide sequence of GAM2071 RNA, herein designated GAM RNA, also designated SEQ ID:371.

Another function of GAM2071 is therefore inhibition of LOC285488 (Accession XP_211914.1). Accordingly, utilities of GAM2071 include diagnosis, prevention and treatment of diseases and clinical conditions associated with LOC285488.

LOC285491 (Accession XP_211917.1) is another GAM2071 target gene, herein designated TARGET GENE. LOC285491 BINDING SITE is a target binding site found in the 3' untranslated region of mRNA encoded by LOC285491, corresponding to a target binding site such as BINDING SITE I, BINDING SITE II or BINDING SITE III of FIG. 8. Table 4 illustrates the complementarity of the nucleotide sequences of LOC285491 BINDING SITE, designated SEQ ID:8951, to the nucleotide sequence of GAM2071 RNA, herein designated GAM RNA, also designated SEQ ID:371.

Another function of GAM2071 is therefore inhibition of LOC285491 (Accession XP_211917.1). Accordingly, utilities of GAM2071 include diagnosis, prevention and treatment of diseases and clinical conditions associated with LOC285491.

LOC285509 (Accession XP_211923.1) is another GAM2071 target gene, herein designated TARGET GENE. LOC285509 BINDING SITE is a target binding site found in the 5' untranslated region of mRNA encoded by LOC285509, corresponding to a target binding site such as BINDING SITE I, BINDING SITE II or BINDING SITE III of FIG. 8. Table 4 illustrates the complementarity of the nucleotide sequences of LOC285509 BINDING SITE, designated SEQ ID:11997, to the nucleotide sequence of GAM2071 RNA, herein designated GAM RNA, also designated SEQ ID:371.

Another function of GAM2071 is therefore inhibition of LOC285509 (Accession XP_211923.1). Accordingly, utilities of GAM2071 include diagnosis, prevention and treatment of diseases and clinical conditions associated with LOC285509.

LOC285540 (Accession XP_209654.1) is another GAM2071 target gene, herein designated TARGET GENE. LOC285540 BINDING SITE1 and LOC285540 BINDING SITE2 are target binding sites found in untranslated regions of mRNA encoded by LOC285540, corresponding to target binding sites such as BINDING SITE I, BINDING SITE II or BINDING SITE III of FIG. 8. Table 4 illustrates the complementarity of the nucleotide sequences of LOC285540 BINDING SITE1 and LOC285540 BINDING SITE2, designated SEQ ID:19426 and SEQ ID:5384 respectively, to the nucleotide sequence of GAM2071 RNA, herein designated GAM RNA, also designated SEQ ID:371.

Another function of GAM2071 is therefore inhibition of LOC285540 (Accession XP_209654.1). Accordingly, utilities of GAM2071 include diagnosis, prevention and treatment of diseases and clinical conditions associated with LOC285540.

LOC285589 (Accession XP_209671.1) is another GAM2071 target gene, herein designated TARGET GENE. LOC285589 BINDING SITE1 and LOC285589 BINDING SITE2 are target binding sites found in untranslated regions of mRNA encoded by LOC285589, corresponding to target binding sites such as BINDING SITE I, BINDING SITE II or BINDING SITE III of FIG. 8. Table 4 illustrates the complementarity of the nucleotide sequences of LOC285589 BINDING SITE1 and LOC285589 BINDING SITE2, designated SEQ ID:14069 and SEQ ID:3782 respectively, to the nucleotide sequence of GAM2071 RNA, herein designated GAM RNA, also designated SEQ ID:371.

Another function of GAM2071 is therefore inhibition of LOC285589 (Accession XP_209671.1). Accordingly, utilities of GAM2071 include diagnosis, prevention and treatment of diseases and clinical conditions associated with LOC285589.

LOC285594 (Accession XP_211946.2) is another GAM2071 target gene, herein designated TARGET GENE. LOC285594 BINDING SITE is a target binding site found in the 3' untranslated region of mRNA encoded by LOC285594, corresponding to a target binding site such as BINDING SITE I, BINDING SITE II or BINDING SITE III of FIG. 8. Table 4 illustrates the complementarity of the nucleotide sequences of LOC285594 BINDING SITE, designated SEQ ID:9271, to the nucleotide sequence of GAM2071 RNA, herein designated GAM RNA, also designated SEQ ID:371.

Another function of GAM2071 is therefore inhibition of LOC285594 (Accession XP_211946.2). Accordingly, utilities of GAM2071 include diagnosis, prevention and treatment of diseases and clinical conditions associated with LOC285594.

LOC285608 (Accession XP_211952.1) is another GAM2071 target gene, herein designated TARGET GENE. LOC285608 BINDING SITE is a target binding site found in the 3' untranslated region of mRNA encoded by LOC285608, corresponding to a target binding site such as BINDING SITE I, BINDING SITE II or BINDING SITE III of FIG. 8. Table 4 illustrates the complementarity of the nucleotide sequences of LOC285608 BINDING SITE, designated SEQ ID:15956, to the nucleotide sequence of GAM2071 RNA, herein designated GAM RNA, also designated SEQ ID:371.

Another function of GAM2071 is therefore inhibition of LOC285608 (Accession XP_211952.1). Accordingly, utilities of GAM2071 include diagnosis, prevention and treatment of diseases and clinical conditions associated with LOC285608.

LOC285638 (Accession XP_209693.1) is another GAM2071 target gene, herein designated TARGET GENE. LOC285638 BINDING SITE is a target binding site found in the 5' untranslated region of mRNA encoded by LOC285638, corresponding to a target binding site such as BINDING SITE I, BINDING SITE II or BINDING SITE III of FIG. 8. Table 4 illustrates the complementarity of the nucleotide sequences of LOC285638 BINDING SITE, designated SEQ ID:13619, to the nucleotide sequence of GAM2071 RNA, herein designated GAM RNA, also designated SEQ ID:371.

Another function of GAM2071 is therefore inhibition of LOC285638 (Accession XP_209693.1). Accordingly, utilities of GAM2071 include diagnosis, prevention and treatment of diseases and clinical conditions associated with LOC285638.

LOC285641 (Accession XP_209697.1) is another GAM2071 target gene, herein designated TARGET GENE. LOC285641 BINDING SITE is a target binding site found in the 5' untranslated region of mRNA encoded by LOC285641, corresponding to a target binding site such as BINDING SITE I, BINDING SITE II or BINDING SITE III of FIG. 8. Table 4 illustrates the complementarity of the nucleotide sequences of LOC285641 BINDING SITE, designated SEQ ID:3501, to the nucleotide sequence of GAM2071 RNA, herein designated GAM RNA, also designated SEQ ID:371.

Another function of GAM2071 is therefore inhibition of LOC285641 (Accession XP_209697.1). Accordingly, utilities of GAM2071 include diagnosis, prevention and treatment of diseases and clinical conditions associated with LOC285641.

LOC285679 (Accession XP_209719.2) is another GAM2071 target gene, herein designated TARGET GENE. LOC285679 BINDING SITE is a target binding site found in the 3' untranslated region of mRNA encoded by LOC285679, corresponding to a target binding site such as BINDING SITE I, BINDING SITE II or BINDING SITE III of FIG. 8. Table 4 illustrates the complementarity of the nucleotide sequences of LOC285679 BINDING SITE, designated SEQ ID:15031, to the nucleotide sequence of GAM2071 RNA, herein designated GAM RNA, also designated SEQ ID:371.

Another function of GAM2071 is therefore inhibition of LOC285679 (Accession XP_209719.2). Accordingly, utilities of GAM2071 include diagnosis, prevention and treatment of diseases and clinical conditions associated with LOC285679.

LOC285683 (Accession XP_211980.1) is another GAM2071 target gene, herein designated TARGET GENE. LOC285683 BINDING SITE is a target binding site found in the 5' untranslated region of mRNA encoded by LOC285683, corresponding to a target binding site such as BINDING SITE I, BINDING SITE II or BINDING SITE III of FIG. 8. Table 4 illustrates the complementarity of the nucleotide sequences of LOC285683 BINDING SITE, designated SEQ ID:5151, to the nucleotide sequence of GAM2071 RNA, herein designated GAM RNA, also designated SEQ ID:371.

Another function of GAM2071 is therefore inhibition of LOC285683 (Accession XP_211980.1). Accordingly, utilities of GAM2071 include diagnosis, prevention and treatment of diseases and clinical conditions associated with LOC285683.

LOC285687 (Accession XP_211985.1) is another GAM2071 target gene, herein designated TARGET GENE. LOC285687 BINDING SITE is a target binding site found in the 3' untranslated region of mRNA encoded by LOC285687, corresponding to a target binding site such as BINDING SITE I, BINDING SITE II or BINDING SITE III of FIG. 8. Table 4 illustrates the complementarity of the nucleotide sequences of LOC285687 BINDING SITE, designated SEQ ID:10580, to the nucleotide sequence of GAM2071 RNA, herein designated GAM RNA, also designated SEQ ID:371.

Another function of GAM2071 is therefore inhibition of LOC285687 (Accession XP_211985.1). Accordingly, utilities of GAM2071 include diagnosis, prevention and treatment of diseases and clinical conditions associated with LOC285687.

LOC285693 (Accession XP_211981.1) is another GAM2071 target gene, herein designated TARGET GENE. LOC285693 BINDING SITE is a target binding site found in the 5' untranslated region of mRNA encoded by LOC285693, corresponding to a target binding site such as BINDING SITE I, BINDING SITE II or BINDING SITE III of FIG. 8. Table 4 illustrates the complementarity of the nucleotide sequences of LOC285693 BINDING SITE, designated SEQ ID:7946, to the nucleotide sequence of GAM2071 RNA, herein designated GAM RNA, also designated SEQ ID:371.

Another function of GAM2071 is therefore inhibition of LOC285693 (Accession XP_211981.1). Accordingly, utilities of GAM2071 include diagnosis, prevention and treatment of diseases and clinical conditions associated with LOC285693.

LOC285722 (Accession XP_211997.1) is another GAM2071 target gene, herein designated TARGET GENE. LOC285722 BINDING SITE is a target binding site found in the 5' untranslated region of mRNA encoded by LOC285722, corresponding to a target binding site such as BINDING SITE I, BINDING SITE II or BINDING SITE III of FIG. 8. Table 4 illustrates the complementarity of the nucleotide sequences of LOC285722 BINDING SITE, designated SEQ ID:19494, to the nucleotide sequence of GAM2071 RNA, herein designated GAM RNA, also designated SEQ ID:371.

Another function of GAM2071 is therefore inhibition of LOC285722 (Accession XP_211997.1). Accordingly, utilities of GAM2071 include diagnosis, prevention and treatment of diseases and clinical conditions associated with LOC285722.

LOC285744 (Accession XP_209743.1) is another GAM2071 target gene, herein designated TARGET GENE. LOC285744 BINDING SITE is a target binding site found in the 3' untranslated region of mRNA encoded by LOC285744, corresponding to a target binding site such as BINDING SITE I, BINDING SITE II or BINDING SITE III of FIG. 8. Table 4 illustrates the complementarity of the nucleotide sequences of LOC285744 BINDING SITE, designated SEQ ID:11603, to the nucleotide sequence of GAM2071 RNA, herein designated GAM RNA, also designated SEQ ID:371.

Another function of GAM2071 is therefore inhibition of LOC285744 (Accession XP_209743.1). Accordingly, utilities of GAM2071 include diagnosis, prevention and treatment of diseases and clinical conditions associated with LOC285744.

LOC285747 (Accession XP_209742.1) is another GAM2071 target gene, herein designated TARGET GENE. LOC285747 BINDING SITE1 and LOC285747 BINDING SITE2 are target binding sites found in untranslated regions of mRNA encoded by LOC285747, corresponding to target binding sites such as BINDING SITE I, BINDING SITE II or BINDING SITE III of FIG. 8. Table 4 illustrates the complementarity of the nucleotide sequences of LOC285747 BINDING SITE1 and LOC285747 BINDING SITE2, designated SEQ ID:13800 and SEQ ID:9553 respectively, to the nucleotide sequence of GAM2071 RNA, herein designated GAM RNA, also designated SEQ ID:371.

Another function of GAM2071 is therefore inhibition of LOC285747 (Accession XP_209742.1). Accordingly, utilities of GAM2071 include diagnosis, prevention and treatment of diseases and clinical conditions associated with LOC285747.

LOC285812 (Accession XP_212055.1) is another GAM2071 target gene, herein designated TARGET GENE. LOC285812 BINDING SITE is a target binding site found in the 3' untranslated region of mRNA encoded by LOC285812, corresponding to a target binding site such as BINDING SITE I, BINDING SITE II or BINDING SITE III of FIG. 8. Table 4 illustrates the complementarity of the nucleotide sequences of LOC285812 BINDING SITE, designated SEQ ID:13275, to the nucleotide sequence of GAM2071 RNA, herein designated GAM RNA, also designated SEQ ID:371.

Another function of GAM2071 is therefore inhibition of LOC285812 (Accession XP_212055.1). Accordingly, utilities of GAM2071 include diagnosis, prevention and treatment of diseases and clinical conditions associated with LOC285812.

LOC285813 (Accession XP_212036.1) is another GAM2071 target gene, herein designated TARGET GENE. LOC285813 BINDING SITE is a target binding site found in the 5' untranslated region of mRNA encoded by LOC285813, corresponding to a target binding site such as BINDING SITE I, BINDING SITE II or BINDING SITE III of FIG. 8. Table 4 illustrates the complementarity of the nucleotide sequences of LOC285813 BINDING SITE, designated SEQ ID:17617, to the nucleotide sequence of GAM2071 RNA, herein designated GAM RNA, also designated SEQ ID:371.

Another function of GAM2071 is therefore inhibition of LOC285813 (Accession XP_212036.1). Accordingly, utilities of GAM2071 include diagnosis, prevention and treatment of diseases and clinical conditions associated with LOC285813.

LOC285821 (Accession XP_209789.1) is another GAM2071 target gene, herein designated TARGET GENE. LOC285821 BINDING SITE is a target binding site found in the 3' untranslated region of mRNA encoded by LOC285821, corresponding to a target binding site such as BINDING SITE I, BINDING SITE II or BINDING SITE III of FIG. 8. Table 4 illustrates the complementarity of the nucleotide sequences of LOC285821 BINDING SITE, designated SEQ ID:7849, to the nucleotide sequence of GAM2071 RNA, herein designated GAM RNA, also designated SEQ ID:371.

Another function of GAM2071 is therefore inhibition of LOC285821 (Accession XP_209789.1). Accordingly, utilities of GAM2071 include diagnosis, prevention and treatment of diseases and clinical conditions associated with LOC285821.

LOC285822 (Accession XP_209777.1) is another GAM2071 target gene, herein designated TARGET GENE. LOC285822 BINDING SITE is a target binding site found in the 5' untranslated region of mRNA encoded by LOC285822, corresponding to a target binding site such as BINDING SITE I, BINDING SITE II or BINDING SITE III of FIG. 8. Table 4 illustrates the complementarity of the nucleotide sequences of LOC285822 BINDING SITE, designated SEQ ID:6011, to the nucleotide sequence of GAM2071 RNA, herein designated GAM RNA, also designated SEQ ID:371.

Another function of GAM2071 is therefore inhibition of LOC285822 (Accession XP_209777.1). Accordingly, utilities of GAM2071 include diagnosis, prevention and treatment of diseases and clinical conditions associated with LOC285822.

LOC285830 (Accession XP_212043.1) is another GAM2071 target gene, herein designated TARGET GENE. LOC285830 BINDING SITE is a target binding site found in the 5' untranslated region of mRNA encoded by LOC285830, corresponding to a target binding site such as BINDING SITE I, BINDING SITE II or BINDING SITE III of FIG. 8. Table 4 illustrates the complementarity of the nucleotide sequences of LOC285830 BINDING SITE, designated SEQ ID:8939, to the nucleotide sequence of GAM2071 RNA, herein designated GAM RNA, also designated SEQ ID:371.

Another function of GAM2071 is therefore inhibition of LOC285830 (Accession XP_212043.1). Accordingly, utilities of GAM2071 include diagnosis, prevention and treatment of diseases and clinical conditions associated with LOC285830.

LOC285840 (Accession XP_208353.1) is another GAM2071 target gene, herein designated TARGET GENE. LOC285840 BINDING SITE is a target binding site found in the 3' untranslated region of mRNA encoded by LOC285840, corresponding to a target binding site such as BINDING SITE I, BINDING SITE II or BINDING SITE III of FIG. 8. Table 4 illustrates the complementarity of the nucleotide sequences of LOC285840 BINDING SITE, designated SEQ ID:15519, to the nucleotide sequence of GAM2071 RNA, herein designated GAM RNA, also designated SEQ ID:371.

Another function of GAM2071 is therefore inhibition of LOC285840 (Accession XP_208353.1). Accordingly, utilities of GAM2071 include diagnosis, prevention and treatment of diseases and clinical conditions associated with LOC285840.

LOC285843 (Accession XP_212034.1) is another GAM2071 target gene, herein designated TARGET GENE. LOC285843 BINDING SITE1 and LOC285843 BINDING SITE2 are target binding sites found in untranslated regions of mRNA encoded by LOC285843, corresponding to target binding sites such as BINDING SITE I, BINDING SITE II or BINDING SITE III of FIG. 8. Table 4 illustrates the complementarity of the nucleotide sequences of LOC285843 BINDING SITE1 and LOC285843 BINDING SITE2, designated SEQ ID:1414 and SEQ ID:11782 respectively, to the nucleotide sequence of GAM2071 RNA, herein designated GAM RNA, also designated SEQ ID:371.

Another function of GAM2071 is therefore inhibition of LOC285843 (Accession XP_212034.1). Accordingly, utilities of GAM2071 include diagnosis, prevention and treatment of diseases and clinical conditions associated with LOC285843.

LOC285847 (Accession XP_212045.1) is another GAM2071 target gene, herein designated TARGET GENE. LOC285847 BINDING SITE is a target binding site found in the 5' untranslated region of mRNA encoded by LOC285847, corresponding to a target binding site such as BINDING SITE I, BINDING SITE II or BINDING SITE III of FIG. 8. Table 4 illustrates the complementarity of the nucleotide sequences of LOC285847 BINDING SITE, designated SEQ ID:7212, to the nucleotide sequence of GAM2071 RNA, herein designated GAM RNA, also designated SEQ ID:371.

Another function of GAM2071 is therefore inhibition of LOC285847 (Accession XP_212045.1). Accordingly, utilities of GAM2071 include diagnosis, prevention and treatment of diseases and clinical conditions associated with LOC285847.

LOC285872 (Accession XP_212061.1) is another GAM2071 target gene, herein designated TARGET GENE. LOC285872 BINDING SITE is a target binding site found in the 3' untranslated region of mRNA encoded by LOC285872, corresponding to a target binding site such as BINDING SITE I, BINDING SITE II or BINDING SITE III of FIG. 8. Table 4 illustrates the complementarity of the nucleotide sequences of LOC285872 BINDING SITE, designated SEQ ID:7986, to the nucleotide sequence of GAM2071 RNA, herein designated GAM RNA, also designated SEQ ID:371.

Another function of GAM2071 is therefore inhibition of LOC285872 (Accession XP_212061.1). Accordingly, utilities of GAM2071 include diagnosis, prevention and treatment of diseases and clinical conditions associated with LOC285872.

LOC285896 (Accession XP_209806.1) is another GAM2071 target gene, herein designated TARGET GENE. LOC285896 BINDING SITE is a target binding site found in the 3' untranslated region of mRNA encoded by LOC285896, corresponding to a target binding site such as BINDING SITE I, BINDING SITE II or BINDING SITE III of FIG. 8. Table 4 illustrates the complementarity of the nucleotide sequences of LOC285896 BINDING SITE, designated SEQ ID:4795, to the nucleotide sequence of GAM2071 RNA, herein designated GAM RNA, also designated SEQ ID:371.

Another function of GAM2071 is therefore inhibition of LOC285896 (Accession XP_209806.1). Accordingly, utilities of GAM2071 include diagnosis, prevention and treatment of diseases and clinical conditions associated with LOC285896.

LOC285922 (Accession XP_209822.1) is another GAM2071 target gene, herein designated TARGET GENE. LOC285922 BINDING SITE is a target binding site found in the 3' untranslated region of mRNA encoded by LOC285922, corresponding to a target binding site such as BINDING SITE I, BINDING SITE II or BINDING SITE III of FIG. 8. Table 4 illustrates the complementarity of the nucleotide sequences of LOC285922 BINDING SITE, designated SEQ ID:4795, to the nucleotide sequence of GAM2071 RNA, herein designated GAM RNA, also designated SEQ ID:371.

Another function of GAM2071 is therefore inhibition of LOC285922 (Accession XP_209822.1). Accordingly, utilities of GAM2071 include diagnosis, prevention and treatment of diseases and clinical conditions associated with LOC285922.

LOC285923 (Accession XP_212104.1) is another GAM2071 target gene, herein designated TARGET GENE. LOC285923 BINDING SITE is a target binding site found in the 3' untranslated region of mRNA encoded by LOC285923, corresponding to a target binding site such as BINDING SITE I, BINDING SITE II or BINDING SITE III of FIG. 8. Table 4 illustrates the complementarity of the nucleotide sequences of LOC285923 BINDING SITE, designated SEQ ID:16934, to the nucleotide sequence of GAM2071 RNA, herein designated GAM RNA, also designated SEQ ID:371.

Another function of GAM2071 is therefore inhibition of LOC285923 (Accession XP_212104.1). Accordingly, utilities of GAM2071 include diagnosis, prevention and treatment of diseases and clinical conditions associated with LOC285923.

LOC285930 (Accession XP_209818.1) is another GAM2071 target gene, herein designated TARGET GENE. LOC285930 BINDING SITE is a target binding site found in the 5' untranslated region of mRNA encoded by LOC285930, corresponding to a target binding site such as BINDING SITE I, BINDING SITE II or BINDING SITE III of FIG. 8. Table 4 illustrates the complementarity of the nucleotide sequences of LOC285930 BINDING SITE, designated SEQ ID:3828, to the nucleotide sequence of GAM2071 RNA, herein designated GAM RNA, also designated SEQ ID:371.

Another function of GAM2071 is therefore inhibition of LOC285930 (Accession XP_209818.1). Accordingly, utilities of GAM2071 include diagnosis, prevention and treatment of diseases and clinical conditions associated with LOC285930.

LOC285945 (Accession XP_212092.1) is another GAM2071 target gene, herein designated TARGET GENE. LOC285945 BINDING SITE is a target binding site found in the 5' untranslated region of mRNA encoded by LOC285945, corresponding to a target binding site such as BINDING SITE I, BINDING SITE II or BINDING SITE III of FIG. 8. Table 4 illustrates the complementarity of the nucleotide sequences of LOC285945 BINDING SITE, designated SEQ ID:12385, to the nucleotide sequence of GAM2071 RNA, herein designated GAM RNA, also designated SEQ ID:371.

Another function of GAM2071 is therefore inhibition of LOC285945 (Accession XP_212092.1). Accordingly, utilities of GAM2071 include diagnosis, prevention and treatment of diseases and clinical conditions associated with LOC285945.

LOC285952 (Accession XP_209821.1) is another GAM2071 target gene, herein designated TARGET GENE. LOC285952 BINDING SITE is a target binding site found in the 3' untranslated region of mRNA encoded by LOC285952, corresponding to a target binding site such as BINDING SITE I, BINDING SITE II or BINDING SITE III of FIG. 8. Table 4 illustrates the complementarity of the nucleotide sequences of LOC285952 BINDING SITE, designated SEQ ID:2758, to the nucleotide sequence of GAM2071 RNA, herein designated GAM RNA, also designated SEQ ID:371.

Another function of GAM2071 is therefore inhibition of LOC285952 (Accession XP_209821.1). Accordingly, utilities of GAM2071 include diagnosis, prevention and treatment of diseases and clinical conditions associated with LOC285952.

LOC285961 (Accession XP_209833.1) is another GAM2071 target gene, herein designated TARGET GENE. LOC285961 BINDING SITE is a target binding site found in the 5' untranslated region of mRNA encoded by LOC285961, corresponding to a target binding site such as BINDING SITE I, BINDING SITE II or BINDING SITE III of FIG. 8. Table 4 illustrates the complementarity of the nucleotide sequences of LOC285961 BINDING SITE, designated SEQ ID:11621, to the nucleotide sequence of GAM2071 RNA, herein designated GAM RNA, also designated SEQ ID:371.

Another function of GAM2071 is therefore inhibition of LOC285961 (Accession XP_209833.1). Accordingly, utilities of GAM2071 include diagnosis, prevention and treatment of diseases and clinical conditions associated with LOC285961.

LOC285972 (Accession XP_212105.1) is another GAM2071 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:8156, to the nucleotide sequence of GAM2071 RNA, herein designated GAM RNA, also designated SEQ ID:371.

Another function of GAM2071 is therefore inhibition of LOC285972 (Accession XP_212105.1). Accordingly, utilities of GAM2071 include diagnosis, prevention and treatment of diseases and clinical conditions associated with LOC285972.

LOC285979 (Accession XP_212117.1) is another GAM2071 target gene, herein designated TARGET GENE. LOC285979 BINDING SITE is a target binding site found in the 5' untranslated region of mRNA encoded by LOC285979, corresponding to a target binding site such as BINDING SITE I, BINDING SITE II or BINDING SITE III of FIG. 8. Table 4 illustrates the complementarity of the nucleotide sequences of LOC285979 BINDING SITE, designated SEQ ID:3889, to the nucleotide sequence of GAM2071 RNA, herein designated GAM RNA, also designated SEQ ID:371.

Another function of GAM2071 is therefore inhibition of LOC285979 (Accession XP_212117.1). Accordingly, utilities of GAM2071 include diagnosis, prevention and treatment of diseases and clinical conditions associated with LOC285979.

LOC286029 (Accession XP_209866.1) is another GAM2071 target gene, herein designated TARGET GENE. LOC286029 BINDING SITE is a target binding site found in the 3' untranslated region of mRNA encoded by LOC286029, corresponding to a target binding site such as BINDING SITE I, BINDING SITE II or BINDING SITE III of FIG. 8. Table 4 illustrates the complementarity of the nucleotide sequences of LOC286029 BINDING SITE, designated SEQ ID:14224, to the nucleotide sequence of GAM2071 RNA, herein designated GAM RNA, also designated SEQ ID:371.

Another function of GAM2071 is therefore inhibition of LOC286029 (Accession XP_209866.1). Accordingly, utilities of GAM2071 include diagnosis, prevention and treatment of diseases and clinical conditions associated with LOC286029.

LOC286032 (Accession XP_209867.2) is another GAM2071 target gene, herein designated TARGET GENE. LOC286032 BINDING SITE is a target binding site found in the 3' untranslated region of mRNA encoded by LOC286032, corresponding to a target binding site such as BINDING SITE I, BINDING SITE II or BINDING SITE III of FIG. 8. Table 4 illustrates the complementarity of the nucleotide sequences of LOC286032 BINDING SITE, designated SEQ ID:1208, to the nucleotide sequence of GAM2071 RNA, herein designated GAM RNA, also designated SEQ ID:371.

Another function of GAM2071 is therefore inhibition of LOC286032 (Accession XP_209867.2). Accordingly, utilities of GAM2071 include diagnosis, prevention and treatment of diseases and clinical conditions associated with LOC286032.

LOC286052 (Accession XP_212152.1) is another GAM2071 target gene, herein designated TARGET GENE. LOC286052 BINDING SITE is a target binding site found in the 3' untranslated region of mRNA encoded by LOC286052, corresponding to a target binding site such as BINDING SITE I, BINDING SITE II or BINDING SITE III of FIG. 8. Table 4 illustrates the complementarity of the nucleotide sequences of LOC286052 BINDING SITE, designated SEQ ID:14748, to the nucleotide sequence of GAM2071 RNA, herein designated GAM RNA, also designated SEQ ID:371.

Another function of GAM2071 is therefore inhibition of LOC286052 (Accession XP_212152.1). Accordingly, utilities of GAM2071 include diagnosis, prevention and treatment of diseases and clinical conditions associated with LOC286052.

LOC286077 (Accession XP_209892.1) is another GAM2071 target gene, herein designated TARGET GENE. LOC286077 BINDING SITE is a target binding site found in the 3' untranslated region of mRNA encoded by LOC286077, corresponding to a target binding site such as BINDING SITE I, BINDING SITE II or BINDING SITE III of FIG. 8. Table 4 illustrates the complementarity of the nucleotide sequences of LOC286077 BINDING SITE, designated SEQ ID:3388, to the nucleotide sequence of GAM2071 RNA, herein designated GAM RNA, also designated SEQ ID:371.

Another function of GAM2071 is therefore inhibition of LOC286077 (Accession XP_209892.1). Accordingly, utilities of GAM2071 include diagnosis, prevention and treatment of diseases and clinical conditions associated with LOC286077.

LOC286078 (Accession XP_212163.1) is another GAM2071 target gene, herein designated TARGET GENE. LOC286078 BINDING SITE1 and LOC286078 BINDING SITE2 are target binding sites found in untranslated regions of mRNA encoded by LOC286078, corresponding to target binding sites such as BINDING SITE I, BINDING SITE II or BINDING SITE III of FIG. 8. Table 4 illustrates the complementarity of the nucleotide sequences of LOC286078 BINDING SITE1 and LOC286078 BINDING SITE2, designated SEQ ID:8139 and SEQ ID:12045 respectively, to the nucleotide sequence of GAM2071 RNA, herein designated GAM RNA, also designated SEQ ID:371.

Another function of GAM2071 is therefore inhibition of LOC286078 (Accession XP_212163.1). Accordingly, utilities of GAM2071 include diagnosis, prevention and treatment of diseases and clinical conditions associated with LOC286078.

LOC286103 (Accession NP_848630.1) is another GAM2071 target gene, herein designated TARGET GENE. LOC286103 BINDING SITE is a target binding site found in the 3' untranslated region of multiple transcripts of mRNA encoded by LOC286103, corresponding to a target binding site such as BINDING SITE I, BINDING SITE II or BINDING SITE III of FIG. 8. Table 4 illustrates the complementarity of the nucleotide sequences of LOC286103 BINDING SITE, designated SEQ ID:15670, to the nucleotide sequence of GAM2071 RNA, herein designated GAM RNA, also designated SEQ ID:371.

Another function of GAM2071 is therefore inhibition of LOC286103 (Accession NP_848630.1). Accordingly, utilities of GAM2071 include diagnosis, prevention and treatment of diseases and clinical conditions associated with LOC286103.

LOC286103 (Accession XP_209897.1) is another GAM2071 target gene, herein designated TARGET GENE. LOC286103 BINDING SITE is a target binding site found in the 3' untranslated region of multiple transcripts of mRNA encoded by LOC286103, corresponding to a target binding site such as BINDING SITE I, BINDING SITE II or BIND- ING SITE III of FIG. 8. Table 4 illustrates the complementarity of the nucleotide sequences of LOC286103 BINDING SITE, designated SEQ ID:15670, to the nucleotide sequence of GAM2071 RNA, herein designated GAM RNA, also designated SEQ ID:371.

Another function of GAM2071 is therefore inhibition of LOC286103 (Accession XP_209897.1). Accordingly, utilities of GAM2071 include diagnosis, prevention and treatment of diseases and clinical conditions associated with LOC286103.

LOC286121 (Accession XP_212184.3) is another GAM2071 target gene, herein designated TARGET GENE. LOC286121 BINDING SITE is a target binding site found in the 3' untranslated region of mRNA encoded by LOC286121, corresponding to a target binding site such as BINDING SITE I, BINDING SITE II or BINDING SITE III of FIG. 8. Table 4 illustrates the complementarity of the nucleotide sequences of LOC286121 BINDING SITE, designated SEQ ID:19438, to the nucleotide sequence of GAM2071 RNA, herein designated GAM RNA, also designated SEQ ID:371.

Another function of GAM2071 is therefore inhibition of LOC286121 (Accession XP_212184.3). Accordingly, utilities of GAM2071 include diagnosis, prevention and treatment of diseases and clinical conditions associated with LOC286121.

LOC286126 (Accession XP_212185.1) is another GAM2071 target gene, herein designated TARGET GENE. LOC286126 BINDING SITE is a target binding site found in the 3' untranslated region of mRNA encoded by LOC286126, corresponding to a target binding site such as BINDING SITE I, BINDING SITE II or BINDING SITE III of FIG. 8. Table 4 illustrates the complementarity of the nucleotide sequences of LOC286126 BINDING SITE, designated SEQ ID:8950, to the nucleotide sequence of GAM2071 RNA, herein designated GAM RNA, also designated SEQ ID:371.

Another function of GAM2071 is therefore inhibition of LOC286126 (Accession XP_212185.1). Accordingly, utilities of GAM2071 include diagnosis, prevention and treatment of diseases and clinical conditions associated with LOC286126.

LOC286132 (Accession XP_212194.1) is another GAM2071 target gene, herein designated TARGET GENE. LOC286132 BINDING SITE is a target binding site found in the 5' untranslated region of mRNA encoded by LOC286132, corresponding to a target binding site such as BINDING SITE I, BINDING SITE II or BINDING SITE III of FIG. 8. Table 4 illustrates the complementarity of the nucleotide sequences of LOC286132 BINDING SITE, designated SEQ ID:2266, to the nucleotide sequence of GAM2071 RNA, herein designated GAM RNA, also designated SEQ ID:371.

Another function of GAM2071 is therefore inhibition of LOC286132 (Accession XP_212194.1). Accordingly, utilities of GAM2071 include diagnosis, prevention and treatment of diseases and clinical conditions associated with LOC286132.

LOC286166 (Accession XP_209925.1) is another GAM2071 target gene, herein designated TARGET GENE. LOC286166 BINDING SITE is a target binding site found in the 5' untranslated region of mRNA encoded by LOC286166, corresponding to a target binding site such as BINDING SITE I, BINDING SITE II or BINDING SITE III of FIG. 8. Table 4 illustrates the complementarity of the nucleotide sequences of LOC286166 BINDING SITE, designated SEQ ID:1529, to the nucleotide sequence of GAM2071 RNA, herein designated GAM RNA, also designated SEQ ID:371.

Another function of GAM2071 is therefore inhibition of LOC286166 (Accession XP_209925.1). Accordingly, utilities of GAM2071 include diagnosis, prevention and treatment of diseases and clinical conditions associated with LOC286166.

LOC286186 (Accession XP_212219.1) is another GAM2071 target gene, herein designated TARGET GENE. LOC286186 BINDING SITE1 and LOC286186 BINDING SITE2 are target binding sites found in untranslated regions of mRNA encoded by LOC286186, corresponding to target binding sites such as BINDING SITE I, BINDING SITE II or BINDING SITE III of FIG. 8. Table 4 illustrates the complementarity of the nucleotide sequences of LOC286186 BINDING SITE1 and LOC286186 BINDING SITE2, designated SEQ ID:15317 and SEQ ID:13117 respectively, to the nucleotide sequence of GAM2071 RNA, herein designated GAM RNA, also designated SEQ ID:371.

Another function of GAM2071 is therefore inhibition of LOC286186 (Accession XP_212219.1). Accordingly, utilities of GAM2071 include diagnosis, prevention and treatment of diseases and clinical conditions associated with LOC286186.

LOC286207 (Accession XP_209941.1) is another GAM2071 target gene, herein designated TARGET GENE. LOC286207 BINDING SITE is a target binding site found in the 3' untranslated region of mRNA encoded by LOC286207, corresponding to a target binding site such as BINDING SITE I, BINDING SITE II or BINDING SITE III of FIG. 8. Table 4 illustrates the complementarity of the nucleotide sequences of LOC286207 BINDING SITE, designated SEQ ID:16987, to the nucleotide sequence of GAM2071 RNA, herein designated GAM RNA, also designated SEQ ID:371.

Another function of GAM2071 is therefore inhibition of LOC286207 (Accession XP_209941.1). Accordingly, utilities of GAM2071 include diagnosis, prevention and treatment of diseases and clinical conditions associated with LOC286207.

LOC286208 (Accession XP_212230.1) is another GAM2071 target gene, herein designated TARGET GENE. LOC286208 BINDING SITE1 and LOC286208 BINDING SITE2 are target binding sites found in untranslated regions of mRNA encoded by LOC286208, corresponding to target binding sites such as BINDING SITE I, BINDING SITE II or BINDING SITE III of FIG. 8. Table 4 illustrates the complementarity of the nucleotide sequences of LOC286208 BINDING SITE1 and LOC286208 BINDING SITE2, designated SEQ ID:16222 and SEQ ID:14347 respectively, to the nucleotide sequence of GAM2071 RNA, herein designated GAM RNA, also designated SEQ ID:371.

Another function of GAM2071 is therefore inhibition of LOC286208 (Accession XP_212230.1). Accordingly, utilities of GAM2071 include diagnosis, prevention and treatment of diseases and clinical conditions associated with LOC286208.

LOC286215 (Accession XP_212228.1) is another GAM2071 target gene, herein designated TARGET GENE. LOC286215 BINDING SITE is a target binding site found in the 5' untranslated region of mRNA encoded by LOC286215, corresponding to a target binding site such as BINDING SITE I, BINDING SITE II or BINDING SITE III of FIG. 8. Table 4 illustrates the complementarity of the nucleotide sequences of LOC286215 BINDING SITE, designated SEQ ID:14899, to the nucleotide sequence of GAM2071 RNA, herein designated GAM RNA, also designated SEQ ID:371.

Another function of GAM2071 is therefore inhibition of LOC286215 (Accession XP_212228.1). Accordingly, utilities of GAM2071 include diagnosis, prevention and treatment of diseases and clinical conditions associated with LOC286215.

LOC286245 (Accession XP_212244.1) is another GAM2071 target gene, herein designated TARGET GENE. LOC286245 BINDING SITE is a target binding site found in the 5' untranslated region of mRNA encoded by LOC286245, corresponding to a target binding site such as BINDING SITE I, BINDING SITE II or BINDING SITE III of FIG. 8. Table 4 illustrates the complementarity of the nucleotide sequences of LOC286245 BINDING SITE, designated SEQ ID:4711, to the nucleotide sequence of GAM2071 RNA, herein designated GAM RNA, also designated SEQ ID:371.

Another function of GAM2071 is therefore inhibition of LOC286245 (Accession XP_212244.1). Accordingly, utilities of GAM2071 include diagnosis, prevention and treatment of diseases and clinical conditions associated with LOC286245.

LOC286341 (Accession XP_212278.1) is another GAM2071 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:14403, to the nucleotide sequence of GAM2071 RNA, herein designated GAM RNA, also designated SEQ ID:371.

Another function of GAM2071 is therefore inhibition of LOC286341 (Accession XP_212278.1). Accordingly, utilities of GAM2071 include diagnosis, prevention and treatment of diseases and clinical conditions associated with LOC286341.

LOC286356 (Accession XP_212290.1) is another GAM2071 target gene, herein designated TARGET GENE. LOC286356 BINDING SITE is a target binding site found in the 5' untranslated region of mRNA encoded by LOC286356, corresponding to a target binding site such as BINDING SITE I, BINDING SITE II or BINDING SITE III of FIG. 8. Table 4 illustrates the complementarity of the nucleotide sequences of LOC286356 BINDING SITE, designated SEQ ID:13800, to the nucleotide sequence of GAM2071 RNA, herein designated GAM RNA, also designated SEQ ID:371.

Another function of GAM2071 is therefore inhibition of LOC286356 (Accession XP_212290.1). Accordingly, utilities of GAM2071 include diagnosis, prevention and treatment of diseases and clinical conditions associated with LOC286356.

LOC286357 (Accession XP_212285.1) is another GAM2071 target gene, herein designated TARGET GENE. LOC286357 BINDING SITE is a target binding site found in the 5' untranslated region of mRNA encoded by LOC286357, corresponding to a target binding site such as BINDING SITE I, BINDING SITE II or BINDING SITE III of FIG. 8. Table 4 illustrates the complementarity of the nucleotide sequences of LOC286357 BINDING SITE, designated SEQ ID:13894, to the nucleotide sequence of GAM2071 RNA, herein designated GAM RNA, also designated SEQ ID:371.

Another function of GAM2071 is therefore inhibition of LOC286357 (Accession XP_212285.1). Accordingly, utilities of GAM2071 include diagnosis, prevention and treatment of diseases and clinical conditions associated with LOC286357.

LOC286441 (Accession XP_212319.1) is another GAM2071 target gene, herein designated TARGET GENE. LOC286441 BINDING SITE is a target binding site found in the 3' untranslated region of mRNA encoded by LOC286441, corresponding to a target binding site such as BINDING SITE I, BINDING SITE II or BINDING SITE III of FIG. 8. Table 4 illustrates the complementarity of the nucleotide sequences of LOC286441 BINDING SITE, designated SEQ ID:643, to the nucleotide sequence of GAM2071 RNA, herein designated GAM RNA, also designated SEQ ID:371.

Another function of GAM2071 is therefore inhibition of LOC286441 (Accession XP_212319.1). Accordingly, utilities of GAM2071 include diagnosis, prevention and treatment of diseases and clinical conditions associated with LOC286441.

LOC286553 (Accession XP_212340.1) is another GAM2071 target gene, herein designated TARGET GENE. LOC286553 BINDING SITE is a target binding site found in the 3' untranslated region of mRNA encoded by LOC286553, corresponding to a target binding site such as BINDING SITE I, BINDING SITE II or BINDING SITE III of FIG. 8. Table 4 illustrates the complementarity of the nucleotide sequences of LOC286553 BINDING SITE, designated SEQ ID:17107, to the nucleotide sequence of GAM2071 RNA, herein designated GAM RNA, also designated SEQ ID:371.

Another function of GAM2071 is therefore inhibition of LOC286553 (Accession XP_212340.1). Accordingly, utilities of GAM2071 include diagnosis, prevention and treatment of diseases and clinical conditions associated with LOC286553.

LOC338562 (Accession XP_294654.1) is another GAM2071 target gene, herein designated TARGET GENE. LOC338562 BINDING SITE is a target binding site found in the 3' untranslated region of mRNA encoded by LOC338562, corresponding to a target binding site such as BINDING SITE I, BINDING SITE II or BINDING SITE III of FIG. 8. Table 4 illustrates the complementarity of the nucleotide sequences of LOC338562 BINDING SITE, designated SEQ ID:17586, to the nucleotide sequence of GAM2071 RNA, herein designated GAM RNA, also designated SEQ ID:371.

Another function of GAM2071 is therefore inhibition of LOC338562 (Accession XP_294654.1). Accordingly, utilities of GAM2071 include diagnosis, prevention and treatment of diseases and clinical conditions associated with LOC338562.

LOC338579 (Accession XP_290472.1) is another GAM2071 target gene, herein designated TARGET GENE. LOC338579 BINDING SITE is a target binding site found in the 3' untranslated region of mRNA encoded by LOC338579, corresponding to a target binding site such as BINDING SITE I, BINDING SITE II or BINDING SITE III of FIG. 8. Table 4 illustrates the complementarity of the nucleotide sequences of LOC338579 BINDING SITE, designated SEQ ID:18756, to the nucleotide sequence of GAM2071 RNA, herein designated GAM RNA, also designated SEQ ID:371.

Another function of GAM2071 is therefore inhibition of LOC338579 (Accession XP_290472.1). Accordingly, utilities of GAM2071 include diagnosis, prevention and treatment of diseases and clinical conditions associated with LOC338579.

LOC338709 (Accession XP_211595.2) is another GAM2071 target gene, herein designated TARGET GENE. LOC338709 BINDING SITE is a target binding site found in the 5' untranslated region of mRNA encoded by LOC338709, corresponding to a target binding site such as BINDING SITE I, BINDING SITE II or BINDING SITE III of FIG. 8. Table 4 illustrates the complementarity of the nucleotide sequences of LOC338709 BINDING SITE, designated SEQ ID:902, to the nucleotide sequence of GAM2071 RNA, herein designated GAM RNA, also designated SEQ ID:371.

Another function of GAM2071 is therefore inhibition of LOC338709 (Accession XP_211595.2). Accordingly, utilities of GAM2071 include diagnosis, prevention and treatment of diseases and clinical conditions associated with LOC338709.

LOC338739 (Accession XP_294690.1) is another GAM2071 target gene, herein designated TARGET GENE. LOC338739 BINDING SITE is a target binding site found in the 3' untranslated region of mRNA encoded by LOC338739, corresponding to a target binding site such as BINDING SITE I, BINDING SITE II or BINDING SITE III of FIG. 8. Table 4 illustrates the complementarity of the nucleotide sequences of LOC338739 BINDING SITE, designated SEQ ID:11661, to the nucleotide sequence of GAM2071 RNA, herein designated GAM RNA, also designated SEQ ID:371.

Another function of GAM2071 is therefore inhibition of LOC338739 (Accession XP_294690.1). Accordingly, utilities of GAM2071 include diagnosis, prevention and treatment of diseases and clinical conditions associated with LOC338739.

LOC338773 (Accession XP_290570.1) is another GAM2071 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:17388, to the nucleotide sequence of GAM2071 RNA, herein designated GAM RNA, also designated SEQ ID:371.

Another function of GAM2071 is therefore inhibition of LOC338773 (Accession XP_290570.1). Accordingly, utilities of GAM2071 include diagnosis, prevention and treatment of diseases and clinical conditions associated with LOC338773.

LOC338817 (Accession XP_290588.1) is another GAM2071 target gene, herein designated TARGET GENE. LOC338817 BINDING SITE is a target binding site found in the 3' untranslated region of mRNA encoded by LOC338817, corresponding to a target binding site such as BINDING SITE I, BINDING SITE II or BINDING SITE III of FIG. 8. Table 4 illustrates the complementarity of the nucleotide sequences of LOC338817 BINDING SITE, designated SEQ ID:11448, to the nucleotide sequence of GAM2071 RNA, herein designated GAM RNA, also designated SEQ ID:371.

Another function of GAM2071 is therefore inhibition of LOC338817 (Accession XP_290588.1). Accordingly, utilities of GAM2071 include diagnosis, prevention and treatment of diseases and clinical conditions associated with LOC338817.

LOC338899 (Accession XP_294740.1) is another GAM2071 target gene, herein designated TARGET GENE. LOC338899 BINDING SITE is a target binding site found in the 5' untranslated region of mRNA encoded by LOC338899, corresponding to a target binding site such as BINDING SITE I, BINDING SITE II or BINDING SITE III of FIG. 8. Table 4 illustrates the complementarity of the nucleotide sequences of LOC338899 BINDING SITE, designated SEQ ID:8888, to the nucleotide sequence of GAM2071 RNA, herein designated GAM RNA, also designated SEQ ID:371.

Another function of GAM2071 is therefore inhibition of LOC338899 (Accession XP_294740.1). Accordingly, utilities of GAM2071 include diagnosis, prevention and treatment of diseases and clinical conditions associated with LOC338899.

LOC338923 (Accession XP_294742.1) is another GAM2071 target gene, herein designated TARGET GENE. LOC338923 BINDING SITE1 and LOC338923 BINDING SITE2 are target binding sites found in untranslated regions of mRNA encoded by LOC338923, corresponding to target binding sites such as BINDING SITE I, BINDING SITE II or BINDING SITE III of FIG. 8. Table 4 illustrates the complementarity of the nucleotide sequences of LOC338923 BINDING SITE1 and LOC338923 BINDING SITE2, designated SEQ ID:14847 and SEQ ID:3243 respectively, to the nucleotide sequence of GAM2071 RNA, herein designated GAM RNA, also designated SEQ ID:371.

Another function of GAM2071 is therefore inhibition of LOC338923 (Accession XP_294742.1). Accordingly, utilities of GAM2071 include diagnosis, prevention and treatment of diseases and clinical conditions associated with LOC338923.

LOC339078 (Accession XP_290692.1) is another GAM2071 target gene, herein designated TARGET GENE. LOC339078 BINDING SITE1 and LOC339078 BINDING SITE2 are target binding sites found in untranslated regions of mRNA encoded by LOC339078, corresponding to target binding sites such as BINDING SITE I, BINDING SITE II or BINDING SITE III of FIG. 8. Table 4 illustrates the complementarity of the nucleotide sequences of LOC339078 BINDING SITE1 and LOC339078 BINDING SITE2, designated SEQ ID:7937 and SEQ ID:19426 respectively, to the nucleotide sequence of GAM2071 RNA, herein designated GAM RNA, also designated SEQ ID:371.

Another function of GAM2071 is therefore inhibition of LOC339078 (Accession XP_290692.1). Accordingly, utilities of GAM2071 include diagnosis, prevention and treatment of diseases and clinical conditions associated with LOC339078.

LOC339146 (Accession XP_294825.1) is another GAM2071 target gene, herein designated TARGET GENE. LOC339146 BINDING SITE is a target binding site found in the 5' untranslated region of mRNA encoded by LOC339146, corresponding to a target binding site such as BINDING SITE I, BINDING SITE II or BINDING SITE III of FIG. 8. Table 4 illustrates the complementarity of the nucleotide sequences of LOC339146 BINDING SITE, designated SEQ ID:822, to the nucleotide sequence of GAM2071 RNA, herein designated GAM RNA, also designated SEQ ID:371.

Another function of GAM2071 is therefore inhibition of LOC339146 (Accession XP_294825.1). Accordingly, utilities of GAM2071 include diagnosis, prevention and treatment of diseases and clinical conditions associated with LOC339146.

LOC339178 (Accession XP_290742.1) is another GAM2071 target gene, herein designated TARGET GENE. LOC339178 BINDING SITE is a target binding site found in the 3' untranslated region of mRNA encoded by LOC339178, corresponding to a target binding site such as BINDING SITE I, BINDING SITE II or BINDING SITE III of FIG. 8. Table 4 illustrates the complementarity of the nucleotide sequences of LOC339178 BINDING SITE, designated SEQ ID:16519, to the nucleotide sequence of GAM2071 RNA, herein designated GAM RNA, also designated SEQ ID:371.

Another function of GAM2071 is therefore inhibition of LOC339178 (Accession XP_290742.1). Accordingly, utilities of GAM2071 include diagnosis, prevention and treatment of diseases and clinical conditions associated with LOC339178.

LOC339201 (Accession XP_290756.1) is another GAM2071 target gene, herein designated TARGET GENE. LOC339201 BINDING SITE is a target binding site found in the 3' untranslated region of mRNA encoded by LOC339201, corresponding to a target binding site such as BINDING SITE I, BINDING SITE II or BINDING SITE III of FIG. 8. Table 4 illustrates the complementarity of the nucleotide sequences of LOC339201 BINDING SITE, designated SEQ ID:11830, to the nucleotide sequence of GAM2071 RNA, herein designated GAM RNA, also designated SEQ ID:371.

Another function of GAM2071 is therefore inhibition of LOC339201 (Accession XP_290756.1). Accordingly, utilities of GAM2071 include diagnosis, prevention and treatment of diseases and clinical conditions associated with LOC339201.

LOC339298 (Accession XP_294903.1) is another GAM2071 target gene, herein designated TARGET GENE. LOC339298 BINDING SITE is a target binding site found in the 5' untranslated region of mRNA encoded by LOC339298, corresponding to a target binding site such as BINDING SITE I, BINDING SITE II or BINDING SITE III of FIG. 8. Table 4 illustrates the complementarity of the nucleotide sequences of LOC339298 BINDING SITE, designated SEQ ID:3121, to the nucleotide sequence of GAM2071 RNA, herein designated GAM RNA, also designated SEQ ID:371.

Another function of GAM2071 is therefore inhibition of LOC339298 (Accession XP_294903.1). Accordingly, utilities of GAM2071 include diagnosis, prevention and treatment of diseases and clinical conditions associated with LOC339298.

LOC339318 (Accession XP_290835.1) is another GAM2071 target gene, herein designated TARGET GENE. LOC339318 BINDING SITE is a target binding site found in the 3' untranslated region of mRNA encoded by LOC339318, corresponding to a target binding site such as BINDING SITE I, BINDING SITE II or BINDING SITE III of FIG. 8. Table 4 illustrates the complementarity of the nucleotide sequences of LOC339318 BINDING SITE, designated SEQ ID:10660, to the nucleotide sequence of GAM2071 RNA, herein designated GAM RNA, also designated SEQ ID:371.

Another function of GAM2071 is therefore inhibition of LOC339318 (Accession XP_290835.1). Accordingly, utilities of GAM2071 include diagnosis, prevention and treatment of diseases and clinical conditions associated with LOC339318.

LOC339325 (Accession XP_290830.1) is another GAM2071 target gene, herein designated TARGET GENE. LOC339325 BINDING SITE1 and LOC339325 BINDING SITE2 are target binding sites found in untranslated regions of mRNA encoded by LOC339325, corresponding to target binding sites such as BINDING SITE I, BINDING SITE II or BINDING SITE III of FIG. 8. Table 4 illustrates the complementarity of the nucleotide sequences of LOC339325 BINDING SITE1 and LOC339325 BINDING SITE2, designated SEQ ID:13290 and SEQ ID:7946 respectively, to the nucleotide sequence of GAM2071 RNA, herein designated GAM RNA, also designated SEQ ID:371.

Another function of GAM2071 is therefore inhibition of LOC339325 (Accession XP_290830.1). Accordingly, utilities of GAM2071 include diagnosis, prevention and treatment of diseases and clinical conditions associated with LOC339325.

LOC339417 (Accession XP_294944.1) is another GAM2071 target gene, herein designated TARGET GENE. LOC339417 BINDING SITE is a target binding site found in the 5' untranslated region of mRNA encoded by LOC339417, corresponding to a target binding site such as BINDING SITE I, BINDING SITE II or BINDING SITE III of FIG. 8. Table 4 illustrates the complementarity of the nucleotide sequences of LOC339417 BINDING SITE, designated SEQ ID:4497, to the nucleotide sequence of GAM2071 RNA, herein designated GAM RNA, also designated SEQ ID:371.

Another function of GAM2071 is therefore inhibition of LOC339417 (Accession XP_294944.1). Accordingly, utilities of GAM2071 include diagnosis, prevention and treatment of diseases and clinical conditions associated with LOC339417.

LOC339448 (Accession XP_290902.1) is another GAM2071 target gene, herein designated TARGET GENE. LOC339448 BINDING SITE is a target binding site found in the 3' untranslated region of mRNA encoded by LOC339448, corresponding to a target binding site such as BINDING SITE I, BINDING SITE II or BINDING SITE III of FIG. 8. Table 4 illustrates the complementarity of the nucleotide sequences of LOC339448 BINDING SITE, designated SEQ ID:19680, to the nucleotide sequence of GAM2071 RNA, herein designated GAM RNA, also designated SEQ ID:371.

Another function of GAM2071 is therefore inhibition of LOC339448 (Accession XP_290902.1). Accordingly, utilities of GAM2071 include diagnosis, prevention and treatment of diseases and clinical conditions associated with LOC339448.

LOC339458 (Accession XP_290911.1) is another GAM2071 target gene, herein designated TARGET GENE. LOC339458 BINDING SITE is a target binding site found in the 3' untranslated region of mRNA encoded by LOC339458, corresponding to a target binding site such as BINDING SITE I, BINDING SITE II or BINDING SITE III of FIG. 8. Table 4 illustrates the complementarity of the nucleotide sequences of LOC339458 BINDING SITE, designated SEQ ID:436, to the nucleotide sequence of GAM2071 RNA, herein designated GAM RNA, also designated SEQ ID:371.

Another function of GAM2071 is therefore inhibition of LOC339458 (Accession XP_290911.1). Accordingly, utilities of GAM2071 include diagnosis, prevention and treatment of diseases and clinical conditions associated with LOC339458.

LOC339459 (Accession XP_290907.2) is another GAM2071 target gene, herein designated TARGET GENE. LOC339459 BINDING SITE is a target binding site found in the 3' untranslated region of mRNA encoded by LOC339459, corresponding to a target binding site such as BINDING SITE I, BINDING SITE II or BINDING SITE III of FIG. 8. Table 4 illustrates the complementarity of the nucleotide sequences of LOC339459 BINDING SITE, designated SEQ ID:13345, to the nucleotide sequence of GAM2071 RNA, herein designated GAM RNA, also designated SEQ ID:371.

Another function of GAM2071 is therefore inhibition of LOC339459 (Accession XP_290907.2). Accordingly, utilities of GAM2071 include diagnosis, prevention and treatment of diseases and clinical conditions associated with LOC339459.

LOC339492 (Accession XP_290919.1) is another GAM2071 target gene, herein designated TARGET GENE. LOC339492 BINDING SITE is a target binding site found in the 3' untranslated region of mRNA encoded by LOC339492, corresponding to a target binding site such as BINDING SITE I, BINDING SITE II or BINDING SITE III of FIG. 8. Table 4 illustrates the complementarity of the nucleotide sequences of LOC339492 BINDING SITE, designated SEQ ID:13601, to the nucleotide sequence of GAM2071 RNA, herein designated GAM RNA, also designated SEQ ID:371.

Another function of GAM2071 is therefore inhibition of LOC339492 (Accession XP_290919.1). Accordingly, utilities of GAM2071 include diagnosis, prevention and treatment of diseases and clinical conditions associated with LOC339492.

LOC339568 (Accession XP_295008.1) is another GAM2071 target gene, herein designated TARGET GENE. LOC339568 BINDING SITE is a target binding site found in the 3' untranslated region of mRNA encoded by LOC339568, corresponding to a target binding site such as BINDING SITE I, BINDING SITE II or BINDING SITE III of FIG. 8. Table 4 illustrates the complementarity of the nucleotide sequences of LOC339568 BINDING SITE, designated SEQ ID:15942, to the nucleotide sequence of GAM2071 RNA, herein designated GAM RNA, also designated SEQ ID:371.

Another function of GAM2071 is therefore inhibition of LOC339568 (Accession XP_295008.1). Accordingly, utilities of GAM2071 include diagnosis, prevention and treatment of diseases and clinical conditions associated with LOC339568.

LOC339577 (Accession XP_295005.1) is another GAM2071 target gene, herein designated TARGET GENE. LOC339577 BINDING SITE1 and LOC339577 BINDING SITE2 are target binding sites found in untranslated regions of mRNA encoded by LOC339577, corresponding to target binding sites such as BINDING SITE I, BINDING SITE II or BINDING SITE III of FIG. 8. Table 4 illustrates the complementarity of the nucleotide sequences of LOC339577 BINDING SITE1 and LOC339577 BINDING SITE2, designated SEQ ID:9239 and SEQ ID:18182 respectively, to the nucleotide sequence of GAM2071 RNA, herein designated GAM RNA, also designated SEQ ID:371.

Another function of GAM2071 is therefore inhibition of LOC339577 (Accession XP_295005.1). Accordingly, utilities of GAM2071 include diagnosis, prevention and treatment of diseases and clinical conditions associated with LOC339577.

LOC339600 (Accession XP_295014.1) is another GAM2071 target gene, herein designated TARGET GENE. LOC339600 BINDING SITE is a target binding site found in the 3' untranslated region of mRNA encoded by LOC339600, corresponding to a target binding site such as BINDING SITE I, BINDING SITE II or BINDING SITE III of FIG. 8. Table 4 illustrates the complementarity of the nucleotide sequences of LOC339600 BINDING SITE, designated SEQ ID:15466, to the nucleotide sequence of GAM2071 RNA, herein designated GAM RNA, also designated SEQ ID:371.

Another function of GAM2071 is therefore inhibition of LOC339600 (Accession XP_295014.1). Accordingly, utilities of GAM2071 include diagnosis, prevention and treatment of diseases and clinical conditions associated with LOC339600.

LOC339622 (Accession XP_295016.1) is another GAM2071 target gene, herein designated TARGET GENE. LOC339622 BINDING SITE is a target binding site found in the 5' untranslated region of mRNA encoded by LOC339622, corresponding to a target binding site such as BINDING SITE I, BINDING SITE II or BINDING SITE III of FIG. 8. Table 4 illustrates the complementarity of the nucleotide sequences of LOC339622 BINDING SITE, designated SEQ ID:15723, to the nucleotide sequence of GAM2071 RNA, herein designated GAM RNA, also designated SEQ ID:371.

Another function of GAM2071 is therefore inhibition of LOC339622 (Accession XP_295016.1). Accordingly, utilities of GAM2071 include diagnosis, prevention and treatment of diseases and clinical conditions associated with LOC339622.

LOC339663 (Accession XP_295028.1) is another GAM2071 target gene, herein designated TARGET GENE. LOC339663 BINDING SITE is a target binding site found in the 5' untranslated region of mRNA encoded by LOC339663, corresponding to a target binding site such as BINDING SITE I, BINDING SITE II or BINDING SITE III of FIG. 8. Table 4 illustrates the complementarity of the nucleotide sequences of LOC339663 BINDING SITE, designated SEQ ID:1438, to the nucleotide sequence of GAM2071 RNA, herein designated GAM RNA, also designated SEQ ID:371.

Another function of GAM2071 is therefore inhibition of LOC339663 (Accession XP_295028.1). Accordingly, utilities of GAM2071 include diagnosis, prevention and treatment of diseases and clinical conditions associated with LOC339663.

LOC339685 (Accession XP_295032.1) is another GAM2071 target gene, herein designated TARGET GENE. LOC339685 BINDING SITE is a target binding site found in the 5' untranslated region of mRNA encoded by LOC339685, corresponding to a target binding site such as BINDING SITE I, BINDING SITE II or BINDING SITE III of FIG. 8. Table 4 illustrates the complementarity of the nucleotide sequences of LOC339685 BINDING SITE, designated SEQ ID:7793, to the nucleotide sequence of GAM2071 RNA, herein designated GAM RNA, also designated SEQ ID:371.

Another function of GAM2071 is therefore inhibition of LOC339685 (Accession XP_295032.1). Accordingly, utilities of GAM2071 include diagnosis, prevention and treatment of diseases and clinical conditions associated with LOC339685.

LOC339711 (Accession XP_295038.1) is another GAM2071 target gene, herein designated TARGET GENE. LOC339711 BINDING SITE is a target binding site found in the 3' untranslated region of mRNA encoded by LOC339711, corresponding to a target binding site such as BINDING SITE I, BINDING SITE II or BINDING SITE III of FIG. 8. Table 4 illustrates the complementarity of the nucleotide sequences of LOC339711 BINDING SITE, designated SEQ ID:3106, to the nucleotide sequence of GAM2071 RNA, herein designated GAM RNA, also designated SEQ ID:371.

Another function of GAM2071 is therefore inhibition of LOC339711 (Accession XP_295038.1). Accordingly, utilities of GAM2071 include diagnosis, prevention and treatment of diseases and clinical conditions associated with LOC339711.

LOC339720 (Accession XP_295041.1) is another GAM2071 target gene, herein designated TARGET GENE. LOC339720 BINDING SITE1 and LOC339720 BINDING SITE2 are target binding sites found in untranslated regions of mRNA encoded by LOC339720, corresponding to target binding sites such as BINDING SITE I, BINDING SITE II or BINDING SITE III of FIG. 8. Table 4 illustrates the complementarity of the nucleotide sequences of LOC339720 BINDING SITE1 and LOC339720 BINDING SITE2, designated SEQ ID:7943 and SEQ ID:17652 respectively, to the nucleotide sequence of GAM2071 RNA, herein designated GAM RNA, also designated SEQ ID:371.

Another function of GAM2071 is therefore inhibition of LOC339720 (Accession XP_295041.1). Accordingly, utilities of GAM2071 include diagnosis, prevention and treatment of diseases and clinical conditions associated with LOC339720.

LOC339803 (Accession XP_295072.1) is another GAM2071 target gene, herein designated TARGET GENE. LOC339803 BINDING SITE is a target binding site found in the 3' untranslated region of mRNA encoded by LOC339803, corresponding to a target binding site such as BINDING SITE I, BINDING SITE II or BINDING SITE III of FIG. 8. Table 4 illustrates the complementarity of the nucleotide sequences of LOC339803 BINDING SITE, designated SEQ ID:2943, to the nucleotide sequence of GAM2071 RNA, herein designated GAM RNA, also designated SEQ ID:371.

Another function of GAM2071 is therefore inhibition of LOC339803 (Accession XP_295072.1). Accordingly, utilities of GAM2071 include diagnosis, prevention and treatment of diseases and clinical conditions associated with LOC339803.

LOC339809 (Accession XP_291020.1) is another GAM2071 target gene, herein designated TARGET GENE. LOC339809 BINDING SITE1 and LOC339809 BINDING SITE2 are target binding sites found in untranslated regions of mRNA encoded by LOC339809, corresponding to target binding sites such as BINDING SITE I, BINDING SITE II or BINDING SITE III of FIG. 8. Table 4 illustrates the complementarity of the nucleotide sequences of LOC339809 BINDING SITE1 and LOC339809 BINDING SITE2, designated SEQ ID:8744 and SEQ ID:9098 respectively, to the nucleotide sequence of GAM2071 RNA, herein designated GAM RNA, also designated SEQ ID:371.

Another function of GAM2071 is therefore inhibition of LOC339809 (Accession XP_291020.1). Accordingly, utilities of GAM2071 include diagnosis, prevention and treatment of diseases and clinical conditions associated with LOC339809.

LOC339813 (Accession XP_295074.1) is another GAM2071 target gene, herein designated TARGET GENE. LOC339813 BINDING SITE1 and LOC339813 BINDING SITE2 are target binding sites found in untranslated regions of mRNA encoded by LOC339813, corresponding to target binding sites such as BINDING SITE I, BINDING SITE II or BINDING SITE III of FIG. 8. Table 4 illustrates the complementarity of the nucleotide sequences of LOC339813 BINDING SITE1 and LOC339813 BINDING SITE2, designated SEQ ID:10731 and SEQ ID:13432 respectively, to the nucleotide sequence of GAM2071 RNA, herein designated GAM RNA, also designated SEQ ID:371.

Another function of GAM2071 is therefore inhibition of LOC339813 (Accession XP_295074.1). Accordingly, utilities of GAM2071 include diagnosis, prevention and treatment of diseases and clinical conditions associated with LOC339813.

LOC339833 (Accession XP_291031.1) is another GAM2071 target gene, herein designated TARGET GENE. LOC339833 BINDING SITE1 and LOC339833 BINDING SITE2 are target binding sites found in untranslated regions of mRNA encoded by LOC339833, corresponding to target binding sites such as BINDING SITE I, BINDING SITE II or BINDING SITE III of FIG. 8. Table 4 illustrates the complementarity of the nucleotide sequences of LOC339833 BINDING SITE1 and LOC339833 BINDING SITE2, designated SEQ ID:8180 and SEQ ID:10061 respectively, to the nucleotide sequence of GAM2071 RNA, herein designated GAM RNA, also designated SEQ ID:371.

Another function of GAM2071 is therefore inhibition of LOC339833 (Accession XP_291031.1). Accordingly, utilities of GAM2071 include diagnosis, prevention and treatment of diseases and clinical conditions associated with LOC339833.

LOC339834 (Accession XP_291033.1) is another GAM2071 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:2474, to the nucleotide sequence of GAM2071 RNA, herein designated GAM RNA, also designated SEQ ID:371.

Another function of GAM2071 is therefore inhibition of LOC339834 (Accession XP_291033.1). Accordingly, utilities of GAM2071 include diagnosis, prevention and treatment of diseases and clinical conditions associated with LOC339834.

LOC339834 (Accession NP_835467.1) is another GAM2071 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:2474, to the nucleotide sequence of GAM2071 RNA, herein designated GAM RNA, also designated SEQ ID:371.

Another function of GAM2071 is therefore inhibition of LOC339834 (Accession NP_835467.1). Accordingly, utilities of GAM2071 include diagnosis, prevention and treatment of diseases and clinical conditions associated with LOC339834.

LOC339872 (Accession XP_291050.1) is another GAM2071 target gene, herein designated TARGET GENE. LOC339872 BINDING SITE1 through LOC339872 BINDING SITE3 are target binding sites found in untranslated regions of mRNA encoded by LOC339872, corresponding to target binding sites such as BINDING SITE I, BINDING SITE II or BINDING SITE III of FIG. 8. Table 4 illustrates the complementarity of the nucleotide sequences of LOC339872 BINDING SITE1 through LOC339872 BINDING SITE3, designated SEQ ID:15990, SEQ ID:10908 and SEQ ID:6179 respectively, to the nucleotide sequence of GAM2071 RNA, herein designated GAM RNA, also designated SEQ ID:371.

Another function of GAM2071 is therefore inhibition of LOC339872 (Accession XP_291050.1). Accordingly, utilities of GAM2071 include diagnosis, prevention and treatment of diseases and clinical conditions associated with LOC339872.

LOC339894 (Accession XP_295095.1) is another GAM2071 target gene, herein designated TARGET GENE. LOC339894 BINDING SITE is a target binding site found in the 5' untranslated region of mRNA encoded by LOC339894, corresponding to a target binding site such as BINDING SITE I, BINDING SITE II or BINDING SITE III of FIG. 8. Table 4 illustrates the complementarity of the nucleotide sequences of LOC339894 BINDING SITE, designated SEQ ID:11426, to the nucleotide sequence of GAM2071 RNA, herein designated GAM RNA, also designated SEQ ID:371.

Another function of GAM2071 is therefore inhibition of LOC339894 (Accession XP_295095.1). Accordingly, utilities of GAM2071 include diagnosis, prevention and treatment of diseases and clinical conditions associated with LOC339894.

LOC339907 (Accession XP_291065.1) is another GAM2071 target gene, herein designated TARGET GENE. LOC339907 BINDING SITE is a target binding site found in the 3' untranslated region of mRNA encoded by LOC339907, corresponding to a target binding site such as BINDING SITE I, BINDING SITE II or BINDING SITE III of FIG. 8. Table 4 illustrates the complementarity of the nucleotide sequences of LOC339907 BINDING SITE, designated SEQ ID:1531, to the nucleotide sequence of GAM2071 RNA, herein designated GAM RNA, also designated SEQ ID:371.

Another function of GAM2071 is therefore inhibition of LOC339907 (Accession XP_291065.1). Accordingly, utilities of GAM2071 include diagnosis, prevention and treatment of diseases and clinical conditions associated with LOC339907.

LOC339909 (Accession XP_291069.1) is another GAM2071 target gene, herein designated TARGET GENE. LOC339909 BINDING SITE is a target binding site found in the 5' untranslated region of mRNA encoded by LOC339909, corresponding to a target binding site such as BINDING SITE I, BINDING SITE II or BINDING SITE III of FIG. 8. Table 4 illustrates the complementarity of the nucleotide sequences of LOC339909 BINDING SITE, designated SEQ ID:9102, to the nucleotide sequence of GAM2071 RNA, herein designated GAM RNA, also designated SEQ ID:371.

Another function of GAM2071 is therefore inhibition of LOC339909 (Accession XP_291069.1). Accordingly, utilities of GAM2071 include diagnosis, prevention and treatment of diseases and clinical conditions associated with LOC339909.

LOC339970 (Accession XP_291095.1) is another GAM2071 target gene, herein designated TARGET GENE. LOC339970 BINDING SITE is a target binding site found in the 3' untranslated region of mRNA encoded by LOC339970, corresponding to a target binding site such as BINDING SITE I, BINDING SITE II or BINDING SITE III of FIG. 8. Table 4 illustrates the complementarity of the nucleotide sequences of LOC339970 BINDING SITE, designated SEQ ID:8858, to the nucleotide sequence of GAM2071 RNA, herein designated GAM RNA, also designated SEQ ID:371.

Another function of GAM2071 is therefore inhibition of LOC339970 (Accession XP_291095.1). Accordingly, utilities of GAM2071 include diagnosis, prevention and treatment of diseases and clinical conditions associated with LOC339970.

LOC340125 (Accession XP_291150.1) is another GAM2071 target gene, herein designated TARGET GENE. LOC340125 BINDING SITE is a target binding site found in the 5' untranslated region of mRNA encoded by LOC340125, corresponding to a target binding site such as BINDING SITE I, BINDING SITE II or BINDING SITE III of FIG. 8. Table 4 illustrates the complementarity of the nucleotide sequences of LOC340125 BINDING SITE, designated SEQ ID:902, to the nucleotide sequence of GAM2071 RNA, herein designated GAM RNA, also designated SEQ ID:371.

Another function of GAM2071 is therefore inhibition of LOC340125 (Accession XP_291150.1). Accordingly, utilities of GAM2071 include diagnosis, prevention and treatment of diseases and clinical conditions associated with LOC340125.

LOC340138 (Accession XP_291153.1) is another GAM2071 target gene, herein designated TARGET GENE. LOC340138 BINDING SITE is a target binding site found in the 3' untranslated region of mRNA encoded by LOC340138, corresponding to a target binding site such as BINDING SITE I, BINDING SITE II or BINDING SITE III of FIG. 8. Table 4 illustrates the complementarity of the nucleotide sequences of LOC340138 BINDING SITE, designated SEQ ID:2442, to the nucleotide sequence of GAM2071 RNA, herein designated GAM RNA, also designated SEQ ID:371.

Another function of GAM2071 is therefore inhibition of LOC340138 (Accession XP_291153.1). Accordingly, utilities of GAM2071 include diagnosis, prevention and treatment of diseases and clinical conditions associated with LOC340138.

LOC340156 (Accession XP_291158.1) is another GAM2071 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:8575, to the nucleotide sequence of GAM2071 RNA, herein designated GAM RNA, also designated SEQ ID:371.

Another function of GAM2071 is therefore inhibition of LOC340156 (Accession XP_291158.1). Accordingly, utilities of GAM2071 include diagnosis, prevention and treatment of diseases and clinical conditions associated with LOC340156.

LOC340227 (Accession XP_291203.1) is another GAM2071 target gene, herein designated TARGET GENE. LOC340227 BINDING SITE is a target binding site found in the 5' untranslated region of mRNA encoded by LOC340227, corresponding to a target binding site such as BINDING SITE I, BINDING SITE II or BINDING SITE III of FIG. 8. Table 4 illustrates the complementarity of the nucleotide sequences of LOC340227 BINDING SITE, designated SEQ ID:902, to the nucleotide sequence of GAM2071 RNA, herein designated GAM RNA, also designated SEQ ID:371.

Another function of GAM2071 is therefore inhibition of LOC340227 (Accession XP_291203.1). Accordingly, utilities of GAM2071 include diagnosis, prevention and treatment of diseases and clinical conditions associated with LOC340227.

LOC340249 (Accession XP_291211.1) is another GAM2071 target gene, herein designated TARGET GENE. LOC340249 BINDING SITE is a target binding site found in the 3' untranslated region of mRNA encoded by LOC340249, corresponding to a target binding site such as BINDING SITE I, BINDING SITE II or BINDING SITE III of FIG. 8. Table 4 illustrates the complementarity of the nucleotide sequences of LOC340249 BINDING SITE, designated SEQ ID:8336, to the nucleotide sequence of GAM2071 RNA, herein designated GAM RNA, also designated SEQ ID:371.

Another function of GAM2071 is therefore inhibition of LOC340249 (Accession XP_291211.1). Accordingly, utilities of GAM2071 include diagnosis, prevention and treatment of diseases and clinical conditions associated with LOC340249.

LOC340290 (Accession XP_291214.1) is another GAM2071 target gene, herein designated TARGET GENE. LOC340290 BINDING SITE is a target binding site found in the 5' untranslated region of mRNA encoded by LOC340290, corresponding to a target binding site such as BINDING SITE I, BINDING SITE II or BINDING SITE III of FIG. 8. Table 4 illustrates the complementarity of the nucleotide sequences of LOC340290 BINDING SITE, designated SEQ ID:15164, to the nucleotide sequence of GAM2071 RNA, herein designated GAM RNA, also designated SEQ ID:371.

Another function of GAM2071 is therefore inhibition of LOC340290 (Accession XP_291214.1). Accordingly, utilities of GAM2071 include diagnosis, prevention and treatment of diseases and clinical conditions associated with LOC340290.

LOC340318 (Accession XP_290401.1) is another GAM2071 target gene, herein designated TARGET GENE. LOC340318 BINDING SITE is a target binding site found in the 5' untranslated region of mRNA encoded by LOC340318, corresponding to a target binding site such as BINDING SITE I, BINDING SITE II or BINDING SITE III of FIG. 8. Table 4 illustrates the complementarity of the nucleotide sequences of LOC340318 BINDING SITE, designated SEQ ID:3251, to the nucleotide sequence of GAM2071 RNA, herein designated GAM RNA, also designated SEQ ID:371.

Another function of GAM2071 is therefore inhibition of LOC340318 (Accession XP_290401.1). Accordingly, utilities of GAM2071 include diagnosis, prevention and treatment of diseases and clinical conditions associated with LOC340318.

LOC340414 (Accession XP_295240.1) is another GAM2071 target gene, herein designated TARGET GENE. LOC340414 BINDING SITE is a target binding site found in the 3' untranslated region of mRNA encoded by LOC340414, corresponding to a target binding site such as BINDING SITE I, BINDING SITE II or BINDING SITE III of FIG. 8. Table 4 illustrates the complementarity of the nucleotide sequences of LOC340414 BINDING SITE, designated SEQ ID:11659, to the nucleotide sequence of GAM2071 RNA, herein designated GAM RNA, also designated SEQ ID:371.

Another function of GAM2071 is therefore inhibition of LOC340414 (Accession XP_295240.1). Accordingly, utilities of GAM2071 include diagnosis, prevention and treatment of diseases and clinical conditions associated with LOC340414.

LOC340450 (Accession XP_295252.1) is another GAM2071 target gene, herein designated TARGET GENE. LOC340450 BINDING SITE is a target binding site found in the 5' untranslated region of mRNA encoded by LOC340450, corresponding to a target binding site such as BINDING SITE I, BINDING SITE II or BINDING SITE III of FIG. 8. Table 4 illustrates the complementarity of the nucleotide sequences of LOC340450 BINDING SITE, designated SEQ ID:4971, to the nucleotide sequence of GAM2071 RNA, herein designated GAM RNA, also designated SEQ ID:371.

Another function of GAM2071 is therefore inhibition of LOC340450 (Accession XP_295252.1). Accordingly, utilities of GAM2071 include diagnosis, prevention and treatment of diseases and clinical conditions associated with LOC340450.

LOC342926 (Accession XP_292790.2) is another GAM2071 target gene, herein designated TARGET GENE. LOC342926 BINDING SITE is a target binding site found in the 3' untranslated region of mRNA encoded by LOC342926, corresponding to a target binding site such as BINDING SITE I, BINDING SITE II or BINDING SITE III of FIG. 8. Table 4 illustrates the complementarity of the nucleotide sequences of LOC342926 BINDING SITE, designated SEQ ID:1413, to the nucleotide sequence of GAM2071 RNA, herein designated GAM RNA, also designated SEQ ID:371.

Another function of GAM2071 is therefore inhibition of LOC342926 (Accession XP_292790.2). Accordingly, utilities of GAM2071 include diagnosis, prevention and treatment of diseases and clinical conditions associated with LOC342926.

LOC344805 (Accession XP_293599.2) is another GAM2071 target gene, herein designated TARGET GENE. LOC344805 BINDING SITE is a target binding site found in the 5' untranslated region of mRNA encoded by LOC344805, corresponding to a target binding site such as BINDING SITE I, BINDING SITE II or BINDING SITE III of FIG. 8. Table 4 illustrates the complementarity of the nucleotide sequences of LOC344805 BINDING SITE, designated SEQ ID:11441, to the nucleotide sequence of GAM2071 RNA, herein designated GAM RNA, also designated SEQ ID:371.

Another function of GAM2071 is therefore inhibition of LOC344805 (Accession XP_293599.2). Accordingly, utilities of GAM2071 include diagnosis, prevention and treatment of diseases and clinical conditions associated with LOC344805.

LOC345275 (Accession NP_835236.1) is another GAM2071 target gene, herein designated TARGET GENE. LOC345275 BINDING SITE is a target binding site found in the 3' untranslated region of multiple transcripts of mRNA encoded by LOC345275, corresponding to a target binding site such as BINDING SITE I, BINDING SITE II or BINDING SITE III of FIG. 8. Table 4 illustrates the complementarity of the nucleotide sequences of LOC345275 BINDING SITE, designated SEQ ID:14511, to the nucleotide sequence of GAM2071 RNA, herein designated GAM RNA, also designated SEQ ID:371.

Another function of GAM2071 is therefore inhibition of LOC345275 (Accession NP_835236.1). Accordingly, utilities of GAM2071 include diagnosis, prevention and treatment of diseases and clinical conditions associated with LOC345275.

LOC347803 (Accession XP_302604.1) is another GAM2071 target gene, herein designated TARGET GENE. LOC347803 BINDING SITE is a target binding site found in the 3' untranslated region of mRNA encoded by LOC347803, corresponding to a target binding site such as BINDING SITE I, BINDING SITE II or BINDING SITE III of FIG. 8. Table 4 illustrates the complementarity of the nucleotide sequences of LOC347803 BINDING SITE, designated SEQ ID:12975, to the nucleotide sequence of GAM2071 RNA, herein designated GAM RNA, also designated SEQ ID:371.

Another function of GAM2071 is therefore inhibition of LOC347803 (Accession XP_302604.1). Accordingly, utilities of GAM2071 include diagnosis, prevention and treatment of diseases and clinical conditions associated with LOC347803.

LOC347918 (Accession XP_300565.1) is another GAM2071 target gene, herein designated TARGET GENE. LOC347918 BINDING SITE is a target binding site found in the 5' untranslated region of mRNA encoded by LOC347918, corresponding to a target binding site such as BINDING SITE I, BINDING SITE II or BINDING SITE III of FIG. 8. Table 4 illustrates the complementarity of the nucleotide sequences of LOC347918 BINDING SITE, designated SEQ ID:983, to the nucleotide sequence of GAM2071 RNA, herein designated GAM RNA, also designated SEQ ID:371.

Another function of GAM2071 is therefore inhibition of LOC347918 (Accession XP_300565.1). Accordingly, utilities of GAM2071 include diagnosis, prevention and treatment of diseases and clinical conditions associated with LOC347918.

LOC348024 (Accession XP_300592.1) is another GAM2071 target gene, herein designated TARGET GENE. LOC348024 BINDING SITE is a target binding site found in the 5' untranslated region of mRNA encoded by LOC348024, corresponding to a target binding site such as BINDING SITE I, BINDING SITE II or BINDING SITE III of FIG. 8. Table 4 illustrates the complementarity of the nucleotide sequences of LOC348024 BINDING SITE, designated SEQ ID:3526, to the nucleotide sequence of GAM2071 RNA, herein designated GAM RNA, also designated SEQ ID:371.

Another function of GAM2071 is therefore inhibition of LOC348024 (Accession XP_300592.1). Accordingly, utilities of GAM2071 include diagnosis, prevention and treatment of diseases and clinical conditions associated with LOC348024.

LOC348071 (Accession XP_300620.1) is another GAM2071 target gene, herein designated TARGET GENE. LOC348071 BINDING SITE is a target binding site found in the 3' untranslated region of mRNA encoded by LOC348071, corresponding to a target binding site such as BINDING SITE I, BINDING SITE II or BINDING SITE III of FIG. 8. Table 4 illustrates the complementarity of the nucleotide sequences of LOC348071 BINDING SITE, designated SEQ ID:16154, to the nucleotide sequence of GAM2071 RNA, herein designated GAM RNA, also designated SEQ ID:371.

Another function of GAM2071 is therefore inhibition of LOC348071 (Accession XP_300620.1). Accordingly, utilities of GAM2071 include diagnosis, prevention and treatment of diseases and clinical conditions associated with LOC348071.

LOC348075 (Accession XP_302653.1) is another GAM2071 target gene, herein designated TARGET GENE. LOC348075 BINDING SITE1 and LOC348075 BINDING SITE2 are target binding sites found in untranslated regions of mRNA encoded by LOC348075, corresponding to target binding sites such as BINDING SITE I, BINDING SITE II or BINDING SITE III of FIG. 8. Table 4 illustrates the complementarity of the nucleotide sequences of LOC348075 BINDING SITE1 and LOC348075 BINDING SITE2, designated SEQ ID:7650 and SEQ ID:777 respectively, to the nucleotide sequence of GAM2071 RNA, herein designated GAM RNA, also designated SEQ ID:371.

Another function of GAM2071 is therefore inhibition of LOC348075 (Accession XP_302653.1). Accordingly, utilities of GAM2071 include diagnosis, prevention and treatment of diseases and clinical conditions associated with LOC348075.

LOC348115 (Accession XP_300626.1) is another GAM2071 target gene, herein designated TARGET GENE. LOC348115 BINDING SITE is a target binding site found in the 5' untranslated region of mRNA encoded by LOC348115, corresponding to a target binding site such as BINDING SITE I, BINDING SITE II or BINDING SITE III of FIG. 8. Table 4 illustrates the complementarity of the nucleotide sequences of LOC348115 BINDING SITE, designated SEQ ID:12601, to the nucleotide sequence of GAM2071 RNA, herein designated GAM RNA, also designated SEQ ID:371.

Another function of GAM2071 is therefore inhibition of LOC348115 (Accession XP_300626.1). Accordingly, utilities of GAM2071 include diagnosis, prevention and treatment of diseases and clinical conditions associated with LOC348115.

LOC348261 (Accession XP_302704.1) is another GAM2071 target gene, herein designated TARGET GENE. LOC348261 BINDING SITE is a target binding site found in the 3' untranslated region of mRNA encoded by LOC348261, corresponding to a target binding site such as BINDING SITE I, BINDING SITE II or BINDING SITE III of FIG. 8. Table 4 illustrates the complementarity of the nucleotide sequences of LOC348261 BINDING SITE, designated SEQ ID:19539, to the nucleotide sequence of GAM2071 RNA, herein designated GAM RNA, also designated SEQ ID:371.

Another function of GAM2071 is therefore inhibition of LOC348261 (Accession XP_302704.1). Accordingly, utilities of GAM2071 include diagnosis, prevention and treatment of diseases and clinical conditions associated with LOC348261.

LOC348262 (Accession XP_300683.1) is another GAM2071 target gene, herein designated TARGET GENE. LOC348262 BINDING SITE is a target binding site found in the 5' untranslated region of mRNA encoded by LOC348262, corresponding to a target binding site such as BINDING SITE I, BINDING SITE II or BINDING SITE III of FIG. 8. Table 4 illustrates the complementarity of the nucleotide sequences of LOC348262 BINDING SITE, designated SEQ ID:7914, to the nucleotide sequence of GAM2071 RNA, herein designated GAM RNA, also designated SEQ ID:371.

Another function of GAM2071 is therefore inhibition of LOC348262 (Accession XP_300683.1). Accordingly, utilities of GAM2071 include diagnosis, prevention and treatment of diseases and clinical conditions associated with LOC348262.

LOC348314 (Accession XP_302716.1) is another GAM2071 target gene, herein designated TARGET GENE. LOC348314 BINDING SITE is a target binding site found in the 5' untranslated region of mRNA encoded by LOC348314, corresponding to a target binding site such as BINDING SITE I, BINDING SITE II or BINDING SITE III of FIG. 8. Table 4 illustrates the complementarity of the nucleotide sequences of LOC348314 BINDING SITE, designated SEQ ID:9161, to the nucleotide sequence of GAM2071 RNA, herein designated GAM RNA, also designated SEQ ID:371.

Another function of GAM2071 is therefore inhibition of LOC348314 (Accession XP_302716.1). Accordingly, utilities of GAM2071 include diagnosis, prevention and treatment of diseases and clinical conditions associated with LOC348314.

LOC348326 (Accession XP_300696.1) is another GAM2071 target gene, herein designated TARGET GENE. LOC348326 BINDING SITE is a target binding site found in the 3' untranslated region of mRNA encoded by LOC348326, corresponding to a target binding site such as BINDING SITE I, BINDING SITE II or BINDING SITE III of FIG. 8. Table 4 illustrates the complementarity of the nucleotide sequences of LOC348326 BINDING SITE, designated SEQ ID:1995, to the nucleotide sequence of GAM2071 RNA, herein designated GAM RNA, also designated SEQ ID:371.

Another function of GAM2071 is therefore inhibition of LOC348326 (Accession XP_300696.1). Accordingly, utilities of GAM2071 include diagnosis, prevention and treatment of diseases and clinical conditions associated with LOC348326.

LOC348327 (Accession XP_030209.2) is another GAM2071 target gene, herein designated TARGET GENE. LOC348327 BINDING SITE is a target binding site found in the 3' untranslated region of mRNA encoded by LOC348327, corresponding to a target binding site such as BINDING SITE I, BINDING SITE II or BINDING SITE III of FIG. 8. Table 4 illustrates the complementarity of the nucleotide sequences of LOC348327 BINDING SITE, designated SEQ ID:16911, to the nucleotide sequence of GAM2071 RNA, herein designated GAM RNA, also designated SEQ ID:371.

Another function of GAM2071 is therefore inhibition of LOC348327 (Accession XP_030209.2). Accordingly, utilities of GAM2071 include diagnosis, prevention and treatment of diseases and clinical conditions associated with LOC348327.

LOC348393 (Accession XP_302741.1) is another GAM2071 target gene, herein designated TARGET GENE. LOC348393 BINDING SITE1 and LOC348393 BINDING SITE2 are target binding sites found in untranslated regions of mRNA encoded by LOC348393, corresponding to target binding sites such as BINDING SITE I, BINDING SITE II or BINDING SITE III of FIG. 8. Table 4 illustrates the complementarity of the nucleotide sequences of LOC348393 BINDING SITE1 and LOC348393 BINDING SITE2, designated SEQ ID:16960 and SEQ ID:20185 respectively, to the nucleotide sequence of GAM2071 RNA, herein designated GAM RNA, also designated SEQ ID:371.

Another function of GAM2071 is therefore inhibition of LOC348393 (Accession XP_302741.1). Accordingly, utilities of GAM2071 include diagnosis, prevention and treatment of diseases and clinical conditions associated with LOC348393.

LOC348396 (Accession XP_300729.1) is another GAM2071 target gene, herein designated TARGET GENE. LOC348396 BINDING SITE1 through LOC348396 BINDING SITE3 are target binding sites found in untranslated regions of mRNA encoded by LOC348396, corresponding to target binding sites such as BINDING SITE I, BINDING SITE II or BINDING SITE III of FIG. 8. Table 4 illustrates the complementarity of the nucleotide sequences of LOC348396 BINDING SITE1 through LOC348396 BINDING SITE3, designated SEQ ID:5596, SEQ ID:1615 and SEQ ID:10631 respectively, to the nucleotide sequence of GAM2071 RNA, herein designated GAM RNA, also designated SEQ ID:371.

Another function of GAM2071 is therefore inhibition of LOC348396 (Accession XP_300729.1). Accordingly, utilities of GAM2071 include diagnosis, prevention and treatment of diseases and clinical conditions associated with LOC348396.

LOC348402 (Accession XP_300730.1) is another GAM2071 target gene, herein designated TARGET GENE. LOC348402 BINDING SITE is a target binding site found in the 3' untranslated region of mRNA encoded by LOC348402, corresponding to a target binding site such as BINDING SITE I, BINDING SITE II or BINDING SITE III of FIG. 8. Table 4 illustrates the complementarity of the nucleotide sequences of LOC348402 BINDING SITE, designated SEQ ID:13601, to the nucleotide sequence of GAM2071 RNA, herein designated GAM RNA, also designated SEQ ID:371.

Another function of GAM2071 is therefore inhibition of LOC348402 (Accession XP_300730.1). Accordingly, utilities of GAM2071 include diagnosis, prevention and treatment of diseases and clinical conditions associated with LOC348402.

LOC348445 (Accession XP_300738.1) is another GAM2071 target gene, herein designated TARGET GENE. LOC348445 BINDING SITE is a target binding site found in the 3' untranslated region of mRNA encoded by LOC348445, corresponding to a target binding site such as BINDING SITE I, BINDING SITE II or BINDING SITE III of FIG. 8. Table 4 illustrates the complementarity of the nucleotide sequences of LOC348445 BINDING SITE, designated SEQ ID:1995, to the nucleotide sequence of GAM2071 RNA, herein designated GAM RNA, also designated SEQ ID:371.

Another function of GAM2071 is therefore inhibition of LOC348445 (Accession XP_300738.1). Accordingly, utilities of GAM2071 include diagnosis, prevention and treatment of diseases and clinical conditions associated with LOC348445.

LOC348455 (Accession XP_302760.1) is another GAM2071 target gene, herein designated TARGET GENE. LOC348455 BINDING SITE is a target binding site found in the 3' untranslated region of mRNA encoded by LOC348455, corresponding to a target binding site such as BINDING SITE I, BINDING SITE II or BINDING SITE III of FIG. 8. Table 4 illustrates the complementarity of the nucleotide sequences of LOC348455 BINDING SITE, designated SEQ ID:9100, to the nucleotide sequence of GAM2071 RNA, herein designated GAM RNA, also designated SEQ ID:371.

Another function of GAM2071 is therefore inhibition of LOC348455 (Accession XP_302760.1). Accordingly, utilities of GAM2071 include diagnosis, prevention and treatment of diseases and clinical conditions associated with LOC348455.

LOC348460 (Accession XP_300743.1) is another GAM2071 target gene, herein designated TARGET GENE. LOC348460 BINDING SITE1 and LOC348460 BINDING SITE2 are target binding sites found in untranslated regions of mRNA encoded by LOC348460, corresponding to target binding sites such as BINDING SITE I, BINDING SITE II or BINDING SITE III of FIG. 8. Table 4 illustrates the complementarity of the nucleotide sequences of LOC348460 BINDING SITE1 and LOC348460 BINDING SITE2, designated SEQ ID:442 and SEQ ID:8756 respectively, to the nucleotide sequence of GAM2071 RNA, herein designated GAM RNA, also designated SEQ ID:371.

Another function of GAM2071 is therefore inhibition of LOC348460 (Accession XP_300743.1). Accordingly, utilities of GAM2071 include diagnosis, prevention and treatment of diseases and clinical conditions associated with LOC348460.

LOC348474 (Accession XP_209299.2) is another GAM2071 target gene, herein designated TARGET GENE. LOC348474 BINDING SITE is a target binding site found in the 3' untranslated region of mRNA encoded by LOC348474, corresponding to a target binding site such as BINDING SITE I, BINDING SITE II or BINDING SITE III of FIG. 8. Table 4 illustrates the complementarity of the nucleotide sequences of LOC348474 BINDING SITE, designated SEQ ID:6597, to the nucleotide sequence of GAM2071 RNA, herein designated GAM RNA, also designated SEQ ID:371.

Another function of GAM2071 is therefore inhibition of LOC348474 (Accession XP_209299.2). Accordingly, utilities of GAM2071 include diagnosis, prevention and treatment of diseases and clinical conditions associated with LOC348474.

LOC348494 (Accession XP_302789.1) is another GAM2071 target gene, herein designated TARGET GENE. LOC348494 BINDING SITE is a target binding site found in the 5' untranslated region of mRNA encoded by LOC348494, corresponding to a target binding site such as BINDING SITE I, BINDING SITE II or BINDING SITE III of FIG. 8. Table 4 illustrates the complementarity of the nucleotide sequences of LOC348494 BINDING SITE, designated SEQ ID:6743, to the nucleotide sequence of GAM2071 RNA, herein designated GAM RNA, also designated SEQ ID:371.

Another function of GAM2071 is therefore inhibition of LOC348494 (Accession XP_302789.1). Accordingly, utilities of GAM2071 include diagnosis, prevention and treatment of diseases and clinical conditions associated with LOC348494.

LOC348503 (Accession XP_300762.1) is another GAM2071 target gene, herein designated TARGET GENE. LOC348503 BINDING SITE is a target binding site found in the 3' untranslated region of mRNA encoded by LOC348503, corresponding to a target binding site such as BINDING SITE I, BINDING SITE II or BINDING SITE III of FIG. 8. Table 4 illustrates the complementarity of the nucleotide sequences of LOC348503 BINDING SITE, designated SEQ ID:12080, to the nucleotide sequence of GAM2071 RNA, herein designated GAM RNA, also designated SEQ ID:371.

Another function of GAM2071 is therefore inhibition of LOC348503 (Accession XP_300762.1). Accordingly, utilities of GAM2071 include diagnosis, prevention and treatment of diseases and clinical conditions associated with LOC348503.

LOC348508 (Accession XP_302806.1) is another GAM2071 target gene, herein designated TARGET GENE. LOC348508 BINDING SITE is a target binding site found in the 5' untranslated region of mRNA encoded by LOC348508, corresponding to a target binding site such as BINDING SITE I, BINDING SITE II or BINDING SITE III of FIG. 8. Table 4 illustrates the complementarity of the nucleotide sequences of LOC348508 BINDING SITE, designated SEQ ID:902, to the nucleotide sequence of GAM2071 RNA, herein designated GAM RNA, also designated SEQ ID:371.

Another function of GAM2071 is therefore inhibition of LOC348508 (Accession XP_302806.1). Accordingly, utilities of GAM2071 include diagnosis, prevention and treatment of diseases and clinical conditions associated with LOC348508.

LOC348525 (Accession XP_300778.1) is another GAM2071 target gene, herein designated TARGET GENE. LOC348525 BINDING SITE is a target binding site found in the 3' untranslated region of mRNA encoded by LOC348525, corresponding to a target binding site such as BINDING SITE I, BINDING SITE II or BINDING SITE III of FIG. 8. Table 4 illustrates the complementarity of the nucleotide sequences of LOC348525 BINDING SITE, designated SEQ ID:436, to the nucleotide sequence of GAM2071 RNA, herein designated GAM RNA, also designated SEQ ID:371.

Another function of GAM2071 is therefore inhibition of LOC348525 (Accession XP_300778.1). Accordingly, utilities of GAM2071 include diagnosis, prevention and treatment of diseases and clinical conditions associated with LOC348525.

LOC348532 (Accession XP_302818.1) is another GAM2071 target gene, herein designated TARGET GENE. LOC348532 BINDING SITE1 and LOC348532 BINDING SITE2 are target binding sites found in untranslated regions of mRNA encoded by LOC348532, corresponding to target binding sites such as BINDING SITE I, BINDING SITE II or BINDING SITE III of FIG. 8. Table 4 illustrates the complementarity of the nucleotide sequences of LOC348532 BINDING SITE1 and LOC348532 BINDING SITE2, designated SEQ ID:16960 and SEQ ID:20185 respectively, to the nucleotide sequence of GAM2071 RNA, herein designated GAM RNA, also designated SEQ ID:371.

Another function of GAM2071 is therefore inhibition of LOC348532 (Accession XP_302818.1). Accordingly, utilities of GAM2071 include diagnosis, prevention and treatment of diseases and clinical conditions associated with LOC348532.

LOC348702 (Accession XP_300808.1) is another GAM2071 target gene, herein designated TARGET GENE. LOC348702 BINDING SITE is a target binding site found in the 5' untranslated region of mRNA encoded by LOC348702, corresponding to a target binding site such as BINDING SITE I, BINDING SITE II or BINDING SITE III of FIG. 8. Table 4 illustrates the complementarity of the nucleotide sequences of LOC348702 BINDING SITE, designated SEQ ID:3103, to the nucleotide sequence of GAM2071 RNA, herein designated GAM RNA, also designated SEQ ID:371.

Another function of GAM2071 is therefore inhibition of LOC348702 (Accession XP_300808.1). Accordingly, utilities of GAM2071 include diagnosis, prevention and treatment of diseases and clinical conditions associated with LOC348702.

LOC348790 (Accession XP_300843.1) is another GAM2071 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:11124, to the nucleotide sequence of GAM2071 RNA, herein designated GAM RNA, also designated SEQ ID:371.

Another function of GAM2071 is therefore inhibition of LOC348790 (Accession XP_300843.1). Accordingly, utilities of GAM2071 include diagnosis, prevention and treatment of diseases and clinical conditions associated with LOC348790.

LOC348797 (Accession XP_302888.1) is another GAM2071 target gene, herein designated TARGET GENE. LOC348797 BINDING SITE is a target binding site found in the 3' untranslated region of mRNA encoded by LOC348797, corresponding to a target binding site such as BINDING SITE I, BINDING SITE II or BINDING SITE III of FIG. 8. Table 4 illustrates the complementarity of the nucleotide sequences of LOC348797 BINDING SITE, designated SEQ ID:4796, to the nucleotide sequence of GAM2071 RNA, herein designated GAM RNA, also designated SEQ ID:371.

Another function of GAM2071 is therefore inhibition of LOC348797 (Accession XP_302888.1). Accordingly, utilities of GAM2071 include diagnosis, prevention and treatment of diseases and clinical conditions associated with LOC348797.

LOC348798 (Accession XP_300845.1) is another GAM2071 target gene, herein designated TARGET GENE. LOC348798 BINDING SITE is a target binding site found in the 3' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:8736, to the nucleotide sequence of GAM2071 RNA, herein designated GAM RNA, also designated SEQ ID:371.

Another function of GAM2071 is therefore inhibition of LOC348798 (Accession XP_300845.1). Accordingly, utilities of GAM2071 include diagnosis, prevention and treatment of diseases and clinical conditions associated with LOC348798.

LOC348825 (Accession XP_300853.1) is another GAM2071 target gene, herein designated TARGET GENE. LOC348825 BINDING SITE is a target binding site found in the 5' untranslated region of mRNA encoded by LOC348825, corresponding to a target binding site such as BINDING SITE I, BINDING SITE II or BINDING SITE III of FIG. 8. Table 4 illustrates the complementarity of the nucleotide sequences of LOC348825 BINDING SITE, designated SEQ ID:2639, to the nucleotide sequence of GAM2071 RNA, herein designated GAM RNA, also designated SEQ ID:371.

Another function of GAM2071 is therefore inhibition of LOC348825 (Accession XP_300853.1). Accordingly, utilities of GAM2071 include diagnosis, prevention and treatment of diseases and clinical conditions associated with LOC348825.

LOC348842 (Accession XP_300861.1) is another GAM2071 target gene, herein designated TARGET GENE. LOC348842 BINDING SITE is a target binding site found in the 5' untranslated region of mRNA encoded by LOC348842, corresponding to a target binding site such as BINDING SITE I, BINDING SITE II or BINDING SITE III of FIG. 8. Table 4 illustrates the complementarity of the nucleotide sequences of LOC348842 BINDING SITE, designated SEQ ID:902, to the nucleotide sequence of GAM2071 RNA, herein designated GAM RNA, also designated SEQ ID:371.

Another function of GAM2071 is therefore inhibition of LOC348842 (Accession XP_300861.1). Accordingly, utilities of GAM2071 include diagnosis, prevention and treatment of diseases and clinical conditions associated with LOC348842.

LOC349024 (Accession XP_300250.1) is another GAM2071 target gene, herein designated TARGET GENE. LOC349024 BINDING SITE1 and LOC349024 BINDING SITE2 are target binding sites found in untranslated regions of mRNA encoded by LOC349024, corresponding to target binding sites such as BINDING SITE I, BINDING SITE II or BINDING SITE III of FIG. 8. Table 4 illustrates the complementarity of the nucleotide sequences of LOC349024 BINDING SITE1 and LOC349024 BINDING SITE2, designated SEQ ID:4753 and SEQ ID:11653 respectively, to the nucleotide sequence of GAM2071 RNA, herein designated GAM RNA, also designated SEQ ID:371.

Another function of GAM2071 is therefore inhibition of LOC349024 (Accession XP_300250.1). Accordingly, utilities of GAM2071 include diagnosis, prevention and treatment of diseases and clinical conditions associated with LOC349024.

LOC349075 (Accession XP_300932.1) is another GAM2071 target gene, herein designated TARGET GENE. LOC349075 BINDING SITE is a target binding site found in the 3' untranslated region of mRNA encoded by LOC349075, corresponding to a target binding site such as BINDING SITE I, BINDING SITE II or BINDING SITE III of FIG. 8. Table 4 illustrates the complementarity of the nucleotide sequences of LOC349075 BINDING SITE, designated SEQ ID:9465, to the nucleotide sequence of GAM2071 RNA, herein designated GAM RNA, also designated SEQ ID:371.

Another function of GAM2071 is therefore inhibition of LOC349075 (Accession XP_300932.1). Accordingly, utilities of GAM2071 include diagnosis, prevention and treatment of diseases and clinical conditions associated with LOC349075.

LOC349114 (Accession XP_302960.1) is another GAM2071 target gene, herein designated TARGET GENE. LOC349114 BINDING SITE is a target binding site found in the 5' untranslated region of mRNA encoded by LOC349114, corresponding to a target binding site such as BINDING SITE I, BINDING SITE II or BINDING SITE III of FIG. 8. Table 4 illustrates the complementarity of the nucleotide sequences of LOC349114 BINDING SITE, designated SEQ ID:902, to the nucleotide sequence of GAM2071 RNA, herein designated GAM RNA, also designated SEQ ID:371.

Another function of GAM2071 is therefore inhibition of LOC349114 (Accession XP_302960.1). Accordingly, utilities of GAM2071 include diagnosis, prevention and treatment of diseases and clinical conditions associated with LOC349114.

LOC349170 (Accession XP_300969.1) is another GAM2071 target gene, herein designated TARGET GENE. LOC349170 BINDING SITE1 and LOC349170 BINDING SITE2 are target binding sites found in untranslated regions of mRNA encoded by LOC349170, corresponding to target binding sites such as BINDING SITE I, BINDING SITE II or BINDING SITE III of FIG. 8. Table 4 illustrates the complementarity of the nucleotide sequences of LOC349170 BINDING SITE1 and LOC349170 BINDING SITE2, designated SEQ ID:13839 and SEQ ID:19429 respectively, to the nucleotide sequence of GAM2071 RNA, herein designated GAM RNA, also designated SEQ ID:371.

Another function of GAM2071 is therefore inhibition of LOC349170 (Accession XP_300969.1). Accordingly, utilities of GAM2071 include diagnosis, prevention and treatment of diseases and clinical conditions associated with LOC349170.

LOC349251 (Accession XP_300251.1) is another GAM2071 target gene, herein designated TARGET GENE. LOC349251 BINDING SITE is a target binding site found in the 3' untranslated region of mRNA encoded by LOC349251, corresponding to a target binding site such as BINDING SITE I, BINDING SITE II or BINDING SITE III of FIG. 8. Table 4 illustrates the complementarity of the nucleotide sequences of LOC349251 BINDING SITE, designated SEQ ID:17649, to the nucleotide sequence of GAM2071 RNA, herein designated GAM RNA, also designated SEQ ID:371.

Another function of GAM2071 is therefore inhibition of LOC349251 (Accession XP_300251.1). Accordingly, utilities of GAM2071 include diagnosis, prevention and treatment of diseases and clinical conditions associated with LOC349251.

LOC349282 (Accession XP_301008.1) is another GAM2071 target gene, herein designated TARGET GENE. LOC349282 BINDING SITE is a target binding site found in the 3' untranslated region of mRNA encoded by LOC349282, corresponding to a target binding site such as BINDING SITE I, BINDING SITE II or BINDING SITE III of FIG. 8. Table 4 illustrates the complementarity of the nucleotide sequences of LOC349282 BINDING SITE, designated SEQ ID:15530, to the nucleotide sequence of GAM2071 RNA, herein designated GAM RNA, also designated SEQ ID:371.

Another function of GAM2071 is therefore inhibition of LOC349282 (Accession XP_301008.1). Accordingly, utilities of GAM2071 include diagnosis, prevention and treatment of diseases and clinical conditions associated with LOC349282.

LOC349313 (Accession XP_301024.1) is another GAM2071 target gene, herein designated TARGET GENE. LOC349313 BINDING SITE is a target binding site found in the 3' untranslated region of mRNA encoded by LOC349313, corresponding to a target binding site such as BINDING SITE I, BINDING SITE II or BINDING SITE III of FIG. 8. Table 4 illustrates the complementarity of the nucleotide sequences of LOC349313 BINDING SITE, designated SEQ ID:15530, to the nucleotide sequence of GAM2071 RNA, herein designated GAM RNA, also designated SEQ ID:371.

Another function of GAM2071 is therefore inhibition of LOC349313 (Accession XP_301024.1). Accordingly, utilities of GAM2071 include diagnosis, prevention and treatment of diseases and clinical conditions associated with LOC349313.

LOC349324 (Accession XP_303030.1) is another GAM2071 target gene, herein designated TARGET GENE. LOC349324 BINDING SITE is a target binding site found in the 3' untranslated region of mRNA encoded by LOC349324, corresponding to a target binding site such as BINDING SITE I, BINDING SITE II or BINDING SITE III of FIG. 8. Table 4 illustrates the complementarity of the nucleotide sequences of LOC349324 BINDING SITE, designated SEQ ID:988, to the nucleotide sequence of GAM2071 RNA, herein designated GAM RNA, also designated SEQ ID:371.

Another function of GAM2071 is therefore inhibition of LOC349324 (Accession XP_303030.1). Accordingly, utilities of GAM2071 include diagnosis, prevention and treatment of diseases and clinical conditions associated with LOC349324.

LOC349440 (Accession XP_300513.1) is another GAM2071 target gene, herein designated TARGET GENE. LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:19505, to the nucleotide sequence of GAM2071 RNA, herein designated GAM RNA, also designated SEQ ID:371.

Another function of GAM2071 is therefore inhibition of LOC349440 (Accession XP_300513.1). Accordingly, utilities of GAM2071 include diagnosis, prevention and treatment of diseases and clinical conditions associated with LOC349440.

LOC351597 (Accession XP_302099.1) is another GAM2071 target gene, herein designated TARGET GENE. LOC351597 BINDING SITE is a target binding site found in the 5' untranslated region of mRNA encoded by LOC351597, corresponding to a target binding site such as BINDING SITE I, BINDING SITE II or BINDING SITE III of FIG. 8. Table 4 illustrates the complementarity of the nucleotide sequences of LOC351597 BINDING SITE, designated SEQ ID:14926, to the nucleotide sequence of GAM2071 RNA, herein designated GAM RNA, also designated SEQ ID:371.

Another function of GAM2071 is therefore inhibition of LOC351597 (Accession XP_302099.1). Accordingly, utilities of GAM2071 include diagnosis, prevention and treatment of diseases and clinical conditions associated with LOC351597.

LOC51193 (Accession NP_057415.1) is another GAM2071 target gene, herein designated TARGET GENE. LOC51193 BINDING SITE is a target binding site found in the 3' untranslated region of mRNA encoded by LOC51193, corresponding to a target binding site such as BINDING SITE I, BINDING SITE II or BINDING SITE III of FIG. 8. Table 4 illustrates the complementarity of the nucleotide sequences of LOC51193 BINDING SITE, designated SEQ ID:6858, to the nucleotide sequence of GAM2071 RNA, herein designated GAM RNA, also designated SEQ ID:371.

Another function of GAM2071 is therefore inhibition of LOC51193 (Accession NP_057415.1). Accordingly, utilities of GAM2071 include diagnosis, prevention and treatment of diseases and clinical conditions associated with LOC51193.

LOC51248 (Accession NP_057568.1) is another GAM2071 target gene, herein designated TARGET GENE. LOC51248 BINDING SITE is a target binding site found in the 5' untranslated region of mRNA encoded by LOC51248, corresponding to a target binding site such as BINDING SITE I, BINDING SITE II or BINDING SITE III of FIG. 8. Table 4 illustrates the complementarity of the nucleotide sequences of LOC51248 BINDING SITE, designated SEQ ID:10914, to the nucleotide sequence of GAM2071 RNA, herein designated GAM RNA, also designated SEQ ID:371.

Another function of GAM2071 is therefore inhibition of LOC51248 (Accession NP_057568.1). Accordingly, utilities of GAM2071 include diagnosis, prevention and treatment of diseases and clinical conditions associated with LOC51248.

LOC51257 (Accession NP_057580.2) is another GAM2071 target gene, herein designated TARGET GENE. LOC51257 BINDING SITE is a target binding site found in the 5' untranslated region of mRNA encoded by LOC51257, corresponding to a target binding site such as BINDING SITE I, BINDING SITE II or BINDING SITE III of FIG. 8. Table 4 illustrates the complementarity of the nucleotide sequences of LOC51257 BINDING SITE, designated SEQ ID:18183, to the nucleotide sequence of GAM2071 RNA, herein designated GAM RNA, also designated SEQ ID:371.

Another function of GAM2071 is therefore inhibition of LOC51257 (Accession NP_057580.2). Accordingly, utilities of GAM2071 include diagnosis, prevention and treatment of diseases and clinical conditions associated with LOC51257.

LOC51336 (Accession NP_057730.1) is another GAM2071 target gene, herein designated TARGET GENE. LOC51336 BINDING SITE is a target binding site found in the 3' untranslated region of mRNA encoded by LOC51336, corresponding to a target binding site such as BINDING SITE I, BINDING SITE II or BINDING SITE III of FIG. 8. Table 4 illustrates the complementarity of the nucleotide sequences of LOC51336 BINDING SITE, designated SEQ ID:18609, to the nucleotide sequence of GAM2071 RNA, herein designated GAM RNA, also designated SEQ ID:371.

Another function of GAM2071 is therefore inhibition of LOC51336 (Accession NP_057730.1). Accordingly, utilities of GAM2071 include diagnosis, prevention and treatment of diseases and clinical conditions associated with LOC51336.

LOC55954 (Accession NP_061976.1) is another GAM2071 target gene, herein designated TARGET GENE. LOC55954 BINDING SITE is a target binding site found in the 5' untranslated region of mRNA encoded by LOC55954, corresponding to a target binding site such as BINDING SITE I, BINDING SITE II or BINDING SITE III of FIG. 8. Table 4 illustrates the complementarity of the nucleotide sequences of LOC55954 BINDING SITE, designated SEQ ID:17853, to the nucleotide sequence of GAM2071 RNA, herein designated GAM RNA, also designated SEQ ID:371.

Another function of GAM2071 is therefore inhibition of LOC55954 (Accession NP_061976.1). Accordingly, utilities of GAM2071 include diagnosis, prevention and treatment of diseases and clinical conditions associated with LOC55954.

LOC56902 (Accession NP_064528.1) is another GAM2071 target gene, herein designated TARGET GENE. LOC56902 BINDING SITE is a target binding site found in the 3' untranslated region of mRNA encoded by LOC56902, corresponding to a target binding site such as BINDING SITE I, BINDING SITE II or BINDING SITE III of FIG. 8. Table 4 illustrates the complementarity of the nucleotide sequences of LOC56902 BINDING SITE, designated SEQ ID:8077, to the nucleotide sequence of GAM2071 RNA, herein designated GAM RNA, also designated SEQ ID:371.

Another function of GAM2071 is therefore inhibition of LOC56902 (Accession NP_064528.1). Accordingly, utilities of GAM2071 include diagnosis, prevention and treatment of diseases and clinical conditions associated with LOC56902.

LOC90408 (Accession XP_031517.1) is another GAM2071 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:2729, to the nucleotide sequence of GAM2071 RNA, herein designated GAM RNA, also designated SEQ ID:371.

Another function of GAM2071 is therefore inhibition of LOC90408 (Accession XP_031517.1). Accordingly, utilities of GAM2071 include diagnosis, prevention and treatment of diseases and clinical conditions associated with LOC90408.

LOC90485 (Accession XP_032059.1) is another GAM2071 target gene, herein designated TARGET GENE. LOC90485 BINDING SITE1 and LOC90485 BINDING SITE2 are target binding sites found in untranslated regions of mRNA encoded by LOC90485, corresponding to target binding sites such as BINDING SITE I, BINDING SITE II or BINDING SITE III of FIG. 8. Table 4 illustrates the complementarity of the nucleotide sequences of LOC90485 BINDING SITE1 and LOC90485 BINDING SITE2, designated SEQ ID:15525 and SEQ ID:10103 respectively, to the nucleotide sequence of GAM2071 RNA, herein designated GAM RNA, also designated SEQ ID:371.

Another function of GAM2071 is therefore inhibition of LOC90485 (Accession XP_032059.1). Accordingly, utilities of GAM2071 include diagnosis, prevention and treatment of diseases and clinical conditions associated with LOC90485.

LOC91056 (Accession NP_612377.1) is another GAM2071 target gene, herein designated TARGET GENE. LOC91056 BINDING SITE is a target binding site found in the 3' untranslated region of multiple transcripts of mRNA encoded by LOC91056, corresponding to a target binding site such as BINDING SITE I, BINDING SITE II or BINDING SITE III of FIG. 8. Table 4 illustrates the complementarity of the nucleotide sequences of LOC91056 BINDING SITE, designated SEQ ID:6693, to the nucleotide sequence of GAM2071 RNA, herein designated GAM RNA, also designated SEQ ID:371.

Another function of GAM2071 is therefore inhibition of LOC91056 (Accession NP_612377.1). Accordingly, utilities of GAM2071 include diagnosis, prevention and treatment of diseases and clinical conditions associated with LOC91056.

LOC91115 (Accession XP_036218.1) is another GAM2071 target gene, herein designated TARGET GENE. LOC91115 BINDING SITE1 and LOC91115 BINDING SITE2 are target binding sites found in untranslated regions of mRNA encoded by LOC91115, corresponding to target binding sites such as BINDING SITE I, BINDING SITE II or BINDING SITE III of FIG. 8. Table 4 illustrates the complementarity of the nucleotide sequences of LOC91115 BINDING SITE1 and LOC91115 BINDING SITE2, designated SEQ ID:18042 and SEQ ID:6053 respectively, to the nucleotide sequence of GAM2071 RNA, herein designated GAM RNA, also designated SEQ ID:371.

Another function of GAM2071 is therefore inhibition of LOC91115 (Accession XP_036218.1). Accordingly, utilities of GAM2071 include diagnosis, prevention and treatment of diseases and clinical conditions associated with LOC91115.

LOC91170 (Accession XP_036612.1) is another GAM2071 target gene, herein designated TARGET GENE. LOC91170 BINDING SITE is a target binding site found in the 5' untranslated region of mRNA encoded by LOC91170, corresponding to a target binding site such as BINDING SITE I, BINDING SITE II or BINDING SITE III of FIG. 8. Table 4 illustrates the complementarity of the nucleotide sequences of LOC91170 BINDING SITE, designated SEQ ID:3969, to the nucleotide sequence of GAM2071 RNA, herein designated GAM RNA, also designated SEQ ID:371.

Another function of GAM2071 is therefore inhibition of LOC91170 (Accession XP_036612.1). Accordingly, utilities of GAM2071 include diagnosis, prevention and treatment of diseases and clinical conditions associated with LOC91170.

LOC91250 (Accession XP_037135.1) is another GAM2071 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:16739, to the nucleotide sequence of GAM2071 RNA, herein designated GAM RNA, also designated SEQ ID:371.

Another function of GAM2071 is therefore inhibition of LOC91250 (Accession XP_037135.1). Accordingly, utilities of GAM2071 include diagnosis, prevention and treatment of diseases and clinical conditions associated with LOC91250.

LOC91373 (Accession XP_038063.5) is another GAM2071 target gene, herein designated TARGET GENE. LOC91373 BINDING SITE is a target binding site found in the 3' untranslated region of mRNA encoded by LOC91373, corresponding to a target binding site such as BINDING SITE I, BINDING SITE II or BINDING SITE III of FIG. 8. Table 4 illustrates the complementarity of the nucleotide sequences of LOC91373 BINDING SITE, designated SEQ ID:5516, to the nucleotide sequence of GAM2071 RNA, herein designated GAM RNA, also designated SEQ ID:371.

Another function of GAM2071 is therefore inhibition of LOC91373 (Accession XP_038063.5). Accordingly, utilities of GAM2071 include diagnosis, prevention and treatment of diseases and clinical conditions associated with LOC91373.

LOC91663 (Accession NP_612382.1) is another GAM2071 target gene, herein designated TARGET GENE. LOC91663 BINDING SITE is a target binding site found in the 3' untranslated region of mRNA encoded by LOC91663, corresponding to a target binding site such as BINDING SITE I, BINDING SITE II or BINDING SITE III of FIG. 8. Table 4 illustrates the complementarity of the nucleotide sequences of LOC91663 BINDING SITE, designated SEQ ID:13779, to the nucleotide sequence of GAM2071 RNA, herein designated GAM RNA, also designated SEQ ID:371.

Another function of GAM2071 is therefore inhibition of LOC91663 (Accession NP_612382.1). Accordingly, utilities of GAM2071 include diagnosis, prevention and treatment of diseases and clinical conditions associated with LOC91663.

LOC91801 (Accession NP_620130.1) is another GAM2071 target gene, herein designated TARGET GENE. LOC91801 BINDING SITE is a target binding site found in the 3' untranslated region of mRNA encoded by LOC91801, corresponding to a target binding site such as BINDING SITE I, BINDING SITE II or BINDING SITE III of FIG. 8. Table 4 illustrates the complementarity of the nucleotide sequences of LOC91801 BINDING SITE, designated SEQ ID:3586, to the nucleotide sequence of GAM2071 RNA, herein designated GAM RNA, also designated SEQ ID:371.

Another function of GAM2071 is therefore inhibition of LOC91801 (Accession NP_620130.1). Accordingly, utilities of GAM2071 include diagnosis, prevention and treatment of diseases and clinical conditions associated with LOC91801.

LOC91893 (Accession XP_041340.1) is another GAM2071 target gene, herein designated TARGET GENE. LOC91893 BINDING SITE is a target binding site found in the 3' untranslated region of mRNA encoded by LOC91893, corresponding to a target binding site such as BINDING SITE I, BINDING SITE II or BINDING SITE III of FIG. 8. Table 4 illustrates the complementarity of the nucleotide sequences of LOC91893 BINDING SITE, designated SEQ ID:9129, to the nucleotide sequence of GAM2071 RNA, herein designated GAM RNA, also designated SEQ ID:371.

Another function of GAM2071 is therefore inhibition of LOC91893 (Accession XP_041340.1). Accordingly, utilities of GAM2071 include diagnosis, prevention and treatment of diseases and clinical conditions associated with LOC91893.

LOC92148 (Accession XP_043160.1) is another GAM2071 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:16536, to the nucleotide sequence of GAM2071 RNA, herein designated GAM RNA, also designated SEQ ID:371.

Another function of GAM2071 is therefore inhibition of LOC92148 (Accession XP_043160.1). Accordingly, utilities of GAM2071 include diagnosis, prevention and treatment of diseases and clinical conditions associated with LOC92148.

LOC92659 (Accession XP_046434.3) is another GAM2071 target gene, herein designated TARGET GENE. LOC92659 BINDING SITE is a target binding site found in the 3' untranslated region of mRNA encoded by LOC92659, corresponding to a target binding site such as BINDING SITE I, BINDING SITE II or BINDING SITE III of FIG. 8. Table 4 illustrates the complementarity of the nucleotide sequences of LOC92659 BINDING SITE, designated SEQ ID:19539, to the nucleotide sequence of GAM2071 RNA, herein designated GAM RNA, also designated SEQ ID:371.

Another function of GAM2071 is therefore inhibition of LOC92659 (Accession XP_046434.3). Accordingly, utilities of GAM2071 include diagnosis, prevention and treatment of diseases and clinical conditions associated with LOC92659.

LPHN1 (Accession NP_055736.1) is another GAM2071 target gene, herein designated TARGET GENE. LPHN1 BINDING SITE is a target binding site found in the 3' untranslated region of mRNA encoded by LPHN1, corresponding to a target binding site such as BINDING SITE I, BINDING SITE II or BINDING SITE III of FIG. 8. Table 4 illustrates the complementarity of the nucleotide sequences of LPHN1 BINDING SITE, designated SEQ ID:12633, to the nucleotide sequence of GAM2071 RNA, herein designated GAM RNA, also designated SEQ ID:371.

Another function of GAM2071 is therefore inhibition of LPHN1 (Accession NP_055736.1). Accordingly, utilities of GAM2071 include diagnosis, prevention and treatment of diseases and clinical conditions associated with LPHN1.

Leukotriene b4 receptor (LTB4R, Accession NP_000743.1) is another GAM2071 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:19595, to the nucleotide sequence of GAM2071 RNA, herein designated GAM RNA, also designated SEQ ID:371.

Another function of GAM2071 is therefore inhibition of Leukotriene b4 receptor (LTB4R, Accession NP_000743.1), a gene which may be the cardiac p2y receptor involved in the regulation of cardiac muscle contraction through modulation of 1-type calcium currents. Accordingly, utilities of GAM2071 include diagnosis, prevention and treatment of diseases and clinical conditions associated with LTB4R.

The function of LTB4R and its association with various diseases and clinical conditions, has been established by previous studies, as described hereinabove with reference to GAM30.1. Lysophospholipase ii (LYPLA2, Accession NP_009191.1) is another GAM2071 target gene, herein designated TARGET GENE. LYPLA2 BINDING SITE is a target binding site found in the 3' untranslated region of mRNA encoded by LYPLA2, corresponding to a target binding site such as BINDING SITE I, BINDING SITE II or BINDING SITE III of FIG. 8. Table 4 illustrates the complementarity of the nucleotide sequences of LYPLA2 BINDING SITE, designated SEQ ID:15519, to the nucleotide sequence of GAM2071 RNA, herein designated GAM RNA, also designated SEQ ID:371.

Another function of GAM2071 is therefore inhibition of Lysophospholipase ii (LYPLA2, Accession NP_009191.1). Accordingly, utilities of GAM2071 include diagnosis, prevention and treatment of diseases and clinical conditions associated with LYPLA2.

Lysozyme (renal amyloidosis) (Ly, Accession NP_000230.1) is another GAM2071 target gene, herein designated TARGET GENE. LYZ BINDING SITE is a target binding site found in the 3' untranslated region of mRNA encoded by Ly, corresponding to a target binding site such as BINDING SITE I, BINDING SITE II or BINDING SITE III of FIG. 8. Table 4 illustrates the complementarity of the nucleotide sequences of LYZ BINDING SITE, designated SEQ ID:3109, to the nucleotide sequence of GAM2071 RNA, herein designated GAM RNA, also designated SEQ ID:371.

Another function of GAM2071 is therefore inhibition of Lysozyme (renal amyloidosis) (Ly, Accession NP_000230.1), a gene which a bacteriolytic enzyme. and therefore may be associated with Renal amyloidosis. Accordingly, utilities of GAM2071 include diagnosis, prevention and treatment of Renal amyloidosis, and of other diseases and clinical conditions associated with LYZ.

The function of LYZ and its association with various diseases and clinical conditions, has been established by previous studies, as described hereinabove with reference to GAM189.1. Leucine zipper, putative tumor suppressor 1 (LZTS1, Accession NP_066300.1) is another GAM2071 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:13405, to the nucleotide sequence of GAM2071 RNA, herein designated GAM RNA, also designated SEQ ID:371.

Another function of GAM2071 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM2071 include diagnosis, prevention and treatment of diseases and clinical conditions associated with LZTS1.

The function of LZTS1 and its association with various diseases and clinical conditions, has been established by previous studies, as described hereinabove with reference to GAM130.1. Male germ cell-associated kinase (MAK, Accession NP_005897.1) is another GAM2071 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:11208, to the nucleotide sequence of GAM2071 RNA, herein designated GAM RNA, also designated SEQ ID:371.

Another function of GAM2071 is therefore inhibition of Male germ cell-associated kinase (MAK, Accession NP_005897.1), a gene which plays an important role in spermatogenesis. Accordingly, utilities of GAM2071 include diagnosis, prevention and treatment of diseases and clinical conditions associated with MAK.

The function of MAK and its association with various diseases and clinical conditions, has been established by previous studies, as described hereinabove with reference to GAM30.1. MAPA (Accession NP_660299.1) is another GAM2071 target gene, herein designated TARGET GENE. MAPA BINDING SITE is a target binding site found in the 3' untranslated region of mRNA encoded by MAPA, corresponding to a target binding site such as BINDING SITE I, BINDING SITE II or BINDING SITE III of FIG. 8. Table 4 illustrates the complementarity of the nucleotide sequences of MAPA BINDING SITE, designated SEQ ID:12475, to the nucleotide sequence of GAM2071 RNA, herein designated GAM RNA, also designated SEQ ID:371.

Another function of GAM2071 is therefore inhibition of MAPA (Accession NP_660299.1). Accordingly, utilities of GAM2071 include diagnosis, prevention and treatment of diseases and clinical conditions associated with MAPA.

MCLC (Accession NP_055942.1) is another GAM2071 target gene, herein designated TARGET GENE. MCLC BINDING SITE is a target binding site found in the 3' untranslated region of mRNA encoded by MCLC, corresponding to a target binding site such as BINDING SITE I, BINDING SITE II or BINDING SITE III of FIG. 8. Table 4 illustrates the complementarity of the nucleotide sequences of MCLC BINDING SITE, designated SEQ ID:4526, to the nucleotide sequence of GAM2071 RNA, herein designated GAM RNA, also designated SEQ ID:371.

Another function of GAM2071 is therefore inhibition of MCLC (Accession NP_055942.1). Accordingly, utilities of GAM2071 include diagnosis, prevention and treatment of diseases and clinical conditions associated with MCLC.

Mcm10 minichromosome maintenance deficient 10 (s. cerevisiae) (MCM10, Accession NP_060988.2) is another GAM2071 target gene, herein designated TARGET GENE. MCM10 BINDING SITE is a target binding site found in the 3' untranslated region of mRNA encoded by MCM10, corresponding to a target binding site such as BINDING SITE I, BINDING SITE II or BINDING SITE III of FIG. 8. Table 4 illustrates the complementarity of the nucleotide sequences of MCM10 BINDING SITE, designated SEQ ID:4821, to the nucleotide sequence of GAM2071 RNA, herein designated GAM RNA, also designated SEQ ID:371.

Another function of GAM2071 is therefore inhibition of Mcm10 minichromosome maintenance deficient 10 (s. cerevisiae) (MCM10, Accession NP_060988.2). Accordingly, utilities of GAM2071 include diagnosis, prevention and treatment of diseases and clinical conditions associated with MCM10.

MDC1 (Accession NP_055456.1) is another GAM2071 target gene, herein designated TARGET GENE. MDC1 BINDING SITE is a target binding site found in the 3' untranslated region of mRNA encoded by MDC1, corresponding to a target binding site such as BINDING SITE I, BINDING SITE II or BINDING SITE III of FIG. 8. Table 4 illustrates the complementarity of the nucleotide sequences of MDC1 BINDING SITE, designated SEQ ID:3945, to the nucleotide sequence of GAM2071 RNA, herein designated GAM RNA, also designated SEQ ID:371.

Another function of GAM2071 is therefore inhibition of MDC1 (Accession NP_055456.1). Accordingly, utilities of GAM2071 include diagnosis, prevention and treatment of diseases and clinical conditions associated with MDC1.

Mam domain containing glycosylphosphatidylinositol anchor 1 (MDGA1, Accession NP_705691.1) is another GAM2071 target gene, herein designated TARGET GENE. MDGA1 BINDING SITE is a target binding site found in the 3' untranslated region of mRNA encoded by MDGA1, corresponding to a target binding site such as BINDING SITE I, BINDING SITE II or BINDING SITE III of FIG. 8. Table 4 illustrates the complementarity of the nucleotide sequences of MDGA1 BINDING SITE, designated SEQ ID:1000, to the nucleotide sequence of GAM2071 RNA, herein designated GAM RNA, also designated SEQ ID:371.

Another function of GAM2071 is therefore inhibition of Mam domain containing glycosylphosphatidylinositol anchor 1 (MDGA1, Accession NP_705691.1). Accordingly, utilities of GAM2071 include diagnosis, prevention and treatment of diseases and clinical conditions associated with MDGA1.

Mdm2, transformed 3t3 cell double minute 2, p53 binding protein (mouse) (MDM2, Accession NP_006872.1) is another GAM2071 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM2071 RNA, herein designated GAM RNA, also designated SEQ ID:371.

Another function of GAM2071 is therefore inhibition of Mdm2, transformed 3t3 cell double minute 2, p53 binding protein (mouse) (MDM2, Accession NP_006872.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM2071 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006870.1) is another GAM2071 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM2071 RNA, herein designated GAM RNA, also designated SEQ ID:371.

Another function of GAM2071 is therefore inhibition of Mdm2, transformed 3t3 cell double minute 2, p53 binding protein (mouse) (MDM2, Accession NP_006870.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM2071 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006871.1) is another GAM2071 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM2071 RNA, herein designated GAM RNA, also designated SEQ ID:371.

Another function of GAM2071 is therefore inhibition of Mdm2, transformed 3t3 cell double minute 2, p53 binding protein (mouse) (MDM2, Accession NP_006871.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM2071 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006869.1) is another GAM2071 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM2071 RNA, herein designated GAM RNA, also designated SEQ ID:371.

Another function of GAM2071 is therefore inhibition of Mdm2, transformed 3t3 cell double minute 2, p53 binding protein (mouse) (MDM2, Accession NP_006869.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM2071 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_002383.1) is another GAM2071 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM2071 RNA, herein designated GAM RNA, also designated SEQ ID:371.

Another function of GAM2071 is therefore inhibition of Mdm2, transformed 3t3 cell double minute 2, p53 binding protein (mouse) (MDM2, Accession NP_002383.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM2071 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006873.1) is another GAM2071 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6085, to the nucleotide sequence of GAM2071 RNA, herein designated GAM RNA, also designated SEQ ID:371.

Another function of GAM2071 is therefore inhibition of Mdm2, transformed 3t3 cell double minute 2, p53 binding protein (mouse) (MDM2, Accession NP_006873.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM2071 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm4, transformed 3t3 cell double minute 4, p53 binding protein (mouse) (MDM4, Accession NP_002384.1) is another GAM2071 target gene, herein designated TARGET GENE. MDM4 BINDING SITE is a target binding site found in the 3' untranslated region of mRNA encoded by MDM4, corresponding to a target binding site such as BINDING SITE I, BINDING SITE II or BINDING SITE III of FIG. 8. Table 4 illustrates the complementarity of the nucleotide sequences of MDM4 BINDING SITE, designated SEQ ID:19527, to the nucleotide sequence of GAM2071 RNA, herein designated GAM RNA, also designated SEQ ID:371.

Another function of GAM2071 is therefore inhibition of Mdm4, transformed 3t3 cell double minute 4, p53 binding protein (mouse) (MDM4, Accession NP_002384.1), a gene which Strongly similar to murine Mdm4; may interact with p53. Accordingly, utilities of GAM2071 include diagnosis, prevention and treatment of diseases and clinical conditions associated with MDM4.

The function of MDM4 and its association with various diseases and clinical conditions, has been established by previous studies, as described hereinabove with reference to GAM189.1. Mediterranean fever (MEFV, Accession NP_000234.1) is another GAM2071 target gene, herein designated TARGET GENE. MEFV BINDING SITE1 and MEFV BINDING SITE2 are target binding sites found in untranslated regions of mRNA encoded by MEFV, corresponding to target binding sites such as BINDING SITE I, BINDING SITE II or BINDING SITE III of FIG. 8. Table 4 illustrates the complementarity of the nucleotide sequences of MEFV BINDING SITE1 and MEFV BINDING SITE2, designated SEQ ID:12284 and SEQ ID:17376 respectively, to the nucleotide sequence of GAM2071 RNA, herein designated GAM RNA, also designated SEQ ID:371.

Another function of GAM2071 is therefore inhibition of Mediterranean fever (MEFV, Accession NP_000234.1). Accordingly, utilities of GAM2071 include diagnosis, prevention and treatment of diseases and clinical conditions associated with MEFV.

MFTC (Accession NP_110407.2) is another GAM2071 target gene, herein designated TARGET GENE. MFTC BINDING SITE is a target binding site found in the 3' untranslated region of mRNA encoded by MFTC, corresponding to a target binding site such as BINDING SITE I, BINDING SITE II or BINDING SITE III of FIG. 8. Table 4 illustrates the complementarity of the nucleotide sequences of MFTC BINDING SITE, designated SEQ ID:10459, to the nucleotide sequence of GAM2071 RNA, herein designated GAM RNA, also designated SEQ ID:371.

Another function of GAM2071 is therefore inhibition of MFTC (Accession NP_110407.2). Accordingly, utilities of GAM2071 include diagnosis, prevention and treatment of diseases and clinical conditions associated with MFTC.

Mannosyl (alpha-1,6-)-glycoprotein beta-1,2-n-acetylglucosaminyltransferase (MGAT2, Accession NP_079374.1) is another GAM2071 target gene, herein designated TARGET GENE. MGAT2 BINDING SITE is a target binding site found in the 3' untranslated region of multiple transcripts of mRNA encoded by MGAT2, corresponding to a target binding site such as BINDING SITE I, BINDING SITE II or BINDING SITE III of FIG. 8. Table 4 illustrates the complementarity of the nucleotide sequences of MGAT2 BINDING SITE, designated SEQ ID:18270, to the nucleotide sequence of GAM2071 RNA, herein designated GAM RNA, also designated SEQ ID:371.

Another function of GAM2071 is therefore inhibition of Mannosyl (alpha-1,6-)-glycoprotein beta-1,2-n-acetylglucosaminyltransferase (MGAT2, Accession NP_079374.1). Accordingly, utilities of GAM2071 include diagnosis, prevention and treatment of diseases and clinical conditions associated with MGAT2.

MGC10200 (Accession NP_659497.1) is another GAM2071 target gene, herein designated TARGET GENE. MGC10200 BINDING SITE1 and MGC10200 BINDING SITE2 are target binding sites found in untranslated regions of mRNA encoded by MGC10200, corresponding to target binding sites such as BINDING SITE I, BINDING SITE II or BINDING SITE III of FIG. 8. Table 4 illustrates the complementarity of the nucleotide sequences of MGC10200 BINDING SITE1 and MGC10200 BINDING SITE2, designated SEQ ID:1700 and SEQ ID:13048 respectively, to the nucleotide sequence of GAM2071 RNA, herein designated GAM RNA, also designated SEQ ID:371.

Another function of GAM2071 is therefore inhibition of MGC10200 (Accession NP_659497.1). Accordingly, utilities of GAM2071 include diagnosis, prevention and treatment of diseases and clinical conditions associated with MGC10200.

MGC11102 (Accession NP_115701.2) is another GAM2071 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:14977, to the nucleotide sequence of GAM2071 RNA, herein designated GAM RNA, also designated SEQ ID:371.

Another function of GAM2071 is therefore inhibition of MGC11102 (Accession NP_115701.2). Accordingly, utilities of GAM2071 include diagnosis, prevention and treatment of diseases and clinical conditions associated with MGC11102.

MGC12262 (Accession NP_116085.1) is another GAM2071 target gene, herein designated TARGET GENE. MGC12262 BINDING SITE is a target binding site found in the 5' untranslated region of mRNA encoded by MGC12262, corresponding to a target binding site such as BINDING SITE I, BINDING SITE II or BINDING SITE III of FIG. 8. Table 4 illustrates the complementarity of the nucleotide sequences of MGC12262 BINDING SITE, designated SEQ ID:6361, to the nucleotide sequence of GAM2071 RNA, herein designated GAM RNA, also designated SEQ ID:371.

Another function of GAM2071 is therefore inhibition of MGC12262 (Accession NP_116085.1). Accordingly, utilities of GAM2071 include diagnosis, prevention and treatment of diseases and clinical conditions associated with MGC12262.

MGC12518 (Accession NP_291026.1) is another GAM2071 target gene, herein designated TARGET GENE. MGC12518 BINDING SITE is a target binding site found in the 3' untranslated region of mRNA encoded by MGC12518, corresponding to a target binding site such as BINDING SITE I, BINDING SITE II or BINDING SITE III of FIG. 8. Table 4 illustrates the complementarity of the nucleotide sequences of MGC12518 BINDING SITE, designated SEQ ID:18251, to the nucleotide sequence of GAM2071 RNA, herein designated GAM RNA, also designated SEQ ID:371.

Another function of GAM2071 is therefore inhibition of MGC12518 (Accession NP_291026.1). Accordingly, utilities of GAM2071 include diagnosis, prevention and treatment of diseases and clinical conditions associated with MGC12518.

MGC13010 (Accession NP_116076.1) is another GAM2071 target gene, herein designated TARGET GENE. MGC13010 BINDING SITE is a target binding site found in the 3' untranslated region of mRNA encoded by MGC13010, corresponding to a target binding site such as BINDING SITE I, BINDING SITE II or BINDING SITE III of FIG. 8. Table 4 illustrates the complementarity of the nucleotide sequences of MGC13010 BINDING SITE, designated SEQ ID:16983, to the nucleotide sequence of GAM2071 RNA, herein designated GAM RNA, also designated SEQ ID:371.

Another function of GAM2071 is therefore inhibition of MGC13010 (Accession NP_116076.1). Accordingly, utilities of GAM2071 include diagnosis, prevention and treatment of diseases and clinical conditions associated with MGC13010.

MGC13017 (Accession NP_542387.1) is another GAM2071 target gene, herein designated TARGET GENE. MGC13017 BINDING SITE is a target binding site found in the 3' untranslated region of mRNA encoded by MGC13017, corresponding to a target binding site such as BINDING SITE I, BINDING SITE II or BINDING SITE III of FIG. 8. Table 4 illustrates the complementarity of the nucleotide sequences of MGC13017 BINDING SITE, designated SEQ ID:18970, to the nucleotide sequence of GAM2071 RNA, herein designated GAM RNA, also designated SEQ ID:371.

Another function of GAM2071 is therefore inhibition of MGC13017 (Accession NP_542387.1). Accordingly, utilities of GAM2071 include diagnosis, prevention and treatment of diseases and clinical conditions associated with MGC13017.

MGC13024 (Accession NP_689501.1) is another GAM2071 target gene, herein designated TARGET GENE. MGC13024 BINDING SITE is a target binding site found in the 3' untranslated region of mRNA encoded by MGC13024, corresponding to a target binding site such as BINDING SITE I, BINDING SITE II or BINDING SITE III of FIG. 8. Table 4 illustrates the complementarity of the nucleotide sequences of MGC13024 BINDING SITE, designated SEQ ID:15630, to the nucleotide sequence of GAM2071 RNA, herein designated GAM RNA, also designated SEQ ID:371.

Another function of GAM2071 is therefore inhibition of MGC13024 (Accession NP_689501.1). Accordingly, utilities of GAM2071 include diagnosis, prevention and treatment of diseases and clinical conditions associated with MGC13024.

MGC13138 (Accession NP_219363.1) is another GAM2071 target gene, herein designated TARGET GENE. MGC13138 BINDING SITE is a target binding site found in the 3' untranslated region of mRNA encoded by MGC13138, corresponding to a target binding site such as BINDING SITE I, BINDING SITE II or BINDING SITE III of FIG. 8. Table 4 illustrates the complementarity of the nucleotide sequences of MGC13138 BINDING SITE, designated SEQ ID:19426, to the nucleotide sequence of GAM2071 RNA, herein designated GAM RNA, also designated SEQ ID:371.

Another function of GAM2071 is therefore inhibition of MGC13138 (Accession NP_219363.1). Accordingly, utilities of GAM2071 include diagnosis, prevention and treatment of diseases and clinical conditions associated with MGC13138.

MGC13204 (Accession NP_113653.1) is another GAM2071 target gene, herein designated TARGET GENE. MGC13204 BINDING SITE is a target binding site found in the 3' untranslated region of mRNA encoded by MGC13204, corresponding to a target binding site such as BINDING SITE I, BINDING SITE II or BINDING SITE III of FIG. 8. Table 4 illustrates the complementarity of the nucleotide sequences of MGC13204 BINDING SITE, designated SEQ ID:17963, to the nucleotide sequence of GAM2071 RNA, herein designated GAM RNA, also designated SEQ ID:371.

Another function of GAM2071 is therefore inhibition of MGC13204 (Accession NP_113653.1). Accordingly, utilities of GAM2071 include diagnosis, prevention and treatment of diseases and clinical conditions associated with MGC13204.

MGC14289 (Accession NP_542391.1) is another GAM2071 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:1959, to the nucleotide sequence of GAM2071 RNA, herein designated GAM RNA, also designated SEQ ID:371.

Another function of GAM2071 is therefore inhibition of MGC14289 (Accession NP_542391.1). Accordingly, utilities of GAM2071 include diagnosis, prevention and treatment of diseases and clinical conditions associated with MGC14289.

MGC14436 (Accession NP_116286.1) is another GAM2071 target gene, herein designated TARGET GENE. MGC14436 BINDING SITE is a target binding site found in the 5' untranslated region of mRNA encoded by MGC14436, corresponding to a target binding site such as BINDING SITE I, BINDING SITE II or BINDING SITE III of FIG. 8. Table 4 illustrates the complementarity of the nucleotide sequences of MGC14436 BINDING SITE, designated SEQ ID:5075, to the nucleotide sequence of GAM2071 RNA, herein designated GAM RNA, also designated SEQ ID:371.

Another function of GAM2071 is therefore inhibition of MGC14436 (Accession NP_116286.1). Accordingly, utilities of GAM2071 include diagnosis, prevention and treatment of diseases and clinical conditions associated with MGC14436.

MGC14836 (Accession NP_219480.1) is another GAM2071 target gene, herein designated TARGET GENE. MGC14836 BINDING SITE is a target binding site found in the 3' untranslated region of mRNA encoded by MGC14836, corresponding to a target binding site such as BINDING SITE I, BINDING SITE II or BINDING SITE III of FIG. 8. Table 4 illustrates the complementarity of the nucleotide sequences of MGC14836 BINDING SITE, designated SEQ ID:9102, to the nucleotide sequence of GAM2071 RNA, herein designated GAM RNA, also designated SEQ ID:371.

Another function of GAM2071 is therefore inhibition of MGC14836 (Accession NP_219480.1). Accordingly, utilities of GAM2071 include diagnosis, prevention and treatment of diseases and clinical conditions associated with MGC14836.

MGC15705 (Accession NP_116146.1) is another GAM2071 target gene, herein designated TARGET GENE. MGC15705 BINDING SITE is a target binding site found in the 3' untranslated region of mRNA encoded by MGC15705, corresponding to a target binding site such as BINDING SITE I, BINDING SITE II or BINDING SITE III of FIG. 8. Table 4 illustrates the complementarity of the nucleotide sequences of MGC15705 BINDING SITE, designated SEQ ID:6734, to the nucleotide sequence of GAM2071 RNA, herein designated GAM RNA, also designated SEQ ID:371.

Another function of GAM2071 is therefore inhibition of MGC15705 (Accession NP_116146.1). Accordingly, utilities of GAM2071 include diagnosis, prevention and treatment of diseases and clinical conditions associated with MGC15705.

MGC17839 (Accession NP_777586.1) is another GAM2071 target gene, herein designated TARGET GENE. MGC17839 BINDING SITE is a target binding site found in the 5' untranslated region of mRNA encoded by MGC17839, corresponding to a target binding site such as BINDING SITE I, BINDING SITE II or BINDING SITE III of FIG. 8. Table 4 illustrates the complementarity of the nucleotide sequences of MGC17839 BINDING SITE, designated SEQ ID:18441, to the nucleotide sequence of GAM2071 RNA, herein designated GAM RNA, also designated SEQ ID:371.

Another function of GAM2071 is therefore inhibition of MGC17839 (Accession NP_777586.1). Accordingly, utilities of GAM2071 include diagnosis, prevention and treatment of diseases and clinical conditions associated with MGC17839.

MGC1842 (Accession XP_037797.2) is another GAM2071 target gene, herein designated TARGET GENE. MGC1842 BINDING SITE is a target binding site found in the 3' untranslated region of mRNA encoded by MGC1842, corresponding to a target binding site such as BINDING SITE I, BINDING SITE II or BINDING SITE III of FIG. 8. Table 4 illustrates the complementarity of the nucleotide sequences of MGC1842 BINDING SITE, designated SEQ ID:11658, to the nucleotide sequence of GAM2071 RNA, herein designated GAM RNA, also designated SEQ ID:371.

Another function of GAM2071 is therefore inhibition of MGC1842 (Accession XP_037797.2). Accordingly, utilities of GAM2071 include diagnosis, prevention and treatment of diseases and clinical conditions associated with MGC1842.

MGC2474 (Accession NP_076420.1) is another GAM2071 target gene, herein designated TARGET GENE. MGC2474 BINDING SITE is a target binding site found in the 3' untranslated region of mRNA encoded by MGC2474, corresponding to a target binding site such as BINDING SITE I, BINDING SITE II or BINDING SITE III of FIG. 8. Table 4 illustrates the complementarity of the nucleotide sequences of MGC2474 BINDING SITE, designated SEQ ID:18119, to the nucleotide sequence of GAM2071 RNA, herein designated GAM RNA, also designated SEQ ID:371.

Another function of GAM2071 is therefore inhibition of MGC2474 (Accession NP_076420.1). Accordingly, utilities of GAM2071 include diagnosis, prevention and treatment of diseases and clinical conditions associated with MGC2474.

MGC2477 (Accession NP_077004.1) is another GAM2071 target gene, herein designated TARGET GENE. MGC2477 BINDING SITE1 and MGC2477 BINDING SITE2 are target binding sites found in untranslated regions of mRNA encoded by MGC2477, corresponding to target binding sites such as BINDING SITE I, BINDING SITE II or BINDING SITE III of FIG. 8. Table 4 illustrates the complementarity of the nucleotide sequences of MGC2477 BINDING SITE1 and MGC2477 BINDING SITE2, designated SEQ ID:12048 and SEQ ID:3973 respectively, to the nucleotide sequence of GAM2071 RNA, herein designated GAM RNA, also designated SEQ ID:371.

Another function of GAM2071 is therefore inhibition of MGC2477 (Accession NP_077004.1). Accordingly, utilities of GAM2071 include diagnosis, prevention and treatment of diseases and clinical conditions associated with MGC2477.

MGC2603 (Accession NP_076942.1) is another GAM2071 target gene, herein designated TARGET GENE. MGC2603 BINDING SITE is a target binding site found in the 3' untranslated region of mRNA encoded by MGC2603, corresponding to a target binding site such as BINDING SITE I, BINDING SITE II or BINDING SITE III of FIG. 8. Table 4 illustrates the complementarity of the nucleotide sequences of MGC2603 BINDING SITE, designated SEQ ID:17763, to the nucleotide sequence of GAM2071 RNA, herein designated GAM RNA, also designated SEQ ID:371.

Another function of GAM2071 is therefore inhibition of MGC2603 (Accession NP_076942.1). Accordingly, utilities of GAM2071 include diagnosis, prevention and treatment of diseases and clinical conditions associated with MGC2603.

MGC26989 (Accession NP_689976.1) is another GAM2071 target gene, herein designated TARGET GENE. MGC26989 BINDING SITE is a target binding site found in the 3' untranslated region of mRNA encoded by MGC26989, corresponding to a target binding site such as BINDING SITE I, BINDING SITE II or BINDING SITE III of FIG. 8. Table 4 illustrates the complementarity of the nucleotide sequences of MGC26989 BINDING SITE, designated SEQ ID:14418, to the nucleotide sequence of GAM2071 RNA, herein designated GAM RNA, also designated SEQ ID:371.

Another function of GAM2071 is therefore inhibition of MGC26989 (Accession NP_689976.1). Accordingly, utilities of GAM2071 include diagnosis, prevention and treatment of diseases and clinical conditions associated with MGC26989.

MGC27345 (Accession XP_300964.1) is another GAM2071 target gene, herein designated TARGET GENE. MGC27345 BINDING SITE is a target binding site found in the 5' untranslated region of multiple transcripts of mRNA encoded by MGC27345, corresponding to a target binding site such as BINDING SITE I, BINDING SITE II or BINDING SITE III of FIG. 8. Table 4 illustrates the complementarity of the nucleotide sequences of MGC27345 BINDING SITE, designated SEQ ID:18352, to the nucleotide sequence of GAM2071 RNA, herein designated GAM RNA, also designated SEQ ID:371.

Another function of GAM2071 is therefore inhibition of MGC27345 (Accession XP_300964.1). Accordingly, utilities of GAM2071 include diagnosis, prevention and treatment of diseases and clinical conditions associated with MGC27345.

MGC29891 (Accession NP_653219.1) is another GAM2071 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:18179, to the nucleotide sequence of GAM2071 RNA, herein designated GAM RNA, also designated SEQ ID:371.

Another function of GAM2071 is therefore inhibition of MGC29891 (Accession NP_653219.1). Accordingly, utilities of GAM2071 include diagnosis, prevention and treatment of diseases and clinical conditions associated with MGC29891.

MGC29898 (Accession NP_659485.1) is another GAM2071 target gene, herein designated TARGET GENE. MGC29898 BINDING SITE is a target binding site found in the 3' untranslated region of mRNA encoded by MGC29898, corresponding to a target binding site such as BINDING SITE I, BINDING SITE II or BINDING SITE III of FIG. 8. Table 4 illustrates the complementarity of the nucleotide sequences of MGC29898 BINDING SITE, designated SEQ ID:9164, to the nucleotide sequence of GAM2071 RNA, herein designated GAM RNA, also designated SEQ ID:371.

Another function of GAM2071 is therefore inhibition of MGC29898 (Accession NP_659485.1). Accordingly, utilities of GAM2071 include diagnosis, prevention and treatment of diseases and clinical conditions associated with MGC29898.

MGC3113 (Accession NP_076940.1) is another GAM2071 target gene, herein designated TARGET GENE. MGC3113 BINDING SITE is a target binding site found in the 3' untranslated region of mRNA encoded by MGC3113, corresponding to a target binding site such as BINDING SITE I, BINDING SITE II or BINDING SITE III of FIG. 8. Table 4 illustrates the complementarity of the nucleotide sequences of MGC3113 BINDING SITE, designated SEQ ID:15946, to the nucleotide sequence of GAM2071 RNA, herein designated GAM RNA, also designated SEQ ID:371.

Another function of GAM2071 is therefore inhibition of MGC3113 (Accession NP_076940.1). Accordingly, utilities of GAM2071 include diagnosis, prevention and treatment of diseases and clinical conditions associated with MGC3113.

MGC3195 (Accession NP_114111.2) is another GAM2071 target gene, herein designated TARGET GENE. MGC3195 BINDING SITE is a target binding site found in the 5' untranslated region of mRNA encoded by MGC3195, corresponding to a target binding site such as BINDING SITE I, BINDING SITE II or BINDING SITE III of FIG. 8. Table 4 illustrates the complementarity of the nucleotide sequences of MGC3195 BINDING SITE, designated SEQ ID:15735, to the nucleotide sequence of GAM2071 RNA, herein designated GAM RNA, also designated SEQ ID:371.

Another function of GAM2071 is therefore inhibition of MGC3195 (Accession NP_114111.2). Accordingly, utilities of GAM2071 include diagnosis, prevention and treatment of diseases and clinical conditions associated with MGC3195.

MGC3207 (Accession NP_115661.1) is another GAM2071 target gene, herein designated TARGET GENE. MGC3207 BINDING SITE1 and MGC3207 BINDING SITE2 are target binding sites found in untranslated regions of mRNA encoded by MGC3207, corresponding to target binding sites such as BINDING SITE I, BINDING SITE II or BINDING SITE III of FIG. 8. Table 4 illustrates the complementarity of the nucleotide sequences of MGC3207 BINDING SITE1 and MGC3207 BINDING SITE2, designated SEQ ID:14723 and SEQ ID:12382 respectively, to the nucleotide sequence of GAM2071 RNA, herein designated GAM RNA, also designated SEQ ID:371.

Another function of GAM2071 is therefore inhibition of MGC3207 (Accession NP_115661.1). Accordingly, utilities of GAM2071 include diagnosis, prevention and treatment of diseases and clinical conditions associated with MGC3207.

MGC3248 (Accession NP_115875.1) is another GAM2071 target gene, herein designated TARGET GENE. MGC3248 BINDING SITE is a target binding site found in the 3' untranslated region of mRNA encoded by MGC3248, corresponding to a target binding site such as BINDING SITE I, BINDING SITE II or BINDING SITE III of FIG. 8. Table 4 illustrates the complementarity of the nucleotide sequences of MGC3248 BINDING SITE, designated SEQ ID:11953, to the nucleotide sequence of GAM2071 RNA, herein designated GAM RNA, also designated SEQ ID:371.

Another function of GAM2071 is therefore inhibition of MGC3248 (Accession NP_115875.1). Accordingly, utilities of GAM2071 include diagnosis, prevention and treatment of diseases and clinical conditions associated with MGC3248.

MGC3329 (Accession NP_076991.2) is another GAM2071 target gene, herein designated TARGET GENE. MGC3329 BINDING SITE is a target binding site found in the 3' untranslated region of mRNA encoded by MGC3329, corresponding to a target binding site such as BINDING SITE I, BINDING SITE II or BINDING SITE III of FIG. 8. Table 4 illustrates the complementarity of the nucleotide sequences of MGC3329 BINDING SITE, designated SEQ ID:4873, to the nucleotide sequence of GAM2071 RNA, herein designated GAM RNA, also designated SEQ ID:371.

Another function of GAM2071 is therefore inhibition of MGC3329 (Accession NP_076991.2). Accordingly, utilities of GAM2071 include diagnosis, prevention and treatment of diseases and clinical conditions associated with MGC3329.

MGC33637 (Accession NP_689809.1) is another GAM2071 target gene, herein designated TARGET GENE. MGC33637 BINDING SITE is a target binding site found in the 3' untranslated region of mRNA encoded by MGC33637, corresponding to a target binding site such as BINDING SITE I, BINDING SITE II or BINDING SITE III of FIG. 8. Table 4 illustrates the complementarity of the nucleotide sequences of MGC33637 BINDING SITE, designated SEQ ID:12383, to the nucleotide sequence of GAM2071 RNA, herein designated GAM RNA, also designated SEQ ID:371.

Another function of GAM2071 is therefore inhibition of MGC33637 (Accession NP_689809.1). Accordingly, utilities of GAM2071 include diagnosis, prevention and treatment of diseases and clinical conditions associated with MGC33637.

MGC34079 (Accession NP_689688.1) is another GAM2071 target gene, herein designated TARGET GENE. MGC34079 BINDING SITE is a target binding site found in the 3' untranslated region of mRNA encoded by MGC34079, corresponding to a target binding site such as BINDING SITE I, BINDING SITE II or BINDING SITE III of FIG. 8. Table 4 illustrates the complementarity of the nucleotide sequences of MGC34079 BINDING SITE, designated SEQ ID:19879, to the nucleotide sequence of GAM2071 RNA, herein designated GAM RNA, also designated SEQ ID:371.

Another function of GAM2071 is therefore inhibition of MGC34079 (Accession NP_689688.1). Accordingly, utilities of GAM2071 include diagnosis, prevention and treatment of diseases and clinical conditions associated with MGC34079.

MGC34132 (Accession XP_291029.1) is another GAM2071 target gene, herein designated TARGET GENE. MGC34132 BINDING SITE1 and MGC34132 BINDING SITE2 are target binding sites found in untranslated regions of mRNA encoded by MGC34132, corresponding to target binding sites such as BINDING SITE I, BINDING SITE II or BINDING SITE III of FIG. 8. Table 4 illustrates the complementarity of the nucleotide sequences of MGC34132 BINDING SITE1 and MGC34132 BINDING SITE2, designated SEQ ID:8862 and SEQ ID:9188 respectively, to the nucleotide sequence of GAM2071 RNA, herein designated GAM RNA, also designated SEQ ID:371.

Another function of GAM2071 is therefore inhibition of MGC34132 (Accession XP_291029.1). Accordingly, utilities of GAM2071 include diagnosis, prevention and treatment of diseases and clinical conditions associated with MGC34132.

MGC35136 (Accession NP_689640.1) is another GAM2071 target gene, herein designated TARGET GENE. MGC35136 BINDING SITE is a target binding site found in the 5' untranslated region of mRNA encoded by MGC35136, corresponding to a target binding site such as BINDING SITE I, BINDING SITE II or BINDING SITE III of FIG. 8. Table 4 illustrates the complementarity of the nucleotide sequences of MGC35136 BINDING SITE, designated SEQ ID:8783, to the nucleotide sequence of GAM2071 RNA, herein designated GAM RNA, also designated SEQ ID:371.

Another function of GAM2071 is therefore inhibition of MGC35136 (Accession NP_689640.1). Accordingly, utilities of GAM2071 include diagnosis, prevention and treatment of diseases and clinical conditions associated with MGC35136.

MGC35440 (Accession NP_694952.1) is another GAM2071 target gene, herein designated TARGET GENE. MGC35440 BINDING SITE is a target binding site found in the 3' untranslated region of mRNA encoded by MGC35440, corresponding to a target binding site such as BINDING SITE I, BINDING SITE II or BINDING SITE III of FIG. 8. Table 4 illustrates the complementarity of the nucleotide sequences of MGC35440 BINDING SITE, designated SEQ ID:13796, to the nucleotide sequence of GAM2071 RNA, herein designated GAM RNA, also designated SEQ ID:371.

Another function of GAM2071 is therefore inhibition of MGC35440 (Accession NP_694952.1). Accordingly, utilities of GAM2071 include diagnosis, prevention and treatment of diseases and clinical conditions associated with MGC35440.

MGC35468 (Accession NP_694976.1) is another GAM2071 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:19258, to the nucleotide sequence of GAM2071 RNA, herein designated GAM RNA, also designated SEQ ID:371.

Another function of GAM2071 is therefore inhibition of MGC35468 (Accession NP_694976.1). Accordingly, utilities of GAM2071 include diagnosis, prevention and treatment of diseases and clinical conditions associated with MGC35468.

MGC39320 (Accession NP_689642.2) is another GAM2071 target gene, herein designated TARGET GENE.

MGC39320 BINDING SITE1 and MGC39320 BINDING SITE2 are target binding sites found in untranslated regions of mRNA encoded by MGC39320, corresponding to target binding sites such as BINDING SITE I, BINDING SITE II or BINDING SITE III of FIG. 8. Table 4 illustrates the complementarity of the nucleotide sequences of MGC39320 BINDING SITE1 and MGC39320 BINDING SITE2, designated SEQ ID:2691 and SEQ ID:1498 respectively, to the nucleotide sequence of GAM2071 RNA, herein designated GAM RNA, also designated SEQ ID:371.

Another function of GAM2071 is therefore inhibition of MGC39320 (Accession NP_689642.2). Accordingly, utilities of GAM2071 include diagnosis, prevention and treatment of diseases and clinical conditions associated with MGC39320.

MGC39558 (Accession NP_689703.1) is another GAM2071 target gene, herein designated TARGET GENE. MGC39558 BINDING SITE is a target binding site found in the 3' untranslated region of mRNA encoded by MGC39558, corresponding to a target binding site such as BINDING SITE I, BINDING SITE II or BINDING SITE III of FIG. 8. Table 4 illustrates the complementarity of the nucleotide sequences of MGC39558 BINDING SITE, designated SEQ ID:1145, to the nucleotide sequence of GAM2071 RNA, herein designated GAM RNA, also designated SEQ ID:371.

Another function of GAM2071 is therefore inhibition of MGC39558 (Accession NP_689703.1). Accordingly, utilities of GAM2071 include diagnosis, prevention and treatment of diseases and clinical conditions associated with MGC39558.

MGC40157 (Accession NP_689563.1) is another GAM2071 target gene, herein designated TARGET GENE. MGC40157 BINDING SITE is a target binding site found in the 3' untranslated region of mRNA encoded by MGC40157, corresponding to a target binding site such as BINDING SITE I, BINDING SITE II or BINDING SITE III of FIG. 8. Table 4 illustrates the complementarity of the nucleotide sequences of MGC40157 BINDING SITE, designated SEQ ID:13547, to the nucleotide sequence of GAM2071 RNA, herein designated GAM RNA, also designated SEQ ID:371.

Another function of GAM2071 is therefore inhibition of MGC40157 (Accession NP_689563.1). Accordingly, utilities of GAM2071 include diagnosis, prevention and treatment of diseases and clinical conditions associated with MGC40157.

MGC40579 (Accession NP_689989.1) is another GAM2071 target gene, herein designated TARGET GENE. MGC40579 BINDING SITE1 and MGC40579 BINDING SITE2 are target binding sites found in untranslated regions of mRNA encoded by MGC40579, corresponding to target binding sites such as BINDING SITE I, BINDING SITE II or BINDING SITE III of FIG. 8. Table 4 illustrates the complementarity of the nucleotide sequences of MGC40579 BINDING SITE1 and MGC40579 BINDING SITE2, designated SEQ ID:3759 and SEQ ID:516 respectively, to the nucleotide sequence of GAM2071 RNA, herein designated GAM RNA, also designated SEQ ID:371.

Another function of GAM2071 is therefore inhibition of MGC40579 (Accession NP_689989.1). Accordingly, utilities of GAM2071 include diagnosis, prevention and treatment of diseases and clinical conditions associated with MGC40579.

MGC43122 (Accession NP_775784.1) is another GAM2071 target gene, herein designated TARGET GENE. MGC43122 BINDING SITE is a target binding site found in the 3' untranslated region of mRNA encoded by MGC43122, corresponding to a target binding site such as BINDING SITE I, BINDING SITE II or BINDING SITE III of FIG. 8. Table 4 illustrates the complementarity of the nucleotide sequences of MGC43122 BINDING SITE, designated SEQ ID:16117, to the nucleotide sequence of GAM2071 RNA, herein designated GAM RNA, also designated SEQ ID:371.

Another function of GAM2071 is therefore inhibition of MGC43122 (Accession NP_775784.1). Accordingly, utilities of GAM2071 include diagnosis, prevention and treatment of diseases and clinical conditions associated with MGC43122.

MGC4415 (Accession NP_113672.1) is another GAM2071 target gene, herein designated TARGET GENE. MGC4415 BINDING SITE is a target binding site found in the 3' untranslated region of mRNA encoded by MGC4415, corresponding to a target binding site such as BINDING SITE I, BINDING SITE II or BINDING SITE III of FIG. 8. Table 4 illustrates the complementarity of the nucleotide sequences of MGC4415 BINDING SITE, designated SEQ ID:8576, to the nucleotide sequence of GAM2071 RNA, herein designated GAM RNA, also designated SEQ ID:371.

Another function of GAM2071 is therefore inhibition of MGC4415 (Accession NP_113672.1). Accordingly, utilities of GAM2071 include diagnosis, prevention and treatment of diseases and clinical conditions associated with MGC4415.

MGC46732 (Accession NP_714925.1) is another GAM2071 target gene, herein designated TARGET GENE. MGC46732 BINDING SITE is a target binding site found in the 3' untranslated region of mRNA encoded by MGC46732, corresponding to a target binding site such as BINDING SITE I, BINDING SITE II or BINDING SITE III of FIG. 8. Table 4 illustrates the complementarity of the nucleotide sequences of MGC46732 BINDING SITE, designated SEQ ID:3645, to the nucleotide sequence of GAM2071 RNA, herein designated GAM RNA, also designated SEQ ID:371.

Another function of GAM2071 is therefore inhibition of MGC46732 (Accession NP_714925.1). Accordingly, utilities of GAM2071 include diagnosis, prevention and treatment of diseases and clinical conditions associated with MGC46732.

MGC50337 (Accession NP_848604.1) is another GAM2071 target gene, herein designated TARGET GENE. MGC50337 BINDING SITE is a target binding site found in the 3' untranslated region of mRNA encoded by MGC50337, corresponding to a target binding site such as BINDING SITE I, BINDING SITE II or BINDING SITE III of FIG. 8. Table 4 illustrates the complementarity of the nucleotide sequences of MGC50337 BINDING SITE, designated SEQ ID:8882, to the nucleotide sequence of GAM2071 RNA, herein designated GAM RNA, also designated SEQ ID:371.

Another function of GAM2071 is therefore inhibition of MGC50337 (Accession NP_848604.1). Accordingly, utilities of GAM2071 include diagnosis, prevention and treatment of diseases and clinical conditions associated with MGC50337.

MGC50559 (Accession NP_776163.1) is another GAM2071 target gene, herein designated TARGET GENE. MGC50559 BINDING SITE is a target binding site found in the 3' untranslated region of mRNA encoded by MGC50559, corresponding to a target binding site such as BINDING SITE I, BINDING SITE II or BINDING SITE III of FIG. 8. Table 4 illustrates the complementarity of the nucleotide sequences of MGC50559 BINDING SITE, designated SEQ ID:7831, to the nucleotide sequence of GAM2071 RNA, herein designated GAM RNA, also designated SEQ ID:371.

Another function of GAM2071 is therefore inhibition of MGC50559 (Accession NP_776163.1). Accordingly, utilities of GAM2071 include diagnosis, prevention and treatment of diseases and clinical conditions associated with MGC50559.

MGC5149 (Accession XP_051200.2) is another GAM2071 target gene, herein designated TARGET GENE. MGC5149 BINDING SITE is a target binding site found in the 3' untranslated region of mRNA encoded by MGC5149, corresponding to a target binding site such as BINDING SITE I, BINDING SITE II or BINDING SITE III of FIG. 8. Table 4 illustrates the complementarity of the nucleotide sequences of MGC5149 BINDING SITE, designated SEQ ID:17590, to the nucleotide sequence of GAM2071 RNA, herein designated GAM RNA, also designated SEQ ID:371.

Another function of GAM2071 is therefore inhibition of MGC5149 (Accession XP_051200.2). Accordingly, utilities of GAM2071 include diagnosis, prevention and treatment of diseases and clinical conditions associated with MGC5149.

MGC9912 (Accession NP_542395.1) is another GAM2071 target gene, herein designated TARGET GENE. MGC9912 BINDING SITE is a target binding site found in the 3' untranslated region of mRNA encoded by MGC9912, corresponding to a target binding site such as BINDING SITE I, BINDING SITE II or BINDING SITE III of FIG. 8. Table 4 illustrates the complementarity of the nucleotide sequences of MGC9912 BINDING SITE, designated SEQ ID:11391, to the nucleotide sequence of GAM2071 RNA, herein designated GAM RNA, also designated SEQ ID:371.

Another function of GAM2071 is therefore inhibition of MGC9912 (Accession NP_542395.1). Accordingly, utilities of GAM2071 include diagnosis, prevention and treatment of diseases and clinical conditions associated with MGC9912.

MGRN1 (Accession XP_048119.4) is another GAM2071 target gene, herein designated TARGET GENE. MGRN1 BINDING SITE is a target binding site found in the 3' untranslated region of mRNA encoded by MGRN1, corresponding to a target binding site such as BINDING SITE I, BINDING SITE II or BINDING SITE III of FIG. 8. Table 4 illustrates the complementarity of the nucleotide sequences of MGRN1 BINDING SITE, designated SEQ ID:13807, to the nucleotide sequence of GAM2071 RNA, herein designated GAM RNA, also designated SEQ ID:371.

Another function of GAM2071 is therefore inhibition of MGRN1 (Accession XP_048119.4). Accordingly, utilities of GAM2071 include diagnosis, prevention and treatment of diseases and clinical conditions associated with MGRN1.

Mhc class ii transactivator (MHC2TA, Accession NP_000237.1) is another GAM2071 target gene, herein designated TARGET GENE. MHC2TA BINDING SITE is a target binding site found in the 3' untranslated region of mRNA encoded by MHC2TA, corresponding to a target binding site such as BINDING SITE I, BINDING SITE II or BINDING SITE III of FIG. 8. Table 4 illustrates the complementarity of the nucleotide sequences of MHC2TA BINDING SITE, designated SEQ ID:9987, to the nucleotide sequence of GAM2071 RNA, herein designated GAM RNA, also designated SEQ ID:371.

Another function of GAM2071 is therefore inhibition of Mhc class ii transactivator (MHC2TA, Accession NP_000237.1). Accordingly, utilities of GAM2071 include diagnosis, prevention and treatment of diseases and clinical conditions associated with MHC2TA.

MIRAB13 (Accession XP_039236.6) is another GAM2071 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:3109, to the nucleotide sequence of GAM2071 RNA, herein designated GAM RNA, also designated SEQ ID:371.

Another function of GAM2071 is therefore inhibition of MIRAB13 (Accession XP_039236.6). Accordingly, utilities of GAM2071 include diagnosis, prevention and treatment of diseases and clinical conditions associated with MIRAB13.

MIRAB13 (Accession NP_203744.1) is another GAM2071 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:3109, to the nucleotide sequence of GAM2071 RNA, herein designated GAM RNA, also designated SEQ ID:371.

Another function of GAM2071 is therefore inhibition of MIRAB13 (Accession NP_203744.1). Accordingly, utilities of GAM2071 include diagnosis, prevention and treatment of diseases and clinical conditions associated with MIRAB13.

MIS12 (Accession NP_076944.1) is another GAM2071 target gene, herein designated TARGET GENE. MIS12 BINDING SITE is a target binding site found in the 3' untranslated region of mRNA encoded by MIS12, corresponding to a target binding site such as BINDING SITE I, BINDING SITE II or BINDING SITE III of FIG. 8. Table 4 illustrates the complementarity of the nucleotide sequences of MIS12 BINDING SITE, designated SEQ ID:3332, to the nucleotide sequence of GAM2071 RNA, herein designated GAM RNA, also designated SEQ ID:371.

Another function of GAM2071 is therefore inhibition of MIS12 (Accession NP_076944.1). Accordingly, utilities of GAM2071 include diagnosis, prevention and treatment of diseases and clinical conditions associated with MIS12.

Makorin, ring finger protein, 4 (MKRN4, Accession NP_110384.1) is another GAM2071 target gene, herein designated TARGET GENE. MKRN4 BINDING SITE is a target binding site found in the 3' untranslated region of mRNA encoded by MKRN4, corresponding to a target binding site such as BINDING SITE I, BINDING SITE II or BINDING SITE III of FIG. 8. Table 4 illustrates the complementarity of the nucleotide sequences of MKRN4 BINDING SITE, designated SEQ ID:12385, to the nucleotide sequence of GAM2071 RNA, herein designated GAM RNA, also designated SEQ ID:371.

Another function of GAM2071 is therefore inhibition of Makorin, ring finger protein, 4 (MKRN4, Accession NP_110384.1). Accordingly, utilities of GAM2071 include diagnosis, prevention and treatment of diseases and clinical conditions associated with MKRN4.

Melanoma-derived leucine zipper, extra-nuclear factor (MLZE, Accession NP_113603.1) is another GAM2071 target gene, herein designated TARGET GENE. MLZE BINDING SITE is a target binding site found in the 5' untranslated region of mRNA encoded by MLZE, corresponding to a target binding site such as BINDING SITE I, BINDING SITE II or BINDING SITE III of FIG. 8. Table 4 illustrates the complementarity of the nucleotide sequences of MLZE BINDING SITE, designated SEQ ID:11404, to the nucleotide sequence of GAM2071 RNA, herein designated GAM RNA, also designated SEQ ID:371.

Another function of GAM2071 is therefore inhibition of Melanoma-derived leucine zipper, extra-nuclear factor (MLZE, Accession NP_113603.1). Accordingly, utilities of GAM2071 include diagnosis, prevention and treatment of diseases and clinical conditions associated with MLZE.

Modulator of apoptosis 1 (MOAP1, Accession NP_071434.2) is another GAM2071 target gene, herein designated TARGET GENE. MOAP1 BINDING SITE is a target binding site found in the 3' untranslated region of mRNA encoded by MOAP1, corresponding to a target binding site such as BINDING SITE I, BINDING SITE II or BINDING SITE III of FIG. 8. Table 4 illustrates the complementarity of the nucleotide sequences of MOAP1 BINDING SITE, designated SEQ ID:11659, to the nucleotide sequence of GAM2071 RNA, herein designated GAM RNA, also designated SEQ ID:371.

Another function of GAM2071 is therefore inhibition of Modulator of apoptosis 1 (MOAP1, Accession NP_071434.2). Accordingly, utilities of GAM2071 include diagnosis, prevention and treatment of diseases and clinical conditions associated with MOAP1.

moblak (Accession NP_570719.1) is another GAM2071 target gene, herein designated TARGET GENE. moblak BINDING SITE1 and moblak BINDING SITE2 are target binding sites found in untranslated regions of mRNA encoded by moblak, corresponding to target binding sites such as BINDING SITE I, BINDING SITE II or BINDING SITE III of FIG. 8. Table 4 illustrates the complementarity of the nucleotide sequences of moblak BINDING SITE1 and moblak BINDING SITE2, designated SEQ ID:2270 and SEQ ID:18353 respectively, to the nucleotide sequence of GAM2071 RNA, herein designated GAM RNA, also designated SEQ ID:371.

Another function of GAM2071 is therefore inhibition of moblak (Accession NP_570719.1). Accordingly, utilities of GAM2071 include diagnosis, prevention and treatment of diseases and clinical conditions associated with moblak.

Molybdenum cofactor synthesis 3 (MOCS3, Accession NP_055299.1) is another GAM2071 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:6108, to the nucleotide sequence of GAM2071 RNA, herein designated GAM RNA, also designated SEQ ID:371.

Another function of GAM2071 is therefore inhibition of Molybdenum cofactor synthesis 3 (MOCS3, Accession NP_055299.1). Accordingly, utilities of GAM2071 include diagnosis, prevention and treatment of diseases and clinical conditions associated with MOCS3.

Myeloproliferative leukemia virus oncogene (MPL, Accession NP_005364.1) is another GAM2071 target gene, herein designated TARGET GENE. MPL BINDING SITE1 and MPL BINDING SITE2 are target binding sites found in untranslated regions of mRNA encoded by MPL, corresponding to target binding sites such as BINDING SITE I, BINDING SITE II or BINDING SITE III of FIG. 8. Table 4 illustrates the complementarity of the nucleotide sequences of MPL BINDING SITE1 and MPL BINDING SITE2, designated SEQ ID:11909 and SEQ ID:633 respectively, to the nucleotide sequence of GAM2071 RNA, herein designated GAM RNA, also designated SEQ ID:371.

Another function of GAM2071 is therefore inhibition of Myeloproliferative leukemia virus oncogene (MPL, Accession NP_005364.1). Accordingly, utilities of GAM2071 include diagnosis, prevention and treatment of diseases and clinical conditions associated with MPL.

Mitochondrial ribosomal protein l30 (MRPL30, Accession NP_660213.1) is another GAM2071 target gene, herein designated TARGET GENE. MRPL30 BINDING SITE is a target binding site found in the 3' untranslated region of multiple transcripts of mRNA encoded by MRPL30, corresponding to a target binding site such as BINDING SITE I, BINDING SITE II or BINDING SITE III of FIG. 8. Table 4 illustrates the complementarity of the nucleotide sequences of MRPL30 BINDING SITE, designated SEQ ID:1858, to the nucleotide sequence of GAM2071 RNA, herein designated GAM RNA, also designated SEQ ID:371.

Another function of GAM2071 is therefore inhibition of Mitochondrial ribosomal protein l30 (MRPL30, Accession NP_660213.1). Accordingly, utilities of GAM2071 include diagnosis, prevention and treatment of diseases and clinical conditions associated with MRPL30.

Mitochondrial ribosomal protein l35 (MRPL35, Accession NP_057706.2) is another GAM2071 target gene, herein designated TARGET GENE. MRPL35 BINDING SITE is a target binding site found in the 3' untranslated region of multiple transcripts of mRNA encoded by MRPL35, corresponding to a target binding site such as BINDING SITE I, BINDING SITE II or BINDING SITE III of FIG. 8. Table 4 illustrates the complementarity of the nucleotide sequences of MRPL35 BINDING SITE, designated SEQ ID:10631, to the nucleotide sequence of GAM2071 RNA, herein designated GAM RNA, also designated SEQ ID:371.

Another function of GAM2071 is therefore inhibition of Mitochondrial ribosomal protein l35 (MRPL35, Accession NP_057706.2). Accordingly, utilities of GAM2071 include diagnosis, prevention and treatment of diseases and clinical conditions associated with MRPL35.

Mitochondrial ribosomal protein l49 (MRPL49, Accession NP_004918.1) is another GAM2071 target gene, herein designated TARGET GENE. MRPL49 BINDING SITE is a target binding site found in the 3' untranslated region of mRNA encoded by MRPL49, corresponding to a target binding site such as BINDING SITE I, BINDING SITE II or BINDING SITE III of FIG. 8. Table 4 illustrates the complementarity of the nucleotide sequences of MRPL49 BINDING SITE, designated SEQ ID:13534, to the nucleotide sequence of GAM2071 RNA, herein designated GAM RNA, also designated SEQ ID:371.

Another function of GAM2071 is therefore inhibition of Mitochondrial ribosomal protein l49 (MRPL49, Accession NP_004918.1). Accordingly, utilities of GAM2071 include diagnosis, prevention and treatment of diseases and clinical conditions associated with MRPL49.

Mitochondrial ribosomal protein s27 (MRPS27, Accession NP_055899.1) is another GAM2071 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:13372, to the nucleotide sequence of GAM2071 RNA, herein designated GAM RNA, also designated SEQ ID:371.

Another function of GAM2071 is therefore inhibition of Mitochondrial ribosomal protein s27 (MRPS27, Accession NP_055899.1). Accordingly, utilities of GAM2071 include diagnosis, prevention and treatment of diseases and clinical conditions associated with MRPS27.

MSTP028 (Accession NP__114160.1) is another GAM2071 target gene, herein designated TARGET GENE. MSTP028 BINDING SITE is a target binding site found in the 3' untranslated region of mRNA encoded by MSTP028, corresponding to a target binding site such as BINDING SITE I, BINDING SITE II or BINDING SITE III of FIG. 8. Table 4 illustrates the complementarity of the nucleotide sequences of MSTP028 BINDING SITE, designated SEQ ID:11359, to the nucleotide sequence of GAM2071 RNA, herein designated GAM RNA, also designated SEQ ID:371.

Another function of GAM2071 is therefore inhibition of MSTP028 (Accession NP__114160.1). Accordingly, utilities of GAM2071 include diagnosis, prevention and treatment of diseases and clinical conditions associated with MSTP028.

MtFMT (Accession NP__640335.1) is another GAM2071 target gene, herein designated TARGET GENE. MtFMT BINDING SITE is a target binding site found in the 3' untranslated region of mRNA encoded by MtFMT, corresponding to a target binding site such as BINDING SITE I, BINDING SITE II or BINDING SITE III of FIG. 8. Table 4 illustrates the complementarity of the nucleotide sequences of MtFMT BINDING SITE, designated SEQ ID:2529, to the nucleotide sequence of GAM2071 RNA, herein designated GAM RNA, also designated SEQ ID:371.

Another function of GAM2071 is therefore inhibition of MtFMT (Accession NP__640335.1). Accordingly, utilities of GAM2071 include diagnosis, prevention and treatment of diseases and clinical conditions associated with MtFMT.

MTH2 (Accession NP__060753.1) is another GAM2071 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:12462, to the nucleotide sequence of GAM2071 RNA, herein designated GAM RNA, also designated SEQ ID:371.

Another function of GAM2071 is therefore inhibition of MTH2 (Accession NP__060753.1). Accordingly, utilities of GAM2071 include diagnosis, prevention and treatment of diseases and clinical conditions associated with MTH2.

5-methyltetrahydrofolate-homocysteine methyltransferase (MTR, Accession NP__000245.1) is another GAM2071 target gene, herein designated TARGET GENE. MTR BINDING SITE is a target binding site found in the 3' untranslated region of mRNA encoded by MTR, corresponding to a target binding site such as BINDING SITE I, BINDING SITE II or BINDING SITE III of FIG. 8. Table 4 illustrates the complementarity of the nucleotide sequences of MTR BINDING SITE, designated SEQ ID:13325, to the nucleotide sequence of GAM2071 RNA, herein designated GAM RNA, also designated SEQ ID:371.

Another function of GAM2071 is therefore inhibition of 5-methyltetrahydrofolate-homocysteine methyltransferase (MTR, Accession NP__000245.1). Accordingly, utilities of GAM2071 include diagnosis, prevention and treatment of diseases and clinical conditions associated with MTR.

Myosin 5c (MYO5C, Accession NP__061198.1) is another GAM2071 target gene, herein designated TARGET GENE. MYO5C BINDING SITE is a target binding site found in the 3' untranslated region of mRNA encoded by MYO5C, corresponding to a target binding site such as BINDING SITE I, BINDING SITE II or BINDING SITE III of FIG. 8. Table 4 illustrates the complementarity of the nucleotide sequences of MYO5C BINDING SITE, designated SEQ ID:14846, to the nucleotide sequence of GAM2071 RNA, herein designated GAM RNA, also designated SEQ ID:371.

Another function of GAM2071 is therefore inhibition of Myosin 5c (MYO5C, Accession NP__061198.1). Accordingly, utilities of GAM2071 include diagnosis, prevention and treatment of diseases and clinical conditions associated with MYO5C.

NAGPA (Accession NP__057340.1) is another GAM2071 target gene, herein designated TARGET GENE. NAGPA BINDING SITE is a target binding site found in the 3' untranslated region of mRNA encoded by NAGPA, corresponding to a target binding site such as BINDING SITE I, BINDING SITE II or BINDING SITE III of FIG. 8. Table 4 illustrates the complementarity of the nucleotide sequences of NAGPA BINDING SITE, designated SEQ ID:8883, to the nucleotide sequence of GAM2071 RNA, herein designated GAM RNA, also designated SEQ ID:371.

Another function of GAM2071 is therefore inhibition of NAGPA (Accession NP__057340.1). Accordingly, utilities of GAM2071 include diagnosis, prevention and treatment of diseases and clinical conditions associated with NAGPA.

NALP12 (Accession NP__150639.1) is another GAM2071 target gene, herein designated TARGET GENE. NALP12 BINDING SITE is a target binding site found in the 5' untranslated region of multiple transcripts of mRNA encoded by NALP12, corresponding to a target binding site such as BINDING SITE I, BINDING SITE II or BINDING SITE III of FIG. 8. Table 4 illustrates the complementarity of the nucleotide sequences of NALP12 BINDING SITE, designated SEQ ID:12925, to the nucleotide sequence of GAM2071 RNA, herein designated GAM RNA, also designated SEQ ID:371.

Another function of GAM2071 is therefore inhibition of NALP12 (Accession NP__150639.1). Accordingly, utilities of GAM2071 include diagnosis, prevention and treatment of diseases and clinical conditions associated with NALP12.

Nanog (Accession NP__079141.1) is another GAM2071 target gene, herein designated TARGET GENE. Nanog BINDING SITE is a target binding site found in the 3' untranslated region of mRNA encoded by Nanog, corresponding to a target binding site such as BINDING SITE I, BINDING SITE II or BINDING SITE III of FIG. 8. Table 4 illustrates the complementarity of the nucleotide sequences of Nanog BINDING SITE, designated SEQ ID:3109, to the nucleotide sequence of GAM2071 RNA, herein designated GAM RNA, also designated SEQ ID:371.

Another function of GAM2071 is therefore inhibition of Nanog (Accession NP__079141.1). Accordingly, utilities of GAM2071 include diagnosis, prevention and treatment of diseases and clinical conditions associated with Nanog.

NCAG1 (Accession NP__115536.1) is another GAM2071 target gene, herein designated TARGET GENE. NCAG1 BINDING SITE is a target binding site found in the 3' untranslated region of mRNA encoded by NCAG1, corresponding to a target binding site such as BINDING SITE I, BINDING SITE II or BINDING SITE III of FIG. 8. Table 4 illustrates the complementarity of the nucleotide sequences of NCAG1 BINDING SITE, designated SEQ ID:11436, to the nucleotide sequence of GAM2071 RNA, herein designated GAM RNA, also designated SEQ ID:371.

Another function of GAM2071 is therefore inhibition of NCAG1 (Accession NP__115536.1). Accordingly, utilities of GAM2071 include diagnosis, prevention and treatment of diseases and clinical conditions associated with NCAG1.

Nuclear receptor coactivator 6 (NCOA6, Accession NP__054790.1) is another GAM2071 target gene, herein designated TARGET GENE. NCOA6 BINDING SITE1 and NCOA6 BINDING SITE2 are target binding sites found in untranslated regions of mRNA encoded by NCOA6, corresponding to target binding sites such as BINDING SITE I, BINDING SITE II or BINDING SITE III of FIG. 8. Table 4 illustrates the complementarity of the nucleotide sequences of NCOA6 BINDING SITE1 and NCOA6 BINDING SITE2, designated SEQ ID:5484 and SEQ ID:6181 respectively, to the nucleotide sequence of GAM2071 RNA, herein designated GAM RNA, also designated SEQ ID:371.

Another function of GAM2071 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM2071 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Nuclear receptor coactivator 6 interacting protein (NCOA6IP, Accession NP_079107.5) is another GAM2071 target gene, herein designated TARGET GENE. NCOA6IP BINDING SITE is a target binding site found in the 3' untranslated region of mRNA encoded by NCOA6IP, corresponding to a target binding site such as BINDING SITE I, BINDING SITE II or BINDING SITE III of FIG. 8. Table 4 illustrates the complementarity of the nucleotide sequences of NCOA6IP BINDING SITE, designated SEQ ID:3026, to the nucleotide sequence of GAM2071 RNA, herein designated GAM RNA, also designated SEQ ID:371.

Another function of GAM2071 is therefore inhibition of Nuclear receptor coactivator 6 interacting protein (NCOA6IP, Accession NP_079107.5). Accordingly, utilities of GAM2071 include diagnosis, prevention and treatment of diseases and clinical conditions associated with NCOA6IP.

NDP52 (Accession NP_005822.1) is another GAM2071 target gene, herein designated TARGET GENE. NDP52 BINDING SITE is a target binding site found in the 3' untranslated region of mRNA encoded by NDP52, corresponding to a target binding site such as BINDING SITE I, BINDING SITE II or BINDING SITE III of FIG. 8. Table 4 illustrates the complementarity of the nucleotide sequences of NDP52 BINDING SITE, designated SEQ ID:13886, to the nucleotide sequence of GAM2071 RNA, herein designated GAM RNA, also designated SEQ ID:371.

Another function of GAM2071 is therefore inhibition of NDP52 (Accession NP_005822.1). Accordingly, utilities of GAM2071 include diagnosis, prevention and treatment of diseases and clinical conditions associated with NDP52.

Ndrg family member 3 (NDRG3, Accession NP_114402.1) is another GAM2071 target gene, herein designated TARGET GENE. NDRG3 BINDING SITE is a target binding site found in the 3' untranslated region of multiple transcripts of mRNA encoded by NDRG3, corresponding to a target binding site such as BINDING SITE I, BINDING SITE II or BINDING SITE III of FIG. 8. Table 4 illustrates the complementarity of the nucleotide sequences of NDRG3 BINDING SITE, designated SEQ ID:20109, to the nucleotide sequence of GAM2071 RNA, herein designated GAM RNA, also designated SEQ ID:371.

Another function of GAM2071 is therefore inhibition of Ndrg family member 3 (NDRG3, Accession NP_114402.1). Accordingly, utilities of GAM2071 include diagnosis, prevention and treatment of diseases and clinical conditions associated with NDRG3.

Nadh dehydrogenase (ubiquinone) 1, subcomplex unknown, 2, 14.5 kda (NDUFC2, Accession NP_004540.1) is another GAM2071 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:15362, to the nucleotide sequence of GAM2071 RNA, herein designated GAM RNA, also designated SEQ ID:371.

Another function of GAM2071 is therefore inhibition of Nadh dehydrogenase (ubiquinone) 1, subcomplex unknown, 2, 14.5 kda (NDUFC2, Accession NP_004540.1). Accordingly, utilities of GAM2071 include diagnosis, prevention and treatment of diseases and clinical conditions associated with NDUFC2.

Sialidase 3 (membrane sialidase) (NEU3, Accession NP_006647.2) is another GAM2071 target gene, herein designated TARGET GENE. NEU3 BINDING SITE is a target binding site found in the 5' untranslated region of mRNA encoded by NEU3, corresponding to a target binding site such as BINDING SITE I, BINDING SITE II or BINDING SITE III of FIG. 8. Table 4 illustrates the complementarity of the nucleotide sequences of NEU3 BINDING SITE, designated SEQ ID:18182, to the nucleotide sequence of GAM2071 RNA, herein designated GAM RNA, also designated SEQ ID:371.

Another function of GAM2071 is therefore inhibition of Sialidase 3 (membrane sialidase) (NEU3, Accession NP_006647.2). Accordingly, utilities of GAM2071 include diagnosis, prevention and treatment of diseases and clinical conditions associated with NEU3.

Neurofibromin 2 (bilateral acoustic neuroma) (NF2, Accession NP_057502.1) is another GAM2071 target gene, herein designated TARGET GENE. NF2 BINDING SITE is a target binding site found in the 5' untranslated region of multiple transcripts of mRNA encoded by NF2, corresponding to a target binding site such as BINDING SITE I, BINDING SITE II or BINDING SITE III of FIG. 8. Table 4 illustrates the complementarity of the nucleotide sequences of NF2 BINDING SITE, designated SEQ ID:557, to the nucleotide sequence of GAM2071 RNA, herein designated GAM RNA, also designated SEQ ID:371.

Another function of GAM2071 is therefore inhibition of Neurofibromin 2 (bilateral acoustic neuroma) (NF2, Accession NP_057502.1). Accordingly, utilities of GAM2071 include diagnosis, prevention and treatment of diseases and clinical conditions associated with NF2.

Non-pou domain containing, octamer-binding (NONO, Accession NP_031389.2) is another GAM2071 target gene, herein designated TARGET GENE. NONO BINDING SITE is a target binding site found in the 3' untranslated region of mRNA encoded by NONO, corresponding to a target binding site such as BINDING SITE I, BINDING SITE II or BINDING SITE III of FIG. 8. Table 4 illustrates the complementarity of the nucleotide sequences of NONO BINDING SITE, designated SEQ ID:1412, to the nucleotide sequence of GAM2071 RNA, herein designated GAM RNA, also designated SEQ ID:371.

Another function of GAM2071 is therefore inhibition of Non-pou domain containing, octamer-binding (NONO, Accession NP_031389.2), a gene which is a nuclear protein which contains RNA recognition motifs. Accordingly, utilities of GAM2071 include diagnosis, prevention and treatment of diseases and clinical conditions associated with NONO.

The function of NONO and its association with various diseases and clinical conditions, has been established by previous studies, as described hereinabove with reference to GAM189.1. Nad(p)h dehydrogenase, quinone 1 (NQO1, Accession NP_000894.1) is another GAM2071 target gene, herein designated TARGET GENE. NQO1 BINDING SITE is a target binding site found in the 3' untranslated region of mRNA encoded by NQO1, corresponding to a target binding site such as BINDING SITE I, BINDING SITE II or BINDING SITE III of FIG. 8. Table 4 illustrates the complementarity of the nucleotide sequences of NQO1 BINDING SITE, designated SEQ ID:18183, to the nucleotide sequence of GAM2071 RNA, herein designated GAM RNA, also designated SEQ ID:371.

Another function of GAM2071 is therefore inhibition of Nad(p)h dehydrogenase, quinone 1 (NQO1, Accession NP_000894.1), a gene which is cytochrome b5 reductase which reduces redox dyes and quinones. Accordingly, utilities of GAM2071 include diagnosis, prevention and treatment of diseases and clinical conditions associated with NQO1.

The function of NQO1 and its association with various diseases and clinical conditions, has been established by previous studies, as described hereinabove with reference to GAM189.1. Neurotensin receptor 2 (NTSR2, Accession NP_036476.1) is another GAM2071 target gene, herein designated TARGET GENE. NTSR2 BINDING SITE is a target binding site found in the 5' untranslated region of mRNA encoded by NTSR2, corresponding to a target binding site such as BINDING SITE I, BINDING SITE II or BINDING SITE III of FIG. 8. Table 4 illustrates the complementarity of the nucleotide sequences of NTSR2 BINDING SITE, designated SEQ ID:4568, to the nucleotide sequence of GAM2071 RNA, herein designated GAM RNA, also designated SEQ ID:371.

Another function of GAM2071 is therefore inhibition of Neurotensin receptor 2 (NTSR2, Accession NP_036476.1). Accordingly, utilities of GAM2071 include diagnosis, prevention and treatment of diseases and clinical conditions associated with NTSR2.

Nudix (nucleoside diphosphate linked moiety x)-type motif 4 (NUDT4, Accession NP_061967.2) is another GAM2071 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:20051, to the nucleotide sequence of GAM2071 RNA, herein designated GAM RNA, also designated SEQ ID:371.

Another function of GAM2071 is therefore inhibition of Nudix (nucleoside diphosphate linked moiety x)-type motif 4 (NUDT4, Accession NP_061967.2). Accordingly, utilities of GAM2071 include diagnosis, prevention and treatment of diseases and clinical conditions associated with NUDT4.

Nucleoredoxin (NXN, Accession NP_071908.1) is another GAM2071 target gene, herein designated TARGET GENE. NXN BINDING SITE is a target binding site found in the 3' untranslated region of mRNA encoded by NXN, corresponding to a target binding site such as BINDING SITE I, BINDING SITE II or BINDING SITE III of FIG. 8. Table 4 illustrates the complementarity of the nucleotide sequences of NXN BINDING SITE, designated SEQ ID:436, to the nucleotide sequence of GAM2071 RNA, herein designated GAM RNA, also designated SEQ ID:371.

Another function of GAM2071 is therefore inhibition of Nucleoredoxin (NXN, Accession NP_071908.1). Accordingly, utilities of GAM2071 include diagnosis, prevention and treatment of diseases and clinical conditions associated with NXN.

Olfactory receptor, family 51, subfamily e, member 2 (OR51E2, Accession NP_110401.1) is another GAM2071 target gene, herein designated TARGET GENE. OR51E2 BINDING SITE is a target binding site found in the 3' untranslated region of mRNA encoded by OR51E2, corresponding to a target binding site such as BINDING SITE I, BINDING SITE II or BINDING SITE III of FIG. 8. Table 4 illustrates the complementarity of the nucleotide sequences of OR51E2 BINDING SITE, designated SEQ ID:8690, to the nucleotide sequence of GAM2071 RNA, herein designated GAM RNA, also designated SEQ ID:371.

Another function of GAM2071 is therefore inhibition of Olfactory receptor, family 51, subfamily e, member 2 (OR51E2, Accession NP_110401.1). Accordingly, utilities of GAM2071 include diagnosis, prevention and treatment of diseases and clinical conditions associated with OR51E2.

Origin recognition complex, subunit 1-like (yeast) (ORC1L, Accession NP_004144.1) is another GAM2071 target gene, herein designated TARGET GENE. ORC1L BINDING SITE is a target binding site found in the 3' untranslated region of mRNA encoded by ORC1L, corresponding to a target binding site such as BINDING SITE I, BINDING SITE II or BINDING SITE III of FIG. 8. Table 4 illustrates the complementarity of the nucleotide sequences of ORC1L BINDING SITE, designated SEQ ID:436, to the nucleotide sequence of GAM2071 RNA, herein designated GAM RNA, also designated SEQ ID:371.

Another function of GAM2071 is therefore inhibition of Origin recognition complex, subunit 1-like (yeast) (ORC1L, Accession NP_004144.1), a gene which may be required for initiation of DNA replication. Accordingly, utilities of GAM2071 include diagnosis, prevention and treatment of diseases and clinical conditions associated with ORC1L.

The function of ORC1L and its association with various diseases and clinical conditions, has been established by previous studies, as described hereinabove with reference to GAM136.1. P15RS (Accession NP_060640.2) is another GAM2071 target gene, herein designated TARGET GENE. P15RS BINDING SITE is a target binding site found in the 3' untranslated region of mRNA encoded by P15RS, corresponding to a target binding site such as BINDING SITE I, BINDING SITE II or BINDING SITE III of FIG. 8. Table 4 illustrates the complementarity of the nucleotide sequences of P15RS BINDING SITE, designated SEQ ID:1032, to the nucleotide sequence of GAM2071 RNA, herein designated GAM RNA, also designated SEQ ID:371.

Another function of GAM2071 is therefore inhibition of P15RS (Accession NP_060640.2). Accordingly, utilities of GAM2071 include diagnosis, prevention and treatment of diseases and clinical conditions associated with P15RS.

Phosphoribosylaminoimidazole carboxylase, phosphoribosylaminoimidazole succinocarboxamide synthetase (PAICS, Accession NP_006443.1) is another GAM2071 target gene, herein designated TARGET GENE. PAICS BINDING SITE is a target binding site found in the 3' untranslated region of mRNA encoded by PAICS, corresponding to a target binding site such as BINDING SITE I, BINDING SITE II or BINDING SITE III of FIG. 8. Table 4 illustrates the complementarity of the nucleotide sequences of PAICS BINDING SITE, designated SEQ ID:11127, to the nucleotide sequence of GAM2071 RNA, herein designated GAM RNA, also designated SEQ ID:371.

Another function of GAM2071 is therefore inhibition of Phosphoribosylaminoimidazole carboxylase, phosphoribosylaminoimidazole succinocarboxamide synthetase (PAICS, Accession NP_006443.1), a gene which is required for purine biosynthesis. Accordingly, utilities of GAM2071 include diagnosis, prevention and treatment of diseases and clinical conditions associated with PAICS.

The function of PAICS and its association with various diseases and clinical conditions, has been established by previous studies, as described hereinabove with reference to GAM96.1. PART1 (Accession NP_057674.1) is another GAM2071 target gene, herein designated TARGET GENE. PART1 BINDING SITE1 and PART1 BINDING SITE2 are target binding sites found in untranslated regions of mRNA encoded by PART1, corresponding to target binding sites such as BINDING SITE I, BINDING SITE II or BINDING SITE III of FIG. 8. Table 4 illustrates the complementarity of the nucleotide sequences of PART1 BINDING SITE1 and PART1 BINDING SITE2, designated SEQ ID:19024 and SEQ ID:7026 respectively, to the nucleotide sequence of GAM2071 RNA, herein designated GAM RNA, also designated SEQ ID:371.

Another function of GAM2071 is therefore inhibition of PART1 (Accession NP_057674.1). Accordingly, utilities of GAM2071 include diagnosis, prevention and treatment of diseases and clinical conditions associated with PART1.

Pas domain containing serine/threonine kinase (PASK, Accession NP_055963.1) is another GAM2071 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:3230, to the nucleotide sequence of GAM2071 RNA, herein designated GAM RNA, also designated SEQ ID:371.

Another function of GAM2071 is therefore inhibition of Pas domain containing serine/threonine kinase (PASK, Accession NP_055963.1). Accordingly, utilities of GAM2071 include diagnosis, prevention and treatment of diseases and clinical conditions associated with PASK.

Protocadherin alpha 9 (PCDHA9, Accession NP_054724.1) is another GAM2071 target gene, herein designated TARGET GENE. PCDHA9 BINDING SITE is a target binding site found in the 3' untranslated region of multiple transcripts of mRNA encoded by PCDHA9, corresponding to a target binding site such as BINDING SITE I, BINDING SITE II or BINDING SITE III of FIG. 8. Table 4 illustrates the complementarity of the nucleotide sequences of PCDHA9 BINDING SITE, designated SEQ ID:10631, to the nucleotide sequence of GAM2071 RNA, herein designated GAM RNA, also designated SEQ ID:371.

Another function of GAM2071 is therefore inhibition of Protocadherin alpha 9 (PCDHA9, Accession NP_054724.1), a gene which is a calcium-dependent cell-adhesion protein. Accordingly, utilities of GAM2071 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Protocadherin beta 11 (PCDHB11, Accession NP_061754.1) is another GAM2071 target gene, herein designated TARGET GENE. PCDHB11 BINDING SITE is a target binding site found in the 3' untranslated region of mRNA encoded by PCDHB11, corresponding to a target binding site such as BINDING SITE I, BINDING SITE II or BINDING SITE III of FIG. 8. Table 4 illustrates the complementarity of the nucleotide sequences of PCDHB11 BINDING SITE, designated SEQ ID:7975, to the nucleotide sequence of GAM2071 RNA, herein designated GAM RNA, also designated SEQ ID:371.

Another function of GAM2071 is therefore inhibition of Protocadherin beta 11 (PCDHB11, Accession NP_061754.1). Accordingly, utilities of GAM2071 include diagnosis, prevention and treatment of diseases and clinical conditions associated with PCDHB11.

Protocadherin beta 16 (PCDHB16, Accession NP_066008.1) is another GAM2071 target gene, herein designated TARGET GENE. PCDHB16 BINDING SITE is a target binding site found in the 3' untranslated region of mRNA encoded by PCDHB16, corresponding to a target binding site such as BINDING SITE I, BINDING SITE II or BINDING SITE III of FIG. 8. Table 4 illustrates the complementarity of the nucleotide sequences of PCDHB16 BINDING SITE, designated SEQ ID:4753, to the nucleotide sequence of GAM2071 RNA, herein designated GAM RNA, also designated SEQ ID:371.

Another function of GAM2071 is therefore inhibition of Protocadherin beta 16 (PCDHB16, Accession NP_066008.1), a gene which is a potential calcium-dependent cell-adhesion protein. Accordingly, utilities of GAM2071 include diagnosis, prevention and treatment of diseases and clinical conditions associated with PCDHB16.

The function of PCDHB16 and its association with various diseases and clinical conditions, has been established by previous studies, as described hereinabove with reference to GAM189.1. Protocadherin beta 9 (PCDHB9, Accession NP_061992.2) is another GAM2071 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:3109, to the nucleotide sequence of GAM2071 RNA, herein designated GAM RNA, also designated SEQ ID:371.

Another function of GAM2071 is therefore inhibition of Protocadherin beta 9 (PCDHB9, Accession NP_061992.2), a gene which is a potential calcium-dependent cell-adhesion protein. Accordingly, utilities of GAM2071 include diagnosis, prevention and treatment of diseases and clinical conditions associated with PCDHB9.

The function of PCDHB9 and its association with various diseases and clinical conditions, has been established by previous studies, as described hereinabove with reference to GAM72.1. Phosducin-like (PDCL, Accession NP_005379.2) is another GAM2071 target gene, herein designated TARGET GENE. PDCL BINDING SITE is a target binding site found in the 3' untranslated region of mRNA encoded by PDCL, corresponding to a target binding site such as BINDING SITE I, BINDING SITE II or BINDING SITE III of FIG. 8. Table 4 illustrates the complementarity of the nucleotide sequences of PDCL BINDING SITE, designated SEQ ID:14559, to the nucleotide sequence of GAM2071 RNA, herein designated GAM RNA, also designated SEQ ID:371.

Another function of GAM2071 is therefore inhibition of Phosducin-like (PDCL, Accession NP_005379.2), a gene which may regulate G-protein signaling and similar to phosducins. Accordingly, utilities of GAM2071 include diagnosis, prevention and treatment of diseases and clinical conditions associated with PDCL.

The function of PDCL and its association with various diseases and clinical conditions, has been established by previous studies, as described hereinabove with reference to GAM30.1. Phosphodiesterase 6b, cgmp-specific, rod, beta (congenital stationary night blindness 3, autosomal dominant) (PDE6B, Accession NP_000274.1) is another GAM2071 target gene, herein designated TARGET GENE. PDE6B BINDING SITE is a target binding site found in the 3' untranslated region of mRNA encoded by PDE6B, corresponding to a target binding site such as BINDING SITE I, BINDING SITE II or BINDING SITE III of FIG. 8. Table 4 illustrates the complementarity of the nucleotide sequences of PDE6B BINDING SITE, designated SEQ ID:18070, to the nucleotide sequence of GAM2071 RNA, herein designated GAM RNA, also designated SEQ ID:371.

Another function of GAM2071 is therefore inhibition of Phosphodiesterase 6b, cgmp-specific, rod, beta (congenital stationary night blindness 3, autosomal dominant) (PDE6B, Accession NP_000274.1). Accordingly, utilities of GAM2071 include diagnosis, prevention and treatment of diseases and clinical conditions associated with PDE6B.

Platelet derived growth factor c (PDGFC, Accession NP_057289.1) is another GAM2071 target gene, herein designated TARGET GENE. PDGFC BINDING SITE is a target binding site found in the 3' untranslated region of mRNA encoded by PDGFC, corresponding to a target binding site such as BINDING SITE I, BINDING SITE II or BINDING SITE III of FIG. 8. Table 4 illustrates the complementarity of the nucleotide sequences of PDGFC BINDING SITE, designated SEQ ID:19767, to the nucleotide sequence of GAM2071 RNA, herein designated GAM RNA, also designated SEQ ID:371.

Another function of GAM2071 is therefore inhibition of Platelet derived growth factor c (PDGFC, Accession NP_057289.1). Accordingly, utilities of GAM2071 include diagnosis, prevention and treatment of diseases and clinical conditions associated with PDGFC.

Pdz and lim domain 2 (mystique) (PDLIM2, Accession NP_789847.1) is another GAM2071 target gene, herein designated TARGET GENE. PDLIM2 BINDING SITE is a target binding site found in the 3' untranslated region of multiple transcripts of mRNA encoded by PDLIM2, corresponding to a target binding site such as BINDING SITE I, BINDING SITE II or BINDING SITE III of FIG. 8. Table 4 illustrates the complementarity of the nucleotide sequences of PDLIM2 BINDING SITE, designated SEQ ID:4874, to the nucleotide sequence of GAM2071 RNA, herein designated GAM RNA, also designated SEQ ID:371.

Another function of GAM2071 is therefore inhibition of Pdz and lim domain 2 (mystique) (PDLIM2, Accession NP_789847.1). Accordingly, utilities of GAM2071 include diagnosis, prevention and treatment of diseases and clinical conditions associated with PDLIM2.

Pdz domain containing 1 (PDZK1, Accession NP_002605.2) is another GAM2071 target gene, herein designated TARGET GENE. PDZK1 BINDING SITE is a target binding site found in the 5' untranslated region of mRNA encoded by PDZK1, corresponding to a target binding site such as BINDING SITE I, BINDING SITE II or BINDING SITE III of FIG. 8. Table 4 illustrates the complementarity of the nucleotide sequences of PDZK1 BINDING SITE, designated SEQ ID:11598, to the nucleotide sequence of GAM2071 RNA, herein designated GAM RNA, also designated SEQ ID:371.

Another function of GAM2071 is therefore inhibition of Pdz domain containing 1 (PDZK1, Accession NP_002605.2), a gene which is a contains PDZ interaction domains, interacts with MAP17, a protein involved in control of cell proliferation. and therefore may be associated with Autosomal dominant hypophosphatemic rickets. Accordingly, utilities of GAM2071 include diagnosis, prevention and treatment of Autosomal dominant hypophosphatemic rickets, and of other diseases and clinical conditions associated with PDZK1.

The function of PDZK1 and its association with various diseases and clinical conditions, has been established by previous studies, as described hereinabove with reference to GAM136.1. PDZRN1 (Accession NP_699202.1) is another GAM2071 target gene, herein designated TARGET GENE. PDZRN1 BINDING SITE is a target binding site found in the 3' untranslated region of mRNA encoded by PDZRN1, corresponding to a target binding site such as BINDING SITE I, BINDING SITE II or BINDING SITE III of FIG. 8. Table 4 illustrates the complementarity of the nucleotide sequences of PDZRN1 BINDING SITE, designated SEQ ID:17567, to the nucleotide sequence of GAM2071 RNA, herein designated GAM RNA, also designated SEQ ID:371.

Another function of GAM2071 is therefore inhibition of PDZRN1 (Accession NP_699202.1). Accordingly, utilities of GAM2071 include diagnosis, prevention and treatment of diseases and clinical conditions associated with PDZRN1.

PEGASUS (Accession NP_071911.2) is another GAM2071 target gene, herein designated TARGET GENE. PEGASUS BINDING SITE is a target binding site found in the 3' untranslated region of mRNA encoded by PEGASUS, corresponding to a target binding site such as BINDING SITE I, BINDING SITE II or BINDING SITE III of FIG. 8. Table 4 illustrates the complementarity of the nucleotide sequences of PEGASUS BINDING SITE, designated SEQ ID:13389, to the nucleotide sequence of GAM2071 RNA, herein designated GAM RNA, also designated SEQ ID:371.

Another function of GAM2071 is therefore inhibition of PEGASUS (Accession NP_071911.2). Accordingly, utilities of GAM2071 include diagnosis, prevention and treatment of diseases and clinical conditions associated with PEGASUS.

Pellino homolog 1 (drosophila) (PELI1, Accession NP_065702.2) is another GAM2071 target gene, herein designated TARGET GENE. PELI1 BINDING SITE1 through PELI1 BINDING SITE3 are target binding sites found in untranslated regions of mRNA encoded by PELI1, corresponding to target binding sites such as BINDING SITE I, BINDING SITE II or BINDING SITE III of FIG. 8. Table 4 illustrates the complementarity of the nucleotide sequences of PELI1 BINDING SITE1 through PELI1 BINDING SITE3, designated SEQ ID:18182, SEQ ID:430 and SEQ ID:13801 respectively, to the nucleotide sequence of GAM2071 RNA, herein designated GAM RNA, also designated SEQ ID:371.

Another function of GAM2071 is therefore inhibition of Pellino homolog 1 (drosophila) (PELI1, Accession NP_065702.2). Accordingly, utilities of GAM2071 include diagnosis, prevention and treatment of diseases and clinical conditions associated with PELI1.

Period homolog 2 (drosophila) (PER2, Accession NP_073728.1) is another GAM2071 target gene, herein designated TARGET GENE. PER2 BINDING SITE is a target binding site found in the 3' untranslated region of multiple transcripts of mRNA encoded by PER2, corresponding to a target binding site such as BINDING SITE I, BINDING SITE II or BINDING SITE III of FIG. 8. Table 4 illustrates the complementarity of the nucleotide sequences of PER2 BINDING SITE, designated SEQ ID:6602, to the nucleotide sequence of GAM2071 RNA, herein designated GAM RNA, also designated SEQ ID:371.

Another function of GAM2071 is therefore inhibition of Period homolog 2 (drosophila) (PER2, Accession NP_073728.1), a gene which Period homolog 2; putative circadian clock protein; has a PAS dimerization domain and therefore may be associated with Familial advanced sleep-phase syndrome. Accordingly, utilities of GAM2071 include diagnosis, prevention and treatment of Familial advanced sleep-phase syndrome, and of other diseases and clinical conditions associated with PER2.

The function of PER2 and its association with various diseases and clinical conditions, has been established by previous studies, as described hereinabove with reference to GAM130.1. Phosphoribosylformylglycinamidine synthase (fgar amidotransferase) (PFAS, Accession NP_036525.1) is another GAM2071 target gene, herein designated TARGET GENE. PFAS BINDING SITE is a target binding site found in the 3' untranslated region of mRNA encoded by PFAS, corresponding to a target binding site such as BINDING SITE I, BINDING SITE II or BINDING SITE III of FIG. 8. Table 4 illustrates the complementarity of the nucleotide sequences of PFAS BINDING SITE, designated SEQ ID:16519, to the nucleotide sequence of GAM2071 RNA, herein designated GAM RNA, also designated SEQ ID:371.

Another function of GAM2071 is therefore inhibition of Phosphoribosylformylglycinamidine synthase (fgar amidotransferase) (PFAS, Accession NP_036525.1). Accordingly, utilities of GAM2071 include diagnosis, prevention and treatment of diseases and clinical conditions associated with PFAS.

Polymeric immunoglobulin receptor (PIGR, Accession NP_002635.2) is another GAM2071 target gene, herein designated TARGET GENE. PIGR BINDING SITE1 and PIGR BINDING SITE2 are target binding sites found in untranslated regions of mRNA encoded by PIGR, corresponding to target binding sites such as BINDING SITE I, BINDING SITE II or BINDING SITE III of FIG. 8. Table 4 illustrates the complementarity of the nucleotide sequences of PIGR BINDING SITE1 and PIGR BINDING SITE2, designated SEQ ID:5370 and SEQ ID:8350 respectively, to the nucleotide sequence of GAM2071 RNA, herein designated GAM RNA, also designated SEQ ID:371.

Another function of GAM2071 is therefore inhibition of Polymeric immunoglobulin receptor (PIGR, Accession NP_002635.2). Accordingly, utilities of GAM2071 include diagnosis, prevention and treatment of diseases and clinical conditions associated with PIGR.

Phosphoinositide-3-kinase, class 2, beta polypeptide (PIK3C2B, Accession NP_002637.2) is another GAM2071 target gene, herein designated TARGET GENE. PIK3C2B BINDING SITE is a target binding site found in the 3' untranslated region of mRNA encoded by PIK3C2B, corresponding to a target binding site such as BINDING SITE I, BINDING SITE II or BINDING SITE III of FIG. 8. Table 4 illustrates the complementarity of the nucleotide sequences of PIK3C2B BINDING SITE, designated SEQ ID:15277, to the nucleotide sequence of GAM2071 RNA, herein designated GAM RNA, also designated SEQ ID:371.

Another function of GAM2071 is therefore inhibition of Phosphoinositide-3-kinase, class 2, beta polypeptide (PIK3C2B, Accession NP_002637.2). Accordingly, utilities of GAM2071 include diagnosis, prevention and treatment of diseases and clinical conditions associated with PIK3C2B.

Phosphoinositide-3-kinase, catalytic, delta polypeptide (PIK3CD, Accession NP_005017.2) is another GAM2071 target gene, herein designated TARGET GENE. PIK3CD BINDING SITE is a target binding site found in the 3' untranslated region of mRNA encoded by PIK3CD, corresponding to a target binding site such as BINDING SITE I, BINDING SITE II or BINDING SITE III of FIG. 8. Table 4 illustrates the complementarity of the nucleotide sequences of PIK3CD BINDING SITE, designated SEQ ID:4771, to the nucleotide sequence of GAM2071 RNA, herein designated GAM RNA, also designated SEQ ID:371.

Another function of GAM2071 is therefore inhibition of Phosphoinositide-3-kinase, catalytic, delta polypeptide (PIK3CD, Accession NP_005017.2), a gene which regulating cell growth. Accordingly, utilities of GAM2071 include diagnosis, prevention and treatment of diseases and clinical conditions associated with PIK3CD.

The function of PIK3CD and its association with various diseases and clinical conditions, has been established by previous studies, as described hereinabove with reference to GAM136.1. PILRB (Accession NP_778212.2) is another GAM2071 target gene, herein designated TARGET GENE. PILRB BINDING SITE is a target binding site found in the 3' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:15120, to the nucleotide sequence of GAM2071 RNA, herein designated GAM RNA, also designated SEQ ID:371.

Another function of GAM2071 is therefore inhibition of PILRB (Accession NP_778212.2). Accordingly, utilities of GAM2071 include diagnosis, prevention and treatment of diseases and clinical conditions associated with PILRB.

PILRB (Accession NP_038468.3) is another GAM2071 target gene, herein designated TARGET GENE. PILRB BINDING SITE is a target binding site found in the 3' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:15120, to the nucleotide sequence of GAM2071 RNA, herein designated GAM RNA, also designated SEQ ID:371.

Another function of GAM2071 is therefore inhibition of PILRB (Accession NP_038468.3). Accordingly, utilities of GAM2071 include diagnosis, prevention and treatment of diseases and clinical conditions associated with PILRB.

PILRB (Accession NP_839956.1) is another GAM2071 target gene, herein designated TARGET GENE. PILRB BINDING SITE is a target binding site found in the 3' untranslated region of multiple transcripts of mRNA encoded by PILRB, corresponding to a target binding site such as BINDING SITE I, BINDING SITE II or BINDING SITE III of FIG. 8. Table 4 illustrates the complementarity of the nucleotide sequences of PILRB BINDING SITE, designated SEQ ID:15120, to the nucleotide sequence of GAM2071 RNA, herein designated GAM RNA, also designated SEQ ID:371.

Another function of GAM2071 is therefore inhibition of PILRB (Accession NP_839956.1). Accordingly, utilities of GAM2071 include diagnosis, prevention and treatment of diseases and clinical conditions associated with PILRB.

Phosphatidylinositol-4-phosphate 5-kinase, type i, gamma (PIP5K1C, Accession NP_036530.1) is another GAM2071 target gene, herein designated TARGET GENE. PIP5K1C BINDING SITE is a target binding site found in the 3' untranslated region of multiple transcripts of mRNA encoded by PIP5K1C, corresponding to a target binding site such as BINDING SITE I, BINDING SITE II or BINDING SITE III of FIG. 8. Table 4 illustrates the complementarity of the nucleotide sequences of PIP5K1C BINDING SITE, designated SEQ ID:1328, to the nucleotide sequence of GAM2071 RNA, herein designated GAM RNA, also designated SEQ ID:371.

Another function of GAM2071 is therefore inhibition of Phosphatidylinositol-4-phosphate 5-kinase, type i, gamma (PIP5K1C, Accession NP_036530.1). Accordingly, utilities of GAM2071 include diagnosis, prevention and treatment of diseases and clinical conditions associated with PIP5K1C.

Phosphatidylinositol-4-phosphate 5-kinase, type i, gamma (PIP5K1C, Accession XP_047620.2) is another GAM2071 target gene, herein designated TARGET GENE. PIP5K1C BINDING SITE is a target binding site found in the 3' untranslated region of multiple transcripts of mRNA encoded by PIP5K1C, corresponding to a target binding site such as BINDING SITE I, BINDING SITE II or BINDING SITE III of FIG. 8. Table 4 illustrates the complementarity of the nucleotide sequences of PIP5K1C BINDING SITE, designated SEQ ID:1328, to the nucleotide sequence of GAM2071 RNA, herein designated GAM RNA, also designated SEQ ID:371.

Another function of GAM2071 is therefore inhibition of Phosphatidylinositol-4-phosphate 5-kinase, type i, gamma (PIP5K1C, Accession XP_047620.2). Accordingly, utilities of GAM2071 include diagnosis, prevention and treatment of diseases and clinical conditions associated with PIP5K1C.

Phosphotidylinositol transfer protein, beta (PITPNB, Accession NP_036531.1) is another GAM2071 target gene, herein designated TARGET GENE. PITPNB BINDING SITE is a target binding site found in the 3' untranslated region of mRNA encoded by PITPNB, corresponding to a target binding site such as BINDING SITE I, BINDING SITE II or BINDING SITE III of FIG. 8. Table 4 illustrates the complementarity of the nucleotide sequences of PITPNB BINDING SITE, designated SEQ ID:19285, to the nucleotide sequence of GAM2071 RNA, herein designated GAM RNA, also designated SEQ ID:371.

Another function of GAM2071 is therefore inhibition of Phosphotidylinositol transfer protein, beta (PITPNB, Accession NP_036531.1), a gene which catalyzes the transfer of ptdins and phosphatidylcholine between membranes. Accordingly, utilities of GAM2071 include diagnosis, prevention and treatment of diseases and clinical conditions associated with PITPNB.

The function of PITPNB and its association with various diseases and clinical conditions, has been established by previous studies, as described hereinabove with reference to GAM354.1. Phosphomannomutase 2 (PMM2, Accession NP_000294.1) is another GAM2071 target gene, herein designated TARGET GENE. PMM2 BINDING SITE is a target binding site found in the 3' untranslated region of mRNA encoded by PMM2, corresponding to a target binding site such as BINDING SITE I, BINDING SITE II or BINDING SITE III of FIG. 8. Table 4 illustrates the complementarity of the nucleotide sequences of PMM2 BINDING SITE, designated SEQ ID:1676, to the nucleotide sequence of GAM2071 RNA, herein designated GAM RNA, also designated SEQ ID:371.

Another function of GAM2071 is therefore inhibition of Phosphomannomutase 2 (PMM2, Accession NP_000294.1). Accordingly, utilities of GAM2071 include diagnosis, prevention and treatment of diseases and clinical conditions associated with PMM2.

Paraneoplastic antigen ma2 (PNMA2, Accession NP_009188.1) is another GAM2071 target gene, herein designated TARGET GENE. PNMA2 BINDING SITE1 and PNMA2 BINDING SITE2 are target binding sites found in untranslated regions of mRNA encoded by PNMA2, corresponding to target binding sites such as BINDING SITE I, BINDING SITE II or BINDING SITE III of FIG. 8. Table 4 illustrates the complementarity of the nucleotide sequences of PNMA2 BINDING SITE1 and PNMA2 BINDING SITE2, designated SEQ ID:11236 and SEQ ID:11189 respectively, to the nucleotide sequence of GAM2071 RNA, herein designated GAM RNA, also designated SEQ ID:371.

Another function of GAM2071 is therefore inhibition of Paraneoplastic antigen ma2 (PNMA2, Accession NP_009188.1). Accordingly, utilities of GAM2071 include diagnosis, prevention and treatment of diseases and clinical conditions associated with PNMA2.

Protein o-fucosyltransferase 1 (POFUT1, Accession NP_056167.1) is another GAM2071 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:1760, to the nucleotide sequence of GAM2071 RNA, herein designated GAM RNA, also designated SEQ ID:371.

Another function of GAM2071 is therefore inhibition of Protein o-fucosyltransferase 1 (POFUT1, Accession NP_056167.1) . Accordingly, utilities of GAM2071 include diagnosis, prevention and treatment of diseases and clinical conditions associated with POFUT1.

Polymerase (dna directed), epsilon 3 (p17 subunit) (POLE3, Accession NP_059139.2) is another GAM2071 target gene, herein designated TARGET GENE. POLE3 BINDING SITE is a target binding site found in the 3' untranslated region of mRNA encoded by POLE3, corresponding to a target binding site such as BINDING SITE I, BINDING SITE II or BINDING SITE III of FIG. 8. Table 4 illustrates the complementarity of the nucleotide sequences of POLE3 BINDING SITE, designated SEQ ID:5665, to the nucleotide sequence of GAM2071 RNA, herein designated GAM RNA, also designated SEQ ID:371.

Another function of GAM2071 is therefore inhibition of Polymerase (dna directed), epsilon 3 (p17 subunit) (POLE3, Accession NP_059139.2). Accordingly, utilities of GAM2071 include diagnosis, prevention and treatment of diseases and clinical conditions associated with POLE3.

Polymerase (rna) ii (dna directed) polypeptide d (POLR2D, Accession NP_004796.1) is another GAM2071 target gene, herein designated TARGET GENE. POLR2D BINDING SITE is a target binding site found in the 3' untranslated region of mRNA encoded by POLR2D, corresponding to a target binding site such as BINDING SITE I, BINDING SITE II or BINDING SITE III of FIG. 8. Table 4 illustrates the complementarity of the nucleotide sequences of POLR2D BINDING SITE, designated SEQ ID:11282, to the nucleotide sequence of GAM2071 RNA, herein designated GAM RNA, also designated SEQ ID:371.

Another function of GAM2071 is therefore inhibition of Polymerase (rna) ii (dna directed) polypeptide d (POLR2D, Accession NP_004796.1). Accordingly, utilities of GAM2071 include diagnosis, prevention and treatment of diseases and clinical conditions associated with POLR2D.

Paraoxonase 1 (PON1, Accession NP_000437.3) is another GAM2071 target gene, herein designated TARGET GENE. PON1 BINDING SITE1 and PON1 BINDING SITE2 are target binding sites found in untranslated regions of mRNA encoded by PON1, corresponding to target binding sites such as BINDING SITE I, BINDING SITE II or BINDING SITE III of FIG. 8. Table 4 illustrates the complementarity of the nucleotide sequences of PON1 BINDING SITE1 and PON1 BINDING SITE2, designated SEQ ID:19429 and SEQ ID:1117 respectively, to the nucleotide sequence of GAM2071 RNA, herein designated GAM RNA, also designated SEQ ID:371.

Another function of GAM2071 is therefore inhibition of Paraoxonase 1 (PON1, Accession NP_000437.3), a gene which hydrolyzes the toxic metabolites of a variety of organophosphorus insecticides. Accordingly, utilities of GAM2071 include diagnosis, prevention and treatment of diseases and clinical conditions associated with PON1.

The function of PON1 and its association with various diseases and clinical conditions, has been established by previous studies, as described hereinabove with reference to GAM189.1. Pou domain, class 2, transcription factor 3 (POU2F3, Accession NP_055167.1) is another GAM2071 target gene, herein designated TARGET GENE. POU2F3 BINDING SITE is a target binding site found in the 3' untranslated region of mRNA encoded by POU2F3, corresponding to a target binding site such as BINDING SITE I, BINDING SITE II or BINDING SITE III of FIG. 8. Table 4 illustrates the complementarity of the nucleotide sequences of POU2F3 BINDING SITE, designated SEQ ID:7036, to the nucleotide sequence of GAM2071 RNA, herein designated GAM RNA, also designated SEQ ID:371.

Another function of GAM2071 is therefore inhibition of Pou domain, class 2, transcription factor 3 (POU2F3, Accession NP_055167.1). Accordingly, utilities of GAM2071 include diagnosis, prevention and treatment of diseases and clinical conditions associated with POU2F3.

Ptprf interacting protein, binding protein 1 (liprin beta 1) (PPFIBP1, Accession NP_003613.2) is another GAM2071 target gene, herein designated TARGET GENE. PPFIBP1 BINDING SITE1 and PPFIBP1 BINDING SITE2 are target binding sites found in untranslated regions of multiple transcripts of mRNA encoded by PPFIBP1, corresponding to target binding sites such as BINDING SITE I, BINDING SITE II or BINDING SITE III of FIG. 8. Table 4 illustrates the complementarity of the nucleotide sequences of PPFIBP1 BINDING SITE1 and PPFIBP1 BINDING SITE2, designated SEQ ID:8861 and SEQ ID:5523 respectively, to the nucleotide sequence of GAM2071 RNA, herein designated GAM RNA, also designated SEQ ID:371.

Another function of GAM2071 is therefore inhibition of Ptprf interacting protein, binding protein 1 (liprin beta 1) (PPFIBP1, Accession NP_003613.2). Accordingly, utilities of GAM2071 include diagnosis, prevention and treatment of diseases and clinical conditions associated with PPFIBP1.

Peptidylprolyl isomerase d (cyclophilin d) (PPID, Accession NP_005029.1) is another GAM2071 target gene, herein designated TARGET GENE. PPID BINDING SITE is a target binding site found in the 3' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:3110, to the nucleotide sequence of GAM2071 RNA, herein designated GAM RNA, also designated SEQ ID:371.

Another function of GAM2071 is therefore inhibition of Peptidylprolyl isomerase d (cyclophilin d) (PPID, Accession NP_005029.1), a gene which catalyzes the cis-trans isomerization of proline imidic peptide bonds in oligopeptides. Accordingly, utilities of GAM2071 include diagnosis, prevention and treatment of diseases and clinical conditions associated with PPID.

The function of PPID and its association with various diseases and clinical conditions, has been established by previous studies, as described hereinabove with reference to GAM136.1. Peptidylprolyl isomerase (cyclophilin)-like 2 (PPIL2, Accession NP_055152.1) is another GAM2071 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:18677, to the nucleotide sequence of GAM2071 RNA, herein designated GAM RNA, also designated SEQ ID:371.

Another function of GAM2071 is therefore inhibition of Peptidylprolyl isomerase (cyclophilin)-like 2 (PPIL2, Accession NP_055152.1). Accordingly, utilities of GAM2071 include diagnosis, prevention and treatment of diseases and clinical conditions associated with PPIL2.

Protein phosphatase 1, regulatory (inhibitor) subunit 12b (PPP1R12B, Accession NP_115288.1) is another GAM2071 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:14820, to the nucleotide sequence of GAM2071 RNA, herein designated GAM RNA, also designated SEQ ID:371.

Another function of GAM2071 is therefore inhibition of Protein phosphatase 1, regulatory (inhibitor) subunit 12b (PPP1R12B, Accession NP_115288.1). Accordingly, utilities of GAM2071 include diagnosis, prevention and treatment of diseases and clinical conditions associated with PPP1R12B.

Protein phosphatase 1, regulatory (inhibitor) subunit 12b (PPP1R12B, Accession NP_002472.1) is another GAM2071 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:14820, to the nucleotide sequence of GAM2071 RNA, herein designated GAM RNA, also designated SEQ ID:371.

Another function of GAM2071 is therefore inhibition of Protein phosphatase 1, regulatory (inhibitor) subunit 12b (PPP1R12B, Accession NP_002472.1). Accordingly, utilities of GAM2071 include diagnosis, prevention and treatment of diseases and clinical conditions associated with PPP1R12B.

Protein phosphatase 2 (formerly 2a), regulatory subunit a (pr 65), beta isoform (PPP2R1B, Accession NP_002707.2) is another GAM2071 target gene, herein designated TARGET GENE. PPP2R1B BINDING SITE is a target binding site found in the 3' untranslated region of mRNA encoded by PPP2R1B, corresponding to a target binding site such as BINDING SITE I, BINDING SITE II or BINDING SITE III of FIG. 8. Table 4 illustrates the complementarity of the nucleotide sequences of PPP2R1B BINDING SITE, designated SEQ ID:8962, to the nucleotide sequence of GAM2071 RNA, herein designated GAM RNA, also designated SEQ ID:371.

Another function of GAM2071 is therefore inhibition of Protein phosphatase 2 (formerly 2a), regulatory subunit a (pr 65), beta isoform (PPP2R1B, Accession NP_002707.2), a gene which is necessary for interaction of the catalytic PP2A-C and variable PP2A-B subunits. Accordingly, utilities of GAM2071 include diagnosis, prevention and treatment of diseases and clinical conditions associated with PPP2R1B.

The function of PPP2R1B and its association with various diseases and clinical conditions, has been established by previous studies, as described hereinabove with reference to GAM94.1. PRDX6 (Accession NP_004896.1) is another GAM2071 target gene, herein designated TARGET GENE. PRDX6 BINDING SITE is a target binding site found in the 3' untranslated region of mRNA encoded by PRDX6, corresponding to a target binding site such as BINDING SITE I, BINDING SITE II or BINDING SITE III of FIG. 8. Table 4 illustrates the complementarity of the nucleotide sequences of PRDX6 BINDING SITE, designated SEQ ID:19006, to the nucleotide sequence of GAM2071 RNA, herein designated GAM RNA, also designated SEQ ID:371.

Another function of GAM2071 is therefore inhibition of PRDX6 (Accession NP_004896.1). Accordingly, utilities of GAM2071 include diagnosis, prevention and treatment of diseases and clinical conditions associated with PRDX6.

Primase, polypeptide 2a, 58 kda (PRIM2A, Accession NP_000938.1) is another GAM2071 target gene, herein designated TARGET GENE. PRIM2A BINDING SITE is a target binding site found in the 3' untranslated region of mRNA encoded by PRIM2A, corresponding to a target binding site such as BINDING SITE I, BINDING SITE II or BINDING SITE III of FIG. 8. Table 4 illustrates the complementarity of the nucleotide sequences of PRIM2A BINDING SITE, designated SEQ ID:12707, to the nucleotide sequence of GAM2071 RNA, herein designated GAM RNA, also designated SEQ ID:371.

Another function of GAM2071 is therefore inhibition of Primase, polypeptide 2a, 58 kda (PRIM2A, Accession NP_000938.1). Accordingly, utilities of GAM2071 include diagnosis, prevention and treatment of diseases and clinical conditions associated with PRIM2A.

Protein kinase, lysine deficient 3 (PRKWNK3, Accession NP_065973.1) is another GAM2071 target gene, herein designated TARGET GENE. PRKWNK3 BINDING SITE is a target binding site found in the 3' untranslated region of mRNA encoded by PRKWNK3, corresponding to a target binding site such as BINDING SITE I, BINDING SITE II or BINDING SITE III of FIG. 8. Table 4 illustrates the complementarity of the nucleotide sequences of PRKWNK3 BINDING SITE, designated SEQ ID:5524, to the nucleotide sequence of GAM2071 RNA, herein designated GAM RNA, also designated SEQ ID:371.

Another function of GAM2071 is therefore inhibition of Protein kinase, lysine deficient 3 (PRKWNK3, Accession NP_065973.1). Accordingly, utilities of GAM2071 include diagnosis, prevention and treatment of diseases and clinical conditions associated with PRKWNK3.

Protein kinase, y-linked (PRKY, Accession NP_002751.1) is another GAM2071 target gene, herein designated TARGET GENE. PRKY BINDING SITE is a target binding site found in the 3' untranslated region of mRNA encoded by PRKY, corresponding to a target binding site such as BINDING SITE I, BINDING SITE II or BINDING SITE III of FIG. 8. Table 4 illustrates the complementarity of the nucleotide sequences of PRKY BINDING SITE, designated SEQ ID:1958, to the nucleotide sequence of GAM2071 RNA, herein designated GAM RNA, also designated SEQ ID:371.

Another function of GAM2071 is therefore inhibition of Protein kinase, y-linked (PRKY, Accession NP_002751.1), a gene which is a putative protein kinase. Accordingly, utilities of GAM2071 include diagnosis, prevention and treatment of diseases and clinical conditions associated with PRKY.

The function of PRKY and its association with various diseases and clinical conditions, has been established by previous studies, as described hereinabove with reference to GAM72.1. Prion protein 2 (dublet) (PRND, Accession NP_036541.1) is another GAM2071 target gene, herein designated TARGET GENE. PRND BINDING SITE is a target binding site found in the 3' untranslated region of mRNA encoded by PRND, corresponding to a target binding site such as BINDING SITE I, BINDING SITE II or BINDING SITE III of FIG. 8. Table 4 illustrates the complementarity of the nucleotide sequences of PRND BINDING SITE, designated SEQ ID:7084, to the nucleotide sequence of GAM2071 RNA, herein designated GAM RNA, also designated SEQ ID:371.

Another function of GAM2071 is therefore inhibition of Prion protein 2 (dublet) (PRND, Accession NP_036541.1), a gene which is similar to prion protein PRNP. Accordingly, utilities of GAM2071 include diagnosis, prevention and treatment of diseases and clinical conditions associated with PRND.

The function of PRND and its association with various diseases and clinical conditions, has been established by previous studies, as described hereinabove with reference to GAM116.1. PRO0159 (Accession NP_054837.1) is another GAM2071 target gene, herein designated TARGET GENE. PRO0159 BINDING SITE is a target binding site found in the 5' untranslated region of mRNA encoded by PRO0159, corresponding to a target binding site such as BINDING SITE I, BINDING SITE II or BINDING SITE III of FIG. 8. Table 4 illustrates the complementarity of the nucleotide sequences of PRO0159 BINDING SITE, designated SEQ ID:4857, to the nucleotide sequence of GAM2071 RNA, herein designated GAM RNA, also designated SEQ ID:371.

Another function of GAM2071 is therefore inhibition of PRO0159 (Accession NP_054837.1). Accordingly, utilities of GAM2071 include diagnosis, prevention and treatment of diseases and clinical conditions associated with PRO0159.

PRO0297 (Accession NP_054800.1) is another GAM2071 target gene, herein designated TARGET GENE. PRO0297 BINDING SITE is a target binding site found in the 5' untranslated region of mRNA encoded by PRO0297, corresponding to a target binding site such as BINDING SITE I, BINDING SITE II or BINDING SITE III of FIG. 8. Table 4 illustrates the complementarity of the nucleotide sequences of PRO0297 BINDING SITE, designated SEQ ID:1504, to the nucleotide sequence of GAM2071 RNA, herein designated GAM RNA, also designated SEQ ID:371.

Another function of GAM2071 is therefore inhibition of PRO0297 (Accession NP_054800.1). Accordingly, utilities of GAM2071 include diagnosis, prevention and treatment of diseases and clinical conditions associated with PRO0297.

PRO0365 (Accession NP_054845.1) is another GAM2071 target gene, herein designated TARGET GENE. PRO0365 BINDING SITE is a target binding site found in the 5' untranslated region of mRNA encoded by PRO0365, corresponding to a target binding site such as BINDING SITE I, BINDING SITE II or BINDING SITE III of FIG. 8. Table 4 illustrates the complementarity of the nucleotide sequences of PRO0365 BINDING SITE, designated SEQ ID:7958, to the nucleotide sequence of GAM2071 RNA, herein designated GAM RNA, also designated SEQ ID:371.

Another function of GAM2071 is therefore inhibition of PRO0365 (Accession NP_054845.1). Accordingly, utilities of GAM2071 include diagnosis, prevention and treatment of diseases and clinical conditions associated with PRO0365.

PROM2 (Accession NP_653308.1) is another GAM2071 target gene, herein designated TARGET GENE. PROM2 BINDING SITE is a target binding site found in the 3' untranslated region of mRNA encoded by PROM2, corresponding to a target binding site such as BINDING SITE I, BINDING SITE II or BINDING SITE III of FIG. 8. Table 4 illustrates the complementarity of the nucleotide sequences of PROM2 BINDING SITE, designated SEQ ID:19427, to the nucleotide sequence of GAM2071 RNA, herein designated GAM RNA, also designated SEQ ID:371.

Another function of GAM2071 is therefore inhibition of PROM2 (Accession NP_653308.1). Accordingly, utilities of GAM2071 include diagnosis, prevention and treatment of diseases and clinical conditions associated with PROM2.

Proteasome (prosome, macropain) 26s subunit, non-atpase, 9 (PSMD9, Accession NP_002804.2) is another GAM2071 target gene, herein designated TARGET GENE. PSMD9 BINDING SITE is a target binding site found in the 3' untranslated region of mRNA encoded by PSMD9, corresponding to a target binding site such as BINDING SITE I, BINDING SITE II or BINDING SITE III of FIG. 8. Table 4 illustrates the complementarity of the nucleotide sequences of PSMD9 BINDING SITE, designated SEQ ID:11654, to the nucleotide sequence of GAM2071 RNA, herein designated GAM RNA, also designated SEQ ID:371.

Another function of GAM2071 is therefore inhibition of Proteasome (prosome, macropain) 26s subunit, non-atpase, 9 (PSMD9, Accession NP_002804.2), a gene which acts as a regulatory subunit of the 26 proteasome. Accordingly, utilities of GAM2071 include diagnosis, prevention and treatment of diseases and clinical conditions associated with PSMD9.

The function of PSMD9 and its association with various diseases and clinical conditions, has been established by previous studies, as described hereinabove with reference to GAM30.1. PSME4 (Accession XP_040158.1) is another GAM2071 target gene, herein designated TARGET GENE. PSME4 BINDING SITE is a target binding site found in the 3' untranslated region of mRNA encoded by PSME4, corresponding to a target binding site such as BINDING SITE I, BINDING SITE II or BINDING SITE III of FIG. 8. Table 4 illustrates the complementarity of the nucleotide sequences of PSME4 BINDING SITE, designated SEQ ID:14216, to the nucleotide sequence of GAM2071 RNA, herein designated GAM RNA, also designated SEQ ID:371.

Another function of GAM2071 is therefore inhibition of PSME4 (Accession XP_040158.1). Accordingly, utilities of GAM2071 include diagnosis, prevention and treatment of diseases and clinical conditions associated with PSME4.

Phosphoserine phosphatase (PSPH, Accession NP_004568.1) is another GAM2071 target gene, herein designated TARGET GENE. PSPH BINDING SITE is a target binding site found in the 3' untranslated region of mRNA encoded by PSPH, corresponding to a target binding site such as BINDING SITE I, BINDING SITE II or BINDING SITE III of FIG. 8. Table 4 illustrates the complementarity of the nucleotide sequences of PSPH BINDING SITE, designated SEQ ID:9102, to the nucleotide sequence of GAM2071 RNA, herein designated GAM RNA, also designated SEQ ID:371.

Another function of GAM2071 is therefore inhibition of Phosphoserine phosphatase (PSPH, Accession NP_004568.1). Accordingly, utilities of GAM2071 include diagnosis, prevention and treatment of diseases and clinical conditions associated with PSPH.

Phosphatidylserine synthase 2 (PTDSS2, Accession NP_110410.1) is another GAM2071 target gene, herein designated TARGET GENE. PTDSS2 BINDING SITE is a target binding site found in the 3' untranslated region of mRNA encoded by PTDSS2, corresponding to a target binding site such as BINDING SITE I, BINDING SITE II or BINDING SITE III of FIG. 8. Table 4 illustrates the complementarity of the nucleotide sequences of PTDSS2 BINDING SITE, designated SEQ ID:12204, to the nucleotide sequence of GAM2071 RNA, herein designated GAM RNA, also designated SEQ ID:371.

Another function of GAM2071 is therefore inhibition of Phosphatidylserine synthase 2 (PTDSS2, Accession NP_110410.1). Accordingly, utilities of GAM2071 include diagnosis, prevention and treatment of diseases and clinical conditions associated with PTDSS2.

Prostaglandin e synthase (PTGES, Accession NP_004869.1) is another GAM2071 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:11575, to the nucleotide sequence of GAM2071 RNA, herein designated GAM RNA, also designated SEQ ID:371.

Another function of GAM2071 is therefore inhibition of Prostaglandin e synthase (PTGES, Accession NP_004869.1). Accordingly, utilities of GAM2071 include diagnosis, prevention and treatment of diseases and clinical conditions associated with PTGES.

Prostaglandin i2 (prostacyclin) synthase (PTGIS, Accession NP_000952.1) is another GAM2071 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:11917, to the nucleotide sequence of GAM2071 RNA, herein designated GAM RNA, also designated SEQ ID:371.

Another function of GAM2071 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM2071 include diagnosis, prevention and treatment of diseases and clinical conditions associated with PTGIS.

The function of PTGIS and its association with various diseases and clinical conditions, has been established by previous studies, as described hereinabove with reference to GAM30.1. RAB11-FIP4 (Accession NP_116321.2) is another GAM2071 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:5406, to the nucleotide sequence of GAM2071 RNA, herein designated GAM RNA, also designated SEQ ID:371.

Another function of GAM2071 is therefore inhibition of RAB11-FIP4 (Accession NP_116321.2). Accordingly, utilities of GAM2071 include diagnosis, prevention and treatment of diseases and clinical conditions associated with RAB11-FIP4.

Rab21, member ras oncogene family (RAB21, Accession NP_055814.1) is another GAM2071 target gene, herein designated TARGET GENE. RAB21 BINDING SITE is a target binding site found in the 3' untranslated region of mRNA encoded by RAB21, corresponding to a target binding site such as BINDING SITE I, BINDING SITE II or BINDING SITE III of FIG. 8. Table 4 illustrates the complementarity of the nucleotide sequences of RAB21 BINDING SITE, designated SEQ ID:17172, to the nucleotide sequence of GAM2071 RNA, herein designated GAM RNA, also designated SEQ ID:371.

Another function of GAM2071 is therefore inhibition of Rab21, member ras oncogene family (RAB21, Accession NP_055814.1). Accordingly, utilities of GAM2071 include diagnosis, prevention and treatment of diseases and clinical conditions associated with RAB21.

Rab33b, member ras oncogene family (RAB33B, Accession NP_112586.1) is another GAM2071 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:15333, to the nucleotide sequence of GAM2071 RNA, herein designated GAM RNA, also designated SEQ ID:371.

Another function of GAM2071 is therefore inhibition of Rab33b, member ras oncogene family (RAB33B, Accession NP_112586.1). Accordingly, utilities of GAM2071 include diagnosis, prevention and treatment of diseases and clinical conditions associated with RAB33B.

Rab36, member ras oncogene family (RAB36, Accession NP_004905.1) is another GAM2071 target gene, herein designated TARGET GENE. RAB36 BINDING SITE is a target binding site found in the 3' untranslated region of mRNA encoded by RAB36, corresponding to a target binding site such as BINDING SITE I, BINDING SITE II or BINDING SITE III of FIG. 8. Table 4 illustrates the complementarity of the nucleotide sequences of RAB36 BINDING SITE, designated SEQ ID:12750, to the nucleotide sequence of GAM2071 RNA, herein designated GAM RNA, also designated SEQ ID:371.

Another function of GAM2071 is therefore inhibition of Rab36, member ras oncogene family (RAB36, Accession NP_004905.1), a gene which is involved in protein transport. Accordingly, utilities of GAM2071 include diagnosis, prevention and treatment of diseases and clinical conditions associated with RAB36.

The function of RAB36 and its association with various diseases and clinical conditions, has been established by previous studies, as described hereinabove with reference to GAM130.1. Rab39, member ras oncogene family (RAB39, Accession XP_084662.1) is another GAM2071 target gene, herein designated TARGET GENE. RAB39 BINDING SITE is a target binding site found in the 3' untranslated region of mRNA encoded by RAB39, corresponding to a target binding site such as BINDING SITE I, BINDING SITE II or BINDING SITE III of FIG. 8. Table 4 illustrates the complementarity of the nucleotide sequences of RAB39 BINDING SITE, designated SEQ ID:2158, to the nucleotide sequence of GAM2071 RNA, herein designated GAM RNA, also designated SEQ ID:371.

Another function of GAM2071 is therefore inhibition of Rab39, member ras oncogene family (RAB39, Accession XP_084662.1). Accordingly, utilities of GAM2071 include diagnosis, prevention and treatment of diseases and clinical conditions associated with RAB39.

Rab40c, member ras oncogene family (RAB40C, Accession NP_066991.1) is another GAM2071 target gene, herein designated TARGET GENE. RAB40C BINDING SITE is a target binding site found in the 3' untranslated region of mRNA encoded by RAB40C, corresponding to a target binding site such as BINDING SITE I, BINDING SITE II or BINDING SITE III of FIG. 8. Table 4 illustrates the complementarity of the nucleotide sequences of RAB40C BINDING SITE, designated SEQ ID:8129, to the nucleotide sequence of GAM2071 RNA, herein designated GAM RNA, also designated SEQ ID:371.

Another function of GAM2071 is therefore inhibition of Rab40c, member ras oncogene family (RAB40C, Accession NP_066991.1). Accordingly, utilities of GAM2071 include diagnosis, prevention and treatment of diseases and clinical conditions associated with RAB40C.

Rab, member of ras oncogene family-like 2a (RABL2A, Accession NP_038198.1) is another GAM2071 target gene, herein designated TARGET GENE. RABL2A BINDING SITE is a target binding site found in the 3' untranslated region of multiple transcripts of mRNA encoded by RABL2A, corresponding to a target binding site such as BINDING SITE I, BINDING SITE II or BINDING SITE III of FIG. 8. Table 4 illustrates the complementarity of the nucleotide sequences of RABL2A BINDING SITE, designated SEQ ID:14847, to the nucleotide sequence of GAM2071 RNA, herein designated GAM RNA, also designated SEQ ID:371.

Another function of GAM2071 is therefore inhibition of Rab, member of ras oncogene family-like 2a (RABL2A, Accession NP_038198.1). Accordingly, utilities of GAM2071 include diagnosis, prevention and treatment of diseases and clinical conditions associated with RABL2A.

Rab, member of ras oncogene family-like 2b (RABL2B, Accession NP_009012.1) is another GAM2071 target gene, herein designated TARGET GENE. RABL2B BINDING SITE is a target binding site found in the 3' untranslated region of mRNA encoded by RABL2B, corresponding to a target binding site such as BINDING SITE I, BINDING SITE II or BINDING SITE III of FIG. 8. Table 4 illustrates the complementarity of the nucleotide sequences of RABL2B BINDING SITE, designated SEQ ID:14847, to the nucleotide sequence of GAM2071 RNA, herein designated GAM RNA, also designated SEQ ID:371.

Another function of GAM2071 is therefore inhibition of Rab, member of ras oncogene family-like 2b (RABL2B, Accession NP_009012.1). Accordingly, utilities of GAM2071 include diagnosis, prevention and treatment of diseases and clinical conditions associated with RABL2B.

Rad52 homolog (s. cerevisiae) (RAD52, Accession NP_602295.1) is another GAM2071 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52

BINDING SITE, designated SEQ ID:4266, to the nucleotide sequence of GAM2071 RNA, herein designated GAM RNA, also designated SEQ ID:371.

Another function of GAM2071 is therefore inhibition of Rad52 homolog (s. cerevisiae) (RAD52, Accession NP_602295.1). Accordingly, utilities of GAM2071 include diagnosis, prevention and treatment of diseases and clinical conditions associated with RAD52.

Rad52 homolog (s. cerevisiae) (RAD52, Accession NP_002870.2) is another GAM2071 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52 BINDING SITE, designated SEQ ID:4266, to the nucleotide sequence of GAM2071 RNA, herein designated GAM RNA, also designated SEQ ID:371.

Another function of GAM2071 is therefore inhibition of Rad52 homolog (s. cerevisiae) (RAD52, Accession NP_002870.2). Accordingly, utilities of GAM2071 include diagnosis, prevention and treatment of diseases and clinical conditions associated with RAD52.

Rad52 homolog (s. cerevisiae) (RAD52, Accession NP_602296.1) is another GAM2071 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52 BINDING SITE, designated SEQ ID:4266, to the nucleotide sequence of GAM2071 RNA, herein designated GAM RNA, also designated SEQ ID:371.

Another function of GAM2071 is therefore inhibition of Rad52 homolog (s. cerevisiae) (RAD52, Accession NP_602296.1). Accordingly, utilities of GAM2071 include diagnosis, prevention and treatment of diseases and clinical conditions associated with RAD52.

Rad52 homolog (s. cerevisiae) (RAD52, Accession NP_602294.1) is another GAM2071 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52 BINDING SITE, designated SEQ ID:4266, to the nucleotide sequence of GAM2071 RNA, herein designated GAM RNA, also designated SEQ ID:371.

Another function of GAM2071 is therefore inhibition of Rad52 homolog (s. cerevisiae) (RAD52, Accession NP_602294.1). Accordingly, utilities of GAM2071 include diagnosis, prevention and treatment of diseases and clinical conditions associated with RAD52.

RAI (Accession NP_006654.1) is another GAM2071 target gene, herein designated TARGET GENE. RAI BINDING SITE is a target binding site found in the 5' untranslated region of mRNA encoded by RAI, corresponding to a target binding site such as BINDING SITE I, BINDING SITE II or BINDING SITE III of FIG. 8. Table 4 illustrates the complementarity of the nucleotide sequences of RAI BINDING SITE, designated SEQ ID:17223, to the nucleotide sequence of GAM2071 RNA, herein designated GAM RNA, also designated SEQ ID:371.

Another function of GAM2071 is therefore inhibition of RAI (Accession NP_006654.1). Accordingly, utilities of GAM2071 include diagnosis, prevention and treatment of diseases and clinical conditions associated with RAI.

Retinoic acid induced 3 (RAI3, Accession NP_003970.1) is another GAM2071 target gene, herein designated TARGET GENE. RAI3 BINDING SITE is a target binding site found in the 3' untranslated region of mRNA encoded by RAI3, corresponding to a target binding site such as BINDING SITE I, BINDING SITE II or BINDING SITE III of FIG. 8. Table 4 illustrates the complementarity of the nucleotide sequences of RAI3 BINDING SITE, designated SEQ ID:16116, to the nucleotide sequence of GAM2071 RNA, herein designated GAM RNA, also designated SEQ ID:371.

Another function of GAM2071 is therefore inhibition of Retinoic acid induced 3 (RAI3, Accession NP_003970.1). Accordingly, utilities of GAM2071 include diagnosis, prevention and treatment of diseases and clinical conditions associated with RAI3.

Ras association (ralgds/af-6) domain family 2 (RASSF2, Accession NP_055552.1) is another GAM2071 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:7664, to the nucleotide sequence of GAM2071 RNA, herein designated GAM RNA, also designated SEQ ID:371.

Another function of GAM2071 is therefore inhibition of Ras association (ralgds/af-6) domain family 2 (RASSF2, Accession NP_055552.1). Accordingly, utilities of GAM2071 include diagnosis, prevention and treatment of diseases and clinical conditions associated with RASSF2.

Ras association (ralgds/af-6) domain family 2 (RASSF2, Accession NP_739580.1) is another GAM2071 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:7664, to the nucleotide sequence of GAM2071 RNA, herein designated GAM RNA, also designated SEQ ID:371.

Another function of GAM2071 is therefore inhibition of Ras association (ralgds/af-6) domain family 2 (RASSF2, Accession NP_739580.1). Accordingly, utilities of GAM2071 include diagnosis, prevention and treatment of diseases and clinical conditions associated with RASSF2.

Ras association (ralgds/af-6) domain family 2 (RASSF2, Accession NP_739579.1) is another GAM2071 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:7664, to the nucleotide sequence of GAM2071 RNA, herein designated GAM RNA, also designated SEQ ID:371.

Another function of GAM2071 is therefore inhibition of Ras association (ralgds/af-6) domain family 2 (RASSF2, Accession NP_739579.1). Accordingly, utilities of GAM2071 include diagnosis, prevention and treatment of diseases and clinical conditions associated with RASSF2.

RCBTB1 (Accession NP_060661.2) is another GAM2071 target gene, herein designated TARGET GENE. RCBTB1 BINDING SITE is a target binding site found in the 5' untranslated region of mRNA encoded by RCBTB1, corresponding to a target binding site such as BINDING SITE I, BINDING SITE II or BINDING SITE III of FIG. 8. Table 4 illustrates the complementarity of the nucleotide sequences of RCBTB1 BINDING SITE, designated SEQ ID:3049, to the nucleotide sequence of GAM2071 RNA, herein designated GAM RNA, also designated SEQ ID:371.

Another function of GAM2071 is therefore inhibition of RCBTB1 (Accession NP_060661.2). Accordingly, utilities of GAM2071 include diagnosis, prevention and treatment of diseases and clinical conditions associated with RCBTB1.

Regulator of g-protein signalling 11 (RGS11, Accession NP_003825.1) is another GAM2071 target gene, herein designated TARGET GENE. RGS11 BINDING SITE is a target binding site found in the 3' untranslated region of mRNA encoded by RGS11, corresponding to a target binding site such as BINDING SITE I, BINDING SITE II or BINDING SITE III of FIG. 8. Table 4 illustrates the complementarity of the nucleotide sequences of RGS11 BINDING SITE, designated SEQ ID:7393, to the nucleotide sequence of GAM2071 RNA, herein designated GAM RNA, also designated SEQ ID:371.

Another function of GAM2071 is therefore inhibition of Regulator of g-protein signalling 11 (RGS11, Accession NP_003825.1). Accordingly, utilities of GAM2071 include diagnosis, prevention and treatment of diseases and clinical conditions associated with RGS11.

Rhesus blood group, d antigen (RHD, Accession NP_057208.2) is another GAM2071 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:442 and SEQ ID:8756 respectively, to the nucleotide sequence of GAM2071 RNA, herein designated GAM RNA, also designated SEQ ID:371.

Another function of GAM2071 is therefore inhibition of Rhesus blood group, d antigen (RHD, Accession NP_057208.2), a gene which Major antigen of the RH system. Accordingly, utilities of GAM2071 include diagnosis, prevention and treatment of diseases and clinical conditions associated with RHD.

The function of RHD and its association with various diseases and clinical conditions, has been established by previous studies, as described hereinabove with reference to GAM161.1. Rhesus blood group, d antigen (RHD, Accession NP_057309.2) is another GAM2071 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:8756 and SEQ ID:442 respectively, to the nucleotide sequence of GAM2071 RNA, herein designated GAM RNA, also designated SEQ ID:371.

Another function of GAM2071 is therefore inhibition of Rhesus blood group, d antigen (RHD, Accession NP_057309.2), a gene which Major antigen of the RH system. Accordingly, utilities of GAM2071 include diagnosis, prevention and treatment of diseases and clinical conditions associated with RHD.

The function of RHD and its association with various diseases and clinical conditions, has been established by previous studies, as described hereinabove with reference to GAM161.1. RHPN2 (Accession NP_149094.2) is another GAM2071 target gene, herein designated TARGET GENE. RHPN2 BINDING SITE is a target binding site found in the 3' untranslated region of mRNA encoded by RHPN2, corresponding to a target binding site such as BINDING SITE I, BINDING SITE II or BINDING SITE III of FIG. 8. Table 4 illustrates the complementarity of the nucleotide sequences of RHPN2 BINDING SITE, designated SEQ ID:5481, to the nucleotide sequence of GAM2071 RNA, herein designated GAM RNA, also designated SEQ ID:371.

Another function of GAM2071 is therefore inhibition of RHPN2 (Accession NP_149094.2). Accordingly, utilities of GAM2071 include diagnosis, prevention and treatment of diseases and clinical conditions associated with RHPN2.

RNF137 (Accession NP_060543.4) is another GAM2071 target gene, herein designated TARGET GENE. RNF137 BINDING SITE is a target binding site found in the 3' untranslated region of mRNA encoded by RNF137, corresponding to a target binding site such as BINDING SITE I, BINDING SITE II or BINDING SITE III of FIG. 8. Table 4 illustrates the complementarity of the nucleotide sequences of RNF137 BINDING SITE, designated SEQ ID:8861, to the nucleotide sequence of GAM2071 RNA, herein designated GAM RNA, also designated SEQ ID:371.

Another function of GAM2071 is therefore inhibition of RNF137 (Accession NP_060543.4). Accordingly, utilities of GAM2071 include diagnosis, prevention and treatment of diseases and clinical conditions associated with RNF137.

Ring finger protein 19 (RNF19, Accession NP_056250.2) is another GAM2071 target gene, herein designated TARGET GENE. RNF19 BINDING SITE is a target binding site found in the 5' untranslated region of mRNA encoded by RNF19, corresponding to a target binding site such as BINDING SITE I, BINDING SITE II or BINDING SITE III of FIG. 8. Table 4 illustrates the complementarity of the nucleotide sequences of RNF19 BINDING SITE, designated SEQ ID:14309, to the nucleotide sequence of GAM2071 RNA, herein designated GAM RNA, also designated SEQ ID:371.

Another function of GAM2071 is therefore inhibition of Ring finger protein 19 (RNF19, Accession NP_056250.2). Accordingly, utilities of GAM2071 include diagnosis, prevention and treatment of diseases and clinical conditions associated with RNF19.

RPP30 (Accession NP_006404.1) is another GAM2071 target gene, herein designated TARGET GENE. RPP30 BINDING SITE is a target binding site found in the 3' untranslated region of mRNA encoded by RPP30, corresponding to a target binding site such as BINDING SITE I, BINDING SITE II or BINDING SITE III of FIG. 8. Table 4 illustrates the complementarity of the nucleotide sequences of RPP30 BINDING SITE, designated SEQ ID:3259, to the nucleotide sequence of GAM2071 RNA, herein designated GAM RNA, also designated SEQ ID:371.

Another function of GAM2071 is therefore inhibition of RPP30 (Accession NP_006404.1), a gene which is a component of ribonuclease p that processes 5' ends of precursor tRNAs. Accordingly, utilities of GAM2071 include diagnosis, prevention and treatment of diseases and clinical conditions associated with RPP30.

The function of RPP30 and its association with various diseases and clinical conditions, has been established by previous studies, as described hereinabove with reference to GAM136.1. S100A15 (Accession NP_789793.1) is another GAM2071 target gene, herein designated TARGET GENE. S100A15 BINDING SITE is a target binding site found in the 3' untranslated region of mRNA encoded by S100A15, corresponding to a target binding site such as BINDING SITE I, BINDING SITE II or BINDING SITE III of FIG. 8. Table 4 illustrates the complementarity of the nucleotide sequences of S100A15 BINDING SITE, designated SEQ ID:18561, to the nucleotide sequence of GAM2071 RNA, herein designated GAM RNA, also designated SEQ ID:371.

Another function of GAM2071 is therefore inhibition of S100A15 (Accession NP_789793.1). Accordingly, utilities of GAM2071 include diagnosis, prevention and treatment of diseases and clinical conditions associated with S100A15.

SBLF (Accession NP_006864.2) is another GAM2071 target gene, herein designated TARGET GENE. SBLF BINDING SITE is a target binding site found in the 3' untranslated region of mRNA encoded by SBLF, corresponding to a target binding site such as BINDING SITE I, BINDING SITE II or BINDING SITE III of FIG. 8. Table 4 illustrates the complementarity of the nucleotide sequences of SBLF BINDING SITE, designated SEQ ID:14250, to the nucleotide sequence of GAM2071 RNA, herein designated GAM RNA, also designated SEQ ID:371.

Another function of GAM2071 is therefore inhibition of SBLF (Accession NP_006864.2). Accordingly, utilities of GAM2071 include diagnosis, prevention and treatment of diseases and clinical conditions associated with SBLF.

SCAMP-4 (Accession NP_524558.1) is another GAM2071 target gene, herein designated TARGET GENE. SCAMP-4 BINDING SITE is a target binding site found in the 3' untranslated region of mRNA encoded by SCAMP-4, corresponding to a target binding site such as BINDING SITE I, BINDING SITE II or BINDING SITE III of FIG. 8. Table 4 illustrates the complementarity of the nucleotide sequences of SCAMP-4 BINDING SITE, designated SEQ ID:19434, to the nucleotide sequence of GAM2071 RNA, herein designated GAM RNA, also designated SEQ ID:371.

Another function of GAM2071 is therefore inhibition of SCAMP-4 (Accession NP_524558.1). Accordingly, utilities of GAM2071 include diagnosis, prevention and treatment of diseases and clinical conditions associated with SCAMP-4.

Scan domain containing 2 (SCAND2, Accession NP_071333.2) is another GAM2071 target gene, herein designated TARGET GENE. SCAND2 BINDING SITE is a target binding site found in the 3' untranslated region of multiple transcripts of mRNA encoded by SCAND2, corresponding to a target binding site such as BINDING SITE I, BINDING SITE II or BINDING SITE III of FIG. 8. Table 4 illustrates the complementarity of the nucleotide sequences of SCAND2 BINDING SITE, designated SEQ ID:16790, to the nucleotide sequence of GAM2071 RNA, herein designated GAM RNA, also designated SEQ ID:371.

Another function of GAM2071 is therefore inhibition of Scan domain containing 2 (SCAND2, Accession NP_071333.2). Accordingly, utilities of GAM2071 include diagnosis, prevention and treatment of diseases and clinical conditions associated with SCAND2.

Scavenger receptor class f, member 1 (SCARF1, Accession NP_003684.1) is another GAM2071 target gene, herein designated TARGET GENE. SCARF1 BINDING SITE is a target binding site found in the 3' untranslated region of mRNA encoded by SCARF1, corresponding to a target binding site such as BINDING SITE I, BINDING SITE II or BINDING SITE III of FIG. 8. Table 4 illustrates the complementarity of the nucleotide sequences of SCARF1 BINDING SITE, designated SEQ ID:12384, to the nucleotide sequence of GAM2071 RNA, herein designated GAM RNA, also designated SEQ ID:371.

Another function of GAM2071 is therefore inhibition of Scavenger receptor class f, member 1 (SCARF1, Accession NP_003684.1). Accordingly, utilities of GAM2071 include diagnosis, prevention and treatment of diseases and clinical conditions associated with SCARF1.

SCN3B (Accession NP_060870.1) is another GAM2071 target gene, herein designated TARGET GENE. SCN3B BINDING SITE1 and SCN3B BINDING SITE2 are target binding sites found in untranslated regions of mRNA encoded by SCN3B, corresponding to target binding sites such as BINDING SITE I, BINDING SITE II or BINDING SITE III of FIG. 8. Table 4 illustrates the complementarity of the nucleotide sequences of SCN3B BINDING SITE1 and SCN3B BINDING SITE2, designated SEQ ID:1471 and SEQ ID:9932 respectively, to the nucleotide sequence of GAM2071 RNA, herein designated GAM RNA, also designated SEQ ID:371.

Another function of GAM2071 is therefore inhibition of SCN3B (Accession NP_060870.1). Accordingly, utilities of GAM2071 include diagnosis, prevention and treatment of diseases and clinical conditions associated with SCN3B.

Stromal cell-derived factor 2 (SDF2, Accession NP_008854.2) is another GAM2071 target gene, herein designated TARGET GENE. SDF2 BINDING SITE is a target binding site found in the 3' untranslated region of mRNA encoded by SDF2, corresponding to a target binding site such as BINDING SITE I, BINDING SITE II or BINDING SITE III of FIG. 8. Table 4 illustrates the complementarity of the nucleotide sequences of SDF2 BINDING SITE, designated SEQ ID:4852, to the nucleotide sequence of GAM2071 RNA, herein designated GAM RNA, also designated SEQ ID:371.

Another function of GAM2071 is therefore inhibition of Stromal cell-derived factor 2 (SDF2, Accession NP_008854.2). Accordingly, utilities of GAM2071 include diagnosis, prevention and treatment of diseases and clinical conditions associated with SDF2.

SDS-RS1 (Accession NP_612441.1) is another GAM2071 target gene, herein designated TARGET GENE. SDS-RS1 BINDING SITE is a target binding site found in the 5' untranslated region of mRNA encoded by SDS-RS1, corresponding to a target binding site such as BINDING SITE I, BINDING SITE II or BINDING SITE III of FIG. 8. Table 4 illustrates the complementarity of the nucleotide sequences of SDS-RS1 BINDING SITE, designated SEQ ID:2100, to the nucleotide sequence of GAM2071 RNA, herein designated GAM RNA, also designated SEQ ID:371.

Another function of GAM2071 is therefore inhibition of SDS-RS1 (Accession NP_612441.1). Accordingly, utilities of GAM2071 include diagnosis, prevention and treatment of diseases and clinical conditions associated with SDS-RS1.

Secreted and transmembrane 1 (SECTM1, Accession NP_002995.1) is another GAM2071 target gene, herein designated TARGET GENE. SECTM1 BINDING SITE is a target binding site found in the 3' untranslated region of mRNA encoded by SECTM1, corresponding to a target binding site such as BINDING SITE I, BINDING SITE II or BINDING SITE III of FIG. 8. Table 4 illustrates the complementarity of the nucleotide sequences of SECTM1 BINDING SITE, designated SEQ ID:14404, to the nucleotide sequence of GAM2071 RNA, herein designated GAM RNA, also designated SEQ ID:371.

Another function of GAM2071 is therefore inhibition of Secreted and transmembrane 1 (SECTM1, Accession NP_002995.1). Accordingly, utilities of GAM2071 include diagnosis, prevention and treatment of diseases and clinical conditions associated with SECTM1.

Spondyloepiphyseal dysplasia, late (SEDL, Accession NP_055378.1) is another GAM2071 target gene, herein designated TARGET GENE. SEDL BINDING SITE1 through SEDL BINDING SITE3 are target binding sites found in untranslated regions of mRNA encoded by SEDL, corresponding to target binding sites such as BINDING SITE I, BINDING SITE II or BINDING SITE III of FIG. 8. Table 4 illustrates the complementarity of the nucleotide sequences of SEDL BINDING SITE1 through SEDL BINDING SITE3, designated SEQ ID:7261, SEQ ID:13400 and SEQ ID:16842 respectively, to the nucleotide sequence of GAM2071 RNA, herein designated GAM RNA, also designated SEQ ID:371.

Another function of GAM2071 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM2071 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. Sel-1 suppressor of lin-12-like (c. elegans) (SEL1L, Accession NP_005056.3) is another GAM2071 target gene, herein designated TARGET GENE. SEL1L BINDING SITE is a target binding site found in the 3' untranslated region of mRNA encoded by SEL1L, corresponding to a target binding site such as BINDING SITE I, BINDING SITE II or BINDING SITE III of FIG. 8. Table 4 illustrates the complementarity of the nucleotide sequences of SEL1L BINDING SITE, designated SEQ ID:16250, to the nucleotide sequence of GAM2071 RNA, herein designated GAM RNA, also designated SEQ ID:371.

Another function of GAM2071 is therefore inhibition of Sel-1 suppressor of lin-12-like (c. elegans) (SEL1L, Accession NP_005056.3), a gene which may play a role in notch signaling (by similarity). Accordingly, utilities of GAM2071 include diagnosis, prevention and treatment of diseases and clinical conditions associated with SEL1L.

The function of SEL1L and its association with various diseases and clinical conditions, has been established by previous studies, as described hereinabove with reference to GAM193.1. Selenoprotein n, 1 (SEPN1, Accession NP_065184.1) is another GAM2071 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:1799, to the nucleotide sequence of GAM2071 RNA, herein designated GAM RNA, also designated SEQ ID:371.

Another function of GAM2071 is therefore inhibition of Selenoprotein n, 1 (SEPN1, Accession NP_065184.1). Accordingly, utilities of GAM2071 include diagnosis, prevention and treatment of diseases and clinical conditions associated with SEPN1.

Small edrk-rich factor 1a (telomeric) (SERF1A, Accession NP_068802.1) is another GAM2071 target gene, herein designated TARGET GENE. SERF1A BINDING SITE is a target binding site found in the 3' untranslated region of mRNA encoded by SERF1A, corresponding to a target binding site such as BINDING SITE I, BINDING SITE II or BINDING SITE III of FIG. 8. Table 4 illustrates the complementarity of the nucleotide sequences of SERF1A BINDING SITE, designated SEQ ID:11123, to the nucleotide sequence of GAM2071 RNA, herein designated GAM RNA, also designated SEQ ID:371.

Another function of GAM2071 is therefore inhibition of Small edrk-rich factor 1a (telomeric) (SERF1A, Accession NP_068802.1). Accordingly, utilities of GAM2071 include diagnosis, prevention and treatment of diseases and clinical conditions associated with SERF1A.

Small edrk-rich factor 1b (centromeric) (SERF1B, Accession NP_075267.1) is another GAM2071 target gene, herein designated TARGET GENE. SERF1B BINDING SITE is a target binding site found in the 3' untranslated region of mRNA encoded by SERF1B, corresponding to a target binding site such as BINDING SITE I, BINDING SITE II or BINDING SITE III of FIG. 8. Table 4 illustrates the complementarity of the nucleotide sequences of SERF1B BINDING SITE, designated SEQ ID:11123, to the nucleotide sequence of GAM2071 RNA, herein designated GAM RNA, also designated SEQ ID:371.

Another function of GAM2071 is therefore inhibition of Small edrk-rich factor 1b (centromeric) (SERF1B, Accession NP_075267.1). Accordingly, utilities of GAM2071 include diagnosis, prevention and treatment of diseases and clinical conditions associated with SERF1B.

Serine (or cysteine) proteinase inhibitor, clade b (ovalbumin), member 9 (SERPINB9, Accession NP_004146.1) is another GAM2071 target gene, herein designated TARGET GENE. SERPINB9 BINDING SITE1 and SERPINB9 BINDING SITE2 are target binding sites found in untranslated regions of mRNA encoded by SERPINB9, corresponding to target binding sites such as BINDING SITE I, BINDING SITE II or BINDING SITE III of FIG. 8. Table 4 illustrates the complementarity of the nucleotide sequences of SERPINB9 BINDING SITE1 and SERPINB9 BINDING SITE2, designated SEQ ID:437 and SEQ ID:4057 respectively, to the nucleotide sequence of GAM2071 RNA, herein designated GAM RNA, also designated SEQ ID:371.

Another function of GAM2071 is therefore inhibition of Serine (or cysteine) proteinase inhibitor, clade b (ovalbumin), member 9 (SERPINB9, Accession NP_004146.1), a gene which may be a serpin serine protease inhibitor that interacts with granzyme B (GZMB). Accordingly, utilities of GAM2071 include diagnosis, prevention and treatment of diseases and clinical conditions associated with SERPINB9.

The function of SERPINB9 and its association with various diseases and clinical conditions, has been established by previous studies, as described hereinabove with reference to GAM88.2. Sh3-domain binding protein 2 (SH3BP2, Accession NP_003014.2) is another GAM2071 target gene, herein designated TARGET GENE. SH3BP2 BINDING SITE1 and SH3BP2 BINDING SITE2 are target binding sites found in untranslated regions of mRNA encoded by SH3BP2, corresponding to target binding sites such as BINDING SITE I, BINDING SITE II or BINDING SITE III of FIG. 8. Table 4 illustrates the complementarity of the nucleotide sequences of SH3BP2 BINDING SITE1 and SH3BP2 BINDING SITE2, designated SEQ ID:18716 and SEQ ID:12957 respectively, to the nucleotide sequence of GAM2071 RNA, herein designated GAM RNA, also designated SEQ ID:371.

Another function of GAM2071 is therefore inhibition of Sh3-domain binding protein 2 (SH3BP2, Accession NP_003014.2). Accordingly, utilities of GAM2071 include diagnosis, prevention and treatment of diseases and clinical conditions associated with SH3BP2.

Sialic acid binding ig-like lectin 8 (SIGLEC8, Accession NP_055257.1) is another GAM2071 target gene, herein designated TARGET GENE. SIGLEC8 BINDING SITE is a target binding site found in the 3' untranslated region of mRNA encoded by SIGLEC8, corresponding to a target binding site such as BINDING SITE I, BINDING SITE II or BINDING SITE III of FIG. 8. Table 4 illustrates the complementarity of the nucleotide sequences of SIGLEC8 BINDING SITE, designated SEQ ID:3441, to the nucleotide sequence of GAM2071 RNA, herein designated GAM RNA, also designated SEQ ID:371.

Another function of GAM2071 is therefore inhibition of Sialic acid binding ig-like lectin 8 (SIGLEC8, Accession NP_055257.1), a gene which is a cell adhesion molecule for postnatal neural development. Accordingly, utilities of GAM2071 include diagnosis, prevention and treatment of diseases and clinical conditions associated with SIGLEC8.

The function of SIGLEC8 and its association with various diseases and clinical conditions, has been established by previous studies, as described hereinabove with reference to GAM63.1. Solute carrier family 12 (potassium/chloride transporters), member 8 (SLC12A8, Accession NP_078904.1) is another GAM2071 target gene, herein designated TARGET GENE. SLC12A8 BINDING SITE is a target binding site found in the 3' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:18425, to the nucleotide sequence of GAM2071 RNA, herein designated GAM RNA, also designated SEQ ID:371.

Another function of GAM2071 is therefore inhibition of Solute carrier family 12 (potassium/chloride transporters), member 8 (SLC12A8, Accession NP_078904.1). Accordingly, utilities of GAM2071 include diagnosis, prevention and treatment of diseases and clinical conditions associated with SLC12A8.

Solute carrier family 13 (sodium/sulfate symporters), member 1 (SLC13A1, Accession NP_071889.2) is another GAM2071 target gene, herein designated TARGET GENE. SLC13A1 BINDING SITE is a target binding site found in the 3' untranslated region of mRNA encoded by SLC13A1, corresponding to a target binding site such as BINDING SITE I, BINDING SITE II or BINDING SITE III of FIG. 8. Table 4 illustrates the complementarity of the nucleotide sequences of SLC13A1 BINDING SITE, designated SEQ ID:15679, to the nucleotide sequence of GAM2071 RNA, herein designated GAM RNA, also designated SEQ ID:371.

Another function of GAM2071 is therefore inhibition of Solute carrier family 13 (sodium/sulfate symporters), member 1 (SLC13A1, Accession NP_071889.2). Accordingly, utilities of GAM2071 include diagnosis, prevention and treatment of diseases and clinical conditions associated with SLC13A1.

Solute carrier family 14 (urea transporter), member 2 (SLC14A2, Accession NP_009094.2) is another GAM2071 target gene, herein designated TARGET GENE. SLC14A2 BINDING SITE is a target binding site found in the 5' untranslated region of mRNA encoded by SLC14A2, corresponding to a target binding site such as BINDING SITE I, BINDING SITE II or BINDING SITE III of FIG. 8. Table 4 illustrates the complementarity of the nucleotide sequences of SLC14A2 BINDING SITE, designated SEQ ID:18700, to the nucleotide sequence of GAM2071 RNA, herein designated GAM RNA, also designated SEQ ID:371.

Another function of GAM2071 is therefore inhibition of Solute carrier family 14 (urea transporter), member 2 (SLC14A2, Accession NP_009094.2), a gene which is a renal urea transporter 2. and therefore may be associated with Orthostatic hypotension. Accordingly, utilities of GAM2071 include diagnosis, prevention and treatment of Orthostatic hypotension, and of other diseases and clinical conditions associated with SLC14A2.

The function of SLC14A2 and its association with various diseases and clinical conditions, has been established by previous studies, as described hereinabove with reference to GAM97.1. Solute carrier family 16 (monocarboxylic acid transporters), member 4 (SLC16A4, Accession NP_004687.1) is another GAM2071 target gene, herein designated TARGET GENE. SLC16A4 BINDING SITE is a target binding site found in the 3' untranslated region of mRNA encoded by SLC16A4, corresponding to a target binding site such as BINDING SITE I, BINDING SITE II or BINDING SITE III of FIG. 8. Table 4 illustrates the complementarity of the nucleotide sequences of SLC16A4 BINDING SITE, designated SEQ ID:20157, to the nucleotide sequence of GAM2071 RNA, herein designated GAM RNA, also designated SEQ ID:371.

Another function of GAM2071 is therefore inhibition of Solute carrier family 16 (monocarboxylic acid transporters), member 4 (SLC16A4, Accession NP_004687.1). Accordingly, utilities of GAM2071 include diagnosis, prevention and treatment of diseases and clinical conditions associated with SLC16A4.

Solute carrier family 16 (monocarboxylic acid transporters), member 6 (SLC16A6, Accession NP_004685.1) is another GAM2071 target gene, herein designated TARGET GENE. SLC16A6 BINDING SITE is a target binding site found in the 5' untranslated region of mRNA encoded by SLC16A6, corresponding to a target binding site such as BINDING SITE I, BINDING SITE II or BINDING SITE III of FIG. 8. Table 4 illustrates the complementarity of the nucleotide sequences of SLC16A6 BINDING SITE, designated SEQ ID:517, to the nucleotide sequence of GAM2071 RNA, herein designated GAM RNA, also designated SEQ ID:371.

Another function of GAM2071 is therefore inhibition of Solute carrier family 16 (monocarboxylic acid transporters), member 6 (SLC16A6, Accession NP_004685.1). Accordingly, utilities of GAM2071 include diagnosis, prevention and treatment of diseases and clinical conditions associated with SLC16A6.

Solute carrier family 25 (mitochondrial carrier; citrate transporter), member 1 (SLC25A1, Accession NP_005975.1) is another GAM2071 target gene, herein designated TARGET GENE. SLC25A1 BINDING SITE is a target binding site found in the 3' untranslated region of mRNA encoded by SLC25A1, corresponding to a target binding site such as BINDING SITE I, BINDING SITE II or BINDING SITE III of FIG. 8. Table 4 illustrates the complementarity of the nucleotide sequences of SLC25A1 BINDING SITE, designated SEQ ID:18982, to the nucleotide sequence of GAM2071 RNA, herein designated GAM RNA, also designated SEQ ID:371.

Another function of GAM2071 is therefore inhibition of Solute carrier family 25 (mitochondrial carrier; citrate transporter), member 1 (SLC25A1, Accession NP_005975.1). Accordingly, utilities of GAM2071 include diagnosis, prevention and treatment of diseases and clinical conditions associated with SLC25A1.

SLC30A5 (Accession NP_076960.1) is another GAM2071 target gene, herein designated TARGET GENE.

SLC30A5 BINDING SITE is a target binding site found in the 3' untranslated region of multiple transcripts of mRNA encoded by SLC30A5, corresponding to a target binding site such as BINDING SITE I, BINDING SITE II or BINDING SITE III of FIG. 8. Table 4 illustrates the complementarity of the nucleotide sequences of SLC30A5 BINDING SITE, designated SEQ ID:1341, to the nucleotide sequence of GAM2071 RNA, herein designated GAM RNA, also designated SEQ ID:371.

Another function of GAM2071 is therefore inhibition of SLC30A5 (Accession NP_076960.1). Accordingly, utilities of GAM2071 include diagnosis, prevention and treatment of diseases and clinical conditions associated with SLC30A5.

SLC35B2 (Accession NP_835361.1) is another GAM2071 target gene, herein designated TARGET GENE. SLC35B2 BINDING SITE is a target binding site found in the 3' untranslated region of multiple transcripts of mRNA encoded by SLC35B2, corresponding to a target binding site such as BINDING SITE I, BINDING SITE II or BINDING SITE III of FIG. 8. Table 4 illustrates the complementarity of the nucleotide sequences of SLC35B2 BINDING SITE, designated SEQ ID:17255, to the nucleotide sequence of GAM2071 RNA, herein designated GAM RNA, also designated SEQ ID:371.

Another function of GAM2071 is therefore inhibition of SLC35B2 (Accession NP_835361.1). Accordingly, utilities of GAM2071 include diagnosis, prevention and treatment of diseases and clinical conditions associated with SLC35B2.

SLC35B2 (Accession XP_300918.1) is another GAM2071 target gene, herein designated TARGET GENE. SLC35B2 BINDING SITE is a target binding site found in the 3' untranslated region of multiple transcripts of mRNA encoded by SLC35B2, corresponding to a target binding site such as BINDING SITE I, BINDING SITE II or BINDING SITE III of FIG. 8. Table 4 illustrates the complementarity of the nucleotide sequences of SLC35B2 BINDING SITE, designated SEQ ID:17255, to the nucleotide sequence of GAM2071 RNA, herein designated GAM RNA, also designated SEQ ID:371.

Another function of GAM2071 is therefore inhibition of SLC35B2 (Accession XP_300918.1). Accordingly, utilities of GAM2071 include diagnosis, prevention and treatment of diseases and clinical conditions associated with SLC35B2.

SLC35E2 (Accession XP_049733.6) is another GAM2071 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:12300, to the nucleotide sequence of GAM2071 RNA, herein designated GAM RNA, also designated SEQ ID:371.

Another function of GAM2071 is therefore inhibition of SLC35E2 (Accession XP_049733.6). Accordingly, utilities of GAM2071 include diagnosis, prevention and treatment of diseases and clinical conditions associated with SLC35E2.

Solute carrier family 39 (zinc transporter), member 1 (SLC39A1, Accession NP_055252.2) is another GAM2071 target gene, herein designated TARGET GENE. SLC39A1 BINDING SITE is a target binding site found in the 5' untranslated region of mRNA encoded by SLC39A1, corresponding to a target binding site such as BINDING SITE I, BINDING SITE II or BINDING SITE III of FIG. 8. Table 4 illustrates the complementarity of the nucleotide sequences of SLC39A1 BINDING SITE, designated SEQ ID:19430, to the nucleotide sequence of GAM2071 RNA, herein designated GAM RNA, also designated SEQ ID:371.

Another function of GAM2071 is therefore inhibition of Solute carrier family 39 (zinc transporter), member 1 (SLC39A1, Accession NP_055252.2), a gene which is a divalent (zinc/iron) metal ion transporter. Accordingly, utilities of GAM2071 include diagnosis, prevention and treatment of diseases and clinical conditions associated with SLC39A1.

The function of SLC39A1 and its association with various diseases and clinical conditions, has been established by previous studies, as described hereinabove with reference to GAM175.1. Solute carrier family 4, sodium bicarbonate cotransporter, member 4 (SLC4A4, Accession NP_003750.1) is another GAM2071 target gene, herein designated TARGET GENE. SLC4A4 BINDING SITE is a target binding site found in the 5' untranslated region of mRNA encoded by SLC4A4, corresponding to a target binding site such as BINDING SITE I, BINDING SITE II or BINDING SITE III of FIG. 8. Table 4 illustrates the complementarity of the nucleotide sequences of SLC4A4 BINDING SITE, designated SEQ ID:13075, to the nucleotide sequence of GAM2071 RNA, herein designated GAM RNA, also designated SEQ ID:371.

Another function of GAM2071 is therefore inhibition of Solute carrier family 4, sodium bicarbonate cotransporter, member 4 (SLC4A4, Accession NP_003750.1), a gene which is a sodium bicarbonate cotransporter and therefore may be associated with Proximal renal tubular acidosis, mental retardation, and bilateral glaucoma, cataracts, and band keratopathy. Accordingly, utilities of GAM2071 include diagnosis, prevention and treatment of Proximal renal tubular acidosis, mental retardation, and bilateral glaucoma, cataracts, and band keratopathy, and of other diseases and clinical conditions associated with SLC4A4.

The function of SLC4A4 and its association with various diseases and clinical conditions, has been established by previous studies, as described hereinabove with reference to GAM96.1. Solute carrier family 6 (neurotransmitter transporter), member 14 (SLC6A14, Accession NP_009162.1) is another GAM2071 target gene, herein designated TARGET GENE. SLC6A14 BINDING SITE is a target binding site found in the 3' untranslated region of mRNA encoded by SLC6A14, corresponding to a target binding site such as BINDING SITE I, BINDING SITE II or BINDING SITE III of FIG. 8. Table 4 illustrates the complementarity of the nucleotide sequences of SLC6A14 BINDING SITE, designated SEQ ID:16741, to the nucleotide sequence of GAM2071 RNA, herein designated GAM RNA, also designated SEQ ID:371.

Another function of GAM2071 is therefore inhibition of Solute carrier family 6 (neurotransmitter transporter), member 14 (SLC6A14, Accession NP_009162.1). Accordingly, utilities of GAM2071 include diagnosis, prevention and treatment of diseases and clinical conditions associated with SLC6A14.

SMAC (Accession NP_620308.1) is another GAM2071 target gene, herein designated TARGET GENE. SMAC BINDING SITE1 and SMAC BINDING SITE2 are target binding sites found in untranslated regions of multiple transcripts of mRNA encoded by SMAC, corresponding to target binding sites such as BINDING SITE I, BINDING SITE II or BINDING SITE III of FIG. 8. Table 4 illustrates the complementarity of the nucleotide sequences of SMAC BINDING SITE1 and SMAC BINDING SITE2, designated SEQ ID:1245 and SEQ ID:15275 respectively, to the nucleotide sequence of GAM2071 RNA, herein designated GAM RNA, also designated SEQ ID:371.

Another function of GAM2071 is therefore inhibition of SMAC (Accession NP_620308.1), a gene which promotes apoptosis via caspase activation. Accordingly, utilities of GAM2071 include diagnosis, prevention and treatment of diseases and clinical conditions associated with SMAC.

The function of SMAC and its association with various diseases and clinical conditions, has been established by previous studies, as described hereinabove with reference to GAM136.1. Synaptosomal-associated protein, 25 kda (SNAP25, Accession NP_570824.1) is another GAM2071 target gene, herein designated TARGET GENE. SNAP25 BINDING SITE is a target binding site found in the 3' untranslated region of multiple transcripts of mRNA encoded by SNAP25, corresponding to a target binding site such as BINDING SITE I, BINDING SITE II or BINDING SITE III of FIG. 8. Table 4 illustrates the complementarity of the nucleotide sequences of SNAP25 BINDING SITE, designated SEQ ID:8525, to the nucleotide sequence of GAM2071 RNA, herein designated GAM RNA, also designated SEQ ID:371.

Another function of GAM2071 is therefore inhibition of Synaptosomal-associated protein, 25 kda (SNAP25, Accession NP_570824.1). Accordingly, utilities of GAM2071 include diagnosis, prevention and treatment of diseases and clinical conditions associated with SNAP25.

Synaptosomal-associated protein, 25 kda (SNAP25, Accession NP_003072.2) is another GAM2071 target gene, herein designated TARGET GENE. SNAP25 BINDING SITE is a target binding site found in the 3' untranslated region of multiple transcripts of mRNA encoded by SNAP25, corresponding to a target binding site such as BINDING SITE I, BINDING SITE II or BINDING SITE III of FIG. 8. Table 4 illustrates the complementarity of the nucleotide sequences of SNAP25 BINDING SITE, designated SEQ ID:8525, to the nucleotide sequence of GAM2071 RNA, herein designated GAM RNA, also designated SEQ ID:371.

Another function of GAM2071 is therefore inhibition of Synaptosomal-associated protein, 25 kda (SNAP25, Accession NP_003072.2). Accordingly, utilities of GAM2071 include diagnosis, prevention and treatment of diseases and clinical conditions associated with SNAP25.

Syntaphilin (SNPH, Accession NP_055538.1) is another GAM2071 target gene, herein designated TARGET GENE. SNPH BINDING SITE is a target binding site found in the 3' untranslated region of mRNA encoded by SNPH, corresponding to a target binding site such as BINDING SITE I, BINDING SITE II or BINDING SITE III of FIG. 8. Table 4 illustrates the complementarity of the nucleotide sequences of SNPH BINDING SITE, designated SEQ ID:1354, to the nucleotide sequence of GAM2071 RNA, herein designated GAM RNA, also designated SEQ ID:371.

Another function of GAM2071 is therefore inhibition of Syntaphilin (SNPH, Accession NP_055538.1). Accordingly, utilities of GAM2071 include diagnosis, prevention and treatment of diseases and clinical conditions associated with SNPH.

Sorting nexin 15 (SNX15, Accession NP_680086.1) is another GAM2071 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:2728, to the nucleotide sequence of GAM2071 RNA, herein designated GAM RNA, also designated SEQ ID:371.

Another function of GAM2071 is therefore inhibition of Sorting nexin 15 (SNX15, Accession NP_680086.1). Accordingly, utilities of GAM2071 include diagnosis, prevention and treatment of diseases and clinical conditions associated with SNX15.

Sorting nexin 15 (SNX15, Accession NP_037438.2) is another GAM2071 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:2728, to the nucleotide sequence of GAM2071 RNA, herein designated GAM RNA, also designated SEQ ID:371.

Another function of GAM2071 is therefore inhibition of Sorting nexin 15 (SNX15, Accession NP_037438.2). Accordingly, utilities of GAM2071 include diagnosis, prevention and treatment of diseases and clinical conditions associated with SNX15.

SNX27 (Accession NP_112180.4) is another GAM2071 target gene, herein designated TARGET GENE. SNX27 BINDING SITE1 and SNX27 BINDING SITE2 are target binding sites found in untranslated regions of mRNA encoded by SNX27, corresponding to target binding sites such as BINDING SITE I, BINDING SITE II or BINDING SITE III of FIG. 8. Table 4 illustrates the complementarity of the nucleotide sequences of SNX27 BINDING SITE1 and SNX27 BINDING SITE2, designated SEQ ID:8857 and SEQ ID:1972 respectively, to the nucleotide sequence of GAM2071 RNA, herein designated GAM RNA, also designated SEQ ID:371.

Another function of GAM2071 is therefore inhibition of SNX27 (Accession NP_112180.4). Accordingly, utilities of GAM2071 include diagnosis, prevention and treatment of diseases and clinical conditions associated with SNX27.

Sry (sex determining region y)-box 8 (SOX8, Accession NP_055402.2) is another GAM2071 target gene, herein designated TARGET GENE. SOX8 BINDING SITE is a target binding site found in the 3' untranslated region of mRNA encoded by SOX8, corresponding to a target binding site such as BINDING SITE I, BINDING SITE II or BINDING SITE III of FIG. 8. Table 4 illustrates the complementarity of the nucleotide sequences of SOX8 BINDING SITE, designated SEQ ID:12214, to the nucleotide sequence of GAM2071 RNA, herein designated GAM RNA, also designated SEQ ID:371.

Another function of GAM2071 is therefore inhibition of Sry (sex determining region y)-box 8 (SOX8, Accession NP_055402.2), a gene which binds the consensus motif 5'-[at][at]caa[at]g-3'. Accordingly, utilities of GAM2071 include diagnosis, prevention and treatment of diseases and clinical conditions associated with SOX8.

The function of SOX8 and its association with various diseases and clinical conditions, has been established by previous studies, as described hereinabove with reference to GAM842.1. Sialophorin (gpl115, leukosialin, cd43) (SPN, Accession NP_003114.1) is another GAM2071 target gene, herein designated TARGET GENE. SPN BINDING SITE is a target binding site found in the 3' untranslated region of mRNA encoded by SPN, corresponding to a target binding site such as BINDING SITE I, BINDING SITE II or BINDING SITE III of FIG. 8. Table 4 illustrates the complementarity of the nucleotide sequences of SPN BINDING SITE, designated SEQ ID:19300, to the nucleotide sequence of GAM2071 RNA, herein designated GAM RNA, also designated SEQ ID:371.

Another function of GAM2071 is therefore inhibition of Sialophorin (gpl115, leukosialin, cd43) (SPN, Accession NP_003114.1), a gene which plays a role in the physico-chemical properties of the t-cell surface and in lectin binding. presents carbohydrate ligands to selectins. . and therefore may be associated with Wiskott-aldrich syndrome. Accordingly, utilities of GAM2071 include diagnosis, prevention and treatment of Wiskott-aldrich syndrome, and of other diseases and clinical conditions associated with SPN.

The function of SPN and its association with various diseases and clinical conditions, has been established by previous studies, as described hereinabove with reference to GAM130.1. Speckle-type poz protein (SPOP, Accession NP_003554.1) is another GAM2071 target gene, herein designated TARGET GENE. SPOP BINDING SITE is a target binding site found in the 5' untranslated region of mRNA encoded by SPOP, corresponding to a target binding site such as BINDING SITE I, BINDING SITE II or BINDING SITE III of FIG. 8. Table 4 illustrates the complementarity of the nucleotide sequences of SPOP BINDING SITE, designated SEQ ID:7212, to the nucleotide sequence of GAM2071 RNA, herein designated GAM RNA, also designated SEQ ID:371.

Another function of GAM2071 is therefore inhibition of Speckle-type poz protein (SPOP, Accession NP_003554.1). Accordingly, utilities of GAM2071 include diagnosis, prevention and treatment of diseases and clinical conditions associated with SPOP.

Scavenger receptor cysteine rich domain containing, group b (4 domains) (SRCRB4D, Accession NP_542782.1) is another GAM2071 target gene, herein designated TARGET GENE. SRCRB4D BINDING SITE is a target binding site found in the 3' untranslated region of mRNA encoded by SRCRB4D, corresponding to a target binding site such as BINDING SITE I, BINDING SITE II or BINDING SITE III of FIG. 8. Table 4 illustrates the complementarity of the nucleotide sequences of SRCRB4D BINDING SITE, designated SEQ ID:19630, to the nucleotide sequence of GAM2071 RNA, herein designated GAM RNA, also designated SEQ ID:371.

Another function of GAM2071 is therefore inhibition of Scavenger receptor cysteine rich domain containing, group b (4 domains) (SRCRB4D, Accession NP_542782.1). Accordingly, utilities of GAM2071 include diagnosis, prevention and treatment of diseases and clinical conditions associated with SRCRB4D.

Sarcalumenin (SRL, Accession XP_064152.3) is another GAM2071 target gene, herein designated TARGET GENE. SRL BINDING SITE is a target binding site found in the 3' untranslated region of mRNA encoded by SRL, corresponding to a target binding site such as BINDING SITE I, BINDING SITE II or BINDING SITE III of FIG. 8. Table 4 illustrates the complementarity of the nucleotide sequences of SRL BINDING SITE, designated SEQ ID:9910, to the nucleotide sequence of GAM2071 RNA, herein designated GAM RNA, also designated SEQ ID:371.

Another function of GAM2071 is therefore inhibition of Sarcalumenin (SRL, Accession XP_064152.3). Accordingly, utilities of GAM2071 include diagnosis, prevention and treatment of diseases and clinical conditions associated with SRL.

Synovial sarcoma translocation, chromosome 18 (SS18, Accession NP_005628.1) is another GAM2071 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:10975, to the nucleotide sequence of GAM2071 RNA, herein designated GAM RNA, also designated SEQ ID:371.

Another function of GAM2071 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM2071 include diagnosis, prevention and treatment of Human synovial sarcomas, and of other diseases and clinical conditions associated with SS18.

The function of SS18 and its association with various diseases and clinical conditions, has been established by previous studies, as described hereinabove with reference to GAM130.1. STAF65(gamma) (Accession NP_055675.1) is another GAM2071 target gene, herein designated TARGET GENE. STAF65(gamma) BINDING SITE is a target binding site found in the 3' untranslated region of mRNA encoded by STAF65(gamma), corresponding to a target binding site such as BINDING SITE I, BINDING SITE II or BINDING SITE III of FIG. 8. Table 4 illustrates the complementarity of the nucleotide sequences of STAF65(gamma) BINDING SITE, designated SEQ ID:6743, to the nucleotide sequence of GAM2071 RNA, herein designated GAM RNA, also designated SEQ ID:371.

Another function of GAM2071 is therefore inhibition of STAF65(gamma) (Accession NP_055675.1). Accordingly, utilities of GAM2071 include diagnosis, prevention and treatment of diseases and clinical conditions associated with STAF65(gamma).

Signal transducing adaptor molecule (sh3 domain and itam motif) 2 (STAM2, Accession NP_005834.3) is another GAM2071 target gene, herein designated TARGET GENE. STAM2 BINDING SITE is a target binding site found in the 3' untranslated region of mRNA encoded by STAM2, corresponding to a target binding site such as BINDING SITE I, BINDING SITE II or BINDING SITE III of FIG. 8. Table 4 illustrates the complementarity of the nucleotide sequences of STAM2 BINDING SITE, designated SEQ ID:5920, to the nucleotide sequence of GAM2071 RNA, herein designated GAM RNA, also designated SEQ ID:371.

Another function of GAM2071 is therefore inhibition of Signal transducing adaptor molecule (sh3 domain and itam motif) 2 (STAM2, Accession NP_005834.3). Accordingly, utilities of GAM2071 include diagnosis, prevention and treatment of diseases and clinical conditions associated with STAM2.

Staufen, rna binding protein (drosophila) (STAU, Accession NP_004593.1) is another GAM2071 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:9365, to the nucleotide sequence of GAM2071 RNA, herein designated GAM RNA, also designated SEQ ID:371.

Another function of GAM2071 is therefore inhibition of Staufen, rna binding protein (drosophila) (STAU, Accession NP_004593.1), a gene which may play a role in specific positioning of mrnas at given sites in the cell and in stimulating their translation at the site. Accordingly, utilities of GAM2071 include diagnosis, prevention and treatment of diseases and clinical conditions associated with STAU.

The function of STAU and its association with various diseases and clinical conditions, has been established by previous studies, as described hereinabove with reference to GAM37.1. Six transmembrane epithelial antigen of prostate 2 (STEAP2, Accession NP_694544.1) is another GAM2071 target gene, herein designated TARGET GENE. STEAP2 BINDING SITE is a target binding site found in the 3' untranslated region of mRNA encoded by STEAP2, corresponding to a target binding site such as BINDING SITE I, BINDING SITE II or BINDING SITE III of FIG. 8. Table 4 illustrates the complementarity of the nucleotide sequences of STEAP2 BINDING SITE, designated SEQ ID:1413, to the nucleotide sequence of GAM2071 RNA, herein designated GAM RNA, also designated SEQ ID:371.

Another function of GAM2071 is therefore inhibition of Six transmembrane epithelial antigen of prostate 2 (STEAP2, Accession NP_694544.1). Accordingly, utilities of GAM2071 include diagnosis, prevention and treatment of diseases and clinical conditions associated with STEAP2.

Syntaxin binding protein 6 (amisyn) (STXBP6, Accession NP_054897.4) is another GAM2071 target gene, herein designated TARGET GENE. STXBP6 BINDING SITE is a target binding site found in the 5' untranslated region of mRNA encoded by STXBP6, corresponding to a target binding site such as BINDING SITE I, BINDING SITE II or BINDING SITE III of FIG. 8. Table 4 illustrates the complementarity of the nucleotide sequences of STXBP6 BINDING SITE, designated SEQ ID:11916, to the nucleotide sequence of GAM2071 RNA, herein designated GAM RNA, also designated SEQ ID:371.

Another function of GAM2071 is therefore inhibition of Syntaxin binding protein 6 (amisyn) (STXBP6, Accession NP_054897.4). Accordingly, utilities of GAM2071 include diagnosis, prevention and treatment of diseases and clinical conditions associated with STXBP6.

Synaptotagmin xii (SYT12, Accession NP_808878.1) is another GAM2071 target gene, herein designated TARGET GENE. SYT12 BINDING SITE is a target binding site found in the 3' untranslated region of mRNA encoded by SYT12, corresponding to a target binding site such as BINDING SITE I, BINDING SITE II or BINDING SITE III of FIG. 8. Table 4 illustrates the complementarity of the nucleotide sequences of SYT12 BINDING SITE, designated SEQ ID:3730, to the nucleotide sequence of GAM2071 RNA, herein designated GAM RNA, also designated SEQ ID:371.

Another function of GAM2071 is therefore inhibition of Synaptotagmin xii (SYT12, Accession NP_808878.1). Accordingly, utilities of GAM2071 include diagnosis, prevention and treatment of diseases and clinical conditions associated with SYT12.

Synaptotagmin xiii (SYT13, Accession NP_065877.1) is another GAM2071 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:19065, to the nucleotide sequence of GAM2071 RNA, herein designated GAM RNA, also designated SEQ ID:371.

Another function of GAM2071 is therefore inhibition of Synaptotagmin xiii (SYT13, Accession NP_065877.1). Accordingly, utilities of GAM2071 include diagnosis, prevention and treatment of diseases and clinical conditions associated with SYT13.

TADA3L (Accession NP_597814.1) is another GAM2071 target gene, herein designated TARGET GENE. TADA3L BINDING SITE is a target binding site found in the 3' untranslated region of multiple transcripts of mRNA encoded by TADA3L, corresponding to a target binding site such as BINDING SITE I, BINDING SITE II or BINDING SITE III of FIG. 8. Table 4 illustrates the complementarity of the nucleotide sequences of TADA3L BINDING SITE, designated SEQ ID:10415, to the nucleotide sequence of GAM2071 RNA, herein designated GAM RNA, also designated SEQ ID:371.

Another function of GAM2071 is therefore inhibition of TADA3L (Accession NP_597814.1). Accordingly, utilities of GAM2071 include diagnosis, prevention and treatment of diseases and clinical conditions associated with TADA3L.

Taf11 rna polymerase ii, tata box binding protein (tbp)-associated factor, 28 kda (TAF11, Accession NP_005634.1) is another GAM2071 target gene, herein designated TARGET GENE. TAF11 BINDING SITE is a target binding site found in the 3' untranslated region of mRNA encoded by TAF11, corresponding to a target binding site such as BINDING SITE I, BINDING SITE II or BINDING SITE III of FIG. 8. Table 4 illustrates the complementarity of the nucleotide sequences of TAF11 BINDING SITE, designated SEQ ID:17432, to the nucleotide sequence of GAM2071 RNA, herein designated GAM RNA, also designated SEQ ID:371.

Another function of GAM2071 is therefore inhibition of Taf11 rna polymerase ii, tata box binding protein (tbp)-associated factor, 28 kda (TAF11, Accession NP_005634.1), a gene which plays a central role in mediating promoter responses to various activators and repressors. Accordingly, utilities of GAM2071 include diagnosis, prevention and treatment of diseases and clinical conditions associated with TAF11.

The function of TAF11 and its association with various diseases and clinical conditions, has been established by previous studies, as described hereinabove with reference to GAM130.1. Tap binding protein (tapasin) (TAPBP, Accession NP_003181.3) is another GAM2071 target gene, herein designated TARGET GENE. TAPBP BINDING SITE1 through TAPBP BINDING SITE3 are target binding sites found in untranslated regions of multiple transcripts of mRNA encoded by TAPBP, corresponding to target binding sites such as BINDING SITE I, BINDING SITE II or BINDING SITE III of FIG. 8. Table 4 illustrates the complementarity of the nucleotide sequences of TAPBP BINDING SITE1 through TAPBP BINDING SITE3, designated SEQ ID:8861, SEQ ID:6086 and SEQ ID:3109 respectively, to the nucleotide sequence of GAM2071 RNA, herein designated GAM RNA, also designated SEQ ID:371.

Another function of GAM2071 is therefore inhibition of Tap binding protein (tapasin) (TAPBP, Accession NP_003181.3), a gene which is involved in MHC class I-restricted antigen processing. Accordingly, utilities of GAM2071 include diagnosis, prevention and treatment of diseases and clinical conditions associated with TAPBP.

The function of TAPBP and its association with various diseases and clinical conditions, has been established by previous studies, as described hereinabove with reference to GAM136.1. Tyrosine aminotransferase (TAT, Accession NP_000344.1) is another GAM2071 target gene, herein designated TARGET GENE. TAT BINDING SITE is a target binding site found in the 3' untranslated region of mRNA encoded by TAT, corresponding to a target binding site such as BINDING SITE I, BINDING SITE II or BINDING SITE III of FIG. 8. Table 4 illustrates the complementarity of the nucleotide sequences of TAT BINDING SITE, designated SEQ ID:20161, to the nucleotide sequence of GAM2071 RNA, herein designated GAM RNA, also designated SEQ ID:371.

Another function of GAM2071 is therefore inhibition of Tyrosine aminotransferase (TAT, Accession NP_000344.1), a gene which is tyrosine aminotransferase and strongly similar to rat Rn.9947, which plays a role in gluconeogenesis. Accordingly, utilities of GAM2071 include diagnosis, prevention and treatment of diseases and clinical conditions associated with TAT.

The function of TAT and its association with various diseases and clinical conditions, has been established by previous studies, as described hereinabove with reference to GAM189.1. Tbc1 domain family, member 5 (TBC1D5, Accession NP_055559.1) is another GAM2071 target gene, herein designated TARGET GENE. TBC1D5 BINDING SITE is a target binding site found in the 5' untranslated region of mRNA encoded by TBC1D5, corresponding to a target binding site such as BINDING SITE I, BINDING SITE II or BINDING SITE III of FIG. 8. Table 4 illustrates the complementarity of the nucleotide sequences of TBC1D5 BINDING SITE, designated SEQ ID:12382, to the nucleotide sequence of GAM2071 RNA, herein designated GAM RNA, also designated SEQ ID:371.

Another function of GAM2071 is therefore inhibition of Tbc1 domain family, member 5 (TBC1D5, Accession NP_055559.1). Accordingly, utilities of GAM2071 include diagnosis, prevention and treatment of diseases and clinical conditions associated with TBC1D5.

Transcription factor 2, hepatic; lf-b3; variant hepatic nuclear factor (TCF2, Accession NP_006472.1) is another GAM2071 target gene, herein designated TARGET GENE. TCF2 BINDING SITE is a target binding site found in the 3' untranslated region of multiple transcripts of mRNA encoded by TCF2, corresponding to a target binding site such as BINDING SITE I, BINDING SITE II or BINDING SITE III of FIG. 8. Table 4 illustrates the complementarity of the nucleotide sequences of TCF2 BINDING SITE, designated SEQ ID:401, to the nucleotide sequence of GAM2071 RNA, herein designated GAM RNA, also designated SEQ ID:371.

Another function of GAM2071 is therefore inhibition of Transcription factor 2, hepatic; lf-b3; variant hepatic nuclear factor (TCF2, Accession NP_006472.1), a gene which probably binds to the inverted palindrome 5'-gttaatnattaac-3'. and therefore is associated with Maturity-onset diabetes of the young type 5 (mody5), familial hypoplastic glomerulocystic kidney disease (gckd). Accordingly, utilities of GAM2071 include diagnosis, prevention and treatment of Maturity-onset diabetes of the young type 5 (mody5), familial hypoplastic glomerulocystic kidney disease (gckd), and of other diseases and clinical conditions associated with TCF2.

The function of TCF2 and its association with various diseases and clinical conditions, has been established by previous studies, as described hereinabove with reference to GAM144.1. Teratocarcinoma-derived growth factor 1 (TDGF1, Accession NP_003203.1) is another GAM2071 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:10005, to the nucleotide sequence of GAM2071 RNA, herein designated GAM RNA, also designated SEQ ID:371.

Another function of GAM2071 is therefore inhibition of Teratocarcinoma-derived growth factor 1 (TDGF1, Accession NP_003203.1), a gene which can play a role in the determination of the epiblastic cells that subsequently give rise to the mesoderm. and therefore may be associated with Forebrain defects. Accordingly, utilities of GAM2071 include diagnosis, prevention and treatment of Forebrain defects, and of other diseases and clinical conditions associated with TDGF1.

The function of TDGF1 and its association with various diseases and clinical conditions, has been established by previous studies, as described hereinabove with reference to GAM30.1. TERA (Accession NP_067061.1) is another GAM2071 target gene, herein designated TARGET GENE. TERA BINDING SITE is a target binding site found in the 3' untranslated region of mRNA encoded by TERA, corresponding to a target binding site such as BINDING SITE I, BINDING SITE II or BINDING SITE III of FIG. 8. Table 4 illustrates the complementarity of the nucleotide sequences of TERA BINDING SITE, designated SEQ ID:971, to the nucleotide sequence of GAM2071 RNA, herein designated GAM RNA, also designated SEQ ID:371.

Another function of GAM2071 is therefore inhibition of TERA (Accession NP_067061.1). Accordingly, utilities of GAM2071 include diagnosis, prevention and treatment of diseases and clinical conditions associated with TERA.

Telomeric repeat binding factor (nima-interacting) 1 (TERF1, Accession NP_059523.1) is another GAM2071 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:13870, to the nucleotide sequence of GAM2071 RNA, herein designated GAM RNA, also designated SEQ ID:371.

Another function of GAM2071 is therefore inhibition of Telomeric repeat binding factor (nima-interacting) 1 (TERF1, Accession NP_059523.1), a gene which negatively regulates telomere length, involves in regulation of the mitotic spindle. Accordingly, utilities of GAM2071 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor (nima-interacting) 1 (TERF1, Accession NP_003209.1) is another GAM2071 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:13870, to the nucleotide sequence of GAM2071 RNA, herein designated GAM RNA, also designated SEQ ID:371.

Another function of GAM2071 is therefore inhibition of Telomeric repeat binding factor (nima-interacting) 1 (TERF1, Accession NP_003209.1), a gene which negatively regulates telomere length, involves in regulation of the mitotic spindle. Accordingly, utilities of GAM2071 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor 2 (TERF2, Accession NP_005643.1) is another GAM2071 target gene, herein designated TARGET GENE. TERF2 BINDING SITE is a target binding site found in the 3' untranslated region of mRNA encoded by TERF2, corresponding to a target binding site such as BINDING SITE I, BINDING SITE II or BINDING SITE III of FIG. 8. Table 4 illustrates the complementarity of the nucleotide sequences of TERF2 BINDING SITE, designated SEQ ID:11659, to the nucleotide sequence of GAM2071 RNA, herein designated GAM RNA, also designated SEQ ID:371.

Another function of GAM2071 is therefore inhibition of Telomeric repeat binding factor 2 (TERF2, Accession NP_005643.1), a gene which plays a key role in the protective activity of telomeres. Accordingly, utilities of GAM2071 include diagnosis, prevention and treatment of diseases and clinical conditions associated with TERF2.

The function of TERF2 and its association with various diseases and clinical conditions, has been established by previous studies, as described hereinabove with reference to GAM133.2. Transforming growth factor, beta receptor iii (betaglycan, 300 kda) (TGFBR3, Accession NP_003234.1) is another GAM2071 target gene, herein designated TARGET GENE. TGFBR3 BINDING SITE is a target binding site found in the 3' untranslated region of mRNA encoded by TGFBR3, corresponding to a target binding site such as BINDING SITE I, BINDING SITE II or BINDING SITE III of FIG. 8. Table 4 illustrates the complementarity of the nucleotide sequences of TGFBR3 BINDING SITE, designated SEQ ID:4831, to the nucleotide sequence of GAM2071 RNA, herein designated GAM RNA, also designated SEQ ID:371.

Another function of GAM2071 is therefore inhibition of Transforming growth factor, beta receptor iii (betaglycan, 300 kda) (TGFBR3, Accession NP_003234.1), a gene which involves in capturing and retaining TGF-beta for presentation to the signaling receptors. Accordingly, utilities of GAM2071 include diagnosis, prevention and treatment of diseases and clinical conditions associated with TGFBR3.

The function of TGFBR3 and its association with various diseases and clinical conditions, has been established by previous studies, as described hereinabove with reference to GAM47.1. Tgfb-induced factor 2 (tale family homeobox) (TGIF2, Accession NP_068581.1) is another GAM2071 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:7274, to the nucleotide sequence of GAM2071 RNA, herein designated GAM RNA, also designated SEQ ID:371.

Another function of GAM2071 is therefore inhibition of Tgfb-induced factor 2 (tale family homeobox) (TGIF2, Accession NP_068581.1). Accordingly, utilities of GAM2071 include diagnosis, prevention and treatment of diseases and clinical conditions associated with TGIF2.

Transmembrane, cochlear expressed, 1 (TMC1, Accession NP_619636.2) is another GAM2071 target gene, herein designated TARGET GENE. TMC1 BINDING SITE is a target binding site found in the 5' untranslated region of mRNA encoded by TMC1, corresponding to a target binding site such as BINDING SITE I, BINDING SITE II or BINDING SITE III of FIG. 8. Table 4 illustrates the complementarity of the nucleotide sequences of TMC1 BINDING SITE, designated SEQ ID:19429, to the nucleotide sequence of GAM2071 RNA, herein designated GAM RNA, also designated SEQ ID:371.

Another function of GAM2071 is therefore inhibition of Transmembrane, cochlear expressed, 1 (TMC1, Accession NP_619636.2), a gene which is required for normal function of cochlear hair cells and therefore may be associated with Autosomal recessive nonsyndromic neurosensory deafness and autosomal dominant nonsyndromic sensorineural hearing loss. Accordingly, utilities of GAM2071 include diagnosis, prevention and treatment of Autosomal recessive nonsyndromic neurosensory deafness and autosomal dominant nonsyndromic sensorineural hearing loss., and of other diseases and clinical conditions associated with TMC1.

The function of TMC1 and its association with various diseases and clinical conditions, has been established by previous studies, as described hereinabove with reference to GAM136.1. TMEM14A (Accession NP_054770.1) is another GAM2071 target gene, herein designated TARGET GENE. TMEM14A BINDING SITE is a target binding site found in the 5' untranslated region of mRNA encoded by TMEM14A, corresponding to a target binding site such as BINDING SITE I, BINDING SITE II or BINDING SITE III of FIG. 8. Table 4 illustrates the complementarity of the nucleotide sequences of TMEM14A BINDING SITE, designated SEQ ID:7622, to the nucleotide sequence of GAM2071 RNA, herein designated GAM RNA, also designated SEQ ID:371.

Another function of GAM2071 is therefore inhibition of TMEM14A (Accession NP_054770.1). Accordingly, utilities of GAM2071 include diagnosis, prevention and treatment of diseases and clinical conditions associated with TMEM14A.

Transmembrane protease, serine 3 (TMPRSS3, Accession NP_076927.1) is another GAM2071 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:15133, to the nucleotide sequence of GAM2071 RNA, herein designated GAM RNA, also designated SEQ ID:371.

Another function of GAM2071 is therefore inhibition of Transmembrane protease, serine 3 (TMPRSS3, Accession NP_076927.1). Accordingly, utilities of GAM2071 include diagnosis, prevention and treatment of diseases and clinical conditions associated with TMPRSS3.

Transmembrane protease, serine 3 (TMPRSS3, Accession NP_115777.1) is another GAM2071 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:15133, to the nucleotide sequence of GAM2071 RNA, herein designated GAM RNA, also designated SEQ ID:371.

Another function of GAM2071 is therefore inhibition of Transmembrane protease, serine 3 (TMPRSS3, Accession NP_115777.1). Accordingly, utilities of GAM2071 include diagnosis, prevention and treatment of diseases and clinical conditions associated with TMPRSS3.

Transmembrane protease, serine 3 (TMPRSS3, Accession NP_115780.1) is another GAM2071 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:15133, to the nucleotide sequence of GAM2071 RNA, herein designated GAM RNA, also designated SEQ ID:371.

Another function of GAM2071 is therefore inhibition of Transmembrane protease, serine 3 (TMPRSS3, Accession NP_115780.1). Accordingly, utilities of GAM2071 include diagnosis, prevention and treatment of diseases and clinical conditions associated with TMPRSS3.

Tumor necrosis factor, alpha-induced protein 2 (TNFAIP2, Accession NP_006282.2) is another GAM2071 target gene, herein designated TARGET GENE. TNFAIP2 BINDING SITE is a target binding site found in the 3' untranslated region of mRNA encoded by TNFAIP2, corresponding to a target binding site such as BINDING SITE I, BINDING SITE II or BINDING SITE III of FIG. 8. Table 4 illustrates the complementarity of the nucleotide sequences of TNFAIP2 BINDING SITE, designated SEQ ID:14228, to the nucleotide sequence of GAM2071 RNA, herein designated GAM RNA, also designated SEQ ID:371.

Another function of GAM2071 is therefore inhibition of Tumor necrosis factor, alpha-induced protein 2 (TNFAIP2, Accession NP_006282.2). Accordingly, utilities of GAM2071 include diagnosis, prevention and treatment of diseases and clinical conditions associated with TNFAIP2.

Tumor necrosis factor receptor superfamily, member 10b (TNFRSF10B, Accession NP_671716.1) is another GAM2071 target gene, herein designated TARGET GENE. TNFRSF10B BINDING SITE1 and TNFRSF10B BINDING SITE2 are target binding sites found in untranslated regions of multiple transcripts of mRNA encoded by TNFRSF10B, corresponding to target binding sites such as BINDING SITE I, BINDING SITE II or BINDING SITE III of FIG. 8. Table 4 illustrates the complementarity of the nucleotide sequences of TNFRSF10B BINDING SITE1 and TNFRSF10B BINDING SITE2, designated SEQ ID:9933 and SEQ ID:9933 respectively, to the nucleotide sequence of GAM2071 RNA, herein designated GAM RNA, also designated SEQ ID:371.

Another function of GAM2071 is therefore inhibition of Tumor necrosis factor receptor superfamily, member 10b (TNFRSF10B, Accession NP_671716.1), a gene which forms complex that induces apoptosis. and therefore may be associated with Squamous cell carcinoma. Accordingly, utilities of GAM2071 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 10b (TNFRSF10B, Accession NP_003833.3) is another GAM2071 target gene, herein designated TARGET GENE. TNFRSF10B BINDING SITE1 and TNFRSF10B BINDING SITE2 are target binding sites found in untranslated regions of multiple transcripts of mRNA encoded by TNFRSF10B, corresponding to target binding sites such as BINDING SITE I, BINDING SITE II or BINDING SITE III of FIG. 8. Table 4 illustrates the complementarity of the nucleotide sequences of TNFRSF10B BINDING SITE1 and TNFRSF10B BINDING SITE2, designated SEQ ID:14554 and SEQ ID:14554 respectively, to the nucleotide sequence of GAM2071 RNA, herein designated GAM RNA, also designated SEQ ID:371.

Another function of GAM2071 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM2071 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 11a, activator of nfkb (TNFRSF11A, Accession NP_003830.1) is another GAM2071 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:11190, to the nucleotide sequence of GAM2071 RNA, herein designated GAM RNA, also designated SEQ ID:371.

Another function of GAM2071 is therefore inhibition of Tumor necrosis factor receptor superfamily, member 11a, activator of nfkb (TNFRSF11A, Accession NP_003830.1). Accordingly, utilities of GAM2071 include diagnosis, prevention and treatment of diseases and clinical conditions associated with TNFRSF11A.

Tumor necrosis factor receptor superfamily, member 9 (TNFRSF9, Accession NP_001552.2) is another GAM2071 target gene, herein designated TARGET GENE. TNFRSF9 BINDING SITE is a target binding site found in the 3' untranslated region of mRNA encoded by TNFRSF9, corresponding to a target binding site such as BINDING SITE I, BINDING SITE II or BINDING SITE III of FIG. 8. Table 4 illustrates the complementarity of the nucleotide sequences of TNFRSF9 BINDING SITE, designated SEQ ID:438, to the nucleotide sequence of GAM2071 RNA, herein designated GAM RNA, also designated SEQ ID:371.

Another function of GAM2071 is therefore inhibition of Tumor necrosis factor receptor superfamily, member 9 (TNFRSF9, Accession NP_001552.2), a gene which inhibits proliferation of activated T lymphocytes. Accordingly, utilities of GAM2071 include diagnosis, prevention and treatment of diseases and clinical conditions associated with TNFRSF9.

The function of TNFRSF9 and its association with various diseases and clinical conditions, has been established by previous studies, as described hereinabove with reference to GAM189.1. TOMM20-PENDING (Accession NP_055580.1) is another GAM2071 target gene, herein designated TARGET GENE. TOMM20-PENDING BINDING SITE is a target binding site found in the 3' untranslated region of mRNA encoded by TOMM20-PENDING, corresponding to a target binding site such as BINDING SITE I, BINDING SITE II or BINDING SITE III of FIG. 8. Table 4 illustrates the complementarity of the nucleotide sequences of TOMM20-PENDING BINDING SITE, designated SEQ ID:11702, to the nucleotide sequence of GAM2071 RNA, herein designated GAM RNA, also designated SEQ ID:371.

Another function of GAM2071 is therefore inhibition of TOMM20-PENDING (Accession NP_055580.1). Accordingly, utilities of GAM2071 include diagnosis, prevention and treatment of diseases and clinical conditions associated with TOMM20-PENDING.

Torsin family 1, member b (torsin b) (TOR1B, Accession NP_055321.1) is another GAM2071 target gene, herein designated TARGET GENE. TOR1B BINDING SITE is a target binding site found in the 3' untranslated region of mRNA encoded by TOR1B, corresponding to a target binding site such as BINDING SITE I, BINDING SITE II or BINDING SITE III of FIG. 8. Table 4 illustrates the complementarity of the nucleotide sequences of TOR1B BINDING SITE, designated SEQ ID:2429, to the nucleotide sequence of GAM2071 RNA, herein designated GAM RNA, also designated SEQ ID:371.

Another function of GAM2071 is therefore inhibition of Torsin family 1, member b (torsin b) (TOR1B, Accession NP_055321.1). Accordingly, utilities of GAM2071 include diagnosis, prevention and treatment of diseases and clinical conditions associated with TOR1B.

Tumor protein p53 (li-fraumeni syndrome) (TP53, Accession NP_000537.2) is another GAM2071 target gene, herein designated TARGET GENE. TP53 BINDING SITE is a target binding site found in the 3' untranslated region of mRNA encoded by TP53, corresponding to a target binding site such as BINDING SITE I, BINDING SITE II or BINDING SITE III of FIG. 8. Table 4 illustrates the complementarity of the nucleotide sequences of TP53 BINDING SITE, designated SEQ ID:2118, to the nucleotide sequence of GAM2071 RNA, herein designated GAM RNA, also designated SEQ ID:371.

Another function of GAM2071 is therefore inhibition of Tumor protein p53 (li-fraumeni syndrome) (TP53, Accession NP_000537.2). Accordingly, utilities of GAM2071 include diagnosis, prevention and treatment of diseases and clinical conditions associated with TP53.

Thiopurine s-methyltransferase (TPMT, Accession NP_000358.1) is another GAM2071 target gene, herein designated TARGET GENE. TPMT BINDING SITE is a target binding site found in the 3' untranslated region of mRNA encoded by TPMT, corresponding to a target binding site such as BINDING SITE I, BINDING SITE II or BINDING SITE III of FIG. 8. Table 4 illustrates the complementarity of the nucleotide sequences of TPMT BINDING SITE, designated SEQ ID:10218, to the nucleotide sequence of GAM2071 RNA, herein designated GAM RNA, also designated SEQ ID:371.

Another function of GAM2071 is therefore inhibition of Thiopurine s-methyltransferase (TPMT, Accession NP_000358.1), a gene which catalyzes the s-methylation of thiopurine drugs such as 6-mercaptopurine. and therefore may be associated with Thiopurine s-methyltransferase polymorphism. Accordingly, utilities of GAM2071 include diagnosis, prevention and treatment of Thiopurine s-methyltransferase polymorphism, and of other diseases and clinical conditions associated with TPMT.

The function of TPMT and its association with various diseases and clinical conditions, has been established by previous studies, as described hereinabove with reference to GAM130.1. Tnf receptor-associated factor 5 (TRAF5, Accession NP_665702.1) is another GAM2071 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:10175, to the nucleotide sequence of GAM2071 RNA, herein designated GAM RNA, also designated SEQ ID:371.

Another function of GAM2071 is therefore inhibition of Tnf receptor-associated factor 5 (TRAF5, Accession NP_665702.1), a gene which Member of a family of proteins that interact with TNF receptors; binds the lymphotoxin beta receptor (LTBR). Accordingly, utilities of GAM2071 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tnf receptor-associated factor 5 (TRAF5, Accession NP_004610.1) is another GAM2071 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:10175, to the nucleotide sequence of GAM2071 RNA, herein designated GAM RNA, also designated SEQ ID:371.

Another function of GAM2071 is therefore inhibition of Tnf receptor-associated factor 5 (TRAF5, Accession NP_004610.1), a gene which Member of a family of proteins that interact with TNF receptors; binds the lymphotoxin beta receptor (LTBR). Accordingly, utilities of GAM2071 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tripartite motif-containing 6 (TRIM6, Accession NP_477514.1) is another GAM2071 target gene, herein designated TARGET GENE. TRIM6 BINDING SITE is a target binding site found in the 3' untranslated region of mRNA encoded by TRIM6, corresponding to a target binding site such as BINDING SITE I, BINDING SITE II or BINDING SITE III of FIG. 8. Table 4 illustrates the complementarity of the nucleotide sequences of TRIM6 BINDING SITE, designated SEQ ID:13974, to the nucleotide sequence of GAM2071 RNA, herein designated GAM RNA, also designated SEQ ID:371.

Another function of GAM2071 is therefore inhibition of Tripartite motif-containing 6 (TRIM6, Accession NP_477514.1). Accordingly, utilities of GAM2071 include diagnosis, prevention and treatment of diseases and clinical conditions associated with TRIM6.

Transient receptor potential cation channel, subfamily m, member 6 (TRPM6, Accession NP_060132.3) is another GAM2071 target gene, herein designated TARGET GENE. TRPM6 BINDING SITE is a target binding site found in the 3' untranslated region of mRNA encoded by TRPM6, corresponding to a target binding site such as BINDING SITE I, BINDING SITE II or BINDING SITE III of FIG. 8. Table 4 illustrates the complementarity of the nucleotide sequences of TRPM6 BINDING SITE, designated SEQ ID:1713, to the nucleotide sequence of GAM2071 RNA, herein designated GAM RNA, also designated SEQ ID:371.

Another function of GAM2071 is therefore inhibition of Transient receptor potential cation channel, subfamily m, member 6 (TRPM6, Accession NP_060132.3), a gene which contains a predicted ion channel domain and a protein kinase domain. and therefore is associated with Hypomagnesemia with secondary hypocalcemia. Accordingly, utilities of GAM2071 include diagnosis, prevention and treatment of Hypomagnesemia with secondary hypocalcemia, and of other diseases and clinical conditions associated with TRPM6.

The function of TRPM6 and its association with various diseases and clinical conditions, has been established by previous studies, as described hereinabove with reference to GAM130.1. Transient receptor potential cation channel, subfamily v, member 1 (TRPV1, Accession NP_061197.3) is another GAM2071 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:15897 and SEQ ID:1587 respectively, to the nucleotide sequence of GAM2071 RNA, herein designated GAM RNA, also designated SEQ ID:371.

Another function of GAM2071 is therefore inhibition of Transient receptor potential cation channel, subfamily v, member 1 (TRPV1, Accession NP_061197.3), a gene which functions as a receptor for capsaicin. Accordingly, utilities of GAM2071 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542437.1) is another GAM2071 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:1587 and SEQ ID:15897 respectively, to the nucleotide sequence of GAM2071 RNA, herein designated GAM RNA, also designated SEQ ID:371.

Another function of GAM2071 is therefore inhibition of Transient receptor potential cation channel, subfamily v, member 1 (TRPV1, Accession NP_542437.1), a gene which functions as a receptor for capsaicin. Accordingly, utilities of GAM2071 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542435.1) is another GAM2071 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:1587 and SEQ ID:15897 respectively, to the nucleotide sequence of GAM2071 RNA, herein designated GAM RNA, also designated SEQ ID:371.

Another function of GAM2071 is therefore inhibition of Transient receptor potential cation channel, subfamily v, member 1 (TRPV1, Accession NP_542435.1), a gene which functions as a receptor for capsaicin. Accordingly, utilities of GAM2071 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542435.1) is another GAM2071 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:15897 and SEQ ID:1587 respectively, to the nucleotide sequence of GAM2071 RNA, herein designated GAM RNA, also designated SEQ ID:371.

Another function of GAM2071 is therefore inhibition of Transient receptor potential cation channel, subfamily v, member 1 (TRPV1, Accession NP_542435.1), a gene which functions as a receptor for capsaicin. Accordingly, utilities of GAM2071 include diagnosis, prevention and treatment of diseases and clinical conditions associated with TRPV1.

The function of TRPV1 and its association with various diseases and clinical conditions, has been established by previous studies, as described hereinabove with reference to GAM130.1. TSARG1 (Accession NP_620712.2) is another GAM2071 target gene, herein designated TARGET GENE. TSARG1 BINDING SITE is a target binding site found in the 3' untranslated region of mRNA encoded by TSARG1, corresponding to a target binding site such as BINDING SITE I, BINDING SITE II or BINDING SITE III of FIG. 8. Table 4 illustrates the complementarity of the nucleotide sequences of TSARG1 BINDING SITE, designated SEQ ID:15069, to the nucleotide sequence of GAM2071 RNA, herein designated GAM RNA, also designated SEQ ID:371.

Another function of GAM2071 is therefore inhibition of TSARG1 (Accession NP_620712.2). Accordingly, utilities of GAM2071 include diagnosis, prevention and treatment of diseases and clinical conditions associated with TSARG1.

Tspy-like (TSPy, Accession XP_166325.1) is another GAM2071 target gene, herein designated TARGET GENE. TSPYL BINDING SITE is a target binding site found in the 3' untranslated region of mRNA encoded by TSPy, corresponding to a target binding site such as BINDING SITE I, BINDING SITE II or BINDING SITE III of FIG. 8. Table 4 illustrates the complementarity of the nucleotide sequences of TSPYL BINDING SITE, designated SEQ ID:9101, to the nucleotide sequence of GAM2071 RNA, herein designated GAM RNA, also designated SEQ ID:371.

Another function of GAM2071 is therefore inhibition of Tspy-like (TSPy, Accession XP_166325.1). Accordingly, utilities of GAM2071 include diagnosis, prevention and treatment of diseases and clinical conditions associated with TSPYL.

TU12B1-TY (Accession NP_057659.1) is another GAM2071 target gene, herein designated TARGET GENE. TU12B1-TY BINDING SITE1 and TU12B1-TY BINDING SITE2 are target binding sites found in untranslated regions of mRNA encoded by TU12B1-TY, corresponding to target binding sites such as BINDING SITE I, BINDING SITE II or BINDING SITE III of FIG. 8. Table 4 illustrates the complementarity of the nucleotide sequences of TU12B1-TY BINDING SITE1 and TU12B1-TY BINDING SITE2, designated SEQ ID:17849 and SEQ ID:12270 respectively, to the nucleotide sequence of GAM2071 RNA, herein designated GAM RNA, also designated SEQ ID:371.

Another function of GAM2071 is therefore inhibition of TU12B1-TY (Accession NP_057659.1). Accordingly, utilities of GAM2071 include diagnosis, prevention and treatment of diseases and clinical conditions associated with TU12B1-TY.

TUCAN (Accession NP_055774.1) is another GAM2071 target gene, herein designated TARGET GENE. TUCAN BINDING SITE1 and TUCAN BINDING SITE2 are target binding sites found in untranslated regions of mRNA encoded by TUCAN, corresponding to target binding sites such as BINDING SITE I, BINDING SITE II or BINDING SITE III of FIG. 8. Table 4 illustrates the complementarity of the nucleotide sequences of TUCAN BINDING SITE1 and TUCAN BINDING SITE2, designated SEQ ID:2265 and SEQ ID:10630 respectively, to the nucleotide sequence of GAM2071 RNA, herein designated GAM RNA, also designated SEQ ID:371.

Another function of GAM2071 is therefore inhibition of TUCAN (Accession NP_055774.1). Accordingly, utilities of GAM2071 include diagnosis, prevention and treatment of diseases and clinical conditions associated with TUCAN.

Tuftelin 1 (TUFT1, Accession NP_064512.1) is another GAM2071 target gene, herein designated TARGET GENE. TUFT1 BINDING SITE is a target binding site found in the 3' untranslated region of mRNA encoded by TUFT1, corresponding to a target binding site such as BINDING SITE I, BINDING SITE II or BINDING SITE III of FIG. 8. Table 4 illustrates the complementarity of the nucleotide sequences of TUFT1 BINDING SITE, designated SEQ ID:19342, to the nucleotide sequence of GAM2071 RNA, herein designated GAM RNA, also designated SEQ ID:371.

Another function of GAM2071 is therefore inhibition of Tuftelin 1 (TUFT1, Accession NP_064512.1), a gene which appears to play a role in cytokinesis, cell shape, and specialized functions such as secretion and capping. Accordingly, utilities of GAM2071 include diagnosis, prevention and treatment of diseases and clinical conditions associated with TUFT1.

The function of TUFT1 and its association with various diseases and clinical conditions, has been established by previous studies, as described hereinabove with reference to GAM136.1. Thioredoxin-like 2 (TXNL2, Accession NP_006532.1) is another GAM2071 target gene, herein designated TARGET GENE. TXNL2 BINDING SITE is a target binding site found in the 3' untranslated region of mRNA encoded by TXNL2, corresponding to a target binding site such as BINDING SITE I, BINDING SITE II or BINDING SITE III of FIG. 8. Table 4 illustrates the complementarity of the nucleotide sequences of TXNL2 BINDING SITE, designated SEQ ID:1413, to the nucleotide sequence of GAM2071 RNA, herein designated GAM RNA, also designated SEQ ID:371.

Another function of GAM2071 is therefore inhibition of Thioredoxin-like 2 (TXNL2, Accession NP_006532.1). Accordingly, utilities of GAM2071 include diagnosis, prevention and treatment of diseases and clinical conditions associated with TXNL2.

Ubiquitin associated protein 2 (UBAP2, Accession NP_680476.1) is another GAM2071 target gene, herein designated TARGET GENE. UBAP2 BINDING SITE is a target binding site found in the 3' untranslated region of multiple transcripts of mRNA encoded by UBAP2, corresponding to a target binding site such as BINDING SITE I, BINDING SITE II or BINDING SITE III of FIG. 8. Table 4 illustrates the complementarity of the nucleotide sequences of UBAP2 BINDING SITE, designated SEQ ID:5122, to the nucleotide sequence of GAM2071 RNA, herein designated GAM RNA, also designated SEQ ID:371.

Another function of GAM2071 is therefore inhibition of Ubiquitin associated protein 2 (UBAP2, Accession NP_680476.1). Accordingly, utilities of GAM2071 include diagnosis, prevention and treatment of diseases and clinical conditions associated with UBAP2.

Ubiquitin associated protein 2 (UBAP2, Accession NP_060919.2) is another GAM2071 target gene, herein designated TARGET GENE. UBAP2 BINDING SITE is a target binding site found in the 3' untranslated region of multiple transcripts of mRNA encoded by UBAP2, corresponding to a target binding site such as BINDING SITE I, BINDING SITE II or BINDING SITE III of FIG. 8. Table 4 illustrates the complementarity of the nucleotide sequences of UBAP2 BINDING SITE, designated SEQ ID:5122, to the nucleotide sequence of GAM2071 RNA, herein designated GAM RNA, also designated SEQ ID:371.

Another function of GAM2071 is therefore inhibition of Ubiquitin associated protein 2 (UBAP2, Accession NP_060919.2). Accordingly, utilities of GAM2071 include diagnosis, prevention and treatment of diseases and clinical conditions associated with UBAP2.

Ubiquitin associated protein 2 (UBAP2, Accession NP_065918.1) is another GAM2071 target gene, herein designated TARGET GENE. UBAP2 BINDING SITE is a target binding site found in the 3' untranslated region of multiple transcripts of mRNA encoded by UBAP2, corresponding to a target binding site such as BINDING SITE I, BINDING SITE II or BINDING SITE III of FIG. 8. Table 4 illustrates the complementarity of the nucleotide sequences of UBAP2 BINDING SITE, designated SEQ ID:5122, to the nucleotide sequence of GAM2071 RNA, herein designated GAM RNA, also designated SEQ ID:371.

Another function of GAM2071 is therefore inhibition of Ubiquitin associated protein 2 (UBAP2, Accession NP_065918.1). Accordingly, utilities of GAM2071 include diagnosis, prevention and treatment of diseases and clinical conditions associated with UBAP2.

UBF-fl (Accession NP_116217.1) is another GAM2071 target gene, herein designated TARGET GENE. UBF-fl BINDING SITE is a target binding site found in the 3' untranslated region of mRNA encoded by UBF-fl, corresponding to a target binding site such as BINDING SITE I, BINDING SITE II or BINDING SITE III of FIG. 8. Table 4 illustrates the complementarity of the nucleotide sequences of UBF-fl BINDING SITE, designated SEQ ID:17229, to the nucleotide sequence of GAM2071 RNA, herein designated GAM RNA, also designated SEQ ID:371.

Another function of GAM2071 is therefore inhibition of UBF-fl (Accession NP_116217.1). Accordingly, utilities of GAM2071 include diagnosis, prevention and treatment of diseases and clinical conditions associated with UBF-fl.

Udp-glucose dehydrogenase (UGDH, Accession NP_003350.1) is another GAM2071 target gene, herein designated TARGET GENE. UGDH BINDING SITE is a target binding site found in the 3' untranslated region of mRNA encoded by UGDH, corresponding to a target binding site such as BINDING SITE I, BINDING SITE II or BINDING SITE III of FIG. 8. Table 4 illustrates the complementarity of the nucleotide sequences of UGDH BINDING SITE, designated SEQ ID:12092, to the nucleotide sequence of GAM2071 RNA, herein designated GAM RNA, also designated SEQ ID:371.

Another function of GAM2071 is therefore inhibition of Udp-glucose dehydrogenase (UGDH, Accession NP_003350.1), a gene which is an UDP- glucose dehydrogenase. Accordingly, utilities of GAM2071 include diagnosis, prevention and treatment of diseases and clinical conditions associated with UGDH.

The function of UGDH and its association with various diseases and clinical conditions, has been established by previous studies, as described hereinabove with reference to GAM69.2. Uridine monophosphate synthetase (orotate phosphoribosyl transferase and orotidine-5'-decarboxylase) (UMPS, Accession NP_000364.1) is another GAM2071 target gene, herein designated TARGET GENE. UMPS BINDING SITE is a target binding site found in the 3' untranslated region of mRNA encoded by UMPS, corresponding to a target binding site such as BINDING SITE I, BINDING SITE II or BINDING SITE III of FIG. 8. Table 4 illustrates the complementarity of the nucleotide sequences of UMPS BINDING SITE, designated SEQ ID:19428, to the nucleotide sequence of GAM2071 RNA, herein designated GAM RNA, also designated SEQ ID:371.

Another function of GAM2071 is therefore inhibition of Uridine monophosphate synthetase (orotate phosphoribosyl transferase and orotidine-5'-decarboxylase) (UMPS, Accession NP_000364.1). Accordingly, utilities of GAM2071 include diagnosis, prevention and treatment of diseases and clinical conditions associated with UMPS.

Uracil-dna glycosylase 2 (UNG2, Accession NP_066970.1) is another GAM2071 target gene, herein designated TARGET GENE. UNG2 BINDING SITE is a target binding site found in the 3' untranslated region of mRNA encoded by UNG2, corresponding to a target binding site such as BINDING SITE I, BINDING SITE II or BINDING SITE III of FIG. 8. Table 4 illustrates the complementarity of the nucleotide sequences of UNG2 BINDING SITE, designated SEQ ID:10716, to the nucleotide sequence of GAM2071 RNA, herein designated GAM RNA, also designated SEQ ID:371.

Another function of GAM2071 is therefore inhibition of Uracil-dna glycosylase 2 (UNG2, Accession NP_066970.1). Accordingly, utilities of GAM2071 include diagnosis, prevention and treatment of diseases and clinical conditions associated with UNG2.

Ubiquitin specific protease 22 (USP22, Accession XP_042698.2) is another GAM2071 target gene, herein designated TARGET GENE. USP22 BINDING SITE is a target binding site found in the 3' untranslated region of mRNA encoded by USP22, corresponding to a target binding site such as BINDING SITE I, BINDING SITE II or BINDING SITE III of FIG. 8. Table 4 illustrates the complementarity of the nucleotide sequences of USP22 BINDING SITE, designated SEQ ID:20055, to the nucleotide sequence of GAM2071 RNA, herein designated GAM RNA, also designated SEQ ID:371.

Another function of GAM2071 is therefore inhibition of Ubiquitin specific protease 22 (USP22, Accession XP_042698.2). Accordingly, utilities of GAM2071 include diagnosis, prevention and treatment of diseases and clinical conditions associated with USP22.

VDU1 (Accession NP_055832.2) is another GAM2071 target gene, herein designated TARGET GENE. VDU1 BINDING SITE is a target binding site found in the 3' untranslated region of mRNA encoded by VDU1, corresponding to a target binding site such as BINDING SITE I, BINDING SITE II or BINDING SITE III of FIG. 8. Table 4 illustrates the complementarity of the nucleotide sequences of VDU1 BINDING SITE, designated SEQ ID:794, to the nucleotide sequence of GAM2071 RNA, herein designated GAM RNA, also designated SEQ ID:371.

Another function of GAM2071 is therefore inhibition of VDU1 (Accession NP_055832.2). Accordingly, utilities of GAM2071 include diagnosis, prevention and treatment of diseases and clinical conditions associated with VDU1.

Vent-like homeobox 2 (VENTX2, Accession NP_055283.1) is another GAM2071 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:13003, to the nucleotide sequence of GAM2071 RNA, herein designated GAM RNA, also designated SEQ ID:371.

Another function of GAM2071 is therefore inhibition of Vent-like homeobox 2 (VENTX2, Accession NP_055283.1). Accordingly, utilities of GAM2071 include diagnosis, prevention and treatment of diseases and clinical conditions associated with VENTX2.

Von hippel-lindau syndrome (VHL, Accession NP_000542.1) is another GAM2071 target gene, herein designated TARGET GENE. VHL BINDING SITE1 and VHL BINDING SITE2 are target binding sites found in untranslated regions of mRNA encoded by VHL, corresponding to target binding sites such as BINDING SITE I, BINDING SITE II or BINDING SITE III of FIG. 8. Table 4 illustrates the complementarity of the nucleotide sequences of VHL BINDING SITE1 and VHL BINDING SITE2, designated SEQ ID:19946 and SEQ ID:969 respectively, to the nucleotide sequence of GAM2071 RNA, herein designated GAM RNA, also designated SEQ ID:371.

Another function of GAM2071 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM2071 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. Vasoactive intestinal peptide receptor 2 (VIPR2, Accession NP_003373.2) is another GAM2071 target gene, herein designated TARGET GENE. VIPR2 BINDING SITE is a target binding site found in the 3' untranslated region of mRNA encoded by VIPR2, corresponding to a target binding site such as BINDING SITE I, BINDING SITE II or BINDING SITE III of FIG. 8. Table 4 illustrates the complementarity of the nucleotide sequences of VIPR2 BINDING SITE, designated SEQ ID:861, to the nucleotide sequence of GAM2071 RNA, herein designated GAM RNA, also designated SEQ ID:371.

Another function of GAM2071 is therefore inhibition of Vasoactive intestinal peptide receptor 2 (VIPR2, Accession NP_003373.2). Accordingly, utilities of GAM2071 include diagnosis, prevention and treatment of diseases and clinical conditions associated with VIPR2.

Vacuolar protein sorting 33a (yeast) (VPS33A, Accession NP_075067.2) is another GAM2071 target gene, herein designated TARGET GENE. VPS33A BINDING SITE is a target binding site found in the 3' untranslated region of mRNA encoded by VPS33A, corresponding to a target binding site such as BINDING SITE I, BINDING SITE II or BINDING SITE III of FIG. 8. Table 4 illustrates the complementarity of the nucleotide sequences of VPS33A BINDING SITE, designated SEQ ID:4137, to the nucleotide sequence of GAM2071 RNA, herein designated GAM RNA, also designated SEQ ID:371.

Another function of GAM2071 is therefore inhibition of Vacuolar protein sorting 33a (yeast) (VPS33A, Accession NP_075067.2). Accordingly, utilities of GAM2071 include diagnosis, prevention and treatment of diseases and clinical conditions associated with VPS33A.

Vesicle transport through interaction with t-snares homolog 1a (yeast) (VTI1A, Accession NP_660207.1) is another GAM2071 target gene, herein designated TARGET GENE. VTI1A BINDING SITE is a target binding site found in the 3' untranslated region of mRNA encoded by VTI1A, corresponding to a target binding site such as BINDING SITE I, BINDING SITE II or BINDING SITE III of FIG. 8. Table 4 illustrates the complementarity of the nucleotide sequences of VTI1A BINDING SITE, designated SEQ ID:1472, to the nucleotide sequence of GAM2071 RNA, herein designated GAM RNA, also designated SEQ ID:371.

Another function of GAM2071 is therefore inhibition of Vesicle transport through interaction with t-snares homolog 1a (yeast) (VTI1A, Accession NP_660207.1). Accordingly, utilities of GAM2071 include diagnosis, prevention and treatment of diseases and clinical conditions associated with VTI1A.

Williams beuren syndrome chromosome region 18 (WBSCR18, Accession NP_115693.2) is another GAM2071 target gene, herein designated TARGET GENE. WBSCR18 BINDING SITE is a target binding site found in the 3' untranslated region of mRNA encoded by WBSCR18, corresponding to a target binding site such as BINDING SITE I, BINDING SITE II or BINDING SITE III of FIG. 8. Table 4 illustrates the complementarity of the nucleotide sequences of WBSCR18 BINDING SITE, designated SEQ ID:10631, to the nucleotide sequence of GAM2071 RNA, herein designated GAM RNA, also designated SEQ ID:371.

Another function of GAM2071 is therefore inhibition of Williams beuren syndrome chromosome region 18 (WBSCR18, Accession NP_115693.2). Accordingly, utilities of GAM2071 include diagnosis, prevention and treatment of diseases and clinical conditions associated with WBSCR18.

Wolf-hirschhorn syndrome candidate 1 (WHSC1, Accession NP_579889.1) is another GAM2071 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:12602, to the nucleotide sequence of GAM2071 RNA, herein designated GAM RNA, also designated SEQ ID:371.

Another function of GAM2071 is therefore inhibition of Wolf-hirschhorn syndrome candidate 1 (WHSC1, Accession NP_579889.1), a gene which binds covalently to and repairs g/t mismatches. and therefore may be associated with Wolf-hirschhorn syndrome. Accordingly, utilities of GAM2071 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wnt1 inducible signaling pathway protein 1 (WISP1, Accession NP_003873.1) is another GAM2071 target gene, herein designated TARGET GENE. WISP1 BINDING SITE is a target binding site found in the 3' untranslated region of multiple transcripts of mRNA encoded by WISP1, corresponding to a target binding site such as BINDING SITE I, BINDING SITE II or BINDING SITE III of FIG. 8. Table 4 illustrates the complementarity of the nucleotide sequences of WISP1 BINDING SITE, designated SEQ ID:6051, to the nucleotide sequence of GAM2071 RNA, herein designated GAM RNA, also designated SEQ ID:371.

Another function of GAM2071 is therefore inhibition of Wnt1 inducible signaling pathway protein 1 (WISP1, Accession NP_003873.1), a gene which is a member of connective tissue growth factor family. Accordingly, utilities of GAM2071 include diagnosis, prevention and treatment of diseases and clinical conditions associated with WISP1.

The function of WISP1 and its association with various diseases and clinical conditions, has been established by previous studies, as described hereinabove with reference to GAM629.1. X-ray repair complementing defective repair in chinese hamster cells 2 (XRCC2, Accession NP_005422.1) is another GAM2071 target gene, herein designated TARGET GENE. XRCC2 BINDING SITE1 and XRCC2 BINDING SITE2 are target binding sites found in untranslated regions of mRNA encoded by XRCC2, corresponding to target binding sites such as BINDING SITE I, BINDING SITE II or BINDING SITE III of FIG. 8. Table 4 illustrates the complementarity of the nucleotide sequences of XRCC2 BINDING SITE1 and XRCC2 BINDING SITE2, designated SEQ ID:19967 and SEQ ID:6034 respectively, to the nucleotide sequence of GAM2071 RNA, herein designated GAM RNA, also designated SEQ ID:371.

Another function of GAM2071 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM2071 include diagnosis, prevention and treatment of diseases and clinical conditions associated with XRCC2.

The function of XRCC2 and its association with various diseases and clinical conditions, has been established by previous studies, as described hereinabove with reference to GAM72.1. V-yes-1 yamaguchi sarcoma viral oncogene homolog 1 (YES1, Accession NP_005424.1) is another GAM2071 target gene, herein designated TARGET GENE. YES1 BINDING SITE is a target binding site found in the 3' untranslated region of mRNA encoded by YES1, corresponding to a target binding site such as BINDING SITE I, BINDING SITE II or BINDING SITE III of FIG. 8. Table 4 illustrates the complementarity of the nucleotide sequences of YES1 BINDING SITE, designated SEQ ID:18699, to the nucleotide sequence of GAM2071 RNA, herein designated GAM RNA, also designated SEQ ID:371.

Another function of GAM2071 is therefore inhibition of V-yes-1 yamaguchi sarcoma viral oncogene homolog 1 (YES1, Accession NP_005424.1), a gene which is a putative protein-tyrosine kinase. Accordingly, utilities of GAM2071 include diagnosis, prevention and treatment of diseases and clinical conditions associated with YES1.

The function of YES1 and its association with various diseases and clinical conditions, has been established by previous studies, as described hereinabove with reference to GAM30.1. ZAP (Accession NP_064504.2) is another GAM2071 target gene, herein designated TARGET GENE. ZAP BINDING SITE is a target binding site found in the 3' untranslated region of multiple transcripts of mRNA encoded by ZAP, corresponding to a target binding site such as BINDING SITE I, BINDING SITE II or BINDING SITE III of FIG. 8. Table 4 illustrates the complementarity of the nucleotide sequences of ZAP BINDING SITE, designated SEQ ID:19083, to the nucleotide sequence of GAM2071 RNA, herein designated GAM RNA, also designated SEQ ID:371.

Another function of GAM2071 is therefore inhibition of ZAP (Accession NP_064504.2). Accordingly, utilities of GAM2071 include diagnosis, prevention and treatment of diseases and clinical conditions associated with ZAP.

ZFP42 (Accession NP_777560.1) is another GAM2071 target gene, herein designated TARGET GENE. ZFP42 BINDING SITE is a target binding site found in the 3' untranslated region of mRNA encoded by ZFP42, corresponding to a target binding site such as BINDING SITE I, BINDING SITE II or BINDING SITE III of FIG. 8. Table 4 illustrates the complementarity of the nucleotide sequences of ZFP42 BINDING SITE, designated SEQ ID:6576, to the nucleotide sequence of GAM2071 RNA, herein designated GAM RNA, also designated SEQ ID:371.

Another function of GAM2071 is therefore inhibition of ZFP42 (Accession NP_777560.1). Accordingly, utilities of GAM2071 include diagnosis, prevention and treatment of diseases and clinical conditions associated with ZFP42.

Zinc finger protein 64 homolog (mouse) (ZFP64, Accession NP_060667.1) is another GAM2071 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:13869, to the nucleotide sequence of GAM2071 RNA, herein designated GAM RNA, also designated SEQ ID:371.

Another function of GAM2071 is therefore inhibition of Zinc finger protein 64 homolog (mouse) (ZFP64, Accession NP_060667.1). Accordingly, utilities of GAM2071 include diagnosis, prevention and treatment of diseases and clinical conditions associated with ZFP64.

Zinc finger protein 64 homolog (mouse) (ZFP64, Accession NP_071371.2) is another GAM2071 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:13869, to the nucleotide sequence of GAM2071 RNA, herein designated GAM RNA, also designated SEQ ID:371.

Another function of GAM2071 is therefore inhibition of Zinc finger protein 64 homolog (mouse) (ZFP64, Accession NP_071371.2). Accordingly, utilities of GAM2071 include diagnosis, prevention and treatment of diseases and clinical conditions associated with ZFP64.

ZMYND17 (Accession NP_848546.1) is another GAM2071 target gene, herein designated TARGET GENE. ZMYND17 BINDING SITE is a target binding site found in the 3' untranslated region of mRNA encoded by ZMYND17, corresponding to a target binding site such as BINDING SITE I, BINDING SITE II or BINDING SITE III of FIG. 8. Table 4 illustrates the complementarity of the nucleotide sequences of ZMYND17 BINDING SITE, designated SEQ ID:11022, to the nucleotide sequence of GAM2071 RNA, herein designated GAM RNA, also designated SEQ ID:371.

Another function of GAM2071 is therefore inhibition of ZMYND17 (Accession NP_848546.1). Accordingly, utilities of GAM2071 include diagnosis, prevention and treatment of diseases and clinical conditions associated with ZMYND17.

Zinc finger protein 253 (ZNF253, Accession NP_066385.1) is another GAM2071 target gene, herein designated TARGET GENE. ZNF253 BINDING SITE is a target binding site found in the 3' untranslated region of mRNA encoded by ZNF253, corresponding to a target binding site such as BINDING SITE I, BINDING SITE II or BINDING SITE III of FIG. 8. Table 4 illustrates the complementarity of the nucleotide sequences of ZNF253 BINDING SITE, designated SEQ ID:12223, to the nucleotide sequence of GAM2071 RNA, herein designated GAM RNA, also designated SEQ ID:371.

Another function of GAM2071 is therefore inhibition of Zinc finger protein 253 (ZNF253, Accession NP_066385.1). Accordingly, utilities of GAM2071 include diagnosis, prevention and treatment of diseases and clinical conditions associated with ZNF253.

Zinc finger protein 264 (ZNF264, Accession NP_003408.1) is another GAM2071 target gene, herein designated TARGET GENE. ZNF264 BINDING SITE1 and ZNF264 BINDING SITE2 are target binding sites found in untranslated regions of mRNA encoded by ZNF264, corresponding to target binding sites such as BINDING SITE I, BINDING SITE II or BINDING SITE III of FIG. 8. Table 4 illustrates the complementarity of the nucleotide sequences of ZNF264 BINDING SITE1 and ZNF264 BINDING SITE2, designated SEQ ID:438 and SEQ ID:15406 respectively, to the nucleotide sequence of GAM2071 RNA, herein designated GAM RNA, also designated SEQ ID:371.

Another function of GAM2071 is therefore inhibition of Zinc finger protein 264 (ZNF264, Accession NP_003408.1). Accordingly, utilities of GAM2071 include diagnosis, prevention and treatment of diseases and clinical conditions associated with ZNF264.

Zinc finger protein 302 (ZNF302, Accession NP_061145.1) is another GAM2071 target gene, herein designated TARGET GENE. ZNF302 BINDING SITE is a target binding site found in the 3' untranslated region of multiple transcripts of mRNA encoded by ZNF302, corresponding to a target binding site such as BINDING SITE I, BINDING SITE II or BINDING SITE III of FIG. 8. Table 4 illustrates the complementarity of the nucleotide sequences of ZNF302 BINDING SITE, designated SEQ ID:19157, to the nucleotide sequence of GAM2071 RNA, herein designated GAM RNA, also designated SEQ ID:371.

Another function of GAM2071 is therefore inhibition of Zinc finger protein 302 (ZNF302, Accession NP_061145.1). Accordingly, utilities of GAM2071 include diagnosis, prevention and treatment of diseases and clinical conditions associated with ZNF302.

Zinc finger protein 302 (ZNF302, Accession NP_060913.1) is another GAM2071 target gene, herein designated TARGET GENE. ZNF302 BINDING SITE is a target binding site found in the 3' untranslated region of multiple transcripts of mRNA encoded by ZNF302, corresponding to a target binding site such as BINDING SITE I, BINDING SITE II or BINDING SITE III of FIG. 8. Table 4 illustrates the complementarity of the nucleotide sequences of ZNF302 BINDING SITE, designated SEQ ID:19157, to the nucleotide sequence of GAM2071 RNA, herein designated GAM RNA, also designated SEQ ID:371.

Another function of GAM2071 is therefore inhibition of Zinc finger protein 302 (ZNF302, Accession NP_060913.1). Accordingly, utilities of GAM2071 include diagnosis, prevention and treatment of diseases and clinical conditions associated with ZNF302.

Zinc finger protein 305 (ZNF305, Accession NP_055539.1) is another GAM2071 target gene, herein designated TARGET GENE. ZNF305 BINDING SITE is a target binding site found in the 3' untranslated region of mRNA encoded by ZNF305, corresponding to a target binding site such as BINDING SITE I, BINDING SITE II or BINDING SITE III of FIG. 8. Table 4 illustrates the complementarity of the nucleotide sequences of ZNF305 BINDING SITE, designated SEQ ID:10363, to the nucleotide sequence of GAM2071 RNA, herein designated GAM RNA, also designated SEQ ID:371.

Another function of GAM2071 is therefore inhibition of Zinc finger protein 305 (ZNF305, Accession NP_055539.1). Accordingly, utilities of GAM2071 include diagnosis, prevention and treatment of diseases and clinical conditions associated with ZNF305.

Zinc finger protein 334 (ZNF334, Accession NP_060572.2) is another GAM2071 target gene, herein designated TARGET GENE. ZNF334 BINDING SITE is a target binding site found in the 5' untranslated region of mRNA encoded by ZNF334, corresponding to a target binding site such as BINDING SITE I, BINDING SITE II or BINDING SITE III of FIG. 8. Table 4 illustrates the complementarity of the nucleotide sequences of ZNF334 BINDING SITE, designated SEQ ID:7143, to the nucleotide sequence of GAM2071 RNA, herein designated GAM RNA, also designated SEQ ID:371.

Another function of GAM2071 is therefore inhibition of Zinc finger protein 334 (ZNF334, Accession NP_060572.2). Accordingly, utilities of GAM2071 include diagnosis, prevention and treatment of diseases and clinical conditions associated with ZNF334.

Zinc finger protein 339 (ZNF339, Accession NP_067043.1) is another GAM2071 target gene, herein designated TARGET GENE. ZNF339 BINDING SITE is a target binding site found in the 3' untranslated region of mRNA encoded by ZNF339, corresponding to a target binding site such as BINDING SITE I, BINDING SITE II or BINDING SITE III of FIG. 8. Table 4 illustrates the complementarity of the nucleotide sequences of ZNF339 BINDING SITE, designated SEQ ID:9097, to the nucleotide sequence of GAM2071 RNA, herein designated GAM RNA, also designated SEQ ID:371.

Another function of GAM2071 is therefore inhibition of Zinc finger protein 339 (ZNF339, Accession NP_067043.1). Accordingly, utilities of GAM2071 include diagnosis, prevention and treatment of diseases and clinical conditions associated with ZNF339.

Zinc finger protein 345 (ZNF345, Accession NP_003410.1) is another GAM2071 target gene, herein designated TARGET GENE. ZNF345 BINDING SITE is a target binding site found in the 3' untranslated region of mRNA encoded by ZNF345, corresponding to a target binding site such as BINDING SITE I, BINDING SITE II or BINDING SITE III of FIG. 8. Table 4 illustrates the complementarity of the nucleotide sequences of ZNF345 BINDING SITE, designated SEQ ID:11758, to the nucleotide sequence of GAM2071 RNA, herein designated GAM RNA, also designated SEQ ID:371.

Another function of GAM2071 is therefore inhibition of Zinc finger protein 345 (ZNF345, Accession NP_003410.1). Accordingly, utilities of GAM2071 include diagnosis, prevention and treatment of diseases and clinical conditions associated with ZNF345.

ZNF431 (Accession XP_086098.2) is another GAM2071 target gene, herein designated TARGET GENE. ZNF431 BINDING SITE is a target binding site found in the 3' untranslated region of mRNA encoded by ZNF431, corresponding to a target binding site such as BINDING SITE I, BINDING SITE II or BINDING SITE III of FIG. 8. Table 4 illustrates the complementarity of the nucleotide sequences of ZNF431 BINDING SITE, designated SEQ ID:9382, to the nucleotide sequence of GAM2071 RNA, herein designated GAM RNA, also designated SEQ ID:371.

Another function of GAM2071 is therefore inhibition of ZNF431 (Accession XP_086098.2). Accordingly, utilities of GAM2071 include diagnosis, prevention and treatment of diseases and clinical conditions associated with ZNF431.

ZNF440 (Accession NP_689570.1) is another GAM2071 target gene, herein designated TARGET GENE. ZNF440 BINDING SITE is a target binding site found in the 3' untranslated region of mRNA encoded by ZNF440, corresponding to a target binding site such as BINDING SITE I, BINDING SITE II or BINDING SITE III of FIG. 8. Table 4 illustrates the complementarity of the nucleotide sequences of ZNF440 BINDING SITE, designated SEQ ID:11659, to the nucleotide sequence of GAM2071 RNA, herein designated GAM RNA, also designated SEQ ID:371.

Another function of GAM2071 is therefore inhibition of ZNF440 (Accession NP_689570.1). Accordingly, utilities of GAM2071 include diagnosis, prevention and treatment of diseases and clinical conditions associated with ZNF440.

ZNF450 (Accession NP_055612.1) is another GAM2071 target gene, herein designated TARGET GENE. ZNF450 BINDING SITE is a target binding site found in the 3' untranslated region of mRNA encoded by ZNF450, corresponding to a target binding site such as BINDING SITE I, BINDING SITE II or BINDING SITE III of FIG. 8. Table 4 illustrates the complementarity of the nucleotide sequences of ZNF450 BINDING SITE, designated SEQ ID:13289, to the nucleotide sequence of GAM2071 RNA, herein designated GAM RNA, also designated SEQ ID:371.

Another function of GAM2071 is therefore inhibition of ZNF450 (Accession NP_055612.1). Accordingly, utilities of GAM2071 include diagnosis, prevention and treatment of diseases and clinical conditions associated with ZNF450.

Zinc finger protein 74 (cos52) (ZNF74, Accession NP_003417.1) is another GAM2071 target gene, herein designated TARGET GENE. ZNF74 BINDING SITE is a target binding site found in the 5' untranslated region of mRNA encoded by ZNF74, corresponding to a target binding site such as BINDING SITE I, BINDING SITE II or BINDING SITE III of FIG. 8. Table 4 illustrates the complementarity of the nucleotide sequences of ZNF74 BINDING SITE, designated SEQ ID:2276, to the nucleotide sequence of GAM2071 RNA, herein designated GAM RNA, also designated SEQ ID:371.

Another function of GAM2071 is therefore inhibition of Zinc finger protein 74 (cos52) (ZNF74, Accession NP_003417.1). Accordingly, utilities of GAM2071 include diagnosis, prevention and treatment of diseases and clinical conditions associated with ZNF74.

ZSIG11 (Accession NP_057010.1) is another GAM2071 target gene, herein designated TARGET GENE. ZSIG11 BINDING SITE is a target binding site found in the 3' untranslated region of mRNA encoded by ZSIG11, corresponding to a target binding site such as BINDING SITE I, BINDING SITE II or BINDING SITE III of FIG. 8. Table 4 illustrates the complementarity of the nucleotide sequences of ZSIG11 BINDING SITE, designated SEQ ID:13057, to the nucleotide sequence of GAM2071 RNA, herein designated GAM RNA, also designated SEQ ID:371.

Another function of GAM2071 is therefore inhibition of ZSIG11 (Accession NP_057010.1). Accordingly, utilities of GAM2071 include diagnosis, prevention and treatment of diseases and clinical conditions associated with ZSIG11.

FIG. 8 further provides a conceptual description of a novel bioinformatically detected of the present invention, referred to here as Genomic Address Messenger 2608 (GAM2608), which modulates expression of respective target genes thereof, the function and utility of which target genes is known in the art.

GAM2608 is a novel bioinformatically detected regulatory, non protein coding, micro RNA (miRNA) gene. The method by which GAM2608 was detected is described hereinabove with reference to FIGS. 8-15.

GAM2608 gene, herein designated GAM GENE, and GAM2608 target gene, herein designated TARGET GENE, are human genes contained in the human genome.

GAM2608 gene encodes a GAM2608 precursor RNA, herein designated GAM PRECURSOR RNA. Similar to other miRNA genes, and unlike most ordinary genes, GAM2608 precursor RNA does not encode a protein. A nucleotide sequence identical or highly similar to the nucleotide sequence of GAM2608 precursor RNA is designated SEQ ID:153, and is provided hereinbelow with reference to the sequence listing part. Nucleotide sequence SEQ ID:153 is located at position 131249166 relative to chromosome X.

GAM2608 precursor RNA folds onto itself, forming GAM2608 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM2608 precursor RNA folds onto itself, forming GAM2608 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM2608 precursor RNA, designated SEQ-ID:153, and a schematic representation of a predicted secondary folding of GAM2608 folded precursor RNA are further described with reference to Table 2, hereby incorporated by reference.

An enzyme complex designated DICER COMPLEX, 'dices' the GAM2608 folded precursor RNA into GAM2608 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM2608 RNA is designated SEQ ID:245, and is provided hereinbelow with references to the sequence listing part and Table 3, hereby incorporated by reference.

GAM2608 target gene, herein designated TARGET GENE, encodes a corresponding messenger RNA, GAM2608 target RNA, herein designated GAM TARGET RNA. GAM2608 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM2608 RNA, herein designated GAM RNA, binds complementarily to one or more target binding sites located in untranslated regions of GAM2608 target RNA, herein designated GAM TARGET RNA. This complementary binding is due to the fact that the nucleotide sequence of GAM2608 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM2608 RNA may have a different number of target binding sites in untranslated regions of a GAM2608 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM2608 RNA, herein designated GAM RNA, to target binding sites on GAM2608 target RNA, herein designated GAM TARGET RNA, such as BINDING SITE I, BINDING SITE II and BINDING SITE III, inhibits translation of GAM2608 target RNA into GAM2608 target protein, herein designated GAM TARGET PROTEIN. GAM target protein is therefore outlined by a broken line.

It is appreciated that GAM2608 target gene, herein designated TARGET GENE, in fact represents a plurality of GAM2608 target genes. The mRNA of each one of this plurality of GAM2608 target genes comprises one or more target binding sites, each having a nucleotide sequence which is at least partly complementary to GAM2608 RNA, herein designated GAM RNA, and which when bound by GAM2608 RNA causes inhibition of translation of respective one or more GAM2608 target proteins.

It is further appreciated by one skilled in the art that the mode of translational inhibition illustrated by FIG. 8 with specific reference to translational inhibition exerted by GAM2608 gene, herein designated GAM GENE, on one or more GAM2608 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM2608 correlate with, and may be deduced from, the identity of the target genes which GAM2608 binds and inhibits, and the function of these target genes, as elaborated hereinbelow.

Atp-binding cassette, sub-family c (cftr/mrp), member 3 (ABCC3, Accession NP_064422.1) is a GAM2608 target gene, herein designated TARGET GENE. ABCC3 BINDING SITE is a target binding site found in the 3' untranslated region of multiple transcripts of mRNA encoded by ABCC3, corresponding to a target binding site such as BINDING SITE I, BINDING SITE II or BINDING SITE III of FIG. 8. Table 4 illustrates the complementarity of the nucleotide sequences of ABCC3 BINDING SITE, designated SEQ ID:19582, to the nucleotide sequence of GAM2608 RNA, herein designated GAM RNA, also designated SEQ ID:245.

A function of GAM2608 is therefore inhibition of Atp-binding cassette, sub-family c (cftr/mrp), member 3

(ABCC3, Accession NP_064422.1), a gene which may act as an inducible transporter in the biliary and intestinal excretion of organic anions. Accordingly, utilities of GAM2608 include diagnosis, prevention and treatment of diseases and clinical conditions associated with ABCC3.

The function of ABCC3 and its association with various diseases and clinical conditions, has been established by previous studies, as described hereinabove with reference to GAM66.2. Atp-binding cassette, sub-family c (cftr/mrp), member 3 (ABCC3, Accession NP_064421.1) is another GAM2608 target gene, herein designated TARGET GENE. ABCC3 BINDING SITE is a target binding site found in the 3' untranslated region of multiple transcripts of mRNA encoded by ABCC3, corresponding to a target binding site such as BINDING SITE I, BINDING SITE II or BINDING SITE III of FIG. 8. Table 4 illustrates the complementarity of the nucleotide sequences of ABCC3 BINDING SITE, designated SEQ ID:19582, to the nucleotide sequence of GAM2608 RNA, herein designated GAM RNA, also designated SEQ ID:245.

Another function of GAM2608 is therefore inhibition of Atp-binding cassette, sub-family c (cftr/mrp), member 3 (ABCC3, Accession NP_064421.1), a gene which may act as an inducible transporter in the biliary and intestinal excretion of organic anions. Accordingly, utilities of GAM2608 include diagnosis, prevention and treatment of diseases and clinical conditions associated with ABCC3.

The function of ABCC3 and its association with various diseases and clinical conditions, has been established by previous studies, as described hereinabove with reference to GAM66.2. Atp-binding cassette, sub-family c (cftr/mrp), member 3 (ABCC3, Accession NP_003777.2) is another GAM2608 target gene, herein designated TARGET GENE. ABCC3 BINDING SITE is a target binding site found in the 3' untranslated region of multiple transcripts of mRNA encoded by ABCC3, corresponding to a target binding site such as BINDING SITE I, BINDING SITE II or BINDING SITE III of FIG. 8. Table 4 illustrates the complementarity of the nucleotide sequences of ABCC3 BINDING SITE, designated SEQ ID:19582, to the nucleotide sequence of GAM2608 RNA, herein designated GAM RNA, also designated SEQ ID:245.

Another function of GAM2608 is therefore inhibition of Atp-binding cassette, sub-family c (cftr/mrp), member 3 (ABCC3, Accession NP_003777.2), a gene which may act as an inducible transporter in the biliary and intestinal excretion of organic anions. Accordingly, utilities of GAM2608 include diagnosis, prevention and treatment of diseases and clinical conditions associated with ABCC3.

The function of ABCC3 and its association with various diseases and clinical conditions, has been established by previous studies, as described hereinabove with reference to GAM66.2. Atpase, cu++ transporting, alpha polypeptide (menkes syndrome) (ATP7A, Accession NP_000043.1) is another GAM2608 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:10811, to the nucleotide sequence of GAM2608 RNA, herein designated GAM RNA, also designated SEQ ID:245.

Another function of GAM2608 is therefore inhibition of Atpase, cu++ transporting, alpha polypeptide (menkes syndrome) (ATP7A, Accession NP_000043.1). Accordingly, utilities of GAM2608 include diagnosis, prevention and treatment of diseases and clinical conditions associated with ATP7A.

Beta-site app-cleaving enzyme (BACE, Accession NP_036236.1) is another GAM2608 target gene, herein designated TARGET GENE. BACE BINDING SITE is a target binding site found in the 3' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:13378, to the nucleotide sequence of GAM2608 RNA, herein designated GAM RNA, also designated SEQ ID:245.

Another function of GAM2608 is therefore inhibition of Beta-site app-cleaving enzyme (BACE, Accession NP_036236.1), a gene which is responsible for the proteolytic processing of the amyloid precursor protein and therefore may be associated with Alzheimer disease. Accordingly, utilities of GAM2608 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_620428.1) is another GAM2608 target gene, herein designated TARGET GENE. BACE BINDING SITE is a target binding site found in the 3' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:13378, to the nucleotide sequence of GAM2608 RNA, herein designated GAM RNA, also designated SEQ ID:245.

Another function of GAM2608 is therefore inhibition of Beta-site app-cleaving enzyme (BACE, Accession NP_620428.1), a gene which is responsible for the proteolytic processing of the amyloid precursor protein and therefore may be associated with Alzheimer disease. Accordingly, utilities of GAM2608 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_620427.1) is another GAM2608 target gene, herein designated TARGET GENE. BACE BINDING SITE is a target binding site found in the 3' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:13378, to the nucleotide sequence of GAM2608 RNA, herein designated GAM RNA, also designated SEQ ID:245.

Another function of GAM2608 is therefore inhibition of Beta-site app-cleaving enzyme (BACE, Accession NP_620427.1), a gene which is responsible for the proteolytic processing of the amyloid precursor protein and therefore may be associated with Alzheimer disease. Accordingly, utilities of GAM2608 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. Beta-site app-cleaving enzyme (BACE, Accession NP_620429.1) is another GAM2608 target gene, herein designated TARGET GENE. BACE BINDING SITE is a target binding site found in the 3' untranslated region of multiple transcripts of mRNA encoded by BACE, corresponding to a target binding site such as BINDING SITE I, BINDING SITE II or BINDING SITE III of FIG. 8. Table 4 illustrates the complementarity of the nucleotide sequences of BACE BINDING SITE, designated SEQ ID:13378, to the nucleotide sequence of GAM2608 RNA, herein designated GAM RNA, also designated SEQ ID:245.

Another function of GAM2608 is therefore inhibition of Beta-site app-cleaving enzyme (BACE, Accession NP_620429.1), a gene which is responsible for the proteolytic processing of the amyloid precursor protein and therefore may be associated with Alzheimer disease. Accordingly, utilities of GAM2608 include diagnosis, prevention and treatment of Alzheimer disease, and of other diseases and clinical conditions associated with BACE.

The function of BACE and its association with various diseases and clinical conditions, has been established by previous studies, as described hereinabove with reference to GAM71.1. BMF (Accession NP_277038.1) is another GAM2608 target gene, herein designated TARGET GENE. BMF BINDING SITE is a target binding site found in the 3' untranslated region of mRNA encoded by BMF, corresponding to a target binding site such as BINDING SITE I, BINDING SITE II or BINDING SITE III of FIG. 8. Table 4 illustrates the complementarity of the nucleotide sequences of BMF BINDING SITE, designated SEQ ID:14471, to the nucleotide sequence of GAM2608 RNA, herein designated GAM RNA, also designated SEQ ID:245.

Another function of GAM2608 is therefore inhibition of BMF (Accession NP_277038.1). Accordingly, utilities of GAM2608 include diagnosis, prevention and treatment of diseases and clinical conditions associated with BMF.

Camp responsive element binding protein-like 2 (CREBL2, Accession NP_001301.1) is another GAM2608 target gene, herein designated TARGET GENE. CREBL2 BINDING SITE is a target binding site found in the 3' untranslated region of mRNA encoded by CREBL2, corresponding to a target binding site such as BINDING SITE I, BINDING SITE II or BINDING SITE III of FIG. 8. Table 4 illustrates the complementarity of the nucleotide sequences of CREBL2 BINDING SITE, designated SEQ ID:10963, to the nucleotide sequence of GAM2608 RNA, herein designated GAM RNA, also designated SEQ ID:245.

Another function of GAM2608 is therefore inhibition of Camp responsive element binding protein-like 2 (CREBL2, Accession NP_001301.1). Accordingly, utilities of GAM2608 include diagnosis, prevention and treatment of diseases and clinical conditions associated with CREBL2.

DJ465N24.2.1 (Accession NP_064713.2) is another GAM2608 target gene, herein designated TARGET GENE. DJ465N24.2.1 BINDING SITE is a target binding site found in the 3' untranslated region of mRNA encoded by DJ465N24.2.1, corresponding to a target binding site such as BINDING SITE I, BINDING SITE II or BINDING SITE III of FIG. 8. Table 4 illustrates the complementarity of the nucleotide sequences of DJ465N24.2.1 BINDING SITE, designated SEQ ID:7651, to the nucleotide sequence of GAM2608 RNA, herein designated GAM RNA, also designated SEQ ID:245.

Another function of GAM2608 is therefore inhibition of DJ465N24.2.1 (Accession NP_064713.2). Accordingly, utilities of GAM2608 include diagnosis, prevention and treatment of diseases and clinical conditions associated with DJ465N24.2.1.

DKFZP586C1619 (Accession NP_665803.1) is another GAM2608 target gene, herein designated TARGET GENE. DKFZP586C1619 BINDING SITE is a target binding site found in the 3' untranslated region of mRNA encoded by DKFZP586C1619, corresponding to a target binding site such as BINDING SITE I, BINDING SITE II or BINDING SITE III of FIG. 8. Table 4 illustrates the complementarity of the nucleotide sequences of DKFZP586C1619 BINDING SITE, designated SEQ ID:1283, to the nucleotide sequence of GAM2608 RNA, herein designated GAM RNA, also designated SEQ ID:245.

Another function of GAM2608 is therefore inhibition of DKFZP586C1619 (Accession NP_665803.1). Accordingly, utilities of GAM2608 include diagnosis, prevention and treatment of diseases and clinical conditions associated with DKFZP586C1619.

DMN (Accession NP_056101.4) is another GAM2608 target gene, herein designated TARGET GENE. DMN BINDING SITE is a target binding site found in the 3' untranslated region of multiple transcripts of mRNA encoded by DMN, corresponding to a target binding site such as BINDING SITE I, BINDING SITE II or BINDING SITE III of FIG. 8. Table 4 illustrates the complementarity of the nucleotide sequences of DMN BINDING SITE, designated SEQ ID:5539, to the nucleotide sequence of GAM2608 RNA, herein designated GAM RNA, also designated SEQ ID:245.

Another function of GAM2608 is therefore inhibition of DMN (Accession NP_056101.4), a gene which may participate in maintaining muscle cell integrity. Accordingly, utilities of GAM2608 include diagnosis, prevention and treatment of diseases and clinical conditions associated with DMN.

The function of DMN and its association with various diseases and clinical conditions, has been established by previous studies, as described hereinabove with reference to GAM66.2. DMN (Accession NP_663780.1) is another GAM2608 target gene, herein designated TARGET GENE. DMN BINDING SITE is a target binding site found in the 3' untranslated region of multiple transcripts of mRNA encoded by DMN, corresponding to a target binding site such as BINDING SITE I, BINDING SITE II or BINDING SITE III of FIG. 8. Table 4 illustrates the complementarity of the nucleotide sequences of DMN BINDING SITE, designated SEQ ID:5539, to the nucleotide sequence of GAM2608 RNA, herein designated GAM RNA, also designated SEQ ID:245.

Another function of GAM2608 is therefore inhibition of DMN (Accession NP_663780.1), a gene which may participate in maintaining muscle cell integrity. Accordingly, utilities of GAM2608 include diagnosis, prevention and treatment of diseases and clinical conditions associated with DMN.

The function of DMN and its association with various diseases and clinical conditions, has been established by previous studies, as described hereinabove with reference to GAM66.2. Elongation of very long chain fatty acids (fen1/elo2, sur4/elo3, yeast)-like 1 (ELOVL1, Accession NP_073732.1) is another GAM2608 target gene, herein designated TARGET GENE. ELOVL1 BINDING SITE is a target binding site found in the 3' untranslated region of mRNA encoded by ELOVL1, corresponding to a target binding site such as BINDING SITE I, BINDING SITE II or BINDING SITE III of FIG. 8. Table 4 illustrates the complementarity of the nucleotide sequences of ELOVL1 BINDING SITE, designated SEQ ID:11677, to the nucleotide sequence of GAM2608 RNA, herein designated GAM RNA, also designated SEQ ID:245.

Another function of GAM2608 is therefore inhibition of Elongation of very long chain fatty acids (fen1/elo2, sur4/elo3, yeast)-like 1 (ELOVL1, Accession NP_073732.1). Accordingly, utilities of GAM2608 include diagnosis, prevention and treatment of diseases and clinical conditions associated with ELOVL1.

Endothelial cell-specific molecule 1 (ESM1, Accession NP_008967.1) is another GAM2608 target gene, herein designated TARGET GENE. ESM1 BINDING SITE is a target binding site found in the 3' untranslated region of mRNA encoded by ESM1, corresponding to a target binding site such as BINDING SITE I, BINDING SITE II or BINDING SITE III of FIG. 8. Table 4 illustrates the complementarity of the nucleotide sequences of ESM1 BINDING SITE, designated SEQ ID:4688, to the nucleotide sequence of GAM2608 RNA, herein designated GAM RNA, also designated SEQ ID:245.

Another function of GAM2608 is therefore inhibition of Endothelial cell-specific molecule 1 (ESM1, Accession NP_008967.1). Accordingly, utilities of GAM2608 include diagnosis, prevention and treatment of diseases and clinical conditions associated with ESM1.

Family with sequence similarity 3, member c (FAM3C, Accession NP_055703.1) is another GAM2608 target gene, herein designated TARGET GENE. FAM3C BINDING SITE is a target binding site found in the 3' untranslated region of mRNA encoded by FAM3C, corresponding to a target binding site such as BINDING SITE I, BINDING SITE II or BINDING SITE III of FIG. 8. Table 4 illustrates the complementarity of the nucleotide sequences of FAM3C BINDING SITE, designated SEQ ID:8964, to the nucleotide sequence of GAM2608 RNA, herein designated GAM RNA, also designated SEQ ID:245.

Another function of GAM2608 is therefore inhibition of Family with sequence similarity 3, member c (FAM3C, Accession NP_055703.1). Accordingly, utilities of GAM2608 include diagnosis, prevention and treatment of diseases and clinical conditions associated with FAM3C.

F-box and leucine-rich repeat protein 3a (FBXL3A, Accession NP_036290.1) is another GAM2608 target gene, herein designated TARGET GENE. FBXL3A BINDING SITE is a target binding site found in the 3' untranslated region of mRNA encoded by FBXL3A, corresponding to a target binding site such as BINDING SITE I, BINDING SITE II or BINDING SITE III of FIG. 8. Table 4 illustrates the complementarity of the nucleotide sequences of FBXL3A BINDING SITE, designated SEQ ID:14877, to the nucleotide sequence of GAM2608 RNA, herein designated GAM RNA, also designated SEQ ID:245.

Another function of GAM2608 is therefore inhibition of F-box and leucine-rich repeat protein 3a (FBXL3A, Accession NP_036290.1), a gene which is a putative SCF ubiquitin ligase subunit involved in protein degradation. Accordingly, utilities of GAM2608 include diagnosis, prevention and treatment of diseases and clinical conditions associated with FBXL3A.

The function of FBXL3A and its association with various diseases and clinical conditions, has been established by previous studies, as described hereinabove with reference to GAM670.1. FLJ10898 (Accession NP_060733.1) is another GAM2608 target gene, herein designated TARGET GENE. FLJ10898 BINDING SITE is a target binding site found in the 3' untranslated region of mRNA encoded by FLJ10898, corresponding to a target binding site such as BINDING SITE I, BINDING SITE II or BINDING SITE III of FIG. 8. Table 4 illustrates the complementarity of the nucleotide sequences of FLJ10898 BINDING SITE, designated SEQ ID:16988, to the nucleotide sequence of GAM2608 RNA, herein designated GAM RNA, also designated SEQ ID:245.

Another function of GAM2608 is therefore inhibition of FLJ10898 (Accession NP_060733.1). Accordingly, utilities of GAM2608 include diagnosis, prevention and treatment of diseases and clinical conditions associated with FLJ10898.

FLJ14810 (Accession NP_116232.2) is another GAM2608 target gene, herein designated TARGET GENE. FLJ14810 BINDING SITE is a target binding site found in the 3' untranslated region of mRNA encoded by FLJ14810, corresponding to a target binding site such as BINDING SITE I, BINDING SITE II or BINDING SITE III of FIG. 8. Table 4 illustrates the complementarity of the nucleotide sequences of FLJ14810 BINDING SITE, designated SEQ ID:4188, to the nucleotide sequence of GAM2608 RNA, herein designated GAM RNA, also designated SEQ ID:245.

Another function of GAM2608 is therefore inhibition of FLJ14810 (Accession NP_116232.2). Accordingly, utilities of GAM2608 include diagnosis, prevention and treatment of diseases and clinical conditions associated with FLJ14810.

FLJ14906 (Accession NP_116248.1) is another GAM2608 target gene, herein designated TARGET GENE. FLJ14906 BINDING SITE is a target binding site found in the 3' untranslated region of mRNA encoded by FLJ14906, corresponding to a target binding site such as BINDING SITE I, BINDING SITE II or BINDING SITE III of FIG. 8. Table 4 illustrates the complementarity of the nucleotide sequences of FLJ14906 BINDING SITE, designated SEQ ID:9840, to the nucleotide sequence of GAM2608 RNA, herein designated GAM RNA, also designated SEQ ID:245.

Another function of GAM2608 is therefore inhibition of FLJ14906 (Accession NP_116248.1). Accordingly, utilities of GAM2608 include diagnosis, prevention and treatment of diseases and clinical conditions associated with FLJ14906.

FLJ33990 (Accession NP_694958.1) is another GAM2608 target gene, herein designated TARGET GENE. FLJ33990 BINDING SITE is a target binding site found in the 3' untranslated region of mRNA encoded by FLJ33990, corresponding to a target binding site such as BINDING SITE I, BINDING SITE II or BINDING SITE III of FIG. 8. Table 4 illustrates the complementarity of the nucleotide sequences of FLJ33990 BINDING SITE, designated SEQ ID:13443, to the nucleotide sequence of GAM2608 RNA, herein designated GAM RNA, also designated SEQ ID:245.

Another function of GAM2608 is therefore inhibition of FLJ33990 (Accession NP_694958.1). Accordingly, utilities of GAM2608 include diagnosis, prevention and treatment of diseases and clinical conditions associated with FLJ33990.

FLJ39821 (Accession NP_775971.1) is another GAM2608 target gene, herein designated TARGET GENE. FLJ39821 BINDING SITE is a target binding site found in the 5' untranslated region of mRNA encoded by FLJ39821, corresponding to a target binding site such as BINDING SITE I, BINDING SITE II or BINDING SITE III of FIG. 8. Table 4 illustrates the complementarity of the nucleotide sequences of FLJ39821 BINDING SITE, designated SEQ ID:12614, to the nucleotide sequence of GAM2608 RNA, herein designated GAM RNA, also designated SEQ ID:245.

Another function of GAM2608 is therefore inhibition of FLJ39821 (Accession NP_775971.1). Accordingly, utilities of GAM2608 include diagnosis, prevention and treatment of diseases and clinical conditions associated with FLJ39821.

FLJ40288 (Accession NP_775953.1) is another GAM2608 target gene, herein designated TARGET GENE.

FLJ40288 BINDING SITE is a target binding site found in the 5' untranslated region of mRNA encoded by FLJ40288, corresponding to a target binding site such as BINDING SITE I, BINDING SITE II or BINDING SITE III of FIG. 8. Table 4 illustrates the complementarity of the nucleotide sequences of FLJ40288 BINDING SITE, designated SEQ ID:4292, to the nucleotide sequence of GAM2608 RNA, herein designated GAM RNA, also designated SEQ ID:245.

Another function of GAM2608 is therefore inhibition of FLJ40288 (Accession NP_775953.1). Accordingly, utilities of GAM2608 include diagnosis, prevention and treatment of diseases and clinical conditions associated with FLJ40288.

FLJ40584 (Accession XP_069189.2) is another GAM2608 target gene, herein designated TARGET GENE. FLJ40584 BINDING SITE is a target binding site found in the 3' untranslated region of mRNA encoded by FLJ40584, corresponding to a target binding site such as BINDING SITE I, BINDING SITE II or BINDING SITE III of FIG. 8. Table 4 illustrates the complementarity of the nucleotide sequences of FLJ40584 BINDING SITE, designated SEQ ID:17085, to the nucleotide sequence of GAM2608 RNA, herein designated GAM RNA, also designated SEQ ID:245.

Another function of GAM2608 is therefore inhibition of FLJ40584 (Accession XP_069189.2). Accordingly, utilities of GAM2608 include diagnosis, prevention and treatment of diseases and clinical conditions associated with FLJ40584.

Glutaminase (GLS, Accession NP_055720.2) is another GAM2608 target gene, herein designated TARGET GENE. GLS BINDING SITE is a target binding site found in the 3' untranslated region of mRNA encoded by GLS, corresponding to a target binding site such as BINDING SITE I, BINDING SITE II or BINDING SITE III of FIG. 8. Table 4 illustrates the complementarity of the nucleotide sequences of GLS BINDING SITE, designated SEQ ID:9171, to the nucleotide sequence of GAM2608 RNA, herein designated GAM RNA, also designated SEQ ID:245.

Another function of GAM2608 is therefore inhibition of Glutaminase (GLS, Accession NP_055720.2). Accordingly, utilities of GAM2608 include diagnosis, prevention and treatment of diseases and clinical conditions associated with GLS.

Glutamate receptor, ionotropic, ampa 1 (GRIA1, Accession NP_000818.1) is another GAM2608 target gene, herein designated TARGET GENE. GRIA1 BINDING SITE is a target binding site found in the 3' untranslated region of mRNA encoded by GRIA1, corresponding to a target binding site such as BINDING SITE I, BINDING SITE II or BINDING SITE III of FIG. 8. Table 4 illustrates the complementarity of the nucleotide sequences of GRIA1 BINDING SITE, designated SEQ ID:16531, to the nucleotide sequence of GAM2608 RNA, herein designated GAM RNA, also designated SEQ ID:245.

Another function of GAM2608 is therefore inhibition of Glutamate receptor, ionotropic, ampa 1 (GRIA1, Accession NP_000818.1), a gene which acts as an excitatory neurotransmitter at many synapses in the central nervous system. Accordingly, utilities of GAM2608 include diagnosis, prevention and treatment of diseases and clinical conditions associated with GRIA1.

The function of GRIA1 and its association with various diseases and clinical conditions, has been established by previous studies, as described hereinabove with reference to GAM412.1. Heparanase (HPSE, Accession NP_006656.1) is another GAM2608 target gene, herein designated TARGET GENE. HPSE BINDING SITE is a target binding site found in the 3' untranslated region of mRNA encoded by HPSE, corresponding to a target binding site such as BINDING SITE I, BINDING SITE II or BINDING SITE III of FIG. 8. Table 4 illustrates the complementarity of the nucleotide sequences of HPSE BINDING SITE, designated SEQ ID:6950, to the nucleotide sequence of GAM2608 RNA, herein designated GAM RNA, also designated SEQ ID:245.

Another function of GAM2608 is therefore inhibition of Heparanase (HPSE, Accession NP_006656.1), a gene which is an endoglycosidase that cleaves heparan sulfate, and therefore may be associated with Breast cancer. Accordingly, utilities of GAM2608 include diagnosis, prevention and treatment of Breast cancer, and of other diseases and clinical conditions associated with HPSE.

The function of HPSE and its association with various diseases and clinical conditions, has been established by previous studies, as described hereinabove with reference to GAM66.2. Inositol 1,4,5-trisphosphate 3-kinase b (ITPKB, Accession NP_002212.1) is another GAM2608 target gene, herein designated TARGET GENE. ITPKB BINDING SITE is a target binding site found in the 3' untranslated region of mRNA encoded by ITPKB, corresponding to a target binding site such as BINDING SITE I, BINDING SITE II or BINDING SITE III of FIG. 8. Table 4 illustrates the complementarity of the nucleotide sequences of ITPKB BINDING SITE, designated SEQ ID:3880, to the nucleotide sequence of GAM2608 RNA, herein designated GAM RNA, also designated SEQ ID:245.

Another function of GAM2608 is therefore inhibition of Inositol 1,4,5-trisphosphate 3-kinase b (ITPKB, Accession NP_002212.1), a gene which is a type B inositol 1,4,5-triphosphate 3 kinase. Accordingly, utilities of GAM2608 include diagnosis, prevention and treatment of diseases and clinical conditions associated with ITPKB.

The function of ITPKB and its association with various diseases and clinical conditions, has been established by previous studies, as described hereinabove with reference to GAM63.1. KIAA0326 (Accession XP_034819.1) is another GAM2608 target gene, herein designated TARGET GENE. KIAA0326 BINDING SITE is a target binding site found in the 3' untranslated region of mRNA encoded by KIAA0326, corresponding to a target binding site such as BINDING SITE I, BINDING SITE II or BINDING SITE III of FIG. 8. Table 4 illustrates the complementarity of the nucleotide sequences of KIAA0326 BINDING SITE, designated SEQ ID:16873, to the nucleotide sequence of GAM2608 RNA, herein designated GAM RNA, also designated SEQ ID:245.

Another function of GAM2608 is therefore inhibition of KIAA0326 (Accession XP_034819.1). Accordingly, utilities of GAM2608 include diagnosis, prevention and treatment of diseases and clinical conditions associated with KIAA0326.

KIAA1826 (Accession XP_040784.1) is another GAM2608 target gene, herein designated TARGET GENE. KIAA1826 BINDING SITE is a target binding site found in the 3' untranslated region of mRNA encoded by KIAA1826, corresponding to a target binding site such as BINDING SITE I, BINDING SITE II or BINDING SITE III of FIG. 8. Table 4 illustrates the complementarity of the nucleotide sequences of KIAA1826 BINDING SITE, designated SEQ ID:13511, to the nucleotide sequence of GAM2608 RNA, herein designated GAM RNA, also designated SEQ ID:245.

Another function of GAM2608 is therefore inhibition of KIAA1826 (Accession XP_040784.1). Accordingly, utilities of GAM2608 include diagnosis, prevention and treatment of diseases and clinical conditions associated with KIAA1826.

KIAA1853 (Accession XP_045184.1) is another GAM2608 target gene, herein designated TARGET GENE. KIAA1853 BINDING SITE is a target binding site found in the 3' untranslated region of mRNA encoded by KIAA1853, corresponding to a target binding site such as BINDING SITE I, BINDING SITE II or BINDING SITE III of FIG. 8. Table 4 illustrates the complementarity of the nucleotide sequences of KIAA1853 BINDING SITE, designated SEQ ID:2810, to the nucleotide sequence of GAM2608 RNA, herein designated GAM RNA, also designated SEQ ID:245.

Another function of GAM2608 is therefore inhibition of KIAA1853 (Accession XP_045184.1). Accordingly, utilities of GAM2608 include diagnosis, prevention and treatment of diseases and clinical conditions associated with KIAA1853.

Lysosomal-associated membrane protein 1 (LAMP1, Accession NP_005552.2) is another GAM2608 target gene, herein designated TARGET GENE. LAMP1 BINDING SITE is a target binding site found in the 3' untranslated region of mRNA encoded by LAMP1, corresponding to a target binding site such as BINDING SITE I, BINDING SITE II or BINDING SITE III of FIG. 8. Table 4 illustrates the complementarity of the nucleotide sequences of LAMP1 BINDING SITE, designated SEQ ID:6326, to the nucleotide sequence of GAM2608 RNA, herein designated GAM RNA, also designated SEQ ID:245.

Another function of GAM2608 is therefore inhibition of Lysosomal-associated membrane protein 1 (LAMP1, Accession NP_005552.2), a gene which presents carbohydrate ligands to selectins. Accordingly, utilities of GAM2608 include diagnosis, prevention and treatment of diseases and clinical conditions associated with LAMP1.

The function of LAMP1 and its association with various diseases and clinical conditions, has been established by previous studies, as described hereinabove with reference to GAM483.1. Lysosomal-associated protein transmembrane 4 alpha (LAPTM4A, Accession NP_055528.1) is another GAM2608 target gene, herein designated TARGET GENE. LAPTM4A BINDING SITE is a target binding site found in the 3' untranslated region of mRNA encoded by LAPTM4A, corresponding to a target binding site such as BINDING SITE I, BINDING SITE II or BINDING SITE III of FIG. 8. Table 4 illustrates the complementarity of the nucleotide sequences of LAPTM4A BINDING SITE, designated SEQ ID:6126, to the nucleotide sequence of GAM2608 RNA, herein designated GAM RNA, also designated SEQ ID:245.

Another function of GAM2608 is therefore inhibition of Lysosomal-associated protein transmembrane 4 alpha (LAPTM4A, Accession NP_055528.1). Accordingly, utilities of GAM2608 include diagnosis, prevention and treatment of diseases and clinical conditions associated with LAPTM4A.

Luteinizing hormone/choriogonadotropin receptor (LHCGR, Accession NP_000224.1) is another GAM2608 target gene, herein designated TARGET GENE. LHCGR BINDING SITE is a target binding site found in the 3' untranslated region of mRNA encoded by LHCGR, corresponding to a target binding site such as BINDING SITE I, BINDING SITE II or BINDING SITE III of FIG. 8. Table 4 illustrates the complementarity of the nucleotide sequences of LHCGR BINDING SITE, designated SEQ ID:15507, to the nucleotide sequence of GAM2608 RNA, herein designated GAM RNA, also designated SEQ ID:245.

Another function of GAM2608 is therefore inhibition of Luteinizing hormone/choriogonadotropin receptor (LHCGR, Accession NP_000224.1). Accordingly, utilities of GAM2608 include diagnosis, prevention and treatment of diseases and clinical conditions associated with LHCGR.

LOC114971 (Accession XP_054936.4) is another GAM2608 target gene, herein designated TARGET GENE. LOC114971 BINDING SITE is a target binding site found in the 3' untranslated region of mRNA encoded by LOC114971, corresponding to a target binding site such as BINDING SITE I, BINDING SITE II or BINDING SITE III of FIG. 8. Table 4 illustrates the complementarity of the nucleotide sequences of LOC114971 BINDING SITE, designated SEQ ID:14175, to the nucleotide sequence of GAM2608 RNA, herein designated GAM RNA, also designated SEQ ID:245.

Another function of GAM2608 is therefore inhibition of LOC114971 (Accession XP_054936.4). Accordingly, utilities of GAM2608 include diagnosis, prevention and treatment of diseases and clinical conditions associated with LOC114971.

LOC147136 (Accession XP_300674.1) is another GAM2608 target gene, herein designated TARGET GENE. LOC147136 BINDING SITE is a target binding site found in the 3' untranslated region of mRNA encoded by LOC147136, corresponding to a target binding site such as BINDING SITE I, BINDING SITE II or BINDING SITE III of FIG. 8. Table 4 illustrates the complementarity of the nucleotide sequences of LOC147136 BINDING SITE, designated SEQ ID:18650, to the nucleotide sequence of GAM2608 RNA, herein designated GAM RNA, also designated SEQ ID:245.

Another function of GAM2608 is therefore inhibition of LOC147136 (Accession XP_300674.1). Accordingly, utilities of GAM2608 include diagnosis, prevention and treatment of diseases and clinical conditions associated with LOC147136.

LOC150279 (Accession XP_086820.1) is another GAM2608 target gene, herein designated TARGET GENE. LOC150279 BINDING SITE is a target binding site found in the 3' untranslated region of mRNA encoded by LOC150279, corresponding to a target binding site such as BINDING SITE I, BINDING SITE II or BINDING SITE III of FIG. 8. Table 4 illustrates the complementarity of the nucleotide sequences of LOC150279 BINDING SITE, designated SEQ ID:8823, to the nucleotide sequence of GAM2608 RNA, herein designated GAM RNA, also designated SEQ ID:245.

Another function of GAM2608 is therefore inhibition of LOC150279 (Accession XP_086820.1). Accordingly, utilities of GAM2608 include diagnosis, prevention and treatment of diseases and clinical conditions associated with LOC150279.

LOC158863 (Accession XP_098999.1) is another GAM2608 target gene, herein designated TARGET GENE. LOC158863 BINDING SITE is a target binding site found in the 3' untranslated region of mRNA encoded by LOC158863, corresponding to a target binding site such as BINDING SITE I, BINDING SITE II or BINDING SITE III of FIG. 8. Table 4 illustrates the complementarity of the nucleotide sequences of LOC158863 BINDING SITE, designated SEQ ID:5453, to the nucleotide sequence of GAM2608 RNA, herein designated GAM RNA, also designated SEQ ID:245.

Another function of GAM2608 is therefore inhibition of LOC158863 (Accession XP_098999.1). Accordingly, utilities of GAM2608 include diagnosis, prevention and treatment of diseases and clinical conditions associated with LOC158863.

LOC201287 (Accession XP_113947.1) is another GAM2608 target gene, herein designated TARGET GENE. LOC201287 BINDING SITE is a target binding site found in the 5' untranslated region of mRNA encoded by LOC201287, corresponding to a target binding site such as BINDING SITE I, BINDING SITE II or BINDING SITE III of FIG. 8. Table 4 illustrates the complementarity of the nucleotide sequences of LOC201287 BINDING SITE, designated SEQ ID:15360, to the nucleotide sequence of GAM2608 RNA, herein designated GAM RNA, also designated SEQ ID:245.

Another function of GAM2608 is therefore inhibition of LOC201287 (Accession XP_113947.1). Accordingly, utilities of GAM2608 include diagnosis, prevention and treatment of diseases and clinical conditions associated with LOC201287.

LOC220486 (Accession XP_165391.2) is another GAM2608 target gene, herein designated TARGET GENE. LOC220486 BINDING SITE is a target binding site found in the 5' untranslated region of mRNA encoded by LOC220486, corresponding to a target binding site such as BINDING SITE I, BINDING SITE II or BINDING SITE III of FIG. 8. Table 4 illustrates the complementarity of the nucleotide sequences of LOC220486 BINDING SITE, designated SEQ ID:5591, to the nucleotide sequence of GAM2608 RNA, herein designated GAM RNA, also designated SEQ ID:245.

Another function of GAM2608 is therefore inhibition of LOC220486 (Accession XP_165391.2). Accordingly, utilities of GAM2608 include diagnosis, prevention and treatment of diseases and clinical conditions associated with LOC220486.

LOC253609 (Accession XP_172986.2) is another GAM2608 target gene, herein designated TARGET GENE. LOC253609 BINDING SITE is a target binding site found in the 5' untranslated region of mRNA encoded by LOC253609, corresponding to a target binding site such as BINDING SITE I, BINDING SITE II or BINDING SITE III of FIG. 8. Table 4 illustrates the complementarity of the nucleotide sequences of LOC253609 BINDING SITE, designated SEQ ID:17912, to the nucleotide sequence of GAM2608 RNA, herein designated GAM RNA, also designated SEQ ID:245.

Another function of GAM2608 is therefore inhibition of LOC253609 (Accession XP_172986.2). Accordingly, utilities of GAM2608 include diagnosis, prevention and treatment of diseases and clinical conditions associated with LOC253609.

LOC253805 (Accession XP_172854.1) is another GAM2608 target gene, herein designated TARGET GENE. LOC253805 BINDING SITE is a target binding site found in the 3' untranslated region of mRNA encoded by LOC253805, corresponding to a target binding site such as BINDING SITE I, BINDING SITE II or BINDING SITE III of FIG. 8. Table 4 illustrates the complementarity of the nucleotide sequences of LOC253805 BINDING SITE, designated SEQ ID:7852, to the nucleotide sequence of GAM2608 RNA, herein designated GAM RNA, also designated SEQ ID:245.

Another function of GAM2608 is therefore inhibition of LOC253805 (Accession XP_172854.1). Accordingly, utilities of GAM2608 include diagnosis, prevention and treatment of diseases and clinical conditions associated with LOC253805.

LOC283116 (Accession XP_208043.1) is another GAM2608 target gene, herein designated TARGET GENE. LOC283116 BINDING SITE is a target binding site found in the 5' untranslated region of mRNA encoded by LOC283116, corresponding to a target binding site such as BINDING SITE I, BINDING SITE II or BINDING SITE III of FIG. 8. Table 4 illustrates the complementarity of the nucleotide sequences of LOC283116 BINDING SITE, designated SEQ ID:8224, to the nucleotide sequence of GAM2608 RNA, herein designated GAM RNA, also designated SEQ ID:245.

Another function of GAM2608 is therefore inhibition of LOC283116 (Accession XP_208043.1). Accordingly, utilities of GAM2608 include diagnosis, prevention and treatment of diseases and clinical conditions associated with LOC283116.

LOC283830 (Accession XP_211223.1) is another GAM2608 target gene, herein designated TARGET GENE. LOC283830 BINDING SITE is a target binding site found in the 3' untranslated region of mRNA encoded by LOC283830, corresponding to a target binding site such as BINDING SITE I, BINDING SITE II or BINDING SITE III of FIG. 8. Table 4 illustrates the complementarity of the nucleotide sequences of LOC283830 BINDING SITE, designated SEQ ID:16975, to the nucleotide sequence of GAM2608 RNA, herein designated GAM RNA, also designated SEQ ID:245.

Another function of GAM2608 is therefore inhibition of LOC283830 (Accession XP_211223.1). Accordingly, utilities of GAM2608 include diagnosis, prevention and treatment of diseases and clinical conditions associated with LOC283830.

LOC284996 (Accession NP_775918.1) is another GAM2608 target gene, herein designated TARGET GENE. LOC284996 BINDING SITE is a target binding site found in the 3' untranslated region of mRNA encoded by LOC284996, corresponding to a target binding site such as BINDING SITE I, BINDING SITE II or BINDING SITE III of FIG. 8. Table 4 illustrates the complementarity of the nucleotide sequences of LOC284996 BINDING SITE, designated SEQ ID:13549, to the nucleotide sequence of GAM2608 RNA, herein designated GAM RNA, also designated SEQ ID:245.

Another function of GAM2608 is therefore inhibition of LOC284996 (Accession NP_775918.1). Accordingly, utilities of GAM2608 include diagnosis, prevention and treatment of diseases and clinical conditions associated with LOC284996.

LOC285595 (Accession XP_211948.1) is another GAM2608 target gene, herein designated TARGET GENE. LOC285595 BINDING SITE is a target binding site found in the 3' untranslated region of mRNA encoded by LOC285595, corresponding to a target binding site such as BINDING SITE I, BINDING SITE II or BINDING SITE III of FIG. 8. Table 4 illustrates the complementarity of the nucleotide sequences of LOC285595 BINDING SITE, designated SEQ ID:13348, to the nucleotide sequence of GAM2608 RNA, herein designated GAM RNA, also designated SEQ ID:245.

Another function of GAM2608 is therefore inhibition of LOC285595 (Accession XP_211948.1). Accordingly, utilities of GAM2608 include diagnosis, prevention and treatment of diseases and clinical conditions associated with LOC285595.

LOC285656 (Accession XP_211976.2) is another GAM2608 target gene, herein designated TARGET GENE. LOC285656 BINDING SITE is a target binding site found in the 3' untranslated region of mRNA encoded by LOC285656, corresponding to a target binding site such as BINDING SITE I, BINDING SITE II or BINDING SITE III of FIG. 8. Table 4 illustrates the complementarity of the nucleotide sequences of LOC285656 BINDING SITE, designated SEQ ID:13348, to the nucleotide sequence of GAM2608 RNA, herein designated GAM RNA, also designated SEQ ID:245.

Another function of GAM2608 is therefore inhibition of LOC285656 (Accession XP_211976.2). Accordingly, utilities of GAM2608 include diagnosis, prevention and treatment of diseases and clinical conditions associated with LOC285656.

LOC286460 (Accession XP_208425.1) is another GAM2608 target gene, herein designated TARGET GENE. LOC286460 BINDING SITE is a target binding site found in the 3' untranslated region of mRNA encoded by LOC286460, corresponding to a target binding site such as BINDING SITE I, BINDING SITE II or BINDING SITE III of FIG. 8. Table 4 illustrates the complementarity of the nucleotide sequences of LOC286460 BINDING SITE, designated SEQ ID:8964, to the nucleotide sequence of GAM2608 RNA, herein designated GAM RNA, also designated SEQ ID:245.

Another function of GAM2608 is therefore inhibition of LOC286460 (Accession XP_208425.1). Accordingly, utilities of GAM2608 include diagnosis, prevention and treatment of diseases and clinical conditions associated with LOC286460.

LOC339005 (Accession XP_290661.1) is another GAM2608 target gene, herein designated TARGET GENE. LOC339005 BINDING SITE is a target binding site found in the 3' untranslated region of mRNA encoded by LOC339005, corresponding to a target binding site such as BINDING SITE I, BINDING SITE II or BINDING SITE III of FIG. 8. Table 4 illustrates the complementarity of the nucleotide sequences of LOC339005 BINDING SITE, designated SEQ ID:3940, to the nucleotide sequence of GAM2608 RNA, herein designated GAM RNA, also designated SEQ ID:245.

Another function of GAM2608 is therefore inhibition of LOC339005 (Accession XP_290661.1). Accordingly, utilities of GAM2608 include diagnosis, prevention and treatment of diseases and clinical conditions associated with LOC339005.

LOC339263 (Accession XP_294889.1) is another GAM2608 target gene, herein designated TARGET GENE. LOC339263 BINDING SITE is a target binding site found in the 5' untranslated region of mRNA encoded by LOC339263, corresponding to a target binding site such as BINDING SITE I, BINDING SITE II or BINDING SITE III of FIG. 8. Table 4 illustrates the complementarity of the nucleotide sequences of LOC339263 BINDING SITE, designated SEQ ID:2561, to the nucleotide sequence of GAM2608 RNA, herein designated GAM RNA, also designated SEQ ID:245.

Another function of GAM2608 is therefore inhibition of LOC339263 (Accession XP_294889.1). Accordingly, utilities of GAM2608 include diagnosis, prevention and treatment of diseases and clinical conditions associated with LOC339263.

LOC348989 (Accession XP_302935.1) is another GAM2608 target gene, herein designated TARGET GENE. LOC348989 BINDING SITE is a target binding site found in the 3' untranslated region of mRNA encoded by LOC348989, corresponding to a target binding site such as BINDING SITE I, BINDING SITE II or BINDING SITE III of FIG. 8. Table 4 illustrates the complementarity of the nucleotide sequences of LOC348989 BINDING SITE, designated SEQ ID:13348, to the nucleotide sequence of GAM2608 RNA, herein designated GAM RNA, also designated SEQ ID:245.

Another function of GAM2608 is therefore inhibition of LOC348989 (Accession XP_302935.1). Accordingly, utilities of GAM2608 include diagnosis, prevention and treatment of diseases and clinical conditions associated with LOC348989.

LOC349440 (Accession XP_300513.1) is another GAM2608 target gene, herein designated TARGET GENE. LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:10811, to the nucleotide sequence of GAM2608 RNA, herein designated GAM RNA, also designated SEQ ID:245.

Another function of GAM2608 is therefore inhibition of LOC349440 (Accession XP_300513.1). Accordingly, utilities of GAM2608 include diagnosis, prevention and treatment of diseases and clinical conditions associated with LOC349440.

LOC55974 (Accession NP_061333.1) is another GAM2608 target gene, herein designated TARGET GENE. LOC55974 BINDING SITE is a target binding site found in the 3' untranslated region of mRNA encoded by LOC55974, corresponding to a target binding site such as BINDING SITE I, BINDING SITE II or BINDING SITE III of FIG. 8. Table 4 illustrates the complementarity of the nucleotide sequences of LOC55974 BINDING SITE, designated SEQ ID:17137, to the nucleotide sequence of GAM2608 RNA, herein designated GAM RNA, also designated SEQ ID:245.

Another function of GAM2608 is therefore inhibition of LOC55974 (Accession NP_061333.1). Accordingly, utilities of GAM2608 include diagnosis, prevention and treatment of diseases and clinical conditions associated with LOC55974.

Mastermind-like 2 (drosophila) (MAML2, Accession XP_045716.1) is another GAM2608 target gene, herein designated TARGET GENE. MAML2 BINDING SITE is a target binding site found in the 3' untranslated region of mRNA encoded by MAML2, corresponding to a target binding site such as BINDING SITE I, BINDING SITE II or BINDING SITE III of FIG. 8. Table 4 illustrates the complementarity of the nucleotide sequences of MAML2 BINDING SITE, designated SEQ ID:11423, to the nucleotide sequence of GAM2608 RNA, herein designated GAM RNA, also designated SEQ ID:245.

Another function of GAM2608 is therefore inhibition of Mastermind-like 2 (drosophila) (MAML2, Accession XP_045716.1). Accordingly, utilities of GAM2608 include diagnosis, prevention and treatment of diseases and clinical conditions associated with MAML2.

Mitogen-activated protein kinase kinase kinase 8 (MAP3K8, Accession NP_005195.2) is another GAM2608 target gene, herein designated TARGET GENE. MAP3K8 BINDING SITE is a target binding site found in the 5' untranslated region of mRNA encoded by MAP3K8, corresponding to a target binding site such as BINDING SITE I, BINDING SITE II or BINDING SITE III of FIG. 8. Table 4 illustrates the complementarity of the nucleotide sequences of MAP3K8 BINDING SITE, designated SEQ ID:17674, to the nucleotide sequence of GAM2608 RNA, herein designated GAM RNA, also designated SEQ ID:245.

Another function of GAM2608 is therefore inhibition of Mitogen-activated protein kinase kinase kinase 8 (MAP3K8, Accession NP_005195.2), a gene which is able to activate nf-kappa-b 1 by stimulating proteasome-mediated p. Accordingly, utilities of GAM2608 include diagnosis, prevention and treatment of diseases and clinical conditions associated with MAP3K8.

The function of MAP3K8 and its association with various diseases and clinical conditions, has been established by previous studies, as described hereinabove with reference to GAM55.1. Mitogen-activated protein kinase kinase kinase 5 (MAP4K5, Accession NP_006566.2) is another GAM2608 target gene, herein designated TARGET GENE. MAP4K5 BINDING SITE is a target binding site found in the 3' untranslated region of mRNA encoded by MAP4K5, corresponding to a target binding site such as BINDING SITE I, BINDING SITE II or BINDING SITE III of FIG. 8. Table 4 illustrates the complementarity of the nucleotide sequences of MAP4K5 BINDING SITE, designated SEQ ID:14765, to the nucleotide sequence of GAM2608 RNA, herein designated GAM RNA, also designated SEQ ID:245.

Another function of GAM2608 is therefore inhibition of Mitogen-activated protein kinase kinase kinase kinase 5 (MAP4K5, Accession NP_006566.2). Accordingly, utilities of GAM2608 include diagnosis, prevention and treatment of diseases and clinical conditions associated with MAP4K5.

Mannan-binding lectin serine protease 1 (c4/c2 activating component of ra-reactive factor) (MASP1, Accession NP_001870.3) is another GAM2608 target gene, herein designated TARGET GENE. MASP1 BINDING SITE is a target binding site found in the 3' untranslated region of multiple transcripts of mRNA encoded by MASP1, corresponding to a target binding site such as BINDING SITE I, BINDING SITE II or BINDING SITE III of FIG. 8. Table 4 illustrates the complementarity of the nucleotide sequences of MASP1 BINDING SITE, designated SEQ ID:16184, to the nucleotide sequence of GAM2608 RNA, herein designated GAM RNA, also designated SEQ ID:245.

Another function of GAM2608 is therefore inhibition of Mannan-binding lectin serine protease 1 (c4/c2 activating component of ra-reactive factor) (MASP1, Accession NP_001870.3), a gene which a complement-dependent bactericidal factor. Accordingly, utilities of GAM2608 include diagnosis, prevention and treatment of diseases and clinical conditions associated with MASP1.

The function of MASP1 and its association with various diseases and clinical conditions, has been established by previous studies, as described hereinabove with reference to GAM40.1. MGC10561 (Accession NP_116036.1) is another GAM2608 target gene, herein designated TARGET GENE. MGC10561 BINDING SITE is a target binding site found in the 3' untranslated region of mRNA encoded by MGC10561, corresponding to a target binding site such as BINDING SITE I, BINDING SITE II or BINDING SITE III of FIG. 8. Table 4 illustrates the complementarity of the nucleotide sequences of MGC10561 BINDING SITE, designated SEQ ID:2731, to the nucleotide sequence of GAM2608 RNA, herein designated GAM RNA, also designated SEQ ID:245.

Another function of GAM2608 is therefore inhibition of MGC10561 (Accession NP_116036.1). Accordingly, utilities of GAM2608 include diagnosis, prevention and treatment of diseases and clinical conditions associated with MGC10561.

MGC13024 (Accession NP_689501.1) is another GAM2608 target gene, herein designated TARGET GENE. MGC13024 BINDING SITE is a target binding site found in the 3' untranslated region of mRNA encoded by MGC13024, corresponding to a target binding site such as BINDING SITE I, BINDING SITE II or BINDING SITE III of FIG. 8. Table 4 illustrates the complementarity of the nucleotide sequences of MGC13024 BINDING SITE, designated SEQ ID:9146, to the nucleotide sequence of GAM2608 RNA, herein designated GAM RNA, also designated SEQ ID:245.

Another function of GAM2608 is therefore inhibition of MGC13024 (Accession NP_689501.1). Accordingly, utilities of GAM2608 include diagnosis, prevention and treatment of diseases and clinical conditions associated with MGC13024.

Monocyte to macrophage differentiation-associated (MMD, Accession NP_036461.1) is another GAM2608 target gene, herein designated TARGET GENE. MMD BINDING SITE is a target binding site found in the 3' untranslated region of mRNA encoded by MMD, corresponding to a target binding site such as BINDING SITE I, BINDING SITE II or BINDING SITE III of FIG. 8. Table 4 illustrates the complementarity of the nucleotide sequences of MMD BINDING SITE, designated SEQ ID:14690, to the nucleotide sequence of GAM2608 RNA, herein designated GAM RNA, also designated SEQ ID:245.

Another function of GAM2608 is therefore inhibition of Monocyte to macrophage differentiation-associated (MMD, Accession NP_036461.1). Accordingly, utilities of GAM2608 include diagnosis, prevention and treatment of diseases and clinical conditions associated with MMD.

Matrix metalloproteinase 26 (MMP26, Accession NP_068573.1) is another GAM2608 target gene, herein designated TARGET GENE. MMP26 BINDING SITE is a target binding site found in the 3' untranslated region of mRNA encoded by MMP26, corresponding to a target binding site such as BINDING SITE I, BINDING SITE II or BINDING SITE III of FIG. 8. Table 4 illustrates the complementarity of the nucleotide sequences of MMP26 BINDING SITE, designated SEQ ID:3864, to the nucleotide sequence of GAM2608 RNA, herein designated GAM RNA, also designated SEQ ID:245.

Another function of GAM2608 is therefore inhibition of Matrix metalloproteinase 26 (MMP26, Accession NP_068573.1). Accordingly, utilities of GAM2608 include diagnosis, prevention and treatment of diseases and clinical conditions associated with MMP26.

Matrix metalloproteinase 3 (stromelysin 1, progelatinase) (MMP3, Accession NP_002413.1) is another GAM2608 target gene, herein designated TARGET GENE. MMP3 BINDING SITE is a target binding site found in the 3' untranslated region of mRNA encoded by MMP3, corresponding to a target binding site such as BINDING SITE I, BINDING SITE II or BINDING SITE III of FIG. 8. Table 4 illustrates the complementarity of the nucleotide sequences of MMP3 BINDING SITE, designated SEQ ID:13663, to the nucleotide sequence of GAM2608 RNA, herein designated GAM RNA, also designated SEQ ID:245.

Another function of GAM2608 is therefore inhibition of Matrix metalloproteinase 3 (stromelysin 1, progelatinase) (MMP3, Accession NP_002413.1). Accordingly, utilities of GAM2608 include diagnosis, prevention and treatment of diseases and clinical conditions associated with MMP3.

Neural precursor cell expressed, developmentally down-regulated 4 (NEDD4, Accession XP_046129.4) is another GAM2608 target gene, herein designated TARGET GENE. NEDD4 BINDING SITE is a target binding site found in the 3' untranslated region of mRNA encoded by NEDD4, corresponding to a target binding site such as BINDING SITE I, BINDING SITE II or BINDING SITE III of FIG. 8. Table 4 illustrates the complementarity of the nucleotide sequences of NEDD4 BINDING SITE, designated SEQ ID:15072, to the nucleotide sequence of GAM2608 RNA, herein designated GAM RNA, also designated SEQ ID:245.

Another function of GAM2608 is therefore inhibition of Neural precursor cell expressed, developmentally down-regulated 4 (NEDD4, Accession XP_046129.4), a gene which ubiquitinates regulatory proteins involved in transcription. Accordingly, utilities of GAM2608 include diagnosis, prevention and treatment of diseases and clinical conditions associated with NEDD4.

The function of NEDD4 and its association with various diseases and clinical conditions, has been established by previous studies, as described hereinabove with reference to GAM48.2. Nuclear receptor subfamily 1, group i, member 2 (NR1I2, Accession NP_148934.1) is another GAM2608 target gene, herein designated TARGET GENE. NR1I2 BINDING SITE is a target binding site found in the 3' untranslated region of multiple transcripts of mRNA encoded by NR1I2, corresponding to a target binding site such as BINDING SITE I, BINDING SITE II or BINDING SITE III of FIG. 8. Table 4 illustrates the complementarity of the nucleotide sequences of NR1I2 BINDING SITE, designated SEQ ID:11884, to the nucleotide sequence of GAM2608 RNA, herein designated GAM RNA, also designated SEQ ID:245.

Another function of GAM2608 is therefore inhibition of Nuclear receptor subfamily 1, group i, member 2 (NR1I2, Accession NP__148934.1), a gene which binds to a response element in the cyp3a4 gene promoter and activates its expression in response to a wide variety of endobiotics and xenobiotics. Accordingly, utilities of GAM2608 include diagnosis, prevention and treatment of diseases and clinical conditions associated with NR1I2.

The function of NR1I2 and its association with various diseases and clinical conditions, has been established by previous studies, as described hereinabove with reference to GAM223.1. Nuclear receptor subfamily 1, group i, member 2 (NR1I2, Accession NP__003880.2) is another GAM2608 target gene, herein designated TARGET GENE. NR1I2 BINDING SITE is a target binding site found in the 3' untranslated region of multiple transcripts of mRNA encoded by NR1I2, corresponding to a target binding site such as BINDING SITE I, BINDING SITE II or BINDING SITE III of FIG. 8. Table 4 illustrates the complementarity of the nucleotide sequences of NR1I2 BINDING SITE, designated SEQ ID:11884, to the nucleotide sequence of GAM2608 RNA, herein designated GAM RNA, also designated SEQ ID:245.

Another function of GAM2608 is therefore inhibition of Nuclear receptor subfamily 1, group i, member 2 (NR1I2, Accession NP__003880.2), a gene which binds to a response element in the cyp3a4 gene promoter and activates its expression in response to a wide variety of endobiotics and xenobiotics. Accordingly, utilities of GAM2608 include diagnosis, prevention and treatment of diseases and clinical conditions associated with NR1I2.

The function of NR1I2 and its association with various diseases and clinical conditions, has been established by previous studies, as described hereinabove with reference to GAM223.1. Nuclear receptor subfamily 1, group i, member 2 (NR1I2, Accession NP__071285.1) is another GAM2608 target gene, herein designated TARGET GENE. NR1I2 BINDING SITE is a target binding site found in the 3' untranslated region of multiple transcripts of mRNA encoded by NR1I2, corresponding to a target binding site such as BINDING SITE I, BINDING SITE II or BINDING SITE III of FIG. 8. Table 4 illustrates the complementarity of the nucleotide sequences of NR1I2 BINDING SITE, designated SEQ ID:11884, to the nucleotide sequence of GAM2608 RNA, herein designated GAM RNA, also designated SEQ ID:245.

Another function of GAM2608 is therefore inhibition of Nuclear receptor subfamily 1, group i, member 2 (NR1I2, Accession NP__071285.1), a gene which binds to a response element in the cyp3a4 gene promoter and activates its expression in response to a wide variety of endobiotics and xenobiotics. Accordingly, utilities of GAM2608 include diagnosis, prevention and treatment of diseases and clinical conditions associated with NR1I2.

The function of NR1I2 and its association with various diseases and clinical conditions, has been established by previous studies, as described hereinabove with reference to GAM223.1. Nudix (nucleoside diphosphate linked moiety x)-type motif 4 (NUDT4, Accession NP__061967.2) is another GAM2608 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:18737, to the nucleotide sequence of GAM2608 RNA, herein designated GAM RNA, also designated SEQ ID:245.

Another function of GAM2608 is therefore inhibition of Nudix (nucleoside diphosphate linked moiety x)-type motif 4 (NUDT4, Accession NP__061967.2). Accordingly, utilities of GAM2608 include diagnosis, prevention and treatment of diseases and clinical conditions associated with NUDT4.

Protein kinase c and casein kinase substrate in neurons 1 (PACSIN1, Accession NP__065855.1) is another GAM2608 target gene, herein designated TARGET GENE. PACSIN1 BINDING SITE is a target binding site found in the 3' untranslated region of mRNA encoded by PACSIN1, corresponding to a target binding site such as BINDING SITE I, BINDING SITE II or BINDING SITE III of FIG. 8. Table 4 illustrates the complementarity of the nucleotide sequences of PACSIN1 BINDING SITE, designated SEQ ID:4408, to the nucleotide sequence of GAM2608 RNA, herein designated GAM RNA, also designated SEQ ID:245.

Another function of GAM2608 is therefore inhibition of Protein kinase c and casein kinase substrate in neurons 1 (PACSIN1, Accession NP_065855.1). Accordingly, utilities of GAM2608 include diagnosis, prevention and treatment of diseases and clinical conditions associated with PACSIN1.

Phosphodiesterase 4d, camp-specific (phosphodiesterase e3 dunce homolog, drosophila) (PDE4D, Accession NP__006194.1) is another GAM2608 target gene, herein designated TARGET GENE. PDE4D BINDING SITE is a target binding site found in the 3' untranslated region of mRNA encoded by PDE4D, corresponding to a target binding site such as BINDING SITE I, BINDING SITE II or BINDING SITE III of FIG. 8. Table 4 illustrates the complementarity of the nucleotide sequences of PDE4D BINDING SITE, designated SEQ ID:15887, to the nucleotide sequence of GAM2608 RNA, herein designated GAM RNA, also designated SEQ ID:245.

Another function of GAM2608 is therefore inhibition of Phosphodiesterase 4d, camp-specific (phosphodiesterase e3 dunce homolog, drosophila) (PDE4D, Accession NP__006194.1), a gene which has similarity to Drosophila dnc, which is the affected protein in learning and memory mutant dunce. Accordingly, utilities of GAM2608 include diagnosis, prevention and treatment of diseases and clinical conditions associated with PDE4D.

The function of PDE4D and its association with various diseases and clinical conditions, has been established by previous studies, as described hereinabove with reference to GAM217.1. Perq amino acid rich, with gyf domain 1 (PERQ1, Accession NP__072096.1) is another GAM2608 target gene, herein designated TARGET GENE. PERQ1 BINDING SITE is a target binding site found in the 3' untranslated region of mRNA encoded by PERQ1, corresponding to a target binding site such as BINDING SITE I, BINDING SITE II or BINDING SITE III of FIG. 8. Table 4 illustrates the complementarity of the nucleotide sequences of PERQ1 BINDING SITE, designated SEQ ID:13107, to the nucleotide sequence of GAM2608 RNA, herein designated GAM RNA, also designated SEQ ID:245.

Another function of GAM2608 is therefore inhibition of Perq amino acid rich, with gyf domain 1 (PERQ1, Accession NP__072096.1). Accordingly, utilities of GAM2608 include diagnosis, prevention and treatment of diseases and clinical conditions associated with PERQ1.

Progesterone receptor membrane component 1 (PGRMC1, Accession NP__006658.1) is another GAM2608 target gene, herein designated TARGET GENE. PGRMC1 BINDING SITE is a target binding site found in the 3' untranslated region of mRNA encoded by PGRMC1, corresponding to a target binding site such as BINDING SITE I, BINDING SITE II or BINDING SITE III of FIG. 8. Table 4 illustrates the complementarity of the nucleotide sequences of PGRMC1 BINDING SITE, designated SEQ ID:12615, to the nucleotide sequence of GAM2608 RNA, herein designated GAM RNA, also designated SEQ ID:245.

Another function of GAM2608 is therefore inhibition of Progesterone receptor membrane component 1 (PGRMC1, Accession NP_006658.1). Accordingly, utilities of GAM2608 include diagnosis, prevention and treatment of diseases and clinical conditions associated with PGRMC1.

Rab5a, member ras oncogene family (RAB5A, Accession NP_004153.2) is another GAM2608 target gene, herein designated TARGET GENE. RAB5A BINDING SITE is a target binding site found in the 3' untranslated region of mRNA encoded by RAB5A, corresponding to a target binding site such as BINDING SITE I, BINDING SITE II or BINDING SITE III of FIG. 8. Table 4 illustrates the complementarity of the nucleotide sequences of RAB5A BINDING SITE, designated SEQ ID:5501, to the nucleotide sequence of GAM2608 RNA, herein designated GAM RNA, also designated SEQ ID:245.

Another function of GAM2608 is therefore inhibition of Rab5a, member ras oncogene family (RAB5A, Accession NP_004153.2), a gene which is a rate-limiting component of the machinery regulating the kinetics of membrane traffic. Accordingly, utilities of GAM2608 include diagnosis, prevention and treatment of diseases and clinical conditions associated with RAB5A.

The function of RAB5A and its association with various diseases and clinical conditions, has been established by previous studies, as described hereinabove with reference to GAM94.1. Ring finger protein 18 (RNF18, Accession NP_065091.1) is another GAM2608 target gene, herein designated TARGET GENE. RNF18 BINDING SITE is a target binding site found in the 5' untranslated region of mRNA encoded by RNF18, corresponding to a target binding site such as BINDING SITE I, BINDING SITE II or BINDING SITE III of FIG. 8. Table 4 illustrates the complementarity of the nucleotide sequences of RNF18 BINDING SITE, designated SEQ ID:8224, to the nucleotide sequence of GAM2608 RNA, herein designated GAM RNA, also designated SEQ ID:245.

Another function of GAM2608 is therefore inhibition of Ring finger protein 18 (RNF18, Accession NP_065091.1). Accordingly, utilities of GAM2608 include diagnosis, prevention and treatment of diseases and clinical conditions associated with RNF18.

Rho-associated, coiled-coil containing protein kinase 2 (ROCK2, Accession NP_004841.1) is another GAM2608 target gene, herein designated TARGET GENE. ROCK2 BINDING SITE is a target binding site found in the 3' untranslated region of mRNA encoded by ROCK2, corresponding to a target binding site such as BINDING SITE I, BINDING SITE II or BINDING SITE III of FIG. 8. Table 4 illustrates the complementarity of the nucleotide sequences of ROCK2 BINDING SITE, designated SEQ ID:19439, to the nucleotide sequence of GAM2608 RNA, herein designated GAM RNA, also designated SEQ ID:245.

Another function of GAM2608 is therefore inhibition of Rho-associated, coiled-coil containing protein kinase 2 (ROCK2, Accession NP_004841.1), a gene which regulates cytokinesis, smooth muscle contraction, the formation of actin stress fibers and focal adhesions. Accordingly, utilities of GAM2608 include diagnosis, prevention and treatment of diseases and clinical conditions associated with ROCK2.

The function of ROCK2 and its association with various diseases and clinical conditions, has been established by previous studies, as described hereinabove with reference to GAM90.1. Sh3 domain binding glutamic acid-rich protein like 2 (SH3BGRL2, Accession NP_113657.1) is another GAM2608 target gene, herein designated TARGET GENE. SH3BGRL2 BINDING SITE is a target binding site found in the 3' untranslated region of mRNA encoded by SH3BGRL2, corresponding to a target binding site such as BINDING SITE I, BINDING SITE II or BINDING SITE III of FIG. 8. Table 4 illustrates the complementarity of the nucleotide sequences of SH3BGRL2 BINDING SITE, designated SEQ ID:18614, to the nucleotide sequence of GAM2608 RNA, herein designated GAM RNA, also designated SEQ ID:245.

Another function of GAM2608 is therefore inhibition of Sh3 domain binding glutamic acid-rich protein like 2 (SH3BGRL2, Accession NP_113657.1). Accordingly, utilities of GAM2608 include diagnosis, prevention and treatment of diseases and clinical conditions associated with SH3BGRL2.

Single-minded homolog 2 (drosophila) (SIM2, Accession NP_005060.1) is another GAM2608 target gene, herein designated TARGET GENE. SIM2 BINDING SITE is a target binding site found in the 3' untranslated region of multiple transcripts of mRNA encoded by SIM2, corresponding to a target binding site such as BINDING SITE I, BINDING SITE II or BINDING SITE III of FIG. 8. Table 4 illustrates the complementarity of the nucleotide sequences of SIM2 BINDING SITE, designated SEQ ID:4214, to the nucleotide sequence of GAM2608 RNA, herein designated GAM RNA, also designated SEQ ID:245.

Another function of GAM2608 is therefore inhibition of Single-minded homolog 2 (drosophila) (SIM2, Accession NP_005060.1), a gene which may be a master gene of cns development. and therefore may be associated with Dysmorphic features, abnormalities of brain development, down syndrome. Accordingly, utilities of GAM2608 include diagnosis, prevention and treatment of Dysmorphic features, abnormalities of brain development, down syndrome., and of other diseases and clinical conditions associated with SIM2.

The function of SIM2 and its association with various diseases and clinical conditions, has been established by previous studies, as described hereinabove with reference to GAM347.1. Serine/threonine kinase 38 like (STK38L, Accession NP_055815.1) is another GAM2608 target gene, herein designated TARGET GENE. STK38L BINDING SITE is a target binding site found in the 3' untranslated region of mRNA encoded by STK38L, corresponding to a target binding site such as BINDING SITE I, BINDING SITE II or BINDING SITE III of FIG. 8. Table 4 illustrates the complementarity of the nucleotide sequences of STK38L BINDING SITE, designated SEQ ID:8158, to the nucleotide sequence of GAM2608 RNA, herein designated GAM RNA, also designated SEQ ID:245.

Another function of GAM2608 is therefore inhibition of Serine/threonine kinase 38 like (STK38L, Accession NP_055815.1). Accordingly, utilities of GAM2608 include diagnosis, prevention and treatment of diseases and clinical conditions associated with STK38L.

Transcription factor b2, mitochondrial (TFB2M, Accession NP_071761.1) is another GAM2608 target gene, herein designated TARGET GENE. TFB2M BINDING SITE is a target binding site found in the 5' untranslated region of mRNA encoded by TFB2M, corresponding to a target binding site such as BINDING SITE I, BINDING SITE II or BINDING SITE III of FIG. 8. Table 4 illustrates the complementarity of the nucleotide sequences of TFB2M BINDING SITE, designated SEQ ID:2805, to the nucleotide sequence of GAM2608 RNA, herein designated GAM RNA, also designated SEQ ID:245.

Another function of GAM2608 is therefore inhibition of Transcription factor b2, mitochondrial (TFB2M, Accession NP_071761.1). Accordingly, utilities of GAM2608 include diagnosis, prevention and treatment of diseases and clinical conditions associated with TFB2M.

Titin immunoglobulin domain protein (myotilin) (TTID, Accession NP_006781.1) is another GAM2608 target gene, herein designated TARGET GENE. TTID BINDING SITE is a target binding site found in the 3' untranslated region of mRNA encoded by TTID, corresponding to a target binding site such as BINDING SITE I, BINDING SITE II or BINDING SITE III of FIG. 8. Table 4 illustrates the complementarity of the nucleotide sequences of TTID BINDING SITE, designated SEQ ID:10202, to the nucleotide sequence of GAM2608 RNA, herein designated GAM RNA, also designated SEQ ID:245.

Another function of GAM2608 is therefore inhibition of Titin immunoglobulin domain protein (myotilin) (TTID, Accession NP_006781.1), a gene which is a sarcomeric structural protein and therefore may be associated with Limb-girdle muscular dystrophy. Accordingly, utilities of GAM2608 include diagnosis, prevention and treatment of Limb-girdle muscular dystrophy, and of other diseases and clinical conditions associated with TTID.

The function of TTID and its association with various diseases and clinical conditions, has been established by previous studies, as described hereinabove with reference to GAM1631.1. Usher syndrome 2a (autosomal recessive, mild) (USH2A, Accession NP_009054.3) is another GAM2608 target gene, herein designated TARGET GENE. USH2A BINDING SITE is a target binding site found in the 3' untranslated region of mRNA encoded by USH2A, corresponding to a target binding site such as BINDING SITE I, BINDING SITE II or BINDING SITE III of FIG. 8. Table 4 illustrates the complementarity of the nucleotide sequences of USH2A BINDING SITE, designated SEQ ID:4007, to the nucleotide sequence of GAM2608 RNA, herein designated GAM RNA, also designated SEQ ID:245.

Another function of GAM2608 is therefore inhibition of Usher syndrome 2a (autosomal recessive, mild) (USH2A, Accession NP_009054.3). Accordingly, utilities of GAM2608 include diagnosis, prevention and treatment of diseases and clinical conditions associated with USH2A.

ZID (Accession NP_006617.1) is another GAM2608 target gene, herein designated TARGET GENE. ZID BINDING SITE is a target binding site found in the 3' untranslated region of mRNA encoded by ZID, corresponding to a target binding site such as BINDING SITE I, BINDING SITE II or BINDING SITE III of FIG. 8. Table 4 illustrates the complementarity of the nucleotide sequences of ZID BINDING SITE, designated SEQ ID:5650, to the nucleotide sequence of GAM2608 RNA, herein designated GAM RNA, also designated SEQ ID:245.

Another function of GAM2608 is therefore inhibition of ZID (Accession NP_006617.1). Accordingly, utilities of GAM2608 include diagnosis, prevention and treatment of diseases and clinical conditions associated with ZID.

FIG. 8 further provides a conceptual description of a novel bioinformatically detected of the present invention, referred to here as Genomic Address Messenger 3027 (GAM3027), which modulates expression of respective target genes thereof, the function and utility of which target genes is known in the art.

GAM3027 is a novel bioinformatically detected regulatory, non protein coding, micro RNA (miRNA) gene. The method by which GAM3027 was detected is described hereinabove with reference to FIGS. 8-15.

GAM3027 gene, herein designated GAM GENE, and GAM3027 target gene, herein designated TARGET GENE, are human genes contained in the human genome.

GAM3027 gene encodes a GAM3027 precursor RNA, herein designated GAM PRECURSOR RNA. Similar to other miRNA genes, and unlike most ordinary genes, GAM3027 precursor RNA does not encode a protein. A nucleotide sequence identical or highly similar to the nucleotide sequence of GAM3027 precursor RNA is designated SEQ ID:8, and is provided hereinbelow with reference to the sequence listing part.

GAM3027 precursor RNA folds onto itself, forming GAM3027 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM3027 precursor RNA folds onto itself, forming GAM3027 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM3027 precursor RNA, designated SEQ-ID:8, and a schematic representation of a predicted secondary folding of GAM3027 folded precursor RNA are further described with reference to Table 2, hereby incorporated by reference.

An enzyme complex designated DICER COMPLEX, 'dices' the GAM3027 folded precursor RNA into GAM3027 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM3027 RNA is designated SEQ ID:242, and is provided hereinbelow with references to the sequence listing part and Table 3, hereby incorporated by reference.

GAM3027 target gene, herein designated TARGET GENE, encodes a corresponding messenger RNA, GAM3027 target RNA, herein designated GAM TARGET RNA. GAM3027 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM3027 RNA, herein designated GAM RNA, binds complementarily to one or more target binding sites located in untranslated regions of GAM3027 target RNA, herein designated GAM TARGET RNA. This complementary binding is due to the fact that the nucleotide sequence of GAM3027 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM3027 RNA may have a different number of target binding sites in untranslated regions of a GAM3027 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM3027 RNA, herein designated GAM RNA, to target binding sites on GAM3027 target RNA, herein designated GAM TARGET RNA, such as BINDING SITE I, BINDING SITE II and BINDING SITE III, inhibits translation of GAM3027 target RNA into GAM3027 target protein, herein designated GAM TARGET PROTEIN. GAM target protein is therefore outlined by a broken line.

It is appreciated that GAM3027 target gene, herein designated TARGET GENE, in fact represents a plurality of GAM3027 target genes. The mRNA of each one of this plurality of GAM3027 target genes comprises one or more target binding sites, each having a nucleotide sequence which is at least partly complementary to GAM3027 RNA, herein designated GAM RNA, and which when bound by GAM3027 RNA causes inhibition of translation of respective one or more GAM3027 target proteins.

It is further appreciated by one skilled in the art that the mode of translational inhibition illustrated by FIG. 8 with specific reference to translational inhibition exerted by GAM3027 gene, herein designated GAM GENE, on one or more GAM3027 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM3027 correlate with, and may be deduced from, the identity of the target genes which GAM3027 binds and inhibits, and the function of these target genes, as elaborated hereinbelow.

(Accession NP_444285.1) is a GAM3027 target gene, herein designated TARGET GENE. BINDING SITE is a target binding site found in the 5' untranslated region of multiple transcripts of mRNA encoded by, corresponding to a target binding site such as BINDING SITE I, BINDING SITE II or BINDING SITE III of FIG. 8. Table 4 illustrates the complementarity of the nucleotide sequences of BINDING SITE, designated SEQ ID:16500, to the nucleotide sequence of GAM3027 RNA, herein designated GAM RNA, also designated SEQ ID:242.

A function of GAM3027 is therefore inhibition of (Accession NP_444285.1). Accordingly, utilities of GAM3027 include diagnosis, prevention and treatment of diseases and clinical conditions associated with .

Absent in melanoma 1-like (AIM1L, Accession NP_060447.1) is another GAM3027 target gene, herein designated TARGET GENE. AIM1L BINDING SITE is a target binding site found in the 3' untranslated region of mRNA encoded by AIM1L, corresponding to a target binding site such as BINDING SITE I, BINDING SITE II or BINDING SITE III of FIG. 8. Table 4 illustrates the complementarity of the nucleotide sequences of AIM1L BINDING SITE, designated SEQ ID:7873, to the nucleotide sequence of GAM3027 RNA, herein designated GAM RNA, also designated SEQ ID:242.

Another function of GAM3027 is therefore inhibition of Absent in melanoma 1-like (AIM1L, Accession NP_060447.1). Accordingly, utilities of GAM3027 include diagnosis, prevention and treatment of diseases and clinical conditions associated with AIM1L.

Btb and cnc homology 1, basic leucine zipper transcription factor 2 (BACH2, Accession NP_068585.1) is another GAM3027 target gene, herein designated TARGET GENE. BACH2 BINDING SITE is a target binding site found in the 3' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:1058, to the nucleotide sequence of GAM3027 RNA, herein designated GAM RNA, also designated SEQ ID:242.

Another function of GAM3027 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM3027 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. C14orf116 (Accession NP_061059.1) is another GAM3027 target gene, herein designated TARGET GENE. C14orf116 BINDING SITE is a target binding site found in the 3' untranslated region of mRNA encoded by C14orf116, corresponding to a target binding site such as BINDING SITE I, BINDING SITE II or BINDING SITE III of FIG. 8. Table 4 illustrates the complementarity of the nucleotide sequences of C14orf116 BINDING SITE, designated SEQ ID:9141, to the nucleotide sequence of GAM3027 RNA, herein designated GAM RNA, also designated SEQ ID:242.

Another function of GAM3027 is therefore inhibition of C14orf116 (Accession NP_061059.1). Accordingly, utilities of GAM3027 include diagnosis, prevention and treatment of diseases and clinical conditions associated with C14orf116.

C5orf13 (Accession NP_004763.1) is another GAM3027 target gene, herein designated TARGET GENE. C5orf13 BINDING SITE is a target binding site found in the 3' untranslated region of mRNA encoded by C5orf13, corresponding to a target binding site such as BINDING SITE I, BINDING SITE II or BINDING SITE III of FIG. 8. Table 4 illustrates the complementarity of the nucleotide sequences of C5orf13 BINDING SITE, designated SEQ ID:11415, to the nucleotide sequence of GAM3027 RNA, herein designated GAM RNA, also designated SEQ ID:242.

Another function of GAM3027 is therefore inhibition of C5orf13 (Accession NP_004763.1). Accordingly, utilities of GAM3027 include diagnosis, prevention and treatment of diseases and clinical conditions associated with C5orf13.

Chromosome 5 open reading frame 5 (C5orf5, Accession NP_057687.1) is another GAM3027 target gene, herein designated TARGET GENE. C5orf5 BINDING SITE is a target binding site found in the 3' untranslated region of mRNA encoded by C5orf5, corresponding to a target binding site such as BINDING SITE I, BINDING SITE II or BINDING SITE III of FIG. 8. Table 4 illustrates the complementarity of the nucleotide sequences of C5orf5 BINDING SITE, designated SEQ ID:11857, to the nucleotide sequence of GAM3027 RNA, herein designated GAM RNA, also designated SEQ ID:242.

Another function of GAM3027 is therefore inhibition of Chromosome 5 open reading frame 5 (C5orf5, Accession NP_057687.1). Accordingly, utilities of GAM3027 include diagnosis, prevention and treatment of diseases and clinical conditions associated with C5orf5.

Chemokine (c-c motif) receptor-like 1 (CCRL1, Accession NP_848540.1) is another GAM3027 target gene, herein designated TARGET GENE. CCRL1 BINDING SITE is a target binding site found in the 5' untranslated region of multiple transcripts of mRNA encoded by CCRL1, corresponding to a target binding site such as BINDING SITE I, BINDING SITE II or BINDING SITE III of FIG. 8. Table 4 illustrates the complementarity of the nucleotide sequences of CCRL1 BINDING SITE, designated SEQ ID:11537, to the nucleotide sequence of GAM3027 RNA, herein designated GAM RNA, also designated SEQ ID:242.

Another function of GAM3027 is therefore inhibition of Chemokine (c-c motif) receptor-like 1 (CCRL1, Accession NP_848540.1), a gene which is a G protein-coupled receptor that binds chemokines of the CC subfamily, especially MCP-4, ELC (SCYA19) and TECK (SCYA25). Accordingly, utilities of GAM3027 include diagnosis, prevention and treatment of diseases and clinical conditions associated with CCRL1.

The function of CCRL1 and its association with various diseases and clinical conditions, has been established by previous studies, as described hereinabove with reference to GAM94.1. Collagen, type iv, alpha 5 (alport syndrome) (COL4A5, Accession NP_203700.1) is another GAM3027 target gene, herein designated TARGET GENE. COL4A5 BINDING SITE is a target binding site found in the 3' untranslated region of multiple transcripts of mRNA encoded by COL4A5, corresponding to a target binding site such as BINDING SITE I, BINDING SITE II or BINDING SITE III of FIG. 8. Table 4 illustrates the complementarity of the nucleotide sequences of COL4A5 BINDING SITE, designated SEQ ID:18409, to the nucleotide sequence of GAM3027 RNA, herein designated GAM RNA, also designated SEQ ID:242.

Another function of GAM3027 is therefore inhibition of Collagen, type iv, alpha 5 (alport syndrome) (COL4A5, Accession NP_203700.1). Accordingly, utilities of GAM3027 include diagnosis, prevention and treatment of diseases and clinical conditions associated with COL4A5.

Collagen, type iv, alpha 5 (alport syndrome) (COL4A5, Accession NP_000486.1) is another GAM3027 target gene, herein designated TARGET GENE. COL4A5 BINDING SITE is a target binding site found in the 3' untranslated region of multiple transcripts of mRNA encoded by COL4A5, corresponding to a target binding site such as BINDING SITE I, BINDING SITE II or BINDING SITE III of FIG. 8. Table 4 illustrates the complementarity of the nucleotide sequences of COL4A5 BINDING SITE, designated SEQ ID:18409, to the nucleotide sequence of GAM3027 RNA, herein designated GAM RNA, also designated SEQ ID:242.

Another function of GAM3027 is therefore inhibition of Collagen, type iv, alpha 5 (alport syndrome) (COL4A5, Accession NP_000486.1). Accordingly, utilities of GAM3027 include diagnosis, prevention and treatment of diseases and clinical conditions associated with COL4A5.

Collagen, type iv, alpha 5 (alport syndrome) (COL4A5, Accession NP_203699.1) is another GAM3027 target gene, herein designated TARGET GENE. COL4A5 BINDING SITE is a target binding site found in the 3' untranslated region of multiple transcripts of mRNA encoded by COL4A5, corresponding to a target binding site such as BINDING SITE I, BINDING SITE II or BINDING SITE III of FIG. 8. Table 4 illustrates the complementarity of the nucleotide sequences of COL4A5 BINDING SITE, designated SEQ ID:18409, to the nucleotide sequence of GAM3027 RNA, herein designated GAM RNA, also designated SEQ ID:242.

Another function of GAM3027 is therefore inhibition of Collagen, type iv, alpha 5 (alport syndrome) (COL4A5, Accession NP_203699.1). Accordingly, utilities of GAM3027 include diagnosis, prevention and treatment of diseases and clinical conditions associated with COL4A5.

Collagen, type v, alpha 2 (COL5A2, Accession NP_000384.1) is another GAM3027 target gene, herein designated TARGET GENE. COL5A2 BINDING SITE is a target binding site found in the 5' untranslated region of mRNA encoded by COL5A2, corresponding to a target binding site such as BINDING SITE I, BINDING SITE II or BINDING SITE III of FIG. 8. Table 4 illustrates the complementarity of the nucleotide sequences of COL5A2 BINDING SITE, designated SEQ ID:17367, to the nucleotide sequence of GAM3027 RNA, herein designated GAM RNA, also designated SEQ ID:242.

Another function of GAM3027 is therefore inhibition of Collagen, type v, alpha 2 (COL5A2, Accession NP_000384.1). Accordingly, utilities of GAM3027 include diagnosis, prevention and treatment of diseases and clinical conditions associated with COL5A2.

Collagen, type vi, alpha 3 (COL6A3, Accession NP_476507.1) is another GAM3027 target gene, herein designated TARGET GENE. COL6A3 BINDING SITE is a target binding site found in the 3' untranslated region of multiple transcripts of mRNA encoded by COL6A3, corresponding to a target binding site such as BINDING SITE I, BINDING SITE II or BINDING SITE III of FIG. 8. Table 4 illustrates the complementarity of the nucleotide sequences of COL6A3 BINDING SITE, designated SEQ ID:16712, to the nucleotide sequence of GAM3027 RNA, herein designated GAM RNA, also designated SEQ ID:242.

Another function of GAM3027 is therefore inhibition of Collagen, type vi, alpha 3 (COL6A3, Accession NP_476507.1). Accordingly, utilities of GAM3027 include diagnosis, prevention and treatment of diseases and clinical conditions associated with COL6A3.

Collagen, type vi, alpha 3 (COL6A3, Accession NP_476505.1) is another GAM3027 target gene, herein designated TARGET GENE. COL6A3 BINDING SITE is a target binding site found in the 3' untranslated region of multiple transcripts of mRNA encoded by COL6A3, corresponding to a target binding site such as BINDING SITE I, BINDING SITE II or BINDING SITE III of FIG. 8. Table 4 illustrates the complementarity of the nucleotide sequences of COL6A3 BINDING SITE, designated SEQ ID:16712, to the nucleotide sequence of GAM3027 RNA, herein designated GAM RNA, also designated SEQ ID:242.

Another function of GAM3027 is therefore inhibition of Collagen, type vi, alpha 3 (COL6A3, Accession NP_476505.1). Accordingly, utilities of GAM3027 include diagnosis, prevention and treatment of diseases and clinical conditions associated with COL6A3.

Collagen, type vi, alpha 3 (COL6A3, Accession NP_004360.1) is another GAM3027 target gene, herein designated TARGET GENE. COL6A3 BINDING SITE is a target binding site found in the 3' untranslated region of multiple transcripts of mRNA encoded by COL6A3, corresponding to a target binding site such as BINDING SITE I, BINDING SITE II or BINDING SITE III of FIG. 8. Table 4 illustrates the complementarity of the nucleotide sequences of COL6A3 BINDING SITE, designated SEQ ID:16712, to the nucleotide sequence of GAM3027 RNA, herein designated GAM RNA, also designated SEQ ID:242.

Another function of GAM3027 is therefore inhibition of Collagen, type vi, alpha 3 (COL6A3, Accession NP_004360.1). Accordingly, utilities of GAM3027 include diagnosis, prevention and treatment of diseases and clinical conditions associated with COL6A3.

Collagen, type vi, alpha 3 (COL6A3, Accession NP_476506.1) is another GAM3027 target gene, herein designated TARGET GENE. COL6A3 BINDING SITE is a target binding site found in the 3' untranslated region of multiple transcripts of mRNA encoded by COL6A3, corresponding to a target binding site such as BINDING SITE I, BINDING SITE II or BINDING SITE III of FIG. 8. Table 4 illustrates the complementarity of the nucleotide sequences of COL6A3 BINDING SITE, designated SEQ ID:16712, to the nucleotide sequence of GAM3027 RNA, herein designated GAM RNA, also designated SEQ ID:242.

Another function of GAM3027 is therefore inhibition of Collagen, type vi, alpha 3 (COL6A3, Accession NP_476506.1). Accordingly, utilities of GAM3027 include diagnosis, prevention and treatment of diseases and clinical conditions associated with COL6A3.

Collagen, type vi, alpha 3 (COL6A3, Accession NP_476508.1) is another GAM3027 target gene, herein designated TARGET GENE. COL6A3 BINDING SITE is a target binding site found in the 3' untranslated region of multiple transcripts of mRNA encoded by COL6A3, corresponding to a target binding site such as BINDING SITE I, BINDING SITE II or BINDING SITE III of FIG. 8. Table 4 illustrates the complementarity of the nucleotide sequences of COL6A3 BINDING SITE, designated SEQ ID:16712, to the nucleotide sequence of GAM3027 RNA, herein designated GAM RNA, also designated SEQ ID:242.

Another function of GAM3027 is therefore inhibition of Collagen, type vi, alpha 3 (COL6A3, Accession NP_476508.1). Accordingly, utilities of GAM3027 include diagnosis, prevention and treatment of diseases and clinical conditions associated with COL6A3.

Chondroitin sulfate proteoglycan 4 (melanoma-associated) (CSPG4, Accession NP_001888.1) is another GAM3027 target gene, herein designated TARGET GENE. CSPG4 BINDING SITE is a target binding site found in the 3' untranslated region of mRNA encoded by CSPG4, corresponding to a target binding site such as BINDING SITE I, BINDING SITE II or BINDING SITE III of FIG. 8. Table 4 illustrates the complementarity of the nucleotide sequences of CSPG4 BINDING SITE, designated SEQ ID:1254, to the nucleotide sequence of GAM3027 RNA, herein designated GAM RNA, also designated SEQ ID:242.

Another function of GAM3027 is therefore inhibition of Chondroitin sulfate proteoglycan 4 (melanoma-associated) (CSPG4, Accession NP_001888.1), a gene which plays a role in stabilizing cell-substratum interactions. and therefore may be associated with Childhood acute lymphoblastic leukemias. Accordingly, utilities of GAM3027 include diagnosis, prevention and treatment of Childhood acute lymphoblastic leukemias, and of other diseases and clinical conditions associated with CSPG4.

The function of CSPG4 and its association with various diseases and clinical conditions, has been established by previous studies, as described hereinabove with reference to GAM579.1. CYCS (Accession NP_061820.1) is another GAM3027 target gene, herein designated TARGET GENE. CYCS BINDING SITE is a target binding site found in the 3' untranslated region of mRNA encoded by CYCS, corresponding to a target binding site such as BINDING SITE I, BINDING SITE II or BINDING SITE III of FIG. 8. Table 4 illustrates the complementarity of the nucleotide sequences of CYCS BINDING SITE, designated SEQ ID:1967, to the nucleotide sequence of GAM3027 RNA, herein designated GAM RNA, also designated SEQ ID:242.

Another function of GAM3027 is therefore inhibition of CYCS (Accession NP_061820.1). Accordingly, utilities of GAM3027 include diagnosis, prevention and treatment of diseases and clinical conditions associated with CYCS.

Dead/h (asp-glu-ala-asp/his) box polypeptide 4 (DDX4, Accession NP_077726.1) is another GAM3027 target gene, herein designated TARGET GENE. DDX4 BINDING SITE1 and DDX4 BINDING SITE2 are target binding sites found in untranslated regions of multiple transcripts of mRNA encoded by DDX4, corresponding to target binding sites such as BINDING SITE I, BINDING SITE II or BINDING SITE III of FIG. 8. Table 4 illustrates the complementarity of the nucleotide sequences of DDX4 BINDING SITE1 and DDX4 BINDING SITE2, designated SEQ ID:4569 and SEQ ID:14219 respectively, to the nucleotide sequence of GAM3027 RNA, herein designated GAM RNA, also designated SEQ ID:242.

Another function of GAM3027 is therefore inhibition of Dead/h (asp-glu-ala-asp/his) box polypeptide 4 (DDX4, Accession NP_077726.1). Accordingly, utilities of GAM3027 include diagnosis, prevention and treatment of diseases and clinical conditions associated with DDX4.

DKFZp434O0515 (Accession NP_835224.1) is another GAM3027 target gene, herein designated TARGET GENE. DKFZp434O0515 BINDING SITE is a target binding site found in the 3' untranslated region of mRNA encoded by DKFZp434O0515, corresponding to a target binding site such as BINDING SITE I, BINDING SITE II or BINDING SITE III of FIG. 8. Table 4 illustrates the complementarity of the nucleotide sequences of DKFZp434O0515 BINDING SITE, designated SEQ ID:2186, to the nucleotide sequence of GAM3027 RNA, herein designated GAM RNA, also designated SEQ ID:242.

Another function of GAM3027 is therefore inhibition of DKFZp434O0515 (Accession NP_835224.1). Accordingly, utilities of GAM3027 include diagnosis, prevention and treatment of diseases and clinical conditions associated with DKFZp434O0515.

EBRP (Accession NP_115954.1) is another GAM3027 target gene, herein designated TARGET GENE. EBRP BINDING SITE is a target binding site found in the 3' untranslated region of mRNA encoded by EBRP, corresponding to a target binding site such as BINDING SITE I, BINDING SITE II or BINDING SITE III of FIG. 8. Table 4 illustrates the complementarity of the nucleotide sequences of EBRP BINDING SITE, designated SEQ ID:13938, to the nucleotide sequence of GAM3027 RNA, herein designated GAM RNA, also designated SEQ ID:242.

Another function of GAM3027 is therefore inhibition of EBRP (Accession NP_115954.1). Accordingly, utilities of GAM3027 include diagnosis, prevention and treatment of diseases and clinical conditions associated with EBRP.

ESDN (Accession NP_563615.2) is another GAM3027 target gene, herein designated TARGET GENE. ESDN BINDING SITE is a target binding site found in the 3' untranslated region of mRNA encoded by ESDN, corresponding to a target binding site such as BINDING SITE I, BINDING SITE II or BINDING SITE III of FIG. 8. Table 4 illustrates the complementarity of the nucleotide sequences of ESDN BINDING SITE, designated SEQ ID:700, to the nucleotide sequence of GAM3027 RNA, herein designated GAM RNA, also designated SEQ ID:242.

Another function of GAM3027 is therefore inhibition of ESDN (Accession NP_563615.2). Accordingly, utilities of GAM3027 include diagnosis, prevention and treatment of diseases and clinical conditions associated with ESDN.

Endothelial cell-specific molecule 1 (ESM1, Accession NP_008967.1) is another GAM3027 target gene, herein designated TARGET GENE. ESM1 BINDING SITE is a target binding site found in the 3' untranslated region of mRNA encoded by ESM1, corresponding to a target binding site such as BINDING SITE I, BINDING SITE II or BINDING SITE III of FIG. 8. Table 4 illustrates the complementarity of the nucleotide sequences of ESM1 BINDING SITE, designated SEQ ID:11981, to the nucleotide sequence of GAM3027 RNA, herein designated GAM RNA, also designated SEQ ID:242.

Another function of GAM3027 is therefore inhibition of Endothelial cell-specific molecule 1 (ESM1, Accession NP_008967.1) . Accordingly, utilities of GAM3027 include diagnosis, prevention and treatment of diseases and clinical conditions associated with ESM1.

Fgd1 family, member 2 (FGD2, Accession NP_775829.1) is another GAM3027 target gene, herein designated TARGET GENE. FGD2 BINDING SITE is a target binding site found in the 3' untranslated region of mRNA encoded by FGD2, corresponding to a target binding site such as BINDING SITE I, BINDING SITE II or BINDING SITE III of FIG. 8. Table 4 illustrates the complementarity of the nucleotide sequences of FGD2 BINDING SITE, designated SEQ ID:8607, to the nucleotide sequence of GAM3027 RNA, herein designated GAM RNA, also designated SEQ ID:242.

Another function of GAM3027 is therefore inhibition of Fgd1 family, member 2 (FGD2, Accession NP_775829.1). Accordingly, utilities of GAM3027 include diagnosis, prevention and treatment of diseases and clinical conditions associated with FGD2.

FLJ10251 (Accession NP_060509.1) is another GAM3027 target gene, herein designated TARGET GENE. FLJ10251 BINDING SITE is a target binding site found in the 5' untranslated region of mRNA encoded by FLJ10251, corresponding to a target binding site such as BINDING SITE I, BINDING SITE II or BINDING SITE III of FIG. 8. Table 4 illustrates the complementarity of the nucleotide sequences of FLJ10251 BINDING SITE, designated SEQ ID:11858, to the nucleotide sequence of GAM3027 RNA, herein designated GAM RNA, also designated SEQ ID:242.

Another function of GAM3027 is therefore inhibition of FLJ10251 (Accession NP_060509.1). Accordingly, utilities of GAM3027 include diagnosis, prevention and treatment of diseases and clinical conditions associated with FLJ10251.

FLJ10292 (Accession NP_060518.1) is another GAM3027 target gene, herein designated TARGET GENE. FLJ10292 BINDING SITE is a target binding site found in the 3' untranslated region of mRNA encoded by FLJ10292, corresponding to a target binding site such as BINDING SITE I, BINDING SITE II or BINDING SITE III of FIG. 8. Table 4 illustrates the complementarity of the nucleotide sequences of FLJ10292 BINDING SITE, designated SEQ ID:3351, to the nucleotide sequence of GAM3027 RNA, herein designated GAM RNA, also designated SEQ ID:242.

Another function of GAM3027 is therefore inhibition of FLJ10292 (Accession NP_060518.1). Accordingly, utilities of GAM3027 include diagnosis, prevention and treatment of diseases and clinical conditions associated with FLJ10292.

FLJ10404 (Accession NP_061930.1) is another GAM3027 target gene, herein designated TARGET GENE. FLJ10404 BINDING SITE is a target binding site found in the 3' untranslated region of mRNA encoded by FLJ10404, corresponding to a target binding site such as BINDING SITE I, BINDING SITE II or BINDING SITE III of FIG. 8. Table 4 illustrates the complementarity of the nucleotide sequences of FLJ10404 BINDING SITE, designated SEQ ID:2867, to the nucleotide sequence of GAM3027 RNA, herein designated GAM RNA, also designated SEQ ID:242.

Another function of GAM3027 is therefore inhibition of FLJ10404 (Accession NP_061930.1). Accordingly, utilities of GAM3027 include diagnosis, prevention and treatment of diseases and clinical conditions associated with FLJ10404.

FLJ25555 (Accession NP_689558.2) is another GAM3027 target gene, herein designated TARGET GENE. FLJ25555 BINDING SITE is a target binding site found in the 3' untranslated region of mRNA encoded by FLJ25555, corresponding to a target binding site such as BINDING SITE I, BINDING SITE II or BINDING SITE III of FIG. 8. Table 4 illustrates the complementarity of the nucleotide sequences of FLJ25555 BINDING SITE, designated SEQ ID:14472, to the nucleotide sequence of GAM3027 RNA, herein designated GAM RNA, also designated SEQ ID:242.

Another function of GAM3027 is therefore inhibition of FLJ25555 (Accession NP_689558.2). Accordingly, utilities of GAM3027 include diagnosis, prevention and treatment of diseases and clinical conditions associated with FLJ25555.

FLJ32468 (Accession NP_660090.1) is another GAM3027 target gene, herein designated TARGET GENE. FLJ32468 BINDING SITE is a target binding site found in the 3' untranslated region of mRNA encoded by FLJ32468, corresponding to a target binding site such as BINDING SITE I, BINDING SITE II or BINDING SITE III of FIG. 8. Table 4 illustrates the complementarity of the nucleotide sequences of FLJ32468 BINDING SITE, designated SEQ ID:5290, to the nucleotide sequence of GAM3027 RNA, herein designated GAM RNA, also designated SEQ ID:242.

Another function of GAM3027 is therefore inhibition of FLJ32468 (Accession NP_660090.1). Accordingly, utilities of GAM3027 include diagnosis, prevention and treatment of diseases and clinical conditions associated with FLJ32468.

FLJ34922 (Accession NP_689483.1) is another GAM3027 target gene, herein designated TARGET GENE. FLJ34922 BINDING SITE is a target binding site found in the 5' untranslated region of mRNA encoded by FLJ34922, corresponding to a target binding site such as BINDING SITE I, BINDING SITE II or BINDING SITE III of FIG. 8. Table 4 illustrates the complementarity of the nucleotide sequences of FLJ34922 BINDING SITE, designated SEQ ID:13523, to the nucleotide sequence of GAM3027 RNA, herein designated GAM RNA, also designated SEQ ID:242.

Another function of GAM3027 is therefore inhibition of FLJ34922 (Accession NP_689483.1). Accordingly, utilities of GAM3027 include diagnosis, prevention and treatment of diseases and clinical conditions associated with FLJ34922.

FLJ36000 (Accession NP_787101.1) is another GAM3027 target gene, herein designated TARGET GENE. FLJ36000 BINDING SITE is a target binding site found in the 3' untranslated region of mRNA encoded by FLJ36000, corresponding to a target binding site such as BINDING SITE I, BINDING SITE II or BINDING SITE III of FIG. 8. Table 4 illustrates the complementarity of the nucleotide sequences of FLJ36000 BINDING SITE, designated SEQ ID:11041, to the nucleotide sequence of GAM3027 RNA, herein designated GAM RNA, also designated SEQ ID:242.

Another function of GAM3027 is therefore inhibition of FLJ36000 (Accession NP_787101.1). Accordingly, utilities of GAM3027 include diagnosis, prevention and treatment of diseases and clinical conditions associated with FLJ36000.

FLJ36331 (Accession XP_211925.1) is another GAM3027 target gene, herein designated TARGET GENE. FLJ36331 BINDING SITE is a target binding site found in the 3' untranslated region of mRNA encoded by FLJ36331, corresponding to a target binding site such as BINDING SITE I, BINDING SITE II or BINDING SITE III of FIG. 8. Table 4 illustrates the complementarity of the nucleotide sequences of FLJ36331 BINDING SITE, designated SEQ ID:13204, to the nucleotide sequence of GAM3027 RNA, herein designated GAM RNA, also designated SEQ ID:242.

Another function of GAM3027 is therefore inhibition of FLJ36331 (Accession XP_211925.1). Accordingly, utilities of GAM3027 include diagnosis, prevention and treatment of diseases and clinical conditions associated with FLJ36331.

Udp-n-acetyl-alpha-d-galactosamine:polypeptide n-acetylgalactosaminyltransferase 8 (galnac-t8) (GALNT8, Accession NP_059113.1) is another GAM3027 target gene, herein designated TARGET GENE. GALNT8 BINDING SITE is a target binding site found in the 3' untranslated region of mRNA encoded by GALNT8, corresponding to a target binding site such as BINDING SITE I, BINDING SITE II or BINDING SITE III of FIG. 8. Table 4 illustrates the complementarity of the nucleotide sequences of GALNT8 BINDING SITE, designated SEQ ID:10446, to the nucleotide sequence of GAM3027 RNA, herein designated GAM RNA, also designated SEQ ID:242.

Another function of GAM3027 is therefore inhibition of Udp-n-acetyl-alpha-d-galactosamine:polypeptide n-acetylgalactosaminyltransferase 8 (galnac-t8) (GALNT8, Accession NP_059113.1). Accordingly, utilities of GAM3027 include diagnosis, prevention and treatment of diseases and clinical conditions associated with GALNT8.

HBP1 (Accession NP_036389.2) is another GAM3027 target gene, herein designated TARGET GENE. HBP1 BINDING SITE is a target binding site found in the 3' untranslated region of mRNA encoded by HBP1, corresponding to a target binding site such as BINDING SITE I, BINDING SITE II or BINDING SITE III of FIG. 8. Table 4 illustrates the complementarity of the nucleotide sequences of HBP1 BINDING SITE, designated SEQ ID:16151, to the nucleotide sequence of GAM3027 RNA, herein designated GAM RNA, also designated SEQ ID:242.

Another function of GAM3027 is therefore inhibition of HBP1 (Accession NP_036389.2). Accordingly, utilities of GAM3027 include diagnosis, prevention and treatment of diseases and clinical conditions associated with HBP1.

Hepatic leukemia factor (HLF, Accession NP_002117.1) is another GAM3027 target gene, herein designated TARGET GENE. HLF BINDING SITE is a target binding site found in the 3' untranslated region of mRNA encoded by HLF, corresponding to a target binding site such as BINDING SITE I, BINDING SITE II or BINDING SITE III of FIG. 8. Table 4 illustrates the complementarity of the nucleotide sequences of HLF BINDING SITE, designated SEQ ID:18455, to the nucleotide sequence of GAM3027 RNA, herein designated GAM RNA, also designated SEQ ID:242.

Another function of GAM3027 is therefore inhibition of Hepatic leukemia factor (HLF, Accession NP_002117.1). Accordingly, utilities of GAM3027 include diagnosis, prevention and treatment of diseases and clinical conditions associated with HLF.

Integrin, alpha d (ITGAD, Accession XP_113880.1) is another GAM3027 target gene, herein designated TARGET GENE. ITGAD BINDING SITE is a target binding site found in the 3' untranslated region of mRNA encoded by ITGAD, corresponding to a target binding site such as BINDING SITE I, BINDING SITE II or BINDING SITE III of FIG. 8. Table 4 illustrates the complementarity of the nucleotide sequences of ITGAD BINDING SITE, designated SEQ ID:7734, to the nucleotide sequence of GAM3027 RNA, herein designated GAM RNA, also designated SEQ ID:242.

Another function of GAM3027 is therefore inhibition of Integrin, alpha d (ITGAD, Accession XP_113880.1). Accordingly, utilities of GAM3027 include diagnosis, prevention and treatment of diseases and clinical conditions associated with ITGAD.

Inositol 1,4,5-triphosphate receptor, type 1 (ITPR1, Accession NP_002213.1) is another GAM3027 target gene, herein designated TARGET GENE. ITPR1 BINDING SITE is a target binding site found in the 3' untranslated region of mRNA encoded by ITPR1, corresponding to a target binding site such as BINDING SITE I, BINDING SITE II or BINDING SITE III of FIG. 8. Table 4 illustrates the complementarity of the nucleotide sequences of ITPR1 BINDING SITE, designated SEQ ID:623, to the nucleotide sequence of GAM3027 RNA, herein designated GAM RNA, also designated SEQ ID:242.

Another function of GAM3027 is therefore inhibition of Inositol 1,4,5-triphosphate receptor, type 1 (ITPR1, Accession NP_002213.1), a gene which couples cell membrane receptors to Ca2+ signal transduction pathways. and therefore may be associated with Ataxia and epileptic seizures. Accordingly, utilities of GAM3027 include diagnosis, prevention and treatment of Ataxia and epileptic seizures, and of other diseases and clinical conditions associated with ITPR1.

The function of ITPR1 and its association with various diseases and clinical conditions, has been established by previous studies, as described hereinabove with reference to GAM404.2. Potassium voltage-gated channel, subfamily h (eag-related), member 7 (KCNH7, Accession NP_775185.1) is another GAM3027 target gene, herein designated TARGET GENE. KCNH7 BINDING SITE is a target binding site found in the 5' untranslated region of multiple transcripts of mRNA encoded by KCNH7, corresponding to a target binding site such as BINDING SITE I, BINDING SITE II or BINDING SITE III of FIG. 8. Table 4 illustrates the complementarity of the nucleotide sequences of KCNH7 BINDING SITE, designated SEQ ID:11768, to the nucleotide sequence of GAM3027 RNA, herein designated GAM RNA, also designated SEQ ID:242.

Another function of GAM3027 is therefore inhibition of Potassium voltage-gated channel, subfamily h (eag-related), member 7 (KCNH7, Accession NP_775185.1). Accordingly, utilities of GAM3027 include diagnosis, prevention and treatment of diseases and clinical conditions associated with KCNH7.

Potassium voltage-gated channel, subfamily h (eag-related), member 7 (KCNH7, Accession NP_150375.2) is another GAM3027 target gene, herein designated TARGET GENE. KCNH7 BINDING SITE is a target binding site found in the 5' untranslated region of multiple transcripts of mRNA encoded by KCNH7, corresponding to a target binding site such as BINDING SITE I, BINDING SITE II or BINDING SITE III of FIG. 8. Table 4 illustrates the complementarity of the nucleotide sequences of KCNH7 BINDING SITE, designated SEQ ID:11768, to the nucleotide sequence of GAM3027 RNA, herein designated GAM RNA, also designated SEQ ID:242.

Another function of GAM3027 is therefore inhibition of Potassium voltage-gated channel, subfamily h (eag-related), member 7 (KCNH7, Accession NP_150375.2). Accordingly, utilities of GAM3027 include diagnosis, prevention and treatment of diseases and clinical conditions associated with KCNH7.

KIAA0125 (Accession NP_055607.1) is another GAM3027 target gene, herein designated TARGET GENE. KIAA0125 BINDING SITE is a target binding site found in the 3' untranslated region of mRNA encoded by KIAA0125, corresponding to a target binding site such as BINDING SITE I, BINDING SITE II or BINDING SITE III of FIG. 8. Table 4 illustrates the complementarity of the nucleotide sequences of KIAA0125 BINDING SITE, designated SEQ ID:16707, to the nucleotide sequence of GAM3027 RNA, herein designated GAM RNA, also designated SEQ ID:242.

Another function of GAM3027 is therefore inhibition of KIAA0125 (Accession NP_055607.1). Accordingly, utilities of GAM3027 include diagnosis, prevention and treatment of diseases and clinical conditions associated with KIAA0125.

KIAA0256 (Accession XP_034905.1) is another GAM3027 target gene, herein designated TARGET GENE. KIAA0256 BINDING SITE is a target binding site found in the 3' untranslated region of mRNA encoded by KIAA0256, corresponding to a target binding site such as BINDING SITE I, BINDING SITE II or BINDING SITE III of FIG. 8. Table 4 illustrates the complementarity of the nucleotide sequences of KIAA0256 BINDING SITE, designated SEQ ID:16077, to the nucleotide sequence of GAM3027 RNA, herein designated GAM RNA, also designated SEQ ID:242.

Another function of GAM3027 is therefore inhibition of KIAA0256 (Accession XP_034905.1). Accordingly, utilities of GAM3027 include diagnosis, prevention and treatment of diseases and clinical conditions associated with KIAA0256.

KIAA1399 (Accession XP_046685.4) is another GAM3027 target gene, herein designated TARGET GENE. KIAA1399 BINDING SITE is a target binding site found in the 3' untranslated region of mRNA encoded by KIAA1399, corresponding to a target binding site such as BINDING SITE I, BINDING SITE II or BINDING SITE III of FIG. 8. Table 4 illustrates the complementarity of the nucleotide sequences of KIAA1399 BINDING SITE, designated SEQ ID:18563, to the nucleotide sequence of GAM3027 RNA, herein designated GAM RNA, also designated SEQ ID:242.

Another function of GAM3027 is therefore inhibition of KIAA1399 (Accession XP_046685.4). Accordingly, utilities of GAM3027 include diagnosis, prevention and treatment of diseases and clinical conditions associated with KIAA1399.

KIAA1666 (Accession XP_036936.1) is another GAM3027 target gene, herein designated TARGET GENE. KIAA1666 BINDING SITE is a target binding site found in the 3' untranslated region of mRNA encoded by KIAA1666, corresponding to a target binding site such as BINDING SITE I, BINDING SITE II or BINDING SITE III of FIG. 8. Table 4 illustrates the complementarity of the nucleotide sequences of KIAA1666 BINDING SITE, designated SEQ ID:2583, to the nucleotide sequence of GAM3027 RNA, herein designated GAM RNA, also designated SEQ ID:242.

Another function of GAM3027 is therefore inhibition of KIAA1666 (Accession XP_036936.1). Accordingly, utilities of GAM3027 include diagnosis, prevention and treatment of diseases and clinical conditions associated with KIAA1666.

KIAA2022 (Accession XP_291326.1) is another GAM3027 target gene, herein designated TARGET GENE. KIAA2022 BINDING SITE is a target binding site found in the 3' untranslated region of mRNA encoded by KIAA2022, corresponding to a target binding site such as BINDING SITE I, BINDING SITE II or BINDING SITE III of FIG. 8. Table 4 illustrates the complementarity of the nucleotide sequences of KIAA2022 BINDING SITE, designated SEQ ID:14473, to the nucleotide sequence of GAM3027 RNA, herein designated GAM RNA, also designated SEQ ID:242.

Another function of GAM3027 is therefore inhibition of KIAA2022 (Accession XP_291326.1). Accordingly, utilities of GAM3027 include diagnosis, prevention and treatment of diseases and clinical conditions associated with KIAA2022.

Kruppel-like factor 12 (KLF12, Accession NP_009180.3) is another GAM3027 target gene, herein designated TARGET GENE. KLF12 BINDING SITE is a target binding site found in the 3' untranslated region of multiple transcripts of mRNA encoded by KLF12, corresponding to a target binding site such as BINDING SITE I, BINDING SITE II or BINDING SITE III of FIG. 8. Table 4 illustrates the complementarity of the nucleotide sequences of KLF12 BINDING SITE, designated SEQ ID:19711, to the nucleotide sequence of GAM3027 RNA, herein designated GAM RNA, also designated SEQ ID:242.

Another function of GAM3027 is therefore inhibition of Kruppel-like factor 12 (KLF12, Accession NP_009180.3). Accordingly, utilities of GAM3027 include diagnosis, prevention and treatment of diseases and clinical conditions associated with KLF12.

Leucine proline-enriched proteoglycan (leprecan) 1 (LEPRE1, Accession NP_071751.2) is another GAM3027 target gene, herein designated TARGET GENE. LEPRE1 BINDING SITE is a target binding site found in the 3' untranslated region of mRNA encoded by LEPRE1, corresponding to a target binding site such as BINDING SITE I, BINDING SITE II or BINDING SITE III of FIG. 8. Table 4 illustrates the complementarity of the nucleotide sequences of LEPRE1 BINDING SITE, designated SEQ ID:12458, to the nucleotide sequence of GAM3027 RNA, herein designated GAM RNA, also designated SEQ ID:242.

Another function of GAM3027 is therefore inhibition of Leucine proline-enriched proteoglycan (leprecan) 1 (LEPRE1, Accession NP_071751.2). Accordingly, utilities of GAM3027 include diagnosis, prevention and treatment of diseases and clinical conditions associated with LEPRE1.

LOC150221 (Accession XP_036942.1) is another GAM3027 target gene, herein designated TARGET GENE. LOC150221 BINDING SITE is a target binding site found in the 3' untranslated region of mRNA encoded by LOC150221, corresponding to a target binding site such as BINDING SITE I, BINDING SITE II or BINDING SITE III of FIG. 8. Table 4 illustrates the complementarity of the nucleotide sequences of LOC150221 BINDING SITE, designated SEQ ID:2583, to the nucleotide sequence of GAM3027 RNA, herein designated GAM RNA, also designated SEQ ID:242.

Another function of GAM3027 is therefore inhibition of LOC150221 (Accession XP_036942.1). Accordingly, utilities of GAM3027 include diagnosis, prevention and treatment of diseases and clinical conditions associated with LOC150221.

LOC151720 (Accession XP_087279.6) is another GAM3027 target gene, herein designated TARGET GENE. LOC151720 BINDING SITE is a target binding site found in the 5' untranslated region of mRNA encoded by LOC151720, corresponding to a target binding site such as BINDING SITE I, BINDING SITE II or BINDING SITE III of FIG. 8. Table 4 illustrates the complementarity of the nucleotide sequences of LOC151720 BINDING SITE, designated SEQ ID:12738, to the nucleotide sequence of GAM3027 RNA, herein designated GAM RNA, also designated SEQ ID:242.

Another function of GAM3027 is therefore inhibition of LOC151720 (Accession XP_087279.6). Accordingly, utilities of GAM3027 include diagnosis, prevention and treatment of diseases and clinical conditions associated with LOC151720.

LOC159053 (Accession XP_099021.1) is another GAM3027 target gene, herein designated TARGET GENE. LOC159053 BINDING SITE is a target binding site found in the 3' untranslated region of mRNA encoded by LOC159053, corresponding to a target binding site such as BINDING SITE I, BINDING SITE II or BINDING SITE III of FIG. 8. Table 4 illustrates the complementarity of the nucleotide sequences of LOC159053 BINDING SITE, designated SEQ ID:16816, to the nucleotide sequence of GAM3027 RNA, herein designated GAM RNA, also designated SEQ ID:242.

Another function of GAM3027 is therefore inhibition of LOC159053 (Accession XP_099021.1). Accordingly, utilities of GAM3027 include diagnosis, prevention and treatment of diseases and clinical conditions associated with LOC159053.

LOC222001 (Accession XP_167489.1) is another GAM3027 target gene, herein designated TARGET GENE. LOC222001 BINDING SITE is a target binding site found in the 5' untranslated region of mRNA encoded by LOC222001, corresponding to a target binding site such as BINDING SITE I, BINDING SITE II or BINDING SITE III of FIG. 8. Table 4 illustrates the complementarity of the nucleotide sequences of LOC222001 BINDING SITE, designated SEQ ID:17330, to the nucleotide sequence of GAM3027 RNA, herein designated GAM RNA, also designated SEQ ID:242.

Another function of GAM3027 is therefore inhibition of LOC222001 (Accession XP_167489.1). Accordingly, utilities of GAM3027 include diagnosis, prevention and treatment of diseases and clinical conditions associated with LOC222001.

LOC283120 (Accession XP_208516.1) is another GAM3027 target gene, herein designated TARGET GENE. LOC283120 BINDING SITE is a target binding site found in the 3' untranslated region of mRNA encoded by LOC283120, corresponding to a target binding site such as BINDING SITE I, BINDING SITE II or BINDING SITE III of FIG. 8. Table 4 illustrates the complementarity of the nucleotide sequences of LOC283120 BINDING SITE, designated SEQ ID:5389, to the nucleotide sequence of GAM3027 RNA, herein designated GAM RNA, also designated SEQ ID:242.

Another function of GAM3027 is therefore inhibition of LOC283120 (Accession XP_208516.1). Accordingly, utilities of GAM3027 include diagnosis, prevention and treatment of diseases and clinical conditions associated with LOC283120.

LOC283368 (Accession XP_208080.1) is another GAM3027 target gene, herein designated TARGET GENE. LOC283368 BINDING SITE is a target binding site found in the 3' untranslated region of mRNA encoded by LOC283368, corresponding to a target binding site such as BINDING SITE I, BINDING SITE II or BINDING SITE III of FIG. 8. Table 4 illustrates the complementarity of the nucleotide sequences of LOC283368 BINDING SITE, designated SEQ ID:8708, to the nucleotide sequence of GAM3027 RNA, herein designated GAM RNA, also designated SEQ ID:242.

Another function of GAM3027 is therefore inhibition of LOC283368 (Accession XP_208080.1). Accordingly, utilities of GAM3027 include diagnosis, prevention and treatment of diseases and clinical conditions associated with LOC283368.

LOC283528 (Accession XP_208708.1) is another GAM3027 target gene, herein designated TARGET GENE. LOC283528 BINDING SITE is a target binding site found in the 3' untranslated region of mRNA encoded by LOC283528, corresponding to a target binding site such as BINDING SITE I, BINDING SITE II or BINDING SITE III of FIG. 8. Table 4 illustrates the complementarity of the nucleotide sequences of LOC283528 BINDING SITE, designated SEQ ID:6585, to the nucleotide sequence of GAM3027 RNA, herein designated GAM RNA, also designated SEQ ID:242.

Another function of GAM3027 is therefore inhibition of LOC283528 (Accession XP_208708.1). Accordingly, utilities of GAM3027 include diagnosis, prevention and treatment of diseases and clinical conditions associated with LOC283528.

LOC283570 (Accession XP_211118.1) is another GAM3027 target gene, herein designated TARGET GENE. LOC283570 BINDING SITE is a target binding site found in the 3' untranslated region of mRNA encoded by LOC283570, corresponding to a target binding site such as BINDING SITE I, BINDING SITE II or BINDING SITE III of FIG. 8. Table 4 illustrates the complementarity of the nucleotide sequences of LOC283570 BINDING SITE, designated SEQ ID:4895, to the nucleotide sequence of GAM3027 RNA, herein designated GAM RNA, also designated SEQ ID:242.

Another function of GAM3027 is therefore inhibition of LOC283570 (Accession XP_211118.1). Accordingly, utilities of GAM3027 include diagnosis, prevention and treatment of diseases and clinical conditions associated with LOC283570.

LOC284124 (Accession XP_294862.1) is another GAM3027 target gene, herein designated TARGET GENE. LOC284124 BINDING SITE is a target binding site found in the 3' untranslated region of mRNA encoded by LOC284124, corresponding to a target binding site such as BINDING SITE I, BINDING SITE II or BINDING SITE III of FIG. 8. Table 4 illustrates the complementarity of the nucleotide sequences of LOC284124 BINDING SITE, designated SEQ ID:11041, to the nucleotide sequence of GAM3027 RNA, herein designated GAM RNA, also designated SEQ ID:242.

Another function of GAM3027 is therefore inhibition of LOC284124 (Accession XP_294862.1). Accordingly, utilities of GAM3027 include diagnosis, prevention and treatment of diseases and clinical conditions associated with LOC284124.

LOC284375 (Accession XP_209154.1) is another GAM3027 target gene, herein designated TARGET GENE. LOC284375 BINDING SITE is a target binding site found in the 3' untranslated region of mRNA encoded by LOC284375, corresponding to a target binding site such as BINDING SITE I, BINDING SITE II or BINDING SITE III of FIG. 8. Table 4 illustrates the complementarity of the nucleotide sequences of LOC284375 BINDING SITE, designated SEQ ID:19882, to the nucleotide sequence of GAM3027 RNA, herein designated GAM RNA, also designated SEQ ID:242.

Another function of GAM3027 is therefore inhibition of LOC284375 (Accession XP_209154.1). Accordingly, utilities of GAM3027 include diagnosis, prevention and treatment of diseases and clinical conditions associated with LOC284375.

LOC284463 (Accession XP_210788.1) is another GAM3027 target gene, herein designated TARGET GENE. LOC284463 BINDING SITE is a target binding site found in the 5' untranslated region of mRNA encoded by LOC284463, corresponding to a target binding site such as BINDING SITE I, BINDING SITE II or BINDING SITE III of FIG. 8. Table 4 illustrates the complementarity of the nucleotide sequences of LOC284463 BINDING SITE, designated SEQ ID:8159, to the nucleotide sequence of GAM3027 RNA, herein designated GAM RNA, also designated SEQ ID:242.

Another function of GAM3027 is therefore inhibition of LOC284463 (Accession XP_210788.1). Accordingly, utilities of GAM3027 include diagnosis, prevention and treatment of diseases and clinical conditions associated with LOC284463.

LOC284709 (Accession XP_209331.1) is another GAM3027 target gene, herein designated TARGET GENE. LOC284709 BINDING SITE is a target binding site found in the 3' untranslated region of mRNA encoded by LOC284709, corresponding to a target binding site such as BINDING SITE I, BINDING SITE II or BINDING SITE III of FIG. 8. Table 4 illustrates the complementarity of the nucleotide sequences of LOC284709 BINDING SITE, designated SEQ ID:10590, to the nucleotide sequence of GAM3027 RNA, herein designated GAM RNA, also designated SEQ ID:242.

Another function of GAM3027 is therefore inhibition of LOC284709 (Accession XP_209331.1). Accordingly, utilities of GAM3027 include diagnosis, prevention and treatment of diseases and clinical conditions associated with LOC284709.

LOC285167 (Accession XP_211790.1) is another GAM3027 target gene, herein designated TARGET GENE. LOC285167 BINDING SITE is a target binding site found in the 3' untranslated region of mRNA encoded by LOC285167, corresponding to a target binding site such as BINDING SITE I, BINDING SITE II or BINDING SITE III of FIG. 8. Table 4 illustrates the complementarity of the nucleotide sequences of LOC285167 BINDING SITE, designated SEQ ID:8965, to the nucleotide sequence of GAM3027 RNA, herein designated GAM RNA, also designated SEQ ID:242.

Another function of GAM3027 is therefore inhibition of LOC285167 (Accession XP_211790.1). Accordingly, utilities of GAM3027 include diagnosis, prevention and treatment of diseases and clinical conditions associated with LOC285167.

LOC285695 (Accession XP_209722.1) is another GAM3027 target gene, herein designated TARGET GENE. LOC285695 BINDING SITE is a target binding site found in the 3' untranslated region of mRNA encoded by LOC285695, corresponding to a target binding site such as BINDING SITE I, BINDING SITE II or BINDING SITE III of FIG. 8. Table 4 illustrates the complementarity of the nucleotide sequences of LOC285695 BINDING SITE, designated SEQ ID:9924, to the nucleotide sequence of GAM3027 RNA, herein designated GAM RNA, also designated SEQ ID:242.

Another function of GAM3027 is therefore inhibition of LOC285695 (Accession XP_209722.1). Accordingly, utilities of GAM3027 include diagnosis, prevention and treatment of diseases and clinical conditions associated with LOC285695.

LOC285827 (Accession XP_212604.1) is another GAM3027 target gene, herein designated TARGET GENE. LOC285827 BINDING SITE is a target binding site found in the 5' untranslated region of multiple transcripts of mRNA encoded by LOC285827, corresponding to a target binding site such as BINDING SITE I, BINDING SITE II or BINDING SITE III of FIG. 8. Table 4 illustrates the complementarity of the nucleotide sequences of LOC285827 BINDING SITE, designated SEQ ID:1968, to the nucleotide sequence of GAM3027 RNA, herein designated GAM RNA, also designated SEQ ID:242.

Another function of GAM3027 is therefore inhibition of LOC285827 (Accession XP_212604.1). Accordingly, utilities of GAM3027 include diagnosis, prevention and treatment of diseases and clinical conditions associated with LOC285827.

LOC285827 (Accession XP_212038.1) is another GAM3027 target gene, herein designated TARGET GENE. LOC285827 BINDING SITE is a target binding site found in the 5' untranslated region of multiple transcripts of mRNA encoded by LOC285827, corresponding to a target binding site such as BINDING SITE I, BINDING SITE II or BINDING SITE III of FIG. 8. Table 4 illustrates the complementarity of the nucleotide sequences of LOC285827 BINDING SITE, designated SEQ ID:1968, to the nucleotide sequence of GAM3027 RNA, herein designated GAM RNA, also designated SEQ ID:242.

Another function of GAM3027 is therefore inhibition of LOC285827 (Accession XP_212038.1). Accordingly, utilities of GAM3027 include diagnosis, prevention and treatment of diseases and clinical conditions associated with LOC285827.

LOC285827 (Accession XP_212645.1) is another GAM3027 target gene, herein designated TARGET GENE. LOC285827 BINDING SITE is a target binding site found in the 5' untranslated region of multiple transcripts of mRNA encoded by LOC285827, corresponding to a target binding site such as BINDING SITE I, BINDING SITE II or BINDING SITE III of FIG. 8. Table 4 illustrates the complementarity of the nucleotide sequences of LOC285827 BINDING SITE, designated SEQ ID:1968, to the nucleotide sequence of GAM3027 RNA, herein designated GAM RNA, also designated SEQ ID:242.

Another function of GAM3027 is therefore inhibition of LOC285827 (Accession XP_212645.1). Accordingly, utilities of GAM3027 include diagnosis, prevention and treatment of diseases and clinical conditions associated with LOC285827.

LOC285939 (Accession XP_208364.1) is another GAM3027 target gene, herein designated TARGET GENE. LOC285939 BINDING SITE is a target binding site found in the 3' untranslated region of mRNA encoded by LOC285939, corresponding to a target binding site such as BINDING SITE I, BINDING SITE II or BINDING SITE III of FIG. 8. Table 4 illustrates the complementarity of the nucleotide sequences of LOC285939 BINDING SITE, designated SEQ ID:11415, to the nucleotide sequence of GAM3027 RNA, herein designated GAM RNA, also designated SEQ ID:242.

Another function of GAM3027 is therefore inhibition of LOC285939 (Accession XP_208364.1). Accordingly, utilities of GAM3027 include diagnosis, prevention and treatment of diseases and clinical conditions associated with LOC285939.

LOC286173 (Accession XP_209928.1) is another GAM3027 target gene, herein designated TARGET GENE. LOC286173 BINDING SITE is a target binding site found in the 3' untranslated region of mRNA encoded by LOC286173, corresponding to a target binding site such as BINDING SITE I, BINDING SITE II or BINDING SITE III of FIG. 8. Table 4 illustrates the complementarity of the nucleotide sequences of LOC286173 BINDING SITE, designated SEQ ID:11415, to the nucleotide sequence of GAM3027 RNA, herein designated GAM RNA, also designated SEQ ID:242.

Another function of GAM3027 is therefore inhibition of LOC286173 (Accession XP_209928.1). Accordingly, utilities of GAM3027 include diagnosis, prevention and treatment of diseases and clinical conditions associated with LOC286173.

LOC338921 (Accession XP_290624.1) is another GAM3027 target gene, herein designated TARGET GENE. LOC338921 BINDING SITE is a target binding site found in the 3' untranslated region of mRNA encoded by LOC338921, corresponding to a target binding site such as BINDING SITE I, BINDING SITE II or BINDING SITE III of FIG. 8. Table 4 illustrates the complementarity of the nucleotide sequences of LOC338921 BINDING SITE, designated SEQ ID:19734, to the nucleotide sequence of GAM3027 RNA, herein designated GAM RNA, also designated SEQ ID:242.

Another function of GAM3027 is therefore inhibition of LOC338921 (Accession XP_290624.1). Accordingly, utilities of GAM3027 include diagnosis, prevention and treatment of diseases and clinical conditions associated with LOC338921.

LOC339856 (Accession XP_295087.1) is another GAM3027 target gene, herein designated TARGET GENE. LOC339856 BINDING SITE is a target binding site found in the 3' untranslated region of mRNA encoded by LOC339856, corresponding to a target binding site such as BINDING SITE I, BINDING SITE II or BINDING SITE III of FIG. 8. Table 4 illustrates the complementarity of the nucleotide sequences of LOC339856 BINDING SITE, designated SEQ ID:15901, to the nucleotide sequence of GAM3027 RNA, herein designated GAM RNA, also designated SEQ ID:242.

Another function of GAM3027 is therefore inhibition of LOC339856 (Accession XP_295087.1). Accordingly, utilities of GAM3027 include diagnosis, prevention and treatment of diseases and clinical conditions associated with LOC339856.

LOC340362 (Accession XP_295225.1) is another GAM3027 target gene, herein designated TARGET GENE. LOC340362 BINDING SITE is a target binding site found in the 5' untranslated region of mRNA encoded by LOC340362, corresponding to a target binding site such as BINDING SITE I, BINDING SITE II or BINDING SITE III of FIG. 8. Table 4 illustrates the complementarity of the nucleotide sequences of LOC340362 BINDING SITE, designated SEQ ID:1433, to the nucleotide sequence of GAM3027 RNA, herein designated GAM RNA, also designated SEQ ID:242.

Another function of GAM3027 is therefore inhibition of LOC340362 (Accession XP_295225.1). Accordingly, utilities of GAM3027 include diagnosis, prevention and treatment of diseases and clinical conditions associated with LOC340362.

LOC340428 (Accession XP_290420.1) is another GAM3027 target gene, herein designated TARGET GENE. LOC340428 BINDING SITE is a target binding site found in the 3' untranslated region of mRNA encoded by LOC340428, corresponding to a target binding site such as BINDING SITE I, BINDING SITE II or BINDING SITE III of FIG. 8. Table 4 illustrates the complementarity of the nucleotide sequences of LOC340428 BINDING SITE, designated SEQ ID:7731, to the nucleotide sequence of GAM3027 RNA, herein designated GAM RNA, also designated SEQ ID:242.

Another function of GAM3027 is therefore inhibition of LOC340428 (Accession XP_290420.1). Accordingly, utilities of GAM3027 include diagnosis, prevention and treatment of diseases and clinical conditions associated with LOC340428.

LOC340542 (Accession XP_291335.1) is another GAM3027 target gene, herein designated TARGET GENE. LOC340542 BINDING SITE is a target binding site found in the 5' untranslated region of mRNA encoded by LOC340542, corresponding to a target binding site such as BINDING SITE I, BINDING SITE II or BINDING SITE III of FIG. 8. Table 4 illustrates the complementarity of the nucleotide sequences of LOC340542 BINDING SITE, designated SEQ ID:16315, to the nucleotide sequence of GAM3027 RNA, herein designated GAM RNA, also designated SEQ ID:242.

Another function of GAM3027 is therefore inhibition of LOC340542 (Accession XP_291335.1). Accordingly, utilities of GAM3027 include diagnosis, prevention and treatment of diseases and clinical conditions associated with LOC340542.

LOC348393 (Accession XP_302741.1) is another GAM3027 target gene, herein designated TARGET GENE. LOC348393 BINDING SITE is a target binding site found in the 3' untranslated region of mRNA encoded by LOC348393, corresponding to a target binding site such as BINDING SITE I, BINDING SITE II or BINDING SITE III of FIG. 8. Table 4 illustrates the complementarity of the nucleotide sequences of LOC348393 BINDING SITE, designated SEQ ID:1132, to the nucleotide sequence of GAM3027 RNA, herein designated GAM RNA, also designated SEQ ID:242.

Another function of GAM3027 is therefore inhibition of LOC348393 (Accession XP_302741.1). Accordingly, utilities of GAM3027 include diagnosis, prevention and treatment of diseases and clinical conditions associated with LOC348393.

LOC348532 (Accession XP_302818.1) is another GAM3027 target gene, herein designated TARGET GENE. LOC348532 BINDING SITE is a target binding site found in the 3' untranslated region of mRNA encoded by LOC348532, corresponding to a target binding site such as BINDING SITE I, BINDING SITE II or BINDING SITE III of FIG. 8. Table 4 illustrates the complementarity of the nucleotide sequences of LOC348532 BINDING SITE, designated SEQ ID:1132, to the nucleotide sequence of GAM3027 RNA, herein designated GAM RNA, also designated SEQ ID:242.

Another function of GAM3027 is therefore inhibition of LOC348532 (Accession XP_302818.1). Accordingly, utilities of GAM3027 include diagnosis, prevention and treatment of diseases and clinical conditions associated with LOC348532.

LOC348572 (Accession XP_290964.1) is another GAM3027 target gene, herein designated TARGET GENE. LOC348572 BINDING SITE is a target binding site found in the 5' untranslated region of mRNA encoded by LOC348572, corresponding to a target binding site such as BINDING SITE I, BINDING SITE II or BINDING SITE III of FIG. 8. Table 4 illustrates the complementarity of the nucleotide sequences of LOC348572 BINDING SITE, designated SEQ ID:17835, to the nucleotide sequence of GAM3027 RNA, herein designated GAM RNA, also designated SEQ ID:242.

Another function of GAM3027 is therefore inhibition of LOC348572 (Accession XP_290964.1). Accordingly, utilities of GAM3027 include diagnosis, prevention and treatment of diseases and clinical conditions associated with LOC348572.

LOC348601 (Accession XP_300791.1) is another GAM3027 target gene, herein designated TARGET GENE. LOC348601 BINDING SITE is a target binding site found in the 3' untranslated region of mRNA encoded by LOC348601, corresponding to a target binding site such as BINDING SITE I, BINDING SITE II or BINDING SITE III of FIG. 8. Table 4 illustrates the complementarity of the nucleotide sequences of LOC348601 BINDING SITE, designated SEQ ID:2583, to the nucleotide sequence of GAM3027 RNA, herein designated GAM RNA, also designated SEQ ID:242.

Another function of GAM3027 is therefore inhibition of LOC348601 (Accession XP_300791.1). Accordingly, utilities of GAM3027 include diagnosis, prevention and treatment of diseases and clinical conditions associated with LOC348601.

LOC349667 (Accession XP_303448.1) is another GAM3027 target gene, herein designated TARGET GENE. LOC349667 BINDING SITE is a target binding site found in the 5' untranslated region of mRNA encoded by LOC349667, corresponding to a target binding site such as BINDING SITE I, BINDING SITE II or BINDING SITE III of FIG. 8. Table 4 illustrates the complementarity of the nucleotide sequences of LOC349667 BINDING SITE, designated SEQ ID:9490, to the nucleotide sequence of GAM3027 RNA, herein designated GAM RNA, also designated SEQ ID:242.

Another function of GAM3027 is therefore inhibition of LOC349667 (Accession XP_303448.1). Accordingly, utilities of GAM3027 include diagnosis, prevention and treatment of diseases and clinical conditions associated with LOC349667.

Mesoderm specific transcript homolog (mouse) (MEST, Accession NP_803491.1) is another GAM3027 target gene, herein designated TARGET GENE. MEST BINDING SITE is a target binding site found in the 3' untranslated region of multiple transcripts of mRNA encoded by MEST, corresponding to a target binding site such as BINDING SITE I, BINDING SITE II or BINDING SITE III of FIG. 8. Table 4 illustrates the complementarity of the nucleotide sequences of MEST BINDING SITE, designated SEQ ID:8219, to the nucleotide sequence of GAM3027 RNA, herein designated GAM RNA, also designated SEQ ID:242.

Another function of GAM3027 is therefore inhibition of Mesoderm specific transcript homolog (mouse) (MEST, Accession NP_803491.1), a gene which appears to be required for the appropriate immediate response of females to their pups. Accordingly, utilities of GAM3027 include diagnosis, prevention and treatment of diseases and clinical conditions associated with MEST.

The function of MEST and its association with various diseases and clinical conditions, has been established by previous studies, as described hereinabove with reference to GAM291.1. Mesoderm specific transcript homolog (mouse) (MEST, Accession NP_002393.2) is another GAM3027 target gene, herein designated TARGET GENE. MEST BINDING SITE is a target binding site found in the 3' untranslated region of multiple transcripts of mRNA encoded by MEST, corresponding to a target binding site such as BINDING SITE I, BINDING SITE II or BINDING SITE III of FIG. 8. Table 4 illustrates the complementarity of the nucleotide sequences of MEST BINDING SITE, designated SEQ ID:8219, to the nucleotide sequence of GAM3027 RNA, herein designated GAM RNA, also designated SEQ ID:242.

Another function of GAM3027 is therefore inhibition of Mesoderm specific transcript homolog (mouse) (MEST, Accession NP_002393.2), a gene which appears to be required for the appropriate immediate response of females to their pups. Accordingly, utilities of GAM3027 include diagnosis, prevention and treatment of diseases and clinical conditions associated with MEST.

The function of MEST and its association with various diseases and clinical conditions, has been established by previous studies, as described hereinabove with reference to GAM291.1. Mesoderm specific transcript homolog (mouse) (MEST, Accession NP_803490.1) is another GAM3027 target gene, herein designated TARGET GENE. MEST BINDING SITE is a target binding site found in the 3' untranslated region of multiple transcripts of mRNA encoded by MEST, corresponding to a target binding site such as BINDING SITE I, BINDING SITE II or BINDING SITE III of FIG. 8. Table 4 illustrates the complementarity of the nucleotide sequences of MEST BINDING SITE, designated SEQ ID:8219, to the nucleotide sequence of GAM3027 RNA, herein designated GAM RNA, also designated SEQ ID:242.

Another function of GAM3027 is therefore inhibition of Mesoderm specific transcript homolog (mouse) (MEST, Accession NP_803490.1), a gene which appears to be required for the appropriate immediate response of females to their pups. Accordingly, utilities of GAM3027 include diagnosis, prevention and treatment of diseases and clinical conditions associated with MEST.

The function of MEST and its association with various diseases and clinical conditions, has been established by previous studies, as described hereinabove with reference to GAM291.1. Methyltransferase-like 1 (METTL1, Accession NP_075421.1) is another GAM3027 target gene, herein designated TARGET GENE. METTL1 BINDING SITE is a target binding site found in the 3' untranslated region of multiple transcripts of mRNA encoded by METTL1, corresponding to a target binding site such as BINDING SITE I, BINDING SITE II or BINDING SITE III of FIG. 8. Table 4 illustrates the complementarity of the nucleotide sequences of METTL1 BINDING SITE, designated SEQ ID:12414, to the nucleotide sequence of GAM3027 RNA, herein designated GAM RNA, also designated SEQ ID:242.

Another function of GAM3027 is therefore inhibition of Methyltransferase-like 1 (METTL1, Accession NP_075421.1). Accordingly, utilities of GAM3027 include diagnosis, prevention and treatment of diseases and clinical conditions associated with METTL1.

MGC22014 (Accession XP_035307.1) is another GAM3027 target gene, herein designated TARGET GENE. MGC22014 BINDING SITE is a target binding site found in the 3' untranslated region of mRNA encoded by MGC22014, corresponding to a target binding site such as BINDING SITE I, BINDING SITE II or BINDING SITE III of FIG. 8. Table 4 illustrates the complementarity of the nucleotide sequences of MGC22014 BINDING SITE, designated SEQ ID:4508, to the nucleotide sequence of GAM3027 RNA, herein designated GAM RNA, also designated SEQ ID:242.

Another function of GAM3027 is therefore inhibition of MGC22014 (Accession XP_035307.1). Accordingly, utilities of GAM3027 include diagnosis, prevention and treatment of diseases and clinical conditions associated with MGC22014.

MGC2705 (Accession NP_116090.2) is another GAM3027 target gene, herein designated TARGET GENE. MGC2705 BINDING SITE is a target binding site found in the 3' untranslated region of mRNA encoded by MGC2705, corresponding to a target binding site such as BINDING SITE I, BINDING SITE II or BINDING SITE III of FIG. 8. Table 4 illustrates the complementarity of the nucleotide sequences of MGC2705 BINDING SITE, designated SEQ ID:1363, to the nucleotide sequence of GAM3027 RNA, herein designated GAM RNA, also designated SEQ ID:242.

Another function of GAM3027 is therefore inhibition of MGC2705 (Accession NP_116090.2). Accordingly, utilities of GAM3027 include diagnosis, prevention and treatment of diseases and clinical conditions associated with MGC2705.

MORF4 (Accession XP_165470.1) is another GAM3027 target gene, herein designated TARGET GENE. MORF4 BINDING SITE is a target binding site found in the 5' untranslated region of mRNA encoded by MORF4, corresponding to a target binding site such as BINDING SITE I, BINDING SITE II or BINDING SITE III of FIG. 8. Table 4 illustrates the complementarity of the nucleotide sequences of MORF4 BINDING SITE, designated SEQ ID:7924, to the nucleotide sequence of GAM3027 RNA, herein designated GAM RNA, also designated SEQ ID:242.

Another function of GAM3027 is therefore inhibition of MORF4 (Accession XP_165470.1). Accordingly, utilities of GAM3027 include diagnosis, prevention and treatment of diseases and clinical conditions associated with MORF4.

Nuclear autoantigenic sperm protein (histone-binding) (NASP, Accession NP_751896.1) is another GAM3027 target gene, herein designated TARGET GENE. NASP BINDING SITE is a target binding site found in the 3' untranslated region of multiple transcripts of mRNA encoded by NASP, corresponding to a target binding site such as BINDING SITE I, BINDING SITE II or BINDING SITE III of FIG. 8. Table 4 illustrates the complementarity of the nucleotide sequences of NASP BINDING SITE, designated SEQ ID:16483, to the nucleotide sequence of GAM3027 RNA, herein designated GAM RNA, also designated SEQ ID:242.

Another function of GAM3027 is therefore inhibition of Nuclear autoantigenic sperm protein (histone-binding) (NASP, Accession NP_751896.1). Accordingly, utilities of GAM3027 include diagnosis, prevention and treatment of diseases and clinical conditions associated with NASP.

Nuclear autoantigenic sperm protein (histone-binding) (NASP, Accession NP_002473.2) is another GAM3027 target gene, herein designated TARGET GENE. NASP BINDING SITE is a target binding site found in the 3' untranslated region of multiple transcripts of mRNA encoded by NASP, corresponding to a target binding site such as BINDING SITE I, BINDING SITE II or BINDING SITE III of FIG. 8. Table 4 illustrates the complementarity of the nucleotide sequences of NASP BINDING SITE, designated SEQ ID:16483, to the nucleotide sequence of GAM3027 RNA, herein designated GAM RNA, also designated SEQ ID:242.

Another function of GAM3027 is therefore inhibition of Nuclear autoantigenic sperm protein (histone-binding) (NASP, Accession NP_002473.2). Accordingly, utilities of GAM3027 include diagnosis, prevention and treatment of diseases and clinical conditions associated with NASP.

Nuclear autoantigenic sperm protein (histone-binding) (NASP, Accession NP_689511.2) is another GAM3027 target gene, herein designated TARGET GENE. NASP BINDING SITE is a target binding site found in the 3' untranslated region of multiple transcripts of mRNA encoded by NASP, corresponding to a target binding site such as BINDING SITE I, BINDING SITE II or BINDING SITE III of FIG. 8. Table 4 illustrates the complementarity of the nucleotide sequences of NASP BINDING SITE, designated SEQ ID:16483, to the nucleotide sequence of GAM3027 RNA, herein designated GAM RNA, also designated SEQ ID:242.

Another function of GAM3027 is therefore inhibition of Nuclear autoantigenic sperm protein (histone-binding) (NASP, Accession NP_689511.2). Accordingly, utilities of GAM3027 include diagnosis, prevention and treatment of diseases and clinical conditions associated with NASP.

Neuron navigator 3 (NAV3, Accession NP_055718.2) is another GAM3027 target gene, herein designated TARGET GENE. NAV3 BINDING SITE is a target binding site found in the 3' untranslated region of mRNA encoded by NAV3, corresponding to a target binding site such as BINDING SITE I, BINDING SITE II or BINDING SITE III of FIG. 8. Table 4 illustrates the complementarity of the nucleotide sequences of NAV3 BINDING SITE, designated SEQ ID:9220, to the nucleotide sequence of GAM3027 RNA, herein designated GAM RNA, also designated SEQ ID:242.

Another function of GAM3027 is therefore inhibition of Neuron navigator 3 (NAV3, Accession NP_055718.2). Accordingly, utilities of GAM3027 include diagnosis, prevention and treatment of diseases and clinical conditions associated with NAV3.

Nuclear receptor coactivator 2 (NCOA2, Accession NP_006531.1) is another GAM3027 target gene, herein designated TARGET GENE. NCOA2 BINDING SITE is a target binding site found in the 5' untranslated region of mRNA encoded by NCOA2, corresponding to a target binding site such as BINDING SITE I, BINDING SITE II or BINDING SITE III of FIG. 8. Table 4 illustrates the complementarity of the nucleotide sequences of NCOA2 BINDING SITE, designated SEQ ID:4666, to the nucleotide sequence of GAM3027 RNA, herein designated GAM RNA, also designated SEQ ID:242.

Another function of GAM3027 is therefore inhibition of Nuclear receptor coactivator 2 (NCOA2, Accession NP_006531.1). Accordingly, utilities of GAM3027 include diagnosis, prevention and treatment of diseases and clinical conditions associated with NCOA2.

Nima (never in mitosis gene a)-related kinase 2 (NEK2, Accession NP_002488.1) is another GAM3027 target gene, herein designated TARGET GENE. NEK2 BINDING SITE is a target binding site found in the 3' untranslated region of mRNA encoded by NEK2, corresponding to a target binding site such as BINDING SITE I, BINDING SITE II or BINDING SITE III of FIG. 8. Table 4 illustrates the complementarity of the nucleotide sequences of NEK2 BINDING SITE, designated SEQ ID:18583, to the nucleotide sequence of GAM3027 RNA, herein designated GAM RNA, also designated SEQ ID:242.

Another function of GAM3027 is therefore inhibition of Nima (never in mitosis gene a)-related kinase 2 (NEK2, Accession NP_002488.1), a gene which is involved in mitotic regulation. Accordingly, utilities of GAM3027 include diagnosis, prevention and treatment of diseases and clinical conditions associated with NEK2.

The function of NEK2 and its association with various diseases and clinical conditions, has been established by previous studies, as described hereinabove with reference to GAM473.1. Polyhomeotic-like 1 (drosophila) (PHC1, Accession NP_004417.1) is another GAM3027 target gene, herein designated TARGET GENE. PHC1 BINDING SITE is a target binding site found in the 3' untranslated region of mRNA encoded by PHC1, corresponding to a target binding site such as BINDING SITE I, BINDING SITE II or BINDING SITE III of FIG. 8. Table 4 illustrates the complementarity of the nucleotide sequences of PHC1 BINDING SITE, designated SEQ ID:8708, to the nucleotide sequence of GAM3027 RNA, herein designated GAM RNA, also designated SEQ ID:242.

Another function of GAM3027 is therefore inhibition of Polyhomeotic-like 1 (drosophila) (PHC1, Accession NP_004417.1). Accordingly, utilities of GAM3027 include diagnosis, prevention and treatment of diseases and clinical conditions associated with PHC1.

Paraneoplastic antigen ma2 (PNMA2, Accession NP_009188.1) is another GAM3027 target gene, herein designated TARGET GENE. PNMA2 BINDING SITE is a target binding site found in the 3' untranslated region of mRNA encoded by PNMA2, corresponding to a target binding site such as BINDING SITE I, BINDING SITE II or BINDING SITE III of FIG. 8. Table 4 illustrates the complementarity of the nucleotide sequences of PNMA2 BINDING SITE, designated SEQ ID:16185, to the nucleotide sequence of GAM3027 RNA, herein designated GAM RNA, also designated SEQ ID:242.

Another function of GAM3027 is therefore inhibition of Paraneoplastic antigen ma2 (PNMA2, Accession NP_009188.1). Accordingly, utilities of GAM3027 include diagnosis, prevention and treatment of diseases and clinical conditions associated with PNMA2.

Protein phosphatase 2, regulatory subunit b (b56), gamma isoform (PPP2R5C, Accession NP_848701.1) is another GAM3027 target gene, herein designated TARGET GENE. PPP2R5C BINDING SITE is a target binding site found in the 3' untranslated region of multiple transcripts of mRNA encoded by PPP2R5C, corresponding to a target binding site such as BINDING SITE I, BINDING SITE II or BINDING SITE III of FIG. 8. Table 4 illustrates the complementarity of the nucleotide sequences of PPP2R5C BINDING SITE, designated SEQ ID:14122, to the nucleotide sequence of GAM3027 RNA, herein designated GAM RNA, also designated SEQ ID:242.

Another function of GAM3027 is therefore inhibition of Protein phosphatase 2, regulatory subunit b (b56), gamma isoform (PPP2R5C, Accession NP_848701.1), a gene which is a regulatory subunit of protein phosphatase 2A. Accordingly, utilities of GAM3027 include diagnosis, prevention and treatment of diseases and clinical conditions associated with PPP2R5C.

The function of PPP2R5C and its association with various diseases and clinical conditions, has been established by previous studies, as described hereinabove with reference to GAM99.1. Protein phosphatase 2, regulatory subunit b (b56), gamma isoform (PPP2R5C, Accession NP_002710.2) is another GAM3027 target gene, herein designated TARGET GENE. PPP2R5C BINDING SITE is a target binding site found in the 3' untranslated region of multiple transcripts of mRNA encoded by PPP2R5C, corresponding to a target binding site such as BINDING SITE I, BINDING SITE II or BINDING SITE III of FIG. 8. Table 4 illustrates the complementarity of the nucleotide sequences of PPP2R5C BINDING SITE, designated SEQ ID:14122, to the nucleotide sequence of GAM3027 RNA, herein designated GAM RNA, also designated SEQ ID:242.

Another function of GAM3027 is therefore inhibition of Protein phosphatase 2, regulatory subunit b (b56), gamma isoform (PPP2R5C, Accession NP_002710.2), a gene which is a regulatory subunit of protein phosphatase 2A. Accordingly, utilities of GAM3027 include diagnosis, prevention and treatment of diseases and clinical conditions associated with PPP2R5C.

The function of PPP2R5C and its association with various diseases and clinical conditions, has been established by previous studies, as described hereinabove with reference to GAM99.1. PRO0132 (Accession NP_054835.1) is another GAM3027 target gene, herein designated TARGET GENE. PRO0132 BINDING SITE is a target binding site found in the 5' untranslated region of mRNA encoded by PRO0132, corresponding to a target binding site such as BINDING SITE I, BINDING SITE II or BINDING SITE III of FIG. 8. Table 4 illustrates the complementarity of the nucleotide sequences of PRO0132 BINDING SITE, designated SEQ ID:18429, to the nucleotide sequence of GAM3027 RNA, herein designated GAM RNA, also designated SEQ ID:242.

Another function of GAM3027 is therefore inhibition of PRO0132 (Accession NP_054835.1). Accordingly, utilities of GAM3027 include diagnosis, prevention and treatment of diseases and clinical conditions associated with PRO0132.

PRO2964 (Accession NP_061017.1) is another GAM3027 target gene, herein designated TARGET GENE. PRO2964 BINDING SITE is a target binding site found in the 5' untranslated region of mRNA encoded by PRO2964, corresponding to a target binding site such as BINDING SITE I, BINDING SITE II or BINDING SITE III of FIG. 8. Table 4 illustrates the complementarity of the nucleotide sequences of PRO2964 BINDING SITE, designated SEQ ID:7172, to the nucleotide sequence of GAM3027 RNA, herein designated GAM RNA, also designated SEQ ID:242.

Another function of GAM3027 is therefore inhibition of PRO2964 (Accession NP_061017.1). Accordingly, utilities of GAM3027 include diagnosis, prevention and treatment of diseases and clinical conditions associated with PRO2964.

Rab30, member ras oncogene family (RAB30, Accession NP_055303.2) is another GAM3027 target gene, herein designated TARGET GENE. RAB30 BINDING SITE is a target binding site found in the 3' untranslated region of mRNA encoded by RAB30, corresponding to a target binding site such as BINDING SITE I, BINDING SITE II or BINDING SITE III of FIG. 8. Table 4 illustrates the complementarity of the nucleotide sequences of RAB30 BINDING SITE, designated SEQ ID:1946, to the nucleotide sequence of GAM3027 RNA, herein designated GAM RNA, also designated SEQ ID:242.

Another function of GAM3027 is therefore inhibition of Rab30, member ras oncogene family (RAB30, Accession NP_055303.2), a gene which is a GTP-binding protein. Accordingly, utilities of GAM3027 include diagnosis, prevention and treatment of diseases and clinical conditions associated with RAB30.

The function of RAB30 and its association with various diseases and clinical conditions, has been established by previous studies, as described hereinabove with reference to GAM129.1. Regulatory factor x-associated protein (RFXAP, Accession NP_000529.1) is another GAM3027 target gene, herein designated TARGET GENE. RFXAP BINDING SITE is a target binding site found in the 3' untranslated region of mRNA encoded by RFXAP, corresponding to a target binding site such as BINDING SITE I, BINDING SITE II or BINDING SITE III of FIG. 8. Table 4 illustrates the complementarity of the nucleotide sequences of RFXAP BINDING SITE, designated SEQ ID:11150, to the nucleotide sequence of GAM3027 RNA, herein designated GAM RNA, also designated SEQ ID:242.

Another function of GAM3027 is therefore inhibition of Regulatory factor x-associated protein (RFXAP, Accession NP_000529.1), a gene which binds to the x-box of mhc ii promoters and is a transcriptional regulator. Accordingly, utilities of GAM3027 include diagnosis, prevention and treatment of diseases and clinical conditions associated with RFXAP.

The function of RFXAP and its association with various diseases and clinical conditions, has been established by previous studies, as described hereinabove with reference to GAM40.2. Ribonuclease, rnase a family, k6 (RNASE6, Accession NP_005606.1) is another GAM3027 target gene, herein designated TARGET GENE. RNASE6 BINDING SITE is a target binding site found in the 5' untranslated region of mRNA encoded by RNASE6, corresponding to a target binding site such as BINDING SITE I, BINDING SITE II or BINDING SITE III of FIG. 8. Table 4 illustrates the complementarity of the nucleotide sequences of RNASE6 BINDING SITE, designated SEQ ID:3045, to the nucleotide sequence of GAM3027 RNA, herein designated GAM RNA, also designated SEQ ID:242.

Another function of GAM3027 is therefore inhibition of Ribonuclease, rnase a family, k6 (RNASE6, Accession NP_005606.1). Accordingly, utilities of GAM3027 include diagnosis, prevention and treatment of diseases and clinical conditions associated with RNASE6.

Ribonuclease l (2',5'-oligoisoadenylate synthetase-dependent) (RNASEL, Accession NP_066956.1) is another GAM3027 target gene, herein designated TARGET GENE. RNASEL BINDING SITE is a target binding site found in the 3' untranslated region of mRNA encoded by RNASEL, corresponding to a target binding site such as BINDING SITE I, BINDING SITE II or BINDING SITE III of FIG. 8. Table 4 illustrates the complementarity of the nucleotide sequences of RNASEL BINDING SITE, designated SEQ ID:12262, to the nucleotide sequence of GAM3027 RNA, herein designated GAM RNA, also designated SEQ ID:242.

Another function of GAM3027 is therefore inhibition of Ribonuclease 1 (2',5'-oligoisoadenylate synthetase-dependent) (RNASEL, Accession NP_066956.1). Accordingly, utilities of GAM3027 include diagnosis, prevention and treatment of diseases and clinical conditions associated with RNASEL.

Rna guanylyltransferase and 5'-phosphatase (RNGTT, Accession NP_003791.1) is another GAM3027 target gene, herein designated TARGET GENE. RNGTT BINDING SITE is a target binding site found in the 3' untranslated region of mRNA encoded by RNGTT, corresponding to a target binding site such as BINDING SITE I, BINDING SITE II or BINDING SITE III of FIG. 8. Table 4 illustrates the complementarity of the nucleotide sequences of RNGTT BINDING SITE, designated SEQ ID:16779, to the nucleotide sequence of GAM3027 RNA, herein designated GAM RNA, also designated SEQ ID:242.

Another function of GAM3027 is therefore inhibition of Rna guanylyltransferase and 5'-phosphatase (RNGTT, Accession NP_003791.1), a gene which is an MRNA capping enzyme; bifunctional enzyme containing both 5'-triphosphatase and mRNA guanylyltransferase activity. Accordingly, utilities of GAM3027 include diagnosis, prevention and treatment of diseases and clinical conditions associated with RNGTT.

The function of RNGTT and its association with various diseases and clinical conditions, has been established by previous studies, as described hereinabove with reference to GAM475.2. Solute carrier family 11 (proton-coupled divalent metal ion transporters), member 2 (SLC11A2, Accession NP_000608.1) is another GAM3027 target gene, herein designated TARGET GENE. SLC11A2 BINDING SITE is a target binding site found in the 3' untranslated region of mRNA encoded by SLC11A2, corresponding to a target binding site such as BINDING SITE I, BINDING SITE II or BINDING SITE III of FIG. 8. Table 4 illustrates the complementarity of the nucleotide sequences of SLC11A2 BINDING SITE, designated SEQ ID:10424, to the nucleotide sequence of GAM3027 RNA, herein designated GAM RNA, also designated SEQ ID:242.

Another function of GAM3027 is therefore inhibition of Solute carrier family 11 (proton-coupled divalent metal ion transporters), member 2 (SLC11A2, Accession NP_000608.1). Accordingly, utilities of GAM3027 include diagnosis, prevention and treatment of diseases and clinical conditions associated with SLC11A2.

Solute carrier family 26, member 7 (SLC26A7, Accession NP_439897.1) is another GAM3027 target gene, herein designated TARGET GENE. SLC26A7 BINDING SITE is a target binding site found in the 3' untranslated region of multiple transcripts of mRNA encoded by SLC26A7, corresponding to a target binding site such as BINDING SITE I, BINDING SITE II or BINDING SITE III of FIG. 8. Table 4 illustrates the complementarity of the nucleotide sequences of SLC26A7 BINDING SITE, designated SEQ ID:19030, to the nucleotide sequence of GAM3027 RNA, herein designated GAM RNA, also designated SEQ ID:242.

Another function of GAM3027 is therefore inhibition of Solute carrier family 26, member 7 (SLC26A7, Accession NP_439897.1). Accordingly, utilities of GAM3027 include diagnosis, prevention and treatment of diseases and clinical conditions associated with SLC26A7.

Solute carrier family 7 (cationic amino acid transporter, y+ system), member 6 (SLC7A6, Accession NP_003974.1) is another GAM3027 target gene, herein designated TARGET GENE. SLC7A6 BINDING SITE is a target binding site found in the 3' untranslated region of mRNA encoded by SLC7A6, corresponding to a target binding site such as BINDING SITE I, BINDING SITE II or BINDING SITE III of FIG. 8. Table 4 illustrates the complementarity of the nucleotide sequences of SLC7A6 BINDING SITE, designated SEQ ID:17897, to the nucleotide sequence of GAM3027 RNA, herein designated GAM RNA, also designated SEQ ID:242.

Another function of GAM3027 is therefore inhibition of Solute carrier family 7 (cationic amino acid transporter, y+ system), member 6 (SLC7A6, Accession NP_003974.1), a gene which is involved in mediating amino acid transport. Accordingly, utilities of GAM3027 include diagnosis, prevention and treatment of diseases and clinical conditions associated with SLC7A6.

The function of SLC7A6 and its association with various diseases and clinical conditions, has been established by previous studies, as described hereinabove with reference to GAM74.1. SNURF-SNRPN (Accession XP_085186.4) is another GAM3027 target gene, herein designated TARGET GENE. SNURF-SNRPN BINDING SITE is a target binding site found in the 3' untranslated region of mRNA encoded by SNURF-SNRPN, corresponding to a target binding site such as BINDING SITE I, BINDING SITE II or BINDING SITE III of FIG. 8. Table 4 illustrates the complementarity of the nucleotide sequences of SNURF-SNRPN BINDING SITE, designated SEQ ID:3268, to the nucleotide sequence of GAM3027 RNA, herein designated GAM RNA, also designated SEQ ID:242.

Another function of GAM3027 is therefore inhibition of SNURF-SNRPN (Accession XP_085186.4). Accordingly, utilities of GAM3027 include diagnosis, prevention and treatment of diseases and clinical conditions associated with SNURF-SNRPN.

Synovial sarcoma translocation, chromosome 18 (SS18, Accession NP_005628.1) is another GAM3027 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:9679, to the nucleotide sequence of GAM3027 RNA, herein designated GAM RNA, also designated SEQ ID:242.

Another function of GAM3027 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM3027 include diagnosis, prevention and treatment of Human synovial sarcomas, and of other diseases and clinical conditions associated with SS18.

The function of SS18 and its association with various diseases and clinical conditions, has been established by previous studies, as described hereinabove with reference to GAM130.1. T-cell leukemia/lymphoma 1a (TCL1A, Accession NP_068801.1) is another GAM3027 target gene, herein designated TARGET GENE. TCL1A BINDING SITE is a target binding site found in the 3' untranslated region of mRNA encoded by TCL1A, corresponding to a target binding site such as BINDING SITE I, BINDING SITE II or BINDING SITE III of FIG. 8. Table 4 illustrates the complementarity of the nucleotide sequences of TCL1A BINDING SITE, designated SEQ ID:14577, to the nucleotide sequence of GAM3027 RNA, herein designated GAM RNA, also designated SEQ ID:242.

Another function of GAM3027 is therefore inhibition of T-cell leukemia/lymphoma 1a (TCL1A, Accession NP_068801.1). Accordingly, utilities of GAM3027 include diagnosis, prevention and treatment of diseases and clinical conditions associated with TCL1A.

Thiamin pyrophosphokinase 1 (TPK1, Accession NP_071890.2) is another GAM3027 target gene, herein designated TARGET GENE. TPK1 BINDING SITE is a target binding site found in the 3' untranslated region of mRNA encoded by TPK1, corresponding to a target binding site such as BINDING SITE I, BINDING SITE II or BINDING SITE III of FIG. 8. Table 4 illustrates the complementarity of the nucleotide sequences of TPK1 BINDING SITE, designated SEQ ID:3731, to the nucleotide sequence of GAM3027 RNA, herein designated GAM RNA, also designated SEQ ID:242.

Another function of GAM3027 is therefore inhibition of Thiamin pyrophosphokinase 1 (TPK1, Accession NP_071890.2), a gene which catalyzes the conversion of thiamine, a form of vitamin B1, to thiamine pyrophosphate. Accordingly, utilities of GAM3027 include diagnosis, prevention and treatment of diseases and clinical conditions associated with TPK1.

The function of TPK1 and its association with various diseases and clinical conditions, has been established by previous studies, as described hereinabove with reference to GAM1435.2. Tripartite motif-containing 9 (TRIM9, Accession NP_443210.1) is another GAM3027 target gene, herein designated TARGET GENE. TRIM9 BINDING SITE is a target binding site found in the 3' untranslated region of multiple transcripts of mRNA encoded by TRIM9, corresponding to a target binding site such as BINDING SITE I, BINDING SITE II or BINDING SITE III of FIG. 8. Table 4 illustrates the complementarity of the nucleotide sequences of TRIM9 BINDING SITE, designated SEQ ID:17715, to the nucleotide sequence of GAM3027 RNA, herein designated GAM RNA, also designated SEQ ID:242.

Another function of GAM3027 is therefore inhibition of Tripartite motif-containing 9 (TRIM9, Accession NP_443210.1), a gene which may function as a positive regulator for mannosylphosphate transferase and is required to mediate mannosylphosphate transfer in both the core and outer chain portions of n-linked. oligosaccharides. Accordingly, utilities of GAM3027 include diagnosis, prevention and treatment of diseases and clinical conditions associated with TRIM9.

The function of TRIM9 and its association with various diseases and clinical conditions, has been established by previous studies, as described hereinabove with reference to GAM72.1.

FIG. 8 further provides a conceptual description of a novel bioinformatically detected of the present invention, referred to here as Genomic Address Messenger 3229 (GAM3229), which modulates expression of respective target genes thereof, the function and utility of which target genes is known in the art.

GAM3229 is a novel bioinformatically detected regulatory, non protein coding, micro RNA (miRNA) gene. The method by which GAM3229 was detected is described hereinabove with reference to FIGS. 8-15.

GAM3229 gene, herein designated GAM GENE, and GAM3229 target gene, herein designated TARGET GENE, are human genes contained in the human genome.

GAM3229 gene encodes a GAM3229 precursor RNA, herein designated GAM PRECURSOR RNA. Similar to other miRNA genes, and unlike most ordinary genes, GAM3229 precursor RNA does not encode a protein. A nucleotide sequence identical or highly similar to the nucleotide sequence of GAM3229 precursor RNA is designated SEQ ID:46, and is provided hereinbelow with reference to the sequence listing part.

GAM3229 precursor RNA folds onto itself, forming GAM3229 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM3229 precursor RNA folds onto itself, forming GAM3229 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM3229 precursor RNA, designated SEQ-ID:46, and a schematic representation of a predicted secondary folding of GAM3229 folded precursor RNA are further described with reference to Table 2, hereby incorporated by reference.

An enzyme complex designated DICER COMPLEX, 'dices' the GAM3229 folded precursor RNA into GAM3229 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM3229 RNA is designated SEQ ID:221, and is provided hereinbelow with references to the sequence listing part and Table 3, hereby incorporated by reference.

GAM3229 target gene, herein designated TARGET GENE, encodes a corresponding messenger RNA, GAM3229 target RNA, herein designated GAM TARGET RNA. GAM3229 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM3229 RNA, herein designated GAM RNA, binds complementarily to one or more target binding sites located in untranslated regions of GAM3229 target RNA, herein designated GAM TARGET RNA. This complementary binding is due to the fact that the nucleotide sequence of GAM3229 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM3229 RNA may have a different number of target binding sites in untranslated regions of a GAM3229 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM3229 RNA, herein designated GAM RNA, to target binding sites on GAM3229 target RNA, herein designated GAM TARGET RNA, such as BINDING SITE I, BINDING SITE II and BINDING SITE III, inhibits translation of GAM3229 target RNA into GAM3229 target protein, herein designated GAM TARGET PROTEIN. GAM target protein is therefore outlined by a broken line.

It is appreciated that GAM3229 target gene, herein designated TARGET GENE, in fact represents a plurality of GAM3229 target genes. The mRNA of each one of this plurality of GAM3229 target genes comprises one or more target binding sites, each having a nucleotide sequence which is at least partly complementary to GAM3229 RNA, herein designated GAM RNA, and which when bound by GAM3229 RNA causes inhibition of translation of respective one or more GAM3229 target proteins.

It is further appreciated by one skilled in the art that the mode of translational inhibition illustrated by FIG. 8 with specific reference to translational inhibition exerted by GAM3229 gene, herein designated GAM GENE, on one or more GAM3229 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM3229 correlate with, and may be deduced from, the identity of the target genes which GAM3229 binds and inhibits, and the function of these target genes, as elaborated hereinbelow.

15E1.2 (Accession XP_290596.1) is a GAM3229 target gene, herein designated TARGET GENE. 15E1.2 BINDING SITE is a target binding site found in the 3' untranslated region of mRNA encoded by 15E1.2, corresponding to a target binding site such as BINDING SITE I, BINDING SITE II or BINDING SITE III of FIG. 8. Table 4 illustrates the complementarity of the nucleotide sequences of 15E1.2 BINDING SITE, designated SEQ ID:7550, to the nucleotide sequence of GAM3229 RNA, herein designated GAM RNA, also designated SEQ ID:221.

A function of GAM3229 is therefore inhibition of 15E1.2 (Accession XP_290596.1). Accordingly, utilities of GAM3229 include diagnosis, prevention and treatment of diseases and clinical conditions associated with 15E1.2.

Alpha-1-b glycoprotein (A1BG, Accession NP_570602.2) is another GAM3229 target gene, herein designated TARGET GENE. A1BG BINDING SITE is a target binding site found in the 3' untranslated region of mRNA encoded by A1BG, corresponding to a target binding site such as BINDING SITE I, BINDING SITE II or BINDING SITE III of FIG. 8. Table 4 illustrates the complementarity of the nucleotide sequences of A1BG BINDING SITE, designated SEQ ID:4606, to the nucleotide sequence of GAM3229 RNA, herein designated GAM RNA, also designated SEQ ID:221.

Another function of GAM3229 is therefore inhibition of Alpha-1-b glycoprotein (A1BG, Accession NP_570602.2), a gene which a plasma protein of unknown function. Accordingly, utilities of GAM3229 include diagnosis, prevention and treatment of diseases and clinical conditions associated with A1BG.

The function of A1BG and its association with various diseases and clinical conditions, has been established by previous studies, as described hereinabove with reference to GAM130.1. Atp-binding cassette, sub-family b (mdr/tap), member 5 (ABCB5, Accession XP_291215.1) is another GAM3229 target gene, herein designated TARGET GENE. ABCB5 BINDING SITE is a target binding site found in the 3' untranslated region of mRNA encoded by ABCB5, corresponding to a target binding site such as BINDING SITE I, BINDING SITE II or BINDING SITE III of FIG. 8. Table 4 illustrates the complementarity of the nucleotide sequences of ABCB5 BINDING SITE, designated SEQ ID:14539, to the nucleotide sequence of GAM3229 RNA, herein designated GAM RNA, also designated SEQ ID:221.

Another function of GAM3229 is therefore inhibition of Atp-binding cassette, sub-family b (mdr/tap), member 5 (ABCB5, Accession XP_291215.1). Accordingly, utilities of GAM3229 include diagnosis, prevention and treatment of diseases and clinical conditions associated with ABCB5.

Amiloride-sensitive cation channel 2, neuronal (ACCN2, Accession NP_001086.2) is another GAM3229 target gene, herein designated TARGET GENE. ACCN2 BINDING SITE is a target binding site found in the 3' untranslated region of multiple transcripts of mRNA encoded by ACCN2, corresponding to a target binding site such as BINDING SITE I, BINDING SITE II or BINDING SITE III of FIG. 8. Table 4 illustrates the complementarity of the nucleotide sequences of ACCN2 BINDING SITE, designated SEQ ID:11565, to the nucleotide sequence of GAM3229 RNA, herein designated GAM RNA, also designated SEQ ID:221.

Another function of GAM3229 is therefore inhibition of Amiloride-sensitive cation channel 2, neuronal (ACCN2, Accession NP_001086.2) . Accordingly, utilities of GAM3229 include diagnosis, prevention and treatment of diseases and clinical conditions associated with ACCN2.

Amiloride-sensitive cation channel 2, neuronal (ACCN2, Accession NP_064423.2) is another GAM3229 target gene, herein designated TARGET GENE. ACCN2 BINDING SITE is a target binding site found in the 3' untranslated region of multiple transcripts of mRNA encoded by ACCN2, corresponding to a target binding site such as BINDING SITE I, BINDING SITE II or BINDING SITE III of FIG. 8. Table 4 illustrates the complementarity of the nucleotide sequences of ACCN2 BINDING SITE, designated SEQ ID:11565, to the nucleotide sequence of GAM3229 RNA, herein designated GAM RNA, also designated SEQ ID:221.

Another function of GAM3229 is therefore inhibition of Amiloride-sensitive cation channel 2, neuronal (ACCN2, Accession NP_064423.2) . Accordingly, utilities of GAM3229 include diagnosis, prevention and treatment of diseases and clinical conditions associated with ACCN2.

A disintegrin-like and metalloprotease (reprolysin type) with thrombospondin type 1 motif, 4 (ADAMTS4, Accession NP_005090.1) is another GAM3229 target gene, herein designated TARGET GENE. ADAMTS4 BINDING SITE is a target binding site found in the 3' untranslated region of mRNA encoded by ADAMTS4, corresponding to a target binding site such as BINDING SITE I, BINDING SITE II or BINDING SITE III of FIG. 8. Table 4 illustrates the complementarity of the nucleotide sequences of ADAMTS4 BINDING SITE, designated SEQ ID:4409, to the nucleotide sequence of GAM3229 RNA, herein designated GAM RNA, also designated SEQ ID:221.

Another function of GAM3229 is therefore inhibition of A disintegrin-like and metalloprotease (reprolysin type) with thrombospondin type 1 motif, 4 (ADAMTS4, Accession NP_005090.1), a gene which cleaves aggrecan, a cartilage proteoglycan, and may be involved in its turnover. Accordingly, utilities of GAM3229 include diagnosis, prevention and treatment of diseases and clinical conditions associated with ADAMTS4.

The function of ADAMTS4 and its association with various diseases and clinical conditions, has been established by previous studies, as described hereinabove with reference to GAM189.1. Adenylate cyclase 6 (ADCY6, Accession NP_056085.1) is another GAM3229 target gene, herein designated TARGET GENE. ADCY6 BINDING SITE is a target binding site found in the 5' untranslated region of multiple transcripts of mRNA encoded by ADCY6, corresponding to a target binding site such as BINDING SITE I, BINDING SITE II or BINDING SITE III of FIG. 8. Table 4 illustrates the complementarity of the nucleotide sequences of ADCY6 BINDING SITE, designated SEQ ID:16258, to the nucleotide sequence of GAM3229 RNA, herein designated GAM RNA, also designated SEQ ID:221.

Another function of GAM3229 is therefore inhibition of Adenylate cyclase 6 (ADCY6, Accession NP_056085.1), a gene which this a membrane-bound, ca(2+)-inhibitable adenylyl cyclase (by similarity). Accordingly, utilities of GAM3229 include diagnosis, prevention and treatment of diseases and clinical conditions associated with ADCY6.

The function of ADCY6 and its association with various diseases and clinical conditions, has been established by previous studies, as described hereinabove with reference to GAM67.2. Amylo-1, 6-glucosidase, 4-alpha-glucanotransferase (glycogen debranching enzyme, glycogen storage disease type iii) (AGL, Accession NP_000637.1) is another GAM3229 target gene, herein designated TARGET GENE. AGL BINDING SITE is a target binding site found in the 5' untranslated region of multiple transcripts of mRNA encoded by AGL, corresponding to a target binding site such as BINDING SITE I, BINDING SITE II or BINDING SITE III of FIG. 8. Table 4 illustrates the complementarity of the nucleotide sequences of AGL BINDING SITE, designated SEQ ID:14206, to the nucleotide sequence of GAM3229 RNA, herein designated GAM RNA, also designated SEQ ID:221.

Another function of GAM3229 is therefore inhibition of Amylo-1, 6-glucosidase, 4-alpha-glucanotransferase (glycogen debranching enzyme, glycogen storage disease type iii) (AGL, Accession NP_000637.1). Accordingly, utilities of GAM3229 include diagnosis, prevention and treatment of diseases and clinical conditions associated with AGL.

Absent in melanoma 1 (AIM1, Accession XP_166300.1) is another GAM3229 target gene, herein designated TARGET GENE. AIM1 BINDING SITE1 through AIM1 BINDING SITE3 are target binding sites found in untranslated regions of mRNA encoded by AIM1, corresponding to target binding sites such as BINDING SITE I, BINDING SITE II or BINDING SITE III of FIG. 8. Table 4 illustrates the complementarity of the nucleotide sequences of AIM1 BINDING SITE1 through AIM1 BINDING SITE3, designated SEQ ID:15456, SEQ ID:4262 and SEQ ID:3982 respectively, to the nucleotide sequence of GAM3229 RNA, herein designated GAM RNA, also designated SEQ ID:221.

Another function of GAM3229 is therefore inhibition of Absent in melanoma 1 (AIM1, Accession XP_166300.1), a gene which is altered in association with tumor suppression in a model of human melanoma and therefore may be associated with Malignant melanoma. Accordingly, utilities of GAM3229 include diagnosis, prevention and treatment of Malignant melanoma, and of other diseases and clinical conditions associated with AIM1.

The function of AIM1 and its association with various diseases and clinical conditions, has been established by previous studies, as described hereinabove with reference to GAM136.1. Arachidonate 15-lipoxygenase (ALOX15, Accession NP_001131.1) is another GAM3229 target gene, herein designated TARGET GENE. ALOX15 BINDING SITE is a target binding site found in the 3' untranslated region of mRNA encoded by ALOX15, corresponding to a target binding site such as BINDING SITE I, BINDING SITE II or BINDING SITE III of FIG. 8. Table 4 illustrates the complementarity of the nucleotide sequences of ALOX15 BINDING SITE, designated SEQ ID:13880, to the nucleotide sequence of GAM3229 RNA, herein designated GAM RNA, also designated SEQ ID:221.

Another function of GAM3229 is therefore inhibition of Arachidonate 15-lipoxygenase (ALOX15, Accession NP_001131.1), a gene which converts arachidonic acid to 15s-hydroperoxyeicosatetraenoic acid. Accordingly, utilities of GAM3229 include diagnosis, prevention and treatment of diseases and clinical conditions associated with ALOX15.

The function of ALOX15 and its association with various diseases and clinical conditions, has been established by previous studies, as described hereinabove with reference to GAM189.1. AP1S3 (Accession XP_291023.1) is another GAM3229 target gene, herein designated TARGET GENE. AP1S3 BINDING SITE is a target binding site found in the 3' untranslated region of multiple transcripts of mRNA encoded by AP1S3, corresponding to a target binding site such as BINDING SITE I, BINDING SITE II or BINDING SITE III of FIG. 8. Table 4 illustrates the complementarity of the nucleotide sequences of AP1S3 BINDING SITE, designated SEQ ID:7058, to the nucleotide sequence of GAM3229 RNA, herein designated GAM RNA, also designated SEQ ID:221.

Another function of GAM3229 is therefore inhibition of AP1S3 (Accession XP_291023.1). Accordingly, utilities of GAM3229 include diagnosis, prevention and treatment of diseases and clinical conditions associated with AP1S3.

Adaptor-related protein complex 3, sigma 2 subunit (AP3S2, Accession NP_005820.1) is another GAM3229 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:4992, to the nucleotide sequence of GAM3229 RNA, herein designated GAM RNA, also designated SEQ ID:221.

Another function of GAM3229 is therefore inhibition of Adaptor-related protein complex 3, sigma 2 subunit (AP3S2, Accession NP_005820.1). Accordingly, utilities of GAM3229 include diagnosis, prevention and treatment of diseases and clinical conditions associated with AP3S2.

Apoptotic protease activating factor (APAF1, Accession NP_037361.1) is another GAM3229 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:15973 and SEQ ID:15973 respectively, to the nucleotide sequence of GAM3229 RNA, herein designated GAM RNA, also designated SEQ ID:221.

Another function of GAM3229 is therefore inhibition of Apoptotic protease activating factor (APAF1, Accession NP_037361.1), a gene which functions in the mitochondrial apoptotic pathway that leads to caspase 9 dependent activation of caspase 3 and therefore may be associated with Cancer. Accordingly, utilities of GAM3229 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apoptotic protease activating factor (APAF1, Accession NP_001151.1) is another GAM3229 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:2783 and SEQ ID:2783 respectively, to the nucleotide sequence of GAM3229 RNA, herein designated GAM RNA, also designated SEQ ID:221.

Another function of GAM3229 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM3229 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. APM1 (Accession NP_004788.1) is another GAM3229 target gene, herein designated TARGET GENE. APM1 BINDING SITE1 and APM1 BINDING SITE2 are target binding sites found in untranslated regions of mRNA encoded by APM1, corresponding to target binding sites such as BINDING SITE I, BINDING SITE II or BINDING SITE III of FIG. 8. Table 4 illustrates the complementarity of the nucleotide sequences of APM1 BINDING SITE1 and APM1 BINDING SITE2, designated SEQ ID:12655 and SEQ ID:9383 respectively, to the nucleotide sequence of GAM3229 RNA, herein designated GAM RNA, also designated SEQ ID:221.

Another function of GAM3229 is therefore inhibition of APM1 (Accession NP_004788.1). Accordingly, utilities of GAM3229 include diagnosis, prevention and treatment of diseases and clinical conditions associated with APM1.

Apolipoprotein c-iii (APOC3, Accession NP_000031.1) is another GAM3229 target gene, herein designated TARGET GENE. APOC3 BINDING SITE is a target binding site found in the 3' untranslated region of mRNA encoded by APOC3, corresponding to a target binding site such as BINDING SITE I, BINDING SITE II or BINDING SITE III of FIG. 8. Table 4 illustrates the complementarity of the nucleotide sequences of APOC3 BINDING SITE, designated SEQ ID:20001, to the nucleotide sequence of GAM3229 RNA, herein designated GAM RNA, also designated SEQ ID:221.

Another function of GAM3229 is therefore inhibition of Apolipoprotein c-iii (APOC3, Accession NP_000031.1). Accordingly, utilities of GAM3229 include diagnosis, prevention and treatment of diseases and clinical conditions associated with APOC3.

Aprataxin (APTX, Accession NP_778243.1) is another GAM3229 target gene, herein designated TARGET GENE. APTX BINDING SITE is a target binding site found in the 5' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:404, to the nucleotide sequence of GAM3229 RNA, herein designated GAM RNA, also designated SEQ ID:221.

Another function of GAM3229 is therefore inhibition of Aprataxin (APTX, Accession NP_778243.1). Accordingly, utilities of GAM3229 include diagnosis, prevention and treatment of diseases and clinical conditions associated with APTX.

Aprataxin (APTX, Accession NP_778242.1) is another GAM3229 target gene, herein designated TARGET GENE. APTX BINDING SITE is a target binding site found in the 5' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:404, to the nucleotide sequence of GAM3229 RNA, herein designated GAM RNA, also designated SEQ ID:221.

Another function of GAM3229 is therefore inhibition of Aprataxin (APTX, Accession NP_778242.1). Accordingly, utilities of GAM3229 include diagnosis, prevention and treatment of diseases and clinical conditions associated with APTX.

Aquaporin 6, kidney specific (AQP6, Accession NP_445738.1) is another GAM3229 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:3122, to the nucleotide sequence of GAM3229 RNA, herein designated GAM RNA, also designated SEQ ID:221.

Another function of GAM3229 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM3229 include diagnosis, prevention and treatment of diseases and clinical conditions associated with AQP6.

The function of AQP6 and its association with various diseases and clinical conditions, has been established by previous studies, as described hereinabove with reference to GAM51.1. Aquaporin 6, kidney specific (AQP6, Accession NP_001643.1) is another GAM3229 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:3122, to the nucleotide sequence of GAM3229 RNA, herein designated GAM RNA, also designated SEQ ID:221.

Another function of GAM3229 is therefore inhibition of Aquaporin 6, kidney specific (AQP6, Accession NP_001643.1), a gene which participates in distinct physiologic function such as glomerular filtration, tubular endocytosis, and acid-base-metabolism. Accordingly, utilities of GAM3229 include diagnosis, prevention and treatment of diseases and clinical conditions associated with AQP6.

The function of AQP6 and its association with various diseases and clinical conditions, has been established by previous studies, as described hereinabove with reference to GAM51.1. Archain 1 (ARCN1, Accession NP_001646.2) is another GAM3229 target gene, herein designated TARGET GENE. ARCN1 BINDING SITE1 and ARCN1 BINDING SITE2 are target binding sites found in untranslated regions of mRNA encoded by ARCN1, corresponding to target binding sites such as BINDING SITE I, BINDING SITE II or BINDING SITE III of FIG. 8. Table 4 illustrates the complementarity of the nucleotide sequences of ARCN1 BINDING SITE1 and ARCN1 BINDING SITE2, designated SEQ ID:2072 and SEQ ID:17074 respectively, to the nucleotide sequence of GAM3229 RNA, herein designated GAM RNA, also designated SEQ ID:221.

Another function of GAM3229 is therefore inhibition of Archain 1 (ARCN1, Accession NP_001646.2), a gene which plays a fundamental role in eukaryotic cell biology. Accordingly, utilities of GAM3229 include diagnosis, prevention and treatment of diseases and clinical conditions associated with ARCN1.

The function of ARCN1 and its association with various diseases and clinical conditions, has been established by previous studies, as described hereinabove with reference to GAM30.1. Rho gtpase activating protein 1 (ARHGAP1, Accession NP_004299.1) is another GAM3229 target gene, herein designated TARGET GENE. ARHGAP1 BINDING SITE1 and ARHGAP1 BINDING SITE2 are target binding sites found in untranslated regions of mRNA encoded by ARHGAP1, corresponding to target binding sites such as BINDING SITE I, BINDING SITE II or BINDING SITE III of FIG. 8. Table 4 illustrates the complementarity of the nucleotide sequences of ARHGAP1 BINDING SITE1 and ARHGAP1 BINDING SITE2, designated SEQ ID:2783 and SEQ ID:7041 respectively, to the nucleotide sequence of GAM3229 RNA, herein designated GAM RNA, also designated SEQ ID:221.

Another function of GAM3229 is therefore inhibition of Rho gtpase activating protein 1 (ARHGAP1, Accession NP_004299.1). Accordingly, utilities of GAM3229 include diagnosis, prevention and treatment of diseases and clinical conditions associated with ARHGAP1.

Rho guanine nucleotide exchange factor (gef) 7 (ARHGEF7, Accession NP_663788.1) is another GAM3229 target gene, herein designated TARGET GENE. ARHGEF7 BINDING SITE is a target binding site found in the 3' untranslated region of multiple transcripts of mRNA encoded by ARHGEF7, corresponding to a target binding site such as BINDING SITE I, BINDING SITE II or BINDING SITE III of FIG. 8. Table 4 illustrates the complementarity of the nucleotide sequences of ARHGEF7 BINDING SITE, designated SEQ ID:13696, to the nucleotide sequence of GAM3229 RNA, herein designated GAM RNA, also designated SEQ ID:221.

Another function of GAM3229 is therefore inhibition of Rho guanine nucleotide exchange factor (gef) 7 (ARHGEF7, Accession NP_663788.1), a gene which acts as a rac1 guanine nucleotide exchange factor (gef) and can induce membrane ruffling. Accordingly, utilities of GAM3229 include diagnosis, prevention and treatment of diseases and clinical conditions associated with ARHGEF7.

The function of ARHGEF7 and its association with various diseases and clinical conditions, has been established by previous studies, as described hereinabove with reference to GAM40.2. ARPP-19 (Accession NP_006619.1) is another GAM3229 target gene, herein designated TARGET GENE. ARPP-19 BINDING SITE is a target binding site found in the 3' untranslated region of mRNA encoded by ARPP-19, corresponding to a target binding site such as BINDING SITE I, BINDING SITE II or BINDING SITE III of FIG. 8. Table 4 illustrates the complementarity of the nucleotide sequences of ARPP-19 BINDING SITE, designated SEQ ID:9396, to the nucleotide sequence of GAM3229 RNA, herein designated GAM RNA, also designated SEQ ID:221.

Another function of GAM3229 is therefore inhibition of ARPP-19 (Accession NP_006619.1). Accordingly, utilities of GAM3229 include diagnosis, prevention and treatment of diseases and clinical conditions associated with ARPP-19.

Ankyrin repeat and socs box-containing 6 (ASB6, Accession NP_060343.1) is another GAM3229 target gene, herein designated TARGET GENE. ASB6 BINDING SITE is a target binding site found in the 3' untranslated region of multiple transcripts of mRNA encoded by ASB6, corresponding to a target binding site such as BINDING SITE I, BINDING SITE II or BINDING SITE III of FIG. 8. Table 4 illustrates the complementarity of the nucleotide sequences of ASB6 BINDING SITE, designated SEQ ID:10286, to the nucleotide sequence of GAM3229 RNA, herein designated GAM RNA, also designated SEQ ID:221.

Another function of GAM3229 is therefore inhibition of Ankyrin repeat and socs box-containing 6 (ASB6, Accession NP_060343.1). Accordingly, utilities of GAM3229 include diagnosis, prevention and treatment of diseases and clinical conditions associated with ASB6.

Ankyrin repeat and socs box-containing 6 (ASB6, Accession NP_821066.1) is another GAM3229 target gene, herein designated TARGET GENE. ASB6 BINDING SITE is a target binding site found in the 3' untranslated region of multiple transcripts of mRNA encoded by ASB6, corresponding to a target binding site such as BINDING SITE I, BINDING SITE II or BINDING SITE III of FIG. 8. Table 4 illustrates the complementarity of the nucleotide sequences of ASB6 BINDING SITE, designated SEQ ID:10286, to the nucleotide sequence of GAM3229 RNA, herein designated GAM RNA, also designated SEQ ID:221.

Another function of GAM3229 is therefore inhibition of Ankyrin repeat and socs box-containing 6 (ASB6, Accession NP_821066.1). Accordingly, utilities of GAM3229 include diagnosis, prevention and treatment of diseases and clinical conditions associated with ASB6.

ATF7IP2 (Accession NP_079273.1) is another GAM3229 target gene, herein designated TARGET GENE. ATF7IP2 BINDING SITE is a target binding site found in the 3' untranslated region of mRNA encoded by ATF7IP2, corresponding to a target binding site such as BINDING SITE I, BINDING SITE II or BINDING SITE III of FIG. 8. Table 4 illustrates the complementarity of the nucleotide sequences of ATF7IP2 BINDING SITE, designated SEQ ID:9615, to the nucleotide sequence of GAM3229 RNA, herein designated GAM RNA, also designated SEQ ID:221.

Another function of GAM3229 is therefore inhibition of ATF7IP2 (Accession NP_079273.1). Accordingly, utilities of GAM3229 include diagnosis, prevention and treatment of diseases and clinical conditions associated with ATF7IP2.

Atpase, na+/k+ transporting, beta 2 polypeptide (ATP1B2, Accession NP_001669.1) is another GAM3229 target gene, herein designated TARGET GENE. ATP1B2 BINDING SITE is a target binding site found in the 3' untranslated region of mRNA encoded by ATP1B2, corresponding to a target binding site such as BINDING SITE I, BINDING SITE II or BINDING SITE III of FIG. 8. Table 4 illustrates the complementarity of the nucleotide sequences of ATP1B2 BINDING SITE, designated SEQ ID:4784, to the nucleotide sequence of GAM3229 RNA, herein designated GAM RNA, also designated SEQ ID:221.

Another function of GAM3229 is therefore inhibition of Atpase, na+/k+ transporting, beta 2 polypeptide (ATP1B2, Accession NP_001669.1), a gene which catalyzes the hydrolysis of ATP coupled with the exchange of Na+/K+ ions across the plasma membrane. Accordingly, utilities of GAM3229 include diagnosis, prevention and treatment of diseases and clinical conditions associated with ATP1B2.

The function of ATP1B2 and its association with various diseases and clinical conditions, has been established by previous studies, as described hereinabove with reference to GAM130.1. Atpase, h+ transporting, lysosomal 38 kda, v0 subunit d isoform 2 (ATP6V0D2, Accession NP_689778.1) is another GAM3229 target gene, herein designated TARGET GENE. ATP6V0D2 BINDING SITE is a target binding site found in the 3' untranslated region of mRNA encoded by ATP6V0D2, corresponding to a target binding site such as BINDING SITE I, BINDING SITE II or BINDING SITE III of FIG. 8. Table 4 illustrates the complementarity of the nucleotide sequences of ATP6V0D2 BINDING SITE, designated SEQ ID:19565, to the nucleotide sequence of GAM3229 RNA, herein designated GAM RNA, also designated SEQ ID:221.

Another function of GAM3229 is therefore inhibition of Atpase, h+ transporting, lysosomal 38 kda, v0 subunit d isoform 2 (ATP6V0D2, Accession NP_689778.1). Accordingly, utilities of GAM3229 include diagnosis, prevention and treatment of diseases and clinical conditions associated with ATP6V0D2.

ATP6V1A (Accession NP_001681.2) is another GAM3229 target gene, herein designated TARGET GENE. ATP6V1A BINDING SITE is a target binding site found in the 3' untranslated region of mRNA encoded by ATP6V1A, corresponding to a target binding site such as BINDING SITE I, BINDING SITE II or BINDING SITE III of FIG. 8. Table 4 illustrates the complementarity of the nucleotide sequences of ATP6V1A BINDING SITE, designated SEQ ID:9671, to the nucleotide sequence of GAM3229 RNA, herein designated GAM RNA, also designated SEQ ID:221.

Another function of GAM3229 is therefore inhibition of ATP6V1A (Accession NP_001681.2). Accordingly, utilities of GAM3229 include diagnosis, prevention and treatment of diseases and clinical conditions associated with ATP6V1A.

Atpase, cu++ transporting, alpha polypeptide (menkes syndrome) (ATP7A, Accession NP_000043.1) is another GAM3229 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:9876, to the nucleotide sequence of GAM3229 RNA, herein designated GAM RNA, also designated SEQ ID:221.

Another function of GAM3229 is therefore inhibition of Atpase, cu++ transporting, alpha polypeptide (menkes syndrome) (ATP7A, Accession NP_000043.1). Accordingly, utilities of GAM3229 include diagnosis, prevention and treatment of diseases and clinical conditions associated with ATP7A.

Axl receptor tyrosine kinase (AXL, Accession NP_001690.2) is another GAM3229 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:3840, to the nucleotide sequence of GAM3229 RNA, herein designated GAM RNA, also designated SEQ ID:221.

Another function of GAM3229 is therefore inhibition of Axl receptor tyrosine kinase (AXL, Accession NP_001690.2). Accordingly, utilities of GAM3229 include diagnosis, prevention and treatment of diseases and clinical conditions associated with AXL.

Axl receptor tyrosine kinase (AXL, Accession NP_068713.2) is another GAM3229 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:3840, to the nucleotide sequence of GAM3229 RNA, herein designated GAM RNA, also designated SEQ ID:221.

Another function of GAM3229 is therefore inhibition of Axl receptor tyrosine kinase (AXL, Accession NP_068713.2). Accordingly, utilities of GAM3229 include diagnosis, prevention and treatment of diseases and clinical conditions associated with AXL.

Udp-gal:betaglcnac beta 1,4-galactosyltransferase, polypeptide 5 (B4GALT5, Accession NP_004767.1) is another GAM3229 target gene, herein designated TARGET GENE. B4GALT5 BINDING SITE1 and B4GALT5 BINDING SITE2 are target binding sites found in untranslated regions of mRNA encoded by B4GALT5, corresponding to target binding sites such as BINDING SITE I, BINDING SITE II or BINDING SITE III of FIG. 8. Table 4 illustrates the complementarity of the nucleotide sequences of B4GALT5 BINDING SITE1 and B4GALT5 BINDING SITE2, designated SEQ ID:10951 and SEQ ID:4737 respectively, to the nucleotide sequence of GAM3229 RNA, herein designated GAM RNA, also designated SEQ ID:221.

Another function of GAM3229 is therefore inhibition of Udp-gal:betaglcnac beta 1,4-galactosyltransferase, polypeptide 5 (B4GALT5, Accession NP_004767.1). Accordingly, utilities of GAM3229 include diagnosis, prevention and treatment of diseases and clinical conditions associated with B4GALT5.

BCAP31 (Accession NP_005736.2) is another GAM3229 target gene, herein designated TARGET GENE. BCAP31 BINDING SITE is a target binding site found in the 3' untranslated region of mRNA encoded by BCAP31, corresponding to a target binding site such as BINDING SITE I, BINDING SITE II or BINDING SITE III of FIG. 8. Table 4 illustrates the complementarity of the nucleotide sequences of BCAP31 BINDING SITE, designated SEQ ID:3188, to the nucleotide sequence of GAM3229 RNA, herein designated GAM RNA, also designated SEQ ID:221.

Another function of GAM3229 is therefore inhibition of BCAP31 (Accession NP_005736.2). Accordingly, utilities of GAM3229 include diagnosis, prevention and treatment of diseases and clinical conditions associated with BCAP31.

B-cell cll/lymphoma 10 (BCL10, Accession NP_003912.1) is another GAM3229 target gene, herein designated TARGET GENE. BCL10 BINDING SITE is a target binding site found in the 3' untranslated region of mRNA encoded by BCL10, corresponding to a target binding site such as BINDING SITE I, BINDING SITE II or BINDING SITE III of FIG. 8. Table 4 illustrates the complementarity of the nucleotide sequences of BCL10 BINDING SITE, designated SEQ ID:7414, to the nucleotide sequence of GAM3229 RNA, herein designated GAM RNA, also designated SEQ ID:221.

Another function of GAM3229 is therefore inhibition of B-cell cll/lymphoma 10 (BCL10, Accession NP_003912.1), a gene which is a positive regulator of lymphocyte proliferation, NF-kappaB activator. and therefore may be associated with Malt lymphoma, follicular lymphoma. Accordingly, utilities of GAM3229 include diagnosis, prevention and treatment of Malt lymphoma, follicular lymphoma, and of other diseases and clinical conditions associated with BCL10.

The function of BCL10 and its association with various diseases and clinical conditions, has been established by previous studies, as described hereinabove with reference to GAM136.1. Bradykinin receptor b1 (BDKRB1, Accession NP_000701.2) is another GAM3229 target gene, herein designated TARGET GENE. BDKRB1 BINDING SITE is a target binding site found in the 5' untranslated region of mRNA encoded by BDKRB1, corresponding to a target binding site such as BINDING SITE I, BINDING SITE II or BINDING SITE III of FIG. 8. Table 4 illustrates the complementarity of the nucleotide sequences of BDKRB1 BINDING SITE, designated SEQ ID:15600, to the nucleotide sequence of GAM3229 RNA, herein designated GAM RNA, also designated SEQ ID:221.

Another function of GAM3229 is therefore inhibition of Bradykinin receptor b1 (BDKRB1, Accession NP_000701.2), a gene which mediates intracellular calcium flux. Accordingly, utilities of GAM3229 include diagnosis, prevention and treatment of diseases and clinical conditions associated with BDKRB1.

The function of BDKRB1 and its association with various diseases and clinical conditions, has been established by previous studies, as described hereinabove with reference to GAM136.1. BHD (Accession NP_659434.2) is another GAM3229 target gene, herein designated TARGET GENE. BHD BINDING SITE1 and BHD BINDING SITE2 are target binding sites found in untranslated regions of multiple transcripts of mRNA encoded by BHD, corresponding to target binding sites such as BINDING SITE I, BINDING SITE II or BINDING SITE III of FIG. 8. Table 4 illustrates the complementarity of the nucleotide sequences of BHD BINDING SITE1 and BHD BINDING SITE2, designated SEQ ID:2783 and SEQ ID:15210 respectively, to the nucleotide sequence of GAM3229 RNA, herein designated GAM RNA, also designated SEQ ID:221.

Another function of GAM3229 is therefore inhibition of BHD (Accession NP_659434.2). Accordingly, utilities of GAM3229 include diagnosis, prevention and treatment of diseases and clinical conditions associated with BHD.

Butyrophilin, subfamily 3, member a1 (BTN3A1, Accession NP_008979.2) is another GAM3229 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:12851, to the nucleotide sequence of GAM3229 RNA, herein designated GAM RNA, also designated SEQ ID:221.

Another function of GAM3229 is therefore inhibition of Butyrophilin, subfamily 3, member a1 (BTN3A1, Accession NP_008979.2). Accordingly, utilities of GAM3229 include diagnosis, prevention and treatment of diseases and clinical conditions associated with BTN3A1.

BXDC1 (Accession XP_166303.1) is another GAM3229 target gene, herein designated TARGET GENE. BXDC1 BINDING SITE is a target binding site found in the 3' untranslated region of mRNA encoded by BXDC1, corresponding to a target binding site such as BINDING SITE I, BINDING SITE II or BINDING SITE III of FIG. 8. Table 4 illustrates the complementarity of the nucleotide sequences of BXDC1 BINDING SITE, designated SEQ ID:9229, to the nucleotide sequence of GAM3229 RNA, herein designated GAM RNA, also designated SEQ ID:221.

Another function of GAM3229 is therefore inhibition of BXDC1 (Accession XP_166303.1). Accordingly, utilities of GAM3229 include diagnosis, prevention and treatment of diseases and clinical conditions associated with BXDC1.

Chromosome 1 open reading frame 24 (C1orf24, Accession NP_443198.1) is another GAM3229 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:3152, to the nucleotide sequence of GAM3229 RNA, herein designated GAM RNA, also designated SEQ ID:221.

Another function of GAM3229 is therefore inhibition of Chromosome 1 open reading frame 24 (C1orf24, Accession NP_443198.1). Accordingly, utilities of GAM3229 include diagnosis, prevention and treatment of diseases and clinical conditions associated with C1orf24.

C1q and tumor necrosis factor related protein 6 (C1QTNF6, Accession NP_114116.2) is another GAM3229 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:19016, to the nucleotide sequence of GAM3229 RNA, herein designated GAM RNA, also designated SEQ ID:221.

Another function of GAM3229 is therefore inhibition of C1q and tumor necrosis factor related protein 6 (C1QTNF6, Accession NP_114116.2). Accordingly, utilities of GAM3229 include diagnosis, prevention and treatment of diseases and clinical conditions associated with C1QTNF6.

Chromosome 20 open reading frame 110 (C20orf110, Accession XP_086728.2) is another GAM3229 target gene, herein designated TARGET GENE. C20orf110 BINDING SITE is a target binding site found in the 3' untranslated region of mRNA encoded by C20orf110, corresponding to a target binding site such as BINDING SITE I, BINDING SITE II or BINDING SITE III of FIG. 8. Table 4 illustrates the complementarity of the nucleotide sequences of C20orf110 BINDING SITE, designated SEQ ID:19165, to the nucleotide sequence of GAM3229 RNA, herein designated GAM RNA, also designated SEQ ID:221.

Another function of GAM3229 is therefore inhibition of Chromosome 20 open reading frame 110 (C20orf110, Accession XP_086728.2). Accordingly, utilities of GAM3229 include diagnosis, prevention and treatment of diseases and clinical conditions associated with C20orf110.

Chromosome 20 open reading frame 147 (C20orf147, Accession NP_689880.1) is another GAM3229 target gene, herein designated TARGET GENE. C20orf147 BINDING SITE1 and C20orf147 BINDING SITE2 are target binding sites found in untranslated regions of mRNA encoded by C20orf147, corresponding to target binding sites such as BINDING SITE I, BINDING SITE II or BINDING SITE III of FIG. 8. Table 4 illustrates the complementarity of the nucleotide sequences of C20orf147 BINDING SITE1 and C20orf147 BINDING SITE2, designated SEQ ID:14837 and SEQ ID:4689 respectively, to the nucleotide sequence of GAM3229 RNA, herein designated GAM RNA, also designated SEQ ID:221.

Another function of GAM3229 is therefore inhibition of Chromosome 20 open reading frame 147 (C20orf147, Accession NP_689880.1). Accordingly, utilities of GAM3229 include diagnosis, prevention and treatment of diseases and clinical conditions associated with C20orf147.

Chromosome 20 open reading frame 161 (C20orf161, Accession NP_690857.1) is another GAM3229 target gene, herein designated TARGET GENE. C20orf161 BINDING SITE is a target binding site found in the 3' untranslated region of multiple transcripts of mRNA encoded by C20orf161, corresponding to a target binding site such as BINDING SITE I, BINDING SITE II or BINDING SITE III of FIG. 8. Table 4 illustrates the complementarity of the nucleotide sequences of C20orf161 BINDING SITE, designated SEQ ID:16804, to the nucleotide sequence of GAM3229 RNA, herein designated GAM RNA, also designated SEQ ID:221.

Another function of GAM3229 is therefore inhibition of Chromosome 20 open reading frame 161 (C20orf161, Accession NP_690857.1). Accordingly, utilities of GAM3229 include diagnosis, prevention and treatment of diseases and clinical conditions associated with C20orf161.

Chromosome 20 open reading frame 161 (C20orf161, Accession NP_219489.1) is another GAM3229 target gene, herein designated TARGET GENE. C20orf161 BINDING SITE is a target binding site found in the 3' untranslated region of multiple transcripts of mRNA encoded by C20orf161, corresponding to a target binding site such as BINDING SITE I, BINDING SITE II or BINDING SITE III of FIG. 8. Table 4 illustrates the complementarity of the nucleotide sequences of C20orf161 BINDING SITE, designated SEQ ID:16804, to the nucleotide sequence of GAM3229 RNA, herein designated GAM RNA, also designated SEQ ID:221.

Another function of GAM3229 is therefore inhibition of Chromosome 20 open reading frame 161 (C20orf161, Accession NP_219489.1). Accordingly, utilities of GAM3229 include diagnosis, prevention and treatment of diseases and clinical conditions associated with C20orf161.

Chromosome 20 open reading frame 177 (C20orf177, Accession XP_290955.1) is another GAM3229 target gene, herein designated TARGET GENE. C20orf177 BINDING SITE is a target binding site found in the 3' untranslated region of mRNA encoded by C20orf177, corresponding to a target binding site such as BINDING SITE I, BINDING SITE II or BINDING SITE III of FIG. 8. Table 4 illustrates the complementarity of the nucleotide sequences of C20orf177 BINDING SITE, designated SEQ ID:18324, to the nucleotide sequence of GAM3229 RNA, herein designated GAM RNA, also designated SEQ ID:221.

Another function of GAM3229 is therefore inhibition of Chromosome 20 open reading frame 177 (C20orf177, Accession XP_290955.1). Accordingly, utilities of GAM3229 include diagnosis, prevention and treatment of diseases and clinical conditions associated with C20orf177.

Chromosome 22 open reading frame 19 (C22orf19, Accession NP_003669.2) is another GAM3229 target gene, herein designated TARGET GENE. C22orf19 BINDING SITE is a target binding site found in the 3' untranslated region of mRNA encoded by C22orf19, corresponding to a target binding site such as BINDING SITE I, BINDING SITE II or BINDING SITE III of FIG. 8. Table 4 illustrates the complementarity of the nucleotide sequences of C22orf19 BINDING SITE, designated SEQ ID:12716, to the nucleotide sequence of GAM3229 RNA, herein designated GAM RNA, also designated SEQ ID:221.

Another function of GAM3229 is therefore inhibition of Chromosome 22 open reading frame 19 (C22orf19, Accession NP_003669.2). Accordingly, utilities of GAM3229 include diagnosis, prevention and treatment of diseases and clinical conditions associated with C22orf19.

C6orf141 (Accession NP_699175.1) is another GAM3229 target gene, herein designated TARGET GENE. C6orf141 BINDING SITE is a target binding site found in the 3' untranslated region of mRNA encoded by C6orf141, corresponding to a target binding site such as BINDING SITE I, BINDING SITE II or BINDING SITE III of FIG. 8. Table 4 illustrates the complementarity of the nucleotide sequences of C6orf141 BINDING SITE, designated SEQ ID:3400, to the nucleotide sequence of GAM3229 RNA, herein designated GAM RNA, also designated SEQ ID:221.

Another function of GAM3229 is therefore inhibition of C6orf141 (Accession NP_699175.1). Accordingly, utilities of GAM3229 include diagnosis, prevention and treatment of diseases and clinical conditions associated with C6orf141.

Chromosome 6 open reading frame 33 (C6orf33, Accession NP_588608.1) is another GAM3229 target gene, herein designated TARGET GENE. C6orf33 BINDING SITE1 and C6orf33 BINDING SITE2 are target binding sites found in untranslated regions of mRNA encoded by C6orf33, corresponding to target binding sites such as BINDING SITE I, BINDING SITE II or BINDING SITE III of FIG. 8. Table 4 illustrates the complementarity of the nucleotide sequences of C6orf33 BINDING SITE1 and C6orf33 BINDING SITE2, designated SEQ ID:15159 and SEQ ID:19984 respectively, to the nucleotide sequence of GAM3229 RNA, herein designated GAM RNA, also designated SEQ ID:221.

Another function of GAM3229 is therefore inhibition of Chromosome 6 open reading frame 33 (C6orf33, Accession NP_588608.1). Accordingly, utilities of GAM3229 include diagnosis, prevention and treatment of diseases and clinical conditions associated with C6orf33.

C6orf57 (Accession NP_660310.1) is another GAM3229 target gene, herein designated TARGET GENE. C6orf57 BINDING SITE is a target binding site found in the 3' untranslated region of mRNA encoded by C6orf57, corresponding to a target binding site such as BINDING SITE I, BINDING SITE II or BINDING SITE III of FIG. 8. Table 4 illustrates the complementarity of the nucleotide sequences of C6orf57 BINDING SITE, designated SEQ ID:16359, to the nucleotide sequence of GAM3229 RNA, herein designated GAM RNA, also designated SEQ ID:221.

Another function of GAM3229 is therefore inhibition of C6orf57 (Accession NP_660310.1). Accordingly, utilities of GAM3229 include diagnosis, prevention and treatment of diseases and clinical conditions associated with C6orf57.

C6orf65 (Accession NP_689944.1) is another GAM3229 target gene, herein designated TARGET GENE. C6orf65 BINDING SITE is a target binding site found in the 3' untranslated region of mRNA encoded by C6orf65, corresponding to a target binding site such as BINDING SITE I, BINDING SITE II or BINDING SITE III of FIG. 8. Table 4 illustrates the complementarity of the nucleotide sequences of C6orf65 BINDING SITE, designated SEQ ID:12905, to the nucleotide sequence of GAM3229 RNA, herein designated GAM RNA, also designated SEQ ID:221.

Another function of GAM3229 is therefore inhibition of C6orf65 (Accession NP_689944.1). Accordingly, utilities of GAM3229 include diagnosis, prevention and treatment of diseases and clinical conditions associated with C6orf65.

Chromosome 6 open reading frame 9 (C6orf9, Accession NP_071390.1) is another GAM3229 target gene, herein designated TARGET GENE. C6orf9 BINDING SITE is a target binding site found in the 3' untranslated region of mRNA encoded by C6orf9, corresponding to a target binding site such as BINDING SITE I, BINDING SITE II or BINDING SITE III of FIG. 8. Table 4 illustrates the complementarity of the nucleotide sequences of C6orf9 BINDING SITE, designated SEQ ID:8509, to the nucleotide sequence of GAM3229 RNA, herein designated GAM RNA, also designated SEQ ID:221.

Another function of GAM3229 is therefore inhibition of Chromosome 6 open reading frame 9 (C6orf9, Accession NP_071390.1). Accordingly, utilities of GAM3229 include diagnosis, prevention and treatment of diseases and clinical conditions associated with C6orf9.

Reserved (C8orf13, Accession XP_088377.1) is another GAM3229 target gene, herein designated TARGET GENE. C8orf13 BINDING SITE is a target binding site found in the 3' untranslated region of mRNA encoded by C8orf13, corresponding to a target binding site such as BINDING SITE I, BINDING SITE II or BINDING SITE III of FIG. 8. Table 4 illustrates the complementarity of the nucleotide sequences of C8orf13 BINDING SITE, designated SEQ ID:7963, to the nucleotide sequence of GAM3229 RNA, herein designated GAM RNA, also designated SEQ ID:221.

Another function of GAM3229 is therefore inhibition of Reserved (C8orf13, Accession XP_088377.1). Accordingly, utilities of GAM3229 include diagnosis, prevention and treatment of diseases and clinical conditions associated with C8orf13.

Calcium modulating ligand (CAMLG, Accession NP_001736.1) is another GAM3229 target gene, herein designated TARGET GENE. CAMLG BINDING SITE is a target binding site found in the 3' untranslated region of mRNA encoded by CAMLG, corresponding to a target binding site such as BINDING SITE I, BINDING SITE II or BINDING SITE III of FIG. 8. Table 4 illustrates the complementarity of the nucleotide sequences of CAMLG BINDING SITE, designated SEQ ID:19721, to the nucleotide sequence of GAM3229 RNA, herein designated GAM RNA, also designated SEQ ID:221.

Another function of GAM3229 is therefore inhibition of Calcium modulating ligand (CAMLG, Accession NP_001736.1), a gene which is likely involved in the mobilization of calcium as a result of the tcr/cd3 complex interaction. Accordingly, utilities of GAM3229 include diagnosis, prevention and treatment of diseases and clinical conditions associated with CAMLG.

The function of CAMLG and its association with various diseases and clinical conditions, has been established by previous studies, as described hereinabove with reference to GAM130.1. Calpain 5 (CAPN5, Accession NP_004046.1) is another GAM3229 target gene, herein designated TARGET GENE. CAPN5 BINDING SITE is a target binding site found in the 3' untranslated region of mRNA encoded by CAPN5, corresponding to a target binding site such as BINDING SITE I, BINDING SITE II or BINDING SITE III of FIG. 8. Table 4 illustrates the complementarity of the nucleotide sequences of CAPN5 BINDING SITE, designated SEQ ID:8293, to the nucleotide sequence of GAM3229 RNA, herein designated GAM RNA, also designated SEQ ID:221.

Another function of GAM3229 is therefore inhibition of Calpain 5 (CAPN5, Accession NP_004046.1), a gene which . Accordingly, utilities of GAM3229 include diagnosis, prevention and treatment of diseases and clinical conditions associated with CAPN5.

The function of CAPN5 and its association with various diseases and clinical conditions, has been established by previous studies, as described hereinabove with reference to GAM307.1. CAPRI (Accession NP_008920.3) is another GAM3229 target gene, herein designated TARGET GENE. CAPRI BINDING SITE is a target binding site found in the 3' untranslated region of mRNA encoded by CAPRI, corresponding to a target binding site such as BINDING SITE I, BINDING SITE II or BINDING SITE III of FIG. 8. Table 4 illustrates the complementarity of the nucleotide sequences of CAPRI BINDING SITE, designated SEQ ID:16875, to the nucleotide sequence of GAM3229 RNA, herein designated GAM RNA, also designated SEQ ID:221.

Another function of GAM3229 is therefore inhibition of CAPRI (Accession NP_008920.3). Accordingly, utilities of GAM3229 include diagnosis, prevention and treatment of diseases and clinical conditions associated with CAPRI.

Caspase 10, apoptosis-related cysteine protease (CASP10, Accession NP_001221.1) is another GAM3229 target gene, herein designated TARGET GENE. CASP10 BINDING SITE1 and CASP10 BINDING SITE2 are target binding sites found in untranslated regions of multiple transcripts of mRNA encoded by CASP10, corresponding to target binding sites such as BINDING SITE I, BINDING SITE II or BINDING SITE III of FIG. 8. Table 4 illustrates the complementarity of the nucleotide sequences of CASP10 BINDING SITE1 and CASP10 BINDING SITE2, designated SEQ ID:10169 and SEQ ID:9941 respectively, to the nucleotide sequence of GAM3229 RNA, herein designated GAM RNA, also designated SEQ ID:221.

Another function of GAM3229 is therefore inhibition of Caspase 10, apoptosis-related cysteine protease (CASP10, Accession NP_001221.1), a gene which is one aspartatespecific cysteine protease and important in death receptor signaling or other cellular processes and therefore may be associated with Gastric cancers. Accordingly, utilities of GAM3229 include diagnosis, prevention and treatment of Gastric cancers ., and of other diseases and clinical conditions associated with CASP10.

The function of CASP10 and its association with various diseases and clinical conditions, has been established by previous studies, as described hereinabove with reference to GAM44.1. Caspase 10, apoptosis-related cysteine protease (CASP10, Accession NP_116758.1) is another GAM3229 target gene, herein designated TARGET GENE. CASP10 BINDING SITE1 and CASP10 BINDING SITE2 are target binding sites found in untranslated regions of multiple transcripts of mRNA encoded by CASP10, corresponding to target binding sites such as BINDING SITE I, BINDING SITE II or BINDING SITE III of FIG. 8. Table 4 illustrates the complementarity of the nucleotide sequences of CASP10 BINDING SITE1 and CASP10 BINDING SITE2, designated SEQ ID:10169 and SEQ ID:10169 respectively, to the nucleotide sequence of GAM3229 RNA, herein designated GAM RNA, also designated SEQ ID:221.

Another function of GAM3229 is therefore inhibition of Caspase 10, apoptosis-related cysteine protease (CASP10, Accession NP_116758.1), a gene which is one aspartate-specific cysteine protease and important in death receptor signaling or other cellular processes and therefore may be associated with Gastric cancers. Accordingly, utilities of GAM3229 include diagnosis, prevention and treatment of Gastric cancers., and of other diseases and clinical conditions associated with CASP10.

The function of CASP10 and its association with various diseases and clinical conditions, has been established by previous studies, as described hereinabove with reference to GAM44.1. Caspase 10, apoptosis-related cysteine protease (CASP10, Accession NP_001221.1) is another GAM3229 target gene, herein designated TARGET GENE. CASP10 BINDING SITE1 and CASP10 BINDING SITE2 are target binding sites found in untranslated regions of multiple transcripts of mRNA encoded by CASP10, corresponding to target binding sites such as BINDING SITE I, BINDING SITE II or BINDING SITE III of FIG. 8. Table 4 illustrates the complementarity of the nucleotide sequences of CASP10 BINDING SITE1 and CASP10 BINDING SITE2, designated SEQ ID:9941 and SEQ ID:9941 respectively, to the nucleotide sequence of GAM3229 RNA, herein designated GAM RNA, also designated SEQ ID:221.

Another function of GAM3229 is therefore inhibition of Caspase 10, apoptosis-related cysteine protease (CASP10, Accession NP_001221.1), a gene which is one aspartate-specific cysteine protease and important in death receptor signaling or other cellular processes and therefore may be associated with Gastric cancers. Accordingly, utilities of GAM3229 include diagnosis, prevention and treatment of Gastric cancers., and of other diseases and clinical conditions associated with CASP10.

The function of CASP10 and its association with various diseases and clinical conditions, has been established by previous studies, as described hereinabove with reference to GAM44.1. Chemokine (c-c motif) ligand 16 (CCL16, Accession NP_004581.1) is another GAM3229 target gene, herein designated TARGET GENE. CCL16 BINDING SITE is a target binding site found in the 3' untranslated region of mRNA encoded by CCL16, corresponding to a target binding site such as BINDING SITE I, BINDING SITE II or BINDING SITE III of FIG. 8. Table 4 illustrates the complementarity of the nucleotide sequences of CCL16 BINDING SITE, designated SEQ ID:5788, to the nucleotide sequence of GAM3229 RNA, herein designated GAM RNA, also designated SEQ ID:221.

Another function of GAM3229 is therefore inhibition of Chemokine (c-c motif) ligand 16 (CCL16, Accession NP_004581.1). Accordingly, utilities of GAM3229 include diagnosis, prevention and treatment of diseases and clinical conditions associated with CCL16.

Chemokine (c-c motif) ligand 22 (CCL22, Accession NP_002981.2) is another GAM3229 target gene, herein designated TARGET GENE. CCL22 BINDING SITE1 and CCL22 BINDING SITE2 are target binding sites found in untranslated regions of mRNA encoded by CCL22, corresponding to target binding sites such as BINDING SITE I, BINDING SITE II or BINDING SITE III of FIG. 8. Table 4 illustrates the complementarity of the nucleotide sequences of CCL22 BINDING SITE1 and CCL22 BINDING SITE2, designated SEQ ID:3458 and SEQ ID:15508 respectively, to the nucleotide sequence of GAM3229 RNA, herein designated GAM RNA, also designated SEQ ID:221.

Another function of GAM3229 is therefore inhibition of Chemokine (c-c motif) ligand 22 (CCL22, Accession NP_002981.2). Accordingly, utilities of GAM3229 include diagnosis, prevention and treatment of diseases and clinical conditions associated with CCL22.

CDCP1 (Accession NP_073753.3) is another GAM3229 target gene, herein designated TARGET GENE. CDCP1 BINDING SITE1 and CDCP1 BINDING SITE2 are target binding sites found in untranslated regions of multiple transcripts of mRNA encoded by CDCP1, corresponding to target binding sites such as BINDING SITE I, BINDING SITE II or BINDING SITE III of FIG. 8. Table 4 illustrates the complementarity of the nucleotide sequences of CDCP1 BINDING SITE1 and CDCP1 BINDING SITE2, designated SEQ ID:10837 and SEQ ID:15862 respectively, to the nucleotide sequence of GAM3229 RNA, herein designated GAM RNA, also designated SEQ ID:221.

Another function of GAM3229 is therefore inhibition of CDCP1 (Accession NP_073753.3). Accordingly, utilities of GAM3229 include diagnosis, prevention and treatment of diseases and clinical conditions associated with CDCP1.

Cadherin 1, type 1, e-cadherin (epithelial) (CDH1, Accession NP_004351.1) is another GAM3229 target gene, herein designated TARGET GENE. CDH1 BINDING SITE is a target binding site found in the 3' untranslated region of mRNA encoded by CDH1, corresponding to a target binding site such as BINDING SITE I, BINDING SITE II or BINDING SITE III of FIG. 8. Table 4 illustrates the complementarity of the nucleotide sequences of CDH1 BINDING SITE, designated SEQ ID:15318, to the nucleotide sequence of GAM3229 RNA, herein designated GAM RNA, also designated SEQ ID:221.

Another function of GAM3229 is therefore inhibition of Cadherin 1, type 1, e-cadherin (epithelial) (CDH1, Accession NP_004351.1). Accordingly, utilities of GAM3229 include diagnosis, prevention and treatment of diseases and clinical conditions associated with CDH1.

Cat eye syndrome chromosome region, candidate 1 (CECR1, Accession NP_059120.2) is another GAM3229 target gene, herein designated TARGET GENE. CECR1 BINDING SITE is a target binding site found in the 3' untranslated region of multiple transcripts of mRNA encoded by CECR1, corresponding to a target binding site such as BINDING SITE I, BINDING SITE II or BINDING SITE III of FIG. 8. Table 4 illustrates the complementarity of the nucleotide sequences of CECR1 BINDING SITE, designated SEQ ID:4587, to the nucleotide sequence of GAM3229 RNA, herein designated GAM RNA, also designated SEQ ID:221.

Another function of GAM3229 is therefore inhibition of Cat eye syndrome chromosome region, candidate 1 (CECR1, Accession NP_059120.2). Accordingly, utilities of GAM3229 include diagnosis, prevention and treatment of diseases and clinical conditions associated with CECR1.

Cat eye syndrome chromosome region, candidate 1 (CECR1, Accession NP_803124.1) is another GAM3229 target gene, herein designated TARGET GENE. CECR1 BINDING SITE is a target binding site found in the 3' untranslated region of multiple transcripts of mRNA encoded by CECR1, corresponding to a target binding site such as BINDING SITE I, BINDING SITE II or BINDING SITE III of FIG. 8. Table 4 illustrates the complementarity of the nucleotide sequences of CECR1 BINDING SITE, designated SEQ ID:4587, to the nucleotide sequence of GAM3229 RNA, herein designated GAM RNA, also designated SEQ ID:221.

Another function of GAM3229 is therefore inhibition of Cat eye syndrome chromosome region, candidate 1 (CECR1, Accession NP_803124.1). Accordingly, utilities of GAM3229 include diagnosis, prevention and treatment of diseases and clinical conditions associated with CECR1.

Centromere protein h (CENPH, Accession NP_075060.1) is another GAM3229 target gene, herein designated TARGET GENE. CENPH BINDING SITE is a target binding site found in the 3' untranslated region of mRNA encoded by CENPH, corresponding to a target binding site such as BINDING SITE I, BINDING SITE II or BINDING SITE III of FIG. 8. Table 4 illustrates the complementarity of the nucleotide sequences of CENPH BINDING SITE, designated SEQ ID:14468, to the nucleotide sequence of GAM3229 RNA, herein designated GAM RNA, also designated SEQ ID:221.

Another function of GAM3229 is therefore inhibition of Centromere protein h (CENPH, Accession NP_075060.1). Accordingly, utilities of GAM3229 include diagnosis, prevention and treatment of diseases and clinical conditions associated with CENPH.

CGI-43 (Accession NP_056437.1) is another GAM3229 target gene, herein designated TARGET GENE. CGI-43 BINDING SITE is a target binding site found in the 3' untranslated region of mRNA encoded by CGI-43, corresponding to a target binding site such as BINDING SITE I, BINDING SITE II or BINDING SITE III of FIG. 8. Table 4 illustrates the complementarity of the nucleotide sequences of CGI-43 BINDING SITE, designated SEQ ID:3459, to the nucleotide sequence of GAM3229 RNA, herein designated GAM RNA, also designated SEQ ID:221.

Another function of GAM3229 is therefore inhibition of CGI-43 (Accession NP_056437.1). Accordingly, utilities of GAM3229 include diagnosis, prevention and treatment of diseases and clinical conditions associated with CGI-43.

Chk1 checkpoint homolog (s. pombe) (CHEK1, Accession NP_001265.1) is another GAM3229 target gene, herein designated TARGET GENE. CHEK1 BINDING SITE is a target binding site found in the 5' untranslated region of mRNA encoded by CHEK1, corresponding to a target binding site such as BINDING SITE I, BINDING SITE II or BINDING SITE III of FIG. 8. Table 4 illustrates the complementarity of the nucleotide sequences of CHEK1 BINDING SITE, designated SEQ ID:1819, to the nucleotide sequence of GAM3229 RNA, herein designated GAM RNA, also designated SEQ ID:221.

Another function of GAM3229 is therefore inhibition of Chk1 checkpoint homolog (s. pombe) (CHEK1, Accession NP_001265.1), a gene which a protein kinase that is required for the DNA damage checkpoint. Accordingly, utilities of GAM3229 include diagnosis, prevention and treatment of diseases and clinical conditions associated with CHEK1.

The function of CHEK1 and its association with various diseases and clinical conditions, has been established by previous studies, as described hereinabove with reference to GAM3154.1. Cold autoinflammatory syndrome 1 (CIAS1, Accession NP_004886.2) is another GAM3229 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:8694, to the nucleotide sequence of GAM3229 RNA, herein designated GAM RNA, also designated SEQ ID:221.

Another function of GAM3229 is therefore inhibition of Cold autoinflammatory syndrome 1 (CIAS1, Accession NP_004886.2), a gene which may mediate protein-protein interactions; contains a leucine rich repeat and therefore may be associated with Familial cold autoinflammatory syndrome, muckle-wells syndrome. Accordingly, utilities of GAM3229 include diagnosis, prevention and treatment of Familial cold autoinflammatory syndrome, muckle-wells syndrome, and of other diseases and clinical conditions associated with CIAS1.

The function of CIAS1 and its association with various diseases and clinical conditions, has been established by previous studies, as described hereinabove with reference to GAM90.1. CIP29 (Accession NP_115740.3) is another GAM3229 target gene, herein designated TARGET GENE. CIP29 BINDING SITE is a target binding site found in the 3' untranslated region of mRNA encoded by CIP29, corresponding to a target binding site such as BINDING SITE I, BINDING SITE II or BINDING SITE III of FIG. 8. Table 4 illustrates the complementarity of the nucleotide sequences of CIP29 BINDING SITE, designated SEQ ID:8546, to the nucleotide sequence of GAM3229 RNA, herein designated GAM RNA, also designated SEQ ID:221.

Another function of GAM3229 is therefore inhibition of CIP29 (Accession NP_115740.3). Accordingly, utilities of GAM3229 include diagnosis, prevention and treatment of diseases and clinical conditions associated with CIP29.

C-type (calcium dependent, carbohydrate-recognition domain) lectin, superfamily member 11 (CLECSF11, Accession NP_569708.1) is another GAM3229 target gene, herein designated TARGET GENE. CLECSF11 BINDING SITE is a target binding site found in the 5' untranslated region of mRNA encoded by CLECSF11, corresponding to a target binding site such as BINDING SITE I, BINDING SITE II or BINDING SITE III of FIG. 8. Table 4 illustrates the complementarity of the nucleotide sequences of CLECSF11 BINDING SITE, designated SEQ ID:17166, to the nucleotide sequence of GAM3229 RNA, herein designated GAM RNA, also designated SEQ ID:221.

Another function of GAM3229 is therefore inhibition of C-type (calcium dependent, carbohydrate-recognition domain) lectin, superfamily member 11 (CLECSF11, Accession NP_569708.1), a gene which may play a role in ligand internalization and presentation. Accordingly, utilities of GAM3229 include diagnosis, prevention and treatment of diseases and clinical conditions associated with CLECSF11.

The function of CLECSF11 and its association with various diseases and clinical conditions, has been established by previous studies, as described hereinabove with reference to GAM571.1. C-type (calcium dependent, carbohydrate-recognition domain) lectin, superfamily member 12 (CLECSF12, Accession NP_072092.2) is another GAM3229 target gene, herein designated TARGET GENE. CLECSF12 BINDING SITE is a target binding site found in the 3' untranslated region of mRNA encoded by CLECSF12, corresponding to a target binding site such as BINDING SITE I, BINDING SITE II or BINDING SITE III of FIG. 8. Table 4 illustrates the complementarity of the nucleotide sequences of CLECSF12 BINDING SITE, designated SEQ ID:2783, to the nucleotide sequence of GAM3229 RNA, herein designated GAM RNA, also designated SEQ ID:221.

Another function of GAM3229 is therefore inhibition of C-type (calcium dependent, carbohydrate-recognition domain) lectin, superfamily member 12 (CLECSF12, Accession NP_072092.2), a gene which is a pattern-recognition receptor. Accordingly, utilities of GAM3229 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. C-type (calcium dependent, carbohydrate-recognition domain) lectin, superfamily member 9 (CLECSF9, Accession NP_055173.1) is another GAM3229 target gene, herein designated TARGET GENE. CLECSF9 BINDING SITE is a target binding site found in the 5' untranslated region of mRNA encoded by CLECSF9, corresponding to a target binding site such as BINDING SITE I, BINDING SITE II or BINDING SITE III of FIG. 8. Table 4 illustrates the complementarity of the nucleotide sequences of CLECSF9 BINDING SITE, designated SEQ ID:12935, to the nucleotide sequence of GAM3229 RNA, herein designated GAM RNA, also designated SEQ ID:221.

Another function of GAM3229 is therefore inhibition of C-type (calcium dependent, carbohydrate-recognition domain) lectin, superfamily member 9 (CLECSF9, Accession NP_055173.1). Accordingly, utilities of GAM3229 include diagnosis, prevention and treatment of diseases and clinical conditions associated with CLECSF9.

CMRF-35H (Accession XP_046925.1) is another GAM3229 target gene, herein designated TARGET GENE. CMRF-35H BINDING SITE is a target binding site found in the 3' untranslated region of mRNA encoded by CMRF-35H, corresponding to a target binding site such as BINDING SITE I, BINDING SITE II or BINDING SITE III of FIG. 8. Table 4 illustrates the complementarity of the nucleotide sequences of CMRF-35H BINDING SITE, designated SEQ ID:3608, to the nucleotide sequence of GAM3229 RNA, herein designated GAM RNA, also designated SEQ ID:221.

Another function of GAM3229 is therefore inhibition of CMRF-35H (Accession XP_046925.1). Accordingly, utilities of GAM3229 include diagnosis, prevention and treatment of diseases and clinical conditions associated with CMRF-35H.

Contactin associated protein-like 2 (CNTNAP2, Accession NP_054860.1) is another GAM3229 target gene, herein designated TARGET GENE. CNTNAP2 BINDING SITE is a target binding site found in the 3' untranslated region of mRNA encoded by CNTNAP2, corresponding to a target binding site such as BINDING SITE I, BINDING SITE II or BINDING SITE III of FIG. 8. Table 4 illustrates the complementarity of the nucleotide sequences of CNTNAP2 BINDING SITE, designated SEQ ID:17240, to the nucleotide sequence of GAM3229 RNA, herein designated GAM RNA, also designated SEQ ID:221.

Another function of GAM3229 is therefore inhibition of Contactin associated protein-like 2 (CNTNAP2, Accession NP_054860.1). Accordingly, utilities of GAM3229 include diagnosis, prevention and treatment of diseases and clinical conditions associated with CNTNAP2.

Collectin sub-family member 12 (COLEC12, Accession NP_110408.2) is another GAM3229 target gene, herein designated TARGET GENE. COLEC12 BINDING SITE is a target binding site found in the 3' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:5286, to the nucleotide sequence of GAM3229 RNA, herein designated GAM RNA, also designated SEQ ID:221.

Another function of GAM3229 is therefore inhibition of Collectin sub-family member 12 (COLEC12, Accession NP_110408.2). Accordingly, utilities of GAM3229 include diagnosis, prevention and treatment of diseases and clinical conditions associated with COLEC12.

Coenzyme q7 homolog, ubiquinone (yeast) (COQ7, Accession NP_057222.2) is another GAM3229 target gene, herein designated TARGET GENE. COQ7 BINDING SITE is a target binding site found in the 3' untranslated region of mRNA encoded by COQ7, corresponding to a target binding site such as BINDING SITE I, BINDING SITE II or BINDING SITE III of FIG. 8. Table 4 illustrates the complementarity of the nucleotide sequences of COQ7 BINDING SITE, designated SEQ ID:5762, to the nucleotide sequence of GAM3229 RNA, herein designated GAM RNA, also designated SEQ ID:221.

Another function of GAM3229 is therefore inhibition of Coenzyme q7 homolog, ubiquinone (yeast) (COQ7, Accession NP_057222.2). Accordingly, utilities of GAM3229 include diagnosis, prevention and treatment of diseases and clinical conditions associated with COQ7.

Carboxypeptidase a4 (CPA4, Accession NP_057436.1) is another GAM3229 target gene, herein designated TARGET GENE. CPA4 BINDING SITE is a target binding site found in the 3' untranslated region of mRNA encoded by CPA4, corresponding to a target binding site such as BINDING SITE I, BINDING SITE II or BINDING SITE III of FIG. 8. Table 4 illustrates the complementarity of the nucleotide sequences of CPA4 BINDING SITE, designated SEQ ID:2783, to the nucleotide sequence of GAM3229 RNA, herein designated GAM RNA, also designated SEQ ID:221.

Another function of GAM3229 is therefore inhibition of Carboxypeptidase a4 (CPA4, Accession NP_057436.1). Accordingly, utilities of GAM3229 include diagnosis, prevention and treatment of diseases and clinical conditions associated with CPA4.

cPLA2delta (Accession XP_208820.2) is another GAM3229 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:5366, to the nucleotide sequence of GAM3229 RNA, herein designated GAM RNA, also designated SEQ ID:221.

Another function of GAM3229 is therefore inhibition of cPLA2delta (Accession XP_208820.2). Accordingly, utilities of GAM3229 include diagnosis, prevention and treatment of diseases and clinical conditions associated with cPLA2delta.

cPLA2delta (Accession NP_828848.1) is another GAM3229 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:5366, to the nucleotide sequence of GAM3229 RNA, herein designated GAM RNA, also designated SEQ ID:221.

Another function of GAM3229 is therefore inhibition of cPLA2delta (Accession NP_828848.1). Accordingly, utilities of GAM3229 include diagnosis, prevention and treatment of diseases and clinical conditions associated with cPLA2delta.

Cleavage and polyadenylation specific factor 2, 100 kda (CPSF2, Accession XP_029311.2) is another GAM3229 target gene, herein designated TARGET GENE. CPSF2 BINDING SITE is a target binding site found in the 3' untranslated region of mRNA encoded by CPSF2, corresponding to a target binding site such as BINDING SITE I, BINDING SITE II or BINDING SITE III of FIG. 8. Table 4 illustrates the complementarity of the nucleotide sequences of CPSF2 BINDING SITE, designated SEQ ID:17815, to the nucleotide sequence of GAM3229 RNA, herein designated GAM RNA, also designated SEQ ID:221.

Another function of GAM3229 is therefore inhibition of Cleavage and polyadenylation specific factor 2, 100 kda (CPSF2, Accession XP_029311.2). Accordingly, utilities of GAM3229 include diagnosis, prevention and treatment of diseases and clinical conditions associated with CPSF2.

CRB3 (Accession NP_777378.1) is another GAM3229 target gene, herein designated TARGET GENE. CRB3 BINDING SITE is a target binding site found in the 5' untranslated region of multiple transcripts of mRNA encoded by CRB3, corresponding to a target binding site such as BINDING SITE I, BINDING SITE II or BINDING SITE III of FIG. 8. Table 4 illustrates the complementarity of the nucleotide sequences of CRB3 BINDING SITE, designated SEQ ID:2333, to the nucleotide sequence of GAM3229 RNA, herein designated GAM RNA, also designated SEQ ID:221.

Another function of GAM3229 is therefore inhibition of CRB3 (Accession NP_777378.1). Accordingly, utilities of GAM3229 include diagnosis, prevention and treatment of diseases and clinical conditions associated with CRB3.

Cytokine receptor-like factor 3 (CRLF3, Accession NP_057070.2) is another GAM3229 target gene, herein designated TARGET GENE. CRLF3 BINDING SITE is a target binding site found in the 3' untranslated region of mRNA encoded by CRLF3, corresponding to a target binding site such as BINDING SITE I, BINDING SITE II or BINDING SITE III of FIG. 8. Table 4 illustrates the complementarity of the nucleotide sequences of CRLF3 BINDING SITE, designated SEQ ID:18242, to the nucleotide sequence of GAM3229 RNA, herein designated GAM RNA, also designated SEQ ID:221.

Another function of GAM3229 is therefore inhibition of Cytokine receptor-like factor 3 (CRLF3, Accession NP_057070.2). Accordingly, utilities of GAM3229 include diagnosis, prevention and treatment of diseases and clinical conditions associated with CRLF3.

Cartilage associated protein (CRTAP, Accession NP_006362.1) is another GAM3229 target gene, herein designated TARGET GENE. CRTAP BINDING SITE is a target binding site found in the 3' untranslated region of mRNA encoded by CRTAP, corresponding to a target binding site such as BINDING SITE I, BINDING SITE II or BINDING SITE III of FIG. 8. Table 4 illustrates the complementarity of the nucleotide sequences of CRTAP BINDING SITE, designated SEQ ID:7898, to the nucleotide sequence of GAM3229 RNA, herein designated GAM RNA, also designated SEQ ID:221.

Another function of GAM3229 is therefore inhibition of Cartilage associated protein (CRTAP, Accession NP_006362.1), a gene which is a novel developmentally regulated chick embryo protein. Accordingly, utilities of GAM3229 include diagnosis, prevention and treatment of diseases and clinical conditions associated with CRTAP.

The function of CRTAP and its association with various diseases and clinical conditions, has been established by previous studies, as described hereinabove with reference to GAM136.1. CST (Accession NP_004852.1) is another GAM3229 target gene, herein designated TARGET GENE. CST BINDING SITE is a target binding site found in the 5' untranslated region of mRNA encoded by CST, corresponding to a target binding site such as BINDING SITE I, BINDING SITE II or BINDING SITE III of FIG. 8. Table 4 illustrates the complementarity of the nucleotide sequences of CST BINDING SITE, designated SEQ ID:19277, to the nucleotide sequence of GAM3229 RNA, herein designated GAM RNA, also designated SEQ ID:221.

Another function of GAM3229 is therefore inhibition of CST (Accession NP_004852.1), a gene which nucleotide-sugar transporter. Accordingly, utilities of GAM3229 include diagnosis, prevention and treatment of diseases and clinical conditions associated with CST.

The function of CST and its association with various diseases and clinical conditions, has been established by previous studies, as described hereinabove with reference to GAM221.1. CTEN (Accession NP_116254.3) is another GAM3229 target gene, herein designated TARGET GENE. CTEN BINDING SITE is a target binding site found in the 3' untranslated region of mRNA encoded by CTEN, corresponding to a target binding site such as BINDING SITE I, BINDING SITE II or BINDING SITE III of FIG. 8. Table 4 illustrates the complementarity of the nucleotide sequences of CTEN BINDING SITE, designated SEQ ID:12312, to the nucleotide sequence of GAM3229 RNA, herein designated GAM RNA, also designated SEQ ID:221.

Another function of GAM3229 is therefore inhibition of CTEN (Accession NP_116254.3). Accordingly, utilities of GAM3229 include diagnosis, prevention and treatment of diseases and clinical conditions associated with CTEN.

Cathepsin b (CTSB, Accession NP_680090.1) is another GAM3229 target gene, herein designated TARGET GENE. CTSB BINDING SITE is a target binding site found in the 5' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:1677, to the nucleotide sequence of GAM3229 RNA, herein designated GAM RNA, also designated SEQ ID:221.

Another function of GAM3229 is therefore inhibition of Cathepsin b (CTSB, Accession NP_680090.1). Accordingly, utilities of GAM3229 include diagnosis, prevention and treatment of diseases and clinical conditions associated with CTSB.

Cathepsin b (CTSB, Accession NP_680092.1) is another GAM3229 target gene, herein designated TARGET GENE. CTSB BINDING SITE is a target binding site found in the 5' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:1677, to the nucleotide sequence of GAM3229 RNA, herein designated GAM RNA, also designated SEQ ID:221.

Another function of GAM3229 is therefore inhibition of Cathepsin b (CTSB, Accession NP_680092.1). Accordingly, utilities of GAM3229 include diagnosis, prevention and treatment of diseases and clinical conditions associated with CTSB.

Cytochrome p450, subfamily i (aromatic compound-inducible), polypeptide 2 (CYP1A2, Accession NP_000752.1) is another GAM3229 target gene, herein designated TARGET GENE. CYP1A2 BINDING SITE is a target binding site found in the 3' untranslated region of mRNA encoded by CYP1A2, corresponding to a target binding site such as BINDING SITE I, BINDING SITE II or BINDING SITE III of FIG. 8. Table 4 illustrates the complementarity of the nucleotide sequences of CYP1A2 BINDING SITE, designated SEQ ID:4564, to the nucleotide sequence of GAM3229 RNA, herein designated GAM RNA, also designated SEQ ID:221.

Another function of GAM3229 is therefore inhibition of Cytochrome p450, subfamily i (aromatic compound-inducible), polypeptide 2 (CYP1A2, Accession NP_000752.1), a gene which intervenes in an NADPH-dependent electron transport pathway. and therefore may be associated with Porphyria cutanea tarda. Accordingly, utilities of GAM3229 include diagnosis, prevention and treatment of Porphyria cutanea tarda, and of other diseases and clinical conditions associated with CYP1A2.

The function of CYP1A2 and its association with various diseases and clinical conditions, has been established by previous studies, as described hereinabove with reference to GAM30.1. Cytochrome p450, subfamily iib (phenobarbital-inducible), polypeptide 6 (CYP2B6, Accession NP_000758.1) is another GAM3229 target gene, herein designated TARGET GENE. CYP2B6 BINDING SITE1 and CYP2B6 BINDING SITE2 are target binding sites found in untranslated regions of mRNA encoded by CYP2B6, corresponding to target binding sites such as BINDING SITE I, BINDING SITE II or BINDING SITE III of FIG. 8. Table 4 illustrates the complementarity of the nucleotide sequences of CYP2B6 BINDING SITE1 and CYP2B6 BINDING SITE2, designated SEQ ID:5285 and SEQ ID:11371 respectively, to the nucleotide sequence of GAM3229 RNA, herein designated GAM RNA, also designated SEQ ID:221.

Another function of GAM3229 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM3229 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. Cytochrome p450, subfamily iic (mephenytoin 4-hydroxylase), polypeptide 18 (CYP2C18, Accession NP_000763.1) is another GAM3229 target gene, herein designated TARGET GENE. CYP2C18 BINDING SITE is a target binding site found in the 3' untranslated region of mRNA encoded by CYP2C18, corresponding to a target binding site such as BINDING SITE I, BINDING SITE II or BINDING SITE III of FIG. 8. Table 4 illustrates the complementarity of the nucleotide sequences of CYP2C18 BINDING SITE, designated SEQ ID:7874, to the nucleotide sequence of GAM3229 RNA, herein designated GAM RNA, also designated SEQ ID:221.

Another function of GAM3229 is therefore inhibition of Cytochrome p450, subfamily iic (mephenytoin 4-hydroxylase), polypeptide 18 (CYP2C18, Accession NP_000763.1). Accordingly, utilities of GAM3229 include diagnosis, prevention and treatment of diseases and clinical conditions associated with CYP2C18.

CYP51A1 (Accession NP_000777.1) is another GAM3229 target gene, herein designated TARGET GENE. CYP51A1 BINDING SITE is a target binding site found in the 3' untranslated region of mRNA encoded by CYP51A1, corresponding to a target binding site such as BINDING SITE I, BINDING SITE II or BINDING SITE III of FIG. 8. Table 4 illustrates the complementarity of the nucleotide sequences of CYP51A1 BINDING SITE, designated SEQ ID:18360, to the nucleotide sequence of GAM3229 RNA, herein designated GAM RNA, also designated SEQ ID:221.

Another function of GAM3229 is therefore inhibition of CYP51A1 (Accession NP_000777.1). Accordingly, utilities of GAM3229 include diagnosis, prevention and treatment of diseases and clinical conditions associated with CYP51A1.

Cytochrome p450, subfamily viiib (sterol 12-alpha-hydroxylase), polypeptide 1 (CYP8B1, Accession NP_004382.1) is another GAM3229 target gene, herein designated TARGET GENE. CYP8B1 BINDING SITE1 and CYP8B1 BINDING SITE2 are target binding sites found in untranslated regions of mRNA encoded by CYP8B1, corresponding to target binding sites such as BINDING SITE I, BINDING SITE II or BINDING SITE III of FIG. 8. Table 4 illustrates the complementarity of the nucleotide sequences of CYP8B1 BINDING SITE1 and CYP8B1 BINDING SITE2, designated SEQ ID:5673 and SEQ ID:15966 respectively, to the nucleotide sequence of GAM3229 RNA, herein designated GAM RNA, also designated SEQ ID:221.

Another function of GAM3229 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM3229 include diagnosis, prevention and treatment of diseases and clinical conditions associated with CYP8B1.

The function of CYP8B1 and its association with various diseases and clinical conditions, has been established by previous studies, as described hereinabove with reference to GAM47.1. Debranching enzyme homolog 1 (s. cerevisiae) (DBR1, Accession NP_057300.1) is another GAM3229 target gene, herein designated TARGET GENE. DBR1 BINDING SITE is a target binding site found in the 3' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:6398, to the nucleotide sequence of GAM3229 RNA, herein designated GAM RNA, also designated SEQ ID:221.

Another function of GAM3229 is therefore inhibition of Debranching enzyme homolog 1 (s. cerevisiae) (DBR1, Accession NP_057300.1). Accordingly, utilities of GAM3229 include diagnosis, prevention and treatment of diseases and clinical conditions associated with DBR1.

Doublecortex; lissencephaly, x-linked (doublecortin) (DCX, Accession NP_000546.2) is another GAM3229 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:8602, to the nucleotide sequence of GAM3229 RNA, herein designated GAM RNA, also designated SEQ ID:221.

Another function of GAM3229 is therefore inhibition of Doublecortex; lissencephaly, x-linked (doublecortin) (DCX, Accession NP_000546.2). Accordingly, utilities of GAM3229 include diagnosis, prevention and treatment of diseases and clinical conditions associated with DCX.

Doublecortex; lissencephaly, x-linked (doublecortin) (DCX, Accession NP_835366.1) is another GAM3229 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:8602, to the nucleotide sequence of GAM3229 RNA, herein designated GAM RNA, also designated SEQ ID:221.

Another function of GAM3229 is therefore inhibition of Doublecortex; lissencephaly, x-linked (doublecortin) (DCX, Accession NP_835366.1). Accordingly, utilities of GAM3229 include diagnosis, prevention and treatment of diseases and clinical conditions associated with DCX.

Doublecortex; lissencephaly, x-linked (doublecortin) (DCX, Accession NP_835365.1) is another GAM3229 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:8602, to the nucleotide sequence of GAM3229 RNA, herein designated GAM RNA, also designated SEQ ID:221.

Another function of GAM3229 is therefore inhibition of Doublecortex; lissencephaly, x-linked (doublecortin) (DCX, Accession NP_835365.1). Accordingly, utilities of GAM3229 include diagnosis, prevention and treatment of diseases and clinical conditions associated with DCX.

Doublecortex; lissencephaly, x-linked (doublecortin) (DCX, Accession NP_835364.1) is another GAM3229 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:8602, to the nucleotide sequence of GAM3229 RNA, herein designated GAM RNA, also designated SEQ ID:221.

Another function of GAM3229 is therefore inhibition of Doublecortex; lissencephaly, x-linked (doublecortin) (DCX, Accession NP_835364.1). Accordingly, utilities of GAM3229 include diagnosis, prevention and treatment of diseases and clinical conditions associated with DCX.

DEPP (Accession NP_008952.1) is another GAM3229 target gene, herein designated TARGET GENE. DEPP BINDING SITE is a target binding site found in the 3' untranslated region of mRNA encoded by DEPP, corresponding to a target binding site such as BINDING SITE I, BINDING SITE II or BINDING SITE III of FIG. 8. Table 4 illustrates the complementarity of the nucleotide sequences of DEPP BINDING SITE, designated SEQ ID:10348, to the nucleotide sequence of GAM3229 RNA, herein designated GAM RNA, also designated SEQ ID:221.

Another function of GAM3229 is therefore inhibition of DEPP (Accession NP_008952.1). Accordingly, utilities of GAM3229 include diagnosis, prevention and treatment of diseases and clinical conditions associated with DEPP.

Dna fragmentation factor, 40 kda, beta polypeptide (caspase-activated dnase) (DFFB, Accession NP_004393.1) is another GAM3229 target gene, herein designated TARGET GENE. DFFB BINDING SITE is a target binding site found in the 3' untranslated region of mRNA encoded by DFFB, corresponding to a target binding site such as BINDING SITE I, BINDING SITE II or BINDING SITE III of FIG. 8. Table 4 illustrates the complementarity of the nucleotide sequences of DFFB BINDING SITE, designated SEQ ID:8629, to the nucleotide sequence of GAM3229 RNA, herein designated GAM RNA, also designated SEQ ID:221.

Another function of GAM3229 is therefore inhibition of Dna fragmentation factor, 40 kda, beta polypeptide (caspase-activated dnase) (DFFB, Accession NP_004393.1), a gene which induces DNA fragmentation and chromatin condensation during apoptosis. Accordingly, utilities of GAM3229 include diagnosis, prevention and treatment of diseases and clinical conditions associated with DFFB.

The function of DFFB and its association with various diseases and clinical conditions, has been established by previous studies, as described hereinabove with reference to GAM130.1. Dihydrofolate reductase (DHFR, Accession NP_000782.1) is another GAM3229 target gene, herein designated TARGET GENE. DHFR BINDING SITE is a target binding site found in the 3' untranslated region of mRNA encoded by DHFR, corresponding to a target binding site such as BINDING SITE I, BINDING SITE II or BINDING SITE III of FIG. 8. Table 4 illustrates the complementarity of the nucleotide sequences of DHFR BINDING SITE, designated SEQ ID:19487, to the nucleotide sequence of GAM3229 RNA, herein designated GAM RNA, also designated SEQ ID:221.

Another function of GAM3229 is therefore inhibition of Dihydrofolate reductase (DHFR, Accession NP_000782.1), a gene which converts dihydrofolate into tetrahydrofolate. Accordingly, utilities of GAM3229 include diagnosis, prevention and treatment of diseases and clinical conditions associated with DHFR.

The function of DHFR and its association with various diseases and clinical conditions, has been established by previous studies, as described hereinabove with reference to GAM64.1. DIRAS1 (Accession NP_660156.1) is another GAM3229 target gene, herein designated TARGET GENE. DIRAS1 BINDING SITE is a target binding site found in the 3' untranslated region of mRNA encoded by DIRAS1, corresponding to a target binding site such as BINDING SITE I, BINDING SITE II or BINDING SITE III of FIG. 8. Table 4 illustrates the complementarity of the nucleotide sequences of DIRAS1 BINDING SITE, designated SEQ ID:19599, to the nucleotide sequence of GAM3229 RNA, herein designated GAM RNA, also designated SEQ ID:221.

Another function of GAM3229 is therefore inhibition of DIRAS1 (Accession NP_660156.1). Accordingly, utilities of GAM3229 include diagnosis, prevention and treatment of diseases and clinical conditions associated with DIRAS1.

Disrupted in schizophrenia 1 (DISC1, Accession NP_061132.1) is another GAM3229 target gene, herein designated TARGET GENE. DISC1 BINDING SITE is a target binding site found in the 3' untranslated region of mRNA encoded by DISC1, corresponding to a target binding site such as BINDING SITE I, BINDING SITE II or BINDING SITE III of FIG. 8. Table 4 illustrates the complementarity of the nucleotide sequences of DISC1 BINDING SITE, designated SEQ ID:14849, to the nucleotide sequence of GAM3229 RNA, herein designated GAM RNA, also designated SEQ ID:221.

Another function of GAM3229 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM3229 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. DKFZP434B044 (Accession NP_113664.1) is another GAM3229 target gene, herein designated TARGET GENE. DKFZP434B044 BINDING SITE is a target binding site found in the 3' untranslated region of mRNA encoded by DKFZP434B044, corresponding to a target binding site such as BINDING SITE I, BINDING SITE II or BINDING SITE III of FIG. 8. Table 4 illustrates the complementarity of the nucleotide sequences of DKFZP434B044 BINDING SITE, designated SEQ ID:13291, to the nucleotide sequence of GAM3229 RNA, herein designated GAM RNA, also designated SEQ ID:221.

Another function of GAM3229 is therefore inhibition of DKFZP434B044 (Accession NP_113664.1). Accordingly, utilities of GAM3229 include diagnosis, prevention and treatment of diseases and clinical conditions associated with DKFZP434B044.

DKFZp434C0923 (Accession NP_060068.1) is another GAM3229 target gene, herein designated TARGET GENE. DKFZp434C0923 BINDING SITE1 and DKFZp434C0923 BINDING SITE2 are target binding sites found in untranslated regions of mRNA encoded by DKFZp434C0923, corresponding to target binding sites such as BINDING SITE I, BINDING SITE II or BINDING SITE III of FIG. 8. Table 4 illustrates the complementarity of the nucleotide sequences of DKFZp434C0923 BINDING SITE1 and DKFZp434C0923 BINDING SITE2, designated SEQ ID:12561 and SEQ ID:15862 respectively, to the nucleotide sequence of GAM3229 RNA, herein designated GAM RNA, also designated SEQ ID:221.

Another function of GAM3229 is therefore inhibition of DKFZp434C0923 (Accession NP_060068.1). Accordingly, utilities of GAM3229 include diagnosis, prevention and treatment of diseases and clinical conditions associated with DKFZp434C0923.

DKFZP434F0318 (Accession NP_110444.1) is another GAM3229 target gene, herein designated TARGET GENE. DKFZP434F0318 BINDING SITE is a target binding site found in the 3' untranslated region of mRNA encoded by DKFZP434F0318, corresponding to a target binding site such as BINDING SITE I, BINDING SITE II or BINDING SITE III of FIG. 8. Table 4 illustrates the complementarity of the nucleotide sequences of DKFZP434F0318 BINDING SITE, designated SEQ ID:1165, to the nucleotide sequence of GAM3229 RNA, herein designated GAM RNA, also designated SEQ ID:221.

Another function of GAM3229 is therefore inhibition of DKFZP434F0318 (Accession NP_110444.1). Accordingly, utilities of GAM3229 include diagnosis, prevention and treatment of diseases and clinical conditions associated with DKFZP434F0318.

DKFZp434J0226 (Accession XP_051327.1) is another GAM3229 target gene, herein designated TARGET GENE. DKFZp434J0226 BINDING SITE is a target binding site found in the 5' untranslated region of mRNA encoded by DKFZp434J0226, corresponding to a target binding site such as BINDING SITE I, BINDING SITE II or BINDING SITE III of FIG. 8. Table 4 illustrates the complementarity of the nucleotide sequences of DKFZp434J0226 BINDING SITE, designated SEQ ID:10801, to the nucleotide sequence of GAM3229 RNA, herein designated GAM RNA, also designated SEQ ID:221.

Another function of GAM3229 is therefore inhibition of DKFZp434J0226 (Accession XP_051327.1). Accordingly, utilities of GAM3229 include diagnosis, prevention and treatment of diseases and clinical conditions associated with DKFZp434J0226.

DKFZP564J0863 (Accession NP_056274.1) is another GAM3229 target gene, herein designated TARGET GENE. DKFZP564J0863 BINDING SITE is a target binding site found in the 3' untranslated region of mRNA encoded by DKFZP564J0863, corresponding to a target binding site such as BINDING SITE I, BINDING SITE II or BINDING SITE III of FIG. 8. Table 4 illustrates the complementarity of the nucleotide sequences of DKFZP564J0863 BINDING SITE, designated SEQ ID:15802, to the nucleotide sequence of GAM3229 RNA, herein designated GAM RNA, also designated SEQ ID:221.

Another function of GAM3229 is therefore inhibition of DKFZP564J0863 (Accession NP_056274.1). Accordingly, utilities of GAM3229 include diagnosis, prevention and treatment of diseases and clinical conditions associated with DKFZP564J0863.

DKFZP566I1024 (Accession NP_056226.1) is another GAM3229 target gene, herein designated TARGET GENE. DKFZP566I1024 BINDING SITE1 and DKFZP566I1024 BINDING SITE2 are target binding sites found in untranslated regions of mRNA encoded by DKFZP566I1024, corresponding to target binding sites such as BINDING SITE I, BINDING SITE II or BINDING SITE III of FIG. 8. Table 4 illustrates the complementarity of the nucleotide sequences of DKFZP566I1024 BINDING SITE1 and DKFZP566I1024 BINDING SITE2, designated SEQ ID:19870 and SEQ ID:18357 respectively, to the nucleotide sequence of GAM3229 RNA, herein designated GAM RNA, also designated SEQ ID:221.

Another function of GAM3229 is therefore inhibition of DKFZP566I1024 (Accession NP_056226.1). Accordingly, utilities of GAM3229 include diagnosis, prevention and treatment of diseases and clinical conditions associated with DKFZP566I1024.

DKFZP586A0522 (Accession NP_054752.1) is another GAM3229 target gene, herein designated TARGET GENE. DKFZP586A0522 BINDING SITE is a target binding site found in the 3' untranslated region of mRNA encoded by DKFZP586A0522, corresponding to a target binding site such as BINDING SITE I, BINDING SITE II or BINDING SITE III of FIG. 8. Table 4 illustrates the complementarity of the nucleotide sequences of DKFZP586A0522 BINDING SITE, designated SEQ ID:15526, to the nucleotide sequence of GAM3229 RNA, herein designated GAM RNA, also designated SEQ ID:221.

Another function of GAM3229 is therefore inhibition of DKFZP586A0522 (Accession NP_054752.1). Accordingly, utilities of GAM3229 include diagnosis, prevention and treatment of diseases and clinical conditions associated with DKFZP586A0522.

DKFZp667B1218 (Accession NP_808881.1) is another GAM3229 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:10537, to the nucleotide sequence of GAM3229 RNA, herein designated GAM RNA, also designated SEQ ID:221.

Another function of GAM3229 is therefore inhibition of DKFZp667B1218 (Accession NP_808881.1). Accordingly, utilities of GAM3229 include diagnosis, prevention and treatment of diseases and clinical conditions associated with DKFZp667B1218.

DKFZp667E0512 (Accession XP_117353.1) is another GAM3229 target gene, herein designated TARGET GENE. DKFZp667E0512 BINDING SITE is a target binding site found in the 3' untranslated region of mRNA encoded by DKFZp667E0512, corresponding to a target binding site such as BINDING SITE I, BINDING SITE II or BINDING SITE III of FIG. 8. Table 4 illustrates the complementarity of the nucleotide sequences of DKFZp667E0512 BINDING SITE, designated SEQ ID:18552, to the nucleotide sequence of GAM3229 RNA, herein designated GAM RNA, also designated SEQ ID:221.

Another function of GAM3229 is therefore inhibition of DKFZp667E0512 (Accession XP_117353.1). Accordingly, utilities of GAM3229 include diagnosis, prevention and treatment of diseases and clinical conditions associated with DKFZp667E0512.

DKFZp686G052 (Accession XP_300559.1) is another GAM3229 target gene, herein designated TARGET GENE. DKFZp686G052 BINDING SITE is a target binding site found in the 3' untranslated region of mRNA encoded by DKFZp686G052, corresponding to a target binding site such as BINDING SITE I, BINDING SITE II or BINDING SITE III of FIG. 8. Table 4 illustrates the complementarity of the nucleotide sequences of DKFZp686G052 BINDING SITE, designated SEQ ID:6504, to the nucleotide sequence of GAM3229 RNA, herein designated GAM RNA, also designated SEQ ID:221.

Another function of GAM3229 is therefore inhibition of DKFZp686G052 (Accession XP_300559.1). Accordingly, utilities of GAM3229 include diagnosis, prevention and treatment of diseases and clinical conditions associated with DKFZp686G052.

DKFZp761H039 (Accession NP_061181.1) is another GAM3229 target gene, herein designated TARGET GENE. DKFZp761H039 BINDING SITE is a target binding site found in the 3' untranslated region of mRNA encoded by DKFZp761H039, corresponding to a target binding site such as BINDING SITE I, BINDING SITE II or BINDING SITE III of FIG. 8. Table 4 illustrates the complementarity of the nucleotide sequences of DKFZp761H039 BINDING SITE, designated SEQ ID:13622, to the nucleotide sequence of GAM3229 RNA, herein designated GAM RNA, also designated SEQ ID:221.

Another function of GAM3229 is therefore inhibition of DKFZp761H039 (Accession NP_061181.1). Accordingly, utilities of GAM3229 include diagnosis, prevention and treatment of diseases and clinical conditions associated with DKFZp761H039.

DKFZp761P1121 (Accession NP_690870.1) is another GAM3229 target gene, herein designated TARGET GENE. DKFZp761P1121 BINDING SITE is a target binding site found in the 3' untranslated region of mRNA encoded by DKFZp761P1121, corresponding to a target binding site such as BINDING SITE I, BINDING SITE II or BINDING SITE III of FIG. 8. Table 4 illustrates the complementarity of the nucleotide sequences of DKFZp761P1121 BINDING SITE, designated SEQ ID:10832, to the nucleotide sequence of GAM3229 RNA, herein designated GAM RNA, also designated SEQ ID:221.

Another function of GAM3229 is therefore inhibition of DKFZp761P1121 (Accession NP_690870.1). Accordingly, utilities of GAM3229 include diagnosis, prevention and treatment of diseases and clinical conditions associated with DKFZp761P1121.

DKFZp762C2414 (Accession NP_848637.1) is another GAM3229 target gene, herein designated TARGET GENE. DKFZp762C2414 BINDING SITE is a target binding site found in the 3' untranslated region of mRNA encoded by DKFZp762C2414, corresponding to a target binding site such as BINDING SITE I, BINDING SITE II or BINDING SITE III of FIG. 8. Table 4 illustrates the complementarity of the nucleotide sequences of DKFZp762C2414 BINDING SITE, designated SEQ ID:7031, to the nucleotide sequence of GAM3229 RNA, herein designated GAM RNA, also designated SEQ ID:221.

Another function of GAM3229 is therefore inhibition of DKFZp762C2414 (Accession NP_848637.1). Accordingly, utilities of GAM3229 include diagnosis, prevention and treatment of diseases and clinical conditions associated with DKFZp762C2414.

DKFZp762H185 (Accession XP_172976.2) is another GAM3229 target gene, herein designated TARGET GENE. DKFZp762H185 BINDING SITE is a target binding site found in the 3' untranslated region of mRNA encoded by DKFZp762H185, corresponding to a target binding site such as BINDING SITE I, BINDING SITE II or BINDING SITE III of FIG. 8. Table 4 illustrates the complementarity of the nucleotide sequences of DKFZp762H185 BINDING SITE, designated SEQ ID:4228, to the nucleotide sequence of GAM3229 RNA, herein designated GAM RNA, also designated SEQ ID:221.

Another function of GAM3229 is therefore inhibition of DKFZp762H185 (Accession XP_172976.2). Accordingly, utilities of GAM3229 include diagnosis, prevention and treatment of diseases and clinical conditions associated with DKFZp762H185.

Dystrophia myotonica-protein kinase (DMPK, Accession NP_004400.3) is another GAM3229 target gene, herein designated TARGET GENE. DMPK BINDING SITE is a target binding site found in the 5' untranslated region of mRNA encoded by DMPK, corresponding to a target binding site such as BINDING SITE I, BINDING SITE II or BINDING SITE III of FIG. 8. Table 4 illustrates the complementarity of the nucleotide sequences of DMPK BINDING SITE, designated SEQ ID:7032, to the nucleotide sequence of GAM3229 RNA, herein designated GAM RNA, also designated SEQ ID:221.

Another function of GAM3229 is therefore inhibition of Dystrophia myotonica-protein kinase (DMPK, Accession NP_004400.3). Accordingly, utilities of GAM3229 include diagnosis, prevention and treatment of diseases and clinical conditions associated with DMPK.

Dnaj (hsp40) homolog, subfamily a, member 3 (DNAJA3, Accession NP_005138.2) is another GAM3229 target gene, herein designated TARGET GENE. DNAJA3 BINDING SITE is a target binding site found in the 3' untranslated region of mRNA encoded by DNAJA3, corresponding to a target binding site such as BINDING SITE I, BINDING SITE II or BINDING SITE III of FIG. 8. Table 4 illustrates the complementarity of the nucleotide sequences of DNAJA3 BINDING SITE, designated SEQ ID:6370, to the nucleotide sequence of GAM3229 RNA, herein designated GAM RNA, also designated SEQ ID:221.

Another function of GAM3229 is therefore inhibition of Dnaj (hsp40) homolog, subfamily a, member 3 (DNAJA3, Accession NP_005138.2). Accordingly, utilities of GAM3229 include diagnosis, prevention and treatment of diseases and clinical conditions associated with DNAJA3.

DUSP18 (Accession NP_689724.2) is another GAM3229 target gene, herein designated TARGET GENE. DUSP18 BINDING SITE is a target binding site found in the 3' untranslated region of mRNA encoded by DUSP18, corresponding to a target binding site such as BINDING SITE I, BINDING SITE II or BINDING SITE III of FIG. 8. Table 4 illustrates the complementarity of the nucleotide sequences of DUSP18 BINDING SITE, designated SEQ ID:7626, to the nucleotide sequence of GAM3229 RNA, herein designated GAM RNA, also designated SEQ ID:221.

Another function of GAM3229 is therefore inhibition of DUSP18 (Accession NP_689724.2). Accordingly, utilities of GAM3229 include diagnosis, prevention and treatment of diseases and clinical conditions associated with DUSP18.

Dual specificity phosphatase 19 (DUSP19, Accession NP_543152.1) is another GAM3229 target gene, herein designated TARGET GENE. DUSP19 BINDING SITE is a target binding site found in the 3' untranslated region of mRNA encoded by DUSP19, corresponding to a target binding site such as BINDING SITE I, BINDING SITE II or BINDING SITE III of FIG. 8. Table 4 illustrates the complementarity of the nucleotide sequences of DUSP19 BINDING SITE, designated SEQ ID:6797, to the nucleotide sequence of GAM3229 RNA, herein designated GAM RNA, also designated SEQ ID:221.

Another function of GAM3229 is therefore inhibition of Dual specificity phosphatase 19 (DUSP19, Accession NP_543152.1). Accordingly, utilities of GAM3229 include diagnosis, prevention and treatment of diseases and clinical conditions associated with DUSP19.

Dual specificity phosphatase 7 (DUSP7, Accession XP_037430.6) is another GAM3229 target gene, herein designated TARGET GENE. DUSP7 BINDING SITE is a target binding site found in the 3' untranslated region of mRNA encoded by DUSP7, corresponding to a target binding site such as BINDING SITE I, BINDING SITE II or BINDING SITE III of FIG. 8. Table 4 illustrates the complementarity of the nucleotide sequences of DUSP7 BINDING SITE, designated SEQ ID:6796, to the nucleotide sequence of GAM3229 RNA, herein designated GAM RNA, also designated SEQ ID:221.

Another function of GAM3229 is therefore inhibition of Dual specificity phosphatase 7 (DUSP7, Accession XP_037430.6), a gene which is a member of the dual specificity protein phosphatase family. Accordingly, utilities of GAM3229 include diagnosis, prevention and treatment of diseases and clinical conditions associated with DUSP7.

The function of DUSP7 and its association with various diseases and clinical conditions, has been established by previous studies, as described hereinabove with reference to GAM71.1. Dual-specificity tyrosine-(y)-phosphorylation regulated kinase 1a (DYRK1A, Accession NP_567824.1) is another GAM3229 target gene, herein designated TARGET GENE. DYRK1A BINDING SITE is a target binding site found in the 5' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:15252, to the nucleotide sequence of GAM3229 RNA, herein designated GAM RNA, also designated SEQ ID:221.

Another function of GAM3229 is therefore inhibition of Dual-specificity tyrosine-(y)-phosphorylation regulated kinase 1a (DYRK1A, Accession NP_567824.1), a gene which regulates cell proliferation and may be involved in brain development . and therefore may be associated with Down syndrome. Accordingly, utilities of GAM3229 include diagnosis, prevention and treatment of Down syndrome, and of other diseases and clinical conditions associated with DYRK1A.

The function of DYRK1A and its association with various diseases and clinical conditions, has been established by previous studies, as described hereinabove with reference to GAM63.1. Eukaryotic translation initiation factor 5a2 (EIF5A2, Accession NP_065123.1) is another GAM3229 target gene, herein designated TARGET GENE. EIF5A2 BINDING SITE is a target binding site found in the 3' untranslated region of mRNA encoded by EIF5A2, corresponding to a target binding site such as BINDING SITE I, BINDING SITE II or BINDING SITE III of FIG. 8. Table 4 illustrates the complementarity of the nucleotide sequences of EIF5A2 BINDING SITE, designated SEQ ID:14800, to the nucleotide sequence of GAM3229 RNA, herein designated GAM RNA, also designated SEQ ID:221.

Another function of GAM3229 is therefore inhibition of Eukaryotic translation initiation factor 5a2 (EIF5A2, Accession NP_065123.1). Accordingly, utilities of GAM3229 include diagnosis, prevention and treatment of diseases and clinical conditions associated with EIF5A2.

ELP3 (Accession NP_060561.3) is another GAM3229 target gene, herein designated TARGET GENE. ELP3 BINDING SITE is a target binding site found in the 3' untranslated region of mRNA encoded by ELP3, corresponding to a target binding site such as BINDING SITE I, BINDING SITE II or BINDING SITE III of FIG. 8. Table 4 illustrates the complementarity of the nucleotide sequences of ELP3 BINDING SITE, designated SEQ ID:11180, to the nucleotide sequence of GAM3229 RNA, herein designated GAM RNA, also designated SEQ ID:221.

Another function of GAM3229 is therefore inhibition of ELP3 (Accession NP_060561.3). Accordingly, utilities of GAM3229 include diagnosis, prevention and treatment of diseases and clinical conditions associated with ELP3.

Ecotropic viral integration site 5 (EVI5, Accession NP_005656.2) is another GAM3229 target gene, herein designated TARGET GENE. EVI5 BINDING SITE is a target binding site found in the 3' untranslated region of mRNA encoded by EVI5, corresponding to a target binding site such as BINDING SITE I, BINDING SITE II or BINDING SITE III of FIG. 8. Table 4 illustrates the complementarity of the nucleotide sequences of EVI5 BINDING SITE, designated SEQ ID:10675, to the nucleotide sequence of GAM3229 RNA, herein designated GAM RNA, also designated SEQ ID:221.

Another function of GAM3229 is therefore inhibition of Ecotropic viral integration site 5 (EVI5, Accession NP_005656.2). Accordingly, utilities of GAM3229 include diagnosis, prevention and treatment of diseases and clinical conditions associated with EVI5.

Coagulation factor iii (thromboplastin, tissue factor) (F3, Accession NP_001984.1) is another GAM3229 target gene, herein designated TARGET GENE. F3 BINDING SITE is a target binding site found in the 3' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:17533, to the nucleotide sequence of GAM3229 RNA, herein designated GAM RNA, also designated SEQ ID:221.

Another function of GAM3229 is therefore inhibition of Coagulation factor iii (thromboplastin, tissue factor) (F3, Accession NP_001984.1), a gene which functions in normal hemostasis. Accordingly, utilities of GAM3229 include diagnosis, prevention and treatment of diseases and clinical conditions associated with F3.

The function of F3 and its association with various diseases and clinical conditions, has been established by previous studies, as described hereinabove with reference to GAM136.1. Fatty acid binding protein 2, intestinal (FABP2, Accession NP_000125.1) is another GAM3229 target gene, herein designated TARGET GENE. FABP2 BINDING SITE is a target binding site found in the 3' untranslated region of mRNA encoded by FABP2, corresponding to a target binding site such as BINDING SITE I, BINDING SITE II or BINDING SITE III of FIG. 8. Table 4 illustrates the complementarity of the nucleotide sequences of FABP2 BINDING SITE, designated SEQ ID:15832, to the nucleotide sequence of GAM3229 RNA, herein designated GAM RNA, also designated SEQ ID:221.

Another function of GAM3229 is therefore inhibition of Fatty acid binding protein 2, intestinal (FABP2, Accession NP_000125.1), a gene which may have a role in dietary fat uptake or processing. and therefore may be associated with Cardiovascular disease and type 2 diabetes. Accordingly, utilities of GAM3229 include diagnosis, prevention and treatment of Cardiovascular disease and type 2 diabetes, and of other diseases and clinical conditions associated with FABP2.

The function of FABP2 and its association with various diseases and clinical conditions, has been established by previous studies, as described hereinabove with reference to GAM189.1. Fanconi anemia, complementation group f (FANCF, Accession NP_073562.1) is another GAM3229 target gene, herein designated TARGET GENE. FANCF BINDING SITE is a target binding site found in the 3' untranslated region of mRNA encoded by FANCF, corresponding to a target binding site such as BINDING SITE I, BINDING SITE II or BINDING SITE III of FIG. 8. Table 4 illustrates the complementarity of the nucleotide sequences of FANCF BINDING SITE, designated SEQ ID:12811, to the nucleotide sequence of GAM3229 RNA, herein designated GAM RNA, also designated SEQ ID:221.

Another function of GAM3229 is therefore inhibition of Fanconi anemia, complementation group f (FANCF, Accession NP_073562.1). Accordingly, utilities of GAM3229 include diagnosis, prevention and treatment of diseases and clinical conditions associated with FANCF.

FBXW8 (Accession NP_699179.2) is another GAM3229 target gene, herein designated TARGET GENE. FBXW8 BINDING SITE1 and FBXW8 BINDING SITE2 are target binding sites found in untranslated regions of multiple transcripts of mRNA encoded by FBXW8, corresponding to target binding sites such as BINDING SITE I, BINDING SITE II or BINDING SITE III of FIG. 8. Table 4 illustrates the complementarity of the nucleotide sequences of FBXW8 BINDING SITE1 and FBXW8 BINDING SITE2, designated SEQ ID:14800 and SEQ ID:14800 respectively, to the nucleotide sequence of GAM3229 RNA, herein designated GAM RNA, also designated SEQ ID:221.

Another function of GAM3229 is therefore inhibition of FBXW8 (Accession NP_699179.2). Accordingly, utilities of GAM3229 include diagnosis, prevention and treatment of diseases and clinical conditions associated with FBXW8.

FBXW8 (Accession NP_036306.1) is another GAM3229 target gene, herein designated TARGET GENE. FBXW8 BINDING SITE1 and FBXW8 BINDING SITE2 are target binding sites found in untranslated regions of multiple transcripts of mRNA encoded by FBXW8, corresponding to target binding sites such as BINDING SITE I, BINDING SITE II or BINDING SITE III of FIG. 8. Table 4 illustrates the complementarity of the nucleotide sequences of FBXW8 BINDING SITE1 and FBXW8 BINDING SITE2, designated SEQ ID:3077 and SEQ ID:3077 respectively, to the nucleotide sequence of GAM3229 RNA, herein designated GAM RNA, also designated SEQ ID:221.

Another function of GAM3229 is therefore inhibition of FBXW8 (Accession NP_036306.1). Accordingly, utilities of GAM3229 include diagnosis, prevention and treatment of diseases and clinical conditions associated with FBXW8.

Fc fragment of iga, receptor for (FCAR, Accession NP_579813.1) is another GAM3229 target gene, herein designated TARGET GENE. FCAR BINDING SITE is a target binding site found in the 3' untranslated region of multiple transcripts of mRNA encoded by FCAR, corresponding to a target binding site such as BINDING SITE I, BINDING SITE II or BINDING SITE III of FIG. 8. Table 4 illustrates the complementarity of the nucleotide sequences of FCAR BINDING SITE, designated SEQ ID:14078, to the nucleotide sequence of GAM3229 RNA, herein designated GAM RNA, also designated SEQ ID:221.

Another function of GAM3229 is therefore inhibition of Fc fragment of iga, receptor for (FCAR, Accession NP_579813.1), a gene which binds to the fc region of immunoglobulins alpha and mediates several functions including cytokine production. and therefore may be associated with Iga nephropathy. Accordingly, utilities of GAM3229 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. FCRH1 (Accession NP_443170.1) is another GAM3229 target gene, herein designated TARGET GENE. FCRH1 BINDING SITE is a target binding site found in the 3' untranslated region of mRNA encoded by FCRH1, corresponding to a target binding site such as BINDING SITE I, BINDING SITE II or BINDING SITE III of FIG. 8. Table 4 illustrates the complementarity of the nucleotide sequences of FCRH1 BINDING SITE, designated SEQ ID:10358, to the nucleotide sequence of GAM3229 RNA, herein designated GAM RNA, also designated SEQ ID:221.

Another function of GAM3229 is therefore inhibition of FCRH1 (Accession NP_443170.1). Accordingly, utilities of GAM3229 include diagnosis, prevention and treatment of diseases and clinical conditions associated with FCRH1.

Fgd1 family, member 2 (FGD2, Accession NP_775829.1) is another GAM3229 target gene, herein designated TARGET GENE. FGD2 BINDING SITE is a target binding site found in the 3' untranslated region of mRNA encoded by FGD2, corresponding to a target binding site such as BINDING SITE I, BINDING SITE II or BINDING SITE III of FIG. 8. Table 4 illustrates the complementarity of the nucleotide sequences of FGD2 BINDING SITE, designated SEQ ID:7015, to the nucleotide sequence of GAM3229 RNA, herein designated GAM RNA, also designated SEQ ID:221.

Another function of GAM3229 is therefore inhibition of Fgd1 family, member 2 (FGD2, Accession NP_775829.1). Accordingly, utilities of GAM3229 include diagnosis, prevention and treatment of diseases and clinical conditions associated with FGD2.

Fragile histidine triad gene (FHIT, Accession NP_002003.1) is another GAM3229 target gene, herein designated TARGET GENE. FHIT BINDING SITE is a target binding site found in the 3' untranslated region of mRNA encoded by FHIT, corresponding to a target binding site such as BINDING SITE I, BINDING SITE II or BINDING SITE III of FIG. 8. Table 4 illustrates the complementarity of the nucleotide sequences of FHIT BINDING SITE, designated SEQ ID:894, to the nucleotide sequence of GAM3229 RNA, herein designated GAM RNA, also designated SEQ ID:221.

Another function of GAM3229 is therefore inhibition of Fragile histidine triad gene (FHIT, Accession NP_002003.1), a gene which cleaves a-5'-ppp-5'a to yield amp and adp. possible tumor suppressor for specific tissues. and therefore may be associated with Cancers. Accordingly, utilities of GAM3229 include diagnosis, prevention and treatment of Cancers, and of other diseases and clinical conditions associated with FHIT.

The function of FHIT and its association with various diseases and clinical conditions, has been established by previous studies, as described hereinabove with reference to GAM664.2. FISH (Accession NP_055446.1) is another GAM3229 target gene, herein designated TARGET GENE. FISH BINDING SITE is a target binding site found in the 5' untranslated region of mRNA encoded by FISH, corresponding to a target binding site such as BINDING SITE I, BINDING SITE II or BINDING SITE III of FIG. 8. Table 4 illustrates the complementarity of the nucleotide sequences of FISH BINDING SITE, designated SEQ ID:15859, to the nucleotide sequence of GAM3229 RNA, herein designated GAM RNA, also designated SEQ ID:221.

Another function of GAM3229 is therefore inhibition of FISH (Accession NP_055446.1). Accordingly, utilities of GAM3229 include diagnosis, prevention and treatment of diseases and clinical conditions associated with FISH.

FLJ00007 (Accession NP_258260.1) is another GAM3229 target gene, herein designated TARGET GENE. FLJ00007 BINDING SITE is a target binding site found in the 3' untranslated region of mRNA encoded by FLJ00007, corresponding to a target binding site such as BINDING SITE I, BINDING SITE II or BINDING SITE III of FIG. 8. Table 4 illustrates the complementarity of the nucleotide sequences of FLJ00007 BINDING SITE, designated SEQ ID:12711, to the nucleotide sequence of GAM3229 RNA, herein designated GAM RNA, also designated SEQ ID:221.

Another function of GAM3229 is therefore inhibition of FLJ00007 (Accession NP_258260.1). Accordingly, utilities of GAM3229 include diagnosis, prevention and treatment of diseases and clinical conditions associated with FLJ00007.

FLJ00060 (Accession XP_028154.1) is another GAM3229 target gene, herein designated TARGET GENE. FLJ00060 BINDING SITE is a target binding site found in the 5' untranslated region of mRNA encoded by FLJ00060, corresponding to a target binding site such as BINDING SITE I, BINDING SITE II or BINDING SITE III of FIG. 8. Table 4 illustrates the complementarity of the nucleotide sequences of FLJ00060 BINDING SITE, designated SEQ ID:717, to the nucleotide sequence of GAM3229 RNA, herein designated GAM RNA, also designated SEQ ID:221.

Another function of GAM3229 is therefore inhibition of FLJ00060 (Accession XP_028154.1). Accordingly, utilities of GAM3229 include diagnosis, prevention and treatment of diseases and clinical conditions associated with FLJ00060.

FLJ10276 (Accession NP_060515.1) is another GAM3229 target gene, herein designated TARGET GENE. FLJ10276 BINDING SITE is a target binding site found in the 3' untranslated region of mRNA encoded by FLJ10276, corresponding to a target binding site such as BINDING SITE I, BINDING SITE II or BINDING SITE III of FIG. 8. Table 4 illustrates the complementarity of the nucleotide sequences of FLJ10276 BINDING SITE, designated SEQ ID:11366, to the nucleotide sequence of GAM3229 RNA, herein designated GAM RNA, also designated SEQ ID:221.

Another function of GAM3229 is therefore inhibition of FLJ10276 (Accession NP_060515.1). Accordingly, utilities of GAM3229 include diagnosis, prevention and treatment of diseases and clinical conditions associated with FLJ10276.

FLJ10520 (Accession NP_060594.2) is another GAM3229 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:9307, to the nucleotide sequence of GAM3229 RNA, herein designated GAM RNA, also designated SEQ ID:221.

Another function of GAM3229 is therefore inhibition of FLJ10520 (Accession NP_060594.2). Accordingly, utilities of GAM3229 include diagnosis, prevention and treatment of diseases and clinical conditions associated with FLJ10520.

FLJ10535 (Accession NP_060599.1) is another GAM3229 target gene, herein designated TARGET GENE. FLJ10535 BINDING SITE is a target binding site found in the 3' untranslated region of mRNA encoded by FLJ10535, corresponding to a target binding site such as BINDING SITE I, BINDING SITE II or BINDING SITE III of FIG. 8. Table 4 illustrates the complementarity of the nucleotide sequences of FLJ10535 BINDING SITE, designated SEQ ID:6398, to the nucleotide sequence of GAM3229 RNA, herein designated GAM RNA, also designated SEQ ID:221.

Another function of GAM3229 is therefore inhibition of FLJ10535 (Accession NP_060599.1). Accordingly, utilities of GAM3229 include diagnosis, prevention and treatment of diseases and clinical conditions associated with FLJ10535.

FLJ10700 (Accession NP_060652.1) is another GAM3229 target gene, herein designated TARGET GENE. FLJ10700 BINDING SITE is a target binding site found in the 3' untranslated region of mRNA encoded by FLJ10700, corresponding to a target binding site such as BINDING SITE I, BINDING SITE II or BINDING SITE III of FIG. 8. Table 4 illustrates the complementarity of the nucleotide sequences of FLJ10700 BINDING SITE, designated SEQ ID:4483, to the nucleotide sequence of GAM3229 RNA, herein designated GAM RNA, also designated SEQ ID:221.

Another function of GAM3229 is therefore inhibition of FLJ10700 (Accession NP_060652.1). Accordingly, utilities of GAM3229 include diagnosis, prevention and treatment of diseases and clinical conditions associated with FLJ10700.

FLJ10847 (Accession NP_060712.2) is another GAM3229 target gene, herein designated TARGET GENE. FLJ10847 BINDING SITE1 through FLJ10847 BINDING SITE3 are target binding sites found in untranslated regions of mRNA encoded by FLJ10847, corresponding to target binding sites such as BINDING SITE I, BINDING SITE II or BINDING SITE III of FIG. 8. Table 4 illustrates the complementarity of the nucleotide sequences of FLJ10847 BINDING SITE1 through FLJ10847 BINDING SITE3, designated SEQ ID:7550, SEQ ID:8121 and SEQ ID:3502 respectively, to the nucleotide sequence of GAM3229 RNA, herein designated GAM RNA, also designated SEQ ID:221.

Another function of GAM3229 is therefore inhibition of FLJ10847 (Accession NP_060712.2). Accordingly, utilities of GAM3229 include diagnosis, prevention and treatment of diseases and clinical conditions associated with FLJ10847.

FLJ11230 (Accession NP_060836.1) is another GAM3229 target gene, herein designated TARGET GENE. FLJ11230 BINDING SITE is a target binding site found in the 3' untranslated region of mRNA encoded by FLJ11230, corresponding to a target binding site such as BINDING SITE I, BINDING SITE II or BINDING SITE III of FIG. 8. Table 4 illustrates the complementarity of the nucleotide sequences of FLJ11230 BINDING SITE, designated SEQ ID:9182, to the nucleotide sequence of GAM3229 RNA, herein designated GAM RNA, also designated SEQ ID:221.

Another function of GAM3229 is therefore inhibition of FLJ11230 (Accession NP_060836.1). Accordingly, utilities of GAM3229 include diagnosis, prevention and treatment of diseases and clinical conditions associated with FLJ11230.

FLJ11323 (Accession NP_060860.1) is another GAM3229 target gene, herein designated TARGET GENE. FLJ11323 BINDING SITE is a target binding site found in the 3' untranslated region of multiple transcripts of mRNA encoded by FLJ11323, corresponding to a target binding site such as BINDING SITE I, BINDING SITE II or BINDING SITE III of FIG. 8. Table 4 illustrates the complementarity of the nucleotide sequences of FLJ11323 BINDING SITE, designated SEQ ID:7842, to the nucleotide sequence of GAM3229 RNA, herein designated GAM RNA, also designated SEQ ID:221.

Another function of GAM3229 is therefore inhibition of FLJ11323 (Accession NP_060860.1). Accordingly, utilities of GAM3229 include diagnosis, prevention and treatment of diseases and clinical conditions associated with FLJ11323.

FLJ12610 (Accession NP_079058.1) is another GAM3229 target gene, herein designated TARGET GENE. FLJ12610 BINDING SITE is a target binding site found in the 3' untranslated region of mRNA encoded by FLJ12610, corresponding to a target binding site such as BINDING SITE I, BINDING SITE II or BINDING SITE III of FIG. 8. Table 4 illustrates the complementarity of the nucleotide sequences of FLJ12610 BINDING SITE, designated SEQ ID:13971, to the nucleotide sequence of GAM3229 RNA, herein designated GAM RNA, also designated SEQ ID:221.

Another function of GAM3229 is therefore inhibition of FLJ12610 (Accession NP_079058.1). Accordingly, utilities of GAM3229 include diagnosis, prevention and treatment of diseases and clinical conditions associated with FLJ12610.

FLJ12747 (Accession XP_290972.1) is another GAM3229 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:3806, to the nucleotide sequence of GAM3229 RNA, herein designated GAM RNA, also designated SEQ ID:221.

Another function of GAM3229 is therefore inhibition of FLJ12747 (Accession XP_290972.1). Accordingly, utilities of GAM3229 include diagnosis, prevention and treatment of diseases and clinical conditions associated with FLJ12747.

FLJ12903 (Accession NP_073590.1) is another GAM3229 target gene, herein designated TARGET GENE. FLJ12903 BINDING SITE1 and FLJ12903 BINDING SITE2 are target binding sites found in untranslated regions of mRNA encoded by FLJ12903, corresponding to target binding sites such as BINDING SITE I, BINDING SITE II or BINDING SITE III of FIG. 8. Table 4 illustrates the complementarity of the nucleotide sequences of FLJ12903 BINDING SITE1 and FLJ12903 BINDING SITE2, designated SEQ ID:15331 and SEQ ID:19721 respectively, to the nucleotide sequence of GAM3229 RNA, herein designated GAM RNA, also designated SEQ ID:221.

Another function of GAM3229 is therefore inhibition of FLJ12903 (Accession NP_073590.1). Accordingly, utilities of GAM3229 include diagnosis, prevention and treatment of diseases and clinical conditions associated with FLJ12903.

FLJ12975 (Accession NP_079085.2) is another GAM3229 target gene, herein designated TARGET GENE. FLJ12975 BINDING SITE1 and FLJ12975 BINDING SITE2 are target binding sites found in untranslated regions of mRNA encoded by FLJ12975, corresponding to target binding sites such as BINDING SITE I, BINDING SITE II or BINDING SITE III of FIG. 8. Table 4 illustrates the complementarity of the nucleotide sequences of FLJ12975 BINDING SITE1 and FLJ12975 BINDING SITE2, designated SEQ ID:6872 and SEQ ID:3161 respectively, to the nucleotide sequence of GAM3229 RNA, herein designated GAM RNA, also designated SEQ ID:221.

Another function of GAM3229 is therefore inhibition of FLJ12975 (Accession NP_079085.2). Accordingly, utilities of GAM3229 include diagnosis, prevention and treatment of diseases and clinical conditions associated with FLJ12975.

FLJ12985 (Accession NP_079200.1) is another GAM3229 target gene, herein designated TARGET GENE. FLJ12985 BINDING SITE is a target binding site found in the 3' untranslated region of mRNA encoded by FLJ12985, corresponding to a target binding site such as BINDING SITE I, BINDING SITE II or BINDING SITE III of FIG. 8. Table 4 illustrates the complementarity of the nucleotide sequences of FLJ12985 BINDING SITE, designated SEQ ID:7712, to the nucleotide sequence of GAM3229 RNA, herein designated GAM RNA, also designated SEQ ID:221.

Another function of GAM3229 is therefore inhibition of FLJ12985 (Accession NP_079200.1). Accordingly, utilities of GAM3229 include diagnosis, prevention and treatment of diseases and clinical conditions associated with FLJ12985.

FLJ13072 (Accession XP_117117.2) is another GAM3229 target gene, herein designated TARGET GENE. FLJ13072 BINDING SITE1 and FLJ13072 BINDING SITE2 are target binding sites found in untranslated regions of mRNA encoded by FLJ13072, corresponding to target binding sites such as BINDING SITE I, BINDING SITE II or BINDING SITE III of FIG. 8. Table 4 illustrates the complementarity of the nucleotide sequences of FLJ13072 BINDING SITE1 and FLJ13072 BINDING SITE2, designated SEQ ID:6829 and SEQ ID:18493 respectively, to the nucleotide sequence of GAM3229 RNA, herein designated GAM RNA, also designated SEQ ID:221.

Another function of GAM3229 is therefore inhibition of FLJ13072 (Accession XP_117117.2). Accordingly, utilities of GAM3229 include diagnosis, prevention and treatment of diseases and clinical conditions associated with FLJ13072.

FLJ13590 (Accession NP_079116.2) is another GAM3229 target gene, herein designated TARGET GENE. FLJ13590 BINDING SITE is a target binding site found in the 5' untranslated region of mRNA encoded by FLJ13590, corresponding to a target binding site such as BINDING SITE I, BINDING SITE II or BINDING SITE III of FIG. 8. Table 4 illustrates the complementarity of the nucleotide sequences of FLJ13590 BINDING SITE, designated SEQ ID:6224, to the nucleotide sequence of GAM3229 RNA, herein designated GAM RNA, also designated SEQ ID:221.

Another function of GAM3229 is therefore inhibition of FLJ13590 (Accession NP_079116.2). Accordingly, utilities of GAM3229 include diagnosis, prevention and treatment of diseases and clinical conditions associated with FLJ13590.

FLJ13955 (Accession NP_079035.1) is another GAM3229 target gene, herein designated TARGET GENE. FLJ13955 BINDING SITE is a target binding site found in the 3' untranslated region of mRNA encoded by FLJ13955, corresponding to a target binding site such as BINDING SITE I, BINDING SITE II or BINDING SITE III of FIG. 8. Table 4 illustrates the complementarity of the nucleotide sequences of FLJ13955 BINDING SITE, designated SEQ ID:7938, to the nucleotide sequence of GAM3229 RNA, herein designated GAM RNA, also designated SEQ ID:221.

Another function of GAM3229 is therefore inhibition of FLJ13955 (Accession NP_079035.1). Accordingly, utilities of GAM3229 include diagnosis, prevention and treatment of diseases and clinical conditions associated with FLJ13955.

FLJ14054 (Accession NP_078839.1) is another GAM3229 target gene, herein designated TARGET GENE. FLJ14054 BINDING SITE is a target binding site found in the 3' untranslated region of mRNA encoded by FLJ14054, corresponding to a target binding site such as BINDING SITE I, BINDING SITE II or BINDING SITE III of FIG. 8. Table 4 illustrates the complementarity of the nucleotide sequences of FLJ14054 BINDING SITE, designated SEQ ID:8656, to the nucleotide sequence of GAM3229 RNA, herein designated GAM RNA, also designated SEQ ID:221.

Another function of GAM3229 is therefore inhibition of FLJ14054 (Accession NP_078839.1). Accordingly, utilities of GAM3229 include diagnosis, prevention and treatment of diseases and clinical conditions associated with FLJ14054.

FLJ14351 (Accession NP_079008.1) is another GAM3229 target gene, herein designated TARGET GENE. FLJ14351 BINDING SITE1 and FLJ14351 BINDING SITE2 are target binding sites found in untranslated regions of mRNA encoded by FLJ14351, corresponding to target binding sites such as BINDING SITE I, BINDING SITE II or BINDING SITE III of FIG. 8. Table 4 illustrates the complementarity of the nucleotide sequences of FLJ14351 BINDING SITE1 and FLJ14351 BINDING SITE2, designated SEQ ID:7578 and SEQ ID:8490 respectively, to the nucleotide sequence of GAM3229 RNA, herein designated GAM RNA, also designated SEQ ID:221.

Another function of GAM3229 is therefore inhibition of FLJ14351 (Accession NP_079008.1). Accordingly, utilities of GAM3229 include diagnosis, prevention and treatment of diseases and clinical conditions associated with FLJ14351.

FLJ14803 (Accession NP_116231.1) is another GAM3229 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:18549, to the nucleotide sequence of GAM3229 RNA, herein designated GAM RNA, also designated SEQ ID:221.

Another function of GAM3229 is therefore inhibition of FLJ14803 (Accession NP_116231.1). Accordingly, utilities of GAM3229 include diagnosis, prevention and treatment of diseases and clinical conditions associated with FLJ14803.

FLJ20038 (Accession NP_060104.1) is another GAM3229 target gene, herein designated TARGET GENE. FLJ20038 BINDING SITE is a target binding site found in the 3' untranslated region of mRNA encoded by FLJ20038, corresponding to a target binding site such as BINDING SITE I, BINDING SITE II or BINDING SITE III of FIG. 8. Table 4 illustrates the complementarity of the nucleotide sequences of FLJ20038 BINDING SITE, designated SEQ ID:14023, to the nucleotide sequence of GAM3229 RNA, herein designated GAM RNA, also designated SEQ ID:221.

Another function of GAM3229 is therefore inhibition of FLJ20038 (Accession NP_060104.1). Accordingly, utilities of GAM3229 include diagnosis, prevention and treatment of diseases and clinical conditions associated with FLJ20038.

FLJ20045 (Accession NP_060108.1) is another GAM3229 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:603, to the nucleotide sequence of GAM3229 RNA, herein designated GAM RNA, also designated SEQ ID:221.

Another function of GAM3229 is therefore inhibition of FLJ20045 (Accession NP_060108.1). Accordingly, utilities of GAM3229 include diagnosis, prevention and treatment of diseases and clinical conditions associated with FLJ20045.

FLJ20125 (Accession NP_060146.1) is another GAM3229 target gene, herein designated TARGET GENE. FLJ20125 BINDING SITE is a target binding site found in the 3' untranslated region of mRNA encoded by FLJ20125, corresponding to a target binding site such as BINDING SITE I, BINDING SITE II or BINDING SITE III of FIG. 8. Table 4 illustrates the complementarity of the nucleotide sequences of FLJ20125 BINDING SITE, designated SEQ ID:12250, to the nucleotide sequence of GAM3229 RNA, herein designated GAM RNA, also designated SEQ ID:221.

Another function of GAM3229 is therefore inhibition of FLJ20125 (Accession NP_060146.1). Accordingly, utilities of GAM3229 include diagnosis, prevention and treatment of diseases and clinical conditions associated with FLJ20125.

FLJ20200 (Accession NP_060178.1) is another GAM3229 target gene, herein designated TARGET GENE. FLJ20200 BINDING SITE is a target binding site found in the 5' untranslated region of mRNA encoded by FLJ20200, corresponding to a target binding site such as BINDING SITE I, BINDING SITE II or BINDING SITE III of FIG. 8. Table 4 illustrates the complementarity of the nucleotide sequences of FLJ20200 BINDING SITE, designated SEQ ID:18150, to the nucleotide sequence of GAM3229 RNA, herein designated GAM RNA, also designated SEQ ID:221.

Another function of GAM3229 is therefore inhibition of FLJ20200 (Accession NP_060178.1). Accordingly, utilities of GAM3229 include diagnosis, prevention and treatment of diseases and clinical conditions associated with FLJ20200.

FLJ20671 (Accession NP_060394.1) is another GAM3229 target gene, herein designated TARGET GENE. FLJ20671 BINDING SITE is a target binding site found in the 3' untranslated region of mRNA encoded by FLJ20671, corresponding to a target binding site such as BINDING SITE I, BINDING SITE II or BINDING SITE III of FIG. 8. Table 4 illustrates the complementarity of the nucleotide sequences of FLJ20671 BINDING SITE, designated SEQ ID:19922, to the nucleotide sequence of GAM3229 RNA, herein designated GAM RNA, also designated SEQ ID:221.

Another function of GAM3229 is therefore inhibition of FLJ20671 (Accession NP_060394.1). Accordingly, utilities of GAM3229 include diagnosis, prevention and treatment of diseases and clinical conditions associated with FLJ20671.

FLJ20729 (Accession NP_060423.2) is another GAM3229 target gene, herein designated TARGET GENE. FLJ20729 BINDING SITE is a target binding site found in the 3' untranslated region of mRNA encoded by FLJ20729, corresponding to a target binding site such as BINDING SITE I, BINDING SITE II or BINDING SITE III of FIG. 8. Table 4 illustrates the complementarity of the nucleotide sequences of FLJ20729 BINDING SITE, designated SEQ ID:7073, to the nucleotide sequence of GAM3229 RNA, herein designated GAM RNA, also designated SEQ ID:221.

Another function of GAM3229 is therefore inhibition of FLJ20729 (Accession NP_060423.2). Accordingly, utilities of GAM3229 include diagnosis, prevention and treatment of diseases and clinical conditions associated with FLJ20729.

FLJ21302 (Accession NP_075052.1) is another GAM3229 target gene, herein designated TARGET GENE. FLJ21302 BINDING SITE is a target binding site found in the 3' untranslated region of mRNA encoded by FLJ21302, corresponding to a target binding site such as BINDING SITE I, BINDING SITE II or BINDING SITE III of FIG. 8. Table 4 illustrates the complementarity of the nucleotide sequences of FLJ21302 BINDING SITE, designated SEQ ID:3479, to the nucleotide sequence of GAM3229 RNA, herein designated GAM RNA, also designated SEQ ID:221.

Another function of GAM3229 is therefore inhibition of FLJ21302 (Accession NP_075052.1). Accordingly, utilities of GAM3229 include diagnosis, prevention and treatment of diseases and clinical conditions associated with FLJ21302.

FLJ22347 (Accession NP_073741.1) is another GAM3229 target gene, herein designated TARGET GENE. FLJ22347 BINDING SITE is a target binding site found in the 3' untranslated region of mRNA encoded by FLJ22347, corresponding to a target binding site such as BINDING SITE I, BINDING SITE II or BINDING SITE III of FIG. 8. Table 4 illustrates the complementarity of the nucleotide sequences of FLJ22347 BINDING SITE, designated SEQ ID:15136, to the nucleotide sequence of GAM3229 RNA, herein designated GAM RNA, also designated SEQ ID:221.

Another function of GAM3229 is therefore inhibition of FLJ22347 (Accession NP_073741.1). Accordingly, utilities of GAM3229 include diagnosis, prevention and treatment of diseases and clinical conditions associated with FLJ22347.

FLJ22529 (Accession NP_079065.1) is another GAM3229 target gene, herein designated TARGET GENE. FLJ22529 BINDING SITE is a target binding site found in the 3' untranslated region of mRNA encoded by FLJ22529, corresponding to a target binding site such as BINDING SITE I, BINDING SITE II or BINDING SITE III of FIG. 8. Table 4 illustrates the complementarity of the nucleotide sequences of FLJ22529 BINDING SITE, designated SEQ ID:19173, to the nucleotide sequence of GAM3229 RNA, herein designated GAM RNA, also designated SEQ ID:221.

Another function of GAM3229 is therefore inhibition of FLJ22529 (Accession NP_079065.1). Accordingly, utilities of GAM3229 include diagnosis, prevention and treatment of diseases and clinical conditions associated with FLJ22529.

FLJ22800 (Accession NP_079071.1) is another GAM3229 target gene, herein designated TARGET GENE. FLJ22800 BINDING SITE is a target binding site found in the 3' untranslated region of mRNA encoded by FLJ22800, corresponding to a target binding site such as BINDING SITE I, BINDING SITE II or BINDING SITE III of FIG. 8. Table 4 illustrates the complementarity of the nucleotide sequences of FLJ22800 BINDING SITE, designated SEQ ID:3918, to the nucleotide sequence of GAM3229 RNA, herein designated GAM RNA, also designated SEQ ID:221.

Another function of GAM3229 is therefore inhibition of FLJ22800 (Accession NP_079071.1). Accordingly, utilities of GAM3229 include diagnosis, prevention and treatment of diseases and clinical conditions associated with FLJ22800.

FLJ23024 (Accession NP_079212.1) is another GAM3229 target gene, herein designated TARGET GENE. FLJ23024 BINDING SITE is a target binding site found in the 3' untranslated region of mRNA encoded by FLJ23024, corresponding to a target binding site such as BINDING SITE I, BINDING SITE II or BINDING SITE III of FIG. 8. Table 4 illustrates the complementarity of the nucleotide sequences of FLJ23024 BINDING SITE, designated SEQ ID:2778, to the nucleotide sequence of GAM3229 RNA, herein designated GAM RNA, also designated SEQ ID:221.

Another function of GAM3229 is therefore inhibition of FLJ23024 (Accession NP_079212.1). Accordingly, utilities of GAM3229 include diagnosis, prevention and treatment of diseases and clinical conditions associated with FLJ23024.

FLJ23040 (Accession NP_079450.1) is another GAM3229 target gene, herein designated TARGET GENE. FLJ23040 BINDING SITE is a target binding site found in the 3' untranslated region of mRNA encoded by FLJ23040, corresponding to a target binding site such as BINDING SITE I, BINDING SITE II or BINDING SITE III of FIG. 8. Table 4 illustrates the complementarity of the nucleotide sequences of FLJ23040 BINDING SITE, designated SEQ ID:7588, to the nucleotide sequence of GAM3229 RNA, herein designated GAM RNA, also designated SEQ ID:221.

Another function of GAM3229 is therefore inhibition of FLJ23040 (Accession NP_079450.1). Accordingly, utilities of GAM3229 include diagnosis, prevention and treatment of diseases and clinical conditions associated with FLJ23040.

FLJ23047 (Accession NP_078824.2) is another GAM3229 target gene, herein designated TARGET GENE. FLJ23047 BINDING SITE is a target binding site found in the 3' untranslated region of mRNA encoded by FLJ23047, corresponding to a target binding site such as BINDING SITE I, BINDING SITE II or BINDING SITE III of FIG. 8. Table 4 illustrates the complementarity of the nucleotide sequences of FLJ23047 BINDING SITE, designated SEQ ID:11628, to the nucleotide sequence of GAM3229 RNA, herein designated GAM RNA, also designated SEQ ID:221.

Another function of GAM3229 is therefore inhibition of FLJ23047 (Accession NP_078824.2). Accordingly, utilities of GAM3229 include diagnosis, prevention and treatment of diseases and clinical conditions associated with FLJ23047.

FLJ23356 (Accession NP_115613.1) is another GAM3229 target gene, herein designated TARGET GENE. FLJ23356 BINDING SITE is a target binding site found in the 3' untranslated region of mRNA encoded by FLJ23356, corresponding to a target binding site such as BINDING SITE I, BINDING SITE II or BINDING SITE III of FIG. 8. Table 4 illustrates the complementarity of the nucleotide sequences of FLJ23356 BINDING SITE, designated SEQ ID:8065, to the nucleotide sequence of GAM3229 RNA, herein designated GAM RNA, also designated SEQ ID:221.

Another function of GAM3229 is therefore inhibition of FLJ23356 (Accession NP_115613.1). Accordingly, utilities of GAM3229 include diagnosis, prevention and treatment of diseases and clinical conditions associated with FLJ23356.

FLJ23416 (Accession NP_115614.1) is another GAM3229 target gene, herein designated TARGET GENE. FLJ23416 BINDING SITE is a target binding site found in the 3' untranslated region of mRNA encoded by FLJ23416, corresponding to a target binding site such as BINDING SITE I, BINDING SITE II or BINDING SITE III of FIG. 8. Table 4 illustrates the complementarity of the nucleotide sequences of FLJ23416 BINDING SITE, designated SEQ ID:15550, to the nucleotide sequence of GAM3229 RNA, herein designated GAM RNA, also designated SEQ ID:221.

Another function of GAM3229 is therefore inhibition of FLJ23416 (Accession NP_115614.1). Accordingly, utilities of GAM3229 include diagnosis, prevention and treatment of diseases and clinical conditions associated with FLJ23416.

FLJ23563 (Accession XP_041701.4) is another GAM3229 target gene, herein designated TARGET GENE. FLJ23563 BINDING SITE is a target binding site found in the 3' untranslated region of mRNA encoded by FLJ23563, corresponding to a target binding site such as BINDING SITE I, BINDING SITE II or BINDING SITE III of FIG. 8. Table 4 illustrates the complementarity of the nucleotide sequences of FLJ23563 BINDING SITE, designated SEQ ID:16466, to the nucleotide sequence of GAM3229 RNA, herein designated GAM RNA, also designated SEQ ID:221.

Another function of GAM3229 is therefore inhibition of FLJ23563 (Accession XP_041701.4). Accordingly, utilities of GAM3229 include diagnosis, prevention and treatment of diseases and clinical conditions associated with FLJ23563.

FLJ25286 (Accession NP_689759.1) is another GAM3229 target gene, herein designated TARGET GENE. FLJ25286 BINDING SITE is a target binding site found in the 3' untranslated region of mRNA encoded by FLJ25286, corresponding to a target binding site such as BINDING SITE I, BINDING SITE II or BINDING SITE III of FIG. 8. Table 4 illustrates the complementarity of the nucleotide sequences of FLJ25286 BINDING SITE, designated SEQ ID:1118, to the nucleotide sequence of GAM3229 RNA, herein designated GAM RNA, also designated SEQ ID:221.

Another function of GAM3229 is therefore inhibition of FLJ25286 (Accession NP_689759.1). Accordingly, utilities of GAM3229 include diagnosis, prevention and treatment of diseases and clinical conditions associated with FLJ25286.

FLJ30656 (Accession NP_689557.1) is another GAM3229 target gene, herein designated TARGET GENE. FLJ30656 BINDING SITE is a target binding site found in the 3' untranslated region of mRNA encoded by FLJ30656, corresponding to a target binding site such as BINDING SITE I, BINDING SITE II or BINDING SITE III of FIG. 8. Table 4 illustrates the complementarity of the nucleotide sequences of FLJ30656 BINDING SITE, designated SEQ ID:11839, to the nucleotide sequence of GAM3229 RNA, herein designated GAM RNA, also designated SEQ ID:221.

Another function of GAM3229 is therefore inhibition of FLJ30656 (Accession NP_689557.1). Accordingly, utilities of GAM3229 include diagnosis, prevention and treatment of diseases and clinical conditions associated with FLJ30656.

FLJ31166 (Accession NP_694567.1) is another GAM3229 target gene, herein designated TARGET GENE. FLJ31166 BINDING SITE is a target binding site found in the 3' untranslated region of mRNA encoded by FLJ31166, corresponding to a target binding site such as BINDING SITE I, BINDING SITE II or BINDING SITE III of FIG. 8. Table 4 illustrates the complementarity of the nucleotide sequences of FLJ31166 BINDING SITE, designated SEQ ID:19706, to the nucleotide sequence of GAM3229 RNA, herein designated GAM RNA, also designated SEQ ID:221.

Another function of GAM3229 is therefore inhibition of FLJ31166 (Accession NP_694567.1). Accordingly, utilities of GAM3229 include diagnosis, prevention and treatment of diseases and clinical conditions associated with FLJ31166.

FLJ31821 (Accession NP_694574.1) is another GAM3229 target gene, herein designated TARGET GENE. FLJ31821 BINDING SITE is a target binding site found in the 3' untranslated region of mRNA encoded by FLJ31821, corresponding to a target binding site such as BINDING SITE I, BINDING SITE II or BINDING SITE III of FIG. 8. Table 4 illustrates the complementarity of the nucleotide sequences of FLJ31821 BINDING SITE, designated SEQ ID:11267, to the nucleotide sequence of GAM3229 RNA, herein designated GAM RNA, also designated SEQ ID:221.

Another function of GAM3229 is therefore inhibition of FLJ31821 (Accession NP_694574.1). Accordingly, utilities of GAM3229 include diagnosis, prevention and treatment of diseases and clinical conditions associated with FLJ31821.

FLJ32096 (Accession NP_776156.1) is another GAM3229 target gene, herein designated TARGET GENE. FLJ32096 BINDING SITE is a target binding site found in the 3' untranslated region of mRNA encoded by FLJ32096, corresponding to a target binding site such as BINDING SITE I, BINDING SITE II or BINDING SITE III of FIG. 8. Table 4 illustrates the complementarity of the nucleotide sequences of FLJ32096 BINDING SITE, designated SEQ ID:8326, to the nucleotide sequence of GAM3229 RNA, herein designated GAM RNA, also designated SEQ ID:221.

Another function of GAM3229 is therefore inhibition of FLJ32096 (Accession NP_776156.1). Accordingly, utilities of GAM3229 include diagnosis, prevention and treatment of diseases and clinical conditions associated with FLJ32096.

FLJ32384 (Accession NP_653209.1) is another GAM3229 target gene, herein designated TARGET GENE. FLJ32384 BINDING SITE is a target binding site found in the 3' untranslated region of mRNA encoded by FLJ32384, corresponding to a target binding site such as BINDING SITE I, BINDING SITE II or BINDING SITE III of FIG. 8. Table 4 illustrates the complementarity of the nucleotide sequences of FLJ32384 BINDING SITE, designated SEQ ID:19381, to the nucleotide sequence of GAM3229 RNA, herein designated GAM RNA, also designated SEQ ID:221.

Another function of GAM3229 is therefore inhibition of FLJ32384 (Accession NP_653209.1). Accordingly, utilities of GAM3229 include diagnosis, prevention and treatment of diseases and clinical conditions associated with FLJ32384.

FLJ32865 (Accession NP_653214.1) is another GAM3229 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:16336, to the nucleotide sequence of GAM3229 RNA, herein designated GAM RNA, also designated SEQ ID:221.

Another function of GAM3229 is therefore inhibition of FLJ32865 (Accession NP_653214.1). Accordingly, utilities of GAM3229 include diagnosis, prevention and treatment of diseases and clinical conditions associated with FLJ32865.

FLJ32894 (Accession NP_653268.1) is another GAM3229 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:18611, to the nucleotide sequence of GAM3229 RNA, herein designated GAM RNA, also designated SEQ ID:221.

Another function of GAM3229 is therefore inhibition of FLJ32894 (Accession NP_653268.1). Accordingly, utilities of GAM3229 include diagnosis, prevention and treatment of diseases and clinical conditions associated with FLJ32894.

FLJ33655 (Accession NP_775912.1) is another GAM3229 target gene, herein designated TARGET GENE. FLJ33655 BINDING SITE is a target binding site found in the 3' untranslated region of mRNA encoded by FLJ33655, corresponding to a target binding site such as BINDING SITE I, BINDING SITE II or BINDING SITE III of FIG. 8. Table 4 illustrates the complementarity of the nucleotide sequences of FLJ33655 BINDING SITE, designated SEQ ID:2783, to the nucleotide sequence of GAM3229 RNA, herein designated GAM RNA, also designated SEQ ID:221.

Another function of GAM3229 is therefore inhibition of FLJ33655 (Accession NP_775912.1). Accordingly, utilities of GAM3229 include diagnosis, prevention and treatment of diseases and clinical conditions associated with FLJ33655.

FLJ33768 (Accession NP_775881.1) is another GAM3229 target gene, herein designated TARGET GENE. FLJ33768 BINDING SITE is a target binding site found in the 3' untranslated region of mRNA encoded by FLJ33768, corresponding to a target binding site such as BINDING SITE I, BINDING SITE II or BINDING SITE III of FIG. 8. Table 4 illustrates the complementarity of the nucleotide sequences of FLJ33768 BINDING SITE, designated SEQ ID:1133, to the nucleotide sequence of GAM3229 RNA, herein designated GAM RNA, also designated SEQ ID:221.

Another function of GAM3229 is therefore inhibition of FLJ33768 (Accession NP_775881.1). Accordingly, utilities of GAM3229 include diagnosis, prevention and treatment of diseases and clinical conditions associated with FLJ33768.

FLJ33814 (Accession NP_775781.1) is another GAM3229 target gene, herein designated TARGET GENE. FLJ33814 BINDING SITE is a target binding site found in the 3' untranslated region of mRNA encoded by FLJ33814, corresponding to a target binding site such as BINDING SITE I, BINDING SITE II or BINDING SITE III of FIG. 8. Table 4 illustrates the complementarity of the nucleotide sequences of FLJ33814 BINDING SITE, designated SEQ ID:4586, to the nucleotide sequence of GAM3229 RNA, herein designated GAM RNA, also designated SEQ ID:221.

Another function of GAM3229 is therefore inhibition of FLJ33814 (Accession NP_775781.1). Accordingly, utilities of GAM3229 include diagnosis, prevention and treatment of diseases and clinical conditions associated with FLJ33814.

FLJ33860 (Accession NP_775915.1) is another GAM3229 target gene, herein designated TARGET GENE. FLJ33860 BINDING SITE is a target binding site found in the 3' untranslated region of mRNA encoded by FLJ33860, corresponding to a target binding site such as BINDING SITE I, BINDING SITE II or BINDING SITE III of FIG. 8. Table 4 illustrates the complementarity of the nucleotide sequences of FLJ33860 BINDING SITE, designated SEQ ID:2033, to the nucleotide sequence of GAM3229 RNA, herein designated GAM RNA, also designated SEQ ID:221.

Another function of GAM3229 is therefore inhibition of FLJ33860 (Accession NP_775915.1). Accordingly, utilities of GAM3229 include diagnosis, prevention and treatment of diseases and clinical conditions associated with FLJ33860.

FLJ33918 (Accession NP_689620.1) is another GAM3229 target gene, herein designated TARGET GENE. FLJ33918 BINDING SITE is a target binding site found in the 3' untranslated region of mRNA encoded by FLJ33918, corresponding to a target binding site such as BINDING SITE I, BINDING SITE II or BINDING SITE III of FIG. 8. Table 4 illustrates the complementarity of the nucleotide sequences of FLJ33918 BINDING SITE, designated SEQ ID:3095, to the nucleotide sequence of GAM3229 RNA, herein designated GAM RNA, also designated SEQ ID:221.

Another function of GAM3229 is therefore inhibition of FLJ33918 (Accession NP_689620.1). Accordingly, utilities of GAM3229 include diagnosis, prevention and treatment of diseases and clinical conditions associated with FLJ33918.

FLJ34817 (Accession NP_689516.1) is another GAM3229 target gene, herein designated TARGET GENE. FLJ34817 BINDING SITE is a target binding site found in the 3' untranslated region of mRNA encoded by FLJ34817, corresponding to a target binding site such as BINDING SITE I, BINDING SITE II or BINDING SITE III of FIG. 8. Table 4 illustrates the complementarity of the nucleotide sequences of FLJ34817 BINDING SITE, designated SEQ ID:20002, to the nucleotide sequence of GAM3229 RNA, herein designated GAM RNA, also designated SEQ ID:221.

Another function of GAM3229 is therefore inhibition of FLJ34817 (Accession NP_689516.1). Accordingly, utilities of GAM3229 include diagnosis, prevention and treatment of diseases and clinical conditions associated with FLJ34817.

FLJ35487 (Accession NP_776181.1) is another GAM3229 target gene, herein designated TARGET GENE. FLJ35487 BINDING SITE is a target binding site found in the 3' untranslated region of mRNA encoded by FLJ35487, corresponding to a target binding site such as BINDING SITE I, BINDING SITE II or BINDING SITE III of FIG. 8. Table 4 illustrates the complementarity of the nucleotide sequences of FLJ35487 BINDING SITE, designated SEQ ID:7671, to the nucleotide sequence of GAM3229 RNA, herein designated GAM RNA, also designated SEQ ID:221.

Another function of GAM3229 is therefore inhibition of FLJ35487 (Accession NP_776181.1). Accordingly, utilities of GAM3229 include diagnosis, prevention and treatment of diseases and clinical conditions associated with FLJ35487.

FLJ35681 (Accession NP_787096.1) is another GAM3229 target gene, herein designated TARGET GENE. FLJ35681 BINDING SITE1 and FLJ35681 BINDING SITE2 are target binding sites found in untranslated regions of mRNA encoded by FLJ35681, corresponding to target binding sites such as BINDING SITE I, BINDING SITE II or BINDING SITE III of FIG. 8. Table 4 illustrates the complementarity of the nucleotide sequences of FLJ35681 BINDING SITE1 and FLJ35681 BINDING SITE2, designated SEQ ID:20076 and SEQ ID:14927 respectively, to the nucleotide sequence of GAM3229 RNA, herein designated GAM RNA, also designated SEQ ID:221.

Another function of GAM3229 is therefore inhibition of FLJ35681 (Accession NP_787096.1). Accordingly, utilities of GAM3229 include diagnosis, prevention and treatment of diseases and clinical conditions associated with FLJ35681.

FLJ35740 (Accession NP_671728.1) is another GAM3229 target gene, herein designated TARGET GENE. FLJ35740 BINDING SITE is a target binding site found in the 3' untranslated region of mRNA encoded by FLJ35740, corresponding to a target binding site such as BINDING SITE I, BINDING SITE II or BINDING SITE III of FIG. 8. Table 4 illustrates the complementarity of the nucleotide sequences of FLJ35740 BINDING SITE, designated SEQ ID:19097, to the nucleotide sequence of GAM3229 RNA, herein designated GAM RNA, also designated SEQ ID:221.

Another function of GAM3229 is therefore inhibition of FLJ35740 (Accession NP_671728.1). Accordingly, utilities of GAM3229 include diagnosis, prevention and treatment of diseases and clinical conditions associated with FLJ35740.

FLJ35848 (Accession XP_290755.1) is another GAM3229 target gene, herein designated TARGET GENE. FLJ35848 BINDING SITE is a target binding site found in the 3' untranslated region of mRNA encoded by FLJ35848, corresponding to a target binding site such as BINDING SITE I, BINDING SITE II or BINDING SITE III of FIG. 8. Table 4 illustrates the complementarity of the nucleotide sequences of FLJ35848 BINDING SITE, designated SEQ ID:4410, to the nucleotide sequence of GAM3229 RNA, herein designated GAM RNA, also designated SEQ ID:221.

Another function of GAM3229 is therefore inhibition of FLJ35848 (Accession XP_290755.1). Accordingly, utilities of GAM3229 include diagnosis, prevention and treatment of diseases and clinical conditions associated with FLJ35848.

FLJ36032 (Accession XP_290874.1) is another GAM3229 target gene, herein designated TARGET GENE. FLJ36032 BINDING SITE is a target binding site found in the 3' untranslated region of mRNA encoded by FLJ36032, corresponding to a target binding site such as BINDING SITE I, BINDING SITE II or BINDING SITE III of FIG. 8. Table 4 illustrates the complementarity of the nucleotide sequences of FLJ36032 BINDING SITE, designated SEQ ID:6274, to the nucleotide sequence of GAM3229 RNA, herein designated GAM RNA, also designated SEQ ID:221.

Another function of GAM3229 is therefore inhibition of FLJ36032 (Accession XP_290874.1). Accordingly, utilities of GAM3229 include diagnosis, prevention and treatment of diseases and clinical conditions associated with FLJ36032.

FLJ37078 (Accession NP_694588.1) is another GAM3229 target gene, herein designated TARGET GENE. FLJ37078 BINDING SITE is a target binding site found in the 5' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:7587, to the nucleotide sequence of GAM3229 RNA, herein designated GAM RNA, also designated SEQ ID:221.

Another function of GAM3229 is therefore inhibition of FLJ37078 (Accession NP_694588.1). Accordingly, utilities of GAM3229 include diagnosis, prevention and treatment of diseases and clinical conditions associated with FLJ37078.

FLJ37433 (Accession NP_848612.1) is another GAM3229 target gene, herein designated TARGET GENE. FLJ37433 BINDING SITE is a target binding site found in the 3' untranslated region of mRNA encoded by FLJ37433, corresponding to a target binding site such as BINDING SITE I, BINDING SITE II or BINDING SITE III of FIG. 8. Table 4 illustrates the complementarity of the nucleotide sequences of FLJ37433 BINDING SITE, designated SEQ ID:10075, to the nucleotide sequence of GAM3229 RNA, herein designated GAM RNA, also designated SEQ ID:221.

Another function of GAM3229 is therefore inhibition of FLJ37433 (Accession NP_848612.1). Accordingly, utilities of GAM3229 include diagnosis, prevention and treatment of diseases and clinical conditions associated with FLJ37433.

FLJ38149 (Accession XP_091919.5) is another GAM3229 target gene, herein designated TARGET GENE. FLJ38149 BINDING SITE is a target binding site found in the 3' untranslated region of mRNA encoded by FLJ38149, corresponding to a target binding site such as BINDING SITE I, BINDING SITE II or BINDING SITE III of FIG. 8. Table 4 illustrates the complementarity of the nucleotide sequences of FLJ38149 BINDING SITE, designated SEQ ID:11940, to the nucleotide sequence of GAM3229 RNA, herein designated GAM RNA, also designated SEQ ID:221.

Another function of GAM3229 is therefore inhibition of FLJ38149 (Accession XP_091919.5). Accordingly, utilities of GAM3229 include diagnosis, prevention and treatment of diseases and clinical conditions associated with FLJ38149.

FLJ38281 (Accession NP_689814.1) is another GAM3229 target gene, herein designated TARGET GENE. FLJ38281 BINDING SITE is a target binding site found in the 3' untranslated region of mRNA encoded by FLJ38281, corresponding to a target binding site such as BINDING SITE I, BINDING SITE II or BINDING SITE III of FIG. 8. Table 4 illustrates the complementarity of the nucleotide sequences of FLJ38281 BINDING SITE, designated SEQ ID:1314, to the nucleotide sequence of GAM3229 RNA, herein designated GAM RNA, also designated SEQ ID:221.

Another function of GAM3229 is therefore inhibition of FLJ38281 (Accession NP_689814.1). Accordingly, utilities of GAM3229 include diagnosis, prevention and treatment of diseases and clinical conditions associated with FLJ38281.

FLJ38607 (Accession NP_689867.1) is another GAM3229 target gene, herein designated TARGET GENE. FLJ38607 BINDING SITE is a target binding site found in the 3' untranslated region of mRNA encoded by FLJ38607, corresponding to a target binding site such as BINDING SITE I, BINDING SITE II or BINDING SITE III of FIG. 8. Table 4 illustrates the complementarity of the nucleotide sequences of FLJ38607 BINDING SITE, designated SEQ ID:11533, to the nucleotide sequence of GAM3229 RNA, herein designated GAM RNA, also designated SEQ ID:221.

Another function of GAM3229 is therefore inhibition of FLJ38607 (Accession NP_689867.1). Accordingly, utilities of GAM3229 include diagnosis, prevention and treatment of diseases and clinical conditions associated with FLJ38607.

FLJ38792 (Accession NP_848615.1) is another GAM3229 target gene, herein designated TARGET GENE. FLJ38792 BINDING SITE is a target binding site found in the 3' untranslated region of mRNA encoded by FLJ38792, corresponding to a target binding site such as BINDING SITE I, BINDING SITE II or BINDING SITE III of FIG. 8. Table 4 illustrates the complementarity of the nucleotide sequences of FLJ38792 BINDING SITE, designated SEQ ID:18663, to the nucleotide sequence of GAM3229 RNA, herein designated GAM RNA, also designated SEQ ID:221.

Another function of GAM3229 is therefore inhibition of FLJ38792 (Accession NP_848615.1). Accordingly, utilities of GAM3229 include diagnosis, prevention and treatment of diseases and clinical conditions associated with FLJ38792.

FLJ38819 (Accession NP_665872.1) is another GAM3229 target gene, herein designated TARGET GENE. FLJ38819 BINDING SITE1 and FLJ38819 BINDING SITE2 are target binding sites found in untranslated regions of mRNA encoded by FLJ38819, corresponding to target binding sites such as BINDING SITE I, BINDING SITE II or BINDING SITE III of FIG. 8. Table 4 illustrates the complementarity of the nucleotide sequences of FLJ38819 BINDING SITE1 and FLJ38819 BINDING SITE2, designated SEQ ID:9307 and SEQ ID:1627 respectively, to the nucleotide sequence of GAM3229 RNA, herein designated GAM RNA, also designated SEQ ID:221.

Another function of GAM3229 is therefore inhibition of FLJ38819 (Accession NP_665872.1). Accordingly, utilities of GAM3229 include diagnosis, prevention and treatment of diseases and clinical conditions associated with FLJ38819.

FLJ38991 (Accession NP_776188.1) is another GAM3229 target gene, herein designated TARGET GENE. FLJ38991 BINDING SITE is a target binding site found in the 3' untranslated region of mRNA encoded by FLJ38991, corresponding to a target binding site such as BINDING SITE I, BINDING SITE II or BINDING SITE III of FIG. 8. Table 4 illustrates the complementarity of the nucleotide sequences of FLJ38991 BINDING SITE, designated SEQ ID:12896, to the nucleotide sequence of GAM3229 RNA, herein designated GAM RNA, also designated SEQ ID:221.

Another function of GAM3229 is therefore inhibition of FLJ38991 (Accession NP_776188.1). Accordingly, utilities of GAM3229 include diagnosis, prevention and treatment of diseases and clinical conditions associated with FLJ38991.

FLJ39058 (Accession NP_775851.1) is another GAM3229 target gene, herein designated TARGET GENE. FLJ39058 BINDING SITE is a target binding site found in the 3' untranslated region of mRNA encoded by FLJ39058, corresponding to a target binding site such as BINDING SITE I, BINDING SITE II or BINDING SITE III of FIG. 8. Table 4 illustrates the complementarity of the nucleotide sequences of FLJ39058 BINDING SITE, designated SEQ ID:5123, to the nucleotide sequence of GAM3229 RNA, herein designated GAM RNA, also designated SEQ ID:221.

Another function of GAM3229 is therefore inhibition of FLJ39058 (Accession NP_775851.1). Accordingly, utilities of GAM3229 include diagnosis, prevention and treatment of diseases and clinical conditions associated with FLJ39058.

FLJ39426 (Accession NP_775880.1) is another GAM3229 target gene, herein designated TARGET GENE. FLJ39426 BINDING SITE is a target binding site found in the 5' untranslated region of mRNA encoded by FLJ39426, corresponding to a target binding site such as BINDING SITE I, BINDING SITE II or BINDING SITE III of FIG. 8. Table 4 illustrates the complementarity of the nucleotide sequences of FLJ39426 BINDING SITE, designated SEQ ID:16679, to the nucleotide sequence of GAM3229 RNA, herein designated GAM RNA, also designated SEQ ID:221.

Another function of GAM3229 is therefore inhibition of FLJ39426 (Accession NP_775880.1). Accordingly, utilities of GAM3229 include diagnosis, prevention and treatment of diseases and clinical conditions associated with FLJ39426.

FLJ39599 (Accession NP_776164.1) is another GAM3229 target gene, herein designated TARGET GENE. FLJ39599 BINDING SITE is a target binding site found in the 3' untranslated region of mRNA encoded by FLJ39599, corresponding to a target binding site such as BINDING SITE I, BINDING SITE II or BINDING SITE III of FIG. 8. Table 4 illustrates the complementarity of the nucleotide sequences of FLJ39599 BINDING SITE, designated SEQ ID:7239, to the nucleotide sequence of GAM3229 RNA, herein designated GAM RNA, also designated SEQ ID:221.

Another function of GAM3229 is therefore inhibition of FLJ39599 (Accession NP_776164.1). Accordingly, utilities of GAM3229 include diagnosis, prevention and treatment of diseases and clinical conditions associated with FLJ39599.

FLJ39639 (Accession XP_290687.1) is another GAM3229 target gene, herein designated TARGET GENE. FLJ39639 BINDING SITE is a target binding site found in the 3' untranslated region of mRNA encoded by FLJ39639, corresponding to a target binding site such as BINDING SITE I, BINDING SITE II or BINDING SITE III of FIG. 8. Table 4 illustrates the complementarity of the nucleotide sequences of FLJ39639 BINDING SITE, designated SEQ ID:2704, to the nucleotide sequence of GAM3229 RNA, herein designated GAM RNA, also designated SEQ ID:221.

Another function of GAM3229 is therefore inhibition of FLJ39639 (Accession XP_290687.1). Accordingly, utilities of GAM3229 include diagnosis, prevention and treatment of diseases and clinical conditions associated with FLJ39639.

FLJ40137 (Accession NP_775749.1) is another GAM3229 target gene, herein designated TARGET GENE. FLJ40137 BINDING SITE is a target binding site found in the 3' untranslated region of mRNA encoded by FLJ40137, corresponding to a target binding site such as BINDING SITE I, BINDING SITE II or BINDING SITE III of FIG. 8. Table 4 illustrates the complementarity of the nucleotide sequences of FLJ40137 BINDING SITE, designated SEQ ID:3565, to the nucleotide sequence of GAM3229 RNA, herein designated GAM RNA, also designated SEQ ID:221.

Another function of GAM3229 is therefore inhibition of FLJ40137 (Accession NP_775749.1). Accordingly, utilities of GAM3229 include diagnosis, prevention and treatment of diseases and clinical conditions associated with FLJ40137.

FLJ90119 (Accession NP_699178.1) is another GAM3229 target gene, herein designated TARGET GENE. FLJ90119 BINDING SITE is a target binding site found in the 3' untranslated region of mRNA encoded by FLJ90119, corresponding to a target binding site such as BINDING SITE I, BINDING SITE II or BINDING SITE III of FIG. 8. Table 4 illustrates the complementarity of the nucleotide sequences of FLJ90119 BINDING SITE, designated SEQ ID:1074, to the nucleotide sequence of GAM3229 RNA, herein designated GAM RNA, also designated SEQ ID:221.

Another function of GAM3229 is therefore inhibition of FLJ90119 (Accession NP_699178.1). Accordingly, utilities of GAM3229 include diagnosis, prevention and treatment of diseases and clinical conditions associated with FLJ90119.

FLJ90754 (Accession NP_699197.1) is another GAM3229 target gene, herein designated TARGET GENE. FLJ90754 BINDING SITE is a target binding site found in the 5' untranslated region of mRNA encoded by FLJ90754, corresponding to a target binding site such as BINDING SITE I, BINDING SITE II or BINDING SITE III of FIG. 8. Table 4 illustrates the complementarity of the nucleotide sequences of FLJ90754 BINDING SITE, designated SEQ ID:2556, to the nucleotide sequence of GAM3229 RNA, herein designated GAM RNA, also designated SEQ ID:221.

Another function of GAM3229 is therefore inhibition of FLJ90754 (Accession NP_699197.1). Accordingly, utilities of GAM3229 include diagnosis, prevention and treatment of diseases and clinical conditions associated with FLJ90754.

Fragile x mental retardation 2 (FMR2, Accession NP_002016.1) is another GAM3229 target gene, herein designated TARGET GENE. FMR2 BINDING SITE is a target binding site found in the 3' untranslated region of mRNA encoded by FMR2, corresponding to a target binding site such as BINDING SITE I, BINDING SITE II or BINDING SITE III of FIG. 8. Table 4 illustrates the complementarity of the nucleotide sequences of FMR2 BINDING SITE, designated SEQ ID:9034, to the nucleotide sequence of GAM3229 RNA, herein designated GAM RNA, also designated SEQ ID:221.

Another function of GAM3229 is therefore inhibition of Fragile x mental retardation 2 (FMR2, Accession NP_002016.1). Accordingly, utilities of GAM3229 include diagnosis, prevention and treatment of diseases and clinical conditions associated with FMR2.

FSD1 (Accession NP_077309.1) is another GAM3229 target gene, herein designated TARGET GENE. FSD1 BINDING SITE is a target binding site found in the 3' untranslated region of mRNA encoded by FSD1, corresponding to a target binding site such as BINDING SITE I, BINDING SITE II or BINDING SITE III of FIG. 8. Table 4 illustrates the complementarity of the nucleotide sequences of FSD1 BINDING SITE, designated SEQ ID:12959, to the nucleotide sequence of GAM3229 RNA, herein designated GAM RNA, also designated SEQ ID:221.

Another function of GAM3229 is therefore inhibition of FSD1 (Accession NP_077309.1). Accordingly, utilities of GAM3229 include diagnosis, prevention and treatment of diseases and clinical conditions associated with FSD1.

Follistatin-like 3 (secreted glycoprotein) (FSTL3, Accession NP_005851.1) is another GAM3229 target gene, herein designated TARGET GENE. FSTL3 BINDING SITE is a target binding site found in the 3' untranslated region of mRNA encoded by FSTL3, corresponding to a target binding site such as BINDING SITE I, BINDING SITE II or BINDING SITE III of FIG. 8. Table 4 illustrates the complementarity of the nucleotide sequences of FSTL3 BINDING SITE, designated SEQ ID:13077, to the nucleotide sequence of GAM3229 RNA, herein designated GAM RNA, also designated SEQ ID:221.

Another function of GAM3229 is therefore inhibition of Follistatin-like 3 (secreted glycoprotein) (FSTL3, Accession NP_005851.1), a gene which is a member of the follistatin-module-protein family and therefore may be associated with Leukemia. Accordingly, utilities of GAM3229 include diagnosis, prevention and treatment of Leukemia, and of other diseases and clinical conditions associated with FSTL3.

The function of FSTL3 and its association with various diseases and clinical conditions, has been established by previous studies, as described hereinabove with reference to GAM523.2. Ftsj homolog 2 (e. coli) (FTSJ2, Accession NP_803191.1) is another GAM3229 target gene, herein designated TARGET GENE. FTSJ2 BINDING SITE is a target binding site found in the 3' untranslated region of multiple transcripts of mRNA encoded by FTSJ2, corresponding to a target binding site such as BINDING SITE I, BINDING SITE II or BINDING SITE III of FIG. 8. Table 4 illustrates the complementarity of the nucleotide sequences of FTSJ2 BINDING SITE, designated SEQ ID:14535, to the nucleotide sequence of GAM3229 RNA, herein designated GAM RNA, also designated SEQ ID:221.

Another function of GAM3229 is therefore inhibition of Ftsj homolog 2 (e. coli) (FTSJ2, Accession NP_803191.1). Accordingly, utilities of GAM3229 include diagnosis, prevention and treatment of diseases and clinical conditions associated with FTSJ2.

Fucosyltransferase 1 (galactoside 2-alpha-l-fucosyltransferase, bombay phenotype included) (FUT1, Accession NP_000139.1) is another GAM3229 target gene, herein designated TARGET GENE. FUT1 BINDING SITE is a target binding site found in the 3' untranslated region of mRNA encoded by FUT1, corresponding to a target binding site such as BINDING SITE I, BINDING SITE II or BINDING SITE III of FIG. 8. Table 4 illustrates the complementarity of the nucleotide sequences of FUT1 BINDING SITE, designated SEQ ID:13673, to the nucleotide sequence of GAM3229 RNA, herein designated GAM RNA, also designated SEQ ID:221.

Another function of GAM3229 is therefore inhibition of Fucosyltransferase 1 (galactoside 2-alpha-l-fucosyltransferase, bombay phenotype included) (FUT1, Accession NP_000139.1). Accordingly, utilities of GAM3229 include diagnosis, prevention and treatment of diseases and clinical conditions associated with FUT1.

Giant axonal neuropathy (gigaxonin) (GAN, Accession NP_071324.1) is another GAM3229 target gene, herein designated TARGET GENE. GAN BINDING SITE is a target binding site found in the 3' untranslated region of mRNA encoded by GAN, corresponding to a target binding site such as BINDING SITE I, BINDING SITE II or BINDING SITE III of FIG. 8. Table 4 illustrates the complementarity of the nucleotide sequences of GAN BINDING SITE, designated SEQ ID:14322, to the nucleotide sequence of GAM3229 RNA, herein designated GAM RNA, also designated SEQ ID:221.

Another function of GAM3229 is therefore inhibition of Giant axonal neuropathy (gigaxonin) (GAN, Accession NP_071324.1), a gene which plays an important role in neurofilament architecture. and therefore may be associated with Giant axonal neuropathy 1. Accordingly, utilities of GAM3229 include diagnosis, prevention and treatment of Giant axonal neuropathy 1., and of other diseases and clinical conditions associated with GAN.

The function of GAN and its association with various diseases and clinical conditions, has been established by previous studies, as described hereinabove with reference to GAM47.1. GBP4 (Accession NP_443173.2) is another GAM3229 target gene, herein designated TARGET GENE. GBP4 BINDING SITE is a target binding site found in the 3' untranslated region of mRNA encoded by GBP4, corresponding to a target binding site such as BINDING SITE I, BINDING SITE II or BINDING SITE III of FIG. 8. Table 4 illustrates the complementarity of the nucleotide sequences of GBP4 BINDING SITE, designated SEQ ID:655, to the nucleotide sequence of GAM3229 RNA, herein designated GAM RNA, also designated SEQ ID:221.

Another function of GAM3229 is therefore inhibition of GBP4 (Accession NP_443173.2). Accordingly, utilities of GAM3229 include diagnosis, prevention and treatment of diseases and clinical conditions associated with GBP4.

Glial fibrillary acidic protein (GFAP, Accession NP_002046.1) is another GAM3229 target gene, herein designated TARGET GENE. GFAP BINDING SITE is a target binding site found in the 3' untranslated region of mRNA encoded by GFAP, corresponding to a target binding site such as BINDING SITE I, BINDING SITE II or BINDING SITE III of FIG. 8. Table 4 illustrates the complementarity of the nucleotide sequences of GFAP BINDING SITE, designated SEQ ID:9652, to the nucleotide sequence of GAM3229 RNA, herein designated GAM RNA, also designated SEQ ID:221.

Another function of GAM3229 is therefore inhibition of Glial fibrillary acidic protein (GFAP, Accession NP_002046.1). Accordingly, utilities of GAM3229 include diagnosis, prevention and treatment of diseases and clinical conditions associated with GFAP.

Glyoxalase i (GLO1, Accession NP_006699.1) is another GAM3229 target gene, herein designated TARGET GENE. GLO1 BINDING SITE is a target binding site found in the 3' untranslated region of mRNA encoded by GLO1, corresponding to a target binding site such as BINDING SITE I, BINDING SITE II or BINDING SITE III of FIG. 8. Table 4 illustrates the complementarity of the nucleotide sequences of GLO1 BINDING SITE, designated SEQ ID:14826, to the nucleotide sequence of GAM3229 RNA, herein designated GAM RNA, also designated SEQ ID:221.

Another function of GAM3229 is therefore inhibition of Glyoxalase i (GLO1, Accession NP_006699.1), a gene which converts methylglyoxal and glutathione to S-lactoylglutathione. Accordingly, utilities of GAM3229 include diagnosis, prevention and treatment of diseases and clinical conditions associated with GLO1.

The function of GLO1 and its association with various diseases and clinical conditions, has been established by previous studies, as described hereinabove with reference to GAM1550.1. Gm2 ganglioside activator protein (GM2A, Accession NP_000396.1) is another GAM3229 target gene, herein designated TARGET GENE. GM2A BINDING SITE is a target binding site found in the 3' untranslated region of mRNA encoded by GM2A, corresponding to a target binding site such as BINDING SITE I, BINDING SITE II or BINDING SITE III of FIG. 8. Table 4 illustrates the complementarity of the nucleotide sequences of GM2A BINDING SITE, designated SEQ ID:2783, to the nucleotide sequence of GAM3229 RNA, herein designated GAM RNA, also designated SEQ ID:221.

Another function of GAM3229 is therefore inhibition of Gm2 ganglioside activator protein (GM2A, Accession NP_000396.1). Accordingly, utilities of GAM3229 include diagnosis, prevention and treatment of diseases and clinical conditions associated with GM2A.

GNPNAT1 (Accession XP_085119.1) is another GAM3229 target gene, herein designated TARGET GENE. GNPNAT1 BINDING SITE1 and GNPNAT1 BINDING SITE2 are target binding sites found in untranslated regions of mRNA encoded by GNPNAT1, corresponding to target binding sites such as BINDING SITE I, BINDING SITE II or BINDING SITE III of FIG. 8. Table 4 illustrates the complementarity of the nucleotide sequences of GNPNAT1 BINDING SITE1 and GNPNAT1 BINDING SITE2, designated SEQ ID:12484 and SEQ ID:13881 respectively, to the nucleotide sequence of GAM3229 RNA, herein designated GAM RNA, also designated SEQ ID:221.

Another function of GAM3229 is therefore inhibition of GNPNAT1 (Accession XP_085119.1). Accordingly, utilities of GAM3229 include diagnosis, prevention and treatment of diseases and clinical conditions associated with GNPNAT1.

GPP34R (Accession NP_060648.2) is another GAM3229 target gene, herein designated TARGET GENE. GPP34R BINDING SITE is a target binding site found in the 3' untranslated region of mRNA encoded by GPP34R, corresponding to a target binding site such as BINDING SITE I, BINDING SITE II or BINDING SITE III of FIG. 8. Table 4 illustrates the complementarity of the nucleotide sequences of GPP34R BINDING SITE, designated SEQ ID:14018, to the nucleotide sequence of GAM3229 RNA, herein designated GAM RNA, also designated SEQ ID:221.

Another function of GAM3229 is therefore inhibition of GPP34R (Accession NP_060648.2). Accordingly, utilities of GAM3229 include diagnosis, prevention and treatment of diseases and clinical conditions associated with GPP34R.

G protein-coupled receptor 81 (GPR81, Accession NP_115943.1) is another GAM3229 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:10075, to the nucleotide sequence of GAM3229 RNA, herein designated GAM RNA, also designated SEQ ID:221.

Another function of GAM3229 is therefore inhibition of G protein-coupled receptor 81 (GPR81, Accession NP_115943.1). Accordingly, utilities of GAM3229 include diagnosis, prevention and treatment of diseases and clinical conditions associated with GPR81.

Glutathione peroxidase 6 (olfactory) (GPX6, Accession NP_056511.2) is another GAM3229 target gene, herein designated TARGET GENE. GPX6 BINDING SITE1 and GPX6 BINDING SITE2 are target binding sites found in untranslated regions of mRNA encoded by GPX6, corresponding to target binding sites such as BINDING SITE I, BINDING SITE II or BINDING SITE III of FIG. 8. Table 4 illustrates the complementarity of the nucleotide sequences of GPX6 BINDING SITE1 and GPX6 BINDING SITE2, designated SEQ ID:7367 and SEQ ID:19324 respectively, to the nucleotide sequence of GAM3229 RNA, herein designated GAM RNA, also designated SEQ ID:221.

Another function of GAM3229 is therefore inhibition of Glutathione peroxidase 6 (olfactory) (GPX6, Accession NP_056511.2). Accordingly, utilities of GAM3229 include diagnosis, prevention and treatment of diseases and clinical conditions associated with GPX6.

GR6 (Accession NP_031380.1) is another GAM3229 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:7906, to the nucleotide sequence of GAM3229 RNA, herein designated GAM RNA, also designated SEQ ID:221.

Another function of GAM3229 is therefore inhibition of GR6 (Accession NP_031380.1). Accordingly, utilities of GAM3229 include diagnosis, prevention and treatment of diseases and clinical conditions associated with GR6.

GREB1 (Accession NP_055483.2) is another GAM3229 target gene, herein designated TARGET GENE. GREB1 BINDING SITE is a target binding site found in the 3' untranslated region of multiple transcripts of mRNA encoded by GREB1, corresponding to a target binding site such as BINDING SITE I, BINDING SITE II or BINDING SITE III of FIG. 8. Table 4 illustrates the complementarity of the nucleotide sequences of GREB1 BINDING SITE, designated SEQ ID:11197, to the nucleotide sequence of GAM3229 RNA, herein designated GAM RNA, also designated SEQ ID:221.

Another function of GAM3229 is therefore inhibition of GREB1 (Accession NP_055483.2). Accordingly, utilities of GAM3229 include diagnosis, prevention and treatment of diseases and clinical conditions associated with GREB1.

Glutamate receptor, ionotropic, delta 1 (GRID1, Accession XP_043613.8) is another GAM3229 target gene, herein designated TARGET GENE. GRID1 BINDING SITE is a target binding site found in the 3' untranslated region of mRNA encoded by GRID1, corresponding to a target binding site such as BINDING SITE I, BINDING SITE II or BINDING SITE III of FIG. 8. Table 4 illustrates the complementarity of the nucleotide sequences of GRID1 BINDING SITE, designated SEQ ID:17543, to the nucleotide sequence of GAM3229 RNA, herein designated GAM RNA, also designated SEQ ID:221.

Another function of GAM3229 is therefore inhibition of Glutamate receptor, ionotropic, delta 1 (GRID1, Accession XP_043613.8). Accordingly, utilities of GAM3229 include diagnosis, prevention and treatment of diseases and clinical conditions associated with GRID1.

Glutamate receptor, ionotropic, n-methyl d-aspartate 2a (GRIN2A, Accession NP_000824.1) is another GAM3229 target gene, herein designated TARGET GENE. GRIN2A BINDING SITE is a target binding site found in the 3' untranslated region of mRNA encoded by GRIN2A, corresponding to a target binding site such as BINDING SITE I, BINDING SITE II or BINDING SITE III of FIG. 8. Table 4 illustrates the complementarity of the nucleotide sequences of GRIN2A BINDING SITE, designated SEQ ID:13819, to the nucleotide sequence of GAM3229 RNA, herein designated GAM RNA, also designated SEQ ID:221.

Another function of GAM3229 is therefore inhibition of Glutamate receptor, ionotropic, n-methyl d-aspartate 2a (GRIN2A, Accession NP_000824.1), a gene which modulates the efficiency of synaptic plasticity. Accordingly, utilities of GAM3229 include diagnosis, prevention and treatment of diseases and clinical conditions associated with GRIN2A.

The function of GRIN2A and its association with various diseases and clinical conditions, has been established by previous studies, as described hereinabove with reference to GAM55.2. Glutamate receptor, metabotropic 6 (GRM6, Accession NP_000834.1) is another GAM3229 target gene, herein designated TARGET GENE. GRM6 BINDING SITE is a target binding site found in the 3' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:12308, to the nucleotide sequence of GAM3229 RNA, herein designated GAM RNA, also designated SEQ ID:221.

Another function of GAM3229 is therefore inhibition of Glutamate receptor, metabotropic 6 (GRM6, Accession NP_000834.1). Accordingly, utilities of GAM3229 include diagnosis, prevention and treatment of diseases and clinical conditions associated with GRM6.

GSDM (Accession NP_835465.1) is another GAM3229 target gene, herein designated TARGET GENE. GSDM BINDING SITE1 and GSDM BINDING SITE2 are target binding sites found in untranslated regions of multiple transcripts of mRNA encoded by GSDM, corresponding to target binding sites such as BINDING SITE I, BINDING SITE II or BINDING SITE III of FIG. 8. Table 4 illustrates the complementarity of the nucleotide sequences of GSDM BINDING SITE1 and GSDM BINDING SITE2, designated SEQ ID:10286 and SEQ ID:6398 respectively, to the nucleotide sequence of GAM3229 RNA, herein designated GAM RNA, also designated SEQ ID:221.

Another function of GAM3229 is therefore inhibition of GSDM (Accession NP_835465.1). Accordingly, utilities of GAM3229 include diagnosis, prevention and treatment of diseases and clinical conditions associated with GSDM.

Hypermethylated in cancer 2 (HIC2, Accession NP_055909.1) is another GAM3229 target gene, herein designated TARGET GENE. HIC2 BINDING SITE is a target binding site found in the 3' untranslated region of multiple transcripts of mRNA encoded by HIC2, corresponding to a target binding site such as BINDING SITE I, BINDING SITE II or BINDING SITE III of FIG. 8. Table 4 illustrates the complementarity of the nucleotide sequences of HIC2 BINDING SITE, designated SEQ ID:9438, to the nucleotide sequence of GAM3229 RNA, herein designated GAM RNA, also designated SEQ ID:221.

Another function of GAM3229 is therefore inhibition of Hypermethylated in cancer 2 (HIC2, Accession NP_055909.1). Accordingly, utilities of GAM3229 include diagnosis, prevention and treatment of diseases and clinical conditions associated with HIC2.

Hypermethylated in cancer 2 (HIC2, Accession XP_036937.2) is another GAM3229 target gene, herein designated TARGET GENE. HIC2 BINDING SITE is a target binding site found in the 3' untranslated region of multiple transcripts of mRNA encoded by HIC2, corresponding to a target binding site such as BINDING SITE I, BINDING SITE II or BINDING SITE III of FIG. 8. Table 4 illustrates the complementarity of the nucleotide sequences of HIC2 BINDING SITE, designated SEQ ID:9438, to the nucleotide sequence of GAM3229 RNA, herein designated GAM RNA, also designated SEQ ID:221.

Another function of GAM3229 is therefore inhibition of Hypermethylated in cancer 2 (HIC2, Accession XP_036937.2). Accordingly, utilities of GAM3229 include diagnosis, prevention and treatment of diseases and clinical conditions associated with HIC2.

HIG1 (Accession NP_054775.1) is another GAM3229 target gene, herein designated TARGET GENE. HIG1 BINDING SITE is a target binding site found in the 5' untranslated region of mRNA encoded by HIG1, corresponding to a target binding site such as BINDING SITE I, BINDING SITE II or BINDING SITE III of FIG. 8. Table 4 illustrates the complementarity of the nucleotide sequences of HIG1 BINDING SITE, designated SEQ ID:6969, to the nucleotide sequence of GAM3229 RNA, herein designated GAM RNA, also designated SEQ ID:221.

Another function of GAM3229 is therefore inhibition of HIG1 (Accession NP_054775.1). Accordingly, utilities of GAM3229 include diagnosis, prevention and treatment of diseases and clinical conditions associated with HIG1.

Major histocompatibility complex, class ii, do beta (HLA-DOB, Accession NP_002111.1) is another GAM3229 target gene, herein designated TARGET GENE. HLA-DOB BINDING SITE is a target binding site found in the 3' untranslated region of mRNA encoded by HLA-DOB, corresponding to a target binding site such as BINDING SITE I, BINDING SITE II or BINDING SITE III of FIG. 8. Table 4 illustrates the complementarity of the nucleotide sequences of HLA-DOB BINDING SITE, designated SEQ ID:14561, to the nucleotide sequence of GAM3229 RNA, herein designated GAM RNA, also designated SEQ ID:221.

Another function of GAM3229 is therefore inhibition of Major histocompatibility complex, class ii, do beta (HLA-DOB, Accession NP_002111.1). Accordingly, utilities of GAM3229 include diagnosis, prevention and treatment of diseases and clinical conditions associated with HLA-DOB.

Homeo box b2 (HOXB2, Accession NP_002136.1) is another GAM3229 target gene, herein designated TARGET GENE. HOXB2 BINDING SITE is a target binding site found in the 3' untranslated region of mRNA encoded by HOXB2, corresponding to a target binding site such as BINDING SITE I, BINDING SITE II or BINDING SITE III of FIG. 8. Table 4 illustrates the complementarity of the nucleotide sequences of HOXB2 BINDING SITE, designated SEQ ID:7506, to the nucleotide sequence of GAM3229 RNA, herein designated GAM RNA, also designated SEQ ID:221.

Another function of GAM3229 is therefore inhibition of Homeo box b2 (HOXB2, Accession NP_002136.1), a gene which may mediate the regulation of hematopoietic cell growth and differentiation. Accordingly, utilities of GAM3229 include diagnosis, prevention and treatment of diseases and clinical conditions associated with HOXB2.

The function of HOXB2 and its association with various diseases and clinical conditions, has been established by previous studies, as described hereinabove with reference to GAM1990.1. Heparan sulfate (glucosamine) 3-o-sulfotransferase 5 (HS3ST5, Accession NP_705840.1) is another GAM3229 target gene, herein designated TARGET GENE. HS3ST5 BINDING SITE is a target binding site found in the 3' untranslated region of mRNA encoded by HS3ST5, corresponding to a target binding site such as BINDING SITE I, BINDING SITE II or BINDING SITE III of FIG. 8. Table 4 illustrates the complementarity of the nucleotide sequences of HS3ST5 BINDING SITE, designated SEQ ID:8703, to the nucleotide sequence of GAM3229 RNA, herein designated GAM RNA, also designated SEQ ID:221.

Another function of GAM3229 is therefore inhibition of Heparan sulfate (glucosamine) 3-o-sulfotransferase 5 (HS3ST5, Accession NP_705840.1). Accordingly, utilities of GAM3229 include diagnosis, prevention and treatment of diseases and clinical conditions associated with HS3ST5.

HSD3B7 (Accession NP_079469.2) is another GAM3229 target gene, herein designated TARGET GENE. HSD3B7 BINDING SITE is a target binding site found in the 3' untranslated region of mRNA encoded by HSD3B7, corresponding to a target binding site such as BINDING SITE I, BINDING SITE II or BINDING SITE III of FIG. 8. Table 4 illustrates the complementarity of the nucleotide sequences of HSD3B7 BINDING SITE, designated SEQ ID:15973, to the nucleotide sequence of GAM3229 RNA, herein designated GAM RNA, also designated SEQ ID:221.

Another function of GAM3229 is therefore inhibition of HSD3B7 (Accession NP_079469.2). Accordingly, utilities of GAM3229 include diagnosis, prevention and treatment of diseases and clinical conditions associated with HSD3B7.

HSNOV1 (Accession NP_059985.2) is another GAM3229 target gene, herein designated TARGET GENE. HSNOV1 BINDING SITE is a target binding site found in the 3' untranslated region of mRNA encoded by HSNOV1, corresponding to a target binding site such as BINDING SITE I, BINDING SITE II or BINDING SITE III of FIG. 8. Table 4 illustrates the complementarity of the nucleotide sequences of HSNOV1 BINDING SITE, designated SEQ ID:10558, to the nucleotide sequence of GAM3229 RNA, herein designated GAM RNA, also designated SEQ ID:221.

Another function of GAM3229 is therefore inhibition of HSNOV1 (Accession NP_059985.2). Accordingly, utilities of GAM3229 include diagnosis, prevention and treatment of diseases and clinical conditions associated with HSNOV1.

Heat shock 70 kda protein 5 (glucose-regulated protein, 78 kda) (HSPA5, Accession NP_005338.1) is another GAM3229 target gene, herein designated TARGET GENE. HSPA5 BINDING SITE is a target binding site found in the 3' untranslated region of mRNA encoded by HSPA5, corresponding to a target binding site such as BINDING SITE I, BINDING SITE II or BINDING SITE III of FIG. 8. Table 4 illustrates the complementarity of the nucleotide sequences of HSPA5 BINDING SITE, designated SEQ ID:12356, to the nucleotide sequence of GAM3229 RNA, herein designated GAM RNA, also designated SEQ ID:221.

Another function of GAM3229 is therefore inhibition of Heat shock 70 kda protein 5 (glucose-regulated protein, 78 kda) (HSPA5, Accession NP_005338.1), a gene which is involved in the folding and assembly of proteins in the endoplasmic reticulum (ER). Accordingly, utilities of GAM3229 include diagnosis, prevention and treatment of diseases and clinical conditions associated with HSPA5.

The function of HSPA5 and its association with various diseases and clinical conditions, has been established by previous studies, as described hereinabove with reference to GAM72.1. HSPC063 (Accession NP_054874.1) is another GAM3229 target gene, herein designated TARGET GENE. HSPC063 BINDING SITE1 and HSPC063 BINDING SITE2 are target binding sites found in untranslated regions of mRNA encoded by HSPC063, corresponding to target binding sites such as BINDING SITE I, BINDING SITE II or BINDING SITE III of FIG. 8. Table 4 illustrates the complementarity of the nucleotide sequences of HSPC063 BINDING SITE1 and HSPC063 BINDING SITE2, designated SEQ ID:7180 and SEQ ID:5789 respectively, to the nucleotide sequence of GAM3229 RNA, herein designated GAM RNA, also designated SEQ ID:221.

Another function of GAM3229 is therefore inhibition of HSPC063 (Accession NP_054874.1). Accordingly, utilities of GAM3229 include diagnosis, prevention and treatment of diseases and clinical conditions associated with HSPC063.

HSPC065 (Accession NP_054876.2) is another GAM3229 target gene, herein designated TARGET GENE. HSPC065 BINDING SITE is a target binding site found in the 3' untranslated region of mRNA encoded by HSPC065, corresponding to a target binding site such as BINDING SITE I, BINDING SITE II or BINDING SITE III of FIG. 8. Table 4 illustrates the complementarity of the nucleotide sequences of HSPC065 BINDING SITE, designated SEQ ID:9903, to the nucleotide sequence of GAM3229 RNA, herein designated GAM RNA, also designated SEQ ID:221.

Another function of GAM3229 is therefore inhibition of HSPC065 (Accession NP_054876.2). Accordingly, utilities of GAM3229 include diagnosis, prevention and treatment of diseases and clinical conditions associated with HSPC065.

HSRNAFEV (Accession NP_059991.1) is another GAM3229 target gene, herein designated TARGET GENE. HSRNAFEV BINDING SITE is a target binding site found in the 3' untranslated region of mRNA encoded by HSRNAFEV, corresponding to a target binding site such as BINDING SITE I, BINDING SITE II or BINDING SITE III of FIG. 8. Table 4 illustrates the complementarity of the nucleotide sequences of HSRNAFEV BINDING SITE, designated SEQ ID:5540, to the nucleotide sequence of GAM3229 RNA, herein designated GAM RNA, also designated SEQ ID:221.

Another function of GAM3229 is therefore inhibition of HSRNAFEV (Accession NP_059991.1). Accordingly, utilities of GAM3229 include diagnosis, prevention and treatment of diseases and clinical conditions associated with HSRNAFEV.

HT009 (Accession NP_060940.1) is another GAM3229 target gene, herein designated TARGET GENE. HT009 BINDING SITE is a target binding site found in the 3' untranslated region of mRNA encoded by HT009, corresponding to a target binding site such as BINDING SITE I, BINDING SITE II or BINDING SITE III of FIG. 8. Table 4 illustrates the complementarity of the nucleotide sequences of HT009 BINDING SITE, designated SEQ ID:10585, to the nucleotide sequence of GAM3229 RNA, herein designated GAM RNA, also designated SEQ ID:221.

Another function of GAM3229 is therefore inhibition of HT009 (Accession NP_060940.1). Accordingly, utilities of GAM3229 include diagnosis, prevention and treatment of diseases and clinical conditions associated with HT009.

HTCD37 (Accession NP_067045.1) is another GAM3229 target gene, herein designated TARGET GENE. HTCD37 BINDING SITE is a target binding site found in the 3' untranslated region of mRNA encoded by HTCD37, corresponding to a target binding site such as BINDING SITE I, BINDING SITE II or BINDING SITE III of FIG. 8. Table 4 illustrates the complementarity of the nucleotide sequences of HTCD37 BINDING SITE, designated SEQ ID:10478, to the nucleotide sequence of GAM3229 RNA, herein designated GAM RNA, also designated SEQ ID:221.

Another function of GAM3229 is therefore inhibition of HTCD37 (Accession NP_067045.1). Accordingly, utilities of GAM3229 include diagnosis, prevention and treatment of diseases and clinical conditions associated with HTCD37.

Hus1 checkpoint homolog (s. pombe) (HUS1, Accession NP_004498.1) is another GAM3229 target gene, herein designated TARGET GENE. HUS1 BINDING SITE is a target binding site found in the 3' untranslated region of mRNA encoded by HUS1, corresponding to a target binding site such as BINDING SITE I, BINDING SITE II or BINDING SITE III of FIG. 8. Table 4 illustrates the complementarity of the nucleotide sequences of HUS1 BINDING SITE, designated SEQ ID:10277, to the nucleotide sequence of GAM3229 RNA, herein designated GAM RNA, also designated SEQ ID:221.

Another function of GAM3229 is therefore inhibition of Hus1 checkpoint homolog (s. pombe) (HUS1, Accession NP_004498.1), a gene which May form DNA damage-responsive protein complex. Accordingly, utilities of GAM3229 include diagnosis, prevention and treatment of diseases and clinical conditions associated with HUS1.

The function of HUS1 and its association with various diseases and clinical conditions, has been established by previous studies, as described hereinabove with reference to GAM189.1. Intercellular adhesion molecule 1 (cd54), human rhinovirus receptor (ICAM1, Accession NP_000192.1) is another GAM3229 target gene, herein designated TARGET GENE. ICAM1 BINDING SITE is a target binding site found in the 3' untranslated region of mRNA encoded by ICAM1, corresponding to a target binding site such as BINDING SITE I, BINDING SITE II or BINDING SITE III of FIG. 8. Table 4 illustrates the complementarity of the nucleotide sequences of ICAM1 BINDING SITE, designated SEQ ID:9491, to the nucleotide sequence of GAM3229 RNA, herein designated GAM RNA, also designated SEQ ID:221.

Another function of GAM3229 is therefore inhibition of Intercellular adhesion molecule 1 (cd54), human rhinovirus receptor (ICAM1, Accession NP_000192.1), a gene which binds the integrin LFA-1 (ITGB2) and promotes adhesion; member of the immunoglobulin superfamily and therefore may be associated with Malaria, cerebral, susceptibility to. Accordingly, utilities of GAM3229 include diagnosis, prevention and treatment of Malaria, cerebral, susceptibility to, and of other diseases and clinical conditions associated with ICAM1.

The function of ICAM1 and its association with various diseases and clinical conditions, has been established by previous studies, as described hereinabove with reference to GAM189.1. Insulin-like growth factor binding protein 5 (IGFBP5, Accession NP_000590.1) is another GAM3229 target gene, herein designated TARGET GENE. IGFBP5 BINDING SITE is a target binding site found in the 5' untranslated region of mRNA encoded by IGFBP5, corresponding to a target binding site such as BINDING SITE I, BINDING SITE II or BINDING SITE III of FIG. 8. Table 4 illustrates the complementarity of the nucleotide sequences of IGFBP5 BINDING SITE, designated SEQ ID:512, to the nucleotide sequence of GAM3229 RNA, herein designated GAM RNA, also designated SEQ ID:221.

Another function of GAM3229 is therefore inhibition of Insulin-like growth factor binding protein 5 (IGFBP5, Accession NP_000590.1), a gene which either inhibits or stimulates the growth promoting effects of the igfs on cell culture. Accordingly, utilities of GAM3229 include diagnosis, prevention and treatment of diseases and clinical conditions associated with IGFBP5.

The function of IGFBP5 has been established by previous studies. See 146733. Allander et al. (1994) cloned the IGFBP5 gene from a human genomic library and showed that it is divided into 4 exons which, primarily due to a first intron of approximately 25 kb, span about 33 kb of DNA. Southern analysis identified a single copy of the IGFBP5 gene in the haploid human genome. By PCR amplification of DNA from somatic human/rodent cell hybrids, by fluorescence in situ hybridization, and by hybridization to pulsed field gel electrophoresis fragments, they showed that the gene is located on 2q33-q34. The IGFBP2 gene (OMIM Ref. No. 146731) and the IGFBP5 gene are transcribed convergently and are separated by approximately 20 to 40 kb of DNA. Primer extension studies identified the IGFBP5 mRNA cap site 772 bp 5-prime to the first nucleotide of the translation start codon. A potential TATA element beginning 33 bp 5-prime to the mRNA cap site was identified. When a DNA fragment containing this cap site and 461 bp of upstream sequence was placed 5-prime to the chloramphenicol acetyltransferase (CAT) reporter gene and transfected into human breast cancer cells, it directed CAT expression in an orientation-specific manner, suggesting that this region contains elements essential for IGFBP5 promoter activity. Kou et al. (1994) demonstrated that, in the mouse, Igfbp2 and Igfbp5 colocalize to a proximal region of chromosome 1 that is syntenic with human chromosome 2q33-q36 and that the 2 genes are 5 kb apart in a tail- to - tail orientation. This suggests that the human IGFBP5 gene is located on 2q33-q36. Kou et al. (1994) also used interspecific backcross mapping and gene cloning to demonstrate that the Igfbp1 and Igfbp3 are located in the proximal part of chromosome 11. In the human genome, these 2 loci map within 20 kb of one another on 7p14-p12, and the genes are organized in a tail- to - tail configuration. The results suggested to Kou et al. (1994) an evolutionary scheme in which a primordial IGFBP gene duplicated to form a cluster that was later replicated to create a second linkage group.

Full details of the abovementioned studies are described in the following publications, the disclosure of which are hereby incorporated by reference:

Allander, S. V.; Larsson, C.; Ehrenborg, E.; Suwanichkul, A.; Weber, G.; Morris, S. L.; Bajalica, S.; Kiefer, M. C.; Luthman, H.; Powell, D. R.: Characterization of the chromosomal gene and promoter for human insulin-like growth factor binding protein-5. J. Biol. Chem. 269:10891-10898, 1994; and Kou, K.; James, P. L.; Clemmons, D. R.; Copeland, N. G.; Gilbert, D. J.; Jenkins, N. A.; Rotwein, P.: Identification of two clusters of mouse insulin-like growth factor binding protein.

Further studies establishing the function and utilities of IGFBP5 are found in John Hopkins OMIM database record ID 146734, and in cited publications listed in Table 5, which are hereby incorporated by reference. Interleukin 11 (IL11, Accession NP_000632.1) is another GAM3229 target gene, herein designated TARGET GENE. IL11 BINDING SITE is a target binding site found in the 3' untranslated region of mRNA encoded by IL11, corresponding to a target binding site such as BINDING SITE I, BINDING SITE II or BINDING SITE III of FIG. 8. Table 4 illustrates the complementarity of the nucleotide sequences of IL11 BINDING SITE, designated SEQ ID:10075, to the nucleotide sequence of GAM3229 RNA, herein designated GAM RNA, also designated SEQ ID:221.

Another function of GAM3229 is therefore inhibition of Interleukin 11 (IL11, Accession NP_000632.1), a gene which stimulates the proliferation of hematopoietic stem cells and megakaryocyte progenitor cells and induces megakaryocyte maturation. Accordingly, utilities of GAM3229 include diagnosis, prevention and treatment of diseases and clinical conditions associated with IL11.

The function of IL11 and its association with various diseases and clinical conditions, has been established by previous studies, as described hereinabove with reference to GAM41.1. Interleukin 12 receptor, beta 1 (IL12RB1, Accession NP_714912.1) is another GAM3229 target gene, herein designated TARGET GENE. IL12RB1 BINDING SITE1 and IL12RB1 BINDING SITE2 are target binding sites found in untranslated regions of multiple transcripts of mRNA encoded by IL12RB1, corresponding to target binding sites such as BINDING SITE I, BINDING SITE II or BINDING SITE III of FIG. 8. Table 4 illustrates the complementarity of the nucleotide sequences of IL12RB1 BINDING SITE1 and IL12RB1 BINDING SITE2, designated SEQ ID:8116 and SEQ ID:9835 respectively, to the nucleotide sequence of GAM3229 RNA, herein designated GAM RNA, also designated SEQ ID:221.

Another function of GAM3229 is therefore inhibition of Interleukin 12 receptor, beta 1 (IL12RB1, Accession NP_714912.1). Accordingly, utilities of GAM3229 include diagnosis, prevention and treatment of diseases and clinical conditions associated with IL12RB1.

Interleukin 19 (IL19, Accession NP_037503.2) is another GAM3229 target gene, herein designated TARGET GENE. IL19 BINDING SITE1 and IL19 BINDING SITE2 are target binding sites found in untranslated regions of multiple transcripts of mRNA encoded by IL19, corresponding to target binding sites such as BINDING SITE I, BINDING SITE II or BINDING SITE III of FIG. 8. Table 4 illustrates the complementarity of the nucleotide sequences of IL19 BINDING SITE1 and IL19 BINDING SITE2, designated SEQ ID:11633 and SEQ ID:14348 respectively, to the nucleotide sequence of GAM3229 RNA, herein designated GAM RNA, also designated SEQ ID:221.

Another function of GAM3229 is therefore inhibition of Interleukin 19 (IL19, Accession NP_037503.2), a gene which may play a role in B-cell activation and autoantibody production. Accordingly, utilities of GAM3229 include diagnosis, prevention and treatment of diseases and clinical conditions associated with IL19.

The function of IL19 and its association with various diseases and clinical conditions, has been established by previous studies, as described hereinabove with reference to GAM94.1. Interleukin 1, alpha (IL1A, Accession NP_000566.3) is another GAM3229 target gene, herein designated TARGET GENE. IL1A BINDING SITE is a target binding site found in the 5' untranslated region of mRNA encoded by IL1A, corresponding to a target binding site such as BINDING SITE I, BINDING SITE II or BINDING SITE III of FIG. 8. Table 4 illustrates the complementarity of the nucleotide sequences of IL1A BINDING SITE, designated SEQ ID:13186, to the nucleotide sequence of GAM3229 RNA, herein designated GAM RNA, also designated SEQ ID:221.

Another function of GAM3229 is therefore inhibition of Interleukin 1, alpha (IL1A, Accession NP_000566.3), a gene which stimulates thymocyte proliferation by inducing il-2 release, b-cell maturation & proliferation, & fibroblast growth factor activity. Accordingly, utilities of GAM3229 include diagnosis, prevention and treatment of diseases and clinical conditions associated with IL1A.

The function of IL1A and its association with various diseases and clinical conditions, has been established by previous studies, as described hereinabove with reference to GAM933.1. Interleukin 8 (IL8, Accession NP_000575.1) is another GAM3229 target gene, herein designated TARGET GENE. IL8 BINDING SITE is a target binding site found in the 3' untranslated region of mRNA encoded by IL8, corresponding to a target binding site such as BINDING SITE I, BINDING SITE II or BINDING SITE III of FIG. 8. Table 4 illustrates the complementarity of the nucleotide sequences of IL8 BINDING SITE, designated SEQ ID:16050, to the nucleotide sequence of GAM3229 RNA, herein designated GAM RNA, also designated SEQ ID:221.

Another function of GAM3229 is therefore inhibition of Interleukin 8 (IL8, Accession NP_000575.1). Accordingly, utilities of GAM3229 include diagnosis, prevention and treatment of diseases and clinical conditions associated with IL8.

Potassium voltage-gated channel, isk-related family, member 3 (KCNE3, Accession NP_005463.1) is another GAM3229 target gene, herein designated TARGET GENE. KCNE3 BINDING SITE is a target binding site found in the 5' untranslated region of mRNA encoded by KCNE3, corresponding to a target binding site such as BINDING SITE I, BINDING SITE II or BINDING SITE III of FIG. 8. Table 4 illustrates the complementarity of the nucleotide sequences of KCNE3 BINDING SITE, designated SEQ ID:19681, to the nucleotide sequence of GAM3229 RNA, herein designated GAM RNA, also designated SEQ ID:221.

Another function of GAM3229 is therefore inhibition of Potassium voltage-gated channel, isk-related family, member 3 (KCNE3, Accession NP_005463.1), a gene which ancillary protein that co-assemble with a potassium channel alpha-subunit to modulate the gating kinetics and enhance stability of the multimeric complex (by similarity). and therefore may be associated with Hypokalemic periodic paralysis. Accordingly, utilities of GAM3229 include diagnosis, prevention and treatment of Hypokalemic periodic paralysis, and of other diseases and clinical conditions associated with KCNE3.

The function of KCNE3 and its association with various diseases and clinical conditions, has been established by previous studies, as described hereinabove with reference to GAM234.1. Kinase insert domain receptor (a type iii receptor tyrosine kinase) (KDR, Accession NP_002244.1) is another GAM3229 target gene, herein designated TARGET GENE. KDR BINDING SITE is a target binding site found in the 3' untranslated region of mRNA encoded by KDR, corresponding to a target binding site such as BINDING SITE I, BINDING SITE II or BINDING SITE III of FIG. 8. Table 4 illustrates the complementarity of the nucleotide sequences of KDR BINDING SITE, designated SEQ ID:618, to the nucleotide sequence of GAM3229 RNA, herein designated GAM RNA, also designated SEQ ID:221.

Another function of GAM3229 is therefore inhibition of Kinase insert domain receptor (a type iii receptor tyrosine kinase) (KDR, Accession NP_002244.1). Accordingly, utilities of GAM3229 include diagnosis, prevention and treatment of diseases and clinical conditions associated with KDR.

KENAE (Accession NP_789786.1) is another GAM3229 target gene, herein designated TARGET GENE. KENAE BINDING SITE is a target binding site found in the 3' untranslated region of mRNA encoded by KENAE, corresponding to a target binding site such as BINDING SITE I, BINDING SITE II or BINDING SITE III of FIG. 8. Table 4 illustrates the complementarity of the nucleotide sequences of KENAE BINDING SITE, designated SEQ ID:3881, to the nucleotide sequence of GAM3229 RNA, herein designated GAM RNA, also designated SEQ ID:221.

Another function of GAM3229 is therefore inhibition of KENAE (Accession NP_789786.1). Accordingly, utilities of GAM3229 include diagnosis, prevention and treatment of diseases and clinical conditions associated with KENAE.

Kh-type splicing regulatory protein (fuse binding protein 2) (KHSRP, Accession NP_003676.1) is another GAM3229 target gene, herein designated TARGET GENE. KHSRP BINDING SITE is a target binding site found in the 3' untranslated region of mRNA encoded by KHSRP, corresponding to a target binding site such as BINDING SITE I, BINDING SITE II or BINDING SITE III of FIG. 8. Table 4 illustrates the complementarity of the nucleotide sequences of KHSRP BINDING SITE, designated SEQ ID:10161, to the nucleotide sequence of GAM3229 RNA, herein designated GAM RNA, also designated SEQ ID:221.

Another function of GAM3229 is therefore inhibition of Kh-type splicing regulatory protein (fuse binding protein 2) (KHSRP, Accession NP_003676.1). Accordingly, utilities of GAM3229 include diagnosis, prevention and treatment of diseases and clinical conditions associated with KHSRP.

KIAA0186 (Accession NP_066545.1) is another GAM3229 target gene, herein designated TARGET GENE. KIAA0186 BINDING SITE is a target binding site found in the 3' untranslated region of mRNA encoded by KIAA0186, corresponding to a target binding site such as BINDING SITE I, BINDING SITE II or BINDING SITE III of FIG. 8. Table 4 illustrates the complementarity of the nucleotide sequences of KIAA0186 BINDING SITE, designated SEQ ID:8187, to the nucleotide sequence of GAM3229 RNA, herein designated GAM RNA, also designated SEQ ID:221.

Another function of GAM3229 is therefore inhibition of KIAA0186 (Accession NP_066545.1). Accordingly, utilities of GAM3229 include diagnosis, prevention and treatment of diseases and clinical conditions associated with KIAA0186.

KIAA0193 (Accession NP_055581.2) is another GAM3229 target gene, herein designated TARGET GENE. KIAA0193 BINDING SITE is a target binding site found in the 3' untranslated region of mRNA encoded by KIAA0193, corresponding to a target binding site such as BINDING SITE I, BINDING SITE II or BINDING SITE III of FIG. 8. Table 4 illustrates the complementarity of the nucleotide sequences of KIAA0193 BINDING SITE, designated SEQ ID:9437, to the nucleotide sequence of GAM3229 RNA, herein designated GAM RNA, also designated SEQ ID:221.

Another function of GAM3229 is therefore inhibition of KIAA0193 (Accession NP_055581.2). Accordingly, utilities of GAM3229 include diagnosis, prevention and treatment of diseases and clinical conditions associated with KIAA0193.

KIAA0205 (Accession NP_055688.1) is another GAM3229 target gene, herein designated TARGET GENE. KIAA0205 BINDING SITE is a target binding site found in the 3' untranslated region of mRNA encoded by KIAA0205, corresponding to a target binding site such as BINDING SITE I, BINDING SITE II or BINDING SITE III of FIG. 8. Table 4 illustrates the complementarity of the nucleotide sequences of KIAA0205 BINDING SITE, designated SEQ ID:5448, to the nucleotide sequence of GAM3229 RNA, herein designated GAM RNA, also designated SEQ ID:221.

Another function of GAM3229 is therefore inhibition of KIAA0205 (Accession NP_055688.1). Accordingly, utilities of GAM3229 include diagnosis, prevention and treatment of diseases and clinical conditions associated with KIAA0205.

KIAA0280 (Accession XP_166238.1) is another GAM3229 target gene, herein designated TARGET GENE. KIAA0280 BINDING SITE is a target binding site found in the 3' untranslated region of mRNA encoded by KIAA0280, corresponding to a target binding site such as BINDING SITE I, BINDING SITE II or BINDING SITE III of FIG. 8. Table 4 illustrates the complementarity of the nucleotide sequences of KIAA0280 BINDING SITE, designated SEQ ID:18647, to the nucleotide sequence of GAM3229 RNA, herein designated GAM RNA, also designated SEQ ID:221.

Another function of GAM3229 is therefore inhibition of KIAA0280 (Accession XP_166238.1). Accordingly, utilities of GAM3229 include diagnosis, prevention and treatment of diseases and clinical conditions associated with KIAA0280.

KIAA0391 (Accession NP_055487.1) is another GAM3229 target gene, herein designated TARGET GENE. KIAA0391 BINDING SITE is a target binding site found in the 3' untranslated region of mRNA encoded by KIAA0391, corresponding to a target binding site such as BINDING SITE I, BINDING SITE II or BINDING SITE III of FIG. 8. Table 4 illustrates the complementarity of the nucleotide sequences of KIAA0391 BINDING SITE, designated SEQ ID:9624, to the nucleotide sequence of GAM3229 RNA, herein designated GAM RNA, also designated SEQ ID:221.

Another function of GAM3229 is therefore inhibition of KIAA0391 (Accession NP_055487.1). Accordingly, utilities of GAM3229 include diagnosis, prevention and treatment of diseases and clinical conditions associated with KIAA0391.

KIAA0446 (Accession XP_044155.1) is another GAM3229 target gene, herein designated TARGET GENE. KIAA0446 BINDING SITE is a target binding site found in the 5' untranslated region of mRNA encoded by KIAA0446, corresponding to a target binding site such as BINDING SITE I, BINDING SITE II or BINDING SITE III of FIG. 8. Table 4 illustrates the complementarity of the nucleotide sequences of KIAA0446 BINDING SITE, designated SEQ ID:12906, to the nucleotide sequence of GAM3229 RNA, herein designated GAM RNA, also designated SEQ ID:221.

Another function of GAM3229 is therefore inhibition of KIAA0446 (Accession XP_044155.1). Accordingly, utilities of GAM3229 include diagnosis, prevention and treatment of diseases and clinical conditions associated with KIAA0446.

KIAA0469 (Accession NP_055666.1) is another GAM3229 target gene, herein designated TARGET GENE. KIAA0469 BINDING SITE is a target binding site found in the 3' untranslated region of mRNA encoded by KIAA0469, corresponding to a target binding site such as BINDING SITE I, BINDING SITE II or BINDING SITE III of FIG. 8. Table 4 illustrates the complementarity of the nucleotide sequences of KIAA0469 BINDING SITE, designated SEQ ID:5867, to the nucleotide sequence of GAM3229 RNA, herein designated GAM RNA, also designated SEQ ID:221.

Another function of GAM3229 is therefore inhibition of KIAA0469 (Accession NP_055666.1). Accordingly, utilities of GAM3229 include diagnosis, prevention and treatment of diseases and clinical conditions associated with KIAA0469.

KIAA0478 (Accession NP_055685.1) is another GAM3229 target gene, herein designated TARGET GENE. KIAA0478 BINDING SITE is a target binding site found in the 3' untranslated region of mRNA encoded by KIAA0478, corresponding to a target binding site such as BINDING SITE I, BINDING SITE II or BINDING SITE III of FIG. 8. Table 4 illustrates the complementarity of the nucleotide sequences of KIAA0478 BINDING SITE, designated SEQ ID:6356, to the nucleotide sequence of GAM3229 RNA, herein designated GAM RNA, also designated SEQ ID:221.

Another function of GAM3229 is therefore inhibition of KIAA0478 (Accession NP_055685.1). Accordingly, utilities of GAM3229 include diagnosis, prevention and treatment of diseases and clinical conditions associated with KIAA0478.

KIAA0493 (Accession XP_034717.1) is another GAM3229 target gene, herein designated TARGET GENE. KIAA0493 BINDING SITE is a target binding site found in the 5' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:13205, to the nucleotide sequence of GAM3229 RNA, herein designated GAM RNA, also designated SEQ ID:221.

Another function of GAM3229 is therefore inhibition of KIAA0493 (Accession XP_034717.1). Accordingly, utilities of GAM3229 include diagnosis, prevention and treatment of diseases and clinical conditions associated with KIAA0493.

KIAA0513 (Accession NP_055547.1) is another GAM3229 target gene, herein designated TARGET GENE. KIAA0513 BINDING SITE is a target binding site found in the 3' untranslated region of mRNA encoded by KIAA0513, corresponding to a target binding site such as BINDING SITE I, BINDING SITE II or BINDING SITE III of FIG. 8. Table 4 illustrates the complementarity of the nucleotide sequences of KIAA0513 BINDING SITE, designated SEQ ID:10075, to the nucleotide sequence of GAM3229 RNA, herein designated GAM RNA, also designated SEQ ID:221.

Another function of GAM3229 is therefore inhibition of KIAA0513 (Accession NP_055547.1). Accordingly, utilities of GAM3229 include diagnosis, prevention and treatment of diseases and clinical conditions associated with KIAA0513.

KIAA0527 (Accession XP_171054.1) is another GAM3229 target gene, herein designated TARGET GENE. KIAA0527 BINDING SITE is a target binding site found in the 3' untranslated region of mRNA encoded by KIAA0527, corresponding to a target binding site such as BINDING SITE I, BINDING SITE II or BINDING SITE III of FIG. 8. Table 4 illustrates the complementarity of the nucleotide sequences of KIAA0527 BINDING SITE, designated SEQ ID:9370, to the nucleotide sequence of GAM3229 RNA, herein designated GAM RNA, also designated SEQ ID:221.

Another function of GAM3229 is therefore inhibition of KIAA0527 (Accession XP_171054.1). Accordingly, utilities of GAM3229 include diagnosis, prevention and treatment of diseases and clinical conditions associated with KIAA0527.

KIAA0532 (Accession XP_047659.6) is another GAM3229 target gene, herein designated TARGET GENE. KIAA0532 BINDING SITE is a target binding site found in the 3' untranslated region of mRNA encoded by KIAA0532, corresponding to a target binding site such as BINDING SITE I, BINDING SITE II or BINDING SITE III of FIG. 8. Table 4 illustrates the complementarity of the nucleotide sequences of KIAA0532 BINDING SITE, designated SEQ ID:3516, to the nucleotide sequence of GAM3229 RNA, herein designated GAM RNA, also designated SEQ ID:221.

Another function of GAM3229 is therefore inhibition of KIAA0532 (Accession XP_047659.6). Accordingly, utilities of GAM3229 include diagnosis, prevention and treatment of diseases and clinical conditions associated with KIAA0532.

KIAA0562 (Accession NP_055519.1) is another GAM3229 target gene, herein designated TARGET GENE. KIAA0562 BINDING SITE is a target binding site found in the 3' untranslated region of mRNA encoded by KIAA0562, corresponding to a target binding site such as BINDING SITE I, BINDING SITE II or BINDING SITE III of FIG. 8. Table 4 illustrates the complementarity of the nucleotide sequences of KIAA0562 BINDING SITE, designated SEQ ID:3797, to the nucleotide sequence of GAM3229 RNA, herein designated GAM RNA, also designated SEQ ID:221.

Another function of GAM3229 is therefore inhibition of KIAA0562 (Accession NP_055519.1). Accordingly, utilities of GAM3229 include diagnosis, prevention and treatment of diseases and clinical conditions associated with KIAA0562.

KIAA0605 (Accession NP_055509.1) is another GAM3229 target gene, herein designated TARGET GENE. KIAA0605 BINDING SITE is a target binding site found in the 5' untranslated region of mRNA encoded by KIAA0605, corresponding to a target binding site such as BINDING SITE I, BINDING SITE II or BINDING SITE III of FIG. 8. Table 4 illustrates the complementarity of the nucleotide sequences of KIAA0605 BINDING SITE, designated SEQ ID:1515, to the nucleotide sequence of GAM3229 RNA, herein designated GAM RNA, also designated SEQ ID:221.

Another function of GAM3229 is therefore inhibition of KIAA0605 (Accession NP_055509.1). Accordingly, utilities of GAM3229 include diagnosis, prevention and treatment of diseases and clinical conditions associated with KIAA0605.

KIAA0828 (Accession NP_056143.1) is another GAM3229 target gene, herein designated TARGET GENE. KIAA0828 BINDING SITE is a target binding site found in the 3' untranslated region of mRNA encoded by KIAA0828, corresponding to a target binding site such as BINDING SITE I, BINDING SITE II or BINDING SITE III of FIG. 8. Table 4 illustrates the complementarity of the nucleotide sequences of KIAA0828 BINDING SITE, designated SEQ ID:15963, to the nucleotide sequence of GAM3229 RNA, herein designated GAM RNA, also designated SEQ ID:221.

Another function of GAM3229 is therefore inhibition of KIAA0828 (Accession NP_056143.1). Accordingly, utilities of GAM3229 include diagnosis, prevention and treatment of diseases and clinical conditions associated with KIAA0828.

KIAA0841 (Accession XP_049237.1) is another GAM3229 target gene, herein designated TARGET GENE. KIAA0841 BINDING SITE is a target binding site found in the 3' untranslated region of mRNA encoded by KIAA0841, corresponding to a target binding site such as BINDING SITE I, BINDING SITE II or BINDING SITE III of FIG. 8. Table 4 illustrates the complementarity of the nucleotide sequences of KIAA0841 BINDING SITE, designated SEQ ID:4565, to the nucleotide sequence of GAM3229 RNA, herein designated GAM RNA, also designated SEQ ID:221.

Another function of GAM3229 is therefore inhibition of KIAA0841 (Accession XP_049237.1). Accordingly, utilities of GAM3229 include diagnosis, prevention and treatment of diseases and clinical conditions associated with KIAA0841.

KIAA0924 (Accession NP_055712.1) is another GAM3229 target gene, herein designated TARGET GENE. KIAA0924 BINDING SITE is a target binding site found in the 3' untranslated region of mRNA encoded by KIAA0924, corresponding to a target binding site such as BINDING SITE I, BINDING SITE II or BINDING SITE III of FIG. 8. Table 4 illustrates the complementarity of the nucleotide sequences of KIAA0924 BINDING SITE, designated SEQ ID:7195, to the nucleotide sequence of GAM3229 RNA, herein designated GAM RNA, also designated SEQ ID:221.

Another function of GAM3229 is therefore inhibition of KIAA0924 (Accession NP_055712.1). Accordingly, utilities of GAM3229 include diagnosis, prevention and treatment of diseases and clinical conditions associated with KIAA0924.

KIAA0935 (Accession XP_052620.6) is another GAM3229 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:12234, to the nucleotide sequence of GAM3229 RNA, herein designated GAM RNA, also designated SEQ ID:221.

Another function of GAM3229 is therefore inhibition of KIAA0935 (Accession XP_052620.6). Accordingly, utilities of GAM3229 include diagnosis, prevention and treatment of diseases and clinical conditions associated with KIAA0935.

KIAA0982 (Accession NP_054742.1) is another GAM3229 target gene, herein designated TARGET GENE. KIAA0982 BINDING SITE is a target binding site found in the 3' untranslated region of mRNA encoded by KIAA0982, corresponding to a target binding site such as BINDING SITE I, BINDING SITE II or BINDING SITE III of FIG. 8. Table 4 illustrates the complementarity of the nucleotide sequences of KIAA0982 BINDING SITE, designated SEQ ID:19897, to the nucleotide sequence of GAM3229 RNA, herein designated GAM RNA, also designated SEQ ID:221.

Another function of GAM3229 is therefore inhibition of KIAA0982 (Accession NP_054742.1). Accordingly, utilities of GAM3229 include diagnosis, prevention and treatment of diseases and clinical conditions associated with KIAA0982.

KIAA1010 (Accession XP_050742.5) is another GAM3229 target gene, herein designated TARGET GENE. KIAA1010 BINDING SITE is a target binding site found in the 3' untranslated region of mRNA encoded by KIAA1010, corresponding to a target binding site such as BINDING SITE I, BINDING SITE II or BINDING SITE III of FIG. 8. Table 4 illustrates the complementarity of the nucleotide sequences of KIAA1010 BINDING SITE, designated SEQ ID:845, to the nucleotide sequence of GAM3229 RNA, herein designated GAM RNA, also designated SEQ ID:221.

Another function of GAM3229 is therefore inhibition of KIAA1010 (Accession XP_050742.5). Accordingly, utilities of GAM3229 include diagnosis, prevention and treatment of diseases and clinical conditions associated with KIAA1010.

KIAA1040 (Accession XP_051091.3) is another GAM3229 target gene, herein designated TARGET GENE. KIAA1040 BINDING SITE is a target binding site found in the 3' untranslated region of mRNA encoded by KIAA1040, corresponding to a target binding site such as BINDING SITE I, BINDING SITE II or BINDING SITE III of FIG. 8. Table 4 illustrates the complementarity of the nucleotide sequences of KIAA1040 BINDING SITE, designated SEQ ID:11317, to the nucleotide sequence of GAM3229 RNA, herein designated GAM RNA, also designated SEQ ID:221.

Another function of GAM3229 is therefore inhibition of KIAA1040 (Accession XP_051091.3). Accordingly, utilities of GAM3229 include diagnosis, prevention and treatment of diseases and clinical conditions associated with KIAA1040.

KIAA1041 (Accession NP_055762.1) is another GAM3229 target gene, herein designated TARGET GENE. KIAA1041 BINDING SITE is a target binding site found in the 3' untranslated region of mRNA encoded by KIAA1041, corresponding to a target binding site such as BINDING SITE I, BINDING SITE II or BINDING SITE III of FIG. 8. Table 4 illustrates the complementarity of the nucleotide sequences of KIAA1041 BINDING SITE, designated SEQ ID:10075, to the nucleotide sequence of GAM3229 RNA, herein designated GAM RNA, also designated SEQ ID:221.

Another function of GAM3229 is therefore inhibition of KIAA1041 (Accession NP_055762.1). Accordingly, utilities of GAM3229 include diagnosis, prevention and treatment of diseases and clinical conditions associated with KIAA1041.

KIAA1054 (Accession XP_043493.5) is another GAM3229 target gene, herein designated TARGET GENE. KIAA1054 BINDING SITE1 and KIAA1054 BINDING SITE2 are target binding sites found in untranslated regions of mRNA encoded by KIAA1054, corresponding to target binding sites such as BINDING SITE I, BINDING SITE II or BINDING SITE III of FIG. 8. Table 4 illustrates the complementarity of the nucleotide sequences of KIAA1054 BINDING SITE1 and KIAA1054 BINDING SITE2, designated SEQ ID:4043 and SEQ ID:15902 respectively, to the nucleotide sequence of GAM3229 RNA, herein designated GAM RNA, also designated SEQ ID:221.

Another function of GAM3229 is therefore inhibition of KIAA1054 (Accession XP_043493.5). Accordingly, utilities of GAM3229 include diagnosis, prevention and treatment of diseases and clinical conditions associated with KIAA1054.

KIAA1145 (Accession NP_065749.1) is another GAM3229 target gene, herein designated TARGET GENE. KIAA1145 BINDING SITE is a target binding site found in the 3' untranslated region of mRNA encoded by KIAA1145, corresponding to a target binding site such as BINDING SITE I, BINDING SITE II or BINDING SITE III of FIG. 8. Table 4 illustrates the complementarity of the nucleotide sequences of KIAA1145 BINDING SITE, designated SEQ ID:10272, to the nucleotide sequence of GAM3229 RNA, herein designated GAM RNA, also designated SEQ ID:221.

Another function of GAM3229 is therefore inhibition of KIAA1145 (Accession NP_065749.1). Accordingly, utilities of GAM3229 include diagnosis, prevention and treatment of diseases and clinical conditions associated with KIAA1145.

KIAA1155 (Accession XP_030864.2) is another GAM3229 target gene, herein designated TARGET GENE. KIAA1155 BINDING SITE1 and KIAA1155 BINDING SITE2 are target binding sites found in untranslated regions of mRNA encoded by KIAA1155, corresponding to target binding sites such as BINDING SITE I, BINDING SITE II or BINDING SITE III of FIG. 8. Table 4 illustrates the complementarity of the nucleotide sequences of KIAA1155 BINDING SITE1 and KIAA1155 BINDING SITE2, designated SEQ ID:9308 and SEQ ID:4896 respectively, to the nucleotide sequence of GAM3229 RNA, herein designated GAM RNA, also designated SEQ ID:221.

Another function of GAM3229 is therefore inhibition of KIAA1155 (Accession XP_030864.2). Accordingly, utilities of GAM3229 include diagnosis, prevention and treatment of diseases and clinical conditions associated with KIAA1155.

KIAA1198 (Accession NP_065765.1) is another GAM3229 target gene, herein designated TARGET GENE. KIAA1198 BINDING SITE1 through KIAA1198 BINDING SITE4 are target binding sites found in untranslated regions of mRNA encoded by KIAA1198, corresponding to target binding sites such as BINDING SITE I, BINDING SITE II or BINDING SITE III of FIG. 8. Table 4 illustrates the complementarity of the nucleotide sequences of KIAA1198 BINDING SITE1 through KIAA1198 BINDING SITE4, designated SEQ ID:4779, SEQ ID:7372, SEQ ID:1315 and SEQ ID:12313 respectively, to the nucleotide sequence of GAM3229 RNA, herein designated GAM RNA, also designated SEQ ID:221.

Another function of GAM3229 is therefore inhibition of KIAA1198 (Accession NP_065765.1). Accordingly, utilities of GAM3229 include diagnosis, prevention and treatment of diseases and clinical conditions associated with KIAA1198.

KIAA1200 (Accession XP_031054.4) is another GAM3229 target gene, herein designated TARGET GENE. KIAA1200 BINDING SITE is a target binding site found in the 3' untranslated region of mRNA encoded by KIAA1200, corresponding to a target binding site such as BINDING SITE I, BINDING SITE II or BINDING SITE III of FIG. 8. Table 4 illustrates the complementarity of the nucleotide sequences of KIAA1200 BINDING SITE, designated SEQ ID:13574, to the nucleotide sequence of GAM3229 RNA, herein designated GAM RNA, also designated SEQ ID:221.

Another function of GAM3229 is therefore inhibition of KIAA1200 (Accession XP_031054.4). Accordingly, utilities of GAM3229 include diagnosis, prevention and treatment of diseases and clinical conditions associated with KIAA1200.

KIAA1257 (Accession XP_031577.2) is another GAM3229 target gene, herein designated TARGET GENE. KIAA1257 BINDING SITE is a target binding site found in the 3' untranslated region of mRNA encoded by KIAA1257, corresponding to a target binding site such as BINDING SITE I, BINDING SITE II or BINDING SITE III of FIG. 8. Table 4 illustrates the complementarity of the nucleotide sequences of KIAA1257 BINDING SITE, designated SEQ ID:9371, to the nucleotide sequence of GAM3229 RNA, herein designated GAM RNA, also designated SEQ ID:221.

Another function of GAM3229 is therefore inhibition of KIAA1257 (Accession XP_031577.2). Accordingly, utilities of GAM3229 include diagnosis, prevention and treatment of diseases and clinical conditions associated with KIAA1257.

KIAA1318 (Accession NP_065820.1) is another GAM3229 target gene, herein designated TARGET GENE. KIAA1318 BINDING SITE is a target binding site found in the 3' untranslated region of mRNA encoded by KIAA1318, corresponding to a target binding site such as BINDING SITE I, BINDING SITE II or BINDING SITE III of FIG. 8. Table 4 illustrates the complementarity of the nucleotide sequences of KIAA1318 BINDING SITE, designated SEQ ID:1457, to the nucleotide sequence of GAM3229 RNA, herein designated GAM RNA, also designated SEQ ID:221.

Another function of GAM3229 is therefore inhibition of KIAA1318 (Accession NP_065820.1). Accordingly, utilities of GAM3229 include diagnosis, prevention and treatment of diseases and clinical conditions associated with KIAA1318.

KIAA1396 (Accession XP_032054.2) is another GAM3229 target gene, herein designated TARGET GENE. KIAA1396 BINDING SITE is a target binding site found in the 3' untranslated region of mRNA encoded by KIAA1396, corresponding to a target binding site such as BINDING SITE I, BINDING SITE II or BINDING SITE III of FIG. 8. Table 4 illustrates the complementarity of the nucleotide sequences of KIAA1396 BINDING SITE, designated SEQ ID:14141, to the nucleotide sequence of GAM3229 RNA, herein designated GAM RNA, also designated SEQ ID:221.

Another function of GAM3229 is therefore inhibition of KIAA1396 (Accession XP_032054.2). Accordingly, utilities of GAM3229 include diagnosis, prevention and treatment of diseases and clinical conditions associated with KIAA1396.

KIAA1493 (Accession XP_034415.1) is another GAM3229 target gene, herein designated TARGET GENE. KIAA1493 BINDING SITE is a target binding site found in the 3' untranslated region of mRNA encoded by KIAA1493, corresponding to a target binding site such as BINDING SITE I, BINDING SITE II or BINDING SITE III of FIG. 8. Table 4 illustrates the complementarity of the nucleotide sequences of KIAA1493 BINDING SITE, designated SEQ ID:4891, to the nucleotide sequence of GAM3229 RNA, herein designated GAM RNA, also designated SEQ ID:221.

Another function of GAM3229 is therefore inhibition of KIAA1493 (Accession XP_034415.1). Accordingly, utilities of GAM3229 include diagnosis, prevention and treatment of diseases and clinical conditions associated with KIAA1493.

KIAA1571 (Accession XP_027744.1) is another GAM3229 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:13416, to the nucleotide sequence of GAM3229 RNA, herein designated GAM RNA, also designated SEQ ID:221.

Another function of GAM3229 is therefore inhibition of KIAA1571 (Accession XP_027744.1). Accordingly, utilities of GAM3229 include diagnosis, prevention and treatment of diseases and clinical conditions associated with KIAA1571.

KIAA1671 (Accession XP_037809.1) is another GAM3229 target gene, herein designated TARGET GENE. KIAA1671 BINDING SITE1 through KIAA1671 BINDING SITE3 are target binding sites found in untranslated regions of mRNA encoded by KIAA1671, corresponding to target binding sites such as BINDING SITE I, BINDING SITE II or BINDING SITE III of FIG. 8. Table 4 illustrates the complementarity of the nucleotide sequences of KIAA1671 BINDING SITE1 through KIAA1671 BINDING SITE3, designated SEQ ID:19751, SEQ ID:17241 and SEQ ID:5639 respectively, to the nucleotide sequence of GAM3229 RNA, herein designated GAM RNA, also designated SEQ ID:221.

Another function of GAM3229 is therefore inhibition of KIAA1671 (Accession XP_037809.1). Accordingly, utilities of GAM3229 include diagnosis, prevention and treatment of diseases and clinical conditions associated with KIAA1671.

KIAA1727 (Accession XP_034262.4) is another GAM3229 target gene, herein designated TARGET GENE. KIAA1727 BINDING SITE1 and KIAA1727 BINDING SITE2 are target binding sites found in untranslated regions of mRNA encoded by KIAA1727, corresponding to target binding sites such as BINDING SITE I, BINDING SITE II or BINDING SITE III of FIG. 8. Table 4 illustrates the complementarity of the nucleotide sequences of KIAA1727 BINDING SITE1 and KIAA1727 BINDING SITE2, designated SEQ ID:8253 and SEQ ID:7550 respectively, to the nucleotide sequence of GAM3229 RNA, herein designated GAM RNA, also designated SEQ ID:221.

Another function of GAM3229 is therefore inhibition of KIAA1727 (Accession XP_034262.4). Accordingly, utilities of GAM3229 include diagnosis, prevention and treatment of diseases and clinical conditions associated with KIAA1727.

KIAA1765 (Accession XP_047355.1) is another GAM3229 target gene, herein designated TARGET GENE. KIAA1765 BINDING SITE is a target binding site found in the 3' untranslated region of mRNA encoded by KIAA1765, corresponding to a target binding site such as BINDING SITE I, BINDING SITE II or BINDING SITE III of FIG. 8. Table 4 illustrates the complementarity of the nucleotide sequences of KIAA1765 BINDING SITE, designated SEQ ID:2344, to the nucleotide sequence of GAM3229 RNA, herein designated GAM RNA, also designated SEQ ID:221.

Another function of GAM3229 is therefore inhibition of KIAA1765 (Accession XP_047355.1). Accordingly, utilities of GAM3229 include diagnosis, prevention and treatment of diseases and clinical conditions associated with KIAA1765.

KIAA1784 (Accession NP_115820.1) is another GAM3229 target gene, herein designated TARGET GENE. KIAA1784 BINDING SITE is a target binding site found in the 3' untranslated region of mRNA encoded by KIAA1784, corresponding to a target binding site such as BINDING SITE I, BINDING SITE II or BINDING SITE III of FIG. 8. Table 4 illustrates the complementarity of the nucleotide sequences of KIAA1784 BINDING SITE, designated SEQ ID:10075, to the nucleotide sequence of GAM3229 RNA, herein designated GAM RNA, also designated SEQ ID:221.

Another function of GAM3229 is therefore inhibition of KIAA1784 (Accession NP_115820.1). Accordingly, utilities of GAM3229 include diagnosis, prevention and treatment of diseases and clinical conditions associated with KIAA1784.

KIAA1827 (Accession XP_290834.1) is another GAM3229 target gene, herein designated TARGET GENE. KIAA1827 BINDING SITE is a target binding site found in the 3' untranslated region of mRNA encoded by KIAA1827, corresponding to a target binding site such as BINDING SITE I, BINDING SITE II or BINDING SITE III of FIG. 8. Table 4 illustrates the complementarity of the nucleotide sequences of KIAA1827 BINDING SITE, designated SEQ ID:10075, to the nucleotide sequence of GAM3229 RNA, herein designated GAM RNA, also designated SEQ ID:221.

Another function of GAM3229 is therefore inhibition of KIAA1827 (Accession XP_290834.1). Accordingly, utilities of GAM3229 include diagnosis, prevention and treatment of diseases and clinical conditions associated with KIAA1827.

KIAA1829 (Accession XP_030378.2) is another GAM3229 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:15973, to the nucleotide sequence of GAM3229 RNA, herein designated GAM RNA, also designated SEQ ID:221.

Another function of GAM3229 is therefore inhibition of KIAA1829 (Accession XP_030378.2). Accordingly, utilities of GAM3229 include diagnosis, prevention and treatment of diseases and clinical conditions associated with KIAA1829.

KIAA1924 (Accession NP_694971.2) is another GAM3229 target gene, herein designated TARGET GENE. KIAA1924 BINDING SITE is a target binding site found in the 3' untranslated region of mRNA encoded by KIAA1924, corresponding to a target binding site such as BINDING SITE I, BINDING SITE II or BINDING SITE III of FIG. 8. Table 4 illustrates the complementarity of the nucleotide sequences of KIAA1924 BINDING SITE, designated SEQ ID:7589, to the nucleotide sequence of GAM3229 RNA, herein designated GAM RNA, also designated SEQ ID:221.

Another function of GAM3229 is therefore inhibition of KIAA1924 (Accession NP_694971.2). Accordingly, utilities of GAM3229 include diagnosis, prevention and treatment of diseases and clinical conditions associated with KIAA1924.

KIAA1971 (Accession XP_058720.4) is another GAM3229 target gene, herein designated TARGET GENE. KIAA1971 BINDING SITE is a target binding site found in the 3' untranslated region of mRNA encoded by KIAA1971, corresponding to a target binding site such as BINDING SITE I, BINDING SITE II or BINDING SITE III of FIG. 8. Table 4 illustrates the complementarity of the nucleotide sequences of KIAA1971 BINDING SITE, designated SEQ ID:7601, to the nucleotide sequence of GAM3229 RNA, herein designated GAM RNA, also designated SEQ ID:221.

Another function of GAM3229 is therefore inhibition of KIAA1971 (Accession XP_058720.4). Accordingly, utilities of GAM3229 include diagnosis, prevention and treatment of diseases and clinical conditions associated with KIAA1971.

KIAA1998 (Accession XP_068710.3) is another GAM3229 target gene, herein designated TARGET GENE. KIAA1998 BINDING SITE is a target binding site found in the 3' untranslated region of mRNA encoded by KIAA1998, corresponding to a target binding site such as BINDING SITE I, BINDING SITE II or BINDING SITE III of FIG. 8. Table 4 illustrates the complementarity of the nucleotide sequences of KIAA1998 BINDING SITE, designated SEQ ID:19071, to the nucleotide sequence of GAM3229 RNA, herein designated GAM RNA, also designated SEQ ID:221.

Another function of GAM3229 is therefore inhibition of KIAA1998 (Accession XP_068710.3). Accordingly, utilities of GAM3229 include diagnosis, prevention and treatment of diseases and clinical conditions associated with KIAA1998.

KIAA2025 (Accession XP_086409.4) is another GAM3229 target gene, herein designated TARGET GENE. KIAA2025 BINDING SITE is a target binding site found in the 3' untranslated region of mRNA encoded by KIAA2025, corresponding to a target binding site such as BINDING SITE I, BINDING SITE II or BINDING SITE III of FIG. 8. Table 4 illustrates the complementarity of the nucleotide sequences of KIAA2025 BINDING SITE, designated SEQ ID:7899, to the nucleotide sequence of GAM3229 RNA, herein designated GAM RNA, also designated SEQ ID:221.

Another function of GAM3229 is therefore inhibition of KIAA2025 (Accession XP_086409.4). Accordingly, utilities of GAM3229 include diagnosis, prevention and treatment of diseases and clinical conditions associated with KIAA2025.

KIAA2028 (Accession XP_059415.2) is another GAM3229 target gene, herein designated TARGET GENE. KIAA2028 BINDING SITE1 through KIAA2028 BINDING SITE3 are target binding sites found in untranslated regions of mRNA encoded by KIAA2028, corresponding to target binding sites such as BINDING SITE I, BINDING SITE II or BINDING SITE III of FIG. 8. Table 4 illustrates the complementarity of the nucleotide sequences of KIAA2028 BINDING SITE1 through KIAA2028 BINDING SITE3, designated SEQ ID:17589, SEQ ID:18073 and SEQ ID:19988 respectively, to the nucleotide sequence of GAM3229 RNA, herein designated GAM RNA, also designated SEQ ID:221.

Another function of GAM3229 is therefore inhibition of KIAA2028 (Accession XP_059415.2). Accordingly, utilities of GAM3229 include diagnosis, prevention and treatment of diseases and clinical conditions associated with KIAA2028.

Kynurenine 3-monooxygenase (kynurenine 3-hydroxylase) (KMO, Accession NP_003670.1) is another GAM3229 target gene, herein designated TARGET GENE. KMO BINDING SITE1 and KMO BINDING SITE2 are target binding sites found in untranslated regions of mRNA encoded by KMO, corresponding to target binding sites such as BINDING SITE I, BINDING SITE II or BINDING SITE III of FIG. 8. Table 4 illustrates the complementarity of the nucleotide sequences of KMO BINDING SITE1 and KMO BINDING SITE2, designated SEQ ID:9048 and SEQ ID:15859 respectively, to the nucleotide sequence of GAM3229 RNA, herein designated GAM RNA, also designated SEQ ID:221.

Another function of GAM3229 is therefore inhibition of Kynurenine 3-monooxygenase (kynurenine 3-hydroxylase) (KMO, Accession NP_003670.1), a gene which may play a role in encephalic photoreception. Accordingly, utilities of GAM3229 include diagnosis, prevention and treatment of diseases and clinical conditions associated with KMO.

The function of KMO and its association with various diseases and clinical conditions, has been established by previous studies, as described hereinabove with reference to GAM30.1. Keratin, hair, basic, 2 (KRTHB2, Accession NP_149022.3) is another GAM3229 target gene, herein designated TARGET GENE. KRTHB2 BINDING SITE is a target binding site found in the 3' untranslated region of mRNA encoded by KRTHB2, corresponding to a target binding site such as BINDING SITE I, BINDING SITE II or BINDING SITE III of FIG. 8. Table 4 illustrates the complementarity of the nucleotide sequences of KRTHB2 BINDING SITE, designated SEQ ID:12235, to the nucleotide sequence of GAM3229 RNA, herein designated GAM RNA, also designated SEQ ID:221.

Another function of GAM3229 is therefore inhibition of Keratin, hair, basic, 2 (KRTHB2, Accession NP_149022.3). Accordingly, utilities of GAM3229 include diagnosis, prevention and treatment of diseases and clinical conditions associated with KRTHB2.

Kinase suppressor of ras (KSR, Accession XP_290793.1) is another GAM3229 target gene, herein designated TARGET GENE. KSR BINDING SITE is a target binding site found in the 5' untranslated region of mRNA encoded by KSR, corresponding to a target binding site such as BINDING SITE I, BINDING SITE II or BINDING SITE III of FIG. 8. Table 4 illustrates the complementarity of the nucleotide sequences of KSR BINDING SITE, designated SEQ ID:10075, to the nucleotide sequence of GAM3229 RNA, herein designated GAM RNA, also designated SEQ ID:221.

Another function of GAM3229 is therefore inhibition of Kinase suppressor of ras (KSR, Accession XP_290793.1). Accordingly, utilities of GAM3229 include diagnosis, prevention and treatment of diseases and clinical conditions associated with KSR.

Lysosomal-associated membrane protein 3 (LAMP3, Accession NP_055213.1) is another GAM3229 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:3841, to the nucleotide sequence of GAM3229 RNA, herein designated GAM RNA, also designated SEQ ID:221.

Another function of GAM3229 is therefore inhibition of Lysosomal-associated membrane protein 3 (LAMP3, Accession NP_055213.1). Accordingly, utilities of GAM3229 include diagnosis, prevention and treatment of diseases and clinical conditions associated with LAMP3.

LAT1-3TM (Accession NP_112488.1) is another GAM3229 target gene, herein designated TARGET GENE. LAT1-3TM BINDING SITE is a target binding site found in the 3' untranslated region of mRNA encoded by LAT1-3TM, corresponding to a target binding site such as BINDING SITE I, BINDING SITE II or BINDING SITE III of FIG. 8. Table 4 illustrates the complementarity of the nucleotide sequences of LAT1-3TM BINDING SITE, designated SEQ ID:13820, to the nucleotide sequence of GAM3229 RNA, herein designated GAM RNA, also designated SEQ ID:221.

Another function of GAM3229 is therefore inhibition of LAT1-3TM (Accession NP_112488.1). Accordingly, utilities of GAM3229 include diagnosis, prevention and treatment of diseases and clinical conditions associated with LAT1-3TM.

Lipocalin 7 (LCN7, Accession NP_071447.1) is another GAM3229 target gene, herein designated TARGET GENE. LCN7 BINDING SITE is a target binding site found in the 3' untranslated region of mRNA encoded by LCN7, corresponding to a target binding site such as BINDING SITE I, BINDING SITE II or BINDING SITE III of FIG. 8. Table 4 illustrates the complementarity of the nucleotide sequences of LCN7 BINDING SITE, designated SEQ ID:7234, to the nucleotide sequence of GAM3229 RNA, herein designated GAM RNA, also designated SEQ ID:221.

Another function of GAM3229 is therefore inhibition of Lipocalin 7 (LCN7, Accession NP_071447.1). Accordingly, utilities of GAM3229 include diagnosis, prevention and treatment of diseases and clinical conditions associated with LCN7.

Lim homeobox protein 3 (LHX3, Accession NP_055379.1) is another GAM3229 target gene, herein designated TARGET GENE. LHX3 BINDING SITE is a target binding site found in the 3' untranslated region of multiple transcripts of mRNA encoded by LHX3, corresponding to a target binding site such as BINDING SITE I, BINDING SITE II or BINDING SITE III of FIG. 8. Table 4 illustrates the complementarity of the nucleotide sequences of LHX3 BINDING SITE, designated SEQ ID:20146, to the nucleotide sequence of GAM3229 RNA, herein designated GAM RNA, also designated SEQ ID:221.

Another function of GAM3229 is therefore inhibition of Lim homeobox protein 3 (LHX3, Accession NP_055379.1). Accordingly, utilities of GAM3229 include diagnosis, prevention and treatment of diseases and clinical conditions associated with LHX3.

Leukemia inhibitory factor (cholinergic differentiation factor) (LIF, Accession NP_002300.1) is another GAM3229 target gene, herein designated TARGET GENE. LIF BINDING SITE is a target binding site found in the 3' untranslated region of mRNA encoded by LIF, corresponding to a target binding site such as BINDING SITE I, BINDING SITE II or BINDING SITE III of FIG. 8. Table 4 illustrates the complementarity of the nucleotide sequences of LIF BINDING SITE, designated SEQ ID:4988, to the nucleotide sequence of GAM3229 RNA, herein designated GAM RNA, also designated SEQ ID:221.

Another function of GAM3229 is therefore inhibition of Leukemia inhibitory factor (cholinergic differentiation factor) (LIF, Accession NP_002300.1). Accordingly, utilities of GAM3229 include diagnosis, prevention and treatment of diseases and clinical conditions associated with LIF.

LNIR (Accession NP_112178.1) is another GAM3229 target gene, herein designated TARGET GENE. LNIR BINDING SITE is a target binding site found in the 3' untranslated region of mRNA encoded by LNIR, corresponding to a target binding site such as BINDING SITE I, BINDING SITE II or BINDING SITE III of FIG. 8. Table 4 illustrates the complementarity of the nucleotide sequences of LNIR BINDING SITE, designated SEQ ID:6798, to the nucleotide sequence of GAM3229 RNA, herein designated GAM RNA, also designated SEQ ID:221.

Another function of GAM3229 is therefore inhibition of LNIR (Accession NP_112178.1). Accordingly, utilities of GAM3229 include diagnosis, prevention and treatment of diseases and clinical conditions associated with LNIR.

LOC112687 (Accession XP_053145.1) is another GAM3229 target gene, herein designated TARGET GENE. LOC112687 BINDING SITE is a target binding site found in the 3' untranslated region of mRNA encoded by LOC112687, corresponding to a target binding site such as BINDING SITE I, BINDING SITE II or BINDING SITE III of FIG. 8. Table 4 illustrates the complementarity of the nucleotide sequences of LOC112687 BINDING SITE, designated SEQ ID:10726, to the nucleotide sequence of GAM3229 RNA, herein designated GAM RNA, also designated SEQ ID:221.

Another function of GAM3229 is therefore inhibition of LOC112687 (Accession XP_053145.1). Accordingly, utilities of GAM3229 include diagnosis, prevention and treatment of diseases and clinical conditions associated with LOC112687.

LOC115098 (Accession NP_612451.1) is another GAM3229 target gene, herein designated TARGET GENE. LOC115098 BINDING SITE is a target binding site found in the 5' untranslated region of mRNA encoded by LOC115098, corresponding to a target binding site such as BINDING SITE I, BINDING SITE II or BINDING SITE III of FIG. 8. Table 4 illustrates the complementarity of the nucleotide sequences of LOC115098 BINDING SITE, designated SEQ ID:15832, to the nucleotide sequence of GAM3229 RNA, herein designated GAM RNA, also designated SEQ ID:221.

Another function of GAM3229 is therefore inhibition of LOC115098 (Accession NP_612451.1). Accordingly, utilities of GAM3229 include diagnosis, prevention and treatment of diseases and clinical conditions associated with LOC115098.

LOC115219 (Accession XP_055499.2) is another GAM3229 target gene, herein designated TARGET GENE. LOC115219 BINDING SITE is a target binding site found in the 5' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:12851, to the nucleotide sequence of GAM3229 RNA, herein designated GAM RNA, also designated SEQ ID:221.

Another function of GAM3229 is therefore inhibition of LOC115219 (Accession XP_055499.2). Accordingly, utilities of GAM3229 include diagnosis, prevention and treatment of diseases and clinical conditions associated with LOC115219.

LOC117584 (Accession NP_476519.1) is another GAM3229 target gene, herein designated TARGET GENE. LOC117584 BINDING SITE is a target binding site found in the 3' untranslated region of mRNA encoded by LOC117584, corresponding to a target binding site such as BINDING SITE I, BINDING SITE II or BINDING SITE III of FIG. 8. Table 4 illustrates the complementarity of the nucleotide sequences of LOC117584 BINDING SITE, designated SEQ ID:3964, to the nucleotide sequence of GAM3229 RNA, herein designated GAM RNA, also designated SEQ ID:221.

Another function of GAM3229 is therefore inhibition of LOC117584 (Accession NP_476519.1). Accordingly, utilities of GAM3229 include diagnosis, prevention and treatment of diseases and clinical conditions associated with LOC117584.

LOC118812 (Accession XP_058346.2) is another GAM3229 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:16805, to the nucleotide sequence of GAM3229 RNA, herein designated GAM RNA, also designated SEQ ID:221.

Another function of GAM3229 is therefore inhibition of LOC118812 (Accession XP_058346.2). Accordingly, utilities of GAM3229 include diagnosis, prevention and treatment of diseases and clinical conditions associated with LOC118812.

LOC118812 (Accession NP_849154.1) is another GAM3229 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:16805, to the nucleotide sequence of GAM3229 RNA, herein designated GAM RNA, also designated SEQ ID:221.

Another function of GAM3229 is therefore inhibition of LOC118812 (Accession NP_849154.1). Accordingly, utilities of GAM3229 include diagnosis, prevention and treatment of diseases and clinical conditions associated with LOC118812.

LOC119392 (Accession NP_660290.1) is another GAM3229 target gene, herein designated TARGET GENE. LOC119392 BINDING SITE is a target binding site found in the 3' untranslated region of mRNA encoded by LOC119392, corresponding to a target binding site such as BINDING SITE I, BINDING SITE II or BINDING SITE III of FIG. 8. Table 4 illustrates the complementarity of the nucleotide sequences of LOC119392 BINDING SITE, designated SEQ ID:9142, to the nucleotide sequence of GAM3229 RNA, herein designated GAM RNA, also designated SEQ ID:221.

Another function of GAM3229 is therefore inhibition of LOC119392 (Accession NP_660290.1). Accordingly, utilities of GAM3229 include diagnosis, prevention and treatment of diseases and clinical conditions associated with LOC119392.

LOC120526 (Accession XP_058475.1) is another GAM3229 target gene, herein designated TARGET GENE. LOC120526 BINDING SITE1 and LOC120526 BINDING SITE2 are target binding sites found in untranslated regions of mRNA encoded by LOC120526, corresponding to target binding sites such as BINDING SITE I, BINDING SITE II or BINDING SITE III of FIG. 8. Table 4 illustrates the complementarity of the nucleotide sequences of LOC120526 BINDING SITE1 and LOC120526 BINDING SITE2, designated SEQ ID:10538 and SEQ ID:2073 respectively, to the nucleotide sequence of GAM3229 RNA, herein designated GAM RNA, also designated SEQ ID:221.

Another function of GAM3229 is therefore inhibition of LOC120526 (Accession XP_058475.1). Accordingly, utilities of GAM3229 include diagnosis, prevention and treatment of diseases and clinical conditions associated with LOC120526.

LOC121838 (Accession XP_071772.1) is another GAM3229 target gene, herein designated TARGET GENE. LOC121838 BINDING SITE1 and LOC121838 BINDING SITE2 are target binding sites found in untranslated regions of mRNA encoded by LOC121838, corresponding to target binding sites such as BINDING SITE I, BINDING SITE II or BINDING SITE III of FIG. 8. Table 4 illustrates the complementarity of the nucleotide sequences of LOC121838 BINDING SITE1 and LOC121838 BINDING SITE2, designated SEQ ID:14349 and SEQ ID:1458 respectively, to the nucleotide sequence of GAM3229 RNA, herein designated GAM RNA, also designated SEQ ID:221.

Another function of GAM3229 is therefore inhibition of LOC121838 (Accession XP_071772.1). Accordingly, utilities of GAM3229 include diagnosis, prevention and treatment of diseases and clinical conditions associated with LOC121838.

LOC125061 (Accession XP_058889.3) is another GAM3229 target gene, herein designated TARGET GENE. LOC125061 BINDING SITE is a target binding site found in the 3' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:10075, to the nucleotide sequence of GAM3229 RNA, herein designated GAM RNA, also designated SEQ ID:221.

Another function of GAM3229 is therefore inhibition of LOC125061 (Accession XP_058889.3). Accordingly, utilities of GAM3229 include diagnosis, prevention and treatment of diseases and clinical conditions associated with LOC125061.

LOC126669 (Accession XP_060121.4) is another GAM3229 target gene, herein designated TARGET GENE. LOC126669 BINDING SITE1 and LOC126669 BINDING SITE2 are target binding sites found in untranslated regions of mRNA encoded by LOC126669, corresponding to target binding sites such as BINDING SITE I, BINDING SITE II or BINDING SITE III of FIG. 8. Table 4 illustrates the complementarity of the nucleotide sequences of LOC126669 BINDING SITE1 and LOC126669 BINDING SITE2, designated SEQ ID:13284 and SEQ ID:11629 respectively, to the nucleotide sequence of GAM3229 RNA, herein designated GAM RNA, also designated SEQ ID:221.

Another function of GAM3229 is therefore inhibition of LOC126669 (Accession XP_060121.4). Accordingly, utilities of GAM3229 include diagnosis, prevention and treatment of diseases and clinical conditions associated with LOC126669.

LOC130639 (Accession XP_059464.2) is another GAM3229 target gene, herein designated TARGET GENE. LOC130639 BINDING SITE is a target binding site found in the 5' untranslated region of mRNA encoded by LOC130639, corresponding to a target binding site such as BINDING SITE I, BINDING SITE II or BINDING SITE III of FIG. 8. Table 4 illustrates the complementarity of the nucleotide sequences of LOC130639 BINDING SITE, designated SEQ ID:13129, to the nucleotide sequence of GAM3229 RNA, herein designated GAM RNA, also designated SEQ ID:221.

Another function of GAM3229 is therefore inhibition of LOC130639 (Accession XP_059464.2). Accordingly, utilities of GAM3229 include diagnosis, prevention and treatment of diseases and clinical conditions associated with LOC130639.

LOC130813 (Accession XP_065904.1) is another GAM3229 target gene, herein designated TARGET GENE. LOC130813 BINDING SITE is a target binding site found in the 3' untranslated region of mRNA encoded by LOC130813, corresponding to a target binding site such as BINDING SITE I, BINDING SITE II or BINDING SITE III of FIG. 8. Table 4 illustrates the complementarity of the nucleotide sequences of LOC130813 BINDING SITE, designated SEQ ID:12421, to the nucleotide sequence of GAM3229 RNA, herein designated GAM RNA, also designated SEQ ID:221.

Another function of GAM3229 is therefore inhibition of LOC130813 (Accession XP_065904.1). Accordingly, utilities of GAM3229 include diagnosis, prevention and treatment of diseases and clinical conditions associated with LOC130813.

LOC132241 (Accession XP_059583.1) is another GAM3229 target gene, herein designated TARGET GENE. LOC132241 BINDING SITE is a target binding site found in the 3' untranslated region of mRNA encoded by LOC132241, corresponding to a target binding site such as BINDING SITE I, BINDING SITE II or BINDING SITE III of FIG. 8. Table 4 illustrates the complementarity of the nucleotide sequences of LOC132241 BINDING SITE, designated SEQ ID:15759, to the nucleotide sequence of GAM3229 RNA, herein designated GAM RNA, also designated SEQ ID:221.

Another function of GAM3229 is therefore inhibition of LOC132241 (Accession XP_059583.1). Accordingly, utilities of GAM3229 include diagnosis, prevention and treatment of diseases and clinical conditions associated with LOC132241.

LOC135293 (Accession XP_072402.4) is another GAM3229 target gene, herein designated TARGET GENE. LOC135293 BINDING SITE is a target binding site found in the 3' untranslated region of mRNA encoded by LOC135293, corresponding to a target binding site such as BINDING SITE I, BINDING SITE II or BINDING SITE III of FIG. 8. Table 4 illustrates the complementarity of the nucleotide sequences of LOC135293 BINDING SITE, designated SEQ ID:12656, to the nucleotide sequence of GAM3229 RNA, herein designated GAM RNA, also designated SEQ ID:221.

Another function of GAM3229 is therefore inhibition of LOC135293 (Accession XP_072402.4). Accordingly, utilities of GAM3229 include diagnosis, prevention and treatment of diseases and clinical conditions associated with LOC135293.

LOC135818 (Accession XP_059804.4) is another GAM3229 target gene, herein designated TARGET GENE. LOC135818 BINDING SITE is a target binding site found in the 3' untranslated region of mRNA encoded by LOC135818, corresponding to a target binding site such as BINDING SITE I, BINDING SITE II or BINDING SITE III of FIG. 8. Table 4 illustrates the complementarity of the nucleotide sequences of LOC135818 BINDING SITE, designated SEQ ID:19721, to the nucleotide sequence of GAM3229 RNA, herein designated GAM RNA, also designated SEQ ID:221.

Another function of GAM3229 is therefore inhibition of LOC135818 (Accession XP_059804.4). Accordingly, utilities of GAM3229 include diagnosis, prevention and treatment of diseases and clinical conditions associated with LOC135818.

LOC136345 (Accession XP_072455.2) is another GAM3229 target gene, herein designated TARGET GENE. LOC136345 BINDING SITE is a target binding site found in the 3' untranslated region of mRNA encoded by LOC136345, corresponding to a target binding site such as BINDING SITE I, BINDING SITE II or BINDING SITE III of FIG. 8. Table 4 illustrates the complementarity of the nucleotide sequences of LOC136345 BINDING SITE, designated SEQ ID:6455, to the nucleotide sequence of GAM3229 RNA, herein designated GAM RNA, also designated SEQ ID:221.

Another function of GAM3229 is therefore inhibition of LOC136345 (Accession XP_072455.2). Accordingly, utilities of GAM3229 include diagnosis, prevention and treatment of diseases and clinical conditions associated with LOC136345.

LOC137886 (Accession XP_059929.3) is another GAM3229 target gene, herein designated TARGET GENE. LOC137886 BINDING SITE is a target binding site found in the 3' untranslated region of mRNA encoded by LOC137886, corresponding to a target binding site such as BINDING SITE I, BINDING SITE II or BINDING SITE III of FIG. 8. Table 4 illustrates the complementarity of the nucleotide sequences of LOC137886 BINDING SITE, designated SEQ ID:9666, to the nucleotide sequence of GAM3229 RNA, herein designated GAM RNA, also designated SEQ ID:221.

Another function of GAM3229 is therefore inhibition of LOC137886 (Accession XP_059929.3). Accordingly, utilities of GAM3229 include diagnosis, prevention and treatment of diseases and clinical conditions associated with LOC137886.

LOC139422 (Accession XP_066687.2) is another GAM3229 target gene, herein designated TARGET GENE. LOC139422 BINDING SITE is a target binding site found in the 5' untranslated region of mRNA encoded by LOC139422, corresponding to a target binding site such as BINDING SITE I, BINDING SITE II or BINDING SITE III of FIG. 8. Table 4 illustrates the complementarity of the nucleotide sequences of LOC139422 BINDING SITE, designated SEQ ID:16130, to the nucleotide sequence of GAM3229 RNA, herein designated GAM RNA, also designated SEQ ID:221.

Another function of GAM3229 is therefore inhibition of LOC139422 (Accession XP_066687.2). Accordingly, utilities of GAM3229 include diagnosis, prevention and treatment of diseases and clinical conditions associated with LOC139422.

LOC143677 (Accession XP_096471.1) is another GAM3229 target gene, herein designated TARGET GENE. LOC143677 BINDING SITE is a target binding site found in the 5' untranslated region of mRNA encoded by LOC143677, corresponding to a target binding site such as BINDING SITE I, BINDING SITE II or BINDING SITE III of FIG. 8. Table 4 illustrates the complementarity of the nucleotide sequences of LOC143677 BINDING SITE, designated SEQ ID:14289, to the nucleotide sequence of GAM3229 RNA, herein designated GAM RNA, also designated SEQ ID:221.

Another function of GAM3229 is therefore inhibition of LOC143677 (Accession XP_096471.1). Accordingly, utilities of GAM3229 include diagnosis, prevention and treatment of diseases and clinical conditions associated with LOC143677.

LOC144404 (Accession XP_084852.6) is another GAM3229 target gene, herein designated TARGET GENE. LOC144404 BINDING SITE is a target binding site found in the 3' untranslated region of mRNA encoded by LOC144404, corresponding to a target binding site such as BINDING SITE I, BINDING SITE II or BINDING SITE III of FIG. 8. Table 4 illustrates the complementarity of the nucleotide sequences of LOC144404 BINDING SITE, designated SEQ ID:19677, to the nucleotide sequence of GAM3229 RNA, herein designated GAM RNA, also designated SEQ ID:221.

Another function of GAM3229 is therefore inhibition of LOC144404 (Accession XP_084852.6). Accordingly, utilities of GAM3229 include diagnosis, prevention and treatment of diseases and clinical conditions associated with LOC144404.

LOC144481 (Accession XP_096611.2) is another GAM3229 target gene, herein designated TARGET GENE. LOC144481 BINDING SITE is a target binding site found in the 3' untranslated region of mRNA encoded by LOC144481, corresponding to a target binding site such as BINDING SITE I, BINDING SITE II or BINDING SITE III of FIG. 8. Table 4 illustrates the complementarity of the nucleotide sequences of LOC144481 BINDING SITE, designated SEQ ID:3550, to the nucleotide sequence of GAM3229 RNA, herein designated GAM RNA, also designated SEQ ID:221.

Another function of GAM3229 is therefore inhibition of LOC144481 (Accession XP_096611.2). Accordingly, utilities of GAM3229 include diagnosis, prevention and treatment of diseases and clinical conditions associated with LOC144481.

LOC144871 (Accession XP_096698.1) is another GAM3229 target gene, herein designated TARGET GENE. LOC144871 BINDING SITE is a target binding site found in the 3' untranslated region of mRNA encoded by LOC144871, corresponding to a target binding site such as BINDING SITE I, BINDING SITE II or BINDING SITE III of FIG. 8. Table 4 illustrates the complementarity of the nucleotide sequences of LOC144871 BINDING SITE, designated SEQ ID:15802, to the nucleotide sequence of GAM3229 RNA, herein designated GAM RNA, also designated SEQ ID:221.

Another function of GAM3229 is therefore inhibition of LOC144871 (Accession XP_096698.1). Accordingly, utilities of GAM3229 include diagnosis, prevention and treatment of diseases and clinical conditions associated with LOC144871.

LOC145188 (Accession XP_085049.1) is another GAM3229 target gene, herein designated TARGET GENE. LOC145188 BINDING SITE is a target binding site found in the 3' untranslated region of mRNA encoded by LOC145188, corresponding to a target binding site such as BINDING SITE I, BINDING SITE II or BINDING SITE III of FIG. 8. Table 4 illustrates the complementarity of the nucleotide sequences of LOC145188 BINDING SITE, designated SEQ ID:15484, to the nucleotide sequence of GAM3229 RNA, herein designated GAM RNA, also designated SEQ ID:221.

Another function of GAM3229 is therefore inhibition of LOC145188 (Accession XP_085049.1). Accordingly, utilities of GAM3229 include diagnosis, prevention and treatment of diseases and clinical conditions associated with LOC145188.

LOC145268 (Accession XP_085072.1) is another GAM3229 target gene, herein designated TARGET GENE. LOC145268 BINDING SITE is a target binding site found in the 5' untranslated region of mRNA encoded by LOC145268, corresponding to a target binding site such as BINDING SITE I, BINDING SITE II or BINDING SITE III of FIG. 8. Table 4 illustrates the complementarity of the nucleotide sequences of LOC145268 BINDING SITE, designated SEQ ID:10524, to the nucleotide sequence of GAM3229 RNA, herein designated GAM RNA, also designated SEQ ID:221.

Another function of GAM3229 is therefore inhibition of LOC145268 (Accession XP_085072.1). Accordingly, utilities of GAM3229 include diagnosis, prevention and treatment of diseases and clinical conditions associated with LOC145268.

LOC145387 (Accession XP_096791.1) is another GAM3229 target gene, herein designated TARGET GENE. LOC145387 BINDING SITE is a target binding site found in the 5' untranslated region of mRNA encoded by LOC145387, corresponding to a target binding site such as BINDING SITE I, BINDING SITE II or BINDING SITE III of FIG. 8. Table 4 illustrates the complementarity of the nucleotide sequences of LOC145387 BINDING SITE, designated SEQ ID:12820, to the nucleotide sequence of GAM3229 RNA, herein designated GAM RNA, also designated SEQ ID:221.

Another function of GAM3229 is therefore inhibition of LOC145387 (Accession XP_096791.1). Accordingly, utilities of GAM3229 include diagnosis, prevention and treatment of diseases and clinical conditions associated with LOC145387.

LOC145601 (Accession XP_096816.1) is another GAM3229 target gene, herein designated TARGET GENE. LOC145601 BINDING SITE is a target binding site found in the 3' untranslated region of mRNA encoded by LOC145601, corresponding to a target binding site such as BINDING SITE I, BINDING SITE II or BINDING SITE III of FIG. 8. Table 4 illustrates the complementarity of the nucleotide sequences of LOC145601 BINDING SITE, designated SEQ ID:10802, to the nucleotide sequence of GAM3229 RNA, herein designated GAM RNA, also designated SEQ ID:221.

Another function of GAM3229 is therefore inhibition of LOC145601 (Accession XP_096816.1). Accordingly, utilities of GAM3229 include diagnosis, prevention and treatment of diseases and clinical conditions associated with LOC145601.

LOC145988 (Accession XP_085290.3) is another GAM3229 target gene, herein designated TARGET GENE. LOC145988 BINDING SITE is a target binding site found in the 5' untranslated region of mRNA encoded by LOC145988, corresponding to a target binding site such as BINDING SITE I, BINDING SITE II or BINDING SITE III of FIG. 8. Table 4 illustrates the complementarity of the nucleotide sequences of LOC145988 BINDING SITE, designated SEQ ID:15535, to the nucleotide sequence of GAM3229 RNA, herein designated GAM RNA, also designated SEQ ID:221.

Another function of GAM3229 is therefore inhibition of LOC145988 (Accession XP_085290.3). Accordingly, utilities of GAM3229 include diagnosis, prevention and treatment of diseases and clinical conditions associated with LOC145988.

LOC146229 (Accession XP_085387.1) is another GAM3229 target gene, herein designated TARGET GENE. LOC146229 BINDING SITE is a target binding site found in the 3' untranslated region of mRNA encoded by LOC146229, corresponding to a target binding site such as BINDING SITE I, BINDING SITE II or BINDING SITE III of FIG. 8. Table 4 illustrates the complementarity of the nucleotide sequences of LOC146229 BINDING SITE, designated SEQ ID:15411, to the nucleotide sequence of GAM3229 RNA, herein designated GAM RNA, also designated SEQ ID:221.

Another function of GAM3229 is therefore inhibition of LOC146229 (Accession XP_085387.1). Accordingly, utilities of GAM3229 include diagnosis, prevention and treatment of diseases and clinical conditions associated with LOC146229.

LOC146336 (Accession XP_085421.2) is another GAM3229 target gene, herein designated TARGET GENE. LOC146336 BINDING SITE is a target binding site found in the 3' untranslated region of mRNA encoded by LOC146336, corresponding to a target binding site such as BINDING SITE I, BINDING SITE II or BINDING SITE III of FIG. 8. Table 4 illustrates the complementarity of the nucleotide sequences of LOC146336 BINDING SITE, designated SEQ ID:5123, to the nucleotide sequence of GAM3229 RNA, herein designated GAM RNA, also designated SEQ ID:221.

Another function of GAM3229 is therefore inhibition of LOC146336 (Accession XP_085421.2). Accordingly, utilities of GAM3229 include diagnosis, prevention and treatment of diseases and clinical conditions associated with LOC146336.

LOC146346 (Accession XP_085430.1) is another GAM3229 target gene, herein designated TARGET GENE. LOC146346 BINDING SITE is a target binding site found in the 5' untranslated region of mRNA encoded by LOC146346, corresponding to a target binding site such as BINDING SITE I, BINDING SITE II or BINDING SITE III of FIG. 8. Table 4 illustrates the complementarity of the nucleotide sequences of LOC146346 BINDING SITE, designated SEQ ID:3401, to the nucleotide sequence of GAM3229 RNA, herein designated GAM RNA, also designated SEQ ID:221.

Another function of GAM3229 is therefore inhibition of LOC146346 (Accession XP_085430.1). Accordingly, utilities of GAM3229 include diagnosis, prevention and treatment of diseases and clinical conditions associated with LOC146346.

LOC146443 (Accession XP_085461.6) is another GAM3229 target gene, herein designated TARGET GENE. LOC146443 BINDING SITE is a target binding site found in the 5' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:9729, to the nucleotide sequence of GAM3229 RNA, herein designated GAM RNA, also designated SEQ ID:221.

Another function of GAM3229 is therefore inhibition of LOC146443 (Accession XP_085461.6). Accordingly, utilities of GAM3229 include diagnosis, prevention and treatment of diseases and clinical conditions associated with LOC146443.

LOC146713 (Accession XP_097071.2) is another GAM3229 target gene, herein designated TARGET GENE. LOC146713 BINDING SITE is a target binding site found in the 3' untranslated region of mRNA encoded by LOC146713, corresponding to a target binding site such as BINDING SITE I, BINDING SITE II or BINDING SITE III of FIG. 8. Table 4 illustrates the complementarity of the nucleotide sequences of LOC146713 BINDING SITE, designated SEQ ID:19578, to the nucleotide sequence of GAM3229 RNA, herein designated GAM RNA, also designated SEQ ID:221.

Another function of GAM3229 is therefore inhibition of LOC146713 (Accession XP_097071.2). Accordingly, utilities of GAM3229 include diagnosis, prevention and treatment of diseases and clinical conditions associated with LOC146713.

LOC146850 (Accession XP_097109.2) is another GAM3229 target gene, herein designated TARGET GENE. LOC146850 BINDING SITE is a target binding site found in the 3' untranslated region of mRNA encoded by LOC146850, corresponding to a target binding site such as BINDING SITE I, BINDING SITE II or BINDING SITE III of FIG. 8. Table 4 illustrates the complementarity of the nucleotide sequences of LOC146850 BINDING SITE, designated SEQ ID:15412, to the nucleotide sequence of GAM3229 RNA, herein designated GAM RNA, also designated SEQ ID:221.

Another function of GAM3229 is therefore inhibition of LOC146850 (Accession XP_097109.2). Accordingly, utilities of GAM3229 include diagnosis, prevention and treatment of diseases and clinical conditions associated with LOC146850.

LOC146909 (Accession XP_085634.2) is another GAM3229 target gene, herein designated TARGET GENE. LOC146909 BINDING SITE is a target binding site found in the 3' untranslated region of mRNA encoded by LOC146909, corresponding to a target binding site such as BINDING SITE I, BINDING SITE II or BINDING SITE III of FIG. 8. Table 4 illustrates the complementarity of the nucleotide sequences of LOC146909 BINDING SITE, designated SEQ ID:11082, to the nucleotide sequence of GAM3229 RNA, herein designated GAM RNA, also designated SEQ ID:221.

Another function of GAM3229 is therefore inhibition of LOC146909 (Accession XP_085634.2). Accordingly, utilities of GAM3229 include diagnosis, prevention and treatment of diseases and clinical conditions associated with LOC146909.

LOC147004 (Accession XP_097155.1) is another GAM3229 target gene, herein designated TARGET GENE. LOC147004 BINDING SITE is a target binding site found in the 3' untranslated region of mRNA encoded by LOC147004, corresponding to a target binding site such as BINDING SITE I, BINDING SITE II or BINDING SITE III of FIG. 8. Table 4 illustrates the complementarity of the nucleotide sequences of LOC147004 BINDING SITE, designated SEQ ID:11470, to the nucleotide sequence of GAM3229 RNA, herein designated GAM RNA, also designated SEQ ID:221.

Another function of GAM3229 is therefore inhibition of LOC147004 (Accession XP_097155.1). Accordingly, utilities of GAM3229 include diagnosis, prevention and treatment of diseases and clinical conditions associated with LOC147004.

LOC147166 (Accession XP_085722.2) is another GAM3229 target gene, herein designated TARGET GENE. LOC147166 BINDING SITE is a target binding site found in the 3' untranslated region of mRNA encoded by LOC147166, corresponding to a target binding site such as BINDING SITE I, BINDING SITE II or BINDING SITE III of FIG. 8. Table 4 illustrates the complementarity of the nucleotide sequences of LOC147166 BINDING SITE, designated SEQ ID:14800, to the nucleotide sequence of GAM3229 RNA, herein designated GAM RNA, also designated SEQ ID:221.

Another function of GAM3229 is therefore inhibition of LOC147166 (Accession XP_085722.2). Accordingly, utilities of GAM3229 include diagnosis, prevention and treatment of diseases and clinical conditions associated with LOC147166.

LOC147343 (Accession XP_097225.1) is another GAM3229 target gene, herein designated TARGET GENE. LOC147343 BINDING SITE is a target binding site found in the 5' untranslated region of mRNA encoded by LOC147343, corresponding to a target binding site such as BINDING SITE I, BINDING SITE II or BINDING SITE III of FIG. 8. Table 4 illustrates the complementarity of the nucleotide sequences of LOC147343 BINDING SITE, designated SEQ ID:7551, to the nucleotide sequence of GAM3229 RNA, herein designated GAM RNA, also designated SEQ ID:221.

Another function of GAM3229 is therefore inhibition of LOC147343 (Accession XP_097225.1). Accordingly, utilities of GAM3229 include diagnosis, prevention and treatment of diseases and clinical conditions associated with LOC147343.

LOC147817 (Accession XP_085903.1) is another GAM3229 target gene, herein designated TARGET GENE. LOC147817 BINDING SITE is a target binding site found in the 3' untranslated region of mRNA encoded by LOC147817, corresponding to a target binding site such as BINDING SITE I, BINDING SITE II or BINDING SITE III of FIG. 8. Table 4 illustrates the complementarity of the nucleotide sequences of LOC147817 BINDING SITE, designated SEQ ID:5287, to the nucleotide sequence of GAM3229 RNA, herein designated GAM RNA, also designated SEQ ID:221.

Another function of GAM3229 is therefore inhibition of LOC147817 (Accession XP_085903.1). Accordingly, utilities of GAM3229 include diagnosis, prevention and treatment of diseases and clinical conditions associated with LOC147817.

LOC147947 (Accession XP_085974.1) is another GAM3229 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:4263, to the nucleotide sequence of GAM3229 RNA, herein designated GAM RNA, also designated SEQ ID:221.

Another function of GAM3229 is therefore inhibition of LOC147947 (Accession XP_085974.1). Accordingly, utilities of GAM3229 include diagnosis, prevention and treatment of diseases and clinical conditions associated with LOC147947.

LOC148203 (Accession XP_086095.1) is another GAM3229 target gene, herein designated TARGET GENE. LOC148203 BINDING SITE1 and LOC148203 BINDING SITE2 are target binding sites found in untranslated regions of mRNA encoded by LOC148203, corresponding to target binding sites such as BINDING SITE I, BINDING SITE II or BINDING SITE III of FIG. 8. Table 4 illustrates the complementarity of the nucleotide sequences of LOC148203 BINDING SITE1 and LOC148203 BINDING SITE2, designated SEQ ID:18261 and SEQ ID:6399 respectively, to the nucleotide sequence of GAM3229 RNA, herein designated GAM RNA, also designated SEQ ID:221.

Another function of GAM3229 is therefore inhibition of LOC148203 (Accession XP_086095.1). Accordingly, utilities of GAM3229 include diagnosis, prevention and treatment of diseases and clinical conditions associated with LOC148203.

LOC148709 (Accession XP_086281.1) is another GAM3229 target gene, herein designated TARGET GENE. LOC148709 BINDING SITE is a target binding site found in the 5' untranslated region of mRNA encoded by LOC148709, corresponding to a target binding site such as BINDING SITE I, BINDING SITE II or BINDING SITE III of FIG. 8. Table 4 illustrates the complementarity of the nucleotide sequences of LOC148709 BINDING SITE, designated SEQ ID:6483, to the nucleotide sequence of GAM3229 RNA, herein designated GAM RNA, also designated SEQ ID:221.

Another function of GAM3229 is therefore inhibition of LOC148709 (Accession XP_086281.1). Accordingly, utilities of GAM3229 include diagnosis, prevention and treatment of diseases and clinical conditions associated with LOC148709.

LOC148918 (Accession XP_086361.1) is another GAM3229 target gene, herein designated TARGET GENE. LOC148918 BINDING SITE1 and LOC148918 BINDING SITE2 are target binding sites found in untranslated regions of mRNA encoded by LOC148918, corresponding to target binding sites such as BINDING SITE I, BINDING SITE II or BINDING SITE III of FIG. 8. Table 4 illustrates the complementarity of the nucleotide sequences of LOC148918 BINDING SITE1 and LOC148918 BINDING SITE2, designated SEQ ID:7157 and SEQ ID:15411 respectively, to the nucleotide sequence of GAM3229 RNA, herein designated GAM RNA, also designated SEQ ID:221.

Another function of GAM3229 is therefore inhibition of LOC148918 (Accession XP_086361.1). Accordingly, utilities of GAM3229 include diagnosis, prevention and treatment of diseases and clinical conditions associated with LOC148918.

LOC149149 (Accession XP_097598.1) is another GAM3229 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:4780, to the nucleotide sequence of GAM3229 RNA, herein designated GAM RNA, also designated SEQ ID:221.

Another function of GAM3229 is therefore inhibition of LOC149149 (Accession XP_097598.1). Accordingly, utilities of GAM3229 include diagnosis, prevention and treatment of diseases and clinical conditions associated with LOC149149.

LOC149371 (Accession NP_787072.1) is another GAM3229 target gene, herein designated TARGET GENE. LOC149371 BINDING SITE is a target binding site found in the 3' untranslated region of mRNA encoded by LOC149371, corresponding to a target binding site such as BINDING SITE I, BINDING SITE II or BINDING SITE III of FIG. 8. Table 4 illustrates the complementarity of the nucleotide sequences of LOC149371 BINDING SITE, designated SEQ ID:4008, to the nucleotide sequence of GAM3229 RNA, herein designated GAM RNA, also designated SEQ ID:221.

Another function of GAM3229 is therefore inhibition of LOC149371 (Accession NP_787072.1). Accordingly, utilities of GAM3229 include diagnosis, prevention and treatment of diseases and clinical conditions associated with LOC149371.

LOC149466 (Accession XP_086546.1) is another GAM3229 target gene, herein designated TARGET GENE. LOC149466 BINDING SITE1 and LOC149466 BINDING SITE2 are target binding sites found in untranslated regions of mRNA encoded by LOC149466, corresponding to target binding sites such as BINDING SITE I, BINDING SITE II or BINDING SITE III of FIG. 8. Table 4 illustrates the complementarity of the nucleotide sequences of LOC149466 BINDING SITE1 and LOC149466 BINDING SITE2, designated SEQ ID:10865 and SEQ ID:12245 respectively, to the nucleotide sequence of GAM3229 RNA, herein designated GAM RNA, also designated SEQ ID:221.

Another function of GAM3229 is therefore inhibition of LOC149466 (Accession XP_086546.1). Accordingly, utilities of GAM3229 include diagnosis, prevention and treatment of diseases and clinical conditions associated with LOC149466.

LOC149670 (Accession XP_086647.4) is another GAM3229 target gene, herein designated TARGET GENE. LOC149670 BINDING SITE is a target binding site found in the 5' untranslated region of mRNA encoded by LOC149670, corresponding to a target binding site such as BINDING SITE I, BINDING SITE II or BINDING SITE III of FIG. 8. Table 4 illustrates the complementarity of the nucleotide sequences of LOC149670 BINDING SITE, designated SEQ ID:10537, to the nucleotide sequence of GAM3229 RNA, herein designated GAM RNA, also designated SEQ ID:221.

Another function of GAM3229 is therefore inhibition of LOC149670 (Accession XP_086647.4). Accordingly, utilities of GAM3229 include diagnosis, prevention and treatment of diseases and clinical conditions associated with LOC149670.

LOC149692 (Accession XP_097706.1) is another GAM3229 target gene, herein designated TARGET GENE. LOC149692 BINDING SITE is a target binding site found in the 3' untranslated region of mRNA encoded by LOC149692, corresponding to a target binding site such as BINDING SITE I, BINDING SITE II or BINDING SITE III of FIG. 8. Table 4 illustrates the complementarity of the nucleotide sequences of LOC149692 BINDING SITE, designated SEQ ID:619, to the nucleotide sequence of GAM3229 RNA, herein designated GAM RNA, also designated SEQ ID:221.

Another function of GAM3229 is therefore inhibition of LOC149692 (Accession XP_097706.1). Accordingly, utilities of GAM3229 include diagnosis, prevention and treatment of diseases and clinical conditions associated with LOC149692.

LOC149821 (Accession XP_097751.2) is another GAM3229 target gene, herein designated TARGET GENE. LOC149821 BINDING SITE is a target binding site found in the 5' untranslated region of mRNA encoded by LOC149821, corresponding to a target binding site such as BINDING SITE I, BINDING SITE II or BINDING SITE III of FIG. 8. Table 4 illustrates the complementarity of the nucleotide sequences of LOC149821 BINDING SITE, designated SEQ ID:7976, to the nucleotide sequence of GAM3229 RNA, herein designated GAM RNA, also designated SEQ ID:221.

Another function of GAM3229 is therefore inhibition of LOC149821 (Accession XP_097751.2). Accordingly, utilities of GAM3229 include diagnosis, prevention and treatment of diseases and clinical conditions associated with LOC149821.

LOC150166 (Accession XP_097824.1) is another GAM3229 target gene, herein designated TARGET GENE. LOC150166 BINDING SITE is a target binding site found in the 5' untranslated region of mRNA encoded by LOC150166, corresponding to a target binding site such as BINDING SITE I, BINDING SITE II or BINDING SITE III of FIG. 8. Table 4 illustrates the complementarity of the nucleotide sequences of LOC150166 BINDING SITE, designated SEQ ID:2705, to the nucleotide sequence of GAM3229 RNA, herein designated GAM RNA, also designated SEQ ID:221.

Another function of GAM3229 is therefore inhibition of LOC150166 (Accession XP_097824.1). Accordingly, utilities of GAM3229 include diagnosis, prevention and treatment of diseases and clinical conditions associated with LOC150166.

LOC150407 (Accession XP_086906.1) is another GAM3229 target gene, herein designated TARGET GENE. LOC150407 BINDING SITE is a target binding site found in the 3' untranslated region of mRNA encoded by LOC150407, corresponding to a target binding site such as BINDING SITE I, BINDING SITE II or BINDING SITE III of FIG. 8. Table 4 illustrates the complementarity of the nucleotide sequences of LOC150407 BINDING SITE, designated SEQ ID:7746, to the nucleotide sequence of GAM3229 RNA, herein designated GAM RNA, also designated SEQ ID:221.

Another function of GAM3229 is therefore inhibition of LOC150407 (Accession XP_086906.1). Accordingly, utilities of GAM3229 include diagnosis, prevention and treatment of diseases and clinical conditions associated with LOC150407.

LOC150587 (Accession XP_097917.1) is another GAM3229 target gene, herein designated TARGET GENE. LOC150587 BINDING SITE is a target binding site found in the 3' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:6798, to the nucleotide sequence of GAM3229 RNA, herein designated GAM RNA, also designated SEQ ID:221.

Another function of GAM3229 is therefore inhibition of LOC150587 (Accession XP_097917.1). Accordingly, utilities of GAM3229 include diagnosis, prevention and treatment of diseases and clinical conditions associated with LOC150587.

LOC150946 (Accession XP_097977.2) is another GAM3229 target gene, herein designated TARGET GENE. LOC150946 BINDING SITE is a target binding site found in the 5' untranslated region of mRNA encoded by LOC150946, corresponding to a target binding site such as BINDING SITE I, BINDING SITE II or BINDING SITE III of FIG. 8. Table 4 illustrates the complementarity of the nucleotide sequences of LOC150946 BINDING SITE, designated SEQ ID:13021, to the nucleotide sequence of GAM3229 RNA, herein designated GAM RNA, also designated SEQ ID:221.

Another function of GAM3229 is therefore inhibition of LOC150946 (Accession XP_097977.2). Accordingly, utilities of GAM3229 include diagnosis, prevention and treatment of diseases and clinical conditions associated with LOC150946.

LOC151196 (Accession XP_098019.1) is another GAM3229 target gene, herein designated TARGET GENE. LOC151196 BINDING SITE is a target binding site found in the 5' untranslated region of mRNA encoded by LOC151196, corresponding to a target binding site such as BINDING SITE I, BINDING SITE II or BINDING SITE III of FIG. 8. Table 4 illustrates the complementarity of the nucleotide sequences of LOC151196 BINDING SITE, designated SEQ ID:2041, to the nucleotide sequence of GAM3229 RNA, herein designated GAM RNA, also designated SEQ ID:221.

Another function of GAM3229 is therefore inhibition of LOC151196 (Accession XP_098019.1). Accordingly, utilities of GAM3229 include diagnosis, prevention and treatment of diseases and clinical conditions associated with LOC151196.

LOC151201 (Accession XP_098021.1) is another GAM3229 target gene, herein designated TARGET GENE. LOC151201 BINDING SITE is a target binding site found in the 3' untranslated region of mRNA encoded by LOC151201, corresponding to a target binding site such as BINDING SITE I, BINDING SITE II or BINDING SITE III of FIG. 8. Table 4 illustrates the complementarity of the nucleotide sequences of LOC151201 BINDING SITE, designated SEQ ID:2056, to the nucleotide sequence of GAM3229 RNA, herein designated GAM RNA, also designated SEQ ID:221.

Another function of GAM3229 is therefore inhibition of LOC151201 (Accession XP_098021.1). Accordingly, utilities of GAM3229 include diagnosis, prevention and treatment of diseases and clinical conditions associated with LOC151201.

LOC151636 (Accession NP_612144.1) is another GAM3229 target gene, herein designated TARGET GENE. LOC151636 BINDING SITE is a target binding site found in the 3' untranslated region of mRNA encoded by LOC151636, corresponding to a target binding site such as BINDING SITE I, BINDING SITE II or BINDING SITE III of FIG. 8. Table 4 illustrates the complementarity of the nucleotide sequences of LOC151636 BINDING SITE, designated SEQ ID:15373, to the nucleotide sequence of GAM3229 RNA, herein designated GAM RNA, also designated SEQ ID:221.

Another function of GAM3229 is therefore inhibition of LOC151636 (Accession NP_612144.1). Accordingly, utilities of GAM3229 include diagnosis, prevention and treatment of diseases and clinical conditions associated with LOC151636.

LOC151657 (Accession XP_098100.2) is another GAM3229 target gene, herein designated TARGET GENE. LOC151657 BINDING SITE is a target binding site found in the 5' untranslated region of mRNA encoded by LOC151657, corresponding to a target binding site such as BINDING SITE I, BINDING SITE II or BINDING SITE III of FIG. 8. Table 4 illustrates the complementarity of the nucleotide sequences of LOC151657 BINDING SITE, designated SEQ ID:12136, to the nucleotide sequence of GAM3229 RNA, herein designated GAM RNA, also designated SEQ ID:221.

Another function of GAM3229 is therefore inhibition of LOC151657 (Accession XP_098100.2). Accordingly, utilities of GAM3229 include diagnosis, prevention and treatment of diseases and clinical conditions associated with LOC151657.

LOC152445 (Accession XP_098231.1) is another GAM3229 target gene, herein designated TARGET GENE. LOC152445 BINDING SITE is a target binding site found in the 3' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:10071, to the nucleotide sequence of GAM3229 RNA, herein designated GAM RNA, also designated SEQ ID:221.

Another function of GAM3229 is therefore inhibition of LOC152445 (Accession XP_098231.1). Accordingly, utilities of GAM3229 include diagnosis, prevention and treatment of diseases and clinical conditions associated with LOC152445.

LOC152620 (Accession XP_011108.2) is another GAM3229 target gene, herein designated TARGET GENE. LOC152620 BINDING SITE is a target binding site found in the 3' untranslated region of mRNA encoded by LOC152620, corresponding to a target binding site such as BINDING SITE I, BINDING SITE II or BINDING SITE III of FIG. 8. Table 4 illustrates the complementarity of the nucleotide sequences of LOC152620 BINDING SITE, designated SEQ ID:10075, to the nucleotide sequence of GAM3229 RNA, herein designated GAM RNA, also designated SEQ ID:221.

Another function of GAM3229 is therefore inhibition of LOC152620 (Accession XP_011108.2). Accordingly, utilities of GAM3229 include diagnosis, prevention and treatment of diseases and clinical conditions associated with LOC152620.

LOC152719 (Accession XP_098257.1) is another GAM3229 target gene, herein designated TARGET GENE. LOC152719 BINDING SITE is a target binding site found in the 5' untranslated region of mRNA encoded by LOC152719, corresponding to a target binding site such as BINDING SITE I, BINDING SITE II or BINDING SITE III of FIG. 8. Table 4 illustrates the complementarity of the nucleotide sequences of LOC152719 BINDING SITE, designated SEQ ID:10075, to the nucleotide sequence of GAM3229 RNA, herein designated GAM RNA, also designated SEQ ID:221.

Another function of GAM3229 is therefore inhibition of LOC152719 (Accession XP_098257.1). Accordingly, utilities of GAM3229 include diagnosis, prevention and treatment of diseases and clinical conditions associated with LOC152719.

LOC152804 (Accession XP_098266.2) is another GAM3229 target gene, herein designated TARGET GENE. LOC152804 BINDING SITE is a target binding site found in the 3' untranslated region of mRNA encoded by LOC152804, corresponding to a target binding site such as BINDING SITE I, BINDING SITE II or BINDING SITE III of FIG. 8. Table 4 illustrates the complementarity of the nucleotide sequences of LOC152804 BINDING SITE, designated SEQ ID:6723, to the nucleotide sequence of GAM3229 RNA, herein designated GAM RNA, also designated SEQ ID:221.

Another function of GAM3229 is therefore inhibition of LOC152804 (Accession XP_098266.2). Accordingly, utilities of GAM3229 include diagnosis, prevention and treatment of diseases and clinical conditions associated with LOC152804.

LOC153139 (Accession XP_098318.1) is another GAM3229 target gene, herein designated TARGET GENE. LOC153139 BINDING SITE is a target binding site found in the 5' untranslated region of mRNA encoded by LOC153139, corresponding to a target binding site such as BINDING SITE I, BINDING SITE II or BINDING SITE III of FIG. 8. Table 4 illustrates the complementarity of the nucleotide sequences of LOC153139 BINDING SITE, designated SEQ ID:4758, to the nucleotide sequence of GAM3229 RNA, herein designated GAM RNA, also designated SEQ ID:221.

Another function of GAM3229 is therefore inhibition of LOC153139 (Accession XP_098318.1). Accordingly, utilities of GAM3229 include diagnosis, prevention and treatment of diseases and clinical conditions associated with LOC153139.

LOC154184 (Accession XP_098488.2) is another GAM3229 target gene, herein designated TARGET GENE. LOC154184 BINDING SITE is a target binding site found in the 5' untranslated region of mRNA encoded by LOC154184, corresponding to a target binding site such as BINDING SITE I, BINDING SITE II or BINDING SITE III of FIG. 8. Table 4 illustrates the complementarity of the nucleotide sequences of LOC154184 BINDING SITE, designated SEQ ID:4758, to the nucleotide sequence of GAM3229 RNA, herein designated GAM RNA, also designated SEQ ID:221.

Another function of GAM3229 is therefore inhibition of LOC154184 (Accession XP_098488.2). Accordingly, utilities of GAM3229 include diagnosis, prevention and treatment of diseases and clinical conditions associated with LOC154184.

LOC154282 (Accession XP_098505.1) is another GAM3229 target gene, herein designated TARGET GENE. LOC154282 BINDING SITE is a target binding site found in the 5' untranslated region of mRNA encoded by LOC154282, corresponding to a target binding site such as BINDING SITE I, BINDING SITE II or BINDING SITE III of FIG. 8. Table 4 illustrates the complementarity of the nucleotide sequences of LOC154282 BINDING SITE, designated SEQ ID:18644, to the nucleotide sequence of GAM3229 RNA, herein designated GAM RNA, also designated SEQ ID:221.

Another function of GAM3229 is therefore inhibition of LOC154282 (Accession XP_098505.1). Accordingly, utilities of GAM3229 include diagnosis, prevention and treatment of diseases and clinical conditions associated with LOC154282.

LOC154822 (Accession XP_098618.3) is another GAM3229 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:1820, to the nucleotide sequence of GAM3229 RNA, herein designated GAM RNA, also designated SEQ ID:221.

Another function of GAM3229 is therefore inhibition of LOC154822 (Accession XP_098618.3). Accordingly, utilities of GAM3229 include diagnosis, prevention and treatment of diseases and clinical conditions associated with LOC154822.

LOC154877 (Accession XP_098626.1) is another GAM3229 target gene, herein designated TARGET GENE. LOC154877 BINDING SITE1 and LOC154877 BINDING SITE2 are target binding sites found in untranslated regions of mRNA encoded by LOC154877, corresponding to target binding sites such as BINDING SITE I, BINDING SITE II or BINDING SITE III of FIG. 8. Table 4 illustrates the complementarity of the nucleotide sequences of LOC154877 BINDING SITE1 and LOC154877 BINDING SITE2, designated SEQ ID:14674 and SEQ ID:10615 respectively, to the nucleotide sequence of GAM3229 RNA, herein designated GAM RNA, also designated SEQ ID:221.

Another function of GAM3229 is therefore inhibition of LOC154877 (Accession XP_098626.1). Accordingly, utilities of GAM3229 include diagnosis, prevention and treatment of diseases and clinical conditions associated with LOC154877.

LOC155032 (Accession XP_098647.1) is another GAM3229 target gene, herein designated TARGET GENE. LOC155032 BINDING SITE1 and LOC155032 BINDING SITE2 are target binding sites found in untranslated regions of mRNA encoded by LOC155032, corresponding to target binding sites such as BINDING SITE I, BINDING SITE II or BINDING SITE III of FIG. 8. Table 4 illustrates the complementarity of the nucleotide sequences of LOC155032 BINDING SITE1 and LOC155032 BINDING SITE2, designated SEQ ID:6455 and SEQ ID:16924 respectively, to the nucleotide sequence of GAM3229 RNA, herein designated GAM RNA, also designated SEQ ID:221.

Another function of GAM3229 is therefore inhibition of LOC155032 (Accession XP_098647.1). Accordingly, utilities of GAM3229 include diagnosis, prevention and treatment of diseases and clinical conditions associated with LOC155032.

LOC157226 (Accession XP_033876.1) is another GAM3229 target gene, herein designated TARGET GENE. LOC157226 BINDING SITE is a target binding site found in the 5' untranslated region of mRNA encoded by LOC157226, corresponding to a target binding site such as BINDING SITE I, BINDING SITE II or BINDING SITE III of FIG. 8. Table 4 illustrates the complementarity of the nucleotide sequences of LOC157226 BINDING SITE, designated SEQ ID:5282, to the nucleotide sequence of GAM3229 RNA, herein designated GAM RNA, also designated SEQ ID:221.

Another function of GAM3229 is therefore inhibition of LOC157226 (Accession XP_033876.1). Accordingly, utilities of GAM3229 include diagnosis, prevention and treatment of diseases and clinical conditions associated with LOC157226.

LOC158014 (Accession XP_088442.1) is another GAM3229 target gene, herein designated TARGET GENE. LOC158014 BINDING SITE is a target binding site found in the 5' untranslated region of mRNA encoded by LOC158014, corresponding to a target binding site such as BINDING SITE I, BINDING SITE II or BINDING SITE III of FIG. 8. Table 4 illustrates the complementarity of the nucleotide sequences of LOC158014 BINDING SITE, designated SEQ ID:16148, to the nucleotide sequence of GAM3229 RNA, herein designated GAM RNA, also designated SEQ ID:221.

Another function of GAM3229 is therefore inhibition of LOC158014 (Accession XP_088442.1). Accordingly, utilities of GAM3229 include diagnosis, prevention and treatment of diseases and clinical conditions associated with LOC158014.

LOC158257 (Accession XP_098908.1) is another GAM3229 target gene, herein designated TARGET GENE. LOC158257 BINDING SITE is a target binding site found in the 5' untranslated region of mRNA encoded by LOC158257, corresponding to a target binding site such as BINDING SITE I, BINDING SITE II or BINDING SITE III of FIG. 8. Table 4 illustrates the complementarity of the nucleotide sequences of LOC158257 BINDING SITE, designated SEQ ID:19341, to the nucleotide sequence of GAM3229 RNA, herein designated GAM RNA, also designated SEQ ID:221.

Another function of GAM3229 is therefore inhibition of LOC158257 (Accession XP_098908.1). Accordingly, utilities of GAM3229 include diagnosis, prevention and treatment of diseases and clinical conditions associated with LOC158257.

LOC158373 (Accession XP_048539.1) is another GAM3229 target gene, herein designated TARGET GENE.

LOC158373 BINDING SITE is a target binding site found in the 5' untranslated region of mRNA encoded by LOC158373, corresponding to a target binding site such as BINDING SITE I, BINDING SITE II or BINDING SITE III of FIG. 8. Table 4 illustrates the complementarity of the nucleotide sequences of LOC158373 BINDING SITE, designated SEQ ID:18514, to the nucleotide sequence of GAM3229 RNA, herein designated GAM RNA, also designated SEQ ID:221.

Another function of GAM3229 is therefore inhibition of LOC158373 (Accession XP_048539.1). Accordingly, utilities of GAM3229 include diagnosis, prevention and treatment of diseases and clinical conditions associated with LOC158373.

LOC158402 (Accession XP_098936.1) is another GAM3229 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:2018, to the nucleotide sequence of GAM3229 RNA, herein designated GAM RNA, also designated SEQ ID:221.

Another function of GAM3229 is therefore inhibition of LOC158402 (Accession XP_098936.1). Accordingly, utilities of GAM3229 include diagnosis, prevention and treatment of diseases and clinical conditions associated with LOC158402.

LOC158476 (Accession XP_098955.1) is another GAM3229 target gene, herein designated TARGET GENE. LOC158476 BINDING SITE is a target binding site found in the 3' untranslated region of mRNA encoded by LOC158476, corresponding to a target binding site such as BINDING SITE I, BINDING SITE II or BINDING SITE III of FIG. 8. Table 4 illustrates the complementarity of the nucleotide sequences of LOC158476 BINDING SITE, designated SEQ ID:6246, to the nucleotide sequence of GAM3229 RNA, herein designated GAM RNA, also designated SEQ ID:221.

Another function of GAM3229 is therefore inhibition of LOC158476 (Accession XP_098955.1). Accordingly, utilities of GAM3229 include diagnosis, prevention and treatment of diseases and clinical conditions associated with LOC158476.

LOC158563 (Accession XP_088606.1) is another GAM3229 target gene, herein designated TARGET GENE. LOC158563 BINDING SITE is a target binding site found in the 5' untranslated region of mRNA encoded by LOC158563, corresponding to a target binding site such as BINDING SITE I, BINDING SITE II or BINDING SITE III of FIG. 8. Table 4 illustrates the complementarity of the nucleotide sequences of LOC158563 BINDING SITE, designated SEQ ID:9836, to the nucleotide sequence of GAM3229 RNA, herein designated GAM RNA, also designated SEQ ID:221.

Another function of GAM3229 is therefore inhibition of LOC158563 (Accession XP_088606.1). Accordingly, utilities of GAM3229 include diagnosis, prevention and treatment of diseases and clinical conditions associated with LOC158563.

LOC158865 (Accession XP_099000.1) is another GAM3229 target gene, herein designated TARGET GENE. LOC158865 BINDING SITE is a target binding site found in the 5' untranslated region of mRNA encoded by LOC158865, corresponding to a target binding site such as BINDING SITE I, BINDING SITE II or BINDING SITE III of FIG. 8. Table 4 illustrates the complementarity of the nucleotide sequences of LOC158865 BINDING SITE, designated SEQ ID:1389, to the nucleotide sequence of GAM3229 RNA, herein designated GAM RNA, also designated SEQ ID:221.

Another function of GAM3229 is therefore inhibition of LOC158865 (Accession XP_099000.1). Accordingly, utilities of GAM3229 include diagnosis, prevention and treatment of diseases and clinical conditions associated with LOC158865.

LOC161145 (Accession XP_101622.1) is another GAM3229 target gene, herein designated TARGET GENE. LOC161145 BINDING SITE is a target binding site found in the 3' untranslated region of mRNA encoded by LOC161145, corresponding to a target binding site such as BINDING SITE I, BINDING SITE II or BINDING SITE III of FIG. 8. Table 4 illustrates the complementarity of the nucleotide sequences of LOC161145 BINDING SITE, designated SEQ ID:10075, to the nucleotide sequence of GAM3229 RNA, herein designated GAM RNA, also designated SEQ ID:221.

Another function of GAM3229 is therefore inhibition of LOC161145 (Accession XP_101622.1). Accordingly, utilities of GAM3229 include diagnosis, prevention and treatment of diseases and clinical conditions associated with LOC161145.

LOC162967 (Accession XP_091890.6) is another GAM3229 target gene, herein designated TARGET GENE. LOC162967 BINDING SITE is a target binding site found in the 3' untranslated region of mRNA encoded by LOC162967, corresponding to a target binding site such as BINDING SITE I, BINDING SITE II or BINDING SITE III of FIG. 8. Table 4 illustrates the complementarity of the nucleotide sequences of LOC162967 BINDING SITE, designated SEQ ID:18580, to the nucleotide sequence of GAM3229 RNA, herein designated GAM RNA, also designated SEQ ID:221.

Another function of GAM3229 is therefore inhibition of LOC162967 (Accession XP_091890.6). Accordingly, utilities of GAM3229 include diagnosis, prevention and treatment of diseases and clinical conditions associated with LOC162967.

LOC163227 (Accession NP_775802.1) is another GAM3229 target gene, herein designated TARGET GENE. LOC163227 BINDING SITE1 and LOC163227 BINDING SITE2 are target binding sites found in untranslated regions of mRNA encoded by LOC163227, corresponding to target binding sites such as BINDING SITE I, BINDING SITE II or BINDING SITE III of FIG. 8. Table 4 illustrates the complementarity of the nucleotide sequences of LOC163227 BINDING SITE1 and LOC163227 BINDING SITE2, designated SEQ ID:19173 and SEQ ID:8466 respectively, to the nucleotide sequence of GAM3229 RNA, herein designated GAM RNA, also designated SEQ ID:221.

Another function of GAM3229 is therefore inhibition of LOC163227 (Accession NP_775802.1). Accordingly, utilities of GAM3229 include diagnosis, prevention and treatment of diseases and clinical conditions associated with LOC163227.

LOC163590 (Accession NP_659471.1) is another GAM3229 target gene, herein designated TARGET GENE. LOC163590 BINDING SITE is a target binding site found in the 5' untranslated region of mRNA encoded by LOC163590, corresponding to a target binding site such as BINDING SITE I, BINDING SITE II or BINDING SITE III of FIG. 8. Table 4 illustrates the complementarity of the nucleotide sequences of LOC163590 BINDING SITE, designated SEQ ID:2345, to the nucleotide sequence of GAM3229 RNA, herein designated GAM RNA, also designated SEQ ID:221.

Another function of GAM3229 is therefore inhibition of LOC163590 (Accession NP_659471.1). Accordingly, utilities of GAM3229 include diagnosis, prevention and treatment of diseases and clinical conditions associated with LOC163590.

LOC164153 (Accession XP_089415.1) is another GAM3229 target gene, herein designated TARGET GENE. LOC164153 BINDING SITE is a target binding site found in the 3' untranslated region of mRNA encoded by LOC164153, corresponding to a target binding site such as BINDING SITE I, BINDING SITE II or BINDING SITE III of FIG. 8. Table 4 illustrates the complementarity of the nucleotide sequences of LOC164153 BINDING SITE, designated SEQ ID:17694, to the nucleotide sequence of GAM3229 RNA, herein designated GAM RNA, also designated SEQ ID:221.

Another function of GAM3229 is therefore inhibition of LOC164153 (Accession XP_089415.1). Accordingly, utilities of GAM3229 include diagnosis, prevention and treatment of diseases and clinical conditions associated with LOC164153.

LOC196214 (Accession XP_116897.1) is another GAM3229 target gene, herein designated TARGET GENE. LOC196214 BINDING SITE is a target binding site found in the 3' untranslated region of mRNA encoded by LOC196214, corresponding to a target binding site such as BINDING SITE I, BINDING SITE II or BINDING SITE III of FIG. 8. Table 4 illustrates the complementarity of the nucleotide sequences of LOC196214 BINDING SITE, designated SEQ ID:12821, to the nucleotide sequence of GAM3229 RNA, herein designated GAM RNA, also designated SEQ ID:221.

Another function of GAM3229 is therefore inhibition of LOC196214 (Accession XP_116897.1). Accordingly, utilities of GAM3229 include diagnosis, prevention and treatment of diseases and clinical conditions associated with LOC196214.

LOC196463 (Accession NP_775813.1) is another GAM3229 target gene, herein designated TARGET GENE. LOC196463 BINDING SITE is a target binding site found in the 3' untranslated region of mRNA encoded by LOC196463, corresponding to a target binding site such as BINDING SITE I, BINDING SITE II or BINDING SITE III of FIG. 8. Table 4 illustrates the complementarity of the nucleotide sequences of LOC196463 BINDING SITE, designated SEQ ID:10525, to the nucleotide sequence of GAM3229 RNA, herein designated GAM RNA, also designated SEQ ID:221.

Another function of GAM3229 is therefore inhibition of LOC196463 (Accession NP_775813.1). Accordingly, utilities of GAM3229 include diagnosis, prevention and treatment of diseases and clinical conditions associated with LOC196463.

LOC197358 (Accession XP_113872.2) is another GAM3229 target gene, herein designated TARGET GENE. LOC197358 BINDING SITE is a target binding site found in the 3' untranslated region of mRNA encoded by LOC197358, corresponding to a target binding site such as BINDING SITE I, BINDING SITE II or BINDING SITE III of FIG. 8. Table 4 illustrates the complementarity of the nucleotide sequences of LOC197358 BINDING SITE, designated SEQ ID:8630, to the nucleotide sequence of GAM3229 RNA, herein designated GAM RNA, also designated SEQ ID:221.

Another function of GAM3229 is therefore inhibition of LOC197358 (Accession XP_113872.2). Accordingly, utilities of GAM3229 include diagnosis, prevention and treatment of diseases and clinical conditions associated with LOC197358.

LOC199899 (Accession XP_117153.1) is another GAM3229 target gene, herein designated TARGET GENE. LOC199899 BINDING SITE is a target binding site found in the 3' untranslated region of mRNA encoded by LOC199899, corresponding to a target binding site such as BINDING SITE I, BINDING SITE II or BINDING SITE III of FIG. 8. Table 4 illustrates the complementarity of the nucleotide sequences of LOC199899 BINDING SITE, designated SEQ ID:940, to the nucleotide sequence of GAM3229 RNA, herein designated GAM RNA, also designated SEQ ID:221.

Another function of GAM3229 is therefore inhibition of LOC199899 (Accession XP_117153.1). Accordingly, utilities of GAM3229 include diagnosis, prevention and treatment of diseases and clinical conditions associated with LOC199899.

LOC200860 (Accession XP_117289.1) is another GAM3229 target gene, herein designated TARGET GENE. LOC200860 BINDING SITE1 and LOC200860 BINDING SITE2 are target binding sites found in untranslated regions of mRNA encoded by LOC200860, corresponding to target binding sites such as BINDING SITE I, BINDING SITE II or BINDING SITE III of FIG. 8. Table 4 illustrates the complementarity of the nucleotide sequences of LOC200860 BINDING SITE1 and LOC200860 BINDING SITE2, designated SEQ ID:6951 and SEQ ID:18373 respectively, to the nucleotide sequence of GAM3229 RNA, herein designated GAM RNA, also designated SEQ ID:221.

Another function of GAM3229 is therefore inhibition of LOC200860 (Accession XP_117289.1). Accordingly, utilities of GAM3229 include diagnosis, prevention and treatment of diseases and clinical conditions associated with LOC200860.

LOC200895 (Accession NP_789785.1) is another GAM3229 target gene, herein designated TARGET GENE. LOC200895 BINDING SITE is a target binding site found in the 3' untranslated region of mRNA encoded by LOC200895, corresponding to a target binding site such as BINDING SITE I, BINDING SITE II or BINDING SITE III of FIG. 8. Table 4 illustrates the complementarity of the nucleotide sequences of LOC200895 BINDING SITE, designated SEQ ID:13587, to the nucleotide sequence of GAM3229 RNA, herein designated GAM RNA, also designated SEQ ID:221.

Another function of GAM3229 is therefore inhibition of LOC200895 (Accession NP_789785.1). Accordingly, utilities of GAM3229 include diagnosis, prevention and treatment of diseases and clinical conditions associated with LOC200895.

LOC200916 (Accession XP_114317.3) is another GAM3229 target gene, herein designated TARGET GENE. LOC200916 BINDING SITE is a target binding site found in the 3' untranslated region of mRNA encoded by LOC200916, corresponding to a target binding site such as BINDING SITE I, BINDING SITE II or BINDING SITE III of FIG. 8. Table 4 illustrates the complementarity of the nucleotide sequences of LOC200916 BINDING SITE, designated SEQ ID:5449, to the nucleotide sequence of GAM3229 RNA, herein designated GAM RNA, also designated SEQ ID:221.

Another function of GAM3229 is therefore inhibition of LOC200916 (Accession XP_114317.3). Accordingly, utilities of GAM3229 include diagnosis, prevention and treatment of diseases and clinical conditions associated with LOC200916.

LOC201292 (Accession NP_775818.1) is another GAM3229 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:11829, to the nucleotide sequence of GAM3229 RNA, herein designated GAM RNA, also designated SEQ ID:221.

Another function of GAM3229 is therefore inhibition of LOC201292 (Accession NP_775818.1). Accordingly, utilities of GAM3229 include diagnosis, prevention and treatment of diseases and clinical conditions associated with LOC201292.

LOC201868 (Accession XP_114393.1) is another GAM3229 target gene, herein designated TARGET GENE. LOC201868 BINDING SITE1 and LOC201868 BINDING SITE2 are target binding sites found in untranslated regions of mRNA encoded by LOC201868, corresponding to target binding sites such as BINDING SITE I, BINDING SITE II or BINDING SITE III of FIG. 8. Table 4 illustrates the complementarity of the nucleotide sequences of LOC201868 BINDING SITE1 and LOC201868 BINDING SITE2, designated SEQ ID:542 and SEQ ID:7507 respectively, to the nucleotide sequence of GAM3229 RNA, herein designated GAM RNA, also designated SEQ ID:221.

Another function of GAM3229 is therefore inhibition of LOC201868 (Accession XP_114393.1). Accordingly, utilities of GAM3229 include diagnosis, prevention and treatment of diseases and clinical conditions associated with LOC201868.

LOC202459 (Accession NP_660346.1) is another GAM3229 target gene, herein designated TARGET GENE. LOC202459 BINDING SITE is a target binding site found in the 5' untranslated region of mRNA encoded by LOC202459, corresponding to a target binding site such as BINDING SITE I, BINDING SITE II or BINDING SITE III of FIG. 8. Table 4 illustrates the complementarity of the nucleotide sequences of LOC202459 BINDING SITE, designated SEQ ID:4939, to the nucleotide sequence of GAM3229 RNA, herein designated GAM RNA, also designated SEQ ID:221.

Another function of GAM3229 is therefore inhibition of LOC202459 (Accession NP_660346.1). Accordingly, utilities of GAM3229 include diagnosis, prevention and treatment of diseases and clinical conditions associated with LOC202459.

LOC202934 (Accession XP_117486.2) is another GAM3229 target gene, herein designated TARGET GENE. LOC202934 BINDING SITE is a target binding site found in the 3' untranslated region of mRNA encoded by LOC202934, corresponding to a target binding site such as BINDING SITE I, BINDING SITE II or BINDING SITE III of FIG. 8. Table 4 illustrates the complementarity of the nucleotide sequences of LOC202934 BINDING SITE, designated SEQ ID:6398, to the nucleotide sequence of GAM3229 RNA, herein designated GAM RNA, also designated SEQ ID:221.

Another function of GAM3229 is therefore inhibition of LOC202934 (Accession XP_117486.2). Accordingly, utilities of GAM3229 include diagnosis, prevention and treatment of diseases and clinical conditions associated with LOC202934.

LOC203547 (Accession XP_114719.1) is another GAM3229 target gene, herein designated TARGET GENE. LOC203547 BINDING SITE1 and LOC203547 BINDING SITE2 are target binding sites found in untranslated regions of mRNA encoded by LOC203547, corresponding to target binding sites such as BINDING SITE I, BINDING SITE II or BINDING SITE III of FIG. 8. Table 4 illustrates the complementarity of the nucleotide sequences of LOC203547 BINDING SITE1 and LOC203547 BINDING SITE2, designated SEQ ID:828 and SEQ ID:17521 respectively, to the nucleotide sequence of GAM3229 RNA, herein designated GAM RNA, also designated SEQ ID:221.

Another function of GAM3229 is therefore inhibition of LOC203547 (Accession XP_114719.1). Accordingly, utilities of GAM3229 include diagnosis, prevention and treatment of diseases and clinical conditions associated with LOC203547.

LOC219293 (Accession XP_166599.2) is another GAM3229 target gene, herein designated TARGET GENE. LOC219293 BINDING SITE is a target binding site found in the 3' untranslated region of mRNA encoded by LOC219293, corresponding to a target binding site such as BINDING SITE I, BINDING SITE II or BINDING SITE III of FIG. 8. Table 4 illustrates the complementarity of the nucleotide sequences of LOC219293 BINDING SITE, designated SEQ ID:14079, to the nucleotide sequence of GAM3229 RNA, herein designated GAM RNA, also designated SEQ ID:221.

Another function of GAM3229 is therefore inhibition of LOC219293 (Accession XP_166599.2). Accordingly, utilities of GAM3229 include diagnosis, prevention and treatment of diseases and clinical conditions associated with LOC219293.

LOC219731 (Accession XP_167596.1) is another GAM3229 target gene, herein designated TARGET GENE. LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:4505, to the nucleotide sequence of GAM3229 RNA, herein designated GAM RNA, also designated SEQ ID:221.

Another function of GAM3229 is therefore inhibition of LOC219731 (Accession XP_167596.1). Accordingly, utilities of GAM3229 include diagnosis, prevention and treatment of diseases and clinical conditions associated with LOC219731.

LOC220074 (Accession NP_660352.1) is another GAM3229 target gene, herein designated TARGET GENE. LOC220074 BINDING SITE is a target binding site found in the 3' untranslated region of mRNA encoded by LOC220074, corresponding to a target binding site such as BINDING SITE I, BINDING SITE II or BINDING SITE III of FIG. 8. Table 4 illustrates the complementarity of the nucleotide sequences of LOC220074 BINDING SITE, designated SEQ ID:9729, to the nucleotide sequence of GAM3229 RNA, herein designated GAM RNA, also designated SEQ ID:221.

Another function of GAM3229 is therefore inhibition of LOC220074 (Accession NP_660352.1). Accordingly, utilities of GAM3229 include diagnosis, prevention and treatment of diseases and clinical conditions associated with LOC220074.

LOC220980 (Accession XP_167629.1) is another GAM3229 target gene, herein designated TARGET GENE. LOC220980 BINDING SITE is a target binding site found in the 5' untranslated region of mRNA encoded by LOC220980, corresponding to a target binding site such as BINDING SITE I, BINDING SITE II or BINDING SITE III of FIG. 8. Table 4 illustrates the complementarity of the nucleotide sequences of LOC220980 BINDING SITE, designated SEQ ID:4661, to the nucleotide sequence of GAM3229 RNA, herein designated GAM RNA, also designated SEQ ID:221.

Another function of GAM3229 is therefore inhibition of LOC220980 (Accession XP_167629.1). Accordingly, utilities of GAM3229 include diagnosis, prevention and treatment of diseases and clinical conditions associated with LOC220980.

LOC221405 (Accession XP_168138.1) is another GAM3229 target gene, herein designated TARGET GENE.

LOC221405 BINDING SITE is a target binding site found in the 3' untranslated region of mRNA encoded by LOC221405, corresponding to a target binding site such as BINDING SITE I, BINDING SITE II or BINDING SITE III of FIG. 8. Table 4 illustrates the complementarity of the nucleotide sequences of LOC221405 BINDING SITE, designated SEQ ID:14485, to the nucleotide sequence of GAM3229 RNA, herein designated GAM RNA, also designated SEQ ID:221.

Another function of GAM3229 is therefore inhibition of LOC221405 (Accession XP_168138.1). Accordingly, utilities of GAM3229 include diagnosis, prevention and treatment of diseases and clinical conditions associated with LOC221405.

LOC221601 (Accession XP_168071.1) is another GAM3229 target gene, herein designated TARGET GENE. LOC221601 BINDING SITE is a target binding site found in the 5' untranslated region of mRNA encoded by LOC221601, corresponding to a target binding site such as BINDING SITE I, BINDING SITE II or BINDING SITE III of FIG. 8. Table 4 illustrates the complementarity of the nucleotide sequences of LOC221601 BINDING SITE, designated SEQ ID:4758, to the nucleotide sequence of GAM3229 RNA, herein designated GAM RNA, also designated SEQ ID:221.

Another function of GAM3229 is therefore inhibition of LOC221601 (Accession XP_168071.1). Accordingly, utilities of GAM3229 include diagnosis, prevention and treatment of diseases and clinical conditions associated with LOC221601.

LOC221663 (Accession XP_168131.1) is another GAM3229 target gene, herein designated TARGET GENE. LOC221663 BINDING SITE is a target binding site found in the 5' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:4068, to the nucleotide sequence of GAM3229 RNA, herein designated GAM RNA, also designated SEQ ID:221.

Another function of GAM3229 is therefore inhibition of LOC221663 (Accession XP_168131.1). Accordingly, utilities of GAM3229 include diagnosis, prevention and treatment of diseases and clinical conditions associated with LOC221663.

LOC221946 (Accession XP_168340.1) is another GAM3229 target gene, herein designated TARGET GENE. LOC221946 BINDING SITE is a target binding site found in the 3' untranslated region of mRNA encoded by LOC221946, corresponding to a target binding site such as BINDING SITE I, BINDING SITE II or BINDING SITE III of FIG. 8. Table 4 illustrates the complementarity of the nucleotide sequences of LOC221946 BINDING SITE, designated SEQ ID:17132, to the nucleotide sequence of GAM3229 RNA, herein designated GAM RNA, also designated SEQ ID:221.

Another function of GAM3229 is therefore inhibition of LOC221946 (Accession XP_168340.1). Accordingly, utilities of GAM3229 include diagnosis, prevention and treatment of diseases and clinical conditions associated with LOC221946.

LOC221960 (Accession XP_165859.1) is another GAM3229 target gene, herein designated TARGET GENE. LOC221960 BINDING SITE is a target binding site found in the 3' untranslated region of mRNA encoded by LOC221960, corresponding to a target binding site such as BINDING SITE I, BINDING SITE II or BINDING SITE III of FIG. 8. Table 4 illustrates the complementarity of the nucleotide sequences of LOC221960 BINDING SITE, designated SEQ ID:3459, to the nucleotide sequence of GAM3229 RNA, herein designated GAM RNA, also designated SEQ ID:221.

Another function of GAM3229 is therefore inhibition of LOC221960 (Accession XP_165859.1). Accordingly, utilities of GAM3229 include diagnosis, prevention and treatment of diseases and clinical conditions associated with LOC221960.

LOC222057 (Accession XP_166594.2) is another GAM3229 target gene, herein designated TARGET GENE. LOC222057 BINDING SITE1 and LOC222057 BINDING SITE2 are target binding sites found in untranslated regions of mRNA encoded by LOC222057, corresponding to target binding sites such as BINDING SITE I, BINDING SITE II or BINDING SITE III of FIG. 8. Table 4 illustrates the complementarity of the nucleotide sequences of LOC222057 BINDING SITE1 and LOC222057 BINDING SITE2, designated SEQ ID:8135 and SEQ ID:9877 respectively, to the nucleotide sequence of GAM3229 RNA, herein designated GAM RNA, also designated SEQ ID:221.

Another function of GAM3229 is therefore inhibition of LOC222057 (Accession XP_166594.2). Accordingly, utilities of GAM3229 include diagnosis, prevention and treatment of diseases and clinical conditions associated with LOC222057.

LOC222224 (Accession XP_168473.1) is another GAM3229 target gene, herein designated TARGET GENE. LOC222224 BINDING SITE is a target binding site found in the 5' untranslated region of mRNA encoded by LOC222224, corresponding to a target binding site such as BINDING SITE I, BINDING SITE II or BINDING SITE III of FIG. 8. Table 4 illustrates the complementarity of the nucleotide sequences of LOC222224 BINDING SITE, designated SEQ ID:18096, to the nucleotide sequence of GAM3229 RNA, herein designated GAM RNA, also designated SEQ ID:221.

Another function of GAM3229 is therefore inhibition of LOC222224 (Accession XP_168473.1). Accordingly, utilities of GAM3229 include diagnosis, prevention and treatment of diseases and clinical conditions associated with LOC222224.

LOC252983 (Accession XP_170858.2) is another GAM3229 target gene, herein designated TARGET GENE. LOC252983 BINDING SITE is a target binding site found in the 3' untranslated region of mRNA encoded by LOC252983, corresponding to a target binding site such as BINDING SITE I, BINDING SITE II or BINDING SITE III of FIG. 8. Table 4 illustrates the complementarity of the nucleotide sequences of LOC252983 BINDING SITE, designated SEQ ID:17884, to the nucleotide sequence of GAM3229 RNA, herein designated GAM RNA, also designated SEQ ID:221.

Another function of GAM3229 is therefore inhibition of LOC252983 (Accession XP_170858.2). Accordingly, utilities of GAM3229 include diagnosis, prevention and treatment of diseases and clinical conditions associated with LOC252983.

LOC255131 (Accession XP_171131.1) is another GAM3229 target gene, herein designated TARGET GENE. LOC255131 BINDING SITE is a target binding site found in the 5' untranslated region of mRNA encoded by LOC255131, corresponding to a target binding site such as BINDING SITE I, BINDING SITE II or BINDING SITE III of FIG. 8. Table 4 illustrates the complementarity of the nucleotide sequences of LOC255131 BINDING SITE, designated SEQ ID:1329, to the nucleotide sequence of GAM3229 RNA, herein designated GAM RNA, also designated SEQ ID:221.

Another function of GAM3229 is therefore inhibition of LOC255131 (Accession XP_171131.1). Accordingly, utilities of GAM3229 include diagnosis, prevention and treatment of diseases and clinical conditions associated with LOC255131.

LOC255338 (Accession XP_171105.3) is another GAM3229 target gene, herein designated TARGET GENE. LOC255338 BINDING SITE is a target binding site found in the 5' untranslated region of mRNA encoded by LOC255338, corresponding to a target binding site such as BINDING SITE I, BINDING SITE II or BINDING SITE III of FIG. 8. Table 4 illustrates the complementarity of the nucleotide sequences of LOC255338 BINDING SITE, designated SEQ ID:10003, to the nucleotide sequence of GAM3229 RNA, herein designated GAM RNA, also designated SEQ ID:221.

Another function of GAM3229 is therefore inhibition of LOC255338 (Accession XP_171105.3). Accordingly, utilities of GAM3229 include diagnosis, prevention and treatment of diseases and clinical conditions associated with LOC255338.

LOC255458 (Accession XP_173150.1) is another GAM3229 target gene, herein designated TARGET GENE. LOC255458 BINDING SITE is a target binding site found in the 5' untranslated region of mRNA encoded by LOC255458, corresponding to a target binding site such as BINDING SITE I, BINDING SITE II or BINDING SITE III of FIG. 8. Table 4 illustrates the complementarity of the nucleotide sequences of LOC255458 BINDING SITE, designated SEQ ID:5123, to the nucleotide sequence of GAM3229 RNA, herein designated GAM RNA, also designated SEQ ID:221.

Another function of GAM3229 is therefore inhibition of LOC255458 (Accession XP_173150.1). Accordingly, utilities of GAM3229 include diagnosis, prevention and treatment of diseases and clinical conditions associated with LOC255458.

LOC255975 (Accession XP_171083.2) is another GAM3229 target gene, herein designated TARGET GENE. LOC255975 BINDING SITE1 and LOC255975 BINDING SITE2 are target binding sites found in untranslated regions of mRNA encoded by LOC255975, corresponding to target binding sites such as BINDING SITE I, BINDING SITE II or BINDING SITE III of FIG. 8. Table 4 illustrates the complementarity of the nucleotide sequences of LOC255975 BINDING SITE1 and LOC255975 BINDING SITE2, designated SEQ ID:829 and SEQ ID:8135 respectively, to the nucleotide sequence of GAM3229 RNA, herein designated GAM RNA, also designated SEQ ID:221.

Another function of GAM3229 is therefore inhibition of LOC255975 (Accession XP_171083.2). Accordingly, utilities of GAM3229 include diagnosis, prevention and treatment of diseases and clinical conditions associated with LOC255975.

LOC256614 (Accession XP_172864.1) is another GAM3229 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:14850, to the nucleotide sequence of GAM3229 RNA, herein designated GAM RNA, also designated SEQ ID:221.

Another function of GAM3229 is therefore inhibition of LOC256614 (Accession XP_172864.1). Accordingly, utilities of GAM3229 include diagnosis, prevention and treatment of diseases and clinical conditions associated with LOC256614.

LOC282919 (Accession XP_212607.1) is another GAM3229 target gene, herein designated TARGET GENE. LOC282919 BINDING SITE is a target binding site found in the 5' untranslated region of mRNA encoded by LOC282919, corresponding to a target binding site such as BINDING SITE I, BINDING SITE II or BINDING SITE III of FIG. 8. Table 4 illustrates the complementarity of the nucleotide sequences of LOC282919 BINDING SITE, designated SEQ ID:9471, to the nucleotide sequence of GAM3229 RNA, herein designated GAM RNA, also designated SEQ ID:221.

Another function of GAM3229 is therefore inhibition of LOC282919 (Accession XP_212607.1). Accordingly, utilities of GAM3229 include diagnosis, prevention and treatment of diseases and clinical conditions associated with LOC282919.

LOC282956 (Accession XP_212649.1) is another GAM3229 target gene, herein designated TARGET GENE. LOC282956 BINDING SITE is a target binding site found in the 5' untranslated region of mRNA encoded by LOC282956, corresponding to a target binding site such as BINDING SITE I, BINDING SITE II or BINDING SITE III of FIG. 8. Table 4 illustrates the complementarity of the nucleotide sequences of LOC282956 BINDING SITE, designated SEQ ID:9471, to the nucleotide sequence of GAM3229 RNA, herein designated GAM RNA, also designated SEQ ID:221.

Another function of GAM3229 is therefore inhibition of LOC282956 (Accession XP_212649.1). Accordingly, utilities of GAM3229 include diagnosis, prevention and treatment of diseases and clinical conditions associated with LOC282956.

LOC282980 (Accession XP_210840.1) is another GAM3229 target gene, herein designated TARGET GENE. LOC282980 BINDING SITE is a target binding site found in the 5' untranslated region of mRNA encoded by LOC282980, corresponding to a target binding site such as BINDING SITE I, BINDING SITE II or BINDING SITE III of FIG. 8. Table 4 illustrates the complementarity of the nucleotide sequences of LOC282980 BINDING SITE, designated SEQ ID:3959, to the nucleotide sequence of GAM3229 RNA, herein designated GAM RNA, also designated SEQ ID:221.

Another function of GAM3229 is therefore inhibition of LOC282980 (Accession XP_210840.1). Accordingly, utilities of GAM3229 include diagnosis, prevention and treatment of diseases and clinical conditions associated with LOC282980.

LOC282997 (Accession XP_208473.1) is another GAM3229 target gene, herein designated TARGET GENE. LOC282997 BINDING SITE1 and LOC282997 BINDING SITE2 are target binding sites found in untranslated regions of mRNA encoded by LOC282997, corresponding to target binding sites such as BINDING SITE I, BINDING SITE II or BINDING SITE III of FIG. 8. Table 4 illustrates the complementarity of the nucleotide sequences of LOC282997 BINDING SITE1 and LOC282997 BINDING SITE2, designated SEQ ID:18319 and SEQ ID:3573 respectively, to the nucleotide sequence of GAM3229 RNA, herein designated GAM RNA, also designated SEQ ID:221.

Another function of GAM3229 is therefore inhibition of LOC282997 (Accession XP_208473.1). Accordingly, utilities of GAM3229 include diagnosis, prevention and treatment of diseases and clinical conditions associated with LOC282997.

LOC283031 (Accession XP_210859.1) is another GAM3229 target gene, herein designated TARGET GENE. LOC283031 BINDING SITE is a target binding site found in the 3' untranslated region of mRNA encoded by LOC283031, corresponding to a target binding site such as BINDING SITE I, BINDING SITE II or BINDING SITE III of FIG. 8. Table 4 illustrates the complementarity of the nucleotide sequences of LOC283031 BINDING SITE, designated SEQ ID:7798, to the nucleotide sequence of GAM3229 RNA, herein designated GAM RNA, also designated SEQ ID:221.

Another function of GAM3229 is therefore inhibition of LOC283031 (Accession XP_210859.1). Accordingly, utilities of GAM3229 include diagnosis, prevention and treatment of diseases and clinical conditions associated with LOC283031.

LOC283046 (Accession XP_208495.1) is another GAM3229 target gene, herein designated TARGET GENE. LOC283046 BINDING SITE is a target binding site found in the 5' untranslated region of mRNA encoded by LOC283046, corresponding to a target binding site such as BINDING SITE I, BINDING SITE II or BINDING SITE III of FIG. 8. Table 4 illustrates the complementarity of the nucleotide sequences of LOC283046 BINDING SITE, designated SEQ ID:9872, to the nucleotide sequence of GAM3229 RNA, herein designated GAM RNA, also designated SEQ ID:221.

Another function of GAM3229 is therefore inhibition of LOC283046 (Accession XP_208495.1). Accordingly, utilities of GAM3229 include diagnosis, prevention and treatment of diseases and clinical conditions associated with LOC283046.

LOC283061 (Accession XP_210875.1) is another GAM3229 target gene, herein designated TARGET GENE. LOC283061 BINDING SITE is a target binding site found in the 3' untranslated region of mRNA encoded by LOC283061, corresponding to a target binding site such as BINDING SITE I, BINDING SITE II or BINDING SITE III of FIG. 8. Table 4 illustrates the complementarity of the nucleotide sequences of LOC283061 BINDING SITE, designated SEQ ID:8704, to the nucleotide sequence of GAM3229 RNA, herein designated GAM RNA, also designated SEQ ID:221.

Another function of GAM3229 is therefore inhibition of LOC283061 (Accession XP_210875.1). Accordingly, utilities of GAM3229 include diagnosis, prevention and treatment of diseases and clinical conditions associated with LOC283061.

LOC283089 (Accession XP_210885.1) is another GAM3229 target gene, herein designated TARGET GENE. LOC283089 BINDING SITE is a target binding site found in the 5' untranslated region of mRNA encoded by LOC283089, corresponding to a target binding site such as BINDING SITE I, BINDING SITE II or BINDING SITE III of FIG. 8. Table 4 illustrates the complementarity of the nucleotide sequences of LOC283089 BINDING SITE, designated SEQ ID:2783, to the nucleotide sequence of GAM3229 RNA, herein designated GAM RNA, also designated SEQ ID:221.

Another function of GAM3229 is therefore inhibition of LOC283089 (Accession XP_210885.1). Accordingly, utilities of GAM3229 include diagnosis, prevention and treatment of diseases and clinical conditions associated with LOC283089.

LOC283112 (Accession XP_210890.2) is another GAM3229 target gene, herein designated TARGET GENE. LOC283112 BINDING SITE is a target binding site found in the 3' untranslated region of mRNA encoded by LOC283112, corresponding to a target binding site such as BINDING SITE I, BINDING SITE II or BINDING SITE III of FIG. 8. Table 4 illustrates the complementarity of the nucleotide sequences of LOC283112 BINDING SITE, designated SEQ ID:12579, to the nucleotide sequence of GAM3229 RNA, herein designated GAM RNA, also designated SEQ ID:221.

Another function of GAM3229 is therefore inhibition of LOC283112 (Accession XP_210890.2). Accordingly, utilities of GAM3229 include diagnosis, prevention and treatment of diseases and clinical conditions associated with LOC283112.

LOC283119 (Accession XP_210895.1) is another GAM3229 target gene, herein designated TARGET GENE. LOC283119 BINDING SITE is a target binding site found in the 3' untranslated region of mRNA encoded by LOC283119, corresponding to a target binding site such as BINDING SITE I, BINDING SITE II or BINDING SITE III of FIG. 8. Table 4 illustrates the complementarity of the nucleotide sequences of LOC283119 BINDING SITE, designated SEQ ID:1059, to the nucleotide sequence of GAM3229 RNA, herein designated GAM RNA, also designated SEQ ID:221.

Another function of GAM3229 is therefore inhibition of LOC283119 (Accession XP_210895.1). Accordingly, utilities of GAM3229 include diagnosis, prevention and treatment of diseases and clinical conditions associated with LOC283119.

LOC283120 (Accession XP_208516.1) is another GAM3229 target gene, herein designated TARGET GENE. LOC283120 BINDING SITE is a target binding site found in the 3' untranslated region of mRNA encoded by LOC283120, corresponding to a target binding site such as BINDING SITE I, BINDING SITE II or BINDING SITE III of FIG. 8. Table 4 illustrates the complementarity of the nucleotide sequences of LOC283120 BINDING SITE, designated SEQ ID:18374, to the nucleotide sequence of GAM3229 RNA, herein designated GAM RNA, also designated SEQ ID:221.

Another function of GAM3229 is therefore inhibition of LOC283120 (Accession XP_208516.1). Accordingly, utilities of GAM3229 include diagnosis, prevention and treatment of diseases and clinical conditions associated with LOC283120.

LOC283130 (Accession XP_208525.3) is another GAM3229 target gene, herein designated TARGET GENE. LOC283130 BINDING SITE is a target binding site found in the 3' untranslated region of mRNA encoded by LOC283130, corresponding to a target binding site such as BINDING SITE I, BINDING SITE II or BINDING SITE III of FIG. 8. Table 4 illustrates the complementarity of the nucleotide sequences of LOC283130 BINDING SITE, designated SEQ ID:13623, to the nucleotide sequence of GAM3229 RNA, herein designated GAM RNA, also designated SEQ ID:221.

Another function of GAM3229 is therefore inhibition of LOC283130 (Accession XP_208525.3). Accordingly, utilities of GAM3229 include diagnosis, prevention and treatment of diseases and clinical conditions associated with LOC283130.

LOC283177 (Accession XP_210903.1) is another GAM3229 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:3801, to the nucleotide sequence of GAM3229 RNA, herein designated GAM RNA, also designated SEQ ID:221.

Another function of GAM3229 is therefore inhibition of LOC283177 (Accession XP_210903.1). Accordingly, utilities of GAM3229 include diagnosis, prevention and treatment of diseases and clinical conditions associated with LOC283177.

LOC283215 (Accession XP_208555.2) is another GAM3229 target gene, herein designated TARGET GENE. LOC283215 BINDING SITE is a target binding site found in the 3' untranslated region of mRNA encoded by LOC283215, corresponding to a target binding site such as BINDING SITE I, BINDING SITE II or BINDING SITE III of FIG. 8. Table 4 illustrates the complementarity of the nucleotide sequences of LOC283215 BINDING SITE, designated SEQ ID:7550, to the nucleotide sequence of GAM3229 RNA, herein designated GAM RNA, also designated SEQ ID:221.

Another function of GAM3229 is therefore inhibition of LOC283215 (Accession XP_208555.2). Accordingly, utilities of GAM3229 include diagnosis, prevention and treatment of diseases and clinical conditions associated with LOC283215.

LOC283293 (Accession XP_210962.1) is another GAM3229 target gene, herein designated TARGET GENE. LOC283293 BINDING SITE is a target binding site found in the 3' untranslated region of mRNA encoded by LOC283293, corresponding to a target binding site such as BINDING SITE I, BINDING SITE II or BINDING SITE III of FIG. 8. Table 4 illustrates the complementarity of the nucleotide sequences of LOC283293 BINDING SITE, designated SEQ ID:3960, to the nucleotide sequence of GAM3229 RNA, herein designated GAM RNA, also designated SEQ ID:221.

Another function of GAM3229 is therefore inhibition of LOC283293 (Accession XP_210962.1). Accordingly, utilities of GAM3229 include diagnosis, prevention and treatment of diseases and clinical conditions associated with LOC283293.

LOC283323 (Accession XP_210973.1) is another GAM3229 target gene, herein designated TARGET GENE. LOC283323 BINDING SITE is a target binding site found in the 3' untranslated region of mRNA encoded by LOC283323, corresponding to a target binding site such as BINDING SITE I, BINDING SITE II or BINDING SITE III of FIG. 8. Table 4 illustrates the complementarity of the nucleotide sequences of LOC283323 BINDING SITE, designated SEQ ID:620, to the nucleotide sequence of GAM3229 RNA, herein designated GAM RNA, also designated SEQ ID:221.

Another function of GAM3229 is therefore inhibition of LOC283323 (Accession XP_210973.1). Accordingly, utilities of GAM3229 include diagnosis, prevention and treatment of diseases and clinical conditions associated with LOC283323.

LOC283336 (Accession XP_208620.1) is another GAM3229 target gene, herein designated TARGET GENE. LOC283336 BINDING SITE is a target binding site found in the 5' untranslated region of mRNA encoded by LOC283336, corresponding to a target binding site such as BINDING SITE I, BINDING SITE II or BINDING SITE III of FIG. 8. Table 4 illustrates the complementarity of the nucleotide sequences of LOC283336 BINDING SITE, designated SEQ ID:6969, to the nucleotide sequence of GAM3229 RNA, herein designated GAM RNA, also designated SEQ ID:221.

Another function of GAM3229 is therefore inhibition of LOC283336 (Accession XP_208620.1). Accordingly, utilities of GAM3229 include diagnosis, prevention and treatment of diseases and clinical conditions associated with LOC283336.

LOC283387 (Accession XP_211007.1) is another GAM3229 target gene, herein designated TARGET GENE. LOC283387 BINDING SITE is a target binding site found in the 3' untranslated region of mRNA encoded by LOC283387, corresponding to a target binding site such as BINDING SITE I, BINDING SITE II or BINDING SITE III of FIG. 8. Table 4 illustrates the complementarity of the nucleotide sequences of LOC283387 BINDING SITE, designated SEQ ID:19818, to the nucleotide sequence of GAM3229 RNA, herein designated GAM RNA, also designated SEQ ID:221.

Another function of GAM3229 is therefore inhibition of LOC283387 (Accession XP_211007.1). Accordingly, utilities of GAM3229 include diagnosis, prevention and treatment of diseases and clinical conditions associated with LOC283387.

LOC283394 (Accession XP_211021.1) is another GAM3229 target gene, herein designated TARGET GENE. LOC283394 BINDING SITE is a target binding site found in the 5' untranslated region of mRNA encoded by LOC283394, corresponding to a target binding site such as BINDING SITE I, BINDING SITE II or BINDING SITE III of FIG. 8. Table 4 illustrates the complementarity of the nucleotide sequences of LOC283394 BINDING SITE, designated SEQ ID:9191, to the nucleotide sequence of GAM3229 RNA, herein designated GAM RNA, also designated SEQ ID:221.

Another function of GAM3229 is therefore inhibition of LOC283394 (Accession XP_211021.1). Accordingly, utilities of GAM3229 include diagnosis, prevention and treatment of diseases and clinical conditions associated with LOC283394.

LOC283484 (Accession XP_211053.1) is another GAM3229 target gene, herein designated TARGET GENE. LOC283484 BINDING SITE is a target binding site found in the 5' untranslated region of mRNA encoded by LOC283484, corresponding to a target binding site such as BINDING SITE I, BINDING SITE II or BINDING SITE III of FIG. 8. Table 4 illustrates the complementarity of the nucleotide sequences of LOC283484 BINDING SITE, designated SEQ ID:14686, to the nucleotide sequence of GAM3229 RNA, herein designated GAM RNA, also designated SEQ ID:221.

Another function of GAM3229 is therefore inhibition of LOC283484 (Accession XP_211053.1). Accordingly, utilities of GAM3229 include diagnosis, prevention and treatment of diseases and clinical conditions associated with LOC283484.

LOC283487 (Accession XP_211062.1) is another GAM3229 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:4891, to the nucleotide sequence of GAM3229 RNA, herein designated GAM RNA, also designated SEQ ID:221.

Another function of GAM3229 is therefore inhibition of LOC283487 (Accession XP_211062.1). Accordingly, utilities of GAM3229 include diagnosis, prevention and treatment of diseases and clinical conditions associated with LOC283487.

LOC283551 (Accession XP_211110.1) is another GAM3229 target gene, herein designated TARGET GENE. LOC283551 BINDING SITE1 and LOC283551 BINDING SITE2 are target binding sites found in untranslated regions of mRNA encoded by LOC283551, corresponding to target binding sites such as BINDING SITE I, BINDING SITE II or BINDING SITE III of FIG. 8. Table 4 illustrates the complementarity of the nucleotide sequences of LOC283551 BINDING SITE1 and LOC283551 BINDING SITE2, designated SEQ ID:17293 and SEQ ID:18515 respectively, to the nucleotide sequence of GAM3229 RNA, herein designated GAM RNA, also designated SEQ ID:221.

Another function of GAM3229 is therefore inhibition of LOC283551 (Accession XP_211110.1). Accordingly, utilities of GAM3229 include diagnosis, prevention and treatment of diseases and clinical conditions associated with LOC283551.

LOC283575 (Accession XP_211095.1) is another GAM3229 target gene, herein designated TARGET GENE. LOC283575 BINDING SITE is a target binding site found in the 5' untranslated region of mRNA encoded by LOC283575, corresponding to a target binding site such as BINDING SITE I, BINDING SITE II or BINDING SITE III of FIG. 8. Table 4 illustrates the complementarity of the nucleotide sequences of LOC283575 BINDING SITE, designated SEQ ID:6798, to the nucleotide sequence of GAM3229 RNA, herein designated GAM RNA, also designated SEQ ID:221.

Another function of GAM3229 is therefore inhibition of LOC283575 (Accession XP_211095.1). Accordingly, utilities of GAM3229 include diagnosis, prevention and treatment of diseases and clinical conditions associated with LOC283575.

LOC283590 (Accession XP_208741.1) is another GAM3229 target gene, herein designated TARGET GENE. LOC283590 BINDING SITE is a target binding site found in the 3' untranslated region of mRNA encoded by LOC283590, corresponding to a target binding site such as BINDING SITE I, BINDING SITE II or BINDING SITE III of FIG. 8. Table 4 illustrates the complementarity of the nucleotide sequences of LOC283590 BINDING SITE, designated SEQ ID:1550, to the nucleotide sequence of GAM3229 RNA, herein designated GAM RNA, also designated SEQ ID:221.

Another function of GAM3229 is therefore inhibition of LOC283590 (Accession XP_208741.1). Accordingly, utilities of GAM3229 include diagnosis, prevention and treatment of diseases and clinical conditions associated with LOC283590.

LOC283641 (Accession XP_208764.1) is another GAM3229 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:10286, to the nucleotide sequence of GAM3229 RNA, herein designated GAM RNA, also designated SEQ ID:221.

Another function of GAM3229 is therefore inhibition of LOC283641 (Accession XP_208764.1). Accordingly, utilities of GAM3229 include diagnosis, prevention and treatment of diseases and clinical conditions associated with LOC283641.

LOC283655 (Accession XP_211144.1) is another GAM3229 target gene, herein designated TARGET GENE. LOC283655 BINDING SITE is a target binding site found in the 5' untranslated region of mRNA encoded by LOC283655, corresponding to a target binding site such as BINDING SITE I, BINDING SITE II or BINDING SITE III of FIG. 8. Table 4 illustrates the complementarity of the nucleotide sequences of LOC283655 BINDING SITE, designated SEQ ID:3252, to the nucleotide sequence of GAM3229 RNA, herein designated GAM RNA, also designated SEQ ID:221.

Another function of GAM3229 is therefore inhibition of LOC283655 (Accession XP_211144.1). Accordingly, utilities of GAM3229 include diagnosis, prevention and treatment of diseases and clinical conditions associated with LOC283655.

LOC283728 (Accession XP_211183.3) is another GAM3229 target gene, herein designated TARGET GENE. LOC283728 BINDING SITE is a target binding site found in the 5' untranslated region of mRNA encoded by LOC283728, corresponding to a target binding site such as BINDING SITE I, BINDING SITE II or BINDING SITE III of FIG. 8. Table 4 illustrates the complementarity of the nucleotide sequences of LOC283728 BINDING SITE, designated SEQ ID:19012, to the nucleotide sequence of GAM3229 RNA, herein designated GAM RNA, also designated SEQ ID:221.

Another function of GAM3229 is therefore inhibition of LOC283728 (Accession XP_211183.3). Accordingly, utilities of GAM3229 include diagnosis, prevention and treatment of diseases and clinical conditions associated with LOC283728.

LOC283767 (Accession XP_208835.1) is another GAM3229 target gene, herein designated TARGET GENE. LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:1069, to the nucleotide sequence of GAM3229 RNA, herein designated GAM RNA, also designated SEQ ID:221.

Another function of GAM3229 is therefore inhibition of LOC283767 (Accession XP_208835.1). Accordingly, utilities of GAM3229 include diagnosis, prevention and treatment of diseases and clinical conditions associated with LOC283767.

LOC283889 (Accession XP_208899.1) is another GAM3229 target gene, herein designated TARGET GENE. LOC283889 BINDING SITE is a target binding site found in the 5' untranslated region of mRNA encoded by LOC283889, corresponding to a target binding site such as BINDING SITE I, BINDING SITE II or BINDING SITE III of FIG. 8. Table 4 illustrates the complementarity of the nucleotide sequences of LOC283889 BINDING SITE, designated SEQ ID:12163, to the nucleotide sequence of GAM3229 RNA, herein designated GAM RNA, also designated SEQ ID:221.

Another function of GAM3229 is therefore inhibition of LOC283889 (Accession XP_208899.1). Accordingly, utilities of GAM3229 include diagnosis, prevention and treatment of diseases and clinical conditions associated with LOC283889.

LOC283928 (Accession XP_208909.1) is another GAM3229 target gene, herein designated TARGET GENE. LOC283928 BINDING SITE is a target binding site found in the 5' untranslated region of mRNA encoded by LOC283928, corresponding to a target binding site such as BINDING SITE I, BINDING SITE II or BINDING SITE III of FIG. 8. Table 4 illustrates the complementarity of the nucleotide sequences of LOC283928 BINDING SITE, designated SEQ ID:8866, to the nucleotide sequence of GAM3229 RNA, herein designated GAM RNA, also designated SEQ ID:221.

Another function of GAM3229 is therefore inhibition of LOC283928 (Accession XP_208909.1). Accordingly, utilities of GAM3229 include diagnosis, prevention and treatment of diseases and clinical conditions associated with LOC283928.

LOC284001 (Accession XP_208958.2) is another GAM3229 target gene, herein designated TARGET GENE. LOC284001 BINDING SITE is a target binding site found in the 3' untranslated region of mRNA encoded by LOC284001, corresponding to a target binding site such as BINDING SITE I, BINDING SITE II or BINDING SITE III of FIG. 8. Table 4 illustrates the complementarity of the nucleotide sequences of LOC284001 BINDING SITE, designated SEQ ID:14012, to the nucleotide sequence of GAM3229 RNA, herein designated GAM RNA, also designated SEQ ID:221.

Another function of GAM3229 is therefore inhibition of LOC284001 (Accession XP_208958.2). Accordingly, utilities of GAM3229 include diagnosis, prevention and treatment of diseases and clinical conditions associated with LOC284001.

LOC284016 (Accession XP_211298.1) is another GAM3229 target gene, herein designated TARGET GENE. LOC284016 BINDING SITE is a target binding site found in the 3' untranslated region of mRNA encoded by LOC284016, corresponding to a target binding site such as BINDING SITE I, BINDING SITE II or BINDING SITE III of FIG. 8. Table 4 illustrates the complementarity of the nucleotide sequences of LOC284016 BINDING SITE, designated SEQ ID:2783, to the nucleotide sequence of GAM3229 RNA, herein designated GAM RNA, also designated SEQ ID:221.

Another function of GAM3229 is therefore inhibition of LOC284016 (Accession XP_211298.1). Accordingly, utilities of GAM3229 include diagnosis, prevention and treatment of diseases and clinical conditions associated with LOC284016.

LOC284041 (Accession XP_211309.1) is another GAM3229 target gene, herein designated TARGET GENE. LOC284041 BINDING SITE is a target binding site found in the 3' untranslated region of mRNA encoded by LOC284041, corresponding to a target binding site such as BINDING SITE I, BINDING SITE II or BINDING SITE III of FIG. 8. Table 4 illustrates the complementarity of the nucleotide sequences of LOC284041 BINDING SITE, designated SEQ ID:17544, to the nucleotide sequence of GAM3229 RNA, herein designated GAM RNA, also designated SEQ ID:221.

Another function of GAM3229 is therefore inhibition of LOC284041 (Accession XP_211309.1). Accordingly, utilities of GAM3229 include diagnosis, prevention and treatment of diseases and clinical conditions associated with LOC284041.

LOC284063 (Accession XP_208992.1) is another GAM3229 target gene, herein designated TARGET GENE. LOC284063 BINDING SITE1 and LOC284063 BINDING SITE2 are target binding sites found in untranslated regions of mRNA encoded by LOC284063, corresponding to target binding sites such as BINDING SITE I, BINDING SITE II or BINDING SITE III of FIG. 8. Table 4 illustrates the complementarity of the nucleotide sequences of LOC284063 BINDING SITE1 and LOC284063 BINDING SITE2, designated SEQ ID:7960 and SEQ ID:9729 respectively, to the nucleotide sequence of GAM3229 RNA, herein designated GAM RNA, also designated SEQ ID:221.

Another function of GAM3229 is therefore inhibition of LOC284063 (Accession XP_208992.1). Accordingly, utilities of GAM3229 include diagnosis, prevention and treatment of diseases and clinical conditions associated with LOC284063.

LOC284074 (Accession XP_211321.1) is another GAM3229 target gene, herein designated TARGET GENE. LOC284074 BINDING SITE is a target binding site found in the 3' untranslated region of mRNA encoded by LOC284074, corresponding to a target binding site such as BINDING SITE I, BINDING SITE II or BINDING SITE III of FIG. 8. Table 4 illustrates the complementarity of the nucleotide sequences of LOC284074 BINDING SITE, designated SEQ ID:1935, to the nucleotide sequence of GAM3229 RNA, herein designated GAM RNA, also designated SEQ ID:221.

Another function of GAM3229 is therefore inhibition of LOC284074 (Accession XP_211321.1). Accordingly, utilities of GAM3229 include diagnosis, prevention and treatment of diseases and clinical conditions associated with LOC284074.

LOC284095 (Accession XP_211324.1) is another GAM3229 target gene, herein designated TARGET GENE. LOC284095 BINDING SITE1 through LOC284095 BINDING SITE3 are target binding sites found in untranslated regions of mRNA encoded by LOC284095, corresponding to target binding sites such as BINDING SITE I, BINDING SITE II or BINDING SITE III of FIG. 8. Table 4 illustrates the complementarity of the nucleotide sequences of LOC284095 BINDING SITE1 through LOC284095 BINDING SITE3, designated SEQ ID:6762, SEQ ID:11871 and SEQ ID:3941 respectively, to the nucleotide sequence of GAM3229 RNA, herein designated GAM RNA, also designated SEQ ID:221.

Another function of GAM3229 is therefore inhibition of LOC284095 (Accession XP_211324.1). Accordingly, utilities of GAM3229 include diagnosis, prevention and treatment of diseases and clinical conditions associated with LOC284095.

LOC284098 (Accession XP_209008.3) is another GAM3229 target gene, herein designated TARGET GENE. LOC284098 BINDING SITE is a target binding site found in the 3' untranslated region of mRNA encoded by LOC284098, corresponding to a target binding site such as BINDING SITE I, BINDING SITE II or BINDING SITE III of FIG. 8. Table 4 illustrates the complementarity of the nucleotide sequences of LOC284098 BINDING SITE, designated SEQ ID:10075, to the nucleotide sequence of GAM3229 RNA, herein designated GAM RNA, also designated SEQ ID:221.

Another function of GAM3229 is therefore inhibition of LOC284098 (Accession XP_209008.3). Accordingly, utilities of GAM3229 include diagnosis, prevention and treatment of diseases and clinical conditions associated with LOC284098.

LOC284101 (Accession XP_209019.1) is another GAM3229 target gene, herein designated TARGET GENE. LOC284101 BINDING SITE is a target binding site found in the 5' untranslated region of mRNA encoded by LOC284101, corresponding to a target binding site such as BINDING SITE I, BINDING SITE II or BINDING SITE III of FIG. 8. Table 4 illustrates the complementarity of the nucleotide sequences of LOC284101 BINDING SITE, designated SEQ ID:2800, to the nucleotide sequence of GAM3229 RNA, herein designated GAM RNA, also designated SEQ ID:221.

Another function of GAM3229 is therefore inhibition of LOC284101 (Accession XP_209019.1). Accordingly, utilities of GAM3229 include diagnosis, prevention and treatment of diseases and clinical conditions associated with LOC284101.

LOC284102 (Accession XP_211327.3) is another GAM3229 target gene, herein designated TARGET GENE. LOC284102 BINDING SITE1 through LOC284102 BINDING SITE4 are target binding sites found in untranslated regions of mRNA encoded by LOC284102, corresponding to target binding sites such as BINDING SITE I, BINDING SITE II or BINDING SITE III of FIG. 8. Table 4 illustrates the complementarity of the nucleotide sequences of LOC284102 BINDING SITE1 through LOC284102 BINDING SITE4, designated SEQ ID:6048, SEQ ID:9397, SEQ ID:4684 and SEQ ID:15652 respectively, to the nucleotide sequence of GAM3229 RNA, herein designated GAM RNA, also designated SEQ ID:221.

Another function of GAM3229 is therefore inhibition of LOC284102 (Accession XP_211327.3). Accordingly, utilities of GAM3229 include diagnosis, prevention and treatment of diseases and clinical conditions associated with LOC284102.

LOC284117 (Accession XP_209024.1) is another GAM3229 target gene, herein designated TARGET GENE.

LOC284117 BINDING SITE is a target binding site found in the 3' untranslated region of mRNA encoded by LOC284117, corresponding to a target binding site such as BINDING SITE I, BINDING SITE II or BINDING SITE III of FIG. 8. Table 4 illustrates the complementarity of the nucleotide sequences of LOC284117 BINDING SITE, designated SEQ ID:3205, to the nucleotide sequence of GAM3229 RNA, herein designated GAM RNA, also designated SEQ ID:221.

Another function of GAM3229 is therefore inhibition of LOC284117 (Accession XP_209024.1). Accordingly, utilities of GAM3229 include diagnosis, prevention and treatment of diseases and clinical conditions associated with LOC284117.

LOC284135 (Accession XP_209032.1) is another GAM3229 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:2340, to the nucleotide sequence of GAM3229 RNA, herein designated GAM RNA, also designated SEQ ID:221.

Another function of GAM3229 is therefore inhibition of LOC284135 (Accession XP_209032.1). Accordingly, utilities of GAM3229 include diagnosis, prevention and treatment of diseases and clinical conditions associated with LOC284135.

LOC284183 (Accession XP_209059.1) is another GAM3229 target gene, herein designated TARGET GENE. LOC284183 BINDING SITE1 and LOC284183 BINDING SITE2 are target binding sites found in untranslated regions of mRNA encoded by LOC284183, corresponding to target binding sites such as BINDING SITE I, BINDING SITE II or BINDING SITE III of FIG. 8. Table 4 illustrates the complementarity of the nucleotide sequences of LOC284183 BINDING SITE1 and LOC284183 BINDING SITE2, designated SEQ ID:4891 and SEQ ID:9729 respectively, to the nucleotide sequence of GAM3229 RNA, herein designated GAM RNA, also designated SEQ ID:221.

Another function of GAM3229 is therefore inhibition of LOC284183 (Accession XP_209059.1). Accordingly, utilities of GAM3229 include diagnosis, prevention and treatment of diseases and clinical conditions associated with LOC284183.

LOC284186 (Accession XP_209060.2) is another GAM3229 target gene, herein designated TARGET GENE. LOC284186 BINDING SITE is a target binding site found in the 3' untranslated region of mRNA encoded by LOC284186, corresponding to a target binding site such as BINDING SITE I, BINDING SITE II or BINDING SITE III of FIG. 8. Table 4 illustrates the complementarity of the nucleotide sequences of LOC284186 BINDING SITE, designated SEQ ID:18663, to the nucleotide sequence of GAM3229 RNA, herein designated GAM RNA, also designated SEQ ID:221.

Another function of GAM3229 is therefore inhibition of LOC284186 (Accession XP_209060.2). Accordingly, utilities of GAM3229 include diagnosis, prevention and treatment of diseases and clinical conditions associated with LOC284186.

LOC284191 (Accession XP_211377.1) is another GAM3229 target gene, herein designated TARGET GENE. LOC284191 BINDING SITE is a target binding site found in the 5' untranslated region of mRNA encoded by LOC284191, corresponding to a target binding site such as BINDING SITE I, BINDING SITE II or BINDING SITE III of FIG. 8. Table 4 illustrates the complementarity of the nucleotide sequences of LOC284191 BINDING SITE, designated SEQ ID:6160, to the nucleotide sequence of GAM3229 RNA, herein designated GAM RNA, also designated SEQ ID:221.

Another function of GAM3229 is therefore inhibition of LOC284191 (Accession XP_211377.1). Accordingly, utilities of GAM3229 include diagnosis, prevention and treatment of diseases and clinical conditions associated with LOC284191.

LOC284260 (Accession XP_211408.1) is another GAM3229 target gene, herein designated TARGET GENE. LOC284260 BINDING SITE is a target binding site found in the 3' untranslated region of mRNA encoded by LOC284260, corresponding to a target binding site such as BINDING SITE I, BINDING SITE II or BINDING SITE III of FIG. 8. Table 4 illustrates the complementarity of the nucleotide sequences of LOC284260 BINDING SITE, designated SEQ ID:8657, to the nucleotide sequence of GAM3229 RNA, herein designated GAM RNA, also designated SEQ ID:221.

Another function of GAM3229 is therefore inhibition of LOC284260 (Accession XP_211408.1). Accordingly, utilities of GAM3229 include diagnosis, prevention and treatment of diseases and clinical conditions associated with LOC284260.

LOC284276 (Accession XP_211412.1) is another GAM3229 target gene, herein designated TARGET GENE. LOC284276 BINDING SITE is a target binding site found in the 5' untranslated region of mRNA encoded by LOC284276, corresponding to a target binding site such as BINDING SITE I, BINDING SITE II or BINDING SITE III of FIG. 8. Table 4 illustrates the complementarity of the nucleotide sequences of LOC284276 BINDING SITE, designated SEQ ID:10075, to the nucleotide sequence of GAM3229 RNA, herein designated GAM RNA, also designated SEQ ID:221.

Another function of GAM3229 is therefore inhibition of LOC284276 (Accession XP_211412.1). Accordingly, utilities of GAM3229 include diagnosis, prevention and treatment of diseases and clinical conditions associated with LOC284276.

LOC284294 (Accession XP_211421.1) is another GAM3229 target gene, herein designated TARGET GENE. LOC284294 BINDING SITE is a target binding site found in the 5' untranslated region of mRNA encoded by LOC284294, corresponding to a target binding site such as BINDING SITE I, BINDING SITE II or BINDING SITE III of FIG. 8. Table 4 illustrates the complementarity of the nucleotide sequences of LOC284294 BINDING SITE, designated SEQ ID:13205, to the nucleotide sequence of GAM3229 RNA, herein designated GAM RNA, also designated SEQ ID:221.

Another function of GAM3229 is therefore inhibition of LOC284294 (Accession XP_211421.1). Accordingly, utilities of GAM3229 include diagnosis, prevention and treatment of diseases and clinical conditions associated with LOC284294.

LOC284305 (Accession XP_211425.1) is another GAM3229 target gene, herein designated TARGET GENE. LOC284305 BINDING SITE is a target binding site found in the 5' untranslated region of mRNA encoded by LOC284305, corresponding to a target binding site such as BINDING SITE I, BINDING SITE II or BINDING SITE III of FIG. 8. Table 4 illustrates the complementarity of the nucleotide sequences of LOC284305 BINDING SITE, designated SEQ ID:4957, to the nucleotide sequence of GAM3229 RNA, herein designated GAM RNA, also designated SEQ ID:221.

Another function of GAM3229 is therefore inhibition of LOC284305 (Accession XP_211425.1). Accordingly, utilities of GAM3229 include diagnosis, prevention and treatment of diseases and clinical conditions associated with LOC284305.

LOC284317 (Accession XP_209162.1) is another GAM3229 target gene, herein designated TARGET GENE. LOC284317 BINDING SITE is a target binding site found in the 3' untranslated region of mRNA encoded by LOC284317, corresponding to a target binding site such as BINDING SITE I, BINDING SITE II or BINDING SITE III of FIG. 8. Table 4 illustrates the complementarity of the nucleotide sequences of LOC284317 BINDING SITE, designated SEQ ID:16453, to the nucleotide sequence of GAM3229 RNA, herein designated GAM RNA, also designated SEQ ID:221.

Another function of GAM3229 is therefore inhibition of LOC284317 (Accession XP_209162.1). Accordingly, utilities of GAM3229 include diagnosis, prevention and treatment of diseases and clinical conditions associated with LOC284317.

LOC284337 (Accession XP_211434.1) is another GAM3229 target gene, herein designated TARGET GENE. LOC284337 BINDING SITE is a target binding site found in the 5' untranslated region of mRNA encoded by LOC284337, corresponding to a target binding site such as BINDING SITE I, BINDING SITE II or BINDING SITE III of FIG. 8. Table 4 illustrates the complementarity of the nucleotide sequences of LOC284337 BINDING SITE, designated SEQ ID:12960, to the nucleotide sequence of GAM3229 RNA, herein designated GAM RNA, also designated SEQ ID:221.

Another function of GAM3229 is therefore inhibition of LOC284337 (Accession XP_211434.1). Accordingly, utilities of GAM3229 include diagnosis, prevention and treatment of diseases and clinical conditions associated with LOC284337.

LOC284361 (Accession NP_778233.2) is another GAM3229 target gene, herein designated TARGET GENE. LOC284361 BINDING SITE is a target binding site found in the 5' untranslated region of mRNA encoded by LOC284361, corresponding to a target binding site such as BINDING SITE I, BINDING SITE II or BINDING SITE III of FIG. 8. Table 4 illustrates the complementarity of the nucleotide sequences of LOC284361 BINDING SITE, designated SEQ ID:11166, to the nucleotide sequence of GAM3229 RNA, herein designated GAM RNA, also designated SEQ ID:221.

Another function of GAM3229 is therefore inhibition of LOC284361 (Accession NP_778233.2). Accordingly, utilities of GAM3229 include diagnosis, prevention and treatment of diseases and clinical conditions associated with LOC284361.

LOC284362 (Accession XP_211435.1) is another GAM3229 target gene, herein designated TARGET GENE. LOC284362 BINDING SITE is a target binding site found in the 3' untranslated region of mRNA encoded by LOC284362, corresponding to a target binding site such as BINDING SITE I, BINDING SITE II or BINDING SITE III of FIG. 8. Table 4 illustrates the complementarity of the nucleotide sequences of LOC284362 BINDING SITE, designated SEQ ID:941, to the nucleotide sequence of GAM3229 RNA, herein designated GAM RNA, also designated SEQ ID:221.

Another function of GAM3229 is therefore inhibition of LOC284362 (Accession XP_211435.1). Accordingly, utilities of GAM3229 include diagnosis, prevention and treatment of diseases and clinical conditions associated with LOC284362.

LOC284421 (Accession XP_209200.1) is another GAM3229 target gene, herein designated TARGET GENE. LOC284421 BINDING SITE1 and LOC284421 BINDING SITE2 are target binding sites found in untranslated regions of mRNA encoded by LOC284421, corresponding to target binding sites such as BINDING SITE I, BINDING SITE II or BINDING SITE III of FIG. 8. Table 4 illustrates the complementarity of the nucleotide sequences of LOC284421 BINDING SITE1 and LOC284421 BINDING SITE2, designated SEQ ID:10044 and SEQ ID:2187 respectively, to the nucleotide sequence of GAM3229 RNA, herein designated GAM RNA, also designated SEQ ID:221.

Another function of GAM3229 is therefore inhibition of LOC284421 (Accession XP_209200.1). Accordingly, utilities of GAM3229 include diagnosis, prevention and treatment of diseases and clinical conditions associated with LOC284421.

LOC284426 (Accession XP_209198.1) is another GAM3229 target gene, herein designated TARGET GENE. LOC284426 BINDING SITE1 through LOC284426 BINDING SITE4 are target binding sites found in untranslated regions of mRNA encoded by LOC284426, corresponding to target binding sites such as BINDING SITE I, BINDING SITE II or BINDING SITE III of FIG. 8. Table 4 illustrates the complementarity of the nucleotide sequences of LOC284426 BINDING SITE1 through LOC284426 BINDING SITE4, designated SEQ ID:20053, SEQ ID:19721, SEQ ID:9681 and SEQ ID:7372 respectively, to the nucleotide sequence of GAM3229 RNA, herein designated GAM RNA, also designated SEQ ID:221.

Another function of GAM3229 is therefore inhibition of LOC284426 (Accession XP_209198.1). Accordingly, utilities of GAM3229 include diagnosis, prevention and treatment of diseases and clinical conditions associated with LOC284426.

LOC284436 (Accession XP_290862.1) is another GAM3229 target gene, herein designated TARGET GENE. LOC284436 BINDING SITE is a target binding site found in the 3' untranslated region of mRNA encoded by LOC284436, corresponding to a target binding site such as BINDING SITE I, BINDING SITE II or BINDING SITE III of FIG. 8. Table 4 illustrates the complementarity of the nucleotide sequences of LOC284436 BINDING SITE, designated SEQ ID:19435, to the nucleotide sequence of GAM3229 RNA, herein designated GAM RNA, also designated SEQ ID:221.

Another function of GAM3229 is therefore inhibition of LOC284436 (Accession XP_290862.1). Accordingly, utilities of GAM3229 include diagnosis, prevention and treatment of diseases and clinical conditions associated with LOC284436.

LOC284454 (Accession XP_209216.1) is another GAM3229 target gene, herein designated TARGET GENE. LOC284454 BINDING SITE is a target binding site found in the 5' untranslated region of mRNA encoded by LOC284454, corresponding to a target binding site such as BINDING SITE I, BINDING SITE II or BINDING SITE III of FIG. 8. Table 4 illustrates the complementarity of the nucleotide sequences of LOC284454 BINDING SITE, designated SEQ ID:9887, to the nucleotide sequence of GAM3229 RNA, herein designated GAM RNA, also designated SEQ ID:221.

Another function of GAM3229 is therefore inhibition of LOC284454 (Accession XP_209216.1). Accordingly, utilities of GAM3229 include diagnosis, prevention and treatment of diseases and clinical conditions associated with LOC284454.

LOC284456 (Accession XP_211470.1) is another GAM3229 target gene, herein designated TARGET GENE. LOC284456 BINDING SITE is a target binding site found in the 3' untranslated region of mRNA encoded by LOC284456, corresponding to a target binding site such as BINDING SITE I, BINDING SITE II or BINDING SITE III of FIG. 8. Table 4 illustrates the complementarity of the nucleotide sequences of LOC284456 BINDING SITE, designated SEQ ID:18780, to the nucleotide sequence of GAM3229 RNA, herein designated GAM RNA, also designated SEQ ID:221.

Another function of GAM3229 is therefore inhibition of LOC284456 (Accession XP_211470.1). Accordingly, utilities of GAM3229 include diagnosis, prevention and treatment of diseases and clinical conditions associated with LOC284456.

LOC284464 (Accession XP_209221.1) is another GAM3229 target gene, herein designated TARGET GENE. LOC284464 BINDING SITE is a target binding site found in the 5' untranslated region of mRNA encoded by LOC284464, corresponding to a target binding site such as BINDING SITE I, BINDING SITE II or BINDING SITE III of FIG. 8. Table 4 illustrates the complementarity of the nucleotide sequences of LOC284464 BINDING SITE, designated SEQ ID:6969, to the nucleotide sequence of GAM3229 RNA, herein designated GAM RNA, also designated SEQ ID:221.

Another function of GAM3229 is therefore inhibition of LOC284464 (Accession XP_209221.1). Accordingly, utilities of GAM3229 include diagnosis, prevention and treatment of diseases and clinical conditions associated with LOC284464.

LOC284471 (Accession XP_209225.1) is another GAM3229 target gene, herein designated TARGET GENE. LOC284471 BINDING SITE1 and LOC284471 BINDING SITE2 are target binding sites found in untranslated regions of mRNA encoded by LOC284471, corresponding to target binding sites such as BINDING SITE I, BINDING SITE II or BINDING SITE III of FIG. 8. Table 4 illustrates the complementarity of the nucleotide sequences of LOC284471 BINDING SITE1 and LOC284471 BINDING SITE2, designated SEQ ID:6824 and SEQ ID:6873 respectively, to the nucleotide sequence of GAM3229 RNA, herein designated GAM RNA, also designated SEQ ID:221.

Another function of GAM3229 is therefore inhibition of LOC284471 (Accession XP_209225.1). Accordingly, utilities of GAM3229 include diagnosis, prevention and treatment of diseases and clinical conditions associated with LOC284471.

LOC284475 (Accession XP_211478.1) is another GAM3229 target gene, herein designated TARGET GENE. LOC284475 BINDING SITE is a target binding site found in the 5' untranslated region of mRNA encoded by LOC284475, corresponding to a target binding site such as BINDING SITE I, BINDING SITE II or BINDING SITE III of FIG. 8. Table 4 illustrates the complementarity of the nucleotide sequences of LOC284475 BINDING SITE, designated SEQ ID:6825, to the nucleotide sequence of GAM3229 RNA, herein designated GAM RNA, also designated SEQ ID:221.

Another function of GAM3229 is therefore inhibition of LOC284475 (Accession XP_211478.1). Accordingly, utilities of GAM3229 include diagnosis, prevention and treatment of diseases and clinical conditions associated with LOC284475.

LOC284512 (Accession XP_211500.1) is another GAM3229 target gene, herein designated TARGET GENE. LOC284512 BINDING SITE is a target binding site found in the 3' untranslated region of mRNA encoded by LOC284512, corresponding to a target binding site such as BINDING SITE I, BINDING SITE II or BINDING SITE III of FIG. 8. Table 4 illustrates the complementarity of the nucleotide sequences of LOC284512 BINDING SITE, designated SEQ ID:13007, to the nucleotide sequence of GAM3229 RNA, herein designated GAM RNA, also designated SEQ ID:221.

Another function of GAM3229 is therefore inhibition of LOC284512 (Accession XP_211500.1). Accordingly, utilities of GAM3229 include diagnosis, prevention and treatment of diseases and clinical conditions associated with LOC284512.

LOC284514 (Accession XP_209244.1) is another GAM3229 target gene, herein designated TARGET GENE. LOC284514 BINDING SITE is a target binding site found in the 3' untranslated region of mRNA encoded by LOC284514, corresponding to a target binding site such as BINDING SITE I, BINDING SITE II or BINDING SITE III of FIG. 8. Table 4 illustrates the complementarity of the nucleotide sequences of LOC284514 BINDING SITE, designated SEQ ID:16576, to the nucleotide sequence of GAM3229 RNA, herein designated GAM RNA, also designated SEQ ID:221.

Another function of GAM3229 is therefore inhibition of LOC284514 (Accession XP_209244.1). Accordingly, utilities of GAM3229 include diagnosis, prevention and treatment of diseases and clinical conditions associated with LOC284514.

LOC284568 (Accession XP_209263.1) is another GAM3229 target gene, herein designated TARGET GENE. LOC284568 BINDING SITE is a target binding site found in the 5' untranslated region of mRNA encoded by LOC284568, corresponding to a target binding site such as BINDING SITE I, BINDING SITE II or BINDING SITE III of FIG. 8. Table 4 illustrates the complementarity of the nucleotide sequences of LOC284568 BINDING SITE, designated SEQ ID:4506, to the nucleotide sequence of GAM3229 RNA, herein designated GAM RNA, also designated SEQ ID:221.

Another function of GAM3229 is therefore inhibition of LOC284568 (Accession XP_209263.1). Accordingly, utilities of GAM3229 include diagnosis, prevention and treatment of diseases and clinical conditions associated with LOC284568.

LOC284587 (Accession XP_209278.3) is another GAM3229 target gene, herein designated TARGET GENE. LOC284587 BINDING SITE is a target binding site found in the 5' untranslated region of mRNA encoded by LOC284587, corresponding to a target binding site such as BINDING SITE I, BINDING SITE II or BINDING SITE III of FIG. 8. Table 4 illustrates the complementarity of the nucleotide sequences of LOC284587 BINDING SITE, designated SEQ ID:9877, to the nucleotide sequence of GAM3229 RNA, herein designated GAM RNA, also designated SEQ ID:221.

Another function of GAM3229 is therefore inhibition of LOC284587 (Accession XP_209278.3). Accordingly, utilities of GAM3229 include diagnosis, prevention and treatment of diseases and clinical conditions associated with LOC284587.

LOC284630 (Accession XP_211562.1) is another GAM3229 target gene, herein designated TARGET GENE. LOC284630 BINDING SITE is a target binding site found in the 3' untranslated region of mRNA encoded by LOC284630, corresponding to a target binding site such as BINDING SITE I, BINDING SITE II or BINDING SITE III of FIG. 8. Table 4 illustrates the complementarity of the nucleotide sequences of LOC284630 BINDING SITE, designated SEQ ID:15653, to the nucleotide sequence of GAM3229 RNA, herein designated GAM RNA, also designated SEQ ID:221.

Another function of GAM3229 is therefore inhibition of LOC284630 (Accession XP_211562.1). Accordingly, utilities of GAM3229 include diagnosis, prevention and treatment of diseases and clinical conditions associated with LOC284630.

LOC284701 (Accession XP_294994.1) is another GAM3229 target gene, herein designated TARGET GENE.

LOC284701 BINDING SITE is a target binding site found in the 5' untranslated region of mRNA encoded by LOC284701, corresponding to a target binding site such as BINDING SITE I, BINDING SITE II or BINDING SITE III of FIG. 8. Table 4 illustrates the complementarity of the nucleotide sequences of LOC284701 BINDING SITE, designated SEQ ID:8135, to the nucleotide sequence of GAM3229 RNA, herein designated GAM RNA, also designated SEQ ID:221.

Another function of GAM3229 is therefore inhibition of LOC284701 (Accession XP_294994.1). Accordingly, utilities of GAM3229 include diagnosis, prevention and treatment of diseases and clinical conditions associated with LOC284701.

LOC284723 (Accession XP_211602.1) is another GAM3229 target gene, herein designated TARGET GENE. LOC284723 BINDING SITE is a target binding site found in the 3' untranslated region of mRNA encoded by LOC284723, corresponding to a target binding site such as BINDING SITE I, BINDING SITE II or BINDING SITE III of FIG. 8. Table 4 illustrates the complementarity of the nucleotide sequences of LOC284723 BINDING SITE, designated SEQ ID:1735, to the nucleotide sequence of GAM3229 RNA, herein designated GAM RNA, also designated SEQ ID:221.

Another function of GAM3229 is therefore inhibition of LOC284723 (Accession XP_211602.1). Accordingly, utilities of GAM3229 include diagnosis, prevention and treatment of diseases and clinical conditions associated with LOC284723.

LOC284745 (Accession XP_211620.1) is another GAM3229 target gene, herein designated TARGET GENE. LOC284745 BINDING SITE is a target binding site found in the 3' untranslated region of mRNA encoded by LOC284745, corresponding to a target binding site such as BINDING SITE I, BINDING SITE II or BINDING SITE III of FIG. 8. Table 4 illustrates the complementarity of the nucleotide sequences of LOC284745 BINDING SITE, designated SEQ ID:9999, to the nucleotide sequence of GAM3229 RNA, herein designated GAM RNA, also designated SEQ ID:221.

Another function of GAM3229 is therefore inhibition of LOC284745 (Accession XP_211620.1). Accordingly, utilities of GAM3229 include diagnosis, prevention and treatment of diseases and clinical conditions associated with LOC284745.

LOC284837 (Accession XP_211658.1) is another GAM3229 target gene, herein designated TARGET GENE. LOC284837 BINDING SITE is a target binding site found in the 3' untranslated region of mRNA encoded by LOC284837, corresponding to a target binding site such as BINDING SITE I, BINDING SITE II or BINDING SITE III of FIG. 8. Table 4 illustrates the complementarity of the nucleotide sequences of LOC284837 BINDING SITE, designated SEQ ID:18808, to the nucleotide sequence of GAM3229 RNA, herein designated GAM RNA, also designated SEQ ID:221.

Another function of GAM3229 is therefore inhibition of LOC284837 (Accession XP_211658.1). Accordingly, utilities of GAM3229 include diagnosis, prevention and treatment of diseases and clinical conditions associated with LOC284837.

LOC284865 (Accession XP_211672.1) is another GAM3229 target gene, herein designated TARGET GENE. LOC284865 BINDING SITE1 and LOC284865 BINDING SITE2 are target binding sites found in untranslated regions of mRNA encoded by LOC284865, corresponding to target binding sites such as BINDING SITE I, BINDING SITE II or BINDING SITE III of FIG. 8. Table 4 illustrates the complementarity of the nucleotide sequences of LOC284865 BINDING SITE1 and LOC284865 BINDING SITE2, designated SEQ ID:10282 and SEQ ID:16817 respectively, to the nucleotide sequence of GAM3229 RNA, herein designated GAM RNA, also designated SEQ ID:221.

Another function of GAM3229 is therefore inhibition of LOC284865 (Accession XP_211672.1). Accordingly, utilities of GAM3229 include diagnosis, prevention and treatment of diseases and clinical conditions associated with LOC284865.

LOC284934 (Accession XP_211696.1) is another GAM3229 target gene, herein designated TARGET GENE. LOC284934 BINDING SITE is a target binding site found in the 5' untranslated region of mRNA encoded by LOC284934, corresponding to a target binding site such as BINDING SITE I, BINDING SITE II or BINDING SITE III of FIG. 8. Table 4 illustrates the complementarity of the nucleotide sequences of LOC284934 BINDING SITE, designated SEQ ID:18766, to the nucleotide sequence of GAM3229 RNA, herein designated GAM RNA, also designated SEQ ID:221.

Another function of GAM3229 is therefore inhibition of LOC284934 (Accession XP_211696.1). Accordingly, utilities of GAM3229 include diagnosis, prevention and treatment of diseases and clinical conditions associated with LOC284934.

LOC285001 (Accession XP_211730.1) is another GAM3229 target gene, herein designated TARGET GENE. LOC285001 BINDING SITE is a target binding site found in the 5' untranslated region of mRNA encoded by LOC285001, corresponding to a target binding site such as BINDING SITE I, BINDING SITE II or BINDING SITE III of FIG. 8. Table 4 illustrates the complementarity of the nucleotide sequences of LOC285001 BINDING SITE, designated SEQ ID:18439, to the nucleotide sequence of GAM3229 RNA, herein designated GAM RNA, also designated SEQ ID:221.

Another function of GAM3229 is therefore inhibition of LOC285001 (Accession XP_211730.1). Accordingly, utilities of GAM3229 include diagnosis, prevention and treatment of diseases and clinical conditions associated with LOC285001.

LOC285026 (Accession XP_209440.1) is another GAM3229 target gene, herein designated TARGET GENE. LOC285026 BINDING SITE1 and LOC285026 BINDING SITE2 are target binding sites found in untranslated regions of mRNA encoded by LOC285026, corresponding to target binding sites such as BINDING SITE I, BINDING SITE II or BINDING SITE III of FIG. 8. Table 4 illustrates the complementarity of the nucleotide sequences of LOC285026 BINDING SITE1 and LOC285026 BINDING SITE2, designated SEQ ID:3961 and SEQ ID:6793 respectively, to the nucleotide sequence of GAM3229 RNA, herein designated GAM RNA, also designated SEQ ID:221.

Another function of GAM3229 is therefore inhibition of LOC285026 (Accession XP_209440.1). Accordingly, utilities of GAM3229 include diagnosis, prevention and treatment of diseases and clinical conditions associated with LOC285026.

LOC285033 (Accession XP_211739.1) is another GAM3229 target gene, herein designated TARGET GENE. LOC285033 BINDING SITE is a target binding site found in the 3' untranslated region of mRNA encoded by LOC285033, corresponding to a target binding site such as BINDING SITE I, BINDING SITE II or BINDING SITE III of FIG. 8. Table 4 illustrates the complementarity of the nucleotide sequences of LOC285033 BINDING SITE, designated SEQ ID:16976, to the nucleotide sequence of GAM3229 RNA, herein designated GAM RNA, also designated SEQ ID:221.

Another function of GAM3229 is therefore inhibition of LOC285033 (Accession XP_211739.1). Accordingly, utilities of GAM3229 include diagnosis, prevention and treatment of diseases and clinical conditions associated with LOC285033.

LOC285058 (Accession XP_211753.1) is another GAM3229 target gene, herein designated TARGET GENE. LOC285058 BINDING SITE is a target binding site found in the 5' untranslated region of mRNA encoded by LOC285058, corresponding to a target binding site such as BINDING SITE I, BINDING SITE II or BINDING SITE III of FIG. 8. Table 4 illustrates the complementarity of the nucleotide sequences of LOC285058 BINDING SITE, designated SEQ ID:9309, to the nucleotide sequence of GAM3229 RNA, herein designated GAM RNA, also designated SEQ ID:221.

Another function of GAM3229 is therefore inhibition of LOC285058 (Accession XP_211753.1). Accordingly, utilities of GAM3229 include diagnosis, prevention and treatment of diseases and clinical conditions associated with LOC285058.

LOC285083 (Accession XP_209464.1) is another GAM3229 target gene, herein designated TARGET GENE. LOC285083 BINDING SITE is a target binding site found in the 3' untranslated region of mRNA encoded by LOC285083, corresponding to a target binding site such as BINDING SITE I, BINDING SITE II or BINDING SITE III of FIG. 8. Table 4 illustrates the complementarity of the nucleotide sequences of LOC285083 BINDING SITE, designated SEQ ID:2096, to the nucleotide sequence of GAM3229 RNA, herein designated GAM RNA, also designated SEQ ID:221.

Another function of GAM3229 is therefore inhibition of LOC285083 (Accession XP_209464.1). Accordingly, utilities of GAM3229 include diagnosis, prevention and treatment of diseases and clinical conditions associated with LOC285083.

LOC285088 (Accession XP_209465.1) is another GAM3229 target gene, herein designated TARGET GENE. LOC285088 BINDING SITE1 and LOC285088 BINDING SITE2 are target binding sites found in untranslated regions of mRNA encoded by LOC285088, corresponding to target binding sites such as BINDING SITE I, BINDING SITE II or BINDING SITE III of FIG. 8. Table 4 illustrates the complementarity of the nucleotide sequences of LOC285088 BINDING SITE1 and LOC285088 BINDING SITE2, designated SEQ ID:9680 and SEQ ID:10075 respectively, to the nucleotide sequence of GAM3229 RNA, herein designated GAM RNA, also designated SEQ ID:221.

Another function of GAM3229 is therefore inhibition of LOC285088 (Accession XP_209465.1). Accordingly, utilities of GAM3229 include diagnosis, prevention and treatment of diseases and clinical conditions associated with LOC285088.

LOC285136 (Accession XP_211777.1) is another GAM3229 target gene, herein designated TARGET GENE. LOC285136 BINDING SITE is a target binding site found in the 5' untranslated region of mRNA encoded by LOC285136, corresponding to a target binding site such as BINDING SITE I, BINDING SITE II or BINDING SITE III of FIG. 8. Table 4 illustrates the complementarity of the nucleotide sequences of LOC285136 BINDING SITE, designated SEQ ID:14792, to the nucleotide sequence of GAM3229 RNA, herein designated GAM RNA, also designated SEQ ID:221.

Another function of GAM3229 is therefore inhibition of LOC285136 (Accession XP_211777.1). Accordingly, utilities of GAM3229 include diagnosis, prevention and treatment of diseases and clinical conditions associated with LOC285136.

LOC285221 (Accession XP_209521.1) is another GAM3229 target gene, herein designated TARGET GENE. LOC285221 BINDING SITE is a target binding site found in the 5' untranslated region of mRNA encoded by LOC285221, corresponding to a target binding site such as BINDING SITE I, BINDING SITE II or BINDING SITE III of FIG. 8. Table 4 illustrates the complementarity of the nucleotide sequences of LOC285221 BINDING SITE, designated SEQ ID:6398, to the nucleotide sequence of GAM3229 RNA, herein designated GAM RNA, also designated SEQ ID:221.

Another function of GAM3229 is therefore inhibition of LOC285221 (Accession XP_209521.1). Accordingly, utilities of GAM3229 include diagnosis, prevention and treatment of diseases and clinical conditions associated with LOC285221.

LOC285231 (Accession XP_211813.1) is another GAM3229 target gene, herein designated TARGET GENE. LOC285231 BINDING SITE1 through LOC285231 BINDING SITE3 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231 BINDING SITE1 through LOC285231 BINDING SITE3, designated SEQ ID:7578, SEQ ID:16034 and SEQ ID:8476 respectively, to the nucleotide sequence of GAM3229 RNA, herein designated GAM RNA, also designated SEQ ID:221.

Another function of GAM3229 is therefore inhibition of LOC285231 (Accession XP_211813.1). Accordingly, utilities of GAM3229 include diagnosis, prevention and treatment of diseases and clinical conditions associated with LOC285231.

LOC285299 (Accession XP_209554.1) is another GAM3229 target gene, herein designated TARGET GENE. LOC285299 BINDING SITE is a target binding site found in the 3' untranslated region of mRNA encoded by LOC285299, corresponding to a target binding site such as BINDING SITE I, BINDING SITE II or BINDING SITE III of FIG. 8. Table 4 illustrates the complementarity of the nucleotide sequences of LOC285299 BINDING SITE, designated SEQ ID:2404, to the nucleotide sequence of GAM3229 RNA, herein designated GAM RNA, also designated SEQ ID:221.

Another function of GAM3229 is therefore inhibition of LOC285299 (Accession XP_209554.1). Accordingly, utilities of GAM3229 include diagnosis, prevention and treatment of diseases and clinical conditions associated with LOC285299.

LOC285334 (Accession XP_211844.1) is another GAM3229 target gene, herein designated TARGET GENE. LOC285334 BINDING SITE is a target binding site found in the 3' untranslated region of mRNA encoded by LOC285334, corresponding to a target binding site such as BINDING SITE I, BINDING SITE II or BINDING SITE III of FIG. 8. Table 4 illustrates the complementarity of the nucleotide sequences of LOC285334 BINDING SITE, designated SEQ ID:16422, to the nucleotide sequence of GAM3229 RNA, herein designated GAM RNA, also designated SEQ ID:221.

Another function of GAM3229 is therefore inhibition of LOC285334 (Accession XP_211844.1). Accordingly, utilities of GAM3229 include diagnosis, prevention and treatment of diseases and clinical conditions associated with LOC285334.

LOC285344 (Accession XP_211853.1) is another GAM3229 target gene, herein designated TARGET GENE. LOC285344 BINDING SITE is a target binding site found in the 5' untranslated region of mRNA encoded by LOC285344, corresponding to a target binding site such as BINDING SITE I, BINDING SITE II or BINDING SITE III of FIG. 8. Table 4 illustrates the complementarity of the nucleotide sequences of LOC285344 BINDING SITE, designated SEQ ID:4229, to the nucleotide sequence of GAM3229 RNA, herein designated GAM RNA, also designated SEQ ID:221.

Another function of GAM3229 is therefore inhibition of LOC285344 (Accession XP_211853.1). Accordingly, utilities of GAM3229 include diagnosis, prevention and treatment of diseases and clinical conditions associated with LOC285344.

LOC285345 (Accession XP_211854.1) is another GAM3229 target gene, herein designated TARGET GENE. LOC285345 BINDING SITE is a target binding site found in the 3' untranslated region of mRNA encoded by LOC285345, corresponding to a target binding site such as BINDING SITE I, BINDING SITE II or BINDING SITE III of FIG. 8. Table 4 illustrates the complementarity of the nucleotide sequences of LOC285345 BINDING SITE, designated SEQ ID:2368, to the nucleotide sequence of GAM3229 RNA, herein designated GAM RNA, also designated SEQ ID:221.

Another function of GAM3229 is therefore inhibition of LOC285345 (Accession XP_211854.1). Accordingly, utilities of GAM3229 include diagnosis, prevention and treatment of diseases and clinical conditions associated with LOC285345.

LOC285363 (Accession XP_211870.1) is another GAM3229 target gene, herein designated TARGET GENE. LOC285363 BINDING SITE is a target binding site found in the 5' untranslated region of mRNA encoded by LOC285363, corresponding to a target binding site such as BINDING SITE I, BINDING SITE II or BINDING SITE III of FIG. 8. Table 4 illustrates the complementarity of the nucleotide sequences of LOC285363 BINDING SITE, designated SEQ ID:14046, to the nucleotide sequence of GAM3229 RNA, herein designated GAM RNA, also designated SEQ ID:221.

Another function of GAM3229 is therefore inhibition of LOC285363 (Accession XP_211870.1). Accordingly, utilities of GAM3229 include diagnosis, prevention and treatment of diseases and clinical conditions associated with LOC285363.

LOC285398 (Accession XP_209593.1) is another GAM3229 target gene, herein designated TARGET GENE. LOC285398 BINDING SITE is a target binding site found in the 3' untranslated region of mRNA encoded by LOC285398, corresponding to a target binding site such as BINDING SITE I, BINDING SITE II or BINDING SITE III of FIG. 8. Table 4 illustrates the complementarity of the nucleotide sequences of LOC285398 BINDING SITE, designated SEQ ID:10964, to the nucleotide sequence of GAM3229 RNA, herein designated GAM RNA, also designated SEQ ID:221.

Another function of GAM3229 is therefore inhibition of LOC285398 (Accession XP_209593.1). Accordingly, utilities of GAM3229 include diagnosis, prevention and treatment of diseases and clinical conditions associated with LOC285398.

LOC285540 (Accession XP_209654.1) is another GAM3229 target gene, herein designated TARGET GENE. LOC285540 BINDING SITE is a target binding site found in the 5' untranslated region of mRNA encoded by LOC285540, corresponding to a target binding site such as BINDING SITE I, BINDING SITE II or BINDING SITE III of FIG. 8. Table 4 illustrates the complementarity of the nucleotide sequences of LOC285540 BINDING SITE, designated SEQ ID:18955, to the nucleotide sequence of GAM3229 RNA, herein designated GAM RNA, also designated SEQ ID:221.

Another function of GAM3229 is therefore inhibition of LOC285540 (Accession XP_209654.1). Accordingly, utilities of GAM3229 include diagnosis, prevention and treatment of diseases and clinical conditions associated with LOC285540.

LOC285587 (Accession XP_211947.1) is another GAM3229 target gene, herein designated TARGET GENE. LOC285587 BINDING SITE is a target binding site found in the 3' untranslated region of mRNA encoded by LOC285587, corresponding to a target binding site such as BINDING SITE I, BINDING SITE II or BINDING SITE III of FIG. 8. Table 4 illustrates the complementarity of the nucleotide sequences of LOC285587 BINDING SITE, designated SEQ ID:12848, to the nucleotide sequence of GAM3229 RNA, herein designated GAM RNA, also designated SEQ ID:221.

Another function of GAM3229 is therefore inhibition of LOC285587 (Accession XP_211947.1). Accordingly, utilities of GAM3229 include diagnosis, prevention and treatment of diseases and clinical conditions associated with LOC285587.

LOC285589 (Accession XP_209671.1) is another GAM3229 target gene, herein designated TARGET GENE. LOC285589 BINDING SITE1 and LOC285589 BINDING SITE2 are target binding sites found in untranslated regions of mRNA encoded by LOC285589, corresponding to target binding sites such as BINDING SITE I, BINDING SITE II or BINDING SITE III of FIG. 8. Table 4 illustrates the complementarity of the nucleotide sequences of LOC285589 BINDING SITE1 and LOC285589 BINDING SITE2, designated SEQ ID:11982 and SEQ ID:6398 respectively, to the nucleotide sequence of GAM3229 RNA, herein designated GAM RNA, also designated SEQ ID:221.

Another function of GAM3229 is therefore inhibition of LOC285589 (Accession XP_209671.1). Accordingly, utilities of GAM3229 include diagnosis, prevention and treatment of diseases and clinical conditions associated with LOC285589.

LOC285626 (Accession XP_211959.1) is another GAM3229 target gene, herein designated TARGET GENE. LOC285626 BINDING SITE is a target binding site found in the 5' untranslated region of mRNA encoded by LOC285626, corresponding to a target binding site such as BINDING SITE I, BINDING SITE II or BINDING SITE III of FIG. 8. Table 4 illustrates the complementarity of the nucleotide sequences of LOC285626 BINDING SITE, designated SEQ ID:14142, to the nucleotide sequence of GAM3229 RNA, herein designated GAM RNA, also designated SEQ ID:221.

Another function of GAM3229 is therefore inhibition of LOC285626 (Accession XP_211959.1). Accordingly, utilities of GAM3229 include diagnosis, prevention and treatment of diseases and clinical conditions associated with LOC285626.

LOC285638 (Accession XP_209693.1) is another GAM3229 target gene, herein designated TARGET GENE. LOC285638 BINDING SITE is a target binding site found in the 5' untranslated region of mRNA encoded by LOC285638, corresponding to a target binding site such as BINDING SITE I, BINDING SITE II or BINDING SITE III of FIG. 8. Table 4 illustrates the complementarity of the nucleotide sequences of LOC285638 BINDING SITE, designated SEQ ID:1800, to the nucleotide sequence of GAM3229 RNA, herein designated GAM RNA, also designated SEQ ID:221.

Another function of GAM3229 is therefore inhibition of LOC285638 (Accession XP_209693.1). Accordingly, utilities of GAM3229 include diagnosis, prevention and treatment of diseases and clinical conditions associated with LOC285638.

LOC285683 (Accession XP_211980.1) is another GAM3229 target gene, herein designated TARGET GENE.

LOC285683 BINDING SITE is a target binding site found in the 5' untranslated region of mRNA encoded by LOC285683, corresponding to a target binding site such as BINDING SITE I, BINDING SITE II or BINDING SITE III of FIG. 8. Table 4 illustrates the complementarity of the nucleotide sequences of LOC285683 BINDING SITE, designated SEQ ID:14636, to the nucleotide sequence of GAM3229 RNA, herein designated GAM RNA, also designated SEQ ID:221.

Another function of GAM3229 is therefore inhibition of LOC285683 (Accession XP_211980.1). Accordingly, utilities of GAM3229 include diagnosis, prevention and treatment of diseases and clinical conditions associated with LOC285683.

LOC285722 (Accession XP_211997.1) is another GAM3229 target gene, herein designated TARGET GENE. LOC285722 BINDING SITE is a target binding site found in the 5' untranslated region of mRNA encoded by LOC285722, corresponding to a target binding site such as BINDING SITE I, BINDING SITE II or BINDING SITE III of FIG. 8. Table 4 illustrates the complementarity of the nucleotide sequences of LOC285722 BINDING SITE, designated SEQ ID:19086, to the nucleotide sequence of GAM3229 RNA, herein designated GAM RNA, also designated SEQ ID:221.

Another function of GAM3229 is therefore inhibition of LOC285722 (Accession XP_211997.1). Accordingly, utilities of GAM3229 include diagnosis, prevention and treatment of diseases and clinical conditions associated with LOC285722.

LOC285744 (Accession XP_209743.1) is another GAM3229 target gene, herein designated TARGET GENE. LOC285744 BINDING SITE1 and LOC285744 BINDING SITE2 are target binding sites found in untranslated regions of mRNA encoded by LOC285744, corresponding to target binding sites such as BINDING SITE I, BINDING SITE II or BINDING SITE III of FIG. 8. Table 4 illustrates the complementarity of the nucleotide sequences of LOC285744 BINDING SITE1 and LOC285744 BINDING SITE2, designated SEQ ID:8764 and SEQ ID:17380 respectively, to the nucleotide sequence of GAM3229 RNA, herein designated GAM RNA, also designated SEQ ID:221.

Another function of GAM3229 is therefore inhibition of LOC285744 (Accession XP_209743.1). Accordingly, utilities of GAM3229 include diagnosis, prevention and treatment of diseases and clinical conditions associated with LOC285744.

LOC285747 (Accession XP_209742.1) is another GAM3229 target gene, herein designated TARGET GENE. LOC285747 BINDING SITE1 and LOC285747 BINDING SITE2 are target binding sites found in untranslated regions of mRNA encoded by LOC285747, corresponding to target binding sites such as BINDING SITE I, BINDING SITE II or BINDING SITE III of FIG. 8. Table 4 illustrates the complementarity of the nucleotide sequences of LOC285747 BINDING SITE1 and LOC285747 BINDING SITE2, designated SEQ ID:6072 and SEQ ID:13313 respectively, to the nucleotide sequence of GAM3229 RNA, herein designated GAM RNA, also designated SEQ ID:221.

Another function of GAM3229 is therefore inhibition of LOC285747 (Accession XP_209742.1). Accordingly, utilities of GAM3229 include diagnosis, prevention and treatment of diseases and clinical conditions associated with LOC285747.

LOC285749 (Accession XP_212010.1) is another GAM3229 target gene, herein designated TARGET GENE. LOC285749 BINDING SITE is a target binding site found in the 5' untranslated region of mRNA encoded by LOC285749, corresponding to a target binding site such as BINDING SITE I, BINDING SITE II or BINDING SITE III of FIG. 8. Table 4 illustrates the complementarity of the nucleotide sequences of LOC285749 BINDING SITE, designated SEQ ID:4758, to the nucleotide sequence of GAM3229 RNA, herein designated GAM RNA, also designated SEQ ID:221.

Another function of GAM3229 is therefore inhibition of LOC285749 (Accession XP_212010.1). Accordingly, utilities of GAM3229 include diagnosis, prevention and treatment of diseases and clinical conditions associated with LOC285749.

LOC285760 (Accession XP_209750.1) is another GAM3229 target gene, herein designated TARGET GENE. LOC285760 BINDING SITE is a target binding site found in the 3' untranslated region of mRNA encoded by LOC285760, corresponding to a target binding site such as BINDING SITE I, BINDING SITE II or BINDING SITE III of FIG. 8. Table 4 illustrates the complementarity of the nucleotide sequences of LOC285760 BINDING SITE, designated SEQ ID:10409, to the nucleotide sequence of GAM3229 RNA, herein designated GAM RNA, also designated SEQ ID:221.

Another function of GAM3229 is therefore inhibition of LOC285760 (Accession XP_209750.1). Accordingly, utilities of GAM3229 include diagnosis, prevention and treatment of diseases and clinical conditions associated with LOC285760.

LOC285822 (Accession XP_209777.1) is another GAM3229 target gene, herein designated TARGET GENE. LOC285822 BINDING SITE is a target binding site found in the 3' untranslated region of mRNA encoded by LOC285822, corresponding to a target binding site such as BINDING SITE I, BINDING SITE II or BINDING SITE III of FIG. 8. Table 4 illustrates the complementarity of the nucleotide sequences of LOC285822 BINDING SITE, designated SEQ ID:6398, to the nucleotide sequence of GAM3229 RNA, herein designated GAM RNA, also designated SEQ ID:221.

Another function of GAM3229 is therefore inhibition of LOC285822 (Accession XP_209777.1). Accordingly, utilities of GAM3229 include diagnosis, prevention and treatment of diseases and clinical conditions associated with LOC285822.

LOC285835 (Accession XP_212057.1) is another GAM3229 target gene, herein designated TARGET GENE. LOC285835 BINDING SITE is a target binding site found in the 5' untranslated region of mRNA encoded by LOC285835, corresponding to a target binding site such as BINDING SITE I, BINDING SITE II or BINDING SITE III of FIG. 8. Table 4 illustrates the complementarity of the nucleotide sequences of LOC285835 BINDING SITE, designated SEQ ID:9471, to the nucleotide sequence of GAM3229 RNA, herein designated GAM RNA, also designated SEQ ID:221.

Another function of GAM3229 is therefore inhibition of LOC285835 (Accession XP_212057.1). Accordingly, utilities of GAM3229 include diagnosis, prevention and treatment of diseases and clinical conditions associated with LOC285835.

LOC285842 (Accession XP_212041.1) is another GAM3229 target gene, herein designated TARGET GENE. LOC285842 BINDING SITE is a target binding site found in the 5' untranslated region of mRNA encoded by LOC285842, corresponding to a target binding site such as BINDING SITE I, BINDING SITE II or BINDING SITE III of FIG. 8. Table 4 illustrates the complementarity of the nucleotide sequences of LOC285842 BINDING SITE, designated SEQ ID:10492, to the nucleotide sequence of GAM3229 RNA, herein designated GAM RNA, also designated SEQ ID:221.

Another function of GAM3229 is therefore inhibition of LOC285842 (Accession XP_212041.1). Accordingly, utilities of GAM3229 include diagnosis, prevention and treatment of diseases and clinical conditions associated with LOC285842.

LOC285843 (Accession XP_212034.1) is another GAM3229 target gene, herein designated TARGET GENE. LOC285843 BINDING SITE is a target binding site found in the 3' untranslated region of mRNA encoded by LOC285843, corresponding to a target binding site such as BINDING SITE I, BINDING SITE II or BINDING SITE III of FIG. 8. Table 4 illustrates the complementarity of the nucleotide sequences of LOC285843 BINDING SITE, designated SEQ ID:10152, to the nucleotide sequence of GAM3229 RNA, herein designated GAM RNA, also designated SEQ ID:221.

Another function of GAM3229 is therefore inhibition of LOC285843 (Accession XP_212034.1). Accordingly, utilities of GAM3229 include diagnosis, prevention and treatment of diseases and clinical conditions associated with LOC285843.

LOC285847 (Accession XP_212045.1) is another GAM3229 target gene, herein designated TARGET GENE. LOC285847 BINDING SITE is a target binding site found in the 5' untranslated region of mRNA encoded by LOC285847, corresponding to a target binding site such as BINDING SITE I, BINDING SITE II or BINDING SITE III of FIG. 8. Table 4 illustrates the complementarity of the nucleotide sequences of LOC285847 BINDING SITE, designated SEQ ID:10601, to the nucleotide sequence of GAM3229 RNA, herein designated GAM RNA, also designated SEQ ID:221.

Another function of GAM3229 is therefore inhibition of LOC285847 (Accession XP_212045.1). Accordingly, utilities of GAM3229 include diagnosis, prevention and treatment of diseases and clinical conditions associated with LOC285847.

LOC285922 (Accession XP_209822.1) is another GAM3229 target gene, herein designated TARGET GENE. LOC285922 BINDING SITE is a target binding site found in the 3' untranslated region of mRNA encoded by LOC285922, corresponding to a target binding site such as BINDING SITE I, BINDING SITE II or BINDING SITE III of FIG. 8. Table 4 illustrates the complementarity of the nucleotide sequences of LOC285922 BINDING SITE, designated SEQ ID:8542, to the nucleotide sequence of GAM3229 RNA, herein designated GAM RNA, also designated SEQ ID:221.

Another function of GAM3229 is therefore inhibition of LOC285922 (Accession XP_209822.1). Accordingly, utilities of GAM3229 include diagnosis, prevention and treatment of diseases and clinical conditions associated with LOC285922.

LOC285923 (Accession XP_212104.1) is another GAM3229 target gene, herein designated TARGET GENE. LOC285923 BINDING SITE is a target binding site found in the 3' untranslated region of mRNA encoded by LOC285923, corresponding to a target binding site such as BINDING SITE I, BINDING SITE II or BINDING SITE III of FIG. 8. Table 4 illustrates the complementarity of the nucleotide sequences of LOC285923 BINDING SITE, designated SEQ ID:7843, to the nucleotide sequence of GAM3229 RNA, herein designated GAM RNA, also designated SEQ ID:221.

Another function of GAM3229 is therefore inhibition of LOC285923 (Accession XP_212104.1). Accordingly, utilities of GAM3229 include diagnosis, prevention and treatment of diseases and clinical conditions associated with LOC285923.

LOC285930 (Accession XP_209818.1) is another GAM3229 target gene, herein designated TARGET GENE. LOC285930 BINDING SITE1 and LOC285930 BINDING SITE2 are target binding sites found in untranslated regions of mRNA encoded by LOC285930, corresponding to target binding sites such as BINDING SITE I, BINDING SITE II or BINDING SITE III of FIG. 8. Table 4 illustrates the complementarity of the nucleotide sequences of LOC285930 BINDING SITE1 and LOC285930 BINDING SITE2, designated SEQ ID:6763 and SEQ ID:18902 respectively, to the nucleotide sequence of GAM3229 RNA, herein designated GAM RNA, also designated SEQ ID:221.

Another function of GAM3229 is therefore inhibition of LOC285930 (Accession XP_209818.1). Accordingly, utilities of GAM3229 include diagnosis, prevention and treatment of diseases and clinical conditions associated with LOC285930.

LOC285958 (Accession XP_212099.1) is another GAM3229 target gene, herein designated TARGET GENE. LOC285958 BINDING SITE is a target binding site found in the 5' untranslated region of mRNA encoded by LOC285958, corresponding to a target binding site such as BINDING SITE I, BINDING SITE II or BINDING SITE III of FIG. 8. Table 4 illustrates the complementarity of the nucleotide sequences of LOC285958 BINDING SITE, designated SEQ ID:10240, to the nucleotide sequence of GAM3229 RNA, herein designated GAM RNA, also designated SEQ ID:221.

Another function of GAM3229 is therefore inhibition of LOC285958 (Accession XP_212099.1). Accordingly, utilities of GAM3229 include diagnosis, prevention and treatment of diseases and clinical conditions associated with LOC285958.

LOC285961 (Accession XP_209833.1) is another GAM3229 target gene, herein designated TARGET GENE. LOC285961 BINDING SITE is a target binding site found in the 3' untranslated region of mRNA encoded by LOC285961, corresponding to a target binding site such as BINDING SITE I, BINDING SITE II or BINDING SITE III of FIG. 8. Table 4 illustrates the complementarity of the nucleotide sequences of LOC285961 BINDING SITE, designated SEQ ID:12547, to the nucleotide sequence of GAM3229 RNA, herein designated GAM RNA, also designated SEQ ID:221.

Another function of GAM3229 is therefore inhibition of LOC285961 (Accession XP_209833.1). Accordingly, utilities of GAM3229 include diagnosis, prevention and treatment of diseases and clinical conditions associated with LOC285961.

LOC285969 (Accession XP_209842.1) is another GAM3229 target gene, herein designated TARGET GENE. LOC285969 BINDING SITE is a target binding site found in the 3' untranslated region of mRNA encoded by LOC285969, corresponding to a target binding site such as BINDING SITE I, BINDING SITE II or BINDING SITE III of FIG. 8. Table 4 illustrates the complementarity of the nucleotide sequences of LOC285969 BINDING SITE, designated SEQ ID:1953, to the nucleotide sequence of GAM3229 RNA, herein designated GAM RNA, also designated SEQ ID:221.

Another function of GAM3229 is therefore inhibition of LOC285969 (Accession XP_209842.1). Accordingly, utilities of GAM3229 include diagnosis, prevention and treatment of diseases and clinical conditions associated with LOC285969.

LOC285972 (Accession XP_212105.1) is another GAM3229 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:9694, to the nucleotide sequence of GAM3229 RNA, herein designated GAM RNA, also designated SEQ ID:221.

Another function of GAM3229 is therefore inhibition of LOC285972 (Accession XP_212105.1). Accordingly, utilities of GAM3229 include diagnosis, prevention and treatment of diseases and clinical conditions associated with LOC285972.

LOC285999 (Accession XP_212120.1) is another GAM3229 target gene, herein designated TARGET GENE. LOC285999 BINDING SITE is a target binding site found in the 3' untranslated region of mRNA encoded by LOC285999, corresponding to a target binding site such as BINDING SITE I, BINDING SITE II or BINDING SITE III of FIG. 8. Table 4 illustrates the complementarity of the nucleotide sequences of LOC285999 BINDING SITE, designated SEQ ID:11099, to the nucleotide sequence of GAM3229 RNA, herein designated GAM RNA, also designated SEQ ID:221.

Another function of GAM3229 is therefore inhibition of LOC285999 (Accession XP_212120.1). Accordingly, utilities of GAM3229 include diagnosis, prevention and treatment of diseases and clinical conditions associated with LOC285999.

LOC286029 (Accession XP_209866.1) is another GAM3229 target gene, herein designated TARGET GENE. LOC286029 BINDING SITE is a target binding site found in the 3' untranslated region of mRNA encoded by LOC286029, corresponding to a target binding site such as BINDING SITE I, BINDING SITE II or BINDING SITE III of FIG. 8. Table 4 illustrates the complementarity of the nucleotide sequences of LOC286029 BINDING SITE, designated SEQ ID:3117, to the nucleotide sequence of GAM3229 RNA, herein designated GAM RNA, also designated SEQ ID:221.

Another function of GAM3229 is therefore inhibition of LOC286029 (Accession XP_209866.1). Accordingly, utilities of GAM3229 include diagnosis, prevention and treatment of diseases and clinical conditions associated with LOC286029.

LOC286058 (Accession XP_212158.1) is another GAM3229 target gene, herein designated TARGET GENE. LOC286058 BINDING SITE is a target binding site found in the 3' untranslated region of mRNA encoded by LOC286058, corresponding to a target binding site such as BINDING SITE I, BINDING SITE II or BINDING SITE III of FIG. 8. Table 4 illustrates the complementarity of the nucleotide sequences of LOC286058 BINDING SITE, designated SEQ ID:15856, to the nucleotide sequence of GAM3229 RNA, herein designated GAM RNA, also designated SEQ ID:221.

Another function of GAM3229 is therefore inhibition of LOC286058 (Accession XP_212158.1). Accordingly, utilities of GAM3229 include diagnosis, prevention and treatment of diseases and clinical conditions associated with LOC286058.

LOC286078 (Accession XP_212163.1) is another GAM3229 target gene, herein designated TARGET GENE. LOC286078 BINDING SITE1 and LOC286078 BINDING SITE2 are target binding sites found in untranslated regions of mRNA encoded by LOC286078, corresponding to target binding sites such as BINDING SITE I, BINDING SITE II or BINDING SITE III of FIG. 8. Table 4 illustrates the complementarity of the nucleotide sequences of LOC286078 BINDING SITE1 and LOC286078 BINDING SITE2, designated SEQ ID:8047 and SEQ ID:13047 respectively, to the nucleotide sequence of GAM3229 RNA, herein designated GAM RNA, also designated SEQ ID:221.

Another function of GAM3229 is therefore inhibition of LOC286078 (Accession XP_212163.1). Accordingly, utilities of GAM3229 include diagnosis, prevention and treatment of diseases and clinical conditions associated with LOC286078.

LOC286103 (Accession NP_848630.1) is another GAM3229 target gene, herein designated TARGET GENE. LOC286103 BINDING SITE is a target binding site found in the 3' untranslated region of multiple transcripts of mRNA encoded by LOC286103, corresponding to a target binding site such as BINDING SITE I, BINDING SITE II or BINDING SITE III of FIG. 8. Table 4 illustrates the complementarity of the nucleotide sequences of LOC286103 BINDING SITE, designated SEQ ID:5123, to the nucleotide sequence of GAM3229 RNA, herein designated GAM RNA, also designated SEQ ID:221.

Another function of GAM3229 is therefore inhibition of LOC286103 (Accession NP_848630.1). Accordingly, utilities of GAM3229 include diagnosis, prevention and treatment of diseases and clinical conditions associated with LOC286103.

LOC286103 (Accession XP_209897.1) is another GAM3229 target gene, herein designated TARGET GENE. LOC286103 BINDING SITE is a target binding site found in the 3' untranslated region of multiple transcripts of mRNA encoded by LOC286103, corresponding to a target binding site such as BINDING SITE I, BINDING SITE II or BINDING SITE III of FIG. 8. Table 4 illustrates the complementarity of the nucleotide sequences of LOC286103 BINDING SITE, designated SEQ ID:5123, to the nucleotide sequence of GAM3229 RNA, herein designated GAM RNA, also designated SEQ ID:221.

Another function of GAM3229 is therefore inhibition of LOC286103 (Accession XP_209897.1). Accordingly, utilities of GAM3229 include diagnosis, prevention and treatment of diseases and clinical conditions associated with LOC286103.

LOC286186 (Accession XP_212219.1) is another GAM3229 target gene, herein designated TARGET GENE. LOC286186 BINDING SITE is a target binding site found in the 5' untranslated region of mRNA encoded by LOC286186, corresponding to a target binding site such as BINDING SITE I, BINDING SITE II or BINDING SITE III of FIG. 8. Table 4 illustrates the complementarity of the nucleotide sequences of LOC286186 BINDING SITE, designated SEQ ID:5503, to the nucleotide sequence of GAM3229 RNA, herein designated GAM RNA, also designated SEQ ID:221.

Another function of GAM3229 is therefore inhibition of LOC286186 (Accession XP_212219.1). Accordingly, utilities of GAM3229 include diagnosis, prevention and treatment of diseases and clinical conditions associated with LOC286186.

LOC286191 (Accession XP_212217.1) is another GAM3229 target gene, herein designated TARGET GENE. LOC286191 BINDING SITE is a target binding site found in the 3' untranslated region of mRNA encoded by LOC286191, corresponding to a target binding site such as BINDING SITE I, BINDING SITE II or BINDING SITE III of FIG. 8. Table 4 illustrates the complementarity of the nucleotide sequences of LOC286191 BINDING SITE, designated SEQ ID:5905, to the nucleotide sequence of GAM3229 RNA, herein designated GAM RNA, also designated SEQ ID:221.

Another function of GAM3229 is therefore inhibition of LOC286191 (Accession XP_212217.1). Accordingly, utilities of GAM3229 include diagnosis, prevention and treatment of diseases and clinical conditions associated with LOC286191.

LOC286207 (Accession XP_209941.1) is another GAM3229 target gene, herein designated TARGET GENE.

LOC286207 BINDING SITE is a target binding site found in the 3' untranslated region of mRNA encoded by LOC286207, corresponding to a target binding site such as BINDING SITE I, BINDING SITE II or BINDING SITE III of FIG. 8. Table 4 illustrates the complementarity of the nucleotide sequences of LOC286207 BINDING SITE, designated SEQ ID:15150, to the nucleotide sequence of GAM3229 RNA, herein designated GAM RNA, also designated SEQ ID:221.

Another function of GAM3229 is therefore inhibition of LOC286207 (Accession XP_209941.1). Accordingly, utilities of GAM3229 include diagnosis, prevention and treatment of diseases and clinical conditions associated with LOC286207.

LOC286208 (Accession XP_212230.1) is another GAM3229 target gene, herein designated TARGET GENE. LOC286208 BINDING SITE1 and LOC286208 BINDING SITE2 are target binding sites found in untranslated regions of mRNA encoded by LOC286208, corresponding to target binding sites such as BINDING SITE I, BINDING SITE II or BINDING SITE III of FIG. 8. Table 4 illustrates the complementarity of the nucleotide sequences of LOC286208 BINDING SITE1 and LOC286208 BINDING SITE2, designated SEQ ID:12103 and SEQ ID:18679 respectively, to the nucleotide sequence of GAM3229 RNA, herein designated GAM RNA, also designated SEQ ID:221.

Another function of GAM3229 is therefore inhibition of LOC286208 (Accession XP_212230.1). Accordingly, utilities of GAM3229 include diagnosis, prevention and treatment of diseases and clinical conditions associated with LOC286208.

LOC286334 (Accession XP_303033.1) is another GAM3229 target gene, herein designated TARGET GENE. LOC286334 BINDING SITE is a target binding site found in the 5' untranslated region of mRNA encoded by LOC286334, corresponding to a target binding site such as BINDING SITE I, BINDING SITE II or BINDING SITE III of FIG. 8. Table 4 illustrates the complementarity of the nucleotide sequences of LOC286334 BINDING SITE, designated SEQ ID:10661, to the nucleotide sequence of GAM3229 RNA, herein designated GAM RNA, also designated SEQ ID:221.

Another function of GAM3229 is therefore inhibition of LOC286334 (Accession XP_303033.1). Accordingly, utilities of GAM3229 include diagnosis, prevention and treatment of diseases and clinical conditions associated with LOC286334.

LOC286341 (Accession XP_212278.1) is another GAM3229 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:10075, to the nucleotide sequence of GAM3229 RNA, herein designated GAM RNA, also designated SEQ ID:221.

Another function of GAM3229 is therefore inhibition of LOC286341 (Accession XP_212278.1). Accordingly, utilities of GAM3229 include diagnosis, prevention and treatment of diseases and clinical conditions associated with LOC286341.

LOC286356 (Accession XP_212290.1) is another GAM3229 target gene, herein designated TARGET GENE. LOC286356 BINDING SITE is a target binding site found in the 5' untranslated region of mRNA encoded by LOC286356, corresponding to a target binding site such as BINDING SITE I, BINDING SITE II or BINDING SITE III of FIG. 8. Table 4 illustrates the complementarity of the nucleotide sequences of LOC286356 BINDING SITE, designated SEQ ID:13314, to the nucleotide sequence of GAM3229 RNA, herein designated GAM RNA, also designated SEQ ID:221.

Another function of GAM3229 is therefore inhibition of LOC286356 (Accession XP_212290.1). Accordingly, utilities of GAM3229 include diagnosis, prevention and treatment of diseases and clinical conditions associated with LOC286356.

LOC286359 (Accession XP_212288.1) is another GAM3229 target gene, herein designated TARGET GENE. LOC286359 BINDING SITE is a target binding site found in the 3' untranslated region of mRNA encoded by LOC286359, corresponding to a target binding site such as BINDING SITE I, BINDING SITE II or BINDING SITE III of FIG. 8. Table 4 illustrates the complementarity of the nucleotide sequences of LOC286359 BINDING SITE, designated SEQ ID:16003, to the nucleotide sequence of GAM3229 RNA, herein designated GAM RNA, also designated SEQ ID:221.

Another function of GAM3229 is therefore inhibition of LOC286359 (Accession XP_212288.1). Accordingly, utilities of GAM3229 include diagnosis, prevention and treatment of diseases and clinical conditions associated with LOC286359.

LOC286401 (Accession XP_212310.1) is another GAM3229 target gene, herein designated TARGET GENE. LOC286401 BINDING SITE is a target binding site found in the 5' untranslated region of mRNA encoded by LOC286401, corresponding to a target binding site such as BINDING SITE I, BINDING SITE II or BINDING SITE III of FIG. 8. Table 4 illustrates the complementarity of the nucleotide sequences of LOC286401 BINDING SITE, designated SEQ ID:1364, to the nucleotide sequence of GAM3229 RNA, herein designated GAM RNA, also designated SEQ ID:221.

Another function of GAM3229 is therefore inhibition of LOC286401 (Accession XP_212310.1). Accordingly, utilities of GAM3229 include diagnosis, prevention and treatment of diseases and clinical conditions associated with LOC286401.

LOC286435 (Accession XP_210047.1) is another GAM3229 target gene, herein designated TARGET GENE. LOC286435 BINDING SITE is a target binding site found in the 3' untranslated region of mRNA encoded by LOC286435, corresponding to a target binding site such as BINDING SITE I, BINDING SITE II or BINDING SITE III of FIG. 8. Table 4 illustrates the complementarity of the nucleotide sequences of LOC286435 BINDING SITE, designated SEQ ID:6220, to the nucleotide sequence of GAM3229 RNA, herein designated GAM RNA, also designated SEQ ID:221.

Another function of GAM3229 is therefore inhibition of LOC286435 (Accession XP_210047.1). Accordingly, utilities of GAM3229 include diagnosis, prevention and treatment of diseases and clinical conditions associated with LOC286435.

LOC286437 (Accession XP_210050.1) is another GAM3229 target gene, herein designated TARGET GENE. LOC286437 BINDING SITE is a target binding site found in the 5' untranslated region of mRNA encoded by LOC286437, corresponding to a target binding site such as BINDING SITE I, BINDING SITE II or BINDING SITE III of FIG. 8. Table 4 illustrates the complementarity of the nucleotide sequences of LOC286437 BINDING SITE, designated SEQ ID:15960, to the nucleotide sequence of GAM3229 RNA, herein designated GAM RNA, also designated SEQ ID:221.

Another function of GAM3229 is therefore inhibition of LOC286437 (Accession XP_210050.1). Accordingly, utilities of GAM3229 include diagnosis, prevention and treatment of diseases and clinical conditions associated with LOC286437.

LOC286441 (Accession XP_212319.1) is another GAM3229 target gene, herein designated TARGET GENE. LOC286441 BINDING SITE is a target binding site found in the 3' untranslated region of mRNA encoded by LOC286441, corresponding to a target binding site such as BINDING SITE I, BINDING SITE II or BINDING SITE III of FIG. 8. Table 4 illustrates the complementarity of the nucleotide sequences of LOC286441 BINDING SITE, designated SEQ ID:9998, to the nucleotide sequence of GAM3229 RNA, herein designated GAM RNA, also designated SEQ ID:221.

Another function of GAM3229 is therefore inhibition of LOC286441 (Accession XP_212319.1). Accordingly, utilities of GAM3229 include diagnosis, prevention and treatment of diseases and clinical conditions associated with LOC286441.

LOC338575 (Accession XP_290473.1) is another GAM3229 target gene, herein designated TARGET GENE. LOC338575 BINDING SITE is a target binding site found in the 3' untranslated region of mRNA encoded by LOC338575, corresponding to a target binding site such as BINDING SITE I, BINDING SITE II or BINDING SITE III of FIG. 8. Table 4 illustrates the complementarity of the nucleotide sequences of LOC338575 BINDING SITE, designated SEQ ID:16337, to the nucleotide sequence of GAM3229 RNA, herein designated GAM RNA, also designated SEQ ID:221.

Another function of GAM3229 is therefore inhibition of LOC338575 (Accession XP_290473.1). Accordingly, utilities of GAM3229 include diagnosis, prevention and treatment of diseases and clinical conditions associated with LOC338575.

LOC338612 (Accession XP_294668.1) is another GAM3229 target gene, herein designated TARGET GENE. LOC338612 BINDING SITE is a target binding site found in the 5' untranslated region of mRNA encoded by LOC338612, corresponding to a target binding site such as BINDING SITE I, BINDING SITE II or BINDING SITE III of FIG. 8. Table 4 illustrates the complementarity of the nucleotide sequences of LOC338612 BINDING SITE, designated SEQ ID:5199, to the nucleotide sequence of GAM3229 RNA, herein designated GAM RNA, also designated SEQ ID:221.

Another function of GAM3229 is therefore inhibition of LOC338612 (Accession XP_294668.1). Accordingly, utilities of GAM3229 include diagnosis, prevention and treatment of diseases and clinical conditions associated with LOC338612.

LOC338645 (Accession XP_290494.1) is another GAM3229 target gene, herein designated TARGET GENE. LOC338645 BINDING SITE1 and LOC338645 BINDING SITE2 are target binding sites found in untranslated regions of mRNA encoded by LOC338645, corresponding to target binding sites such as BINDING SITE I, BINDING SITE II or BINDING SITE III of FIG. 8. Table 4 illustrates the complementarity of the nucleotide sequences of LOC338645 BINDING SITE1 and LOC338645 BINDING SITE2, designated SEQ ID:13444 and SEQ ID:2827 respectively, to the nucleotide sequence of GAM3229 RNA, herein designated GAM RNA, also designated SEQ ID:221.

Another function of GAM3229 is therefore inhibition of LOC338645 (Accession XP_290494.1). Accordingly, utilities of GAM3229 include diagnosis, prevention and treatment of diseases and clinical conditions associated with LOC338645.

LOC338709 (Accession XP_211595.2) is another GAM3229 target gene, herein designated TARGET GENE. LOC338709 BINDING SITE1 and LOC338709 BINDING SITE2 are target binding sites found in untranslated regions of mRNA encoded by LOC338709, corresponding to target binding sites such as BINDING SITE I, BINDING SITE II or BINDING SITE III of FIG. 8. Table 4 illustrates the complementarity of the nucleotide sequences of LOC338709 BINDING SITE1 and LOC338709 BINDING SITE2, designated SEQ ID:8135 and SEQ ID:9877 respectively, to the nucleotide sequence of GAM3229 RNA, herein designated GAM RNA, also designated SEQ ID:221.

Another function of GAM3229 is therefore inhibition of LOC338709 (Accession XP_211595.2). Accordingly, utilities of GAM3229 include diagnosis, prevention and treatment of diseases and clinical conditions associated with LOC338709.

LOC338773 (Accession XP_290570.1) is another GAM3229 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:9515, to the nucleotide sequence of GAM3229 RNA, herein designated GAM RNA, also designated SEQ ID:221.

Another function of GAM3229 is therefore inhibition of LOC338773 (Accession XP_290570.1). Accordingly, utilities of GAM3229 include diagnosis, prevention and treatment of diseases and clinical conditions associated with LOC338773.

LOC338799 (Accession NP_848633.1) is another GAM3229 target gene, herein designated TARGET GENE. LOC338799 BINDING SITE is a target binding site found in the 5' untranslated region of multiple transcripts of mRNA encoded by LOC338799, corresponding to a target binding site such as BINDING SITE I, BINDING SITE II or BINDING SITE III of FIG. 8. Table 4 illustrates the complementarity of the nucleotide sequences of LOC338799 BINDING SITE, designated SEQ ID:14539, to the nucleotide sequence of GAM3229 RNA, herein designated GAM RNA, also designated SEQ ID:221.

Another function of GAM3229 is therefore inhibition of LOC338799 (Accession NP_848633.1). Accordingly, utilities of GAM3229 include diagnosis, prevention and treatment of diseases and clinical conditions associated with LOC338799.

LOC338817 (Accession XP_290588.1) is another GAM3229 target gene, herein designated TARGET GENE. LOC338817 BINDING SITE is a target binding site found in the 3' untranslated region of mRNA encoded by LOC338817, corresponding to a target binding site such as BINDING SITE I, BINDING SITE II or BINDING SITE III of FIG. 8. Table 4 illustrates the complementarity of the nucleotide sequences of LOC338817 BINDING SITE, designated SEQ ID:19436, to the nucleotide sequence of GAM3229 RNA, herein designated GAM RNA, also designated SEQ ID:221.

Another function of GAM3229 is therefore inhibition of LOC338817 (Accession XP_290588.1). Accordingly, utilities of GAM3229 include diagnosis, prevention and treatment of diseases and clinical conditions associated with LOC338817.

LOC338864 (Accession XP_294731.1) is another GAM3229 target gene, herein designated TARGET GENE. LOC338864 BINDING SITE is a target binding site found in the 3' untranslated region of mRNA encoded by LOC338864, corresponding to a target binding site such as BINDING SITE I, BINDING SITE II or BINDING SITE III of FIG. 8. Table 4 illustrates the complementarity of the nucleotide sequences of LOC338864 BINDING SITE, designated SEQ ID:16899, to the nucleotide sequence of GAM3229 RNA, herein designated GAM RNA, also designated SEQ ID:221.

Another function of GAM3229 is therefore inhibition of LOC338864 (Accession XP_294731.1). Accordingly, utilities of GAM3229 include diagnosis, prevention and treatment of diseases and clinical conditions associated with LOC338864.

LOC338899 (Accession XP_294740.1) is another GAM3229 target gene, herein designated TARGET GENE. LOC338899 BINDING SITE is a target binding site found in the 5' untranslated region of mRNA encoded by LOC338899, corresponding to a target binding site such as BINDING SITE I, BINDING SITE II or BINDING SITE III of FIG. 8. Table 4 illustrates the complementarity of the nucleotide sequences of LOC338899 BINDING SITE, designated SEQ ID:8395, to the nucleotide sequence of GAM3229 RNA, herein designated GAM RNA, also designated SEQ ID:221.

Another function of GAM3229 is therefore inhibition of LOC338899 (Accession XP_294740.1). Accordingly, utilities of GAM3229 include diagnosis, prevention and treatment of diseases and clinical conditions associated with LOC338899.

LOC338917 (Accession XP_290610.1) is another GAM3229 target gene, herein designated TARGET GENE. LOC338917 BINDING SITE is a target binding site found in the 3' untranslated region of mRNA encoded by LOC338917, corresponding to a target binding site such as BINDING SITE I, BINDING SITE II or BINDING SITE III of FIG. 8. Table 4 illustrates the complementarity of the nucleotide sequences of LOC338917 BINDING SITE, designated SEQ ID:8024, to the nucleotide sequence of GAM3229 RNA, herein designated GAM RNA, also designated SEQ ID:221.

Another function of GAM3229 is therefore inhibition of LOC338917 (Accession XP_290610.1). Accordingly, utilities of GAM3229 include diagnosis, prevention and treatment of diseases and clinical conditions associated with LOC338917.

LOC338991 (Accession XP_290663.1) is another GAM3229 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:1069, to the nucleotide sequence of GAM3229 RNA, herein designated GAM RNA, also designated SEQ ID:221.

Another function of GAM3229 is therefore inhibition of LOC338991 (Accession XP_290663.1). Accordingly, utilities of GAM3229 include diagnosis, prevention and treatment of diseases and clinical conditions associated with LOC338991.

LOC338999 (Accession XP_290659.1) is another GAM3229 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:1069, to the nucleotide sequence of GAM3229 RNA, herein designated GAM RNA, also designated SEQ ID:221.

Another function of GAM3229 is therefore inhibition of LOC338999 (Accession XP_290659.1). Accordingly, utilities of GAM3229 include diagnosis, prevention and treatment of diseases and clinical conditions associated with LOC338999.

LOC339077 (Accession XP_294802.2) is another GAM3229 target gene, herein designated TARGET GENE. LOC339077 BINDING SITE is a target binding site found in the 3' untranslated region of mRNA encoded by LOC339077, corresponding to a target binding site such as BINDING SITE I, BINDING SITE II or BINDING SITE III of FIG. 8. Table 4 illustrates the complementarity of the nucleotide sequences of LOC339077 BINDING SITE, designated SEQ ID:9695, to the nucleotide sequence of GAM3229 RNA, herein designated GAM RNA, also designated SEQ ID:221.

Another function of GAM3229 is therefore inhibition of LOC339077 (Accession XP_294802.2). Accordingly, utilities of GAM3229 include diagnosis, prevention and treatment of diseases and clinical conditions associated with LOC339077.

LOC339078 (Accession XP_290692.1) is another GAM3229 target gene, herein designated TARGET GENE. LOC339078 BINDING SITE is a target binding site found in the 3' untranslated region of mRNA encoded by LOC339078, corresponding to a target binding site such as BINDING SITE I, BINDING SITE II or BINDING SITE III of FIG. 8. Table 4 illustrates the complementarity of the nucleotide sequences of LOC339078 BINDING SITE, designated SEQ ID:9304, to the nucleotide sequence of GAM3229 RNA, herein designated GAM RNA, also designated SEQ ID:221.

Another function of GAM3229 is therefore inhibition of LOC339078 (Accession XP_290692.1). Accordingly, utilities of GAM3229 include diagnosis, prevention and treatment of diseases and clinical conditions associated with LOC339078.

LOC339091 (Accession XP_290239.1) is another GAM3229 target gene, herein designated TARGET GENE. LOC339091 BINDING SITE is a target binding site found in the 5' untranslated region of mRNA encoded by LOC339091, corresponding to a target binding site such as BINDING SITE I, BINDING SITE II or BINDING SITE III of FIG. 8. Table 4 illustrates the complementarity of the nucleotide sequences of LOC339091 BINDING SITE, designated SEQ ID:13820, to the nucleotide sequence of GAM3229 RNA, herein designated GAM RNA, also designated SEQ ID:221.

Another function of GAM3229 is therefore inhibition of LOC339091 (Accession XP_290239.1). Accordingly, utilities of GAM3229 include diagnosis, prevention and treatment of diseases and clinical conditions associated with LOC339091.

LOC339146 (Accession XP_294825.1) is another GAM3229 target gene, herein designated TARGET GENE. LOC339146 BINDING SITE is a target binding site found in the 5' untranslated region of mRNA encoded by LOC339146, corresponding to a target binding site such as BINDING SITE I, BINDING SITE II or BINDING SITE III of FIG. 8. Table 4 illustrates the complementarity of the nucleotide sequences of LOC339146 BINDING SITE, designated SEQ ID:2752, to the nucleotide sequence of GAM3229 RNA, herein designated GAM RNA, also designated SEQ ID:221.

Another function of GAM3229 is therefore inhibition of LOC339146 (Accession XP_294825.1). Accordingly, utilities of GAM3229 include diagnosis, prevention and treatment of diseases and clinical conditions associated with LOC339146.

LOC339178 (Accession XP_290742.1) is another GAM3229 target gene, herein designated TARGET GENE. LOC339178 BINDING SITE is a target binding site found in the 3' untranslated region of mRNA encoded by LOC339178, corresponding to a target binding site such as BINDING SITE I, BINDING SITE II or BINDING SITE III of FIG. 8. Table 4 illustrates the complementarity of the nucleotide sequences of LOC339178 BINDING SITE, designated SEQ ID:19259, to the nucleotide sequence of GAM3229 RNA, herein designated GAM RNA, also designated SEQ ID:221.

Another function of GAM3229 is therefore inhibition of LOC339178 (Accession XP_290742.1). Accordingly, utilities of GAM3229 include diagnosis, prevention and treatment of diseases and clinical conditions associated with LOC339178.

LOC339201 (Accession XP_290756.1) is another GAM3229 target gene, herein designated TARGET GENE. LOC339201 BINDING SITE is a target binding site found in the 3' untranslated region of mRNA encoded by LOC339201, corresponding to a target binding site such as BINDING SITE I, BINDING SITE II or BINDING SITE III of FIG. 8. Table 4 illustrates the complementarity of the nucleotide sequences of LOC339201 BINDING SITE, designated SEQ ID:7031, to the nucleotide sequence of GAM3229 RNA, herein designated GAM RNA, also designated SEQ ID:221.

Another function of GAM3229 is therefore inhibition of LOC339201 (Accession XP_290756.1). Accordingly, utilities of GAM3229 include diagnosis, prevention and treatment of diseases and clinical conditions associated with LOC339201.

LOC339216 (Accession XP_290762.2) is another GAM3229 target gene, herein designated TARGET GENE. LOC339216 BINDING SITE is a target binding site found in the 5' untranslated region of mRNA encoded by LOC339216, corresponding to a target binding site such as BINDING SITE I, BINDING SITE II or BINDING SITE III of FIG. 8. Table 4 illustrates the complementarity of the nucleotide sequences of LOC339216 BINDING SITE, designated SEQ ID:2800, to the nucleotide sequence of GAM3229 RNA, herein designated GAM RNA, also designated SEQ ID:221.

Another function of GAM3229 is therefore inhibition of LOC339216 (Accession XP_290762.2). Accordingly, utilities of GAM3229 include diagnosis, prevention and treatment of diseases and clinical conditions associated with LOC339216.

LOC339282 (Accession XP_294900.2) is another GAM3229 target gene, herein designated TARGET GENE. LOC339282 BINDING SITE is a target binding site found in the 5' untranslated region of mRNA encoded by LOC339282, corresponding to a target binding site such as BINDING SITE I, BINDING SITE II or BINDING SITE III of FIG. 8. Table 4 illustrates the complementarity of the nucleotide sequences of LOC339282 BINDING SITE, designated SEQ ID:2800, to the nucleotide sequence of GAM3229 RNA, herein designated GAM RNA, also designated SEQ ID:221.

Another function of GAM3229 is therefore inhibition of LOC339282 (Accession XP_294900.2). Accordingly, utilities of GAM3229 include diagnosis, prevention and treatment of diseases and clinical conditions associated with LOC339282.

LOC339283 (Accession XP_294899.2) is another GAM3229 target gene, herein designated TARGET GENE. LOC339283 BINDING SITE1 and LOC339283 BINDING SITE2 are target binding sites found in untranslated regions of mRNA encoded by LOC339283, corresponding to target binding sites such as BINDING SITE I, BINDING SITE II or BINDING SITE III of FIG. 8. Table 4 illustrates the complementarity of the nucleotide sequences of LOC339283 BINDING SITE1 and LOC339283 BINDING SITE2, designated SEQ ID:12131 and SEQ ID:2800 respectively, to the nucleotide sequence of GAM3229 RNA, herein designated GAM RNA, also designated SEQ ID:221.

Another function of GAM3229 is therefore inhibition of LOC339283 (Accession XP_294899.2). Accordingly, utilities of GAM3229 include diagnosis, prevention and treatment of diseases and clinical conditions associated with LOC339283.

LOC339325 (Accession XP_290830.1) is another GAM3229 target gene, herein designated TARGET GENE. LOC339325 BINDING SITE1 and LOC339325 BINDING SITE2 are target binding sites found in untranslated regions of mRNA encoded by LOC339325, corresponding to target binding sites such as BINDING SITE I, BINDING SITE II or BINDING SITE III of FIG. 8. Table 4 illustrates the complementarity of the nucleotide sequences of LOC339325 BINDING SITE1 and LOC339325 BINDING SITE2, designated SEQ ID:20083 and SEQ ID:9527 respectively, to the nucleotide sequence of GAM3229 RNA, herein designated GAM RNA, also designated SEQ ID:221.

Another function of GAM3229 is therefore inhibition of LOC339325 (Accession XP_290830.1). Accordingly, utilities of GAM3229 include diagnosis, prevention and treatment of diseases and clinical conditions associated with LOC339325.

LOC339400 (Accession XP_294926.1) is another GAM3229 target gene, herein designated TARGET GENE. LOC339400 BINDING SITE is a target binding site found in the 3' untranslated region of mRNA encoded by LOC339400, corresponding to a target binding site such as BINDING SITE I, BINDING SITE II or BINDING SITE III of FIG. 8. Table 4 illustrates the complementarity of the nucleotide sequences of LOC339400 BINDING SITE, designated SEQ ID:17876, to the nucleotide sequence of GAM3229 RNA, herein designated GAM RNA, also designated SEQ ID:221.

Another function of GAM3229 is therefore inhibition of LOC339400 (Accession XP_294926.1). Accordingly, utilities of GAM3229 include diagnosis, prevention and treatment of diseases and clinical conditions associated with LOC339400.

LOC339459 (Accession XP_290907.2) is another GAM3229 target gene, herein designated TARGET GENE. LOC339459 BINDING SITE1 and LOC339459 BINDING SITE2 are target binding sites found in untranslated regions of mRNA encoded by LOC339459, corresponding to target binding sites such as BINDING SITE I, BINDING SITE II or BINDING SITE III of FIG. 8. Table 4 illustrates the complementarity of the nucleotide sequences of LOC339459 BINDING SITE1 and LOC339459 BINDING SITE2, designated SEQ ID:537 and SEQ ID:4044 respectively, to the nucleotide sequence of GAM3229 RNA, herein designated GAM RNA, also designated SEQ ID:221.

Another function of GAM3229 is therefore inhibition of LOC339459 (Accession XP_290907.2). Accordingly, utilities of GAM3229 include diagnosis, prevention and treatment of diseases and clinical conditions associated with LOC339459.

LOC339492 (Accession XP_290919.1) is another GAM3229 target gene, herein designated TARGET GENE. LOC339492 BINDING SITE1 and LOC339492 BINDING SITE2 are target binding sites found in untranslated regions of mRNA encoded by LOC339492, corresponding to target binding sites such as BINDING SITE I, BINDING SITE II or BINDING SITE III of FIG. 8. Table 4 illustrates the complementarity of the nucleotide sequences of LOC339492 BINDING SITE1 and LOC339492 BINDING SITE2, designated SEQ ID:3503 and SEQ ID:1590 respectively, to the nucleotide sequence of GAM3229 RNA, herein designated GAM RNA, also designated SEQ ID:221.

Another function of GAM3229 is therefore inhibition of LOC339492 (Accession XP_290919.1). Accordingly, utilities of GAM3229 include diagnosis, prevention and treatment of diseases and clinical conditions associated with LOC339492.

LOC339577 (Accession XP_295005.1) is another GAM3229 target gene, herein designated TARGET GENE. LOC339577 BINDING SITE is a target binding site found in the 3' untranslated region of mRNA encoded by LOC339577, corresponding to a target binding site such as BINDING SITE I, BINDING SITE II or BINDING SITE III of FIG. 8. Table 4 illustrates the complementarity of the nucleotide sequences of LOC339577 BINDING SITE, designated SEQ ID:18440, to the nucleotide sequence of GAM3229 RNA, herein designated GAM RNA, also designated SEQ ID:221.

Another function of GAM3229 is therefore inhibition of LOC339577 (Accession XP_295005.1). Accordingly, utilities of GAM3229 include diagnosis, prevention and treatment of diseases and clinical conditions associated with LOC339577.

LOC339600 (Accession XP_295014.1) is another GAM3229 target gene, herein designated TARGET GENE. LOC339600 BINDING SITE is a target binding site found in the 3' untranslated region of mRNA encoded by LOC339600, corresponding to a target binding site such as BINDING SITE I, BINDING SITE II or BINDING SITE III of FIG. 8. Table 4 illustrates the complementarity of the nucleotide sequences of LOC339600 BINDING SITE, designated SEQ ID:18533, to the nucleotide sequence of GAM3229 RNA, herein designated GAM RNA, also designated SEQ ID:221.

Another function of GAM3229 is therefore inhibition of LOC339600 (Accession XP_295014.1). Accordingly, utilities of GAM3229 include diagnosis, prevention and treatment of diseases and clinical conditions associated with LOC339600.

LOC339635 (Accession XP_293210.2) is another GAM3229 target gene, herein designated TARGET GENE. LOC339635 BINDING SITE is a target binding site found in the 5' untranslated region of mRNA encoded by LOC339635, corresponding to a target binding site such as BINDING SITE I, BINDING SITE II or BINDING SITE III of FIG. 8. Table 4 illustrates the complementarity of the nucleotide sequences of LOC339635 BINDING SITE, designated SEQ ID:19918, to the nucleotide sequence of GAM3229 RNA, herein designated GAM RNA, also designated SEQ ID:221.

Another function of GAM3229 is therefore inhibition of LOC339635 (Accession XP_293210.2). Accordingly, utilities of GAM3229 include diagnosis, prevention and treatment of diseases and clinical conditions associated with LOC339635.

LOC339685 (Accession XP_295032.1) is another GAM3229 target gene, herein designated TARGET GENE. LOC339685 BINDING SITE is a target binding site found in the 5' untranslated region of mRNA encoded by LOC339685, corresponding to a target binding site such as BINDING SITE I, BINDING SITE II or BINDING SITE III of FIG. 8. Table 4 illustrates the complementarity of the nucleotide sequences of LOC339685 BINDING SITE, designated SEQ ID:19789, to the nucleotide sequence of GAM3229 RNA, herein designated GAM RNA, also designated SEQ ID:221.

Another function of GAM3229 is therefore inhibition of LOC339685 (Accession XP_295032.1). Accordingly, utilities of GAM3229 include diagnosis, prevention and treatment of diseases and clinical conditions associated with LOC339685.

LOC339694 (Accession XP_295035.1) is another GAM3229 target gene, herein designated TARGET GENE. LOC339694 BINDING SITE1 and LOC339694 BINDING SITE2 are target binding sites found in untranslated regions of mRNA encoded by LOC339694, corresponding to target binding sites such as BINDING SITE I, BINDING SITE II or BINDING SITE III of FIG. 8. Table 4 illustrates the complementarity of the nucleotide sequences of LOC339694 BINDING SITE1 and LOC339694 BINDING SITE2, designated SEQ ID:7230 and SEQ ID:12466 respectively, to the nucleotide sequence of GAM3229 RNA, herein designated GAM RNA, also designated SEQ ID:221.

Another function of GAM3229 is therefore inhibition of LOC339694 (Accession XP_295035.1). Accordingly, utilities of GAM3229 include diagnosis, prevention and treatment of diseases and clinical conditions associated with LOC339694.

LOC339720 (Accession XP_295041.1) is another GAM3229 target gene, herein designated TARGET GENE. LOC339720 BINDING SITE is a target binding site found in the 5' untranslated region of mRNA encoded by LOC339720, corresponding to a target binding site such as BINDING SITE I, BINDING SITE II or BINDING SITE III of FIG. 8. Table 4 illustrates the complementarity of the nucleotide sequences of LOC339720 BINDING SITE, designated SEQ ID:9730, to the nucleotide sequence of GAM3229 RNA, herein designated GAM RNA, also designated SEQ ID:221.

Another function of GAM3229 is therefore inhibition of LOC339720 (Accession XP_295041.1). Accordingly, utilities of GAM3229 include diagnosis, prevention and treatment of diseases and clinical conditions associated with LOC339720.

LOC339738 (Accession XP_295048.1) is another GAM3229 target gene, herein designated TARGET GENE. LOC339738 BINDING SITE is a target binding site found in the 5' untranslated region of mRNA encoded by LOC339738, corresponding to a target binding site such as BINDING SITE I, BINDING SITE II or BINDING SITE III of FIG. 8. Table 4 illustrates the complementarity of the nucleotide sequences of LOC339738 BINDING SITE, designated SEQ ID:7722, to the nucleotide sequence of GAM3229 RNA, herein designated GAM RNA, also designated SEQ ID:221.

Another function of GAM3229 is therefore inhibition of LOC339738 (Accession XP_295048.1). Accordingly, utilities of GAM3229 include diagnosis, prevention and treatment of diseases and clinical conditions associated with LOC339738.

LOC339751 (Accession XP_295053.1) is another GAM3229 target gene, herein designated TARGET GENE. LOC339751 BINDING SITE is a target binding site found in the 3' untranslated region of mRNA encoded by LOC339751, corresponding to a target binding site such as BINDING SITE I, BINDING SITE II or BINDING SITE III of FIG. 8. Table 4 illustrates the complementarity of the nucleotide sequences of LOC339751 BINDING SITE, designated SEQ ID:13172, to the nucleotide sequence of GAM3229 RNA, herein designated GAM RNA, also designated SEQ ID:221.

Another function of GAM3229 is therefore inhibition of LOC339751 (Accession XP_295053.1). Accordingly, utilities of GAM3229 include diagnosis, prevention and treatment of diseases and clinical conditions associated with LOC339751.

LOC339803 (Accession XP_295072.1) is another GAM3229 target gene, herein designated TARGET GENE. LOC339803 BINDING SITE is a target binding site found in the 3' untranslated region of mRNA encoded by LOC339803, corresponding to a target binding site such as BINDING SITE I, BINDING SITE II or BINDING SITE III of FIG. 8. Table 4 illustrates the complementarity of the nucleotide sequences of LOC339803 BINDING SITE, designated SEQ ID:10537, to the nucleotide sequence of GAM3229 RNA, herein designated GAM RNA, also designated SEQ ID:221.

Another function of GAM3229 is therefore inhibition of LOC339803 (Accession XP_295072.1). Accordingly, utilities of GAM3229 include diagnosis, prevention and treatment of diseases and clinical conditions associated with LOC339803.

LOC339807 (Accession XP_295070.1) is another GAM3229 target gene, herein designated TARGET GENE. LOC339807 BINDING SITE is a target binding site found in the 3' untranslated region of mRNA encoded by LOC339807, corresponding to a target binding site such as BINDING SITE I, BINDING SITE II or BINDING SITE III of FIG. 8. Table 4 illustrates the complementarity of the nucleotide sequences of LOC339807 BINDING SITE, designated SEQ ID:11926, to the nucleotide sequence of GAM3229 RNA, herein designated GAM RNA, also designated SEQ ID:221.

Another function of GAM3229 is therefore inhibition of LOC339807 (Accession XP_295070.1). Accordingly, utilities of GAM3229 include diagnosis, prevention and treatment of diseases and clinical conditions associated with LOC339807.

LOC339809 (Accession XP_291020.1) is another GAM3229 target gene, herein designated TARGET GENE. LOC339809 BINDING SITE is a target binding site found in the 5' untranslated region of mRNA encoded by LOC339809, corresponding to a target binding site such as BINDING SITE I, BINDING SITE II or BINDING SITE III of FIG. 8. Table 4 illustrates the complementarity of the nucleotide sequences of LOC339809 BINDING SITE, designated SEQ ID:17851, to the nucleotide sequence of GAM3229 RNA, herein designated GAM RNA, also designated SEQ ID:221.

Another function of GAM3229 is therefore inhibition of LOC339809 (Accession XP_291020.1). Accordingly, utilities of GAM3229 include diagnosis, prevention and treatment of diseases and clinical conditions associated with LOC339809.

LOC339813 (Accession XP_295074.1) is another GAM3229 target gene, herein designated TARGET GENE. LOC339813 BINDING SITE is a target binding site found in the 5' untranslated region of mRNA encoded by LOC339813, corresponding to a target binding site such as BINDING SITE I, BINDING SITE II or BINDING SITE III of FIG. 8. Table 4 illustrates the complementarity of the nucleotide sequences of LOC339813 BINDING SITE, designated SEQ ID:10359, to the nucleotide sequence of GAM3229 RNA, herein designated GAM RNA, also designated SEQ ID:221.

Another function of GAM3229 is therefore inhibition of LOC339813 (Accession XP_295074.1). Accordingly, utilities of GAM3229 include diagnosis, prevention and treatment of diseases and clinical conditions associated with LOC339813.

LOC339833 (Accession XP_291031.1) is another GAM3229 target gene, herein designated TARGET GENE. LOC339833 BINDING SITE is a target binding site found in the 5' untranslated region of mRNA encoded by LOC339833, corresponding to a target binding site such as BINDING SITE I, BINDING SITE II or BINDING SITE III of FIG. 8. Table 4 illustrates the complementarity of the nucleotide sequences of LOC339833 BINDING SITE, designated SEQ ID:17042, to the nucleotide sequence of GAM3229 RNA, herein designated GAM RNA, also designated SEQ ID:221.

Another function of GAM3229 is therefore inhibition of LOC339833 (Accession XP_291031.1). Accordingly, utilities of GAM3229 include diagnosis, prevention and treatment of diseases and clinical conditions associated with LOC339833.

LOC339907 (Accession XP_291065.1) is another GAM3229 target gene, herein designated TARGET GENE. LOC339907 BINDING SITE is a target binding site found in the 3' untranslated region of mRNA encoded by LOC339907, corresponding to a target binding site such as BINDING SITE I, BINDING SITE II or BINDING SITE III of FIG. 8. Table 4 illustrates the complementarity of the nucleotide sequences of LOC339907 BINDING SITE, designated SEQ ID:8327, to the nucleotide sequence of GAM3229 RNA, herein designated GAM RNA, also designated SEQ ID:221.

Another function of GAM3229 is therefore inhibition of LOC339907 (Accession XP_291065.1). Accordingly, utilities of GAM3229 include diagnosis, prevention and treatment of diseases and clinical conditions associated with LOC339907.

LOC339942 (Accession XP_295107.1) is another GAM3229 target gene, herein designated TARGET GENE. LOC339942 BINDING SITE is a target binding site found in the 5' untranslated region of mRNA encoded by LOC339942, corresponding to a target binding site such as BINDING SITE I, BINDING SITE II or BINDING SITE III of FIG. 8. Table 4 illustrates the complementarity of the nucleotide sequences of LOC339942 BINDING SITE, designated SEQ ID:11400, to the nucleotide sequence of GAM3229 RNA, herein designated GAM RNA, also designated SEQ ID:221.

Another function of GAM3229 is therefore inhibition of LOC339942 (Accession XP_295107.1). Accordingly, utilities of GAM3229 include diagnosis, prevention and treatment of diseases and clinical conditions associated with LOC339942.

LOC340125 (Accession XP_291150.1) is another GAM3229 target gene, herein designated TARGET GENE. LOC340125 BINDING SITE1 and LOC340125 BINDING SITE2 are target binding sites found in untranslated regions of mRNA encoded by LOC340125, corresponding to target binding sites such as BINDING SITE I, BINDING SITE II or BINDING SITE III of FIG. 8. Table 4 illustrates the complementarity of the nucleotide sequences of LOC340125 BINDING SITE1 and LOC340125 BINDING SITE2, designated SEQ ID:9877 and SEQ ID:8135 respectively, to the nucleotide sequence of GAM3229 RNA, herein designated GAM RNA, also designated SEQ ID:221.

Another function of GAM3229 is therefore inhibition of LOC340125 (Accession XP_291150.1). Accordingly, utilities of GAM3229 include diagnosis, prevention and treatment of diseases and clinical conditions associated with LOC340125.

LOC340138 (Accession XP_291153.1) is another GAM3229 target gene, herein designated TARGET GENE. LOC340138 BINDING SITE is a target binding site found in the 3' untranslated region of mRNA encoded by LOC340138, corresponding to a target binding site such as BINDING SITE I, BINDING SITE II or BINDING SITE III of FIG. 8. Table 4 illustrates the complementarity of the nucleotide sequences of LOC340138 BINDING SITE, designated SEQ ID:2497, to the nucleotide sequence of GAM3229 RNA, herein designated GAM RNA, also designated SEQ ID:221.

Another function of GAM3229 is therefore inhibition of LOC340138 (Accession XP_291153.1). Accordingly, utilities of GAM3229 include diagnosis, prevention and treatment of diseases and clinical conditions associated with LOC340138.

LOC340170 (Accession XP_291160.1) is another GAM3229 target gene, herein designated TARGET GENE.

LOC340170 BINDING SITE is a target binding site found in the 3' untranslated region of mRNA encoded by LOC340170, corresponding to a target binding site such as BINDING SITE I, BINDING SITE II or BINDING SITE III of FIG. 8. Table 4 illustrates the complementarity of the nucleotide sequences of LOC340170 BINDING SITE, designated SEQ ID:1195, to the nucleotide sequence of GAM3229 RNA, herein designated GAM RNA, also designated SEQ ID:221.

Another function of GAM3229 is therefore inhibition of LOC340170 (Accession XP_291160.1). Accordingly, utilities of GAM3229 include diagnosis, prevention and treatment of diseases and clinical conditions associated with LOC340170.

LOC340227 (Accession XP_291203.1) is another GAM3229 target gene, herein designated TARGET GENE. LOC340227 BINDING SITE is a target binding site found in the 5' untranslated region of mRNA encoded by LOC340227, corresponding to a target binding site such as BINDING SITE I, BINDING SITE II or BINDING SITE III of FIG. 8. Table 4 illustrates the complementarity of the nucleotide sequences of LOC340227 BINDING SITE, designated SEQ ID:8135, to the nucleotide sequence of GAM3229 RNA, herein designated GAM RNA, also designated SEQ ID:221.

Another function of GAM3229 is therefore inhibition of LOC340227 (Accession XP_291203.1). Accordingly, utilities of GAM3229 include diagnosis, prevention and treatment of diseases and clinical conditions associated with LOC340227.

LOC340249 (Accession XP_291211.1) is another GAM3229 target gene, herein designated TARGET GENE. LOC340249 BINDING SITE is a target binding site found in the 3' untranslated region of mRNA encoded by LOC340249, corresponding to a target binding site such as BINDING SITE I, BINDING SITE II or BINDING SITE III of FIG. 8. Table 4 illustrates the complementarity of the nucleotide sequences of LOC340249 BINDING SITE, designated SEQ ID:20021, to the nucleotide sequence of GAM3229 RNA, herein designated GAM RNA, also designated SEQ ID:221.

Another function of GAM3229 is therefore inhibition of LOC340249 (Accession XP_291211.1). Accordingly, utilities of GAM3229 include diagnosis, prevention and treatment of diseases and clinical conditions associated with LOC340249.

LOC340290 (Accession XP_291214.1) is another GAM3229 target gene, herein designated TARGET GENE. LOC340290 BINDING SITE is a target binding site found in the 5' untranslated region of mRNA encoded by LOC340290, corresponding to a target binding site such as BINDING SITE I, BINDING SITE II or BINDING SITE III of FIG. 8. Table 4 illustrates the complementarity of the nucleotide sequences of LOC340290 BINDING SITE, designated SEQ ID:8135, to the nucleotide sequence of GAM3229 RNA, herein designated GAM RNA, also designated SEQ ID:221.

Another function of GAM3229 is therefore inhibition of LOC340290 (Accession XP_291214.1). Accordingly, utilities of GAM3229 include diagnosis, prevention and treatment of diseases and clinical conditions associated with LOC340290.

LOC340321 (Accession XP_295212.1) is another GAM3229 target gene, herein designated TARGET GENE. LOC340321 BINDING SITE is a target binding site found in the 5' untranslated region of mRNA encoded by LOC340321, corresponding to a target binding site such as BINDING SITE I, BINDING SITE II or BINDING SITE III of FIG. 8. Table 4 illustrates the complementarity of the nucleotide sequences of LOC340321 BINDING SITE, designated SEQ ID:1655, to the nucleotide sequence of GAM3229 RNA, herein designated GAM RNA, also designated SEQ ID:221.

Another function of GAM3229 is therefore inhibition of LOC340321 (Accession XP_295212.1). Accordingly, utilities of GAM3229 include diagnosis, prevention and treatment of diseases and clinical conditions associated with LOC340321.

LOC340390 (Accession XP_291269.1) is another GAM3229 target gene, herein designated TARGET GENE. LOC340390 BINDING SITE is a target binding site found in the 3' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:1473, to the nucleotide sequence of GAM3229 RNA, herein designated GAM RNA, also designated SEQ ID:221.

Another function of GAM3229 is therefore inhibition of LOC340390 (Accession XP_291269.1). Accordingly, utilities of GAM3229 include diagnosis, prevention and treatment of diseases and clinical conditions associated with LOC340390.

LOC340414 (Accession XP_295240.1) is another GAM3229 target gene, herein designated TARGET GENE. LOC340414 BINDING SITE1 and LOC340414 BINDING SITE2 are target binding sites found in untranslated regions of mRNA encoded by LOC340414, corresponding to target binding sites such as BINDING SITE I, BINDING SITE II or BINDING SITE III of FIG. 8. Table 4 illustrates the complementarity of the nucleotide sequences of LOC340414 BINDING SITE1 and LOC340414 BINDING SITE2, designated SEQ ID:7368 and SEQ ID:13658 respectively, to the nucleotide sequence of GAM3229 RNA, herein designated GAM RNA, also designated SEQ ID:221.

Another function of GAM3229 is therefore inhibition of LOC340414 (Accession XP_295240.1). Accordingly, utilities of GAM3229 include diagnosis, prevention and treatment of diseases and clinical conditions associated with LOC340414.

LOC340494 (Accession XP_290428.1) is another GAM3229 target gene, herein designated TARGET GENE. LOC340494 BINDING SITE is a target binding site found in the 3' untranslated region of mRNA encoded by LOC340494, corresponding to a target binding site such as BINDING SITE I, BINDING SITE II or BINDING SITE III of FIG. 8. Table 4 illustrates the complementarity of the nucleotide sequences of LOC340494 BINDING SITE, designated SEQ ID:19097, to the nucleotide sequence of GAM3229 RNA, herein designated GAM RNA, also designated SEQ ID:221.

Another function of GAM3229 is therefore inhibition of LOC340494 (Accession XP_290428.1). Accordingly, utilities of GAM3229 include diagnosis, prevention and treatment of diseases and clinical conditions associated with LOC340494.

LOC340512 (Accession XP_295262.1) is another GAM3229 target gene, herein designated TARGET GENE. LOC340512 BINDING SITE is a target binding site found in the 5' untranslated region of mRNA encoded by LOC340512, corresponding to a target binding site such as BINDING SITE I, BINDING SITE II or BINDING SITE III of FIG. 8. Table 4 illustrates the complementarity of the nucleotide sequences of LOC340512 BINDING SITE, designated SEQ ID:9452, to the nucleotide sequence of GAM3229 RNA, herein designated GAM RNA, also designated SEQ ID:221.

Another function of GAM3229 is therefore inhibition of LOC340512 (Accession XP_295262.1). Accordingly, utilities of GAM3229 include diagnosis, prevention and treatment of diseases and clinical conditions associated with LOC340512.

LOC340528 (Accession XP_295268.1) is another GAM3229 target gene, herein designated TARGET GENE. LOC340528 BINDING SITE is a target binding site found in the 5' untranslated region of mRNA encoded by LOC340528, corresponding to a target binding site such as BINDING SITE I, BINDING SITE II or BINDING SITE III of FIG. 8. Table 4 illustrates the complementarity of the nucleotide sequences of LOC340528 BINDING SITE, designated SEQ ID:14406, to the nucleotide sequence of GAM3229 RNA, herein designated GAM RNA, also designated SEQ ID:221.

Another function of GAM3229 is therefore inhibition of LOC340528 (Accession XP_295268.1). Accordingly, utilities of GAM3229 include diagnosis, prevention and treatment of diseases and clinical conditions associated with LOC340528.

LOC342926 (Accession XP_292790.2) is another GAM3229 target gene, herein designated TARGET GENE. LOC342926 BINDING SITE is a target binding site found in the 3' untranslated region of mRNA encoded by LOC342926, corresponding to a target binding site such as BINDING SITE I, BINDING SITE II or BINDING SITE III of FIG. 8. Table 4 illustrates the complementarity of the nucleotide sequences of LOC342926 BINDING SITE, designated SEQ ID:10075, to the nucleotide sequence of GAM3229 RNA, herein designated GAM RNA, also designated SEQ ID:221.

Another function of GAM3229 is therefore inhibition of LOC342926 (Accession XP_292790.2). Accordingly, utilities of GAM3229 include diagnosis, prevention and treatment of diseases and clinical conditions associated with LOC342926.

LOC343803 (Accession XP_297895.1) is another GAM3229 target gene, herein designated TARGET GENE. LOC343803 BINDING SITE is a target binding site found in the 5' untranslated region of mRNA encoded by LOC343803, corresponding to a target binding site such as BINDING SITE I, BINDING SITE II or BINDING SITE III of FIG. 8. Table 4 illustrates the complementarity of the nucleotide sequences of LOC343803 BINDING SITE, designated SEQ ID:14285, to the nucleotide sequence of GAM3229 RNA, herein designated GAM RNA, also designated SEQ ID:221.

Another function of GAM3229 is therefore inhibition of LOC343803 (Accession XP_297895.1). Accordingly, utilities of GAM3229 include diagnosis, prevention and treatment of diseases and clinical conditions associated with LOC343803.

LOC346653 (Accession XP_294357.2) is another GAM3229 target gene, herein designated TARGET GENE. LOC346653 BINDING SITE is a target binding site found in the 3' untranslated region of mRNA encoded by LOC346653, corresponding to a target binding site such as BINDING SITE I, BINDING SITE II or BINDING SITE III of FIG. 8. Table 4 illustrates the complementarity of the nucleotide sequences of LOC346653 BINDING SITE, designated SEQ ID:19528, to the nucleotide sequence of GAM3229 RNA, herein designated GAM RNA, also designated SEQ ID:221.

Another function of GAM3229 is therefore inhibition of LOC346653 (Accession XP_294357.2). Accordingly, utilities of GAM3229 include diagnosis, prevention and treatment of diseases and clinical conditions associated with LOC346653.

LOC347848 (Accession XP_302609.1) is another GAM3229 target gene, herein designated TARGET GENE. LOC347848 BINDING SITE is a target binding site found in the 5' untranslated region of mRNA encoded by LOC347848, corresponding to a target binding site such as BINDING SITE I, BINDING SITE II or BINDING SITE III of FIG. 8. Table 4 illustrates the complementarity of the nucleotide sequences of LOC347848 BINDING SITE, designated SEQ ID:16961, to the nucleotide sequence of GAM3229 RNA, herein designated GAM RNA, also designated SEQ ID:221.

Another function of GAM3229 is therefore inhibition of LOC347848 (Accession XP_302609.1). Accordingly, utilities of GAM3229 include diagnosis, prevention and treatment of diseases and clinical conditions associated with LOC347848.

LOC347918 (Accession XP_300565.1) is another GAM3229 target gene, herein designated TARGET GENE. LOC347918 BINDING SITE is a target binding site found in the 5' untranslated region of mRNA encoded by LOC347918, corresponding to a target binding site such as BINDING SITE I, BINDING SITE II or BINDING SITE III of FIG. 8. Table 4 illustrates the complementarity of the nucleotide sequences of LOC347918 BINDING SITE, designated SEQ ID:955, to the nucleotide sequence of GAM3229 RNA, herein designated GAM RNA, also designated SEQ ID:221.

Another function of GAM3229 is therefore inhibition of LOC347918 (Accession XP_300565.1). Accordingly, utilities of GAM3229 include diagnosis, prevention and treatment of diseases and clinical conditions associated with LOC347918.

LOC348094 (Accession XP_300615.1) is another GAM3229 target gene, herein designated TARGET GENE. LOC348094 BINDING SITE is a target binding site found in the 5' untranslated region of mRNA encoded by LOC348094, corresponding to a target binding site such as BINDING SITE I, BINDING SITE II or BINDING SITE III of FIG. 8. Table 4 illustrates the complementarity of the nucleotide sequences of LOC348094 BINDING SITE, designated SEQ ID:16020, to the nucleotide sequence of GAM3229 RNA, herein designated GAM RNA, also designated SEQ ID:221.

Another function of GAM3229 is therefore inhibition of LOC348094 (Accession XP_300615.1). Accordingly, utilities of GAM3229 include diagnosis, prevention and treatment of diseases and clinical conditions associated with LOC348094.

LOC348113 (Accession XP_300623.1) is another GAM3229 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:1069, to the nucleotide sequence of GAM3229 RNA, herein designated GAM RNA, also designated SEQ ID:221.

Another function of GAM3229 is therefore inhibition of LOC348113 (Accession XP_300623.1). Accordingly, utilities of GAM3229 include diagnosis, prevention and treatment of diseases and clinical conditions associated with LOC348113.

LOC348137 (Accession XP_300635.1) is another GAM3229 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:1069, to the nucleotide sequence of GAM3229 RNA, herein designated GAM RNA, also designated SEQ ID:221.

Another function of GAM3229 is therefore inhibition of LOC348137 (Accession XP_300635.1). Accordingly, utilities of GAM3229 include diagnosis, prevention and treatment of diseases and clinical conditions associated with LOC348137.

LOC348142 (Accession XP_300636.1) is another GAM3229 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:1069, to the nucleotide sequence of GAM3229 RNA, herein designated GAM RNA, also designated SEQ ID:221.

Another function of GAM3229 is therefore inhibition of LOC348142 (Accession XP_300636.1). Accordingly, utilities of GAM3229 include diagnosis, prevention and treatment of diseases and clinical conditions associated with LOC348142.

LOC348235 (Accession XP_300670.1) is another GAM3229 target gene, herein designated TARGET GENE. LOC348235 BINDING SITE is a target binding site found in the 3' untranslated region of mRNA encoded by LOC348235, corresponding to a target binding site such as BINDING SITE I, BINDING SITE II or BINDING SITE III of FIG. 8. Table 4 illustrates the complementarity of the nucleotide sequences of LOC348235 BINDING SITE, designated SEQ ID:16390, to the nucleotide sequence of GAM3229 RNA, herein designated GAM RNA, also designated SEQ ID:221.

Another function of GAM3229 is therefore inhibition of LOC348235 (Accession XP_300670.1). Accordingly, utilities of GAM3229 include diagnosis, prevention and treatment of diseases and clinical conditions associated with LOC348235.

LOC348262 (Accession XP_300683.1) is another GAM3229 target gene, herein designated TARGET GENE. LOC348262 BINDING SITE is a target binding site found in the 5' untranslated region of mRNA encoded by LOC348262, corresponding to a target binding site such as BINDING SITE I, BINDING SITE II or BINDING SITE III of FIG. 8. Table 4 illustrates the complementarity of the nucleotide sequences of LOC348262 BINDING SITE, designated SEQ ID:19609, to the nucleotide sequence of GAM3229 RNA, herein designated GAM RNA, also designated SEQ ID:221.

Another function of GAM3229 is therefore inhibition of LOC348262 (Accession XP_300683.1). Accordingly, utilities of GAM3229 include diagnosis, prevention and treatment of diseases and clinical conditions associated with LOC348262.

LOC348378 (Accession XP_300723.1) is another GAM3229 target gene, herein designated TARGET GENE. LOC348378 BINDING SITE is a target binding site found in the 3' untranslated region of mRNA encoded by LOC348378, corresponding to a target binding site such as BINDING SITE I, BINDING SITE II or BINDING SITE III of FIG. 8. Table 4 illustrates the complementarity of the nucleotide sequences of LOC348378 BINDING SITE, designated SEQ ID:10183, to the nucleotide sequence of GAM3229 RNA, herein designated GAM RNA, also designated SEQ ID:221.

Another function of GAM3229 is therefore inhibition of LOC348378 (Accession XP_300723.1). Accordingly, utilities of GAM3229 include diagnosis, prevention and treatment of diseases and clinical conditions associated with LOC348378.

LOC348393 (Accession XP_302741.1) is another GAM3229 target gene, herein designated TARGET GENE. LOC348393 BINDING SITE is a target binding site found in the 3' untranslated region of mRNA encoded by LOC348393, corresponding to a target binding site such as BINDING SITE I, BINDING SITE II or BINDING SITE III of FIG. 8. Table 4 illustrates the complementarity of the nucleotide sequences of LOC348393 BINDING SITE, designated SEQ ID:10000, to the nucleotide sequence of GAM3229 RNA, herein designated GAM RNA, also designated SEQ ID:221.

Another function of GAM3229 is therefore inhibition of LOC348393 (Accession XP_302741.1). Accordingly, utilities of GAM3229 include diagnosis, prevention and treatment of diseases and clinical conditions associated with LOC348393.

LOC348396 (Accession XP_300729.1) is another GAM3229 target gene, herein designated TARGET GENE. LOC348396 BINDING SITE is a target binding site found in the 5' untranslated region of mRNA encoded by LOC348396, corresponding to a target binding site such as BINDING SITE I, BINDING SITE II or BINDING SITE III of FIG. 8. Table 4 illustrates the complementarity of the nucleotide sequences of LOC348396 BINDING SITE, designated SEQ ID:17091, to the nucleotide sequence of GAM3229 RNA, herein designated GAM RNA, also designated SEQ ID:221.

Another function of GAM3229 is therefore inhibition of LOC348396 (Accession XP_300729.1). Accordingly, utilities of GAM3229 include diagnosis, prevention and treatment of diseases and clinical conditions associated with LOC348396.

LOC348402 (Accession XP_300730.1) is another GAM3229 target gene, herein designated TARGET GENE. LOC348402 BINDING SITE1 and LOC348402 BINDING SITE2 are target binding sites found in untranslated regions of mRNA encoded by LOC348402, corresponding to target binding sites such as BINDING SITE I, BINDING SITE II or BINDING SITE III of FIG. 8. Table 4 illustrates the complementarity of the nucleotide sequences of LOC348402 BINDING SITE1 and LOC348402 BINDING SITE2, designated SEQ ID:3503 and SEQ ID:1590 respectively, to the nucleotide sequence of GAM3229 RNA, herein designated GAM RNA, also designated SEQ ID:221.

Another function of GAM3229 is therefore inhibition of LOC348402 (Accession XP_300730.1). Accordingly, utilities of GAM3229 include diagnosis, prevention and treatment of diseases and clinical conditions associated with LOC348402.

LOC348474 (Accession XP_209299.2) is another GAM3229 target gene, herein designated TARGET GENE. LOC348474 BINDING SITE is a target binding site found in the 3' untranslated region of mRNA encoded by LOC348474, corresponding to a target binding site such as BINDING SITE I, BINDING SITE II or BINDING SITE III of FIG. 8. Table 4 illustrates the complementarity of the nucleotide sequences of LOC348474 BINDING SITE, designated SEQ ID:13205, to the nucleotide sequence of GAM3229 RNA, herein designated GAM RNA, also designated SEQ ID:221.

Another function of GAM3229 is therefore inhibition of LOC348474 (Accession XP_209299.2). Accordingly, utilities of GAM3229 include diagnosis, prevention and treatment of diseases and clinical conditions associated with LOC348474.

LOC348488 (Accession XP_300352.1) is another GAM3229 target gene, herein designated TARGET GENE. LOC348488 BINDING SITE is a target binding site found in the 3' untranslated region of mRNA encoded by LOC348488, corresponding to a target binding site such as BINDING SITE I, BINDING SITE II or BINDING SITE III of FIG. 8. Table 4 illustrates the complementarity of the nucleotide sequences of LOC348488 BINDING SITE, designated SEQ ID:7579, to the nucleotide sequence of GAM3229 RNA, herein designated GAM RNA, also designated SEQ ID:221.

Another function of GAM3229 is therefore inhibition of LOC348488 (Accession XP_300352.1). Accordingly, utilities of GAM3229 include diagnosis, prevention and treatment of diseases and clinical conditions associated with LOC348488.

LOC348503 (Accession XP_300762.1) is another GAM3229 target gene, herein designated TARGET GENE. LOC348503 BINDING SITE is a target binding site found in the 3' untranslated region of mRNA encoded by LOC348503, corresponding to a target binding site such as BINDING SITE I, BINDING SITE II or BINDING SITE III of FIG. 8. Table 4 illustrates the complementarity of the nucleotide sequences of LOC348503 BINDING SITE, designated SEQ ID:14079, to the nucleotide sequence of GAM3229 RNA, herein designated GAM RNA, also designated SEQ ID:221.

Another function of GAM3229 is therefore inhibition of LOC348503 (Accession XP_300762.1). Accordingly, utilities of GAM3229 include diagnosis, prevention and treatment of diseases and clinical conditions associated with LOC348503.

LOC348504 (Accession XP_300769.1) is another GAM3229 target gene, herein designated TARGET GENE. LOC348504 BINDING SITE1 and LOC348504 BINDING SITE2 are target binding sites found in untranslated regions of mRNA encoded by LOC348504, corresponding to target binding sites such as BINDING SITE I, BINDING SITE II or BINDING SITE III of FIG. 8. Table 4 illustrates the complementarity of the nucleotide sequences of LOC348504 BINDING SITE1 and LOC348504 BINDING SITE2, designated SEQ ID:542 and SEQ ID:7507 respectively, to the nucleotide sequence of GAM3229 RNA, herein designated GAM RNA, also designated SEQ ID:221.

Another function of GAM3229 is therefore inhibition of LOC348504 (Accession XP_300769.1). Accordingly, utilities of GAM3229 include diagnosis, prevention and treatment of diseases and clinical conditions associated with LOC348504.

LOC348508 (Accession XP_302806.1) is another GAM3229 target gene, herein designated TARGET GENE. LOC348508 BINDING SITE1 and LOC348508 BINDING SITE2 are target binding sites found in untranslated regions of mRNA encoded by LOC348508, corresponding to target binding sites such as BINDING SITE I, BINDING SITE II or BINDING SITE III of FIG. 8. Table 4 illustrates the complementarity of the nucleotide sequences of LOC348508 BINDING SITE1 and LOC348508 BINDING SITE2, designated SEQ ID:8135 and SEQ ID:9877 respectively, to the nucleotide sequence of GAM3229 RNA, herein designated GAM RNA, also designated SEQ ID:221.

Another function of GAM3229 is therefore inhibition of LOC348508 (Accession XP_302806.1). Accordingly, utilities of GAM3229 include diagnosis, prevention and treatment of diseases and clinical conditions associated with LOC348508.

LOC348532 (Accession XP_302818.1) is another GAM3229 target gene, herein designated TARGET GENE. LOC348532 BINDING SITE is a target binding site found in the 3' untranslated region of mRNA encoded by LOC348532, corresponding to a target binding site such as BINDING SITE I, BINDING SITE II or BINDING SITE III of FIG. 8. Table 4 illustrates the complementarity of the nucleotide sequences of LOC348532 BINDING SITE, designated SEQ ID:10000, to the nucleotide sequence of GAM3229 RNA, herein designated GAM RNA, also designated SEQ ID:221.

Another function of GAM3229 is therefore inhibition of LOC348532 (Accession XP_302818.1). Accordingly, utilities of GAM3229 include diagnosis, prevention and treatment of diseases and clinical conditions associated with LOC348532.

LOC348567 (Accession XP_300378.1) is another GAM3229 target gene, herein designated TARGET GENE. LOC348567 BINDING SITE is a target binding site found in the 3' untranslated region of mRNA encoded by LOC348567, corresponding to a target binding site such as BINDING SITE I, BINDING SITE II or BINDING SITE III of FIG. 8. Table 4 illustrates the complementarity of the nucleotide sequences of LOC348567 BINDING SITE, designated SEQ ID:10075, to the nucleotide sequence of GAM3229 RNA, herein designated GAM RNA, also designated SEQ ID:221.

Another function of GAM3229 is therefore inhibition of LOC348567 (Accession XP_300378.1). Accordingly, utilities of GAM3229 include diagnosis, prevention and treatment of diseases and clinical conditions associated with LOC348567.

LOC348687 (Accession XP_302853.1) is another GAM3229 target gene, herein designated TARGET GENE. LOC348687 BINDING SITE is a target binding site found in the 3' untranslated region of mRNA encoded by LOC348687, corresponding to a target binding site such as BINDING SITE I, BINDING SITE II or BINDING SITE III of FIG. 8. Table 4 illustrates the complementarity of the nucleotide sequences of LOC348687 BINDING SITE, designated SEQ ID:4582, to the nucleotide sequence of GAM3229 RNA, herein designated GAM RNA, also designated SEQ ID:221.

Another function of GAM3229 is therefore inhibition of LOC348687 (Accession XP_302853.1). Accordingly, utilities of GAM3229 include diagnosis, prevention and treatment of diseases and clinical conditions associated with LOC348687.

LOC348790 (Accession XP_300843.1) is another GAM3229 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:18680, to the nucleotide sequence of GAM3229 RNA, herein designated GAM RNA, also designated SEQ ID:221.

Another function of GAM3229 is therefore inhibition of LOC348790 (Accession XP_300843.1). Accordingly, utilities of GAM3229 include diagnosis, prevention and treatment of diseases and clinical conditions associated with LOC348790.

LOC348797 (Accession XP_302888.1) is another GAM3229 target gene, herein designated TARGET GENE. LOC348797 BINDING SITE is a target binding site found in the 3' untranslated region of mRNA encoded by LOC348797, corresponding to a target binding site such as BINDING SITE I, BINDING SITE II or BINDING SITE III of FIG. 8. Table 4 illustrates the complementarity of the nucleotide sequences of LOC348797 BINDING SITE, designated SEQ ID:750, to the nucleotide sequence of GAM3229 RNA, herein designated GAM RNA, also designated SEQ ID:221.

Another function of GAM3229 is therefore inhibition of LOC348797 (Accession XP_302888.1). Accordingly, utilities of GAM3229 include diagnosis, prevention and treatment of diseases and clinical conditions associated with LOC348797.

LOC348842 (Accession XP_300861.1) is another GAM3229 target gene, herein designated TARGET GENE.

LOC348842 BINDING SITE is a target binding site found in the 5' untranslated region of mRNA encoded by LOC348842, corresponding to a target binding site such as BINDING SITE I, BINDING SITE II or BINDING SITE III of FIG. 8. Table 4 illustrates the complementarity of the nucleotide sequences of LOC348842 BINDING SITE, designated SEQ ID:9877, to the nucleotide sequence of GAM3229 RNA, herein designated GAM RNA, also designated SEQ ID:221.

Another function of GAM3229 is therefore inhibition of LOC348842 (Accession XP_300861.1). Accordingly, utilities of GAM3229 include diagnosis, prevention and treatment of diseases and clinical conditions associated with LOC348842.

LOC348843 (Accession XP_302903.1) is another GAM3229 target gene, herein designated TARGET GENE. LOC348843 BINDING SITE1 and LOC348843 BINDING SITE2 are target binding sites found in untranslated regions of mRNA encoded by LOC348843, corresponding to target binding sites such as BINDING SITE I, BINDING SITE II or BINDING SITE III of FIG. 8. Table 4 illustrates the complementarity of the nucleotide sequences of LOC348843 BINDING SITE1 and LOC348843 BINDING SITE2, designated SEQ ID:542 and SEQ ID:7507 respectively, to the nucleotide sequence of GAM3229 RNA, herein designated GAM RNA, also designated SEQ ID:221.

Another function of GAM3229 is therefore inhibition of LOC348843 (Accession XP_302903.1). Accordingly, utilities of GAM3229 include diagnosis, prevention and treatment of diseases and clinical conditions associated with LOC348843.

LOC348909 (Accession XP_300875.1) is another GAM3229 target gene, herein designated TARGET GENE. LOC348909 BINDING SITE is a target binding site found in the 5' untranslated region of mRNA encoded by LOC348909, corresponding to a target binding site such as BINDING SITE I, BINDING SITE II or BINDING SITE III of FIG. 8. Table 4 illustrates the complementarity of the nucleotide sequences of LOC348909 BINDING SITE, designated SEQ ID:9882, to the nucleotide sequence of GAM3229 RNA, herein designated GAM RNA, also designated SEQ ID:221.

Another function of GAM3229 is therefore inhibition of LOC348909 (Accession XP_300875.1). Accordingly, utilities of GAM3229 include diagnosis, prevention and treatment of diseases and clinical conditions associated with LOC348909.

LOC348938 (Accession XP_300883.1) is another GAM3229 target gene, herein designated TARGET GENE. LOC348938 BINDING SITE is a target binding site found in the 3' untranslated region of mRNA encoded by LOC348938, corresponding to a target binding site such as BINDING SITE I, BINDING SITE II or BINDING SITE III of FIG. 8. Table 4 illustrates the complementarity of the nucleotide sequences of LOC348938 BINDING SITE, designated SEQ ID:15195, to the nucleotide sequence of GAM3229 RNA, herein designated GAM RNA, also designated SEQ ID:221.

Another function of GAM3229 is therefore inhibition of LOC348938 (Accession XP_300883.1). Accordingly, utilities of GAM3229 include diagnosis, prevention and treatment of diseases and clinical conditions associated with LOC348938.

LOC348995 (Accession XP_300434.1) is another GAM3229 target gene, herein designated TARGET GENE. LOC348995 BINDING SITE is a target binding site found in the 3' untranslated region of mRNA encoded by LOC348995, corresponding to a target binding site such as BINDING SITE I, BINDING SITE II or BINDING SITE III of FIG. 8. Table 4 illustrates the complementarity of the nucleotide sequences of LOC348995 BINDING SITE, designated SEQ ID:6161, to the nucleotide sequence of GAM3229 RNA, herein designated GAM RNA, also designated SEQ ID:221.

Another function of GAM3229 is therefore inhibition of LOC348995 (Accession XP_300434.1). Accordingly, utilities of GAM3229 include diagnosis, prevention and treatment of diseases and clinical conditions associated with LOC348995.

LOC349075 (Accession XP_300932.1) is another GAM3229 target gene, herein designated TARGET GENE. LOC349075 BINDING SITE is a target binding site found in the 3' untranslated region of mRNA encoded by LOC349075, corresponding to a target binding site such as BINDING SITE I, BINDING SITE II or BINDING SITE III of FIG. 8. Table 4 illustrates the complementarity of the nucleotide sequences of LOC349075 BINDING SITE, designated SEQ ID:8631, to the nucleotide sequence of GAM3229 RNA, herein designated GAM RNA, also designated SEQ ID:221.

Another function of GAM3229 is therefore inhibition of LOC349075 (Accession XP_300932.1). Accordingly, utilities of GAM3229 include diagnosis, prevention and treatment of diseases and clinical conditions associated with LOC349075.

LOC349101 (Accession XP_173186.2) is another GAM3229 target gene, herein designated TARGET GENE. LOC349101 BINDING SITE is a target binding site found in the 3' untranslated region of mRNA encoded by LOC349101, corresponding to a target binding site such as BINDING SITE I, BINDING SITE II or BINDING SITE III of FIG. 8. Table 4 illustrates the complementarity of the nucleotide sequences of LOC349101 BINDING SITE, designated SEQ ID:3432, to the nucleotide sequence of GAM3229 RNA, herein designated GAM RNA, also designated SEQ ID:221.

Another function of GAM3229 is therefore inhibition of LOC349101 (Accession XP_173186.2). Accordingly, utilities of GAM3229 include diagnosis, prevention and treatment of diseases and clinical conditions associated with LOC349101.

LOC349169 (Accession XP_302978.1) is another GAM3229 target gene, herein designated TARGET GENE. LOC349169 BINDING SITE is a target binding site found in the 3' untranslated region of mRNA encoded by LOC349169, corresponding to a target binding site such as BINDING SITE I, BINDING SITE II or BINDING SITE III of FIG. 8. Table 4 illustrates the complementarity of the nucleotide sequences of LOC349169 BINDING SITE, designated SEQ ID:7284, to the nucleotide sequence of GAM3229 RNA, herein designated GAM RNA, also designated SEQ ID:221.

Another function of GAM3229 is therefore inhibition of LOC349169 (Accession XP_302978.1). Accordingly, utilities of GAM3229 include diagnosis, prevention and treatment of diseases and clinical conditions associated with LOC349169.

LOC349170 (Accession XP_300969.1) is another GAM3229 target gene, herein designated TARGET GENE. LOC349170 BINDING SITE1 through LOC349170 BINDING SITE3 are target binding sites found in untranslated regions of mRNA encoded by LOC349170, corresponding to target binding sites such as BINDING SITE I, BINDING SITE II or BINDING SITE III of FIG. 8. Table 4 illustrates the complementarity of the nucleotide sequences of LOC349170 BINDING SITE1 through LOC349170 BINDING SITE3, designated SEQ ID:14615, SEQ ID:20159 and SEQ ID:20022 respectively, to the nucleotide sequence of GAM3229 RNA, herein designated GAM RNA, also designated SEQ ID:221.

Another function of GAM3229 is therefore inhibition of LOC349170 (Accession XP_300969.1). Accordingly, utilities of GAM3229 include diagnosis, prevention and treatment of diseases and clinical conditions associated with LOC349170.

LOC349236 (Accession XP_300988.1) is another GAM3229 target gene, herein designated TARGET GENE. LOC349236 BINDING SITE is a target binding site found in the 3' untranslated region of mRNA encoded by LOC349236, corresponding to a target binding site such as BINDING SITE I, BINDING SITE II or BINDING SITE III of FIG. 8. Table 4 illustrates the complementarity of the nucleotide sequences of LOC349236 BINDING SITE, designated SEQ ID:17381, to the nucleotide sequence of GAM3229 RNA, herein designated GAM RNA, also designated SEQ ID:221.

Another function of GAM3229 is therefore inhibition of LOC349236 (Accession XP_300988.1). Accordingly, utilities of GAM3229 include diagnosis, prevention and treatment of diseases and clinical conditions associated with LOC349236.

LOC349261 (Accession XP_300998.1) is another GAM3229 target gene, herein designated TARGET GENE. LOC349261 BINDING SITE is a target binding site found in the 5' untranslated region of mRNA encoded by LOC349261, corresponding to a target binding site such as BINDING SITE I, BINDING SITE II or BINDING SITE III of FIG. 8. Table 4 illustrates the complementarity of the nucleotide sequences of LOC349261 BINDING SITE, designated SEQ ID:2783, to the nucleotide sequence of GAM3229 RNA, herein designated GAM RNA, also designated SEQ ID:221.

Another function of GAM3229 is therefore inhibition of LOC349261 (Accession XP_300998.1). Accordingly, utilities of GAM3229 include diagnosis, prevention and treatment of diseases and clinical conditions associated with LOC349261.

LOC349360 (Accession XP_088528.1) is another GAM3229 target gene, herein designated TARGET GENE. LOC349360 BINDING SITE is a target binding site found in the 5' untranslated region of mRNA encoded by LOC349360, corresponding to a target binding site such as BINDING SITE I, BINDING SITE II or BINDING SITE III of FIG. 8. Table 4 illustrates the complementarity of the nucleotide sequences of LOC349360 BINDING SITE, designated SEQ ID:6478, to the nucleotide sequence of GAM3229 RNA, herein designated GAM RNA, also designated SEQ ID:221.

Another function of GAM3229 is therefore inhibition of LOC349360 (Accession XP_088528.1). Accordingly, utilities of GAM3229 include diagnosis, prevention and treatment of diseases and clinical conditions associated with LOC349360.

LOC349430 (Accession XP_301084.1) is another GAM3229 target gene, herein designated TARGET GENE. LOC349430 BINDING SITE is a target binding site found in the 3' untranslated region of mRNA encoded by LOC349430, corresponding to a target binding site such as BINDING SITE I, BINDING SITE II or BINDING SITE III of FIG. 8. Table 4 illustrates the complementarity of the nucleotide sequences of LOC349430 BINDING SITE, designated SEQ ID:6220, to the nucleotide sequence of GAM3229 RNA, herein designated GAM RNA, also designated SEQ ID:221.

Another function of GAM3229 is therefore inhibition of LOC349430 (Accession XP_301084.1). Accordingly, utilities of GAM3229 include diagnosis, prevention and treatment of diseases and clinical conditions associated with LOC349430.

LOC349440 (Accession XP_300513.1) is another GAM3229 target gene, herein designated TARGET GENE. LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:9876, to the nucleotide sequence of GAM3229 RNA, herein designated GAM RNA, also designated SEQ ID:221.

Another function of GAM3229 is therefore inhibition of LOC349440 (Accession XP_300513.1). Accordingly, utilities of GAM3229 include diagnosis, prevention and treatment of diseases and clinical conditions associated with LOC349440.

LOC51193 (Accession NP_057415.1) is another GAM3229 target gene, herein designated TARGET GENE. LOC51193 BINDING SITE is a target binding site found in the 3' untranslated region of mRNA encoded by LOC51193, corresponding to a target binding site such as BINDING SITE I, BINDING SITE II or BINDING SITE III of FIG. 8. Table 4 illustrates the complementarity of the nucleotide sequences of LOC51193 BINDING SITE, designated SEQ ID:4293, to the nucleotide sequence of GAM3229 RNA, herein designated GAM RNA, also designated SEQ ID:221.

Another function of GAM3229 is therefore inhibition of LOC51193 (Accession NP_057415.1). Accordingly, utilities of GAM3229 include diagnosis, prevention and treatment of diseases and clinical conditions associated with LOC51193.

LOC55954 (Accession NP_061976.1) is another GAM3229 target gene, herein designated TARGET GENE. LOC55954 BINDING SITE is a target binding site found in the 5' untranslated region of mRNA encoded by LOC55954, corresponding to a target binding site such as BINDING SITE I, BINDING SITE II or BINDING SITE III of FIG. 8. Table 4 illustrates the complementarity of the nucleotide sequences of LOC55954 BINDING SITE, designated SEQ ID:5283, to the nucleotide sequence of GAM3229 RNA, herein designated GAM RNA, also designated SEQ ID:221.

Another function of GAM3229 is therefore inhibition of LOC55954 (Accession NP_061976.1). Accordingly, utilities of GAM3229 include diagnosis, prevention and treatment of diseases and clinical conditions associated with LOC55954.

LOC90408 (Accession XP_031517.1) is another GAM3229 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:16149, to the nucleotide sequence of GAM3229 RNA, herein designated GAM RNA, also designated SEQ ID:221.

Another function of GAM3229 is therefore inhibition of LOC90408 (Accession XP_031517.1). Accordingly, utilities of GAM3229 include diagnosis, prevention and treatment of diseases and clinical conditions associated with LOC90408.

LOC90485 (Accession XP_032059.1) is another GAM3229 target gene, herein designated TARGET GENE. LOC90485 BINDING SITE is a target binding site found in the 3' untranslated region of mRNA encoded by LOC90485, corresponding to a target binding site such as BINDING SITE I, BINDING SITE II or BINDING SITE III of FIG. 8. Table 4 illustrates the complementarity of the nucleotide sequences of LOC90485 BINDING SITE, designated SEQ ID:2914, to the nucleotide sequence of GAM3229 RNA, herein designated GAM RNA, also designated SEQ ID:221.

Another function of GAM3229 is therefore inhibition of LOC90485 (Accession XP_032059.1). Accordingly, utilities of GAM3229 include diagnosis, prevention and treatment of diseases and clinical conditions associated with LOC90485.

LOC91250 (Accession XP_037135.1) is another GAM3229 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:18320, to the nucleotide sequence of GAM3229 RNA, herein designated GAM RNA, also designated SEQ ID:221.

Another function of GAM3229 is therefore inhibition of LOC91250 (Accession XP_037135.1). Accordingly, utilities of GAM3229 include diagnosis, prevention and treatment of diseases and clinical conditions associated with LOC91250.

LOC92597 (Accession NP_775739.1) is another GAM3229 target gene, herein designated TARGET GENE. LOC92597 BINDING SITE is a target binding site found in the 3' untranslated region of mRNA encoded by LOC92597, corresponding to a target binding site such as BINDING SITE I, BINDING SITE II or BINDING SITE III of FIG. 8. Table 4 illustrates the complementarity of the nucleotide sequences of LOC92597 BINDING SITE, designated SEQ ID:4501, to the nucleotide sequence of GAM3229 RNA, herein designated GAM RNA, also designated SEQ ID:221.

Another function of GAM3229 is therefore inhibition of LOC92597 (Accession NP_775739.1). Accordingly, utilities of GAM3229 include diagnosis, prevention and treatment of diseases and clinical conditions associated with LOC92597.

LOC93463 (Accession XP_051528.1) is another GAM3229 target gene, herein designated TARGET GENE. LOC93463 BINDING SITE is a target binding site found in the 3' untranslated region of mRNA encoded by LOC93463, corresponding to a target binding site such as BINDING SITE I, BINDING SITE II or BINDING SITE III of FIG. 8. Table 4 illustrates the complementarity of the nucleotide sequences of LOC93463 BINDING SITE, designated SEQ ID:1098, to the nucleotide sequence of GAM3229 RNA, herein designated GAM RNA, also designated SEQ ID:221.

Another function of GAM3229 is therefore inhibition of LOC93463 (Accession XP_051528.1). Accordingly, utilities of GAM3229 include diagnosis, prevention and treatment of diseases and clinical conditions associated with LOC93463.

Low density lipoprotein receptor-related protein 4 (LRP4, Accession XP_035037.2) is another GAM3229 target gene, herein designated TARGET GENE. LRP4 BINDING SITE is a target binding site found in the 3' untranslated region of mRNA encoded by LRP4, corresponding to a target binding site such as BINDING SITE I, BINDING SITE II or BINDING SITE III of FIG. 8. Table 4 illustrates the complementarity of the nucleotide sequences of LRP4 BINDING SITE, designated SEQ ID:16726, to the nucleotide sequence of GAM3229 RNA, herein designated GAM RNA, also designated SEQ ID:221.

Another function of GAM3229 is therefore inhibition of Low density lipoprotein receptor-related protein 4 (LRP4, Accession XP_035037.2). Accordingly, utilities of GAM3229 include diagnosis, prevention and treatment of diseases and clinical conditions associated with LRP4.

Lymphocyte antigen 6 complex, locus g6c (LY6G6C, Accession NP_079537.1) is another GAM3229 target gene, herein designated TARGET GENE. LY6G6C BINDING SITE is a target binding site found in the 3' untranslated region of mRNA encoded by LY6G6C, corresponding to a target binding site such as BINDING SITE I, BINDING SITE II or BINDING SITE III of FIG. 8. Table 4 illustrates the complementarity of the nucleotide sequences of LY6G6C BINDING SITE, designated SEQ ID:11181, to the nucleotide sequence of GAM3229 RNA, herein designated GAM RNA, also designated SEQ ID:221.

Another function of GAM3229 is therefore inhibition of Lymphocyte antigen 6 complex, locus g6c (LY6G6C, Accession NP_079537.1). Accordingly, utilities of GAM3229 include diagnosis, prevention and treatment of diseases and clinical conditions associated with LY6G6C.

Leucine zipper, putative tumor suppressor 1 (LZTS1, Accession NP_066300.1) is another GAM3229 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:1073, to the nucleotide sequence of GAM3229 RNA, herein designated GAM RNA, also designated SEQ ID:221.

Another function of GAM3229 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM3229 include diagnosis, prevention and treatment of diseases and clinical conditions associated with LZTS1.

The function of LZTS1 and its association with various diseases and clinical conditions, has been established by previous studies, as described hereinabove with reference to GAM130.1. MAC30 (Accession XP_031536.2) is another GAM3229 target gene, herein designated TARGET GENE. MAC30 BINDING SITE is a target binding site found in the 3' untranslated region of mRNA encoded by MAC30, corresponding to a target binding site such as BINDING SITE I, BINDING SITE II or BINDING SITE III of FIG. 8. Table 4 illustrates the complementarity of the nucleotide sequences of MAC30 BINDING SITE, designated SEQ ID:15124, to the nucleotide sequence of GAM3229 RNA, herein designated GAM RNA, also designated SEQ ID:221.

Another function of GAM3229 is therefore inhibition of MAC30 (Accession XP_031536.2). Accordingly, utilities of GAM3229 include diagnosis, prevention and treatment of diseases and clinical conditions associated with MAC30.

Mannosidase, beta a, lysosomal-like (MANBAL, Accession NP_071360.1) is another GAM3229 target gene, herein designated TARGET GENE. MANBAL BINDING SITE is a target binding site found in the 5' untranslated region of mRNA encoded by MANBAL, corresponding to a target binding site such as BINDING SITE I, BINDING SITE II or BINDING SITE III of FIG. 8. Table 4 illustrates the complementarity of the nucleotide sequences of MANBAL BINDING SITE, designated SEQ ID:18033, to the nucleotide sequence of GAM3229 RNA, herein designated GAM RNA, also designated SEQ ID:221.

Another function of GAM3229 is therefore inhibition of Mannosidase, beta a, lysosomal-like (MANBAL, Accession NP_071360.1). Accordingly, utilities of GAM3229 include diagnosis, prevention and treatment of diseases and clinical conditions associated with MANBAL.

Microtubule-associated protein 1 light chain 3 beta (MAP1LC3B, Accession NP_073729.1) is another GAM3229 target gene, herein designated TARGET GENE. MAP1LC3B BINDING SITE is a target binding site found in the 3' untranslated region of mRNA encoded by MAP1LC3B, corresponding to a target binding site such as BINDING SITE I, BINDING SITE II or BINDING SITE III of FIG. 8. Table 4 illustrates the complementarity of the nucleotide sequences of MAP1LC3B BINDING SITE, designated SEQ ID:18525, to the nucleotide sequence of GAM3229 RNA, herein designated GAM RNA, also designated SEQ ID:221.

Another function of GAM3229 is therefore inhibition of Microtubule-associated protein 1 light chain 3 beta (MAP1LC3B, Accession NP_073729.1). Accordingly, utilities of GAM3229 include diagnosis, prevention and treatment of diseases and clinical conditions associated with MAP1LC3B.

MAPA (Accession NP_660299.1) is another GAM3229 target gene, herein designated TARGET GENE. MAPA BINDING SITE is a target binding site found in the 3' untranslated region of mRNA encoded by MAPA, corresponding to a target binding site such as BINDING SITE I, BINDING SITE II or BINDING SITE III of FIG. 8. Table 4 illustrates the complementarity of the nucleotide sequences of MAPA BINDING SITE, designated SEQ ID:17799, to the nucleotide sequence of GAM3229 RNA, herein designated GAM RNA, also designated SEQ ID:221.

Another function of GAM3229 is therefore inhibition of MAPA (Accession NP_660299.1). Accordingly, utilities of GAM3229 include diagnosis, prevention and treatment of diseases and clinical conditions associated with MAPA.

Microtubule-associated protein tau (MAPT, Accession NP_776088.1) is another GAM3229 target gene, herein designated TARGET GENE. MAPT BINDING SITE is a target binding site found in the 3' untranslated region of multiple transcripts of mRNA encoded by MAPT, corresponding to a target binding site such as BINDING SITE I, BINDING SITE II or BINDING SITE III of FIG. 8. Table 4 illustrates the complementarity of the nucleotide sequences of MAPT BINDING SITE, designated SEQ ID:18784, to the nucleotide sequence of GAM3229 RNA, herein designated GAM RNA, also designated SEQ ID:221.

Another function of GAM3229 is therefore inhibition of Microtubule-associated protein tau (MAPT, Accession NP_776088.1), a gene which Microtubule-associated protein tau; promotes microtubule assembly. and therefore is associated with Frontotemporal dementia, pallidopontonigral degeneration, pick disease-like dementia, pick disease. Accordingly, utilities of GAM3229 include diagnosis, prevention and treatment of Frontotemporal dementia, pallidopontonigral degeneration, pick disease-like dementia, pick disease, and of other diseases and clinical conditions associated with MAPT.

The function of MAPT and its association with various diseases and clinical conditions, has been established by previous studies, as described hereinabove with reference to GAM200.2. Map/microtubule affinity-regulating kinase 2 (MARK2, Accession NP_059672.1) is another GAM3229 target gene, herein designated TARGET GENE. MARK2 BINDING SITE is a target binding site found in the 3' untranslated region of multiple transcripts of mRNA encoded by MARK2, corresponding to a target binding site such as BINDING SITE I, BINDING SITE II or BINDING SITE III of FIG. 8. Table 4 illustrates the complementarity of the nucleotide sequences of MARK2 BINDING SITE, designated SEQ ID:8182, to the nucleotide sequence of GAM3229 RNA, herein designated GAM RNA, also designated SEQ ID:221.

Another function of GAM3229 is therefore inhibition of Map/microtubule affinity-regulating kinase 2 (MARK2, Accession NP_059672.1). Accordingly, utilities of GAM3229 include diagnosis, prevention and treatment of diseases and clinical conditions associated with MARK2.

Map/microtubule affinity-regulating kinase 2 (MARK2, Accession NP_004945.2) is another GAM3229 target gene, herein designated TARGET GENE. MARK2 BINDING SITE is a target binding site found in the 3' untranslated region of multiple transcripts of mRNA encoded by MARK2, corresponding to a target binding site such as BINDING SITE I, BINDING SITE II or BINDING SITE III of FIG. 8. Table 4 illustrates the complementarity of the nucleotide sequences of MARK2 BINDING SITE, designated SEQ ID:8182, to the nucleotide sequence of GAM3229 RNA, herein designated GAM RNA, also designated SEQ ID:221.

Another function of GAM3229 is therefore inhibition of Map/microtubule affinity-regulating kinase 2 (MARK2, Accession NP_004945.2). Accordingly, utilities of GAM3229 include diagnosis, prevention and treatment of diseases and clinical conditions associated with MARK2.

Mcm10 minichromosome maintenance deficient 10 (s. cerevisiae) (MCM10, Accession NP_060988.2) is another GAM3229 target gene, herein designated TARGET GENE. MCM10 BINDING SITE is a target binding site found in the 3' untranslated region of mRNA encoded by MCM10, corresponding to a target binding site such as BINDING SITE I, BINDING SITE II or BINDING SITE III of FIG. 8. Table 4 illustrates the complementarity of the nucleotide sequences of MCM10 BINDING SITE, designated SEQ ID:6797, to the nucleotide sequence of GAM3229 RNA, herein designated GAM RNA, also designated SEQ ID:221.

Another function of GAM3229 is therefore inhibition of Mcm10 minichromosome maintenance deficient 10 (s. cerevisiae) (MCM10, Accession NP_060988.2). Accordingly, utilities of GAM3229 include diagnosis, prevention and treatment of diseases and clinical conditions associated with MCM10.

Mediterranean fever (MEFV, Accession NP_000234.1) is another GAM3229 target gene, herein designated TARGET GENE. MEFV BINDING SITE is a target binding site found in the 3' untranslated region of mRNA encoded by MEFV, corresponding to a target binding site such as BINDING SITE I, BINDING SITE II or BINDING SITE III of FIG. 8. Table 4 illustrates the complementarity of the nucleotide sequences of MEFV BINDING SITE, designated SEQ ID:5889, to the nucleotide sequence of GAM3229 RNA, herein designated GAM RNA, also designated SEQ ID:221.

Another function of GAM3229 is therefore inhibition of Mediterranean fever (MEFV, Accession NP_000234.1). Accordingly, utilities of GAM3229 include diagnosis, prevention and treatment of diseases and clinical conditions associated with MEFV.

MGC10200 (Accession NP_659497.1) is another GAM3229 target gene, herein designated TARGET GENE. MGC10200 BINDING SITE is a target binding site found in the 3' untranslated region of mRNA encoded by MGC10200, corresponding to a target binding site such as BINDING SITE I, BINDING SITE II or BINDING SITE III of FIG. 8. Table 4 illustrates the complementarity of the nucleotide sequences of MGC10200 BINDING SITE, designated SEQ ID:5932, to the nucleotide sequence of GAM3229 RNA, herein designated GAM RNA, also designated SEQ ID:221.

Another function of GAM3229 is therefore inhibition of MGC10200 (Accession NP_659497.1). Accordingly, utilities of GAM3229 include diagnosis, prevention and treatment of diseases and clinical conditions associated with MGC10200.

MGC10818 (Accession NP_085045.2) is another GAM3229 target gene, herein designated TARGET GENE. MGC10818 BINDING SITE is a target binding site found in the 3' untranslated region of mRNA encoded by MGC10818, corresponding to a target binding site such as BINDING SITE I, BINDING SITE II or BINDING SITE III of FIG. 8. Table 4 illustrates the complementarity of the nucleotide sequences of MGC10818 BINDING SITE, designated SEQ ID:14416, to the nucleotide sequence of GAM3229 RNA, herein designated GAM RNA, also designated SEQ ID:221.

Another function of GAM3229 is therefore inhibition of MGC10818 (Accession NP_085045.2). Accordingly, utilities of GAM3229 include diagnosis, prevention and treatment of diseases and clinical conditions associated with MGC10818.

MGC10986 (Accession NP_085053.1) is another GAM3229 target gene, herein designated TARGET GENE. MGC10986 BINDING SITE is a target binding site found in the 3' untranslated region of mRNA encoded by MGC10986, corresponding to a target binding site such as BINDING SITE I, BINDING SITE II or BINDING SITE III of FIG. 8. Table 4 illustrates the complementarity of the nucleotide sequences of MGC10986 BINDING SITE, designated SEQ ID:6559, to the nucleotide sequence of GAM3229 RNA, herein designated GAM RNA, also designated SEQ ID:221.

Another function of GAM3229 is therefore inhibition of MGC10986 (Accession NP_085053.1). Accordingly, utilities of GAM3229 include diagnosis, prevention and treatment of diseases and clinical conditions associated with MGC10986.

MGC11386 (Accession NP_116322.1) is another GAM3229 target gene, herein designated TARGET GENE. MGC11386 BINDING SITE is a target binding site found in the 3' untranslated region of mRNA encoded by MGC11386, corresponding to a target binding site such as BINDING SITE I, BINDING SITE II or BINDING SITE III of FIG. 8. Table 4 illustrates the complementarity of the nucleotide sequences of MGC11386 BINDING SITE, designated SEQ ID:4993, to the nucleotide sequence of GAM3229 RNA, herein designated GAM RNA, also designated SEQ ID:221.

Another function of GAM3229 is therefore inhibition of MGC11386 (Accession NP_116322.1). Accordingly, utilities of GAM3229 include diagnosis, prevention and treatment of diseases and clinical conditions associated with MGC11386.

MGC13024 (Accession NP_689501.1) is another GAM3229 target gene, herein designated TARGET GENE. MGC13024 BINDING SITE is a target binding site found in the 3' untranslated region of mRNA encoded by MGC13024, corresponding to a target binding site such as BINDING SITE I, BINDING SITE II or BINDING SITE III of FIG. 8. Table 4 illustrates the complementarity of the nucleotide sequences of MGC13024 BINDING SITE, designated SEQ ID:16302, to the nucleotide sequence of GAM3229 RNA, herein designated GAM RNA, also designated SEQ ID:221.

Another function of GAM3229 is therefore inhibition of MGC13024 (Accession NP_689501.1). Accordingly, utilities of GAM3229 include diagnosis, prevention and treatment of diseases and clinical conditions associated with MGC13024.

MGC13138 (Accession NP_219363.1) is another GAM3229 target gene, herein designated TARGET GENE. MGC13138 BINDING SITE is a target binding site found in the 3' untranslated region of mRNA encoded by MGC13138, corresponding to a target binding site such as BINDING SITE I, BINDING SITE II or BINDING SITE III of FIG. 8. Table 4 illustrates the complementarity of the nucleotide sequences of MGC13138 BINDING SITE, designated SEQ ID:10825, to the nucleotide sequence of GAM3229 RNA, herein designated GAM RNA, also designated SEQ ID:221.

Another function of GAM3229 is therefore inhibition of MGC13138 (Accession NP_219363.1). Accordingly, utilities of GAM3229 include diagnosis, prevention and treatment of diseases and clinical conditions associated with MGC13138.

MGC14289 (Accession NP_542391.1) is another GAM3229 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:13575, to the nucleotide sequence of GAM3229 RNA, herein designated GAM RNA, also designated SEQ ID:221.

Another function of GAM3229 is therefore inhibition of MGC14289 (Accession NP_542391.1). Accordingly, utilities of GAM3229 include diagnosis, prevention and treatment of diseases and clinical conditions associated with MGC14289.

MGC14386 (Accession NP_291022.1) is another GAM3229 target gene, herein designated TARGET GENE. MGC14386 BINDING SITE is a target binding site found in the 3' untranslated region of mRNA encoded by MGC14386, corresponding to a target binding site such as BINDING SITE I, BINDING SITE II or BINDING SITE III of FIG. 8. Table 4 illustrates the complementarity of the nucleotide sequences of MGC14386 BINDING SITE, designated SEQ ID:10978, to the nucleotide sequence of GAM3229 RNA, herein designated GAM RNA, also designated SEQ ID:221.

Another function of GAM3229 is therefore inhibition of MGC14386 (Accession NP_291022.1). Accordingly, utilities of GAM3229 include diagnosis, prevention and treatment of diseases and clinical conditions associated with MGC14386.

MGC14836 (Accession NP_219480.1) is another GAM3229 target gene, herein designated TARGET GENE. MGC14836 BINDING SITE is a target binding site found in the 3' untranslated region of mRNA encoded by MGC14836, corresponding to a target binding site such as BINDING SITE I, BINDING SITE II or BINDING SITE III of FIG. 8. Table 4 illustrates the complementarity of the nucleotide sequences of MGC14836 BINDING SITE, designated SEQ ID:12819, to the nucleotide sequence of GAM3229 RNA, herein designated GAM RNA, also designated SEQ ID:221.

Another function of GAM3229 is therefore inhibition of MGC14836 (Accession NP_219480.1). Accordingly, utilities of GAM3229 include diagnosis, prevention and treatment of diseases and clinical conditions associated with MGC14836.

MGC15606 (Accession NP_659474.1) is another GAM3229 target gene, herein designated TARGET GENE. MGC15606 BINDING SITE is a target binding site found in the 5' untranslated region of mRNA encoded by MGC15606, corresponding to a target binding site such as BINDING SITE I, BINDING SITE II or BINDING SITE III of FIG. 8. Table 4 illustrates the complementarity of the nucleotide sequences of MGC15606 BINDING SITE, designated SEQ ID:9411, to the nucleotide sequence of GAM3229 RNA, herein designated GAM RNA, also designated SEQ ID:221.

Another function of GAM3229 is therefore inhibition of MGC15606 (Accession NP_659474.1). Accordingly, utilities of GAM3229 include diagnosis, prevention and treatment of diseases and clinical conditions associated with MGC15606.

MGC21675 (Accession NP_443093.1) is another GAM3229 target gene, herein designated TARGET GENE. MGC21675 BINDING SITE is a target binding site found in the 3' untranslated region of mRNA encoded by MGC21675, corresponding to a target binding site such as BINDING SITE I, BINDING SITE II or BINDING SITE III of FIG. 8. Table 4 illustrates the complementarity of the nucleotide sequences of MGC21675 BINDING SITE, designated SEQ ID:1835, to the nucleotide sequence of GAM3229 RNA, herein designated GAM RNA, also designated SEQ ID:221.

Another function of GAM3229 is therefore inhibition of MGC21675 (Accession NP_443093.1). Accordingly, utilities of GAM3229 include diagnosis, prevention and treatment of diseases and clinical conditions associated with MGC21675.

MGC2452 (Accession NP_116033.1) is another GAM3229 target gene, herein designated TARGET GENE. MGC2452 BINDING SITE is a target binding site found in the 5' untranslated region of mRNA encoded by MGC2452, corresponding to a target binding site such as BINDING SITE I, BINDING SITE II or BINDING SITE III of FIG. 8. Table 4 illustrates the complementarity of the nucleotide sequences of MGC2452 BINDING SITE, designated SEQ ID:6351, to the nucleotide sequence of GAM3229 RNA, herein designated GAM RNA, also designated SEQ ID:221.

Another function of GAM3229 is therefore inhibition of MGC2452 (Accession NP_116033.1). Accordingly, utilities of GAM3229 include diagnosis, prevention and treatment of diseases and clinical conditions associated with MGC2452.

MGC2474 (Accession NP_076420.1) is another GAM3229 target gene, herein designated TARGET GENE. MGC2474 BINDING SITE is a target binding site found in the 3' untranslated region of mRNA encoded by MGC2474, corresponding to a target binding site such as BINDING SITE I, BINDING SITE II or BINDING SITE III of FIG. 8. Table 4 illustrates the complementarity of the nucleotide sequences of MGC2474 BINDING SITE, designated SEQ ID:5948, to the nucleotide sequence of GAM3229 RNA, herein designated GAM RNA, also designated SEQ ID:221.

Another function of GAM3229 is therefore inhibition of MGC2474 (Accession NP_076420.1). Accordingly, utilities of GAM3229 include diagnosis, prevention and treatment of diseases and clinical conditions associated with MGC2474.

MGC26979 (Accession NP_714915.1) is another GAM3229 target gene, herein designated TARGET GENE. MGC26979 BINDING SITE is a target binding site found in the 3' untranslated region of mRNA encoded by MGC26979, corresponding to a target binding site such as BINDING SITE I, BINDING SITE II or BINDING SITE III of FIG. 8. Table 4 illustrates the complementarity of the nucleotide sequences of MGC26979 BINDING SITE, designated SEQ ID:15483, to the nucleotide sequence of GAM3229 RNA, herein designated GAM RNA, also designated SEQ ID:221.

Another function of GAM3229 is therefore inhibition of MGC26979 (Accession NP_714915.1). Accordingly, utilities of GAM3229 include diagnosis, prevention and treatment of diseases and clinical conditions associated with MGC26979.

MGC27345 (Accession XP_300964.1) is another GAM3229 target gene, herein designated TARGET GENE. MGC27345 BINDING SITE1 and MGC27345 BINDING SITE2 are target binding sites found in untranslated regions of multiple transcripts of mRNA encoded by MGC27345, corresponding to target binding sites such as BINDING SITE I, BINDING SITE II or BINDING SITE III of FIG. 8. Table 4 illustrates the complementarity of the nucleotide sequences of MGC27345 BINDING SITE1 and MGC27345 BINDING SITE2, designated SEQ ID:10537 and SEQ ID:8394 respectively, to the nucleotide sequence of GAM3229 RNA, herein designated GAM RNA, also designated SEQ ID:221.

Another function of GAM3229 is therefore inhibition of MGC27345 (Accession XP_300964.1). Accordingly, utilities of GAM3229 include diagnosis, prevention and treatment of diseases and clinical conditions associated with MGC27345.

MGC27345 (Accession NP_787076.1) is another GAM3229 target gene, herein designated TARGET GENE. MGC27345 BINDING SITE1 and MGC27345 BINDING SITE2 are target binding sites found in untranslated regions of multiple transcripts of mRNA encoded by MGC27345, corresponding to target binding sites such as BINDING SITE I, BINDING SITE II or BINDING SITE III of FIG. 8. Table 4 illustrates the complementarity of the nucleotide sequences of MGC27345 BINDING SITE1 and MGC27345 BINDING SITE2, designated SEQ ID:10537 and SEQ ID:10712 respectively, to the nucleotide sequence of GAM3229 RNA, herein designated GAM RNA, also designated SEQ ID:221.

Another function of GAM3229 is therefore inhibition of MGC27345 (Accession NP_787076.1). Accordingly, utilities of GAM3229 include diagnosis, prevention and treatment of diseases and clinical conditions associated with MGC27345.

MGC3113 (Accession NP_076940.1) is another GAM3229 target gene, herein designated TARGET GENE. MGC3113 BINDING SITE1 and MGC3113 BINDING SITE2 are target binding sites found in untranslated regions of mRNA encoded by MGC3113, corresponding to target binding sites such as BINDING SITE I, BINDING SITE II or BINDING SITE III of FIG. 8. Table 4 illustrates the complementarity of the nucleotide sequences of MGC3113 BINDING SITE1 and MGC3113 BINDING SITE2, designated SEQ ID:2387 and SEQ ID:18526 respectively, to the nucleotide sequence of GAM3229 RNA, herein designated GAM RNA, also designated SEQ ID:221.

Another function of GAM3229 is therefore inhibition of MGC3113 (Accession NP_076940.1). Accordingly, utilities of GAM3229 include diagnosis, prevention and treatment of diseases and clinical conditions associated with MGC3113.

MGC33637 (Accession NP_689809.1) is another GAM3229 target gene, herein designated TARGET GENE. MGC33637 BINDING SITE is a target binding site found in the 3' untranslated region of mRNA encoded by MGC33637, corresponding to a target binding site such as BINDING SITE I, BINDING SITE II or BINDING SITE III of FIG. 8. Table 4 illustrates the complementarity of the nucleotide sequences of MGC33637 BINDING SITE, designated SEQ ID:10075, to the nucleotide sequence of GAM3229 RNA, herein designated GAM RNA, also designated SEQ ID:221.

Another function of GAM3229 is therefore inhibition of MGC33637 (Accession NP_689809.1). Accordingly, utilities of GAM3229 include diagnosis, prevention and treatment of diseases and clinical conditions associated with MGC33637.

MGC34132 (Accession XP_291029.1) is another GAM3229 target gene, herein designated TARGET GENE. MGC34132 BINDING SITE is a target binding site found in the 3' untranslated region of mRNA encoded by MGC34132, corresponding to a target binding site such as BINDING SITE I, BINDING SITE II or BINDING SITE III of FIG. 8. Table 4 illustrates the complementarity of the nucleotide sequences of MGC34132 BINDING SITE, designated SEQ ID:17411, to the nucleotide sequence of GAM3229 RNA, herein designated GAM RNA, also designated SEQ ID:221.

Another function of GAM3229 is therefore inhibition of MGC34132 (Accession XP_291029.1). Accordingly, utilities of GAM3229 include diagnosis, prevention and treatment of diseases and clinical conditions associated with MGC34132.

MGC35163 (Accession NP_689765.1) is another GAM3229 target gene, herein designated TARGET GENE. MGC35163 BINDING SITE is a target binding site found in the 3' untranslated region of mRNA encoded by MGC35163, corresponding to a target binding site such as BINDING SITE I, BINDING SITE II or BINDING SITE III of FIG. 8. Table 4 illustrates the complementarity of the nucleotide sequences of MGC35163 BINDING SITE, designated SEQ ID:2119, to the nucleotide sequence of GAM3229 RNA, herein designated GAM RNA, also designated SEQ ID:221.

Another function of GAM3229 is therefore inhibition of MGC35163 (Accession NP_689765.1). Accordingly, utilities of GAM3229 include diagnosis, prevention and treatment of diseases and clinical conditions associated with MGC35163.

MGC35308 (Accession NP_787118.1) is another GAM3229 target gene, herein designated TARGET GENE. MGC35308 BINDING SITE is a target binding site found in the 3' untranslated region of mRNA encoded by MGC35308, corresponding to a target binding site such as BINDING SITE I, BINDING SITE II or BINDING SITE III of FIG. 8. Table 4 illustrates the complementarity of the nucleotide sequences of MGC35308 BINDING SITE, designated SEQ ID:14998, to the nucleotide sequence of GAM3229 RNA, herein designated GAM RNA, also designated SEQ ID:221.

Another function of GAM3229 is therefore inhibition of MGC35308 (Accession NP_787118.1). Accordingly, utilities of GAM3229 include diagnosis, prevention and treatment of diseases and clinical conditions associated with MGC35308.

MGC35468 (Accession NP_694976.1) is another GAM3229 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:12471, to the nucleotide sequence of GAM3229 RNA, herein designated GAM RNA, also designated SEQ ID:221.

Another function of GAM3229 is therefore inhibition of MGC35468 (Accession NP_694976.1). Accordingly, utilities of GAM3229 include diagnosis, prevention and treatment of diseases and clinical conditions associated with MGC35468.

MGC46336 (Accession XP_290712.1) is another GAM3229 target gene, herein designated TARGET GENE. MGC46336 BINDING SITE is a target binding site found in the 3' untranslated region of mRNA encoded by MGC46336, corresponding to a target binding site such as BINDING SITE I, BINDING SITE II or BINDING SITE III of FIG. 8. Table 4 illustrates the complementarity of the nucleotide sequences of MGC46336 BINDING SITE, designated SEQ ID:8629, to the nucleotide sequence of GAM3229 RNA, herein designated GAM RNA, also designated SEQ ID:221.

Another function of GAM3229 is therefore inhibition of MGC46336 (Accession XP_290712.1). Accordingly, utilities of GAM3229 include diagnosis, prevention and treatment of diseases and clinical conditions associated with MGC46336.

MGC50337 (Accession NP_848604.1) is another GAM3229 target gene, herein designated TARGET GENE. MGC50337 BINDING SITE is a target binding site found in the 3' untranslated region of mRNA encoded by MGC50337, corresponding to a target binding site such as BINDING SITE I, BINDING SITE II or BINDING SITE III of FIG. 8. Table 4 illustrates the complementarity of the nucleotide sequences of MGC50337 BINDING SITE, designated SEQ ID:17884, to the nucleotide sequence of GAM3229 RNA, herein designated GAM RNA, also designated SEQ ID:221.

Another function of GAM3229 is therefore inhibition of MGC50337 (Accession NP_848604.1). Accordingly, utilities of GAM3229 include diagnosis, prevention and treatment of diseases and clinical conditions associated with MGC50337.

MGC5149 (Accession XP_051200.2) is another GAM3229 target gene, herein designated TARGET GENE. MGC5149 BINDING SITE is a target binding site found in the 3' untranslated region of mRNA encoded by MGC5149, corresponding to a target binding site such as BINDING SITE I, BINDING SITE II or BINDING SITE III of FIG. 8. Table 4 illustrates the complementarity of the nucleotide sequences of MGC5149 BINDING SITE, designated SEQ ID:940, to the nucleotide sequence of GAM3229 RNA, herein designated GAM RNA, also designated SEQ ID:221.

Another function of GAM3229 is therefore inhibition of MGC5149 (Accession XP_051200.2). Accordingly, utilities of GAM3229 include diagnosis, prevention and treatment of diseases and clinical conditions associated with MGC5149.

MGC9726 (Accession NP_796377.1) is another GAM3229 target gene, herein designated TARGET GENE. MGC9726 BINDING SITE is a target binding site found in the 3' untranslated region of mRNA encoded by MGC9726, corresponding to a target binding site such as BINDING SITE I, BINDING SITE II or BINDING SITE III of FIG. 8. Table 4 illustrates the complementarity of the nucleotide sequences of MGC9726 BINDING SITE, designated SEQ ID:18506, to the nucleotide sequence of GAM3229 RNA, herein designated GAM RNA, also designated SEQ ID:221.

Another function of GAM3229 is therefore inhibition of MGC9726 (Accession NP_796377.1). Accordingly, utilities of GAM3229 include diagnosis, prevention and treatment of diseases and clinical conditions associated with MGC9726.

Mhc class ii transactivator (MHC2TA, Accession NP_000237.1) is another GAM3229 target gene, herein designated TARGET GENE. MHC2TA BINDING SITE1 and MHC2TA BINDING SITE2 are target binding sites found in untranslated regions of mRNA encoded by MHC2TA, corresponding to target binding sites such as BINDING SITE I, BINDING SITE II or BINDING SITE III of FIG. 8. Table 4 illustrates the complementarity of the nucleotide sequences of MHC2TA BINDING SITE1 and MHC2TA BINDING SITE2, designated SEQ ID:12501 and SEQ ID:14620 respectively, to the nucleotide sequence of GAM3229 RNA, herein designated GAM RNA, also designated SEQ ID:221.

Another function of GAM3229 is therefore inhibition of Mhc class ii transactivator (MHC2TA, Accession NP_000237.1). Accordingly, utilities of GAM3229 include diagnosis, prevention and treatment of diseases and clinical conditions associated with MHC2TA.

Mhc class i polypeptide-related sequence b (MICB, Accession NP_005922.1) is another GAM3229 target gene, herein designated TARGET GENE. MICB BINDING SITE is a target binding site found in the 3' untranslated region of mRNA encoded by MICB, corresponding to a target binding site such as BINDING SITE I, BINDING SITE II or BINDING SITE III of FIG. 8. Table 4 illustrates the complementarity of the nucleotide sequences of MICB BINDING SITE, designated SEQ ID:11538, to the nucleotide sequence of GAM3229 RNA, herein designated GAM RNA, also designated SEQ ID:221.

Another function of GAM3229 is therefore inhibition of Mhc class i polypeptide-related sequence b (MICB, Accession NP_005922.1), a gene which involved in the presentation of foreign antigens to the immune system. Accordingly, utilities of GAM3229 include diagnosis, prevention and treatment of diseases and clinical conditions associated with MICB.

The function of MICB and its association with various diseases and clinical conditions, has been established by previous studies, as described hereinabove with reference to GAM258.1. MIDORI (Accession NP_065829.1) is another GAM3229 target gene, herein designated TARGET GENE. MIDORI BINDING SITE is a target binding site found in the 3' untranslated region of mRNA encoded by MIDORI, corresponding to a target binding site such as BINDING SITE I, BINDING SITE II or BINDING SITE III of FIG. 8. Table 4 illustrates the complementarity of the nucleotide sequences of MIDORI BINDING SITE, designated SEQ ID:7016, to the nucleotide sequence of GAM3229 RNA, herein designated GAM RNA, also designated SEQ ID:221.

Another function of GAM3229 is therefore inhibition of MIDORI (Accession NP_065829.1). Accordingly, utilities of GAM3229 include diagnosis, prevention and treatment of diseases and clinical conditions associated with MIDORI.

MIZF (Accession NP_056332.1) is another GAM3229 target gene, herein designated TARGET GENE. MIZF BINDING SITE is a target binding site found in the 5' untranslated region of mRNA encoded by MIZF, corresponding to a target binding site such as BINDING SITE I, BINDING SITE II or BINDING SITE III of FIG. 8. Table 4 illustrates the complementarity of the nucleotide sequences of MIZF BINDING SITE, designated SEQ ID:6430, to the nucleotide sequence of GAM3229 RNA, herein designated GAM RNA, also designated SEQ ID:221.

Another function of GAM3229 is therefore inhibition of MIZF (Accession NP_056332.1). Accordingly, utilities of GAM3229 include diagnosis, prevention and treatment of diseases and clinical conditions associated with MIZF.

Melan-a (MLANA, Accession NP_005502.1) is another GAM3229 target gene, herein designated TARGET GENE. MLANA BINDING SITE is a target binding site found in the 3' untranslated region of mRNA encoded by MLANA, corresponding to a target binding site such as BINDING SITE I, BINDING SITE II or BINDING SITE III of FIG. 8. Table 4 illustrates the complementarity of the nucleotide sequences of MLANA BINDING SITE, designated SEQ ID:12846, to the nucleotide sequence of GAM3229 RNA, herein designated GAM RNA, also designated SEQ ID:221.

Another function of GAM3229 is therefore inhibition of Melan-a (MLANA, Accession NP_005502.1). Accordingly, utilities of GAM3229 include diagnosis, prevention and treatment of diseases and clinical conditions associated with MLANA.

Melanoma-derived leucine zipper, extra-nuclear factor (MLZE, Accession NP_113603.1) is another GAM3229 target gene, herein designated TARGET GENE. MLZE BINDING SITE is a target binding site found in the 5' untranslated region of mRNA encoded by MLZE, corresponding to a target binding site such as BINDING SITE I, BINDING SITE II or BINDING SITE III of FIG. 8. Table 4 illustrates the complementarity of the nucleotide sequences of MLZE BINDING SITE, designated SEQ ID:2064, to the nucleotide sequence of GAM3229 RNA, herein designated GAM RNA, also designated SEQ ID:221.

Another function of GAM3229 is therefore inhibition of Melanoma-derived leucine zipper, extra-nuclear factor (MLZE, Accession NP_113603.1). Accordingly, utilities of GAM3229 include diagnosis, prevention and treatment of diseases and clinical conditions associated with MLZE.

Matrix metalloproteinase-like 1 (MMPL1, Accession NP_004133.1) is another GAM3229 target gene, herein designated TARGET GENE. MMPL1 BINDING SITE is a target binding site found in the 3' untranslated region of mRNA encoded by MMPL1, corresponding to a target binding site such as BINDING SITE I, BINDING SITE II or BINDING SITE III of FIG. 8. Table 4 illustrates the complementarity of the nucleotide sequences of MMPL1 BINDING SITE, designated SEQ ID:18579, to the nucleotide sequence of GAM3229 RNA, herein designated GAM RNA, also designated SEQ ID:221.

Another function of GAM3229 is therefore inhibition of Matrix metalloproteinase-like 1 (MMPL1, Accession NP_004133.1). Accordingly, utilities of GAM3229 include diagnosis, prevention and treatment of diseases and clinical conditions associated with MMPL1.

Mitochondrial ribosomal protein l30 (MRPL30, Accession NP_660213.1) is another GAM3229 target gene, herein designated TARGET GENE. MRPL30 BINDING SITE1 and MRPL30 BINDING SITE2 are target binding sites found in untranslated regions of multiple transcripts of mRNA encoded by MRPL30, corresponding to target binding sites such as BINDING SITE I, BINDING SITE II or BINDING SITE III of FIG. 8. Table 4 illustrates the complementarity of the nucleotide sequences of MRPL30 BINDING SITE1 and MRPL30 BINDING SITE2, designated SEQ ID:4263 and SEQ ID:4509 respectively, to the nucleotide sequence of GAM3229 RNA, herein designated GAM RNA, also designated SEQ ID:221.

Another function of GAM3229 is therefore inhibition of Mitochondrial ribosomal protein l30 (MRPL30, Accession NP_660213.1) . Accordingly, utilities of GAM3229 include diagnosis, prevention and treatment of diseases and clinical conditions associated with MRPL30.

Mitochondrial ribosomal protein s27 (MRPS27, Accession NP_055899.1) is another GAM3229 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:10070, to the nucleotide sequence of GAM3229 RNA, herein designated GAM RNA, also designated SEQ ID:221.

Another function of GAM3229 is therefore inhibition of Mitochondrial ribosomal protein s27 (MRPS27, Accession NP_055899.1) . Accordingly, utilities of GAM3229 include diagnosis, prevention and treatment of diseases and clinical conditions associated with MRPS27.

MRS3/4 (Accession NP_112489.2) is another GAM3229 target gene, herein designated TARGET GENE. MRS3/4 BINDING SITE is a target binding site found in the 3' untranslated region of mRNA encoded by MRS3/4, corresponding to a target binding site such as BINDING SITE I, BINDING SITE II or BINDING SITE III of FIG. 8. Table 4 illustrates the complementarity of the nucleotide sequences of MRS3/4 BINDING SITE, designated SEQ ID:7253, to the nucleotide sequence of GAM3229 RNA, herein designated GAM RNA, also designated SEQ ID:221.

Another function of GAM3229 is therefore inhibition of MRS3/4 (Accession NP_112489.2). Accordingly, utilities of GAM3229 include diagnosis, prevention and treatment of diseases and clinical conditions associated with MRS3/4.

MtFMT (Accession NP_640335.1) is another GAM3229 target gene, herein designated TARGET GENE. MtFMT BINDING SITE is a target binding site found in the 3' untranslated region of mRNA encoded by MtFMT, corresponding to a target binding site such as BINDING SITE I, BINDING SITE II or BINDING SITE III of FIG. 8. Table 4 illustrates the complementarity of the nucleotide sequences of MtFMT BINDING SITE, designated SEQ ID:6398, to the nucleotide sequence of GAM3229 RNA, herein designated GAM RNA, also designated SEQ ID:221.

Another function of GAM3229 is therefore inhibition of MtFMT (Accession NP_640335.1). Accordingly, utilities of GAM3229 include diagnosis, prevention and treatment of diseases and clinical conditions associated with MtFMT.

MTH2 (Accession NP_060753.1) is another GAM3229 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:18725, to the nucleotide sequence of GAM3229 RNA, herein designated GAM RNA, also designated SEQ ID:221.

Another function of GAM3229 is therefore inhibition of MTH2 (Accession NP_060753.1). Accordingly, utilities of GAM3229 include diagnosis, prevention and treatment of diseases and clinical conditions associated with MTH2.

MYLC2PL (Accession NP_612412.1) is another GAM3229 target gene, herein designated TARGET GENE. MYLC2PL BINDING SITE is a target binding site found in the 5' untranslated region of mRNA encoded by MYLC2PL, corresponding to a target binding site such as BINDING SITE I, BINDING SITE II or BINDING SITE III of FIG. 8. Table 4 illustrates the complementarity of the nucleotide sequences of MYLC2PL BINDING SITE, designated SEQ ID:13697, to the nucleotide sequence of GAM3229 RNA, herein designated GAM RNA, also designated SEQ ID:221.

Another function of GAM3229 is therefore inhibition of MYLC2PL (Accession NP_612412.1). Accordingly, utilities of GAM3229 include diagnosis, prevention and treatment of diseases and clinical conditions associated with MYLC2PL.

Myosin 5c (MYO5C, Accession NP_061198.1) is another GAM3229 target gene, herein designated TARGET GENE. MYO5C BINDING SITE is a target binding site found in the 3' untranslated region of mRNA encoded by MYO5C, corresponding to a target binding site such as BINDING SITE I, BINDING SITE II or BINDING SITE III of FIG. 8. Table 4 illustrates the complementarity of the nucleotide sequences of MYO5C BINDING SITE, designated SEQ ID:12851, to the nucleotide sequence of GAM3229 RNA, herein designated GAM RNA, also designated SEQ ID:221.

Another function of GAM3229 is therefore inhibition of Myosin 5c (MYO5C, Accession NP_061198.1). Accordingly, utilities of GAM3229 include diagnosis, prevention and treatment of diseases and clinical conditions associated with MYO5C.

N-ethylmaleimide-sensitive factor attachment protein, alpha (NAPA, Accession NP_003818.1) is another GAM3229 target gene, herein designated TARGET GENE. NAPA BINDING SITE is a target binding site found in the 3' untranslated region of mRNA encoded by NAPA, corresponding to a target binding site such as BINDING SITE I, BINDING SITE II or BINDING SITE III of FIG. 8. Table 4 illustrates the complementarity of the nucleotide sequences of NAPA BINDING SITE, designated SEQ ID:5619, to the nucleotide sequence of GAM3229 RNA, herein designated GAM RNA, also designated SEQ ID:221.

Another function of GAM3229 is therefore inhibition of N-ethylmaleimide-sensitive factor attachment protein, alpha (NAPA, Accession NP_003818.1). Accordingly, utilities of GAM3229 include diagnosis, prevention and treatment of diseases and clinical conditions associated with NAPA.

Nuclear receptor coactivator 6 (NCOA6, Accession NP_054790.1) is another GAM3229 target gene, herein designated TARGET GENE. NCOA6 BINDING SITE is a target binding site found in the 5' untranslated region of mRNA encoded by NCOA6, corresponding to a target binding site such as BINDING SITE I, BINDING SITE II or BINDING SITE III of FIG. 8. Table 4 illustrates the complementarity of the nucleotide sequences of NCOA6 BINDING SITE, designated SEQ ID:18704, to the nucleotide sequence of GAM3229 RNA, herein designated GAM RNA, also designated SEQ ID:221.

Another function of GAM3229 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM3229 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Nuclear receptor coactivator 6 interacting protein (NCOA6IP, Accession NP_079107.5) is another GAM3229 target gene, herein designated TARGET GENE. NCOA6IP BINDING SITE is a target binding site found in the 3' untranslated region of mRNA encoded by NCOA6IP, corresponding to a target binding site such as BINDING SITE I, BINDING SITE II or BINDING SITE III of FIG. 8. Table 4 illustrates the complementarity of the nucleotide sequences of NCOA6IP BINDING SITE, designated SEQ ID:14417, to the nucleotide sequence of GAM3229 RNA, herein designated GAM RNA, also designated SEQ ID:221.

Another function of GAM3229 is therefore inhibition of Nuclear receptor coactivator 6 interacting protein (NCOA6IP, Accession NP_079107.5). Accordingly, utilities of GAM3229 include diagnosis, prevention and treatment of diseases and clinical conditions associated with NCOA6IP.

Nadh dehydrogenase (ubiquinone) 1, subcomplex unknown, 2, 14.5 kda (NDUFC2, Accession NP_004540.1) is another GAM3229 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:2783, to the nucleotide sequence of GAM3229 RNA, herein designated GAM RNA, also designated SEQ ID:221.

Another function of GAM3229 is therefore inhibition of Nadh dehydrogenase (ubiquinone) 1, subcomplex unknown, 2, 14.5 kda (NDUFC2, Accession NP_004540.1). Accordingly, utilities of GAM3229 include diagnosis, prevention and treatment of diseases and clinical conditions associated with NDUFC2.

Neural precursor cell expressed, developmentally down-regulated 4 (NEDD4, Accession XP_046129.4) is another GAM3229 target gene, herein designated TARGET GENE. NEDD4 BINDING SITE is a target binding site found in the 3' untranslated region of mRNA encoded by NEDD4, corresponding to a target binding site such as BINDING SITE I, BINDING SITE II or BINDING SITE III of FIG. 8. Table 4 illustrates the complementarity of the nucleotide sequences of NEDD4 BINDING SITE, designated SEQ ID:16923, to the nucleotide sequence of GAM3229 RNA, herein designated GAM RNA, also designated SEQ ID:221.

Another function of GAM3229 is therefore inhibition of Neural precursor cell expressed, developmentally down-regulated 4 (NEDD4, Accession XP_046129.4), a gene which ubiquitinates regulatory proteins involved in transcription. Accordingly, utilities of GAM3229 include diagnosis, prevention and treatment of diseases and clinical conditions associated with NEDD4.

The function of NEDD4 and its association with various diseases and clinical conditions, has been established by previous studies, as described hereinabove with reference to GAM48.2. Nei like 2 (e. coli) (NEIL2, Accession NP_659480.1) is another GAM3229 target gene, herein designated TARGET GENE. NEIL2 BINDING SITE is a target binding site found in the 3' untranslated region of mRNA encoded by NEIL2, corresponding to a target binding site such as BINDING SITE I, BINDING SITE II or BINDING SITE III of FIG. 8. Table 4 illustrates the complementarity of the nucleotide sequences of NEIL2 BINDING SITE, designated SEQ ID:9514, to the nucleotide sequence of GAM3229 RNA, herein designated GAM RNA, also designated SEQ ID:221.

Another function of GAM3229 is therefore inhibition of Nei like 2 (e. coli) (NEIL2, Accession NP_659480.1). Accordingly, utilities of GAM3229 include diagnosis, prevention and treatment of diseases and clinical conditions associated with NEIL2.

Neurogenic differentiation 1 (NEUROD1, Accession NP_002491.1) is another GAM3229 target gene, herein designated TARGET GENE. NEUROD1 BINDING SITE is a target binding site found in the 3' untranslated region of mRNA encoded by NEUROD1, corresponding to a target binding site such as BINDING SITE I, BINDING SITE II or BINDING SITE III of FIG. 8. Table 4 illustrates the complementarity of the nucleotide sequences of NEUROD1 BINDING SITE, designated SEQ ID:14176, to the nucleotide sequence of GAM3229 RNA, herein designated GAM RNA, also designated SEQ ID:221.

Another function of GAM3229 is therefore inhibition of Neurogenic differentiation 1 (NEUROD1, Accession NP_002491.1), a gene which acts as a differentiation factor during neurogenesis and therefore may be associated with Type ii diabetes mellitus. Accordingly, utilities of GAM3229 include diagnosis, prevention and treatment of Type ii diabetes mellitus, and of other diseases and clinical conditions associated with NEUROD1.

The function of NEUROD1 and its association with various diseases and clinical conditions, has been established by previous studies, as described hereinabove with reference to GAM1035.1. Neurofibromin 2 (bilateral acoustic neuroma) (NF2, Accession NP_057502.1) is another GAM3229 target gene, herein designated TARGET GENE. NF2 BINDING SITE1 and NF2 BINDING SITE2 are target binding sites found in untranslated regions of multiple transcripts of mRNA encoded by NF2, corresponding to target binding sites such as BINDING SITE I, BINDING SITE II or BINDING SITE III of FIG. 8. Table 4 illustrates the complementarity of the nucleotide sequences of NF2 BINDING SITE1 and NF2 BINDING SITE2, designated SEQ ID:11182 and SEQ ID:8254 respectively, to the nucleotide sequence of GAM3229 RNA, herein designated GAM RNA, also designated SEQ ID:221.

Another function of GAM3229 is therefore inhibition of Neurofibromin 2 (bilateral acoustic neuroma) (NF2, Accession NP_057502.1). Accordingly, utilities of GAM3229 include diagnosis, prevention and treatment of diseases and clinical conditions associated with NF2.

Nad(p)h dehydrogenase, quinone 1 (NQO1, Accession NP_000894.1) is another GAM3229 target gene, herein designated TARGET GENE. NQO1 BINDING SITE is a target binding site found in the 3' untranslated region of mRNA encoded by NQO1, corresponding to a target binding site such as BINDING SITE I, BINDING SITE II or BINDING SITE III of FIG. 8. Table 4 illustrates the complementarity of the nucleotide sequences of NQO1 BINDING SITE, designated SEQ ID:19166, to the nucleotide sequence of GAM3229 RNA, herein designated GAM RNA, also designated SEQ ID:221.

Another function of GAM3229 is therefore inhibition of Nad(p)h dehydrogenase, quinone 1 (NQO1, Accession NP_000894.1), a gene which is cytochrome b5 reductase which reduces redox dyes and quinones. Accordingly, utilities of GAM3229 include diagnosis, prevention and treatment of diseases and clinical conditions associated with NQO1.

The function of NQO1 and its association with various diseases and clinical conditions, has been established by previous studies, as described hereinabove with reference to GAM189.1. NUP43 (Accession NP_078923.2) is another GAM3229 target gene, herein designated TARGET GENE. NUP43 BINDING SITE is a target binding site found in the 3' untranslated region of mRNA encoded by NUP43, corresponding to a target binding site such as BINDING SITE I, BINDING SITE II or BINDING SITE III of FIG. 8. Table 4 illustrates the complementarity of the nucleotide sequences of NUP43 BINDING SITE, designated SEQ ID:16948, to the nucleotide sequence of GAM3229 RNA, herein designated GAM RNA, also designated SEQ ID:221.

Another function of GAM3229 is therefore inhibition of NUP43 (Accession NP_078923.2). Accordingly, utilities of GAM3229 include diagnosis, prevention and treatment of diseases and clinical conditions associated with NUP43.

Opioid receptor, mu 1 (OPRM1, Accession NP_000905.1) is another GAM3229 target gene, herein designated TARGET GENE. OPRM1 BINDING SITE is a target binding site found in the 3' untranslated region of mRNA encoded by OPRM1, corresponding to a target binding site such as BINDING SITE I, BINDING SITE II or BINDING SITE III of FIG. 8. Table 4 illustrates the complementarity of the nucleotide sequences of OPRM1 BINDING SITE, designated SEQ ID:17047, to the nucleotide sequence of GAM3229 RNA, herein designated GAM RNA, also designated SEQ ID:221.

Another function of GAM3229 is therefore inhibition of Opioid receptor, mu 1 (OPRM1, Accession NP_000905.1), a gene which inhibits neurotransmitter release by reducing calcium ion currents and increasing potassium ion conductance.

Accordingly, utilities of GAM3229 include diagnosis, prevention and treatment of diseases and clinical conditions associated with OPRM1.

The function of OPRM1 and its association with various diseases and clinical conditions, has been established by previous studies, as described hereinabove with reference to GAM883.1. Oxysterol binding protein-like 3 (OSBPL3, Accession NP_663164.1) is another GAM3229 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:8465, to the nucleotide sequence of GAM3229 RNA, herein designated GAM RNA, also designated SEQ ID:221.

Another function of GAM3229 is therefore inhibition of Oxysterol binding protein-like 3 (OSBPL3, Accession NP_663164.1). Accordingly, utilities of GAM3229 include diagnosis, prevention and treatment of diseases and clinical conditions associated with OSBPL3.

Oxysterol binding protein-like 3 (OSBPL3, Accession NP_663160.1) is another GAM3229 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:8465, to the nucleotide sequence of GAM3229 RNA, herein designated GAM RNA, also designated SEQ ID:221.

Another function of GAM3229 is therefore inhibition of Oxysterol binding protein-like 3 (OSBPL3, Accession NP_663160.1). Accordingly, utilities of GAM3229 include diagnosis, prevention and treatment of diseases and clinical conditions associated with OSBPL3.

Oxysterol binding protein-like 3 (OSBPL3, Accession NP_663163.1) is another GAM3229 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:8465, to the nucleotide sequence of GAM3229 RNA, herein designated GAM RNA, also designated SEQ ID:221.

Another function of GAM3229 is therefore inhibition of Oxysterol binding protein-like 3 (OSBPL3, Accession NP_663163.1). Accordingly, utilities of GAM3229 include diagnosis, prevention and treatment of diseases and clinical conditions associated with OSBPL3.

Oxysterol binding protein-like 3 (OSBPL3, Accession NP_663161.1) is another GAM3229 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:8465, to the nucleotide sequence of GAM3229 RNA, herein designated GAM RNA, also designated SEQ ID:221.

Another function of GAM3229 is therefore inhibition of Oxysterol binding protein-like 3 (OSBPL3, Accession NP_663161.1). Accordingly, utilities of GAM3229 include diagnosis, prevention and treatment of diseases and clinical conditions associated with OSBPL3.

Oxysterol binding protein-like 3 (OSBPL3, Accession NP_056365.1) is another GAM3229 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:8465, to the nucleotide sequence of GAM3229 RNA, herein designated GAM RNA, also designated SEQ ID:221.

Another function of GAM3229 is therefore inhibition of Oxysterol binding protein-like 3 (OSBPL3, Accession NP_056365.1). Accordingly, utilities of GAM3229 include diagnosis, prevention and treatment of diseases and clinical conditions associated with OSBPL3.

Oxysterol binding protein-like 3 (OSBPL3, Accession NP_663162.1) is another GAM3229 target gene, herein designated TARGET GENE. OSBPL3 BINDING SITE is a target binding site found in the 3' untranslated region of multiple transcripts of mRNA encoded by OSBPL3, corresponding to a target binding site such as BINDING SITE I, BINDING SITE II or BINDING SITE III of FIG. 8. Table 4 illustrates the complementarity of the nucleotide sequences of OSBPL3 BINDING SITE, designated SEQ ID:8465, to the nucleotide sequence of GAM3229 RNA, herein designated GAM RNA, also designated SEQ ID:221.

Another function of GAM3229 is therefore inhibition of Oxysterol binding protein-like 3 (OSBPL3, Accession NP_663162.1). Accordingly, utilities of GAM3229 include diagnosis, prevention and treatment of diseases and clinical conditions associated with OSBPL3.

Oxysterol binding protein-like 8 (OSBPL8, Accession NP_065892.1) is another GAM3229 target gene, herein designated TARGET GENE. OSBPL8 BINDING SITE is a target binding site found in the 3' untranslated region of mRNA encoded by OSBPL8, corresponding to a target binding site such as BINDING SITE I, BINDING SITE II or BINDING SITE III of FIG. 8. Table 4 illustrates the complementarity of the nucleotide sequences of OSBPL8 BINDING SITE, designated SEQ ID:1446, to the nucleotide sequence of GAM3229 RNA, herein designated GAM RNA, also designated SEQ ID:221.

Another function of GAM3229 is therefore inhibition of Oxysterol binding protein-like 8 (OSBPL8, Accession NP_065892.1). Accordingly, utilities of GAM3229 include diagnosis, prevention and treatment of diseases and clinical conditions associated with OSBPL8.

Oncostatin m (OSM, Accession NP_065391.1) is another GAM3229 target gene, herein designated TARGET GENE. OSM BINDING SITE is a target binding site found in the 3' untranslated region of mRNA encoded by OSM, corresponding to a target binding site such as BINDING SITE I, BINDING SITE II or BINDING SITE III of FIG. 8. Table 4 illustrates the complementarity of the nucleotide sequences of OSM BINDING SITE, designated SEQ ID:15290, to the nucleotide sequence of GAM3229 RNA, herein designated GAM RNA, also designated SEQ ID:221.

Another function of GAM3229 is therefore inhibition of Oncostatin m (OSM, Accession NP_065391.1), a gene which inhibits the proliferation of a number of tumor cell lines, caused an acute inflammatory reaction. Accordingly, utilities of GAM3229 include diagnosis, prevention and treatment of diseases and clinical conditions associated with OSM.

The function of OSM and its association with various diseases and clinical conditions, has been established by previous studies, as described hereinabove with reference to GAM65.2. Phosphoribosylaminoimidazole carboxylase, phosphoribosylaminoimidazole succinocarboxamide synthetase (PAICS, Accession NP_006443.1) is another GAM3229 target gene, herein designated TARGET GENE. PAICS BINDING SITE1 and PAICS BINDING SITE2 are target binding sites found in untranslated regions of mRNA encoded by PAICS, corresponding to target binding sites such as BINDING SITE I, BINDING SITE II or BINDING SITE III of FIG. 8. Table 4 illustrates the complementarity of the nucleotide sequences of PAICS BINDING SITE1 and PAICS BINDING SITE2, designated SEQ ID:963 and SEQ ID:12311 respectively, to the nucleotide sequence of GAM3229 RNA, herein designated GAM RNA, also designated SEQ ID:221.

Another function of GAM3229 is therefore inhibition of Phosphoribosylaminoimidazole carboxylase, phosphoribosylaminoimidazole succinocarboxamide synthetase (PAICS, Accession NP_006443.1), a gene which is required for purine biosynthesis. Accordingly, utilities of GAM3229 include diagnosis, prevention and treatment of diseases and clinical conditions associated with PAICS.

The function of PAICS and its association with various diseases and clinical conditions, has been established by previous studies, as described hereinabove with reference to GAM96.1. Protocadherin alpha 9 (PCDHA9, Accession NP_054724.1) is another GAM3229 target gene, herein designated TARGET GENE. PCDHA9 BINDING SITE is a target binding site found in the 3' untranslated region of multiple transcripts of mRNA encoded by PCDHA9, corresponding to a target binding site such as BINDING SITE I, BINDING SITE II or BINDING SITE III of FIG. 8. Table 4 illustrates the complementarity of the nucleotide sequences of PCDHA9 BINDING SITE, designated SEQ ID:2783, to the nucleotide sequence of GAM3229 RNA, herein designated GAM RNA, also designated SEQ ID:221.

Another function of GAM3229 is therefore inhibition of Protocadherin alpha 9 (PCDHA9, Accession NP_054724.1), a gene which is a calcium-dependent cell-adhesion protein. Accordingly, utilities of GAM3229 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Protocadherin beta 11 (PCDHB11, Accession NP_061754.1) is another GAM3229 target gene, herein designated TARGET GENE. PCDHB11 BINDING SITE is a target binding site found in the 3' untranslated region of mRNA encoded by PCDHB11, corresponding to a target binding site such as BINDING SITE I, BINDING SITE II or BINDING SITE III of FIG. 8. Table 4 illustrates the complementarity of the nucleotide sequences of PCDHB11 BINDING SITE, designated SEQ ID:3153, to the nucleotide sequence of GAM3229 RNA, herein designated GAM RNA, also designated SEQ ID:221.

Another function of GAM3229 is therefore inhibition of Protocadherin beta 11 (PCDHB11, Accession NP_061754.1). Accordingly, utilities of GAM3229 include diagnosis, prevention and treatment of diseases and clinical conditions associated with PCDHB11.

Protocadherin beta 16 (PCDHB16, Accession NP_066008.1) is another GAM3229 target gene, herein designated TARGET GENE. PCDHB16 BINDING SITE is a target binding site found in the 3' untranslated region of mRNA encoded by PCDHB16, corresponding to a target binding site such as BINDING SITE I, BINDING SITE II or BINDING SITE III of FIG. 8. Table 4 illustrates the complementarity of the nucleotide sequences of PCDHB16 BINDING SITE, designated SEQ ID:5101, to the nucleotide sequence of GAM3229 RNA, herein designated GAM RNA, also designated SEQ ID:221.

Another function of GAM3229 is therefore inhibition of Protocadherin beta 16 (PCDHB16, Accession NP_066008.1), a gene which is a potential calcium-dependent cell-adhesion protein. Accordingly, utilities of GAM3229 include diagnosis, prevention and treatment of diseases and clinical conditions associated with PCDHB16.

The function of PCDHB16 and its association with various diseases and clinical conditions, has been established by previous studies, as described hereinabove with reference to GAM189.1. Protocadherin gamma subfamily a, 1 (PCDHGA1, Accession NP_061735.1) is another GAM3229 target gene, herein designated TARGET GENE. PCDHGA1 BINDING SITE is a target binding site found in the 3' untranslated region of mRNA encoded by PCDHGA1, corresponding to a target binding site such as BINDING SITE I, BINDING SITE II or BINDING SITE III of FIG. 8. Table 4 illustrates the complementarity of the nucleotide sequences of PCDHGA1 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 1 (PCDHGA1, Accession NP_061735.1). Accordingly, utilities of GAM3229 include diagnosis, prevention and treatment of diseases and clinical conditions associated with PCDHGA1.

Protocadherin gamma subfamily a, 10 (PCDHGA10, Accession NP_061736.1) is another GAM3229 target gene, herein designated TARGET GENE. PCDHGA10 BINDING SITE is a target binding site found in the 3' untranslated region of mRNA encoded by PCDHGA10, corresponding to a target binding site such as BINDING SITE I, BINDING SITE II or BINDING SITE III of FIG. 8. Table 4 illustrates the complementarity of the nucleotide sequences of PCDHGA10 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 10 (PCDHGA10, Accession NP_061736.1). Accordingly, utilities of GAM3229 include diagnosis, prevention and treatment of diseases and clinical conditions associated with PCDHGA10.

Protocadherin gamma subfamily a, 11 (PCDHGA11, Accession NP_061737.1) is another GAM3229 target gene, herein designated TARGET GENE. PCDHGA11 BINDING SITE is a target binding site found in the 3' untranslated region of multiple transcripts of mRNA encoded by PCDHGA11, corresponding to a target binding site such as BINDING SITE I, BINDING SITE II or BINDING SITE III of FIG. 8. Table 4 illustrates the complementarity of the nucleotide sequences of PCDHGA11 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 11 (PCDHGA11, Accession NP_061737.1). Accordingly, utilities of GAM3229 include diagnosis, prevention and treatment of diseases and clinical conditions associated with PCDHGA11.

Protocadherin gamma subfamily a, 11 (PCDHGA11, Accession NP__114481.1) is another GAM3229 target gene, herein designated TARGET GENE. PCDHGA11 BINDING SITE is a target binding site found in the 3' untranslated region of multiple transcripts of mRNA encoded by PCDHGA11, corresponding to a target binding site such as BINDING SITE I, BINDING SITE II or BINDING SITE III of FIG. 8. Table 4 illustrates the complementarity of the nucleotide sequences of PCDHGA11 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 11 (PCDHGA11, Accession NP__114481.1). Accordingly, utilities of GAM3229 include diagnosis, prevention and treatment of diseases and clinical conditions associated with PCDHGA11.

Protocadherin gamma subfamily a, 12 (PCDHGA12, Accession NP__003726.1) is another GAM3229 target gene, herein designated TARGET GENE. PCDHGA12 BINDING SITE is a target binding site found in the 3' untranslated region of multiple transcripts of mRNA encoded by PCDHGA12, corresponding to a target binding site such as BINDING SITE I, BINDING SITE II or BINDING SITE III of FIG. 8. Table 4 illustrates the complementarity of the nucleotide sequences of PCDHGA12 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 12 (PCDHGA12, Accession NP__003726.1), a gene which potential calcium-dependent cell-adhesion protein. Accordingly, utilities of GAM3229 include diagnosis, prevention and treatment of diseases and clinical conditions associated with PCDHGA12.

The function of PCDHGA12 and its association with various diseases and clinical conditions, has been established by previous studies, as described hereinabove with reference to GAM607.2. Protocadherin gamma subfamily a, 2 (PCDHGA2, Accession NP__061738.1) is another GAM3229 target gene, herein designated TARGET GENE. PCDHGA2 BINDING SITE is a target binding site found in the 3' untranslated region of multiple transcripts of mRNA encoded by PCDHGA2, corresponding to a target binding site such as BINDING SITE I, BINDING SITE II or BINDING SITE III of FIG. 8. Table 4 illustrates the complementarity of the nucleotide sequences of PCDHGA2 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 2 (PCDHGA2, Accession NP__061738.1). Accordingly, utilities of GAM3229 include diagnosis, prevention and treatment of diseases and clinical conditions associated with PCDHGA2.

Protocadherin gamma subfamily a, 3 (PCDHGA3, Accession NP_061739.2) is another GAM3229 target gene, herein designated TARGET GENE. PCDHGA3 BINDING SITE is a target binding site found in the 3' untranslated region of mRNA encoded by PCDHGA3, corresponding to a target binding site such as BINDING SITE I, BINDING SITE II or BINDING SITE III of FIG. 8. Table 4 illustrates the complementarity of the nucleotide sequences of PCDHGA3 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 3 (PCDHGA3, Accession NP__061739.2), a gene which is a potential calcium-dependent cell-adhesion protein. Accordingly, utilities of GAM3229 include diagnosis, prevention and treatment of diseases and clinical conditions associated with PCDHGA3.

The function of PCDHGA3 and its association with various diseases and clinical conditions, has been established by previous studies, as described hereinabove with reference to GAM607.2. Protocadherin gamma subfamily a, 4 (PCDHGA4, Accession NP_061740.1) is another GAM3229 target gene, herein designated TARGET GENE. PCDHGA4 BINDING SITE is a target binding site found in the 3' untranslated region of multiple transcripts of mRNA encoded by PCDHGA4, corresponding to a target binding site such as BINDING SITE I, BINDING SITE II or BINDING SITE III of FIG. 8. Table 4 illustrates the complementarity of the nucleotide sequences of PCDHGA4 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 4 (PCDHGA4, Accession NP__061740.1). Accordingly, utilities of GAM3229 include diagnosis, prevention and treatment of diseases and clinical conditions associated with PCDHGA4.

Protocadherin gamma subfamily a, 5 (PCDHGA5, Accession NP_061741.1) is another GAM3229 target gene, herein designated TARGET GENE. PCDHGA5 BINDING SITE is a target binding site found in the 3' untranslated region of mRNA encoded by PCDHGA5, corresponding to a target binding site such as BINDING SITE I, BINDING SITE II or BINDING SITE III of FIG. 8. Table 4 illustrates the complementarity of the nucleotide sequences of PCDHGA5 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 5 (PCDHGA5, Accession NP__061741.1), a gene which is a potential calcium-dependent cell-adhesion protein. Accordingly, utilities of GAM3229 include diagnosis, prevention and treatment of diseases and clinical conditions associated with PCDHGA5.

The function of PCDHGA5 and its association with various diseases and clinical conditions, has been established by previous studies, as described hereinabove with reference to GAM607.2. Protocadherin gamma subfamily a, 6 (PCDHGA6, Accession NP_061742.1) is another GAM3229 target gene, herein designated TARGET GENE. PCDHGA6 BINDING SITE is a target binding site found in the 3' untranslated region of mRNA encoded by PCDHGA6, corresponding to a target binding site such as BINDING SITE I, BINDING SITE II or BINDING SITE III of FIG. 8. Table 4 illustrates the complementarity of the nucleotide sequences of PCDHGA6 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 6 (PCDHGA6, Accession NP__061742.1). Accordingly, utilities of GAM3229 include diagnosis, prevention and treatment of diseases and clinical conditions associated with PCDHGA6.

Protocadherin gamma subfamily a, 7 (PCDHGA7, Accession NP_061743.1) is another GAM3229 target gene, herein designated TARGET GENE. PCDHGA7 BINDING SITE is a target binding site found in the 3' untranslated region of multiple transcripts of mRNA encoded by PCDHGA7, corresponding to a target binding site such as BINDING SITE I, BINDING SITE II or BINDING SITE III of FIG. 8. Table 4 illustrates the complementarity of the nucleotide sequences of PCDHGA7 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 7 (PCDHGA7, Accession NP_061743.1). Accordingly, utilities of GAM3229 include diagnosis, prevention and treatment of diseases and clinical conditions associated with PCDHGA7.

Protocadherin gamma subfamily a, 8 (PCDHGA8, Accession NP_114477.1) is another GAM3229 target gene, herein designated TARGET GENE. PCDHGA8 BINDING SITE is a target binding site found in the 3' untranslated region of multiple transcripts of mRNA encoded by PCDHGA8, corresponding to a target binding site such as BINDING SITE I, BINDING SITE II or BINDING SITE III of FIG. 8. Table 4 illustrates the complementarity of the nucleotide sequences of PCDHGA8 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 8 (PCDHGA8, Accession NP_114477.1), a gene which is a potential calcium-dependent cell-adhesion protein. Accordingly, utilities of GAM3229 include diagnosis, prevention and treatment of diseases and clinical conditions associated with PCDHGA8.

The function of PCDHGA8 and its association with various diseases and clinical conditions, has been established by previous studies, as described hereinabove with reference to GAM607.2. Protocadherin gamma subfamily a, 9 (PCDHGA9, Accession NP_061744.1) is another GAM3229 target gene, herein designated TARGET GENE. PCDHGA9 BINDING SITE is a target binding site found in the 3' untranslated region of mRNA encoded by PCDHGA9, corresponding to a target binding site such as BINDING SITE I, BINDING SITE II or BINDING SITE III of FIG. 8. Table 4 illustrates the complementarity of the nucleotide sequences of PCDHGA9 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily a, 9 (PCDHGA9, Accession NP_061744.1). Accordingly, utilities of GAM3229 include diagnosis, prevention and treatment of diseases and clinical conditions associated with PCDHGA9.

Protocadherin gamma subfamily b, 1 (PCDHGB1, Accession NP_061745.1) is another GAM3229 target gene, herein designated TARGET GENE. PCDHGB1 BINDING SITE is a target binding site found in the 3' untranslated region of mRNA encoded by PCDHGB1, corresponding to a target binding site such as BINDING SITE I, BINDING SITE II or BINDING SITE III of FIG. 8. Table 4 illustrates the complementarity of the nucleotide sequences of PCDHGB1 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily b, 1 (PCDHGB1, Accession NP_061745.1). Accordingly, utilities of GAM3229 include diagnosis, prevention and treatment of diseases and clinical conditions associated with PCDHGB1.

Protocadherin gamma subfamily b, 2 (PCDHGB2, Accession NP_061746.1) is another GAM3229 target gene, herein designated TARGET GENE. PCDHGB2 BINDING SITE is a target binding site found in the 3' untranslated region of mRNA encoded by PCDHGB2, corresponding to a target binding site such as BINDING SITE I, BINDING SITE II or BINDING SITE III of FIG. 8. Table 4 illustrates the complementarity of the nucleotide sequences of PCDHGB2 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily b, 2 (PCDHGB2, Accession NP_061746.1). Accordingly, utilities of GAM3229 include diagnosis, prevention and treatment of diseases and clinical conditions associated with PCDHGB2.

Protocadherin gamma subfamily b, 3 (PCDHGB3, Accession NP_061747.1) is another GAM3229 target gene, herein designated TARGET GENE. PCDHGB3 BINDING SITE is a target binding site found in the 3' untranslated region of mRNA encoded by PCDHGB3, corresponding to a target binding site such as BINDING SITE I, BINDING SITE II or BINDING SITE III of FIG. 8. Table 4 illustrates the complementarity of the nucleotide sequences of PCDHGB3 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily b, 3 (PCDHGB3, Accession NP_061747.1). Accordingly, utilities of GAM3229 include diagnosis, prevention and treatment of diseases and clinical conditions associated with PCDHGB3.

Protocadherin gamma subfamily b, 4 (PCDHGB4, Accession NP_003727.1) is another GAM3229 target gene, herein designated TARGET GENE. PCDHGB4 BINDING SITE is a target binding site found in the 3' untranslated region of mRNA encoded by PCDHGB4, corresponding to a target binding site such as BINDING SITE I, BINDING SITE II or BINDING SITE III of FIG. 8. Table 4 illustrates the complementarity of the nucleotide sequences of PCDHGB4 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily b, 4 (PCDHGB4, Accession NP_003727.1), a gene which is a potential calcium-dependent cell-adhesion protein. Accordingly, utilities of GAM3229 include diagnosis, prevention and treatment of diseases and clinical conditions associated with PCDHGB4.

The function of PCDHGB4 and its association with various diseases and clinical conditions, has been established by previous studies, as described hereinabove with reference to GAM607.2. Protocadherin gamma subfamily b, 5 (PCDHGB5, Accession NP_061748.1) is another GAM3229 target gene, herein designated TARGET GENE. PCDHGB5 BINDING SITE is a target binding site found in the 3' untranslated region of mRNA encoded by PCDHGB5, corresponding to a target binding site such as BINDING SITE I, BINDING SITE II or BINDING SITE III of FIG. 8. Table 4 illustrates the complementarity of the nucleotide sequences of PCDHGB5 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily b, 5 (PCDHGB5, Accession NP_061748.1). Accordingly, utilities of GAM3229 include diagnosis, prevention and treatment of diseases and clinical conditions associated with PCDHGB5.

Protocadherin gamma subfamily b, 6 (PCDHGB6, Accession NP_061749.1) is another GAM3229 target gene, herein designated TARGET GENE. PCDHGB6 BINDING SITE is a target binding site found in the 3' untranslated region of mRNA encoded by PCDHGB6, corresponding to a target binding site such as BINDING SITE I, BINDING SITE II or BINDING SITE III of FIG. 8. Table 4 illustrates the complementarity of the nucleotide sequences of PCDHGB6 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily b, 6 (PCDHGB6, Accession NP_061749.1). Accordingly, utilities of GAM3229 include diagnosis, prevention and treatment of diseases and clinical conditions associated with PCDHGB6.

Protocadherin gamma subfamily b, 7 (PCDHGB7, Accession NP_061750.1) is another GAM3229 target gene, herein designated TARGET GENE. PCDHGB7 BINDING SITE is a target binding site found in the 3' untranslated region of multiple transcripts of mRNA encoded by PCDHGB7, corresponding to a target binding site such as BINDING SITE I, BINDING SITE II or BINDING SITE III of FIG. 8. Table 4 illustrates the complementarity of the nucleotide sequences of PCDHGB7 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily b, 7 (PCDHGB7, Accession NP_061750.1), a gene which is a potential calcium-dependent cell-adhesion protein. Accordingly, utilities of GAM3229 include diagnosis, prevention and treatment of diseases and clinical conditions associated with PCDHGB7.

The function of PCDHGB7 and its association with various diseases and clinical conditions, has been established by previous studies, as described hereinabove with reference to GAM607.2. Protocadherin gamma subfamily c, 3 (PCDHGC3, Accession NP_115779.1) is another GAM3229 target gene, herein designated TARGET GENE. PCDHGC3 BINDING SITE is a target binding site found in the 3' untranslated region of multiple transcripts of mRNA encoded by PCDHGC3, corresponding to a target binding site such as BINDING SITE I, BINDING SITE II or BINDING SITE III of FIG. 8. Table 4 illustrates the complementarity of the nucleotide sequences of PCDHGC3 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily c, 3 (PCDHGC3, Accession NP_115779.1), a gene which is a potential calcium-dependent cell-adhesion protein. Accordingly, utilities of GAM3229 include diagnosis, prevention and treatment of diseases and clinical conditions associated with PCDHGC3.

The function of PCDHGC3 and its association with various diseases and clinical conditions, has been established by previous studies, as described hereinabove with reference to GAM607.2. Protocadherin gamma subfamily c, 3 (PCDHGC3, Accession NP_002579.2) is another GAM3229 target gene, herein designated TARGET GENE. PCDHGC3 BINDING SITE is a target binding site found in the 3' untranslated region of multiple transcripts of mRNA encoded by PCDHGC3, corresponding to a target binding site such as BINDING SITE I, BINDING SITE II or BINDING SITE III of FIG. 8. Table 4 illustrates the complementarity of the nucleotide sequences of PCDHGC3 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily c, 3 (PCDHGC3, Accession NP_002579.2), a gene which is a potential calcium-dependent cell-adhesion protein. Accordingly, utilities of GAM3229 include diagnosis, prevention and treatment of diseases and clinical conditions associated with PCDHGC3.

The function of PCDHGC3 and its association with various diseases and clinical conditions, has been established by previous studies, as described hereinabove with reference to GAM607.2. Protocadherin gamma subfamily c, 4 (PCDHGC4, Accession NP_061751.1) is another GAM3229 target gene, herein designated TARGET GENE. PCDHGC4 BINDING SITE is a target binding site found in the 3' untranslated region of mRNA encoded by PCDHGC4, corresponding to a target binding site such as BINDING SITE I, BINDING SITE II or BINDING SITE III of FIG. 8. Table 4 illustrates the complementarity of the nucleotide sequences of PCDHGC4 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily c, 4 (PCDHGC4, Accession NP_061751.1), a gene which is a potential calcium-dependent cell-adhesion protein. Accordingly, utilities of GAM3229 include diagnosis, prevention and treatment of diseases and clinical conditions associated with PCDHGC4.

The function of PCDHGC4 and its association with various diseases and clinical conditions, has been established by previous studies, as described hereinabove with reference to GAM607.2. Protocadherin gamma subfamily c, 5 (PCDHGC5, Accession NP_061752.1) is another GAM3229 target gene, herein designated TARGET GENE. PCDHGC5 BINDING SITE is a target binding site found in the 3' untranslated region of mRNA encoded by PCDHGC5, corresponding to a target binding site such as BINDING SITE I, BINDING SITE II or BINDING SITE III of FIG. 8. Table 4 illustrates the complementarity of the nucleotide sequences of PCDHGC5 BINDING SITE, designated SEQ ID:11054, to the nucleotide sequence of GAM3229 RNA, herein designated GAM RNA, also designated SEQ ID:221.

Another function of GAM3229 is therefore inhibition of Protocadherin gamma subfamily c, 5 (PCDHGC5, Accession NP_061752.1). Accordingly, utilities of GAM3229 include diagnosis, prevention and treatment of diseases and clinical conditions associated with PCDHGC5.

Phosducin-like (PDCL, Accession NP_005379.2) is another GAM3229 target gene, herein designated TARGET GENE. PDCL BINDING SITE is a target binding site found in the 3' untranslated region of mRNA encoded by PDCL, corresponding to a target binding site such as BINDING SITE I, BINDING SITE II or BINDING SITE III of FIG. 8. Table 4 illustrates the complementarity of the nucleotide sequences of PDCL BINDING SITE, designated SEQ ID:18230, to the nucleotide sequence of GAM3229 RNA, herein designated GAM RNA, also designated SEQ ID:221.

Another function of GAM3229 is therefore inhibition of Phosducin-like (PDCL, Accession NP_005379.2), a gene which may regulate G-protein signaling and similar to phosducins. Accordingly, utilities of GAM3229 include diagnosis, prevention and treatment of diseases and clinical conditions associated with PDCL.

The function of PDCL and its association with various diseases and clinical conditions, has been established by previous studies, as described hereinabove with reference to GAM30.1. PDZRN1 (Accession NP_699202.1) is another GAM3229 target gene, herein designated TARGET GENE. PDZRN1 BINDING SITE is a target binding site found in the 3' untranslated region of mRNA encoded by PDZRN1, corresponding to a target binding site such as BINDING SITE I, BINDING SITE II or BINDING SITE III of FIG. 8. Table 4 illustrates the complementarity of the nucleotide sequences of PDZRN1 BINDING SITE, designated SEQ ID:19980, to the nucleotide sequence of GAM3229 RNA, herein designated GAM RNA, also designated SEQ ID:221.

Another function of GAM3229 is therefore inhibition of PDZRN1 (Accession NP_699202.1). Accordingly, utilities of GAM3229 include diagnosis, prevention and treatment of diseases and clinical conditions associated with PDZRN1.

PEPP3 (Accession NP_055750.1) is another GAM3229 target gene, herein designated TARGET GENE. PEPP3 BINDING SITE is a target binding site found in the 3' untranslated region of mRNA encoded by PEPP3, corresponding to a target binding site such as BINDING SITE I, BINDING SITE II or BINDING SITE III of FIG. 8. Table 4 illustrates the complementarity of the nucleotide sequences of PEPP3 BINDING SITE, designated SEQ ID:17981, to the nucleotide sequence of GAM3229 RNA, herein designated GAM RNA, also designated SEQ ID:221.

Another function of GAM3229 is therefore inhibition of PEPP3 (Accession NP_055750.1). Accordingly, utilities of GAM3229 include diagnosis, prevention and treatment of diseases and clinical conditions associated with PEPP3.

Period homolog 1 (drosophila) (PER1, Accession NP_002607.1) is another GAM3229 target gene, herein designated TARGET GENE. PER1 BINDING SITE is a target binding site found in the 5' untranslated region of mRNA encoded by PER1, corresponding to a target binding site such as BINDING SITE I, BINDING SITE II or BINDING SITE III of FIG. 8. Table 4 illustrates the complementarity of the nucleotide sequences of PER1 BINDING SITE, designated SEQ ID:4346, to the nucleotide sequence of GAM3229 RNA, herein designated GAM RNA, also designated SEQ ID:221.

Another function of GAM3229 is therefore inhibition of Period homolog 1 (drosophila) (PER1, Accession NP_002607.1). Accordingly, utilities of GAM3229 include diagnosis, prevention and treatment of diseases and clinical conditions associated with PER1.

Period homolog 2 (drosophila) (PER2, Accession NP_073728.1) is another GAM3229 target gene, herein designated TARGET GENE. PER2 BINDING SITE is a target binding site found in the 3' untranslated region of multiple transcripts of mRNA encoded by PER2, corresponding to a target binding site such as BINDING SITE I, BINDING SITE II or BINDING SITE III of FIG. 8. Table 4 illustrates the complementarity of the nucleotide sequences of PER2 BINDING SITE, designated SEQ ID:10711, to the nucleotide sequence of GAM3229 RNA, herein designated GAM RNA, also designated SEQ ID:221.

Another function of GAM3229 is therefore inhibition of Period homolog 2 (drosophila) (PER2, Accession NP_073728.1), a gene which Period homolog 2; putative circadian clock protein; has a PAS dimerization domain and therefore may be associated with Familial advanced sleep-phase syndrome. Accordingly, utilities of GAM3229 include diagnosis, prevention and treatment of Familial advanced sleep-phase syndrome, and of other diseases and clinical conditions associated with PER2.

The function of PER2 and its association with various diseases and clinical conditions, has been established by previous studies, as described hereinabove with reference to GAM130.1. Phosphoribosylformylglycinamidine synthase (fgar amidotransferase) (PFAS, Accession NP_036525.1) is another GAM3229 target gene, herein designated TARGET GENE. PFAS BINDING SITE is a target binding site found in the 3' untranslated region of mRNA encoded by PFAS, corresponding to a target binding site such as BINDING SITE I, BINDING SITE II or BINDING SITE III of FIG. 8. Table 4 illustrates the complementarity of the nucleotide sequences of PFAS BINDING SITE, designated SEQ ID:19259, to the nucleotide sequence of GAM3229 RNA, herein designated GAM RNA, also designated SEQ ID:221.

Another function of GAM3229 is therefore inhibition of Phosphoribosylformylglycinamidine synthase (fgar amidotransferase) (PFAS, Accession NP_036525.1). Accordingly, utilities of GAM3229 include diagnosis, prevention and treatment of diseases and clinical conditions associated with PFAS.

Putative homeodomain transcription factor 2 (PHTF2, Accession NP_065165.1) is another GAM3229 target gene, herein designated TARGET GENE. PHTF2 BINDING SITE is a target binding site found in the 3' untranslated region of mRNA encoded by PHTF2, corresponding to a target binding site such as BINDING SITE I, BINDING SITE II or BINDING SITE III of FIG. 8. Table 4 illustrates the complementarity of the nucleotide sequences of PHTF2 BINDING SITE, designated SEQ ID:18794, to the nucleotide sequence of GAM3229 RNA, herein designated GAM RNA, also designated SEQ ID:221.

Another function of GAM3229 is therefore inhibition of Putative homeodomain transcription factor 2 (PHTF2, Accession NP_065165.1) . Accordingly, utilities of GAM3229 include diagnosis, prevention and treatment of diseases and clinical conditions associated with PHTF2.

PIK3AP1 (Accession NP_689522.1) is another GAM3229 target gene, herein designated TARGET GENE. PIK3AP1 BINDING SITE is a target binding site found in the 5' untranslated region of mRNA encoded by PIK3AP1, corresponding to a target binding site such as BINDING SITE I, BINDING SITE II or BINDING SITE III of FIG. 8. Table 4 illustrates the complementarity of the nucleotide sequences of PIK3AP1 BINDING SITE, designated SEQ ID:4110, to the nucleotide sequence of GAM3229 RNA, herein designated GAM RNA, also designated SEQ ID:221.

Another function of GAM3229 is therefore inhibition of PIK3AP1 (Accession NP_689522.1). Accordingly, utilities of GAM3229 include diagnosis, prevention and treatment of diseases and clinical conditions associated with PIK3AP1.

Pbx/knotted 1 homeobox 1 (PKNOX1, Accession NP_004562.2) is another GAM3229 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:18518, to the nucleotide sequence of GAM3229 RNA, herein designated GAM RNA, also designated SEQ ID:221.

Another function of GAM3229 is therefore inhibition of Pbx/knotted 1 homeobox 1 (PKNOX1, Accession NP_004562.2), a gene which may regulate gene expression and control cell differentiation. Accordingly, utilities of GAM3229 include diagnosis, prevention and treatment of diseases and clinical conditions associated with PKNOX1.

The function of PKNOX1 and its association with various diseases and clinical conditions, has been established by previous studies, as described hereinabove with reference to GAM55.1. Phospholipase a2, group iid (PLA2G2D, Accession NP_036532.1) is another GAM3229 target gene, herein designated TARGET GENE. PLA2G2D BINDING SITE is a target binding site found in the 3' untranslated region of mRNA encoded by PLA2G2D, corresponding to a target binding site such as BINDING SITE I, BINDING SITE II or BINDING SITE III of FIG. 8. Table 4 illustrates the complementarity of the nucleotide sequences of PLA2G2D BINDING SITE, designated SEQ ID:12102, to the nucleotide sequence of GAM3229 RNA, herein designated GAM RNA, also designated SEQ ID:221.

Another function of GAM3229 is therefore inhibition of Phospholipase a2, group iid (PLA2G2D, Accession NP_036532.1), a gene which is involved in phospholipid digestion, remodeling of cell membranes, and host defense, as well as pathophysiologic processes. Accordingly, utilities of GAM3229 include diagnosis, prevention and treatment of diseases and clinical conditions associated with PLA2G2D.

The function of PLA2G2D and its association with various diseases and clinical conditions, has been established by previous studies, as described hereinabove with reference to GAM72.1. PLB (Accession NP_694566.1) is another GAM3229 target gene, herein designated TARGET GENE. PLB BINDING SITE is a target binding site found in the 3' untranslated region of mRNA encoded by PLB, corresponding to a target binding site such as BINDING SITE I, BINDING SITE II or BINDING SITE III of FIG. 8. Table 4 illustrates the complementarity of the nucleotide sequences of PLB BINDING SITE, designated SEQ ID:16989, to the nucleotide sequence of GAM3229 RNA, herein designated GAM RNA, also designated SEQ ID:221.

Another function of GAM3229 is therefore inhibition of PLB (Accession NP_694566.1). Accordingly, utilities of GAM3229 include diagnosis, prevention and treatment of diseases and clinical conditions associated with PLB.

Pro-melanin-concentrating hormone-like 1 (PMCHL1, Accession NP_114093.1) is another GAM3229 target gene, herein designated TARGET GENE. PMCHL1 BINDING SITE is a target binding site found in the 3' untranslated region of mRNA encoded by PMCHL1, corresponding to a target binding site such as BINDING SITE I, BINDING SITE II or BINDING SITE III of FIG. 8. Table 4 illustrates the complementarity of the nucleotide sequences of PMCHL1 BINDING SITE, designated SEQ ID:2034, to the nucleotide sequence of GAM3229 RNA, herein designated GAM RNA, also designated SEQ ID:221.

Another function of GAM3229 is therefore inhibition of Pro-melanin-concentrating hormone-like 1 (PMCHL1, Accession NP_114093.1). Accordingly, utilities of GAM3229 include diagnosis, prevention and treatment of diseases and clinical conditions associated with PMCHL1.

Pro-melanin-concentrating hormone-like 2 (PMCHL2, Accession NP_114094.1) is another GAM3229 target gene, herein designated TARGET GENE. PMCHL2 BINDING SITE is a target binding site found in the 3' untranslated region of mRNA encoded by PMCHL2, corresponding to a target binding site such as BINDING SITE I, BINDING SITE II or BINDING SITE III of FIG. 8. Table 4 illustrates the complementarity of the nucleotide sequences of PMCHL2 BINDING SITE, designated SEQ ID:7283, to the nucleotide sequence of GAM3229 RNA, herein designated GAM RNA, also designated SEQ ID:221.

Another function of GAM3229 is therefore inhibition of Pro-melanin-concentrating hormone-like 2 (PMCHL2, Accession NP_114094.1). Accordingly, utilities of GAM3229 include diagnosis, prevention and treatment of diseases and clinical conditions associated with PMCHL2.

POLD3 (Accession XP_166243.1) is another GAM3229 target gene, herein designated TARGET GENE. POLD3 BINDING SITE is a target binding site found in the 3' untranslated region of mRNA encoded by POLD3, corresponding to a target binding site such as BINDING SITE I, BINDING SITE II or BINDING SITE III of FIG. 8. Table 4 illustrates the complementarity of the nucleotide sequences of POLD3 BINDING SITE, designated SEQ ID:11834, to the nucleotide sequence of GAM3229 RNA, herein designated GAM RNA, also designated SEQ ID:221.

Another function of GAM3229 is therefore inhibition of POLD3 (Accession XP_166243.1). Accordingly, utilities of GAM3229 include diagnosis, prevention and treatment of diseases and clinical conditions associated with POLD3.

POLR1B (Accession NP_115588.1) is another GAM3229 target gene, herein designated TARGET GENE. POLR1B BINDING SITE is a target binding site found in the 3' untranslated region of multiple transcripts of mRNA encoded by POLR1B, corresponding to a target binding site such as BINDING SITE I, BINDING SITE II or BINDING SITE III of FIG. 8. Table 4 illustrates the complementarity of the nucleotide sequences of POLR1B BINDING SITE, designated SEQ ID:14540, to the nucleotide sequence of GAM3229 RNA, herein designated GAM RNA, also designated SEQ ID:221.

Another function of GAM3229 is therefore inhibition of POLR1B (Accession NP_115588.1). Accordingly, utilities of GAM3229 include diagnosis, prevention and treatment of diseases and clinical conditions associated with POLR1B.

POLR1B (Accession NP_061887.1) is another GAM3229 target gene, herein designated TARGET GENE. POLR1B BINDING SITE is a target binding site found in the 3' untranslated region of multiple transcripts of mRNA encoded by POLR1B, corresponding to a target binding site such as BINDING SITE I, BINDING SITE II or BINDING SITE III of FIG. 8. Table 4 illustrates the complementarity of the nucleotide sequences of POLR1B BINDING SITE, designated SEQ ID:14540, to the nucleotide sequence of GAM3229 RNA, herein designated GAM RNA, also designated SEQ ID:221.

Another function of GAM3229 is therefore inhibition of POLR1B (Accession NP_061887.1). Accordingly, utilities of GAM3229 include diagnosis, prevention and treatment of diseases and clinical conditions associated with POLR1B.

Ptprf interacting protein, binding protein 1 (liprin beta 1) (PPFIBP1, Accession NP_003613.2) is another GAM3229 target gene, herein designated TARGET GENE. PPFIBP1 BINDING SITE1 and PPFIBP1 BINDING SITE2 are target binding sites found in untranslated regions of multiple transcripts of mRNA encoded by PPFIBP1, corresponding to target binding sites such as BINDING SITE I, BINDING SITE II or BINDING SITE III of FIG. 8. Table 4 illustrates the complementarity of the nucleotide sequences of PPFIBP1 BINDING SITE1 and PPFIBP1 BINDING SITE2, designated SEQ ID:15585 and SEQ ID:7102 respectively, to the nucleotide sequence of GAM3229 RNA, herein designated GAM RNA, also designated SEQ ID:221.

Another function of GAM3229 is therefore inhibition of Ptprf interacting protein, binding protein 1 (liprin beta 1) (PPFIBP1, Accession NP_003613.2). Accordingly, utilities of GAM3229 include diagnosis, prevention and treatment of diseases and clinical conditions associated with PPFIBP1.

Peptidylprolyl isomerase d (cyclophilin d) (PPID, Accession NP_005029.1) is another GAM3229 target gene, herein designated TARGET GENE. PPID BINDING SITE is a target binding site found in the 3' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:8015, to the nucleotide sequence of GAM3229 RNA, herein designated GAM RNA, also designated SEQ ID:221.

Another function of GAM3229 is therefore inhibition of Peptidylprolyl isomerase d (cyclophilin d) (PPID, Accession NP_005029.1), a gene which catalyzes the cis-trans isomerization of proline imidic peptide bonds in oligopeptides. Accordingly, utilities of GAM3229 include diagnosis, prevention and treatment of diseases and clinical conditions associated with PPID.

The function of PPID and its association with various diseases and clinical conditions, has been established by previous studies, as described hereinabove with reference to GAM136.1. Peptidylprolyl isomerase (cyclophilin)-like 2 (PPIL2, Accession NP_055152.1) is another GAM3229 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:6798, to the nucleotide sequence of GAM3229 RNA, herein designated GAM RNA, also designated SEQ ID:221.

Another function of GAM3229 is therefore inhibition of Peptidylprolyl isomerase (cyclophilin)-like 2 (PPIL2, Accession NP_055152.1). Accordingly, utilities of GAM3229 include diagnosis, prevention and treatment of diseases and clinical conditions associated with PPIL2.

PRICKLE2 (Accession XP_093799.2) is another GAM3229 target gene, herein designated TARGET GENE. PRICKLE2 BINDING SITE is a target binding site found in the 3' untranslated region of mRNA encoded by PRICKLE2, corresponding to a target binding site such as BINDING SITE I, BINDING SITE II or BINDING SITE III of FIG. 8. Table 4 illustrates the complementarity of the nucleotide sequences of PRICKLE2 BINDING SITE, designated SEQ ID:1859, to the nucleotide sequence of GAM3229 RNA, herein designated GAM RNA, also designated SEQ ID:221.

Another function of GAM3229 is therefore inhibition of PRICKLE2 (Accession XP_093799.2). Accordingly, utilities of GAM3229 include diagnosis, prevention and treatment of diseases and clinical conditions associated with PRICKLE2.

Protamine 2 (PRM2, Accession NP_002753.1) is another GAM3229 target gene, herein designated TARGET GENE. PRM2 BINDING SITE is a target binding site found in the 3' untranslated region of mRNA encoded by PRM2, corresponding to a target binding site such as BINDING SITE I, BINDING SITE II or BINDING SITE III of FIG. 8. Table 4 illustrates the complementarity of the nucleotide sequences of PRM2 BINDING SITE, designated SEQ ID:15684, to the nucleotide sequence of GAM3229 RNA, herein designated GAM RNA, also designated SEQ ID:221.

Another function of GAM3229 is therefore inhibition of Protamine 2 (PRM2, Accession NP_002753.1), a gene which compacts sperm dna into a highly condensed, stable and inactive complex. and therefore may be associated with Infertility. Accordingly, utilities of GAM3229 include diagnosis, prevention and treatment of Infertility, and of other diseases and clinical conditions associated with PRM2.

The function of PRM2 and its association with various diseases and clinical conditions, has been established by previous studies, as described hereinabove with reference to GAM347.2. PRO0233 (Accession NP_054840.1) is another GAM3229 target gene, herein designated TARGET GENE. PRO0233 BINDING SITE is a target binding site found in the 3' untranslated region of mRNA encoded by PRO0233, corresponding to a target binding site such as BINDING SITE I, BINDING SITE II or BINDING SITE III of FIG. 8. Table 4 illustrates the complementarity of the nucleotide sequences of PRO0233 BINDING SITE, designated SEQ ID:7103, to the nucleotide sequence of GAM3229 RNA, herein designated GAM RNA, also designated SEQ ID:221.

Another function of GAM3229 is therefore inhibition of PRO0233 (Accession NP_054840.1). Accordingly, utilities of GAM3229 include diagnosis, prevention and treatment of diseases and clinical conditions associated with PRO0233.

PRO0297 (Accession NP_054800.1) is another GAM3229 target gene, herein designated TARGET GENE. PRO0297 BINDING SITE is a target binding site found in the 5' untranslated region of mRNA encoded by PRO0297, corresponding to a target binding site such as BINDING SITE I, BINDING SITE II or BINDING SITE III of FIG. 8. Table 4 illustrates the complementarity of the nucleotide sequences of PRO0297 BINDING SITE, designated SEQ ID:16889, to the nucleotide sequence of GAM3229 RNA, herein designated GAM RNA, also designated SEQ ID:221.

Another function of GAM3229 is therefore inhibition of PRO0297 (Accession NP_054800.1). Accordingly, utilities of GAM3229 include diagnosis, prevention and treatment of diseases and clinical conditions associated with PRO0297.

Presenilin 1 (alzheimer disease 3) (PSEN1, Accession NP_000012.1) is another GAM3229 target gene, herein designated TARGET GENE. PSEN1 BINDING SITE1 and PSEN1 BINDING SITE2 are target binding sites found in untranslated regions of multiple transcripts of mRNA encoded by PSEN1, corresponding to target binding sites such as BINDING SITE I, BINDING SITE II or BINDING SITE III of FIG. 8. Table 4 illustrates the complementarity of the nucleotide sequences of PSEN1 BINDING SITE1 and PSEN1 BINDING SITE2, designated SEQ ID:20121 and SEQ ID:4484 respectively, to the nucleotide sequence of GAM3229 RNA, herein designated GAM RNA, also designated SEQ ID:221.

Another function of GAM3229 is therefore inhibition of Presenilin 1 (alzheimer disease 3) (PSEN1, Accession NP_000012.1) . Accordingly, utilities of GAM3229 include diagnosis, prevention and treatment of diseases and clinical conditions associated with PSEN1.

PSK (Accession NP_057235.1) is another GAM3229 target gene, herein designated TARGET GENE. PSK BINDING SITE is a target binding site found in the 3' untranslated region of mRNA encoded by PSK, corresponding to a target binding site such as BINDING SITE I, BINDING SITE II or BINDING SITE III of FIG. 8. Table 4 illustrates the complementarity of the nucleotide sequences of PSK BINDING SITE, designated SEQ ID:14317, to the nucleotide sequence of GAM3229 RNA, herein designated GAM RNA, also designated SEQ ID:221.

Another function of GAM3229 is therefore inhibition of PSK (Accession NP_057235.1). Accordingly, utilities of GAM3229 include diagnosis, prevention and treatment of diseases and clinical conditions associated with PSK.

Proteasome (prosome, macropain) activator subunit 3 (pa28 gamma; ki) (PSME3, Accession NP_005780.2) is another GAM3229 target gene, herein designated TARGET GENE. PSME3 BINDING SITE is a target binding site found in the 3' untranslated region of multiple transcripts of mRNA encoded by PSME3, corresponding to a target binding site such as BINDING SITE I, BINDING SITE II or BINDING SITE III of FIG. 8. Table 4 illustrates the complementarity of the nucleotide sequences of PSME3 BINDING SITE, designated SEQ ID:5202, to the nucleotide sequence of GAM3229 RNA, herein designated GAM RNA, also designated SEQ ID:221.

Another function of GAM3229 is therefore inhibition of Proteasome (prosome, macropain) activator subunit 3 (pa28 gamma; ki) (PSME3, Accession NP_005780.2), a gene which is the activator subunit of the proteasome (prosome macropain). Accordingly, utilities of GAM3229 include diagnosis, prevention and treatment of diseases and clinical conditions associated with PSME3.

The function of PSME3 and its association with various diseases and clinical conditions, has been established by previous studies, as described hereinabove with reference to GAM195.2. Proteasome (prosome, macropain) activator subunit 3 (pa28 gamma; ki) (PSME3, Accession NP_789839.1) is another GAM3229 target gene, herein designated TARGET GENE. PSME3 BINDING SITE is a target binding site found in the 3' untranslated region of multiple transcripts of mRNA encoded by PSME3, corresponding to a target binding site such as BINDING SITE I, BINDING SITE II or BINDING SITE III of FIG. 8. Table 4 illustrates the complementarity of the nucleotide sequences of PSME3 BINDING SITE, designated SEQ ID:5202, to the nucleotide sequence of GAM3229 RNA, herein designated GAM RNA, also designated SEQ ID:221.

Another function of GAM3229 is therefore inhibition of Proteasome (prosome, macropain) activator subunit 3 (pa28 gamma; ki) (PSME3, Accession NP_789839.1), a gene which is the activator subunit of the proteasome (prosome macropain). Accordingly, utilities of GAM3229 include diagnosis, prevention and treatment of diseases and clinical conditions associated with PSME3.

The function of PSME3 and its association with various diseases and clinical conditions, has been established by previous studies, as described hereinabove with reference to GAM195.2. Phosphoserine phosphatase (PSPH, Accession NP_004568.1) is another GAM3229 target gene, herein designated TARGET GENE. PSPH BINDING SITE is a target binding site found in the 5' untranslated region of mRNA encoded by PSPH, corresponding to a target binding site such as BINDING SITE I, BINDING SITE II or BINDING SITE III of FIG. 8. Table 4 illustrates the complementarity of the nucleotide sequences of PSPH BINDING SITE, designated SEQ ID:9353, to the nucleotide sequence of GAM3229 RNA, herein designated GAM RNA, also designated SEQ ID:221.

Another function of GAM3229 is therefore inhibition of Phosphoserine phosphatase (PSPH, Accession NP_004568.1). Accordingly, utilities of GAM3229 include diagnosis, prevention and treatment of diseases and clinical conditions associated with PSPH.

Prostaglandin e synthase (PTGES, Accession NP_004869.1) is another GAM3229 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:11180, to the nucleotide sequence of GAM3229 RNA, herein designated GAM RNA, also designated SEQ ID:221.

Another function of GAM3229 is therefore inhibition of Prostaglandin e synthase (PTGES, Accession NP_004869.1). Accordingly, utilities of GAM3229 include diagnosis, prevention and treatment of diseases and clinical conditions associated with PTGES.

Protein tyrosine phosphatase, non-receptor type 18 (brain-derived) (PTPN18, Accession NP_055184.2) is another GAM3229 target gene, herein designated TARGET GENE. PTPN18 BINDING SITE is a target binding site found in the 3' untranslated region of mRNA encoded by PTPN18, corresponding to a target binding site such as BINDING SITE I, BINDING SITE II or BINDING SITE III of FIG. 8. Table 4 illustrates the complementarity of the nucleotide sequences of PTPN18 BINDING SITE, designated SEQ ID:10017, to the nucleotide sequence of GAM3229 RNA, herein designated GAM RNA, also designated SEQ ID:221.

Another function of GAM3229 is therefore inhibition of Protein tyrosine phosphatase, non-receptor type 18 (brain-derived) (PTPN18, Accession NP_055184.2). Accordingly, utilities of GAM3229 include diagnosis, prevention and treatment of diseases and clinical conditions associated with PTPN18.

Protein tyrosine phosphatase, non-receptor type 21 (PTPN21, Accession NP_008970.1) is another GAM3229 target gene, herein designated TARGET GENE. PTPN21 BINDING SITE is a target binding site found in the 3' untranslated region of mRNA encoded by PTPN21, corresponding to a target binding site such as BINDING SITE I, BINDING SITE II or BINDING SITE III of FIG. 8. Table 4 illustrates the complementarity of the nucleotide sequences of PTPN21 BINDING SITE, designated SEQ ID:18866, to the nucleotide sequence of GAM3229 RNA, herein designated GAM RNA, also designated SEQ ID:221.

Another function of GAM3229 is therefore inhibition of Protein tyrosine phosphatase, non-receptor type 21 (PTPN21, Accession NP_008970.1). Accordingly, utilities of GAM3229 include diagnosis, prevention and treatment of diseases and clinical conditions associated with PTPN21.

Poliovirus receptor (PVR, Accession NP_006496.2) is another GAM3229 target gene, herein designated TARGET GENE. PVR BINDING SITE is a target binding site found in the 3' untranslated region of mRNA encoded by PVR, corresponding to a target binding site such as BINDING SITE I, BINDING SITE II or BINDING SITE III of FIG. 8. Table 4 illustrates the complementarity of the nucleotide sequences of PVR BINDING SITE, designated SEQ ID:16119, to the nucleotide sequence of GAM3229 RNA, herein designated GAM RNA, also designated SEQ ID:221.

Another function of GAM3229 is therefore inhibition of Poliovirus receptor (PVR, Accession NP_006496.2), a gene which is a poliovirus receptor and therefore may be associated with Poliomyelitis. Accordingly, utilities of GAM3229 include diagnosis, prevention and treatment of Poliomyelitis, and of other diseases and clinical conditions associated with PVR.

The function of PVR and its association with various diseases and clinical conditions, has been established by previous studies, as described hereinabove with reference to GAM47.1. RA-GEF-2 (Accession NP_057424.1) is another GAM3229 target gene, herein designated TARGET GENE. RA-GEF-2 BINDING SITE is a target binding site found in the 3' untranslated region of mRNA encoded by RA-GEF-2, corresponding to a target binding site such as BINDING SITE I, BINDING SITE II or BINDING SITE III of FIG. 8. Table 4 illustrates the complementarity of the nucleotide sequences of RA-GEF-2 BINDING SITE, designated SEQ ID:685, to the nucleotide sequence of GAM3229 RNA, herein designated GAM RNA, also designated SEQ ID:221.

Another function of GAM3229 is therefore inhibition of RA-GEF-2 (Accession NP_057424.1). Accordingly, utilities of GAM3229 include diagnosis, prevention and treatment of diseases and clinical conditions associated with RA-GEF-2.

RAB11-FIP4 (Accession NP_116321.2) is another GAM3229 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:4504, to the nucleotide sequence of GAM3229 RNA, herein designated GAM RNA, also designated SEQ ID:221.

Another function of GAM3229 is therefore inhibition of RAB11-FIP4 (Accession NP_116321.2). Accordingly, utilities of GAM3229 include diagnosis, prevention and treatment of diseases and clinical conditions associated with RAB11-FIP4.

Rab33b, member ras oncogene family (RAB33B, Accession NP_112586.1) is another GAM3229 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:10964, to the nucleotide sequence of GAM3229 RNA, herein designated GAM RNA, also designated SEQ ID:221.

Another function of GAM3229 is therefore inhibition of Rab33b, member ras oncogene family (RAB33B, Accession NP_112586.1). Accordingly, utilities of GAM3229 include diagnosis, prevention and treatment of diseases and clinical conditions associated with RAB33B.

Retinoic acid induced 3 (RAI3, Accession NP_003970.1) is another GAM3229 target gene, herein designated TARGET GENE. RAI3 BINDING SITE is a target binding site found in the 3' untranslated region of mRNA encoded by RAI3, corresponding to a target binding site such as BINDING SITE I, BINDING SITE II or BINDING SITE III of FIG. 8. Table 4 illustrates the complementarity of the nucleotide sequences of RAI3 BINDING SITE, designated SEQ ID:2965, to the nucleotide sequence of GAM3229 RNA, herein designated GAM RNA, also designated SEQ ID:221.

Another function of GAM3229 is therefore inhibition of Retinoic acid induced 3 (RAI3, Accession NP_003970.1). Accordingly, utilities of GAM3229 include diagnosis, prevention and treatment of diseases and clinical conditions associated with RAI3.

Retinoblastoma binding protein 9 (RBBP9, Accession NP_006597.2) is another GAM3229 target gene, herein designated TARGET GENE. RBBP9 BINDING SITE is a target binding site found in the 3' untranslated region of multiple transcripts of mRNA encoded by RBBP9, corresponding to a target binding site such as BINDING SITE I, BINDING SITE II or BINDING SITE III of FIG. 8. Table 4 illustrates the complementarity of the nucleotide sequences of RBBP9 BINDING SITE, designated SEQ ID:14743, to the nucleotide sequence of GAM3229 RNA, herein designated GAM RNA, also designated SEQ ID:221.

Another function of GAM3229 is therefore inhibition of Retinoblastoma binding protein 9 (RBBP9, Accession NP_006597.2). Accordingly, utilities of GAM3229 include diagnosis, prevention and treatment of diseases and clinical conditions associated with RBBP9.

RE2 (Accession NP_722561.1) is another GAM3229 target gene, herein designated TARGET GENE. RE2 BINDING SITE is a target binding site found in the 5' untranslated region of multiple transcripts of mRNA encoded by RE2, corresponding to a target binding site such as BINDING SITE I, BINDING SITE II or BINDING SITE III of FIG. 8. Table 4 illustrates the complementarity of the nucleotide sequences of RE2 BINDING SITE, designated SEQ ID:2783, to the nucleotide sequence of GAM3229 RNA, herein designated GAM RNA, also designated SEQ ID:221.

Another function of GAM3229 is therefore inhibition of RE2 (Accession NP_722561.1). Accordingly, utilities of GAM3229 include diagnosis, prevention and treatment of diseases and clinical conditions associated with RE2.

Rhesus blood group, d antigen (RHD, Accession NP_057309.2) is another GAM3229 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:6398 and SEQ ID:17898 respectively, to the nucleotide sequence of GAM3229 RNA, herein designated GAM RNA, also designated SEQ ID:221.

Another function of GAM3229 is therefore inhibition of Rhesus blood group, d antigen (RHD, Accession NP_057309.2), a gene which Major antigen of the RH system. Accordingly, utilities of GAM3229 include diagnosis, prevention and treatment of diseases and clinical conditions associated with RHD.

The function of RHD and its association with various diseases and clinical conditions, has been established by previous studies, as described hereinabove with reference to GAM161.1. Rhesus blood group, d antigen (RHD, Accession NP_057208.2) is another GAM3229 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:6398 and SEQ ID:17898 respectively, to the nucleotide sequence of GAM3229 RNA, herein designated GAM RNA, also designated SEQ ID:221.

Another function of GAM3229 is therefore inhibition of Rhesus blood group, d antigen (RHD, Accession NP_057208.2), a gene which Major antigen of the RH system. Accordingly, utilities of GAM3229 include diagnosis, prevention and treatment of diseases and clinical conditions associated with RHD.

The function of RHD and its association with various diseases and clinical conditions, has been established by previous studies, as described hereinabove with reference to GAM161.1. RHPN2 (Accession NP_149094.2) is another GAM3229 target gene, herein designated TARGET GENE. RHPN2 BINDING SITE is a target binding site found in the 3' untranslated region of mRNA encoded by RHPN2, corresponding to a target binding site such as BINDING SITE I, BINDING SITE II or BINDING SITE III of FIG. 8. Table 4 illustrates the complementarity of the nucleotide sequences of RHPN2 BINDING SITE, designated SEQ ID:14536, to the nucleotide sequence of GAM3229 RNA, herein designated GAM RNA, also designated SEQ ID:221.

Another function of GAM3229 is therefore inhibition of RHPN2 (Accession NP_149094.2). Accordingly, utilities of GAM3229 include diagnosis, prevention and treatment of diseases and clinical conditions associated with RHPN2.

RI58 (Accession NP_036552.1) is another GAM3229 target gene, herein designated TARGET GENE. RI58 BIND- ING SITE is a target binding site found in the 3' untranslated region of mRNA encoded by RI58, corresponding to a target binding site such as BINDING SITE I, BINDING SITE II or BINDING SITE III of FIG. 8. Table 4 illustrates the complementarity of the nucleotide sequences of RI58 BINDING SITE, designated SEQ ID:10523, to the nucleotide sequence of GAM3229 RNA, herein designated GAM RNA, also designated SEQ ID:221.

Another function of GAM3229 is therefore inhibition of RI58 (Accession NP_036552.1). Accordingly, utilities of GAM3229 include diagnosis, prevention and treatment of diseases and clinical conditions associated with RI58.

RNF135 (Accession NP_115698.2) is another GAM3229 target gene, herein designated TARGET GENE. RNF135 BINDING SITE is a target binding site found in the 3' untranslated region of mRNA encoded by RNF135, corresponding to a target binding site such as BINDING SITE I, BINDING SITE II or BINDING SITE III of FIG. 8. Table 4 illustrates the complementarity of the nucleotide sequences of RNF135 BINDING SITE, designated SEQ ID:15831, to the nucleotide sequence of GAM3229 RNA, herein designated GAM RNA, also designated SEQ ID:221.

Another function of GAM3229 is therefore inhibition of RNF135 (Accession NP_115698.2). Accordingly, utilities of GAM3229 include diagnosis, prevention and treatment of diseases and clinical conditions associated with RNF135.

RNF144 (Accession NP_055561.1) is another GAM3229 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:5448, to the nucleotide sequence of GAM3229 RNA, herein designated GAM RNA, also designated SEQ ID:221.

Another function of GAM3229 is therefore inhibition of RNF144 (Accession NP_055561.1). Accordingly, utilities of GAM3229 include diagnosis, prevention and treatment of diseases and clinical conditions associated with RNF144.

Ring finger protein 19 (RNF19, Accession NP_056250.2) is another GAM3229 target gene, herein designated TARGET GENE. RNF19 BINDING SITE is a target binding site found in the 5' untranslated region of mRNA encoded by RNF19, corresponding to a target binding site such as BINDING SITE I, BINDING SITE II or BINDING SITE III of FIG. 8. Table 4 illustrates the complementarity of the nucleotide sequences of RNF19 BINDING SITE, designated SEQ ID:15444, to the nucleotide sequence of GAM3229 RNA, herein designated GAM RNA, also designated SEQ ID:221.

Another function of GAM3229 is therefore inhibition of Ring finger protein 19 (RNF19, Accession NP_056250.2). Accordingly, utilities of GAM3229 include diagnosis, prevention and treatment of diseases and clinical conditions associated with RNF19.

Ring finger protein (c3hc4 type) 8 (RNF8, Accession NP_003949.1) is another GAM3229 target gene, herein designated TARGET GENE. RNF8 BINDING SITE is a target binding site found in the 3' untranslated region of mRNA encoded by RNF8, corresponding to a target binding site such as BINDING SITE I, BINDING SITE II or BINDING SITE III of FIG. 8. Table 4 illustrates the complementarity of the nucleotide sequences of RNF8 BINDING SITE, designated SEQ ID:11343, to the nucleotide sequence of GAM3229 RNA, herein designated GAM RNA, also designated SEQ ID:221.

Another function of GAM3229 is therefore inhibition of Ring finger protein (c3hc4 type) 8 (RNF8, Accession NP_003949.1). Accordingly, utilities of GAM3229 include diagnosis, prevention and treatment of diseases and clinical conditions associated with RNF8.

Retinitis pigmentosa 2 (x-linked recessive) (RP2, Accession NP_008846.1) is another GAM3229 target gene, herein designated TARGET GENE. RP2 BINDING SITE is a target binding site found in the 3' untranslated region of mRNA encoded by RP2, corresponding to a target binding site such as BINDING SITE I, BINDING SITE II or BINDING SITE III of FIG. 8. Table 4 illustrates the complementarity of the nucleotide sequences of RP2 BINDING SITE, designated SEQ ID:15091, to the nucleotide sequence of GAM3229 RNA, herein designated GAM RNA, also designated SEQ ID:221.

Another function of GAM3229 is therefore inhibition of Retinitis pigmentosa 2 (x-linked recessive) (RP2, Accession NP_008846.1). Accordingly, utilities of GAM3229 include diagnosis, prevention and treatment of diseases and clinical conditions associated with RP2.

RP4-622L5 (Accession NP_061991.2) is another GAM3229 target gene, herein designated TARGET GENE. RP4-622L5 BINDING SITE is a target binding site found in the 3' untranslated region of mRNA encoded by RP4-622L5, corresponding to a target binding site such as BINDING SITE I, BINDING SITE II or BINDING SITE III of FIG. 8. Table 4 illustrates the complementarity of the nucleotide sequences of RP4-622L5 BINDING SITE, designated SEQ ID:6481, to the nucleotide sequence of GAM3229 RNA, herein designated GAM RNA, also designated SEQ ID:221.

Another function of GAM3229 is therefore inhibition of RP4-622L5 (Accession NP_061991.2). Accordingly, utilities of GAM3229 include diagnosis, prevention and treatment of diseases and clinical conditions associated with RP4-622L5.

Ribonucleotide reductase m2 b (tp53 inducible) (RRM2B, Accession XP_042096.1) is another GAM3229 target gene, herein designated TARGET GENE. RRM2B BINDING SITE is a target binding site found in the 3' untranslated region of mRNA encoded by RRM2B, corresponding to a target binding site such as BINDING SITE I, BINDING SITE II or BINDING SITE III of FIG. 8. Table 4 illustrates the complementarity of the nucleotide sequences of RRM2B BINDING SITE, designated SEQ ID:9272, to the nucleotide sequence of GAM3229 RNA, herein designated GAM RNA, also designated SEQ ID:221.

Another function of GAM3229 is therefore inhibition of Ribonucleotide reductase m2 b (tp53 inducible) (RRM2B, Accession XP_042096.1). Accordingly, utilities of GAM3229 include diagnosis, prevention and treatment of diseases and clinical conditions associated with RRM2B.

S100 calcium binding protein a1 (S100A1, Accession NP_006262.1) is another GAM3229 target gene, herein designated TARGET GENE. S100A1 BINDING SITE is a target binding site found in the 5' untranslated region of mRNA encoded by S100A1, corresponding to a target binding site such as BINDING SITE I, BINDING SITE II or BINDING SITE III of FIG. 8. Table 4 illustrates the complementarity of the nucleotide sequences of S100A1 BINDING SITE, designated SEQ ID:7600, to the nucleotide sequence of GAM3229 RNA, herein designated GAM RNA, also designated SEQ ID:221.

Another function of GAM3229 is therefore inhibition of S100 calcium binding protein a1 (S100A1, Accession NP_006262.1), a gene which weakly binds calcium but binds zinc very tightly-distinct binding sites with different affinities exist for both ions on each monomer. Accordingly, utilities of GAM3229 include diagnosis, prevention and treatment of diseases and clinical conditions associated with S100A1.

The function of S100A1 and its association with various diseases and clinical conditions, has been established by previous studies, as described hereinabove with reference to GAM724.1. Sterol-c4-methyl oxidase-like (SC4MOL, Accession NP_006736.1) is another GAM3229 target gene, herein designated TARGET GENE. SC4MOL BINDING SITE is a target binding site found in the 3' untranslated region of mRNA encoded by SC4MOL, corresponding to a target binding site such as BINDING SITE I, BINDING SITE II or BINDING SITE III of FIG. 8. Table 4 illustrates the complementarity of the nucleotide sequences of SC4MOL BINDING SITE, designated SEQ ID:3278, to the nucleotide sequence of GAM3229 RNA, herein designated GAM RNA, also designated SEQ ID:221.

Another function of GAM3229 is therefore inhibition of Sterol-c4-methyl oxidase-like (SC4MOL, Accession NP_006736.1). Accordingly, utilities of GAM3229 include diagnosis, prevention and treatment of diseases and clinical conditions associated with SC4MOL.

SCAMP-4 (Accession NP_524558.1) is another GAM3229 target gene, herein designated TARGET GENE. SCAMP-4 BINDING SITE is a target binding site found in the 3' untranslated region of mRNA encoded by SCAMP-4, corresponding to a target binding site such as BINDING SITE I, BINDING SITE II or BINDING SITE III of FIG. 8. Table 4 illustrates the complementarity of the nucleotide sequences of SCAMP-4 BINDING SITE, designated SEQ ID:15109, to the nucleotide sequence of GAM3229 RNA, herein designated GAM RNA, also designated SEQ ID:221.

Another function of GAM3229 is therefore inhibition of SCAMP-4 (Accession NP_524558.1). Accordingly, utilities of GAM3229 include diagnosis, prevention and treatment of diseases and clinical conditions associated with SCAMP-4.

Sex comb on midleg-like 2 (drosophila) (SCML2, Accession NP_006080.1) is another GAM3229 target gene, herein designated TARGET GENE. SCML2 BINDING SITE1 and SCML2 BINDING SITE2 are target binding sites found in untranslated regions of mRNA encoded by SCML2, corresponding to target binding sites such as BINDING SITE I, BINDING SITE II or BINDING SITE III of FIG. 8. Table 4 illustrates the complementarity of the nucleotide sequences of SCML2 BINDING SITE1 and SCML2 BINDING SITE2, designated SEQ ID:1648 and SEQ ID:12471 respectively, to the nucleotide sequence of GAM3229 RNA, herein designated GAM RNA, also designated SEQ ID:221.

Another function of GAM3229 is therefore inhibition of Sex comb on midleg-like 2 (drosophila) (SCML2, Accession NP_006080.1). Accordingly, utilities of GAM3229 include diagnosis, prevention and treatment of diseases and clinical conditions associated with SCML2.

SCN3B (Accession NP_060870.1) is another GAM3229 target gene, herein designated TARGET GENE. SCN3B BINDING SITE1 through SCN3B BINDING SITE3 are target binding sites found in untranslated regions of mRNA encoded by SCN3B, corresponding to target binding sites such as BINDING SITE I, BINDING SITE II or BINDING SITE III of FIG. 8. Table 4 illustrates the complementarity of the nucleotide sequences of SCN3B BINDING SITE1 through SCN3B BINDING SITE3, designated SEQ ID:12530, SEQ ID:19668 and SEQ ID:856 respectively, to the nucleotide sequence of GAM3229 RNA, herein designated GAM RNA, also designated SEQ ID:221.

Another function of GAM3229 is therefore inhibition of SCN3B (Accession NP_060870.1). Accordingly, utilities of GAM3229 include diagnosis, prevention and treatment of diseases and clinical conditions associated with SCN3B.

Spondyloepiphyseal dysplasia, late (SEDL, Accession NP_055378.1) is another GAM3229 target gene, herein designated TARGET GENE. SEDL BINDING SITE1 through SEDL BINDING SITE3 are target binding sites found in untranslated regions of mRNA encoded by SEDL, corresponding to target binding sites such as BINDING SITE I, BINDING SITE II or BINDING SITE III of FIG. 8. Table 4 illustrates the complementarity of the nucleotide sequences of SEDL BINDING SITE1 through SEDL BINDING SITE3, designated SEQ ID:15920, SEQ ID:6019 and SEQ ID:9526 respectively, to the nucleotide sequence of GAM3229 RNA, herein designated GAM RNA, also designated SEQ ID:221.

Another function of GAM3229 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM3229 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. Selenoprotein n, 1 (SEPN1, Accession NP_065184.1) is another GAM3229 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:941, to the nucleotide sequence of GAM3229 RNA, herein designated GAM RNA, also designated SEQ ID:221.

Another function of GAM3229 is therefore inhibition of Selenoprotein n, 1 (SEPN1, Accession NP_065184.1). Accordingly, utilities of GAM3229 include diagnosis, prevention and treatment of diseases and clinical conditions associated with SEPN1.

Small edrk-rich factor 1a (telomeric) (SERF1A, Accession NP_068802.1) is another GAM3229 target gene, herein designated TARGET GENE. SERF1A BINDING SITE is a target binding site found in the 3' untranslated region of mRNA encoded by SERF1A, corresponding to a target binding site such as BINDING SITE I, BINDING SITE II or BINDING SITE III of FIG. 8. Table 4 illustrates the complementarity of the nucleotide sequences of SERF1A BINDING SITE, designated SEQ ID:4780, to the nucleotide sequence of GAM3229 RNA, herein designated GAM RNA, also designated SEQ ID:221.

Another function of GAM3229 is therefore inhibition of Small edrk-rich factor 1a (telomeric) (SERF1A, Accession NP_068802.1). Accordingly, utilities of GAM3229 include diagnosis, prevention and treatment of diseases and clinical conditions associated with SERF1A.

Small edrk-rich factor 1b (centromeric) (SERF1B, Accession NP_075267.1) is another GAM3229 target gene, herein designated TARGET GENE. SERF1B BINDING SITE is a target binding site found in the 3' untranslated region of mRNA encoded by SERF1B, corresponding to a target binding site such as BINDING SITE I, BINDING SITE II or BINDING SITE III of FIG. 8. Table 4 illustrates the complementarity of the nucleotide sequences of SERF1B BINDING SITE, designated SEQ ID:4780, to the nucleotide sequence of GAM3229 RNA, herein designated GAM RNA, also designated SEQ ID:221.

Another function of GAM3229 is therefore inhibition of Small edrk-rich factor 1b (centromeric) (SERF1B, Accession NP_075267.1). Accordingly, utilities of GAM3229 include diagnosis, prevention and treatment of diseases and clinical conditions associated with SERF1B.

Small edrk-rich factor 2 (SERF2, Accession NP_005761.2) is another GAM3229 target gene, herein designated TARGET GENE. SERF2 BINDING SITE is a target binding site found in the 5' untranslated region of mRNA encoded by SERF2, corresponding to a target binding site such as BINDING SITE I, BINDING SITE II or BINDING SITE III of FIG. 8. Table 4 illustrates the complementarity of the nucleotide sequences of SERF2 BINDING SITE, designated SEQ ID:6225, to the nucleotide sequence of GAM3229 RNA, herein designated GAM RNA, also designated SEQ ID:221.

Another function of GAM3229 is therefore inhibition of Small edrk-rich factor 2 (SERF2, Accession NP_005761.2). Accordingly, utilities of GAM3229 include diagnosis, prevention and treatment of diseases and clinical conditions associated with SERF2.

Serine (or cysteine) proteinase inhibitor, clade b (ovalbumin), member 9 (SERPINB9, Accession NP_004146.1) is another GAM3229 target gene, herein designated TARGET GENE. SERPINB9 BINDING SITE1 and SERPINB9 BINDING SITE2 are target binding sites found in untranslated regions of mRNA encoded by SERPINB9, corresponding to target binding sites such as BINDING SITE I, BINDING SITE II or BINDING SITE III of FIG. 8. Table 4 illustrates the complementarity of the nucleotide sequences of SERPINB9 BINDING SITE1 and SERPINB9 BINDING SITE2, designated SEQ ID:3013 and SEQ ID:10182 respectively, to the nucleotide sequence of GAM3229 RNA, herein designated GAM RNA, also designated SEQ ID:221.

Another function of GAM3229 is therefore inhibition of Serine (or cysteine) proteinase inhibitor, clade b (ovalbumin), member 9 (SERPINB9, Accession NP_004146.1), a gene which may be a serpin serine protease inhibitor that interacts with granzyme B (GZMB). Accordingly, utilities of GAM3229 include diagnosis, prevention and treatment of diseases and clinical conditions associated with SERPINB9.

The function of SERPINB9 and its association with various diseases and clinical conditions, has been established by previous studies, as described hereinabove with reference to GAM88.2. Short stature homeobox (SHOX, Accession NP_006874.1) is another GAM3229 target gene, herein designated TARGET GENE. SHOX BINDING SITE is a target binding site found in the 3' untranslated region of multiple transcripts of mRNA encoded by SHOX, corresponding to a target binding site such as BINDING SITE I, BINDING SITE II or BINDING SITE III of FIG. 8. Table 4 illustrates the complementarity of the nucleotide sequences of SHOX BINDING SITE, designated SEQ ID:10964, to the nucleotide sequence of GAM3229 RNA, herein designated GAM RNA, also designated SEQ ID:221.

Another function of GAM3229 is therefore inhibition of Short stature homeobox (SHOX, Accession NP_006874.1). Accordingly, utilities of GAM3229 include diagnosis, prevention and treatment of diseases and clinical conditions associated with SHOX.

Sialic acid binding ig-like lectin 11 (SIGLEC11, Accession NP_443116.1) is another GAM3229 target gene, herein designated TARGET GENE. SIGLEC11 BINDING SITE is a target binding site found in the 3' untranslated region of mRNA encoded by SIGLEC11, corresponding to a target binding site such as BINDING SITE I, BINDING SITE II or BINDING SITE III of FIG. 8. Table 4 illustrates the complementarity of the nucleotide sequences of SIGLEC11 BINDING SITE, designated SEQ ID:11214, to the nucleotide sequence of GAM3229 RNA, herein designated GAM RNA, also designated SEQ ID:221.

Another function of GAM3229 is therefore inhibition of Sialic acid binding ig-like lectin 11 (SIGLEC11, Accession NP_443116.1). Accordingly, utilities of GAM3229 include diagnosis, prevention and treatment of diseases and clinical conditions associated with SIGLEC11.

Sialic acid binding ig-like lectin 5 (SIGLEC5, Accession NP_003821.1) is another GAM3229 target gene, herein designated TARGET GENE. SIGLEC5 BINDING SITE is a target binding site found in the 3' untranslated region of mRNA encoded by SIGLEC5, corresponding to a target binding site such as BINDING SITE I, BINDING SITE II or BINDING SITE III of FIG. 8. Table 4 illustrates the complementarity of the nucleotide sequences of SIGLEC5 BINDING SITE, designated SEQ ID:15567, to the nucleotide sequence of GAM3229 RNA, herein designated GAM RNA, also designated SEQ ID:221.

Another function of GAM3229 is therefore inhibition of Sialic acid binding ig-like lectin 5 (SIGLEC5, Accession NP_003821.1), a gene which is a cell adhesion molecule for postnatal neural development. Accordingly, utilities of GAM3229 include diagnosis, prevention and treatment of diseases and clinical conditions associated with SIGLEC5.

The function of SIGLEC5 and its association with various diseases and clinical conditions, has been established by previous studies, as described hereinabove with reference to GAM94.1. Sialic acid binding ig-like lectin 8 (SIGLEC8, Accession NP_055257.1) is another GAM3229 target gene, herein designated TARGET GENE. SIGLEC8 BINDING SITE is a target binding site found in the 3' untranslated region of mRNA encoded by SIGLEC8, corresponding to a target binding site such as BINDING SITE I, BINDING SITE II or BINDING SITE III of FIG. 8. Table 4 illustrates the complementarity of the nucleotide sequences of SIGLEC8 BINDING SITE, designated SEQ ID:6398, to the nucleotide sequence of GAM3229 RNA, herein designated GAM RNA, also designated SEQ ID:221.

Another function of GAM3229 is therefore inhibition of Sialic acid binding ig-like lectin 8 (SIGLEC8, Accession NP_055257.1), a gene which is a cell adhesion molecule for postnatal neural development. Accordingly, utilities of GAM3229 include diagnosis, prevention and treatment of diseases and clinical conditions associated with SIGLEC8.

The function of SIGLEC8 and its association with various diseases and clinical conditions, has been established by previous studies, as described hereinabove with reference to GAM63.1. Src-like-adaptor 2 (SLA2, Accession NP_778252.1) is another GAM3229 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:17394, to the nucleotide sequence of GAM3229 RNA, herein designated GAM RNA, also designated SEQ ID:221.

Another function of GAM3229 is therefore inhibition of Src-like-adaptor 2 (SLA2, Accession NP_778252.1).

Accordingly, utilities of GAM3229 include diagnosis, prevention and treatment of diseases and clinical conditions associated with SLA2.

Src-like-adaptor 2 (SLA2, Accession NP_115590.1) is another GAM3229 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:17394, to the nucleotide sequence of GAM3229 RNA, herein designated GAM RNA, also designated SEQ ID:221.

Another function of GAM3229 is therefore inhibition of Src-like-adaptor 2 (SLA2, Accession NP_115590.1). Accordingly, utilities of GAM3229 include diagnosis, prevention and treatment of diseases and clinical conditions associated with SLA2.

Solute carrier family 12 (potassium/chloride transporters), member 8 (SLC12A8, Accession NP_078904.1) is another GAM3229 target gene, herein designated TARGET GENE. SLC12A8 BINDING SITE is a target binding site found in the 3' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:18490, to the nucleotide sequence of GAM3229 RNA, herein designated GAM RNA, also designated SEQ ID:221.

Another function of GAM3229 is therefore inhibition of Solute carrier family 12 (potassium/chloride transporters), member 8 (SLC12A8, Accession NP_078904.1). Accordingly, utilities of GAM3229 include diagnosis, prevention and treatment of diseases and clinical conditions associated with SLC12A8.

Solute carrier family 15 (oligopeptide transporter), member 1 (SLC15A1, Accession NP_005064.1) is another GAM3229 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:940, to the nucleotide sequence of GAM3229 RNA, herein designated GAM RNA, also designated SEQ ID:221.

Another function of GAM3229 is therefore inhibition of Solute carrier family 15 (oligopeptide transporter), member 1 (SLC15A1, Accession NP_005064.1), a gene which is a H(+)-coupled peptide transporter. Accordingly, utilities of GAM3229 include diagnosis, prevention and treatment of diseases and clinical conditions associated with SLC15A1.

The function of SLC15A1 and its association with various diseases and clinical conditions, has been established by previous studies, as described hereinabove with reference to GAM30.1. Solute carrier family 16 (monocarboxylic acid transporters), member 6 (SLC16A6, Accession NP_004685.1) is another GAM3229 target gene, herein designated TARGET GENE. SLC16A6 BINDING SITE is a target binding site found in the 5' untranslated region of mRNA encoded by SLC16A6, corresponding to a target binding site such as BINDING SITE I, BINDING SITE II or BINDING SITE III of FIG. 8. Table 4 illustrates the complementarity of the nucleotide sequences of SLC16A6 BINDING SITE, designated SEQ ID:3300, to the nucleotide sequence of GAM3229 RNA, herein designated GAM RNA, also designated SEQ ID:221.

Another function of GAM3229 is therefore inhibition of Solute carrier family 16 (monocarboxylic acid transporters), member 6 (SLC16A6, Accession NP_004685.1). Accordingly, utilities of GAM3229 include diagnosis, prevention and treatment of diseases and clinical conditions associated with SLC16A6.

Solute carrier family 24 (sodium/potassium/calcium exchanger), member 1 (SLC24A1, Accession NP_004718.1) is another GAM3229 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:1284, to the nucleotide sequence of GAM3229 RNA, herein designated GAM RNA, also designated SEQ ID:221.

Another function of GAM3229 is therefore inhibition of Solute carrier family 24 (sodium/potassium/calcium exchanger), member 1 (SLC24A1, Accession NP_004718.1), a gene which is a critical component of the visual transduction cascade, controlling the calcium concentration of outer segments during light and darkness. Accordingly, utilities of GAM3229 include diagnosis, prevention and treatment of diseases and clinical conditions associated with SLC24A1.

The function of SLC24A1 and its association with various diseases and clinical conditions, has been established by previous studies, as described hereinabove with reference to GAM130.1. Solute carrier family 2 (facilitated glucose transporter), member 10 (SLC2A10, Accession NP_110404.1) is another GAM3229 target gene, herein designated TARGET GENE. SLC2A10 BINDING SITE is a target binding site found in the 3' untranslated region of mRNA encoded by SLC2A10, corresponding to a target binding site such as BINDING SITE I, BINDING SITE II or BINDING SITE III of FIG. 8. Table 4 illustrates the complementarity of the nucleotide sequences of SLC2A10 BINDING SITE, designated SEQ ID:7814, to the nucleotide sequence of GAM3229 RNA, herein designated GAM RNA, also designated SEQ ID:221.

Another function of GAM3229 is therefore inhibition of Solute carrier family 2 (facilitated glucose transporter), member 10 (SLC2A10, Accession NP_110404.1). Accordingly, utilities of GAM3229 include diagnosis, prevention and treatment of diseases and clinical conditions associated with SLC2A10.

SLC35E2 (Accession XP_049733.6) is another GAM3229 target gene, herein designated TARGET GENE. SLC35E2 BINDING SITE1 and SLC35E2 BINDING SITE2 are target binding sites found in untranslated regions of mRNA encoded by SLC35E2, corresponding to target binding sites such as BINDING SITE I, BINDING SITE II or BINDING SITE III of FIG. 8. Table 4 illustrates the complementarity of the nucleotide sequences of SLC35E2 BINDING SITE1 and SLC35E2 BINDING SITE2, designated SEQ ID:13880 and SEQ ID:16129 respectively, to the nucleotide sequence of GAM3229 RNA, herein designated GAM RNA, also designated SEQ ID:221.

Another function of GAM3229 is therefore inhibition of SLC35E2 (Accession XP_049733.6). Accordingly, utilities of GAM3229 include diagnosis, prevention and treatment of diseases and clinical conditions associated with SLC35E2.

Solute carrier family 36 (proton/amino acid symporter), member 1 (SLC36A1, Accession NP_510968.1) is another GAM3229 target gene, herein designated TARGET GENE. SLC36A1 BINDING SITE is a target binding site found in the 3' untranslated region of mRNA encoded by SLC36A1, corresponding to a target binding site such as BINDING SITE I, BINDING SITE II or BINDING SITE III of FIG. 8. Table 4 illustrates the complementarity of the nucleotide sequences of SLC36A1 BINDING SITE, designated SEQ ID:989, to the nucleotide sequence of GAM3229 RNA, herein designated GAM RNA, also designated SEQ ID:221.

Another function of GAM3229 is therefore inhibition of Solute carrier family 36 (proton/amino acid symporter), member 1 (SLC36A1, Accession NP_510968.1). Accordingly, utilities of GAM3229 include diagnosis, prevention and treatment of diseases and clinical conditions associated with SLC36A1.

Solute carrier family 39 (zinc transporter), member 1 (SLC39A1, Accession NP_055252.2) is another GAM3229 target gene, herein designated TARGET GENE. SLC39A1 BINDING SITE is a target binding site found in the 5' untranslated region of mRNA encoded by SLC39A1, corresponding to a target binding site such as BINDING SITE I, BINDING SITE II or BINDING SITE III of FIG. 8. Table 4 illustrates the complementarity of the nucleotide sequences of SLC39A1 BINDING SITE, designated SEQ ID:17454, to the nucleotide sequence of GAM3229 RNA, herein designated GAM RNA, also designated SEQ ID:221.

Another function of GAM3229 is therefore inhibition of Solute carrier family 39 (zinc transporter), member 1 (SLC39A1, Accession NP_055252.2), a gene which is a divalent (zinc/iron) metal ion transporter. Accordingly, utilities of GAM3229 include diagnosis, prevention and treatment of diseases and clinical conditions associated with SLC39A1.

The function of SLC39A1 and its association with various diseases and clinical conditions, has been established by previous studies, as described hereinabove with reference to GAM175.1. Solute carrier family 5 (sodium-dependent vitamin transporter), member 6 (SLC5A6, Accession NP_066918.1) is another GAM3229 target gene, herein designated TARGET GENE. SLC5A6 BINDING SITE is a target binding site found in the 3' untranslated region of mRNA encoded by SLC5A6, corresponding to a target binding site such as BINDING SITE I, BINDING SITE II or BINDING SITE III of FIG. 8. Table 4 illustrates the complementarity of the nucleotide sequences of SLC5A6 BINDING SITE, designated SEQ ID:11338, to the nucleotide sequence of GAM3229 RNA, herein designated GAM RNA, also designated SEQ ID:221.

Another function of GAM3229 is therefore inhibition of Solute carrier family 5 (sodium-dependent vitamin transporter), member 6 (SLC5A6, Accession NP_066918.1). Accordingly, utilities of GAM3229 include diagnosis, prevention and treatment of diseases and clinical conditions associated with SLC5A6.

Solute carrier family 6 (neurotransmitter transporter, betaine/gaba), member 12 (SLC6A12, Accession NP_003035.2) is another GAM3229 target gene, herein designated TARGET GENE. SLC6A12 BINDING SITE is a target binding site found in the 3' untranslated region of mRNA encoded by SLC6A12, corresponding to a target binding site such as BINDING SITE I, BINDING SITE II or BINDING SITE III of FIG. 8. Table 4 illustrates the complementarity of the nucleotide sequences of SLC6A12 BINDING SITE, designated SEQ ID:9875, to the nucleotide sequence of GAM3229 RNA, herein designated GAM RNA, also designated SEQ ID:221.

Another function of GAM3229 is therefore inhibition of Solute carrier family 6 (neurotransmitter transporter, betaine/gaba), member 12 (SLC6A12, Accession NP_003035.2), a gene which transports betaine and gaba. Accordingly, utilities of GAM3229 include diagnosis, prevention and treatment of diseases and clinical conditions associated with SLC6A12.

The function of SLC6A12 and its association with various diseases and clinical conditions, has been established by previous studies, as described hereinabove with reference to GAM1095.1. Solute carrier family 7 (cationic amino acid transporter, y+ system), member 5 (SLC7A5, Accession NP_003477.3) is another GAM3229 target gene, herein designated TARGET GENE. SLC7A5 BINDING SITE is a target binding site found in the 3' untranslated region of mRNA encoded by SLC7A5, corresponding to a target binding site such as BINDING SITE I, BINDING SITE II or BINDING SITE III of FIG. 8. Table 4 illustrates the complementarity of the nucleotide sequences of SLC7A5 BINDING SITE, designated SEQ ID:15377, to the nucleotide sequence of GAM3229 RNA, herein designated GAM RNA, also designated SEQ ID:221.

Another function of GAM3229 is therefore inhibition of Solute carrier family 7 (cationic amino acid transporter, y+ system), member 5 (SLC7A5, Accession NP_003477.3), a gene which mediates transport of large and small neutral amino acids. Accordingly, utilities of GAM3229 include diagnosis, prevention and treatment of diseases and clinical conditions associated with SLC7A5.

The function of SLC7A5 and its association with various diseases and clinical conditions, has been established by previous studies, as described hereinabove with reference to GAM98.1. SLC9A8 (Accession XP_030524.2) is another GAM3229 target gene, herein designated TARGET GENE. SLC9A8 BINDING SITE is a target binding site found in the 3' untranslated region of mRNA encoded by SLC9A8, corresponding to a target binding site such as BINDING SITE I, BINDING SITE II or BINDING SITE III of FIG. 8. Table 4 illustrates the complementarity of the nucleotide sequences of SLC9A8 BINDING SITE, designated SEQ ID:5218, to the nucleotide sequence of GAM3229 RNA, herein designated GAM RNA, also designated SEQ ID:221.

Another function of GAM3229 is therefore inhibition of SLC9A8 (Accession XP_030524.2). Accordingly, utilities of GAM3229 include diagnosis, prevention and treatment of diseases and clinical conditions associated with SLC9A8.

Swi/snf related, matrix associated, actin dependent regulator of chromatin, subfamily f, member 1 (SMARCF1, Accession NP_060920.4) is another GAM3229 target gene, herein designated TARGET GENE. SMARCF1 BINDING SITE is a target binding site found in the 3' untranslated region of multiple transcripts of mRNA encoded by SMARCF1, corresponding to a target binding site such as BINDING SITE I, BINDING SITE II or BINDING SITE III of FIG. 8. Table 4 illustrates the complementarity of the nucleotide sequences of SMARCF1 BINDING SITE, designated SEQ ID:10764, to the nucleotide sequence of GAM3229 RNA, herein designated GAM RNA, also designated SEQ ID:221.

Another function of GAM3229 is therefore inhibition of Swi/snf related, matrix associated, actin dependent regulator of chromatin, subfamily f, member 1 (SMARCF1, Accession NP_060920.4). Accordingly, utilities of GAM3229 include diagnosis, prevention and treatment of diseases and clinical conditions associated with SMARCF1.

Swi/snf related, matrix associated, actin dependent regulator of chromatin, subfamily f, member 1 (SMARCF1, Accession NP__624361.1) is another GAM3229 target gene, herein designated TARGET GENE. SMARCF1 BINDING SITE is a target binding site found in the 3' untranslated region of multiple transcripts of mRNA encoded by SMARCF1, corresponding to a target binding site such as BINDING SITE I, BINDING SITE II or BINDING SITE III of FIG. 8. Table 4 illustrates the complementarity of the nucleotide sequences of SMARCF1 BINDING SITE, designated SEQ ID:10764, to the nucleotide sequence of GAM3229 RNA, herein designated GAM RNA, also designated SEQ ID:221.

Another function of GAM3229 is therefore inhibition of Swi/snf related, matrix associated, actin dependent regulator of chromatin, subfamily f, member 1 (SMARCF1, Accession NP__624361.1). Accordingly, utilities of GAM3229 include diagnosis, prevention and treatment of diseases and clinical conditions associated with SMARCF1.

Swi/snf related, matrix associated, actin dependent regulator of chromatin, subfamily f, member 1 (SMARCF1, Accession NP__006006.3) is another GAM3229 target gene, herein designated TARGET GENE. SMARCF1 BINDING SITE is a target binding site found in the 3' untranslated region of multiple transcripts of mRNA encoded by SMARCF1, corresponding to a target binding site such as BINDING SITE I, BINDING SITE II or BINDING SITE III of FIG. 8. Table 4 illustrates the complementarity of the nucleotide sequences of SMARCF1 BINDING SITE, designated SEQ ID:10764, to the nucleotide sequence of GAM3229 RNA, herein designated GAM RNA, also designated SEQ ID:221.

Another function of GAM3229 is therefore inhibition of Swi/snf related, matrix associated, actin dependent regulator of chromatin, subfamily f, member 1 (SMARCF1, Accession NP__006006.3). Accordingly, utilities of GAM3229 include diagnosis, prevention and treatment of diseases and clinical conditions associated with SMARCF1.

Synaptosomal-associated protein, 23 kda (SNAP23, Accession NP_003816.2) is another GAM3229 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:15734, to the nucleotide sequence of GAM3229 RNA, herein designated GAM RNA, also designated SEQ ID:221.

Another function of GAM3229 is therefore inhibition of Synaptosomal-associated protein, 23 kda (SNAP23, Accession NP__003816.2), a gene which is essential component of the high affinity receptor for the general membrane fusion machinery. Accordingly, utilities of GAM3229 include diagnosis, prevention and treatment of diseases and clinical conditions associated with SNAP23.

The function of SNAP23 and its association with various diseases and clinical conditions, has been established by previous studies, as described hereinabove with reference to GAM30.1. Synaptosomal-associated protein, 23 kda (SNAP23, Accession NP__570710.1) is another GAM3229 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:15734, to the nucleotide sequence of GAM3229 RNA, herein designated GAM RNA, also designated SEQ ID:221.

Another function of GAM3229 is therefore inhibition of Synaptosomal-associated protein, 23 kda (SNAP23, Accession NP__570710.1), a gene which is essential component of the high affinity receptor for the general membrane fusion machinery. Accordingly, utilities of GAM3229 include diagnosis, prevention and treatment of diseases and clinical conditions associated with SNAP23.

The function of SNAP23 and its association with various diseases and clinical conditions, has been established by previous studies, as described hereinabove with reference to GAM30.1. SNARK (Accession NP__112214.1) is another GAM3229 target gene, herein designated TARGET GENE. SNARK BINDING SITE is a target binding site found in the 3' untranslated region of mRNA encoded by SNARK, corresponding to a target binding site such as BINDING SITE I, BINDING SITE II or BINDING SITE III of FIG. 8. Table 4 illustrates the complementarity of the nucleotide sequences of SNARK BINDING SITE, designated SEQ ID:9680, to the nucleotide sequence of GAM3229 RNA, herein designated GAM RNA, also designated SEQ ID:221.

Another function of GAM3229 is therefore inhibition of SNARK (Accession NP__112214.1). Accordingly, utilities of GAM3229 include diagnosis, prevention and treatment of diseases and clinical conditions associated with SNARK.

Syntrophin, beta 2 (dystrophin-associated protein a1, 59 kda, basic component 2) (SNTB2, Accession NP__006741.1) is another GAM3229 target gene, herein designated TARGET GENE. SNTB2 BINDING SITE is a target binding site found in the 3' untranslated region of multiple transcripts of mRNA encoded by SNTB2, corresponding to a target binding site such as BINDING SITE I, BINDING SITE II or BINDING SITE III of FIG. 8. Table 4 illustrates the complementarity of the nucleotide sequences of SNTB2 BINDING SITE, designated SEQ ID:5203, to the nucleotide sequence of GAM3229 RNA, herein designated GAM RNA, also designated SEQ ID:221.

Another function of GAM3229 is therefore inhibition of Syntrophin, beta 2 (dystrophin-associated protein a1, 59 kda, basic component 2) (SNTB2, Accession NP__006741.1). Accordingly, utilities of GAM3229 include diagnosis, prevention and treatment of diseases and clinical conditions associated with SNTB2.

Syntrophin, beta 2 (dystrophin-associated protein a1, 59 kda, basic component 2) (SNTB2, Accession NP__570896.1) is another GAM3229 target gene, herein designated TARGET GENE. SNTB2 BINDING SITE is a target binding site found in the 3' untranslated region of multiple transcripts of mRNA encoded by SNTB2, corresponding to a target binding site such as BINDING SITE I, BINDING SITE II or BINDING SITE III of FIG. 8. Table 4 illustrates the complementarity of the nucleotide sequences of SNTB2 BINDING SITE, designated SEQ ID:5203, to the nucleotide sequence of GAM3229 RNA, herein designated GAM RNA, also designated SEQ ID:221.

Another function of GAM3229 is therefore inhibition of Syntrophin, beta 2 (dystrophin-associated protein a1, 59 kda, basic component 2) (SNTB2, Accession NP__570896.1). Accordingly, utilities of GAM3229 include diagnosis, prevention and treatment of diseases and clinical conditions associated with SNTB2.

Sorting nexin 15 (SNX15, Accession NP__680086.1) is another GAM3229 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:17861, to the nucleotide sequence of GAM3229 RNA, herein designated GAM RNA, also designated SEQ ID:221.

Another function of GAM3229 is therefore inhibition of Sorting nexin 15 (SNX15, Accession NP_680086.1). Accordingly, utilities of GAM3229 include diagnosis, prevention and treatment of diseases and clinical conditions associated with SNX15.

Sorting nexin 15 (SNX15, Accession NP_037438.2) is another GAM3229 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:17861, to the nucleotide sequence of GAM3229 RNA, herein designated GAM RNA, also designated SEQ ID:221.

Another function of GAM3229 is therefore inhibition of Sorting nexin 15 (SNX15, Accession NP_037438.2). Accordingly, utilities of GAM3229 include diagnosis, prevention and treatment of diseases and clinical conditions associated with SNX15.

SNX22 (Accession NP_079074.1) is another GAM3229 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:10075, to the nucleotide sequence of GAM3229 RNA, herein designated GAM RNA, also designated SEQ ID:221.

Another function of GAM3229 is therefore inhibition of SNX22 (Accession NP_079074.1). Accordingly, utilities of GAM3229 include diagnosis, prevention and treatment of diseases and clinical conditions associated with SNX22.

SNX27 (Accession NP_112180.4) is another GAM3229 target gene, herein designated TARGET GENE. SNX27 BINDING SITE is a target binding site found in the 3' untranslated region of mRNA encoded by SNX27, corresponding to a target binding site such as BINDING SITE I, BINDING SITE II or BINDING SITE III of FIG. 8. Table 4 illustrates the complementarity of the nucleotide sequences of SNX27 BINDING SITE, designated SEQ ID:4464, to the nucleotide sequence of GAM3229 RNA, herein designated GAM RNA, also designated SEQ ID:221.

Another function of GAM3229 is therefore inhibition of SNX27 (Accession NP_112180.4). Accordingly, utilities of GAM3229 include diagnosis, prevention and treatment of diseases and clinical conditions associated with SNX27.

Sp110 nuclear body protein (SP110, Accession NP_536349.1) is another GAM3229 target gene, herein designated TARGET GENE. SP110 BINDING SITE is a target binding site found in the 3' untranslated region of multiple transcripts of mRNA encoded by SP110, corresponding to a target binding site such as BINDING SITE I, BINDING SITE II or BINDING SITE III of FIG. 8. Table 4 illustrates the complementarity of the nucleotide sequences of SP110 BINDING SITE, designated SEQ ID:11431, to the nucleotide sequence of GAM3229 RNA, herein designated GAM RNA, also designated SEQ ID:221.

Another function of GAM3229 is therefore inhibition of Sp110 nuclear body protein (SP110, Accession NP_536349.1), a gene which is involved in transduction of interferon action. Accordingly, utilities of GAM3229 include diagnosis, prevention and treatment of diseases and clinical conditions associated with SP110.

The function of SP110 and its association with various diseases and clinical conditions, has been established by previous studies, as described hereinabove with reference to GAM223.2. Sp110 nuclear body protein (SP110, Accession NP_004500.2) is another GAM3229 target gene, herein designated TARGET GENE. SP110 BINDING SITE is a target binding site found in the 3' untranslated region of multiple transcripts of mRNA encoded by SP110, corresponding to a target binding site such as BINDING SITE I, BINDING SITE II or BINDING SITE III of FIG. 8. Table 4 illustrates the complementarity of the nucleotide sequences of SP110 BINDING SITE, designated SEQ ID:11431, to the nucleotide sequence of GAM3229 RNA, herein designated GAM RNA, also designated SEQ ID:221.

Another function of GAM3229 is therefore inhibition of Sp110 nuclear body protein (SP110, Accession NP_004500.2), a gene which is involved in transduction of interferon action. Accordingly, utilities of GAM3229 include diagnosis, prevention and treatment of diseases and clinical conditions associated with SP110.

The function of SP110 and its association with various diseases and clinical conditions, has been established by previous studies, as described hereinabove with reference to GAM223.2. SPCX (Accession NP_775260.1) is another GAM3229 target gene, herein designated TARGET GENE. SPCX BINDING SITE is a target binding site found in the 5' untranslated region of mRNA encoded by SPCX, corresponding to a target binding site such as BINDING SITE I, BINDING SITE II or BINDING SITE III of FIG. 8. Table 4 illustrates the complementarity of the nucleotide sequences of SPCX BINDING SITE, designated SEQ ID:6614, to the nucleotide sequence of GAM3229 RNA, herein designated GAM RNA, also designated SEQ ID:221.

Another function of GAM3229 is therefore inhibition of SPCX (Accession NP_775260.1). Accordingly, utilities of GAM3229 include diagnosis, prevention and treatment of diseases and clinical conditions associated with SPCX.

Synovial sarcoma translocation, chromosome 18 (SS18, Accession NP_005628.1) is another GAM3229 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:10286, to the nucleotide sequence of GAM3229 RNA, herein designated GAM RNA, also designated SEQ ID:221.

Another function of GAM3229 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM3229 include diagnosis, prevention and treatment of Human synovial sarcomas, and of other diseases and clinical conditions associated with SS18.

The function of SS18 and its association with various diseases and clinical conditions, has been established by previous studies, as described hereinabove with reference to GAM130.1. Taf11 rna polymerase ii, tata box binding protein (tbp)-associated factor, 28 kda (TAF11, Accession NP_005634.1) is another GAM3229 target gene, herein designated TARGET GENE. TAF11 BINDING SITE1 and TAF11 BINDING SITE2 are target binding sites found in untranslated regions of mRNA encoded by TAF11, corresponding to target binding sites such as BINDING SITE I, BINDING SITE II or BINDING SITE III of FIG. 8. Table 4 illustrates the complementarity of the nucleotide sequences of TAF11 BINDING SITE1 and TAF11 BINDING SITE2, designated SEQ ID:16874 and SEQ ID:5021 respectively, to the nucleotide sequence of GAM3229 RNA, herein designated GAM RNA, also designated SEQ ID:221.

Another function of GAM3229 is therefore inhibition of Taf11 rna polymerase ii, tata box binding protein (tbp)-associated factor, 28 kda (TAF11, Accession NP_005634.1), a gene which plays a central role in mediating promoter responses to various activators and repressors. Accordingly, utilities of GAM3229 include diagnosis, prevention and treatment of diseases and clinical conditions associated with TAF11.

The function of TAF11 and its association with various diseases and clinical conditions, has been established by previous studies, as described hereinabove with reference to GAM130.1. T-cell acute lymphocytic leukemia 1 (TAL1, Accession NP_003180.1) is another GAM3229 target gene, herein designated TARGET GENE. TAL1 BINDING SITE1 and TAL1 BINDING SITE2 are target binding sites found in untranslated regions of mRNA encoded by TAL1, corresponding to target binding sites such as BINDING SITE I, BINDING SITE II or BINDING SITE III of FIG. 8. Table 4 illustrates the complementarity of the nucleotide sequences of TAL1 BINDING SITE1 and TAL1 BINDING SITE2, designated SEQ ID:5904 and SEQ ID:3829 respectively, to the nucleotide sequence of GAM3229 RNA, herein designated GAM RNA, also designated SEQ ID:221.

Another function of GAM3229 is therefore inhibition of T-cell acute lymphocytic leukemia 1 (TAL1, Accession NP_003180.1), a gene which may help control cell growth and differentiation. Accordingly, utilities of GAM3229 include diagnosis, prevention and treatment of diseases and clinical conditions associated with TAL1.

The function of TAL1 and its association with various diseases and clinical conditions, has been established by previous studies, as described hereinabove with reference to GAM30.1. Tap binding protein (tapasin) (TAPBP, Accession NP_003181.3) is another GAM3229 target gene, herein designated TARGET GENE. TAPBP BINDING SITE1 and TAPBP BINDING SITE2 are target binding sites found in untranslated regions of multiple transcripts of mRNA encoded by TAPBP, corresponding to target binding sites such as BINDING SITE I, BINDING SITE II or BINDING SITE III of FIG. 8. Table 4 illustrates the complementarity of the nucleotide sequences of TAPBP BINDING SITE1 and TAPBP BINDING SITE2, designated SEQ ID:9729 and SEQ ID:12850 respectively, to the nucleotide sequence of GAM3229 RNA, herein designated GAM RNA, also designated SEQ ID:221.

Another function of GAM3229 is therefore inhibition of Tap binding protein (tapasin) (TAPBP, Accession NP_003181.3), a gene which is involved in MHC class I-restricted antigen processing. Accordingly, utilities of GAM3229 include diagnosis, prevention and treatment of diseases and clinical conditions associated with TAPBP.

The function of TAPBP and its association with various diseases and clinical conditions, has been established by previous studies, as described hereinabove with reference to GAM136.1. Tea domain family member 3 (TEAD3, Accession NP_003205.1) is another GAM3229 target gene, herein designated TARGET GENE. TEAD3 BINDING SITE is a target binding site found in the 3' untranslated region of mRNA encoded by TEAD3, corresponding to a target binding site such as BINDING SITE I, BINDING SITE II or BINDING SITE III of FIG. 8. Table 4 illustrates the complementarity of the nucleotide sequences of TEAD3 BINDING SITE, designated SEQ ID:11870, to the nucleotide sequence of GAM3229 RNA, herein designated GAM RNA, also designated SEQ ID:221.

Another function of GAM3229 is therefore inhibition of Tea domain family member 3 (TEAD3, Accession NP_003205.1), a gene which binds to multiple functional elements of the human chorionic somatomammotropin-b gene enhancer. Accordingly, utilities of GAM3229 include diagnosis, prevention and treatment of diseases and clinical conditions associated with TEAD3.

The function of TEAD3 and its association with various diseases and clinical conditions, has been established by previous studies, as described hereinabove with reference to GAM497.1. Testis derived transcript (3 lim domains) (TES, Accession NP_690042.1) is another GAM3229 target gene, herein designated TARGET GENE. TES BINDING SITE is a target binding site found in the 3' untranslated region of multiple transcripts of mRNA encoded by TES, corresponding to a target binding site such as BINDING SITE I, BINDING SITE II or BINDING SITE III of FIG. 8. Table 4 illustrates the complementarity of the nucleotide sequences of TES BINDING SITE, designated SEQ ID:16668, to the nucleotide sequence of GAM3229 RNA, herein designated GAM RNA, also designated SEQ ID:221.

Another function of GAM3229 is therefore inhibition of Testis derived transcript (3 lim domains) (TES, Accession NP_690042.1), a gene which acts as a tumor suppressor and therefore may be associated with Ovarian carcinomas, breast cancer. Accordingly, utilities of GAM3229 include diagnosis, prevention and treatment of Ovarian carcinomas, breast cancer, and of other diseases and clinical conditions associated with TES.

The function of TES and its association with various diseases and clinical conditions, has been established by previous studies, as described hereinabove with reference to GAM72.1. Testis derived transcript (3 lim domains) (TES, Accession NP_056456.1) is another GAM3229 target gene, herein designated TARGET GENE. TES BINDING SITE is a target binding site found in the 3' untranslated region of multiple transcripts of mRNA encoded by TES, corresponding to a target binding site such as BINDING SITE I, BINDING SITE II or BINDING SITE III of FIG. 8. Table 4 illustrates the complementarity of the nucleotide sequences of TES BINDING SITE, designated SEQ ID:16668, to the nucleotide sequence of GAM3229 RNA, herein designated GAM RNA, also designated SEQ ID:221.

Another function of GAM3229 is therefore inhibition of Testis derived transcript (3 lim domains) (TES, Accession NP_056456.1), a gene which acts as a tumor suppressor and therefore may be associated with Ovarian carcinomas, breast cancer. Accordingly, utilities of GAM3229 include diagnosis, prevention and treatment of Ovarian carcinomas, breast cancer, and of other diseases and clinical conditions associated with TES.

The function of TES and its association with various diseases and clinical conditions, has been established by previous studies, as described hereinabove with reference to GAM72.1. Transforming growth factor, beta-induced, 68 kda (TGFBI, Accession NP_000349.1) is another GAM3229 target gene, herein designated TARGET GENE. TGFBI BINDING SITE is a target binding site found in the 3' untranslated region of mRNA encoded by TGFBI, corresponding to a target binding site such as BINDING SITE I, BINDING SITE II or BINDING SITE III of FIG. 8. Table 4 illustrates the complementarity of the nucleotide sequences of TGFBI BINDING SITE, designated SEQ ID:15372, to the nucleotide sequence of GAM3229 RNA, herein designated GAM RNA, also designated SEQ ID:221.

Another function of GAM3229 is therefore inhibition of Transforming growth factor, beta-induced, 68 kda (TGFBI, Accession NP_000349.1). Accordingly, utilities of GAM3229 include diagnosis, prevention and treatment of diseases and clinical conditions associated with TGFBI.

Tgfb-induced factor 2 (tale family homeobox) (TGIF2, Accession NP_068581.1) is another GAM3229 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:18631, to the nucleotide sequence of GAM3229 RNA, herein designated GAM RNA, also designated SEQ ID:221.

Another function of GAM3229 is therefore inhibition of Tgfb-induced factor 2 (tale family homeobox) (TGIF2, Accession NP_068581.1). Accordingly, utilities of GAM3229 include diagnosis, prevention and treatment of diseases and clinical conditions associated with TGIF2.

TIM50L (Accession XP_053074.2) is another GAM3229 target gene, herein designated TARGET GENE. TIM50L BINDING SITE is a target binding site found in the 3' untranslated region of mRNA encoded by TIM50L, corresponding to a target binding site such as BINDING SITE I, BINDING SITE II or BINDING SITE III of FIG. 8. Table 4 illustrates the complementarity of the nucleotide sequences of TIM50L BINDING SITE, designated SEQ ID:5198, to the nucleotide sequence of GAM3229 RNA, herein designated GAM RNA, also designated SEQ ID:221.

Another function of GAM3229 is therefore inhibition of TIM50L (Accession XP_053074.2). Accordingly, utilities of GAM3229 include diagnosis, prevention and treatment of diseases and clinical conditions associated with TIM50L.

Tissue inhibitor of metalloproteinase 3 (sorsby fundus dystrophy, pseudoinflammatory) (TIMP3, Accession NP_000353.1) is another GAM3229 target gene, herein designated TARGET GENE. TIMP3 BINDING SITE is a target binding site found in the 3' untranslated region of mRNA encoded by TIMP3, corresponding to a target binding site such as BINDING SITE I, BINDING SITE II or BINDING SITE III of FIG. 8. Table 4 illustrates the complementarity of the nucleotide sequences of TIMP3 BINDING SITE, designated SEQ ID:10513, to the nucleotide sequence of GAM3229 RNA, herein designated GAM RNA, also designated SEQ ID:221.

Another function of GAM3229 is therefore inhibition of Tissue inhibitor of metalloproteinase 3 (sorsby fundus dystrophy, pseudoinflammatory) (TIMP3, Accession NP_000353.1). Accordingly, utilities of GAM3229 include diagnosis, prevention and treatment of diseases and clinical conditions associated with TIMP3.

Tumor necrosis factor receptor superfamily, member 10b (TNFRSF10B, Accession NP_003833.3) is another GAM3229 target gene, herein designated TARGET GENE. TNFRSF10B BINDING SITE1 and TNFRSF10B BINDING SITE2 are target binding sites found in untranslated regions of multiple transcripts of mRNA encoded by TNFRSF10B, corresponding to target binding sites such as BINDING SITE I, BINDING SITE II or BINDING SITE III of FIG. 8. Table 4 illustrates the complementarity of the nucleotide sequences of TNFRSF10B BINDING SITE1 and TNFRSF10B BINDING SITE2, designated SEQ ID:2703 and SEQ ID:2055 respectively, to the nucleotide sequence of GAM3229 RNA, herein designated GAM RNA, also designated SEQ ID:221.

Another function of GAM3229 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM3229 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 10b (TNFRSF10B, Accession NP_671716.1) is another GAM3229 target gene, herein designated TARGET GENE. TNFRSF10B BINDING SITE1 and TNFRSF10B BINDING SITE2 are target binding sites found in untranslated regions of multiple transcripts of mRNA encoded by TNFRSF10B, corresponding to target binding sites such as BINDING SITE I, BINDING SITE II or BINDING SITE III of FIG. 8. Table 4 illustrates the complementarity of the nucleotide sequences of TNFRSF10B BINDING SITE1 and TNFRSF10B BINDING SITE2, designated SEQ ID:2055 and SEQ ID:2703 respectively, to the nucleotide sequence of GAM3229 RNA, herein designated GAM RNA, also designated SEQ ID:221.

Another function of GAM3229 is therefore inhibition of Tumor necrosis factor receptor superfamily, member 10b (TNFRSF10B, Accession NP_671716.1), a gene which forms complex that induces apoptosis. and therefore may be associated with Squamous cell carcinoma. Accordingly, utilities of GAM3229 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 11a, activator of nfkb (TNFRSF11A, Accession NP_003830.1) is another GAM3229 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:18341, to the nucleotide sequence of GAM3229 RNA, herein designated GAM RNA, also designated SEQ ID:221.

Another function of GAM3229 is therefore inhibition of Tumor necrosis factor receptor superfamily, member 11a, activator of nfkb (TNFRSF11A, Accession NP_003830.1). Accordingly, utilities of GAM3229 include diagnosis, prevention and treatment of diseases and clinical conditions associated with TNFRSF11A.

TP53I5 (Accession XP_290532.2) is another GAM3229 target gene, herein designated TARGET GENE. TP53I5 BINDING SITE is a target binding site found in the 5' untranslated region of mRNA encoded by TP53I5, corresponding to a target binding site such as BINDING SITE I, BINDING SITE II or BINDING SITE III of FIG. 8. Table 4 illustrates the complementarity of the nucleotide sequences of TP53I5 BINDING SITE, designated SEQ ID:11115, to the nucleotide sequence of GAM3229 RNA, herein designated GAM RNA, also designated SEQ ID:221.

Another function of GAM3229 is therefore inhibition of TP53I5 (Accession XP_290532.2). Accordingly, utilities of GAM3229 include diagnosis, prevention and treatment of diseases and clinical conditions associated with TP53I5.

Thiopurine s-methyltransferase (TPMT, Accession NP_000358.1) is another GAM3229 target gene, herein designated TARGET GENE. TPMT BINDING SITE is a target binding site found in the 3' untranslated region of mRNA encoded by TPMT, corresponding to a target binding site such as BINDING SITE I, BINDING SITE II or BINDING SITE III of FIG. 8. Table 4 illustrates the complementarity of the nucleotide sequences of TPMT BINDING SITE, designated SEQ ID:8393, to the nucleotide sequence of GAM3229 RNA, herein designated GAM RNA, also designated SEQ ID:221.

Another function of GAM3229 is therefore inhibition of Thiopurine s-methyltransferase (TPMT, Accession NP_000358.1), a gene which catalyzes the s-methylation of thiopurine drugs such as 6-mercaptopurine. and therefore may be associated with Thiopurine s-methyltransferase polymorphism. Accordingly, utilities of GAM3229 include diagnosis, prevention and treatment of Thiopurine s-methyltransferase polymorphism, and of other diseases and clinical conditions associated with TPMT.

The function of TPMT and its association with various diseases and clinical conditions, has been established by previous studies, as described hereinabove with reference to GAM130.1. Tryptase gamma 1 (TPSG1, Accession NP_036599.1) is another GAM3229 target gene, herein designated TARGET GENE. TPSG1 BINDING SITE is a target binding site found in the 5' untranslated region of mRNA encoded by TPSG1, corresponding to a target binding site such as BINDING SITE I, BINDING SITE II or BINDING SITE III of FIG. 8. Table 4 illustrates the complementarity of the nucleotide sequences of TPSG1 BINDING SITE, designated SEQ ID:10281, to the nucleotide sequence of GAM3229 RNA, herein designated GAM RNA, also designated SEQ ID:221.

Another function of GAM3229 is therefore inhibition of Tryptase gamma 1 (TPSG1, Accession NP_036599.1). Accordingly, utilities of GAM3229 include diagnosis, prevention and treatment of diseases and clinical conditions associated with TPSG1.

TRAM2 (Accession NP_036420.1) is another GAM3229 target gene, herein designated TARGET GENE. TRAM2 BINDING SITE is a target binding site found in the 3' untranslated region of mRNA encoded by TRAM2, corresponding to a target binding site such as BINDING SITE I, BINDING SITE II or BINDING SITE III of FIG. 8. Table 4 illustrates the complementarity of the nucleotide sequences of TRAM2 BINDING SITE, designated SEQ ID:14318, to the nucleotide sequence of GAM3229 RNA, herein designated GAM RNA, also designated SEQ ID:221.

Another function of GAM3229 is therefore inhibition of TRAM2 (Accession NP_036420.1). Accordingly, utilities of GAM3229 include diagnosis, prevention and treatment of diseases and clinical conditions associated with TRAM2.

Tripartite motif-containing 16 (TRIM16, Accession NP_006461.2) is another GAM3229 target gene, herein designated TARGET GENE. TRIM16 BINDING SITE is a target binding site found in the 3' untranslated region of mRNA encoded by TRIM16, corresponding to a target binding site such as BINDING SITE I, BINDING SITE II or BINDING SITE III of FIG. 8. Table 4 illustrates the complementarity of the nucleotide sequences of TRIM16 BINDING SITE, designated SEQ ID:14800, to the nucleotide sequence of GAM3229 RNA, herein designated GAM RNA, also designated SEQ ID:221.

Another function of GAM3229 is therefore inhibition of Tripartite motif-containing 16 (TRIM16, Accession NP_006461.2). Accordingly, utilities of GAM3229 include diagnosis, prevention and treatment of diseases and clinical conditions associated with TRIM16.

Tripartite motif-containing 5 (TRIM5, Accession NP_149023.1) is another GAM3229 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:11399, to the nucleotide sequence of GAM3229 RNA, herein designated GAM RNA, also designated SEQ ID:221.

Another function of GAM3229 is therefore inhibition of Tripartite motif-containing 5 (TRIM5, Accession NP_149023.1). Accordingly, utilities of GAM3229 include diagnosis, prevention and treatment of diseases and clinical conditions associated with TRIM5.

Transient receptor potential cation channel, subfamily v, member 1 (TRPV1, Accession NP_542435.1) is another GAM3229 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:14539 and SEQ ID:3431 respectively, to the nucleotide sequence of GAM3229 RNA, herein designated GAM RNA, also designated SEQ ID:221.

Another function of GAM3229 is therefore inhibition of Transient receptor potential cation channel, subfamily v, member 1 (TRPV1, Accession NP_542435.1), a gene which functions as a receptor for capsaicin. Accordingly, utilities of GAM3229 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_061197.3) is another GAM3229 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:14539 and SEQ ID:3431 respectively, to the nucleotide sequence of GAM3229 RNA, herein designated GAM RNA, also designated SEQ ID:221.

Another function of GAM3229 is therefore inhibition of Transient receptor potential cation channel, subfamily v, member 1 (TRPV1, Accession NP_061197.3), a gene which functions as a receptor for capsaicin. Accordingly, utilities of GAM3229 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542436.1) is another GAM3229 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:14539 and SEQ ID:14539 respectively, to the nucleotide sequence of GAM3229 RNA, herein designated GAM RNA, also designated SEQ ID:221.

Another function of GAM3229 is therefore inhibition of Transient receptor potential cation channel, subfamily v, member 1 (TRPV1, Accession NP_542436.1), a gene which functions as a receptor for capsaicin. Accordingly, utilities of GAM3229 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542436.1) is another GAM3229 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:3431 and SEQ ID:3431 respectively, to the nucleotide sequence of GAM3229 RNA, herein designated GAM RNA, also designated SEQ ID:221.

Another function of GAM3229 is therefore inhibition of Transient receptor potential cation channel, subfamily v, member 1 (TRPV1, Accession NP_542436.1), a gene which functions as a receptor for capsaicin. Accordingly, utilities of GAM3229 include diagnosis, prevention and treatment of diseases and clinical conditions associated with TRPV1.

The function of TRPV1 and its association with various diseases and clinical conditions, has been established by previous studies, as described hereinabove with reference to GAM130.1. TU12B1-TY (Accession NP_057659.1) is another GAM3229 target gene, herein designated TARGET GENE. TU12B1-TY BINDING SITE1 through TU12B1-TY BINDING SITE3 are target binding sites found in untranslated regions of mRNA encoded by TU12B1-TY, corresponding to target binding sites such as BINDING SITE I, BINDING SITE II or BINDING SITE III of FIG. 8. Table 4 illustrates the complementarity of the nucleotide sequences of TU12B1-TY BINDING SITE1 through TU12B1-TY BINDING SITE3, designated SEQ ID:1925, SEQ ID:3770 and SEQ ID:11645 respectively, to the nucleotide sequence of GAM3229 RNA, herein designated GAM RNA, also designated SEQ ID:221.

Another function of GAM3229 is therefore inhibition of TU12B1-TY (Accession NP_057659.1). Accordingly, utilities of GAM3229 include diagnosis, prevention and treatment of diseases and clinical conditions associated with TU12B1-TY.

TUCAN (Accession NP_055774.1) is another GAM3229 target gene, herein designated TARGET GENE. TUCAN BINDING SITE is a target binding site found in the 3' untranslated region of mRNA encoded by TUCAN, corresponding to a target binding site such as BINDING SITE I, BINDING SITE II or BINDING SITE III of FIG. 8. Table 4 illustrates the complementarity of the nucleotide sequences of TUCAN BINDING SITE, designated SEQ ID:16766, to the nucleotide sequence of GAM3229 RNA, herein designated GAM RNA, also designated SEQ ID:221.

Another function of GAM3229 is therefore inhibition of TUCAN (Accession NP_055774.1). Accordingly, utilities of GAM3229 include diagnosis, prevention and treatment of diseases and clinical conditions associated with TUCAN.

Tuftelin 1 (TUFT1, Accession NP_064512.1) is another GAM3229 target gene, herein designated TARGET GENE. TUFT1 BINDING SITE is a target binding site found in the 3' untranslated region of mRNA encoded by TUFT1, corresponding to a target binding site such as BINDING SITE I, BINDING SITE II or BINDING SITE III of FIG. 8. Table 4 illustrates the complementarity of the nucleotide sequences of TUFT1 BINDING SITE, designated SEQ ID:5345, to the nucleotide sequence of GAM3229 RNA, herein designated GAM RNA, also designated SEQ ID:221.

Another function of GAM3229 is therefore inhibition of Tuftelin 1 (TUFT1, Accession NP_064512.1), a gene which appears to play a role in cytokinesis, cell shape, and specialized functions such as secretion and capping. Accordingly, utilities of GAM3229 include diagnosis, prevention and treatment of diseases and clinical conditions associated with TUFT1.

The function of TUFT1 and its association with various diseases and clinical conditions, has been established by previous studies, as described hereinabove with reference to GAM136.1. TUWD12 (Accession NP_758440.1) is another GAM3229 target gene, herein designated TARGET GENE. TUWD12 BINDING SITE is a target binding site found in the 3' untranslated region of mRNA encoded by TUWD12, corresponding to a target binding site such as BINDING SITE I, BINDING SITE II or BINDING SITE III of FIG. 8. Table 4 illustrates the complementarity of the nucleotide sequences of TUWD12 BINDING SITE, designated SEQ ID:9384, to the nucleotide sequence of GAM3229 RNA, herein designated GAM RNA, also designated SEQ ID:221.

Another function of GAM3229 is therefore inhibition of TUWD12 (Accession NP_758440.1). Accordingly, utilities of GAM3229 include diagnosis, prevention and treatment of diseases and clinical conditions associated with TUWD12.

TXL-2 (Accession NP_835231.1) is another GAM3229 target gene, herein designated TARGET GENE. TXL-2 BINDING SITE is a target binding site found in the 3' untranslated region of mRNA encoded by TXL-2, corresponding to a target binding site such as BINDING SITE I, BINDING SITE II or BINDING SITE III of FIG. 8. Table 4 illustrates the complementarity of the nucleotide sequences of TXL-2 BINDING SITE, designated SEQ ID:15613, to the nucleotide sequence of GAM3229 RNA, herein designated GAM RNA, also designated SEQ ID:221.

Another function of GAM3229 is therefore inhibition of TXL-2 (Accession NP_835231.1). Accordingly, utilities of GAM3229 include diagnosis, prevention and treatment of diseases and clinical conditions associated with TXL-2.

UBF-fl (Accession NP_116217.1) is another GAM3229 target gene, herein designated TARGET GENE. UBF-fl BINDING SITE is a target binding site found in the 3' untranslated region of mRNA encoded by UBF-fl, corresponding to a target binding site such as BINDING SITE I, BINDING SITE II or BINDING SITE III of FIG. 8. Table 4 illustrates the complementarity of the nucleotide sequences of UBF-fl BINDING SITE, designated SEQ ID:12691, to the nucleotide sequence of GAM3229 RNA, herein designated GAM RNA, also designated SEQ ID:221.

Another function of GAM3229 is therefore inhibition of UBF-fl (Accession NP_116217.1). Accordingly, utilities of GAM3229 include diagnosis, prevention and treatment of diseases and clinical conditions associated with UBF-fl.

Uridine monophosphate synthetase (orotate phosphoribosyl transferase and orotidine-5'-decarboxylase) (UMPS, Accession NP_000364.1) is another GAM3229 target gene, herein designated TARGET GENE. UMPS BINDING SITE is a target binding site found in the 3' untranslated region of mRNA encoded by UMPS, corresponding to a target binding site such as BINDING SITE I, BINDING SITE II or BINDING SITE III of FIG. 8. Table 4 illustrates the complementarity of the nucleotide sequences of UMPS BINDING SITE, designated SEQ ID:14691, to the nucleotide sequence of GAM3229 RNA, herein designated GAM RNA, also designated SEQ ID:221.

Another function of GAM3229 is therefore inhibition of Uridine monophosphate synthetase (orotate phosphoribosyl transferase and orotidine-5'-decarboxylase) (UMPS, Accession NP_000364.1). Accordingly, utilities of GAM3229 include diagnosis, prevention and treatment of diseases and clinical conditions associated with UMPS.

Ubiquitin specific protease 22 (USP22, Accession XP_042698.2) is another GAM3229 target gene, herein designated TARGET GENE. USP22 BINDING SITE1 and USP22 BINDING SITE2 are target binding sites found in untranslated regions of mRNA encoded by USP22, corresponding to target binding sites such as BINDING SITE I, BINDING SITE II or BINDING SITE III of FIG. 8. Table 4 illustrates the complementarity of the nucleotide sequences of USP22 BINDING SITE1 and USP22 BINDING SITE2, designated SEQ ID:14801 and SEQ ID:1601 respectively, to the nucleotide sequence of GAM3229 RNA, herein designated GAM RNA, also designated SEQ ID:221.

Another function of GAM3229 is therefore inhibition of Ubiquitin specific protease 22 (USP22, Accession XP_042698.2). Accordingly, utilities of GAM3229 include diagnosis, prevention and treatment of diseases and clinical conditions associated with USP22.

VDU1 (Accession NP_055832.2) is another GAM3229 target gene, herein designated TARGET GENE. VDU1 BINDING SITE is a target binding site found in the 3' untranslated region of mRNA encoded by VDU1, corresponding to a target binding site such as BINDING SITE I, BINDING SITE II or BINDING SITE III of FIG. 8. Table 4 illustrates the complementarity of the nucleotide sequences of VDU1 BINDING SITE, designated SEQ ID:10537, to the nucleotide sequence of GAM3229 RNA, herein designated GAM RNA, also designated SEQ ID:221.

Another function of GAM3229 is therefore inhibition of VDU1 (Accession NP_055832.2). Accordingly, utilities of GAM3229 include diagnosis, prevention and treatment of diseases and clinical conditions associated with VDU1.

Vent-like homeobox 2 (VENTX2, Accession NP_055283.1) is another GAM3229 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:19528, to the nucleotide sequence of GAM3229 RNA, herein designated GAM RNA, also designated SEQ ID:221.

Another function of GAM3229 is therefore inhibition of Vent-like homeobox 2 (VENTX2, Accession NP_055283.1). Accordingly, utilities of GAM3229 include diagnosis, prevention and treatment of diseases and clinical conditions associated with VENTX2.

Von hippel-lindau syndrome (VHL, Accession NP_000542.1) is another GAM3229 target gene, herein designated TARGET GENE. VHL BINDING SITE is a target binding site found in the 3' untranslated region of mRNA encoded by VHL, corresponding to a target binding site such as BINDING SITE I, BINDING SITE II or BINDING SITE III of FIG. 8. Table 4 illustrates the complementarity of the nucleotide sequences of VHL BINDING SITE, designated SEQ ID:8629, to the nucleotide sequence of GAM3229 RNA, herein designated GAM RNA, also designated SEQ ID:221.

Another function of GAM3229 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM3229 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. VIK (Accession NP_612503.1) is another GAM3229 target gene, herein designated TARGET GENE. VIK BINDING SITE is a target binding site found in the 3' untranslated region of multiple transcripts of mRNA encoded by VIK, corresponding to a target binding site such as BINDING SITE I, BINDING SITE II or BINDING SITE III of FIG. 8. Table 4 illustrates the complementarity of the nucleotide sequences of VIK BINDING SITE, designated SEQ ID:3535, to the nucleotide sequence of GAM3229 RNA, herein designated GAM RNA, also designated SEQ ID:221.

Another function of GAM3229 is therefore inhibition of VIK (Accession NP_612503.1). Accordingly, utilities of GAM3229 include diagnosis, prevention and treatment of diseases and clinical conditions associated with VIK.

Vesicular membrane protein p24 (VMP, Accession NP_542454.2) is another GAM3229 target gene, herein designated TARGET GENE. VMP BINDING SITE is a target binding site found in the 3' untranslated region of mRNA encoded by VMP, corresponding to a target binding site such as BINDING SITE I, BINDING SITE II or BINDING SITE III of FIG. 8. Table 4 illustrates the complementarity of the nucleotide sequences of VMP BINDING SITE, designated SEQ ID:5123, to the nucleotide sequence of GAM3229 RNA, herein designated GAM RNA, also designated SEQ ID:221.

Another function of GAM3229 is therefore inhibition of Vesicular membrane protein p24 (VMP, Accession NP_542454.2). Accordingly, utilities of GAM3229 include diagnosis, prevention and treatment of diseases and clinical conditions associated with VMP.

Vanin 1 (VNN1, Accession NP_004657.1) is another GAM3229 target gene, herein designated TARGET GENE. VNN1 BINDING SITE is a target binding site found in the 3' untranslated region of mRNA encoded by VNN1, corresponding to a target binding site such as BINDING SITE I, BINDING SITE II or BINDING SITE III of FIG. 8. Table 4 illustrates the complementarity of the nucleotide sequences of VNN1 BINDING SITE, designated SEQ ID:16216, to the nucleotide sequence of GAM3229 RNA, herein designated GAM RNA, also designated SEQ ID:221.

Another function of GAM3229 is therefore inhibition of Vanin 1 (VNN1, Accession NP_004657.1), a gene which may regulate steps in thymus homing and play a role in mammalian sexual development. Accordingly, utilities of GAM3229 include diagnosis, prevention and treatment of diseases and clinical conditions associated with VNN1.

The function of VNN1 and its association with various diseases and clinical conditions, has been established by previous studies, as described hereinabove with reference to GAM65.1. Vacuolar protein sorting 33a (yeast) (VPS33A, Accession NP_075067.2) is another GAM3229 target gene, herein designated TARGET GENE. VPS33A BINDING SITE is a target binding site found in the 3' untranslated region of mRNA encoded by VPS33A, corresponding to a target binding site such as BINDING SITE I, BINDING SITE II or BINDING SITE III of FIG. 8. Table 4 illustrates the complementarity of the nucleotide sequences of VPS33A BINDING SITE, designated SEQ ID:12847, to the nucleotide sequence of GAM3229 RNA, herein designated GAM RNA, also designated SEQ ID:221.

Another function of GAM3229 is therefore inhibition of Vacuolar protein sorting 33a (yeast) (VPS33A, Accession NP_075067.2). Accordingly, utilities of GAM3229 include diagnosis, prevention and treatment of diseases and clinical conditions associated with VPS33A.

WBP3 (Accession NP_783863.2) is another GAM3229 target gene, herein designated TARGET GENE. WBP3 BINDING SITE is a target binding site found in the 3' untranslated region of mRNA encoded by WBP3, corresponding to a target binding site such as BINDING SITE I, BINDING SITE II or BINDING SITE III of FIG. 8. Table 4 illustrates the complementarity of the nucleotide sequences of WBP3 BINDING SITE, designated SEQ ID:13231, to the nucleotide sequence of GAM3229 RNA, herein designated GAM RNA, also designated SEQ ID:221.

Another function of GAM3229 is therefore inhibition of WBP3 (Accession NP_783863.2). Accordingly, utilities of GAM3229 include diagnosis, prevention and treatment of diseases and clinical conditions associated with WBP3.

Williams-beuren syndrome chromosome region 23 (WBSCR23, Accession NP_079318.1) is another GAM3229 target gene, herein designated TARGET GENE. WBSCR23 BINDING SITE is a target binding site found in the 3' untranslated region of mRNA encoded by WBSCR23, corresponding to a target binding site such as BINDING SITE I, BINDING SITE II or BINDING SITE III of FIG. 8. Table 4 illustrates the complementarity of the nucleotide sequences of WBSCR23 BINDING SITE, designated SEQ ID:4757, to the nucleotide sequence of GAM3229 RNA, herein designated GAM RNA, also designated SEQ ID:221.

Another function of GAM3229 is therefore inhibition of Williams-beuren syndrome chromosome region 23 (WBSCR23, Accession NP_079318.1). Accordingly, utilities of GAM3229 include diagnosis, prevention and treatment of diseases and clinical conditions associated with WBSCR23.

WDFY3 (Accession NP_848700.1) is another GAM3229 target gene, herein designated TARGET GENE. WDFY3 BINDING SITE is a target binding site found in the 5' untranslated region of multiple transcripts of mRNA encoded by WDFY3, corresponding to a target binding site such as BINDING SITE I, BINDING SITE II or BINDING SITE III of FIG. 8. Table 4 illustrates the complementarity of the nucleotide sequences of WDFY3 BINDING SITE, designated SEQ ID:18416, to the nucleotide sequence of GAM3229 RNA, herein designated GAM RNA, also designated SEQ ID:221.

Another function of GAM3229 is therefore inhibition of WDFY3 (Accession NP_848700.1). Accordingly, utilities of GAM3229 include diagnosis, prevention and treatment of diseases and clinical conditions associated with WDFY3.

WFDC8 (Accession NP_852611.1) is another GAM3229 target gene, herein designated TARGET GENE. WFDC8 BINDING SITE is a target binding site found in the 3' untranslated region of multiple transcripts of mRNA encoded by WFDC8, corresponding to a target binding site such as BINDING SITE I, BINDING SITE II or BINDING SITE III of FIG. 8. Table 4 illustrates the complementarity of the nucleotide sequences of WFDC8 BINDING SITE, designated SEQ ID:15411, to the nucleotide sequence of GAM3229 RNA, herein designated GAM RNA, also designated SEQ ID:221.

Another function of GAM3229 is therefore inhibition of WFDC8 (Accession NP_852611.1). Accordingly, utilities of GAM3229 include diagnosis, prevention and treatment of diseases and clinical conditions associated with WFDC8.

Wolf-hirschhorn syndrome candidate 1 (WHSC1, Accession NP_055734.1) is another GAM3229 target gene, herein designated TARGET GENE. WHSC1 BINDING SITE1 and WHSC1 BINDING SITE2 are target binding sites found in untranslated regions of multiple transcripts of mRNA encoded by WHSC1, corresponding to target binding sites such as BINDING SITE I, BINDING SITE II or BINDING SITE III of FIG. 8. Table 4 illustrates the complementarity of the nucleotide sequences of WHSC1 BINDING SITE1 and WHSC1 BINDING SITE2, designated SEQ ID:18856 and SEQ ID:18856 respectively, to the nucleotide sequence of GAM3229 RNA, herein designated GAM RNA, also designated SEQ ID:221.

Another function of GAM3229 is therefore inhibition of Wolf-hirschhorn syndrome candidate 1 (WHSC1, Accession NP_055734.1), a gene which binds covalently to and repairs g/t mismatches. and therefore may be associated with Wolf-hirschhorn syndrome. Accordingly, utilities of GAM3229 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wolf-hirschhorn syndrome candidate 1 (WHSC1, Accession NP_579878.1) is another GAM3229 target gene, herein designated TARGET GENE. WHSC1 BINDING SITE1 and WHSC1 BINDING SITE2 are target binding sites found in untranslated regions of multiple transcripts of mRNA encoded by WHSC1, corresponding to target binding sites such as BINDING SITE I, BINDING SITE II or BINDING SITE III of FIG. 8. Table 4 illustrates the complementarity of the nucleotide sequences of WHSC1 BINDING SITE1 and WHSC1 BINDING SITE2, designated SEQ ID:18856 and SEQ ID:5144 respectively, to the nucleotide sequence of GAM3229 RNA, herein designated GAM RNA, also designated SEQ ID:221.

Another function of GAM3229 is therefore inhibition of Wolf-hirschhorn syndrome candidate 1 (WHSC1, Accession NP_579878.1), a gene which binds covalently to and repairs g/t mismatches. and therefore may be associated with Wolf-hirschhorn syndrome. Accordingly, utilities of GAM3229 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wolf-hirschhorn syndrome candidate 1 (WHSC1, Accession NP_579877.1) is another GAM3229 target gene, herein designated TARGET GENE. WHSC1 BINDING SITE1 and WHSC1 BINDING SITE2 are target binding sites found in untranslated regions of multiple transcripts of mRNA encoded by WHSC1, corresponding to target binding sites such as BINDING SITE I, BINDING SITE II or BINDING SITE III of FIG. 8. Table 4 illustrates the complementarity of the nucleotide sequences of WHSC1 BINDING SITE1 and WHSC1 BINDING SITE2, designated SEQ ID:18856 and SEQ ID:18856 respectively, to the nucleotide sequence of GAM3229 RNA, herein designated GAM RNA, also designated SEQ ID:221.

Another function of GAM3229 is therefore inhibition of Wolf-hirschhorn syndrome candidate 1 (WHSC1, Accession NP_579877.1), a gene which binds covalently to and repairs g/t mismatches. and therefore may be associated with Wolf-hirschhorn syndrome. Accordingly, utilities of GAM3229 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wolf-hirschhorn syndrome candidate 1 (WHSC1, Accession NP_015627.1) is another GAM3229 target gene, herein designated TARGET GENE. WHSC1 BINDING SITE1 and WHSC1 BINDING SITE2 are target binding sites found in untranslated regions of multiple transcripts of mRNA encoded by WHSC1, corresponding to target binding sites such as BINDING SITE I, BINDING SITE II or BINDING SITE III of FIG. 8. Table 4 illustrates the complementarity of the nucleotide sequences of WHSC1 BINDING SITE1 and WHSC1 BINDING SITE2, designated SEQ ID:18856 and SEQ ID:18608 respectively, to the nucleotide sequence of GAM3229 RNA, herein designated GAM RNA, also designated SEQ ID:221.

Another function of GAM3229 is therefore inhibition of Wolf-hirschhorn syndrome candidate 1 (WHSC1, Accession NP_015627.1), a gene which binds covalently to and repairs g/t mismatches. and therefore may be associated with Wolf-hirschhorn syndrome. Accordingly, utilities of GAM3229 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. X-ray repair complementing defective repair in chinese hamster cells 2 (XRCC2, Accession NP_005422.1) is another GAM3229 target gene, herein designated TARGET GENE. XRCC2 BINDING SITE1 and XRCC2 BINDING SITE2 are target binding sites found in untranslated regions of mRNA encoded by XRCC2, corresponding to target binding sites such as BINDING SITE I, BINDING SITE II or BINDING SITE III of FIG. 8. Table 4 illustrates the complementarity of the nucleotide sequences of XRCC2 BINDING SITE1 and XRCC2 BINDING SITE2, designated SEQ ID:14540 and SEQ ID:10425 respectively, to the nucleotide sequence of GAM3229 RNA, herein designated GAM RNA, also designated SEQ ID:221.

Another function of GAM3229 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM3229 include diagnosis, prevention and treatment of diseases and clinical conditions associated with XRCC2.

The function of XRCC2 and its association with various diseases and clinical conditions, has been established by previous studies, as described hereinabove with reference to GAM72.1. ZAP (Accession NP_064504.2) is another GAM3229 target gene, herein designated TARGET GENE. ZAP BINDING SITE is a target binding site found in the 3' untranslated region of multiple transcripts of mRNA encoded by ZAP, corresponding to a target binding site such as BINDING SITE I, BINDING SITE II or BINDING SITE III of FIG. 8. Table 4 illustrates the complementarity of the nucleotide sequences of ZAP BINDING SITE, designated SEQ ID:10075, to the nucleotide sequence of GAM3229 RNA, herein designated GAM RNA, also designated SEQ ID:221.

Another function of GAM3229 is therefore inhibition of ZAP (Accession NP_064504.2). Accordingly, utilities of GAM3229 include diagnosis, prevention and treatment of diseases and clinical conditions associated with ZAP.

ZFP42 (Accession NP_777560.1) is another GAM3229 target gene, herein designated TARGET GENE. ZFP42 BINDING SITE is a target binding site found in the 3' untranslated region of mRNA encoded by ZFP42, corresponding to a target binding site such as BINDING SITE I, BINDING SITE II or BINDING SITE III of FIG. 8. Table 4 illustrates the complementarity of the nucleotide sequences of ZFP42 BINDING SITE, designated SEQ ID:20009, to the nucleotide sequence of GAM3229 RNA, herein designated GAM RNA, also designated SEQ ID:221.

Another function of GAM3229 is therefore inhibition of ZFP42 (Accession NP_777560.1). Accordingly, utilities of GAM3229 include diagnosis, prevention and treatment of diseases and clinical conditions associated with ZFP42.

Zinc finger protein 64 homolog (mouse) (ZFP64, Accession NP_060667.1) is another GAM3229 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:3840, to the nucleotide sequence of GAM3229 RNA, herein designated GAM RNA, also designated SEQ ID:221.

Another function of GAM3229 is therefore inhibition of Zinc finger protein 64 homolog (mouse) (ZFP64, Accession NP_060667.1). Accordingly, utilities of GAM3229 include diagnosis, prevention and treatment of diseases and clinical conditions associated with ZFP64.

Zinc finger protein 64 homolog (mouse) (ZFP64, Accession NP_071371.2) is another GAM3229 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:3840, to the nucleotide sequence of GAM3229 RNA, herein designated GAM RNA, also designated SEQ ID:221.

Another function of GAM3229 is therefore inhibition of Zinc finger protein 64 homolog (mouse) (ZFP64, Accession NP_071371.2). Accordingly, utilities of GAM3229 include diagnosis, prevention and treatment of diseases and clinical conditions associated with ZFP64.

Zinc finger protein 95 homolog (mouse) (ZFP95, Accession NP_659570.1) is another GAM3229 target gene, herein designated TARGET GENE. ZFP95 BINDING SITE is a target binding site found in the 3' untranslated region of multiple transcripts of mRNA encoded by ZFP95, corresponding to a target binding site such as BINDING SITE I, BINDING SITE II or BINDING SITE III of FIG. 8. Table 4 illustrates the complementarity of the nucleotide sequences of ZFP95 BINDING SITE, designated SEQ ID:8365, to the nucleotide sequence of GAM3229 RNA, herein designated GAM RNA, also designated SEQ ID:221.

Another function of GAM3229 is therefore inhibition of Zinc finger protein 95 homolog (mouse) (ZFP95, Accession NP_659570.1). Accordingly, utilities of GAM3229 include diagnosis, prevention and treatment of diseases and clinical conditions associated with ZFP95.

Zinc finger protein 95 homolog (mouse) (ZFP95, Accession NP_055384.1) is another GAM3229 target gene, herein designated TARGET GENE. ZFP95 BINDING SITE is a target binding site found in the 3' untranslated region of multiple transcripts of mRNA encoded by ZFP95, corresponding to a target binding site such as BINDING SITE I, BINDING SITE II or BINDING SITE III of FIG. 8. Table 4 illustrates the complementarity of the nucleotide sequences of ZFP95 BINDING SITE, designated SEQ ID:8365, to the nucleotide sequence of GAM3229 RNA, herein designated GAM RNA, also designated SEQ ID:221.

Another function of GAM3229 is therefore inhibition of Zinc finger protein 95 homolog (mouse) (ZFP95, Accession NP_055384.1). Accordingly, utilities of GAM3229 include diagnosis, prevention and treatment of diseases and clinical conditions associated with ZFP95.

Zinc finger protein 138 (clone phz-32) (ZNF138, Accession XP_088081.1) is another GAM3229 target gene, herein designated TARGET GENE. ZNF138 BINDING SITE is a target binding site found in the 3' untranslated region of mRNA encoded by ZNF138, corresponding to a target binding site such as BINDING SITE I, BINDING SITE II or BINDING SITE III of FIG. 8. Table 4 illustrates the complementarity of the nucleotide sequences of ZNF138 BINDING SITE, designated SEQ ID:6482, to the nucleotide sequence of GAM3229 RNA, herein designated GAM RNA, also designated SEQ ID:221.

Another function of GAM3229 is therefore inhibition of Zinc finger protein 138 (clone phz-32) (ZNF138, Accession XP_088081.1). Accordingly, utilities of GAM3229 include diagnosis, prevention and treatment of diseases and clinical conditions associated with ZNF138.

Zinc finger protein 214 (ZNF214, Accession NP_037381.1) is another GAM3229 target gene, herein designated TARGET GENE. ZNF214 BINDING SITE is a target binding site found in the 5' untranslated region of mRNA encoded by ZNF214, corresponding to a target binding site such as BINDING SITE I, BINDING SITE II or BINDING SITE III of FIG. 8. Table 4 illustrates the complementarity of the nucleotide sequences of ZNF214 BINDING SITE, designated SEQ ID:8097, to the nucleotide sequence of GAM3229 RNA, herein designated GAM RNA, also designated SEQ ID:221.

Another function of GAM3229 is therefore inhibition of Zinc finger protein 214 (ZNF214, Accession NP_037381.1). Accordingly, utilities of GAM3229 include diagnosis, prevention and treatment of diseases and clinical conditions associated with ZNF214.

Zinc finger protein 264 (ZNF264, Accession NP_003408.1) is another GAM3229 target gene, herein designated TARGET GENE. ZNF264 BINDING SITE is a target binding site found in the 3' untranslated region of mRNA encoded by ZNF264, corresponding to a target binding site such as BINDING SITE I, BINDING SITE II or BINDING SITE III of FIG. 8. Table 4 illustrates the complementarity of the nucleotide sequences of ZNF264 BINDING SITE, designated SEQ ID:1422, to the nucleotide sequence of GAM3229 RNA, herein designated GAM RNA, also designated SEQ ID:221.

Another function of GAM3229 is therefore inhibition of Zinc finger protein 264 (ZNF264, Accession NP_003408.1). Accordingly, utilities of GAM3229 include diagnosis, prevention and treatment of diseases and clinical conditions associated with ZNF264.

Zinc finger protein 273 (ZNF273, Accession XP_088082.1) is another GAM3229 target gene, herein designated TARGET GENE. ZNF273 BINDING SITE is a target binding site found in the 3' untranslated region of mRNA encoded by ZNF273, corresponding to a target binding site such as BINDING SITE I, BINDING SITE II or BINDING SITE III of FIG. 8. Table 4 illustrates the complementarity of the nucleotide sequences of ZNF273 BINDING SITE, designated SEQ ID:16389, to the nucleotide sequence of GAM3229 RNA, herein designated GAM RNA, also designated SEQ ID:221.

Another function of GAM3229 is therefore inhibition of Zinc finger protein 273 (ZNF273, Accession XP_088082.1). Accordingly, utilities of GAM3229 include diagnosis, prevention and treatment of diseases and clinical conditions associated with ZNF273.

Zinc finger protein 398 (ZNF398, Accession NP_065832.1) is another GAM3229 target gene, herein designated TARGET GENE. ZNF398 BINDING SITE is a target binding site found in the 5' untranslated region of multiple transcripts of mRNA encoded by ZNF398, corresponding to a target binding site such as BINDING SITE I, BINDING SITE II or BINDING SITE III of FIG. 8. Table 4 illustrates the complementarity of the nucleotide sequences of ZNF398 BINDING SITE, designated SEQ ID:16846, to the nucleotide sequence of GAM3229 RNA, herein designated GAM RNA, also designated SEQ ID:221.

Another function of GAM3229 is therefore inhibition of Zinc finger protein 398 (ZNF398, Accession NP_065832.1). Accordingly, utilities of GAM3229 include diagnosis, prevention and treatment of diseases and clinical conditions associated with ZNF398.

ZNF430 (Accession NP_079465.1) is another GAM3229 target gene, herein designated TARGET GENE. ZNF430 BINDING SITE is a target binding site found in the 3' untranslated region of mRNA encoded by ZNF430, corresponding to a target binding site such as BINDING SITE I, BINDING SITE II or BINDING SITE III of FIG. 8. Table 4 illustrates the complementarity of the nucleotide sequences of ZNF430 BINDING SITE, designated SEQ ID:5502, to the nucleotide sequence of GAM3229 RNA, herein designated GAM RNA, also designated SEQ ID:221.

Another function of GAM3229 is therefore inhibition of ZNF430 (Accession NP_079465.1). Accordingly, utilities of GAM3229 include diagnosis, prevention and treatment of diseases and clinical conditions associated with ZNF430.

ZNF431 (Accession XP_086098.2) is another GAM3229 target gene, herein designated TARGET GENE. ZNF431 BINDING SITE is a target binding site found in the 3' untranslated region of mRNA encoded by ZNF431, corresponding to a target binding site such as BINDING SITE I, BINDING SITE II or BINDING SITE III of FIG. 8. Table 4 illustrates the complementarity of the nucleotide sequences of ZNF431 BINDING SITE, designated SEQ ID:16935, to the nucleotide sequence of GAM3229 RNA, herein designated GAM RNA, also designated SEQ ID:221.

Another function of GAM3229 is therefore inhibition of ZNF431 (Accession XP_086098.2). Accordingly, utilities of GAM3229 include diagnosis, prevention and treatment of diseases and clinical conditions associated with ZNF431.

ZNF440 (Accession NP_689570.1) is another GAM3229 target gene, herein designated TARGET GENE. ZNF440 BINDING SITE1 and ZNF440 BINDING SITE2 are target binding sites found in untranslated regions of mRNA encoded by ZNF440, corresponding to target binding sites such as BINDING SITE I, BINDING SITE II or BINDING SITE III of FIG. 8. Table 4 illustrates the complementarity of the nucleotide sequences of ZNF440 BINDING SITE1 and ZNF440 BINDING SITE2, designated SEQ ID:13052 and SEQ ID:8337 respectively, to the nucleotide sequence of GAM3229 RNA, herein designated GAM RNA, also designated SEQ ID:221.

Another function of GAM3229 is therefore inhibition of ZNF440 (Accession NP_689570.1). Accordingly, utilities of GAM3229 include diagnosis, prevention and treatment of diseases and clinical conditions associated with ZNF440.

ZNF450 (Accession NP_055612.1) is another GAM3229 target gene, herein designated TARGET GENE. ZNF450 BINDING SITE is a target binding site found in the 3' untranslated region of mRNA encoded by ZNF450, corresponding to a target binding site such as BINDING SITE I, BINDING SITE II or BINDING SITE III of FIG. 8. Table 4 illustrates the complementarity of the nucleotide sequences of ZNF450 BINDING SITE, designated SEQ ID:14177, to the nucleotide sequence of GAM3229 RNA, herein designated GAM RNA, also designated SEQ ID:221.

Another function of GAM3229 is therefore inhibition of ZNF450 (Accession NP_055612.1). Accordingly, utilities of GAM3229 include diagnosis, prevention and treatment of diseases and clinical conditions associated with ZNF450.

Zinc finger protein 74 (cos52) (ZNF74, Accession NP_003417.1) is another GAM3229 target gene, herein designated TARGET GENE. ZNF74 BINDING SITE is a target binding site found in the 5' untranslated region of mRNA encoded by ZNF74, corresponding to a target binding site such as BINDING SITE I, BINDING SITE II or BINDING SITE III of FIG. 8. Table 4 illustrates the complementarity of the nucleotide sequences of ZNF74 BINDING SITE, designated SEQ ID:15580, to the nucleotide sequence of GAM3229 RNA, herein designated GAM RNA, also designated SEQ ID:221.

Another function of GAM3229 is therefore inhibition of Zinc finger protein 74 (cos52) (ZNF74, Accession NP_003417.1). Accordingly, utilities of GAM3229 include diagnosis, prevention and treatment of diseases and clinical conditions associated with ZNF74.

FIG. 8 further provides a conceptual description of a novel bioinformatically detected of the present invention, referred to here as Genomic Address Messenger 3298 (GAM3298), which modulates expression of respective target genes thereof, the function and utility of which target genes is known in the art.

GAM3298 is a novel bioinformatically detected regulatory, non protein coding, micro RNA (miRNA) gene. The method by which GAM3298 was detected is described hereinabove with reference to FIGS. 8-15.

GAM3298 gene, herein designated GAM GENE, and GAM3298 target gene, herein designated TARGET GENE, are human genes contained in the human genome.

GAM3298 gene encodes a GAM3298 precursor RNA, herein designated GAM PRECURSOR RNA. Similar to other miRNA genes, and unlike most ordinary genes, GAM3298 precursor RNA does not encode a protein. A nucleotide sequence identical or highly similar to the nucleotide sequence of GAM3298 precursor RNA is designated SEQ ID:111, and is provided hereinbelow with reference to the sequence listing part. Nucleotide sequence SEQ ID:111 is located at position 131248914 relative to chromosome X.

GAM3298 precursor RNA folds onto itself, forming GAM3298 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM3298 precursor RNA folds onto itself, forming GAM3298 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM3298 precursor RNA, designated SEQ-ID:111, and a schematic representation of a predicted secondary folding of GAM3298 folded precursor RNA are further described with reference to Table 2, hereby incorporated by reference.

An enzyme complex designated DICER COMPLEX, 'dices' the GAM3298 folded precursor RNA into GAM3298 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM3298 RNA is designated SEQ ID:259, and is provided hereinbelow with references to the sequence listing part and Table 3, hereby incorporated by reference.

GAM3298 target gene, herein designated TARGET GENE, encodes a corresponding messenger RNA, GAM3298 target RNA, herein designated GAM TARGET RNA. GAM3298 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM3298 RNA, herein designated GAM RNA, binds complementarily to one or more target binding sites located in untranslated regions of GAM3298 target RNA, herein designated GAM TARGET RNA. This complementary binding is due to the fact that the nucleotide sequence of GAM3298 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM3298 RNA may have a different number of target binding sites in untranslated regions of a GAM3298 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM3298 RNA, herein designated GAM RNA, to target binding sites on GAM3298 target RNA, herein designated GAM TARGET RNA, such as BINDING SITE I, BINDING SITE II and BINDING SITE III, inhibits translation of GAM3298 target RNA into GAM3298 target protein, herein designated GAM TARGET PROTEIN. GAM target protein is therefore outlined by a broken line.

It is appreciated that GAM3298 target gene, herein designated TARGET GENE, in fact represents a plurality of GAM3298 target genes. The mRNA of each one of this plurality of GAM3298 target genes comprises one or more target binding sites, each having a nucleotide sequence which is at least partly complementary to GAM3298 RNA, herein designated GAM RNA, and which when bound by GAM3298 RNA causes inhibition of translation of respective one or more GAM3298 target proteins.

It is further appreciated by one skilled in the art that the mode of translational inhibition illustrated by FIG. 8 with specific reference to translational inhibition exerted by GAM3298 gene, herein designated GAM GENE, on one or more GAM3298 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM3298 correlate with, and may be deduced from, the identity of the target genes which GAM3298 binds and inhibits, and the function of these target genes, as elaborated hereinbelow.

15E1.2 (Accession XP_290596.1) is a GAM3298 target gene, herein designated TARGET GENE. 15E1.2 BINDING SITE is a target binding site found in the 3' untranslated region of mRNA encoded by 15E1.2, corresponding to a target binding site such as BINDING SITE I, BINDING SITE II or BINDING SITE III of FIG. 8. Table 4 illustrates the complementarity of the nucleotide sequences of 15E1.2 BINDING SITE, designated SEQ ID:7468, to the nucleotide sequence of GAM3298 RNA, herein designated GAM RNA, also designated SEQ ID:259.

A function of GAM3298 is therefore inhibition of 15E1.2 (Accession XP_290596.1). Accordingly, utilities of GAM3298 include diagnosis, prevention and treatment of diseases and clinical conditions associated with 15E1.2.

Atp-binding cassette, sub-family c (cftr/mrp), member 13 (ABCC13, Accession NP_742021.1) is another GAM3298 target gene, herein designated TARGET GENE. ABCC13 BINDING SITE is a target binding site found in the 3' untranslated region of multiple transcripts of mRNA encoded by ABCC13, corresponding to a target binding site such as BINDING SITE I, BINDING SITE II or BINDING SITE III of FIG. 8. Table 4 illustrates the complementarity of the nucleotide sequences of ABCC13 BINDING SITE, designated SEQ ID:3706, to the nucleotide sequence of GAM3298 RNA, herein designated GAM RNA, also designated SEQ ID:259.

Another function of GAM3298 is therefore inhibition of Atp-binding cassette, sub-family c (cftr/mrp), member 13 (ABCC13, Accession NP_742021.1). Accordingly, utilities of GAM3298 include diagnosis, prevention and treatment of diseases and clinical conditions associated with ABCC13.

ACATE2 (Accession NP_036464.1) is another GAM3298 target gene, herein designated TARGET GENE. ACATE2 BINDING SITE is a target binding site found in the 3' untranslated region of mRNA encoded by ACATE2, corresponding to a target binding site such as BINDING SITE I, BINDING SITE II or BINDING SITE III of FIG. 8. Table 4 illustrates the complementarity of the nucleotide sequences of ACATE2 BINDING SITE, designated SEQ ID:3706, to the nucleotide sequence of GAM3298 RNA, herein designated GAM RNA, also designated SEQ ID:259.

Another function of GAM3298 is therefore inhibition of ACATE2 (Accession NP_036464.1). Accordingly, utilities of GAM3298 include diagnosis, prevention and treatment of diseases and clinical conditions associated with ACATE2.

Adenylate cyclase 1 (brain) (ADCY1, Accession NP_066939.1) is another GAM3298 target gene, herein designated TARGET GENE. ADCY1 BINDING SITE is a target binding site found in the 3' untranslated region of multiple transcripts of mRNA encoded by ADCY1, corresponding to a target binding site such as BINDING SITE I, BINDING SITE II or BINDING SITE III of FIG. 8. Table 4 illustrates the complementarity of the nucleotide sequences of ADCY1 BINDING SITE, designated SEQ ID:14995, to the nucleotide sequence of GAM3298 RNA, herein designated GAM RNA, also designated SEQ ID:259.

Another function of GAM3298 is therefore inhibition of Adenylate cyclase 1 (brain) (ADCY1, Accession NP_066939.1), a gene which a calmodulin-sensitive adenylyl cyclase. it may play a role in memory acquisition and learning. Accordingly, utilities of GAM3298 include diagnosis, prevention and treatment of diseases and clinical conditions associated with ADCY1.

The function of ADCY1 and its association with various diseases and clinical conditions, has been established by previous studies, as described hereinabove with reference to GAM144.1. Adenylate cyclase 7 (ADCY7, Accession NP_001105.1) is another GAM3298 target gene, herein designated TARGET GENE. ADCY7 BINDING SITE is a target binding site found in the 3' untranslated region of mRNA encoded by ADCY7, corresponding to a target binding site such as BINDING SITE I, BINDING SITE II or BINDING SITE III of FIG. 8. Table 4 illustrates the complementarity of the nucleotide sequences of ADCY7 BINDING SITE, designated SEQ ID:17337, to the nucleotide sequence of GAM3298 RNA, herein designated GAM RNA, also designated SEQ ID:259.

Another function of GAM3298 is therefore inhibition of Adenylate cyclase 7 (ADCY7, Accession NP_001105.1), a gene which this a membrane-bound, ca(2+)-inhibitable adenylyl cyclase. Accordingly, utilities of GAM3298 include diagnosis, prevention and treatment of diseases and clinical conditions associated with ADCY7.

The function of ADCY7 and its association with various diseases and clinical conditions, has been established by previous studies, as described hereinabove with reference to GAM75.1. Agmatine ureohydrolase (agmatinase) (AGMAT, Accession NP_079034.2) is another GAM3298 target gene, herein designated TARGET GENE. AGMAT BINDING SITE is a target binding site found in the 3' untranslated region of mRNA encoded by AGMAT, corresponding to a target binding site such as BINDING SITE I, BINDING SITE II or BINDING SITE III of FIG. 8. Table 4 illustrates the complementarity of the nucleotide sequences of AGMAT BINDING SITE, designated SEQ ID:16781, to the nucleotide sequence of GAM3298 RNA, herein designated GAM RNA, also designated SEQ ID:259.

Another function of GAM3298 is therefore inhibition of Agmatine ureohydrolase (agmatinase) (AGMAT, Accession NP_079034.2). Accordingly, utilities of GAM3298 include diagnosis, prevention and treatment of diseases and clinical conditions associated with AGMAT.

Adenylate kinase 1 (AK1, Accession NP_000467.1) is another GAM3298 target gene, herein designated TARGET GENE. AK1 BINDING SITE is a target binding site found in the 3' untranslated region of mRNA encoded by AK1, corresponding to a target binding site such as BINDING SITE I, BINDING SITE II or BINDING SITE III of FIG. 8. Table 4 illustrates the complementarity of the nucleotide sequences of AK1 BINDING SITE, designated SEQ ID:816, to the nucleotide sequence of GAM3298 RNA, herein designated GAM RNA, also designated SEQ ID:259.

Another function of GAM3298 is therefore inhibition of Adenylate kinase 1 (AK1, Accession NP_000467.1). Accordingly, utilities of GAM3298 include diagnosis, prevention and treatment of diseases and clinical conditions associated with AK1.

Aldehyde dehydrogenase 3 family, member a2 (ALDH3A2, Accession NP_000373.1) is another GAM3298 target gene, herein designated TARGET GENE. ALDH3A2 BINDING SITE is a target binding site found in the 3' untranslated region of mRNA encoded by ALDH3A2, corresponding to a target binding site such as BINDING SITE I, BINDING SITE II or BINDING SITE III of FIG. 8. Table 4 illustrates the complementarity of the nucleotide sequences of ALDH3A2 BINDING SITE, designated SEQ ID:3706, to the nucleotide sequence of GAM3298 RNA, herein designated GAM RNA, also designated SEQ ID:259.

Another function of GAM3298 is therefore inhibition of Aldehyde dehydrogenase 3 family, member a2 (ALDH3A2, Accession NP_000373.1). Accordingly, utilities of GAM3298 include diagnosis, prevention and treatment of diseases and clinical conditions associated with ALDH3A2.

Aldehyde dehydrogenase 9 family, member a1 (ALDH9A1, Accession NP_000687.2) is another GAM3298 target gene, herein designated TARGET GENE. ALDH9A1 BINDING SITE is a target binding site found in the 3' untranslated region of mRNA encoded by ALDH9A1, corresponding to a target binding site such as BINDING SITE I, BINDING SITE II or BINDING SITE III of FIG. 8. Table 4 illustrates the complementarity of the nucleotide sequences of ALDH9A1 BINDING SITE, designated SEQ ID:3390, to the nucleotide sequence of GAM3298 RNA, herein designated GAM RNA, also designated SEQ ID:259.

Another function of GAM3298 is therefore inhibition of Aldehyde dehydrogenase 9 family, member a1 (ALDH9A1, Accession NP_000687.2). Accordingly, utilities of GAM3298 include diagnosis, prevention and treatment of diseases and clinical conditions associated with ALDH9A1.

Ac-like transposable element (ALTE, Accession NP_004720.1) is another GAM3298 target gene, herein designated TARGET GENE. ALTE BINDING SITE is a target binding site found in the 3' untranslated region of mRNA encoded by ALTE, corresponding to a target binding site such as BINDING SITE I, BINDING SITE II or BINDING SITE III of FIG. 8. Table 4 illustrates the complementarity of the nucleotide sequences of ALTE BINDING SITE, designated SEQ ID:525, to the nucleotide sequence of GAM3298 RNA, herein designated GAM RNA, also designated SEQ ID:259.

Another function of GAM3298 is therefore inhibition of Ac-like transposable element (ALTE, Accession NP_004720.1). Accordingly, utilities of GAM3298 include diagnosis, prevention and treatment of diseases and clinical conditions associated with ALTE.

ANAPC7 (Accession NP_057322.1) is another GAM3298 target gene, herein designated TARGET GENE. ANAPC7 BINDING SITE is a target binding site found in the 5' untranslated region of mRNA encoded by ANAPC7, corresponding to a target binding site such as BINDING SITE I, BINDING SITE II or BINDING SITE III of FIG. 8. Table 4 illustrates the complementarity of the nucleotide sequences of ANAPC7 BINDING SITE, designated SEQ ID:16150, to the nucleotide sequence of GAM3298 RNA, herein designated GAM RNA, also designated SEQ ID:259.

Another function of GAM3298 is therefore inhibition of ANAPC7 (Accession NP_057322.1). Accordingly, utilities of GAM3298 include diagnosis, prevention and treatment of diseases and clinical conditions associated with ANAPC7.

Apolipoprotein l, 1 (APOL1, Accession NP_663318.1) is another GAM3298 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:19832, to the nucleotide sequence of GAM3298 RNA, herein designated GAM RNA, also designated SEQ ID:259.

Another function of GAM3298 is therefore inhibition of Apolipoprotein l, 1 (APOL1, Accession NP_663318.1), a gene which may participate in reverse cholesterol transport from peripheral cells to the liver. and therefore may be associated with Schizophrenia. Accordingly, utilities of GAM3298 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Apolipoprotein l, 1 (APOL1, Accession NP_003652.2) is another GAM3298 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:19832, to the nucleotide sequence of GAM3298 RNA, herein designated GAM RNA, also designated SEQ ID:259.

Another function of GAM3298 is therefore inhibition of Apolipoprotein l, 1 (APOL1, Accession NP_003652.2), a gene which may participate in reverse cholesterol transport from peripheral cells to the liver. and therefore may be associated with Schizophrenia. Accordingly, utilities of GAM3298 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Aquaporin 6, kidney specific (AQP6, Accession NP_445738.1) is another GAM3298 target gene, herein designated TARGET GENE. AQP6 BINDING SITE is a target binding site found in the 5' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:15019, to the nucleotide sequence of GAM3298 RNA, herein designated GAM RNA, also designated SEQ ID:259.

Another function of GAM3298 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM3298 include diagnosis, prevention and treatment of diseases and clinical conditions associated with AQP6.

The function of AQP6 and its association with various diseases and clinical conditions, has been established by previous studies, as described hereinabove with reference to GAM51.1. Ankyrin repeat and socs box-containing 1 (ASB1, Accession NP_057198.1) is another GAM3298 target gene, herein designated TARGET GENE. ASB1 BINDING SITE is a target binding site found in the 3' untranslated region of mRNA encoded by ASB1, corresponding to a target binding site such as BINDING SITE I, BINDING SITE II or BINDING SITE III of FIG. 8. Table 4 illustrates the complementarity of the nucleotide sequences of ASB1 BINDING SITE, designated SEQ ID:4892, to the nucleotide sequence of GAM3298 RNA, herein designated GAM RNA, also designated SEQ ID:259.

Another function of GAM3298 is therefore inhibition of Ankyrin repeat and socs box-containing 1 (ASB1, Accession NP_057198.1), a gene which May mediate protein-protein interactions. Accordingly, utilities of GAM3298 include diagnosis, prevention and treatment of diseases and clinical conditions associated with ASB1.

The function of ASB1 and its association with various diseases and clinical conditions, has been established by previous studies, as described hereinabove with reference to GAM47.1. Ankyrin repeat and socs box-containing 13 (ASB13, Accession NP_078977.2) is another GAM3298 target gene, herein designated TARGET GENE. ASB13 BINDING SITE is a target binding site found in the 3' untranslated region of mRNA encoded by ASB13, corresponding to a target binding site such as BINDING SITE I, BINDING SITE II or BINDING SITE III of FIG. 8. Table 4 illustrates the complementarity of the nucleotide sequences of ASB13 BINDING SITE, designated SEQ ID:17002, to the nucleotide sequence of GAM3298 RNA, herein designated GAM RNA, also designated SEQ ID:259.

Another function of GAM3298 is therefore inhibition of Ankyrin repeat and socs box-containing 13 (ASB13, Accession NP_078977.2). Accordingly, utilities of GAM3298 include diagnosis, prevention and treatment of diseases and clinical conditions associated with ASB13.

Ankyrin repeat and socs box-containing 9 (ASB9, Accession NP_076992.1) is another GAM3298 target gene, herein designated TARGET GENE. ASB9 BINDING SITE is a target binding site found in the 3' untranslated region of mRNA encoded by ASB9, corresponding to a target binding site such as BINDING SITE I, BINDING SITE II or BINDING SITE III of FIG. 8. Table 4 illustrates the complementarity of the nucleotide sequences of ASB9 BINDING SITE, designated SEQ ID:4781, to the nucleotide sequence of GAM3298 RNA, herein designated GAM RNA, also designated SEQ ID:259.

Another function of GAM3298 is therefore inhibition of Ankyrin repeat and socs box-containing 9 (ASB9, Accession NP_076992.1). Accordingly, utilities of GAM3298 include diagnosis, prevention and treatment of diseases and clinical conditions associated with ASB9.

Activating transcription factor 5 (ATF5, Accession NP_036200.2) is another GAM3298 target gene, herein designated TARGET GENE. ATF5 BINDING SITE is a target binding site found in the 3' untranslated region of mRNA encoded by ATF5, corresponding to a target binding site such as BINDING SITE I, BINDING SITE II or BINDING SITE III of FIG. 8. Table 4 illustrates the complementarity of the nucleotide sequences of ATF5 BINDING SITE, designated SEQ ID:15319, to the nucleotide sequence of GAM3298 RNA, herein designated GAM RNA, also designated SEQ ID:259.

Another function of GAM3298 is therefore inhibition of Activating transcription factor 5 (ATF5, Accession NP_036200.2), a gene which binds to cAMP-inducible promoters and is involved in gene transcription. Accordingly, utilities of GAM3298 include diagnosis, prevention and treatment of diseases and clinical conditions associated with ATF5.

The function of ATF5 and its association with various diseases and clinical conditions, has been established by previous studies, as described hereinabove with reference to GAM259.1. Atpase, na+/k+ transporting, alpha 2 (+) polypeptide (ATP1A2, Accession NP_000693.1) is another GAM3298 target gene, herein designated TARGET GENE. ATP1A2 BINDING SITE is a target binding site found in the 3' untranslated region of mRNA encoded by ATP1A2, corresponding to a target binding site such as BINDING SITE I, BINDING SITE II or BINDING SITE III of FIG. 8. Table 4 illustrates the complementarity of the nucleotide sequences of ATP1A2 BINDING SITE, designated SEQ ID:3706, to the nucleotide sequence of GAM3298 RNA, herein designated GAM RNA, also designated SEQ ID:259.

Another function of GAM3298 is therefore inhibition of Atpase, na+/k+ transporting, alpha 2 (+) polypeptide (ATP1A2, Accession NP_000693.1). Accordingly, utilities of GAM3298 include diagnosis, prevention and treatment of diseases and clinical conditions associated with ATP1A2.

Betaine-homocysteine methyltransferase 2 (BHMT2, Accession NP_060084.2) is another GAM3298 target gene, herein designated TARGET GENE. BHMT2 BINDING SITE is a target binding site found in the 3' untranslated region of mRNA encoded by BHMT2, corresponding to a target binding site such as BINDING SITE I, BINDING SITE II or BINDING SITE III of FIG. 8. Table 4 illustrates the complementarity of the nucleotide sequences of BHMT2 BINDING SITE, designated SEQ ID:6371, to the nucleotide sequence of GAM3298 RNA, herein designated GAM RNA, also designated SEQ ID:259.

Another function of GAM3298 is therefore inhibition of Betaine-homocysteine methyltransferase 2 (BHMT2, Accession NP_060084.2). Accordingly, utilities of GAM3298 include diagnosis, prevention and treatment of diseases and clinical conditions associated with BHMT2.

3'(2'), 5'-bisphosphate nucleotidase 1 (BPNT1, Accession NP_006076.2) is another GAM3298 target gene, herein designated TARGET GENE. BPNT1 BINDING SITE is a target binding site found in the 3' untranslated region of multiple transcripts of mRNA encoded by BPNT1, corresponding to a target binding site such as BINDING SITE I, BINDING SITE II or BINDING SITE III of FIG. 8. Table 4 illustrates the complementarity of the nucleotide sequences of BPNT1 BINDING SITE, designated SEQ ID:3706, to the nucleotide sequence of GAM3298 RNA, herein designated GAM RNA, also designated SEQ ID:259.

Another function of GAM3298 is therefore inhibition of 3'(2'), 5'-bisphosphate nucleotidase 1 (BPNT1, Accession NP_006076.2). Accordingly, utilities of GAM3298 include diagnosis, prevention and treatment of diseases and clinical conditions associated with BPNT1.

3'(2'), 5'-bisphosphate nucleotidase 1 (BPNT1, Accession XP_035738.1) is another GAM3298 target gene, herein designated TARGET GENE. BPNT1 BINDING SITE is a target binding site found in the 3' untranslated region of multiple transcripts of mRNA encoded by BPNT1, corresponding to a target binding site such as BINDING SITE I, BINDING SITE II or BINDING SITE III of FIG. 8. Table 4 illustrates the complementarity of the nucleotide sequences of BPNT1 BINDING SITE, designated SEQ ID:3706, to the nucleotide sequence of GAM3298 RNA, herein designated GAM RNA, also designated SEQ ID:259.

Another function of GAM3298 is therefore inhibition of 3'(2'), 5'-bisphosphate nucleotidase 1 (BPNT1, Accession XP_035738.1). Accordingly, utilities of GAM3298 include diagnosis, prevention and treatment of diseases and clinical conditions associated with BPNT1.

Btb (poz) domain containing 5 (BTBD5, Accession NP_060128.1) is another GAM3298 target gene, herein designated TARGET GENE. BTBD5 BINDING SITE is a target binding site found in the 3' untranslated region of mRNA encoded by BTBD5, corresponding to a target binding site such as BINDING SITE I, BINDING SITE II or BINDING SITE III of FIG. 8. Table 4 illustrates the complementarity of the nucleotide sequences of BTBD5 BINDING SITE, designated SEQ ID:11724, to the nucleotide sequence of GAM3298 RNA, herein designated GAM RNA, also designated SEQ ID:259.

Another function of GAM3298 is therefore inhibition of Btb (poz) domain containing 5 (BTBD5, Accession NP_060128.1). Accordingly, utilities of GAM3298 include diagnosis, prevention and treatment of diseases and clinical conditions associated with BTBD5.

Butyrophilin, subfamily 1, member a1 (BTN1A1, Accession NP_001723.1) is another GAM3298 target gene, herein designated TARGET GENE. BTN1A1 BINDING SITE is a target binding site found in the 3' untranslated region of mRNA encoded by BTN1A1, corresponding to a target binding site such as BINDING SITE I, BINDING SITE II or BINDING SITE III of FIG. 8. Table 4 illustrates the complementarity of the nucleotide sequences of BTN1A1 BINDING SITE, designated SEQ ID:6923, to the nucleotide sequence of GAM3298 RNA, herein designated GAM RNA, also designated SEQ ID:259.

Another function of GAM3298 is therefore inhibition of Butyrophilin, subfamily 1, member a1 (BTN1A1, Accession NP_001723.1). Accordingly, utilities of GAM3298 include diagnosis, prevention and treatment of diseases and clinical conditions associated with BTN1A1.

Butyrophilin, subfamily 3, member a1 (BTN3A1, Accession NP_008979.2) is another GAM3298 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:2811, to the nucleotide sequence of GAM3298 RNA, herein designated GAM RNA, also designated SEQ ID:259.

Another function of GAM3298 is therefore inhibition of Butyrophilin, subfamily 3, member a1 (BTN3A1, Accession NP_008979.2). Accordingly, utilities of GAM3298 include diagnosis, prevention and treatment of diseases and clinical conditions associated with BTN3A1.

Butyrophilin, subfamily 3, member a2 (BTN3A2, Accession NP_008978.1) is another GAM3298 target gene, herein designated TARGET GENE. BTN3A2 BINDING SITE is a target binding site found in the 3' untranslated region of mRNA encoded by BTN3A2, corresponding to a target binding site such as BINDING SITE I, BINDING SITE II or BINDING SITE III of FIG. 8. Table 4 illustrates the complementarity of the nucleotide sequences of BTN3A2 BINDING SITE, designated SEQ ID:16180, to the nucleotide sequence of GAM3298 RNA, herein designated GAM RNA, also designated SEQ ID:259.

Another function of GAM3298 is therefore inhibition of Butyrophilin, subfamily 3, member a2 (BTN3A2, Accession NP_008978.1). Accordingly, utilities of GAM3298 include diagnosis, prevention and treatment of diseases and clinical conditions associated with BTN3A2.

C14orf145 (Accession NP_689659.1) is another GAM3298 target gene, herein designated TARGET GENE. C14orf145 BINDING SITE is a target binding site found in the 3' untranslated region of mRNA encoded by C14orf145, corresponding to a target binding site such as BINDING SITE I, BINDING SITE II or BINDING SITE III of FIG. 8. Table 4 illustrates the complementarity of the nucleotide sequences of C14orf145 BINDING SITE, designated SEQ ID:11312, to the nucleotide sequence of GAM3298 RNA, herein designated GAM RNA, also designated SEQ ID:259.

Another function of GAM3298 is therefore inhibition of C14orf145 (Accession NP_689659.1). Accordingly, utilities of GAM3298 include diagnosis, prevention and treatment of diseases and clinical conditions associated with C14orf145.

C14orf52 (Accession NP_660148.1) is another GAM3298 target gene, herein designated TARGET GENE. C14orf52 BINDING SITE is a target binding site found in the 3' untranslated region of mRNA encoded by C14orf52, corresponding to a target binding site such as BINDING SITE I, BINDING SITE II or BINDING SITE III of FIG. 8. Table 4 illustrates the complementarity of the nucleotide sequences of C14orf52 BINDING SITE, designated SEQ ID:14163, to the nucleotide sequence of GAM3298 RNA, herein designated GAM RNA, also designated SEQ ID:259.

Another function of GAM3298 is therefore inhibition of C14orf52 (Accession NP_660148.1). Accordingly, utilities of GAM3298 include diagnosis, prevention and treatment of diseases and clinical conditions associated with C14orf52.

Chromosome 1 open reading frame 34 (C1orf34, Accession XP_027172.1) is another GAM3298 target gene, herein designated TARGET GENE. C1orf34 BINDING SITE is a target binding site found in the 3' untranslated region of mRNA encoded by C1orf34, corresponding to a target binding site such as BINDING SITE I, BINDING SITE II or BINDING SITE III of FIG. 8. Table 4 illustrates the complementarity of the nucleotide sequences of C1orf34 BINDING SITE, designated SEQ ID:840, to the nucleotide sequence of GAM3298 RNA, herein designated GAM RNA, also designated SEQ ID:259.

Another function of GAM3298 is therefore inhibition of Chromosome 1 open reading frame 34 (C1orf34, Accession XP_027172.1). Accordingly, utilities of GAM3298 include diagnosis, prevention and treatment of diseases and clinical conditions associated with C1orf34.

Chromosome 20 open reading frame 11 (C20orf11, Accession NP_060366.1) is another GAM3298 target gene, herein designated TARGET GENE. C20orf11 BINDING SITE is a target binding site found in the 3' untranslated region of mRNA encoded by C20orf11, corresponding to a target binding site such as BINDING SITE I, BINDING SITE II or BINDING SITE III of FIG. 8. Table 4 illustrates the complementarity of the nucleotide sequences of C20orf11 BIND- ING SITE, designated SEQ ID:19207, to the nucleotide sequence of GAM3298 RNA, herein designated GAM RNA, also designated SEQ ID:259.

Another function of GAM3298 is therefore inhibition of Chromosome 20 open reading frame 11 (C20orf11, Accession NP_060366.1). Accordingly, utilities of GAM3298 include diagnosis, prevention and treatment of diseases and clinical conditions associated with C20orf11.

Chromosome 20 open reading frame 129 (C20orf129, Accession NP_112181.1) is another GAM3298 target gene, herein designated TARGET GENE. C20orf129 BINDING SITE is a target binding site found in the 3' untranslated region of mRNA encoded by C20orf129, corresponding to a target binding site such as BINDING SITE I, BINDING SITE II or BINDING SITE III of FIG. 8. Table 4 illustrates the complementarity of the nucleotide sequences of C20orf129 BINDING SITE, designated SEQ ID:7920, to the nucleotide sequence of GAM3298 RNA, herein designated GAM RNA, also designated SEQ ID:259.

Another function of GAM3298 is therefore inhibition of Chromosome 20 open reading frame 129 (C20orf129, Accession NP_112181.1). Accordingly, utilities of GAM3298 include diagnosis, prevention and treatment of diseases and clinical conditions associated with C20orf129.

Chromosome 20 open reading frame 164 (C20orf164, Accession NP_542790.1) is another GAM3298 target gene, herein designated TARGET GENE. C20orf164 BINDING SITE is a target binding site found in the 3' untranslated region of mRNA encoded by C20orf164, corresponding to a target binding site such as BINDING SITE I, BINDING SITE II or BINDING SITE III of FIG. 8. Table 4 illustrates the complementarity of the nucleotide sequences of C20orf164 BINDING SITE, designated SEQ ID:9547, to the nucleotide sequence of GAM3298 RNA, herein designated GAM RNA, also designated SEQ ID:259.

Another function of GAM3298 is therefore inhibition of Chromosome 20 open reading frame 164 (C20orf164, Accession NP_542790.1). Accordingly, utilities of GAM3298 include diagnosis, prevention and treatment of diseases and clinical conditions associated with C20orf164.

Chromosome 20 open reading frame 169 (C20orf169, Accession NP_291020.1) is another GAM3298 target gene, herein designated TARGET GENE. C20orf169 BINDING SITE is a target binding site found in the 3' untranslated region of mRNA encoded by C20orf169, corresponding to a target binding site such as BINDING SITE I, BINDING SITE II or BINDING SITE III of FIG. 8. Table 4 illustrates the complementarity of the nucleotide sequences of C20orf169 BINDING SITE, designated SEQ ID:16567, to the nucleotide sequence of GAM3298 RNA, herein designated GAM RNA, also designated SEQ ID:259.

Another function of GAM3298 is therefore inhibition of Chromosome 20 open reading frame 169 (C20orf169, Accession NP_291020.1). Accordingly, utilities of GAM3298 include diagnosis, prevention and treatment of diseases and clinical conditions associated with C20orf169.

C6orf96 (Accession NP_060379.1) is another GAM3298 target gene, herein designated TARGET GENE. C6orf96 BINDING SITE is a target binding site found in the 3' untranslated region of mRNA encoded by C6orf96, corresponding to a target binding site such as BINDING SITE I, BINDING SITE II or BINDING SITE III of FIG. 8. Table 4 illustrates the complementarity of the nucleotide sequences of C6orf96 BINDING SITE, designated SEQ ID:3433, to the nucleotide sequence of GAM3298 RNA, herein designated GAM RNA, also designated SEQ ID:259.

Another function of GAM3298 is therefore inhibition of C6orf96 (Accession NP_060379.1). Accordingly, utilities of GAM3298 include diagnosis, prevention and treatment of diseases and clinical conditions associated with C6orf96.

Calcium-binding tyrosine-(y)-phosphorylation regulated (fibrousheathin 2) (CABy, Accession NP_722452.1) is another GAM3298 target gene, herein designated TARGET GENE. CABYR BINDING SITE is a target binding site found in the 3' untranslated region of multiple transcripts of mRNA encoded by CABy, corresponding to a target binding site such as BINDING SITE I, BINDING SITE II or BINDING SITE III of FIG. 8. Table 4 illustrates the complementarity of the nucleotide sequences of CABYR BINDING SITE, designated SEQ ID:5933, to the nucleotide sequence of GAM3298 RNA, herein designated GAM RNA, also designated SEQ ID:259.

Another function of GAM3298 is therefore inhibition of Calcium-binding tyrosine-(y)-phosphorylation regulated (fibrousheathin 2) (CABy, Accession NP_722452.1). Accordingly, utilities of GAM3298 include diagnosis, prevention and treatment of diseases and clinical conditions associated with CABYR.

Calcium-binding tyrosine-(y)-phosphorylation regulated (fibrousheathin 2) (CABy, Accession NP_036321.2) is another GAM3298 target gene, herein designated TARGET GENE. CABYR BINDING SITE is a target binding site found in the 3' untranslated region of multiple transcripts of mRNA encoded by CABy, corresponding to a target binding site such as BINDING SITE I, BINDING SITE II or BINDING SITE III of FIG. 8. Table 4 illustrates the complementarity of the nucleotide sequences of CABYR BINDING SITE, designated SEQ ID:5933, to the nucleotide sequence of GAM3298 RNA, herein designated GAM RNA, also designated SEQ ID:259.

Another function of GAM3298 is therefore inhibition of Calcium-binding tyrosine-(y)-phosphorylation regulated (fibrousheathin 2) (CABy, Accession NP_036321.2). Accordingly, utilities of GAM3298 include diagnosis, prevention and treatment of diseases and clinical conditions associated with CABYR.

Calcium/calmodulin-dependent protein kinase (cam kinase) ii delta (CAMK2D, Accession NP_742125.1) is another GAM3298 target gene, herein designated TARGET GENE. CAMK2D BINDING SITE is a target binding site found in the 3' untranslated region of multiple transcripts of mRNA encoded by CAMK2D, corresponding to a target binding site such as BINDING SITE I, BINDING SITE II or BINDING SITE III of FIG. 8. Table 4 illustrates the complementarity of the nucleotide sequences of CAMK2D BINDING SITE, designated SEQ ID:879, to the nucleotide sequence of GAM3298 RNA, herein designated GAM RNA, also designated SEQ ID:259.

Another function of GAM3298 is therefore inhibition of Calcium/calmodulin-dependent protein kinase (cam kinase) ii delta (CAMK2D, Accession NP_742125.1). Accordingly, utilities of GAM3298 include diagnosis, prevention and treatment of diseases and clinical conditions associated with CAMK2D.

Calcium/calmodulin-dependent protein kinase (cam kinase) ii delta (CAMK2D, Accession NP_742126.1) is another GAM3298 target gene, herein designated TARGET GENE. CAMK2D BINDING SITE is a target binding site found in the 3' untranslated region of multiple transcripts of mRNA encoded by CAMK2D, corresponding to a target binding site such as BINDING SITE I, BINDING SITE II or BINDING SITE III of FIG. 8. Table 4 illustrates the complementarity of the nucleotide sequences of CAMK2D BIND- ING SITE, designated SEQ ID:879, to the nucleotide sequence of GAM3298 RNA, herein designated GAM RNA, also designated SEQ ID:259.

Another function of GAM3298 is therefore inhibition of Calcium/calmodulin-dependent protein kinase (cam kinase) ii delta (CAMK2D, Accession NP_742126.1). Accordingly, utilities of GAM3298 include diagnosis, prevention and treatment of diseases and clinical conditions associated with CAMK2D.

Cd28 antigen (tp44) (CD28, Accession NP_006130.1) is another GAM3298 target gene, herein designated TARGET GENE. CD28 BINDING SITE is a target binding site found in the 3' untranslated region of mRNA encoded by CD28, corresponding to a target binding site such as BINDING SITE I, BINDING SITE II or BINDING SITE III of FIG. 8. Table 4 illustrates the complementarity of the nucleotide sequences of CD28 BINDING SITE, designated SEQ ID:6352, to the nucleotide sequence of GAM3298 RNA, herein designated GAM RNA, also designated SEQ ID:259.

Another function of GAM3298 is therefore inhibition of Cd28 antigen (tp44) (CD28, Accession NP_006130.1), a gene which possibly involved in t-cell activation. Accordingly, utilities of GAM3298 include diagnosis, prevention and treatment of diseases and clinical conditions associated with CD28.

The function of CD28 and its association with various diseases and clinical conditions, has been established by previous studies, as described hereinabove with reference to GAM94.1. Cd68 antigen (CD68, Accession NP_001242.1) is another GAM3298 target gene, herein designated TARGET GENE. CD68 BINDING SITE is a target binding site found in the 3' untranslated region of mRNA encoded by CD68, corresponding to a target binding site such as BINDING SITE I, BINDING SITE II or BINDING SITE III of FIG. 8. Table 4 illustrates the complementarity of the nucleotide sequences of CD68 BINDING SITE, designated SEQ ID:3706, to the nucleotide sequence of GAM3298 RNA, herein designated GAM RNA, also designated SEQ ID:259.

Another function of GAM3298 is therefore inhibition of Cd68 antigen (CD68, Accession NP_001242.1), a gene which is highly expressed by human monocytes and tissue macrophages. Accordingly, utilities of GAM3298 include diagnosis, prevention and treatment of diseases and clinical conditions associated with CD68.

The function of CD68 and its association with various diseases and clinical conditions, has been established by previous studies, as described hereinabove with reference to GAM347.1. Congenital dyserythropoietic anemia, type i (CDAN1, Accession XP_085300.3) is another GAM3298 target gene, herein designated TARGET GENE. CDAN1 BINDING SITE is a target binding site found in the 3' untranslated region of mRNA encoded by CDAN1, corresponding to a target binding site such as BINDING SITE I, BINDING SITE II or BINDING SITE III of FIG. 8. Table 4 illustrates the complementarity of the nucleotide sequences of CDAN1 BINDING SITE, designated SEQ ID:12246, to the nucleotide sequence of GAM3298 RNA, herein designated GAM RNA, also designated SEQ ID:259.

Another function of GAM3298 is therefore inhibition of Congenital dyserythropoietic anemia, type i (CDAN1, Accession XP_085300.3). Accordingly, utilities of GAM3298 include diagnosis, prevention and treatment of diseases and clinical conditions associated with CDAN1.

Cofilin 2 (muscle) (CFL2, Accession NP_068733.1) is another GAM3298 target gene, herein designated TARGET GENE. CFL2 BINDING SITE is a target binding site found in the 3' untranslated region of mRNA encoded by CFL2, corresponding to a target binding site such as BINDING SITE I, BINDING SITE II or BINDING SITE III of FIG. 8. Table 4 illustrates the complementarity of the nucleotide sequences of CFL2 BINDING SITE, designated SEQ ID:16417, to the nucleotide sequence of GAM3298 RNA, herein designated GAM RNA, also designated SEQ ID:259.

Another function of GAM3298 is therefore inhibition of Cofilin 2 (muscle) (CFL2, Accession NP_068733.1). Accordingly, utilities of GAM3298 include diagnosis, prevention and treatment of diseases and clinical conditions associated with CFL2.

Claudin 15 (CLDN15, Accession NP_612438.1) is another GAM3298 target gene, herein designated TARGET GENE. CLDN15 BINDING SITE is a target binding site found in the 3' untranslated region of multiple transcripts of mRNA encoded by CLDN15, corresponding to a target binding site such as BINDING SITE I, BINDING SITE II or BINDING SITE III of FIG. 8. Table 4 illustrates the complementarity of the nucleotide sequences of CLDN15 BINDING SITE, designated SEQ ID:16467, to the nucleotide sequence of GAM3298 RNA, herein designated GAM RNA, also designated SEQ ID:259.

Another function of GAM3298 is therefore inhibition of Claudin 15 (CLDN15, Accession NP_612438.1). Accordingly, utilities of GAM3298 include diagnosis, prevention and treatment of diseases and clinical conditions associated with CLDN15.

Cyclin m3 (CNNM3, Accession NP_060093.2) is another GAM3298 target gene, herein designated TARGET GENE. CNNM3 BINDING SITE is a target binding site found in the 3' untranslated region of mRNA encoded by CNNM3, corresponding to a target binding site such as BINDING SITE I, BINDING SITE II or BINDING SITE III of FIG. 8. Table 4 illustrates the complementarity of the nucleotide sequences of CNNM3 BINDING SITE, designated SEQ ID:1930, to the nucleotide sequence of GAM3298 RNA, herein designated GAM RNA, also designated SEQ ID:259.

Another function of GAM3298 is therefore inhibition of Cyclin m3 (CNNM3, Accession NP_060093.2). Accordingly, utilities of GAM3298 include diagnosis, prevention and treatment of diseases and clinical conditions associated with CNNM3.

Coatomer protein complex, subunit alpha (COPA, Accession NP_004362.1) is another GAM3298 target gene, herein designated TARGET GENE. COPA BINDING SITE is a target binding site found in the 3' untranslated region of mRNA encoded by COPA, corresponding to a target binding site such as BINDING SITE I, BINDING SITE II or BINDING SITE III of FIG. 8. Table 4 illustrates the complementarity of the nucleotide sequences of COPA BINDING SITE, designated SEQ ID:815, to the nucleotide sequence of GAM3298 RNA, herein designated GAM RNA, also designated SEQ ID:259.

Another function of GAM3298 is therefore inhibition of Coatomer protein complex, subunit alpha (COPA, Accession NP_004362.1), a gene which is invovled protein transport between the endoplasmic reticulum (ER) and Golgi compartments. Accordingly, utilities of GAM3298 include diagnosis, prevention and treatment of diseases and clinical conditions associated with COPA.

The function of COPA and its association with various diseases and clinical conditions, has been established by previous studies, as described hereinabove with reference to GAM47.1. CRN (Accession NP_006578.2) is another GAM3298 target gene, herein designated TARGET GENE. CRN BINDING SITE is a target binding site found in the 3' untranslated region of mRNA encoded by CRN, corresponding to a target binding site such as BINDING SITE I, BINDING SITE II or BINDING SITE III of FIG. 8. Table 4 illustrates the complementarity of the nucleotide sequences of CRN BINDING SITE, designated SEQ ID:5868, to the nucleotide sequence of GAM3298 RNA, herein designated GAM RNA, also designated SEQ ID:259.

Another function of GAM3298 is therefore inhibition of CRN (Accession NP_006578.2). Accordingly, utilities of GAM3298 include diagnosis, prevention and treatment of diseases and clinical conditions associated with CRN.

CRTAM (Accession NP_062550.1) is another GAM3298 target gene, herein designated TARGET GENE. CRTAM BINDING SITE is a target binding site found in the 3' untranslated region of mRNA encoded by CRTAM, corresponding to a target binding site such as BINDING SITE I, BINDING SITE II or BINDING SITE III of FIG. 8. Table 4 illustrates the complementarity of the nucleotide sequences of CRTAM BINDING SITE, designated SEQ ID:840, to the nucleotide sequence of GAM3298 RNA, herein designated GAM RNA, also designated SEQ ID:259.

Another function of GAM3298 is therefore inhibition of CRTAM (Accession NP_062550.1). Accordingly, utilities of GAM3298 include diagnosis, prevention and treatment of diseases and clinical conditions associated with CRTAM.

CT120 (Accession NP_079068.1) is another GAM3298 target gene, herein designated TARGET GENE. CT120 BINDING SITE is a target binding site found in the 3' untranslated region of mRNA encoded by CT120, corresponding to a target binding site such as BINDING SITE I, BINDING SITE II or BINDING SITE III of FIG. 8. Table 4 illustrates the complementarity of the nucleotide sequences of CT120 BINDING SITE, designated SEQ ID:13728, to the nucleotide sequence of GAM3298 RNA, herein designated GAM RNA, also designated SEQ ID:259.

Another function of GAM3298 is therefore inhibition of CT120 (Accession NP_079068.1). Accordingly, utilities of GAM3298 include diagnosis, prevention and treatment of diseases and clinical conditions associated with CT120.

CYCS (Accession NP_061820.1) is another GAM3298 target gene, herein designated TARGET GENE. CYCS BINDING SITE is a target binding site found in the 3' untranslated region of mRNA encoded by CYCS, corresponding to a target binding site such as BINDING SITE I, BINDING SITE II or BINDING SITE III of FIG. 8. Table 4 illustrates the complementarity of the nucleotide sequences of CYCS BINDING SITE, designated SEQ ID:5995, to the nucleotide sequence of GAM3298 RNA, herein designated GAM RNA, also designated SEQ ID:259.

Another function of GAM3298 is therefore inhibition of CYCS (Accession NP_061820.1). Accordingly, utilities of GAM3298 include diagnosis, prevention and treatment of diseases and clinical conditions associated with CYCS.

Dolichyl-diphosphooligosaccharide-protein glycosyltransferase (DDOST, Accession NP_005207.2) is another GAM3298 target gene, herein designated TARGET GENE. DDOST BINDING SITE is a target binding site found in the 3' untranslated region of mRNA encoded by DDOST, corresponding to a target binding site such as BINDING SITE I, BINDING SITE II or BINDING SITE III of FIG. 8. Table 4 illustrates the complementarity of the nucleotide sequences of DDOST BINDING SITE, designated SEQ ID:3706, to the nucleotide sequence of GAM3298 RNA, herein designated GAM RNA, also designated SEQ ID:259.

Another function of GAM3298 is therefore inhibition of Dolichyl-diphosphooligosaccharide-protein glycosyltransferase (DDOST, Accession NP_005207.2), a gene which transfers high-mannose oligosaccharides to nascent polypeptides. Accordingly, utilities of GAM3298 include diagnosis, prevention and treatment of diseases and clinical conditions associated with DDOST.

The function of DDOST and its association with various diseases and clinical conditions, has been established by previous studies, as described hereinabove with reference to GAM347.2. DDX51 (Accession NP_778236.1) is another GAM3298 target gene, herein designated TARGET GENE. DDX51 BINDING SITE1 and DDX51 BINDING SITE2 are target binding sites found in untranslated regions of mRNA encoded by DDX51, corresponding to target binding sites such as BINDING SITE I, BINDING SITE II or BINDING SITE III of FIG. 8. Table 4 illustrates the complementarity of the nucleotide sequences of DDX51 BINDING SITE1 and DDX51 BINDING SITE2, designated SEQ ID:5949 and SEQ ID:6665 respectively, to the nucleotide sequence of GAM3298 RNA, herein designated GAM RNA, also designated SEQ ID:259.

Another function of GAM3298 is therefore inhibition of DDX51 (Accession NP_778236.1). Accordingly, utilities of GAM3298 include diagnosis, prevention and treatment of diseases and clinical conditions associated with DDX51.

DDX54 (Accession NP_076977.2) is another GAM3298 target gene, herein designated TARGET GENE. DDX54 BINDING SITE is a target binding site found in the 3' untranslated region of mRNA encoded by DDX54, corresponding to a target binding site such as BINDING SITE I, BINDING SITE II or BINDING SITE III of FIG. 8. Table 4 illustrates the complementarity of the nucleotide sequences of DDX54 BINDING SITE, designated SEQ ID:8510, to the nucleotide sequence of GAM3298 RNA, herein designated GAM RNA, also designated SEQ ID:259.

Another function of GAM3298 is therefore inhibition of DDX54 (Accession NP_076977.2). Accordingly, utilities of GAM3298 include diagnosis, prevention and treatment of diseases and clinical conditions associated with DDX54.

Dead/h (asp-glu-ala-asp/his) box polypeptide 9 (rna helicase a, nuclear dna helicase ii; leukophysin) (DDX9, Accession NP_085077.1) is another GAM3298 target gene, herein designated TARGET GENE. DDX9 BINDING SITE is a target binding site found in the 5' untranslated region of multiple transcripts of mRNA encoded by DDX9, corresponding to a target binding site such as BINDING SITE I, BINDING SITE II or BINDING SITE III of FIG. 8. Table 4 illustrates the complementarity of the nucleotide sequences of DDX9 BINDING SITE, designated SEQ ID:12897, to the nucleotide sequence of GAM3298 RNA, herein designated GAM RNA, also designated SEQ ID:259.

Another function of GAM3298 is therefore inhibition of Dead/h (asp-glu-ala-asp/his) box polypeptide 9 (rna helicase a, nuclear dna helicase ii; leukophysin) (DDX9, Accession NP_085077.1), a gene which plays an important role in transcription, RNA processing, translation, and RNA replication. Accordingly, utilities of GAM3298 include diagnosis, prevention and treatment of diseases and clinical conditions associated with DDX9.

The function of DDX9 and its association with various diseases and clinical conditions, has been established by previous studies, as described hereinabove with reference to GAM139.1. DKFZp434E1119 (Accession XP_210937.1) is another GAM3298 target gene, herein designated TARGET GENE. DKFZp434E1119 BINDING SITE is a target binding site found in the 3' untranslated region of mRNA encoded by DKFZp434E1119, corresponding to a target binding site such as BINDING SITE I, BINDING SITE II or BINDING SITE III of FIG. 8. Table 4 illustrates the complementarity of the nucleotide sequences of DKFZp434E1119 BINDING SITE, designated SEQ ID:13379, to the nucleotide sequence of GAM3298 RNA, herein designated GAM RNA, also designated SEQ ID:259.

Another function of GAM3298 is therefore inhibition of DKFZp434E1119 (Accession XP_210937.1). Accordingly, utilities of GAM3298 include diagnosis, prevention and treatment of diseases and clinical conditions associated with DKFZp434E1119.

DKFZP586C1324 (Accession XP_045876.1) is another GAM3298 target gene, herein designated TARGET GENE. DKFZP586C1324 BINDING SITE is a target binding site found in the 3' untranslated region of mRNA encoded by DKFZP586C1324, corresponding to a target binding site such as BINDING SITE I, BINDING SITE II or BINDING SITE III of FIG. 8. Table 4 illustrates the complementarity of the nucleotide sequences of DKFZP586C1324 BINDING SITE, designated SEQ ID:13787, to the nucleotide sequence of GAM3298 RNA, herein designated GAM RNA, also designated SEQ ID:259.

Another function of GAM3298 is therefore inhibition of DKFZP586C1324 (Accession XP_045876.1). Accordingly, utilities of GAM3298 include diagnosis, prevention and treatment of diseases and clinical conditions associated with DKFZP586C1324.

DKFZp761G058 (Accession NP_689755.2) is another GAM3298 target gene, herein designated TARGET GENE. DKFZp761G058 BINDING SITE is a target binding site found in the 3' untranslated region of mRNA encoded by DKFZp761G058, corresponding to a target binding site such as BINDING SITE I, BINDING SITE II or BINDING SITE III of FIG. 8. Table 4 illustrates the complementarity of the nucleotide sequences of DKFZp761G058 BINDING SITE, designated SEQ ID:3706, to the nucleotide sequence of GAM3298 RNA, herein designated GAM RNA, also designated SEQ ID:259.

Another function of GAM3298 is therefore inhibition of DKFZp761G058 (Accession NP_689755.2). Accordingly, utilities of GAM3298 include diagnosis, prevention and treatment of diseases and clinical conditions associated with DKFZp761G058.

DKFZP761G1913 (Accession NP_113662.1) is another GAM3298 target gene, herein designated TARGET GENE. DKFZP761G1913 BINDING SITE is a target binding site found in the 3' untranslated region of mRNA encoded by DKFZP761G1913, corresponding to a target binding site such as BINDING SITE I, BINDING SITE II or BINDING SITE III of FIG. 8. Table 4 illustrates the complementarity of the nucleotide sequences of DKFZP761G1913 BINDING SITE, designated SEQ ID:3706, to the nucleotide sequence of GAM3298 RNA, herein designated GAM RNA, also designated SEQ ID:259.

Another function of GAM3298 is therefore inhibition of DKFZP761G1913 (Accession NP_113662.1). Accordingly, utilities of GAM3298 include diagnosis, prevention and treatment of diseases and clinical conditions associated with DKFZP761G1913.

DKFZp761K1423 (Accession NP_060892.1) is another GAM3298 target gene, herein designated TARGET GENE. DKFZp761K1423 BINDING SITE is a target binding site found in the 5' untranslated region of mRNA encoded by DKFZp761K1423, corresponding to a target binding site such as BINDING SITE I, BINDING SITE II or BINDING SITE III of FIG. 8. Table 4 illustrates the complementarity of the nucleotide sequences of DKFZp761K1423 BINDING SITE, designated SEQ ID:13788, to the nucleotide sequence of GAM3298 RNA, herein designated GAM RNA, also designated SEQ ID:259.

Another function of GAM3298 is therefore inhibition of DKFZp761K1423 (Accession NP_060892.1). Accordingly, utilities of GAM3298 include diagnosis, prevention and treatment of diseases and clinical conditions associated with DKFZp761K1423.

Endothelial differentiation, sphingolipid g-protein-coupled receptor, 3 (EDG3, Accession NP_005217.1) is another GAM3298 target gene, herein designated TARGET GENE. EDG3 BINDING SITE is a target binding site found in the 5' untranslated region of mRNA encoded by EDG3, corresponding to a target binding site such as BINDING SITE I, BINDING SITE II or BINDING SITE III of FIG. 8. Table 4 illustrates the complementarity of the nucleotide sequences of EDG3 BINDING SITE, designated SEQ ID:6456, to the nucleotide sequence of GAM3298 RNA, herein designated GAM RNA, also designated SEQ ID:259.

Another function of GAM3298 is therefore inhibition of Endothelial differentiation, sphingolipid g-protein-coupled receptor, 3 (EDG3, Accession NP_005217.1). Accordingly, utilities of GAM3298 include diagnosis, prevention and treatment of diseases and clinical conditions associated with EDG3.

Eukaryotic translation initiation factor 2c, 1 (EIF2C1, Accession NP_036331.1) is another GAM3298 target gene, herein designated TARGET GENE. EIF2C1 BINDING SITE is a target binding site found in the 3' untranslated region of mRNA encoded by EIF2C1, corresponding to a target binding site such as BINDING SITE I, BINDING SITE II or BINDING SITE III of FIG. 8. Table 4 illustrates the complementarity of the nucleotide sequences of EIF2C1 BINDING SITE, designated SEQ ID:17274, to the nucleotide sequence of GAM3298 RNA, herein designated GAM RNA, also designated SEQ ID:259.

Another function of GAM3298 is therefore inhibition of Eukaryotic translation initiation factor 2c, 1 (EIF2C1, Accession NP_036331.1), a gene which plays an important role in the eukaryotic peptide chain initiation process. Accordingly, utilities of GAM3298 include diagnosis, prevention and treatment of diseases and clinical conditions associated with EIF2C1.

The function of EIF2C1 and its association with various diseases and clinical conditions, has been established by previous studies, as described hereinabove with reference to GAM223.1. Erythrocyte membrane protein band 4.1 like 4b (EPB41L4B, Accession NP_061987.2) is another GAM3298 target gene, herein designated TARGET GENE. EPB41L4B BINDING SITE is a target binding site found in the 3' untranslated region of multiple transcripts of mRNA encoded by EPB41L4B, corresponding to a target binding site such as BINDING SITE I, BINDING SITE II or BINDING SITE III of FIG. 8. Table 4 illustrates the complementarity of the nucleotide sequences of EPB41L4B BINDING SITE, designated SEQ ID:5651, to the nucleotide sequence of GAM3298 RNA, herein designated GAM RNA, also designated SEQ ID:259.

Another function of GAM3298 is therefore inhibition of Erythrocyte membrane protein band 4.1 like 4b (EPB41L4B, Accession NP_061987.2). Accordingly, utilities of GAM3298 include diagnosis, prevention and treatment of diseases and clinical conditions associated with EPB41L4B.

ERAP140 (Accession XP_059748.2) is another GAM3298 target gene, herein designated TARGET GENE. ERAP140 BINDING SITE is a target binding site found in the 3' untranslated region of mRNA encoded by ERAP140, corresponding to a target binding site such as BINDING SITE I, BINDING SITE II or BINDING SITE III of FIG. 8. Table 4 illustrates the complementarity of the nucleotide sequences of ERAP140 BINDING SITE, designated SEQ ID:7576, to the nucleotide sequence of GAM3298 RNA, herein designated GAM RNA, also designated SEQ ID:259.

Another function of GAM3298 is therefore inhibition of ERAP140 (Accession XP_059748.2). Accordingly, utilities of GAM3298 include diagnosis, prevention and treatment of diseases and clinical conditions associated with ERAP140.

V-erb-b2 erythroblastic leukemia viral oncogene homolog 3 (avian) (ERBB3, Accession NP_001973.1) is another GAM3298 target gene, herein designated TARGET GENE. ERBB3 BINDING SITE is a target binding site found in the 3' untranslated region of mRNA encoded by ERBB3, corresponding to a target binding site such as BINDING SITE I, BINDING SITE II or BINDING SITE III of FIG. 8. Table 4 illustrates the complementarity of the nucleotide sequences of ERBB3 BINDING SITE, designated SEQ ID:6353, to the nucleotide sequence of GAM3298 RNA, herein designated GAM RNA, also designated SEQ ID:259.

Another function of GAM3298 is therefore inhibition of V-erb-b2 erythroblastic leukemia viral oncogene homolog 3 (avian) (ERBB3, Accession NP_001973.1), a gene which binds and is activated by neuregulins and ntak. Accordingly, utilities of GAM3298 include diagnosis, prevention and treatment of diseases and clinical conditions associated with ERBB3.

The function of ERBB3 and its association with various diseases and clinical conditions, has been established by previous studies, as described hereinabove with reference to GAM63.1. ET (Accession NP_077287.1) is another GAM3298 target gene, herein designated TARGET GENE. ET BINDING SITE is a target binding site found in the 3' untranslated region of mRNA encoded by ET, corresponding to a target binding site such as BINDING SITE I, BINDING SITE II or BINDING SITE III of FIG. 8. Table 4 illustrates the complementarity of the nucleotide sequences of ET BINDING SITE, designated SEQ ID:1920, to the nucleotide sequence of GAM3298 RNA, herein designated GAM RNA, also designated SEQ ID:259.

Another function of GAM3298 is therefore inhibition of ET (Accession NP_077287.1). Accordingly, utilities of GAM3298 include diagnosis, prevention and treatment of diseases and clinical conditions associated with ET.

Epithelial v-like antigen 1 (EVA1, Accession NP_005788.1) is another GAM3298 target gene, herein designated TARGET GENE. EVA1 BINDING SITE is a target binding site found in the 3' untranslated region of multiple transcripts of mRNA encoded by EVA1, corresponding to a target binding site such as BINDING SITE I, BINDING SITE II or BINDING SITE III of FIG. 8. Table 4 illustrates the complementarity of the nucleotide sequences of EVA1 BINDING SITE, designated SEQ ID:11961, to the nucleotide sequence of GAM3298 RNA, herein designated GAM RNA, also designated SEQ ID:259.

Another function of GAM3298 is therefore inhibition of Epithelial v-like antigen 1 (EVA1, Accession NP_005788.1). Accordingly, utilities of GAM3298 include diagnosis, prevention and treatment of diseases and clinical conditions associated with EVA1.

Coagulation factor ii (thrombin) receptor-like 3 (F2RL3, Accession NP_003941.1) is another GAM3298 target gene, herein designated TARGET GENE. F2RL3 BINDING SITE is a target binding site found in the 3' untranslated region of mRNA encoded by F2RL3, corresponding to a target binding site such as BINDING SITE I, BINDING SITE II or BINDING SITE III of FIG. 8. Table 4 illustrates the complementarity of the nucleotide sequences of F2RL3 BINDING SITE, designated SEQ ID:12961, to the nucleotide sequence of GAM3298 RNA, herein designated GAM RNA, also designated SEQ ID:259.

Another function of GAM3298 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM3298 include diagnosis, prevention and treatment of diseases and clinical conditions associated with F2RL3.

The function of F2RL3 and its association with various diseases and clinical conditions, has been established by previous studies, as described hereinabove with reference to GAM72.1. Fanconi anemia, complementation group d2 (FANCD2, Accession NP_149075.2) is another GAM3298 target gene, herein designated TARGET GENE. FANCD2 BINDING SITE is a target binding site found in the 3' untranslated region of mRNA encoded by FANCD2, corresponding to a target binding site such as BINDING SITE I, BINDING SITE II or BINDING SITE III of FIG. 8. Table 4 illustrates the complementarity of the nucleotide sequences of FANCD2 BINDING SITE, designated SEQ ID:9757, to the nucleotide sequence of GAM3298 RNA, herein designated GAM RNA, also designated SEQ ID:259.

Another function of GAM3298 is therefore inhibition of Fanconi anemia, complementation group d2 (FANCD2, Accession NP_149075.2). Accordingly, utilities of GAM3298 include diagnosis, prevention and treatment of diseases and clinical conditions associated with FANCD2.

FBLP-1 (Accession XP_290943.1) is another GAM3298 target gene, herein designated TARGET GENE. FBLP-1 BINDING SITE is a target binding site found in the 3' untranslated region of multiple transcripts of mRNA encoded by FBLP-1, corresponding to a target binding site such as BINDING SITE I, BINDING SITE II or BINDING SITE III of FIG. 8. Table 4 illustrates the complementarity of the nucleotide sequences of FBLP-1 BINDING SITE, designated SEQ ID:3706, to the nucleotide sequence of GAM3298 RNA, herein designated GAM RNA, also designated SEQ ID:259.

Another function of GAM3298 is therefore inhibition of FBLP-1 (Accession XP_290943.1). Accordingly, utilities of GAM3298 include diagnosis, prevention and treatment of diseases and clinical conditions associated with FBLP-1.

F-box only protein 27 (FBXO27, Accession NP_849142.1) is another GAM3298 target gene, herein designated TARGET GENE. FBXO27 BINDING SITE is a target binding site found in the 3' untranslated region of multiple transcripts of mRNA encoded by FBXO27, corresponding to a target binding site such as BINDING SITE I, BINDING SITE II or BINDING SITE III of FIG. 8. Table 4 illustrates the complementarity of the nucleotide sequences of FBXO27 BINDING SITE, designated SEQ ID:3706, to the nucleotide sequence of GAM3298 RNA, herein designated GAM RNA, also designated SEQ ID:259.

Another function of GAM3298 is therefore inhibition of F-box only protein 27 (FBXO27, Accession NP_849142.1). Accordingly, utilities of GAM3298 include diagnosis, prevention and treatment of diseases and clinical conditions associated with FBXO27.

F-box only protein 27 (FBXO27, Accession XP_059045.1) is another GAM3298 target gene, herein designated TARGET GENE. FBXO27 BINDING SITE is a target binding site found in the 3' untranslated region of multiple transcripts of mRNA encoded by FBXO27, corresponding to a target binding site such as BINDING SITE I, BINDING SITE II or BINDING SITE III of FIG. 8. Table 4 illustrates the complementarity of the nucleotide sequences of FBXO27 BINDING SITE, designated SEQ ID:3706, to the nucleotide sequence of GAM3298 RNA, herein designated GAM RNA, also designated SEQ ID:259.

Another function of GAM3298 is therefore inhibition of F-box only protein 27 (FBXO27, Accession XP_059045.1). Accordingly, utilities of GAM3298 include diagnosis, prevention and treatment of diseases and clinical conditions associated with FBXO27.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075263.1) is another GAM3298 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:3706, to the nucleotide sequence of GAM3298 RNA, herein designated GAM RNA, also designated SEQ ID:259.

Another function of GAM3298 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075263.1). Accordingly, utilities of GAM3298 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075262.1) is another GAM3298 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:3706, to the nucleotide sequence of GAM3298 RNA, herein designated GAM RNA, also designated SEQ ID:259.

Another function of GAM3298 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075262.1). Accordingly, utilities of GAM3298 include diagnosis, prevention and treatment of diseases and clinical conditions associated with FGFR2.

Fk506 binding protein 14, 22 kda (FKBP14, Accession NP_060416.1) is another GAM3298 target gene, herein designated TARGET GENE. FKBP14 BINDING SITE1 and FKBP14 BINDING SITE2 are target binding sites found in untranslated regions of mRNA encoded by FKBP14, corresponding to target binding sites such as BINDING SITE I, BINDING SITE II or BINDING SITE III of FIG. 8. Table 4 illustrates the complementarity of the nucleotide sequences of FKBP14 BINDING SITE1 and FKBP14 BINDING SITE2, designated SEQ ID:3706 and SEQ ID:17308 respectively, to the nucleotide sequence of GAM3298 RNA, herein designated GAM RNA, also designated SEQ ID:259.

Another function of GAM3298 is therefore inhibition of Fk506 binding protein 14, 22 kda (FKBP14, Accession NP_060416.1). Accordingly, utilities of GAM3298 include diagnosis, prevention and treatment of diseases and clinical conditions associated with FKBP14.

FKSG17 (Accession NP_114420.1) is another GAM3298 target gene, herein designated TARGET GENE. FKSG17 BINDING SITE is a target binding site found in the 3' untranslated region of mRNA encoded by FKSG17, corresponding to a target binding site such as BINDING SITE I, BINDING SITE II or BINDING SITE III of FIG. 8. Table 4 illustrates the complementarity of the nucleotide sequences of FKSG17 BINDING SITE, designated SEQ ID:18744, to the nucleotide sequence of GAM3298 RNA, herein designated GAM RNA, also designated SEQ ID:259.

Another function of GAM3298 is therefore inhibition of FKSG17 (Accession NP_114420.1). Accordingly, utilities of GAM3298 include diagnosis, prevention and treatment of diseases and clinical conditions associated with FKSG17.

FLJ10058 (Accession NP_060455.1) is another GAM3298 target gene, herein designated TARGET GENE. FLJ10058 BINDING SITE is a target binding site found in the 3' untranslated region of mRNA encoded by FLJ10058, corresponding to a target binding site such as BINDING SITE I, BINDING SITE II or BINDING SITE III of FIG. 8. Table 4 illustrates the complementarity of the nucleotide sequences of FLJ10058 BINDING SITE, designated SEQ ID:841, to the nucleotide sequence of GAM3298 RNA, herein designated GAM RNA, also designated SEQ ID:259.

Another function of GAM3298 is therefore inhibition of FLJ10058 (Accession NP_060455.1). Accordingly, utilities of GAM3298 include diagnosis, prevention and treatment of diseases and clinical conditions associated with FLJ10058.

FLJ10665 (Accession NP_060643.1) is another GAM3298 target gene, herein designated TARGET GENE. FLJ10665 BINDING SITE is a target binding site found in the 3' untranslated region of mRNA encoded by FLJ10665, corresponding to a target binding site such as BINDING SITE I, BINDING SITE II or BINDING SITE III of FIG. 8. Table 4 illustrates the complementarity of the nucleotide sequences of FLJ10665 BINDING SITE, designated SEQ ID:3983, to the nucleotide sequence of GAM3298 RNA, herein designated GAM RNA, also designated SEQ ID:259.

Another function of GAM3298 is therefore inhibition of FLJ10665 (Accession NP_060643.1). Accordingly, utilities of GAM3298 include diagnosis, prevention and treatment of diseases and clinical conditions associated with FLJ10665.

FLJ10853 (Accession NP_060716.1) is another GAM3298 target gene, herein designated TARGET GENE. FLJ10853 BINDING SITE is a target binding site found in the 3' untranslated region of mRNA encoded by FLJ10853, corresponding to a target binding site such as BINDING SITE I, BINDING SITE II or BINDING SITE III of FIG. 8. Table 4 illustrates the complementarity of the nucleotide sequences of FLJ10853 BINDING SITE, designated SEQ ID:16806, to the nucleotide sequence of GAM3298 RNA, herein designated GAM RNA, also designated SEQ ID:259.

Another function of GAM3298 is therefore inhibition of FLJ10853 (Accession NP_060716.1). Accordingly, utilities of GAM3298 include diagnosis, prevention and treatment of diseases and clinical conditions associated with FLJ10853.

FLJ11011 (Accession NP_060769.1) is another GAM3298 target gene, herein designated TARGET GENE. FLJ11011 BINDING SITE is a target binding site found in the 3' untranslated region of mRNA encoded by FLJ11011, corresponding to a target binding site such as BINDING SITE I, BINDING SITE II or BINDING SITE III of FIG. 8. Table 4 illustrates the complementarity of the nucleotide sequences of FLJ11011 BINDING SITE, designated SEQ ID:1510, to the nucleotide sequence of GAM3298 RNA, herein designated GAM RNA, also designated SEQ ID:259.

Another function of GAM3298 is therefore inhibition of FLJ11011 (Accession NP_060769.1). Accordingly, utilities of GAM3298 include diagnosis, prevention and treatment of diseases and clinical conditions associated with FLJ11011.

FLJ11259 (Accession NP_060840.1) is another GAM3298 target gene, herein designated TARGET GENE. FLJ11259 BINDING SITE is a target binding site found in the 3' untranslated region of mRNA encoded by FLJ11259, corresponding to a target binding site such as BINDING SITE I, BINDING SITE II or BINDING SITE III of FIG. 8. Table 4 illustrates the complementarity of the nucleotide sequences of FLJ11259 BINDING SITE, designated SEQ ID:6479, to the nucleotide sequence of GAM3298 RNA, herein designated GAM RNA, also designated SEQ ID:259.

Another function of GAM3298 is therefore inhibition of FLJ11259 (Accession NP_060840.1). Accordingly, utilities of GAM3298 include diagnosis, prevention and treatment of diseases and clinical conditions associated with FLJ11259.

FLJ11267 (Accession NP_062553.1) is another GAM3298 target gene, herein designated TARGET GENE. FLJ11267 BINDING SITE is a target binding site found in the 3' untranslated region of mRNA encoded by FLJ11267, corresponding to a target binding site such as BINDING SITE I, BINDING SITE II or BINDING SITE III of FIG. 8. Table 4 illustrates the complementarity of the nucleotide sequences of FLJ11267 BINDING SITE, designated SEQ ID:3706, to the nucleotide sequence of GAM3298 RNA, herein designated GAM RNA, also designated SEQ ID:259.

Another function of GAM3298 is therefore inhibition of FLJ11267 (Accession NP_062553.1). Accordingly, utilities of GAM3298 include diagnosis, prevention and treatment of diseases and clinical conditions associated with FLJ11267.

FLJ11996 (Accession NP_079252.1) is another GAM3298 target gene, herein designated TARGET GENE. FLJ11996 BINDING SITE is a target binding site found in the 3' untranslated region of mRNA encoded by FLJ11996, corresponding to a target binding site such as BINDING SITE I, BINDING SITE II or BINDING SITE III of FIG. 8. Table 4 illustrates the complementarity of the nucleotide sequences of FLJ11996 BINDING SITE, designated SEQ ID:17309, to the nucleotide sequence of GAM3298 RNA, herein designated GAM RNA, also designated SEQ ID:259.

Another function of GAM3298 is therefore inhibition of FLJ11996 (Accession NP_079252.1). Accordingly, utilities of GAM3298 include diagnosis, prevention and treatment of diseases and clinical conditions associated with FLJ11996.

FLJ12132 (Accession NP_079256.2) is another GAM3298 target gene, herein designated TARGET GENE. FLJ12132 BINDING SITE is a target binding site found in the 3' untranslated region of mRNA encoded by FLJ12132, corresponding to a target binding site such as BINDING SITE I, BINDING SITE II or BINDING SITE III of FIG. 8. Table 4 illustrates the complementarity of the nucleotide sequences of FLJ12132 BINDING SITE, designated SEQ ID:18184, to the nucleotide sequence of GAM3298 RNA, herein designated GAM RNA, also designated SEQ ID:259.

Another function of GAM3298 is therefore inhibition of FLJ12132 (Accession NP_079256.2). Accordingly, utilities of GAM3298 include diagnosis, prevention and treatment of diseases and clinical conditions associated with FLJ12132.

FLJ12270 (Accession XP_290704.1) is another GAM3298target gene, herein designated TARGET GENE. FLJ12270 BINDING SITE is a target binding site found in the 3' untranslated region of mRNA encoded by FLJ12270, corresponding to a target binding site such as BINDING SITE I, BINDING SITE II or BINDING SITE III of FIG. 8. Table 4 illustrates the complementarity of the nucleotide sequences of FLJ12270 BINDING SITE, designated SEQ ID:19970, to the nucleotide sequence of GAM3298 RNA, herein designated GAM RNA, also designated SEQ ID:259.

Another function of GAM3298 is therefore inhibition of FLJ12270 (Accession XP_290704.1). Accordingly, utilities of GAM3298 include diagnosis, prevention and treatment of diseases and clinical conditions associated with FLJ12270.

FLJ12595 (Accession NP_079270.1) is another GAM3298 target gene, herein designated TARGET GENE. FLJ12595 BINDING SITE is a target binding site found in the 3' untranslated region of mRNA encoded by FLJ12595, corresponding to a target binding site such as BINDING SITE I, BINDING SITE II or BINDING SITE III of FIG. 8. Table 4 illustrates the complementarity of the nucleotide sequences of FLJ12595 BINDING SITE, designated SEQ ID:2951, to the nucleotide sequence of GAM3298 RNA, herein designated GAM RNA, also designated SEQ ID:259.

Another function of GAM3298 is therefore inhibition of FLJ12595 (Accession NP_079270.1). Accordingly, utilities of GAM3298 include diagnosis, prevention and treatment of diseases and clinical conditions associated with FLJ12595.

FLJ13114 (Accession NP_078817.1) is another GAM3298 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:14687, to the nucleotide sequence of GAM3298 RNA, herein designated GAM RNA, also designated SEQ ID:259.

Another function of GAM3298 is therefore inhibition of FLJ13114 (Accession NP_078817.1). Accordingly, utilities of GAM3298 include diagnosis, prevention and treatment of diseases and clinical conditions associated with FLJ13114.

FLJ13456 (Accession XP_038291.5) is another GAM3298 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:20122, to the nucleotide sequence of GAM3298 RNA, herein designated GAM RNA, also designated SEQ ID:259.

Another function of GAM3298 is therefore inhibition of FLJ13456 (Accession XP_038291.5). Accordingly, utilities of GAM3298 include diagnosis, prevention and treatment of diseases and clinical conditions associated with FLJ13456.

FLJ13621 (Accession NP_079285.1) is another GAM3298 target gene, herein designated TARGET GENE. FLJ13621 BINDING SITE is a target binding site found in the 3' untranslated region of mRNA encoded by FLJ13621, corresponding to a target binding site such as BINDING SITE I, BINDING SITE II or BINDING SITE III of FIG. 8. Table 4 illustrates the complementarity of the nucleotide sequences of FLJ13621 BINDING SITE, designated SEQ ID:16777, to the nucleotide sequence of GAM3298 RNA, herein designated GAM RNA, also designated SEQ ID:259.

Another function of GAM3298 is therefore inhibition of FLJ13621 (Accession NP_079285.1). Accordingly, utilities of GAM3298 include diagnosis, prevention and treatment of diseases and clinical conditions associated with FLJ13621.

FLJ14082 (Accession NP_079300.1) is another GAM3298 target gene, herein designated TARGET GENE.

FLJ14082 BINDING SITE is a target binding site found in the 3' untranslated region of mRNA encoded by FLJ14082, corresponding to a target binding site such as BINDING SITE I, BINDING SITE II or BINDING SITE III of FIG. 8. Table 4 illustrates the complementarity of the nucleotide sequences of FLJ14082 BINDING SITE, designated SEQ ID:13784, to the nucleotide sequence of GAM3298 RNA, herein designated GAM RNA, also designated SEQ ID:259.

Another function of GAM3298 is therefore inhibition of FLJ14082 (Accession NP_079300.1). Accordingly, utilities of GAM3298 include diagnosis, prevention and treatment of diseases and clinical conditions associated with FLJ14082.

FLJ14107 (Accession NP_079302.1) is another GAM3298 target gene, herein designated TARGET GENE. FLJ14107 BINDING SITE is a target binding site found in the 3' untranslated region of mRNA encoded by FLJ14107, corresponding to a target binding site such as BINDING SITE I, BINDING SITE II or BINDING SITE III of FIG. 8. Table 4 illustrates the complementarity of the nucleotide sequences of FLJ14107 BINDING SITE, designated SEQ ID:3706, to the nucleotide sequence of GAM3298 RNA, herein designated GAM RNA, also designated SEQ ID:259.

Another function of GAM3298 is therefore inhibition of FLJ14107 (Accession NP_079302.1). Accordingly, utilities of GAM3298 include diagnosis, prevention and treatment of diseases and clinical conditions associated with FLJ14107.

FLJ14399 (Accession NP_116169.2) is another GAM3298 target gene, herein designated TARGET GENE. FLJ14399 BINDING SITE is a target binding site found in the 3' untranslated region of mRNA encoded by FLJ14399, corresponding to a target binding site such as BINDING SITE I, BINDING SITE II or BINDING SITE III of FIG. 8. Table 4 illustrates the complementarity of the nucleotide sequences of FLJ14399 BINDING SITE, designated SEQ ID:7464, to the nucleotide sequence of GAM3298 RNA, herein designated GAM RNA, also designated SEQ ID:259.

Another function of GAM3298 is therefore inhibition of FLJ14399 (Accession NP_116169.2). Accordingly, utilities of GAM3298 include diagnosis, prevention and treatment of diseases and clinical conditions associated with FLJ14399.

FLJ14642 (Accession NP_116207.1) is another GAM3298 target gene, herein designated TARGET GENE. FLJ14642 BINDING SITE is a target binding site found in the 3' untranslated region of mRNA encoded by FLJ14642, corresponding to a target binding site such as BINDING SITE I, BINDING SITE II or BINDING SITE III of FIG. 8. Table 4 illustrates the complementarity of the nucleotide sequences of FLJ14642 BINDING SITE, designated SEQ ID:816, to the nucleotide sequence of GAM3298 RNA, herein designated GAM RNA, also designated SEQ ID:259.

Another function of GAM3298 is therefore inhibition of FLJ14642 (Accession NP_116207.1). Accordingly, utilities of GAM3298 include diagnosis, prevention and treatment of diseases and clinical conditions associated with FLJ14642.

FLJ14888 (Accession NP_116245.1) is another GAM3298 target gene, herein designated TARGET GENE. FLJ14888 BINDING SITE is a target binding site found in the 3' untranslated region of mRNA encoded by FLJ14888, corresponding to a target binding site such as BINDING SITE I, BINDING SITE II or BINDING SITE III of FIG. 8. Table 4 illustrates the complementarity of the nucleotide sequences of FLJ14888 BINDING SITE, designated SEQ ID:17382, to the nucleotide sequence of GAM3298 RNA, herein designated GAM RNA, also designated SEQ ID:259.

Another function of GAM3298 is therefore inhibition of FLJ14888 (Accession NP_116245.1). Accordingly, utilities of GAM3298 include diagnosis, prevention and treatment of diseases and clinical conditions associated with FLJ14888.

FLJ20059 (Accession NP_060114.1) is another GAM3298 target gene, herein designated TARGET GENE. FLJ20059 BINDING SITE is a target binding site found in the 3' untranslated region of mRNA encoded by FLJ20059, corresponding to a target binding site such as BINDING SITE I, BINDING SITE II or BINDING SITE III of FIG. 8. Table 4 illustrates the complementarity of the nucleotide sequences of FLJ20059 BINDING SITE, designated SEQ ID:841, to the nucleotide sequence of GAM3298 RNA, herein designated GAM RNA, also designated SEQ ID:259.

Another function of GAM3298 is therefore inhibition of FLJ20059 (Accession NP_060114.1). Accordingly, utilities of GAM3298 include diagnosis, prevention and treatment of diseases and clinical conditions associated with FLJ20059.

FLJ20359 (Accession NP_060251.1) is another GAM3298 target gene, herein designated TARGET GENE. FLJ20359 BINDING SITE is a target binding site found in the 3' untranslated region of mRNA encoded by FLJ20359, corresponding to a target binding site such as BINDING SITE I, BINDING SITE II or BINDING SITE III of FIG. 8. Table 4 illustrates the complementarity of the nucleotide sequences of FLJ20359 BINDING SITE, designated SEQ ID:3706, to the nucleotide sequence of GAM3298 RNA, herein designated GAM RNA, also designated SEQ ID:259.

Another function of GAM3298 is therefore inhibition of FLJ20359 (Accession NP_060251.1). Accordingly, utilities of GAM3298 include diagnosis, prevention and treatment of diseases and clinical conditions associated with FLJ20359.

FLJ20452 (Accession NP_060298.2) is another GAM3298 target gene, herein designated TARGET GENE. FLJ20452 BINDING SITE is a target binding site found in the 3' untranslated region of mRNA encoded by FLJ20452, corresponding to a target binding site such as BINDING SITE I, BINDING SITE II or BINDING SITE III of FIG. 8. Table 4 illustrates the complementarity of the nucleotide sequences of FLJ20452 BINDING SITE, designated SEQ ID:16046, to the nucleotide sequence of GAM3298 RNA, herein designated GAM RNA, also designated SEQ ID:259.

Another function of GAM3298 is therefore inhibition of FLJ20452 (Accession NP_060298.2). Accordingly, utilities of GAM3298 include diagnosis, prevention and treatment of diseases and clinical conditions associated with FLJ20452.

FLJ20464 (Accession NP_060304.1) is another GAM3298 target gene, herein designated TARGET GENE. FLJ20464 BINDING SITE is a target binding site found in the 3' untranslated region of mRNA encoded by FLJ20464, corresponding to a target binding site such as BINDING SITE I, BINDING SITE II or BINDING SITE III of FIG. 8. Table 4 illustrates the complementarity of the nucleotide sequences of FLJ20464 BINDING SITE, designated SEQ ID:3706, to the nucleotide sequence of GAM3298 RNA, herein designated GAM RNA, also designated SEQ ID:259.

Another function of GAM3298 is therefore inhibition of FLJ20464 (Accession NP_060304.1). Accordingly, utilities of GAM3298 include diagnosis, prevention and treatment of diseases and clinical conditions associated with FLJ20464.

FLJ20582 (Accession XP_090970.4) is another GAM3298 target gene, herein designated TARGET GENE. FLJ20582 BINDING SITE is a target binding site found in the 5' untranslated region of mRNA encoded by FLJ20582, corresponding to a target binding site such as BINDING SITE I, BINDING SITE II or BINDING SITE III of FIG. 8. Table 4 illustrates the complementarity of the nucleotide sequences of FLJ20582 BINDING SITE, designated SEQ ID:5838, to the nucleotide sequence of GAM3298 RNA, herein designated GAM RNA, also designated SEQ ID:259.

Another function of GAM3298 is therefore inhibition of FLJ20582 (Accession XP_090970.4). Accordingly, utilities of GAM3298 include diagnosis, prevention and treatment of diseases and clinical conditions associated with FLJ20582.

FLJ20700 (Accession NP_060402.1) is another GAM3298 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:3706, to the nucleotide sequence of GAM3298 RNA, herein designated GAM RNA, also designated SEQ ID:259.

Another function of GAM3298 is therefore inhibition of FLJ20700 (Accession NP_060402.1). Accordingly, utilities of GAM3298 include diagnosis, prevention and treatment of diseases and clinical conditions associated with FLJ20700.

FLJ21144 (Accession NP_073611.1) is another GAM3298 target gene, herein designated TARGET GENE. FLJ21144 BINDING SITE is a target binding site found in the 3' untranslated region of mRNA encoded by FLJ21144, corresponding to a target binding site such as BINDING SITE I, BINDING SITE II or BINDING SITE III of FIG. 8. Table 4 illustrates the complementarity of the nucleotide sequences of FLJ21144 BINDING SITE, designated SEQ ID:20084, to the nucleotide sequence of GAM3298 RNA, herein designated GAM RNA, also designated SEQ ID:259.

Another function of GAM3298 is therefore inhibition of FLJ21144 (Accession NP_073611.1). Accordingly, utilities of GAM3298 include diagnosis, prevention and treatment of diseases and clinical conditions associated with FLJ21144.

FLJ21369 (Accession NP_079078.1) is another GAM3298 target gene, herein designated TARGET GENE. FLJ21369 BINDING SITE is a target binding site found in the 3' untranslated region of mRNA encoded by FLJ21369, corresponding to a target binding site such as BINDING SITE I, BINDING SITE II or BINDING SITE III of FIG. 8. Table 4 illustrates the complementarity of the nucleotide sequences of FLJ21369 BINDING SITE, designated SEQ ID:18903, to the nucleotide sequence of GAM3298 RNA, herein designated GAM RNA, also designated SEQ ID:259.

Another function of GAM3298 is therefore inhibition of FLJ21369 (Accession NP_079078.1). Accordingly, utilities of GAM3298 include diagnosis, prevention and treatment of diseases and clinical conditions associated with FLJ21369.

FLJ21673 (Accession NP_112160.1) is another GAM3298 target gene, herein designated TARGET GENE. FLJ21673 BINDING SITE is a target binding site found in the 3' untranslated region of mRNA encoded by FLJ21673, corresponding to a target binding site such as BINDING SITE I, BINDING SITE II or BINDING SITE III of FIG. 8. Table 4 illustrates the complementarity of the nucleotide sequences of FLJ21673 BINDING SITE, designated SEQ ID:3706, to the nucleotide sequence of GAM3298 RNA, herein designated GAM RNA, also designated SEQ ID:259.

Another function of GAM3298 is therefore inhibition of FLJ21673 (Accession NP_112160.1). Accordingly, utilities of GAM3298 include diagnosis, prevention and treatment of diseases and clinical conditions associated with FLJ21673.

FLJ21870 (Accession NP_075392.1) is another GAM3298 target gene, herein designated TARGET GENE. FLJ21870 BINDING SITE is a target binding site found in the 3' untranslated region of mRNA encoded by FLJ21870, corresponding to a target binding site such as BINDING SITE I, BINDING SITE II or BINDING SITE III of FIG. 8. Table 4 illustrates the complementarity of the nucleotide sequences of FLJ21870 BINDING SITE, designated SEQ ID:3706, to the nucleotide sequence of GAM3298 RNA, herein designated GAM RNA, also designated SEQ ID:259.

Another function of GAM3298 is therefore inhibition of FLJ21870 (Accession NP_075392.1). Accordingly, utilities of GAM3298 include diagnosis, prevention and treatment of diseases and clinical conditions associated with FLJ21870.

FLJ23042 (Accession NP_079433.1) is another GAM3298 target gene, herein designated TARGET GENE. FLJ23042 BINDING SITE is a target binding site found in the 3' untranslated region of mRNA encoded by FLJ23042, corresponding to a target binding site such as BINDING SITE I, BINDING SITE II or BINDING SITE III of FIG. 8. Table 4 illustrates the complementarity of the nucleotide sequences of FLJ23042 BINDING SITE, designated SEQ ID:6627, to the nucleotide sequence of GAM3298 RNA, herein designated GAM RNA, also designated SEQ ID:259.

Another function of GAM3298 is therefore inhibition of FLJ23042 (Accession NP_079433.1). Accordingly, utilities of GAM3298 include diagnosis, prevention and treatment of diseases and clinical conditions associated with FLJ23042.

FLJ23129 (Accession NP_079039.1) is another GAM3298 target gene, herein designated TARGET GENE. FLJ23129 BINDING SITE is a target binding site found in the 3' untranslated region of mRNA encoded by FLJ23129, corresponding to a target binding site such as BINDING SITE I, BINDING SITE II or BINDING SITE III of FIG. 8. Table 4 illustrates the complementarity of the nucleotide sequences of FLJ23129 BINDING SITE, designated SEQ ID:730, to the nucleotide sequence of GAM3298 RNA, herein designated GAM RNA, also designated SEQ ID:259.

Another function of GAM3298 is therefore inhibition of FLJ23129 (Accession NP_079039.1). Accordingly, utilities of GAM3298 include diagnosis, prevention and treatment of diseases and clinical conditions associated with FLJ23129.

FLJ23235 (Accession NP_079219.1) is another GAM3298 target gene, herein designated TARGET GENE. FLJ23235 BINDING SITE is a target binding site found in the 3' untranslated region of mRNA encoded by FLJ23235, corresponding to a target binding site such as BINDING SITE I, BINDING SITE II or BINDING SITE III of FIG. 8. Table 4 illustrates the complementarity of the nucleotide sequences of FLJ23235 BINDING SITE, designated SEQ ID:14990, to the nucleotide sequence of GAM3298 RNA, herein designated GAM RNA, also designated SEQ ID:259.

Another function of GAM3298 is therefore inhibition of FLJ23235 (Accession NP_079219.1). Accordingly, utilities of GAM3298 include diagnosis, prevention and treatment of diseases and clinical conditions associated with FLJ23235.

FLJ23360 (Accession NP_075564.1) is another GAM3298 target gene, herein designated TARGET GENE. FLJ23360 BINDING SITE is a target binding site found in the 3' untranslated region of mRNA encoded by FLJ23360, corresponding to a target binding site such as BINDING SITE I, BINDING SITE II or BINDING SITE III of FIG. 8. Table 4 illustrates the complementarity of the nucleotide sequences of FLJ23360 BINDING SITE, designated SEQ ID:17938, to the nucleotide sequence of GAM3298 RNA, herein designated GAM RNA, also designated SEQ ID:259.

Another function of GAM3298 is therefore inhibition of FLJ23360 (Accession NP_075564.1). Accordingly, utilities of GAM3298 include diagnosis, prevention and treatment of diseases and clinical conditions associated with FLJ23360.

FLJ23447 (Accession NP_079101.1) is another GAM3298 target gene, herein designated TARGET GENE.

FLJ23447 BINDING SITE is a target binding site found in the 3' untranslated region of mRNA encoded by FLJ23447, corresponding to a target binding site such as BINDING SITE I, BINDING SITE II or BINDING SITE III of FIG. 8. Table 4 illustrates the complementarity of the nucleotide sequences of FLJ23447 BINDING SITE, designated SEQ ID:8160, to the nucleotide sequence of GAM3298 RNA, herein designated GAM RNA, also designated SEQ ID:259.

Another function of GAM3298 is therefore inhibition of FLJ23447 (Accession NP_079101.1). Accordingly, utilities of GAM3298 include diagnosis, prevention and treatment of diseases and clinical conditions associated with FLJ23447.

FLJ23499 (Accession NP_073598.1) is another GAM3298 target gene, herein designated TARGET GENE. FLJ23499 BINDING SITE is a target binding site found in the 3' untranslated region of mRNA encoded by FLJ23499, corresponding to a target binding site such as BINDING SITE I, BINDING SITE II or BINDING SITE III of FIG. 8. Table 4 illustrates the complementarity of the nucleotide sequences of FLJ23499 BINDING SITE, designated SEQ ID:3706, to the nucleotide sequence of GAM3298 RNA, herein designated GAM RNA, also designated SEQ ID:259.

Another function of GAM3298 is therefore inhibition of FLJ23499 (Accession NP_073598.1). Accordingly, utilities of GAM3298 include diagnosis, prevention and treatment of diseases and clinical conditions associated with FLJ23499.

FLJ23499 (Accession NP_073598.1) is another GAM3298 target gene, herein designated TARGET GENE. FLJ23499 BINDING SITE is a target binding site found in the 3' untranslated region of mRNA encoded by FLJ23499, corresponding to a target binding site such as BINDING SITE I, BINDING SITE II or BINDING SITE III of FIG. 8. Table 4 illustrates the complementarity of the nucleotide sequences of FLJ23499 BINDING SITE, designated SEQ ID:3706, to the nucleotide sequence of GAM3298 RNA, herein designated GAM RNA, also designated SEQ ID:259.

Another function of GAM3298 is therefore inhibition of FLJ23499 (Accession NP_073598.1). Accordingly, utilities of GAM3298 include diagnosis, prevention and treatment of diseases and clinical conditions associated with FLJ23499.

FLJ23751 (Accession NP_689495.1) is another GAM3298 target gene, herein designated TARGET GENE. FLJ23751 BINDING SITE is a target binding site found in the 3' untranslated region of mRNA encoded by FLJ23751, corresponding to a target binding site such as BINDING SITE I, BINDING SITE II or BINDING SITE III of FIG. 8. Table 4 illustrates the complementarity of the nucleotide sequences of FLJ23751 BINDING SITE, designated SEQ ID:5102, to the nucleotide sequence of GAM3298 RNA, herein designated GAM RNA, also designated SEQ ID:259.

Another function of GAM3298 is therefore inhibition of FLJ23751 (Accession NP_689495.1). Accordingly, utilities of GAM3298 include diagnosis, prevention and treatment of diseases and clinical conditions associated with FLJ23751.

FLJ23834 (Accession NP_689963.1) is another GAM3298 target gene, herein designated TARGET GENE. FLJ23834 BINDING SITE is a target binding site found in the 3' untranslated region of mRNA encoded by FLJ23834, corresponding to a target binding site such as BINDING SITE I, BINDING SITE II or BINDING SITE III of FIG. 8. Table 4 illustrates the complementarity of the nucleotide sequences of FLJ23834 BINDING SITE, designated SEQ ID:8593, to the nucleotide sequence of GAM3298 RNA, herein designated GAM RNA, also designated SEQ ID:259.

Another function of GAM3298 is therefore inhibition of FLJ23834 (Accession NP_689963.1). Accordingly, utilities of GAM3298 include diagnosis, prevention and treatment of diseases and clinical conditions associated with FLJ23834.

FLJ25179 (Accession NP_653271.1) is another GAM3298 target gene, herein designated TARGET GENE. FLJ25179 BINDING SITE is a target binding site found in the 3' untranslated region of mRNA encoded by FLJ25179, corresponding to a target binding site such as BINDING SITE I, BINDING SITE II or BINDING SITE III of FIG. 8. Table 4 illustrates the complementarity of the nucleotide sequences of FLJ25179 BINDING SITE, designated SEQ ID:8989, to the nucleotide sequence of GAM3298 RNA, herein designated GAM RNA, also designated SEQ ID:259.

Another function of GAM3298 is therefore inhibition of FLJ25179 (Accession NP_653271.1). Accordingly, utilities of GAM3298 include diagnosis, prevention and treatment of diseases and clinical conditions associated with FLJ25179.

FLJ30317 (Accession NP_742148.1) is another GAM3298 target gene, herein designated TARGET GENE. FLJ30317 BINDING SITE is a target binding site found in the 3' untranslated region of mRNA encoded by FLJ30317, corresponding to a target binding site such as BINDING SITE I, BINDING SITE II or BINDING SITE III of FIG. 8. Table 4 illustrates the complementarity of the nucleotide sequences of FLJ30317 BINDING SITE, designated SEQ ID:14675, to the nucleotide sequence of GAM3298 RNA, herein designated GAM RNA, also designated SEQ ID:259.

Another function of GAM3298 is therefore inhibition of FLJ30317 (Accession NP_742148.1). Accordingly, utilities of GAM3298 include diagnosis, prevention and treatment of diseases and clinical conditions associated with FLJ30317.

FLJ30899 (Accession NP_689943.1) is another GAM3298 target gene, herein designated TARGET GENE. FLJ30899 BINDING SITE is a target binding site found in the 3' untranslated region of mRNA encoded by FLJ30899, corresponding to a target binding site such as BINDING SITE I, BINDING SITE II or BINDING SITE III of FIG. 8. Table 4 illustrates the complementarity of the nucleotide sequences of FLJ30899 BINDING SITE, designated SEQ ID:3706, to the nucleotide sequence of GAM3298 RNA, herein designated GAM RNA, also designated SEQ ID:259.

Another function of GAM3298 is therefore inhibition of FLJ30899 (Accession NP_689943.1). Accordingly, utilities of GAM3298 include diagnosis, prevention and treatment of diseases and clinical conditions associated with FLJ30899.

FLJ31208 (Accession NP_694568.1) is another GAM3298 target gene, herein designated TARGET GENE. FLJ31208 BINDING SITE is a target binding site found in the 3' untranslated region of mRNA encoded by FLJ31208, corresponding to a target binding site such as BINDING SITE I, BINDING SITE II or BINDING SITE III of FIG. 8. Table 4 illustrates the complementarity of the nucleotide sequences of FLJ31208 BINDING SITE, designated SEQ ID:3706, to the nucleotide sequence of GAM3298 RNA, herein designated GAM RNA, also designated SEQ ID:259.

Another function of GAM3298 is therefore inhibition of FLJ31208 (Accession NP_694568.1). Accordingly, utilities of GAM3298 include diagnosis, prevention and treatment of diseases and clinical conditions associated with FLJ31208.

FLJ31434 (Accession NP_689709.1) is another GAM3298 target gene, herein designated TARGET GENE. FLJ31434 BINDING SITE is a target binding site found in the 3' untranslated region of mRNA encoded by FLJ31434, corresponding to a target binding site such as BINDING SITE I, BINDING SITE II or BINDING SITE III of FIG. 8. Table 4 illustrates the complementarity of the nucleotide sequences of FLJ31434 BINDING SITE, designated SEQ ID:7468, to the nucleotide sequence of GAM3298 RNA, herein designated GAM RNA, also designated SEQ ID:259.

Another function of GAM3298 is therefore inhibition of FLJ31434 (Accession NP_689709.1). Accordingly, utilities of GAM3298 include diagnosis, prevention and treatment of diseases and clinical conditions associated with FLJ31434.

FLJ31659 (Accession NP_694572.1) is another GAM3298 target gene, herein designated TARGET GENE. FLJ31659 BINDING SITE is a target binding site found in the 3' untranslated region of mRNA encoded by FLJ31659, corresponding to a target binding site such as BINDING SITE I, BINDING SITE II or BINDING SITE III of FIG. 8. Table 4 illustrates the complementarity of the nucleotide sequences of FLJ31659 BINDING SITE, designated SEQ ID:18701, to the nucleotide sequence of GAM3298 RNA, herein designated GAM RNA, also designated SEQ ID:259.

Another function of GAM3298 is therefore inhibition of FLJ31659 (Accession NP_694572.1). Accordingly, utilities of GAM3298 include diagnosis, prevention and treatment of diseases and clinical conditions associated with FLJ31659.

FLJ31842 (Accession NP_689700.1) is another GAM3298 target gene, herein designated TARGET GENE. FLJ31842 BINDING SITE is a target binding site found in the 3' untranslated region of mRNA encoded by FLJ31842, corresponding to a target binding site such as BINDING SITE I, BINDING SITE II or BINDING SITE III of FIG. 8. Table 4 illustrates the complementarity of the nucleotide sequences of FLJ31842 BINDING SITE, designated SEQ ID:3706, to the nucleotide sequence of GAM3298 RNA, herein designated GAM RNA, also designated SEQ ID:259.

Another function of GAM3298 is therefore inhibition of FLJ31842 (Accession NP_689700.1). Accordingly, utilities of GAM3298 include diagnosis, prevention and treatment of diseases and clinical conditions associated with FLJ31842.

FLJ31882 (Accession NP_689673.1) is another GAM3298 target gene, herein designated TARGET GENE. FLJ31882 BINDING SITE is a target binding site found in the 3' untranslated region of mRNA encoded by FLJ31882, corresponding to a target binding site such as BINDING SITE I, BINDING SITE II or BINDING SITE III of FIG. 8. Table 4 illustrates the complementarity of the nucleotide sequences of FLJ31882 BINDING SITE, designated SEQ ID:9354, to the nucleotide sequence of GAM3298 RNA, herein designated GAM RNA, also designated SEQ ID:259.

Another function of GAM3298 is therefore inhibition of FLJ31882 (Accession NP_689673.1). Accordingly, utilities of GAM3298 include diagnosis, prevention and treatment of diseases and clinical conditions associated with FLJ31882.

FLJ32029 (Accession NP_775853.2) is another GAM3298 target gene, herein designated TARGET GENE. FLJ32029 BINDING SITE is a target binding site found in the 3' untranslated region of mRNA encoded by FLJ32029, corresponding to a target binding site such as BINDING SITE I, BINDING SITE II or BINDING SITE III of FIG. 8. Table 4 illustrates the complementarity of the nucleotide sequences of FLJ32029 BINDING SITE, designated SEQ ID:840, to the nucleotide sequence of GAM3298 RNA, herein designated GAM RNA, also designated SEQ ID:259.

Another function of GAM3298 is therefore inhibition of FLJ32029 (Accession NP_775853.2). Accordingly, utilities of GAM3298 include diagnosis, prevention and treatment of diseases and clinical conditions associated with FLJ32029.

FLJ32833 (Accession NP_689701.1) is another GAM3298 target gene, herein designated TARGET GENE. FLJ32833 BINDING SITE is a target binding site found in the 3' untranslated region of mRNA encoded by FLJ32833, corresponding to a target binding site such as BINDING SITE I, BINDING SITE II or BINDING SITE III of FIG. 8. Table 4 illustrates the complementarity of the nucleotide sequences of FLJ32833 BINDING SITE, designated SEQ ID:16532, to the nucleotide sequence of GAM3298 RNA, herein designated GAM RNA, also designated SEQ ID:259.

Another function of GAM3298 is therefore inhibition of FLJ32833 (Accession NP_689701.1). Accordingly, utilities of GAM3298 include diagnosis, prevention and treatment of diseases and clinical conditions associated with FLJ32833.

FLJ33167 (Accession NP_689896.1) is another GAM3298 target gene, herein designated TARGET GENE. FLJ33167 BINDING SITE is a target binding site found in the 3' untranslated region of mRNA encoded by FLJ33167, corresponding to a target binding site such as BINDING SITE I, BINDING SITE II or BINDING SITE III of FIG. 8. Table 4 illustrates the complementarity of the nucleotide sequences of FLJ33167 BINDING SITE, designated SEQ ID:10382, to the nucleotide sequence of GAM3298 RNA, herein designated GAM RNA, also designated SEQ ID:259.

Another function of GAM3298 is therefore inhibition of FLJ33167 (Accession NP_689896.1). Accordingly, utilities of GAM3298 include diagnosis, prevention and treatment of diseases and clinical conditions associated with FLJ33167.

FLJ33505 (Accession NP_689530.1) is another GAM3298 target gene, herein designated TARGET GENE. FLJ33505 BINDING SITE is a target binding site found in the 3' untranslated region of mRNA encoded by FLJ33505, corresponding to a target binding site such as BINDING SITE I, BINDING SITE II or BINDING SITE III of FIG. 8. Table 4 illustrates the complementarity of the nucleotide sequences of FLJ33505 BINDING SITE, designated SEQ ID:17309, to the nucleotide sequence of GAM3298 RNA, herein designated GAM RNA, also designated SEQ ID:259.

Another function of GAM3298 is therefore inhibition of FLJ33505 (Accession NP_689530.1). Accordingly, utilities of GAM3298 include diagnosis, prevention and treatment of diseases and clinical conditions associated with FLJ33505.

FLJ34917 (Accession NP_694995.1) is another GAM3298 target gene, herein designated TARGET GENE. FLJ34917 BINDING SITE is a target binding site found in the 3' untranslated region of mRNA encoded by FLJ34917, corresponding to a target binding site such as BINDING SITE I, BINDING SITE II or BINDING SITE III of FIG. 8. Table 4 illustrates the complementarity of the nucleotide sequences of FLJ34917 BINDING SITE, designated SEQ ID:3706, to the nucleotide sequence of GAM3298 RNA, herein designated GAM RNA, also designated SEQ ID:259.

Another function of GAM3298 is therefore inhibition of FLJ34917 (Accession NP_694995.1). Accordingly, utilities of GAM3298 include diagnosis, prevention and treatment of diseases and clinical conditions associated with FLJ34917.

FLJ37228 (Accession NP_787113.1) is another GAM3298 target gene, herein designated TARGET GENE. FLJ37228 BINDING SITE is a target binding site found in the 3' untranslated region of mRNA encoded by FLJ37228, corresponding to a target binding site such as BINDING SITE I, BINDING SITE II or BINDING SITE III of FIG. 8. Table 4 illustrates the complementarity of the nucleotide sequences of FLJ37228 BINDING SITE, designated SEQ ID:3706, to the nucleotide sequence of GAM3298 RNA, herein designated GAM RNA, also designated SEQ ID:259.

Another function of GAM3298 is therefore inhibition of FLJ37228 (Accession NP_787113.1). Accordingly, utilities of GAM3298 include diagnosis, prevention and treatment of diseases and clinical conditions associated with FLJ37228.

FLJ38690 (Accession NP_848608.1) is another GAM3298 target gene, herein designated TARGET GENE.

FLJ38690 BINDING SITE1 and FLJ38690 BINDING SITE2 are target binding sites found in untranslated regions of mRNA encoded by FLJ38690, corresponding to target binding sites such as BINDING SITE I, BINDING SITE II or BINDING SITE III of FIG. 8. Table 4 illustrates the complementarity of the nucleotide sequences of FLJ38690 BINDING SITE1 and FLJ38690 BINDING SITE2, designated SEQ ID:3706 and SEQ ID:7398 respectively, to the nucleotide sequence of GAM3298 RNA, herein designated GAM RNA, also designated SEQ ID:259.

Another function of GAM3298 is therefore inhibition of FLJ38690 (Accession NP_848608.1). Accordingly, utilities of GAM3298 include diagnosis, prevention and treatment of diseases and clinical conditions associated with FLJ38690.

FLJ38991 (Accession NP_776188.1) is another GAM3298 target gene, herein designated TARGET GENE. FLJ38991 BINDING SITE is a target binding site found in the 3' untranslated region of mRNA encoded by FLJ38991, corresponding to a target binding site such as BINDING SITE I, BINDING SITE II or BINDING SITE III of FIG. 8. Table 4 illustrates the complementarity of the nucleotide sequences of FLJ38991 BINDING SITE, designated SEQ ID:3706, to the nucleotide sequence of GAM3298 RNA, herein designated GAM RNA, also designated SEQ ID:259.

Another function of GAM3298 is therefore inhibition of FLJ38991 (Accession NP_776188.1). Accordingly, utilities of GAM3298 include diagnosis, prevention and treatment of diseases and clinical conditions associated with FLJ38991.

FLJ39005 (Accession NP_848616.1) is another GAM3298 target gene, herein designated TARGET GENE. FLJ39005 BINDING SITE is a target binding site found in the 3' untranslated region of mRNA encoded by FLJ39005, corresponding to a target binding site such as BINDING SITE I, BINDING SITE II or BINDING SITE III of FIG. 8. Table 4 illustrates the complementarity of the nucleotide sequences of FLJ39005 BINDING SITE, designated SEQ ID:16046, to the nucleotide sequence of GAM3298 RNA, herein designated GAM RNA, also designated SEQ ID:259.

Another function of GAM3298 is therefore inhibition of FLJ39005 (Accession NP_848616.1). Accordingly, utilities of GAM3298 include diagnosis, prevention and treatment of diseases and clinical conditions associated with FLJ39005.

FLJ90165 (Accession NP_699169.1) is another GAM3298 target gene, herein designated TARGET GENE. FLJ90165 BINDING SITE is a target binding site found in the 3' untranslated region of mRNA encoded by FLJ90165, corresponding to a target binding site such as BINDING SITE I, BINDING SITE II or BINDING SITE III of FIG. 8. Table 4 illustrates the complementarity of the nucleotide sequences of FLJ90165 BINDING SITE, designated SEQ ID:3706, to the nucleotide sequence of GAM3298 RNA, herein designated GAM RNA, also designated SEQ ID:259.

Another function of GAM3298 is therefore inhibition of FLJ90165 (Accession NP_699169.1). Accordingly, utilities of GAM3298 include diagnosis, prevention and treatment of diseases and clinical conditions associated with FLJ90165.

FRSB (Accession NP_005678.2) is another GAM3298 target gene, herein designated TARGET GENE. FRSB BINDING SITE is a target binding site found in the 3' untranslated region of mRNA encoded by FRSB, corresponding to a target binding site such as BINDING SITE I, BINDING SITE II or BINDING SITE III of FIG. 8. Table 4 illustrates the complementarity of the nucleotide sequences of FRSB BINDING SITE, designated SEQ ID:840, to the nucleotide sequence of GAM3298 RNA, herein designated GAM RNA, also designated SEQ ID:259.

Another function of GAM3298 is therefore inhibition of FRSB (Accession NP_005678.2). Accordingly, utilities of GAM3298 include diagnosis, prevention and treatment of diseases and clinical conditions associated with FRSB.

Udp-n-acetyl-alpha-d-galactosamine:polypeptide n-acetylgalactosaminyltransferase 7 (galnac-t7) (GALNT7, Accession NP_473451.2) is another GAM3298 target gene, herein designated TARGET GENE. GALNT7 BINDING SITE is a target binding site found in the 3' untranslated region of multiple transcripts of mRNA encoded by GALNT7, corresponding to a target binding site such as BINDING SITE I, BINDING SITE II or BINDING SITE III of FIG. 8. Table 4 illustrates the complementarity of the nucleotide sequences of GALNT7 BINDING SITE, designated SEQ ID:6665, to the nucleotide sequence of GAM3298 RNA, herein designated GAM RNA, also designated SEQ ID:259.

Another function of GAM3298 is therefore inhibition of Udp-n-acetyl-alpha-d-galactosamine:polypeptide n-acetylgalactosaminyltransferase 7 (galnac-t7) (GALNT7, Accession NP_473451.2). Accordingly, utilities of GAM3298 include diagnosis, prevention and treatment of diseases and clinical conditions associated with GALNT7.

GBP4 (Accession NP_443173.2) is another GAM3298 target gene, herein designated TARGET GENE. GBP4 BINDING SITE is a target binding site found in the 3' untranslated region of mRNA encoded by GBP4, corresponding to a target binding site such as BINDING SITE I, BINDING SITE II or BINDING SITE III of FIG. 8. Table 4 illustrates the complementarity of the nucleotide sequences of GBP4 BINDING SITE, designated SEQ ID:7240, to the nucleotide sequence of GAM3298 RNA, herein designated GAM RNA, also designated SEQ ID:259.

Another function of GAM3298 is therefore inhibition of GBP4 (Accession NP_443173.2). Accordingly, utilities of GAM3298 include diagnosis, prevention and treatment of diseases and clinical conditions associated with GBP4.

GK001 (Accession NP_064583.1) is another GAM3298 target gene, herein designated TARGET GENE. GK001 BINDING SITE is a target binding site found in the 3' untranslated region of mRNA encoded by GK001, corresponding to a target binding site such as BINDING SITE I, BINDING SITE II or BINDING SITE III of FIG. 8. Table 4 illustrates the complementarity of the nucleotide sequences of GK001 BINDING SITE, designated SEQ ID:11534, to the nucleotide sequence of GAM3298 RNA, herein designated GAM RNA, also designated SEQ ID:259.

Another function of GAM3298 is therefore inhibition of GK001 (Accession NP_064583.1). Accordingly, utilities of GAM3298 include diagnosis, prevention and treatment of diseases and clinical conditions associated with GK001.

Glyoxalase i (GLO1, Accession NP_006699.1) is another GAM3298 target gene, herein designated TARGET GENE. GLO1 BINDING SITE is a target binding site found in the 3' untranslated region of mRNA encoded by GLO1, corresponding to a target binding site such as BINDING SITE I, BINDING SITE II or BINDING SITE III of FIG. 8. Table 4 illustrates the complementarity of the nucleotide sequences of GLO1 BINDING SITE, designated SEQ ID:4209, to the nucleotide sequence of GAM3298 RNA, herein designated GAM RNA, also designated SEQ ID:259.

Another function of GAM3298 is therefore inhibition of Glyoxalase i (GLO1, Accession NP_006699.1), a gene which converts methylglyoxal and glutathione to S-lactoylglutathione. Accordingly, utilities of GAM3298 include diagnosis, prevention and treatment of diseases and clinical conditions associated with GLO1.

The function of GLO1 and its association with various diseases and clinical conditions, has been established by previous studies, as described hereinabove with reference to GAM1550.1. G protein-coupled receptor 6 (GPR6, Accession NP_005275.1) is another GAM3298 target gene, herein designated TARGET GENE. GPR6 BINDING SITE is a target binding site found in the 3' untranslated region of mRNA encoded by GPR6, corresponding to a target binding site such as BINDING SITE I, BINDING SITE II or BINDING SITE III of FIG. 8. Table 4 illustrates the complementarity of the nucleotide sequences of GPR6 BINDING SITE, designated SEQ ID:4712, to the nucleotide sequence of GAM3298 RNA, herein designated GAM RNA, also designated SEQ ID:259.

Another function of GAM3298 is therefore inhibition of G protein-coupled receptor 6 (GPR6, Accession NP_005275.1), a gene which transduces extracellular signals through heterotrimeric G proteins. Accordingly, utilities of GAM3298 include diagnosis, prevention and treatment of diseases and clinical conditions associated with GPR6.

The function of GPR6 and its association with various diseases and clinical conditions, has been established by previous studies, as described hereinabove with reference to GAM203.2. G protein-coupled receptor kinase 7 (GPRK7, Accession NP_631948.1) is another GAM3298 target gene, herein designated TARGET GENE. GPRK7 BINDING SITE is a target binding site found in the 3' untranslated region of mRNA encoded by GPRK7, corresponding to a target binding site such as BINDING SITE I, BINDING SITE II or BINDING SITE III of FIG. 8. Table 4 illustrates the complementarity of the nucleotide sequences of GPRK7 BINDING SITE, designated SEQ ID:12104, to the nucleotide sequence of GAM3298 RNA, herein designated GAM RNA, also designated SEQ ID:259.

Another function of GAM3298 is therefore inhibition of G protein-coupled receptor kinase 7 (GPRK7, Accession NP_631948.1), a gene which regulates the G protein-coupled receptors. Accordingly, utilities of GAM3298 include diagnosis, prevention and treatment of diseases and clinical conditions associated with GPRK7.

The function of GPRK7 and its association with various diseases and clinical conditions, has been established by previous studies, as described hereinabove with reference to GAM72.1. GRIPE (Accession XP_170749.4) is another GAM3298 target gene, herein designated TARGET GENE. GRIPE BINDING SITE is a target binding site found in the 5' untranslated region of mRNA encoded by GRIPE, corresponding to a target binding site such as BINDING SITE I, BINDING SITE II or BINDING SITE III of FIG. 8. Table 4 illustrates the complementarity of the nucleotide sequences of GRIPE BINDING SITE, designated SEQ ID:2629, to the nucleotide sequence of GAM3298 RNA, herein designated GAM RNA, also designated SEQ ID:259.

Another function of GAM3298 is therefore inhibition of GRIPE (Accession XP_170749.4). Accordingly, utilities of GAM3298 include diagnosis, prevention and treatment of diseases and clinical conditions associated with GRIPE.

Gtp binding protein 5 (putative) (GTPBP5, Accession NP_056481.1) is another GAM3298 target gene, herein designated TARGET GENE. GTPBP5 BINDING SITE is a target binding site found in the 3' untranslated region of mRNA encoded by GTPBP5, corresponding to a target binding site such as BINDING SITE I, BINDING SITE II or BINDING SITE III of FIG. 8. Table 4 illustrates the complementarity of the nucleotide sequences of GTPBP5 BINDING SITE, designated SEQ ID:17309, to the nucleotide sequence of GAM3298 RNA, herein designated GAM RNA, also designated SEQ ID:259.

Another function of GAM3298 is therefore inhibition of Gtp binding protein 5 (putative) (GTPBP5, Accession NP_056481.1). Accordingly, utilities of GAM3298 include diagnosis, prevention and treatment of diseases and clinical conditions associated with GTPBP5.

H2a histone family, member j (H2AFJ, Accession NP_060737.1) is another GAM3298 target gene, herein designated TARGET GENE. H2AFJ BINDING SITE is a target binding site found in the 3' untranslated region of multiple transcripts of mRNA encoded by H2AFJ, corresponding to a target binding site such as BINDING SITE I, BINDING SITE II or BINDING SITE III of FIG. 8. Table 4 illustrates the complementarity of the nucleotide sequences of H2AFJ BINDING SITE, designated SEQ ID:11330, to the nucleotide sequence of GAM3298 RNA, herein designated GAM RNA, also designated SEQ ID:259.

Another function of GAM3298 is therefore inhibition of H2a histone family, member j (H2AFJ, Accession NP_060737.1). Accordingly, utilities of GAM3298 include diagnosis, prevention and treatment of diseases and clinical conditions associated with H2AFJ.

HIG2 (Accession NP_037464.1) is another GAM3298 target gene, herein designated TARGET GENE. HIG2 BINDING SITE is a target binding site found in the 3' untranslated region of mRNA encoded by HIG2, corresponding to a target binding site such as BINDING SITE I, BINDING SITE II or BINDING SITE III of FIG. 8. Table 4 illustrates the complementarity of the nucleotide sequences of HIG2 BINDING SITE, designated SEQ ID:840, to the nucleotide sequence of GAM3298 RNA, herein designated GAM RNA, also designated SEQ ID:259.

Another function of GAM3298 is therefore inhibition of HIG2 (Accession NP_037464.1). Accordingly, utilities of GAM3298 include diagnosis, prevention and treatment of diseases and clinical conditions associated with HIG2.

Histocompatibility (minor) 13 (HM13, Accession NP_848697.1) is another GAM3298 target gene, herein designated TARGET GENE. HM13 BINDING SITE is a target binding site found in the 3' untranslated region of multiple transcripts of mRNA encoded by HM13, corresponding to a target binding site such as BINDING SITE I, BINDING SITE II or BINDING SITE III of FIG. 8. Table 4 illustrates the complementarity of the nucleotide sequences of HM13 BINDING SITE, designated SEQ ID:3706, to the nucleotide sequence of GAM3298 RNA, herein designated GAM RNA, also designated SEQ ID:259.

Another function of GAM3298 is therefore inhibition of Histocompatibility (minor) 13 (HM13, Accession NP_848697.1). Accordingly, utilities of GAM3298 include diagnosis, prevention and treatment of diseases and clinical conditions associated with HM13.

HSPC043 (Accession NP_067041.1) is another GAM3298 target gene, herein designated TARGET GENE. HSPC043 BINDING SITE is a target binding site found in the 3' untranslated region of mRNA encoded by HSPC043, corresponding to a target binding site such as BINDING SITE I, BINDING SITE II or BINDING SITE III of FIG. 8. Table 4 illustrates the complementarity of the nucleotide sequences of HSPC043 BINDING SITE, designated SEQ ID:16780, to the nucleotide sequence of GAM3298 RNA, herein designated GAM RNA, also designated SEQ ID:259.

Another function of GAM3298 is therefore inhibition of HSPC043 (Accession NP_067041.1). Accordingly, utilities of GAM3298 include diagnosis, prevention and treatment of diseases and clinical conditions associated with HSPC043.

Interferon-induced protein with tetratricopeptide repeats 4 (IFIT4, Accession NP_001540.2) is another GAM3298 target gene, herein designated TARGET GENE. IFIT4 BINDING SITE is a target binding site found in the 3' untranslated region of mRNA encoded by IFIT4, corresponding to a target binding site such as BINDING SITE I, BINDING SITE II or BINDING SITE III of FIG. 8. Table 4 illustrates the complementarity of the nucleotide sequences of IFIT4 BINDING SITE, designated SEQ ID:3706, to the nucleotide sequence of GAM3298 RNA, herein designated GAM RNA, also designated SEQ ID:259.

Another function of GAM3298 is therefore inhibition of Interferon-induced protein with tetratricopeptide repeats 4 (IFIT4, Accession NP_001540.2), a gene which is an interferon-induced protein. Accordingly, utilities of GAM3298 include diagnosis, prevention and treatment of diseases and clinical conditions associated with IFIT4.

The function of IFIT4 and its association with various diseases and clinical conditions, has been established by previous studies, as described hereinabove with reference to GAM347.1. Interleukin 12 receptor, beta 2 (IL12RB2, Accession NP_001550.1) is another GAM3298 target gene, herein designated TARGET GENE. IL12RB2 BINDING SITE is a target binding site found in the 3' untranslated region of mRNA encoded by IL12RB2, corresponding to a target binding site such as BINDING SITE I, BINDING SITE II or BINDING SITE III of FIG. 8. Table 4 illustrates the complementarity of the nucleotide sequences of IL12RB2 BINDING SITE, designated SEQ ID:5498, to the nucleotide sequence of GAM3298 RNA, herein designated GAM RNA, also designated SEQ ID:259.

Another function of GAM3298 is therefore inhibition of Interleukin 12 receptor, beta 2 (IL12RB2, Accession NP_001550.1), a gene which is involved in il-12 transduction. binds to il-12 with a low affinity. Accordingly, utilities of GAM3298 include diagnosis, prevention and treatment of diseases and clinical conditions associated with IL12RB2.

The function of IL12RB2 and its association with various diseases and clinical conditions, has been established by previous studies, as described hereinabove with reference to GAM374.1. IL23R (Accession NP_653302.2) is another GAM3298 target gene, herein designated TARGET GENE. IL23R BINDING SITE is a target binding site found in the 3' untranslated region of mRNA encoded by IL23R, corresponding to a target binding site such as BINDING SITE I, BINDING SITE II or BINDING SITE III of FIG. 8. Table 4 illustrates the complementarity of the nucleotide sequences of IL23R BINDING SITE, designated SEQ ID:15196, to the nucleotide sequence of GAM3298 RNA, herein designated GAM RNA, also designated SEQ ID:259.

Another function of GAM3298 is therefore inhibition of IL23R (Accession NP_653302.2). Accordingly, utilities of GAM3298 include diagnosis, prevention and treatment of diseases and clinical conditions associated with IL23R.

Inositol polyphosphate-5-phosphatase, 75 kda (INPP5B, Accession XP_300739.1) is another GAM3298 target gene, herein designated TARGET GENE. INPP5B BINDING SITE is a target binding site found in the 3' untranslated region of mRNA encoded by INPP5B, corresponding to a target binding site such as BINDING SITE I, BINDING SITE II or BINDING SITE III of FIG. 8. Table 4 illustrates the complementarity of the nucleotide sequences of INPP5B BINDING SITE, designated SEQ ID:19238, to the nucleotide sequence of GAM3298 RNA, herein designated GAM RNA, also designated SEQ ID:259.

Another function of GAM3298 is therefore inhibition of Inositol polyphosphate-5-phosphatase, 75 kda (INPP5B, Accession XP_300739.1), a gene which hydrolyzes the calcium-mobilizing second messenger ins(1,4,5)p3. Accordingly, utilities of GAM3298 include diagnosis, prevention and treatment of diseases and clinical conditions associated with INPP5B.

The function of INPP5B and its association with various diseases and clinical conditions, has been established by previous studies, as described hereinabove with reference to GAM347.1. Interleukin-1 receptor-associated kinase 4 (IRAK4, Accession NP_057207.1) is another GAM3298 target gene, herein designated TARGET GENE. IRAK4 BINDING SITE is a target binding site found in the 3' untranslated region of mRNA encoded by IRAK4, corresponding to a target binding site such as BINDING SITE I, BINDING SITE II or BINDING SITE III of FIG. 8. Table 4 illustrates the complementarity of the nucleotide sequences of IRAK4 BINDING SITE, designated SEQ ID:16303, to the nucleotide sequence of GAM3298 RNA, herein designated GAM RNA, also designated SEQ ID:259.

Another function of GAM3298 is therefore inhibition of Interleukin-1 receptor-associated kinase 4 (IRAK4, Accession NP_057207.1), a gene which may function as an IRAK1 kinase, triggering a cascade of phosphorylation events. and therefore may be associated with Renal tumors. Accordingly, utilities of GAM3298 include diagnosis, prevention and treatment of Renal tumors, and of other diseases and clinical conditions associated with IRAK4.

The function of IRAK4 and its association with various diseases and clinical conditions, has been established by previous studies, as described hereinabove with reference to GAM72.1. Il2-inducible t-cell kinase (ITK, Accession NP_005537.3) is another GAM3298 target gene, herein designated TARGET GENE. ITK BINDING SITE is a target binding site found in the 3' untranslated region of mRNA encoded by ITK, corresponding to a target binding site such as BINDING SITE I, BINDING SITE II or BINDING SITE III of FIG. 8. Table 4 illustrates the complementarity of the nucleotide sequences of ITK BINDING SITE, designated SEQ ID:19655, to the nucleotide sequence of GAM3298 RNA, herein designated GAM RNA, also designated SEQ ID:259.

Another function of GAM3298 is therefore inhibition of Il2-inducible t-cell kinase (ITK, Accession NP_005537.3), a gene which plays a role in t cell proliferation and differentiation. and therefore may be associated with Myelodysplastic syndrome. Accordingly, utilities of GAM3298 include diagnosis, prevention and treatment of Myelodysplastic syndrome, and of other diseases and clinical conditions associated with ITK.

The function of ITK and its association with various diseases and clinical conditions, has been established by previous studies, as described hereinabove with reference to GAM44.1. Potassium voltage-gated channel, shaker-related subfamily, member 7 (KCNA7, Accession NP_114092.2) is another GAM3298 target gene, herein designated TARGET GENE. KCNA7 BINDING SITE is a target binding site found in the 3' untranslated region of mRNA encoded by KCNA7, corresponding to a target binding site such as BINDING SITE I, BINDING SITE II or BINDING SITE III of FIG. 8. Table 4 illustrates the complementarity of the nucleotide sequences of KCNA7 BINDING SITE, designated SEQ ID:11198, to the nucleotide sequence of GAM3298 RNA, herein designated GAM RNA, also designated SEQ ID:259.

Another function of GAM3298 is therefore inhibition of Potassium voltage-gated channel, shaker-related subfamily, member 7 (KCNA7, Accession NP__114092.2), a gene which allows nerve cells to efficiently repolarize following an action potential. Accordingly, utilities of GAM3298 include diagnosis, prevention and treatment of diseases and clinical conditions associated with KCNA7.

The function of KCNA7 and its association with various diseases and clinical conditions, has been established by previous studies, as described hereinabove with reference to GAM72.1. KIAA0356 (Accession XP__038655.4) is another GAM3298 target gene, herein designated TARGET GENE. KIAA0356 BINDING SITE is a target binding site found in the 3' untranslated region of mRNA encoded by KIAA0356, corresponding to a target binding site such as BINDING SITE I, BINDING SITE II or BINDING SITE III of FIG. 8. Table 4 illustrates the complementarity of the nucleotide sequences of KIAA0356 BINDING SITE, designated SEQ ID:11293, to the nucleotide sequence of GAM3298 RNA, herein designated GAM RNA, also designated SEQ ID:259.

Another function of GAM3298 is therefore inhibition of KIAA0356 (Accession XP__038655.4). Accordingly, utilities of GAM3298 include diagnosis, prevention and treatment of diseases and clinical conditions associated with KIAA0356.

KIAA0391 (Accession NP__055487.1) is another GAM3298 target gene, herein designated TARGET GENE. KIAA0391 BINDING SITE is a target binding site found in the 3' untranslated region of mRNA encoded by KIAA0391, corresponding to a target binding site such as BINDING SITE I, BINDING SITE II or BINDING SITE III of FIG. 8. Table 4 illustrates the complementarity of the nucleotide sequences of KIAA0391 BINDING SITE, designated SEQ ID:18795, to the nucleotide sequence of GAM3298 RNA, herein designated GAM RNA, also designated SEQ ID:259.

Another function of GAM3298 is therefore inhibition of KIAA0391 (Accession NP__055487.1). Accordingly, utilities of GAM3298 include diagnosis, prevention and treatment of diseases and clinical conditions associated with KIAA0391.

KIAA0408 (Accession NP__055517.1) is another GAM3298 target gene, herein designated TARGET GENE. KIAA0408 BINDING SITE is a target binding site found in the 3' untranslated region of mRNA encoded by KIAA0408, corresponding to a target binding site such as BINDING SITE I, BINDING SITE II or BINDING SITE III of FIG. 8. Table 4 illustrates the complementarity of the nucleotide sequences of KIAA0408 BINDING SITE, designated SEQ ID:7576, to the nucleotide sequence of GAM3298 RNA, herein designated GAM RNA, also designated SEQ ID:259.

Another function of GAM3298 is therefore inhibition of KIAA0408 (Accession NP__055517.1). Accordingly, utilities of GAM3298 include diagnosis, prevention and treatment of diseases and clinical conditions associated with KIAA0408.

KIAA0446 (Accession XP__044155.1) is another GAM3298 target gene, herein designated TARGET GENE. KIAA0446 BINDING SITE is a target binding site found in the 5' untranslated region of mRNA encoded by KIAA0446, corresponding to a target binding site such as BINDING SITE I, BINDING SITE II or BINDING SITE III of FIG. 8. Table 4 illustrates the complementarity of the nucleotide sequences of KIAA0446 BINDING SITE, designated SEQ ID:1087, to the nucleotide sequence of GAM3298 RNA, herein designated GAM RNA, also designated SEQ ID:259.

Another function of GAM3298 is therefore inhibition of KIAA0446 (Accession XP__044155.1). Accordingly, utilities of GAM3298 include diagnosis, prevention and treatment of diseases and clinical conditions associated with KIAA0446.

KIAA0514 (Accession NP__055511.1) is another GAM3298 target gene, herein designated TARGET GENE. KIAA0514 BINDING SITE is a target binding site found in the 3' untranslated region of mRNA encoded by KIAA0514, corresponding to a target binding site such as BINDING SITE I, BINDING SITE II or BINDING SITE III of FIG. 8. Table 4 illustrates the complementarity of the nucleotide sequences of KIAA0514 BINDING SITE, designated SEQ ID:3706, to the nucleotide sequence of GAM3298 RNA, herein designated GAM RNA, also designated SEQ ID:259.

Another function of GAM3298 is therefore inhibition of KIAA0514 (Accession NP__055511.1). Accordingly, utilities of GAM3298 include diagnosis, prevention and treatment of diseases and clinical conditions associated with KIAA0514.

KIAA0628 (Accession NP__055604.1) is another GAM3298 target gene, herein designated TARGET GENE. KIAA0628 BINDING SITE is a target binding site found in the 3' untranslated region of mRNA encoded by KIAA0628, corresponding to a target binding site such as BINDING SITE I, BINDING SITE II or BINDING SITE III of FIG. 8. Table 4 illustrates the complementarity of the nucleotide sequences of KIAA0628 BINDING SITE, designated SEQ ID:5410, to the nucleotide sequence of GAM3298 RNA, herein designated GAM RNA, also designated SEQ ID:259.

Another function of GAM3298 is therefore inhibition of KIAA0628 (Accession NP__055604.1). Accordingly, utilities of GAM3298 include diagnosis, prevention and treatment of diseases and clinical conditions associated with KIAA0628.

KIAA0831 (Accession NP__055739.1) is another GAM3298 target gene, herein designated TARGET GENE. KIAA0831 BINDING SITE1 and KIAA0831 BINDING SITE2 are target binding sites found in untranslated regions of mRNA encoded by KIAA0831, corresponding to target binding sites such as BINDING SITE I, BINDING SITE II or BINDING SITE III of FIG. 8. Table 4 illustrates the complementarity of the nucleotide sequences of KIAA0831 BINDING SITE1 and KIAA0831 BINDING SITE2, designated SEQ ID:840 and SEQ ID:19561 respectively, to the nucleotide sequence of GAM3298 RNA, herein designated GAM RNA, also designated SEQ ID:259.

Another function of GAM3298 is therefore inhibition of KIAA0831 (Accession NP__055739.1). Accordingly, utilities of GAM3298 include diagnosis, prevention and treatment of diseases and clinical conditions associated with KIAA0831.

KIAA0872 (Accession NP__055755.1) is another GAM3298 target gene, herein designated TARGET GENE. KIAA0872 BINDING SITE is a target binding site found in the 3' untranslated region of mRNA encoded by KIAA0872, corresponding to a target binding site such as BINDING SITE I, BINDING SITE II or BINDING SITE III of FIG. 8. Table 4 illustrates the complementarity of the nucleotide sequences of KIAA0872 BINDING SITE, designated SEQ ID:10203, to the nucleotide sequence of GAM3298 RNA, herein designated GAM RNA, also designated SEQ ID:259.

Another function of GAM3298 is therefore inhibition of KIAA0872 (Accession NP__055755.1). Accordingly, utilities of GAM3298 include diagnosis, prevention and treatment of diseases and clinical conditions associated with KIAA0872.

KIAA0889 (Accession NP__056192.1) is another GAM3298 target gene, herein designated TARGET GENE.

KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:3706, to the nucleotide sequence of GAM3298 RNA, herein designated GAM RNA, also designated SEQ ID:259.

Another function of GAM3298 is therefore inhibition of KIAA0889 (Accession NP_056192.1). Accordingly, utilities of GAM3298 include diagnosis, prevention and treatment of diseases and clinical conditions associated with KIAA0889.

KIAA0913 (Accession XP_044347.3) is another GAM3298 target gene, herein designated TARGET GENE. KIAA0913 BINDING SITE is a target binding site found in the 3' untranslated region of mRNA encoded by KIAA0913, corresponding to a target binding site such as BINDING SITE I, BINDING SITE II or BINDING SITE III of FIG. 8. Table 4 illustrates the complementarity of the nucleotide sequences of KIAA0913 BINDING SITE, designated SEQ ID:12246, to the nucleotide sequence of GAM3298 RNA, herein designated GAM RNA, also designated SEQ ID:259.

Another function of GAM3298 is therefore inhibition of KIAA0913 (Accession XP_044347.3). Accordingly, utilities of GAM3298 include diagnosis, prevention and treatment of diseases and clinical conditions associated with KIAA0913.

KIAA0953 (Accession XP_039733.2) is another GAM3298 target gene, herein designated TARGET GENE. KIAA0953 BINDING SITE is a target binding site found in the 3' untranslated region of mRNA encoded by KIAA0953, corresponding to a target binding site such as BINDING SITE I, BINDING SITE II or BINDING SITE III of FIG. 8. Table 4 illustrates the complementarity of the nucleotide sequences of KIAA0953 BINDING SITE, designated SEQ ID:6353, to the nucleotide sequence of GAM3298 RNA, herein designated GAM RNA, also designated SEQ ID:259.

Another function of GAM3298 is therefore inhibition of KIAA0953 (Accession XP_039733.2). Accordingly, utilities of GAM3298 include diagnosis, prevention and treatment of diseases and clinical conditions associated with KIAA0953.

KIAA0982 (Accession NP_054742.1) is another GAM3298 target gene, herein designated TARGET GENE. KIAA0982 BINDING SITE is a target binding site found in the 3' untranslated region of mRNA encoded by KIAA0982, corresponding to a target binding site such as BINDING SITE I, BINDING SITE II or BINDING SITE III of FIG. 8. Table 4 illustrates the complementarity of the nucleotide sequences of KIAA0982 BINDING SITE, designated SEQ ID:4347, to the nucleotide sequence of GAM3298 RNA, herein designated GAM RNA, also designated SEQ ID:259.

Another function of GAM3298 is therefore inhibition of KIAA0982 (Accession NP_054742.1). Accordingly, utilities of GAM3298 include diagnosis, prevention and treatment of diseases and clinical conditions associated with KIAA0982.

KIAA0992 (Accession NP_057165.2) is another GAM3298 target gene, herein designated TARGET GENE. KIAA0992 BINDING SITE is a target binding site found in the 3' untranslated region of mRNA encoded by KIAA0992, corresponding to a target binding site such as BINDING SITE I, BINDING SITE II or BINDING SITE III of FIG. 8. Table 4 illustrates the complementarity of the nucleotide sequences of KIAA0992 BINDING SITE, designated SEQ ID:16161, to the nucleotide sequence of GAM3298 RNA, herein designated GAM RNA, also designated SEQ ID:259.

Another function of GAM3298 is therefore inhibition of KIAA0992 (Accession NP_057165.2). Accordingly, utilities of GAM3298 include diagnosis, prevention and treatment of diseases and clinical conditions associated with KIAA0992.

KIAA1194 (Accession NP_056270.2) is another GAM3298 target gene, herein designated TARGET GENE. KIAA1194 BINDING SITE is a target binding site found in the 3' untranslated region of mRNA encoded by KIAA1194, corresponding to a target binding site such as BINDING SITE I, BINDING SITE II or BINDING SITE III of FIG. 8. Table 4 illustrates the complementarity of the nucleotide sequences of KIAA1194 BINDING SITE, designated SEQ ID:12999, to the nucleotide sequence of GAM3298 RNA, herein designated GAM RNA, also designated SEQ ID:259.

Another function of GAM3298 is therefore inhibition of KIAA1194 (Accession NP_056270.2). Accordingly, utilities of GAM3298 include diagnosis, prevention and treatment of diseases and clinical conditions associated with KIAA1194.

KIAA1377 (Accession XP_040708.2) is another GAM3298 target gene, herein designated TARGET GENE. KIAA1377 BINDING SITE is a target binding site found in the 3' untranslated region of mRNA encoded by KIAA1377, corresponding to a target binding site such as BINDING SITE I, BINDING SITE II or BINDING SITE III of FIG. 8. Table 4 illustrates the complementarity of the nucleotide sequences of KIAA1377 BINDING SITE, designated SEQ ID:9122, to the nucleotide sequence of GAM3298 RNA, herein designated GAM RNA, also designated SEQ ID:259.

Another function of GAM3298 is therefore inhibition of KIAA1377 (Accession XP_040708.2). Accordingly, utilities of GAM3298 include diagnosis, prevention and treatment of diseases and clinical conditions associated with KIAA1377.

KIAA1456 (Accession XP_040100.3) is another GAM3298 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:3706, to the nucleotide sequence of GAM3298 RNA, herein designated GAM RNA, also designated SEQ ID:259.

Another function of GAM3298 is therefore inhibition of KIAA1456 (Accession XP_040100.3). Accordingly, utilities of GAM3298 include diagnosis, prevention and treatment of diseases and clinical conditions associated with KIAA1456.

KIAA1559 (Accession XP_054472.2) is another GAM3298 target gene, herein designated TARGET GENE. KIAA1559 BINDING SITE is a target binding site found in the 3' untranslated region of mRNA encoded by KIAA1559, corresponding to a target binding site such as BINDING SITE I, BINDING SITE II or BINDING SITE III of FIG. 8. Table 4 illustrates the complementarity of the nucleotide sequences of KIAA1559 BINDING SITE, designated SEQ ID:3706, to the nucleotide sequence of GAM3298 RNA, herein designated GAM RNA, also designated SEQ ID:259.

Another function of GAM3298 is therefore inhibition of KIAA1559 (Accession XP_054472.2). Accordingly, utilities of GAM3298 include diagnosis, prevention and treatment of diseases and clinical conditions associated with KIAA1559.

KIAA1595 (Accession XP_045520.5) is another GAM3298 target gene, herein designated TARGET GENE. KIAA1595 BINDING SITE is a target binding site found in the 3' untranslated region of mRNA encoded by KIAA1595, corresponding to a target binding site such as BINDING SITE I, BINDING SITE II or BINDING SITE III of FIG. 8. Table 4 illustrates the complementarity of the nucleotide sequences of KIAA1595 BINDING SITE, designated SEQ ID:11215, to the nucleotide sequence of GAM3298 RNA, herein designated GAM RNA, also designated SEQ ID:259.

Another function of GAM3298 is therefore inhibition of KIAA1595 (Accession XP_045520.5). Accordingly, utilities of GAM3298 include diagnosis, prevention and treatment of diseases and clinical conditions associated with KIAA1595.

KIAA1630 (Accession NP_061176.2) is another GAM3298 target gene, herein designated TARGET GENE. KIAA1630 BINDING SITE is a target binding site found in the 3' untranslated region of mRNA encoded by KIAA1630, corresponding to a target binding site such as BINDING SITE I, BINDING SITE II or BINDING SITE III of FIG. 8. Table 4 illustrates the complementarity of the nucleotide sequences of KIAA1630 BINDING SITE, designated SEQ ID:8338, to the nucleotide sequence of GAM3298 RNA, herein designated GAM RNA, also designated SEQ ID:259.

Another function of GAM3298 is therefore inhibition of KIAA1630 (Accession NP_061176.2). Accordingly, utilities of GAM3298 include diagnosis, prevention and treatment of diseases and clinical conditions associated with KIAA1630.

KIAA1724 (Accession XP_040280.2) is another GAM3298 target gene, herein designated TARGET GENE. KIAA1724 BINDING SITE is a target binding site found in the 3' untranslated region of mRNA encoded by KIAA1724, corresponding to a target binding site such as BINDING SITE I, BINDING SITE II or BINDING SITE III of FIG. 8. Table 4 illustrates the complementarity of the nucleotide sequences of KIAA1724 BINDING SITE, designated SEQ ID:20160, to the nucleotide sequence of GAM3298 RNA, herein designated GAM RNA, also designated SEQ ID:259.

Another function of GAM3298 is therefore inhibition of KIAA1724 (Accession XP_040280.2). Accordingly, utilities of GAM3298 include diagnosis, prevention and treatment of diseases and clinical conditions associated with KIAA1724.

KIAA1727 (Accession XP_034262.4) is another GAM3298 target gene, herein designated TARGET GENE. KIAA1727 BINDING SITE is a target binding site found in the 3' untranslated region of mRNA encoded by KIAA1727, corresponding to a target binding site such as BINDING SITE I, BINDING SITE II or BINDING SITE III of FIG. 8. Table 4 illustrates the complementarity of the nucleotide sequences of KIAA1727 BINDING SITE, designated SEQ ID:10851, to the nucleotide sequence of GAM3298 RNA, herein designated GAM RNA, also designated SEQ ID:259.

Another function of GAM3298 is therefore inhibition of KIAA1727 (Accession XP_034262.4). Accordingly, utilities of GAM3298 include diagnosis, prevention and treatment of diseases and clinical conditions associated with KIAA1727.

KIAA1735 (Accession XP_290496.1) is another GAM3298 target gene, herein designated TARGET GENE. KIAA1735 BINDING SITE is a target binding site found in the 3' untranslated region of mRNA encoded by KIAA1735, corresponding to a target binding site such as BINDING SITE I, BINDING SITE II or BINDING SITE III of FIG. 8. Table 4 illustrates the complementarity of the nucleotide sequences of KIAA1735 BINDING SITE, designated SEQ ID:6665, to the nucleotide sequence of GAM3298 RNA, herein designated GAM RNA, also designated SEQ ID:259.

Another function of GAM3298 is therefore inhibition of KIAA1735 (Accession XP_290496.1). Accordingly, utilities of GAM3298 include diagnosis, prevention and treatment of diseases and clinical conditions associated with KIAA1735.

KIAA1771 (Accession XP_086404.1) is another GAM3298 target gene, herein designated TARGET GENE. KIAA1771 BINDING SITE is a target binding site found in the 3' untranslated region of mRNA encoded by KIAA1771, corresponding to a target binding site such as BINDING SITE I, BINDING SITE II or BINDING SITE III of FIG. 8. Table 4 illustrates the complementarity of the nucleotide sequences of KIAA1771 BINDING SITE, designated SEQ ID:7993, to the nucleotide sequence of GAM3298 RNA, herein designated GAM RNA, also designated SEQ ID:259.

Another function of GAM3298 is therefore inhibition of KIAA1771 (Accession XP_086404.1). Accordingly, utilities of GAM3298 include diagnosis, prevention and treatment of diseases and clinical conditions associated with KIAA1771.

KIAA1871 (Accession XP_290737.1) is another GAM3298 target gene, herein designated TARGET GENE. KIAA1871 BINDING SITE is a target binding site found in the 3' untranslated region of mRNA encoded by KIAA1871, corresponding to a target binding site such as BINDING SITE I, BINDING SITE II or BINDING SITE III of FIG. 8. Table 4 illustrates the complementarity of the nucleotide sequences of KIAA1871 BINDING SITE, designated SEQ ID:18994, to the nucleotide sequence of GAM3298 RNA, herein designated GAM RNA, also designated SEQ ID:259.

Another function of GAM3298 is therefore inhibition of KIAA1871 (Accession XP_290737.1). Accordingly, utilities of GAM3298 include diagnosis, prevention and treatment of diseases and clinical conditions associated with KIAA1871.

KIAA1950 (Accession XP_166532.1) is another GAM3298 target gene, herein designated TARGET GENE. KIAA1950 BINDING SITE is a target binding site found in the 3' untranslated region of mRNA encoded by KIAA1950, corresponding to a target binding site such as BINDING SITE I, BINDING SITE II or BINDING SITE III of FIG. 8. Table 4 illustrates the complementarity of the nucleotide sequences of KIAA1950 BINDING SITE, designated SEQ ID:6327, to the nucleotide sequence of GAM3298 RNA, herein designated GAM RNA, also designated SEQ ID:259.

Another function of GAM3298 is therefore inhibition of KIAA1950 (Accession XP_166532.1). Accordingly, utilities of GAM3298 include diagnosis, prevention and treatment of diseases and clinical conditions associated with KIAA1950.

KIF11 (Accession NP_004514.2) is another GAM3298 target gene, herein designated TARGET GENE. KIF11 BINDING SITE is a target binding site found in the 3' untranslated region of mRNA encoded by KIF11, corresponding to a target binding site such as BINDING SITE I, BINDING SITE II or BINDING SITE III of FIG. 8. Table 4 illustrates the complementarity of the nucleotide sequences of KIF11 BINDING SITE, designated SEQ ID:3706, to the nucleotide sequence of GAM3298 RNA, herein designated GAM RNA, also designated SEQ ID:259.

Another function of GAM3298 is therefore inhibition of KIF11 (Accession NP_004514.2). Accordingly, utilities of GAM3298 include diagnosis, prevention and treatment of diseases and clinical conditions associated with KIF11.

Kinesin family member 3b (KIF3B, Accession NP_004789.1) is another GAM3298 target gene, herein designated TARGET GENE. KIF3B BINDING SITE is a target binding site found in the 3' untranslated region of mRNA encoded by KIF3B, corresponding to a target binding site such as BINDING SITE I, BINDING SITE II or BINDING SITE III of FIG. 8. Table 4 illustrates the complementarity of the nucleotide sequences of KIF3B BINDING SITE, designated SEQ ID:14234, to the nucleotide sequence of GAM3298 RNA, herein designated GAM RNA, also designated SEQ ID:259.

Another function of GAM3298 is therefore inhibition of Kinesin family member 3b (KIF3B, Accession NP_004789.1), a gene which is a microtubule-based anterograde translocator for membranous organelles. Accordingly, utilities of GAM3298 include diagnosis, prevention and treatment of diseases and clinical conditions associated with KIF3B.

The function of KIF3B and its association with various diseases and clinical conditions, has been established by previous studies, as described hereinabove with reference to GAM72.1. Karyopherin (importin) beta 3 (KPNB3, Accession NP_002262.3) is another GAM3298 target gene, herein designated TARGET GENE. KPNB3 BINDING SITE1 and KPNB3 BINDING SITE2 are target binding sites found in untranslated regions of mRNA encoded by KPNB3, corresponding to target binding sites such as BINDING SITE I, BINDING SITE II or BINDING SITE III of FIG. 8. Table 4 illustrates the complementarity of the nucleotide sequences of KPNB3 BINDING SITE1 and KPNB3 BINDING SITE2, designated SEQ ID:7119 and SEQ ID:18083 respectively, to the nucleotide sequence of GAM3298 RNA, herein designated GAM RNA, also designated SEQ ID:259.

Another function of GAM3298 is therefore inhibition of Karyopherin (importin) beta 3 (KPNB3, Accession NP_002262.3). Accordingly, utilities of GAM3298 include diagnosis, prevention and treatment of diseases and clinical conditions associated with KPNB3.

Kringle containing transmembrane protein 1 (KREMEN1, Accession NP_114434.3) is another GAM3298 target gene, herein designated TARGET GENE. KREMEN1 BINDING SITE is a target binding site found in the 3' untranslated region of multiple transcripts of mRNA encoded by KREMEN1, corresponding to a target binding site such as BINDING SITE I, BINDING SITE II or BINDING SITE III of FIG. 8. Table 4 illustrates the complementarity of the nucleotide sequences of KREMEN1 BINDING SITE, designated SEQ ID:841, to the nucleotide sequence of GAM3298 RNA, herein designated GAM RNA, also designated SEQ ID:259.

Another function of GAM3298 is therefore inhibition of Kringle containing transmembrane protein 1 (KREMEN1, Accession NP_114434.3). Accordingly, utilities of GAM3298 include diagnosis, prevention and treatment of diseases and clinical conditions associated with KREMEN1.

Link-GEFII (Accession NP_057423.1) is another GAM3298 target gene, herein designated TARGET GENE. Link-GEFII BINDING SITE is a target binding site found in the 3' untranslated region of mRNA encoded by Link-GEFII, corresponding to a target binding site such as BINDING SITE I, BINDING SITE II or BINDING SITE III of FIG. 8. Table 4 illustrates the complementarity of the nucleotide sequences of Link-GEFII BINDING SITE, designated SEQ ID:15182, to the nucleotide sequence of GAM3298 RNA, herein designated GAM RNA, also designated SEQ ID:259.

Another function of GAM3298 is therefore inhibition of Link-GEFII (Accession NP_057423.1). Accordingly, utilities of GAM3298 include diagnosis, prevention and treatment of diseases and clinical conditions associated with Link-GEFII.

LOC115129 (Accession XP_055292.1) is another GAM3298 target gene, herein designated TARGET GENE. LOC115129 BINDING SITE is a target binding site found in the 3' untranslated region of mRNA encoded by LOC115129, corresponding to a target binding site such as BINDING SITE I, BINDING SITE II or BINDING SITE III of FIG. 8. Table 4 illustrates the complementarity of the nucleotide sequences of LOC115129 BINDING SITE, designated SEQ ID:8061, to the nucleotide sequence of GAM3298 RNA, herein designated GAM RNA, also designated SEQ ID:259.

Another function of GAM3298 is therefore inhibition of LOC115129 (Accession XP_055292.1). Accordingly, utilities of GAM3298 include diagnosis, prevention and treatment of diseases and clinical conditions associated with LOC115129.

LOC116143 (Accession NP_612467.1) is another GAM3298 target gene, herein designated TARGET GENE. LOC116143 BINDING SITE is a target binding site found in the 3' untranslated region of mRNA encoded by LOC116143, corresponding to a target binding site such as BINDING SITE I, BINDING SITE II or BINDING SITE III of FIG. 8. Table 4 illustrates the complementarity of the nucleotide sequences of LOC116143 BINDING SITE, designated SEQ ID:7468, to the nucleotide sequence of GAM3298 RNA, herein designated GAM RNA, also designated SEQ ID:259.

Another function of GAM3298 is therefore inhibition of LOC116143 (Accession NP_612467.1). Accordingly, utilities of GAM3298 include diagnosis, prevention and treatment of diseases and clinical conditions associated with LOC116143.

LOC116228 (Accession XP_300752.1) is another GAM3298 target gene, herein designated TARGET GENE. LOC116228 BINDING SITE is a target binding site found in the 3' untranslated region of mRNA encoded by LOC116228, corresponding to a target binding site such as BINDING SITE I, BINDING SITE II or BINDING SITE III of FIG. 8. Table 4 illustrates the complementarity of the nucleotide sequences of LOC116228 BINDING SITE, designated SEQ ID:815, to the nucleotide sequence of GAM3298 RNA, herein designated GAM RNA, also designated SEQ ID:259.

Another function of GAM3298 is therefore inhibition of LOC116228 (Accession XP_300752.1). Accordingly, utilities of GAM3298 include diagnosis, prevention and treatment of diseases and clinical conditions associated with LOC116228.

LOC124411 (Accession XP_058804.4) is another GAM3298 target gene, herein designated TARGET GENE. LOC124411 BINDING SITE is a target binding site found in the 3' untranslated region of mRNA encoded by LOC124411, corresponding to a target binding site such as BINDING SITE I, BINDING SITE II or BINDING SITE III of FIG. 8. Table 4 illustrates the complementarity of the nucleotide sequences of LOC124411 BINDING SITE, designated SEQ ID:9305, to the nucleotide sequence of GAM3298 RNA, herein designated GAM RNA, also designated SEQ ID:259.

Another function of GAM3298 is therefore inhibition of LOC124411 (Accession XP_058804.4). Accordingly, utilities of GAM3298 include diagnosis, prevention and treatment of diseases and clinical conditions associated with LOC124411.

LOC130574 (Accession XP_059451.1) is another GAM3298 target gene, herein designated TARGET GENE. LOC130574 BINDING SITE1 and LOC130574 BINDING SITE2 are target binding sites found in untranslated regions of mRNA encoded by LOC130574, corresponding to target binding sites such as BINDING SITE I, BINDING SITE II or BINDING SITE III of FIG. 8. Table 4 illustrates the complementarity of the nucleotide sequences of LOC130574 BINDING SITE1 and LOC130574 BINDING SITE2, designated SEQ ID:5219 and SEQ ID:10337 respectively, to the nucleotide sequence of GAM3298 RNA, herein designated GAM RNA, also designated SEQ ID:259.

Another function of GAM3298 is therefore inhibition of LOC130574 (Accession XP_059451.1). Accordingly, utilities of GAM3298 include diagnosis, prevention and treatment of diseases and clinical conditions associated with LOC130574.

LOC132724 (Accession XP_068002.4) is another GAM3298 target gene, herein designated TARGET GENE. LOC132724 BINDING SITE is a target binding site found in the 3' untranslated region of mRNA encoded by LOC132724, corresponding to a target binding site such as BINDING SITE I, BINDING SITE II or BINDING SITE III of FIG. 8. Table 4 illustrates the complementarity of the nucleotide sequences of LOC132724 BINDING SITE, designated SEQ ID:8048, to the nucleotide sequence of GAM3298 RNA, herein designated GAM RNA, also designated SEQ ID:259.

Another function of GAM3298 is therefore inhibition of LOC132724 (Accession XP_068002.4). Accordingly, utilities of GAM3298 include diagnosis, prevention and treatment of diseases and clinical conditions associated with LOC132724.

LOC134147 (Accession NP_620164.1) is another GAM3298 target gene, herein designated TARGET GENE. LOC134147 BINDING SITE is a target binding site found in the 3' untranslated region of mRNA encoded by LOC134147, corresponding to a target binding site such as BINDING SITE I, BINDING SITE II or BINDING SITE III of FIG. 8. Table 4 illustrates the complementarity of the nucleotide sequences of LOC134147 BINDING SITE, designated SEQ ID:11885, to the nucleotide sequence of GAM3298 RNA, herein designated GAM RNA, also designated SEQ ID:259.

Another function of GAM3298 is therefore inhibition of LOC134147 (Accession NP_620164.1). Accordingly, utilities of GAM3298 include diagnosis, prevention and treatment of diseases and clinical conditions associated with LOC134147.

LOC142779 (Accession XP_084337.1) is another GAM3298 target gene, herein designated TARGET GENE. LOC142779 BINDING SITE is a target binding site found in the 3' untranslated region of mRNA encoded by LOC142779, corresponding to a target binding site such as BINDING SITE I, BINDING SITE II or BINDING SITE III of FIG. 8. Table 4 illustrates the complementarity of the nucleotide sequences of LOC142779 BINDING SITE, designated SEQ ID:9354, to the nucleotide sequence of GAM3298 RNA, herein designated GAM RNA, also designated SEQ ID:259.

Another function of GAM3298 is therefore inhibition of LOC142779 (Accession XP_084337.1). Accordingly, utilities of GAM3298 include diagnosis, prevention and treatment of diseases and clinical conditions associated with LOC142779.

LOC143458 (Accession NP_777562.1) is another GAM3298 target gene, herein designated TARGET GENE. LOC143458 BINDING SITE is a target binding site found in the 3' untranslated region of mRNA encoded by LOC143458, corresponding to a target binding site such as BINDING SITE I, BINDING SITE II or BINDING SITE III of FIG. 8. Table 4 illustrates the complementarity of the nucleotide sequences of LOC143458 BINDING SITE, designated SEQ ID:19260, to the nucleotide sequence of GAM3298 RNA, herein designated GAM RNA, also designated SEQ ID:259.

Another function of GAM3298 is therefore inhibition of LOC143458 (Accession NP_777562.1). Accordingly, utilities of GAM3298 include diagnosis, prevention and treatment of diseases and clinical conditions associated with LOC143458.

LOC144817 (Accession XP_084972.1) is another GAM3298 target gene, herein designated TARGET GENE. LOC144817 BINDING SITE is a target binding site found in the 3' untranslated region of mRNA encoded by LOC144817, corresponding to a target binding site such as BINDING SITE I, BINDING SITE II or BINDING SITE III of FIG. 8. Table 4 illustrates the complementarity of the nucleotide sequences of LOC144817 BINDING SITE, designated SEQ ID:7468, to the nucleotide sequence of GAM3298 RNA, herein designated GAM RNA, also designated SEQ ID:259.

Another function of GAM3298 is therefore inhibition of LOC144817 (Accession XP_084972.1). Accordingly, utilities of GAM3298 include diagnosis, prevention and treatment of diseases and clinical conditions associated with LOC144817.

LOC144845 (Accession NP_612483.1) is another GAM3298 target gene, herein designated TARGET GENE. LOC144845 BINDING SITE is a target binding site found in the 3' untranslated region of mRNA encoded by LOC144845, corresponding to a target binding site such as BINDING SITE I, BINDING SITE II or BINDING SITE III of FIG. 8. Table 4 illustrates the complementarity of the nucleotide sequences of LOC144845 BINDING SITE, designated SEQ ID:7468, to the nucleotide sequence of GAM3298 RNA, herein designated GAM RNA, also designated SEQ ID:259.

Another function of GAM3298 is therefore inhibition of LOC144845 (Accession NP_612483.1). Accordingly, utilities of GAM3298 include diagnosis, prevention and treatment of diseases and clinical conditions associated with LOC144845.

LOC145231 (Accession XP_096740.1) is another GAM3298 target gene, herein designated TARGET GENE. LOC145231 BINDING SITE is a target binding site found in the 3' untranslated region of mRNA encoded by LOC145231, corresponding to a target binding site such as BINDING SITE I, BINDING SITE II or BINDING SITE III of FIG. 8. Table 4 illustrates the complementarity of the nucleotide sequences of LOC145231 BINDING SITE, designated SEQ ID:16046, to the nucleotide sequence of GAM3298 RNA, herein designated GAM RNA, also designated SEQ ID:259.

Another function of GAM3298 is therefore inhibition of LOC145231 (Accession XP_096740.1). Accordingly, utilities of GAM3298 include diagnosis, prevention and treatment of diseases and clinical conditions associated with LOC145231.

LOC145663 (Accession XP_096829.1) is another GAM3298 target gene, herein designated TARGET GENE. LOC145663 BINDING SITE is a target binding site found in the 3' untranslated region of mRNA encoded by LOC145663, corresponding to a target binding site such as BINDING SITE I, BINDING SITE II or BINDING SITE III of FIG. 8. Table 4 illustrates the complementarity of the nucleotide sequences of LOC145663 BINDING SITE, designated SEQ ID:6352, to the nucleotide sequence of GAM3298 RNA, herein designated GAM RNA, also designated SEQ ID:259.

Another function of GAM3298 is therefore inhibition of LOC145663 (Accession XP_096829.1). Accordingly, utilities of GAM3298 include diagnosis, prevention and treatment of diseases and clinical conditions associated with LOC145663.

LOC145757 (Accession XP_085227.1) is another GAM3298 target gene, herein designated TARGET GENE. LOC145757 BINDING SITE is a target binding site found in the 3' untranslated region of mRNA encoded by LOC145757, corresponding to a target binding site such as BINDING SITE I, BINDING SITE II or BINDING SITE III of FIG. 8. Table 4 illustrates the complementarity of the nucleotide sequences of LOC145757 BINDING SITE, designated SEQ ID:3706, to the nucleotide sequence of GAM3298 RNA, herein designated GAM RNA, also designated SEQ ID:259.

Another function of GAM3298 is therefore inhibition of LOC145757 (Accession XP_085227.1). Accordingly, utilities of GAM3298 include diagnosis, prevention and treatment of diseases and clinical conditions associated with LOC145757.

LOC145824 (Accession XP_085247.1) is another GAM3298 target gene, herein designated TARGET GENE. LOC145824 BINDING SITE is a target binding site found in the 3' untranslated region of mRNA encoded by LOC145824, corresponding to a target binding site such as BINDING SITE I, BINDING SITE II or BINDING SITE III of FIG. 8. Table 4 illustrates the complementarity of the nucleotide sequences of LOC145824 BINDING SITE, designated SEQ ID:14990, to the nucleotide sequence of GAM3298 RNA, herein designated GAM RNA, also designated SEQ ID:259.

Another function of GAM3298 is therefore inhibition of LOC145824 (Accession XP_085247.1). Accordingly, utilities of GAM3298 include diagnosis, prevention and treatment of diseases and clinical conditions associated with LOC145824.

LOC146013 (Accession XP_096919.1) is another GAM3298 target gene, herein designated TARGET GENE. LOC146013 BINDING SITE is a target binding site found in the 3' untranslated region of mRNA encoded by LOC146013, corresponding to a target binding site such as BINDING SITE I, BINDING SITE II or BINDING SITE III of FIG. 8. Table 4 illustrates the complementarity of the nucleotide sequences of LOC146013 BINDING SITE, designated SEQ ID:8603, to the nucleotide sequence of GAM3298 RNA, herein designated GAM RNA, also designated SEQ ID:259.

Another function of GAM3298 is therefore inhibition of LOC146013 (Accession XP_096919.1). Accordingly, utilities of GAM3298 include diagnosis, prevention and treatment of diseases and clinical conditions associated with LOC146013.

LOC146958 (Accession XP_097142.1) is another GAM3298 target gene, herein designated TARGET GENE. LOC146958 BINDING SITE is a target binding site found in the 3' untranslated region of mRNA encoded by LOC146958, corresponding to a target binding site such as BINDING SITE I, BINDING SITE II or BINDING SITE III of FIG. 8. Table 4 illustrates the complementarity of the nucleotide sequences of LOC146958 BINDING SITE, designated SEQ ID:11424, to the nucleotide sequence of GAM3298 RNA, herein designated GAM RNA, also designated SEQ ID:259.

Another function of GAM3298 is therefore inhibition of LOC146958 (Accession XP_097142.1). Accordingly, utilities of GAM3298 include diagnosis, prevention and treatment of diseases and clinical conditions associated with LOC146958.

LOC147841 (Accession XP_085924.2) is another GAM3298 target gene, herein designated TARGET GENE. LOC147841 BINDING SITE is a target binding site found in the 3' untranslated region of mRNA encoded by LOC147841, corresponding to a target binding site such as BINDING SITE I, BINDING SITE II or BINDING SITE III of FIG. 8. Table 4 illustrates the complementarity of the nucleotide sequences of LOC147841 BINDING SITE, designated SEQ ID:16695, to the nucleotide sequence of GAM3298 RNA, herein designated GAM RNA, also designated SEQ ID:259.

Another function of GAM3298 is therefore inhibition of LOC147841 (Accession XP_085924.2). Accordingly, utilities of GAM3298 include diagnosis, prevention and treatment of diseases and clinical conditions associated with LOC147841.

LOC149464 (Accession XP_097645.1) is another GAM3298 target gene, herein designated TARGET GENE. LOC149464 BINDING SITE is a target binding site found in the 5' untranslated region of mRNA encoded by LOC149464, corresponding to a target binding site such as BINDING SITE I, BINDING SITE II or BINDING SITE III of FIG. 8. Table 4 illustrates the complementarity of the nucleotide sequences of LOC149464 BINDING SITE, designated SEQ ID:7723, to the nucleotide sequence of GAM3298 RNA, herein designated GAM RNA, also designated SEQ ID:259.

Another function of GAM3298 is therefore inhibition of LOC149464 (Accession XP_097645.1). Accordingly, utilities of GAM3298 include diagnosis, prevention and treatment of diseases and clinical conditions associated with LOC149464.

LOC149910 (Accession XP_086699.1) is another GAM3298 target gene, herein designated TARGET GENE. LOC149910 BINDING SITE is a target binding site found in the 3' untranslated region of mRNA encoded by LOC149910, corresponding to a target binding site such as BINDING SITE I, BINDING SITE II or BINDING SITE III of FIG. 8. Table 4 illustrates the complementarity of the nucleotide sequences of LOC149910 BINDING SITE, designated SEQ ID:3001, to the nucleotide sequence of GAM3298 RNA, herein designated GAM RNA, also designated SEQ ID:259.

Another function of GAM3298 is therefore inhibition of LOC149910 (Accession XP_086699.1). Accordingly, utilities of GAM3298 include diagnosis, prevention and treatment of diseases and clinical conditions associated with LOC149910.

LOC150225 (Accession XP_097870.1) is another GAM3298 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:10727, to the nucleotide sequence of GAM3298 RNA, herein designated GAM RNA, also designated SEQ ID:259.

Another function of GAM3298 is therefore inhibition of LOC150225 (Accession XP_097870.1). Accordingly, utilities of GAM3298 include diagnosis, prevention and treatment of diseases and clinical conditions associated with LOC150225.

LOC150287 (Accession XP_086889.1) is another GAM3298 target gene, herein designated TARGET GENE. LOC150287 BINDING SITE is a target binding site found in the 3' untranslated region of mRNA encoded by LOC150287, corresponding to a target binding site such as BINDING SITE I, BINDING SITE II or BINDING SITE III of FIG. 8. Table 4 illustrates the complementarity of the nucleotide sequences of LOC150287 BINDING SITE, designated SEQ ID:3702, to the nucleotide sequence of GAM3298 RNA, herein designated GAM RNA, also designated SEQ ID:259.

Another function of GAM3298 is therefore inhibition of LOC150287 (Accession XP_086889.1). Accordingly, utilities of GAM3298 include diagnosis, prevention and treatment of diseases and clinical conditions associated with LOC150287.

LOC150299 (Accession XP_097869.2) is another GAM3298 target gene, herein designated TARGET GENE. LOC150299 BINDING SITE is a target binding site found in the 3' untranslated region of mRNA encoded by LOC150299, corresponding to a target binding site such as BINDING SITE I, BINDING SITE II or BINDING SITE III of FIG. 8. Table 4 illustrates the complementarity of the nucleotide sequences of LOC150299 BINDING SITE, designated SEQ ID:12013, to the nucleotide sequence of GAM3298 RNA, herein designated GAM RNA, also designated SEQ ID:259.

Another function of GAM3298 is therefore inhibition of LOC150299 (Accession XP_097869.2). Accordingly, utilities of GAM3298 include diagnosis, prevention and treatment of diseases and clinical conditions associated with LOC150299.

LOC150630 (Accession XP_097931.1) is another GAM3298 target gene, herein designated TARGET GENE. LOC150630 BINDING SITE is a target binding site found in the 3' untranslated region of mRNA encoded by LOC150630, corresponding to a target binding site such as BINDING SITE I, BINDING SITE II or BINDING SITE III of FIG. 8. Table 4 illustrates the complementarity of the nucleotide sequences of LOC150630 BINDING SITE, designated SEQ ID:3706, to the nucleotide sequence of GAM3298 RNA, herein designated GAM RNA, also designated SEQ ID:259.

Another function of GAM3298 is therefore inhibition of LOC150630 (Accession XP_097931.1). Accordingly, utilities of GAM3298 include diagnosis, prevention and treatment of diseases and clinical conditions associated with LOC150630.

LOC151068 (Accession XP_098000.1) is another GAM3298 target gene, herein designated TARGET GENE. LOC151068 BINDING SITE is a target binding site found in the 3' untranslated region of mRNA encoded by LOC151068, corresponding to a target binding site such as BINDING SITE I, BINDING SITE II or BINDING SITE III of FIG. 8. Table 4 illustrates the complementarity of the nucleotide sequences of LOC151068 BINDING SITE, designated SEQ ID:12510, to the nucleotide sequence of GAM3298 RNA, herein designated GAM RNA, also designated SEQ ID:259.

Another function of GAM3298 is therefore inhibition of LOC151068 (Accession XP_098000.1). Accordingly, utilities of GAM3298 include diagnosis, prevention and treatment of diseases and clinical conditions associated with LOC151068.

LOC151438 (Accession XP_098060.1) is another GAM3298 target gene, herein designated TARGET GENE. LOC151438 BINDING SITE is a target binding site found in the 3' untranslated region of mRNA encoded by LOC151438, corresponding to a target binding site such as BINDING SITE I, BINDING SITE II or BINDING SITE III of FIG. 8. Table 4 illustrates the complementarity of the nucleotide sequences of LOC151438 BINDING SITE, designated SEQ ID:6221, to the nucleotide sequence of GAM3298 RNA, herein designated GAM RNA, also designated SEQ ID:259.

Another function of GAM3298 is therefore inhibition of LOC151438 (Accession XP_098060.1). Accordingly, utilities of GAM3298 include diagnosis, prevention and treatment of diseases and clinical conditions associated with LOC151438.

LOC153338 (Accession XP_098361.1) is another GAM3298 target gene, herein designated TARGET GENE. LOC153338 BINDING SITE is a target binding site found in the 3' untranslated region of mRNA encoded by LOC153338, corresponding to a target binding site such as BINDING SITE I, BINDING SITE II or BINDING SITE III of FIG. 8. Table 4 illustrates the complementarity of the nucleotide sequences of LOC153338 BINDING SITE, designated SEQ ID:16145, to the nucleotide sequence of GAM3298 RNA, herein designated GAM RNA, also designated SEQ ID:259.

Another function of GAM3298 is therefore inhibition of LOC153338 (Accession XP_098361.1). Accordingly, utilities of GAM3298 include diagnosis, prevention and treatment of diseases and clinical conditions associated with LOC153338.

LOC153561 (Accession XP_087708.6) is another GAM3298 target gene, herein designated TARGET GENE. LOC153561 BINDING SITE1 and LOC153561 BINDING SITE2 are target binding sites found in untranslated regions of mRNA encoded by LOC153561, corresponding to target binding sites such as BINDING SITE I, BINDING SITE II or BINDING SITE III of FIG. 8. Table 4 illustrates the complementarity of the nucleotide sequences of LOC153561 BINDING SITE1 and LOC153561 BINDING SITE2, designated SEQ ID:4776 and SEQ ID:3706 respectively, to the nucleotide sequence of GAM3298 RNA, herein designated GAM RNA, also designated SEQ ID:259.

Another function of GAM3298 is therefore inhibition of LOC153561 (Accession XP_087708.6). Accordingly, utilities of GAM3298 include diagnosis, prevention and treatment of diseases and clinical conditions associated with LOC153561.

LOC153682 (Accession XP_098414.1) is another GAM3298 target gene, herein designated TARGET GENE. LOC153682 BINDING SITE is a target binding site found in the 3' untranslated region of mRNA encoded by LOC153682, corresponding to a target binding site such as BINDING SITE I, BINDING SITE II or BINDING SITE III of FIG. 8. Table 4 illustrates the complementarity of the nucleotide sequences of LOC153682 BINDING SITE, designated SEQ ID:8989, to the nucleotide sequence of GAM3298 RNA, herein designated GAM RNA, also designated SEQ ID:259.

Another function of GAM3298 is therefore inhibition of LOC153682 (Accession XP_098414.1). Accordingly, utilities of GAM3298 include diagnosis, prevention and treatment of diseases and clinical conditions associated with LOC153682.

LOC153727 (Accession XP_098422.1) is another GAM3298 target gene, herein designated TARGET GENE. LOC153727 BINDING SITE is a target binding site found in the 3' untranslated region of mRNA encoded by LOC153727, corresponding to a target binding site such as BINDING SITE I, BINDING SITE II or BINDING SITE III of FIG. 8. Table 4 illustrates the complementarity of the nucleotide sequences of LOC153727 BINDING SITE, designated SEQ ID:6353, to the nucleotide sequence of GAM3298 RNA, herein designated GAM RNA, also designated SEQ ID:259.

Another function of GAM3298 is therefore inhibition of LOC153727 (Accession XP_098422.1). Accordingly, utilities of GAM3298 include diagnosis, prevention and treatment of diseases and clinical conditions associated with LOC153727.

LOC155006 (Accession XP_088117.1) is another GAM3298 target gene, herein designated TARGET GENE. LOC155006 BINDING SITE1 and LOC155006 BINDING SITE2 are target binding sites found in untranslated regions of mRNA encoded by LOC155006, corresponding to target binding sites such as BINDING SITE I, BINDING SITE II or BINDING SITE III of FIG. 8. Table 4 illustrates the complementarity of the nucleotide sequences of LOC155006 BINDING SITE1 and LOC155006 BINDING SITE2, designated SEQ ID:12246 and SEQ ID:3706 respectively, to the nucleotide sequence of GAM3298 RNA, herein designated GAM RNA, also designated SEQ ID:259.

Another function of GAM3298 is therefore inhibition of LOC155006 (Accession XP_088117.1). Accordingly, utilities of GAM3298 include diagnosis, prevention and treatment of diseases and clinical conditions associated with LOC155006.

LOC157531 (Accession XP_212210.1) is another GAM3298 target gene, herein designated TARGET GENE. LOC157531 BINDING SITE is a target binding site found in the 5' untranslated region of multiple transcripts of mRNA encoded by LOC157531, corresponding to a target binding site such as BINDING SITE I, BINDING SITE II or BINDING SITE III of FIG. 8. Table 4 illustrates the complementarity of the nucleotide sequences of LOC157531 BINDING SITE, designated SEQ ID:15279, to the nucleotide sequence of GAM3298 RNA, herein designated GAM RNA, also designated SEQ ID:259.

Another function of GAM3298 is therefore inhibition of LOC157531 (Accession XP_212210.1). Accordingly, utilities of GAM3298 include diagnosis, prevention and treatment of diseases and clinical conditions associated with LOC157531.

LOC158434 (Accession XP_098939.1) is another GAM3298 target gene, herein designated TARGET GENE. LOC158434 BINDING SITE is a target binding site found in the 3' untranslated region of mRNA encoded by LOC158434, corresponding to a target binding site such as BINDING SITE I, BINDING SITE II or BINDING SITE III of FIG. 8. Table 4 illustrates the complementarity of the nucleotide sequences of LOC158434 BINDING SITE, designated SEQ ID:8220, to the nucleotide sequence of GAM3298 RNA, herein designated GAM RNA, also designated SEQ ID:259.

Another function of GAM3298 is therefore inhibition of LOC158434 (Accession XP_098939.1). Accordingly, utilities of GAM3298 include diagnosis, prevention and treatment of diseases and clinical conditions associated with LOC158434.

LOC159036 (Accession XP_099018.1) is another GAM3298 target gene, herein designated TARGET GENE. LOC159036 BINDING SITE is a target binding site found in the 3' untranslated region of mRNA encoded by LOC159036, corresponding to a target binding site such as BINDING SITE I, BINDING SITE II or BINDING SITE III of FIG. 8. Table 4 illustrates the complementarity of the nucleotide sequences of LOC159036 BINDING SITE, designated SEQ ID:816, to the nucleotide sequence of GAM3298 RNA, herein designated GAM RNA, also designated SEQ ID:259.

Another function of GAM3298 is therefore inhibition of LOC159036 (Accession XP_099018.1). Accordingly, utilities of GAM3298 include diagnosis, prevention and treatment of diseases and clinical conditions associated with LOC159036.

LOC163259 (Accession XP_088769.6) is another GAM3298 target gene, herein designated TARGET GENE. LOC163259 BINDING SITE is a target binding site found in the 3' untranslated region of mRNA encoded by LOC163259, corresponding to a target binding site such as BINDING SITE I, BINDING SITE II or BINDING SITE III of FIG. 8. Table 4 illustrates the complementarity of the nucleotide sequences of LOC163259 BINDING SITE, designated SEQ ID:7144, to the nucleotide sequence of GAM3298 RNA, herein designated GAM RNA, also designated SEQ ID:259.

Another function of GAM3298 is therefore inhibition of LOC163259 (Accession XP_088769.6). Accordingly, utilities of GAM3298 include diagnosis, prevention and treatment of diseases and clinical conditions associated with LOC163259.

LOC165324 (Accession XP_092518.1) is another GAM3298 target gene, herein designated TARGET GENE. LOC165324 BINDING SITE is a target binding site found in the 3' untranslated region of mRNA encoded by LOC165324, corresponding to a target binding site such as BINDING SITE I, BINDING SITE II or BINDING SITE III of FIG. 8. Table 4 illustrates the complementarity of the nucleotide sequences of LOC165324 BINDING SITE, designated SEQ ID:3706, to the nucleotide sequence of GAM3298 RNA, herein designated GAM RNA, also designated SEQ ID:259.

Another function of GAM3298 is therefore inhibition of LOC165324 (Accession XP_092518.1). Accordingly, utilities of GAM3298 include diagnosis, prevention and treatment of diseases and clinical conditions associated with LOC165324.

LOC166522 (Accession XP_093920.5) is another GAM3298 target gene, herein designated TARGET GENE. LOC166522 BINDING SITE is a target binding site found in the 3' untranslated region of mRNA encoded by LOC166522, corresponding to a target binding site such as BINDING SITE I, BINDING SITE II or BINDING SITE III of FIG. 8. Table 4 illustrates the complementarity of the nucleotide sequences of LOC166522 BINDING SITE, designated SEQ ID:16780, to the nucleotide sequence of GAM3298 RNA, herein designated GAM RNA, also designated SEQ ID:259.

Another function of GAM3298 is therefore inhibition of LOC166522 (Accession XP_093920.5). Accordingly, utilities of GAM3298 include diagnosis, prevention and treatment of diseases and clinical conditions associated with LOC166522.

LOC196540 (Accession XP_116933.1) is another GAM3298 target gene, herein designated TARGET GENE. LOC196540 BINDING SITE is a target binding site found in the 5' untranslated region of mRNA encoded by LOC196540, corresponding to a target binding site such as BINDING SITE I, BINDING SITE II or BINDING SITE III of FIG. 8. Table 4 illustrates the complementarity of the nucleotide sequences of LOC196540 BINDING SITE, designated SEQ ID:2952, to the nucleotide sequence of GAM3298 RNA, herein designated GAM RNA, also designated SEQ ID:259.

Another function of GAM3298 is therefore inhibition of LOC196540 (Accession XP_116933.1). Accordingly, utilities of GAM3298 include diagnosis, prevention and treatment of diseases and clinical conditions associated with LOC196540.

LOC199733 (Accession XP_117123.2) is another GAM3298 target gene, herein designated TARGET GENE. LOC199733 BINDING SITE is a target binding site found in the 3' untranslated region of mRNA encoded by LOC199733, corresponding to a target binding site such as BINDING SITE I, BINDING SITE II or BINDING SITE III of FIG. 8. Table 4 illustrates the complementarity of the nucleotide sequences of LOC199733 BINDING SITE, designated SEQ ID:7468, to the nucleotide sequence of GAM3298 RNA, herein designated GAM RNA, also designated SEQ ID:259.

Another function of GAM3298 is therefore inhibition of LOC199733 (Accession XP_117123.2). Accordingly, utilities of GAM3298 include diagnosis, prevention and treatment of diseases and clinical conditions associated with LOC199733.

LOC200008 (Accession XP_114089.3) is another GAM3298 target gene, herein designated TARGET GENE. LOC200008 BINDING SITE1 and LOC200008 BINDING SITE2 are target binding sites found in untranslated regions of mRNA encoded by LOC200008, corresponding to target binding sites such as BINDING SITE I, BINDING SITE II or BINDING SITE III of FIG. 8. Table 4 illustrates the complementarity of the nucleotide sequences of LOC200008 BINDING SITE1 and LOC200008 BINDING SITE2, designated SEQ ID:6353 and SEQ ID:3706 respectively, to the nucleotide sequence of GAM3298 RNA, herein designated GAM RNA, also designated SEQ ID:259.

Another function of GAM3298 is therefore inhibition of LOC200008 (Accession XP_114089.3). Accordingly, utilities of GAM3298 include diagnosis, prevention and treatment of diseases and clinical conditions associated with LOC200008.

LOC201475 (Accession XP_113967.1) is another GAM3298 target gene, herein designated TARGET GENE. LOC201475 BINDING SITE is a target binding site found in the 3' untranslated region of mRNA encoded by LOC201475, corresponding to a target binding site such as BINDING SITE I, BINDING SITE II or BINDING SITE III of FIG. 8. Table 4 illustrates the complementarity of the nucleotide sequences of LOC201475 BINDING SITE, designated SEQ ID:9894, to the nucleotide sequence of GAM3298 RNA, herein designated GAM RNA, also designated SEQ ID:259.

Another function of GAM3298 is therefore inhibition of LOC201475 (Accession XP_113967.1). Accordingly, utilities of GAM3298 include diagnosis, prevention and treatment of diseases and clinical conditions associated with LOC201475.

LOC201810 (Accession XP_114383.1) is another GAM3298 target gene, herein designated TARGET GENE. LOC201810 BINDING SITE is a target binding site found in the 3' untranslated region of mRNA encoded by LOC201810, corresponding to a target binding site such as BINDING SITE I, BINDING SITE II or BINDING SITE III of FIG. 8. Table 4 illustrates the complementarity of the nucleotide sequences of LOC201810 BINDING SITE, designated SEQ ID:840, to the nucleotide sequence of GAM3298 RNA, herein designated GAM RNA, also designated SEQ ID:259.

Another function of GAM3298 is therefore inhibition of LOC201810 (Accession XP_114383.1). Accordingly, utilities of GAM3298 include diagnosis, prevention and treatment of diseases and clinical conditions associated with LOC201810.

LOC202134 (Accession XP_117365.1) is another GAM3298 target gene, herein designated TARGET GENE. LOC202134 BINDING SITE is a target binding site found in the 5' untranslated region of mRNA encoded by LOC202134, corresponding to a target binding site such as BINDING SITE I, BINDING SITE II or BINDING SITE III of FIG. 8. Table 4 illustrates the complementarity of the nucleotide sequences of LOC202134 BINDING SITE, designated SEQ ID:19238, to the nucleotide sequence of GAM3298 RNA, herein designated GAM RNA, also designated SEQ ID:259.

Another function of GAM3298 is therefore inhibition of LOC202134 (Accession XP_117365.1). Accordingly, utilities of GAM3298 include diagnosis, prevention and treatment of diseases and clinical conditions associated with LOC202134.

LOC220739 (Accession XP_167548.3) is another GAM3298 target gene, herein designated TARGET GENE. LOC220739 BINDING SITE1 and LOC220739 BINDING SITE2 are target binding sites found in untranslated regions of mRNA encoded by LOC220739, corresponding to target binding sites such as BINDING SITE I, BINDING SITE II or BINDING SITE III of FIG. 8. Table 4 illustrates the complementarity of the nucleotide sequences of LOC220739 BINDING SITE1 and LOC220739 BINDING SITE2, designated SEQ ID:16984 and SEQ ID:5839 respectively, to the nucleotide sequence of GAM3298 RNA, herein designated GAM RNA, also designated SEQ ID:259.

Another function of GAM3298 is therefore inhibition of LOC220739 (Accession XP_167548.3). Accordingly, utilities of GAM3298 include diagnosis, prevention and treatment of diseases and clinical conditions associated with LOC220739.

LOC221035 (Accession XP_167640.1) is another GAM3298 target gene, herein designated TARGET GENE. LOC221035 BINDING SITE is a target binding site found in the 3' untranslated region of mRNA encoded by LOC221035, corresponding to a target binding site such as BINDING SITE I, BINDING SITE II or BINDING SITE III of FIG. 8. Table 4 illustrates the complementarity of the nucleotide sequences of LOC221035 BINDING SITE, designated SEQ ID:18581, to the nucleotide sequence of GAM3298 RNA, herein designated GAM RNA, also designated SEQ ID:259.

Another function of GAM3298 is therefore inhibition of LOC221035 (Accession XP_167640.1). Accordingly, utilities of GAM3298 include diagnosis, prevention and treatment of diseases and clinical conditions associated with LOC221035.

LOC221601 (Accession XP_168071.1) is another GAM3298 target gene, herein designated TARGET GENE. LOC221601 BINDING SITE is a target binding site found in the 5' untranslated region of mRNA encoded by LOC221601, corresponding to a target binding site such as BINDING SITE I, BINDING SITE II or BINDING SITE III of FIG. 8. Table 4 illustrates the complementarity of the nucleotide sequences of LOC221601 BINDING SITE, designated SEQ ID:10387, to the nucleotide sequence of GAM3298 RNA, herein designated GAM RNA, also designated SEQ ID:259.

Another function of GAM3298 is therefore inhibition of LOC221601 (Accession XP_168071.1). Accordingly, utilities of GAM3298 include diagnosis, prevention and treatment of diseases and clinical conditions associated with LOC221601.

LOC221931 (Accession XP_168348.1) is another GAM3298 target gene, herein designated TARGET GENE. LOC221931 BINDING SITE is a target binding site found in the 3' untranslated region of mRNA encoded by LOC221931, corresponding to a target binding site such as BINDING SITE I, BINDING SITE II or BINDING SITE III of FIG. 8. Table 4 illustrates the complementarity of the nucleotide sequences of LOC221931 BINDING SITE, designated SEQ ID:3706, to the nucleotide sequence of GAM3298 RNA, herein designated GAM RNA, also designated SEQ ID:259.

Another function of GAM3298 is therefore inhibition of LOC221931 (Accession XP_168348.1). Accordingly, utilities of GAM3298 include diagnosis, prevention and treatment of diseases and clinical conditions associated with LOC221931.

LOC221954 (Accession XP_168349.1) is another GAM3298 target gene, herein designated TARGET GENE. LOC221954 BINDING SITE is a target binding site found in the 5' untranslated region of mRNA encoded by LOC221954, corresponding to a target binding site such as BINDING SITE I, BINDING SITE II or BINDING SITE III of FIG. 8. Table 4 illustrates the complementarity of the nucleotide sequences of LOC221954 BINDING SITE, designated SEQ ID:15872, to the nucleotide sequence of GAM3298 RNA, herein designated GAM RNA, also designated SEQ ID:259.

Another function of GAM3298 is therefore inhibition of LOC221954 (Accession XP_168349.1). Accordingly, utilities of GAM3298 include diagnosis, prevention and treatment of diseases and clinical conditions associated with LOC221954.

LOC222060 (Accession XP_168427.1) is another GAM3298 target gene, herein designated TARGET GENE. LOC222060 BINDING SITE is a target binding site found in the 5' untranslated region of mRNA encoded by LOC222060, corresponding to a target binding site such as BINDING SITE I, BINDING SITE II or BINDING SITE III of FIG. 8. Table 4 illustrates the complementarity of the nucleotide sequences of LOC222060 BINDING SITE, designated SEQ ID:14995, to the nucleotide sequence of GAM3298 RNA, herein designated GAM RNA, also designated SEQ ID:259.

Another function of GAM3298 is therefore inhibition of LOC222060 (Accession XP_168427.1). Accordingly, utilities of GAM3298 include diagnosis, prevention and treatment of diseases and clinical conditions associated with LOC222060.

LOC222160 (Accession XP_168431.1) is another GAM3298 target gene, herein designated TARGET GENE. LOC222160 BINDING SITE is a target binding site found in the 5' untranslated region of mRNA encoded by LOC222160, corresponding to a target binding site such as BINDING SITE I, BINDING SITE II or BINDING SITE III of FIG. 8. Table 4 illustrates the complementarity of the nucleotide sequences of LOC222160 BINDING SITE, designated SEQ ID:8175, to the nucleotide sequence of GAM3298 RNA, herein designated GAM RNA, also designated SEQ ID:259.

Another function of GAM3298 is therefore inhibition of LOC222160 (Accession XP_168431.1). Accordingly, utilities of GAM3298 include diagnosis, prevention and treatment of diseases and clinical conditions associated with LOC222160.

LOC253782 (Accession XP_171023.1) is another GAM3298 target gene, herein designated TARGET GENE. LOC253782 BINDING SITE is a target binding site found in the 3' untranslated region of mRNA encoded by LOC253782, corresponding to a target binding site such as BINDING SITE I, BINDING SITE II or BINDING SITE III of FIG. 8. Table 4 illustrates the complementarity of the nucleotide sequences of LOC253782 BINDING SITE, designated SEQ ID:10198, to the nucleotide sequence of GAM3298 RNA, herein designated GAM RNA, also designated SEQ ID:259.

Another function of GAM3298 is therefore inhibition of LOC253782 (Accession XP_171023.1). Accordingly, utilities of GAM3298 include diagnosis, prevention and treatment of diseases and clinical conditions associated with LOC253782.

LOC255185 (Accession XP_170826.1) is another GAM3298 target gene, herein designated TARGET GENE. LOC255185 BINDING SITE is a target binding site found in the 3' untranslated region of mRNA encoded by LOC255185, corresponding to a target binding site such as BINDING SITE I, BINDING SITE II or BINDING SITE III of FIG. 8. Table 4 illustrates the complementarity of the nucleotide sequences of LOC255185 BINDING SITE, designated SEQ ID:6353, to the nucleotide sequence of GAM3298 RNA, herein designated GAM RNA, also designated SEQ ID:259.

Another function of GAM3298 is therefore inhibition of LOC255185 (Accession XP_170826.1). Accordingly, utilities of GAM3298 include diagnosis, prevention and treatment of diseases and clinical conditions associated with LOC255185.

LOC282915 (Accession XP_212579.1) is another GAM3298 target gene, herein designated TARGET GENE. LOC282915 BINDING SITE is a target binding site found in the 3' untranslated region of mRNA encoded by LOC282915, corresponding to a target binding site such as BINDING SITE I, BINDING SITE II or BINDING SITE III of FIG. 8. Table 4 illustrates the complementarity of the nucleotide sequences of LOC282915 BINDING SITE, designated SEQ ID:19337, to the nucleotide sequence of GAM3298 RNA, herein designated GAM RNA, also designated SEQ ID:259.

Another function of GAM3298 is therefore inhibition of LOC282915 (Accession XP_212579.1). Accordingly, utilities of GAM3298 include diagnosis, prevention and treatment of diseases and clinical conditions associated with LOC282915.

LOC282951 (Accession XP_212627.1) is another GAM3298 target gene, herein designated TARGET GENE. LOC282951 BINDING SITE is a target binding site found in the 3' untranslated region of mRNA encoded by LOC282951, corresponding to a target binding site such as BINDING SITE I, BINDING SITE II or BINDING SITE III of FIG. 8. Table 4 illustrates the complementarity of the nucleotide sequences of LOC282951 BINDING SITE, designated SEQ ID:19337, to the nucleotide sequence of GAM3298 RNA, herein designated GAM RNA, also designated SEQ ID:259.

Another function of GAM3298 is therefore inhibition of LOC282951 (Accession XP_212627.1). Accordingly, utilities of GAM3298 include diagnosis, prevention and treatment of diseases and clinical conditions associated with LOC282951.

LOC282973 (Accession XP_208463.1) is another GAM3298 target gene, herein designated TARGET GENE. LOC282973 BINDING SITE is a target binding site found in the 5' untranslated region of mRNA encoded by LOC282973, corresponding to a target binding site such as BINDING SITE I, BINDING SITE II or BINDING SITE III of FIG. 8. Table 4 illustrates the complementarity of the nucleotide sequences of LOC282973 BINDING SITE, designated SEQ ID:7468, to the nucleotide sequence of GAM3298 RNA, herein designated GAM RNA, also designated SEQ ID:259.

Another function of GAM3298 is therefore inhibition of LOC282973 (Accession XP_208463.1). Accordingly, utilities of GAM3298 include diagnosis, prevention and treatment of diseases and clinical conditions associated with LOC282973.

LOC283005 (Accession XP_208481.1) is another GAM3298 target gene, herein designated TARGET GENE. LOC283005 BINDING SITE is a target binding site found in the 3' untranslated region of mRNA encoded by LOC283005, corresponding to a target binding site such as BINDING SITE I, BINDING SITE II or BINDING SITE III of FIG. 8. Table 4 illustrates the complementarity of the nucleotide sequences of LOC283005 BINDING SITE, designated SEQ ID:3706, to the nucleotide sequence of GAM3298 RNA, herein designated GAM RNA, also designated SEQ ID:259.

Another function of GAM3298 is therefore inhibition of LOC283005 (Accession XP_208481.1). Accordingly, utilities of GAM3298 include diagnosis, prevention and treatment of diseases and clinical conditions associated with LOC283005.

LOC283061 (Accession XP_210875.1) is another GAM3298 target gene, herein designated TARGET GENE. LOC283061 BINDING SITE is a target binding site found in the 3' untranslated region of mRNA encoded by LOC283061, corresponding to a target binding site such as BINDING SITE I, BINDING SITE II or BINDING SITE III of FIG. 8. Table 4 illustrates the complementarity of the nucleotide sequences of LOC283061 BINDING SITE, designated SEQ ID:841, to the nucleotide sequence of GAM3298 RNA, herein designated GAM RNA, also designated SEQ ID:259.

Another function of GAM3298 is therefore inhibition of LOC283061 (Accession XP_210875.1). Accordingly, utilities of GAM3298 include diagnosis, prevention and treatment of diseases and clinical conditions associated with LOC283061.

LOC283199 (Accession XP_210929.1) is another GAM3298 target gene, herein designated TARGET GENE. LOC283199 BINDING SITE is a target binding site found in the 5' untranslated region of mRNA encoded by LOC283199, corresponding to a target binding site such as BINDING SITE I, BINDING SITE II or BINDING SITE III of FIG. 8. Table 4 illustrates the complementarity of the nucleotide sequences of LOC283199 BINDING SITE, designated SEQ ID:14868, to the nucleotide sequence of GAM3298 RNA, herein designated GAM RNA, also designated SEQ ID:259.

Another function of GAM3298 is therefore inhibition of LOC283199 (Accession XP_210929.1). Accordingly, utilities of GAM3298 include diagnosis, prevention and treatment of diseases and clinical conditions associated with LOC283199.

LOC283230 (Accession XP_210945.1) is another GAM3298 target gene, herein designated TARGET GENE. LOC283230 BINDING SITE is a target binding site found in the 3' untranslated region of mRNA encoded by LOC283230, corresponding to a target binding site such as BINDING SITE I, BINDING SITE II or BINDING SITE III of FIG. 8. Table 4 illustrates the complementarity of the nucleotide sequences of LOC283230 BINDING SITE, designated SEQ ID:7329, to the nucleotide sequence of GAM3298 RNA, herein designated GAM RNA, also designated SEQ ID:259.

Another function of GAM3298 is therefore inhibition of LOC283230 (Accession XP_210945.1). Accordingly, utilities of GAM3298 include diagnosis, prevention and treatment of diseases and clinical conditions associated with LOC283230.

LOC283289 (Accession XP_210960.1) is another GAM3298 target gene, herein designated TARGET GENE. LOC283289 BINDING SITE is a target binding site found in the 3' untranslated region of mRNA encoded by LOC283289, corresponding to a target binding site such as BINDING SITE I, BINDING SITE II or BINDING SITE III of FIG. 8. Table 4 illustrates the complementarity of the nucleotide sequences of LOC283289 BINDING SITE, designated SEQ ID:19239, to the nucleotide sequence of GAM3298 RNA, herein designated GAM RNA, also designated SEQ ID:259.

Another function of GAM3298 is therefore inhibition of LOC283289 (Accession XP_210960.1). Accordingly, utilities of GAM3298 include diagnosis, prevention and treatment of diseases and clinical conditions associated with LOC283289.

LOC283460 (Accession XP_208682.1) is another GAM3298 target gene, herein designated TARGET GENE. LOC283460 BINDING SITE1 and LOC283460 BINDING SITE2 are target binding sites found in untranslated regions of mRNA encoded by LOC283460, corresponding to target binding sites such as BINDING SITE I, BINDING SITE II or BINDING SITE III of FIG. 8. Table 4 illustrates the complementarity of the nucleotide sequences of LOC283460 BINDING SITE1 and LOC283460 BINDING SITE2, designated SEQ ID:3706 and SEQ ID:7398 respectively, to the nucleotide sequence of GAM3298 RNA, herein designated GAM RNA, also designated SEQ ID:259.

Another function of GAM3298 is therefore inhibition of LOC283460 (Accession XP_208682.1). Accordingly, utilities of GAM3298 include diagnosis, prevention and treatment of diseases and clinical conditions associated with LOC283460.

LOC283475 (Accession XP_211056.1) is another GAM3298 target gene, herein designated TARGET GENE. LOC283475 BINDING SITE is a target binding site found in the 3' untranslated region of mRNA encoded by LOC283475, corresponding to a target binding site such as BINDING SITE I, BINDING SITE II or BINDING SITE III of FIG. 8. Table 4 illustrates the complementarity of the nucleotide sequences of LOC283475 BINDING SITE, designated SEQ ID:8626, to the nucleotide sequence of GAM3298 RNA, herein designated GAM RNA, also designated SEQ ID:259.

Another function of GAM3298 is therefore inhibition of LOC283475 (Accession XP_211056.1). Accordingly, utilities of GAM3298 include diagnosis, prevention and treatment of diseases and clinical conditions associated with LOC283475.

LOC283508 (Accession XP_211070.1) is another GAM3298 target gene, herein designated TARGET GENE. LOC283508 BINDING SITE is a target binding site found in the 3' untranslated region of mRNA encoded by LOC283508, corresponding to a target binding site such as BINDING SITE I, BINDING SITE II or BINDING SITE III of FIG. 8. Table 4 illustrates the complementarity of the nucleotide sequences of LOC283508 BINDING SITE, designated SEQ ID:8580, to the nucleotide sequence of GAM3298 RNA, herein designated GAM RNA, also designated SEQ ID:259.

Another function of GAM3298 is therefore inhibition of LOC283508 (Accession XP_211070.1). Accordingly, utilities of GAM3298 include diagnosis, prevention and treatment of diseases and clinical conditions associated with LOC283508.

LOC283672 (Accession XP_211152.1) is another GAM3298 target gene, herein designated TARGET GENE. LOC283672 BINDING SITE is a target binding site found in the 3' untranslated region of mRNA encoded by LOC283672, corresponding to a target binding site such as BINDING SITE I, BINDING SITE II or BINDING SITE III of FIG. 8. Table 4 illustrates the complementarity of the nucleotide sequences of LOC283672 BINDING SITE, designated SEQ ID:3706, to the nucleotide sequence of GAM3298 RNA, herein designated GAM RNA, also designated SEQ ID:259.

Another function of GAM3298 is therefore inhibition of LOC283672 (Accession XP_211152.1). Accordingly, utilities of GAM3298 include diagnosis, prevention and treatment of diseases and clinical conditions associated with LOC283672.

LOC283690 (Accession XP_211167.1) is another GAM3298 target gene, herein designated TARGET GENE. LOC283690 BINDING SITE is a target binding site found in the 3' untranslated region of mRNA encoded by LOC283690, corresponding to a target binding site such as BINDING SITE I, BINDING SITE II or BINDING SITE III of FIG. 8. Table 4 illustrates the complementarity of the nucleotide sequences of LOC283690 BINDING SITE, designated SEQ ID:3706, to the nucleotide sequence of GAM3298 RNA, herein designated GAM RNA, also designated SEQ ID:259.

Another function of GAM3298 is therefore inhibition of LOC283690 (Accession XP_211167.1). Accordingly, utilities of GAM3298 include diagnosis, prevention and treatment of diseases and clinical conditions associated with LOC283690.

LOC283693 (Accession XP_208788.1) is another GAM3298 target gene, herein designated TARGET GENE. LOC283693 BINDING SITE is a target binding site found in the 3' untranslated region of mRNA encoded by LOC283693, corresponding to a target binding site such as BINDING SITE I, BINDING SITE II or BINDING SITE III of FIG. 8. Table 4 illustrates the complementarity of the nucleotide sequences of LOC283693 BINDING SITE, designated SEQ ID:16061, to the nucleotide sequence of GAM3298 RNA, herein designated GAM RNA, also designated SEQ ID:259.

Another function of GAM3298 is therefore inhibition of LOC283693 (Accession XP_208788.1). Accordingly, utilities of GAM3298 include diagnosis, prevention and treatment of diseases and clinical conditions associated with LOC283693.

LOC283760 (Accession XP_208826.2) is another GAM3298 target gene, herein designated TARGET GENE. LOC283760 BINDING SITE is a target binding site found in the 3' untranslated region of mRNA encoded by LOC283760, corresponding to a target binding site such as BINDING SITE I, BINDING SITE II or BINDING SITE III of FIG. 8. Table 4 illustrates the complementarity of the nucleotide sequences of LOC283760 BINDING SITE, designated SEQ ID:11927, to the nucleotide sequence of GAM3298 RNA, herein designated GAM RNA, also designated SEQ ID:259.

Another function of GAM3298 is therefore inhibition of LOC283760 (Accession XP_208826.2). Accordingly, utilities of GAM3298 include diagnosis, prevention and treatment of diseases and clinical conditions associated with LOC283760.

LOC283891 (Accession XP_208889.2) is another GAM3298 target gene, herein designated TARGET GENE. LOC283891 BINDING SITE is a target binding site found in the 5' untranslated region of mRNA encoded by LOC283891, corresponding to a target binding site such as BINDING SITE I, BINDING SITE II or BINDING SITE III of FIG. 8. Table 4 illustrates the complementarity of the nucleotide sequences of LOC283891 BINDING SITE, designated SEQ ID:5840, to the nucleotide sequence of GAM3298 RNA, herein designated GAM RNA, also designated SEQ ID:259.

Another function of GAM3298 is therefore inhibition of LOC283891 (Accession XP_208889.2). Accordingly, utilities of GAM3298 include diagnosis, prevention and treatment of diseases and clinical conditions associated with LOC283891.

LOC283924 (Accession XP_208906.1) is another GAM3298 target gene, herein designated TARGET GENE. LOC283924 BINDING SITE1 and LOC283924 BINDING SITE2 are target binding sites found in untranslated regions of mRNA encoded by LOC283924, corresponding to target binding sites such as BINDING SITE I, BINDING SITE II or BINDING SITE III of FIG. 8. Table 4 illustrates the complementarity of the nucleotide sequences of LOC283924 BINDING SITE1 and LOC283924 BINDING SITE2, designated SEQ ID:3706 and SEQ ID:6479 respectively, to the nucleotide sequence of GAM3298 RNA, herein designated GAM RNA, also designated SEQ ID:259.

Another function of GAM3298 is therefore inhibition of LOC283924 (Accession XP_208906.1). Accordingly, utilities of GAM3298 include diagnosis, prevention and treatment of diseases and clinical conditions associated with LOC283924.

LOC283985 (Accession NP_835229.1) is another GAM3298 target gene, herein designated TARGET GENE. LOC283985 BINDING SITE is a target binding site found in the 3' untranslated region of multiple transcripts of mRNA encoded by LOC283985, corresponding to a target binding site such as BINDING SITE I, BINDING SITE II or BINDING SITE III of FIG. 8. Table 4 illustrates the complementarity of the nucleotide sequences of LOC283985 BINDING SITE, designated SEQ ID:3706, to the nucleotide sequence of GAM3298 RNA, herein designated GAM RNA, also designated SEQ ID:259.

Another function of GAM3298 is therefore inhibition of LOC283985 (Accession NP_835229.1). Accordingly, utilities of GAM3298 include diagnosis, prevention and treatment of diseases and clinical conditions associated with LOC283985.

LOC283985 (Accession XP_208951.2) is another GAM3298 target gene, herein designated TARGET GENE. LOC283985 BINDING SITE is a target binding site found in the 3' untranslated region of multiple transcripts of mRNA encoded by LOC283985, corresponding to a target binding site such as BINDING SITE I, BINDING SITE II or BINDING SITE III of FIG. 8. Table 4 illustrates the complementarity of the nucleotide sequences of LOC283985 BINDING SITE, designated SEQ ID:3706, to the nucleotide sequence of GAM3298 RNA, herein designated GAM RNA, also designated SEQ ID:259.

Another function of GAM3298 is therefore inhibition of LOC283985 (Accession XP_208951.2). Accordingly, utilities of GAM3298 include diagnosis, prevention and treatment of diseases and clinical conditions associated with LOC283985.

LOC284014 (Accession XP_211300.2) is another GAM3298 target gene, herein designated TARGET GENE. LOC284014 BINDING SITE is a target binding site found in the 3' untranslated region of mRNA encoded by LOC284014, corresponding to a target binding site such as BINDING SITE I, BINDING SITE II or BINDING SITE III of FIG. 8. Table 4 illustrates the complementarity of the nucleotide sequences of LOC284014 BINDING SITE, designated SEQ ID:3706, to the nucleotide sequence of GAM3298 RNA, herein designated GAM RNA, also designated SEQ ID:259.

Another function of GAM3298 is therefore inhibition of LOC284014 (Accession XP_211300.2). Accordingly, utilities of GAM3298 include diagnosis, prevention and treatment of diseases and clinical conditions associated with LOC284014.

LOC284024 (Accession XP_208970.1) is another GAM3298 target gene, herein designated TARGET GENE. LOC284024 BINDING SITE is a target binding site found in the 3' untranslated region of mRNA encoded by LOC284024, corresponding to a target binding site such as BINDING SITE I, BINDING SITE II or BINDING SITE III of FIG. 8. Table 4 illustrates the complementarity of the nucleotide sequences of LOC284024 BINDING SITE, designated SEQ ID:3706, to the nucleotide sequence of GAM3298 RNA, herein designated GAM RNA, also designated SEQ ID:259.

Another function of GAM3298 is therefore inhibition of LOC284024 (Accession XP_208970.1). Accordingly, utilities of GAM3298 include diagnosis, prevention and treatment of diseases and clinical conditions associated with LOC284024.

LOC284161 (Accession XP_209047.2) is another GAM3298 target gene, herein designated TARGET GENE. LOC284161 BINDING SITE is a target binding site found in the 3' untranslated region of mRNA encoded by LOC284161, corresponding to a target binding site such as BINDING SITE I, BINDING SITE II or BINDING SITE III of FIG. 8. Table 4 illustrates the complementarity of the nucleotide sequences of LOC284161 BINDING SITE, designated SEQ ID:3706, to the nucleotide sequence of GAM3298 RNA, herein designated GAM RNA, also designated SEQ ID:259.

Another function of GAM3298 is therefore inhibition of LOC284161 (Accession XP_209047.2). Accordingly, utilities of GAM3298 include diagnosis, prevention and treatment of diseases and clinical conditions associated with LOC284161.

LOC284313 (Accession XP_209116.1) is another GAM3298 target gene, herein designated TARGET GENE. LOC284313 BINDING SITE is a target binding site found in the 3' untranslated region of mRNA encoded by LOC284313, corresponding to a target binding site such as BINDING SITE I, BINDING SITE II or BINDING SITE III of FIG. 8. Table 4 illustrates the complementarity of the nucleotide sequences of LOC284313 BINDING SITE, designated SEQ ID:16046, to the nucleotide sequence of GAM3298 RNA, herein designated GAM RNA, also designated SEQ ID:259.

Another function of GAM3298 is therefore inhibition of LOC284313 (Accession XP_209116.1). Accordingly, utilities of GAM3298 include diagnosis, prevention and treatment of diseases and clinical conditions associated with LOC284313.

LOC284371 (Accession XP_209155.1) is another GAM3298 target gene, herein designated TARGET GENE. LOC284371 BINDING SITE is a target binding site found in the 3' untranslated region of mRNA encoded by LOC284371, corresponding to a target binding site such as BINDING SITE I, BINDING SITE II or BINDING SITE III of FIG. 8. Table 4 illustrates the complementarity of the nucleotide sequences of LOC284371 BINDING SITE, designated SEQ ID:3706, to the nucleotide sequence of GAM3298 RNA, herein designated GAM RNA, also designated SEQ ID:259.

Another function of GAM3298 is therefore inhibition of LOC284371 (Accession XP_209155.1). Accordingly, utilities of GAM3298 include diagnosis, prevention and treatment of diseases and clinical conditions associated with LOC284371.

LOC284417 (Accession XP_209187.1) is another GAM3298 target gene, herein designated TARGET GENE. LOC284417 BINDING SITE is a target binding site found in the 3' untranslated region of mRNA encoded by LOC284417, corresponding to a target binding site such as BINDING SITE I, BINDING SITE II or BINDING SITE III of FIG. 8. Table 4 illustrates the complementarity of the nucleotide sequences of LOC284417 BINDING SITE, designated SEQ ID:6665, to the nucleotide sequence of GAM3298 RNA, herein designated GAM RNA, also designated SEQ ID:259.

Another function of GAM3298 is therefore inhibition of LOC284417 (Accession XP_209187.1). Accordingly, utilities of GAM3298 include diagnosis, prevention and treatment of diseases and clinical conditions associated with LOC284417.

LOC284461 (Accession XP_211476.1) is another GAM3298 target gene, herein designated TARGET GENE. LOC284461 BINDING SITE is a target binding site found in the 3' untranslated region of mRNA encoded by LOC284461, corresponding to a target binding site such as BINDING SITE I, BINDING SITE II or BINDING SITE III of FIG. 8. Table 4 illustrates the complementarity of the nucleotide sequences of LOC284461 BINDING SITE, designated SEQ ID:17236, to the nucleotide sequence of GAM3298 RNA, herein designated GAM RNA, also designated SEQ ID:259.

Another function of GAM3298 is therefore inhibition of LOC284461 (Accession XP_211476.1). Accordingly, utilities of GAM3298 include diagnosis, prevention and treatment of diseases and clinical conditions associated with LOC284461.

LOC284475 (Accession XP_211478.1) is another GAM3298 target gene, herein designated TARGET GENE. LOC284475 BINDING SITE is a target binding site found in the 5' untranslated region of mRNA encoded by LOC284475, corresponding to a target binding site such as BINDING SITE I, BINDING SITE II or BINDING SITE III of FIG. 8. Table 4 illustrates the complementarity of the nucleotide sequences of LOC284475 BINDING SITE, designated SEQ ID:8335, to the nucleotide sequence of GAM3298 RNA, herein designated GAM RNA, also designated SEQ ID:259.

Another function of GAM3298 is therefore inhibition of LOC284475 (Accession XP_211478.1). Accordingly, utilities of GAM3298 include diagnosis, prevention and treatment of diseases and clinical conditions associated with LOC284475.

LOC284486 (Accession XP_209231.1) is another GAM3298 target gene, herein designated TARGET GENE. LOC284486 BINDING SITE is a target binding site found in the 3' untranslated region of mRNA encoded by LOC284486, corresponding to a target binding site such as BINDING SITE I, BINDING SITE II or BINDING SITE III of FIG. 8. Table 4 illustrates the complementarity of the nucleotide sequences of LOC284486 BINDING SITE, designated SEQ ID:3706, to the nucleotide sequence of GAM3298 RNA, herein designated GAM RNA, also designated SEQ ID:259.

Another function of GAM3298 is therefore inhibition of LOC284486 (Accession XP_209231.1). Accordingly, utilities of GAM3298 include diagnosis, prevention and treatment of diseases and clinical conditions associated with LOC284486.

LOC284542 (Accession XP_209254.1) is another GAM3298 target gene, herein designated TARGET GENE. LOC284542 BINDING SITE is a target binding site found in the 5' untranslated region of mRNA encoded by LOC284542, corresponding to a target binding site such as BINDING SITE I, BINDING SITE II or BINDING SITE III of FIG. 8. Table 4 illustrates the complementarity of the nucleotide sequences of LOC284542 BINDING SITE, designated SEQ ID:12376, to the nucleotide sequence of GAM3298 RNA, herein designated GAM RNA, also designated SEQ ID:259.

Another function of GAM3298 is therefore inhibition of LOC284542 (Accession XP_209254.1). Accordingly, utilities of GAM3298 include diagnosis, prevention and treatment of diseases and clinical conditions associated with LOC284542.

LOC284552 (Accession XP_211516.1) is another GAM3298 target gene, herein designated TARGET GENE. LOC284552 BINDING SITE is a target binding site found in the 3' untranslated region of mRNA encoded by LOC284552, corresponding to a target binding site such as BINDING SITE I, BINDING SITE II or BINDING SITE III of FIG. 8. Table 4 illustrates the complementarity of the nucleotide sequences of LOC284552 BINDING SITE, designated SEQ ID:1017, to the nucleotide sequence of GAM3298 RNA, herein designated GAM RNA, also designated SEQ ID:259.

Another function of GAM3298 is therefore inhibition of LOC284552 (Accession XP_211516.1). Accordingly, utilities of GAM3298 include diagnosis, prevention and treatment of diseases and clinical conditions associated with LOC284552.

LOC284639 (Accession XP_211567.1) is another GAM3298 target gene, herein designated TARGET GENE. LOC284639 BINDING SITE is a target binding site found in the 3' untranslated region of mRNA encoded by LOC284639, corresponding to a target binding site such as BINDING SITE I, BINDING SITE II or BINDING SITE III of FIG. 8. Table 4 illustrates the complementarity of the nucleotide sequences of LOC284639 BINDING SITE, designated SEQ ID:3703, to the nucleotide sequence of GAM3298 RNA, herein designated GAM RNA, also designated SEQ ID:259.

Another function of GAM3298 is therefore inhibition of LOC284639 (Accession XP_211567.1). Accordingly, utilities of GAM3298 include diagnosis, prevention and treatment of diseases and clinical conditions associated with LOC284639.

LOC284647 (Accession XP_211569.1) is another GAM3298 target gene, herein designated TARGET GENE. LOC284647 BINDING SITE1 and LOC284647 BINDING SITE2 are target binding sites found in untranslated regions of mRNA encoded by LOC284647, corresponding to target binding sites such as BINDING SITE I, BINDING SITE II or BINDING SITE III of FIG. 8. Table 4 illustrates the complementarity of the nucleotide sequences of LOC284647 BINDING SITE1 and LOC284647 BINDING SITE2, designated SEQ ID:10343 and SEQ ID:15701 respectively, to the nucleotide sequence of GAM3298 RNA, herein designated GAM RNA, also designated SEQ ID:259.

Another function of GAM3298 is therefore inhibition of LOC284647 (Accession XP_211569.1). Accordingly, utilities of GAM3298 include diagnosis, prevention and treatment of diseases and clinical conditions associated with LOC284647.

LOC284665 (Accession XP_211581.1) is another GAM3298 target gene, herein designated TARGET GENE. LOC284665 BINDING SITE is a target binding site found in the 5' untranslated region of mRNA encoded by LOC284665, corresponding to a target binding site such as BINDING SITE I, BINDING SITE II or BINDING SITE III of FIG. 8. Table 4 illustrates the complementarity of the nucleotide sequences of LOC284665 BINDING SITE, designated SEQ ID:7468, to the nucleotide sequence of GAM3298 RNA, herein designated GAM RNA, also designated SEQ ID:259.

Another function of GAM3298 is therefore inhibition of LOC284665 (Accession XP_211581.1). Accordingly, utilities of GAM3298 include diagnosis, prevention and treatment of diseases and clinical conditions associated with LOC284665.

LOC284707 (Accession XP_211598.1) is another GAM3298 target gene, herein designated TARGET GENE. LOC284707 BINDING SITE is a target binding site found in the 3' untranslated region of mRNA encoded by LOC284707, corresponding to a target binding site such as BINDING SITE I, BINDING SITE II or BINDING SITE III of FIG. 8. Table 4 illustrates the complementarity of the nucleotide sequences of LOC284707 BINDING SITE, designated SEQ ID:3706, to the nucleotide sequence of GAM3298 RNA, herein designated GAM RNA, also designated SEQ ID:259.

Another function of GAM3298 is therefore inhibition of LOC284707 (Accession XP_211598.1). Accordingly, utilities of GAM3298 include diagnosis, prevention and treatment of diseases and clinical conditions associated with LOC284707.

LOC284739 (Accession XP_211609.1) is another GAM3298 target gene, herein designated TARGET GENE. LOC284739 BINDING SITE is a target binding site found in the 3' untranslated region of mRNA encoded by LOC284739, corresponding to a target binding site such as BINDING SITE I, BINDING SITE II or BINDING SITE III of FIG. 8. Table 4 illustrates the complementarity of the nucleotide sequences of LOC284739 BINDING SITE, designated SEQ ID:18406, to the nucleotide sequence of GAM3298 RNA, herein designated GAM RNA, also designated SEQ ID:259.

Another function of GAM3298 is therefore inhibition of LOC284739 (Accession XP_211609.1). Accordingly, utilities of GAM3298 include diagnosis, prevention and treatment of diseases and clinical conditions associated with LOC284739.

LOC284857 (Accession XP_211671.1) is another GAM3298 target gene, herein designated TARGET GENE. LOC284857 BINDING SITE is a target binding site found in the 3' untranslated region of mRNA encoded by LOC284857, corresponding to a target binding site such as BINDING SITE I, BINDING SITE II or BINDING SITE III of FIG. 8. Table 4 illustrates the complementarity of the nucleotide sequences of LOC284857 BINDING SITE, designated SEQ ID:3706, to the nucleotide sequence of GAM3298 RNA, herein designated GAM RNA, also designated SEQ ID:259.

Another function of GAM3298 is therefore inhibition of LOC284857 (Accession XP_211671.1). Accordingly, utilities of GAM3298 include diagnosis, prevention and treatment of diseases and clinical conditions associated with LOC284857.

LOC284858 (Accession XP_209386.1) is another GAM3298 target gene, herein designated TARGET GENE. LOC284858 BINDING SITE is a target binding site found in the 3' untranslated region of mRNA encoded by LOC284858, corresponding to a target binding site such as BINDING SITE I, BINDING SITE II or BINDING SITE III of FIG. 8. Table 4 illustrates the complementarity of the nucleotide sequences of LOC284858 BINDING SITE, designated SEQ ID:3706, to the nucleotide sequence of GAM3298 RNA, herein designated GAM RNA, also designated SEQ ID:259.

Another function of GAM3298 is therefore inhibition of LOC284858 (Accession XP_209386.1). Accordingly, utilities of GAM3298 include diagnosis, prevention and treatment of diseases and clinical conditions associated with LOC284858.

LOC284911 (Accession XP_211684.1) is another GAM3298 target gene, herein designated TARGET GENE. LOC284911 BINDING SITE1 and LOC284911 BINDING SITE2 are target binding sites found in untranslated regions of mRNA encoded by LOC284911, corresponding to target binding sites such as BINDING SITE I, BINDING SITE II or BINDING SITE III of FIG. 8. Table 4 illustrates the complementarity of the nucleotide sequences of LOC284911 BINDING SITE1 and LOC284911 BINDING SITE2, designated SEQ ID:3706 and SEQ ID:12485 respectively, to the nucleotide sequence of GAM3298 RNA, herein designated GAM RNA, also designated SEQ ID:259.

Another function of GAM3298 is therefore inhibition of LOC284911 (Accession XP_211684.1). Accordingly, utilities of GAM3298 include diagnosis, prevention and treatment of diseases and clinical conditions associated with LOC284911.

LOC284912 (Accession XP_209413.1) is another GAM3298 target gene, herein designated TARGET GENE. LOC284912 BINDING SITE is a target binding site found in the 3' untranslated region of mRNA encoded by LOC284912, corresponding to a target binding site such as BINDING SITE I, BINDING SITE II or BINDING SITE III of FIG. 8. Table 4 illustrates the complementarity of the nucleotide sequences of LOC284912 BINDING SITE, designated SEQ ID:5498, to the nucleotide sequence of GAM3298 RNA, herein designated GAM RNA, also designated SEQ ID:259.

Another function of GAM3298 is therefore inhibition of LOC284912 (Accession XP_209413.1). Accordingly, utilities of GAM3298 include diagnosis, prevention and treatment of diseases and clinical conditions associated with LOC284912.

LOC284972 (Accession XP_211712.1) is another GAM3298 target gene, herein designated TARGET GENE. LOC284972 BINDING SITE is a target binding site found in the 5' untranslated region of mRNA encoded by LOC284972, corresponding to a target binding site such as BINDING SITE I, BINDING SITE II or BINDING SITE III of FIG. 8. Table 4 illustrates the complementarity of the nucleotide sequences of LOC284972 BINDING SITE, designated SEQ ID:13200, to the nucleotide sequence of GAM3298 RNA, herein designated GAM RNA, also designated SEQ ID:259.

Another function of GAM3298 is therefore inhibition of LOC284972 (Accession XP_211712.1). Accordingly, utilities of GAM3298 include diagnosis, prevention and treatment of diseases and clinical conditions associated with LOC284972.

LOC284995 (Accession XP_211729.1) is another GAM3298 target gene, herein designated TARGET GENE. LOC284995 BINDING SITE is a target binding site found in the 3' untranslated region of mRNA encoded by LOC284995, corresponding to a target binding site such as BINDING SITE I, BINDING SITE II or BINDING SITE III of FIG. 8. Table 4 illustrates the complementarity of the nucleotide sequences of LOC284995 BINDING SITE, designated SEQ ID:17671, to the nucleotide sequence of GAM3298 RNA, herein designated GAM RNA, also designated SEQ ID:259.

Another function of GAM3298 is therefore inhibition of LOC284995 (Accession XP_211729.1). Accordingly, utilities of GAM3298 include diagnosis, prevention and treatment of diseases and clinical conditions associated with LOC284995.

LOC284998 (Accession XP_211726.1) is another GAM3298 target gene, herein designated TARGET GENE. LOC284998 BINDING SITE1 and LOC284998 BINDING SITE2 are target binding sites found in untranslated regions of mRNA encoded by LOC284998, corresponding to target binding sites such as BINDING SITE I, BINDING SITE II or BINDING SITE III of FIG. 8. Table 4 illustrates the complementarity of the nucleotide sequences of LOC284998 BINDING SITE1 and LOC284998 BINDING SITE2, designated SEQ ID:14399 and SEQ ID:13613 respectively, to the nucleotide sequence of GAM3298 RNA, herein designated GAM RNA, also designated SEQ ID:259.

Another function of GAM3298 is therefore inhibition of LOC284998 (Accession XP_211726.1). Accordingly, utilities of GAM3298 include diagnosis, prevention and treatment of diseases and clinical conditions associated with LOC284998.

LOC285001 (Accession XP_211730.1) is another GAM3298 target gene, herein designated TARGET GENE. LOC285001 BINDING SITE is a target binding site found in the 5' untranslated region of mRNA encoded by LOC285001, corresponding to a target binding site such as BINDING SITE I, BINDING SITE II or BINDING SITE III of FIG. 8. Table 4 illustrates the complementarity of the nucleotide sequences of LOC285001 BINDING SITE, designated SEQ ID:16577, to the nucleotide sequence of GAM3298 RNA, herein designated GAM RNA, also designated SEQ ID:259.

Another function of GAM3298 is therefore inhibition of LOC285001 (Accession XP_211730.1). Accordingly, utilities of GAM3298 include diagnosis, prevention and treatment of diseases and clinical conditions associated with LOC285001.

LOC285052 (Accession XP_211751.1) is another GAM3298 target gene, herein designated TARGET GENE. LOC285052 BINDING SITE is a target binding site found in the 3' untranslated region of mRNA encoded by LOC285052, corresponding to a target binding site such as BINDING SITE I, BINDING SITE II or BINDING SITE III of FIG. 8. Table 4 illustrates the complementarity of the nucleotide sequences of LOC285052 BINDING SITE, designated SEQ ID:3706, to the nucleotide sequence of GAM3298 RNA, herein designated GAM RNA, also designated SEQ ID:259.

Another function of GAM3298 is therefore inhibition of LOC285052 (Accession XP_211751.1). Accordingly, utilities of GAM3298 include diagnosis, prevention and treatment of diseases and clinical conditions associated with LOC285052.

LOC285082 (Accession XP_211759.1) is another GAM3298 target gene, herein designated TARGET GENE. LOC285082 BINDING SITE is a target binding site found in the 3' untranslated region of mRNA encoded by LOC285082, corresponding to a target binding site such as BINDING SITE I, BINDING SITE II or BINDING SITE III of FIG. 8. Table 4 illustrates the complementarity of the nucleotide sequences of LOC285082 BINDING SITE, designated SEQ ID:3706, to the nucleotide sequence of GAM3298 RNA, herein designated GAM RNA, also designated SEQ ID:259.

Another function of GAM3298 is therefore inhibition of LOC285082 (Accession XP_211759.1). Accordingly, utilities of GAM3298 include diagnosis, prevention and treatment of diseases and clinical conditions associated with LOC285082.

LOC285376 (Accession XP_211864.1) is another GAM3298 target gene, herein designated TARGET GENE. LOC285376 BINDING SITE is a target binding site found in the 3' untranslated region of mRNA encoded by LOC285376, corresponding to a target binding site such as BINDING SITE I, BINDING SITE II or BINDING SITE III of FIG. 8. Table 4 illustrates the complementarity of the nucleotide sequences of LOC285376 BINDING SITE, designated SEQ ID:4250, to the nucleotide sequence of GAM3298 RNA, herein designated GAM RNA, also designated SEQ ID:259.

Another function of GAM3298 is therefore inhibition of LOC285376 (Accession XP_211864.1). Accordingly, utilities of GAM3298 include diagnosis, prevention and treatment of diseases and clinical conditions associated with LOC285376.

LOC285378 (Accession XP_211859.1) is another GAM3298 target gene, herein designated TARGET GENE. LOC285378 BINDING SITE is a target binding site found in the 5' untranslated region of mRNA encoded by LOC285378, corresponding to a target binding site such as BINDING SITE I, BINDING SITE II or BINDING SITE III of FIG. 8. Table 4 illustrates the complementarity of the nucleotide sequences of LOC285378 BINDING SITE, designated SEQ ID:3706, to the nucleotide sequence of GAM3298 RNA, herein designated GAM RNA, also designated SEQ ID:259.

Another function of GAM3298 is therefore inhibition of LOC285378 (Accession XP_211859.1). Accordingly, utilities of GAM3298 include diagnosis, prevention and treatment of diseases and clinical conditions associated with LOC285378.

LOC285379 (Accession XP_211868.1) is another GAM3298 target gene, herein designated TARGET GENE. LOC285379 BINDING SITE is a target binding site found in the 3' untranslated region of mRNA encoded by LOC285379, corresponding to a target binding site such as BINDING SITE I, BINDING SITE II or BINDING SITE III of FIG. 8. Table 4 illustrates the complementarity of the nucleotide sequences of LOC285379 BINDING SITE, designated SEQ ID:12631, to the nucleotide sequence of GAM3298 RNA, herein designated GAM RNA, also designated SEQ ID:259.

Another function of GAM3298 is therefore inhibition of LOC285379 (Accession XP_211868.1). Accordingly, utilities of GAM3298 include diagnosis, prevention and treatment of diseases and clinical conditions associated with LOC285379.

LOC285398 (Accession XP_209593.1) is another GAM3298 target gene, herein designated TARGET GENE. LOC285398 BINDING SITE is a target binding site found in the 3' untranslated region of mRNA encoded by LOC285398, corresponding to a target binding site such as BINDING SITE I, BINDING SITE II or BINDING SITE III of FIG. 8. Table 4 illustrates the complementarity of the nucleotide sequences of LOC285398 BINDING SITE, designated SEQ ID:18417, to the nucleotide sequence of GAM3298 RNA, herein designated GAM RNA, also designated SEQ ID:259.

Another function of GAM3298 is therefore inhibition of LOC285398 (Accession XP_209593.1). Accordingly, utilities of GAM3298 include diagnosis, prevention and treatment of diseases and clinical conditions associated with LOC285398.

LOC285400 (Accession XP_209596.1) is another GAM3298 target gene, herein designated TARGET GENE. LOC285400 BINDING SITE is a target binding site found in the 5' untranslated region of mRNA encoded by LOC285400, corresponding to a target binding site such as BINDING SITE I, BINDING SITE II or BINDING SITE III of FIG. 8. Table 4 illustrates the complementarity of the nucleotide sequences of LOC285400 BINDING SITE, designated SEQ ID:19239, to the nucleotide sequence of GAM3298 RNA, herein designated GAM RNA, also designated SEQ ID:259.

Another function of GAM3298 is therefore inhibition of LOC285400 (Accession XP_209596.1). Accordingly, utilities of GAM3298 include diagnosis, prevention and treatment of diseases and clinical conditions associated with LOC285400.

LOC285540 (Accession XP_209654.1) is another GAM3298 target gene, herein designated TARGET GENE. LOC285540 BINDING SITE is a target binding site found in the 5' untranslated region of mRNA encoded by LOC285540, corresponding to a target binding site such as BINDING SITE I, BINDING SITE II or BINDING SITE III of FIG. 8. Table 4 illustrates the complementarity of the nucleotide sequences of LOC285540 BINDING SITE, designated SEQ ID:4958, to the nucleotide sequence of GAM3298 RNA, herein designated GAM RNA, also designated SEQ ID:259.

Another function of GAM3298 is therefore inhibition of LOC285540 (Accession XP_209654.1). Accordingly, utilities of GAM3298 include diagnosis, prevention and treatment of diseases and clinical conditions associated with LOC285540.

LOC285676 (Accession XP_209718.1) is another GAM3298 target gene, herein designated TARGET GENE. LOC285676 BINDING SITE is a target binding site found in the 5' untranslated region of mRNA encoded by LOC285676, corresponding to a target binding site such as BINDING SITE I, BINDING SITE II or BINDING SITE III of FIG. 8. Table 4 illustrates the complementarity of the nucleotide sequences of LOC285676 BINDING SITE, designated SEQ ID:2225, to the nucleotide sequence of GAM3298 RNA, herein designated GAM RNA, also designated SEQ ID:259.

Another function of GAM3298 is therefore inhibition of LOC285676 (Accession XP_209718.1). Accordingly, utilities of GAM3298 include diagnosis, prevention and treatment of diseases and clinical conditions associated with LOC285676.

LOC285719 (Accession XP_211990.1) is another GAM3298 target gene, herein designated TARGET GENE. LOC285719 BINDING SITE is a target binding site found in the 3' untranslated region of mRNA encoded by LOC285719, corresponding to a target binding site such as BINDING SITE I, BINDING SITE II or BINDING SITE III of FIG. 8. Table 4 illustrates the complementarity of the nucleotide sequences of LOC285719 BINDING SITE, designated SEQ ID:840, to the nucleotide sequence of GAM3298 RNA, herein designated GAM RNA, also designated SEQ ID:259.

Another function of GAM3298 is therefore inhibition of LOC285719 (Accession XP_211990.1). Accordingly, utilities of GAM3298 include diagnosis, prevention and treatment of diseases and clinical conditions associated with LOC285719.

LOC285722 (Accession XP_211997.1) is another GAM3298 target gene, herein designated TARGET GENE. LOC285722 BINDING SITE is a target binding site found in the 3' untranslated region of mRNA encoded by LOC285722, corresponding to a target binding site such as BINDING SITE I, BINDING SITE II or BINDING SITE III of FIG. 8. Table 4 illustrates the complementarity of the nucleotide sequences of LOC285722 BINDING SITE, designated SEQ ID:14868, to the nucleotide sequence of GAM3298 RNA, herein designated GAM RNA, also designated SEQ ID:259.

Another function of GAM3298 is therefore inhibition of LOC285722 (Accession XP_211997.1). Accordingly, utilities of GAM3298 include diagnosis, prevention and treatment of diseases and clinical conditions associated with LOC285722.

LOC285747 (Accession XP_209742.1) is another GAM3298 target gene, herein designated TARGET GENE. LOC285747 BINDING SITE is a target binding site found in the 3' untranslated region of mRNA encoded by LOC285747, corresponding to a target binding site such as BINDING SITE I, BINDING SITE II or BINDING SITE III of FIG. 8. Table 4 illustrates the complementarity of the nucleotide sequences of LOC285747 BINDING SITE, designated SEQ ID:17940, to the nucleotide sequence of GAM3298 RNA, herein designated GAM RNA, also designated SEQ ID:259.

Another function of GAM3298 is therefore inhibition of LOC285747 (Accession XP_209742.1). Accordingly, utilities of GAM3298 include diagnosis, prevention and treatment of diseases and clinical conditions associated with LOC285747.

LOC285749 (Accession XP_212010.1) is another GAM3298 target gene, herein designated TARGET GENE. LOC285749 BINDING SITE is a target binding site found in the 5' untranslated region of mRNA encoded by LOC285749, corresponding to a target binding site such as BINDING SITE I, BINDING SITE II or BINDING SITE III of FIG. 8. Table 4 illustrates the complementarity of the nucleotide sequences of LOC285749 BINDING SITE, designated SEQ ID:10387, to the nucleotide sequence of GAM3298 RNA, herein designated GAM RNA, also designated SEQ ID:259.

Another function of GAM3298 is therefore inhibition of LOC285749 (Accession XP_212010.1). Accordingly, utilities of GAM3298 include diagnosis, prevention and treatment of diseases and clinical conditions associated with LOC285749.

LOC285758 (Accession XP_212012.1) is another GAM3298 target gene, herein designated TARGET GENE. LOC285758 BINDING SITE is a target binding site found in the 5' untranslated region of mRNA encoded by LOC285758, corresponding to a target binding site such as BINDING SITE I, BINDING SITE II or BINDING SITE III of FIG. 8. Table 4 illustrates the complementarity of the nucleotide sequences of LOC285758 BINDING SITE, designated SEQ ID:3706, to the nucleotide sequence of GAM3298 RNA, herein designated GAM RNA, also designated SEQ ID:259.

Another function of GAM3298 is therefore inhibition of LOC285758 (Accession XP_212012.1). Accordingly, utilities of GAM3298 include diagnosis, prevention and treatment of diseases and clinical conditions associated with LOC285758.

LOC285833 (Accession XP_209790.1) is another GAM3298 target gene, herein designated TARGET GENE.

LOC285833 BINDING SITE is a target binding site found in the 3' untranslated region of mRNA encoded by LOC285833, corresponding to a target binding site such as BINDING SITE I, BINDING SITE II or BINDING SITE III of FIG. 8. Table 4 illustrates the complementarity of the nucleotide sequences of LOC285833 BINDING SITE, designated SEQ ID:19337, to the nucleotide sequence of GAM3298 RNA, herein designated GAM RNA, also designated SEQ ID:259.

Another function of GAM3298 is therefore inhibition of LOC285833 (Accession XP_209790.1). Accordingly, utilities of GAM3298 include diagnosis, prevention and treatment of diseases and clinical conditions associated with LOC285833.

LOC285854 (Accession XP_209770.1) is another GAM3298 target gene, herein designated TARGET GENE. LOC285854 BINDING SITE is a target binding site found in the 3' untranslated region of mRNA encoded by LOC285854, corresponding to a target binding site such as BINDING SITE I, BINDING SITE II or BINDING SITE III of FIG. 8. Table 4 illustrates the complementarity of the nucleotide sequences of LOC285854 BINDING SITE, designated SEQ ID:5474, to the nucleotide sequence of GAM3298 RNA, herein designated GAM RNA, also designated SEQ ID:259.

Another function of GAM3298 is therefore inhibition of LOC285854 (Accession XP_209770.1). Accordingly, utilities of GAM3298 include diagnosis, prevention and treatment of diseases and clinical conditions associated with LOC285854.

LOC285859 (Accession XP_209775.1) is another GAM3298 target gene, herein designated TARGET GENE. LOC285859 BINDING SITE is a target binding site found in the 3' untranslated region of mRNA encoded by LOC285859, corresponding to a target binding site such as BINDING SITE I, BINDING SITE II or BINDING SITE III of FIG. 8. Table 4 illustrates the complementarity of the nucleotide sequences of LOC285859 BINDING SITE, designated SEQ ID:17309, to the nucleotide sequence of GAM3298 RNA, herein designated GAM RNA, also designated SEQ ID:259.

Another function of GAM3298 is therefore inhibition of LOC285859 (Accession XP_209775.1). Accordingly, utilities of GAM3298 include diagnosis, prevention and treatment of diseases and clinical conditions associated with LOC285859.

LOC285869 (Accession XP_212058.1) is another GAM3298 target gene, herein designated TARGET GENE. LOC285869 BINDING SITE is a target binding site found in the 3' untranslated region of mRNA encoded by LOC285869, corresponding to a target binding site such as BINDING SITE I, BINDING SITE II or BINDING SITE III of FIG. 8. Table 4 illustrates the complementarity of the nucleotide sequences of LOC285869 BINDING SITE, designated SEQ ID:18034, to the nucleotide sequence of GAM3298 RNA, herein designated GAM RNA, also designated SEQ ID:259.

Another function of GAM3298 is therefore inhibition of LOC285869 (Accession XP_212058.1). Accordingly, utilities of GAM3298 include diagnosis, prevention and treatment of diseases and clinical conditions associated with LOC285869.

LOC285912 (Accession XP_212078.1) is another GAM3298 target gene, herein designated TARGET GENE. LOC285912 BINDING SITE is a target binding site found in the 3' untranslated region of mRNA encoded by LOC285912, corresponding to a target binding site such as BINDING SITE I, BINDING SITE II or BINDING SITE III of FIG. 8. Table 4 illustrates the complementarity of the nucleotide sequences of LOC285912 BINDING SITE, designated SEQ ID:816, to the nucleotide sequence of GAM3298 RNA, herein designated GAM RNA, also designated SEQ ID:259.

Another function of GAM3298 is therefore inhibition of LOC285912 (Accession XP_212078.1). Accordingly, utilities of GAM3298 include diagnosis, prevention and treatment of diseases and clinical conditions associated with LOC285912.

LOC285920 (Accession XP_212091.1) is another GAM3298 target gene, herein designated TARGET GENE. LOC285920 BINDING SITE1 and LOC285920 BINDING SITE2 are target binding sites found in untranslated regions of mRNA encoded by LOC285920, corresponding to target binding sites such as BINDING SITE I, BINDING SITE II or BINDING SITE III of FIG. 8. Table 4 illustrates the complementarity of the nucleotide sequences of LOC285920 BINDING SITE1 and LOC285920 BINDING SITE2, designated SEQ ID:15927 and SEQ ID:3706 respectively, to the nucleotide sequence of GAM3298 RNA, herein designated GAM RNA, also designated SEQ ID:259.

Another function of GAM3298 is therefore inhibition of LOC285920 (Accession XP_212091.1). Accordingly, utilities of GAM3298 include diagnosis, prevention and treatment of diseases and clinical conditions associated with LOC285920.

LOC285926 (Accession XP_208368.2) is another GAM3298 target gene, herein designated TARGET GENE. LOC285926 BINDING SITE is a target binding site found in the 3' untranslated region of mRNA encoded by LOC285926, corresponding to a target binding site such as BINDING SITE I, BINDING SITE II or BINDING SITE III of FIG. 8. Table 4 illustrates the complementarity of the nucleotide sequences of LOC285926 BINDING SITE, designated SEQ ID:11962, to the nucleotide sequence of GAM3298 RNA, herein designated GAM RNA, also designated SEQ ID:259.

Another function of GAM3298 is therefore inhibition of LOC285926 (Accession XP_208368.2). Accordingly, utilities of GAM3298 include diagnosis, prevention and treatment of diseases and clinical conditions associated with LOC285926.

LOC285928 (Accession XP_212087.1) is another GAM3298 target gene, herein designated TARGET GENE. LOC285928 BINDING SITE is a target binding site found in the 3' untranslated region of mRNA encoded by LOC285928, corresponding to a target binding site such as BINDING SITE I, BINDING SITE II or BINDING SITE III of FIG. 8. Table 4 illustrates the complementarity of the nucleotide sequences of LOC285928 BINDING SITE, designated SEQ ID:16949, to the nucleotide sequence of GAM3298 RNA, herein designated GAM RNA, also designated SEQ ID:259.

Another function of GAM3298 is therefore inhibition of LOC285928 (Accession XP_212087.1). Accordingly, utilities of GAM3298 include diagnosis, prevention and treatment of diseases and clinical conditions associated with LOC285928.

LOC285953 (Accession XP_209820.1) is another GAM3298 target gene, herein designated TARGET GENE. LOC285953 BINDING SITE is a target binding site found in the 3' untranslated region of mRNA encoded by LOC285953, corresponding to a target binding site such as BINDING SITE I, BINDING SITE II or BINDING SITE III of FIG. 8. Table 4 illustrates the complementarity of the nucleotide sequences of LOC285953 BINDING SITE, designated SEQ ID:3706, to the nucleotide sequence of GAM3298 RNA, herein designated GAM RNA, also designated SEQ ID:259.

Another function of GAM3298 is therefore inhibition of LOC285953 (Accession XP_209820.1). Accordingly, utilities of GAM3298 include diagnosis, prevention and treatment of diseases and clinical conditions associated with LOC285953.

LOC285960 (Accession XP_212088.1) is another GAM3298 target gene, herein designated TARGET GENE. LOC285960 BINDING SITE is a target binding site found in the 3' untranslated region of mRNA encoded by LOC285960, corresponding to a target binding site such as BINDING SITE I, BINDING SITE II or BINDING SITE III of FIG. 8. Table 4 illustrates the complementarity of the nucleotide sequences of LOC285960 BINDING SITE, designated SEQ ID:14995, to the nucleotide sequence of GAM3298 RNA, herein designated GAM RNA, also designated SEQ ID:259.

Another function of GAM3298 is therefore inhibition of LOC285960 (Accession XP_212088.1). Accordingly, utilities of GAM3298 include diagnosis, prevention and treatment of diseases and clinical conditions associated with LOC285960.

LOC286129 (Accession XP_209910.2) is another GAM3298 target gene, herein designated TARGET GENE. LOC286129 BINDING SITE is a target binding site found in the 3' untranslated region of mRNA encoded by LOC286129, corresponding to a target binding site such as BINDING SITE I, BINDING SITE II or BINDING SITE III of FIG. 8. Table 4 illustrates the complementarity of the nucleotide sequences of LOC286129 BINDING SITE, designated SEQ ID:7202, to the nucleotide sequence of GAM3298 RNA, herein designated GAM RNA, also designated SEQ ID:259.

Another function of GAM3298 is therefore inhibition of LOC286129 (Accession XP_209910.2). Accordingly, utilities of GAM3298 include diagnosis, prevention and treatment of diseases and clinical conditions associated with LOC286129.

LOC286166 (Accession XP_209925.1) is another GAM3298 target gene, herein designated TARGET GENE. LOC286166 BINDING SITE is a target binding site found in the 5' untranslated region of mRNA encoded by LOC286166, corresponding to a target binding site such as BINDING SITE I, BINDING SITE II or BINDING SITE III of FIG. 8. Table 4 illustrates the complementarity of the nucleotide sequences of LOC286166 BINDING SITE, designated SEQ ID:7939, to the nucleotide sequence of GAM3298 RNA, herein designated GAM RNA, also designated SEQ ID:259.

Another function of GAM3298 is therefore inhibition of LOC286166 (Accession XP_209925.1). Accordingly, utilities of GAM3298 include diagnosis, prevention and treatment of diseases and clinical conditions associated with LOC286166.

LOC286184 (Accession XP_212216.1) is another GAM3298 target gene, herein designated TARGET GENE. LOC286184 BINDING SITE is a target binding site found in the 5' untranslated region of mRNA encoded by LOC286184, corresponding to a target binding site such as BINDING SITE I, BINDING SITE II or BINDING SITE III of FIG. 8. Table 4 illustrates the complementarity of the nucleotide sequences of LOC286184 BINDING SITE, designated SEQ ID:3702, to the nucleotide sequence of GAM3298 RNA, herein designated GAM RNA, also designated SEQ ID:259.

Another function of GAM3298 is therefore inhibition of LOC286184 (Accession XP_212216.1). Accordingly, utilities of GAM3298 include diagnosis, prevention and treatment of diseases and clinical conditions associated with LOC286184.

LOC286186 (Accession XP_212219.1) is another GAM3298 target gene, herein designated TARGET GENE. LOC286186 BINDING SITE is a target binding site found in the 3' untranslated region of mRNA encoded by LOC286186, corresponding to a target binding site such as BINDING SITE I, BINDING SITE II or BINDING SITE III of FIG. 8. Table 4 illustrates the complementarity of the nucleotide sequences of LOC286186 BINDING SITE, designated SEQ ID:3706, to the nucleotide sequence of GAM3298 RNA, herein designated GAM RNA, also designated SEQ ID:259.

Another function of GAM3298 is therefore inhibition of LOC286186 (Accession XP_212219.1). Accordingly, utilities of GAM3298 include diagnosis, prevention and treatment of diseases and clinical conditions associated with LOC286186.

LOC286197 (Accession XP_209940.1) is another GAM3298 target gene, herein designated TARGET GENE. LOC286197 BINDING SITE is a target binding site found in the 3' untranslated region of mRNA encoded by LOC286197, corresponding to a target binding site such as BINDING SITE I, BINDING SITE II or BINDING SITE III of FIG. 8. Table 4 illustrates the complementarity of the nucleotide sequences of LOC286197 BINDING SITE, designated SEQ ID:3706, to the nucleotide sequence of GAM3298 RNA, herein designated GAM RNA, also designated SEQ ID:259.

Another function of GAM3298 is therefore inhibition of LOC286197 (Accession XP_209940.1). Accordingly, utilities of GAM3298 include diagnosis, prevention and treatment of diseases and clinical conditions associated with LOC286197.

LOC286222 (Accession XP_209955.1) is another GAM3298 target gene, herein designated TARGET GENE. LOC286222 BINDING SITE is a target binding site found in the 3' untranslated region of mRNA encoded by LOC286222, corresponding to a target binding site such as BINDING SITE I, BINDING SITE II or BINDING SITE III of FIG. 8. Table 4 illustrates the complementarity of the nucleotide sequences of LOC286222 BINDING SITE, designated SEQ ID:14873, to the nucleotide sequence of GAM3298 RNA, herein designated GAM RNA, also designated SEQ ID:259.

Another function of GAM3298 is therefore inhibition of LOC286222 (Accession XP_209955.1). Accordingly, utilities of GAM3298 include diagnosis, prevention and treatment of diseases and clinical conditions associated with LOC286222.

LOC286337 (Accession XP_212274.3) is another GAM3298 target gene, herein designated TARGET GENE. LOC286337 BINDING SITE is a target binding site found in the 3' untranslated region of mRNA encoded by LOC286337, corresponding to a target binding site such as BINDING SITE I, BINDING SITE II or BINDING SITE III of FIG. 8. Table 4 illustrates the complementarity of the nucleotide sequences of LOC286337 BINDING SITE, designated SEQ ID:3706, to the nucleotide sequence of GAM3298 RNA, herein designated GAM RNA, also designated SEQ ID:259.

Another function of GAM3298 is therefore inhibition of LOC286337 (Accession XP_212274.3). Accordingly, utilities of GAM3298 include diagnosis, prevention and treatment of diseases and clinical conditions associated with LOC286337.

LOC286374 (Accession XP_212293.1) is another GAM3298 target gene, herein designated TARGET GENE. LOC286374 BINDING SITE is a target binding site found in the 5' untranslated region of mRNA encoded by LOC286374, corresponding to a target binding site such as BINDING SITE I, BINDING SITE II or BINDING SITE III of FIG. 8. Table 4 illustrates the complementarity of the nucleotide sequences of LOC286374 BINDING SITE, designated SEQ ID:10184, to the nucleotide sequence of GAM3298 RNA, herein designated GAM RNA, also designated SEQ ID:259.

Another function of GAM3298 is therefore inhibition of LOC286374 (Accession XP_212293.1). Accordingly, utilities of GAM3298 include diagnosis, prevention and treatment of diseases and clinical conditions associated with LOC286374.

LOC286470 (Accession XP_212325.1) is another GAM3298 target gene, herein designated TARGET GENE. LOC286470 BINDING SITE is a target binding site found in the 3' untranslated region of mRNA encoded by LOC286470, corresponding to a target binding site such as BINDING SITE I, BINDING SITE II or BINDING SITE III of FIG. 8. Table 4 illustrates the complementarity of the nucleotide sequences of LOC286470 BINDING SITE, designated SEQ ID:7468, to the nucleotide sequence of GAM3298 RNA, herein designated GAM RNA, also designated SEQ ID:259.

Another function of GAM3298 is therefore inhibition of LOC286470 (Accession XP_212325.1). Accordingly, utilities of GAM3298 include diagnosis, prevention and treatment of diseases and clinical conditions associated with LOC286470.

LOC338549 (Accession XP_294651.1) is another GAM3298 target gene, herein designated TARGET GENE. LOC338549 BINDING SITE1 and LOC338549 BINDING SITE2 are target binding sites found in untranslated regions of mRNA encoded by LOC338549, corresponding to target binding sites such as BINDING SITE I, BINDING SITE II or BINDING SITE III of FIG. 8. Table 4 illustrates the complementarity of the nucleotide sequences of LOC338549 BINDING SITE1 and LOC338549 BINDING SITE2, designated SEQ ID:8366 and SEQ ID:5498 respectively, to the nucleotide sequence of GAM3298 RNA, herein designated GAM RNA, also designated SEQ ID:259.

Another function of GAM3298 is therefore inhibition of LOC338549 (Accession XP_294651.1). Accordingly, utilities of GAM3298 include diagnosis, prevention and treatment of diseases and clinical conditions associated with LOC338549.

LOC338594 (Accession XP_294660.1) is another GAM3298 target gene, herein designated TARGET GENE. LOC338594 BINDING SITE is a target binding site found in the 3' untranslated region of mRNA encoded by LOC338594, corresponding to a target binding site such as BINDING SITE I, BINDING SITE II or BINDING SITE III of FIG. 8. Table 4 illustrates the complementarity of the nucleotide sequences of LOC338594 BINDING SITE, designated SEQ ID:5843, to the nucleotide sequence of GAM3298 RNA, herein designated GAM RNA, also designated SEQ ID:259.

Another function of GAM3298 is therefore inhibition of LOC338594 (Accession XP_294660.1). Accordingly, utilities of GAM3298 include diagnosis, prevention and treatment of diseases and clinical conditions associated with LOC338594.

LOC338963 (Accession XP_294757.1) is another GAM3298 target gene, herein designated TARGET GENE. LOC338963 BINDING SITE is a target binding site found in the 5' untranslated region of mRNA encoded by LOC338963, corresponding to a target binding site such as BINDING SITE I, BINDING SITE II or BINDING SITE III of FIG. 8. Table 4 illustrates the complementarity of the nucleotide sequences of LOC338963 BINDING SITE, designated SEQ ID:3706, to the nucleotide sequence of GAM3298 RNA, herein designated GAM RNA, also designated SEQ ID:259.

Another function of GAM3298 is therefore inhibition of LOC338963 (Accession XP_294757.1). Accordingly, utilities of GAM3298 include diagnosis, prevention and treatment of diseases and clinical conditions associated with LOC338963.

LOC339290 (Accession XP_294901.1) is another GAM3298 target gene, herein designated TARGET GENE. LOC339290 BINDING SITE is a target binding site found in the 5' untranslated region of mRNA encoded by LOC339290, corresponding to a target binding site such as BINDING SITE I, BINDING SITE II or BINDING SITE III of FIG. 8. Table 4 illustrates the complementarity of the nucleotide sequences of LOC339290 BINDING SITE, designated SEQ ID:13707, to the nucleotide sequence of GAM3298 RNA, herein designated GAM RNA, also designated SEQ ID:259.

Another function of GAM3298 is therefore inhibition of LOC339290 (Accession XP_294901.1). Accordingly, utilities of GAM3298 include diagnosis, prevention and treatment of diseases and clinical conditions associated with LOC339290.

LOC339373 (Accession XP_294921.1) is another GAM3298 target gene, herein designated TARGET GENE. LOC339373 BINDING SITE is a target binding site found in the 3' untranslated region of mRNA encoded by LOC339373, corresponding to a target binding site such as BINDING SITE I, BINDING SITE II or BINDING SITE III of FIG. 8. Table 4 illustrates the complementarity of the nucleotide sequences of LOC339373 BINDING SITE, designated SEQ ID:815, to the nucleotide sequence of GAM3298 RNA, herein designated GAM RNA, also designated SEQ ID:259.

Another function of GAM3298 is therefore inhibition of LOC339373 (Accession XP_294921.1). Accordingly, utilities of GAM3298 include diagnosis, prevention and treatment of diseases and clinical conditions associated with LOC339373.

LOC339413 (Accession XP_294936.1) is another GAM3298 target gene, herein designated TARGET GENE. LOC339413 BINDING SITE is a target binding site found in the 3' untranslated region of mRNA encoded by LOC339413, corresponding to a target binding site such as BINDING SITE I, BINDING SITE II or BINDING SITE III of FIG. 8. Table 4 illustrates the complementarity of the nucleotide sequences of LOC339413 BINDING SITE, designated SEQ ID:19562, to the nucleotide sequence of GAM3298 RNA, herein designated GAM RNA, also designated SEQ ID:259.

Another function of GAM3298 is therefore inhibition of LOC339413 (Accession XP_294936.1). Accordingly, utilities of GAM3298 include diagnosis, prevention and treatment of diseases and clinical conditions associated with LOC339413.

LOC339761 (Accession XP_291005.1) is another GAM3298 target gene, herein designated TARGET GENE. LOC339761 BINDING SITE is a target binding site found in the 3' untranslated region of mRNA encoded by LOC339761, corresponding to a target binding site such as BINDING SITE I, BINDING SITE II or BINDING SITE III of FIG. 8. Table 4 illustrates the complementarity of the nucleotide sequences of LOC339761 BINDING SITE, designated SEQ ID:3706, to the nucleotide sequence of GAM3298 RNA, herein designated GAM RNA, also designated SEQ ID:259.

Another function of GAM3298 is therefore inhibition of LOC339761 (Accession XP_291005.1). Accordingly, utilities of GAM3298 include diagnosis, prevention and treatment of diseases and clinical conditions associated with LOC339761.

LOC339841 (Accession XP_291038.1) is another GAM3298 target gene, herein designated TARGET GENE. LOC339841 BINDING SITE is a target binding site found in the 3' untranslated region of mRNA encoded by LOC339841, corresponding to a target binding site such as BINDING SITE I, BINDING SITE II or BINDING SITE III of FIG. 8. Table 4 illustrates the complementarity of the nucleotide sequences of LOC339841 BINDING SITE, designated SEQ ID:7576, to the nucleotide sequence of GAM3298 RNA, herein designated GAM RNA, also designated SEQ ID:259.

Another function of GAM3298 is therefore inhibition of LOC339841 (Accession XP_291038.1). Accordingly, utilities of GAM3298 include diagnosis, prevention and treatment of diseases and clinical conditions associated with LOC339841.

LOC340038 (Accession XP_291125.2) is another GAM3298 target gene, herein designated TARGET GENE. LOC340038 BINDING SITE is a target binding site found in the 3' untranslated region of mRNA encoded by LOC340038, corresponding to a target binding site such as BINDING SITE I, BINDING SITE II or BINDING SITE III of FIG. 8. Table 4 illustrates the complementarity of the nucleotide sequences of LOC340038 BINDING SITE, designated SEQ ID:19238, to the nucleotide sequence of GAM3298 RNA, herein designated GAM RNA, also designated SEQ ID:259.

Another function of GAM3298 is therefore inhibition of LOC340038 (Accession XP_291125.2). Accordingly, utilities of GAM3298 include diagnosis, prevention and treatment of diseases and clinical conditions associated with LOC340038.

LOC340087 (Accession XP_295153.1) is another GAM3298 target gene, herein designated TARGET GENE. LOC340087 BINDING SITE is a target binding site found in the 3' untranslated region of mRNA encoded by LOC340087, corresponding to a target binding site such as BINDING SITE I, BINDING SITE II or BINDING SITE III of FIG. 8. Table 4 illustrates the complementarity of the nucleotide sequences of LOC340087 BINDING SITE, designated SEQ ID:16347, to the nucleotide sequence of GAM3298 RNA, herein designated GAM RNA, also designated SEQ ID:259.

Another function of GAM3298 is therefore inhibition of LOC340087 (Accession XP_295153.1). Accordingly, utilities of GAM3298 include diagnosis, prevention and treatment of diseases and clinical conditions associated with LOC340087.

LOC340184 (Accession XP_295183.1) is another GAM3298 target gene, herein designated TARGET GENE. LOC340184 BINDING SITE is a target binding site found in the 3' untranslated region of mRNA encoded by LOC340184, corresponding to a target binding site such as BINDING SITE I, BINDING SITE II or BINDING SITE III of FIG. 8. Table 4 illustrates the complementarity of the nucleotide sequences of LOC340184 BINDING SITE, designated SEQ ID:3706, to the nucleotide sequence of GAM3298 RNA, herein designated GAM RNA, also designated SEQ ID:259.

Another function of GAM3298 is therefore inhibition of LOC340184 (Accession XP_295183.1). Accordingly, utilities of GAM3298 include diagnosis, prevention and treatment of diseases and clinical conditions associated with LOC340184.

LOC340208 (Accession XP_295187.1) is another GAM3298 target gene, herein designated TARGET GENE. LOC340208 BINDING SITE is a target binding site found in the 5' untranslated region of mRNA encoded by LOC340208, corresponding to a target binding site such as BINDING SITE I, BINDING SITE II or BINDING SITE III of FIG. 8. Table 4 illustrates the complementarity of the nucleotide sequences of LOC340208 BINDING SITE, designated SEQ ID:3706, to the nucleotide sequence of GAM3298 RNA, herein designated GAM RNA, also designated SEQ ID:259.

Another function of GAM3298 is therefore inhibition of LOC340208 (Accession XP_295187.1). Accordingly, utilities of GAM3298 include diagnosis, prevention and treatment of diseases and clinical conditions associated with LOC340208.

LOC340269 (Accession XP_295199.1) is another GAM3298 target gene, herein designated TARGET GENE. LOC340269 BINDING SITE is a target binding site found in the 5' untranslated region of mRNA encoded by LOC340269, corresponding to a target binding site such as BINDING SITE I, BINDING SITE II or BINDING SITE III of FIG. 8. Table 4 illustrates the complementarity of the nucleotide sequences of LOC340269 BINDING SITE, designated SEQ ID:16625, to the nucleotide sequence of GAM3298 RNA, herein designated GAM RNA, also designated SEQ ID:259.

Another function of GAM3298 is therefore inhibition of LOC340269 (Accession XP_295199.1). Accordingly, utilities of GAM3298 include diagnosis, prevention and treatment of diseases and clinical conditions associated with LOC340269.

LOC340320 (Accession XP_295211.1) is another GAM3298 target gene, herein designated TARGET GENE. LOC340320 BINDING SITE is a target binding site found in the 3' untranslated region of mRNA encoded by LOC340320, corresponding to a target binding site such as BINDING SITE I, BINDING SITE II or BINDING SITE III of FIG. 8. Table 4 illustrates the complementarity of the nucleotide sequences of LOC340320 BINDING SITE, designated SEQ ID:4826, to the nucleotide sequence of GAM3298 RNA, herein designated GAM RNA, also designated SEQ ID:259.

Another function of GAM3298 is therefore inhibition of LOC340320 (Accession XP_295211.1). Accordingly, utilities of GAM3298 include diagnosis, prevention and treatment of diseases and clinical conditions associated with LOC340320.

LOC340362 (Accession XP_295225.1) is another GAM3298 target gene, herein designated TARGET GENE. LOC340362 BINDING SITE is a target binding site found in the 3' untranslated region of mRNA encoded by LOC340362, corresponding to a target binding site such as BINDING SITE I, BINDING SITE II or BINDING SITE III of FIG. 8. Table 4 illustrates the complementarity of the nucleotide sequences of LOC340362 BINDING SITE, designated SEQ ID:8160, to the nucleotide sequence of GAM3298 RNA, herein designated GAM RNA, also designated SEQ ID:259.

Another function of GAM3298 is therefore inhibition of LOC340362 (Accession XP_295225.1). Accordingly, utilities of GAM3298 include diagnosis, prevention and treatment of diseases and clinical conditions associated with LOC340362.

LOC340394 (Accession XP_295235.1) is another GAM3298 target gene, herein designated TARGET GENE. LOC340394 BINDING SITE is a target binding site found in the 3' untranslated region of mRNA encoded by LOC340394, corresponding to a target binding site such as BINDING SITE I, BINDING SITE II or BINDING SITE III of FIG. 8. Table 4 illustrates the complementarity of the nucleotide sequences of LOC340394 BINDING SITE, designated SEQ ID:15241, to the nucleotide sequence of GAM3298 RNA, herein designated GAM RNA, also designated SEQ ID:259.

Another function of GAM3298 is therefore inhibition of LOC340394 (Accession XP_295235.1). Accordingly, utilities of GAM3298 include diagnosis, prevention and treatment of diseases and clinical conditions associated with LOC340394.

LOC340547 (Accession XP_291331.1) is another GAM3298 target gene, herein designated TARGET GENE. LOC340547 BINDING SITE is a target binding site found in the 3' untranslated region of mRNA encoded by LOC340547, corresponding to a target binding site such as BINDING SITE I, BINDING SITE II or BINDING SITE III of FIG. 8. Table 4 illustrates the complementarity of the nucleotide sequences of LOC340547 BINDING SITE, designated SEQ ID:1347, to the nucleotide sequence of GAM3298 RNA, herein designated GAM RNA, also designated SEQ ID:259.

Another function of GAM3298 is therefore inhibition of LOC340547 (Accession XP_291331.1). Accordingly, utilities of GAM3298 include diagnosis, prevention and treatment of diseases and clinical conditions associated with LOC340547.

LOC343434 (Accession XP_295562.1) is another GAM3298 target gene, herein designated TARGET GENE. LOC343434 BINDING SITE is a target binding site found in the 5' untranslated region of mRNA encoded by LOC343434, corresponding to a target binding site such as BINDING SITE I, BINDING SITE II or BINDING SITE III of FIG. 8. Table 4 illustrates the complementarity of the nucleotide sequences of LOC343434 BINDING SITE, designated SEQ ID:5570, to the nucleotide sequence of GAM3298 RNA, herein designated GAM RNA, also designated SEQ ID:259.

Another function of GAM3298 is therefore inhibition of LOC343434 (Accession XP_295562.1). Accordingly, utilities of GAM3298 include diagnosis, prevention and treatment of diseases and clinical conditions associated with LOC343434.

LOC346232 (Accession XP_294131.1) is another GAM3298 target gene, herein designated TARGET GENE. LOC346232 BINDING SITE is a target binding site found in the 5' untranslated region of mRNA encoded by LOC346232, corresponding to a target binding site such as BINDING SITE I, BINDING SITE II or BINDING SITE III of FIG. 8. Table 4 illustrates the complementarity of the nucleotide sequences of LOC346232 BINDING SITE, designated SEQ ID:18321, to the nucleotide sequence of GAM3298 RNA, herein designated GAM RNA, also designated SEQ ID:259.

Another function of GAM3298 is therefore inhibition of LOC346232 (Accession XP_294131.1). Accordingly, utilities of GAM3298 include diagnosis, prevention and treatment of diseases and clinical conditions associated with LOC346232.

LOC348102 (Accession XP_302651.1) is another GAM3298 target gene, herein designated TARGET GENE. LOC348102 BINDING SITE is a target binding site found in the 5' untranslated region of mRNA encoded by LOC348102, corresponding to a target binding site such as BINDING SITE I, BINDING SITE II or BINDING SITE III of FIG. 8. Table 4 illustrates the complementarity of the nucleotide sequences of LOC348102 BINDING SITE, designated SEQ ID:3706, to the nucleotide sequence of GAM3298 RNA, herein designated GAM RNA, also designated SEQ ID:259.

Another function of GAM3298 is therefore inhibition of LOC348102 (Accession XP_302651.1). Accordingly, utilities of GAM3298 include diagnosis, prevention and treatment of diseases and clinical conditions associated with LOC348102.

LOC348442 (Accession XP_057659.1) is another GAM3298 target gene, herein designated TARGET GENE. LOC348442 BINDING SITE is a target binding site found in the 3' untranslated region of mRNA encoded by LOC348442, corresponding to a target binding site such as BINDING SITE I, BINDING SITE II or BINDING SITE III of FIG. 8. Table 4 illustrates the complementarity of the nucleotide sequences of LOC348442 BINDING SITE, designated SEQ ID:815, to the nucleotide sequence of GAM3298 RNA, herein designated GAM RNA, also designated SEQ ID:259.

Another function of GAM3298 is therefore inhibition of LOC348442 (Accession XP_057659.1). Accordingly, utilities of GAM3298 include diagnosis, prevention and treatment of diseases and clinical conditions associated with LOC348442.

LOC348456 (Accession XP_302761.1) is another GAM3298 target gene, herein designated TARGET GENE. LOC348456 BINDING SITE is a target binding site found in the 3' untranslated region of mRNA encoded by LOC348456, corresponding to a target binding site such as BINDING SITE I, BINDING SITE II or BINDING SITE III of FIG. 8. Table 4 illustrates the complementarity of the nucleotide sequences of LOC348456 BINDING SITE, designated SEQ ID:3706, to the nucleotide sequence of GAM3298 RNA, herein designated GAM RNA, also designated SEQ ID:259.

Another function of GAM3298 is therefore inhibition of LOC348456 (Accession XP_302761.1). Accordingly, utilities of GAM3298 include diagnosis, prevention and treatment of diseases and clinical conditions associated with LOC348456.

LOC348527 (Accession XP_300779.1) is another GAM3298 target gene, herein designated TARGET GENE. LOC348527 BINDING SITE is a target binding site found in the 3' untranslated region of mRNA encoded by LOC348527, corresponding to a target binding site such as BINDING SITE I, BINDING SITE II or BINDING SITE III of FIG. 8. Table 4 illustrates the complementarity of the nucleotide sequences of LOC348527 BINDING SITE, designated SEQ ID:3706, to the nucleotide sequence of GAM3298 RNA, herein designated GAM RNA, also designated SEQ ID:259.

Another function of GAM3298 is therefore inhibition of LOC348527 (Accession XP_300779.1). Accordingly, utilities of GAM3298 include diagnosis, prevention and treatment of diseases and clinical conditions associated with LOC348527.

LOC348738 (Accession XP_300826.1) is another GAM3298 target gene, herein designated TARGET GENE. LOC348738 BINDING SITE is a target binding site found in the 3' untranslated region of mRNA encoded by LOC348738, corresponding to a target binding site such as BINDING SITE I, BINDING SITE II or BINDING SITE III of FIG. 8. Table 4 illustrates the complementarity of the nucleotide sequences of LOC348738 BINDING SITE, designated SEQ ID:3706, to the nucleotide sequence of GAM3298 RNA, herein designated GAM RNA, also designated SEQ ID:259.

Another function of GAM3298 is therefore inhibition of LOC348738 (Accession XP_300826.1). Accordingly, utilities of GAM3298 include diagnosis, prevention and treatment of diseases and clinical conditions associated with LOC348738.

LOC349063 (Accession XP_302949.1) is another GAM3298 target gene, herein designated TARGET GENE. LOC349063 BINDING SITE is a target binding site found in the 3' untranslated region of mRNA encoded by LOC349063, corresponding to a target binding site such as BINDING SITE I, BINDING SITE II or BINDING SITE III of FIG. 8. Table 4 illustrates the complementarity of the nucleotide sequences of LOC349063 BINDING SITE, designated SEQ ID:18034, to the nucleotide sequence of GAM3298 RNA, herein designated GAM RNA, also designated SEQ ID:259.

Another function of GAM3298 is therefore inhibition of LOC349063 (Accession XP_302949.1). Accordingly, utilities of GAM3298 include diagnosis, prevention and treatment of diseases and clinical conditions associated with LOC349063.

LOC349092 (Accession XP_302959.1) is another GAM3298 target gene, herein designated TARGET GENE.

LOC349092 BINDING SITE is a target binding site found in the 3' untranslated region of mRNA encoded by LOC349092, corresponding to a target binding site such as BINDING SITE I, BINDING SITE II or BINDING SITE III of FIG. 8. Table 4 illustrates the complementarity of the nucleotide sequences of LOC349092 BINDING SITE, designated SEQ ID:16691, to the nucleotide sequence of GAM3298 RNA, herein designated GAM RNA, also designated SEQ ID:259.

Another function of GAM3298 is therefore inhibition of LOC349092 (Accession XP_302959.1). Accordingly, utilities of GAM3298 include diagnosis, prevention and treatment of diseases and clinical conditions associated with LOC349092.

LOC349169 (Accession XP_302978.1) is another GAM3298 target gene, herein designated TARGET GENE. LOC349169 BINDING SITE is a target binding site found in the 3' untranslated region of mRNA encoded by LOC349169, corresponding to a target binding site such as BINDING SITE I, BINDING SITE II or BINDING SITE III of FIG. 8. Table 4 illustrates the complementarity of the nucleotide sequences of LOC349169 BINDING SITE, designated SEQ ID:17395, to the nucleotide sequence of GAM3298 RNA, herein designated GAM RNA, also designated SEQ ID:259.

Another function of GAM3298 is therefore inhibition of LOC349169 (Accession XP_302978.1). Accordingly, utilities of GAM3298 include diagnosis, prevention and treatment of diseases and clinical conditions associated with LOC349169.

LOC349170 (Accession XP_300969.1) is another GAM3298 target gene, herein designated TARGET GENE. LOC349170 BINDING SITE is a target binding site found in the 3' untranslated region of mRNA encoded by LOC349170, corresponding to a target binding site such as BINDING SITE I, BINDING SITE II or BINDING SITE III of FIG. 8. Table 4 illustrates the complementarity of the nucleotide sequences of LOC349170 BINDING SITE, designated SEQ ID:3706, to the nucleotide sequence of GAM3298 RNA, herein designated GAM RNA, also designated SEQ ID:259.

Another function of GAM3298 is therefore inhibition of LOC349170 (Accession XP_300969.1). Accordingly, utilities of GAM3298 include diagnosis, prevention and treatment of diseases and clinical conditions associated with LOC349170.

LOC349282 (Accession XP_301008.1) is another GAM3298 target gene, herein designated TARGET GENE. LOC349282 BINDING SITE is a target binding site found in the 3' untranslated region of mRNA encoded by LOC349282, corresponding to a target binding site such as BINDING SITE I, BINDING SITE II or BINDING SITE III of FIG. 8. Table 4 illustrates the complementarity of the nucleotide sequences of LOC349282 BINDING SITE, designated SEQ ID:19238, to the nucleotide sequence of GAM3298 RNA, herein designated GAM RNA, also designated SEQ ID:259.

Another function of GAM3298 is therefore inhibition of LOC349282 (Accession XP_301008.1). Accordingly, utilities of GAM3298 include diagnosis, prevention and treatment of diseases and clinical conditions associated with LOC349282.

LOC349313 (Accession XP_301024.1) is another GAM3298 target gene, herein designated TARGET GENE. LOC349313 BINDING SITE is a target binding site found in the 3' untranslated region of mRNA encoded by LOC349313, corresponding to a target binding site such as BINDING SITE I, BINDING SITE II or BINDING SITE III of FIG. 8. Table 4 illustrates the complementarity of the nucleotide sequences of LOC349313 BINDING SITE, designated SEQ ID:19238, to the nucleotide sequence of GAM3298 RNA, herein designated GAM RNA, also designated SEQ ID:259.

Another function of GAM3298 is therefore inhibition of LOC349313 (Accession XP_301024.1). Accordingly, utilities of GAM3298 include diagnosis, prevention and treatment of diseases and clinical conditions associated with LOC349313.

LOC349323 (Accession XP_301029.1) is another GAM3298 target gene, herein designated TARGET GENE. LOC349323 BINDING SITE is a target binding site found in the 3' untranslated region of mRNA encoded by LOC349323, corresponding to a target binding site such as BINDING SITE I, BINDING SITE II or BINDING SITE III of FIG. 8. Table 4 illustrates the complementarity of the nucleotide sequences of LOC349323 BINDING SITE, designated SEQ ID:18956, to the nucleotide sequence of GAM3298 RNA, herein designated GAM RNA, also designated SEQ ID:259.

Another function of GAM3298 is therefore inhibition of LOC349323 (Accession XP_301029.1). Accordingly, utilities of GAM3298 include diagnosis, prevention and treatment of diseases and clinical conditions associated with LOC349323.

LOC51333 (Accession NP_057727.1) is another GAM3298 target gene, herein designated TARGET GENE. LOC51333 BINDING SITE is a target binding site found in the 3' untranslated region of mRNA encoded by LOC51333, corresponding to a target binding site such as BINDING SITE I, BINDING SITE II or BINDING SITE III of FIG. 8. Table 4 illustrates the complementarity of the nucleotide sequences of LOC51333 BINDING SITE, designated SEQ ID:17893, to the nucleotide sequence of GAM3298 RNA, herein designated GAM RNA, also designated SEQ ID:259.

Another function of GAM3298 is therefore inhibition of LOC51333 (Accession NP_057727.1). Accordingly, utilities of GAM3298 include diagnosis, prevention and treatment of diseases and clinical conditions associated with LOC51333.

LOC51759 (Accession NP_057566.1) is another GAM3298 target gene, herein designated TARGET GENE. LOC51759 BINDING SITE is a target binding site found in the 3' untranslated region of multiple transcripts of mRNA encoded by LOC51759, corresponding to a target binding site such as BINDING SITE I, BINDING SITE II or BINDING SITE III of FIG. 8. Table 4 illustrates the complementarity of the nucleotide sequences of LOC51759 BINDING SITE, designated SEQ ID:4777, to the nucleotide sequence of GAM3298 RNA, herein designated GAM RNA, also designated SEQ ID:259.

Another function of GAM3298 is therefore inhibition of LOC51759 (Accession NP_057566.1). Accordingly, utilities of GAM3298 include diagnosis, prevention and treatment of diseases and clinical conditions associated with LOC51759.

LOC85865 (Accession NP_149098.1) is another GAM3298 target gene, herein designated TARGET GENE. LOC85865 BINDING SITE is a target binding site found in the 3' untranslated region of mRNA encoded by LOC85865, corresponding to a target binding site such as BINDING SITE I, BINDING SITE II or BINDING SITE III of FIG. 8. Table 4 illustrates the complementarity of the nucleotide sequences of LOC85865 BINDING SITE, designated SEQ ID:6826, to the nucleotide sequence of GAM3298 RNA, herein designated GAM RNA, also designated SEQ ID:259.

Another function of GAM3298 is therefore inhibition of LOC85865 (Accession NP_149098.1). Accordingly, utilities of GAM3298 include diagnosis, prevention and treatment of diseases and clinical conditions associated with LOC85865.

LOC91056 (Accession NP_612377.1) is another GAM3298 target gene, herein designated TARGET GENE. LOC91056 BINDING SITE is a target binding site found in the 3' untranslated region of multiple transcripts of mRNA encoded by LOC91056, corresponding to a target binding site such as BINDING SITE I, BINDING SITE II or BINDING SITE III of FIG. 8. Table 4 illustrates the complementarity of the nucleotide sequences of LOC91056 BINDING SITE, designated SEQ ID:12246, to the nucleotide sequence of GAM3298 RNA, herein designated GAM RNA, also designated SEQ ID:259.

Another function of GAM3298 is therefore inhibition of LOC91056 (Accession NP_612377.1). Accordingly, utilities of GAM3298 include diagnosis, prevention and treatment of diseases and clinical conditions associated with LOC91056.

LOC91565 (Accession XP_039231.1) is another GAM3298 target gene, herein designated TARGET GENE. LOC91565 BINDING SITE is a target binding site found in the 3' untranslated region of mRNA encoded by LOC91565, corresponding to a target binding site such as BINDING SITE I, BINDING SITE II or BINDING SITE III of FIG. 8. Table 4 illustrates the complementarity of the nucleotide sequences of LOC91565 BINDING SITE, designated SEQ ID:6049, to the nucleotide sequence of GAM3298 RNA, herein designated GAM RNA, also designated SEQ ID:259.

Another function of GAM3298 is therefore inhibition of LOC91565 (Accession XP_039231.1). Accordingly, utilities of GAM3298 include diagnosis, prevention and treatment of diseases and clinical conditions associated with LOC91565.

LOC93613 (Accession XP_052568.1) is another GAM3298 target gene, herein designated TARGET GENE. LOC93613 BINDING SITE is a target binding site found in the 3' untranslated region of mRNA encoded by LOC93613, corresponding to a target binding site such as BINDING SITE I, BINDING SITE II or BINDING SITE III of FIG. 8. Table 4 illustrates the complementarity of the nucleotide sequences of LOC93613 BINDING SITE, designated SEQ ID:10184, to the nucleotide sequence of GAM3298 RNA, herein designated GAM RNA, also designated SEQ ID:259.

Another function of GAM3298 is therefore inhibition of LOC93613 (Accession XP_052568.1). Accordingly, utilities of GAM3298 include diagnosis, prevention and treatment of diseases and clinical conditions associated with LOC93613.

LPHN3 (Accession NP_056051.1) is another GAM3298 target gene, herein designated TARGET GENE. LPHN3 BINDING SITE is a target binding site found in the 3' untranslated region of mRNA encoded by LPHN3, corresponding to a target binding site such as BINDING SITE I, BINDING SITE II or BINDING SITE III of FIG. 8. Table 4 illustrates the complementarity of the nucleotide sequences of LPHN3 BINDING SITE, designated SEQ ID:3875, to the nucleotide sequence of GAM3298 RNA, herein designated GAM RNA, also designated SEQ ID:259.

Another function of GAM3298 is therefore inhibition of LPHN3 (Accession NP_056051.1). Accordingly, utilities of GAM3298 include diagnosis, prevention and treatment of diseases and clinical conditions associated with LPHN3.

Mitogen-activated protein kinase kinase kinase 8 (MAP3K8, Accession NP_005195.2) is another GAM3298 target gene, herein designated TARGET GENE. MAP3K8 BINDING SITE is a target binding site found in the 5' untranslated region of mRNA encoded by MAP3K8, corresponding to a target binding site such as BINDING SITE I, BINDING SITE II or BINDING SITE III of FIG. 8. Table 4 illustrates the complementarity of the nucleotide sequences of MAP3K8 BINDING SITE, designated SEQ ID:11824, to the nucleotide sequence of GAM3298 RNA, herein designated GAM RNA, also designated SEQ ID:259.

Another function of GAM3298 is therefore inhibition of Mitogen-activated protein kinase kinase kinase 8 (MAP3K8, Accession NP_005195.2), a gene which is able to activate nf-kappa-b 1 by stimulating proteasome-mediated p. Accordingly, utilities of GAM3298 include diagnosis, prevention and treatment of diseases and clinical conditions associated with MAP3K8.

The function of MAP3K8 and its association with various diseases and clinical conditions, has been established by previous studies, as described hereinabove with reference to GAM55.1. Matrin 3 (MATR3, Accession NP_061322.2) is another GAM3298 target gene, herein designated TARGET GENE. MATR3 BINDING SITE is a target binding site found in the 3' untranslated region of mRNA encoded by MATR3, corresponding to a target binding site such as BINDING SITE I, BINDING SITE II or BINDING SITE III of FIG. 8. Table 4 illustrates the complementarity of the nucleotide sequences of MATR3 BINDING SITE, designated SEQ ID:19562, to the nucleotide sequence of GAM3298 RNA, herein designated GAM RNA, also designated SEQ ID:259.

Another function of GAM3298 is therefore inhibition of Matrin 3 (MATR3, Accession NP_061322.2). Accordingly, utilities of GAM3298 include diagnosis, prevention and treatment of diseases and clinical conditions associated with MATR3.

MAWBP (Accession NP_071412.1) is another GAM3298 target gene, herein designated TARGET GENE. MAWBP BINDING SITE1 and MAWBP BINDING SITE2 are target binding sites found in untranslated regions of mRNA encoded by MAWBP, corresponding to target binding sites such as BINDING SITE I, BINDING SITE II or BINDING SITE III of FIG. 8. Table 4 illustrates the complementarity of the nucleotide sequences of MAWBP BINDING SITE1 and MAWBP BINDING SITE2, designated SEQ ID:4940 and SEQ ID:15240 respectively, to the nucleotide sequence of GAM3298 RNA, herein designated GAM RNA, also designated SEQ ID:259.

Another function of GAM3298 is therefore inhibition of MAWBP (Accession NP_071412.1). Accordingly, utilities of GAM3298 include diagnosis, prevention and treatment of diseases and clinical conditions associated with MAWBP.

Methionyl aminopeptidase 1 (METAP1, Accession NP_055958.1) is another GAM3298 target gene, herein designated TARGET GENE. METAP1 BINDING SITE is a target binding site found in the 3' untranslated region of mRNA encoded by METAP1, corresponding to a target binding site such as BINDING SITE I, BINDING SITE II or BINDING SITE III of FIG. 8. Table 4 illustrates the complementarity of the nucleotide sequences of METAP1 BINDING SITE, designated SEQ ID:12453, to the nucleotide sequence of GAM3298 RNA, herein designated GAM RNA, also designated SEQ ID:259.

Another function of GAM3298 is therefore inhibition of Methionyl aminopeptidase 1 (METAP1, Accession NP_055958.1). Accordingly, utilities of GAM3298 include diagnosis, prevention and treatment of diseases and clinical conditions associated with METAP1.

Mannosyl (beta-1,4-)-glycoprotein beta-1,4-n-acetylglucosaminyltransferase (MGAT3, Accession NP_835470.1) is another GAM3298 target gene, herein designated TARGET GENE. MGAT3 BINDING SITE1 and MGAT3 BINDING SITE2 are target binding sites found in untranslated regions of multiple transcripts of mRNA encoded by MGAT3, corresponding to target binding sites such as BINDING SITE I, BINDING SITE II or BINDING SITE III of FIG. 8. Table 4 illustrates the complementarity of the nucleotide sequences of MGAT3 BINDING SITE1 and MGAT3 BINDING SITE2, designated SEQ ID:16776 and SEQ ID:16780 respectively, to the nucleotide sequence of GAM3298 RNA, herein designated GAM RNA, also designated SEQ ID:259.

Another function of GAM3298 is therefore inhibition of Mannosyl (beta-1,4-)-glycoprotein beta-1,4-n-acetylglucosaminyltransferase (MGAT3, Accession NP_835470.1). Accordingly, utilities of GAM3298 include diagnosis, prevention and treatment of diseases and clinical conditions associated with MGAT3.

MGC10765 (Accession NP_077321.1) is another GAM3298 target gene, herein designated TARGET GENE. MGC10765 BINDING SITE is a target binding site found in the 3' untranslated region of mRNA encoded by MGC10765, corresponding to a target binding site such as BINDING SITE I, BINDING SITE II or BINDING SITE III of FIG. 8. Table 4 illustrates the complementarity of the nucleotide sequences of MGC10765 BINDING SITE, designated SEQ ID:3706, to the nucleotide sequence of GAM3298 RNA, herein designated GAM RNA, also designated SEQ ID:259.

Another function of GAM3298 is therefore inhibition of MGC10765 (Accession NP_077321.1). Accordingly, utilities of GAM3298 include diagnosis, prevention and treatment of diseases and clinical conditions associated with MGC10765.

MGC10771 (Accession NP_078782.2) is another GAM3298 target gene, herein designated TARGET GENE. MGC10771 BINDING SITE is a target binding site found in the 3' untranslated region of mRNA encoded by MGC10771, corresponding to a target binding site such as BINDING SITE I, BINDING SITE II or BINDING SITE III of FIG. 8. Table 4 illustrates the complementarity of the nucleotide sequences of MGC10771 BINDING SITE, designated SEQ ID:3706, to the nucleotide sequence of GAM3298 RNA, herein designated GAM RNA, also designated SEQ ID:259.

Another function of GAM3298 is therefore inhibition of MGC10771 (Accession NP_078782.2). Accordingly, utilities of GAM3298 include diagnosis, prevention and treatment of diseases and clinical conditions associated with MGC10771.

MGC10814 (Accession NP_116060.1) is another GAM3298 target gene, herein designated TARGET GENE. MGC10814 BINDING SITE is a target binding site found in the 5' untranslated region of mRNA encoded by MGC10814, corresponding to a target binding site such as BINDING SITE I, BINDING SITE II or BINDING SITE III of FIG. 8. Table 4 illustrates the complementarity of the nucleotide sequences of MGC10814 BINDING SITE, designated SEQ ID:3706, to the nucleotide sequence of GAM3298 RNA, herein designated GAM RNA, also designated SEQ ID:259.

Another function of GAM3298 is therefore inhibition of MGC10814 (Accession NP_116060.1). Accordingly, utilities of GAM3298 include diagnosis, prevention and treatment of diseases and clinical conditions associated with MGC10814.

MGC13053 (Accession NP_116099.1) is another GAM3298 target gene, herein designated TARGET GENE. MGC13053 BINDING SITE is a target binding site found in the 3' untranslated region of mRNA encoded by MGC13053, corresponding to a target binding site such as BINDING SITE I, BINDING SITE II or BINDING SITE III of FIG. 8. Table 4 illustrates the complementarity of the nucleotide sequences of MGC13053 BINDING SITE, designated SEQ ID:11709, to the nucleotide sequence of GAM3298 RNA, herein designated GAM RNA, also designated SEQ ID:259.

Another function of GAM3298 is therefore inhibition of MGC13053 (Accession NP_116099.1). Accordingly, utilities of GAM3298 include diagnosis, prevention and treatment of diseases and clinical conditions associated with MGC13053.

MGC16703 (Accession NP_659479.1) is another GAM3298 target gene, herein designated TARGET GENE. MGC16703 BINDING SITE is a target binding site found in the 3' untranslated region of mRNA encoded by MGC16703, corresponding to a target binding site such as BINDING SITE I, BINDING SITE II or BINDING SITE III of FIG. 8. Table 4 illustrates the complementarity of the nucleotide sequences of MGC16703 BINDING SITE, designated SEQ ID:3706, to the nucleotide sequence of GAM3298 RNA, herein designated GAM RNA, also designated SEQ ID:259.

Another function of GAM3298 is therefore inhibition of MGC16703 (Accession NP_659479.1). Accordingly, utilities of GAM3298 include diagnosis, prevention and treatment of diseases and clinical conditions associated with MGC16703.

MGC17791 (Accession NP_689575.1) is another GAM3298 target gene, herein designated TARGET GENE. MGC17791 BINDING SITE is a target binding site found in the 3' untranslated region of mRNA encoded by MGC17791, corresponding to a target binding site such as BINDING SITE I, BINDING SITE II or BINDING SITE III of FIG. 8. Table 4 illustrates the complementarity of the nucleotide sequences of MGC17791 BINDING SITE, designated SEQ ID:15278, to the nucleotide sequence of GAM3298 RNA, herein designated GAM RNA, also designated SEQ ID:259.

Another function of GAM3298 is therefore inhibition of MGC17791 (Accession NP_689575.1). Accordingly, utilities of GAM3298 include diagnosis, prevention and treatment of diseases and clinical conditions associated with MGC17791.

MGC17986 (Accession NP_705836.1) is another GAM3298 target gene, herein designated TARGET GENE. MGC17986 BINDING SITE is a target binding site found in the 3' untranslated region of mRNA encoded by MGC17986, corresponding to a target binding site such as BINDING SITE I, BINDING SITE II or BINDING SITE III of FIG. 8. Table 4 illustrates the complementarity of the nucleotide sequences of MGC17986 BINDING SITE, designated SEQ ID:3706, to the nucleotide sequence of GAM3298 RNA, herein designated GAM RNA, also designated SEQ ID:259.

Another function of GAM3298 is therefore inhibition of MGC17986 (Accession NP_705836.1). Accordingly, utilities of GAM3298 include diagnosis, prevention and treatment of diseases and clinical conditions associated with MGC17986.

MGC2396 (Accession NP_443084.1) is another GAM3298 target gene, herein designated TARGET GENE. MGC2396 BINDING SITE is a target binding site found in the 3' untranslated region of mRNA encoded by MGC2396, corresponding to a target binding site such as BINDING SITE I, BINDING SITE II or BINDING SITE III of FIG. 8. Table 4 illustrates the complementarity of the nucleotide sequences of MGC2396 BINDING SITE, designated SEQ ID:6794, to the nucleotide sequence of GAM3298 RNA, herein designated GAM RNA, also designated SEQ ID:259.

Another function of GAM3298 is therefore inhibition of MGC2396 (Accession NP_443084.1). Accordingly, utilities of GAM3298 include diagnosis, prevention and treatment of diseases and clinical conditions associated with MGC2396.

MGC29937 (Accession NP_653198.1) is another GAM3298 target gene, herein designated TARGET GENE. MGC29937 BINDING SITE is a target binding site found in the 3' untranslated region of mRNA encoded by MGC29937, corresponding to a target binding site such as BINDING SITE I, BINDING SITE II or BINDING SITE III of FIG. 8. Table 4 illustrates the complementarity of the nucleotide sequences of MGC29937 BINDING SITE, designated SEQ ID:3706, to the nucleotide sequence of GAM3298 RNA, herein designated GAM RNA, also designated SEQ ID:259.

Another function of GAM3298 is therefore inhibition of MGC29937 (Accession NP_653198.1). Accordingly, utilities of GAM3298 include diagnosis, prevention and treatment of diseases and clinical conditions associated with MGC29937.

MGC30052 (Accession NP_653322.1) is another GAM3298 target gene, herein designated TARGET GENE. MGC30052 BINDING SITE is a target binding site found in the 3' untranslated region of mRNA encoded by MGC30052, corresponding to a target binding site such as BINDING SITE I, BINDING SITE II or BINDING SITE III of FIG. 8. Table 4 illustrates the complementarity of the nucleotide sequences of MGC30052 BINDING SITE, designated SEQ ID:6970, to the nucleotide sequence of GAM3298 RNA, herein designated GAM RNA, also designated SEQ ID:259.

Another function of GAM3298 is therefore inhibition of MGC30052 (Accession NP_653322.1). Accordingly, utilities of GAM3298 include diagnosis, prevention and treatment of diseases and clinical conditions associated with MGC30052.

MGC3195 (Accession NP_114111.2) is another GAM3298 target gene, herein designated TARGET GENE. MGC3195 BINDING SITE is a target binding site found in the 3' untranslated region of mRNA encoded by MGC3195, corresponding to a target binding site such as BINDING SITE I, BINDING SITE II or BINDING SITE III of FIG. 8. Table 4 illustrates the complementarity of the nucleotide sequences of MGC3195 BINDING SITE, designated SEQ ID:7576, to the nucleotide sequence of GAM3298 RNA, herein designated GAM RNA, also designated SEQ ID:259.

Another function of GAM3298 is therefore inhibition of MGC3195 (Accession NP_114111.2). Accordingly, utilities of GAM3298 include diagnosis, prevention and treatment of diseases and clinical conditions associated with MGC3195.

MGC3207 (Accession NP_115661.1) is another GAM3298 target gene, herein designated TARGET GENE. MGC3207 BINDING SITE is a target binding site found in the 3' untranslated region of mRNA encoded by MGC3207, corresponding to a target binding site such as BINDING SITE I, BINDING SITE II or BINDING SITE III of FIG. 8. Table 4 illustrates the complementarity of the nucleotide sequences of MGC3207 BINDING SITE, designated SEQ ID:6665, to the nucleotide sequence of GAM3298 RNA, herein designated GAM RNA, also designated SEQ ID:259.

Another function of GAM3298 is therefore inhibition of MGC3207 (Accession NP_115661.1). Accordingly, utilities of GAM3298 include diagnosis, prevention and treatment of diseases and clinical conditions associated with MGC3207.

MGC34034 (Accession NP_694956.1) is another GAM3298 target gene, herein designated TARGET GENE. MGC34034 BINDING SITE is a target binding site found in the 3' untranslated region of mRNA encoded by MGC34034, corresponding to a target binding site such as BINDING SITE I, BINDING SITE II or BINDING SITE III of FIG. 8. Table 4 illustrates the complementarity of the nucleotide sequences of MGC34034 BINDING SITE, designated SEQ ID:17939, to the nucleotide sequence of GAM3298 RNA, herein designated GAM RNA, also designated SEQ ID:259.

Another function of GAM3298 is therefore inhibition of MGC34034 (Accession NP_694956.1). Accordingly, utilities of GAM3298 include diagnosis, prevention and treatment of diseases and clinical conditions associated with MGC34034.

MGC50836 (Accession XP_171060.1) is another GAM3298 target gene, herein designated TARGET GENE. MGC50836 BINDING SITE is a target binding site found in the 3' untranslated region of mRNA encoded by MGC50836, corresponding to a target binding site such as BINDING SITE I, BINDING SITE II or BINDING SITE III of FIG. 8. Table 4 illustrates the complementarity of the nucleotide sequences of MGC50836 BINDING SITE, designated SEQ ID:17939, to the nucleotide sequence of GAM3298 RNA, herein designated GAM RNA, also designated SEQ ID:259.

Another function of GAM3298 is therefore inhibition of MGC50836 (Accession XP_171060.1). Accordingly, utilities of GAM3298 include diagnosis, prevention and treatment of diseases and clinical conditions associated with MGC50836.

MGC5384 (Accession NP_112234.1) is another GAM3298 target gene, herein designated TARGET GENE. MGC5384 BINDING SITE is a target binding site found in the 3' untranslated region of mRNA encoded by MGC5384, corresponding to a target binding site such as BINDING SITE I, BINDING SITE II or BINDING SITE III of FIG. 8. Table 4 illustrates the complementarity of the nucleotide sequences of MGC5384 BINDING SITE, designated SEQ ID:3706, to the nucleotide sequence of GAM3298 RNA, herein designated GAM RNA, also designated SEQ ID:259.

Another function of GAM3298 is therefore inhibition of MGC5384 (Accession NP_112234.1). Accordingly, utilities of GAM3298 include diagnosis, prevention and treatment of diseases and clinical conditions associated with MGC5384.

Mhc class i polypeptide-related sequence a (MICA, Accession NP_000238.1) is another GAM3298 target gene, herein designated TARGET GENE. MICA BINDING SITE is a target binding site found in the 3' untranslated region of mRNA encoded by MICA, corresponding to a target binding site such as BINDING SITE I, BINDING SITE II or BINDING SITE III of FIG. 8. Table 4 illustrates the complementarity of the nucleotide sequences of MICA BINDING SITE, designated SEQ ID:15857, to the nucleotide sequence of GAM3298 RNA, herein designated GAM RNA, also designated SEQ ID:259.

Another function of GAM3298 is therefore inhibition of Mhc class i polypeptide-related sequence a (MICA, Accession NP_000238.1). Accordingly, utilities of GAM3298 include diagnosis, prevention and treatment of diseases and clinical conditions associated with MICA.

MONDOA (Accession NP_055753.1) is another GAM3298 target gene, herein designated TARGET GENE. MONDOA BINDING SITE is a target binding site found in the 3' untranslated region of mRNA encoded by MONDOA, corresponding to a target binding site such as BINDING SITE I, BINDING SITE II or BINDING SITE III of FIG. 8. Table 4 illustrates the complementarity of the nucleotide sequences of MONDOA BINDING SITE, designated SEQ ID:16680, to the nucleotide sequence of GAM3298 RNA, herein designated GAM RNA, also designated SEQ ID:259.

Another function of GAM3298 is therefore inhibition of MONDOA (Accession NP_055753.1). Accordingly, utilities of GAM3298 include diagnosis, prevention and treatment of diseases and clinical conditions associated with MONDOA.

MPRG (Accession NP_060175.2) is another GAM3298 target gene, herein designated TARGET GENE. MPRG BINDING SITE is a target binding site found in the 3' untranslated region of mRNA encoded by MPRG, corresponding to a target binding site such as BINDING SITE I, BINDING SITE II or BINDING SITE III of FIG. 8. Table 4 illustrates the complementarity of the nucleotide sequences of MPRG BINDING SITE, designated SEQ ID:17939, to the nucleotide sequence of GAM3298 RNA, herein designated GAM RNA, also designated SEQ ID:259.

Another function of GAM3298 is therefore inhibition of MPRG (Accession NP_060175.2). Accordingly, utilities of GAM3298 include diagnosis, prevention and treatment of diseases and clinical conditions associated with MPRG.

Mre11 meiotic recombination 11 homolog a (s. cerevisiae) (MRE11A, Accession NP_005582.1) is another GAM3298 target gene, herein designated TARGET GENE. MRE11A BINDING SITE is a target binding site found in the 3' untranslated region of multiple transcripts of mRNA encoded by MRE11A, corresponding to a target binding site such as BINDING SITE I, BINDING SITE II or BINDING SITE III of FIG. 8. Table 4 illustrates the complementarity of the nucleotide sequences of MRE11A BINDING SITE, designated SEQ ID:9057, to the nucleotide sequence of GAM3298 RNA, herein designated GAM RNA, also designated SEQ ID:259.

Another function of GAM3298 is therefore inhibition of Mre11 meiotic recombination 11 homolog a (s. cerevisiae) (MRE11A, Accession NP_005582.1). Accordingly, utilities of GAM3298 include diagnosis, prevention and treatment of diseases and clinical conditions associated with MRE11A.

Mre11 meiotic recombination 11 homolog a (s. cerevisiae) (MRE11A, Accession NP_005581.2) is another GAM3298 target gene, herein designated TARGET GENE. MRE11A BINDING SITE is a target binding site found in the 3' untranslated region of multiple transcripts of mRNA encoded by MRE11A, corresponding to a target binding site such as BINDING SITE I, BINDING SITE II or BINDING SITE III of FIG. 8. Table 4 illustrates the complementarity of the nucleotide sequences of MRE11A BINDING SITE, designated SEQ ID:9057, to the nucleotide sequence of GAM3298 RNA, herein designated GAM RNA, also designated SEQ ID:259.

Another function of GAM3298 is therefore inhibition of Mre11 meiotic recombination 11 homolog a (s. cerevisiae) (MRE11A, Accession NP_005581.2). Accordingly, utilities of GAM3298 include diagnosis, prevention and treatment of diseases and clinical conditions associated with MRE11A.

Mitochondrial ribosomal protein s18b (MRPS18B, Accession NP_054765.1) is another GAM3298 target gene, herein designated TARGET GENE. MRPS18B BINDING SITE is a target binding site found in the 3' untranslated region of mRNA encoded by MRPS18B, corresponding to a target binding site such as BINDING SITE I, BINDING SITE II or BINDING SITE III of FIG. 8. Table 4 illustrates the complementarity of the nucleotide sequences of MRPS18B BINDING SITE, designated SEQ ID:5843, to the nucleotide sequence of GAM3298 RNA, herein designated GAM RNA, also designated SEQ ID:259.

Another function of GAM3298 is therefore inhibition of Mitochondrial ribosomal protein s18b (MRPS18B, Accession NP_054765.1). Accordingly, utilities of GAM3298 include diagnosis, prevention and treatment of diseases and clinical conditions associated with MRPS18B.

Muts homolog 3 (e. coli) (MSH3, Accession NP_002430.1) is another GAM3298 target gene, herein designated TARGET GENE. MSH3 BINDING SITE is a target binding site found in the 3' untranslated region of mRNA encoded by MSH3, corresponding to a target binding site such as BINDING SITE I, BINDING SITE II or BINDING SITE III of FIG. 8. Table 4 illustrates the complementarity of the nucleotide sequences of MSH3 BINDING SITE, designated SEQ ID:3706, to the nucleotide sequence of GAM3298 RNA, herein designated GAM RNA, also designated SEQ ID:259.

Another function of GAM3298 is therefore inhibition of Muts homolog 3 (e. coli) (MSH3, Accession NP_002430.1), a gene which belongs to the dna mismatch repair muts family. and therefore may be associated with Hereditary nonpolyposis colorectal cancer. Accordingly, utilities of GAM3298 include diagnosis, prevention and treatment of Hereditary nonpolyposis colorectal cancer, and of other diseases and clinical conditions associated with MSH3.

The function of MSH3 and its association with various diseases and clinical conditions, has been established by previous studies, as described hereinabove with reference to GAM347.1. Major vault protein (MVP, Accession NP_059447.2) is another GAM3298 target gene, herein designated TARGET GENE. MVP BINDING SITE is a target binding site found in the 5' untranslated region of multiple transcripts of mRNA encoded by MVP, corresponding to a target binding site such as BINDING SITE I, BINDING SITE II or BINDING SITE III of FIG. 8. Table 4 illustrates the complementarity of the nucleotide sequences of MVP BINDING SITE, designated SEQ ID:6247, to the nucleotide sequence of GAM3298 RNA, herein designated GAM RNA, also designated SEQ ID:259.

Another function of GAM3298 is therefore inhibition of Major vault protein (MVP, Accession NP_059447.2), a gene which may be involved in nucleo- cytoplasmic transport. Accordingly, utilities of GAM3298 include diagnosis, prevention and treatment of diseases and clinical conditions associated with MVP.

The function of MVP and its association with various diseases and clinical conditions, has been established by previous studies, as described hereinabove with reference to GAM1674.1. NBR2 (Accession NP_005812.1) is another GAM3298 target gene, herein designated TARGET GENE. NBR2 BINDING SITE is a target binding site found in the 3' untranslated region of mRNA encoded by NBR2, corresponding to a target binding site such as BINDING SITE I, BINDING SITE II or BINDING SITE III of FIG. 8. Table 4 illustrates the complementarity of the nucleotide sequences of NBR2 BINDING SITE, designated SEQ ID:17309, to the nucleotide sequence of GAM3298 RNA, herein designated GAM RNA, also designated SEQ ID:259.

Another function of GAM3298 is therefore inhibition of NBR2 (Accession NP_005812.1). Accordingly, utilities of GAM3298 include diagnosis, prevention and treatment of diseases and clinical conditions associated with NBR2.

Nuclear receptor coactivator 3 (NCOA3, Accession NP_006525.1) is another GAM3298 target gene, herein designated TARGET GENE. NCOA3 BINDING SITE is a target binding site found in the 3' untranslated region of mRNA encoded by NCOA3, corresponding to a target binding site such as BINDING SITE I, BINDING SITE II or BINDING SITE III of FIG. 8. Table 4 illustrates the complementarity of the nucleotide sequences of NCOA3 BINDING SITE, designated SEQ ID:13706, to the nucleotide sequence of GAM3298 RNA, herein designated GAM RNA, also designated SEQ ID:259.

Another function of GAM3298 is therefore inhibition of Nuclear receptor coactivator 3 (NCOA3, Accession NP_006525.1), a gene which directly binds nuclear receptors and stimulates the transcriptional activities in hormone-dependent fashion. and therefore may be associated with Steroid-dependent cancers. Accordingly, utilities of GAM3298 include diagnosis, prevention and treatment of Steroid-dependent cancers, and of other diseases and clinical conditions associated with NCOA3.

The function of NCOA3 and its association with various diseases and clinical conditions, has been established by previous studies, as described hereinabove with reference to GAM385.2. NDP52 (Accession NP_005822.1) is another GAM3298 target gene, herein designated TARGET GENE. NDP52 BINDING SITE is a target binding site found in the 3' untranslated region of mRNA encoded by NDP52, corresponding to a target binding site such as BINDING SITE I, BINDING SITE II or BINDING SITE III of FIG. 8. Table 4 illustrates the complementarity of the nucleotide sequences of NDP52 BINDING SITE, designated SEQ ID:2868, to the nucleotide sequence of GAM3298 RNA, herein designated GAM RNA, also designated SEQ ID:259.

Another function of GAM3298 is therefore inhibition of NDP52 (Accession NP_005822.1). Accordingly, utilities of GAM3298 include diagnosis, prevention and treatment of diseases and clinical conditions associated with NDP52.

Nadh dehydrogenase (ubiquinone) 1, subcomplex unknown, 2, 14.5 kda (NDUFC2, Accession NP_004540.1) is another GAM3298 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:12246, to the nucleotide sequence of GAM3298 RNA, herein designated GAM RNA, also designated SEQ ID:259.

Another function of GAM3298 is therefore inhibition of Nadh dehydrogenase (ubiquinone) 1, subcomplex unknown, 2, 14.5 kda (NDUFC2, Accession NP_004540.1). Accordingly, utilities of GAM3298 include diagnosis, prevention and treatment of diseases and clinical conditions associated with NDUFC2.

Neural precursor cell expressed, developmentally down-regulated 4-like (NEDD4L, Accession NP_056092.2) is another GAM3298 target gene, herein designated TARGET GENE. NEDD4L BINDING SITE is a target binding site found in the 3' untranslated region of mRNA encoded by NEDD4L, corresponding to a target binding site such as BINDING SITE I, BINDING SITE II or BINDING SITE III of FIG. 8. Table 4 illustrates the complementarity of the nucleotide sequences of NEDD4L BINDING SITE, designated SEQ ID:12224, to the nucleotide sequence of GAM3298 RNA, herein designated GAM RNA, also designated SEQ ID:259.

Another function of GAM3298 is therefore inhibition of Neural precursor cell expressed, developmentally down-regulated 4-like (NEDD4L, Accession NP_056092.2), a gene which may play a role in the regulation of epithelial sodium channel function. Accordingly, utilities of GAM3298 include diagnosis, prevention and treatment of diseases and clinical conditions associated with NEDD4L.

The function of NEDD4L and its association with various diseases and clinical conditions, has been established by previous studies, as described hereinabove with reference to GAM499.2. Nuclear factor of activated t-cells 5, tonicity-responsive (NFAT5, Accession NP_775322.1) is another GAM3298 target gene, herein designated TARGET GENE. NFAT5 BINDING SITE is a target binding site found in the 3' untranslated region of multiple transcripts of mRNA encoded by NFAT5, corresponding to a target binding site such as BINDING SITE I, BINDING SITE II or BINDING SITE III of FIG. 8. Table 4 illustrates the complementarity of the nucleotide sequences of NFAT5 BINDING SITE, designated SEQ ID:12246, to the nucleotide sequence of GAM3298 RNA, herein designated GAM RNA, also designated SEQ ID:259.

Another function of GAM3298 is therefore inhibition of Nuclear factor of activated t-cells 5, tonicity-responsive (NFAT5, Accession NP_775322.1). Accordingly, utilities of GAM3298 include diagnosis, prevention and treatment of diseases and clinical conditions associated with NFAT5.

Natural killer-tumor recognition sequence (NKTR, Accession NP_005376.2) is another GAM3298 target gene, herein designated TARGET GENE. NKTR BINDING SITE is a target binding site found in the 3' untranslated region of mRNA encoded by NKTR, corresponding to a target binding site such as BINDING SITE I, BINDING SITE II or BINDING SITE III of FIG. 8. Table 4 illustrates the complementarity of the nucleotide sequences of NKTR BINDING SITE, designated SEQ ID:14143, to the nucleotide sequence of GAM3298 RNA, herein designated GAM RNA, also designated SEQ ID:259.

Another function of GAM3298 is therefore inhibition of Natural killer-tumor recognition sequence (NKTR, Accession NP_005376.2), a gene which is involved in the function of nk cells. Accordingly, utilities of GAM3298 include diagnosis, prevention and treatment of diseases and clinical conditions associated with NKTR.

The function of NKTR and its association with various diseases and clinical conditions, has been established by previous studies, as described hereinabove with reference to GAM467.2. NMA (Accession NP_036474.1) is another GAM3298 target gene, herein designated TARGET GENE. NMA BINDING SITE is a target binding site found in the 3' untranslated region of mRNA encoded by NMA, corresponding to a target binding site such as BINDING SITE I, BINDING SITE II or BINDING SITE III of FIG. 8. Table 4 illustrates the complementarity of the nucleotide sequences of NMA BINDING SITE, designated SEQ ID:12002, to the nucleotide sequence of GAM3298 RNA, herein designated GAM RNA, also designated SEQ ID:259.

Another function of GAM3298 is therefore inhibition of NMA (Accession NP_036474.1). Accordingly, utilities of GAM3298 include diagnosis, prevention and treatment of diseases and clinical conditions associated with NMA.

ODAG (Accession NP_066990.2) is another GAM3298 target gene, herein designated TARGET GENE. ODAG BINDING SITE is a target binding site found in the 3' untranslated region of mRNA encoded by ODAG, corresponding to a target binding site such as BINDING SITE I, BINDING SITE II or BINDING SITE III of FIG. 8. Table 4 illustrates the complementarity of the nucleotide sequences of ODAG BINDING SITE, designated SEQ ID:13789, to the nucleotide sequence of GAM3298 RNA, herein designated GAM RNA, also designated SEQ ID:259.

Another function of GAM3298 is therefore inhibition of ODAG (Accession NP_066990.2). Accordingly, utilities of GAM3298 include diagnosis, prevention and treatment of diseases and clinical conditions associated with ODAG.

Optineurin (OPTN, Accession NP_068815.2) is another GAM3298 target gene, herein designated TARGET GENE. OPTN BINDING SITE is a target binding site found in the 3' untranslated region of mRNA encoded by OPTN, corresponding to a target binding site such as BINDING SITE I, BINDING SITE II or BINDING SITE III of FIG. 8. Table 4 illustrates the complementarity of the nucleotide sequences of OPTN BINDING SITE, designated SEQ ID:3706, to the nucleotide sequence of GAM3298 RNA, herein designated GAM RNA, also designated SEQ ID:259.

Another function of GAM3298 is therefore inhibition of Optineurin (OPTN, Accession NP_068815.2). Accordingly, utilities of GAM3298 include diagnosis, prevention and treatment of diseases and clinical conditions associated with OPTN.

Platelet-activating factor acetylhydrolase 2, 40 kda (PAFAH2, Accession NP_000428.2) is another GAM3298 target gene, herein designated TARGET GENE. PAFAH2 BINDING SITE is a target binding site found in the 3' untranslated region of mRNA encoded by PAFAH2, corresponding to a target binding site such as BINDING SITE I, BINDING SITE II or BINDING SITE III of FIG. 8. Table 4 illustrates the complementarity of the nucleotide sequences of PAFAH2 BINDING SITE, designated SEQ ID:3706, to the nucleotide sequence of GAM3298 RNA, herein designated GAM RNA, also designated SEQ ID:259.

Another function of GAM3298 is therefore inhibition of Platelet-activating factor acetylhydrolase 2, 40 kda (PAFAH2, Accession NP_000428.2). Accordingly, utilities of GAM3298 include diagnosis, prevention and treatment of diseases and clinical conditions associated with PAFAH2.

PBXIP1 (Accession NP_065385.2) is another GAM3298 target gene, herein designated TARGET GENE. PBXIP1 BINDING SITE is a target binding site found in the 3' untranslated region of mRNA encoded by PBXIP1, corresponding to a target binding site such as BINDING SITE I, BINDING SITE II or BINDING SITE III of FIG. 8. Table 4 illustrates the complementarity of the nucleotide sequences of PBXIP1 BINDING SITE, designated SEQ ID:19722, to the nucleotide sequence of GAM3298 RNA, herein designated GAM RNA, also designated SEQ ID:259.

Another function of GAM3298 is therefore inhibition of PBXIP1 (Accession NP_065385.2). Accordingly, utilities of GAM3298 include diagnosis, prevention and treatment of diseases and clinical conditions associated with PBXIP1.

Protocadherin 11 y-linked (PCDH11Y, Accession NP_116753.1) is another GAM3298 target gene, herein designated TARGET GENE. PCDH11Y BINDING SITE is a target binding site found in the 3' untranslated region of multiple transcripts of mRNA encoded by PCDH11Y, corresponding to a target binding site such as BINDING SITE I, BINDING SITE II or BINDING SITE III of FIG. 8. Table 4 illustrates the complementarity of the nucleotide sequences of PCDH11Y BINDING SITE, designated SEQ ID:815, to the nucleotide sequence of GAM3298 RNA, herein designated GAM RNA, also designated SEQ ID:259.

Another function of GAM3298 is therefore inhibition of Protocadherin 11 y-linked (PCDH11Y, Accession NP_116753.1). Accordingly, utilities of GAM3298 include diagnosis, prevention and treatment of diseases and clinical conditions associated with PCDH11Y.

Protocadherin 11 y-linked (PCDH11Y, Accession NP_116754.1) is another GAM3298 target gene, herein designated TARGET GENE. PCDH11Y BINDING SITE is a target binding site found in the 3' untranslated region of multiple transcripts of mRNA encoded by PCDH11Y, corresponding to a target binding site such as BINDING SITE I, BINDING SITE II or BINDING SITE III of FIG. 8. Table 4 illustrates the complementarity of the nucleotide sequences of PCDH11Y BINDING SITE, designated SEQ ID:815, to the nucleotide sequence of GAM3298 RNA, herein designated GAM RNA, also designated SEQ ID:259.

Another function of GAM3298 is therefore inhibition of Protocadherin 11 y-linked (PCDH11Y, Accession NP_116754.1). Accordingly, utilities of GAM3298 include diagnosis, prevention and treatment of diseases and clinical conditions associated with PCDH11Y.

Protocadherin alpha 1 (PCDHA1, Accession NP_113599.1) is another GAM3298 target gene, herein designated TARGET GENE. PCDHA1 BINDING SITE is a target binding site found in the 3' untranslated region of multiple transcripts of mRNA encoded by PCDHA1, corresponding to a target binding site such as BINDING SITE I, BINDING SITE II or BINDING SITE III of FIG. 8. Table 4 illustrates the complementarity of the nucleotide sequences of PCDHA1 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 1 (PCDHA1, Accession NP_113599.1). Accordingly, utilities of GAM3298 include diagnosis, prevention and treatment of diseases and clinical conditions associated with PCDHA1.

Protocadherin alpha 1 (PCDHA1, Accession NP_061723.1) is another GAM3298 target gene, herein designated TARGET GENE. PCDHA1 BINDING SITE is a target binding site found in the 3' untranslated region of multiple transcripts of mRNA encoded by PCDHA1, corresponding to a target binding site such as BINDING SITE I, BINDING SITE II or BINDING SITE III of FIG. 8. Table 4 illustrates the complementarity of the nucleotide sequences of PCDHA1 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 1 (PCDHA1, Accession NP_061723.1). Accordingly, utilities of GAM3298 include diagnosis, prevention and treatment of diseases and clinical conditions associated with PCDHA1.

Protocadherin alpha 10 (PCDHA10, Accession NP_061724.1) is another GAM3298 target gene, herein designated TARGET GENE. PCDHA10 BINDING SITE is a target binding site found in the 3' untranslated region of multiple transcripts of mRNA encoded by PCDHA10, corresponding to a target binding site such as BINDING SITE I, BINDING SITE II or BINDING SITE III of FIG. 8. Table 4 illustrates the complementarity of the nucleotide sequences of PCDHA10 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 10 (PCDHA10, Accession NP_061724.1). Accordingly, utilities of GAM3298 include diagnosis, prevention and treatment of diseases and clinical conditions associated with PCDHA10.

Protocadherin alpha 10 (PCDHA10, Accession NP_114066.1) is another GAM3298 target gene, herein designated TARGET GENE. PCDHA10 BINDING SITE is a target binding site found in the 3' untranslated region of multiple transcripts of mRNA encoded by PCDHA10, corresponding to a target binding site such as BINDING SITE I, BINDING SITE II or BINDING SITE III of FIG. 8. Table 4 illustrates the complementarity of the nucleotide sequences of PCDHA10 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 10 (PCDHA10, Accession NP_114066.1). Accordingly, utilities of GAM3298 include diagnosis, prevention and treatment of diseases and clinical conditions associated with PCDHA10.

Protocadherin alpha 11 (PCDHA11, Accession NP_061725.1) is another GAM3298 target gene, herein designated TARGET GENE. PCDHA11 BINDING SITE is a target binding site found in the 3' untranslated region of multiple transcripts of mRNA encoded by PCDHA11, corresponding to a target binding site such as BINDING SITE I, BINDING SITE II or BINDING SITE III of FIG. 8. Table 4 illustrates the complementarity of the nucleotide sequences of PCDHA11 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 11 (PCDHA11, Accession NP_061725.1). Accordingly, utilities of GAM3298 include diagnosis, prevention and treatment of diseases and clinical conditions associated with PCDHA11.

Protocadherin alpha 12 (PCDHA12, Accession NP_061726.1) is another GAM3298 target gene, herein designated TARGET GENE. PCDHA12 BINDING SITE is a target binding site found in the 3' untranslated region of multiple transcripts of mRNA encoded by PCDHA12, corresponding to a target binding site such as BINDING SITE I, BINDING SITE II or BINDING SITE III of FIG. 8. Table 4 illustrates the complementarity of the nucleotide sequences of PCDHA12 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 12 (PCDHA12, Accession NP_061726.1). Accordingly, utilities of GAM3298 include diagnosis, prevention and treatment of diseases and clinical conditions associated with PCDHA12.

Protocadherin alpha 13 (PCDHA13, Accession NP_061727.1) is another GAM3298 target gene, herein designated TARGET GENE. PCDHA13 BINDING SITE is a target binding site found in the 3' untranslated region of multiple transcripts of mRNA encoded by PCDHA13, corresponding to a target binding site such as BINDING SITE I, BINDING SITE II or BINDING SITE III of FIG. 8. Table 4 illustrates the complementarity of the nucleotide sequences of PCDHA13 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 13 (PCDHA13, Accession NP_061727.1). Accordingly, utilities of GAM3298 include diagnosis, prevention and treatment of diseases and clinical conditions associated with PCDHA13.

Protocadherin alpha 2 (PCDHA2, Accession NP_061728.1) is another GAM3298 target gene, herein designated TARGET GENE. PCDHA2 BINDING SITE is a target binding site found in the 3' untranslated region of multiple transcripts of mRNA encoded by PCDHA2, corresponding to a target binding site such as BINDING SITE I, BINDING SITE II or BINDING SITE III of FIG. 8. Table 4 illustrates the complementarity of the nucleotide sequences of PCDHA2 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 2 (PCDHA2, Accession NP_061728.1). Accordingly, utilities of GAM3298 include diagnosis, prevention and treatment of diseases and clinical conditions associated with PCDHA2.

Protocadherin alpha 3 (PCDHA3, Accession NP_061729.1) is another GAM3298 target gene, herein designated TARGET GENE. PCDHA3 BINDING SITE is a target binding site found in the 3' untranslated region of mRNA encoded by PCDHA3, corresponding to a target binding site such as BINDING SITE I, BINDING SITE II or BINDING SITE III of FIG. 8. Table 4 illustrates the complementarity of the nucleotide sequences of PCDHA3 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 3 (PCDHA3, Accession NP_061729.1). Accordingly, utilities of GAM3298 include diagnosis, prevention and treatment of diseases and clinical conditions associated with PCDHA3.

Protocadherin alpha 4 (PCDHA4, Accession NP_061730.1) is another GAM3298 target gene, herein designated TARGET GENE. PCDHA4 BINDING SITE is a target binding site found in the 3' untranslated region of multiple transcripts of mRNA encoded by PCDHA4, corresponding to a target binding site such as BINDING SITE I, BINDING SITE II or BINDING SITE III of FIG. 8. Table 4 illustrates the complementarity of the nucleotide sequences of PCDHA4 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 4 (PCDHA4, Accession NP_061730.1). Accordingly, utilities of GAM3298 include diagnosis, prevention and treatment of diseases and clinical conditions associated with PCDHA4.

Protocadherin alpha 5 (PCDHA5, Accession NP_061731.1) is another GAM3298 target gene, herein designated TARGET GENE. PCDHA5 BINDING SITE is a target binding site found in the 3' untranslated region of mRNA encoded by PCDHA5, corresponding to a target binding site such as BINDING SITE I, BINDING SITE II or BINDING SITE III of FIG. 8. Table 4 illustrates the complementarity of the nucleotide sequences of PCDHA5 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 5 (PCDHA5, Accession NP_061731.1). Accordingly, utilities of GAM3298 include diagnosis, prevention and treatment of diseases and clinical conditions associated with PCDHA5.

Protocadherin alpha 6 (PCDHA6, Accession NP_061732.1) is another GAM3298 target gene, herein designated TARGET GENE. PCDHA6 BINDING SITE is a target binding site found in the 3' untranslated region of multiple transcripts of mRNA encoded by PCDHA6, corresponding to a target binding site such as BINDING SITE I, BINDING SITE II or BINDING SITE III of FIG. 8. Table 4 illustrates the complementarity of the nucleotide sequences of PCDHA6 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 6 (PCDHA6, Accession NP_061732.1). Accordingly, utilities of GAM3298 include diagnosis, prevention and treatment of diseases and clinical conditions associated with PCDHA6.

Protocadherin alpha 6 (PCDHA6, Accession NP_114037.1) is another GAM3298 target gene, herein designated TARGET GENE. PCDHA6 BINDING SITE is a target binding site found in the 3' untranslated region of multiple transcripts of mRNA encoded by PCDHA6, corresponding to a target binding site such as BINDING SITE I, BINDING SITE II or BINDING SITE III of FIG. 8. Table 4 illustrates the complementarity of the nucleotide sequences of PCDHA6 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 6 (PCDHA6, Accession NP_114037.1). Accordingly, utilities of GAM3298 include diagnosis, prevention and treatment of diseases and clinical conditions associated with PCDHA6.

Protocadherin alpha 7 (PCDHA7, Accession NP_061733.1) is another GAM3298 target gene, herein designated TARGET GENE. PCDHA7 BINDING SITE is a target binding site found in the 3' untranslated region of mRNA encoded by PCDHA7, corresponding to a target binding site such as BINDING SITE I, BINDING SITE II or BINDING SITE III of FIG. 8. Table 4 illustrates the complementarity of the nucleotide sequences of PCDHA7 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 7 (PCDHA7, Accession NP_061733.1). Accordingly, utilities of GAM3298 include diagnosis, prevention and treatment of diseases and clinical conditions associated with PCDHA7.

Protocadherin alpha 8 (PCDHA8, Accession NP_061734.1) is another GAM3298 target gene, herein designated TARGET GENE. PCDHA8 BINDING SITE is a target binding site found in the 3' untranslated region of mRNA encoded by PCDHA8, corresponding to a target binding site such as BINDING SITE I, BINDING SITE II or BINDING SITE III of FIG. 8. Table 4 illustrates the complementarity of the nucleotide sequences of PCDHA8 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 8 (PCDHA8, Accession NP_061734.1). Accordingly, utilities of GAM3298 include diagnosis, prevention and treatment of diseases and clinical conditions associated with PCDHA8.

Protocadherin alpha 9 (PCDHA9, Accession NP_114063.1) is another GAM3298 target gene, herein designated TARGET GENE. PCDHA9 BINDING SITE is a target binding site found in the 3' untranslated region of multiple transcripts of mRNA encoded by PCDHA9, corresponding to a target binding site such as BINDING SITE I, BINDING SITE II or BINDING SITE III of FIG. 8. Table 4 illustrates the complementarity of the nucleotide sequences of PCDHA9 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha 9 (PCDHA9, Accession NP_114063.1), a gene which is a calcium-dependent cell-adhesion protein. Accordingly, utilities of GAM3298 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Protocadherin alpha subfamily c, 1 (PCDHAC1, Accession NP_061721.2) is another GAM3298 target gene, herein designated TARGET GENE. PCDHAC1 BINDING SITE is a target binding site found in the 3' untranslated region of multiple transcripts of mRNA encoded by PCDHAC1, corresponding to a target binding site such as BINDING SITE I, BINDING SITE II or BINDING SITE III of FIG. 8. Table 4 illustrates the complementarity of the nucleotide sequences of PCDHAC1 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha subfamily c, 1 (PCDHAC1, Accession NP_061721.2). Accordingly, utilities of GAM3298 include diagnosis, prevention and treatment of diseases and clinical conditions associated with PCDHAC1.

Protocadherin alpha subfamily c, 2 (PCDHAC2, Accession NP_061722.1) is another GAM3298 target gene, herein designated TARGET GENE. PCDHAC2 BINDING SITE is a target binding site found in the 3' untranslated region of mRNA encoded by PCDHAC2, corresponding to a target binding site such as BINDING SITE I, BINDING SITE II or BINDING SITE III of FIG. 8. Table 4 illustrates the complementarity of the nucleotide sequences of PCDHAC2 BINDING SITE, designated SEQ ID:12657, to the nucleotide sequence of GAM3298 RNA, herein designated GAM RNA, also designated SEQ ID:259.

Another function of GAM3298 is therefore inhibition of Protocadherin alpha subfamily c, 2 (PCDHAC2, Accession NP_061722.1). Accordingly, utilities of GAM3298 include diagnosis, prevention and treatment of diseases and clinical conditions associated with PCDHAC2.

PEX26 (Accession NP_060399.1) is another GAM3298 target gene, herein designated TARGET GENE. PEX26 BINDING SITE is a target binding site found in the 3' untranslated region of mRNA encoded by PEX26, corresponding to a target binding site such as BINDING SITE I, BINDING SITE II or BINDING SITE III of FIG. 8. Table 4 illustrates the complementarity of the nucleotide sequences of PEX26 BINDING SITE, designated SEQ ID:16060, to the nucleotide sequence of GAM3298 RNA, herein designated GAM RNA, also designated SEQ ID:259.

Another function of GAM3298 is therefore inhibition of PEX26 (Accession NP_060399.1). Accordingly, utilities of GAM3298 include diagnosis, prevention and treatment of diseases and clinical conditions associated with PEX26.

Phosphatidylinositol glycan, class m (PIGM, Accession NP_660150.1) is another GAM3298 target gene, herein designated TARGET GENE. PIGM BINDING SITE is a target binding site found in the 3' untranslated region of mRNA encoded by PIGM, corresponding to a target binding site such as BINDING SITE I, BINDING SITE II or BINDING SITE III of FIG. 8. Table 4 illustrates the complementarity of the nucleotide sequences of PIGM BINDING SITE, designated SEQ ID:1310, to the nucleotide sequence of GAM3298 RNA, herein designated GAM RNA, also designated SEQ ID:259.

Another function of GAM3298 is therefore inhibition of Phosphatidylinositol glycan, class m (PIGM, Accession NP_660150.1). Accordingly, utilities of GAM3298 include diagnosis, prevention and treatment of diseases and clinical conditions associated with PIGM.

PIGO (Accession NP_116023.2) is another GAM3298 target gene, herein designated TARGET GENE. PIGO BINDING SITE is a target binding site found in the 3' untranslated region of multiple transcripts of mRNA encoded by PIGO, corresponding to a target binding site such as BINDING SITE I, BINDING SITE II or BINDING SITE III of FIG. 8. Table 4 illustrates the complementarity of the nucleotide sequences of PIGO BINDING SITE, designated SEQ ID:19803, to the nucleotide sequence of GAM3298 RNA, herein designated GAM RNA, also designated SEQ ID:259.

Another function of GAM3298 is therefore inhibition of PIGO (Accession NP_116023.2). Accordingly, utilities of GAM3298 include diagnosis, prevention and treatment of diseases and clinical conditions associated with PIGO.

PIGO (Accession NP_690577.1) is another GAM3298 target gene, herein designated TARGET GENE. PIGO BINDING SITE is a target binding site found in the 3' untranslated region of multiple transcripts of mRNA encoded by PIGO, corresponding to a target binding site such as BINDING SITE I, BINDING SITE II or BINDING SITE III of FIG. 8. Table 4 illustrates the complementarity of the nucleotide sequences of PIGO BINDING SITE, designated SEQ ID:19803, to the nucleotide sequence of GAM3298 RNA, herein designated GAM RNA, also designated SEQ ID:259.

Another function of GAM3298 is therefore inhibition of PIGO (Accession NP_690577.1). Accordingly, utilities of GAM3298 include diagnosis, prevention and treatment of diseases and clinical conditions associated with PIGO.

Phosphoinositide-3-kinase, regulatory subunit, polypeptide 2 (p85 beta) (PIK3R2, Accession NP_005018.1) is another GAM3298 target gene, herein designated TARGET GENE. PIK3R2 BINDING SITE is a target binding site found in the 3' untranslated region of mRNA encoded by PIK3R2, corresponding to a target binding site such as BINDING SITE I, BINDING SITE II or BINDING SITE III of FIG. 8. Table 4 illustrates the complementarity of the nucleotide sequences of PIK3R2 BINDING SITE, designated SEQ ID:3706, to the nucleotide sequence of GAM3298 RNA, herein designated GAM RNA, also designated SEQ ID:259.

Another function of GAM3298 is therefore inhibition of Phosphoinositide-3-kinase, regulatory subunit, polypeptide 2 (p85 beta) (PIK3R2, Accession NP_005018.1), a gene which acts as an adapter and is regulatory subunit (p85 beta) of phosphatidylinositol 3-kinase. Accordingly, utilities of GAM3298 include diagnosis, prevention and treatment of diseases and clinical conditions associated with PIK3R2.

The function of PIK3R2 and its association with various diseases and clinical conditions, has been established by previous studies, as described hereinabove with reference to GAM439.1. Polycystic kidney and hepatic disease 1 (autosomal recessive) (PKHD1, Accession NP_619639.2) is another GAM3298 target gene, herein designated TARGET GENE. PKHD1 BINDING SITE is a target binding site found in the 3' untranslated region of multiple transcripts of mRNA encoded by PKHD1, corresponding to a target binding site such as BINDING SITE I, BINDING SITE II or BINDING SITE III of FIG. 8. Table 4 illustrates the complementarity of the nucleotide sequences of PKHD1 BINDING SITE, designated SEQ ID:12090, to the nucleotide sequence of GAM3298 RNA, herein designated GAM RNA, also designated SEQ ID:259.

Another function of GAM3298 is therefore inhibition of Polycystic kidney and hepatic disease 1 (autosomal recessive) (PKHD1, Accession NP_619639.2). Accordingly, utilities of GAM3298 include diagnosis, prevention and treatment of diseases and clinical conditions associated with PKHD1.

Placenta-specific 1 (PLAC1, Accession NP_068568.1) is another GAM3298 target gene, herein designated TARGET GENE. PLAC1 BINDING SITE is a target binding site found in the 3' untranslated region of mRNA encoded by PLAC1, corresponding to a target binding site such as BINDING SITE I, BINDING SITE II or BINDING SITE III of FIG. 8. Table 4 illustrates the complementarity of the nucleotide sequences of PLAC1 BINDING SITE, designated SEQ ID:1845, to the nucleotide sequence of GAM3298 RNA, herein designated GAM RNA, also designated SEQ ID:259.

Another function of GAM3298 is therefore inhibition of Placenta-specific 1 (PLAC1, Accession NP_068568.1). Accordingly, utilities of GAM3298 include diagnosis, prevention and treatment of diseases and clinical conditions associated with PLAC1.

PNPLA1 (Accession NP_775947.1) is another GAM3298 target gene, herein designated TARGET GENE. PNPLA1 BINDING SITE is a target binding site found in the 3' untranslated region of mRNA encoded by PNPLA1, corresponding to a target binding site such as BINDING SITE I, BINDING SITE II or BINDING SITE III of FIG. 8. Table 4 illustrates the complementarity of the nucleotide sequences of PNPLA1 BINDING SITE, designated SEQ ID:3706, to the nucleotide sequence of GAM3298 RNA, herein designated GAM RNA, also designated SEQ ID:259.

Another function of GAM3298 is therefore inhibition of PNPLA1 (Accession NP_775947.1). Accordingly, utilities of GAM3298 include diagnosis, prevention and treatment of diseases and clinical conditions associated with PNPLA1.

Protein o-fucosyltransferase 1 (POFUT1, Accession NP_056167.1) is another GAM3298 target gene, herein designated TARGET GENE. POFUT1 BINDING SITE1 and POFUT1 BINDING SITE2 are target binding sites found in untranslated regions of multiple transcripts of mRNA encoded by POFUT1, corresponding to target binding sites such as BINDING SITE I, BINDING SITE II or BINDING SITE III of FIG. 8. Table 4 illustrates the complementarity of the nucleotide sequences of POFUT1 BINDING SITE1 and POFUT1 BINDING SITE2, designated SEQ ID:8174 and SEQ ID:6456 respectively, to the nucleotide sequence of GAM3298 RNA, herein designated GAM RNA, also designated SEQ ID:259.

Another function of GAM3298 is therefore inhibition of Protein o-fucosyltransferase 1 (POFUT1, Accession NP_056167.1) . Accordingly, utilities of GAM3298 include diagnosis, prevention and treatment of diseases and clinical conditions associated with POFUT1.

Polymerase (dna directed), eta (POLH, Accession NP_006493.1) is another GAM3298 target gene, herein designated TARGET GENE. POLH BINDING SITE is a target binding site found in the 3' untranslated region of mRNA encoded by POLH, corresponding to a target binding site such as BINDING SITE I, BINDING SITE II or BINDING SITE III of FIG. 8. Table 4 illustrates the complementarity of the nucleotide sequences of POLH BINDING SITE, designated SEQ ID:11747, to the nucleotide sequence of GAM3298 RNA, herein designated GAM RNA, also designated SEQ ID:259.

Another function of GAM3298 is therefore inhibition of Polymerase (dna directed), eta (POLH, Accession NP_006493.1). Accordingly, utilities of GAM3298 include diagnosis, prevention and treatment of diseases and clinical conditions associated with POLH.

PORIMIN (Accession NP_443164.1) is another GAM3298 target gene, herein designated TARGET GENE. PORIMIN BINDING SITE is a target binding site found in the 3' untranslated region of mRNA encoded by PORIMIN, corresponding to a target binding site such as BINDING SITE I, BINDING SITE II or BINDING SITE III of FIG. 8. Table 4 illustrates the complementarity of the nucleotide sequences of PORIMIN BINDING SITE, designated SEQ ID:5738, to the nucleotide sequence of GAM3298 RNA, herein designated GAM RNA, also designated SEQ ID:259.

Another function of GAM3298 is therefore inhibition of PORIMIN (Accession NP_443164.1). Accordingly, utilities of GAM3298 include diagnosis, prevention and treatment of diseases and clinical conditions associated with PORIMIN.

Pyrophosphatase (inorganic) (PP, Accession NP_066952.1) is another GAM3298 target gene, herein designated TARGET GENE. PP BINDING SITE is a target binding site found in the 5' untranslated region of mRNA encoded by PP, corresponding to a target binding site such as BINDING SITE I, BINDING SITE II or BINDING SITE III of FIG. 8. Table 4 illustrates the complementarity of the nucleotide sequences of PP BINDING SITE, designated SEQ ID:5885, to the nucleotide sequence of GAM3298 RNA, herein designated GAM RNA, also designated SEQ ID:259.

Another function of GAM3298 is therefore inhibition of Pyrophosphatase (inorganic) (PP, Accession NP_066952.1). Accordingly, utilities of GAM3298 include diagnosis, prevention and treatment of diseases and clinical conditions associated with PP.

Protein phosphatase 1, regulatory (inhibitor) subunit 3b (PPP1R3B, Accession NP_078883.1) is another GAM3298 target gene, herein designated TARGET GENE. PPP1R3B BINDING SITE is a target binding site found in the 3' untranslated region of mRNA encoded by PPP1R3B, corresponding to a target binding site such as BINDING SITE I, BINDING SITE II or BINDING SITE III of FIG. 8. Table 4 illustrates the complementarity of the nucleotide sequences of PPP1R3B BINDING SITE, designated SEQ ID:19238, to the nucleotide sequence of GAM3298 RNA, herein designated GAM RNA, also designated SEQ ID:259.

Another function of GAM3298 is therefore inhibition of Protein phosphatase 1, regulatory (inhibitor) subunit 3b (PPP1R3B, Accession NP_078883.1). Accordingly, utilities of GAM3298 include diagnosis, prevention and treatment of diseases and clinical conditions associated with PPP1R3B.

Protein phosphatase 6, catalytic subunit (PPP6C, Accession NP_002712.1) is another GAM3298 target gene, herein designated TARGET GENE. PPP6C BINDING SITE is a target binding site found in the 3' untranslated region of mRNA encoded by PPP6C, corresponding to a target binding site such as BINDING SITE I, BINDING SITE II or BINDING SITE III of FIG. 8. Table 4 illustrates the complementarity of the nucleotide sequences of PPP6C BINDING SITE, designated SEQ ID:17178, to the nucleotide sequence of GAM3298 RNA, herein designated GAM RNA, also designated SEQ ID:259.

Another function of GAM3298 is therefore inhibition of Protein phosphatase 6, catalytic subunit (PPP6C, Accession NP_002712.1), a gene which is the catalytic subunit of protein phosphatase 6 which may function in cell cycle regulation. Accordingly, utilities of GAM3298 include diagnosis, prevention and treatment of diseases and clinical conditions associated with PPP6C.

The function of PPP6C and its association with various diseases and clinical conditions, has been established by previous studies, as described hereinabove with reference to GAM287.2. Protein kinase, y-linked (PRKY, Accession NP_002751.1) is another GAM3298 target gene, herein designated TARGET GENE. PRKY BINDING SITE is a target binding site found in the 3' untranslated region of mRNA encoded by PRKY, corresponding to a target binding site such as BINDING SITE I, BINDING SITE II or BINDING SITE III of FIG. 8. Table 4 illustrates the complementarity of the nucleotide sequences of PRKY BINDING SITE, designated SEQ ID:9486, to the nucleotide sequence of GAM3298 RNA, herein designated GAM RNA, also designated SEQ ID:259.

Another function of GAM3298 is therefore inhibition of Protein kinase, y-linked (PRKY, Accession NP_002751.1), a gene which is a putative protein kinase. Accordingly, utilities of GAM3298 include diagnosis, prevention and treatment of diseases and clinical conditions associated with PRKY.

The function of PRKY and its association with various diseases and clinical conditions, has been established by previous studies, as described hereinabove with reference to GAM72.1. PRO0478 (Accession NP_054848.1) is another GAM3298 target gene, herein designated TARGET GENE. PRO0478 BINDING SITE is a target binding site found in the 3' untranslated region of mRNA encoded by PRO0478, corresponding to a target binding site such as BINDING SITE I, BINDING SITE II or BINDING SITE III of FIG. 8. Table 4 illustrates the complementarity of the nucleotide sequences of PRO0478 BINDING SITE, designated SEQ ID:3706, to the nucleotide sequence of GAM3298 RNA, herein designated GAM RNA, also designated SEQ ID:259.

Another function of GAM3298 is therefore inhibition of PRO0478 (Accession NP_054848.1). Accordingly, utilities of GAM3298 include diagnosis, prevention and treatment of diseases and clinical conditions associated with PRO0478.

PRO1496 (Accession NP_061073.1) is another GAM3298 target gene, herein designated TARGET GENE. PRO1496 BINDING SITE is a target binding site found in the 3' untranslated region of mRNA encoded by PRO1496, corresponding to a target binding site such as BINDING SITE I, BINDING SITE II or BINDING SITE III of FIG. 8. Table 4 illustrates the complementarity of the nucleotide sequences of PRO1496 BINDING SITE, designated SEQ ID:16693, to the nucleotide sequence of GAM3298 RNA, herein designated GAM RNA, also designated SEQ ID:259.

Another function of GAM3298 is therefore inhibition of PRO1496 (Accession NP_061073.1). Accordingly, utilities of GAM3298 include diagnosis, prevention and treatment of diseases and clinical conditions associated with PRO1496.

PRO1853 (Accession NP_061077.1) is another GAM3298 target gene, herein designated TARGET GENE. PRO1853 BINDING SITE is a target binding site found in the 3' untranslated region of multiple transcripts of mRNA encoded by PRO1853, corresponding to a target binding site such as BINDING SITE I, BINDING SITE II or BINDING SITE III of FIG. 8. Table 4 illustrates the complementarity of the nucleotide sequences of PRO1853 BINDING SITE, designated SEQ ID:3706, to the nucleotide sequence of GAM3298 RNA, herein designated GAM RNA, also designated SEQ ID:259.

Another function of GAM3298 is therefore inhibition of PRO1853 (Accession NP_061077.1). Accordingly, utilities of GAM3298 include diagnosis, prevention and treatment of diseases and clinical conditions associated with PRO1853.

PRO2859 (Accession NP_061013.1) is another GAM3298 target gene, herein designated TARGET GENE. PRO2859 BINDING SITE is a target binding site found in the 3' untranslated region of mRNA encoded by PRO2859, corresponding to a target binding site such as BINDING SITE I, BINDING SITE II or BINDING SITE III of FIG. 8. Table 4 illustrates the complementarity of the nucleotide sequences of PRO2859 BINDING SITE, designated SEQ ID:3706, to the nucleotide sequence of GAM3298 RNA, herein designated GAM RNA, also designated SEQ ID:259.

Another function of GAM3298 is therefore inhibition of PRO2859 (Accession NP_061013.1). Accordingly, utilities of GAM3298 include diagnosis, prevention and treatment of diseases and clinical conditions associated with PRO2859.

PRO2949 (Accession NP_061014.1) is another GAM3298 target gene, herein designated TARGET GENE. PRO2949 BINDING SITE is a target binding site found in the 3' untranslated region of mRNA encoded by PRO2949, corresponding to a target binding site such as BINDING SITE I, BINDING SITE II or BINDING SITE III of FIG. 8. Table 4 illustrates the complementarity of the nucleotide sequences of PRO2949 BINDING SITE, designated SEQ ID:3706, to the nucleotide sequence of GAM3298 RNA, herein designated GAM RNA, also designated SEQ ID:259.

Another function of GAM3298 is therefore inhibition of PRO2949 (Accession NP_061014.1). Accordingly, utilities of GAM3298 include diagnosis, prevention and treatment of diseases and clinical conditions associated with PRO2949.

Presenilin 1 (alzheimer disease 3) (PSEN1, Accession NP_015557.1) is another GAM3298 target gene, herein designated TARGET GENE. PSEN1 BINDING SITE is a target binding site found in the 3' untranslated region of multiple transcripts of mRNA encoded by PSEN1, corresponding to a target binding site such as BINDING SITE I, BINDING SITE II or BINDING SITE III of FIG. 8. Table 4 illustrates the complementarity of the nucleotide sequences of PSEN1 BINDING SITE, designated SEQ ID:8810, to the nucleotide sequence of GAM3298 RNA, herein designated GAM RNA, also designated SEQ ID:259.

Another function of GAM3298 is therefore inhibition of Presenilin 1 (alzheimer disease 3) (PSEN1, Accession NP_015557.1) . Accordingly, utilities of GAM3298 include diagnosis, prevention and treatment of diseases and clinical conditions associated with PSEN1.

Presenilin 1 (alzheimer disease 3) (PSEN1, Accession NP_000012.1) is another GAM3298 target gene, herein designated TARGET GENE. PSEN1 BINDING SITE is a target binding site found in the 3' untranslated region of multiple transcripts of mRNA encoded by PSEN1, corresponding to a target binding site such as BINDING SITE I, BINDING SITE II or BINDING SITE III of FIG. 8. Table 4 illustrates the complementarity of the nucleotide sequences of PSEN1 BINDING SITE, designated SEQ ID:8810, to the nucleotide sequence of GAM3298 RNA, herein designated GAM RNA, also designated SEQ ID:259.

Another function of GAM3298 is therefore inhibition of Presenilin 1 (alzheimer disease 3) (PSEN1, Accession NP_000012.1) . Accordingly, utilities of GAM3298 include diagnosis, prevention and treatment of diseases and clinical conditions associated with PSEN1.

PSK (Accession NP_057235.1) is another GAM3298 target gene, herein designated TARGET GENE. PSK BINDING SITE is a target binding site found in the 3' untranslated region of mRNA encoded by PSK, corresponding to a target binding site such as BINDING SITE I, BINDING SITE II or BINDING SITE III of FIG. 8. Table 4 illustrates the complementarity of the nucleotide sequences of PSK BINDING SITE, designated SEQ ID:17787, to the nucleotide sequence of GAM3298 RNA, herein designated GAM RNA, also designated SEQ ID:259.

Another function of GAM3298 is therefore inhibition of PSK (Accession NP_057235.1). Accordingly, utilities of GAM3298 include diagnosis, prevention and treatment of diseases and clinical conditions associated with PSK.

Prostaglandin i2 (prostacyclin) synthase (PTGIS, Accession NP_000952.1) is another GAM3298 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:4543, to the nucleotide sequence of GAM3298 RNA, herein designated GAM RNA, also designated SEQ ID:259.

Another function of GAM3298 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM3298 include diagnosis, prevention and treatment of diseases and clinical conditions associated with PTGIS.

The function of PTGIS and its association with various diseases and clinical conditions, has been established by previous studies, as described hereinabove with reference to GAM30.1. Ptk6 protein tyrosine kinase 6 (PTK6, Accession NP_005966.1) is another GAM3298 target gene, herein designated TARGET GENE. PTK6 BINDING SITE is a target binding site found in the 3' untranslated region of mRNA encoded by PTK6, corresponding to a target binding site such as BINDING SITE I, BINDING SITE II or BINDING SITE III of FIG. 8. Table 4 illustrates the complementarity of the nucleotide sequences of PTK6 BINDING SITE, designated SEQ ID:3706, to the nucleotide sequence of GAM3298 RNA, herein designated GAM RNA, also designated SEQ ID:259.

Another function of GAM3298 is therefore inhibition of Ptk6 protein tyrosine kinase 6 (PTK6, Accession NP_005966.1). Accordingly, utilities of GAM3298 include diagnosis, prevention and treatment of diseases and clinical conditions associated with PTK6.

Rab4b, member ras oncogene family (RAB4B, Accession NP_057238.2) is another GAM3298 target gene, herein designated TARGET GENE. RAB4B BINDING SITE is a target binding site found in the 5' untranslated region of mRNA encoded by RAB4B, corresponding to a target binding site such as BINDING SITE I, BINDING SITE II or BINDING SITE III of FIG. 8. Table 4 illustrates the complementarity of the nucleotide sequences of RAB4B BINDING SITE, designated SEQ ID:3706, to the nucleotide sequence of GAM3298 RNA, herein designated GAM RNA, also designated SEQ ID:259.

Another function of GAM3298 is therefore inhibition of Rab4b, member ras oncogene family (RAB4B, Accession NP_057238.2). Accordingly, utilities of GAM3298 include diagnosis, prevention and treatment of diseases and clinical conditions associated with RAB4B.

RABEX5 (Accession NP_055319.1) is another GAM3298 target gene, herein designated TARGET GENE. RABEX5 BINDING SITE is a target binding site found in the 3' untranslated region of mRNA encoded by RABEX5, corresponding to a target binding site such as BINDING SITE I, BINDING SITE II or BINDING SITE III of FIG. 8. Table 4 illustrates the complementarity of the nucleotide sequences of RABEX5 BINDING SITE, designated SEQ ID:6850, to the nucleotide sequence of GAM3298 RNA, herein designated GAM RNA, also designated SEQ ID:259.

Another function of GAM3298 is therefore inhibition of RABEX5 (Accession NP_055319.1). Accordingly, utilities of GAM3298 include diagnosis, prevention and treatment of diseases and clinical conditions associated with RABEX5.

Rad51 homolog (reca homolog, e. coli) (s. cerevisiae) (RAD51, Accession NP_002866.2) is another GAM3298 target gene, herein designated TARGET GENE. RAD51 BINDING SITE is a target binding site found in the 3' untranslated region of multiple transcripts of mRNA encoded by RAD51, corresponding to a target binding site such as BINDING SITE I, BINDING SITE II or BINDING SITE III of FIG. 8. Table 4 illustrates the complementarity of the nucleotide sequences of RAD51 BINDING SITE, designated SEQ ID:16562, to the nucleotide sequence of GAM3298 RNA, herein designated GAM RNA, also designated SEQ ID:259.

Another function of GAM3298 is therefore inhibition of Rad51 homolog (reca homolog, e. coli) (s. cerevisiae) (RAD51, Accession NP_002866.2). Accordingly, utilities of GAM3298 include diagnosis, prevention and treatment of diseases and clinical conditions associated with RAD51.

Rad51 homolog (reca homolog, e. coli) (s. cerevisiae) (RAD51, Accession NP_597994.1) is another GAM3298 target gene, herein designated TARGET GENE. RAD51 BINDING SITE is a target binding site found in the 3' untranslated region of multiple transcripts of mRNA encoded by RAD51, corresponding to a target binding site such as BINDING SITE I, BINDING SITE II or BINDING SITE III of FIG. 8. Table 4 illustrates the complementarity of the nucleotide sequences of RAD51 BINDING SITE, designated SEQ ID:16562, to the nucleotide sequence of GAM3298 RNA, herein designated GAM RNA, also designated SEQ ID:259.

Another function of GAM3298 is therefore inhibition of Rad51 homolog (reca homolog, e. coli) (s. cerevisiae) (RAD51, Accession NP_597994.1). Accordingly, utilities of GAM3298 include diagnosis, prevention and treatment of diseases and clinical conditions associated with RAD51.

RDHL (Accession NP_005762.2) is another GAM3298 target gene, herein designated TARGET GENE. RDHL BINDING SITE is a target binding site found in the 5' untranslated region of mRNA encoded by RDHL, corresponding to a target binding site such as BINDING SITE I, BINDING SITE II or BINDING SITE III of FIG. 8. Table 4 illustrates the complementarity of the nucleotide sequences of RDHL BINDING SITE, designated SEQ ID:3706, to the nucleotide sequence of GAM3298 RNA, herein designated GAM RNA, also designated SEQ ID:259.

Another function of GAM3298 is therefore inhibition of RDHL (Accession NP_005762.2). Accordingly, utilities of GAM3298 include diagnosis, prevention and treatment of diseases and clinical conditions associated with RDHL.

Recq protein-like 5 (RECQL5, Accession NP_004250.1) is another GAM3298 target gene, herein designated TARGET GENE. RECQL5 BINDING SITE is a target binding site found in the 3' untranslated region of mRNA encoded by RECQL5, corresponding to a target binding site such as BINDING SITE I, BINDING SITE II or BINDING SITE III of FIG. 8. Table 4 illustrates the complementarity of the nucleotide sequences of RECQL5 BINDING SITE, designated SEQ ID:2405, to the nucleotide sequence of GAM3298 RNA, herein designated GAM RNA, also designated SEQ ID:259.

Another function of GAM3298 is therefore inhibition of Recq protein-like 5 (RECQL5, Accession NP_004250.1). Accordingly, utilities of GAM3298 include diagnosis, prevention and treatment of diseases and clinical conditions associated with RECQL5.

SCR59 (Accession NP_075559.1) is another GAM3298 target gene, herein designated TARGET GENE. SCR59 BINDING SITE is a target binding site found in the 3' untranslated region of mRNA encoded by SCR59, corresponding to a target binding site such as BINDING SITE I, BINDING SITE II or BINDING SITE III of FIG. 8. Table 4 illustrates the complementarity of the nucleotide sequences of SCR59 BINDING SITE, designated SEQ ID:3706, to the nucleotide sequence of GAM3298 RNA, herein designated GAM RNA, also designated SEQ ID:259.

Another function of GAM3298 is therefore inhibition of SCR59 (Accession NP_075559.1). Accordingly, utilities of GAM3298 include diagnosis, prevention and treatment of diseases and clinical conditions associated with SCR59.

Secreted and transmembrane 1 (SECTM1, Accession NP_002995.1) is another GAM3298 target gene, herein designated TARGET GENE. SECTM1 BINDING SITE is a target binding site found in the 3' untranslated region of mRNA encoded by SECTM1, corresponding to a target binding site such as BINDING SITE I, BINDING SITE II or BINDING SITE III of FIG. 8. Table 4 illustrates the complementarity of the nucleotide sequences of SECTM1 BINDING SITE, designated SEQ ID:18249, to the nucleotide sequence of GAM3298 RNA, herein designated GAM RNA, also designated SEQ ID:259.

Another function of GAM3298 is therefore inhibition of Secreted and transmembrane 1 (SECTM1, Accession NP_002995.1). Accordingly, utilities of GAM3298 include diagnosis, prevention and treatment of diseases and clinical conditions associated with SECTM1.

Small edrk-rich factor 1a (telomeric) (SERF1A, Accession NP_068802.1) is another GAM3298 target gene, herein designated TARGET GENE. SERF1A BINDING SITE is a target binding site found in the 3' untranslated region of mRNA encoded by SERF1A, corresponding to a target binding site such as BINDING SITE I, BINDING SITE II or BINDING SITE III of FIG. 8. Table 4 illustrates the complementarity of the nucleotide sequences of SERF1A BINDING SITE, designated SEQ ID:4210, to the nucleotide sequence of GAM3298 RNA, herein designated GAM RNA, also designated SEQ ID:259.

Another function of GAM3298 is therefore inhibition of Small edrk-rich factor 1a (telomeric) (SERF1A, Accession NP_068802.1). Accordingly, utilities of GAM3298 include diagnosis, prevention and treatment of diseases and clinical conditions associated with SERF1A.

Small edrk-rich factor 1b (centromeric) (SERF1B, Accession NP_075267.1) is another GAM3298 target gene, herein designated TARGET GENE. SERF1B BINDING SITE is a target binding site found in the 3' untranslated region of mRNA encoded by SERF1B, corresponding to a target binding site such as BINDING SITE I, BINDING SITE II or BINDING SITE III of FIG. 8. Table 4 illustrates the complementarity of the nucleotide sequences of SERF1B BINDING SITE, designated SEQ ID:4210, to the nucleotide sequence of GAM3298 RNA, herein designated GAM RNA, also designated SEQ ID:259.

Another function of GAM3298 is therefore inhibition of Small edrk-rich factor 1b (centromeric) (SERF1B, Accession NP_075267.1). Accordingly, utilities of GAM3298 include diagnosis, prevention and treatment of diseases and clinical conditions associated with SERF1B.

Solute carrier family 17 (anion/sugar transporter), member 5 (SLC17A5, Accession NP_036566.1) is another GAM3298 target gene, herein designated TARGET GENE. SLC17A5 BINDING SITE is a target binding site found in the 3' untranslated region of mRNA encoded by SLC17A5, corresponding to a target binding site such as BINDING SITE I, BINDING SITE II or BINDING SITE III of FIG. 8. Table 4 illustrates the complementarity of the nucleotide sequences of SLC17A5 BINDING SITE, designated SEQ ID:3707, to the nucleotide sequence of GAM3298 RNA, herein designated GAM RNA, also designated SEQ ID:259.

Another function of GAM3298 is therefore inhibition of Solute carrier family 17 (anion/sugar transporter), member 5

(SLC17A5, Accession NP_036566.1), a gene which is a member of a family of anion/cation symporters and therefore may be associated with Salla disease ; infantile sialic acid storage disorder. Accordingly, utilities of GAM3298 include diagnosis, prevention and treatment of Salla disease ; infantile sialic acid storage disorder, and of other diseases and clinical conditions associated with SLC17A5.

The function of SLC17A5 and its association with various diseases and clinical conditions, has been established by previous studies, as described hereinabove with reference to GAM347.2. Solute carrier family 26, member 4 (SLC26A4, Accession NP_000432.1) is another GAM3298 target gene, herein designated TARGET GENE. SLC26A4 BINDING SITE is a target binding site found in the 3' untranslated region of mRNA encoded by SLC26A4, corresponding to a target binding site such as BINDING SITE I, BINDING SITE II or BINDING SITE III of FIG. 8. Table 4 illustrates the complementarity of the nucleotide sequences of SLC26A4 BINDING SITE, designated SEQ ID:3706, to the nucleotide sequence of GAM3298 RNA, herein designated GAM RNA, also designated SEQ ID:259.

Another function of GAM3298 is therefore inhibition of Solute carrier family 26, member 4 (SLC26A4, Accession NP_000432.1). Accordingly, utilities of GAM3298 include diagnosis, prevention and treatment of diseases and clinical conditions associated with SLC26A4.

Solute carrier family 31 (copper transporters), member 1 (SLC31A1, Accession NP_001850.1) is another GAM3298 target gene, herein designated TARGET GENE. SLC31A1 BINDING SITE is a target binding site found in the 3' untranslated region of mRNA encoded by SLC31A1, corresponding to a target binding site such as BINDING SITE I, BINDING SITE II or BINDING SITE III of FIG. 8. Table 4 illustrates the complementarity of the nucleotide sequences of SLC31A1 BINDING SITE, designated SEQ ID:912, to the nucleotide sequence of GAM3298 RNA, herein designated GAM RNA, also designated SEQ ID:259.

Another function of GAM3298 is therefore inhibition of Solute carrier family 31 (copper transporters), member 1 (SLC31A1, Accession NP_001850.1), a gene which is involved in high-affinity copper uptake. Accordingly, utilities of GAM3298 include diagnosis, prevention and treatment of diseases and clinical conditions associated with SLC31A1.

The function of SLC31A1 and its association with various diseases and clinical conditions, has been established by previous studies, as described hereinabove with reference to GAM257.1. SLC35E1 (Accession NP_079157.2) is another GAM3298 target gene, herein designated TARGET GENE. SLC35E1 BINDING SITE is a target binding site found in the 3' untranslated region of mRNA encoded by SLC35E1, corresponding to a target binding site such as BINDING SITE I, BINDING SITE II or BINDING SITE III of FIG. 8. Table 4 illustrates the complementarity of the nucleotide sequences of SLC35E1 BINDING SITE, designated SEQ ID:6353, to the nucleotide sequence of GAM3298 RNA, herein designated GAM RNA, also designated SEQ ID:259.

Another function of GAM3298 is therefore inhibition of SLC35E1 (Accession NP_079157.2). Accordingly, utilities of GAM3298 include diagnosis, prevention and treatment of diseases and clinical conditions associated with SLC35E1.

Swi/snf related, matrix associated, actin dependent regulator of chromatin, subfamily d, member 2 (SMARCD2, Accession NP_003068.2) is another GAM3298 target gene, herein designated TARGET GENE. SMARCD2 BINDING SITE is a target binding site found in the 3' untranslated region of mRNA encoded by SMARCD2, corresponding to a target binding site such as BINDING SITE I, BINDING SITE II or BINDING SITE III of FIG. 8. Table 4 illustrates the complementarity of the nucleotide sequences of SMARCD2 BINDING SITE, designated SEQ ID:6099, to the nucleotide sequence of GAM3298 RNA, herein designated GAM RNA, also designated SEQ ID:259.

Another function of GAM3298 is therefore inhibition of Swi/snf related, matrix associated, actin dependent regulator of chromatin, subfamily d, member 2 (SMARCD2, Accession NP_003068.2), a gene which is involved in chromatin remodeling. Accordingly, utilities of GAM3298 include diagnosis, prevention and treatment of diseases and clinical conditions associated with SMARCD2.

The function of SMARCD2 and its association with various diseases and clinical conditions, has been established by previous studies, as described hereinabove with reference to GAM537.1. Syntaphilin (SNPH, Accession NP_055538.1) is another GAM3298 target gene, herein designated TARGET GENE. SNPH BINDING SITE is a target binding site found in the 3' untranslated region of mRNA encoded by SNPH, corresponding to a target binding site such as BINDING SITE I, BINDING SITE II or BINDING SITE III of FIG. 8. Table 4 illustrates the complementarity of the nucleotide sequences of SNPH BINDING SITE, designated SEQ ID:4989, to the nucleotide sequence of GAM3298 RNA, herein designated GAM RNA, also designated SEQ ID:259.

Another function of GAM3298 is therefore inhibition of Syntaphilin (SNPH, Accession NP_055538.1). Accordingly, utilities of GAM3298 include diagnosis, prevention and treatment of diseases and clinical conditions associated with SNPH.

Sorting nexin 11 (SNX11, Accession NP_037455.2) is another GAM3298 target gene, herein designated TARGET GENE. SNX11 BINDING SITE is a target binding site found in the 3' untranslated region of multiple transcripts of mRNA encoded by SNX11, corresponding to a target binding site such as BINDING SITE I, BINDING SITE II or BINDING SITE III of FIG. 8. Table 4 illustrates the complementarity of the nucleotide sequences of SNX11 BINDING SITE, designated SEQ ID:19139, to the nucleotide sequence of GAM3298 RNA, herein designated GAM RNA, also designated SEQ ID:259.

Another function of GAM3298 is therefore inhibition of Sorting nexin 11 (SNX11, Accession NP_037455.2). Accordingly, utilities of GAM3298 include diagnosis, prevention and treatment of diseases and clinical conditions associated with SNX11.

Sorting nexin 11 (SNX11, Accession NP_689450.1) is another GAM3298 target gene, herein designated TARGET GENE. SNX11 BINDING SITE is a target binding site found in the 3' untranslated region of multiple transcripts of mRNA encoded by SNX11, corresponding to a target binding site such as BINDING SITE I, BINDING SITE II or BINDING SITE III of FIG. 8. Table 4 illustrates the complementarity of the nucleotide sequences of SNX11 BINDING SITE, designated SEQ ID:19139, to the nucleotide sequence of GAM3298 RNA, herein designated GAM RNA, also designated SEQ ID:259.

Another function of GAM3298 is therefore inhibition of Sorting nexin 11 (SNX11, Accession NP_689450.1). Accordingly, utilities of GAM3298 include diagnosis, prevention and treatment of diseases and clinical conditions associated with SNX11.

SNX22 (Accession NP_079074.1) is another GAM3298 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:8175, to the nucleotide sequence of GAM3298 RNA, herein designated GAM RNA, also designated SEQ ID:259.

Another function of GAM3298 is therefore inhibition of SNX22 (Accession NP_079074.1). Accordingly, utilities of GAM3298 include diagnosis, prevention and treatment of diseases and clinical conditions associated with SNX22.

SNX25 (Accession NP_114159.1) is another GAM3298 target gene, herein designated TARGET GENE. SNX25 BINDING SITE is a target binding site found in the 5' untranslated region of mRNA encoded by SNX25, corresponding to a target binding site such as BINDING SITE I, BINDING SITE II or BINDING SITE III of FIG. 8. Table 4 illustrates the complementarity of the nucleotide sequences of SNX25 BINDING SITE, designated SEQ ID:11908, to the nucleotide sequence of GAM3298 RNA, herein designated GAM RNA, also designated SEQ ID:259.

Another function of GAM3298 is therefore inhibition of SNX25 (Accession NP_114159.1). Accordingly, utilities of GAM3298 include diagnosis, prevention and treatment of diseases and clinical conditions associated with SNX25.

Serine palmitoyltransferase, long chain base subunit 1 (SPTLC1, Accession NP_847894.1) is another GAM3298 target gene, herein designated TARGET GENE. SPTLC1 BINDING SITE is a target binding site found in the 3' untranslated region of multiple transcripts of mRNA encoded by SPTLC1, corresponding to a target binding site such as BINDING SITE I, BINDING SITE II or BINDING SITE III of FIG. 8. Table 4 illustrates the complementarity of the nucleotide sequences of SPTLC1 BINDING SITE, designated SEQ ID:478, to the nucleotide sequence of GAM3298 RNA, herein designated GAM RNA, also designated SEQ ID:259.

Another function of GAM3298 is therefore inhibition of Serine palmitoyltransferase, long chain base subunit 1 (SPTLC1, Accession NP_847894.1). Accordingly, utilities of GAM3298 include diagnosis, prevention and treatment of diseases and clinical conditions associated with SPTLC1.

Staufen, rna binding protein (drosophila) (STAU, Accession NP_059347.1) is another GAM3298 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:17501, to the nucleotide sequence of GAM3298 RNA, herein designated GAM RNA, also designated SEQ ID:259.

Another function of GAM3298 is therefore inhibition of Staufen, rna binding protein (drosophila) (STAU, Accession NP_059347.1), a gene which may play a role in specific positioning of mrnas at given sites in the cell and in stimulating their translation at the site. Accordingly, utilities of GAM3298 include diagnosis, prevention and treatment of diseases and clinical conditions associated with STAU.

The function of STAU and its association with various diseases and clinical conditions, has been established by previous studies, as described hereinabove with reference to GAM37.1. Synaptojanin 2 binding protein (SYNJ2BP, Accession NP_060843.1) is another GAM3298 target gene, herein designated TARGET GENE. SYNJ2BP BINDING SITE is a target binding site found in the 3' untranslated region of mRNA encoded by SYNJ2BP, corresponding to a target binding site such as BINDING SITE I, BINDING SITE II or BINDING SITE III of FIG. 8. Table 4 illustrates the complementarity of the nucleotide sequences of SYNJ2BP BINDING SITE, designated SEQ ID:666, to the nucleotide sequence of GAM3298 RNA, herein designated GAM RNA, also designated SEQ ID:259.

Another function of GAM3298 is therefore inhibition of Synaptojanin 2 binding protein (SYNJ2BP, Accession NP_060843.1). Accordingly, utilities of GAM3298 include diagnosis, prevention and treatment of diseases and clinical conditions associated with SYNJ2BP.

TEM7 (Accession NP_065138.2) is another GAM3298 target gene, herein designated TARGET GENE. TEM7 BINDING SITE is a target binding site found in the 3' untranslated region of mRNA encoded by TEM7, corresponding to a target binding site such as BINDING SITE I, BINDING SITE II or BINDING SITE III of FIG. 8. Table 4 illustrates the complementarity of the nucleotide sequences of TEM7 BINDING SITE, designated SEQ ID:14878, to the nucleotide sequence of GAM3298 RNA, herein designated GAM RNA, also designated SEQ ID:259.

Another function of GAM3298 is therefore inhibition of TEM7 (Accession NP_065138.2), a gene which involves in angiogenesis and therefore may be associated with Colorectal cancer. Accordingly, utilities of GAM3298 include diagnosis, prevention and treatment of Colorectal cancer, and of other diseases and clinical conditions associated with TEM7.

The function of TEM7 and its association with various diseases and clinical conditions, has been established by previous studies, as described hereinabove with reference to GAM63.1. Testis expressed sequence 15 (TEX15, Accession NP_112561.1) is another GAM3298 target gene, herein designated TARGET GENE. TEX15 BINDING SITE is a target binding site found in the 3' untranslated region of mRNA encoded by TEX15, corresponding to a target binding site such as BINDING SITE I, BINDING SITE II or BINDING SITE III of FIG. 8. Table 4 illustrates the complementarity of the nucleotide sequences of TEX15 BINDING SITE, designated SEQ ID:18387, to the nucleotide sequence of GAM3298 RNA, herein designated GAM RNA, also designated SEQ ID:259.

Another function of GAM3298 is therefore inhibition of Testis expressed sequence 15 (TEX15, Accession NP_112561.1). Accordingly, utilities of GAM3298 include diagnosis, prevention and treatment of diseases and clinical conditions associated with TEX15.

TMG4 (Accession NP_076986.1) is another GAM3298 target gene, herein designated TARGET GENE. TMG4 BINDING SITE is a target binding site found in the 3' untranslated region of mRNA encoded by TMG4, corresponding to a target binding site such as BINDING SITE I, BINDING SITE II or BINDING SITE III of FIG. 8. Table 4 illustrates the complementarity of the nucleotide sequences of TMG4 BINDING SITE, designated SEQ ID:3706, to the nucleotide sequence of GAM3298 RNA, herein designated GAM RNA, also designated SEQ ID:259.

Another function of GAM3298 is therefore inhibition of TMG4 (Accession NP_076986.1). Accordingly, utilities of GAM3298 include diagnosis, prevention and treatment of diseases and clinical conditions associated with TMG4.

Tumor necrosis factor receptor superfamily, member 10a (TNFRSF10A, Accession NP_003835.2) is another GAM3298 target gene, herein designated TARGET GENE. TNFRSF10A BINDING SITE is a target binding site found in the 3' untranslated region of mRNA encoded by TNFRSF10A, corresponding to a target binding site such as BINDING SITE I, BINDING SITE II or BINDING SITE III of FIG. 8. Table 4 illustrates the complementarity of the nucleotide sequences of TNFRSF10A BINDING SITE, designated SEQ ID:3706, to the nucleotide sequence of GAM3298 RNA, herein designated GAM RNA, also designated SEQ ID:259.

Another function of GAM3298 is therefore inhibition of Tumor necrosis factor receptor superfamily, member 10a (TNFRSF10A, Accession NP_003835.2), a gene which is a member of the tumor necrosis factor receptor superfamily; involved in apoptosis; contains a cytoplasmic death domain. Accordingly, utilities of GAM3298 include diagnosis, prevention and treatment of diseases and clinical conditions associated with TNFRSF10A.

The function of TNFRSF10A and its association with various diseases and clinical conditions, has been established by previous studies, as described hereinabove with reference to GAM236.1. Tumor necrosis factor receptor superfamily, member 10d, decoy with truncated death domain (TNFRSF10D, Accession NP_003831.2) is another GAM3298 target gene, herein designated TARGET GENE. TNFRSF10D BINDING SITE is a target binding site found in the 3' untranslated region of mRNA encoded by TNFRSF10D, corresponding to a target binding site such as BINDING SITE I, BINDING SITE II or BINDING SITE III of FIG. 8. Table 4 illustrates the complementarity of the nucleotide sequences of TNFRSF10D BINDING SITE, designated SEQ ID:20093, to the nucleotide sequence of GAM3298 RNA, herein designated GAM RNA, also designated SEQ ID:259.

Another function of GAM3298 is therefore inhibition of Tumor necrosis factor receptor superfamily, member 10d, decoy with truncated death domain (TNFRSF10D, Accession NP_003831.2), a gene which activates NF-kappaB and inhibits TRAIL-induced apoptosis. Accordingly, utilities of GAM3298 include diagnosis, prevention and treatment of diseases and clinical conditions associated with TNFRSF10D.

The function of TNFRSF10D and its association with various diseases and clinical conditions, has been established by previous studies, as described hereinabove with reference to GAM236.1. TOPK (Accession NP_060962.2) is another GAM3298 target gene, herein designated TARGET GENE. TOPK BINDING SITE is a target binding site found in the 3' untranslated region of mRNA encoded by TOPK, corresponding to a target binding site such as BINDING SITE I, BINDING SITE II or BINDING SITE III of FIG. 8. Table 4 illustrates the complementarity of the nucleotide sequences of TOPK BINDING SITE, designated SEQ ID:4288, to the nucleotide sequence of GAM3298 RNA, herein designated GAM RNA, also designated SEQ ID:259.

Another function of GAM3298 is therefore inhibition of TOPK (Accession NP_060962.2). Accordingly, utilities of GAM3298 include diagnosis, prevention and treatment of diseases and clinical conditions associated with TOPK.

Tripartite motif-containing 8 (TRIM8, Accession NP_112174.1) is another GAM3298 target gene, herein designated TARGET GENE. TRIM8 BINDING SITE is a target binding site found in the 3' untranslated region of mRNA encoded by TRIM8, corresponding to a target binding site such as BINDING SITE I, BINDING SITE II or BINDING SITE III of FIG. 8. Table 4 illustrates the complementarity of the nucleotide sequences of TRIM8 BINDING SITE, designated SEQ ID:16708, to the nucleotide sequence of GAM3298 RNA, herein designated GAM RNA, also designated SEQ ID:259.

Another function of GAM3298 is therefore inhibition of Tripartite motif-containing 8 (TRIM8, Accession NP_112174.1). Accordingly, utilities of GAM3298 include diagnosis, prevention and treatment of diseases and clinical conditions associated with TRIM8.

Transient receptor potential cation channel, subfamily m, member 1 (TRPM1, Accession NP_002411.2) is another GAM3298 target gene, herein designated TARGET GENE. TRPM1 BINDING SITE is a target binding site found in the 3' untranslated region of mRNA encoded by TRPM1, corresponding to a target binding site such as BINDING SITE I, BINDING SITE II or BINDING SITE III of FIG. 8. Table 4 illustrates the complementarity of the nucleotide sequences of TRPM1 BINDING SITE, designated SEQ ID:840, to the nucleotide sequence of GAM3298 RNA, herein designated GAM RNA, also designated SEQ ID:259.

Another function of GAM3298 is therefore inhibition of Transient receptor potential cation channel, subfamily m, member 1 (TRPM1, Accession NP_002411.2), a gene which is suggested to mediate calcium entry. Accordingly, utilities of GAM3298 include diagnosis, prevention and treatment of diseases and clinical conditions associated with TRPM1.

The function of TRPM1 and its association with various diseases and clinical conditions, has been established by previous studies, as described hereinabove with reference to GAM94.1. Thioredoxin-like 2 (TXNL2, Accession NP_006532.1) is another GAM3298 target gene, herein designated TARGET GENE. TXNL2 BINDING SITE is a target binding site found in the 3' untranslated region of mRNA encoded by TXNL2, corresponding to a target binding site such as BINDING SITE I, BINDING SITE II or BINDING SITE III of FIG. 8. Table 4 illustrates the complementarity of the nucleotide sequences of TXNL2 BINDING SITE, designated SEQ ID:16694, to the nucleotide sequence of GAM3298 RNA, herein designated GAM RNA, also designated SEQ ID:259.

Another function of GAM3298 is therefore inhibition of Thioredoxin-like 2 (TXNL2, Accession NP_006532.1). Accordingly, utilities of GAM3298 include diagnosis, prevention and treatment of diseases and clinical conditions associated with TXNL2.

Uroplakin 1b (UPK1B, Accession NP_008883.1) is another GAM3298 target gene, herein designated TARGET GENE. UPK1B BINDING SITE is a target binding site found in the 3' untranslated region of mRNA encoded by UPK1B, corresponding to a target binding site such as BINDING SITE I, BINDING SITE II or BINDING SITE III of FIG. 8. Table 4 illustrates the complementarity of the nucleotide sequences of UPK1B BINDING SITE, designated SEQ ID:3706, to the nucleotide sequence of GAM3298 RNA, herein designated GAM RNA, also designated SEQ ID:259.

Another function of GAM3298 is therefore inhibition of Uroplakin 1b (UPK1B, Accession NP_008883.1), a gene which strengthens and stabilizes the urothelial apical surface of the asymmetric unit membrane of mammalian bladder epithelium. Accordingly, utilities of GAM3298 include diagnosis, prevention and treatment of diseases and clinical conditions associated with UPK1B.

The function of UPK1B and its association with various diseases and clinical conditions, has been established by previous studies, as described hereinabove with reference to GAM223.1. Von hippel-lindau syndrome (VHL, Accession NP_000542.1) is another GAM3298 target gene, herein designated TARGET GENE. VHL BINDING SITE is a target binding site found in the 3' untranslated region of mRNA encoded by VHL, corresponding to a target binding site such as BINDING SITE I, BINDING SITE II or BINDING SITE III of FIG. 8. Table 4 illustrates the complementarity of the nucleotide sequences of VHL BINDING SITE, designated SEQ ID:3706, to the nucleotide sequence of GAM3298 RNA, herein designated GAM RNA, also designated SEQ ID:259.

Another function of GAM3298 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM3298 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. Vacuolar protein sorting 4b (yeast) (VPS4B, Accession NP_004860.2) is another GAM3298 target gene, herein designated TARGET GENE. VPS4B BINDING SITE is a target binding site found in the 3' untranslated region of mRNA encoded by VPS4B, corresponding to a target binding site such as BINDING SITE I, BINDING SITE II or BINDING SITE III of FIG. 8. Table 4 illustrates the complementarity of the nucleotide sequences of VPS4B BINDING SITE, designated SEQ ID:19238, to the nucleotide sequence of GAM3298 RNA, herein designated GAM RNA, also designated SEQ ID:259.

Another function of GAM3298 is therefore inhibition of Vacuolar protein sorting 4b (yeast) (VPS4B, Accession NP_004860.2). Accordingly, utilities of GAM3298 include diagnosis, prevention and treatment of diseases and clinical conditions associated with VPS4B.

Williams beuren syndrome chromosome region 21 (WBSCR21, Accession NP_683710.1) is another GAM3298 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:6665, to the nucleotide sequence of GAM3298 RNA, herein designated GAM RNA, also designated SEQ ID:259.

Another function of GAM3298 is therefore inhibition of Williams beuren syndrome chromosome region 21 (WBSCR21, Accession NP_683710.1). Accordingly, utilities of GAM3298 include diagnosis, prevention and treatment of diseases and clinical conditions associated with WBSCR21.

Williams beuren syndrome chromosome region 21 (WBSCR21, Accession NP_683711.1) is another GAM3298 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:6665, to the nucleotide sequence of GAM3298 RNA, herein designated GAM RNA, also designated SEQ ID:259.

Another function of GAM3298 is therefore inhibition of Williams beuren syndrome chromosome region 21 (WBSCR21, Accession NP_683711.1). Accordingly, utilities of GAM3298 include diagnosis, prevention and treatment of diseases and clinical conditions associated with WBSCR21.

Williams beuren syndrome chromosome region 21 (WBSCR21, Accession NP_112585.2) is another GAM3298 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:6665, to the nucleotide sequence of GAM3298 RNA, herein designated GAM RNA, also designated SEQ ID:259.

Another function of GAM3298 is therefore inhibition of Williams beuren syndrome chromosome region 21 (WBSCR21, Accession NP_112585.2). Accordingly, utilities of GAM3298 include diagnosis, prevention and treatment of diseases and clinical conditions associated with WBSCR21.

Williams beuren syndrome chromosome region 21 (WBSCR21, Accession NP_683713.1) is another GAM3298 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:6665, to the nucleotide sequence of GAM3298 RNA, herein designated GAM RNA, also designated SEQ ID:259.

Another function of GAM3298 is therefore inhibition of Williams beuren syndrome chromosome region 21 (WBSCR21, Accession NP_683713.1). Accordingly, utilities of GAM3298 include diagnosis, prevention and treatment of diseases and clinical conditions associated with WBSCR21.

WDR23 (Accession NP_079506.3) is another GAM3298 target gene, herein designated TARGET GENE. WDR23 BINDING SITE is a target binding site found in the 3' untranslated region of multiple transcripts of mRNA encoded by WDR23, corresponding to a target binding site such as BINDING SITE I, BINDING SITE II or BINDING SITE III of FIG. 8. Table 4 illustrates the complementarity of the nucleotide sequences of WDR23 BINDING SITE, designated SEQ ID:1087, to the nucleotide sequence of GAM3298 RNA, herein designated GAM RNA, also designated SEQ ID:259.

Another function of GAM3298 is therefore inhibition of WDR23 (Accession NP_079506.3). Accordingly, utilities of GAM3298 include diagnosis, prevention and treatment of diseases and clinical conditions associated with WDR23.

WDR23 (Accession NP_852002.1) is another GAM3298 target gene, herein designated TARGET GENE. WDR23 BINDING SITE is a target binding site found in the 3' untranslated region of multiple transcripts of mRNA encoded by WDR23, corresponding to a target binding site such as BINDING SITE I, BINDING SITE II or BINDING SITE III of FIG. 8. Table 4 illustrates the complementarity of the nucleotide sequences of WDR23 BINDING SITE, designated SEQ ID:1087, to the nucleotide sequence of GAM3298 RNA, herein designated GAM RNA, also designated SEQ ID:259.

Another function of GAM3298 is therefore inhibition of WDR23 (Accession NP_852002.1). Accordingly, utilities of GAM3298 include diagnosis, prevention and treatment of diseases and clinical conditions associated with WDR23.

Wee1 homolog (s. pombe) (WEE1, Accession NP_003381.1) is another GAM3298 target gene, herein designated TARGET GENE. WEE1 BINDING SITE is a target binding site found in the 3' untranslated region of mRNA encoded by WEE1, corresponding to a target binding site such as BINDING SITE I, BINDING SITE II or BINDING SITE III of FIG. 8. Table 4 illustrates the complementarity of the nucleotide sequences of WEE1 BINDING SITE, designated SEQ ID:5763, to the nucleotide sequence of GAM3298 RNA, herein designated GAM RNA, also designated SEQ ID:259.

Another function of GAM3298 is therefore inhibition of Wee1 homolog (s. pombe) (WEE1, Accession NP_003381.1), a gene which negatively regulates entry into mitosis by catalyzing the inhibitory tyrosine phosphorylation of CDC2/cyclin. Accordingly, utilities of GAM3298 include diagnosis, prevention and treatment of diseases and clinical conditions associated with WEE1.

The function of WEE1 and its association with various diseases and clinical conditions, has been established by previous studies, as described hereinabove with reference to GAM322.1. X-ray repair complementing defective repair in chinese hamster cells 2 (XRCC2, Accession NP_005422.1) is another GAM3298 target gene, herein designated TARGET GENE. XRCC2 BINDING SITE is a target binding site found in the 3' untranslated region of mRNA encoded by XRCC2, corresponding to a target binding site such as BINDING SITE I, BINDING SITE II or BINDING SITE III of FIG. 8. Table 4 illustrates the complementarity of the nucleotide sequences of XRCC2 BINDING SITE, designated SEQ ID:2322, to the nucleotide sequence of GAM3298 RNA, herein designated GAM RNA, also designated SEQ ID:259.

Another function of GAM3298 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM3298 include diagnosis, prevention and treatment of diseases and clinical conditions associated with XRCC2.

The function of XRCC2 and its association with various diseases and clinical conditions, has been established by previous studies, as described hereinabove with reference to GAM72.1. ZFP30 (Accession NP_055713.1) is another GAM3298 target gene, herein designated TARGET GENE. ZFP30 BINDING SITE is a target binding site found in the 3' untranslated region of mRNA encoded by ZFP30, corresponding to a target binding site such as BINDING SITE I, BINDING SITE II or BINDING SITE III of FIG. 8. Table 4 illustrates the complementarity of the nucleotide sequences of ZFP30 BINDING SITE, designated SEQ ID:1921, to the nucleotide sequence of GAM3298 RNA, herein designated GAM RNA, also designated SEQ ID:259.

Another function of GAM3298 is therefore inhibition of ZFP30 (Accession NP_055713.1). Accordingly, utilities of GAM3298 include diagnosis, prevention and treatment of diseases and clinical conditions associated with ZFP30.

Zinc finger protein 174 (ZNF174, Accession NP_003441.1) is another GAM3298 target gene, herein designated TARGET GENE. ZNF174 BINDING SITE is a target binding site found in the 5' untranslated region of mRNA encoded by ZNF174, corresponding to a target binding site such as BINDING SITE I, BINDING SITE II or BINDING SITE III of FIG. 8. Table 4 illustrates the complementarity of the nucleotide sequences of ZNF174 BINDING SITE, designated SEQ ID:7167, to the nucleotide sequence of GAM3298 RNA, herein designated GAM RNA, also designated SEQ ID:259.

Another function of GAM3298 is therefore inhibition of Zinc finger protein 174 (ZNF174, Accession NP_003441.1). Accordingly, utilities of GAM3298 include diagnosis, prevention and treatment of diseases and clinical conditions associated with ZNF174.

Zinc finger protein 197 (ZNF197, Accession NP_008922.1) is another GAM3298 target gene, herein designated TARGET GENE. ZNF197 BINDING SITE is a target binding site found in the 3' untranslated region of mRNA encoded by ZNF197, corresponding to a target binding site such as BINDING SITE I, BINDING SITE II or BINDING SITE III of FIG. 8. Table 4 illustrates the complementarity of the nucleotide sequences of ZNF197 BINDING SITE, designated SEQ ID:12246, to the nucleotide sequence of GAM3298 RNA, herein designated GAM RNA, also designated SEQ ID:259.

Another function of GAM3298 is therefore inhibition of Zinc finger protein 197 (ZNF197, Accession NP_008922.1). Accordingly, utilities of GAM3298 include diagnosis, prevention and treatment of diseases and clinical conditions associated with ZNF197.

Zinc finger protein 264 (ZNF264, Accession NP_003408.1) is another GAM3298 target gene, herein designated TARGET GENE. ZNF264 BINDING SITE is a target binding site found in the 3' untranslated region of mRNA encoded by ZNF264, corresponding to a target binding site such as BINDING SITE I, BINDING SITE II or BINDING SITE III of FIG. 8. Table 4 illustrates the complementarity of the nucleotide sequences of ZNF264 BINDING SITE, designated SEQ ID:8644, to the nucleotide sequence of GAM3298 RNA, herein designated GAM RNA, also designated SEQ ID:259.

Another function of GAM3298 is therefore inhibition of Zinc finger protein 264 (ZNF264, Accession NP_003408.1). Accordingly, utilities of GAM3298 include diagnosis, prevention and treatment of diseases and clinical conditions associated with ZNF264.

ZNF450 (Accession NP_055612.1) is another GAM3298 target gene, herein designated TARGET GENE. ZNF450 BINDING SITE is a target binding site found in the 3' untranslated region of mRNA encoded by ZNF450, corresponding to a target binding site such as BINDING SITE I, BINDING SITE II or BINDING SITE III of FIG. 8. Table 4 illustrates the complementarity of the nucleotide sequences of ZNF450 BINDING SITE, designated SEQ ID:3706, to the nucleotide sequence of GAM3298 RNA, herein designated GAM RNA, also designated SEQ ID:259.

Another function of GAM3298 is therefore inhibition of ZNF450 (Accession NP_055612.1). Accordingly, utilities of GAM3298 include diagnosis, prevention and treatment of diseases and clinical conditions associated with ZNF450.

FIG. 8 further provides a conceptual description of a novel bioinformatically detected of the present invention, referred to here as Genomic Address Messenger 3418 (GAM3418), which modulates expression of respective target genes thereof, the function and utility of which target genes is known in the art.

GAM3418 is a novel bioinformatically detected regulatory, non protein coding, micro RNA (miRNA) gene. The method by which GAM3418 was detected is described hereinabove with reference to FIGS. 8-15.

GAM3418 gene, herein designated GAM GENE, and GAM3418 target gene, herein designated TARGET GENE, are human genes contained in the human genome.

GAM3418 gene encodes a GAM3418 precursor RNA, herein designated GAM PRECURSOR RNA. Similar to other miRNA genes, and unlike most ordinary genes, GAM3418 precursor RNA does not encode a protein. A nucleotide sequence identical or highly similar to the nucleotide sequence of GAM3418 precursor RNA is designated SEQ ID:147, and is provided hereinbelow with reference to the sequence listing part.

GAM3418 precursor RNA folds onto itself, forming GAM3418 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM3418 precursor RNA folds onto itself, forming GAM3418 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM3418 precursor RNA, designated SEQ-ID:147, and a schematic representation of a predicted secondary folding of GAM3418 folded precursor RNA are further described with reference to Table 2, hereby incorporated by reference.

An enzyme complex designated DICER COMPLEX, 'dices' the GAM3418 folded precursor RNA into GAM3418 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM3418 RNA is designated SEQ ID:291, and is provided hereinbelow with references to the sequence listing part and Table 3, hereby incorporated by reference.

GAM3418 target gene, herein designated TARGET GENE, encodes a corresponding messenger RNA, GAM3418 target RNA, herein designated GAM TARGET RNA. GAM3418 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM3418 RNA, herein designated GAM RNA, binds complementarily to one or more target binding sites located in untranslated regions of GAM3418 target RNA, herein designated GAM TARGET RNA. This complementary binding is due to the fact that the nucleotide sequence of GAM3418 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM3418 RNA may have a different number of target binding sites in untranslated regions of a GAM3418 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM3418 RNA, herein designated GAM RNA, to target binding sites on GAM3418 target RNA, herein designated GAM TARGET RNA, such as BINDING SITE I, BINDING SITE II and BINDING SITE III, inhibits translation of GAM3418 target RNA into GAM3418 target protein, herein designated GAM TARGET PROTEIN. GAM target protein is therefore outlined by a broken line.

It is appreciated that GAM3418 target gene, herein designated TARGET GENE, in fact represents a plurality of GAM3418 target genes. The mRNA of each one of this plurality of GAM3418 target genes comprises one or more target binding sites, each having a nucleotide sequence which is at least partly complementary to GAM3418 RNA, herein designated GAM RNA, and which when bound by GAM3418 RNA causes inhibition of translation of respective one or more GAM3418 target proteins.

It is further appreciated by one skilled in the art that the mode of translational inhibition illustrated by FIG. 8 with specific reference to translational inhibition exerted by GAM3418 gene, herein designated GAM GENE, on one or more GAM3418 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM3418 correlate with, and may be deduced from, the identity of the target genes which GAM3418 binds and inhibits, and the function of these target genes, as elaborated hereinbelow.

A disintegrin and metalloproteinase domain 19 (meltrin beta) (ADAM19, Accession NP_150377.1) is a GAM3418 target gene, herein designated TARGET GENE. ADAM19 BINDING SITE is a target binding site found in the 3' untranslated region of multiple transcripts of mRNA encoded by ADAM19, corresponding to a target binding site such as BINDING SITE I, BINDING SITE II or BINDING SITE III of FIG. 8. Table 4 illustrates the complementarity of the nucleotide sequences of ADAM19 BINDING SITE, designated SEQ ID:2787, to the nucleotide sequence of GAM3418 RNA, herein designated GAM RNA, also designated SEQ ID:291.

A function of GAM3418 is therefore inhibition of A disintegrin and metalloproteinase domain 19 (meltrin beta) (ADAM19, Accession NP_150377.1), a gene which participates in the proteolytic processing of beta- type neuregulin isoforms. Accordingly, utilities of GAM3418 include diagnosis, prevention and treatment of diseases and clinical conditions associated with ADAM19.

The function of ADAM19 and its association with various diseases and clinical conditions, has been established by previous studies, as described hereinabove with reference to GAM129.1. B1 (Accession NP_055266.1) is another GAM3418 target gene, herein designated TARGET GENE. B1 BINDING SITE is a target binding site found in the 3' untranslated region of mRNA encoded by B1, corresponding to a target binding site such as BINDING SITE I, BINDING SITE II or BINDING SITE III of FIG. 8. Table 4 illustrates the complementarity of the nucleotide sequences of B1 BINDING SITE, designated SEQ ID:9166, to the nucleotide sequence of GAM3418 RNA, herein designated GAM RNA, also designated SEQ ID:291.

Another function of GAM3418 is therefore inhibition of B1 (Accession NP_055266.1). Accordingly, utilities of GAM3418 include diagnosis, prevention and treatment of diseases and clinical conditions associated with B1.

Cyclin-dependent kinase 4 (CDK4, Accession NP_000066.1) is another GAM3418 target gene, herein designated TARGET GENE. CDK4 BINDING SITE1 and CDK4 BINDING SITE2 are target binding sites found in untranslated regions of multiple transcripts of mRNA encoded by CDK4, corresponding to target binding sites such as BINDING SITE I, BINDING SITE II or BINDING SITE III of FIG. 8. Table 4 illustrates the complementarity of the nucleotide sequences of CDK4 BINDING SITE1 and CDK4 BINDING SITE2, designated SEQ ID:5869 and SEQ ID:12296 respectively, to the nucleotide sequence of GAM3418 RNA, herein designated GAM RNA, also designated SEQ ID:291.

Another function of GAM3418 is therefore inhibition of Cyclin-dependent kinase 4 (CDK4, Accession NP_000066.1). Accordingly, utilities of GAM3418 include diagnosis, prevention and treatment of diseases and clinical conditions associated with CDK4.

Cleavage and polyadenylation specific factor 2, 100 kda (CPSF2, Accession XP_029311.2) is another GAM3418 target gene, herein designated TARGET GENE. CPSF2 BINDING SITE is a target binding site found in the 5' untranslated region of mRNA encoded by CPSF2, corresponding to a target binding site such as BINDING SITE I, BINDING SITE II or BINDING SITE III of FIG. 8. Table 4 illustrates the complementarity of the nucleotide sequences of CPSF2 BINDING SITE, designated SEQ ID:20174, to the nucleotide sequence of GAM3418 RNA, herein designated GAM RNA, also designated SEQ ID:291.

Another function of GAM3418 is therefore inhibition of Cleavage and polyadenylation specific factor 2, 100 kda (CPSF2, Accession XP_029311.2). Accordingly, utilities of GAM3418 include diagnosis, prevention and treatment of diseases and clinical conditions associated with CPSF2.

Cylindromatosis (turban tumor syndrome) (CYLD, Accession NP_056062.1) is another GAM3418 target gene, herein designated TARGET GENE. CYLD BINDING SITE is a target binding site found in the 3' untranslated region of mRNA encoded by CYLD, corresponding to a target binding site such as BINDING SITE I, BINDING SITE II or BINDING SITE III of FIG. 8. Table 4 illustrates the complementarity of the nucleotide sequences of CYLD BINDING SITE, designated SEQ ID:18734, to the nucleotide sequence of GAM3418 RNA, herein designated GAM RNA, also designated SEQ ID:291.

Another function of GAM3418 is therefore inhibition of Cylindromatosis (turban tumor syndrome) (CYLD, Accession NP_056062.1). Accordingly, utilities of GAM3418 include diagnosis, prevention and treatment of diseases and clinical conditions associated with CYLD.

DKFZp547G0215 (Accession NP_775914.1) is another GAM3418 target gene, herein designated TARGET GENE. DKFZp547G0215 BINDING SITE is a target binding site found in the 3' untranslated region of mRNA encoded by DKFZp547G0215, corresponding to a target binding site such as BINDING SITE I, BINDING SITE II or BINDING SITE III of FIG. 8. Table 4 illustrates the complementarity of the nucleotide sequences of DKFZp547G0215 BINDING SITE, designated SEQ ID:3848, to the nucleotide sequence of GAM3418 RNA, herein designated GAM RNA, also designated SEQ ID:291.

Another function of GAM3418 is therefore inhibition of DKFZp547G0215 (Accession NP_775914.1). Accordingly, utilities of GAM3418 include diagnosis, prevention and treatment of diseases and clinical conditions associated with DKFZp547G0215.

Ells1 (Accession NP_690006.1) is another GAM3418 target gene, herein designated TARGET GENE. Ells1 BINDING SITE is a target binding site found in the 3' untranslated region of mRNA encoded by Ells1, corresponding to a target binding site such as BINDING SITE I, BINDING SITE II or BINDING SITE III of FIG. 8. Table 4 illustrates the complementarity of the nucleotide sequences of Ells1 BINDING SITE, designated SEQ ID:11977, to the nucleotide sequence of GAM3418 RNA, herein designated GAM RNA, also designated SEQ ID:291.

Another function of GAM3418 is therefore inhibition of Ells1 (Accession NP_690006.1). Accordingly, utilities of GAM3418 include diagnosis, prevention and treatment of diseases and clinical conditions associated with Ells1.

Estrogen-related receptor gamma (ESRRG, Accession NP_001429.1) is another GAM3418 target gene, herein designated TARGET GENE. ESRRG BINDING SITE is a target binding site found in the 3' untranslated region of mRNA encoded by ESRRG, corresponding to a target binding site such as BINDING SITE I, BINDING SITE II or BINDING SITE III of FIG. 8. Table 4 illustrates the complementarity of the nucleotide sequences of ESRRG BINDING SITE, designated SEQ ID:19845, to the nucleotide sequence of GAM3418 RNA, herein designated GAM RNA, also designated SEQ ID:291.

Another function of GAM3418 is therefore inhibition of Estrogen-related receptor gamma (ESRRG, Accession NP_001429.1), a gene which Estrogen- related receptor gamma. Accordingly, utilities of GAM3418 include diagnosis, prevention and treatment of diseases and clinical conditions associated with ESRRG.

The function of ESRRG and its association with various diseases and clinical conditions, has been established by previous studies, as described hereinabove with reference to GAM200.1. FLJ11175 (Accession NP_060819.1) is another GAM3418 target gene, herein designated TARGET GENE. FLJ11175 BINDING SITE is a target binding site found in the 3' untranslated region of mRNA encoded by FLJ11175, corresponding to a target binding site such as BINDING SITE I, BINDING SITE II or BINDING SITE III of FIG. 8. Table 4 illustrates the complementarity of the nucleotide sequences of FLJ11175 BINDING SITE, designated SEQ ID:12392, to the nucleotide sequence of GAM3418 RNA, herein designated GAM RNA, also designated SEQ ID:291.

Another function of GAM3418 is therefore inhibition of FLJ11175 (Accession NP_060819.1). Accordingly, utilities of GAM3418 include diagnosis, prevention and treatment of diseases and clinical conditions associated with FLJ11175.

FLJ12660 (Accession NP_079428.1) is another GAM3418 target gene, herein designated TARGET GENE. FLJ12660 BINDING SITE is a target binding site found in the 3' untranslated region of mRNA encoded by FLJ12660, corresponding to a target binding site such as BINDING SITE I, BINDING SITE II or BINDING SITE III of FIG. 8. Table 4 illustrates the complementarity of the nucleotide sequences of FLJ12660 BINDING SITE, designated SEQ ID:9523, to the nucleotide sequence of GAM3418 RNA, herein designated GAM RNA, also designated SEQ ID:291.

Another function of GAM3418 is therefore inhibition of FLJ12660 (Accession NP_079428.1). Accordingly, utilities of GAM3418 include diagnosis, prevention and treatment of diseases and clinical conditions associated with FLJ12660.

FLJ13149 (Accession NP_068598.1) is another GAM3418 target gene, herein designated TARGET GENE. FLJ13149 BINDING SITE is a target binding site found in the 5' untranslated region of mRNA encoded by FLJ13149, corresponding to a target binding site such as BINDING SITE I, BINDING SITE II or BINDING SITE III of FIG. 8. Table 4 illustrates the complementarity of the nucleotide sequences of FLJ13149 BINDING SITE, designated SEQ ID:3760, to the nucleotide sequence of GAM3418 RNA, herein designated GAM RNA, also designated SEQ ID:291.

Another function of GAM3418 is therefore inhibition of FLJ13149 (Accession NP__068598.1). Accordingly, utilities of GAM3418 include diagnosis, prevention and treatment of diseases and clinical conditions associated with FLJ13149.

FLJ13912 (Accession NP__073607.2) is another GAM3418 target gene, herein designated TARGET GENE. FLJ13912 BINDING SITE is a target binding site found in the 3' untranslated region of mRNA encoded by FLJ13912, corresponding to a target binding site such as BINDING SITE I, BINDING SITE II or BINDING SITE III of FIG. 8. Table 4 illustrates the complementarity of the nucleotide sequences of FLJ13912 BINDING SITE, designated SEQ ID:16332, to the nucleotide sequence of GAM3418 RNA, herein designated GAM RNA, also designated SEQ ID:291.

Another function of GAM3418 is therefore inhibition of FLJ13912 (Accession NP__073607.2). Accordingly, utilities of GAM3418 include diagnosis, prevention and treatment of diseases and clinical conditions associated with FLJ13912.

FLJ14103 (Accession NP__078965.1) is another GAM3418 target gene, herein designated TARGET GENE. FLJ14103 BINDING SITE is a target binding site found in the 3' untranslated region of mRNA encoded by FLJ14103, corresponding to a target binding site such as BINDING SITE I, BINDING SITE II or BINDING SITE III of FIG. 8. Table 4 illustrates the complementarity of the nucleotide sequences of FLJ14103 BINDING SITE, designated SEQ ID:15222, to the nucleotide sequence of GAM3418 RNA, herein designated GAM RNA, also designated SEQ ID:291.

Another function of GAM3418 is therefore inhibition of FLJ14103 (Accession NP__078965.1). Accordingly, utilities of GAM3418 include diagnosis, prevention and treatment of diseases and clinical conditions associated with FLJ14103.

FLJ31033 (Accession XP__037817.5) is another GAM3418 target gene, herein designated TARGET GENE. FLJ31033 BINDING SITE is a target binding site found in the 3' untranslated region of mRNA encoded by FLJ31033, corresponding to a target binding site such as BINDING SITE I, BINDING SITE II or BINDING SITE III of FIG. 8. Table 4 illustrates the complementarity of the nucleotide sequences of FLJ31033 BINDING SITE, designated SEQ ID:10323, to the nucleotide sequence of GAM3418 RNA, herein designated GAM RNA, also designated SEQ ID:291.

Another function of GAM3418 is therefore inhibition of FLJ31033 (Accession XP__037817.5). Accordingly, utilities of GAM3418 include diagnosis, prevention and treatment of diseases and clinical conditions associated with FLJ31033.

GRIPE (Accession XP__170749.4) is another GAM3418 target gene, herein designated TARGET GENE. GRIPE BINDING SITE is a target binding site found in the 5' untranslated region of mRNA encoded by GRIPE, corresponding to a target binding site such as BINDING SITE I, BINDING SITE II or BINDING SITE III of FIG. 8. Table 4 illustrates the complementarity of the nucleotide sequences of GRIPE BINDING SITE, designated SEQ ID:1088, to the nucleotide sequence of GAM3418 RNA, herein designated GAM RNA, also designated SEQ ID:291.

Another function of GAM3418 is therefore inhibition of GRIPE (Accession XP__170749.4). Accordingly, utilities of GAM3418 include diagnosis, prevention and treatment of diseases and clinical conditions associated with GRIPE.

General transcription factor iie, polypeptide 2, beta 34 kda (GTF2E2, Accession NP__002086.1) is another GAM3418 target gene, herein designated TARGET GENE. GTF2E2 BINDING SITE is a target binding site found in the 3' untranslated region of mRNA encoded by GTF2E2, corresponding to a target binding site such as BINDING SITE I, BINDING SITE II or BINDING SITE III of FIG. 8. Table 4 illustrates the complementarity of the nucleotide sequences of GTF2E2 BINDING SITE, designated SEQ ID:19529, to the nucleotide sequence of GAM3418 RNA, herein designated GAM RNA, also designated SEQ ID:291.

Another function of GAM3418 is therefore inhibition of General transcription factor iie, polypeptide 2, beta 34 kda (GTF2E2, Accession NP__002086.1). Accordingly, utilities of GAM3418 include diagnosis, prevention and treatment of diseases and clinical conditions associated with GTF2E2.

HH114 (Accession NP__115888.1) is another GAM3418 target gene, herein designated TARGET GENE. HH114 BINDING SITE is a target binding site found in the 5' untranslated region of mRNA encoded by HH114, corresponding to a target binding site such as BINDING SITE I, BINDING SITE II or BINDING SITE III of FIG. 8. Table 4 illustrates the complementarity of the nucleotide sequences of HH114 BINDING SITE, designated SEQ ID:11665, to the nucleotide sequence of GAM3418 RNA, herein designated GAM RNA, also designated SEQ ID:291.

Another function of GAM3418 is therefore inhibition of HH114 (Accession NP__115888.1). Accordingly, utilities of GAM3418 include diagnosis, prevention and treatment of diseases and clinical conditions associated with HH114.

5-hydroxytryptamine (serotonin) receptor 7 (adenylate cyclase-coupled) (HTR7, Accession NP__062874.1) is another GAM3418 target gene, herein designated TARGET GENE. HTR7 BINDING SITE is a target binding site found in the 3' untranslated region of multiple transcripts of mRNA encoded by HTR7, corresponding to a target binding site such as BINDING SITE I, BINDING SITE II or BINDING SITE III of FIG. 8. Table 4 illustrates the complementarity of the nucleotide sequences of HTR7 BINDING SITE, designated SEQ ID:751, to the nucleotide sequence of GAM3418 RNA, herein designated GAM RNA, also designated SEQ ID:291.

Another function of GAM3418 is therefore inhibition of 5-hydroxytryptamine (serotonin) receptor 7 (adenylate cyclase-coupled) (HTR7, Accession NP__062874.1), a gene which stimulates adenylate cyclase. Accordingly, utilities of GAM3418 include diagnosis, prevention and treatment of diseases and clinical conditions associated with HTR7.

The function of HTR7 and its association with various diseases and clinical conditions, has been established by previous studies, as described hereinabove with reference to GAM492.2. 5-hydroxytryptamine (serotonin) receptor 7 (adenylate cyclase-coupled) (HTR7, Accession NP__000863.1) is another GAM3418 target gene, herein designated TARGET GENE. HTR7 BINDING SITE is a target binding site found in the 3' untranslated region of multiple transcripts of mRNA encoded by HTR7, corresponding to a target binding site such as BINDING SITE I, BINDING SITE II or BINDING SITE III of FIG. 8. Table 4 illustrates the complementarity of the nucleotide sequences of HTR7 BINDING SITE, designated SEQ ID:751, to the nucleotide sequence of GAM3418 RNA, herein designated GAM RNA, also designated SEQ ID:291.

Another function of GAM3418 is therefore inhibition of 5-hydroxytryptamine (serotonin) receptor 7 (adenylate cyclase-coupled) (HTR7, Accession NP__000863.1), a gene which stimulates adenylate cyclase. Accordingly, utilities of GAM3418 include diagnosis, prevention and treatment of diseases and clinical conditions associated with HTR7.

The function of HTR7 and its association with various diseases and clinical conditions, has been established by previous studies, as described hereinabove with reference to GAM492.2. 5-hydroxytryptamine (serotonin) receptor 7 (adenylate cyclase-coupled) (HTR7, Accession NP_062873.1) is another GAM3418 target gene, herein designated TARGET GENE. HTR7 BINDING SITE is a target binding site found in the 3' untranslated region of multiple transcripts of mRNA encoded by HTR7, corresponding to a target binding site such as BINDING SITE I, BINDING SITE II or BINDING SITE III of FIG. 8. Table 4 illustrates the complementarity of the nucleotide sequences of HTR7 BINDING SITE, designated SEQ ID:751, to the nucleotide sequence of GAM3418 RNA, herein designated GAM RNA, also designated SEQ ID:291.

Another function of GAM3418 is therefore inhibition of 5-hydroxytryptamine (serotonin) receptor 7 (adenylate cyclase-coupled) (HTR7, Accession NP_062873.1), a gene which stimulates adenylate cyclase. Accordingly, utilities of GAM3418 include diagnosis, prevention and treatment of diseases and clinical conditions associated with HTR7.

The function of HTR7 and its association with various diseases and clinical conditions, has been established by previous studies, as described hereinabove with reference to GAM492.2. KIAA1196 (Accession XP_028968.3) is another GAM3418 target gene, herein designated TARGET GENE. KIAA1196 BINDING SITE is a target binding site found in the 3' untranslated region of mRNA encoded by KIAA1196, corresponding to a target binding site such as BINDING SITE I, BINDING SITE II or BINDING SITE III of FIG. 8. Table 4 illustrates the complementarity of the nucleotide sequences of KIAA1196 BINDING SITE, designated SEQ ID:3870, to the nucleotide sequence of GAM3418 RNA, herein designated GAM RNA, also designated SEQ ID:291.

Another function of GAM3418 is therefore inhibition of KIAA1196 (Accession XP_028968.3). Accordingly, utilities of GAM3418 include diagnosis, prevention and treatment of diseases and clinical conditions associated with KIAA1196.

KIAA1203 (Accession XP_049683.4) is another GAM3418 target gene, herein designated TARGET GENE. KIAA1203 BINDING SITE is a target binding site found in the 3' untranslated region of mRNA encoded by KIAA1203, corresponding to a target binding site such as BINDING SITE I, BINDING SITE II or BINDING SITE III of FIG. 8. Table 4 illustrates the complementarity of the nucleotide sequences of KIAA1203 BINDING SITE, designated SEQ ID:16550, to the nucleotide sequence of GAM3418 RNA, herein designated GAM RNA, also designated SEQ ID:291.

Another function of GAM3418 is therefore inhibition of KIAA1203 (Accession XP_049683.4). Accordingly, utilities of GAM3418 include diagnosis, prevention and treatment of diseases and clinical conditions associated with KIAA1203.

Lim domain kinase 2 (LIMK2, Accession NP_005560.1) is another GAM3418 target gene, herein designated TARGET GENE. LIMK2 BINDING SITE is a target binding site found in the 3' untranslated region of multiple transcripts of mRNA encoded by LIMK2, corresponding to a target binding site such as BINDING SITE I, BINDING SITE II or BINDING SITE III of FIG. 8. Table 4 illustrates the complementarity of the nucleotide sequences of LIMK2 BINDING SITE, designated SEQ ID:7977, to the nucleotide sequence of GAM3418 RNA, herein designated GAM RNA, also designated SEQ ID:291.

Another function of GAM3418 is therefore inhibition of Lim domain kinase 2 (LIMK2, Accession NP_005560.1). Accordingly, utilities of GAM3418 include diagnosis, prevention and treatment of diseases and clinical conditions associated with LIMK2.

Lim domain kinase 2 (LIMK2, Accession NP_057952.1) is another GAM3418 target gene, herein designated TARGET GENE. LIMK2 BINDING SITE is a target binding site found in the 3' untranslated region of multiple transcripts of mRNA encoded by LIMK2, corresponding to a target binding site such as BINDING SITE I, BINDING SITE II or BINDING SITE III of FIG. 8. Table 4 illustrates the complementarity of the nucleotide sequences of LIMK2 BINDING SITE, designated SEQ ID:7977, to the nucleotide sequence of GAM3418 RNA, herein designated GAM RNA, also designated SEQ ID:291.

Another function of GAM3418 is therefore inhibition of Lim domain kinase 2 (LIMK2, Accession NP_057952.1). Accordingly, utilities of GAM3418 include diagnosis, prevention and treatment of diseases and clinical conditions associated with LIMK2.

LOC126755 (Accession XP_059074.1) is another GAM3418 target gene, herein designated TARGET GENE. LOC126755 BINDING SITE is a target binding site found in the 3' untranslated region of mRNA encoded by LOC126755, corresponding to a target binding site such as BINDING SITE I, BINDING SITE II or BINDING SITE III of FIG. 8. Table 4 illustrates the complementarity of the nucleotide sequences of LOC126755 BINDING SITE, designated SEQ ID:16572, to the nucleotide sequence of GAM3418 RNA, herein designated GAM RNA, also designated SEQ ID:291.

Another function of GAM3418 is therefore inhibition of LOC126755 (Accession XP_059074.1). Accordingly, utilities of GAM3418 include diagnosis, prevention and treatment of diseases and clinical conditions associated with LOC126755.

LOC129607 (Accession XP_059368.4) is another GAM3418 target gene, herein designated TARGET GENE. LOC129607 BINDING SITE is a target binding site found in the 3' untranslated region of mRNA encoded by LOC129607, corresponding to a target binding site such as BINDING SITE I, BINDING SITE II or BINDING SITE III of FIG. 8. Table 4 illustrates the complementarity of the nucleotide sequences of LOC129607 BINDING SITE, designated SEQ ID:3587, to the nucleotide sequence of GAM3418 RNA, herein designated GAM RNA, also designated SEQ ID:291.

Another function of GAM3418 is therefore inhibition of LOC129607 (Accession XP_059368.4). Accordingly, utilities of GAM3418 include diagnosis, prevention and treatment of diseases and clinical conditions associated with LOC129607.

LOC145652 (Accession XP_096827.1) is another GAM3418 target gene, herein designated TARGET GENE. LOC145652 BINDING SITE is a target binding site found in the 3' untranslated region of mRNA encoded by LOC145652, corresponding to a target binding site such as BINDING SITE I, BINDING SITE II or BINDING SITE III of FIG. 8. Table 4 illustrates the complementarity of the nucleotide sequences of LOC145652 BINDING SITE, designated SEQ ID:8999, to the nucleotide sequence of GAM3418 RNA, herein designated GAM RNA, also designated SEQ ID:291.

Another function of GAM3418 is therefore inhibition of LOC145652 (Accession XP_096827.1). Accordingly, utilities of GAM3418 include diagnosis, prevention and treatment of diseases and clinical conditions associated with LOC145652.

LOC145783 (Accession XP_085231.2) is another GAM3418 target gene, herein designated TARGET GENE. LOC145783 BINDING SITE is a target binding site found in the 3' untranslated region of mRNA encoded by LOC145783, corresponding to a target binding site such as BINDING SITE I, BINDING SITE II or BINDING SITE III of FIG. 8. Table 4 illustrates the complementarity of the nucleotide sequences of LOC145783 BINDING SITE, designated SEQ ID:8080, to the nucleotide sequence of GAM3418 RNA, herein designated GAM RNA, also designated SEQ ID:291.

Another function of GAM3418 is therefore inhibition of LOC145783 (Accession XP_085231.2). Accordingly, utilities of GAM3418 include diagnosis, prevention and treatment of diseases and clinical conditions associated with LOC145783.

LOC152519 (Accession XP_087483.3) is another GAM3418 target gene, herein designated TARGET GENE. LOC152519 BINDING SITE is a target binding site found in the 3' untranslated region of mRNA encoded by LOC152519, corresponding to a target binding site such as BINDING SITE I, BINDING SITE II or BINDING SITE III of FIG. 8. Table 4 illustrates the complementarity of the nucleotide sequences of LOC152519 BINDING SITE, designated SEQ ID:10441, to the nucleotide sequence of GAM3418 RNA, herein designated GAM RNA, also designated SEQ ID:291.

Another function of GAM3418 is therefore inhibition of LOC152519 (Accession XP_087483.3). Accordingly, utilities of GAM3418 include diagnosis, prevention and treatment of diseases and clinical conditions associated with LOC152519.

LOC283295 (Accession XP_210964.1) is another GAM3418 target gene, herein designated TARGET GENE. LOC283295 BINDING SITE is a target binding site found in the 3' untranslated region of mRNA encoded by LOC283295, corresponding to a target binding site such as BINDING SITE I, BINDING SITE II or BINDING SITE III of FIG. 8. Table 4 illustrates the complementarity of the nucleotide sequences of LOC283295 BINDING SITE, designated SEQ ID:13815, to the nucleotide sequence of GAM3418 RNA, herein designated GAM RNA, also designated SEQ ID:291.

Another function of GAM3418 is therefore inhibition of LOC283295 (Accession XP_210964.1). Accordingly, utilities of GAM3418 include diagnosis, prevention and treatment of diseases and clinical conditions associated with LOC283295.

LOC283505 (Accession XP_208702.1) is another GAM3418 target gene, herein designated TARGET GENE. LOC283505 BINDING SITE is a target binding site found in the 5' untranslated region of mRNA encoded by LOC283505, corresponding to a target binding site such as BINDING SITE I, BINDING SITE II or BINDING SITE III of FIG. 8. Table 4 illustrates the complementarity of the nucleotide sequences of LOC283505 BINDING SITE, designated SEQ ID:9453, to the nucleotide sequence of GAM3418 RNA, herein designated GAM RNA, also designated SEQ ID:291.

Another function of GAM3418 is therefore inhibition of LOC283505 (Accession XP_208702.1). Accordingly, utilities of GAM3418 include diagnosis, prevention and treatment of diseases and clinical conditions associated with LOC283505.

LOC283596 (Accession XP_294746.1) is another GAM3418 target gene, herein designated TARGET GENE. LOC283596 BINDING SITE is a target binding site found in the 5' untranslated region of mRNA encoded by LOC283596, corresponding to a target binding site such as BINDING SITE I, BINDING SITE II or BINDING SITE III of FIG. 8. Table 4 illustrates the complementarity of the nucleotide sequences of LOC283596 BINDING SITE, designated SEQ ID:604, to the nucleotide sequence of GAM3418 RNA, herein designated GAM RNA, also designated SEQ ID:291.

Another function of GAM3418 is therefore inhibition of LOC283596 (Accession XP_294746.1). Accordingly, utilities of GAM3418 include diagnosis, prevention and treatment of diseases and clinical conditions associated with LOC283596.

LOC283817 (Accession XP_211215.1) is another GAM3418 target gene, herein designated TARGET GENE. LOC283817 BINDING SITE is a target binding site found in the 5' untranslated region of mRNA encoded by LOC283817, corresponding to a target binding site such as BINDING SITE I, BINDING SITE II or BINDING SITE III of FIG. 8. Table 4 illustrates the complementarity of the nucleotide sequences of LOC283817 BINDING SITE, designated SEQ ID:12884, to the nucleotide sequence of GAM3418 RNA, herein designated GAM RNA, also designated SEQ ID:291.

Another function of GAM3418 is therefore inhibition of LOC283817 (Accession XP_211215.1). Accordingly, utilities of GAM3418 include diagnosis, prevention and treatment of diseases and clinical conditions associated with LOC283817.

LOC283940 (Accession XP_208917.3) is another GAM3418 target gene, herein designated TARGET GENE. LOC283940 BINDING SITE is a target binding site found in the 5' untranslated region of mRNA encoded by LOC283940, corresponding to a target binding site such as BINDING SITE I, BINDING SITE II or BINDING SITE III of FIG. 8. Table 4 illustrates the complementarity of the nucleotide sequences of LOC283940 BINDING SITE, designated SEQ ID:2801, to the nucleotide sequence of GAM3418 RNA, herein designated GAM RNA, also designated SEQ ID:291.

Another function of GAM3418 is therefore inhibition of LOC283940 (Accession XP_208917.3). Accordingly, utilities of GAM3418 include diagnosis, prevention and treatment of diseases and clinical conditions associated with LOC283940.

LOC283980 (Accession XP_208940.2) is another GAM3418 target gene, herein designated TARGET GENE. LOC283980 BINDING SITE is a target binding site found in the 3' untranslated region of mRNA encoded by LOC283980, corresponding to a target binding site such as BINDING SITE I, BINDING SITE II or BINDING SITE III of FIG. 8. Table 4 illustrates the complementarity of the nucleotide sequences of LOC283980 BINDING SITE, designated SEQ ID:2801, to the nucleotide sequence of GAM3418 RNA, herein designated GAM RNA, also designated SEQ ID:291.

Another function of GAM3418 is therefore inhibition of LOC283980 (Accession XP_208940.2). Accordingly, utilities of GAM3418 include diagnosis, prevention and treatment of diseases and clinical conditions associated with LOC283980.

LOC284542 (Accession XP_209254.1) is another GAM3418 target gene, herein designated TARGET GENE. LOC284542 BINDING SITE is a target binding site found in the 5' untranslated region of mRNA encoded by LOC284542, corresponding to a target binding site such as BINDING SITE I, BINDING SITE II or BINDING SITE III of FIG. 8. Table 4 illustrates the complementarity of the nucleotide sequences of LOC284542 BINDING SITE, designated SEQ ID:11511, to the nucleotide sequence of GAM3418 RNA, herein designated GAM RNA, also designated SEQ ID:291.

Another function of GAM3418 is therefore inhibition of LOC284542 (Accession XP_209254.1). Accordingly, utilities of GAM3418 include diagnosis, prevention and treatment of diseases and clinical conditions associated with LOC284542.

LOC284647 (Accession XP_211569.1) is another GAM3418 target gene, herein designated TARGET GENE. LOC284647 BINDING SITE is a target binding site found in the 3' untranslated region of mRNA encoded by LOC284647, corresponding to a target binding site such as BINDING SITE I, BINDING SITE II or BINDING SITE III of FIG. 8. Table 4 illustrates the complementarity of the nucleotide sequences of LOC284647 BINDING SITE, designated SEQ ID:8747, to the nucleotide sequence of GAM3418 RNA, herein designated GAM RNA, also designated SEQ ID:291.

Another function of GAM3418 is therefore inhibition of LOC284647 (Accession XP_211569.1). Accordingly, utilities of GAM3418 include diagnosis, prevention and treatment of diseases and clinical conditions associated with LOC284647.

LOC284719 (Accession XP_211601.1) is another GAM3418 target gene, herein designated TARGET GENE. LOC284719 BINDING SITE is a target binding site found in the 5' untranslated region of mRNA encoded by LOC284719, corresponding to a target binding site such as BINDING SITE I, BINDING SITE II or BINDING SITE III of FIG. 8. Table 4 illustrates the complementarity of the nucleotide sequences of LOC284719 BINDING SITE, designated SEQ ID:13651, to the nucleotide sequence of GAM3418 RNA, herein designated GAM RNA, also designated SEQ ID:291.

Another function of GAM3418 is therefore inhibition of LOC284719 (Accession XP_211601.1). Accordingly, utilities of GAM3418 include diagnosis, prevention and treatment of diseases and clinical conditions associated with LOC284719.

LOC284950 (Accession XP_211703.1) is another GAM3418 target gene, herein designated TARGET GENE. LOC284950 BINDING SITE is a target binding site found in the 5' untranslated region of mRNA encoded by LOC284950, corresponding to a target binding site such as BINDING SITE I, BINDING SITE II or BINDING SITE III of FIG. 8. Table 4 illustrates the complementarity of the nucleotide sequences of LOC284950 BINDING SITE, designated SEQ ID:6222, to the nucleotide sequence of GAM3418 RNA, herein designated GAM RNA, also designated SEQ ID:291.

Another function of GAM3418 is therefore inhibition of LOC284950 (Accession XP_211703.1). Accordingly, utilities of GAM3418 include diagnosis, prevention and treatment of diseases and clinical conditions associated with LOC284950.

LOC285786 (Accession XP_208349.1) is another GAM3418 target gene, herein designated TARGET GENE. LOC285786 BINDING SITE is a target binding site found in the 3' untranslated region of mRNA encoded by LOC285786, corresponding to a target binding site such as BINDING SITE I, BINDING SITE II or BINDING SITE III of FIG. 8. Table 4 illustrates the complementarity of the nucleotide sequences of LOC285786 BINDING SITE, designated SEQ ID:8604, to the nucleotide sequence of GAM3418 RNA, herein designated GAM RNA, also designated SEQ ID:291.

Another function of GAM3418 is therefore inhibition of LOC285786 (Accession XP_208349.1). Accordingly, utilities of GAM3418 include diagnosis, prevention and treatment of diseases and clinical conditions associated with LOC285786.

LOC347775 (Accession XP_302601.1) is another GAM3418 target gene, herein designated TARGET GENE. LOC347775 BINDING SITE is a target binding site found in the 5' untranslated region of mRNA encoded by LOC347775, corresponding to a target binding site such as BINDING SITE I, BINDING SITE II or BINDING SITE III of FIG. 8. Table 4 illustrates the complementarity of the nucleotide sequences of LOC347775 BINDING SITE, designated SEQ ID:1860, to the nucleotide sequence of GAM3418 RNA, herein designated GAM RNA, also designated SEQ ID:291.

Another function of GAM3418 is therefore inhibition of LOC347775 (Accession XP_302601.1). Accordingly, utilities of GAM3418 include diagnosis, prevention and treatment of diseases and clinical conditions associated with LOC347775.

LOC348731 (Accession XP_300399.1) is another GAM3418 target gene, herein designated TARGET GENE. LOC348731 BINDING SITE is a target binding site found in the 3' untranslated region of mRNA encoded by LOC348731, corresponding to a target binding site such as BINDING SITE I, BINDING SITE II or BINDING SITE III of FIG. 8. Table 4 illustrates the complementarity of the nucleotide sequences of LOC348731 BINDING SITE, designated SEQ ID:13922, to the nucleotide sequence of GAM3418 RNA, herein designated GAM RNA, also designated SEQ ID:291.

Another function of GAM3418 is therefore inhibition of LOC348731 (Accession XP_300399.1). Accordingly, utilities of GAM3418 include diagnosis, prevention and treatment of diseases and clinical conditions associated with LOC348731.

LOC349257 (Accession XP_300996.1) is another GAM3418 target gene, herein designated TARGET GENE. LOC349257 BINDING SITE is a target binding site found in the 5' untranslated region of mRNA encoded by LOC349257, corresponding to a target binding site such as BINDING SITE I, BINDING SITE II or BINDING SITE III of FIG. 8. Table 4 illustrates the complementarity of the nucleotide sequences of LOC349257 BINDING SITE, designated SEQ ID:17812, to the nucleotide sequence of GAM3418 RNA, herein designated GAM RNA, also designated SEQ ID:291.

Another function of GAM3418 is therefore inhibition of LOC349257 (Accession XP_300996.1). Accordingly, utilities of GAM3418 include diagnosis, prevention and treatment of diseases and clinical conditions associated with LOC349257.

LOC349265 (Accession XP_301000.1) is another GAM3418 target gene, herein designated TARGET GENE. LOC349265 BINDING SITE is a target binding site found in the 5' untranslated region of mRNA encoded by LOC349265, corresponding to a target binding site such as BINDING SITE I, BINDING SITE II or BINDING SITE III of FIG. 8. Table 4 illustrates the complementarity of the nucleotide sequences of LOC349265 BINDING SITE, designated SEQ ID:17812, to the nucleotide sequence of GAM3418 RNA, herein designated GAM RNA, also designated SEQ ID:291.

Another function of GAM3418 is therefore inhibition of LOC349265 (Accession XP_301000.1). Accordingly, utilities of GAM3418 include diagnosis, prevention and treatment of diseases and clinical conditions associated with LOC349265.

Mitogen-activated protein kinase 14 (MAPK14, Accession NP_001306.1) is another GAM3418 target gene, herein designated TARGET GENE. MAPK14 BINDING SITE is a target binding site found in the 3' untranslated region of multiple transcripts of mRNA encoded by MAPK14, corresponding to a target binding site such as BINDING SITE I, BINDING SITE II or BINDING SITE III of FIG. 8. Table 4 illustrates the complementarity of the nucleotide sequences of MAPK14 BINDING SITE, designated SEQ ID:5165, to the nucleotide sequence of GAM3418 RNA, herein designated GAM RNA, also designated SEQ ID:291.

Another function of GAM3418 is therefore inhibition of Mitogen-activated protein kinase 14 (MAPK14, Accession NP_001306.1), a gene which is important for cytokine production; responds to changes in extracellular osmolarity. Accordingly, utilities of GAM3418 include diagnosis, prevention and treatment of diseases and clinical conditions associated with MAPK14.

The function of MAPK14 and its association with various diseases and clinical conditions, has been established by previous studies, as described hereinabove with reference to GAM473.1. Mitogen-activated protein kinase 14 (MAPK14, Accession NP_620581.1) is another GAM3418 target gene, herein designated TARGET GENE. MAPK14 BINDING SITE is a target binding site found in the 3' untranslated region of multiple transcripts of mRNA encoded by MAPK14, corresponding to a target binding site such as BINDING SITE I, BINDING SITE II or BINDING SITE III of FIG. 8. Table 4 illustrates the complementarity of the nucleotide sequences of MAPK14 BINDING SITE, designated SEQ ID:5165, to the nucleotide sequence of GAM3418 RNA, herein designated GAM RNA, also designated SEQ ID:291.

Another function of GAM3418 is therefore inhibition of Mitogen-activated protein kinase 14 (MAPK14, Accession NP_620581.1), a gene which is important for cytokine production; responds to changes in extracellular osmolarity. Accordingly, utilities of GAM3418 include diagnosis, prevention and treatment of diseases and clinical conditions associated with MAPK14.

The function of MAPK14 and its association with various diseases and clinical conditions, has been established by previous studies, as described hereinabove with reference to GAM473.1. Mitogen-activated protein kinase 14 (MAPK14, Accession NP_620583.1) is another GAM3418 target gene, herein designated TARGET GENE. MAPK14 BINDING SITE is a target binding site found in the 3' untranslated region of multiple transcripts of mRNA encoded by MAPK14, corresponding to a target binding site such as BINDING SITE I, BINDING SITE II or BINDING SITE III of FIG. 8. Table 4 illustrates the complementarity of the nucleotide sequences of MAPK14 BINDING SITE, designated SEQ ID:5165, to the nucleotide sequence of GAM3418 RNA, herein designated GAM RNA, also designated SEQ ID:291.

Another function of GAM3418 is therefore inhibition of Mitogen-activated protein kinase 14 (MAPK14, Accession NP_620583.1), a gene which is important for cytokine production; responds to changes in extracellular osmolarity. Accordingly, utilities of GAM3418 include diagnosis, prevention and treatment of diseases and clinical conditions associated with MAPK14.

The function of MAPK14 and its association with various diseases and clinical conditions, has been established by previous studies, as described hereinabove with reference to GAM473.1. MGC45866 (Accession NP_689472.2) is another GAM3418 target gene, herein designated TARGET GENE. MGC45866 BINDING SITE is a target binding site found in the 3' untranslated region of mRNA encoded by MGC45866, corresponding to a target binding site such as BINDING SITE I, BINDING SITE II or BINDING SITE III of FIG. 8. Table 4 illustrates the complementarity of the nucleotide sequences of MGC45866 BINDING SITE, designated SEQ ID:5930, to the nucleotide sequence of GAM3418 RNA, herein designated GAM RNA, also designated SEQ ID:291.

Another function of GAM3418 is therefore inhibition of MGC45866 (Accession NP_689472.2). Accordingly, utilities of GAM3418 include diagnosis, prevention and treatment of diseases and clinical conditions associated with MGC45866.

Nebulin (NEB, Accession NP_004534.1) is another GAM3418 target gene, herein designated TARGET GENE. NEB BINDING SITE is a target binding site found in the 3' untranslated region of mRNA encoded by NEB, corresponding to a target binding site such as BINDING SITE I, BINDING SITE II or BINDING SITE III of FIG. 8. Table 4 illustrates the complementarity of the nucleotide sequences of NEB BINDING SITE, designated SEQ ID:14890, to the nucleotide sequence of GAM3418 RNA, herein designated GAM RNA, also designated SEQ ID:291.

Another function of GAM3418 is therefore inhibition of Nebulin (NEB, Accession NP_004534.1). Accordingly, utilities of GAM3418 include diagnosis, prevention and treatment of diseases and clinical conditions associated with NEB.

NET-2 (Accession NP_036470.1) is another GAM3418 target gene, herein designated TARGET GENE. NET-2 BINDING SITE is a target binding site found in the 3' untranslated region of mRNA encoded by NET-2, corresponding to a target binding site such as BINDING SITE I, BINDING SITE II or BINDING SITE III of FIG. 8. Table 4 illustrates the complementarity of the nucleotide sequences of NET-2 BINDING SITE, designated SEQ ID:10940, to the nucleotide sequence of GAM3418 RNA, herein designated GAM RNA, also designated SEQ ID:291.

Another function of GAM3418 is therefore inhibition of NET-2 (Accession NP_036470.1). Accordingly, utilities of GAM3418 include diagnosis, prevention and treatment of diseases and clinical conditions associated with NET-2.

8-oxoguanine dna glycosylase (OGG1, Accession NP_058438.1) is another GAM3418 target gene, herein designated TARGET GENE. OGG1 BINDING SITE is a target binding site found in the 3' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:20054, to the nucleotide sequence of GAM3418 RNA, herein designated GAM RNA, also designated SEQ ID:291.

Another function of GAM3418 is therefore inhibition of 8-oxoguanine dna glycosylase (OGG1, Accession NP_058438.1), a gene which is involved in base excision DNA repair and removal of 8-oxyguanine and therefore may be associated with Tumorigenesis. Accordingly, utilities of GAM3418 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1. Protocadherin 12 (PCDH12, Accession NP_057664.1) is another GAM3418 target gene, herein designated TARGET GENE. PCDH12 BINDING SITE is a target binding site found in the 5' untranslated region of mRNA encoded by PCDH12, corresponding to a target binding site such as BINDING SITE I, BINDING SITE II or BINDING SITE III of FIG. 8. Table 4 illustrates the complementarity of the nucleotide sequences of PCDH12 BINDING SITE, designated SEQ ID:1606, to the nucleotide sequence of GAM3418 RNA, herein designated GAM RNA, also designated SEQ ID:291.

Another function of GAM3418 is therefore inhibition of Protocadherin 12 (PCDH12, Accession NP_057664.1), a gene which is a member of a family of nonclassical cadherins.

Accordingly, utilities of GAM3418 include diagnosis, prevention and treatment of diseases and clinical conditions associated with PCDH12.

The function of PCDH12 and its association with various diseases and clinical conditions, has been established by previous studies, as described hereinabove with reference to GAM63.1. Polymerase (dna directed) sigma (POLS, Accession NP_008930.1) is another GAM3418 target gene, herein designated TARGET GENE. POLS BINDING SITE is a target binding site found in the 3' untranslated region of mRNA encoded by POLS, corresponding to a target binding site such as BINDING SITE I, BINDING SITE II or BINDING SITE III of FIG. 8. Table 4 illustrates the complementarity of the nucleotide sequences of POLS BINDING SITE, designated SEQ ID:19359, to the nucleotide sequence of GAM3418 RNA, herein designated GAM RNA, also designated SEQ ID:291.

Another function of GAM3418 is therefore inhibition of Polymerase (dna directed) sigma (POLS, Accession NP_008930.1), a gene which is necessary for chromosome segregation. Accordingly, utilities of GAM3418 include diagnosis, prevention and treatment of diseases and clinical conditions associated with POLS.

The function of POLS and its association with various diseases and clinical conditions, has been established by previous studies, as described hereinabove with reference to GAM96.1. PP1665 (Accession NP_110419.3) is another GAM3418 target gene, herein designated TARGET GENE. PP1665 BINDING SITE is a target binding site found in the 3' untranslated region of mRNA encoded by PP1665, corresponding to a target binding site such as BINDING SITE I, BINDING SITE II or BINDING SITE III of FIG. 8. Table 4 illustrates the complementarity of the nucleotide sequences of PP1665 BINDING SITE, designated SEQ ID:1909, to the nucleotide sequence of GAM3418 RNA, herein designated GAM RNA, also designated SEQ ID:291.

Another function of GAM3418 is therefore inhibition of PP1665 (Accession NP_110419.3). Accordingly, utilities of GAM3418 include diagnosis, prevention and treatment of diseases and clinical conditions associated with PP1665.

Protein tyrosine phosphatase, non-receptor type 11 (noonan syndrome 1) (PTPN11, Accession NP_002825.2) is another GAM3418 target gene, herein designated TARGET GENE. PTPN11 BINDING SITE is a target binding site found in the 3' untranslated region of multiple transcripts of mRNA encoded by PTPN11, corresponding to a target binding site such as BINDING SITE I, BINDING SITE II or BINDING SITE III of FIG. 8. Table 4 illustrates the complementarity of the nucleotide sequences of PTPN11 BINDING SITE, designated SEQ ID:13861, to the nucleotide sequence of GAM3418 RNA, herein designated GAM RNA, also designated SEQ ID:291.

Another function of GAM3418 is therefore inhibition of Protein tyrosine phosphatase, non-receptor type 11 (noonan syndrome 1) (PTPN11, Accession NP_002825.2). Accordingly, utilities of GAM3418 include diagnosis, prevention and treatment of diseases and clinical conditions associated with PTPN11.

Rab17, member ras oncogene family (RAB17, Accession NP_071894.1) is another GAM3418 target gene, herein designated TARGET GENE. RAB17 BINDING SITE is a target binding site found in the 3' untranslated region of mRNA encoded by RAB17, corresponding to a target binding site such as BINDING SITE I, BINDING SITE II or BINDING SITE III of FIG. 8. Table 4 illustrates the complementarity of the nucleotide sequences of RAB17 BINDING SITE, designated SEQ ID:16304, to the nucleotide sequence of GAM3418 RNA, herein designated GAM RNA, also designated SEQ ID:291.

Another function of GAM3418 is therefore inhibition of Rab17, member ras oncogene family (RAB17, Accession NP_071894.1). Accordingly, utilities of GAM3418 include diagnosis, prevention and treatment of diseases and clinical conditions associated with RAB17.

SWAP70 (Accession XP_049197.2) is another GAM3418 target gene, herein designated TARGET GENE. SWAP70 BINDING SITE is a target binding site found in the 3' untranslated region of multiple transcripts of mRNA encoded by SWAP70, corresponding to a target binding site such as BINDING SITE I, BINDING SITE II or BINDING SITE III of FIG. 8. Table 4 illustrates the complementarity of the nucleotide sequences of SWAP70 BINDING SITE, designated SEQ ID:18354, to the nucleotide sequence of GAM3418 RNA, herein designated GAM RNA, also designated SEQ ID:291.

Another function of GAM3418 is therefore inhibition of SWAP70 (Accession XP_049197.2), a gene which is involved not only in nuclear events but also in signaling in B-cell activation. Accordingly, utilities of GAM3418 include diagnosis, prevention and treatment of diseases and clinical conditions associated with SWAP70.

The function of SWAP70 and its association with various diseases and clinical conditions, has been established by previous studies, as described hereinabove with reference to GAM257.1. SWAP70 (Accession NP_055870.1) is another GAM3418 target gene, herein designated TARGET GENE. SWAP70 BINDING SITE is a target binding site found in the 3' untranslated region of multiple transcripts of mRNA encoded by SWAP70, corresponding to a target binding site such as BINDING SITE I, BINDING SITE II or BINDING SITE III of FIG. 8. Table 4 illustrates the complementarity of the nucleotide sequences of SWAP70 BINDING SITE, designated SEQ ID:18354, to the nucleotide sequence of GAM3418 RNA, herein designated GAM RNA, also designated SEQ ID:291.

Another function of GAM3418 is therefore inhibition of SWAP70 (Accession NP_055870.1), a gene which is involved not only in nuclear events but also in signaling in B-cell activation. Accordingly, utilities of GAM3418 include diagnosis, prevention and treatment of diseases and clinical conditions associated with SWAP70.

The function of SWAP70 and its association with various diseases and clinical conditions, has been established by previous studies, as described hereinabove with reference to GAM257.1. Wolf-hirschhorn syndrome candidate 1 (WHSC1, Accession NP_055734.1) is another GAM3418 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:13876, to the nucleotide sequence of GAM3418 RNA, herein designated GAM RNA, also designated SEQ ID:291.

Another function of GAM3418 is therefore inhibition of Wolf-hirschhorn syndrome candidate 1 (WHSC1, Accession NP_055734.1), a gene which binds covalently to and repairs g/t mismatches. and therefore may be associated with Wolf-hirschhorn syndrome. Accordingly, utilities of GAM3418 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Zinc finger protein 323 (ZNF323, Accession NP_112161.2) is another GAM3418 target gene, herein designated TARGET GENE. ZNF323 BINDING SITE is a target binding site found in the 3' untranslated region of mRNA encoded by ZNF323, corresponding to a target binding site such as BINDING SITE I, BINDING SITE II or BINDING SITE III of FIG. 8. Table 4 illustrates the complementarity of the nucleotide sequences of ZNF323 BINDING SITE, designated SEQ ID:11866, to the nucleotide sequence of GAM3418 RNA, herein designated GAM RNA, also designated SEQ ID:291.

Another function of GAM3418 is therefore inhibition of Zinc finger protein 323 (ZNF323, Accession NP_112161.2). Accordingly, utilities of GAM3418 include diagnosis, prevention and treatment of diseases and clinical conditions associated with ZNF323.

Zinc finger protein 336 (ZNF336, Accession NP_071927.1) is another GAM3418 target gene, herein designated TARGET GENE. ZNF336 BINDING SITE is a target binding site found in the 3' untranslated region of mRNA encoded by ZNF336, corresponding to a target binding site such as BINDING SITE I, BINDING SITE II or BINDING SITE III of FIG. 8. Table 4 illustrates the complementarity of the nucleotide sequences of ZNF336 BINDING SITE, designated SEQ ID:11914, to the nucleotide sequence of GAM3418 RNA, herein designated GAM RNA, also designated SEQ ID:291.

Another function of GAM3418 is therefore inhibition of Zinc finger protein 336 (ZNF336, Accession NP_071927.1). Accordingly, utilities of GAM3418 include diagnosis, prevention and treatment of diseases and clinical conditions associated with ZNF336.

FIG. 8 further provides a conceptual description of a novel bioinformatically detected of the present invention, referred to here as Genomic Address Messenger 3431 (GAM3431), which modulates expression of respective target genes thereof, the function and utility of which target genes is known in the art.

GAM3431 is a novel bioinformatically detected regulatory, non protein coding, micro RNA (miRNA) gene. The method by which GAM3431 was detected is described hereinabove with reference to FIGS. 8-15.

GAM3431 gene, herein designated GAM GENE, and GAM3431 target gene, herein designated TARGET GENE, are human genes contained in the human genome.

GAM3431 gene encodes a GAM3431 precursor RNA, herein designated GAM PRECURSOR RNA. Similar to other miRNA genes, and unlike most ordinary genes, GAM3431 precursor RNA does not encode a protein. A nucleotide sequence identical or highly similar to the nucleotide sequence of GAM3431 precursor RNA is designated SEQ ID:105, and is provided hereinbelow with reference to the sequence listing part. Nucleotide sequence SEQ ID:105 is located at position 6952115 relative to chromosome 12.

GAM3431 precursor RNA folds onto itself, forming GAM3431 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM3431 precursor RNA folds onto itself, forming GAM3431 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM3431 precursor RNA, designated SEQ-ID:105, and a schematic representation of a predicted secondary folding of GAM3431 folded precursor RNA are further described with reference to Table 2, hereby incorporated by reference.

An enzyme complex designated DICER COMPLEX, 'dices' the GAM3431 folded precursor RNA into GAM3431 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM3431 RNA is designated SEQ ID:356, and is provided hereinbelow with references to the sequence listing part and Table 3, hereby incorporated by reference.

GAM3431 target gene, herein designated TARGET GENE, encodes a corresponding messenger RNA, GAM3431 target RNA, herein designated GAM TARGET RNA. GAM3431 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM3431 RNA, herein designated GAM RNA, binds complementarily to one or more target binding sites located in untranslated regions of GAM3431 target RNA, herein designated GAM TARGET RNA. This complementary binding is due to the fact that the nucleotide sequence of GAM3431 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM3431 RNA may have a different number of target binding sites in untranslated regions of a GAM3431 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM3431 RNA, herein designated GAM RNA, to target binding sites on GAM3431 target RNA, herein designated GAM TARGET RNA, such as BINDING SITE I, BINDING SITE II and BINDING SITE III, inhibits translation of GAM3431 target RNA into GAM3431 target protein, herein designated GAM TARGET PROTEIN. GAM target protein is therefore outlined by a broken line.

It is appreciated that GAM3431 target gene, herein designated TARGET GENE, in fact represents a plurality of GAM3431 target genes. The mRNA of each one of this plurality of GAM3431 target genes comprises one or more target binding sites, each having a nucleotide sequence which is at least partly complementary to GAM3431 RNA, herein designated GAM RNA, and which when bound by GAM3431 RNA causes inhibition of translation of respective one or more GAM3431 target proteins.

It is further appreciated by one skilled in the art that the mode of translational inhibition illustrated by FIG. 8 with specific reference to translational inhibition exerted by GAM3431 gene, herein designated GAM GENE, on one or more GAM3431 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM3431 correlate with, and may be deduced from, the identity of the target genes which GAM3431 binds and inhibits, and the function of these target genes, as elaborated hereinbelow.

A2BP1 (Accession NP_665900.1) is a GAM3431 target gene, herein designated TARGET GENE. A2BP1 BINDING SITE is a target binding site found in the 3' untranslated region of multiple transcripts of mRNA encoded by A2BP1, corresponding to a target binding site such as BINDING SITE I, BINDING SITE II or BINDING SITE III of FIG. 8. Table 4 illustrates the complementarity of the nucleotide sequences of A2BP1 BINDING SITE, designated SEQ ID:7176, to the nucleotide sequence of GAM3431 RNA, herein designated GAM RNA, also designated SEQ ID:356.

A function of GAM3431 is therefore inhibition of A2BP1 (Accession NP_665900.1). Accordingly, utilities of GAM3431 include diagnosis, prevention and treatment of diseases and clinical conditions associated with A2BP1.

A2BP1 (Accession NP_665898.1) is another GAM3431 target gene, herein designated TARGET GENE. A2BP1 BINDING SITE is a target binding site found in the 3' untranslated region of multiple transcripts of mRNA encoded by A2BP1, corresponding to a target binding site such as BINDING SITE I, BINDING SITE II or BINDING SITE III of FIG. 8. Table 4 illustrates the complementarity of the nucleotide sequences of A2BP1 BINDING SITE, designated SEQ ID:7176, to the nucleotide sequence of GAM3431 RNA, herein designated GAM RNA, also designated SEQ ID:356.

Another function of GAM3431 is therefore inhibition of A2BP1 (Accession NP_665898.1). Accordingly, utilities of GAM3431 include diagnosis, prevention and treatment of diseases and clinical conditions associated with A2BP1.

A2BP1 (Accession NP_665899.1) is another GAM3431 target gene, herein designated TARGET GENE. A2BP1 BINDING SITE is a target binding site found in the 3' untranslated region of multiple transcripts of mRNA encoded by A2BP1, corresponding to a target binding site such as BINDING SITE I, BINDING SITE II or BINDING SITE III of FIG. 8. Table 4 illustrates the complementarity of the nucleotide sequences of A2BP1 BINDING SITE, designated SEQ ID:7176, to the nucleotide sequence of GAM3431 RNA, herein designated GAM RNA, also designated SEQ ID:356.

Another function of GAM3431 is therefore inhibition of A2BP1 (Accession NP_665899.1). Accordingly, utilities of GAM3431 include diagnosis, prevention and treatment of diseases and clinical conditions associated with A2BP1.

Atp-binding cassette, sub-family c (cftr/mrp), member 13 (ABCC13, Accession NP_620054.1) is another GAM3431 target gene, herein designated TARGET GENE. ABCC13 BINDING SITE is a target binding site found in the 3' untranslated region of multiple transcripts of mRNA encoded by ABCC13, corresponding to a target binding site such as BINDING SITE I, BINDING SITE II or BINDING SITE III of FIG. 8. Table 4 illustrates the complementarity of the nucleotide sequences of ABCC13 BINDING SITE, designated SEQ ID:13374, to the nucleotide sequence of GAM3431 RNA, herein designated GAM RNA, also designated SEQ ID:356.

Another function of GAM3431 is therefore inhibition of Atp-binding cassette, sub-family c (cftr/mrp), member 13 (ABCC13, Accession NP_620054.1). Accordingly, utilities of GAM3431 include diagnosis, prevention and treatment of diseases and clinical conditions associated with ABCC13.

Ras homolog gene family, member e (ARHE, Accession NP_005159.1) is another GAM3431 target gene, herein designated TARGET GENE. ARHE BINDING SITE is a target binding site found in the 3' untranslated region of mRNA encoded by ARHE, corresponding to a target binding site such as BINDING SITE I, BINDING SITE II or BINDING SITE III of FIG. 8. Table 4 illustrates the complementarity of the nucleotide sequences of ARHE BINDING SITE, designated SEQ ID:4853, to the nucleotide sequence of GAM3431 RNA, herein designated GAM RNA, also designated SEQ ID:356.

Another function of GAM3431 is therefore inhibition of Ras homolog gene family, member e (ARHE, Accession NP_005159.1). Accordingly, utilities of GAM3431 include diagnosis, prevention and treatment of diseases and clinical conditions associated with ARHE.

Chromosome 3 open reading frame 4 (C3orf4, Accession NP_063948.1) is another GAM3431 target gene, herein designated TARGET GENE. C3orf4 BINDING SITE is a target binding site found in the 3' untranslated region of mRNA encoded by C3orf4, corresponding to a target binding site such as BINDING SITE I, BINDING SITE II or BINDING SITE III of FIG. 8. Table 4 illustrates the complementarity of the nucleotide sequences of C3orf4 BINDING SITE, designated SEQ ID:12739, to the nucleotide sequence of GAM3431 RNA, herein designated GAM RNA, also designated SEQ ID:356.

Another function of GAM3431 is therefore inhibition of Chromosome 3 open reading frame 4 (C3orf4, Accession NP_063948.1). Accordingly, utilities of GAM3431 include diagnosis, prevention and treatment of diseases and clinical conditions associated with C3orf4.

Cd59 antigen p18-20 (antigen identified by monoclonal antibodies 16.3a5, ej16, ej30, el32 and g344) (CD59, Accession NP_000602.1) is another GAM3431 target gene, herein designated TARGET GENE. CD59 BINDING SITE is a target binding site found in the 3' untranslated region of mRNA encoded by CD59, corresponding to a target binding site such as BINDING SITE I, BINDING SITE II or BINDING SITE III of FIG. 8. Table 4 illustrates the complementarity of the nucleotide sequences of CD59 BINDING SITE, designated SEQ ID:18546, to the nucleotide sequence of GAM3431 RNA, herein designated GAM RNA, also designated SEQ ID:356.

Another function of GAM3431 is therefore inhibition of Cd59 antigen p18-20 (antigen identified by monoclonal antibodies 16.3a5, ej16, ej30, el32 and g344) (CD59, Accession NP_000602.1), a gene which restricts lysis of human erythrocytes and leukocytes by homologous complement. and therefore may be associated with Cd59 deficiency (hemolytic anemia and thrombosis). Accordingly, utilities of GAM3431 include diagnosis, prevention and treatment of Cd59 deficiency (hemolytic anemia and thrombosis), and of other diseases and clinical conditions associated with CD59.

The function of CD59 and its association with various diseases and clinical conditions, has been established by previous studies, as described hereinabove with reference to GAM401.1. DKFZP434G1411 (Accession XP_166383.1) is another GAM3431 target gene, herein designated TARGET GENE. DKFZP434G1411 BINDING SITE is a target binding site found in the 3' untranslated region of mRNA encoded by DKFZP434G1411, corresponding to a target binding site such as BINDING SITE I, BINDING SITE II or BINDING SITE III of FIG. 8. Table 4 illustrates the complementarity of the nucleotide sequences of DKFZP434G1411 BINDING SITE, designated SEQ ID:13982, to the nucleotide sequence of GAM3431 RNA, herein designated GAM RNA, also designated SEQ ID:356.

Another function of GAM3431 is therefore inhibition of DKFZP434G1411 (Accession XP_166383.1). Accordingly, utilities of GAM3431 include diagnosis, prevention and treatment of diseases and clinical conditions associated with DKFZP434G1411.

DKFZP564I0422 (Accession NP_113623.1) is another GAM3431 target gene, herein designated TARGET GENE. DKFZP564I0422 BINDING SITE is a target binding site found in the 3' untranslated region of mRNA encoded by DKFZP564I0422, corresponding to a target binding site such as BINDING SITE I, BINDING SITE II or BINDING SITE III of FIG. 8. Table 4 illustrates the complementarity of the nucleotide sequences of DKFZP564I0422 BINDING SITE, designated SEQ ID:3040, to the nucleotide sequence of GAM3431 RNA, herein designated GAM RNA, also designated SEQ ID:356.

Another function of GAM3431 is therefore inhibition of DKFZP564I0422 (Accession NP_113623.1). Accordingly, utilities of GAM3431 include diagnosis, prevention and treatment of diseases and clinical conditions associated with DKFZP564I0422.

FAT3 (Accession XP_061871.5) is another GAM3431 target gene, herein designated TARGET GENE. FAT3 BINDING SITE is a target binding site found in the 3' untranslated region of mRNA encoded by FAT3, corresponding to a target binding site such as BINDING SITE I, BINDING SITE II or BINDING SITE III of FIG. 8. Table 4 illustrates the complementarity of the nucleotide sequences of FAT3 BINDING SITE, designated SEQ ID:3238, to the nucleotide sequence of GAM3431 RNA, herein designated GAM RNA, also designated SEQ ID:356.

Another function of GAM3431 is therefore inhibition of FAT3 (Accession XP_061871.5). Accordingly, utilities of GAM3431 include diagnosis, prevention and treatment of diseases and clinical conditions associated with FAT3.

FLJ13197 (Accession NP_078890.1) is another GAM3431 target gene, herein designated TARGET GENE. FLJ13197 BINDING SITE is a target binding site found in the 3' untranslated region of mRNA encoded by FLJ13197, corresponding to a target binding site such as BINDING SITE I, BINDING SITE II or BINDING SITE III of FIG. 8. Table 4 illustrates the complementarity of the nucleotide sequences of FLJ13197 BINDING SITE, designated SEQ ID:14915, to the nucleotide sequence of GAM3431 RNA, herein designated GAM RNA, also designated SEQ ID:356.

Another function of GAM3431 is therefore inhibition of FLJ13197 (Accession NP_078890.1). Accordingly, utilities of GAM3431 include diagnosis, prevention and treatment of diseases and clinical conditions associated with FLJ13197.

FLJ32191 (Accession NP_653290.2) is another GAM3431 target gene, herein designated TARGET GENE. FLJ32191 BINDING SITE is a target binding site found in the 3' untranslated region of mRNA encoded by FLJ32191, corresponding to a target binding site such as BINDING SITE I, BINDING SITE II or BINDING SITE III of FIG. 8. Table 4 illustrates the complementarity of the nucleotide sequences of FLJ32191 BINDING SITE, designated SEQ ID:4685, to the nucleotide sequence of GAM3431 RNA, herein designated GAM RNA, also designated SEQ ID:356.

Another function of GAM3431 is therefore inhibition of FLJ32191 (Accession NP_653290.2). Accordingly, utilities of GAM3431 include diagnosis, prevention and treatment of diseases and clinical conditions associated with FLJ32191.

FLJ33918 (Accession NP_689620.1) is another GAM3431 target gene, herein designated TARGET GENE. FLJ33918 BINDING SITE is a target binding site found in the 3' untranslated region of mRNA encoded by FLJ33918, corresponding to a target binding site such as BINDING SITE I, BINDING SITE II or BINDING SITE III of FIG. 8. Table 4 illustrates the complementarity of the nucleotide sequences of FLJ33918 BINDING SITE, designated SEQ ID:9000, to the nucleotide sequence of GAM3431 RNA, herein designated GAM RNA, also designated SEQ ID:356.

Another function of GAM3431 is therefore inhibition of FLJ33918 (Accession NP_689620.1). Accordingly, utilities of GAM3431 include diagnosis, prevention and treatment of diseases and clinical conditions associated with FLJ33918.

FLJ40298 (Accession XP_059377.5) is another GAM3431 target gene, herein designated TARGET GENE. FLJ40298 BINDING SITE is a target binding site found in the 3' untranslated region of mRNA encoded by FLJ40298, corresponding to a target binding site such as BINDING SITE I, BINDING SITE II or BINDING SITE III of FIG. 8. Table 4 illustrates the complementarity of the nucleotide sequences of FLJ40298 BINDING SITE, designated SEQ ID:6666, to the nucleotide sequence of GAM3431 RNA, herein designated GAM RNA, also designated SEQ ID:356.

Another function of GAM3431 is therefore inhibition of FLJ40298 (Accession XP_059377.5). Accordingly, utilities of GAM3431 include diagnosis, prevention and treatment of diseases and clinical conditions associated with FLJ40298.

Forkhead box p1 (FOXP1, Accession NP_116071.2) is another GAM3431 target gene, herein designated TARGET GENE. FOXP1 BINDING SITE is a target binding site found in the 3' untranslated region of mRNA encoded by FOXP1, corresponding to a target binding site such as BINDING SITE I, BINDING SITE II or BINDING SITE III of FIG. 8. Table 4 illustrates the complementarity of the nucleotide sequences of FOXP1 BINDING SITE, designated SEQ ID:7666, to the nucleotide sequence of GAM3431 RNA, herein designated GAM RNA, also designated SEQ ID:356.

Another function of GAM3431 is therefore inhibition of Forkhead box p1 (FOXP1, Accession NP_116071.2). Accordingly, utilities of GAM3431 include diagnosis, prevention and treatment of diseases and clinical conditions associated with FOXP1.

HSPC177 (Accession NP_057494.2) is another GAM3431 target gene, herein designated TARGET GENE. HSPC177 BINDING SITE is a target binding site found in the 3' untranslated region of mRNA encoded by HSPC177, corresponding to a target binding site such as BINDING SITE I, BINDING SITE II or BINDING SITE III of FIG. 8. Table 4 illustrates the complementarity of the nucleotide sequences of HSPC177 BINDING SITE, designated SEQ ID:19777, to the nucleotide sequence of GAM3431 RNA, herein designated GAM RNA, also designated SEQ ID:356.

Another function of GAM3431 is therefore inhibition of HSPC177 (Accession NP_057494.2). Accordingly, utilities of GAM3431 include diagnosis, prevention and treatment of diseases and clinical conditions associated with HSPC177.

KIAA1155 (Accession XP_030864.2) is another GAM3431 target gene, herein designated TARGET GENE. KIAA1155 BINDING SITE is a target binding site found in the 3' untranslated region of mRNA encoded by KIAA1155, corresponding to a target binding site such as BINDING SITE I, BINDING SITE II or BINDING SITE III of FIG. 8. Table 4 illustrates the complementarity of the nucleotide sequences of KIAA1155 BINDING SITE, designated SEQ ID:2654, to the nucleotide sequence of GAM3431 RNA, herein designated GAM RNA, also designated SEQ ID:356.

Another function of GAM3431 is therefore inhibition of KIAA1155 (Accession XP_030864.2). Accordingly, utilities of GAM3431 include diagnosis, prevention and treatment of diseases and clinical conditions associated with KIAA1155.

KIAA1432 (Accession XP_039698.3) is another GAM3431 target gene, herein designated TARGET GENE. KIAA1432 BINDING SITE is a target binding site found in the 3' untranslated region of mRNA encoded by KIAA1432, corresponding to a target binding site such as BINDING SITE I, BINDING SITE II or BINDING SITE III of FIG. 8. Table 4 illustrates the complementarity of the nucleotide sequences of KIAA1432 BINDING SITE, designated SEQ ID:18507, to the nucleotide sequence of GAM3431 RNA, herein designated GAM RNA, also designated SEQ ID:356.

Another function of GAM3431 is therefore inhibition of KIAA1432 (Accession XP_039698.3). Accordingly, utilities of GAM3431 include diagnosis, prevention and treatment of diseases and clinical conditions associated with KIAA1432.

KIAA1576 (Accession NP_065978.1) is another GAM3431 target gene, herein designated TARGET GENE. KIAA1576 BINDING SITE is a target binding site found in the 3' untranslated region of mRNA encoded by KIAA1576, corresponding to a target binding site such as BINDING SITE I, BINDING SITE II or BINDING SITE III of FIG. 8. Table 4 illustrates the complementarity of the nucleotide sequences of KIAA1576 BINDING SITE, designated SEQ ID:4405, to the nucleotide sequence of GAM3431 RNA, herein designated GAM RNA, also designated SEQ ID:356.

Another function of GAM3431 is therefore inhibition of KIAA1576 (Accession NP_065978.1). Accordingly, utilities of GAM3431 include diagnosis, prevention and treatment of diseases and clinical conditions associated with KIAA1576.

KIAA1587 (Accession NP_065983.1) is another GAM3431 target gene, herein designated TARGET GENE. KIAA1587 BINDING SITE is a target binding site found in the 5' untranslated region of mRNA encoded by KIAA1587, corresponding to a target binding site such as BINDING SITE I, BINDING SITE II or BINDING SITE III of FIG. 8. Table 4 illustrates the complementarity of the nucleotide sequences of KIAA1587 BINDING SITE, designated SEQ ID:10648, to the nucleotide sequence of GAM3431 RNA, herein designated GAM RNA, also designated SEQ ID:356.

Another function of GAM3431 is therefore inhibition of KIAA1587 (Accession NP_065983.1). Accordingly, utilities of GAM3431 include diagnosis, prevention and treatment of diseases and clinical conditions associated with KIAA1587.

KIAA1673 (Accession XP_047672.4) is another GAM3431 target gene, herein designated TARGET GENE. KIAA1673 BINDING SITE is a target binding site found in the 3' untranslated region of mRNA encoded by KIAA1673, corresponding to a target binding site such as BINDING SITE I, BINDING SITE II or BINDING SITE III of FIG. 8. Table 4 illustrates the complementarity of the nucleotide sequences of KIAA1673 BINDING SITE, designated SEQ ID:17033, to the nucleotide sequence of GAM3431 RNA, herein designated GAM RNA, also designated SEQ ID:356.

Another function of GAM3431 is therefore inhibition of KIAA1673 (Accession XP_047672.4). Accordingly, utilities of GAM3431 include diagnosis, prevention and treatment of diseases and clinical conditions associated with KIAA1673.

Kelch-like 3 (drosophila) (KLHL3, Accession NP_059111.1) is another GAM3431 target gene, herein designated TARGET GENE. KLHL3 BINDING SITE is a target binding site found in the 3' untranslated region of mRNA encoded by KLHL3, corresponding to a target binding site such as BINDING SITE I, BINDING SITE II or BINDING SITE III of FIG. 8. Table 4 illustrates the complementarity of the nucleotide sequences of KLHL3 BINDING SITE, designated SEQ ID:2902, to the nucleotide sequence of GAM3431 RNA, herein designated GAM RNA, also designated SEQ ID:356.

Another function of GAM3431 is therefore inhibition of Kelch-like 3 (drosophila) (KLHL3, Accession NP_059111.1). Accordingly, utilities of GAM3431 include diagnosis, prevention and treatment of diseases and clinical conditions associated with KLHL3.

LOC126669 (Accession XP_060121.4) is another GAM3431 target gene, herein designated TARGET GENE. LOC126669 BINDING SITE is a target binding site found in the 3' untranslated region of mRNA encoded by LOC126669, corresponding to a target binding site such as BINDING SITE I, BINDING SITE II or BINDING SITE III of FIG. 8. Table 4 illustrates the complementarity of the nucleotide sequences of LOC126669 BINDING SITE, designated SEQ ID:8765, to the nucleotide sequence of GAM3431 RNA, herein designated GAM RNA, also designated SEQ ID:356.

Another function of GAM3431 is therefore inhibition of LOC126669 (Accession XP_060121.4). Accordingly, utilities of GAM3431 include diagnosis, prevention and treatment of diseases and clinical conditions associated with LOC126669.

LOC144874 (Accession XP_096696.1) is another GAM3431 target gene, herein designated TARGET GENE. LOC144874 BINDING SITE is a target binding site found in the 5' untranslated region of mRNA encoded by LOC144874, corresponding to a target binding site such as BINDING SITE I, BINDING SITE II or BINDING SITE III of FIG. 8. Table 4 illustrates the complementarity of the nucleotide sequences of LOC144874 BINDING SITE, designated SEQ ID:552, to the nucleotide sequence of GAM3431 RNA, herein designated GAM RNA, also designated SEQ ID:356.

Another function of GAM3431 is therefore inhibition of LOC144874 (Accession XP_096696.1). Accordingly, utilities of GAM3431 include diagnosis, prevention and treatment of diseases and clinical conditions associated with LOC144874.

LOC150587 (Accession XP_097917.1) is another GAM3431 target gene, herein designated TARGET GENE. LOC150587 BINDING SITE is a target binding site found in the 5' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:6328, to the nucleotide sequence of GAM3431 RNA, herein designated GAM RNA, also designated SEQ ID:356.

Another function of GAM3431 is therefore inhibition of LOC150587 (Accession XP_097917.1). Accordingly, utilities of GAM3431 include diagnosis, prevention and treatment of diseases and clinical conditions associated with LOC150587.

LOC254532 (Accession XP_172961.1) is another GAM3431 target gene, herein designated TARGET GENE. LOC254532 BINDING SITE is a target binding site found in the 5' untranslated region of mRNA encoded by LOC254532, corresponding to a target binding site such as BINDING SITE I, BINDING SITE II or BINDING SITE III of FIG. 8. Table 4 illustrates the complementarity of the nucleotide sequences of LOC254532 BINDING SITE, designated SEQ ID:18418, to the nucleotide sequence of GAM3431 RNA, herein designated GAM RNA, also designated SEQ ID:356.

Another function of GAM3431 is therefore inhibition of LOC254532 (Accession XP_172961.1). Accordingly, utilities of GAM3431 include diagnosis, prevention and treatment of diseases and clinical conditions associated with LOC254532.

LOC283053 (Accession XP_210869.1) is another GAM3431 target gene, herein designated TARGET GENE. LOC283053 BINDING SITE is a target binding site found in the 5' untranslated region of mRNA encoded by LOC283053, corresponding to a target binding site such as BINDING SITE I, BINDING SITE II or BINDING SITE III of FIG. 8. Table 4 illustrates the complementarity of the nucleotide sequences of LOC283053 BINDING SITE, designated SEQ ID:6480, to the nucleotide sequence of GAM3431 RNA, herein designated GAM RNA, also designated SEQ ID:356.

Another function of GAM3431 is therefore inhibition of LOC283053 (Accession XP_210869.1). Accordingly, utilities of GAM3431 include diagnosis, prevention and treatment of diseases and clinical conditions associated with LOC283053.

LOC284317 (Accession XP_209162.1) is another GAM3431 target gene, herein designated TARGET GENE. LOC284317 BINDING SITE is a target binding site found in the 3' untranslated region of mRNA encoded by LOC284317, corresponding to a target binding site such as BINDING SITE I, BINDING SITE II or BINDING SITE III of FIG. 8. Table 4 illustrates the complementarity of the nucleotide sequences of LOC284317 BINDING SITE, designated SEQ ID:4230, to the nucleotide sequence of GAM3431 RNA, herein designated GAM RNA, also designated SEQ ID:356.

Another function of GAM3431 is therefore inhibition of LOC284317 (Accession XP_209162.1). Accordingly, utilities of GAM3431 include diagnosis, prevention and treatment of diseases and clinical conditions associated with LOC284317.

LOC284325 (Accession XP_209143.1) is another GAM3431 target gene, herein designated TARGET GENE. LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:10520, to the nucleotide sequence of GAM3431 RNA, herein designated GAM RNA, also designated SEQ ID:356.

Another function of GAM3431 is therefore inhibition of LOC284325 (Accession XP_209143.1). Accordingly, utilities of GAM3431 include diagnosis, prevention and treatment of diseases and clinical conditions associated with LOC284325.

LOC285082 (Accession XP_211759.1) is another GAM3431 target gene, herein designated TARGET GENE. LOC285082 BINDING SITE is a target binding site found in the 3' untranslated region of mRNA encoded by LOC285082, corresponding to a target binding site such as BINDING SITE I, BINDING SITE II or BINDING SITE III of FIG. 8. Table 4 illustrates the complementarity of the nucleotide sequences of LOC285082 BINDING SITE, designated SEQ ID:19819, to the nucleotide sequence of GAM3431 RNA, herein designated GAM RNA, also designated SEQ ID:356.

Another function of GAM3431 is therefore inhibition of LOC285082 (Accession XP_211759.1). Accordingly, utilities of GAM3431 include diagnosis, prevention and treatment of diseases and clinical conditions associated with LOC285082.

LOC285147 (Accession XP_211784.1) is another GAM3431 target gene, herein designated TARGET GENE. LOC285147 BINDING SITE is a target binding site found in the 3' untranslated region of mRNA encoded by LOC285147, corresponding to a target binding site such as BINDING SITE I, BINDING SITE II or BINDING SITE III of FIG. 8. Table 4 illustrates the complementarity of the nucleotide sequences of LOC285147 BINDING SITE, designated SEQ ID:6394, to the nucleotide sequence of GAM3431 RNA, herein designated GAM RNA, also designated SEQ ID:356.

Another function of GAM3431 is therefore inhibition of LOC285147 (Accession XP_211784.1). Accordingly, utilities of GAM3431 include diagnosis, prevention and treatment of diseases and clinical conditions associated with LOC285147.

LOC286416 (Accession XP_210041.1) is another GAM3431 target gene, herein designated TARGET GENE. LOC286416 BINDING SITE is a target binding site found in the 5' untranslated region of mRNA encoded by LOC286416, corresponding to a target binding site such as BINDING SITE I, BINDING SITE II or BINDING SITE III of FIG. 8. Table 4 illustrates the complementarity of the nucleotide sequences of LOC286416 BINDING SITE, designated SEQ ID:494, to the nucleotide sequence of GAM3431 RNA, herein designated GAM RNA, also designated SEQ ID:356.

Another function of GAM3431 is therefore inhibition of LOC286416 (Accession XP_210041.1). Accordingly, utilities of GAM3431 include diagnosis, prevention and treatment of diseases and clinical conditions associated with LOC286416.

LOC339987 (Accession XP_295123.1) is another GAM3431 target gene, herein designated TARGET GENE. LOC339987 BINDING SITE is a target binding site found in the 3' untranslated region of mRNA encoded by LOC339987, corresponding to a target binding site such as BINDING SITE I, BINDING SITE II or BINDING SITE III of FIG. 8. Table 4 illustrates the complementarity of the nucleotide sequences of LOC339987 BINDING SITE, designated SEQ ID:6821, to the nucleotide sequence of GAM3431 RNA, herein designated GAM RNA, also designated SEQ ID:356.

Another function of GAM3431 is therefore inhibition of LOC339987 (Accession XP_295123.1). Accordingly, utilities of GAM3431 include diagnosis, prevention and treatment of diseases and clinical conditions associated with LOC339987.

MGC24180 (Accession NP_689565.1) is another GAM3431 target gene, herein designated TARGET GENE. MGC24180 BINDING SITE is a target binding site found in the 3' untranslated region of mRNA encoded by MGC24180, corresponding to a target binding site such as BINDING SITE I, BINDING SITE II or BINDING SITE III of FIG. 8. Table 4 illustrates the complementarity of the nucleotide sequences of MGC24180 BINDING SITE, designated SEQ ID:15915, to the nucleotide sequence of GAM3431 RNA, herein designated GAM RNA, also designated SEQ ID:356.

Another function of GAM3431 is therefore inhibition of MGC24180 (Accession NP_689565.1). Accordingly, utilities of GAM3431 include diagnosis, prevention and treatment of diseases and clinical conditions associated with MGC24180.

MGC50559 (Accession NP_776163.1) is another GAM3431 target gene, herein designated TARGET GENE. MGC50559 BINDING SITE is a target binding site found in the 3' untranslated region of mRNA encoded by MGC50559, corresponding to a target binding site such as BINDING SITE I, BINDING SITE II or BINDING SITE III of FIG. 8. Table 4 illustrates the complementarity of the nucleotide sequences of MGC50559 BINDING SITE, designated SEQ ID:4039, to the nucleotide sequence of GAM3431 RNA, herein designated GAM RNA, also designated SEQ ID:356.

Another function of GAM3431 is therefore inhibition of MGC50559 (Accession NP_776163.1). Accordingly, utilities of GAM3431 include diagnosis, prevention and treatment of diseases and clinical conditions associated with MGC50559.

Pim-2 oncogene (PIM2, Accession NP_006866.1) is another GAM3431 target gene, herein designated TARGET GENE. PIM2 BINDING SITE is a target binding site found in the 3' untranslated region of mRNA encoded by PIM2, corresponding to a target binding site such as BINDING SITE I, BINDING SITE II or BINDING SITE III of FIG. 8. Table 4 illustrates the complementarity of the nucleotide sequences of PIM2 BINDING SITE, designated SEQ ID:2828, to the nucleotide sequence of GAM3431 RNA, herein designated GAM RNA, also designated SEQ ID:356.

Another function of GAM3431 is therefore inhibition of Pim-2 oncogene (PIM2, Accession NP_006866.1). Accordingly, utilities of GAM3431 include diagnosis, prevention and treatment of diseases and clinical conditions associated with PIM2.

Peroxisome proliferative activated receptor, delta (PPARD, Accession NP_006229.1) is another GAM3431 target gene, herein designated TARGET GENE. PPARD BINDING SITE is a target binding site found in the 3' untranslated region of multiple transcripts of mRNA encoded by PPARD, corresponding to a target binding site such as BINDING SITE I, BINDING SITE II or BINDING SITE III of FIG. 8. Table 4 illustrates the complementarity of the nucleotide sequences of PPARD BINDING SITE, designated SEQ ID:10291, to the nucleotide sequence of GAM3431 RNA, herein designated GAM RNA, also designated SEQ ID:356.

Another function of GAM3431 is therefore inhibition of Peroxisome proliferative activated receptor, delta (PPARD, Accession NP_006229.1). Accordingly, utilities of GAM3431 include diagnosis, prevention and treatment of diseases and clinical conditions associated with PPARD.

Pleckstrin homology, sec7 and coiled/coil domains 3 (PSCD3, Accession NP_004218.1) is another GAM3431 target gene, herein designated TARGET GENE. PSCD3 BINDING SITE is a target binding site found in the 3' untranslated region of mRNA encoded by PSCD3, corresponding to a target binding site such as BINDING SITE I, BINDING SITE II or BINDING SITE III of FIG. 8. Table 4 illustrates the complementarity of the nucleotide sequences of PSCD3 BINDING SITE, designated SEQ ID:6586, to the nucleotide sequence of GAM3431 RNA, herein designated GAM RNA, also designated SEQ ID:356.

Another function of GAM3431 is therefore inhibition of Pleckstrin homology, sec7 and coiled/coil domains 3 (PSCD3, Accession NP_004218.1), a gene which regulates vesicle trafficking in eukaryotic cells. Accordingly, utilities of GAM3431 include diagnosis, prevention and treatment of diseases and clinical conditions associated with PSCD3.

The function of PSCD3 and its association with various diseases and clinical conditions, has been established by previous studies, as described hereinabove with reference to GAM650.2. Reelin (RELN, Accession NP_774959.1) is another GAM3431 target gene, herein designated TARGET GENE. RELN BINDING SITE is a target binding site found in the 3' untranslated region of multiple transcripts of mRNA encoded by RELN, corresponding to a target binding site such as BINDING SITE I, BINDING SITE II or BINDING SITE III of FIG. 8. Table 4 illustrates the complementarity of the nucleotide sequences of RELN BINDING SITE, designated SEQ ID:615, to the nucleotide sequence of GAM3431 RNA, herein designated GAM RNA, also designated SEQ ID:356.

Another function of GAM3431 is therefore inhibition of Reelin (RELN, Accession NP_774959.1), a gene which regulates microtubule function in neurons and neuronal migration. and therefore is associated with Norman-roberts syndrome. Accordingly, utilities of GAM3431 include diagnosis, prevention and treatment of Norman-roberts syndrome, and of other diseases and clinical conditions associated with RELN.

The function of RELN and its association with various diseases and clinical conditions, has been established by previous studies, as described hereinabove with reference to GAM700.2. Reelin (RELN, Accession NP_005036.2) is another GAM3431 target gene, herein designated TARGET GENE. RELN BINDING SITE is a target binding site found in the 3' untranslated region of multiple transcripts of mRNA encoded by RELN, corresponding to a target binding site such as BINDING SITE I, BINDING SITE II or BINDING SITE III of FIG. 8. Table 4 illustrates the complementarity of the nucleotide sequences of RELN BINDING SITE, designated SEQ ID:615, to the nucleotide sequence of GAM3431 RNA, herein designated GAM RNA, also designated SEQ ID:356.

Another function of GAM3431 is therefore inhibition of Reelin (RELN, Accession NP_005036.2), a gene which regulates microtubule function in neurons and neuronal migration. and therefore is associated with Norman-roberts syndrome. Accordingly, utilities of GAM3431 include diagnosis, prevention and treatment of Norman-roberts syndrome, and of other diseases and clinical conditions associated with RELN.

The function of RELN and its association with various diseases and clinical conditions, has been established by previous studies, as described hereinabove with reference to GAM700.2. Rna guanylyltransferase and 5'-phosphatase (RNGTT, Accession NP_003791.1) is another GAM3431 target gene, herein designated TARGET GENE. RNGTT BINDING SITE is a target binding site found in the 3' untranslated region of mRNA encoded by RNGTT, corresponding to a target binding site such as BINDING SITE I, BINDING SITE II or BINDING SITE III of FIG. 8. Table 4 illustrates the complementarity of the nucleotide sequences of RNGTT BINDING SITE, designated SEQ ID:19971, to the nucleotide sequence of GAM3431 RNA, herein designated GAM RNA, also designated SEQ ID:356.

Another function of GAM3431 is therefore inhibition of Rna guanylyltransferase and 5'-phosphatase (RNGTT, Accession NP_003791.1), a gene which is an MRNA capping enzyme; bifunctional enzyme containing both 5'-triphosphatase and mRNA guanylyltransferase activity. Accordingly, utilities of GAM3431 include diagnosis, prevention and treatment of diseases and clinical conditions associated with RNGTT.

The function of RNGTT and its association with various diseases and clinical conditions, has been established by previous studies, as described hereinabove with reference to GAM475.2. RTKN2 (Accession NP_660350.2) is another GAM3431 target gene, herein designated TARGET GENE. RTKN2 BINDING SITE is a target binding site found in the 3' untranslated region of mRNA encoded by RTKN2, corresponding to a target binding site such as BINDING SITE I, BINDING SITE II or BINDING SITE III of FIG. 8. Table 4 illustrates the complementarity of the nucleotide sequences of RTKN2 BINDING SITE, designated SEQ ID:8705, to the nucleotide sequence of GAM3431 RNA, herein designated GAM RNA, also designated SEQ ID:356.

Another function of GAM3431 is therefore inhibition of RTKN2 (Accession NP_660350.2). Accordingly, utilities of GAM3431 include diagnosis, prevention and treatment of diseases and clinical conditions associated with RTKN2.

Solute carrier family 25 (mitochondrial carrier, aralar), member 12 (SLC25A12, Accession NP_003696.2) is another GAM3431 target gene, herein designated TARGET GENE. SLC25A12 BINDING SITE is a target binding site found in the 3' untranslated region of mRNA encoded by SLC25A12, corresponding to a target binding site such as BINDING SITE I, BINDING SITE II or BINDING SITE III of FIG. 8. Table 4 illustrates the complementarity of the nucleotide sequences of SLC25A12 BINDING SITE, designated SEQ ID:801, to the nucleotide sequence of GAM3431 RNA, herein designated GAM RNA, also designated SEQ ID:356.

Another function of GAM3431 is therefore inhibition of Solute carrier family 25 (mitochondrial carrier, aralar), member 12 (SLC25A12, Accession NP_003696.2), a gene which is a calcium -dependent mitochondrial solute carrier.may have a function in the urea cycle (by similarity). Accordingly, utilities of GAM3431 include diagnosis, prevention and treatment of diseases and clinical conditions associated with SLC25A12.

The function of SLC25A12 and its association with various diseases and clinical conditions, has been established by previous studies, as described hereinabove with reference to GAM522.2. SNX16 (Accession NP_071416.2) is another GAM3431 target gene, herein designated TARGET GENE. SNX16 BINDING SITE is a target binding site found in the 3' untranslated region of multiple transcripts of mRNA encoded by SNX16, corresponding to a target binding site such as BINDING SITE I, BINDING SITE II or BINDING SITE III of FIG. 8. Table 4 illustrates the complementarity of the nucleotide sequences of SNX16 BINDING SITE, designated SEQ ID:9454, to the nucleotide sequence of GAM3431 RNA, herein designated GAM RNA, also designated SEQ ID:356.

Another function of GAM3431 is therefore inhibition of SNX16 (Accession NP_071416.2). Accordingly, utilities of GAM3431 include diagnosis, prevention and treatment of diseases and clinical conditions associated with SNX16.

SNX16 (Accession NP_690049.1) is another GAM3431 target gene, herein designated TARGET GENE. SNX16 BINDING SITE is a target binding site found in the 3' untranslated region of multiple transcripts of mRNA encoded by SNX16, corresponding to a target binding site such as BINDING SITE I, BINDING SITE II or BINDING SITE III of FIG. 8. Table 4 illustrates the complementarity of the nucleotide sequences of SNX16 BINDING SITE, designated SEQ ID:9454, to the nucleotide sequence of GAM3431 RNA, herein designated GAM RNA, also designated SEQ ID:356.

Another function of GAM3431 is therefore inhibition of SNX16 (Accession NP_690049.1). Accordingly, utilities of GAM3431 include diagnosis, prevention and treatment of diseases and clinical conditions associated with SNX16.

SNX16 (Accession NP_690050.1) is another GAM3431 target gene, herein designated TARGET GENE. SNX16 BINDING SITE is a target binding site found in the 3' untranslated region of multiple transcripts of mRNA encoded by SNX16, corresponding to a target binding site such as BINDING SITE I, BINDING SITE II or BINDING SITE III of FIG. 8. Table 4 illustrates the complementarity of the nucleotide sequences of SNX16 BINDING SITE, designated SEQ ID:9454, to the nucleotide sequence of GAM3431 RNA, herein designated GAM RNA, also designated SEQ ID:356.

Another function of GAM3431 is therefore inhibition of SNX16 (Accession NP_690050.1). Accordingly, utilities of GAM3431 include diagnosis, prevention and treatment of diseases and clinical conditions associated with SNX16.

SRGAP2 (Accession NP_055665.1) is another GAM3431 target gene, herein designated TARGET GENE. SRGAP2 BINDING SITE is a target binding site found in the 3' untranslated region of mRNA encoded by SRGAP2, corresponding to a target binding site such as BINDING SITE I, BINDING SITE II or BINDING SITE III of FIG. 8. Table 4 illustrates the complementarity of the nucleotide sequences of SRGAP2 BINDING SITE, designated SEQ ID:5806, to the nucleotide sequence of GAM3431 RNA, herein designated GAM RNA, also designated SEQ ID:356.

Another function of GAM3431 is therefore inhibition of SRGAP2 (Accession NP_055665.1). Accordingly, utilities of GAM3431 include diagnosis, prevention and treatment of diseases and clinical conditions associated with SRGAP2.

T-box 4 (TBX4, Accession NP_060958.2) is another GAM3431 target gene, herein designated TARGET GENE. TBX4 BINDING SITE is a target binding site found in the 3' untranslated region of mRNA encoded by TBX4, corresponding to a target binding site such as BINDING SITE I, BINDING SITE II or BINDING SITE III of FIG. 8. Table 4 illustrates the complementarity of the nucleotide sequences of TBX4 BINDING SITE, designated SEQ ID:19579, to the nucleotide sequence of GAM3431 RNA, herein designated GAM RNA, also designated SEQ ID:356.

Another function of GAM3431 is therefore inhibition of T-box 4 (TBX4, Accession NP_060958.2). Accordingly, utilities of GAM3431 include diagnosis, prevention and treatment of diseases and clinical conditions associated with TBX4.

Zinc finger protein 183-like 1 (ZNF183L1, Accession NP_849192.1) is another GAM3431 target gene, herein designated TARGET GENE. ZNF183L1 BINDING SITE is a target binding site found in the 3' untranslated region of mRNA encoded by ZNF183L1, corresponding to a target binding site such as BINDING SITE I, BINDING SITE II or BINDING SITE III of FIG. 8. Table 4 illustrates the complementarity of the nucleotide sequences of ZNF183L1 BINDING SITE, designated SEQ ID:13659, to the nucleotide sequence of GAM3431 RNA, herein designated GAM RNA, also designated SEQ ID:356.

Another function of GAM3431 is therefore inhibition of Zinc finger protein 183-like 1 (ZNF183L1, Accession NP_849192.1). Accordingly, utilities of GAM3431 include diagnosis, prevention and treatment of diseases and clinical conditions associated with ZNF183L1.

FIG. 8 further provides a conceptual description of a novel bioinformatically detected of the present invention, referred to here as Genomic Address Messenger 3499 (GAM3499), which modulates expression of respective target genes thereof, the function and utility of which target genes is known in the art.

GAM3499 is a novel bioinformatically detected regulatory, non protein coding, micro RNA (miRNA) gene. The method by which GAM3499 was detected is described hereinabove with reference to FIGS. 8-15.

GAM3499 gene, herein designated GAM GENE, and GAM3499 target gene, herein designated TARGET GENE, are human genes contained in the human genome.

GAM3499 gene encodes a GAM3499 precursor RNA, herein designated GAM PRECURSOR RNA. Similar to other miRNA genes, and unlike most ordinary genes, GAM3499 precursor RNA does not encode a protein. A nucleotide sequence identical or highly similar to the nucleotide sequence of GAM3499 precursor RNA is designated SEQ ID:38, and is provided hereinbelow with reference to the sequence listing part.

GAM3499 precursor RNA folds onto itself, forming GAM3499 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM3499 precursor RNA folds onto itself, forming GAM3499 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM3499 precursor RNA, designated SEQ-ID:38, and a schematic representation of a predicted secondary folding of GAM3499 folded precursor RNA are further described with reference to Table 2, hereby incorporated by reference.

An enzyme complex designated DICER COMPLEX, 'dices' the GAM3499 folded precursor RNA into GAM3499 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM3499 RNA is designated SEQ ID:226, and is provided hereinbelow with references to the sequence listing part and Table 3, hereby incorporated by reference.

GAM3499 target gene, herein designated TARGET GENE, encodes a corresponding messenger RNA, GAM3499 target RNA, herein designated GAM TARGET RNA. GAM3499 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM3499 RNA, herein designated GAM RNA, binds complementarily to one or more target binding sites located in untranslated regions of GAM3499 target RNA, herein designated GAM TARGET RNA. This complementary binding is due to the fact that the nucleotide sequence of GAM3499 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM3499 RNA may have a different number of target binding sites in untranslated regions of a GAM3499 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM3499 RNA, herein designated GAM RNA, to target binding sites on GAM3499 target RNA, herein designated GAM TARGET RNA, such as BINDING SITE I, BINDING SITE II and BINDING SITE III, inhibits translation of GAM3499 target RNA into GAM3499 target protein, herein designated GAM TARGET PROTEIN. GAM target protein is therefore outlined by a broken line.

It is appreciated that GAM3499 target gene, herein designated TARGET GENE, in fact represents a plurality of GAM3499 target genes. The mRNA of each one of this plurality of GAM3499 target genes comprises one or more target binding sites, each having a nucleotide sequence which is at least partly complementary to GAM3499 RNA, herein designated GAM RNA, and which when bound by GAM3499 RNA causes inhibition of translation of respective one or more GAM3499 target proteins.

It is further appreciated by one skilled in the art that the mode of translational inhibition illustrated by FIG. 8 with specific reference to translational inhibition exerted by GAM3499 gene, herein designated GAM GENE, on one or more GAM3499 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM3499 correlate with, and may be deduced from, the identity of the target genes which GAM3499 binds and inhibits, and the function of these target genes, as elaborated hereinbelow.

Agmatine ureohydrolase (agmatinase) (AGMAT, Accession NP_079034.2) is a GAM3499 target gene, herein designated TARGET GENE. AGMAT BINDING SITE is a target binding site found in the 3' untranslated region of mRNA encoded by AGMAT, corresponding to a target binding site such as BINDING SITE I, BINDING SITE II or BINDING SITE III of FIG. 8. Table 4 illustrates the complementarity of the nucleotide sequences of AGMAT BINDING SITE, designated SEQ ID:17623, to the nucleotide sequence of GAM3499 RNA, herein designated GAM RNA, also designated SEQ ID:226.

A function of GAM3499 is therefore inhibition of Agmatine ureohydrolase (agmatinase) (AGMAT, Accession NP_079034.2). Accordingly, utilities of GAM3499 include diagnosis, prevention and treatment of diseases and clinical conditions associated with AGMAT.

BTBD9 (Accession NP_689946.1) is another GAM3499 target gene, herein designated TARGET GENE. BTBD9 BINDING SITE is a target binding site found in the 5' untranslated region of mRNA encoded by BTBD9, corresponding to a target binding site such as BINDING SITE I, BINDING SITE II or BINDING SITE III of FIG. 8. Table 4 illustrates the complementarity of the nucleotide sequences of BTBD9 BINDING SITE, designated SEQ ID:1931, to the nucleotide sequence of GAM3499 RNA, herein designated GAM RNA, also designated SEQ ID:226.

Another function of GAM3499 is therefore inhibition of BTBD9 (Accession NP_689946.1). Accordingly, utilities of GAM3499 include diagnosis, prevention and treatment of diseases and clinical conditions associated with BTBD9.

C14orf117 (Accession NP_061148.1) is another GAM3499 target gene, herein designated TARGET GENE. C14orf117 BINDING SITE is a target binding site found in the 3' untranslated region of mRNA encoded by C14orf117, corresponding to a target binding site such as BINDING SITE I, BINDING SITE II or BINDING SITE III of FIG. 8. Table 4 illustrates the complementarity of the nucleotide sequences of C14orf117 BINDING SITE, designated SEQ ID:9472, to the nucleotide sequence of GAM3499 RNA, herein designated GAM RNA, also designated SEQ ID:226.

Another function of GAM3499 is therefore inhibition of C14orf117 (Accession NP_061148.1). Accordingly, utilities of GAM3499 include diagnosis, prevention and treatment of diseases and clinical conditions associated with C14orf117.

Chromosome 1 open reading frame 24 (C1orf24, Accession NP_443198.1) is another GAM3499 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:18867, to the nucleotide sequence of GAM3499 RNA, herein designated GAM RNA, also designated SEQ ID:226.

Another function of GAM3499 is therefore inhibition of Chromosome 1 open reading frame 24 (C1orf24, Accession NP_443198.1). Accordingly, utilities of GAM3499 include diagnosis, prevention and treatment of diseases and clinical conditions associated with C1orf24.

Cyclin d2 (CCND2, Accession NP_001750.1) is another GAM3499 target gene, herein designated TARGET GENE. CCND2 BINDING SITE is a target binding site found in the 3' untranslated region of mRNA encoded by CCND2, corresponding to a target binding site such as BINDING SITE I, BINDING SITE II or BINDING SITE III of FIG. 8. Table 4 illustrates the complementarity of the nucleotide sequences of CCND2 BINDING SITE, designated SEQ ID:10931, to the nucleotide sequence of GAM3499 RNA, herein designated GAM RNA, also designated SEQ ID:226.

Another function of GAM3499 is therefore inhibition of Cyclin d2 (CCND2, Accession NP_001750.1), a gene which is essential for the control of the cell cycle at the g1/s (start) transition. Accordingly, utilities of GAM3499 include diagnosis, prevention and treatment of diseases and clinical conditions associated with CCND2.

The function of CCND2 and its association with various diseases and clinical conditions, has been established by previous studies, as described hereinabove with reference to GAM47.1. Cyclin-dependent kinase inhibitor 2b (p15, inhibits cdk4) (CDKN2B, Accession NP_511042.1) is another GAM3499 target gene, herein designated TARGET GENE. CDKN2B BINDING SITE is a target binding site found in the 5' untranslated region of multiple transcripts of mRNA encoded by CDKN2B, corresponding to a target binding site such as BINDING SITE I, BINDING SITE II or BINDING SITE III of FIG. 8. Table 4 illustrates the complementarity of the nucleotide sequences of CDKN2B BINDING SITE, designated SEQ ID:7140, to the nucleotide sequence of GAM3499 RNA, herein designated GAM RNA, also designated SEQ ID:226.

Another function of GAM3499 is therefore inhibition of Cyclin-dependent kinase inhibitor 2b (p15, inhibits cdk4) (CDKN2B, Accession NP_511042.1). Accordingly, utilities of GAM3499 include diagnosis, prevention and treatment of diseases and clinical conditions associated with CDKN2B.

Cyclin-dependent kinase inhibitor 2b (p15, inhibits cdk4) (CDKN2B, Accession NP_004927.2) is another GAM3499 target gene, herein designated TARGET GENE. CDKN2B BINDING SITE is a target binding site found in the 5' untranslated region of multiple transcripts of mRNA encoded by CDKN2B, corresponding to a target binding site such as BINDING SITE I, BINDING SITE II or BINDING SITE III of FIG. 8. Table 4 illustrates the complementarity of the nucleotide sequences of CDKN2B BINDING SITE, designated SEQ ID:7140, to the nucleotide sequence of GAM3499 RNA, herein designated GAM RNA, also designated SEQ ID:226.

Another function of GAM3499 is therefore inhibition of Cyclin-dependent kinase inhibitor 2b (p15, inhibits cdk4) (CDKN2B, Accession NP_004927.2). Accordingly, utilities of GAM3499 include diagnosis, prevention and treatment of diseases and clinical conditions associated with CDKN2B.

CGI-31 (Accession NP_057043.1) is another GAM3499 target gene, herein designated TARGET GENE. CGI-31 BINDING SITE is a target binding site found in the 3' untranslated region of mRNA encoded by CGI-31, corresponding to a target binding site such as BINDING SITE I, BINDING SITE II or BINDING SITE III of FIG. 8. Table 4 illustrates the complementarity of the nucleotide sequences of CGI-31 BINDING SITE, designated SEQ ID:16300, to the nucleotide sequence of GAM3499 RNA, herein designated GAM RNA, also designated SEQ ID:226.

Another function of GAM3499 is therefore inhibition of CGI-31 (Accession NP_057043.1). Accordingly, utilities of GAM3499 include diagnosis, prevention and treatment of diseases and clinical conditions associated with CGI-31.

CHD6 (Accession NP_115597.3) is another GAM3499 target gene, herein designated TARGET GENE. CHD6 BINDING SITE is a target binding site found in the 3' untranslated region of mRNA encoded by CHD6, corresponding to a target binding site such as BINDING SITE I, BINDING SITE II or BINDING SITE III of FIG. 8. Table 4 illustrates the complementarity of the nucleotide sequences of CHD6 BINDING SITE, designated SEQ ID:11177, to the nucleotide sequence of GAM3499 RNA, herein designated GAM RNA, also designated SEQ ID:226.

Another function of GAM3499 is therefore inhibition of CHD6 (Accession NP_115597.3). Accordingly, utilities of GAM3499 include diagnosis, prevention and treatment of diseases and clinical conditions associated with CHD6.

Chloride channel 6 (CLCN6, Accession NP_068504.1) is another GAM3499 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:10812, to the nucleotide sequence of GAM3499 RNA, herein designated GAM RNA, also designated SEQ ID:226.

Another function of GAM3499 is therefore inhibition of Chloride channel 6 (CLCN6, Accession NP_068504.1), a gene which is a voltage-gated chloride channel. Accordingly, utilities of GAM3499 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_001277.1) is another GAM3499 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:10812, to the nucleotide sequence of GAM3499 RNA, herein designated GAM RNA, also designated SEQ ID:226.

Another function of GAM3499 is therefore inhibition of Chloride channel 6 (CLCN6, Accession NP_001277.1), a gene which is a voltage-gated chloride channel. Accordingly, utilities of GAM3499 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_068505.1) is another GAM3499 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:10812, to the nucleotide sequence of GAM3499 RNA, herein designated GAM RNA, also designated SEQ ID:226.

Another function of GAM3499 is therefore inhibition of Chloride channel 6 (CLCN6, Accession NP_068505.1), a gene which is a voltage-gated chloride channel. Accordingly, utilities of GAM3499 include diagnosis, prevention and treatment of diseases and clinical conditions associated with CLCN6.

The function of CLCN6 and its association with various diseases and clinical conditions, has been established by previous studies, as described hereinabove with reference to GAM40.1. Chloride channel 6 (CLCN6, Accession NP_068503.1) is another GAM3499 target gene, herein designated TARGET GENE. CLCN6 BINDING SITE is a target binding site found in the 3' untranslated region of multiple transcripts of mRNA encoded by CLCN6, corresponding to a target binding site such as BINDING SITE I, BINDING SITE II or BINDING SITE III of FIG. 8. Table 4 illustrates the complementarity of the nucleotide sequences of CLCN6 BINDING SITE, designated SEQ ID:10812, to the nucleotide sequence of GAM3499 RNA, herein designated GAM RNA, also designated SEQ ID:226.

Another function of GAM3499 is therefore inhibition of Chloride channel 6 (CLCN6, Accession NP_068503.1), a gene which is a voltage-gated chloride channel. Accordingly, utilities of GAM3499 include diagnosis, prevention and treatment of diseases and clinical conditions associated with CLCN6.

The function of CLCN6 and its association with various diseases and clinical conditions, has been established by previous studies, as described hereinabove with reference to GAM40.1. Claudin 1 (CLDN1, Accession NP_066924.1) is another GAM3499 target gene, herein designated TARGET GENE. CLDN1 BINDING SITE is a target binding site found in the 3' untranslated region of mRNA encoded by CLDN1, corresponding to a target binding site such as BINDING SITE I, BINDING SITE II or BINDING SITE III of FIG. 8. Table 4 illustrates the complementarity of the nucleotide sequences of CLDN1 BINDING SITE, designated SEQ ID:19530, to the nucleotide sequence of GAM3499 RNA, herein designated GAM RNA, also designated SEQ ID:226.

Another function of GAM3499 is therefore inhibition of Claudin 1 (CLDN1, Accession NP_066924.1). Accordingly, utilities of GAM3499 include diagnosis, prevention and treatment of diseases and clinical conditions associated with CLDN1.

CYP19A1 (Accession NP_112503.1) is another GAM3499 target gene, herein designated TARGET GENE. CYP19A1 BINDING SITE is a target binding site found in the 3' untranslated region of multiple transcripts of mRNA encoded by CYP19A1, corresponding to a target binding site such as BINDING SITE I, BINDING SITE II or BINDING SITE III of FIG. 8. Table 4 illustrates the complementarity of the nucleotide sequences of CYP19A1 BINDING SITE, designated SEQ ID:13808, to the nucleotide sequence of GAM3499 RNA, herein designated GAM RNA, also designated SEQ ID:226.

Another function of GAM3499 is therefore inhibition of CYP19A1 (Accession NP_112503.1). Accordingly, utilities of GAM3499 include diagnosis, prevention and treatment of diseases and clinical conditions associated with CYP19A1.

CYP19A1 (Accession NP_000094.2) is another GAM3499 target gene, herein designated TARGET GENE. CYP19A1 BINDING SITE is a target binding site found in the 3' untranslated region of multiple transcripts of mRNA encoded by CYP19A1, corresponding to a target binding site such as BINDING SITE I, BINDING SITE II or BINDING SITE III of FIG. 8. Table 4 illustrates the complementarity of the nucleotide sequences of CYP19A1 BINDING SITE, designated SEQ ID:13808, to the nucleotide sequence of GAM3499 RNA, herein designated GAM RNA, also designated SEQ ID:226.

Another function of GAM3499 is therefore inhibition of CYP19A1 (Accession NP_000094.2). Accordingly, utilities of GAM3499 include diagnosis, prevention and treatment of diseases and clinical conditions associated with CYP19A1.

Diaphanous homolog 2 (drosophila) (DIAPH2, Accession NP_006720.1) is another GAM3499 target gene, herein designated TARGET GENE. DIAPH2 BINDING SITE is a target binding site found in the 3' untranslated region of multiple transcripts of mRNA encoded by DIAPH2, corresponding to a target binding site such as BINDING SITE I, BINDING SITE II or BINDING SITE III of FIG. 8. Table 4 illustrates the complementarity of the nucleotide sequences of DIAPH2 BINDING SITE, designated SEQ ID:9117, to the nucleotide sequence of GAM3499 RNA, herein designated GAM RNA, also designated SEQ ID:226.

Another function of GAM3499 is therefore inhibition of Diaphanous homolog 2 (drosophila) (DIAPH2, Accession NP_006720.1), a gene which may affect in oogenesis and therefore may be associated with Premature ovarian failure. Accordingly, utilities of GAM3499 include diagnosis, prevention and treatment of Premature ovarian failure., and of other diseases and clinical conditions associated with DIAPH2.

The function of DIAPH2 and its association with various diseases and clinical conditions, has been established by previous studies, as described hereinabove with reference to GAM66.1. DKFZp434E0519 (Accession NP_115623.1) is another GAM3499 target gene, herein designated TARGET GENE. DKFZp434E0519 BINDING SITE1 and DKFZp434E0519 BINDING SITE2 are target binding sites found in untranslated regions of mRNA encoded by DKFZp434E0519, corresponding to target binding sites such as BINDING SITE I, BINDING SITE II or BINDING SITE III of FIG. 8. Table 4 illustrates the complementarity of the nucleotide sequences of DKFZp434E0519 BINDING SITE1 and DKFZp434E0519 BINDING SITE2, designated SEQ ID:2462 and SEQ ID:3588 respectively, to the nucleotide sequence of GAM3499 RNA, herein designated GAM RNA, also designated SEQ ID:226.

Another function of GAM3499 is therefore inhibition of DKFZp434E0519 (Accession NP_115623.1). Accordingly, utilities of GAM3499 include diagnosis, prevention and treatment of diseases and clinical conditions associated with DKFZp434E0519.

DKFZP434G072 (Accession NP_115525.1) is another GAM3499 target gene, herein designated TARGET GENE. DKFZP434G072 BINDING SITE is a target binding site found in the 3' untranslated region of mRNA encoded by DKFZP434G072, corresponding to a target binding site such as BINDING SITE I, BINDING SITE II or BINDING SITE III of FIG. 8. Table 4 illustrates the complementarity of the nucleotide sequences of DKFZP434G072 BINDING SITE, designated SEQ ID:14688, to the nucleotide sequence of GAM3499 RNA, herein designated GAM RNA, also designated SEQ ID:226.

Another function of GAM3499 is therefore inhibition of DKFZP434G072 (Accession NP_115525.1). Accordingly, utilities of GAM3499 include diagnosis, prevention and treatment of diseases and clinical conditions associated with DKFZP434G072.

DKFZP434I092 (Accession NP_056483.1) is another GAM3499 target gene, herein designated TARGET GENE. DKFZP434I092 BINDING SITE is a target binding site found in the 3' untranslated region of mRNA encoded by DKFZP434I092, corresponding to a target binding site such as BINDING SITE I, BINDING SITE II or BINDING SITE III of FIG. 8. Table 4 illustrates the complementarity of the nucleotide sequences of DKFZP434I092 BINDING SITE, designated SEQ ID:4289, to the nucleotide sequence of GAM3499 RNA, herein designated GAM RNA, also designated SEQ ID:226.

Another function of GAM3499 is therefore inhibition of DKFZP434I092 (Accession NP_056483.1). Accordingly, utilities of GAM3499 include diagnosis, prevention and treatment of diseases and clinical conditions associated with DKFZP434I092.

DKFZP564M182 (Accession XP_085525.3) is another GAM3499 target gene, herein designated TARGET GENE. DKFZP564M182 BINDING SITE is a target binding site found in the 3' untranslated region of mRNA encoded by DKFZP564M182, corresponding to a target binding site such as BINDING SITE I, BINDING SITE II or BINDING SITE III of FIG. 8. Table 4 illustrates the complementarity of the nucleotide sequences of DKFZP564M182 BINDING SITE, designated SEQ ID:4069, to the nucleotide sequence of GAM3499 RNA, herein designated GAM RNA, also designated SEQ ID:226.

Another function of GAM3499 is therefore inhibition of DKFZP564M182 (Accession XP_085525.3). Accordingly, utilities of GAM3499 include diagnosis, prevention and treatment of diseases and clinical conditions associated with DKFZP564M182.

DKFZp762C1112 (Accession XP_095568.5) is another GAM3499 target gene, herein designated TARGET GENE. DKFZp762C1112 BINDING SITE is a target binding site found in the 3' untranslated region of mRNA encoded by DKFZp762C1112, corresponding to a target binding site such as BINDING SITE I, BINDING SITE II or BINDING SITE III of FIG. 8. Table 4 illustrates the complementarity of the nucleotide sequences of DKFZp762C1112 BINDING SITE, designated SEQ ID:964, to the nucleotide sequence of GAM3499 RNA, herein designated GAM RNA, also designated SEQ ID:226.

Another function of GAM3499 is therefore inhibition of DKFZp762C1112 (Accession XP_095568.5). Accordingly, utilities of GAM3499 include diagnosis, prevention and treatment of diseases and clinical conditions associated with DKFZp762C1112.

DKFZP762N2316 (Accession XP_040560.4) is another GAM3499 target gene, herein designated TARGET GENE. DKFZP762N2316 BINDING SITE is a target binding site found in the 3' untranslated region of multiple transcripts of mRNA encoded by DKFZP762N2316, corresponding to a target binding site such as BINDING SITE I, BINDING SITE II or BINDING SITE III of FIG. 8. Table 4 illustrates the complementarity of the nucleotide sequences of DKFZP762N2316 BINDING SITE, designated SEQ ID:10932, to the nucleotide sequence of GAM3499 RNA, herein designated GAM RNA, also designated SEQ ID:226.

Another function of GAM3499 is therefore inhibition of DKFZP762N2316 (Accession XP_040560.4). Accordingly, utilities of GAM3499 include diagnosis, prevention and treatment of diseases and clinical conditions associated with DKFZP762N2316.

FLJ12892 (Accession NP_073594.2) is another GAM3499 target gene, herein designated TARGET GENE. FLJ12892 BINDING SITE is a target binding site found in the 5' untranslated region of mRNA encoded by FLJ12892, corresponding to a target binding site such as BINDING SITE I, BINDING SITE II or BINDING SITE III of FIG. 8. Table 4 illustrates the complementarity of the nucleotide sequences of FLJ12892 BINDING SITE, designated SEQ ID:18919, to the nucleotide sequence of GAM3499 RNA, herein designated GAM RNA, also designated SEQ ID:226.

Another function of GAM3499 is therefore inhibition of FLJ12892 (Accession NP_073594.2). Accordingly, utilities of GAM3499 include diagnosis, prevention and treatment of diseases and clinical conditions associated with FLJ12892.

FLJ13456 (Accession XP_038291.5) is another GAM3499 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:12797, to the nucleotide sequence of GAM3499 RNA, herein designated GAM RNA, also designated SEQ ID:226.

Another function of GAM3499 is therefore inhibition of FLJ13456 (Accession XP_038291.5). Accordingly, utilities of GAM3499 include diagnosis, prevention and treatment of diseases and clinical conditions associated with FLJ13456.

FLJ20582 (Accession XP_090970.4) is another GAM3499 target gene, herein designated TARGET GENE.

FLJ20582 BINDING SITE is a target binding site found in the 5' untranslated region of mRNA encoded by FLJ20582, corresponding to a target binding site such as BINDING SITE I, BINDING SITE II or BINDING SITE III of FIG. 8. Table 4 illustrates the complementarity of the nucleotide sequences of FLJ20582 BINDING SITE, designated SEQ ID:12014, to the nucleotide sequence of GAM3499 RNA, herein designated GAM RNA, also designated SEQ ID:226.

Another function of GAM3499 is therefore inhibition of FLJ20582 (Accession XP_090970.4). Accordingly, utilities of GAM3499 include diagnosis, prevention and treatment of diseases and clinical conditions associated with FLJ20582.

FLJ23447 (Accession NP_079101.1) is another GAM3499 target gene, herein designated TARGET GENE. FLJ23447 BINDING SITE is a target binding site found in the 3' untranslated region of mRNA encoded by FLJ23447, corresponding to a target binding site such as BINDING SITE I, BINDING SITE II or BINDING SITE III of FIG. 8. Table 4 illustrates the complementarity of the nucleotide sequences of FLJ23447 BINDING SITE, designated SEQ ID:18407, to the nucleotide sequence of GAM3499 RNA, herein designated GAM RNA, also designated SEQ ID:226.

Another function of GAM3499 is therefore inhibition of FLJ23447 (Accession NP_079101.1). Accordingly, utilities of GAM3499 include diagnosis, prevention and treatment of diseases and clinical conditions associated with FLJ23447.

FLJ23537 (Accession NP_079165.1) is another GAM3499 target gene, herein designated TARGET GENE. FLJ23537 BINDING SITE is a target binding site found in the 3' untranslated region of mRNA encoded by FLJ23537, corresponding to a target binding site such as BINDING SITE I, BINDING SITE II or BINDING SITE III of FIG. 8. Table 4 illustrates the complementarity of the nucleotide sequences of FLJ23537 BINDING SITE, designated SEQ ID:18841, to the nucleotide sequence of GAM3499 RNA, herein designated GAM RNA, also designated SEQ ID:226.

Another function of GAM3499 is therefore inhibition of FLJ23537 (Accession NP_079165.1). Accordingly, utilities of GAM3499 include diagnosis, prevention and treatment of diseases and clinical conditions associated with FLJ23537.

FLJ30681 (Accession XP_166291.1) is another GAM3499 target gene, herein designated TARGET GENE. FLJ30681 BINDING SITE is a target binding site found in the 3' untranslated region of mRNA encoded by FLJ30681, corresponding to a target binding site such as BINDING SITE I, BINDING SITE II or BINDING SITE III of FIG. 8. Table 4 illustrates the complementarity of the nucleotide sequences of FLJ30681 BINDING SITE, designated SEQ ID:16626, to the nucleotide sequence of GAM3499 RNA, herein designated GAM RNA, also designated SEQ ID:226.

Another function of GAM3499 is therefore inhibition of FLJ30681 (Accession XP_166291.1). Accordingly, utilities of GAM3499 include diagnosis, prevention and treatment of diseases and clinical conditions associated with FLJ30681.

FLJ31208 (Accession NP_694568.1) is another GAM3499 target gene, herein designated TARGET GENE. FLJ31208 BINDING SITE is a target binding site found in the 3' untranslated region of mRNA encoded by FLJ31208, corresponding to a target binding site such as BINDING SITE I, BINDING SITE II or BINDING SITE III of FIG. 8. Table 4 illustrates the complementarity of the nucleotide sequences of FLJ31208 BINDING SITE, designated SEQ ID:5760, to the nucleotide sequence of GAM3499 RNA, herein designated GAM RNA, also designated SEQ ID:226.

Another function of GAM3499 is therefore inhibition of FLJ31208 (Accession NP_694568.1). Accordingly, utilities of GAM3499 include diagnosis, prevention and treatment of diseases and clinical conditions associated with FLJ31208.

FLJ35693 (Accession NP_694972.2) is another GAM3499 target gene, herein designated TARGET GENE. FLJ35693 BINDING SITE is a target binding site found in the 3' untranslated region of mRNA encoded by FLJ35693, corresponding to a target binding site such as BINDING SITE I, BINDING SITE II or BINDING SITE III of FIG. 8. Table 4 illustrates the complementarity of the nucleotide sequences of FLJ35693 BINDING SITE, designated SEQ ID:7369, to the nucleotide sequence of GAM3499 RNA, herein designated GAM RNA, also designated SEQ ID:226.

Another function of GAM3499 is therefore inhibition of FLJ35693 (Accession NP_694972.2). Accordingly, utilities of GAM3499 include diagnosis, prevention and treatment of diseases and clinical conditions associated with FLJ35693.

FLJ36754 (Accession NP_776190.1) is another GAM3499 target gene, herein designated TARGET GENE. FLJ36754 BINDING SITE is a target binding site found in the 3' untranslated region of mRNA encoded by FLJ36754, corresponding to a target binding site such as BINDING SITE I, BINDING SITE II or BINDING SITE III of FIG. 8. Table 4 illustrates the complementarity of the nucleotide sequences of FLJ36754 BINDING SITE, designated SEQ ID:7444, to the nucleotide sequence of GAM3499 RNA, herein designated GAM RNA, also designated SEQ ID:226.

Another function of GAM3499 is therefore inhibition of FLJ36754 (Accession NP_776190.1). Accordingly, utilities of GAM3499 include diagnosis, prevention and treatment of diseases and clinical conditions associated with FLJ36754.

FLJ37131 (Accession NP_775958.1) is another GAM3499 target gene, herein designated TARGET GENE. FLJ37131 BINDING SITE is a target binding site found in the 3' untranslated region of mRNA encoded by FLJ37131, corresponding to a target binding site such as BINDING SITE I, BINDING SITE II or BINDING SITE III of FIG. 8. Table 4 illustrates the complementarity of the nucleotide sequences of FLJ37131 BINDING SITE, designated SEQ ID:16721, to the nucleotide sequence of GAM3499 RNA, herein designated GAM RNA, also designated SEQ ID:226.

Another function of GAM3499 is therefore inhibition of FLJ37131 (Accession NP_775958.1). Accordingly, utilities of GAM3499 include diagnosis, prevention and treatment of diseases and clinical conditions associated with FLJ37131.

Glycoprotein 2 (zymogen granule membrane) (GP2, Accession NP_001493.1) is another GAM3499 target gene, herein designated TARGET GENE. GP2 BINDING SITE is a target binding site found in the 3' untranslated region of mRNA encoded by GP2, corresponding to a target binding site such as BINDING SITE I, BINDING SITE II or BINDING SITE III of FIG. 8. Table 4 illustrates the complementarity of the nucleotide sequences of GP2 BINDING SITE, designated SEQ ID:3890, to the nucleotide sequence of GAM3499 RNA, herein designated GAM RNA, also designated SEQ ID:226.

Another function of GAM3499 is therefore inhibition of Glycoprotein 2 (zymogen granule membrane) (GP2, Accession NP_001493.1), a gene which expresses in the secretory granule of the exocrine pancreas. Accordingly, utilities of GAM3499 include diagnosis, prevention and treatment of diseases and clinical conditions associated with GP2.

The function of GP2 and its association with various diseases and clinical conditions, has been established by previous studies, as described hereinabove with reference to GAM347.1. G protein-coupled receptor 105 (GPR105, Accession NP_055694.1) is another GAM3499 target gene, herein designated TARGET GENE. GPR105 BINDING SITE is a target binding site found in the 3' untranslated region of mRNA encoded by GPR105, corresponding to a target binding site such as BINDING SITE I, BINDING SITE II or BINDING SITE III of FIG. 8. Table 4 illustrates the complementarity of the nucleotide sequences of GPR105 BINDING SITE, designated SEQ ID:7994, to the nucleotide sequence of GAM3499 RNA, herein designated GAM RNA, also designated SEQ ID:226.

Another function of GAM3499 is therefore inhibition of G protein-coupled receptor 105 (GPR105, Accession NP_055694.1). Accordingly, utilities of GAM3499 include diagnosis, prevention and treatment of diseases and clinical conditions associated with GPR105.

Glutamate receptor, ionotropic, n-methyl-d-aspartate 3a (GRIN3A, Accession NP_597702.1) is another GAM3499 target gene, herein designated TARGET GENE. GRIN3A BINDING SITE is a target binding site found in the 3' untranslated region of mRNA encoded by GRIN3A, corresponding to a target binding site such as BINDING SITE I, BINDING SITE II or BINDING SITE III of FIG. 8. Table 4 illustrates the complementarity of the nucleotide sequences of GRIN3A BINDING SITE, designated SEQ ID:19610, to the nucleotide sequence of GAM3499 RNA, herein designated GAM RNA, also designated SEQ ID:226.

Another function of GAM3499 is therefore inhibition of Glutamate receptor, ionotropic, n-methyl-d-aspartate 3a (GRIN3A, Accession NP_597702.1). Accordingly, utilities of GAM3499 include diagnosis, prevention and treatment of diseases and clinical conditions associated with GRIN3A.

High-mobility group 20a (HMG20A, Accession NP_060670.1) is another GAM3499 target gene, herein designated TARGET GENE. HMG20A BINDING SITE is a target binding site found in the 3' untranslated region of mRNA encoded by HMG20A, corresponding to a target binding site such as BINDING SITE I, BINDING SITE II or BINDING SITE III of FIG. 8. Table 4 illustrates the complementarity of the nucleotide sequences of HMG20A BINDING SITE, designated SEQ ID:17461, to the nucleotide sequence of GAM3499 RNA, herein designated GAM RNA, also designated SEQ ID:226.

Another function of GAM3499 is therefore inhibition of High-mobility group 20a (HMG20A, Accession NP_060670.1). Accordingly, utilities of GAM3499 include diagnosis, prevention and treatment of diseases and clinical conditions associated with HMG20A.

Heterogeneous nuclear ribonucleoprotein a0 (HNRPA0, Accession NP_006796.1) is another GAM3499 target gene, herein designated TARGET GENE. HNRPA0 BINDING SITE is a target binding site found in the 5' untranslated region of mRNA encoded by HNRPA0, corresponding to a target binding site such as BINDING SITE I, BINDING SITE II or BINDING SITE III of FIG. 8. Table 4 illustrates the complementarity of the nucleotide sequences of HNRPA0 BINDING SITE, designated SEQ ID:10813, to the nucleotide sequence of GAM3499 RNA, herein designated GAM RNA, also designated SEQ ID:226.

Another function of GAM3499 is therefore inhibition of Heterogeneous nuclear ribonucleoprotein a0 (HNRPA0, Accession NP_006796.1). Accordingly, utilities of GAM3499 include diagnosis, prevention and treatment of diseases and clinical conditions associated with HNRPA0.

KIAA0514 (Accession NP_055511.1) is another GAM3499 target gene, herein designated TARGET GENE. KIAA0514 BINDING SITE is a target binding site found in the 3' untranslated region of mRNA encoded by KIAA0514, corresponding to a target binding site such as BINDING SITE I, BINDING SITE II or BINDING SITE III of FIG. 8. Table 4 illustrates the complementarity of the nucleotide sequences of KIAA0514 BINDING SITE, designated SEQ ID:18061, to the nucleotide sequence of GAM3499 RNA, herein designated GAM RNA, also designated SEQ ID:226.

Another function of GAM3499 is therefore inhibition of KIAA0514 (Accession NP_055511.1). Accordingly, utilities of GAM3499 include diagnosis, prevention and treatment of diseases and clinical conditions associated with KIAA0514.

KIAA1735 (Accession XP_290496.1) is another GAM3499 target gene, herein designated TARGET GENE. KIAA1735 BINDING SITE is a target binding site found in the 3' untranslated region of mRNA encoded by KIAA1735, corresponding to a target binding site such as BINDING SITE I, BINDING SITE II or BINDING SITE III of FIG. 8. Table 4 illustrates the complementarity of the nucleotide sequences of KIAA1735 BINDING SITE, designated SEQ ID:12467, to the nucleotide sequence of GAM3499 RNA, herein designated GAM RNA, also designated SEQ ID:226.

Another function of GAM3499 is therefore inhibition of KIAA1735 (Accession XP_290496.1). Accordingly, utilities of GAM3499 include diagnosis, prevention and treatment of diseases and clinical conditions associated with KIAA1735.

KIAA1985 (Accession NP_078853.1) is another GAM3499 target gene, herein designated TARGET GENE. KIAA1985 BINDING SITE is a target binding site found in the 5' untranslated region of mRNA encoded by KIAA1985, corresponding to a target binding site such as BINDING SITE I, BINDING SITE II or BINDING SITE III of FIG. 8. Table 4 illustrates the complementarity of the nucleotide sequences of KIAA1985 BINDING SITE, designated SEQ ID:6965, to the nucleotide sequence of GAM3499 RNA, herein designated GAM RNA, also designated SEQ ID:226.

Another function of GAM3499 is therefore inhibition of KIAA1985 (Accession NP_078853.1). Accordingly, utilities of GAM3499 include diagnosis, prevention and treatment of diseases and clinical conditions associated with KIAA1985.

KIAA2024 (Accession NP_742067.1) is another GAM3499 target gene, herein designated TARGET GENE. KIAA2024 BINDING SITE is a target binding site found in the 5' untranslated region of mRNA encoded by KIAA2024, corresponding to a target binding site such as BINDING SITE I, BINDING SITE II or BINDING SITE III of FIG. 8. Table 4 illustrates the complementarity of the nucleotide sequences of KIAA2024 BINDING SITE, designated SEQ ID:18702, to the nucleotide sequence of GAM3499 RNA, herein designated GAM RNA, also designated SEQ ID:226.

Another function of GAM3499 is therefore inhibition of KIAA2024 (Accession NP_742067.1). Accordingly, utilities of GAM3499 include diagnosis, prevention and treatment of diseases and clinical conditions associated with KIAA2024.

Legumain (LGMN, Accession NP_005597.2) is another GAM3499 target gene, herein designated TARGET GENE. LGMN BINDING SITE is a target binding site found in the 3' untranslated region of mRNA encoded by LGMN, corresponding to a target binding site such as BINDING SITE I, BINDING SITE II or BINDING SITE III of FIG. 8. Table 4 illustrates the complementarity of the nucleotide sequences of LGMN BINDING SITE, designated SEQ ID:10662, to the nucleotide sequence of GAM3499 RNA, herein designated GAM RNA, also designated SEQ ID:226.

Another function of GAM3499 is therefore inhibition of Legumain (LGMN, Accession NP_005597.2). Accordingly, utilities of GAM3499 include diagnosis, prevention and treatment of diseases and clinical conditions associated with LGMN.

LOC115219 (Accession XP_055499.2) is another GAM3499 target gene, herein designated TARGET GENE. LOC115219 BINDING SITE is a target binding site found in the 5' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:2334, to the nucleotide sequence of GAM3499 RNA, herein designated GAM RNA, also designated SEQ ID:226.

Another function of GAM3499 is therefore inhibition of LOC115219 (Accession XP_055499.2). Accordingly, utilities of GAM3499 include diagnosis, prevention and treatment of diseases and clinical conditions associated with LOC115219.

LOC137485 (Accession XP_059909.1) is another GAM3499 target gene, herein designated TARGET GENE. LOC137485 BINDING SITE is a target binding site found in the 3' untranslated region of mRNA encoded by LOC137485, corresponding to a target binding site such as BINDING SITE I, BINDING SITE II or BINDING SITE III of FIG. 8. Table 4 illustrates the complementarity of the nucleotide sequences of LOC137485 BINDING SITE, designated SEQ ID:8695, to the nucleotide sequence of GAM3499 RNA, herein designated GAM RNA, also designated SEQ ID:226.

Another function of GAM3499 is therefore inhibition of LOC137485 (Accession XP_059909.1). Accordingly, utilities of GAM3499 include diagnosis, prevention and treatment of diseases and clinical conditions associated with LOC137485.

LOC143381 (Accession XP_084501.1) is another GAM3499 target gene, herein designated TARGET GENE. LOC143381 BINDING SITE is a target binding site found in the 3' untranslated region of mRNA encoded by LOC143381, corresponding to a target binding site such as BINDING SITE I, BINDING SITE II or BINDING SITE III of FIG. 8. Table 4 illustrates the complementarity of the nucleotide sequences of LOC143381 BINDING SITE, designated SEQ ID:14117, to the nucleotide sequence of GAM3499 RNA, herein designated GAM RNA, also designated SEQ ID:226.

Another function of GAM3499 is therefore inhibition of LOC143381 (Accession XP_084501.1). Accordingly, utilities of GAM3499 include diagnosis, prevention and treatment of diseases and clinical conditions associated with LOC143381.

LOC145844 (Accession XP_085255.1) is another GAM3499 target gene, herein designated TARGET GENE. LOC145844 BINDING SITE is a target binding site found in the 3' untranslated region of mRNA encoded by LOC145844, corresponding to a target binding site such as BINDING SITE I, BINDING SITE II or BINDING SITE III of FIG. 8. Table 4 illustrates the complementarity of the nucleotide sequences of LOC145844 BINDING SITE, designated SEQ ID:4635, to the nucleotide sequence of GAM3499 RNA, herein designated GAM RNA, also designated SEQ ID:226.

Another function of GAM3499 is therefore inhibition of LOC145844 (Accession XP_085255.1). Accordingly, utilities of GAM3499 include diagnosis, prevention and treatment of diseases and clinical conditions associated with LOC145844.

LOC147727 (Accession XP_085862.1) is another GAM3499 target gene, herein designated TARGET GENE. LOC147727 BINDING SITE is a target binding site found in the 5' untranslated region of mRNA encoded by LOC147727, corresponding to a target binding site such as BINDING SITE I, BINDING SITE II or BINDING SITE III of FIG. 8. Table 4 illustrates the complementarity of the nucleotide sequences of LOC147727 BINDING SITE, designated SEQ ID:5469, to the nucleotide sequence of GAM3499 RNA, herein designated GAM RNA, also designated SEQ ID:226.

Another function of GAM3499 is therefore inhibition of LOC147727 (Accession XP_085862.1). Accordingly, utilities of GAM3499 include diagnosis, prevention and treatment of diseases and clinical conditions associated with LOC147727.

LOC149371 (Accession NP_787072.1) is another GAM3499 target gene, herein designated TARGET GENE. LOC149371 BINDING SITE is a target binding site found in the 3' untranslated region of mRNA encoded by LOC149371, corresponding to a target binding site such as BINDING SITE I, BINDING SITE II or BINDING SITE III of FIG. 8. Table 4 illustrates the complementarity of the nucleotide sequences of LOC149371 BINDING SITE, designated SEQ ID:7415, to the nucleotide sequence of GAM3499 RNA, herein designated GAM RNA, also designated SEQ ID:226.

Another function of GAM3499 is therefore inhibition of LOC149371 (Accession NP_787072.1). Accordingly, utilities of GAM3499 include diagnosis, prevention and treatment of diseases and clinical conditions associated with LOC149371.

LOC149420 (Accession NP_690048.1) is another GAM3499 target gene, herein designated TARGET GENE. LOC149420 BINDING SITE is a target binding site found in the 3' untranslated region of mRNA encoded by LOC149420, corresponding to a target binding site such as BINDING SITE I, BINDING SITE II or BINDING SITE III of FIG. 8. Table 4 illustrates the complementarity of the nucleotide sequences of LOC149420 BINDING SITE, designated SEQ ID:2383, to the nucleotide sequence of GAM3499 RNA, herein designated GAM RNA, also designated SEQ ID:226.

Another function of GAM3499 is therefore inhibition of LOC149420 (Accession NP_690048.1). Accordingly, utilities of GAM3499 include diagnosis, prevention and treatment of diseases and clinical conditions associated with LOC149420.

LOC149619 (Accession XP_097690.1) is another GAM3499 target gene, herein designated TARGET GENE. LOC149619 BINDING SITE is a target binding site found in the 3' untranslated region of mRNA encoded by LOC149619, corresponding to a target binding site such as BINDING SITE I, BINDING SITE II or BINDING SITE III of FIG. 8. Table 4 illustrates the complementarity of the nucleotide sequences of LOC149619 BINDING SITE, designated SEQ ID:5200, to the nucleotide sequence of GAM3499 RNA, herein designated GAM RNA, also designated SEQ ID:226.

Another function of GAM3499 is therefore inhibition of LOC149619 (Accession XP_097690.1). Accordingly, utilities of GAM3499 include diagnosis, prevention and treatment of diseases and clinical conditions associated with LOC149619.

LOC150174 (Accession XP_086802.2) is another GAM3499 target gene, herein designated TARGET GENE. LOC150174 BINDING SITE is a target binding site found in the 3' untranslated region of mRNA encoded by LOC150174, corresponding to a target binding site such as BINDING SITE I, BINDING SITE II or BINDING SITE III of FIG. 8. Table 4 illustrates the complementarity of the nucleotide sequences of LOC150174 BINDING SITE, designated SEQ ID:1768, to the nucleotide sequence of GAM3499 RNA, herein designated GAM RNA, also designated SEQ ID:226.

Another function of GAM3499 is therefore inhibition of LOC150174 (Accession XP_086802.2). Accordingly, utilities of GAM3499 include diagnosis, prevention and treatment of diseases and clinical conditions associated with LOC150174.

LOC150212 (Accession XP_086827.2) is another GAM3499 target gene, herein designated TARGET GENE. LOC150212 BINDING SITE is a target binding site found in the 3' untranslated region of mRNA encoded by LOC150212, corresponding to a target binding site such as BINDING SITE I, BINDING SITE II or BINDING SITE III of FIG. 8. Table 4 illustrates the complementarity of the nucleotide sequences of LOC150212 BINDING SITE, designated SEQ ID:11780, to the nucleotide sequence of GAM3499 RNA, herein designated GAM RNA, also designated SEQ ID:226.

Another function of GAM3499 is therefore inhibition of LOC150212 (Accession XP_086827.2). Accordingly, utilities of GAM3499 include diagnosis, prevention and treatment of diseases and clinical conditions associated with LOC150212.

LOC150213 (Accession XP_059324.1) is another GAM3499 target gene, herein designated TARGET GENE. LOC150213 BINDING SITE is a target binding site found in the 3' untranslated region of mRNA encoded by LOC150213, corresponding to a target binding site such as BINDING SITE I, BINDING SITE II or BINDING SITE III of FIG. 8. Table 4 illustrates the complementarity of the nucleotide sequences of LOC150213 BINDING SITE, designated SEQ ID:1768, to the nucleotide sequence of GAM3499 RNA, herein designated GAM RNA, also designated SEQ ID:226.

Another function of GAM3499 is therefore inhibition of LOC150213 (Accession XP_059324.1). Accordingly, utilities of GAM3499 include diagnosis, prevention and treatment of diseases and clinical conditions associated with LOC150213.

LOC155081 (Accession XP_088145.2) is another GAM3499 target gene, herein designated TARGET GENE. LOC155081 BINDING SITE is a target binding site found in the 3' untranslated region of mRNA encoded by LOC155081, corresponding to a target binding site such as BINDING SITE I, BINDING SITE II or BINDING SITE III of FIG. 8. Table 4 illustrates the complementarity of the nucleotide sequences of LOC155081 BINDING SITE, designated SEQ ID:3019, to the nucleotide sequence of GAM3499 RNA, herein designated GAM RNA, also designated SEQ ID:226.

Another function of GAM3499 is therefore inhibition of LOC155081 (Accession XP_088145.2). Accordingly, utilities of GAM3499 include diagnosis, prevention and treatment of diseases and clinical conditions associated with LOC155081.

LOC157556 (Accession XP_098783.1) is another GAM3499 target gene, herein designated TARGET GENE. LOC157556 BINDING SITE is a target binding site found in the 5' untranslated region of mRNA encoded by LOC157556, corresponding to a target binding site such as BINDING SITE I, BINDING SITE II or BINDING SITE III of FIG. 8. Table 4 illustrates the complementarity of the nucleotide sequences of LOC157556 BINDING SITE, designated SEQ ID:4290, to the nucleotide sequence of GAM3499 RNA, herein designated GAM RNA, also designated SEQ ID:226.

Another function of GAM3499 is therefore inhibition of LOC157556 (Accession XP_098783.1). Accordingly, utilities of GAM3499 include diagnosis, prevention and treatment of diseases and clinical conditions associated with LOC157556.

LOC197201 (Accession XP_113839.2) is another GAM3499 target gene, herein designated TARGET GENE. LOC197201 BINDING SITE is a target binding site found in the 5' untranslated region of mRNA encoded by LOC197201, corresponding to a target binding site such as BINDING SITE I, BINDING SITE II or BINDING SITE III of FIG. 8. Table 4 illustrates the complementarity of the nucleotide sequences of LOC197201 BINDING SITE, designated SEQ ID:19865, to the nucleotide sequence of GAM3499 RNA, herein designated GAM RNA, also designated SEQ ID:226.

Another function of GAM3499 is therefore inhibition of LOC197201 (Accession XP_113839.2). Accordingly, utilities of GAM3499 include diagnosis, prevention and treatment of diseases and clinical conditions associated with LOC197201.

LOC200339 (Accession XP_117226.1) is another GAM3499 target gene, herein designated TARGET GENE. LOC200339 BINDING SITE is a target binding site found in the 3' untranslated region of mRNA encoded by LOC200339, corresponding to a target binding site such as BINDING SITE I, BINDING SITE II or BINDING SITE III of FIG. 8. Table 4 illustrates the complementarity of the nucleotide sequences of LOC200339 BINDING SITE, designated SEQ ID:2412, to the nucleotide sequence of GAM3499 RNA, herein designated GAM RNA, also designated SEQ ID:226.

Another function of GAM3499 is therefore inhibition of LOC200339 (Accession XP_117226.1). Accordingly, utilities of GAM3499 include diagnosis, prevention and treatment of diseases and clinical conditions associated with LOC200339.

LOC201510 (Accession XP_113972.1) is another GAM3499 target gene, herein designated TARGET GENE. LOC201510 BINDING SITE is a target binding site found in the 3' untranslated region of mRNA encoded by LOC201510, corresponding to a target binding site such as BINDING SITE I, BINDING SITE II or BINDING SITE III of FIG. 8. Table 4 illustrates the complementarity of the nucleotide sequences of LOC201510 BINDING SITE, designated SEQ ID:8805, to the nucleotide sequence of GAM3499 RNA, herein designated GAM RNA, also designated SEQ ID:226.

Another function of GAM3499 is therefore inhibition of LOC201510 (Accession XP_113972.1). Accordingly, utilities of GAM3499 include diagnosis, prevention and treatment of diseases and clinical conditions associated with LOC201510.

LOC202802 (Accession XP_114560.1) is another GAM3499 target gene, herein designated TARGET GENE. LOC202802 BINDING SITE is a target binding site found in the 3' untranslated region of mRNA encoded by LOC202802, corresponding to a target binding site such as BINDING SITE I, BINDING SITE II or BINDING SITE III of FIG. 8. Table 4 illustrates the complementarity of the nucleotide sequences of LOC202802 BINDING SITE, designated SEQ ID:3019, to the nucleotide sequence of GAM3499 RNA, herein designated GAM RNA, also designated SEQ ID:226.

Another function of GAM3499 is therefore inhibition of LOC202802 (Accession XP_114560.1). Accordingly, utilities of GAM3499 include diagnosis, prevention and treatment of diseases and clinical conditions associated with LOC202802.

LOC256895 (Accession XP_173029.2) is another GAM3499 target gene, herein designated TARGET GENE. LOC256895 BINDING SITE is a target binding site found in the 3' untranslated region of mRNA encoded by LOC256895, corresponding to a target binding site such as BINDING SITE I, BINDING SITE II or BINDING SITE III of FIG. 8. Table 4 illustrates the complementarity of the nucleotide sequences of LOC256895 BINDING SITE, designated SEQ ID:18534, to the nucleotide sequence of GAM3499 RNA, herein designated GAM RNA, also designated SEQ ID:226.

Another function of GAM3499 is therefore inhibition of LOC256895 (Accession XP_173029.2). Accordingly, utilities of GAM3499 include diagnosis, prevention and treatment of diseases and clinical conditions associated with LOC256895.

LOC283038 (Accession XP_302599.1) is another GAM3499 target gene, herein designated TARGET GENE. LOC283038 BINDING SITE is a target binding site found in the 3' untranslated region of mRNA encoded by LOC283038, corresponding to a target binding site such as BINDING SITE I, BINDING SITE II or BINDING SITE III of FIG. 8. Table 4 illustrates the complementarity of the nucleotide sequences of LOC283038 BINDING SITE, designated SEQ ID:10213, to the nucleotide sequence of GAM3499 RNA, herein designated GAM RNA, also designated SEQ ID:226.

Another function of GAM3499 is therefore inhibition of LOC283038 (Accession XP_302599.1). Accordingly, utilities of GAM3499 include diagnosis, prevention and treatment of diseases and clinical conditions associated with LOC283038.

LOC283070 (Accession XP_210878.1) is another GAM3499 target gene, herein designated TARGET GENE. LOC283070 BINDING SITE is a target binding site found in the 5' untranslated region of mRNA encoded by LOC283070, corresponding to a target binding site such as BINDING SITE I, BINDING SITE II or BINDING SITE III of FIG. 8. Table 4 illustrates the complementarity of the nucleotide sequences of LOC283070 BINDING SITE, designated SEQ ID:16956, to the nucleotide sequence of GAM3499 RNA, herein designated GAM RNA, also designated SEQ ID:226.

Another function of GAM3499 is therefore inhibition of LOC283070 (Accession XP_210878.1). Accordingly, utilities of GAM3499 include diagnosis, prevention and treatment of diseases and clinical conditions associated with LOC283070.

LOC283655 (Accession XP_211144.1) is another GAM3499 target gene, herein designated TARGET GENE. LOC283655 BINDING SITE is a target binding site found in the 3' untranslated region of mRNA encoded by LOC283655, corresponding to a target binding site such as BINDING SITE I, BINDING SITE II or BINDING SITE III of FIG. 8. Table 4 illustrates the complementarity of the nucleotide sequences of LOC283655 BINDING SITE, designated SEQ ID:3498, to the nucleotide sequence of GAM3499 RNA, herein designated GAM RNA, also designated SEQ ID:226.

Another function of GAM3499 is therefore inhibition of LOC283655 (Accession XP_211144.1). Accordingly, utilities of GAM3499 include diagnosis, prevention and treatment of diseases and clinical conditions associated with LOC283655.

LOC283682 (Accession XP_211161.1) is another GAM3499 target gene, herein designated TARGET GENE. LOC283682 BINDING SITE is a target binding site found in the 3' untranslated region of mRNA encoded by LOC283682, corresponding to a target binding site such as BINDING SITE I, BINDING SITE II or BINDING SITE III of FIG. 8. Table 4 illustrates the complementarity of the nucleotide sequences of LOC283682 BINDING SITE, designated SEQ ID:11367, to the nucleotide sequence of GAM3499 RNA, herein designated GAM RNA, also designated SEQ ID:226.

Another function of GAM3499 is therefore inhibition of LOC283682 (Accession XP_211161.1). Accordingly, utilities of GAM3499 include diagnosis, prevention and treatment of diseases and clinical conditions associated with LOC283682.

LOC284360 (Accession XP_211433.1) is another GAM3499 target gene, herein designated TARGET GENE. LOC284360 BINDING SITE is a target binding site found in the 5' untranslated region of mRNA encoded by LOC284360, corresponding to a target binding site such as BINDING SITE I, BINDING SITE II or BINDING SITE III of FIG. 8. Table 4 illustrates the complementarity of the nucleotide sequences of LOC284360 BINDING SITE, designated SEQ ID:14189, to the nucleotide sequence of GAM3499 RNA, herein designated GAM RNA, also designated SEQ ID:226.

Another function of GAM3499 is therefore inhibition of LOC284360 (Accession XP_211433.1). Accordingly, utilities of GAM3499 include diagnosis, prevention and treatment of diseases and clinical conditions associated with LOC284360.

LOC284650 (Accession XP_211571.1) is another GAM3499 target gene, herein designated TARGET GENE. LOC284650 BINDING SITE is a target binding site found in the 5' untranslated region of mRNA encoded by LOC284650, corresponding to a target binding site such as BINDING SITE I, BINDING SITE II or BINDING SITE III of FIG. 8. Table 4 illustrates the complementarity of the nucleotide sequences of LOC284650 BINDING SITE, designated SEQ ID:10960, to the nucleotide sequence of GAM3499 RNA, herein designated GAM RNA, also designated SEQ ID:226.

Another function of GAM3499 is therefore inhibition of LOC284650 (Accession XP_211571.1). Accordingly, utilities of GAM3499 include diagnosis, prevention and treatment of diseases and clinical conditions associated with LOC284650.

LOC284899 (Accession XP_211680.1) is another GAM3499 target gene, herein designated TARGET GENE. LOC284899 BINDING SITE is a target binding site found in the 5' untranslated region of mRNA encoded by LOC284899, corresponding to a target binding site such as BINDING SITE I, BINDING SITE II or BINDING SITE III of FIG. 8. Table 4 illustrates the complementarity of the nucleotide sequences of LOC284899 BINDING SITE, designated SEQ ID:2091, to the nucleotide sequence of GAM3499 RNA, herein designated GAM RNA, also designated SEQ ID:226.

Another function of GAM3499 is therefore inhibition of LOC284899 (Accession XP_211680.1). Accordingly, utilities of GAM3499 include diagnosis, prevention and treatment of diseases and clinical conditions associated with LOC284899.

LOC284999 (Accession XP_211728.1) is another GAM3499 target gene, herein designated TARGET GENE. LOC284999 BINDING SITE is a target binding site found in the 3' untranslated region of mRNA encoded by LOC284999, corresponding to a target binding site such as BINDING SITE I, BINDING SITE II or BINDING SITE III of FIG. 8. Table 4 illustrates the complementarity of the nucleotide sequences of LOC284999 BINDING SITE, designated SEQ ID:15988, to the nucleotide sequence of GAM3499 RNA, herein designated GAM RNA, also designated SEQ ID:226.

Another function of GAM3499 is therefore inhibition of LOC284999 (Accession XP_211728.1). Accordingly, utilities of GAM3499 include diagnosis, prevention and treatment of diseases and clinical conditions associated with LOC284999.

LOC338564 (Accession XP_290466.1) is another GAM3499 target gene, herein designated TARGET GENE. LOC338564 BINDING SITE is a target binding site found in the 3' untranslated region of mRNA encoded by LOC338564, corresponding to a target binding site such as BINDING SITE I, BINDING SITE II or BINDING SITE III of FIG. 8. Table 4 illustrates the complementarity of the nucleotide sequences of LOC338564 BINDING SITE, designated SEQ ID:18841, to the nucleotide sequence of GAM3499 RNA, herein designated GAM RNA, also designated SEQ ID:226.

Another function of GAM3499 is therefore inhibition of LOC338564 (Accession XP_290466.1). Accordingly, utilities of GAM3499 include diagnosis, prevention and treatment of diseases and clinical conditions associated with LOC338564.

LOC339083 (Accession XP_290697.2) is another GAM3499 target gene, herein designated TARGET GENE. LOC339083 BINDING SITE is a target binding site found in the 5' untranslated region of mRNA encoded by LOC339083, corresponding to a target binding site such as BINDING SITE I, BINDING SITE II or BINDING SITE III of FIG. 8. Table 4 illustrates the complementarity of the nucleotide sequences of LOC339083 BINDING SITE, designated SEQ ID:4465, to the nucleotide sequence of GAM3499 RNA, herein designated GAM RNA, also designated SEQ ID:226.

Another function of GAM3499 is therefore inhibition of LOC339083 (Accession XP_290697.2). Accordingly, utilities of GAM3499 include diagnosis, prevention and treatment of diseases and clinical conditions associated with LOC339083.

LOC347042 (Accession XP_299969.1) is another GAM3499 target gene, herein designated TARGET GENE. LOC347042 BINDING SITE is a target binding site found in the 5' untranslated region of mRNA encoded by LOC347042, corresponding to a target binding site such as BINDING SITE I, BINDING SITE II or BINDING SITE III of FIG. 8. Table 4 illustrates the complementarity of the nucleotide sequences of LOC347042 BINDING SITE, designated SEQ ID:15492, to the nucleotide sequence of GAM3499 RNA, herein designated GAM RNA, also designated SEQ ID:226.

Another function of GAM3499 is therefore inhibition of LOC347042 (Accession XP_299969.1). Accordingly, utilities of GAM3499 include diagnosis, prevention and treatment of diseases and clinical conditions associated with LOC347042.

LOC348171 (Accession XP_302672.1) is another GAM3499 target gene, herein designated TARGET GENE. LOC348171 BINDING SITE is a target binding site found in the 3' untranslated region of mRNA encoded by LOC348171, corresponding to a target binding site such as BINDING SITE I, BINDING SITE II or BINDING SITE III of FIG. 8. Table 4 illustrates the complementarity of the nucleotide sequences of LOC348171 BINDING SITE, designated SEQ ID:11763, to the nucleotide sequence of GAM3499 RNA, herein designated GAM RNA, also designated SEQ ID:226.

Another function of GAM3499 is therefore inhibition of LOC348171 (Accession XP_302672.1). Accordingly, utilities of GAM3499 include diagnosis, prevention and treatment of diseases and clinical conditions associated with LOC348171.

LOC349081 (Accession XP_300935.1) is another GAM3499 target gene, herein designated TARGET GENE. LOC349081 BINDING SITE is a target binding site found in the 3' untranslated region of mRNA encoded by LOC349081, corresponding to a target binding site such as BINDING SITE I, BINDING SITE II or BINDING SITE III of FIG. 8. Table 4 illustrates the complementarity of the nucleotide sequences of LOC349081 BINDING SITE, designated SEQ ID:8658, to the nucleotide sequence of GAM3499 RNA, herein designated GAM RNA, also designated SEQ ID:226.

Another function of GAM3499 is therefore inhibition of LOC349081 (Accession XP_300935.1). Accordingly, utilities of GAM3499 include diagnosis, prevention and treatment of diseases and clinical conditions associated with LOC349081.

LOC349094 (Accession XP_300945.1) is another GAM3499 target gene, herein designated TARGET GENE. LOC349094 BINDING SITE is a target binding site found in the 3' untranslated region of mRNA encoded by LOC349094, corresponding to a target binding site such as BINDING SITE I, BINDING SITE II or BINDING SITE III of FIG. 8. Table 4 illustrates the complementarity of the nucleotide sequences of LOC349094 BINDING SITE, designated SEQ ID:3536, to the nucleotide sequence of GAM3499 RNA, herein designated GAM RNA, also designated SEQ ID:226.

Another function of GAM3499 is therefore inhibition of LOC349094 (Accession XP_300945.1). Accordingly, utilities of GAM3499 include diagnosis, prevention and treatment of diseases and clinical conditions associated with LOC349094.

LOC349097 (Accession XP_300940.1) is another GAM3499 target gene, herein designated TARGET GENE. LOC349097 BINDING SITE is a target binding site found in the 3' untranslated region of mRNA encoded by LOC349097, corresponding to a target binding site such as BINDING SITE I, BINDING SITE II or BINDING SITE III of FIG. 8. Table 4 illustrates the complementarity of the nucleotide sequences of LOC349097 BINDING SITE, designated SEQ ID:3536, to the nucleotide sequence of GAM3499 RNA, herein designated GAM RNA, also designated SEQ ID:226.

Another function of GAM3499 is therefore inhibition of LOC349097 (Accession XP_300940.1). Accordingly, utilities of GAM3499 include diagnosis, prevention and treatment of diseases and clinical conditions associated with LOC349097.

LOC349138 (Accession XP_300960.1) is another GAM3499 target gene, herein designated TARGET GENE. LOC349138 BINDING SITE is a target binding site found in the 3' untranslated region of mRNA encoded by LOC349138, corresponding to a target binding site such as BINDING SITE I, BINDING SITE II or BINDING SITE III of FIG. 8. Table 4 illustrates the complementarity of the nucleotide sequences of LOC349138 BINDING SITE, designated SEQ ID:3536, to the nucleotide sequence of GAM3499 RNA, herein designated GAM RNA, also designated SEQ ID:226.

Another function of GAM3499 is therefore inhibition of LOC349138 (Accession XP_300960.1). Accordingly, utilities of GAM3499 include diagnosis, prevention and treatment of diseases and clinical conditions associated with LOC349138.

LOC90826 (Accession NP_612373.1) is another GAM3499 target gene, herein designated TARGET GENE. LOC90826 BINDING SITE is a target binding site found in the 5' untranslated region of mRNA encoded by LOC90826, corresponding to a target binding site such as BINDING SITE I, BINDING SITE II or BINDING SITE III of FIG. 8. Table 4 illustrates the complementarity of the nucleotide sequences of LOC90826 BINDING SITE, designated SEQ ID:8249, to the nucleotide sequence of GAM3499 RNA, herein designated GAM RNA, also designated SEQ ID:226.

Another function of GAM3499 is therefore inhibition of LOC90826 (Accession NP_612373.1). Accordingly, utilities of GAM3499 include diagnosis, prevention and treatment of diseases and clinical conditions associated with LOC90826.

LOC92912 (Accession NP_775740.1) is another GAM3499 target gene, herein designated TARGET GENE. LOC92912 BINDING SITE is a target binding site found in the 3' untranslated region of mRNA encoded by LOC92912, corresponding to a target binding site such as BINDING SITE I, BINDING SITE II or BINDING SITE III of FIG. 8. Table 4 illustrates the complementarity of the nucleotide sequences of LOC92912 BINDING SITE, designated SEQ ID:16021, to the nucleotide sequence of GAM3499 RNA, herein designated GAM RNA, also designated SEQ ID:226.

Another function of GAM3499 is therefore inhibition of LOC92912 (Accession NP_775740.1). Accordingly, utilities of GAM3499 include diagnosis, prevention and treatment of diseases and clinical conditions associated with LOC92912.

Leucine-rich repeat protein, neuronal 1 (LRRN1, Accession NP_065924.1) is another GAM3499 target gene, herein designated TARGET GENE. LRRN1 BINDING SITE is a target binding site found in the 3' untranslated region of mRNA encoded by LRRN1, corresponding to a target binding site such as BINDING SITE I, BINDING SITE II or BINDING SITE III of FIG. 8. Table 4 illustrates the complementarity of the nucleotide sequences of LRRN1 BINDING SITE, designated SEQ ID:7636, to the nucleotide sequence of GAM3499 RNA, herein designated GAM RNA, also designated SEQ ID:226.

Another function of GAM3499 is therefore inhibition of Leucine-rich repeat protein, neuronal 1 (LRRN1, Accession NP_065924.1). Accordingly, utilities of GAM3499 include diagnosis, prevention and treatment of diseases and clinical conditions associated with LRRN1.

Leucine zipper transcription factor-like 1 (LZTFL1, Accession NP_065080.1) is another GAM3499 target gene, herein designated TARGET GENE. LZTFL1 BINDING SITE is a target binding site found in the 3' untranslated region of mRNA encoded by LZTFL1, corresponding to a target binding site such as BINDING SITE I, BINDING SITE II or BINDING SITE III of FIG. 8. Table 4 illustrates the complementarity of the nucleotide sequences of LZTFL1 BINDING SITE, designated SEQ ID:4713, to the nucleotide sequence of GAM3499 RNA, herein designated GAM RNA, also designated SEQ ID:226.

Another function of GAM3499 is therefore inhibition of Leucine zipper transcription factor-like 1 (LZTFL1, Accession NP_065080.1). Accordingly, utilities of GAM3499 include diagnosis, prevention and treatment of diseases and clinical conditions associated with LZTFL1.

Mcf.2 cell line derived transforming sequence (MCF2, Accession NP_005360.2) is another GAM3499 target gene, herein designated TARGET GENE. MCF2 BINDING SITE is a target binding site found in the 3' untranslated region of mRNA encoded by MCF2, corresponding to a target binding site such as BINDING SITE I, BINDING SITE II or BINDING SITE III of FIG. 8. Table 4 illustrates the complementarity of the nucleotide sequences of MCF2 BINDING SITE, designated SEQ ID:17926, to the nucleotide sequence of GAM3499 RNA, herein designated GAM RNA, also designated SEQ ID:226.

Another function of GAM3499 is therefore inhibition of Mcf.2 cell line derived transforming sequence (MCF2, Accession NP_005360.2), a gene which Cytoplasmic oncoprotein similar to vimentin and therefore may be associated with B-cell lymphoma (dbl) oncogene. Accordingly, utilities of GAM3499 include diagnosis, prevention and treatment of B-cell lymphoma (dbl) oncogene., and of other diseases and clinical conditions associated with MCF2.

The function of MCF2 and its association with various diseases and clinical conditions, has been established by previous studies, as described hereinabove with reference to GAM619.1. MGC14836 (Accession NP_219480.1) is another GAM3499 target gene, herein designated TARGET GENE. MGC14836 BINDING SITE is a target binding site found in the 3' untranslated region of mRNA encoded by MGC14836, corresponding to a target binding site such as BINDING SITE I, BINDING SITE II or BINDING SITE III of FIG. 8. Table 4 illustrates the complementarity of the nucleotide sequences of MGC14836 BINDING SITE, designated SEQ ID:6981, to the nucleotide sequence of GAM3499 RNA, herein designated GAM RNA, also designated SEQ ID:226.

Another function of GAM3499 is therefore inhibition of MGC14836 (Accession NP_219480.1). Accordingly, utilities of GAM3499 include diagnosis, prevention and treatment of diseases and clinical conditions associated with MGC14836.

Membrane protein, palmitoylated 3 (maguk p55 subfamily member 3) (MPP3, Accession NP_001923.2) is another GAM3499 target gene, herein designated TARGET GENE. MPP3 BINDING SITE is a target binding site found in the 3' untranslated region of mRNA encoded by MPP3, corresponding to a target binding site such as BINDING SITE I, BINDING SITE II or BINDING SITE III of FIG. 8. Table 4 illustrates the complementarity of the nucleotide sequences of MPP3 BINDING SITE, designated SEQ ID:6425, to the nucleotide sequence of GAM3499 RNA, herein designated GAM RNA, also designated SEQ ID:226.

Another function of GAM3499 is therefore inhibition of Membrane protein, palmitoylated 3 (maguk p55 subfamily member 3) (MPP3, Accession NP_001923.2). Accordingly, utilities of GAM3499 include diagnosis, prevention and treatment of diseases and clinical conditions associated with MPP3.

MPPE1 (Accession NP_075563.2) is another GAM3499 target gene, herein designated TARGET GENE. MPPE1 BINDING SITE is a target binding site found in the 3' untranslated region of mRNA encoded by MPPE1, corresponding to a target binding site such as BINDING SITE I, BINDING SITE II or BINDING SITE III of FIG. 8. Table 4 illustrates the complementarity of the nucleotide sequences of MPPE1 BINDING SITE, designated SEQ ID:13939, to the nucleotide sequence of GAM3499 RNA, herein designated GAM RNA, also designated SEQ ID:226.

Another function of GAM3499 is therefore inhibition of MPPE1 (Accession NP_075563.2). Accordingly, utilities of GAM3499 include diagnosis, prevention and treatment of diseases and clinical conditions associated with MPPE1.

Myosin, heavy polypeptide 11, smooth muscle (MYH11, Accession NP_002465.1) is another GAM3499 target gene, herein designated TARGET GENE. MYH11 BINDING SITE is a target binding site found in the 3' untranslated region of multiple transcripts of mRNA encoded by MYH11, corresponding to a target binding site such as BINDING SITE I, BINDING SITE II or BINDING SITE III of FIG. 8. Table 4 illustrates the complementarity of the nucleotide sequences of MYH11 BINDING SITE, designated SEQ ID:6924, to the nucleotide sequence of GAM3499 RNA, herein designated GAM RNA, also designated SEQ ID:226.

Another function of GAM3499 is therefore inhibition of Myosin, heavy polypeptide 11, smooth muscle (MYH11, Accession NP_002465.1), a gene which is involved in muscle contraction. and therefore may be associated with Acute myeloid leukemia. Accordingly, utilities of GAM3499 include diagnosis, prevention and treatment of Acute myeloid leukemia, and of other diseases and clinical conditions associated with MYH11.

The function of MYH11 and its association with various diseases and clinical conditions, has been established by previous studies, as described hereinabove with reference to GAM291.1. Myosin, heavy polypeptide 11, smooth muscle (MYH11, Accession NP_074035.1) is another GAM3499 target gene, herein designated TARGET GENE. MYH11 BINDING SITE is a target binding site found in the 3' untranslated region of multiple transcripts of mRNA encoded by MYH11, corresponding to a target binding site such as BINDING SITE I, BINDING SITE II or BINDING SITE III of FIG. 8. Table 4 illustrates the complementarity of the nucleotide sequences of MYH11 BINDING SITE, designated SEQ ID:6924, to the nucleotide sequence of GAM3499 RNA, herein designated GAM RNA, also designated SEQ ID:226.

Another function of GAM3499 is therefore inhibition of Myosin, heavy polypeptide 11, smooth muscle (MYH11, Accession NP_074035.1), a gene which is involved in muscle contraction. and therefore may be associated with Acute myeloid leukemia. Accordingly, utilities of GAM3499 include diagnosis, prevention and treatment of Acute myeloid leukemia, and of other diseases and clinical conditions associated with MYH11.

The function of MYH11 and its association with various diseases and clinical conditions, has been established by previous studies, as described hereinabove with reference to GAM291.1. Nuclear receptor interacting protein 1 (NRIP1, Accession NP_003480.1) is another GAM3499 target gene, herein designated TARGET GENE. NRIP1 BINDING SITE is a target binding site found in the 3' untranslated region of multiple transcripts of mRNA encoded by NRIP1, corresponding to a target binding site such as BINDING SITE I, BINDING SITE II or BINDING SITE III of FIG. 8. Table 4 illustrates the complementarity of the nucleotide sequences of NRIP1 BINDING SITE, designated SEQ ID:11880, to the nucleotide sequence of GAM3499 RNA, herein designated GAM RNA, also designated SEQ ID:226.

Another function of GAM3499 is therefore inhibition of Nuclear receptor interacting protein 1 (NRIP1, Accession NP_003480.1), a gene which modulates transcriptional activation by the estrogen receptor. Accordingly, utilities of GAM3499 include diagnosis, prevention and treatment of diseases and clinical conditions associated with NRIP1.

The function of NRIP1 and its association with various diseases and clinical conditions, has been established by previous studies, as described hereinabove with reference to GAM223.1. Nuclear receptor interacting protein 1 (NRIP1, Accession XP_009699.1) is another GAM3499 target gene, herein designated TARGET GENE. NRIP1 BINDING SITE is a target binding site found in the 3' untranslated region of multiple transcripts of mRNA encoded by NRIP1, corresponding to a target binding site such as BINDING SITE I, BINDING SITE II or BINDING SITE III of FIG. 8. Table 4 illustrates the complementarity of the nucleotide sequences of NRIP1 BINDING SITE, designated SEQ ID:11880, to the nucleotide sequence of GAM3499 RNA, herein designated GAM RNA, also designated SEQ ID:226.

Another function of GAM3499 is therefore inhibition of Nuclear receptor interacting protein 1 (NRIP1, Accession XP_009699.1), a gene which modulates transcriptional activation by the estrogen receptor. Accordingly, utilities of GAM3499 include diagnosis, prevention and treatment of diseases and clinical conditions associated with NRIP1.

The function of NRIP1 and its association with various diseases and clinical conditions, has been established by previous studies, as described hereinabove with reference to GAM223.1. Origin recognition complex, subunit 4-like (yeast) (ORC4L, Accession NP_002543.1) is another GAM3499 target gene, herein designated TARGET GENE. ORC4L BINDING SITE is a target binding site found in the 3' untranslated region of mRNA encoded by ORC4L, corresponding to a target binding site such as BINDING SITE I, BINDING SITE II or BINDING SITE III of FIG. 8. Table 4 illustrates the complementarity of the nucleotide sequences of ORC4L BINDING SITE, designated SEQ ID:5097, to the nucleotide sequence of GAM3499 RNA, herein designated GAM RNA, also designated SEQ ID:226.

Another function of GAM3499 is therefore inhibition of Origin recognition complex, subunit 4-like (yeast) (ORC4L, Accession NP_002543.1), a gene which may be required for initiation of DNA replication and has a putative nucleotide triphosphate binding motif. Accordingly, utilities of GAM3499 include diagnosis, prevention and treatment of diseases and clinical conditions associated with ORC4L.

The function of ORC4L and its association with various diseases and clinical conditions, has been established by previous studies, as described hereinabove with reference to GAM203.2. Protocadherin beta 7 (PCDHB7, Accession NP_061763.1) is another GAM3499 target gene, herein designated TARGET GENE. PCDHB7 BINDING SITE is a target binding site found in the 3' untranslated region of mRNA encoded by PCDHB7, corresponding to a target binding site such as BINDING SITE I, BINDING SITE II or BINDING SITE III of FIG. 8. Table 4 illustrates the complementarity of the nucleotide sequences of PCDHB7 BINDING SITE, designated SEQ ID:9936, to the nucleotide sequence of GAM3499 RNA, herein designated GAM RNA, also designated SEQ ID:226.

Another function of GAM3499 is therefore inhibition of Protocadherin beta 7 (PCDHB7, Accession NP_061763.1). Accordingly, utilities of GAM3499 include diagnosis, prevention and treatment of diseases and clinical conditions associated with PCDHB7.

PRO0478 (Accession NP_054848.1) is another GAM3499 target gene, herein designated TARGET GENE. PRO0478 BINDING SITE is a target binding site found in the 3' untranslated region of mRNA encoded by PRO0478, corresponding to a target binding site such as BINDING SITE I, BINDING SITE II or BINDING SITE III of FIG. 8. Table 4 illustrates the complementarity of the nucleotide sequences of PRO0478 BINDING SITE, designated SEQ ID:2029, to the nucleotide sequence of GAM3499 RNA, herein designated GAM RNA, also designated SEQ ID:226.

Another function of GAM3499 is therefore inhibition of PRO0478 (Accession NP_054848.1). Accordingly, utilities of GAM3499 include diagnosis, prevention and treatment of diseases and clinical conditions associated with PRO0478.

Ptk2 protein tyrosine kinase 2 (PTK2, Accession NP_005598.3) is another GAM3499 target gene, herein designated TARGET GENE. PTK2 BINDING SITE is a target binding site found in the 3' untranslated region of multiple transcripts of mRNA encoded by PTK2, corresponding to a target binding site such as BINDING SITE I, BINDING SITE II or BINDING SITE III of FIG. 8. Table 4 illustrates the complementarity of the nucleotide sequences of PTK2 BINDING SITE, designated SEQ ID:9167, to the nucleotide sequence of GAM3499 RNA, herein designated GAM RNA, also designated SEQ ID:226.

Another function of GAM3499 is therefore inhibition of Ptk2 protein tyrosine kinase 2 (PTK2, Accession NP_005598.3), a gene which involves in intracellular signal transduction pathway and is a putative homolog of chicken focal adhesion associated kinase. Accordingly, utilities of GAM3499 include diagnosis, prevention and treatment of diseases and clinical conditions associated with PTK2.

The function of PTK2 and its association with various diseases and clinical conditions, has been established by previous studies, as described hereinabove with reference to GAM65.2. Ptk2 protein tyrosine kinase 2 (PTK2, Accession NP_722560.1) is another GAM3499 target gene, herein designated TARGET GENE. PTK2 BINDING SITE is a target binding site found in the 3' untranslated region of multiple transcripts of mRNA encoded by PTK2, corresponding to a target binding site such as BINDING SITE I, BINDING SITE II or BINDING SITE III of FIG. 8. Table 4 illustrates the complementarity of the nucleotide sequences of PTK2 BINDING SITE, designated SEQ ID:9167, to the nucleotide sequence of GAM3499 RNA, herein designated GAM RNA, also designated SEQ ID:226.

Another function of GAM3499 is therefore inhibition of Ptk2 protein tyrosine kinase 2 (PTK2, Accession NP_722560.1), a gene which involves in intracellular signal transduction pathway and is a putative homolog of chicken focal adhesion associated kinase. Accordingly, utilities of GAM3499 include diagnosis, prevention and treatment of diseases and clinical conditions associated with PTK2.

The function of PTK2 and its association with various diseases and clinical conditions, has been established by previous studies, as described hereinabove with reference to GAM65.2. Protein tyrosine phosphatase, receptor type, c (PTPRC, Accession NP_002829.2) is another GAM3499 target gene, herein designated TARGET GENE. PTPRC BINDING SITE is a target binding site found in the 3' untranslated region of multiple transcripts of mRNA encoded by PTPRC, corresponding to a target binding site such as BINDING SITE I, BINDING SITE II or BINDING SITE III of FIG. 8. Table 4 illustrates the complementarity of the nucleotide sequences of PTPRC BINDING SITE, designated SEQ ID:18645, to the nucleotide sequence of GAM3499 RNA, herein designated GAM RNA, also designated SEQ ID:226.

Another function of GAM3499 is therefore inhibition of Protein tyrosine phosphatase, receptor type, c (PTPRC, Accession NP_002829.2). Accordingly, utilities of GAM3499 include diagnosis, prevention and treatment of diseases and clinical conditions associated with PTPRC.

Protein tyrosine phosphatase, receptor type, c (PTPRC, Accession NP_563579.1) is another GAM3499 target gene, herein designated TARGET GENE. PTPRC BINDING SITE is a target binding site found in the 3' untranslated region of multiple transcripts of mRNA encoded by PTPRC, corresponding to a target binding site such as BINDING SITE I, BINDING SITE II or BINDING SITE III of FIG. 8. Table 4 illustrates the complementarity of the nucleotide sequences of PTPRC BINDING SITE, designated SEQ ID:18645, to the nucleotide sequence of GAM3499 RNA, herein designated GAM RNA, also designated SEQ ID:226.

Another function of GAM3499 is therefore inhibition of Protein tyrosine phosphatase, receptor type, c (PTPRC, Accession NP_563579.1). Accordingly, utilities of GAM3499 include diagnosis, prevention and treatment of diseases and clinical conditions associated with PTPRC.

Protein tyrosine phosphatase, receptor type, c (PTPRC, Accession NP_563578.1) is another GAM3499 target gene, herein designated TARGET GENE. PTPRC BINDING SITE is a target binding site found in the 3' untranslated region of multiple transcripts of mRNA encoded by PTPRC, corresponding to a target binding site such as BINDING SITE I, BINDING SITE II or BINDING SITE III of FIG. 8. Table 4 illustrates the complementarity of the nucleotide sequences of PTPRC BINDING SITE, designated SEQ ID:18645, to the nucleotide sequence of GAM3499 RNA, herein designated GAM RNA, also designated SEQ ID:226.

Another function of GAM3499 is therefore inhibition of Protein tyrosine phosphatase, receptor type, c (PTPRC, Accession NP_563578.1). Accordingly, utilities of GAM3499 include diagnosis, prevention and treatment of diseases and clinical conditions associated with PTPRC.

RAD18 (Accession NP_064550.2) is another GAM3499 target gene, herein designated TARGET GENE. RAD18 BINDING SITE is a target binding site found in the 3' untranslated region of mRNA encoded by RAD18, corresponding to a target binding site such as BINDING SITE I, BINDING SITE II or BINDING SITE III of FIG. 8. Table 4 illustrates the complementarity of the nucleotide sequences of RAD18 BINDING SITE, designated SEQ ID:3162, to the nucleotide sequence of GAM3499 RNA, herein designated GAM RNA, also designated SEQ ID:226.

Another function of GAM3499 is therefore inhibition of RAD18 (Accession NP_064550.2), a gene which functions with dna repair protein rad5 in error-free postreplication dna repair and therefore may be associated with Cancer. Accordingly, utilities of GAM3499 include diagnosis, prevention and treatment of Cancer, and of other diseases and clinical conditions associated with RAD18.

The function of RAD18 and its association with various diseases and clinical conditions, has been established by previous studies, as described hereinabove with reference to GAM55.2. SB52 (Accession NP_612208.1) is another GAM3499 target gene, herein designated TARGET GENE. SB52 BINDING SITE is a target binding site found in the 3' untranslated region of mRNA encoded by SB52, corresponding to a target binding site such as BINDING SITE I, BINDING SITE II or BINDING SITE III of FIG. 8. Table 4 illustrates the complementarity of the nucleotide sequences of SB52 BINDING SITE, designated SEQ ID:6196, to the nucleotide sequence of GAM3499 RNA, herein designated GAM RNA, also designated SEQ ID:226.

Another function of GAM3499 is therefore inhibition of SB52 (Accession NP_612208.1). Accordingly, utilities of GAM3499 include diagnosis, prevention and treatment of diseases and clinical conditions associated with SB52.

SEC15B (Accession XP_039570.3) is another GAM3499 target gene, herein designated TARGET GENE. SEC15B BINDING SITE is a target binding site found in the 3' untranslated region of mRNA encoded by SEC15B, corresponding to a target binding site such as BINDING SITE I, BINDING SITE II or BINDING SITE III of FIG. 8. Table 4 illustrates the complementarity of the nucleotide sequences of SEC15B BINDING SITE, designated SEQ ID:4566, to the nucleotide sequence of GAM3499 RNA, herein designated GAM RNA, also designated SEQ ID:226.

Another function of GAM3499 is therefore inhibition of SEC15B (Accession XP_039570.3). Accordingly, utilities of GAM3499 include diagnosis, prevention and treatment of diseases and clinical conditions associated with SEC15B.

SLC35E2 (Accession XP_049733.6) is another GAM3499 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:8532, to the nucleotide sequence of GAM3499 RNA, herein designated GAM RNA, also designated SEQ ID:226.

Another function of GAM3499 is therefore inhibition of SLC35E2 (Accession XP_049733.6). Accordingly, utilities of GAM3499 include diagnosis, prevention and treatment of diseases and clinical conditions associated with SLC35E2.

SNX22 (Accession NP_079074.1) is another GAM3499 target gene, herein designated TARGET GENE. SNX22 BINDING SITE1 and SNX22 BINDING SITE2 are target binding sites found in untranslated regions of mRNA encoded by SNX22, corresponding to target binding sites such as BINDING SITE I, BINDING SITE II or BINDING SITE III of FIG. 8. Table 4 illustrates the complementarity of the nucleotide sequences of SNX22 BINDING SITE1 and SNX22 BINDING SITE2, designated SEQ ID:7099 and SEQ ID:11732 respectively, to the nucleotide sequence of GAM3499 RNA, herein designated GAM RNA, also designated SEQ ID:226.

Another function of GAM3499 is therefore inhibition of SNX22 (Accession NP_079074.1). Accordingly, utilities of GAM3499 include diagnosis, prevention and treatment of diseases and clinical conditions associated with SNX22.

Sprouty homolog 3 (drosophila) (SPRY3, Accession NP_005831.1) is another GAM3499 target gene, herein designated TARGET GENE. SPRY3 BINDING SITE is a target binding site found in the 3' untranslated region of mRNA encoded by SPRY3, corresponding to a target binding site such as BINDING SITE I, BINDING SITE II or BINDING SITE III of FIG. 8. Table 4 illustrates the complementarity of the nucleotide sequences of SPRY3 BINDING SITE, designated SEQ ID:428, to the nucleotide sequence of GAM3499 RNA, herein designated GAM RNA, also designated SEQ ID:226.

Another function of GAM3499 is therefore inhibition of Sprouty homolog 3 (drosophila) (SPRY3, Accession NP_005831.1). Accordingly, utilities of GAM3499 include diagnosis, prevention and treatment of diseases and clinical conditions associated with SPRY3.

Tgfb-induced factor 2 (tale family homeobox) (TGIF2, Accession NP_068581.1) is another GAM3499 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:7688, to the nucleotide sequence of GAM3499 RNA, herein designated GAM RNA, also designated SEQ ID:226.

Another function of GAM3499 is therefore inhibition of Tgfb-induced factor 2 (tale family homeobox) (TGIF2, Accession NP_068581.1). Accordingly, utilities of GAM3499 include diagnosis, prevention and treatment of diseases and clinical conditions associated with TGIF2.

Triple homeobox 1 (TIX1, Accession NP_055850.1) is another GAM3499 target gene, herein designated TARGET GENE. TIX1 BINDING SITE is a target binding site found in the 3' untranslated region of mRNA encoded by TIX1, corresponding to a target binding site such as BINDING SITE I, BINDING SITE II or BINDING SITE III of FIG. 8. Table 4 illustrates the complementarity of the nucleotide sequences of TIX1 BINDING SITE, designated SEQ ID:17199, to the nucleotide sequence of GAM3499 RNA, herein designated GAM RNA, also designated SEQ ID:226.

Another function of GAM3499 is therefore inhibition of Triple homeobox 1 (TIX1, Accession NP_055850.1). Accordingly, utilities of GAM3499 include diagnosis, prevention and treatment of diseases and clinical conditions associated with TIX1.

Toll-like receptor 3 (TLR3, Accession NP_003256.1) is another GAM3499 target gene, herein designated TARGET GENE. TLR3 BINDING SITE is a target binding site found in the 3' untranslated region of mRNA encoded by TLR3, corresponding to a target binding site such as BINDING SITE I, BINDING SITE II or BINDING SITE III of FIG. 8. Table 4 illustrates the complementarity of the nucleotide sequences of TLR3 BINDING SITE, designated SEQ ID:13708, to the nucleotide sequence of GAM3499 RNA, herein designated GAM RNA, also designated SEQ ID:226.

Another function of GAM3499 is therefore inhibition of Toll-like receptor 3 (TLR3, Accession NP_003256.1), a gene which involves in host defense against viruses. Accordingly, utilities of GAM3499 include diagnosis, prevention and treatment of diseases and clinical conditions associated with TLR3.

The function of TLR3 and its association with various diseases and clinical conditions, has been established by previous studies, as described hereinabove with reference to GAM1490.1. Topoisomerase (dna) ii alpha 170 kda (TOP2A, Accession NP_001058.2) is another GAM3499 target gene, herein designated TARGET GENE. TOP2A BINDING SITE is a target binding site found in the 3' untranslated region of mRNA encoded by TOP2A, corresponding to a target binding site such as BINDING SITE I, BINDING SITE II or BINDING SITE III of FIG. 8. Table 4 illustrates the complementarity of the nucleotide sequences of TOP2A BINDING SITE, designated SEQ ID:14864, to the nucleotide sequence of GAM3499 RNA, herein designated GAM RNA, also designated SEQ ID:226.

Another function of GAM3499 is therefore inhibition of Topoisomerase (dna) ii alpha 170 kda (TOP2A, Accession NP_001058.2). Accordingly, utilities of GAM3499 include diagnosis, prevention and treatment of diseases and clinical conditions associated with TOP2A.

TP53BPL (Accession NP_005793.1) is another GAM3499 target gene, herein designated TARGET GENE. TP53BPL BINDING SITE is a target binding site found in the 3' untranslated region of mRNA encoded by TP53BPL, corresponding to a target binding site such as BINDING SITE I, BINDING SITE II or BINDING SITE III of FIG. 8. Table 4 illustrates the complementarity of the nucleotide sequences of TP53BPL BINDING SITE, designated SEQ ID:1710, to the nucleotide sequence of GAM3499 RNA, herein designated GAM RNA, also designated SEQ ID:226.

Another function of GAM3499 is therefore inhibition of TP53BPL (Accession NP_005793.1). Accordingly, utilities of GAM3499 include diagnosis, prevention and treatment of diseases and clinical conditions associated with TP53BPL.

VN1R1 (Accession NP_065684.1) is another GAM3499 target gene, herein designated TARGET GENE. VN1R1 BINDING SITE is a target binding site found in the 3' untranslated region of mRNA encoded by VN1R1, corresponding to a target binding site such as BINDING SITE I, BINDING SITE II or BINDING SITE III of FIG. 8. Table 4 illustrates the complementarity of the nucleotide sequences of VN1R1 BINDING SITE, designated SEQ ID:14407, to the nucleotide sequence of GAM3499 RNA, herein designated GAM RNA, also designated SEQ ID:226.

Another function of GAM3499 is therefore inhibition of VN1R1 (Accession NP_065684.1). Accordingly, utilities of GAM3499 include diagnosis, prevention and treatment of diseases and clinical conditions associated with VN1R1.

Williams beuren syndrome chromosome region 19 (WBSCR19, Accession NP_778234.2) is another GAM3499 target gene, herein designated TARGET GENE. WBSCR19 BINDING SITE is a target binding site found in the 3' untranslated region of mRNA encoded by WBSCR19, corresponding to a target binding site such as BINDING SITE I, BINDING SITE II or BINDING SITE III of FIG. 8. Table 4 illustrates the complementarity of the nucleotide sequences of WBSCR19 BINDING SITE, designated SEQ ID:3019, to the nucleotide sequence of GAM3499 RNA, herein designated GAM RNA, also designated SEQ ID:226.

Another function of GAM3499 is therefore inhibition of Williams beuren syndrome chromosome region 19 (WBSCR19, Accession NP_778234.2). Accordingly, utilities of GAM3499 include diagnosis, prevention and treatment of diseases and clinical conditions associated with WBSCR19.

Zinc finger protein 214 (ZNF214, Accession NP_037381.1) is another GAM3499 target gene, herein designated TARGET GENE. ZNF214 BINDING SITE is a target binding site found in the 3' untranslated region of mRNA encoded by ZNF214, corresponding to a target binding site such as BINDING SITE I, BINDING SITE II or BINDING SITE III of FIG. 8. Table 4 illustrates the complementarity of the nucleotide sequences of ZNF214 BINDING SITE, designated SEQ ID:6248, to the nucleotide sequence of GAM3499 RNA, herein designated GAM RNA, also designated SEQ ID:226.

Another function of GAM3499 is therefore inhibition of Zinc finger protein 214 (ZNF214, Accession NP_037381.1). Accordingly, utilities of GAM3499 include diagnosis, prevention and treatment of diseases and clinical conditions associated with ZNF214.

ZNF333 (Accession NP_115809.1) is another GAM3499 target gene, herein designated TARGET GENE. ZNF333 BINDING SITE is a target binding site found in the 3' untranslated region of mRNA encoded by ZNF333, corresponding to a target binding site such as BINDING SITE I, BINDING SITE II or BINDING SITE III of FIG. 8. Table 4 illustrates the complementarity of the nucleotide sequences of ZNF333 BINDING SITE, designated SEQ ID:15527, to the nucleotide sequence of GAM3499 RNA, herein designated GAM RNA, also designated SEQ ID:226.

Another function of GAM3499 is therefore inhibition of ZNF333 (Accession NP_115809.1). Accordingly, utilities of GAM3499 include diagnosis, prevention and treatment of diseases and clinical conditions associated with ZNF333.

Zinc finger protein 36 (kox 18) (ZNF36, Accession XP_168302.1) is another GAM3499 target gene, herein designated TARGET GENE. ZNF36 BINDING SITE is a target binding site found in the 3' untranslated region of mRNA encoded by ZNF36, corresponding to a target binding site such as BINDING SITE I, BINDING SITE II or BINDING SITE III of FIG. 8. Table 4 illustrates the complementarity of the nucleotide sequences of ZNF36 BINDING SITE, designated SEQ ID:10965, to the nucleotide sequence of GAM3499 RNA, herein designated GAM RNA, also designated SEQ ID:226.

Another function of GAM3499 is therefore inhibition of Zinc finger protein 36 (kox 18) (ZNF36, Accession XP_168302.1), a gene which may be involved in transcriptional regulation. Accordingly, utilities of GAM3499 include diagnosis, prevention and treatment of diseases and clinical conditions associated with ZNF36.

The function of ZNF36 and its association with various diseases and clinical conditions, has been established by previous studies, as described hereinabove with reference to GAM31.1.

FIG. 8 further provides a conceptual description of a novel bioinformatically detected of the present invention, referred to here as Genomic Address Messenger 3770 (GAM3770), which modulates expression of respective target genes thereof, the function and utility of which target genes is known in the art.

GAM3770 is a novel bioinformatically detected regulatory, non protein coding, micro RNA (miRNA) gene. The method by which GAM3770 was detected is described hereinabove with reference to FIGS. 8-15.

GAM3770 gene, herein designated GAM GENE, and GAM3770 target gene, herein designated TARGET GENE, are human genes contained in the human genome.

GAM3770 gene encodes a GAM3770 precursor RNA, herein designated GAM PRECURSOR RNA. Similar to other miRNA genes, and unlike most ordinary genes, GAM3770 precursor RNA does not encode a protein. A nucleotide sequence identical or highly similar to the nucleotide sequence of GAM3770 precursor RNA is designated SEQ ID:29, and is provided hereinbelow with reference to the sequence listing part.

GAM3770 precursor RNA folds onto itself, forming GAM3770 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM3770 precursor RNA folds onto itself, forming GAM3770 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM3770 precursor RNA, designated SEQ-ID:29, and a schematic representation of a predicted secondary folding of GAM3770 folded precursor RNA are further described with reference to Table 2, hereby incorporated by reference.

An enzyme complex designated DICER COMPLEX, 'dices' the GAM3770 folded precursor RNA into GAM3770 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM3770 RNA is designated SEQ ID:281, and is provided hereinbelow with references to the sequence listing part and Table 3, hereby incorporated by reference.

GAM3770 target gene, herein designated TARGET GENE, encodes a corresponding messenger RNA, GAM3770 target RNA, herein designated GAM TARGET RNA. GAM3770 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM3770 RNA, herein designated GAM RNA, binds complementarily to one or more target binding sites located in untranslated regions of GAM3770 target RNA, herein designated GAM TARGET RNA. This complementary binding is due to the fact that the nucleotide sequence of GAM3770 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM3770 RNA may have a different number of target binding sites in untranslated regions of a GAM3770 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM3770 RNA, herein designated GAM RNA, to target binding sites on GAM3770 target RNA, herein designated GAM TARGET RNA, such as BINDING SITE I, BINDING SITE II and BINDING SITE III, inhibits translation of GAM3770 target RNA into GAM3770 target protein, herein designated GAM TARGET PROTEIN. GAM target protein is therefore outlined by a broken line.

It is appreciated that GAM3770 target gene, herein designated TARGET GENE, in fact represents a plurality of GAM3770 target genes. The mRNA of each one of this plurality of GAM3770 target genes comprises one or more target binding sites, each having a nucleotide sequence which is at least partly complementary to GAM3770 RNA, herein designated GAM RNA, and which when bound by GAM3770 RNA causes inhibition of translation of respective one or more GAM3770 target proteins.

It is further appreciated by one skilled in the art that the mode of translational inhibition illustrated by FIG. 8 with specific reference to translational inhibition exerted by GAM3770 gene, herein designated GAM GENE, on one or more GAM3770 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM3770 correlate with, and may be deduced from, the identity of the target genes which GAM3770 binds and inhibits, and the function of these target genes, as elaborated hereinbelow.

Atp-binding cassette, sub-family d (ald), member 2 (ABCD2, Accession NP_005155.1) is a GAM3770 target gene, herein designated TARGET GENE. ABCD2 BINDING SITE is a target binding site found in the 5' untranslated region of mRNA encoded by ABCD2, corresponding to a target binding site such as BINDING SITE I, BINDING SITE II or BINDING SITE III of FIG. 8. Table 4 illustrates the complementarity of the nucleotide sequences of ABCD2 BINDING SITE, designated SEQ ID:19013, to the nucleotide sequence of GAM3770 RNA, herein designated GAM RNA, also designated SEQ ID:281.

A function of GAM3770 is therefore inhibition of Atp-binding cassette, sub-family d (ald), member 2 (ABCD2, Accession NP_005155.1), a gene which probable transporter. and therefore may be associated with Adrenoleukodystrophy. Accordingly, utilities of GAM3770 include diagnosis, prevention and treatment of Adrenoleukodystrophy, and of other diseases and clinical conditions associated with ABCD2.

The function of ABCD2 and its association with various diseases and clinical conditions, has been established by previous studies, as described hereinabove with reference to GAM47.1. Atp-binding cassette, sub-family f (gcn20), member 2 (ABCF2, Accession NP_009120.1) is another GAM3770 target gene, herein designated TARGET GENE. ABCF2 BINDING SITE is a target binding site found in the 3' untranslated region of multiple transcripts of mRNA encoded by ABCF2, corresponding to a target binding site such as BINDING SITE I, BINDING SITE II or BINDING SITE III of FIG. 8. Table 4 illustrates the complementarity of the nucleotide sequences of ABCF2 BINDING SITE, designated SEQ ID:484, to the nucleotide sequence of GAM3770 RNA, herein designated GAM RNA, also designated SEQ ID:281.

Another function of GAM3770 is therefore inhibition of Atp-binding cassette, sub-family f (gcn20), member 2 (ABCF2, Accession NP_009120.1). Accordingly, utilities of GAM3770 include diagnosis, prevention and treatment of diseases and clinical conditions associated with ABCF2.

Arp1 actin-related protein 1 homolog a, centractin alpha (yeast) (ACTR1A, Accession NP_005727.1) is another GAM3770 target gene, herein designated TARGET GENE. ACTR1A BINDING SITE is a target binding site found in the 3' untranslated region of mRNA encoded by ACTR1A, corresponding to a target binding site such as BINDING SITE I, BINDING SITE II or BINDING SITE III of FIG. 8. Table 4 illustrates the complementarity of the nucleotide sequences of ACTR1A BINDING SITE, designated SEQ ID:6045, to the nucleotide sequence of GAM3770 RNA, herein designated GAM RNA, also designated SEQ ID:241.

Another function of GAM3770 is therefore inhibition of Arp1 actin-related protein 1 homolog a, centractin alpha (yeast) (ACTR1A, Accession NP_005727.1). Accordingly, utilities of GAM3770 include diagnosis, prevention and treatment of diseases and clinical conditions associated with ACTR1A.

A kinase (prka) anchor protein 2 (AKAP2, Accession NP_009134.1) is another GAM3770 target gene, herein designated TARGET GENE. AKAP2 BINDING SITE is a target binding site found in the 3' untranslated region of multiple transcripts of mRNA encoded by AKAP2, corresponding to a target binding site such as BINDING SITE I, BINDING SITE II or BINDING SITE III of FIG. 8. Table 4 illustrates the complementarity of the nucleotide sequences of AKAP2 BINDING SITE, designated SEQ ID:7250, to the nucleotide sequence of GAM3770 RNA, herein designated GAM RNA, also designated SEQ ID:281.

Another function of GAM3770 is therefore inhibition of A kinase (prka) anchor protein 2 (AKAP2, Accession NP_009134.1), a gene which binds to regulatory subunit (rii) of protein kinase a. Accordingly, utilities of GAM3770 include diagnosis, prevention and treatment of diseases and clinical conditions associated with AKAP2.

The function of AKAP2 and its association with various diseases and clinical conditions, has been established by previous studies, as described hereinabove with reference to GAM94.1. Aldehyde dehydrogenase 3 family, member a2 (ALDH3A2, Accession NP_000373.1) is another GAM3770 target gene, herein designated TARGET GENE. ALDH3A2 BINDING SITE is a target binding site found in the 3' untranslated region of mRNA encoded by ALDH3A2, corresponding to a target binding site such as BINDING SITE I, BINDING SITE II or BINDING SITE III of FIG. 8. Table 4 illustrates the complementarity of the nucleotide sequences of ALDH3A2 BINDING SITE, designated SEQ ID:15493, to the nucleotide sequence of GAM3770 RNA, herein designated GAM RNA, also designated SEQ ID:281.

Another function of GAM3770 is therefore inhibition of Aldehyde dehydrogenase 3 family, member a2 (ALDH3A2, Accession NP_000373.1). Accordingly, utilities of GAM3770 include diagnosis, prevention and treatment of diseases and clinical conditions associated with ALDH3A2.

Aldehyde dehydrogenase 6 family, member a1 (ALDH6A1, Accession NP_005580.1) is another GAM3770 target gene, herein designated TARGET GENE. ALDH6A1 BINDING SITE is a target binding site found in the 5' untranslated region of mRNA encoded by ALDH6A1, corresponding to a target binding site such as BINDING SITE I, BINDING SITE II or BINDING SITE III of FIG. 8. Table 4 illustrates the complementarity of the nucleotide sequences of ALDH6A1 BINDING SITE, designated SEQ ID:7652, to the nucleotide sequence of GAM3770 RNA, herein designated GAM RNA, also designated SEQ ID:281.

Another function of GAM3770 is therefore inhibition of Aldehyde dehydrogenase 6 family, member a1 (ALDH6A1, Accession NP_005580.1). Accordingly, utilities of GAM3770 include diagnosis, prevention and treatment of diseases and clinical conditions associated with ALDH6A1.

Aldehyde dehydrogenase 9 family, member a1 (ALDH9A1, Accession NP_000687.2) is another GAM3770 target gene, herein designated TARGET GENE. ALDH9A1 BINDING SITE is a target binding site found in the 5' untranslated region of mRNA encoded by ALDH9A1, corresponding to a target binding site such as BINDING SITE I, BINDING SITE II or BINDING SITE III of FIG. 8. Table 4 illustrates the complementarity of the nucleotide sequences of ALDH9A1 BINDING SITE, designated SEQ ID:4064, to the nucleotide sequence of GAM3770 RNA, herein designated GAM RNA, also designated SEQ ID:281.

Another function of GAM3770 is therefore inhibition of Aldehyde dehydrogenase 9 family, member a1 (ALDH9A1, Accession NP_000687.2). Accordingly, utilities of GAM3770 include diagnosis, prevention and treatment of diseases and clinical conditions associated with ALDH9A1.

Autocrine motility factor receptor (AMFR, Accession NP_620408.1) is another GAM3770 target gene, herein designated TARGET GENE. AMFR BINDING SITE is a target binding site found in the 3' untranslated region of multiple transcripts of mRNA encoded by AMFR, corresponding to a target binding site such as BINDING SITE I, BINDING SITE II or BINDING SITE III of FIG. 8. Table 4 illustrates the complementarity of the nucleotide sequences of AMFR BINDING SITE, designated SEQ ID:6822, to the nucleotide sequence of GAM3770 RNA, herein designated GAM RNA, also designated SEQ ID:241.

Another function of GAM3770 is therefore inhibition of Autocrine motility factor receptor (AMFR, Accession NP_620408.1), a gene which acts to stimulate migration of fibrosarcoma cells and therefore may be associated with Tumors. Accordingly, utilities of GAM3770 include diagnosis, prevention and treatment of Tumors, and of other diseases and clinical conditions associated with AMFR.

The function of AMFR and its association with various diseases and clinical conditions, has been established by previous studies, as described hereinabove with reference to GAM63.1. Autocrine motility factor receptor (AMFR, Accession NP_001135.3) is another GAM3770 target gene, herein designated TARGET GENE. AMFR BINDING SITE is a target binding site found in the 3' untranslated region of multiple transcripts of mRNA encoded by AMFR, corresponding to a target binding site such as BINDING SITE I, BINDING SITE II or BINDING SITE III of FIG. 8. Table 4 illustrates the complementarity of the nucleotide sequences of AMFR BINDING SITE, designated SEQ ID:6822, to the nucleotide sequence of GAM3770 RNA, herein designated GAM RNA, also designated SEQ ID:241.

Another function of GAM3770 is therefore inhibition of Autocrine motility factor receptor (AMFR, Accession NP_001135.3), a gene which acts to stimulate migration of fibrosarcoma cells and therefore may be associated with Tumors. Accordingly, utilities of GAM3770 include diagnosis, prevention and treatment of Tumors, and of other diseases and clinical conditions associated with AMFR.

The function of AMFR and its association with various diseases and clinical conditions, has been established by previous studies, as described hereinabove with reference to GAM63.1. Adenosine monophosphate deaminase (isoform e) (AMPD3, Accession NP_000471.1) is another GAM3770 target gene, herein designated TARGET GENE. AMPD3 BINDING SITE is a target binding site found in the 3' untranslated region of mRNA encoded by AMPD3, corresponding to a target binding site such as BINDING SITE I, BINDING SITE II or BINDING SITE III of FIG. 8. Table 4 illustrates the complementarity of the nucleotide sequences of AMPD3 BINDING SITE, designated SEQ ID:2981, to the nucleotide sequence of GAM3770 RNA, herein designated GAM RNA, also designated SEQ ID:281.

Another function of GAM3770 is therefore inhibition of Adenosine monophosphate deaminase (isoform e) (AMPD3, Accession NP_000471.1), a gene which plays a critical role in energy metabolism. Accordingly, utilities of GAM3770 include diagnosis, prevention and treatment of diseases and clinical conditions associated with AMPD3.

The function of AMPD3 and its association with various diseases and clinical conditions, has been established by previous studies, as described hereinabove with reference to GAM584.1. Rac/cdc42 guanine nucleotide exchange factor (gef) 6 (ARHGEF6, Accession NP_004831.1) is another GAM3770 target gene, herein designated TARGET GENE. ARHGEF6 BINDING SITE is a target binding site found in the 3' untranslated region of mRNA encoded by ARHGEF6, corresponding to a target binding site such as BINDING SITE I, BINDING SITE II or BINDING SITE III of FIG. 8. Table 4 illustrates the complementarity of the nucleotide sequences of ARHGEF6 BINDING SITE, designated SEQ ID:4040, to the nucleotide sequence of GAM3770 RNA, herein designated GAM RNA, also designated SEQ ID:241.

Another function of GAM3770 is therefore inhibition of Rac/cdc42 guanine nucleotide exchange factor (gef) 6 (ARHGEF6, Accession NP_004831.1). Accordingly, utilities of GAM3770 include diagnosis, prevention and treatment of diseases and clinical conditions associated with ARHGEF6.

ARPP-21 (Accession NP_057384.1) is another GAM3770 target gene, herein designated TARGET GENE. ARPP-21 BINDING SITE is a target binding site found in the 5' untranslated region of mRNA encoded by ARPP-21, corresponding to a target binding site such as BINDING SITE I, BINDING SITE II or BINDING SITE III of FIG. 8. Table 4 illustrates the complementarity of the nucleotide sequences of ARPP-21 BINDING SITE, designated SEQ ID:4251, to the nucleotide sequence of GAM3770 RNA, herein designated GAM RNA, also designated SEQ ID:281.

Another function of GAM3770 is therefore inhibition of ARPP-21 (Accession NP_057384.1). Accordingly, utilities of GAM3770 include diagnosis, prevention and treatment of diseases and clinical conditions associated with ARPP-21.

Arylsulfatase b (ARSB, Accession NP_000037.1) is another GAM3770 target gene, herein designated TARGET GENE. ARSB BINDING SITE is a target binding site found in the 3' untranslated region of mRNA encoded by ARSB, corresponding to a target binding site such as BINDING SITE I, BINDING SITE II or BINDING SITE III of FIG. 8. Table 4 illustrates the complementarity of the nucleotide sequences of ARSB BINDING SITE, designated SEQ ID:11835, to the nucleotide sequence of GAM3770 RNA, herein designated GAM RNA, also designated SEQ ID:281.

Another function of GAM3770 is therefore inhibition of Arylsulfatase b (ARSB, Accession NP_000037.1). Accordingly, utilities of GAM3770 include diagnosis, prevention and treatment of diseases and clinical conditions associated with ARSB.

Atpase, class i, type 8b, member 2 (ATP8B2, Accession XP_290875.1) is another GAM3770 target gene, herein designated TARGET GENE. ATP8B2 BINDING SITE is a target binding site found in the 3' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:17310, to the nucleotide sequence of GAM3770 RNA, herein designated GAM RNA, also designated SEQ ID:241.

Another function of GAM3770 is therefore inhibition of Atpase, class i, type 8b, member 2 (ATP8B2, Accession XP_290875.1). Accordingly, utilities of GAM3770 include diagnosis, prevention and treatment of diseases and clinical conditions associated with ATP8B2.

Bai1-associated protein 2 (BAIAP2, Accession NP_059345.1) is another GAM3770 target gene, herein designated TARGET GENE. BAIAP2 BINDING SITE is a target binding site found in the 3' untranslated region of multiple transcripts of mRNA encoded by BAIAP2, corresponding to a target binding site such as BINDING SITE I, BINDING SITE II or BINDING SITE III of FIG. 8. Table 4 illustrates the complementarity of the nucleotide sequences of BAIAP2 BINDING SITE, designated SEQ ID:6156, to the nucleotide sequence of GAM3770 RNA, herein designated GAM RNA, also designated SEQ ID:281.

Another function of GAM3770 is therefore inhibition of Bai1-associated protein 2 (BAIAP2, Accession NP_059345.1). Accordingly, utilities of GAM3770 include diagnosis, prevention and treatment of diseases and clinical conditions associated with BAIAP2.

BCAP31 (Accession NP_005736.2) is another GAM3770 target gene, herein designated TARGET GENE. BCAP31 BINDING SITE is a target binding site found in the 3' untranslated region of mRNA encoded by BCAP31, corresponding to a target binding site such as BINDING SITE I, BINDING SITE II or BINDING SITE III of FIG. 8. Table 4 illustrates the complementarity of the nucleotide sequences of BCAP31 BINDING SITE, designated SEQ ID:13375, to the nucleotide sequence of GAM3770 RNA, herein designated GAM RNA, also designated SEQ ID:281.

Another function of GAM3770 is therefore inhibition of BCAP31 (Accession NP_005736.2). Accordingly, utilities of GAM3770 include diagnosis, prevention and treatment of diseases and clinical conditions associated with BCAP31.

B-cell cll/lymphoma 7a (BCL7A, Accession NP_066273.1) is another GAM3770 target gene, herein designated TARGET GENE. BCL7A BINDING SITE1 and BCL7A BINDING SITE2 are target binding sites found in untranslated regions of mRNA encoded by BCL7A, corresponding to target binding sites such as BINDING SITE I, BINDING SITE II or BINDING SITE III of FIG. 8. Table 4 illustrates the complementarity of the nucleotide sequences of BCL7A BINDING SITE1 and BCL7A BINDING SITE2, designated SEQ ID:16792 and SEQ ID:8131 respectively, to the nucleotide sequence of GAM3770 RNA, herein designated GAM RNA, also designated SEQ ID:281.

Another function of GAM3770 is therefore inhibition of B-cell cll/lymphoma 7a (BCL7A, Accession NP_066273.1). Accordingly, utilities of GAM3770 include diagnosis, prevention and treatment of diseases and clinical conditions associated with BCL7A.

Baculoviral iap repeat-containing 8 (BIRC8, Accession NP_203127.2) is another GAM3770 target gene, herein designated TARGET GENE. BIRC8 BINDING SITE is a target binding site found in the 5' untranslated region of mRNA encoded by BIRC8, corresponding to a target binding site such as BINDING SITE I, BINDING SITE II or BINDING SITE III of FIG. 8. Table 4 illustrates the complementarity of the nucleotide sequences of BIRC8 BINDING SITE, designated SEQ ID:2524, to the nucleotide sequence of GAM3770 RNA, herein designated GAM RNA, also designated SEQ ID:281.

Another function of GAM3770 is therefore inhibition of Baculoviral iap repeat-containing 8 (BIRC8, Accession NP_203127.2). Accordingly, utilities of GAM3770 include diagnosis, prevention and treatment of diseases and clinical conditions associated with BIRC8.

BLAME (Accession NP_064510.1) is another GAM3770 target gene, herein designated TARGET GENE. BLAME BINDING SITE is a target binding site found in the 5' untranslated region of mRNA encoded by BLAME, corresponding to a target binding site such as BINDING SITE I, BINDING SITE II or BINDING SITE III of FIG. 8. Table 4 illustrates the complementarity of the nucleotide sequences of BLAME BINDING SITE, designated SEQ ID:14865, to the nucleotide sequence of GAM3770 RNA, herein designated GAM RNA, also designated SEQ ID:281.

Another function of GAM3770 is therefore inhibition of BLAME (Accession NP_064510.1). Accordingly, utilities of GAM3770 include diagnosis, prevention and treatment of diseases and clinical conditions associated with BLAME.

Brf2, subunit of rna polymerase iii transcription initiation factor, brf1-like (BRF2, Accession NP_060780.2) is another GAM3770 target gene, herein designated TARGET GENE. BRF2 BINDING SITE is a target binding site found in the 3' untranslated region of mRNA encoded by BRF2, corresponding to a target binding site such as BINDING SITE I, BINDING SITE II or BINDING SITE III of FIG. 8. Table 4 illustrates the complementarity of the nucleotide sequences of BRF2 BINDING SITE, designated SEQ ID:4164, to the nucleotide sequence of GAM3770 RNA, herein designated GAM RNA, also designated SEQ ID:281.

Another function of GAM3770 is therefore inhibition of Brf2, subunit of rna polymerase iii transcription initiation factor, brf1-like (BRF2, Accession NP_060780.2), a gene which is one of the multiple subunits of the RNA polymerase III transcription factor complex. Accordingly, utilities of GAM3770 include diagnosis, prevention and treatment of diseases and clinical conditions associated with BRF2.

The function of BRF2 and its association with various diseases and clinical conditions, has been established by previous studies, as described hereinabove with reference to GAM1095.1. Bassoon (presynaptic cytomatrix protein) (BSN, Accession NP_003449.1) is another GAM3770 target gene, herein designated TARGET GENE. BSN BINDING SITE is a target binding site found in the 3' untranslated region of mRNA encoded by BSN, corresponding to a target binding site such as BINDING SITE I, BINDING SITE II or BINDING SITE III of FIG. 8. Table 4 illustrates the complementarity of the nucleotide sequences of BSN BINDING SITE, designated SEQ ID:11733, to the nucleotide sequence of GAM3770 RNA, herein designated GAM RNA, also designated SEQ ID:281.

Another function of GAM3770 is therefore inhibition of Bassoon (presynaptic cytomatrix protein) (BSN, Accession NP_003449.1), a gene which may be involved in cytomatrix organization at the site of neurotransmitter release and therefore may be associated with Multiple system atrophy (msa). Accordingly, utilities of GAM3770 include diagnosis, prevention and treatment of Multiple system atrophy (msa), and of other diseases and clinical conditions associated with BSN.

The function of BSN and its association with various diseases and clinical conditions, has been established by previous studies, as described hereinabove with reference to GAM146.1. Btb (poz) domain containing 6 (BTBD6, Accession NP_150374.1) is another GAM3770 target gene, herein designated TARGET GENE. BTBD6 BINDING SITE is a target binding site found in the 3' untranslated region of mRNA encoded by BTBD6, corresponding to a target binding site such as BINDING SITE I, BINDING SITE II or BINDING SITE III of FIG. 8. Table 4 illustrates the complementarity of the nucleotide sequences of BTBD6 BINDING SITE, designated SEQ ID:14701, to the nucleotide sequence of GAM3770 RNA, herein designated GAM RNA, also designated SEQ ID:281.

Another function of GAM3770 is therefore inhibition of Btb (poz) domain containing 6 (BTBD6, Accession NP_150374.1). Accordingly, utilities of GAM3770 include diagnosis, prevention and treatment of diseases and clinical conditions associated with BTBD6.

BZRAP1 (Accession NP_004749.1) is another GAM3770 target gene, herein designated TARGET GENE. BZRAP1 BINDING SITE is a target binding site found in the 3' untranslated region of mRNA encoded by BZRAP1, corresponding to a target binding site such as BINDING SITE I, BINDING SITE II or BINDING SITE III of FIG. 8. Table 4 illustrates the complementarity of the nucleotide sequences of BZRAP1 BINDING SITE, designated SEQ ID:7707, to the nucleotide sequence of GAM3770 RNA, herein designated GAM RNA, also designated SEQ ID:241.

Another function of GAM3770 is therefore inhibition of BZRAP1 (Accession NP_004749.1). Accordingly, utilities of GAM3770 include diagnosis, prevention and treatment of diseases and clinical conditions associated with BZRAP1.

Chromosome 1 open reading frame 25 (C1orf25, Accession NP_112196.2) is another GAM3770 target gene, herein designated TARGET GENE. C1orf25 BINDING SITE is a target binding site found in the 3' untranslated region of mRNA encoded by C1orf25, corresponding to a target binding site such as BINDING SITE I, BINDING SITE II or BINDING SITE III of FIG. 8. Table 4 illustrates the complementarity of the nucleotide sequences of C1orf25 BINDING SITE, designated SEQ ID:8737, to the nucleotide sequence of GAM3770 RNA, herein designated GAM RNA, also designated SEQ ID:281.

Another function of GAM3770 is therefore inhibition of Chromosome 1 open reading frame 25 (C1orf25, Accession NP_112196.2). Accordingly, utilities of GAM3770 include diagnosis, prevention and treatment of diseases and clinical conditions associated with C1orf25.

Chromosome 20 open reading frame 103 (C20orf103, Accession NP_036393.1) is another GAM3770 target gene, herein designated TARGET GENE. C20orf103 BINDING SITE is a target binding site found in the 3' untranslated region of mRNA encoded by C20orf103, corresponding to a target binding site such as BINDING SITE I, BINDING SITE II or BINDING SITE III of FIG. 8. Table 4 illustrates the complementarity of the nucleotide sequences of C20orf103 BINDING SITE, designated SEQ ID:8221, to the nucleotide sequence of GAM3770 RNA, herein designated GAM RNA, also designated SEQ ID:281.

Another function of GAM3770 is therefore inhibition of Chromosome 20 open reading frame 103 (C20orf103, Accession NP_036393.1). Accordingly, utilities of GAM3770 include diagnosis, prevention and treatment of diseases and clinical conditions associated with C20orf103.

Chromosome 20 open reading frame 152 (C20orf152, Accession NP_543024.1) is another GAM3770 target gene, herein designated TARGET GENE. C20orf152 BINDING SITE is a target binding site found in the 5' untranslated region of mRNA encoded by C20orf152, corresponding to a target binding site such as BINDING SITE I, BINDING SITE II or BINDING SITE III of FIG. 8. Table 4 illustrates the complementarity of the nucleotide sequences of C20orf152 BINDING SITE, designated SEQ ID:9895, to the nucleotide sequence of GAM3770 RNA, herein designated GAM RNA, also designated SEQ ID:281.

Another function of GAM3770 is therefore inhibition of Chromosome 20 open reading frame 152 (C20orf152, Accession NP_543024.1). Accordingly, utilities of GAM3770 include diagnosis, prevention and treatment of diseases and clinical conditions associated with C20orf152.

Chromosome 20 open reading frame 175 (C20orf175, Accession NP_543019.1) is another GAM3770 target gene, herein designated TARGET GENE. C20orf175 BINDING SITE is a target binding site found in the 5' untranslated region of mRNA encoded by C20orf175, corresponding to a target binding site such as BINDING SITE I, BINDING SITE II or BINDING SITE III of FIG. 8. Table 4 illustrates the complementarity of the nucleotide sequences of C20orf175 BINDING SITE, designated SEQ ID:13674, to the nucleotide sequence of GAM3770 RNA, herein designated GAM RNA, also designated SEQ ID:281.

Another function of GAM3770 is therefore inhibition of Chromosome 20 open reading frame 175 (C20orf175, Accession NP_543019.1). Accordingly, utilities of GAM3770 include diagnosis, prevention and treatment of diseases and clinical conditions associated with C20orf175.

C20orf194 (Accession XP_045421.1) is another GAM3770 target gene, herein designated TARGET GENE. C20orf194 BINDING SITE1 and C20orf194 BINDING SITE2 are target binding sites found in untranslated regions of mRNA encoded by C20orf194, corresponding to target binding sites such as BINDING SITE I, BINDING SITE II or BINDING SITE III of FIG. 8. Table 4 illustrates the complementarity of the nucleotide sequences of C20orf194 BINDING SITE1 and C20orf194 BINDING SITE2, designated SEQ ID:20123 and SEQ ID:12486 respectively, to the nucleotide sequence of GAM3770 RNA, herein designated GAM RNA, also designated SEQ ID:281.

Another function of GAM3770 is therefore inhibition of C20orf194 (Accession XP_045421.1). Accordingly, utilities of GAM3770 include diagnosis, prevention and treatment of diseases and clinical conditions associated with C20orf194.

Chromosome 5 open reading frame 4 (C5orf4, Accession NP_057432.1) is another GAM3770 target gene, herein designated TARGET GENE. C5orf4 BINDING SITE is a target binding site found in the 5' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:7312, to the nucleotide sequence of GAM3770 RNA, herein designated GAM RNA, also designated SEQ ID:241.

Another function of GAM3770 is therefore inhibition of Chromosome 5 open reading frame 4 (C5orf4, Accession NP_057432.1). Accordingly, utilities of GAM3770 include diagnosis, prevention and treatment of diseases and clinical conditions associated with C5orf4.

Chromosome 5 open reading frame 4 (C5orf4, Accession NP_115761.1) is another GAM3770 target gene, herein designated TARGET GENE. C5orf4 BINDING SITE is a target binding site found in the 3' untranslated region of multiple transcripts of mRNA encoded by C5orf4, corresponding to a target binding site such as BINDING SITE I, BINDING SITE II or BINDING SITE III of FIG. 8. Table 4 illustrates the complementarity of the nucleotide sequences of C5orf4 BINDING SITE, designated SEQ ID:7312, to the nucleotide sequence of GAM3770 RNA, herein designated GAM RNA, also designated SEQ ID:241.

Another function of GAM3770 is therefore inhibition of Chromosome 5 open reading frame 4 (C5orf4, Accession NP_115761.1). Accordingly, utilities of GAM3770 include diagnosis, prevention and treatment of diseases and clinical conditions associated with C5orf4.

Caspase recruitment domain family, member 9 (CARD9, Accession NP_071747.2) is another GAM3770 target gene, herein designated TARGET GENE. CARD9 BINDING SITE is a target binding site found in the 3' untranslated region of multiple transcripts of mRNA encoded by CARD9, corresponding to a target binding site such as BINDING SITE I, BINDING SITE II or BINDING SITE III of FIG. 8. Table 4 illustrates the complementarity of the nucleotide sequences of CARD9 BINDING SITE, designated SEQ ID:9215, to the nucleotide sequence of GAM3770 RNA, herein designated GAM RNA, also designated SEQ ID:241.

Another function of GAM3770 is therefore inhibition of Caspase recruitment domain family, member 9 (CARD9, Accession NP_071747.2) . Accordingly, utilities of GAM3770 include diagnosis, prevention and treatment of diseases and clinical conditions associated with CARD9.

Chemokine (c-c motif) ligand 1 (CCL1, Accession NP_002972.1) is another GAM3770 target gene, herein designated TARGET GENE. CCL1 BINDING SITE is a target binding site found in the 5' untranslated region of mRNA encoded by CCL1, corresponding to a target binding site such as BINDING SITE I, BINDING SITE II or BINDING SITE III of FIG. 8. Table 4 illustrates the complementarity of the nucleotide sequences of CCL1 BINDING SITE, designated SEQ ID:11794, to the nucleotide sequence of GAM3770 RNA, herein designated GAM RNA, also designated SEQ ID:281.

Another function of GAM3770 is therefore inhibition of Chemokine (c-c motif) ligand 1 (CCL1, Accession NP_002972.1). Accordingly, utilities of GAM3770 include diagnosis, prevention and treatment of diseases and clinical conditions associated with CCL1.

Chemokine (c-c motif) receptor 1 (CCR1, Accession NP_001286.1) is another GAM3770 target gene, herein designated TARGET GENE. CCR1 BINDING SITE is a target binding site found in the 3' untranslated region of mRNA encoded by CCR1, corresponding to a target binding site such as BINDING SITE I, BINDING SITE II or BINDING SITE III of FIG. 8. Table 4 illustrates the complementarity of the nucleotide sequences of CCR1 BINDING SITE, designated SEQ ID:17877, to the nucleotide sequence of GAM3770 RNA, herein designated GAM RNA, also designated SEQ ID:281.

Another function of GAM3770 is therefore inhibition of Chemokine (c-c motif) receptor 1 (CCR1, Accession NP_001286.1). Accordingly, utilities of GAM3770 include diagnosis, prevention and treatment of diseases and clinical conditions associated with CCR1.

Cd1a antigen, a polypeptide (CD1A, Accession NP_001754.1) is another GAM3770 target gene, herein designated TARGET GENE. CD1A BINDING SITE is a target binding site found in the 5' untranslated region of mRNA encoded by CD1A, corresponding to a target binding site such as BINDING SITE I, BINDING SITE II or BINDING SITE III of FIG. 8. Table 4 illustrates the complementarity of the nucleotide sequences of CD1A BINDING SITE, designated SEQ ID:6426, to the nucleotide sequence of GAM3770 RNA, herein designated GAM RNA, also designated SEQ ID:281.

Another function of GAM3770 is therefore inhibition of Cd1a antigen, a polypeptide (CD1A, Accession NP_001754.1), a gene which is involved in antigen presentation. Accordingly, utilities of GAM3770 include diagnosis, prevention and treatment of diseases and clinical conditions associated with CD1A.

The function of CD1A and its association with various diseases and clinical conditions, has been established by previous studies, as described hereinabove with reference to GAM223.1. Cd1d antigen, d polypeptide (CD1D, Accession NP_001757.1) is another GAM3770 target gene, herein designated TARGET GENE. CD1D BINDING SITE is a target binding site found in the 5' untranslated region of mRNA encoded by CD1D, corresponding to a target binding site such as BINDING SITE I, BINDING SITE II or BINDING SITE III of FIG. 8. Table 4 illustrates the complementarity of the nucleotide sequences of CD1D BINDING SITE, designated SEQ ID:3178, to the nucleotide sequence of GAM3770 RNA, herein designated GAM RNA, also designated SEQ ID:241.

Another function of GAM3770 is therefore inhibition of Cd1d antigen, d polypeptide (CD1D, Accession NP_001757.1), a gene which is a member D of the CD1 family; involved in antigen presentation . Accordingly, utilities of GAM3770 include diagnosis, prevention and treatment of diseases and clinical conditions associated with CD1D.

The function of CD1D and its association with various diseases and clinical conditions, has been established by previous studies, as described hereinabove with reference to GAM550.1. Congenital dyserythropoietic anemia, type i (CDAN1, Accession XP_085300.3) is another GAM3770 target gene, herein designated TARGET GENE. CDAN1 BINDING SITE is a target binding site found in the 5' untranslated region of mRNA encoded by CDAN1, corresponding to a target binding site such as BINDING SITE I, BINDING SITE II or BINDING SITE III of FIG. 8. Table 4 illustrates the complementarity of the nucleotide sequences of CDAN1 BINDING SITE, designated SEQ ID:6457, to the nucleotide sequence of GAM3770 RNA, herein designated GAM RNA, also designated SEQ ID:241.

Another function of GAM3770 is therefore inhibition of Congenital dyserythropoietic anemia, type i (CDAN1, Accession XP_085300.3) . Accordingly, utilities of GAM3770 include diagnosis, prevention and treatment of diseases and clinical conditions associated with CDAN1.

Cdc42 effector protein (rho gtpase binding) 3 (CDC42EP3, Accession NP_006440.2) is another GAM3770 target gene, herein designated TARGET GENE. CDC42EP3 BINDING SITE is a target binding site found in the 5' untranslated region of mRNA encoded by CDC42EP3, corresponding to a target binding site such as BINDING SITE I, BINDING SITE II or BINDING SITE III of FIG. 8. Table 4 illustrates the complementarity of the nucleotide sequences of CDC42EP3

BINDING SITE, designated SEQ ID:19072, to the nucleotide sequence of GAM3770 RNA, herein designated GAM RNA, also designated SEQ ID:241.

Another function of GAM3770 is therefore inhibition of Cdc42 effector protein (rho gtpase binding) 3 (CDC42EP3, Accession NP_006440.2). Accordingly, utilities of GAM3770 include diagnosis, prevention and treatment of diseases and clinical conditions associated with CDC42EP3.

Cdc91 cell division cycle 91-like 1 (s. cerevisiae) (CDC91L1, Accession NP_536724.1) is another GAM3770 target gene, herein designated TARGET GENE. CDC91L1 BINDING SITE is a target binding site found in the 3' untranslated region of mRNA encoded by CDC91L1, corresponding to a target binding site such as BINDING SITE I, BINDING SITE II or BINDING SITE III of FIG. 8. Table 4 illustrates the complementarity of the nucleotide sequences of CDC91L1 BINDING SITE, designated SEQ ID:3448, to the nucleotide sequence of GAM3770 RNA, herein designated GAM RNA, also designated SEQ ID:281.

Another function of GAM3770 is therefore inhibition of Cdc91 cell division cycle 91-like 1 (s. cerevisiae) (CDC91L1, Accession NP_536724.1). Accordingly, utilities of GAM3770 include diagnosis, prevention and treatment of diseases and clinical conditions associated with CDC91L1.

Cadherin 5, type 2, ve-cadherin (vascular epithelium) (CDH5, Accession NP_001786.1) is another GAM3770 target gene, herein designated TARGET GENE. CDH5 BINDING SITE is a target binding site found in the 3' untranslated region of mRNA encoded by CDH5, corresponding to a target binding site such as BINDING SITE I, BINDING SITE II or BINDING SITE III of FIG. 8. Table 4 illustrates the complementarity of the nucleotide sequences of CDH5 BINDING SITE, designated SEQ ID:10833, to the nucleotide sequence of GAM3770 RNA, herein designated GAM RNA, also designated SEQ ID:281.

Another function of GAM3770 is therefore inhibition of Cadherin 5, type 2, ve-cadherin (vascular epithelium) (CDH5, Accession NP_001786.1), a gene which associates with alpha-catenin forming a link to the cytoskeleton. Accordingly, utilities of GAM3770 include diagnosis, prevention and treatment of diseases and clinical conditions associated with CDH5.

The function of CDH5 and its association with various diseases and clinical conditions, has been established by previous studies, as described hereinabove with reference to GAM144.1. Cysteine dioxygenase, type i (CDO1, Accession NP_001792.1) is another GAM3770 target gene, herein designated TARGET GENE. CDO1 BINDING SITE is a target binding site found in the 5' untranslated region of mRNA encoded by CDO1, corresponding to a target binding site such as BINDING SITE I, BINDING SITE II or BINDING SITE III of FIG. 8. Table 4 illustrates the complementarity of the nucleotide sequences of CDO1 BINDING SITE, designated SEQ ID:4009, to the nucleotide sequence of GAM3770 RNA, herein designated GAM RNA, also designated SEQ ID:281.

Another function of GAM3770 is therefore inhibition of Cysteine dioxygenase, type i (CDO1, Accession NP_001792.1), a gene which is involved in degradation of cysteine to pyruvate. Accordingly, utilities of GAM3770 include diagnosis, prevention and treatment of diseases and clinical conditions associated with CDO1.

The function of CDO1 and its association with various diseases and clinical conditions, has been established by previous studies, as described hereinabove with reference to GAM475.1. Claudin 1 (CLDN1, Accession NP_066924.1) is another GAM3770 target gene, herein designated TARGET GENE. CLDN1 BINDING SITE is a target binding site found in the 5' untranslated region of mRNA encoded by CLDN1, corresponding to a target binding site such as BINDING SITE I, BINDING SITE II or BINDING SITE III of FIG. 8. Table 4 illustrates the complementarity of the nucleotide sequences of CLDN1 BINDING SITE, designated SEQ ID:17449, to the nucleotide sequence of GAM3770 RNA, herein designated GAM RNA, also designated SEQ ID:281.

Another function of GAM3770 is therefore inhibition of Claudin 1 (CLDN1, Accession NP_066924.1). Accordingly, utilities of GAM3770 include diagnosis, prevention and treatment of diseases and clinical conditions associated with CLDN1.

cPLA2delta (Accession NP_828848.1) is another GAM3770 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:17982, to the nucleotide sequence of GAM3770 RNA, herein designated GAM RNA, also designated SEQ ID:281.

Another function of GAM3770 is therefore inhibition of cPLA2delta (Accession NP_828848.1). Accordingly, utilities of GAM3770 include diagnosis, prevention and treatment of diseases and clinical conditions associated with cPLA2delta.

cPLA2delta (Accession XP_208820.2) is another GAM3770 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:17982, to the nucleotide sequence of GAM3770 RNA, herein designated GAM RNA, also designated SEQ ID:281.

Another function of GAM3770 is therefore inhibition of cPLA2delta (Accession XP_208820.2). Accordingly, utilities of GAM3770 include diagnosis, prevention and treatment of diseases and clinical conditions associated with cPLA2delta.

C-reactive protein, pentraxin-related (CRP, Accession NP_000558.1) is another GAM3770 target gene, herein designated TARGET GENE. CRP BINDING SITE is a target binding site found in the 3' untranslated region of mRNA encoded by CRP, corresponding to a target binding site such as BINDING SITE I, BINDING SITE II or BINDING SITE III of FIG. 8. Table 4 illustrates the complementarity of the nucleotide sequences of CRP BINDING SITE, designated SEQ ID:11630, to the nucleotide sequence of GAM3770 RNA, herein designated GAM RNA, also designated SEQ ID:281.

Another function of GAM3770 is therefore inhibition of C-reactive protein, pentraxin-related (CRP, Accession NP_000558.1). Accordingly, utilities of GAM3770 include diagnosis, prevention and treatment of diseases and clinical conditions associated with CRP.

Cofactor required for sp1 transcriptional activation, subunit 2, 150 kda (CRSP2, Accession NP_004220.2) is another GAM3770 target gene, herein designated TARGET GENE. CRSP2 BINDING SITE is a target binding site found in the 3' untranslated region of mRNA encoded by CRSP2, corresponding to a target binding site such as BINDING SITE I, BINDING SITE II or BINDING SITE III of FIG. 8. Table 4 illustrates the complementarity of the nucleotide sequences of CRSP2 BINDING SITE, designated SEQ ID:10521, to the nucleotide sequence of GAM3770 RNA, herein designated GAM RNA, also designated SEQ ID:281.

Another function of GAM3770 is therefore inhibition of Cofactor required for sp1 transcriptional activation, subunit 2, 150 kda (CRSP2, Accession NP_004220.2). Accordingly, utilities of GAM3770 include diagnosis, prevention and treatment of diseases and clinical conditions associated with CRSP2.

Cullin 3 (CUL3, Accession NP_003581.1) is another GAM3770 target gene, herein designated TARGET GENE. CUL3 BINDING SITE is a target binding site found in the 3' untranslated region of mRNA encoded by CUL3, corresponding to a target binding site such as BINDING SITE I, BINDING SITE II or BINDING SITE III of FIG. 8. Table 4 illustrates the complementarity of the nucleotide sequences of CUL3 BINDING SITE, designated SEQ ID:9467, to the nucleotide sequence of GAM3770 RNA, herein designated GAM RNA, also designated SEQ ID:241.

Another function of GAM3770 is therefore inhibition of Cullin 3 (CUL3, Accession NP_003581.1), a gene which may target other proteins for ubiquitin-dependent proteolysis. Accordingly, utilities of GAM3770 include diagnosis, prevention and treatment of diseases and clinical conditions associated with CUL3.

The function of CUL3 and its association with various diseases and clinical conditions, has been established by previous studies, as described hereinabove with reference to GAM32.1. Cytoplasmic linker 2 (CYLN2, Accession NP_003379.2) is another GAM3770 target gene, herein designated TARGET GENE. CYLN2 BINDING SITE is a target binding site found in the 3' untranslated region of multiple transcripts of mRNA encoded by CYLN2, corresponding to a target binding site such as BINDING SITE I, BINDING SITE II or BINDING SITE III of FIG. 8. Table 4 illustrates the complementarity of the nucleotide sequences of CYLN2 BINDING SITE, designated SEQ ID:9937, to the nucleotide sequence of GAM3770 RNA, herein designated GAM RNA, also designated SEQ ID:241.

Another function of GAM3770 is therefore inhibition of Cytoplasmic linker 2 (CYLN2, Accession NP_003379.2), a gene which associates with microtubules and dendritic lamellar bodies. and therefore may be associated with Williams-beuren syndrome. Accordingly, utilities of GAM3770 include diagnosis, prevention and treatment of Williams-beuren syndrome, and of other diseases and clinical conditions associated with CYLN2.

The function of CYLN2 and its association with various diseases and clinical conditions, has been established by previous studies, as described hereinabove with reference to GAM330.2. Cytoplasmic linker 2 (CYLN2, Accession NP_115797.1) is another GAM3770 target gene, herein designated TARGET GENE. CYLN2 BINDING SITE is a target binding site found in the 3' untranslated region of multiple transcripts of mRNA encoded by CYLN2, corresponding to a target binding site such as BINDING SITE I, BINDING SITE II or BINDING SITE III of FIG. 8. Table 4 illustrates the complementarity of the nucleotide sequences of CYLN2 BINDING SITE, designated SEQ ID:9937, to the nucleotide sequence of GAM3770 RNA, herein designated GAM RNA, also designated SEQ ID:241.

Another function of GAM3770 is therefore inhibition of Cytoplasmic linker 2 (CYLN2, Accession NP_115797.1), a gene which associates with microtubules and dendritic lamellar bodies. and therefore may be associated with Williams-beuren syndrome. Accordingly, utilities of GAM3770 include diagnosis, prevention and treatment of Williams-beuren syndrome, and of other diseases and clinical conditions associated with CYLN2.

The function of CYLN2 and its association with various diseases and clinical conditions, has been established by previous studies, as described hereinabove with reference to GAM330.2. DBC-1 (Accession NP_066997.3) is another GAM3770 target gene, herein designated TARGET GENE. DBC-1 BINDING SITE is a target binding site found in the 5' untranslated region of mRNA encoded by DBC-1, corresponding to a target binding site such as BINDING SITE I, BINDING SITE II or BINDING SITE III of FIG. 8. Table 4 illustrates the complementarity of the nucleotide sequences of DBC-1 BINDING SITE, designated SEQ ID:17305, to the nucleotide sequence of GAM3770 RNA, herein designated GAM RNA, also designated SEQ ID:281.

Another function of GAM3770 is therefore inhibition of DBC-1 (Accession NP_066997.3). Accordingly, utilities of GAM3770 include diagnosis, prevention and treatment of diseases and clinical conditions associated with DBC-1.

Digeorge syndrome critical region gene 14 (DGCR14, Accession NP_073210.1) is another GAM3770 target gene, herein designated TARGET GENE. DGCR14 BINDING SITE is a target binding site found in the 3' untranslated region of mRNA encoded by DGCR14, corresponding to a target binding site such as BINDING SITE I, BINDING SITE II or BINDING SITE III of FIG. 8. Table 4 illustrates the complementarity of the nucleotide sequences of DGCR14 BINDING SITE, designated SEQ ID:10110, to the nucleotide sequence of GAM3770 RNA, herein designated GAM RNA, also designated SEQ ID:281.

Another function of GAM3770 is therefore inhibition of Digeorge syndrome critical region gene 14 (DGCR14, Accession NP_073210.1). Accordingly, utilities of GAM3770 include diagnosis, prevention and treatment of diseases and clinical conditions associated with DGCR14.

DKFZp434D177-like (Accession XP_209288.2) is another GAM3770 target gene, herein designated TARGET GENE. DKFZp434D177-like BINDING SITE is a target binding site found in the 3' untranslated region of mRNA encoded by DKFZp434D177-like, corresponding to a target binding site such as BINDING SITE I, BINDING SITE II or BINDING SITE III of FIG. 8. Table 4 illustrates the complementarity of the nucleotide sequences of DKFZp434D177-like BINDING SITE, designated SEQ ID:8952, to the nucleotide sequence of GAM3770 RNA, herein designated GAM RNA, also designated SEQ ID:281.

Another function of GAM3770 is therefore inhibition of DKFZp434D177-like (Accession XP_209288.2). Accordingly, utilities of GAM3770 include diagnosis, prevention and treatment of diseases and clinical conditions associated with DKFZp434D177-like.

DKFZp434E2321 (Accession XP_038298.1) is another GAM3770 target gene, herein designated TARGET GENE. DKFZp434E2321 BINDING SITE is a target binding site found in the 3' untranslated region of mRNA encoded by DKFZp434E2321, corresponding to a target binding site such as BINDING SITE I, BINDING SITE II or BINDING SITE III of FIG. 8. Table 4 illustrates the complementarity of the nucleotide sequences of DKFZp434E2321 BINDING SITE, designated SEQ ID:4827, to the nucleotide sequence of GAM3770 RNA, herein designated GAM RNA, also designated SEQ ID:241.

Another function of GAM3770 is therefore inhibition of DKFZp434E2321 (Accession XP_038298.1). Accordingly, utilities of GAM3770 include diagnosis, prevention and treatment of diseases and clinical conditions associated with DKFZp434E2321.

DKFZP434H132 (Accession NP_056307.1) is another GAM3770 target gene, herein designated TARGET GENE. DKFZP434H132 BINDING SITE is a target binding site found in the 5' untranslated region of mRNA encoded by DKFZP434H132, corresponding to a target binding site such as BINDING SITE I, BINDING SITE II or BINDING SITE III of FIG. 8. Table 4 illustrates the complementarity of the nucleotide sequences of DKFZP434H132 BINDING SITE, designated SEQ ID:9323, to the nucleotide sequence of GAM3770 RNA, herein designated GAM RNA, also designated SEQ ID:241.

Another function of GAM3770 is therefore inhibition of DKFZP434H132 (Accession NP_056307.1). Accordingly, utilities of GAM3770 include diagnosis, prevention and treatment of diseases and clinical conditions associated with DKFZP434H132.

DKFZP761D0211 (Accession NP_114428.1) is another GAM3770 target gene, herein designated TARGET GENE. DKFZP761D0211 BINDING SITE is a target binding site found in the 3' untranslated region of mRNA encoded by DKFZP761D0211, corresponding to a target binding site such as BINDING SITE I, BINDING SITE II or BINDING SITE III of FIG. 8. Table 4 illustrates the complementarity of the nucleotide sequences of DKFZP761D0211 BINDING SITE, designated SEQ ID:14838, to the nucleotide sequence of GAM3770 RNA, herein designated GAM RNA, also designated SEQ ID:241.

Another function of GAM3770 is therefore inhibition of DKFZP761D0211 (Accession NP_114428.1). Accordingly, utilities of GAM3770 include diagnosis, prevention and treatment of diseases and clinical conditions associated with DKFZP761D0211.

DKFZp761L1518 (Accession XP_294685.2) is another GAM3770 target gene, herein designated TARGET GENE. DKFZp761L1518 BINDING SITE is a target binding site found in the 5' untranslated region of mRNA encoded by DKFZp761L1518, corresponding to a target binding site such as BINDING SITE I, BINDING SITE II or BINDING SITE III of FIG. 8. Table 4 illustrates the complementarity of the nucleotide sequences of DKFZp761L1518 BINDING SITE, designated SEQ ID:10498, to the nucleotide sequence of GAM3770 RNA, herein designated GAM RNA, also designated SEQ ID:281.

Another function of GAM3770 is therefore inhibition of DKFZp761L1518 (Accession XP_294685.2). Accordingly, utilities of GAM3770 include diagnosis, prevention and treatment of diseases and clinical conditions associated with DKFZp761L1518.

EDEM (Accession NP_055489.1) is another GAM3770 target gene, herein designated TARGET GENE. EDEM BINDING SITE is a target binding site found in the 3' untranslated region of mRNA encoded by EDEM, corresponding to a target binding site such as BINDING SITE I, BINDING SITE II or BINDING SITE III of FIG. 8. Table 4 illustrates the complementarity of the nucleotide sequences of EDEM BINDING SITE, designated SEQ ID:4285, to the nucleotide sequence of GAM3770 RNA, herein designated GAM RNA, also designated SEQ ID:241.

Another function of GAM3770 is therefore inhibition of EDEM (Accession NP_055489.1). Accordingly, utilities of GAM3770 include diagnosis, prevention and treatment of diseases and clinical conditions associated with EDEM.

Endothelin 3 (EDN3, Accession NP_000105.1) is another GAM3770 target gene, herein designated TARGET GENE. EDN3 BINDING SITE is a target binding site found in the 5' untranslated region of mRNA encoded by EDN3, corresponding to a target binding site such as BINDING SITE I, BINDING SITE II or BINDING SITE III of FIG. 8. Table 4 illustrates the complementarity of the nucleotide sequences of EDN3 BINDING SITE, designated SEQ ID:6587, to the nucleotide sequence of GAM3770 RNA, herein designated GAM RNA, also designated SEQ ID:241.

Another function of GAM3770 is therefore inhibition of Endothelin 3 (EDN3, Accession NP_000105.1). Accordingly, utilities of GAM3770 include diagnosis, prevention and treatment of diseases and clinical conditions associated with EDN3.

Ells1 (Accession NP_690006.1) is another GAM3770 target gene, herein designated TARGET GENE. Ells1 BINDING SITE is a target binding site found in the 3' untranslated region of mRNA encoded by Ells1, corresponding to a target binding site such as BINDING SITE I, BINDING SITE II or BINDING SITE III of FIG. 8. Table 4 illustrates the complementarity of the nucleotide sequences of Ells1 BINDING SITE, designated SEQ ID:12892, to the nucleotide sequence of GAM3770 RNA, herein designated GAM RNA, also designated SEQ ID:281.

Another function of GAM3770 is therefore inhibition of Ells1 (Accession NP_690006.1). Accordingly, utilities of GAM3770 include diagnosis, prevention and treatment of diseases and clinical conditions associated with Ells1.

Engulfment and cell motility 1 (ced-12 homolog, c. elegans) (ELMO1, Accession NP_055615.8) is another GAM3770 target gene, herein designated TARGET GENE. ELMO1 BINDING SITE is a target binding site found in the 5' untranslated region of multiple transcripts of mRNA encoded by ELMO1, corresponding to a target binding site such as BINDING SITE I, BINDING SITE II or BINDING SITE III of FIG. 8. Table 4 illustrates the complementarity of the nucleotide sequences of ELMO1 BINDING SITE, designated SEQ ID:16847, to the nucleotide sequence of GAM3770 RNA, herein designated GAM RNA, also designated SEQ ID:241.

Another function of GAM3770 is therefore inhibition of Engulfment and cell motility 1 (ced-12 homolog, c. elegans) (ELMO1, Accession NP_055615.8). Accordingly, utilities of GAM3770 include diagnosis, prevention and treatment of diseases and clinical conditions associated with ELMO1.

ERdj5 (Accession NP_061854.1) is another GAM3770 target gene, herein designated TARGET GENE. ERdj5 BINDING SITE is a target binding site found in the 3' untranslated region of mRNA encoded by ERdj5, corresponding to a target binding site such as BINDING SITE I, BINDING SITE II or BINDING SITE III of FIG. 8. Table 4 illustrates the complementarity of the nucleotide sequences of ERdj5 BINDING SITE, designated SEQ ID:5195, to the nucleotide sequence of GAM3770 RNA, herein designated GAM RNA, also designated SEQ ID:241.

Another function of GAM3770 is therefore inhibition of ERdj5 (Accession NP_061854.1). Accordingly, utilities of GAM3770 include diagnosis, prevention and treatment of diseases and clinical conditions associated with ERdj5.

Ets variant gene 4 (e1a enhancer binding protein, e1af) (ETV4, Accession NP_001977.1) is another GAM3770 target gene, herein designated TARGET GENE. ETV4 BINDING SITE is a target binding site found in the 3' untranslated region of mRNA encoded by ETV4, corresponding to a target binding site such as BINDING SITE I, BINDING SITE II or BINDING SITE III of FIG. 8. Table 4 illustrates the complementarity of the nucleotide sequences of ETV4 BINDING SITE, designated SEQ ID:12526, to the nucleotide sequence of GAM3770 RNA, herein designated GAM RNA, also designated SEQ ID:281.

Another function of GAM3770 is therefore inhibition of Ets variant gene 4 (e1a enhancer binding protein, e1af) (ETV4, Accession NP_001977.1). Accordingly, utilities of GAM3770 include diagnosis, prevention and treatment of diseases and clinical conditions associated with ETV4.

F-box only protein 2 (FBXO2, Accession NP_036300.2) is another GAM3770 target gene, herein designated TARGET GENE. FBXO2 BINDING SITE is a target binding site found in the 3' untranslated region of mRNA encoded by FBXO2, corresponding to a target binding site such as BINDING SITE I, BINDING SITE II or BINDING SITE III of FIG. 8. Table 4 illustrates the complementarity of the nucleotide sequences of FBXO2 BINDING SITE, designated SEQ ID:4915, to the nucleotide sequence of GAM3770 RNA, herein designated GAM RNA, also designated SEQ ID:281.

Another function of GAM3770 is therefore inhibition of F-box only protein 2 (FBXO2, Accession NP_036300.2). Accordingly, utilities of GAM3770 include diagnosis, prevention and treatment of diseases and clinical conditions associated with FBXO2.

FLJ10751 (Accession NP_060709.1) is another GAM3770 target gene, herein designated TARGET GENE. FLJ10751 BINDING SITE is a target binding site found in the 3' untranslated region of multiple transcripts of mRNA encoded by FLJ10751, corresponding to a target binding site such as BINDING SITE I, BINDING SITE II or BINDING SITE III of FIG. 8. Table 4 illustrates the complementarity of the nucleotide sequences of FLJ10751 BINDING SITE, designated SEQ ID:764, to the nucleotide sequence of GAM3770 RNA, herein designated GAM RNA, also designated SEQ ID:281.

Another function of GAM3770 is therefore inhibition of FLJ10751 (Accession NP_060709.1). Accordingly, utilities of GAM3770 include diagnosis, prevention and treatment of diseases and clinical conditions associated with FLJ10751.

FLJ10751 (Accession NP_060675.1) is another GAM3770 target gene, herein designated TARGET GENE. FLJ10751 BINDING SITE is a target binding site found in the 3' untranslated region of multiple transcripts of mRNA encoded by FLJ10751, corresponding to a target binding site such as BINDING SITE I, BINDING SITE II or BINDING SITE III of FIG. 8. Table 4 illustrates the complementarity of the nucleotide sequences of FLJ10751 BINDING SITE, designated SEQ ID:764, to the nucleotide sequence of GAM3770 RNA, herein designated GAM RNA, also designated SEQ ID:281.

Another function of GAM3770 is therefore inhibition of FLJ10751 (Accession NP_060675.1). Accordingly, utilities of GAM3770 include diagnosis, prevention and treatment of diseases and clinical conditions associated with FLJ10751.

FLJ10901 (Accession NP_060735.1) is another GAM3770 target gene, herein designated TARGET GENE. FLJ10901 BINDING SITE is a target binding site found in the 3' untranslated region of mRNA encoded by FLJ10901, corresponding to a target binding site such as BINDING SITE I, BINDING SITE II or BINDING SITE III of FIG. 8. Table 4 illustrates the complementarity of the nucleotide sequences of FLJ10901 BINDING SITE, designated SEQ ID:18342, to the nucleotide sequence of GAM3770 RNA, herein designated GAM RNA, also designated SEQ ID:241.

Another function of GAM3770 is therefore inhibition of FLJ10901 (Accession NP_060735.1). Accordingly, utilities of GAM3770 include diagnosis, prevention and treatment of diseases and clinical conditions associated with FLJ10901.

FLJ10945 (Accession NP_060750.1) is another GAM3770 target gene, herein designated TARGET GENE. FLJ10945 BINDING SITE is a target binding site found in the 3' untranslated region of mRNA encoded by FLJ10945, corresponding to a target binding site such as BINDING SITE I, BINDING SITE II or BINDING SITE III of FIG. 8. Table 4 illustrates the complementarity of the nucleotide sequences of FLJ10945 BINDING SITE, designated SEQ ID:17908, to the nucleotide sequence of GAM3770 RNA, herein designated GAM RNA, also designated SEQ ID:241.

Another function of GAM3770 is therefore inhibition of FLJ10945 (Accession NP_060750.1). Accordingly, utilities of GAM3770 include diagnosis, prevention and treatment of diseases and clinical conditions associated with FLJ10945.

FLJ12121 (Accession NP_079254.1) is another GAM3770 target gene, herein designated TARGET GENE. FLJ12121 BINDING SITE is a target binding site found in the 3' untranslated region of mRNA encoded by FLJ12121, corresponding to a target binding site such as BINDING SITE I, BINDING SITE II or BINDING SITE III of FIG. 8. Table 4 illustrates the complementarity of the nucleotide sequences of FLJ12121 BINDING SITE, designated SEQ ID:6795, to the nucleotide sequence of GAM3770 RNA, herein designated GAM RNA, also designated SEQ ID:281.

Another function of GAM3770 is therefore inhibition of FLJ12121 (Accession NP_079254.1). Accordingly, utilities of GAM3770 include diagnosis, prevention and treatment of diseases and clinical conditions associated with FLJ12121.

FLJ12788 (Accession NP_071937.1) is another GAM3770 target gene, herein designated TARGET GENE. FLJ12788 BINDING SITE is a target binding site found in the 3' untranslated region of mRNA encoded by FLJ12788, corresponding to a target binding site such as BINDING SITE I, BINDING SITE II or BINDING SITE III of FIG. 8. Table 4 illustrates the complementarity of the nucleotide sequences of FLJ12788 BINDING SITE, designated SEQ ID:18045, to the nucleotide sequence of GAM3770 RNA, herein designated GAM RNA, also designated SEQ ID:241.

Another function of GAM3770 is therefore inhibition of FLJ12788 (Accession NP_071937.1). Accordingly, utilities of GAM3770 include diagnosis, prevention and treatment of diseases and clinical conditions associated with FLJ12788.

FLJ13114 (Accession NP_078817.1) is another GAM3770 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:14164, to the nucleotide sequence of GAM3770 RNA, herein designated GAM RNA, also designated SEQ ID:281.

Another function of GAM3770 is therefore inhibition of FLJ13114 (Accession NP_078817.1). Accordingly, utilities of GAM3770 include diagnosis, prevention and treatment of diseases and clinical conditions associated with FLJ13114.

FLJ13224 (Accession NP_079075.1) is another GAM3770 target gene, herein designated TARGET GENE. FLJ13224 BINDING SITE is a target binding site found in the 3' untranslated region of mRNA encoded by FLJ13224, corresponding to a target binding site such as BINDING SITE I, BINDING SITE II or BINDING SITE III of FIG. 8. Table 4 illustrates the complementarity of the nucleotide sequences of FLJ13224 BINDING SITE, designated SEQ ID:2074, to the nucleotide sequence of GAM3770 RNA, herein designated GAM RNA, also designated SEQ ID:241.

Another function of GAM3770 is therefore inhibition of FLJ13224 (Accession NP_079075.1). Accordingly, utilities of GAM3770 include diagnosis, prevention and treatment of diseases and clinical conditions associated with FLJ13224.

FLJ13646 (Accession NP_078860.1) is another GAM3770 target gene, herein designated TARGET GENE. FLJ13646 BINDING SITE is a target binding site found in the 3' untranslated region of mRNA encoded by FLJ13646, corresponding to a target binding site such as BINDING SITE I, BINDING SITE II or BINDING SITE III of FIG. 8. Table 4 illustrates the complementarity of the nucleotide sequences of FLJ13646 BINDING SITE, designated SEQ ID:19731, to the nucleotide sequence of GAM3770 RNA, herein designated GAM RNA, also designated SEQ ID:281.

Another function of GAM3770 is therefore inhibition of FLJ13646 (Accession NP_078860.1). Accordingly, utilities of GAM3770 include diagnosis, prevention and treatment of diseases and clinical conditions associated with FLJ13646.

FLJ20320 (Accession NP_060235.1) is another GAM3770 target gene, herein designated TARGET GENE. FLJ20320 BINDING SITE is a target binding site found in the 5' untranslated region of mRNA encoded by FLJ20320, corresponding to a target binding site such as BINDING SITE I, BINDING SITE II or BINDING SITE III of FIG. 8. Table 4 illustrates the complementarity of the nucleotide sequences of FLJ20320 BINDING SITE, designated SEQ ID:14004, to the nucleotide sequence of GAM3770 RNA, herein designated GAM RNA, also designated SEQ ID:241.

Another function of GAM3770 is therefore inhibition of FLJ20320 (Accession NP_060235.1). Accordingly, utilities of GAM3770 include diagnosis, prevention and treatment of diseases and clinical conditions associated with FLJ20320.

FLJ20445 (Accession NP_060294.1) is another GAM3770 target gene, herein designated TARGET GENE. FLJ20445 BINDING SITE is a target binding site found in the 3' untranslated region of mRNA encoded by FLJ20445, corresponding to a target binding site such as BINDING SITE I, BINDING SITE II or BINDING SITE III of FIG. 8. Table 4 illustrates the complementarity of the nucleotide sequences of FLJ20445 BINDING SITE, designated SEQ ID:3014, to the nucleotide sequence of GAM3770 RNA, herein designated GAM RNA, also designated SEQ ID:281.

Another function of GAM3770 is therefore inhibition of FLJ20445 (Accession NP_060294.1). Accordingly, utilities of GAM3770 include diagnosis, prevention and treatment of diseases and clinical conditions associated with FLJ20445.

FLJ22222 (Accession NP_078924.1) is another GAM3770 target gene, herein designated TARGET GENE. FLJ22222 BINDING SITE is a target binding site found in the 3' untranslated region of multiple transcripts of mRNA encoded by FLJ22222, corresponding to a target binding site such as BINDING SITE I, BINDING SITE II or BINDING SITE III of FIG. 8. Table 4 illustrates the complementarity of the nucleotide sequences of FLJ22222 BINDING SITE, designated SEQ ID:8328, to the nucleotide sequence of GAM3770 RNA, herein designated GAM RNA, also designated SEQ ID:241.

Another function of GAM3770 is therefore inhibition of FLJ22222 (Accession NP_078924.1). Accordingly, utilities of GAM3770 include diagnosis, prevention and treatment of diseases and clinical conditions associated with FLJ22222.

FLJ22222 (Accession NP_787098.2) is another GAM3770 target gene, herein designated TARGET GENE. FLJ22222 BINDING SITE is a target binding site found in the 3' untranslated region of multiple transcripts of mRNA encoded by FLJ22222, corresponding to a target binding site such as BINDING SITE I, BINDING SITE II or BINDING SITE III of FIG. 8. Table 4 illustrates the complementarity of the nucleotide sequences of FLJ22222 BINDING SITE, designated SEQ ID:8328, to the nucleotide sequence of GAM3770 RNA, herein designated GAM RNA, also designated SEQ ID:241.

Another function of GAM3770 is therefore inhibition of FLJ22222 (Accession NP_787098.2). Accordingly, utilities of GAM3770 include diagnosis, prevention and treatment of diseases and clinical conditions associated with FLJ22222.

FLJ23186 (Accession NP_078892.1) is another GAM3770 target gene, herein designated TARGET GENE. FLJ23186 BINDING SITE is a target binding site found in the 3' untranslated region of mRNA encoded by FLJ23186, corresponding to a target binding site such as BINDING SITE I, BINDING SITE II or BINDING SITE III of FIG. 8. Table 4 illustrates the complementarity of the nucleotide sequences of FLJ23186 BINDING SITE, designated SEQ ID:3020, to the nucleotide sequence of GAM3770 RNA, herein designated GAM RNA, also designated SEQ ID:241.

Another function of GAM3770 is therefore inhibition of FLJ23186 (Accession NP_078892.1). Accordingly, utilities of GAM3770 include diagnosis, prevention and treatment of diseases and clinical conditions associated with FLJ23186.

FLJ23323 (Accession NP_078930.1) is another GAM3770 target gene, herein designated TARGET GENE. FLJ23323 BINDING SITE is a target binding site found in the 3' untranslated region of mRNA encoded by FLJ23323, corresponding to a target binding site such as BINDING SITE I, BINDING SITE II or BINDING SITE III of FIG. 8. Table 4 illustrates the complementarity of the nucleotide sequences of FLJ23323 BINDING SITE, designated SEQ ID:12687, to the nucleotide sequence of GAM3770 RNA, herein designated GAM RNA, also designated SEQ ID:241.

Another function of GAM3770 is therefore inhibition of FLJ23323 (Accession NP_078930.1). Accordingly, utilities of GAM3770 include diagnosis, prevention and treatment of diseases and clinical conditions associated with FLJ23323.

FLJ23867 (Accession NP_689875.1) is another GAM3770 target gene, herein designated TARGET GENE. FLJ23867 BINDING SITE is a target binding site found in the 3' untranslated region of mRNA encoded by FLJ23867, corresponding to a target binding site such as BINDING SITE I, BINDING SITE II or BINDING SITE III of FIG. 8. Table 4 illustrates the complementarity of the nucleotide sequences of FLJ23867 BINDING SITE, designated SEQ ID:1191, to the nucleotide sequence of GAM3770 RNA, herein designated GAM RNA, also designated SEQ ID:281.

Another function of GAM3770 is therefore inhibition of FLJ23867 (Accession NP_689875.1). Accordingly, utilities of GAM3770 include diagnosis, prevention and treatment of diseases and clinical conditions associated with FLJ23867.

FLJ32096 (Accession NP_776156.1) is another GAM3770 target gene, herein designated TARGET GENE. FLJ32096 BINDING SITE is a target binding site found in the 3' untranslated region of mRNA encoded by FLJ32096, corresponding to a target binding site such as BINDING SITE I, BINDING SITE II or BINDING SITE III of FIG. 8. Table 4 illustrates the complementarity of the nucleotide sequences of FLJ32096 BINDING SITE, designated SEQ ID:12027, to the nucleotide sequence of GAM3770 RNA, herein designated GAM RNA, also designated SEQ ID:241.

Another function of GAM3770 is therefore inhibition of FLJ32096 (Accession NP_776156.1). Accordingly, utilities of GAM3770 include diagnosis, prevention and treatment of diseases and clinical conditions associated with FLJ32096.

FLJ32334 (Accession NP_653166.1) is another GAM3770 target gene, herein designated TARGET GENE.

FLJ32334 BINDING SITE is a target binding site found in the 3' untranslated region of mRNA encoded by FLJ32334, corresponding to a target binding site such as BINDING SITE I, BINDING SITE II or BINDING SITE III of FIG. 8. Table 4 illustrates the complementarity of the nucleotide sequences of FLJ32334 BINDING SITE, designated SEQ ID:14094, to the nucleotide sequence of GAM3770 RNA, herein designated GAM RNA, also designated SEQ ID:281.

Another function of GAM3770 is therefore inhibition of FLJ32334 (Accession NP_653166.1). Accordingly, utilities of GAM3770 include diagnosis, prevention and treatment of diseases and clinical conditions associated with FLJ32334.

FLJ32389 (Accession NP_653218.1) is another GAM3770 target gene, herein designated TARGET GENE. FLJ32389 BINDING SITE is a target binding site found in the 3' untranslated region of mRNA encoded by FLJ32389, corresponding to a target binding site such as BINDING SITE I, BINDING SITE II or BINDING SITE III of FIG. 8. Table 4 illustrates the complementarity of the nucleotide sequences of FLJ32389 BINDING SITE, designated SEQ ID:18343, to the nucleotide sequence of GAM3770 RNA, herein designated GAM RNA, also designated SEQ ID:241.

Another function of GAM3770 is therefore inhibition of FLJ32389 (Accession NP_653218.1). Accordingly, utilities of GAM3770 include diagnosis, prevention and treatment of diseases and clinical conditions associated with FLJ32389.

FLJ32833 (Accession NP_689701.1) is another GAM3770 target gene, herein designated TARGET GENE. FLJ32833 BINDING SITE is a target binding site found in the 3' untranslated region of mRNA encoded by FLJ32833, corresponding to a target binding site such as BINDING SITE I, BINDING SITE II or BINDING SITE III of FIG. 8. Table 4 illustrates the complementarity of the nucleotide sequences of FLJ32833 BINDING SITE, designated SEQ ID:8952, to the nucleotide sequence of GAM3770 RNA, herein designated GAM RNA, also designated SEQ ID:281.

Another function of GAM3770 is therefore inhibition of FLJ32833 (Accession NP_689701.1). Accordingly, utilities of GAM3770 include diagnosis, prevention and treatment of diseases and clinical conditions associated with FLJ32833.

FLJ37078 (Accession NP_694588.1) is another GAM3770 target gene, herein designated TARGET GENE. FLJ37078 BINDING SITE is a target binding site found in the 5' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:924, to the nucleotide sequence of GAM3770 RNA, herein designated GAM RNA, also designated SEQ ID:281.

Another function of GAM3770 is therefore inhibition of FLJ37078 (Accession NP_694588.1). Accordingly, utilities of GAM3770 include diagnosis, prevention and treatment of diseases and clinical conditions associated with FLJ37078.

FLJ38607 (Accession NP_689867.1) is another GAM3770 target gene, herein designated TARGET GENE. FLJ38607 BINDING SITE is a target binding site found in the 3' untranslated region of mRNA encoded by FLJ38607, corresponding to a target binding site such as BINDING SITE I, BINDING SITE II or BINDING SITE III of FIG. 8. Table 4 illustrates the complementarity of the nucleotide sequences of FLJ38607 BINDING SITE, designated SEQ ID:1795, to the nucleotide sequence of GAM3770 RNA, herein designated GAM RNA, also designated SEQ ID:241.

Another function of GAM3770 is therefore inhibition of FLJ38607 (Accession NP_689867.1). Accordingly, utilities of GAM3770 include diagnosis, prevention and treatment of diseases and clinical conditions associated with FLJ38607.

FRCP2 (Accession NP_715637.1) is another GAM3770 target gene, herein designated TARGET GENE. FRCP2 BINDING SITE is a target binding site found in the 3' untranslated region of mRNA encoded by FRCP2, corresponding to a target binding site such as BINDING SITE I, BINDING SITE II or BINDING SITE III of FIG. 8. Table 4 illustrates the complementarity of the nucleotide sequences of FRCP2 BINDING SITE, designated SEQ ID:8098, to the nucleotide sequence of GAM3770 RNA, herein designated GAM RNA, also designated SEQ ID:241.

Another function of GAM3770 is therefore inhibition of FRCP2 (Accession NP_715637.1). Accordingly, utilities of GAM3770 include diagnosis, prevention and treatment of diseases and clinical conditions associated with FRCP2.

Frequenin homolog (drosophila) (FREQ, Accession NP_055101.2) is another GAM3770 target gene, herein designated TARGET GENE. FREQ BINDING SITE is a target binding site found in the 3' untranslated region of mRNA encoded by FREQ, corresponding to a target binding site such as BINDING SITE I, BINDING SITE II or BINDING SITE III of FIG. 8. Table 4 illustrates the complementarity of the nucleotide sequences of FREQ BINDING SITE, designated SEQ ID:12562, to the nucleotide sequence of GAM3770 RNA, herein designated GAM RNA, also designated SEQ ID:281.

Another function of GAM3770 is therefore inhibition of Frequenin homolog (drosophila) (FREQ, Accession NP_055101.2). Accordingly, utilities of GAM3770 include diagnosis, prevention and treatment of diseases and clinical conditions associated with FREQ.

Gamma-aminobutyric acid (gaba) a receptor, epsilon (GABRE, Accession NP_068822.1) is another GAM3770 target gene, herein designated TARGET GENE. GABRE BINDING SITE is a target binding site found in the 3' untranslated region of multiple transcripts of mRNA encoded by GABRE, corresponding to a target binding site such as BINDING SITE I, BINDING SITE II or BINDING SITE III of FIG. 8. Table 4 illustrates the complementarity of the nucleotide sequences of GABRE BINDING SITE, designated SEQ ID:10097, to the nucleotide sequence of GAM3770 RNA, herein designated GAM RNA, also designated SEQ ID:281.

Another function of GAM3770 is therefore inhibition of Gamma-aminobutyric acid (gaba) a receptor, epsilon (GABRE, Accession NP_068822.1), a gene which mediates neuronal inhibition by binding to the gaba/benzodiazepine receptor and opening an integral chloride channel. and therefore may be associated with Early-onset parkinsonism (or waisman syndrome), mrx3 (a form of x-linked mental retardation). Accordingly, utilities of GAM3770 include diagnosis, prevention and treatment of Early-onset parkinsonism (or waisman syndrome), mrx3 (a form of x-linked mental retardation), and of other diseases and clinical conditions associated with GABRE.

The function of GABRE and its association with various diseases and clinical conditions, has been established by previous studies, as described hereinabove with reference to GAM65.1. Gamma-aminobutyric acid (gaba) a receptor, epsilon (GABRE, Accession NP_068830.1) is another GAM3770 target gene, herein designated TARGET GENE. GABRE BINDING SITE is a target binding site found in the 3' untranslated region of multiple transcripts of mRNA encoded by GABRE, corresponding to a target binding site such as BINDING SITE I, BINDING SITE II or BINDING SITE III of FIG. 8. Table 4 illustrates the complementarity of the nucleotide sequences of GABRE BINDING SITE, designated SEQ ID:10097, to the nucleotide sequence of GAM3770 RNA, herein designated GAM RNA, also designated SEQ ID:281.

Another function of GAM3770 is therefore inhibition of Gamma-aminobutyric acid (gaba) a receptor, epsilon (GABRE, Accession NP_068830.1), a gene which mediates neuronal inhibition by binding to the gaba/benzodiazepine receptor and opening an integral chloride channel. and therefore may be associated with Early-onset parkinsonism (or waisman syndrome), mrx3 (a form of x-linked mental retardation). Accordingly, utilities of GAM3770 include diagnosis, prevention and treatment of Early-onset parkinsonism (or waisman syndrome), mrx3 (a form of x-linked mental retardation), and of other diseases and clinical conditions associated with GABRE.

The function of GABRE and its association with various diseases and clinical conditions, has been established by previous studies, as described hereinabove with reference to GAM65.1. Gamma-aminobutyric acid (gaba) a receptor, epsilon (GABRE, Accession NP_068819.1) is another GAM3770 target gene, herein designated TARGET GENE. GABRE BINDING SITE is a target binding site found in the 3' untranslated region of multiple transcripts of mRNA encoded by GABRE, corresponding to a target binding site such as BINDING SITE I, BINDING SITE II or BINDING SITE III of FIG. 8. Table 4 illustrates the complementarity of the nucleotide sequences of GABRE BINDING SITE, designated SEQ ID:10097, to the nucleotide sequence of GAM3770 RNA, herein designated GAM RNA, also designated SEQ ID:281.

Another function of GAM3770 is therefore inhibition of Gamma-aminobutyric acid (gaba) a receptor, epsilon (GABRE, Accession NP_068819.1), a gene which mediates neuronal inhibition by binding to the gaba/benzodiazepine receptor and opening an integral chloride channel. and therefore may be associated with Early-onset parkinsonism (or waisman syndrome), mrx3 (a form of x-linked mental retardation). Accordingly, utilities of GAM3770 include diagnosis, prevention and treatment of Early-onset parkinsonism (or waisman syndrome), mrx3 (a form of x-linked mental retardation), and of other diseases and clinical conditions associated with GABRE.

The function of GABRE and its association with various diseases and clinical conditions, has been established by previous studies, as described hereinabove with reference to GAM65.1. Gamma-aminobutyric acid (gaba) a receptor, epsilon (GABRE, Accession NP_004952.1) is another GAM3770 target gene, herein designated TARGET GENE. GABRE BINDING SITE is a target binding site found in the 3' untranslated region of multiple transcripts of mRNA encoded by GABRE, corresponding to a target binding site such as BINDING SITE I, BINDING SITE II or BINDING SITE III of FIG. 8. Table 4 illustrates the complementarity of the nucleotide sequences of GABRE BINDING SITE, designated SEQ ID:10097, to the nucleotide sequence of GAM3770 RNA, herein designated GAM RNA, also designated SEQ ID:281.

Another function of GAM3770 is therefore inhibition of Gamma-aminobutyric acid (gaba) a receptor, epsilon (GABRE, Accession NP_004952.1), a gene which mediates neuronal inhibition by binding to the gaba/benzodiazepine receptor and opening an integral chloride channel. and therefore may be associated with Early-onset parkinsonism (or waisman syndrome), mrx3 (a form of x-linked mental retardation). Accordingly, utilities of GAM3770 include diagnosis, prevention and treatment of Early-onset parkinsonism (or waisman syndrome), mrx3 (a form of x-linked mental retardation), and of other diseases and clinical conditions associated with GABRE.

The function of GABRE and its association with various diseases and clinical conditions, has been established by previous studies, as described hereinabove with reference to GAM65.1. Udp-n-acetyl-alpha-d-galactosamine:polypeptide n-acetylgalactosaminyltransferase 2 (galnac-t2) (GALNT2, Accession NP_004472.1) is another GAM3770 target gene, herein designated TARGET GENE. GALNT2 BINDING SITE is a target binding site found in the 3' untranslated region of mRNA encoded by GALNT2, corresponding to a target binding site such as BINDING SITE I, BINDING SITE II or BINDING SITE III of FIG. 8. Table 4 illustrates the complementarity of the nucleotide sequences of GALNT2 BINDING SITE, designated SEQ ID:6744, to the nucleotide sequence of GAM3770 RNA, herein designated GAM RNA, also designated SEQ ID:241.

Another function of GAM3770 is therefore inhibition of Udp-n-acetyl-alpha-d-galactosamine:polypeptide n-acetylgalactosaminyltransferase 2 (galnac-t2) (GALNT2, Accession NP_004472.1), a gene which catalyzes the initial reaction in o-linked oligosaccharide biosynthesis. Accordingly, utilities of GAM3770 include diagnosis, prevention and treatment of diseases and clinical conditions associated with GALNT2.

The function of GALNT2 and its association with various diseases and clinical conditions, has been established by previous studies, as described hereinabove with reference to GAM96.1. Glycine amidinotransferase (l-arginine:glycine amidinotransferase) (GATM, Accession NP_001473.1) is another GAM3770 target gene, herein designated TARGET GENE. GATM BINDING SITE is a target binding site found in the 3' untranslated region of mRNA encoded by GATM, corresponding to a target binding site such as BINDING SITE I, BINDING SITE II or BINDING SITE III of FIG. 8. Table 4 illustrates the complementarity of the nucleotide sequences of GATM BINDING SITE, designated SEQ ID:19758, to the nucleotide sequence of GAM3770 RNA, herein designated GAM RNA, also designated SEQ ID:281.

Another function of GAM3770 is therefore inhibition of Glycine amidinotransferase (l-arginine:glycine amidinotransferase) (GATM, Accession NP_001473.1), a gene which glycine amidinotransferase; component of the creatine biosynthetic pathway and therefore may be associated with Agat deficiency. Accordingly, utilities of GAM3770 include diagnosis, prevention and treatment of Agat deficiency, and of other diseases and clinical conditions associated with GATM.

The function of GATM and its association with various diseases and clinical conditions, has been established by previous studies, as described hereinabove with reference to GAM367.1. Ganglioside-induced differentiation-associated protein 1-like 1 (GDAP1L1, Accession NP_076939.3) is another GAM3770 target gene, herein designated TARGET GENE. GDAP1L1 BINDING SITE is a target binding site found in the 3' untranslated region of mRNA encoded by GDAP1L1, corresponding to a target binding site such as BINDING SITE I, BINDING SITE II or BINDING SITE III of FIG. 8. Table 4 illustrates the complementarity of the nucleotide sequences of GDAP1L1 BINDING SITE, designated SEQ ID:1628, to the nucleotide sequence of GAM3770 RNA, herein designated GAM RNA, also designated SEQ ID:281.

Another function of GAM3770 is therefore inhibition of Ganglioside-induced differentiation-associated protein 1-like 1 (GDAP1L1, Accession NP_076939.3). Accordingly, utilities of GAM3770 include diagnosis, prevention and treatment of diseases and clinical conditions associated with GDAP1L1.

Growth differentiation factor 10 (GDF10, Accession NP_004953.1) is another GAM3770 target gene, herein designated TARGET GENE. GDF10 BINDING SITE is a target binding site found in the 5' untranslated region of mRNA encoded by GDF10, corresponding to a target binding site such as BINDING SITE I, BINDING SITE II or BINDING SITE III of FIG. 8. Table 4 illustrates the complementarity of the nucleotide sequences of GDF10 BINDING SITE, designated SEQ ID:15145, to the nucleotide sequence of GAM3770 RNA, herein designated GAM RNA, also designated SEQ ID:241.

Another function of GAM3770 is therefore inhibition of Growth differentiation factor 10 (GDF10, Accession NP_004953.1). Accordingly, utilities of GAM3770 include diagnosis, prevention and treatment of diseases and clinical conditions associated with GDF10.

Glycine receptor, alpha 3 (GLRA3, Accession NP_006520.1) is another GAM3770 target gene, herein designated TARGET GENE. GLRA3 BINDING SITE is a target binding site found in the 5' untranslated region of mRNA encoded by GLRA3, corresponding to a target binding site such as BINDING SITE I, BINDING SITE II or BINDING SITE III of FIG. 8. Table 4 illustrates the complementarity of the nucleotide sequences of GLRA3 BINDING SITE, designated SEQ ID:12548, to the nucleotide sequence of GAM3770 RNA, herein designated GAM RNA, also designated SEQ ID:241.

Another function of GAM3770 is therefore inhibition of Glycine receptor, alpha 3 (GLRA3, Accession NP_006520.1), a gene which increases the chloride conductance and thus produces hyperpolarization (inhibition of neuronal firing). Accordingly, utilities of GAM3770 include diagnosis, prevention and treatment of diseases and clinical conditions associated with GLRA3.

The function of GLRA3 and its association with various diseases and clinical conditions, has been established by previous studies, as described hereinabove with reference to GAM785.1. GNB4 (Accession NP_067642.1) is another GAM3770 target gene, herein designated TARGET GENE. GNB4 BINDING SITE is a target binding site found in the 5' untranslated region of mRNA encoded by GNB4, corresponding to a target binding site such as BINDING SITE I, BINDING SITE II or BINDING SITE III of FIG. 8. Table 4 illustrates the complementarity of the nucleotide sequences of GNB4 BINDING SITE, designated SEQ ID:19919, to the nucleotide sequence of GAM3770 RNA, herein designated GAM RNA, also designated SEQ ID:241.

Another function of GAM3770 is therefore inhibition of GNB4 (Accession NP_067642.1). Accordingly, utilities of GAM3770 include diagnosis, prevention and treatment of diseases and clinical conditions associated with GNB4.

GNPNAT1 (Accession XP_085119.1) is another GAM3770 target gene, herein designated TARGET GENE. GNPNAT1 BINDING SITE is a target binding site found in the 3' untranslated region of mRNA encoded by GNPNAT1, corresponding to a target binding site such as BINDING SITE I, BINDING SITE II or BINDING SITE III of FIG. 8. Table 4 illustrates the complementarity of the nucleotide sequences of GNPNAT1 BINDING SITE, designated SEQ ID:12686, to the nucleotide sequence of GAM3770 RNA, herein designated GAM RNA, also designated SEQ ID:281.

Another function of GAM3770 is therefore inhibition of GNPNAT1 (Accession XP_085119.1). Accordingly, utilities of GAM3770 include diagnosis, prevention and treatment of diseases and clinical conditions associated with GNPNAT1.

Glycoprotein a33 (transmembrane) (GPA33, Accession NP_005805.1) is another GAM3770 target gene, herein designated TARGET GENE. GPA33 BINDING SITE is a target binding site found in the 3' untranslated region of mRNA encoded by GPA33, corresponding to a target binding site such as BINDING SITE I, BINDING SITE II or BINDING SITE III of FIG. 8. Table 4 illustrates the complementarity of the nucleotide sequences of GPA33 BINDING SITE, designated SEQ ID:11566, to the nucleotide sequence of GAM3770 RNA, herein designated GAM RNA, also designated SEQ ID:281.

Another function of GAM3770 is therefore inhibition of Glycoprotein a33 (transmembrane) (GPA33, Accession NP_005805.1). Accordingly, utilities of GAM3770 include diagnosis, prevention and treatment of diseases and clinical conditions associated with GPA33.

GTR2 (Accession NP_071440.1) is another GAM3770 target gene, herein designated TARGET GENE. GTR2 BINDING SITE is a target binding site found in the 3' untranslated region of mRNA encoded by GTR2, corresponding to a target binding site such as BINDING SITE I, BINDING SITE II or BINDING SITE III of FIG. 8. Table 4 illustrates the complementarity of the nucleotide sequences of GTR2 BINDING SITE, designated SEQ ID:18842, to the nucleotide sequence of GAM3770 RNA, herein designated GAM RNA, also designated SEQ ID:281.

Another function of GAM3770 is therefore inhibition of GTR2 (Accession NP_071440.1). Accordingly, utilities of GAM3770 include diagnosis, prevention and treatment of diseases and clinical conditions associated with GTR2.

Huntingtin (huntington disease) (HD, Accession NP_002102.2) is another GAM3770 target gene, herein designated TARGET GENE. HD BINDING SITE is a target binding site found in the 3' untranslated region of mRNA encoded by HD, corresponding to a target binding site such as BINDING SITE I, BINDING SITE II or BINDING SITE III of FIG. 8. Table 4 illustrates the complementarity of the nucleotide sequences of HD BINDING SITE, designated SEQ ID:17396, to the nucleotide sequence of GAM3770 RNA, herein designated GAM RNA, also designated SEQ ID:281.

Another function of GAM3770 is therefore inhibition of Huntingtin (huntington disease) (HD, Accession NP_002102.2). Accordingly, utilities of GAM3770 include diagnosis, prevention and treatment of diseases and clinical conditions associated with HD.

HEMK (Accession NP_057257.1) is another GAM3770 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:18413, to the nucleotide sequence of GAM3770 RNA, herein designated GAM RNA, also designated SEQ ID:281.

Another function of GAM3770 is therefore inhibition of HEMK (Accession NP_057257.1). Accordingly, utilities of GAM3770 include diagnosis, prevention and treatment of diseases and clinical conditions associated with HEMK.

Hect domain and rld 3 (HERC3, Accession NP_055421.1) is another GAM3770 target gene, herein designated TARGET GENE. HERC3 BINDING SITE is a target binding site found in the 3' untranslated region of mRNA encoded by HERC3, corresponding to a target binding site such as BIND- ING SITE I, BINDING SITE II or BINDING SITE III of FIG. 8. Table 4 illustrates the complementarity of the nucleotide sequences of HERC3 BINDING SITE, designated SEQ ID:13951, to the nucleotide sequence of GAM3770 RNA, herein designated GAM RNA, also designated SEQ ID:281.

Another function of GAM3770 is therefore inhibition of Hect domain and rld 3 (HERC3, Accession NP_055421.1). Accordingly, utilities of GAM3770 include diagnosis, prevention and treatment of diseases and clinical conditions associated with HERC3.

HFL-EDDG1 (Accession NP_006544.1) is another GAM3770 target gene, herein designated TARGET GENE. HFL-EDDG1 BINDING SITE is a target binding site found in the 5' untranslated region of mRNA encoded by HFL-EDDG1, corresponding to a target binding site such as BINDING SITE I, BINDING SITE II or BINDING SITE III of FIG. 8. Table 4 illustrates the complementarity of the nucleotide sequences of HFL-EDDG1 BINDING SITE, designated SEQ ID:13232, to the nucleotide sequence of GAM3770 RNA, herein designated GAM RNA, also designated SEQ ID:281.

Another function of GAM3770 is therefore inhibition of HFL-EDDG1 (Accession NP_006544.1). Accordingly, utilities of GAM3770 include diagnosis, prevention and treatment of diseases and clinical conditions associated with HFL-EDDG1.

hIAN2 (Accession NP_078987.2) is another GAM3770 target gene, herein designated TARGET GENE. hIAN2 BINDING SITE is a target binding site found in the 3' untranslated region of mRNA encoded by hIAN2, corresponding to a target binding site such as BINDING SITE I, BINDING SITE II or BINDING SITE III of FIG. 8. Table 4 illustrates the complementarity of the nucleotide sequences of hIAN2 BINDING SITE, designated SEQ ID:19907, to the nucleotide sequence of GAM3770 RNA, herein designated GAM RNA, also designated SEQ ID:281.

Another function of GAM3770 is therefore inhibition of hIAN2 (Accession NP_078987.2). Accordingly, utilities of GAM3770 include diagnosis, prevention and treatment of diseases and clinical conditions associated with hIAN2.

Hypermethylated in cancer 2 (HIC2, Accession NP_055909.1) is another GAM3770 target gene, herein designated TARGET GENE. HIC2 BINDING SITE is a target binding site found in the 3' untranslated region of multiple transcripts of mRNA encoded by HIC2, corresponding to a target binding site such as BINDING SITE I, BINDING SITE II or BINDING SITE III of FIG. 8. Table 4 illustrates the complementarity of the nucleotide sequences of HIC2 BINDING SITE, designated SEQ ID:3402, to the nucleotide sequence of GAM3770 RNA, herein designated GAM RNA, also designated SEQ ID:241.

Another function of GAM3770 is therefore inhibition of Hypermethylated in cancer 2 (HIC2, Accession NP_055909.1). Accordingly, utilities of GAM3770 include diagnosis, prevention and treatment of diseases and clinical conditions associated with HIC2.

Hypermethylated in cancer 2 (HIC2, Accession XP_036937.2) is another GAM3770 target gene, herein designated TARGET GENE. HIC2 BINDING SITE is a target binding site found in the 3' untranslated region of multiple transcripts of mRNA encoded by HIC2, corresponding to a target binding site such as BINDING SITE I, BINDING SITE II or BINDING SITE III of FIG. 8. Table 4 illustrates the complementarity of the nucleotide sequences of HIC2 BINDING SITE, designated SEQ ID:3402, to the nucleotide sequence of GAM3770 RNA, herein designated GAM RNA, also designated SEQ ID:241.

Another function of GAM3770 is therefore inhibition of Hypermethylated in cancer 2 (HIC2, Accession XP_036937.2). Accordingly, utilities of GAM3770 include diagnosis, prevention and treatment of diseases and clinical conditions associated with HIC2.

HIP1R (Accession XP_290592.1) is another GAM3770 target gene, herein designated TARGET GENE. HIP1R BINDING SITE is a target binding site found in the 3' untranslated region of mRNA encoded by HIP1R, corresponding to a target binding site such as BINDING SITE I, BINDING SITE II or BINDING SITE III of FIG. 8. Table 4 illustrates the complementarity of the nucleotide sequences of HIP1R BINDING SITE, designated SEQ ID:16778, to the nucleotide sequence of GAM3770 RNA, herein designated GAM RNA, also designated SEQ ID:281.

Another function of GAM3770 is therefore inhibition of HIP1R (Accession XP_290592.1). Accordingly, utilities of GAM3770 include diagnosis, prevention and treatment of diseases and clinical conditions associated with HIP1R.

High-mobility group box 3 (HMGB3, Accession NP_005333.1) is another GAM3770 target gene, herein designated TARGET GENE. HMGB3 BINDING SITE is a target binding site found in the 3' untranslated region of mRNA encoded by HMGB3, corresponding to a target binding site such as BINDING SITE I, BINDING SITE II or BINDING SITE III of FIG. 8. Table 4 illustrates the complementarity of the nucleotide sequences of HMGB3 BINDING SITE, designated SEQ ID:4089, to the nucleotide sequence of GAM3770 RNA, herein designated GAM RNA, also designated SEQ ID:241.

Another function of GAM3770 is therefore inhibition of High-mobility group box 3 (HMGB3, Accession NP_005333.1), a gene which plays a fundamental role in DNA replication, nucleosome assembly, and transcription. Accordingly, utilities of GAM3770 include diagnosis, prevention and treatment of diseases and clinical conditions associated with HMGB3.

The function of HMGB3 and its association with various diseases and clinical conditions, has been established by previous studies, as described hereinabove with reference to GAM409.1. Heparan sulfate (glucosamine) 3-o-sulfotransferase 4 (HS3ST4, Accession XP_056254.4) is another GAM3770 target gene, herein designated TARGET GENE. HS3ST4 BINDING SITE is a target binding site found in the 3' untranslated region of mRNA encoded by HS3ST4, corresponding to a target binding site such as BINDING SITE I, BINDING SITE II or BINDING SITE III of FIG. 8. Table 4 illustrates the complementarity of the nucleotide sequences of HS3ST4 BINDING SITE, designated SEQ ID:1736, to the nucleotide sequence of GAM3770 RNA, herein designated GAM RNA, also designated SEQ ID:241.

Another function of GAM3770 is therefore inhibition of Heparan sulfate (glucosamine) 3-o-sulfotransferase 4 (HS3ST4, Accession XP_056254.4). Accordingly, utilities of GAM3770 include diagnosis, prevention and treatment of diseases and clinical conditions associated with HS3ST4.

Hydroxy-delta-5-steroid dehydrogenase, 3 beta- and steroid delta-isomerase 2 (HSD3B2, Accession NP_000189.1) is another GAM3770 target gene, herein designated TARGET GENE. HSD3B2 BINDING SITE is a target binding site found in the 3' untranslated region of mRNA encoded by HSD3B2, corresponding to a target binding site such as BINDING SITE I, BINDING SITE II or BINDING SITE III of FIG. 8. Table 4 illustrates the complementarity of the nucleotide sequences of HSD3B2 BINDING SITE, designated SEQ ID:10226, to the nucleotide sequence of GAM3770 RNA, herein designated GAM RNA, also designated SEQ ID:281.

Another function of GAM3770 is therefore inhibition of Hydroxy-delta-5-steroid dehydrogenase, 3 beta- and steroid delta-isomerase 2 (HSD3B2, Accession NP_000189.1). Accordingly, utilities of GAM3770 include diagnosis, prevention and treatment of diseases and clinical conditions associated with HSD3B2.

HUMPPA (Accession XP_290730.2) is another GAM3770 target gene, herein designated TARGET GENE. HUMPPA BINDING SITE is a target binding site found in the 3' untranslated region of mRNA encoded by HUMPPA, corresponding to a target binding site such as BINDING SITE I, BINDING SITE II or BINDING SITE III of FIG. 8. Table 4 illustrates the complementarity of the nucleotide sequences of HUMPPA BINDING SITE, designated SEQ ID:1054, to the nucleotide sequence of GAM3770 RNA, herein designated GAM RNA, also designated SEQ ID:281.

Another function of GAM3770 is therefore inhibition of HUMPPA (Accession XP_290730.2). Accordingly, utilities of GAM3770 include diagnosis, prevention and treatment of diseases and clinical conditions associated with HUMPPA.

Inhibitor of dna binding 4, dominant negative helix-loop-helix protein (ID4, Accession NP_001537.1) is another GAM3770 target gene, herein designated TARGET GENE. ID4 BINDING SITE is a target binding site found in the 3' untranslated region of mRNA encoded by ID4, corresponding to a target binding site such as BINDING SITE I, BINDING SITE II or BINDING SITE III of FIG. 8. Table 4 illustrates the complementarity of the nucleotide sequences of ID4 BINDING SITE, designated SEQ ID:2437, to the nucleotide sequence of GAM3770 RNA, herein designated GAM RNA, also designated SEQ ID:281.

Another function of GAM3770 is therefore inhibition of Inhibitor of dna binding 4, dominant negative helix-loop-helix protein (ID4, Accession NP_001537.1), a gene which negatively regulates cell differentiation. Accordingly, utilities of GAM3770 include diagnosis, prevention and treatment of diseases and clinical conditions associated with ID4.

The function of ID4 and its association with various diseases and clinical conditions, has been established by previous studies, as described hereinabove with reference to GAM71.1. Interferon induced transmembrane protein 2 (1-8d) (IFITM2, Accession NP_006426.1) is another GAM3770 target gene, herein designated TARGET GENE. IFITM2 BINDING SITE is a target binding site found in the 3' untranslated region of mRNA encoded by IFITM2, corresponding to a target binding site such as BINDING SITE I, BINDING SITE II or BINDING SITE III of FIG. 8. Table 4 illustrates the complementarity of the nucleotide sequences of IFITM2 BINDING SITE, designated SEQ ID:3118, to the nucleotide sequence of GAM3770 RNA, herein designated GAM RNA, also designated SEQ ID:281.

Another function of GAM3770 is therefore inhibition of Interferon induced transmembrane protein 2 (1-8d) (IFITM2, Accession NP_006426.1). Accordingly, utilities of GAM3770 include diagnosis, prevention and treatment of diseases and clinical conditions associated with IFITM2.

Interleukin 6 receptor (IL6R, Accession NP_000556.1) is another GAM3770 target gene, herein designated TARGET GENE. IL6R BINDING SITE is a target binding site found in the 3' untranslated region of multiple transcripts of mRNA encoded by IL6R, corresponding to a target binding site such as BINDING SITE I, BINDING SITE II or BINDING SITE III of FIG. 8. Table 4 illustrates the complementarity of the nucleotide sequences of IL6R BINDING SITE, designated SEQ ID:10573, to the nucleotide sequence of GAM3770 RNA, herein designated GAM RNA, also designated SEQ ID:281.

Another function of GAM3770 is therefore inhibition of Interleukin 6 receptor (IL6R, Accession NP_000556.1), a gene which is essential to the regulation of the immune response, hematopoiesis, and acute-phase reactions. Accordingly, utilities of GAM3770 include diagnosis, prevention and treatment of diseases and clinical conditions associated with IL6R.

The function of IL6R and its association with various diseases and clinical conditions, has been established by previous studies, as described hereinabove with reference to GAM94.1. Interleukin 6 receptor (IL6R, Accession NP_852004.1) is another GAM3770 target gene, herein designated TARGET GENE. IL6R BINDING SITE is a target binding site found in the 3' untranslated region of multiple transcripts of mRNA encoded by IL6R, corresponding to a target binding site such as BINDING SITE I, BINDING SITE II or BINDING SITE III of FIG. 8. Table 4 illustrates the complementarity of the nucleotide sequences of IL6R BINDING SITE, designated SEQ ID:10573, to the nucleotide sequence of GAM3770 RNA, herein designated GAM RNA, also designated SEQ ID:281.

Another function of GAM3770 is therefore inhibition of Interleukin 6 receptor (IL6R, Accession NP_852004.1), a gene which is essential to the regulation of the immune response, hematopoiesis, and acute-phase reactions. Accordingly, utilities of GAM3770 include diagnosis, prevention and treatment of diseases and clinical conditions associated with IL6R.

The function of IL6R and its association with various diseases and clinical conditions, has been established by previous studies, as described hereinabove with reference to GAM94.1. Inhibin, beta b (activin ab beta polypeptide) (INHBB, Accession NP_002184.1) is another GAM3770 target gene, herein designated TARGET GENE. INHBB BINDING SITE is a target binding site found in the 3' untranslated region of mRNA encoded by INHBB, corresponding to a target binding site such as BINDING SITE I, BINDING SITE II or BINDING SITE III of FIG. 8. Table 4 illustrates the complementarity of the nucleotide sequences of INHBB BINDING SITE, designated SEQ ID:14744, to the nucleotide sequence of GAM3770 RNA, herein designated GAM RNA, also designated SEQ ID:281.

Another function of GAM3770 is therefore inhibition of Inhibin, beta b (activin ab beta polypeptide) (INHBB, Accession NP_002184.1), a gene which inhibins inhibit the secretion of follitropin by the pituitary gland. and therefore may be associated with Tumors. Accordingly, utilities of GAM3770 include diagnosis, prevention and treatment of Tumors, and of other diseases and clinical conditions associated with INHBB.

The function of INHBB and its association with various diseases and clinical conditions, has been established by previous studies, as described hereinabove with reference to GAM174.1. Potassium voltage-gated channel, shab-related subfamily, member 2 (KCNB2, Accession NP_004761.2) is another GAM3770 target gene, herein designated TARGET GENE. KCNB2 BINDING SITE is a target binding site found in the 5' untranslated region of mRNA encoded by KCNB2, corresponding to a target binding site such as BINDING SITE I, BINDING SITE II or BINDING SITE III of FIG. 8. Table 4 illustrates the complementarity of the nucleotide sequences of KCNB2 BINDING SITE, designated SEQ ID:6452, to the nucleotide sequence of GAM3770 RNA, herein designated GAM RNA, also designated SEQ ID:281.

Another function of GAM3770 is therefore inhibition of Potassium voltage-gated channel, shab-related subfamily, member 2 (KCNB2, Accession NP_004761.2). Accordingly, utilities of GAM3770 include diagnosis, prevention and treatment of diseases and clinical conditions associated with KCNB2.

Potassium voltage-gated channel, shal-related subfamily, member 1 (KCND1, Accession NP_004970.3) is another GAM3770 target gene, herein designated TARGET GENE. KCND1 BINDING SITE is a target binding site found in the 3' untranslated region of mRNA encoded by KCND1, corresponding to a target binding site such as BINDING SITE I, BINDING SITE II or BINDING SITE III of FIG. 8. Table 4 illustrates the complementarity of the nucleotide sequences of KCND1 BINDING SITE, designated SEQ ID:12525, to the nucleotide sequence of GAM3770 RNA, herein designated GAM RNA, also designated SEQ ID:281.

Another function of GAM3770 is therefore inhibition of Potassium voltage-gated channel, shal-related subfamily, member 1 (KCND1, Accession NP_004970.3). Accordingly, utilities of GAM3770 include diagnosis, prevention and treatment of diseases and clinical conditions associated with KCND1.

Kdel (lys-asp-glu-leu) endoplasmic reticulum protein retention receptor 1 (KDELR1, Accession NP_006792.1) is another GAM3770 target gene, herein designated TARGET GENE. KDELR1 BINDING SITE is a target binding site found in the 3' untranslated region of mRNA encoded by KDELR1, corresponding to a target binding site such as BINDING SITE I, BINDING SITE II or BINDING SITE III of FIG. 8. Table 4 illustrates the complementarity of the nucleotide sequences of KDELR1 BINDING SITE, designated SEQ ID:1055, to the nucleotide sequence of GAM3770 RNA, herein designated GAM RNA, also designated SEQ ID:281.

Another function of GAM3770 is therefore inhibition of Kdel (lys-asp-glu-leu) endoplasmic reticulum protein retention receptor 1 (KDELR1, Accession NP_006792.1). Accordingly, utilities of GAM3770 include diagnosis, prevention and treatment of diseases and clinical conditions associated with KDELR1.

KIAA0194 (Accession XP_038362.3) is another GAM3770 target gene, herein designated TARGET GENE. KIAA0194 BINDING SITE is a target binding site found in the 3' untranslated region of mRNA encoded by KIAA0194, corresponding to a target binding site such as BINDING SITE I, BINDING SITE II or BINDING SITE III of FIG. 8. Table 4 illustrates the complementarity of the nucleotide sequences of KIAA0194 BINDING SITE, designated SEQ ID:19314, to the nucleotide sequence of GAM3770 RNA, herein designated GAM RNA, also designated SEQ ID:281.

Another function of GAM3770 is therefore inhibition of KIAA0194 (Accession XP_038362.3). Accordingly, utilities of GAM3770 include diagnosis, prevention and treatment of diseases and clinical conditions associated with KIAA0194.

KIAA0252 (Accession NP_055953.1) is another GAM3770 target gene, herein designated TARGET GENE. KIAA0252 BINDING SITE is a target binding site found in the 3' untranslated region of mRNA encoded by KIAA0252, corresponding to a target binding site such as BINDING SITE I, BINDING SITE II or BINDING SITE III of FIG. 8. Table 4 illustrates the complementarity of the nucleotide sequences of KIAA0252 BINDING SITE, designated SEQ ID:19417, to the nucleotide sequence of GAM3770 RNA, herein designated GAM RNA, also designated SEQ ID:281.

Another function of GAM3770 is therefore inhibition of KIAA0252 (Accession NP_055953.1). Accordingly, utilities of GAM3770 include diagnosis, prevention and treatment of diseases and clinical conditions associated with KIAA0252.

KIAA0570 (Accession XP_291018.1) is another GAM3770 target gene, herein designated TARGET GENE. KIAA0570 BINDING SITE is a target binding site found in the 3' untranslated region of mRNA encoded by KIAA0570, corresponding to a target binding site such as BINDING SITE I, BINDING SITE II or BINDING SITE III of FIG. 8. Table 4 illustrates the complementarity of the nucleotide sequences of KIAA0570 BINDING SITE, designated SEQ ID:3719, to the nucleotide sequence of GAM3770 RNA, herein designated GAM RNA, also designated SEQ ID:241.

Another function of GAM3770 is therefore inhibition of KIAA0570 (Accession XP_291018.1). Accordingly, utilities of GAM3770 include diagnosis, prevention and treatment of diseases and clinical conditions associated with KIAA0570.

KIAA0657 (Accession XP_051017.2) is another GAM3770 target gene, herein designated TARGET GENE. KIAA0657 BINDING SITE is a target binding site found in the 3' untranslated region of mRNA encoded by KIAA0657, corresponding to a target binding site such as BINDING SITE I, BINDING SITE II or BINDING SITE III of FIG. 8. Table 4 illustrates the complementarity of the nucleotide sequences of KIAA0657 BINDING SITE, designated SEQ ID:10072, to the nucleotide sequence of GAM3770 RNA, herein designated GAM RNA, also designated SEQ ID:281.

Another function of GAM3770 is therefore inhibition of KIAA0657 (Accession XP_051017.2). Accordingly, utilities of GAM3770 include diagnosis, prevention and treatment of diseases and clinical conditions associated with KIAA0657.

KIAA1032 (Accession XP_038604.4) is another GAM3770 target gene, herein designated TARGET GENE. KIAA1032 BINDING SITE is a target binding site found in the 3' untranslated region of mRNA encoded by KIAA1032, corresponding to a target binding site such as BINDING SITE I, BINDING SITE II or BINDING SITE III of FIG. 8. Table 4 illustrates the complementarity of the nucleotide sequences of KIAA1032 BINDING SITE, designated SEQ ID:12901, to the nucleotide sequence of GAM3770 RNA, herein designated GAM RNA, also designated SEQ ID:241.

Another function of GAM3770 is therefore inhibition of KIAA1032 (Accession XP_038604.4). Accordingly, utilities of GAM3770 include diagnosis, prevention and treatment of diseases and clinical conditions associated with KIAA1032.

KIAA1209 (Accession XP_027307.2) is another GAM3770 target gene, herein designated TARGET GENE. KIAA1209 BINDING SITE is a target binding site found in the 3' untranslated region of mRNA encoded by KIAA1209, corresponding to a target binding site such as BINDING SITE I, BINDING SITE II or BINDING SITE III of FIG. 8. Table 4 illustrates the complementarity of the nucleotide sequences of KIAA1209 BINDING SITE, designated SEQ ID:11915, to the nucleotide sequence of GAM3770 RNA, herein designated GAM RNA, also designated SEQ ID:281.

Another function of GAM3770 is therefore inhibition of KIAA1209 (Accession XP_027307.2). Accordingly, utilities of GAM3770 include diagnosis, prevention and treatment of diseases and clinical conditions associated with KIAA1209.

KIAA1522 (Accession XP_036299.6) is another GAM3770 target gene, herein designated TARGET GENE.

KIAA1522 BINDING SITE is a target binding site found in the 3' untranslated region of mRNA encoded by KIAA1522, corresponding to a target binding site such as BINDING SITE I, BINDING SITE II or BINDING SITE III of FIG. 8. Table 4 illustrates the complementarity of the nucleotide sequences of KIAA1522 BINDING SITE, designated SEQ ID:17568, to the nucleotide sequence of GAM3770 RNA, herein designated GAM RNA, also designated SEQ ID:281.

Another function of GAM3770 is therefore inhibition of KIAA1522 (Accession XP_036299.6). Accordingly, utilities of GAM3770 include diagnosis, prevention and treatment of diseases and clinical conditions associated with KIAA1522.

KIAA1813 (Accession XP_046743.2) is another GAM3770 target gene, herein designated TARGET GENE. KIAA1813 BINDING SITE is a target binding site found in the 5' untranslated region of mRNA encoded by KIAA1813, corresponding to a target binding site such as BINDING SITE I, BINDING SITE II or BINDING SITE III of FIG. 8. Table 4 illustrates the complementarity of the nucleotide sequences of KIAA1813 BINDING SITE, designated SEQ ID:6050, to the nucleotide sequence of GAM3770 RNA, herein designated GAM RNA, also designated SEQ ID:281.

Another function of GAM3770 is therefore inhibition of KIAA1813 (Accession XP_046743.2). Accordingly, utilities of GAM3770 include diagnosis, prevention and treatment of diseases and clinical conditions associated with KIAA1813.

KIAA1939 (Accession NP_079113.1) is another GAM3770 target gene, herein designated TARGET GENE. KIAA1939 BINDING SITE is a target binding site found in the 5' untranslated region of mRNA encoded by KIAA1939, corresponding to a target binding site such as BINDING SITE I, BINDING SITE II or BINDING SITE III of FIG. 8. Table 4 illustrates the complementarity of the nucleotide sequences of KIAA1939 BINDING SITE, designated SEQ ID:4111, to the nucleotide sequence of GAM3770 RNA, herein designated GAM RNA, also designated SEQ ID:241.

Another function of GAM3770 is therefore inhibition of KIAA1939 (Accession NP_079113.1). Accordingly, utilities of GAM3770 include diagnosis, prevention and treatment of diseases and clinical conditions associated with KIAA1939.

Kinesin family member 5a (KIF5A, Accession NP_004975.1) is another GAM3770 target gene, herein designated TARGET GENE. KIF5A BINDING SITE is a target binding site found in the 5' untranslated region of mRNA encoded by KIF5A, corresponding to a target binding site such as BINDING SITE I, BINDING SITE II or BINDING SITE III of FIG. 8. Table 4 illustrates the complementarity of the nucleotide sequences of KIF5A BINDING SITE, designated SEQ ID:14793, to the nucleotide sequence of GAM3770 RNA, herein designated GAM RNA, also designated SEQ ID:241.

Another function of GAM3770 is therefore inhibition of Kinesin family member 5a (KIF5A, Accession NP_004975.1), a gene which is a microtubule-associated force-producing protein that may play a role in organelle transport. Accordingly, utilities of GAM3770 include diagnosis, prevention and treatment of diseases and clinical conditions associated with KIF5A.

The function of KIF5A and its association with various diseases and clinical conditions, has been established by previous studies, as described hereinabove with reference to GAM47.1. Kallikrein 12 (KLK12, Accession NP_665901.1) is another GAM3770 target gene, herein designated TARGET GENE. KLK12 BINDING SITE is a target binding site found in the 3' untranslated region of multiple transcripts of mRNA encoded by KLK12, corresponding to a target binding site such as BINDING SITE I, BINDING SITE II or BINDING SITE III of FIG. 8. Table 4 illustrates the complementarity of the nucleotide sequences of KLK12 BINDING SITE, designated SEQ ID:12199, to the nucleotide sequence of GAM3770 RNA, herein designated GAM RNA, also designated SEQ ID:281.

Another function of GAM3770 is therefore inhibition of Kallikrein 12 (KLK12, Accession NP_665901.1). Accordingly, utilities of GAM3770 include diagnosis, prevention and treatment of diseases and clinical conditions associated with KLK12.

Kallikrein 12 (KLK12, Accession NP_665902.1) is another GAM3770 target gene, herein designated TARGET GENE. KLK12 BINDING SITE is a target binding site found in the 3' untranslated region of multiple transcripts of mRNA encoded by KLK12, corresponding to a target binding site such as BINDING SITE I, BINDING SITE II or BINDING SITE III of FIG. 8. Table 4 illustrates the complementarity of the nucleotide sequences of KLK12 BINDING SITE, designated SEQ ID:12199, to the nucleotide sequence of GAM3770 RNA, herein designated GAM RNA, also designated SEQ ID:281.

Another function of GAM3770 is therefore inhibition of Kallikrein 12 (KLK12, Accession NP_665902.1). Accordingly, utilities of GAM3770 include diagnosis, prevention and treatment of diseases and clinical conditions associated with KLK12.

KRTHBP2 (Accession XP_303553.1) is another GAM3770 target gene, herein designated TARGET GENE. KRTHBP2 BINDING SITE is a target binding site found in the 3' untranslated region of mRNA encoded by KRTHBP2, corresponding to a target binding site such as BINDING SITE I, BINDING SITE II or BINDING SITE III of FIG. 8. Table 4 illustrates the complementarity of the nucleotide sequences of KRTHBP2 BINDING SITE, designated SEQ ID:12132, to the nucleotide sequence of GAM3770 RNA, herein designated GAM RNA, also designated SEQ ID:281.

Another function of GAM3770 is therefore inhibition of KRTHBP2 (Accession XP_303553.1). Accordingly, utilities of GAM3770 include diagnosis, prevention and treatment of diseases and clinical conditions associated with KRTHBP2.

LCHN (Accession XP_098615.2) is another GAM3770 target gene, herein designated TARGET GENE. LCHN BINDING SITE is a target binding site found in the 3' untranslated region of mRNA encoded by LCHN, corresponding to a target binding site such as BINDING SITE I, BINDING SITE II or BINDING SITE III of FIG. 8. Table 4 illustrates the complementarity of the nucleotide sequences of LCHN BINDING SITE, designated SEQ ID:19437, to the nucleotide sequence of GAM3770 RNA, herein designated GAM RNA, also designated SEQ ID:281.

Another function of GAM3770 is therefore inhibition of LCHN (Accession XP_098615.2). Accordingly, utilities of GAM3770 include diagnosis, prevention and treatment of diseases and clinical conditions associated with LCHN.

LOC115219 (Accession XP_055499.2) is another GAM3770 target gene, herein designated TARGET GENE. LOC115219 BINDING SITE is a target binding site found in the 3' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:13877, to the nucleotide sequence of GAM3770 RNA, herein designated GAM RNA, also designated SEQ ID:241.

Another function of GAM3770 is therefore inhibition of LOC115219 (Accession XP_055499.2). Accordingly, utilities of GAM3770 include diagnosis, prevention and treatment of diseases and clinical conditions associated with LOC115219.

LOC122704 (Accession XP_058647.1) is another GAM3770 target gene, herein designated TARGET GENE. LOC122704 BINDING SITE is a target binding site found in the 3' untranslated region of mRNA encoded by LOC122704, corresponding to a target binding site such as BINDING SITE I, BINDING SITE II or BINDING SITE III of FIG. 8. Table 4 illustrates the complementarity of the nucleotide sequences of LOC122704 BINDING SITE, designated SEQ ID:12936, to the nucleotide sequence of GAM3770 RNA, herein designated GAM RNA, also designated SEQ ID:281.

Another function of GAM3770 is therefore inhibition of LOC122704 (Accession XP_058647.1). Accordingly, utilities of GAM3770 include diagnosis, prevention and treatment of diseases and clinical conditions associated with LOC122704.

LOC124842 (Accession XP_064333.3) is another GAM3770 target gene, herein designated TARGET GENE. LOC124842 BINDING SITE is a target binding site found in the 3' untranslated region of mRNA encoded by LOC124842, corresponding to a target binding site such as BINDING SITE I, BINDING SITE II or BINDING SITE III of FIG. 8. Table 4 illustrates the complementarity of the nucleotide sequences of LOC124842 BINDING SITE, designated SEQ ID:15407, to the nucleotide sequence of GAM3770 RNA, herein designated GAM RNA, also designated SEQ ID:281.

Another function of GAM3770 is therefore inhibition of LOC124842 (Accession XP_064333.3). Accordingly, utilities of GAM3770 include diagnosis, prevention and treatment of diseases and clinical conditions associated with LOC124842.

LOC137886 (Accession XP_059929.3) is another GAM3770 target gene, herein designated TARGET GENE. LOC137886 BINDING SITE is a target binding site found in the 3' untranslated region of mRNA encoded by LOC137886, corresponding to a target binding site such as BINDING SITE I, BINDING SITE II or BINDING SITE III of FIG. 8. Table 4 illustrates the complementarity of the nucleotide sequences of LOC137886 BINDING SITE, designated SEQ ID:4502, to the nucleotide sequence of GAM3770 RNA, herein designated GAM RNA, also designated SEQ ID:281.

Another function of GAM3770 is therefore inhibition of LOC137886 (Accession XP_059929.3). Accordingly, utilities of GAM3770 include diagnosis, prevention and treatment of diseases and clinical conditions associated with LOC137886.

LOC143310 (Accession XP_084485.1) is another GAM3770 target gene, herein designated TARGET GENE. LOC143310 BINDING SITE is a target binding site found in the 3' untranslated region of mRNA encoded by LOC143310, corresponding to a target binding site such as BINDING SITE I, BINDING SITE II or BINDING SITE III of FIG. 8. Table 4 illustrates the complementarity of the nucleotide sequences of LOC143310 BINDING SITE, designated SEQ ID:17009, to the nucleotide sequence of GAM3770 RNA, herein designated GAM RNA, also designated SEQ ID:281.

Another function of GAM3770 is therefore inhibition of LOC143310 (Accession XP_084485.1). Accordingly, utilities of GAM3770 include diagnosis, prevention and treatment of diseases and clinical conditions associated with LOC143310.

LOC143680 (Accession XP_096474.1) is another GAM3770 target gene, herein designated TARGET GENE. LOC143680 BINDING SITE is a target binding site found in the 3' untranslated region of mRNA encoded by LOC143680, corresponding to a target binding site such as BINDING SITE I, BINDING SITE II or BINDING SITE III of FIG. 8. Table 4 illustrates the complementarity of the nucleotide sequences of LOC143680 BINDING SITE, designated SEQ ID:11678, to the nucleotide sequence of GAM3770 RNA, herein designated GAM RNA, also designated SEQ ID:281.

Another function of GAM3770 is therefore inhibition of LOC143680 (Accession XP_096474.1). Accordingly, utilities of GAM3770 include diagnosis, prevention and treatment of diseases and clinical conditions associated with LOC143680.

LOC144248 (Accession XP_084786.1) is another GAM3770 target gene, herein designated TARGET GENE. LOC144248 BINDING SITE is a target binding site found in the 3' untranslated region of mRNA encoded by LOC144248, corresponding to a target binding site such as BINDING SITE I, BINDING SITE II or BINDING SITE III of FIG. 8. Table 4 illustrates the complementarity of the nucleotide sequences of LOC144248 BINDING SITE, designated SEQ ID:16663, to the nucleotide sequence of GAM3770 RNA, herein designated GAM RNA, also designated SEQ ID:281.

Another function of GAM3770 is therefore inhibition of LOC144248 (Accession XP_084786.1). Accordingly, utilities of GAM3770 include diagnosis, prevention and treatment of diseases and clinical conditions associated with LOC144248.

LOC144438 (Accession XP_084860.1) is another GAM3770 target gene, herein designated TARGET GENE. LOC144438 BINDING SITE is a target binding site found in the 3' untranslated region of mRNA encoded by LOC144438, corresponding to a target binding site such as BINDING SITE I, BINDING SITE II or BINDING SITE III of FIG. 8. Table 4 illustrates the complementarity of the nucleotide sequences of LOC144438 BINDING SITE, designated SEQ ID:6020, to the nucleotide sequence of GAM3770 RNA, herein designated GAM RNA, also designated SEQ ID:281.

Another function of GAM3770 is therefore inhibition of LOC144438 (Accession XP_084860.1). Accordingly, utilities of GAM3770 include diagnosis, prevention and treatment of diseases and clinical conditions associated with LOC144438.

LOC146229 (Accession XP_085387.1) is another GAM3770 target gene, herein designated TARGET GENE. LOC146229 BINDING SITE is a target binding site found in the 3' untranslated region of mRNA encoded by LOC146229, corresponding to a target binding site such as BINDING SITE I, BINDING SITE II or BINDING SITE III of FIG. 8. Table 4 illustrates the complementarity of the nucleotide sequences of LOC146229 BINDING SITE, designated SEQ ID:5022, to the nucleotide sequence of GAM3770 RNA, herein designated GAM RNA, also designated SEQ ID:281.

Another function of GAM3770 is therefore inhibition of LOC146229 (Accession XP_085387.1). Accordingly, utilities of GAM3770 include diagnosis, prevention and treatment of diseases and clinical conditions associated with LOC146229.

LOC146325 (Accession NP_660313.1) is another GAM3770 target gene, herein designated TARGET GENE. LOC146325 BINDING SITE is a target binding site found in the 3' untranslated region of mRNA encoded by LOC146325, corresponding to a target binding site such as BINDING SITE I, BINDING SITE II or BINDING SITE III of FIG. 8. Table 4 illustrates the complementarity of the nucleotide sequences of LOC146325 BINDING SITE, designated SEQ ID:16441, to the nucleotide sequence of GAM3770 RNA, herein designated GAM RNA, also designated SEQ ID:241.

Another function of GAM3770 is therefore inhibition of LOC146325 (Accession NP_660313.1). Accordingly, utilities of GAM3770 include diagnosis, prevention and treatment of diseases and clinical conditions associated with LOC146325.

LOC146350 (Accession XP_096985.1) is another GAM3770 target gene, herein designated TARGET GENE. LOC146350 BINDING SITE is a target binding site found in the 3' untranslated region of mRNA encoded by LOC146350, corresponding to a target binding site such as BINDING SITE I, BINDING SITE II or BINDING SITE III of FIG. 8. Table 4 illustrates the complementarity of the nucleotide sequences of LOC146350 BINDING SITE, designated SEQ ID:17607, to the nucleotide sequence of GAM3770 RNA, herein designated GAM RNA, also designated SEQ ID:281.

Another function of GAM3770 is therefore inhibition of LOC146350 (Accession XP_096985.1). Accordingly, utilities of GAM3770 include diagnosis, prevention and treatment of diseases and clinical conditions associated with LOC146350.

LOC148918 (Accession XP_086361.1) is another GAM3770 target gene, herein designated TARGET GENE. LOC148918 BINDING SITE is a target binding site found in the 5' untranslated region of mRNA encoded by LOC148918, corresponding to a target binding site such as BINDING SITE I, BINDING SITE II or BINDING SITE III of FIG. 8. Table 4 illustrates the complementarity of the nucleotide sequences of LOC148918 BINDING SITE, designated SEQ ID:17967, to the nucleotide sequence of GAM3770 RNA, herein designated GAM RNA, also designated SEQ ID:281.

Another function of GAM3770 is therefore inhibition of LOC148918 (Accession XP_086361.1). Accordingly, utilities of GAM3770 include diagnosis, prevention and treatment of diseases and clinical conditions associated with LOC148918.

LOC150157 (Accession XP_097823.1) is another GAM3770 target gene, herein designated TARGET GENE. LOC150157 BINDING SITE is a target binding site found in the 5' untranslated region of mRNA encoded by LOC150157, corresponding to a target binding site such as BINDING SITE I, BINDING SITE II or BINDING SITE III of FIG. 8. Table 4 illustrates the complementarity of the nucleotide sequences of LOC150157 BINDING SITE, designated SEQ ID:6127, to the nucleotide sequence of GAM3770 RNA, herein designated GAM RNA, also designated SEQ ID:281.

Another function of GAM3770 is therefore inhibition of LOC150157 (Accession XP_097823.1). Accordingly, utilities of GAM3770 include diagnosis, prevention and treatment of diseases and clinical conditions associated with LOC150157.

LOC150935 (Accession XP_087049.1) is another GAM3770 target gene, herein designated TARGET GENE. LOC150935 BINDING SITE is a target binding site found in the 3' untranslated region of mRNA encoded by LOC150935, corresponding to a target binding site such as BINDING SITE I, BINDING SITE II or BINDING SITE III of FIG. 8. Table 4 illustrates the complementarity of the nucleotide sequences of LOC150935 BINDING SITE, designated SEQ ID:9952, to the nucleotide sequence of GAM3770 RNA, herein designated GAM RNA, also designated SEQ ID:241.

Another function of GAM3770 is therefore inhibition of LOC150935 (Accession XP_087049.1). Accordingly, utilities of GAM3770 include diagnosis, prevention and treatment of diseases and clinical conditions associated with LOC150935.

LOC151154 (Accession XP_098008.1) is another GAM3770 target gene, herein designated TARGET GENE. LOC151154 BINDING SITE is a target binding site found in the 5' untranslated region of mRNA encoded by LOC151154, corresponding to a target binding site such as BINDING SITE I, BINDING SITE II or BINDING SITE III of FIG. 8. Table 4 illustrates the complementarity of the nucleotide sequences of LOC151154 BINDING SITE, designated SEQ ID:14042, to the nucleotide sequence of GAM3770 RNA, herein designated GAM RNA, also designated SEQ ID:281.

Another function of GAM3770 is therefore inhibition of LOC151154 (Accession XP_098008.1). Accordingly, utilities of GAM3770 include diagnosis, prevention and treatment of diseases and clinical conditions associated with LOC151154.

LOC151647 (Accession XP_087261.1) is another GAM3770 target gene, herein designated TARGET GENE. LOC151647 BINDING SITE is a target binding site found in the 3' untranslated region of mRNA encoded by LOC151647, corresponding to a target binding site such as BINDING SITE I, BINDING SITE II or BINDING SITE III of FIG. 8. Table 4 illustrates the complementarity of the nucleotide sequences of LOC151647 BINDING SITE, designated SEQ ID:13550, to the nucleotide sequence of GAM3770 RNA, herein designated GAM RNA, also designated SEQ ID:281.

Another function of GAM3770 is therefore inhibition of LOC151647 (Accession XP_087261.1). Accordingly, utilities of GAM3770 include diagnosis, prevention and treatment of diseases and clinical conditions associated with LOC151647.

LOC152719 (Accession XP_098257.1) is another GAM3770 target gene, herein designated TARGET GENE. LOC152719 BINDING SITE is a target binding site found in the 5' untranslated region of mRNA encoded by LOC152719, corresponding to a target binding site such as BINDING SITE I, BINDING SITE II or BINDING SITE III of FIG. 8. Table 4 illustrates the complementarity of the nucleotide sequences of LOC152719 BINDING SITE, designated SEQ ID:6325, to the nucleotide sequence of GAM3770 RNA, herein designated GAM RNA, also designated SEQ ID:281.

Another function of GAM3770 is therefore inhibition of LOC152719 (Accession XP_098257.1). Accordingly, utilities of GAM3770 include diagnosis, prevention and treatment of diseases and clinical conditions associated with LOC152719.

LOC152790 (Accession XP_098264.1) is another GAM3770 target gene, herein designated TARGET GENE. LOC152790 BINDING SITE is a target binding site found in the 5' untranslated region of mRNA encoded by LOC152790, corresponding to a target binding site such as BINDING SITE I, BINDING SITE II or BINDING SITE III of FIG. 8. Table 4 illustrates the complementarity of the nucleotide sequences of LOC152790 BINDING SITE, designated SEQ ID:9283, to the nucleotide sequence of GAM3770 RNA, herein designated GAM RNA, also designated SEQ ID:281.

Another function of GAM3770 is therefore inhibition of LOC152790 (Accession XP_098264.1). Accordingly, utilities of GAM3770 include diagnosis, prevention and treatment of diseases and clinical conditions associated with LOC152790.

LOC154822 (Accession XP_098618.3) is another GAM3770 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:5835, to the nucleotide sequence of GAM3770 RNA, herein designated GAM RNA, also designated SEQ ID:281.

Another function of GAM3770 is therefore inhibition of LOC154822 (Accession XP_098618.3). Accordingly, utilities of GAM3770 include diagnosis, prevention and treatment of diseases and clinical conditions associated with LOC154822.

LOC154860 (Accession XP_098623.1) is another GAM3770 target gene, herein designated TARGET GENE. LOC154860 BINDING SITE is a target binding site found in the 5' untranslated region of mRNA encoded by LOC154860, corresponding to a target binding site such as BINDING SITE I, BINDING SITE II or BINDING SITE III of FIG. 8. Table 4 illustrates the complementarity of the nucleotide sequences of LOC154860 BINDING SITE, designated SEQ ID:13099, to the nucleotide sequence of GAM3770 RNA, herein designated GAM RNA, also designated SEQ ID:281.

Another function of GAM3770 is therefore inhibition of LOC154860 (Accession XP_098623.1). Accordingly, utilities of GAM3770 include diagnosis, prevention and treatment of diseases and clinical conditions associated with LOC154860.

LOC155036 (Accession XP_098651.1) is another GAM3770 target gene, herein designated TARGET GENE. LOC155036 BINDING SITE is a target binding site found in the 5' untranslated region of mRNA encoded by LOC155036, corresponding to a target binding site such as BINDING SITE I, BINDING SITE II or BINDING SITE III of FIG. 8. Table 4 illustrates the complementarity of the nucleotide sequences of LOC155036 BINDING SITE, designated SEQ ID:2202, to the nucleotide sequence of GAM3770 RNA, herein designated GAM RNA, also designated SEQ ID:281.

Another function of GAM3770 is therefore inhibition of LOC155036 (Accession XP_098651.1). Accordingly, utilities of GAM3770 include diagnosis, prevention and treatment of diseases and clinical conditions associated with LOC155036.

LOC158062 (Accession XP_098861.2) is another GAM3770 target gene, herein designated TARGET GENE. LOC158062 BINDING SITE is a target binding site found in the 3' untranslated region of mRNA encoded by LOC158062, corresponding to a target binding site such as BINDING SITE I, BINDING SITE II or BINDING SITE III of FIG. 8. Table 4 illustrates the complementarity of the nucleotide sequences of LOC158062 BINDING SITE, designated SEQ ID:19866, to the nucleotide sequence of GAM3770 RNA, herein designated GAM RNA, also designated SEQ ID:241.

Another function of GAM3770 is therefore inhibition of LOC158062 (Accession XP_098861.2). Accordingly, utilities of GAM3770 include diagnosis, prevention and treatment of diseases and clinical conditions associated with LOC158062.

LOC170371 (Accession XP_096316.5) is another GAM3770 target gene, herein designated TARGET GENE. LOC170371 BINDING SITE is a target binding site found in the 3' untranslated region of mRNA encoded by LOC170371, corresponding to a target binding site such as BINDING SITE I, BINDING SITE II or BINDING SITE III of FIG. 8. Table 4 illustrates the complementarity of the nucleotide sequences of LOC170371 BINDING SITE, designated SEQ ID:17257, to the nucleotide sequence of GAM3770 RNA, herein designated GAM RNA, also designated SEQ ID:281.

Another function of GAM3770 is therefore inhibition of LOC170371 (Accession XP_096316.5). Accordingly, utilities of GAM3770 include diagnosis, prevention and treatment of diseases and clinical conditions associated with LOC170371.

LOC196484 (Accession XP_031807.3) is another GAM3770 target gene, herein designated TARGET GENE. LOC196484 BINDING SITE is a target binding site found in the 3' untranslated region of mRNA encoded by LOC196484, corresponding to a target binding site such as BINDING SITE I, BINDING SITE II or BINDING SITE III of FIG. 8. Table 4 illustrates the complementarity of the nucleotide sequences of LOC196484 BINDING SITE, designated SEQ ID:19892, to the nucleotide sequence of GAM3770 RNA, herein designated GAM RNA, also designated SEQ ID:281.

Another function of GAM3770 is therefore inhibition of LOC196484 (Accession XP_031807.3). Accordingly, utilities of GAM3770 include diagnosis, prevention and treatment of diseases and clinical conditions associated with LOC196484.

LOC197322 (Accession NP_777577.1) is another GAM3770 target gene, herein designated TARGET GENE. LOC197322 BINDING SITE is a target binding site found in the 3' untranslated region of mRNA encoded by LOC197322, corresponding to a target binding site such as BINDING SITE I, BINDING SITE II or BINDING SITE III of FIG. 8. Table 4 illustrates the complementarity of the nucleotide sequences of LOC197322 BINDING SITE, designated SEQ ID:1678, to the nucleotide sequence of GAM3770 RNA, herein designated GAM RNA, also designated SEQ ID:241.

Another function of GAM3770 is therefore inhibition of LOC197322 (Accession NP_777577.1). Accordingly, utilities of GAM3770 include diagnosis, prevention and treatment of diseases and clinical conditions associated with LOC197322.

LOC202404 (Accession XP_114481.4) is another GAM3770 target gene, herein designated TARGET GENE. LOC202404 BINDING SITE is a target binding site found in the 5' untranslated region of mRNA encoded by LOC202404, corresponding to a target binding site such as BINDING SITE I, BINDING SITE II or BINDING SITE III of FIG. 8. Table 4 illustrates the complementarity of the nucleotide sequences of LOC202404 BINDING SITE, designated SEQ ID:3891, to the nucleotide sequence of GAM3770 RNA, herein designated GAM RNA, also designated SEQ ID:241.

Another function of GAM3770 is therefore inhibition of LOC202404 (Accession XP_114481.4). Accordingly, utilities of GAM3770 include diagnosis, prevention and treatment of diseases and clinical conditions associated with LOC202404.

LOC221218 (Accession XP_166281.3) is another GAM3770 target gene, herein designated TARGET GENE. LOC221218 BINDING SITE is a target binding site found in the 3' untranslated region of mRNA encoded by LOC221218, corresponding to a target binding site such as BINDING SITE I, BINDING SITE II or BINDING SITE III of FIG. 8. Table 4 illustrates the complementarity of the nucleotide sequences of LOC221218 BINDING SITE, designated SEQ ID:18010, to the nucleotide sequence of GAM3770 RNA, herein designated GAM RNA, also designated SEQ ID:281.

Another function of GAM3770 is therefore inhibition of LOC221218 (Accession XP_166281.3). Accordingly, utilities of GAM3770 include diagnosis, prevention and treatment of diseases and clinical conditions associated with LOC221218.

LOC221442 (Accession XP_166432.1) is another GAM3770 target gene, herein designated TARGET GENE. LOC221442 BINDING SITE is a target binding site found in the 3' untranslated region of mRNA encoded by LOC221442, corresponding to a target binding site such as BINDING SITE I, BINDING SITE II or BINDING SITE III of FIG. 8. Table 4 illustrates the complementarity of the nucleotide sequences of LOC221442 BINDING SITE, designated SEQ ID:11963, to the nucleotide sequence of GAM3770 RNA, herein designated GAM RNA, also designated SEQ ID:241.

Another function of GAM3770 is therefore inhibition of LOC221442 (Accession XP_166432.1). Accordingly, utilities of GAM3770 include diagnosis, prevention and treatment of diseases and clinical conditions associated with LOC221442.

LOC253559 (Accession NP_694854.1) is another GAM3770 target gene, herein designated TARGET GENE. LOC253559 BINDING SITE is a target binding site found in the 5' untranslated region of mRNA encoded by LOC253559, corresponding to a target binding site such as BINDING SITE I, BINDING SITE II or BINDING SITE III of FIG. 8. Table 4 illustrates the complementarity of the nucleotide sequences of LOC253559 BINDING SITE, designated SEQ ID:6427, to the nucleotide sequence of GAM3770 RNA, herein designated GAM RNA, also designated SEQ ID:241.

Another function of GAM3770 is therefore inhibition of LOC253559 (Accession NP_694854.1). Accordingly, utilities of GAM3770 include diagnosis, prevention and treatment of diseases and clinical conditions associated with LOC253559.

LOC254099 (Accession XP_173023.1) is another GAM3770 target gene, herein designated TARGET GENE. LOC254099 BINDING SITE is a target binding site found in the 3' untranslated region of mRNA encoded by LOC254099, corresponding to a target binding site such as BINDING SITE I, BINDING SITE II or BINDING SITE III of FIG. 8. Table 4 illustrates the complementarity of the nucleotide sequences of LOC254099 BINDING SITE, designated SEQ ID:3792, to the nucleotide sequence of GAM3770 RNA, herein designated GAM RNA, also designated SEQ ID:281.

Another function of GAM3770 is therefore inhibition of LOC254099 (Accession XP_173023.1). Accordingly, utilities of GAM3770 include diagnosis, prevention and treatment of diseases and clinical conditions associated with LOC254099.

LOC255783 (Accession XP_170871.1) is another GAM3770 target gene, herein designated TARGET GENE. LOC255783 BINDING SITE is a target binding site found in the 3' untranslated region of multiple transcripts of mRNA encoded by LOC255783, corresponding to a target binding site such as BINDING SITE I, BINDING SITE II or BINDING SITE III of FIG. 8. Table 4 illustrates the complementarity of the nucleotide sequences of LOC255783 BINDING SITE, designated SEQ ID:746, to the nucleotide sequence of GAM3770 RNA, herein designated GAM RNA, also designated SEQ ID:241.

Another function of GAM3770 is therefore inhibition of LOC255783 (Accession XP_170871.1). Accordingly, utilities of GAM3770 include diagnosis, prevention and treatment of diseases and clinical conditions associated with LOC255783.

LOC255783 (Accession NP_848606.1) is another GAM3770 target gene, herein designated TARGET GENE. LOC255783 BINDING SITE is a target binding site found in the 3' untranslated region of multiple transcripts of mRNA encoded by LOC255783, corresponding to a target binding site such as BINDING SITE I, BINDING SITE II or BINDING SITE III of FIG. 8. Table 4 illustrates the complementarity of the nucleotide sequences of LOC255783 BINDING SITE, designated SEQ ID:746, to the nucleotide sequence of GAM3770 RNA, herein designated GAM RNA, also designated SEQ ID:241.

Another function of GAM3770 is therefore inhibition of LOC255783 (Accession NP_848606.1). Accordingly, utilities of GAM3770 include diagnosis, prevention and treatment of diseases and clinical conditions associated with LOC255783.

LOC282965 (Accession XP_210833.1) is another GAM3770 target gene, herein designated TARGET GENE. LOC282965 BINDING SITE is a target binding site found in the 3' untranslated region of mRNA encoded by LOC282965, corresponding to a target binding site such as BINDING SITE I, BINDING SITE II or BINDING SITE III of FIG. 8. Table 4 illustrates the complementarity of the nucleotide sequences of LOC282965 BINDING SITE, designated SEQ ID:20085, to the nucleotide sequence of GAM3770 RNA, herein designated GAM RNA, also designated SEQ ID:281.

Another function of GAM3770 is therefore inhibition of LOC282965 (Accession XP_210833.1). Accordingly, utilities of GAM3770 include diagnosis, prevention and treatment of diseases and clinical conditions associated with LOC282965.

LOC283005 (Accession XP_208481.1) is another GAM3770 target gene, herein designated TARGET GENE. LOC283005 BINDING SITE is a target binding site found in the 3' untranslated region of mRNA encoded by LOC283005, corresponding to a target binding site such as BINDING SITE I, BINDING SITE II or BINDING SITE III of FIG. 8. Table 4 illustrates the complementarity of the nucleotide sequences of LOC283005 BINDING SITE, designated SEQ ID:14676, to the nucleotide sequence of GAM3770 RNA, herein designated GAM RNA, also designated SEQ ID:241.

Another function of GAM3770 is therefore inhibition of LOC283005 (Accession XP_208481.1). Accordingly, utilities of GAM3770 include diagnosis, prevention and treatment of diseases and clinical conditions associated with LOC283005.

LOC283045 (Accession XP_210866.1) is another GAM3770 target gene, herein designated TARGET GENE. LOC283045 BINDING SITE is a target binding site found in the 3' untranslated region of mRNA encoded by LOC283045, corresponding to a target binding site such as BINDING SITE I, BINDING SITE II or BINDING SITE III of FIG. 8. Table 4 illustrates the complementarity of the nucleotide sequences of LOC283045 BINDING SITE, designated SEQ ID:19707, to the nucleotide sequence of GAM3770 RNA, herein designated GAM RNA, also designated SEQ ID:241.

Another function of GAM3770 is therefore inhibition of LOC283045 (Accession XP_210866.1). Accordingly, utilities of GAM3770 include diagnosis, prevention and treatment of diseases and clinical conditions associated with LOC283045.

LOC283048 (Accession XP_210867.1) is another GAM3770 target gene, herein designated TARGET GENE. LOC283048 BINDING SITE is a target binding site found in the 5' untranslated region of mRNA encoded by LOC283048, corresponding to a target binding site such as BINDING SITE I, BINDING SITE II or BINDING SITE III of FIG. 8. Table 4 illustrates the complementarity of the nucleotide sequences of LOC283048 BINDING SITE, designated SEQ ID:12366, to the nucleotide sequence of GAM3770 RNA, herein designated GAM RNA, also designated SEQ ID:241.

Another function of GAM3770 is therefore inhibition of LOC283048 (Accession XP_210867.1). Accordingly, utilities of GAM3770 include diagnosis, prevention and treatment of diseases and clinical conditions associated with LOC283048.

LOC283454 (Accession XP_211049.1) is another GAM3770 target gene, herein designated TARGET GENE. LOC283454 BINDING SITE is a target binding site found in the 5' untranslated region of mRNA encoded by LOC283454, corresponding to a target binding site such as BINDING SITE I, BINDING SITE II or BINDING SITE III of FIG. 8. Table 4 illustrates the complementarity of the nucleotide sequences of LOC283454 BINDING SITE, designated SEQ ID:15833, to the nucleotide sequence of GAM3770 RNA, herein designated GAM RNA, also designated SEQ ID:241.

Another function of GAM3770 is therefore inhibition of LOC283454 (Accession XP_211049.1). Accordingly, utilities of GAM3770 include diagnosis, prevention and treatment of diseases and clinical conditions associated with LOC283454.

LOC283491 (Accession XP_208695.1) is another GAM3770 target gene, herein designated TARGET GENE. LOC283491 BINDING SITE is a target binding site found in the 5' untranslated region of mRNA encoded by LOC283491, corresponding to a target binding site such as BINDING SITE I, BINDING SITE II or BINDING SITE III of FIG. 8. Table 4 illustrates the complementarity of the nucleotide sequences of LOC283491 BINDING SITE, designated SEQ ID:14118, to the nucleotide sequence of GAM3770 RNA, herein designated GAM RNA, also designated SEQ ID:241.

Another function of GAM3770 is therefore inhibition of LOC283491 (Accession XP_208695.1). Accordingly, utilities of GAM3770 include diagnosis, prevention and treatment of diseases and clinical conditions associated with LOC283491.

LOC283526 (Accession XP_211081.1) is another GAM3770 target gene, herein designated TARGET GENE. LOC283526 BINDING SITE is a target binding site found in the 3' untranslated region of mRNA encoded by LOC283526, corresponding to a target binding site such as BINDING SITE I, BINDING SITE II or BINDING SITE III of FIG. 8. Table 4 illustrates the complementarity of the nucleotide sequences of LOC283526 BINDING SITE, designated SEQ ID:4485, to the nucleotide sequence of GAM3770 RNA, herein designated GAM RNA, also designated SEQ ID:241.

Another function of GAM3770 is therefore inhibition of LOC283526 (Accession XP_211081.1). Accordingly, utilities of GAM3770 include diagnosis, prevention and treatment of diseases and clinical conditions associated with LOC283526.

LOC283851 (Accession XP_211229.1) is another GAM3770 target gene, herein designated TARGET GENE. LOC283851 BINDING SITE is a target binding site found in the 3' untranslated region of mRNA encoded by LOC283851, corresponding to a target binding site such as BINDING SITE I, BINDING SITE II or BINDING SITE III of FIG. 8. Table 4 illustrates the complementarity of the nucleotide sequences of LOC283851 BINDING SITE, designated SEQ ID:9696, to the nucleotide sequence of GAM3770 RNA, herein designated GAM RNA, also designated SEQ ID:281.

Another function of GAM3770 is therefore inhibition of LOC283851 (Accession XP_211229.1). Accordingly, utilities of GAM3770 include diagnosis, prevention and treatment of diseases and clinical conditions associated with LOC283851.

LOC283875 (Accession XP_211241.1) is another GAM3770 target gene, herein designated TARGET GENE. LOC283875 BINDING SITE is a target binding site found in the 5' untranslated region of mRNA encoded by LOC283875, corresponding to a target binding site such as BINDING SITE I, BINDING SITE II or BINDING SITE III of FIG. 8. Table 4 illustrates the complementarity of the nucleotide sequences of LOC283875 BINDING SITE, designated SEQ ID:12309, to the nucleotide sequence of GAM3770 RNA, herein designated GAM RNA, also designated SEQ ID:241.

Another function of GAM3770 is therefore inhibition of LOC283875 (Accession XP_211241.1). Accordingly, utilities of GAM3770 include diagnosis, prevention and treatment of diseases and clinical conditions associated with LOC283875.

LOC283921 (Accession XP_211263.1) is another GAM3770 target gene, herein designated TARGET GENE. LOC283921 BINDING SITE is a target binding site found in the 3' untranslated region of mRNA encoded by LOC283921, corresponding to a target binding site such as BINDING SITE I, BINDING SITE II or BINDING SITE III of FIG. 8. Table 4 illustrates the complementarity of the nucleotide sequences of LOC283921 BINDING SITE, designated SEQ ID:13328, to the nucleotide sequence of GAM3770 RNA, herein designated GAM RNA, also designated SEQ ID:281.

Another function of GAM3770 is therefore inhibition of LOC283921 (Accession XP_211263.1). Accordingly, utilities of GAM3770 include diagnosis, prevention and treatment of diseases and clinical conditions associated with LOC283921.

LOC284084 (Accession XP_211325.1) is another GAM3770 target gene, herein designated TARGET GENE. LOC284084 BINDING SITE is a target binding site found in the 3' untranslated region of mRNA encoded by LOC284084, corresponding to a target binding site such as BINDING SITE I, BINDING SITE II or BINDING SITE III of FIG. 8. Table 4 illustrates the complementarity of the nucleotide sequences of LOC284084 BINDING SITE, designated SEQ ID:14562, to the nucleotide sequence of GAM3770 RNA, herein designated GAM RNA, also designated SEQ ID:281.

Another function of GAM3770 is therefore inhibition of LOC284084 (Accession XP_211325.1). Accordingly, utilities of GAM3770 include diagnosis, prevention and treatment of diseases and clinical conditions associated with LOC284084.

LOC284118 (Accession XP_211336.1) is another GAM3770 target gene, herein designated TARGET GENE. LOC284118 BINDING SITE is a target binding site found in the 5' untranslated region of mRNA encoded by LOC284118, corresponding to a target binding site such as BINDING SITE I, BINDING SITE II or BINDING SITE III of FIG. 8. Table 4 illustrates the complementarity of the nucleotide sequences of LOC284118 BINDING SITE, designated SEQ ID:15952, to the nucleotide sequence of GAM3770 RNA, herein designated GAM RNA, also designated SEQ ID:241.

Another function of GAM3770 is therefore inhibition of LOC284118 (Accession XP_211336.1). Accordingly, utilities of GAM3770 include diagnosis, prevention and treatment of diseases and clinical conditions associated with LOC284118.

LOC284130 (Accession XP_209031.1) is another GAM3770 target gene, herein designated TARGET GENE. LOC284130 BINDING SITE is a target binding site found in the 3' untranslated region of mRNA encoded by LOC284130, corresponding to a target binding site such as BINDING SITE I, BINDING SITE II or BINDING SITE III of FIG. 8. Table 4 illustrates the complementarity of the nucleotide sequences of LOC284130 BINDING SITE, designated SEQ ID:18185, to the nucleotide sequence of GAM3770 RNA, herein designated GAM RNA, also designated SEQ ID:241.

Another function of GAM3770 is therefore inhibition of LOC284130 (Accession XP_209031.1). Accordingly, utilities of GAM3770 include diagnosis, prevention and treatment of diseases and clinical conditions associated with LOC284130.

LOC284336 (Accession XP_211438.1) is another GAM3770 target gene, herein designated TARGET GENE. LOC284336 BINDING SITE is a target binding site found in the 3' untranslated region of mRNA encoded by LOC284336, corresponding to a target binding site such as BINDING SITE I, BINDING SITE II or BINDING SITE III of FIG. 8. Table 4 illustrates the complementarity of the nucleotide sequences of LOC284336 BINDING SITE, designated SEQ ID:13309, to the nucleotide sequence of GAM3770 RNA, herein designated GAM RNA, also designated SEQ ID:281.

Another function of GAM3770 is therefore inhibition of LOC284336 (Accession XP_211438.1). Accordingly, utilities of GAM3770 include diagnosis, prevention and treatment of diseases and clinical conditions associated with LOC284336.

LOC284570 (Accession XP_211521.1) is another GAM3770 target gene, herein designated TARGET GENE. LOC284570 BINDING SITE is a target binding site found in the 5' untranslated region of mRNA encoded by LOC284570, corresponding to a target binding site such as BINDING SITE I, BINDING SITE II or BINDING SITE III of FIG. 8. Table 4 illustrates the complementarity of the nucleotide sequences of LOC284570 BINDING SITE, designated SEQ ID:4065, to the nucleotide sequence of GAM3770 RNA, herein designated GAM RNA, also designated SEQ ID:281.

Another function of GAM3770 is therefore inhibition of LOC284570 (Accession XP_211521.1). Accordingly, utilities of GAM3770 include diagnosis, prevention and treatment of diseases and clinical conditions associated with LOC284570.

LOC284708 (Accession XP_209332.1) is another GAM3770 target gene, herein designated TARGET GENE. LOC284708 BINDING SITE is a target binding site found in the 3' untranslated region of mRNA encoded by LOC284708, corresponding to a target binding site such as BINDING SITE I, BINDING SITE II or BINDING SITE III of FIG. 8. Table 4 illustrates the complementarity of the nucleotide sequences of LOC284708 BINDING SITE, designated SEQ ID:9883, to the nucleotide sequence of GAM3770 RNA, herein designated GAM RNA, also designated SEQ ID:281.

Another function of GAM3770 is therefore inhibition of LOC284708 (Accession XP_209332.1). Accordingly, utilities of GAM3770 include diagnosis, prevention and treatment of diseases and clinical conditions associated with LOC284708.

LOC284736 (Accession XP_209343.1) is another GAM3770 target gene, herein designated TARGET GENE. LOC284736 BINDING SITE is a target binding site found in the 5' untranslated region of mRNA encoded by LOC284736, corresponding to a target binding site such as BINDING SITE I, BINDING SITE II or BINDING SITE III of FIG. 8. Table 4 illustrates the complementarity of the nucleotide sequences of LOC284736 BINDING SITE, designated SEQ ID:1836, to the nucleotide sequence of GAM3770 RNA, herein designated GAM RNA, also designated SEQ ID:281.

Another function of GAM3770 is therefore inhibition of LOC284736 (Accession XP_209343.1). Accordingly, utilities of GAM3770 include diagnosis, prevention and treatment of diseases and clinical conditions associated with LOC284736.

LOC284751 (Accession XP_211622.1) is another GAM3770 target gene, herein designated TARGET GENE. LOC284751 BINDING SITE is a target binding site found in the 3' untranslated region of mRNA encoded by LOC284751, corresponding to a target binding site such as BINDING SITE I, BINDING SITE II or BINDING SITE III of FIG. 8. Table 4 illustrates the complementarity of the nucleotide sequences of LOC284751 BINDING SITE, designated SEQ ID:7838, to the nucleotide sequence of GAM3770 RNA, herein designated GAM RNA, also designated SEQ ID:281.

Another function of GAM3770 is therefore inhibition of LOC284751 (Accession XP_211622.1). Accordingly, utilities of GAM3770 include diagnosis, prevention and treatment of diseases and clinical conditions associated with LOC284751.

LOC284997 (Accession XP_211723.1) is another GAM3770 target gene, herein designated TARGET GENE. LOC284997 BINDING SITE is a target binding site found in the 3' untranslated region of mRNA encoded by LOC284997, corresponding to a target binding site such as BINDING SITE I, BINDING SITE II or BINDING SITE III of FIG. 8. Table 4 illustrates the complementarity of the nucleotide sequences of LOC284997 BINDING SITE, designated SEQ ID:19759, to the nucleotide sequence of GAM3770 RNA, herein designated GAM RNA, also designated SEQ ID:281.

Another function of GAM3770 is therefore inhibition of LOC284997 (Accession XP_211723.1). Accordingly, utilities of GAM3770 include diagnosis, prevention and treatment of diseases and clinical conditions associated with LOC284997.

LOC285085 (Accession XP_209463.1) is another GAM3770 target gene, herein designated TARGET GENE. LOC285085 BINDING SITE is a target binding site found in the 3' untranslated region of mRNA encoded by LOC285085, corresponding to a target binding site such as BINDING SITE I, BINDING SITE II or BINDING SITE III of FIG. 8. Table 4 illustrates the complementarity of the nucleotide sequences of LOC285085 BINDING SITE, designated SEQ ID:9957, to the nucleotide sequence of GAM3770 RNA, herein designated GAM RNA, also designated SEQ ID:241.

Another function of GAM3770 is therefore inhibition of LOC285085 (Accession XP_209463.1). Accordingly, utilities of GAM3770 include diagnosis, prevention and treatment of diseases and clinical conditions associated with LOC285085.

LOC285582 (Accession XP_211943.1) is another GAM3770 target gene, herein designated TARGET GENE. LOC285582 BINDING SITE is a target binding site found in the 5' untranslated region of mRNA encoded by LOC285582, corresponding to a target binding site such as BINDING SITE I, BINDING SITE II or BINDING SITE III of FIG. 8. Table 4 illustrates the complementarity of the nucleotide sequences of LOC285582 BINDING SITE, designated SEQ ID:12902, to the nucleotide sequence of GAM3770 RNA, herein designated GAM RNA, also designated SEQ ID:281.

Another function of GAM3770 is therefore inhibition of LOC285582 (Accession XP_211943.1). Accordingly, utilities of GAM3770 include diagnosis, prevention and treatment of diseases and clinical conditions associated with LOC285582.

LOC285589 (Accession XP_209671.1) is another GAM3770 target gene, herein designated TARGET GENE. LOC285589 BINDING SITE is a target binding site found in the 3' untranslated region of mRNA encoded by LOC285589, corresponding to a target binding site such as BINDING SITE I, BINDING SITE II or BINDING SITE III of FIG. 8. Table 4 illustrates the complementarity of the nucleotide sequences of LOC285589 BINDING SITE, designated SEQ ID:10045, to the nucleotide sequence of GAM3770 RNA, herein designated GAM RNA, also designated SEQ ID:241.

Another function of GAM3770 is therefore inhibition of LOC285589 (Accession XP_209671.1). Accordingly, utilities of GAM3770 include diagnosis, prevention and treatment of diseases and clinical conditions associated with LOC285589.

LOC285622 (Accession XP_208333.1) is another GAM3770 target gene, herein designated TARGET GENE. LOC285622 BINDING SITE is a target binding site found in the 3' untranslated region of mRNA encoded by LOC285622, corresponding to a target binding site such as BINDING SITE I, BINDING SITE II or BINDING SITE III of FIG. 8. Table 4 illustrates the complementarity of the nucleotide sequences of LOC285622 BINDING SITE, designated SEQ ID:8952, to the nucleotide sequence of GAM3770 RNA, herein designated GAM RNA, also designated SEQ ID:281.

Another function of GAM3770 is therefore inhibition of LOC285622 (Accession XP_208333.1). Accordingly, utilities of GAM3770 include diagnosis, prevention and treatment of diseases and clinical conditions associated with LOC285622.

LOC285727 (Accession XP_212000.1) is another GAM3770 target gene, herein designated TARGET GENE. LOC285727 BINDING SITE is a target binding site found in the 3' untranslated region of mRNA encoded by LOC285727, corresponding to a target binding site such as BINDING SITE I, BINDING SITE II or BINDING SITE III of FIG. 8. Table 4 illustrates the complementarity of the nucleotide sequences of LOC285727 BINDING SITE, designated SEQ ID:2857, to the nucleotide sequence of GAM3770 RNA, herein designated GAM RNA, also designated SEQ ID:241.

Another function of GAM3770 is therefore inhibition of LOC285727 (Accession XP_212000.1). Accordingly, utilities of GAM3770 include diagnosis, prevention and treatment of diseases and clinical conditions associated with LOC285727.

LOC285772 (Accession XP_212014.1) is another GAM3770 target gene, herein designated TARGET GENE. LOC285772 BINDING SITE is a target binding site found in the 3' untranslated region of mRNA encoded by LOC285772, corresponding to a target binding site such as BINDING SITE I, BINDING SITE II or BINDING SITE III of FIG. 8. Table 4 illustrates the complementarity of the nucleotide sequences of LOC285772 BINDING SITE, designated SEQ ID:2909, to the nucleotide sequence of GAM3770 RNA, herein designated GAM RNA, also designated SEQ ID:241.

Another function of GAM3770 is therefore inhibition of LOC285772 (Accession XP_212014.1). Accordingly, utilities of GAM3770 include diagnosis, prevention and treatment of diseases and clinical conditions associated with LOC285772.

LOC285951 (Accession XP_212090.1) is another GAM3770 target gene, herein designated TARGET GENE. LOC285951 BINDING SITE is a target binding site found in the 5' untranslated region of mRNA encoded by LOC285951, corresponding to a target binding site such as BINDING SITE I, BINDING SITE II or BINDING SITE III of FIG. 8. Table 4 illustrates the complementarity of the nucleotide sequences of LOC285951 BINDING SITE, designated SEQ ID:3942, to the nucleotide sequence of GAM3770 RNA, herein designated GAM RNA, also designated SEQ ID:281.

Another function of GAM3770 is therefore inhibition of LOC285951 (Accession XP_212090.1). Accordingly, utilities of GAM3770 include diagnosis, prevention and treatment of diseases and clinical conditions associated with LOC285951.

LOC286058 (Accession XP_212158.1) is another GAM3770 target gene, herein designated TARGET GENE. LOC286058 BINDING SITE is a target binding site found in the 3' untranslated region of mRNA encoded by LOC286058, corresponding to a target binding site such as BINDING SITE I, BINDING SITE II or BINDING SITE III of FIG. 8. Table 4 illustrates the complementarity of the nucleotide sequences of LOC286058 BINDING SITE, designated SEQ ID:1673, to the nucleotide sequence of GAM3770 RNA, herein designated GAM RNA, also designated SEQ ID:281.

Another function of GAM3770 is therefore inhibition of LOC286058 (Accession XP_212158.1). Accordingly, utilities of GAM3770 include diagnosis, prevention and treatment of diseases and clinical conditions associated with LOC286058.

LOC286078 (Accession XP_212163.1) is another GAM3770 target gene, herein designated TARGET GENE. LOC286078 BINDING SITE is a target binding site found in the 5' untranslated region of mRNA encoded by LOC286078, corresponding to a target binding site such as BINDING SITE I, BINDING SITE II or BINDING SITE III of FIG. 8. Table 4 illustrates the complementarity of the nucleotide sequences of LOC286078 BINDING SITE, designated SEQ ID:11859, to the nucleotide sequence of GAM3770 RNA, herein designated GAM RNA, also designated SEQ ID:281.

Another function of GAM3770 is therefore inhibition of LOC286078 (Accession XP_212163.1). Accordingly, utilities of GAM3770 include diagnosis, prevention and treatment of diseases and clinical conditions associated with LOC286078.

LOC286206 (Accession XP_209953.1) is another GAM3770 target gene, herein designated TARGET GENE. LOC286206 BINDING SITE is a target binding site found in the 3' untranslated region of mRNA encoded by LOC286206, corresponding to a target binding site such as BINDING SITE I, BINDING SITE II or BINDING SITE III of FIG. 8. Table 4 illustrates the complementarity of the nucleotide sequences of LOC286206 BINDING SITE, designated SEQ ID:5166, to the nucleotide sequence of GAM3770 RNA, herein designated GAM RNA, also designated SEQ ID:281.

Another function of GAM3770 is therefore inhibition of LOC286206 (Accession XP_209953.1). Accordingly, utilities of GAM3770 include diagnosis, prevention and treatment of diseases and clinical conditions associated with LOC286206.

LOC286214 (Accession XP_212231.1) is another GAM3770 target gene, herein designated TARGET GENE. LOC286214 BINDING SITE is a target binding site found in the 5' untranslated region of mRNA encoded by LOC286214, corresponding to a target binding site such as BINDING SITE I, BINDING SITE II or BINDING SITE III of FIG. 8. Table 4 illustrates the complementarity of the nucleotide sequences of LOC286214 BINDING SITE, designated SEQ ID:19388, to the nucleotide sequence of GAM3770 RNA, herein designated GAM RNA, also designated SEQ ID:241.

Another function of GAM3770 is therefore inhibition of LOC286214 (Accession XP_212231.1). Accordingly, utilities of GAM3770 include diagnosis, prevention and treatment of diseases and clinical conditions associated with LOC286214.

LOC286381 (Accession XP_212298.1) is another GAM3770 target gene, herein designated TARGET GENE. LOC286381 BINDING SITE is a target binding site found in the 5' untranslated region of mRNA encoded by LOC286381, corresponding to a target binding site such as BINDING SITE I, BINDING SITE II or BINDING SITE III of FIG. 8. Table 4 illustrates the complementarity of the nucleotide sequences of LOC286381 BINDING SITE, designated SEQ ID:13537, to the nucleotide sequence of GAM3770 RNA, herein designated GAM RNA, also designated SEQ ID:241.

Another function of GAM3770 is therefore inhibition of LOC286381 (Accession XP_212298.1). Accordingly, utilities of GAM3770 include diagnosis, prevention and treatment of diseases and clinical conditions associated with LOC286381.

LOC286493 (Accession XP_208437.1) is another GAM3770 target gene, herein designated TARGET GENE. LOC286493 BINDING SITE is a target binding site found in the 5' untranslated region of mRNA encoded by LOC286493, corresponding to a target binding site such as BINDING SITE I, BINDING SITE II or BINDING SITE III of FIG. 8. Table 4 illustrates the complementarity of the nucleotide sequences of LOC286493 BINDING SITE, designated SEQ ID:18478, to the nucleotide sequence of GAM3770 RNA, herein designated GAM RNA, also designated SEQ ID:281.

Another function of GAM3770 is therefore inhibition of LOC286493 (Accession XP_208437.1). Accordingly, utilities of GAM3770 include diagnosis, prevention and treatment of diseases and clinical conditions associated with LOC286493.

LOC338769 (Accession XP_294696.2) is another GAM3770 target gene, herein designated TARGET GENE. LOC338769 BINDING SITE is a target binding site found in the 5' untranslated region of mRNA encoded by LOC338769, corresponding to a target binding site such as BINDING SITE I, BINDING SITE II or BINDING SITE III of FIG. 8. Table 4 illustrates the complementarity of the nucleotide sequences of LOC338769 BINDING SITE, designated SEQ ID:2578, to the nucleotide sequence of GAM3770 RNA, herein designated GAM RNA, also designated SEQ ID:281.

Another function of GAM3770 is therefore inhibition of LOC338769 (Accession XP_294696.2). Accordingly, utilities of GAM3770 include diagnosis, prevention and treatment of diseases and clinical conditions associated with LOC338769.

LOC339149 (Accession XP_294830.1) is another GAM3770 target gene, herein designated TARGET GENE. LOC339149 BINDING SITE is a target binding site found in the 3' untranslated region of mRNA encoded by LOC339149, corresponding to a target binding site such as BINDING SITE I, BINDING SITE II or BINDING SITE III of FIG. 8. Table 4 illustrates the complementarity of the nucleotide sequences of LOC339149 BINDING SITE, designated SEQ ID:19949, to the nucleotide sequence of GAM3770 RNA, herein designated GAM RNA, also designated SEQ ID:281.

Another function of GAM3770 is therefore inhibition of LOC339149 (Accession XP_294830.1). Accordingly, utilities of GAM3770 include diagnosis, prevention and treatment of diseases and clinical conditions associated with LOC339149.

LOC339392 (Accession XP_294925.1) is another GAM3770 target gene, herein designated TARGET GENE. LOC339392 BINDING SITE is a target binding site found in the 5' untranslated region of mRNA encoded by LOC339392, corresponding to a target binding site such as BINDING SITE I, BINDING SITE II or BINDING SITE III of FIG. 8. Table 4 illustrates the complementarity of the nucleotide sequences of LOC339392 BINDING SITE, designated SEQ ID:4480, to the nucleotide sequence of GAM3770 RNA, herein designated GAM RNA, also designated SEQ ID:241.

Another function of GAM3770 is therefore inhibition of LOC339392 (Accession XP_294925.1). Accordingly, utilities of GAM3770 include diagnosis, prevention and treatment of diseases and clinical conditions associated with LOC339392.

LOC339442 (Accession XP_294957.1) is another GAM3770 target gene, herein designated TARGET GENE. LOC339442 BINDING SITE is a target binding site found in the 3' untranslated region of mRNA encoded by LOC339442, corresponding to a target binding site such as BINDING SITE I, BINDING SITE II or BINDING SITE III of FIG. 8. Table 4 illustrates the complementarity of the nucleotide sequences of LOC339442 BINDING SITE, designated SEQ ID:995, to the nucleotide sequence of GAM3770 RNA, herein designated GAM RNA, also designated SEQ ID:281.

Another function of GAM3770 is therefore inhibition of LOC339442 (Accession XP_294957.1). Accordingly, utilities of GAM3770 include diagnosis, prevention and treatment of diseases and clinical conditions associated with LOC339442.

LOC339492 (Accession XP_290919.1) is another GAM3770 target gene, herein designated TARGET GENE. LOC339492 BINDING SITE is a target binding site found in the 3' untranslated region of mRNA encoded by LOC339492, corresponding to a target binding site such as BINDING SITE I, BINDING SITE II or BINDING SITE III of FIG. 8. Table 4 illustrates the complementarity of the nucleotide sequences of LOC339492 BINDING SITE, designated SEQ ID:17748, to the nucleotide sequence of GAM3770 RNA, herein designated GAM RNA, also designated SEQ ID:281.

Another function of GAM3770 is therefore inhibition of LOC339492 (Accession XP_290919.1). Accordingly, utilities of GAM3770 include diagnosis, prevention and treatment of diseases and clinical conditions associated with LOC339492.

LOC339502 (Accession XP_294983.1) is another GAM3770 target gene, herein designated TARGET GENE. LOC339502 BINDING SITE is a target binding site found in the 5' untranslated region of mRNA encoded by LOC339502, corresponding to a target binding site such as BINDING SITE I, BINDING SITE II or BINDING SITE III of FIG. 8. Table 4 illustrates the complementarity of the nucleotide sequences of LOC339502 BINDING SITE, designated SEQ ID:18035, to the nucleotide sequence of GAM3770 RNA, herein designated GAM RNA, also designated SEQ ID:281.

Another function of GAM3770 is therefore inhibition of LOC339502 (Accession XP_294983.1). Accordingly, utilities of GAM3770 include diagnosis, prevention and treatment of diseases and clinical conditions associated with LOC339502.

LOC339975 (Accession XP_295115.1) is another GAM3770 target gene, herein designated TARGET GENE. LOC339975 BINDING SITE is a target binding site found in the 5' untranslated region of mRNA encoded by LOC339975, corresponding to a target binding site such as BINDING SITE I, BINDING SITE II or BINDING SITE III of FIG. 8. Table 4 illustrates the complementarity of the nucleotide sequences of LOC339975 BINDING SITE, designated SEQ ID:5687, to the nucleotide sequence of GAM3770 RNA, herein designated GAM RNA, also designated SEQ ID:281.

Another function of GAM3770 is therefore inhibition of LOC339975 (Accession XP_295115.1). Accordingly, utilities of GAM3770 include diagnosis, prevention and treatment of diseases and clinical conditions associated with LOC339975.

LOC340319 (Accession XP_295216.1) is another GAM3770 target gene, herein designated TARGET GENE. LOC340319 BINDING SITE is a target binding site found in the 3' untranslated region of mRNA encoded by LOC340319, corresponding to a target binding site such as BINDING SITE I, BINDING SITE II or BINDING SITE III of FIG. 8. Table 4 illustrates the complementarity of the nucleotide sequences of LOC340319 BINDING SITE, designated SEQ ID:3583, to the nucleotide sequence of GAM3770 RNA, herein designated GAM RNA, also designated SEQ ID:281.

Another function of GAM3770 is therefore inhibition of LOC340319 (Accession XP_295216.1). Accordingly, utilities of GAM3770 include diagnosis, prevention and treatment of diseases and clinical conditions associated with LOC340319.

LOC348549 (Accession XP_211637.1) is another GAM3770 target gene, herein designated TARGET GENE. LOC348549 BINDING SITE1 and LOC348549 BINDING SITE2 are target binding sites found in untranslated regions of mRNA encoded by LOC348549, corresponding to target binding sites such as BINDING SITE I, BINDING SITE II or BINDING SITE III of FIG. 8. Table 4 illustrates the complementarity of the nucleotide sequences of LOC348549 BINDING SITE1 and LOC348549 BINDING SITE2, designated SEQ ID:12486 and SEQ ID:20123 respectively, to the nucleotide sequence of GAM3770 RNA, herein designated GAM RNA, also designated SEQ ID:281.

Another function of GAM3770 is therefore inhibition of LOC348549 (Accession XP_211637.1). Accordingly, utilities of GAM3770 include diagnosis, prevention and treatment of diseases and clinical conditions associated with LOC348549.

LOC348897 (Accession XP_300874.1) is another GAM3770 target gene, herein designated TARGET GENE. LOC348897 BINDING SITE is a target binding site found in the 5' untranslated region of mRNA encoded by LOC348897, corresponding to a target binding site such as BINDING SITE I, BINDING SITE II or BINDING SITE III of FIG. 8. Table 4 illustrates the complementarity of the nucleotide sequences of LOC348897 BINDING SITE, designated SEQ ID:14363, to the nucleotide sequence of GAM3770 RNA, herein designated GAM RNA, also designated SEQ ID:281.

Another function of GAM3770 is therefore inhibition of LOC348897 (Accession XP_300874.1). Accordingly, utilities of GAM3770 include diagnosis, prevention and treatment of diseases and clinical conditions associated with LOC348897.

LOC349312 (Accession XP_303025.1) is another GAM3770 target gene, herein designated TARGET GENE. LOC349312 BINDING SITE is a target binding site found in the 5' untranslated region of mRNA encoded by LOC349312, corresponding to a target binding site such as BINDING SITE I, BINDING SITE II or BINDING SITE III of FIG. 8. Table 4 illustrates the complementarity of the nucleotide sequences of LOC349312 BINDING SITE, designated SEQ ID:13537, to the nucleotide sequence of GAM3770 RNA, herein designated GAM RNA, also designated SEQ ID:241.

Another function of GAM3770 is therefore inhibition of LOC349312 (Accession XP_303025.1). Accordingly, utilities of GAM3770 include diagnosis, prevention and treatment of diseases and clinical conditions associated with LOC349312.

LOC349364 (Accession XP_303037.1) is another GAM3770 target gene, herein designated TARGET GENE. LOC349364 BINDING SITE is a target binding site found in the 3' untranslated region of mRNA encoded by LOC349364, corresponding to a target binding site such as BINDING SITE I, BINDING SITE II or BINDING SITE III of FIG. 8. Table 4 illustrates the complementarity of the nucleotide sequences of LOC349364 BINDING SITE, designated SEQ ID:12158, to the nucleotide sequence of GAM3770 RNA, herein designated GAM RNA, also designated SEQ ID:281.

Another function of GAM3770 is therefore inhibition of LOC349364 (Accession XP_303037.1). Accordingly, utilities of GAM3770 include diagnosis, prevention and treatment of diseases and clinical conditions associated with LOC349364.

LOC349613 (Accession XP_303409.1) is another GAM3770 target gene, herein designated TARGET GENE. LOC349613 BINDING SITE is a target binding site found in the 5' untranslated region of mRNA encoded by LOC349613, corresponding to a target binding site such as BINDING SITE I, BINDING SITE II or BINDING SITE III of FIG. 8. Table 4 illustrates the complementarity of the nucleotide sequences of LOC349613 BINDING SITE, designated SEQ ID:19525, to the nucleotide sequence of GAM3770 RNA, herein designated GAM RNA, also designated SEQ ID:281.

Another function of GAM3770 is therefore inhibition of LOC349613 (Accession XP_303409.1). Accordingly, utilities of GAM3770 include diagnosis, prevention and treatment of diseases and clinical conditions associated with LOC349613.

LOC350154 (Accession XP_301527.1) is another GAM3770 target gene, herein designated TARGET GENE. LOC350154 BINDING SITE is a target binding site found in the 5' untranslated region of mRNA encoded by LOC350154, corresponding to a target binding site such as BINDING SITE I, BINDING SITE II or BINDING SITE III of FIG. 8. Table 4 illustrates the complementarity of the nucleotide sequences of LOC350154 BINDING SITE, designated SEQ ID:13364, to the nucleotide sequence of GAM3770 RNA, herein designated GAM RNA, also designated SEQ ID:241.

Another function of GAM3770 is therefore inhibition of LOC350154 (Accession XP_301527.1). Accordingly, utilities of GAM3770 include diagnosis, prevention and treatment of diseases and clinical conditions associated with LOC350154.

LOC352856 (Accession XP_304742.1) is another GAM3770 target gene, herein designated TARGET GENE. LOC352856 BINDING SITE is a target binding site found in the 3' untranslated region of mRNA encoded by LOC352856, corresponding to a target binding site such as BINDING SITE I, BINDING SITE II or BINDING SITE III of FIG. 8. Table 4 illustrates the complementarity of the nucleotide sequences of LOC352856 BINDING SITE, designated SEQ ID:8614, to the nucleotide sequence of GAM3770 RNA, herein designated GAM RNA, also designated SEQ ID:241.

Another function of GAM3770 is therefore inhibition of LOC352856 (Accession XP_304742.1). Accordingly, utilities of GAM3770 include diagnosis, prevention and treatment of diseases and clinical conditions associated with LOC352856.

LOC63928 (Accession NP_071380.1) is another GAM3770 target gene, herein designated TARGET GENE. LOC63928 BINDING SITE is a target binding site found in the 5' untranslated region of mRNA encoded by LOC63928, corresponding to a target binding site such as BINDING SITE I, BINDING SITE II or BINDING SITE III of FIG. 8. Table 4 illustrates the complementarity of the nucleotide sequences of LOC63928 BINDING SITE, designated SEQ ID:6921, to the nucleotide sequence of GAM3770 RNA, herein designated GAM RNA, also designated SEQ ID:241.

Another function of GAM3770 is therefore inhibition of LOC63928 (Accession NP_071380.1). Accordingly, utilities of GAM3770 include diagnosis, prevention and treatment of diseases and clinical conditions associated with LOC63928.

LOC90110 (Accession XP_029046.1) is another GAM3770 target gene, herein designated TARGET GENE. LOC90110 BINDING SITE is a target binding site found in the 5' untranslated region of mRNA encoded by LOC90110, corresponding to a target binding site such as BINDING SITE I, BINDING SITE II or BINDING SITE III of FIG. 8. Table 4 illustrates the complementarity of the nucleotide sequences of LOC90110 BINDING SITE, designated SEQ ID:3656, to the nucleotide sequence of GAM3770 RNA, herein designated GAM RNA, also designated SEQ ID:281.

Another function of GAM3770 is therefore inhibition of LOC90110 (Accession XP_029046.1). Accordingly, utilities of GAM3770 include diagnosis, prevention and treatment of diseases and clinical conditions associated with LOC90110.

LOC90170 (Accession XP_029589.1) is another GAM3770 target gene, herein designated TARGET GENE. LOC90170 BINDING SITE is a target binding site found in the 3' untranslated region of mRNA encoded by LOC90170, corresponding to a target binding site such as BINDING SITE I, BINDING SITE II or BINDING SITE III of FIG. 8. Table 4 illustrates the complementarity of the nucleotide sequences of LOC90170 BINDING SITE, designated SEQ ID:8664, to the nucleotide sequence of GAM3770 RNA, herein designated GAM RNA, also designated SEQ ID:281.

Another function of GAM3770 is therefore inhibition of LOC90170 (Accession XP_029589.1). Accordingly, utilities of GAM3770 include diagnosis, prevention and treatment of diseases and clinical conditions associated with LOC90170.

LOC90668 (Accession XP_090790.7) is another GAM3770 target gene, herein designated TARGET GENE. LOC90668 BINDING SITE is a target binding site found in the 3' untranslated region of mRNA encoded by LOC90668, corresponding to a target binding site such as BINDING SITE I, BINDING SITE II or BINDING SITE III of FIG. 8. Table 4 illustrates the complementarity of the nucleotide sequences of LOC90668 BINDING SITE, designated SEQ ID:9653, to the nucleotide sequence of GAM3770 RNA, herein designated GAM RNA, also designated SEQ ID:241.

Another function of GAM3770 is therefore inhibition of LOC90668 (Accession XP_090790.7). Accordingly, utilities of GAM3770 include diagnosis, prevention and treatment of diseases and clinical conditions associated with LOC90668.

LOC91661 (Accession NP_612381.1) is another GAM3770 target gene, herein designated TARGET GENE. LOC91661 BINDING SITE is a target binding site found in the 3' untranslated region of mRNA encoded by LOC91661, corresponding to a target binding site such as BINDING SITE I, BINDING SITE II or BINDING SITE III of FIG. 8. Table 4 illustrates the complementarity of the nucleotide sequences of LOC91661 BINDING SITE, designated SEQ ID:2238, to the nucleotide sequence of GAM3770 RNA, herein designated GAM RNA, also designated SEQ ID:281.

Another function of GAM3770 is therefore inhibition of LOC91661 (Accession NP_612381.1). Accordingly, utilities of GAM3770 include diagnosis, prevention and treatment of diseases and clinical conditions associated with LOC91661.

LOC96597 (Accession XP_039922.1) is another GAM3770 target gene, herein designated TARGET GENE. LOC96597 BINDING SITE is a target binding site found in the 5' untranslated region of mRNA encoded by LOC96597, corresponding to a target binding site such as BINDING SITE I, BINDING SITE II or BINDING SITE III of FIG. 8. Table 4 illustrates the complementarity of the nucleotide sequences of LOC96597 BINDING SITE, designated SEQ ID:9043, to the nucleotide sequence of GAM3770 RNA, herein designated GAM RNA, also designated SEQ ID:281.

Another function of GAM3770 is therefore inhibition of LOC96597 (Accession XP_039922.1). Accordingly, utilities of GAM3770 include diagnosis, prevention and treatment of diseases and clinical conditions associated with LOC96597.

LRRC8 (Accession XP_026998.2) is another GAM3770 target gene, herein designated TARGET GENE. LRRC8 BINDING SITE is a target binding site found in the 3' untranslated region of mRNA encoded by LRRC8, corresponding to a target binding site such as BINDING SITE I, BINDING SITE II or BINDING SITE III of FIG. 8. Table 4 illustrates the complementarity of the nucleotide sequences of LRRC8 BINDING SITE, designated SEQ ID:11922, to the nucleotide sequence of GAM3770 RNA, herein designated GAM RNA, also designated SEQ ID:281.

Another function of GAM3770 is therefore inhibition of LRRC8 (Accession XP_026998.2). Accordingly, utilities of GAM3770 include diagnosis, prevention and treatment of diseases and clinical conditions associated with LRRC8.

Mitogen-activated protein kinase 8 interacting protein 3 (MAPK8IP3, Accession NP_203750.1) is another GAM3770 target gene, herein designated TARGET GENE. MAPK8IP3 BINDING SITE is a target binding site found in the 3' untranslated region of multiple transcripts of mRNA encoded by MAPK8IP3, corresponding to a target binding site such as BINDING SITE I, BINDING SITE II or BINDING SITE III of FIG. 8. Table 4 illustrates the complementarity of the nucleotide sequences of MAPK8IP3 BINDING SITE, designated SEQ ID:11255, to the nucleotide sequence of GAM3770 RNA, herein designated GAM RNA, also designated SEQ ID:281.

Another function of GAM3770 is therefore inhibition of Mitogen-activated protein kinase 8 interacting protein 3 (MAPK8IP3, Accession NP_203750.1). Accordingly, utilities of GAM3770 include diagnosis, prevention and treatment of diseases and clinical conditions associated with MAPK8IP3.

MDS018 (Accession NP_068595.2) is another GAM3770 target gene, herein designated TARGET GENE. MDS018 BINDING SITE is a target binding site found in the 5' untranslated region of mRNA encoded by MDS018, corresponding to a target binding site such as BINDING SITE I, BINDING SITE II or BINDING SITE III of FIG. 8. Table 4 illustrates the complementarity of the nucleotide sequences of MDS018 BINDING SITE, designated SEQ ID:7934, to the nucleotide sequence of GAM3770 RNA, herein designated GAM RNA, also designated SEQ ID:281.

Another function of GAM3770 is therefore inhibition of MDS018 (Accession NP_068595.2). Accordingly, utilities of GAM3770 include diagnosis, prevention and treatment of diseases and clinical conditions associated with MDS018.

Antigen p97 (melanoma associated) identified by monoclonal antibodies 133.2 and 96.5 (MFI2, Accession NP_201573.1) is another GAM3770 target gene, herein designated TARGET GENE. MFI2 BINDING SITE is a target binding site found in the 3' untranslated region of multiple transcripts of mRNA encoded by MFI2, corresponding to a target binding site such as BINDING SITE I, BINDING SITE II or BINDING SITE III of FIG. 8. Table 4 illustrates the complementarity of the nucleotide sequences of MFI2 BINDING SITE, designated SEQ ID:10773, to the nucleotide sequence of GAM3770 RNA, herein designated GAM RNA, also designated SEQ ID:241.

Another function of GAM3770 is therefore inhibition of Antigen p97 (melanoma associated) identified by monoclonal antibodies 133.2 and 96.5 (MFI2, Accession NP_201573.1). Accordingly, utilities of GAM3770 include diagnosis, prevention and treatment of diseases and clinical conditions associated with MFI2.

MFN1 (Accession NP_060397.1) is another GAM3770 target gene, herein designated TARGET GENE. MFN1 BINDING SITE is a target binding site found in the 3' untranslated region of multiple transcripts of mRNA encoded by MFN1, corresponding to a target binding site such as BINDING SITE I, BINDING SITE II or BINDING SITE III of FIG. 8. Table 4 illustrates the complementarity of the nucleotide sequences of MFN1 BINDING SITE, designated SEQ ID:8117, to the nucleotide sequence of GAM3770 RNA, herein designated GAM RNA, also designated SEQ ID:281.

Another function of GAM3770 is therefore inhibition of MFN1 (Accession NP_060397.1). Accordingly, utilities of GAM3770 include diagnosis, prevention and treatment of diseases and clinical conditions associated with MFN1.

MFN1 (Accession NP_284941.1) is another GAM3770 target gene, herein designated TARGET GENE. MFN1 BINDING SITE is a target binding site found in the 3' untranslated region of multiple transcripts of mRNA encoded by MFN1, corresponding to a target binding site such as BINDING SITE I, BINDING SITE II or BINDING SITE III of FIG. 8. Table 4 illustrates the complementarity of the nucleotide sequences of MFN1 BINDING SITE, designated SEQ ID:8117, to the nucleotide sequence of GAM3770 RNA, herein designated GAM RNA, also designated SEQ ID:281.

Another function of GAM3770 is therefore inhibition of MFN1 (Accession NP_284941.1). Accordingly, utilities of GAM3770 include diagnosis, prevention and treatment of diseases and clinical conditions associated with MFN1.

MGC11134 (Accession NP_113660.1) is another GAM3770 target gene, herein designated TARGET GENE. MGC11134 BINDING SITE is a target binding site found in the 5' untranslated region of mRNA encoded by MGC11134, corresponding to a target binding site such as BINDING SITE I, BINDING SITE II or BINDING SITE III of FIG. 8. Table 4 illustrates the complementarity of the nucleotide sequences of MGC11134 BINDING SITE, designated SEQ ID:7280, to the nucleotide sequence of GAM3770 RNA, herein designated GAM RNA, also designated SEQ ID:281.

Another function of GAM3770 is therefore inhibition of MGC11134 (Accession NP_113660.1). Accordingly, utilities of GAM3770 include diagnosis, prevention and treatment of diseases and clinical conditions associated with MGC11134.

MGC21688 (Accession NP_653236.1) is another GAM3770 target gene, herein designated TARGET GENE. MGC21688 BINDING SITE is a target binding site found in the 3' untranslated region of mRNA encoded by MGC21688, corresponding to a target binding site such as BINDING SITE I, BINDING SITE II or BINDING SITE III of FIG. 8. Table 4 illustrates the complementarity of the nucleotide sequences of MGC21688 BINDING SITE, designated SEQ ID:10713, to the nucleotide sequence of GAM3770 RNA, herein designated GAM RNA, also designated SEQ ID:281.

Another function of GAM3770 is therefore inhibition of MGC21688 (Accession NP_653236.1). Accordingly, utilities of GAM3770 include diagnosis, prevention and treatment of diseases and clinical conditions associated with MGC21688.

MGC2734 (Accession NP_149108.1) is another GAM3770 target gene, herein designated TARGET GENE. MGC2734 BINDING SITE is a target binding site found in the 5' untranslated region of mRNA encoded by MGC2734, corresponding to a target binding site such as BINDING SITE I, BINDING SITE II or BINDING SITE III of FIG. 8. Table 4 illustrates the complementarity of the nucleotide sequences of MGC2734 BINDING SITE, designated SEQ ID:1723, to the nucleotide sequence of GAM3770 RNA, herein designated GAM RNA, also designated SEQ ID:241.

Another function of GAM3770 is therefore inhibition of MGC2734 (Accession NP_149108.1). Accordingly, utilities of GAM3770 include diagnosis, prevention and treatment of diseases and clinical conditions associated with MGC2734.

MGC2793 (Accession NP_659501.1) is another GAM3770 target gene, herein designated TARGET GENE. MGC2793 BINDING SITE is a target binding site found in the 5' untranslated region of mRNA encoded by MGC2793, corresponding to a target binding site such as BINDING SITE I, BINDING SITE II or BINDING SITE III of FIG. 8. Table 4 illustrates the complementarity of the nucleotide sequences of MGC2793 BINDING SITE, designated SEQ ID:13614, to the nucleotide sequence of GAM3770 RNA, herein designated GAM RNA, also designated SEQ ID:241.

Another function of GAM3770 is therefore inhibition of MGC2793 (Accession NP_659501.1). Accordingly, utilities of GAM3770 include diagnosis, prevention and treatment of diseases and clinical conditions associated with MGC2793.

MGC29649 (Accession NP_776171.1) is another GAM3770 target gene, herein designated TARGET GENE. MGC29649 BINDING SITE is a target binding site found in the 5' untranslated region of mRNA encoded by MGC29649, corresponding to a target binding site such as BINDING SITE I, BINDING SITE II or BINDING SITE III of FIG. 8. Table 4 illustrates the complementarity of the nucleotide sequences of MGC29649 BINDING SITE, designated SEQ ID:9449, to the nucleotide sequence of GAM3770 RNA, herein designated GAM RNA, also designated SEQ ID:241.

Another function of GAM3770 is therefore inhibition of MGC29649 (Accession NP_776171.1). Accordingly, utilities of GAM3770 include diagnosis, prevention and treatment of diseases and clinical conditions associated with MGC29649.

MGC4238 (Accession NP_115708.1) is another GAM3770 target gene, herein designated TARGET GENE. MGC4238 BINDING SITE is a target binding site found in the 5' untranslated region of mRNA encoded by MGC4238, corresponding to a target binding site such as BINDING SITE I, BINDING SITE II or BINDING SITE III of FIG. 8. Table 4 illustrates the complementarity of the nucleotide sequences of MGC4238 BINDING SITE, designated SEQ ID:7861, to the nucleotide sequence of GAM3770 RNA, herein designated GAM RNA, also designated SEQ ID:281.

Another function of GAM3770 is therefore inhibition of MGC4238 (Accession NP_115708.1). Accordingly, utilities of GAM3770 include diagnosis, prevention and treatment of diseases and clinical conditions associated with MGC4238.

MGC46719 (Accession NP_714924.1) is another GAM3770 target gene, herein designated TARGET GENE. MGC46719 BINDING SITE is a target binding site found in the 3' untranslated region of mRNA encoded by MGC46719, corresponding to a target binding site such as BINDING SITE I, BINDING SITE II or BINDING SITE III of FIG. 8. Table 4 illustrates the complementarity of the nucleotide sequences of MGC46719 BINDING SITE, designated SEQ ID:9825, to the nucleotide sequence of GAM3770 RNA, herein designated GAM RNA, also designated SEQ ID:281.

Another function of GAM3770 is therefore inhibition of MGC46719 (Accession NP_714924.1). Accordingly, utilities of GAM3770 include diagnosis, prevention and treatment of diseases and clinical conditions associated with MGC46719.

MGC5576 (Accession NP_076961.1) is another GAM3770 target gene, herein designated TARGET GENE. MGC5576 BINDING SITE is a target binding site found in the 3' untranslated region of mRNA encoded by MGC5576, corresponding to a target binding site such as BINDING SITE I, BINDING SITE II or BINDING SITE III of FIG. 8. Table 4 illustrates the complementarity of the nucleotide sequences of MGC5576 BINDING SITE, designated SEQ ID:11789, to the nucleotide sequence of GAM3770 RNA, herein designated GAM RNA, also designated SEQ ID:241.

Another function of GAM3770 is therefore inhibition of MGC5576 (Accession NP_076961.1). Accordingly, utilities of GAM3770 include diagnosis, prevention and treatment of diseases and clinical conditions associated with MGC5576.

Midline 1 (opitz/bbb syndrome) (MID1, Accession NP_150632.1) is another GAM3770 target gene, herein designated TARGET GENE. MID1 BINDING SITE is a target binding site found in the 5' untranslated region of multiple transcripts of mRNA encoded by MID1, corresponding to a target binding site such as BINDING SITE I, BINDING SITE II or BINDING SITE III of FIG. 8. Table 4 illustrates the complementarity of the nucleotide sequences of MID1 BINDING SITE, designated SEQ ID:2966, to the nucleotide sequence of GAM3770 RNA, herein designated GAM RNA, also designated SEQ ID:241.

Another function of GAM3770 is therefore inhibition of Midline 1 (opitz/bbb syndrome) (MID1, Accession NP_150632.1). Accordingly, utilities of GAM3770 include diagnosis, prevention and treatment of diseases and clinical conditions associated with MID1.

MONDOA (Accession NP_055753.1) is another GAM3770 target gene, herein designated TARGET GENE. MONDOA BINDING SITE is a target binding site found in the 3' untranslated region of mRNA encoded by MONDOA, corresponding to a target binding site such as BINDING SITE I, BINDING SITE II or BINDING SITE III of FIG. 8. Table 4 illustrates the complementarity of the nucleotide sequences of MONDOA BINDING SITE, designated SEQ ID:17392, to the nucleotide sequence of GAM3770 RNA, herein designated GAM RNA, also designated SEQ ID:281.

Another function of GAM3770 is therefore inhibition of MONDOA (Accession NP_055753.1). Accordingly, utilities of GAM3770 include diagnosis, prevention and treatment of diseases and clinical conditions associated with MONDOA.

Mitochondrial ribosomal protein l52 (MRPL52, Accession NP_848026.1) is another GAM3770 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:12936, to the nucleotide sequence of GAM3770 RNA, herein designated GAM RNA, also designated SEQ ID:281.

Another function of GAM3770 is therefore inhibition of Mitochondrial ribosomal protein l52 (MRPL52, Accession NP_848026.1). Accordingly, utilities of GAM3770 include diagnosis, prevention and treatment of diseases and clinical conditions associated with MRPL52.

Mitochondrial ribosomal protein l52 (MRPL52, Accession NP_851313.1) is another GAM3770 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:12936, to the nucleotide sequence of GAM3770 RNA, herein designated GAM RNA, also designated SEQ ID:281.

Another function of GAM3770 is therefore inhibition of Mitochondrial ribosomal protein l52 (MRPL52, Accession NP_851313.1). Accordingly, utilities of GAM3770 include diagnosis, prevention and treatment of diseases and clinical conditions associated with MRPL52.

Mitochondrial ribosomal protein l52 (MRPL52, Accession NP_851822.1) is another GAM3770 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:12936, to the nucleotide sequence of GAM3770 RNA, herein designated GAM RNA, also designated SEQ ID:281.

Another function of GAM3770 is therefore inhibition of Mitochondrial ribosomal protein l52 (MRPL52, Accession NP_851822.1). Accordingly, utilities of GAM3770 include diagnosis, prevention and treatment of diseases and clinical conditions associated with MRPL52.

Mitochondrial ribosomal protein l52 (MRPL52, Accession NP_851823.1) is another GAM3770 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:12936, to the nucleotide sequence of GAM3770 RNA, herein designated GAM RNA, also designated SEQ ID:281.

Another function of GAM3770 is therefore inhibition of Mitochondrial ribosomal protein l52 (MRPL52, Accession NP_851823.1). Accordingly, utilities of GAM3770 include diagnosis, prevention and treatment of diseases and clinical conditions associated with MRPL52.

Mitochondrial ribosomal protein l52 (MRPL52, Accession NP_851821.1) is another GAM3770 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:12936, to the nucleotide sequence of GAM3770 RNA, herein designated GAM RNA, also designated SEQ ID:281.

Another function of GAM3770 is therefore inhibition of Mitochondrial ribosomal protein l52 (MRPL52, Accession NP_851821.1). Accordingly, utilities of GAM3770 include diagnosis, prevention and treatment of diseases and clinical conditions associated with MRPL52.

Mitochondrial ribosomal protein l52 (MRPL52, Accession NP_851312.1) is another GAM3770 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:12936, to the nucleotide sequence of GAM3770 RNA, herein designated GAM RNA, also designated SEQ ID:281.

Another function of GAM3770 is therefore inhibition of Mitochondrial ribosomal protein l52 (MRPL52, Accession NP_851312.1) . Accordingly, utilities of GAM3770 include diagnosis, prevention and treatment of diseases and clinical conditions associated with MRPL52.

Mitochondrial ribosomal protein l52 (MRPL52, Accession NP_851824.1) is another GAM3770 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:12936, to the nucleotide sequence of GAM3770 RNA, herein designated GAM RNA, also designated SEQ ID:281.

Another function of GAM3770 is therefore inhibition of Mitochondrial ribosomal protein l52 (MRPL52, Accession NP_851824.1) . Accordingly, utilities of GAM3770 include diagnosis, prevention and treatment of diseases and clinical conditions associated with MRPL52.

MRS3/4 (Accession NP_112489.2) is another GAM3770 target gene, herein designated TARGET GENE. MRS3/4 BINDING SITE is a target binding site found in the 5' untranslated region of mRNA encoded by MRS3/4, corresponding to a target binding site such as BINDING SITE I, BINDING SITE II or BINDING SITE III of FIG. 8. Table 4 illustrates the complementarity of the nucleotide sequences of MRS3/4 BINDING SITE, designated SEQ ID:4406, to the nucleotide sequence of GAM3770 RNA, herein designated GAM RNA, also designated SEQ ID:241.

Another function of GAM3770 is therefore inhibition of MRS3/4 (Accession NP_112489.2). Accordingly, utilities of GAM3770 include diagnosis, prevention and treatment of diseases and clinical conditions associated with MRS3/4.

Musculin (activated b-cell factor-1) (MSC, Accession NP_005089.1) is another GAM3770 target gene, herein designated TARGET GENE. MSC BINDING SITE is a target binding site found in the 5' untranslated region of mRNA encoded by MSC, corresponding to a target binding site such as BINDING SITE I, BINDING SITE II or BINDING SITE III of FIG. 8. Table 4 illustrates the complementarity of the nucleotide sequences of MSC BINDING SITE, designated SEQ ID:10452, to the nucleotide sequence of GAM3770 RNA, herein designated GAM RNA, also designated SEQ ID:281.

Another function of GAM3770 is therefore inhibition of Musculin (activated b-cell factor-1) (MSC, Accession NP_005089.1). Accordingly, utilities of GAM3770 include diagnosis, prevention and treatment of diseases and clinical conditions associated with MSC.

Neutrophil cytosolic factor 4, 40 kda (NCF4, Accession NP_000622.1) is another GAM3770 target gene, herein designated TARGET GENE. NCF4 BINDING SITE is a target binding site found in the 3' untranslated region of multiple transcripts of mRNA encoded by NCF4, corresponding to a target binding site such as BINDING SITE I, BINDING SITE II or BINDING SITE III of FIG. 8. Table 4 illustrates the complementarity of the nucleotide sequences of NCF4 BINDING SITE, designated SEQ ID:11268, to the nucleotide sequence of GAM3770 RNA, herein designated GAM RNA, also designated SEQ ID:241.

Another function of GAM3770 is therefore inhibition of Neutrophil cytosolic factor 4, 40 kda (NCF4, Accession NP_000622.1), a gene which may be important for the assembly and/or activation of the nadph-oxidase complex. Accordingly, utilities of GAM3770 include diagnosis, prevention and treatment of diseases and clinical conditions associated with NCF4.

The function of NCF4 and its association with various diseases and clinical conditions, has been established by previous studies, as described hereinabove with reference to GAM967.1. NID67 (Accession NP_116565.1) is another GAM3770 target gene, herein designated TARGET GENE. NID67 BINDING SITE is a target binding site found in the 5' untranslated region of mRNA encoded by NID67, corresponding to a target binding site such as BINDING SITE I, BINDING SITE II or BINDING SITE III of FIG. 8. Table 4 illustrates the complementarity of the nucleotide sequences of NID67 BINDING SITE, designated SEQ ID:1378, to the nucleotide sequence of GAM3770 RNA, herein designated GAM RNA, also designated SEQ ID:281.

Another function of GAM3770 is therefore inhibition of NID67 (Accession NP_116565.1). Accordingly, utilities of GAM3770 include diagnosis, prevention and treatment of diseases and clinical conditions associated with NID67.

Nk3 transcription factor related, locus 1 (drosophila) (NKX3-1, Accession NP_006158.2) is another GAM3770 target gene, herein designated TARGET GENE. NKX3-1 BINDING SITE is a target binding site found in the 3' untranslated region of mRNA encoded by NKX3-1, corresponding to a target binding site such as BINDING SITE I, BINDING SITE II or BINDING SITE III of FIG. 8. Table 4 illustrates the complementarity of the nucleotide sequences of NKX3-1 BINDING SITE, designated SEQ ID:5499, to the nucleotide sequence of GAM3770 RNA, herein designated GAM RNA, also designated SEQ ID:281.

Another function of GAM3770 is therefore inhibition of Nk3 transcription factor related, locus 1 (drosophila) (NKX3-1, Accession NP_006158.2). Accordingly, utilities of GAM3770 include diagnosis, prevention and treatment of diseases and clinical conditions associated with NKX3-1.

NMNAT2 (Accession NP_055854.1) is another GAM3770 target gene, herein designated TARGET GENE. NMNAT2 BINDING SITE is a target binding site found in the 3' untranslated region of multiple transcripts of mRNA encoded by NMNAT2, corresponding to a target binding site such as BINDING SITE I, BINDING SITE II or BINDING SITE III of FIG. 8. Table 4 illustrates the complementarity of the nucleotide sequences of NMNAT2 BINDING SITE, designated SEQ ID:1983, to the nucleotide sequence of GAM3770 RNA, herein designated GAM RNA, also designated SEQ ID:281.

Another function of GAM3770 is therefore inhibition of NMNAT2 (Accession NP_055854.1). Accordingly, utilities of GAM3770 include diagnosis, prevention and treatment of diseases and clinical conditions associated with NMNAT2.

Npc1 (niemann-pick disease, type c1, gene)-like 1 (NPC1L1, Accession NP_037521.1) is another GAM3770 target gene, herein designated TARGET GENE. NPC1L1 BINDING SITE is a target binding site found in the 3' untranslated region of mRNA encoded by NPC1L1, corresponding to a target binding site such as BINDING SITE I, BINDING SITE II or BINDING SITE III of FIG. 8. Table 4 illustrates the complementarity of the nucleotide sequences of NPC1L1 BINDING SITE, designated SEQ ID:17761, to the nucleotide sequence of GAM3770 RNA, herein designated GAM RNA, also designated SEQ ID:281.

Another function of GAM3770 is therefore inhibition of Npc1 (niemann-pick disease, type c1, gene)-like 1 (NPC1L1, Accession NP_037521.1). Accordingly, utilities of GAM3770 include diagnosis, prevention and treatment of diseases and clinical conditions associated with NPC1L1.

Oxidative-stress responsive 1 (OSR1, Accession NP_005100.1) is another GAM3770 target gene, herein designated TARGET GENE. OSR1 BINDING SITE is a target binding site found in the 3' untranslated region of multiple transcripts of mRNA encoded by OSR1, corresponding to a target binding site such as BINDING SITE I, BINDING SITE II or BINDING SITE III of FIG. 8. Table 4 illustrates the complementarity of the nucleotide sequences of OSR1 BINDING SITE, designated SEQ ID:8511, to the nucleotide sequence of GAM3770 RNA, herein designated GAM RNA, also designated SEQ ID:281.

Another function of GAM3770 is therefore inhibition of Oxidative-stress responsive 1 (OSR1, Accession NP_005100.1), a gene which mediats stress-activated signals. Accordingly, utilities of GAM3770 include diagnosis, prevention and treatment of diseases and clinical conditions associated with OSR1.

The function of OSR1 and its association with various diseases and clinical conditions, has been established by previous studies, as described hereinabove with reference to GAM133.1. OTOP3 (Accession XP_292588.2) is another GAM3770 target gene, herein designated TARGET GENE. OTOP3 BINDING SITE is a target binding site found in the 5' untranslated region of mRNA encoded by OTOP3, corresponding to a target binding site such as BINDING SITE I, BINDING SITE II or BINDING SITE III of FIG. 8. Table 4 illustrates the complementarity of the nucleotide sequences of OTOP3 BINDING SITE, designated SEQ ID:11275, to the nucleotide sequence of GAM3770 RNA, herein designated GAM RNA, also designated SEQ ID:241.

Another function of GAM3770 is therefore inhibition of OTOP3 (Accession XP_292588.2). Accordingly, utilities of GAM3770 include diagnosis, prevention and treatment of diseases and clinical conditions associated with OTOP3.

P21(cdkn1a)-activated kinase 6 (PAK6, Accession NP_064553.1) is another GAM3770 target gene, herein designated TARGET GENE. PAK6 BINDING SITE is a target binding site found in the 3' untranslated region of mRNA encoded by PAK6, corresponding to a target binding site such as BINDING SITE I, BINDING SITE II or BINDING SITE III of FIG. 8. Table 4 illustrates the complementarity of the nucleotide sequences of PAK6 BINDING SITE, designated SEQ ID:10797, to the nucleotide sequence of GAM3770 RNA, herein designated GAM RNA, also designated SEQ ID:281.

Another function of GAM3770 is therefore inhibition of P21(cdkn1a)-activated kinase 6 (PAK6, Accession NP_064553.1). Accordingly, utilities of GAM3770 include diagnosis, prevention and treatment of diseases and clinical conditions associated with PAK6.

Pas domain containing serine/threonine kinase (PASK, Accession NP_055963.1) is another GAM3770 target gene, herein designated TARGET GENE. PASK BINDING SITE is a target binding site found in the 3' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:20147, to the nucleotide sequence of GAM3770 RNA, herein designated GAM RNA, also designated SEQ ID:281.

Another function of GAM3770 is therefore inhibition of Pas domain containing serine/threonine kinase (PASK, Accession NP_055963.1). Accordingly, utilities of GAM3770 include diagnosis, prevention and treatment of diseases and clinical conditions associated with PASK.

Procollagen (type iii) n-endopeptidase (PCOLN3, Accession NP_002759.1) is another GAM3770 target gene, herein designated TARGET GENE. PCOLN3 BINDING SITE is a target binding site found in the 3' untranslated region of mRNA encoded by PCOLN3, corresponding to a target binding site such as BINDING SITE I, BINDING SITE II or BINDING SITE III of FIG. 8. Table 4 illustrates the complementarity of the nucleotide sequences of PCOLN3 BINDING SITE, designated SEQ ID:2932, to the nucleotide sequence of GAM3770 RNA, herein designated GAM RNA, also designated SEQ ID:281.

Another function of GAM3770 is therefore inhibition of Procollagen (type iii) n-endopeptidase (PCOLN3, Accession NP_002759.1), a gene which is a member of the zincin superfamily of zinc-dependent metalloproteases. Accordingly, utilities of GAM3770 include diagnosis, prevention and treatment of diseases and clinical conditions associated with PCOLN3.

The function of PCOLN3 and its association with various diseases and clinical conditions, has been established by previous studies, as described hereinabove with reference to GAM38.1. Placental growth factor, vascular endothelial growth factor-related protein (PGF, Accession NP_002623.2) is another GAM3770 target gene, herein designated TARGET GENE. PGF BINDING SITE is a target binding site found in the 3' untranslated region of mRNA encoded by PGF, corresponding to a target binding site such as BINDING SITE I, BINDING SITE II or BINDING SITE III of FIG. 8. Table 4 illustrates the complementarity of the nucleotide sequences of PGF BINDING SITE, designated SEQ ID:11465, to the nucleotide sequence of GAM3770 RNA, herein designated GAM RNA, also designated SEQ ID:281.

Another function of GAM3770 is therefore inhibition of Placental growth factor, vascular endothelial growth factor-related protein (PGF, Accession NP_002623.2), a gene which is a growth factor active in angiogenesis, and endothelial cell growth, stimulating cell proliferation and migration. it binds to receptor vegfr-1/fl. Accordingly, utilities of GAM3770 include diagnosis, prevention and treatment of diseases and clinical conditions associated with PGF.

The function of PGF and its association with various diseases and clinical conditions, has been established by previous studies, as described hereinabove with reference to GAM758.1. Phosphoglycerate kinase 1 (PGK1, Accession NP_000282.1) is another GAM3770 target gene, herein designated TARGET GENE. PGK1 BINDING SITE is a target binding site found in the 3' untranslated region of mRNA encoded by PGK1, corresponding to a target binding site such as BINDING SITE I, BINDING SITE II or BINDING SITE III of FIG. 8. Table 4 illustrates the complementarity of the nucleotide sequences of PGK1 BINDING SITE, designated SEQ ID:495, to the nucleotide sequence of GAM3770 RNA, herein designated GAM RNA, also designated SEQ ID:241.

Another function of GAM3770 is therefore inhibition of Phosphoglycerate kinase 1 (PGK1, Accession NP_000282.1). Accordingly, utilities of GAM3770 include diagnosis, prevention and treatment of diseases and clinical conditions associated with PGK1.

Phosphotidylinositol transfer protein (PITPN, Accession NP_006215.1) is another GAM3770 target gene, herein designated TARGET GENE. PITPN BINDING SITE is a target binding site found in the 3' untranslated region of mRNA encoded by PITPN, corresponding to a target binding site such as BINDING SITE I, BINDING SITE II or BINDING SITE III of FIG. 8. Table 4 illustrates the complementarity of the nucleotide sequences of PITPN BINDING SITE, designated SEQ ID:423, to the nucleotide sequence of GAM3770 RNA, herein designated GAM RNA, also designated SEQ ID:241.

Another function of GAM3770 is therefore inhibition of Phosphotidylinositol transfer protein (PITPN, Accession NP_006215.1), a gene which catalyzes the transfer of ptdins and phosphatidylcholine between membranes. Accordingly, utilities of GAM3770 include diagnosis, prevention and treatment of diseases and clinical conditions associated with PITPN.

The function of PITPN and its association with various diseases and clinical conditions, has been established by previous studies, as described hereinabove with reference to GAM223.1. Protein phosphatase 1, regulatory (inhibitor) subunit 12b (PPP1R12B, Accession NP_115288.1) is another GAM3770 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:19376, to the nucleotide sequence of GAM3770 RNA, herein designated GAM RNA, also designated SEQ ID:281.

Another function of GAM3770 is therefore inhibition of Protein phosphatase 1, regulatory (inhibitor) subunit 12b (PPP1R12B, Accession NP_115288.1). Accordingly, utilities of GAM3770 include diagnosis, prevention and treatment of diseases and clinical conditions associated with PPP1R12B.

Protein phosphatase 1, regulatory (inhibitor) subunit 12b (PPP1R12B, Accession NP_002472.1) is another GAM3770 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:19376, to the nucleotide sequence of GAM3770 RNA, herein designated GAM RNA, also designated SEQ ID:281.

Another function of GAM3770 is therefore inhibition of Protein phosphatase 1, regulatory (inhibitor) subunit 12b (PPP1R12B, Accession NP_002472.1). Accordingly, utilities of GAM3770 include diagnosis, prevention and treatment of diseases and clinical conditions associated with PPP1R12B.

Protease, serine, 7 (enterokinase) (PRSS7, Accession NP_002763.1) is another GAM3770 target gene, herein designated TARGET GENE. PRSS7 BINDING SITE is a target binding site found in the 3' untranslated region of mRNA encoded by PRSS7, corresponding to a target binding site such as BINDING SITE I, BINDING SITE II or BINDING SITE III of FIG. 8. Table 4 illustrates the complementarity of the nucleotide sequences of PRSS7 BINDING SITE, designated SEQ ID:4893, to the nucleotide sequence of GAM3770 RNA, herein designated GAM RNA, also designated SEQ ID:281.

Another function of GAM3770 is therefore inhibition of Protease, serine, 7 (enterokinase) (PRSS7, Accession NP_002763.1), a gene which Some of the trypsinogen genes are expressed in nonpancreatic tissues where their function is unknown and therefore is associated with Enterokinase deficiency. Accordingly, utilities of GAM3770 include diagnosis, prevention and treatment of Enterokinase deficiency, and of other diseases and clinical conditions associated with PRSS7.

The function of PRSS7 and its association with various diseases and clinical conditions, has been established by previous studies, as described hereinabove with reference to GAM1956.1. Protein tyrosine phosphatase, receptor type, r (PTPRR, Accession NP_002840.1) is another GAM3770 target gene, herein designated TARGET GENE. PTPRR BINDING SITE is a target binding site found in the 5' untranslated region of multiple transcripts of mRNA encoded by PTPRR, corresponding to a target binding site such as BINDING SITE I, BINDING SITE II or BINDING SITE III of FIG. 8. Table 4 illustrates the complementarity of the nucleotide sequences of PTPRR BINDING SITE, designated SEQ ID:10961, to the nucleotide sequence of GAM3770 RNA, herein designated GAM RNA, also designated SEQ ID:241.

Another function of GAM3770 is therefore inhibition of Protein tyrosine phosphatase, receptor type, r (PTPRR, Accession NP_002840.1). Accordingly, utilities of GAM3770 include diagnosis, prevention and treatment of diseases and clinical conditions associated with PTPRR.

Phosphorylase, glycogen; muscle (mcardle syndrome, glycogen storage disease type v) (PYGM, Accession NP_005600.1) is another GAM3770 target gene, herein designated TARGET GENE. PYGM BINDING SITE is a target binding site found in the 5' untranslated region of mRNA encoded by PYGM, corresponding to a target binding site such as BINDING SITE I, BINDING SITE II or BINDING SITE III of FIG. 8. Table 4 illustrates the complementarity of the nucleotide sequences of PYGM BINDING SITE, designated SEQ ID:11354, to the nucleotide sequence of GAM3770 RNA, herein designated GAM RNA, also designated SEQ ID:281.

Another function of GAM3770 is therefore inhibition of Phosphorylase, glycogen; muscle (mcardle syndrome, glycogen storage disease type v) (PYGM, Accession NP_005600.1). Accordingly, utilities of GAM3770 include diagnosis, prevention and treatment of diseases and clinical conditions associated with PYGM.

Rab3a interacting protein (rabin3)-like 1 (RAB3IL1, Accession NP_037533.2) is another GAM3770 target gene, herein designated TARGET GENE. RAB3IL1 BINDING SITE is a target binding site found in the 3' untranslated region of mRNA encoded by RAB3IL1, corresponding to a target binding site such as BINDING SITE I, BINDING SITE II or BINDING SITE III of FIG. 8. Table 4 illustrates the complementarity of the nucleotide sequences of RAB3IL1 BINDING SITE, designated SEQ ID:7921, to the nucleotide sequence of GAM3770 RNA, herein designated GAM RNA, also designated SEQ ID:281.

Another function of GAM3770 is therefore inhibition of Rab3a interacting protein (rabin3)-like 1 (RAB3IL1, Accession NP_037533.2). Accordingly, utilities of GAM3770 include diagnosis, prevention and treatment of diseases and clinical conditions associated with RAB3IL1.

Rad52 homolog (s. cerevisiae) (RAD52, Accession NP_602296.1) is another GAM3770 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52 BINDING SITE, designated SEQ ID:6948, to the nucleotide sequence of GAM3770 RNA, herein designated GAM RNA, also designated SEQ ID:241.

Another function of GAM3770 is therefore inhibition of Rad52 homolog (s. cerevisiae) (RAD52, Accession NP_602296.1). Accordingly, utilities of GAM3770 include diagnosis, prevention and treatment of diseases and clinical conditions associated with RAD52.

Rad52 homolog (s. cerevisiae) (RAD52, Accession NP_602295.1) is another GAM3770 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52 BINDING SITE, designated SEQ ID:6948, to the nucleotide sequence of GAM3770 RNA, herein designated GAM RNA, also designated SEQ ID:241.

Another function of GAM3770 is therefore inhibition of Rad52 homolog (s. cerevisiae) (RAD52, Accession NP_602295.1). Accordingly, utilities of GAM3770 include diagnosis, prevention and treatment of diseases and clinical conditions associated with RAD52.

Rad52 homolog (s. cerevisiae) (RAD52, Accession NP_602294.1) is another GAM3770 target gene, herein designated TARGET GENE. RAD52 BINDING SITE is a target binding site found in the 3' untranslated region of multiple transcripts of mRNA encoded by RAD52, corresponding to a target binding site such as BINDING SITE I, BINDING SITE II or BINDING SITE III of FIG. 8. Table 4 illustrates the complementarity of the nucleotide sequences of RAD52 BINDING SITE, designated SEQ ID:6948, to the nucleotide sequence of GAM3770 RNA, herein designated GAM RNA, also designated SEQ ID:241.

Another function of GAM3770 is therefore inhibition of Rad52 homolog (s. cerevisiae) (RAD52, Accession NP_602294.1). Accordingly, utilities of GAM3770 include diagnosis, prevention and treatment of diseases and clinical conditions associated with RAD52.

RASSF4 (Accession NP_835281.1) is another GAM3770 target gene, herein designated TARGET GENE. RASSF4 BINDING SITE is a target binding site found in the 3' untranslated region of multiple transcripts of mRNA encoded by RASSF4, corresponding to a target binding site such as BINDING SITE I, BINDING SITE II or BINDING SITE III of FIG. 8. Table 4 illustrates the complementarity of the nucleotide sequences of RASSF4 BINDING SITE, designated SEQ ID:725, to the nucleotide sequence of GAM3770 RNA, herein designated GAM RNA, also designated SEQ ID:281.

Another function of GAM3770 is therefore inhibition of RASSF4 (Accession NP_835281.1). Accordingly, utilities of GAM3770 include diagnosis, prevention and treatment of diseases and clinical conditions associated with RASSF4.

RASSF4 (Accession NP_114412.2) is another GAM3770 target gene, herein designated TARGET GENE. RASSF4 BINDING SITE is a target binding site found in the 3' untranslated region of multiple transcripts of mRNA encoded by RASSF4, corresponding to a target binding site such as BINDING SITE I, BINDING SITE II or BINDING SITE III of FIG. 8. Table 4 illustrates the complementarity of the nucleotide sequences of RASSF4 BINDING SITE, designated SEQ ID:725, to the nucleotide sequence of GAM3770 RNA, herein designated GAM RNA, also designated SEQ ID:281.

Another function of GAM3770 is therefore inhibition of RASSF4 (Accession NP_114412.2). Accordingly, utilities of GAM3770 include diagnosis, prevention and treatment of diseases and clinical conditions associated with RASSF4.

RE2 (Accession NP_722561.1) is another GAM3770 target gene, herein designated TARGET GENE. RE2 BINDING SITE is a target binding site found in the 5' untranslated region of multiple transcripts of mRNA encoded by RE2, corresponding to a target binding site such as BINDING SITE I, BINDING SITE II or BINDING SITE III of FIG. 8. Table 4 illustrates the complementarity of the nucleotide sequences of RE2 BINDING SITE, designated SEQ ID:1602, to the nucleotide sequence of GAM3770 RNA, herein designated GAM RNA, also designated SEQ ID:241.

Another function of GAM3770 is therefore inhibition of RE2 (Accession NP_722561.1). Accordingly, utilities of GAM3770 include diagnosis, prevention and treatment of diseases and clinical conditions associated with RE2.

RE2 (Accession NP_031395.1) is another GAM3770 target gene, herein designated TARGET GENE. RE2 BINDING SITE is a target binding site found in the 5' untranslated region of multiple transcripts of mRNA encoded by RE2, corresponding to a target binding site such as BINDING SITE I, BINDING SITE II or BINDING SITE III of FIG. 8. Table 4 illustrates the complementarity of the nucleotide sequences of RE2 BINDING SITE, designated SEQ ID:1602, to the nucleotide sequence of GAM3770 RNA, herein designated GAM RNA, also designated SEQ ID:241.

Another function of GAM3770 is therefore inhibition of RE2 (Accession NP_031395.1). Accordingly, utilities of GAM3770 include diagnosis, prevention and treatment of diseases and clinical conditions associated with RE2.

Replication factor c (activator 1) 1, 145 kda (RFC1, Accession NP_002904.2) is another GAM3770 target gene, herein designated TARGET GENE. RFC1 BINDING SITE is a target binding site found in the 3' untranslated region of mRNA encoded by RFC1, corresponding to a target binding site such as BINDING SITE I, BINDING SITE II or BINDING SITE III of FIG. 8. Table 4 illustrates the complementarity of the nucleotide sequences of RFC1 BINDING SITE, designated SEQ ID:12616, to the nucleotide sequence of GAM3770 RNA, herein designated GAM RNA, also designated SEQ ID:281.

Another function of GAM3770 is therefore inhibition of Replication factor c (activator 1) 1, 145 kda (RFC1, Accession NP_002904.2), a gene which plays a role in dna transcription, replication and/or repair. Accordingly, utilities of GAM3770 include diagnosis, prevention and treatment of diseases and clinical conditions associated with RFC1.

The function of RFC1 and its association with various diseases and clinical conditions, has been established by previous studies, as described hereinabove with reference to GAM195.2. Ribonuclease/angiogenin inhibitor (RNH, Accession NP_002930.2) is another GAM3770 target gene, herein designated TARGET GENE. RNH BINDING SITE is a target binding site found in the 5' untranslated region of mRNA encoded by RNH, corresponding to a target binding site such as BINDING SITE I, BINDING SITE II or BINDING SITE III of FIG. 8. Table 4 illustrates the complementarity of the nucleotide sequences of RNH BINDING SITE, designated SEQ ID:8721, to the nucleotide sequence of GAM3770 RNA, herein designated GAM RNA, also designated SEQ ID:281.

Another function of GAM3770 is therefore inhibition of Ribonuclease/angiogenin inhibitor (RNH, Accession NP_002930.2), a gene which is an inhibitor of pancreatic rnase and angiogenin. may also function in the modulation of cellular activities. Accordingly, utilities of GAM3770 include diagnosis, prevention and treatment of diseases and clinical conditions associated with RNH.

The function of RNH and its association with various diseases and clinical conditions, has been established by previous studies, as described hereinabove with reference to GAM204.2. Ribonucleotide reductase m2 polypeptide (RRM2, Accession NP_001025.1) is another GAM3770 target gene, herein designated TARGET GENE. RRM2 BINDING SITE is a target binding site found in the 3' untranslated region of mRNA encoded by RRM2, corresponding to a target binding site such as BINDING SITE I, BINDING SITE II or BINDING SITE III of FIG. 8. Table 4 illustrates the complementarity of the nucleotide sequences of RRM2 BINDING SITE, designated SEQ ID:17167, to the nucleotide sequence of GAM3770 RNA, herein designated GAM RNA, also designated SEQ ID:281.

Another function of GAM3770 is therefore inhibition of Ribonucleotide reductase m2 polypeptide (RRM2, Accession NP_001025.1). Accordingly, utilities of GAM3770 include diagnosis, prevention and treatment of diseases and clinical conditions associated with RRM2.

Runt-related transcription factor 3 (RUNX3, Accession NP_004341.1) is another GAM3770 target gene, herein designated TARGET GENE. RUNX3 BINDING SITE is a target binding site found in the 3' untranslated region of mRNA encoded by RUNX3, corresponding to a target binding site such as BINDING SITE I, BINDING SITE II or BINDING SITE III of FIG. 8. Table 4 illustrates the complementarity of the nucleotide sequences of RUNX3 BINDING SITE, designated SEQ ID:16681, to the nucleotide sequence of GAM3770 RNA, herein designated GAM RNA, also designated SEQ ID:241.

Another function of GAM3770 is therefore inhibition of Runt-related transcription factor 3 (RUNX3, Accession NP_004341.1), a gene which binds to the core site, 5'-pyg-pyggt-3', of a number of enhancers and promoters. Accordingly, utilities of GAM3770 include diagnosis, prevention and treatment of diseases and clinical conditions associated with RUNX3.

The function of RUNX3 and its association with various diseases and clinical conditions, has been established by previous studies, as described hereinabove with reference to GAM69.2. Syndecan 3 (n-syndecan) (SDC3, Accession NP_055469.1) is another GAM3770 target gene, herein designated TARGET GENE. SDC3 BINDING SITE is a target binding site found in the 3' untranslated region of mRNA encoded by SDC3, corresponding to a target binding site such as BINDING SITE I, BINDING SITE II or BINDING SITE III of FIG. 8. Table 4 illustrates the complementarity of the nucleotide sequences of SDC3 BINDING SITE, designated SEQ ID:5640, to the nucleotide sequence of GAM3770 RNA, herein designated GAM RNA, also designated SEQ ID:241.

Another function of GAM3770 is therefore inhibition of Syndecan 3 (n-syndecan) (SDC3, Accession NP_055469.1). Accordingly, utilities of GAM3770 include diagnosis, prevention and treatment of diseases and clinical conditions associated with SDC3.

Spondyloepiphyseal dysplasia, late (SEDL, Accession NP_055378.1) is another GAM3770 target gene, herein designated TARGET GENE. SEDL BINDING SITE is a target binding site found in the 5' untranslated region of mRNA encoded by SEDL, corresponding to a target binding site such as BINDING SITE I, BINDING SITE II or BINDING SITE III of FIG. 8. Table 4 illustrates the complementarity of the nucleotide sequences of SEDL BINDING SITE, designated SEQ ID:1404, to the nucleotide sequence of GAM3770 RNA, herein designated GAM RNA, also designated SEQ ID:281.

Another function of GAM3770 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM3770 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. SIT (Accession NP_055265.1) is another GAM3770 target gene, herein designated TARGET GENE. SIT BINDING SITE is a target binding site found in the 3' untranslated region of mRNA encoded by SIT, corresponding to a target binding site such as BINDING SITE I, BINDING SITE II or BINDING SITE III of FIG. 8. Table 4 illustrates the complementarity of the nucleotide sequences of SIT BINDING SITE, designated SEQ ID:13417, to the nucleotide sequence of GAM3770 RNA, herein designated GAM RNA, also designated SEQ ID:241.

Another function of GAM3770 is therefore inhibition of SIT (Accession NP_055265.1), a gene which recruits tyrosine phosphatase SHP2 to the cell membrane. Accordingly, utilities of GAM3770 include diagnosis, prevention and treatment of diseases and clinical conditions associated with SIT.

The function of SIT and its association with various diseases and clinical conditions, has been established by previous studies, as described hereinabove with reference to GAM144.1. Solute carrier family 2 (facilitated glucose transporter), member 10 (SLC2A10, Accession NP_110404.1) is another GAM3770 target gene, herein designated TARGET GENE. SLC2A10 BINDING SITE is a target binding site found in the 3' untranslated region of mRNA encoded by SLC2A10, corresponding to a target binding site such as BINDING SITE I, BINDING SITE II or BINDING SITE III of FIG. 8. Table 4 illustrates the complementarity of the nucleotide sequences of SLC2A10 BINDING SITE, designated SEQ ID:11011, to the nucleotide sequence of GAM3770 RNA, herein designated GAM RNA, also designated SEQ ID:281.

Another function of GAM3770 is therefore inhibition of Solute carrier family 2 (facilitated glucose transporter), member 10 (SLC2A10, Accession NP_110404.1). Accordingly, utilities of GAM3770 include diagnosis, prevention and treatment of diseases and clinical conditions associated with SLC2A10.

Solute carrier family 2 (facilitated glucose transporter), member 6 (SLC2A6, Accession NP_060055.1) is another GAM3770 target gene, herein designated TARGET GENE. SLC2A6 BINDING SITE is a target binding site found in the 3' untranslated region of mRNA encoded by SLC2A6, corresponding to a target binding site such as BINDING SITE I, BINDING SITE II or BINDING SITE III of FIG. 8. Table 4 illustrates the complementarity of the nucleotide sequences of SLC2A6 BINDING SITE, designated SEQ ID:10319, to the nucleotide sequence of GAM3770 RNA, herein designated GAM RNA, also designated SEQ ID:241.

Another function of GAM3770 is therefore inhibition of Solute carrier family 2 (facilitated glucose transporter), member 6 (SLC2A6, Accession NP_060055.1). Accordingly, utilities of GAM3770 include diagnosis, prevention and treatment of diseases and clinical conditions associated with SLC2A6.

Smith-magenis syndrome chromosome region, candidate 5 (SMCR5, Accession NP_658987.1) is another GAM3770 target gene, herein designated TARGET GENE. SMCR5 BINDING SITE is a target binding site found in the 3' untranslated region of mRNA encoded by SMCR5, corresponding to a target binding site such as BINDING SITE I, BINDING SITE II or BINDING SITE III of FIG. 8. Table 4 illustrates the complementarity of the nucleotide sequences of SMCR5 BINDING SITE, designated SEQ ID:20071, to the nucleotide sequence of GAM3770 RNA, herein designated GAM RNA, also designated SEQ ID:281.

Another function of GAM3770 is therefore inhibition of Smith-magenis syndrome chromosome region, candidate 5 (SMCR5, Accession NP_658987.1). Accordingly, utilities of GAM3770 include diagnosis, prevention and treatment of diseases and clinical conditions associated with SMCR5.

Survival of motor neuron 1, telomeric (SMN1, Accession NP_000335.1) is another GAM3770 target gene, herein designated TARGET GENE. SMN1 BINDING SITE is a target binding site found in the 5' untranslated region of multiple transcripts of mRNA encoded by SMN1, corresponding to a target binding site such as BINDING SITE I, BINDING SITE II or BINDING SITE III of FIG. 8. Table 4 illustrates the complementarity of the nucleotide sequences of SMN1 BINDING SITE, designated SEQ ID:3206, to the nucleotide sequence of GAM3770 RNA, herein designated GAM RNA, also designated SEQ ID:241.

Another function of GAM3770 is therefore inhibition of Survival of motor neuron 1, telomeric (SMN1, Accession NP_000335.1), a gene which plays an essential role in spliceosomal snrnp assembly in the cytoplasm and therefore is associated with Spinal muscular atrophy, type i, ii,iii. Accordingly, utilities of GAM3770 include diagnosis, prevention and treatment of Spinal muscular atrophy, type i, ii,iii, and of other diseases and clinical conditions associated with SMN1.

The function of SMN1 and its association with various diseases and clinical conditions, has been established by previous studies, as described hereinabove with reference to GAM148.2. Survival of motor neuron 1, telomeric (SMN1, Accession NP_075012.1) is another GAM3770 target gene, herein designated TARGET GENE. SMN1 BINDING SITE is a target binding site found in the 5' untranslated region of multiple transcripts of mRNA encoded by SMN1, corresponding to a target binding site such as BINDING SITE I, BINDING SITE II or BINDING SITE III of FIG. 8. Table 4 illustrates the complementarity of the nucleotide sequences of SMN1 BINDING SITE, designated SEQ ID:3206, to the nucleotide sequence of GAM3770 RNA, herein designated GAM RNA, also designated SEQ ID:241.

Another function of GAM3770 is therefore inhibition of Survival of motor neuron 1, telomeric (SMN1, Accession NP_075012.1), a gene which plays an essential role in spliceosomal snrnp assembly in the cytoplasm and therefore is associated with Spinal muscular atrophy, type i, ii,iii. Accordingly, utilities of GAM3770 include diagnosis, prevention and treatment of Spinal muscular atrophy, type i, ii,iii, and of other diseases and clinical conditions associated with SMN1.

The function of SMN1 and its association with various diseases and clinical conditions, has been established by previous studies, as described hereinabove with reference to GAM148.2. Survival of motor neuron 2, centromeric (SMN2, Accession NP_075013.1) is another GAM3770 target gene, herein designated TARGET GENE. SMN2 BINDING SITE is a target binding site found in the 5' untranslated region of multiple transcripts of mRNA encoded by SMN2, corresponding to a target binding site such as BINDING SITE I, BINDING SITE II or BINDING SITE III of FIG. 8. Table 4 illustrates the complementarity of the nucleotide sequences of SMN2 BINDING SITE, designated SEQ ID:3206, to the nucleotide sequence of GAM3770 RNA, herein designated GAM RNA, also designated SEQ ID:241.

Another function of GAM3770 is therefore inhibition of Survival of motor neuron 2, centromeric (SMN2, Accession NP_075013.1). Accordingly, utilities of GAM3770 include diagnosis, prevention and treatment of diseases and clinical conditions associated with SMN2.

Survival of motor neuron 2, centromeric (SMN2, Accession NP_059107.1) is another GAM3770 target gene, herein designated TARGET GENE. SMN2 BINDING SITE is a target binding site found in the 5' untranslated region of multiple transcripts of mRNA encoded by SMN2, corresponding to a target binding site such as BINDING SITE I, BINDING SITE II or BINDING SITE III of FIG. 8. Table 4 illustrates the complementarity of the nucleotide sequences of SMN2 BINDING SITE, designated SEQ ID:3206, to the nucleotide sequence of GAM3770 RNA, herein designated GAM RNA, also designated SEQ ID:241.

Another function of GAM3770 is therefore inhibition of Survival of motor neuron 2, centromeric (SMN2, Accession NP_059107.1). Accordingly, utilities of GAM3770 include diagnosis, prevention and treatment of diseases and clinical conditions associated with SMN2.

Survival of motor neuron 2, centromeric (SMN2, Accession NP_075015.1) is another GAM3770 target gene, herein designated TARGET GENE. SMN2 BINDING SITE is a target binding site found in the 5' untranslated region of multiple transcripts of mRNA encoded by SMN2, corresponding to a target binding site such as BINDING SITE I, BINDING SITE II or BINDING SITE III of FIG. 8. Table 4 illustrates the complementarity of the nucleotide sequences of SMN2 BINDING SITE, designated SEQ ID:3206, to the nucleotide sequence of GAM3770 RNA, herein designated GAM RNA, also designated SEQ ID:241.

Another function of GAM3770 is therefore inhibition of Survival of motor neuron 2, centromeric (SMN2, Accession NP_075015.1). Accordingly, utilities of GAM3770 include diagnosis, prevention and treatment of diseases and clinical conditions associated with SMN2.

Survival of motor neuron 2, centromeric (SMN2, Accession NP_075014.1) is another GAM3770 target gene, herein designated TARGET GENE. SMN2 BINDING SITE is a target binding site found in the 5' untranslated region of multiple transcripts of mRNA encoded by SMN2, corresponding to a target binding site such as BINDING SITE I, BINDING SITE II or BINDING SITE III of FIG. 8. Table 4 illustrates the complementarity of the nucleotide sequences of SMN2 BINDING SITE, designated SEQ ID:3206, to the nucleotide sequence of GAM3770 RNA, herein designated GAM RNA, also designated SEQ ID:241.

Another function of GAM3770 is therefore inhibition of Survival of motor neuron 2, centromeric (SMN2, Accession NP_075014.1). Accordingly, utilities of GAM3770 include diagnosis, prevention and treatment of diseases and clinical conditions associated with SMN2.

Serine protease inhibitor-like, with kunitz and wap domains 1 (eppin) (SPINLW1, Accession NP_852479.1) is another GAM3770 target gene, herein designated TARGET GENE. SPINLW1 BINDING SITE is a target binding site found in the 5' untranslated region of multiple transcripts of mRNA encoded by SPINLW1, corresponding to a target binding site such as BINDING SITE I, BINDING SITE II or BINDING SITE III of FIG. 8. Table 4 illustrates the complementarity of the nucleotide sequences of SPINLW1 BINDING SITE, designated SEQ ID:18980, to the nucleotide sequence of GAM3770 RNA, herein designated GAM RNA, also designated SEQ ID:281.

Another function of GAM3770 is therefore inhibition of Serine protease inhibitor-like, with kunitz and wap domains 1 (eppin) (SPINLW1, Accession NP_852479.1). Accordingly, utilities of GAM3770 include diagnosis, prevention and treatment of diseases and clinical conditions associated with SPINLW1.

Sarcalumenin (SRL, Accession XP_064152.3) is another GAM3770 target gene, herein designated TARGET GENE. SRL BINDING SITE is a target binding site found in the 3' untranslated region of mRNA encoded by SRL, corresponding to a target binding site such as BINDING SITE I, BINDING SITE II or BINDING SITE III of FIG. 8. Table 4 illustrates the complementarity of the nucleotide sequences of SRL BINDING SITE, designated SEQ ID:10846, to the nucleotide sequence of GAM3770 RNA, herein designated GAM RNA, also designated SEQ ID:281.

Another function of GAM3770 is therefore inhibition of Sarcalumenin (SRL, Accession XP_064152.3). Accordingly, utilities of GAM3770 include diagnosis, prevention and treatment of diseases and clinical conditions associated with SRL.

Serine/threonine kinase 29 (STK29, Accession NP_003948.1) is another GAM3770 target gene, herein designated TARGET GENE. STK29 BINDING SITE is a target binding site found in the 3' untranslated region of mRNA encoded by STK29, corresponding to a target binding site such as BINDING SITE I, BINDING SITE II or BINDING SITE III of FIG. 8. Table 4 illustrates the complementarity of the nucleotide sequences of STK29 BINDING SITE, designated SEQ ID:19087, to the nucleotide sequence of GAM3770 RNA, herein designated GAM RNA, also designated SEQ ID:241.

Another function of GAM3770 is therefore inhibition of Serine/threonine kinase 29 (STK29, Accession NP_003948.1). Accordingly, utilities of GAM3770 include diagnosis, prevention and treatment of diseases and clinical conditions associated with STK29.

SULF1 (Accession NP_055985.1) is another GAM3770 target gene, herein designated TARGET GENE. SULF1 BINDING SITE is a target binding site found in the 3' untranslated region of mRNA encoded by SULF1, corresponding to a target binding site such as BINDING SITE I, BINDING SITE II or BINDING SITE III of FIG. 8. Table 4 illustrates the complementarity of the nucleotide sequences of SULF1 BINDING SITE, designated SEQ ID:12171, to the nucleotide sequence of GAM3770 RNA, herein designated GAM RNA, also designated SEQ ID:241.

Another function of GAM3770 is therefore inhibition of SULF1 (Accession NP_055985.1). Accordingly, utilities of GAM3770 include diagnosis, prevention and treatment of diseases and clinical conditions associated with SULF1.

Surfeit 4 (SURF4, Accession NP_149351.1) is another GAM3770 target gene, herein designated TARGET GENE. SURF4 BINDING SITE is a target binding site found in the 3' untranslated region of mRNA encoded by SURF4, corresponding to a target binding site such as BINDING SITE I, BINDING SITE II or BINDING SITE III of FIG. 8. Table 4 illustrates the complementarity of the nucleotide sequences of SURF4 BINDING SITE, designated SEQ ID:547, to the nucleotide sequence of GAM3770 RNA, herein designated GAM RNA, also designated SEQ ID:281.

Another function of GAM3770 is therefore inhibition of Surfeit 4 (SURF4, Accession NP_149351.1), a gene which is a conserved integral membrane protein containing multiple putative transmembrane regions. Accordingly, utilities of GAM3770 include diagnosis, prevention and treatment of diseases and clinical conditions associated with SURF4.

The function of SURF4 and its association with various diseases and clinical conditions, has been established by previous studies, as described hereinabove with reference to GAM329.1. Transcription elongation factor a (sii), 1 (TCEA1, Accession NP_006747.1) is another GAM3770 target gene, herein designated TARGET GENE. TCEA1 BINDING SITE is a target binding site found in the 3' untranslated region of mRNA encoded by TCEA1, corresponding to a target binding site such as BINDING SITE I, BINDING SITE II or BINDING SITE III of FIG. 8. Table 4 illustrates the complementarity of the nucleotide sequences of TCEA1 BINDING SITE, designated SEQ ID:10324, to the nucleotide sequence of GAM3770 RNA, herein designated GAM RNA, also designated SEQ ID:241.

Another function of GAM3770 is therefore inhibition of Transcription elongation factor a (sii), 1 (TCEA1, Accession NP_006747.1), a gene which helps RNA polymerase II to transcribe past blockages. Accordingly, utilities of GAM3770 include diagnosis, prevention and treatment of diseases and clinical conditions associated with TCEA1.

The function of TCEA1 and its association with various diseases and clinical conditions, has been established by previous studies, as described hereinabove with reference to GAM259.1. Thymidine kinase 1, soluble (TK1, Accession NP_003249.1) is another GAM3770 target gene, herein designated TARGET GENE. TK1 BINDING SITE is a target binding site found in the 3' untranslated region of mRNA encoded by TK1, corresponding to a target binding site such as BINDING SITE I, BINDING SITE II or BINDING SITE III of FIG. 8. Table 4 illustrates the complementarity of the nucleotide sequences of TK1 BINDING SITE, designated SEQ ID:11195, to the nucleotide sequence of GAM3770 RNA, herein designated GAM RNA, also designated SEQ ID:241.

Another function of GAM3770 is therefore inhibition of Thymidine kinase 1, soluble (TK1, Accession NP_003249.1). Accordingly, utilities of GAM3770 include diagnosis, prevention and treatment of diseases and clinical conditions associated with TK1.

TMPRSS6 (Accession NP_694564.2) is another GAM3770 target gene, herein designated TARGET GENE. TMPRSS6 BINDING SITE is a target binding site found in the 3' untranslated region of multiple transcripts of mRNA encoded by TMPRSS6, corresponding to a target binding site such as BINDING SITE I, BINDING SITE II or BINDING SITE III of FIG. 8. Table 4 illustrates the complementarity of the nucleotide sequences of TMPRSS6 BINDING SITE, designated SEQ ID:18491, to the nucleotide sequence of GAM3770 RNA, herein designated GAM RNA, also designated SEQ ID:281.

Another function of GAM3770 is therefore inhibition of TMPRSS6 (Accession NP_694564.2). Accordingly, utilities of GAM3770 include diagnosis, prevention and treatment of diseases and clinical conditions associated with TMPRSS6.

Tumor necrosis factor receptor superfamily, member 1b (TNFRSF1B, Accession NP_001057.1) is another GAM3770 target gene, herein designated TARGET GENE. TNFRSF1B BINDING SITE is a target binding site found in the 3' untranslated region of mRNA encoded by TNFRSF1B, corresponding to a target binding site such as BINDING SITE I, BINDING SITE II or BINDING SITE III of FIG. 8. Table 4 illustrates the complementarity of the nucleotide sequences of TNFRSF1B BINDING SITE, designated SEQ ID:4544, to the nucleotide sequence of GAM3770 RNA, herein designated GAM RNA, also designated SEQ ID:281.

Another function of GAM3770 is therefore inhibition of Tumor necrosis factor receptor superfamily, member 1b (TNFRSF1B, Accession NP_001057.1), a gene which mediates proinflammatory cellular responses. and therefore may be associated with Familial combined hyperlipidemia. Accordingly, utilities of GAM3770 include diagnosis, prevention and treatment of Familial combined hyperlipidemia, and of other diseases and clinical conditions associated with TNFRSF1B.

The function of TNFRSF1B and its association with various diseases and clinical conditions, has been established by previous studies, as described hereinabove with reference to GAM72.1. Topoisomerase (dna) i (TOP1, Accession NP_003277.1) is another GAM3770 target gene, herein designated TARGET GENE. TOP1 BINDING SITE is a target binding site found in the 5' untranslated region of mRNA encoded by TOP1, corresponding to a target binding site such as BINDING SITE I, BINDING SITE II or BINDING SITE III of FIG. 8. Table 4 illustrates the complementarity of the nucleotide sequences of TOP1 BINDING SITE, designated SEQ ID:17569, to the nucleotide sequence of GAM3770 RNA, herein designated GAM RNA, also designated SEQ ID:241.

Another function of GAM3770 is therefore inhibition of Topoisomerase (dna) i (TOP1, Accession NP_003277.1). Accordingly, utilities of GAM3770 include diagnosis, prevention and treatment of diseases and clinical conditions associated with TOP1.

Transient receptor potential cation channel, subfamily m, member 2 (TRPM2, Accession NP_003298.1) is another GAM3770 target gene, herein designated TARGET GENE. TRPM2 BINDING SITE is a target binding site found in the 3' untranslated region of mRNA encoded by TRPM2, corresponding to a target binding site such as BINDING SITE I, BINDING SITE II or BINDING SITE III of FIG. 8. Table 4 illustrates the complementarity of the nucleotide sequences of TRPM2 BINDING SITE, designated SEQ ID:16176, to the nucleotide sequence of GAM3770 RNA, herein designated GAM RNA, also designated SEQ ID:281.

Another function of GAM3770 is therefore inhibition of Transient receptor potential cation channel, subfamily m, member 2 (TRPM2, Accession NP_003298.1), a gene which may be a calcium channel. Accordingly, utilities of GAM3770 include diagnosis, prevention and treatment of diseases and clinical conditions associated with TRPM2.

The function of TRPM2 and its association with various diseases and clinical conditions, has been established by previous studies, as described hereinabove with reference to GAM335.1. TSAP6 (Accession NP_060704.1) is another GAM3770 target gene, herein designated TARGET GENE. TSAP6 BINDING SITE is a target binding site found in the 3' untranslated region of mRNA encoded by TSAP6, corresponding to a target binding site such as BINDING SITE I, BINDING SITE II or BINDING SITE III of FIG. 8. Table 4 illustrates the complementarity of the nucleotide sequences of TSAP6 BINDING SITE, designated SEQ ID:17391, to the nucleotide sequence of GAM3770 RNA, herein designated GAM RNA, also designated SEQ ID:241.

Another function of GAM3770 is therefore inhibition of TSAP6 (Accession NP_060704.1). Accordingly, utilities of GAM3770 include diagnosis, prevention and treatment of diseases and clinical conditions associated with TSAP6.

TULP4 (Accession NP_064630.1) is another GAM3770 target gene, herein designated TARGET GENE. TULP4 BINDING SITE is a target binding site found in the 3' untranslated region of mRNA encoded by TULP4, corresponding to a target binding site such as BINDING SITE I, BINDING SITE II or BINDING SITE III of FIG. 8. Table 4 illustrates the complementarity of the nucleotide sequences of TULP4 BINDING SITE, designated SEQ ID:5367, to the nucleotide sequence of GAM3770 RNA, herein designated GAM RNA, also designated SEQ ID:241.

Another function of GAM3770 is therefore inhibition of TULP4 (Accession NP_064630.1). Accordingly, utilities of GAM3770 include diagnosis, prevention and treatment of diseases and clinical conditions associated with TULP4.

Thioredoxin-like 2 (TXNL2, Accession NP_006532.1) is another GAM3770 target gene, herein designated TARGET GENE. TXNL2 BINDING SITE is a target binding site found in the 3' untranslated region of mRNA encoded by TXNL2, corresponding to a target binding site such as BINDING SITE I, BINDING SITE II or BINDING SITE III of FIG. 8. Table 4 illustrates the complementarity of the nucleotide sequences of TXNL2 BINDING SITE, designated SEQ ID:13570, to the nucleotide sequence of GAM3770 RNA, herein designated GAM RNA, also designated SEQ ID:281.

Another function of GAM3770 is therefore inhibition of Thioredoxin-like 2 (TXNL2, Accession NP_006532.1). Accordingly, utilities of GAM3770 include diagnosis, prevention and treatment of diseases and clinical conditions associated with TXNL2.

Ubiquitin-conjugating enzyme e2g 1 (ubc7 homolog, c. elegans) (UBE2G1, Accession NP_003333.1) is another GAM3770 target gene, herein designated TARGET GENE. UBE2G1 BINDING SITE is a target binding site found in the 3' untranslated region of mRNA encoded by UBE2G1, corresponding to a target binding site such as BINDING SITE I, BINDING SITE II or BINDING SITE III of FIG. 8. Table 4 illustrates the complementarity of the nucleotide sequences of UBE2G1 BINDING SITE, designated SEQ ID:14637, to the nucleotide sequence of GAM3770 RNA, herein designated GAM RNA, also designated SEQ ID:281.

Another function of GAM3770 is therefore inhibition of Ubiquitin-conjugating enzyme e2g 1 (ubc7 homolog, c. elegans) (UBE2G1, Accession NP_003333.1). Accordingly, utilities of GAM3770 include diagnosis, prevention and treatment of diseases and clinical conditions associated with UBE2G1.

Ubiquitination factor e4a (ufd2 homolog, yeast) (UBE4A, Accession NP_004779.1) is another GAM3770 target gene, herein designated TARGET GENE. UBE4A BINDING SITE is a target binding site found in the 3' untranslated region of mRNA encoded by UBE4A, corresponding to a target binding site such as BINDING SITE I, BINDING SITE II or BINDING SITE III of FIG. 8. Table 4 illustrates the complementarity of the nucleotide sequences of UBE4A BINDING SITE, designated SEQ ID:5235, to the nucleotide sequence of GAM3770 RNA, herein designated GAM RNA, also designated SEQ ID:241.

Another function of GAM3770 is therefore inhibition of Ubiquitination factor e4a (ufd2 homolog, yeast) (UBE4A, Accession NP_004779.1), a gene which binds to the ubiquitin moieties of preformed conjugates and catalyzes ubiquitin chain assembly in conjunction with E1, E2, and E3. Accordingly, utilities of GAM3770 include diagnosis, prevention and treatment of diseases and clinical conditions associated with UBE4A.

The function of UBE4A and its association with various diseases and clinical conditions, has been established by previous studies, as described hereinabove with reference to GAM139.2. Ubiquitin carboxyl-terminal esterase l1 (ubiquitin thiolesterase) (UCHL1, Accession NP_004172.2) is another GAM3770 target gene, herein designated TARGET GENE. UCHL1 BINDING SITE is a target binding site found in the 5' untranslated region of mRNA encoded by UCHL1, corresponding to a target binding site such as BINDING SITE I, BINDING SITE II or BINDING SITE III of FIG. 8. Table 4 illustrates the complementarity of the nucleotide sequences of UCHL1 BINDING SITE, designated SEQ ID:5541, to the nucleotide sequence of GAM3770 RNA, herein designated GAM RNA, also designated SEQ ID:281.

Another function of GAM3770 is therefore inhibition of Ubiquitin carboxyl-terminal esterase l1 (ubiquitin thiolesterase) (UCHL1, Accession NP_004172.2), a gene which is involved both in the processing of ubiquitin precursors and of ubiquinated proteins. and therefore may be associated with Parkinson disease. Accordingly, utilities of GAM3770 include diagnosis, prevention and treatment of Parkinson disease, and of other diseases and clinical conditions associated with UCHL1.

The function of UCHL1 and its association with various diseases and clinical conditions, has been established by previous studies, as described hereinabove with reference to GAM2745.2. UPLC1 (Accession NP_060177.2) is another GAM3770 target gene, herein designated TARGET GENE. UPLC1 BINDING SITE is a target binding site found in the 3' untranslated region of mRNA encoded by UPLC1, corresponding to a target binding site such as BINDING SITE I, BINDING SITE II or BINDING SITE III of FIG. 8. Table 4 illustrates the complementarity of the nucleotide sequences of UPLC1 BINDING SITE, designated SEQ ID:10056, to the nucleotide sequence of GAM3770 RNA, herein designated GAM RNA, also designated SEQ ID:281.

Another function of GAM3770 is therefore inhibition of UPLC1 (Accession NP_060177.2). Accordingly, utilities of GAM3770 include diagnosis, prevention and treatment of diseases and clinical conditions associated with UPLC1.

Vasoactive intestinal peptide receptor 1 (VIPR1, Accession NP_004615.2) is another GAM3770 target gene, herein designated TARGET GENE. VIPR1 BINDING SITE is a target binding site found in the 3' untranslated region of mRNA encoded by VIPR1, corresponding to a target binding site such as BINDING SITE I, BINDING SITE II or BINDING SITE III of FIG. 8. Table 4 illustrates the complementarity of the nucleotide sequences of VIPR1 BINDING SITE, designated SEQ ID:12543, to the nucleotide sequence of GAM3770 RNA, herein designated GAM RNA, also designated SEQ ID:241.

Another function of GAM3770 is therefore inhibition of Vasoactive intestinal peptide receptor 1 (VIPR1, Accession NP_004615.2), a gene which binds vip and is mediated by g proteins which activate adenylyl cyclase. Accordingly, utilities of GAM3770 include diagnosis, prevention and treatment of diseases and clinical conditions associated with VIPR1.

The function of VIPR1 and its association with various diseases and clinical conditions, has been established by previous studies, as described hereinabove with reference to GAM47.1. Von willebrand factor (VWF, Accession NP_000543.1) is another GAM3770 target gene, herein designated TARGET GENE. VWF BINDING SITE is a target binding site found in the 3' untranslated region of mRNA encoded by VWF, corresponding to a target binding site such as BINDING SITE I, BINDING SITE II or BINDING SITE III of FIG. 8. Table 4 illustrates the complementarity of the nucleotide sequences of VWF BINDING SITE, designated SEQ ID:11547, to the nucleotide sequence of GAM3770 RNA, herein designated GAM RNA, also designated SEQ ID:281.

Another function of GAM3770 is therefore inhibition of Von willebrand factor (VWF, Accession NP_000543.1). Accordingly, utilities of GAM3770 include diagnosis, prevention and treatment of diseases and clinical conditions associated with VWF.

YAP (Accession NP_620830.1) is another GAM3770 target gene, herein designated TARGET GENE. YAP BINDING SITE is a target binding site found in the 3' untranslated region of multiple transcripts of mRNA encoded by YAP, corresponding to a target binding site such as BINDING SITE I, BINDING SITE II or BINDING SITE III of FIG. 8. Table 4 illustrates the complementarity of the nucleotide sequences of YAP BINDING SITE, designated SEQ ID:18388, to the nucleotide sequence of GAM3770 RNA, herein designated GAM RNA, also designated SEQ ID:281.

Another function of GAM3770 is therefore inhibition of YAP (Accession NP_620830.1). Accordingly, utilities of GAM3770 include diagnosis, prevention and treatment of diseases and clinical conditions associated with YAP.

YAP (Accession NP_620829.1) is another GAM3770 target gene, herein designated TARGET GENE. YAP BINDING SITE is a target binding site found in the 3' untranslated region of multiple transcripts of mRNA encoded by YAP, corresponding to a target binding site such as BINDING SITE I, BINDING SITE II or BINDING SITE III of FIG. 8. Table 4 illustrates the complementarity of the nucleotide sequences of YAP BINDING SITE, designated SEQ ID:18388, to the nucleotide sequence of GAM3770 RNA, herein designated GAM RNA, also designated SEQ ID:281.

Another function of GAM3770 is therefore inhibition of YAP (Accession NP_620829.1). Accordingly, utilities of GAM3770 include diagnosis, prevention and treatment of diseases and clinical conditions associated with YAP.

YAP (Accession NP_620832.1) is another GAM3770 target gene, herein designated TARGET GENE. YAP BINDING SITE is a target binding site found in the 3' untranslated region of multiple transcripts of mRNA encoded by YAP, corresponding to a target binding site such as BINDING SITE I, BINDING SITE II or BINDING SITE III of FIG. 8. Table 4 illustrates the complementarity of the nucleotide sequences of YAP BINDING SITE, designated SEQ ID:18388, to the nucleotide sequence of GAM3770 RNA, herein designated GAM RNA, also designated SEQ ID:281.

Another function of GAM3770 is therefore inhibition of YAP (Accession NP_620832.1). Accordingly, utilities of GAM3770 include diagnosis, prevention and treatment of diseases and clinical conditions associated with YAP.

YAP (Accession NP_060723.2) is another GAM3770 target gene, herein designated TARGET GENE. YAP BINDING SITE is a target binding site found in the 3' untranslated region of multiple transcripts of mRNA encoded by YAP, corresponding to a target binding site such as BINDING SITE I, BINDING SITE II or BINDING SITE III of FIG. 8. Table 4 illustrates the complementarity of the nucleotide sequences of YAP BINDING SITE, designated SEQ ID:18388, to the nucleotide sequence of GAM3770 RNA, herein designated GAM RNA, also designated SEQ ID:281.

Another function of GAM3770 is therefore inhibition of YAP (Accession NP_060723.2). Accordingly, utilities of GAM3770 include diagnosis, prevention and treatment of diseases and clinical conditions associated with YAP.

YAP (Accession NP_620831.1) is another GAM3770 target gene, herein designated TARGET GENE. YAP BINDING SITE is a target binding site found in the 3' untranslated region of multiple transcripts of mRNA encoded by YAP, corresponding to a target binding site such as BINDING SITE I, BINDING SITE II or BINDING SITE III of FIG. 8. Table 4 illustrates the complementarity of the nucleotide sequences of YAP BINDING SITE, designated SEQ ID:18388, to the nucleotide sequence of GAM3770 RNA, herein designated GAM RNA, also designated SEQ ID:281.

Another function of GAM3770 is therefore inhibition of YAP (Accession NP_620831.1). Accordingly, utilities of GAM3770 include diagnosis, prevention and treatment of diseases and clinical conditions associated with YAP.

ZBED4 (Accession NP_055653.1) is another GAM3770 target gene, herein designated TARGET GENE. ZBED4 BINDING SITE is a target binding site found in the 3' untranslated region of mRNA encoded by ZBED4, corresponding to a target binding site such as BINDING SITE I, BINDING SITE II or BINDING SITE III of FIG. 8. Table 4 illustrates the complementarity of the nucleotide sequences of ZBED4 BINDING SITE, designated SEQ ID:2237, to the nucleotide sequence of GAM3770 RNA, herein designated GAM RNA, also designated SEQ ID:241.

Another function of GAM3770 is therefore inhibition of ZBED4 (Accession NP_055653.1). Accordingly, utilities of GAM3770 include diagnosis, prevention and treatment of diseases and clinical conditions associated with ZBED4.

Zinc finger protein 36, c3h type-like 2 (ZFP36L2, Accession NP_008818.3) is another GAM3770 target gene, herein designated TARGET GENE. ZFP36L2 BINDING SITE is a target binding site found in the 5' untranslated region of mRNA encoded by ZFP36L2, corresponding to a target binding site such as BINDING SITE I, BINDING SITE II or BINDING SITE III of FIG. 8. Table 4 illustrates the complementarity of the nucleotide sequences of ZFP36L2 BINDING SITE, designated SEQ ID:14047, to the nucleotide sequence of GAM3770 RNA, herein designated GAM RNA, also designated SEQ ID:241.

Another function of GAM3770 is therefore inhibition of Zinc finger protein 36, c3h type-like 2 (ZFP36L2, Accession NP_008818.3). Accordingly, utilities of GAM3770 include diagnosis, prevention and treatment of diseases and clinical conditions associated with ZFP36L2.

FIG. 8 further provides a conceptual description of a novel bioinformatically detected of the present invention, referred to here as Genomic Address Messenger 5227 (GAM5227), which modulates expression of respective target genes thereof, the function and utility of which target genes is known in the art.

GAM5227 is a novel bioinformatically detected regulatory, non protein coding, micro RNA (miRNA) gene. The method by which GAM5227 was detected is described hereinabove with reference to FIGS. 8-15.

GAM5227 gene, herein designated GAM GENE, and GAM5227 target gene, herein designated TARGET GENE, are human genes contained in the human genome.

GAM5227 gene encodes a GAM5227 precursor RNA, herein designated GAM PRECURSOR RNA. Similar to other miRNA genes, and unlike most ordinary genes, GAM5227 precursor RNA does not encode a protein. A nucleotide sequence identical or highly similar to the nucleotide sequence of GAM5227 precursor RNA is designated SEQ ID:162, and is provided hereinbelow with reference to the sequence listing part. Nucleotide sequence SEQ ID:162 is located at position 200067225 relative to chromosome 1.

GAM5227 precursor RNA folds onto itself, forming GAM5227 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM5227 precursor RNA folds onto itself, forming GAM5227 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM5227 precursor RNA, designated SEQ-ID:162, and a schematic representation of a predicted secondary folding of GAM5227 folded precursor RNA are further described with reference to Table 2, hereby incorporated by reference.

An enzyme complex designated DICER COMPLEX, 'dices' the GAM5227 folded precursor RNA into GAM5227 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM5227 RNA is designated SEQ ID:299, and is provided hereinbelow with references to the sequence listing part and Table 3, hereby incorporated by reference.

GAM5227 target gene, herein designated TARGET GENE, encodes a corresponding messenger RNA, GAM5227 target RNA, herein designated GAM TARGET RNA. GAM5227 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM5227 RNA, herein designated GAM RNA, binds complementarily to one or more target binding sites located in untranslated regions of GAM5227 target RNA, herein designated GAM TARGET RNA. This complementary binding is due to the fact that the nucleotide sequence of GAM5227 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM5227 RNA may have a different number of target binding sites in untranslated regions of a GAM5227 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM5227 RNA, herein designated GAM RNA, to target binding sites on GAM5227 target RNA, herein designated GAM TARGET RNA, such as BINDING SITE I, BINDING SITE II and BINDING SITE III, inhibits translation of GAM5227 target RNA into GAM5227 target protein, herein designated GAM TARGET PROTEIN. GAM target protein is therefore outlined by a broken line.

It is appreciated that GAM5227 target gene, herein designated TARGET GENE, in fact represents a plurality of GAM5227 target genes. The mRNA of each one of this plurality of GAM5227 target genes comprises one or more target binding sites, each having a nucleotide sequence which is at least partly complementary to GAM5227 RNA, herein designated GAM RNA, and which when bound by GAM5227 RNA causes inhibition of translation of respective one or more GAM5227 target proteins.

It is further appreciated by one skilled in the art that the mode of translational inhibition illustrated by FIG. 8 with specific reference to translational inhibition exerted by GAM5227 gene, herein designated GAM GENE, on one or more GAM5227 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM5227 correlate with, and may be deduced from, the identity of the target genes which GAM5227 binds and inhibits, and the function of these target genes, as elaborated hereinbelow.

3PAP (Accession NP_061934.2) is a GAM5227 target gene, herein designated TARGET GENE. 3PAP BINDING SITE is a target binding site found in the 3' untranslated region of mRNA encoded by 3PAP, corresponding to a target binding site such as BINDING SITE I, BINDING SITE II or BINDING SITE III of FIG. 8. Table 4 illustrates the complementarity of the nucleotide sequences of 3PAP BINDING SITE, designated SEQ ID:18356, to the nucleotide sequence of GAM5227 RNA, herein designated GAM RNA, also designated SEQ ID:299.

A function of GAM5227 is therefore inhibition of 3PAP (Accession NP_061934.2). Accordingly, utilities of GAM5227 include diagnosis, prevention and treatment of diseases and clinical conditions associated with 3PAP.

Alpha-2-macroglobulin (A2M, Accession NP_000005.1) is another GAM5227 target gene, herein designated TARGET GENE. A2M BINDING SITE is a target binding site found in the 5' untranslated region of mRNA encoded by A2M, corresponding to a target binding site such as BINDING SITE I, BINDING SITE II or BINDING SITE III of FIG. 8. Table 4 illustrates the complementarity of the nucleotide sequences of A2M BINDING SITE, designated SEQ ID:1882, to the nucleotide sequence of GAM5227 RNA, herein designated GAM RNA, also designated SEQ ID:299.

Another function of GAM5227 is therefore inhibition of Alpha-2-macroglobulin (A2M, Accession NP_000005.1), a gene which inhibit all four classes of proteinases and therefore may be associated with Alzheimer disease. Accordingly, utilities of GAM5227 include diagnosis, prevention and treatment of Alzheimer disease, and of other diseases and clinical conditions associated with A2M.

The function of A2M and its association with various diseases and clinical conditions, has been established by previous studies, as described hereinabove with reference to GAM1653.1. Acetyl-coenzyme a synthetase 2 (amp forming)-like (ACAS2L, Accession NP_115890.2) is another GAM5227 target gene, herein designated TARGET GENE. ACAS2L BINDING SITE is a target binding site found in the 3' untranslated region of mRNA encoded by ACAS2L, corresponding to a target binding site such as BINDING SITE I, BINDING SITE II or BINDING SITE III of FIG. 8. Table 4 illustrates the complementarity of the nucleotide sequences of ACAS2L BINDING SITE, designated SEQ ID:4172, to the nucleotide sequence of GAM5227 RNA, herein designated GAM RNA, also designated SEQ ID:299.

Another function of GAM5227 is therefore inhibition of Acetyl-coenzyme a synthetase 2 (amp forming)-like (ACAS2L, Accession NP_115890.2). Accordingly, utilities of GAM5227 include diagnosis, prevention and treatment of diseases and clinical conditions associated with ACAS2L.

Acrosomal vesicle protein 1 (ACRV1, Accession NP_064497.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064497.1). Accordingly, utilities of GAM5227 include diagnosis, prevention and treatment of diseases and clinical conditions associated with ACRV1.

Acrosomal vesicle protein 1 (ACRV1, Accession NP_064495.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064495.1). Accordingly, utilities of GAM5227 include diagnosis, prevention and treatment of diseases and clinical conditions associated with ACRV1.

Acrosomal vesicle protein 1 (ACRV1, Accession NP_064499.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064499.1). Accordingly, utilities of GAM5227 include diagnosis, prevention and treatment of diseases and clinical conditions associated with ACRV1.

Acrosomal vesicle protein 1 (ACRV1, Accession NP_064454.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1

BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064454.1). Accordingly, utilities of GAM5227 include diagnosis, prevention and treatment of diseases and clinical conditions associated with ACRV1.

Acrosomal vesicle protein 1 (ACRV1, Accession NP_064496.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064496.1). Accordingly, utilities of GAM5227 include diagnosis, prevention and treatment of diseases and clinical conditions associated with ACRV1.

Acrosomal vesicle protein 1 (ACRV1, Accession NP_064500.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064500.1). Accordingly, utilities of GAM5227 include diagnosis, prevention and treatment of diseases and clinical conditions associated with ACRV1.

Acrosomal vesicle protein 1 (ACRV1, Accession NP_064492.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064492.1). Accordingly, utilities of GAM5227 include diagnosis, prevention and treatment of diseases and clinical conditions associated with ACRV1.

Acrosomal vesicle protein 1 (ACRV1, Accession NP_064494.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064494.1). Accordingly, utilities of GAM5227 include diagnosis, prevention and treatment of diseases and clinical conditions associated with ACRV1.

Acrosomal vesicle protein 1 (ACRV1, Accession NP_064498.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064498.1). Accordingly, utilities of GAM5227 include diagnosis, prevention and treatment of diseases and clinical conditions associated with ACRV1.

Acrosomal vesicle protein 1 (ACRV1, Accession NP_064493.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_064493.1). Accordingly, utilities of GAM5227 include diagnosis, prevention and treatment of diseases and clinical conditions associated with ACRV1.

Acrosomal vesicle protein 1 (ACRV1, Accession NP_001603.1) is another GAM5227 target gene, herein designated TARGET GENE. ACRV1 BINDING SITE is a target binding site found in the 3' untranslated region of multiple transcripts of mRNA encoded by ACRV1, corresponding to a target binding site such as BINDING SITE I, BINDING SITE II or BINDING SITE III of FIG. 8. Table 4 illustrates the complementarity of the nucleotide sequences of ACRV1 BINDING SITE, designated SEQ ID:14126, to the nucleotide sequence of GAM5227 RNA, herein designated GAM RNA, also designated SEQ ID:299.

Another function of GAM5227 is therefore inhibition of Acrosomal vesicle protein 1 (ACRV1, Accession NP_001603.1). Accordingly, utilities of GAM5227 include diagnosis, prevention and treatment of diseases and clinical conditions associated with ACRV1.

Arp1 actin-related protein 1 homolog a, centractin alpha (yeast) (ACTR1A, Accession NP_005727.1) is another GAM5227 target gene, herein designated TARGET GENE. ACTR1A BINDING SITE is a target binding site found in the 3' untranslated region of mRNA encoded by ACTR1A, corresponding to a target binding site such as BINDING SITE I, BINDING SITE II or BINDING SITE III of FIG. 8. Table 4 illustrates the complementarity of the nucleotide sequences of ACTR1A BINDING SITE, designated SEQ ID:3042, to the nucleotide sequence of GAM5227 RNA, herein designated GAM RNA, also designated SEQ ID:299.

Another function of GAM5227 is therefore inhibition of Arp1 actin-related protein 1 homolog a, centractin alpha (yeast) (ACTR1A, Accession NP_005727.1). Accordingly, utilities of GAM5227 include diagnosis, prevention and treatment of diseases and clinical conditions associated with ACTR1A.

Angiomotin like 1 (AMOTL1, Accession NP_570899.1) is another GAM5227 target gene, herein designated TARGET GENE. AMOTL1 BINDING SITE is a target binding site found in the 3' untranslated region of mRNA encoded by AMOTL1, corresponding to a target binding site such as BINDING SITE I, BINDING SITE II or BINDING SITE III of FIG. 8. Table 4 illustrates the complementarity of the nucleotide sequences of AMOTL1 BINDING SITE, designated SEQ ID:11813, to the nucleotide sequence of GAM5227 RNA, herein designated GAM RNA, also designated SEQ ID:299.

Another function of GAM5227 is therefore inhibition of Angiomotin like 1 (AMOTL1, Accession NP_570899.1). Accordingly, utilities of GAM5227 include diagnosis, prevention and treatment of diseases and clinical conditions associated with AMOTL1.

Adenosine monophosphate deaminase 2 (isoform 1) (AMPD2, Accession NP_004028.3) is another GAM5227 target gene, herein designated TARGET GENE. AMPD2 BINDING SITE is a target binding site found in the 3' untranslated region of mRNA encoded by AMPD2, corresponding to a target binding site such as BINDING SITE I, BINDING SITE II or BINDING SITE III of FIG. 8. Table 4 illustrates the complementarity of the nucleotide sequences of AMPD2 BINDING SITE, designated SEQ ID:6548, to the nucleotide sequence of GAM5227 RNA, herein designated GAM RNA, also designated SEQ ID:299.

Another function of GAM5227 is therefore inhibition of Adenosine monophosphate deaminase 2 (isoform 1) (AMPD2, Accession NP_004028.3), a gene which plays a critical role in energy metabolism. Accordingly, utilities of GAM5227 include diagnosis, prevention and treatment of diseases and clinical conditions associated with AMPD2.

The function of AMPD2 and its association with various diseases and clinical conditions, has been established by previous studies, as described hereinabove with reference to GAM270.2. Annexin a5 (ANXA5, Accession NP_001145.1) is another GAM5227 target gene, herein designated TARGET GENE. ANXA5 BINDING SITE is a target binding site found in the 3' untranslated region of mRNA encoded by ANXA5, corresponding to a target binding site such as BINDING SITE I, BINDING SITE II or BINDING SITE III of FIG. 8. Table 4 illustrates the complementarity of the nucleotide sequences of ANXA5 BINDING SITE, designated SEQ ID:2768, to the nucleotide sequence of GAM5227 RNA, herein designated GAM RNA, also designated SEQ ID:299.

Another function of GAM5227 is therefore inhibition of Annexin a5 (ANXA5, Accession NP_001145.1), a gene which acts as an indirect inhibitor of the thromboplastin-specific complex. Accordingly, utilities of GAM5227 include diagnosis, prevention and treatment of diseases and clinical conditions associated with ANXA5.

The function of ANXA5 and its association with various diseases and clinical conditions, has been established by previous studies, as described hereinabove with reference to GAM1095.1. APA1 (Accession NP_067011.1) is another GAM5227 target gene, herein designated TARGET GENE. APA1 BINDING SITE is a target binding site found in the 3' untranslated region of mRNA encoded by APA1, corresponding to a target binding site such as BINDING SITE I, BINDING SITE II or BINDING SITE III of FIG. 8. Table 4 illustrates the complementarity of the nucleotide sequences of APA1 BINDING SITE, designated SEQ ID:11175, to the nucleotide sequence of GAM5227 RNA, herein designated GAM RNA, also designated SEQ ID:299.

Another function of GAM5227 is therefore inhibition of APA1 (Accession NP_067011.1). Accordingly, utilities of GAM5227 include diagnosis, prevention and treatment of diseases and clinical conditions associated with APA1.

Rho gtpase activating protein 1 (ARHGAP1, Accession NP_004299.1) is another GAM5227 target gene, herein designated TARGET GENE. ARHGAP1 BINDING SITE is a target binding site found in the 3' untranslated region of mRNA encoded by ARHGAP1, corresponding to a target binding site such as BINDING SITE I, BINDING SITE II or BINDING SITE III of FIG. 8. Table 4 illustrates the complementarity of the nucleotide sequences of ARHGAP1 BINDING SITE, designated SEQ ID:11478, to the nucleotide sequence of GAM5227 RNA, herein designated GAM RNA, also designated SEQ ID:299.

Another function of GAM5227 is therefore inhibition of Rho gtpase activating protein 1 (ARHGAP1, Accession NP_004299.1). Accordingly, utilities of GAM5227 include diagnosis, prevention and treatment of diseases and clinical conditions associated with ARHGAP1.

Rho gtpase activating protein 12 (ARHGAP12, Accession NP_060757.4) is another GAM5227 target gene, herein designated TARGET GENE. ARHGAP12 BINDING SITE is a target binding site found in the 3' untranslated region of mRNA encoded by ARHGAP12, corresponding to a target binding site such as BINDING SITE I, BINDING SITE II or BINDING SITE III of FIG. 8. Table 4 illustrates the complementarity of the nucleotide sequences of ARHGAP12 BINDING SITE, designated SEQ ID:440, to the nucleotide sequence of GAM5227 RNA, herein designated GAM RNA, also designated SEQ ID:299.

Another function of GAM5227 is therefore inhibition of Rho gtpase activating protein 12 (ARHGAP12, Accession NP_060757.4). Accordingly, utilities of GAM5227 include diagnosis, prevention and treatment of diseases and clinical conditions associated with ARHGAP12.

Atpase, na+/k+ transporting, alpha 2 (+) polypeptide (ATP1A2, Accession NP_000693.1) is another GAM5227 target gene, herein designated TARGET GENE. ATP1A2 BINDING SITE is a target binding site found in the 3' untranslated region of mRNA encoded by ATP1A2, corresponding to a target binding site such as BINDING SITE I, BINDING SITE II or BINDING SITE III of FIG. 8. Table 4 illustrates the complementarity of the nucleotide sequences of ATP1A2 BINDING SITE, designated SEQ ID:14999, to the nucleotide sequence of GAM5227 RNA, herein designated GAM RNA, also designated SEQ ID:299.

Another function of GAM5227 is therefore inhibition of Atpase, na+/k+ transporting, alpha 2 (+) polypeptide (ATP1A2, Accession NP_000693.1). Accordingly, utilities of GAM5227 include diagnosis, prevention and treatment of diseases and clinical conditions associated with ATP1A2.

Udp-gal:betaglcnac beta 1,4-galactosyltransferase, polypeptide 6 (B4GALT6, Accession NP_004766.1) is another GAM5227 target gene, herein designated TARGET GENE. B4GALT6 BINDING SITE is a target binding site found in the 3' untranslated region of mRNA encoded by B4GALT6, corresponding to a target binding site such as BINDING SITE I, BINDING SITE II or BINDING SITE III of FIG. 8. Table 4 illustrates the complementarity of the nucleotide sequences of B4GALT6 BINDING SITE, designated SEQ ID:17518, to the nucleotide sequence of GAM5227 RNA, herein designated GAM RNA, also designated SEQ ID:299.

Another function of GAM5227 is therefore inhibition of Udp-gal:betaglcnac beta 1,4-galactosyltransferase, polypeptide 6 (B4GALT6, Accession NP_004766.1). Accordingly, utilities of GAM5227 include diagnosis, prevention and treatment of diseases and clinical conditions associated with B4GALT6.

Bcl2-associated x protein (BAX, Accession NP_004315.1) is another GAM5227 target gene, herein designated TARGET GENE. BAX BINDING SITE is a target binding site found in the 3' untranslated region of multiple transcripts of mRNA encoded by BAX, corresponding to a target binding site such as BINDING SITE I, BINDING SITE II or BINDING SITE III of FIG. 8. Table 4 illustrates the complementarity of the nucleotide sequences of BAX BINDING SITE, designated SEQ ID:3053, to the nucleotide sequence of GAM5227 RNA, herein designated GAM RNA, also designated SEQ ID:299.

Another function of GAM5227 is therefore inhibition of Bcl2-associated x protein (BAX, Accession NP_004315.1), a gene which accelerates programmed cell death and therefore may be associated with Colorectal cancer, t-cell acute lymphoblastic leukemia. Accordingly, utilities of GAM5227 include diagnosis, prevention and treatment of Colorectal cancer, t-cell acute lymphoblastic leukemia, and of other diseases and clinical conditions associated with BAX.

The function of BAX and its association with various diseases and clinical conditions, has been established by previous studies, as described hereinabove with reference to GAM960.1. Bone morphogenetic protein 8 (osteogenic protein 2) (BMP8, Accession NP_001711.2) is another GAM5227 target gene, herein designated TARGET GENE. BMP8 BINDING SITE is a target binding site found in the 3' untranslated region of mRNA encoded by BMP8, corresponding to a target binding site such as BINDING SITE I, BINDING SITE II or BINDING SITE III of FIG. 8. Table 4 illustrates the complementarity of the nucleotide sequences of BMP8 BINDING SITE, designated SEQ ID:1565, to the nucleotide sequence of GAM5227 RNA, herein designated GAM RNA, also designated SEQ ID:299.

Another function of GAM5227 is therefore inhibition of Bone morphogenetic protein 8 (osteogenic protein 2) (BMP8, Accession NP_001711.2), a gene which plays a role in calcium regulation and bone homeostasis. Accordingly, utilities of GAM5227 include diagnosis, prevention and treatment of diseases and clinical conditions associated with BMP8.

The function of BMP8 and its association with various diseases and clinical conditions, has been established by previous studies, as described hereinabove with reference to GAM347.1. BOP (Accession XP_097915.2) is another GAM5227 target gene, herein designated TARGET GENE. BOP BINDING SITE is a target binding site found in the 3' untranslated region of mRNA encoded by BOP, corresponding to a target binding site such as BINDING SITE I, BINDING SITE II or BINDING SITE III of FIG. 8. Table 4 illustrates the complementarity of the nucleotide sequences of BOP BINDING SITE, designated SEQ ID:6088, to the nucleotide sequence of GAM5227 RNA, herein designated GAM RNA, also designated SEQ ID:299.

Another function of GAM5227 is therefore inhibition of BOP (Accession XP_097915.2). Accordingly, utilities of GAM5227 include diagnosis, prevention and treatment of diseases and clinical conditions associated with BOP.

Bernardinelli-seip congenital lipodystrophy 2 (seipin) (BSCL2, Accession NP_116056.2) is another GAM5227 target gene, herein designated TARGET GENE. BSCL2 BINDING SITE is a target binding site found in the 5' untranslated region of mRNA encoded by BSCL2, corresponding to a target binding site such as BINDING SITE I, BINDING SITE II or BINDING SITE III of FIG. 8. Table 4 illustrates the complementarity of the nucleotide sequences of BSCL2 BINDING SITE, designated SEQ ID:15949, to the nucleotide sequence of GAM5227 RNA, herein designated GAM RNA, also designated SEQ ID:299.

Another function of GAM5227 is therefore inhibition of Bernardinelli-seip congenital lipodystrophy 2 (seipin) (BSCL2, Accession NP_116056.2). Accordingly, utilities of GAM5227 include diagnosis, prevention and treatment of diseases and clinical conditions associated with BSCL2.

Chromosome 20 open reading frame 42 (C20orf42, Accession NP_060141.2) is another GAM5227 target gene, herein designated TARGET GENE. C20orf42 BINDING SITE is a target binding site found in the 3' untranslated region of mRNA encoded by C20orf42, corresponding to a target binding site such as BINDING SITE I, BINDING SITE II or BINDING SITE III of FIG. 8. Table 4 illustrates the complementarity of the nucleotide sequences of C20orf42 BINDING SITE, designated SEQ ID:16282, to the nucleotide sequence of GAM5227 RNA, herein designated GAM RNA, also designated SEQ ID:299.

Another function of GAM5227 is therefore inhibition of Chromosome 20 open reading frame 42 (C20orf42, Accession NP_060141.2). Accordingly, utilities of GAM5227 include diagnosis, prevention and treatment of diseases and clinical conditions associated with C20orf42.

Chromosome 21 open reading frame 90 (C21orf90, Accession NP_694936.1) is another GAM5227 target gene, herein designated TARGET GENE. C21orf90 BINDING SITE is a target binding site found in the 5' untranslated region of mRNA encoded by C21orf90, corresponding to a target binding site such as BINDING SITE I, BINDING SITE II or BINDING SITE III of FIG. 8. Table 4 illustrates the complementarity of the nucleotide sequences of C21orf90 BINDING SITE, designated SEQ ID:13507, to the nucleotide sequence of GAM5227 RNA, herein designated GAM RNA, also designated SEQ ID:299.

Another function of GAM5227 is therefore inhibition of Chromosome 21 open reading frame 90 (C21orf90, Accession NP_694936.1). Accordingly, utilities of GAM5227 include diagnosis, prevention and treatment of diseases and clinical conditions associated with C21orf90.

C6orf151 (Accession NP_689764.1) is another GAM5227 target gene, herein designated TARGET GENE. C6orf151 BINDING SITE is a target binding site found in the 3' untranslated region of mRNA encoded by C6orf151, corresponding to a target binding site such as BINDING SITE I, BINDING SITE II or BINDING SITE III of FIG. 8. Table 4 illustrates the complementarity of the nucleotide sequences of C6orf151 BINDING SITE, designated SEQ ID:4598, to the nucleotide sequence of GAM5227 RNA, herein designated GAM RNA, also designated SEQ ID:299.

Another function of GAM5227 is therefore inhibition of C6orf151 (Accession NP_689764.1). Accordingly, utilities of GAM5227 include diagnosis, prevention and treatment of diseases and clinical conditions associated with C6orf151.

Calcium channel, voltage-dependent, alpha 1h subunit (CACNA1H, Accession NP_066921.1) is another GAM5227 target gene, herein designated TARGET GENE. CACNA1H BINDING SITE is a target binding site found in the 3' untranslated region of mRNA encoded by CACNA1H, corresponding to a target binding site such as BINDING SITE I, BINDING SITE II or BINDING SITE III of FIG. 8. Table 4 illustrates the complementarity of the nucleotide sequences of CACNA1H BINDING SITE, designated SEQ ID:4280, to the nucleotide sequence of GAM5227 RNA, herein designated GAM RNA, also designated SEQ ID:299.

Another function of GAM5227 is therefore inhibition of Calcium channel, voltage-dependent, alpha 1h subunit (CACNA1H, Accession NP_066921.1). Accordingly, utilities of GAM5227 include diagnosis, prevention and treatment of diseases and clinical conditions associated with CACNA1H.

Chemokine (c-c motif) ligand 22 (CCL22, Accession NP_002981.2) is another GAM5227 target gene, herein designated TARGET GENE. CCL22 BINDING SITE is a target binding site found in the 3' untranslated region of mRNA encoded by CCL22, corresponding to a target binding site such as BINDING SITE I, BINDING SITE II or BINDING SITE III of FIG. 8. Table 4 illustrates the complementarity of the nucleotide sequences of CCL22 BINDING SITE, designated SEQ ID:5881, to the nucleotide sequence of GAM5227 RNA, herein designated GAM RNA, also designated SEQ ID:299.

Another function of GAM5227 is therefore inhibition of Chemokine (c-c motif) ligand 22 (CCL22, Accession NP_002981.2). Accordingly, utilities of GAM5227 include diagnosis, prevention and treatment of diseases and clinical conditions associated with CCL22.

Cd209 antigen (CD209, Accession NP_066978.1) is another GAM5227 target gene, herein designated TARGET GENE. CD209 BINDING SITE is a target binding site found in the 3' untranslated region of mRNA encoded by CD209, corresponding to a target binding site such as BINDING SITE I, BINDING SITE II or BINDING SITE III of FIG. 8. Table 4 illustrates the complementarity of the nucleotide sequences of CD209 BINDING SITE, designated SEQ ID:14170, to the nucleotide sequence of GAM5227 RNA, herein designated GAM RNA, also designated SEQ ID:299.

Another function of GAM5227 is therefore inhibition of Cd209 antigen (CD209, Accession NP_066978.1), a gene which may play an important role in the CD4-independent association of HIV with cells. Accordingly, utilities of GAM5227 include diagnosis, prevention and treatment of diseases and clinical conditions associated with CD209.

The function of CD209 and its association with various diseases and clinical conditions, has been established by previous studies, as described hereinabove with reference to GAM96.1. Cd34 antigen (CD34, Accession NP_001764.1) is another GAM5227 target gene, herein designated TARGET GENE. CD34 BINDING SITE is a target binding site found in the 3' untranslated region of mRNA encoded by CD34, corresponding to a target binding site such as BINDING SITE I, BINDING SITE II or BINDING SITE III of FIG. 8. Table 4 illustrates the complementarity of the nucleotide sequences of CD34 BINDING SITE, designated SEQ ID:8867, to the nucleotide sequence of GAM5227 RNA, herein designated GAM RNA, also designated SEQ ID:299.

Another function of GAM5227 is therefore inhibition of Cd34 antigen (CD34, Accession NP_001764.1), a gene which is a monomeric cell surface antigen that is selectively expressed on human hematopoietic progenitor cells. Accordingly, utilities of GAM5227 include diagnosis, prevention and treatment of diseases and clinical conditions associated with CD34.

The function of CD34 and its association with various diseases and clinical conditions, has been established by previous studies, as described hereinabove with reference to GAM38.1. Cadherin 16, ksp-cadherin (CDH16, Accession NP_004053.1) is another GAM5227 target gene, herein designated TARGET GENE. CDH16 BINDING SITE is a target binding site found in the 3' untranslated region of mRNA encoded by CDH16, corresponding to a target binding site such as BINDING SITE I, BINDING SITE II or BINDING SITE III of FIG. 8. Table 4 illustrates the complementarity of the nucleotide sequences of CDH16 BINDING SITE, designated SEQ ID:18186, to the nucleotide sequence of GAM5227 RNA, herein designated GAM RNA, also designated SEQ ID:299.

Another function of GAM5227 is therefore inhibition of Cadherin 16, ksp-cadherin (CDH16, Accession NP_004053.1), a gene which is a calcium dependent cell adhesion protein. Accordingly, utilities of GAM5227 include diagnosis, prevention and treatment of diseases and clinical conditions associated with CDH16.

The function of CDH16 and its association with various diseases and clinical conditions, has been established by previous studies, as described hereinabove with reference to GAM148.1. Cat eye syndrome chromosome region, candidate 1 (CECR1, Accession NP_803124.1) is another GAM5227 target gene, herein designated TARGET GENE. CECR1 BINDING SITE is a target binding site found in the 3' untranslated region of multiple transcripts of mRNA encoded by CECR1, corresponding to a target binding site such as BINDING SITE I, BINDING SITE II or BINDING SITE III of FIG. 8. Table 4 illustrates the complementarity of the nucleotide sequences of CECR1 BINDING SITE, designated SEQ ID:14307, to the nucleotide sequence of GAM5227 RNA, herein designated GAM RNA, also designated SEQ ID:299.

Another function of GAM5227 is therefore inhibition of Cat eye syndrome chromosome region, candidate 1 (CECR1, Accession NP_803124.1). Accordingly, utilities of GAM5227 include diagnosis, prevention and treatment of diseases and clinical conditions associated with CECR1.

Cat eye syndrome chromosome region, candidate 1 (CECR1, Accession NP_059120.2) is another GAM5227 target gene, herein designated TARGET GENE. CECR1 BINDING SITE is a target binding site found in the 3' untranslated region of multiple transcripts of mRNA encoded by CECR1, corresponding to a target binding site such as BINDING SITE I, BINDING SITE II or BINDING SITE III of FIG. 8. Table 4 illustrates the complementarity of the nucleotide sequences of CECR1 BINDING SITE, designated SEQ ID:14307, to the nucleotide sequence of GAM5227 RNA, herein designated GAM RNA, also designated SEQ ID:299.

Another function of GAM5227 is therefore inhibition of Cat eye syndrome chromosome region, candidate 1 (CECR1, Accession NP_059120.2). Accordingly, utilities of GAM5227 include diagnosis, prevention and treatment of diseases and clinical conditions associated with CECR1.

Cyclin m4 (CNNM4, Accession NP_064569.1) is another GAM5227 target gene, herein designated TARGET GENE. CNNM4 BINDING SITE is a target binding site found in the 5' untranslated region of mRNA encoded by CNNM4, corresponding to a target binding site such as BINDING SITE I, BINDING SITE II or BINDING SITE III of FIG. 8. Table 4 illustrates the complementarity of the nucleotide sequences of CNNM4 BINDING SITE, designated SEQ ID:14344, to the nucleotide sequence of GAM5227 RNA, herein designated GAM RNA, also designated SEQ ID:299.

Another function of GAM5227 is therefore inhibition of Cyclin m4 (CNNM4, Accession NP_064569.1). Accordingly, utilities of GAM5227 include diagnosis, prevention and treatment of diseases and clinical conditions associated with CNNM4.

Collagen, type xi, alpha 1 (COL11A1, Accession NP_542197.1) is another GAM5227 target gene, herein designated TARGET GENE. COL11A1 BINDING SITE is a target binding site found in the 3' untranslated region of multiple transcripts of mRNA encoded by COL11A1, corresponding to a target binding site such as BINDING SITE I, BINDING SITE II or BINDING SITE III of FIG. 8. Table 4 illustrates the complementarity of the nucleotide sequences of COL11A1 BINDING SITE, designated SEQ ID:8352, to the nucleotide sequence of GAM5227 RNA, herein designated GAM RNA, also designated SEQ ID:299.

Another function of GAM5227 is therefore inhibition of Collagen, type xi, alpha 1 (COL11A1, Accession NP_542197.1). Accordingly, utilities of GAM5227 include diagnosis, prevention and treatment of diseases and clinical conditions associated with COL11A1.

Collagen, type xi, alpha 1 (COL11A1, Accession NP_001845.2) is another GAM5227 target gene, herein designated TARGET GENE. COL11A1 BINDING SITE is a target binding site found in the 3' untranslated region of multiple transcripts of mRNA encoded by COL11A1, corresponding to a target binding site such as BINDING SITE I, BINDING SITE II or BINDING SITE III of FIG. 8. Table 4 illustrates the complementarity of the nucleotide sequences of COL11A1 BINDING SITE, designated SEQ ID:8352, to the nucleotide sequence of GAM5227 RNA, herein designated GAM RNA, also designated SEQ ID:299.

Another function of GAM5227 is therefore inhibition of Collagen, type xi, alpha 1 (COL11A1, Accession NP_001845.2). Accordingly, utilities of GAM5227 include diagnosis, prevention and treatment of diseases and clinical conditions associated with COL11A1.

Collagen, type xi, alpha 1 (COL11A1, Accession NP_542196.1) is another GAM5227 target gene, herein designated TARGET GENE. COL11A1 BINDING SITE is a target binding site found in the 3' untranslated region of multiple transcripts of mRNA encoded by COL11A1, corresponding to a target binding site such as BINDING SITE I, BINDING SITE II or BINDING SITE III of FIG. 8. Table 4 illustrates the complementarity of the nucleotide sequences of COL11A1 BINDING SITE, designated SEQ ID:8352, to the nucleotide sequence of GAM5227 RNA, herein designated GAM RNA, also designated SEQ ID:299.

Another function of GAM5227 is therefore inhibition of Collagen, type xi, alpha 1 (COL11A1, Accession NP_542196.1). Accordingly, utilities of GAM5227 include diagnosis, prevention and treatment of diseases and clinical conditions associated with COL11A1.

Collectin sub-family member 10 (c-type lectin) (COLEC10, Accession NP_006429.1) is another GAM5227 target gene, herein designated TARGET GENE. COLEC10 BINDING SITE is a target binding site found in the 3' untranslated region of mRNA encoded by COLEC10, corresponding to a target binding site such as BINDING SITE I, BINDING SITE II or BINDING SITE III of FIG. 8. Table 4 illustrates the complementarity of the nucleotide sequences of COLEC10 BINDING SITE, designated SEQ ID:13201, to the nucleotide sequence of GAM5227 RNA, herein designated GAM RNA, also designated SEQ ID:299.

Another function of GAM5227 is therefore inhibition of Collectin sub-family member 10 (c-type lectin) (COLEC10, Accession NP_006429.1). Accordingly, utilities of GAM5227 include diagnosis, prevention and treatment of diseases and clinical conditions associated with COLEC10.

Carboxypeptidase d (CPD, Accession NP_001295.2) is another GAM5227 target gene, herein designated TARGET GENE. CPD BINDING SITE is a target binding site found in the 3' untranslated region of mRNA encoded by CPD, corresponding to a target binding site such as BINDING SITE I, BINDING SITE II or BINDING SITE III of FIG. 8. Table 4 illustrates the complementarity of the nucleotide sequences of CPD BINDING SITE, designated SEQ ID:3803, to the nucleotide sequence of GAM5227 RNA, herein designated GAM RNA, also designated SEQ ID:299.

Another function of GAM5227 is therefore inhibition of Carboxypeptidase d (CPD, Accession NP_001295.2), a gene which is a membrane-bound metalloprotease. Accordingly, utilities of GAM5227 include diagnosis, prevention and treatment of diseases and clinical conditions associated with CPD.

The function of CPD and its association with various diseases and clinical conditions, has been established by previous studies, as described hereinabove with reference to GAM66.2. Casein kinase 1, alpha 1 (CSNK1A1, Accession NP_001883.3) is another GAM5227 target gene, herein designated TARGET GENE. CSNK1A1 BINDING SITE is a target binding site found in the 5' untranslated region of mRNA encoded by CSNK1A1, corresponding to a target binding site such as BINDING SITE I, BINDING SITE II or BINDING SITE III of FIG. 8. Table 4 illustrates the complementarity of the nucleotide sequences of CSNK1A1 BINDING SITE, designated SEQ ID:8360, to the nucleotide sequence of GAM5227 RNA, herein designated GAM RNA, also designated SEQ ID:299.

Another function of GAM5227 is therefore inhibition of Casein kinase 1, alpha 1 (CSNK1A1, Accession NP_001883.3). Accordingly, utilities of GAM5227 include diagnosis, prevention and treatment of diseases and clinical conditions associated with CSNK1A1.

Catenin (cadherin-associated protein), delta 1 (CTNND1, Accession NP_001322.1) is another GAM5227 target gene, herein designated TARGET GENE. CTNND1 BINDING SITE is a target binding site found in the 3' untranslated region of mRNA encoded by CTNND1, corresponding to a target binding site such as BINDING SITE I, BINDING SITE II or BINDING SITE III of FIG. 8. Table 4 illustrates the complementarity of the nucleotide sequences of CTNND1 BINDING SITE, designated SEQ ID:15067, to the nucleotide sequence of GAM5227 RNA, herein designated GAM RNA, also designated SEQ ID:299.

Another function of GAM5227 is therefore inhibition of Catenin (cadherin-associated protein), delta 1 (CTNND1, Accession NP_001322.1). Accordingly, utilities of GAM5227 include diagnosis, prevention and treatment of diseases and clinical conditions associated with CTNND1.

Cathepsin b (CTSB, Accession NP_680090.1) is another GAM5227 target gene, herein designated TARGET GENE. CTSB BINDING SITE is a target binding site found in the 3' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:12008, to the nucleotide sequence of GAM5227 RNA, herein designated GAM RNA, also designated SEQ ID:299.

Another function of GAM5227 is therefore inhibition of Cathepsin b (CTSB, Accession NP_680090.1). Accordingly, utilities of GAM5227 include diagnosis, prevention and treatment of diseases and clinical conditions associated with CTSB.

Cathepsin b (CTSB, Accession NP_001899.1) is another GAM5227 target gene, herein designated TARGET GENE. CTSB BINDING SITE is a target binding site found in the 3' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:12008, to the nucleotide sequence of GAM5227 RNA, herein designated GAM RNA, also designated SEQ ID:299.

Another function of GAM5227 is therefore inhibition of Cathepsin b (CTSB, Accession NP_001899.1). Accordingly, utilities of GAM5227 include diagnosis, prevention and treatment of diseases and clinical conditions associated with CTSB.

Cathepsin b (CTSB, Accession NP_680092.1) is another GAM5227 target gene, herein designated TARGET GENE. CTSB BINDING SITE is a target binding site found in the 3' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:12008, to the nucleotide sequence of GAM5227 RNA, herein designated GAM RNA, also designated SEQ ID:299.

Another function of GAM5227 is therefore inhibition of Cathepsin b (CTSB, Accession NP_680092.1). Accordingly, utilities of GAM5227 include diagnosis, prevention and treatment of diseases and clinical conditions associated with CTSB.

Cathepsin b (CTSB, Accession NP_680093.1) is another GAM5227 target gene, herein designated TARGET GENE. CTSB BINDING SITE is a target binding site found in the 3' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:12008, to the nucleotide sequence of GAM5227 RNA, herein designated GAM RNA, also designated SEQ ID:299.

Another function of GAM5227 is therefore inhibition of Cathepsin b (CTSB, Accession NP_680093.1). Accordingly, utilities of GAM5227 include diagnosis, prevention and treatment of diseases and clinical conditions associated with CTSB.

Cathepsin b (CTSB, Accession NP_680091.1) is another GAM5227 target gene, herein designated TARGET GENE. CTSB BINDING SITE is a target binding site found in the 3' untranslated region of multiple transcripts of mRNA encoded by CTSB, corresponding to a target binding site such as BINDING SITE I, BINDING SITE II or BINDING SITE III of FIG. 8. Table 4 illustrates the complementarity of the nucleotide sequences of CTSB BINDING SITE, designated SEQ ID:12008, to the nucleotide sequence of GAM5227 RNA, herein designated GAM RNA, also designated SEQ ID:299.

Another function of GAM5227 is therefore inhibition of Cathepsin b (CTSB, Accession NP_680091.1). Accordingly, utilities of GAM5227 include diagnosis, prevention and treatment of diseases and clinical conditions associated with CTSB.

Coxsackie virus and adenovirus receptor (CXADR, Accession NP_001329.1) is another GAM5227 target gene, herein designated TARGET GENE. CXADR BINDING SITE is a target binding site found in the 3' untranslated region of mRNA encoded by CXADR, corresponding to a target binding site such as BINDING SITE I, BINDING SITE II or BINDING SITE III of FIG. 8. Table 4 illustrates the complementarity of the nucleotide sequences of CXADR BINDING SITE, designated SEQ ID:8611, to the nucleotide sequence of GAM5227 RNA, herein designated GAM RNA, also designated SEQ ID:299.

Another function of GAM5227 is therefore inhibition of Coxsackie virus and adenovirus receptor (CXADR, Accession NP_001329.1), a gene which is a member of the immunoglobulin superfamily. Accordingly, utilities of GAM5227 include diagnosis, prevention and treatment of diseases and clinical conditions associated with CXADR.

The function of CXADR and its association with various diseases and clinical conditions, has been established by previous studies, as described hereinabove with reference to GAM378.2. Dystroglycan 1 (dystrophin-associated glycoprotein 1) (DAG1, Accession NP_004384.1) is another GAM5227 target gene, herein designated TARGET GENE. DAG1 BINDING SITE is a target binding site found in the 3' untranslated region of mRNA encoded by DAG1, corresponding to a target binding site such as BINDING SITE I, BINDING SITE II or BINDING SITE III of FIG. 8. Table 4 illustrates the complementarity of the nucleotide sequences of DAG1 BINDING SITE, designated SEQ ID:16633, to the nucleotide sequence of GAM5227 RNA, herein designated GAM RNA, also designated SEQ ID:299.

Another function of GAM5227 is therefore inhibition of Dystroglycan 1 (dystrophin-associated glycoprotein 1) (DAG1, Accession NP_004384.1), a gene which may provide linkage between the sarcolemma and extracellular matrix (ECM) and therefore may be associated with Fukuyama-type congenital muscular dystrophy. Accordingly, utilities of GAM5227 include diagnosis, prevention and treatment of Fukuyama-type congenital muscular dystrophy, and of other diseases and clinical conditions associated with DAG1.

The function of DAG1 and its association with various diseases and clinical conditions, has been established by previous studies, as described hereinabove with reference to GAM63.1. Defensin, theta 1 (DEFT1, Accession NP_624312.1) is another GAM5227 target gene, herein designated TARGET GENE. DEFT1 BINDING SITE is a target binding site found in the 3' untranslated region of mRNA encoded by DEFT1, corresponding to a target binding site such as BINDING SITE I, BINDING SITE II or BINDING SITE III of FIG. 8. Table 4 illustrates the complementarity of the nucleotide sequences of DEFT1 BINDING SITE, designated SEQ ID:863, to the nucleotide sequence of GAM5227 RNA, herein designated GAM RNA, also designated SEQ ID:299.

Another function of GAM5227 is therefore inhibition of Defensin, theta 1 (DEFT1, Accession NP_624312.1). Accordingly, utilities of GAM5227 include diagnosis, prevention and treatment of diseases and clinical conditions associated with DEFT1.

Digeorge syndrome critical region gene 2 (DGCR2, Accession NP_005128.1) is another GAM5227 target gene, herein designated TARGET GENE. DGCR2 BINDING SITE is a target binding site found in the 3' untranslated region of mRNA encoded by DGCR2, corresponding to a target binding site such as BINDING SITE I, BINDING SITE II or BINDING SITE III of FIG. 8. Table 4 illustrates the complementarity of the nucleotide sequences of DGCR2 BINDING SITE, designated SEQ ID:7719, to the nucleotide sequence of GAM5227 RNA, herein designated GAM RNA, also designated SEQ ID:299.

Another function of GAM5227 is therefore inhibition of Digeorge syndrome critical region gene 2 (DGCR2, Accession NP_005128.1), a gene which is putative adhesion receptor and intervenes in cell-cell or cell-matrix interactions and therefore may be associated with Digeorge syndrome.

Accordingly, utilities of GAM5227 include diagnosis, prevention and treatment of Digeorge syndrome, and of other diseases and clinical conditions associated with DGCR2.

The function of DGCR2 and its association with various diseases and clinical conditions, has been established by previous studies, as described hereinabove with reference to GAM84.1. Dicer1, dcr-1 homolog (drosophila) (DICER1, Accession NP_085124.2) is another GAM5227 target gene, herein designated TARGET GENE. DICER1 BINDING SITE is a target binding site found in the 3' untranslated region of multiple transcripts of mRNA encoded by DICER1, corresponding to a target binding site such as BINDING SITE I, BINDING SITE II or BINDING SITE III of FIG. 8. Table 4 illustrates the complementarity of the nucleotide sequences of DICER1 BINDING SITE, designated SEQ ID:13841, to the nucleotide sequence of GAM5227 RNA, herein designated GAM RNA, also designated SEQ ID:299.

Another function of GAM5227 is therefore inhibition of Dicer1, dcr-1 homolog (drosophila) (DICER1, Accession NP_085124.2). Accordingly, utilities of GAM5227 include diagnosis, prevention and treatment of diseases and clinical conditions associated with DICER1.

Dicer1, dcr-1 homolog (drosophila) (DICER1, Accession NP_803187.1) is another GAM5227 target gene, herein designated TARGET GENE. DICER1 BINDING SITE is a target binding site found in the 3' untranslated region of multiple transcripts of mRNA encoded by DICER1, corresponding to a target binding site such as BINDING SITE I, BINDING SITE II or BINDING SITE III of FIG. 8. Table 4 illustrates the complementarity of the nucleotide sequences of DICER1 BINDING SITE, designated SEQ ID:13841, to the nucleotide sequence of GAM5227 RNA, herein designated GAM RNA, also designated SEQ ID:299.

Another function of GAM5227 is therefore inhibition of Dicer1, dcr-1 homolog (drosophila) (DICER1, Accession NP_803187.1). Accordingly, utilities of GAM5227 include diagnosis, prevention and treatment of diseases and clinical conditions associated with DICER1.

DKFZP434P0714 (Accession NP_115507.2) is another GAM5227 target gene, herein designated TARGET GENE. DKFZP434P0714 BINDING SITE is a target binding site found in the 5' untranslated region of mRNA encoded by DKFZP434P0714, corresponding to a target binding site such as BINDING SITE I, BINDING SITE II or BINDING SITE III of FIG. 8. Table 4 illustrates the complementarity of the nucleotide sequences of DKFZP434P0714 BINDING SITE, designated SEQ ID:17734, to the nucleotide sequence of GAM5227 RNA, herein designated GAM RNA, also designated SEQ ID:299.

Another function of GAM5227 is therefore inhibition of DKFZP434P0714 (Accession NP_115507.2). Accordingly, utilities of GAM5227 include diagnosis, prevention and treatment of diseases and clinical conditions associated with DKFZP434P0714.

DKFZp547A023 (Accession NP_061174.1) is another GAM5227 target gene, herein designated TARGET GENE. DKFZp547A023 BINDING SITE is a target binding site found in the 3' untranslated region of mRNA encoded by DKFZp547A023, corresponding to a target binding site such as BINDING SITE I, BINDING SITE II or BINDING SITE III of FIG. 8. Table 4 illustrates the complementarity of the nucleotide sequences of DKFZp547A023 BINDING SITE, designated SEQ ID:18504, to the nucleotide sequence of GAM5227 RNA, herein designated GAM RNA, also designated SEQ ID:299.

Another function of GAM5227 is therefore inhibition of DKFZp547A023 (Accession NP_061174.1). Accordingly, utilities of GAM5227 include diagnosis, prevention and treatment of diseases and clinical conditions associated with DKFZp547A023.

DKFZP586B1621 (Accession NP_056348.2) is another GAM5227 target gene, herein designated TARGET GENE. DKFZP586B1621 BINDING SITE is a target binding site found in the 5' untranslated region of mRNA encoded by DKFZP586B1621, corresponding to a target binding site such as BINDING SITE I, BINDING SITE II or BINDING SITE III of FIG. 8. Table 4 illustrates the complementarity of the nucleotide sequences of DKFZP586B1621 BINDING SITE, designated SEQ ID:1196, to the nucleotide sequence of GAM5227 RNA, herein designated GAM RNA, also designated SEQ ID:299.

Another function of GAM5227 is therefore inhibition of DKFZP586B1621 (Accession NP_056348.2). Accordingly, utilities of GAM5227 include diagnosis, prevention and treatment of diseases and clinical conditions associated with DKFZP586B1621.

DKFZp667G2110 (Accession NP_705833.1) is another GAM5227 target gene, herein designated TARGET GENE. DKFZp667G2110 BINDING SITE is a target binding site found in the 3' untranslated region of mRNA encoded by DKFZp667G2110, corresponding to a target binding site such as BINDING SITE I, BINDING SITE II or BINDING SITE III of FIG. 8. Table 4 illustrates the complementarity of the nucleotide sequences of DKFZp667G2110 BINDING SITE, designated SEQ ID:20018, to the nucleotide sequence of GAM5227 RNA, herein designated GAM RNA, also designated SEQ ID:299.

Another function of GAM5227 is therefore inhibition of DKFZp667G2110 (Accession NP_705833.1). Accordingly, utilities of GAM5227 include diagnosis, prevention and treatment of diseases and clinical conditions associated with DKFZp667G2110.

DKFZp761H0421 (Accession NP_775102.1) is another GAM5227 target gene, herein designated TARGET GENE. DKFZp761H0421 BINDING SITE is a target binding site found in the 3' untranslated region of mRNA encoded by DKFZp761H0421, corresponding to a target binding site such as BINDING SITE I, BINDING SITE II or BINDING SITE III of FIG. 8. Table 4 illustrates the complementarity of the nucleotide sequences of DKFZp761H0421 BINDING SITE, designated SEQ ID:3514, to the nucleotide sequence of GAM5227 RNA, herein designated GAM RNA, also designated SEQ ID:299.

Another function of GAM5227 is therefore inhibition of DKFZp761H0421 (Accession NP_775102.1). Accordingly, utilities of GAM5227 include diagnosis, prevention and treatment of diseases and clinical conditions associated with DKFZp761H0421.

E2f transcription factor 3 (E2F3, Accession NP_001940.1) is another GAM5227 target gene, herein designated TARGET GENE. E2F3 BINDING SITE is a target binding site found in the 3' untranslated region of mRNA encoded by E2F3, corresponding to a target binding site such as BINDING SITE I, BINDING SITE II or BINDING SITE III of FIG. 8. Table 4 illustrates the complementarity of the nucleotide sequences of E2F3 BINDING SITE, designated SEQ ID:16017, to the nucleotide sequence of GAM5227 RNA, herein designated GAM RNA, also designated SEQ ID:299.

Another function of GAM5227 is therefore inhibition of E2f transcription factor 3 (E2F3, Accession NP_001940.1), a gene which binds dna and controls cell-cycle progression from g1 to s phase. and therefore may be associated with Hereditary autosomal dominant myoclonus dystonia. Accordingly, utilities of GAM5227 include diagnosis, prevention and treatment of Hereditary autosomal dominant myoclonus dystonia, and of other diseases and clinical conditions associated with E2F3.

The function of E2F3 and its association with various diseases and clinical conditions, has been established by previous studies, as described hereinabove with reference to GAM44.1. Endothelial differentiation-related factor 1 (EDF1, Accession NP_003783.1) is another GAM5227 target gene, herein designated TARGET GENE. EDF1 BINDING SITE is a target binding site found in the 3' untranslated region of multiple transcripts of mRNA encoded by EDF1, corresponding to a target binding site such as BINDING SITE I, BINDING SITE II or BINDING SITE III of FIG. 8. Table 4 illustrates the complementarity of the nucleotide sequences of EDF1 BINDING SITE, designated SEQ ID:535, to the nucleotide sequence of GAM5227 RNA, herein designated GAM RNA, also designated SEQ ID:299.

Another function of GAM5227 is therefore inhibition of Endothelial differentiation-related factor 1 (EDF1, Accession NP_003783.1). Accordingly, utilities of GAM5227 include diagnosis, prevention and treatment of diseases and clinical conditions associated with EDF1.

Epidermal growth factor receptor (erythroblastic leukemia viral (v-erb-b) oncogene homolog, avian) (EGFR, Accession NP_005219.2) is another GAM5227 target gene, herein designated TARGET GENE. EGFR BINDING SITE is a target binding site found in the 3' untranslated region of mRNA encoded by EGFR, corresponding to a target binding site such as BINDING SITE I, BINDING SITE II or BINDING SITE III of FIG. 8. Table 4 illustrates the complementarity of the nucleotide sequences of EGFR BINDING SITE, designated SEQ ID:7441, to the nucleotide sequence of GAM5227 RNA, herein designated GAM RNA, also designated SEQ ID:299.

Another function of GAM5227 is therefore inhibition of Epidermal growth factor receptor (erythroblastic leukemia viral (v-erb-b) oncogene homolog, avian) (EGFR, Accession NP_005219.2), a gene which is a receptor for egf, but also for other members of the egf family. and therefore may be associated with Colon cancer, silver-russell syndrome. Accordingly, utilities of GAM5227 include diagnosis, prevention and treatment of Colon cancer, silver-russell syndrome, and of other diseases and clinical conditions associated with EGFR.

The function of EGFR and its association with various diseases and clinical conditions, has been established by previous studies, as described hereinabove with reference to GAM148.2. Engulfment and cell motility 2 (ced-12 homolog, c. elegans) (ELMO2, Accession NP_071369.4) is another GAM5227 target gene, herein designated TARGET GENE. ELMO2 BINDING SITE is a target binding site found in the 5' untranslated region of multiple transcripts of mRNA encoded by ELMO2, corresponding to a target binding site such as BINDING SITE I, BINDING SITE II or BINDING SITE III of FIG. 8. Table 4 illustrates the complementarity of the nucleotide sequences of ELMO2 BINDING SITE, designated SEQ ID:15621, to the nucleotide sequence of GAM5227 RNA, herein designated GAM RNA, also designated SEQ ID:299.

Another function of GAM5227 is therefore inhibition of Engulfment and cell motility 2 (ced-12 homolog, c. elegans) (ELMO2, Accession NP_071369.4). Accordingly, utilities of GAM5227 include diagnosis, prevention and treatment of diseases and clinical conditions associated with ELMO2.

Engulfment and cell motility 2 (ced-12 homolog, c. elegans) (ELMO2, Accession NP_573403.1) is another GAM5227 target gene, herein designated TARGET GENE. ELMO2 BINDING SITE is a target binding site found in the 5' untranslated region of multiple transcripts of mRNA encoded by ELMO2, corresponding to a target binding site such as BINDING SITE I, BINDING SITE II or BINDING SITE III of FIG. 8. Table 4 illustrates the complementarity of the nucleotide sequences of ELMO2 BINDING SITE, designated SEQ ID:15621, to the nucleotide sequence of GAM5227 RNA, herein designated GAM RNA, also designated SEQ ID:299.

Another function of GAM5227 is therefore inhibition of Engulfment and cell motility 2 (ced-12 homolog, c. elegans) (ELMO2, Accession NP_573403.1). Accordingly, utilities of GAM5227 include diagnosis, prevention and treatment of diseases and clinical conditions associated with ELMO2.

ENT4 (Accession NP_694979.1) is another GAM5227 target gene, herein designated TARGET GENE. ENT4 BINDING SITE is a target binding site found in the 3' untranslated region of mRNA encoded by ENT4, corresponding to a target binding site such as BINDING SITE I, BINDING SITE II or BINDING SITE III of FIG. 8. Table 4 illustrates the complementarity of the nucleotide sequences of ENT4 BINDING SITE, designated SEQ ID:8473, to the nucleotide sequence of GAM5227 RNA, herein designated GAM RNA, also designated SEQ ID:299.

Another function of GAM5227 is therefore inhibition of ENT4 (Accession NP_694979.1). Accordingly, utilities of GAM5227 include diagnosis, prevention and treatment of diseases and clinical conditions associated with ENT4.

FAD104 (Accession NP_073600.2) is another GAM5227 target gene, herein designated TARGET GENE. FAD104 BINDING SITE is a target binding site found in the 3' untranslated region of mRNA encoded by FAD104, corresponding to a target binding site such as BINDING SITE I, BINDING SITE II or BINDING SITE III of FIG. 8. Table 4 illustrates the complementarity of the nucleotide sequences of FAD104 BINDING SITE, designated SEQ ID:19708, to the nucleotide sequence of GAM5227 RNA, herein designated GAM RNA, also designated SEQ ID:299.

Another function of GAM5227 is therefore inhibition of FAD104 (Accession NP_073600.2). Accordingly, utilities of GAM5227 include diagnosis, prevention and treatment of diseases and clinical conditions associated with FAD104.

FAT3 (Accession XP_061871.5) is another GAM5227 target gene, herein designated TARGET GENE. FAT3 BINDING SITE is a target binding site found in the 3' untranslated region of mRNA encoded by FAT3, corresponding to a target binding site such as BINDING SITE I, BINDING SITE II or BINDING SITE III of FIG. 8. Table 4 illustrates the complementarity of the nucleotide sequences of FAT3 BINDING SITE, designated SEQ ID:7573, to the nucleotide sequence of GAM5227 RNA, herein designated GAM RNA, also designated SEQ ID:299.

Another function of GAM5227 is therefore inhibition of FAT3 (Accession XP_061871.5). Accordingly, utilities of GAM5227 include diagnosis, prevention and treatment of diseases and clinical conditions associated with FAT3.

FBXW8 (Accession NP_036306.1) is another GAM5227 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:11502, to the nucleotide sequence of GAM5227 RNA, herein designated GAM RNA, also designated SEQ ID:299.

Another function of GAM5227 is therefore inhibition of FBXW8 (Accession NP_036306.1). Accordingly, utilities of GAM5227 include diagnosis, prevention and treatment of diseases and clinical conditions associated with FBXW8.

FBXW8 (Accession NP_699179.2) is another GAM5227 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:11502, to the nucleotide sequence of GAM5227 RNA, herein designated GAM RNA, also designated SEQ ID:299.

Another function of GAM5227 is therefore inhibition of FBXW8 (Accession NP_699179.2). Accordingly, utilities of GAM5227 include diagnosis, prevention and treatment of diseases and clinical conditions associated with FBXW8.

FLJ00026 (Accession XP_036307.7) is another GAM5227 target gene, herein designated TARGET GENE. FLJ00026 BINDING SITE is a target binding site found in the 5' untranslated region of mRNA encoded by FLJ00026, corresponding to a target binding site such as BINDING SITE I, BINDING SITE II or BINDING SITE III of FIG. 8. Table 4 illustrates the complementarity of the nucleotide sequences of FLJ00026 BINDING SITE, designated SEQ ID:10221, to the nucleotide sequence of GAM5227 RNA, herein designated GAM RNA, also designated SEQ ID:299.

Another function of GAM5227 is therefore inhibition of FLJ00026 (Accession XP_036307.7). Accordingly, utilities of GAM5227 include diagnosis, prevention and treatment of diseases and clinical conditions associated with FLJ00026.

FLJ00225 (Accession XP_084552.3) is another GAM5227 target gene, herein designated TARGET GENE. FLJ00225 BINDING SITE is a target binding site found in the 3' untranslated region of mRNA encoded by FLJ00225, corresponding to a target binding site such as BINDING SITE I, BINDING SITE II or BINDING SITE III of FIG. 8. Table 4 illustrates the complementarity of the nucleotide sequences of FLJ00225 BINDING SITE, designated SEQ ID:13481, to the nucleotide sequence of GAM5227 RNA, herein designated GAM RNA, also designated SEQ ID:299.

Another function of GAM5227 is therefore inhibition of FLJ00225 (Accession XP_084552.3). Accordingly, utilities of GAM5227 include diagnosis, prevention and treatment of diseases and clinical conditions associated with FLJ00225.

FLJ10074 (Accession NP_060458.2) is another GAM5227 target gene, herein designated TARGET GENE. FLJ10074 BINDING SITE is a target binding site found in the 3' untranslated region of mRNA encoded by FLJ10074, corresponding to a target binding site such as BINDING SITE I, BINDING SITE II or BINDING SITE III of FIG. 8. Table 4 illustrates the complementarity of the nucleotide sequences of FLJ10074 BINDING SITE, designated SEQ ID:18487, to the nucleotide sequence of GAM5227 RNA, herein designated GAM RNA, also designated SEQ ID:299.

Another function of GAM5227 is therefore inhibition of FLJ10074 (Accession NP_060458.2). Accordingly, utilities of GAM5227 include diagnosis, prevention and treatment of diseases and clinical conditions associated with FLJ10074.

FLJ10097 (Accession XP_043653.1) is another GAM5227 target gene, herein designated TARGET GENE. FLJ10097 BINDING SITE is a target binding site found in the 3' untranslated region of mRNA encoded by FLJ10097, corresponding to a target binding site such as BINDING SITE I, BINDING SITE II or BINDING SITE III of FIG. 8. Table 4 illustrates the complementarity of the nucleotide sequences of FLJ10097 BINDING SITE, designated SEQ ID:10680, to the nucleotide sequence of GAM5227 RNA, herein designated GAM RNA, also designated SEQ ID:299.

Another function of GAM5227 is therefore inhibition of FLJ10097 (Accession XP_043653.1). Accordingly, utilities of GAM5227 include diagnosis, prevention and treatment of diseases and clinical conditions associated with FLJ10097.

FLJ10260 (Accession NP_060512.2) is another GAM5227 target gene, herein designated TARGET GENE. FLJ10260 BINDING SITE is a target binding site found in the 5' untranslated region of mRNA encoded by FLJ10260, corresponding to a target binding site such as BINDING SITE I, BINDING SITE II or BINDING SITE III of FIG. 8. Table 4 illustrates the complementarity of the nucleotide sequences of FLJ10260 BINDING SITE, designated SEQ ID:2454, to the nucleotide sequence of GAM5227 RNA, herein designated GAM RNA, also designated SEQ ID:299.

Another function of GAM5227 is therefore inhibition of FLJ10260 (Accession NP_060512.2). Accordingly, utilities of GAM5227 include diagnosis, prevention and treatment of diseases and clinical conditions associated with FLJ10260.

FLJ10420 (Accession NP_060560.1) is another GAM5227 target gene, herein designated TARGET GENE. FLJ10420 BINDING SITE is a target binding site found in the 3' untranslated region of mRNA encoded by FLJ10420, corresponding to a target binding site such as BINDING SITE I, BINDING SITE II or BINDING SITE III of FIG. 8. Table 4 illustrates the complementarity of the nucleotide sequences of FLJ10420 BINDING SITE, designated SEQ ID:1979, to the nucleotide sequence of GAM5227 RNA, herein designated GAM RNA, also designated SEQ ID:299.

Another function of GAM5227 is therefore inhibition of FLJ10420 (Accession NP_060560.1). Accordingly, utilities of GAM5227 include diagnosis, prevention and treatment of diseases and clinical conditions associated with FLJ10420.

FLJ12505 (Accession NP_079025.1) is another GAM5227 target gene, herein designated TARGET GENE. FLJ12505 BINDING SITE is a target binding site found in the 3' untranslated region of mRNA encoded by FLJ12505, corresponding to a target binding site such as BINDING SITE I, BINDING SITE II or BINDING SITE III of FIG. 8. Table 4 illustrates the complementarity of the nucleotide sequences of FLJ12505 BINDING SITE, designated SEQ ID:8025, to the nucleotide sequence of GAM5227 RNA, herein designated GAM RNA, also designated SEQ ID:299.

Another function of GAM5227 is therefore inhibition of FLJ12505 (Accession NP_079025.1). Accordingly, utilities of GAM5227 include diagnosis, prevention and treatment of diseases and clinical conditions associated with FLJ12505.

FLJ12975 (Accession NP_079085.2) is another GAM5227 target gene, herein designated TARGET GENE. FLJ12975 BINDING SITE is a target binding site found in the 3' untranslated region of mRNA encoded by FLJ12975, corresponding to a target binding site such as BINDING SITE I, BINDING SITE II or BINDING SITE III of FIG. 8. Table 4 illustrates the complementarity of the nucleotide sequences of FLJ12975 BINDING SITE, designated SEQ ID:11304, to the nucleotide sequence of GAM5227 RNA, herein designated GAM RNA, also designated SEQ ID:299.

Another function of GAM5227 is therefore inhibition of FLJ12975 (Accession NP_079085.2). Accordingly, utilities of GAM5227 include diagnosis, prevention and treatment of diseases and clinical conditions associated with FLJ12975.

FLJ13114 (Accession NP_078817.1) is another GAM5227 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:5150, to the nucleotide sequence of GAM5227 RNA, herein designated GAM RNA, also designated SEQ ID:299.

Another function of GAM5227 is therefore inhibition of FLJ13114 (Accession NP_078817.1). Accordingly, utilities of GAM5227 include diagnosis, prevention and treatment of diseases and clinical conditions associated with FLJ13114.

FLJ20254 (Accession NP_060197.2) is another GAM5227 target gene, herein designated TARGET GENE. FLJ20254 BINDING SITE is a target binding site found in the 3' untranslated region of mRNA encoded by FLJ20254, corresponding to a target binding site such as BINDING SITE I, BINDING SITE II or BINDING SITE III of FIG. 8. Table 4 illustrates the complementarity of the nucleotide sequences of FLJ20254 BINDING SITE, designated SEQ ID:9250, to the nucleotide sequence of GAM5227 RNA, herein designated GAM RNA, also designated SEQ ID:299.

Another function of GAM5227 is therefore inhibition of FLJ20254 (Accession NP_060197.2). Accordingly, utilities of GAM5227 include diagnosis, prevention and treatment of diseases and clinical conditions associated with FLJ20254.

FLJ23510 (Accession NP_078996.1) is another GAM5227 target gene, herein designated TARGET GENE. FLJ23510 BINDING SITE is a target binding site found in the 5' untranslated region of mRNA encoded by FLJ23510, corresponding to a target binding site such as BINDING SITE I, BINDING SITE II or BINDING SITE III of FIG. 8. Table 4 illustrates the complementarity of the nucleotide sequences of FLJ23510 BINDING SITE, designated SEQ ID:10450, to the nucleotide sequence of GAM5227 RNA, herein designated GAM RNA, also designated SEQ ID:299.

Another function of GAM5227 is therefore inhibition of FLJ23510 (Accession NP_078996.1). Accordingly, utilities of GAM5227 include diagnosis, prevention and treatment of diseases and clinical conditions associated with FLJ23510.

FLJ31713 (Accession NP_689788.1) is another GAM5227 target gene, herein designated TARGET GENE. FLJ31713 BINDING SITE is a target binding site found in the 3' untranslated region of mRNA encoded by FLJ31713, corresponding to a target binding site such as BINDING SITE I, BINDING SITE II or BINDING SITE III of FIG. 8. Table 4 illustrates the complementarity of the nucleotide sequences of FLJ31713 BINDING SITE, designated SEQ ID:8441, to the nucleotide sequence of GAM5227 RNA, herein designated GAM RNA, also designated SEQ ID:299.

Another function of GAM5227 is therefore inhibition of FLJ31713 (Accession NP_689788.1). Accordingly, utilities of GAM5227 include diagnosis, prevention and treatment of diseases and clinical conditions associated with FLJ31713.

FLJ37478 (Accession NP_848652.1) is another GAM5227 target gene, herein designated TARGET GENE. FLJ37478 BINDING SITE is a target binding site found in the 3' untranslated region of mRNA encoded by FLJ37478, corresponding to a target binding site such as BINDING SITE I, BINDING SITE II or BINDING SITE III of FIG. 8. Table 4 illustrates the complementarity of the nucleotide sequences of FLJ37478 BINDING SITE, designated SEQ ID:11160, to the nucleotide sequence of GAM5227 RNA, herein designated GAM RNA, also designated SEQ ID:299.

Another function of GAM5227 is therefore inhibition of FLJ37478 (Accession NP_848652.1). Accordingly, utilities of GAM5227 include diagnosis, prevention and treatment of diseases and clinical conditions associated with FLJ37478.

FLJ38608 (Accession NP_694947.1) is another GAM5227 target gene, herein designated TARGET GENE. FLJ38608 BINDING SITE is a target binding site found in the 3' untranslated region of mRNA encoded by FLJ38608, corresponding to a target binding site such as BINDING SITE I, BINDING SITE II or BINDING SITE III of FIG. 8. Table 4 illustrates the complementarity of the nucleotide sequences of FLJ38608 BINDING SITE, designated SEQ ID:8113, to the nucleotide sequence of GAM5227 RNA, herein designated GAM RNA, also designated SEQ ID:299.

Another function of GAM5227 is therefore inhibition of FLJ38608 (Accession NP_694947.1). Accordingly, utilities of GAM5227 include diagnosis, prevention and treatment of diseases and clinical conditions associated with FLJ38608.

FLJ38690 (Accession NP_848608.1) is another GAM5227 target gene, herein designated TARGET GENE. FLJ38690 BINDING SITE is a target binding site found in the 3' untranslated region of mRNA encoded by FLJ38690, corresponding to a target binding site such as BINDING SITE I, BINDING SITE II or BINDING SITE III of FIG. 8. Table 4 illustrates the complementarity of the nucleotide sequences of FLJ38690 BINDING SITE, designated SEQ ID:5440, to the nucleotide sequence of GAM5227 RNA, herein designated GAM RNA, also designated SEQ ID:299.

Another function of GAM5227 is therefore inhibition of FLJ38690 (Accession NP_848608.1). Accordingly, utilities of GAM5227 include diagnosis, prevention and treatment of diseases and clinical conditions associated with FLJ38690.

FLJ39116 (Accession NP_689848.1) is another GAM5227 target gene, herein designated TARGET GENE. FLJ39116 BINDING SITE is a target binding site found in the 5' untranslated region of mRNA encoded by FLJ39116, corresponding to a target binding site such as BINDING SITE I, BINDING SITE II or BINDING SITE III of FIG. 8. Table 4 illustrates the complementarity of the nucleotide sequences of FLJ39116 BINDING SITE, designated SEQ ID:19608, to the nucleotide sequence of GAM5227 RNA, herein designated GAM RNA, also designated SEQ ID:299.

Another function of GAM5227 is therefore inhibition of FLJ39116 (Accession NP_689848.1). Accordingly, utilities of GAM5227 include diagnosis, prevention and treatment of diseases and clinical conditions associated with FLJ39116.

FLJ39599 (Accession NP_776164.1) is another GAM5227 target gene, herein designated TARGET GENE. FLJ39599 BINDING SITE is a target binding site found in the 3' untranslated region of mRNA encoded by FLJ39599, corresponding to a target binding site such as BINDING SITE I, BINDING SITE II or BINDING SITE III of FIG. 8. Table 4 illustrates the complementarity of the nucleotide sequences of FLJ39599 BINDING SITE, designated SEQ ID:11751, to the nucleotide sequence of GAM5227 RNA, herein designated GAM RNA, also designated SEQ ID:299.

Another function of GAM5227 is therefore inhibition of FLJ39599 (Accession NP_776164.1). Accordingly, utilities of GAM5227 include diagnosis, prevention and treatment of diseases and clinical conditions associated with FLJ39599.

FLJ39647 (Accession NP_775896.2) is another GAM5227 target gene, herein designated TARGET GENE. FLJ39647 BINDING SITE is a target binding site found in the 3' untranslated region of mRNA encoded by FLJ39647, corresponding to a target binding site such as BINDING SITE I, BINDING SITE II or BINDING SITE III of FIG. 8. Table 4 illustrates the complementarity of the nucleotide sequences of FLJ39647 BINDING SITE, designated SEQ ID:14874, to the nucleotide sequence of GAM5227 RNA, herein designated GAM RNA, also designated SEQ ID:299.

Another function of GAM5227 is therefore inhibition of FLJ39647 (Accession NP_775896.2). Accordingly, utilities of GAM5227 include diagnosis, prevention and treatment of diseases and clinical conditions associated with FLJ39647.

Frequently rearranged in advanced t-cell lymphomas (FRAT1, Accession NP_005470.2) is another GAM5227 target gene, herein designated TARGET GENE. FRAT1 BINDING SITE is a target binding site found in the 3' untranslated region of multiple transcripts of mRNA encoded by FRAT1, corresponding to a target binding site such as BINDING SITE I, BINDING SITE II or BINDING SITE III of FIG. 8. Table 4 illustrates the complementarity of the nucleotide sequences of FRAT1 BINDING SITE, designated SEQ ID:11515, to the nucleotide sequence of GAM5227 RNA, herein designated GAM RNA, also designated SEQ ID:299.

Another function of GAM5227 is therefore inhibition of Frequently rearranged in advanced t-cell lymphomas (FRAT1, Accession NP_005470.2). Accordingly, utilities of GAM5227 include diagnosis, prevention and treatment of diseases and clinical conditions associated with FRAT1.

Frequently rearranged in advanced t-cell lymphomas (FRAT1, Accession NP_852000.1) is another GAM5227 target gene, herein designated TARGET GENE. FRAT1 BINDING SITE is a target binding site found in the 3' untranslated region of multiple transcripts of mRNA encoded by FRAT1, corresponding to a target binding site such as BINDING SITE I, BINDING SITE II or BINDING SITE III of FIG. 8. Table 4 illustrates the complementarity of the nucleotide sequences of FRAT1 BINDING SITE, designated SEQ ID:11515, to the nucleotide sequence of GAM5227 RNA, herein designated GAM RNA, also designated SEQ ID:299.

Another function of GAM5227 is therefore inhibition of Frequently rearranged in advanced t-cell lymphomas (FRAT1, Accession NP_852000.1). Accordingly, utilities of GAM5227 include diagnosis, prevention and treatment of diseases and clinical conditions associated with FRAT1.

Fyve and coiled-coil domain containing 1 (FYCO1, Accession NP_078789.1) is another GAM5227 target gene, herein designated TARGET GENE. FYCO1 BINDING SITE is a target binding site found in the 3' untranslated region of mRNA encoded by FYCO1, corresponding to a target binding site such as BINDING SITE I, BINDING SITE II or BINDING SITE III of FIG. 8. Table 4 illustrates the complementarity of the nucleotide sequences of FYCO1 BINDING SITE, designated SEQ ID:653, to the nucleotide sequence of GAM5227 RNA, herein designated GAM RNA, also designated SEQ ID:299.

Another function of GAM5227 is therefore inhibition of Fyve and coiled-coil domain containing 1 (FYCO1, Accession NP_078789.1). Accordingly, utilities of GAM5227 include diagnosis, prevention and treatment of diseases and clinical conditions associated with FYCO1.

Frizzled homolog 4 (drosophila) (FZD4, Accession NP_036325.2) is another GAM5227 target gene, herein designated TARGET GENE. FZD4 BINDING SITE is a target binding site found in the 3' untranslated region of mRNA encoded by FZD4, corresponding to a target binding site such as BINDING SITE I, BINDING SITE II or BINDING SITE III of FIG. 8. Table 4 illustrates the complementarity of the nucleotide sequences of FZD4 BINDING SITE, designated SEQ ID:19026, to the nucleotide sequence of GAM5227 RNA, herein designated GAM RNA, also designated SEQ ID:299.

Another function of GAM5227 is therefore inhibition of Frizzled homolog 4 (drosophila) (FZD4, Accession NP_036325.2), a gene which may function in cell polarity, cell fate specification and cancer; similar to frizzled receptor family, has seven transmembrane domains and therefore may be associated with Familial exudative vitreoretinopathy. Accordingly, utilities of GAM5227 include diagnosis, prevention and treatment of Familial exudative vitreoretinopathy, and of other diseases and clinical conditions associated with FZD4.

The function of FZD4 and its association with various diseases and clinical conditions, has been established by previous studies, as described hereinabove with reference to GAM67.1. Glutamate-cysteine ligase, modifier subunit (GCLM, Accession NP_002052.1) is another GAM5227 target gene, herein designated TARGET GENE. GCLM BINDING SITE is a target binding site found in the 3' untranslated region of mRNA encoded by GCLM, corresponding to a target binding site such as BINDING SITE I, BINDING SITE II or BINDING SITE III of FIG. 8. Table 4 illustrates the complementarity of the nucleotide sequences of GCLM BINDING SITE, designated SEQ ID:4027, to the nucleotide sequence of GAM5227 RNA, herein designated GAM RNA, also designated SEQ ID:299.

Another function of GAM5227 is therefore inhibition of Glutamate-cysteine ligase, modifier subunit (GCLM, Accession NP_002052.1), a gene which is GLUTAMATE-CYSTEINE LIGASE. Accordingly, utilities of GAM5227 include diagnosis, prevention and treatment of diseases and clinical conditions associated with GCLM.

The function of GCLM and its association with various diseases and clinical conditions, has been established by previous studies, as described hereinabove with reference to GAM879.1. G protein-coupled receptor 4 (GPR4, Accession NP_005273.1) is another GAM5227 target gene, herein designated TARGET GENE. GPR4 BINDING SITE is a target binding site found in the 3' untranslated region of mRNA encoded by GPR4, corresponding to a target binding site such as BINDING SITE I, BINDING SITE II or BINDING SITE III of FIG. 8. Table 4 illustrates the complementarity of the nucleotide sequences of GPR4 BINDING SITE, designated SEQ ID:13775, to the nucleotide sequence of GAM5227 RNA, herein designated GAM RNA, also designated SEQ ID:299.

Another function of GAM5227 is therefore inhibition of G protein-coupled receptor 4 (GPR4, Accession NP_005273.1), a gene which stimulates to produce increased calcium by both SPC and LPC . Accordingly, utilities of GAM5227 include diagnosis, prevention and treatment of diseases and clinical conditions associated with GPR4.

The function of GPR4 and its association with various diseases and clinical conditions, has been established by previous studies, as described hereinabove with reference to GAM189.1. G1 to s phase transition 1 (GSPT1, Accession NP_002085.1) is another GAM5227 target gene, herein designated TARGET GENE. GSPT1 BINDING SITE is a target binding site found in the 5' untranslated region of mRNA encoded by GSPT1, corresponding to a target binding site such as BINDING SITE I, BINDING SITE II or BINDING SITE III of FIG. 8. Table 4 illustrates the complementarity of the nucleotide sequences of GSPT1 BINDING SITE, designated SEQ ID:10693, to the nucleotide sequence of GAM5227 RNA, herein designated GAM RNA, also designated SEQ ID:299.

Another function of GAM5227 is therefore inhibition of G1 to s phase transition 1 (GSPT1, Accession NP_002085.1), a gene which involves in regulation of mammalian cell growth. Accordingly, utilities of GAM5227 include diagnosis, prevention and treatment of diseases and clinical conditions associated with GSPT1.

The function of GSPT1 and its association with various diseases and clinical conditions, has been established by previous studies, as described hereinabove with reference to GAM229.1. H41 (Accession NP_060018.1) is another GAM5227 target gene, herein designated TARGET GENE. H41 BINDING SITE is a target binding site found in the 3' untranslated region of mRNA encoded by H41, corresponding to a target binding site such as BINDING SITE I, BINDING SITE II or BINDING SITE III of FIG. 8. Table 4 illustrates the complementarity of the nucleotide sequences of H41 BINDING SITE, designated SEQ ID:15147, to the nucleotide sequence of GAM5227 RNA, herein designated GAM RNA, also designated SEQ ID:299.

Another function of GAM5227 is therefore inhibition of H41 (Accession NP_060018.1). Accordingly, utilities of GAM5227 include diagnosis, prevention and treatment of diseases and clinical conditions associated with H41.

Hyaluronan synthase 2 (HAS2, Accession NP_005319.1) is another GAM5227 target gene, herein designated TARGET GENE. HAS2 BINDING SITE is a target binding site found in the 5' untranslated region of mRNA encoded by HAS2, corresponding to a target binding site such as BINDING SITE I, BINDING SITE II or BINDING SITE III of FIG. 8. Table 4 illustrates the complementarity of the nucleotide sequences of HAS2 BINDING SITE, designated SEQ ID:15347, to the nucleotide sequence of GAM5227 RNA, herein designated GAM RNA, also designated SEQ ID:299.

Another function of GAM5227 is therefore inhibition of Hyaluronan synthase 2 (HAS2, Accession NP_005319.1), a gene which plays a role in hyaluronan/hyaluronic acid (ha) synthesis and transport. Accordingly, utilities of GAM5227 include diagnosis, prevention and treatment of diseases and clinical conditions associated with HAS2.

The function of HAS2 and its association with various diseases and clinical conditions, has been established by previous studies, as described hereinabove with reference to GAM715.1. Hypoxia-inducible factor 1, alpha subunit inhibitor (HIF1AN, Accession NP_060372.1) is another GAM5227 target gene, herein designated TARGET GENE. HIF1AN BINDING SITE is a target binding site found in the 3' untranslated region of mRNA encoded by HIF1AN, corresponding to a target binding site such as BINDING SITE I, BINDING SITE II or BINDING SITE III of FIG. 8. Table 4 illustrates the complementarity of the nucleotide sequences of HIF1AN BINDING SITE, designated SEQ ID:8091, to the nucleotide sequence of GAM5227 RNA, herein designated GAM RNA, also designated SEQ ID:299.

Another function of GAM5227 is therefore inhibition of Hypoxia-inducible factor 1, alpha subunit inhibitor (HIF1AN, Accession NP_060372.1). Accordingly, utilities of GAM5227 include diagnosis, prevention and treatment of diseases and clinical conditions associated with HIF1AN.

HN1L (Accession NP_653171.1) is another GAM5227 target gene, herein designated TARGET GENE. HN1L BINDING SITE is a target binding site found in the 3' untranslated region of mRNA encoded by HN1L, corresponding to a target binding site such as BINDING SITE I, BINDING SITE II or BINDING SITE III of FIG. 8. Table 4 illustrates the complementarity of the nucleotide sequences of HN1L BINDING SITE, designated SEQ ID:6999, to the nucleotide sequence of GAM5227 RNA, herein designated GAM RNA, also designated SEQ ID:299.

Another function of GAM5227 is therefore inhibition of HN1L (Accession NP_653171.1). Accordingly, utilities of GAM5227 include diagnosis, prevention and treatment of diseases and clinical conditions associated with HN1L.

Heparan sulfate (glucosamine) 3-o-sulfotransferase 2 (HS3ST2, Accession NP_006034.1) is another GAM5227 target gene, herein designated TARGET GENE. HS3ST2 BINDING SITE is a target binding site found in the 3' untranslated region of mRNA encoded by HS3ST2, corresponding to a target binding site such as BINDING SITE I, BINDING SITE II or BINDING SITE III of FIG. 8. Table 4 illustrates the complementarity of the nucleotide sequences of HS3ST2 BINDING SITE, designated SEQ ID:10566, to the nucleotide sequence of GAM5227 RNA, herein designated GAM RNA, also designated SEQ ID:299.

Another function of GAM5227 is therefore inhibition of Heparan sulfate (glucosamine) 3-o-sulfotransferase 2 (HS3ST2, Accession NP_006034.1), a gene which plays a role in the generation of heparan sulfate proteoglycan. Accordingly, utilities of GAM5227 include diagnosis, prevention and treatment of diseases and clinical conditions associated with HS3ST2.

The function of HS3ST2 and its association with various diseases and clinical conditions, has been established by previous studies, as described hereinabove with reference to GAM767.1. Indian hedgehog homolog (drosophila) (IHH, Accession XP_050846.3) is another GAM5227 target gene, herein designated TARGET GENE. IHH BINDING SITE is a target binding site found in the 3' untranslated region of mRNA encoded by IHH, corresponding to a target binding site such as BINDING SITE I, BINDING SITE II or BINDING SITE III of FIG. 8. Table 4 illustrates the complementarity of the nucleotide sequences of IHH BINDING SITE, designated SEQ ID:762, to the nucleotide sequence of GAM5227 RNA, herein designated GAM RNA, also designated SEQ ID:299.

Another function of GAM5227 is therefore inhibition of Indian hedgehog homolog (drosophila) (IHH, Accession XP_050846.3), a gene which intercellular signal essential for a variety of patterning events during development. binds to the patched (ptc) receptor, which functions in association with smoothened (smo), to activate the transcription of target genes. implicated in endochondral ossification: may regulate the balance between growth and ossification of the developing bones. induces the expression of parathyroid hormone-related protein (pthrp) (by similarity). and therefore is associated with Brachydactyly type a1. Accordingly, utilities of GAM5227 include diagnosis, prevention and treatment of Brachydactyly type a1, and of other diseases and clinical conditions associated with IHH.

The function of IHH and its association with various diseases and clinical conditions, has been established by previous studies, as described hereinabove with reference to GAM206.1. Interleukin 1 family, member 8 (eta) (IL1F8, Accession NP_055253.2) is another GAM5227 target gene, herein designated TARGET GENE. IL1F8 BINDING SITE is a target binding site found in the 5' untranslated region of multiple transcripts of mRNA encoded by IL1F8, corresponding to a target binding site such as BINDING SITE I, BINDING SITE II or BINDING SITE III of FIG. 8. Table 4 illustrates the complementarity of the nucleotide sequences of IL1F8 BINDING SITE, designated SEQ ID:2378, to the nucleotide sequence of GAM5227 RNA, herein designated GAM RNA, also designated SEQ ID:299.

Another function of GAM5227 is therefore inhibition of Interleukin 1 family, member 8 (eta) (IL1F8, Accession NP_055253.2), a gene which initiates and promotes the host response to injury or infection by activating a set of transcription factors. Accordingly, utilities of GAM5227 include diagnosis, prevention and treatment of diseases and clinical conditions associated with IL1F8.

The function of IL1F8 and its association with various diseases and clinical conditions, has been established by previous studies, as described hereinabove with reference to GAM488.1. Interleukin 1 family, member 8 (eta) (IL1F8, Accession NP_775270.1) is another GAM5227 target gene, herein designated TARGET GENE. IL1F8 BINDING SITE is a target binding site found in the 5' untranslated region of multiple transcripts of mRNA encoded by IL1F8, corresponding to a target binding site such as BINDING SITE I, BINDING SITE II or BINDING SITE III of FIG. 8. Table 4 illustrates the complementarity of the nucleotide sequences of IL1F8 BINDING SITE, designated SEQ ID:2378, to the nucleotide sequence of GAM5227 RNA, herein designated GAM RNA, also designated SEQ ID:299.

Another function of GAM5227 is therefore inhibition of Interleukin 1 family, member 8 (eta) (IL1F8, Accession NP_775270.1), a gene which initiates and promotes the host response to injury or infection by activating a set of transcription factors. Accordingly, utilities of GAM5227 include diagnosis, prevention and treatment of diseases and clinical conditions associated with IL1F8.

The function of IL1F8 and its association with various diseases and clinical conditions, has been established by previous studies, as described hereinabove with reference to GAM488.1. Interleukin 1 receptor, type i (IL1R1, Accession NP_000868.1) is another GAM5227 target gene, herein designated TARGET GENE. IL1R1 BINDING SITE is a target binding site found in the 3' untranslated region of mRNA encoded by IL1R1, corresponding to a target binding site such as BINDING SITE I, BINDING SITE II or BINDING SITE III of FIG. 8. Table 4 illustrates the complementarity of the nucleotide sequences of IL1R1 BINDING SITE, designated SEQ ID:7235, to the nucleotide sequence of GAM5227 RNA, herein designated GAM RNA, also designated SEQ ID:299.

Another function of GAM5227 is therefore inhibition of Interleukin 1 receptor, type i (IL1R1, Accession NP_000868.1), a gene which is a receptor for interleukin-1 alpha (il-1a), beta (il-1b), and interleukin-1 receptor antagonist protein (il-1ra). Accordingly, utilities of GAM5227 include diagnosis, prevention and treatment of diseases and clinical conditions associated with IL1R1.

The function of IL1R1 and its association with various diseases and clinical conditions, has been established by previous studies, as described hereinabove with reference to GAM40.1. Interleukin 1 receptor accessory protein (IL1RAP, Accession NP_002173.1) is another GAM5227 target gene, herein designated TARGET GENE. IL1RAP BINDING SITE is a target binding site found in the 3' untranslated region of multiple transcripts of mRNA encoded by IL1RAP, corresponding to a target binding site such as BINDING SITE I, BINDING SITE II or BINDING SITE III of FIG. 8. Table 4 illustrates the complementarity of the nucleotide sequences of IL1RAP BINDING SITE, designated SEQ ID:19607, to the nucleotide sequence of GAM5227 RNA, herein designated GAM RNA, also designated SEQ ID:299.

Another function of GAM5227 is therefore inhibition of Interleukin 1 receptor accessory protein (IL1RAP, Accession NP_002173.1), a gene which may function as a membrane receptor. promotes heterophilic cellular adhesion. Accordingly, utilities of GAM5227 include diagnosis, prevention and treatment of diseases and clinical conditions associated with IL1RAP.

The function of IL1RAP and its association with various diseases and clinical conditions, has been established by previous studies, as described hereinabove with reference to GAM335.2. IMP-2 (Accession NP_006539.2) is another GAM5227 target gene, herein designated TARGET GENE. IMP-2 BINDING SITE is a target binding site found in the 3' untranslated region of mRNA encoded by IMP-2, corresponding to a target binding site such as BINDING SITE I, BINDING SITE II or BINDING SITE III of FIG. 8. Table 4 illustrates the complementarity of the nucleotide sequences of IMP-2 BINDING SITE, designated SEQ ID:9919, to the nucleotide sequence of GAM5227 RNA, herein designated GAM RNA, also designated SEQ ID:299.

Another function of GAM5227 is therefore inhibition of IMP-2 (Accession NP_006539.2). Accordingly, utilities of GAM5227 include diagnosis, prevention and treatment of diseases and clinical conditions associated with IMP-2.

KIAA0140 (Accession NP_055476.1) is another GAM5227 target gene, herein designated TARGET GENE. KIAA0140 BINDING SITE is a target binding site found in the 3' untranslated region of mRNA encoded by KIAA0140, corresponding to a target binding site such as BINDING SITE I, BINDING SITE II or BINDING SITE III of FIG. 8. Table 4 illustrates the complementarity of the nucleotide sequences of KIAA0140 BINDING SITE, designated SEQ ID:9212, to the nucleotide sequence of GAM5227 RNA, herein designated GAM RNA, also designated SEQ ID:299.

Another function of GAM5227 is therefore inhibition of KIAA0140 (Accession NP_055476.1). Accordingly, utilities of GAM5227 include diagnosis, prevention and treatment of diseases and clinical conditions associated with KIAA0140.

KIAA0157 (Accession NP_115558.2) is another GAM5227 target gene, herein designated TARGET GENE. KIAA0157 BINDING SITE is a target binding site found in the 3' untranslated region of mRNA encoded by KIAA0157, corresponding to a target binding site such as BINDING SITE I, BINDING SITE II or BINDING SITE III of FIG. 8. Table 4 illustrates the complementarity of the nucleotide sequences of KIAA0157 BINDING SITE, designated SEQ ID:13266, to the nucleotide sequence of GAM5227 RNA, herein designated GAM RNA, also designated SEQ ID:299.

Another function of GAM5227 is therefore inhibition of KIAA0157 (Accession NP_115558.2). Accordingly, utilities of GAM5227 include diagnosis, prevention and treatment of diseases and clinical conditions associated with KIAA0157.

KIAA0232 (Accession XP_291106.1) is another GAM5227 target gene, herein designated TARGET GENE. KIAA0232 BINDING SITE is a target binding site found in the 3' untranslated region of mRNA encoded by KIAA0232, corresponding to a target binding site such as BINDING SITE I, BINDING SITE II or BINDING SITE III of FIG. 8. Table 4 illustrates the complementarity of the nucleotide sequences of KIAA0232 BINDING SITE, designated SEQ ID:17412, to the nucleotide sequence of GAM5227 RNA, herein designated GAM RNA, also designated SEQ ID:299.

Another function of GAM5227 is therefore inhibition of KIAA0232 (Accession XP_291106.1). Accordingly, utilities of GAM5227 include diagnosis, prevention and treatment of diseases and clinical conditions associated with KIAA0232.

KIAA0268 (Accession XP_300768.1) is another GAM5227 target gene, herein designated TARGET GENE. KIAA0268 BINDING SITE is a target binding site found in the 3' untranslated region of mRNA encoded by KIAA0268, corresponding to a target binding site such as BINDING SITE I, BINDING SITE II or BINDING SITE III of FIG. 8. Table 4 illustrates the complementarity of the nucleotide sequences of KIAA0268 BINDING SITE, designated SEQ ID:9788, to the nucleotide sequence of GAM5227 RNA, herein designated GAM RNA, also designated SEQ ID:299.

Another function of GAM5227 is therefore inhibition of KIAA0268 (Accession XP_300768.1). Accordingly, utilities of GAM5227 include diagnosis, prevention and treatment of diseases and clinical conditions associated with KIAA0268.

KIAA0295 (Accession XP_042833.2) is another GAM5227 target gene, herein designated TARGET GENE. KIAA0295 BINDING SITE is a target binding site found in the 3' untranslated region of mRNA encoded by KIAA0295, corresponding to a target binding site such as BINDING SITE I, BINDING SITE II or BINDING SITE III of FIG. 8. Table 4 illustrates the complementarity of the nucleotide sequences of KIAA0295 BINDING SITE, designated SEQ ID:19557, to the nucleotide sequence of GAM5227 RNA, herein designated GAM RNA, also designated SEQ ID:299.

Another function of GAM5227 is therefore inhibition of KIAA0295 (Accession XP_042833.2). Accordingly, utilities of GAM5227 include diagnosis, prevention and treatment of diseases and clinical conditions associated with KIAA0295.

KIAA0367 (Accession XP_041018.2) is another GAM5227 target gene, herein designated TARGET GENE. KIAA0367 BINDING SITE is a target binding site found in the 3' untranslated region of mRNA encoded by KIAA0367, corresponding to a target binding site such as BINDING SITE I, BINDING SITE II or BINDING SITE III of FIG. 8. Table 4 illustrates the complementarity of the nucleotide sequences of KIAA0367 BINDING SITE, designated SEQ ID:10082, to the nucleotide sequence of GAM5227 RNA, herein designated GAM RNA, also designated SEQ ID:299.

Another function of GAM5227 is therefore inhibition of KIAA0367 (Accession XP_041018.2). Accordingly, utilities of GAM5227 include diagnosis, prevention and treatment of diseases and clinical conditions associated with KIAA0367.

KIAA0514 (Accession NP_055511.1) is another GAM5227 target gene, herein designated TARGET GENE. KIAA0514 BINDING SITE is a target binding site found in the 3' untranslated region of mRNA encoded by KIAA0514, corresponding to a target binding site such as BINDING SITE I, BINDING SITE II or BINDING SITE III of FIG. 8. Table 4 illustrates the complementarity of the nucleotide sequences of KIAA0514 BINDING SITE, designated SEQ ID:15950, to the nucleotide sequence of GAM5227 RNA, herein designated GAM RNA, also designated SEQ ID:299.

Another function of GAM5227 is therefore inhibition of KIAA0514 (Accession NP_055511.1). Accordingly, utilities of GAM5227 include diagnosis, prevention and treatment of diseases and clinical conditions associated with KIAA0514.

KIAA0721 (Accession NP_067680.2) is another GAM5227 target gene, herein designated TARGET GENE. KIAA0721 BINDING SITE is a target binding site found in the 3' untranslated region of mRNA encoded by KIAA0721, corresponding to a target binding site such as BINDING SITE I, BINDING SITE II or BINDING SITE III of FIG. 8. Table 4 illustrates the complementarity of the nucleotide sequences of KIAA0721 BINDING SITE, designated SEQ ID:19760, to the nucleotide sequence of GAM5227 RNA, herein designated GAM RNA, also designated SEQ ID:299.

Another function of GAM5227 is therefore inhibition of KIAA0721 (Accession NP_067680.2). Accordingly, utilities of GAM5227 include diagnosis, prevention and treatment of diseases and clinical conditions associated with KIAA0721.

KIAA1136 (Accession XP_166110.3) is another GAM5227 target gene, herein designated TARGET GENE. KIAA1136 BINDING SITE is a target binding site found in the 3' untranslated region of mRNA encoded by KIAA1136, corresponding to a target binding site such as BINDING SITE I, BINDING SITE II or BINDING SITE III of FIG. 8. Table 4 illustrates the complementarity of the nucleotide sequences of KIAA1136 BINDING SITE, designated SEQ ID:12332, to the nucleotide sequence of GAM5227 RNA, herein designated GAM RNA, also designated SEQ ID:299.

Another function of GAM5227 is therefore inhibition of KIAA1136 (Accession XP_166110.3). Accordingly, utilities of GAM5227 include diagnosis, prevention and treatment of diseases and clinical conditions associated with KIAA1136.

KIAA1157 (Accession XP_051093.2) is another GAM5227 target gene, herein designated TARGET GENE. KIAA1157 BINDING SITE is a target binding site found in the 3' untranslated region of mRNA encoded by KIAA1157, corresponding to a target binding site such as BINDING SITE I, BINDING SITE II or BINDING SITE III of FIG. 8. Table 4 illustrates the complementarity of the nucleotide sequences of KIAA1157 BINDING SITE, designated SEQ ID:7957, to the nucleotide sequence of GAM5227 RNA, herein designated GAM RNA, also designated SEQ ID:299.

Another function of GAM5227 is therefore inhibition of KIAA1157 (Accession XP_051093.2). Accordingly, utilities of GAM5227 include diagnosis, prevention and treatment of diseases and clinical conditions associated with KIAA1157.

KIAA1446 (Accession NP_065887.1) is another GAM5227 target gene, herein designated TARGET GENE. KIAA1446 BINDING SITE is a target binding site found in the 3' untranslated region of mRNA encoded by KIAA1446, corresponding to a target binding site such as BINDING SITE I, BINDING SITE II or BINDING SITE III of FIG. 8. Table 4 illustrates the complementarity of the nucleotide sequences of KIAA1446 BINDING SITE, designated SEQ ID:6089, to the nucleotide sequence of GAM5227 RNA, herein designated GAM RNA, also designated SEQ ID:299.

Another function of GAM5227 is therefore inhibition of KIAA1446 (Accession NP_065887.1). Accordingly, utilities of GAM5227 include diagnosis, prevention and treatment of diseases and clinical conditions associated with KIAA1446.

KIAA1822 (Accession XP_041566.2) is another GAM5227 target gene, herein designated TARGET GENE. KIAA1822 BINDING SITE is a target binding site found in the 3' untranslated region of mRNA encoded by KIAA1822, corresponding to a target binding site such as BINDING SITE I, BINDING SITE II or BINDING SITE III of FIG. 8. Table 4 illustrates the complementarity of the nucleotide sequences of KIAA1822 BINDING SITE, designated SEQ ID:17711, to the nucleotide sequence of GAM5227 RNA, herein designated GAM RNA, also designated SEQ ID:299.

Another function of GAM5227 is therefore inhibition of KIAA1822 (Accession XP_041566.2). Accordingly, utilities of GAM5227 include diagnosis, prevention and treatment of diseases and clinical conditions associated with KIAA1822.

KIAA1854 (Accession XP_049884.1) is another GAM5227 target gene, herein designated TARGET GENE. KIAA1854 BINDING SITE is a target binding site found in the 3' untranslated region of mRNA encoded by KIAA1854, corresponding to a target binding site such as BINDING SITE I, BINDING SITE II or BINDING SITE III of FIG. 8. Table 4 illustrates the complementarity of the nucleotide sequences of KIAA1854 BINDING SITE, designated SEQ ID:9010, to the nucleotide sequence of GAM5227 RNA, herein designated GAM RNA, also designated SEQ ID:299.

Another function of GAM5227 is therefore inhibition of KIAA1854 (Accession XP_049884.1). Accordingly, utilities of GAM5227 include diagnosis, prevention and treatment of diseases and clinical conditions associated with KIAA1854.

KIAA1879 (Accession XP_056635.1) is another GAM5227 target gene, herein designated TARGET GENE. KIAA1879 BINDING SITE is a target binding site found in the 5' untranslated region of mRNA encoded by KIAA1879, corresponding to a target binding site such as BINDING SITE I, BINDING SITE II or BINDING SITE III of FIG. 8. Table 4 illustrates the complementarity of the nucleotide sequences of KIAA1879 BINDING SITE, designated SEQ ID:15546, to the nucleotide sequence of GAM5227 RNA, herein designated GAM RNA, also designated SEQ ID:299.

Another function of GAM5227 is therefore inhibition of KIAA1879 (Accession XP_056635.1). Accordingly, utilities of GAM5227 include diagnosis, prevention and treatment of diseases and clinical conditions associated with KIAA1879.

Kruppel-like factor 12 (KLF12, Accession NP_009180.3) is another GAM5227 target gene, herein designated TARGET GENE. KLF12 BINDING SITE is a target binding site found in the 3' untranslated region of multiple transcripts of mRNA encoded by KLF12, corresponding to a target binding site such as BINDING SITE I, BINDING SITE II or BINDING SITE III of FIG. 8. Table 4 illustrates the complementarity of the nucleotide sequences of KLF12 BINDING SITE, designated SEQ ID:5272, to the nucleotide sequence of GAM5227 RNA, herein designated GAM RNA, also designated SEQ ID:299.

Another function of GAM5227 is therefore inhibition of Kruppel-like factor 12 (KLF12, Accession NP_009180.3). Accordingly, utilities of GAM5227 include diagnosis, prevention and treatment of diseases and clinical conditions associated with KLF12.

Low density lipoprotein receptor (familial hypercholesterolemia) (LDLR, Accession NP_000518.1) is another GAM5227 target gene, herein designated TARGET GENE. LDLR BINDING SITE is a target binding site found in the 3' untranslated region of mRNA encoded by LDLR, corresponding to a target binding site such as BINDING SITE I, BINDING SITE II or BINDING SITE III of FIG. 8. Table 4 illustrates the complementarity of the nucleotide sequences of LDLR BINDING SITE, designated SEQ ID:9706, to the nucleotide sequence of GAM5227 RNA, herein designated GAM RNA, also designated SEQ ID:299.

Another function of GAM5227 is therefore inhibition of Low density lipoprotein receptor (familial hypercholesterolemia) (LDLR, Accession NP_000518.1), a gene which also acts as a tumor suppressor. and therefore is associated with Familial hypercholesterolemia. Accordingly, utilities of GAM5227 include diagnosis, prevention and treatment of Familial hypercholesterolemia, and of other diseases and clinical conditions associated with LDLR.

The function of LDLR and its association with various diseases and clinical conditions, has been established by previous studies, as described hereinabove with reference to GAM99.1. Lim homeobox 9 (LHX9, Accession NP_064589.1) is another GAM5227 target gene, herein designated TARGET GENE. LHX9 BINDING SITE is a target binding site found in the 5' untranslated region of multiple transcripts of mRNA encoded by LHX9, corresponding to a target binding site such as BINDING SITE I, BINDING SITE II or BINDING SITE III of FIG. 8. Table 4 illustrates the complementarity of the nucleotide sequences of LHX9 BINDING SITE, designated SEQ ID:7190, to the nucleotide sequence of GAM5227 RNA, herein designated GAM RNA, also designated SEQ ID:299.

Another function of GAM5227 is therefore inhibition of Lim homeobox 9 (LHX9, Accession NP_064589.1). Accordingly, utilities of GAM5227 include diagnosis, prevention and treatment of diseases and clinical conditions associated with LHX9.

LOC115131 (Accession NP_660285.1) is another GAM5227 target gene, herein designated TARGET GENE. LOC115131 BINDING SITE is a target binding site found in the 3' untranslated region of mRNA encoded by LOC115131, corresponding to a target binding site such as BINDING SITE I, BINDING SITE II or BINDING SITE III of FIG. 8. Table 4 illustrates the complementarity of the nucleotide sequences of LOC115131 BINDING SITE, designated SEQ ID:9407, to the nucleotide sequence of GAM5227 RNA, herein designated GAM RNA, also designated SEQ ID:299.

Another function of GAM5227 is therefore inhibition of LOC115131 (Accession NP_660285.1). Accordingly, utilities of GAM5227 include diagnosis, prevention and treatment of diseases and clinical conditions associated with LOC115131.

LOC143310 (Accession XP_084485.1) is another GAM5227 target gene, herein designated TARGET GENE. LOC143310 BINDING SITE is a target binding site found in the 3' untranslated region of mRNA encoded by LOC143310, corresponding to a target binding site such as BINDING SITE I, BINDING SITE II or BINDING SITE III of FIG. 8. Table 4 illustrates the complementarity of the nucleotide sequences of LOC143310 BINDING SITE, designated SEQ ID:1541, to the nucleotide sequence of GAM5227 RNA, herein designated GAM RNA, also designated SEQ ID:299.

Another function of GAM5227 is therefore inhibition of LOC143310 (Accession XP_084485.1). Accordingly, utilities of GAM5227 include diagnosis, prevention and treatment of diseases and clinical conditions associated with LOC143310.

LOC145453 (Accession XP_085120.1) is another GAM5227 target gene, herein designated TARGET GENE. LOC145453 BINDING SITE is a target binding site found in the 3' untranslated region of mRNA encoded by LOC145453, corresponding to a target binding site such as BINDING SITE I, BINDING SITE II or BINDING SITE III of FIG. 8. Table 4 illustrates the complementarity of the nucleotide sequences of LOC145453 BINDING SITE, designated SEQ ID:1961, to the nucleotide sequence of GAM5227 RNA, herein designated GAM RNA, also designated SEQ ID:299.

Another function of GAM5227 is therefore inhibition of LOC145453 (Accession XP_085120.1). Accordingly, utilities of GAM5227 include diagnosis, prevention and treatment of diseases and clinical conditions associated with LOC145453.

LOC145601 (Accession XP_096816.1) is another GAM5227 target gene, herein designated TARGET GENE. LOC145601 BINDING SITE is a target binding site found in the 3' untranslated region of mRNA encoded by LOC145601, corresponding to a target binding site such as BINDING SITE I, BINDING SITE II or BINDING SITE III of FIG. 8. Table 4 illustrates the complementarity of the nucleotide sequences of LOC145601 BINDING SITE, designated SEQ ID:1398, to the nucleotide sequence of GAM5227 RNA, herein designated GAM RNA, also designated SEQ ID:299.

Another function of GAM5227 is therefore inhibition of LOC145601 (Accession XP_096816.1). Accordingly, utilities of GAM5227 include diagnosis, prevention and treatment of diseases and clinical conditions associated with LOC145601.

LOC145725 (Accession XP_085211.1) is another GAM5227 target gene, herein designated TARGET GENE. LOC145725 BINDING SITE is a target binding site found in the 3' untranslated region of mRNA encoded by LOC145725, corresponding to a target binding site such as BINDING SITE I, BINDING SITE II or BINDING SITE III of FIG. 8. Table 4 illustrates the complementarity of the nucleotide sequences of LOC145725 BINDING SITE, designated SEQ ID:17221, to the nucleotide sequence of GAM5227 RNA, herein designated GAM RNA, also designated SEQ ID:299.

Another function of GAM5227 is therefore inhibition of LOC145725 (Accession XP_085211.1). Accordingly, utilities of GAM5227 include diagnosis, prevention and treatment of diseases and clinical conditions associated with LOC145725.

LOC145845 (Accession XP_096884.1) is another GAM5227 target gene, herein designated TARGET GENE. LOC145845 BINDING SITE is a target binding site found in the 3' untranslated region of mRNA encoded by LOC145845, corresponding to a target binding site such as BINDING SITE I, BINDING SITE II or BINDING SITE III of FIG. 8. Table 4 illustrates the complementarity of the nucleotide sequences of LOC145845 BINDING SITE, designated SEQ ID:19334, to the nucleotide sequence of GAM5227 RNA, herein designated GAM RNA, also designated SEQ ID:299.

Another function of GAM5227 is therefore inhibition of LOC145845 (Accession XP_096884.1). Accordingly, utilities of GAM5227 include diagnosis, prevention and treatment of diseases and clinical conditions associated with LOC145845.

LOC146272 (Accession XP_085396.1) is another GAM5227 target gene, herein designated TARGET GENE. LOC146272 BINDING SITE is a target binding site found in the 3' untranslated region of mRNA encoded by LOC146272, corresponding to a target binding site such as BINDING SITE I, BINDING SITE II or BINDING SITE III of FIG. 8. Table 4 illustrates the complementarity of the nucleotide sequences of LOC146272 BINDING SITE, designated SEQ ID:10066, to the nucleotide sequence of GAM5227 RNA, herein designated GAM RNA, also designated SEQ ID:299.

Another function of GAM5227 is therefore inhibition of LOC146272 (Accession XP_085396.1). Accordingly, utilities of GAM5227 include diagnosis, prevention and treatment of diseases and clinical conditions associated with LOC146272.

LOC151234 (Accession XP_087136.1) is another GAM5227 target gene, herein designated TARGET GENE. LOC151234 BINDING SITE is a target binding site found in the 3' untranslated region of mRNA encoded by LOC151234, corresponding to a target binding site such as BINDING SITE I, BINDING SITE II or BINDING SITE III of FIG. 8. Table 4 illustrates the complementarity of the nucleotide sequences of LOC151234 BINDING SITE, designated SEQ ID:16533, to the nucleotide sequence of GAM5227 RNA, herein designated GAM RNA, also designated SEQ ID:299.

Another function of GAM5227 is therefore inhibition of LOC151234 (Accession XP_087136.1). Accordingly, utilities of GAM5227 include diagnosis, prevention and treatment of diseases and clinical conditions associated with LOC151234.

LOC152078 (Accession XP_087376.2) is another GAM5227 target gene, herein designated TARGET GENE. LOC152078 BINDING SITE is a target binding site found in the 5' untranslated region of mRNA encoded by LOC152078, corresponding to a target binding site such as BINDING SITE I, BINDING SITE II or BINDING SITE III of FIG. 8. Table 4 illustrates the complementarity of the nucleotide sequences of LOC152078 BINDING SITE, designated SEQ ID:16522, to the nucleotide sequence of GAM5227 RNA, herein designated GAM RNA, also designated SEQ ID:299.

Another function of GAM5227 is therefore inhibition of LOC152078 (Accession XP_087376.2). Accordingly, utilities of GAM5227 include diagnosis, prevention and treatment of diseases and clinical conditions associated with LOC152078.

LOC153577 (Accession XP_098394.1) is another GAM5227 target gene, herein designated TARGET GENE. LOC153577 BINDING SITE is a target binding site found in the 5' untranslated region of mRNA encoded by LOC153577, corresponding to a target binding site such as BINDING SITE I, BINDING SITE II or BINDING SITE III of FIG. 8. Table 4 illustrates the complementarity of the nucleotide sequences of LOC153577 BINDING SITE, designated SEQ ID:10222, to the nucleotide sequence of GAM5227 RNA, herein designated GAM RNA, also designated SEQ ID:299.

Another function of GAM5227 is therefore inhibition of LOC153577 (Accession XP_098394.1). Accordingly, utilities of GAM5227 include diagnosis, prevention and treatment of diseases and clinical conditions associated with LOC153577.

LOC154834 (Accession XP_098621.1) is another GAM5227 target gene, herein designated TARGET GENE. LOC154834 BINDING SITE is a target binding site found in the 3' untranslated region of mRNA encoded by LOC154834, corresponding to a target binding site such as BINDING SITE I, BINDING SITE II or BINDING SITE III of FIG. 8. Table 4 illustrates the complementarity of the nucleotide sequences of LOC154834 BINDING SITE, designated SEQ ID:7900, to the nucleotide sequence of GAM5227 RNA, herein designated GAM RNA, also designated SEQ ID:299.

Another function of GAM5227 is therefore inhibition of LOC154834 (Accession XP_098621.1). Accordingly, utilities of GAM5227 include diagnosis, prevention and treatment of diseases and clinical conditions associated with LOC154834.

LOC154877 (Accession XP_098626.1) is another GAM5227 target gene, herein designated TARGET GENE. LOC154877 BINDING SITE is a target binding site found in the 3' untranslated region of mRNA encoded by LOC154877, corresponding to a target binding site such as BINDING SITE I, BINDING SITE II or BINDING SITE III of FIG. 8. Table 4 illustrates the complementarity of the nucleotide sequences of LOC154877 BINDING SITE, designated SEQ ID:17668, to the nucleotide sequence of GAM5227 RNA, herein designated GAM RNA, also designated SEQ ID:299.

Another function of GAM5227 is therefore inhibition of LOC154877 (Accession XP_098626.1). Accordingly, utilities of GAM5227 include diagnosis, prevention and treatment of diseases and clinical conditions associated with LOC154877.

LOC161635 (Accession XP_172921.1) is another GAM5227 target gene, herein designated TARGET GENE. LOC161635 BINDING SITE is a target binding site found in the 5' untranslated region of mRNA encoded by LOC161635, corresponding to a target binding site such as BINDING SITE I, BINDING SITE II or BINDING SITE III of FIG. 8. Table 4 illustrates the complementarity of the nucleotide sequences of LOC161635 BINDING SITE, designated SEQ ID:11973, to the nucleotide sequence of GAM5227 RNA, herein designated GAM RNA, also designated SEQ ID:299.

Another function of GAM5227 is therefore inhibition of LOC161635 (Accession XP_172921.1). Accordingly, utilities of GAM5227 include diagnosis, prevention and treatment of diseases and clinical conditions associated with LOC161635.

LOC164580 (Accession XP_104562.1) is another GAM5227 target gene, herein designated TARGET GENE. LOC164580 BINDING SITE is a target binding site found in the 3' untranslated region of mRNA encoded by LOC164580, corresponding to a target binding site such as BINDING SITE I, BINDING SITE II or BINDING SITE III of FIG. 8. Table 4 illustrates the complementarity of the nucleotide sequences of LOC164580 BINDING SITE, designated SEQ ID:1232, to the nucleotide sequence of GAM5227 RNA, herein designated GAM RNA, also designated SEQ ID:299.

Another function of GAM5227 is therefore inhibition of LOC164580 (Accession XP_104562.1). Accordingly, utilities of GAM5227 include diagnosis, prevention and treatment of diseases and clinical conditions associated with LOC164580.

LOC199692 (Accession NP_660338.1) is another GAM5227 target gene, herein designated TARGET GENE. LOC199692 BINDING SITE is a target binding site found in the 3' untranslated region of mRNA encoded by LOC199692, corresponding to a target binding site such as BINDING SITE I, BINDING SITE II or BINDING SITE III of FIG. 8. Table 4 illustrates the complementarity of the nucleotide sequences of LOC199692 BINDING SITE, designated SEQ ID:17021, to the nucleotide sequence of GAM5227 RNA, herein designated GAM RNA, also designated SEQ ID:299.

Another function of GAM5227 is therefore inhibition of LOC199692 (Accession NP_660338.1). Accordingly, utilities of GAM5227 include diagnosis, prevention and treatment of diseases and clinical conditions associated with LOC199692.

LOC200574 (Accession XP_114264.1) is another GAM5227 target gene, herein designated TARGET GENE. LOC200574 BINDING SITE is a target binding site found in the 3' untranslated region of mRNA encoded by LOC200574, corresponding to a target binding site such as BINDING SITE I, BINDING SITE II or BINDING SITE III of FIG. 8. Table 4 illustrates the complementarity of the nucleotide sequences of LOC200574 BINDING SITE, designated SEQ ID:5245, to the nucleotide sequence of GAM5227 RNA, herein designated GAM RNA, also designated SEQ ID:299.

Another function of GAM5227 is therefore inhibition of LOC200574 (Accession XP_114264.1). Accordingly, utilities of GAM5227 include diagnosis, prevention and treatment of diseases and clinical conditions associated with LOC200574.

LOC200681 (Accession XP_117260.1) is another GAM5227 target gene, herein designated TARGET GENE. LOC200681 BINDING SITE is a target binding site found in the 5' untranslated region of mRNA encoded by LOC200681, corresponding to a target binding site such as BINDING SITE I, BINDING SITE II or BINDING SITE III of FIG. 8. Table 4 illustrates the complementarity of the nucleotide sequences of LOC200681 BINDING SITE, designated SEQ ID:15034, to the nucleotide sequence of GAM5227 RNA, herein designated GAM RNA, also designated SEQ ID:299.

Another function of GAM5227 is therefore inhibition of LOC200681 (Accession XP_117260.1). Accordingly, utilities of GAM5227 include diagnosis, prevention and treatment of diseases and clinical conditions associated with LOC200681.

LOC201194 (Accession XP_117061.1) is another GAM5227 target gene, herein designated TARGET GENE. LOC201194 BINDING SITE is a target binding site found in the 5' untranslated region of mRNA encoded by LOC201194, corresponding to a target binding site such as BINDING SITE I, BINDING SITE II or BINDING SITE III of FIG. 8. Table 4 illustrates the complementarity of the nucleotide sequences of LOC201194 BINDING SITE, designated SEQ ID:2742, to the nucleotide sequence of GAM5227 RNA, herein designated GAM RNA, also designated SEQ ID:299.

Another function of GAM5227 is therefore inhibition of LOC201194 (Accession XP_117061.1). Accordingly, utilities of GAM5227 include diagnosis, prevention and treatment of diseases and clinical conditions associated with LOC201194.

LOC222252 (Accession XP_168640.1) is another GAM5227 target gene, herein designated TARGET GENE. LOC222252 BINDING SITE is a target binding site found in the 5' untranslated region of mRNA encoded by LOC222252, corresponding to a target binding site such as BINDING SITE I, BINDING SITE II or BINDING SITE III of FIG. 8. Table 4 illustrates the complementarity of the nucleotide sequences of LOC222252 BINDING SITE, designated SEQ ID:13169, to the nucleotide sequence of GAM5227 RNA, herein designated GAM RNA, also designated SEQ ID:299.

Another function of GAM5227 is therefore inhibition of LOC222252 (Accession XP_168640.1). Accordingly, utilities of GAM5227 include diagnosis, prevention and treatment of diseases and clinical conditions associated with LOC222252.

LOC254128 (Accession XP_171004.1) is another GAM5227 target gene, herein designated TARGET GENE. LOC254128 BINDING SITE is a target binding site found in the 3' untranslated region of mRNA encoded by LOC254128, corresponding to a target binding site such as BINDING SITE I, BINDING SITE II or BINDING SITE III of FIG. 8. Table 4 illustrates the complementarity of the nucleotide sequences of LOC254128 BINDING SITE, designated SEQ ID:2157, to the nucleotide sequence of GAM5227 RNA, herein designated GAM RNA, also designated SEQ ID:299.

Another function of GAM5227 is therefore inhibition of LOC254128 (Accession XP_171004.1). Accordingly, utilities of GAM5227 include diagnosis, prevention and treatment of diseases and clinical conditions associated with LOC254128.

LOC254544 (Accession XP_172947.1) is another GAM5227 target gene, herein designated TARGET GENE. LOC254544 BINDING SITE is a target binding site found in the 5' untranslated region of mRNA encoded by LOC254544, corresponding to a target binding site such as BINDING SITE I, BINDING SITE II or BINDING SITE III of FIG. 8. Table 4 illustrates the complementarity of the nucleotide sequences of LOC254544 BINDING SITE, designated SEQ ID:3693, to the nucleotide sequence of GAM5227 RNA, herein designated GAM RNA, also designated SEQ ID:299.

Another function of GAM5227 is therefore inhibition of LOC254544 (Accession XP_172947.1). Accordingly, utilities of GAM5227 include diagnosis, prevention and treatment of diseases and clinical conditions associated with LOC254544.

LOC254556 (Accession XP_170588.1) is another GAM5227 target gene, herein designated TARGET GENE. LOC254556 BINDING SITE is a target binding site found in the 3' untranslated region of mRNA encoded by LOC254556, corresponding to a target binding site such as BINDING SITE I, BINDING SITE II or BINDING SITE III of FIG. 8. Table 4 illustrates the complementarity of the nucleotide sequences of LOC254556 BINDING SITE, designated SEQ ID:13871, to the nucleotide sequence of GAM5227 RNA, herein designated GAM RNA, also designated SEQ ID:299.

Another function of GAM5227 is therefore inhibition of LOC254556 (Accession XP_170588.1). Accordingly, utilities of GAM5227 include diagnosis, prevention and treatment of diseases and clinical conditions associated with LOC254556.

LOC283018 (Accession XP_208026.2) is another GAM5227 target gene, herein designated TARGET GENE. LOC283018 BINDING SITE is a target binding site found in the 5' untranslated region of mRNA encoded by LOC283018, corresponding to a target binding site such as BINDING SITE I, BINDING SITE II or BINDING SITE III of FIG. 8. Table 4 illustrates the complementarity of the nucleotide sequences of LOC283018 BINDING SITE, designated SEQ ID:9893, to the nucleotide sequence of GAM5227 RNA, herein designated GAM RNA, also designated SEQ ID:299.

Another function of GAM5227 is therefore inhibition of LOC283018 (Accession XP_208026.2). Accordingly, utilities of GAM5227 include diagnosis, prevention and treatment of diseases and clinical conditions associated with LOC283018.

LOC283107 (Accession XP_210889.1) is another GAM5227 target gene, herein designated TARGET GENE. LOC283107 BINDING SITE1 and LOC283107 BINDING SITE2 are target binding sites found in untranslated regions of mRNA encoded by LOC283107, corresponding to target binding sites such as BINDING SITE I, BINDING SITE II or BINDING SITE III of FIG. 8. Table 4 illustrates the complementarity of the nucleotide sequences of LOC283107 BINDING SITE1 and LOC283107 BINDING SITE2, designated SEQ ID:10191 and SEQ ID:13094 respectively, to the nucleotide sequence of GAM5227 RNA, herein designated GAM RNA, also designated SEQ ID:299.

Another function of GAM5227 is therefore inhibition of LOC283107 (Accession XP_210889.1). Accordingly, utilities of GAM5227 include diagnosis, prevention and treatment of diseases and clinical conditions associated with LOC283107.

LOC283153 (Accession XP_208532.1) is another GAM5227 target gene, herein designated TARGET GENE. LOC283153 BINDING SITE is a target binding site found in the 3' untranslated region of mRNA encoded by LOC283153, corresponding to a target binding site such as BINDING SITE I, BINDING SITE II or BINDING SITE III of FIG. 8. Table 4 illustrates the complementarity of the nucleotide sequences of LOC283153 BINDING SITE, designated SEQ ID:13811, to the nucleotide sequence of GAM5227 RNA, herein designated GAM RNA, also designated SEQ ID:299.

Another function of GAM5227 is therefore inhibition of LOC283153 (Accession XP_208532.1). Accordingly, utilities of GAM5227 include diagnosis, prevention and treatment of diseases and clinical conditions associated with LOC283153.

LOC283332 (Accession XP_210976.1) is another GAM5227 target gene, herein designated TARGET GENE. LOC283332 BINDING SITE is a target binding site found in the 5' untranslated region of mRNA encoded by LOC283332, corresponding to a target binding site such as BINDING SITE I, BINDING SITE II or BINDING SITE III of FIG. 8. Table 4 illustrates the complementarity of the nucleotide sequences of LOC283332 BINDING SITE, designated SEQ ID:19526, to the nucleotide sequence of GAM5227 RNA, herein designated GAM RNA, also designated SEQ ID:299.

Another function of GAM5227 is therefore inhibition of LOC283332 (Accession XP_210976.1). Accordingly, utilities of GAM5227 include diagnosis, prevention and treatment of diseases and clinical conditions associated with LOC283332.

LOC283385 (Accession NP_776254.1) is another GAM5227 target gene, herein designated TARGET GENE. LOC283385 BINDING SITE is a target binding site found in the 3' untranslated region of mRNA encoded by LOC283385, corresponding to a target binding site such as BINDING SITE I, BINDING SITE II or BINDING SITE III of FIG. 8. Table 4 illustrates the complementarity of the nucleotide sequences of LOC283385 BINDING SITE, designated SEQ ID:2089, to the nucleotide sequence of GAM5227 RNA, herein designated GAM RNA, also designated SEQ ID:299.

Another function of GAM5227 is therefore inhibition of LOC283385 (Accession NP_776254.1). Accordingly, utilities of GAM5227 include diagnosis, prevention and treatment of diseases and clinical conditions associated with LOC283385.

LOC283460 (Accession XP_208682.1) is another GAM5227 target gene, herein designated TARGET GENE. LOC283460 BINDING SITE is a target binding site found in the 3' untranslated region of mRNA encoded by LOC283460, corresponding to a target binding site such as BINDING SITE I, BINDING SITE II or BINDING SITE III of FIG. 8. Table 4 illustrates the complementarity of the nucleotide sequences of LOC283460 BINDING SITE, designated SEQ ID:5440, to the nucleotide sequence of GAM5227 RNA, herein designated GAM RNA, also designated SEQ ID:299.

Another function of GAM5227 is therefore inhibition of LOC283460 (Accession XP_208682.1). Accordingly, utilities of GAM5227 include diagnosis, prevention and treatment of diseases and clinical conditions associated with LOC283460.

LOC283534 (Accession XP_211083.1) is another GAM5227 target gene, herein designated TARGET GENE. LOC283534 BINDING SITE is a target binding site found in the 3' untranslated region of mRNA encoded by LOC283534, corresponding to a target binding site such as BINDING SITE I, BINDING SITE II or BINDING SITE III of FIG. 8. Table 4 illustrates the complementarity of the nucleotide sequences of LOC283534 BINDING SITE, designated SEQ ID:19940, to the nucleotide sequence of GAM5227 RNA, herein designated GAM RNA, also designated SEQ ID:299.

Another function of GAM5227 is therefore inhibition of LOC283534 (Accession XP_211083.1). Accordingly, utilities of GAM5227 include diagnosis, prevention and treatment of diseases and clinical conditions associated with LOC283534.

LOC283551 (Accession XP_211110.1) is another GAM5227 target gene, herein designated TARGET GENE. LOC283551 BINDING SITE is a target binding site found in the 3' untranslated region of mRNA encoded by LOC283551, corresponding to a target binding site such as BINDING SITE I, BINDING SITE II or BINDING SITE III of FIG. 8. Table 4 illustrates the complementarity of the nucleotide sequences of LOC283551 BINDING SITE, designated SEQ ID:10476, to the nucleotide sequence of GAM5227 RNA, herein designated GAM RNA, also designated SEQ ID:299.

Another function of GAM5227 is therefore inhibition of LOC283551 (Accession XP_211110.1). Accordingly, utilities of GAM5227 include diagnosis, prevention and treatment of diseases and clinical conditions associated with LOC283551.

LOC283738 (Accession XP_211186.1) is another GAM5227 target gene, herein designated TARGET GENE. LOC283738 BINDING SITE is a target binding site found in the 5' untranslated region of mRNA encoded by LOC283738, corresponding to a target binding site such as BINDING SITE I, BINDING SITE II or BINDING SITE III of FIG. 8. Table 4 illustrates the complementarity of the nucleotide sequences of LOC283738 BINDING SITE, designated SEQ ID:9445, to the nucleotide sequence of GAM5227 RNA, herein designated GAM RNA, also designated SEQ ID:299.

Another function of GAM5227 is therefore inhibition of LOC283738 (Accession XP_211186.1). Accordingly, utilities of GAM5227 include diagnosis, prevention and treatment of diseases and clinical conditions associated with LOC283738.

LOC283806 (Accession XP_208846.1) is another GAM5227 target gene, herein designated TARGET GENE. LOC283806 BINDING SITE is a target binding site found in the 5' untranslated region of mRNA encoded by LOC283806, corresponding to a target binding site such as BINDING SITE I, BINDING SITE II or BINDING SITE III of FIG. 8. Table 4 illustrates the complementarity of the nucleotide sequences of LOC283806 BINDING SITE, designated SEQ ID:17351, to the nucleotide sequence of GAM5227 RNA, herein designated GAM RNA, also designated SEQ ID:299.

Another function of GAM5227 is therefore inhibition of LOC283806 (Accession XP_208846.1). Accordingly, utilities of GAM5227 include diagnosis, prevention and treatment of diseases and clinical conditions associated with LOC283806.

LOC283849 (Accession NP_848611.1) is another GAM5227 target gene, herein designated TARGET GENE. LOC283849 BINDING SITE is a target binding site found in the 3' untranslated region of multiple transcripts of mRNA encoded by LOC283849, corresponding to a target binding site such as BINDING SITE I, BINDING SITE II or BINDING SITE III of FIG. 8. Table 4 illustrates the complementarity of the nucleotide sequences of LOC283849 BINDING SITE, designated SEQ ID:5876, to the nucleotide sequence of GAM5227 RNA, herein designated GAM RNA, also designated SEQ ID:299.

Another function of GAM5227 is therefore inhibition of LOC283849 (Accession NP_848611.1). Accordingly, utilities of GAM5227 include diagnosis, prevention and treatment of diseases and clinical conditions associated with LOC283849.

LOC283924 (Accession XP_208906.1) is another GAM5227 target gene, herein designated TARGET GENE. LOC283924 BINDING SITE is a target binding site found in the 3' untranslated region of mRNA encoded by LOC283924, corresponding to a target binding site such as BINDING SITE I, BINDING SITE II or BINDING SITE III of FIG. 8. Table 4 illustrates the complementarity of the nucleotide sequences of LOC283924 BINDING SITE, designated SEQ ID:6869, to the nucleotide sequence of GAM5227 RNA, herein designated GAM RNA, also designated SEQ ID:299.

Another function of GAM5227 is therefore inhibition of LOC283924 (Accession XP_208906.1). Accordingly, utilities of GAM5227 include diagnosis, prevention and treatment of diseases and clinical conditions associated with LOC283924.

LOC283949 (Accession XP_208928.1) is another GAM5227 target gene, herein designated TARGET GENE. LOC283949 BINDING SITE is a target binding site found in the 3' untranslated region of mRNA encoded by LOC283949, corresponding to a target binding site such as BINDING SITE I, BINDING SITE II or BINDING SITE III of FIG. 8. Table 4 illustrates the complementarity of the nucleotide sequences of LOC283949 BINDING SITE, designated SEQ ID:1669, to the nucleotide sequence of GAM5227 RNA, herein designated GAM RNA, also designated SEQ ID:299.

Another function of GAM5227 is therefore inhibition of LOC283949 (Accession XP_208928.1). Accordingly, utilities of GAM5227 include diagnosis, prevention and treatment of diseases and clinical conditions associated with LOC283949.

LOC284082 (Accession XP_211323.1) is another GAM5227 target gene, herein designated TARGET GENE. LOC284082 BINDING SITE is a target binding site found in the 3' untranslated region of mRNA encoded by LOC284082, corresponding to a target binding site such as BINDING SITE I, BINDING SITE II or BINDING SITE III of FIG. 8. Table 4 illustrates the complementarity of the nucleotide sequences of LOC284082 BINDING SITE, designated SEQ ID:15264, to the nucleotide sequence of GAM5227 RNA, herein designated GAM RNA, also designated SEQ ID:299.

Another function of GAM5227 is therefore inhibition of LOC284082 (Accession XP_211323.1). Accordingly, utilities of GAM5227 include diagnosis, prevention and treatment of diseases and clinical conditions associated with LOC284082.

LOC284118 (Accession XP_211336.1) is another GAM5227 target gene, herein designated TARGET GENE. LOC284118 BINDING SITE is a target binding site found in the 3' untranslated region of mRNA encoded by LOC284118, corresponding to a target binding site such as BINDING SITE I, BINDING SITE II or BINDING SITE III of FIG. 8. Table 4 illustrates the complementarity of the nucleotide sequences of LOC284118 BINDING SITE, designated SEQ ID:12184, to the nucleotide sequence of GAM5227 RNA, herein designated GAM RNA, also designated SEQ ID:299.

Another function of GAM5227 is therefore inhibition of LOC284118 (Accession XP_211336.1). Accordingly, utilities of GAM5227 include diagnosis, prevention and treatment of diseases and clinical conditions associated with LOC284118.

LOC284178 (Accession XP_211365.1) is another GAM5227 target gene, herein designated TARGET GENE. LOC284178 BINDING SITE is a target binding site found in the 5' untranslated region of mRNA encoded by LOC284178, corresponding to a target binding site such as BINDING SITE I, BINDING SITE II or BINDING SITE III of FIG. 8. Table 4 illustrates the complementarity of the nucleotide sequences of LOC284178 BINDING SITE, designated SEQ ID:8059, to the nucleotide sequence of GAM5227 RNA, herein designated GAM RNA, also designated SEQ ID:299.

Another function of GAM5227 is therefore inhibition of LOC284178 (Accession XP_211365.1). Accordingly, utilities of GAM5227 include diagnosis, prevention and treatment of diseases and clinical conditions associated with LOC284178.

LOC284281 (Accession XP_211415.1) is another GAM5227 target gene, herein designated TARGET GENE. LOC284281 BINDING SITE is a target binding site found in the 5' untranslated region of mRNA encoded by LOC284281, corresponding to a target binding site such as BINDING SITE I, BINDING SITE II or BINDING SITE III of FIG. 8. Table 4 illustrates the complementarity of the nucleotide sequences of LOC284281 BINDING SITE, designated SEQ ID:15205, to the nucleotide sequence of GAM5227 RNA, herein designated GAM RNA, also designated SEQ ID:299.

Another function of GAM5227 is therefore inhibition of LOC284281 (Accession XP_211415.1). Accordingly, utilities of GAM5227 include diagnosis, prevention and treatment of diseases and clinical conditions associated with LOC284281.

LOC284325 (Accession XP_209143.1) is another GAM5227 target gene, herein designated TARGET GENE.

LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:6963, to the nucleotide sequence of GAM5227 RNA, herein designated GAM RNA, also designated SEQ ID:299.

Another function of GAM5227 is therefore inhibition of LOC284325 (Accession XP_209143.1). Accordingly, utilities of GAM5227 include diagnosis, prevention and treatment of diseases and clinical conditions associated with LOC284325.

LOC284375 (Accession XP_209154.1) is another GAM5227 target gene, herein designated TARGET GENE. LOC284375 BINDING SITE is a target binding site found in the 3' untranslated region of mRNA encoded by LOC284375, corresponding to a target binding site such as BINDING SITE I, BINDING SITE II or BINDING SITE III of FIG. 8. Table 4 illustrates the complementarity of the nucleotide sequences of LOC284375 BINDING SITE, designated SEQ ID:6814, to the nucleotide sequence of GAM5227 RNA, herein designated GAM RNA, also designated SEQ ID:299.

Another function of GAM5227 is therefore inhibition of LOC284375 (Accession XP_209154.1). Accordingly, utilities of GAM5227 include diagnosis, prevention and treatment of diseases and clinical conditions associated with LOC284375.

LOC284402 (Accession XP_211453.1) is another GAM5227 target gene, herein designated TARGET GENE. LOC284402 BINDING SITE is a target binding site found in the 5' untranslated region of mRNA encoded by LOC284402, corresponding to a target binding site such as BINDING SITE I, BINDING SITE II or BINDING SITE III of FIG. 8. Table 4 illustrates the complementarity of the nucleotide sequences of LOC284402 BINDING SITE, designated SEQ ID:13078, to the nucleotide sequence of GAM5227 RNA, herein designated GAM RNA, also designated SEQ ID:299.

Another function of GAM5227 is therefore inhibition of LOC284402 (Accession XP_211453.1). Accordingly, utilities of GAM5227 include diagnosis, prevention and treatment of diseases and clinical conditions associated with LOC284402.

LOC284459 (Accession XP_290826.1) is another GAM5227 target gene, herein designated TARGET GENE. LOC284459 BINDING SITE is a target binding site found in the 5' untranslated region of mRNA encoded by LOC284459, corresponding to a target binding site such as BINDING SITE I, BINDING SITE II or BINDING SITE III of FIG. 8. Table 4 illustrates the complementarity of the nucleotide sequences of LOC284459 BINDING SITE, designated SEQ ID:1608, to the nucleotide sequence of GAM5227 RNA, herein designated GAM RNA, also designated SEQ ID:299.

Another function of GAM5227 is therefore inhibition of LOC284459 (Accession XP_290826.1). Accordingly, utilities of GAM5227 include diagnosis, prevention and treatment of diseases and clinical conditions associated with LOC284459.

LOC284650 (Accession XP_211571.1) is another GAM5227 target gene, herein designated TARGET GENE. LOC284650 BINDING SITE is a target binding site found in the 5' untranslated region of mRNA encoded by LOC284650, corresponding to a target binding site such as BINDING SITE I, BINDING SITE II or BINDING SITE III of FIG. 8. Table 4 illustrates the complementarity of the nucleotide sequences of LOC284650 BINDING SITE, designated SEQ ID:9610, to the nucleotide sequence of GAM5227 RNA, herein designated GAM RNA, also designated SEQ ID:299.

Another function of GAM5227 is therefore inhibition of LOC284650 (Accession XP_211571.1). Accordingly, utilities of GAM5227 include diagnosis, prevention and treatment of diseases and clinical conditions associated with LOC284650.

LOC285117 (Accession XP_209482.1) is another GAM5227 target gene, herein designated TARGET GENE. LOC285117 BINDING SITE is a target binding site found in the 3' untranslated region of mRNA encoded by LOC285117, corresponding to a target binding site such as BINDING SITE I, BINDING SITE II or BINDING SITE III of FIG. 8. Table 4 illustrates the complementarity of the nucleotide sequences of LOC285117 BINDING SITE, designated SEQ ID:13418, to the nucleotide sequence of GAM5227 RNA, herein designated GAM RNA, also designated SEQ ID:299.

Another function of GAM5227 is therefore inhibition of LOC285117 (Accession XP_209482.1). Accordingly, utilities of GAM5227 include diagnosis, prevention and treatment of diseases and clinical conditions associated with LOC285117.

LOC285127 (Accession XP_211771.1) is another GAM5227 target gene, herein designated TARGET GENE. LOC285127 BINDING SITE is a target binding site found in the 3' untranslated region of mRNA encoded by LOC285127, corresponding to a target binding site such as BINDING SITE I, BINDING SITE II or BINDING SITE III of FIG. 8. Table 4 illustrates the complementarity of the nucleotide sequences of LOC285127 BINDING SITE, designated SEQ ID:7199, to the nucleotide sequence of GAM5227 RNA, herein designated GAM RNA, also designated SEQ ID:299.

Another function of GAM5227 is therefore inhibition of LOC285127 (Accession XP_211771.1). Accordingly, utilities of GAM5227 include diagnosis, prevention and treatment of diseases and clinical conditions associated with LOC285127.

LOC285194 (Accession XP_211803.1) is another GAM5227 target gene, herein designated TARGET GENE. LOC285194 BINDING SITE is a target binding site found in the 5' untranslated region of mRNA encoded by LOC285194, corresponding to a target binding site such as BINDING SITE I, BINDING SITE II or BINDING SITE III of FIG. 8. Table 4 illustrates the complementarity of the nucleotide sequences of LOC285194 BINDING SITE, designated SEQ ID:16102, to the nucleotide sequence of GAM5227 RNA, herein designated GAM RNA, also designated SEQ ID:299.

Another function of GAM5227 is therefore inhibition of LOC285194 (Accession XP_211803.1). Accordingly, utilities of GAM5227 include diagnosis, prevention and treatment of diseases and clinical conditions associated with LOC285194.

LOC285284 (Accession XP_211836.1) is another GAM5227 target gene, herein designated TARGET GENE. LOC285284 BINDING SITE is a target binding site found in the 3' untranslated region of mRNA encoded by LOC285284, corresponding to a target binding site such as BINDING SITE I, BINDING SITE II or BINDING SITE III of FIG. 8. Table 4 illustrates the complementarity of the nucleotide sequences of LOC285284 BINDING SITE, designated SEQ ID:567, to the nucleotide sequence of GAM5227 RNA, herein designated GAM RNA, also designated SEQ ID:299.

Another function of GAM5227 is therefore inhibition of LOC285284 (Accession XP_211836.1). Accordingly, utilities of GAM5227 include diagnosis, prevention and treatment of diseases and clinical conditions associated with LOC285284.

LOC285587 (Accession XP_211947.1) is another GAM5227 target gene, herein designated TARGET GENE. LOC285587 BINDING SITE is a target binding site found in the 3' untranslated region of mRNA encoded by LOC285587, corresponding to a target binding site such as BINDING SITE I, BINDING SITE II or BINDING SITE III of FIG. 8. Table 4 illustrates the complementarity of the nucleotide sequences of LOC285587 BINDING SITE, designated SEQ ID:1779, to the nucleotide sequence of GAM5227 RNA, herein designated GAM RNA, also designated SEQ ID:299.

Another function of GAM5227 is therefore inhibition of LOC285587 (Accession XP_211947.1). Accordingly, utilities of GAM5227 include diagnosis, prevention and treatment of diseases and clinical conditions associated with LOC285587.

LOC285673 (Accession XP_209720.1) is another GAM5227 target gene, herein designated TARGET GENE. LOC285673 BINDING SITE is a target binding site found in the 3' untranslated region of mRNA encoded by LOC285673, corresponding to a target binding site such as BINDING SITE I, BINDING SITE II or BINDING SITE III of FIG. 8. Table 4 illustrates the complementarity of the nucleotide sequences of LOC285673 BINDING SITE, designated SEQ ID:4976, to the nucleotide sequence of GAM5227 RNA, herein designated GAM RNA, also designated SEQ ID:299.

Another function of GAM5227 is therefore inhibition of LOC285673 (Accession XP_209720.1). Accordingly, utilities of GAM5227 include diagnosis, prevention and treatment of diseases and clinical conditions associated with LOC285673.

LOC285799 (Accession XP_209764.1) is another GAM5227 target gene, herein designated TARGET GENE. LOC285799 BINDING SITE is a target binding site found in the 5' untranslated region of mRNA encoded by LOC285799, corresponding to a target binding site such as BINDING SITE I, BINDING SITE II or BINDING SITE III of FIG. 8. Table 4 illustrates the complementarity of the nucleotide sequences of LOC285799 BINDING SITE, designated SEQ ID:3655, to the nucleotide sequence of GAM5227 RNA, herein designated GAM RNA, also designated SEQ ID:299.

Another function of GAM5227 is therefore inhibition of LOC285799 (Accession XP_209764.1). Accordingly, utilities of GAM5227 include diagnosis, prevention and treatment of diseases and clinical conditions associated with LOC285799.

LOC285806 (Accession XP_212028.1) is another GAM5227 target gene, herein designated TARGET GENE. LOC285806 BINDING SITE is a target binding site found in the 3' untranslated region of mRNA encoded by LOC285806, corresponding to a target binding site such as BINDING SITE I, BINDING SITE II or BINDING SITE III of FIG. 8. Table 4 illustrates the complementarity of the nucleotide sequences of LOC285806 BINDING SITE, designated SEQ ID:17117, to the nucleotide sequence of GAM5227 RNA, herein designated GAM RNA, also designated SEQ ID:299.

Another function of GAM5227 is therefore inhibition of LOC285806 (Accession XP_212028.1). Accordingly, utilities of GAM5227 include diagnosis, prevention and treatment of diseases and clinical conditions associated with LOC285806.

LOC285827 (Accession XP_212645.1) is another GAM5227 target gene, herein designated TARGET GENE. LOC285827 BINDING SITE1 and LOC285827 BINDING SITE2 are target binding sites found in untranslated regions of multiple transcripts of mRNA encoded by LOC285827, corresponding to target binding sites such as BINDING SITE I, BINDING SITE II or BINDING SITE III of FIG. 8. Table 4 illustrates the complementarity of the nucleotide sequences of LOC285827 BINDING SITE1 and LOC285827 BINDING SITE2, designated SEQ ID:13212 and SEQ ID:13212 respectively, to the nucleotide sequence of GAM5227 RNA, herein designated GAM RNA, also designated SEQ ID:299.

Another function of GAM5227 is therefore inhibition of LOC285827 (Accession XP_212645.1). Accordingly, utilities of GAM5227 include diagnosis, prevention and treatment of diseases and clinical conditions associated with LOC285827.

LOC285827 (Accession XP_212604.1) is another GAM5227 target gene, herein designated TARGET GENE. LOC285827 BINDING SITE1 and LOC285827 BINDING SITE2 are target binding sites found in untranslated regions of multiple transcripts of mRNA encoded by LOC285827, corresponding to target binding sites such as BINDING SITE I, BINDING SITE II or BINDING SITE III of FIG. 8. Table 4 illustrates the complementarity of the nucleotide sequences of LOC285827 BINDING SITE1 and LOC285827 BINDING SITE2, designated SEQ ID:4842 and SEQ ID:5526 respectively, to the nucleotide sequence of GAM5227 RNA, herein designated GAM RNA, also designated SEQ ID:299.

Another function of GAM5227 is therefore inhibition of LOC285827 (Accession XP_212604.1). Accordingly, utilities of GAM5227 include diagnosis, prevention and treatment of diseases and clinical conditions associated with LOC285827.

LOC286045 (Accession XP_212151.1) is another GAM5227 target gene, herein designated TARGET GENE. LOC286045 BINDING SITE is a target binding site found in the 5' untranslated region of mRNA encoded by LOC286045, corresponding to a target binding site such as BINDING SITE I, BINDING SITE II or BINDING SITE III of FIG. 8. Table 4 illustrates the complementarity of the nucleotide sequences of LOC286045 BINDING SITE, designated SEQ ID:17966, to the nucleotide sequence of GAM5227 RNA, herein designated GAM RNA, also designated SEQ ID:299.

Another function of GAM5227 is therefore inhibition of LOC286045 (Accession XP_212151.1). Accordingly, utilities of GAM5227 include diagnosis, prevention and treatment of diseases and clinical conditions associated with LOC286045.

LOC286208 (Accession XP_212230.1) is another GAM5227 target gene, herein designated TARGET GENE. LOC286208 BINDING SITE is a target binding site found in the 3' untranslated region of mRNA encoded by LOC286208, corresponding to a target binding site such as BINDING SITE I, BINDING SITE II or BINDING SITE III of FIG. 8. Table 4 illustrates the complementarity of the nucleotide sequences of LOC286208 BINDING SITE, designated SEQ ID:8321, to the nucleotide sequence of GAM5227 RNA, herein designated GAM RNA, also designated SEQ ID:299.

Another function of GAM5227 is therefore inhibition of LOC286208 (Accession XP_212230.1). Accordingly, utilities of GAM5227 include diagnosis, prevention and treatment of diseases and clinical conditions associated with LOC286208.

LOC286255 (Accession XP_209977.1) is another GAM5227 target gene, herein designated TARGET GENE. LOC286255 BINDING SITE is a target binding site found in the 5' untranslated region of mRNA encoded by LOC286255, corresponding to a target binding site such as BINDING SITE I, BINDING SITE II or BINDING SITE III of FIG. 8. Table 4 illustrates the complementarity of the nucleotide sequences of LOC286255 BINDING SITE, designated SEQ ID:13323, to the nucleotide sequence of GAM5227 RNA, herein designated GAM RNA, also designated SEQ ID:299.

Another function of GAM5227 is therefore inhibition of LOC286255 (Accession XP_209977.1). Accordingly, utilities of GAM5227 include diagnosis, prevention and treatment of diseases and clinical conditions associated with LOC286255.

LOC286354 (Accession XP_212286.1) is another GAM5227 target gene, herein designated TARGET GENE. LOC286354 BINDING SITE is a target binding site found in the 5' untranslated region of mRNA encoded by LOC286354, corresponding to a target binding site such as BINDING SITE I, BINDING SITE II or BINDING SITE III of FIG. 8. Table 4 illustrates the complementarity of the nucleotide sequences of LOC286354 BINDING SITE, designated SEQ ID:1632, to the nucleotide sequence of GAM5227 RNA, herein designated GAM RNA, also designated SEQ ID:299.

Another function of GAM5227 is therefore inhibition of LOC286354 (Accession XP_212286.1). Accordingly, utilities of GAM5227 include diagnosis, prevention and treatment of diseases and clinical conditions associated with LOC286354.

LOC338653 (Accession XP_294673.1) is another GAM5227 target gene, herein designated TARGET GENE. LOC338653 BINDING SITE is a target binding site found in the 3' untranslated region of mRNA encoded by LOC338653, corresponding to a target binding site such as BINDING SITE I, BINDING SITE II or BINDING SITE III of FIG. 8. Table 4 illustrates the complementarity of the nucleotide sequences of LOC338653 BINDING SITE, designated SEQ ID:10990, to the nucleotide sequence of GAM5227 RNA, herein designated GAM RNA, also designated SEQ ID:299.

Another function of GAM5227 is therefore inhibition of LOC338653 (Accession XP_294673.1). Accordingly, utilities of GAM5227 include diagnosis, prevention and treatment of diseases and clinical conditions associated with LOC338653.

LOC339679 (Accession XP_295029.1) is another GAM5227 target gene, herein designated TARGET GENE. LOC339679 BINDING SITE is a target binding site found in the 5' untranslated region of mRNA encoded by LOC339679, corresponding to a target binding site such as BINDING SITE I, BINDING SITE II or BINDING SITE III of FIG. 8. Table 4 illustrates the complementarity of the nucleotide sequences of LOC339679 BINDING SITE, designated SEQ ID:2642, to the nucleotide sequence of GAM5227 RNA, herein designated GAM RNA, also designated SEQ ID:299.

Another function of GAM5227 is therefore inhibition of LOC339679 (Accession XP_295029.1). Accordingly, utilities of GAM5227 include diagnosis, prevention and treatment of diseases and clinical conditions associated with LOC339679.

LOC339983 (Accession XP_291101.1) is another GAM5227 target gene, herein designated TARGET GENE. LOC339983 BINDING SITE is a target binding site found in the 3' untranslated region of mRNA encoded by LOC339983, corresponding to a target binding site such as BINDING SITE I, BINDING SITE II or BINDING SITE III of FIG. 8. Table 4 illustrates the complementarity of the nucleotide sequences of LOC339983 BINDING SITE, designated SEQ ID:11160, to the nucleotide sequence of GAM5227 RNA, herein designated GAM RNA, also designated SEQ ID:299.

Another function of GAM5227 is therefore inhibition of LOC339983 (Accession XP_291101.1). Accordingly, utilities of GAM5227 include diagnosis, prevention and treatment of diseases and clinical conditions associated with LOC339983.

LOC340504 (Accession XP_295260.1) is another GAM5227 target gene, herein designated TARGET GENE. LOC340504 BINDING SITE is a target binding site found in the 5' untranslated region of mRNA encoded by LOC340504, corresponding to a target binding site such as BINDING SITE I, BINDING SITE II or BINDING SITE III of FIG. 8. Table 4 illustrates the complementarity of the nucleotide sequences of LOC340504 BINDING SITE, designated SEQ ID:1223, to the nucleotide sequence of GAM5227 RNA, herein designated GAM RNA, also designated SEQ ID:299.

Another function of GAM5227 is therefore inhibition of LOC340504 (Accession XP_295260.1). Accordingly, utilities of GAM5227 include diagnosis, prevention and treatment of diseases and clinical conditions associated with LOC340504.

LOC348399 (Accession XP_302744.1) is another GAM5227 target gene, herein designated TARGET GENE. LOC348399 BINDING SITE is a target binding site found in the 3' untranslated region of mRNA encoded by LOC348399, corresponding to a target binding site such as BINDING SITE I, BINDING SITE II or BINDING SITE III of FIG. 8. Table 4 illustrates the complementarity of the nucleotide sequences of LOC348399 BINDING SITE, designated SEQ ID:12324, to the nucleotide sequence of GAM5227 RNA, herein designated GAM RNA, also designated SEQ ID:299.

Another function of GAM5227 is therefore inhibition of LOC348399 (Accession XP_302744.1). Accordingly, utilities of GAM5227 include diagnosis, prevention and treatment of diseases and clinical conditions associated with LOC348399.

LOC348428 (Accession XP_302753.1) is another GAM5227 target gene, herein designated TARGET GENE. LOC348428 BINDING SITE is a target binding site found in the 5' untranslated region of mRNA encoded by LOC348428, corresponding to a target binding site such as BINDING SITE I, BINDING SITE II or BINDING SITE III of FIG. 8. Table 4 illustrates the complementarity of the nucleotide sequences of LOC348428 BINDING SITE, designated SEQ ID:6112, to the nucleotide sequence of GAM5227 RNA, herein designated GAM RNA, also designated SEQ ID:299.

Another function of GAM5227 is therefore inhibition of LOC348428 (Accession XP_302753.1). Accordingly, utilities of GAM5227 include diagnosis, prevention and treatment of diseases and clinical conditions associated with LOC348428.

LOC348477 (Accession XP_046126.4) is another GAM5227 target gene, herein designated TARGET GENE. LOC348477 BINDING SITE is a target binding site found in the 3' untranslated region of mRNA encoded by LOC348477, corresponding to a target binding site such as BINDING SITE I, BINDING SITE II or BINDING SITE III of FIG. 8. Table 4 illustrates the complementarity of the nucleotide sequences of LOC348477 BINDING SITE, designated SEQ ID:9788, to the nucleotide sequence of GAM5227 RNA, herein designated GAM RNA, also designated SEQ ID:299.

Another function of GAM5227 is therefore inhibition of LOC348477 (Accession XP_046126.4). Accordingly, utilities of GAM5227 include diagnosis, prevention and treatment of diseases and clinical conditions associated with LOC348477.

LOC348928 (Accession XP_209688.1) is another GAM5227 target gene, herein designated TARGET GENE. LOC348928 BINDING SITE is a target binding site found in the 3' untranslated region of mRNA encoded by LOC348928, corresponding to a target binding site such as BINDING SITE I, BINDING SITE II or BINDING SITE III of FIG. 8. Table 4 illustrates the complementarity of the nucleotide sequences of LOC348928 BINDING SITE, designated SEQ ID:8901, to the nucleotide sequence of GAM5227 RNA, herein designated GAM RNA, also designated SEQ ID:299.

Another function of GAM5227 is therefore inhibition of LOC348928 (Accession XP_209688.1). Accordingly, utilities of GAM5227 include diagnosis, prevention and treatment of diseases and clinical conditions associated with LOC348928.

LOC349289 (Accession XP_300477.1) is another GAM5227 target gene, herein designated TARGET GENE. LOC349289 BINDING SITE is a target binding site found in the 3' untranslated region of mRNA encoded by LOC349289, corresponding to a target binding site such as BINDING SITE I, BINDING SITE II or BINDING SITE III of FIG. 8. Table 4 illustrates the complementarity of the nucleotide sequences of LOC349289 BINDING SITE, designated SEQ ID:8287, to the nucleotide sequence of GAM5227 RNA, herein designated GAM RNA, also designated SEQ ID:299.

Another function of GAM5227 is therefore inhibition of LOC349289 (Accession XP_300477.1). Accordingly, utilities of GAM5227 include diagnosis, prevention and treatment of diseases and clinical conditions associated with LOC349289.

LOC352027 (Accession XP_302245.1) is another GAM5227 target gene, herein designated TARGET GENE. LOC352027 BINDING SITE is a target binding site found in the 5' untranslated region of mRNA encoded by LOC352027, corresponding to a target binding site such as BINDING SITE I, BINDING SITE II or BINDING SITE III of FIG. 8. Table 4 illustrates the complementarity of the nucleotide sequences of LOC352027 BINDING SITE, designated SEQ ID:13440, to the nucleotide sequence of GAM5227 RNA, herein designated GAM RNA, also designated SEQ ID:299.

Another function of GAM5227 is therefore inhibition of LOC352027 (Accession XP_302245.1). Accordingly, utilities of GAM5227 include diagnosis, prevention and treatment of diseases and clinical conditions associated with LOC352027.

LOC56920 (Accession NP_064548.1) is another GAM5227 target gene, herein designated TARGET GENE. LOC56920 BINDING SITE is a target binding site found in the 3' untranslated region of mRNA encoded by LOC56920, corresponding to a target binding site such as BINDING SITE I, BINDING SITE II or BINDING SITE III of FIG. 8. Table 4 illustrates the complementarity of the nucleotide sequences of LOC56920 BINDING SITE, designated SEQ ID:14103, to the nucleotide sequence of GAM5227 RNA, herein designated GAM RNA, also designated SEQ ID:299.

Another function of GAM5227 is therefore inhibition of LOC56920 (Accession NP_064548.1). Accordingly, utilities of GAM5227 include diagnosis, prevention and treatment of diseases and clinical conditions associated with LOC56920.

LOC90408 (Accession XP_031517.1) is another GAM5227 target gene, herein designated TARGET GENE. LOC90408 BINDING SITE is a target binding site found in the 3' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:6783, to the nucleotide sequence of GAM5227 RNA, herein designated GAM RNA, also designated SEQ ID:299.

Another function of GAM5227 is therefore inhibition of LOC90408 (Accession XP_031517.1). Accordingly, utilities of GAM5227 include diagnosis, prevention and treatment of diseases and clinical conditions associated with LOC90408.

LOC90529 (Accession NP_835223.1) is another GAM5227 target gene, herein designated TARGET GENE. LOC90529 BINDING SITE is a target binding site found in the 3' untranslated region of mRNA encoded by LOC90529, corresponding to a target binding site such as BINDING SITE I, BINDING SITE II or BINDING SITE III of FIG. 8. Table 4 illustrates the complementarity of the nucleotide sequences of LOC90529 BINDING SITE, designated SEQ ID:13508, to the nucleotide sequence of GAM5227 RNA, herein designated GAM RNA, also designated SEQ ID:299.

Another function of GAM5227 is therefore inhibition of LOC90529 (Accession NP_835223.1). Accordingly, utilities of GAM5227 include diagnosis, prevention and treatment of diseases and clinical conditions associated with LOC90529.

Lymphotoxin alpha (tnf superfamily, member 1) (LTA, Accession NP_000586.2) is another GAM5227 target gene, herein designated TARGET GENE. LTA BINDING SITE is a target binding site found in the 3' untranslated region of mRNA encoded by LTA, corresponding to a target binding site such as BINDING SITE I, BINDING SITE II or BINDING SITE III of FIG. 8. Table 4 illustrates the complementarity of the nucleotide sequences of LTA BINDING SITE, designated SEQ ID:16521, to the nucleotide sequence of GAM5227 RNA, herein designated GAM RNA, also designated SEQ ID:299.

Another function of GAM5227 is therefore inhibition of Lymphotoxin alpha (tnf superfamily, member 1) (LTA, Accession NP_000586.2), a gene which is a cytokine that in its homotrimeric form binds to tnfrsf1a/tnfr1, tnfrsf1b/tnfbr and tnfrsf14/hvem. Accordingly, utilities of GAM5227 include diagnosis, prevention and treatment of diseases and clinical conditions associated with LTA.

The function of LTA and its association with various diseases and clinical conditions, has been established by previous studies, as described hereinabove with reference to GAM44.1. Leukotriene b4 receptor (LTB4R, Accession NP_000743.1) is another GAM5227 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:19312, to the nucleotide sequence of GAM5227 RNA, herein designated GAM RNA, also designated SEQ ID:299.

Another function of GAM5227 is therefore inhibition of Leukotriene b4 receptor (LTB4R, Accession NP_000743.1), a gene which may be the cardiac p2y receptor involved in the regulation of cardiac muscle contraction through modulation of l-type calcium currents. Accordingly, utilities of GAM5227 include diagnosis, prevention and treatment of diseases and clinical conditions associated with LTB4R.

The function of LTB4R and its association with various diseases and clinical conditions, has been established by previous studies, as described hereinabove with reference to GAM30.1. Mitogen-activated protein kinase kinase kinase kinase 2 (MAP4K2, Accession NP_004570.2) is another GAM5227 target gene, herein designated TARGET GENE. MAP4K2 BINDING SITE is a target binding site found in the 3' untranslated region of mRNA encoded by MAP4K2, corresponding to a target binding site such as BINDING SITE I, BINDING SITE II or BINDING SITE III of FIG. 8. Table 4 illustrates the complementarity of the nucleotide sequences of MAP4K2 BINDING SITE, designated SEQ ID:12350, to the nucleotide sequence of GAM5227 RNA, herein designated GAM RNA, also designated SEQ ID:299.

Another function of GAM5227 is therefore inhibition of Mitogen-activated protein kinase kinase kinase kinase 2 (MAP4K2, Accession NP_004570.2), a gene which serine/threonine protein kinase required for spore wall development. activates Jun N-terminal kinase; member of the STE20 kinase family. Accordingly, utilities of GAM5227 include diagnosis, prevention and treatment of diseases and clinical conditions associated with MAP4K2.

The function of MAP4K2 and its association with various diseases and clinical conditions, has been established by previous studies, as described hereinabove with reference to GAM1849.1. MCFP (Accession NP_061331.1) is another GAM5227 target gene, herein designated TARGET GENE. MCFP BINDING SITE is a target binding site found in the 5' untranslated region of mRNA encoded by MCFP, corresponding to a target binding site such as BINDING SITE I, BINDING SITE II or BINDING SITE III of FIG. 8. Table 4 illustrates the complementarity of the nucleotide sequences of MCFP BINDING SITE, designated SEQ ID:906, to the nucleotide sequence of GAM5227 RNA, herein designated GAM RNA, also designated SEQ ID:299.

Another function of GAM5227 is therefore inhibition of MCFP (Accession NP_061331.1). Accordingly, utilities of GAM5227 include diagnosis, prevention and treatment of diseases and clinical conditions associated with MCFP.

MDS018 (Accession NP_068595.2) is another GAM5227 target gene, herein designated TARGET GENE. MDS018 BINDING SITE is a target binding site found in the 3' untranslated region of mRNA encoded by MDS018, corresponding to a target binding site such as BINDING SITE I, BINDING SITE II or BINDING SITE III of FIG. 8. Table 4 illustrates the complementarity of the nucleotide sequences of MDS018 BINDING SITE, designated SEQ ID:3171, to the nucleotide sequence of GAM5227 RNA, herein designated GAM RNA, also designated SEQ ID:299.

Another function of GAM5227 is therefore inhibition of MDS018 (Accession NP_068595.2). Accordingly, utilities of GAM5227 include diagnosis, prevention and treatment of diseases and clinical conditions associated with MDS018.

MGC14161 (Accession NP_116281.1) is another GAM5227 target gene, herein designated TARGET GENE. MGC14161 BINDING SITE is a target binding site found in the 5' untranslated region of mRNA encoded by MGC14161, corresponding to a target binding site such as BINDING SITE I, BINDING SITE II or BINDING SITE III of FIG. 8. Table 4 illustrates the complementarity of the nucleotide sequences of MGC14161 BINDING SITE, designated SEQ ID:11439, to the nucleotide sequence of GAM5227 RNA, herein designated GAM RNA, also designated SEQ ID:299.

Another function of GAM5227 is therefore inhibition of MGC14161 (Accession NP_116281.1). Accordingly, utilities of GAM5227 include diagnosis, prevention and treatment of diseases and clinical conditions associated with MGC14161.

MGC15730 (Accession NP_116269.2) is another GAM5227 target gene, herein designated TARGET GENE. MGC15730 BINDING SITE is a target binding site found in the 3' untranslated region of mRNA encoded by MGC15730, corresponding to a target binding site such as BINDING SITE I, BINDING SITE II or BINDING SITE III of FIG. 8. Table 4 illustrates the complementarity of the nucleotide sequences of MGC15730 BINDING SITE, designated SEQ ID:10025, to the nucleotide sequence of GAM5227 RNA, herein designated GAM RNA, also designated SEQ ID:299.

Another function of GAM5227 is therefore inhibition of MGC15730 (Accession NP_116269.2). Accordingly, utilities of GAM5227 include diagnosis, prevention and treatment of diseases and clinical conditions associated with MGC15730.

MGC17515 (Accession NP_689684.1) is another GAM5227 target gene, herein designated TARGET GENE. MGC17515 BINDING SITE is a target binding site found in the 5' untranslated region of mRNA encoded by MGC17515, corresponding to a target binding site such as BINDING SITE I, BINDING SITE II or BINDING SITE III of FIG. 8. Table 4 illustrates the complementarity of the nucleotide sequences of MGC17515 BINDING SITE, designated SEQ ID:4222, to the nucleotide sequence of GAM5227 RNA, herein designated GAM RNA, also designated SEQ ID:299.

Another function of GAM5227 is therefore inhibition of MGC17515 (Accession NP_689684.1). Accordingly, utilities of GAM5227 include diagnosis, prevention and treatment of diseases and clinical conditions associated with MGC17515.

MGC3020 (Accession NP_076953.2) is another GAM5227 target gene, herein designated TARGET GENE. MGC3020 BINDING SITE is a target binding site found in the 5' untranslated region of mRNA encoded by MGC3020, corresponding to a target binding site such as BINDING SITE I, BINDING SITE II or BINDING SITE III of FIG. 8. Table 4 illustrates the complementarity of the nucleotide sequences of MGC3020 BINDING SITE, designated SEQ ID:3360, to the nucleotide sequence of GAM5227 RNA, herein designated GAM RNA, also designated SEQ ID:299.

Another function of GAM5227 is therefore inhibition of MGC3020 (Accession NP_076953.2). Accordingly, utilities of GAM5227 include diagnosis, prevention and treatment of diseases and clinical conditions associated with MGC3020.

MGC3113 (Accession NP_076940.1) is another GAM5227 target gene, herein designated TARGET GENE. MGC3113 BINDING SITE is a target binding site found in the 3' untranslated region of mRNA encoded by MGC3113, corresponding to a target binding site such as BINDING SITE I, BINDING SITE II or BINDING SITE III of FIG. 8. Table 4 illustrates the complementarity of the nucleotide sequences of MGC3113 BINDING SITE, designated SEQ ID:1375, to the nucleotide sequence of GAM5227 RNA, herein designated GAM RNA, also designated SEQ ID:299.

Another function of GAM5227 is therefore inhibition of MGC3113 (Accession NP_076940.1). Accordingly, utilities of GAM5227 include diagnosis, prevention and treatment of diseases and clinical conditions associated with MGC3113.

MGC39633 (Accession NP_689762.1) is another GAM5227 target gene, herein designated TARGET GENE. MGC39633 BINDING SITE is a target binding site found in the 5' untranslated region of mRNA encoded by MGC39633, corresponding to a target binding site such as BINDING SITE I, BINDING SITE II or BINDING SITE III of FIG. 8. Table 4 illustrates the complementarity of the nucleotide sequences of MGC39633 BINDING SITE, designated SEQ ID:1566, to the nucleotide sequence of GAM5227 RNA, herein designated GAM RNA, also designated SEQ ID:299.

Another function of GAM5227 is therefore inhibition of MGC39633 (Accession NP_689762.1). Accordingly, utilities of GAM5227 include diagnosis, prevention and treatment of diseases and clinical conditions associated with MGC39633.

MI-ER1 (Accession NP_065999.1) is another GAM5227 target gene, herein designated TARGET GENE. MI-ER1 BINDING SITE is a target binding site found in the 3' untranslated region of mRNA encoded by MI-ER1, corresponding to a target binding site such as BINDING SITE I, BINDING SITE II or BINDING SITE III of FIG. 8. Table 4 illustrates the complementarity of the nucleotide sequences of MI-ER1 BINDING SITE, designated SEQ ID:2832, to the nucleotide sequence of GAM5227 RNA, herein designated GAM RNA, also designated SEQ ID:299.

Another function of GAM5227 is therefore inhibition of MI-ER1 (Accession NP_065999.1). Accordingly, utilities of GAM5227 include diagnosis, prevention and treatment of diseases and clinical conditions associated with MI-ER1.

Myeloid/lymphoid or mixed-lineage leukemia (trithorax homolog, drosophila); translocated to, 3 (MLLT3, Accession NP_004520.1) is another GAM5227 target gene, herein designated TARGET GENE. MLLT3 BINDING SITE is a target binding site found in the 3' untranslated region of mRNA encoded by MLLT3, corresponding to a target binding site such as BINDING SITE I, BINDING SITE II or BINDING SITE III of FIG. 8. Table 4 illustrates the complementarity of the nucleotide sequences of MLLT3 BINDING SITE, designated SEQ ID:16801, to the nucleotide sequence of GAM5227 RNA, herein designated GAM RNA, also designated SEQ ID:299.

Another function of GAM5227 is therefore inhibition of Myeloid/lymphoid or mixed-lineage leukemia (trithorax homolog, drosophila); translocated to, 3 (MLLT3, Accession NP_004520.1), a gene which is Serine and proline rich protein and therefore is associated with Acute leukemias. Accordingly, utilities of GAM5227 include diagnosis, prevention and treatment of Acute leukemias, and of other diseases and clinical conditions associated with MLLT3.

The function of MLLT3 and its association with various diseases and clinical conditions, has been established by previous studies, as described hereinabove with reference to GAM233.1. Myeloproliferative leukemia virus oncogene (MPL, Accession NP_005364.1) is another GAM5227 target gene, herein designated TARGET GENE. MPL BINDING SITE is a target binding site found in the 3' untranslated region of mRNA encoded by MPL, corresponding to a target binding site such as BINDING SITE I, BINDING SITE II or BINDING SITE III of FIG. 8. Table 4 illustrates the complementarity of the nucleotide sequences of MPL BINDING SITE, designated SEQ ID:8412, to the nucleotide sequence of GAM5227 RNA, herein designated GAM RNA, also designated SEQ ID:299.

Another function of GAM5227 is therefore inhibition of Myeloproliferative leukemia virus oncogene (MPL, Accession NP_005364.1). Accordingly, utilities of GAM5227 include diagnosis, prevention and treatment of diseases and clinical conditions associated with MPL.

MPRG (Accession NP_060175.2) is another GAM5227 target gene, herein designated TARGET GENE. MPRG BINDING SITE is a target binding site found in the 3' untranslated region of mRNA encoded by MPRG, corresponding to a target binding site such as BINDING SITE I, BINDING SITE II or BINDING SITE III of FIG. 8. Table 4 illustrates the complementarity of the nucleotide sequences of MPRG BINDING SITE, designated SEQ ID:19256, to the nucleotide sequence of GAM5227 RNA, herein designated GAM RNA, also designated SEQ ID:299.

Another function of GAM5227 is therefore inhibition of MPRG (Accession NP_060175.2). Accordingly, utilities of GAM5227 include diagnosis, prevention and treatment of diseases and clinical conditions associated with MPRG.

Max interacting protein 1 (MXI1, Accession NP_005953.2) is another GAM5227 target gene, herein designated TARGET GENE. MXI1 BINDING SITE is a target binding site found in the 3' untranslated region of multiple transcripts of mRNA encoded by MXI1, corresponding to a target binding site such as BINDING SITE I, BINDING SITE II or BINDING SITE III of FIG. 8. Table 4 illustrates the complementarity of the nucleotide sequences of MXI1 BINDING SITE, designated SEQ ID:10235, to the nucleotide sequence of GAM5227 RNA, herein designated GAM RNA, also designated SEQ ID:299.

Another function of GAM5227 is therefore inhibition of Max interacting protein 1 (MXI1, Accession NP_005953.2), a gene which acts as a tumor suppressor in vivo, engages the MYC network in a functionally relevant manner and therefore may be associated with Prostate cancer, neurofibrosarcoma. Accordingly, utilities of GAM5227 include diagnosis, prevention and treatment of Prostate cancer, neurofibrosarcoma, and of other diseases and clinical conditions associated with MXI1.

The function of MXI1 and its association with various diseases and clinical conditions, has been established by previous studies, as described hereinabove with reference to GAM94.1. Max interacting protein 1 (MXI1, Accession NP_569157.1) is another GAM5227 target gene, herein designated TARGET GENE. MXI1 BINDING SITE is a target binding site found in the 3' untranslated region of multiple transcripts of mRNA encoded by MXI1, corresponding to a target binding site such as BINDING SITE I, BINDING SITE II or BINDING SITE III of FIG. 8. Table 4 illustrates the complementarity of the nucleotide sequences of MXI1 BINDING SITE, designated SEQ ID:10235, to the nucleotide sequence of GAM5227 RNA, herein designated GAM RNA, also designated SEQ ID:299.

Another function of GAM5227 is therefore inhibition of Max interacting protein 1 (MXI1, Accession NP_569157.1), a gene which acts as a tumor suppressor in vivo, engages the MYC network in a functionally relevant manner and therefore may be associated with Prostate cancer, neurofibrosarcoma. Accordingly, utilities of GAM5227 include diagnosis, prevention and treatment of Prostate cancer, neurofibrosarcoma, and of other diseases and clinical conditions associated with MXI1.

The function of MXI1 and its association with various diseases and clinical conditions, has been established by previous studies, as described hereinabove with reference to GAM94.1. Myosin light chain kinase 2, skeletal muscle (MYLK2, Accession NP_149109.1) is another GAM5227 target gene, herein designated TARGET GENE. MYLK2 BINDING SITE is a target binding site found in the 3' untranslated region of mRNA encoded by MYLK2, corresponding to a target binding site such as BINDING SITE I, BINDING SITE II or BINDING SITE III of FIG. 8. Table 4 illustrates the complementarity of the nucleotide sequences of MYLK2 BINDING SITE, designated SEQ ID:8353, to the nucleotide sequence of GAM5227 RNA, herein designated GAM RNA, also designated SEQ ID:299.

Another function of GAM5227 is therefore inhibition of Myosin light chain kinase 2, skeletal muscle (MYLK2, Accession NP_149109.1) . Accordingly, utilities of GAM5227 include diagnosis, prevention and treatment of diseases and clinical conditions associated with MYLK2.

Nuclear receptor co-repressor 2 (NCOR2, Accession NP_006303.1) is another GAM5227 target gene, herein designated TARGET GENE. NCOR2 BINDING SITE1 and NCOR2 BINDING SITE2 are target binding sites found in untranslated regions of mRNA encoded by NCOR2, corresponding to target binding sites such as BINDING SITE I, BINDING SITE II or BINDING SITE III of FIG. 8. Table 4 illustrates the complementarity of the nucleotide sequences of NCOR2 BINDING SITE1 and NCOR2 BINDING SITE2, designated SEQ ID:19433 and SEQ ID:18576 respectively, to the nucleotide sequence of GAM5227 RNA, herein designated GAM RNA, also designated SEQ ID:299.

Another function of GAM5227 is therefore inhibition of Nuclear receptor co-repressor 2 (NCOR2, Accession NP_006303.1), a gene which mediates the transcriptional repression activity of some nuclear receptors by promoting chromatin condensation, thus preventing access of the basal transcription. Accordingly, utilities of GAM5227 include diagnosis, prevention and treatment of diseases and clinical conditions associated with NCOR2.

The function of NCOR2 and its association with various diseases and clinical conditions, has been established by previous studies, as described hereinabove with reference to GAM1065.1. NDEL1 (Accession NP_110435.1) is another GAM5227 target gene, herein designated TARGET GENE. NDEL1 BINDING SITE is a target binding site found in the 3' untranslated region of mRNA encoded by NDEL1, corresponding to a target binding site such as BINDING SITE I, BINDING SITE II or BINDING SITE III of FIG. 8. Table 4 illustrates the complementarity of the nucleotide sequences of NDEL1 BINDING SITE, designated SEQ ID:4770, to the nucleotide sequence of GAM5227 RNA, herein designated GAM RNA, also designated SEQ ID:299.

Another function of GAM5227 is therefore inhibition of NDEL1 (Accession NP_110435.1). Accordingly, utilities of GAM5227 include diagnosis, prevention and treatment of diseases and clinical conditions associated with NDEL1.

Neuroglobin (NGB, Accession NP_067080.1) is another GAM5227 target gene, herein designated TARGET GENE. NGB BINDING SITE is a target binding site found in the 3' untranslated region of mRNA encoded by NGB, corresponding to a target binding site such as BINDING SITE I, BINDING SITE II or BINDING SITE III of FIG. 8. Table 4 illustrates the complementarity of the nucleotide sequences of NGB BINDING SITE, designated SEQ ID:16217, to the nucleotide sequence of GAM5227 RNA, herein designated GAM RNA, also designated SEQ ID:299.

Another function of GAM5227 is therefore inhibition of Neuroglobin (NGB, Accession NP_067080.1), a gene which has function in oxygen transport and storage in humans. Accordingly, utilities of GAM5227 include diagnosis, prevention and treatment of diseases and clinical conditions associated with NGB.

The function of NGB and its association with various diseases and clinical conditions, has been established by previous studies, as described hereinabove with reference to GAM404.2. Non-metastatic cells 2, protein (nm23b) expressed in (NME2, Accession NP_002503.1) is another GAM5227 target gene, herein designated TARGET GENE. NME2 BINDING SITE is a target binding site found in the 3' untranslated region of mRNA encoded by NME2, corresponding to a target binding site such as BINDING SITE I, BINDING SITE II or BINDING SITE III of FIG. 8. Table 4 illustrates the complementarity of the nucleotide sequences of NME2 BINDING SITE, designated SEQ ID:1264, to the nucleotide sequence of GAM5227 RNA, herein designated GAM RNA, also designated SEQ ID:299.

Another function of GAM5227 is therefore inhibition of Non-metastatic cells 2, protein (nm23b) expressed in (NME2, Accession NP_002503.1), a gene which has a major role in the synthesis of nucleoside triphosphates other than atp and acts as a transcriptional activator of the c-myc gene. Accordingly, utilities of GAM5227 include diagnosis, prevention and treatment of diseases and clinical conditions associated with NME2.

The function of NME2 and its association with various diseases and clinical conditions, has been established by previous studies, as described hereinabove with reference to GAM762.1. Nsfl1 (p97) cofactor (p47) (NSFL1C, Accession NP_061327.2) is another GAM5227 target gene, herein designated TARGET GENE. NSFL1C BINDING SITE is a target binding site found in the 3' untranslated region of multiple transcripts of mRNA encoded by NSFL1C, corresponding to a target binding site such as BINDING SITE I, BINDING SITE II or BINDING SITE III of FIG. 8. Table 4 illustrates the complementarity of the nucleotide sequences of NSFL1C BINDING SITE, designated SEQ ID:15237, to the nucleotide sequence of GAM5227 RNA, herein designated GAM RNA, also designated SEQ ID:299.

Another function of GAM5227 is therefore inhibition of Nsfl1 (p97) cofactor (p47) (NSFL1C, Accession NP_061327.2). Accordingly, utilities of GAM5227 include diagnosis, prevention and treatment of diseases and clinical conditions associated with NSFL1C.

Purinergic receptor p2x, ligand-gated ion channel, 1 (P2RX1, Accession NP_002549.1) is another GAM5227 target gene, herein designated TARGET GENE. P2RX1 BINDING SITE is a target binding site found in the 3' untranslated region of mRNA encoded by P2RX1, corresponding to a target binding site such as BINDING SITE I, BINDING SITE II or BINDING SITE III of FIG. 8. Table 4 illustrates the complementarity of the nucleotide sequences of P2RX1 BINDING SITE, designated SEQ ID:8598, to the nucleotide sequence of GAM5227 RNA, herein designated GAM RNA, also designated SEQ ID:299.

Another function of GAM5227 is therefore inhibition of Purinergic receptor p2x, ligand-gated ion channel, 1 (P2RX1, Accession NP_002549.1). Accordingly, utilities of GAM5227 include diagnosis, prevention and treatment of diseases and clinical conditions associated with P2RX1.

P53AIP1 (Accession NP_071395.1) is another GAM5227 target gene, herein designated TARGET GENE. P53AIP1 BINDING SITE is a target binding site found in the 3' untranslated region of mRNA encoded by P53AIP1, corresponding to a target binding site such as BINDING SITE I, BINDING SITE II or BINDING SITE III of FIG. 8. Table 4 illustrates the complementarity of the nucleotide sequences of P53AIP1 BINDING SITE, designated SEQ ID:17485, to the nucleotide sequence of GAM5227 RNA, herein designated GAM RNA, also designated SEQ ID:299.

Another function of GAM5227 is therefore inhibition of P53AIP1 (Accession NP_071395.1). Accordingly, utilities of GAM5227 include diagnosis, prevention and treatment of diseases and clinical conditions associated with P53AIP1.

Protocadherin beta 12 (PCDHB12, Accession NP_061755.1) is another GAM5227 target gene, herein designated TARGET GENE. PCDHB12 BINDING SITE is a target binding site found in the 3' untranslated region of mRNA encoded by PCDHB12, corresponding to a target binding site such as BINDING SITE I, BINDING SITE II or BINDING SITE III of FIG. 8. Table 4 illustrates the complementarity of the nucleotide sequences of PCDHB12 BINDING SITE, designated SEQ ID:7917, to the nucleotide sequence of GAM5227 RNA, herein designated GAM RNA, also designated SEQ ID:299.

Another function of GAM5227 is therefore inhibition of Protocadherin beta 12 (PCDHB12, Accession NP_061755.1). Accordingly, utilities of GAM5227 include diagnosis, prevention and treatment of diseases and clinical conditions associated with PCDHB12.

PCMF (Accession NP_064507.2) is another GAM5227 target gene, herein designated TARGET GENE. PCMF BINDING SITE is a target binding site found in the 3' untranslated region of mRNA encoded by PCMF, corresponding to a target binding site such as BINDING SITE I, BINDING SITE II or BINDING SITE III of FIG. 8. Table 4 illustrates the complementarity of the nucleotide sequences of PCMF BINDING SITE, designated SEQ ID:11762, to the nucleotide sequence of GAM5227 RNA, herein designated GAM RNA, also designated SEQ ID:299.

Another function of GAM5227 is therefore inhibition of PCMF (Accession NP_064507.2). Accordingly, utilities of GAM5227 include diagnosis, prevention and treatment of diseases and clinical conditions associated with PCMF.

Proprotein convertase subtilisin/kexin type 7 (PCSK7, Accession NP_004707.2) is another GAM5227 target gene, herein designated TARGET GENE. PCSK7 BINDING SITE is a target binding site found in the 3' untranslated region of mRNA encoded by PCSK7, corresponding to a target binding site such as BINDING SITE I, BINDING SITE II or BINDING SITE III of FIG. 8. Table 4 illustrates the complementarity of the nucleotide sequences of PCSK7 BINDING SITE, designated SEQ ID:11321, to the nucleotide sequence of GAM5227 RNA, herein designated GAM RNA, also designated SEQ ID:299.

Another function of GAM5227 is therefore inhibition of Proprotein convertase subtilisin/kexin type 7 (PCSK7, Accession NP_004707.2) . Accordingly, utilities of GAM5227 include diagnosis, prevention and treatment of diseases and clinical conditions associated with PCSK7.

Pyruvate dehydrogenase kinase, isoenzyme 4 (PDK4, Accession NP_002603.1) is another GAM5227 target gene, herein designated TARGET GENE. PDK4 BINDING SITE is a target binding site found in the 3' untranslated region of mRNA encoded by PDK4, corresponding to a target binding site such as BINDING SITE I, BINDING SITE II or BINDING SITE III of FIG. 8. Table 4 illustrates the complementarity of the nucleotide sequences of PDK4 BINDING SITE, designated SEQ ID:2181, to the nucleotide sequence of GAM5227 RNA, herein designated GAM RNA, also designated SEQ ID:299.

Another function of GAM5227 is therefore inhibition of Pyruvate dehydrogenase kinase, isoenzyme 4 (PDK4, Accession NP_002603.1). Accordingly, utilities of GAM5227 include diagnosis, prevention and treatment of diseases and clinical conditions associated with PDK4.

Paternally expressed 10 (PEG10, Accession NP_055883.1) is another GAM5227 target gene, herein designated TARGET GENE. PEG10 BINDING SITE is a target binding site found in the 3' untranslated region of mRNA encoded by PEG10, corresponding to a target binding site such as BINDING SITE I, BINDING SITE II or BINDING SITE III of FIG. 8. Table 4 illustrates the complementarity of the nucleotide sequences of PEG10 BINDING SITE, designated SEQ ID:10949, to the nucleotide sequence of GAM5227 RNA, herein designated GAM RNA, also designated SEQ ID:299.

Another function of GAM5227 is therefore inhibition of Paternally expressed 10 (PEG10, Accession NP_055883.1). Accordingly, utilities of GAM5227 include diagnosis, prevention and treatment of diseases and clinical conditions associated with PEG10.

6-phosphofructo -2-kinase/fructose-2,6-biphosphatase 3 (PFKFB3, Accession NP_004557.1) is another GAM5227 target gene, herein designated TARGET GENE. PFKFB3 BINDING SITE is a target binding site found in the 3' untranslated region of mRNA encoded by PFKFB3, corresponding to a target binding site such as BINDING SITE I, BINDING SITE II or BINDING SITE III of FIG. 8. Table 4 illustrates the complementarity of the nucleotide sequences of PFKFB3 BINDING SITE, designated SEQ ID:2796, to the nucleotide sequence of GAM5227 RNA, herein designated GAM RNA, also designated SEQ ID:299.

Another function of GAM5227 is therefore inhibition of 6-phosphofructo -2-kinase/fructose-2,6-biphosphatase 3 (PFKFB3, Accession NP_004557.1), a gene which catalyzes synthesis and degradation of fructose 2,6-bisphosphate. Accordingly, utilities of GAM5227 include diagnosis, prevention and treatment of diseases and clinical conditions associated with PFKFB3.

The function of PFKFB3 and its association with various diseases and clinical conditions, has been established by previous studies, as described hereinabove with reference to GAM47.1. PI4KII (Accession NP_060895.1) is another GAM5227 target gene, herein designated TARGET GENE. PI4KII BINDING SITE is a target binding site found in the 3' untranslated region of mRNA encoded by PI4KII, corresponding to a target binding site such as BINDING SITE I, BINDING SITE II or BINDING SITE III of FIG. 8. Table 4 illustrates the complementarity of the nucleotide sequences of PI4KII BINDING SITE, designated SEQ ID:11397, to the nucleotide sequence of GAM5227 RNA, herein designated GAM RNA, also designated SEQ ID:299.

Another function of GAM5227 is therefore inhibition of PI4KII (Accession NP_060895.1). Accordingly, utilities of GAM5227 include diagnosis, prevention and treatment of diseases and clinical conditions associated with PI4KII.

Plexin a2 (PLXNA2, Accession NP_079455.1) is another GAM5227 target gene, herein designated TARGET GENE. PLXNA2 BINDING SITE is a target binding site found in the 3' untranslated region of mRNA encoded by PLXNA2, corresponding to a target binding site such as BINDING SITE I, BINDING SITE II or BINDING SITE III of FIG. 8. Table 4 illustrates the complementarity of the nucleotide sequences of PLXNA2 BINDING SITE, designated SEQ ID:6296, to the nucleotide sequence of GAM5227 RNA, herein designated GAM RNA, also designated SEQ ID:299.

Another function of GAM5227 is therefore inhibition of Plexin a2 (PLXNA2, Accession NP_079455.1), a gene which is a transmembrane protein. Accordingly, utilities of GAM5227 include diagnosis, prevention and treatment of diseases and clinical conditions associated with PLXNA2.

The function of PLXNA2 and its association with various diseases and clinical conditions, has been established by previous studies, as described hereinabove with reference to GAM65.1. Podocalyxin-like (PODXL, Accession NP_005388.1) is another GAM5227 target gene, herein designated TARGET GENE. PODXL BINDING SITE is a target binding site found in the 3' untranslated region of mRNA encoded by PODXL, corresponding to a target binding site such as BINDING SITE I, BINDING SITE II or BINDING SITE III of FIG. 8. Table 4 illustrates the complementarity of the nucleotide sequences of PODXL BINDING SITE, designated SEQ ID:15111, to the nucleotide sequence of GAM5227 RNA, herein designated GAM RNA, also designated SEQ ID:299.

Another function of GAM5227 is therefore inhibition of Podocalyxin-like (PODXL, Accession NP_005388.1), a gene which is an antiadhesin. Accordingly, utilities of GAM5227 include diagnosis, prevention and treatment of diseases and clinical conditions associated with PODXL.

The function of PODXL and its association with various diseases and clinical conditions, has been established by previous studies, as described hereinabove with reference to GAM335.1. Polymerase (dna directed), epsilon 3 (p17 subunit) (POLE3, Accession NP_059139.2) is another GAM5227 target gene, herein designated TARGET GENE. POLE3 BINDING SITE is a target binding site found in the 3' untranslated region of mRNA encoded by POLE3, corresponding to a target binding site such as BINDING SITE I, BINDING SITE II or BINDING SITE III of FIG. 8. Table 4 illustrates the complementarity of the nucleotide sequences of POLE3 BINDING SITE, designated SEQ ID:18239, to the nucleotide sequence of GAM5227 RNA, herein designated GAM RNA, also designated SEQ ID:299.

Another function of GAM5227 is therefore inhibition of Polymerase (dna directed), epsilon 3 (p17 subunit) (POLE3, Accession NP_059139.2). Accordingly, utilities of GAM5227 include diagnosis, prevention and treatment of diseases and clinical conditions associated with POLE3.

Pou domain, class 2, transcription factor 2 (POU2F2, Accession NP_002689.1) is another GAM5227 target gene, herein designated TARGET GENE. POU2F2 BINDING SITE is a target binding site found in the 3' untranslated region of mRNA encoded by POU2F2, corresponding to a target binding site such as BINDING SITE I, BINDING SITE II or BINDING SITE III of FIG. 8. Table 4 illustrates the complementarity of the nucleotide sequences of POU2F2 BINDING SITE, designated SEQ ID:13248, to the nucleotide sequence of GAM5227 RNA, herein designated GAM RNA, also designated SEQ ID:299.

Another function of GAM5227 is therefore inhibition of Pou domain, class 2, transcription factor 2 (POU2F2, Accession NP_002689.1), a gene which activates immunoglobulin gene expression. Accordingly, utilities of GAM5227 include diagnosis, prevention and treatment of diseases and clinical conditions associated with POU2F2.

The function of POU2F2 and its association with various diseases and clinical conditions, has been established by previous studies, as described hereinabove with reference to GAM148.2. Protein kinase, interferon-inducible double stranded rna dependent (PRKR, Accession NP_002750.1) is another GAM5227 target gene, herein designated TARGET GENE. PRKR BINDING SITE is a target binding site found in the 5' untranslated region of mRNA encoded by PRKR, corresponding to a target binding site such as BINDING SITE I, BINDING SITE II or BINDING SITE III of FIG. 8. Table 4 illustrates the complementarity of the nucleotide sequences of PRKR BINDING SITE, designated SEQ ID:1023, to the nucleotide sequence of GAM5227 RNA, herein designated GAM RNA, also designated SEQ ID:299.

Another function of GAM5227 is therefore inhibition of Protein kinase, interferon-inducible double stranded rna dependent (PRKR, Accession NP_002750.1), a gene which catalyze the phosphorylation of the alpha subunit of eif2. and therefore may be associated with Huntington's disease. Accordingly, utilities of GAM5227 include diagnosis, prevention and treatment of Huntington's disease, and of other diseases and clinical conditions associated with PRKR.

The function of PRKR and its association with various diseases and clinical conditions, has been established by previous studies, as described hereinabove with reference to GAM136.1. PRO2435 (Accession NP_060997.1) is another GAM5227 target gene, herein designated TARGET GENE. PRO2435 BINDING SITE is a target binding site found in the 5' untranslated region of mRNA encoded by PRO2435, corresponding to a target binding site such as BINDING SITE I, BINDING SITE II or BINDING SITE III of FIG. 8. Table 4 illustrates the complementarity of the nucleotide sequences of PRO2435 BINDING SITE, designated SEQ ID:18921, to the nucleotide sequence of GAM5227 RNA, herein designated GAM RNA, also designated SEQ ID:299.

Another function of GAM5227 is therefore inhibition of PRO2435 (Accession NP_060997.1). Accordingly, utilities of GAM5227 include diagnosis, prevention and treatment of diseases and clinical conditions associated with PRO2435.

PROM2 (Accession NP_653308.1) is another GAM5227 target gene, herein designated TARGET GENE. PROM2 BINDING SITE is a target binding site found in the 3' untranslated region of mRNA encoded by PROM2, corresponding to a target binding site such as BINDING SITE I, BINDING SITE II or BINDING SITE III of FIG. 8. Table 4 illustrates the complementarity of the nucleotide sequences of PROM2 BINDING SITE, designated SEQ ID:11956, to the nucleotide sequence of GAM5227 RNA, herein designated GAM RNA, also designated SEQ ID:299.

Another function of GAM5227 is therefore inhibition of PROM2 (Accession NP_653308.1). Accordingly, utilities of GAM5227 include diagnosis, prevention and treatment of diseases and clinical conditions associated with PROM2.

Pregnancy specific beta-1-glycoprotein 7 (PSG7, Accession NP_002774.1) is another GAM5227 target gene, herein designated TARGET GENE. PSG7 BINDING SITE is a target binding site found in the 3' untranslated region of mRNA encoded by PSG7, corresponding to a target binding site such as BINDING SITE I, BINDING SITE II or BINDING SITE III of FIG. 8. Table 4 illustrates the complementarity of the nucleotide sequences of PSG7 BINDING SITE, designated SEQ ID:3072, to the nucleotide sequence of GAM5227 RNA, herein designated GAM RNA, also designated SEQ ID:299.

Another function of GAM5227 is therefore inhibition of Pregnancy specific beta-1-glycoprotein 7 (PSG7, Accession NP_002774.1), a gene which function still unknown. Accordingly, utilities of GAM5227 include diagnosis, prevention and treatment of diseases and clinical conditions associated with PSG7.

The function of PSG7 and its association with various diseases and clinical conditions, has been established by previous studies, as described hereinabove with reference to GAM63.1. Quiescin q6 (QSCN6, Accession NP_002817.2) is another GAM5227 target gene, herein designated TARGET GENE. QSCN6 BINDING SITE is a target binding site found in the 3' untranslated region of mRNA encoded by QSCN6, corresponding to a target binding site such as BINDING SITE I, BINDING SITE II or BINDING SITE III of FIG. 8. Table 4 illustrates the complementarity of the nucleotide sequences of QSCN6 BINDING SITE, designated SEQ ID:11516, to the nucleotide sequence of GAM5227 RNA, herein designated GAM RNA, also designated SEQ ID:299.

Another function of GAM5227 is therefore inhibition of Quiescin q6 (QSCN6, Accession NP_002817.2). Accordingly, utilities of GAM5227 include diagnosis, prevention and treatment of diseases and clinical conditions associated with QSCN6.

Rab17, member ras oncogene family (RAB17, Accession NP_071894.1) is another GAM5227 target gene, herein designated TARGET GENE. RAB17 BINDING SITE is a target binding site found in the 3' untranslated region of mRNA encoded by RAB17, corresponding to a target binding site such as BINDING SITE I, BINDING SITE II or BINDING SITE III of FIG. 8. Table 4 illustrates the complementarity of the nucleotide sequences of RAB17 BINDING SITE, designated SEQ ID:18385, to the nucleotide sequence of GAM5227 RNA, herein designated GAM RNA, also designated SEQ ID:299.

Another function of GAM5227 is therefore inhibition of Rab17, member ras oncogene family (RAB17, Accession NP_071894.1). Accordingly, utilities of GAM5227 include diagnosis, prevention and treatment of diseases and clinical conditions associated with RAB17.

Receptor (calcitonin) activity modifying protein 3 (RAMP3, Accession NP_005847.1) is another GAM5227 target gene, herein designated TARGET GENE. RAMP3 BINDING SITE is a target binding site found in the 3' untranslated region of mRNA encoded by RAMP3, corresponding to a target binding site such as BINDING SITE I, BINDING SITE II or BINDING SITE III of FIG. 8. Table 4 illustrates the complementarity of the nucleotide sequences of RAMP3 BINDING SITE, designated SEQ ID:7834, to the nucleotide sequence of GAM5227 RNA, herein designated GAM RNA, also designated SEQ ID:299.

Another function of GAM5227 is therefore inhibition of Receptor (calcitonin) activity modifying protein 3 (RAMP3, Accession NP_005847.1), a gene which is required to transport calcitonin-receptor-like receptor (crlr) to the plasma membrane. Accordingly, utilities of GAM5227 include diagnosis, prevention and treatment of diseases and clinical conditions associated with RAMP3.

The function of RAMP3 and its association with various diseases and clinical conditions, has been established by previous studies, as described hereinabove with reference to GAM625.1. Reelin (RELN, Accession NP_774959.1) is another GAM5227 target gene, herein designated TARGET GENE. RELN BINDING SITE is a target binding site found in the 3' untranslated region of multiple transcripts of mRNA encoded by RELN, corresponding to a target binding site such as BINDING SITE I, BINDING SITE II or BINDING SITE III of FIG. 8. Table 4 illustrates the complementarity of the nucleotide sequences of RELN BINDING SITE, designated SEQ ID:16254, to the nucleotide sequence of GAM5227 RNA, herein designated GAM RNA, also designated SEQ ID:299.

Another function of GAM5227 is therefore inhibition of Reelin (RELN, Accession NP_774959.1), a gene which regulates microtubule function in neurons and neuronal migration. and therefore is associated with Norman-roberts syndrome. Accordingly, utilities of GAM5227 include diagnosis, prevention and treatment of Norman-roberts syndrome, and of other diseases and clinical conditions associated with RELN.

The function of RELN and its association with various diseases and clinical conditions, has been established by previous studies, as described hereinabove with reference to GAM700.2. Reelin (RELN, Accession NP_005036.2) is another GAM5227 target gene, herein designated TARGET GENE. RELN BINDING SITE is a target binding site found in the 3' untranslated region of multiple transcripts of mRNA encoded by RELN, corresponding to a target binding site such as BINDING SITE I, BINDING SITE II or BINDING SITE III of FIG. 8. Table 4 illustrates the complementarity of the nucleotide sequences of RELN BINDING SITE, designated SEQ ID:16254, to the nucleotide sequence of GAM5227 RNA, herein designated GAM RNA, also designated SEQ ID:299.

Another function of GAM5227 is therefore inhibition of Reelin (RELN, Accession NP_005036.2), a gene which regulates microtubule function in neurons and neuronal migration. and therefore is associated with Norman-roberts syndrome. Accordingly, utilities of GAM5227 include diagnosis, prevention and treatment of Norman-roberts syndrome, and of other diseases and clinical conditions associated with RELN.

The function of RELN and its association with various diseases and clinical conditions, has been established by previous studies, as described hereinabove with reference to GAM700.2. RETNLB (Accession NP_115968.1) is another GAM5227 target gene, herein designated TARGET GENE. RETNLB BINDING SITE is a target binding site found in the 5' untranslated region of mRNA encoded by RETNLB, corresponding to a target binding site such as BINDING SITE I, BINDING SITE II or BINDING SITE III of FIG. 8. Table 4 illustrates the complementarity of the nucleotide sequences of RETNLB BINDING SITE, designated SEQ ID:1728, to the nucleotide sequence of GAM5227 RNA, herein designated GAM RNA, also designated SEQ ID:299.

Another function of GAM5227 is therefore inhibition of RETNLB (Accession NP_115968.1). Accordingly, utilities of GAM5227 include diagnosis, prevention and treatment of diseases and clinical conditions associated with RETNLB.

Regulator of g-protein signalling 7 (RGS7, Accession NP_002915.2) is another GAM5227 target gene, herein designated TARGET GENE. RGS7 BINDING SITE is a target binding site found in the 3' untranslated region of mRNA encoded by RGS7, corresponding to a target binding site such as BINDING SITE I, BINDING SITE II or BINDING SITE III of FIG. 8. Table 4 illustrates the complementarity of the nucleotide sequences of RGS7 BINDING SITE, designated SEQ ID:20171, to the nucleotide sequence of GAM5227 RNA, herein designated GAM RNA, also designated SEQ ID:299.

Another function of GAM5227 is therefore inhibition of Regulator of g-protein signalling 7 (RGS7, Accession NP_002915.2). Accordingly, utilities of GAM5227 include diagnosis, prevention and treatment of diseases and clinical conditions associated with RGS7.

Ring finger protein 24 (RNF24, Accession NP_009150.1) is another GAM5227 target gene, herein designated TARGET GENE. RNF24 BINDING SITE is a target binding site found in the 3' untranslated region of mRNA encoded by RNF24, corresponding to a target binding site such as BINDING SITE I, BINDING SITE II or BINDING SITE III of FIG. 8. Table 4 illustrates the complementarity of the nucleotide sequences of RNF24 BINDING SITE, designated SEQ ID:16047, to the nucleotide sequence of GAM5227 RNA, herein designated GAM RNA, also designated SEQ ID:299.

Another function of GAM5227 is therefore inhibition of Ring finger protein 24 (RNF24, Accession NP_009150.1). Accordingly, utilities of GAM5227 include diagnosis, prevention and treatment of diseases and clinical conditions associated with RNF24.

Sodium channel, voltage-gated, type iv, alpha polypeptide (SCN4A, Accession NP_000325.1) is another GAM5227 target gene, herein designated TARGET GENE. SCN4A BINDING SITE is a target binding site found in the 3' untranslated region of mRNA encoded by SCN4A, corresponding to a target binding site such as BINDING SITE I, BINDING SITE II or BINDING SITE III of FIG. 8. Table 4 illustrates the complementarity of the nucleotide sequences of SCN4A BINDING SITE, designated SEQ ID:3212, to the nucleotide sequence of GAM5227 RNA, herein designated GAM RNA, also designated SEQ ID:299.

Another function of GAM5227 is therefore inhibition of Sodium channel, voltage-gated, type iv, alpha polypeptide (SCN4A, Accession NP_000325.1). Accordingly, utilities of GAM5227 include diagnosis, prevention and treatment of diseases and clinical conditions associated with SCN4A.

SETDB2 (Accession NP_114121.1) is another GAM5227 target gene, herein designated TARGET GENE. SETDB2 BINDING SITE is a target binding site found in the 5' untranslated region of mRNA encoded by SETDB2, corresponding to a target binding site such as BINDING SITE I, BINDING SITE II or BINDING SITE III of FIG. 8. Table 4 illustrates the complementarity of the nucleotide sequences of SETDB2 BINDING SITE, designated SEQ ID:9368, to the nucleotide sequence of GAM5227 RNA, herein designated GAM RNA, also designated SEQ ID:299.

Another function of GAM5227 is therefore inhibition of SETDB2 (Accession NP_114121.1). Accordingly, utilities of GAM5227 include diagnosis, prevention and treatment of diseases and clinical conditions associated with SETDB2.

Solute carrier family 13 (sodium-dependent dicarboxylate transporter), member 3 (SLC13A3, Accession NP_073740.2) is another GAM5227 target gene, herein designated TARGET GENE. SLC13A3 BINDING SITE is a target binding site found in the 3' untranslated region of mRNA encoded by SLC13A3, corresponding to a target binding site such as BINDING SITE I, BINDING SITE II or BINDING SITE III of FIG. 8. Table 4 illustrates the complementarity of the nucleotide sequences of SLC13A3 BINDING SITE, designated SEQ ID:18351, to the nucleotide sequence of GAM5227 RNA, herein designated GAM RNA, also designated SEQ ID:299.

Another function of GAM5227 is therefore inhibition of Solute carrier family 13 (sodium-dependent dicarboxylate transporter), member 3 (SLC13A3, Accession NP_073740.2). Accordingly, utilities of GAM5227 include diagnosis, prevention and treatment of diseases and clinical conditions associated with SLC13A3.

Solute carrier family 17 (sodium-dependent inorganic phosphate cotransporter), member 7 (SLC17A7, Accession NP_064705.1) is another GAM5227 target gene, herein designated TARGET GENE. SLC17A7 BINDING SITE is a target binding site found in the 3' untranslated region of mRNA encoded by SLC17A7, corresponding to a target binding site such as BINDING SITE I, BINDING SITE II or BINDING SITE III of FIG. 8. Table 4 illustrates the complementarity of the nucleotide sequences of SLC17A7 BINDING SITE, designated SEQ ID:4723, to the nucleotide sequence of GAM5227 RNA, herein designated GAM RNA, also designated SEQ ID:299.

Another function of GAM5227 is therefore inhibition of Solute carrier family 17 (sodium-dependent inorganic phosphate cotransporter), member 7 (SLC17A7, Accession NP_064705.1), a gene which is a brain-specific Na-dependent inorganic phosphate cotransporter. Accordingly, utilities of GAM5227 include diagnosis, prevention and treatment of diseases and clinical conditions associated with SLC17A7.

The function of SLC17A7 and its association with various diseases and clinical conditions, has been established by previous studies, as described hereinabove with reference to GAM500.2. SLC9A8 (Accession XP_030524.2) is another GAM5227 target gene, herein designated TARGET GENE. SLC9A8 BINDING SITE is a target binding site found in the 3' untranslated region of mRNA encoded by SLC9A8, corresponding to a target binding site such as BINDING SITE I, BINDING SITE II or BINDING SITE III of FIG. 8. Table 4 illustrates the complementarity of the nucleotide sequences of SLC9A8 BINDING SITE, designated SEQ ID:13104, to the nucleotide sequence of GAM5227 RNA, herein designated GAM RNA, also designated SEQ ID:299.

Another function of GAM5227 is therefore inhibition of SLC9A8 (Accession XP_030524.2). Accordingly, utilities of GAM5227 include diagnosis, prevention and treatment of diseases and clinical conditions associated with SLC9A8.

Synovial sarcoma translocation, chromosome 18 (SS18, Accession NP_005628.1) is another GAM5227 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:5489, to the nucleotide sequence of GAM5227 RNA, herein designated GAM RNA, also designated SEQ ID:299.

Another function of GAM5227 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM5227 include diagnosis, prevention and treatment of Human synovial sarcomas, and of other diseases and clinical conditions associated with SS18.

The function of SS18 and its association with various diseases and clinical conditions, has been established by previous studies, as described hereinabove with reference to GAM130.1. T-cell leukemia/lymphoma 6 (TCL6, Accession NP_055233.1) is another GAM5227 target gene, herein designated TARGET GENE. TCL6 BINDING SITE is a target binding site found in the 3' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:13727, to the nucleotide sequence of GAM5227 RNA, herein designated GAM RNA, also designated SEQ ID:299.

Another function of GAM5227 is therefore inhibition of T-cell leukemia/lymphoma 6 (TCL6, Accession NP_055233.1). Accordingly, utilities of GAM5227 include diagnosis, prevention and treatment of diseases and clinical conditions associated with TCL6.

T-cell leukemia/lymphoma 6 (TCL6, Accession NP_065575.1) is another GAM5227 target gene, herein designated TARGET GENE. TCL6 BINDING SITE is a target binding site found in the 3' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:13727, to the nucleotide sequence of GAM5227 RNA, herein designated GAM RNA, also designated SEQ ID:299.

Another function of GAM5227 is therefore inhibition of T-cell leukemia/lymphoma 6 (TCL6, Accession NP_065575.1). Accordingly, utilities of GAM5227 include diagnosis, prevention and treatment of diseases and clinical conditions associated with TCL6.

Thioesterase, adipose associated (THEA, Accession NP_671517.1) is another GAM5227 target gene, herein designated TARGET GENE. THEA BINDING SITE is a target binding site found in the 3' untranslated region of multiple transcripts of mRNA encoded by THEA, corresponding to a target binding site such as BINDING SITE I, BINDING SITE II or BINDING SITE III of FIG. 8. Table 4 illustrates the complementarity of the nucleotide sequences of THEA BINDING SITE, designated SEQ ID:7538, to the nucleotide sequence of GAM5227 RNA, herein designated GAM RNA, also designated SEQ ID:299.

Another function of GAM5227 is therefore inhibition of Thioesterase, adipose associated (THEA, Accession NP_671517.1). Accordingly, utilities of GAM5227 include diagnosis, prevention and treatment of diseases and clinical conditions associated with THEA.

Transducin-like enhancer of split 2 (e(sp1) homolog, drosophila) (TLE2, Accession NP_003251.2) is another GAM5227 target gene, herein designated TARGET GENE. TLE2 BINDING SITE is a target binding site found in the 5' untranslated region of mRNA encoded by TLE2, corresponding to a target binding site such as BINDING SITE I, BINDING SITE II or BINDING SITE III of FIG. 8. Table 4 illustrates the complementarity of the nucleotide sequences of TLE2 BINDING SITE, designated SEQ ID:642, to the nucleotide sequence of GAM5227 RNA, herein designated GAM RNA, also designated SEQ ID:299.

Another function of GAM5227 is therefore inhibition of Transducin-like enhancer of split 2 (e(sp1) homolog, drosophila) (TLE2, Accession NP_003251.2), a gene which involves in epithelial differentiation. Accordingly, utilities of GAM5227 include diagnosis, prevention and treatment of diseases and clinical conditions associated with TLE2.

The function of TLE2 and its association with various diseases and clinical conditions, has been established by previous studies, as described hereinabove with reference to GAM223.1. Transmembrane protease, serine 3 (TMPRSS3, Accession NP_076927.1) is another GAM5227 target gene, herein designated TARGET GENE. TMPRSS3 BINDING SITE1 and TMPRSS3 BINDING SITE2 are target binding sites found in untranslated regions of multiple transcripts of mRNA encoded by TMPRSS3, corresponding to target binding sites such as BINDING SITE I, BINDING SITE II or BINDING SITE III of FIG. 8. Table 4 illustrates the complementarity of the nucleotide sequences of TMPRSS3 BINDING SITE1 and TMPRSS3 BINDING SITE2, designated SEQ ID:19374 and SEQ ID:17983 respectively, to the nucleotide sequence of GAM5227 RNA, herein designated GAM RNA, also designated SEQ ID:299.

Another function of GAM5227 is therefore inhibition of Transmembrane protease, serine 3 (TMPRSS3, Accession NP_076927.1). Accordingly, utilities of GAM5227 include diagnosis, prevention and treatment of diseases and clinical conditions associated with TMPRSS3.

Transmembrane protease, serine 3 (TMPRSS3, Accession NP_076927.1) is another GAM5227 target gene, herein designated TARGET GENE. TMPRSS3 BINDING SITE1 and TMPRSS3 BINDING SITE2 are target binding sites found in untranslated regions of multiple transcripts of mRNA encoded by TMPRSS3, corresponding to target binding sites such as BINDING SITE I, BINDING SITE II or BINDING SITE III of FIG. 8. Table 4 illustrates the complementarity of the nucleotide sequences of TMPRSS3 BINDING SITE1 and TMPRSS3 BINDING SITE2, designated SEQ ID:17983 and SEQ ID:17983 respectively, to the nucleotide sequence of GAM5227 RNA, herein designated GAM RNA, also designated SEQ ID:299.

Another function of GAM5227 is therefore inhibition of Transmembrane protease, serine 3 (TMPRSS3, Accession NP_076927.1). Accordingly, utilities of GAM5227 include diagnosis, prevention and treatment of diseases and clinical conditions associated with TMPRSS3.

Transmembrane protease, serine 3 (TMPRSS3, Accession NP_115777.1) is another GAM5227 target gene, herein designated TARGET GENE. TMPRSS3 BINDING SITE1 and TMPRSS3 BINDING SITE2 are target binding sites found in untranslated regions of multiple transcripts of mRNA encoded by TMPRSS3, corresponding to target binding sites such as BINDING SITE I, BINDING SITE II or BINDING SITE III of FIG. 8. Table 4 illustrates the complementarity of the nucleotide sequences of TMPRSS3 BINDING SITE1 and TMPRSS3 BINDING SITE2, designated SEQ ID:19374 and SEQ ID:19374 respectively, to the nucleotide sequence of GAM5227 RNA, herein designated GAM RNA, also designated SEQ ID:299.

Another function of GAM5227 is therefore inhibition of Transmembrane protease, serine 3 (TMPRSS3, Accession NP_115777.1). Accordingly, utilities of GAM5227 include diagnosis, prevention and treatment of diseases and clinical conditions associated with TMPRSS3.

Troponin c, slow (TNNC1, Accession NP_003271.1) is another GAM5227 target gene, herein designated TARGET GENE. TNNC1 BINDING SITE is a target binding site found in the 3' untranslated region of mRNA encoded by TNNC1, corresponding to a target binding site such as BINDING SITE I, BINDING SITE II or BINDING SITE III of FIG. 8. Table 4 illustrates the complementarity of the nucleotide sequences of TNNC1 BINDING SITE, designated SEQ ID:12996, to the nucleotide sequence of GAM5227 RNA, herein designated GAM RNA, also designated SEQ ID:299.

Another function of GAM5227 is therefore inhibition of Troponin c, slow (TNNC1, Accession NP_003271.1), a gene which Troponin C; calcium- binding subunit of troponin, a regulatory protein, prevents actin and myosin interaction in resting muscle tissue. Accordingly, utilities of GAM5227 include diagnosis, prevention and treatment of diseases and clinical conditions associated with TNNC1.

The function of TNNC1 and its association with various diseases and clinical conditions, has been established by previous studies, as described hereinabove with reference to GAM3099.2. Trichorhinophalangeal syndrome i (TRPS1, Accession NP_054831.1) is another GAM5227 target gene, herein designated TARGET GENE. TRPS1 BINDING SITE is a target binding site found in the 3' untranslated region of mRNA encoded by TRPS1, corresponding to a target binding site such as BINDING SITE I, BINDING SITE II or BINDING SITE III of FIG. 8. Table 4 illustrates the complementarity of the nucleotide sequences of TRPS1 BINDING SITE, designated SEQ ID:5417, to the nucleotide sequence of GAM5227 RNA, herein designated GAM RNA, also designated SEQ ID:299.

Another function of GAM5227 is therefore inhibition of Trichorhinophalangeal syndrome i (TRPS1, Accession NP_054831.1), a gene which may function as a transcriptional activator protein and therefore is associated with Trichorhinophalangeal syndrome type i, type iii. Accordingly, utilities of GAM5227 include diagnosis, prevention and treatment of Trichorhinophalangeal syndrome type i, type iii, and of other diseases and clinical conditions associated with TRPS1.

The function of TRPS1 and its association with various diseases and clinical conditions, has been established by previous studies, as described hereinabove with reference to GAM139.1. Tissue specific transplantation antigen p35b (TSTA3, Accession NP_003304.1) is another GAM5227 target gene, herein designated TARGET GENE. TSTA3 BINDING SITE is a target binding site found in the 3' untranslated region of mRNA encoded by TSTA3, corresponding to a target binding site such as BINDING SITE I, BINDING SITE II or BINDING SITE III of FIG. 8. Table 4 illustrates the complementarity of the nucleotide sequences of TSTA3 BINDING SITE, designated SEQ ID:19224, to the nucleotide sequence of GAM5227 RNA, herein designated GAM RNA, also designated SEQ ID:299.

Another function of GAM5227 is therefore inhibition of Tissue specific transplantation antigen p35b (TSTA3, Accession NP_003304.1), a gene which converts gdp-4-dehydro-6-deoxy-d-mannose to gdp-fucose. and therefore may be associated with Leukocyte adhesion deficiency, type ii. Accordingly, utilities of GAM5227 include diagnosis, prevention and treatment of Leukocyte adhesion deficiency, type ii, and of other diseases and clinical conditions associated with TSTA3.

The function of TSTA3 and its association with various diseases and clinical conditions, has been established by previous studies, as described hereinabove with reference to GAM2012.2. VCIP135 (Accession NP_079330.1) is another GAM5227 target gene, herein designated TARGET GENE. VCIP135 BINDING SITE is a target binding site found in the 3' untranslated region of mRNA encoded by VCIP135, corresponding to a target binding site such as BINDING SITE I, BINDING SITE II or BINDING SITE III of FIG. 8. Table 4 illustrates the complementarity of the nucleotide sequences of VCIP135 BINDING SITE, designated SEQ ID:16563, to the nucleotide sequence of GAM5227 RNA, herein designated GAM RNA, also designated SEQ ID:299.

Another function of GAM5227 is therefore inhibition of VCIP135 (Accession NP_079330.1). Accordingly, utilities of GAM5227 include diagnosis, prevention and treatment of diseases and clinical conditions associated with VCIP135.

Zinc finger, dhhc domain containing 2 (ZDHHC2, Accession NP_057437.1) is another GAM5227 target gene, herein designated TARGET GENE. ZDHHC2 BINDING SITE is a target binding site found in the 3' untranslated region of mRNA encoded by ZDHHC2, corresponding to a target binding site such as BINDING SITE I, BINDING SITE II or BINDING SITE III of FIG. 8. Table 4 illustrates the complementarity of the nucleotide sequences of ZDHHC2 BINDING SITE, designated SEQ ID:8860, to the nucleotide sequence of GAM5227 RNA, herein designated GAM RNA, also designated SEQ ID:299.

Another function of GAM5227 is therefore inhibition of Zinc finger, dhhc domain containing 2 (ZDHHC2, Accession NP_057437.1). Accordingly, utilities of GAM5227 include diagnosis, prevention and treatment of diseases and clinical conditions associated with ZDHHC2.

Zinc finger protein 297b (ZNF297B, Accession NP_054726.1) is another GAM5227 target gene, herein designated TARGET GENE. ZNF297B BINDING SITE is a target binding site found in the 3' untranslated region of mRNA encoded by ZNF297B, corresponding to a target binding site such as BINDING SITE I, BINDING SITE II or BINDING SITE III of FIG. 8. Table 4 illustrates the complementarity of the nucleotide sequences of ZNF297B BINDING SITE, designated SEQ ID:14345, to the nucleotide sequence of GAM5227 RNA, herein designated GAM RNA, also designated SEQ ID:299.

Another function of GAM5227 is therefore inhibition of Zinc finger protein 297b (ZNF297B, Accession NP_054726.1). Accordingly, utilities of GAM5227 include diagnosis, prevention and treatment of diseases and clinical conditions associated with ZNF297B.

FIG. 8 further provides a conceptual description of a novel bioinformatically detected of the present invention, referred to here as Genomic Address Messenger 5346 (GAM5346), which modulates expression of respective target genes thereof, the function and utility of which target genes is known in the art.

GAM5346 is a novel bioinformatically detected regulatory, non protein coding, micro RNA (miRNA) gene. The method by which GAM5346 was detected is described hereinabove with reference to FIGS. 8-15.

GAM5346 gene, herein designated GAM GENE, and GAM5346 target gene, herein designated TARGET GENE, are human genes contained in the human genome.

GAM5346 gene encodes a GAM5346 precursor RNA, herein designated GAM PRECURSOR RNA. Similar to other miRNA genes, and unlike most ordinary genes, GAM5346 precursor RNA does not encode a protein. A nucleotide sequence identical or highly similar to the nucleotide sequence of GAM5346 precursor RNA is designated SEQ ID:152, and is provided hereinbelow with reference to the sequence listing part.

GAM5346 precursor RNA folds onto itself, forming GAM5346 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM5346 precursor RNA folds onto itself, forming GAM5346 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM5346 precursor RNA, designated SEQ-ID:152, and a schematic representation of a predicted secondary folding of GAM5346 folded precursor RNA are further described with reference to Table 2, hereby incorporated by reference.

An enzyme complex designated DICER COMPLEX, 'dices' the GAM5346 folded precursor RNA into GAM5346 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM5346 RNA is designated SEQ ID:319, and is provided hereinbelow with references to the sequence listing part and Table 3, hereby incorporated by reference.

GAM5346 target gene, herein designated TARGET GENE, encodes a corresponding messenger RNA, GAM5346 target RNA, herein designated GAM TARGET RNA. GAM5346 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM5346 RNA, herein designated GAM RNA, binds complementarily to one or more target binding sites located in untranslated regions of GAM5346 target RNA, herein designated GAM TARGET RNA. This complementary binding is due to the fact that the nucleotide sequence of GAM5346 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM5346 RNA may have a different number of target binding sites in untranslated regions of a GAM5346 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM5346 RNA, herein designated GAM RNA, to target binding sites on GAM5346 target RNA, herein designated GAM TARGET RNA, such as BINDING SITE I, BINDING SITE II and BINDING SITE III, inhibits translation of GAM5346 target RNA into GAM5346 target protein, herein designated GAM TARGET PROTEIN. GAM target protein is therefore outlined by a broken line.

It is appreciated that GAM5346 target gene, herein designated TARGET GENE, in fact represents a plurality of GAM5346 target genes. The mRNA of each one of this plurality of GAM5346 target genes comprises one or more target binding sites, each having a nucleotide sequence which is at least partly complementary to GAM5346 RNA, herein designated GAM RNA, and which when bound by GAM5346 RNA causes inhibition of translation of respective one or more GAM5346 target proteins.

It is further appreciated by one skilled in the art that the mode of translational inhibition illustrated by FIG. 8 with specific reference to translational inhibition exerted by GAM5346 gene, herein designated GAM GENE, on one or more GAM5346 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM5346 correlate with, and may be deduced from, the identity of the target genes which GAM5346 binds and inhibits, and the function of these target genes, as elaborated hereinbelow.

A kinase (prka) anchor protein 11 (AKAP11, Accession NP__652761.1) is a GAM5346 target gene, herein designated TARGET GENE. AKAP11 BINDING SITE is a target binding site found in the 3' untranslated region of multiple transcripts of mRNA encoded by AKAP11, corresponding to a target binding site such as BINDING SITE I, BINDING SITE II or BINDING SITE III of FIG. 8. Table 4 illustrates the complementarity of the nucleotide sequences of AKAP11 BINDING SITE, designated SEQ ID:11814, to the nucleotide sequence of GAM5346 RNA, herein designated GAM RNA, also designated SEQ ID:319.

A function of GAM5346 is therefore inhibition of A kinase (prka) anchor protein 11 (AKAP11, Accession NP__652761.1). Accordingly, utilities of GAM5346 include diagnosis, prevention and treatment of diseases and clinical conditions associated with AKAP11.

Aquaporin 10 (AQP10, Accession NP__536354.2) is another GAM5346 target gene, herein designated TARGET GENE. AQP10 BINDING SITE is a target binding site found in the 3' untranslated region of mRNA encoded by AQP10, corresponding to a target binding site such as BINDING SITE I, BINDING SITE II or BINDING SITE III of FIG. 8. Table 4 illustrates the complementarity of the nucleotide sequences of AQP10 BINDING SITE, designated SEQ ID:3157, to the nucleotide sequence of GAM5346 RNA, herein designated GAM RNA, also designated SEQ ID:319.

Another function of GAM5346 is therefore inhibition of Aquaporin 10 (AQP10, Accession NP__536354.2). Accordingly, utilities of GAM5346 include diagnosis, prevention and treatment of diseases and clinical conditions associated with AQP10.

Adp-ribosylation factor-like 6 interacting protein (ARL6IP, Accession NP__055976.1) is another GAM5346 target gene, herein designated TARGET GENE. ARL6IP BINDING SITE is a target binding site found in the 3' untranslated region of mRNA encoded by ARL6IP, corresponding to a target binding site such as BINDING SITE I, BINDING SITE II or BINDING SITE III of FIG. 8. Table 4 illustrates the complementarity of the nucleotide sequences of ARL6IP BINDING SITE, designated SEQ ID:422, to the nucleotide sequence of GAM5346 RNA, herein designated GAM RNA, also designated SEQ ID:319.

Another function of GAM5346 is therefore inhibition of Adp-ribosylation factor-like 6 interacting protein (ARL6IP, Accession NP__055976.1). Accordingly, utilities of GAM5346 include diagnosis, prevention and treatment of diseases and clinical conditions associated with ARL6IP.

Aryl-hydrocarbon receptor nuclear translocator 2 (ARNT2, Accession NP__055677.1) is another GAM5346 target gene, herein designated TARGET GENE. ARNT2 BINDING SITE is a target binding site found in the 3' untranslated region of mRNA encoded by ARNT2, corresponding to a target binding site such as BINDING SITE I, BINDING SITE II or BINDING SITE III of FIG. 8. Table 4 illustrates the complementarity of the nucleotide sequences of ARNT2 BINDING SITE, designated SEQ ID:12943, to the nucleotide sequence of GAM5346 RNA, herein designated GAM RNA, also designated SEQ ID:319.

Another function of GAM5346 is therefore inhibition of Aryl-hydrocarbon receptor nuclear translocator 2 (ARNT2, Accession NP__055677.1), a gene which specifically recognizes the xenobiotic response element (xre). Accordingly, utilities of GAM5346 include diagnosis, prevention and treatment of diseases and clinical conditions associated with ARNT2.

The function of ARNT2 and its association with various diseases and clinical conditions, has been established by previous studies, as described hereinabove with reference to GAM67.1. Alpha thalassemia/mental retardation syndrome x-linked (rad54 homolog, s. cerevisiae) (ATRX, Accession NP__612115.1) is another GAM5346 target gene, herein designated TARGET GENE. ATRX BINDING SITE is a target binding site found in the 5' untranslated region of multiple transcripts of mRNA encoded by ATRX, corresponding to a target binding site such as BINDING SITE I, BINDING SITE II or BINDING SITE III of FIG. 8. Table 4 illustrates the complementarity of the nucleotide sequences of ATRX BINDING SITE, designated SEQ ID:13943, to the nucleotide sequence of GAM5346 RNA, herein designated GAM RNA, also designated SEQ ID:319.

Another function of GAM5346 is therefore inhibition of Alpha thalassemia/mental retardation syndrome x-linked (rad54 homolog, s. cerevisiae) (ATRX, Accession NP__612115.1). Accordingly, utilities of GAM5346 include diagnosis, prevention and treatment of diseases and clinical conditions associated with ATRX.

Butyrophilin, subfamily 2, member a2 (BTN2A2, Accession NP__008926.2) is another GAM5346 target gene, herein designated TARGET GENE. BTN2A2 BINDING SITE is a target binding site found in the 3' untranslated region of mRNA encoded by BTN2A2, corresponding to a target binding site such as BINDING SITE I, BINDING SITE II or BINDING SITE III of FIG. 8. Table 4 illustrates the complementarity of the nucleotide sequences of BTN2A2 BINDING SITE, designated SEQ ID:2449, to the nucleotide sequence of GAM5346 RNA, herein designated GAM RNA, also designated SEQ ID:319.

Another function of GAM5346 is therefore inhibition of Butyrophilin, subfamily 2, member a2 (BTN2A2, Accession NP_008926.2). Accordingly, utilities of GAM5346 include diagnosis, prevention and treatment of diseases and clinical conditions associated with BTN2A2.

Blood vessel epicardial substance (BVES, Accession NP_009004.2) is another GAM5346 target gene, herein designated TARGET GENE. BVES BINDING SITE is a target binding site found in the 3' untranslated region of multiple transcripts of mRNA encoded by BVES, corresponding to a target binding site such as BINDING SITE I, BINDING SITE II or BINDING SITE III of FIG. 8. Table 4 illustrates the complementarity of the nucleotide sequences of BVES BINDING SITE, designated SEQ ID:7200, to the nucleotide sequence of GAM5346 RNA, herein designated GAM RNA, also designated SEQ ID:319.

Another function of GAM5346 is therefore inhibition of Blood vessel epicardial substance (BVES, Accession NP_009004.2), a gene which plays an important role in vertebrate heart development. Accordingly, utilities of GAM5346 include diagnosis, prevention and treatment of diseases and clinical conditions associated with BVES.

The function of BVES and its association with various diseases and clinical conditions, has been established by previous studies, as described hereinabove with reference to GAM180.1. Chromosome 1 open reading frame 17 (C1orf17, Accession NP_055916.1) is another GAM5346 target gene, herein designated TARGET GENE. C1orf17 BINDING SITE is a target binding site found in the 3' untranslated region of mRNA encoded by C1orf17, corresponding to a target binding site such as BINDING SITE I, BINDING SITE II or BINDING SITE III of FIG. 8. Table 4 illustrates the complementarity of the nucleotide sequences of C1orf17 BINDING SITE, designated SEQ ID:9464, to the nucleotide sequence of GAM5346 RNA, herein designated GAM RNA, also designated SEQ ID:319.

Another function of GAM5346 is therefore inhibition of Chromosome 1 open reading frame 17 (C1orf17, Accession NP_055916.1). Accordingly, utilities of GAM5346 include diagnosis, prevention and treatment of diseases and clinical conditions associated with C1orf17.

Chromosome 1 open reading frame 21 (C1orf21, Accession NP_110433.1) is another GAM5346 target gene, herein designated TARGET GENE. C1orf21 BINDING SITE is a target binding site found in the 3' untranslated region of mRNA encoded by C1orf21, corresponding to a target binding site such as BINDING SITE I, BINDING SITE II or BINDING SITE III of FIG. 8. Table 4 illustrates the complementarity of the nucleotide sequences of C1orf21 BINDING SITE, designated SEQ ID:2690, to the nucleotide sequence of GAM5346 RNA, herein designated GAM RNA, also designated SEQ ID:319.

Another function of GAM5346 is therefore inhibition of Chromosome 1 open reading frame 21 (C1orf21, Accession NP_110433.1). Accordingly, utilities of GAM5346 include diagnosis, prevention and treatment of diseases and clinical conditions associated with C1orf21.

C1QDC1 (Accession NP_115532.1) is another GAM5346 target gene, herein designated TARGET GENE. C1QDC1 BINDING SITE is a target binding site found in the 3' untranslated region of multiple transcripts of mRNA encoded by C1QDC1, corresponding to a target binding site such as BINDING SITE I, BINDING SITE II or BINDING SITE III of FIG. 8. Table 4 illustrates the complementarity of the nucleotide sequences of C1QDC1 BINDING SITE, designated SEQ ID:6143, to the nucleotide sequence of GAM5346 RNA, herein designated GAM RNA, also designated SEQ ID:319.

Another function of GAM5346 is therefore inhibition of C1QDC1 (Accession NP_115532.1). Accordingly, utilities of GAM5346 include diagnosis, prevention and treatment of diseases and clinical conditions associated with C1QDC1.

Chromosome 20 open reading frame 38 (C20orf38, Accession NP_060797.1) is another GAM5346 target gene, herein designated TARGET GENE. C20orf38 BINDING SITE is a target binding site found in the 3' untranslated region of mRNA encoded by C20orf38, corresponding to a target binding site such as BINDING SITE I, BINDING SITE II or BINDING SITE III of FIG. 8. Table 4 illustrates the complementarity of the nucleotide sequences of C20orf38 BINDING SITE, designated SEQ ID:9565, to the nucleotide sequence of GAM5346 RNA, herein designated GAM RNA, also designated SEQ ID:319.

Another function of GAM5346 is therefore inhibition of Chromosome 20 open reading frame 38 (C20orf38, Accession NP_060797.1). Accordingly, utilities of GAM5346 include diagnosis, prevention and treatment of diseases and clinical conditions associated with C20orf38.

Chromosome 21 open reading frame 109 (C21orf109, Accession NP_620418.1) is another GAM5346 target gene, herein designated TARGET GENE. C21orf109 BINDING SITE is a target binding site found in the 5' untranslated region of mRNA encoded by C21orf109, corresponding to a target binding site such as BINDING SITE I, BINDING SITE II or BINDING SITE III of FIG. 8. Table 4 illustrates the complementarity of the nucleotide sequences of C21orf109 BINDING SITE, designated SEQ ID:13650, to the nucleotide sequence of GAM5346 RNA, herein designated GAM RNA, also designated SEQ ID:319.

Another function of GAM5346 is therefore inhibition of Chromosome 21 open reading frame 109 (C21orf109, Accession NP_620418.1). Accordingly, utilities of GAM5346 include diagnosis, prevention and treatment of diseases and clinical conditions associated with C21orf109.

Chromosome 5 open reading frame 6 (C5orf6, Accession NP_057689.1) is another GAM5346 target gene, herein designated TARGET GENE. C5orf6 BINDING SITE is a target binding site found in the 5' untranslated region of mRNA encoded by C5orf6, corresponding to a target binding site such as BINDING SITE I, BINDING SITE II or BINDING SITE III of FIG. 8. Table 4 illustrates the complementarity of the nucleotide sequences of C5orf6 BINDING SITE, designated SEQ ID:4877, to the nucleotide sequence of GAM5346 RNA, herein designated GAM RNA, also designated SEQ ID:319.

Another function of GAM5346 is therefore inhibition of Chromosome 5 open reading frame 6 (C5orf6, Accession NP_057689.1). Accordingly, utilities of GAM5346 include diagnosis, prevention and treatment of diseases and clinical conditions associated with C5orf6.

Carbonic anhydrase viii (CA8, Accession NP_004047.3) is another GAM5346 target gene, herein designated TARGET GENE. CA8 BINDING SITE is a target binding site found in the 3' untranslated region of mRNA encoded by CA8, corresponding to a target binding site such as BINDING SITE I, BINDING SITE II or BINDING SITE III of FIG. 8. Table 4 illustrates the complementarity of the nucleotide sequences of CA8 BINDING SITE, designated SEQ ID:2246, to the nucleotide sequence of GAM5346 RNA, herein designated GAM RNA, also designated SEQ ID:319.

Another function of GAM5346 is therefore inhibition of Carbonic anhydrase viii (CA8, Accession NP_004047.3). Accordingly, utilities of GAM5346 include diagnosis, prevention and treatment of diseases and clinical conditions associated with CA8.

Calcium/calmodulin-dependent protein kinase (cam kinase) ii alpha (CAMK2A, Accession NP_057065.2) is another GAM5346 target gene, herein designated TARGET GENE. CAMK2A BINDING SITE is a target binding site found in the 3' untranslated region of multiple transcripts of mRNA encoded by CAMK2A, corresponding to a target binding site such as BINDING SITE I, BINDING SITE II or BINDING SITE III of FIG. 8. Table 4 illustrates the complementarity of the nucleotide sequences of CAMK2A BINDING SITE, designated SEQ ID:12760, to the nucleotide sequence of GAM5346 RNA, herein designated GAM RNA, also designated SEQ ID:319.

Another function of GAM5346 is therefore inhibition of Calcium/calmodulin-dependent protein kinase (cam kinase) ii alpha (CAMK2A, Accession NP_057065.2), a gene which may modulate the synaptic events required for the consolidation of memory traces in cortical networks. Accordingly, utilities of GAM5346 include diagnosis, prevention and treatment of diseases and clinical conditions associated with CAMK2A.

The function of CAMK2A and its association with various diseases and clinical conditions, has been established by previous studies, as described hereinabove with reference to GAM223.1. Calcium/calmodulin-dependent protein kinase (cam kinase) ii alpha (CAMK2A, Accession NP_741960.1) is another GAM5346 target gene, herein designated TARGET GENE. CAMK2A BINDING SITE is a target binding site found in the 3' untranslated region of multiple transcripts of mRNA encoded by CAMK2A, corresponding to a target binding site such as BINDING SITE I, BINDING SITE II or BINDING SITE III of FIG. 8. Table 4 illustrates the complementarity of the nucleotide sequences of CAMK2A BINDING SITE, designated SEQ ID:12760, to the nucleotide sequence of GAM5346 RNA, herein designated GAM RNA, also designated SEQ ID:319.

Another function of GAM5346 is therefore inhibition of Calcium/calmodulin-dependent protein kinase (cam kinase) ii alpha (CAMK2A, Accession NP_741960.1), a gene which may modulate the synaptic events required for the consolidation of memory traces in cortical networks. Accordingly, utilities of GAM5346 include diagnosis, prevention and treatment of diseases and clinical conditions associated with CAMK2A.

The function of CAMK2A and its association with various diseases and clinical conditions, has been established by previous studies, as described hereinabove with reference to GAM223.1. CARF (Accession NP_060102.1) is another GAM5346 target gene, herein designated TARGET GENE. CARF BINDING SITE is a target binding site found in the 3' untranslated region of mRNA encoded by CARF, corresponding to a target binding site such as BINDING SITE I, BINDING SITE II or BINDING SITE III of FIG. 8. Table 4 illustrates the complementarity of the nucleotide sequences of CARF BINDING SITE, designated SEQ ID:11378, to the nucleotide sequence of GAM5346 RNA, herein designated GAM RNA, also designated SEQ ID:319.

Another function of GAM5346 is therefore inhibition of CARF (Accession NP_060102.1). Accordingly, utilities of GAM5346 include diagnosis, prevention and treatment of diseases and clinical conditions associated with CARF.

Cat eye syndrome chromosome region, candidate 1 (CECR1, Accession NP_803124.1) is another GAM5346 target gene, herein designated TARGET GENE. CECR1 BINDING SITE is a target binding site found in the 5' untranslated region of multiple transcripts of mRNA encoded by CECR1, corresponding to a target binding site such as BINDING SITE I, BINDING SITE II or BINDING SITE III of FIG. 8. Table 4 illustrates the complementarity of the nucleotide sequences of CECR1 BINDING SITE, designated SEQ ID:12603, to the nucleotide sequence of GAM5346 RNA, herein designated GAM RNA, also designated SEQ ID:319.

Another function of GAM5346 is therefore inhibition of Cat eye syndrome chromosome region, candidate 1 (CECR1, Accession NP_803124.1). Accordingly, utilities of GAM5346 include diagnosis, prevention and treatment of diseases and clinical conditions associated with CECR1.

CGI-141 (Accession NP_057156.1) is another GAM5346 target gene, herein designated TARGET GENE. CGI-141 BINDING SITE is a target binding site found in the 3' untranslated region of mRNA encoded by CGI-141, corresponding to a target binding site such as BINDING SITE I, BINDING SITE II or BINDING SITE III of FIG. 8. Table 4 illustrates the complementarity of the nucleotide sequences of CGI-141 BINDING SITE, designated SEQ ID:6784, to the nucleotide sequence of GAM5346 RNA, herein designated GAM RNA, also designated SEQ ID:319.

Another function of GAM5346 is therefore inhibition of CGI-141 (Accession NP_057156.1). Accordingly, utilities of GAM5346 include diagnosis, prevention and treatment of diseases and clinical conditions associated with CGI-141.

Chondrolectin (CHODL, Accession NP_079220.2) is another GAM5346 target gene, herein designated TARGET GENE. CHODL BINDING SITE is a target binding site found in the 3' untranslated region of mRNA encoded by CHODL, corresponding to a target binding site such as BINDING SITE I, BINDING SITE II or BINDING SITE III of FIG. 8. Table 4 illustrates the complementarity of the nucleotide sequences of CHODL BINDING SITE, designated SEQ ID:3700, to the nucleotide sequence of GAM5346 RNA, herein designated GAM RNA, also designated SEQ ID:319.

Another function of GAM5346 is therefore inhibition of Chondrolectin (CHODL, Accession NP_079220.2). Accordingly, utilities of GAM5346 include diagnosis, prevention and treatment of diseases and clinical conditions associated with CHODL.

Cholinergic receptor, nicotinic, alpha polypeptide 3 (CHRNA3, Accession NP_000734.2) is another GAM5346 target gene, herein designated TARGET GENE. CHRNA3 BINDING SITE is a target binding site found in the 3' untranslated region of mRNA encoded by CHRNA3, corresponding to a target binding site such as BINDING SITE I, BINDING SITE II or BINDING SITE III of FIG. 8. Table 4 illustrates the complementarity of the nucleotide sequences of CHRNA3 BINDING SITE, designated SEQ ID:15387, to the nucleotide sequence of GAM5346 RNA, herein designated GAM RNA, also designated SEQ ID:319.

Another function of GAM5346 is therefore inhibition of Cholinergic receptor, nicotinic, alpha polypeptide 3 (CHRNA3, Accession NP_000734.2), a gene which binds acetylcholine and opens an ion-conducting channel across the plasma membrane. and therefore may be associated with Myasthenia gravis. Accordingly, utilities of GAM5346 include diagnosis, prevention and treatment of Myasthenia gravis, and of other diseases and clinical conditions associated with CHRNA3.

The function of CHRNA3 and its association with various diseases and clinical conditions, has been established by previous studies, as described hereinabove with reference to GAM404.2. CHST10 (Accession NP_004845.1) is another GAM5346 target gene, herein designated TARGET GENE. CHST10 BINDING SITE is a target binding site found in the 3' untranslated region of mRNA encoded by CHST10, corresponding to a target binding site such as BINDING SITE I, BINDING SITE II or BINDING SITE III of FIG. 8. Table 4 illustrates the complementarity of the nucleotide sequences of CHST10 BINDING SITE, designated SEQ ID:14727, to the nucleotide sequence of GAM5346 RNA, herein designated GAM RNA, also designated SEQ ID:319.

Another function of GAM5346 is therefore inhibition of CHST10 (Accession NP_004845.1). Accordingly, utilities of GAM5346 include diagnosis, prevention and treatment of diseases and clinical conditions associated with CHST10.

Clock homolog (mouse) (CLOCK, Accession NP_004889.1) is another GAM5346 target gene, herein designated TARGET GENE. CLOCK BINDING SITE is a target binding site found in the 3' untranslated region of mRNA encoded by CLOCK, corresponding to a target binding site such as BINDING SITE I, BINDING SITE II or BINDING SITE III of FIG. 8. Table 4 illustrates the complementarity of the nucleotide sequences of CLOCK BINDING SITE, designated SEQ ID:6844, to the nucleotide sequence of GAM5346 RNA, herein designated GAM RNA, also designated SEQ ID:319.

Another function of GAM5346 is therefore inhibition of Clock homolog (mouse) (CLOCK, Accession NP_004889.1). Accordingly, utilities of GAM5346 include diagnosis, prevention and treatment of diseases and clinical conditions associated with CLOCK.

Ccr4-not transcription complex, subunit 7 (CNOT7, Accession NP_473367.1) is another GAM5346 target gene, herein designated TARGET GENE. CNOT7 BINDING SITE is a target binding site found in the 3' untranslated region of multiple transcripts of mRNA encoded by CNOT7, corresponding to a target binding site such as BINDING SITE I, BINDING SITE II or BINDING SITE III of FIG. 8. Table 4 illustrates the complementarity of the nucleotide sequences of CNOT7 BINDING SITE, designated SEQ ID:12054, to the nucleotide sequence of GAM5346 RNA, herein designated GAM RNA, also designated SEQ ID:319.

Another function of GAM5346 is therefore inhibition of Ccr4-not transcription complex, subunit 7 (CNOT7, Accession NP_473367.1). Accordingly, utilities of GAM5346 include diagnosis, prevention and treatment of diseases and clinical conditions associated with CNOT7.

Collagen, type iv, alpha 3 (goodpasture antigen) binding protein (COL4A3BP, Accession NP_112729.1) is another GAM5346 target gene, herein designated TARGET GENE. COL4A3BP BINDING SITE is a target binding site found in the 5' untranslated region of multiple transcripts of mRNA encoded by COL4A3BP, corresponding to a target binding site such as BINDING SITE I, BINDING SITE II or BINDING SITE III of FIG. 8. Table 4 illustrates the complementarity of the nucleotide sequences of COL4A3BP BINDING SITE, designated SEQ ID:13701, to the nucleotide sequence of GAM5346 RNA, herein designated GAM RNA, also designated SEQ ID:319.

Another function of GAM5346 is therefore inhibition of Collagen, type iv, alpha 3 (goodpasture antigen) binding protein (COL4A3BP, Accession NP_112729.1). Accordingly, utilities of GAM5346 include diagnosis, prevention and treatment of diseases and clinical conditions associated with COL4A3BP.

Collagen, type iv, alpha 3 (goodpasture antigen) binding protein (COL4A3BP, Accession NP_005704.1) is another GAM5346 target gene, herein designated TARGET GENE. COL4A3BP BINDING SITE is a target binding site found in the 5' untranslated region of multiple transcripts of mRNA encoded by COL4A3BP, corresponding to a target binding site such as BINDING SITE I, BINDING SITE II or BINDING SITE III of FIG. 8. Table 4 illustrates the complementarity of the nucleotide sequences of COL4A3BP BINDING SITE, designated SEQ ID:13701, to the nucleotide sequence of GAM5346 RNA, herein designated GAM RNA, also designated SEQ ID:319.

Another function of GAM5346 is therefore inhibition of Collagen, type iv, alpha 3 (goodpasture antigen) binding protein (COL4A3BP, Accession NP_005704.1). Accordingly, utilities of GAM5346 include diagnosis, prevention and treatment of diseases and clinical conditions associated with COL4A3BP.

Collectin sub-family member 12 (COLEC12, Accession NP_110408.2) is another GAM5346 target gene, herein designated TARGET GENE. COLEC12 BINDING SITE is a target binding site found in the 3' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:1211, to the nucleotide sequence of GAM5346 RNA, herein designated GAM RNA, also designated SEQ ID:319.

Another function of GAM5346 is therefore inhibition of Collectin sub-family member 12 (COLEC12, Accession NP_110408.2). Accordingly, utilities of GAM5346 include diagnosis, prevention and treatment of diseases and clinical conditions associated with COLEC12.

Cytochrome c oxidase subunit vb (COX5B, Accession NP_001853.2) is another GAM5346 target gene, herein designated TARGET GENE. COX5B BINDING SITE is a target binding site found in the 5' untranslated region of mRNA encoded by COX5B, corresponding to a target binding site such as BINDING SITE I, BINDING SITE II or BINDING SITE III of FIG. 8. Table 4 illustrates the complementarity of the nucleotide sequences of COX5B BINDING SITE, designated SEQ ID:15248, to the nucleotide sequence of GAM5346 RNA, herein designated GAM RNA, also designated SEQ ID:319.

Another function of GAM5346 is therefore inhibition of Cytochrome c oxidase subunit vb (COX5B, Accession NP_001853.2). Accordingly, utilities of GAM5346 include diagnosis, prevention and treatment of diseases and clinical conditions associated with COX5B.

Cytochrome c oxidase subunit viia polypeptide 2 like (COX7A2L, Accession NP_004709.2) is another GAM5346 target gene, herein designated TARGET GENE. COX7A2L BINDING SITE is a target binding site found in the 3' untranslated region of mRNA encoded by COX7A2L, corresponding to a target binding site such as BINDING SITE I, BINDING SITE II or BINDING SITE III of FIG. 8. Table 4 illustrates the complementarity of the nucleotide sequences of COX7A2L BINDING SITE, designated SEQ ID:14171, to the nucleotide sequence of GAM5346 RNA, herein designated GAM RNA, also designated SEQ ID:319.

Another function of GAM5346 is therefore inhibition of Cytochrome c oxidase subunit viia polypeptide 2 like (COX7A2L, Accession NP_004709.2). Accordingly, utilities of GAM5346 include diagnosis, prevention and treatment of diseases and clinical conditions associated with COX7A2L.

Cofactor required for sp1 transcriptional activation, subunit 3, 130 kda (CRSP3, Accession NP_004821.2) is another GAM5346 target gene, herein designated TARGET GENE.

CRSP3 BINDING SITE is a target binding site found in the 3' untranslated region of multiple transcripts of mRNA encoded by CRSP3, corresponding to a target binding site such as BINDING SITE I, BINDING SITE II or BINDING SITE III of FIG. 8. Table 4 illustrates the complementarity of the nucleotide sequences of CRSP3 BINDING SITE, designated SEQ ID:19755, to the nucleotide sequence of GAM5346 RNA, herein designated GAM RNA, also designated SEQ ID:319.

Another function of GAM5346 is therefore inhibition of Cofactor required for sp1 transcriptional activation, subunit 3, 130 kda (CRSP3, Accession NP_004821.2). Accordingly, utilities of GAM5346 include diagnosis, prevention and treatment of diseases and clinical conditions associated with CRSP3.

Crystallin, lambda 1 (CRYL1, Accession NP_057058.1) is another GAM5346 target gene, herein designated TARGET GENE. CRYL1 BINDING SITE is a target binding site found in the 5' untranslated region of mRNA encoded by CRYL1, corresponding to a target binding site such as BINDING SITE I, BINDING SITE II or BINDING SITE III of FIG. 8. Table 4 illustrates the complementarity of the nucleotide sequences of CRYL1 BINDING SITE, designated SEQ ID:18424, to the nucleotide sequence of GAM5346 RNA, herein designated GAM RNA, also designated SEQ ID:319.

Another function of GAM5346 is therefore inhibition of Crystallin, lambda 1 (CRYL1, Accession NP_057058.1). Accordingly, utilities of GAM5346 include diagnosis, prevention and treatment of diseases and clinical conditions associated with CRYL1.

Dead/h (asp-glu-ala-asp/his) box polypeptide 11 (chl1-like helicase homolog, s. cerevisiae) (DDX11, Accession NP_085911.1) is another GAM5346 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:13852, to the nucleotide sequence of GAM5346 RNA, herein designated GAM RNA, also designated SEQ ID:319.

Another function of GAM5346 is therefore inhibition of Dead/h (asp-glu-ala-asp/his) box polypeptide 11 (chl1-like helicase homolog, s. cerevisiae) (DDX11, Accession NP_085911.1), a gene which could be an ATP-dependent DNA-binding helicase and may intervene in cell cycle regulation. Accordingly, utilities of GAM5346 include diagnosis, prevention and treatment of diseases and clinical conditions associated with DDX11.

The function of DDX11 and its association with various diseases and clinical conditions, has been established by previous studies, as described hereinabove with reference to GAM63.1. Dead/h (asp-glu-ala-asp/his) box polypeptide 11 (chl1-like helicase homolog, s. cerevisiae) (DDX11, Accession NP_004390.2) is another GAM5346 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:13852, to the nucleotide sequence of GAM5346 RNA, herein designated GAM RNA, also designated SEQ ID:319.

Another function of GAM5346 is therefore inhibition of Dead/h (asp-glu-ala-asp/his) box polypeptide 11 (chl1-like helicase homolog, s. cerevisiae) (DDX11, Accession NP_004390.2), a gene which could be an ATP-dependent DNA-binding helicase and may intervene in cell cycle regulation. Accordingly, utilities of GAM5346 include diagnosis, prevention and treatment of diseases and clinical conditions associated with DDX11.

The function of DDX11 and its association with various diseases and clinical conditions, has been established by previous studies, as described hereinabove with reference to GAM63.1. Dead/h (asp-glu-ala-asp/his) box polypeptide 11 (chl1-like helicase homolog, s. cerevisiae) (DDX11, Accession NP_085913.1) is another GAM5346 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:13852, to the nucleotide sequence of GAM5346 RNA, herein designated GAM RNA, also designated SEQ ID:319.

Another function of GAM5346 is therefore inhibition of Dead/h (asp-glu-ala-asp/his) box polypeptide 11 (chl1-like helicase homolog, s. cerevisiae) (DDX11, Accession NP_085913.1), a gene which could be an ATP-dependent DNA-binding helicase and may intervene in cell cycle regulation. Accordingly, utilities of GAM5346 include diagnosis, prevention and treatment of diseases and clinical conditions associated with DDX11.

The function of DDX11 and its association with various diseases and clinical conditions, has been established by previous studies, as described hereinabove with reference to GAM63.1. DDX56 (Accession NP_061955.1) is another GAM5346 target gene, herein designated TARGET GENE. DDX56 BINDING SITE is a target binding site found in the 3' untranslated region of mRNA encoded by DDX56, corresponding to a target binding site such as BINDING SITE I, BINDING SITE II or BINDING SITE III of FIG. 8. Table 4 illustrates the complementarity of the nucleotide sequences of DDX56 BINDING SITE, designated SEQ ID:13267, to the nucleotide sequence of GAM5346 RNA, herein designated GAM RNA, also designated SEQ ID:319.

Another function of GAM5346 is therefore inhibition of DDX56 (Accession NP_061955.1). Accordingly, utilities of GAM5346 include diagnosis, prevention and treatment of diseases and clinical conditions associated with DDX56.

DKFZp434E1119 (Accession XP_210937.1) is another GAM5346 target gene, herein designated TARGET GENE. DKFZp434E1119 BINDING SITE is a target binding site found in the 3' untranslated region of mRNA encoded by DKFZp434E1119, corresponding to a target binding site such as BINDING SITE I, BINDING SITE II or BINDING SITE III of FIG. 8. Table 4 illustrates the complementarity of the nucleotide sequences of DKFZp434E1119 BINDING SITE, designated SEQ ID:3872, to the nucleotide sequence of GAM5346 RNA, herein designated GAM RNA, also designated SEQ ID:319.

Another function of GAM5346 is therefore inhibition of DKFZp434E1119 (Accession XP_210937.1). Accordingly, utilities of GAM5346 include diagnosis, prevention and treatment of diseases and clinical conditions associated with DKFZp434E1119.

DKFZP564D166 (Accession NP_056438.1) is another GAM5346 target gene, herein designated TARGET GENE. DKFZP564D166 BINDING SITE is a target binding site found in the 3' untranslated region of multiple transcripts of mRNA encoded by DKFZP564D166, corresponding to a target binding site such as BINDING SITE I, BINDING SITE II or BINDING SITE III of FIG. 8. Table 4 illustrates the complementarity of the nucleotide sequences of DKFZP564D166 BINDING SITE, designated SEQ ID:14703, to the nucleotide sequence of GAM5346 RNA, herein designated GAM RNA, also designated SEQ ID:319.

Another function of GAM5346 is therefore inhibition of DKFZP564D166 (Accession NP_056438.1). Accordingly, utilities of GAM5346 include diagnosis, prevention and treatment of diseases and clinical conditions associated with DKFZP564D166.

DKFZp761O17121 (Accession NP_115663.1) is another GAM5346 target gene, herein designated TARGET GENE. DKFZp761O17121 BINDING SITE is a target binding site found in the 5' untranslated region of mRNA encoded by DKFZp761O17121, corresponding to a target binding site such as BINDING SITE I, BINDING SITE II or BINDING SITE III of FIG. 8. Table 4 illustrates the complementarity of the nucleotide sequences of DKFZp761O17121 BINDING SITE, designated SEQ ID:15142, to the nucleotide sequence of GAM5346 RNA, herein designated GAM RNA, also designated SEQ ID:319.

Another function of GAM5346 is therefore inhibition of DKFZp761O17121 (Accession NP_115663.1). Accordingly, utilities of GAM5346 include diagnosis, prevention and treatment of diseases and clinical conditions associated with DKFZp761O17121.

Doublesex and mab-3 related transcription factor 1 (DMRT1, Accession NP_068770.1) is another GAM5346 target gene, herein designated TARGET GENE. DMRT1 BINDING SITE is a target binding site found in the 3' untranslated region of mRNA encoded by DMRT1, corresponding to a target binding site such as BINDING SITE I, BINDING SITE II or BINDING SITE III of FIG. 8. Table 4 illustrates the complementarity of the nucleotide sequences of DMRT1 BINDING SITE, designated SEQ ID:12585, to the nucleotide sequence of GAM5346 RNA, herein designated GAM RNA, also designated SEQ ID:319.

Another function of GAM5346 is therefore inhibition of Doublesex and mab-3 related transcription factor 1 (DMRT1, Accession NP_068770.1), a gene which May be involved in male sexual development. Accordingly, utilities of GAM5346 include diagnosis, prevention and treatment of diseases and clinical conditions associated with DMRT1.

The function of DMRT1 and its association with various diseases and clinical conditions, has been established by previous studies, as described hereinabove with reference to GAM505.1. Eukaryotic translation elongation factor 1 delta (guanine nucleotide exchange protein) (EEF1D, Accession NP_001951.2) is another GAM5346 target gene, herein designated TARGET GENE. EEF1D BINDING SITE is a target binding site found in the 5' untranslated region of multiple transcripts of mRNA encoded by EEF1D, corresponding to a target binding site such as BINDING SITE I, BINDING SITE II or BINDING SITE III of FIG. 8. Table 4 illustrates the complementarity of the nucleotide sequences of EEF1D BINDING SITE, designated SEQ ID:10991, to the nucleotide sequence of GAM5346 RNA, herein designated GAM RNA, also designated SEQ ID:319.

Another function of GAM5346 is therefore inhibition of Eukaryotic translation elongation factor 1 delta (guanine nucleotide exchange protein) (EEF1D, Accession NP_001951.2). Accordingly, utilities of GAM5346 include diagnosis, prevention and treatment of diseases and clinical conditions associated with EEF1D.

Eukaryotic translation initiation factor 4e-like 3 (EIF4EL3, Accession NP_004837.1) is another GAM5346 target gene, herein designated TARGET GENE. EIF4EL3 BINDING SITE is a target binding site found in the 5' untranslated region of mRNA encoded by EIF4EL3, corresponding to a target binding site such as BINDING SITE I, BINDING SITE II or BINDING SITE III of FIG. 8. Table 4 illustrates the complementarity of the nucleotide sequences of EIF4EL3 BINDING SITE, designated SEQ ID:14958, to the nucleotide sequence of GAM5346 RNA, herein designated GAM RNA, also designated SEQ ID:319.

Another function of GAM5346 is therefore inhibition of Eukaryotic translation initiation factor 4e-like 3 (EIF4EL3, Accession NP_004837.1), a gene which is a cap-binding protein. Accordingly, utilities of GAM5346 include diagnosis, prevention and treatment of diseases and clinical conditions associated with EIF4EL3.

The function of EIF4EL3 and its association with various diseases and clinical conditions, has been established by previous studies, as described hereinabove with reference to GAM1713.2. FLJ10204 (Accession NP_060494.1) is another GAM5346 target gene, herein designated TARGET GENE. FLJ10204 BINDING SITE is a target binding site found in the 3' untranslated region of mRNA encoded by FLJ10204, corresponding to a target binding site such as BINDING SITE I, BINDING SITE II or BINDING SITE III of FIG. 8. Table 4 illustrates the complementarity of the nucleotide sequences of FLJ10204 BINDING SITE, designated SEQ ID:19088, to the nucleotide sequence of GAM5346 RNA, herein designated GAM RNA, also designated SEQ ID:319.

Another function of GAM5346 is therefore inhibition of FLJ10204 (Accession NP_060494.1). Accordingly, utilities of GAM5346 include diagnosis, prevention and treatment of diseases and clinical conditions associated with FLJ10204.

FLJ11267 (Accession NP_062553.1) is another GAM5346 target gene, herein designated TARGET GENE. FLJ11267 BINDING SITE is a target binding site found in the 3' untranslated region of mRNA encoded by FLJ11267, corresponding to a target binding site such as BINDING SITE I, BINDING SITE II or BINDING SITE III of FIG. 8. Table 4 illustrates the complementarity of the nucleotide sequences of FLJ11267 BINDING SITE, designated SEQ ID:5853, to the nucleotide sequence of GAM5346 RNA, herein designated GAM RNA, also designated SEQ ID:319.

Another function of GAM5346 is therefore inhibition of FLJ11267 (Accession NP_062553.1). Accordingly, utilities of GAM5346 include diagnosis, prevention and treatment of diseases and clinical conditions associated with FLJ11267.

FLJ11724 (Accession XP_044426.1) is another GAM5346 target gene, herein designated TARGET GENE. FLJ11724 BINDING SITE is a target binding site found in the 3' untranslated region of mRNA encoded by FLJ11724, corresponding to a target binding site such as BINDING SITE I, BINDING SITE II or BINDING SITE III of FIG. 8. Table 4 illustrates the complementarity of the nucleotide sequences of FLJ11724 BINDING SITE, designated SEQ ID:11865, to the nucleotide sequence of GAM5346 RNA, herein designated GAM RNA, also designated SEQ ID:319.

Another function of GAM5346 is therefore inhibition of FLJ11724 (Accession XP_044426.1). Accordingly, utilities of GAM5346 include diagnosis, prevention and treatment of diseases and clinical conditions associated with FLJ11724.

FLJ11806 (Accession NP_079100.1) is another GAM5346 target gene, herein designated TARGET GENE. FLJ11806 BINDING SITE is a target binding site found in the 5' untranslated region of mRNA encoded by FLJ11806, corresponding to a target binding site such as BINDING SITE I, BINDING SITE II or BINDING SITE III of FIG. 8. Table 4 illustrates the complementarity of the nucleotide sequences of FLJ11806 BINDING SITE, designated SEQ ID:12794, to the nucleotide sequence of GAM5346 RNA, herein designated GAM RNA, also designated SEQ ID:319.

Another function of GAM5346 is therefore inhibition of FLJ11806 (Accession NP_079100.1). Accordingly, utilities of GAM5346 include diagnosis, prevention and treatment of diseases and clinical conditions associated with FLJ11806.

FLJ12294 (Accession NP_079376.1) is another GAM5346 target gene, herein designated TARGET GENE. FLJ12294 BINDING SITE is a target binding site found in the 3' untranslated region of mRNA encoded by FLJ12294, corresponding to a target binding site such as BINDING SITE I, BINDING SITE II or BINDING SITE III of FIG. 8. Table 4 illustrates the complementarity of the nucleotide sequences of FLJ12294 BINDING SITE, designated SEQ ID:7539, to the nucleotide sequence of GAM5346 RNA, herein designated GAM RNA, also designated SEQ ID:319.

Another function of GAM5346 is therefore inhibition of FLJ12294 (Accession NP_079376.1). Accordingly, utilities of GAM5346 include diagnosis, prevention and treatment of diseases and clinical conditions associated with FLJ12294.

FLJ12891 (Accession NP_079226.1) is another GAM5346 target gene, herein designated TARGET GENE. FLJ12891 BINDING SITE is a target binding site found in the 3' untranslated region of mRNA encoded by FLJ12891, corresponding to a target binding site such as BINDING SITE I, BINDING SITE II or BINDING SITE III of FIG. 8. Table 4 illustrates the complementarity of the nucleotide sequences of FLJ12891 BINDING SITE, designated SEQ ID:2301, to the nucleotide sequence of GAM5346 RNA, herein designated GAM RNA, also designated SEQ ID:319.

Another function of GAM5346 is therefore inhibition of FLJ12891 (Accession NP_079226.1). Accordingly, utilities of GAM5346 include diagnosis, prevention and treatment of diseases and clinical conditions associated with FLJ12891.

FLJ14001 (Accession NP_078953.2) is another GAM5346 target gene, herein designated TARGET GENE. FLJ14001 BINDING SITE is a target binding site found in the 3' untranslated region of mRNA encoded by FLJ14001, corresponding to a target binding site such as BINDING SITE I, BINDING SITE II or BINDING SITE III of FIG. 8. Table 4 illustrates the complementarity of the nucleotide sequences of FLJ14001 BINDING SITE, designated SEQ ID:9178, to the nucleotide sequence of GAM5346 RNA, herein designated GAM RNA, also designated SEQ ID:319.

Another function of GAM5346 is therefore inhibition of FLJ14001 (Accession NP_078953.2). Accordingly, utilities of GAM5346 include diagnosis, prevention and treatment of diseases and clinical conditions associated with FLJ14001.

FLJ14816 (Accession NP_116234.1) is another GAM5346 target gene, herein designated TARGET GENE. FLJ14816 BINDING SITE is a target binding site found in the 3' untranslated region of mRNA encoded by FLJ14816, corresponding to a target binding site such as BINDING SITE I, BINDING SITE II or BINDING SITE III of FIG. 8. Table 4 illustrates the complementarity of the nucleotide sequences of FLJ14816 BINDING SITE, designated SEQ ID:10584, to the nucleotide sequence of GAM5346 RNA, herein designated GAM RNA, also designated SEQ ID:319.

Another function of GAM5346 is therefore inhibition of FLJ14816 (Accession NP_116234.1). Accordingly, utilities of GAM5346 include diagnosis, prevention and treatment of diseases and clinical conditions associated with FLJ14816.

FLJ20209 (Accession XP_098142.1) is another GAM5346 target gene, herein designated TARGET GENE. FLJ20209 BINDING SITE is a target binding site found in the 3' untranslated region of mRNA encoded by FLJ20209, corresponding to a target binding site such as BINDING SITE I, BINDING SITE II or BINDING SITE III of FIG. 8. Table 4 illustrates the complementarity of the nucleotide sequences of FLJ20209 BINDING SITE, designated SEQ ID:2433, to the nucleotide sequence of GAM5346 RNA, herein designated GAM RNA, also designated SEQ ID:319.

Another function of GAM5346 is therefore inhibition of FLJ20209 (Accession XP_098142.1). Accordingly, utilities of GAM5346 include diagnosis, prevention and treatment of diseases and clinical conditions associated with FLJ20209.

FLJ20300 (Accession NP_060223.1) is another GAM5346 target gene, herein designated TARGET GENE. FLJ20300 BINDING SITE is a target binding site found in the 3' untranslated region of mRNA encoded by FLJ20300, corresponding to a target binding site such as BINDING SITE I, BINDING SITE II or BINDING SITE III of FIG. 8. Table 4 illustrates the complementarity of the nucleotide sequences of FLJ20300 BINDING SITE, designated SEQ ID:6291, to the nucleotide sequence of GAM5346 RNA, herein designated GAM RNA, also designated SEQ ID:319.

Another function of GAM5346 is therefore inhibition of FLJ20300 (Accession NP_060223.1). Accordingly, utilities of GAM5346 include diagnosis, prevention and treatment of diseases and clinical conditions associated with FLJ20300.

FLJ21272 (Accession NP_079308.1) is another GAM5346 target gene, herein designated TARGET GENE. FLJ21272 BINDING SITE is a target binding site found in the 3' untranslated region of mRNA encoded by FLJ21272, corresponding to a target binding site such as BINDING SITE I, BINDING SITE II or BINDING SITE III of FIG. 8. Table 4 illustrates the complementarity of the nucleotide sequences of FLJ21272 BINDING SITE, designated SEQ ID:15440, to the nucleotide sequence of GAM5346 RNA, herein designated GAM RNA, also designated SEQ ID:319.

Another function of GAM5346 is therefore inhibition of FLJ21272 (Accession NP_079308.1). Accordingly, utilities of GAM5346 include diagnosis, prevention and treatment of diseases and clinical conditions associated with FLJ21272.

FLJ23259 (Accession NP_079003.1) is another GAM5346 target gene, herein designated TARGET GENE. FLJ23259 BINDING SITE is a target binding site found in the 5' untranslated region of mRNA encoded by FLJ23259, corresponding to a target binding site such as BINDING SITE I, BINDING SITE II or BINDING SITE III of FIG. 8. Table 4 illustrates the complementarity of the nucleotide sequences of FLJ23259 BINDING SITE, designated SEQ ID:19128, to the nucleotide sequence of GAM5346 RNA, herein designated GAM RNA, also designated SEQ ID:319.

Another function of GAM5346 is therefore inhibition of FLJ23259 (Accession NP_079003.1). Accordingly, utilities of GAM5346 include diagnosis, prevention and treatment of diseases and clinical conditions associated with FLJ23259.

FLJ23861 (Accession NP_689732.1) is another GAM5346 target gene, herein designated TARGET GENE. FLJ23861 BINDING SITE is a target binding site found in the 5' untranslated region of mRNA encoded by FLJ23861, corresponding to a target binding site such as BINDING SITE I, BINDING SITE II or BINDING SITE III of FIG. 8. Table 4 illustrates the complementarity of the nucleotide sequences of FLJ23861 BINDING SITE, designated SEQ ID:11394, to the nucleotide sequence of GAM5346 RNA, herein designated GAM RNA, also designated SEQ ID:319.

Another function of GAM5346 is therefore inhibition of FLJ23861 (Accession NP_689732.1). Accordingly, utilities of GAM5346 include diagnosis, prevention and treatment of diseases and clinical conditions associated with FLJ23861.

FLJ25359 (Accession NP_653188.1) is another GAM5346 target gene, herein designated TARGET GENE. FLJ25359 BINDING SITE is a target binding site found in the 5' untranslated region of mRNA encoded by FLJ25359, corresponding to a target binding site such as BINDING SITE I, BINDING SITE II or BINDING SITE III of FIG. 8. Table 4 illustrates the complementarity of the nucleotide sequences of FLJ25359 BINDING SITE, designated SEQ ID:16387, to the nucleotide sequence of GAM5346 RNA, herein designated GAM RNA, also designated SEQ ID:319.

Another function of GAM5346 is therefore inhibition of FLJ25359 (Accession NP_653188.1). Accordingly, utilities of GAM5346 include diagnosis, prevention and treatment of diseases and clinical conditions associated with FLJ25359.

FLJ32028 (Accession NP_689893.1) is another GAM5346 target gene, herein designated TARGET GENE. FLJ32028 BINDING SITE is a target binding site found in the 3' untranslated region of mRNA encoded by FLJ32028, corresponding to a target binding site such as BINDING SITE I, BINDING SITE II or BINDING SITE III of FIG. 8. Table 4 illustrates the complementarity of the nucleotide sequences of FLJ32028 BINDING SITE, designated SEQ ID:5186, to the nucleotide sequence of GAM5346 RNA, herein designated GAM RNA, also designated SEQ ID:319.

Another function of GAM5346 is therefore inhibition of FLJ32028 (Accession NP_689893.1). Accordingly, utilities of GAM5346 include diagnosis, prevention and treatment of diseases and clinical conditions associated with FLJ32028.

FLJ32940 (Accession NP_653220.1) is another GAM5346 target gene, herein designated TARGET GENE. FLJ32940 BINDING SITE is a target binding site found in the 5' untranslated region of mRNA encoded by FLJ32940, corresponding to a target binding site such as BINDING SITE I, BINDING SITE II or BINDING SITE III of FIG. 8. Table 4 illustrates the complementarity of the nucleotide sequences of FLJ32940 BINDING SITE, designated SEQ ID:9834, to the nucleotide sequence of GAM5346 RNA, herein designated GAM RNA, also designated SEQ ID:319.

Another function of GAM5346 is therefore inhibition of FLJ32940 (Accession NP_653220.1). Accordingly, utilities of GAM5346 include diagnosis, prevention and treatment of diseases and clinical conditions associated with FLJ32940.

FLJ35728 (Accession NP_689823.1) is another GAM5346 target gene, herein designated TARGET GENE. FLJ35728 BINDING SITE is a target binding site found in the 5' untranslated region of mRNA encoded by FLJ35728, corresponding to a target binding site such as BINDING SITE I, BINDING SITE II or BINDING SITE III of FIG. 8. Table 4 illustrates the complementarity of the nucleotide sequences of FLJ35728 BINDING SITE, designated SEQ ID:14579, to the nucleotide sequence of GAM5346 RNA, herein designated GAM RNA, also designated SEQ ID:319.

Another function of GAM5346 is therefore inhibition of FLJ35728 (Accession NP_689823.1). Accordingly, utilities of GAM5346 include diagnosis, prevention and treatment of diseases and clinical conditions associated with FLJ35728.

FLJ35801 (Accession NP_694589.1) is another GAM5346 target gene, herein designated TARGET GENE. FLJ35801 BINDING SITE is a target binding site found in the 5' untranslated region of mRNA encoded by FLJ35801, corresponding to a target binding site such as BINDING SITE I, BINDING SITE II or BINDING SITE III of FIG. 8. Table 4 illustrates the complementarity of the nucleotide sequences of FLJ35801 BINDING SITE, designated SEQ ID:3807, to the nucleotide sequence of GAM5346 RNA, herein designated GAM RNA, also designated SEQ ID:319.

Another function of GAM5346 is therefore inhibition of FLJ35801 (Accession NP_694589.1). Accordingly, utilities of GAM5346 include diagnosis, prevention and treatment of diseases and clinical conditions associated with FLJ35801.

FLJ36576 (Accession NP_775793.1) is another GAM5346 target gene, herein designated TARGET GENE. FLJ36576 BINDING SITE is a target binding site found in the 3' untranslated region of mRNA encoded by FLJ36576, corresponding to a target binding site such as BINDING SITE I, BINDING SITE II or BINDING SITE III of FIG. 8. Table 4 illustrates the complementarity of the nucleotide sequences of FLJ36576 BINDING SITE, designated SEQ ID:11409, to the nucleotide sequence of GAM5346 RNA, herein designated GAM RNA, also designated SEQ ID:319.

Another function of GAM5346 is therefore inhibition of FLJ36576 (Accession NP_775793.1). Accordingly, utilities of GAM5346 include diagnosis, prevention and treatment of diseases and clinical conditions associated with FLJ36576.

FLJ37228 (Accession NP_787113.1) is another GAM5346 target gene, herein designated TARGET GENE. FLJ37228 BINDING SITE is a target binding site found in the 3' untranslated region of mRNA encoded by FLJ37228, corresponding to a target binding site such as BINDING SITE I, BINDING SITE II or BINDING SITE III of FIG. 8. Table 4 illustrates the complementarity of the nucleotide sequences of FLJ37228 BINDING SITE, designated SEQ ID:11241, to the nucleotide sequence of GAM5346 RNA, herein designated GAM RNA, also designated SEQ ID:319.

Another function of GAM5346 is therefore inhibition of FLJ37228 (Accession NP_787113.1). Accordingly, utilities of GAM5346 include diagnosis, prevention and treatment of diseases and clinical conditions associated with FLJ37228.

FLJ37307 (Accession NP_848610.1) is another GAM5346 target gene, herein designated TARGET GENE. FLJ37307 BINDING SITE is a target binding site found in the 3' untranslated region of mRNA encoded by FLJ37307, corresponding to a target binding site such as BINDING SITE I, BINDING SITE II or BINDING SITE III of FIG. 8. Table 4 illustrates the complementarity of the nucleotide sequences of FLJ37307 BINDING SITE, designated SEQ ID:12590, to the nucleotide sequence of GAM5346 RNA, herein designated GAM RNA, also designated SEQ ID:319.

Another function of GAM5346 is therefore inhibition of FLJ37307 (Accession NP_848610.1). Accordingly, utilities of GAM5346 include diagnosis, prevention and treatment of diseases and clinical conditions associated with FLJ37307.

Fibronectin leucine rich transmembrane protein 2 (FLRT2, Accession NP_037363.1) is another GAM5346 target gene, herein designated TARGET GENE. FLRT2 BINDING SITE is a target binding site found in the 3' untranslated region of mRNA encoded by FLRT2, corresponding to a target binding site such as BINDING SITE I, BINDING SITE II or BINDING SITE III of FIG. 8. Table 4 illustrates the complementarity of the nucleotide sequences of FLRT2 BINDING SITE, designated SEQ ID:11704, to the nucleotide sequence of GAM5346 RNA, herein designated GAM RNA, also designated SEQ ID:319.

Another function of GAM5346 is therefore inhibition of Fibronectin leucine rich transmembrane protein 2 (FLRT2, Accession NP_037363.1), a gene which may have a function in cell adhesion and/or receptor signaling. Accordingly, utilities of GAM5346 include diagnosis, prevention and treatment of diseases and clinical conditions associated with FLRT2.

The function of FLRT2 and its association with various diseases and clinical conditions, has been established by previous studies, as described hereinabove with reference to GAM72.1. G2 (Accession XP_039515.8) is another GAM5346 target gene, herein designated TARGET GENE. G2 BINDING SITE is a target binding site found in the 3' untranslated region of mRNA encoded by G2, corresponding to a target binding site such as BINDING SITE I, BINDING SITE II or BINDING SITE III of FIG. 8. Table 4 illustrates the complementarity of the nucleotide sequences of G2 BINDING SITE, designated SEQ ID:13665, to the nucleotide sequence of GAM5346 RNA, herein designated GAM RNA, also designated SEQ ID:319.

Another function of GAM5346 is therefore inhibition of G2 (Accession XP_039515.8). Accordingly, utilities of GAM5346 include diagnosis, prevention and treatment of diseases and clinical conditions associated with G2.

GPR124 (Accession NP_116166.6) is another GAM5346 target gene, herein designated TARGET GENE. GPR124 BINDING SITE is a target binding site found in the 3' untranslated region of mRNA encoded by GPR124, corresponding to a target binding site such as BINDING SITE I, BINDING SITE II or BINDING SITE III of FIG. 8. Table 4 illustrates the complementarity of the nucleotide sequences of GPR124 BINDING SITE, designated SEQ ID:6815, to the nucleotide sequence of GAM5346 RNA, herein designated GAM RNA, also designated SEQ ID:319.

Another function of GAM5346 is therefore inhibition of GPR124 (Accession NP_116166.6). Accordingly, utilities of GAM5346 include diagnosis, prevention and treatment of diseases and clinical conditions associated with GPR124.

G-rich rna sequence binding factor 1 (GRSF1, Accession NP_002083.1) is another GAM5346 target gene, herein designated TARGET GENE. GRSF1 BINDING SITE is a target binding site found in the 3' untranslated region of mRNA encoded by GRSF1, corresponding to a target binding site such as BINDING SITE I, BINDING SITE II or BINDING SITE III of FIG. 8. Table 4 illustrates the complementarity of the nucleotide sequences of GRSF1 BINDING SITE, designated SEQ ID:17530, to the nucleotide sequence of GAM5346 RNA, herein designated GAM RNA, also designated SEQ ID:319.

Another function of GAM5346 is therefore inhibition of G-rich rna sequence binding factor 1 (GRSF1, Accession NP_002083.1). Accordingly, utilities of GAM5346 include diagnosis, prevention and treatment of diseases and clinical conditions associated with GRSF1.

High-mobility group 20a (HMG20A, Accession NP_060670.1) is another GAM5346 target gene, herein designated TARGET GENE. HMG20A BINDING SITE is a target binding site found in the 3' untranslated region of mRNA encoded by HMG20A, corresponding to a target binding site such as BINDING SITE I, BINDING SITE II or BINDING SITE III of FIG. 8. Table 4 illustrates the complementarity of the nucleotide sequences of HMG20A BINDING SITE, designated SEQ ID:1619, to the nucleotide sequence of GAM5346 RNA, herein designated GAM RNA, also designated SEQ ID:319.

Another function of GAM5346 is therefore inhibition of High-mobility group 20a (HMG20A, Accession NP_060670.1). Accordingly, utilities of GAM5346 include diagnosis, prevention and treatment of diseases and clinical conditions associated with HMG20A.

Isoleucine-trna synthetase (IARS, Accession NP_002152.1) is another GAM5346 target gene, herein designated TARGET GENE. IARS BINDING SITE is a target binding site found in the 3' untranslated region of multiple transcripts of mRNA encoded by IARS, corresponding to a target binding site such as BINDING SITE I, BINDING SITE II or BINDING SITE III of FIG. 8. Table 4 illustrates the complementarity of the nucleotide sequences of IARS BINDING SITE, designated SEQ ID:8969, to the nucleotide sequence of GAM5346 RNA, herein designated GAM RNA, also designated SEQ ID:319.

Another function of GAM5346 is therefore inhibition of Isoleucine-trna synthetase (IARS, Accession NP_002152.1), a gene which functions in protein biosynthesis. Accordingly, utilities of GAM5346 include diagnosis, prevention and treatment of diseases and clinical conditions associated with IARS.

The function of IARS and its association with various diseases and clinical conditions, has been established by previous studies, as described hereinabove with reference to GAM291.1. Isoleucine-trna synthetase (IARS, Accession NP_038203.1) is another GAM5346 target gene, herein designated TARGET GENE. IARS BINDING SITE is a target binding site found in the 3' untranslated region of multiple transcripts of mRNA encoded by IARS, corresponding to a target binding site such as BINDING SITE I, BINDING SITE II or BINDING SITE III of FIG. 8. Table 4 illustrates the complementarity of the nucleotide sequences of IARS BINDING SITE, designated SEQ ID:8969, to the nucleotide sequence of GAM5346 RNA, herein designated GAM RNA, also designated SEQ ID:319.

Another function of GAM5346 is therefore inhibition of Isoleucine-trna synthetase (IARS, Accession NP_038203.1), a gene which functions in protein biosynthesis. Accordingly, utilities of GAM5346 include diagnosis, prevention and treatment of diseases and clinical conditions associated with IARS.

The function of IARS and its association with various diseases and clinical conditions, has been established by previous studies, as described hereinabove with reference to GAM291.1. Interleukin 23, alpha subunit p19 (IL23A, Accession NP_057668.1) is another GAM5346 target gene, herein designated TARGET GENE. IL23A BINDING SITE is a target binding site found in the 5' untranslated region of mRNA encoded by IL23A, corresponding to a target binding site such as BINDING SITE I, BINDING SITE II or BINDING SITE III of FIG. 8. Table 4 illustrates the complementarity of the nucleotide sequences of IL23A BINDING SITE, designated SEQ ID:15401, to the nucleotide sequence of GAM5346 RNA, herein designated GAM RNA, also designated SEQ ID:319.

Another function of GAM5346 is therefore inhibition of Interleukin 23, alpha subunit p19 (IL23A, Accession NP_057668.1). Accordingly, utilities of GAM5346 include diagnosis, prevention and treatment of diseases and clinical conditions associated with IL23A.

Inositol 1,4,5-trisphosphate 3-kinase b (ITPKB, Accession NP_002212.1) is another GAM5346 target gene, herein designated TARGET GENE. ITPKB BINDING SITE is a target binding site found in the 3' untranslated region of mRNA encoded by ITPKB, corresponding to a target binding site such as BINDING SITE I, BINDING SITE II or BINDING SITE III of FIG. 8. Table 4 illustrates the complementarity of the nucleotide sequences of ITPKB BINDING SITE, designated SEQ ID:8612, to the nucleotide sequence of GAM5346 RNA, herein designated GAM RNA, also designated SEQ ID:319.

Another function of GAM5346 is therefore inhibition of Inositol 1,4,5-trisphosphate 3-kinase b (ITPKB, Accession NP_002212.1), a gene which is a type B inositol 1,4,5-triphosphate 3 kinase. Accordingly, utilities of GAM5346 include diagnosis, prevention and treatment of diseases and clinical conditions associated with ITPKB.

The function of ITPKB and its association with various diseases and clinical conditions, has been established by previous studies, as described hereinabove with reference to GAM63.1. JMJD1 (Accession NP_060903.2) is another GAM5346 target gene, herein designated TARGET GENE. JMJD1 BINDING SITE is a target binding site found in the 3' untranslated region of mRNA encoded by JMJD1, corresponding to a target binding site such as BINDING SITE I, BINDING SITE II or BINDING SITE III of FIG. 8. Table 4 illustrates the complementarity of the nucleotide sequences of JMJD1 BINDING SITE, designated SEQ ID:1010, to the nucleotide sequence of GAM5346 RNA, herein designated GAM RNA, also designated SEQ ID:319.

Another function of GAM5346 is therefore inhibition of JMJD1 (Accession NP_060903.2). Accordingly, utilities of GAM5346 include diagnosis, prevention and treatment of diseases and clinical conditions associated with JMJD1.

Potassium voltage-gated channel, shaker-related subfamily, member 3 (KCNA3, Accession NP_002223.2) is another GAM5346 target gene, herein designated TARGET GENE. KCNA3 BINDING SITE is a target binding site found in the 3' untranslated region of mRNA encoded by KCNA3, corresponding to a target binding site such as BINDING SITE I, BINDING SITE II or BINDING SITE III of FIG. 8. Table 4 illustrates the complementarity of the nucleotide sequences of KCNA3 BINDING SITE, designated SEQ ID:9276, to the nucleotide sequence of GAM5346 RNA, herein designated GAM RNA, also designated SEQ ID:319.

Another function of GAM5346 is therefore inhibition of Potassium voltage-gated channel, shaker-related subfamily, member 3 (KCNA3, Accession NP_002223.2). Accordingly, utilities of GAM5346 include diagnosis, prevention and treatment of diseases and clinical conditions associated with KCNA3.

KIAA0218 (Accession NP_055575.1) is another GAM5346 target gene, herein designated TARGET GENE. KIAA0218 BINDING SITE is a target binding site found in the 3' untranslated region of mRNA encoded by KIAA0218, corresponding to a target binding site such as BINDING SITE I, BINDING SITE II or BINDING SITE III of FIG. 8. Table 4 illustrates the complementarity of the nucleotide sequences of KIAA0218 BINDING SITE, designated SEQ ID:15087, to the nucleotide sequence of GAM5346 RNA, herein designated GAM RNA, also designated SEQ ID:319.

Another function of GAM5346 is therefore inhibition of KIAA0218 (Accession NP_055575.1). Accordingly, utilities of GAM5346 include diagnosis, prevention and treatment of diseases and clinical conditions associated with KIAA0218.

KIAA0962 (Accession XP_290942.1) is another GAM5346 target gene, herein designated TARGET GENE. KIAA0962 BINDING SITE is a target binding site found in the 3' untranslated region of mRNA encoded by KIAA0962, corresponding to a target binding site such as BINDING SITE I, BINDING SITE II or BINDING SITE III of FIG. 8. Table 4 illustrates the complementarity of the nucleotide sequences of KIAA0962 BINDING SITE, designated SEQ ID:5013, to the nucleotide sequence of GAM5346 RNA, herein designated GAM RNA, also designated SEQ ID:319.

Another function of GAM5346 is therefore inhibition of KIAA0962 (Accession XP_290942.1). Accordingly, utilities of GAM5346 include diagnosis, prevention and treatment of diseases and clinical conditions associated with KIAA0962.

KIAA1554 (Accession XP_290768.1) is another GAM5346 target gene, herein designated TARGET GENE. KIAA1554 BINDING SITE is a target binding site found in the 3' untranslated region of mRNA encoded by KIAA1554, corresponding to a target binding site such as BINDING SITE I, BINDING SITE II or BINDING SITE III of FIG. 8. Table 4 illustrates the complementarity of the nucleotide sequences of KIAA1554 BINDING SITE, designated SEQ ID:19516, to the nucleotide sequence of GAM5346 RNA, herein designated GAM RNA, also designated SEQ ID:319.

Another function of GAM5346 is therefore inhibition of KIAA1554 (Accession XP_290768.1). Accordingly, utilities of GAM5346 include diagnosis, prevention and treatment of diseases and clinical conditions associated with KIAA1554.

KIAA1673 (Accession XP_047672.4) is another GAM5346 target gene, herein designated TARGET GENE. KIAA1673 BINDING SITE is a target binding site found in the 3' untranslated region of mRNA encoded by KIAA1673, corresponding to a target binding site such as BINDING SITE I, BINDING SITE II or BINDING SITE III of FIG. 8. Table 4 illustrates the complementarity of the nucleotide sequences of KIAA1673 BINDING SITE, designated SEQ ID:13140, to the nucleotide sequence of GAM5346 RNA, herein designated GAM RNA, also designated SEQ ID:319.

Another function of GAM5346 is therefore inhibition of KIAA1673 (Accession XP_047672.4). Accordingly, utilities of GAM5346 include diagnosis, prevention and treatment of diseases and clinical conditions associated with KIAA1673.

KIAA1998 (Accession XP_068710.3) is another GAM5346 target gene, herein designated TARGET GENE. KIAA1998 BINDING SITE is a target binding site found in the 3' untranslated region of mRNA encoded by KIAA1998, corresponding to a target binding site such as BINDING SITE I, BINDING SITE II or BINDING SITE III of FIG. 8. Table 4 illustrates the complementarity of the nucleotide sequences of KIAA1998 BINDING SITE, designated SEQ ID:1079, to the nucleotide sequence of GAM5346 RNA, herein designated GAM RNA, also designated SEQ ID:319.

Another function of GAM5346 is therefore inhibition of KIAA1998 (Accession XP_068710.3). Accordingly, utilities of GAM5346 include diagnosis, prevention and treatment of diseases and clinical conditions associated with KIAA1998.

LOC115442 (Accession XP_052510.3) is another GAM5346 target gene, herein designated TARGET GENE. LOC115442 BINDING SITE1 and LOC115442 BINDING SITE2 are target binding sites found in untranslated regions of mRNA encoded by LOC115442, corresponding to target binding sites such as BINDING SITE I, BINDING SITE II or BINDING SITE III of FIG. 8. Table 4 illustrates the complementarity of the nucleotide sequences of LOC115442 BINDING SITE1 and LOC115442 BINDING SITE2, designated SEQ ID:14698 and SEQ ID:16018 respectively, to the nucleotide sequence of GAM5346 RNA, herein designated GAM RNA, also designated SEQ ID:319.

Another function of GAM5346 is therefore inhibition of LOC115442 (Accession XP_052510.3). Accordingly, utilities of GAM5346 include diagnosis, prevention and treatment of diseases and clinical conditions associated with LOC115442.

LOC126037 (Accession XP_058967.6) is another GAM5346 target gene, herein designated TARGET GENE. LOC126037 BINDING SITE is a target binding site found in the 5' untranslated region of mRNA encoded by LOC126037, corresponding to a target binding site such as BINDING SITE I, BINDING SITE II or BINDING SITE III of FIG. 8. Table 4 illustrates the complementarity of the nucleotide sequences of LOC126037 BINDING SITE, designated SEQ ID:10991, to the nucleotide sequence of GAM5346 RNA, herein designated GAM RNA, also designated SEQ ID:319.

Another function of GAM5346 is therefore inhibition of LOC126037 (Accession XP_058967.6). Accordingly, utilities of GAM5346 include diagnosis, prevention and treatment of diseases and clinical conditions associated with LOC126037.

LOC130985 (Accession XP_059490.3) is another GAM5346 target gene, herein designated TARGET GENE. LOC130985 BINDING SITE is a target binding site found in the 3' untranslated region of mRNA encoded by LOC130985, corresponding to a target binding site such as BINDING SITE I, BINDING SITE II or BINDING SITE III of FIG. 8. Table 4 illustrates the complementarity of the nucleotide sequences of LOC130985 BINDING SITE, designated SEQ ID:3929, to the nucleotide sequence of GAM5346 RNA, herein designated GAM RNA, also designated SEQ ID:319.

Another function of GAM5346 is therefore inhibition of LOC130985 (Accession XP_059490.3). Accordingly, utilities of GAM5346 include diagnosis, prevention and treatment of diseases and clinical conditions associated with LOC130985.

LOC144866 (Accession XP_096699.1) is another GAM5346 target gene, herein designated TARGET GENE. LOC144866 BINDING SITE is a target binding site found in the 5' untranslated region of mRNA encoded by LOC144866, corresponding to a target binding site such as BINDING SITE I, BINDING SITE II or BINDING SITE III of FIG. 8. Table 4 illustrates the complementarity of the nucleotide sequences of LOC144866 BINDING SITE, designated SEQ ID:780, to the nucleotide sequence of GAM5346 RNA, herein designated GAM RNA, also designated SEQ ID:319.

Another function of GAM5346 is therefore inhibition of LOC144866 (Accession XP_096699.1). Accordingly, utilities of GAM5346 include diagnosis, prevention and treatment of diseases and clinical conditions associated with LOC144866.

LOC145644 (Accession XP_035608.1) is another GAM5346 target gene, herein designated TARGET GENE. LOC145644 BINDING SITE is a target binding site found in the 3' untranslated region of mRNA encoded by LOC145644, corresponding to a target binding site such as BINDING SITE I, BINDING SITE II or BINDING SITE III of FIG. 8. Table 4 illustrates the complementarity of the nucleotide sequences of LOC145644 BINDING SITE, designated SEQ ID:16433, to the nucleotide sequence of GAM5346 RNA, herein designated GAM RNA, also designated SEQ ID:319.

Another function of GAM5346 is therefore inhibition of LOC145644 (Accession XP_035608.1). Accordingly, utilities of GAM5346 include diagnosis, prevention and treatment of diseases and clinical conditions associated with LOC145644.

LOC145786 (Accession XP_096860.1) is another GAM5346 target gene, herein designated TARGET GENE. LOC145786 BINDING SITE is a target binding site found in the 5' untranslated region of mRNA encoded by LOC145786, corresponding to a target binding site such as BINDING SITE I, BINDING SITE II or BINDING SITE III of FIG. 8. Table 4 illustrates the complementarity of the nucleotide sequences of LOC145786 BINDING SITE, designated SEQ ID:2737, to the nucleotide sequence of GAM5346 RNA, herein designated GAM RNA, also designated SEQ ID:319.

Another function of GAM5346 is therefore inhibition of LOC145786 (Accession XP_096860.1). Accordingly, utilities of GAM5346 include diagnosis, prevention and treatment of diseases and clinical conditions associated with LOC145786.

LOC145957 (Accession NP_612640.1) is another GAM5346 target gene, herein designated TARGET GENE. LOC145957 BINDING SITE is a target binding site found in the 3' untranslated region of mRNA encoded by LOC145957, corresponding to a target binding site such as BINDING SITE I, BINDING SITE II or BINDING SITE III of FIG. 8. Table 4 illustrates the complementarity of the nucleotide sequences of LOC145957 BINDING SITE, designated SEQ ID:11305, to the nucleotide sequence of GAM5346 RNA, herein designated GAM RNA, also designated SEQ ID:319.

Another function of GAM5346 is therefore inhibition of LOC145957 (Accession NP_612640.1). Accordingly, utilities of GAM5346 include diagnosis, prevention and treatment of diseases and clinical conditions associated with LOC145957.

LOC148918 (Accession XP_086361.1) is another GAM5346 target gene, herein designated TARGET GENE. LOC148918 BINDING SITE is a target binding site found in the 3' untranslated region of mRNA encoded by LOC148918, corresponding to a target binding site such as BINDING SITE I, BINDING SITE II or BINDING SITE III of FIG. 8. Table 4 illustrates the complementarity of the nucleotide sequences of LOC148918 BINDING SITE, designated SEQ ID:8659, to the nucleotide sequence of GAM5346 RNA, herein designated GAM RNA, also designated SEQ ID:319.

Another function of GAM5346 is therefore inhibition of LOC148918 (Accession XP_086361.1). Accordingly, utilities of GAM5346 include diagnosis, prevention and treatment of diseases and clinical conditions associated with LOC148918.

LOC149127 (Accession XP_097584.1) is another GAM5346 target gene, herein designated TARGET GENE. LOC149127 BINDING SITE is a target binding site found in the 5' untranslated region of mRNA encoded by LOC149127, corresponding to a target binding site such as BINDING SITE I, BINDING SITE II or BINDING SITE III of FIG. 8. Table 4 illustrates the complementarity of the nucleotide sequences of LOC149127 BINDING SITE, designated SEQ ID:11810, to the nucleotide sequence of GAM5346 RNA, herein designated GAM RNA, also designated SEQ ID:319.

Another function of GAM5346 is therefore inhibition of LOC149127 (Accession XP_097584.1). Accordingly, utilities of GAM5346 include diagnosis, prevention and treatment of diseases and clinical conditions associated with LOC149127.

LOC149372 (Accession XP_086509.1) is another GAM5346 target gene, herein designated TARGET GENE. LOC149372 BINDING SITE is a target binding site found in the 3' untranslated region of mRNA encoded by LOC149372, corresponding to a target binding site such as BINDING SITE I, BINDING SITE II or BINDING SITE III of FIG. 8. Table 4 illustrates the complementarity of the nucleotide sequences of LOC149372 BINDING SITE, designated SEQ ID:16788, to the nucleotide sequence of GAM5346 RNA, herein designated GAM RNA, also designated SEQ ID:319.

Another function of GAM5346 is therefore inhibition of LOC149372 (Accession XP_086509.1). Accordingly, utilities of GAM5346 include diagnosis, prevention and treatment of diseases and clinical conditions associated with LOC149372.

LOC155060 (Accession XP_098650.3) is another GAM5346 target gene, herein designated TARGET GENE. LOC155060 BINDING SITE is a target binding site found in the 5' untranslated region of mRNA encoded by LOC155060, corresponding to a target binding site such as BINDING SITE I, BINDING SITE II or BINDING SITE III of FIG. 8. Table 4 illustrates the complementarity of the nucleotide sequences of LOC155060 BINDING SITE, designated SEQ ID:10054, to the nucleotide sequence of GAM5346 RNA, herein designated GAM RNA, also designated SEQ ID:319.

Another function of GAM5346 is therefore inhibition of LOC155060 (Accession XP_098650.3). Accordingly, utilities of GAM5346 include diagnosis, prevention and treatment of diseases and clinical conditions associated with LOC155060.

LOC158450 (Accession XP_088580.1) is another GAM5346 target gene, herein designated TARGET GENE. LOC158450 BINDING SITE is a target binding site found in the 3' untranslated region of mRNA encoded by LOC158450, corresponding to a target binding site such as BINDING SITE I, BINDING SITE II or BINDING SITE III of FIG. 8. Table 4 illustrates the complementarity of the nucleotide sequences of LOC158450 BINDING SITE, designated SEQ ID:1358, to the nucleotide sequence of GAM5346 RNA, herein designated GAM RNA, also designated SEQ ID:319.

Another function of GAM5346 is therefore inhibition of LOC158450 (Accession XP_088580.1). Accordingly, utilities of GAM5346 include diagnosis, prevention and treatment of diseases and clinical conditions associated with LOC158450.

LOC196337 (Accession XP_113696.1) is another GAM5346 target gene, herein designated TARGET GENE. LOC196337 BINDING SITE is a target binding site found in the 5' untranslated region of mRNA encoded by LOC196337, corresponding to a target binding site such as BINDING SITE I, BINDING SITE II or BINDING SITE III of FIG. 8. Table 4 illustrates the complementarity of the nucleotide sequences of LOC196337 BINDING SITE, designated SEQ ID:3387, to the nucleotide sequence of GAM5346 RNA, herein designated GAM RNA, also designated SEQ ID:319.

Another function of GAM5346 is therefore inhibition of LOC196337 (Accession XP_113696.1). Accordingly, utilities of GAM5346 include diagnosis, prevention and treatment of diseases and clinical conditions associated with LOC196337.

LOC200008 (Accession XP_114089.3) is another GAM5346 target gene, herein designated TARGET GENE. LOC200008 BINDING SITE is a target binding site found in the 3' untranslated region of mRNA encoded by LOC200008, corresponding to a target binding site such as BINDING SITE I, BINDING SITE II or BINDING SITE III of FIG. 8. Table 4 illustrates the complementarity of the nucleotide sequences of LOC200008 BINDING SITE, designated SEQ ID:11957, to the nucleotide sequence of GAM5346 RNA, herein designated GAM RNA, also designated SEQ ID:319.

Another function of GAM5346 is therefore inhibition of LOC200008 (Accession XP_114089.3). Accordingly, utilities of GAM5346 include diagnosis, prevention and treatment of diseases and clinical conditions associated with LOC200008.

LOC202451 (Accession XP_117401.1) is another GAM5346 target gene, herein designated TARGET GENE. LOC202451 BINDING SITE is a target binding site found in the 5' untranslated region of mRNA encoded by LOC202451, corresponding to a target binding site such as BINDING SITE I, BINDING SITE II or BINDING SITE III of FIG. 8. Table 4 illustrates the complementarity of the nucleotide sequences of LOC202451 BINDING SITE, designated SEQ ID:2543, to the nucleotide sequence of GAM5346 RNA, herein designated GAM RNA, also designated SEQ ID:319.

Another function of GAM5346 is therefore inhibition of LOC202451 (Accession XP_117401.1). Accordingly, utilities of GAM5346 include diagnosis, prevention and treatment of diseases and clinical conditions associated with LOC202451.

LOC220477 (Accession XP_071675.1) is another GAM5346 target gene, herein designated TARGET GENE. LOC220477 BINDING SITE is a target binding site found in the 5' untranslated region of mRNA encoded by LOC220477, corresponding to a target binding site such as BINDING SITE I, BINDING SITE II or BINDING SITE III of FIG. 8. Table 4 illustrates the complementarity of the nucleotide sequences of LOC220477 BINDING SITE, designated SEQ ID:17554, to the nucleotide sequence of GAM5346 RNA, herein designated GAM RNA, also designated SEQ ID:319.

Another function of GAM5346 is therefore inhibition of LOC220477 (Accession XP_071675.1). Accordingly, utilities of GAM5346 include diagnosis, prevention and treatment of diseases and clinical conditions associated with LOC220477.

LOC254719 (Accession XP_171166.1) is another GAM5346 target gene, herein designated TARGET GENE. LOC254719 BINDING SITE is a target binding site found in the 3' untranslated region of mRNA encoded by LOC254719, corresponding to a target binding site such as BINDING SITE I, BINDING SITE II or BINDING SITE III of FIG. 8. Table 4 illustrates the complementarity of the nucleotide sequences of LOC254719 BINDING SITE, designated SEQ ID:17345, to the nucleotide sequence of GAM5346 RNA, herein designated GAM RNA, also designated SEQ ID:319.

Another function of GAM5346 is therefore inhibition of LOC254719 (Accession XP_171166.1). Accordingly, utilities of GAM5346 include diagnosis, prevention and treatment of diseases and clinical conditions associated with LOC254719.

LOC283119 (Accession XP_210895.1) is another GAM5346 target gene, herein designated TARGET GENE. LOC283119 BINDING SITE is a target binding site found in the 3' untranslated region of mRNA encoded by LOC283119, corresponding to a target binding site such as BINDING SITE I, BINDING SITE II or BINDING SITE III of FIG. 8. Table 4 illustrates the complementarity of the nucleotide sequences of LOC283119 BINDING SITE, designated SEQ ID:18560, to the nucleotide sequence of GAM5346 RNA, herein designated GAM RNA, also designated SEQ ID:319.

Another function of GAM5346 is therefore inhibition of LOC283119 (Accession XP_210895.1). Accordingly, utilities of GAM5346 include diagnosis, prevention and treatment of diseases and clinical conditions associated with LOC283119.

LOC283387 (Accession XP_211007.1) is another GAM5346 target gene, herein designated TARGET GENE. LOC283387 BINDING SITE is a target binding site found in the 3' untranslated region of mRNA encoded by LOC283387, corresponding to a target binding site such as BINDING SITE I, BINDING SITE II or BINDING SITE III of FIG. 8. Table 4 illustrates the complementarity of the nucleotide sequences of LOC283387 BINDING SITE, designated SEQ ID:884, to the nucleotide sequence of GAM5346 RNA, herein designated GAM RNA, also designated SEQ ID:319.

Another function of GAM5346 is therefore inhibition of LOC283387 (Accession XP_211007.1). Accordingly, utilities of GAM5346 include diagnosis, prevention and treatment of diseases and clinical conditions associated with LOC283387.

LOC283516 (Accession XP_211072.1) is another GAM5346 target gene, herein designated TARGET GENE. LOC283516 BINDING SITE is a target binding site found in the 3' untranslated region of mRNA encoded by LOC283516, corresponding to a target binding site such as BINDING SITE I, BINDING SITE II or BINDING SITE III of FIG. 8. Table 4 illustrates the complementarity of the nucleotide sequences of LOC283516 BINDING SITE, designated SEQ ID:763, to the nucleotide sequence of GAM5346 RNA, herein designated GAM RNA, also designated SEQ ID:319.

Another function of GAM5346 is therefore inhibition of LOC283516 (Accession XP_211072.1). Accordingly, utilities of GAM5346 include diagnosis, prevention and treatment of diseases and clinical conditions associated with LOC283516.

LOC283521 (Accession XP_208705.1) is another GAM5346 target gene, herein designated TARGET GENE. LOC283521 BINDING SITE is a target binding site found in the 3' untranslated region of mRNA encoded by LOC283521, corresponding to a target binding site such as BINDING SITE I, BINDING SITE II or BINDING SITE III of FIG. 8. Table 4 illustrates the complementarity of the nucleotide sequences of LOC283521 BINDING SITE, designated SEQ ID:12590, to the nucleotide sequence of GAM5346 RNA, herein designated GAM RNA, also designated SEQ ID:319.

Another function of GAM5346 is therefore inhibition of LOC283521 (Accession XP_208705.1). Accordingly, utilities of GAM5346 include diagnosis, prevention and treatment of diseases and clinical conditions associated with LOC283521.

LOC283887 (Accession XP_211248.2) is another GAM5346 target gene, herein designated TARGET GENE. LOC283887 BINDING SITE is a target binding site found in the 5' untranslated region of mRNA encoded by LOC283887, corresponding to a target binding site such as BINDING SITE I, BINDING SITE II or BINDING SITE III of FIG. 8. Table 4 illustrates the complementarity of the nucleotide sequences of LOC283887 BINDING SITE, designated SEQ ID:6494, to the nucleotide sequence of GAM5346 RNA, herein designated GAM RNA, also designated SEQ ID:319.

Another function of GAM5346 is therefore inhibition of LOC283887 (Accession XP_211248.2). Accordingly, utilities of GAM5346 include diagnosis, prevention and treatment of diseases and clinical conditions associated with LOC283887.

LOC283925 (Accession XP_208907.1) is another GAM5346 target gene, herein designated TARGET GENE. LOC283925 BINDING SITE is a target binding site found in the 3' untranslated region of mRNA encoded by LOC283925, corresponding to a target binding site such as BINDING SITE I, BINDING SITE II or BINDING SITE III of FIG. 8. Table 4 illustrates the complementarity of the nucleotide sequences of LOC283925 BINDING SITE, designated SEQ ID:1883, to the nucleotide sequence of GAM5346 RNA, herein designated GAM RNA, also designated SEQ ID:319.

Another function of GAM5346 is therefore inhibition of LOC283925 (Accession XP_208907.1). Accordingly, utilities of GAM5346 include diagnosis, prevention and treatment of diseases and clinical conditions associated with LOC283925.

LOC284019 (Accession XP_211302.1) is another GAM5346 target gene, herein designated TARGET GENE. LOC284019 BINDING SITE is a target binding site found in the 3' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:8913, to the nucleotide sequence of GAM5346 RNA, herein designated GAM RNA, also designated SEQ ID:319.

Another function of GAM5346 is therefore inhibition of LOC284019 (Accession XP_211302.1). Accordingly, utilities of GAM5346 include diagnosis, prevention and treatment of diseases and clinical conditions associated with LOC284019.

LOC284135 (Accession XP_209032.1) is another GAM5346 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:1642, to the nucleotide sequence of GAM5346 RNA, herein designated GAM RNA, also designated SEQ ID:319.

Another function of GAM5346 is therefore inhibition of LOC284135 (Accession XP_209032.1). Accordingly, utilities of GAM5346 include diagnosis, prevention and treatment of diseases and clinical conditions associated with LOC284135.

LOC284221 (Accession XP_211392.1) is another GAM5346 target gene, herein designated TARGET GENE. LOC284221 BINDING SITE is a target binding site found in the 3' untranslated region of mRNA encoded by LOC284221, corresponding to a target binding site such as BINDING SITE I, BINDING SITE II or BINDING SITE III of FIG. 8. Table 4 illustrates the complementarity of the nucleotide sequences of LOC284221 BINDING SITE, designated SEQ ID:1752, to the nucleotide sequence of GAM5346 RNA, herein designated GAM RNA, also designated SEQ ID:319.

Another function of GAM5346 is therefore inhibition of LOC284221 (Accession XP_211392.1). Accordingly, utilities of GAM5346 include diagnosis, prevention and treatment of diseases and clinical conditions associated with LOC284221.

LOC284262 (Accession XP_211402.1) is another GAM5346 target gene, herein designated TARGET GENE. LOC284262 BINDING SITE is a target binding site found in the 5' untranslated region of mRNA encoded by LOC284262, corresponding to a target binding site such as BINDING SITE I, BINDING SITE II or BINDING SITE III of FIG. 8. Table 4 illustrates the complementarity of the nucleotide sequences of LOC284262 BINDING SITE, designated SEQ ID:1292, to the nucleotide sequence of GAM5346 RNA, herein designated GAM RNA, also designated SEQ ID:319.

Another function of GAM5346 is therefore inhibition of LOC284262 (Accession XP_211402.1). Accordingly, utilities of GAM5346 include diagnosis, prevention and treatment of diseases and clinical conditions associated with LOC284262.

LOC284506 (Accession XP_211498.1) is another GAM5346 target gene, herein designated TARGET GENE. LOC284506 BINDING SITE is a target binding site found in the 5' untranslated region of mRNA encoded by LOC284506, corresponding to a target binding site such as BINDING SITE I, BINDING SITE II or BINDING SITE III of FIG. 8. Table 4 illustrates the complementarity of the nucleotide sequences of LOC284506 BINDING SITE, designated SEQ ID:417, to the nucleotide sequence of GAM5346 RNA, herein designated GAM RNA, also designated SEQ ID:319.

Another function of GAM5346 is therefore inhibition of LOC284506 (Accession XP_211498.1). Accordingly, utilities of GAM5346 include diagnosis, prevention and treatment of diseases and clinical conditions associated with LOC284506.

LOC284542 (Accession XP_209254.1) is another GAM5346 target gene, herein designated TARGET GENE.

LOC284542 BINDING SITE is a target binding site found in the 3' untranslated region of mRNA encoded by LOC284542, corresponding to a target binding site such as BINDING SITE I, BINDING SITE II or BINDING SITE III of FIG. 8. Table 4 illustrates the complementarity of the nucleotide sequences of LOC284542 BINDING SITE, designated SEQ ID:15471, to the nucleotide sequence of GAM5346 RNA, herein designated GAM RNA, also designated SEQ ID:319.

Another function of GAM5346 is therefore inhibition of LOC284542 (Accession XP_209254.1). Accordingly, utilities of GAM5346 include diagnosis, prevention and treatment of diseases and clinical conditions associated with LOC284542.

LOC284561 (Accession XP_211519.1) is another GAM5346 target gene, herein designated TARGET GENE. LOC284561 BINDING SITE is a target binding site found in the 5' untranslated region of mRNA encoded by LOC284561, corresponding to a target binding site such as BINDING SITE I, BINDING SITE II or BINDING SITE III of FIG. 8. Table 4 illustrates the complementarity of the nucleotide sequences of LOC284561 BINDING SITE, designated SEQ ID:9611, to the nucleotide sequence of GAM5346 RNA, herein designated GAM RNA, also designated SEQ ID:319.

Another function of GAM5346 is therefore inhibition of LOC284561 (Accession XP_211519.1). Accordingly, utilities of GAM5346 include diagnosis, prevention and treatment of diseases and clinical conditions associated with LOC284561.

LOC284751 (Accession XP_211622.1) is another GAM5346 target gene, herein designated TARGET GENE. LOC284751 BINDING SITE is a target binding site found in the 3' untranslated region of mRNA encoded by LOC284751, corresponding to a target binding site such as BINDING SITE I, BINDING SITE II or BINDING SITE III of FIG. 8. Table 4 illustrates the complementarity of the nucleotide sequences of LOC284751 BINDING SITE, designated SEQ ID:10156, to the nucleotide sequence of GAM5346 RNA, herein designated GAM RNA, also designated SEQ ID:319.

Another function of GAM5346 is therefore inhibition of LOC284751 (Accession XP_211622.1). Accordingly, utilities of GAM5346 include diagnosis, prevention and treatment of diseases and clinical conditions associated with LOC284751.

LOC284796 (Accession XP_208248.1) is another GAM5346 target gene, herein designated TARGET GENE. LOC284796 BINDING SITE is a target binding site found in the 5' untranslated region of mRNA encoded by LOC284796, corresponding to a target binding site such as BINDING SITE I, BINDING SITE II or BINDING SITE III of FIG. 8. Table 4 illustrates the complementarity of the nucleotide sequences of LOC284796 BINDING SITE, designated SEQ ID:16414, to the nucleotide sequence of GAM5346 RNA, herein designated GAM RNA, also designated SEQ ID:319.

Another function of GAM5346 is therefore inhibition of LOC284796 (Accession XP_208248.1). Accordingly, utilities of GAM5346 include diagnosis, prevention and treatment of diseases and clinical conditions associated with LOC284796.

LOC284899 (Accession XP_211680.1) is another GAM5346 target gene, herein designated TARGET GENE. LOC284899 BINDING SITE is a target binding site found in the 3' untranslated region of mRNA encoded by LOC284899, corresponding to a target binding site such as BINDING SITE I, BINDING SITE II or BINDING SITE III of FIG. 8. Table 4 illustrates the complementarity of the nucleotide sequences of LOC284899 BINDING SITE, designated SEQ ID:7326, to the nucleotide sequence of GAM5346 RNA, herein designated GAM RNA, also designated SEQ ID:319.

Another function of GAM5346 is therefore inhibition of LOC284899 (Accession XP_211680.1). Accordingly, utilities of GAM5346 include diagnosis, prevention and treatment of diseases and clinical conditions associated with LOC284899.

LOC284925 (Accession XP_209414.1) is another GAM5346 target gene, herein designated TARGET GENE. LOC284925 BINDING SITE is a target binding site found in the 5' untranslated region of mRNA encoded by LOC284925, corresponding to a target binding site such as BINDING SITE I, BINDING SITE II or BINDING SITE III of FIG. 8. Table 4 illustrates the complementarity of the nucleotide sequences of LOC284925 BINDING SITE, designated SEQ ID:15142, to the nucleotide sequence of GAM5346 RNA, herein designated GAM RNA, also designated SEQ ID:319.

Another function of GAM5346 is therefore inhibition of LOC284925 (Accession XP_209414.1). Accordingly, utilities of GAM5346 include diagnosis, prevention and treatment of diseases and clinical conditions associated with LOC284925.

LOC285192 (Accession XP_209508.3) is another GAM5346 target gene, herein designated TARGET GENE. LOC285192 BINDING SITE is a target binding site found in the 3' untranslated region of mRNA encoded by LOC285192, corresponding to a target binding site such as BINDING SITE I, BINDING SITE II or BINDING SITE III of FIG. 8. Table 4 illustrates the complementarity of the nucleotide sequences of LOC285192 BINDING SITE, designated SEQ ID:3929, to the nucleotide sequence of GAM5346 RNA, herein designated GAM RNA, also designated SEQ ID:319.

Another function of GAM5346 is therefore inhibition of LOC285192 (Accession XP_209508.3). Accordingly, utilities of GAM5346 include diagnosis, prevention and treatment of diseases and clinical conditions associated with LOC285192.

LOC285535 (Accession XP_211930.1) is another GAM5346 target gene, herein designated TARGET GENE. LOC285535 BINDING SITE is a target binding site found in the 3' untranslated region of mRNA encoded by LOC285535, corresponding to a target binding site such as BINDING SITE I, BINDING SITE II or BINDING SITE III of FIG. 8. Table 4 illustrates the complementarity of the nucleotide sequences of LOC285535 BINDING SITE, designated SEQ ID:5061, to the nucleotide sequence of GAM5346 RNA, herein designated GAM RNA, also designated SEQ ID:319.

Another function of GAM5346 is therefore inhibition of LOC285535 (Accession XP_211930.1). Accordingly, utilities of GAM5346 include diagnosis, prevention and treatment of diseases and clinical conditions associated with LOC285535.

LOC285822 (Accession XP_209777.1) is another GAM5346 target gene, herein designated TARGET GENE. LOC285822 BINDING SITE is a target binding site found in the 5' untranslated region of mRNA encoded by LOC285822, corresponding to a target binding site such as BINDING SITE I, BINDING SITE II or BINDING SITE III of FIG. 8. Table 4 illustrates the complementarity of the nucleotide sequences of LOC285822 BINDING SITE, designated SEQ ID:8268, to the nucleotide sequence of GAM5346 RNA, herein designated GAM RNA, also designated SEQ ID:319.

Another function of GAM5346 is therefore inhibition of LOC285822 (Accession XP_209777.1). Accordingly, utilities of GAM5346 include diagnosis, prevention and treatment of diseases and clinical conditions associated with LOC285822.

LOC285857 (Accession XP_212054.1) is another GAM5346 target gene, herein designated TARGET GENE. LOC285857 BINDING SITE is a target binding site found in the 3' untranslated region of mRNA encoded by LOC285857, corresponding to a target binding site such as BINDING SITE I, BINDING SITE II or BINDING SITE III of FIG. 8. Table 4 illustrates the complementarity of the nucleotide sequences of LOC285857 BINDING SITE, designated SEQ ID:1533, to the nucleotide sequence of GAM5346 RNA, herein designated GAM RNA, also designated SEQ ID:319.

Another function of GAM5346 is therefore inhibition of LOC285857 (Accession XP_212054.1). Accordingly, utilities of GAM5346 include diagnosis, prevention and treatment of diseases and clinical conditions associated with LOC285857.

LOC338558 (Accession XP_290465.1) is another GAM5346 target gene, herein designated TARGET GENE. LOC338558 BINDING SITE is a target binding site found in the 5' untranslated region of mRNA encoded by LOC338558, corresponding to a target binding site such as BINDING SITE I, BINDING SITE II or BINDING SITE III of FIG. 8. Table 4 illustrates the complementarity of the nucleotide sequences of LOC338558 BINDING SITE, designated SEQ ID:17259, to the nucleotide sequence of GAM5346 RNA, herein designated GAM RNA, also designated SEQ ID:319.

Another function of GAM5346 is therefore inhibition of LOC338558 (Accession XP_290465.1). Accordingly, utilities of GAM5346 include diagnosis, prevention and treatment of diseases and clinical conditions associated with LOC338558.

LOC339232 (Accession XP_294874.2) is another GAM5346 target gene, herein designated TARGET GENE. LOC339232 BINDING SITE is a target binding site found in the 5' untranslated region of mRNA encoded by LOC339232, corresponding to a target binding site such as BINDING SITE I, BINDING SITE II or BINDING SITE III of FIG. 8. Table 4 illustrates the complementarity of the nucleotide sequences of LOC339232 BINDING SITE, designated SEQ ID:11810, to the nucleotide sequence of GAM5346 RNA, herein designated GAM RNA, also designated SEQ ID:319.

Another function of GAM5346 is therefore inhibition of LOC339232 (Accession XP_294874.2). Accordingly, utilities of GAM5346 include diagnosis, prevention and treatment of diseases and clinical conditions associated with LOC339232.

LOC339829 (Accession XP_291028.1) is another GAM5346 target gene, herein designated TARGET GENE. LOC339829 BINDING SITE is a target binding site found in the 3' untranslated region of mRNA encoded by LOC339829, corresponding to a target binding site such as BINDING SITE I, BINDING SITE II or BINDING SITE III of FIG. 8. Table 4 illustrates the complementarity of the nucleotide sequences of LOC339829 BINDING SITE, designated SEQ ID:6647, to the nucleotide sequence of GAM5346 RNA, herein designated GAM RNA, also designated SEQ ID:319.

Another function of GAM5346 is therefore inhibition of LOC339829 (Accession XP_291028.1). Accordingly, utilities of GAM5346 include diagnosis, prevention and treatment of diseases and clinical conditions associated with LOC339829.

LOC340074 (Accession XP_295148.1) is another GAM5346 target gene, herein designated TARGET GENE. LOC340074 BINDING SITE is a target binding site found in the 3' untranslated region of mRNA encoded by LOC340074, corresponding to a target binding site such as BINDING SITE I, BINDING SITE II or BINDING SITE III of FIG. 8. Table 4 illustrates the complementarity of the nucleotide sequences of LOC340074 BINDING SITE, designated SEQ ID:15029, to the nucleotide sequence of GAM5346 RNA, herein designated GAM RNA, also designated SEQ ID:319.

Another function of GAM5346 is therefore inhibition of LOC340074 (Accession XP_295148.1). Accordingly, utilities of GAM5346 include diagnosis, prevention and treatment of diseases and clinical conditions associated with LOC340074.

LOC340113 (Accession XP_295157.1) is another GAM5346 target gene, herein designated TARGET GENE. LOC340113 BINDING SITE is a target binding site found in the 3' untranslated region of mRNA encoded by LOC340113, corresponding to a target binding site such as BINDING SITE I, BINDING SITE II or BINDING SITE III of FIG. 8. Table 4 illustrates the complementarity of the nucleotide sequences of LOC340113 BINDING SITE, designated SEQ ID:16181, to the nucleotide sequence of GAM5346 RNA, herein designated GAM RNA, also designated SEQ ID:319.

Another function of GAM5346 is therefore inhibition of LOC340113 (Accession XP_295157.1). Accordingly, utilities of GAM5346 include diagnosis, prevention and treatment of diseases and clinical conditions associated with LOC340113.

LOC343699 (Accession XP_293153.2) is another GAM5346 target gene, herein designated TARGET GENE. LOC343699 BINDING SITE is a target binding site found in the 5' untranslated region of mRNA encoded by LOC343699, corresponding to a target binding site such as BINDING SITE I, BINDING SITE II or BINDING SITE III of FIG. 8. Table 4 illustrates the complementarity of the nucleotide sequences of LOC343699 BINDING SITE, designated SEQ ID:11126, to the nucleotide sequence of GAM5346 RNA, herein designated GAM RNA, also designated SEQ ID:319.

Another function of GAM5346 is therefore inhibition of LOC343699 (Accession XP_293153.2). Accordingly, utilities of GAM5346 include diagnosis, prevention and treatment of diseases and clinical conditions associated with LOC343699.

LOC346178 (Accession XP_294100.1) is another GAM5346 target gene, herein designated TARGET GENE. LOC346178 BINDING SITE is a target binding site found in the 5' untranslated region of mRNA encoded by LOC346178, corresponding to a target binding site such as BINDING SITE I, BINDING SITE II or BINDING SITE III of FIG. 8. Table 4 illustrates the complementarity of the nucleotide sequences of LOC346178 BINDING SITE, designated SEQ ID:11727, to the nucleotide sequence of GAM5346 RNA, herein designated GAM RNA, also designated SEQ ID:319.

Another function of GAM5346 is therefore inhibition of LOC346178 (Accession XP_294100.1). Accordingly, utilities of GAM5346 include diagnosis, prevention and treatment of diseases and clinical conditions associated with LOC346178.

LOC347926 (Accession XP_302628.1) is another GAM5346 target gene, herein designated TARGET GENE. LOC347926 BINDING SITE is a target binding site found in the 3' untranslated region of mRNA encoded by LOC347926, corresponding to a target binding site such as BINDING SITE I, BINDING SITE II or BINDING SITE III of FIG. 8. Table 4 illustrates the complementarity of the nucleotide sequences of LOC347926 BINDING SITE, designated SEQ ID:17961, to the nucleotide sequence of GAM5346 RNA, herein designated GAM RNA, also designated SEQ ID:319.

Another function of GAM5346 is therefore inhibition of LOC347926 (Accession XP_302628.1). Accordingly, utilities of GAM5346 include diagnosis, prevention and treatment of diseases and clinical conditions associated with LOC347926.

LOC348174 (Accession XP_300648.1) is another GAM5346 target gene, herein designated TARGET GENE. LOC348174 BINDING SITE is a target binding site found in the 3' untranslated region of mRNA encoded by LOC348174, corresponding to a target binding site such as BINDING SITE I, BINDING SITE II or BINDING SITE III of FIG. 8. Table 4 illustrates the complementarity of the nucleotide sequences of LOC348174 BINDING SITE, designated SEQ ID:1883, to the nucleotide sequence of GAM5346 RNA, herein designated GAM RNA, also designated SEQ ID:319.

Another function of GAM5346 is therefore inhibition of LOC348174 (Accession XP_300648.1). Accordingly, utilities of GAM5346 include diagnosis, prevention and treatment of diseases and clinical conditions associated with LOC348174.

LOC348798 (Accession XP_300845.1) is another GAM5346 target gene, herein designated TARGET GENE. LOC348798 BINDING SITE is a target binding site found in the 3' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:10026, to the nucleotide sequence of GAM5346 RNA, herein designated GAM RNA, also designated SEQ ID:319.

Another function of GAM5346 is therefore inhibition of LOC348798 (Accession XP_300845.1). Accordingly, utilities of GAM5346 include diagnosis, prevention and treatment of diseases and clinical conditions associated with LOC348798.

LOC349288 (Accession XP_300476.1) is another GAM5346 target gene, herein designated TARGET GENE. LOC349288 BINDING SITE is a target binding site found in the 5' untranslated region of mRNA encoded by LOC349288, corresponding to a target binding site such as BINDING SITE I, BINDING SITE II or BINDING SITE III of FIG. 8. Table 4 illustrates the complementarity of the nucleotide sequences of LOC349288 BINDING SITE, designated SEQ ID:6413, to the nucleotide sequence of GAM5346 RNA, herein designated GAM RNA, also designated SEQ ID:319.

Another function of GAM5346 is therefore inhibition of LOC349288 (Accession XP_300476.1). Accordingly, utilities of GAM5346 include diagnosis, prevention and treatment of diseases and clinical conditions associated with LOC349288.

LOC93273 (Accession XP_050184.1) is another GAM5346 target gene, herein designated TARGET GENE. LOC93273 BINDING SITE is a target binding site found in the 5' untranslated region of mRNA encoded by LOC93273, corresponding to a target binding site such as BINDING SITE I, BINDING SITE II or BINDING SITE III of FIG. 8. Table 4 illustrates the complementarity of the nucleotide sequences of LOC93273 BINDING SITE, designated SEQ ID:4336, to the nucleotide sequence of GAM5346 RNA, herein designated GAM RNA, also designated SEQ ID:319.

Another function of GAM5346 is therefore inhibition of LOC93273 (Accession XP_050184.1). Accordingly, utilities of GAM5346 include diagnosis, prevention and treatment of diseases and clinical conditions associated with LOC93273.

MAGEC3 (Accession NP_803251.1) is another GAM5346 target gene, herein designated TARGET GENE. MAGEC3 BINDING SITE is a target binding site found in the 5' untranslated region of mRNA encoded by MAGEC3, corresponding to a target binding site such as BINDING SITE I, BINDING SITE II or BINDING SITE III of FIG. 8. Table 4 illustrates the complementarity of the nucleotide sequences of MAGEC3 BINDING SITE, designated SEQ ID:17747, to the nucleotide sequence of GAM5346 RNA, herein designated GAM RNA, also designated SEQ ID:319.

Another function of GAM5346 is therefore inhibition of MAGEC3 (Accession NP_803251.1). Accordingly, utilities of GAM5346 include diagnosis, prevention and treatment of diseases and clinical conditions associated with MAGEC3.

Mitogen-activated protein kinase kinase kinase 7 interacting protein 2 (MAP3K7IP2, Accession NP_055908.1) is another GAM5346 target gene, herein designated TARGET GENE. MAP3K7IP2 BINDING SITE is a target binding site found in the 3' untranslated region of multiple transcripts of mRNA encoded by MAP3K7IP2, corresponding to a target binding site such as BINDING SITE I, BINDING SITE II or BINDING SITE III of FIG. 8. Table 4 illustrates the complementarity of the nucleotide sequences of MAP3K7IP2 BINDING SITE, designated SEQ ID:1518, to the nucleotide sequence of GAM5346 RNA, herein designated GAM RNA, also designated SEQ ID:319.

Another function of GAM5346 is therefore inhibition of Mitogen-activated protein kinase kinase kinase 7 interacting protein 2 (MAP3K7IP2, Accession NP_055908.1). Accordingly, utilities of GAM5346 include diagnosis, prevention and treatment of diseases and clinical conditions associated with MAP3K7IP2.

Mitogen-activated protein kinase kinase kinase 7 interacting protein 2 (MAP3K7IP2, Accession NP_663317.1) is another GAM5346 target gene, herein designated TARGET GENE. MAP3K7IP2 BINDING SITE is a target binding site found in the 3' untranslated region of multiple transcripts of mRNA encoded by MAP3K7IP2, corresponding to a target binding site such as BINDING SITE I, BINDING SITE II or BINDING SITE III of FIG. 8. Table 4 illustrates the complementarity of the nucleotide sequences of MAP3K7IP2 BINDING SITE, designated SEQ ID:1518, to the nucleotide sequence of GAM5346 RNA, herein designated GAM RNA, also designated SEQ ID:319.

Another function of GAM5346 is therefore inhibition of Mitogen-activated protein kinase kinase kinase 7 interacting protein 2 (MAP3K7IP2, Accession NP_663317.1). Accordingly, utilities of GAM5346 include diagnosis, prevention and treatment of diseases and clinical conditions associated with MAP3K7IP2.

Mcm6 minichromosome maintenance deficient 6 (mis5 homolog, s. pombe) (s. cerevisiae) (MCM6, Accession NP_005906.2) is another GAM5346 target gene, herein designated TARGET GENE. MCM6 BINDING SITE is a target binding site found in the 3' untranslated region of mRNA encoded by MCM6, corresponding to a target binding site such as BINDING SITE I, BINDING SITE II or BINDING SITE III of FIG. 8. Table 4 illustrates the complementarity of the nucleotide sequences of MCM6 BINDING SITE, designated SEQ ID:7000, to the nucleotide sequence of GAM5346 RNA, herein designated GAM RNA, also designated SEQ ID:319.

Another function of GAM5346 is therefore inhibition of Mcm6 minichromosome maintenance deficient 6 (mis5 homolog, s. pombe) (s. cerevisiae) (MCM6, Accession NP_005906.2). Accordingly, utilities of GAM5346 include diagnosis, prevention and treatment of diseases and clinical conditions associated with MCM6.

Methyl cpg binding protein 2 (rett syndrome) (MECP2, Accession NP_004983.1) is another GAM5346 target gene, herein designated TARGET GENE. MECP2 BINDING SITE is a target binding site found in the 3' untranslated region of mRNA encoded by MECP2, corresponding to a target binding site such as BINDING SITE I, BINDING SITE II or BINDING SITE III of FIG. 8. Table 4 illustrates the complementarity of the nucleotide sequences of MECP2 BINDING SITE, designated SEQ ID:17727, to the nucleotide sequence of GAM5346 RNA, herein designated GAM RNA, also designated SEQ ID:319.

Another function of GAM5346 is therefore inhibition of Methyl cpg binding protein 2 (rett syndrome) (MECP2, Accession NP_004983.1). Accordingly, utilities of GAM5346 include diagnosis, prevention and treatment of diseases and clinical conditions associated with MECP2.

MGC13198 (Accession NP_116079.1) is another GAM5346 target gene, herein designated TARGET GENE. MGC13198 BINDING SITE is a target binding site found in the 5' untranslated region of mRNA encoded by MGC13198, corresponding to a target binding site such as BINDING SITE I, BINDING SITE II or BINDING SITE III of FIG. 8. Table 4 illustrates the complementarity of the nucleotide sequences of MGC13198 BINDING SITE, designated SEQ ID:14308, to the nucleotide sequence of GAM5346 RNA, herein designated GAM RNA, also designated SEQ ID:319.

Another function of GAM5346 is therefore inhibition of MGC13198 (Accession NP_116079.1). Accordingly, utilities of GAM5346 include diagnosis, prevention and treatment of diseases and clinical conditions associated with MGC13198.

MGC16385 (Accession NP_659476.1) is another GAM5346 target gene, herein designated TARGET GENE. MGC16385 BINDING SITE is a target binding site found in the 3' untranslated region of mRNA encoded by MGC16385, corresponding to a target binding site such as BINDING SITE I, BINDING SITE II or BINDING SITE III of FIG. 8. Table 4 illustrates the complementarity of the nucleotide sequences of MGC16385 BINDING SITE, designated SEQ ID:14308, to the nucleotide sequence of GAM5346 RNA, herein designated GAM RNA, also designated SEQ ID:319.

Another function of GAM5346 is therefore inhibition of MGC16385 (Accession NP_659476.1). Accordingly, utilities of GAM5346 include diagnosis, prevention and treatment of diseases and clinical conditions associated with MGC16385.

MGC34761 (Accession NP_775890.1) is another GAM5346 target gene, herein designated TARGET GENE. MGC34761 BINDING SITE is a target binding site found in the 3' untranslated region of mRNA encoded by MGC34761, corresponding to a target binding site such as BINDING SITE I, BINDING SITE II or BINDING SITE III of FIG. 8. Table 4 illustrates the complementarity of the nucleotide sequences of MGC34761 BINDING SITE, designated SEQ ID:1883, to the nucleotide sequence of GAM5346 RNA, herein designated GAM RNA, also designated SEQ ID:319.

Another function of GAM5346 is therefore inhibition of MGC34761 (Accession NP_775890.1). Accordingly, utilities of GAM5346 include diagnosis, prevention and treatment of diseases and clinical conditions associated with MGC34761.

MGC45726 (Accession NP_689777.1) is another GAM5346 target gene, herein designated TARGET GENE. MGC45726 BINDING SITE is a target binding site found in the 5' untranslated region of mRNA encoded by MGC45726, corresponding to a target binding site such as BINDING SITE I, BINDING SITE II or BINDING SITE III of FIG. 8. Table 4 illustrates the complementarity of the nucleotide sequences of MGC45726 BINDING SITE, designated SEQ ID:10845, to the nucleotide sequence of GAM5346 RNA, herein designated GAM RNA, also designated SEQ ID:319.

Another function of GAM5346 is therefore inhibition of MGC45726 (Accession NP_689777.1). Accordingly, utilities of GAM5346 include diagnosis, prevention and treatment of diseases and clinical conditions associated with MGC45726.

MGC5528 (Accession NP_076999.1) is another GAM5346 target gene, herein designated TARGET GENE. MGC5528 BINDING SITE is a target binding site found in the 3' untranslated region of mRNA encoded by MGC5528, corresponding to a target binding site such as BINDING SITE I, BINDING SITE II or BINDING SITE III of FIG. 8. Table 4 illustrates the complementarity of the nucleotide sequences of MGC5528 BINDING SITE, designated SEQ ID:600, to the nucleotide sequence of GAM5346 RNA, herein designated GAM RNA, also designated SEQ ID:319.

Another function of GAM5346 is therefore inhibition of MGC5528 (Accession NP_076999.1). Accordingly, utilities of GAM5346 include diagnosis, prevention and treatment of diseases and clinical conditions associated with MGC5528.

MI-ER1 (Accession NP_065999.1) is another GAM5346 target gene, herein designated TARGET GENE. MI-ER1 BINDING SITE is a target binding site found in the 3' untranslated region of mRNA encoded by MI-ER1, corresponding to a target binding site such as BINDING SITE I, BINDING SITE II or BINDING SITE III of FIG. 8. Table 4 illustrates the complementarity of the nucleotide sequences of MI-ER1 BINDING SITE, designated SEQ ID:3518, to the nucleotide sequence of GAM5346 RNA, herein designated GAM RNA, also designated SEQ ID:319.

Another function of GAM5346 is therefore inhibition of MI-ER1 (Accession NP_065999.1). Accordingly, utilities of GAM5346 include diagnosis, prevention and treatment of diseases and clinical conditions associated with MI-ER1.

Membrane metallo-endopeptidase (neutral endopeptidase, enkephalinase, calla, cd10) (MME, Accession NP_009219.1) is another GAM5346 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:4799, to the nucleotide sequence of GAM5346 RNA, herein designated GAM RNA, also designated SEQ ID:319.

Another function of GAM5346 is therefore inhibition of Membrane metallo-endopeptidase (neutral endopeptidase, enkephalinase, calla, cd10) (MME, Accession NP_009219.1), a gene which is thermolysin-like specificity. and therefore is associated with Acute lymphocytic leukemia. Accordingly, utilities of GAM5346 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_009220.1) is another GAM5346 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:4799, to the nucleotide sequence of GAM5346 RNA, herein designated GAM RNA, also designated SEQ ID:319.

Another function of GAM5346 is therefore inhibition of Membrane metallo-endopeptidase (neutral endopeptidase, enkephalinase, calla, cd10) (MME, Accession NP_009220.1), a gene which is thermolysin-like specificity. and therefore is associated with Acute lymphocytic leukemia. Accordingly, utilities of GAM5346 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_009218.1) is another GAM5346 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:4799, to the nucleotide sequence of GAM5346 RNA, herein designated GAM RNA, also designated SEQ ID:319.

Another function of GAM5346 is therefore inhibition of Membrane metallo-endopeptidase (neutral endopeptidase, enkephalinase, calla, cd10) (MME, Accession NP_009218.1), a gene which is thermolysin-like specificity. and therefore is associated with Acute lymphocytic leukemia. Accordingly, utilities of GAM5346 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_000893.1) is another GAM5346 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:4799, to the nucleotide sequence of GAM5346 RNA, herein designated GAM RNA, also designated SEQ ID:319.

Another function of GAM5346 is therefore inhibition of Membrane metallo-endopeptidase (neutral endopeptidase, enkephalinase, calla, cd10) (MME, Accession NP_000893.1), a gene which is thermolysin-like specificity. and therefore is associated with Acute lymphocytic leukemia. Accordingly, utilities of GAM5346 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Myogenic factor 5 (MYF5, Accession NP_005584.1) is another GAM5346 target gene, herein designated TARGET GENE. MYF5 BINDING SITE is a target binding site found in the 3' untranslated region of mRNA encoded by MYF5, corresponding to a target binding site such as BINDING SITE I, BINDING SITE II or BINDING SITE III of FIG. 8. Table 4 illustrates the complementarity of the nucleotide sequences of MYF5 BINDING SITE, designated SEQ ID:4931, to the nucleotide sequence of GAM5346 RNA, herein designated GAM RNA, also designated SEQ ID:319.

Another function of GAM5346 is therefore inhibition of Myogenic factor 5 (MYF5, Accession NP_005584.1), a gene which is involved in muscle differentiation and induces fibroblasts to differentiate into myoblasts. Accordingly, utilities of GAM5346 include diagnosis, prevention and treatment of diseases and clinical conditions associated with MYF5.

The function of MYF5 and its association with various diseases and clinical conditions, has been established by previous studies, as described hereinabove with reference to GAM1906.1. Notch homolog 2 (drosophila) (NOTCH2, Accession NP_077719.2) is another GAM5346 target gene, herein designated TARGET GENE. NOTCH2 BINDING SITE is a target binding site found in the 3' untranslated region of mRNA encoded by NOTCH2, corresponding to a target binding site such as BINDING SITE I, BINDING SITE II or BINDING SITE III of FIG. 8. Table 4 illustrates the complementarity of the nucleotide sequences of NOTCH2 BINDING SITE, designated SEQ ID:5941, to the nucleotide sequence of GAM5346 RNA, herein designated GAM RNA, also designated SEQ ID:319.

Another function of GAM5346 is therefore inhibition of Notch homolog 2 (drosophila) (NOTCH2, Accession NP_077719.2), a gene which is moderately similar to a region of murine Notch1 and contains an ankyrin repeat. Accordingly, utilities of GAM5346 include diagnosis, prevention and treatment of diseases and clinical conditions associated with NOTCH2.

The function of NOTCH2 and its association with various diseases and clinical conditions, has been established by previous studies, as described hereinabove with reference to GAM47.1. NSE1 (Accession NP_660158.1) is another GAM5346 target gene, herein designated TARGET GENE. NSE1 BINDING SITE is a target binding site found in the 3' untranslated region of multiple transcripts of mRNA encoded by NSE1, corresponding to a target binding site such as BINDING SITE I, BINDING SITE II or BINDING SITE III of FIG. 8. Table 4 illustrates the complementarity of the nucleotide sequences of NSE1 BINDING SITE, designated SEQ ID:7984, to the nucleotide sequence of GAM5346 RNA, herein designated GAM RNA, also designated SEQ ID:319.

Another function of GAM5346 is therefore inhibition of NSE1 (Accession NP_660158.1). Accordingly, utilities of GAM5346 include diagnosis, prevention and treatment of diseases and clinical conditions associated with NSE1.

NYD-SP14 (Accession NP_114162.1) is another GAM5346 target gene, herein designated TARGET GENE. NYD-SP14 BINDING SITE is a target binding site found in the 5' untranslated region of mRNA encoded by NYD-SP14, corresponding to a target binding site such as BINDING SITE I, BINDING SITE II or BINDING SITE III of FIG. 8. Table 4 illustrates the complementarity of the nucleotide sequences of NYD-SP14 BINDING SITE, designated SEQ ID:17669, to the nucleotide sequence of GAM5346 RNA, herein designated GAM RNA, also designated SEQ ID:319.

Another function of GAM5346 is therefore inhibition of NYD-SP14 (Accession NP_114162.1). Accordingly, utilities of GAM5346 include diagnosis, prevention and treatment of diseases and clinical conditions associated with NYD-SP14.

Orthodenticle homolog 3 (drosophila) (OTX3, Accession NP_757379.1) is another GAM5346 target gene, herein designated TARGET GENE. OTX3 BINDING SITE is a target binding site found in the 3' untranslated region of multiple transcripts of mRNA encoded by OTX3, corresponding to a target binding site such as BINDING SITE I, BINDING SITE II or BINDING SITE III of FIG. 8. Table 4 illustrates the complementarity of the nucleotide sequences of OTX3 BINDING SITE, designated SEQ ID:7260, to the nucleotide sequence of GAM5346 RNA, herein designated GAM RNA, also designated SEQ ID:319.

Another function of GAM5346 is therefore inhibition of Orthodenticle homolog 3 (drosophila) (OTX3, Accession NP_757379.1). Accordingly, utilities of GAM5346 include diagnosis, prevention and treatment of diseases and clinical conditions associated with OTX3.

Orthodenticle homolog 3 (drosophila) (OTX3, Accession NP_671725.1) is another GAM5346 target gene, herein designated TARGET GENE. OTX3 BINDING SITE is a target binding site found in the 3' untranslated region of multiple transcripts of mRNA encoded by OTX3, corresponding to a target binding site such as BINDING SITE I, BINDING SITE II or BINDING SITE III of FIG. 8. Table 4 illustrates the complementarity of the nucleotide sequences of OTX3 BINDING SITE, designated SEQ ID:7260, to the nucleotide sequence of GAM5346 RNA, herein designated GAM RNA, also designated SEQ ID:319.

Another function of GAM5346 is therefore inhibition of Orthodenticle homolog 3 (drosophila) (OTX3, Accession NP_671725.1). Accordingly, utilities of GAM5346 include diagnosis, prevention and treatment of diseases and clinical conditions associated with OTX3.

Pantothenate kinase 2 (hallervorden-spatz syndrome) (PANK2, Accession NP_705903.1) is another GAM5346 target gene, herein designated TARGET GENE. PANK2 BINDING SITE is a target binding site found in the 3' untranslated region of multiple transcripts of mRNA encoded by PANK2, corresponding to a target binding site such as BINDING SITE I, BINDING SITE II or BINDING SITE III of FIG. 8. Table 4 illustrates the complementarity of the nucleotide sequences of PANK2 BINDING SITE, designated SEQ ID:15989, to the nucleotide sequence of GAM5346 RNA, herein designated GAM RNA, also designated SEQ ID:319.

Another function of GAM5346 is therefore inhibition of Pantothenate kinase 2 (hallervorden-spatz syndrome) (PANK2, Accession NP_705903.1). Accordingly, utilities of GAM5346 include diagnosis, prevention and treatment of diseases and clinical conditions associated with PANK2.

Proteasome (prosome, macropain) 26s subunit, non-atpase, 8 (PSMD8, Accession NP_002803.1) is another GAM5346 target gene, herein designated TARGET GENE. PSMD8 BINDING SITE is a target binding site found in the 5' untranslated region of mRNA encoded by PSMD8, corresponding to a target binding site such as BINDING SITE I, BINDING SITE II or BINDING SITE III of FIG. 8. Table 4 illustrates the complementarity of the nucleotide sequences of PSMD8 BINDING SITE, designated SEQ ID:19154, to the nucleotide sequence of GAM5346 RNA, herein designated GAM RNA, also designated SEQ ID:319.

Another function of GAM5346 is therefore inhibition of Proteasome (prosome, macropain) 26s subunit, non-atpase, 8 (PSMD8, Accession NP_002803.1). Accordingly, utilities of GAM5346 include diagnosis, prevention and treatment of diseases and clinical conditions associated with PSMD8.

Polypyrimidine tract binding protein 1 (PTBP1, Accession NP_002810.1) is another GAM5346 target gene, herein designated TARGET GENE. PTBP1 BINDING SITE is a target binding site found in the 3' untranslated region of multiple transcripts of mRNA encoded by PTBP1, corresponding to a target binding site such as BINDING SITE I, BINDING SITE II or BINDING SITE III of FIG. 8. Table 4 illustrates the complementarity of the nucleotide sequences of PTBP1 BINDING SITE, designated SEQ ID:18181, to the nucleotide sequence of GAM5346 RNA, herein designated GAM RNA, also designated SEQ ID:319.

Another function of GAM5346 is therefore inhibition of Polypyrimidine tract binding protein 1 (PTBP1, Accession NP_002810.1), a gene which is required for pre-mRNA splicing, and acts via the protein degradation ubiquitin- proteasome pathway. Accordingly, utilities of GAM5346 include diagnosis, prevention and treatment of diseases and clinical conditions associated with PTBP1.

The function of PTBP1 and its association with various diseases and clinical conditions, has been established by previous studies, as described hereinabove with reference to GAM354.1. Polypyrimidine tract binding protein 1 (PTBP1, Accession NP_114367.1) is another GAM5346 target gene, herein designated TARGET GENE. PTBP1 BINDING SITE is a target binding site found in the 3' untranslated region of multiple transcripts of mRNA encoded by PTBP1, corresponding to a target binding site such as BINDING SITE I, BINDING SITE II or BINDING SITE III of FIG. 8. Table 4 illustrates the complementarity of the nucleotide sequences of PTBP1 BINDING SITE, designated SEQ ID:18181, to the nucleotide sequence of GAM5346 RNA, herein designated GAM RNA, also designated SEQ ID:319.

Another function of GAM5346 is therefore inhibition of Polypyrimidine tract binding protein 1 (PTBP1, Accession NP_114367.1), a gene which is required for pre-mRNA splicing, and acts via the protein degradation ubiquitin- proteasome pathway. Accordingly, utilities of GAM5346 include diagnosis, prevention and treatment of diseases and clinical conditions associated with PTBP1.

The function of PTBP1 and its association with various diseases and clinical conditions, has been established by previous studies, as described hereinabove with reference to GAM354.1. Polypyrimidine tract binding protein 1 (PTBP1, Accession NP_114368.1) is another GAM5346 target gene, herein designated TARGET GENE. PTBP1 BINDING SITE is a target binding site found in the 3' untranslated region of multiple transcripts of mRNA encoded by PTBP1, corresponding to a target binding site such as BINDING SITE I, BINDING SITE II or BINDING SITE III of FIG. 8. Table 4 illustrates the complementarity of the nucleotide sequences of PTBP1 BINDING SITE, designated SEQ ID:18181, to the nucleotide sequence of GAM5346 RNA, herein designated GAM RNA, also designated SEQ ID:319.

Another function of GAM5346 is therefore inhibition of Polypyrimidine tract binding protein 1 (PTBP1, Accession NP_114368.1), a gene which is required for pre-mRNA splicing, and acts via the protein degradation ubiquitin- proteasome pathway. Accordingly, utilities of GAM5346 include diagnosis, prevention and treatment of diseases and clinical conditions associated with PTBP1.

The function of PTBP1 and its association with various diseases and clinical conditions, has been established by previous studies, as described hereinabove with reference to GAM354.1. Polypyrimidine tract binding protein 1 (PTBP1, Accession NP_787041.1) is another GAM5346 target gene, herein designated TARGET GENE. PTBP1 BINDING SITE is a target binding site found in the 3' untranslated region of multiple transcripts of mRNA encoded by PTBP1, corresponding to a target binding site such as BINDING SITE I, BINDING SITE II or BINDING SITE III of FIG. 8. Table 4 illustrates the complementarity of the nucleotide sequences of PTBP1 BINDING SITE, designated SEQ ID:18181, to the nucleotide sequence of GAM5346 RNA, herein designated GAM RNA, also designated SEQ ID:319.

Another function of GAM5346 is therefore inhibition of Polypyrimidine tract binding protein 1 (PTBP1, Accession NP_787041.1), a gene which is required for pre-mRNA splicing, and acts via the protein degradation ubiquitin- proteasome pathway. Accordingly, utilities of GAM5346 include diagnosis, prevention and treatment of diseases and clinical conditions associated with PTBP1.

The function of PTBP1 and its association with various diseases and clinical conditions, has been established by previous studies, as described hereinabove with reference to GAM354.1. Prostaglandin i2 (prostacyclin) synthase (PTGIS, Accession NP_000952.1) is another GAM5346 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:9392, to the nucleotide sequence of GAM5346 RNA, herein designated GAM RNA, also designated SEQ ID:319.

Another function of GAM5346 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM5346 include diagnosis, prevention and treatment of diseases and clinical conditions associated with PTGIS.

The function of PTGIS and its association with various diseases and clinical conditions, has been established by previous studies, as described hereinabove with reference to GAM30.1. SH3YL1 (Accession NP_056492.1) is another GAM5346 target gene, herein designated TARGET GENE. SH3YL1 BINDING SITE is a target binding site found in the 3' untranslated region of mRNA encoded by SH3YL1, corresponding to a target binding site such as BINDING SITE I, BINDING SITE II or BINDING SITE III of FIG. 8. Table 4 illustrates the complementarity of the nucleotide sequences of SH3YL1 BINDING SITE, designated SEQ ID:16719, to the nucleotide sequence of GAM5346 RNA, herein designated GAM RNA, also designated SEQ ID:319.

Another function of GAM5346 is therefore inhibition of SH3YL1 (Accession NP_056492.1). Accordingly, utilities of GAM5346 include diagnosis, prevention and treatment of diseases and clinical conditions associated with SH3YL1.

Signal-regulatory protein beta 2 (SIRPB2, Accession NP_061026.1) is another GAM5346 target gene, herein designated TARGET GENE. SIRPB2 BINDING SITE is a target binding site found in the 5' untranslated region of multiple transcripts of mRNA encoded by SIRPB2, corresponding to a target binding site such as BINDING SITE I, BINDING SITE II or BINDING SITE III of FIG. 8. Table 4 illustrates the complementarity of the nucleotide sequences of SIRPB2 BINDING SITE, designated SEQ ID:17134, to the nucleotide sequence of GAM5346 RNA, herein designated GAM RNA, also designated SEQ ID:319.

Another function of GAM5346 is therefore inhibition of Signal-regulatory protein beta 2 (SIRPB2, Accession NP_061026.1). Accordingly, utilities of GAM5346 include diagnosis, prevention and treatment of diseases and clinical conditions associated with SIRPB2.

Signal-regulatory protein beta 2 (SIRPB2, Accession NP_543006.1) is another GAM5346 target gene, herein designated TARGET GENE. SIRPB2 BINDING SITE is a target binding site found in the 5' untranslated region of multiple transcripts of mRNA encoded by SIRPB2, corresponding to a target binding site such as BINDING SITE I, BINDING SITE II or BINDING SITE III of FIG. 8. Table 4 illustrates the complementarity of the nucleotide sequences of SIRPB2 BINDING SITE, designated SEQ ID:17134, to the nucleotide sequence of GAM5346 RNA, herein designated GAM RNA, also designated SEQ ID:319.

Another function of GAM5346 is therefore inhibition of Signal-regulatory protein beta 2 (SIRPB2, Accession NP_543006.1). Accordingly, utilities of GAM5346 include diagnosis, prevention and treatment of diseases and clinical conditions associated with SIRPB2.

Telomeric repeat binding factor 2 (TERF2, Accession NP_005643.1) is another GAM5346 target gene, herein designated TARGET GENE. TERF2 BINDING SITE is a target binding site found in the 3' untranslated region of mRNA encoded by TERF2, corresponding to a target binding site such as BINDING SITE I, BINDING SITE II or BINDING SITE III of FIG. 8. Table 4 illustrates the complementarity of the nucleotide sequences of TERF2 BINDING SITE, designated SEQ ID:2418, to the nucleotide sequence of GAM5346 RNA, herein designated GAM RNA, also designated SEQ ID:319.

Another function of GAM5346 is therefore inhibition of Telomeric repeat binding factor 2 (TERF2, Accession NP_005643.1), a gene which plays a key role in the protective activity of telomeres. Accordingly, utilities of GAM5346 include diagnosis, prevention and treatment of diseases and clinical conditions associated with TERF2.

The function of TERF2 and its association with various diseases and clinical conditions, has been established by previous studies, as described hereinabove with reference to GAM133.2. TRAD (Accession NP_008995.1) is another GAM5346 target gene, herein designated TARGET GENE. TRAD BINDING SITE is a target binding site found in the 3' untranslated region of mRNA encoded by TRAD, corresponding to a target binding site such as BINDING SITE I, BINDING SITE II or BINDING SITE III of FIG. 8. Table 4 illustrates the complementarity of the nucleotide sequences of TRAD BINDING SITE, designated SEQ ID:2049, to the nucleotide sequence of GAM5346 RNA, herein designated GAM RNA, also designated SEQ ID:319.

Another function of GAM5346 is therefore inhibition of TRAD (Accession NP_008995.1). Accordingly, utilities of GAM5346 include diagnosis, prevention and treatment of diseases and clinical conditions associated with TRAD.

Ubiquitin specific protease 24 (USP24, Accession XP_165973.3) is another GAM5346 target gene, herein designated TARGET GENE. USP24 BINDING SITE is a target binding site found in the 3' untranslated region of mRNA encoded by USP24, corresponding to a target binding site such as BINDING SITE I, BINDING SITE II or BINDING SITE III of FIG. 8. Table 4 illustrates the complementarity of the nucleotide sequences of USP24 BINDING SITE, designated SEQ ID:17338, to the nucleotide sequence of GAM5346 RNA, herein designated GAM RNA, also designated SEQ ID:319.

Another function of GAM5346 is therefore inhibition of Ubiquitin specific protease 24 (USP24, Accession XP_165973.3). Accordingly, utilities of GAM5346 include diagnosis, prevention and treatment of diseases and clinical conditions associated with USP24.

Zinc finger protein 254 (ZNF254, Accession NP_004867.1) is another GAM5346 target gene, herein designated TARGET GENE. ZNF254 BINDING SITE is a target binding site found in the 3' untranslated region of mRNA encoded by ZNF254, corresponding to a target binding site such as BINDING SITE I, BINDING SITE II or BINDING SITE III of FIG. 8. Table 4 illustrates the complementarity of the nucleotide sequences of ZNF254 BINDING SITE, designated SEQ ID:9378, to the nucleotide sequence of GAM5346 RNA, herein designated GAM RNA, also designated SEQ ID:319.

Another function of GAM5346 is therefore inhibition of Zinc finger protein 254 (ZNF254, Accession NP_004867.1). Accordingly, utilities of GAM5346 include diagnosis, prevention and treatment of diseases and clinical conditions associated with ZNF254.

Zinc finger protein 255 (ZNF255, Accession NP_005765.1) is another GAM5346 target gene, herein designated TARGET GENE. ZNF255 BINDING SITE is a target binding site found in the 5' untranslated region of mRNA encoded by ZNF255, corresponding to a target binding site such as BINDING SITE I, BINDING SITE II or BINDING SITE III of FIG. 8. Table 4 illustrates the complementarity of the nucleotide sequences of ZNF255 BINDING SITE, designated SEQ ID:2601, to the nucleotide sequence of GAM5346 RNA, herein designated GAM RNA, also designated SEQ ID:319.

Another function of GAM5346 is therefore inhibition of Zinc finger protein 255 (ZNF255, Accession NP_005765.1). Accordingly, utilities of GAM5346 include diagnosis, prevention and treatment of diseases and clinical conditions associated with ZNF255.

ZNF431 (Accession XP_086098.2) is another GAM5346 target gene, herein designated TARGET GENE. ZNF431 BINDING SITE is a target binding site found in the 3' untranslated region of mRNA encoded by ZNF431, corresponding to a target binding site such as BINDING SITE I, BINDING SITE II or BINDING SITE III of FIG. 8. Table 4 illustrates the complementarity of the nucleotide sequences of ZNF431 BINDING SITE, designated SEQ ID:9162, to the nucleotide sequence of GAM5346 RNA, herein designated GAM RNA, also designated SEQ ID:319.

Another function of GAM5346 is therefore inhibition of ZNF431 (Accession XP_086098.2). Accordingly, utilities of GAM5346 include diagnosis, prevention and treatment of diseases and clinical conditions associated with ZNF431.

FIG. 8 further provides a conceptual description of a novel bioinformatically detected of the present invention, referred to here as Genomic Address Messenger 5385 (GAM5385), which modulates expression of respective target genes thereof, the function and utility of which target genes is known in the art.

GAM5385 is a novel bioinformatically detected regulatory, non protein coding, micro RNA (miRNA) gene. The method by which GAM5385 was detected is described hereinabove with reference to FIGS. 8-15.

GAM5385 gene, herein designated GAM GENE, and GAM5385 target gene, herein designated TARGET GENE, are human genes contained in the human genome.

GAM5385 gene encodes a GAM5385 precursor RNA, herein designated GAM PRECURSOR RNA. Similar to other miRNA genes, and unlike most ordinary genes, GAM5385 precursor RNA does not encode a protein. A nucleotide sequence identical or highly similar to the nucleotide sequence of GAM5385 precursor RNA is designated SEQ ID:22, and is provided hereinbelow with reference to the sequence listing part. Nucleotide sequence SEQ ID:22 is located at position 35621433 relative to chromosome 3.

GAM5385 precursor RNA folds onto itself, forming GAM5385 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM5385 precursor RNA folds onto itself, forming GAM5385 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM5385 precursor RNA, designated SEQ-ID:22, and a schematic representation of a predicted secondary folding of GAM5385 folded precursor RNA are further described with reference to Table 2, hereby incorporated by reference.

An enzyme complex designated DICER COMPLEX, 'dices' the GAM5385 folded precursor RNA into GAM5385 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM5385 RNA is designated SEQ ID:218, and is provided hereinbelow with references to the sequence listing part and Table 3, hereby incorporated by reference.

GAM5385 target gene, herein designated TARGET GENE, encodes a corresponding messenger RNA, GAM5385 target RNA, herein designated GAM TARGET RNA. GAM5385 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM5385 RNA, herein designated GAM RNA, binds complementarily to one or more target binding sites located in untranslated regions of GAM5385 target RNA, herein designated GAM TARGET RNA. This complementary binding is due to the fact that the nucleotide sequence of GAM5385 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM5385 RNA may have a different number of target binding sites in untranslated regions of a GAM5385 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM5385 RNA, herein designated GAM RNA, to target binding sites on GAM5385 target RNA, herein designated GAM TARGET RNA, such as BINDING SITE I, BINDING SITE II and BINDING SITE III, inhibits translation of GAM5385 target RNA into GAM5385 target protein, herein designated GAM TARGET PROTEIN. GAM target protein is therefore outlined by a broken line.

It is appreciated that GAM5385 target gene, herein designated TARGET GENE, in fact represents a plurality of GAM5385 target genes. The mRNA of each one of this plurality of GAM5385 target genes comprises one or more target binding sites, each having a nucleotide sequence which is at least partly complementary to GAM5385 RNA, herein designated GAM RNA, and which when bound by GAM5385 RNA causes inhibition of translation of respective one or more GAM5385 target proteins.

It is further appreciated by one skilled in the art that the mode of translational inhibition illustrated by FIG. 8 with specific reference to translational inhibition exerted by GAM5385 gene, herein designated GAM GENE, on one or more GAM5385 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM5385 correlate with, and may be deduced from, the identity of the target genes which GAM5385 binds and inhibits, and the function of these target genes, as elaborated hereinbelow.

Actin binding lim protein 1 (ABLIM1, Accession NP_006710.2) is a GAM5385 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:16103, to the nucleotide sequence of GAM5385 RNA, herein designated GAM RNA, also designated SEQ ID:218.

A function of GAM5385 is therefore inhibition of Actin binding lim protein 1 (ABLIM1, Accession NP_006710.2). Accordingly, utilities of GAM5385 include diagnosis, prevention and treatment of diseases and clinical conditions associated with ABLIM1.

Actin binding lim protein 1 (ABLIM1, Accession NP_006711.2) is another GAM5385 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:16103, to the nucleotide sequence of GAM5385 RNA, herein designated GAM RNA, also designated SEQ ID:218.

Another function of GAM5385 is therefore inhibition of Actin binding lim protein 1 (ABLIM1, Accession NP_006711.2). Accordingly, utilities of GAM5385 include diagnosis, prevention and treatment of diseases and clinical conditions associated with ABLIM1.

Actin binding lim protein 1 (ABLIM1, Accession NP_002304.2) is another GAM5385 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:16103, to the nucleotide sequence of GAM5385 RNA, herein designated GAM RNA, also designated SEQ ID:218.

Another function of GAM5385 is therefore inhibition of Actin binding lim protein 1 (ABLIM1, Accession NP_002304.2). Accordingly, utilities of GAM5385 include diagnosis, prevention and treatment of diseases and clinical conditions associated with ABLIM1.

Acetyl-coenzyme a acyltransferase 2 (mitochondrial 3-oxoacyl-coenzyme a thiolase) (ACAA2, Accession NP_006102.1) is another GAM5385 target gene, herein designated TARGET GENE. ACAA2 BINDING SITE is a target binding site found in the 3' untranslated region of mRNA encoded by ACAA2, corresponding to a target binding site such as BINDING SITE I, BINDING SITE II or BINDING SITE III of FIG. 8. Table 4 illustrates the complementarity of the nucleotide sequences of ACAA2 BINDING SITE, designated SEQ ID:10451, to the nucleotide sequence of GAM5385 RNA, herein designated GAM RNA, also designated SEQ ID:218.

Another function of GAM5385 is therefore inhibition of Acetyl-coenzyme a acyltransferase 2 (mitochondrial 3-oxoacyl-coenzyme a thiolase) (ACAA2, Accession NP_006102.1). Accordingly, utilities of GAM5385 include diagnosis, prevention and treatment of diseases and clinical conditions associated with ACAA2.

AD-020 (Accession NP_064526.1) is another GAM5385 target gene, herein designated TARGET GENE. AD-020 BINDING SITE is a target binding site found in the 3' untranslated region of mRNA encoded by AD-020, corresponding to a target binding site such as BINDING SITE I, BINDING SITE II or BINDING SITE III of FIG. 8. Table 4 illustrates the complementarity of the nucleotide sequences of AD-020 BINDING SITE, designated SEQ ID:16382, to the nucleotide sequence of GAM5385 RNA, herein designated GAM RNA, also designated SEQ ID:218.

Another function of GAM5385 is therefore inhibition of AD-020 (Accession NP_064526.1). Accordingly, utilities of GAM5385 include diagnosis, prevention and treatment of diseases and clinical conditions associated with AD-020.

Arachidonate 15-lipoxygenase, second type (ALOX15B, Accession NP_001132.1) is another GAM5385 target gene, herein designated TARGET GENE. ALOX15B BINDING SITE is a target binding site found in the 3' untranslated region of mRNA encoded by ALOX15B, corresponding to a target binding site such as BINDING SITE I, BINDING SITE II or BINDING SITE III of FIG. 8. Table 4 illustrates the complementarity of the nucleotide sequences of ALOX15B BINDING SITE, designated SEQ ID:5527, to the nucleotide sequence of GAM5385 RNA, herein designated GAM RNA, also designated SEQ ID:218.

Another function of GAM5385 is therefore inhibition of Arachidonate 15-lipoxygenase, second type (ALOX15B, Accession NP_001132.1). Accordingly, utilities of GAM5385 include diagnosis, prevention and treatment of diseases and clinical conditions associated with ALOX15B.

Ap1 gamma subunit binding protein 1 (AP1GBP1, Accession NP_542117.1) is another GAM5385 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:14123, to the nucleotide sequence of GAM5385 RNA, herein designated GAM RNA, also designated SEQ ID:218.

Another function of GAM5385 is therefore inhibition of Ap1 gamma subunit binding protein 1 (AP1GBP1, Accession NP_542117.1). Accordingly, utilities of GAM5385 include diagnosis, prevention and treatment of diseases and clinical conditions associated with AP1GBP1.

Ap1 gamma subunit binding protein 1 (AP1GBP1, Accession NP_009178.2) is another GAM5385 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:14123, to the nucleotide sequence of GAM5385 RNA, herein designated GAM RNA, also designated SEQ ID:218.

Another function of GAM5385 is therefore inhibition of Ap1 gamma subunit binding protein 1 (AP1GBP1, Accession NP_009178.2). Accordingly, utilities of GAM5385 include diagnosis, prevention and treatment of diseases and clinical conditions associated with AP1GBP1.

Ap1 gamma subunit binding protein 1 (AP1GBP1, Accession NP_542118.1) is another GAM5385 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:14123, to the nucleotide sequence of GAM5385 RNA, herein designated GAM RNA, also designated SEQ ID:218.

Another function of GAM5385 is therefore inhibition of Ap1 gamma subunit binding protein 1 (AP1GBP1, Accession NP_542118.1). Accordingly, utilities of GAM5385 include diagnosis, prevention and treatment of diseases and clinical conditions associated with AP1GBP1.

Aprataxin (APTX, Accession NP_060162.1) is another GAM5385 target gene, herein designated TARGET GENE. APTX BINDING SITE is a target binding site found in the 5' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:9973, to the nucleotide sequence of GAM5385 RNA, herein designated GAM RNA, also designated SEQ ID:218.

Another function of GAM5385 is therefore inhibition of Aprataxin (APTX, Accession NP_060162.1). Accordingly, utilities of GAM5385 include diagnosis, prevention and treatment of diseases and clinical conditions associated with APTX.

Aprataxin (APTX, Accession NP_778241.1) is another GAM5385 target gene, herein designated TARGET GENE. APTX BINDING SITE is a target binding site found in the 5' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:9973, to the nucleotide sequence of GAM5385 RNA, herein designated GAM RNA, also designated SEQ ID:218.

Another function of GAM5385 is therefore inhibition of Aprataxin (APTX, Accession NP_778241.1). Accordingly, utilities of GAM5385 include diagnosis, prevention and treatment of diseases and clinical conditions associated with APTX.

Ras homolog gene family, member e (ARHE, Accession NP_005159.1) is another GAM5385 target gene, herein designated TARGET GENE. ARHE BINDING SITE is a target binding site found in the 3' untranslated region of mRNA encoded by ARHE, corresponding to a target binding site such as BINDING SITE I, BINDING SITE II or BINDING SITE III of FIG. 8. Table 4 illustrates the complementarity of the nucleotide sequences of ARHE BINDING SITE, designated SEQ ID:5435, to the nucleotide sequence of GAM5385 RNA, herein designated GAM RNA, also designated SEQ ID:218.

Another function of GAM5385 is therefore inhibition of Ras homolog gene family, member e (ARHE, Accession NP_005159.1). Accordingly, utilities of GAM5385 include diagnosis, prevention and treatment of diseases and clinical conditions associated with ARHE.

Rho guanine nucleotide exchange factor (gef) 4 (ARHGEF4, Accession NP_056135.2) is another GAM5385 target gene, herein designated TARGET GENE. ARHGEF4 BINDING SITE is a target binding site found in the 3' untranslated region of multiple transcripts of mRNA encoded by ARHGEF4, corresponding to a target binding site such as BINDING SITE I, BINDING SITE II or BINDING SITE III of FIG. 8. Table 4 illustrates the complementarity of the nucleotide sequences of ARHGEF4 BINDING SITE, designated SEQ ID:15522, to the nucleotide sequence of GAM5385 RNA, herein designated GAM RNA, also designated SEQ ID:218.

Another function of GAM5385 is therefore inhibition of Rho guanine nucleotide exchange factor (gef) 4 (ARHGEF4, Accession NP_056135.2). Accordingly, utilities of GAM5385 include diagnosis, prevention and treatment of diseases and clinical conditions associated with ARHGEF4.

Rho guanine nucleotide exchange factor (gef) 4 (ARHGEF4, Accession NP_127462.1) is another GAM5385 target gene, herein designated TARGET GENE. ARHGEF4 BINDING SITE is a target binding site found in the 3' untranslated region of multiple transcripts of mRNA encoded by ARHGEF4, corresponding to a target binding site such as BINDING SITE I, BINDING SITE II or BINDING SITE III of FIG. 8. Table 4 illustrates the complementarity of the nucleotide sequences of ARHGEF4 BINDING SITE, designated SEQ ID:15522, to the nucleotide sequence of GAM5385 RNA, herein designated GAM RNA, also designated SEQ ID:218.

Another function of GAM5385 is therefore inhibition of Rho guanine nucleotide exchange factor (gef) 4 (ARHGEF4, Accession NP_127462.1). Accordingly, utilities of GAM5385 include diagnosis, prevention and treatment of diseases and clinical conditions associated with ARHGEF4.

ARL8 (Accession NP_848930.1) is another GAM5385 target gene, herein designated TARGET GENE. ARL8 BINDING SITE is a target binding site found in the 3' untranslated region of multiple transcripts of mRNA encoded by ARL8, corresponding to a target binding site such as BINDING SITE I, BINDING SITE II or BINDING SITE III of FIG. 8. Table 4 illustrates the complementarity of the nucleotide sequences of ARL8 BINDING SITE, designated SEQ ID:13890, to the nucleotide sequence of GAM5385 RNA, herein designated GAM RNA, also designated SEQ ID:218.

Another function of GAM5385 is therefore inhibition of ARL8 (Accession NP_848930.1). Accordingly, utilities of GAM5385 include diagnosis, prevention and treatment of diseases and clinical conditions associated with ARL8.

ARL8 (Accession XP_167671.1) is another GAM5385 target gene, herein designated TARGET GENE. ARL8 BINDING SITE is a target binding site found in the 3' untranslated region of multiple transcripts of mRNA encoded by ARL8, corresponding to a target binding site such as BINDING SITE I, BINDING SITE II or BINDING SITE III of FIG. 8. Table 4 illustrates the complementarity of the nucleotide sequences of ARL8 BINDING SITE, designated SEQ ID:13890, to the nucleotide sequence of GAM5385 RNA, herein designated GAM RNA, also designated SEQ ID:218.

Another function of GAM5385 is therefore inhibition of ARL8 (Accession XP_167671.1). Accordingly, utilities of GAM5385 include diagnosis, prevention and treatment of diseases and clinical conditions associated with ARL8.

Attractin (ATRN, Accession NP_647537.1) is another GAM5385 target gene, herein designated TARGET GENE. ATRN BINDING SITE is a target binding site found in the 3' untranslated region of multiple transcripts of mRNA encoded by ATRN, corresponding to a target binding site such as BINDING SITE I, BINDING SITE II or BINDING SITE III of FIG. 8. Table 4 illustrates the complementarity of the nucleotide sequences of ATRN BINDING SITE, designated SEQ ID:14810, to the nucleotide sequence of GAM5385 RNA, herein designated GAM RNA, also designated SEQ ID:218.

Another function of GAM5385 is therefore inhibition of Attractin (ATRN, Accession NP_647537.1), a gene which is involved in the initial immune cell clustering during inflammatory response. Accordingly, utilities of GAM5385 include diagnosis, prevention and treatment of diseases and clinical conditions associated with ATRN.

The function of ATRN and its association with various diseases and clinical conditions, has been established by previous studies, as described hereinabove with reference to GAM47.1. Barren homolog (drosophila) (BRRN1, Accession NP_056156.2) is another GAM5385 target gene, herein designated TARGET GENE. BRRN1 BINDING SITE is a target binding site found in the 3' untranslated region of mRNA encoded by BRRN1, corresponding to a target binding site such as BINDING SITE I, BINDING SITE II or BINDING SITE III of FIG. 8. Table 4 illustrates the complementarity of the nucleotide sequences of BRRN1 BINDING SITE, designated SEQ ID:8848, to the nucleotide sequence of GAM5385 RNA, herein designated GAM RNA, also designated SEQ ID:218.

Another function of GAM5385 is therefore inhibition of Barren homolog (drosophila) (BRRN1, Accession NP_056156.2). Accordingly, utilities of GAM5385 include diagnosis, prevention and treatment of diseases and clinical conditions associated with BRRN1.

Chromosome 20 open reading frame 158 (C20orf158, Accession NP_689515.1) is another GAM5385 target gene, herein designated TARGET GENE. C20orf158 BINDING SITE is a target binding site found in the 3' untranslated region of mRNA encoded by C20orf158, corresponding to a target binding site such as BINDING SITE I, BINDING SITE II or BINDING SITE III of FIG. 8. Table 4 illustrates the complementarity of the nucleotide sequences of C20orf158 BINDING SITE, designated SEQ ID:1219, to the nucleotide sequence of GAM5385 RNA, herein designated GAM RNA, also designated SEQ ID:218.

Another function of GAM5385 is therefore inhibition of Chromosome 20 open reading frame 158 (C20orf158, Accession NP_689515.1). Accordingly, utilities of GAM5385 include diagnosis, prevention and treatment of diseases and clinical conditions associated with C20orf158.

Chromosome 20 open reading frame 174 (C20orf174, Accession XP_066058.2) is another GAM5385 target gene, herein designated TARGET GENE. C20orf174 BINDING SITE is a target binding site found in the 3' untranslated region of mRNA encoded by C20orf174, corresponding to a target binding site such as BINDING SITE I, BINDING SITE II or BINDING SITE III of FIG. 8. Table 4 illustrates the complementarity of the nucleotide sequences of C20orf174 BINDING SITE, designated SEQ ID:13482, to the nucleotide sequence of GAM5385 RNA, herein designated GAM RNA, also designated SEQ ID:218.

Another function of GAM5385 is therefore inhibition of Chromosome 20 open reading frame 174 (C20orf174, Accession XP_066058.2). Accordingly, utilities of GAM5385 include diagnosis, prevention and treatment of diseases and clinical conditions associated with C20orf174.

Chromosome 21 open reading frame 93 (C21orf93, Accession NP_660162.1) is another GAM5385 target gene, herein designated TARGET GENE. C21orf93 BINDING SITE is a target binding site found in the 3' untranslated region of mRNA encoded by C21orf93, corresponding to a target binding site such as BINDING SITE I, BINDING SITE II or BINDING SITE III of FIG. 8. Table 4 illustrates the complementarity of the nucleotide sequences of C21orf93 BINDING SITE, designated SEQ ID:4794, to the nucleotide sequence of GAM5385 RNA, herein designated GAM RNA, also designated SEQ ID:218.

Another function of GAM5385 is therefore inhibition of Chromosome 21 open reading frame 93 (C21orf93, Accession NP_660162.1). Accordingly, utilities of GAM5385 include diagnosis, prevention and treatment of diseases and clinical conditions associated with C21orf93.

Carcinoembryonic antigen-related cell adhesion molecule 8 (CEACAM8, Accession NP_001807.2) is another GAM5385 target gene, herein designated TARGET GENE. CEACAM8 BINDING SITE is a target binding site found in the 3' untranslated region of mRNA encoded by CEACAM8, corresponding to a target binding site such as BINDING SITE I, BINDING SITE II or BINDING SITE III of FIG. 8. Table 4 illustrates the complementarity of the nucleotide sequences of CEACAM8 BINDING SITE, designated SEQ ID:3579, to the nucleotide sequence of GAM5385 RNA, herein designated GAM RNA, also designated SEQ ID:218.

Another function of GAM5385 is therefore inhibition of Carcinoembryonic antigen-related cell adhesion molecule 8 (CEACAM8, Accession NP_001807.2). Accordingly, utilities of GAM5385 include diagnosis, prevention and treatment of diseases and clinical conditions associated with CEACAM8.

CG012 (Accession XP_096710.1) is another GAM5385 target gene, herein designated TARGET GENE. CG012 BINDING SITE is a target binding site found in the 5' untranslated region of mRNA encoded by CG012, corresponding to a target binding site such as BINDING SITE I, BINDING SITE II or BINDING SITE III of FIG. 8. Table 4 illustrates the complementarity of the nucleotide sequences of CG012 BINDING SITE, designated SEQ ID:19634, to the nucleotide sequence of GAM5385 RNA, herein designated GAM RNA, also designated SEQ ID:218.

Another function of GAM5385 is therefore inhibition of CG012 (Accession XP_096710.1). Accordingly, utilities of GAM5385 include diagnosis, prevention and treatment of diseases and clinical conditions associated with CG012.

Cytokine inducible sh2-containing protein (CISH, Accession NP_659508.1) is another GAM5385 target gene, herein designated TARGET GENE. CISH BINDING SITE is a target binding site found in the 3' untranslated region of multiple transcripts of mRNA encoded by CISH, corresponding to a target binding site such as BINDING SITE I, BINDING SITE II or BINDING SITE III of FIG. 8. Table 4 illustrates the complementarity of the nucleotide sequences of CISH BINDING SITE, designated SEQ ID:2516, to the nucleotide sequence of GAM5385 RNA, herein designated GAM RNA, also designated SEQ ID:218.

Another function of GAM5385 is therefore inhibition of Cytokine inducible sh2-containing protein (CISH, Accession NP_659508.1), a gene which intervenes in the negative regulation of cytokines. Accordingly, utilities of GAM5385 include diagnosis, prevention and treatment of diseases and clinical conditions associated with CISH.

The function of CISH and its association with various diseases and clinical conditions, has been established by previous studies, as described hereinabove with reference to GAM47.1. Cytokine inducible sh2-containing protein (CISH, Accession NP_037456.4) is another GAM5385 target gene, herein designated TARGET GENE. CISH BINDING SITE is a target binding site found in the 3' untranslated region of multiple transcripts of mRNA encoded by CISH, corresponding to a target binding site such as BINDING SITE I, BINDING SITE II or BINDING SITE III of FIG. 8. Table 4 illustrates the complementarity of the nucleotide sequences of CISH BINDING SITE, designated SEQ ID:2516, to the nucleotide sequence of GAM5385 RNA, herein designated GAM RNA, also designated SEQ ID:218.

Another function of GAM5385 is therefore inhibition of Cytokine inducible sh2-containing protein (CISH, Accession NP_037456.4), a gene which intervenes in the negative regulation of cytokines. Accordingly, utilities of GAM5385 include diagnosis, prevention and treatment of diseases and clinical conditions associated with CISH.

The function of CISH and its association with various diseases and clinical conditions, has been established by previous studies, as described hereinabove with reference to GAM47.1. CLONE24945 (Accession NP_056498.1) is another GAM5385 target gene, herein designated TARGET GENE. CLONE24945 BINDING SITE is a target binding site found in the 3' untranslated region of mRNA encoded by CLONE24945, corresponding to a target binding site such as BINDING SITE I, BINDING SITE II or BINDING SITE III of FIG. 8. Table 4 illustrates the complementarity of the nucleotide sequences of CLONE24945 BINDING SITE, designated SEQ ID:19577, to the nucleotide sequence of GAM5385 RNA, herein designated GAM RNA, also designated SEQ ID:218.

Another function of GAM5385 is therefore inhibition of CLONE24945 (Accession NP_056498.1). Accordingly, utilities of GAM5385 include diagnosis, prevention and treatment of diseases and clinical conditions associated with CLONE24945.

Colony stimulating factor 1 (macrophage) (CSF1, Accession NP_757350.1) is another GAM5385 target gene, herein designated TARGET GENE. CSF1 BINDING SITE is a target binding site found in the 3' untranslated region of multiple transcripts of mRNA encoded by CSF1, corresponding to a target binding site such as BINDING SITE I, BINDING SITE II or BINDING SITE III of FIG. 8. Table 4 illustrates the complementarity of the nucleotide sequences of CSF1 BINDING SITE, designated SEQ ID:13158, to the nucleotide sequence of GAM5385 RNA, herein designated GAM RNA, also designated SEQ ID:218.

Another function of GAM5385 is therefore inhibition of Colony stimulating factor 1 (macrophage) (CSF1, Accession NP_757350.1). Accordingly, utilities of GAM5385 include diagnosis, prevention and treatment of diseases and clinical conditions associated with CSF1.

Colony stimulating factor 1 (macrophage) (CSF1, Accession NP_000748.3) is another GAM5385 target gene, herein designated TARGET GENE. CSF1 BINDING SITE is a target binding site found in the 3' untranslated region of multiple transcripts of mRNA encoded by CSF1, corresponding to a target binding site such as BINDING SITE I, BINDING SITE II or BINDING SITE III of FIG. 8. Table 4 illustrates the complementarity of the nucleotide sequences of CSF1 BINDING SITE, designated SEQ ID:13158, to the nucleotide sequence of GAM5385 RNA, herein designated GAM RNA, also designated SEQ ID:218.

Another function of GAM5385 is therefore inhibition of Colony stimulating factor 1 (macrophage) (CSF1, Accession NP_000748.3). Accordingly, utilities of GAM5385 include diagnosis, prevention and treatment of diseases and clinical conditions associated with CSF1.

D-aspartate oxidase (DDO, Accession NP_004023.1) is another GAM5385 target gene, herein designated TARGET GENE. DDO BINDING SITE is a target binding site found in the 3' untranslated region of multiple transcripts of mRNA encoded by DDO, corresponding to a target binding site such as BINDING SITE I, BINDING SITE II or BINDING SITE III of FIG. 8. Table 4 illustrates the complementarity of the nucleotide sequences of DDO BINDING SITE, designated SEQ ID:6520, to the nucleotide sequence of GAM5385 RNA, herein designated GAM RNA, also designated SEQ ID:218.

Another function of GAM5385 is therefore inhibition of D-aspartate oxidase (DDO, Accession NP_004023.1). Accordingly, utilities of GAM5385 include diagnosis, prevention and treatment of diseases and clinical conditions associated with DDO.

D-aspartate oxidase (DDO, Accession NP_003640.1) is another GAM5385 target gene, herein designated TARGET GENE. DDO BINDING SITE is a target binding site found in the 3' untranslated region of multiple transcripts of mRNA encoded by DDO, corresponding to a target binding site such as BINDING SITE I, BINDING SITE II or BINDING SITE III of FIG. 8. Table 4 illustrates the complementarity of the nucleotide sequences of DDO BINDING SITE, designated SEQ ID:6520, to the nucleotide sequence of GAM5385 RNA, herein designated GAM RNA, also designated SEQ ID:218.

Another function of GAM5385 is therefore inhibition of D-aspartate oxidase (DDO, Accession NP_003640.1). Accordingly, utilities of GAM5385 include diagnosis, prevention and treatment of diseases and clinical conditions associated with DDO.

Disrupted in schizophrenia 1 (DISC1, Accession NP_061132.1) is another GAM5385 target gene, herein designated TARGET GENE. DISC1 BINDING SITE is a target binding site found in the 3' untranslated region of mRNA encoded by DISC1, corresponding to a target binding site such as BINDING SITE I, BINDING SITE II or BINDING SITE III of FIG. 8. Table 4 illustrates the complementarity of the nucleotide sequences of DISC1 BINDING SITE, designated SEQ ID:8442, to the nucleotide sequence of GAM5385 RNA, herein designated GAM RNA, also designated SEQ ID:218.

Another function of GAM5385 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM5385 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. DKFZP564D166 (Accession NP_056438.1) is another GAM5385 target gene, herein designated TARGET GENE. DKFZP564D166 BINDING SITE is a target binding site found in the 5' untranslated region of multiple transcripts of mRNA encoded by DKFZP564D166, corresponding to a target binding site such as BINDING SITE I, BINDING SITE II or BINDING SITE III of FIG. 8. Table 4 illustrates the complementarity of the nucleotide sequences of DKFZP564D166 BINDING SITE, designated SEQ ID:775, to the nucleotide sequence of GAM5385 RNA, herein designated GAM RNA, also designated SEQ ID:218.

Another function of GAM5385 is therefore inhibition of DKFZP564D166 (Accession NP_056438.1). Accordingly, utilities of GAM5385 include diagnosis, prevention and treatment of diseases and clinical conditions associated with DKFZP564D166.

DKFZP586A0522 (Accession NP_054752.1) is another GAM5385 target gene, herein designated TARGET GENE. DKFZP586A0522 BINDING SITE is a target binding site found in the 3' untranslated region of mRNA encoded by DKFZP586A0522, corresponding to a target binding site such as BINDING SITE I, BINDING SITE II or BINDING SITE III of FIG. 8. Table 4 illustrates the complementarity of the nucleotide sequences of DKFZP586A0522 BINDING SITE, designated SEQ ID:12685, to the nucleotide sequence of GAM5385 RNA, herein designated GAM RNA, also designated SEQ ID:218.

Another function of GAM5385 is therefore inhibition of DKFZP586A0522 (Accession NP_054752.1). Accordingly, utilities of GAM5385 include diagnosis, prevention and treatment of diseases and clinical conditions associated with DKFZP586A0522.

Dnaj (hsp40) homolog, subfamily c, member 5 (DNAJC5, Accession XP_028966.2) is another GAM5385 target gene, herein designated TARGET GENE. DNAJC5 BINDING SITE is a target binding site found in the 3' untranslated region of mRNA encoded by DNAJC5, corresponding to a target binding site such as BINDING SITE I, BINDING SITE II or BINDING SITE III of FIG. 8. Table 4 illustrates the complementarity of the nucleotide sequences of DNAJC5 BINDING SITE, designated SEQ ID:5877, to the nucleotide sequence of GAM5385 RNA, herein designated GAM RNA, also designated SEQ ID:218.

Another function of GAM5385 is therefore inhibition of Dnaj (hsp40) homolog, subfamily c, member 5 (DNAJC5, Accession XP_028966.2). Accordingly, utilities of GAM5385 include diagnosis, prevention and treatment of diseases and clinical conditions associated with DNAJC5.

DOT1L (Accession NP_115871.1) is another GAM5385 target gene, herein designated TARGET GENE. DOT1L BINDING SITE is a target binding site found in the 3' untranslated region of mRNA encoded by DOT1L, corresponding to a target binding site such as BINDING SITE I, BINDING SITE II or BINDING SITE III of FIG. 8. Table 4 illustrates the complementarity of the nucleotide sequences of DOT1L BINDING SITE, designated SEQ ID:13923, to the nucleotide sequence of GAM5385 RNA, herein designated GAM RNA, also designated SEQ ID:218.

Another function of GAM5385 is therefore inhibition of DOT1L (Accession NP_115871.1). Accordingly, utilities of GAM5385 include diagnosis, prevention and treatment of diseases and clinical conditions associated with DOT1L.

Dual specificity phosphatase 16 (DUSP16, Accession XP_039106.1) is another GAM5385 target gene, herein designated TARGET GENE. DUSP16 BINDING SITE1 and DUSP16 BINDING SITE2 are target binding sites found in untranslated regions of mRNA encoded by DUSP16, corresponding to target binding sites such as BINDING SITE I, BINDING SITE II or BINDING SITE III of FIG. 8. Table 4 illustrates the complementarity of the nucleotide sequences of DUSP16 BINDING SITE1 and DUSP16 BINDING SITE2, designated SEQ ID:19356 and SEQ ID:10606 respectively, to the nucleotide sequence of GAM5385 RNA, herein designated GAM RNA, also designated SEQ ID:218.

Another function of GAM5385 is therefore inhibition of Dual specificity phosphatase 16 (DUSP16, Accession XP_039106.1). Accordingly, utilities of GAM5385 include diagnosis, prevention and treatment of diseases and clinical conditions associated with DUSP16.

Dual-specificity tyrosine-(y)-phosphorylation regulated kinase 2 (DYRK2, Accession NP_003574.1) is another GAM5385 target gene, herein designated TARGET GENE. DYRK2 BINDING SITE is a target binding site found in the 3' untranslated region of multiple transcripts of mRNA encoded by DYRK2, corresponding to a target binding site such as BINDING SITE I, BINDING SITE II or BINDING SITE III of FIG. 8. Table 4 illustrates the complementarity of the nucleotide sequences of DYRK2 BINDING SITE, designated SEQ ID:19011, to the nucleotide sequence of GAM5385 RNA, herein designated GAM RNA, also designated SEQ ID:218.

Another function of GAM5385 is therefore inhibition of Dual-specificity tyrosine-(y)-phosphorylation regulated kinase 2 (DYRK2, Accession NP_003574.1). Accordingly, utilities of GAM5385 include diagnosis, prevention and treatment of diseases and clinical conditions associated with DYRK2.

Dual-specificity tyrosine-(y)-phosphorylation regulated kinase 2 (DYRK2, Accession NP_006473.1) is another GAM5385 target gene, herein designated TARGET GENE. DYRK2 BINDING SITE is a target binding site found in the 3' untranslated region of multiple transcripts of mRNA encoded by DYRK2, corresponding to a target binding site such as BINDING SITE I, BINDING SITE II or BINDING SITE III of FIG. 8. Table 4 illustrates the complementarity of the nucleotide sequences of DYRK2 BINDING SITE, designated SEQ ID:19011, to the nucleotide sequence of GAM5385 RNA, herein designated GAM RNA, also designated SEQ ID:218.

Another function of GAM5385 is therefore inhibition of Dual-specificity tyrosine-(y)-phosphorylation regulated kinase 2 (DYRK2, Accession NP_006473.1). Accordingly, utilities of GAM5385 include diagnosis, prevention and treatment of diseases and clinical conditions associated with DYRK2.

Egf-like-domain, multiple 4 (EGFL4, Accession XP_290821.1) is another GAM5385 target gene, herein designated TARGET GENE. EGFL4 BINDING SITE is a target binding site found in the 3' untranslated region of mRNA encoded by EGFL4, corresponding to a target binding site such as BINDING SITE I, BINDING SITE II or BINDING SITE III of FIG. 8. Table 4 illustrates the complementarity of the nucleotide sequences of EGFL4 BINDING SITE, designated SEQ ID:14183, to the nucleotide sequence of GAM5385 RNA, herein designated GAM RNA, also designated SEQ ID:218.

Another function of GAM5385 is therefore inhibition of Egf-like-domain, multiple 4 (EGFL4, Accession XP_290821.1). Accordingly, utilities of GAM5385 include diagnosis, prevention and treatment of diseases and clinical conditions associated with EGFL4.

Erythrocyte membrane protein band 4.9 (dematin) (EPB49, Accession NP_001969.1) is another GAM5385 target gene, herein designated TARGET GENE. EPB49 BINDING SITE is a target binding site found in the 5' untranslated region of mRNA encoded by EPB49, corresponding to a target binding site such as BINDING SITE I, BINDING SITE II or BINDING SITE III of FIG. 8. Table 4 illustrates the complementarity of the nucleotide sequences of EPB49 BINDING SITE, designated SEQ ID:11878, to the nucleotide sequence of GAM5385 RNA, herein designated GAM RNA, also designated SEQ ID:218.

Another function of GAM5385 is therefore inhibition of Erythrocyte membrane protein band 4.9 (dematin) (EPB49, Accession NP_001969.1), a gene which is an actin-bundling protein. Accordingly, utilities of GAM5385 include diagnosis, prevention and treatment of diseases and clinical conditions associated with EPB49.

The function of EPB49 and its association with various diseases and clinical conditions, has been established by previous studies, as described hereinabove with reference to GAM47.1. ERG-1 (Accession NP_071317.2) is another GAM5385 target gene, herein designated TARGET GENE. ERG-1 BINDING SITE is a target binding site found in the 5' untranslated region of mRNA encoded by ERG-1, corresponding to a target binding site such as BINDING SITE I, BINDING SITE II or BINDING SITE III of FIG. 8. Table 4 illustrates the complementarity of the nucleotide sequences of ERG-1 BINDING SITE, designated SEQ ID:13141, to the nucleotide sequence of GAM5385 RNA, herein designated GAM RNA, also designated SEQ ID:218.

Another function of GAM5385 is therefore inhibition of ERG-1 (Accession NP_071317.2). Accordingly, utilities of GAM5385 include diagnosis, prevention and treatment of diseases and clinical conditions associated with ERG-1.

Fibulin 1 (FBLN1, Accession NP_006478.1) is another GAM5385 target gene, herein designated TARGET GENE. FBLN1 BINDING SITE1 and FBLN1 BINDING SITE2 are target binding sites found in untranslated regions of multiple transcripts of mRNA encoded by FBLN1, corresponding to target binding sites such as BINDING SITE I, BINDING SITE II or BINDING SITE III of FIG. 8. Table 4 illustrates the complementarity of the nucleotide sequences of FBLN1 BINDING SITE1 and FBLN1 BINDING SITE2, designated SEQ ID:12051 and SEQ ID:16278 respectively, to the nucleotide sequence of GAM5385 RNA, herein designated GAM RNA, also designated SEQ ID:218.

Another function of GAM5385 is therefore inhibition of Fibulin 1 (FBLN1, Accession NP_006478.1), a gene which secreted glycoprotein; has EGF-like repeats, similar to anaphylatoxins C3a, C4a, and C5a. Accordingly, utilities of GAM5385 include diagnosis, prevention and treatment of diseases and clinical conditions associated with FBLN1.

The function of FBLN1 and its association with various diseases and clinical conditions, has been established by previous studies, as described hereinabove with reference to GAM179.1. Fc fragment of igg, high affinity ia, receptor for (cd64) (FCGR1A, Accession NP_000557.1) is another GAM5385 target gene, herein designated TARGET GENE. FCGR1A BINDING SITE is a target binding site found in the 3' untranslated region of mRNA encoded by FCGR1A, corresponding to a target binding site such as BINDING SITE I, BINDING SITE II or BINDING SITE III of FIG. 8. Table 4 illustrates the complementarity of the nucleotide sequences of FCGR1A BINDING SITE, designated SEQ ID:11092, to the nucleotide sequence of GAM5385 RNA, herein designated GAM RNA, also designated SEQ ID:218.

Another function of GAM5385 is therefore inhibition of Fc fragment of igg, high affinity ia, receptor for (cd64) (FCGR1A, Accession NP_000557.1), a gene which binds to the fc region of immunoglobulins gamma. high affinity receptor. and therefore may be associated with Igg receptor i, phagocytic, familial deficiency of. Accordingly, utilities of GAM5385 include diagnosis, prevention and treatment of Igg receptor i, phagocytic, familial deficiency of, and of other diseases and clinical conditions associated with FCGR1A.

The function of FCGR1A and its association with various diseases and clinical conditions, has been established by previous studies, as described hereinabove with reference to GAM206.1. Fibroblast growth factor receptor 1 (fms-related tyrosine kinase 2, pfeiffer syndrome) (FGFR1, Accession NP_075599.1) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_075599.1). Accordingly, utilities of GAM5385 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_075596.1) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_075596.1). Accordingly, utilities of GAM5385 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_075593.1) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_075593.1). Accordingly, utilities of GAM5385 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_075595.1) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_075595.1). Accordingly, utilities of GAM5385 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_000595.1) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_000595.1). Accordingly, utilities of GAM5385 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_056934.2) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_056934.2). Accordingly, utilities of GAM5385 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_075594.1) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_075594.1). Accordingly, utilities of GAM5385 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_075598.1) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_075598.1). Accordingly, utilities of GAM5385 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_075597.1) is another GAM5385 target gene, herein designated TARGET GENE. FGFR1 BINDING SITE is a target binding site found in the 5' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:4651, to the nucleotide sequence of GAM5385 RNA, herein designated GAM RNA, also designated SEQ ID:218.

Another function of GAM5385 is therefore inhibition of Fibroblast growth factor receptor 1 (fms-related tyrosine kinase 2, pfeiffer syndrome) (FGFR1, Accession NP_075597.1). Accordingly, utilities of GAM5385 include diagnosis, prevention and treatment of diseases and clinical conditions associated with FGFR1.

FLJ10420 (Accession NP_060560.1) is another GAM5385 target gene, herein designated TARGET GENE. FLJ10420 BINDING SITE is a target binding site found in the 3' untranslated region of mRNA encoded by FLJ10420, corresponding to a target binding site such as BINDING SITE I, BINDING SITE II or BINDING SITE III of FIG. 8. Table 4 illustrates the complementarity of the nucleotide sequences of FLJ10420 BINDING SITE, designated SEQ ID:14824, to the nucleotide sequence of GAM5385 RNA, herein designated GAM RNA, also designated SEQ ID:218.

Another function of GAM5385 is therefore inhibition of FLJ10420 (Accession NP_060560.1). Accordingly, utilities of GAM5385 include diagnosis, prevention and treatment of diseases and clinical conditions associated with FLJ10420.

FLJ10706 (Accession NP_060656.1) is another GAM5385 target gene, herein designated TARGET GENE. FLJ10706 BINDING SITE is a target binding site found in the 5' untranslated region of mRNA encoded by FLJ10706, corresponding to a target binding site such as BINDING SITE I, BINDING SITE II or BINDING SITE III of FIG. 8. Table 4 illustrates the complementarity of the nucleotide sequences of FLJ10706 BINDING SITE, designated SEQ ID:11748, to the nucleotide sequence of GAM5385 RNA, herein designated GAM RNA, also designated SEQ ID:218.

Another function of GAM5385 is therefore inhibition of FLJ10706 (Accession NP_060656.1). Accordingly, utilities of GAM5385 include diagnosis, prevention and treatment of diseases and clinical conditions associated with FLJ10706.

FLJ10916 (Accession NP_060741.1) is another GAM5385 target gene, herein designated TARGET GENE. FLJ10916 BINDING SITE is a target binding site found in the 5' untranslated region of mRNA encoded by FLJ10916, corresponding to a target binding site such as BINDING SITE I, BINDING SITE II or BINDING SITE III of FIG. 8. Table 4 illustrates the complementarity of the nucleotide sequences of FLJ10916 BINDING SITE, designated SEQ ID:13403, to the nucleotide sequence of GAM5385 RNA, herein designated GAM RNA, also designated SEQ ID:218.

Another function of GAM5385 is therefore inhibition of FLJ10916 (Accession NP_060741.1). Accordingly, utilities of GAM5385 include diagnosis, prevention and treatment of diseases and clinical conditions associated with FLJ10916.

FLJ11800 (Accession NP_079250.1) is another GAM5385 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:1416, to the nucleotide sequence of GAM5385 RNA, herein designated GAM RNA, also designated SEQ ID:218.

Another function of GAM5385 is therefore inhibition of FLJ11800 (Accession NP_079250.1). Accordingly, utilities of GAM5385 include diagnosis, prevention and treatment of diseases and clinical conditions associated with FLJ11800.

FLJ20184 (Accession NP_060170.1) is another GAM5385 target gene, herein designated TARGET GENE. FLJ20184 BINDING SITE is a target binding site found in the 3' untranslated region of mRNA encoded by FLJ20184, corresponding to a target binding site such as BINDING SITE I, BINDING SITE II or BINDING SITE III of FIG. 8. Table 4 illustrates the complementarity of the nucleotide sequences of FLJ20184 BINDING SITE, designated SEQ ID:17813, to the nucleotide sequence of GAM5385 RNA, herein designated GAM RNA, also designated SEQ ID:218.

Another function of GAM5385 is therefore inhibition of FLJ20184 (Accession NP_060170.1). Accordingly, utilities of GAM5385 include diagnosis, prevention and treatment of diseases and clinical conditions associated with FLJ20184.

FLJ20464 (Accession NP_060304.1) is another GAM5385 target gene, herein designated TARGET GENE. FLJ20464 BINDING SITE is a target binding site found in the 3' untranslated region of mRNA encoded by FLJ20464, corresponding to a target binding site such as BINDING SITE I, BINDING SITE II or BINDING SITE III of FIG. 8. Table 4 illustrates the complementarity of the nucleotide sequences of FLJ20464 BINDING SITE, designated SEQ ID:17685, to the nucleotide sequence of GAM5385 RNA, herein designated GAM RNA, also designated SEQ ID:218.

Another function of GAM5385 is therefore inhibition of FLJ20464 (Accession NP_060304.1). Accordingly, utilities of GAM5385 include diagnosis, prevention and treatment of diseases and clinical conditions associated with FLJ20464.

FLJ22494 (Accession NP_079091.1) is another GAM5385 target gene, herein designated TARGET GENE. FLJ22494 BINDING SITE is a target binding site found in the 5' untranslated region of mRNA encoded by FLJ22494, corresponding to a target binding site such as BINDING SITE I, BINDING SITE II or BINDING SITE III of FIG. 8. Table 4 illustrates the complementarity of the nucleotide sequences of FLJ22494 BINDING SITE, designated SEQ ID:4622, to the nucleotide sequence of GAM5385 RNA, herein designated GAM RNA, also designated SEQ ID:218.

Another function of GAM5385 is therefore inhibition of FLJ22494 (Accession NP_079091.1). Accordingly, utilities of GAM5385 include diagnosis, prevention and treatment of diseases and clinical conditions associated with FLJ22494.

FLJ32112 (Accession NP_694580.1) is another GAM5385 target gene, herein designated TARGET GENE. FLJ32112 BINDING SITE is a target binding site found in the 3' untranslated region of mRNA encoded by FLJ32112, corresponding to a target binding site such as BINDING SITE I, BINDING SITE II or BINDING SITE III of FIG. 8. Table 4 illustrates the complementarity of the nucleotide sequences of FLJ32112 BINDING SITE, designated SEQ ID:10311, to the nucleotide sequence of GAM5385 RNA, herein designated GAM RNA, also designated SEQ ID:218.

Another function of GAM5385 is therefore inhibition of FLJ32112 (Accession NP_694580.1). Accordingly, utilities of GAM5385 include diagnosis, prevention and treatment of diseases and clinical conditions associated with FLJ32112.

FLJ32115 (Accession NP_689534.1) is another GAM5385 target gene, herein designated TARGET GENE. FLJ32115 BINDING SITE is a target binding site found in the 3' untranslated region of mRNA encoded by FLJ32115, corresponding to a target binding site such as BINDING SITE I, BINDING SITE II or BINDING SITE III of FIG. 8. Table 4 illustrates the complementarity of the nucleotide sequences of FLJ32115 BINDING SITE, designated SEQ ID:6946, to the nucleotide sequence of GAM5385 RNA, herein designated GAM RNA, also designated SEQ ID:218.

Another function of GAM5385 is therefore inhibition of FLJ32115 (Accession NP_689534.1). Accordingly, utilities of GAM5385 include diagnosis, prevention and treatment of diseases and clinical conditions associated with FLJ32115.

Ftsj homolog 2 (e. coli) (FTSJ2, Accession NP_803191.1) is another GAM5385 target gene, herein designated TARGET GENE. FTSJ2 BINDING SITE is a target binding site found in the 3' untranslated region of multiple transcripts of mRNA encoded by FTSJ2, corresponding to a target binding site such as BINDING SITE I, BINDING SITE II or BINDING SITE III of FIG. 8. Table 4 illustrates the complementarity of the nucleotide sequences of FTSJ2 BINDING SITE, designated SEQ ID:3879, to the nucleotide sequence of GAM5385 RNA, herein designated GAM RNA, also designated SEQ ID:218.

Another function of GAM5385 is therefore inhibition of Ftsj homolog 2 (e. coli) (FTSJ2, Accession NP_803191.1). Accordingly, utilities of GAM5385 include diagnosis, prevention and treatment of diseases and clinical conditions associated with FTSJ2.

G2 (Accession XP_039515.8) is another GAM5385 target gene, herein designated TARGET GENE. G2 BINDING SITE is a target binding site found in the 3' untranslated region of mRNA encoded by G2, corresponding to a target binding site such as BINDING SITE I, BINDING SITE II or BINDING SITE III of FIG. 8. Table 4 illustrates the complementarity of the nucleotide sequences of G2 BINDING SITE, designated SEQ ID:15665, to the nucleotide sequence of GAM5385 RNA, herein designated GAM RNA, also designated SEQ ID:218.

Another function of GAM5385 is therefore inhibition of G2 (Accession XP_039515.8). Accordingly, utilities of GAM5385 include diagnosis, prevention and treatment of diseases and clinical conditions associated with G2.

Glutamic pyruvate transaminase (alanine aminotransferase) 2 (GPT2, Accession NP_597700.1) is another GAM5385 target gene, herein designated TARGET GENE. GPT2 BINDING SITE is a target binding site found in the 3' untranslated region of mRNA encoded by GPT2, corresponding to a target binding site such as BINDING SITE I, BINDING SITE II or BINDING SITE III of FIG. 8. Table 4 illustrates the complementarity of the nucleotide sequences of GPT2 BINDING SITE, designated SEQ ID:12001, to the nucleotide sequence of GAM5385 RNA, herein designated GAM RNA, also designated SEQ ID:218.

Another function of GAM5385 is therefore inhibition of Glutamic pyruvate transaminase (alanine aminotransferase) 2 (GPT2, Accession NP_597700.1). Accordingly, utilities of GAM5385 include diagnosis, prevention and treatment of diseases and clinical conditions associated with GPT2.

Glyoxylate reductase/hydroxypyruvate reductase (GRHPR, Accession NP_036335.1) is another GAM5385 target gene, herein designated TARGET GENE. GRHPR BINDING SITE is a target binding site found in the 5' untranslated region of mRNA encoded by GRHPR, corresponding to a target binding site such as BINDING SITE I, BINDING SITE II or BINDING SITE III of FIG. 8. Table 4 illustrates the complementarity of the nucleotide sequences of GRHPR BINDING SITE, designated SEQ ID:3593, to the nucleotide sequence of GAM5385 RNA, herein designated GAM RNA, also designated SEQ ID:218.

Another function of GAM5385 is therefore inhibition of Glyoxylate reductase/hydroxypyruvate reductase (GRHPR, Accession NP_036335.1), a gene which has widespread tissue expression and has a role in metabolism. Accordingly, utilities of GAM5385 include diagnosis, prevention and treatment of diseases and clinical conditions associated with GRHPR.

The function of GRHPR has been established by previous studies. Cramer et al. (1999) and Rumsby and Cregeen (1999) independently identified a glyoxylate reductase/hydroxypyruvate reductase (GRHPR; EC 1.1.1.79) cDNA clone from a human liver EST library. The GRHPR gene encodes a predicted 328-amino acid protein with a mass of 35,563 Da. By transient transfection of the cDNA clone into COS cells, Cramer et al. (1999) verified that GRHPR encodes an enzyme with hydroxypyruvate reductase, glyoxylate reductase, and D-glycerate dehydrogenase enzymatic activities. Database analysis of human ESTs revealed widespread tissue expression, indicating that the enzyme may have a role in metabolism. Cramer et al. (1999) determined that the human GRHPR gene spans approximately 9 kb and is composed of 9 exons and 8 introns. In 2 pairs of sibs from 2 unrelated families with type II hyperoxaluria (OMIM Ref. No. 260000), Cramer et al. (1999) identified a 1-bp deletion in the GRHPR gene (103delG; 604296.0001) by SSCP analysis. All 4 patients were homozygous for the same mutation. Webster et al. (2000) identified 5 other mutations in patients with type II hyperoxaluria. Ten of 11 patients that they had genotyped were homozygous for 1 of the 6 known mutations. In the case of two-thirds of the patients, the parents were related. Genotyping also showed the possible presence of a founder effect for the 2 most common mutations:103delG and arg99 to ter (604296.0002).

Full details of the abovementioned studies are described in the following publications, the disclosure of which are hereby incorporated by reference:

Cramer, S. D.; Ferree, P. M.; Lin, K.; Milliner, D. S.; Holmes, R. P.: The gene encoding hydroxypyruvate reductase (GRHPR) is mutated in patients with primary hyperoxaluria type II. Hum. Molec. Genet. 8:2063-2069, 1999; and Webster, K. E.; Ferree, P. M.; Holmes, R. P.; Cramer, S. D.: Identification of missense, nonsense, and deletion mutations in the GRHPR gene in patients with primary hyperoxaluria type.

Further studies establishing the function and utilities of GRHPR are found in John Hopkins OMIM database record ID 604296, and in cited publications listed in Table 5, which are hereby incorporated by reference. Glutamate receptor, ionotropic, delta 1 (GRID1, Accession XP_043613.8) is another GAM5385 target gene, herein designated TARGET GENE. GRID1 BINDING SITE is a target binding site found in the 3' untranslated region of mRNA encoded by GRID1, corresponding to a target binding site such as BINDING SITE I, BINDING SITE II or BINDING SITE III of FIG. 8. Table 4 illustrates the complementarity of the nucleotide sequences of GRID1 BINDING SITE, designated SEQ ID:9369, to the nucleotide sequence of GAM5385 RNA, herein designated GAM RNA, also designated SEQ ID:218.

Another function of GAM5385 is therefore inhibition of Glutamate receptor, ionotropic, delta 1 (GRID1, Accession XP_043613.8). Accordingly, utilities of GAM5385 include diagnosis, prevention and treatment of diseases and clinical conditions associated with GRID1.

H-plk (Accession NP_056936.1) is another GAM5385 target gene, herein designated TARGET GENE. H-plk BINDING SITE is a target binding site found in the 5' untranslated region of mRNA encoded by H-plk, corresponding to a target binding site such as BINDING SITE I, BINDING SITE II or BINDING SITE III of FIG. 8. Table 4 illustrates the complementarity of the nucleotide sequences of H-plk BINDING SITE, designated SEQ ID:8719, to the nucleotide sequence of GAM5385 RNA, herein designated GAM RNA, also designated SEQ ID:218.

Another function of GAM5385 is therefore inhibition of H-plk (Accession NP_056936.1). Accordingly, utilities of GAM5385 include diagnosis, prevention and treatment of diseases and clinical conditions associated with H-plk.

HGC6.2 (Accession NP_055171.1) is another GAM5385 target gene, herein designated TARGET GENE. HGC6.2 BINDING SITE is a target binding site found in the 3' untranslated region of mRNA encoded by HGC6.2, corresponding to a target binding site such as BINDING SITE I, BINDING SITE II or BINDING SITE III of FIG. 8. Table 4 illustrates the complementarity of the nucleotide sequences of HGC6.2 BINDING SITE, designated SEQ ID:11193, to the nucleotide sequence of GAM5385 RNA, herein designated GAM RNA, also designated SEQ ID:218.

Another function of GAM5385 is therefore inhibition of HGC6.2 (Accession NP_055171.1). Accordingly, utilities of GAM5385 include diagnosis, prevention and treatment of diseases and clinical conditions associated with HGC6.2.

Hla-g histocompatibility antigen, class i, g (HLA-G, Accession NP_002118.1) is another GAM5385 target gene, herein designated TARGET GENE. HLA-G BINDING SITE is a target binding site found in the 3' untranslated region of mRNA encoded by HLA-G, corresponding to a target binding site such as BINDING SITE I, BINDING SITE II or BINDING SITE III of FIG. 8. Table 4 illustrates the complementarity of the nucleotide sequences of HLA-G BINDING SITE, designated SEQ ID:17163, to the nucleotide sequence of GAM5385 RNA, herein designated GAM RNA, also designated SEQ ID:218.

Another function of GAM5385 is therefore inhibition of Hla-g histocompatibility antigen, class i, g (HLA-G, Accession NP_002118.1), a gene which involved in the presentation of foreign antigens to the immune system. Accordingly, utilities of GAM5385 include diagnosis, prevention and treatment of diseases and clinical conditions associated with HLA-G.

The function of HLA-G and its association with various diseases and clinical conditions, has been established by previous studies, as described hereinabove with reference to GAM504.1. Interferon regulatory factor 4 (IRF4, Accession NP_002451.1) is another GAM5385 target gene, herein designated TARGET GENE. IRF4 BINDING SITE is a target binding site found in the 3' untranslated region of mRNA encoded by IRF4, corresponding to a target binding site such as BINDING SITE I, BINDING SITE II or BINDING SITE III of FIG. 8. Table 4 illustrates the complementarity of the nucleotide sequences of IRF4 BINDING SITE, designated SEQ ID:2090, to the nucleotide sequence of GAM5385 RNA, herein designated GAM RNA, also designated SEQ ID:218.

Another function of GAM5385 is therefore inhibition of Interferon regulatory factor 4 (IRF4, Accession NP_002451.1). Accordingly, utilities of GAM5385 include diagnosis, prevention and treatment of diseases and clinical conditions associated with IRF4.

Integrin, alpha l (antigen cd11a (p180), lymphocyte function-associated antigen 1; alpha polypeptide) (ITGAL, Accession NP_002200.1) is another GAM5385 target gene, herein designated TARGET GENE. ITGAL BINDING SITE is a target binding site found in the 5' untranslated region of mRNA encoded by ITGAL, corresponding to a target binding site such as BINDING SITE I, BINDING SITE II or BINDING SITE III of FIG. 8. Table 4 illustrates the complementarity of the nucleotide sequences of ITGAL BINDING SITE, designated SEQ ID:16142, to the nucleotide sequence of GAM5385 RNA, herein designated GAM RNA, also designated SEQ ID:218.

Another function of GAM5385 is therefore inhibition of Integrin, alpha l (antigen cd11a (p180), lymphocyte function-associated antigen 1; alpha polypeptide) (ITGAL, Accession NP_002200.1), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of GAM5385 include diagnosis, prevention and treatment of diseases and clinical conditions associated with ITGAL.

The function of ITGAL and its association with various diseases and clinical conditions, has been established by previous studies, as described hereinabove with reference to GAM148.1. KIAA0317 (Accession NP_055636.1) is another GAM5385 target gene, herein designated TARGET GENE. KIAA0317 BINDING SITE is a target binding site found in the 3' untranslated region of mRNA encoded by KIAA0317, corresponding to a target binding site such as BINDING SITE I, BINDING SITE II or BINDING SITE III of FIG. 8. Table 4 illustrates the complementarity of the nucleotide sequences of KIAA0317 BINDING SITE, designated SEQ ID:14991, to the nucleotide sequence of GAM5385 RNA, herein designated GAM RNA, also designated SEQ ID:218.

Another function of GAM5385 is therefore inhibition of KIAA0317 (Accession NP_055636.1). Accordingly, utilities of GAM5385 include diagnosis, prevention and treatment of diseases and clinical conditions associated with KIAA0317.

KIAA0352 (Accession NP_055645.1) is another GAM5385 target gene, herein designated TARGET GENE. KIAA0352 BINDING SITE is a target binding site found in the 3' untranslated region of mRNA encoded by KIAA0352, corresponding to a target binding site such as BINDING SITE I, BINDING SITE II or BINDING SITE III of FIG. 8. Table 4 illustrates the complementarity of the nucleotide sequences of KIAA0352 BINDING SITE, designated SEQ ID:18577, to the nucleotide sequence of GAM5385 RNA, herein designated GAM RNA, also designated SEQ ID:218.

Another function of GAM5385 is therefore inhibition of KIAA0352 (Accession NP_055645.1). Accordingly, utilities of GAM5385 include diagnosis, prevention and treatment of diseases and clinical conditions associated with KIAA0352.

KIAA0514 (Accession NP_055511.1) is another GAM5385 target gene, herein designated TARGET GENE. KIAA0514 BINDING SITE is a target binding site found in the 3' untranslated region of mRNA encoded by KIAA0514, corresponding to a target binding site such as BINDING SITE I, BINDING SITE II or BINDING SITE III of FIG. 8. Table 4 illustrates the complementarity of the nucleotide sequences of KIAA0514 BINDING SITE, designated SEQ ID:1534, to the nucleotide sequence of GAM5385 RNA, herein designated GAM RNA, also designated SEQ ID:218.

Another function of GAM5385 is therefore inhibition of KIAA0514 (Accession NP_055511.1). Accordingly, utilities of GAM5385 include diagnosis, prevention and treatment of diseases and clinical conditions associated with KIAA0514.

KIAA0721 (Accession NP_067680.2) is another GAM5385 target gene, herein designated TARGET GENE. KIAA0721 BINDING SITE is a target binding site found in the 3' untranslated region of mRNA encoded by KIAA0721, corresponding to a target binding site such as BINDING SITE I, BINDING SITE II or BINDING SITE III of FIG. 8. Table 4 illustrates the complementarity of the nucleotide sequences of KIAA0721 BINDING SITE, designated SEQ ID:4456, to the nucleotide sequence of GAM5385 RNA, herein designated GAM RNA, also designated SEQ ID:218.

Another function of GAM5385 is therefore inhibition of KIAA0721 (Accession NP_067680.2). Accordingly, utilities of GAM5385 include diagnosis, prevention and treatment of diseases and clinical conditions associated with KIAA0721.

KIAA0876 (Accession XP_290852.1) is another GAM5385 target gene, herein designated TARGET GENE. KIAA0876 BINDING SITE is a target binding site found in the 3' untranslated region of mRNA encoded by KIAA0876, corresponding to a target binding site such as BINDING SITE I, BINDING SITE II or BINDING SITE III of FIG. 8. Table 4 illustrates the complementarity of the nucleotide sequences of KIAA0876 BINDING SITE, designated SEQ ID:10335, to the nucleotide sequence of GAM5385 RNA, herein designated GAM RNA, also designated SEQ ID:218.

Another function of GAM5385 is therefore inhibition of KIAA0876 (Accession XP_290852.1). Accordingly, utilities of GAM5385 include diagnosis, prevention and treatment of diseases and clinical conditions associated with KIAA0876.

KIAA0972 (Accession NP_055745.1) is another GAM5385 target gene, herein designated TARGET GENE. KIAA0972 BINDING SITE is a target binding site found in the 3' untranslated region of mRNA encoded by KIAA0972, corresponding to a target binding site such as BINDING SITE I, BINDING SITE II or BINDING SITE III of FIG. 8. Table 4 illustrates the complementarity of the nucleotide sequences of KIAA0972 BINDING SITE, designated SEQ ID:10280, to the nucleotide sequence of GAM5385 RNA, herein designated GAM RNA, also designated SEQ ID:218.

Another function of GAM5385 is therefore inhibition of KIAA0972 (Accession NP_055745.1). Accordingly, utilities of GAM5385 include diagnosis, prevention and treatment of diseases and clinical conditions associated with KIAA0972.

KIAA1754 (Accession NP_203755.1) is another GAM5385 target gene, herein designated TARGET GENE. KIAA1754 BINDING SITE is a target binding site found in the 3' untranslated region of mRNA encoded by KIAA1754, corresponding to a target binding site such as BINDING SITE I, BINDING SITE II or BINDING SITE III of FIG. 8. Table 4 illustrates the complementarity of the nucleotide sequences of KIAA1754 BINDING SITE, designated SEQ ID:14851, to the nucleotide sequence of GAM5385 RNA, herein designated GAM RNA, also designated SEQ ID:218.

Another function of GAM5385 is therefore inhibition of KIAA1754 (Accession NP_203755.1). Accordingly, utilities of GAM5385 include diagnosis, prevention and treatment of diseases and clinical conditions associated with KIAA1754.

KIAA1904 (Accession XP_056282.1) is another GAM5385 target gene, herein designated TARGET GENE. KIAA1904 BINDING SITE is a target binding site found in the 3' untranslated region of mRNA encoded by KIAA1904, corresponding to a target binding site such as BINDING SITE I, BINDING SITE II or BINDING SITE III of FIG. 8. Table 4 illustrates the complementarity of the nucleotide sequences of KIAA1904 BINDING SITE, designated SEQ ID:19375, to the nucleotide sequence of GAM5385 RNA, herein designated GAM RNA, also designated SEQ ID:218.

Another function of GAM5385 is therefore inhibition of KIAA1904 (Accession XP_056282.1). Accordingly, utilities of GAM5385 include diagnosis, prevention and treatment of diseases and clinical conditions associated with KIAA1904.

KIDINS220 (Accession XP_291015.1) is another GAM5385 target gene, herein designated TARGET GENE. KIDINS220 BINDING SITE is a target binding site found in the 3' untranslated region of mRNA encoded by KIDINS220, corresponding to a target binding site such as BINDING SITE I, BINDING SITE II or BINDING SITE III of FIG. 8. Table 4 illustrates the complementarity of the nucleotide sequences of KIDINS220 BINDING SITE, designated SEQ ID:2942, to the nucleotide sequence of GAM5385 RNA, herein designated GAM RNA, also designated SEQ ID:218.

Another function of GAM5385 is therefore inhibition of KIDINS220 (Accession XP_291015.1). Accordingly, utilities of GAM5385 include diagnosis, prevention and treatment of diseases and clinical conditions associated with KIDINS220.

Lectin, galactoside-binding, soluble, 3 (galectin 3) (LGALS3, Accession NP_002297.1) is another GAM5385 target gene, herein designated TARGET GENE. LGALS3 BINDING SITE is a target binding site found in the 3' untranslated region of mRNA encoded by LGALS3, corresponding to a target binding site such as BINDING SITE I, BINDING SITE II or BINDING SITE III of FIG. 8. Table 4 illustrates the complementarity of the nucleotide sequences of LGALS3 BINDING SITE, designated SEQ ID:506, to the nucleotide sequence of GAM5385 RNA, herein designated GAM RNA, also designated SEQ ID:218.

Another function of GAM5385 is therefore inhibition of Lectin, galactoside-binding, soluble, 3 (galectin 3) (LGALS3, Accession NP_002297.1). Accordingly, utilities of GAM5385 include diagnosis, prevention and treatment of diseases and clinical conditions associated with LGALS3.

Lim domain only 4 (LMO4, Accession NP_006760.1) is another GAM5385 target gene, herein designated TARGET GENE. LMO4 BINDING SITE is a target binding site found in the 3' untranslated region of mRNA encoded by LMO4, corresponding to a target binding site such as BINDING SITE I, BINDING SITE II or BINDING SITE III of FIG. 8. Table 4 illustrates the complementarity of the nucleotide sequences of LMO4 BINDING SITE, designated SEQ ID:3198, to the nucleotide sequence of GAM5385 RNA, herein designated GAM RNA, also designated SEQ ID:218.

Another function of GAM5385 is therefore inhibition of Lim domain only 4 (LMO4, Accession NP_006760.1), a gene which promotes myogenic differentiation. Accordingly, utilities of GAM5385 include diagnosis, prevention and treatment of diseases and clinical conditions associated with LMO4.

The function of LMO4 and its association with various diseases and clinical conditions, has been established by previous studies, as described hereinabove with reference to GAM467.2. LOC113612 (Accession XP_054492.1) is another GAM5385 target gene, herein designated TARGET GENE. LOC113612 BINDING SITE is a target binding site found in the 3' untranslated region of mRNA encoded by LOC113612, corresponding to a target binding site such as BINDING SITE I, BINDING SITE II or BINDING SITE III of FIG. 8. Table 4 illustrates the complementarity of the nucleotide sequences of LOC113612 BINDING SITE, designated SEQ ID:821, to the nucleotide sequence of GAM5385 RNA, herein designated GAM RNA, also designated SEQ ID:218.

Another function of GAM5385 is therefore inhibition of LOC113612 (Accession XP_054492.1). Accordingly, utilities of GAM5385 include diagnosis, prevention and treatment of diseases and clinical conditions associated with LOC113612.

LOC126917 (Accession XP_059091.2) is another GAM5385 target gene, herein designated TARGET GENE. LOC126917 BINDING SITE is a target binding site found in the 3' untranslated region of mRNA encoded by LOC126917, corresponding to a target binding site such as BINDING SITE I, BINDING SITE II or BINDING SITE III of FIG. 8. Table 4 illustrates the complementarity of the nucleotide sequences of LOC126917 BINDING SITE, designated SEQ ID:2569, to the nucleotide sequence of GAM5385 RNA, herein designated GAM RNA, also designated SEQ ID:218.

Another function of GAM5385 is therefore inhibition of LOC126917 (Accession XP_059091.2). Accordingly, utilities of GAM5385 include diagnosis, prevention and treatment of diseases and clinical conditions associated with LOC126917.

LOC127262 (Accession XP_072073.5) is another GAM5385 target gene, herein designated TARGET GENE. LOC127262 BINDING SITE is a target binding site found in the 3' untranslated region of mRNA encoded by LOC127262, corresponding to a target binding site such as BINDING SITE I, BINDING SITE II or BINDING SITE III of FIG. 8. Table 4 illustrates the complementarity of the nucleotide sequences of LOC127262 BINDING SITE, designated SEQ ID:14394, to the nucleotide sequence of GAM5385 RNA, herein designated GAM RNA, also designated SEQ ID:218.

Another function of GAM5385 is therefore inhibition of LOC127262 (Accession XP_072073.5). Accordingly, utilities of GAM5385 include diagnosis, prevention and treatment of diseases and clinical conditions associated with LOC127262.

LOC128239 (Accession XP_059223.4) is another GAM5385 target gene, herein designated TARGET GENE. LOC128239 BINDING SITE is a target binding site found in the 5' untranslated region of mRNA encoded by LOC128239, corresponding to a target binding site such as BINDING SITE I, BINDING SITE II or BINDING SITE III of FIG. 8. Table 4 illustrates the complementarity of the nucleotide sequences of LOC128239 BINDING SITE, designated SEQ ID:1443, to the nucleotide sequence of GAM5385 RNA, herein designated GAM RNA, also designated SEQ ID:218.

Another function of GAM5385 is therefore inhibition of LOC128239 (Accession XP_059223.4). Accordingly, utilities of GAM5385 include diagnosis, prevention and treatment of diseases and clinical conditions associated with LOC128239.

LOC130633 (Accession XP_059463.2) is another GAM5385 target gene, herein designated TARGET GENE. LOC130633 BINDING SITE is a target binding site found in the 3' untranslated region of mRNA encoded by LOC130633, corresponding to a target binding site such as BINDING SITE I, BINDING SITE II or BINDING SITE III of FIG. 8. Table 4 illustrates the complementarity of the nucleotide sequences of LOC130633 BINDING SITE, designated SEQ ID:17789, to the nucleotide sequence of GAM5385 RNA, herein designated GAM RNA, also designated SEQ ID:218.

Another function of GAM5385 is therefore inhibition of LOC130633 (Accession XP_059463.2). Accordingly, utilities of GAM5385 include diagnosis, prevention and treatment of diseases and clinical conditions associated with LOC130633.

LOC135521 (Accession XP_059776.1) is another GAM5385 target gene, herein designated TARGET GENE. LOC135521 BINDING SITE is a target binding site found in the 3' untranslated region of mRNA encoded by LOC135521, corresponding to a target binding site such as BINDING SITE I, BINDING SITE II or BINDING SITE III of FIG. 8. Table 4 illustrates the complementarity of the nucleotide sequences of LOC135521 BINDING SITE, designated SEQ ID:18796, to the nucleotide sequence of GAM5385 RNA, herein designated GAM RNA, also designated SEQ ID:218.

Another function of GAM5385 is therefore inhibition of LOC135521 (Accession XP_059776.1). Accordingly, utilities of GAM5385 include diagnosis, prevention and treatment of diseases and clinical conditions associated with LOC135521.

LOC143381 (Accession XP_084501.1) is another GAM5385 target gene, herein designated TARGET GENE. LOC143381 BINDING SITE is a target binding site found in the 3' untranslated region of mRNA encoded by LOC143381, corresponding to a target binding site such as BINDING SITE I, BINDING SITE II or BINDING SITE III of FIG. 8. Table 4 illustrates the complementarity of the nucleotide sequences of LOC143381 BINDING SITE, designated SEQ ID:9647, to the nucleotide sequence of GAM5385 RNA, herein designated GAM RNA, also designated SEQ ID:218.

Another function of GAM5385 is therefore inhibition of LOC143381 (Accession XP_084501.1). Accordingly, utilities of GAM5385 include diagnosis, prevention and treatment of diseases and clinical conditions associated with LOC143381.

LOC144467 (Accession NP_612482.1) is another GAM5385 target gene, herein designated TARGET GENE. LOC144467 BINDING SITE is a target binding site found in the 3' untranslated region of mRNA encoded by LOC144467, corresponding to a target binding site such as BINDING SITE I, BINDING SITE II or BINDING SITE III of FIG. 8. Table 4 illustrates the complementarity of the nucleotide sequences of LOC144467 BINDING SITE, designated SEQ ID:16762, to the nucleotide sequence of GAM5385 RNA, herein designated GAM RNA, also designated SEQ ID:218.

Another function of GAM5385 is therefore inhibition of LOC144467 (Accession NP_612482.1). Accordingly, utilities of GAM5385 include diagnosis, prevention and treatment of diseases and clinical conditions associated with LOC144467.

LOC144678 (Accession XP_096656.1) is another GAM5385 target gene, herein designated TARGET GENE. LOC144678 BINDING SITE is a target binding site found in the 3' untranslated region of mRNA encoded by LOC144678, corresponding to a target binding site such as BINDING SITE I, BINDING SITE II or BINDING SITE III of FIG. 8. Table 4 illustrates the complementarity of the nucleotide sequences of LOC144678 BINDING SITE, designated SEQ ID:18404, to the nucleotide sequence of GAM5385 RNA, herein designated GAM RNA, also designated SEQ ID:218.

Another function of GAM5385 is therefore inhibition of LOC144678 (Accession XP_096656.1). Accordingly, utilities of GAM5385 include diagnosis, prevention and treatment of diseases and clinical conditions associated with LOC144678.

LOC145980 (Accession XP_096914.1) is another GAM5385 target gene, herein designated TARGET GENE. LOC145980 BINDING SITE is a target binding site found in the 5' untranslated region of mRNA encoded by LOC145980, corresponding to a target binding site such as BINDING SITE I, BINDING SITE II or BINDING SITE III of FIG. 8. Table 4 illustrates the complementarity of the nucleotide sequences of LOC145980 BINDING SITE, designated SEQ ID:16415, to the nucleotide sequence of GAM5385 RNA, herein designated GAM RNA, also designated SEQ ID:218.

Another function of GAM5385 is therefore inhibition of LOC145980 (Accession XP_096914.1). Accordingly, utilities of GAM5385 include diagnosis, prevention and treatment of diseases and clinical conditions associated with LOC145980.

LOC147808 (Accession XP_097313.2) is another GAM5385 target gene, herein designated TARGET GENE. LOC147808 BINDING SITE is a target binding site found in the 3' untranslated region of mRNA encoded by LOC147808, corresponding to a target binding site such as BINDING SITE I, BINDING SITE II or BINDING SITE III of FIG. 8. Table 4 illustrates the complementarity of the nucleotide sequences of LOC147808 BINDING SITE, designated SEQ ID:8092, to the nucleotide sequence of GAM5385 RNA, herein designated GAM RNA, also designated SEQ ID:218.

Another function of GAM5385 is therefore inhibition of LOC147808 (Accession XP_097313.2). Accordingly, utilities of GAM5385 include diagnosis, prevention and treatment of diseases and clinical conditions associated with LOC147808.

LOC148418 (Accession XP_086188.6) is another GAM5385 target gene, herein designated TARGET GENE. LOC148418 BINDING SITE is a target binding site found in the 3' untranslated region of mRNA encoded by LOC148418, corresponding to a target binding site such as BINDING SITE I, BINDING SITE II or BINDING SITE III of FIG. 8. Table 4 illustrates the complementarity of the nucleotide sequences of LOC148418 BINDING SITE, designated SEQ ID:14739, to the nucleotide sequence of GAM5385 RNA, herein designated GAM RNA, also designated SEQ ID:218.

Another function of GAM5385 is therefore inhibition of LOC148418 (Accession XP_086188.6). Accordingly, utilities of GAM5385 include diagnosis, prevention and treatment of diseases and clinical conditions associated with LOC148418.

LOC148823 (Accession NP_660321.1) is another GAM5385 target gene, herein designated TARGET GENE. LOC148823 BINDING SITE is a target binding site found in the 5' untranslated region of mRNA encoded by LOC148823, corresponding to a target binding site such as BINDING SITE I, BINDING SITE II or BINDING SITE III of FIG. 8. Table 4 illustrates the complementarity of the nucleotide sequences of LOC148823 BINDING SITE, designated SEQ ID:7024, to the nucleotide sequence of GAM5385 RNA, herein designated GAM RNA, also designated SEQ ID:218.

Another function of GAM5385 is therefore inhibition of LOC148823 (Accession NP_660321.1). Accordingly, utilities of GAM5385 include diagnosis, prevention and treatment of diseases and clinical conditions associated with LOC148823.

LOC150527 (Accession XP_086942.1) is another GAM5385 target gene, herein designated TARGET GENE. LOC150527 BINDING SITE is a target binding site found in the 3' untranslated region of mRNA encoded by LOC150527, corresponding to a target binding site such as BINDING SITE I, BINDING SITE II or BINDING SITE III of FIG. 8. Table 4 illustrates the complementarity of the nucleotide sequences of LOC150527 BINDING SITE, designated SEQ ID:2809, to the nucleotide sequence of GAM5385 RNA, herein designated GAM RNA, also designated SEQ ID:218.

Another function of GAM5385 is therefore inhibition of LOC150527 (Accession XP_086942.1). Accordingly, utilities of GAM5385 include diagnosis, prevention and treatment of diseases and clinical conditions associated with LOC150527.

LOC152790 (Accession XP_098264.1) is another GAM5385 target gene, herein designated TARGET GENE. LOC152790 BINDING SITE is a target binding site found in the 5' untranslated region of mRNA encoded by LOC152790, corresponding to a target binding site such as BINDING SITE I, BINDING SITE II or BINDING SITE III of FIG. 8. Table 4 illustrates the complementarity of the nucleotide sequences of LOC152790 BINDING SITE, designated SEQ ID:6839, to the nucleotide sequence of GAM5385 RNA, herein designated GAM RNA, also designated SEQ ID:218.

Another function of GAM5385 is therefore inhibition of LOC152790 (Accession XP_098264.1). Accordingly, utilities of GAM5385 include diagnosis, prevention and treatment of diseases and clinical conditions associated with LOC152790.

LOC153146 (Accession XP_098319.1) is another GAM5385 target gene, herein designated TARGET GENE. LOC153146 BINDING SITE is a target binding site found in the 5' untranslated region of mRNA encoded by LOC153146, corresponding to a target binding site such as BINDING SITE I, BINDING SITE II or BINDING SITE III of FIG. 8. Table 4 illustrates the complementarity of the nucleotide sequences of LOC153146 BINDING SITE, designated SEQ ID:7502, to the nucleotide sequence of GAM5385 RNA, herein designated GAM RNA, also designated SEQ ID:218.

Another function of GAM5385 is therefore inhibition of LOC153146 (Accession XP_098319.1). Accordingly, utilities of GAM5385 include diagnosis, prevention and treatment of diseases and clinical conditions associated with LOC153146.

LOC158381 (Accession XP_048461.1) is another GAM5385 target gene, herein designated TARGET GENE. LOC158381 BINDING SITE is a target binding site found in the 5' untranslated region of mRNA encoded by LOC158381, corresponding to a target binding site such as BINDING SITE I, BINDING SITE II or BINDING SITE III of FIG. 8. Table 4 illustrates the complementarity of the nucleotide sequences of LOC158381 BINDING SITE, designated SEQ ID:5669, to the nucleotide sequence of GAM5385 RNA, herein designated GAM RNA, also designated SEQ ID:218.

Another function of GAM5385 is therefore inhibition of LOC158381 (Accession XP_048461.1). Accordingly, utilities of GAM5385 include diagnosis, prevention and treatment of diseases and clinical conditions associated with LOC158381.

LOC200169 (Accession XP_211599.1) is another GAM5385 target gene, herein designated TARGET GENE. LOC200169 BINDING SITE is a target binding site found in the 5' untranslated region of multiple transcripts of mRNA encoded by LOC200169, corresponding to a target binding site such as BINDING SITE I, BINDING SITE II or BINDING SITE III of FIG. 8. Table 4 illustrates the complementarity of the nucleotide sequences of LOC200169 BINDING SITE, designated SEQ ID:5297, to the nucleotide sequence of GAM5385 RNA, herein designated GAM RNA, also designated SEQ ID:218.

Another function of GAM5385 is therefore inhibition of LOC200169 (Accession XP_211599.1). Accordingly, utilities of GAM5385 include diagnosis, prevention and treatment of diseases and clinical conditions associated with LOC200169.

LOC202551 (Accession XP_011448.4) is another GAM5385 target gene, herein designated TARGET GENE. LOC202551 BINDING SITE is a target binding site found in the 3' untranslated region of mRNA encoded by LOC202551, corresponding to a target binding site such as BINDING SITE I, BINDING SITE II or BINDING SITE III of FIG. 8. Table 4 illustrates the complementarity of the nucleotide sequences of LOC202551 BINDING SITE, designated SEQ ID:16316, to the nucleotide sequence of GAM5385 RNA, herein designated GAM RNA, also designated SEQ ID:218.

Another function of GAM5385 is therefore inhibition of LOC202551 (Accession XP_011448.4). Accordingly, utilities of GAM5385 include diagnosis, prevention and treatment of diseases and clinical conditions associated with LOC202551.

LOC203249 (Accession XP_116805.2) is another GAM5385 target gene, herein designated TARGET GENE. LOC203249 BINDING SITE is a target binding site found in the 3' untranslated region of mRNA encoded by LOC203249, corresponding to a target binding site such as BINDING SITE I, BINDING SITE II or BINDING SITE III of FIG. 8. Table 4 illustrates the complementarity of the nucleotide sequences of LOC203249 BINDING SITE, designated SEQ ID:6033, to the nucleotide sequence of GAM5385 RNA, herein designated GAM RNA, also designated SEQ ID:218.

Another function of GAM5385 is therefore inhibition of LOC203249 (Accession XP_116805.2). Accordingly, utilities of GAM5385 include diagnosis, prevention and treatment of diseases and clinical conditions associated with LOC203249.

LOC219690 (Accession XP_167572.1) is another GAM5385 target gene, herein designated TARGET GENE. LOC219690 BINDING SITE is a target binding site found in the 5' untranslated region of mRNA encoded by LOC219690, corresponding to a target binding site such as BINDING SITE I, BINDING SITE II or BINDING SITE III of FIG. 8. Table 4 illustrates the complementarity of the nucleotide sequences of LOC219690 BINDING SITE, designated SEQ ID:14755, to the nucleotide sequence of GAM5385 RNA, herein designated GAM RNA, also designated SEQ ID:218.

Another function of GAM5385 is therefore inhibition of LOC219690 (Accession XP_167572.1). Accordingly, utilities of GAM5385 include diagnosis, prevention and treatment of diseases and clinical conditions associated with LOC219690.

LOC255870 (Accession XP_170628.1) is another GAM5385 target gene, herein designated TARGET GENE. LOC255870 BINDING SITE1 and LOC255870 BINDING SITE2 are target binding sites found in untranslated regions of mRNA encoded by LOC255870, corresponding to target binding sites such as BINDING SITE I, BINDING SITE II or BINDING SITE III of FIG. 8. Table 4 illustrates the complementarity of the nucleotide sequences of LOC255870 BINDING SITE1 and LOC255870 BINDING SITE2, designated SEQ ID:17784 and SEQ ID:8949 respectively, to the nucleotide sequence of GAM5385 RNA, herein designated GAM RNA, also designated SEQ ID:218.

Another function of GAM5385 is therefore inhibition of LOC255870 (Accession XP_170628.1). Accordingly, utilities of GAM5385 include diagnosis, prevention and treatment of diseases and clinical conditions associated with LOC255870.

LOC283167 (Accession XP_210921.1) is another GAM5385 target gene, herein designated TARGET GENE. LOC283167 BINDING SITE is a target binding site found in the 3' untranslated region of mRNA encoded by LOC283167, corresponding to a target binding site such as BINDING SITE I, BINDING SITE II or BINDING SITE III of FIG. 8. Table 4 illustrates the complementarity of the nucleotide sequences of LOC283167 BINDING SITE, designated SEQ ID:6144, to the nucleotide sequence of GAM5385 RNA, herein designated GAM RNA, also designated SEQ ID:218.

Another function of GAM5385 is therefore inhibition of LOC283167 (Accession XP_210921.1). Accordingly, utilities of GAM5385 include diagnosis, prevention and treatment of diseases and clinical conditions associated with LOC283167.

LOC283293 (Accession XP_210962.1) is another GAM5385 target gene, herein designated TARGET GENE. LOC283293 BINDING SITE is a target binding site found in the 5' untranslated region of mRNA encoded by LOC283293, corresponding to a target binding site such as BINDING SITE I, BINDING SITE II or BINDING SITE III of FIG. 8. Table 4 illustrates the complementarity of the nucleotide sequences of LOC283293 BINDING SITE, designated SEQ ID:4599, to the nucleotide sequence of GAM5385 RNA, herein designated GAM RNA, also designated SEQ ID:218.

Another function of GAM5385 is therefore inhibition of LOC283293 (Accession XP_210962.1). Accordingly, utilities of GAM5385 include diagnosis, prevention and treatment of diseases and clinical conditions associated with LOC283293.

LOC283465 (Accession XP_208686.1) is another GAM5385 target gene, herein designated TARGET GENE. LOC283465 BINDING SITE is a target binding site found in the 3' untranslated region of mRNA encoded by LOC283465, corresponding to a target binding site such as BINDING SITE I, BINDING SITE II or BINDING SITE III of FIG. 8. Table 4 illustrates the complementarity of the nucleotide sequences of LOC283465 BINDING SITE, designated SEQ ID:1830, to the nucleotide sequence of GAM5385 RNA, herein designated GAM RNA, also designated SEQ ID:218.

Another function of GAM5385 is therefore inhibition of LOC283465 (Accession XP_208686.1). Accordingly, utilities of GAM5385 include diagnosis, prevention and treatment of diseases and clinical conditions associated with LOC283465.

LOC283484 (Accession XP_211053.1) is another GAM5385 target gene, herein designated TARGET GENE. LOC283484 BINDING SITE is a target binding site found in the 5' untranslated region of mRNA encoded by LOC283484, corresponding to a target binding site such as BINDING SITE I, BINDING SITE II or BINDING SITE III of FIG. 8. Table 4 illustrates the complementarity of the nucleotide sequences of LOC283484 BINDING SITE, designated SEQ ID:3455, to the nucleotide sequence of GAM5385 RNA, herein designated GAM RNA, also designated SEQ ID:218.

Another function of GAM5385 is therefore inhibition of LOC283484 (Accession XP_211053.1). Accordingly, utilities of GAM5385 include diagnosis, prevention and treatment of diseases and clinical conditions associated with LOC283484.

LOC283661 (Accession XP_208102.1) is another GAM5385 target gene, herein designated TARGET GENE. LOC283661 BINDING SITE is a target binding site found in the 3' untranslated region of mRNA encoded by LOC283661, corresponding to a target binding site such as BINDING SITE I, BINDING SITE II or BINDING SITE III of FIG. 8. Table 4 illustrates the complementarity of the nucleotide sequences of LOC283661 BINDING SITE, designated SEQ ID:1336, to the nucleotide sequence of GAM5385 RNA, herein designated GAM RNA, also designated SEQ ID:218.

Another function of GAM5385 is therefore inhibition of LOC283661 (Accession XP_208102.1). Accordingly, utilities of GAM5385 include diagnosis, prevention and treatment of diseases and clinical conditions associated with LOC283661.

LOC284048 (Accession XP_208152.1) is another GAM5385 target gene, herein designated TARGET GENE. LOC284048 BINDING SITE is a target binding site found in the 3' untranslated region of mRNA encoded by LOC284048, corresponding to a target binding site such as BINDING SITE I, BINDING SITE II or BINDING SITE III of FIG. 8. Table 4 illustrates the complementarity of the nucleotide sequences of LOC284048 BINDING SITE, designated SEQ ID:1416, to the nucleotide sequence of GAM5385 RNA, herein designated GAM RNA, also designated SEQ ID:218.

Another function of GAM5385 is therefore inhibition of LOC284048 (Accession XP_208152.1). Accordingly, utilities of GAM5385 include diagnosis, prevention and treatment of diseases and clinical conditions associated with LOC284048.

LOC284101 (Accession XP_209019.1) is another GAM5385 target gene, herein designated TARGET GENE. LOC284101 BINDING SITE is a target binding site found in the 5' untranslated region of mRNA encoded by LOC284101, corresponding to a target binding site such as BINDING SITE I, BINDING SITE II or BINDING SITE III of FIG. 8. Table 4 illustrates the complementarity of the nucleotide sequences of LOC284101 BINDING SITE, designated SEQ ID:6084, to the nucleotide sequence of GAM5385 RNA, herein designated GAM RNA, also designated SEQ ID:218.

Another function of GAM5385 is therefore inhibition of LOC284101 (Accession XP_209019.1). Accordingly, utilities of GAM5385 include diagnosis, prevention and treatment of diseases and clinical conditions associated with LOC284101.

LOC284158 (Accession XP_209041.1) is another GAM5385 target gene, herein designated TARGET GENE. LOC284158 BINDING SITE is a target binding site found in the 5' untranslated region of mRNA encoded by LOC284158, corresponding to a target binding site such as BINDING SITE I, BINDING SITE II or BINDING SITE III of FIG. 8. Table 4 illustrates the complementarity of the nucleotide sequences of LOC284158 BINDING SITE, designated SEQ ID:17928, to the nucleotide sequence of GAM5385 RNA, herein designated GAM RNA, also designated SEQ ID:218.

Another function of GAM5385 is therefore inhibition of LOC284158 (Accession XP_209041.1). Accordingly, utilities of GAM5385 include diagnosis, prevention and treatment of diseases and clinical conditions associated with LOC284158.

LOC284263 (Accession XP_211400.1) is another GAM5385 target gene, herein designated TARGET GENE. LOC284263 BINDING SITE is a target binding site found in the 5' untranslated region of mRNA encoded by LOC284263, corresponding to a target binding site such as BINDING SITE I, BINDING SITE II or BINDING SITE III of FIG. 8. Table 4 illustrates the complementarity of the nucleotide sequences of LOC284263 BINDING SITE, designated SEQ ID:10396, to the nucleotide sequence of GAM5385 RNA, herein designated GAM RNA, also designated SEQ ID:218.

Another function of GAM5385 is therefore inhibition of LOC284263 (Accession XP_211400.1). Accordingly, utilities of GAM5385 include diagnosis, prevention and treatment of diseases and clinical conditions associated with LOC284263.

LOC284555 (Accession XP_211518.1) is another GAM5385 target gene, herein designated TARGET GENE. LOC284555 BINDING SITE is a target binding site found in the 3' untranslated region of mRNA encoded by LOC284555, corresponding to a target binding site such as BINDING SITE I, BINDING SITE II or BINDING SITE III of FIG. 8. Table 4 illustrates the complementarity of the nucleotide sequences of LOC284555 BINDING SITE, designated SEQ ID:5552, to the nucleotide sequence of GAM5385 RNA, herein designated GAM RNA, also designated SEQ ID:218.

Another function of GAM5385 is therefore inhibition of LOC284555 (Accession XP_211518.1). Accordingly, utilities of GAM5385 include diagnosis, prevention and treatment of diseases and clinical conditions associated with LOC284555.

LOC284737 (Accession XP_211612.1) is another GAM5385 target gene, herein designated TARGET GENE. LOC284737 BINDING SITE is a target binding site found in the 3' untranslated region of mRNA encoded by LOC284737, corresponding to a target binding site such as BINDING SITE I, BINDING SITE II or BINDING SITE III of FIG. 8. Table 4 illustrates the complementarity of the nucleotide sequences of LOC284737 BINDING SITE, designated SEQ ID:6441, to the nucleotide sequence of GAM5385 RNA, herein designated GAM RNA, also designated SEQ ID:218.

Another function of GAM5385 is therefore inhibition of LOC284737 (Accession XP_211612.1). Accordingly, utilities of GAM5385 include diagnosis, prevention and treatment of diseases and clinical conditions associated with LOC284737.

LOC284759 (Accession XP_209363.1) is another GAM5385 target gene, herein designated TARGET GENE. LOC284759 BINDING SITE is a target binding site found in the 3' untranslated region of mRNA encoded by LOC284759, corresponding to a target binding site such as BINDING SITE I, BINDING SITE II or BINDING SITE III of FIG. 8. Table 4 illustrates the complementarity of the nucleotide sequences of LOC284759 BINDING SITE, designated SEQ ID:10735, to the nucleotide sequence of GAM5385 RNA, herein designated GAM RNA, also designated SEQ ID:218.

Another function of GAM5385 is therefore inhibition of LOC284759 (Accession XP_209363.1). Accordingly, utilities of GAM5385 include diagnosis, prevention and treatment of diseases and clinical conditions associated with LOC284759.

LOC284898 (Accession XP_211685.1) is another GAM5385 target gene, herein designated TARGET GENE. LOC284898 BINDING SITE is a target binding site found in the 3' untranslated region of mRNA encoded by LOC284898, corresponding to a target binding site such as BINDING SITE I, BINDING SITE II or BINDING SITE III of FIG. 8. Table 4 illustrates the complementarity of the nucleotide sequences of LOC284898 BINDING SITE, designated SEQ ID:13073, to the nucleotide sequence of GAM5385 RNA, herein designated GAM RNA, also designated SEQ ID:218.

Another function of GAM5385 is therefore inhibition of LOC284898 (Accession XP_211685.1). Accordingly, utilities of GAM5385 include diagnosis, prevention and treatment of diseases and clinical conditions associated with LOC284898.

LOC338825 (Accession XP_294723.1) is another GAM5385 target gene, herein designated TARGET GENE. LOC338825 BINDING SITE is a target binding site found in the 5' untranslated region of mRNA encoded by LOC338825, corresponding to a target binding site such as BINDING SITE I, BINDING SITE II or BINDING SITE III of FIG. 8. Table 4 illustrates the complementarity of the nucleotide sequences of LOC338825 BINDING SITE, designated SEQ ID:12400, to the nucleotide sequence of GAM5385 RNA, herein designated GAM RNA, also designated SEQ ID:218.

Another function of GAM5385 is therefore inhibition of LOC338825 (Accession XP_294723.1). Accordingly, utilities of GAM5385 include diagnosis, prevention and treatment of diseases and clinical conditions associated with LOC338825.

LOC339216 (Accession XP_290762.2) is another GAM5385 target gene, herein designated TARGET GENE. LOC339216 BINDING SITE is a target binding site found in the 5' untranslated region of mRNA encoded by LOC339216, corresponding to a target binding site such as BINDING SITE I, BINDING SITE II or BINDING SITE III of FIG. 8. Table 4 illustrates the complementarity of the nucleotide sequences of LOC339216 BINDING SITE, designated SEQ ID:6084, to the nucleotide sequence of GAM5385 RNA, herein designated GAM RNA, also designated SEQ ID:218.

Another function of GAM5385 is therefore inhibition of LOC339216 (Accession XP_290762.2). Accordingly, utilities of GAM5385 include diagnosis, prevention and treatment of diseases and clinical conditions associated with LOC339216.

LOC339282 (Accession XP_294900.2) is another GAM5385 target gene, herein designated TARGET GENE. LOC339282 BINDING SITE is a target binding site found in the 5' untranslated region of mRNA encoded by LOC339282, corresponding to a target binding site such as BINDING SITE I, BINDING SITE II or BINDING SITE III of FIG. 8. Table 4 illustrates the complementarity of the nucleotide sequences of LOC339282 BINDING SITE, designated SEQ ID:6084, to the nucleotide sequence of GAM5385 RNA, herein designated GAM RNA, also designated SEQ ID:218.

Another function of GAM5385 is therefore inhibition of LOC339282 (Accession XP_294900.2). Accordingly, utilities of GAM5385 include diagnosis, prevention and treatment of diseases and clinical conditions associated with LOC339282.

LOC340178 (Accession XP_295181.1) is another GAM5385 target gene, herein designated TARGET GENE. LOC340178 BINDING SITE is a target binding site found in the 5' untranslated region of mRNA encoded by LOC340178, corresponding to a target binding site such as BINDING SITE I, BINDING SITE II or BINDING SITE III of FIG. 8. Table 4 illustrates the complementarity of the nucleotide sequences of LOC340178 BINDING SITE, designated SEQ ID:3108, to the nucleotide sequence of GAM5385 RNA, herein designated GAM RNA, also designated SEQ ID:218.

Another function of GAM5385 is therefore inhibition of LOC340178 (Accession XP_295181.1). Accordingly, utilities of GAM5385 include diagnosis, prevention and treatment of diseases and clinical conditions associated with LOC340178.

LOC341036 (Accession XP_295967.2) is another GAM5385 target gene, herein designated TARGET GENE. LOC341036 BINDING SITE1 and LOC341036 BINDING SITE2 are target binding sites found in untranslated regions of mRNA encoded by LOC341036, corresponding to target binding sites such as BINDING SITE I, BINDING SITE II or BINDING SITE III of FIG. 8. Table 4 illustrates the complementarity of the nucleotide sequences of LOC341036 BINDING SITE1 and LOC341036 BINDING SITE2, designated SEQ ID:2544 and SEQ ID:4152 respectively, to the nucleotide sequence of GAM5385 RNA, herein designated GAM RNA, also designated SEQ ID:218.

Another function of GAM5385 is therefore inhibition of LOC341036 (Accession XP_295967.2). Accordingly, utilities of GAM5385 include diagnosis, prevention and treatment of diseases and clinical conditions associated with LOC341036.

LOC341640 (Accession XP_292193.1) is another GAM5385 target gene, herein designated TARGET GENE. LOC341640 BINDING SITE is a target binding site found in the 5' untranslated region of mRNA encoded by LOC341640, corresponding to a target binding site such as BINDING SITE I, BINDING SITE II or BINDING SITE III of FIG. 8. Table 4 illustrates the complementarity of the nucleotide sequences of LOC341640 BINDING SITE, designated SEQ ID:8348, to the nucleotide sequence of GAM5385 RNA, herein designated GAM RNA, also designated SEQ ID:218.

Another function of GAM5385 is therefore inhibition of LOC341640 (Accession XP_292193.1). Accordingly, utilities of GAM5385 include diagnosis, prevention and treatment of diseases and clinical conditions associated with LOC341640.

LOC343265 (Accession XP_291488.1) is another GAM5385 target gene, herein designated TARGET GENE. LOC343265 BINDING SITE is a target binding site found in the 5' untranslated region of mRNA encoded by LOC343265, corresponding to a target binding site such as BINDING SITE I, BINDING SITE II or BINDING SITE III of FIG. 8. Table 4 illustrates the complementarity of the nucleotide sequences of LOC343265 BINDING SITE, designated SEQ ID:5095, to the nucleotide sequence of GAM5385 RNA, herein designated GAM RNA, also designated SEQ ID:218.

Another function of GAM5385 is therefore inhibition of LOC343265 (Accession XP_291488.1). Accordingly, utilities of GAM5385 include diagnosis, prevention and treatment of diseases and clinical conditions associated with LOC343265.

LOC348529 (Accession XP_302813.1) is another GAM5385 target gene, herein designated TARGET GENE. LOC348529 BINDING SITE is a target binding site found in the 5' untranslated region of mRNA encoded by LOC348529, corresponding to a target binding site such as BINDING SITE I, BINDING SITE II or BINDING SITE III of FIG. 8. Table 4 illustrates the complementarity of the nucleotide sequences of LOC348529 BINDING SITE, designated SEQ ID:18900, to the nucleotide sequence of GAM5385 RNA, herein designated GAM RNA, also designated SEQ ID:218.

Another function of GAM5385 is therefore inhibition of LOC348529 (Accession XP_302813.1). Accordingly, utilities of GAM5385 include diagnosis, prevention and treatment of diseases and clinical conditions associated with LOC348529.

LOC348734 (Accession XP_211718.1) is another GAM5385 target gene, herein designated TARGET GENE. LOC348734 BINDING SITE is a target binding site found in the 3' untranslated region of mRNA encoded by LOC348734, corresponding to a target binding site such as BINDING SITE I, BINDING SITE II or BINDING SITE III of FIG. 8. Table 4 illustrates the complementarity of the nucleotide sequences of LOC348734 BINDING SITE, designated SEQ ID:2809, to the nucleotide sequence of GAM5385 RNA, herein designated GAM RNA, also designated SEQ ID:218.

Another function of GAM5385 is therefore inhibition of LOC348734 (Accession XP_211718.1). Accordingly, utilities of GAM5385 include diagnosis, prevention and treatment of diseases and clinical conditions associated with LOC348734.

LOC351012 (Accession XP_304617.1) is another GAM5385 target gene, herein designated TARGET GENE. LOC351012 BINDING SITE is a target binding site found in the 3' untranslated region of mRNA encoded by LOC351012, corresponding to a target binding site such as BINDING SITE I, BINDING SITE II or BINDING SITE III of FIG. 8. Table 4 illustrates the complementarity of the nucleotide sequences of LOC351012 BINDING SITE, designated SEQ ID:18415, to the nucleotide sequence of GAM5385 RNA, herein designated GAM RNA, also designated SEQ ID:218.

Another function of GAM5385 is therefore inhibition of LOC351012 (Accession XP_304617.1). Accordingly, utilities of GAM5385 include diagnosis, prevention and treatment of diseases and clinical conditions associated with LOC351012.

LOC352051 (Accession XP_305365.1) is another GAM5385 target gene, herein designated TARGET GENE. LOC352051 BINDING SITE is a target binding site found in the 5' untranslated region of mRNA encoded by LOC352051, corresponding to a target binding site such as BINDING SITE I, BINDING SITE II or BINDING SITE III of FIG. 8. Table 4 illustrates the complementarity of the nucleotide sequences of LOC352051 BINDING SITE, designated SEQ ID:1884, to the nucleotide sequence of GAM5385 RNA, herein designated GAM RNA, also designated SEQ ID:218.

Another function of GAM5385 is therefore inhibition of LOC352051 (Accession XP_305365.1). Accordingly, utilities of GAM5385 include diagnosis, prevention and treatment of diseases and clinical conditions associated with LOC352051.

LOC55908 (Accession NP_061157.2) is another GAM5385 target gene, herein designated TARGET GENE. LOC55908 BINDING SITE is a target binding site found in the 3' untranslated region of mRNA encoded by LOC55908, corresponding to a target binding site such as BINDING SITE I, BINDING SITE II or BINDING SITE III of FIG. 8. Table 4 illustrates the complementarity of the nucleotide sequences of LOC55908 BINDING SITE, designated SEQ ID:6986, to the nucleotide sequence of GAM5385 RNA, herein designated GAM RNA, also designated SEQ ID:218.

Another function of GAM5385 is therefore inhibition of LOC55908 (Accession NP_061157.2). Accordingly, utilities of GAM5385 include diagnosis, prevention and treatment of diseases and clinical conditions associated with LOC55908.

LOC90719 (Accession XP_033704.1) is another GAM5385 target gene, herein designated TARGET GENE. LOC90719 BINDING SITE is a target binding site found in the 3' untranslated region of mRNA encoded by LOC90719, corresponding to a target binding site such as BINDING SITE I, BINDING SITE II or BINDING SITE III of FIG. 8. Table 4 illustrates the complementarity of the nucleotide sequences of LOC90719 BINDING SITE, designated SEQ ID:17254, to the nucleotide sequence of GAM5385 RNA, herein designated GAM RNA, also designated SEQ ID:218.

Another function of GAM5385 is therefore inhibition of LOC90719 (Accession XP_033704.1). Accordingly, utilities of GAM5385 include diagnosis, prevention and treatment of diseases and clinical conditions associated with LOC90719.

LOC91947 (Accession XP_041721.2) is another GAM5385 target gene, herein designated TARGET GENE. LOC91947 BINDING SITE1 and LOC91947 BINDING SITE2 are target binding sites found in untranslated regions of mRNA encoded by LOC91947, corresponding to target binding sites such as BINDING SITE I, BINDING SITE II or BINDING SITE III of FIG. 8. Table 4 illustrates the complementarity of the nucleotide sequences of LOC91947 BINDING SITE1 and LOC91947 BINDING SITE2, designated SEQ ID:7137 and SEQ ID:13311 respectively, to the nucleotide sequence of GAM5385 RNA, herein designated GAM RNA, also designated SEQ ID:218.

Another function of GAM5385 is therefore inhibition of LOC91947 (Accession XP_041721.2). Accordingly, utilities of GAM5385 include diagnosis, prevention and treatment of diseases and clinical conditions associated with LOC91947.

LOC96597 (Accession XP_039922.1) is another GAM5385 target gene, herein designated TARGET GENE. LOC96597 BINDING SITE is a target binding site found in the 3' untranslated region of mRNA encoded by LOC96597, corresponding to a target binding site such as BINDING SITE I, BINDING SITE II or BINDING SITE III of FIG. 8. Table 4 illustrates the complementarity of the nucleotide sequences of LOC96597 BINDING SITE, designated SEQ ID:9062, to the nucleotide sequence of GAM5385 RNA, herein designated GAM RNA, also designated SEQ ID:218.

Another function of GAM5385 is therefore inhibition of LOC96597 (Accession XP_039922.1). Accordingly, utilities of GAM5385 include diagnosis, prevention and treatment of diseases and clinical conditions associated with LOC96597.

Loss of heterozygosity, 11, chromosomal region 2, gene a (LOH11CR2A, Accession NP_055437.1) is another GAM5385 target gene, herein designated TARGET GENE. LOH11CR2A BINDING SITE is a target binding site found in the 3' untranslated region of mRNA encoded by LOH11CR2A, corresponding to a target binding site such as BINDING SITE I, BINDING SITE II or BINDING SITE III of FIG. 8. Table 4 illustrates the complementarity of the nucleotide sequences of LOH11CR2A BINDING SITE, designated SEQ ID:14358, to the nucleotide sequence of GAM5385 RNA, herein designated GAM RNA, also designated SEQ ID:218.

Another function of GAM5385 is therefore inhibition of Loss of heterozygosity, 11, chromosomal region 2, gene a (LOH11CR2A, Accession NP_055437.1). Accordingly, utilities of GAM5385 include diagnosis, prevention and treatment of diseases and clinical conditions associated with LOH11CR2A.

Mads box transcription enhancer factor 2, polypeptide b (myocyte enhancer factor 2b) (MEF2B, Accession NP_005910.1) is another GAM5385 target gene, herein designated TARGET GENE. MEF2B BINDING SITE is a target binding site found in the 5' untranslated region of mRNA encoded by MEF2B, corresponding to a target binding site such as BINDING SITE I, BINDING SITE II or BINDING SITE III of FIG. 8. Table 4 illustrates the complementarity of the nucleotide sequences of MEF2B BINDING SITE, designated SEQ ID:13472, to the nucleotide sequence of GAM5385 RNA, herein designated GAM RNA, also designated SEQ ID:218.

Another function of GAM5385 is therefore inhibition of Mads box transcription enhancer factor 2, polypeptide b (myocyte enhancer factor 2b) (MEF2B, Accession NP_005910.1), a gene which binds a consensus sequence that regulates transcription. Accordingly, utilities of GAM5385 include diagnosis, prevention and treatment of diseases and clinical conditions associated with MEF2B.

The function of MEF2B and its association with various diseases and clinical conditions, has been established by previous studies, as described hereinabove with reference to GAM31.1. MGC11061 (Accession NP_115688.1) is another GAM5385 target gene, herein designated TARGET GENE. MGC11061 BINDING SITE is a target binding site found in the 3' untranslated region of mRNA encoded by MGC11061, corresponding to a target binding site such as BINDING SITE I, BINDING SITE II or BINDING SITE III of FIG. 8. Table 4 illustrates the complementarity of the nucleotide sequences of MGC11061 BINDING SITE, designated SEQ ID:10669, to the nucleotide sequence of GAM5385 RNA, herein designated GAM RNA, also designated SEQ ID:218.

Another function of GAM5385 is therefore inhibition of MGC11061 (Accession NP_115688.1). Accordingly, utilities of GAM5385 include diagnosis, prevention and treatment of diseases and clinical conditions associated with MGC11061.

MGC18216 (Accession NP_689665.1) is another GAM5385 target gene, herein designated TARGET GENE. MGC18216 BINDING SITE is a target binding site found in the 5' untranslated region of mRNA encoded by MGC18216, corresponding to a target binding site such as BINDING SITE I, BINDING SITE II or BINDING SITE III of FIG. 8. Table 4 illustrates the complementarity of the nucleotide sequences of MGC18216 BINDING SITE, designated SEQ ID:8207, to the nucleotide sequence of GAM5385 RNA, herein designated GAM RNA, also designated SEQ ID:218.

Another function of GAM5385 is therefore inhibition of MGC18216 (Accession NP_689665.1). Accordingly, utilities of GAM5385 include diagnosis, prevention and treatment of diseases and clinical conditions associated with MGC18216.

MGC34713 (Accession NP_775936.1) is another GAM5385 target gene, herein designated TARGET GENE. MGC34713 BINDING SITE is a target binding site found in the 5' untranslated region of mRNA encoded by MGC34713, corresponding to a target binding site such as BINDING SITE I, BINDING SITE II or BINDING SITE III of FIG. 8. Table 4 illustrates the complementarity of the nucleotide sequences of MGC34713 BINDING SITE, designated SEQ ID:10134, to the nucleotide sequence of GAM5385 RNA, herein designated GAM RNA, also designated SEQ ID:218.

Another function of GAM5385 is therefore inhibition of MGC34713 (Accession NP_775936.1). Accordingly, utilities of GAM5385 include diagnosis, prevention and treatment of diseases and clinical conditions associated with MGC34713.

Nuclear receptor subfamily 2, group f, member 2 (NR2F2, Accession NP_066285.1) is another GAM5385 target gene, herein designated TARGET GENE. NR2F2 BINDING SITE is a target binding site found in the 3' untranslated region of mRNA encoded by NR2F2, corresponding to a target binding site such as BINDING SITE I, BINDING SITE II or BINDING SITE III of FIG. 8. Table 4 illustrates the complementarity of the nucleotide sequences of NR2F2 BINDING SITE, designated SEQ ID:11718, to the nucleotide sequence of GAM5385 RNA, herein designated GAM RNA, also designated SEQ ID:218.

Another function of GAM5385 is therefore inhibition of Nuclear receptor subfamily 2, group f, member 2 (NR2F2, Accession NP_066285.1), a gene which is the regulation of the apolipoprotein ai gene transcription. Accordingly, utilities of GAM5385 include diagnosis, prevention and treatment of diseases and clinical conditions associated with NR2F2.

The function of NR2F2 and its association with various diseases and clinical conditions, has been established by previous studies, as described hereinabove with reference to GAM386.1. NY-REN-25 (Accession XP_027116.6) is another GAM5385 target gene, herein designated TARGET GENE. NY-REN-25 BINDING SITE is a target binding site found in the 3' untranslated region of mRNA encoded by NY-REN-25, corresponding to a target binding site such as BINDING SITE I, BINDING SITE II or BINDING SITE III of FIG. 8. Table 4 illustrates the complementarity of the nucleotide sequences of NY-REN-25 BINDING SITE, designated SEQ ID:974, to the nucleotide sequence of GAM5385 RNA, herein designated GAM RNA, also designated SEQ ID:218.

Another function of GAM5385 is therefore inhibition of NY-REN-25 (Accession XP_027116.6). Accordingly, utilities of GAM5385 include diagnosis, prevention and treatment of diseases and clinical conditions associated with NY-REN-25.

NY-REN-41 (Accession NP_542385.1) is another GAM5385 target gene, herein designated TARGET GENE. NY-REN-41 BINDING SITE is a target binding site found in the 3' untranslated region of mRNA encoded by NY-REN-41, corresponding to a target binding site such as BINDING SITE I, BINDING SITE II or BINDING SITE III of FIG. 8. Table 4 illustrates the complementarity of the nucleotide sequences of NY-REN-41 BINDING SITE, designated SEQ ID:4623, to the nucleotide sequence of GAM5385 RNA, herein designated GAM RNA, also designated SEQ ID:218.

Another function of GAM5385 is therefore inhibition of NY-REN-41 (Accession NP_542385.1). Accordingly, utilities of GAM5385 include diagnosis, prevention and treatment of diseases and clinical conditions associated with NY-REN-41.

Oxysterol binding protein-like 10 (OSBPL10, Accession NP_060254.2) is another GAM5385 target gene, herein designated TARGET GENE. OSBPL10 BINDING SITE is a target binding site found in the 3' untranslated region of mRNA encoded by OSBPL10, corresponding to a target binding site such as BINDING SITE I, BINDING SITE II or BINDING SITE III of FIG. 8. Table 4 illustrates the complementarity of the nucleotide sequences of OSBPL10 BINDING SITE, designated SEQ ID:2040, to the nucleotide sequence of GAM5385 RNA, herein designated GAM RNA, also designated SEQ ID:218.

Another function of GAM5385 is therefore inhibition of Oxysterol binding protein-like 10 (OSBPL10, Accession NP_060254.2). Accordingly, utilities of GAM5385 include diagnosis, prevention and treatment of diseases and clinical conditions associated with OSBPL10.

Paired box gene 7 (PAX7, Accession NP_002575.1) is another GAM5385 target gene, herein designated TARGET GENE. PAX7 BINDING SITE is a target binding site found in the 5' untranslated region of multiple transcripts of mRNA encoded by PAX7, corresponding to a target binding site such as BINDING SITE I, BINDING SITE II or BINDING SITE III of FIG. 8. Table 4 illustrates the complementarity of the nucleotide sequences of PAX7 BINDING SITE, designated SEQ ID:16405, to the nucleotide sequence of GAM5385 RNA, herein designated GAM RNA, also designated SEQ ID:218.

Another function of GAM5385 is therefore inhibition of Paired box gene 7 (PAX7, Accession NP_002575.1), a gene which involves in myogenesis and therefore is associated with Rhabdomyosarcoma-2. Accordingly, utilities of GAM5385 include diagnosis, prevention and treatment of Rhabdomyosarcoma-2, and of other diseases and clinical conditions associated with PAX7.

The function of PAX7 and its association with various diseases and clinical conditions, has been established by previous studies, as described hereinabove with reference to GAM94.1. Paired box gene 7 (PAX7, Accession NP_039236.1) is another GAM5385 target gene, herein designated TARGET GENE. PAX7 BINDING SITE is a target binding site found in the 5' untranslated region of multiple transcripts of mRNA encoded by PAX7, corresponding to a target binding site such as BINDING SITE I, BINDING SITE II or BINDING SITE III of FIG. 8. Table 4 illustrates the complementarity of the nucleotide sequences of PAX7 BINDING SITE, designated SEQ ID:16405, to the nucleotide sequence of GAM5385 RNA, herein designated GAM RNA, also designated SEQ ID:218.

Another function of GAM5385 is therefore inhibition of Paired box gene 7 (PAX7, Accession NP_039236.1), a gene which involves in myogenesis and therefore is associated with Rhabdomyosarcoma-2. Accordingly, utilities of GAM5385 include diagnosis, prevention and treatment of Rhabdomyosarcoma-2, and of other diseases and clinical conditions associated with PAX7.

The function of PAX7 and its association with various diseases and clinical conditions, has been established by previous studies, as described hereinabove with reference to GAM94.1. Phosphoglycerate dehydrogenase (PHGDH, Accession NP_006614.2) is another GAM5385 target gene, herein designated TARGET GENE. PHGDH BINDING SITE is a target binding site found in the 3' untranslated region of mRNA encoded by PHGDH, corresponding to a target binding site such as BINDING SITE I, BINDING SITE II or BINDING SITE III of FIG. 8. Table 4 illustrates the complementarity of the nucleotide sequences of PHGDH BINDING SITE, designated SEQ ID:14461, to the nucleotide sequence of GAM5385 RNA, herein designated GAM RNA, also designated SEQ ID:218.

Another function of GAM5385 is therefore inhibition of Phosphoglycerate dehydrogenase (PHGDH, Accession NP_006614.2). Accordingly, utilities of GAM5385 include diagnosis, prevention and treatment of diseases and clinical conditions associated with PHGDH.

Pleckstrin homology domain containing, family a (phosphoinositide binding specific) member 4 (PLEKHA4, Accession NP_065955.1) is another GAM5385 target gene, herein designated TARGET GENE. PLEKHA4 BINDING SITE is a target binding site found in the 5' untranslated region of mRNA encoded by PLEKHA4, corresponding to a target binding site such as BINDING SITE I, BINDING SITE II or BINDING SITE III of FIG. 8. Table 4 illustrates the complementarity of the nucleotide sequences of PLEKHA4 BINDING SITE, designated SEQ ID:6785, to the nucleotide sequence of GAM5385 RNA, herein designated GAM RNA, also designated SEQ ID:218.

Another function of GAM5385 is therefore inhibition of Pleckstrin homology domain containing, family a (phosphoinositide binding specific) member 4 (PLEKHA4, Accession NP_065955.1). Accordingly, utilities of GAM5385 include diagnosis, prevention and treatment of diseases and clinical conditions associated with PLEKHA4.

Pro-melanin-concentrating hormone-like 1 (PMCHL1, Accession NP__114093.1) is another GAM5385 target gene, herein designated TARGET GENE. PMCHL1 BINDING SITE is a target binding site found in the 3' untranslated region of mRNA encoded by PMCHL1, corresponding to a target binding site such as BINDING SITE I, BINDING SITE II or BINDING SITE III of FIG. 8. Table 4 illustrates the complementarity of the nucleotide sequences of PMCHL1 BINDING SITE, designated SEQ ID:10293, to the nucleotide sequence of GAM5385 RNA, herein designated GAM RNA, also designated SEQ ID:218.

Another function of GAM5385 is therefore inhibition of Pro-melanin-concentrating hormone-like 1 (PMCHL1, Accession NP__114093.1). Accordingly, utilities of GAM5385 include diagnosis, prevention and treatment of diseases and clinical conditions associated with PMCHL1.

Pro-melanin-concentrating hormone-like 2 (PMCHL2, Accession NP__114094.1) is another GAM5385 target gene, herein designated TARGET GENE. PMCHL2 BINDING SITE is a target binding site found in the 3' untranslated region of mRNA encoded by PMCHL2, corresponding to a target binding site such as BINDING SITE I, BINDING SITE II or BINDING SITE III of FIG. 8. Table 4 illustrates the complementarity of the nucleotide sequences of PMCHL2 BINDING SITE, designated SEQ ID:3755, to the nucleotide sequence of GAM5385 RNA, herein designated GAM RNA, also designated SEQ ID:218.

Another function of GAM5385 is therefore inhibition of Pro-melanin-concentrating hormone-like 2 (PMCHL2, Accession NP__114094.1). Accordingly, utilities of GAM5385 include diagnosis, prevention and treatment of diseases and clinical conditions associated with PMCHL2.

Protein tyrosine phosphatase, non-receptor type 9 (PTPN9, Accession NP__002824.1) is another GAM5385 target gene, herein designated TARGET GENE. PTPN9 BINDING SITE is a target binding site found in the 3' untranslated region of mRNA encoded by PTPN9, corresponding to a target binding site such as BINDING SITE I, BINDING SITE II or BINDING SITE III of FIG. 8. Table 4 illustrates the complementarity of the nucleotide sequences of PTPN9 BINDING SITE, designated SEQ ID:13095, to the nucleotide sequence of GAM5385 RNA, herein designated GAM RNA, also designated SEQ ID:218.

Another function of GAM5385 is therefore inhibition of Protein tyrosine phosphatase, non-receptor type 9 (PTPN9, Accession NP__002824.1). Accordingly, utilities of GAM5385 include diagnosis, prevention and treatment of diseases and clinical conditions associated with PTPN9.

Ras, dexamethasone-induced 1 (RASD1, Accession NP__057168.1) is another GAM5385 target gene, herein designated TARGET GENE. RASD1 BINDING SITE is a target binding site found in the 3' untranslated region of mRNA encoded by RASD1, corresponding to a target binding site such as BINDING SITE I, BINDING SITE II or BINDING SITE III of FIG. 8. Table 4 illustrates the complementarity of the nucleotide sequences of RASD1 BINDING SITE, designated SEQ ID:9061, to the nucleotide sequence of GAM5385 RNA, herein designated GAM RNA, also designated SEQ ID:218.

Another function of GAM5385 is therefore inhibition of Ras, dexamethasone-induced 1 (RASD1, Accession NP__057168.1), a gene which is a novel physiologic NO effector. Accordingly, utilities of GAM5385 include diagnosis, prevention and treatment of diseases and clinical conditions associated with RASD1.

The function of RASD1 and its association with various diseases and clinical conditions, has been established by previous studies, as described hereinabove with reference to GAM842.2. Regulator of g-protein signalling 2, 24 kda (RGS2, Accession NP__002914.1) is another GAM5385 target gene, herein designated TARGET GENE. RGS2 BINDING SITE is a target binding site found in the 3' untranslated region of mRNA encoded by RGS2, corresponding to a target binding site such as BINDING SITE I, BINDING SITE II or BINDING SITE III of FIG. 8. Table 4 illustrates the complementarity of the nucleotide sequences of RGS2 BINDING SITE, designated SEQ ID:19470, to the nucleotide sequence of GAM5385 RNA, herein designated GAM RNA, also designated SEQ ID:218.

Another function of GAM5385 is therefore inhibition of Regulator of g-protein signalling 2, 24 kda (RGS2, Accession NP__002914.1), a gene which inhibits signal transduction by increasing the gtpase activity of g protein thereby driving them into their inactive gdp-bound form. and therefore may be associated with Rieger syndrome. Accordingly, utilities of GAM5385 include diagnosis, prevention and treatment of Rieger syndrome, and of other diseases and clinical conditions associated with RGS2.

The function of RGS2 and its association with various diseases and clinical conditions, has been established by previous studies, as described hereinabove with reference to GAM374.2. Regulator of g-protein signalling 6 (RGS6, Accession NP__004287.3) is another GAM5385 target gene, herein designated TARGET GENE. RGS6 BINDING SITE is a target binding site found in the 3' untranslated region of mRNA encoded by RGS6, corresponding to a target binding site such as BINDING SITE I, BINDING SITE II or BINDING SITE III of FIG. 8. Table 4 illustrates the complementarity of the nucleotide sequences of RGS6 BINDING SITE, designated SEQ ID:19481, to the nucleotide sequence of GAM5385 RNA, herein designated GAM RNA, also designated SEQ ID:218.

Another function of GAM5385 is therefore inhibition of Regulator of g-protein signalling 6 (RGS6, Accession NP__004287.3). Accordingly, utilities of GAM5385 include diagnosis, prevention and treatment of diseases and clinical conditions associated with RGS6.

RIS (Accession NP__057647.1) is another GAM5385 target gene, herein designated TARGET GENE. RIS BINDING SITE is a target binding site found in the 3' untranslated region of mRNA encoded by RIS, corresponding to a target binding site such as BINDING SITE I, BINDING SITE II or BINDING SITE III of FIG. 8. Table 4 illustrates the complementarity of the nucleotide sequences of RIS BINDING SITE, designated SEQ ID:6292, to the nucleotide sequence of GAM5385 RNA, herein designated GAM RNA, also designated SEQ ID:218.

Another function of GAM5385 is therefore inhibition of RIS (Accession NP__057647.1). Accordingly, utilities of GAM5385 include diagnosis, prevention and treatment of diseases and clinical conditions associated with RIS.

S100A15 (Accession NP__789793.1) is another GAM5385 target gene, herein designated TARGET GENE. S100A15 BINDING SITE is a target binding site found in the 3' untranslated region of mRNA encoded by S100A15, corresponding to a target binding site such as BINDING SITE I, BINDING SITE II or BINDING SITE III of FIG. 8. Table 4 illustrates the complementarity of the nucleotide sequences of S100A15 BINDING SITE, designated SEQ ID:5854, to the nucleotide sequence of GAM5385 RNA, herein designated GAM RNA, also designated SEQ ID:218.

Another function of GAM5385 is therefore inhibition of S100A15 (Accession NP_789793.1). Accordingly, utilities of GAM5385 include diagnosis, prevention and treatment of diseases and clinical conditions associated with S100A15.

Secretory carrier membrane protein 3 (SCAMP3, Accession NP_443069.1) is another GAM5385 target gene, herein designated TARGET GENE. SCAMP3 BINDING SITE is a target binding site found in the 3' untranslated region of multiple transcripts of mRNA encoded by SCAMP3, corresponding to a target binding site such as BINDING SITE I, BINDING SITE II or BINDING SITE III of FIG. 8. Table 4 illustrates the complementarity of the nucleotide sequences of SCAMP3 BINDING SITE, designated SEQ ID:12492, to the nucleotide sequence of GAM5385 RNA, herein designated GAM RNA, also designated SEQ ID:218.

Another function of GAM5385 is therefore inhibition of Secretory carrier membrane protein 3 (SCAMP3, Accession NP_443069.1), a gene which functions in post-golgi recycling pathways and acts as a recycling carrier to the cell surface. Accordingly, utilities of GAM5385 include diagnosis, prevention and treatment of diseases and clinical conditions associated with SCAMP3.

The function of SCAMP3 and its association with various diseases and clinical conditions, has been established by previous studies, as described hereinabove with reference to GAM610.1. Secretory carrier membrane protein 3 (SCAMP3, Accession NP_005689.2) is another GAM5385 target gene, herein designated TARGET GENE. SCAMP3 BINDING SITE is a target binding site found in the 3' untranslated region of multiple transcripts of mRNA encoded by SCAMP3, corresponding to a target binding site such as BINDING SITE I, BINDING SITE II or BINDING SITE III of FIG. 8. Table 4 illustrates the complementarity of the nucleotide sequences of SCAMP3 BINDING SITE, designated SEQ ID:12492, to the nucleotide sequence of GAM5385 RNA, herein designated GAM RNA, also designated SEQ ID:218.

Another function of GAM5385 is therefore inhibition of Secretory carrier membrane protein 3 (SCAMP3, Accession NP_005689.2), a gene which functions in post-golgi recycling pathways and acts as a recycling carrier to the cell surface. Accordingly, utilities of GAM5385 include diagnosis, prevention and treatment of diseases and clinical conditions associated with SCAMP3.

The function of SCAMP3 and its association with various diseases and clinical conditions, has been established by previous studies, as described hereinabove with reference to GAM610.1. SEC61A1 (Accession NP_037468.1) is another GAM5385 target gene, herein designated TARGET GENE. SEC61A1 BINDING SITE is a target binding site found in the 3' untranslated region of mRNA encoded by SEC61A1, corresponding to a target binding site such as BINDING SITE I, BINDING SITE II or BINDING SITE III of FIG. 8. Table 4 illustrates the complementarity of the nucleotide sequences of SEC61A1 BINDING SITE, designated SEQ ID:9945, to the nucleotide sequence of GAM5385 RNA, herein designated GAM RNA, also designated SEQ ID:218.

Another function of GAM5385 is therefore inhibition of SEC61A1 (Accession NP_037468.1). Accordingly, utilities of GAM5385 include diagnosis, prevention and treatment of diseases and clinical conditions associated with SEC61A1.

Selenoprotein x, 1 (SEPX1, Accession NP_057416.1) is another GAM5385 target gene, herein designated TARGET GENE. SEPX1 BINDING SITE is a target binding site found in the 3' untranslated region of mRNA encoded by SEPX1, corresponding to a target binding site such as BINDING SITE I, BINDING SITE II or BINDING SITE III of FIG. 8. Table 4 illustrates the complementarity of the nucleotide sequences of SEPX1 BINDING SITE, designated SEQ ID:5607, to the nucleotide sequence of GAM5385 RNA, herein designated GAM RNA, also designated SEQ ID:218.

Another function of GAM5385 is therefore inhibition of Selenoprotein x, 1 (SEPX1, Accession NP_057416.1). Accordingly, utilities of GAM5385 include diagnosis, prevention and treatment of diseases and clinical conditions associated with SEPX1.

Serine (or cysteine) proteinase inhibitor, clade i (neuroserpin), member 2 (SERPINI2, Accession NP_006208.1) is another GAM5385 target gene, herein designated TARGET GENE. SERPINI2 BINDING SITE is a target binding site found in the 3' untranslated region of mRNA encoded by SERPINI2, corresponding to a target binding site such as BINDING SITE I, BINDING SITE II or BINDING SITE III of FIG. 8. Table 4 illustrates the complementarity of the nucleotide sequences of SERPINI2 BINDING SITE, designated SEQ ID:7346, to the nucleotide sequence of GAM5385 RNA, herein designated GAM RNA, also designated SEQ ID:218.

Another function of GAM5385 is therefore inhibition of Serine (or cysteine) proteinase inhibitor, clade i (neuroserpin), member 2 (SERPINI2, Accession NP_006208.1). Accordingly, utilities of GAM5385 include diagnosis, prevention and treatment of diseases and clinical conditions associated with SERPINI2.

Solute carrier family 21 (organic anion transporter), member 14 (SLC21A14, Accession NP_059131.1) is another GAM5385 target gene, herein designated TARGET GENE. SLC21A14 BINDING SITE is a target binding site found in the 5' untranslated region of mRNA encoded by SLC21A14, corresponding to a target binding site such as BINDING SITE I, BINDING SITE II or BINDING SITE III of FIG. 8. Table 4 illustrates the complementarity of the nucleotide sequences of SLC21A14 BINDING SITE, designated SEQ ID:6067, to the nucleotide sequence of GAM5385 RNA, herein designated GAM RNA, also designated SEQ ID:218.

Another function of GAM5385 is therefore inhibition of Solute carrier family 21 (organic anion transporter), member 14 (SLC21A14, Accession NP_059131.1). Accordingly, utilities of GAM5385 include diagnosis, prevention and treatment of diseases and clinical conditions associated with SLC21A14.

SLC37A3 (Accession NP_115671.1) is another GAM5385 target gene, herein designated TARGET GENE. SLC37A3 BINDING SITE is a target binding site found in the 3' untranslated region of mRNA encoded by SLC37A3, corresponding to a target binding site such as BINDING SITE I, BINDING SITE II or BINDING SITE III of FIG. 8. Table 4 illustrates the complementarity of the nucleotide sequences of SLC37A3 BINDING SITE, designated SEQ ID:18317, to the nucleotide sequence of GAM5385 RNA, herein designated GAM RNA, also designated SEQ ID:218.

Another function of GAM5385 is therefore inhibition of SLC37A3 (Accession NP_115671.1). Accordingly, utilities of GAM5385 include diagnosis, prevention and treatment of diseases and clinical conditions associated with SLC37A3.

Tbc1 domain family, member 4 (TBC1D4, Accession NP_055647.1) is another GAM5385 target gene, herein designated TARGET GENE. TBC1D4 BINDING SITE is a target binding site found in the 3' untranslated region of mRNA encoded by TBC1D4, corresponding to a target binding site such as BINDING SITE I, BINDING SITE II or BINDING SITE III of FIG. 8. Table 4 illustrates the complementarity of the nucleotide sequences of TBC1D4 BINDING SITE, designated SEQ ID:20148, to the nucleotide sequence of GAM5385 RNA, herein designated GAM RNA, also designated SEQ ID:218.

Another function of GAM5385 is therefore inhibition of Tbc1 domain family, member 4 (TBC1D4, Accession NP_055647.1). Accordingly, utilities of GAM5385 include diagnosis, prevention and treatment of diseases and clinical conditions associated with TBC1D4.

TLP19 (Accession NP_056997.1) is another GAM5385 target gene, herein designated TARGET GENE. TLP19 BINDING SITE is a target binding site found in the 3' untranslated region of mRNA encoded by TLP19, corresponding to a target binding site such as BINDING SITE I, BINDING SITE II or BINDING SITE III of FIG. 8. Table 4 illustrates the complementarity of the nucleotide sequences of TLP19 BINDING SITE, designated SEQ ID:12082, to the nucleotide sequence of GAM5385 RNA, herein designated GAM RNA, also designated SEQ ID:218.

Another function of GAM5385 is therefore inhibition of TLP19 (Accession NP_056997.1). Accordingly, utilities of GAM5385 include diagnosis, prevention and treatment of diseases and clinical conditions associated with TLP19.

TRIM43 (Accession NP_620155.1) is another GAM5385 target gene, herein designated TARGET GENE. TRIM43 BINDING SITE is a target binding site found in the 3' untranslated region of mRNA encoded by TRIM43, corresponding to a target binding site such as BINDING SITE I, BINDING SITE II or BINDING SITE III of FIG. 8. Table 4 illustrates the complementarity of the nucleotide sequences of TRIM43 BINDING SITE, designated SEQ ID:17789, to the nucleotide sequence of GAM5385 RNA, herein designated GAM RNA, also designated SEQ ID:218.

Another function of GAM5385 is therefore inhibition of TRIM43 (Accession NP_620155.1). Accordingly, utilities of GAM5385 include diagnosis, prevention and treatment of diseases and clinical conditions associated with TRIM43.

Tubby homolog (mouse) (TUB, Accession NP_003311.2) is another GAM5385 target gene, herein designated TARGET GENE. TUB BINDING SITE is a target binding site found in the 3' untranslated region of multiple transcripts of mRNA encoded by TUB, corresponding to a target binding site such as BINDING SITE I, BINDING SITE II or BINDING SITE III of FIG. 8. Table 4 illustrates the complementarity of the nucleotide sequences of TUB BINDING SITE, designated SEQ ID:20119, to the nucleotide sequence of GAM5385 RNA, herein designated GAM RNA, also designated SEQ ID:218.

Another function of GAM5385 is therefore inhibition of Tubby homolog (mouse) (TUB, Accession NP_003311.2). Accordingly, utilities of GAM5385 include diagnosis, prevention and treatment of diseases and clinical conditions associated with TUB.

Tubby homolog (mouse) (TUB, Accession NP_813977.1) is another GAM5385 target gene, herein designated TARGET GENE. TUB BINDING SITE is a target binding site found in the 3' untranslated region of multiple transcripts of mRNA encoded by TUB, corresponding to a target binding site such as BINDING SITE I, BINDING SITE II or BINDING SITE III of FIG. 8. Table 4 illustrates the complementarity of the nucleotide sequences of TUB BINDING SITE, designated SEQ ID:20119, to the nucleotide sequence of GAM5385 RNA, herein designated GAM RNA, also designated SEQ ID:218.

Another function of GAM5385 is therefore inhibition of Tubby homolog (mouse) (TUB, Accession NP_813977.1). Accordingly, utilities of GAM5385 include diagnosis, prevention and treatment of diseases and clinical conditions associated with TUB.

Ubiquitin-like 3 (UBL3, Accession NP_009037.1) is another GAM5385 target gene, herein designated TARGET GENE. UBL3 BINDING SITE is a target binding site found in the 3' untranslated region of mRNA encoded by UBL3, corresponding to a target binding site such as BINDING SITE I, BINDING SITE II or BINDING SITE III of FIG. 8. Table 4 illustrates the complementarity of the nucleotide sequences of UBL3 BINDING SITE, designated SEQ ID:17405, to the nucleotide sequence of GAM5385 RNA, herein designated GAM RNA, also designated SEQ ID:218.

Another function of GAM5385 is therefore inhibition of Ubiquitin-like 3 (UBL3, Accession NP_009037.1), a gene which appears to have a diverse range of cellular functions. Accordingly, utilities of GAM5385 include diagnosis, prevention and treatment of diseases and clinical conditions associated with UBL3.

The function of UBL3 and its association with various diseases and clinical conditions, has been established by previous studies, as described hereinabove with reference to GAM240.1. UPF2 (Accession NP_542166.1) is another GAM5385 target gene, herein designated TARGET GENE. UPF2 BINDING SITE is a target binding site found in the 3' untranslated region of multiple transcripts of mRNA encoded by UPF2, corresponding to a target binding site such as BINDING SITE I, BINDING SITE II or BINDING SITE III of FIG. 8. Table 4 illustrates the complementarity of the nucleotide sequences of UPF2 BINDING SITE, designated SEQ ID:17322, to the nucleotide sequence of GAM5385 RNA, herein designated GAM RNA, also designated SEQ ID:218.

Another function of GAM5385 is therefore inhibition of UPF2 (Accession NP_542166.1). Accordingly, utilities of GAM5385 include diagnosis, prevention and treatment of diseases and clinical conditions associated with UPF2.

UPF2 (Accession NP_056357.1) is another GAM5385 target gene, herein designated TARGET GENE. UPF2 BINDING SITE is a target binding site found in the 3' untranslated region of multiple transcripts of mRNA encoded by UPF2, corresponding to a target binding site such as BINDING SITE I, BINDING SITE II or BINDING SITE III of FIG. 8. Table 4 illustrates the complementarity of the nucleotide sequences of UPF2 BINDING SITE, designated SEQ ID:17322, to the nucleotide sequence of GAM5385 RNA, herein designated GAM RNA, also designated SEQ ID:218.

Another function of GAM5385 is therefore inhibition of UPF2 (Accession NP_056357.1). Accordingly, utilities of GAM5385 include diagnosis, prevention and treatment of diseases and clinical conditions associated with UPF2.

Ubiquitin specific protease 15 (USP15, Accession NP_006304.1) is another GAM5385 target gene, herein designated TARGET GENE. USP15 BINDING SITE is a target binding site found in the 3' untranslated region of mRNA encoded by USP15, corresponding to a target binding site such as BINDING SITE I, BINDING SITE II or BINDING SITE III of FIG. 8. Table 4 illustrates the complementarity of the nucleotide sequences of USP15 BINDING SITE, designated SEQ ID:7999, to the nucleotide sequence of GAM5385 RNA, herein designated GAM RNA, also designated SEQ ID:218.

Another function of GAM5385 is therefore inhibition of Ubiquitin specific protease 15 (USP15, Accession NP_006304.1). Accordingly, utilities of GAM5385 include diagnosis, prevention and treatment of diseases and clinical conditions associated with USP15.

XT3 (Accession NP_071800.1) is another GAM5385 target gene, herein designated TARGET GENE. XT3 BINDING SITE is a target binding site found in the 3' untranslated region of multiple transcripts of mRNA encoded by XT3, corresponding to a target binding site such as BINDING SITE I, BINDING SITE II or BINDING SITE III of FIG. 8. Table 4 illustrates the complementarity of the nucleotide sequences of XT3 BINDING SITE, designated SEQ ID:9855, to the nucleotide sequence of GAM5385 RNA, herein designated GAM RNA, also designated SEQ ID:218.

Another function of GAM5385 is therefore inhibition of XT3 (Accession NP_071800.1), a gene which is a Kidney-specific orphan transporter. Accordingly, utilities of GAM5385 include diagnosis, prevention and treatment of diseases and clinical conditions associated with XT3.

The function of XT3 and its association with various diseases and clinical conditions, has been established by previous studies, as described hereinabove with reference to GAM66.1. XT3 (Accession NP_064593.1) is another GAM5385 target gene, herein designated TARGET GENE. XT3 BINDING SITE is a target binding site found in the 3' untranslated region of multiple transcripts of mRNA encoded by XT3, corresponding to a target binding site such as BINDING SITE I, BINDING SITE II or BINDING SITE III of FIG. 8. Table 4 illustrates the complementarity of the nucleotide sequences of XT3 BINDING SITE, designated SEQ ID:9855, to the nucleotide sequence of GAM5385 RNA, herein designated GAM RNA, also designated SEQ ID:218.

Another function of GAM5385 is therefore inhibition of XT3 (Accession NP_064593.1), a gene which is a Kidney-specific orphan transporter. Accordingly, utilities of GAM5385 include diagnosis, prevention and treatment of diseases and clinical conditions associated with XT3.

The function of XT3 and its association with various diseases and clinical conditions, has been established by previous studies, as described hereinabove with reference to GAM66.1. Zinc finger protein 272 (ZNF272, Accession XP_030227.3) is another GAM5385 target gene, herein designated TARGET GENE. ZNF272 BINDING SITE is a target binding site found in the 3' untranslated region of mRNA encoded by ZNF272, corresponding to a target binding site such as BINDING SITE I, BINDING SITE II or BINDING SITE III of FIG. 8. Table 4 illustrates the complementarity of the nucleotide sequences of ZNF272 BINDING SITE, designated SEQ ID:19140, to the nucleotide sequence of GAM5385 RNA, herein designated GAM RNA, also designated SEQ ID:218.

Another function of GAM5385 is therefore inhibition of Zinc finger protein 272 (ZNF272, Accession XP_030227.3). Accordingly, utilities of GAM5385 include diagnosis, prevention and treatment of diseases and clinical conditions associated with ZNF272.

ZNF463 (Accession NP_061025.3) is another GAM5385 target gene, herein designated TARGET GENE. ZNF463 BINDING SITE is a target binding site found in the 5' untranslated region of mRNA encoded by ZNF463, corresponding to a target binding site such as BINDING SITE I, BINDING SITE II or BINDING SITE III of FIG. 8. Table 4 illustrates the complementarity of the nucleotide sequences of ZNF463 BINDING SITE, designated SEQ ID:1764, to the nucleotide sequence of GAM5385 RNA, herein designated GAM RNA, also designated SEQ ID:218.

Another function of GAM5385 is therefore inhibition of ZNF463 (Accession NP_061025.3). Accordingly, utilities of GAM5385 include diagnosis, prevention and treatment of diseases and clinical conditions associated with ZNF463.

FIG. 8 further provides a conceptual description of a novel bioinformatically detected of the present invention, referred to here as Genomic Address Messenger 7052 (GAM7052), which modulates expression of respective target genes thereof, the function and utility of which target genes is known in the art.

GAM7052 is a novel bioinformatically detected regulatory, non protein coding, micro RNA (miRNA) gene. The method by which GAM7052 was detected is described hereinabove with reference to FIGS. 8-15.

GAM7052 gene, herein designated GAM GENE, and GAM7052 target gene, herein designated TARGET GENE, are human genes contained in the human genome.

GAM7052 gene encodes a GAM7052 precursor RNA, herein designated GAM PRECURSOR RNA. Similar to other miRNA genes, and unlike most ordinary genes, GAM7052 precursor RNA does not encode a protein. A nucleotide sequence identical or highly similar to the nucleotide sequence of GAM7052 precursor RNA is designated SEQ ID:10, and is provided hereinbelow with reference to the sequence listing part.

GAM7052 precursor RNA folds onto itself, forming GAM7052 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM7052 precursor RNA folds onto itself, forming GAM7052 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM7052 precursor RNA, designated SEQ-ID:10, and a schematic representation of a predicted secondary folding of GAM7052 folded precursor RNA are further described with reference to Table 2, hereby incorporated by reference.

An enzyme complex designated DICER COMPLEX, 'dices' the GAM7052 folded precursor RNA into GAM7052 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM7052 RNA is designated SEQ ID:296, and is provided hereinbelow with references to the sequence listing part and Table 3, hereby incorporated by reference.

GAM7052 target gene, herein designated TARGET GENE, encodes a corresponding messenger RNA, GAM7052 target RNA, herein designated GAM TARGET RNA. GAM7052 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM7052 RNA, herein designated GAM RNA, binds complementarily to one or more target binding sites located in untranslated regions of GAM7052 target RNA, herein designated GAM TARGET RNA. This complementary binding is due to the fact that the nucleotide sequence of GAM7052 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM7052 RNA may have a different number of target binding sites in untranslated regions of a GAM7052 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM7052 RNA, herein designated GAM RNA, to target binding sites on GAM7052 target RNA, herein designated GAM TARGET RNA, such as BINDING SITE I, BINDING SITE II and BINDING SITE III, inhibits translation of GAM7052 target RNA into GAM7052 target protein, herein designated GAM TARGET PROTEIN. GAM target protein is therefore outlined by a broken line.

It is appreciated that GAM7052 target gene, herein designated TARGET GENE, in fact represents a plurality of GAM7052 target genes. The mRNA of each one of this plurality of GAM7052 target genes comprises one or more target binding sites, each having a nucleotide sequence which is at least partly complementary to GAM7052 RNA, herein designated GAM RNA, and which when bound by GAM7052 RNA causes inhibition of translation of respective one or more GAM7052 target proteins.

It is further appreciated by one skilled in the art that the mode of translational inhibition illustrated by FIG. 8 with specific reference to translational inhibition exerted by GAM7052 gene, herein designated GAM GENE, on one or more GAM7052 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM7052 correlate with, and may be deduced from, the identity of the target genes which GAM7052 binds and inhibits, and the function of these target genes, as elaborated hereinbelow.

(Accession NP_054819.1) is a GAM7052 target gene, herein designated TARGET GENE. BINDING SITE is a target binding site found in the 3' untranslated region of multiple transcripts of mRNA encoded by, corresponding to a target binding site such as BINDING SITE I, BINDING SITE II or BINDING SITE III of FIG. 8. Table 4 illustrates the complementarity of the nucleotide sequences of BINDING SITE, designated SEQ ID:17475, to the nucleotide sequence of GAM7052 RNA, herein designated GAM RNA, also designated SEQ ID:296.

A function of GAM7052 is therefore inhibition of (Accession NP_054819.1). Accordingly, utilities of GAM7052 include diagnosis, prevention and treatment of diseases and clinical conditions associated with .

Alpha-1-b glycoprotein (A1BG, Accession NP_570602.2) is another GAM7052 target gene, herein designated TARGET GENE. A1BG BINDING SITE1 through A1BG BINDING SITE3 are target binding sites found in untranslated regions of mRNA encoded by A1BG, corresponding to target binding sites such as BINDING SITE I, BINDING SITE II or BINDING SITE III of FIG. 8. Table 4 illustrates the complementarity of the nucleotide sequences of A1BG BINDING SITE1 through A1BG BINDING SITE3, designated SEQ ID:4738, SEQ ID:19222 and SEQ ID:1831 respectively, to the nucleotide sequence of GAM7052 RNA, herein designated GAM RNA, also designated SEQ ID:296.

Another function of GAM7052 is therefore inhibition of Alpha-1-b glycoprotein (A1BG, Accession NP_570602.2), a gene which a plasma protein of unknown function. Accordingly, utilities of GAM7052 include diagnosis, prevention and treatment of diseases and clinical conditions associated with A1BG.

The function of A1BG and its association with various diseases and clinical conditions, has been established by previous studies, as described hereinabove with reference to GAM130.1. A2BP1 (Accession NP_665898.1) is another GAM7052 target gene, herein designated TARGET GENE. A2BP1 BINDING SITE is a target binding site found in the 3' untranslated region of multiple transcripts of mRNA encoded by A2BP1, corresponding to a target binding site such as BINDING SITE I, BINDING SITE II or BINDING SITE III of FIG. 8. Table 4 illustrates the complementarity of the nucleotide sequences of A2BP1 BINDING SITE, designated SEQ ID:11694, to the nucleotide sequence of GAM7052 RNA, herein designated GAM RNA, also designated SEQ ID:296.

Another function of GAM7052 is therefore inhibition of A2BP1 (Accession NP_665898.1). Accordingly, utilities of GAM7052 include diagnosis, prevention and treatment of diseases and clinical conditions associated with A2BP1.

A2BP1 (Accession NP_665900.1) is another GAM7052 target gene, herein designated TARGET GENE. A2BP1 BINDING SITE is a target binding site found in the 3' untranslated region of multiple transcripts of mRNA encoded by A2BP1, corresponding to a target binding site such as BINDING SITE I, BINDING SITE II or BINDING SITE III of FIG. 8. Table 4 illustrates the complementarity of the nucleotide sequences of A2BP1 BINDING SITE, designated SEQ ID:11694, to the nucleotide sequence of GAM7052 RNA, herein designated GAM RNA, also designated SEQ ID:296.

Another function of GAM7052 is therefore inhibition of A2BP1 (Accession NP_665900.1). Accordingly, utilities of GAM7052 include diagnosis, prevention and treatment of diseases and clinical conditions associated with A2BP1.

A2BP1 (Accession NP_665899.1) is another GAM7052 target gene, herein designated TARGET GENE. A2BP1 BINDING SITE is a target binding site found in the 3' untranslated region of multiple transcripts of mRNA encoded by A2BP1, corresponding to a target binding site such as BINDING SITE I, BINDING SITE II or BINDING SITE III of FIG. 8. Table 4 illustrates the complementarity of the nucleotide sequences of A2BP1 BINDING SITE, designated SEQ ID:11694, to the nucleotide sequence of GAM7052 RNA, herein designated GAM RNA, also designated SEQ ID:296.

Another function of GAM7052 is therefore inhibition of A2BP1 (Accession NP_665899.1). Accordingly, utilities of GAM7052 include diagnosis, prevention and treatment of diseases and clinical conditions associated with A2BP1.

A2BP1 (Accession NP_061193.2) is another GAM7052 target gene, herein designated TARGET GENE. A2BP1 BINDING SITE is a target binding site found in the 3' untranslated region of multiple transcripts of mRNA encoded by A2BP1, corresponding to a target binding site such as BINDING SITE I, BINDING SITE II or BINDING SITE III of FIG. 8. Table 4 illustrates the complementarity of the nucleotide sequences of A2BP1 BINDING SITE, designated SEQ ID:11694, to the nucleotide sequence of GAM7052 RNA, herein designated GAM RNA, also designated SEQ ID:296.

Another function of GAM7052 is therefore inhibition of A2BP1 (Accession NP_061193.2). Accordingly, utilities of GAM7052 include diagnosis, prevention and treatment of diseases and clinical conditions associated with A2BP1.

Atp-binding cassette, sub-family b (mdr/tap), member 5 (ABCB5, Accession XP_291215.1) is another GAM7052 target gene, herein designated TARGET GENE. ABCB5 BINDING SITE is a target binding site found in the 3' untranslated region of mRNA encoded by ABCB5, corresponding to a target binding site such as BINDING SITE I, BINDING SITE II or BINDING SITE III of FIG. 8. Table 4 illustrates the complementarity of the nucleotide sequences of ABCB5 BINDING SITE, designated SEQ ID:15685, to the nucleotide sequence of GAM7052 RNA, herein designated GAM RNA, also designated SEQ ID:296.

Another function of GAM7052 is therefore inhibition of Atp-binding cassette, sub-family b (mdr/tap), member 5 (ABCB5, Accession XP_291215.1). Accordingly, utilities of GAM7052 include diagnosis, prevention and treatment of diseases and clinical conditions associated with ABCB5.

Ankyrin repeat and btb (poz) domain containing 1 (ABTB1, Accession NP_115937.1) is another GAM7052 target gene, herein designated TARGET GENE. ABTB1 BINDING SITE is a target binding site found in the 5' untranslated region of multiple transcripts of mRNA encoded by ABTB1, corresponding to a target binding site such as BINDING SITE I, BINDING SITE II or BINDING SITE III of FIG. 8. Table 4 illustrates the complementarity of the nucleotide sequences of ABTB1 BINDING SITE, designated SEQ ID:17325, to the nucleotide sequence of GAM7052 RNA, herein designated GAM RNA, also designated SEQ ID:296.

Another function of GAM7052 is therefore inhibition of Ankyrin repeat and btb (poz) domain containing 1 (ABTB1, Accession NP_115937.1). Accordingly, utilities of GAM7052 include diagnosis, prevention and treatment of diseases and clinical conditions associated with ABTB1.

A disintegrin-like and metalloprotease (reprolysin type) with thrombospondin type 1 motif, 4 (ADAMTS4, Accession NP_005090.1) is another GAM7052 target gene, herein designated TARGET GENE. ADAMTS4 BINDING SITE is a target binding site found in the 3' untranslated region of mRNA encoded by ADAMTS4, corresponding to a target binding site such as BINDING SITE I, BINDING SITE II or BINDING SITE III of FIG. 8. Table 4 illustrates the complementarity of the nucleotide sequences of ADAMTS4 BINDING SITE, designated SEQ ID:6395, to the nucleotide sequence of GAM7052 RNA, herein designated GAM RNA, also designated SEQ ID:296.

Another function of GAM7052 is therefore inhibition of A disintegrin-like and metalloprotease (reprolysin type) with thrombospondin type 1 motif, 4 (ADAMTS4, Accession NP_005090.1), a gene which cleaves aggrecan, a cartilage proteoglycan, and may be involved in its turnover. Accordingly, utilities of GAM7052 include diagnosis, prevention and treatment of diseases and clinical conditions associated with ADAMTS4.

The function of ADAMTS4 and its association with various diseases and clinical conditions, has been established by previous studies, as described hereinabove with reference to GAM189.1. Adenylate cyclase 6 (ADCY6, Accession NP_056085.1) is another GAM7052 target gene, herein designated TARGET GENE. ADCY6 BINDING SITE is a target binding site found in the 5' untranslated region of multiple transcripts of mRNA encoded by ADCY6, corresponding to a target binding site such as BINDING SITE I, BINDING SITE II or BINDING SITE III of FIG. 8. Table 4 illustrates the complementarity of the nucleotide sequences of ADCY6 BINDING SITE, designated SEQ ID:20175, to the nucleotide sequence of GAM7052 RNA, herein designated GAM RNA, also designated SEQ ID:296.

Another function of GAM7052 is therefore inhibition of Adenylate cyclase 6 (ADCY6, Accession NP_056085.1), a gene which this a membrane-bound, ca(2+)-inhibitable adenylyl cyclase (by similarity). Accordingly, utilities of GAM7052 include diagnosis, prevention and treatment of diseases and clinical conditions associated with ADCY6.

The function of ADCY6 and its association with various diseases and clinical conditions, has been established by previous studies, as described hereinabove with reference to GAM67.2. Atp/gtp binding protein 1 (AGTPBP1, Accession NP_056054.1) is another GAM7052 target gene, herein designated TARGET GENE. AGTPBP1 BINDING SITE is a target binding site found in the 3' untranslated region of mRNA encoded by AGTPBP1, corresponding to a target binding site such as BINDING SITE I, BINDING SITE II or BINDING SITE III of FIG. 8. Table 4 illustrates the complementarity of the nucleotide sequences of AGTPBP1 BINDING SITE, designated SEQ ID:16343, to the nucleotide sequence of GAM7052 RNA, herein designated GAM RNA, also designated SEQ ID:296.

Another function of GAM7052 is therefore inhibition of Atp/gtp binding protein 1 (AGTPBP1, Accession NP_056054.1), a gene which a zinc carboxypeptidase. Accordingly, utilities of GAM7052 include diagnosis, prevention and treatment of diseases and clinical conditions associated with AGTPBP1.

The function of AGTPBP1 and its association with various diseases and clinical conditions, has been established by previous studies, as described hereinabove with reference to GAM480.1. Aldo-keto reductase family 1, member a1 (aldehyde reductase) (AKR1A1, Accession NP_006057.1) is another GAM7052 target gene, herein designated TARGET GENE. AKR1A1 BINDING SITE is a target binding site found in the 5' untranslated region of multiple transcripts of mRNA encoded by AKR1A1, corresponding to a target binding site such as BINDING SITE I, BINDING SITE II or BINDING SITE III of FIG. 8. Table 4 illustrates the complementarity of the nucleotide sequences of AKR1A1 BINDING SITE, designated SEQ ID:18726, to the nucleotide sequence of GAM7052 RNA, herein designated GAM RNA, also designated SEQ ID:296.

Another function of GAM7052 is therefore inhibition of Aldo-keto reductase family 1, member a1 (aldehyde reductase) (AKR1A1, Accession NP_006057.1). Accordingly, utilities of GAM7052 include diagnosis, prevention and treatment of diseases and clinical conditions associated with AKR1A1.

Aldehyde dehydrogenase 1 family, member b1 (ALDH1B1, Accession NP_000683.3) is another GAM7052 target gene, herein designated TARGET GENE. ALDH1B1 BINDING SITE is a target binding site found in the 3' untranslated region of mRNA encoded by ALDH1B1, corresponding to a target binding site such as BINDING SITE I, BINDING SITE II or BINDING SITE III of FIG. 8. Table 4 illustrates the complementarity of the nucleotide sequences of ALDH1B1 BINDING SITE, designated SEQ ID:17862, to the nucleotide sequence of GAM7052 RNA, herein designated GAM RNA, also designated SEQ ID:296.

Another function of GAM7052 is therefore inhibition of Aldehyde dehydrogenase 1 family, member b1 (ALDH1B1, Accession NP_000683.3). Accordingly, utilities of GAM7052 include diagnosis, prevention and treatment of diseases and clinical conditions associated with ALDH1B1.

Arachidonate 15-lipoxygenase (ALOX15, Accession NP_001131.1) is another GAM7052 target gene, herein designated TARGET GENE. ALOX15 BINDING SITE is a target binding site found in the 3' untranslated region of mRNA encoded by ALOX15, corresponding to a target binding site such as BINDING SITE I, BINDING SITE II or BINDING SITE III of FIG. 8. Table 4 illustrates the complementarity of the nucleotide sequences of ALOX15 BINDING SITE, designated SEQ ID:11095, to the nucleotide sequence of GAM7052 RNA, herein designated GAM RNA, also designated SEQ ID:296.

Another function of GAM7052 is therefore inhibition of Arachidonate 15-lipoxygenase (ALOX15, Accession NP_001131.1), a gene which converts arachidonic acid to 15s-hydroperoxyeicosatetraenoic acid. Accordingly, utilities of GAM7052 include diagnosis, prevention and treatment of diseases and clinical conditions associated with ALOX15.

The function of ALOX15 and its association with various diseases and clinical conditions, has been established by previous studies, as described hereinabove with reference to GAM189.1. AP1S3 (Accession XP_291023.1) is another GAM7052 target gene, herein designated TARGET GENE. AP1S3 BINDING SITE is a target binding site found in the 3' untranslated region of multiple transcripts of mRNA encoded by AP1S3, corresponding to a target binding site such as BINDING SITE I, BINDING SITE II or BINDING SITE III of FIG. 8. Table 4 illustrates the complementarity of the nucleotide sequences of AP1S3 BINDING SITE, designated SEQ ID:809, to the nucleotide sequence of GAM7052 RNA, herein designated GAM RNA, also designated SEQ ID:296.

Another function of GAM7052 is therefore inhibition of AP1S3 (Accession XP_291023.1). Accordingly, utilities of GAM7052 include diagnosis, prevention and treatment of diseases and clinical conditions associated with AP1S3.

Adaptor-related protein complex 3, sigma 2 subunit (AP3S2, Accession NP_005820.1) is another GAM7052 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:6157, to the nucleotide sequence of GAM7052 RNA, herein designated GAM RNA, also designated SEQ ID:296.

Another function of GAM7052 is therefore inhibition of Adaptor-related protein complex 3, sigma 2 subunit (AP3S2, Accession NP_005820.1). Accordingly, utilities of GAM7052 include diagnosis, prevention and treatment of diseases and clinical conditions associated with AP3S2.

Amyloid beta precursor protein (cytoplasmic tail) binding protein 2 (APPBP2, Accession NP_006371.2) is another GAM7052 target gene, herein designated TARGET GENE. APPBP2 BINDING SITE is a target binding site found in the 3' untranslated region of mRNA encoded by APPBP2, corresponding to a target binding site such as BINDING SITE I, BINDING SITE II or BINDING SITE III of FIG. 8. Table 4 illustrates the complementarity of the nucleotide sequences of APPBP2 BINDING SITE, designated SEQ ID:14578, to the nucleotide sequence of GAM7052 RNA, herein designated GAM RNA, also designated SEQ ID:296.

Another function of GAM7052 is therefore inhibition of Amyloid beta precursor protein (cytoplasmic tail) binding protein 2 (APPBP2, Accession NP_006371.2), a gene which interacts with the basolateral sorting signal of amyloid precursor protein. and therefore may be associated with Alzheimer's disease. Accordingly, utilities of GAM7052 include diagnosis, prevention and treatment of Alzheimer's disease, and of other diseases and clinical conditions associated with APPBP2.

The function of APPBP2 and its association with various diseases and clinical conditions, has been established by previous studies, as described hereinabove with reference to GAM130.1. Aprataxin (APTX, Accession NP_060162.1) is another GAM7052 target gene, herein designated TARGET GENE. APTX BINDING SITE is a target binding site found in the 3' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:2203, to the nucleotide sequence of GAM7052 RNA, herein designated GAM RNA, also designated SEQ ID:296.

Another function of GAM7052 is therefore inhibition of Aprataxin (APTX, Accession NP_060162.1). Accordingly, utilities of GAM7052 include diagnosis, prevention and treatment of diseases and clinical conditions associated with APTX.

Aprataxin (APTX, Accession NP_778239.1) is another GAM7052 target gene, herein designated TARGET GENE. APTX BINDING SITE is a target binding site found in the 3' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:2203, to the nucleotide sequence of GAM7052 RNA, herein designated GAM RNA, also designated SEQ ID:296.

Another function of GAM7052 is therefore inhibition of Aprataxin (APTX, Accession NP_778239.1). Accordingly, utilities of GAM7052 include diagnosis, prevention and treatment of diseases and clinical conditions associated with APTX.

Aprataxin (APTX, Accession NP_778243.1) is another GAM7052 target gene, herein designated TARGET GENE. APTX BINDING SITE is a target binding site found in the 3' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:2203, to the nucleotide sequence of GAM7052 RNA, herein designated GAM RNA, also designated SEQ ID:296.

Another function of GAM7052 is therefore inhibition of Aprataxin (APTX, Accession NP_778243.1). Accordingly, utilities of GAM7052 include diagnosis, prevention and treatment of diseases and clinical conditions associated with APTX.

Aprataxin (APTX, Accession NP_778242.1) is another GAM7052 target gene, herein designated TARGET GENE. APTX BINDING SITE is a target binding site found in the 3' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:2203, to the nucleotide sequence of GAM7052 RNA, herein designated GAM RNA, also designated SEQ ID:296.

Another function of GAM7052 is therefore inhibition of Aprataxin (APTX, Accession NP_778242.1). Accordingly, utilities of GAM7052 include diagnosis, prevention and treatment of diseases and clinical conditions associated with APTX.

Aprataxin (APTX, Accession NP_778241.1) is another GAM7052 target gene, herein designated TARGET GENE. APTX BINDING SITE is a target binding site found in the 3' untranslated region of multiple transcripts of mRNA encoded by APTX, corresponding to a target binding site such as BINDING SITE I, BINDING SITE II or BINDING SITE III of FIG. 8. Table 4 illustrates the complementarity of the nucleotide sequences of APTX BINDING SITE, designated SEQ ID:2203, to the nucleotide sequence of GAM7052 RNA, herein designated GAM RNA, also designated SEQ ID:296.

Another function of GAM7052 is therefore inhibition of Aprataxin (APTX, Accession NP_778241.1). Accordingly, utilities of GAM7052 include diagnosis, prevention and treatment of diseases and clinical conditions associated with APTX.

Aquaporin 6, kidney specific (AQP6, Accession NP_001643.1) is another GAM7052 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:11163, to the nucleotide sequence of GAM7052 RNA, herein designated GAM RNA, also designated SEQ ID:296.

Another function of GAM7052 is therefore inhibition of Aquaporin 6, kidney specific (AQP6, Accession NP_001643.1), a gene which participates in distinct physiologic function such as glomerular filtration, tubular endocytosis, and acid-base-metabolism. Accordingly, utilities of GAM7052 include diagnosis, prevention and treatment of diseases and clinical conditions associated with AQP6.

The function of AQP6 and its association with various diseases and clinical conditions, has been established by previous studies, as described hereinabove with reference to GAM51.1. Aquaporin 6, kidney specific (AQP6, Accession NP_445738.1) is another GAM7052 target gene, herein designated TARGET GENE. AQP6 BINDING SITE is a target binding site found in the 3' untranslated region of multiple transcripts of mRNA encoded by AQP6, corresponding to a target binding site such as BINDING SITE I, BINDING SITE II or BINDING SITE III of FIG. 8. Table 4 illustrates the complementarity of the nucleotide sequences of AQP6 BINDING SITE, designated SEQ ID:11163, to the nucleotide sequence of GAM7052 RNA, herein designated GAM RNA, also designated SEQ ID:296.

Another function of GAM7052 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM7052 include diagnosis, prevention and treatment of diseases and clinical conditions associated with AQP6.

The function of AQP6 and its association with various diseases and clinical conditions, has been established by previous studies, as described hereinabove with reference to GAM51.1. Archain 1 (ARCN1, Accession NP_001646.2) is another GAM7052 target gene, herein designated TARGET GENE. ARCN1 BINDING SITE is a target binding site found in the 3' untranslated region of mRNA encoded by ARCN1, corresponding to a target binding site such as BINDING SITE I, BINDING SITE II or BINDING SITE III of FIG. 8. Table 4 illustrates the complementarity of the nucleotide sequences of ARCN1 BINDING SITE, designated SEQ ID:14158, to the nucleotide sequence of GAM7052 RNA, herein designated GAM RNA, also designated SEQ ID:296.

Another function of GAM7052 is therefore inhibition of Archain 1 (ARCN1, Accession NP_001646.2), a gene which plays a fundamental role in eukaryotic cell biology. Accordingly, utilities of GAM7052 include diagnosis, prevention and treatment of diseases and clinical conditions associated with ARCN1.

The function of ARCN1 and its association with various diseases and clinical conditions, has been established by previous studies, as described hereinabove with reference to GAM30.1. Ras homolog gene family, member f (in filopodia) (ARHF, Accession NP_061907.1) is another GAM7052 target gene, herein designated TARGET GENE. ARHF BINDING SITE is a target binding site found in the 3' untranslated region of mRNA encoded by ARHF, corresponding to a target binding site such as BINDING SITE I, BINDING SITE II or BINDING SITE III of FIG. 8. Table 4 illustrates the complementarity of the nucleotide sequences of ARHF BINDING SITE, designated SEQ ID:13834, to the nucleotide sequence of GAM7052 RNA, herein designated GAM RNA, also designated SEQ ID:296.

Another function of GAM7052 is therefore inhibition of Ras homolog gene family, member f (in filopodia) (ARHF, Accession NP_061907.1). Accordingly, utilities of GAM7052 include diagnosis, prevention and treatment of diseases and clinical conditions associated with ARHF.

Rho gtpase activating protein 1 (ARHGAP1, Accession NP_004299.1) is another GAM7052 target gene, herein designated TARGET GENE. ARHGAP1 BINDING SITE1 and ARHGAP1 BINDING SITE2 are target binding sites found in untranslated regions of mRNA encoded by ARHGAP1, corresponding to target binding sites such as BINDING SITE I, BINDING SITE II or BINDING SITE III of FIG. 8. Table 4 illustrates the complementarity of the nucleotide sequences of ARHGAP1 BINDING SITE1 and ARHGAP1 BINDING SITE2, designated SEQ ID:13952 and SEQ ID:15853 respectively, to the nucleotide sequence of GAM7052 RNA, herein designated GAM RNA, also designated SEQ ID:296.

Another function of GAM7052 is therefore inhibition of Rho gtpase activating protein 1 (ARHGAP1, Accession NP_004299.1). Accordingly, utilities of GAM7052 include diagnosis, prevention and treatment of diseases and clinical conditions associated with ARHGAP1.

ARPP-19 (Accession NP_006619.1) is another GAM7052 target gene, herein designated TARGET GENE. ARPP-19 BINDING SITE is a target binding site found in the 3' untranslated region of mRNA encoded by ARPP-19, corresponding to a target binding site such as BINDING SITE I, BINDING SITE II or BINDING SITE III of FIG. 8. Table 4 illustrates the complementarity of the nucleotide sequences of ARPP-19 BINDING SITE, designated SEQ ID:4389, to the nucleotide sequence of GAM7052 RNA, herein designated GAM RNA, also designated SEQ ID:296.

Another function of GAM7052 is therefore inhibition of ARPP-19 (Accession NP_006619.1). Accordingly, utilities of GAM7052 include diagnosis, prevention and treatment of diseases and clinical conditions associated with ARPP-19.

Ankyrin repeat and socs box-containing 16 (ASB16, Accession NP_543139.4) is another GAM7052 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:10273, to the nucleotide sequence of GAM7052 RNA, herein designated GAM RNA, also designated SEQ ID:296.

Another function of GAM7052 is therefore inhibition of Ankyrin repeat and socs box-containing 16 (ASB16, Accession NP_543139.4) . Accordingly, utilities of GAM7052 include diagnosis, prevention and treatment of diseases and clinical conditions associated with ASB16.

Ankyrin repeat and socs box-containing 6 (ASB6, Accession NP_821066.1) is another GAM7052 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:9847 and SEQ ID:13406 respectively, to the nucleotide sequence of GAM7052 RNA, herein designated GAM RNA, also designated SEQ ID:296.

Another function of GAM7052 is therefore inhibition of Ankyrin repeat and socs box-containing 6 (ASB6, Accession NP_821066.1). Accordingly, utilities of GAM7052 include diagnosis, prevention and treatment of diseases and clinical conditions associated with ASB6.

Ankyrin repeat and socs box-containing 6 (ASB6, Accession NP_060343.1) is another GAM7052 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:9847 and SEQ ID:13406 respectively, to the nucleotide sequence of GAM7052 RNA, herein designated GAM RNA, also designated SEQ ID:296.

Another function of GAM7052 is therefore inhibition of Ankyrin repeat and socs box-containing 6 (ASB6, Accession NP_060343.1). Accordingly, utilities of GAM7052 include diagnosis, prevention and treatment of diseases and clinical conditions associated with ASB6.

ASE-1 (Accession NP_036231.1) is another GAM7052 target gene, herein designated TARGET GENE. ASE-1 BINDING SITE is a target binding site found in the 3' untranslated region of mRNA encoded by ASE-1, corresponding to a target binding site such as BINDING SITE I, BINDING SITE II or BINDING SITE III of FIG. 8. Table 4 illustrates the complementarity of the nucleotide sequences of ASE-1 BINDING SITE, designated SEQ ID:6396, to the nucleotide sequence of GAM7052 RNA, herein designated GAM RNA, also designated SEQ ID:296.

Another function of GAM7052 is therefore inhibition of ASE-1 (Accession NP_036231.1). Accordingly, utilities of GAM7052 include diagnosis, prevention and treatment of diseases and clinical conditions associated with ASE-1.

Atpase, (na+)/k+ transporting, beta 4 polypeptide (ATP1B4, Accession NP_036201.1) is another GAM7052 target gene, herein designated TARGET GENE. ATP1B4 BINDING SITE is a target binding site found in the 3' untranslated region of mRNA encoded by ATP1B4, corresponding to a target binding site such as BINDING SITE I, BINDING SITE II or BINDING SITE III of FIG. 8. Table 4 illustrates the complementarity of the nucleotide sequences of ATP1B4 BINDING SITE, designated SEQ ID:11229, to the nucleotide sequence of GAM7052 RNA, herein designated GAM RNA, also designated SEQ ID:296.

Another function of GAM7052 is therefore inhibition of Atpase, (na+)/k+ transporting, beta 4 polypeptide (ATP1B4, Accession NP_036201.1). Accordingly, utilities of GAM7052 include diagnosis, prevention and treatment of diseases and clinical conditions associated with ATP1B4.

Atpase, h+ transporting, lysosomal 38 kda, v0 subunit d isoform 2 (ATP6V0D2, Accession NP_689778.1) is another GAM7052 target gene, herein designated TARGET GENE. ATP6V0D2 BINDING SITE1 and ATP6V0D2 BINDING SITE2 are target binding sites found in untranslated regions of mRNA encoded by ATP6V0D2, corresponding to target binding sites such as BINDING SITE I, BINDING SITE II or BINDING SITE III of FIG. 8. Table 4 illustrates the complementarity of the nucleotide sequences of ATP6V0D2 BINDING SITE1 and ATP6V0D2 BINDING SITE2, designated SEQ ID:6393 and SEQ ID:14828 respectively, to the nucleotide sequence of GAM7052 RNA, herein designated GAM RNA, also designated SEQ ID:296.

Another function of GAM7052 is therefore inhibition of Atpase, h+ transporting, lysosomal 38 kda, v0 subunit d isoform 2 (ATP6V0D2, Accession NP_689778.1). Accordingly, utilities of GAM7052 include diagnosis, prevention and treatment of diseases and clinical conditions associated with ATP6V0D2.

ATP6V1A (Accession NP_001681.2) is another GAM7052 target gene, herein designated TARGET GENE. ATP6V1A BINDING SITE is a target binding site found in the 3' untranslated region of mRNA encoded by ATP6V1A, corresponding to a target binding site such as BINDING SITE I, BINDING SITE II or BINDING SITE III of FIG. 8. Table 4 illustrates the complementarity of the nucleotide sequences of ATP6V1A BINDING SITE, designated SEQ ID:16885, to the nucleotide sequence of GAM7052 RNA, herein designated GAM RNA, also designated SEQ ID:296.

Another function of GAM7052 is therefore inhibition of ATP6V1A (Accession NP_001681.2). Accordingly, utilities of GAM7052 include diagnosis, prevention and treatment of diseases and clinical conditions associated with ATP6V1A.

Atpase, cu++ transporting, alpha polypeptide (menkes syndrome) (ATP7A, Accession NP_000043.1) is another GAM7052 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:3639, to the nucleotide sequence of GAM7052 RNA, herein designated GAM RNA, also designated SEQ ID:296.

Another function of GAM7052 is therefore inhibition of Atpase, cu++ transporting, alpha polypeptide (menkes syndrome) (ATP7A, Accession NP_000043.1). Accordingly, utilities of GAM7052 include diagnosis, prevention and treatment of diseases and clinical conditions associated with ATP7A.

Atpase, class i, type 8b, member 2 (ATP8B2, Accession XP_290875.1) is another GAM7052 target gene, herein designated TARGET GENE. ATP8B2 BINDING SITE is a target binding site found in the 3' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:11229, to the nucleotide sequence of GAM7052 RNA, herein designated GAM RNA, also designated SEQ ID:296.

Another function of GAM7052 is therefore inhibition of Atpase, class i, type 8b, member 2 (ATP8B2, Accession XP_290875.1). Accordingly, utilities of GAM7052 include diagnosis, prevention and treatment of diseases and clinical conditions associated with ATP8B2.

Axl receptor tyrosine kinase (AXL, Accession NP_068713.2) is another GAM7052 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:9692, to the nucleotide sequence of GAM7052 RNA, herein designated GAM RNA, also designated SEQ ID:296.

Another function of GAM7052 is therefore inhibition of Axl receptor tyrosine kinase (AXL, Accession NP_068713.2). Accordingly, utilities of GAM7052 include diagnosis, prevention and treatment of diseases and clinical conditions associated with AXL.

Axl receptor tyrosine kinase (AXL, Accession NP_001690.2) is another GAM7052 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:9692, to the nucleotide sequence of GAM7052 RNA, herein designated GAM RNA, also designated SEQ ID:296.

Another function of GAM7052 is therefore inhibition of Axl receptor tyrosine kinase (AXL, Accession NP_001690.2). Accordingly, utilities of GAM7052 include diagnosis, prevention and treatment of diseases and clinical conditions associated with AXL.

Udp-gal:betaglcnac beta 1,3-galactosyltransferase, polypeptide 5 (B3GALT5, Accession NP_149360.1) is another GAM7052 target gene, herein designated TARGET GENE. B3GALT5 BINDING SITE is a target binding site found in the 3' untranslated region of multiple transcripts of mRNA encoded by B3GALT5, corresponding to a target binding site such as BINDING SITE I, BINDING SITE II or BINDING SITE III of FIG. 8. Table 4 illustrates the complementarity of the nucleotide sequences of B3GALT5 BINDING SITE, designated SEQ ID:7881, to the nucleotide sequence of GAM7052 RNA, herein designated GAM RNA, also designated SEQ ID:296.

Another function of GAM7052 is therefore inhibition of Udp-gal:betaglcnac beta 1,3-galactosyltransferase, polypeptide 5 (B3GALT5, Accession NP_149360.1). Accordingly, utilities of GAM7052 include diagnosis, prevention and treatment of diseases and clinical conditions associated with B3GALT5.

Udp-gal:betaglcnac beta 1,3-galactosyltransferase, polypeptide 5 (B3GALT5, Accession NP_149363.1) is another GAM7052 target gene, herein designated TARGET GENE. B3GALT5 BINDING SITE is a target binding site found in the 3' untranslated region of multiple transcripts of mRNA encoded by B3GALT5, corresponding to a target binding site such as BINDING SITE I, BINDING SITE II or BINDING SITE III of FIG. 8. Table 4 illustrates the complementarity of the nucleotide sequences of B3GALT5 BINDING SITE, designated SEQ ID:7881, to the nucleotide sequence of GAM7052 RNA, herein designated GAM RNA, also designated SEQ ID:296.

Another function of GAM7052 is therefore inhibition of Udp-gal:betaglcnac beta 1,3-galactosyltransferase, polypeptide 5 (B3GALT5, Accession NP_149363.1). Accordingly, utilities of GAM7052 include diagnosis, prevention and treatment of diseases and clinical conditions associated with B3GALT5.

Udp-gal:betaglcnac beta 1,3-galactosyltransferase, polypeptide 5 (B3GALT5, Accession NP_149361.1) is another GAM7052 target gene, herein designated TARGET GENE. B3GALT5 BINDING SITE is a target binding site found in the 3' untranslated region of multiple transcripts of mRNA encoded by B3GALT5, corresponding to a target binding site such as BINDING SITE I, BINDING SITE II or BINDING SITE III of FIG. 8. Table 4 illustrates the complementarity of the nucleotide sequences of B3GALT5 BINDING SITE, designated SEQ ID:7881, to the nucleotide sequence of GAM7052 RNA, herein designated GAM RNA, also designated SEQ ID:296.

Another function of GAM7052 is therefore inhibition of Udp-gal:betaglcnac beta 1,3-galactosyltransferase, polypeptide 5 (B3GALT5, Accession NP_149361.1). Accordingly, utilities of GAM7052 include diagnosis, prevention and treatment of diseases and clinical conditions associated with B3GALT5.

Udp-gal:betaglcnac beta 1,3-galactosyltransferase, polypeptide 5 (B3GALT5, Accession NP_149362.1) is another GAM7052 target gene, herein designated TARGET GENE. B3GALT5 BINDING SITE is a target binding site found in the 3' untranslated region of multiple transcripts of mRNA encoded by B3GALT5, corresponding to a target binding site such as BINDING SITE I, BINDING SITE II or BINDING SITE III of FIG. 8. Table 4 illustrates the complementarity of the nucleotide sequences of B3GALT5 BINDING SITE, designated SEQ ID:7881, to the nucleotide sequence of GAM7052 RNA, herein designated GAM RNA, also designated SEQ ID:296.

Another function of GAM7052 is therefore inhibition of Udp-gal:betaglcnac beta 1,3-galactosyltransferase, polypeptide 5 (B3GALT5, Accession NP_149362.1). Accordingly, utilities of GAM7052 include diagnosis, prevention and treatment of diseases and clinical conditions associated with B3GALT5.

Udp-gal:betaglcnac beta 1,3-galactosyltransferase, polypeptide 5 (B3GALT5, Accession NP_006048.1) is another GAM7052 target gene, herein designated TARGET GENE. B3GALT5 BINDING SITE is a target binding site found in the 3' untranslated region of multiple transcripts of mRNA encoded by B3GALT5, corresponding to a target binding site such as BINDING SITE I, BINDING SITE II or BINDING SITE III of FIG. 8. Table 4 illustrates the complementarity of the nucleotide sequences of B3GALT5 BINDING SITE, designated SEQ ID:7881, to the nucleotide sequence of GAM7052 RNA, herein designated GAM RNA, also designated SEQ ID:296.

Another function of GAM7052 is therefore inhibition of Udp-gal:betaglcnac beta 1,3-galactosyltransferase, polypeptide 5 (B3GALT5, Accession NP_006048.1). Accordingly, utilities of GAM7052 include diagnosis, prevention and treatment of diseases and clinical conditions associated with B3GALT5.

Bcl2-associated athanogene 5 (BAG5, Accession NP_004864.1) is another GAM7052 target gene, herein designated TARGET GENE. BAG5 BINDING SITE is a target binding site found in the 3' untranslated region of mRNA encoded by BAG5, corresponding to a target binding site such as BINDING SITE I, BINDING SITE II or BINDING SITE III of FIG. 8. Table 4 illustrates the complementarity of the nucleotide sequences of BAG5 BINDING SITE, designated SEQ ID:19275, to the nucleotide sequence of GAM7052 RNA, herein designated GAM RNA, also designated SEQ ID:296.

Another function of GAM7052 is therefore inhibition of Bcl2-associated athanogene 5 (BAG5, Accession NP_004864.1). Accordingly, utilities of GAM7052 include diagnosis, prevention and treatment of diseases and clinical conditions associated with BAG5.

BCAP31 (Accession NP_005736.2) is another GAM7052 target gene, herein designated TARGET GENE. BCAP31 BINDING SITE is a target binding site found in the 3' untranslated region of mRNA encoded by BCAP31, corresponding to a target binding site such as BINDING SITE I, BINDING SITE II or BINDING SITE III of FIG. 8. Table 4 illustrates the complementarity of the nucleotide sequences of BCAP31 BINDING SITE, designated SEQ ID:13785, to the nucleotide sequence of GAM7052 RNA, herein designated GAM RNA, also designated SEQ ID:296.

Another function of GAM7052 is therefore inhibition of BCAP31 (Accession NP_005736.2). Accordingly, utilities of GAM7052 include diagnosis, prevention and treatment of diseases and clinical conditions associated with BCAP31.

BCLG (Accession NP_110393.1) is another GAM7052 target gene, herein designated TARGET GENE. BCLG BINDING SITE is a target binding site found in the 5' untranslated region of multiple transcripts of mRNA encoded by BCLG, corresponding to a target binding site such as BINDING SITE I, BINDING SITE II or BINDING SITE III of FIG. 8. Table 4 illustrates the complementarity of the nucleotide sequences of BCLG BINDING SITE, designated SEQ ID:10887, to the nucleotide sequence of GAM7052 RNA, herein designated GAM RNA, also designated SEQ ID:296.

Another function of GAM7052 is therefore inhibition of BCLG (Accession NP_110393.1). Accordingly, utilities of GAM7052 include diagnosis, prevention and treatment of diseases and clinical conditions associated with BCLG.

BCLG (Accession NP_620048.1) is another GAM7052 target gene, herein designated TARGET GENE. BCLG BINDING SITE is a target binding site found in the 5' untranslated region of multiple transcripts of mRNA encoded by BCLG, corresponding to a target binding site such as BINDING SITE I, BINDING SITE II or BINDING SITE III of FIG. 8. Table 4 illustrates the complementarity of the nucleotide sequences of BCLG BINDING SITE, designated SEQ ID:10887, to the nucleotide sequence of GAM7052 RNA, herein designated GAM RNA, also designated SEQ ID:296.

Another function of GAM7052 is therefore inhibition of BCLG (Accession NP_620048.1). Accordingly, utilities of GAM7052 include diagnosis, prevention and treatment of diseases and clinical conditions associated with BCLG.

BM-002 (Accession NP_057701.1) is another GAM7052 target gene, herein designated TARGET GENE. BM-002 BINDING SITE is a target binding site found in the 3' untranslated region of mRNA encoded by BM-002, corresponding to a target binding site such as BINDING SITE I, BINDING SITE II or BINDING SITE III of FIG. 8. Table 4 illustrates the complementarity of the nucleotide sequences of BM-002 BINDING SITE, designated SEQ ID:9516, to the nucleotide sequence of GAM7052 RNA, herein designated GAM RNA, also designated SEQ ID:296.

Another function of GAM7052 is therefore inhibition of BM-002 (Accession NP_057701.1). Accordingly, utilities of GAM7052 include diagnosis, prevention and treatment of diseases and clinical conditions associated with BM-002.

Breast cancer 1, early onset (BRCA1, Accession NP_009237.1) is another GAM7052 target gene, herein designated TARGET GENE. BRCA1 BINDING SITE is a target binding site found in the 3' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:19804, to the nucleotide sequence of GAM7052 RNA, herein designated GAM RNA, also designated SEQ ID:296.

Another function of GAM7052 is therefore inhibition of Breast cancer 1, early onset (BRCA1, Accession NP_009237.1). Accordingly, utilities of GAM7052 include diagnosis, prevention and treatment of diseases and clinical conditions associated with BRCA1.

BRIP1 (Accession NP_114432.1) is another GAM7052 target gene, herein designated TARGET GENE. BRIP1 BINDING SITE is a target binding site found in the 3' untranslated region of mRNA encoded by BRIP1, corresponding to a target binding site such as BINDING SITE I, BINDING SITE II or BINDING SITE III of FIG. 8. Table 4 illustrates the complementarity of the nucleotide sequences of BRIP1 BINDING SITE, designated SEQ ID:16280, to the nucleotide sequence of GAM7052 RNA, herein designated GAM RNA, also designated SEQ ID:296.

Another function of GAM7052 is therefore inhibition of BRIP1 (Accession NP_114432.1). Accordingly, utilities of GAM7052 include diagnosis, prevention and treatment of diseases and clinical conditions associated with BRIP1.

BXDC1 (Accession XP_166303.1) is another GAM7052 target gene, herein designated TARGET GENE. BXDC1 BINDING SITE is a target binding site found in the 3' untranslated region of mRNA encoded by BXDC1, corresponding to a target binding site such as BINDING SITE I, BINDING SITE II or BINDING SITE III of FIG. 8. Table 4 illustrates the complementarity of the nucleotide sequences of BXDC1 BINDING SITE, designated SEQ ID:10897, to the nucleotide sequence of GAM7052 RNA, herein designated GAM RNA, also designated SEQ ID:296.

Another function of GAM7052 is therefore inhibition of BXDC1 (Accession XP_166303.1). Accordingly, utilities of GAM7052 include diagnosis, prevention and treatment of diseases and clinical conditions associated with BXDC1.

C19orf9 (Accession XP_290171.1) is another GAM7052 target gene, herein designated TARGET GENE. C19orf9 BINDING SITE is a target binding site found in the 5' untranslated region of mRNA encoded by C19orf9, corresponding to a target binding site such as BINDING SITE I, BINDING SITE II or BINDING SITE III of FIG. 8. Table 4 illustrates the complementarity of the nucleotide sequences of C19orf9 BINDING SITE, designated SEQ ID:7215, to the nucleotide sequence of GAM7052 RNA, herein designated GAM RNA, also designated SEQ ID:296.

Another function of GAM7052 is therefore inhibition of C19orf9 (Accession XP_290171.1). Accordingly, utilities of GAM7052 include diagnosis, prevention and treatment of diseases and clinical conditions associated with C19orf9.

C1q and tumor necrosis factor related protein 6 (C1QTNF6, Accession NP_114116.2) is another GAM7052 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:13966, to the nucleotide sequence of GAM7052 RNA, herein designated GAM RNA, also designated SEQ ID:296.

Another function of GAM7052 is therefore inhibition of C1q and tumor necrosis factor related protein 6 (C1QTNF6, Accession NP_114116.2). Accordingly, utilities of GAM7052 include diagnosis, prevention and treatment of diseases and clinical conditions associated with C1QTNF6.

Chromosome 20 open reading frame 161 (C20orf161, Accession NP_690857.1) is another GAM7052 target gene, herein designated TARGET GENE. C20orf161 BINDING SITE is a target binding site found in the 3' untranslated region of multiple transcripts of mRNA encoded by C20orf161, corresponding to a target binding site such as BINDING SITE I, BINDING SITE II or BINDING SITE III of FIG. 8. Table 4 illustrates the complementarity of the nucleotide sequences of C20orf161 BINDING SITE, designated SEQ ID:16361, to the nucleotide sequence of GAM7052 RNA, herein designated GAM RNA, also designated SEQ ID:296.

Another function of GAM7052 is therefore inhibition of Chromosome 20 open reading frame 161 (C20orf161, Accession NP_690857.1). Accordingly, utilities of GAM7052 include diagnosis, prevention and treatment of diseases and clinical conditions associated with C20orf161.

Chromosome 20 open reading frame 161 (C20orf161, Accession NP_219489.1) is another GAM7052 target gene, herein designated TARGET GENE. C20orf161 BINDING SITE is a target binding site found in the 3' untranslated region of multiple transcripts of mRNA encoded by C20orf161, corresponding to a target binding site such as BINDING SITE I, BINDING SITE II or BINDING SITE III of FIG. 8. Table 4 illustrates the complementarity of the nucleotide sequences of C20orf161 BINDING SITE, designated SEQ ID:16361, to the nucleotide sequence of GAM7052 RNA, herein designated GAM RNA, also designated SEQ ID:296.

Another function of GAM7052 is therefore inhibition of Chromosome 20 open reading frame 161 (C20orf161, Accession NP_219489.1). Accordingly, utilities of GAM7052 include diagnosis, prevention and treatment of diseases and clinical conditions associated with C20orf161.

C4orf9 (Accession XP_035572.1) is another GAM7052 target gene, herein designated TARGET GENE. C4orf9 BINDING SITE is a target binding site found in the 3' untranslated region of mRNA encoded by C4orf9, corresponding to a target binding site such as BINDING SITE I, BINDING SITE II or BINDING SITE III of FIG. 8. Table 4 illustrates the complementarity of the nucleotide sequences of C4orf9 BINDING SITE, designated SEQ ID:4343, to the nucleotide sequence of GAM7052 RNA, herein designated GAM RNA, also designated SEQ ID:296.

Another function of GAM7052 is therefore inhibition of C4orf9 (Accession XP_035572.1). Accordingly, utilities of GAM7052 include diagnosis, prevention and treatment of diseases and clinical conditions associated with C4orf9.

C6orf141 (Accession NP_699175.1) is another GAM7052 target gene, herein designated TARGET GENE. C6orf141 BINDING SITE is a target binding site found in the 3' untranslated region of mRNA encoded by C6orf141, corresponding to a target binding site such as BINDING SITE I, BINDING SITE II or BINDING SITE III of FIG. 8. Table 4 illustrates the complementarity of the nucleotide sequences of C6orf141 BINDING SITE, designated SEQ ID:17672, to the nucleotide sequence of GAM7052 RNA, herein designated GAM RNA, also designated SEQ ID:296.

Another function of GAM7052 is therefore inhibition of C6orf141 (Accession NP_699175.1). Accordingly, utilities of GAM7052 include diagnosis, prevention and treatment of diseases and clinical conditions associated with C6orf141.

C6orf57 (Accession NP_660310.1) is another GAM7052 target gene, herein designated TARGET GENE. C6orf57 BINDING SITE is a target binding site found in the 3' untranslated region of mRNA encoded by C6orf57, corresponding to a target binding site such as BINDING SITE I, BINDING SITE II or BINDING SITE III of FIG. 8. Table 4 illustrates the complementarity of the nucleotide sequences of C6orf57 BINDING SITE, designated SEQ ID:5864, to the nucleotide sequence of GAM7052 RNA, herein designated GAM RNA, also designated SEQ ID:296.

Another function of GAM7052 is therefore inhibition of C6orf57 (Accession NP_660310.1). Accordingly, utilities of GAM7052 include diagnosis, prevention and treatment of diseases and clinical conditions associated with C6orf57.

Chromosome 8 open reading frame 12 (C8orf12, Accession NP_473358.1) is another GAM7052 target gene, herein designated TARGET GENE. C8orf12 BINDING SITE is a target binding site found in the 5' untranslated region of mRNA encoded by C8orf12, corresponding to a target binding site such as BINDING SITE I, BINDING SITE II or BINDING SITE III of FIG. 8. Table 4 illustrates the complementarity of the nucleotide sequences of C8orf12 BINDING SITE, designated SEQ ID:8627, to the nucleotide sequence of GAM7052 RNA, herein designated GAM RNA, also designated SEQ ID:296.

Another function of GAM7052 is therefore inhibition of Chromosome 8 open reading frame 12 (C8orf12, Accession NP_473358.1). Accordingly, utilities of GAM7052 include diagnosis, prevention and treatment of diseases and clinical conditions associated with C8orf12.

Chromosome 9 open reading frame 9 (C9orf9, Accession NP_061829.2) is another GAM7052 target gene, herein designated TARGET GENE. C9orf9 BINDING SITE is a target binding site found in the 3' untranslated region of mRNA encoded by C9orf9, corresponding to a target binding site such as BINDING SITE I, BINDING SITE II or BINDING SITE III of FIG. 8. Table 4 illustrates the complementarity of the nucleotide sequences of C9orf9 BINDING SITE, designated SEQ ID:16870, to the nucleotide sequence of GAM7052 RNA, herein designated GAM RNA, also designated SEQ ID:296.

Another function of GAM7052 is therefore inhibition of Chromosome 9 open reading frame 9 (C9orf9, Accession NP_061829.2). Accordingly, utilities of GAM7052 include diagnosis, prevention and treatment of diseases and clinical conditions associated with C9orf9.

Calcium channel, voltage-dependent, gamma subunit 6 (CACNG6, Accession NP_665814.1) is another GAM7052 target gene, herein designated TARGET GENE. CACNG6 BINDING SITE is a target binding site found in the 3' untranslated region of multiple transcripts of mRNA encoded by CACNG6, corresponding to a target binding site such as BINDING SITE I, BINDING SITE II or BINDING SITE III of FIG. 8. Table 4 illustrates the complementarity of the nucleotide sequences of CACNG6 BINDING SITE, designated SEQ ID:10214, to the nucleotide sequence of GAM7052 RNA, herein designated GAM RNA, also designated SEQ ID:296.

Another function of GAM7052 is therefore inhibition of Calcium channel, voltage-dependent, gamma subunit 6 (CACNG6, Accession NP_665814.1), a gene which plays a role in excitation-contraction coupling. Accordingly, utilities of GAM7052 include diagnosis, prevention and treatment of diseases and clinical conditions associated with CACNG6.

The function of CACNG6 and its association with various diseases and clinical conditions, has been established by previous studies, as described hereinabove with reference to GAM63.1. Calcium channel, voltage-dependent, gamma subunit 6 (CACNG6, Accession NP_665813.1) is another GAM7052 target gene, herein designated TARGET GENE. CACNG6 BINDING SITE is a target binding site found in the 3' untranslated region of multiple transcripts of mRNA encoded by CACNG6, corresponding to a target binding site such as BINDING SITE I, BINDING SITE II or BINDING SITE III of FIG. 8. Table 4 illustrates the complementarity of the nucleotide sequences of CACNG6 BINDING SITE, designated SEQ ID:10214, to the nucleotide sequence of GAM7052 RNA, herein designated GAM RNA, also designated SEQ ID:296.

Another function of GAM7052 is therefore inhibition of Calcium channel, voltage-dependent, gamma subunit 6 (CACNG6, Accession NP_665813.1), a gene which plays a role in excitation-contraction coupling. Accordingly, utilities of GAM7052 include diagnosis, prevention and treatment of diseases and clinical conditions associated with CACNG6.

The function of CACNG6 and its association with various diseases and clinical conditions, has been established by previous studies, as described hereinabove with reference to GAM63.1. Calcium channel, voltage-dependent, gamma subunit 6 (CACNG6, Accession NP_114103.2) is another GAM7052 target gene, herein designated TARGET GENE. CACNG6 BINDING SITE is a target binding site found in the 3' untranslated region of multiple transcripts of mRNA encoded by CACNG6, corresponding to a target binding site such as BINDING SITE I, BINDING SITE II or BINDING SITE III of FIG. 8. Table 4 illustrates the complementarity of the nucleotide sequences of CACNG6 BINDING SITE, designated SEQ ID:10214, to the nucleotide sequence of GAM7052 RNA, herein designated GAM RNA, also designated SEQ ID:296.

Another function of GAM7052 is therefore inhibition of Calcium channel, voltage-dependent, gamma subunit 6 (CACNG6, Accession NP_114103.2), a gene which plays a role in excitation-contraction coupling. Accordingly, utilities of GAM7052 include diagnosis, prevention and treatment of diseases and clinical conditions associated with CACNG6.

The function of CACNG6 and its association with various diseases and clinical conditions, has been established by previous studies, as described hereinabove with reference to GAM63.1. Calcium modulating ligand (CAMLG, Accession NP_001736.1) is another GAM7052 target gene, herein designated TARGET GENE. CAMLG BINDING SITE is a target binding site found in the 3' untranslated region of mRNA encoded by CAMLG, corresponding to a target binding site such as BINDING SITE I, BINDING SITE II or BINDING SITE III of FIG. 8. Table 4 illustrates the complementarity of the nucleotide sequences of CAMLG BINDING SITE, designated SEQ ID:2107, to the nucleotide sequence of GAM7052 RNA, herein designated GAM RNA, also designated SEQ ID:296.

Another function of GAM7052 is therefore inhibition of Calcium modulating ligand (CAMLG, Accession NP_001736.1), a gene which is likely involved in the mobilization of calcium as a result of the tcr/cd3 complex interaction. Accordingly, utilities of GAM7052 include diagnosis, prevention and treatment of diseases and clinical conditions associated with CAMLG.

The function of CAMLG and its association with various diseases and clinical conditions, has been established by previous studies, as described hereinabove with reference to GAM130.1. CAPRI (Accession NP_008920.3) is another GAM7052 target gene, herein designated TARGET GENE. CAPRI BINDING SITE is a target binding site found in the 3' untranslated region of mRNA encoded by CAPRI, corresponding to a target binding site such as BINDING SITE I, BINDING SITE II or BINDING SITE III of FIG. 8. Table 4 illustrates the complementarity of the nucleotide sequences of CAPRI BINDING SITE, designated SEQ ID:7042, to the nucleotide sequence of GAM7052 RNA, herein designated GAM RNA, also designated SEQ ID:296.

Another function of GAM7052 is therefore inhibition of CAPRI (Accession NP_008920.3). Accordingly, utilities of GAM7052 include diagnosis, prevention and treatment of diseases and clinical conditions associated with CAPRI.

Caspase recruitment domain family, member 6 (CARD6, Accession NP_115976.2) is another GAM7052 target gene, herein designated TARGET GENE. CARD6 BINDING SITE is a target binding site found in the 3' untranslated region of mRNA encoded by CARD6, corresponding to a target binding site such as BINDING SITE I, BINDING SITE II or BINDING SITE III of FIG. 8. Table 4 illustrates the complementarity of the nucleotide sequences of CARD6 BINDING SITE, designated SEQ ID:2824, to the nucleotide sequence of GAM7052 RNA, herein designated GAM RNA, also designated SEQ ID:296.

Another function of GAM7052 is therefore inhibition of Caspase recruitment domain family, member 6 (CARD6, Accession NP_115976.2) . Accordingly, utilities of GAM7052 include diagnosis, prevention and treatment of diseases and clinical conditions associated with CARD6.

Core-binding factor, runt domain, alpha subunit 2; translocated to, 2 (CBFA2T2, Accession NP_005084.1) is another GAM7052 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:1249, to the nucleotide sequence of GAM7052 RNA, herein designated GAM RNA, also designated SEQ ID:296.

Another function of GAM7052 is therefore inhibition of Core-binding factor, runt domain, alpha subunit 2; translocated to, 2 (CBFA2T2, Accession NP_005084.1), a gene which is a putative transcription factor. Accordingly, utilities of GAM7052 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Core-binding factor, runt domain, alpha subunit 2; translocated to, 2 (CBFA2T2, Accession NP_787060.1) is another GAM7052 target gene, herein designated TARGET GENE. CBFA2T2 BINDING SITE is a target binding site found in the 3' untranslated region of multiple transcripts of mRNA encoded by CBFA2T2, corresponding to a target binding site such as BINDING SITE I, BINDING SITE II or BINDING SITE III of FIG. 8. Table 4 illustrates the complementarity of the nucleotide sequences of CBFA2T2 BINDING SITE, designated SEQ ID:1249, to the nucleotide sequence of GAM7052 RNA, herein designated GAM RNA, also designated SEQ ID:296.

Another function of GAM7052 is therefore inhibition of Core-binding factor, runt domain, alpha subunit 2; translocated to, 2 (CBFA2T2, Accession NP_787060.1), a gene which is a putative transcription factor. Accordingly, utilities of GAM7052 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Chemokine (c-c motif) ligand 16 (CCL16, Accession NP_004581.1) is another GAM7052 target gene, herein designated TARGET GENE. CCL16 BINDING SITE is a target binding site found in the 3' untranslated region of mRNA encoded by CCL16, corresponding to a target binding site such as BINDING SITE I, BINDING SITE II or BINDING SITE III of FIG. 8. Table 4 illustrates the complementarity of the nucleotide sequences of CCL16 BINDING SITE, designated SEQ ID:12626, to the nucleotide sequence of GAM7052 RNA, herein designated GAM RNA, also designated SEQ ID:296.

Another function of GAM7052 is therefore inhibition of Chemokine (c-c motif) ligand 16 (CCL16, Accession NP_004581.1). Accordingly, utilities of GAM7052 include diagnosis, prevention and treatment of diseases and clinical conditions associated with CCL16.

Chemokine (c-c motif) ligand 22 (CCL22, Accession NP_002981.2) is another GAM7052 target gene, herein designated TARGET GENE. CCL22 BINDING SITE1 and CCL22 BINDING SITE2 are target binding sites found in untranslated regions of mRNA encoded by CCL22, corresponding to target binding sites such as BINDING SITE I, BINDING SITE II or BINDING SITE III of FIG. 8. Table 4 illustrates the complementarity of the nucleotide sequences of CCL22 BINDING SITE1 and CCL22 BINDING SITE2, designated SEQ ID:6967 and SEQ ID:13638 respectively, to the nucleotide sequence of GAM7052 RNA, herein designated GAM RNA, also designated SEQ ID:296.

Another function of GAM7052 is therefore inhibition of Chemokine (c-c motif) ligand 22 (CCL22, Accession NP_002981.2). Accordingly, utilities of GAM7052 include diagnosis, prevention and treatment of diseases and clinical conditions associated with CCL22.

Chemokine (c-c motif) ligand 28 (CCL28, Accession NP_062820.1) is another GAM7052 target gene, herein designated TARGET GENE. CCL28 BINDING SITE is a target binding site found in the 3' untranslated region of multiple transcripts of mRNA encoded by CCL28, corresponding to a target binding site such as BINDING SITE I, BINDING SITE II or BINDING SITE III of FIG. 8. Table 4 illustrates the complementarity of the nucleotide sequences of CCL28 BINDING SITE, designated SEQ ID:5390, to the nucleotide sequence of GAM7052 RNA, herein designated GAM RNA, also designated SEQ ID:296.

Another function of GAM7052 is therefore inhibition of Chemokine (c-c motif) ligand 28 (CCL28, Accession NP_062820.1). Accordingly, utilities of GAM7052 include diagnosis, prevention and treatment of diseases and clinical conditions associated with CCL28.

Cyclin f (CCNF, Accession NP_001752.1) is another GAM7052 target gene, herein designated TARGET GENE. CCNF BINDING SITE is a target binding site found in the 3' untranslated region of mRNA encoded by CCNF, corresponding to a target binding site such as BINDING SITE I, BINDING SITE II or BINDING SITE III of FIG. 8. Table 4 illustrates the complementarity of the nucleotide sequences of CCNF BINDING SITE, designated SEQ ID:8016, to the nucleotide sequence of GAM7052 RNA, herein designated GAM RNA, also designated SEQ ID:296.

Another function of GAM7052 is therefore inhibition of Cyclin f (CCNF, Accession NP_001752.1), a gene which likely to be involved in the control of the cell cycle during s phase and g2. Accordingly, utilities of GAM7052 include diagnosis, prevention and treatment of diseases and clinical conditions associated with CCNF.

The function of CCNF and its association with various diseases and clinical conditions, has been established by previous studies, as described hereinabove with reference to GAM130.1. CCNL2 (Accession NP_112199.1) is another GAM7052 target gene, herein designated TARGET GENE. CCNL2 BINDING SITE is a target binding site found in the 5' untranslated region of mRNA encoded by CCNL2, corresponding to a target binding site such as BINDING SITE I, BINDING SITE II or BINDING SITE III of FIG. 8. Table 4 illustrates the complementarity of the nucleotide sequences of CCNL2 BINDING SITE, designated SEQ ID:8702, to the nucleotide sequence of GAM7052 RNA, herein designated GAM RNA, also designated SEQ ID:296.

Another function of GAM7052 is therefore inhibition of CCNL2 (Accession NP_112199.1). Accordingly, utilities of GAM7052 include diagnosis, prevention and treatment of diseases and clinical conditions associated with CCNL2.

Cd24 antigen (small cell lung carcinoma cluster 4 antigen) (CD24, Accession NP_037362.1) is another GAM7052 target gene, herein designated TARGET GENE. CD24 BINDING SITE is a target binding site found in the 3' untranslated region of mRNA encoded by CD24, corresponding to a target binding site such as BINDING SITE I, BINDING SITE II or BINDING SITE III of FIG. 8. Table 4 illustrates the complementarity of the nucleotide sequences of CD24 BINDING SITE, designated SEQ ID:12740, to the nucleotide sequence of GAM7052 RNA, herein designated GAM RNA, also designated SEQ ID:296.

Another function of GAM7052 is therefore inhibition of Cd24 antigen (small cell lung carcinoma cluster 4 antigen) (CD24, Accession NP_037362.1). Accordingly, utilities of GAM7052 include diagnosis, prevention and treatment of diseases and clinical conditions associated with CD24.

Cdc14 cell division cycle 14 homolog b (s. cerevisiae) (CDC14B, Accession NP_201589.1) is another GAM7052 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:8433, to the nucleotide sequence of GAM7052 RNA, herein designated GAM RNA, also designated SEQ ID:296.

Another function of GAM7052 is therefore inhibition of Cdc14 cell division cycle 14 homolog b (s. cerevisiae) (CDC14B, Accession NP_201589.1). Accordingly, utilities of GAM7052 include diagnosis, prevention and treatment of diseases and clinical conditions associated with CDC14B.

Cell division cycle 2-like 2 (CDC2L2, Accession NP_296370.1) is another GAM7052 target gene, herein designated TARGET GENE. CDC2L2 BINDING SITE is a target binding site found in the 5' untranslated region of multiple transcripts of mRNA encoded by CDC2L2, corresponding to a target binding site such as BINDING SITE I, BINDING SITE II or BINDING SITE III of FIG. 8. Table 4 illustrates the complementarity of the nucleotide sequences of CDC2L2 BINDING SITE, designated SEQ ID:14683, to the nucleotide sequence of GAM7052 RNA, herein designated GAM RNA, also designated SEQ ID:296.

Another function of GAM7052 is therefore inhibition of Cell division cycle 2-like 2 (CDC2L2, Accession NP_296370.1). Accordingly, utilities of GAM7052 include diagnosis, prevention and treatment of diseases and clinical conditions associated with CDC2L2.

Cdc6 cell division cycle 6 homolog (s. cerevisiae) (CDC6, Accession NP_001245.1) is another GAM7052 target gene, herein designated TARGET GENE. CDC6 BINDING SITE is a target binding site found in the 3' untranslated region of mRNA encoded by CDC6, corresponding to a target binding site such as BINDING SITE I, BINDING SITE II or BINDING SITE III of FIG. 8. Table 4 illustrates the complementarity of the nucleotide sequences of CDC6 BINDING SITE, designated SEQ ID:2823, to the nucleotide sequence of GAM7052 RNA, herein designated GAM RNA, also designated SEQ ID:296.

Another function of GAM7052 is therefore inhibition of Cdc6 cell division cycle 6 homolog (s. cerevisiae) (CDC6, Accession NP_001245.1), a gene which is a component of the origin recognition complex (orc) that binds origins of replication. Accordingly, utilities of GAM7052 include diagnosis, prevention and treatment of diseases and clinical conditions associated with CDC6.

The function of CDC6 and its association with various diseases and clinical conditions, has been established by previous studies, as described hereinabove with reference to GAM189.1. Cadherin 1, type 1, e-cadherin (epithelial) (CDH1, Accession NP_004351.1) is another GAM7052 target gene, herein designated TARGET GENE. CDH1 BINDING SITE is a target binding site found in the 3' untranslated region of mRNA encoded by CDH1, corresponding to a target binding site such as BINDING SITE I, BINDING SITE II or BINDING SITE III of FIG. 8. Table 4 illustrates the complementarity of the nucleotide sequences of CDH1 BINDING SITE, designated SEQ ID:15641, to the nucleotide sequence of GAM7052 RNA, herein designated GAM RNA, also designated SEQ ID:296.

Another function of GAM7052 is therefore inhibition of Cadherin 1, type 1, e-cadherin (epithelial) (CDH1, Accession NP_004351.1). Accordingly, utilities of GAM7052 include diagnosis, prevention and treatment of diseases and clinical conditions associated with CDH1.

Cadherin 11, type 2, ob-cadherin (osteoblast) (CDH11, Accession NP_387513.1) is another GAM7052 target gene, herein designated TARGET GENE. CDH11 BINDING SITE is a target binding site found in the 3' untranslated region of multiple transcripts of mRNA encoded by CDH11, corresponding to a target binding site such as BINDING SITE I, BINDING SITE II or BINDING SITE III of FIG. 8. Table 4 illustrates the complementarity of the nucleotide sequences of CDH11 BINDING SITE, designated SEQ ID:7516, to the nucleotide sequence of GAM7052 RNA, herein designated GAM RNA, also designated SEQ ID:296.

Another function of GAM7052 is therefore inhibition of Cadherin 11, type 2, ob-cadherin (osteoblast) (CDH11, Accession NP_387513.1), a gene which plays an role in development and maintenance of tissues. Accordingly, utilities of GAM7052 include diagnosis, prevention and treatment of diseases and clinical conditions associated with CDH11.

The function of CDH11 and its association with various diseases and clinical conditions, has been established by previous studies, as described hereinabove with reference to GAM206.1. Carcinoembryonic antigen-related cell adhesion molecule 8 (CEACAM8, Accession NP_001807.2) is another GAM7052 target gene, herein designated TARGET GENE. CEACAM8 BINDING SITE is a target binding site found in the 3' untranslated region of mRNA encoded by CEACAM8, corresponding to a target binding site such as BINDING SITE I, BINDING SITE II or BINDING SITE III of FIG. 8. Table 4 illustrates the complementarity of the nucleotide sequences of CEACAM8 BINDING SITE, designated SEQ ID:9995, to the nucleotide sequence of GAM7052 RNA, herein designated GAM RNA, also designated SEQ ID:296.

Another function of GAM7052 is therefore inhibition of Carcinoembryonic antigen-related cell adhesion molecule 8 (CEACAM8, Accession NP_001807.2). Accordingly, utilities of GAM7052 include diagnosis, prevention and treatment of diseases and clinical conditions associated with CEACAM8.

Cat eye syndrome chromosome region, candidate 1 (CECR1, Accession NP_059120.2) is another GAM7052 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:5536 and SEQ ID:5536 respectively, to the nucleotide sequence of GAM7052 RNA, herein designated GAM RNA, also designated SEQ ID:296.

Another function of GAM7052 is therefore inhibition of Cat eye syndrome chromosome region, candidate 1 (CECR1, Accession NP_059120.2). Accordingly, utilities of GAM7052 include diagnosis, prevention and treatment of diseases and clinical conditions associated with CECR1.

Cat eye syndrome chromosome region, candidate 1 (CECR1, Accession NP_059120.2) is another GAM7052 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:16723 and SEQ ID:16723 respectively, to the nucleotide sequence of GAM7052 RNA, herein designated GAM RNA, also designated SEQ ID:296.

Another function of GAM7052 is therefore inhibition of Cat eye syndrome chromosome region, candidate 1 (CECR1, Accession NP_059120.2). Accordingly, utilities of GAM7052 include diagnosis, prevention and treatment of diseases and clinical conditions associated with CECR1.

CGI-14 (Accession NP_057028.2) is another GAM7052 target gene, herein designated TARGET GENE. CGI-14 BINDING SITE is a target binding site found in the 3' untranslated region of mRNA encoded by CGI-14, corresponding to a target binding site such as BINDING SITE I, BINDING SITE II or BINDING SITE III of FIG. 8. Table 4 illustrates the complementarity of the nucleotide sequences of CGI-14 BINDING SITE, designated SEQ ID:17011, to the nucleotide sequence of GAM7052 RNA, herein designated GAM RNA, also designated SEQ ID:296.

Another function of GAM7052 is therefore inhibition of CGI-14 (Accession NP_057028.2). Accordingly, utilities of GAM7052 include diagnosis, prevention and treatment of diseases and clinical conditions associated with CGI-14.

CGI-18 (Accession NP_057031.1) is another GAM7052 target gene, herein designated TARGET GENE. CGI-18 BINDING SITE is a target binding site found in the 5' untranslated region of mRNA encoded by CGI-18, corresponding to a target binding site such as BINDING SITE I, BINDING SITE II or BINDING SITE III of FIG. 8. Table 4 illustrates the complementarity of the nucleotide sequences of CGI-18 BINDING SITE, designated SEQ ID:16885, to the nucleotide sequence of GAM7052 RNA, herein designated GAM RNA, also designated SEQ ID:296.

Another function of GAM7052 is therefore inhibition of CGI-18 (Accession NP_057031.1). Accordingly, utilities of GAM7052 include diagnosis, prevention and treatment of diseases and clinical conditions associated with CGI-18.

Chromatin accessibility complex 1 (CHRAC1, Accession NP_059140.1) is another GAM7052 target gene, herein designated TARGET GENE. CHRAC1 BINDING SITE is a target binding site found in the 3' untranslated region of mRNA encoded by CHRAC1, corresponding to a target binding site such as BINDING SITE I, BINDING SITE II or BINDING SITE III of FIG. 8. Table 4 illustrates the complementarity of the nucleotide sequences of CHRAC1 BINDING SITE, designated SEQ ID:8325, to the nucleotide sequence of GAM7052 RNA, herein designated GAM RNA, also designated SEQ ID:296.

Another function of GAM7052 is therefore inhibition of Chromatin accessibility complex 1 (CHRAC1, Accession NP_059140.1). Accordingly, utilities of GAM7052 include diagnosis, prevention and treatment of diseases and clinical conditions associated with CHRAC1.

Cholinergic receptor, nicotinic, beta polypeptide 4 (CHRNB4, Accession NP_000741.1) is another GAM7052 target gene, herein designated TARGET GENE. CHRNB4 BINDING SITE is a target binding site found in the 3' untranslated region of mRNA encoded by CHRNB4, corresponding to a target binding site such as BINDING SITE I, BINDING SITE II or BINDING SITE III of FIG. 8. Table 4 illustrates the complementarity of the nucleotide sequences of CHRNB4 BINDING SITE, designated SEQ ID:13754, to the nucleotide sequence of GAM7052 RNA, herein designated GAM RNA, also designated SEQ ID:296.

Another function of GAM7052 is therefore inhibition of Cholinergic receptor, nicotinic, beta polypeptide 4 (CHRNB4, Accession NP_000741.1), a gene which mediates fast signal transmission at synapses. Accordingly, utilities of GAM7052 include diagnosis, prevention and treatment of diseases and clinical conditions associated with CHRNB4.

The function of CHRNB4 and its association with various diseases and clinical conditions, has been established by previous studies, as described hereinabove with reference to GAM76.1. Carbohydrate (chondroitin) synthase 1 (CHSY1, Accession NP_055733.2) is another GAM7052 target gene, herein designated TARGET GENE. CHSY1 BINDING SITE is a target binding site found in the 3' untranslated region of mRNA encoded by CHSY1, corresponding to a target binding site such as BINDING SITE I, BINDING SITE II or BINDING SITE III of FIG. 8. Table 4 illustrates the complementarity of the nucleotide sequences of CHSY1 BINDING SITE, designated SEQ ID:9811, to the nucleotide sequence of GAM7052 RNA, herein designated GAM RNA, also designated SEQ ID:296.

Another function of GAM7052 is therefore inhibition of Carbohydrate (chondroitin) synthase 1 (CHSY1, Accession NP_055733.2). Accordingly, utilities of GAM7052 include diagnosis, prevention and treatment of diseases and clinical conditions associated with CHSY1.

Cold autoinflammatory syndrome 1 (CIAS1, Accession NP_004886.2) is another GAM7052 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:12643, to the nucleotide sequence of GAM7052 RNA, herein designated GAM RNA, also designated SEQ ID:296.

Another function of GAM7052 is therefore inhibition of Cold autoinflammatory syndrome 1 (CIAS1, Accession NP_004886.2), a gene which may mediate protein-protein interactions; contains a leucine rich repeat and therefore may be associated with Familial cold autoinflammatory syndrome, muckle-wells syndrome. Accordingly, utilities of GAM7052 include diagnosis, prevention and treatment of Familial cold autoinflammatory syndrome, muckle-wells syndrome, and of other diseases and clinical conditions associated with CIAS1.

The function of CIAS1 and its association with various diseases and clinical conditions, has been established by previous studies, as described hereinabove with reference to GAM90.1. CIP29 (Accession NP_115740.3) is another GAM7052 target gene, herein designated TARGET GENE. CIP29 BINDING SITE is a target binding site found in the 3' untranslated region of mRNA encoded by CIP29, corresponding to a target binding site such as BINDING SITE I, BINDING SITE II or BINDING SITE III of FIG. 8. Table 4 illustrates the complementarity of the nucleotide sequences of CIP29 BINDING SITE, designated SEQ ID:11229, to the nucleotide sequence of GAM7052 RNA, herein designated GAM RNA, also designated SEQ ID:296.

Another function of GAM7052 is therefore inhibition of CIP29 (Accession NP_115740.3). Accordingly, utilities of GAM7052 include diagnosis, prevention and treatment of diseases and clinical conditions associated with CIP29.

C-type (calcium dependent, carbohydrate-recognition domain) lectin, superfamily member 12 (CLECSF12, Accession NP_072092.2) is another GAM7052 target gene, herein designated TARGET GENE. CLECSF12 BINDING SITE is a target binding site found in the 3' untranslated region of mRNA encoded by CLECSF12, corresponding to a target binding site such as BINDING SITE I, BINDING SITE II or BINDING SITE III of FIG. 8. Table 4 illustrates the complementarity of the nucleotide sequences of CLECSF12 BINDING SITE, designated SEQ ID:10135, to the nucleotide sequence of GAM7052 RNA, herein designated GAM RNA, also designated SEQ ID:296.

Another function of GAM7052 is therefore inhibition of C-type (calcium dependent, carbohydrate-recognition domain) lectin, superfamily member 12 (CLECSF12, Accession NP_072092.2), a gene which is a pattern- recognition receptor. Accordingly, utilities of GAM7052 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. Ceroid-lipofuscinosis, neuronal 8 (epilepsy, progressive with mental retardation) (CLN8, Accession NP_061764.2) is another GAM7052 target gene, herein designated TARGET GENE. CLN8 BINDING SITE is a target binding site found in the 3' untranslated region of mRNA encoded by CLN8, corresponding to a target binding site such as BINDING SITE I, BINDING SITE II or BINDING SITE III of FIG. 8. Table 4 illustrates the complementarity of the nucleotide sequences of CLN8 BINDING SITE, designated SEQ ID:3696, to the nucleotide sequence of GAM7052 RNA, herein designated GAM RNA, also designated SEQ ID:296.

Another function of GAM7052 is therefore inhibition of Ceroid-lipofuscinosis, neuronal 8 (epilepsy, progressive with mental retardation) (CLN8, Accession NP_061764.2). Accordingly, utilities of GAM7052 include diagnosis, prevention and treatment of diseases and clinical conditions associated with CLN8.

cPLA2delta (Accession NP_828848.1) is another GAM7052 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:10898, to the nucleotide sequence of GAM7052 RNA, herein designated GAM RNA, also designated SEQ ID:296.

Another function of GAM7052 is therefore inhibition of cPLA2delta (Accession NP_828848.1). Accordingly, utilities of GAM7052 include diagnosis, prevention and treatment of diseases and clinical conditions associated with cPLA2delta.

cPLA2delta (Accession XP_208820.2) is another GAM7052 target gene, herein designated TARGET GENE. cPLA2delta BINDING SITE is a target binding site found in the 3' untranslated region of multiple transcripts of mRNA encoded by cPLA2delta, corresponding to a target binding site such as BINDING SITE I, BINDING SITE II or BINDING SITE III of FIG. 8. Table 4 illustrates the complementarity of the nucleotide sequences of cPLA2delta BINDING SITE, designated SEQ ID:10898, to the nucleotide sequence of GAM7052 RNA, herein designated GAM RNA, also designated SEQ ID:296.

Another function of GAM7052 is therefore inhibition of cPLA2delta (Accession XP_208820.2). Accordingly, utilities of GAM7052 include diagnosis, prevention and treatment of diseases and clinical conditions associated with cPLA2delta.

Cleavage and polyadenylation specific factor 2, 100 kda (CPSF2, Accession XP_029311.2) is another GAM7052 target gene, herein designated TARGET GENE. CPSF2 BINDING SITE is a target binding site found in the 3' untranslated region of mRNA encoded by CPSF2, corresponding to a target binding site such as BINDING SITE I, BINDING SITE II or BINDING SITE III of FIG. 8. Table 4 illustrates the complementarity of the nucleotide sequences of CPSF2 BINDING SITE, designated SEQ ID:16291, to the nucleotide sequence of GAM7052 RNA, herein designated GAM RNA, also designated SEQ ID:296.

Another function of GAM7052 is therefore inhibition of Cleavage and polyadenylation specific factor 2, 100 kda (CPSF2, Accession XP_029311.2). Accordingly, utilities of GAM7052 include diagnosis, prevention and treatment of diseases and clinical conditions associated with CPSF2.

Cytokine receptor-like factor 3 (CRLF3, Accession NP_057070.2) is another GAM7052 target gene, herein designated TARGET GENE. CRLF3 BINDING SITE is a target binding site found in the 3' untranslated region of mRNA encoded by CRLF3, corresponding to a target binding site such as BINDING SITE I, BINDING SITE II or BINDING SITE III of FIG. 8. Table 4 illustrates the complementarity of the nucleotide sequences of CRLF3 BINDING SITE, designated SEQ ID:10228, to the nucleotide sequence of GAM7052 RNA, herein designated GAM RNA, also designated SEQ ID:296.

Another function of GAM7052 is therefore inhibition of Cytokine receptor-like factor 3 (CRLF3, Accession NP_057070.2). Accordingly, utilities of GAM7052 include diagnosis, prevention and treatment of diseases and clinical conditions associated with CRLF3.

Cofactor required for sp1 transcriptional activation, subunit 6, 77 kda (CRSP6, Accession NP_004259.3) is another GAM7052 target gene, herein designated TARGET GENE. CRSP6 BINDING SITE is a target binding site found in the 3' untranslated region of mRNA encoded by CRSP6, corresponding to a target binding site such as BINDING SITE I, BINDING SITE II or BINDING SITE III of FIG. 8. Table 4 illustrates the complementarity of the nucleotide sequences of CRSP6 BINDING SITE, designated SEQ ID:5118, to the nucleotide sequence of GAM7052 RNA, herein designated GAM RNA, also designated SEQ ID:296.

Another function of GAM7052 is therefore inhibition of Cofactor required for sp1 transcriptional activation, subunit 6, 77 kda (CRSP6, Accession NP_004259.3), a gene which is required for Sp1 mediated transcriptional activation with TAF (II)s. Accordingly, utilities of GAM7052 include diagnosis, prevention and treatment of diseases and clinical conditions associated with CRSP6.

The function of CRSP6 and its association with various diseases and clinical conditions, has been established by previous studies, as described hereinabove with reference to GAM189.1. CTEN (Accession NP_116254.3) is another GAM7052 target gene, herein designated TARGET GENE. CTEN BINDING SITE is a target binding site found in the 3' untranslated region of mRNA encoded by CTEN, corresponding to a target binding site such as BINDING SITE I, BINDING SITE II or BINDING SITE III of FIG. 8. Table 4 illustrates the complementarity of the nucleotide sequences of CTEN BINDING SITE, designated SEQ ID:4888, to the nucleotide sequence of GAM7052 RNA, herein designated GAM RNA, also designated SEQ ID:296.

Another function of GAM7052 is therefore inhibition of CTEN (Accession NP_116254.3). Accordingly, utilities of GAM7052 include diagnosis, prevention and treatment of diseases and clinical conditions associated with CTEN.

CYCS (Accession NP_061820.1) is another GAM7052 target gene, herein designated TARGET GENE. CYCS BINDING SITE1 and CYCS BINDING SITE2 are target binding sites found in untranslated regions of mRNA encoded by CYCS, corresponding to target binding sites such as BINDING SITE I, BINDING SITE II or BINDING SITE III of FIG. 8. Table 4 illustrates the complementarity of the nucleotide sequences of CYCS BINDING SITE1 and CYCS BINDING SITE2, designated SEQ ID:18745 and SEQ ID:6532 respectively, to the nucleotide sequence of GAM7052 RNA, herein designated GAM RNA, also designated SEQ ID:296.

Another function of GAM7052 is therefore inhibition of CYCS (Accession NP_061820.1). Accordingly, utilities of GAM7052 include diagnosis, prevention and treatment of diseases and clinical conditions associated with CYCS.

Cylicin, basic protein of sperm head cytoskeleton 2 (CYLC2, Accession NP_001331.1) is another GAM7052 target gene, herein designated TARGET GENE. CYLC2 BINDING SITE is a target binding site found in the 3' untranslated region of mRNA encoded by CYLC2, corresponding to a target binding site such as BINDING SITE I, BINDING SITE II or BINDING SITE III of FIG. 8. Table 4 illustrates the complementarity of the nucleotide sequences of CYLC2 BINDING SITE, designated SEQ ID:13498, to the nucleotide sequence of GAM7052 RNA, herein designated GAM RNA, also designated SEQ ID:296.

Another function of GAM7052 is therefore inhibition of Cylicin, basic protein of sperm head cytoskeleton 2 (CYLC2, Accession NP_001331.1). Accordingly, utilities of GAM7052 include diagnosis, prevention and treatment of diseases and clinical conditions associated with CYLC2.

CYP24A1 (Accession NP_000773.1) is another GAM7052 target gene, herein designated TARGET GENE. CYP24A1 BINDING SITE is a target binding site found in the 3' untranslated region of mRNA encoded by CYP24A1, corresponding to a target binding site such as BINDING SITE I, BINDING SITE II or BINDING SITE III of FIG. 8. Table 4 illustrates the complementarity of the nucleotide sequences of CYP24A1 BINDING SITE, designated SEQ ID:5450, to the nucleotide sequence of GAM7052 RNA, herein designated GAM RNA, also designated SEQ ID:296.

Another function of GAM7052 is therefore inhibition of CYP24A1 (Accession NP_000773.1). Accordingly, utilities of GAM7052 include diagnosis, prevention and treatment of diseases and clinical conditions associated with CYP24A1.

Cytochrome p450, subfamily iib (phenobarbital-inducible), polypeptide 6 (CYP2B6, Accession NP_000758.1) is another GAM7052 target gene, herein designated TARGET GENE. CYP2B6 BINDING SITE1 and CYP2B6 BINDING SITE2 are target binding sites found in untranslated regions of mRNA encoded by CYP2B6, corresponding to target binding sites such as BINDING SITE I, BINDING SITE II or BINDING SITE III of FIG. 8. Table 4 illustrates the complementarity of the nucleotide sequences of CYP2B6 BINDING SITE1 and CYP2B6 BINDING SITE2, designated SEQ ID:14638 and SEQ ID:14013 respectively, to the nucleotide sequence of GAM7052 RNA, herein designated GAM RNA, also designated SEQ ID:296.

Another function of GAM7052 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM7052 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. Cytochrome p450, subfamily viiib (sterol 12-alpha-hydroxylase), polypeptide 1 (CYP8B1, Accession NP_004382.1) is another GAM7052 target gene, herein designated TARGET GENE. CYP8B1 BINDING SITE1 and CYP8B1 BINDING SITE2 are target binding sites found in untranslated regions of mRNA encoded by CYP8B1, corresponding to target binding sites such as BINDING SITE I, BINDING SITE II or BINDING SITE III of FIG. 8. Table 4 illustrates the complementarity of the nucleotide sequences of CYP8B1 BINDING SITE1 and CYP8B1 BINDING SITE2, designated SEQ ID:5688 and SEQ ID:14961 respectively, to the nucleotide sequence of GAM7052 RNA, herein designated GAM RNA, also designated SEQ ID:296.

Another function of GAM7052 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM7052 include diagnosis, prevention and treatment of diseases and clinical conditions associated with CYP8B1.

The function of CYP8B1 and its association with various diseases and clinical conditions, has been established by previous studies, as described hereinabove with reference to GAM47.1. Doublecortex; lissencephaly, x-linked (doublecortin) (DCX, Accession NP_835365.1) is another GAM7052 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:5712, to the nucleotide sequence of GAM7052 RNA, herein designated GAM RNA, also designated SEQ ID:296.

Another function of GAM7052 is therefore inhibition of Doublecortex; lissencephaly, x-linked (doublecortin) (DCX, Accession NP_835365.1). Accordingly, utilities of GAM7052 include diagnosis, prevention and treatment of diseases and clinical conditions associated with DCX.

Doublecortex; lissencephaly, x-linked (doublecortin) (DCX, Accession NP_000546.2) is another GAM7052 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:5712, to the nucleotide sequence of GAM7052 RNA, herein designated GAM RNA, also designated SEQ ID:296.

Another function of GAM7052 is therefore inhibition of Doublecortex; lissencephaly, x-linked (doublecortin) (DCX, Accession NP_000546.2). Accordingly, utilities of GAM7052 include diagnosis, prevention and treatment of diseases and clinical conditions associated with DCX.

Doublecortex; lissencephaly, x-linked (doublecortin) (DCX, Accession NP_835366.1) is another GAM7052 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:5712, to the nucleotide sequence of GAM7052 RNA, herein designated GAM RNA, also designated SEQ ID:296.

Another function of GAM7052 is therefore inhibition of Doublecortex; lissencephaly, x-linked (doublecortin) (DCX, Accession NP_835366.1). Accordingly, utilities of GAM7052 include diagnosis, prevention and treatment of diseases and clinical conditions associated with DCX.

Doublecortex; lissencephaly, x-linked (doublecortin) (DCX, Accession NP_835364.1) is another GAM7052 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:5712, to the nucleotide sequence of GAM7052 RNA, herein designated GAM RNA, also designated SEQ ID:296.

Another function of GAM7052 is therefore inhibition of Doublecortex; lissencephaly, x-linked (doublecortin) (DCX, Accession NP_835364.1). Accordingly, utilities of GAM7052 include diagnosis, prevention and treatment of diseases and clinical conditions associated with DCX.

Dna fragmentation factor, 40 kda, beta polypeptide (caspase-activated dnase) (DFFB, Accession NP_004393.1) is another GAM7052 target gene, herein designated TARGET GENE. DFFB BINDING SITE1 and DFFB BINDING SITE2 are target binding sites found in untranslated regions of mRNA encoded by DFFB, corresponding to target binding sites such as BINDING SITE I, BINDING SITE II or BINDING SITE III of FIG. 8. Table 4 illustrates the complementarity of the nucleotide sequences of DFFB BINDING SITE1 and DFFB BINDING SITE2, designated SEQ ID:12740 and SEQ ID:16722 respectively, to the nucleotide sequence of GAM7052 RNA, herein designated GAM RNA, also designated SEQ ID:296.

Another function of GAM7052 is therefore inhibition of Dna fragmentation factor, 40 kda, beta polypeptide (caspase-activated dnase) (DFFB, Accession NP_004393.1), a gene which induces DNA fragmentation and chromatin condensation during apoptosis. Accordingly, utilities of GAM7052 include diagnosis, prevention and treatment of diseases and clinical conditions associated with DFFB.

The function of DFFB and its association with various diseases and clinical conditions, has been established by previous studies, as described hereinabove with reference to GAM130.1. DKFZp434C0923 (Accession NP_060068.1) is another GAM7052 target gene, herein designated TARGET GENE. DKFZp434C0923 BINDING SITE is a target binding site found in the 3' untranslated region of mRNA encoded by DKFZp434C0923, corresponding to a target binding site such as BINDING SITE I, BINDING SITE II or BINDING SITE III of FIG. 8. Table 4 illustrates the complementarity of the nucleotide sequences of DKFZp434C0923 BINDING SITE, designated SEQ ID:8218, to the nucleotide sequence of GAM7052 RNA, herein designated GAM RNA, also designated SEQ ID:296.

Another function of GAM7052 is therefore inhibition of DKFZp434C0923 (Accession NP_060068.1). Accordingly, utilities of GAM7052 include diagnosis, prevention and treatment of diseases and clinical conditions associated with DKFZp434C0923.

DKFZP434D146 (Accession NP_056410.2) is another GAM7052 target gene, herein designated TARGET GENE. DKFZP434D146 BINDING SITE is a target binding site found in the 3' untranslated region of mRNA encoded by DKFZP434D146, corresponding to a target binding site such as BINDING SITE I, BINDING SITE II or BINDING SITE III of FIG. 8. Table 4 illustrates the complementarity of the nucleotide sequences of DKFZP434D146 BINDING SITE, designated SEQ ID:2840, to the nucleotide sequence of GAM7052 RNA, herein designated GAM RNA, also designated SEQ ID:296.

Another function of GAM7052 is therefore inhibition of DKFZP434D146 (Accession NP_056410.2). Accordingly, utilities of GAM7052 include diagnosis, prevention and treatment of diseases and clinical conditions associated with DKFZP434D146.

DKFZP434F0318 (Accession NP_110444.1) is another GAM7052 target gene, herein designated TARGET GENE. DKFZP434F0318 BINDING SITE is a target binding site found in the 3' untranslated region of mRNA encoded by DKFZP434F0318, corresponding to a target binding site such as BINDING SITE I, BINDING SITE II or BINDING SITE III of FIG. 8. Table 4 illustrates the complementarity of the nucleotide sequences of DKFZP434F0318 BINDING SITE, designated SEQ ID:5215, to the nucleotide sequence of GAM7052 RNA, herein designated GAM RNA, also designated SEQ ID:296.

Another function of GAM7052 is therefore inhibition of DKFZP434F0318 (Accession NP_110444.1). Accordingly, utilities of GAM7052 include diagnosis, prevention and treatment of diseases and clinical conditions associated with DKFZP434F0318.

DKFZp547A023 (Accession NP_061174.1) is another GAM7052 target gene, herein designated TARGET GENE. DKFZp547A023 BINDING SITE is a target binding site found in the 3' untranslated region of mRNA encoded by DKFZp547A023, corresponding to a target binding site such as BINDING SITE I, BINDING SITE II or BINDING SITE III of FIG. 8. Table 4 illustrates the complementarity of the nucleotide sequences of DKFZp547A023 BINDING SITE, designated SEQ ID:15974, to the nucleotide sequence of GAM7052 RNA, herein designated GAM RNA, also designated SEQ ID:296.

Another function of GAM7052 is therefore inhibition of DKFZp547A023 (Accession NP_061174.1). Accordingly, utilities of GAM7052 include diagnosis, prevention and treatment of diseases and clinical conditions associated with DKFZp547A023.

DKFZP564G092 (Accession NP_056416.1) is another GAM7052 target gene, herein designated TARGET GENE. DKFZP564G092 BINDING SITE is a target binding site found in the 5' untranslated region of mRNA encoded by DKFZP564G092, corresponding to a target binding site such as BINDING SITE I, BINDING SITE II or BINDING SITE III of FIG. 8. Table 4 illustrates the complementarity of the nucleotide sequences of DKFZP564G092 BINDING SITE, designated SEQ ID:11229, to the nucleotide sequence of GAM7052 RNA, herein designated GAM RNA, also designated SEQ ID:296.

Another function of GAM7052 is therefore inhibition of DKFZP564G092 (Accession NP_056416.1). Accordingly, utilities of GAM7052 include diagnosis, prevention and treatment of diseases and clinical conditions associated with DKFZP564G092.

DKFZP564O0523 (Accession NP_115496.1) is another GAM7052 target gene, herein designated TARGET GENE. DKFZP564O0523 BINDING SITE is a target binding site found in the 3' untranslated region of mRNA encoded by DKFZP564O0523, corresponding to a target binding site such as BINDING SITE I, BINDING SITE II or BINDING SITE III of FIG. 8. Table 4 illustrates the complementarity of the nucleotide sequences of DKFZP564O0523 BINDING SITE, designated SEQ ID:19558, to the nucleotide sequence of GAM7052 RNA, herein designated GAM RNA, also designated SEQ ID:296.

Another function of GAM7052 is therefore inhibition of DKFZP564O0523 (Accession NP_115496.1). Accordingly, utilities of GAM7052 include diagnosis, prevention and treatment of diseases and clinical conditions associated with DKFZP564O0523.

DKFZP566I1024 (Accession NP_056226.1) is another GAM7052 target gene, herein designated TARGET GENE. DKFZP566I1024 BINDING SITE is a target binding site found in the 3' untranslated region of mRNA encoded by DKFZP566I1024, corresponding to a target binding site such as BINDING SITE I, BINDING SITE II or BINDING SITE III of FIG. 8. Table 4 illustrates the complementarity of the nucleotide sequences of DKFZP566I1024 BINDING SITE, designated SEQ ID:9433, to the nucleotide sequence of GAM7052 RNA, herein designated GAM RNA, also designated SEQ ID:296.

Another function of GAM7052 is therefore inhibition of DKFZP566I1024 (Accession NP_056226.1). Accordingly, utilities of GAM7052 include diagnosis, prevention and treatment of diseases and clinical conditions associated with DKFZP566I1024.

DKFZP586D0919 (Accession NP_056248.1) is another GAM7052 target gene, herein designated TARGET GENE. DKFZP586D0919 BINDING SITE is a target binding site found in the 3' untranslated region of mRNA encoded by DKFZP586D0919, corresponding to a target binding site such as BINDING SITE I, BINDING SITE II or BINDING SITE III of FIG. 8. Table 4 illustrates the complementarity of the nucleotide sequences of DKFZP586D0919 BINDING SITE, designated SEQ ID:9678, to the nucleotide sequence of GAM7052 RNA, herein designated GAM RNA, also designated SEQ ID:296.

Another function of GAM7052 is therefore inhibition of DKFZP586D0919 (Accession NP_056248.1). Accordingly, utilities of GAM7052 include diagnosis, prevention and treatment of diseases and clinical conditions associated with DKFZP586D0919.

DKFZp586I1420 (Accession NP_689960.1) is another GAM7052 target gene, herein designated TARGET GENE. DKFZp586I1420 BINDING SITE is a target binding site found in the 3' untranslated region of mRNA encoded by DKFZp586I1420, corresponding to a target binding site such as BINDING SITE I, BINDING SITE II or BINDING SITE III of FIG. 8. Table 4 illustrates the complementarity of the nucleotide sequences of DKFZp586I1420 BINDING SITE, designated SEQ ID:3745, to the nucleotide sequence of GAM7052 RNA, herein designated GAM RNA, also designated SEQ ID:296.

Another function of GAM7052 is therefore inhibition of DKFZp586I1420 (Accession NP_689960.1). Accordingly, utilities of GAM7052 include diagnosis, prevention and treatment of diseases and clinical conditions associated with DKFZp586I1420.

DKFZP586M1120 (Accession NP_112584.1) is another GAM7052 target gene, herein designated TARGET GENE. DKFZP586M1120 BINDING SITE is a target binding site found in the 3' untranslated region of mRNA encoded by DKFZP586M1120, corresponding to a target binding site such as BINDING SITE I, BINDING SITE II or BINDING SITE III of FIG. 8. Table 4 illustrates the complementarity of the nucleotide sequences of DKFZP586M1120 BINDING SITE, designated SEQ ID:3746, to the nucleotide sequence of GAM7052 RNA, herein designated GAM RNA, also designated SEQ ID:296.

Another function of GAM7052 is therefore inhibition of DKFZP586M1120 (Accession NP_112584.1). Accordingly, utilities of GAM7052 include diagnosis, prevention and treatment of diseases and clinical conditions associated with DKFZP586M1120.

DKFZp667B1218 (Accession NP_808881.1) is another GAM7052 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:7365, to the nucleotide sequence of GAM7052 RNA, herein designated GAM RNA, also designated SEQ ID:296.

Another function of GAM7052 is therefore inhibition of DKFZp667B1218 (Accession NP_808881.1). Accordingly, utilities of GAM7052 include diagnosis, prevention and treatment of diseases and clinical conditions associated with DKFZp667B1218.

DKFZp761B107 (Accession NP_775734.1) is another GAM7052 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:14917, to the nucleotide sequence of GAM7052 RNA, herein designated GAM RNA, also designated SEQ ID:296.

Another function of GAM7052 is therefore inhibition of DKFZp761B107 (Accession NP_775734.1). Accordingly, utilities of GAM7052 include diagnosis, prevention and treatment of diseases and clinical conditions associated with DKFZp761B107.

DKFZp761B128 (Accession NP_689650.1) is another GAM7052 target gene, herein designated TARGET GENE. DKFZp761B128 BINDING SITE is a target binding site found in the 5' untranslated region of mRNA encoded by DKFZp761B128, corresponding to a target binding site such as BINDING SITE I, BINDING SITE II or BINDING SITE III of FIG. 8. Table 4 illustrates the complementarity of the nucleotide sequences of DKFZp761B128 BINDING SITE, designated SEQ ID:3467, to the nucleotide sequence of GAM7052 RNA, herein designated GAM RNA, also designated SEQ ID:296.

Another function of GAM7052 is therefore inhibition of DKFZp761B128 (Accession NP_689650.1). Accordingly, utilities of GAM7052 include diagnosis, prevention and treatment of diseases and clinical conditions associated with DKFZp761B128.

DKFZp761H039 (Accession NP_061181.1) is another GAM7052 target gene, herein designated TARGET GENE. DKFZp761H039 BINDING SITE is a target binding site found in the 3' untranslated region of mRNA encoded by DKFZp761H039, corresponding to a target binding site such as BINDING SITE I, BINDING SITE II or BINDING SITE III of FIG. 8. Table 4 illustrates the complementarity of the nucleotide sequences of DKFZp761H039 BINDING SITE, designated SEQ ID:3638, to the nucleotide sequence of GAM7052 RNA, herein designated GAM RNA, also designated SEQ ID:296.

Another function of GAM7052 is therefore inhibition of DKFZp761H039 (Accession NP_061181.1). Accordingly, utilities of GAM7052 include diagnosis, prevention and treatment of diseases and clinical conditions associated with DKFZp761H039.

DKFZp761P1121 (Accession NP_690870.1) is another GAM7052 target gene, herein designated TARGET GENE. DKFZp761P1121 BINDING SITE is a target binding site found in the 3' untranslated region of mRNA encoded by DKFZp761P1121, corresponding to a target binding site such as BINDING SITE I, BINDING SITE II or BINDING SITE III of FIG. 8. Table 4 illustrates the complementarity of the nucleotide sequences of DKFZp761P1121 BINDING SITE, designated SEQ ID:6533, to the nucleotide sequence of GAM7052 RNA, herein designated GAM RNA, also designated SEQ ID:296.

Another function of GAM7052 is therefore inhibition of DKFZp761P1121 (Accession NP_690870.1). Accordingly, utilities of GAM7052 include diagnosis, prevention and treatment of diseases and clinical conditions associated with DKFZp761P1121.

DKFZp762L0311 (Accession NP_061189.2) is another GAM7052 target gene, herein designated TARGET GENE. DKFZp762L0311 BINDING SITE is a target binding site found in the 3' untranslated region of mRNA encoded by DKFZp762L0311, corresponding to a target binding site such as BINDING SITE I, BINDING SITE II or BINDING SITE III of FIG. 8. Table 4 illustrates the complementarity of the nucleotide sequences of DKFZp762L0311 BINDING SITE, designated SEQ ID:13279, to the nucleotide sequence of GAM7052 RNA, herein designated GAM RNA, also designated SEQ ID:296.

Another function of GAM7052 is therefore inhibition of DKFZp762L0311 (Accession NP_061189.2). Accordingly, utilities of GAM7052 include diagnosis, prevention and treatment of diseases and clinical conditions associated with DKFZp762L0311.

DLAD (Accession NP_490649.1) is another GAM7052 target gene, herein designated TARGET GENE. DLAD BINDING SITE is a target binding site found in the 5' untranslated region of multiple transcripts of mRNA encoded by DLAD, corresponding to a target binding site such as BINDING SITE I, BINDING SITE II or BINDING SITE III of FIG. 8. Table 4 illustrates the complementarity of the nucleotide sequences of DLAD BINDING SITE, designated SEQ ID:10031, to the nucleotide sequence of GAM7052 RNA, herein designated GAM RNA, also designated SEQ ID:296.

Another function of GAM7052 is therefore inhibition of DLAD (Accession NP_490649.1). Accordingly, utilities of GAM7052 include diagnosis, prevention and treatment of diseases and clinical conditions associated with DLAD.

Dihydrolipoamide s-succinyltransferase (e2 component of 2-oxo-glutarate complex) (DLST, Accession NP_001924.2) is another GAM7052 target gene, herein designated TARGET GENE. DLST BINDING SITE is a target binding site found in the 3' untranslated region of mRNA encoded by DLST, corresponding to a target binding site such as BINDING SITE I, BINDING SITE II or BINDING SITE III of FIG. 8. Table 4 illustrates the complementarity of the nucleotide sequences of DLST BINDING SITE, designated SEQ ID:9118, to the nucleotide sequence of GAM7052 RNA, herein designated GAM RNA, also designated SEQ ID:296.

Another function of GAM7052 is therefore inhibition of Dihydrolipoamide s-succinyltransferase (e2 component of 2-oxo-glutarate complex) (DLST, Accession NP_001924.2), a gene which catalyzes the oxidative decarboxylation of alpha-keto acids. Accordingly, utilities of GAM7052 include diagnosis, prevention and treatment of diseases and clinical conditions associated with DLST.

The function of DLST and its association with various diseases and clinical conditions, has been established by previous studies, as described hereinabove with reference to GAM507.1. Desmocollin 3 (DSC3, Accession NP_077741.1) is another GAM7052 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:9847, to the nucleotide sequence of GAM7052 RNA, herein designated GAM RNA, also designated SEQ ID:296.

Another function of GAM7052 is therefore inhibition of Desmocollin 3 (DSC3, Accession NP_077741.1), a gene which is a component of intercellular desmosome junctions. Accordingly, utilities of GAM7052 include diagnosis, prevention and treatment of diseases and clinical conditions associated with DSC3.

The function of DSC3 and its association with various diseases and clinical conditions, has been established by previous studies, as described hereinabove with reference to GAM30.1. Desmocollin 3 (DSC3, Accession NP_001932.1) is another GAM7052 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:9847, to the nucleotide sequence of GAM7052 RNA, herein designated GAM RNA, also designated SEQ ID:296.

Another function of GAM7052 is therefore inhibition of Desmocollin 3 (DSC3, Accession NP_001932.1), a gene which is a component of intercellular desmosome junctions. Accordingly, utilities of GAM7052 include diagnosis, prevention and treatment of diseases and clinical conditions associated with DSC3.

The function of DSC3 and its association with various diseases and clinical conditions, has been established by previous studies, as described hereinabove with reference to GAM30.1. Dual-specificity tyrosine-(y)-phosphorylation regulated kinase 1a (DYRK1A, Accession NP_567824.1) is another GAM7052 target gene, herein designated TARGET GENE. DYRK1A BINDING SITE is a target binding site found in the 5' untranslated region of multiple transcripts of mRNA encoded by DYRK1A, corresponding to a target binding site such as BINDING SITE I, BINDING SITE II or BINDING SITE III of FIG. 8. Table 4 illustrates the complementarity of the nucleotide sequences of DYRK1A BINDING SITE, designated SEQ ID:17441, to the nucleotide sequence of GAM7052 RNA, herein designated GAM RNA, also designated SEQ ID:296.

Another function of GAM7052 is therefore inhibition of Dual-specificity tyrosine-(y)-phosphorylation regulated kinase 1a (DYRK1A, Accession NP_567824.1), a gene which regulates cell proliferation and may be involved in brain development and therefore may be associated with Down syndrome. Accordingly, utilities of GAM7052 include diagnosis, prevention and treatment of Down syndrome, and of other diseases and clinical conditions associated with DYRK1A.

The function of DYRK1A and its association with various diseases and clinical conditions, has been established by previous studies, as described hereinabove with reference to GAM63.1. EDEM (Accession NP_055489.1) is another GAM7052 target gene, herein designated TARGET GENE. EDEM BINDING SITE is a target binding site found in the 3' untranslated region of mRNA encoded by EDEM, corresponding to a target binding site such as BINDING SITE I, BINDING SITE II or BINDING SITE III of FIG. 8. Table 4 illustrates the complementarity of the nucleotide sequences of EDEM BINDING SITE, designated SEQ ID:12749, to the nucleotide sequence of GAM7052 RNA, herein designated GAM RNA, also designated SEQ ID:296.

Another function of GAM7052 is therefore inhibition of EDEM (Accession NP_055489.1). Accordingly, utilities of GAM7052 include diagnosis, prevention and treatment of diseases and clinical conditions associated with EDEM.

EEF2K (Accession NP_037434.1) is another GAM7052 target gene, herein designated TARGET GENE. EEF2K BINDING SITE is a target binding site found in the 3' untranslated region of mRNA encoded by EEF2K, corresponding to a target binding site such as BINDING SITE I, BINDING SITE II or BINDING SITE III of FIG. 8. Table 4 illustrates the complementarity of the nucleotide sequences of EEF2K BINDING SITE, designated SEQ ID:13359, to the nucleotide sequence of GAM7052 RNA, herein designated GAM RNA, also designated SEQ ID:296.

Another function of GAM7052 is therefore inhibition of EEF2K (Accession NP_037434.1), a gene which phosphorylates serine or threonine on the eukaryotic elongation factor-2 and therefore may be associated with Systemic lupus erythematosus and cancer. Accordingly, utilities of GAM7052 include diagnosis, prevention and treatment of Systemic lupus erythematosus and cancer, and of other diseases and clinical conditions associated with EEF2K.

The function of EEF2K and its association with various diseases and clinical conditions, has been established by previous studies, as described hereinabove with reference to GAM189.1. Early growth response 1 (EGR1, Accession NP_001955.1) is another GAM7052 target gene, herein designated TARGET GENE. EGR1 BINDING SITE is a target binding site found in the 3' untranslated region of mRNA encoded by EGR1, corresponding to a target binding site such as BINDING SITE I, BINDING SITE II or BINDING SITE III of FIG. 8. Table 4 illustrates the complementarity of the nucleotide sequences of EGR1 BINDING SITE, designated SEQ ID:10941, to the nucleotide sequence of GAM7052 RNA, herein designated GAM RNA, also designated SEQ ID:296.

Another function of GAM7052 is therefore inhibition of Early growth response 1 (EGR1, Accession NP_001955.1). Accordingly, utilities of GAM7052 include diagnosis, prevention and treatment of diseases and clinical conditions associated with EGR1.

Eh-domain containing 2 (EHD2, Accession NP_055416.2) is another GAM7052 target gene, herein designated TARGET GENE. EHD2 BINDING SITE is a target binding site found in the 3' untranslated region of mRNA encoded by EHD2, corresponding to a target binding site such as BINDING SITE I, BINDING SITE II or BINDING SITE III of FIG. 8. Table 4 illustrates the complementarity of the nucleotide sequences of EHD2 BINDING SITE, designated SEQ ID:10698, to the nucleotide sequence of GAM7052 RNA, herein designated GAM RNA, also designated SEQ ID:296.

Another function of GAM7052 is therefore inhibition of Eh-domain containing 2 (EHD2, Accession NP_055416.2). Accordingly, utilities of GAM7052 include diagnosis, prevention and treatment of diseases and clinical conditions associated with EHD2.

ELP3 (Accession NP_060561.3) is another GAM7052 target gene, herein designated TARGET GENE. ELP3 BINDING SITE is a target binding site found in the 3' untranslated region of mRNA encoded by ELP3, corresponding to a target binding site such as BINDING SITE I, BINDING SITE II or BINDING SITE III of FIG. 8. Table 4 illustrates the complementarity of the nucleotide sequences of ELP3 BINDING SITE, designated SEQ ID:8011, to the nucleotide sequence of GAM7052 RNA, herein designated GAM RNA, also designated SEQ ID:296.

Another function of GAM7052 is therefore inhibition of ELP3 (Accession NP_060561.3). Accordingly, utilities of GAM7052 include diagnosis, prevention and treatment of diseases and clinical conditions associated with ELP3.

Endothelial cell-specific molecule 1 (ESM1, Accession NP_008967.1) is another GAM7052 target gene, herein designated TARGET GENE. ESM1 BINDING SITE is a target binding site found in the 5' untranslated region of mRNA encoded by ESM1, corresponding to a target binding site such as BINDING SITE I, BINDING SITE II or BINDING SITE III of FIG. 8. Table 4 illustrates the complementarity of the nucleotide sequences of ESM1 BINDING SITE, designated SEQ ID:1018, to the nucleotide sequence of GAM7052 RNA, herein designated GAM RNA, also designated SEQ ID:296.

Another function of GAM7052 is therefore inhibition of Endothelial cell-specific molecule 1 (ESM1, Accession NP_008967.1). Accordingly, utilities of GAM7052 include diagnosis, prevention and treatment of diseases and clinical conditions associated with ESM1.

ET(B)R-LP-2 (Accession NP_004758.2) is another GAM7052 target gene, herein designated TARGET GENE. ET(B)R-LP-2 BINDING SITE is a target binding site found in the 3' untranslated region of mRNA encoded by ET(B)R-LP-2, corresponding to a target binding site such as BINDING SITE I, BINDING SITE II or BINDING SITE III of FIG. 8. Table 4 illustrates the complementarity of the nucleotide sequences of ET(B)R-LP-2 BINDING SITE, designated SEQ ID:9691, to the nucleotide sequence of GAM7052 RNA, herein designated GAM RNA, also designated SEQ ID:296.

Another function of GAM7052 is therefore inhibition of ET(B)R-LP-2 (Accession NP_004758.2). Accordingly, utilities of GAM7052 include diagnosis, prevention and treatment of diseases and clinical conditions associated with ET(B)R-LP-2.

F11R (Accession NP_653086.1) is another GAM7052 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:9554, to the nucleotide sequence of GAM7052 RNA, herein designated GAM RNA, also designated SEQ ID:296.

Another function of GAM7052 is therefore inhibition of F11R (Accession NP_653086.1). Accordingly, utilities of GAM7052 include diagnosis, prevention and treatment of diseases and clinical conditions associated with F11R.

F11R (Accession NP_653085.1) is another GAM7052 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:9554, to the nucleotide sequence of GAM7052 RNA, herein designated GAM RNA, also designated SEQ ID:296.

Another function of GAM7052 is therefore inhibition of F11R (Accession NP_653085.1). Accordingly, utilities of GAM7052 include diagnosis, prevention and treatment of diseases and clinical conditions associated with F11R.

F11R (Accession NP_653087.1) is another GAM7052 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:9554, to the nucleotide sequence of GAM7052 RNA, herein designated GAM RNA, also designated SEQ ID:296.

Another function of GAM7052 is therefore inhibition of F11R (Accession NP_653087.1). Accordingly, utilities of GAM7052 include diagnosis, prevention and treatment of diseases and clinical conditions associated with F11R.

F11R (Accession NP_058642.1) is another GAM7052 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:9554, to the nucleotide sequence of GAM7052 RNA, herein designated GAM RNA, also designated SEQ ID:296.

Another function of GAM7052 is therefore inhibition of F11R (Accession NP_058642.1). Accordingly, utilities of GAM7052 include diagnosis, prevention and treatment of diseases and clinical conditions associated with F11R.

Coagulation factor ii (thrombin) receptor-like 2 (F2RL2, Accession NP_004092.1) is another GAM7052 target gene, herein designated TARGET GENE. F2RL2 BINDING SITE is a target binding site found in the 3' untranslated region of mRNA encoded by F2RL2, corresponding to a target binding site such as BINDING SITE I, BINDING SITE II or BINDING SITE III of FIG. 8. Table 4 illustrates the complementarity of the nucleotide sequences of F2RL2 BINDING SITE, designated SEQ ID:6476, to the nucleotide sequence of GAM7052 RNA, herein designated GAM RNA, also designated SEQ ID:296.

Another function of GAM7052 is therefore inhibition of Coagulation factor ii (thrombin) receptor-like 2 (F2RL2, Accession NP_004092.1), a gene which receptor for activated thrombin coupled to g proteins that stimulate phosphoinositide hydrolysis. Accordingly, utilities of GAM7052 include diagnosis, prevention and treatment of diseases and clinical conditions associated with F2RL2.

The function of F2RL2 and its association with various diseases and clinical conditions, has been established by previous studies, as described hereinabove with reference to GAM136.1. Coagulation factor iii (thromboplastin, tissue factor) (F3, Accession NP_001984.1) is another GAM7052 target gene, herein designated TARGET GENE. F3 BINDING SITE is a target binding site found in the 3' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:14740, to the nucleotide sequence of GAM7052 RNA, herein designated GAM RNA, also designated SEQ ID:296.

Another function of GAM7052 is therefore inhibition of Coagulation factor iii (thromboplastin, tissue factor) (F3, Accession NP_001984.1), a gene which functions in normal hemostasis. Accordingly, utilities of GAM7052 include diagnosis, prevention and treatment of diseases and clinical conditions associated with F3.

The function of F3 and its association with various diseases and clinical conditions, has been established by previous studies, as described hereinabove with reference to GAM136.1. Fatty acid binding protein 2, intestinal (FABP2, Accession NP_000125.1) is another GAM7052 target gene, herein designated TARGET GENE. FABP2 BINDING SITE is a target binding site found in the 3' untranslated region of mRNA encoded by FABP2, corresponding to a target binding site such as BINDING SITE I, BINDING SITE II or BINDING SITE III of FIG. 8. Table 4 illustrates the complementarity of the nucleotide sequences of FABP2 BINDING SITE, designated SEQ ID:17010, to the nucleotide sequence of GAM7052 RNA, herein designated GAM RNA, also designated SEQ ID:296.

Another function of GAM7052 is therefore inhibition of Fatty acid binding protein 2, intestinal (FABP2, Accession NP_000125.1), a gene which may have a role in dietary fat uptake or processing. and therefore may be associated with Cardiovascular disease and type 2 diabetes. Accordingly, utilities of GAM7052 include diagnosis, prevention and treatment of Cardiovascular disease and type 2 diabetes, and of other diseases and clinical conditions associated with FABP2.

The function of FABP2 and its association with various diseases and clinical conditions, has been established by previous studies, as described hereinabove with reference to GAM189.1. Fanconi anemia, complementation group e (FANCE, Accession NP_068741.1) is another GAM7052 target gene, herein designated TARGET GENE. FANCE BINDING SITE is a target binding site found in the 3' untranslated region of mRNA encoded by FANCE, corresponding to a target binding site such as BINDING SITE I, BINDING SITE II or BINDING SITE III of FIG. 8. Table 4 illustrates the complementarity of the nucleotide sequences of FANCE BINDING SITE, designated SEQ ID:1495, to the nucleotide sequence of GAM7052 RNA, herein designated GAM RNA, also designated SEQ ID:296.

Another function of GAM7052 is therefore inhibition of Fanconi anemia, complementation group e (FANCE, Accession NP_068741.1), a gene which is a possible regulator of lymphocyte and platelet function. and therefore is associated with Fanconi anemia, complementation group e. Accordingly, utilities of GAM7052 include diagnosis, prevention and treatment of Fanconi anemia, complementation group e., and of other diseases and clinical conditions associated with FANCE.

The function of FANCE and its association with various diseases and clinical conditions, has been established by previous studies, as described hereinabove with reference to GAM189.1. Fanconi anemia, complementation group f (FANCF, Accession NP_073562.1) is another GAM7052 target gene, herein designated TARGET GENE. FANCF BINDING SITE is a target binding site found in the 3' untranslated region of mRNA encoded by FANCF, corresponding to a target binding site such as BINDING SITE I, BINDING SITE II or BINDING SITE III of FIG. 8. Table 4 illustrates the complementarity of the nucleotide sequences of FANCF BINDING SITE, designated SEQ ID:13765, to the nucleotide sequence of GAM7052 RNA, herein designated GAM RNA, also designated SEQ ID:296.

Another function of GAM7052 is therefore inhibition of Fanconi anemia, complementation group f (FANCF, Accession NP_073562.1). Accordingly, utilities of GAM7052 include diagnosis, prevention and treatment of diseases and clinical conditions associated with FANCF.

F-box only protein 32 (FBXO32, Accession NP_478136.1) is another GAM7052 target gene, herein designated TARGET GENE. FBXO32 BINDING SITE is a target binding site found in the 3' untranslated region of multiple transcripts of mRNA encoded by FBXO32, corresponding to a target binding site such as BINDING SITE I, BINDING SITE II or BINDING SITE III of FIG. 8. Table 4 illustrates the complementarity of the nucleotide sequences of FBXO32 BINDING SITE, designated SEQ ID:4134, to the nucleotide sequence of GAM7052 RNA, herein designated GAM RNA, also designated SEQ ID:296.

Another function of GAM7052 is therefore inhibition of F-box only protein 32 (FBXO32, Accession NP_478136.1). Accordingly, utilities of GAM7052 include diagnosis, prevention and treatment of diseases and clinical conditions associated with FBXO32.

F-box only protein 32 (FBXO32, Accession NP_680482.1) is another GAM7052 target gene, herein designated TARGET GENE. FBXO32 BINDING SITE is a target binding site found in the 3' untranslated region of multiple transcripts of mRNA encoded by FBXO32, corresponding to a target binding site such as BINDING SITE I, BINDING SITE II or BINDING SITE III of FIG. 8. Table 4 illustrates the complementarity of the nucleotide sequences of FBXO32 BINDING SITE, designated SEQ ID:4134, to the nucleotide sequence of GAM7052 RNA, herein designated GAM RNA, also designated SEQ ID:296.

Another function of GAM7052 is therefore inhibition of F-box only protein 32 (FBXO32, Accession NP_680482.1). Accordingly, utilities of GAM7052 include diagnosis, prevention and treatment of diseases and clinical conditions associated with FBXO32.

FBXW8 (Accession NP_699179.2) is another GAM7052 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:8434, to the nucleotide sequence of GAM7052 RNA, herein designated GAM RNA, also designated SEQ ID:296.

Another function of GAM7052 is therefore inhibition of FBXW8 (Accession NP_699179.2). Accordingly, utilities of GAM7052 include diagnosis, prevention and treatment of diseases and clinical conditions associated with FBXW8.

FBXW8 (Accession NP_036306.1) is another GAM7052 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:8434, to the nucleotide sequence of GAM7052 RNA, herein designated GAM RNA, also designated SEQ ID:296.

Another function of GAM7052 is therefore inhibition of FBXW8 (Accession NP_036306.1). Accordingly, utilities of GAM7052 include diagnosis, prevention and treatment of diseases and clinical conditions associated with FBXW8.

Fc fragment of igg, low affinity iia, receptor for (cd32) (FCGR2A, Accession NP_067674.1) is another GAM7052 target gene, herein designated TARGET GENE. FCGR2A BINDING SITE is a target binding site found in the 3' untranslated region of mRNA encoded by FCGR2A, corresponding to a target binding site such as BINDING SITE I, BINDING SITE II or BINDING SITE III of FIG. 8. Table 4 illustrates the complementarity of the nucleotide sequences of FCGR2A BINDING SITE, designated SEQ ID:6966, to the nucleotide sequence of GAM7052 RNA, herein designated GAM RNA, also designated SEQ ID:296.

Another function of GAM7052 is therefore inhibition of Fc fragment of igg, low affinity iia, receptor for (cd32) (FCGR2A, Accession NP_067674.1), a gene which binds IgG immune complexes; member of the immunoglobulin superfamily. and therefore may be associated with Lupus nephritis. Accordingly, utilities of GAM7052 include diagnosis, prevention and treatment of Lupus nephritis, and of other diseases and clinical conditions associated with FCGR2A.

The function of FCGR2A and its association with various diseases and clinical conditions, has been established by previous studies, as described hereinabove with reference to GAM189.1. FCRH1 (Accession NP_443170.1) is another GAM7052 target gene, herein designated TARGET GENE. FCRH1 BINDING SITE is a target binding site found in the 3' untranslated region of mRNA encoded by FCRH1, corresponding to a target binding site such as BINDING SITE I, BINDING SITE II or BINDING SITE III of FIG. 8. Table 4 illustrates the complementarity of the nucleotide sequences of FCRH1 BINDING SITE, designated SEQ ID:6123, to the nucleotide sequence of GAM7052 RNA, herein designated GAM RNA, also designated SEQ ID:296.

Another function of GAM7052 is therefore inhibition of FCRH1 (Accession NP_443170.1). Accordingly, utilities of GAM7052 include diagnosis, prevention and treatment of diseases and clinical conditions associated with FCRH1.

Fer-1-like 4 (c. elegans) (FER1L4, Accession XP_300246.1) is another GAM7052 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:20036, to the nucleotide sequence of GAM7052 RNA, herein designated GAM RNA, also designated SEQ ID:296.

Another function of GAM7052 is therefore inhibition of Fer-1-like 4 (c. elegans) (FER1L4, Accession XP_300246.1). Accordingly, utilities of GAM7052 include diagnosis, prevention and treatment of diseases and clinical conditions associated with FER1L4.

Fer-1-like 4 (c. elegans) (FER1L4, Accession XP_300246.1) is another GAM7052 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:20036, to the nucleotide sequence of GAM7052 RNA, herein designated GAM RNA, also designated SEQ ID:296.

Another function of GAM7052 is therefore inhibition of Fer-1-like 4 (c. elegans) (FER1L4, Accession XP_300246.1). Accordingly, utilities of GAM7052 include diagnosis, prevention and treatment of diseases and clinical conditions associated with FER1L4.

Fasciculation and elongation protein zeta 1 (zygin i) (FEZ1, Accession NP_072043.1) is another GAM7052 target gene, herein designated TARGET GENE. FEZ1 BINDING SITE is a target binding site found in the 3' untranslated region of multiple transcripts of mRNA encoded by FEZ1, corresponding to a target binding site such as BINDING SITE I, BINDING SITE II or BINDING SITE III of FIG. 8. Table 4 illustrates the complementarity of the nucleotide sequences of FEZ1 BINDING SITE, designated SEQ ID:4759, to the nucleotide sequence of GAM7052 RNA, herein designated GAM RNA, also designated SEQ ID:296.

Another function of GAM7052 is therefore inhibition of Fasciculation and elongation protein zeta 1 (zygin i) (FEZ1, Accession NP_072043.1), a gene which Zygin 1; may have a role in axonal outgrowth; has similarity to C. elegans UNC-76. Accordingly, utilities of GAM7052 include diagnosis, prevention and treatment of diseases and clinical conditions associated with FEZ1.

The function of FEZ1 and its association with various diseases and clinical conditions, has been established by previous studies, as described hereinabove with reference to GAM30.1. Fibroblast growth factor 5 (FGF5, Accession NP_149134.1) is another GAM7052 target gene, herein designated TARGET GENE. FGF5 BINDING SITE1 and FGF5 BINDING SITE2 are target binding sites found in untranslated regions of multiple transcripts of mRNA encoded by FGF5, corresponding to target binding sites such as BINDING SITE I, BINDING SITE II or BINDING SITE III of FIG. 8. Table 4 illustrates the complementarity of the nucleotide sequences of FGF5 BINDING SITE1 and FGF5 BINDING SITE2, designated SEQ ID:14043 and SEQ ID:17245 respectively, to the nucleotide sequence of GAM7052 RNA, herein designated GAM RNA, also designated SEQ ID:296.

Another function of GAM7052 is therefore inhibition of Fibroblast growth factor 5 (FGF5, Accession NP_149134.1), a gene which induces transformation and may regulate neuronal differentiation. Accordingly, utilities of GAM7052 include diagnosis, prevention and treatment of diseases and clinical conditions associated with FGF5.

The function of FGF5 and its association with various diseases and clinical conditions, has been established by previous studies, as described hereinabove with reference to GAM106.1. Fibroblast growth factor 5 (FGF5, Accession NP_004455.1) is another GAM7052 target gene, herein designated TARGET GENE. FGF5 BINDING SITE1 and FGF5 BINDING SITE2 are target binding sites found in untranslated regions of multiple transcripts of mRNA encoded by FGF5, corresponding to target binding sites such as BINDING SITE I, BINDING SITE II or BINDING SITE III of FIG. 8. Table 4 illustrates the complementarity of the nucleotide sequences of FGF5 BINDING SITE1 and FGF5 BINDING SITE2, designated SEQ ID:17245 and SEQ ID:14043 respectively, to the nucleotide sequence of GAM7052 RNA, herein designated GAM RNA, also designated SEQ ID:296.

Another function of GAM7052 is therefore inhibition of Fibroblast growth factor 5 (FGF5, Accession NP_004455.1), a gene which induces transformation and may regulate neuronal differentiation. Accordingly, utilities of GAM7052 include diagnosis, prevention and treatment of diseases and clinical conditions associated with FGF5.

The function of FGF5 and its association with various diseases and clinical conditions, has been established by previous studies, as described hereinabove with reference to GAM106.1. FLJ10232 (Accession NP_060503.1) is another GAM7052 target gene, herein designated TARGET GENE. FLJ10232 BINDING SITE1 and FLJ10232 BINDING SITE2 are target binding sites found in untranslated regions of mRNA encoded by FLJ10232, corresponding to target binding sites such as BINDING SITE I, BINDING SITE II or BINDING SITE III of FIG. 8. Table 4 illustrates the complementarity of the nucleotide sequences of FLJ10232 BINDING SITE1 and FLJ10232 BINDING SITE2, designated SEQ ID:6964 and SEQ ID:15854 respectively, to the nucleotide sequence of GAM7052 RNA, herein designated GAM RNA, also designated SEQ ID:296.

Another function of GAM7052 is therefore inhibition of FLJ10232 (Accession NP_060503.1). Accordingly, utilities of GAM7052 include diagnosis, prevention and treatment of diseases and clinical conditions associated with FLJ10232.

FLJ10346 (Accession NP_060535.1) is another GAM7052 target gene, herein designated TARGET GENE. FLJ10346 BINDING SITE is a target binding site found in the 5' untranslated region of mRNA encoded by FLJ10346, corresponding to a target binding site such as BINDING SITE I, BINDING SITE II or BINDING SITE III of FIG. 8. Table 4 illustrates the complementarity of the nucleotide sequences of FLJ10346 BINDING SITE, designated SEQ ID:14573, to the nucleotide sequence of GAM7052 RNA, herein designated GAM RNA, also designated SEQ ID:296.

Another function of GAM7052 is therefore inhibition of FLJ10346 (Accession NP_060535.1). Accordingly, utilities of GAM7052 include diagnosis, prevention and treatment of diseases and clinical conditions associated with FLJ10346.

FLJ10560 (Accession NP_060608.1) is another GAM7052 target gene, herein designated TARGET GENE. FLJ10560 BINDING SITE is a target binding site found in the 3' untranslated region of mRNA encoded by FLJ10560, corresponding to a target binding site such as BINDING SITE I, BINDING SITE II or BINDING SITE III of FIG. 8. Table 4 illustrates the complementarity of the nucleotide sequences of FLJ10560 BINDING SITE, designated SEQ ID:9847, to the nucleotide sequence of GAM7052 RNA, herein designated GAM RNA, also designated SEQ ID:296.

Another function of GAM7052 is therefore inhibition of FLJ10560 (Accession NP_060608.1). Accordingly, utilities of GAM7052 include diagnosis, prevention and treatment of diseases and clinical conditions associated with FLJ10560.

FLJ10613 (Accession NP_061940.1) is another GAM7052 target gene, herein designated TARGET GENE. FLJ10613 BINDING SITE is a target binding site found in the 3' untranslated region of mRNA encoded by FLJ10613, corresponding to a target binding site such as BINDING SITE I, BINDING SITE II or BINDING SITE III of FIG. 8. Table 4 illustrates the complementarity of the nucleotide sequences of FLJ10613 BINDING SITE, designated SEQ ID:3913, to the nucleotide sequence of GAM7052 RNA, herein designated GAM RNA, also designated SEQ ID:296.

Another function of GAM7052 is therefore inhibition of FLJ10613 (Accession NP_061940.1). Accordingly, utilities of GAM7052 include diagnosis, prevention and treatment of diseases and clinical conditions associated with FLJ10613.

FLJ10620 (Accession NP_060627.1) is another GAM7052 target gene, herein designated TARGET GENE. FLJ10620 BINDING SITE is a target binding site found in the 3' untranslated region of mRNA encoded by FLJ10620, corresponding to a target binding site such as BINDING SITE I, BINDING SITE II or BINDING SITE III of FIG. 8. Table 4 illustrates the complementarity of the nucleotide sequences of FLJ10620 BINDING SITE, designated SEQ ID:8748, to the nucleotide sequence of GAM7052 RNA, herein designated GAM RNA, also designated SEQ ID:296.

Another function of GAM7052 is therefore inhibition of FLJ10620 (Accession NP_060627.1). Accordingly, utilities of GAM7052 include diagnosis, prevention and treatment of diseases and clinical conditions associated with FLJ10620.

FLJ10640 (Accession NP_061896.1) is another GAM7052 target gene, herein designated TARGET GENE. FLJ10640 BINDING SITE is a target binding site found in the 5' untranslated region of mRNA encoded by FLJ10640, corresponding to a target binding site such as BINDING SITE I, BINDING SITE II or BINDING SITE III of FIG. 8. Table 4 illustrates the complementarity of the nucleotide sequences of FLJ10640 BINDING SITE, designated SEQ ID:9332, to the nucleotide sequence of GAM7052 RNA, herein designated GAM RNA, also designated SEQ ID:296.

Another function of GAM7052 is therefore inhibition of FLJ10640 (Accession NP_061896.1). Accordingly, utilities of GAM7052 include diagnosis, prevention and treatment of diseases and clinical conditions associated with FLJ10640.

FLJ10847 (Accession NP_060712.2) is another GAM7052 target gene, herein designated TARGET GENE. FLJ10847 BINDING SITE1 and FLJ10847 BINDING SITE2 are target binding sites found in untranslated regions of mRNA encoded by FLJ10847, corresponding to target binding sites such as BINDING SITE I, BINDING SITE II or BINDING SITE III of FIG. 8. Table 4 illustrates the complementarity of the nucleotide sequences of FLJ10847 BINDING SITE1 and FLJ10847 BINDING SITE2, designated SEQ ID:19185 and SEQ ID:16146 respectively, to the nucleotide sequence of GAM7052 RNA, herein designated GAM RNA, also designated SEQ ID:296.

Another function of GAM7052 is therefore inhibition of FLJ10847 (Accession NP_060712.2). Accordingly, utilities of GAM7052 include diagnosis, prevention and treatment of diseases and clinical conditions associated with FLJ10847.

FLJ10901 (Accession NP_060735.1) is another GAM7052 target gene, herein designated TARGET GENE. FLJ10901 BINDING SITE is a target binding site found in the 3' untranslated region of mRNA encoded by FLJ10901, corresponding to a target binding site such as BINDING SITE I, BINDING SITE II or BINDING SITE III of FIG. 8. Table 4 illustrates the complementarity of the nucleotide sequences of FLJ10901 BINDING SITE, designated SEQ ID:1578, to the nucleotide sequence of GAM7052 RNA, herein designated GAM RNA, also designated SEQ ID:296.

Another function of GAM7052 is therefore inhibition of FLJ10901 (Accession NP_060735.1). Accordingly, utilities of GAM7052 include diagnosis, prevention and treatment of diseases and clinical conditions associated with FLJ10901.

FLJ10922 (Accession NP_060743.1) is another GAM7052 target gene, herein designated TARGET GENE. FLJ10922 BINDING SITE is a target binding site found in the 3' untranslated region of mRNA encoded by FLJ10922, corresponding to a target binding site such as BINDING SITE I, BINDING SITE II or BINDING SITE III of FIG. 8. Table 4 illustrates the complementarity of the nucleotide sequences of FLJ10922 BINDING SITE, designated SEQ ID:857, to the nucleotide sequence of GAM7052 RNA, herein designated GAM RNA, also designated SEQ ID:296.

Another function of GAM7052 is therefore inhibition of FLJ10922 (Accession NP_060743.1). Accordingly, utilities of GAM7052 include diagnosis, prevention and treatment of diseases and clinical conditions associated with FLJ10922.

FLJ11467 (Accession NP_079239.2) is another GAM7052 target gene, herein designated TARGET GENE. FLJ11467 BINDING SITE is a target binding site found in the 3' untranslated region of mRNA encoded by FLJ11467, corresponding to a target binding site such as BINDING SITE I, BINDING SITE II or BINDING SITE III of FIG. 8. Table 4 illustrates the complementarity of the nucleotide sequences of FLJ11467 BINDING SITE, designated SEQ ID:18821, to the nucleotide sequence of GAM7052 RNA, herein designated GAM RNA, also designated SEQ ID:296.

Another function of GAM7052 is therefore inhibition of FLJ11467 (Accession NP_079239.2). Accordingly, utilities of GAM7052 include diagnosis, prevention and treatment of diseases and clinical conditions associated with FLJ11467.

FLJ11827 (Accession NP_079369.1) is another GAM7052 target gene, herein designated TARGET GENE. FLJ11827 BINDING SITE is a target binding site found in the 3' untranslated region of mRNA encoded by FLJ11827, corresponding to a target binding site such as BINDING SITE I, BINDING SITE II or BINDING SITE III of FIG. 8. Table 4 illustrates the complementarity of the nucleotide sequences of FLJ11827 BINDING SITE, designated SEQ ID:11535, to the nucleotide sequence of GAM7052 RNA, herein designated GAM RNA, also designated SEQ ID:296.

Another function of GAM7052 is therefore inhibition of FLJ11827 (Accession NP_079369.1). Accordingly, utilities of GAM7052 include diagnosis, prevention and treatment of diseases and clinical conditions associated with FLJ11827.

FLJ12363 (Accession NP_115543.1) is another GAM7052 target gene, herein designated TARGET GENE. FLJ12363 BINDING SITE is a target binding site found in the 3' untranslated region of mRNA encoded by FLJ12363, corresponding to a target binding site such as BINDING SITE I, BINDING SITE II or BINDING SITE III of FIG. 8. Table 4 illustrates the complementarity of the nucleotide sequences of FLJ12363 BINDING SITE, designated SEQ ID:8012, to the nucleotide sequence of GAM7052 RNA, herein designated GAM RNA, also designated SEQ ID:296.

Another function of GAM7052 is therefore inhibition of FLJ12363 (Accession NP_115543.1). Accordingly, utilities of GAM7052 include diagnosis, prevention and treatment of diseases and clinical conditions associated with FLJ12363.

FLJ12572 (Accession NP_075056.2) is another GAM7052 target gene, herein designated TARGET GENE. FLJ12572 BINDING SITE is a target binding site found in the 3' untranslated region of mRNA encoded by FLJ12572, corresponding to a target binding site such as BINDING SITE I, BINDING SITE II or BINDING SITE III of FIG. 8. Table 4 illustrates the complementarity of the nucleotide sequences of FLJ12572 BINDING SITE, designated SEQ ID:1348, to the nucleotide sequence of GAM7052 RNA, herein designated GAM RNA, also designated SEQ ID:296.

Another function of GAM7052 is therefore inhibition of FLJ12572 (Accession NP_075056.2). Accordingly, utilities of GAM7052 include diagnosis, prevention and treatment of diseases and clinical conditions associated with FLJ12572.

FLJ12649 (Accession XP_291344.1) is another GAM7052 target gene, herein designated TARGET GENE. FLJ12649 BINDING SITE is a target binding site found in the 3' untranslated region of mRNA encoded by FLJ12649, corresponding to a target binding site such as BINDING SITE I, BINDING SITE II or BINDING SITE III of FIG. 8. Table 4 illustrates the complementarity of the nucleotide sequences of FLJ12649 BINDING SITE, designated SEQ ID:10699, to the nucleotide sequence of GAM7052 RNA, herein designated GAM RNA, also designated SEQ ID:296.

Another function of GAM7052 is therefore inhibition of FLJ12649 (Accession XP_291344.1). Accordingly, utilities of GAM7052 include diagnosis, prevention and treatment of diseases and clinical conditions associated with FLJ12649.

FLJ12747 (Accession XP_290972.1) is another GAM7052 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:2107, to the nucleotide sequence of GAM7052 RNA, herein designated GAM RNA, also designated SEQ ID:296.

Another function of GAM7052 is therefore inhibition of FLJ12747 (Accession XP_290972.1). Accordingly, utilities of GAM7052 include diagnosis, prevention and treatment of diseases and clinical conditions associated with FLJ12747.

FLJ12787 (Accession NP_115551.1) is another GAM7052 target gene, herein designated TARGET GENE. FLJ12787 BINDING SITE is a target binding site found in the 3' untranslated region of mRNA encoded by FLJ12787, corresponding to a target binding site such as BINDING SITE I, BINDING SITE II or BINDING SITE III of FIG. 8. Table 4 illustrates the complementarity of the nucleotide sequences of FLJ12787 BINDING SITE, designated SEQ ID:9691, to the nucleotide sequence of GAM7052 RNA, herein designated GAM RNA, also designated SEQ ID:296.

Another function of GAM7052 is therefore inhibition of FLJ12787 (Accession NP_115551.1). Accordingly, utilities of GAM7052 include diagnosis, prevention and treatment of diseases and clinical conditions associated with FLJ12787.

FLJ12903 (Accession NP_073590.1) is another GAM7052 target gene, herein designated TARGET GENE. FLJ12903 BINDING SITE is a target binding site found in the 3' untranslated region of mRNA encoded by FLJ12903, corresponding to a target binding site such as BINDING SITE I, BINDING SITE II or BINDING SITE III of FIG. 8. Table 4 illustrates the complementarity of the nucleotide sequences of FLJ12903 BINDING SITE, designated SEQ ID:17852, to the nucleotide sequence of GAM7052 RNA, herein designated GAM RNA, also designated SEQ ID:296.

Another function of GAM7052 is therefore inhibition of FLJ12903 (Accession NP_073590.1). Accordingly, utilities of GAM7052 include diagnosis, prevention and treatment of diseases and clinical conditions associated with FLJ12903.

FLJ12973 (Accession NP_079184.1) is another GAM7052 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:13360, to the nucleotide sequence of GAM7052 RNA, herein designated GAM RNA, also designated SEQ ID:296.

Another function of GAM7052 is therefore inhibition of FLJ12973 (Accession NP_079184.1). Accordingly, utilities of GAM7052 include diagnosis, prevention and treatment of diseases and clinical conditions associated with FLJ12973.

FLJ13072 (Accession XP_117117.2) is another GAM7052 target gene, herein designated TARGET GENE. FLJ13072 BINDING SITE is a target binding site found in the 3' untranslated region of mRNA encoded by FLJ13072, corresponding to a target binding site such as BINDING SITE I, BINDING SITE II or BINDING SITE III of FIG. 8. Table 4 illustrates the complementarity of the nucleotide sequences of FLJ13072 BINDING SITE, designated SEQ ID:16722, to the nucleotide sequence of GAM7052 RNA, herein designated GAM RNA, also designated SEQ ID:296.

Another function of GAM7052 is therefore inhibition of FLJ13072 (Accession XP_117117.2). Accordingly, utilities of GAM7052 include diagnosis, prevention and treatment of diseases and clinical conditions associated with FLJ13072.

FLJ13171 (Accession NP_076412.1) is another GAM7052 target gene, herein designated TARGET GENE. FLJ13171 BINDING SITE is a target binding site found in the 5' untranslated region of mRNA encoded by FLJ13171, corresponding to a target binding site such as BINDING SITE I, BINDING SITE II or BINDING SITE III of FIG. 8. Table 4 illustrates the complementarity of the nucleotide sequences of FLJ13171 BINDING SITE, designated SEQ ID:10344, to the nucleotide sequence of GAM7052 RNA, herein designated GAM RNA, also designated SEQ ID:296.

Another function of GAM7052 is therefore inhibition of FLJ13171 (Accession NP_076412.1). Accordingly, utilities of GAM7052 include diagnosis, prevention and treatment of diseases and clinical conditions associated with FLJ13171.

FLJ13188 (Accession NP_071346.1) is another GAM7052 target gene, herein designated TARGET GENE. FLJ13188 BINDING SITE is a target binding site found in the 3' untranslated region of mRNA encoded by FLJ13188, corresponding to a target binding site such as BINDING SITE I, BINDING SITE II or BINDING SITE III of FIG. 8. Table 4 illustrates the complementarity of the nucleotide sequences of FLJ13188 BINDING SITE, designated SEQ ID:11689, to the nucleotide sequence of GAM7052 RNA, herein designated GAM RNA, also designated SEQ ID:296.

Another function of GAM7052 is therefore inhibition of FLJ13188 (Accession NP_071346.1). Accordingly, utilities of GAM7052 include diagnosis, prevention and treatment of diseases and clinical conditions associated with FLJ13188.

FLJ13204 (Accession NP_079037.2) is another GAM7052 target gene, herein designated TARGET GENE. FLJ13204 BINDING SITE is a target binding site found in the 3' untranslated region of mRNA encoded by FLJ13204, corresponding to a target binding site such as BINDING SITE I, BINDING SITE II or BINDING SITE III of FIG. 8. Table 4 illustrates the complementarity of the nucleotide sequences of FLJ13204 BINDING SITE, designated SEQ ID:7003, to the nucleotide sequence of GAM7052 RNA, herein designated GAM RNA, also designated SEQ ID:296.

Another function of GAM7052 is therefore inhibition of FLJ13204 (Accession NP_079037.2). Accordingly, utilities of GAM7052 include diagnosis, prevention and treatment of diseases and clinical conditions associated with FLJ13204.

FLJ14442 (Accession NP_116174.1) is another GAM7052 target gene, herein designated TARGET GENE. FLJ14442 BINDING SITE is a target binding site found in the 3' untranslated region of mRNA encoded by FLJ14442, corresponding to a target binding site such as BINDING SITE I, BINDING SITE II or BINDING SITE III of FIG. 8. Table 4 illustrates the complementarity of the nucleotide sequences of FLJ14442 BINDING SITE, designated SEQ ID:9691, to the nucleotide sequence of GAM7052 RNA, herein designated GAM RNA, also designated SEQ ID:296.

Another function of GAM7052 is therefore inhibition of FLJ14442 (Accession NP_116174.1). Accordingly, utilities of GAM7052 include diagnosis, prevention and treatment of diseases and clinical conditions associated with FLJ14442.

FLJ14803 (Accession NP_116231.1) is another GAM7052 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:7216, to the nucleotide sequence of GAM7052 RNA, herein designated GAM RNA, also designated SEQ ID:296.

Another function of GAM7052 is therefore inhibition of FLJ14803 (Accession NP_116231.1). Accordingly, utilities of GAM7052 include diagnosis, prevention and treatment of diseases and clinical conditions associated with FLJ14803.

FLJ20045 (Accession NP_060108.1) is another GAM7052 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:5969, to the nucleotide sequence of GAM7052 RNA, herein designated GAM RNA, also designated SEQ ID:296.

Another function of GAM7052 is therefore inhibition of FLJ20045 (Accession NP_060108.1). Accordingly, utilities of GAM7052 include diagnosis, prevention and treatment of diseases and clinical conditions associated with FLJ20045.

FLJ20079 (Accession NP_060126.1) is another GAM7052 target gene, herein designated TARGET GENE. FLJ20079 BINDING SITE is a target binding site found in the 3' untranslated region of mRNA encoded by FLJ20079, corresponding to a target binding site such as BINDING SITE I, BINDING SITE II or BINDING SITE III of FIG. 8. Table 4 illustrates the complementarity of the nucleotide sequences of FLJ20079 BINDING SITE, designated SEQ ID:17687, to the nucleotide sequence of GAM7052 RNA, herein designated GAM RNA, also designated SEQ ID:296.

Another function of GAM7052 is therefore inhibition of FLJ20079 (Accession NP_060126.1). Accordingly, utilities of GAM7052 include diagnosis, prevention and treatment of diseases and clinical conditions associated with FLJ20079.

FLJ20136 (Accession NP_060154.1) is another GAM7052 target gene, herein designated TARGET GENE. FLJ20136 BINDING SITE is a target binding site found in the 3' untranslated region of mRNA encoded by FLJ20136, corresponding to a target binding site such as BINDING SITE I, BINDING SITE II or BINDING SITE III of FIG. 8. Table 4 illustrates the complementarity of the nucleotide sequences of FLJ20136 BINDING SITE, designated SEQ ID:9023, to the nucleotide sequence of GAM7052 RNA, herein designated GAM RNA, also designated SEQ ID:296.

Another function of GAM7052 is therefore inhibition of FLJ20136 (Accession NP_060154.1). Accordingly, utilities of GAM7052 include diagnosis, prevention and treatment of diseases and clinical conditions associated with FLJ20136.

FLJ20245 (Accession NP_060193.1) is another GAM7052 target gene, herein designated TARGET GENE. FLJ20245 BINDING SITE is a target binding site found in the 3' untranslated region of mRNA encoded by FLJ20245, corresponding to a target binding site such as BINDING SITE I, BINDING SITE II or BINDING SITE III of FIG. 8. Table 4 illustrates the complementarity of the nucleotide sequences of FLJ20245 BINDING SITE, designated SEQ ID:12481, to the nucleotide sequence of GAM7052 RNA, herein designated GAM RNA, also designated SEQ ID:296.

Another function of GAM7052 is therefore inhibition of FLJ20245 (Accession NP_060193.1). Accordingly, utilities of GAM7052 include diagnosis, prevention and treatment of diseases and clinical conditions associated with FLJ20245.

FLJ20276 (Accession NP_060208.1) is another GAM7052 target gene, herein designated TARGET GENE. FLJ20276 BINDING SITE is a target binding site found in the 3' untranslated region of mRNA encoded by FLJ20276, corresponding to a target binding site such as BINDING SITE I, BINDING SITE II or BINDING SITE III of FIG. 8. Table 4 illustrates the complementarity of the nucleotide sequences of FLJ20276 BINDING SITE, designated SEQ ID:14443, to the nucleotide sequence of GAM7052 RNA, herein designated GAM RNA, also designated SEQ ID:296.

Another function of GAM7052 is therefore inhibition of FLJ20276 (Accession NP_060208.1). Accordingly, utilities of GAM7052 include diagnosis, prevention and treatment of diseases and clinical conditions associated with FLJ20276.

FLJ20507 (Accession NP_060319.1) is another GAM7052 target gene, herein designated TARGET GENE. FLJ20507 BINDING SITE1 and FLJ20507 BINDING SITE2 are target binding sites found in untranslated regions of mRNA encoded by FLJ20507, corresponding to target binding sites such as BINDING SITE I, BINDING SITE II or BINDING SITE III of FIG. 8. Table 4 illustrates the complementarity of the nucleotide sequences of FLJ20507 BINDING SITE1 and FLJ20507 BINDING SITE2, designated SEQ ID:16723 and SEQ ID:3913 respectively, to the nucleotide sequence of GAM7052 RNA, herein designated GAM RNA, also designated SEQ ID:296.

Another function of GAM7052 is therefore inhibition of FLJ20507 (Accession NP_060319.1). Accordingly, utilities of GAM7052 include diagnosis, prevention and treatment of diseases and clinical conditions associated with FLJ20507.

FLJ20511 (Accession NP_060323.1) is another GAM7052 target gene, herein designated TARGET GENE. FLJ20511 BINDING SITE is a target binding site found in the 3' untranslated region of mRNA encoded by FLJ20511, corresponding to a target binding site such as BINDING SITE I, BINDING SITE II or BINDING SITE III of FIG. 8. Table 4 illustrates the complementarity of the nucleotide sequences of FLJ20511 BINDING SITE, designated SEQ ID:9847, to the nucleotide sequence of GAM7052 RNA, herein designated GAM RNA, also designated SEQ ID:296.

Another function of GAM7052 is therefore inhibition of FLJ20511 (Accession NP_060323.1). Accordingly, utilities of GAM7052 include diagnosis, prevention and treatment of diseases and clinical conditions associated with FLJ20511.

FLJ21865 (Accession NP_073596.1) is another GAM7052 target gene, herein designated TARGET GENE. FLJ21865 BINDING SITE is a target binding site found in the 3' untranslated region of mRNA encoded by FLJ21865, corresponding to a target binding site such as BINDING SITE I, BINDING SITE II or BINDING SITE III of FIG. 8. Table 4 illustrates the complementarity of the nucleotide sequences of FLJ21865 BINDING SITE, designated SEQ ID:3914, to the nucleotide sequence of GAM7052 RNA, herein designated GAM RNA, also designated SEQ ID:296.

Another function of GAM7052 is therefore inhibition of FLJ21865 (Accession NP_073596.1). Accordingly, utilities of GAM7052 include diagnosis, prevention and treatment of diseases and clinical conditions associated with FLJ21865.

FLJ22531 (Accession NP_078926.2) is another GAM7052 target gene, herein designated TARGET GENE. FLJ22531 BINDING SITE is a target binding site found in the 5' untranslated region of mRNA encoded by FLJ22531, corresponding to a target binding site such as BINDING SITE I, BINDING SITE II or BINDING SITE III of FIG. 8. Table 4 illustrates the complementarity of the nucleotide sequences of FLJ22531 BINDING SITE, designated SEQ ID:7027, to the nucleotide sequence of GAM7052 RNA, herein designated GAM RNA, also designated SEQ ID:296.

Another function of GAM7052 is therefore inhibition of FLJ22531 (Accession NP_078926.2). Accordingly, utilities of GAM7052 include diagnosis, prevention and treatment of diseases and clinical conditions associated with FLJ22531.

FLJ22593 (Accession NP_078979.1) is another GAM7052 target gene, herein designated TARGET GENE. FLJ22593 BINDING SITE is a target binding site found in the 5' untranslated region of mRNA encoded by FLJ22593, corresponding to a target binding site such as BINDING SITE I, BINDING SITE II or BINDING SITE III of FIG. 8. Table 4 illustrates the complementarity of the nucleotide sequences of FLJ22593 BINDING SITE, designated SEQ ID:8875, to the nucleotide sequence of GAM7052 RNA, herein designated GAM RNA, also designated SEQ ID:296.

Another function of GAM7052 is therefore inhibition of FLJ22593 (Accession NP_078979.1). Accordingly, utilities of GAM7052 include diagnosis, prevention and treatment of diseases and clinical conditions associated with FLJ22593.

FLJ22679 (Accession NP_115603.1) is another GAM7052 target gene, herein designated TARGET GENE. FLJ22679 BINDING SITE is a target binding site found in the 3' untranslated region of multiple transcripts of mRNA encoded by FLJ22679, corresponding to a target binding site such as BINDING SITE I, BINDING SITE II or BINDING SITE III of FIG. 8. Table 4 illustrates the complementarity of the nucleotide sequences of FLJ22679 BINDING SITE, designated SEQ ID:19747, to the nucleotide sequence of GAM7052 RNA, herein designated GAM RNA, also designated SEQ ID:296.

Another function of GAM7052 is therefore inhibition of FLJ22679 (Accession NP_115603.1). Accordingly, utilities of GAM7052 include diagnosis, prevention and treatment of diseases and clinical conditions associated with FLJ22679.

FLJ22679 (Accession NP_060168.1) is another GAM7052 target gene, herein designated TARGET GENE. FLJ22679 BINDING SITE is a target binding site found in the 3' untranslated region of multiple transcripts of mRNA encoded by FLJ22679, corresponding to a target binding site such as BINDING SITE I, BINDING SITE II or BINDING SITE III of FIG. 8. Table 4 illustrates the complementarity of the nucleotide sequences of FLJ22679 BINDING SITE, designated SEQ ID:19747, to the nucleotide sequence of GAM7052 RNA, herein designated GAM RNA, also designated SEQ ID:296.

Another function of GAM7052 is therefore inhibition of FLJ22679 (Accession NP_060168.1). Accordingly, utilities of GAM7052 include diagnosis, prevention and treatment of diseases and clinical conditions associated with FLJ22679.

FLJ22794 (Accession NP_071357.1) is another GAM7052 target gene, herein designated TARGET GENE. FLJ22794 BINDING SITE is a target binding site found in the 3' untranslated region of mRNA encoded by FLJ22794, corresponding to a target binding site such as BINDING SITE I, BINDING SITE II or BINDING SITE III of FIG. 8. Table 4 illustrates the complementarity of the nucleotide sequences of FLJ22794 BINDING SITE, designated SEQ ID:9450, to the nucleotide sequence of GAM7052 RNA, herein designated GAM RNA, also designated SEQ ID:296.

Another function of GAM7052 is therefore inhibition of FLJ22794 (Accession NP_071357.1). Accordingly, utilities of GAM7052 include diagnosis, prevention and treatment of diseases and clinical conditions associated with FLJ22794.

FLJ22965 (Accession NP_071384.1) is another GAM7052 target gene, herein designated TARGET GENE. FLJ22965 BINDING SITE is a target binding site found in the 3' untranslated region of mRNA encoded by FLJ22965, corresponding to a target binding site such as BINDING SITE I, BINDING SITE II or BINDING SITE III of FIG. 8. Table 4 illustrates the complementarity of the nucleotide sequences of FLJ22965 BINDING SITE, designated SEQ ID:2108, to the nucleotide sequence of GAM7052 RNA, herein designated GAM RNA, also designated SEQ ID:296.

Another function of GAM7052 is therefore inhibition of FLJ22965 (Accession NP_071384.1). Accordingly, utilities of GAM7052 include diagnosis, prevention and treatment of diseases and clinical conditions associated with FLJ22965.

FLJ23024 (Accession NP_079212.1) is another GAM7052 target gene, herein designated TARGET GENE. FLJ23024 BINDING SITE is a target binding site found in the 3' untranslated region of mRNA encoded by FLJ23024, corresponding to a target binding site such as BINDING SITE I, BINDING SITE II or BINDING SITE III of FIG. 8. Table 4 illustrates the complementarity of the nucleotide sequences of FLJ23024 BINDING SITE, designated SEQ ID:14741, to the nucleotide sequence of GAM7052 RNA, herein designated GAM RNA, also designated SEQ ID:296.

Another function of GAM7052 is therefore inhibition of FLJ23024 (Accession NP_079212.1). Accordingly, utilities of GAM7052 include diagnosis, prevention and treatment of diseases and clinical conditions associated with FLJ23024.

FLJ23151 (Accession NP_079048.2) is another GAM7052 target gene, herein designated TARGET GENE. FLJ23151 BINDING SITE is a target binding site found in the 5' untranslated region of mRNA encoded by FLJ23151, corresponding to a target binding site such as BINDING SITE I, BINDING SITE II or BINDING SITE III of FIG. 8. Table 4 illustrates the complementarity of the nucleotide sequences of FLJ23151 BINDING SITE, designated SEQ ID:6505, to the nucleotide sequence of GAM7052 RNA, herein designated GAM RNA, also designated SEQ ID:296.

Another function of GAM7052 is therefore inhibition of FLJ23151 (Accession NP_079048.2). Accordingly, utilities of GAM7052 include diagnosis, prevention and treatment of diseases and clinical conditions associated with FLJ23151.

FLJ23392 (Accession NP_079060.1) is another GAM7052 target gene, herein designated TARGET GENE. FLJ23392 BINDING SITE is a target binding site found in the 3' untranslated region of mRNA encoded by FLJ23392, corresponding to a target binding site such as BINDING SITE I, BINDING SITE II or BINDING SITE III of FIG. 8. Table 4 illustrates the complementarity of the nucleotide sequences of FLJ23392 BINDING SITE, designated SEQ ID:18508, to the nucleotide sequence of GAM7052 RNA, herein designated GAM RNA, also designated SEQ ID:296.

Another function of GAM7052 is therefore inhibition of FLJ23392 (Accession NP_079060.1). Accordingly, utilities of GAM7052 include diagnosis, prevention and treatment of diseases and clinical conditions associated with FLJ23392.

FLJ23416 (Accession NP_115614.1) is another GAM7052 target gene, herein designated TARGET GENE. FLJ23416 BINDING SITE is a target binding site found in the 3' untranslated region of mRNA encoded by FLJ23416, corresponding to a target binding site such as BINDING SITE I, BINDING SITE II or BINDING SITE III of FIG. 8. Table 4 illustrates the complementarity of the nucleotide sequences of FLJ23416 BINDING SITE, designated SEQ ID:1770, to the nucleotide sequence of GAM7052 RNA, herein designated GAM RNA, also designated SEQ ID:296.

Another function of GAM7052 is therefore inhibition of FLJ23416 (Accession NP_115614.1). Accordingly, utilities of GAM7052 include diagnosis, prevention and treatment of diseases and clinical conditions associated with FLJ23416.

FLJ23556 (Accession NP_079156.1) is another GAM7052 target gene, herein designated TARGET GENE. FLJ23556 BINDING SITE is a target binding site found in the 3' untranslated region of mRNA encoded by FLJ23556, corresponding to a target binding site such as BINDING SITE I, BINDING SITE II or BINDING SITE III of FIG. 8. Table 4 illustrates the complementarity of the nucleotide sequences of FLJ23556 BINDING SITE, designated SEQ ID:19274, to the nucleotide sequence of GAM7052 RNA, herein designated GAM RNA, also designated SEQ ID:296.

Another function of GAM7052 is therefore inhibition of FLJ23556 (Accession NP_079156.1). Accordingly, utilities of GAM7052 include diagnosis, prevention and treatment of diseases and clinical conditions associated with FLJ23556.

FLJ23563 (Accession XP_041701.4) is another GAM7052 target gene, herein designated TARGET GENE.

FLJ23563 BINDING SITE is a target binding site found in the 3' untranslated region of mRNA encoded by FLJ23563, corresponding to a target binding site such as BINDING SITE I, BINDING SITE II or BINDING SITE III of FIG. 8. Table 4 illustrates the complementarity of the nucleotide sequences of FLJ23563 BINDING SITE, designated SEQ ID:3638, to the nucleotide sequence of GAM7052 RNA, herein designated GAM RNA, also designated SEQ ID:296.

Another function of GAM7052 is therefore inhibition of FLJ23563 (Accession XP_041701.4). Accordingly, utilities of GAM7052 include diagnosis, prevention and treatment of diseases and clinical conditions associated with FLJ23563.

FLJ25033 (Accession NP_689779.1) is another GAM7052 target gene, herein designated TARGET GENE. FLJ25033 BINDING SITE is a target binding site found in the 3' untranslated region of mRNA encoded by FLJ25033, corresponding to a target binding site such as BINDING SITE I, BINDING SITE II or BINDING SITE III of FIG. 8. Table 4 illustrates the complementarity of the nucleotide sequences of FLJ25033 BINDING SITE, designated SEQ ID:1524, to the nucleotide sequence of GAM7052 RNA, herein designated GAM RNA, also designated SEQ ID:296.

Another function of GAM7052 is therefore inhibition of FLJ25033 (Accession NP_689779.1). Accordingly, utilities of GAM7052 include diagnosis, prevention and treatment of diseases and clinical conditions associated with FLJ25033.

FLJ25067 (Accession NP_689717.2) is another GAM7052 target gene, herein designated TARGET GENE. FLJ25067 BINDING SITE is a target binding site found in the 3' untranslated region of mRNA encoded by FLJ25067, corresponding to a target binding site such as BINDING SITE I, BINDING SITE II or BINDING SITE III of FIG. 8. Table 4 illustrates the complementarity of the nucleotide sequences of FLJ25067 BINDING SITE, designated SEQ ID:16676, to the nucleotide sequence of GAM7052 RNA, herein designated GAM RNA, also designated SEQ ID:296.

Another function of GAM7052 is therefore inhibition of FLJ25067 (Accession NP_689717.2). Accordingly, utilities of GAM7052 include diagnosis, prevention and treatment of diseases and clinical conditions associated with FLJ25067.

FLJ25429 (Accession NP_689589.1) is another GAM7052 target gene, herein designated TARGET GENE. FLJ25429 BINDING SITE is a target binding site found in the 3' untranslated region of mRNA encoded by FLJ25429, corresponding to a target binding site such as BINDING SITE I, BINDING SITE II or BINDING SITE III of FIG. 8. Table 4 illustrates the complementarity of the nucleotide sequences of FLJ25429 BINDING SITE, designated SEQ ID:12652, to the nucleotide sequence of GAM7052 RNA, herein designated GAM RNA, also designated SEQ ID:296.

Another function of GAM7052 is therefore inhibition of FLJ25429 (Accession NP_689589.1). Accordingly, utilities of GAM7052 include diagnosis, prevention and treatment of diseases and clinical conditions associated with FLJ25429.

FLJ25795 (Accession NP_689633.1) is another GAM7052 target gene, herein designated TARGET GENE. FLJ25795 BINDING SITE is a target binding site found in the 3' untranslated region of mRNA encoded by FLJ25795, corresponding to a target binding site such as BINDING SITE I, BINDING SITE II or BINDING SITE III of FIG. 8. Table 4 illustrates the complementarity of the nucleotide sequences of FLJ25795 BINDING SITE, designated SEQ ID:11825, to the nucleotide sequence of GAM7052 RNA, herein designated GAM RNA, also designated SEQ ID:296.

Another function of GAM7052 is therefore inhibition of FLJ25795 (Accession NP_689633.1). Accordingly, utilities of GAM7052 include diagnosis, prevention and treatment of diseases and clinical conditions associated with FLJ25795.

FLJ30507 (Accession NP_694555.1) is another GAM7052 target gene, herein designated TARGET GENE. FLJ30507 BINDING SITE is a target binding site found in the 5' untranslated region of mRNA encoded by FLJ30507, corresponding to a target binding site such as BINDING SITE I, BINDING SITE II or BINDING SITE III of FIG. 8. Table 4 illustrates the complementarity of the nucleotide sequences of FLJ30507 BINDING SITE, designated SEQ ID:6534, to the nucleotide sequence of GAM7052 RNA, herein designated GAM RNA, also designated SEQ ID:296.

Another function of GAM7052 is therefore inhibition of FLJ30507 (Accession NP_694555.1). Accordingly, utilities of GAM7052 include diagnosis, prevention and treatment of diseases and clinical conditions associated with FLJ30507.

FLJ30532 (Accession NP_653325.1) is another GAM7052 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:4754, to the nucleotide sequence of GAM7052 RNA, herein designated GAM RNA, also designated SEQ ID:296.

Another function of GAM7052 is therefore inhibition of FLJ30532 (Accession NP_653325.1). Accordingly, utilities of GAM7052 include diagnosis, prevention and treatment of diseases and clinical conditions associated with FLJ30532.

FLJ31139 (Accession NP_775928.1) is another GAM7052 target gene, herein designated TARGET GENE. FLJ31139 BINDING SITE is a target binding site found in the 3' untranslated region of mRNA encoded by FLJ31139, corresponding to a target binding site such as BINDING SITE I, BINDING SITE II or BINDING SITE III of FIG. 8. Table 4 illustrates the complementarity of the nucleotide sequences of FLJ31139 BINDING SITE, designated SEQ ID:16723, to the nucleotide sequence of GAM7052 RNA, herein designated GAM RNA, also designated SEQ ID:296.

Another function of GAM7052 is therefore inhibition of FLJ31139 (Accession NP_775928.1). Accordingly, utilities of GAM7052 include diagnosis, prevention and treatment of diseases and clinical conditions associated with FLJ31139.

FLJ31338 (Accession NP_689682.1) is another GAM7052 target gene, herein designated TARGET GENE. FLJ31338 BINDING SITE is a target binding site found in the 3' untranslated region of mRNA encoded by FLJ31338, corresponding to a target binding site such as BINDING SITE I, BINDING SITE II or BINDING SITE III of FIG. 8. Table 4 illustrates the complementarity of the nucleotide sequences of FLJ31338 BINDING SITE, designated SEQ ID:13983, to the nucleotide sequence of GAM7052 RNA, herein designated GAM RNA, also designated SEQ ID:296.

Another function of GAM7052 is therefore inhibition of FLJ31338 (Accession NP_689682.1). Accordingly, utilities of GAM7052 include diagnosis, prevention and treatment of diseases and clinical conditions associated with FLJ31338.

FLJ31393 (Accession NP_694569.1) is another GAM7052 target gene, herein designated TARGET GENE. FLJ31393 BINDING SITE is a target binding site found in the 5' untranslated region of mRNA encoded by FLJ31393, corresponding to a target binding site such as BINDING SITE I, BINDING SITE II or BINDING SITE III of FIG. 8. Table 4 illustrates the complementarity of the nucleotide sequences of FLJ31393 BINDING SITE, designated SEQ ID:4686, to the nucleotide sequence of GAM7052 RNA, herein designated GAM RNA, also designated SEQ ID:296.

Another function of GAM7052 is therefore inhibition of FLJ31393 (Accession NP_694569.1). Accordingly, utilities of GAM7052 include diagnosis, prevention and treatment of diseases and clinical conditions associated with FLJ31393.

FLJ31958 (Accession NP_694575.1) is another GAM7052 target gene, herein designated TARGET GENE. FLJ31958 BINDING SITE is a target binding site found in the 3' untranslated region of mRNA encoded by FLJ31958, corresponding to a target binding site such as BINDING SITE I, BINDING SITE II or BINDING SITE III of FIG. 8. Table 4 illustrates the complementarity of the nucleotide sequences of FLJ31958 BINDING SITE, designated SEQ ID:18462, to the nucleotide sequence of GAM7052 RNA, herein designated GAM RNA, also designated SEQ ID:296.

Another function of GAM7052 is therefore inhibition of FLJ31958 (Accession NP_694575.1). Accordingly, utilities of GAM7052 include diagnosis, prevention and treatment of diseases and clinical conditions associated with FLJ31958.

FLJ32096 (Accession NP_776156.1) is another GAM7052 target gene, herein designated TARGET GENE. FLJ32096 BINDING SITE1 and FLJ32096 BINDING SITE2 are target binding sites found in untranslated regions of mRNA encoded by FLJ32096, corresponding to target binding sites such as BINDING SITE I, BINDING SITE II or BINDING SITE III of FIG. 8. Table 4 illustrates the complementarity of the nucleotide sequences of FLJ32096 BINDING SITE1 and FLJ32096 BINDING SITE2, designated SEQ ID:12527 and SEQ ID:1832 respectively, to the nucleotide sequence of GAM7052 RNA, herein designated GAM RNA, also designated SEQ ID:296.

Another function of GAM7052 is therefore inhibition of FLJ32096 (Accession NP_776156.1). Accordingly, utilities of GAM7052 include diagnosis, prevention and treatment of diseases and clinical conditions associated with FLJ32096.

FLJ32130 (Accession NP_689671.2) is another GAM7052 target gene, herein designated TARGET GENE. FLJ32130 BINDING SITE is a target binding site found in the 3' untranslated region of mRNA encoded by FLJ32130, corresponding to a target binding site such as BINDING SITE I, BINDING SITE II or BINDING SITE III of FIG. 8. Table 4 illustrates the complementarity of the nucleotide sequences of FLJ32130 BINDING SITE, designated SEQ ID:14068, to the nucleotide sequence of GAM7052 RNA, herein designated GAM RNA, also designated SEQ ID:296.

Another function of GAM7052 is therefore inhibition of FLJ32130 (Accession NP_689671.2). Accordingly, utilities of GAM7052 include diagnosis, prevention and treatment of diseases and clinical conditions associated with FLJ32130.

FLJ32803 (Accession NP_694584.1) is another GAM7052 target gene, herein designated TARGET GENE. FLJ32803 BINDING SITE is a target binding site found in the 3' untranslated region of mRNA encoded by FLJ32803, corresponding to a target binding site such as BINDING SITE I, BINDING SITE II or BINDING SITE III of FIG. 8. Table 4 illustrates the complementarity of the nucleotide sequences of FLJ32803 BINDING SITE, designated SEQ ID:702, to the nucleotide sequence of GAM7052 RNA, herein designated GAM RNA, also designated SEQ ID:296.

Another function of GAM7052 is therefore inhibition of FLJ32803 (Accession NP_694584.1). Accordingly, utilities of GAM7052 include diagnosis, prevention and treatment of diseases and clinical conditions associated with FLJ32803.

FLJ32865 (Accession NP_653214.1) is another GAM7052 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:16885, to the nucleotide sequence of GAM7052 RNA, herein designated GAM RNA, also designated SEQ ID:296.

Another function of GAM7052 is therefore inhibition of FLJ32865 (Accession NP_653214.1). Accordingly, utilities of GAM7052 include diagnosis, prevention and treatment of diseases and clinical conditions associated with FLJ32865.

FLJ33655 (Accession NP_775912.1) is another GAM7052 target gene, herein designated TARGET GENE. FLJ33655 BINDING SITE is a target binding site found in the 3' untranslated region of mRNA encoded by FLJ33655, corresponding to a target binding site such as BINDING SITE I, BINDING SITE II or BINDING SITE III of FIG. 8. Table 4 illustrates the complementarity of the nucleotide sequences of FLJ33655 BINDING SITE, designated SEQ ID:19276, to the nucleotide sequence of GAM7052 RNA, herein designated GAM RNA, also designated SEQ ID:296.

Another function of GAM7052 is therefore inhibition of FLJ33655 (Accession NP_775912.1). Accordingly, utilities of GAM7052 include diagnosis, prevention and treatment of diseases and clinical conditions associated with FLJ33655.

FLJ33814 (Accession NP_775781.1) is another GAM7052 target gene, herein designated TARGET GENE. FLJ33814 BINDING SITE is a target binding site found in the 3' untranslated region of mRNA encoded by FLJ33814, corresponding to a target binding site such as BINDING SITE I, BINDING SITE II or BINDING SITE III of FIG. 8. Table 4 illustrates the complementarity of the nucleotide sequences of FLJ33814 BINDING SITE, designated SEQ ID:13609, to the nucleotide sequence of GAM7052 RNA, herein designated GAM RNA, also designated SEQ ID:296.

Another function of GAM7052 is therefore inhibition of FLJ33814 (Accession NP_775781.1). Accordingly, utilities of GAM7052 include diagnosis, prevention and treatment of diseases and clinical conditions associated with FLJ33814.

FLJ34817 (Accession NP_689516.1) is another GAM7052 target gene, herein designated TARGET GENE. FLJ34817 BINDING SITE is a target binding site found in the 5' untranslated region of mRNA encoded by FLJ34817, corresponding to a target binding site such as BINDING SITE I, BINDING SITE II or BINDING SITE III of FIG. 8. Table 4 illustrates the complementarity of the nucleotide sequences of FLJ34817 BINDING SITE, designated SEQ ID:5119, to the nucleotide sequence of GAM7052 RNA, herein designated GAM RNA, also designated SEQ ID:296.

Another function of GAM7052 is therefore inhibition of FLJ34817 (Accession NP_689516.1). Accordingly, utilities of GAM7052 include diagnosis, prevention and treatment of diseases and clinical conditions associated with FLJ34817.

FLJ34922 (Accession NP_689483.1) is another GAM7052 target gene, herein designated TARGET GENE. FLJ34922 BINDING SITE is a target binding site found in the 5' untranslated region of mRNA encoded by FLJ34922, corresponding to a target binding site such as BINDING SITE I, BINDING SITE II or BINDING SITE III of FIG. 8. Table 4 illustrates the complementarity of the nucleotide sequences of FLJ34922 BINDING SITE, designated SEQ ID:11941, to the nucleotide sequence of GAM7052 RNA, herein designated GAM RNA, also designated SEQ ID:296.

Another function of GAM7052 is therefore inhibition of FLJ34922 (Accession NP_689483.1). Accordingly, utilities of GAM7052 include diagnosis, prevention and treatment of diseases and clinical conditions associated with FLJ34922.

FLJ34969 (Accession XP_114353.1) is another GAM7052 target gene, herein designated TARGET GENE. FLJ34969 BINDING SITE is a target binding site found in the 3' untranslated region of mRNA encoded by FLJ34969, corresponding to a target binding site such as BINDING SITE I, BINDING SITE II or BINDING SITE III of FIG. 8. Table 4 illustrates the complementarity of the nucleotide sequences of FLJ34969 BINDING SITE, designated SEQ ID:6275, to the nucleotide sequence of GAM7052 RNA, herein designated GAM RNA, also designated SEQ ID:296.

Another function of GAM7052 is therefore inhibition of FLJ34969 (Accession XP_114353.1). Accordingly, utilities of GAM7052 include diagnosis, prevention and treatment of diseases and clinical conditions associated with FLJ34969.

FLJ35105 (Accession NP_689890.1) is another GAM7052 target gene, herein designated TARGET GENE. FLJ35105 BINDING SITE is a target binding site found in the 5' untranslated region of mRNA encoded by FLJ35105, corresponding to a target binding site such as BINDING SITE I, BINDING SITE II or BINDING SITE III of FIG. 8. Table 4 illustrates the complementarity of the nucleotide sequences of FLJ35105 BINDING SITE, designated SEQ ID:6938, to the nucleotide sequence of GAM7052 RNA, herein designated GAM RNA, also designated SEQ ID:296.

Another function of GAM7052 is therefore inhibition of FLJ35105 (Accession NP_689890.1). Accordingly, utilities of GAM7052 include diagnosis, prevention and treatment of diseases and clinical conditions associated with FLJ35105.

FLJ36445 (Accession NP_694965.1) is another GAM7052 target gene, herein designated TARGET GENE. FLJ36445 BINDING SITE is a target binding site found in the 3' untranslated region of mRNA encoded by FLJ36445, corresponding to a target binding site such as BINDING SITE I, BINDING SITE II or BINDING SITE III of FIG. 8. Table 4 illustrates the complementarity of the nucleotide sequences of FLJ36445 BINDING SITE, designated SEQ ID:9024, to the nucleotide sequence of GAM7052 RNA, herein designated GAM RNA, also designated SEQ ID:296.

Another function of GAM7052 is therefore inhibition of FLJ36445 (Accession NP_694965.1). Accordingly, utilities of GAM7052 include diagnosis, prevention and treatment of diseases and clinical conditions associated with FLJ36445.

FLJ37078 (Accession NP_694588.1) is another GAM7052 target gene, herein designated TARGET GENE. FLJ37078 BINDING SITE is a target binding site found in the 5' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:15855, to the nucleotide sequence of GAM7052 RNA, herein designated GAM RNA, also designated SEQ ID:296.

Another function of GAM7052 is therefore inhibition of FLJ37078 (Accession NP_694588.1). Accordingly, utilities of GAM7052 include diagnosis, prevention and treatment of diseases and clinical conditions associated with FLJ37078.

FLJ37433 (Accession NP_848612.1) is another GAM7052 target gene, herein designated TARGET GENE. FLJ37433 BINDING SITE is a target binding site found in the 3' untranslated region of mRNA encoded by FLJ37433, corresponding to a target binding site such as BINDING SITE I, BINDING SITE II or BINDING SITE III of FIG. 8. Table 4 illustrates the complementarity of the nucleotide sequences of FLJ37433 BINDING SITE, designated SEQ ID:4384, to the nucleotide sequence of GAM7052 RNA, herein designated GAM RNA, also designated SEQ ID:296.

Another function of GAM7052 is therefore inhibition of FLJ37433 (Accession NP_848612.1). Accordingly, utilities of GAM7052 include diagnosis, prevention and treatment of diseases and clinical conditions associated with FLJ37433.

FLJ37543 (Accession NP_775938.1) is another GAM7052 target gene, herein designated TARGET GENE. FLJ37543 BINDING SITE is a target binding site found in the 3' untranslated region of mRNA encoded by FLJ37543, corresponding to a target binding site such as BINDING SITE I, BINDING SITE II or BINDING SITE III of FIG. 8. Table 4 illustrates the complementarity of the nucleotide sequences of FLJ37543 BINDING SITE, designated SEQ ID:17646, to the nucleotide sequence of GAM7052 RNA, herein designated GAM RNA, also designated SEQ ID:296.

Another function of GAM7052 is therefore inhibition of FLJ37543 (Accession NP_775938.1). Accordingly, utilities of GAM7052 include diagnosis, prevention and treatment of diseases and clinical conditions associated with FLJ37543.

FLJ38101 (Accession NP_694993.2) is another GAM7052 target gene, herein designated TARGET GENE. FLJ38101 BINDING SITE is a target binding site found in the 3' untranslated region of mRNA encoded by FLJ38101, corresponding to a target binding site such as BINDING SITE I, BINDING SITE II or BINDING SITE III of FIG. 8. Table 4 illustrates the complementarity of the nucleotide sequences of FLJ38101 BINDING SITE, designated SEQ ID:1941, to the nucleotide sequence of GAM7052 RNA, herein designated GAM RNA, also designated SEQ ID:296.

Another function of GAM7052 is therefore inhibition of FLJ38101 (Accession NP_694993.2). Accordingly, utilities of GAM7052 include diagnosis, prevention and treatment of diseases and clinical conditions associated with FLJ38101.

FLJ38149 (Accession XP_091919.5) is another GAM7052 target gene, herein designated TARGET GENE. FLJ38149 BINDING SITE1 and FLJ38149 BINDING SITE2 are target binding sites found in untranslated regions of mRNA encoded by FLJ38149, corresponding to target binding sites such as BINDING SITE I, BINDING SITE II or BINDING SITE III of FIG. 8. Table 4 illustrates the complementarity of the nucleotide sequences of FLJ38149 BINDING SITE1 and FLJ38149 BINDING SITE2, designated SEQ ID:15374 and SEQ ID:14014 respectively, to the nucleotide sequence of GAM7052 RNA, herein designated GAM RNA, also designated SEQ ID:296.

Another function of GAM7052 is therefore inhibition of FLJ38149 (Accession XP_091919.5). Accordingly, utilities of GAM7052 include diagnosis, prevention and treatment of diseases and clinical conditions associated with FLJ38149.

FLJ38281 (Accession NP_689814.1) is another GAM7052 target gene, herein designated TARGET GENE. FLJ38281 BINDING SITE is a target binding site found in the 3' untranslated region of mRNA encoded by FLJ38281, corresponding to a target binding site such as BINDING SITE I, BINDING SITE II or BINDING SITE III of FIG. 8. Table 4 illustrates the complementarity of the nucleotide sequences of FLJ38281 BINDING SITE, designated SEQ ID:7430, to the nucleotide sequence of GAM7052 RNA, herein designated GAM RNA, also designated SEQ ID:296.

Another function of GAM7052 is therefore inhibition of FLJ38281 (Accession NP_689814.1). Accordingly, utilities of GAM7052 include diagnosis, prevention and treatment of diseases and clinical conditions associated with FLJ38281.

FLJ38607 (Accession NP_689867.1) is another GAM7052 target gene, herein designated TARGET GENE. FLJ38607 BINDING SITE is a target binding site found in the 3' untranslated region of mRNA encoded by FLJ38607, corresponding to a target binding site such as BINDING SITE I, BINDING SITE II or BINDING SITE III of FIG. 8. Table 4 illustrates the complementarity of the nucleotide sequences of FLJ38607 BINDING SITE, designated SEQ ID:8761, to the nucleotide sequence of GAM7052 RNA, herein designated GAM RNA, also designated SEQ ID:296.

Another function of GAM7052 is therefore inhibition of FLJ38607 (Accession NP_689867.1). Accordingly, utilities of GAM7052 include diagnosis, prevention and treatment of diseases and clinical conditions associated with FLJ38607.

FLJ38716 (Accession NP_689580.1) is another GAM7052 target gene, herein designated TARGET GENE. FLJ38716 BINDING SITE is a target binding site found in the 3' untranslated region of mRNA encoded by FLJ38716, corresponding to a target binding site such as BINDING SITE I, BINDING SITE II or BINDING SITE III of FIG. 8. Table 4 illustrates the complementarity of the nucleotide sequences of FLJ38716 BINDING SITE, designated SEQ ID:10312, to the nucleotide sequence of GAM7052 RNA, herein designated GAM RNA, also designated SEQ ID:296.

Another function of GAM7052 is therefore inhibition of FLJ38716 (Accession NP_689580.1). Accordingly, utilities of GAM7052 include diagnosis, prevention and treatment of diseases and clinical conditions associated with FLJ38716.

FLJ38723 (Accession NP_776166.1) is another GAM7052 target gene, herein designated TARGET GENE. FLJ38723 BINDING SITE is a target binding site found in the 3' untranslated region of mRNA encoded by FLJ38723, corresponding to a target binding site such as BINDING SITE I, BINDING SITE II or BINDING SITE III of FIG. 8. Table 4 illustrates the complementarity of the nucleotide sequences of FLJ38723 BINDING SITE, designated SEQ ID:7203, to the nucleotide sequence of GAM7052 RNA, herein designated GAM RNA, also designated SEQ ID:296.

Another function of GAM7052 is therefore inhibition of FLJ38723 (Accession NP_776166.1). Accordingly, utilities of GAM7052 include diagnosis, prevention and treatment of diseases and clinical conditions associated with FLJ38723.

FLJ38819 (Accession NP_665872.1) is another GAM7052 target gene, herein designated TARGET GENE. FLJ38819 BINDING SITE is a target binding site found in the 3' untranslated region of mRNA encoded by FLJ38819, corresponding to a target binding site such as BINDING SITE I, BINDING SITE II or BINDING SITE III of FIG. 8. Table 4 illustrates the complementarity of the nucleotide sequences of FLJ38819 BINDING SITE, designated SEQ ID:5470, to the nucleotide sequence of GAM7052 RNA, herein designated GAM RNA, also designated SEQ ID:296.

Another function of GAM7052 is therefore inhibition of FLJ38819 (Accession NP_665872.1). Accordingly, utilities of GAM7052 include diagnosis, prevention and treatment of diseases and clinical conditions associated with FLJ38819.

FLJ38991 (Accession NP_776188.1) is another GAM7052 target gene, herein designated TARGET GENE. FLJ38991 BINDING SITE is a target binding site found in the 3' untranslated region of mRNA encoded by FLJ38991, corresponding to a target binding site such as BINDING SITE I, BINDING SITE II or BINDING SITE III of FIG. 8. Table 4 illustrates the complementarity of the nucleotide sequences of FLJ38991 BINDING SITE, designated SEQ ID:16971, to the nucleotide sequence of GAM7052 RNA, herein designated GAM RNA, also designated SEQ ID:296.

Another function of GAM7052 is therefore inhibition of FLJ38991 (Accession NP_776188.1). Accordingly, utilities of GAM7052 include diagnosis, prevention and treatment of diseases and clinical conditions associated with FLJ38991.

FLJ39058 (Accession NP_775851.1) is another GAM7052 target gene, herein designated TARGET GENE. FLJ39058 BINDING SITE is a target binding site found in the 3' untranslated region of mRNA encoded by FLJ39058, corresponding to a target binding site such as BINDING SITE I, BINDING SITE II or BINDING SITE III of FIG. 8. Table 4 illustrates the complementarity of the nucleotide sequences of FLJ39058 BINDING SITE, designated SEQ ID:4759, to the nucleotide sequence of GAM7052 RNA, herein designated GAM RNA, also designated SEQ ID:296.

Another function of GAM7052 is therefore inhibition of FLJ39058 (Accession NP_775851.1). Accordingly, utilities of GAM7052 include diagnosis, prevention and treatment of diseases and clinical conditions associated with FLJ39058.

FLJ39075 (Accession NP_689553.1) is another GAM7052 target gene, herein designated TARGET GENE. FLJ39075 BINDING SITE is a target binding site found in the 3' untranslated region of mRNA encoded by FLJ39075, corresponding to a target binding site such as BINDING SITE I, BINDING SITE II or BINDING SITE III of FIG. 8. Table 4 illustrates the complementarity of the nucleotide sequences of FLJ39075 BINDING SITE, designated SEQ ID:6073, to the nucleotide sequence of GAM7052 RNA, herein designated GAM RNA, also designated SEQ ID:296.

Another function of GAM7052 is therefore inhibition of FLJ39075 (Accession NP_689553.1). Accordingly, utilities of GAM7052 include diagnosis, prevention and treatment of diseases and clinical conditions associated with FLJ39075.

FLJ39599 (Accession NP_776164.1) is another GAM7052 target gene, herein designated TARGET GENE. FLJ39599 BINDING SITE1 and FLJ39599 BINDING SITE2 are target binding sites found in untranslated regions of mRNA encoded by FLJ39599, corresponding to target binding sites such as BINDING SITE I, BINDING SITE II or BINDING SITE III of FIG. 8. Table 4 illustrates the complementarity of the nucleotide sequences of FLJ39599 BINDING SITE1 and FLJ39599 BINDING SITE2, designated SEQ ID:3756 and SEQ ID:2431 respectively, to the nucleotide sequence of GAM7052 RNA, herein designated GAM RNA, also designated SEQ ID:296.

Another function of GAM7052 is therefore inhibition of FLJ39599 (Accession NP_776164.1). Accordingly, utilities of GAM7052 include diagnosis, prevention and treatment of diseases and clinical conditions associated with FLJ39599.

FLJ39639 (Accession XP_290687.1) is another GAM7052 target gene, herein designated TARGET GENE. FLJ39639 BINDING SITE1 and FLJ39639 BINDING SITE2 are target binding sites found in untranslated regions of mRNA encoded by FLJ39639, corresponding to target binding sites such as BINDING SITE I, BINDING SITE II or BINDING SITE III of FIG. 8. Table 4 illustrates the complementarity of the nucleotide sequences of FLJ39639 BINDING SITE1 and FLJ39639 BINDING SITE2, designated SEQ ID:14740 and SEQ ID:8837 respectively, to the nucleotide sequence of GAM7052 RNA, herein designated GAM RNA, also designated SEQ ID:296.

Another function of GAM7052 is therefore inhibition of FLJ39639 (Accession XP_290687.1). Accordingly, utilities of GAM7052 include diagnosis, prevention and treatment of diseases and clinical conditions associated with FLJ39639.

FLJ39821 (Accession NP_775971.1) is another GAM7052 target gene, herein designated TARGET GENE. FLJ39821 BINDING SITE is a target binding site found in the 3' untranslated region of mRNA encoded by FLJ39821, corresponding to a target binding site such as BINDING SITE I, BINDING SITE II or BINDING SITE III of FIG. 8. Table 4 illustrates the complementarity of the nucleotide sequences of FLJ39821 BINDING SITE, designated SEQ ID:648, to the nucleotide sequence of GAM7052 RNA, herein designated GAM RNA, also designated SEQ ID:296.

Another function of GAM7052 is therefore inhibition of FLJ39821 (Accession NP_775971.1). Accordingly, utilities of GAM7052 include diagnosis, prevention and treatment of diseases and clinical conditions associated with FLJ39821.

Fucosyltransferase 1 (galactoside 2-alpha-l-fucosyltransferase, bombay phenotype included) (FUT1, Accession NP_000139.1) is another GAM7052 target gene, herein designated TARGET GENE. FUT1 BINDING SITE1 and FUT1 BINDING SITE2 are target binding sites found in untranslated regions of mRNA encoded by FUT1, corresponding to target binding sites such as BINDING SITE I, BINDING SITE II or BINDING SITE III of FIG. 8. Table 4 illustrates the complementarity of the nucleotide sequences of FUT1 BINDING SITE1 and FUT1 BINDING SITE2, designated SEQ ID:9847 and SEQ ID:16237 respectively, to the nucleotide sequence of GAM7052 RNA, herein designated GAM RNA, also designated SEQ ID:296.

Another function of GAM7052 is therefore inhibition of Fucosyltransferase 1 (galactoside 2-alpha-l-fucosyltransferase, bombay phenotype included) (FUT1, Accession NP_000139.1). Accordingly, utilities of GAM7052 include diagnosis, prevention and treatment of diseases and clinical conditions associated with FUT1.

G2A (Accession NP_037477.1) is another GAM7052 target gene, herein designated TARGET GENE. G2A BINDING SITE is a target binding site found in the 3' untranslated region of mRNA encoded by G2A, corresponding to a target binding site such as BINDING SITE I, BINDING SITE II or BINDING SITE III of FIG. 8. Table 4 illustrates the complementarity of the nucleotide sequences of G2A BINDING SITE, designated SEQ ID:4759, to the nucleotide sequence of GAM7052 RNA, herein designated GAM RNA, also designated SEQ ID:296.

Another function of GAM7052 is therefore inhibition of G2A (Accession NP_037477.1), a gene which may mediate some of the effects of extracellular atp on insulin secretion. and therefore may be associated with Autoimmune disease. Accordingly, utilities of GAM7052 include diagnosis, prevention and treatment of Autoimmune disease, and of other diseases and clinical conditions associated with G2A.

The function of G2A and its association with various diseases and clinical conditions, has been established by previous studies, as described hereinabove with reference to GAM189.1. Glial fibrillary acidic protein (GFAP, Accession NP_002046.1) is another GAM7052 target gene, herein designated TARGET GENE. GFAP BINDING SITE is a target binding site found in the 3' untranslated region of mRNA encoded by GFAP, corresponding to a target binding site such as BINDING SITE I, BINDING SITE II or BINDING SITE III of FIG. 8. Table 4 illustrates the complementarity of the nucleotide sequences of GFAP BINDING SITE, designated SEQ ID:18063, to the nucleotide sequence of GAM7052 RNA, herein designated GAM RNA, also designated SEQ ID:296.

Another function of GAM7052 is therefore inhibition of Glial fibrillary acidic protein (GFAP, Accession NP_002046.1). Accordingly, utilities of GAM7052 include diagnosis, prevention and treatment of diseases and clinical conditions associated with GFAP.

Growth factor, augmenter of liver regeneration (erv1 homolog, s. cerevisiae) (GFER, Accession NP_005253.2) is another GAM7052 target gene, herein designated TARGET GENE. GFER BINDING SITE is a target binding site found in the 3' untranslated region of mRNA encoded by GFER, corresponding to a target binding site such as BINDING SITE I, BINDING SITE II or BINDING SITE III of FIG. 8. Table 4 illustrates the complementarity of the nucleotide sequences of GFER BINDING SITE, designated SEQ ID:1984, to the nucleotide sequence of GAM7052 RNA, herein designated GAM RNA, also designated SEQ ID:296.

Another function of GAM7052 is therefore inhibition of Growth factor, augmenter of liver regeneration (erv1 homolog, s. cerevisiae) (GFER, Accession NP_005253.2), a gene which has a function in liver regeneration and spermatogenesis (by similarity). Accordingly, utilities of GAM7052 include diagnosis, prevention and treatment of diseases and clinical conditions associated with GFER.

The function of GFER and its association with various diseases and clinical conditions, has been established by previous studies, as described hereinabove with reference to GAM385.2. Golgi associated, gamma adaptin ear containing, arf binding protein 2 (GGA2, Accession NP_619581.1) is another GAM7052 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:15132, to the nucleotide sequence of GAM7052 RNA, herein designated GAM RNA, also designated SEQ ID:296.

Another function of GAM7052 is therefore inhibition of Golgi associated, gamma adaptin ear containing, arf binding protein 2 (GGA2, Accession NP_619581.1). Accordingly, utilities of GAM7052 include diagnosis, prevention and treatment of diseases and clinical conditions associated with GGA2.

Golgi associated, gamma adaptin ear containing, arf binding protein 2 (GGA2, Accession NP_055859.1) is another GAM7052 target gene, herein designated TARGET GENE. GGA2 BINDING SITE is a target binding site found in the 3' untranslated region of multiple transcripts of mRNA encoded by GGA2, corresponding to a target binding site such as BINDING SITE I, BINDING SITE II or BINDING SITE III of FIG. 8. Table 4 illustrates the complementarity of the nucleotide sequences of GGA2 BINDING SITE, designated SEQ ID:15132, to the nucleotide sequence of GAM7052 RNA, herein designated GAM RNA, also designated SEQ ID:296.

Another function of GAM7052 is therefore inhibition of Golgi associated, gamma adaptin ear containing, arf binding protein 2 (GGA2, Accession NP_055859.1). Accordingly, utilities of GAM7052 include diagnosis, prevention and treatment of diseases and clinical conditions associated with GGA2.

Growth hormone receptor (GHR, Accession NP_000154.1) is another GAM7052 target gene, herein designated TARGET GENE. GHR BINDING SITE is a target binding site found in the 3' untranslated region of mRNA encoded by GHR, corresponding to a target binding site such as BINDING SITE I, BINDING SITE II or BINDING SITE III of FIG. 8. Table 4 illustrates the complementarity of the nucleotide sequences of GHR BINDING SITE, designated SEQ ID:2927, to the nucleotide sequence of GAM7052 RNA, herein designated GAM RNA, also designated SEQ ID:296.

Another function of GAM7052 is therefore inhibition of Growth hormone receptor (GHR, Accession NP_000154.1). Accordingly, utilities of GAM7052 include diagnosis, prevention and treatment of diseases and clinical conditions associated with GHR.

GNE (Accession NP_005467.1) is another GAM7052 target gene, herein designated TARGET GENE. GNE BINDING SITE is a target binding site found in the 3' untranslated region of mRNA encoded by GNE, corresponding to a target binding site such as BINDING SITE I, BINDING SITE II or BINDING SITE III of FIG. 8. Table 4 illustrates the complementarity of the nucleotide sequences of GNE BINDING SITE, designated SEQ ID:10442, to the nucleotide sequence of GAM7052 RNA, herein designated GAM RNA, also designated SEQ ID:296.

Another function of GAM7052 is therefore inhibition of GNE (Accession NP_005467.1), a gene which has roles in sialic acid biosynthesis and regulates cell surface sialylation. Accordingly, utilities of GAM7052 include diagnosis, prevention and treatment of diseases and clinical conditions associated with GNE.

The function of GNE and its association with various diseases and clinical conditions, has been established by previous studies, as described hereinabove with reference to GAM189.1. Guanine nucleotide binding protein (g protein), gamma 4 (GNG4, Accession NP_004476.1) is another GAM7052 target gene, herein designated TARGET GENE. GNG4 BINDING SITE is a target binding site found in the 3' untranslated region of mRNA encoded by GNG4, corresponding to a target binding site such as BINDING SITE I, BINDING SITE II or BINDING SITE III of FIG. 8. Table 4 illustrates the complementarity of the nucleotide sequences of GNG4 BINDING SITE, designated SEQ ID:16886, to the nucleotide sequence of GAM7052 RNA, herein designated GAM RNA, also designated SEQ ID:296.

Another function of GAM7052 is therefore inhibition of Guanine nucleotide binding protein (g protein), gamma 4 (GNG4, Accession NP_004476.1). Accordingly, utilities of GAM7052 include diagnosis, prevention and treatment of diseases and clinical conditions associated with GNG4.

GNPNAT1 (Accession XP_085119.1) is another GAM7052 target gene, herein designated TARGET GENE. GNPNAT1 BINDING SITE is a target binding site found in the 3' untranslated region of mRNA encoded by GNPNAT1, corresponding to a target binding site such as BINDING SITE I, BINDING SITE II or BINDING SITE III of FIG. 8. Table 4 illustrates the complementarity of the nucleotide sequences of GNPNAT1 BINDING SITE, designated SEQ ID:3158, to the nucleotide sequence of GAM7052 RNA, herein designated GAM RNA, also designated SEQ ID:296.

Another function of GAM7052 is therefore inhibition of GNPNAT1 (Accession XP_085119.1). Accordingly, utilities of GAM7052 include diagnosis, prevention and treatment of diseases and clinical conditions associated with GNPNAT1.

Golgi autoantigen, golgin subfamily a, 3 (GOLGA3, Accession NP_005886.2) is another GAM7052 target gene, herein designated TARGET GENE. GOLGA3 BINDING SITE is a target binding site found in the 3' untranslated region of multiple transcripts of mRNA encoded by GOLGA3, corresponding to a target binding site such as BINDING SITE I, BINDING SITE II or BINDING SITE III of FIG. 8. Table 4 illustrates the complementarity of the nucleotide sequences of GOLGA3 BINDING SITE, designated SEQ ID:11625, to the nucleotide sequence of GAM7052 RNA, herein designated GAM RNA, also designated SEQ ID:296.

Another function of GAM7052 is therefore inhibition of Golgi autoantigen, golgin subfamily a, 3 (GOLGA3, Accession NP_005886.2) . Accordingly, utilities of GAM7052 include diagnosis, prevention and treatment of diseases and clinical conditions associated with GOLGA3.

Glycoprotein v (platelet) (GP5, Accession NP_004479.1) is another GAM7052 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:3078, to the nucleotide sequence of GAM7052 RNA, herein designated GAM RNA, also designated SEQ ID:296.

Another function of GAM7052 is therefore inhibition of Glycoprotein v (platelet) (GP5, Accession NP_004479.1). Accordingly, utilities of GAM7052 include diagnosis, prevention and treatment of diseases and clinical conditions associated with GP5.

G protein-coupled receptor 56 (GPR56, Accession NP_005673.2) is another GAM7052 target gene, herein designated TARGET GENE. GPR56 BINDING SITE is a target binding site found in the 5' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:3347, to the nucleotide sequence of GAM7052 RNA, herein designated GAM RNA, also designated SEQ ID:296.

Another function of GAM7052 is therefore inhibition of G protein-coupled receptor 56 (GPR56, Accession NP_005673.2), a gene which transduces extracellular signals through heterotrimeric G proteins. Accordingly, utilities of GAM7052 include diagnosis, prevention and treatment of diseases and clinical conditions associated with GPR56.

The function of GPR56 and its association with various diseases and clinical conditions, has been established by previous studies, as described hereinabove with reference to GAM63.1. GR6 (Accession NP_031380.1) is another GAM7052 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:14557, to the nucleotide sequence of GAM7052 RNA, herein designated GAM RNA, also designated SEQ ID:296.

Another function of GAM7052 is therefore inhibition of GR6 (Accession NP_031380.1). Accordingly, utilities of GAM7052 include diagnosis, prevention and treatment of diseases and clinical conditions associated with GR6.

General transcription factor iie, polypeptide 1, alpha 56 kda (GTF2E1, Accession NP_005504.1) is another GAM7052 target gene, herein designated TARGET GENE. GTF2E1 BINDING SITE is a target binding site found in the 3' untranslated region of mRNA encoded by GTF2E1, corresponding to a target binding site such as BINDING SITE I, BINDING SITE II or BINDING SITE III of FIG. 8. Table 4 illustrates the complementarity of the nucleotide sequences of GTF2E1 BINDING SITE, designated SEQ ID:3032, to the nucleotide sequence of GAM7052 RNA, herein designated GAM RNA, also designated SEQ ID:296.

Another function of GAM7052 is therefore inhibition of General transcription factor iie, polypeptide 1, alpha 56 kda (GTF2E1, Accession NP_005504.1) Accordingly, utilities of GAM7052 include diagnosis, prevention and treatment of diseases and clinical conditions associated with GTF2E1.

GTPBG3 (Accession NP_116009.1) is another GAM7052 target gene, herein designated TARGET GENE.

GTPBG3 BINDING SITE1 and GTPBG3 BINDING SITE2 are target binding sites found in untranslated regions of mRNA encoded by GTPBG3, corresponding to target binding sites such as BINDING SITE I, BINDING SITE II or BINDING SITE III of FIG. 8. Table 4 illustrates the complementarity of the nucleotide sequences of GTPBG3 BINDING SITE1 and GTPBG3 BINDING SITE2, designated SEQ ID:1434 and SEQ ID:16887 respectively, to the nucleotide sequence of GAM7052 RNA, herein designated GAM RNA, also designated SEQ ID:296.

Another function of GAM7052 is therefore inhibition of GTPBG3 (Accession NP_116009.1). Accordingly, utilities of GAM7052 include diagnosis, prevention and treatment of diseases and clinical conditions associated with GTPBG3.

GYLTL1B (Accession NP_689525.1) is another GAM7052 target gene, herein designated TARGET GENE. GYLTL1B BINDING SITE is a target binding site found in the 5' untranslated region of mRNA encoded by GYLTL1B, corresponding to a target binding site such as BINDING SITE I, BINDING SITE II or BINDING SITE III of FIG. 8. Table 4 illustrates the complementarity of the nucleotide sequences of GYLTL1B BINDING SITE, designated SEQ ID:14235, to the nucleotide sequence of GAM7052 RNA, herein designated GAM RNA, also designated SEQ ID:296.

Another function of GAM7052 is therefore inhibition of GYLTL1B (Accession NP_689525.1). Accordingly, utilities of GAM7052 include diagnosis, prevention and treatment of diseases and clinical conditions associated with GYLTL1B.

H-plk (Accession NP_056936.1) is another GAM7052 target gene, herein designated TARGET GENE. H-plk BINDING SITE is a target binding site found in the 5' untranslated region of mRNA encoded by H-plk, corresponding to a target binding site such as BINDING SITE I, BINDING SITE II or BINDING SITE III of FIG. 8. Table 4 illustrates the complementarity of the nucleotide sequences of H-plk BINDING SITE, designated SEQ ID:5790, to the nucleotide sequence of GAM7052 RNA, herein designated GAM RNA, also designated SEQ ID:296.

Another function of GAM7052 is therefore inhibition of H-plk (Accession NP_056936.1). Accordingly, utilities of GAM7052 include diagnosis, prevention and treatment of diseases and clinical conditions associated with H-plk.

H2AV (Accession NP_619541.1) is another GAM7052 target gene, herein designated TARGET GENE. H2AV BINDING SITE1 and H2AV BINDING SITE2 are target binding sites found in untranslated regions of multiple transcripts of mRNA encoded by H2AV, corresponding to target binding sites such as BINDING SITE I, BINDING SITE II or BINDING SITE III of FIG. 8. Table 4 illustrates the complementarity of the nucleotide sequences of H2AV BINDING SITE1 and H2AV BINDING SITE2, designated SEQ ID:9267 and SEQ ID:17174 respectively, to the nucleotide sequence of GAM7052 RNA, herein designated GAM RNA, also designated SEQ ID:296.

Another function of GAM7052 is therefore inhibition of H2AV (Accession NP_619541.1). Accordingly, utilities of GAM7052 include diagnosis, prevention and treatment of diseases and clinical conditions associated with H2AV.

H63 (Accession NP_816929.1) is another GAM7052 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:1187, to the nucleotide sequence of GAM7052 RNA, herein designated GAM RNA, also designated SEQ ID:296.

Another function of GAM7052 is therefore inhibition of H63 (Accession NP_816929.1). Accordingly, utilities of GAM7052 include diagnosis, prevention and treatment of diseases and clinical conditions associated with H63.

H63 (Accession NP_612432.2) is another GAM7052 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:1187, to the nucleotide sequence of GAM7052 RNA, herein designated GAM RNA, also designated SEQ ID:296.

Another function of GAM7052 is therefore inhibition of H63 (Accession NP_612432.2). Accordingly, utilities of GAM7052 include diagnosis, prevention and treatment of diseases and clinical conditions associated with H63.

Hepatitis a virus cellular receptor 2 (HAVCR2, Accession NP_116171.2) is another GAM7052 target gene, herein designated TARGET GENE. HAVCR2 BINDING SITE is a target binding site found in the 3' untranslated region of mRNA encoded by HAVCR2, corresponding to a target binding site such as BINDING SITE I, BINDING SITE II or BINDING SITE III of FIG. 8. Table 4 illustrates the complementarity of the nucleotide sequences of HAVCR2 BINDING SITE, designated SEQ ID:5471, to the nucleotide sequence of GAM7052 RNA, herein designated GAM RNA, also designated SEQ ID:296.

Another function of GAM7052 is therefore inhibition of Hepatitis a virus cellular receptor 2 (HAVCR2, Accession NP_116171.2). Accordingly, utilities of GAM7052 include diagnosis, prevention and treatment of diseases and clinical conditions associated with HAVCR2.

HBP17 (Accession NP_005121.1) is another GAM7052 target gene, herein designated TARGET GENE. HBP17 BINDING SITE is a target binding site found in the 5' untranslated region of mRNA encoded by HBP17, corresponding to a target binding site such as BINDING SITE I, BINDING SITE II or BINDING SITE III of FIG. 8. Table 4 illustrates the complementarity of the nucleotide sequences of HBP17 BINDING SITE, designated SEQ ID:8507, to the nucleotide sequence of GAM7052 RNA, herein designated GAM RNA, also designated SEQ ID:296.

Another function of GAM7052 is therefore inhibition of HBP17 (Accession NP_005121.1). Accordingly, utilities of GAM7052 include diagnosis, prevention and treatment of diseases and clinical conditions associated with HBP17.

Hypoxia inducible factor 3, alpha subunit (HIF3A, Accession NP_690009.1) is another GAM7052 target gene, herein designated TARGET GENE. HIF3A BINDING SITE is a target binding site found in the 3' untranslated region of multiple transcripts of mRNA encoded by HIF3A, corresponding to a target binding site such as BINDING SITE I, BINDING SITE II or BINDING SITE III of FIG. 8. Table 4 illustrates the complementarity of the nucleotide sequences of HIF3A BINDING SITE, designated SEQ ID:4583, to the nucleotide sequence of GAM7052 RNA, herein designated GAM RNA, also designated SEQ ID:296.

Another function of GAM7052 is therefore inhibition of Hypoxia inducible factor 3, alpha subunit (HIF3A, Accession NP_690009.1). Accordingly, utilities of GAM7052 include diagnosis, prevention and treatment of diseases and clinical conditions associated with HIF3A.

Histamine receptor h4 (HRH4, Accession NP_067637.2) is another GAM7052 target gene, herein designated TARGET GENE. HRH4 BINDING SITE is a target binding site found in the 3' untranslated region of mRNA encoded by HRH4, corresponding to a target binding site such as BINDING SITE I, BINDING SITE II or BINDING SITE III of FIG. 8. Table 4 illustrates the complementarity of the nucleotide sequences of HRH4 BINDING SITE, designated SEQ ID:10866, to the nucleotide sequence of GAM7052 RNA, herein designated GAM RNA, also designated SEQ ID:296.

Another function of GAM7052 is therefore inhibition of Histamine receptor h4 (HRH4, Accession NP_067637.2). Accordingly, utilities of GAM7052 include diagnosis, prevention and treatment of diseases and clinical conditions associated with HRH4.

Hydroxysteroid (17-beta) dehydrogenase 1 (HSD17B1, Accession NP_000404.1) is another GAM7052 target gene, herein designated TARGET GENE. HSD17B1 BINDING SITE is a target binding site found in the 5' untranslated region of mRNA encoded by HSD17B1, corresponding to a target binding site such as BINDING SITE I, BINDING SITE II or BINDING SITE III of FIG. 8. Table 4 illustrates the complementarity of the nucleotide sequences of HSD17B1 BINDING SITE, designated SEQ ID:13157, to the nucleotide sequence of GAM7052 RNA, herein designated GAM RNA, also designated SEQ ID:296.

Another function of GAM7052 is therefore inhibition of Hydroxysteroid (17-beta) dehydrogenase 1 (HSD17B1, Accession NP_000404.1). Accordingly, utilities of GAM7052 include diagnosis, prevention and treatment of diseases and clinical conditions associated with HSD17B1.

HSMPP8 (Accession XP_167894.1) is another GAM7052 target gene, herein designated TARGET GENE. HSMPP8 BINDING SITE is a target binding site found in the 3' untranslated region of mRNA encoded by HSMPP8, corresponding to a target binding site such as BINDING SITE I, BINDING SITE II or BINDING SITE III of FIG. 8. Table 4 illustrates the complementarity of the nucleotide sequences of HSMPP8 BINDING SITE, designated SEQ ID:5864, to the nucleotide sequence of GAM7052 RNA, herein designated GAM RNA, also designated SEQ ID:296.

Another function of GAM7052 is therefore inhibition of HSMPP8 (Accession XP_167894.1). Accordingly, utilities of GAM7052 include diagnosis, prevention and treatment of diseases and clinical conditions associated with HSMPP8.

HSPC065 (Accession NP_054876.2) is another GAM7052 target gene, herein designated TARGET GENE. HSPC065 BINDING SITE is a target binding site found in the 3' untranslated region of mRNA encoded by HSPC065, corresponding to a target binding site such as BINDING SITE I, BINDING SITE II or BINDING SITE III of FIG. 8. Table 4 illustrates the complementarity of the nucleotide sequences of HSPC065 BINDING SITE, designated SEQ ID:686, to the nucleotide sequence of GAM7052 RNA, herein designated GAM RNA, also designated SEQ ID:296.

Another function of GAM7052 is therefore inhibition of HSPC065 (Accession NP_054876.2). Accordingly, utilities of GAM7052 include diagnosis, prevention and treatment of diseases and clinical conditions associated with HSPC065.

5-hydroxytryptamine (serotonin) receptor 1e (HTR1E, Accession NP_000856.1) is another GAM7052 target gene, herein designated TARGET GENE. HTR1E BINDING SITE is a target binding site found in the 5' untranslated region of mRNA encoded by HTR1E, corresponding to a target binding site such as BINDING SITE I, BINDING SITE II or BINDING SITE III of FIG. 8. Table 4 illustrates the complementarity of the nucleotide sequences of HTR1E BINDING SITE, designated SEQ ID:19389, to the nucleotide sequence of GAM7052 RNA, herein designated GAM RNA, also designated SEQ ID:296.

Another function of GAM7052 is therefore inhibition of 5-hydroxytryptamine (serotonin) receptor 1e (HTR1E, Accession NP_000856.1), a gene which belongs to g-protein coupled receptors. Accordingly, utilities of GAM7052 include diagnosis, prevention and treatment of diseases and clinical conditions associated with HTR1E.

The function of HTR1E and its association with various diseases and clinical conditions, has been established by previous studies, as described hereinabove with reference to GAM161.1. Hus1 checkpoint homolog (s. pombe) (HUS1, Accession NP_004498.1) is another GAM7052 target gene, herein designated TARGET GENE. HUS1 BINDING SITE is a target binding site found in the 3' untranslated region of mRNA encoded by HUS1, corresponding to a target binding site such as BINDING SITE I, BINDING SITE II or BINDING SITE III of FIG. 8. Table 4 illustrates the complementarity of the nucleotide sequences of HUS1 BINDING SITE, designated SEQ ID:16890, to the nucleotide sequence of GAM7052 RNA, herein designated GAM RNA, also designated SEQ ID:296.

Another function of GAM7052 is therefore inhibition of Hus1 checkpoint homolog (s. pombe) (HUS1, Accession NP_004498.1), a gene which May form DNA damage-responsive protein complex. Accordingly, utilities of GAM7052 include diagnosis, prevention and treatment of diseases and clinical conditions associated with HUS1.

The function of HUS1 and its association with various diseases and clinical conditions, has been established by previous studies, as described hereinabove with reference to GAM189.1. Interferon (alpha, beta and omega) receptor 2 (IFNAR2, Accession NP_000865.2) is another GAM7052 target gene, herein designated TARGET GENE. IFNAR2 BINDING SITE is a target binding site found in the 3' untranslated region of mRNA encoded by IFNAR2, corresponding to a target binding site such as BINDING SITE I, BINDING SITE II or BINDING SITE III of FIG. 8. Table 4 illustrates the complementarity of the nucleotide sequences of IFNAR2 BINDING SITE, designated SEQ ID:10469, to the nucleotide sequence of GAM7052 RNA, herein designated GAM RNA, also designated SEQ ID:296.

Another function of GAM7052 is therefore inhibition of Interferon (alpha, beta and omega) receptor 2 (IFNAR2, Accession NP_000865.2), a gene which is a receptor for interferons alpha and beta. Accordingly, utilities of GAM7052 include diagnosis, prevention and treatment of diseases and clinical conditions associated with IFNAR2.

The function of IFNAR2 and its association with various diseases and clinical conditions, has been established by previous studies, as described hereinabove with reference to GAM30.1. Insulin-like growth factor 1 (somatomedin c) (IGF1, Accession NP_000609.1) is another GAM7052 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:8011, to the nucleotide sequence of GAM7052 RNA, herein designated GAM RNA, also designated SEQ ID:296.

Another function of GAM7052 is therefore inhibition of Insulin-like growth factor 1 (somatomedin c) (IGF1, Accession NP_000609.1), a gene which are structurally and functionally related to insulin but have a much higher growth-promoting activity and therefore may be associated with Growth retardation with sensorineural deafness and mental retardation. Accordingly, utilities of GAM7052 include diagnosis, prevention and treatment of Growth retardation with sensorineural deafness and mental retardation, and of other diseases and clinical conditions associated with IGF1.

The function of IGF1 and its association with various diseases and clinical conditions, has been established by previous studies, as described hereinabove with reference to GAM66.2. Interleukin 12 receptor, beta 1 (IL12RB1, Accession NP_714912.1) is another GAM7052 target gene, herein designated TARGET GENE. IL12RB1 BINDING SITE is a target binding site found in the 3' untranslated region of multiple transcripts of mRNA encoded by IL12RB1, corresponding to a target binding site such as BINDING SITE I, BINDING SITE II or BINDING SITE III of FIG. 8. Table 4 illustrates the complementarity of the nucleotide sequences of IL12RB1 BINDING SITE, designated SEQ ID:12219, to the nucleotide sequence of GAM7052 RNA, herein designated GAM RNA, also designated SEQ ID:296.

Another function of GAM7052 is therefore inhibition of Interleukin 12 receptor, beta 1 (IL12RB1, Accession NP_714912.1). Accordingly, utilities of GAM7052 include diagnosis, prevention and treatment of diseases and clinical conditions associated with IL12RB1.

Interleukin 28 receptor, alpha (IL28RA, Accession NP_775088.1) is another GAM7052 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:1187, to the nucleotide sequence of GAM7052 RNA, herein designated GAM RNA, also designated SEQ ID:296.

Another function of GAM7052 is therefore inhibition of Interleukin 28 receptor, alpha (IL28RA, Accession NP_775088.1). Accordingly, utilities of GAM7052 include diagnosis, prevention and treatment of diseases and clinical conditions associated with IL28RA.

Interleukin 28 receptor, alpha (IL28RA, Accession NP_734464.1) is another GAM7052 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:1187, to the nucleotide sequence of GAM7052 RNA, herein designated GAM RNA, also designated SEQ ID:296.

Another function of GAM7052 is therefore inhibition of Interleukin 28 receptor, alpha (IL28RA, Accession NP_734464.1). Accordingly, utilities of GAM7052 include diagnosis, prevention and treatment of diseases and clinical conditions associated with IL28RA.

Interleukin 28 receptor, alpha (IL28RA, Accession NP_775087.1) is another GAM7052 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:1187, to the nucleotide sequence of GAM7052 RNA, herein designated GAM RNA, also designated SEQ ID:296.

Another function of GAM7052 is therefore inhibition of Interleukin 28 receptor, alpha (IL28RA, Accession NP_775087.1). Accordingly, utilities of GAM7052 include diagnosis, prevention and treatment of diseases and clinical conditions associated with IL28RA.

IMPACT (Accession NP_060909.1) is another GAM7052 target gene, herein designated TARGET GENE. IMPACT BINDING SITE is a target binding site found in the 3' untranslated region of mRNA encoded by IMPACT, corresponding to a target binding site such as BINDING SITE I, BINDING SITE II or BINDING SITE III of FIG. 8. Table 4 illustrates the complementarity of the nucleotide sequences of IMPACT BINDING SITE, designated SEQ ID:11567, to the nucleotide sequence of GAM7052 RNA, herein designated GAM RNA, also designated SEQ ID:296.

Another function of GAM7052 is therefore inhibition of IMPACT (Accession NP_060909.1). Accordingly, utilities of GAM7052 include diagnosis, prevention and treatment of diseases and clinical conditions associated with IMPACT.

Indolethylamine n-methyltransferase (INMT, Accession NP_006765.3) is another GAM7052 target gene, herein designated TARGET GENE. INMT BINDING SITE is a target binding site found in the 3' untranslated region of mRNA encoded by INMT, corresponding to a target binding site such as BINDING SITE I, BINDING SITE II or BINDING SITE III of FIG. 8. Table 4 illustrates the complementarity of the nucleotide sequences of INMT BINDING SITE, designated SEQ ID:16621, to the nucleotide sequence of GAM7052 RNA, herein designated GAM RNA, also designated SEQ ID:296.

Another function of GAM7052 is therefore inhibition of Indolethylamine n-methyltransferase (INMT, Accession NP_006765.3). Accordingly, utilities of GAM7052 include diagnosis, prevention and treatment of diseases and clinical conditions associated with INMT.

Interferon regulatory factor 4 (IRF4, Accession NP_002451.1) is another GAM7052 target gene, herein designated TARGET GENE. IRF4 BINDING SITE is a target binding site found in the 3' untranslated region of mRNA encoded by IRF4, corresponding to a target binding site such as BINDING SITE I, BINDING SITE II or BINDING SITE III of FIG. 8. Table 4 illustrates the complementarity of the nucleotide sequences of IRF4 BINDING SITE, designated SEQ ID:3531, to the nucleotide sequence of GAM7052 RNA, herein designated GAM RNA, also designated SEQ ID:296.

Another function of GAM7052 is therefore inhibition of Interferon regulatory factor 4 (IRF4, Accession NP_002451.1). Accordingly, utilities of GAM7052 include diagnosis, prevention and treatment of diseases and clinical conditions associated with IRF4.

Janus kinase 3 (a protein tyrosine kinase, leukocyte) (JAK3, Accession NP_000206.1) is another GAM7052 target gene, herein designated TARGET GENE. JAK3 BINDING SITE is a target binding site found in the 3' untranslated region of mRNA encoded by JAK3, corresponding to a target binding site such as BINDING SITE I, BINDING SITE II or BINDING SITE III of FIG. 8. Table 4 illustrates the complementarity of the nucleotide sequences of JAK3 BINDING SITE, designated SEQ ID:7364, to the nucleotide sequence of GAM7052 RNA, herein designated GAM RNA, also designated SEQ ID:296.

Another function of GAM7052 is therefore inhibition of Janus kinase 3 (a protein tyrosine kinase, leukocyte) (JAK3, Accession NP_000206.1). Accordingly, utilities of GAM7052 include diagnosis, prevention and treatment of diseases and clinical conditions associated with JAK3.

JM11 (Accession NP_296375.1) is another GAM7052 target gene, herein designated TARGET GENE. JM11 BINDING SITE is a target binding site found in the 3' untranslated region of mRNA encoded by JM11, corresponding to a target binding site such as BINDING SITE I, BINDING SITE II or BINDING SITE III of FIG. 8. Table 4 illustrates the complementarity of the nucleotide sequences of JM11 BINDING SITE, designated SEQ ID:19302, to the nucleotide sequence of GAM7052 RNA, herein designated GAM RNA, also designated SEQ ID:296.

Another function of GAM7052 is therefore inhibition of JM11 (Accession NP_296375.1). Accordingly, utilities of GAM7052 include diagnosis, prevention and treatment of diseases and clinical conditions associated with JM11.

Potassium inwardly-rectifying channel, subfamily j, member 11 (KCNJ11, Accession NP_000516.2) is another GAM7052 target gene, herein designated TARGET GENE. KCNJ11 BINDING SITE is a target binding site found in the 5' untranslated region of mRNA encoded by KCNJ11, corresponding to a target binding site such as BINDING SITE I, BINDING SITE II or BINDING SITE III of FIG. 8. Table 4 illustrates the complementarity of the nucleotide sequences of KCNJ11 BINDING SITE, designated SEQ ID:4460, to the nucleotide sequence of GAM7052 RNA, herein designated GAM RNA, also designated SEQ ID:296.

Another function of GAM7052 is therefore inhibition of Potassium inwardly-rectifying channel, subfamily j, member 11 (KCNJ11, Accession NP_000516.2), a gene which is controlled by g proteins. inward rectifier k+ channels are characterized by a greater tendency to allow potassium to flow into the cell rather than out of it. and therefore is associated with Persistent hyperinsulinemic hypoglycemia of infancy. Accordingly, utilities of GAM7052 include diagnosis, prevention and treatment of Persistent hyperinsulinemic hypoglycemia of infancy, and of other diseases and clinical conditions associated with KCNJ11.

The function of KCNJ11 and its association with various diseases and clinical conditions, has been established by previous studies, as described hereinabove with reference to GAM189.1. KIAA0087 (Accession NP_055584.1) is another GAM7052 target gene, herein designated TARGET GENE. KIAA0087 BINDING SITE1 and KIAA0087 BINDING SITE2 are target binding sites found in untranslated regions of mRNA encoded by KIAA0087, corresponding to target binding sites such as BINDING SITE I, BINDING SITE II or BINDING SITE III of FIG. 8. Table 4 illustrates the complementarity of the nucleotide sequences of KIAA0087 BINDING SITE1 and KIAA0087 BINDING SITE2, designated SEQ ID:16774 and SEQ ID:18062 respectively, to the nucleotide sequence of GAM7052 RNA, herein designated GAM RNA, also designated SEQ ID:296.

Another function of GAM7052 is therefore inhibition of KIAA0087 (Accession NP_055584.1). Accordingly, utilities of GAM7052 include diagnosis, prevention and treatment of diseases and clinical conditions associated with KIAA0087.

KIAA0117 (Accession XP_290939.1) is another GAM7052 target gene, herein designated TARGET GENE. KIAA0117 BINDING SITE is a target binding site found in the 3' untranslated region of mRNA encoded by KIAA0117, corresponding to a target binding site such as BINDING SITE I, BINDING SITE II or BINDING SITE III of FIG. 8. Table 4 illustrates the complementarity of the nucleotide sequences of KIAA0117 BINDING SITE, designated SEQ ID:11163, to the nucleotide sequence of GAM7052 RNA, herein designated GAM RNA, also designated SEQ ID:296.

Another function of GAM7052 is therefore inhibition of KIAA0117 (Accession XP_290939.1). Accordingly, utilities of GAM7052 include diagnosis, prevention and treatment of diseases and clinical conditions associated with KIAA0117.

KIAA0186 (Accession NP_066545.1) is another GAM7052 target gene, herein designated TARGET GENE. KIAA0186 BINDING SITE is a target binding site found in the 3' untranslated region of mRNA encoded by KIAA0186, corresponding to a target binding site such as BINDING SITE I, BINDING SITE II or BINDING SITE III of FIG. 8. Table 4 illustrates the complementarity of the nucleotide sequences of KIAA0186 BINDING SITE, designated SEQ ID:4041, to the nucleotide sequence of GAM7052 RNA, herein designated GAM RNA, also designated SEQ ID:296.

Another function of GAM7052 is therefore inhibition of KIAA0186 (Accession NP_066545.1). Accordingly, utilities of GAM7052 include diagnosis, prevention and treatment of diseases and clinical conditions associated with KIAA0186.

KIAA0406 (Accession NP_055472.1) is another GAM7052 target gene, herein designated TARGET GENE. KIAA0406 BINDING SITE is a target binding site found in the 5' untranslated region of mRNA encoded by KIAA0406, corresponding to a target binding site such as BINDING SITE I, BINDING SITE II or BINDING SITE III of FIG. 8. Table 4 illustrates the complementarity of the nucleotide sequences of KIAA0406 BINDING SITE, designated SEQ ID:17968, to the nucleotide sequence of GAM7052 RNA, herein designated GAM RNA, also designated SEQ ID:296.

Another function of GAM7052 is therefore inhibition of KIAA0406 (Accession NP_055472.1). Accordingly, utilities of GAM7052 include diagnosis, prevention and treatment of diseases and clinical conditions associated with KIAA0406.

KIAA0459 (Accession XP_027862.1) is another GAM7052 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:7366, to the nucleotide sequence of GAM7052 RNA, herein designated GAM RNA, also designated SEQ ID:296.

Another function of GAM7052 is therefore inhibition of KIAA0459 (Accession XP_027862.1). Accordingly, utilities of GAM7052 include diagnosis, prevention and treatment of diseases and clinical conditions associated with KIAA0459.

KIAA0472 (Accession XP_290898.1) is another GAM7052 target gene, herein designated TARGET GENE. KIAA0472 BINDING SITE is a target binding site found in the 5' untranslated region of mRNA encoded by KIAA0472, corresponding to a target binding site such as BINDING SITE I, BINDING SITE II or BINDING SITE III of FIG. 8. Table 4 illustrates the complementarity of the nucleotide sequences of KIAA0472 BINDING SITE, designated SEQ ID:12393, to the nucleotide sequence of GAM7052 RNA, herein designated GAM RNA, also designated SEQ ID:296.

Another function of GAM7052 is therefore inhibition of KIAA0472 (Accession XP_290898.1). Accordingly, utilities of GAM7052 include diagnosis, prevention and treatment of diseases and clinical conditions associated with KIAA0472.

KIAA0475 (Accession NP_055679.1) is another GAM7052 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:7779, to the nucleotide sequence of GAM7052 RNA, herein designated GAM RNA, also designated SEQ ID:296.

Another function of GAM7052 is therefore inhibition of KIAA0475 (Accession NP_055679.1). Accordingly, utilities of GAM7052 include diagnosis, prevention and treatment of diseases and clinical conditions associated with KIAA0475.

KIAA0495 (Accession XP_031397.1) is another GAM7052 target gene, herein designated TARGET GENE. KIAA0495 BINDING SITE is a target binding site found in the 3' untranslated region of mRNA encoded by KIAA0495, corresponding to a target binding site such as BINDING SITE I, BINDING SITE II or BINDING SITE III of FIG. 8. Table 4 illustrates the complementarity of the nucleotide sequences of KIAA0495 BINDING SITE, designated SEQ ID:4636, to the nucleotide sequence of GAM7052 RNA, herein designated GAM RNA, also designated SEQ ID:296.

Another function of GAM7052 is therefore inhibition of KIAA0495 (Accession XP_031397.1). Accordingly, utilities of GAM7052 include diagnosis, prevention and treatment of diseases and clinical conditions associated with KIAA0495.

KIAA0513 (Accession NP_055547.1) is another GAM7052 target gene, herein designated TARGET GENE. KIAA0513 BINDING SITE1 and KIAA0513 BINDING SITE2 are target binding sites found in untranslated regions of mRNA encoded by KIAA0513, corresponding to target binding sites such as BINDING SITE I, BINDING SITE II or BINDING SITE III of FIG. 8. Table 4 illustrates the complementarity of the nucleotide sequences of KIAA0513 BINDING SITE1 and KIAA0513 BINDING SITE2, designated SEQ ID:19867 and SEQ ID:5592 respectively, to the nucleotide sequence of GAM7052 RNA, herein designated GAM RNA, also designated SEQ ID:296.

Another function of GAM7052 is therefore inhibition of KIAA0513 (Accession NP_055547.1). Accordingly, utilities of GAM7052 include diagnosis, prevention and treatment of diseases and clinical conditions associated with KIAA0513.

KIAA0555 (Accession NP_055605.1) is another GAM7052 target gene, herein designated TARGET GENE. KIAA0555 BINDING SITE is a target binding site found in the 3' untranslated region of mRNA encoded by KIAA0555, corresponding to a target binding site such as BINDING SITE I, BINDING SITE II or BINDING SITE III of FIG. 8. Table 4 illustrates the complementarity of the nucleotide sequences of KIAA0555 BINDING SITE, designated SEQ ID:8953, to the nucleotide sequence of GAM7052 RNA, herein designated GAM RNA, also designated SEQ ID:296.

Another function of GAM7052 is therefore inhibition of KIAA0555 (Accession NP_055605.1). Accordingly, utilities of GAM7052 include diagnosis, prevention and treatment of diseases and clinical conditions associated with KIAA0555.

KIAA0557 (Accession XP_085507.1) is another GAM7052 target gene, herein designated TARGET GENE. KIAA0557 BINDING SITE1 and KIAA0557 BINDING SITE2 are target binding sites found in untranslated regions of mRNA encoded by KIAA0557, corresponding to target binding sites such as BINDING SITE I, BINDING SITE II or BINDING SITE III of FIG. 8. Table 4 illustrates the complementarity of the nucleotide sequences of KIAA0557 BINDING SITE1 and KIAA0557 BINDING SITE2, designated SEQ ID:14583 and SEQ ID:9434 respectively, to the nucleotide sequence of GAM7052 RNA, herein designated GAM RNA, also designated SEQ ID:296.

Another function of GAM7052 is therefore inhibition of KIAA0557 (Accession XP_085507.1). Accordingly, utilities of GAM7052 include diagnosis, prevention and treatment of diseases and clinical conditions associated with KIAA0557.

KIAA0562 (Accession NP_055519.1) is another GAM7052 target gene, herein designated TARGET GENE. KIAA0562 BINDING SITE is a target binding site found in the 3' untranslated region of mRNA encoded by KIAA0562, corresponding to a target binding site such as BINDING SITE I, BINDING SITE II or BINDING SITE III of FIG. 8. Table 4 illustrates the complementarity of the nucleotide sequences of KIAA0562 BINDING SITE, designated SEQ ID:5466, to the nucleotide sequence of GAM7052 RNA, herein designated GAM RNA, also designated SEQ ID:296.

Another function of GAM7052 is therefore inhibition of KIAA0562 (Accession NP_055519.1). Accordingly, utilities of GAM7052 include diagnosis, prevention and treatment of diseases and clinical conditions associated with KIAA0562.

KIAA0563 (Accession NP_055649.1) is another GAM7052 target gene, herein designated TARGET GENE. KIAA0563 BINDING SITE is a target binding site found in the 5' untranslated region of mRNA encoded by KIAA0563, corresponding to a target binding site such as BINDING SITE I, BINDING SITE II or BINDING SITE III of FIG. 8. Table 4 illustrates the complementarity of the nucleotide sequences of KIAA0563 BINDING SITE, designated SEQ ID:697, to the nucleotide sequence of GAM7052 RNA, herein designated GAM RNA, also designated SEQ ID:296.

Another function of GAM7052 is therefore inhibition of KIAA0563 (Accession NP_055649.1). Accordingly, utilities of GAM7052 include diagnosis, prevention and treatment of diseases and clinical conditions associated with KIAA0563.

KIAA0605 (Accession NP_055509.1) is another GAM7052 target gene, herein designated TARGET GENE. KIAA0605 BINDING SITE is a target binding site found in the 5' untranslated region of mRNA encoded by KIAA0605, corresponding to a target binding site such as BINDING SITE I, BINDING SITE II or BINDING SITE III of FIG. 8. Table 4 illustrates the complementarity of the nucleotide sequences of KIAA0605 BINDING SITE, designated SEQ ID:5865, to the nucleotide sequence of GAM7052 RNA, herein designated GAM RNA, also designated SEQ ID:296.

Another function of GAM7052 is therefore inhibition of KIAA0605 (Accession NP_055509.1). Accordingly, utilities of GAM7052 include diagnosis, prevention and treatment of diseases and clinical conditions associated with KIAA0605.

KIAA0643 (Accession NP_079069.1) is another GAM7052 target gene, herein designated TARGET GENE. KIAA0643 BINDING SITE is a target binding site found in the 5' untranslated region of mRNA encoded by KIAA0643, corresponding to a target binding site such as BINDING SITE I, BINDING SITE II or BINDING SITE III of FIG. 8. Table 4 illustrates the complementarity of the nucleotide sequences of KIAA0643 BINDING SITE, designated SEQ ID:6764, to the nucleotide sequence of GAM7052 RNA, herein designated GAM RNA, also designated SEQ ID:296.

Another function of GAM7052 is therefore inhibition of KIAA0643 (Accession NP_079069.1). Accordingly, utilities of GAM7052 include diagnosis, prevention and treatment of diseases and clinical conditions associated with KIAA0643.

KIAA0663 (Accession NP_055642.1) is another GAM7052 target gene, herein designated TARGET GENE. KIAA0663 BINDING SITE is a target binding site found in the 5' untranslated region of mRNA encoded by KIAA0663, corresponding to a target binding site such as BINDING SITE I, BINDING SITE II or BINDING SITE III of FIG. 8. Table 4 illustrates the complementarity of the nucleotide sequences of KIAA0663 BINDING SITE, designated SEQ ID:19611, to the nucleotide sequence of GAM7052 RNA, herein designated GAM RNA, also designated SEQ ID:296.

Another function of GAM7052 is therefore inhibition of KIAA0663 (Accession NP_055642.1). Accordingly, utilities of GAM7052 include diagnosis, prevention and treatment of diseases and clinical conditions associated with KIAA0663.

KIAA0831 (Accession NP_055739.1) is another GAM7052 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:10893, to the nucleotide sequence of GAM7052 RNA, herein designated GAM RNA, also designated SEQ ID:296.

Another function of GAM7052 is therefore inhibition of KIAA0831 (Accession NP_055739.1). Accordingly, utilities of GAM7052 include diagnosis, prevention and treatment of diseases and clinical conditions associated with KIAA0831.

KIAA0841 (Accession XP_049237.1) is another GAM7052 target gene, herein designated TARGET GENE. KIAA0841 BINDING SITE is a target binding site found in the 3' untranslated region of mRNA encoded by KIAA0841, corresponding to a target binding site such as BINDING SITE I, BINDING SITE II or BINDING SITE III of FIG. 8. Table 4 illustrates the complementarity of the nucleotide sequences of KIAA0841 BINDING SITE, designated SEQ ID:5866, to the nucleotide sequence of GAM7052 RNA, herein designated GAM RNA, also designated SEQ ID:296.

Another function of GAM7052 is therefore inhibition of KIAA0841 (Accession XP_049237.1). Accordingly, utilities of GAM7052 include diagnosis, prevention and treatment of diseases and clinical conditions associated with KIAA0841.

KIAA0861 (Accession NP_055893.2) is another GAM7052 target gene, herein designated TARGET GENE. KIAA0861 BINDING SITE is a target binding site found in the 3' untranslated region of mRNA encoded by KIAA0861, corresponding to a target binding site such as BINDING SITE I, BINDING SITE II or BINDING SITE III of FIG. 8. Table 4 illustrates the complementarity of the nucleotide sequences of KIAA0861 BINDING SITE, designated SEQ ID:9847, to the nucleotide sequence of GAM7052 RNA, herein designated GAM RNA, also designated SEQ ID:296.

Another function of GAM7052 is therefore inhibition of KIAA0861 (Accession NP_055893.2). Accordingly, utilities of GAM7052 include diagnosis, prevention and treatment of diseases and clinical conditions associated with KIAA0861.

KIAA0931 (Accession XP_041191.2) is another GAM7052 target gene, herein designated TARGET GENE. KIAA0931 BINDING SITE is a target binding site found in the 3' untranslated region of mRNA encoded by KIAA0931, corresponding to a target binding site such as BINDING SITE I, BINDING SITE II or BINDING SITE III of FIG. 8. Table 4 illustrates the complementarity of the nucleotide sequences of KIAA0931 BINDING SITE, designated SEQ ID:8012, to the nucleotide sequence of GAM7052 RNA, herein designated GAM RNA, also designated SEQ ID:296.

Another function of GAM7052 is therefore inhibition of KIAA0931 (Accession XP_041191.2). Accordingly, utilities of GAM7052 include diagnosis, prevention and treatment of diseases and clinical conditions associated with KIAA0931.

KIAA0962 (Accession XP_290942.1) is another GAM7052 target gene, herein designated TARGET GENE. KIAA0962 BINDING SITE is a target binding site found in the 3' untranslated region of mRNA encoded by KIAA0962, corresponding to a target binding site such as BINDING SITE I, BINDING SITE II or BINDING SITE III of FIG. 8. Table 4 illustrates the complementarity of the nucleotide sequences of KIAA0962 BINDING SITE, designated SEQ ID:2109, to the nucleotide sequence of GAM7052 RNA, herein designated GAM RNA, also designated SEQ ID:296.

Another function of GAM7052 is therefore inhibition of KIAA0962 (Accession XP_290942.1). Accordingly, utilities of GAM7052 include diagnosis, prevention and treatment of diseases and clinical conditions associated with KIAA0962.

KIAA0972 (Accession NP_055745.1) is another GAM7052 target gene, herein designated TARGET GENE. KIAA0972 BINDING SITE is a target binding site found in the 3' untranslated region of mRNA encoded by KIAA0972, corresponding to a target binding site such as BINDING SITE I, BINDING SITE II or BINDING SITE III of FIG. 8. Table 4 illustrates the complementarity of the nucleotide sequences of KIAA0972 BINDING SITE, designated SEQ ID:16232, to the nucleotide sequence of GAM7052 RNA, herein designated GAM RNA, also designated SEQ ID:296.

Another function of GAM7052 is therefore inhibition of KIAA0972 (Accession NP_055745.1). Accordingly, utilities of GAM7052 include diagnosis, prevention and treatment of diseases and clinical conditions associated with KIAA0972.

KIAA0981 (Accession XP_028867.2) is another GAM7052 target gene, herein designated TARGET GENE. KIAA0981 BINDING SITE is a target binding site found in the 3' untranslated region of mRNA encoded by KIAA0981, corresponding to a target binding site such as BINDING SITE I, BINDING SITE II or BINDING SITE III of FIG. 8. Table 4 illustrates the complementarity of the nucleotide sequences of KIAA0981 BINDING SITE, designated SEQ ID:7266, to the nucleotide sequence of GAM7052 RNA, herein designated GAM RNA, also designated SEQ ID:296.

Another function of GAM7052 is therefore inhibition of KIAA0981 (Accession XP_028867.2). Accordingly, utilities of GAM7052 include diagnosis, prevention and treatment of diseases and clinical conditions associated with KIAA0981.

KIAA1002 (Accession XP_290584.1) is another GAM7052 target gene, herein designated TARGET GENE. KIAA1002 BINDING SITE is a target binding site found in the 5' untranslated region of mRNA encoded by KIAA1002, corresponding to a target binding site such as BINDING SITE I, BINDING SITE II or BINDING SITE III of FIG. 8. Table 4 illustrates the complementarity of the nucleotide sequences of KIAA1002 BINDING SITE, designated SEQ ID:11806, to the nucleotide sequence of GAM7052 RNA, herein designated GAM RNA, also designated SEQ ID:296.

Another function of GAM7052 is therefore inhibition of KIAA1002 (Accession XP_290584.1). Accordingly, utilities of GAM7052 include diagnosis, prevention and treatment of diseases and clinical conditions associated with KIAA1002.

KIAA1041 (Accession NP_055762.1) is another GAM7052 target gene, herein designated TARGET GENE. KIAA1041 BINDING SITE is a target binding site found in the 3' untranslated region of mRNA encoded by KIAA1041, corresponding to a target binding site such as BINDING SITE I, BINDING SITE II or BINDING SITE III of FIG. 8. Table 4 illustrates the complementarity of the nucleotide sequences of KIAA1041 BINDING SITE, designated SEQ ID:18227, to the nucleotide sequence of GAM7052 RNA, herein designated GAM RNA, also designated SEQ ID:296.

Another function of GAM7052 is therefore inhibition of KIAA1041 (Accession NP_055762.1). Accordingly, utilities of GAM7052 include diagnosis, prevention and treatment of diseases and clinical conditions associated with KIAA1041.

KIAA1054 (Accession XP_043493.5) is another GAM7052 target gene, herein designated TARGET GENE. KIAA1054 BINDING SITE is a target binding site found in the 3' untranslated region of mRNA encoded by KIAA1054, corresponding to a target binding site such as BINDING SITE I, BINDING SITE II or BINDING SITE III of FIG. 8. Table 4 illustrates the complementarity of the nucleotide sequences of KIAA1054 BINDING SITE, designated SEQ ID:3041, to the nucleotide sequence of GAM7052 RNA, herein designated GAM RNA, also designated SEQ ID:296.

Another function of GAM7052 is therefore inhibition of KIAA1054 (Accession XP_043493.5). Accordingly, utilities of GAM7052 include diagnosis, prevention and treatment of diseases and clinical conditions associated with KIAA1054.

KIAA1061 (Accession XP_048786.4) is another GAM7052 target gene, herein designated TARGET GENE. KIAA1061 BINDING SITE is a target binding site found in the 3' untranslated region of mRNA encoded by KIAA1061, corresponding to a target binding site such as BINDING SITE I, BINDING SITE II or BINDING SITE III of FIG. 8. Table 4 illustrates the complementarity of the nucleotide sequences of KIAA1061 BINDING SITE, designated SEQ ID:13719, to the nucleotide sequence of GAM7052 RNA, herein designated GAM RNA, also designated SEQ ID:296.

Another function of GAM7052 is therefore inhibition of KIAA1061 (Accession XP_048786.4). Accordingly, utilities of GAM7052 include diagnosis, prevention and treatment of diseases and clinical conditions associated with KIAA1061.

KIAA1128 (Accession NP_061872.1) is another GAM7052 target gene, herein designated TARGET GENE. KIAA1128 BINDING SITE is a target binding site found in the 3' untranslated region of mRNA encoded by KIAA1128, corresponding to a target binding site such as BINDING SITE I, BINDING SITE II or BINDING SITE III of FIG. 8. Table 4 illustrates the complementarity of the nucleotide sequences of KIAA1128 BINDING SITE, designated SEQ ID:5120, to the nucleotide sequence of GAM7052 RNA, herein designated GAM RNA, also designated SEQ ID:296.

Another function of GAM7052 is therefore inhibition of KIAA1128 (Accession NP_061872.1). Accordingly, utilities of GAM7052 include diagnosis, prevention and treatment of diseases and clinical conditions associated with KIAA1128.

KIAA1185 (Accession NP_065761.1) is another GAM7052 target gene, herein designated TARGET GENE. KIAA1185 BINDING SITE is a target binding site found in the 3' untranslated region of mRNA encoded by KIAA1185, corresponding to a target binding site such as BINDING SITE I, BINDING SITE II or BINDING SITE III of FIG. 8. Table 4 illustrates the complementarity of the nucleotide sequences of KIAA1185 BINDING SITE, designated SEQ ID:2092, to the nucleotide sequence of GAM7052 RNA, herein designated GAM RNA, also designated SEQ ID:296.

Another function of GAM7052 is therefore inhibition of KIAA1185 (Accession NP_065761.1). Accordingly, utilities of GAM7052 include diagnosis, prevention and treatment of diseases and clinical conditions associated with KIAA1185.

KIAA1193 (Accession XP_041843.1) is another GAM7052 target gene, herein designated TARGET GENE. KIAA1193 BINDING SITE is a target binding site found in the 3' untranslated region of mRNA encoded by KIAA1193, corresponding to a target binding site such as BINDING SITE I, BINDING SITE II or BINDING SITE III of FIG. 8. Table 4 illustrates the complementarity of the nucleotide sequences of KIAA1193 BINDING SITE, designated SEQ ID:12481, to the nucleotide sequence of GAM7052 RNA, herein designated GAM RNA, also designated SEQ ID:296.

Another function of GAM7052 is therefore inhibition of KIAA1193 (Accession XP_041843.1). Accordingly, utilities of GAM7052 include diagnosis, prevention and treatment of diseases and clinical conditions associated with KIAA1193.

KIAA1198 (Accession NP_065765.1) is another GAM7052 target gene, herein designated TARGET GENE. KIAA1198 BINDING SITE1 through KIAA1198 BINDING SITE3 are target binding sites found in untranslated regions of mRNA encoded by KIAA1198, corresponding to target binding sites such as BINDING SITE I, BINDING SITE II or BINDING SITE III of FIG. 8. Table 4 illustrates the complementarity of the nucleotide sequences of KIAA1198 BINDING SITE1 through KIAA1198 BINDING SITE3, designated SEQ ID:18274, SEQ ID:1359 and SEQ ID:12377 respectively, to the nucleotide sequence of GAM7052 RNA, herein designated GAM RNA, also designated SEQ ID:296.

Another function of GAM7052 is therefore inhibition of KIAA1198 (Accession NP_065765.1). Accordingly, utilities of GAM7052 include diagnosis, prevention and treatment of diseases and clinical conditions associated with KIAA1198.

KIAA1200 (Accession XP_031054.4) is another GAM7052 target gene, herein designated TARGET GENE. KIAA1200 BINDING SITE is a target binding site found in the 3' untranslated region of mRNA encoded by KIAA1200, corresponding to a target binding site such as BINDING SITE I, BINDING SITE II or BINDING SITE III of FIG. 8. Table 4 illustrates the complementarity of the nucleotide sequences of KIAA1200 BINDING SITE, designated SEQ ID:10959, to the nucleotide sequence of GAM7052 RNA, herein designated GAM RNA, also designated SEQ ID:296.

Another function of GAM7052 is therefore inhibition of KIAA1200 (Accession XP_031054.4). Accordingly, utilities of GAM7052 include diagnosis, prevention and treatment of diseases and clinical conditions associated with KIAA1200.

KIAA1209 (Accession XP_027307.2) is another GAM7052 target gene, herein designated TARGET GENE. KIAA1209 BINDING SITE is a target binding site found in the 3' untranslated region of mRNA encoded by KIAA1209, corresponding to a target binding site such as BINDING SITE I, BINDING SITE II or BINDING SITE III of FIG. 8. Table 4 illustrates the complementarity of the nucleotide sequences of KIAA1209 BINDING SITE, designated SEQ ID:15011, to the nucleotide sequence of GAM7052 RNA, herein designated GAM RNA, also designated SEQ ID:296.

Another function of GAM7052 is therefore inhibition of KIAA1209 (Accession XP_027307.2). Accordingly, utilities of GAM7052 include diagnosis, prevention and treatment of diseases and clinical conditions associated with KIAA1209.

KIAA1257 (Accession XP_031577.2) is another GAM7052 target gene, herein designated TARGET GENE. KIAA1257 BINDING SITE1 and KIAA1257 BINDING SITE2 are target binding sites found in untranslated regions of mRNA encoded by KIAA1257, corresponding to target binding sites such as BINDING SITE I, BINDING SITE II or BINDING SITE III of FIG. 8. Table 4 illustrates the complementarity of the nucleotide sequences of KIAA1257 BINDING SITE1 and KIAA1257 BINDING SITE2, designated SEQ ID:7935 and SEQ ID:12291 respectively, to the nucleotide sequence of GAM7052 RNA, herein designated GAM RNA, also designated SEQ ID:296.

Another function of GAM7052 is therefore inhibition of KIAA1257 (Accession XP_031577.2). Accordingly, utilities of GAM7052 include diagnosis, prevention and treatment of diseases and clinical conditions associated with KIAA1257.

KIAA1268 (Accession XP_291055.1) is another GAM7052 target gene, herein designated TARGET GENE. KIAA1268 BINDING SITE is a target binding site found in the 3' untranslated region of mRNA encoded by KIAA1268, corresponding to a target binding site such as BINDING SITE I, BINDING SITE II or BINDING SITE III of FIG. 8. Table 4 illustrates the complementarity of the nucleotide sequences of KIAA1268 BINDING SITE, designated SEQ ID:16885, to the nucleotide sequence of GAM7052 RNA, herein designated GAM RNA, also designated SEQ ID:296.

Another function of GAM7052 is therefore inhibition of KIAA1268 (Accession XP_291055.1). Accordingly, utilities of GAM7052 include diagnosis, prevention and treatment of diseases and clinical conditions associated with KIAA1268.

KIAA1273 (Accession XP_300760.1) is another GAM7052 target gene, herein designated TARGET GENE. KIAA1273 BINDING SITE is a target binding site found in the 5' untranslated region of mRNA encoded by KIAA1273, corresponding to a target binding site such as BINDING SITE I, BINDING SITE II or BINDING SITE III of FIG. 8. Table 4 illustrates the complementarity of the nucleotide sequences of KIAA1273 BINDING SITE, designated SEQ ID:13714, to the nucleotide sequence of GAM7052 RNA, herein designated GAM RNA, also designated SEQ ID:296.

Another function of GAM7052 is therefore inhibition of KIAA1273 (Accession XP_300760.1). Accordingly, utilities of GAM7052 include diagnosis, prevention and treatment of diseases and clinical conditions associated with KIAA1273.

KIAA1287 (Accession NP_065799.1) is another GAM7052 target gene, herein designated TARGET GENE. KIAA1287 BINDING SITE is a target binding site found in the 3' untranslated region of mRNA encoded by KIAA1287, corresponding to a target binding site such as BINDING SITE I, BINDING SITE II or BINDING SITE III of FIG. 8. Table 4 illustrates the complementarity of the nucleotide sequences of KIAA1287 BINDING SITE, designated SEQ ID:14633, to the nucleotide sequence of GAM7052 RNA, herein designated GAM RNA, also designated SEQ ID:296.

Another function of GAM7052 is therefore inhibition of KIAA1287 (Accession NP_065799.1). Accordingly, utilities of GAM7052 include diagnosis, prevention and treatment of diseases and clinical conditions associated with KIAA1287.

KIAA1443 (Accession NP_065885.1) is another GAM7052 target gene, herein designated TARGET GENE. KIAA1443 BINDING SITE is a target binding site found in the 3' untranslated region of mRNA encoded by KIAA1443, corresponding to a target binding site such as BINDING SITE I, BINDING SITE II or BINDING SITE III of FIG. 8. Table 4 illustrates the complementarity of the nucleotide sequences of KIAA1443 BINDING SITE, designated SEQ ID:3913, to the nucleotide sequence of GAM7052 RNA, herein designated GAM RNA, also designated SEQ ID:296.

Another function of GAM7052 is therefore inhibition of KIAA1443 (Accession NP_065885.1). Accordingly, utilities of GAM7052 include diagnosis, prevention and treatment of diseases and clinical conditions associated with KIAA1443.

KIAA1456 (Accession XP_040100.3) is another GAM7052 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:6661, to the nucleotide sequence of GAM7052 RNA, herein designated GAM RNA, also designated SEQ ID:296.

Another function of GAM7052 is therefore inhibition of KIAA1456 (Accession XP_040100.3). Accordingly, utilities of GAM7052 include diagnosis, prevention and treatment of diseases and clinical conditions associated with KIAA1456.

KIAA1493 (Accession XP_034415.1) is another GAM7052 target gene, herein designated TARGET GENE. KIAA1493 BINDING SITE is a target binding site found in the 3' untranslated region of mRNA encoded by KIAA1493, corresponding to a target binding site such as BINDING SITE I, BINDING SITE II or BINDING SITE III of FIG. 8. Table 4 illustrates the complementarity of the nucleotide sequences of KIAA1493 BINDING SITE, designated SEQ ID:9995, to the nucleotide sequence of GAM7052 RNA, herein designated GAM RNA, also designated SEQ ID:296.

Another function of GAM7052 is therefore inhibition of KIAA1493 (Accession XP_034415.1). Accordingly, utilities of GAM7052 include diagnosis, prevention and treatment of diseases and clinical conditions associated with KIAA1493.

KIAA1518 (Accession XP_170889.1) is another GAM7052 target gene, herein designated TARGET GENE. KIAA1518 BINDING SITE is a target binding site found in the 3' untranslated region of multiple transcripts of mRNA encoded by KIAA1518, corresponding to a target binding site such as BINDING SITE I, BINDING SITE II or BINDING SITE III of FIG. 8. Table 4 illustrates the complementarity of the nucleotide sequences of KIAA1518 BINDING SITE, designated SEQ ID:14558, to the nucleotide sequence of GAM7052 RNA, herein designated GAM RNA, also designated SEQ ID:296.

Another function of GAM7052 is therefore inhibition of KIAA1518 (Accession XP_170889.1). Accordingly, utilities of GAM7052 include diagnosis, prevention and treatment of diseases and clinical conditions associated with KIAA1518.

KIAA1530 (Accession XP_042661.5) is another GAM7052 target gene, herein designated TARGET GENE. KIAA1530 BINDING SITE is a target binding site found in the 3' untranslated region of mRNA encoded by KIAA1530, corresponding to a target binding site such as BINDING SITE I, BINDING SITE II or BINDING SITE III of FIG. 8. Table 4 illustrates the complementarity of the nucleotide sequences of KIAA1530 BINDING SITE, designated SEQ ID:12327, to the nucleotide sequence of GAM7052 RNA, herein designated GAM RNA, also designated SEQ ID:296.

Another function of GAM7052 is therefore inhibition of KIAA1530 (Accession XP_042661.5). Accordingly, utilities of GAM7052 include diagnosis, prevention and treatment of diseases and clinical conditions associated with KIAA1530.

KIAA1571 (Accession XP_027744.1) is another GAM7052 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:9469, to the nucleotide sequence of GAM7052 RNA, herein designated GAM RNA, also designated SEQ ID:296.

Another function of GAM7052 is therefore inhibition of KIAA1571 (Accession XP_027744.1). Accordingly, utilities of GAM7052 include diagnosis, prevention and treatment of diseases and clinical conditions associated with KIAA1571.

KIAA1615 (Accession NP_066002.1) is another GAM7052 target gene, herein designated TARGET GENE. KIAA1615 BINDING SITE1 and KIAA1615 BINDING SITE2 are target binding sites found in untranslated regions of mRNA encoded by KIAA1615, corresponding to target binding sites such as BINDING SITE I, BINDING SITE II or BINDING SITE III of FIG. 8. Table 4 illustrates the complementarity of the nucleotide sequences of KIAA1615 BINDING SITE1 and KIAA1615 BINDING SITE2, designated SEQ ID:18920 and SEQ ID:15445 respectively, to the nucleotide sequence of GAM7052 RNA, herein designated GAM RNA, also designated SEQ ID:296.

Another function of GAM7052 is therefore inhibition of KIAA1615 (Accession NP_066002.1). Accordingly, utilities of GAM7052 include diagnosis, prevention and treatment of diseases and clinical conditions associated with KIAA1615.

KIAA1617 (Accession XP_166140.1) is another GAM7052 target gene, herein designated TARGET GENE. KIAA1617 BINDING SITE is a target binding site found in the 3' untranslated region of mRNA encoded by KIAA1617, corresponding to a target binding site such as BINDING SITE I, BINDING SITE II or BINDING SITE III of FIG. 8. Table 4 illustrates the complementarity of the nucleotide sequences of KIAA1617 BINDING SITE, designated SEQ ID:1187, to the nucleotide sequence of GAM7052 RNA, herein designated GAM RNA, also designated SEQ ID:296.

Another function of GAM7052 is therefore inhibition of KIAA1617 (Accession XP_166140.1). Accordingly, utilities of GAM7052 include diagnosis, prevention and treatment of diseases and clinical conditions associated with KIAA1617.

KIAA1712 (Accession NP_085136.1) is another GAM7052 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:15686 and SEQ ID:16883 respectively, to the nucleotide sequence of GAM7052 RNA, herein designated GAM RNA, also designated SEQ ID:296.

Another function of GAM7052 is therefore inhibition of KIAA1712 (Accession NP_085136.1). Accordingly, utilities of GAM7052 include diagnosis, prevention and treatment of diseases and clinical conditions associated with KIAA1712.

KIAA1712 (Accession XP_041497.2) is another GAM7052 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:16883 and SEQ ID:15686 respectively, to the nucleotide sequence of GAM7052 RNA, herein designated GAM RNA, also designated SEQ ID:296.

Another function of GAM7052 is therefore inhibition of KIAA1712 (Accession XP_041497.2). Accordingly, utilities of GAM7052 include diagnosis, prevention and treatment of diseases and clinical conditions associated with KIAA1712.

KIAA1737 (Accession NP_219494.1) is another GAM7052 target gene, herein designated TARGET GENE. KIAA1737 BINDING SITE is a target binding site found in the 3' untranslated region of mRNA encoded by KIAA1737, corresponding to a target binding site such as BINDING SITE I, BINDING SITE II or BINDING SITE III of FIG. 8. Table 4 illustrates the complementarity of the nucleotide sequences of KIAA1737 BINDING SITE, designated SEQ ID:3033, to the nucleotide sequence of GAM7052 RNA, herein designated GAM RNA, also designated SEQ ID:296.

Another function of GAM7052 is therefore inhibition of KIAA1737 (Accession NP_219494.1). Accordingly, utilities of GAM7052 include diagnosis, prevention and treatment of diseases and clinical conditions associated with KIAA1737.

KIAA1827 (Accession XP_290834.1) is another GAM7052 target gene, herein designated TARGET GENE. KIAA1827 BINDING SITE is a target binding site found in the 3' untranslated region of mRNA encoded by KIAA1827, corresponding to a target binding site such as BINDING SITE I, BINDING SITE II or BINDING SITE III of FIG. 8. Table 4 illustrates the complementarity of the nucleotide sequences of KIAA1827 BINDING SITE, designated SEQ ID:1496, to the nucleotide sequence of GAM7052 RNA, herein designated GAM RNA, also designated SEQ ID:296.

Another function of GAM7052 is therefore inhibition of KIAA1827 (Accession XP_290834.1). Accordingly, utilities of GAM7052 include diagnosis, prevention and treatment of diseases and clinical conditions associated with KIAA1827.

KIAA1829 (Accession XP_030378.2) is another GAM7052 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:2825, to the nucleotide sequence of GAM7052 RNA, herein designated GAM RNA, also designated SEQ ID:296.

Another function of GAM7052 is therefore inhibition of KIAA1829 (Accession XP_030378.2). Accordingly, utilities of GAM7052 include diagnosis, prevention and treatment of diseases and clinical conditions associated with KIAA1829.

KIAA1836 (Accession XP_114087.2) is another GAM7052 target gene, herein designated TARGET GENE. KIAA1836 BINDING SITE is a target binding site found in the 3' untranslated region of mRNA encoded by KIAA1836, corresponding to a target binding site such as BINDING SITE I, BINDING SITE II or BINDING SITE III of FIG. 8. Table 4 illustrates the complementarity of the nucleotide sequences of KIAA1836 BINDING SITE, designated SEQ ID:14962, to the nucleotide sequence of GAM7052 RNA, herein designated GAM RNA, also designated SEQ ID:296.

Another function of GAM7052 is therefore inhibition of KIAA1836 (Accession XP_114087.2). Accordingly, utilities of GAM7052 include diagnosis, prevention and treatment of diseases and clinical conditions associated with KIAA1836.

KIAA1922 (Accession XP_057040.1) is another GAM7052 target gene, herein designated TARGET GENE. KIAA1922 BINDING SITE is a target binding site found in the 5' untranslated region of mRNA encoded by KIAA1922, corresponding to a target binding site such as BINDING SITE I, BINDING SITE II or BINDING SITE III of FIG. 8. Table 4 illustrates the complementarity of the nucleotide sequences of KIAA1922 BINDING SITE, designated SEQ ID:10834, to the nucleotide sequence of GAM7052 RNA, herein designated GAM RNA, also designated SEQ ID:296.

Another function of GAM7052 is therefore inhibition of KIAA1922 (Accession XP_057040.1). Accordingly, utilities of GAM7052 include diagnosis, prevention and treatment of diseases and clinical conditions associated with KIAA1922.

KIAA1940 (Accession XP_086981.2) is another GAM7052 target gene, herein designated TARGET GENE. KIAA1940 BINDING SITE is a target binding site found in the 3' untranslated region of mRNA encoded by KIAA1940, corresponding to a target binding site such as BINDING SITE I, BINDING SITE II or BINDING SITE III of FIG. 8. Table 4 illustrates the complementarity of the nucleotide sequences of KIAA1940 BINDING SITE, designated SEQ ID:17635, to the nucleotide sequence of GAM7052 RNA, herein designated GAM RNA, also designated SEQ ID:296.

Another function of GAM7052 is therefore inhibition of KIAA1940 (Accession XP_086981.2). Accordingly, utilities of GAM7052 include diagnosis, prevention and treatment of diseases and clinical conditions associated with KIAA1940.

KIAA1971 (Accession XP_058720.4) is another GAM7052 target gene, herein designated TARGET GENE. KIAA1971 BINDING SITE1 and KIAA1971 BINDING SITE2 are target binding sites found in untranslated regions of mRNA encoded by KIAA1971, corresponding to target binding sites such as BINDING SITE I, BINDING SITE II or BINDING SITE III of FIG. 8. Table 4 illustrates the complementarity of the nucleotide sequences of KIAA1971 BINDING SITE1 and KIAA1971 BINDING SITE2, designated SEQ ID:16885 and SEQ ID:12858 respectively, to the nucleotide sequence of GAM7052 RNA, herein designated GAM RNA, also designated SEQ ID:296.

Another function of GAM7052 is therefore inhibition of KIAA1971 (Accession XP_058720.4). Accordingly, utilities of GAM7052 include diagnosis, prevention and treatment of diseases and clinical conditions associated with KIAA1971.

KIAA1987 (Accession XP_113870.1) is another GAM7052 target gene, herein designated TARGET GENE. KIAA1987 BINDING SITE is a target binding site found in the 5' untranslated region of mRNA encoded by KIAA1987, corresponding to a target binding site such as BINDING SITE I, BINDING SITE II or BINDING SITE III of FIG. 8. Table 4 illustrates the complementarity of the nucleotide sequences of KIAA1987 BINDING SITE, designated SEQ ID:6990, to the nucleotide sequence of GAM7052 RNA, herein designated GAM RNA, also designated SEQ ID:296.

Another function of GAM7052 is therefore inhibition of KIAA1987 (Accession XP_113870.1). Accordingly, utilities of GAM7052 include diagnosis, prevention and treatment of diseases and clinical conditions associated with KIAA1987.

KIAA2028 (Accession XP_059415.2) is another GAM7052 target gene, herein designated TARGET GENE. KIAA2028 BINDING SITE is a target binding site found in the 3' untranslated region of mRNA encoded by KIAA2028, corresponding to a target binding site such as BINDING SITE I, BINDING SITE II or BINDING SITE III of FIG. 8. Table 4 illustrates the complementarity of the nucleotide sequences of KIAA2028 BINDING SITE, designated SEQ ID:17522, to the nucleotide sequence of GAM7052 RNA, herein designated GAM RNA, also designated SEQ ID:296.

Another function of GAM7052 is therefore inhibition of KIAA2028 (Accession XP_059415.2). Accordingly, utilities of GAM7052 include diagnosis, prevention and treatment of diseases and clinical conditions associated with KIAA2028.

Killer cell lectin-like receptor subfamily c, member 3 (KLRC3, Accession NP_002252.1) is another GAM7052 target gene, herein designated TARGET GENE. KLRC3 BINDING SITE is a target binding site found in the 3' untranslated region of multiple transcripts of mRNA encoded by KLRC3, corresponding to a target binding site such as BINDING SITE I, BINDING SITE II or BINDING SITE III of FIG. 8. Table 4 illustrates the complementarity of the nucleotide sequences of KLRC3 BINDING SITE, designated SEQ ID:12994, to the nucleotide sequence of GAM7052 RNA, herein designated GAM RNA, also designated SEQ ID:296.

Another function of GAM7052 is therefore inhibition of Killer cell lectin-like receptor subfamily c, member 3 (KLRC3, Accession NP_002252.1), a gene which is a receptor for the recognition of mhc class i hla-e molecules by nk cells and some cytotoxic t-cells. Accordingly, utilities of GAM7052 include diagnosis, prevention and treatment of diseases and clinical conditions associated with KLRC3.

The function of KLRC3 and its association with various diseases and clinical conditions, has been established by previous studies, as described hereinabove with reference to GAM2624.1. Lysosomal-associated membrane protein 3 (LAMP3, Accession NP_055213.1) is another GAM7052 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:1656, to the nucleotide sequence of GAM7052 RNA, herein designated GAM RNA, also designated SEQ ID:296.

Another function of GAM7052 is therefore inhibition of Lysosomal-associated membrane protein 3 (LAMP3, Accession NP_055213.1). Accordingly, utilities of GAM7052 include diagnosis, prevention and treatment of diseases and clinical conditions associated with LAMP3.

Lipoma hmgic fusion partner (LHFP, Accession NP_005771.1) is another GAM7052 target gene, herein designated TARGET GENE. LHFP BINDING SITE is a target binding site found in the 3' untranslated region of mRNA encoded by LHFP, corresponding to a target binding site such as BINDING SITE I, BINDING SITE II or BINDING SITE III of FIG. 8. Table 4 illustrates the complementarity of the nucleotide sequences of LHFP BINDING SITE, designated SEQ ID:3333, to the nucleotide sequence of GAM7052 RNA, herein designated GAM RNA, also designated SEQ ID:296.

Another function of GAM7052 is therefore inhibition of Lipoma hmgic fusion partner (LHFP, Accession NP_005771.1). Accordingly, utilities of GAM7052 include diagnosis, prevention and treatment of diseases and clinical conditions associated with LHFP.

LNIR (Accession NP_112178.1) is another GAM7052 target gene, herein designated TARGET GENE. LNIR BINDING SITE is a target binding site found in the 3' untranslated region of mRNA encoded by LNIR, corresponding to a target binding site such as BINDING SITE I, BINDING SITE II or BINDING SITE III of FIG. 8. Table 4 illustrates the complementarity of the nucleotide sequences of LNIR BINDING SITE, designated SEQ ID:5115, to the nucleotide sequence of GAM7052 RNA, herein designated GAM RNA, also designated SEQ ID:296.

Another function of GAM7052 is therefore inhibition of LNIR (Accession NP_112178.1). Accordingly, utilities of GAM7052 include diagnosis, prevention and treatment of diseases and clinical conditions associated with LNIR.

LNK (Accession NP_005466.1) is another GAM7052 target gene, herein designated TARGET GENE. LNK BINDING SITE is a target binding site found in the 3' untranslated region of mRNA encoded by LNK, corresponding to a target binding site such as BINDING SITE I, BINDING SITE II or BINDING SITE III of FIG. 8. Table 4 illustrates the complementarity of the nucleotide sequences of LNK BINDING SITE, designated SEQ ID:8674, to the nucleotide sequence of GAM7052 RNA, herein designated GAM RNA, also designated SEQ ID:296.

Another function of GAM7052 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM7052 include diagnosis, prevention and treatment of diseases and clinical conditions associated with LNK.

The function of LNK and its association with various diseases and clinical conditions, has been established by previous studies, as described hereinabove with reference to GAM130.1. LOC112687 (Accession XP_053145.1) is another GAM7052 target gene, herein designated TARGET GENE. LOC112687 BINDING SITE is a target binding site found in the 3' untranslated region of mRNA encoded by LOC112687, corresponding to a target binding site such as BINDING SITE I, BINDING SITE II or BINDING SITE III of FIG. 8. Table 4 illustrates the complementarity of the nucleotide sequences of LOC112687 BINDING SITE, designated SEQ ID:11096, to the nucleotide sequence of GAM7052 RNA, herein designated GAM RNA, also designated SEQ ID:296.

Another function of GAM7052 is therefore inhibition of LOC112687 (Accession XP_053145.1). Accordingly, utilities of GAM7052 include diagnosis, prevention and treatment of diseases and clinical conditions associated with LOC112687.

LOC112817 (Accession NP_612422.2) is another GAM7052 target gene, herein designated TARGET GENE. LOC112817 BINDING SITE is a target binding site found in the 3' untranslated region of mRNA encoded by LOC112817, corresponding to a target binding site such as BINDING SITE I, BINDING SITE II or BINDING SITE III of FIG. 8. Table 4 illustrates the complementarity of the nucleotide sequences of LOC112817 BINDING SITE, designated SEQ ID:12527, to the nucleotide sequence of GAM7052 RNA, herein designated GAM RNA, also designated SEQ ID:296.

Another function of GAM7052 is therefore inhibition of LOC112817 (Accession NP_612422.2). Accordingly, utilities of GAM7052 include diagnosis, prevention and treatment of diseases and clinical conditions associated with LOC112817.

LOC113444 (Accession NP_612437.2) is another GAM7052 target gene, herein designated TARGET GENE. LOC113444 BINDING SITE1 and LOC113444 BINDING SITE2 are target binding sites found in untranslated regions of mRNA encoded by LOC113444, corresponding to target binding sites such as BINDING SITE I, BINDING SITE II or BINDING SITE III of FIG. 8. Table 4 illustrates the complementarity of the nucleotide sequences of LOC113444 BINDING SITE1 and LOC113444 BINDING SITE2, designated SEQ ID:13633 and SEQ ID:9691 respectively, to the nucleotide sequence of GAM7052 RNA, herein designated GAM RNA, also designated SEQ ID:296.

Another function of GAM7052 is therefore inhibition of LOC113444 (Accession NP_612437.2). Accordingly, utilities of GAM7052 include diagnosis, prevention and treatment of diseases and clinical conditions associated with LOC113444.

LOC115648 (Accession NP_663299.1) is another GAM7052 target gene, herein designated TARGET GENE. LOC115648 BINDING SITE1 and LOC115648 BINDING SITE2 are target binding sites found in untranslated regions of mRNA encoded by LOC115648, corresponding to target binding sites such as BINDING SITE I, BINDING SITE II or BINDING SITE III of FIG. 8. Table 4 illustrates the complementarity of the nucleotide sequences of LOC115648 BINDING SITE1 and LOC115648 BINDING SITE2, designated SEQ ID:5621 and SEQ ID:3028 respectively, to the nucleotide sequence of GAM7052 RNA, herein designated GAM RNA, also designated SEQ ID:296.

Another function of GAM7052 is therefore inhibition of LOC115648 (Accession NP_663299.1). Accordingly, utilities of GAM7052 include diagnosis, prevention and treatment of diseases and clinical conditions associated with LOC115648.

LOC118490 (Accession XP_060981.3) is another GAM7052 target gene, herein designated TARGET GENE. LOC118490 BINDING SITE is a target binding site found in the 3' untranslated region of mRNA encoded by LOC118490, corresponding to a target binding site such as BINDING SITE I, BINDING SITE II or BINDING SITE III of FIG. 8. Table 4 illustrates the complementarity of the nucleotide sequences of LOC118490 BINDING SITE, designated SEQ ID:13356, to the nucleotide sequence of GAM7052 RNA, herein designated GAM RNA, also designated SEQ ID:296.

Another function of GAM7052 is therefore inhibition of LOC118490 (Accession XP_060981.3). Accordingly, utilities of GAM7052 include diagnosis, prevention and treatment of diseases and clinical conditions associated with LOC118490.

LOC118812 (Accession NP_849154.1) is another GAM7052 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:13816, to the nucleotide sequence of GAM7052 RNA, herein designated GAM RNA, also designated SEQ ID:296.

Another function of GAM7052 is therefore inhibition of LOC118812 (Accession NP_849154.1). Accordingly, utilities of GAM7052 include diagnosis, prevention and treatment of diseases and clinical conditions associated with LOC118812.

LOC118812 (Accession XP_058346.2) is another GAM7052 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:13816, to the nucleotide sequence of GAM7052 RNA, herein designated GAM RNA, also designated SEQ ID:296.

Another function of GAM7052 is therefore inhibition of LOC118812 (Accession XP_058346.2). Accordingly, utilities of GAM7052 include diagnosis, prevention and treatment of diseases and clinical conditions associated with LOC118812.

LOC121952 (Accession XP_062872.2) is another GAM7052 target gene, herein designated TARGET GENE. LOC121952 BINDING SITE is a target binding site found in the 5' untranslated region of mRNA encoded by LOC121952, corresponding to a target binding site such as BINDING SITE I, BINDING SITE II or BINDING SITE III of FIG. 8. Table 4 illustrates the complementarity of the nucleotide sequences of LOC121952 BINDING SITE, designated SEQ ID:18973, to the nucleotide sequence of GAM7052 RNA, herein designated GAM RNA, also designated SEQ ID:296.

Another function of GAM7052 is therefore inhibition of LOC121952 (Accession XP_062872.2). Accordingly, utilities of GAM7052 include diagnosis, prevention and treatment of diseases and clinical conditions associated with LOC121952.

LOC125061 (Accession XP_058889.3) is another GAM7052 target gene, herein designated TARGET GENE. LOC125061 BINDING SITE is a target binding site found in the 3' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:13952, to the nucleotide sequence of GAM7052 RNA, herein designated GAM RNA, also designated SEQ ID:296.

Another function of GAM7052 is therefore inhibition of LOC125061 (Accession XP_058889.3). Accordingly, utilities of GAM7052 include diagnosis, prevention and treatment of diseases and clinical conditions associated with LOC125061.

LOC126257 (Accession XP_059009.2) is another GAM7052 target gene, herein designated TARGET GENE. LOC126257 BINDING SITE is a target binding site found in the 5' untranslated region of mRNA encoded by LOC126257, corresponding to a target binding site such as BINDING SITE I, BINDING SITE II or BINDING SITE III of FIG. 8. Table 4 illustrates the complementarity of the nucleotide sequences of LOC126257 BINDING SITE, designated SEQ ID:18559, to the nucleotide sequence of GAM7052 RNA, herein designated GAM RNA, also designated SEQ ID:296.

Another function of GAM7052 is therefore inhibition of LOC126257 (Accession XP_059009.2). Accordingly, utilities of GAM7052 include diagnosis, prevention and treatment of diseases and clinical conditions associated with LOC126257.

LOC128387 (Accession XP_059243.2) is another GAM7052 target gene, herein designated TARGET GENE. LOC128387 BINDING SITE is a target binding site found in the 3' untranslated region of mRNA encoded by LOC128387, corresponding to a target binding site such as BINDING SITE I, BINDING SITE II or BINDING SITE III of FIG. 8. Table 4 illustrates the complementarity of the nucleotide sequences of LOC128387 BINDING SITE, designated SEQ ID:10834, to the nucleotide sequence of GAM7052 RNA, herein designated GAM RNA, also designated SEQ ID:296.

Another function of GAM7052 is therefore inhibition of LOC128387 (Accession XP_059243.2). Accordingly, utilities of GAM7052 include diagnosis, prevention and treatment of diseases and clinical conditions associated with LOC128387.

LOC129039 (Accession XP_059329.1) is another GAM7052 target gene, herein designated TARGET GENE. LOC129039 BINDING SITE is a target binding site found in the 3' untranslated region of mRNA encoded by LOC129039, corresponding to a target binding site such as BINDING SITE I, BINDING SITE II or BINDING SITE III of FIG. 8. Table 4 illustrates the complementarity of the nucleotide sequences of LOC129039 BINDING SITE, designated SEQ ID:10993, to the nucleotide sequence of GAM7052 RNA, herein designated GAM RNA, also designated SEQ ID:296.

Another function of GAM7052 is therefore inhibition of LOC129039 (Accession XP_059329.1). Accordingly, utilities of GAM7052 include diagnosis, prevention and treatment of diseases and clinical conditions associated with LOC129039.

LOC130639 (Accession XP_059464.2) is another GAM7052 target gene, herein designated TARGET GENE. LOC130639 BINDING SITE is a target binding site found in the 5' untranslated region of mRNA encoded by LOC130639, corresponding to a target binding site such as BINDING SITE I, BINDING SITE II or BINDING SITE III of FIG. 8. Table 4 illustrates the complementarity of the nucleotide sequences of LOC130639 BINDING SITE, designated SEQ ID:19669, to the nucleotide sequence of GAM7052 RNA, herein designated GAM RNA, also designated SEQ ID:296.

Another function of GAM7052 is therefore inhibition of LOC130639 (Accession XP_059464.2). Accordingly, utilities of GAM7052 include diagnosis, prevention and treatment of diseases and clinical conditions associated with LOC130639.

LOC130813 (Accession XP_065904.1) is another GAM7052 target gene, herein designated TARGET GENE. LOC130813 BINDING SITE is a target binding site found in the 3' untranslated region of mRNA encoded by LOC130813, corresponding to a target binding site such as BINDING SITE I, BINDING SITE II or BINDING SITE III of FIG. 8. Table 4 illustrates the complementarity of the nucleotide sequences of LOC130813 BINDING SITE, designated SEQ ID:2257, to the nucleotide sequence of GAM7052 RNA, herein designated GAM RNA, also designated SEQ ID:296.

Another function of GAM7052 is therefore inhibition of LOC130813 (Accession XP_065904.1). Accordingly, utilities of GAM7052 include diagnosis, prevention and treatment of diseases and clinical conditions associated with LOC130813.

LOC135293 (Accession XP_072402.4) is another GAM7052 target gene, herein designated TARGET GENE. LOC135293 BINDING SITE is a target binding site found in the 3' untranslated region of mRNA encoded by LOC135293, corresponding to a target binding site such as BINDING SITE I, BINDING SITE II or BINDING SITE III of FIG. 8. Table 4 illustrates the complementarity of the nucleotide sequences of LOC135293 BINDING SITE, designated SEQ ID:18228, to the nucleotide sequence of GAM7052 RNA, herein designated GAM RNA, also designated SEQ ID:296.

Another function of GAM7052 is therefore inhibition of LOC135293 (Accession XP_072402.4). Accordingly, utilities of GAM7052 include diagnosis, prevention and treatment of diseases and clinical conditions associated with LOC135293.

LOC135763 (Accession NP_612639.1) is another GAM7052 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:19515, to the nucleotide sequence of GAM7052 RNA, herein designated GAM RNA, also designated SEQ ID:296.

Another function of GAM7052 is therefore inhibition of LOC135763 (Accession NP_612639.1). Accordingly, utilities of GAM7052 include diagnosis, prevention and treatment of diseases and clinical conditions associated with LOC135763.

LOC137886 (Accession XP_059929.3) is another GAM7052 target gene, herein designated TARGET GENE. LOC137886 BINDING SITE is a target binding site found in the 3' untranslated region of mRNA encoded by LOC137886, corresponding to a target binding site such as BINDING SITE I, BINDING SITE II or BINDING SITE III of FIG. 8. Table 4 illustrates the complementarity of the nucleotide sequences of LOC137886 BINDING SITE, designated SEQ ID:2107, to the nucleotide sequence of GAM7052 RNA, herein designated GAM RNA, also designated SEQ ID:296.

Another function of GAM7052 is therefore inhibition of LOC137886 (Accession XP_059929.3). Accordingly, utilities of GAM7052 include diagnosis, prevention and treatment of diseases and clinical conditions associated with LOC137886.

LOC142826 (Accession XP_084355.1) is another GAM7052 target gene, herein designated TARGET GENE. LOC142826 BINDING SITE is a target binding site found in the 3' untranslated region of mRNA encoded by LOC142826, corresponding to a target binding site such as BINDING SITE I, BINDING SITE II or BINDING SITE III of FIG. 8. Table 4 illustrates the complementarity of the nucleotide sequences of LOC142826 BINDING SITE, designated SEQ ID:6899, to the nucleotide sequence of GAM7052 RNA, herein designated GAM RNA, also designated SEQ ID:296.

Another function of GAM7052 is therefore inhibition of LOC142826 (Accession XP_084355.1). Accordingly, utilities of GAM7052 include diagnosis, prevention and treatment of diseases and clinical conditions associated with LOC142826.

LOC142948 (Accession XP_096364.1) is another GAM7052 target gene, herein designated TARGET GENE. LOC142948 BINDING SITE is a target binding site found in the 3' untranslated region of mRNA encoded by LOC142948, corresponding to a target binding site such as BINDING SITE I, BINDING SITE II or BINDING SITE III of FIG. 8. Table 4 illustrates the complementarity of the nucleotide sequences of LOC142948 BINDING SITE, designated SEQ ID:4637, to the nucleotide sequence of GAM7052 RNA, herein designated GAM RNA, also designated SEQ ID:296.

Another function of GAM7052 is therefore inhibition of LOC142948 (Accession XP_096364.1). Accordingly, utilities of GAM7052 include diagnosis, prevention and treatment of diseases and clinical conditions associated with LOC142948.

LOC143241 (Accession NP_620167.1) is another GAM7052 target gene, herein designated TARGET GENE. LOC143241 BINDING SITE is a target binding site found in the 5' untranslated region of mRNA encoded by LOC143241, corresponding to a target binding site such as BINDING SITE I, BINDING SITE II or BINDING SITE III of FIG. 8. Table 4 illustrates the complementarity of the nucleotide sequences of LOC143241 BINDING SITE, designated SEQ ID:16432, to the nucleotide sequence of GAM7052 RNA, herein designated GAM RNA, also designated SEQ ID:296.

Another function of GAM7052 is therefore inhibition of LOC143241 (Accession NP_620167.1). Accordingly, utilities of GAM7052 include diagnosis, prevention and treatment of diseases and clinical conditions associated with LOC143241.

LOC143916 (Accession XP_084664.1) is another GAM7052 target gene, herein designated TARGET GENE. LOC143916 BINDING SITE is a target binding site found in the 3' untranslated region of mRNA encoded by LOC143916, corresponding to a target binding site such as BINDING SITE I, BINDING SITE II or BINDING SITE III of FIG. 8. Table 4 illustrates the complementarity of the nucleotide sequences of LOC143916 BINDING SITE, designated SEQ ID:19303, to the nucleotide sequence of GAM7052 RNA, herein designated GAM RNA, also designated SEQ ID:296.

Another function of GAM7052 is therefore inhibition of LOC143916 (Accession XP_084664.1). Accordingly, utilities of GAM7052 include diagnosis, prevention and treatment of diseases and clinical conditions associated with LOC143916.

LOC144100 (Accession NP_778228.1) is another GAM7052 target gene, herein designated TARGET GENE. LOC144100 BINDING SITE is a target binding site found in the 3' untranslated region of mRNA encoded by LOC144100, corresponding to a target binding site such as BINDING SITE I, BINDING SITE II or BINDING SITE III of FIG. 8. Table 4 illustrates the complementarity of the nucleotide sequences of LOC144100 BINDING SITE, designated SEQ ID:18030, to the nucleotide sequence of GAM7052 RNA, herein designated GAM RNA, also designated SEQ ID:296.

Another function of GAM7052 is therefore inhibition of LOC144100 (Accession NP_778228.1). Accordingly, utilities of GAM7052 include diagnosis, prevention and treatment of diseases and clinical conditions associated with LOC144100.

LOC144248 (Accession XP_084786.1) is another GAM7052 target gene, herein designated TARGET GENE. LOC144248 BINDING SITE is a target binding site found in the 5' untranslated region of mRNA encoded by LOC144248, corresponding to a target binding site such as BINDING SITE I, BINDING SITE II or BINDING SITE III of FIG. 8. Table 4 illustrates the complementarity of the nucleotide sequences of LOC144248 BINDING SITE, designated SEQ ID:12527, to the nucleotide sequence of GAM7052 RNA, herein designated GAM RNA, also designated SEQ ID:296.

Another function of GAM7052 is therefore inhibition of LOC144248 (Accession XP_084786.1). Accordingly, utilities of GAM7052 include diagnosis, prevention and treatment of diseases and clinical conditions associated with LOC144248.

LOC144742 (Accession XP_084949.1) is another GAM7052 target gene, herein designated TARGET GENE. LOC144742 BINDING SITE is a target binding site found in the 5' untranslated region of mRNA encoded by LOC144742, corresponding to a target binding site such as BINDING SITE I, BINDING SITE II or BINDING SITE III of FIG. 8. Table 4 illustrates the complementarity of the nucleotide sequences of LOC144742 BINDING SITE, designated SEQ ID:13167, to the nucleotide sequence of GAM7052 RNA, herein designated GAM RNA, also designated SEQ ID:296.

Another function of GAM7052 is therefore inhibition of LOC144742 (Accession XP_084949.1). Accordingly, utilities of GAM7052 include diagnosis, prevention and treatment of diseases and clinical conditions associated with LOC144742.

LOC145268 (Accession XP_085072.1) is another GAM7052 target gene, herein designated TARGET GENE. LOC145268 BINDING SITE is a target binding site found in the 5' untranslated region of mRNA encoded by LOC145268, corresponding to a target binding site such as BINDING SITE I, BINDING SITE II or BINDING SITE III of FIG. 8. Table 4 illustrates the complementarity of the nucleotide sequences of LOC145268 BINDING SITE, designated SEQ ID:10250, to the nucleotide sequence of GAM7052 RNA, herein designated GAM RNA, also designated SEQ ID:296.

Another function of GAM7052 is therefore inhibition of LOC145268 (Accession XP_085072.1). Accordingly, utilities of GAM7052 include diagnosis, prevention and treatment of diseases and clinical conditions associated with LOC145268.

LOC145453 (Accession XP_085120.1) is another GAM7052 target gene, herein designated TARGET GENE. LOC145453 BINDING SITE is a target binding site found in the 5' untranslated region of mRNA encoded by LOC145453, corresponding to a target binding site such as BINDING SITE I, BINDING SITE II or BINDING SITE III of FIG. 8. Table 4 illustrates the complementarity of the nucleotide sequences of LOC145453 BINDING SITE, designated SEQ ID:6583, to the nucleotide sequence of GAM7052 RNA, herein designated GAM RNA, also designated SEQ ID:296.

Another function of GAM7052 is therefore inhibition of LOC145453 (Accession XP_085120.1). Accordingly, utilities of GAM7052 include diagnosis, prevention and treatment of diseases and clinical conditions associated with LOC145453.

LOC145678 (Accession XP_096832.1) is another GAM7052 target gene, herein designated TARGET GENE. LOC145678 BINDING SITE is a target binding site found in the 5' untranslated region of mRNA encoded by LOC145678, corresponding to a target binding site such as BINDING SITE I, BINDING SITE II or BINDING SITE III of FIG. 8. Table 4 illustrates the complementarity of the nucleotide sequences of LOC145678 BINDING SITE, designated SEQ ID:20072, to the nucleotide sequence of GAM7052 RNA, herein designated GAM RNA, also designated SEQ ID:296.

Another function of GAM7052 is therefore inhibition of LOC145678 (Accession XP_096832.1). Accordingly, utilities of GAM7052 include diagnosis, prevention and treatment of diseases and clinical conditions associated with LOC145678.

LOC145757 (Accession XP_085227.1) is another GAM7052 target gene, herein designated TARGET GENE. LOC145757 BINDING SITE is a target binding site found in the 5' untranslated region of mRNA encoded by LOC145757, corresponding to a target binding site such as BINDING SITE I, BINDING SITE II or BINDING SITE III of FIG. 8. Table 4 illustrates the complementarity of the nucleotide sequences of LOC145757 BINDING SITE, designated SEQ ID:15280, to the nucleotide sequence of GAM7052 RNA, herein designated GAM RNA, also designated SEQ ID:296.

Another function of GAM7052 is therefore inhibition of LOC145757 (Accession XP_085227.1). Accordingly, utilities of GAM7052 include diagnosis, prevention and treatment of diseases and clinical conditions associated with LOC145757.

LOC146177 (Accession NP_778229.1) is another GAM7052 target gene, herein designated TARGET GENE. LOC146177 BINDING SITE is a target binding site found in the 5' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:2107, to the nucleotide sequence of GAM7052 RNA, herein designated GAM RNA, also designated SEQ ID:296.

Another function of GAM7052 is therefore inhibition of LOC146177 (Accession NP_778229.1). Accordingly, utilities of GAM7052 include diagnosis, prevention and treatment of diseases and clinical conditions associated with LOC146177.

LOC146346 (Accession XP_085430.1) is another GAM7052 target gene, herein designated TARGET GENE. LOC146346 BINDING SITE is a target binding site found in the 5' untranslated region of mRNA encoded by LOC146346, corresponding to a target binding site such as BINDING SITE I, BINDING SITE II or BINDING SITE III of FIG. 8. Table 4 illustrates the complementarity of the nucleotide sequences of LOC146346 BINDING SITE, designated SEQ ID:10470, to the nucleotide sequence of GAM7052 RNA, herein designated GAM RNA, also designated SEQ ID:296.

Another function of GAM7052 is therefore inhibition of LOC146346 (Accession XP_085430.1). Accordingly, utilities of GAM7052 include diagnosis, prevention and treatment of diseases and clinical conditions associated with LOC146346.

LOC146429 (Accession XP_096998.2) is another GAM7052 target gene, herein designated TARGET GENE. LOC146429 BINDING SITE is a target binding site found in the 5' untranslated region of mRNA encoded by LOC146429, corresponding to a target binding site such as BINDING SITE I, BINDING SITE II or BINDING SITE III of FIG. 8. Table 4 illustrates the complementarity of the nucleotide sequences of LOC146429 BINDING SITE, designated SEQ ID:8011, to the nucleotide sequence of GAM7052 RNA, herein designated GAM RNA, also designated SEQ ID:296.

Another function of GAM7052 is therefore inhibition of LOC146429 (Accession XP_096998.2). Accordingly, utilities of GAM7052 include diagnosis, prevention and treatment of diseases and clinical conditions associated with LOC146429.

LOC146443 (Accession XP_085461.6) is another GAM7052 target gene, herein designated TARGET GENE. LOC146443 BINDING SITE is a target binding site found in the 5' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:4286, to the nucleotide sequence of GAM7052 RNA, herein designated GAM RNA, also designated SEQ ID:296.

Another function of GAM7052 is therefore inhibition of LOC146443 (Accession XP_085461.6). Accordingly, utilities of GAM7052 include diagnosis, prevention and treatment of diseases and clinical conditions associated with LOC146443.

LOC146820 (Accession XP_085603.1) is another GAM7052 target gene, herein designated TARGET GENE. LOC146820 BINDING SITE is a target binding site found in the 5' untranslated region of mRNA encoded by LOC146820, corresponding to a target binding site such as BINDING SITE I, BINDING SITE II or BINDING SITE III of FIG. 8. Table 4 illustrates the complementarity of the nucleotide sequences of LOC146820 BINDING SITE, designated SEQ ID:10012, to the nucleotide sequence of GAM7052 RNA, herein designated GAM RNA, also designated SEQ ID:296.

Another function of GAM7052 is therefore inhibition of LOC146820 (Accession XP_085603.1). Accordingly, utilities of GAM7052 include diagnosis, prevention and treatment of diseases and clinical conditions associated with LOC146820.

LOC146894 (Accession NP_660316.1) is another GAM7052 target gene, herein designated TARGET GENE. LOC146894 BINDING SITE is a target binding site found in the 3' untranslated region of mRNA encoded by LOC146894, corresponding to a target binding site such as BINDING SITE I, BINDING SITE II or BINDING SITE III of FIG. 8. Table 4 illustrates the complementarity of the nucleotide sequences of LOC146894 BINDING SITE, designated SEQ ID:1234, to the nucleotide sequence of GAM7052 RNA, herein designated GAM RNA, also designated SEQ ID:296.

Another function of GAM7052 is therefore inhibition of LOC146894 (Accession NP_660316.1). Accordingly, utilities of GAM7052 include diagnosis, prevention and treatment of diseases and clinical conditions associated with LOC146894.

LOC147071 (Accession XP_054031.5) is another GAM7052 target gene, herein designated TARGET GENE. LOC147071 BINDING SITE is a target binding site found in the 5' untranslated region of mRNA encoded by LOC147071, corresponding to a target binding site such as BINDING SITE I, BINDING SITE II or BINDING SITE III of FIG. 8. Table 4 illustrates the complementarity of the nucleotide sequences of LOC147071 BINDING SITE, designated SEQ ID:1525, to the nucleotide sequence of GAM7052 RNA, herein designated GAM RNA, also designated SEQ ID:296.

Another function of GAM7052 is therefore inhibition of LOC147071 (Accession XP_054031.5). Accordingly, utilities of GAM7052 include diagnosis, prevention and treatment of diseases and clinical conditions associated with LOC147071.

LOC147166 (Accession XP_085722.2) is another GAM7052 target gene, herein designated TARGET GENE. LOC147166 BINDING SITE is a target binding site found in the 3' untranslated region of mRNA encoded by LOC147166, corresponding to a target binding site such as BINDING SITE I, BINDING SITE II or BINDING SITE III of FIG. 8. Table 4 illustrates the complementarity of the nucleotide sequences of LOC147166 BINDING SITE, designated SEQ ID:3032, to the nucleotide sequence of GAM7052 RNA, herein designated GAM RNA, also designated SEQ ID:296.

Another function of GAM7052 is therefore inhibition of LOC147166 (Accession XP_085722.2). Accordingly, utilities of GAM7052 include diagnosis, prevention and treatment of diseases and clinical conditions associated with LOC147166.

LOC147791 (Accession XP_097293.2) is another GAM7052 target gene, herein designated TARGET GENE. LOC147791 BINDING SITE is a target binding site found in the 5' untranslated region of mRNA encoded by LOC147791, corresponding to a target binding site such as BINDING SITE I, BINDING SITE II or BINDING SITE III of FIG. 8. Table 4 illustrates the complementarity of the nucleotide sequences of LOC147791 BINDING SITE, designated SEQ ID:8528, to the nucleotide sequence of GAM7052 RNA, herein designated GAM RNA, also designated SEQ ID:296.

Another function of GAM7052 is therefore inhibition of LOC147791 (Accession XP_097293.2). Accordingly, utilities of GAM7052 include diagnosis, prevention and treatment of diseases and clinical conditions associated with LOC147791.

LOC147817 (Accession XP_085903.1) is another GAM7052 target gene, herein designated TARGET GENE. LOC147817 BINDING SITE1 and LOC147817 BINDING SITE2 are target binding sites found in untranslated regions of mRNA encoded by LOC147817, corresponding to target binding sites such as BINDING SITE I, BINDING SITE II or BINDING SITE III of FIG. 8. Table 4 illustrates the complementarity of the nucleotide sequences of LOC147817 BINDING SITE1 and LOC147817 BINDING SITE2, designated SEQ ID:18468 and SEQ ID:16859 respectively, to the nucleotide sequence of GAM7052 RNA, herein designated GAM RNA, also designated SEQ ID:296.

Another function of GAM7052 is therefore inhibition of LOC147817 (Accession XP_085903.1). Accordingly, utilities of GAM7052 include diagnosis, prevention and treatment of diseases and clinical conditions associated with LOC147817.

LOC147841 (Accession XP_085924.2) is another GAM7052 target gene, herein designated TARGET GENE. LOC147841 BINDING SITE1 and LOC147841 BINDING SITE2 are target binding sites found in untranslated regions of mRNA encoded by LOC147841, corresponding to target binding sites such as BINDING SITE I, BINDING SITE II or BINDING SITE III of FIG. 8. Table 4 illustrates the complementarity of the nucleotide sequences of LOC147841 BINDING SITE1 and LOC147841 BINDING SITE2, designated SEQ ID:8527 and SEQ ID:2989 respectively, to the nucleotide sequence of GAM7052 RNA, herein designated GAM RNA, also designated SEQ ID:296.

Another function of GAM7052 is therefore inhibition of LOC147841 (Accession XP_085924.2). Accordingly, utilities of GAM7052 include diagnosis, prevention and treatment of diseases and clinical conditions associated with LOC147841.

LOC148198 (Accession XP_047554.4) is another GAM7052 target gene, herein designated TARGET GENE. LOC148198 BINDING SITE is a target binding site found in the 3' untranslated region of mRNA encoded by LOC148198, corresponding to a target binding site such as BINDING SITE I, BINDING SITE II or BINDING SITE III of FIG. 8. Table 4 illustrates the complementarity of the nucleotide sequences of LOC148198 BINDING SITE, designated SEQ ID:16957, to the nucleotide sequence of GAM7052 RNA, herein designated GAM RNA, also designated SEQ ID:296.

Another function of GAM7052 is therefore inhibition of LOC148198 (Accession XP_047554.4). Accordingly, utilities of GAM7052 include diagnosis, prevention and treatment of diseases and clinical conditions associated with LOC148198.

LOC148203 (Accession XP_086095.1) is another GAM7052 target gene, herein designated TARGET GENE. LOC148203 BINDING SITE is a target binding site found in the 3' untranslated region of mRNA encoded by LOC148203, corresponding to a target binding site such as BINDING SITE I, BINDING SITE II or BINDING SITE III of FIG. 8. Table 4 illustrates the complementarity of the nucleotide sequences of LOC148203 BINDING SITE, designated SEQ ID:2820, to the nucleotide sequence of GAM7052 RNA, herein designated GAM RNA, also designated SEQ ID:296.

Another function of GAM7052 is therefore inhibition of LOC148203 (Accession XP_086095.1). Accordingly, utilities of GAM7052 include diagnosis, prevention and treatment of diseases and clinical conditions associated with LOC148203.

LOC149466 (Accession XP_086546.1) is another GAM7052 target gene, herein designated TARGET GENE. LOC149466 BINDING SITE is a target binding site found in the 3' untranslated region of mRNA encoded by LOC149466, corresponding to a target binding site such as BINDING SITE I, BINDING SITE II or BINDING SITE III of FIG. 8. Table 4 illustrates the complementarity of the nucleotide sequences of LOC149466 BINDING SITE, designated SEQ ID:19862, to the nucleotide sequence of GAM7052 RNA, herein designated GAM RNA, also designated SEQ ID:296.

Another function of GAM7052 is therefore inhibition of LOC149466 (Accession XP_086546.1). Accordingly, utilities of GAM7052 include diagnosis, prevention and treatment of diseases and clinical conditions associated with LOC149466.

LOC149478 (Accession XP_086536.1) is another GAM7052 target gene, herein designated TARGET GENE. LOC149478 BINDING SITE is a target binding site found in the 3' untranslated region of mRNA encoded by LOC149478, corresponding to a target binding site such as BINDING SITE I, BINDING SITE II or BINDING SITE III of FIG. 8. Table 4 illustrates the complementarity of the nucleotide sequences of LOC149478 BINDING SITE, designated SEQ ID:4344, to the nucleotide sequence of GAM7052 RNA, herein designated GAM RNA, also designated SEQ ID:296.

Another function of GAM7052 is therefore inhibition of LOC149478 (Accession XP_086536.1). Accordingly, utilities of GAM7052 include diagnosis, prevention and treatment of diseases and clinical conditions associated with LOC149478.

LOC149506 (Accession XP_097661.1) is another GAM7052 target gene, herein designated TARGET GENE. LOC149506 BINDING SITE1 and LOC149506 BINDING SITE2 are target binding sites found in untranslated regions of mRNA encoded by LOC149506, corresponding to target binding sites such as BINDING SITE I, BINDING SITE II or BINDING SITE III of FIG. 8. Table 4 illustrates the complementarity of the nucleotide sequences of LOC149506 BINDING SITE1 and LOC149506 BINDING SITE2, designated SEQ ID:15681 and SEQ ID:12482 respectively, to the nucleotide sequence of GAM7052 RNA, herein designated GAM RNA, also designated SEQ ID:296.

Another function of GAM7052 is therefore inhibition of LOC149506 (Accession XP_097661.1). Accordingly, utilities of GAM7052 include diagnosis, prevention and treatment of diseases and clinical conditions associated with LOC149506.

LOC149692 (Accession XP_097706.1) is another GAM7052 target gene, herein designated TARGET GENE. LOC149692 BINDING SITE is a target binding site found in the 3' untranslated region of mRNA encoded by LOC149692, corresponding to a target binding site such as BINDING SITE I, BINDING SITE II or BINDING SITE III of FIG. 8. Table 4 illustrates the complementarity of the nucleotide sequences of LOC149692 BINDING SITE, designated SEQ ID:12440, to the nucleotide sequence of GAM7052 RNA, herein designated GAM RNA, also designated SEQ ID:296.

Another function of GAM7052 is therefore inhibition of LOC149692 (Accession XP_097706.1). Accordingly, utilities of GAM7052 include diagnosis, prevention and treatment of diseases and clinical conditions associated with LOC149692.

LOC150054 (Accession XP_097797.1) is another GAM7052 target gene, herein designated TARGET GENE. LOC150054 BINDING SITE is a target binding site found in the 5' untranslated region of mRNA encoded by LOC150054, corresponding to a target binding site such as BINDING SITE I, BINDING SITE II or BINDING SITE III of FIG. 8. Table 4 illustrates the complementarity of the nucleotide sequences of LOC150054 BINDING SITE, designated SEQ ID:3913, to the nucleotide sequence of GAM7052 RNA, herein designated GAM RNA, also designated SEQ ID:296.

Another function of GAM7052 is therefore inhibition of LOC150054 (Accession XP_097797.1). Accordingly, utilities of GAM7052 include diagnosis, prevention and treatment of diseases and clinical conditions associated with LOC150054.

LOC150225 (Accession XP_097870.1) is another GAM7052 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:5964, to the nucleotide sequence of GAM7052 RNA, herein designated GAM RNA, also designated SEQ ID:296.

Another function of GAM7052 is therefore inhibition of LOC150225 (Accession XP_097870.1). Accordingly, utilities of GAM7052 include diagnosis, prevention and treatment of diseases and clinical conditions associated with LOC150225.

LOC150282 (Accession XP_086852.1) is another GAM7052 target gene, herein designated TARGET GENE. LOC150282 BINDING SITE is a target binding site found in the 5' untranslated region of mRNA encoded by LOC150282, corresponding to a target binding site such as BINDING SITE I, BINDING SITE II or BINDING SITE III of FIG. 8. Table 4 illustrates the complementarity of the nucleotide sequences of LOC150282 BINDING SITE, designated SEQ ID:9847, to the nucleotide sequence of GAM7052 RNA, herein designated GAM RNA, also designated SEQ ID:296.

Another function of GAM7052 is therefore inhibition of LOC150282 (Accession XP_086852.1). Accordingly, utilities of GAM7052 include diagnosis, prevention and treatment of diseases and clinical conditions associated with LOC150282.

LOC150397 (Accession XP_086907.1) is another GAM7052 target gene, herein designated TARGET GENE. LOC150397 BINDING SITE is a target binding site found in the 3' untranslated region of mRNA encoded by LOC150397, corresponding to a target binding site such as BINDING SITE I, BINDING SITE II or BINDING SITE III of FIG. 8. Table 4 illustrates the complementarity of the nucleotide sequences of LOC150397 BINDING SITE, designated SEQ ID:11386, to the nucleotide sequence of GAM7052 RNA, herein designated GAM RNA, also designated SEQ ID:296.

Another function of GAM7052 is therefore inhibition of LOC150397 (Accession XP_086907.1). Accordingly, utilities of GAM7052 include diagnosis, prevention and treatment of diseases and clinical conditions associated with LOC150397.

LOC150587 (Accession XP_097917.1) is another GAM7052 target gene, herein designated TARGET GENE. LOC150587 BINDING SITE is a target binding site found in the 5' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:9025, to the nucleotide sequence of GAM7052 RNA, herein designated GAM RNA, also designated SEQ ID:296.

Another function of GAM7052 is therefore inhibition of LOC150587 (Accession XP_097917.1). Accordingly, utilities of GAM7052 include diagnosis, prevention and treatment of diseases and clinical conditions associated with LOC150587.

LOC151057 (Accession XP_097998.1) is another GAM7052 target gene, herein designated TARGET GENE. LOC151057 BINDING SITE is a target binding site found in the 3' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:14936, to the nucleotide sequence of GAM7052 RNA, herein designated GAM RNA, also designated SEQ ID:296.

Another function of GAM7052 is therefore inhibition of LOC151057 (Accession XP_097998.1). Accordingly, utilities of GAM7052 include diagnosis, prevention and treatment of diseases and clinical conditions associated with LOC151057.

LOC151475 (Accession XP_098063.1) is another GAM7052 target gene, herein designated TARGET GENE. LOC151475 BINDING SITE is a target binding site found in the 5' untranslated region of mRNA encoded by LOC151475, corresponding to a target binding site such as BINDING SITE I, BINDING SITE II or BINDING SITE III of FIG. 8. Table 4 illustrates the complementarity of the nucleotide sequences of LOC151475 BINDING SITE, designated SEQ ID:6688, to the nucleotide sequence of GAM7052 RNA, herein designated GAM RNA, also designated SEQ ID:296.

Another function of GAM7052 is therefore inhibition of LOC151475 (Accession XP_098063.1). Accordingly, utilities of GAM7052 include diagnosis, prevention and treatment of diseases and clinical conditions associated with LOC151475.

LOC151636 (Accession NP_612144.1) is another GAM7052 target gene, herein designated TARGET GENE. LOC151636 BINDING SITE is a target binding site found in the 3' untranslated region of mRNA encoded by LOC151636, corresponding to a target binding site such as BINDING SITE I, BINDING SITE II or BINDING SITE III of FIG. 8. Table 4 illustrates the complementarity of the nucleotide sequences of LOC151636 BINDING SITE, designated SEQ ID:7366, to the nucleotide sequence of GAM7052 RNA, herein designated GAM RNA, also designated SEQ ID:296.

Another function of GAM7052 is therefore inhibition of LOC151636 (Accession NP_612144.1). Accordingly, utilities of GAM7052 include diagnosis, prevention and treatment of diseases and clinical conditions associated with LOC151636.

LOC152620 (Accession XP_011108.2) is another GAM7052 target gene, herein designated TARGET GENE. LOC152620 BINDING SITE is a target binding site found in the 3' untranslated region of mRNA encoded by LOC152620, corresponding to a target binding site such as BINDING SITE I, BINDING SITE II or BINDING SITE III of FIG. 8. Table 4 illustrates the complementarity of the nucleotide sequences of LOC152620 BINDING SITE, designated SEQ ID:11229, to the nucleotide sequence of GAM7052 RNA, herein designated GAM RNA, also designated SEQ ID:296.

Another function of GAM7052 is therefore inhibition of LOC152620 (Accession XP_011108.2). Accordingly, utilities of GAM7052 include diagnosis, prevention and treatment of diseases and clinical conditions associated with LOC152620.

LOC152667 (Accession XP_087500.1) is another GAM7052 target gene, herein designated TARGET GENE. LOC152667 BINDING SITE is a target binding site found in the 5' untranslated region of mRNA encoded by LOC152667, corresponding to a target binding site such as BINDING SITE I, BINDING SITE II or BINDING SITE III of FIG. 8. Table 4 illustrates the complementarity of the nucleotide sequences of LOC152667 BINDING SITE, designated SEQ ID:5099, to the nucleotide sequence of GAM7052 RNA, herein designated GAM RNA, also designated SEQ ID:296.

Another function of GAM7052 is therefore inhibition of LOC152667 (Accession XP_087500.1). Accordingly, utilities of GAM7052 include diagnosis, prevention and treatment of diseases and clinical conditions associated with LOC152667.

LOC152719 (Accession XP_098257.1) is another GAM7052 target gene, herein designated TARGET GENE. LOC152719 BINDING SITE1 and LOC152719 BINDING SITE2 are target binding sites found in untranslated regions of mRNA encoded by LOC152719, corresponding to target binding sites such as BINDING SITE I, BINDING SITE II or BINDING SITE III of FIG. 8. Table 4 illustrates the complementarity of the nucleotide sequences of LOC152719 BINDING SITE1 and LOC152719 BINDING SITE2, designated SEQ ID:726 and SEQ ID:14742 respectively, to the nucleotide sequence of GAM7052 RNA, herein designated GAM RNA, also designated SEQ ID:296.

Another function of GAM7052 is therefore inhibition of LOC152719 (Accession XP_098257.1). Accordingly, utilities of GAM7052 include diagnosis, prevention and treatment of diseases and clinical conditions associated with LOC152719.

LOC152804 (Accession XP_098266.2) is another GAM7052 target gene, herein designated TARGET GENE. LOC152804 BINDING SITE is a target binding site found in the 3' untranslated region of mRNA encoded by LOC152804, corresponding to a target binding site such as BINDING SITE I, BINDING SITE II or BINDING SITE III of FIG. 8. Table 4 illustrates the complementarity of the nucleotide sequences of LOC152804 BINDING SITE, designated SEQ ID:2898, to the nucleotide sequence of GAM7052 RNA, herein designated GAM RNA, also designated SEQ ID:296.

Another function of GAM7052 is therefore inhibition of LOC152804 (Accession XP_098266.2). Accordingly, utilities of GAM7052 include diagnosis, prevention and treatment of diseases and clinical conditions associated with LOC152804.

LOC153077 (Accession XP_098307.1) is another GAM7052 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:4990, to the nucleotide sequence of GAM7052 RNA, herein designated GAM RNA, also designated SEQ ID:296.

Another function of GAM7052 is therefore inhibition of LOC153077 (Accession XP_098307.1). Accordingly, utilities of GAM7052 include diagnosis, prevention and treatment of diseases and clinical conditions associated with LOC153077.

LOC154282 (Accession XP_098505.1) is another GAM7052 target gene, herein designated TARGET GENE. LOC154282 BINDING SITE is a target binding site found in the 5' untranslated region of mRNA encoded by LOC154282, corresponding to a target binding site such as BINDING SITE I, BINDING SITE II or BINDING SITE III of FIG. 8. Table 4 illustrates the complementarity of the nucleotide sequences of LOC154282 BINDING SITE, designated SEQ ID:19732, to the nucleotide sequence of GAM7052 RNA, herein designated GAM RNA, also designated SEQ ID:296.

Another function of GAM7052 is therefore inhibition of LOC154282 (Accession XP_098505.1). Accordingly, utilities of GAM7052 include diagnosis, prevention and treatment of diseases and clinical conditions associated with LOC154282.

LOC154739 (Accession XP_098602.1) is another GAM7052 target gene, herein designated TARGET GENE. LOC154739 BINDING SITE is a target binding site found in the 3' untranslated region of mRNA encoded by LOC154739, corresponding to a target binding site such as BINDING SITE I, BINDING SITE II or BINDING SITE III of FIG. 8. Table 4 illustrates the complementarity of the nucleotide sequences of LOC154739 BINDING SITE, designated SEQ ID:16887, to the nucleotide sequence of GAM7052 RNA, herein designated GAM RNA, also designated SEQ ID:296.

Another function of GAM7052 is therefore inhibition of LOC154739 (Accession XP_098602.1). Accordingly, utilities of GAM7052 include diagnosis, prevention and treatment of diseases and clinical conditions associated with LOC154739.

LOC154822 (Accession XP_098618.3) is another GAM7052 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:1649, to the nucleotide sequence of GAM7052 RNA, herein designated GAM RNA, also designated SEQ ID:296.

Another function of GAM7052 is therefore inhibition of LOC154822 (Accession XP_098618.3). Accordingly, utilities of GAM7052 include diagnosis, prevention and treatment of diseases and clinical conditions associated with LOC154822.

LOC154866 (Accession XP_088059.1) is another GAM7052 target gene, herein designated TARGET GENE. LOC154866 BINDING SITE is a target binding site found in the 3' untranslated region of mRNA encoded by LOC154866, corresponding to a target binding site such as BINDING SITE I, BINDING SITE II or BINDING SITE III of FIG. 8. Table 4 illustrates the complementarity of the nucleotide sequences of LOC154866 BINDING SITE, designated SEQ ID:17476, to the nucleotide sequence of GAM7052 RNA, herein designated GAM RNA, also designated SEQ ID:296.

Another function of GAM7052 is therefore inhibition of LOC154866 (Accession XP_088059.1). Accordingly, utilities of GAM7052 include diagnosis, prevention and treatment of diseases and clinical conditions associated with LOC154866.

LOC154877 (Accession XP_098626.1) is another GAM7052 target gene, herein designated TARGET GENE. LOC154877 BINDING SITE1 through LOC154877 BINDING SITE3 are target binding sites found in untranslated regions of mRNA encoded by LOC154877, corresponding to target binding sites such as BINDING SITE I, BINDING SITE II or BINDING SITE III of FIG. 8. Table 4 illustrates the complementarity of the nucleotide sequences of LOC154877 BINDING SITE1 through LOC154877 BINDING SITE3, designated SEQ ID:14460, SEQ ID:19863 and SEQ ID:2182 respectively, to the nucleotide sequence of GAM7052 RNA, herein designated GAM RNA, also designated SEQ ID:296.

Another function of GAM7052 is therefore inhibition of LOC154877 (Accession XP_098626.1). Accordingly, utilities of GAM7052 include diagnosis, prevention and treatment of diseases and clinical conditions associated with LOC154877.

LOC157531 (Accession XP_212210.1) is another GAM7052 target gene, herein designated TARGET GENE. LOC157531 BINDING SITE is a target binding site found in the 5' untranslated region of multiple transcripts of mRNA encoded by LOC157531, corresponding to a target binding site such as BINDING SITE I, BINDING SITE II or BINDING SITE III of FIG. 8. Table 4 illustrates the complementarity of the nucleotide sequences of LOC157531 BINDING SITE, designated SEQ ID:1954, to the nucleotide sequence of GAM7052 RNA, herein designated GAM RNA, also designated SEQ ID:296.

Another function of GAM7052 is therefore inhibition of LOC157531 (Accession XP_212210.1). Accordingly, utilities of GAM7052 include diagnosis, prevention and treatment of diseases and clinical conditions associated with LOC157531.

LOC157858 (Accession XP_098833.2) is another GAM7052 target gene, herein designated TARGET GENE. LOC157858 BINDING SITE is a target binding site found in the 5' untranslated region of mRNA encoded by LOC157858, corresponding to a target binding site such as BINDING SITE I, BINDING SITE II or BINDING SITE III of FIG. 8. Table 4 illustrates the complementarity of the nucleotide sequences of LOC157858 BINDING SITE, designated SEQ ID:6270, to the nucleotide sequence of GAM7052 RNA, herein designated GAM RNA, also designated SEQ ID:296.

Another function of GAM7052 is therefore inhibition of LOC157858 (Accession XP_098833.2). Accordingly, utilities of GAM7052 include diagnosis, prevention and treatment of diseases and clinical conditions associated with LOC157858.

LOC158436 (Accession XP_098942.1) is another GAM7052 target gene, herein designated TARGET GENE. LOC158436 BINDING SITE is a target binding site found in the 3' untranslated region of mRNA encoded by LOC158436, corresponding to a target binding site such as BINDING SITE I, BINDING SITE II or BINDING SITE III of FIG. 8. Table 4 illustrates the complementarity of the nucleotide sequences of LOC158436 BINDING SITE, designated SEQ ID:14740, to the nucleotide sequence of GAM7052 RNA, herein designated GAM RNA, also designated SEQ ID:296.

Another function of GAM7052 is therefore inhibition of LOC158436 (Accession XP_098942.1). Accordingly, utilities of GAM7052 include diagnosis, prevention and treatment of diseases and clinical conditions associated with LOC158436.

LOC158476 (Accession XP_098955.1) is another GAM7052 target gene, herein designated TARGET GENE. LOC158476 BINDING SITE is a target binding site found in the 3' untranslated region of mRNA encoded by LOC158476, corresponding to a target binding site such as BINDING SITE I, BINDING SITE II or BINDING SITE III of FIG. 8. Table 4 illustrates the complementarity of the nucleotide sequences of LOC158476 BINDING SITE, designated SEQ ID:12099, to the nucleotide sequence of GAM7052 RNA, herein designated GAM RNA, also designated SEQ ID:296.

Another function of GAM7052 is therefore inhibition of LOC158476 (Accession XP_098955.1). Accordingly, utilities of GAM7052 include diagnosis, prevention and treatment of diseases and clinical conditions associated with LOC158476.

LOC158527 (Accession XP_088594.1) is another GAM7052 target gene, herein designated TARGET GENE. LOC158527 BINDING SITE is a target binding site found in the 5' untranslated region of mRNA encoded by LOC158527, corresponding to a target binding site such as BINDING SITE I, BINDING SITE II or BINDING SITE III of FIG. 8. Table 4 illustrates the complementarity of the nucleotide sequences of LOC158527 BINDING SITE, designated SEQ ID:17909, to the nucleotide sequence of GAM7052 RNA, herein designated GAM RNA, also designated SEQ ID:296.

Another function of GAM7052 is therefore inhibition of LOC158527 (Accession XP_088594.1). Accordingly, utilities of GAM7052 include diagnosis, prevention and treatment of diseases and clinical conditions associated with LOC158527.

LOC158668 (Accession XP_045161.1) is another GAM7052 target gene, herein designated TARGET GENE. LOC158668 BINDING SITE is a target binding site found in the 3' untranslated region of mRNA encoded by LOC158668, corresponding to a target binding site such as BINDING SITE I, BINDING SITE II or BINDING SITE III of FIG. 8. Table 4 illustrates the complementarity of the nucleotide sequences of LOC158668 BINDING SITE, designated SEQ ID:14574, to the nucleotide sequence of GAM7052 RNA, herein designated GAM RNA, also designated SEQ ID:296.

Another function of GAM7052 is therefore inhibition of LOC158668 (Accession XP_045161.1). Accordingly, utilities of GAM7052 include diagnosis, prevention and treatment of diseases and clinical conditions associated with LOC158668.

LOC158865 (Accession XP_099000.1) is another GAM7052 target gene, herein designated TARGET GENE. LOC158865 BINDING SITE is a target binding site found in the 5' untranslated region of mRNA encoded by LOC158865, corresponding to a target binding site such as BINDING SITE I, BINDING SITE II or BINDING SITE III of FIG. 8. Table 4 illustrates the complementarity of the nucleotide sequences of LOC158865 BINDING SITE, designated SEQ ID:4005, to the nucleotide sequence of GAM7052 RNA, herein designated GAM RNA, also designated SEQ ID:296.

Another function of GAM7052 is therefore inhibition of LOC158865 (Accession XP_099000.1). Accordingly, utilities of GAM7052 include diagnosis, prevention and treatment of diseases and clinical conditions associated with LOC158865.

LOC160897 (Accession XP_090573.3) is another GAM7052 target gene, herein designated TARGET GENE. LOC160897 BINDING SITE is a target binding site found in the 5' untranslated region of mRNA encoded by LOC160897, corresponding to a target binding site such as BINDING SITE I, BINDING SITE II or BINDING SITE III of FIG. 8. Table 4 illustrates the complementarity of the nucleotide sequences of LOC160897 BINDING SITE, designated SEQ ID:15778, to the nucleotide sequence of GAM7052 RNA, herein designated GAM RNA, also designated SEQ ID:296.

Another function of GAM7052 is therefore inhibition of LOC160897 (Accession XP_090573.3). Accordingly, utilities of GAM7052 include diagnosis, prevention and treatment of diseases and clinical conditions associated with LOC160897.

LOC162967 (Accession XP_091890.6) is another GAM7052 target gene, herein designated TARGET GENE. LOC162967 BINDING SITE is a target binding site found in the 3' untranslated region of mRNA encoded by LOC162967, corresponding to a target binding site such as BINDING SITE I, BINDING SITE II or BINDING SITE III of FIG. 8. Table 4 illustrates the complementarity of the nucleotide sequences of LOC162967 BINDING SITE, designated SEQ ID:15400, to the nucleotide sequence of GAM7052 RNA, herein designated GAM RNA, also designated SEQ ID:296.

Another function of GAM7052 is therefore inhibition of LOC162967 (Accession XP_091890.6). Accordingly, utilities of GAM7052 include diagnosis, prevention and treatment of diseases and clinical conditions associated with LOC162967.

LOC162993 (Accession XP_091914.2) is another GAM7052 target gene, herein designated TARGET GENE. LOC162993 BINDING SITE is a target binding site found in the 3' untranslated region of mRNA encoded by LOC162993, corresponding to a target binding site such as BINDING SITE I, BINDING SITE II or BINDING SITE III of FIG. 8. Table 4 illustrates the complementarity of the nucleotide sequences of LOC162993 BINDING SITE, designated SEQ ID:16333, to the nucleotide sequence of GAM7052 RNA, herein designated GAM RNA, also designated SEQ ID:296.

Another function of GAM7052 is therefore inhibition of LOC162993 (Accession XP_091914.2). Accordingly, utilities of GAM7052 include diagnosis, prevention and treatment of diseases and clinical conditions associated with LOC162993.

LOC163227 (Accession NP_775802.1) is another GAM7052 target gene, herein designated TARGET GENE. LOC163227 BINDING SITE1 and LOC163227 BINDING SITE2 are target binding sites found in untranslated regions of mRNA encoded by LOC163227, corresponding to target binding sites such as BINDING SITE I, BINDING SITE II or BINDING SITE III of FIG. 8. Table 4 illustrates the complementarity of the nucleotide sequences of LOC163227 BINDING SITE1 and LOC163227 BINDING SITE2, designated SEQ ID:12740 and SEQ ID:12735 respectively, to the nucleotide sequence of GAM7052 RNA, herein designated GAM RNA, also designated SEQ ID:296.

Another function of GAM7052 is therefore inhibition of LOC163227 (Accession NP_775802.1). Accordingly, utilities of GAM7052 include diagnosis, prevention and treatment of diseases and clinical conditions associated with LOC163227.

LOC164091 (Accession XP_089356.1) is another GAM7052 target gene, herein designated TARGET GENE. LOC164091 BINDING SITE1 and LOC164091 BINDING SITE2 are target binding sites found in untranslated regions of mRNA encoded by LOC164091, corresponding to target binding sites such as BINDING SITE I, BINDING SITE II or BINDING SITE III of FIG. 8. Table 4 illustrates the complementarity of the nucleotide sequences of LOC164091 BINDING SITE1 and LOC164091 BINDING SITE2, designated SEQ ID:8838 and SEQ ID:7689 respectively, to the nucleotide sequence of GAM7052 RNA, herein designated GAM RNA, also designated SEQ ID:296.

Another function of GAM7052 is therefore inhibition of LOC164091 (Accession XP_089356.1). Accordingly, utilities of GAM7052 include diagnosis, prevention and treatment of diseases and clinical conditions associated with LOC164091.

LOC168451 (Accession XP_095114.2) is another GAM7052 target gene, herein designated TARGET GENE. LOC168451 BINDING SITE is a target binding site found in the 3' untranslated region of mRNA encoded by LOC168451, corresponding to a target binding site such as BINDING SITE I, BINDING SITE II or BINDING SITE III of FIG. 8. Table 4 illustrates the complementarity of the nucleotide sequences of LOC168451 BINDING SITE, designated SEQ ID:17863, to the nucleotide sequence of GAM7052 RNA, herein designated GAM RNA, also designated SEQ ID:296.

Another function of GAM7052 is therefore inhibition of LOC168451 (Accession XP_095114.2). Accordingly, utilities of GAM7052 include diagnosis, prevention and treatment of diseases and clinical conditions associated with LOC168451.

LOC169611 (Accession XP_095809.4) is another GAM7052 target gene, herein designated TARGET GENE. LOC169611 BINDING SITE is a target binding site found in the 3' untranslated region of mRNA encoded by LOC169611, corresponding to a target binding site such as BINDING SITE I, BINDING SITE II or BINDING SITE III of FIG. 8. Table 4 illustrates the complementarity of the nucleotide sequences of LOC169611 BINDING SITE, designated SEQ ID:11251, to the nucleotide sequence of GAM7052 RNA, herein designated GAM RNA, also designated SEQ ID:296.

Another function of GAM7052 is therefore inhibition of LOC169611 (Accession XP_095809.4). Accordingly, utilities of GAM7052 include diagnosis, prevention and treatment of diseases and clinical conditions associated with LOC169611.

LOC196264 (Accession XP_113683.1) is another GAM7052 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:2824, to the nucleotide sequence of GAM7052 RNA, herein designated GAM RNA, also designated SEQ ID:296.

Another function of GAM7052 is therefore inhibition of LOC196264 (Accession XP_113683.1). Accordingly, utilities of GAM7052 include diagnosis, prevention and treatment of diseases and clinical conditions associated with LOC196264.

LOC199725 (Accession XP_117119.1) is another GAM7052 target gene, herein designated TARGET GENE. LOC199725 BINDING SITE is a target binding site found in the 5' untranslated region of mRNA encoded by LOC199725, corresponding to a target binding site such as BINDING SITE I, BINDING SITE II or BINDING SITE III of FIG. 8. Table 4 illustrates the complementarity of the nucleotide sequences of LOC199725 BINDING SITE, designated SEQ ID:9306, to the nucleotide sequence of GAM7052 RNA, herein designated GAM RNA, also designated SEQ ID:296.

Another function of GAM7052 is therefore inhibition of LOC199725 (Accession XP_117119.1). Accordingly, utilities of GAM7052 include diagnosis, prevention and treatment of diseases and clinical conditions associated with LOC199725.

LOC199858 (Accession XP_114040.1) is another GAM7052 target gene, herein designated TARGET GENE. LOC199858 BINDING SITE is a target binding site found in the 5' untranslated region of mRNA encoded by LOC199858, corresponding to a target binding site such as BINDING SITE I, BINDING SITE II or BINDING SITE III of FIG. 8. Table 4 illustrates the complementarity of the nucleotide sequences of LOC199858 BINDING SITE, designated SEQ ID:1343, to the nucleotide sequence of GAM7052 RNA, herein designated GAM RNA, also designated SEQ ID:296.

Another function of GAM7052 is therefore inhibition of LOC199858 (Accession XP_114040.1). Accordingly, utilities of GAM7052 include diagnosis, prevention and treatment of diseases and clinical conditions associated with LOC199858.

LOC199899 (Accession XP_117153.1) is another GAM7052 target gene, herein designated TARGET GENE. LOC199899 BINDING SITE is a target binding site found in the 5' untranslated region of mRNA encoded by LOC199899, corresponding to a target binding site such as BINDING SITE I, BINDING SITE II or BINDING SITE III of FIG. 8. Table 4 illustrates the complementarity of the nucleotide sequences of LOC199899 BINDING SITE, designated SEQ ID:9143, to the nucleotide sequence of GAM7052 RNA, herein designated GAM RNA, also designated SEQ ID:296.

Another function of GAM7052 is therefore inhibition of LOC199899 (Accession XP_117153.1). Accordingly, utilities of GAM7052 include diagnosis, prevention and treatment of diseases and clinical conditions associated with LOC199899.

LOC200339 (Accession XP_117226.1) is another GAM7052 target gene, herein designated TARGET GENE. LOC200339 BINDING SITE is a target binding site found in the 3' untranslated region of mRNA encoded by LOC200339, corresponding to a target binding site such as BINDING SITE I, BINDING SITE II or BINDING SITE III of FIG. 8. Table 4 illustrates the complementarity of the nucleotide sequences of LOC200339 BINDING SITE, designated SEQ ID:12277, to the nucleotide sequence of GAM7052 RNA, herein designated GAM RNA, also designated SEQ ID:296.

Another function of GAM7052 is therefore inhibition of LOC200339 (Accession XP_117226.1). Accordingly, utilities of GAM7052 include diagnosis, prevention and treatment of diseases and clinical conditions associated with LOC200339.

LOC200491 (Accession XP_117239.1) is another GAM7052 target gene, herein designated TARGET GENE. LOC200491 BINDING SITE is a target binding site found in the 5' untranslated region of mRNA encoded by LOC200491, corresponding to a target binding site such as BINDING SITE I, BINDING SITE II or BINDING SITE III of FIG. 8. Table 4 illustrates the complementarity of the nucleotide sequences of LOC200491 BINDING SITE, designated SEQ ID:11368, to the nucleotide sequence of GAM7052 RNA, herein designated GAM RNA, also designated SEQ ID:296.

Another function of GAM7052 is therefore inhibition of LOC200491 (Accession XP_117239.1). Accordingly, utilities of GAM7052 include diagnosis, prevention and treatment of diseases and clinical conditions associated with LOC200491.

LOC201164 (Accession XP_290750.1) is another GAM7052 target gene, herein designated TARGET GENE. LOC201164 BINDING SITE is a target binding site found in the 3' untranslated region of multiple transcripts of mRNA encoded by LOC201164, corresponding to a target binding site such as BINDING SITE I, BINDING SITE II or BINDING SITE III of FIG. 8. Table 4 illustrates the complementarity of the nucleotide sequences of LOC201164 BINDING SITE, designated SEQ ID:3032, to the nucleotide sequence of GAM7052 RNA, herein designated GAM RNA, also designated SEQ ID:296.

Another function of GAM7052 is therefore inhibition of LOC201164 (Accession XP_290750.1). Accordingly, utilities of GAM7052 include diagnosis, prevention and treatment of diseases and clinical conditions associated with LOC201164.

LOC201164 (Accession NP_849158.1) is another GAM7052 target gene, herein designated TARGET GENE. LOC201164 BINDING SITE is a target binding site found in the 3' untranslated region of multiple transcripts of mRNA encoded by LOC201164, corresponding to a target binding site such as BINDING SITE I, BINDING SITE II or BINDING SITE III of FIG. 8. Table 4 illustrates the complementarity of the nucleotide sequences of LOC201164 BINDING SITE, designated SEQ ID:3032, to the nucleotide sequence of GAM7052 RNA, herein designated GAM RNA, also designated SEQ ID:296.

Another function of GAM7052 is therefore inhibition of LOC201164 (Accession NP_849158.1). Accordingly, utilities of GAM7052 include diagnosis, prevention and treatment of diseases and clinical conditions associated with LOC201164.

LOC201292 (Accession NP_775818.1) is another GAM7052 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:9524, to the nucleotide sequence of GAM7052 RNA, herein designated GAM RNA, also designated SEQ ID:296.

Another function of GAM7052 is therefore inhibition of LOC201292 (Accession NP_775818.1). Accordingly, utilities of GAM7052 include diagnosis, prevention and treatment of diseases and clinical conditions associated with LOC201292.

LOC201562 (Accession XP_114343.2) is another GAM7052 target gene, herein designated TARGET GENE. LOC201562 BINDING SITE is a target binding site found in the 3' untranslated region of mRNA encoded by LOC201562, corresponding to a target binding site such as BINDING SITE I, BINDING SITE II or BINDING SITE III of FIG. 8. Table 4 illustrates the complementarity of the nucleotide sequences of LOC201562 BINDING SITE, designated SEQ ID:16775, to the nucleotide sequence of GAM7052 RNA, herein designated GAM RNA, also designated SEQ ID:296.

Another function of GAM7052 is therefore inhibition of LOC201562 (Accession XP_114343.2). Accordingly, utilities of GAM7052 include diagnosis, prevention and treatment of diseases and clinical conditions associated with LOC201562.

LOC202400 (Accession XP_117397.1) is another GAM7052 target gene, herein designated TARGET GENE. LOC202400 BINDING SITE is a target binding site found in the 5' untranslated region of mRNA encoded by LOC202400, corresponding to a target binding site such as BINDING SITE I, BINDING SITE II or BINDING SITE III of FIG. 8. Table 4 illustrates the complementarity of the nucleotide sequences of LOC202400 BINDING SITE, designated SEQ ID:9253, to the nucleotide sequence of GAM7052 RNA, herein designated GAM RNA, also designated SEQ ID:296.

Another function of GAM7052 is therefore inhibition of LOC202400 (Accession XP_117397.1). Accordingly, utilities of GAM7052 include diagnosis, prevention and treatment of diseases and clinical conditions associated with LOC202400.

LOC202934 (Accession XP_117486.2) is another GAM7052 target gene, herein designated TARGET GENE. LOC202934 BINDING SITE is a target binding site found in the 3' untranslated region of mRNA encoded by LOC202934, corresponding to a target binding site such as BINDING SITE I, BINDING SITE II or BINDING SITE III of FIG. 8. Table 4 illustrates the complementarity of the nucleotide sequences of LOC202934 BINDING SITE, designated SEQ ID:18974, to the nucleotide sequence of GAM7052 RNA, herein designated GAM RNA, also designated SEQ ID:296.

Another function of GAM7052 is therefore inhibition of LOC202934 (Accession XP_117486.2). Accordingly, utilities of GAM7052 include diagnosis, prevention and treatment of diseases and clinical conditions associated with LOC202934.

LOC219731 (Accession XP_167596.1) is another GAM7052 target gene, herein designated TARGET GENE. LOC219731 BINDING SITE1 and LOC219731 BINDING SITE2 are target binding sites found in untranslated regions of mRNA encoded by LOC219731, corresponding to target binding sites such as BINDING SITE I, BINDING SITE II or BINDING SITE III of FIG. 8. Table 4 illustrates the complementarity of the nucleotide sequences of LOC219731 BINDING SITE1 and LOC219731 BINDING SITE2, designated SEQ ID:5076 and SEQ ID:3064 respectively, to the nucleotide sequence of GAM7052 RNA, herein designated GAM RNA, also designated SEQ ID:296.

Another function of GAM7052 is therefore inhibition of LOC219731 (Accession XP_167596.1). Accordingly, utilities of GAM7052 include diagnosis, prevention and treatment of diseases and clinical conditions associated with LOC219731.

LOC219735 (Accession XP_167601.1) is another GAM7052 target gene, herein designated TARGET GENE. LOC219735 BINDING SITE is a target binding site found in the 3' untranslated region of mRNA encoded by LOC219735, corresponding to a target binding site such as BINDING SITE I, BINDING SITE II or BINDING SITE III of FIG. 8. Table 4 illustrates the complementarity of the nucleotide sequences of LOC219735 BINDING SITE, designated SEQ ID:3029, to the nucleotide sequence of GAM7052 RNA, herein designated GAM RNA, also designated SEQ ID:296.

Another function of GAM7052 is therefore inhibition of LOC219735 (Accession XP_167601.1). Accordingly, utilities of GAM7052 include diagnosis, prevention and treatment of diseases and clinical conditions associated with LOC219735.

LOC220074 (Accession NP_660352.1) is another GAM7052 target gene, herein designated TARGET GENE. LOC220074 BINDING SITE1 and LOC220074 BINDING SITE2 are target binding sites found in untranslated regions of mRNA encoded by LOC220074, corresponding to target binding sites such as BINDING SITE I, BINDING SITE II or BINDING SITE III of FIG. 8. Table 4 illustrates the complementarity of the nucleotide sequences of LOC220074 BINDING SITE1 and LOC220074 BINDING SITE2, designated SEQ ID:14319 and SEQ ID:12482 respectively, to the nucleotide sequence of GAM7052 RNA, herein designated GAM RNA, also designated SEQ ID:296.

Another function of GAM7052 is therefore inhibition of LOC220074 (Accession NP_660352.1). Accordingly, utilities of GAM7052 include diagnosis, prevention and treatment of diseases and clinical conditions associated with LOC220074.

LOC221540 (Accession XP_168133.1) is another GAM7052 target gene, herein designated TARGET GENE. LOC221540 BINDING SITE is a target binding site found in the 3' untranslated region of mRNA encoded by LOC221540, corresponding to a target binding site such as BINDING SITE I, BINDING SITE II or BINDING SITE III of FIG. 8. Table 4 illustrates the complementarity of the nucleotide sequences of LOC221540 BINDING SITE, designated SEQ ID:8853, to the nucleotide sequence of GAM7052 RNA, herein designated GAM RNA, also designated SEQ ID:296.

Another function of GAM7052 is therefore inhibition of LOC221540 (Accession XP_168133.1). Accordingly, utilities of GAM7052 include diagnosis, prevention and treatment of diseases and clinical conditions associated with LOC221540.

LOC221814 (Accession XP_168226.1) is another GAM7052 target gene, herein designated TARGET GENE. LOC221814 BINDING SITE is a target binding site found in the 5' untranslated region of mRNA encoded by LOC221814, corresponding to a target binding site such as BINDING SITE I, BINDING SITE II or BINDING SITE III of FIG. 8. Table 4 illustrates the complementarity of the nucleotide sequences of LOC221814 BINDING SITE, designated SEQ ID:16581, to the nucleotide sequence of GAM7052 RNA, herein designated GAM RNA, also designated SEQ ID:296.

Another function of GAM7052 is therefore inhibition of LOC221814 (Accession XP_168226.1). Accordingly, utilities of GAM7052 include diagnosis, prevention and treatment of diseases and clinical conditions associated with LOC221814.

LOC222068 (Accession XP_166556.1) is another GAM7052 target gene, herein designated TARGET GENE. LOC222068 BINDING SITE is a target binding site found in the 3' untranslated region of mRNA encoded by LOC222068, corresponding to a target binding site such as BINDING SITE I, BINDING SITE II or BINDING SITE III of FIG. 8. Table 4 illustrates the complementarity of the nucleotide sequences of LOC222068 BINDING SITE, designated SEQ ID:1573, to the nucleotide sequence of GAM7052 RNA, herein designated GAM RNA, also designated SEQ ID:296.

Another function of GAM7052 is therefore inhibition of LOC222068 (Accession XP_166556.1). Accordingly, utilities of GAM7052 include diagnosis, prevention and treatment of diseases and clinical conditions associated with LOC222068.

LOC222159 (Accession XP_212100.1) is another GAM7052 target gene, herein designated TARGET GENE. LOC222159 BINDING SITE is a target binding site found in the 5' untranslated region of multiple transcripts of mRNA encoded by LOC222159, corresponding to a target binding site such as BINDING SITE I, BINDING SITE II or BINDING SITE III of FIG. 8. Table 4 illustrates the complementarity of the nucleotide sequences of LOC222159 BINDING SITE, designated SEQ ID:11226, to the nucleotide sequence of GAM7052 RNA, herein designated GAM RNA, also designated SEQ ID:296.

Another function of GAM7052 is therefore inhibition of LOC222159 (Accession XP_212100.1). Accordingly, utilities of GAM7052 include diagnosis, prevention and treatment of diseases and clinical conditions associated with LOC222159.

LOC222224 (Accession XP_168473.1) is another GAM7052 target gene, herein designated TARGET GENE. LOC222224 BINDING SITE is a target binding site found in the 5' untranslated region of mRNA encoded by LOC222224, corresponding to a target binding site such as BINDING SITE I, BINDING SITE II or BINDING SITE III of FIG. 8. Table 4 illustrates the complementarity of the nucleotide sequences of LOC222224 BINDING SITE, designated SEQ ID:9925, to the nucleotide sequence of GAM7052 RNA, herein designated GAM RNA, also designated SEQ ID:296.

Another function of GAM7052 is therefore inhibition of LOC222224 (Accession XP_168473.1). Accordingly, utilities of GAM7052 include diagnosis, prevention and treatment of diseases and clinical conditions associated with LOC222224.

LOC253612 (Accession XP_172985.2) is another GAM7052 target gene, herein designated TARGET GENE. LOC253612 BINDING SITE is a target binding site found in the 5' untranslated region of mRNA encoded by LOC253612, corresponding to a target binding site such as BINDING SITE I, BINDING SITE II or BINDING SITE III of FIG. 8. Table 4 illustrates the complementarity of the nucleotide sequences of LOC253612 BINDING SITE, designated SEQ ID:11867, to the nucleotide sequence of GAM7052 RNA, herein designated GAM RNA, also designated SEQ ID:296.

Another function of GAM7052 is therefore inhibition of LOC253612 (Accession XP_172985.2). Accordingly, utilities of GAM7052 include diagnosis, prevention and treatment of diseases and clinical conditions associated with LOC253612.

LOC253842 (Accession XP_173230.1) is another GAM7052 target gene, herein designated TARGET GENE. LOC253842 BINDING SITE is a target binding site found in the 5' untranslated region of mRNA encoded by LOC253842, corresponding to a target binding site such as BINDING SITE I, BINDING SITE II or BINDING SITE III of FIG. 8. Table 4 illustrates the complementarity of the nucleotide sequences of LOC253842 BINDING SITE, designated SEQ ID:9847, to the nucleotide sequence of GAM7052 RNA, herein designated GAM RNA, also designated SEQ ID:296.

Another function of GAM7052 is therefore inhibition of LOC253842 (Accession XP_173230.1). Accordingly, utilities of GAM7052 include diagnosis, prevention and treatment of diseases and clinical conditions associated with LOC253842.

LOC253981 (Accession XP_171064.1) is another GAM7052 target gene, herein designated TARGET GENE. LOC253981 BINDING SITE1 and LOC253981 BINDING SITE2 are target binding sites found in untranslated regions of mRNA encoded by LOC253981, corresponding to target binding sites such as BINDING SITE I, BINDING SITE II or BINDING SITE III of FIG. 8. Table 4 illustrates the complementarity of the nucleotide sequences of LOC253981 BINDING SITE1 and LOC253981 BINDING SITE2, designated SEQ ID:3391 and SEQ ID:2107 respectively, to the nucleotide sequence of GAM7052 RNA, herein designated GAM RNA, also designated SEQ ID:296.

Another function of GAM7052 is therefore inhibition of LOC253981 (Accession XP_171064.1). Accordingly, utilities of GAM7052 include diagnosis, prevention and treatment of diseases and clinical conditions associated with LOC253981.

LOC254532 (Accession XP_172961.1) is another GAM7052 target gene, herein designated TARGET GENE. LOC254532 BINDING SITE is a target binding site found in the 5' untranslated region of mRNA encoded by LOC254532, corresponding to a target binding site such as BINDING SITE I, BINDING SITE II or BINDING SITE III of FIG. 8. Table 4 illustrates the complementarity of the nucleotide sequences of LOC254532 BINDING SITE, designated SEQ ID:4317, to the nucleotide sequence of GAM7052 RNA, herein designated GAM RNA, also designated SEQ ID:296.

Another function of GAM7052 is therefore inhibition of LOC254532 (Accession XP_172961.1). Accordingly, utilities of GAM7052 include diagnosis, prevention and treatment of diseases and clinical conditions associated with LOC254532.

LOC282905 (Accession XP_212606.1) is another GAM7052 target gene, herein designated TARGET GENE.

LOC282905 BINDING SITE is a target binding site found in the 5' untranslated region of mRNA encoded by LOC282905, corresponding to a target binding site such as BINDING SITE I, BINDING SITE II or BINDING SITE III of FIG. 8. Table 4 illustrates the complementarity of the nucleotide sequences of LOC282905 BINDING SITE, designated SEQ ID:14138, to the nucleotide sequence of GAM7052 RNA, herein designated GAM RNA, also designated SEQ ID:296.

Another function of GAM7052 is therefore inhibition of LOC282905 (Accession XP_212606.1). Accordingly, utilities of GAM7052 include diagnosis, prevention and treatment of diseases and clinical conditions associated with LOC282905.

LOC282916 (Accession XP_212603.1) is another GAM7052 target gene, herein designated TARGET GENE. LOC282916 BINDING SITE is a target binding site found in the 3' untranslated region of mRNA encoded by LOC282916, corresponding to a target binding site such as BINDING SITE I, BINDING SITE II or BINDING SITE III of FIG. 8. Table 4 illustrates the complementarity of the nucleotide sequences of LOC282916 BINDING SITE, designated SEQ ID:8853, to the nucleotide sequence of GAM7052 RNA, herein designated GAM RNA, also designated SEQ ID:296.

Another function of GAM7052 is therefore inhibition of LOC282916 (Accession XP_212603.1). Accordingly, utilities of GAM7052 include diagnosis, prevention and treatment of diseases and clinical conditions associated with LOC282916.

LOC282943 (Accession XP_212647.1) is another GAM7052 target gene, herein designated TARGET GENE. LOC282943 BINDING SITE is a target binding site found in the 5' untranslated region of mRNA encoded by LOC282943, corresponding to a target binding site such as BINDING SITE I, BINDING SITE II or BINDING SITE III of FIG. 8. Table 4 illustrates the complementarity of the nucleotide sequences of LOC282943 BINDING SITE, designated SEQ ID:14138, to the nucleotide sequence of GAM7052 RNA, herein designated GAM RNA, also designated SEQ ID:296.

Another function of GAM7052 is therefore inhibition of LOC282943 (Accession XP_212647.1). Accordingly, utilities of GAM7052 include diagnosis, prevention and treatment of diseases and clinical conditions associated with LOC282943.

LOC282953 (Accession XP_212644.1) is another GAM7052 target gene, herein designated TARGET GENE. LOC282953 BINDING SITE is a target binding site found in the 3' untranslated region of mRNA encoded by LOC282953, corresponding to a target binding site such as BINDING SITE I, BINDING SITE II or BINDING SITE III of FIG. 8. Table 4 illustrates the complementarity of the nucleotide sequences of LOC282953 BINDING SITE, designated SEQ ID:8853, to the nucleotide sequence of GAM7052 RNA, herein designated GAM RNA, also designated SEQ ID:296.

Another function of GAM7052 is therefore inhibition of LOC282953 (Accession XP_212644.1). Accordingly, utilities of GAM7052 include diagnosis, prevention and treatment of diseases and clinical conditions associated with LOC282953.

LOC283012 (Accession XP_210847.1) is another GAM7052 target gene, herein designated TARGET GENE. LOC283012 BINDING SITE is a target binding site found in the 5' untranslated region of mRNA encoded by LOC283012, corresponding to a target binding site such as BINDING SITE I, BINDING SITE II or BINDING SITE III of FIG. 8. Table 4 illustrates the complementarity of the nucleotide sequences of LOC283012 BINDING SITE, designated SEQ ID:13809, to the nucleotide sequence of GAM7052 RNA, herein designated GAM RNA, also designated SEQ ID:296.

Another function of GAM7052 is therefore inhibition of LOC283012 (Accession XP_210847.1). Accordingly, utilities of GAM7052 include diagnosis, prevention and treatment of diseases and clinical conditions associated with LOC283012.

LOC283089 (Accession XP_210885.1) is another GAM7052 target gene, herein designated TARGET GENE. LOC283089 BINDING SITE is a target binding site found in the 5' untranslated region of mRNA encoded by LOC283089, corresponding to a target binding site such as BINDING SITE I, BINDING SITE II or BINDING SITE III of FIG. 8. Table 4 illustrates the complementarity of the nucleotide sequences of LOC283089 BINDING SITE, designated SEQ ID:16357, to the nucleotide sequence of GAM7052 RNA, herein designated GAM RNA, also designated SEQ ID:296.

Another function of GAM7052 is therefore inhibition of LOC283089 (Accession XP_210885.1). Accordingly, utilities of GAM7052 include diagnosis, prevention and treatment of diseases and clinical conditions associated with LOC283089.

LOC283177 (Accession XP_210903.1) is another GAM7052 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:3679, to the nucleotide sequence of GAM7052 RNA, herein designated GAM RNA, also designated SEQ ID:296.

Another function of GAM7052 is therefore inhibition of LOC283177 (Accession XP_210903.1). Accordingly, utilities of GAM7052 include diagnosis, prevention and treatment of diseases and clinical conditions associated with LOC283177.

LOC283215 (Accession XP_208555.2) is another GAM7052 target gene, herein designated TARGET GENE. LOC283215 BINDING SITE is a target binding site found in the 3' untranslated region of mRNA encoded by LOC283215, corresponding to a target binding site such as BINDING SITE I, BINDING SITE II or BINDING SITE III of FIG. 8. Table 4 illustrates the complementarity of the nucleotide sequences of LOC283215 BINDING SITE, designated SEQ ID:8183, to the nucleotide sequence of GAM7052 RNA, herein designated GAM RNA, also designated SEQ ID:296.

Another function of GAM7052 is therefore inhibition of LOC283215 (Accession XP_208555.2). Accordingly, utilities of GAM7052 include diagnosis, prevention and treatment of diseases and clinical conditions associated with LOC283215.

LOC283241 (Accession NP_787089.1) is another GAM7052 target gene, herein designated TARGET GENE. LOC283241 BINDING SITE is a target binding site found in the 5' untranslated region of mRNA encoded by LOC283241, corresponding to a target binding site such as BINDING SITE I, BINDING SITE II or BINDING SITE III of FIG. 8. Table 4 illustrates the complementarity of the nucleotide sequences of LOC283241 BINDING SITE, designated SEQ ID:1942, to the nucleotide sequence of GAM7052 RNA, herein designated GAM RNA, also designated SEQ ID:296.

Another function of GAM7052 is therefore inhibition of LOC283241 (Accession NP_787089.1). Accordingly, utilities of GAM7052 include diagnosis, prevention and treatment of diseases and clinical conditions associated with LOC283241.

LOC283293 (Accession XP_210962.1) is another GAM7052 target gene, herein designated TARGET GENE. LOC283293 BINDING SITE is a target binding site found in the 3' untranslated region of mRNA encoded by LOC283293, corresponding to a target binding site such as BINDING SITE I, BINDING SITE II or BINDING SITE III of FIG. 8. Table 4 illustrates the complementarity of the nucleotide sequences of LOC283293 BINDING SITE, designated SEQ ID:10694, to the nucleotide sequence of GAM7052 RNA, herein designated GAM RNA, also designated SEQ ID:296.

Another function of GAM7052 is therefore inhibition of LOC283293 (Accession XP_210962.1). Accordingly, utilities of GAM7052 include diagnosis, prevention and treatment of diseases and clinical conditions associated with LOC283293.

LOC283335 (Accession XP_210981.1) is another GAM7052 target gene, herein designated TARGET GENE. LOC283335 BINDING SITE is a target binding site found in the 3' untranslated region of mRNA encoded by LOC283335, corresponding to a target binding site such as BINDING SITE I, BINDING SITE II or BINDING SITE III of FIG. 8. Table 4 illustrates the complementarity of the nucleotide sequences of LOC283335 BINDING SITE, designated SEQ ID:14245, to the nucleotide sequence of GAM7052 RNA, herein designated GAM RNA, also designated SEQ ID:296.

Another function of GAM7052 is therefore inhibition of LOC283335 (Accession XP_210981.1). Accordingly, utilities of GAM7052 include diagnosis, prevention and treatment of diseases and clinical conditions associated with LOC283335.

LOC283377 (Accession XP_208647.1) is another GAM7052 target gene, herein designated TARGET GENE. LOC283377 BINDING SITE1 and LOC283377 BINDING SITE2 are target binding sites found in untranslated regions of mRNA encoded by LOC283377, corresponding to target binding sites such as BINDING SITE I, BINDING SITE II or BINDING SITE III of FIG. 8. Table 4 illustrates the complementarity of the nucleotide sequences of LOC283377 BINDING SITE1 and LOC283377 BINDING SITE2, designated SEQ ID:9023 and SEQ ID:18130 respectively, to the nucleotide sequence of GAM7052 RNA, herein designated GAM RNA, also designated SEQ ID:296.

Another function of GAM7052 is therefore inhibition of LOC283377 (Accession XP_208647.1). Accordingly, utilities of GAM7052 include diagnosis, prevention and treatment of diseases and clinical conditions associated with LOC283377.

LOC283387 (Accession XP_211007.1) is another GAM7052 target gene, herein designated TARGET GENE. LOC283387 BINDING SITE is a target binding site found in the 3' untranslated region of mRNA encoded by LOC283387, corresponding to a target binding site such as BINDING SITE I, BINDING SITE II or BINDING SITE III of FIG. 8. Table 4 illustrates the complementarity of the nucleotide sequences of LOC283387 BINDING SITE, designated SEQ ID:1113, to the nucleotide sequence of GAM7052 RNA, herein designated GAM RNA, also designated SEQ ID:296.

Another function of GAM7052 is therefore inhibition of LOC283387 (Accession XP_211007.1). Accordingly, utilities of GAM7052 include diagnosis, prevention and treatment of diseases and clinical conditions associated with LOC283387.

LOC283400 (Accession XP_211024.1) is another GAM7052 target gene, herein designated TARGET GENE. LOC283400 BINDING SITE is a target binding site found in the 5' untranslated region of mRNA encoded by LOC283400, corresponding to a target binding site such as BINDING SITE I, BINDING SITE II or BINDING SITE III of FIG. 8. Table 4 illustrates the complementarity of the nucleotide sequences of LOC283400 BINDING SITE, designated SEQ ID:16677, to the nucleotide sequence of GAM7052 RNA, herein designated GAM RNA, also designated SEQ ID:296.

Another function of GAM7052 is therefore inhibition of LOC283400 (Accession XP_211024.1). Accordingly, utilities of GAM7052 include diagnosis, prevention and treatment of diseases and clinical conditions associated with LOC283400.

LOC283432 (Accession XP_211032.1) is another GAM7052 target gene, herein designated TARGET GENE. LOC283432 BINDING SITE is a target binding site found in the 5' untranslated region of mRNA encoded by LOC283432, corresponding to a target binding site such as BINDING SITE I, BINDING SITE II or BINDING SITE III of FIG. 8. Table 4 illustrates the complementarity of the nucleotide sequences of LOC283432 BINDING SITE, designated SEQ ID:9847, to the nucleotide sequence of GAM7052 RNA, herein designated GAM RNA, also designated SEQ ID:296.

Another function of GAM7052 is therefore inhibition of LOC283432 (Accession XP_211032.1). Accordingly, utilities of GAM7052 include diagnosis, prevention and treatment of diseases and clinical conditions associated with LOC283432.

LOC283454 (Accession XP_211049.1) is another GAM7052 target gene, herein designated TARGET GENE. LOC283454 BINDING SITE is a target binding site found in the 5' untranslated region of mRNA encoded by LOC283454, corresponding to a target binding site such as BINDING SITE I, BINDING SITE II or BINDING SITE III of FIG. 8. Table 4 illustrates the complementarity of the nucleotide sequences of LOC283454 BINDING SITE, designated SEQ ID:8011, to the nucleotide sequence of GAM7052 RNA, herein designated GAM RNA, also designated SEQ ID:296.

Another function of GAM7052 is therefore inhibition of LOC283454 (Accession XP_211049.1). Accordingly, utilities of GAM7052 include diagnosis, prevention and treatment of diseases and clinical conditions associated with LOC283454.

LOC283487 (Accession XP_211062.1) is another GAM7052 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:10199, to the nucleotide sequence of GAM7052 RNA, herein designated GAM RNA, also designated SEQ ID:296.

Another function of GAM7052 is therefore inhibition of LOC283487 (Accession XP_211062.1). Accordingly, utilities of GAM7052 include diagnosis, prevention and treatment of diseases and clinical conditions associated with LOC283487.

LOC283507 (Accession XP_211075.1) is another GAM7052 target gene, herein designated TARGET GENE. LOC283507 BINDING SITE1 and LOC283507 BINDING SITE2 are target binding sites found in untranslated regions of mRNA encoded by LOC283507, corresponding to target binding sites such as BINDING SITE I, BINDING SITE II or BINDING SITE III of FIG. 8. Table 4 illustrates the complementarity of the nucleotide sequences of LOC283507 BINDING SITE1 and LOC283507 BINDING SITE2, designated SEQ ID:1226 and SEQ ID:4986 respectively, to the nucleotide sequence of GAM7052 RNA, herein designated GAM RNA, also designated SEQ ID:296.

Another function of GAM7052 is therefore inhibition of LOC283507 (Accession XP_211075.1). Accordingly, utilities of GAM7052 include diagnosis, prevention and treatment of diseases and clinical conditions associated with LOC283507.

LOC283523 (Accession XP_208097.1) is another GAM7052 target gene, herein designated TARGET GENE. LOC283523 BINDING SITE is a target binding site found in the 3' untranslated region of mRNA encoded by LOC283523, corresponding to a target binding site such as BINDING SITE I, BINDING SITE II or BINDING SITE III of FIG. 8. Table 4 illustrates the complementarity of the nucleotide sequences of LOC283523 BINDING SITE, designated SEQ ID:5965, to the nucleotide sequence of GAM7052 RNA, herein designated GAM RNA, also designated SEQ ID:296.

Another function of GAM7052 is therefore inhibition of LOC283523 (Accession XP_208097.1). Accordingly, utilities of GAM7052 include diagnosis, prevention and treatment of diseases and clinical conditions associated with LOC283523.

LOC283624 (Accession XP_211126.1) is another GAM7052 target gene, herein designated TARGET GENE. LOC283624 BINDING SITE is a target binding site found in the 5' untranslated region of mRNA encoded by LOC283624, corresponding to a target binding site such as BINDING SITE I, BINDING SITE II or BINDING SITE III of FIG. 8. Table 4 illustrates the complementarity of the nucleotide sequences of LOC283624 BINDING SITE, designated SEQ ID:12482, to the nucleotide sequence of GAM7052 RNA, herein designated GAM RNA, also designated SEQ ID:296.

Another function of GAM7052 is therefore inhibition of LOC283624 (Accession XP_211126.1). Accordingly, utilities of GAM7052 include diagnosis, prevention and treatment of diseases and clinical conditions associated with LOC283624.

LOC283637 (Accession XP_211134.1) is another GAM7052 target gene, herein designated TARGET GENE. LOC283637 BINDING SITE is a target binding site found in the 5' untranslated region of mRNA encoded by LOC283637, corresponding to a target binding site such as BINDING SITE I, BINDING SITE II or BINDING SITE III of FIG. 8. Table 4 illustrates the complementarity of the nucleotide sequences of LOC283637 BINDING SITE, designated SEQ ID:19555, to the nucleotide sequence of GAM7052 RNA, herein designated GAM RNA, also designated SEQ ID:296.

Another function of GAM7052 is therefore inhibition of LOC283637 (Accession XP_211134.1). Accordingly, utilities of GAM7052 include diagnosis, prevention and treatment of diseases and clinical conditions associated with LOC283637.

LOC283641 (Accession XP_208764.1) is another GAM7052 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:5466, to the nucleotide sequence of GAM7052 RNA, herein designated GAM RNA, also designated SEQ ID:296.

Another function of GAM7052 is therefore inhibition of LOC283641 (Accession XP_208764.1). Accordingly, utilities of GAM7052 include diagnosis, prevention and treatment of diseases and clinical conditions associated with LOC283641.

LOC283655 (Accession XP_211144.1) is another GAM7052 target gene, herein designated TARGET GENE. LOC283655 BINDING SITE1 and LOC283655 BINDING SITE2 are target binding sites found in untranslated regions of mRNA encoded by LOC283655, corresponding to target binding sites such as BINDING SITE I, BINDING SITE II or BINDING SITE III of FIG. 8. Table 4 illustrates the complementarity of the nucleotide sequences of LOC283655 BINDING SITE1 and LOC283655 BINDING SITE2, designated SEQ ID:16035 and SEQ ID:19485 respectively, to the nucleotide sequence of GAM7052 RNA, herein designated GAM RNA, also designated SEQ ID:296.

Another function of GAM7052 is therefore inhibition of LOC283655 (Accession XP_211144.1). Accordingly, utilities of GAM7052 include diagnosis, prevention and treatment of diseases and clinical conditions associated with LOC283655.

LOC283690 (Accession XP_211167.1) is another GAM7052 target gene, herein designated TARGET GENE. LOC283690 BINDING SITE is a target binding site found in the 3' untranslated region of mRNA encoded by LOC283690, corresponding to a target binding site such as BINDING SITE I, BINDING SITE II or BINDING SITE III of FIG. 8. Table 4 illustrates the complementarity of the nucleotide sequences of LOC283690 BINDING SITE, designated SEQ ID:4911, to the nucleotide sequence of GAM7052 RNA, herein designated GAM RNA, also designated SEQ ID:296.

Another function of GAM7052 is therefore inhibition of LOC283690 (Accession XP_211167.1). Accordingly, utilities of GAM7052 include diagnosis, prevention and treatment of diseases and clinical conditions associated with LOC283690.

LOC283701 (Accession XP_211170.3) is another GAM7052 target gene, herein designated TARGET GENE. LOC283701 BINDING SITE is a target binding site found in the 3' untranslated region of mRNA encoded by LOC283701, corresponding to a target binding site such as BINDING SITE I, BINDING SITE II or BINDING SITE III of FIG. 8. Table 4 illustrates the complementarity of the nucleotide sequences of LOC283701 BINDING SITE, designated SEQ ID:12676, to the nucleotide sequence of GAM7052 RNA, herein designated GAM RNA, also designated SEQ ID:296.

Another function of GAM7052 is therefore inhibition of LOC283701 (Accession XP_211170.3). Accordingly, utilities of GAM7052 include diagnosis, prevention and treatment of diseases and clinical conditions associated with LOC283701.

LOC283857 (Accession XP_211236.1) is another GAM7052 target gene, herein designated TARGET GENE. LOC283857 BINDING SITE is a target binding site found in the 5' untranslated region of mRNA encoded by LOC283857, corresponding to a target binding site such as BINDING SITE I, BINDING SITE II or BINDING SITE III of FIG. 8. Table 4 illustrates the complementarity of the nucleotide sequences of LOC283857 BINDING SITE, designated SEQ ID:13947, to the nucleotide sequence of GAM7052 RNA, herein designated GAM RNA, also designated SEQ ID:296.

Another function of GAM7052 is therefore inhibition of LOC283857 (Accession XP_211236.1). Accordingly, utilities of GAM7052 include diagnosis, prevention and treatment of diseases and clinical conditions associated with LOC283857.

LOC283861 (Accession NP_787095.1) is another GAM7052 target gene, herein designated TARGET GENE. LOC283861 BINDING SITE1 and LOC283861 BINDING SITE2 are target binding sites found in untranslated regions of mRNA encoded by LOC283861, corresponding to target binding sites such as BINDING SITE I, BINDING SITE II or BINDING SITE III of FIG. 8. Table 4 illustrates the complementarity of the nucleotide sequences of LOC283861 BINDING SITE1 and LOC283861 BINDING SITE2, designated SEQ ID:4775 and SEQ ID:3638 respectively, to the nucleotide sequence of GAM7052 RNA, herein designated GAM RNA, also designated SEQ ID:296.

Another function of GAM7052 is therefore inhibition of LOC283861 (Accession NP_787095.1). Accordingly, utilities of GAM7052 include diagnosis, prevention and treatment of diseases and clinical conditions associated with LOC283861.

LOC283863 (Accession XP_208875.1) is another GAM7052 target gene, herein designated TARGET GENE. LOC283863 BINDING SITE is a target binding site found in the 3' untranslated region of mRNA encoded by LOC283863, corresponding to a target binding site such as BINDING SITE I, BINDING SITE II or BINDING SITE III of FIG. 8. Table 4 illustrates the complementarity of the nucleotide sequences of LOC283863 BINDING SITE, designated SEQ ID:12833, to the nucleotide sequence of GAM7052 RNA, herein designated GAM RNA, also designated SEQ ID:296.

Another function of GAM7052 is therefore inhibition of LOC283863 (Accession XP_208875.1). Accordingly, utilities of GAM7052 include diagnosis, prevention and treatment of diseases and clinical conditions associated with LOC283863.

LOC283889 (Accession XP_208899.1) is another GAM7052 target gene, herein designated TARGET GENE. LOC283889 BINDING SITE1 and LOC283889 BINDING SITE2 are target binding sites found in untranslated regions of mRNA encoded by LOC283889, corresponding to target binding sites such as BINDING SITE I, BINDING SITE II or BINDING SITE III of FIG. 8. Table 4 illustrates the complementarity of the nucleotide sequences of LOC283889 BINDING SITE1 and LOC283889 BINDING SITE2, designated SEQ ID:5077 and SEQ ID:765 respectively, to the nucleotide sequence of GAM7052 RNA, herein designated GAM RNA, also designated SEQ ID:296.

Another function of GAM7052 is therefore inhibition of LOC283889 (Accession XP_208899.1). Accordingly, utilities of GAM7052 include diagnosis, prevention and treatment of diseases and clinical conditions associated with LOC283889.

LOC283928 (Accession XP_208909.1) is another GAM7052 target gene, herein designated TARGET GENE. LOC283928 BINDING SITE1 through LOC283928 BINDING SITE3 are target binding sites found in untranslated regions of mRNA encoded by LOC283928, corresponding to target binding sites such as BINDING SITE I, BINDING SITE II or BINDING SITE III of FIG. 8. Table 4 illustrates the complementarity of the nucleotide sequences of LOC283928 BINDING SITE1 through LOC283928 BINDING SITE3, designated SEQ ID:5120, SEQ ID:10915 and SEQ ID:10829 respectively, to the nucleotide sequence of GAM7052 RNA, herein designated GAM RNA, also designated SEQ ID:296.

Another function of GAM7052 is therefore inhibition of LOC283928 (Accession XP_208909.1). Accordingly, utilities of GAM7052 include diagnosis, prevention and treatment of diseases and clinical conditions associated with LOC283928.

LOC284001 (Accession XP_208958.2) is another GAM7052 target gene, herein designated TARGET GENE. LOC284001 BINDING SITE is a target binding site found in the 3' untranslated region of mRNA encoded by LOC284001, corresponding to a target binding site such as BINDING SITE I, BINDING SITE II or BINDING SITE III of FIG. 8. Table 4 illustrates the complementarity of the nucleotide sequences of LOC284001 BINDING SITE, designated SEQ ID:15850, to the nucleotide sequence of GAM7052 RNA, herein designated GAM RNA, also designated SEQ ID:296.

Another function of GAM7052 is therefore inhibition of LOC284001 (Accession XP_208958.2). Accordingly, utilities of GAM7052 include diagnosis, prevention and treatment of diseases and clinical conditions associated with LOC284001.

LOC284023 (Accession XP_208983.3) is another GAM7052 target gene, herein designated TARGET GENE. LOC284023 BINDING SITE is a target binding site found in the 3' untranslated region of mRNA encoded by LOC284023, corresponding to a target binding site such as BINDING SITE I, BINDING SITE II or BINDING SITE III of FIG. 8. Table 4 illustrates the complementarity of the nucleotide sequences of LOC284023 BINDING SITE, designated SEQ ID:15391, to the nucleotide sequence of GAM7052 RNA, herein designated GAM RNA, also designated SEQ ID:296.

Another function of GAM7052 is therefore inhibition of LOC284023 (Accession XP_208983.3). Accordingly, utilities of GAM7052 include diagnosis, prevention and treatment of diseases and clinical conditions associated with LOC284023.

LOC284063 (Accession XP_208992.1) is another GAM7052 target gene, herein designated TARGET GENE. LOC284063 BINDING SITE is a target binding site found in the 3' untranslated region of mRNA encoded by LOC284063, corresponding to a target binding site such as BINDING SITE I, BINDING SITE II or BINDING SITE III of FIG. 8. Table 4 illustrates the complementarity of the nucleotide sequences of LOC284063 BINDING SITE, designated SEQ ID:6628, to the nucleotide sequence of GAM7052 RNA, herein designated GAM RNA, also designated SEQ ID:296.

Another function of GAM7052 is therefore inhibition of LOC284063 (Accession XP_208992.1). Accordingly, utilities of GAM7052 include diagnosis, prevention and treatment of diseases and clinical conditions associated with LOC284063.

LOC284080 (Accession XP_211322.1) is another GAM7052 target gene, herein designated TARGET GENE. LOC284080 BINDING SITE is a target binding site found in the 3' untranslated region of mRNA encoded by LOC284080, corresponding to a target binding site such as BINDING SITE I, BINDING SITE II or BINDING SITE III of FIG. 8. Table 4 illustrates the complementarity of the nucleotide sequences of LOC284080 BINDING SITE, designated SEQ ID:7784, to the nucleotide sequence of GAM7052 RNA, herein designated GAM RNA, also designated SEQ ID:296.

Another function of GAM7052 is therefore inhibition of LOC284080 (Accession XP_211322.1). Accordingly, utilities of GAM7052 include diagnosis, prevention and treatment of diseases and clinical conditions associated with LOC284080.

LOC284098 (Accession XP_209008.3) is another GAM7052 target gene, herein designated TARGET GENE. LOC284098 BINDING SITE is a target binding site found in the 3' untranslated region of mRNA encoded by LOC284098, corresponding to a target binding site such as BINDING SITE I, BINDING SITE II or BINDING SITE III of FIG. 8. Table 4 illustrates the complementarity of the nucleotide sequences of LOC284098 BINDING SITE, designated SEQ ID:4384, to the nucleotide sequence of GAM7052 RNA, herein designated GAM RNA, also designated SEQ ID:296.

Another function of GAM7052 is therefore inhibition of LOC284098 (Accession XP_209008.3). Accordingly, utilities of GAM7052 include diagnosis, prevention and treatment of diseases and clinical conditions associated with LOC284098.

LOC284102 (Accession XP_211327.3) is another GAM7052 target gene, herein designated TARGET GENE. LOC284102 BINDING SITE1 through LOC284102 BINDING SITE3 are target binding sites found in untranslated regions of mRNA encoded by LOC284102, corresponding to target binding sites such as BINDING SITE I, BINDING SITE II or BINDING SITE III of FIG. 8. Table 4 illustrates the complementarity of the nucleotide sequences of LOC284102 BINDING SITE1 through LOC284102 BINDING SITE3, designated SEQ ID:16386, SEQ ID:12703 and SEQ ID:10012 respectively, to the nucleotide sequence of GAM7052 RNA, herein designated GAM RNA, also designated SEQ ID:296.

Another function of GAM7052 is therefore inhibition of LOC284102 (Accession XP_211327.3). Accordingly, utilities of GAM7052 include diagnosis, prevention and treatment of diseases and clinical conditions associated with LOC284102.

LOC284116 (Accession XP_211338.2) is another GAM7052 target gene, herein designated TARGET GENE. LOC284116 BINDING SITE is a target binding site found in the 5' untranslated region of mRNA encoded by LOC284116, corresponding to a target binding site such as BINDING SITE I, BINDING SITE II or BINDING SITE III of FIG. 8. Table 4 illustrates the complementarity of the nucleotide sequences of LOC284116 BINDING SITE, designated SEQ ID:8308, to the nucleotide sequence of GAM7052 RNA, herein designated GAM RNA, also designated SEQ ID:296.

Another function of GAM7052 is therefore inhibition of LOC284116 (Accession XP_211338.2). Accordingly, utilities of GAM7052 include diagnosis, prevention and treatment of diseases and clinical conditions associated with LOC284116.

LOC284117 (Accession XP_209024.1) is another GAM7052 target gene, herein designated TARGET GENE. LOC284117 BINDING SITE is a target binding site found in the 3' untranslated region of mRNA encoded by LOC284117, corresponding to a target binding site such as BINDING SITE I, BINDING SITE II or BINDING SITE III of FIG. 8. Table 4 illustrates the complementarity of the nucleotide sequences of LOC284117 BINDING SITE, designated SEQ ID:7907, to the nucleotide sequence of GAM7052 RNA, herein designated GAM RNA, also designated SEQ ID:296.

Another function of GAM7052 is therefore inhibition of LOC284117 (Accession XP_209024.1). Accordingly, utilities of GAM7052 include diagnosis, prevention and treatment of diseases and clinical conditions associated with LOC284117.

LOC284135 (Accession XP_209032.1) is another GAM7052 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:12522, to the nucleotide sequence of GAM7052 RNA, herein designated GAM RNA, also designated SEQ ID:296.

Another function of GAM7052 is therefore inhibition of LOC284135 (Accession XP_209032.1). Accordingly, utilities of GAM7052 include diagnosis, prevention and treatment of diseases and clinical conditions associated with LOC284135.

LOC284155 (Accession XP_211354.1) is another GAM7052 target gene, herein designated TARGET GENE. LOC284155 BINDING SITE is a target binding site found in the 3' untranslated region of mRNA encoded by LOC284155, corresponding to a target binding site such as BINDING SITE I, BINDING SITE II or BINDING SITE III of FIG. 8. Table 4 illustrates the complementarity of the nucleotide sequences of LOC284155 BINDING SITE, designated SEQ ID:15851, to the nucleotide sequence of GAM7052 RNA, herein designated GAM RNA, also designated SEQ ID:296.

Another function of GAM7052 is therefore inhibition of LOC284155 (Accession XP_211354.1). Accordingly, utilities of GAM7052 include diagnosis, prevention and treatment of diseases and clinical conditions associated with LOC284155.

LOC284171 (Accession XP_209051.1) is another GAM7052 target gene, herein designated TARGET GENE. LOC284171 BINDING SITE is a target binding site found in the 3' untranslated region of mRNA encoded by LOC284171, corresponding to a target binding site such as BINDING SITE I, BINDING SITE II or BINDING SITE III of FIG. 8. Table 4 illustrates the complementarity of the nucleotide sequences of LOC284171 BINDING SITE, designated SEQ ID:6477, to the nucleotide sequence of GAM7052 RNA, herein designated GAM RNA, also designated SEQ ID:296.

Another function of GAM7052 is therefore inhibition of LOC284171 (Accession XP_209051.1). Accordingly, utilities of GAM7052 include diagnosis, prevention and treatment of diseases and clinical conditions associated with LOC284171.

LOC284183 (Accession XP_209059.1) is another GAM7052 target gene, herein designated TARGET GENE. LOC284183 BINDING SITE1 and LOC284183 BINDING SITE2 are target binding sites found in untranslated regions of mRNA encoded by LOC284183, corresponding to target binding sites such as BINDING SITE I, BINDING SITE II or BINDING SITE III of FIG. 8. Table 4 illustrates the complementarity of the nucleotide sequences of LOC284183 BINDING SITE1 and LOC284183 BINDING SITE2, designated SEQ ID:8749 and SEQ ID:10894 respectively, to the nucleotide sequence of GAM7052 RNA, herein designated GAM RNA, also designated SEQ ID:296.

Another function of GAM7052 is therefore inhibition of LOC284183 (Accession XP_209059.1). Accordingly, utilities of GAM7052 include diagnosis, prevention and treatment of diseases and clinical conditions associated with LOC284183.

LOC284260 (Accession XP_211408.1) is another GAM7052 target gene, herein designated TARGET GENE. LOC284260 BINDING SITE is a target binding site found in the 3' untranslated region of mRNA encoded by LOC284260, corresponding to a target binding site such as BINDING SITE I, BINDING SITE II or BINDING SITE III of FIG. 8. Table 4 illustrates the complementarity of the nucleotide sequences of LOC284260 BINDING SITE, designated SEQ ID:17615, to the nucleotide sequence of GAM7052 RNA, herein designated GAM RNA, also designated SEQ ID:296.

Another function of GAM7052 is therefore inhibition of LOC284260 (Accession XP_211408.1). Accordingly, utilities of GAM7052 include diagnosis, prevention and treatment of diseases and clinical conditions associated with LOC284260.

LOC284281 (Accession XP_211415.1) is another GAM7052 target gene, herein designated TARGET GENE. LOC284281 BINDING SITE is a target binding site found in the 5' untranslated region of mRNA encoded by LOC284281, corresponding to a target binding site such as BINDING SITE I, BINDING SITE II or BINDING SITE III of FIG. 8. Table 4 illustrates the complementarity of the nucleotide sequences of LOC284281 BINDING SITE, designated SEQ ID:7059, to the nucleotide sequence of GAM7052 RNA, herein designated GAM RNA, also designated SEQ ID:296.

Another function of GAM7052 is therefore inhibition of LOC284281 (Accession XP_211415.1). Accordingly, utilities of GAM7052 include diagnosis, prevention and treatment of diseases and clinical conditions associated with LOC284281.

LOC284286 (Accession XP_211419.1) is another GAM7052 target gene, herein designated TARGET GENE. LOC284286 BINDING SITE is a target binding site found in the 3' untranslated region of mRNA encoded by LOC284286, corresponding to a target binding site such as BINDING SITE I, BINDING SITE II or BINDING SITE III of FIG. 8. Table 4 illustrates the complementarity of the nucleotide sequences of LOC284286 BINDING SITE, designated SEQ ID:19098, to the nucleotide sequence of GAM7052 RNA, herein designated GAM RNA, also designated SEQ ID:296.

Another function of GAM7052 is therefore inhibition of LOC284286 (Accession XP_211419.1). Accordingly, utilities of GAM7052 include diagnosis, prevention and treatment of diseases and clinical conditions associated with LOC284286.

LOC284289 (Accession XP_209105.1) is another GAM7052 target gene, herein designated TARGET GENE. LOC284289 BINDING SITE is a target binding site found in the 3' untranslated region of mRNA encoded by LOC284289, corresponding to a target binding site such as BINDING SITE I, BINDING SITE II or BINDING SITE III of FIG. 8. Table 4 illustrates the complementarity of the nucleotide sequences of LOC284289 BINDING SITE, designated SEQ ID:3340, to the nucleotide sequence of GAM7052 RNA, herein designated GAM RNA, also designated SEQ ID:296.

Another function of GAM7052 is therefore inhibition of LOC284289 (Accession XP_209105.1). Accordingly, utilities of GAM7052 include diagnosis, prevention and treatment of diseases and clinical conditions associated with LOC284289.

LOC284305 (Accession XP_211425.1) is another GAM7052 target gene, herein designated TARGET GENE. LOC284305 BINDING SITE1 and LOC284305 BINDING SITE2 are target binding sites found in untranslated regions of mRNA encoded by LOC284305, corresponding to target binding sites such as BINDING SITE I, BINDING SITE II or BINDING SITE III of FIG. 8. Table 4 illustrates the complementarity of the nucleotide sequences of LOC284305 BINDING SITE1 and LOC284305 BINDING SITE2, designated SEQ ID:16484 and SEQ ID:16775 respectively, to the nucleotide sequence of GAM7052 RNA, herein designated GAM RNA, also designated SEQ ID:296.

Another function of GAM7052 is therefore inhibition of LOC284305 (Accession XP_211425.1). Accordingly, utilities of GAM7052 include diagnosis, prevention and treatment of diseases and clinical conditions associated with LOC284305.

LOC284311 (Accession XP_302720.1) is another GAM7052 target gene, herein designated TARGET GENE. LOC284311 BINDING SITE is a target binding site found in the 5' untranslated region of mRNA encoded by LOC284311, corresponding to a target binding site such as BINDING SITE I, BINDING SITE II or BINDING SITE III of FIG. 8. Table 4 illustrates the complementarity of the nucleotide sequences of LOC284311 BINDING SITE, designated SEQ ID:15828, to the nucleotide sequence of GAM7052 RNA, herein designated GAM RNA, also designated SEQ ID:296.

Another function of GAM7052 is therefore inhibition of LOC284311 (Accession XP_302720.1). Accordingly, utilities of GAM7052 include diagnosis, prevention and treatment of diseases and clinical conditions associated with LOC284311.

LOC284356 (Accession XP_211437.1) is another GAM7052 target gene, herein designated TARGET GENE. LOC284356 BINDING SITE is a target binding site found in the 3' untranslated region of mRNA encoded by LOC284356, corresponding to a target binding site such as BINDING SITE I, BINDING SITE II or BINDING SITE III of FIG. 8. Table 4 illustrates the complementarity of the nucleotide sequences of LOC284356 BINDING SITE, designated SEQ ID:7004, to the nucleotide sequence of GAM7052 RNA, herein designated GAM RNA, also designated SEQ ID:296.

Another function of GAM7052 is therefore inhibition of LOC284356 (Accession XP_211437.1). Accordingly, utilities of GAM7052 include diagnosis, prevention and treatment of diseases and clinical conditions associated with LOC284356.

LOC284362 (Accession XP_211435.1) is another GAM7052 target gene, herein designated TARGET GENE. LOC284362 BINDING SITE1 and LOC284362 BINDING SITE2 are target binding sites found in untranslated regions of mRNA encoded by LOC284362, corresponding to target binding sites such as BINDING SITE I, BINDING SITE II or BINDING SITE III of FIG. 8. Table 4 illustrates the complementarity of the nucleotide sequences of LOC284362 BINDING SITE1 and LOC284362 BINDING SITE2, designated SEQ ID:1466 and SEQ ID:11728 respectively, to the nucleotide sequence of GAM7052 RNA, herein designated GAM RNA, also designated SEQ ID:296.

Another function of GAM7052 is therefore inhibition of LOC284362 (Accession XP_211435.1). Accordingly, utilities of GAM7052 include diagnosis, prevention and treatment of diseases and clinical conditions associated with LOC284362.

LOC284396 (Accession XP_211452.1) is another GAM7052 target gene, herein designated TARGET GENE. LOC284396 BINDING SITE is a target binding site found in the 3' untranslated region of mRNA encoded by LOC284396, corresponding to a target binding site such as BINDING SITE I, BINDING SITE II or BINDING SITE III of FIG. 8. Table 4 illustrates the complementarity of the nucleotide sequences of LOC284396 BINDING SITE, designated SEQ ID:15146, to the nucleotide sequence of GAM7052 RNA, herein designated GAM RNA, also designated SEQ ID:296.

Another function of GAM7052 is therefore inhibition of LOC284396 (Accession XP_211452.1). Accordingly, utilities of GAM7052 include diagnosis, prevention and treatment of diseases and clinical conditions associated with LOC284396.

LOC284426 (Accession XP_209198.1) is another GAM7052 target gene, herein designated TARGET GENE. LOC284426 BINDING SITE1 through LOC284426 BINDING SITE3 are target binding sites found in untranslated regions of mRNA encoded by LOC284426, corresponding to target binding sites such as BINDING SITE I, BINDING SITE II or BINDING SITE III of FIG. 8. Table 4 illustrates the complementarity of the nucleotide sequences of LOC284426 BINDING SITE1 through LOC284426 BINDING SITE3, designated SEQ ID:5116, SEQ ID:5145 and SEQ ID:12481 respectively, to the nucleotide sequence of GAM7052 RNA, herein designated GAM RNA, also designated SEQ ID:296.

Another function of GAM7052 is therefore inhibition of LOC284426 (Accession XP_209198.1). Accordingly, utilities of GAM7052 include diagnosis, prevention and treatment of diseases and clinical conditions associated with LOC284426.

LOC284436 (Accession XP_290862.1) is another GAM7052 target gene, herein designated TARGET GENE. LOC284436 BINDING SITE is a target binding site found in the 3' untranslated region of mRNA encoded by LOC284436, corresponding to a target binding site such as BINDING SITE I, BINDING SITE II or BINDING SITE III of FIG. 8. Table 4 illustrates the complementarity of the nucleotide sequences of LOC284436 BINDING SITE, designated SEQ ID:8011, to the nucleotide sequence of GAM7052 RNA, herein designated GAM RNA, also designated SEQ ID:296.

Another function of GAM7052 is therefore inhibition of LOC284436 (Accession XP_290862.1). Accordingly, utilities of GAM7052 include diagnosis, prevention and treatment of diseases and clinical conditions associated with LOC284436.

LOC284454 (Accession XP_209216.1) is another GAM7052 target gene, herein designated TARGET GENE. LOC284454 BINDING SITE1 and LOC284454 BINDING SITE2 are target binding sites found in untranslated regions of mRNA encoded by LOC284454, corresponding to target binding sites such as BINDING SITE I, BINDING SITE II or BINDING SITE III of FIG. 8. Table 4 illustrates the complementarity of the nucleotide sequences of LOC284454 BINDING SITE1 and LOC284454 BINDING SITE2, designated SEQ ID:13118 and SEQ ID:15855 respectively, to the nucleotide sequence of GAM7052 RNA, herein designated GAM RNA, also designated SEQ ID:296.

Another function of GAM7052 is therefore inhibition of LOC284454 (Accession XP_209216.1). Accordingly, utilities of GAM7052 include diagnosis, prevention and treatment of diseases and clinical conditions associated with LOC284454.

LOC284577 (Accession XP_211522.1) is another GAM7052 target gene, herein designated TARGET GENE. LOC284577 BINDING SITE is a target binding site found in the 3' untranslated region of mRNA encoded by LOC284577, corresponding to a target binding site such as BINDING SITE I, BINDING SITE II or BINDING SITE III of FIG. 8. Table 4 illustrates the complementarity of the nucleotide sequences of LOC284577 BINDING SITE, designated SEQ ID:5969, to the nucleotide sequence of GAM7052 RNA, herein designated GAM RNA, also designated SEQ ID:296.

Another function of GAM7052 is therefore inhibition of LOC284577 (Accession XP_211522.1). Accordingly, utilities of GAM7052 include diagnosis, prevention and treatment of diseases and clinical conditions associated with LOC284577.

LOC284585 (Accession XP_209277.2) is another GAM7052 target gene, herein designated TARGET GENE. LOC284585 BINDING SITE is a target binding site found in the 3' untranslated region of mRNA encoded by LOC284585, corresponding to a target binding site such as BINDING SITE I, BINDING SITE II or BINDING SITE III of FIG. 8. Table 4 illustrates the complementarity of the nucleotide sequences of LOC284585 BINDING SITE, designated SEQ ID:5500, to the nucleotide sequence of GAM7052 RNA, herein designated GAM RNA, also designated SEQ ID:296.

Another function of GAM7052 is therefore inhibition of LOC284585 (Accession XP_209277.2). Accordingly, utilities of GAM7052 include diagnosis, prevention and treatment of diseases and clinical conditions associated with LOC284585.

LOC284591 (Accession XP_211529.1) is another GAM7052 target gene, herein designated TARGET GENE. LOC284591 BINDING SITE is a target binding site found in the 5' untranslated region of mRNA encoded by LOC284591, corresponding to a target binding site such as BINDING SITE I, BINDING SITE II or BINDING SITE III of FIG. 8. Table 4 illustrates the complementarity of the nucleotide sequences of LOC284591 BINDING SITE, designated SEQ ID:507, to the nucleotide sequence of GAM7052 RNA, herein designated GAM RNA, also designated SEQ ID:296.

Another function of GAM7052 is therefore inhibition of LOC284591 (Accession XP_211529.1). Accordingly, utilities of GAM7052 include diagnosis, prevention and treatment of diseases and clinical conditions associated with LOC284591.

LOC284628 (Accession XP_211561.1) is another GAM7052 target gene, herein designated TARGET GENE. LOC284628 BINDING SITE is a target binding site found in the 5' untranslated region of mRNA encoded by LOC284628, corresponding to a target binding site such as BINDING SITE I, BINDING SITE II or BINDING SITE III of FIG. 8. Table 4 illustrates the complementarity of the nucleotide sequences of LOC284628 BINDING SITE, designated SEQ ID:11163, to the nucleotide sequence of GAM7052 RNA, herein designated GAM RNA, also designated SEQ ID:296.

Another function of GAM7052 is therefore inhibition of LOC284628 (Accession XP_211561.1). Accordingly, utilities of GAM7052 include diagnosis, prevention and treatment of diseases and clinical conditions associated with LOC284628.

LOC284708 (Accession XP_209332.1) is another GAM7052 target gene, herein designated TARGET GENE. LOC284708 BINDING SITE is a target binding site found in the 3' untranslated region of mRNA encoded by LOC284708, corresponding to a target binding site such as BINDING SITE I, BINDING SITE II or BINDING SITE III of FIG. 8. Table 4 illustrates the complementarity of the nucleotide sequences of LOC284708 BINDING SITE, designated SEQ ID:17993, to the nucleotide sequence of GAM7052 RNA, herein designated GAM RNA, also designated SEQ ID:296.

Another function of GAM7052 is therefore inhibition of LOC284708 (Accession XP_209332.1). Accordingly, utilities of GAM7052 include diagnosis, prevention and treatment of diseases and clinical conditions associated with LOC284708.

LOC284723 (Accession XP_211602.1) is another GAM7052 target gene, herein designated TARGET GENE. LOC284723 BINDING SITE is a target binding site found in the 3' untranslated region of mRNA encoded by LOC284723, corresponding to a target binding site such as BINDING SITE I, BINDING SITE II or BINDING SITE III of FIG. 8. Table 4 illustrates the complementarity of the nucleotide sequences of LOC284723 BINDING SITE, designated SEQ ID:7366, to the nucleotide sequence of GAM7052 RNA, herein designated GAM RNA, also designated SEQ ID:296.

Another function of GAM7052 is therefore inhibition of LOC284723 (Accession XP_211602.1). Accordingly, utilities of GAM7052 include diagnosis, prevention and treatment of diseases and clinical conditions associated with LOC284723.

LOC284805 (Accession XP_209371.1) is another GAM7052 target gene, herein designated TARGET GENE. LOC284805 BINDING SITE is a target binding site found in the 3' untranslated region of mRNA encoded by LOC284805, corresponding to a target binding site such as BINDING SITE I, BINDING SITE II or BINDING SITE III of FIG. 8. Table 4 illustrates the complementarity of the nucleotide sequences of LOC284805 BINDING SITE, designated SEQ ID:2369, to the nucleotide sequence of GAM7052 RNA, herein designated GAM RNA, also designated SEQ ID:296.

Another function of GAM7052 is therefore inhibition of LOC284805 (Accession XP_209371.1). Accordingly, utilities of GAM7052 include diagnosis, prevention and treatment of diseases and clinical conditions associated with LOC284805.

LOC284865 (Accession XP_211672.1) is another GAM7052 target gene, herein designated TARGET GENE. LOC284865 BINDING SITE1 and LOC284865 BINDING SITE2 are target binding sites found in untranslated regions of mRNA encoded by LOC284865, corresponding to target binding sites such as BINDING SITE I, BINDING SITE II or BINDING SITE III of FIG. 8. Table 4 illustrates the complementarity of the nucleotide sequences of LOC284865 BINDING SITE1 and LOC284865 BINDING SITE2, designated SEQ ID:14664 and SEQ ID:15707 respectively, to the nucleotide sequence of GAM7052 RNA, herein designated GAM RNA, also designated SEQ ID:296.

Another function of GAM7052 is therefore inhibition of LOC284865 (Accession XP_211672.1). Accordingly, utilities of GAM7052 include diagnosis, prevention and treatment of diseases and clinical conditions associated with LOC284865.

LOC284874 (Accession XP_209394.1) is another GAM7052 target gene, herein designated TARGET GENE. LOC284874 BINDING SITE is a target binding site found in the 3' untranslated region of mRNA encoded by LOC284874, corresponding to a target binding site such as BINDING SITE I, BINDING SITE II or BINDING SITE III of FIG. 8. Table 4 illustrates the complementarity of the nucleotide sequences of LOC284874 BINDING SITE, designated SEQ ID:18809, to the nucleotide sequence of GAM7052 RNA, herein designated GAM RNA, also designated SEQ ID:296.

Another function of GAM7052 is therefore inhibition of LOC284874 (Accession XP_209394.1). Accordingly, utilities of GAM7052 include diagnosis, prevention and treatment of diseases and clinical conditions associated with LOC284874.

LOC284934 (Accession XP_211696.1) is another GAM7052 target gene, herein designated TARGET GENE. LOC284934 BINDING SITE is a target binding site found in the 5' untranslated region of mRNA encoded by LOC284934, corresponding to a target binding site such as BINDING SITE I, BINDING SITE II or BINDING SITE III of FIG. 8. Table 4 illustrates the complementarity of the nucleotide sequences of LOC284934 BINDING SITE, designated SEQ ID:16887, to the nucleotide sequence of GAM7052 RNA, herein designated GAM RNA, also designated SEQ ID:296.

Another function of GAM7052 is therefore inhibition of LOC284934 (Accession XP_211696.1). Accordingly, utilities of GAM7052 include diagnosis, prevention and treatment of diseases and clinical conditions associated with LOC284934.

LOC284947 (Accession XP_211705.1) is another GAM7052 target gene, herein designated TARGET GENE. LOC284947 BINDING SITE1 and LOC284947 BINDING SITE2 are target binding sites found in untranslated regions of mRNA encoded by LOC284947, corresponding to target binding sites such as BINDING SITE I, BINDING SITE II or BINDING SITE III of FIG. 8. Table 4 illustrates the complementarity of the nucleotide sequences of LOC284947 BINDING SITE1 and LOC284947 BINDING SITE2, designated SEQ ID:10834 and SEQ ID:7168 respectively, to the nucleotide sequence of GAM7052 RNA, herein designated GAM RNA, also designated SEQ ID:296.

Another function of GAM7052 is therefore inhibition of LOC284947 (Accession XP_211705.1). Accordingly, utilities of GAM7052 include diagnosis, prevention and treatment of diseases and clinical conditions associated with LOC284947.

LOC284950 (Accession XP_211703.1) is another GAM7052 target gene, herein designated TARGET GENE. LOC284950 BINDING SITE is a target binding site found in the 3' untranslated region of mRNA encoded by LOC284950, corresponding to a target binding site such as BINDING SITE I, BINDING SITE II or BINDING SITE III of FIG. 8. Table 4 illustrates the complementarity of the nucleotide sequences of LOC284950 BINDING SITE, designated SEQ ID:8376, to the nucleotide sequence of GAM7052 RNA, herein designated GAM RNA, also designated SEQ ID:296.

Another function of GAM7052 is therefore inhibition of LOC284950 (Accession XP_211703.1). Accordingly, utilities of GAM7052 include diagnosis, prevention and treatment of diseases and clinical conditions associated with LOC284950.

LOC284982 (Accession XP_211721.1) is another GAM7052 target gene, herein designated TARGET GENE. LOC284982 BINDING SITE is a target binding site found in the 5' untranslated region of mRNA encoded by LOC284982, corresponding to a target binding site such as BINDING SITE I, BINDING SITE II or BINDING SITE III of FIG. 8. Table 4 illustrates the complementarity of the nucleotide sequences of LOC284982 BINDING SITE, designated SEQ ID:7724, to the nucleotide sequence of GAM7052 RNA, herein designated GAM RNA, also designated SEQ ID:296.

Another function of GAM7052 is therefore inhibition of LOC284982 (Accession XP_211721.1). Accordingly, utilities of GAM7052 include diagnosis, prevention and treatment of diseases and clinical conditions associated with LOC284982.

LOC285058 (Accession XP_211753.1) is another GAM7052 target gene, herein designated TARGET GENE. LOC285058 BINDING SITE is a target binding site found in the 5' untranslated region of mRNA encoded by LOC285058, corresponding to a target binding site such as BINDING SITE I, BINDING SITE II or BINDING SITE III of FIG. 8. Table 4 illustrates the complementarity of the nucleotide sequences of LOC285058 BINDING SITE, designated SEQ ID:17393, to the nucleotide sequence of GAM7052 RNA, herein designated GAM RNA, also designated SEQ ID:296.

Another function of GAM7052 is therefore inhibition of LOC285058 (Accession XP_211753.1). Accordingly, utilities of GAM7052 include diagnosis, prevention and treatment of diseases and clinical conditions associated with LOC285058.

LOC285127 (Accession XP_211771.1) is another GAM7052 target gene, herein designated TARGET GENE. LOC285127 BINDING SITE is a target binding site found in the 3' untranslated region of mRNA encoded by LOC285127, corresponding to a target binding site such as BINDING SITE I, BINDING SITE II or BINDING SITE III of FIG. 8. Table 4 illustrates the complementarity of the nucleotide sequences of LOC285127 BINDING SITE, designated SEQ ID:3391, to the nucleotide sequence of GAM7052 RNA, herein designated GAM RNA, also designated SEQ ID:296.

Another function of GAM7052 is therefore inhibition of LOC285127 (Accession XP_211771.1). Accordingly, utilities of GAM7052 include diagnosis, prevention and treatment of diseases and clinical conditions associated with LOC285127.

LOC285166 (Accession XP_211791.1) is another GAM7052 target gene, herein designated TARGET GENE.

LOC285166 BINDING SITE is a target binding site found in the 3' untranslated region of mRNA encoded by LOC285166, corresponding to a target binding site such as BINDING SITE I, BINDING SITE II or BINDING SITE III of FIG. 8. Table 4 illustrates the complementarity of the nucleotide sequences of LOC285166 BINDING SITE, designated SEQ ID:7526, to the nucleotide sequence of GAM7052 RNA, herein designated GAM RNA, also designated SEQ ID:296.

Another function of GAM7052 is therefore inhibition of LOC285166 (Accession XP_211791.1). Accordingly, utilities of GAM7052 include diagnosis, prevention and treatment of diseases and clinical conditions associated with LOC285166.

LOC285193 (Accession XP_209509.1) is another GAM7052 target gene, herein designated TARGET GENE. LOC285193 BINDING SITE1 and LOC285193 BINDING SITE2 are target binding sites found in untranslated regions of mRNA encoded by LOC285193, corresponding to target binding sites such as BINDING SITE I, BINDING SITE II or BINDING SITE III of FIG. 8. Table 4 illustrates the complementarity of the nucleotide sequences of LOC285193 BINDING SITE1 and LOC285193 BINDING SITE2, designated SEQ ID:8008 and SEQ ID:16072 respectively, to the nucleotide sequence of GAM7052 RNA, herein designated GAM RNA, also designated SEQ ID:296.

Another function of GAM7052 is therefore inhibition of LOC285193 (Accession XP_209509.1). Accordingly, utilities of GAM7052 include diagnosis, prevention and treatment of diseases and clinical conditions associated with LOC285193.

LOC285231 (Accession XP_211813.1) is another GAM7052 target gene, herein designated TARGET GENE. LOC285231 BINDING SITE is a target binding site found in the 3' untranslated region of mRNA encoded by LOC285231, corresponding to a target binding site such as BINDING SITE I, BINDING SITE II or BINDING SITE III of FIG. 8. Table 4 illustrates the complementarity of the nucleotide sequences of LOC285231 BINDING SITE, designated SEQ ID:13978, to the nucleotide sequence of GAM7052 RNA, herein designated GAM RNA, also designated SEQ ID:296.

Another function of GAM7052 is therefore inhibition of LOC285231 (Accession XP_211813.1). Accordingly, utilities of GAM7052 include diagnosis, prevention and treatment of diseases and clinical conditions associated with LOC285231.

LOC285281 (Accession XP_211829.1) is another GAM7052 target gene, herein designated TARGET GENE. LOC285281 BINDING SITE is a target binding site found in the 5' untranslated region of mRNA encoded by LOC285281, corresponding to a target binding site such as BINDING SITE I, BINDING SITE II or BINDING SITE III of FIG. 8. Table 4 illustrates the complementarity of the nucleotide sequences of LOC285281 BINDING SITE, designated SEQ ID:5734, to the nucleotide sequence of GAM7052 RNA, herein designated GAM RNA, also designated SEQ ID:296.

Another function of GAM7052 is therefore inhibition of LOC285281 (Accession XP_211829.1). Accordingly, utilities of GAM7052 include diagnosis, prevention and treatment of diseases and clinical conditions associated with LOC285281.

LOC285336 (Accession XP_211850.1) is another GAM7052 target gene, herein designated TARGET GENE. LOC285336 BINDING SITE is a target binding site found in the 3' untranslated region of mRNA encoded by LOC285336, corresponding to a target binding site such as BINDING SITE I, BINDING SITE II or BINDING SITE III of FIG. 8. Table 4 illustrates the complementarity of the nucleotide sequences of LOC285336 BINDING SITE, designated SEQ ID:14034, to the nucleotide sequence of GAM7052 RNA, herein designated GAM RNA, also designated SEQ ID:296.

Another function of GAM7052 is therefore inhibition of LOC285336 (Accession XP_211850.1). Accordingly, utilities of GAM7052 include diagnosis, prevention and treatment of diseases and clinical conditions associated with LOC285336.

LOC285398 (Accession XP_209593.1) is another GAM7052 target gene, herein designated TARGET GENE. LOC285398 BINDING SITE1 and LOC285398 BINDING SITE2 are target binding sites found in untranslated regions of mRNA encoded by LOC285398, corresponding to target binding sites such as BINDING SITE I, BINDING SITE II or BINDING SITE III of FIG. 8. Table 4 illustrates the complementarity of the nucleotide sequences of LOC285398 BINDING SITE1 and LOC285398 BINDING SITE2, designated SEQ ID:2258 and SEQ ID:14737 respectively, to the nucleotide sequence of GAM7052 RNA, herein designated GAM RNA, also designated SEQ ID:296.

Another function of GAM7052 is therefore inhibition of LOC285398 (Accession XP_209593.1). Accordingly, utilities of GAM7052 include diagnosis, prevention and treatment of diseases and clinical conditions associated with LOC285398.

LOC285456 (Accession XP_209617.1) is another GAM7052 target gene, herein designated TARGET GENE. LOC285456 BINDING SITE is a target binding site found in the 5' untranslated region of mRNA encoded by LOC285456, corresponding to a target binding site such as BINDING SITE I, BINDING SITE II or BINDING SITE III of FIG. 8. Table 4 illustrates the complementarity of the nucleotide sequences of LOC285456 BINDING SITE, designated SEQ ID:1360, to the nucleotide sequence of GAM7052 RNA, herein designated GAM RNA, also designated SEQ ID:296.

Another function of GAM7052 is therefore inhibition of LOC285456 (Accession XP_209617.1). Accordingly, utilities of GAM7052 include diagnosis, prevention and treatment of diseases and clinical conditions associated with LOC285456.

LOC285510 (Accession XP_209643.1) is another GAM7052 target gene, herein designated TARGET GENE. LOC285510 BINDING SITE is a target binding site found in the 3' untranslated region of mRNA encoded by LOC285510, corresponding to a target binding site such as BINDING SITE I, BINDING SITE II or BINDING SITE III of FIG. 8. Table 4 illustrates the complementarity of the nucleotide sequences of LOC285510 BINDING SITE, designated SEQ ID:6609, to the nucleotide sequence of GAM7052 RNA, herein designated GAM RNA, also designated SEQ ID:296.

Another function of GAM7052 is therefore inhibition of LOC285510 (Accession XP_209643.1). Accordingly, utilities of GAM7052 include diagnosis, prevention and treatment of diseases and clinical conditions associated with LOC285510.

LOC285589 (Accession XP_209671.1) is another GAM7052 target gene, herein designated TARGET GENE. LOC285589 BINDING SITE is a target binding site found in the 3' untranslated region of mRNA encoded by LOC285589, corresponding to a target binding site such as BINDING SITE I, BINDING SITE II or BINDING SITE III of FIG. 8. Table 4 illustrates the complementarity of the nucleotide sequences of LOC285589 BINDING SITE, designated SEQ ID:11163, to the nucleotide sequence of GAM7052 RNA, herein designated GAM RNA, also designated SEQ ID:296.

Another function of GAM7052 is therefore inhibition of LOC285589 (Accession XP_209671.1). Accordingly, utilities of GAM7052 include diagnosis, prevention and treatment of diseases and clinical conditions associated with LOC285589.

LOC285676 (Accession XP_209718.1) is another GAM7052 target gene, herein designated TARGET GENE. LOC285676 BINDING SITE is a target binding site found in the 3' untranslated region of mRNA encoded by LOC285676, corresponding to a target binding site such as BINDING SITE I, BINDING SITE II or BINDING SITE III of FIG. 8. Table 4 illustrates the complementarity of the nucleotide sequences of LOC285676 BINDING SITE, designated SEQ ID:18681, to the nucleotide sequence of GAM7052 RNA, herein designated GAM RNA, also designated SEQ ID:296.

Another function of GAM7052 is therefore inhibition of LOC285676 (Accession XP_209718.1). Accordingly, utilities of GAM7052 include diagnosis, prevention and treatment of diseases and clinical conditions associated with LOC285676.

LOC285683 (Accession XP_211980.1) is another GAM7052 target gene, herein designated TARGET GENE. LOC285683 BINDING SITE is a target binding site found in the 5' untranslated region of mRNA encoded by LOC285683, corresponding to a target binding site such as BINDING SITE I, BINDING SITE II or BINDING SITE III of FIG. 8. Table 4 illustrates the complementarity of the nucleotide sequences of LOC285683 BINDING SITE, designated SEQ ID:11222, to the nucleotide sequence of GAM7052 RNA, herein designated GAM RNA, also designated SEQ ID:296.

Another function of GAM7052 is therefore inhibition of LOC285683 (Accession XP_211980.1). Accordingly, utilities of GAM7052 include diagnosis, prevention and treatment of diseases and clinical conditions associated with LOC285683.

LOC285722 (Accession XP_211997.1) is another GAM7052 target gene, herein designated TARGET GENE. LOC285722 BINDING SITE is a target binding site found in the 5' untranslated region of mRNA encoded by LOC285722, corresponding to a target binding site such as BINDING SITE I, BINDING SITE II or BINDING SITE III of FIG. 8. Table 4 illustrates the complementarity of the nucleotide sequences of LOC285722 BINDING SITE, designated SEQ ID:4287, to the nucleotide sequence of GAM7052 RNA, herein designated GAM RNA, also designated SEQ ID:296.

Another function of GAM7052 is therefore inhibition of LOC285722 (Accession XP_211997.1). Accordingly, utilities of GAM7052 include diagnosis, prevention and treatment of diseases and clinical conditions associated with LOC285722.

LOC285747 (Accession XP_209742.1) is another GAM7052 target gene, herein designated TARGET GENE. LOC285747 BINDING SITE1 and LOC285747 BINDING SITE2 are target binding sites found in untranslated regions of mRNA encoded by LOC285747, corresponding to target binding sites such as BINDING SITE I, BINDING SITE II or BINDING SITE III of FIG. 8. Table 4 illustrates the complementarity of the nucleotide sequences of LOC285747 BINDING SITE1 and LOC285747 BINDING SITE2, designated SEQ ID:4189 and SEQ ID:5620 respectively, to the nucleotide sequence of GAM7052 RNA, herein designated GAM RNA, also designated SEQ ID:296.

Another function of GAM7052 is therefore inhibition of LOC285747 (Accession XP_209742.1). Accordingly, utilities of GAM7052 include diagnosis, prevention and treatment of diseases and clinical conditions associated with LOC285747.

LOC285812 (Accession XP_212055.1) is another GAM7052 target gene, herein designated TARGET GENE. LOC285812 BINDING SITE is a target binding site found in the 3' untranslated region of mRNA encoded by LOC285812, corresponding to a target binding site such as BINDING SITE I, BINDING SITE II or BINDING SITE III of FIG. 8. Table 4 illustrates the complementarity of the nucleotide sequences of LOC285812 BINDING SITE, designated SEQ ID:15916, to the nucleotide sequence of GAM7052 RNA, herein designated GAM RNA, also designated SEQ ID:296.

Another function of GAM7052 is therefore inhibition of LOC285812 (Accession XP_212055.1). Accordingly, utilities of GAM7052 include diagnosis, prevention and treatment of diseases and clinical conditions associated with LOC285812.

LOC285813 (Accession XP_212036.1) is another GAM7052 target gene, herein designated TARGET GENE. LOC285813 BINDING SITE is a target binding site found in the 5' untranslated region of mRNA encoded by LOC285813, corresponding to a target binding site such as BINDING SITE I, BINDING SITE II or BINDING SITE III of FIG. 8. Table 4 illustrates the complementarity of the nucleotide sequences of LOC285813 BINDING SITE, designated SEQ ID:12894, to the nucleotide sequence of GAM7052 RNA, herein designated GAM RNA, also designated SEQ ID:296.

Another function of GAM7052 is therefore inhibition of LOC285813 (Accession XP_212036.1). Accordingly, utilities of GAM7052 include diagnosis, prevention and treatment of diseases and clinical conditions associated with LOC285813.

LOC285822 (Accession XP_209777.1) is another GAM7052 target gene, herein designated TARGET GENE. LOC285822 BINDING SITE is a target binding site found in the 5' untranslated region of mRNA encoded by LOC285822, corresponding to a target binding site such as BINDING SITE I, BINDING SITE II or BINDING SITE III of FIG. 8. Table 4 illustrates the complementarity of the nucleotide sequences of LOC285822 BINDING SITE, designated SEQ ID:649, to the nucleotide sequence of GAM7052 RNA, herein designated GAM RNA, also designated SEQ ID:296.

Another function of GAM7052 is therefore inhibition of LOC285822 (Accession XP_209777.1). Accordingly, utilities of GAM7052 include diagnosis, prevention and treatment of diseases and clinical conditions associated with LOC285822.

LOC285830 (Accession XP_212043.1) is another GAM7052 target gene, herein designated TARGET GENE. LOC285830 BINDING SITE is a target binding site found in the 5' untranslated region of mRNA encoded by LOC285830, corresponding to a target binding site such as BINDING SITE I, BINDING SITE II or BINDING SITE III of FIG. 8. Table 4 illustrates the complementarity of the nucleotide sequences of LOC285830 BINDING SITE, designated SEQ ID:14138, to the nucleotide sequence of GAM7052 RNA, herein designated GAM RNA, also designated SEQ ID:296.

Another function of GAM7052 is therefore inhibition of LOC285830 (Accession XP_212043.1). Accordingly, utilities of GAM7052 include diagnosis, prevention and treatment of diseases and clinical conditions associated with LOC285830.

LOC285843 (Accession XP_212034.1) is another GAM7052 target gene, herein designated TARGET GENE. LOC285843 BINDING SITE1 and LOC285843 BINDING SITE2 are target binding sites found in untranslated regions of mRNA encoded by LOC285843, corresponding to target binding sites such as BINDING SITE I, BINDING SITE II or BINDING SITE III of FIG. 8. Table 4 illustrates the complementarity of the nucleotide sequences of LOC285843 BINDING SITE1 and LOC285843 BINDING SITE2, designated SEQ ID:12028 and SEQ ID:3009 respectively, to the nucleotide sequence of GAM7052 RNA, herein designated GAM RNA, also designated SEQ ID:296.

Another function of GAM7052 is therefore inhibition of LOC285843 (Accession XP_212034.1). Accordingly, utilities of GAM7052 include diagnosis, prevention and treatment of diseases and clinical conditions associated with LOC285843.

LOC285853 (Accession XP_209779.1) is another GAM7052 target gene, herein designated TARGET GENE. LOC285853 BINDING SITE is a target binding site found in the 3' untranslated region of mRNA encoded by LOC285853, corresponding to a target binding site such as BINDING SITE I, BINDING SITE II or BINDING SITE III of FIG. 8. Table 4 illustrates the complementarity of the nucleotide sequences of LOC285853 BINDING SITE, designated SEQ ID:3638, to the nucleotide sequence of GAM7052 RNA, herein designated GAM RNA, also designated SEQ ID:296.

Another function of GAM7052 is therefore inhibition of LOC285853 (Accession XP_209779.1). Accordingly, utilities of GAM7052 include diagnosis, prevention and treatment of diseases and clinical conditions associated with LOC285853.

LOC285896 (Accession XP_209806.1) is another GAM7052 target gene, herein designated TARGET GENE. LOC285896 BINDING SITE1 and LOC285896 BINDING SITE2 are target binding sites found in untranslated regions of mRNA encoded by LOC285896, corresponding to target binding sites such as BINDING SITE I, BINDING SITE II or BINDING SITE III of FIG. 8. Table 4 illustrates the complementarity of the nucleotide sequences of LOC285896 BINDING SITE1 and LOC285896 BINDING SITE2, designated SEQ ID:13183 and SEQ ID:19678 respectively, to the nucleotide sequence of GAM7052 RNA, herein designated GAM RNA, also designated SEQ ID:296.

Another function of GAM7052 is therefore inhibition of LOC285896 (Accession XP_209806.1). Accordingly, utilities of GAM7052 include diagnosis, prevention and treatment of diseases and clinical conditions associated with LOC285896.

LOC285922 (Accession XP_209822.1) is another GAM7052 target gene, herein designated TARGET GENE. LOC285922 BINDING SITE1 and LOC285922 BINDING SITE2 are target binding sites found in untranslated regions of mRNA encoded by LOC285922, corresponding to target binding sites such as BINDING SITE I, BINDING SITE II or BINDING SITE III of FIG. 8. Table 4 illustrates the complementarity of the nucleotide sequences of LOC285922 BINDING SITE1 and LOC285922 BINDING SITE2, designated SEQ ID:13183 and SEQ ID:19678 respectively, to the nucleotide sequence of GAM7052 RNA, herein designated GAM RNA, also designated SEQ ID:296.

Another function of GAM7052 is therefore inhibition of LOC285922 (Accession XP_209822.1). Accordingly, utilities of GAM7052 include diagnosis, prevention and treatment of diseases and clinical conditions associated with LOC285922.

LOC285936 (Accession XP_209834.2) is another GAM7052 target gene, herein designated TARGET GENE. LOC285936 BINDING SITE is a target binding site found in the 3' untranslated region of mRNA encoded by LOC285936, corresponding to a target binding site such as BINDING SITE I, BINDING SITE II or BINDING SITE III of FIG. 8. Table 4 illustrates the complementarity of the nucleotide sequences of LOC285936 BINDING SITE, designated SEQ ID:5346, to the nucleotide sequence of GAM7052 RNA, herein designated GAM RNA, also designated SEQ ID:296.

Another function of GAM7052 is therefore inhibition of LOC285936 (Accession XP_209834.2). Accordingly, utilities of GAM7052 include diagnosis, prevention and treatment of diseases and clinical conditions associated with LOC285936.

LOC285946 (Accession XP_212103.1) is another GAM7052 target gene, herein designated TARGET GENE. LOC285946 BINDING SITE is a target binding site found in the 3' untranslated region of mRNA encoded by LOC285946, corresponding to a target binding site such as BINDING SITE I, BINDING SITE II or BINDING SITE III of FIG. 8. Table 4 illustrates the complementarity of the nucleotide sequences of LOC285946 BINDING SITE, designated SEQ ID:18469, to the nucleotide sequence of GAM7052 RNA, herein designated GAM RNA, also designated SEQ ID:296.

Another function of GAM7052 is therefore inhibition of LOC285946 (Accession XP_212103.1). Accordingly, utilities of GAM7052 include diagnosis, prevention and treatment of diseases and clinical conditions associated with LOC285946.

LOC285952 (Accession XP_209821.1) is another GAM7052 target gene, herein designated TARGET GENE. LOC285952 BINDING SITE1 and LOC285952 BINDING SITE2 are target binding sites found in untranslated regions of mRNA encoded by LOC285952, corresponding to target binding sites such as BINDING SITE I, BINDING SITE II or BINDING SITE III of FIG. 8. Table 4 illustrates the complementarity of the nucleotide sequences of LOC285952 BINDING SITE1 and LOC285952 BINDING SITE2, designated SEQ ID:10251 and SEQ ID:13737 respectively, to the nucleotide sequence of GAM7052 RNA, herein designated GAM RNA, also designated SEQ ID:296.

Another function of GAM7052 is therefore inhibition of LOC285952 (Accession XP_209821.1). Accordingly, utilities of GAM7052 include diagnosis, prevention and treatment of diseases and clinical conditions associated with LOC285952.

LOC285961 (Accession XP_209833.1) is another GAM7052 target gene, herein designated TARGET GENE. LOC285961 BINDING SITE is a target binding site found in the 3' untranslated region of mRNA encoded by LOC285961, corresponding to a target binding site such as BINDING SITE I, BINDING SITE II or BINDING SITE III of FIG. 8. Table 4 illustrates the complementarity of the nucleotide sequences of LOC285961 BINDING SITE, designated SEQ ID:4709, to the nucleotide sequence of GAM7052 RNA, herein designated GAM RNA, also designated SEQ ID:296.

Another function of GAM7052 is therefore inhibition of LOC285961 (Accession XP_209833.1). Accordingly, utilities of GAM7052 include diagnosis, prevention and treatment of diseases and clinical conditions associated with LOC285961.

LOC285972 (Accession XP_212105.1) is another GAM7052 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:1250, to the nucleotide sequence of GAM7052 RNA, herein designated GAM RNA, also designated SEQ ID:296.

Another function of GAM7052 is therefore inhibition of LOC285972 (Accession XP_212105.1). Accordingly, utilities of GAM7052 include diagnosis, prevention and treatment of diseases and clinical conditions associated with LOC285972.

LOC285981 (Accession XP_212114.1) is another GAM7052 target gene, herein designated TARGET GENE. LOC285981 BINDING SITE is a target binding site found in the 5' untranslated region of mRNA encoded by LOC285981, corresponding to a target binding site such as BINDING SITE I, BINDING SITE II or BINDING SITE III of FIG. 8. Table 4 illustrates the complementarity of the nucleotide sequences of LOC285981 BINDING SITE, designated SEQ ID:9691, to the nucleotide sequence of GAM7052 RNA, herein designated GAM RNA, also designated SEQ ID:296.

Another function of GAM7052 is therefore inhibition of LOC285981 (Accession XP_212114.1). Accordingly, utilities of GAM7052 include diagnosis, prevention and treatment of diseases and clinical conditions associated with LOC285981.

LOC285989 (Accession XP_212111.1) is another GAM7052 target gene, herein designated TARGET GENE. LOC285989 BINDING SITE is a target binding site found in the 3' untranslated region of mRNA encoded by LOC285989, corresponding to a target binding site such as BINDING SITE I, BINDING SITE II or BINDING SITE III of FIG. 8. Table 4 illustrates the complementarity of the nucleotide sequences of LOC285989 BINDING SITE, designated SEQ ID:9996, to the nucleotide sequence of GAM7052 RNA, herein designated GAM RNA, also designated SEQ ID:296.

Another function of GAM7052 is therefore inhibition of LOC285989 (Accession XP_212111.1). Accordingly, utilities of GAM7052 include diagnosis, prevention and treatment of diseases and clinical conditions associated with LOC285989.

LOC285999 (Accession XP_212120.1) is another GAM7052 target gene, herein designated TARGET GENE. LOC285999 BINDING SITE is a target binding site found in the 3' untranslated region of mRNA encoded by LOC285999, corresponding to a target binding site such as BINDING SITE I, BINDING SITE II or BINDING SITE III of FIG. 8. Table 4 illustrates the complementarity of the nucleotide sequences of LOC285999 BINDING SITE, designated SEQ ID:14823, to the nucleotide sequence of GAM7052 RNA, herein designated GAM RNA, also designated SEQ ID:296.

Another function of GAM7052 is therefore inhibition of LOC285999 (Accession XP_212120.1). Accordingly, utilities of GAM7052 include diagnosis, prevention and treatment of diseases and clinical conditions associated with LOC285999.

LOC286030 (Accession XP_209868.1) is another GAM7052 target gene, herein designated TARGET GENE. LOC286030 BINDING SITE is a target binding site found in the 5' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:8761, to the nucleotide sequence of GAM7052 RNA, herein designated GAM RNA, also designated SEQ ID:296.

Another function of GAM7052 is therefore inhibition of LOC286030 (Accession XP_209868.1). Accordingly, utilities of GAM7052 include diagnosis, prevention and treatment of diseases and clinical conditions associated with LOC286030.

LOC286039 (Accession XP_209873.1) is another GAM7052 target gene, herein designated TARGET GENE. LOC286039 BINDING SITE is a target binding site found in the 5' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:4778, to the nucleotide sequence of GAM7052 RNA, herein designated GAM RNA, also designated SEQ ID:296.

Another function of GAM7052 is therefore inhibition of LOC286039 (Accession XP_209873.1). Accordingly, utilities of GAM7052 include diagnosis, prevention and treatment of diseases and clinical conditions associated with LOC286039.

LOC286052 (Accession XP_212152.1) is another GAM7052 target gene, herein designated TARGET GENE. LOC286052 BINDING SITE is a target binding site found in the 3' untranslated region of mRNA encoded by LOC286052, corresponding to a target binding site such as BINDING SITE I, BINDING SITE II or BINDING SITE III of FIG. 8. Table 4 illustrates the complementarity of the nucleotide sequences of LOC286052 BINDING SITE, designated SEQ ID:12351, to the nucleotide sequence of GAM7052 RNA, herein designated GAM RNA, also designated SEQ ID:296.

Another function of GAM7052 is therefore inhibition of LOC286052 (Accession XP_212152.1). Accordingly, utilities of GAM7052 include diagnosis, prevention and treatment of diseases and clinical conditions associated with LOC286052.

LOC286059 (Accession XP_212156.1) is another GAM7052 target gene, herein designated TARGET GENE. LOC286059 BINDING SITE is a target binding site found in the 3' untranslated region of mRNA encoded by LOC286059, corresponding to a target binding site such as BINDING SITE I, BINDING SITE II or BINDING SITE III of FIG. 8. Table 4 illustrates the complementarity of the nucleotide sequences of LOC286059 BINDING SITE, designated SEQ ID:1551, to the nucleotide sequence of GAM7052 RNA, herein designated GAM RNA, also designated SEQ ID:296.

Another function of GAM7052 is therefore inhibition of LOC286059 (Accession XP_212156.1). Accordingly, utilities of GAM7052 include diagnosis, prevention and treatment of diseases and clinical conditions associated with LOC286059.

LOC286077 (Accession XP_209892.1) is another GAM7052 target gene, herein designated TARGET GENE. LOC286077 BINDING SITE is a target binding site found in the 3' untranslated region of mRNA encoded by LOC286077, corresponding to a target binding site such as BINDING SITE I, BINDING SITE II or BINDING SITE III of FIG. 8. Table 4 illustrates the complementarity of the nucleotide sequences of LOC286077 BINDING SITE, designated SEQ ID:16730, to the nucleotide sequence of GAM7052 RNA, herein designated GAM RNA, also designated SEQ ID:296.

Another function of GAM7052 is therefore inhibition of LOC286077 (Accession XP_209892.1). Accordingly, utilities of GAM7052 include diagnosis, prevention and treatment of diseases and clinical conditions associated with LOC286077.

LOC286078 (Accession XP_212163.1) is another GAM7052 target gene, herein designated TARGET GENE. LOC286078 BINDING SITE1 through LOC286078 BINDING SITE3 are target binding sites found in untranslated regions of mRNA encoded by LOC286078, corresponding to target binding sites such as BINDING SITE I, BINDING SITE II or BINDING SITE III of FIG. 8. Table 4 illustrates the complementarity of the nucleotide sequences of LOC286078 BINDING SITE1 through LOC286078 BINDING SITE3, designated SEQ ID:8761, SEQ ID:18097 and SEQ ID:7215 respectively, to the nucleotide sequence of GAM7052 RNA, herein designated GAM RNA, also designated SEQ ID:296.

Another function of GAM7052 is therefore inhibition of LOC286078 (Accession XP_212163.1). Accordingly, utilities of GAM7052 include diagnosis, prevention and treatment of diseases and clinical conditions associated with LOC286078.

LOC286170 (Accession XP_212211.1) is another GAM7052 target gene, herein designated TARGET GENE. LOC286170 BINDING SITE is a target binding site found in the 5' untranslated region of mRNA encoded by LOC286170, corresponding to a target binding site such as BINDING SITE I, BINDING SITE II or BINDING SITE III of FIG. 8. Table 4 illustrates the complementarity of the nucleotide sequences of LOC286170 BINDING SITE, designated SEQ ID:20073, to the nucleotide sequence of GAM7052 RNA, herein designated GAM RNA, also designated SEQ ID:296.

Another function of GAM7052 is therefore inhibition of LOC286170 (Accession XP_212211.1). Accordingly, utilities of GAM7052 include diagnosis, prevention and treatment of diseases and clinical conditions associated with LOC286170.

LOC286215 (Accession XP_212228.1) is another GAM7052 target gene, herein designated TARGET GENE. LOC286215 BINDING SITE is a target binding site found in the 5' untranslated region of mRNA encoded by LOC286215, corresponding to a target binding site such as BINDING SITE I, BINDING SITE II or BINDING SITE III of FIG. 8. Table 4 illustrates the complementarity of the nucleotide sequences of LOC286215 BINDING SITE, designated SEQ ID:1985, to the nucleotide sequence of GAM7052 RNA, herein designated GAM RNA, also designated SEQ ID:296.

Another function of GAM7052 is therefore inhibition of LOC286215 (Accession XP_212228.1). Accordingly, utilities of GAM7052 include diagnosis, prevention and treatment of diseases and clinical conditions associated with LOC286215.

LOC286218 (Accession XP_212235.1) is another GAM7052 target gene, herein designated TARGET GENE. LOC286218 BINDING SITE is a target binding site found in the 3' untranslated region of mRNA encoded by LOC286218, corresponding to a target binding site such as BINDING SITE I, BINDING SITE II or BINDING SITE III of FIG. 8. Table 4 illustrates the complementarity of the nucleotide sequences of LOC286218 BINDING SITE, designated SEQ ID:4345, to the nucleotide sequence of GAM7052 RNA, herein designated GAM RNA, also designated SEQ ID:296.

Another function of GAM7052 is therefore inhibition of LOC286218 (Accession XP_212235.1). Accordingly, utilities of GAM7052 include diagnosis, prevention and treatment of diseases and clinical conditions associated with LOC286218.

LOC286235 (Accession XP_212238.1) is another GAM7052 target gene, herein designated TARGET GENE. LOC286235 BINDING SITE1 and LOC286235 BINDING SITE2 are target binding sites found in untranslated regions of mRNA encoded by LOC286235, corresponding to target binding sites such as BINDING SITE I, BINDING SITE II or BINDING SITE III of FIG. 8. Table 4 illustrates the complementarity of the nucleotide sequences of LOC286235 BINDING SITE1 and LOC286235 BINDING SITE2, designated SEQ ID:7295 and SEQ ID:8806 respectively, to the nucleotide sequence of GAM7052 RNA, herein designated GAM RNA, also designated SEQ ID:296.

Another function of GAM7052 is therefore inhibition of LOC286235 (Accession XP_212238.1). Accordingly, utilities of GAM7052 include diagnosis, prevention and treatment of diseases and clinical conditions associated with LOC286235.

LOC286237 (Accession XP_212241.1) is another GAM7052 target gene, herein designated TARGET GENE. LOC286237 BINDING SITE1 and LOC286237 BINDING SITE2 are target binding sites found in untranslated regions of mRNA encoded by LOC286237, corresponding to target binding sites such as BINDING SITE I, BINDING SITE II or BINDING SITE III of FIG. 8. Table 4 illustrates the complementarity of the nucleotide sequences of LOC286237 BINDING SITE1 and LOC286237 BINDING SITE2, designated SEQ ID:8806 and SEQ ID:7295 respectively, to the nucleotide sequence of GAM7052 RNA, herein designated GAM RNA, also designated SEQ ID:296.

Another function of GAM7052 is therefore inhibition of LOC286237 (Accession XP_212241.1). Accordingly, utilities of GAM7052 include diagnosis, prevention and treatment of diseases and clinical conditions associated with LOC286237.

LOC286245 (Accession XP_212244.1) is another GAM7052 target gene, herein designated TARGET GENE. LOC286245 BINDING SITE is a target binding site found in the 5' untranslated region of mRNA encoded by LOC286245, corresponding to a target binding site such as BINDING SITE I, BINDING SITE II or BINDING SITE III of FIG. 8. Table 4 illustrates the complementarity of the nucleotide sequences of LOC286245 BINDING SITE, designated SEQ ID:10128, to the nucleotide sequence of GAM7052 RNA, herein designated GAM RNA, also designated SEQ ID:296.

Another function of GAM7052 is therefore inhibition of LOC286245 (Accession XP_212244.1). Accordingly, utilities of GAM7052 include diagnosis, prevention and treatment of diseases and clinical conditions associated with LOC286245.

LOC286341 (Accession XP_212278.1) is another GAM7052 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:2204, to the nucleotide sequence of GAM7052 RNA, herein designated GAM RNA, also designated SEQ ID:296.

Another function of GAM7052 is therefore inhibition of LOC286341 (Accession XP_212278.1). Accordingly, utilities of GAM7052 include diagnosis, prevention and treatment of diseases and clinical conditions associated with LOC286341.

LOC286354 (Accession XP_212286.1) is another GAM7052 target gene, herein designated TARGET GENE. LOC286354 BINDING SITE is a target binding site found in the 5' untranslated region of mRNA encoded by LOC286354, corresponding to a target binding site such as BINDING SITE I, BINDING SITE II or BINDING SITE III of FIG. 8. Table 4 illustrates the complementarity of the nucleotide sequences of LOC286354 BINDING SITE, designated SEQ ID:10895, to the nucleotide sequence of GAM7052 RNA, herein designated GAM RNA, also designated SEQ ID:296.

Another function of GAM7052 is therefore inhibition of LOC286354 (Accession XP_212286.1). Accordingly, utilities of GAM7052 include diagnosis, prevention and treatment of diseases and clinical conditions associated with LOC286354.

LOC286381 (Accession XP_212298.1) is another GAM7052 target gene, herein designated TARGET GENE. LOC286381 BINDING SITE is a target binding site found in the 3' untranslated region of mRNA encoded by LOC286381, corresponding to a target binding site such as BINDING SITE I, BINDING SITE II or BINDING SITE III of FIG. 8. Table 4 illustrates the complementarity of the nucleotide sequences of LOC286381 BINDING SITE, designated SEQ ID:15760, to the nucleotide sequence of GAM7052 RNA, herein designated GAM RNA, also designated SEQ ID:296.

Another function of GAM7052 is therefore inhibition of LOC286381 (Accession XP_212298.1). Accordingly, utilities of GAM7052 include diagnosis, prevention and treatment of diseases and clinical conditions associated with LOC286381.

LOC286395 (Accession XP_212308.1) is another GAM7052 target gene, herein designated TARGET GENE. LOC286395 BINDING SITE is a target binding site found in the 5' untranslated region of mRNA encoded by LOC286395, corresponding to a target binding site such as BINDING SITE I, BINDING SITE II or BINDING SITE III of FIG. 8. Table 4 illustrates the complementarity of the nucleotide sequences of LOC286395 BINDING SITE, designated SEQ ID:15494, to the nucleotide sequence of GAM7052 RNA, herein designated GAM RNA, also designated SEQ ID:296.

Another function of GAM7052 is therefore inhibition of LOC286395 (Accession XP_212308.1). Accordingly, utilities of GAM7052 include diagnosis, prevention and treatment of diseases and clinical conditions associated with LOC286395.

LOC286401 (Accession XP_212310.1) is another GAM7052 target gene, herein designated TARGET GENE. LOC286401 BINDING SITE is a target binding site found in the 5' untranslated region of mRNA encoded by LOC286401, corresponding to a target binding site such as BINDING SITE I, BINDING SITE II or BINDING SITE III of FIG. 8. Table 4 illustrates the complementarity of the nucleotide sequences of LOC286401 BINDING SITE, designated SEQ ID:6157, to the nucleotide sequence of GAM7052 RNA, herein designated GAM RNA, also designated SEQ ID:296.

Another function of GAM7052 is therefore inhibition of LOC286401 (Accession XP_212310.1). Accordingly, utilities of GAM7052 include diagnosis, prevention and treatment of diseases and clinical conditions associated with LOC286401.

LOC286467 (Accession XP_210063.1) is another GAM7052 target gene, herein designated TARGET GENE. LOC286467 BINDING SITE is a target binding site found in the 3' untranslated region of mRNA encoded by LOC286467, corresponding to a target binding site such as BINDING SITE I, BINDING SITE II or BINDING SITE III of FIG. 8. Table 4 illustrates the complementarity of the nucleotide sequences of LOC286467 BINDING SITE, designated SEQ ID:16885, to the nucleotide sequence of GAM7052 RNA, herein designated GAM RNA, also designated SEQ ID:296.

Another function of GAM7052 is therefore inhibition of LOC286467 (Accession XP_210063.1). Accordingly, utilities of GAM7052 include diagnosis, prevention and treatment of diseases and clinical conditions associated with LOC286467.

LOC286553 (Accession XP_212340.1) is another GAM7052 target gene, herein designated TARGET GENE. LOC286553 BINDING SITE is a target binding site found in the 3' untranslated region of mRNA encoded by LOC286553, corresponding to a target binding site such as BINDING SITE I, BINDING SITE II or BINDING SITE III of FIG. 8. Table 4 illustrates the complementarity of the nucleotide sequences of LOC286553 BINDING SITE, designated SEQ ID:12740, to the nucleotide sequence of GAM7052 RNA, herein designated GAM RNA, also designated SEQ ID:296.

Another function of GAM7052 is therefore inhibition of LOC286553 (Accession XP_212340.1). Accordingly, utilities of GAM7052 include diagnosis, prevention and treatment of diseases and clinical conditions associated with LOC286553.

LOC338565 (Accession XP_294653.1) is another GAM7052 target gene, herein designated TARGET GENE. LOC338565 BINDING SITE1 and LOC338565 BINDING SITE2 are target binding sites found in untranslated regions of mRNA encoded by LOC338565, corresponding to target binding sites such as BINDING SITE I, BINDING SITE II or BINDING SITE III of FIG. 8. Table 4 illustrates the complementarity of the nucleotide sequences of LOC338565 BINDING SITE1 and LOC338565 BINDING SITE2, designated SEQ ID:4912 and SEQ ID:13157 respectively, to the nucleotide sequence of GAM7052 RNA, herein designated GAM RNA, also designated SEQ ID:296.

Another function of GAM7052 is therefore inhibition of LOC338565 (Accession XP_294653.1). Accordingly, utilities of GAM7052 include diagnosis, prevention and treatment of diseases and clinical conditions associated with LOC338565.

LOC338575 (Accession XP_290473.1) is another GAM7052 target gene, herein designated TARGET GENE. LOC338575 BINDING SITE is a target binding site found in the 3' untranslated region of mRNA encoded by LOC338575, corresponding to a target binding site such as BINDING SITE I, BINDING SITE II or BINDING SITE III of FIG. 8. Table 4 illustrates the complementarity of the nucleotide sequences of LOC338575 BINDING SITE, designated SEQ ID:10830, to the nucleotide sequence of GAM7052 RNA, herein designated GAM RNA, also designated SEQ ID:296.

Another function of GAM7052 is therefore inhibition of LOC338575 (Accession XP_290473.1). Accordingly, utilities of GAM7052 include diagnosis, prevention and treatment of diseases and clinical conditions associated with LOC338575.

LOC338638 (Accession XP_294671.1) is another GAM7052 target gene, herein designated TARGET GENE. LOC338638 BINDING SITE is a target binding site found in the 5' untranslated region of mRNA encoded by LOC338638, corresponding to a target binding site such as BINDING SITE I, BINDING SITE II or BINDING SITE III of FIG. 8. Table 4 illustrates the complementarity of the nucleotide sequences of LOC338638 BINDING SITE, designated SEQ ID:19998, to the nucleotide sequence of GAM7052 RNA, herein designated GAM RNA, also designated SEQ ID:296.

Another function of GAM7052 is therefore inhibition of LOC338638 (Accession XP_294671.1). Accordingly, utilities of GAM7052 include diagnosis, prevention and treatment of diseases and clinical conditions associated with LOC338638.

LOC338645 (Accession XP_290494.1) is another GAM7052 target gene, herein designated TARGET GENE. LOC338645 BINDING SITE is a target binding site found in the 3' untranslated region of mRNA encoded by LOC338645, corresponding to a target binding site such as BINDING SITE I, BINDING SITE II or BINDING SITE III of FIG. 8. Table 4 illustrates the complementarity of the nucleotide sequences of LOC338645 BINDING SITE, designated SEQ ID:7837, to the nucleotide sequence of GAM7052 RNA, herein designated GAM RNA, also designated SEQ ID:296.

Another function of GAM7052 is therefore inhibition of LOC338645 (Accession XP_290494.1). Accordingly, utilities of GAM7052 include diagnosis, prevention and treatment of diseases and clinical conditions associated with LOC338645.

LOC338731 (Accession XP_294688.1) is another GAM7052 target gene, herein designated TARGET GENE.

LOC338731 BINDING SITE1 and LOC338731 BINDING SITE2 are target binding sites found in untranslated regions of mRNA encoded by LOC338731, corresponding to target binding sites such as BINDING SITE I, BINDING SITE II or BINDING SITE III of FIG. 8. Table 4 illustrates the complementarity of the nucleotide sequences of LOC338731 BINDING SITE1 and LOC338731 BINDING SITE2, designated SEQ ID:17885 and SEQ ID:12023 respectively, to the nucleotide sequence of GAM7052 RNA, herein designated GAM RNA, also designated SEQ ID:296.

Another function of GAM7052 is therefore inhibition of LOC338731 (Accession XP_294688.1). Accordingly, utilities of GAM7052 include diagnosis, prevention and treatment of diseases and clinical conditions associated with LOC338731.

LOC338739 (Accession XP_294690.1) is another GAM7052 target gene, herein designated TARGET GENE. LOC338739 BINDING SITE is a target binding site found in the 3' untranslated region of mRNA encoded by LOC338739, corresponding to a target binding site such as BINDING SITE I, BINDING SITE II or BINDING SITE III of FIG. 8. Table 4 illustrates the complementarity of the nucleotide sequences of LOC338739 BINDING SITE, designated SEQ ID:16372, to the nucleotide sequence of GAM7052 RNA, herein designated GAM RNA, also designated SEQ ID:296.

Another function of GAM7052 is therefore inhibition of LOC338739 (Accession XP_294690.1). Accordingly, utilities of GAM7052 include diagnosis, prevention and treatment of diseases and clinical conditions associated with LOC338739.

LOC338773 (Accession XP_290570.1) is another GAM7052 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:18646, to the nucleotide sequence of GAM7052 RNA, herein designated GAM RNA, also designated SEQ ID:296.

Another function of GAM7052 is therefore inhibition of LOC338773 (Accession XP_290570.1). Accordingly, utilities of GAM7052 include diagnosis, prevention and treatment of diseases and clinical conditions associated with LOC338773.

LOC338899 (Accession XP_294740.1) is another GAM7052 target gene, herein designated TARGET GENE. LOC338899 BINDING SITE is a target binding site found in the 5' untranslated region of mRNA encoded by LOC338899, corresponding to a target binding site such as BINDING SITE I, BINDING SITE II or BINDING SITE III of FIG. 8. Table 4 illustrates the complementarity of the nucleotide sequences of LOC338899 BINDING SITE, designated SEQ ID:9873, to the nucleotide sequence of GAM7052 RNA, herein designated GAM RNA, also designated SEQ ID:296.

Another function of GAM7052 is therefore inhibition of LOC338899 (Accession XP_294740.1). Accordingly, utilities of GAM7052 include diagnosis, prevention and treatment of diseases and clinical conditions associated with LOC338899.

LOC338923 (Accession XP_294742.1) is another GAM7052 target gene, herein designated TARGET GENE. LOC338923 BINDING SITE is a target binding site found in the 3' untranslated region of mRNA encoded by LOC338923, corresponding to a target binding site such as BINDING SITE I, BINDING SITE II or BINDING SITE III of FIG. 8. Table 4 illustrates the complementarity of the nucleotide sequences of LOC338923 BINDING SITE, designated SEQ ID:9896, to the nucleotide sequence of GAM7052 RNA, herein designated GAM RNA, also designated SEQ ID:296.

Another function of GAM7052 is therefore inhibition of LOC338923 (Accession XP_294742.1). Accordingly, utilities of GAM7052 include diagnosis, prevention and treatment of diseases and clinical conditions associated with LOC338923.

LOC339078 (Accession XP_290692.1) is another GAM7052 target gene, herein designated TARGET GENE. LOC339078 BINDING SITE is a target binding site found in the 3' untranslated region of mRNA encoded by LOC339078, corresponding to a target binding site such as BINDING SITE I, BINDING SITE II or BINDING SITE III of FIG. 8. Table 4 illustrates the complementarity of the nucleotide sequences of LOC339078 BINDING SITE, designated SEQ ID:16281, to the nucleotide sequence of GAM7052 RNA, herein designated GAM RNA, also designated SEQ ID:296.

Another function of GAM7052 is therefore inhibition of LOC339078 (Accession XP_290692.1). Accordingly, utilities of GAM7052 include diagnosis, prevention and treatment of diseases and clinical conditions associated with LOC339078.

LOC339324 (Accession XP_290838.1) is another GAM7052 target gene, herein designated TARGET GENE. LOC339324 BINDING SITE is a target binding site found in the 3' untranslated region of mRNA encoded by LOC339324, corresponding to a target binding site such as BINDING SITE I, BINDING SITE II or BINDING SITE III of FIG. 8. Table 4 illustrates the complementarity of the nucleotide sequences of LOC339324 BINDING SITE, designated SEQ ID:17237, to the nucleotide sequence of GAM7052 RNA, herein designated GAM RNA, also designated SEQ ID:296.

Another function of GAM7052 is therefore inhibition of LOC339324 (Accession XP_290838.1). Accordingly, utilities of GAM7052 include diagnosis, prevention and treatment of diseases and clinical conditions associated with LOC339324.

LOC339448 (Accession XP_290902.1) is another GAM7052 target gene, herein designated TARGET GENE. LOC339448 BINDING SITE is a target binding site found in the 3' untranslated region of mRNA encoded by LOC339448, corresponding to a target binding site such as BINDING SITE I, BINDING SITE II or BINDING SITE III of FIG. 8. Table 4 illustrates the complementarity of the nucleotide sequences of LOC339448 BINDING SITE, designated SEQ ID:14659, to the nucleotide sequence of GAM7052 RNA, herein designated GAM RNA, also designated SEQ ID:296.

Another function of GAM7052 is therefore inhibition of LOC339448 (Accession XP_290902.1). Accordingly, utilities of GAM7052 include diagnosis, prevention and treatment of diseases and clinical conditions associated with LOC339448.

LOC339492 (Accession XP_290919.1) is another GAM7052 target gene, herein designated TARGET GENE. LOC339492 BINDING SITE is a target binding site found in the 3' untranslated region of mRNA encoded by LOC339492, corresponding to a target binding site such as BINDING SITE I, BINDING SITE II or BINDING SITE III of FIG. 8. Table 4 illustrates the complementarity of the nucleotide sequences of LOC339492 BINDING SITE, designated SEQ ID:2858, to the nucleotide sequence of GAM7052 RNA, herein designated GAM RNA, also designated SEQ ID:296.

Another function of GAM7052 is therefore inhibition of LOC339492 (Accession XP_290919.1). Accordingly, utilities of GAM7052 include diagnosis, prevention and treatment of diseases and clinical conditions associated with LOC339492.

LOC339545 (Accession XP_290946.1) is another GAM7052 target gene, herein designated TARGET GENE. LOC339545 BINDING SITE is a target binding site found in the 3' untranslated region of mRNA encoded by LOC339545, corresponding to a target binding site such as BINDING SITE I, BINDING SITE II or BINDING SITE III of FIG. 8. Table 4 illustrates the complementarity of the nucleotide sequences of LOC339545 BINDING SITE, designated SEQ ID:19920, to the nucleotide sequence of GAM7052 RNA, herein designated GAM RNA, also designated SEQ ID:296.

Another function of GAM7052 is therefore inhibition of LOC339545 (Accession XP_290946.1). Accordingly, utilities of GAM7052 include diagnosis, prevention and treatment of diseases and clinical conditions associated with LOC339545.

LOC339553 (Accession XP_290949.1) is another GAM7052 target gene, herein designated TARGET GENE. LOC339553 BINDING SITE is a target binding site found in the 3' untranslated region of mRNA encoded by LOC339553, corresponding to a target binding site such as BINDING SITE I, BINDING SITE II or BINDING SITE III of FIG. 8. Table 4 illustrates the complementarity of the nucleotide sequences of LOC339553 BINDING SITE, designated SEQ ID:19920, to the nucleotide sequence of GAM7052 RNA, herein designated GAM RNA, also designated SEQ ID:296.

Another function of GAM7052 is therefore inhibition of LOC339553 (Accession XP_290949.1). Accordingly, utilities of GAM7052 include diagnosis, prevention and treatment of diseases and clinical conditions associated with LOC339553.

LOC339600 (Accession XP_295014.1) is another GAM7052 target gene, herein designated TARGET GENE. LOC339600 BINDING SITE is a target binding site found in the 3' untranslated region of mRNA encoded by LOC339600, corresponding to a target binding site such as BINDING SITE I, BINDING SITE II or BINDING SITE III of FIG. 8. Table 4 illustrates the complementarity of the nucleotide sequences of LOC339600 BINDING SITE, designated SEQ ID:10808, to the nucleotide sequence of GAM7052 RNA, herein designated GAM RNA, also designated SEQ ID:296.

Another function of GAM7052 is therefore inhibition of LOC339600 (Accession XP_295014.1). Accordingly, utilities of GAM7052 include diagnosis, prevention and treatment of diseases and clinical conditions associated with LOC339600.

LOC339622 (Accession XP_295016.1) is another GAM7052 target gene, herein designated TARGET GENE. LOC339622 BINDING SITE is a target binding site found in the 5' untranslated region of mRNA encoded by LOC339622, corresponding to a target binding site such as BINDING SITE I, BINDING SITE II or BINDING SITE III of FIG. 8. Table 4 illustrates the complementarity of the nucleotide sequences of LOC339622 BINDING SITE, designated SEQ ID:1892, to the nucleotide sequence of GAM7052 RNA, herein designated GAM RNA, also designated SEQ ID:296.

Another function of GAM7052 is therefore inhibition of LOC339622 (Accession XP_295016.1). Accordingly, utilities of GAM7052 include diagnosis, prevention and treatment of diseases and clinical conditions associated with LOC339622.

LOC339659 (Accession XP_290981.1) is another GAM7052 target gene, herein designated TARGET GENE. LOC339659 BINDING SITE is a target binding site found in the 3' untranslated region of mRNA encoded by LOC339659, corresponding to a target binding site such as BINDING SITE I, BINDING SITE II or BINDING SITE III of FIG. 8. Table 4 illustrates the complementarity of the nucleotide sequences of LOC339659 BINDING SITE, designated SEQ ID:19261, to the nucleotide sequence of GAM7052 RNA, herein designated GAM RNA, also designated SEQ ID:296.

Another function of GAM7052 is therefore inhibition of LOC339659 (Accession XP_290981.1). Accordingly, utilities of GAM7052 include diagnosis, prevention and treatment of diseases and clinical conditions associated with LOC339659.

LOC339809 (Accession XP_291020.1) is another GAM7052 target gene, herein designated TARGET GENE. LOC339809 BINDING SITE is a target binding site found in the 5' untranslated region of mRNA encoded by LOC339809, corresponding to a target binding site such as BINDING SITE I, BINDING SITE II or BINDING SITE III of FIG. 8. Table 4 illustrates the complementarity of the nucleotide sequences of LOC339809 BINDING SITE, designated SEQ ID:1251, to the nucleotide sequence of GAM7052 RNA, herein designated GAM RNA, also designated SEQ ID:296.

Another function of GAM7052 is therefore inhibition of LOC339809 (Accession XP_291020.1). Accordingly, utilities of GAM7052 include diagnosis, prevention and treatment of diseases and clinical conditions associated with LOC339809.

LOC339832 (Accession XP_295079.1) is another GAM7052 target gene, herein designated TARGET GENE. LOC339832 BINDING SITE is a target binding site found in the 5' untranslated region of mRNA encoded by LOC339832, corresponding to a target binding site such as BINDING SITE I, BINDING SITE II or BINDING SITE III of FIG. 8. Table 4 illustrates the complementarity of the nucleotide sequences of LOC339832 BINDING SITE, designated SEQ ID:14207, to the nucleotide sequence of GAM7052 RNA, herein designated GAM RNA, also designated SEQ ID:296.

Another function of GAM7052 is therefore inhibition of LOC339832 (Accession XP_295079.1). Accordingly, utilities of GAM7052 include diagnosis, prevention and treatment of diseases and clinical conditions associated with LOC339832.

LOC339833 (Accession XP_291031.1) is another GAM7052 target gene, herein designated TARGET GENE. LOC339833 BINDING SITE1 and LOC339833 BINDING SITE2 are target binding sites found in untranslated regions of mRNA encoded by LOC339833, corresponding to target binding sites such as BINDING SITE I, BINDING SITE II or BINDING SITE III of FIG. 8. Table 4 illustrates the complementarity of the nucleotide sequences of LOC339833 BINDING SITE1 and LOC339833 BINDING SITE2, designated SEQ ID:18479 and SEQ ID:17916 respectively, to the nucleotide sequence of GAM7052 RNA, herein designated GAM RNA, also designated SEQ ID:296.

Another function of GAM7052 is therefore inhibition of LOC339833 (Accession XP_291031.1). Accordingly, utilities of GAM7052 include diagnosis, prevention and treatment of diseases and clinical conditions associated with LOC339833.

LOC339909 (Accession XP_291069.1) is another GAM7052 target gene, herein designated TARGET GENE. LOC339909 BINDING SITE is a target binding site found in the 5' untranslated region of mRNA encoded by LOC339909, corresponding to a target binding site such as BINDING SITE I, BINDING SITE II or BINDING SITE III of FIG. 8. Table 4 illustrates the complementarity of the nucleotide sequences of LOC339909 BINDING SITE, designated SEQ ID:9636, to the nucleotide sequence of GAM7052 RNA, herein designated GAM RNA, also designated SEQ ID:296.

Another function of GAM7052 is therefore inhibition of LOC339909 (Accession XP_291069.1). Accordingly, utilities of GAM7052 include diagnosis, prevention and treatment of diseases and clinical conditions associated with LOC339909.

LOC340037 (Accession XP_295137.1) is another GAM7052 target gene, herein designated TARGET GENE. LOC340037 BINDING SITE is a target binding site found in the 3' untranslated region of mRNA encoded by LOC340037, corresponding to a target binding site such as BINDING SITE I, BINDING SITE II or BINDING SITE III of FIG. 8. Table 4 illustrates the complementarity of the nucleotide sequences of LOC340037 BINDING SITE, designated SEQ ID:13456, to the nucleotide sequence of GAM7052 RNA, herein designated GAM RNA, also designated SEQ ID:296.

Another function of GAM7052 is therefore inhibition of LOC340037 (Accession XP_295137.1). Accordingly, utilities of GAM7052 include diagnosis, prevention and treatment of diseases and clinical conditions associated with LOC340037.

LOC340065 (Accession XP_295146.1) is another GAM7052 target gene, herein designated TARGET GENE. LOC340065 BINDING SITE is a target binding site found in the 3' untranslated region of mRNA encoded by LOC340065, corresponding to a target binding site such as BINDING SITE I, BINDING SITE II or BINDING SITE III of FIG. 8. Table 4 illustrates the complementarity of the nucleotide sequences of LOC340065 BINDING SITE, designated SEQ ID:11211, to the nucleotide sequence of GAM7052 RNA, herein designated GAM RNA, also designated SEQ ID:296.

Another function of GAM7052 is therefore inhibition of LOC340065 (Accession XP_295146.1). Accordingly, utilities of GAM7052 include diagnosis, prevention and treatment of diseases and clinical conditions associated with LOC340065.

LOC340109 (Accession XP_295156.1) is another GAM7052 target gene, herein designated TARGET GENE. LOC340109 BINDING SITE1 and LOC340109 BINDING SITE2 are target binding sites found in untranslated regions of mRNA encoded by LOC340109, corresponding to target binding sites such as BINDING SITE I, BINDING SITE II or BINDING SITE III of FIG. 8. Table 4 illustrates the complementarity of the nucleotide sequences of LOC340109 BINDING SITE1 and LOC340109 BINDING SITE2, designated SEQ ID:9847 and SEQ ID:2492 respectively, to the nucleotide sequence of GAM7052 RNA, herein designated GAM RNA, also designated SEQ ID:296.

Another function of GAM7052 is therefore inhibition of LOC340109 (Accession XP_295156.1). Accordingly, utilities of GAM7052 include diagnosis, prevention and treatment of diseases and clinical conditions associated with LOC340109.

LOC340138 (Accession XP_291153.1) is another GAM7052 target gene, herein designated TARGET GENE. LOC340138 BINDING SITE is a target binding site found in the 3' untranslated region of mRNA encoded by LOC340138, corresponding to a target binding site such as BINDING SITE I, BINDING SITE II or BINDING SITE III of FIG. 8. Table 4 illustrates the complementarity of the nucleotide sequences of LOC340138 BINDING SITE, designated SEQ ID:10831, to the nucleotide sequence of GAM7052 RNA, herein designated GAM RNA, also designated SEQ ID:296.

Another function of GAM7052 is therefore inhibition of LOC340138 (Accession XP_291153.1). Accordingly, utilities of GAM7052 include diagnosis, prevention and treatment of diseases and clinical conditions associated with LOC340138.

LOC340156 (Accession XP_291158.1) is another GAM7052 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:765, to the nucleotide sequence of GAM7052 RNA, herein designated GAM RNA, also designated SEQ ID:296.

Another function of GAM7052 is therefore inhibition of LOC340156 (Accession XP_291158.1). Accordingly, utilities of GAM7052 include diagnosis, prevention and treatment of diseases and clinical conditions associated with LOC340156.

LOC340259 (Accession XP_295190.1) is another GAM7052 target gene, herein designated TARGET GENE. LOC340259 BINDING SITE is a target binding site found in the 5' untranslated region of mRNA encoded by LOC340259, corresponding to a target binding site such as BINDING SITE I, BINDING SITE II or BINDING SITE III of FIG. 8. Table 4 illustrates the complementarity of the nucleotide sequences of LOC340259 BINDING SITE, designated SEQ ID:12172, to the nucleotide sequence of GAM7052 RNA, herein designated GAM RNA, also designated SEQ ID:296.

Another function of GAM7052 is therefore inhibition of LOC340259 (Accession XP_295190.1). Accordingly, utilities of GAM7052 include diagnosis, prevention and treatment of diseases and clinical conditions associated with LOC340259.

LOC340390 (Accession XP_291269.1) is another GAM7052 target gene, herein designated TARGET GENE. LOC340390 BINDING SITE is a target binding site found in the 3' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:16887, to the nucleotide sequence of GAM7052 RNA, herein designated GAM RNA, also designated SEQ ID:296.

Another function of GAM7052 is therefore inhibition of LOC340390 (Accession XP_291269.1). Accordingly, utilities of GAM7052 include diagnosis, prevention and treatment of diseases and clinical conditions associated with LOC340390.

LOC340408 (Accession XP_291274.1) is another GAM7052 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:8761, to the nucleotide sequence of GAM7052 RNA, herein designated GAM RNA, also designated SEQ ID:296.

Another function of GAM7052 is therefore inhibition of LOC340408 (Accession XP_291274.1). Accordingly, utilities of GAM7052 include diagnosis, prevention and treatment of diseases and clinical conditions associated with LOC340408.

LOC340528 (Accession XP_295268.1) is another GAM7052 target gene, herein designated TARGET GENE. LOC340528 BINDING SITE is a target binding site found in the 3' untranslated region of mRNA encoded by LOC340528, corresponding to a target binding site such as BINDING SITE I, BINDING SITE II or BINDING SITE III of FIG. 8. Table 4 illustrates the complementarity of the nucleotide sequences of LOC340528 BINDING SITE, designated SEQ ID:9710, to the nucleotide sequence of GAM7052 RNA, herein designated GAM RNA, also designated SEQ ID:296.

Another function of GAM7052 is therefore inhibition of LOC340528 (Accession XP_295268.1). Accordingly, utilities of GAM7052 include diagnosis, prevention and treatment of diseases and clinical conditions associated with LOC340528.

LOC340547 (Accession XP_291331.1) is another GAM7052 target gene, herein designated TARGET GENE. LOC340547 BINDING SITE is a target binding site found in the 3' untranslated region of mRNA encoded by LOC340547, corresponding to a target binding site such as BINDING SITE I, BINDING SITE II or BINDING SITE III of FIG. 8. Table 4 illustrates the complementarity of the nucleotide sequences of LOC340547 BINDING SITE, designated SEQ ID:13947, to the nucleotide sequence of GAM7052 RNA, herein designated GAM RNA, also designated SEQ ID:296.

Another function of GAM7052 is therefore inhibition of LOC340547 (Accession XP_291331.1). Accordingly, utilities of GAM7052 include diagnosis, prevention and treatment of diseases and clinical conditions associated with LOC340547.

LOC342926 (Accession XP_292790.2) is another GAM7052 target gene, herein designated TARGET GENE. LOC342926 BINDING SITE is a target binding site found in the 3' untranslated region of mRNA encoded by LOC342926, corresponding to a target binding site such as BINDING SITE I, BINDING SITE II or BINDING SITE III of FIG. 8. Table 4 illustrates the complementarity of the nucleotide sequences of LOC342926 BINDING SITE, designated SEQ ID:4809, to the nucleotide sequence of GAM7052 RNA, herein designated GAM RNA, also designated SEQ ID:296.

Another function of GAM7052 is therefore inhibition of LOC342926 (Accession XP_292790.2). Accordingly, utilities of GAM7052 include diagnosis, prevention and treatment of diseases and clinical conditions associated with LOC342926.

LOC344805 (Accession XP_293599.2) is another GAM7052 target gene, herein designated TARGET GENE. LOC344805 BINDING SITE is a target binding site found in the 3' untranslated region of mRNA encoded by LOC344805, corresponding to a target binding site such as BINDING SITE I, BINDING SITE II or BINDING SITE III of FIG. 8. Table 4 illustrates the complementarity of the nucleotide sequences of LOC344805 BINDING SITE, designated SEQ ID:10624, to the nucleotide sequence of GAM7052 RNA, herein designated GAM RNA, also designated SEQ ID:296.

Another function of GAM7052 is therefore inhibition of LOC344805 (Accession XP_293599.2). Accordingly, utilities of GAM7052 include diagnosis, prevention and treatment of diseases and clinical conditions associated with LOC344805.

LOC345275 (Accession NP_835236.1) is another GAM7052 target gene, herein designated TARGET GENE. LOC345275 BINDING SITE is a target binding site found in the 3' untranslated region of multiple transcripts of mRNA encoded by LOC345275, corresponding to a target binding site such as BINDING SITE I, BINDING SITE II or BINDING SITE III of FIG. 8. Table 4 illustrates the complementarity of the nucleotide sequences of LOC345275 BINDING SITE, designated SEQ ID:9847, to the nucleotide sequence of GAM7052 RNA, herein designated GAM RNA, also designated SEQ ID:296.

Another function of GAM7052 is therefore inhibition of LOC345275 (Accession NP_835236.1). Accordingly, utilities of GAM7052 include diagnosis, prevention and treatment of diseases and clinical conditions associated with LOC345275.

LOC347803 (Accession XP_302604.1) is another GAM7052 target gene, herein designated TARGET GENE. LOC347803 BINDING SITE is a target binding site found in the 3' untranslated region of mRNA encoded by LOC347803, corresponding to a target binding site such as BINDING SITE I, BINDING SITE II or BINDING SITE III of FIG. 8. Table 4 illustrates the complementarity of the nucleotide sequences of LOC347803 BINDING SITE, designated SEQ ID:19575, to the nucleotide sequence of GAM7052 RNA, herein designated GAM RNA, also designated SEQ ID:296.

Another function of GAM7052 is therefore inhibition of LOC347803 (Accession XP_302604.1). Accordingly, utilities of GAM7052 include diagnosis, prevention and treatment of diseases and clinical conditions associated with LOC347803.

LOC347905 (Accession XP_302624.1) is another GAM7052 target gene, herein designated TARGET GENE. LOC347905 BINDING SITE is a target binding site found in the 5' untranslated region of mRNA encoded by LOC347905, corresponding to a target binding site such as BINDING SITE I, BINDING SITE II or BINDING SITE III of FIG. 8. Table 4 illustrates the complementarity of the nucleotide sequences of LOC347905 BINDING SITE, designated SEQ ID:7074, to the nucleotide sequence of GAM7052 RNA, herein designated GAM RNA, also designated SEQ ID:296.

Another function of GAM7052 is therefore inhibition of LOC347905 (Accession XP_302624.1). Accordingly, utilities of GAM7052 include diagnosis, prevention and treatment of diseases and clinical conditions associated with LOC347905.

LOC348075 (Accession XP_302653.1) is another GAM7052 target gene, herein designated TARGET GENE. LOC348075 BINDING SITE is a target binding site found in the 3' untranslated region of mRNA encoded by LOC348075, corresponding to a target binding site such as BINDING SITE I, BINDING SITE II or BINDING SITE III of FIG. 8. Table 4 illustrates the complementarity of the nucleotide sequences of LOC348075 BINDING SITE, designated SEQ ID:12676, to the nucleotide sequence of GAM7052 RNA, herein designated GAM RNA, also designated SEQ ID:296.

Another function of GAM7052 is therefore inhibition of LOC348075 (Accession XP_302653.1). Accordingly, utilities of GAM7052 include diagnosis, prevention and treatment of diseases and clinical conditions associated with LOC348075.

LOC348094 (Accession XP_300615.1) is another GAM7052 target gene, herein designated TARGET GENE. LOC348094 BINDING SITE1 and LOC348094 BINDING SITE2 are target binding sites found in untranslated regions of mRNA encoded by LOC348094, corresponding to target binding sites such as BINDING SITE I, BINDING SITE II or BINDING SITE III of FIG. 8. Table 4 illustrates the complementarity of the nucleotide sequences of LOC348094 BINDING SITE1 and LOC348094 BINDING SITE2, designated SEQ ID:16360 and SEQ ID:16871 respectively, to the nucleotide sequence of GAM7052 RNA, herein designated GAM RNA, also designated SEQ ID:296.

Another function of GAM7052 is therefore inhibition of LOC348094 (Accession XP_300615.1). Accordingly, utilities of GAM7052 include diagnosis, prevention and treatment of diseases and clinical conditions associated with LOC348094.

LOC348208 (Accession XP_302683.1) is another GAM7052 target gene, herein designated TARGET GENE. LOC348208 BINDING SITE is a target binding site found in the 5' untranslated region of mRNA encoded by LOC348208, corresponding to a target binding site such as BINDING SITE I, BINDING SITE II or BINDING SITE III of FIG. 8. Table 4 illustrates the complementarity of the nucleotide sequences of LOC348208 BINDING SITE, designated SEQ ID:17011, to the nucleotide sequence of GAM7052 RNA, herein designated GAM RNA, also designated SEQ ID:296.

Another function of GAM7052 is therefore inhibition of LOC348208 (Accession XP_302683.1). Accordingly, utilities of GAM7052 include diagnosis, prevention and treatment of diseases and clinical conditions associated with LOC348208.

LOC348235 (Accession XP_300670.1) is another GAM7052 target gene, herein designated TARGET GENE. LOC348235 BINDING SITE is a target binding site found in the 3' untranslated region of mRNA encoded by LOC348235, corresponding to a target binding site such as BINDING SITE I, BINDING SITE II or BINDING SITE III of FIG. 8. Table 4 illustrates the complementarity of the nucleotide sequences of LOC348235 BINDING SITE, designated SEQ ID:4503, to the nucleotide sequence of GAM7052 RNA, herein designated GAM RNA, also designated SEQ ID:296.

Another function of GAM7052 is therefore inhibition of LOC348235 (Accession XP_300670.1). Accordingly, utilities of GAM7052 include diagnosis, prevention and treatment of diseases and clinical conditions associated with LOC348235.

LOC348262 (Accession XP_300683.1) is another GAM7052 target gene, herein designated TARGET GENE. LOC348262 BINDING SITE is a target binding site found in the 5' untranslated region of mRNA encoded by LOC348262, corresponding to a target binding site such as BINDING SITE I, BINDING SITE II or BINDING SITE III of FIG. 8. Table 4 illustrates the complementarity of the nucleotide sequences of LOC348262 BINDING SITE, designated SEQ ID:5537, to the nucleotide sequence of GAM7052 RNA, herein designated GAM RNA, also designated SEQ ID:296.

Another function of GAM7052 is therefore inhibition of LOC348262 (Accession XP_300683.1). Accordingly, utilities of GAM7052 include diagnosis, prevention and treatment of diseases and clinical conditions associated with LOC348262.

LOC348396 (Accession XP_300729.1) is another GAM7052 target gene, herein designated TARGET GENE. LOC348396 BINDING SITE1 and LOC348396 BINDING SITE2 are target binding sites found in untranslated regions of mRNA encoded by LOC348396, corresponding to target binding sites such as BINDING SITE I, BINDING SITE II or BINDING SITE III of FIG. 8. Table 4 illustrates the complementarity of the nucleotide sequences of LOC348396 BINDING SITE1 and LOC348396 BINDING SITE2, designated SEQ ID:2104 and SEQ ID:10170 respectively, to the nucleotide sequence of GAM7052 RNA, herein designated GAM RNA, also designated SEQ ID:296.

Another function of GAM7052 is therefore inhibition of LOC348396 (Accession XP_300729.1). Accordingly, utilities of GAM7052 include diagnosis, prevention and treatment of diseases and clinical conditions associated with LOC348396.

LOC348402 (Accession XP_300730.1) is another GAM7052 target gene, herein designated TARGET GENE. LOC348402 BINDING SITE is a target binding site found in the 3' untranslated region of mRNA encoded by LOC348402, corresponding to a target binding site such as BINDING SITE I, BINDING SITE II or BINDING SITE III of FIG. 8. Table 4 illustrates the complementarity of the nucleotide sequences of LOC348402 BINDING SITE, designated SEQ ID:2858, to the nucleotide sequence of GAM7052 RNA, herein designated GAM RNA, also designated SEQ ID:296.

Another function of GAM7052 is therefore inhibition of LOC348402 (Accession XP_300730.1). Accordingly, utilities of GAM7052 include diagnosis, prevention and treatment of diseases and clinical conditions associated with LOC348402.

LOC348428 (Accession XP_302753.1) is another GAM7052 target gene, herein designated TARGET GENE. LOC348428 BINDING SITE1 through LOC348428 BINDING SITE3 are target binding sites found in untranslated regions of mRNA encoded by LOC348428, corresponding to target binding sites such as BINDING SITE I, BINDING SITE II or BINDING SITE III of FIG. 8. Table 4 illustrates the complementarity of the nucleotide sequences of LOC348428 BINDING SITE1 through LOC348428 BINDING SITE3, designated SEQ ID:2400, SEQ ID:1361 and SEQ ID:7896 respectively, to the nucleotide sequence of GAM7052 RNA, herein designated GAM RNA, also designated SEQ ID:296.

Another function of GAM7052 is therefore inhibition of LOC348428 (Accession XP_302753.1). Accordingly, utilities of GAM7052 include diagnosis, prevention and treatment of diseases and clinical conditions associated with LOC348428.

LOC348460 (Accession XP_300743.1) is another GAM7052 target gene, herein designated TARGET GENE. LOC348460 BINDING SITE is a target binding site found in the 3' untranslated region of mRNA encoded by LOC348460, corresponding to a target binding site such as BINDING SITE I, BINDING SITE II or BINDING SITE III of FIG. 8. Table 4 illustrates the complementarity of the nucleotide sequences of LOC348460 BINDING SITE, designated SEQ ID:13251, to the nucleotide sequence of GAM7052 RNA, herein designated GAM RNA, also designated SEQ ID:296.

Another function of GAM7052 is therefore inhibition of LOC348460 (Accession XP_300743.1). Accordingly, utilities of GAM7052 include diagnosis, prevention and treatment of diseases and clinical conditions associated with LOC348460.

LOC348492 (Accession XP_300758.1) is another GAM7052 target gene, herein designated TARGET GENE. LOC348492 BINDING SITE is a target binding site found in the 3' untranslated region of mRNA encoded by LOC348492, corresponding to a target binding site such as BINDING SITE I, BINDING SITE II or BINDING SITE III of FIG. 8. Table 4 illustrates the complementarity of the nucleotide sequences of LOC348492 BINDING SITE, designated SEQ ID:19920, to the nucleotide sequence of GAM7052 RNA, herein designated GAM RNA, also designated SEQ ID:296.

Another function of GAM7052 is therefore inhibition of LOC348492 (Accession XP_300758.1). Accordingly, utilities of GAM7052 include diagnosis, prevention and treatment of diseases and clinical conditions associated with LOC348492.

LOC348567 (Accession XP_300378.1) is another GAM7052 target gene, herein designated TARGET GENE. LOC348567 BINDING SITE is a target binding site found in the 3' untranslated region of mRNA encoded by LOC348567, corresponding to a target binding site such as BINDING SITE I, BINDING SITE II or BINDING SITE III of FIG. 8. Table 4 illustrates the complementarity of the nucleotide sequences of LOC348567 BINDING SITE, designated SEQ ID:5965, to the nucleotide sequence of GAM7052 RNA, herein designated GAM RNA, also designated SEQ ID:296.

Another function of GAM7052 is therefore inhibition of LOC348567 (Accession XP_300378.1). Accordingly, utilities of GAM7052 include diagnosis, prevention and treatment of diseases and clinical conditions associated with LOC348567.

LOC348699 (Accession XP_300816.1) is another GAM7052 target gene, herein designated TARGET GENE. LOC348699 BINDING SITE is a target binding site found in the 5' untranslated region of mRNA encoded by LOC348699, corresponding to a target binding site such as BINDING SITE I, BINDING SITE II or BINDING SITE III of FIG. 8. Table 4 illustrates the complementarity of the nucleotide sequences of LOC348699 BINDING SITE, designated SEQ ID:13715, to the nucleotide sequence of GAM7052 RNA, herein designated GAM RNA, also designated SEQ ID:296.

Another function of GAM7052 is therefore inhibition of LOC348699 (Accession XP_300816.1). Accordingly, utilities of GAM7052 include diagnosis, prevention and treatment of diseases and clinical conditions associated with LOC348699.

LOC348797 (Accession XP_302888.1) is another GAM7052 target gene, herein designated TARGET GENE. LOC348797 BINDING SITE is a target binding site found in the 3' untranslated region of mRNA encoded by LOC348797, corresponding to a target binding site such as BINDING SITE I, BINDING SITE II or BINDING SITE III of FIG. 8. Table 4 illustrates the complementarity of the nucleotide sequences of LOC348797 BINDING SITE, designated SEQ ID:7313, to the nucleotide sequence of GAM7052 RNA, herein designated GAM RNA, also designated SEQ ID:296.

Another function of GAM7052 is therefore inhibition of LOC348797 (Accession XP_302888.1). Accordingly, utilities of GAM7052 include diagnosis, prevention and treatment of diseases and clinical conditions associated with LOC348797.

LOC348798 (Accession XP_300845.1) is another GAM7052 target gene, herein designated TARGET GENE. LOC348798 BINDING SITE1 and LOC348798 BINDING SITE2 are target binding sites found in untranslated regions of mRNA encoded by LOC348798, corresponding to target binding sites such as BINDING SITE I, BINDING SITE II or BINDING SITE III of FIG. 8. Table 4 illustrates the complementarity of the nucleotide sequences of LOC348798 BINDING SITE1 and LOC348798 BINDING SITE2, designated SEQ ID:3079 and SEQ ID:12640 respectively, to the nucleotide sequence of GAM7052 RNA, herein designated GAM RNA, also designated SEQ ID:296.

Another function of GAM7052 is therefore inhibition of LOC348798 (Accession XP_300845.1). Accordingly, utilities of GAM7052 include diagnosis, prevention and treatment of diseases and clinical conditions associated with LOC348798.

LOC348888 (Accession XP_302910.1) is another GAM7052 target gene, herein designated TARGET GENE. LOC348888 BINDING SITE1 and LOC348888 BINDING SITE2 are target binding sites found in untranslated regions of mRNA encoded by LOC348888, corresponding to target binding sites such as BINDING SITE I, BINDING SITE II or BINDING SITE III of FIG. 8. Table 4 illustrates the complementarity of the nucleotide sequences of LOC348888 BINDING SITE1 and LOC348888 BINDING SITE2, designated SEQ ID:473 and SEQ ID:5196 respectively, to the nucleotide sequence of GAM7052 RNA, herein designated GAM RNA, also designated SEQ ID:296.

Another function of GAM7052 is therefore inhibition of LOC348888 (Accession XP_302910.1). Accordingly, utilities of GAM7052 include diagnosis, prevention and treatment of diseases and clinical conditions associated with LOC348888.

LOC348947 (Accession XP_302929.1) is another GAM7052 target gene, herein designated TARGET GENE. LOC348947 BINDING SITE is a target binding site found in the 3' untranslated region of mRNA encoded by LOC348947, corresponding to a target binding site such as BINDING SITE I, BINDING SITE II or BINDING SITE III of FIG. 8. Table 4 illustrates the complementarity of the nucleotide sequences of LOC348947 BINDING SITE, designated SEQ ID:1705, to the nucleotide sequence of GAM7052 RNA, herein designated GAM RNA, also designated SEQ ID:296.

Another function of GAM7052 is therefore inhibition of LOC348947 (Accession XP_302929.1). Accordingly, utilities of GAM7052 include diagnosis, prevention and treatment of diseases and clinical conditions associated with LOC348947.

LOC349075 (Accession XP_300932.1) is another GAM7052 target gene, herein designated TARGET GENE. LOC349075 BINDING SITE is a target binding site found in the 3' untranslated region of mRNA encoded by LOC349075, corresponding to a target binding site such as BINDING SITE I, BINDING SITE II or BINDING SITE III of FIG. 8. Table 4 illustrates the complementarity of the nucleotide sequences of LOC349075 BINDING SITE, designated SEQ ID:17749, to the nucleotide sequence of GAM7052 RNA, herein designated GAM RNA, also designated SEQ ID:296.

Another function of GAM7052 is therefore inhibition of LOC349075 (Accession XP_300932.1). Accordingly, utilities of GAM7052 include diagnosis, prevention and treatment of diseases and clinical conditions associated with LOC349075.

LOC349170 (Accession XP_300969.1) is another GAM7052 target gene, herein designated TARGET GENE. LOC349170 BINDING SITE1 through LOC349170 BINDING SITE3 are target binding sites found in untranslated regions of mRNA encoded by LOC349170, corresponding to target binding sites such as BINDING SITE I, BINDING SITE II or BINDING SITE III of FIG. 8. Table 4 illustrates the complementarity of the nucleotide sequences of LOC349170 BINDING SITE1 through LOC349170 BINDING SITE3, designated SEQ ID:13113, SEQ ID:5467 and SEQ ID:11095 respectively, to the nucleotide sequence of GAM7052 RNA, herein designated GAM RNA, also designated SEQ ID:296.

Another function of GAM7052 is therefore inhibition of LOC349170 (Accession XP_300969.1). Accordingly, utilities of GAM7052 include diagnosis, prevention and treatment of diseases and clinical conditions associated with LOC349170.

LOC349251 (Accession XP_300251.1) is another GAM7052 target gene, herein designated TARGET GENE. LOC349251 BINDING SITE is a target binding site found in the 3' untranslated region of mRNA encoded by LOC349251, corresponding to a target binding site such as BINDING SITE I, BINDING SITE II or BINDING SITE III of FIG. 8. Table 4 illustrates the complementarity of the nucleotide sequences of LOC349251 BINDING SITE, designated SEQ ID:3623, to the nucleotide sequence of GAM7052 RNA, herein designated GAM RNA, also designated SEQ ID:296.

Another function of GAM7052 is therefore inhibition of LOC349251 (Accession XP_300251.1). Accordingly, utilities of GAM7052 include diagnosis, prevention and treatment of diseases and clinical conditions associated with LOC349251.

LOC349261 (Accession XP_300998.1) is another GAM7052 target gene, herein designated TARGET GENE.

LOC349261 BINDING SITE is a target binding site found in the 5' untranslated region of mRNA encoded by LOC349261, corresponding to a target binding site such as BINDING SITE I, BINDING SITE II or BINDING SITE III of FIG. 8. Table 4 illustrates the complementarity of the nucleotide sequences of LOC349261 BINDING SITE, designated SEQ ID:8011, to the nucleotide sequence of GAM7052 RNA, herein designated GAM RNA, also designated SEQ ID:296.

Another function of GAM7052 is therefore inhibition of LOC349261 (Accession XP_300998.1). Accordingly, utilities of GAM7052 include diagnosis, prevention and treatment of diseases and clinical conditions associated with LOC349261.

LOC349272 (Accession XP_303013.1) is another GAM7052 target gene, herein designated TARGET GENE. LOC349272 BINDING SITE is a target binding site found in the 3' untranslated region of mRNA encoded by LOC349272, corresponding to a target binding site such as BINDING SITE I, BINDING SITE II or BINDING SITE III of FIG. 8. Table 4 illustrates the complementarity of the nucleotide sequences of LOC349272 BINDING SITE, designated SEQ ID:16887, to the nucleotide sequence of GAM7052 RNA, herein designated GAM RNA, also designated SEQ ID:296.

Another function of GAM7052 is therefore inhibition of LOC349272 (Accession XP_303013.1). Accordingly, utilities of GAM7052 include diagnosis, prevention and treatment of diseases and clinical conditions associated with LOC349272.

LOC349279 (Accession XP_303015.1) is another GAM7052 target gene, herein designated TARGET GENE. LOC349279 BINDING SITE is a target binding site found in the 3' untranslated region of mRNA encoded by LOC349279, corresponding to a target binding site such as BINDING SITE I, BINDING SITE II or BINDING SITE III of FIG. 8. Table 4 illustrates the complementarity of the nucleotide sequences of LOC349279 BINDING SITE, designated SEQ ID:16887, to the nucleotide sequence of GAM7052 RNA, herein designated GAM RNA, also designated SEQ ID:296.

Another function of GAM7052 is therefore inhibition of LOC349279 (Accession XP_303015.1). Accordingly, utilities of GAM7052 include diagnosis, prevention and treatment of diseases and clinical conditions associated with LOC349279.

LOC349301 (Accession XP_303022.1) is another GAM7052 target gene, herein designated TARGET GENE. LOC349301 BINDING SITE is a target binding site found in the 3' untranslated region of mRNA encoded by LOC349301, corresponding to a target binding site such as BINDING SITE I, BINDING SITE II or BINDING SITE III of FIG. 8. Table 4 illustrates the complementarity of the nucleotide sequences of LOC349301 BINDING SITE, designated SEQ ID:16887, to the nucleotide sequence of GAM7052 RNA, herein designated GAM RNA, also designated SEQ ID:296.

Another function of GAM7052 is therefore inhibition of LOC349301 (Accession XP_303022.1). Accordingly, utilities of GAM7052 include diagnosis, prevention and treatment of diseases and clinical conditions associated with LOC349301.

LOC349305 (Accession XP_301019.1) is another GAM7052 target gene, herein designated TARGET GENE. LOC349305 BINDING SITE is a target binding site found in the 3' untranslated region of mRNA encoded by LOC349305, corresponding to a target binding site such as BINDING SITE I, BINDING SITE II or BINDING SITE III of FIG. 8. Table 4 illustrates the complementarity of the nucleotide sequences of LOC349305 BINDING SITE, designated SEQ ID:5500, to the nucleotide sequence of GAM7052 RNA, herein designated GAM RNA, also designated SEQ ID:296.

Another function of GAM7052 is therefore inhibition of LOC349305 (Accession XP_301019.1). Accordingly, utilities of GAM7052 include diagnosis, prevention and treatment of diseases and clinical conditions associated with LOC349305.

LOC349306 (Accession XP_303023.1) is another GAM7052 target gene, herein designated TARGET GENE. LOC349306 BINDING SITE is a target binding site found in the 3' untranslated region of mRNA encoded by LOC349306, corresponding to a target binding site such as BINDING SITE I, BINDING SITE II or BINDING SITE III of FIG. 8. Table 4 illustrates the complementarity of the nucleotide sequences of LOC349306 BINDING SITE, designated SEQ ID:16887, to the nucleotide sequence of GAM7052 RNA, herein designated GAM RNA, also designated SEQ ID:296.

Another function of GAM7052 is therefore inhibition of LOC349306 (Accession XP_303023.1). Accordingly, utilities of GAM7052 include diagnosis, prevention and treatment of diseases and clinical conditions associated with LOC349306.

LOC349360 (Accession XP_088528.1) is another GAM7052 target gene, herein designated TARGET GENE. LOC349360 BINDING SITE is a target binding site found in the 5' untranslated region of mRNA encoded by LOC349360, corresponding to a target binding site such as BINDING SITE I, BINDING SITE II or BINDING SITE III of FIG. 8. Table 4 illustrates the complementarity of the nucleotide sequences of LOC349360 BINDING SITE, designated SEQ ID:16885, to the nucleotide sequence of GAM7052 RNA, herein designated GAM RNA, also designated SEQ ID:296.

Another function of GAM7052 is therefore inhibition of LOC349360 (Accession XP_088528.1). Accordingly, utilities of GAM7052 include diagnosis, prevention and treatment of diseases and clinical conditions associated with LOC349360.

LOC349408 (Accession XP_303044.1) is another GAM7052 target gene, herein designated TARGET GENE. LOC349408 BINDING SITE1 and LOC349408 BINDING SITE2 are target binding sites found in untranslated regions of mRNA encoded by LOC349408, corresponding to target binding sites such as BINDING SITE I, BINDING SITE II or BINDING SITE III of FIG. 8. Table 4 illustrates the complementarity of the nucleotide sequences of LOC349408 BINDING SITE1 and LOC349408 BINDING SITE2, designated SEQ ID:19208 and SEQ ID:15314 respectively, to the nucleotide sequence of GAM7052 RNA, herein designated GAM RNA, also designated SEQ ID:296.

Another function of GAM7052 is therefore inhibition of LOC349408 (Accession XP_303044.1). Accordingly, utilities of GAM7052 include diagnosis, prevention and treatment of diseases and clinical conditions associated with LOC349408.

LOC349440 (Accession XP_300513.1) is another GAM7052 target gene, herein designated TARGET GENE. LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:3639, to the nucleotide sequence of GAM7052 RNA, herein designated GAM RNA, also designated SEQ ID:296.

Another function of GAM7052 is therefore inhibition of LOC349440 (Accession XP_300513.1). Accordingly, utilities of GAM7052 include diagnosis, prevention and treatment of diseases and clinical conditions associated with LOC349440.

LOC51186 (Accession NP_057387.1) is another GAM7052 target gene, herein designated TARGET GENE. LOC51186 BINDING SITE is a target binding site found in the 3' untranslated region of mRNA encoded by LOC51186, corresponding to a target binding site such as BINDING SITE I, BINDING SITE II or BINDING SITE III of FIG. 8. Table 4 illustrates the complementarity of the nucleotide sequences of LOC51186 BINDING SITE, designated SEQ ID:11729, to the nucleotide sequence of GAM7052 RNA, herein designated GAM RNA, also designated SEQ ID:296.

Another function of GAM7052 is therefore inhibition of LOC51186 (Accession NP_057387.1). Accordingly, utilities of GAM7052 include diagnosis, prevention and treatment of diseases and clinical conditions associated with LOC51186.

LOC57146 (Accession NP_065155.2) is another GAM7052 target gene, herein designated TARGET GENE. LOC57146 BINDING SITE is a target binding site found in the 3' untranslated region of mRNA encoded by LOC57146, corresponding to a target binding site such as BINDING SITE I, BINDING SITE II or BINDING SITE III of FIG. 8. Table 4 illustrates the complementarity of the nucleotide sequences of LOC57146 BINDING SITE, designated SEQ ID:1187, to the nucleotide sequence of GAM7052 RNA, herein designated GAM RNA, also designated SEQ ID:296.

Another function of GAM7052 is therefore inhibition of LOC57146 (Accession NP_065155.2). Accordingly, utilities of GAM7052 include diagnosis, prevention and treatment of diseases and clinical conditions associated with LOC57146.

LOC90408 (Accession XP_031517.1) is another GAM7052 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:18503, to the nucleotide sequence of GAM7052 RNA, herein designated GAM RNA, also designated SEQ ID:296.

Another function of GAM7052 is therefore inhibition of LOC90408 (Accession XP_031517.1). Accordingly, utilities of GAM7052 include diagnosis, prevention and treatment of diseases and clinical conditions associated with LOC90408.

LOC90806 (Accession NP_653168.1) is another GAM7052 target gene, herein designated TARGET GENE. LOC90806 BINDING SITE is a target binding site found in the 3' untranslated region of mRNA encoded by LOC90806, corresponding to a target binding site such as BINDING SITE I, BINDING SITE II or BINDING SITE III of FIG. 8. Table 4 illustrates the complementarity of the nucleotide sequences of LOC90806 BINDING SITE, designated SEQ ID:16793, to the nucleotide sequence of GAM7052 RNA, herein designated GAM RNA, also designated SEQ ID:296.

Another function of GAM7052 is therefore inhibition of LOC90806 (Accession NP_653168.1). Accordingly, utilities of GAM7052 include diagnosis, prevention and treatment of diseases and clinical conditions associated with LOC90806.

LOC91056 (Accession NP_612377.1) is another GAM7052 target gene, herein designated TARGET GENE. LOC91056 BINDING SITE1 and LOC91056 BINDING SITE2 are target binding sites found in untranslated regions of multiple transcripts of mRNA encoded by LOC91056, corresponding to target binding sites such as BINDING SITE I, BINDING SITE II or BINDING SITE III of FIG. 8. Table 4 illustrates the complementarity of the nucleotide sequences of LOC91056 BINDING SITE1 and LOC91056 BINDING SITE2, designated SEQ ID:4090 and SEQ ID:13610 respectively, to the nucleotide sequence of GAM7052 RNA, herein designated GAM RNA, also designated SEQ ID:296.

Another function of GAM7052 is therefore inhibition of LOC91056 (Accession NP_612377.1). Accordingly, utilities of GAM7052 include diagnosis, prevention and treatment of diseases and clinical conditions associated with LOC91056.

LOC91115 (Accession XP_036218.1) is another GAM7052 target gene, herein designated TARGET GENE. LOC91115 BINDING SITE1 and LOC91115 BINDING SITE2 are target binding sites found in untranslated regions of mRNA encoded by LOC91115, corresponding to target binding sites such as BINDING SITE I, BINDING SITE II or BINDING SITE III of FIG. 8. Table 4 illustrates the complementarity of the nucleotide sequences of LOC91115 BINDING SITE1 and LOC91115 BINDING SITE2, designated SEQ ID:4889 and SEQ ID:12496 respectively, to the nucleotide sequence of GAM7052 RNA, herein designated GAM RNA, also designated SEQ ID:296.

Another function of GAM7052 is therefore inhibition of LOC91115 (Accession XP_036218.1). Accordingly, utilities of GAM7052 include diagnosis, prevention and treatment of diseases and clinical conditions associated with LOC91115.

LOC91250 (Accession XP_037135.1) is another GAM7052 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:6792, to the nucleotide sequence of GAM7052 RNA, herein designated GAM RNA, also designated SEQ ID:296.

Another function of GAM7052 is therefore inhibition of LOC91250 (Accession XP_037135.1). Accordingly, utilities of GAM7052 include diagnosis, prevention and treatment of diseases and clinical conditions associated with LOC91250.

LOC91549 (Accession XP_039115.1) is another GAM7052 target gene, herein designated TARGET GENE. LOC91549 BINDING SITE is a target binding site found in the 5' untranslated region of mRNA encoded by LOC91549, corresponding to a target binding site such as BINDING SITE I, BINDING SITE II or BINDING SITE III of FIG. 8. Table 4 illustrates the complementarity of the nucleotide sequences of LOC91549 BINDING SITE, designated SEQ ID:7060, to the nucleotide sequence of GAM7052 RNA, herein designated GAM RNA, also designated SEQ ID:296.

Another function of GAM7052 is therefore inhibition of LOC91549 (Accession XP_039115.1). Accordingly, utilities of GAM7052 include diagnosis, prevention and treatment of diseases and clinical conditions associated with LOC91549.

LOC92148 (Accession XP_043160.1) is another GAM7052 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:14963, to the nucleotide sequence of GAM7052 RNA, herein designated GAM RNA, also designated SEQ ID:296.

Another function of GAM7052 is therefore inhibition of LOC92148 (Accession XP_043160.1). Accordingly, utilities of GAM7052 include diagnosis, prevention and treatment of diseases and clinical conditions associated with LOC92148.

LOC92597 (Accession NP_775739.1) is another GAM7052 target gene, herein designated TARGET GENE. LOC92597 BINDING SITE is a target binding site found in the 3' untranslated region of mRNA encoded by LOC92597, corresponding to a target binding site such as BINDING SITE I, BINDING SITE II or BINDING SITE III of FIG. 8. Table 4 illustrates the complementarity of the nucleotide sequences of LOC92597 BINDING SITE, designated SEQ ID:9812, to the nucleotide sequence of GAM7052 RNA, herein designated GAM RNA, also designated SEQ ID:296.

Another function of GAM7052 is therefore inhibition of LOC92597 (Accession NP_775739.1). Accordingly, utilities of GAM7052 include diagnosis, prevention and treatment of diseases and clinical conditions associated with LOC92597.

LOC93349 (Accession NP_612411.2) is another GAM7052 target gene, herein designated TARGET GENE. LOC93349 BINDING SITE is a target binding site found in the 3' untranslated region of mRNA encoded by LOC93349, corresponding to a target binding site such as BINDING SITE I, BINDING SITE II or BINDING SITE III of FIG. 8. Table 4 illustrates the complementarity of the nucleotide sequences of LOC93349 BINDING SITE, designated SEQ ID:7858, to the nucleotide sequence of GAM7052 RNA, herein designated GAM RNA, also designated SEQ ID:296.

Another function of GAM7052 is therefore inhibition of LOC93349 (Accession NP_612411.2). Accordingly, utilities of GAM7052 include diagnosis, prevention and treatment of diseases and clinical conditions associated with LOC93349.

Lanosterol synthase (2,3-oxidosqualene-lanosterol cyclase) (LSS, Accession NP_002331.2) is another GAM7052 target gene, herein designated TARGET GENE. LSS BINDING SITE is a target binding site found in the 3' untranslated region of mRNA encoded by LSS, corresponding to a target binding site such as BINDING SITE I, BINDING SITE II or BINDING SITE III of FIG. 8. Table 4 illustrates the complementarity of the nucleotide sequences of LSS BINDING SITE, designated SEQ ID:13480, to the nucleotide sequence of GAM7052 RNA, herein designated GAM RNA, also designated SEQ ID:296.

Another function of GAM7052 is therefore inhibition of Lanosterol synthase (2,3-oxidosqualene-lanosterol cyclase) (LSS, Accession NP_002331.2). Accordingly, utilities of GAM7052 include diagnosis, prevention and treatment of diseases and clinical conditions associated with LSS.

Male germ cell-associated kinase (MAK, Accession NP_005897.1) is another GAM7052 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:7895, to the nucleotide sequence of GAM7052 RNA, herein designated GAM RNA, also designated SEQ ID:296.

Another function of GAM7052 is therefore inhibition of Male germ cell-associated kinase (MAK, Accession NP_005897.1), a gene which plays an important role in spermatogenesis. Accordingly, utilities of GAM7052 include diagnosis, prevention and treatment of diseases and clinical conditions associated with MAK.

The function of MAK and its association with various diseases and clinical conditions, has been established by previous studies, as described hereinabove with reference to GAM30.1. Mannosidase, beta a, lysosomal-like (MANBAL, Accession NP_071360.1) is another GAM7052 target gene, herein designated TARGET GENE. MANBAL BINDING SITE is a target binding site found in the 5' untranslated region of mRNA encoded by MANBAL, corresponding to a target binding site such as BINDING SITE I, BINDING SITE II or BINDING SITE III of FIG. 8. Table 4 illustrates the complementarity of the nucleotide sequences of MANBAL BINDING SITE, designated SEQ ID:12674, to the nucleotide sequence of GAM7052 RNA, herein designated GAM RNA, also designated SEQ ID:296.

Another function of GAM7052 is therefore inhibition of Mannosidase, beta a, lysosomal-like (MANBAL, Accession NP_071360.1). Accordingly, utilities of GAM7052 include diagnosis, prevention and treatment of diseases and clinical conditions associated with MANBAL.

MAPA (Accession NP_660299.1) is another GAM7052 target gene, herein designated TARGET GENE. MAPA BINDING SITE1 and MAPA BINDING SITE2 are target binding sites found in untranslated regions of mRNA encoded by MAPA, corresponding to target binding sites such as BINDING SITE I, BINDING SITE II or BINDING SITE III of FIG. 8. Table 4 illustrates the complementarity of the nucleotide sequences of MAPA BINDING SITE1 and MAPA BINDING SITE2, designated SEQ ID:2128 and SEQ ID:9966 respectively, to the nucleotide sequence of GAM7052 RNA, herein designated GAM RNA, also designated SEQ ID:296.

Another function of GAM7052 is therefore inhibition of MAPA (Accession NP_660299.1). Accordingly, utilities of GAM7052 include diagnosis, prevention and treatment of diseases and clinical conditions associated with MAPA.

Mads box transcription enhancer factor 2, polypeptide a (myocyte enhancer factor 2a) (MEF2A, Accession NP_005578.1) is another GAM7052 target gene, herein designated TARGET GENE. MEF2A BINDING SITE is a target binding site found in the 5' untranslated region of mRNA encoded by MEF2A, corresponding to a target binding site such as BINDING SITE I, BINDING SITE II or BINDING SITE III of FIG. 8. Table 4 illustrates the complementarity of the nucleotide sequences of MEF2A BINDING SITE, designated SEQ ID:12527, to the nucleotide sequence of GAM7052 RNA, herein designated GAM RNA, also designated SEQ ID:296.

Another function of GAM7052 is therefore inhibition of Mads box transcription enhancer factor 2, polypeptide a (myocyte enhancer factor 2a) (MEF2A, Accession NP_005578.1), a gene which binds a consensus sequence that regulates transcription. Accordingly, utilities of GAM7052 include diagnosis, prevention and treatment of diseases and clinical conditions associated with MEF2A.

The function of MEF2A and its association with various diseases and clinical conditions, has been established by previous studies, as described hereinabove with reference to GAM130.1. Mediterranean fever (MEFV, Accession NP_000234.1) is another GAM7052 target gene, herein designated TARGET GENE. MEFV BINDING SITE1 and MEFV BINDING SITE2 are target binding sites found in untranslated regions of mRNA encoded by MEFV, corresponding to target binding sites such as BINDING SITE I, BINDING SITE II or BINDING SITE III of FIG. 8. Table 4 illustrates the complementarity of the nucleotide sequences of MEFV BINDING SITE1 and MEFV BINDING SITE2, designated SEQ ID:12378 and SEQ ID:3905 respectively, to the nucleotide sequence of GAM7052 RNA, herein designated GAM RNA, also designated SEQ ID:296.

Another function of GAM7052 is therefore inhibition of Mediterranean fever (MEFV, Accession NP_000234.1). Accordingly, utilities of GAM7052 include diagnosis, prevention and treatment of diseases and clinical conditions associated with MEFV.

Antigen p97 (melanoma associated) identified by monoclonal antibodies 133.2 and 96.5 (MFI2, Accession NP_201573.1) is another GAM7052 target gene, herein designated TARGET GENE. MFI2 BINDING SITE is a target binding site found in the 3' untranslated region of multiple transcripts of mRNA encoded by MFI2, corresponding to a target binding site such as BINDING SITE I, BINDING SITE II or BINDING SITE III of FIG. 8. Table 4 illustrates the complementarity of the nucleotide sequences of MFI2 BINDING SITE, designated SEQ ID:19559, to the nucleotide sequence of GAM7052 RNA, herein designated GAM RNA, also designated SEQ ID:296.

Another function of GAM7052 is therefore inhibition of Antigen p97 (melanoma associated) identified by monoclonal antibodies 133.2 and 96.5 (MFI2, Accession NP_201573.1). Accordingly, utilities of GAM7052 include diagnosis, prevention and treatment of diseases and clinical conditions associated with MFI2.

MFTC (Accession NP_110407.2) is another GAM7052 target gene, herein designated TARGET GENE. MFTC BINDING SITE is a target binding site found in the 3' untranslated region of mRNA encoded by MFTC, corresponding to a target binding site such as BINDING SITE I, BINDING SITE II or BINDING SITE III of FIG. 8. Table 4 illustrates the complementarity of the nucleotide sequences of MFTC BINDING SITE, designated SEQ ID:8527, to the nucleotide sequence of GAM7052 RNA, herein designated GAM RNA, also designated SEQ ID:296.

Another function of GAM7052 is therefore inhibition of MFTC (Accession NP_110407.2). Accordingly, utilities of GAM7052 include diagnosis, prevention and treatment of diseases and clinical conditions associated with MFTC.

MGC11102 (Accession NP_115701.2) is another GAM7052 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:8801, to the nucleotide sequence of GAM7052 RNA, herein designated GAM RNA, also designated SEQ ID:296.

Another function of GAM7052 is therefore inhibition of MGC11102 (Accession NP_115701.2). Accordingly, utilities of GAM7052 include diagnosis, prevention and treatment of diseases and clinical conditions associated with MGC11102.

MGC12518 (Accession NP_291026.1) is another GAM7052 target gene, herein designated TARGET GENE. MGC12518 BINDING SITE is a target binding site found in the 3' untranslated region of mRNA encoded by MGC12518, corresponding to a target binding site such as BINDING SITE I, BINDING SITE II or BINDING SITE III of FIG. 8. Table 4 illustrates the complementarity of the nucleotide sequences of MGC12518 BINDING SITE, designated SEQ ID:16735, to the nucleotide sequence of GAM7052 RNA, herein designated GAM RNA, also designated SEQ ID:296.

Another function of GAM7052 is therefore inhibition of MGC12518 (Accession NP_291026.1). Accordingly, utilities of GAM7052 include diagnosis, prevention and treatment of diseases and clinical conditions associated with MGC12518.

MGC13071 (Accession NP_116078.2) is another GAM7052 target gene, herein designated TARGET GENE. MGC13071 BINDING SITE is a target binding site found in the 3' untranslated region of mRNA encoded by MGC13071, corresponding to a target binding site such as BINDING SITE I, BINDING SITE II or BINDING SITE III of FIG. 8. Table 4 illustrates the complementarity of the nucleotide sequences of MGC13071 BINDING SITE, designated SEQ ID:20118, to the nucleotide sequence of GAM7052 RNA, herein designated GAM RNA, also designated SEQ ID:296.

Another function of GAM7052 is therefore inhibition of MGC13071 (Accession NP_116078.2). Accordingly, utilities of GAM7052 include diagnosis, prevention and treatment of diseases and clinical conditions associated with MGC13071.

MGC13204 (Accession NP_113653.1) is another GAM7052 target gene, herein designated TARGET GENE. MGC13204 BINDING SITE is a target binding site found in the 3' untranslated region of mRNA encoded by MGC13204, corresponding to a target binding site such as BINDING SITE I, BINDING SITE II or BINDING SITE III of FIG. 8. Table 4 illustrates the complementarity of the nucleotide sequences of MGC13204 BINDING SITE, designated SEQ ID:10962, to the nucleotide sequence of GAM7052 RNA, herein designated GAM RNA, also designated SEQ ID:296.

Another function of GAM7052 is therefore inhibition of MGC13204 (Accession NP_113653.1). Accordingly, utilities of GAM7052 include diagnosis, prevention and treatment of diseases and clinical conditions associated with MGC13204.

MGC14289 (Accession NP_542391.1) is another GAM7052 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:7116, to the nucleotide sequence of GAM7052 RNA, herein designated GAM RNA, also designated SEQ ID:296.

Another function of GAM7052 is therefore inhibition of MGC14289 (Accession NP_542391.1). Accordingly, utilities of GAM7052 include diagnosis, prevention and treatment of diseases and clinical conditions associated with MGC14289.

MGC24180 (Accession NP_689565.1) is another GAM7052 target gene, herein designated TARGET GENE. MGC24180 BINDING SITE is a target binding site found in the 5' untranslated region of mRNA encoded by MGC24180, corresponding to a target binding site such as BINDING SITE I, BINDING SITE II or BINDING SITE III of FIG. 8. Table 4 illustrates the complementarity of the nucleotide sequences of MGC24180 BINDING SITE, designated SEQ ID:7412, to the nucleotide sequence of GAM7052 RNA, herein designated GAM RNA, also designated SEQ ID:296.

Another function of GAM7052 is therefore inhibition of MGC24180 (Accession NP_689565.1). Accordingly, utilities of GAM7052 include diagnosis, prevention and treatment of diseases and clinical conditions associated with MGC24180.

MGC27345 (Accession XP_300964.1) is another GAM7052 target gene, herein designated TARGET GENE.

MGC27345 BINDING SITE is a target binding site found in the 5' untranslated region of multiple transcripts of mRNA encoded by MGC27345, corresponding to a target binding site such as BINDING SITE I, BINDING SITE II or BINDING SITE III of FIG. 8. Table 4 illustrates the complementarity of the nucleotide sequences of MGC27345 BINDING SITE, designated SEQ ID:7770, to the nucleotide sequence of GAM7052 RNA, herein designated GAM RNA, also designated SEQ ID:296.

Another function of GAM7052 is therefore inhibition of MGC27345 (Accession XP_300964.1). Accordingly, utilities of GAM7052 include diagnosis, prevention and treatment of diseases and clinical conditions associated with MGC27345.

MGC29649 (Accession NP_776171.1) is another GAM7052 target gene, herein designated TARGET GENE. MGC29649 BINDING SITE is a target binding site found in the 5' untranslated region of mRNA encoded by MGC29649, corresponding to a target binding site such as BINDING SITE I, BINDING SITE II or BINDING SITE III of FIG. 8. Table 4 illustrates the complementarity of the nucleotide sequences of MGC29649 BINDING SITE, designated SEQ ID:2841, to the nucleotide sequence of GAM7052 RNA, herein designated GAM RNA, also designated SEQ ID:296.

Another function of GAM7052 is therefore inhibition of MGC29649 (Accession NP_776171.1). Accordingly, utilities of GAM7052 include diagnosis, prevention and treatment of diseases and clinical conditions associated with MGC29649.

MGC29891 (Accession NP_653219.1) is another GAM7052 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:6192, to the nucleotide sequence of GAM7052 RNA, herein designated GAM RNA, also designated SEQ ID:296.

Another function of GAM7052 is therefore inhibition of MGC29891 (Accession NP_653219.1). Accordingly, utilities of GAM7052 include diagnosis, prevention and treatment of diseases and clinical conditions associated with MGC29891.

MGC29898 (Accession NP_659485.1) is another GAM7052 target gene, herein designated TARGET GENE. MGC29898 BINDING SITE is a target binding site found in the 3' untranslated region of mRNA encoded by MGC29898, corresponding to a target binding site such as BINDING SITE I, BINDING SITE II or BINDING SITE III of FIG. 8. Table 4 illustrates the complementarity of the nucleotide sequences of MGC29898 BINDING SITE, designated SEQ ID:8105, to the nucleotide sequence of GAM7052 RNA, herein designated GAM RNA, also designated SEQ ID:296.

Another function of GAM7052 is therefore inhibition of MGC29898 (Accession NP_659485.1). Accordingly, utilities of GAM7052 include diagnosis, prevention and treatment of diseases and clinical conditions associated with MGC29898.

MGC3207 (Accession NP_115661.1) is another GAM7052 target gene, herein designated TARGET GENE. MGC3207 BINDING SITE1 and MGC3207 BINDING SITE2 are target binding sites found in untranslated regions of mRNA encoded by MGC3207, corresponding to target binding sites such as BINDING SITE I, BINDING SITE II or BINDING SITE III of FIG. 8. Table 4 illustrates the complementarity of the nucleotide sequences of MGC3207 BINDING SITE1 and MGC3207 BINDING SITE2, designated SEQ ID:16723 and SEQ ID:13361 respectively, to the nucleotide sequence of GAM7052 RNA, herein designated GAM RNA, also designated SEQ ID:296.

Another function of GAM7052 is therefore inhibition of MGC3207 (Accession NP_115661.1). Accordingly, utilities of GAM7052 include diagnosis, prevention and treatment of diseases and clinical conditions associated with MGC3207.

MGC33338 (Accession NP_689579.2) is another GAM7052 target gene, herein designated TARGET GENE. MGC33338 BINDING SITE is a target binding site found in the 3' untranslated region of mRNA encoded by MGC33338, corresponding to a target binding site such as BINDING SITE I, BINDING SITE II or BINDING SITE III of FIG. 8. Table 4 illustrates the complementarity of the nucleotide sequences of MGC33338 BINDING SITE, designated SEQ ID:9435, to the nucleotide sequence of GAM7052 RNA, herein designated GAM RNA, also designated SEQ ID:296.

Another function of GAM7052 is therefore inhibition of MGC33338 (Accession NP_689579.2). Accordingly, utilities of GAM7052 include diagnosis, prevention and treatment of diseases and clinical conditions associated with MGC33338.

MGC33637 (Accession NP_689809.1) is another GAM7052 target gene, herein designated TARGET GENE. MGC33637 BINDING SITE is a target binding site found in the 3' untranslated region of mRNA encoded by MGC33637, corresponding to a target binding site such as BINDING SITE I, BINDING SITE II or BINDING SITE III of FIG. 8. Table 4 illustrates the complementarity of the nucleotide sequences of MGC33637 BINDING SITE, designated SEQ ID:14742, to the nucleotide sequence of GAM7052 RNA, herein designated GAM RNA, also designated SEQ ID:296.

Another function of GAM7052 is therefore inhibition of MGC33637 (Accession NP_689809.1). Accordingly, utilities of GAM7052 include diagnosis, prevention and treatment of diseases and clinical conditions associated with MGC33637.

MGC34132 (Accession XP_291029.1) is another GAM7052 target gene, herein designated TARGET GENE. MGC34132 BINDING SITE1 and MGC34132 BINDING SITE2 are target binding sites found in untranslated regions of mRNA encoded by MGC34132, corresponding to target binding sites such as BINDING SITE I, BINDING SITE II or BINDING SITE III of FIG. 8. Table 4 illustrates the complementarity of the nucleotide sequences of MGC34132 BINDING SITE1 and MGC34132 BINDING SITE2, designated SEQ ID:7217 and SEQ ID:18011 respectively, to the nucleotide sequence of GAM7052 RNA, herein designated GAM RNA, also designated SEQ ID:296.

Another function of GAM7052 is therefore inhibition of MGC34132 (Accession XP_291029.1). Accordingly, utilities of GAM7052 include diagnosis, prevention and treatment of diseases and clinical conditions associated with MGC34132.

MGC35048 (Accession NP_694940.1) is another GAM7052 target gene, herein designated TARGET GENE. MGC35048 BINDING SITE is a target binding site found in the 5' untranslated region of mRNA encoded by MGC35048, corresponding to a target binding site such as BINDING SITE I, BINDING SITE II or BINDING SITE III of FIG. 8. Table 4 illustrates the complementarity of the nucleotide sequences of MGC35048 BINDING SITE, designated SEQ ID:16147, to the nucleotide sequence of GAM7052 RNA, herein designated GAM RNA, also designated SEQ ID:296.

Another function of GAM7052 is therefore inhibition of MGC35048 (Accession NP_694940.1). Accordingly, utilities of GAM7052 include diagnosis, prevention and treatment of diseases and clinical conditions associated with MGC35048.

MGC35468 (Accession NP_694976.1) is another GAM7052 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:17258, to the nucleotide sequence of GAM7052 RNA, herein designated GAM RNA, also designated SEQ ID:296.

Another function of GAM7052 is therefore inhibition of MGC35468 (Accession NP_694976.1). Accordingly, utilities of GAM7052 include diagnosis, prevention and treatment of diseases and clinical conditions associated with MGC35468.

MGC40168 (Accession NP_714920.1) is another GAM7052 target gene, herein designated TARGET GENE. MGC40168 BINDING SITE is a target binding site found in the 5' untranslated region of mRNA encoded by MGC40168, corresponding to a target binding site such as BINDING SITE I, BINDING SITE II or BINDING SITE III of FIG. 8. Table 4 illustrates the complementarity of the nucleotide sequences of MGC40168 BINDING SITE, designated SEQ ID:6366, to the nucleotide sequence of GAM7052 RNA, herein designated GAM RNA, also designated SEQ ID:296.

Another function of GAM7052 is therefore inhibition of MGC40168 (Accession NP_714920.1). Accordingly, utilities of GAM7052 include diagnosis, prevention and treatment of diseases and clinical conditions associated with MGC40168.

MGC40579 (Accession NP_689989.1) is another GAM7052 target gene, herein designated TARGET GENE. MGC40579 BINDING SITE is a target binding site found in the 3' untranslated region of mRNA encoded by MGC40579, corresponding to a target binding site such as BINDING SITE I, BINDING SITE II or BINDING SITE III of FIG. 8. Table 4 illustrates the complementarity of the nucleotide sequences of MGC40579 BINDING SITE, designated SEQ ID:18904, to the nucleotide sequence of GAM7052 RNA, herein designated GAM RNA, also designated SEQ ID:296.

Another function of GAM7052 is therefore inhibition of MGC40579 (Accession NP_689989.1). Accordingly, utilities of GAM7052 include diagnosis, prevention and treatment of diseases and clinical conditions associated with MGC40579.

MGC43122 (Accession NP_775784.1) is another GAM7052 target gene, herein designated TARGET GENE. MGC43122 BINDING SITE is a target binding site found in the 3' untranslated region of mRNA encoded by MGC43122, corresponding to a target binding site such as BINDING SITE I, BINDING SITE II or BINDING SITE III of FIG. 8. Table 4 illustrates the complementarity of the nucleotide sequences of MGC43122 BINDING SITE, designated SEQ ID:19043, to the nucleotide sequence of GAM7052 RNA, herein designated GAM RNA, also designated SEQ ID:296.

Another function of GAM7052 is therefore inhibition of MGC43122 (Accession NP_775784.1). Accordingly, utilities of GAM7052 include diagnosis, prevention and treatment of diseases and clinical conditions associated with MGC43122.

MGC46336 (Accession XP_290712.1) is another GAM7052 target gene, herein designated TARGET GENE. MGC46336 BINDING SITE1 through MGC46336 BINDING SITE3 are target binding sites found in untranslated regions of mRNA encoded by MGC46336, corresponding to target binding sites such as BINDING SITE I, BINDING SITE II or BINDING SITE III of FIG. 8. Table 4 illustrates the complementarity of the nucleotide sequences of MGC46336 BINDING SITE1 through MGC46336 BINDING SITE3, designated SEQ ID:4916, SEQ ID:10377 and SEQ ID:5284 respectively, to the nucleotide sequence of GAM7052 RNA, herein designated GAM RNA, also designated SEQ ID:296.

Another function of GAM7052 is therefore inhibition of MGC46336 (Accession XP_290712.1). Accordingly, utilities of GAM7052 include diagnosis, prevention and treatment of diseases and clinical conditions associated with MGC46336.

MGC46732 (Accession NP_714925.1) is another GAM7052 target gene, herein designated TARGET GENE. MGC46732 BINDING SITE is a target binding site found in the 3' untranslated region of mRNA encoded by MGC46732, corresponding to a target binding site such as BINDING SITE I, BINDING SITE II or BINDING SITE III of FIG. 8. Table 4 illustrates the complementarity of the nucleotide sequences of MGC46732 BINDING SITE, designated SEQ ID:5120, to the nucleotide sequence of GAM7052 RNA, herein designated GAM RNA, also designated SEQ ID:296.

Another function of GAM7052 is therefore inhibition of MGC46732 (Accession NP_714925.1). Accordingly, utilities of GAM7052 include diagnosis, prevention and treatment of diseases and clinical conditions associated with MGC46732.

MGC50452 (Accession NP_775733.1) is another GAM7052 target gene, herein designated TARGET GENE. MGC50452 BINDING SITE is a target binding site found in the 3' untranslated region of mRNA encoded by MGC50452, corresponding to a target binding site such as BINDING SITE I, BINDING SITE II or BINDING SITE III of FIG. 8. Table 4 illustrates the complementarity of the nucleotide sequences of MGC50452 BINDING SITE, designated SEQ ID:6275, to the nucleotide sequence of GAM7052 RNA, herein designated GAM RNA, also designated SEQ ID:296.

Another function of GAM7052 is therefore inhibition of MGC50452 (Accession NP_775733.1). Accordingly, utilities of GAM7052 include diagnosis, prevention and treatment of diseases and clinical conditions associated with MGC50452.

MGC50559 (Accession NP_776163.1) is another GAM7052 target gene, herein designated TARGET GENE. MGC50559 BINDING SITE is a target binding site found in the 3' untranslated region of mRNA encoded by MGC50559, corresponding to a target binding site such as BINDING SITE I, BINDING SITE II or BINDING SITE III of FIG. 8. Table 4 illustrates the complementarity of the nucleotide sequences of MGC50559 BINDING SITE, designated SEQ ID:19560, to the nucleotide sequence of GAM7052 RNA, herein designated GAM RNA, also designated SEQ ID:296.

Another function of GAM7052 is therefore inhibition of MGC50559 (Accession NP_776163.1). Accordingly, utilities of GAM7052 include diagnosis, prevention and treatment of diseases and clinical conditions associated with MGC50559.

MGRN1 (Accession XP_048119.4) is another GAM7052 target gene, herein designated TARGET GENE. MGRN1 BINDING SITE1 and MGRN1 BINDING SITE2 are target binding sites found in untranslated regions of mRNA encoded by MGRN1, corresponding to target binding sites such as BINDING SITE I, BINDING SITE II or BINDING SITE III of FIG. 8. Table 4 illustrates the complementarity of the nucleotide sequences of MGRN1 BINDING SITE1 and MGRN1 BINDING SITE2, designated SEQ ID:16263 and SEQ ID:14616 respectively, to the nucleotide sequence of GAM7052 RNA, herein designated GAM RNA, also designated SEQ ID:296.

Another function of GAM7052 is therefore inhibition of MGRN1 (Accession XP_048119.4). Accordingly, utilities of GAM7052 include diagnosis, prevention and treatment of diseases and clinical conditions associated with MGRN1.

Melan-a (MLANA, Accession NP_005502.1) is another GAM7052 target gene, herein designated TARGET GENE. MLANA BINDING SITE is a target binding site found in the 3' untranslated region of mRNA encoded by MLANA, corresponding to a target binding site such as BINDING SITE I, BINDING SITE II or BINDING SITE III of FIG. 8. Table 4 illustrates the complementarity of the nucleotide sequences of MLANA BINDING SITE, designated SEQ ID:5470, to the nucleotide sequence of GAM7052 RNA, herein designated GAM RNA, also designated SEQ ID:296.

Another function of GAM7052 is therefore inhibition of Melan-a (MLANA, Accession NP_005502.1). Accordingly, utilities of GAM7052 include diagnosis, prevention and treatment of diseases and clinical conditions associated with MLANA.

Melanoma-derived leucine zipper, extra-nuclear factor (MLZE, Accession NP_113603.1) is another GAM7052 target gene, herein designated TARGET GENE. MLZE BINDING SITE is a target binding site found in the 5' untranslated region of mRNA encoded by MLZE, corresponding to a target binding site such as BINDING SITE I, BINDING SITE II or BINDING SITE III of FIG. 8. Table 4 illustrates the complementarity of the nucleotide sequences of MLZE BINDING SITE, designated SEQ ID:18046, to the nucleotide sequence of GAM7052 RNA, herein designated GAM RNA, also designated SEQ ID:296.

Another function of GAM7052 is therefore inhibition of Melanoma-derived leucine zipper, extra-nuclear factor (MLZE, Accession NP_113603.1). Accordingly, utilities of GAM7052 include diagnosis, prevention and treatment of diseases and clinical conditions associated with MLZE.

Matrix metalloproteinase-like 1 (MMPL1, Accession NP_004133.1) is another GAM7052 target gene, herein designated TARGET GENE. MMPL1 BINDING SITE is a target binding site found in the 3' untranslated region of mRNA encoded by MMPL1, corresponding to a target binding site such as BINDING SITE I, BINDING SITE II or BINDING SITE III of FIG. 8. Table 4 illustrates the complementarity of the nucleotide sequences of MMPL1 BINDING SITE, designated SEQ ID:10936, to the nucleotide sequence of GAM7052 RNA, herein designated GAM RNA, also designated SEQ ID:296.

Another function of GAM7052 is therefore inhibition of Matrix metalloproteinase-like 1 (MMPL1, Accession NP_004133.1). Accordingly, utilities of GAM7052 include diagnosis, prevention and treatment of diseases and clinical conditions associated with MMPL1.

moblak (Accession NP_570719.1) is another GAM7052 target gene, herein designated TARGET GENE. moblak BINDING SITE is a target binding site found in the 3' untranslated region of mRNA encoded by moblak, corresponding to a target binding site such as BINDING SITE I, BINDING SITE II or BINDING SITE III of FIG. 8. Table 4 illustrates the complementarity of the nucleotide sequences of moblak BINDING SITE, designated SEQ ID:9025, to the nucleotide sequence of GAM7052 RNA, herein designated GAM RNA, also designated SEQ ID:296.

Another function of GAM7052 is therefore inhibition of moblak (Accession NP_570719.1). Accordingly, utilities of GAM7052 include diagnosis, prevention and treatment of diseases and clinical conditions associated with moblak.

Molybdenum cofactor synthesis 1 (MOCS1, Accession NP_005934.2) is another GAM7052 target gene, herein designated TARGET GENE. MOCS1 BINDING SITE is a target binding site found in the 3' untranslated region of multiple transcripts of mRNA encoded by MOCS1, corresponding to a target binding site such as BINDING SITE I, BINDING SITE II or BINDING SITE III of FIG. 8. Table 4 illustrates the complementarity of the nucleotide sequences of MOCS1 BINDING SITE, designated SEQ ID:16709, to the nucleotide sequence of GAM7052 RNA, herein designated GAM RNA, also designated SEQ ID:296.

Another function of GAM7052 is therefore inhibition of Molybdenum cofactor synthesis 1 (MOCS1, Accession NP_005934.2). Accordingly, utilities of GAM7052 include diagnosis, prevention and treatment of diseases and clinical conditions associated with MOCS1.

Molybdenum cofactor synthesis 1 (MOCS1, Accession NP_620306.1) is another GAM7052 target gene, herein designated TARGET GENE. MOCS1 BINDING SITE is a target binding site found in the 3' untranslated region of multiple transcripts of mRNA encoded by MOCS1, corresponding to a target binding site such as BINDING SITE I, BINDING SITE II or BINDING SITE III of FIG. 8. Table 4 illustrates the complementarity of the nucleotide sequences of MOCS1 BINDING SITE, designated SEQ ID:16709, to the nucleotide sequence of GAM7052 RNA, herein designated GAM RNA, also designated SEQ ID:296.

Another function of GAM7052 is therefore inhibition of Molybdenum cofactor synthesis 1 (MOCS1, Accession NP_620306.1). Accordingly, utilities of GAM7052 include diagnosis, prevention and treatment of diseases and clinical conditions associated with MOCS1.

Molybdenum cofactor synthesis 1 (MOCS1, Accession NP_005933.1) is another GAM7052 target gene, herein designated TARGET GENE. MOCS1 BINDING SITE is a target binding site found in the 3' untranslated region of multiple transcripts of mRNA encoded by MOCS1, corresponding to a target binding site such as BINDING SITE I, BINDING SITE II or BINDING SITE III of FIG. 8. Table 4 illustrates the complementarity of the nucleotide sequences of MOCS1 BINDING SITE, designated SEQ ID:16709, to the nucleotide sequence of GAM7052 RNA, herein designated GAM RNA, also designated SEQ ID:296.

Another function of GAM7052 is therefore inhibition of Molybdenum cofactor synthesis 1 (MOCS1, Accession NP_005933.1). Accordingly, utilities of GAM7052 include diagnosis, prevention and treatment of diseases and clinical conditions associated with MOCS1.

Molybdenum cofactor synthesis 3 (MOCS3, Accession NP_055299.1) is another GAM7052 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:12388, to the nucleotide sequence of GAM7052 RNA, herein designated GAM RNA, also designated SEQ ID:296.

Another function of GAM7052 is therefore inhibition of Molybdenum cofactor synthesis 3 (MOCS3, Accession NP_055299.1). Accordingly, utilities of GAM7052 include diagnosis, prevention and treatment of diseases and clinical conditions associated with MOCS3.

Myeloproliferative leukemia virus oncogene (MPL, Accession NP_005364.1) is another GAM7052 target gene, herein designated TARGET GENE. MPL BINDING SITE is a target binding site found in the 3' untranslated region of mRNA encoded by MPL, corresponding to a target binding site such as BINDING SITE I, BINDING SITE II or BINDING SITE III of FIG. 8. Table 4 illustrates the complementarity of the nucleotide sequences of MPL BINDING SITE, designated SEQ ID:19484, to the nucleotide sequence of GAM7052 RNA, herein designated GAM RNA, also designated SEQ ID:296.

Another function of GAM7052 is therefore inhibition of Myeloproliferative leukemia virus oncogene (MPL, Accession NP_005364.1). Accordingly, utilities of GAM7052 include diagnosis, prevention and treatment of diseases and clinical conditions associated with MPL.

Mitochondrial ribosomal protein l38 (MRPL38, Accession NP_115867.1) is another GAM7052 target gene, herein designated TARGET GENE. MRPL38 BINDING SITE is a target binding site found in the 5' untranslated region of mRNA encoded by MRPL38, corresponding to a target binding site such as BINDING SITE I, BINDING SITE II or BINDING SITE III of FIG. 8. Table 4 illustrates the complementarity of the nucleotide sequences of MRPL38 BINDING SITE, designated SEQ ID:15457, to the nucleotide sequence of GAM7052 RNA, herein designated GAM RNA, also designated SEQ ID:296.

Another function of GAM7052 is therefore inhibition of Mitochondrial ribosomal protein l38 (MRPL38, Accession NP_115867.1). Accordingly, utilities of GAM7052 include diagnosis, prevention and treatment of diseases and clinical conditions associated with MRPL38.

Mitochondrial ribosomal protein l44 (MRPL44, Accession NP_075066.1) is another GAM7052 target gene, herein designated TARGET GENE. MRPL44 BINDING SITE is a target binding site found in the 3' untranslated region of mRNA encoded by MRPL44, corresponding to a target binding site such as BINDING SITE I, BINDING SITE II or BINDING SITE III of FIG. 8. Table 4 illustrates the complementarity of the nucleotide sequences of MRPL44 BINDING SITE, designated SEQ ID:8317, to the nucleotide sequence of GAM7052 RNA, herein designated GAM RNA, also designated SEQ ID:296.

Another function of GAM7052 is therefore inhibition of Mitochondrial ribosomal protein l44 (MRPL44, Accession NP_075066.1). Accordingly, utilities of GAM7052 include diagnosis, prevention and treatment of diseases and clinical conditions associated with MRPL44.

Mitochondrial ribosomal protein l49 (MRPL49, Accession NP_004918.1) is another GAM7052 target gene, herein designated TARGET GENE. MRPL49 BINDING SITE is a target binding site found in the 3' untranslated region of mRNA encoded by MRPL49, corresponding to a target binding site such as BINDING SITE I, BINDING SITE II or BINDING SITE III of FIG. 8. Table 4 illustrates the complementarity of the nucleotide sequences of MRPL49 BINDING SITE, designated SEQ ID:13740, to the nucleotide sequence of GAM7052 RNA, herein designated GAM RNA, also designated SEQ ID:296.

Another function of GAM7052 is therefore inhibition of Mitochondrial ribosomal protein l49 (MRPL49, Accession NP_004918.1). Accordingly, utilities of GAM7052 include diagnosis, prevention and treatment of diseases and clinical conditions associated with MRPL49.

MSCP (Accession NP_061049.2) is another GAM7052 target gene, herein designated TARGET GENE. MSCP BINDING SITE is a target binding site found in the 3' untranslated region of multiple transcripts of mRNA encoded by MSCP, corresponding to a target binding site such as BINDING SITE I, BINDING SITE II or BINDING SITE III of FIG. 8. Table 4 illustrates the complementarity of the nucleotide sequences of MSCP BINDING SITE, designated SEQ ID:12409, to the nucleotide sequence of GAM7052 RNA, herein designated GAM RNA, also designated SEQ ID:296.

Another function of GAM7052 is therefore inhibition of MSCP (Accession NP_061049.2). Accordingly, utilities of GAM7052 include diagnosis, prevention and treatment of diseases and clinical conditions associated with MSCP.

MSTP028 (Accession NP_114160.1) is another GAM7052 target gene, herein designated TARGET GENE. MSTP028 BINDING SITE is a target binding site found in the 3' untranslated region of mRNA encoded by MSTP028, corresponding to a target binding site such as BINDING SITE I, BINDING SITE II or BINDING SITE III of FIG. 8. Table 4 illustrates the complementarity of the nucleotide sequences of MSTP028 BINDING SITE, designated SEQ ID:14617, to the nucleotide sequence of GAM7052 RNA, herein designated GAM RNA, also designated SEQ ID:296.

Another function of GAM7052 is therefore inhibition of MSTP028 (Accession NP_114160.1). Accordingly, utilities of GAM7052 include diagnosis, prevention and treatment of diseases and clinical conditions associated with MSTP028.

MtFMT (Accession NP_640335.1) is another GAM7052 target gene, herein designated TARGET GENE. MtFMT BINDING SITE is a target binding site found in the 3' untranslated region of mRNA encoded by MtFMT, corresponding to a target binding site such as BINDING SITE I, BINDING SITE II or BINDING SITE III of FIG. 8. Table 4 illustrates the complementarity of the nucleotide sequences of MtFMT BINDING SITE, designated SEQ ID:11229, to the nucleotide sequence of GAM7052 RNA, herein designated GAM RNA, also designated SEQ ID:296.

Another function of GAM7052 is therefore inhibition of MtFMT (Accession NP_640335.1). Accordingly, utilities of GAM7052 include diagnosis, prevention and treatment of diseases and clinical conditions associated with MtFMT.

MTH2 (Accession NP_060753.1) is another GAM7052 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:4662, to the nucleotide sequence of GAM7052 RNA, herein designated GAM RNA, also designated SEQ ID:296.

Another function of GAM7052 is therefore inhibition of MTH2 (Accession NP_060753.1). Accordingly, utilities of GAM7052 include diagnosis, prevention and treatment of diseases and clinical conditions associated with MTH2.

Myosin 5c (MYO5C, Accession NP_061198.1) is another GAM7052 target gene, herein designated TARGET GENE. MYO5C BINDING SITE is a target binding site found in the 3' untranslated region of mRNA encoded by MYO5C, corresponding to a target binding site such as BINDING SITE I, BINDING SITE II or BINDING SITE III of FIG. 8. Table 4 illustrates the complementarity of the nucleotide sequences of MYO5C BINDING SITE, designated SEQ ID:8527, to the nucleotide sequence of GAM7052 RNA, herein designated GAM RNA, also designated SEQ ID:296.

Another function of GAM7052 is therefore inhibition of Myosin 5c (MYO5C, Accession NP_061198.1). Accordingly, utilities of GAM7052 include diagnosis, prevention and treatment of diseases and clinical conditions associated with MYO5C.

NCAG1 (Accession NP_115536.1) is another GAM7052 target gene, herein designated TARGET GENE. NCAG1 BINDING SITE is a target binding site found in the 3' untranslated region of mRNA encoded by NCAG1, corresponding to a target binding site such as BINDING SITE I, BINDING SITE II or BINDING SITE III of FIG. 8. Table 4 illustrates the complementarity of the nucleotide sequences of NCAG1 BINDING SITE, designated SEQ ID:9119, to the nucleotide sequence of GAM7052 RNA, herein designated GAM RNA, also designated SEQ ID:296.

Another function of GAM7052 is therefore inhibition of NCAG1 (Accession NP_115536.1). Accordingly, utilities of GAM7052 include diagnosis, prevention and treatment of diseases and clinical conditions associated with NCAG1.

Nuclear receptor coactivator 6 (NCOA6, Accession NP_054790.1) is another GAM7052 target gene, herein designated TARGET GENE. NCOA6 BINDING SITE is a target binding site found in the 5' untranslated region of mRNA encoded by NCOA6, corresponding to a target binding site such as BINDING SITE I, BINDING SITE II or BINDING SITE III of FIG. 8. Table 4 illustrates the complementarity of the nucleotide sequences of NCOA6 BINDING SITE, designated SEQ ID:8801, to the nucleotide sequence of GAM7052 RNA, herein designated GAM RNA, also designated SEQ ID:296.

Another function of GAM7052 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM7052 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Nuclear receptor coactivator 6 interacting protein (NCOA6IP, Accession NP_079107.5) is another GAM7052 target gene, herein designated TARGET GENE. NCOA6IP BINDING SITE is a target binding site found in the 3' untranslated region of mRNA encoded by NCOA6IP, corresponding to a target binding site such as BINDING SITE I, BINDING SITE II or BINDING SITE III of FIG. 8. Table 4 illustrates the complementarity of the nucleotide sequences of NCOA6IP BINDING SITE, designated SEQ ID:16997, to the nucleotide sequence of GAM7052 RNA, herein designated GAM RNA, also designated SEQ ID:296.

Another function of GAM7052 is therefore inhibition of Nuclear receptor coactivator 6 interacting protein (NCOA6IP, Accession NP_079107.5). Accordingly, utilities of GAM7052 include diagnosis, prevention and treatment of diseases and clinical conditions associated with NCOA6IP.

NDP52 (Accession NP_005822.1) is another GAM7052 target gene, herein designated TARGET GENE. NDP52 BINDING SITE is a target binding site found in the 3' untranslated region of mRNA encoded by NDP52, corresponding to a target binding site such as BINDING SITE I, BINDING SITE II or BINDING SITE III of FIG. 8. Table 4 illustrates the complementarity of the nucleotide sequences of NDP52 BINDING SITE, designated SEQ ID:13638, to the nucleotide sequence of GAM7052 RNA, herein designated GAM RNA, also designated SEQ ID:296.

Another function of GAM7052 is therefore inhibition of NDP52 (Accession NP_005822.1). Accordingly, utilities of GAM7052 include diagnosis, prevention and treatment of diseases and clinical conditions associated with NDP52.

Neurofibromin 2 (bilateral acoustic neuroma) (NF2, Accession NP_057502.1) is another GAM7052 target gene, herein designated TARGET GENE. NF2 BINDING SITE is a target binding site found in the 5' untranslated region of multiple transcripts of mRNA encoded by NF2, corresponding to a target binding site such as BINDING SITE I, BINDING SITE II or BINDING SITE III of FIG. 8. Table 4 illustrates the complementarity of the nucleotide sequences of NF2 BINDING SITE, designated SEQ ID:1234, to the nucleotide sequence of GAM7052 RNA, herein designated GAM RNA, also designated SEQ ID:296.

Another function of GAM7052 is therefore inhibition of Neurofibromin 2 (bilateral acoustic neuroma) (NF2, Accession NP_057502.1). Accordingly, utilities of GAM7052 include diagnosis, prevention and treatment of diseases and clinical conditions associated with NF2.

Nescient helix loop helix 1 (NHLH1, Accession NP_005589.1) is another GAM7052 target gene, herein designated TARGET GENE. NHLH1 BINDING SITE is a target binding site found in the 3' untranslated region of mRNA encoded by NHLH1, corresponding to a target binding site such as BINDING SITE I, BINDING SITE II or BINDING SITE III of FIG. 8. Table 4 illustrates the complementarity of the nucleotide sequences of NHLH1 BINDING SITE, designated SEQ ID:10682, to the nucleotide sequence of GAM7052 RNA, herein designated GAM RNA, also designated SEQ ID:296.

Another function of GAM7052 is therefore inhibition of Nescient helix loop helix 1 (NHLH1, Accession NP_005589.1), a gene which may have a role in development of the nervous system. Accordingly, utilities of GAM7052 include diagnosis, prevention and treatment of diseases and clinical conditions associated with NHLH1.

The function of NHLH1 and its association with various diseases and clinical conditions, has been established by previous studies, as described hereinabove with reference to GAM354.1. Nidogen (enactin) (NID, Accession NP_002499.1) is another GAM7052 target gene, herein designated TARGET GENE. NID BINDING SITE is a target binding site found in the 3' untranslated region of mRNA encoded by NID, corresponding to a target binding site such as BINDING SITE I, BINDING SITE II or BINDING SITE III of FIG. 8. Table 4 illustrates the complementarity of the nucleotide sequences of NID BINDING SITE, designated SEQ ID:10147, to the nucleotide sequence of GAM7052 RNA, herein designated GAM RNA, also designated SEQ ID:296.

Another function of GAM7052 is therefore inhibition of Nidogen (enactin) (NID, Accession NP_002499.1). Accordingly, utilities of GAM7052 include diagnosis, prevention and treatment of diseases and clinical conditions associated with NID.

N-myristoyltransferase 1 (NMT1, Accession NP_066565.1) is another GAM7052 target gene, herein designated TARGET GENE. NMT1 BINDING SITE is a target binding site found in the 3' untranslated region of mRNA encoded by NMT1, corresponding to a target binding site such as BINDING SITE I, BINDING SITE II or BINDING SITE III of FIG. 8. Table 4 illustrates the complementarity of the nucleotide sequences of NMT1 BINDING SITE, designated SEQ ID:14612, to the nucleotide sequence of GAM7052 RNA, herein designated GAM RNA, also designated SEQ ID:296.

Another function of GAM7052 is therefore inhibition of N-myristoyltransferase 1 (NMT1, Accession NP_066565.1). Accordingly, utilities of GAM7052 include diagnosis, prevention and treatment of diseases and clinical conditions associated with NMT1.

NOSIP (Accession NP_057037.1) is another GAM7052 target gene, herein designated TARGET GENE. NOSIP BINDING SITE is a target binding site found in the 5' untranslated region of mRNA encoded by NOSIP, corresponding to a target binding site such as BINDING SITE I, BINDING SITE II or BINDING SITE III of FIG. 8. Table 4 illustrates the complementarity of the nucleotide sequences of NOSIP BINDING SITE, designated SEQ ID:4828, to the nucleotide sequence of GAM7052 RNA, herein designated GAM RNA, also designated SEQ ID:296.

Another function of GAM7052 is therefore inhibition of NOSIP (Accession NP_057037.1). Accordingly, utilities of GAM7052 include diagnosis, prevention and treatment of diseases and clinical conditions associated with NOSIP.

Nudix (nucleoside diphosphate linked moiety x)-type motif 4 (NUDT4, Accession NP_061967.2) is another GAM7052 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:13741, to the nucleotide sequence of GAM7052 RNA, herein designated GAM RNA, also designated SEQ ID:296.

Another function of GAM7052 is therefore inhibition of Nudix (nucleoside diphosphate linked moiety x)-type motif 4 (NUDT4, Accession NP_061967.2). Accordingly, utilities of GAM7052 include diagnosis, prevention and treatment of diseases and clinical conditions associated with NUDT4.

Nuclear fragile x mental retardation protein interacting protein 1 (NUFIP1, Accession NP_036477.1) is another GAM7052 target gene, herein designated TARGET GENE. NUFIP1 BINDING SITE is a target binding site found in the 3' untranslated region of mRNA encoded by NUFIP1, corresponding to a target binding site such as BINDING SITE I, BINDING SITE II or BINDING SITE III of FIG. 8. Table 4 illustrates the complementarity of the nucleotide sequences of NUFIP1 BINDING SITE, designated SEQ ID:12644, to the nucleotide sequence of GAM7052 RNA, herein designated GAM RNA, also designated SEQ ID:296.

Another function of GAM7052 is therefore inhibition of Nuclear fragile x mental retardation protein interacting protein 1 (NUFIP1, Accession NP_036477.1), a gene which binds and colocalizes with nuclear fragile X mental retardation protein. Accordingly, utilities of GAM7052 include diagnosis, prevention and treatment of diseases and clinical conditions associated with NUFIP1.

The function of NUFIP1 and its association with various diseases and clinical conditions, has been established by previous studies, as described hereinabove with reference to GAM139.2. Nuclear mitotic apparatus protein 1 (NUMA1, Accession NP_006176.1) is another GAM7052 target gene, herein designated TARGET GENE. NUMA1 BINDING SITE is a target binding site found in the 5' untranslated region of mRNA encoded by NUMA1, corresponding to a target binding site such as BINDING SITE I, BINDING SITE II or BINDING SITE III of FIG. 8. Table 4 illustrates the complementarity of the nucleotide sequences of NUMA1 BINDING SITE, designated SEQ ID:13914, to the nucleotide sequence of GAM7052 RNA, herein designated GAM RNA, also designated SEQ ID:296.

Another function of GAM7052 is therefore inhibition of Nuclear mitotic apparatus protein 1 (NUMA1, Accession NP_006176.1), a gene which is nuclear mitotic apparatus protein. Accordingly, utilities of GAM7052 include diagnosis, prevention and treatment of diseases and clinical conditions associated with NUMA1.

The function of NUMA1 and its association with various diseases and clinical conditions, has been established by previous studies, as described hereinabove with reference to GAM133.1. Nucleoredoxin (NXN, Accession NP_071908.1) is another GAM7052 target gene, herein designated TARGET GENE. NXN BINDING SITE is a target binding site found in the 3' untranslated region of mRNA encoded by NXN, corresponding to a target binding site such as BINDING SITE I, BINDING SITE II or BINDING SITE III of FIG. 8. Table 4 illustrates the complementarity of the nucleotide sequences of NXN BINDING SITE, designated SEQ ID:10897, to the nucleotide sequence of GAM7052 RNA, herein designated GAM RNA, also designated SEQ ID:296.

Another function of GAM7052 is therefore inhibition of Nucleoredoxin (NXN, Accession NP_071908.1). Accordingly, utilities of GAM7052 include diagnosis, prevention and treatment of diseases and clinical conditions associated with NXN.

Oral cancer overexpressed 1 (ORAOV1, Accession NP_703152.1) is another GAM7052 target gene, herein designated TARGET GENE. ORAOV1 BINDING SITE is a target binding site found in the 3' untranslated region of mRNA encoded by ORAOV1, corresponding to a target binding site such as BINDING SITE I, BINDING SITE II or BINDING SITE III of FIG. 8. Table 4 illustrates the complementarity of the nucleotide sequences of ORAOV1 BINDING SITE, designated SEQ ID:8157, to the nucleotide sequence of GAM7052 RNA, herein designated GAM RNA, also designated SEQ ID:296.

Another function of GAM7052 is therefore inhibition of Oral cancer overexpressed 1 (ORAOV1, Accession NP_703152.1). Accordingly, utilities of GAM7052 include diagnosis, prevention and treatment of diseases and clinical conditions associated with ORAOV1.

Oxysterol binding protein-like 2 (OSBPL2, Accession NP_653081.1) is another GAM7052 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:13183, to the nucleotide sequence of GAM7052 RNA, herein designated GAM RNA, also designated SEQ ID:296.

Another function of GAM7052 is therefore inhibition of Oxysterol binding protein-like 2 (OSBPL2, Accession NP_653081.1). Accordingly, utilities of GAM7052 include diagnosis, prevention and treatment of diseases and clinical conditions associated with OSBPL2.

Oxysterol binding protein-like 2 (OSBPL2, Accession NP_055650.1) is another GAM7052 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:13183, to the nucleotide sequence of GAM7052 RNA, herein designated GAM RNA, also designated SEQ ID:296.

Another function of GAM7052 is therefore inhibition of Oxysterol binding protein-like 2 (OSBPL2, Accession NP_055650.1). Accordingly, utilities of GAM7052 include diagnosis, prevention and treatment of diseases and clinical conditions associated with OSBPL2.

Pas domain containing serine/threonine kinase (PASK, Accession NP_055963.1) is another GAM7052 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:9616, to the nucleotide sequence of GAM7052 RNA, herein designated GAM RNA, also designated SEQ ID:296.

Another function of GAM7052 is therefore inhibition of Pas domain containing serine/threonine kinase (PASK, Accession NP_055963.1). Accordingly, utilities of GAM7052 include diagnosis, prevention and treatment of diseases and clinical conditions associated with PASK.

Protocadherin alpha 9 (PCDHA9, Accession NP_054724.1) is another GAM7052 target gene, herein designated TARGET GENE. PCDHA9 BINDING SITE is a target binding site found in the 3' untranslated region of multiple transcripts of mRNA encoded by PCDHA9, corresponding to a target binding site such as BINDING SITE I, BINDING SITE II or BINDING SITE III of FIG. 8. Table 4 illustrates the complementarity of the nucleotide sequences of PCDHA9 BINDING SITE, designated SEQ ID:11228, to the nucleotide sequence of GAM7052 RNA, herein designated GAM RNA, also designated SEQ ID:296.

Another function of GAM7052 is therefore inhibition of Protocadherin alpha 9 (PCDHA9, Accession NP_054724.1), a gene which is a calcium-dependent cell-adhesion protein. Accordingly, utilities of GAM7052 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Phosphodiesterase 6b, cgmp-specific, rod, beta (congenital stationary night blindness 3, autosomal dominant) (PDE6B, Accession NP_000274.1) is another GAM7052 target gene, herein designated TARGET GENE. PDE6B BINDING SITE1 and PDE6B BINDING SITE2 are target binding sites found in untranslated regions of mRNA encoded by PDE6B, corresponding to target binding sites such as BINDING SITE I, BINDING SITE II or BINDING SITE III of FIG. 8. Table 4 illustrates the complementarity of the nucleotide sequences of PDE6B BINDING SITE1 and PDE6B BINDING SITE2, designated SEQ ID:7445 and SEQ ID:9847 respectively, to the nucleotide sequence of GAM7052 RNA, herein designated GAM RNA, also designated SEQ ID:296.

Another function of GAM7052 is therefore inhibition of Phosphodiesterase 6b, cgmp-specific, rod, beta (congenital stationary night blindness 3, autosomal dominant) (PDE6B, Accession NP_000274.1). Accordingly, utilities of GAM7052 include diagnosis, prevention and treatment of diseases and clinical conditions associated with PDE6B.

Pellino homolog 1 (drosophila) (PELI1, Accession NP_065702.2) is another GAM7052 target gene, herein designated TARGET GENE. PELI1 BINDING SITE is a target binding site found in the 5' untranslated region of mRNA encoded by PELI1, corresponding to a target binding site such as BINDING SITE I, BINDING SITE II or BINDING SITE III of FIG. 8. Table 4 illustrates the complementarity of the nucleotide sequences of PELI1 BINDING SITE, designated SEQ ID:10821, to the nucleotide sequence of GAM7052 RNA, herein designated GAM RNA, also designated SEQ ID:296.

Another function of GAM7052 is therefore inhibition of Pellino homolog 1 (drosophila) (PELI1, Accession NP_065702.2). Accordingly, utilities of GAM7052 include diagnosis, prevention and treatment of diseases and clinical conditions associated with PELI1.

Period homolog 2 (drosophila) (PER2, Accession NP_073728.1) is another GAM7052 target gene, herein designated TARGET GENE. PER2 BINDING SITE is a target binding site found in the 3' untranslated region of multiple transcripts of mRNA encoded by PER2, corresponding to a target binding site such as BINDING SITE I, BINDING SITE II or BINDING SITE III of FIG. 8. Table 4 illustrates the complementarity of the nucleotide sequences of PER2 BINDING SITE, designated SEQ ID:18316, to the nucleotide sequence of GAM7052 RNA, herein designated GAM RNA, also designated SEQ ID:296.

Another function of GAM7052 is therefore inhibition of Period homolog 2 (drosophila) (PER2, Accession NP_073728.1), a gene which Period homolog 2; putative circadian clock protein; has a PAS dimerization domain and therefore may be associated with Familial advanced sleep-phase syndrome. Accordingly, utilities of GAM7052 include diagnosis, prevention and treatment of Familial advanced sleep-phase syndrome, and of other diseases and clinical conditions associated with PER2.

The function of PER2 and its association with various diseases and clinical conditions, has been established by previous studies, as described hereinabove with reference to GAM130.1. PHAX (Accession NP_115553.1) is another GAM7052 target gene, herein designated TARGET GENE. PHAX BINDING SITE is a target binding site found in the 3' untranslated region of mRNA encoded by PHAX, corresponding to a target binding site such as BINDING SITE I, BINDING SITE II or BINDING SITE III of FIG. 8. Table 4 illustrates the complementarity of the nucleotide sequences of PHAX BINDING SITE, designated SEQ ID:14737, to the nucleotide sequence of GAM7052 RNA, herein designated GAM RNA, also designated SEQ ID:296.

Another function of GAM7052 is therefore inhibition of PHAX (Accession NP_115553.1). Accordingly, utilities of GAM7052 include diagnosis, prevention and treatment of diseases and clinical conditions associated with PHAX.

Phosphoinositide-3-kinase, class 2, beta polypeptide (PIK3C2B, Accession NP_002637.2) is another GAM7052 target gene, herein designated TARGET GENE. PIK3C2B BINDING SITE is a target binding site found in the 3' untranslated region of mRNA encoded by PIK3C2B, corresponding to a target binding site such as BINDING SITE I, BINDING SITE II or BINDING SITE III of FIG. 8. Table 4 illustrates the complementarity of the nucleotide sequences of PIK3C2B BINDING SITE, designated SEQ ID:16722, to the nucleotide sequence of GAM7052 RNA, herein designated GAM RNA, also designated SEQ ID:296.

Another function of GAM7052 is therefore inhibition of Phosphoinositide-3-kinase, class 2, beta polypeptide (PIK3C2B, Accession NP_002637.2). Accordingly, utilities of GAM7052 include diagnosis, prevention and treatment of diseases and clinical conditions associated with PIK3C2B.

Phosphoinositide-3-kinase, catalytic, delta polypeptide (PIK3CD, Accession NP_005017.2) is another GAM7052 target gene, herein designated TARGET GENE. PIK3CD BINDING SITE is a target binding site found in the 3' untranslated region of mRNA encoded by PIK3CD, corresponding to a target binding site such as BINDING SITE I, BINDING SITE II or BINDING SITE III of FIG. 8. Table 4 illustrates the complementarity of the nucleotide sequences of PIK3CD BINDING SITE, designated SEQ ID:9691, to the nucleotide sequence of GAM7052 RNA, herein designated GAM RNA, also designated SEQ ID:296.

Another function of GAM7052 is therefore inhibition of Phosphoinositide-3-kinase, catalytic, delta polypeptide (PIK3CD, Accession NP_005017.2), a gene which regulating cell growth. Accordingly, utilities of GAM7052 include diagnosis, prevention and treatment of diseases and clinical conditions associated with PIK3CD.

The function of PIK3CD and its association with various diseases and clinical conditions, has been established by previous studies, as described hereinabove with reference to GAM136.1. Pbx/knotted 1 homeobox 1 (PKNOX1, Accession NP_004562.2) is another GAM7052 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:16723, to the nucleotide sequence of GAM7052 RNA, herein designated GAM RNA, also designated SEQ ID:296.

Another function of GAM7052 is therefore inhibition of Pbx/knotted 1 homeobox 1 (PKNOX1, Accession NP_004562.2), a gene which may regulate gene expression and control cell differentiation. Accordingly, utilities of GAM7052 include diagnosis, prevention and treatment of diseases and clinical conditions associated with PKNOX1.

The function of PKNOX1 and its association with various diseases and clinical conditions, has been established by previous studies, as described hereinabove with reference to GAM55.1. Phospholipase c, delta 3 (PLCD3, Accession NP_588614.1) is another GAM7052 target gene, herein designated TARGET GENE. PLCD3 BINDING SITE is a target binding site found in the 3' untranslated region of mRNA encoded by PLCD3, corresponding to a target binding site such as BINDING SITE I, BINDING SITE II or BINDING SITE III of FIG. 8. Table 4 illustrates the complementarity of the nucleotide sequences of PLCD3 BINDING SITE, designated SEQ ID:11178, to the nucleotide sequence of GAM7052 RNA, herein designated GAM RNA, also designated SEQ ID:296.

Another function of GAM7052 is therefore inhibition of Phospholipase c, delta 3 (PLCD3, Accession NP_588614.1). Accordingly, utilities of GAM7052 include diagnosis, prevention and treatment of diseases and clinical conditions associated with PLCD3.

Paraneoplastic antigen ma2 (PNMA2, Accession NP_009188.1) is another GAM7052 target gene, herein designated TARGET GENE. PNMA2 BINDING SITE is a target binding site found in the 3' untranslated region of mRNA encoded by PNMA2, corresponding to a target binding site such as BINDING SITE I, BINDING SITE II or BINDING SITE III of FIG. 8. Table 4 illustrates the complementarity of the nucleotide sequences of PNMA2 BINDING SITE, designated SEQ ID:10897, to the nucleotide sequence of GAM7052 RNA, herein designated GAM RNA, also designated SEQ ID:296.

Another function of GAM7052 is therefore inhibition of Paraneoplastic antigen ma2 (PNMA2, Accession NP_009188.1). Accordingly, utilities of GAM7052 include diagnosis, prevention and treatment of diseases and clinical conditions associated with PNMA2.

POLD3 (Accession XP_166243.1) is another GAM7052 target gene, herein designated TARGET GENE. POLD3 BINDING SITE is a target binding site found in the 3' untranslated region of mRNA encoded by POLD3, corresponding to a target binding site such as BINDING SITE I, BINDING SITE II or BINDING SITE III of FIG. 8. Table 4 illustrates the complementarity of the nucleotide sequences of POLD3 BINDING SITE, designated SEQ ID:19468, to the nucleotide sequence of GAM7052 RNA, herein designated GAM RNA, also designated SEQ ID:296.

Another function of GAM7052 is therefore inhibition of POLD3 (Accession XP_166243.1). Accordingly, utilities of GAM7052 include diagnosis, prevention and treatment of diseases and clinical conditions associated with POLD3.

Pou domain, class 2, associating factor 1 (POU2AF1, Accession NP_006226.1) is another GAM7052 target gene, herein designated TARGET GENE. POU2AF1 BINDING SITE is a target binding site found in the 3' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:16360, to the nucleotide sequence of GAM7052 RNA, herein designated GAM RNA, also designated SEQ ID:296.

Another function of GAM7052 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM7052 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. PP1665 (Accession NP_110419.3) is another GAM7052 target gene, herein designated TARGET GENE. PP1665 BINDING SITE is a target binding site found in the 5' untranslated region of mRNA encoded by PP1665, corresponding to a target binding site such as BINDING SITE I, BINDING SITE II or BINDING SITE III of FIG. 8. Table 4 illustrates the complementarity of the nucleotide sequences of PP1665 BINDING SITE, designated SEQ ID:15458, to the nucleotide sequence of GAM7052 RNA, herein designated GAM RNA, also designated SEQ ID:296.

Another function of GAM7052 is therefore inhibition of PP1665 (Accession NP_110419.3). Accordingly, utilities of GAM7052 include diagnosis, prevention and treatment of diseases and clinical conditions associated with PP1665.

Protein phosphatase, ef hand calcium-binding domain 2 (PPEF2, Accession NP_690911.1) is another GAM7052 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:16723, to the nucleotide sequence of GAM7052 RNA, herein designated GAM RNA, also designated SEQ ID:296.

Another function of GAM7052 is therefore inhibition of Protein phosphatase, ef hand calcium-binding domain 2 (PPEF2, Accession NP_690911.1), a gene which is a homolog of Drosophila rdgC. Accordingly, utilities of GAM7052 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_690910.1) is another GAM7052 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:16723, to the nucleotide sequence of GAM7052 RNA, herein designated GAM RNA, also designated SEQ ID:296.

Another function of GAM7052 is therefore inhibition of Protein phosphatase, ef hand calcium-binding domain 2 (PPEF2, Accession NP_690910.1), a gene which is a homolog of Drosophila rdgC. Accordingly, utilities of GAM7052 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_006230.2) is another GAM7052 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:16723, to the nucleotide sequence of GAM7052 RNA, herein designated GAM RNA, also designated SEQ ID:296.

Another function of GAM7052 is therefore inhibition of Protein phosphatase, ef hand calcium-binding domain 2 (PPEF2, Accession NP_006230.2), a gene which is a homolog of Drosophila rdgC. Accordingly, utilities of GAM7052 include diagnosis, prevention and treatment of diseases and clinical conditions associated with PPEF2.

The function of PPEF2 and its association with various diseases and clinical conditions, has been established by previous studies, as described hereinabove with reference to GAM66.2. Ptprf interacting protein, binding protein 1 (liprin beta 1) (PPFIBP1, Accession NP_003613.2) is another GAM7052 target gene, herein designated TARGET GENE. PPFIBP1 BINDING SITE is a target binding site found in the 3' untranslated region of multiple transcripts of mRNA encoded by PPFIBP1, corresponding to a target binding site such as BINDING SITE I, BINDING SITE II or BINDING SITE III of FIG. 8. Table 4 illustrates the complementarity of the nucleotide sequences of PPFIBP1 BINDING SITE, designated SEQ ID:9291, to the nucleotide sequence of GAM7052 RNA, herein designated GAM RNA, also designated SEQ ID:296.

Another function of GAM7052 is therefore inhibition of Ptprf interacting protein, binding protein 1 (liprin beta 1) (PPFIBP1, Accession NP_003613.2). Accordingly, utilities of GAM7052 include diagnosis, prevention and treatment of diseases and clinical conditions associated with PPFIBP1.

Peptidylprolyl isomerase d (cyclophilin d) (PPID, Accession NP_005029.1) is another GAM7052 target gene, herein designated TARGET GENE. PPID BINDING SITE is a target binding site found in the 3' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:10127, to the nucleotide sequence of GAM7052 RNA, herein designated GAM RNA, also designated SEQ ID:296.

Another function of GAM7052 is therefore inhibition of Peptidylprolyl isomerase d (cyclophilin d) (PPID, Accession NP_005029.1), a gene which catalyzes the cis-trans isomerization of proline imidic peptide bonds in oligopeptides. Accordingly, utilities of GAM7052 include diagnosis, prevention and treatment of diseases and clinical conditions associated with PPID.

The function of PPID and its association with various diseases and clinical conditions, has been established by previous studies, as described hereinabove with reference to GAM136.1. Protein phosphatase 1, regulatory (inhibitor) subunit 16b (PPP1R16B, Accession NP_056383.1) is another GAM7052 target gene, herein designated TARGET GENE. PPP1R16B BINDING SITE is a target binding site found in the 3' untranslated region of mRNA encoded by PPP1R16B, corresponding to a target binding site such as BINDING SITE I, BINDING SITE II or BINDING SITE III of FIG. 8. Table 4 illustrates the complementarity of the nucleotide sequences of PPP1R16B BINDING SITE, designated SEQ ID:4482, to the nucleotide sequence of GAM7052 RNA, herein designated GAM RNA, also designated SEQ ID:296.

Another function of GAM7052 is therefore inhibition of Protein phosphatase 1, regulatory (inhibitor) subunit 16b (PPP1R16B, Accession NP_056383.1). Accordingly, utilities of GAM7052 include diagnosis, prevention and treatment of diseases and clinical conditions associated with PPP1R16B.

Protein kinase, interferon-inducible double stranded rna dependent (PRKR, Accession NP_002750.1) is another GAM7052 target gene, herein designated TARGET GENE. PRKR BINDING SITE1 and PRKR BINDING SITE2 are target binding sites found in untranslated regions of mRNA encoded by PRKR, corresponding to target binding sites such as BINDING SITE I, BINDING SITE II or BINDING SITE III of FIG. 8. Table 4 illustrates the complementarity of the nucleotide sequences of PRKR BINDING SITE1 and PRKR BINDING SITE2, designated SEQ ID:15131 and SEQ ID:14827 respectively, to the nucleotide sequence of GAM7052 RNA, herein designated GAM RNA, also designated SEQ ID:296.

Another function of GAM7052 is therefore inhibition of Protein kinase, interferon-inducible double stranded rna dependent (PRKR, Accession NP_002750.1), a gene which catalyze the phosphorylation of the alpha subunit of eif2. and therefore may be associated with Huntington's disease. Accordingly, utilities of GAM7052 include diagnosis, prevention and treatment of Huntington's disease, and of other diseases and clinical conditions associated with PRKR.

The function of PRKR and its association with various diseases and clinical conditions, has been established by previous studies, as described hereinabove with reference to GAM136.1. Protein kinase, lysine deficient 3 (PRKWNK3, Accession NP_065973.1) is another GAM7052 target gene, herein designated TARGET GENE. PRKWNK3 BINDING SITE is a target binding site found in the 3' untranslated region of mRNA encoded by PRKWNK3, corresponding to a target binding site such as BINDING SITE I, BINDING SITE II or BINDING SITE III of FIG. 8. Table 4 illustrates the complementarity of the nucleotide sequences of PRKWNK3 BINDING SITE, designated SEQ ID:5689, to the nucleotide sequence of GAM7052 RNA, herein designated GAM RNA, also designated SEQ ID:296.

Another function of GAM7052 is therefore inhibition of Protein kinase, lysine deficient 3 (PRKWNK3, Accession NP_065973.1). Accordingly, utilities of GAM7052 include diagnosis, prevention and treatment of diseases and clinical conditions associated with PRKWNK3.

Prion protein 2 (dublet) (PRND, Accession NP_036541.1) is another GAM7052 target gene, herein designated TARGET GENE. PRND BINDING SITE is a target binding site found in the 3' untranslated region of mRNA encoded by PRND, corresponding to a target binding site such as BINDING SITE I, BINDING SITE II or BINDING SITE III of FIG. 8. Table 4 illustrates the complementarity of the nucleotide sequences of PRND BINDING SITE, designated SEQ ID:14582, to the nucleotide sequence of GAM7052 RNA, herein designated GAM RNA, also designated SEQ ID:296.

Another function of GAM7052 is therefore inhibition of Prion protein 2 (dublet) (PRND, Accession NP_036541.1), a gene which is similar to prion protein PRNP. Accordingly, utilities of GAM7052 include diagnosis, prevention and treatment of diseases and clinical conditions associated with PRND.

The function of PRND and its association with various diseases and clinical conditions, has been established by previous studies, as described hereinabove with reference to GAM116.1. PRO0971 (Accession NP_061039.2) is another GAM7052 target gene, herein designated TARGET GENE. PRO0971 BINDING SITE is a target binding site found in the 3' untranslated region of mRNA encoded by PRO0971, corresponding to a target binding site such as BINDING SITE I, BINDING SITE II or BINDING SITE III of FIG. 8. Table 4 illustrates the complementarity of the nucleotide sequences of PRO0971 BINDING SITE, designated SEQ ID:7840, to the nucleotide sequence of GAM7052 RNA, herein designated GAM RNA, also designated SEQ ID:296.

Another function of GAM7052 is therefore inhibition of PRO0971 (Accession NP_061039.2). Accordingly, utilities of GAM7052 include diagnosis, prevention and treatment of diseases and clinical conditions associated with PRO0971.

Proline-serine-threonine phosphatase interacting protein 2 (PSTPIP2, Accession NP_077748.2) is another GAM7052 target gene, herein designated TARGET GENE. PSTPIP2 BINDING SITE is a target binding site found in the 3' untranslated region of mRNA encoded by PSTPIP2, corresponding to a target binding site such as BINDING SITE I, BINDING SITE II or BINDING SITE III of FIG. 8. Table 4 illustrates the complementarity of the nucleotide sequences of PSTPIP2 BINDING SITE, designated SEQ ID:8011, to the nucleotide sequence of GAM7052 RNA, herein designated GAM RNA, also designated SEQ ID:296.

Another function of GAM7052 is therefore inhibition of Proline-serine-threonine phosphatase interacting protein 2 (PSTPIP2, Accession NP_077748.2). Accordingly, utilities of GAM7052 include diagnosis, prevention and treatment of diseases and clinical conditions associated with PSTPIP2.

Prostaglandin e synthase (PTGES, Accession NP_004869.1) is another GAM7052 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:12377, to the nucleotide sequence of GAM7052 RNA, herein designated GAM RNA, also designated SEQ ID:296.

Another function of GAM7052 is therefore inhibition of Prostaglandin e synthase (PTGES, Accession NP_004869.1). Accordingly, utilities of GAM7052 include diagnosis, prevention and treatment of diseases and clinical conditions associated with PTGES.

Prostaglandin i2 (prostacyclin) synthase (PTGIS, Accession NP_000952.1) is another GAM7052 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:8761, to the nucleotide sequence of GAM7052 RNA, herein designated GAM RNA, also designated SEQ ID:296.

Another function of GAM7052 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM7052 include diagnosis, prevention and treatment of diseases and clinical conditions associated with PTGIS.

The function of PTGIS and its association with various diseases and clinical conditions, has been established by previous studies, as described hereinabove with reference to GAM30.1. Protein tyrosine phosphatase, non-receptor type 18 (brain-derived) (PTPN18, Accession NP_055184.2) is another GAM7052 target gene, herein designated TARGET GENE. PTPN18 BINDING SITE is a target binding site found in the 3' untranslated region of mRNA encoded by PTPN18, corresponding to a target binding site such as BINDING SITE I, BINDING SITE II or BINDING SITE III of FIG. 8. Table 4 illustrates the complementarity of the nucleotide sequences of PTPN18 BINDING SITE, designated SEQ ID:17110, to the nucleotide sequence of GAM7052 RNA, herein designated GAM RNA, also designated SEQ ID:296.

Another function of GAM7052 is therefore inhibition of Protein tyrosine phosphatase, non-receptor type 18 (brain-derived) (PTPN18, Accession NP_055184.2). Accordingly, utilities of GAM7052 include diagnosis, prevention and treatment of diseases and clinical conditions associated with PTPN18.

Protein tyrosine phosphatase, receptor type, t (PTPRT, Accession NP_008981.2) is another GAM7052 target gene, herein designated TARGET GENE. PTPRT BINDING SITE is a target binding site found in the 3' untranslated region of multiple transcripts of mRNA encoded by PTPRT, corresponding to a target binding site such as BINDING SITE I, BINDING SITE II or BINDING SITE III of FIG. 8. Table 4 illustrates the complementarity of the nucleotide sequences of PTPRT BINDING SITE, designated SEQ ID:18384, to the nucleotide sequence of GAM7052 RNA, herein designated GAM RNA, also designated SEQ ID:296.

Another function of GAM7052 is therefore inhibition of Protein tyrosine phosphatase, receptor type, t (PTPRT, Accession NP_008981.2). Accordingly, utilities of GAM7052 include diagnosis, prevention and treatment of diseases and clinical conditions associated with PTPRT.

Protein tyrosine phosphatase, receptor type, t (PTPRT, Accession NP_573400.1) is another GAM7052 target gene, herein designated TARGET GENE. PTPRT BINDING SITE is a target binding site found in the 3' untranslated region of multiple transcripts of mRNA encoded by PTPRT, corresponding to a target binding site such as BINDING SITE I, BINDING SITE II or BINDING SITE III of FIG. 8. Table 4 illustrates the complementarity of the nucleotide sequences of PTPRT BINDING SITE, designated SEQ ID:18384, to the nucleotide sequence of GAM7052 RNA, herein designated GAM RNA, also designated SEQ ID:296.

Another function of GAM7052 is therefore inhibition of Protein tyrosine phosphatase, receptor type, t (PTPRT, Accession NP_573400.1). Accordingly, utilities of GAM7052 include diagnosis, prevention and treatment of diseases and clinical conditions associated with PTPRT.

RAB11-FIP4 (Accession NP_116321.2) is another GAM7052 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:1607, to the nucleotide sequence of GAM7052 RNA, herein designated GAM RNA, also designated SEQ ID:296.

Another function of GAM7052 is therefore inhibition of RAB11-FIP4 (Accession NP_116321.2). Accordingly, utilities of GAM7052 include diagnosis, prevention and treatment of diseases and clinical conditions associated with RAB11-FIP4.

Rab33b, member ras oncogene family (RAB33B, Accession NP_112586.1) is another GAM7052 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:19271, to the nucleotide sequence of GAM7052 RNA, herein designated GAM RNA, also designated SEQ ID:296.

Another function of GAM7052 is therefore inhibition of Rab33b, member ras oncogene family (RAB33B, Accession NP_112586.1). Accordingly, utilities of GAM7052 include diagnosis, prevention and treatment of diseases and clinical conditions associated with RAB33B.

Rab34, member ras oncogene family (RAB34, Accession NP_114140.2) is another GAM7052 target gene, herein designated TARGET GENE. RAB34 BINDING SITE is a target binding site found in the 3' untranslated region of mRNA encoded by RAB34, corresponding to a target binding site such as BINDING SITE I, BINDING SITE II or BINDING SITE III of FIG. 8. Table 4 illustrates the complementarity of the nucleotide sequences of RAB34 BINDING SITE, designated SEQ ID:8691, to the nucleotide sequence of GAM7052 RNA, herein designated GAM RNA, also designated SEQ ID:296.

Another function of GAM7052 is therefore inhibition of Rab34, member ras oncogene family (RAB34, Accession NP_114140.2). Accordingly, utilities of GAM7052 include diagnosis, prevention and treatment of diseases and clinical conditions associated with RAB34.

Rab36, member ras oncogene family (RAB36, Accession NP_004905.1) is another GAM7052 target gene, herein designated TARGET GENE. RAB36 BINDING SITE is a target binding site found in the 3' untranslated region of mRNA encoded by RAB36, corresponding to a target binding site such as BINDING SITE I, BINDING SITE II or BINDING SITE III of FIG. 8. Table 4 illustrates the complementarity of the nucleotide sequences of RAB36 BINDING SITE, designated SEQ ID:2107, to the nucleotide sequence of GAM7052 RNA, herein designated GAM RNA, also designated SEQ ID:296.

Another function of GAM7052 is therefore inhibition of Rab36, member ras oncogene family (RAB36, Accession NP_004905.1), a gene which is involved in protein transport. Accordingly, utilities of GAM7052 include diagnosis, prevention and treatment of diseases and clinical conditions associated with RAB36.

The function of RAB36 and its association with various diseases and clinical conditions, has been established by previous studies, as described hereinabove with reference to GAM130.1. RAI (Accession NP_006654.1) is another GAM7052 target gene, herein designated TARGET GENE. RAI BINDING SITE is a target binding site found in the 5' untranslated region of mRNA encoded by RAI, corresponding to a target binding site such as BINDING SITE I, BINDING SITE II or BINDING SITE III of FIG. 8. Table 4 illustrates the complementarity of the nucleotide sequences of RAI BINDING SITE, designated SEQ ID:13915, to the nucleotide sequence of GAM7052 RNA, herein designated GAM RNA, also designated SEQ ID:296.

Another function of GAM7052 is therefore inhibition of RAI (Accession NP_006654.1). Accordingly, utilities of GAM7052 include diagnosis, prevention and treatment of diseases and clinical conditions associated with RAI.

Rap1, gtpase activating protein 1 (RAP1GA1, Accession NP_002876.1) is another GAM7052 target gene, herein designated TARGET GENE. RAP1GA1 BINDING SITE is a target binding site found in the 3' untranslated region of mRNA encoded by RAP1GA1, corresponding to a target binding site such as BINDING SITE I, BINDING SITE II or BINDING SITE III of FIG. 8. Table 4 illustrates the complementarity of the nucleotide sequences of RAP1GA1 BINDING SITE, designated SEQ ID:16882, to the nucleotide sequence of GAM7052 RNA, herein designated GAM RNA, also designated SEQ ID:296.

Another function of GAM7052 is therefore inhibition of Rap1, gtpase activating protein 1 (RAP1GA1, Accession NP_002876.1). Accordingly, utilities of GAM7052 include diagnosis, prevention and treatment of diseases and clinical conditions associated with RAP1GA1.

Ras association (ralgds/af-6) domain family 2 (RASSF2, Accession NP_739580.1) is another GAM7052 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:9279, to the nucleotide sequence of GAM7052 RNA, herein designated GAM RNA, also designated SEQ ID:296.

Another function of GAM7052 is therefore inhibition of Ras association (ralgds/af-6) domain family 2 (RASSF2, Accession NP_739580.1). Accordingly, utilities of GAM7052 include diagnosis, prevention and treatment of diseases and clinical conditions associated with RASSF2.

Ras association (ralgds/af-6) domain family 2 (RASSF2, Accession NP_055552.1) is another GAM7052 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:9279, to the nucleotide sequence of GAM7052 RNA, herein designated GAM RNA, also designated SEQ ID:296.

Another function of GAM7052 is therefore inhibition of Ras association (ralgds/af-6) domain family 2 (RASSF2, Accession NP_055552.1). Accordingly, utilities of GAM7052 include diagnosis, prevention and treatment of diseases and clinical conditions associated with RASSF2.

Ras association (ralgds/af-6) domain family 2 (RASSF2, Accession NP_739579.1) is another GAM7052 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:9279, to the nucleotide sequence of GAM7052 RNA, herein designated GAM RNA, also designated SEQ ID:296.

Another function of GAM7052 is therefore inhibition of Ras association (ralgds/af-6) domain family 2 (RASSF2, Accession NP_739579.1). Accordingly, utilities of GAM7052 include diagnosis, prevention and treatment of diseases and clinical conditions associated with RASSF2.

Rna binding motif protein 8a (RBM8A, Accession NP_005096.1) is another GAM7052 target gene, herein designated TARGET GENE. RBM8A BINDING SITE is a target binding site found in the 3' untranslated region of mRNA encoded by RBM8A, corresponding to a target binding site such as BINDING SITE I, BINDING SITE II or BINDING SITE III of FIG. 8. Table 4 illustrates the complementarity of the nucleotide sequences of RBM8A BINDING SITE, designated SEQ ID:18273, to the nucleotide sequence of GAM7052 RNA, herein designated GAM RNA, also designated SEQ ID:296.

Another function of GAM7052 is therefore inhibition of Rna binding motif protein 8a (RBM8A, Accession NP_005096.1), a gene which involves in the pathway of gene expression postsplicing nuclear preexport mRNPs, and newly exported cytoplasmic mRNPs. Accordingly, utilities of GAM7052 include diagnosis, prevention and treatment of diseases and clinical conditions associated with RBM8A.

The function of RBM8A and its association with various diseases and clinical conditions, has been established by previous studies, as described hereinabove with reference to GAM47.1. RDH13 (Accession NP_612421.1) is another GAM7052 target gene, herein designated TARGET GENE. RDH13 BINDING SITE is a target binding site found in the 5' untranslated region of mRNA encoded by RDH13, corresponding to a target binding site such as BINDING SITE I, BINDING SITE II or BINDING SITE III of FIG. 8. Table 4 illustrates the complementarity of the nucleotide sequences of RDH13 BINDING SITE, designated SEQ ID:7857, to the nucleotide sequence of GAM7052 RNA, herein designated GAM RNA, also designated SEQ ID:296.

Another function of GAM7052 is therefore inhibition of RDH13 (Accession NP_612421.1). Accordingly, utilities of GAM7052 include diagnosis, prevention and treatment of diseases and clinical conditions associated with RDH13.

Rhesus blood group, d antigen (RHD, Accession NP_057208.2) is another GAM7052 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:8197 and SEQ ID:13068 respectively, to the nucleotide sequence of GAM7052 RNA, herein designated GAM RNA, also designated SEQ ID:296.

Another function of GAM7052 is therefore inhibition of Rhesus blood group, d antigen (RHD, Accession NP_057208.2), a gene which Major antigen of the RH system. Accordingly, utilities of GAM7052 include diagnosis, prevention and treatment of diseases and clinical conditions associated with RHD.

The function of RHD and its association with various diseases and clinical conditions, has been established by previous studies, as described hereinabove with reference to GAM161.1. Rhesus blood group, d antigen (RHD, Accession NP_057309.2) is another GAM7052 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:8197 and SEQ ID:13068 respectively, to the nucleotide sequence of GAM7052 RNA, herein designated GAM RNA, also designated SEQ ID:296.

Another function of GAM7052 is therefore inhibition of Rhesus blood group, d antigen (RHD, Accession NP_057309.2), a gene which Major antigen of the RH system. Accordingly, utilities of GAM7052 include diagnosis, prevention and treatment of diseases and clinical conditions associated with RHD.

The function of RHD and its association with various diseases and clinical conditions, has been established by previous studies, as described hereinabove with reference to GAM161.1. RINZF (Accession NP_076418.2) is another GAM7052 target gene, herein designated TARGET GENE. RINZF BINDING SITE is a target binding site found in the 3' untranslated region of mRNA encoded by RINZF, corresponding to a target binding site such as BINDING SITE I, BINDING SITE II or BINDING SITE III of FIG. 8. Table 4 illustrates the complementarity of the nucleotide sequences of RINZF BINDING SITE, designated SEQ ID:3551, to the nucleotide sequence of GAM7052 RNA, herein designated GAM RNA, also designated SEQ ID:296.

Another function of GAM7052 is therefore inhibition of RINZF (Accession NP_076418.2). Accordingly, utilities of GAM7052 include diagnosis, prevention and treatment of diseases and clinical conditions associated with RINZF.

RNF137 (Accession NP_060543.4) is another GAM7052 target gene, herein designated TARGET GENE. RNF137 BINDING SITE is a target binding site found in the 3' untranslated region of mRNA encoded by RNF137, corresponding to a target binding site such as BINDING SITE I, BINDING SITE II or BINDING SITE III of FIG. 8. Table 4 illustrates the complementarity of the nucleotide sequences of RNF137 BINDING SITE, designated SEQ ID:4953, to the nucleotide sequence of GAM7052 RNA, herein designated GAM RNA, also designated SEQ ID:296.

Another function of GAM7052 is therefore inhibition of RNF137 (Accession NP_060543.4). Accordingly, utilities of GAM7052 include diagnosis, prevention and treatment of diseases and clinical conditions associated with RNF137.

RNF144 (Accession NP_055561.1) is another GAM7052 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:1187, to the nucleotide sequence of GAM7052 RNA, herein designated GAM RNA, also designated SEQ ID:296.

Another function of GAM7052 is therefore inhibition of RNF144 (Accession NP_055561.1). Accordingly, utilities of GAM7052 include diagnosis, prevention and treatment of diseases and clinical conditions associated with RNF144.

Ring finger protein 3 (RNF3, Accession NP_006306.2) is another GAM7052 target gene, herein designated TARGET GENE. RNF3 BINDING SITE is a target binding site found in the 3' untranslated region of multiple transcripts of mRNA encoded by RNF3, corresponding to a target binding site such as BINDING SITE I, BINDING SITE II or BINDING SITE III of FIG. 8. Table 4 illustrates the complementarity of the nucleotide sequences of RNF3 BINDING SITE, designated SEQ ID:6218, to the nucleotide sequence of GAM7052 RNA, herein designated GAM RNA, also designated SEQ ID:296.

Another function of GAM7052 is therefore inhibition of Ring finger protein 3 (RNF3, Accession NP_006306.2), a gene which is a mitogen-activated nuclear kinase involved in signal transduction. Accordingly, utilities of GAM7052 include diagnosis, prevention and treatment of diseases and clinical conditions associated with RNF3.

The function of RNF3 and its association with various diseases and clinical conditions, has been established by previous studies, as described hereinabove with reference to GAM63.1. Retinitis pigmentosa 2 (x-linked recessive) (RP2, Accession NP_008846.1) is another GAM7052 target gene, herein designated TARGET GENE. RP2 BINDING SITE is a target binding site found in the 3' untranslated region of mRNA encoded by RP2, corresponding to a target binding site such as BINDING SITE I, BINDING SITE II or BINDING SITE III of FIG. 8. Table 4 illustrates the complementarity of the nucleotide sequences of RP2 BINDING SITE, designated SEQ ID:10728, to the nucleotide sequence of GAM7052 RNA, herein designated GAM RNA, also designated SEQ ID:296.

Another function of GAM7052 is therefore inhibition of Retinitis pigmentosa 2 (x-linked recessive) (RP2, Accession NP_008846.1). Accordingly, utilities of GAM7052 include diagnosis, prevention and treatment of diseases and clinical conditions associated with RP2.

Rabphilin 3a-like (without c2 domains) (RPH3AL, Accession NP_008918.1) is another GAM7052 target gene, herein designated TARGET GENE. RPH3AL BINDING SITE is a target binding site found in the 3' untranslated region of mRNA encoded by RPH3AL, corresponding to a target binding site such as BINDING SITE I, BINDING SITE II or BINDING SITE III of FIG. 8. Table 4 illustrates the complementarity of the nucleotide sequences of RPH3AL BINDING SITE, designated SEQ ID:2060, to the nucleotide sequence of GAM7052 RNA, herein designated GAM RNA, also designated SEQ ID:296.

Another function of GAM7052 is therefore inhibition of Rabphilin 3a-like (without c2 domains) (RPH3AL, Accession NP_008918.1), a gene which is a protein transporter. could play a role in neurotransmitter release by regulating membrane flow in the nerve terminal. Accordingly, utilities of GAM7052 include diagnosis, prevention and treatment of diseases and clinical conditions associated with RPH3AL.

The function of RPH3AL and its association with various diseases and clinical conditions, has been established by previous studies, as described hereinabove with reference to GAM189.1. RPP30 (Accession NP_006404.1) is another GAM7052 target gene, herein designated TARGET GENE. RPP30 BINDING SITE1 and RPP30 BINDING SITE2 are target binding sites found in untranslated regions of mRNA encoded by RPP30, corresponding to target binding sites such as BINDING SITE I, BINDING SITE II or BINDING SITE III of FIG. 8. Table 4 illustrates the complementarity of the nucleotide sequences of RPP30 BINDING SITE1 and RPP30 BINDING SITE2, designated SEQ ID:14044 and SEQ ID:17179 respectively, to the nucleotide sequence of GAM7052 RNA, herein designated GAM RNA, also designated SEQ ID:296.

Another function of GAM7052 is therefore inhibition of RPP30 (Accession NP_006404.1), a gene which is a component of ribonuclease p that processes 5' ends of precursor tRNAs. Accordingly, utilities of GAM7052 include diagnosis, prevention and treatment of diseases and clinical conditions associated with RPP30.

The function of RPP30 and its association with various diseases and clinical conditions, has been established by previous studies, as described hereinabove with reference to GAM136.1. Sarcoma amplified sequence (SAS, Accession NP_005972.1) is another GAM7052 target gene, herein designated TARGET GENE. SAS BINDING SITE is a target binding site found in the 3' untranslated region of mRNA encoded by SAS, corresponding to a target binding site such as BINDING SITE I, BINDING SITE II or BINDING SITE III of FIG. 8. Table 4 illustrates the complementarity of the nucleotide sequences of SAS BINDING SITE, designated SEQ ID:12782, to the nucleotide sequence of GAM7052 RNA, herein designated GAM RNA, also designated SEQ ID:296.

Another function of GAM7052 is therefore inhibition of Sarcoma amplified sequence (SAS, Accession NP_005972.1), a gene which is a member of the transmembrane 4 superfamily (TM4SF) and may be involved in growth-related cellular processes T. Accordingly, utilities of GAM7052 include diagnosis, prevention and treatment of diseases and clinical conditions associated with SAS.

The function of SAS and its association with various diseases and clinical conditions, has been established by previous studies, as described hereinabove with reference to GAM88.1. Sterol-c4-methyl oxidase-like (SC4MOL, Accession NP_006736.1) is another GAM7052 target gene, herein designated TARGET GENE. SC4MOL BINDING SITE is a target binding site found in the 3' untranslated region of mRNA encoded by SC4MOL, corresponding to a target binding site such as BINDING SITE I, BINDING SITE II or BINDING SITE III of FIG. 8. Table 4 illustrates the complementarity of the nucleotide sequences of SC4MOL BINDING SITE, designated SEQ ID:1187, to the nucleotide sequence of GAM7052 RNA, herein designated GAM RNA, also designated SEQ ID:296.

Another function of GAM7052 is therefore inhibition of Sterol-c4-methyl oxidase-like (SC4MOL, Accession NP_006736.1). Accordingly, utilities of GAM7052 include diagnosis, prevention and treatment of diseases and clinical conditions associated with SC4MOL.

Scan domain containing 2 (SCAND2, Accession NP_071333.2) is another GAM7052 target gene, herein designated TARGET GENE. SCAND2 BINDING SITE is a target binding site found in the 3' untranslated region of multiple transcripts of mRNA encoded by SCAND2, corresponding to a target binding site such as BINDING SITE I, BINDING SITE II or BINDING SITE III of FIG. 8. Table 4 illustrates the complementarity of the nucleotide sequences of SCAND2 BINDING SITE, designated SEQ ID:13669, to the nucleotide sequence of GAM7052 RNA, herein designated GAM RNA, also designated SEQ ID:296.

Another function of GAM7052 is therefore inhibition of Scan domain containing 2 (SCAND2, Accession NP_071333.2). Accordingly, utilities of GAM7052 include diagnosis, prevention and treatment of diseases and clinical conditions associated with SCAND2.

SCN3B (Accession NP_060870.1) is another GAM7052 target gene, herein designated TARGET GENE. SCN3B BINDING SITE is a target binding site found in the 3' untranslated region of mRNA encoded by SCN3B, corresponding to a target binding site such as BINDING SITE I, BINDING SITE II or BINDING SITE III of FIG. 8. Table 4 illustrates the complementarity of the nucleotide sequences of SCN3B BINDING SITE, designated SEQ ID:6424, to the nucleotide sequence of GAM7052 RNA, herein designated GAM RNA, also designated SEQ ID:296.

Another function of GAM7052 is therefore inhibition of SCN3B (Accession NP_060870.1). Accordingly, utilities of GAM7052 include diagnosis, prevention and treatment of diseases and clinical conditions associated with SCN3B.

SDS-RS1 (Accession NP_612441.1) is another GAM7052 target gene, herein designated TARGET GENE. SDS-RS1 BINDING SITE is a target binding site found in the 5' untranslated region of mRNA encoded by SDS-RS1, corresponding to a target binding site such as BINDING SITE I, BINDING SITE II or BINDING SITE III of FIG. 8. Table 4 illustrates the complementarity of the nucleotide sequences of SDS-RS1 BINDING SITE, designated SEQ ID:12439, to the nucleotide sequence of GAM7052 RNA, herein designated GAM RNA, also designated SEQ ID:296.

Another function of GAM7052 is therefore inhibition of SDS-RS1 (Accession NP_612441.1). Accordingly, utilities of GAM7052 include diagnosis, prevention and treatment of diseases and clinical conditions associated with SDS-RS1.

Spondyloepiphyseal dysplasia, late (SEDL, Accession NP_055378.1) is another GAM7052 target gene, herein designated TARGET GENE. SEDL BINDING SITE is a target binding site found in the 3' untranslated region of mRNA encoded by SEDL, corresponding to a target binding site such as BINDING SITE I, BINDING SITE II or BINDING SITE III of FIG. 8. Table 4 illustrates the complementarity of the nucleotide sequences of SEDL BINDING SITE, designated SEQ ID:16885, to the nucleotide sequence of GAM7052 RNA, herein designated GAM RNA, also designated SEQ ID:296.

Another function of GAM7052 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM7052 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. Sema domain, immunoglobulin domain (ig), transmembrane domain (tm) and short cytoplasmic domain, (semaphorin) 4g (SEMA4G, Accession NP_060363.2) is another GAM7052 target gene, herein designated TARGET GENE. SEMA4G BINDING SITE is a target binding site found in the 5' untranslated region of mRNA encoded by SEMA4G, corresponding to a target binding site such as BINDING SITE I, BINDING SITE II or BINDING SITE III of FIG. 8. Table 4 illustrates the complementarity of the nucleotide sequences of SEMA4G BINDING SITE, designated SEQ ID:6560, to the nucleotide sequence of GAM7052 RNA, herein designated GAM RNA, also designated SEQ ID:296.

Another function of GAM7052 is therefore inhibition of Sema domain, immunoglobulin domain (ig), transmembrane domain (tm) and short cytoplasmic domain, (semaphorin) 4g (SEMA4G, Accession NP_060363.2). Accordingly, utilities of GAM7052 include diagnosis, prevention and treatment of diseases and clinical conditions associated with SEMA4G.

Selenoprotein n, 1 (SEPN1, Accession NP_065184.1) is another GAM7052 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:16360, to the nucleotide sequence of GAM7052 RNA, herein designated GAM RNA, also designated SEQ ID:296.

Another function of GAM7052 is therefore inhibition of Selenoprotein n, 1 (SEPN1, Accession NP_065184.1). Accordingly, utilities of GAM7052 include diagnosis, prevention and treatment of diseases and clinical conditions associated with SEPN1.

Small edrk-rich factor 1a (telomeric) (SERF1A, Accession NP_068802.1) is another GAM7052 target gene, herein designated TARGET GENE. SERF1A BINDING SITE1 and SERF1A BINDING SITE2 are target binding sites found in untranslated regions of mRNA encoded by SERF1A, corresponding to target binding sites such as BINDING SITE I, BINDING SITE II or BINDING SITE III of FIG. 8. Table 4 illustrates the complementarity of the nucleotide sequences of SERF1A BINDING SITE1 and SERF1A BINDING SITE2, designated SEQ ID:12128 and SEQ ID:13493 respectively, to the nucleotide sequence of GAM7052 RNA, herein designated GAM RNA, also designated SEQ ID:296.

Another function of GAM7052 is therefore inhibition of Small edrk-rich factor 1a (telomeric) (SERF1A, Accession NP_068802.1). Accordingly, utilities of GAM7052 include diagnosis, prevention and treatment of diseases and clinical conditions associated with SERF1A.

Small edrk-rich factor 1b (centromeric) (SERF1B, Accession NP_075267.1) is another GAM7052 target gene, herein designated TARGET GENE. SERF1B BINDING SITE1 and SERF1B BINDING SITE2 are target binding sites found in untranslated regions of mRNA encoded by SERF1B, corresponding to target binding sites such as BINDING SITE I, BINDING SITE II or BINDING SITE III of FIG. 8. Table 4 illustrates the complementarity of the nucleotide sequences of SERF1B BINDING SITE1 and SERF1B BINDING SITE2, designated SEQ ID:13493 and SEQ ID:12128 respectively, to the nucleotide sequence of GAM7052 RNA, herein designated GAM RNA, also designated SEQ ID:296.

Another function of GAM7052 is therefore inhibition of Small edrk-rich factor 1b (centromeric) (SERF1B, Accession NP_075267.1). Accordingly, utilities of GAM7052 include diagnosis, prevention and treatment of diseases and clinical conditions associated with SERF1B.

Splicing factor 3a, subunit 3, 60 kda (SF3A3, Accession NP_006793.1) is another GAM7052 target gene, herein designated TARGET GENE. SF3A3 BINDING SITE is a target binding site found in the 3' untranslated region of mRNA encoded by SF3A3, corresponding to a target binding site such as BINDING SITE I, BINDING SITE II or BINDING SITE III of FIG. 8. Table 4 illustrates the complementarity of the nucleotide sequences of SF3A3 BINDING SITE, designated SEQ ID:5836, to the nucleotide sequence of GAM7052 RNA, herein designated GAM RNA, also designated SEQ ID:296.

Another function of GAM7052 is therefore inhibition of Splicing factor 3a, subunit 3, 60 kda (SF3A3, Accession NP_006793.1). Accordingly, utilities of GAM7052 include diagnosis, prevention and treatment of diseases and clinical conditions associated with SF3A3.

Sideroflexin 2 (SFXN2, Accession NP_849189.1) is another GAM7052 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:16442, to the nucleotide sequence of GAM7052 RNA, herein designated GAM RNA, also designated SEQ ID:296.

Another function of GAM7052 is therefore inhibition of Sideroflexin 2 (SFXN2, Accession NP_849189.1). Accordingly, utilities of GAM7052 include diagnosis, prevention and treatment of diseases and clinical conditions associated with SFXN2.

Sideroflexin 2 (SFXN2, Accession XP_058359.2) is another GAM7052 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:16442, to the nucleotide sequence of GAM7052 RNA, herein designated GAM RNA, also designated SEQ ID:296.

Another function of GAM7052 is therefore inhibition of Sideroflexin 2 (SFXN2, Accession XP_058359.2). Accordingly, utilities of GAM7052 include diagnosis, prevention and treatment of diseases and clinical conditions associated with SFXN2.

Shc (src homology 2 domain containing) transforming protein 1 (SHC1, Accession NP_003020.1) is another GAM7052 target gene, herein designated TARGET GENE. SHC1 BINDING SITE is a target binding site found in the 3' untranslated region of mRNA encoded by SHC1, corresponding to a target binding site such as BINDING SITE I, BINDING SITE II or BINDING SITE III of FIG. 8. Table 4 illustrates the complementarity of the nucleotide sequences of SHC1 BINDING SITE, designated SEQ ID:15883, to the nucleotide sequence of GAM7052 RNA, herein designated GAM RNA, also designated SEQ ID:296.

Another function of GAM7052 is therefore inhibition of Shc (src homology 2 domain containing) transforming protein 1 (SHC1, Accession NP_003020.1), a gene which couples activated growth factor receptors to a signaling pathway. Accordingly, utilities of GAM7052 include diagnosis, prevention and treatment of diseases and clinical conditions associated with SHC1.

The function of SHC1 and its association with various diseases and clinical conditions, has been established by previous studies, as described hereinabove with reference to GAM868.1. Short stature homeobox (SHOX, Accession NP_006874.1) is another GAM7052 target gene, herein designated TARGET GENE. SHOX BINDING SITE1 and SHOX BINDING SITE2 are target binding sites found in untranslated regions of multiple transcripts of mRNA encoded by SHOX, corresponding to target binding sites such as BINDING SITE I, BINDING SITE II or BINDING SITE III of FIG. 8. Table 4 illustrates the complementarity of the nucleotide sequences of SHOX BINDING SITE1 and SHOX BINDING SITE2, designated SEQ ID:8761 and SEQ ID:2823 respectively, to the nucleotide sequence of GAM7052 RNA, herein designated GAM RNA, also designated SEQ ID:296.

Another function of GAM7052 is therefore inhibition of Short stature homeobox (SHOX, Accession NP_006874.1). Accordingly, utilities of GAM7052 include diagnosis, prevention and treatment of diseases and clinical conditions associated with SHOX.

Signal-regulatory protein beta 1 (SIRPB1, Accession NP_006056.1) is another GAM7052 target gene, herein designated TARGET GENE. SIRPB1 BINDING SITE is a target binding site found in the 3' untranslated region of mRNA encoded by SIRPB1, corresponding to a target binding site such as BINDING SITE I, BINDING SITE II or BINDING SITE III of FIG. 8. Table 4 illustrates the complementarity of the nucleotide sequences of SIRPB1 BINDING SITE, designated SEQ ID:16887, to the nucleotide sequence of GAM7052 RNA, herein designated GAM RNA, also designated SEQ ID:296.

Another function of GAM7052 is therefore inhibition of Signal-regulatory protein beta 1 (SIRPB1, Accession NP_006056.1). Accordingly, utilities of GAM7052 include diagnosis, prevention and treatment of diseases and clinical conditions associated with SIRPB1.

Solute carrier family 12 (potassium/chloride transporters), member 8 (SLC12A8, Accession NP_078904.1) is another GAM7052 target gene, herein designated TARGET GENE. SLC12A8 BINDING SITE is a target binding site found in the 3' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:17034, to the nucleotide sequence of GAM7052 RNA, herein designated GAM RNA, also designated SEQ ID:296.

Another function of GAM7052 is therefore inhibition of Solute carrier family 12 (potassium/chloride transporters), member 8 (SLC12A8, Accession NP_078904.1). Accordingly, utilities of GAM7052 include diagnosis, prevention and treatment of diseases and clinical conditions associated with SLC12A8.

Solute carrier family 15 (oligopeptide transporter), member 1 (SLC15A1, Accession NP_005064.1) is another GAM7052 target gene, herein designated TARGET GENE. SLC15A1 BINDING SITE1 and SLC15A1 BINDING SITE2 are target binding sites found in untranslated regions of mRNA encoded by SLC15A1, corresponding to target binding sites such as BINDING SITE I, BINDING SITE II or BINDING SITE III of FIG. 8. Table 4 illustrates the complementarity of the nucleotide sequences of SLC15A1 BINDING SITE1 and SLC15A1 BINDING SITE2, designated SEQ ID:15654 and SEQ ID:12924 respectively, to the nucleotide sequence of GAM7052 RNA, herein designated GAM RNA, also designated SEQ ID:296.

Another function of GAM7052 is therefore inhibition of Solute carrier family 15 (oligopeptide transporter), member 1 (SLC15A1, Accession NP_005064.1), a gene which is a H(+)-coupled peptide transporter. Accordingly, utilities of GAM7052 include diagnosis, prevention and treatment of diseases and clinical conditions associated with SLC15A1.

The function of SLC15A1 and its association with various diseases and clinical conditions, has been established by previous studies, as described hereinabove with reference to GAM30.1. Solute carrier family 19, member 3 (SLC19A3, Accession NP_079519.1) is another GAM7052 target gene, herein designated TARGET GENE. SLC19A3 BINDING SITE is a target binding site found in the 3' untranslated region of mRNA encoded by SLC19A3, corresponding to a target binding site such as BINDING SITE I, BINDING SITE II or BINDING SITE III of FIG. 8. Table 4 illustrates the complementarity of the nucleotide sequences of SLC19A3 BINDING SITE, designated SEQ ID:1083, to the nucleotide sequence of GAM7052 RNA, herein designated GAM RNA, also designated SEQ ID:296.

Another function of GAM7052 is therefore inhibition of Solute carrier family 19, member 3 (SLC19A3, Accession NP_079519.1). Accordingly, utilities of GAM7052 include diagnosis, prevention and treatment of diseases and clinical conditions associated with SLC19A3.

Solute carrier family 2 (facilitated glucose transporter), member 10 (SLC2A10, Accession NP_110404.1) is another GAM7052 target gene, herein designated TARGET GENE. SLC2A10 BINDING SITE is a target binding site found in the 3' untranslated region of mRNA encoded by SLC2A10, corresponding to a target binding site such as BINDING SITE I, BINDING SITE II or BINDING SITE III of FIG. 8. Table 4 illustrates the complementarity of the nucleotide sequences of SLC2A10 BINDING SITE, designated SEQ ID:17326, to the nucleotide sequence of GAM7052 RNA, herein designated GAM RNA, also designated SEQ ID:296.

Another function of GAM7052 is therefore inhibition of Solute carrier family 2 (facilitated glucose transporter), member 10 (SLC2A10, Accession NP_110404.1). Accordingly, utilities of GAM7052 include diagnosis, prevention and treatment of diseases and clinical conditions associated with SLC2A10.

SLC30A5 (Accession NP_076960.1) is another GAM7052 target gene, herein designated TARGET GENE. SLC30A5 BINDING SITE is a target binding site found in the 3' untranslated region of multiple transcripts of mRNA encoded by SLC30A5, corresponding to a target binding site such as BINDING SITE I, BINDING SITE II or BINDING SITE III of FIG. 8. Table 4 illustrates the complementarity of the nucleotide sequences of SLC30A5 BINDING SITE, designated SEQ ID:5862, to the nucleotide sequence of GAM7052 RNA, herein designated GAM RNA, also designated SEQ ID:296.

Another function of GAM7052 is therefore inhibition of SLC30A5 (Accession NP_076960.1). Accordingly, utilities of GAM7052 include diagnosis, prevention and treatment of diseases and clinical conditions associated with SLC30A5.

SLC30A6 (Accession NP_060434.2) is another GAM7052 target gene, herein designated TARGET GENE. SLC30A6 BINDING SITE1 and SLC30A6 BINDING SITE2 are target binding sites found in untranslated regions of mRNA encoded by SLC30A6, corresponding to target binding sites such as BINDING SITE I, BINDING SITE II or BINDING SITE III of FIG. 8. Table 4 illustrates the complementarity of the nucleotide sequences of SLC30A6 BINDING SITE1 and SLC30A6 BINDING SITE2, designated SEQ ID:15429 and SEQ ID:8012 respectively, to the nucleotide sequence of GAM7052 RNA, herein designated GAM RNA, also designated SEQ ID:296.

Another function of GAM7052 is therefore inhibition of SLC30A6 (Accession NP_060434.2). Accordingly, utilities of GAM7052 include diagnosis, prevention and treatment of diseases and clinical conditions associated with SLC30A6.

Solute carrier family 6 (neurotransmitter transporter), member 14 (SLC6A14, Accession NP_009162.1) is another GAM7052 target gene, herein designated TARGET GENE. SLC6A14 BINDING SITE is a target binding site found in the 3' untranslated region of mRNA encoded by SLC6A14, corresponding to a target binding site such as BINDING SITE I, BINDING SITE II or BINDING SITE III of FIG. 8. Table 4 illustrates the complementarity of the nucleotide sequences of SLC6A14 BINDING SITE, designated SEQ ID:15390, to the nucleotide sequence of GAM7052 RNA, herein designated GAM RNA, also designated SEQ ID:296.

Another function of GAM7052 is therefore inhibition of Solute carrier family 6 (neurotransmitter transporter), member 14 (SLC6A14, Accession NP_009162.1). Accordingly, utilities of GAM7052 include diagnosis, prevention and treatment of diseases and clinical conditions associated with SLC6A14.

Solute carrier family 9 (sodium/hydrogen exchanger), isoform 5 (SLC9A5, Accession NP_004585.1) is another GAM7052 target gene, herein designated TARGET GENE. SLC9A5 BINDING SITE is a target binding site found in the 3' untranslated region of mRNA encoded by SLC9A5, corresponding to a target binding site such as BINDING SITE I, BINDING SITE II or BINDING SITE III of FIG. 8. Table 4 illustrates the complementarity of the nucleotide sequences of SLC9A5 BINDING SITE, designated SEQ ID:2167, to the nucleotide sequence of GAM7052 RNA, herein designated GAM RNA, also designated SEQ ID:296.

Another function of GAM7052 is therefore inhibition of Solute carrier family 9 (sodium/hydrogen exchanger), isoform 5 (SLC9A5, Accession NP_004585.1). Accordingly, utilities of GAM7052 include diagnosis, prevention and treatment of diseases and clinical conditions associated with SLC9A5.

SMAC (Accession NP_620308.1) is another GAM7052 target gene, herein designated TARGET GENE. SMAC BINDING SITE1 and SMAC BINDING SITE2 are target binding sites found in untranslated regions of multiple transcripts of mRNA encoded by SMAC, corresponding to target binding sites such as BINDING SITE I, BINDING SITE II or BINDING SITE III of FIG. 8. Table 4 illustrates the complementarity of the nucleotide sequences of SMAC BINDING SITE1 and SMAC BINDING SITE2, designated SEQ ID:11548 and SEQ ID:2683 respectively, to the nucleotide sequence of GAM7052 RNA, herein designated GAM RNA, also designated SEQ ID:296.

Another function of GAM7052 is therefore inhibition of SMAC (Accession NP_620308.1), a gene which promotes apoptosis via caspase activation. Accordingly, utilities of GAM7052 include diagnosis, prevention and treatment of diseases and clinical conditions associated with SMAC.

The function of SMAC and its association with various diseases and clinical conditions, has been established by previous studies, as described hereinabove with reference to GAM136.1. Synaptosomal-associated protein, 23 kda (SNAP23, Accession NP_003816.2) is another GAM7052 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:9468, to the nucleotide sequence of GAM7052 RNA, herein designated GAM RNA, also designated SEQ ID:296.

Another function of GAM7052 is therefore inhibition of Synaptosomal-associated protein, 23 kda (SNAP23, Accession NP_003816.2), a gene which is essential component of the high affinity receptor for the general membrane fusion machinery. Accordingly, utilities of GAM7052 include diagnosis, prevention and treatment of diseases and clinical conditions associated with SNAP23.

The function of SNAP23 and its association with various diseases and clinical conditions, has been established by previous studies, as described hereinabove with reference to GAM30.1. Synaptosomal-associated protein, 23 kda (SNAP23, Accession NP_570710.1) is another GAM7052 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:9468, to the nucleotide sequence of GAM7052 RNA, herein designated GAM RNA, also designated SEQ ID:296.

Another function of GAM7052 is therefore inhibition of Synaptosomal-associated protein, 23 kda (SNAP23, Accession NP_570710.1), a gene which is essential component of the high affinity receptor for the general membrane fusion machinery. Accordingly, utilities of GAM7052 include diagnosis, prevention and treatment of diseases and clinical conditions associated with SNAP23.

The function of SNAP23 and its association with various diseases and clinical conditions, has been established by previous studies, as described hereinabove with reference to GAM30.1. SNARK (Accession NP_112214.1) is another GAM7052 target gene, herein designated TARGET GENE. SNARK BINDING SITE is a target binding site found in the 3' untranslated region of mRNA encoded by SNARK, corresponding to a target binding site such as BINDING SITE I, BINDING SITE II or BINDING SITE III of FIG. 8. Table 4 illustrates the complementarity of the nucleotide sequences of SNARK BINDING SITE, designated SEQ ID:1482, to the nucleotide sequence of GAM7052 RNA, herein designated GAM RNA, also designated SEQ ID:296.

Another function of GAM7052 is therefore inhibition of SNARK (Accession NP_112214.1). Accordingly, utilities of GAM7052 include diagnosis, prevention and treatment of diseases and clinical conditions associated with SNARK.

SNX22 (Accession NP_079074.1) is another GAM7052 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:3382, to the nucleotide sequence of GAM7052 RNA, herein designated GAM RNA, also designated SEQ ID:296.

Another function of GAM7052 is therefore inhibition of SNX22 (Accession NP_079074.1). Accordingly, utilities of GAM7052 include diagnosis, prevention and treatment of diseases and clinical conditions associated with SNX22.

SNX27 (Accession NP_112180.4) is another GAM7052 target gene, herein designated TARGET GENE. SNX27 BINDING SITE1 and SNX27 BINDING SITE2 are target binding sites found in untranslated regions of mRNA encoded by SNX27, corresponding to target binding sites such as BINDING SITE I, BINDING SITE II or BINDING SITE III of FIG. 8. Table 4 illustrates the complementarity of the nucleotide sequences of SNX27 BINDING SITE1 and SNX27 BINDING SITE2, designated SEQ ID:2903 and SEQ ID:4461 respectively, to the nucleotide sequence of GAM7052 RNA, herein designated GAM RNA, also designated SEQ ID:296.

Another function of GAM7052 is therefore inhibition of SNX27 (Accession NP_112180.4). Accordingly, utilities of GAM7052 include diagnosis, prevention and treatment of diseases and clinical conditions associated with SNX27.

Speckle-type poz protein (SPOP, Accession NP_003554.1) is another GAM7052 target gene, herein designated TARGET GENE. SPOP BINDING SITE is a target binding site found in the 5' untranslated region of mRNA encoded by SPOP, corresponding to a target binding site such as BINDING SITE I, BINDING SITE II or BINDING SITE III of FIG. 8. Table 4 illustrates the complementarity of the nucleotide sequences of SPOP BINDING SITE, designated SEQ ID:6561, to the nucleotide sequence of GAM7052 RNA, herein designated GAM RNA, also designated SEQ ID:296.

Another function of GAM7052 is therefore inhibition of Speckle-type poz protein (SPOP, Accession NP_003554.1). Accordingly, utilities of GAM7052 include diagnosis, prevention and treatment of diseases and clinical conditions associated with SPOP.

Serum response factor (c-fos serum response element-binding transcription factor) (SRF, Accession NP_003122.1) is another GAM7052 target gene, herein designated TARGET GENE. SRF BINDING SITE1 and SRF BINDING SITE2 are target binding sites found in untranslated regions of mRNA encoded by SRF, corresponding to target binding sites such as BINDING SITE I, BINDING SITE II or BINDING SITE III of FIG. 8. Table 4 illustrates the complementarity of the nucleotide sequences of SRF BINDING SITE1 and SRF BINDING SITE2, designated SEQ ID:2413 and SEQ ID:1206 respectively, to the nucleotide sequence of GAM7052 RNA, herein designated GAM RNA, also designated SEQ ID:296.

Another function of GAM7052 is therefore inhibition of Serum response factor (c-fos serum response element-binding transcription factor) (SRF, Accession NP_003122.1). Accordingly, utilities of GAM7052 include diagnosis, prevention and treatment of diseases and clinical conditions associated with SRF.

Sarcalumenin (SRL, Accession XP_064152.3) is another GAM7052 target gene, herein designated TARGET GENE. SRL BINDING SITE is a target binding site found in the 3' untranslated region of mRNA encoded by SRL, corresponding to a target binding site such as BINDING SITE I, BINDING SITE II or BINDING SITE III of FIG. 8. Table 4 illustrates the complementarity of the nucleotide sequences of SRL BINDING SITE, designated SEQ ID:17636, to the nucleotide sequence of GAM7052 RNA, herein designated GAM RNA, also designated SEQ ID:296.

Another function of GAM7052 is therefore inhibition of Sarcalumenin (SRL, Accession XP_064152.3). Accordingly, utilities of GAM7052 include diagnosis, prevention and treatment of diseases and clinical conditions associated with SRL.

STAF65(gamma) (Accession NP_055675.1) is another GAM7052 target gene, herein designated TARGET GENE. STAF65(gamma) BINDING SITE is a target binding site found in the 3' untranslated region of mRNA encoded by STAF65(gamma), corresponding to a target binding site such as BINDING SITE I, BINDING SITE II or BINDING SITE III of FIG. 8. Table 4 illustrates the complementarity of the nucleotide sequences of STAF65(gamma) BINDING SITE, designated SEQ ID:4663, to the nucleotide sequence of GAM7052 RNA, herein designated GAM RNA, also designated SEQ ID:296.

Another function of GAM7052 is therefore inhibition of STAF65(gamma) (Accession NP_055675.1). Accordingly, utilities of GAM7052 include diagnosis, prevention and treatment of diseases and clinical conditions associated with STAF65(gamma).

Stomatin (STOM, Accession NP_004090.3) is another GAM7052 target gene, herein designated TARGET GENE. STOM BINDING SITE is a target binding site found in the 3' untranslated region of mRNA encoded by STOM, corresponding to a target binding site such as BINDING SITE I, BINDING SITE II or BINDING SITE III of FIG. 8. Table 4 illustrates the complementarity of the nucleotide sequences of STOM BINDING SITE, designated SEQ ID:18019, to the nucleotide sequence of GAM7052 RNA, herein designated GAM RNA, also designated SEQ ID:296.

Another function of GAM7052 is therefore inhibition of Stomatin (STOM, Accession NP_004090.3). Accordingly, utilities of GAM7052 include diagnosis, prevention and treatment of diseases and clinical conditions associated with STOM.

Synaptotagmin xi (SYT11, Accession NP_689493.2) is another GAM7052 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:1187, to the nucleotide sequence of GAM7052 RNA, herein designated GAM RNA, also designated SEQ ID:296.

Another function of GAM7052 is therefore inhibition of Synaptotagmin xi (SYT11, Accession NP_689493.2). Accordingly, utilities of GAM7052 include diagnosis, prevention and treatment of diseases and clinical conditions associated with SYT11.

Synaptotagmin xiii (SYT13, Accession NP_065877.1) is another GAM7052 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:12639, to the nucleotide sequence of GAM7052 RNA, herein designated GAM RNA, also designated SEQ ID:296.

Another function of GAM7052 is therefore inhibition of Synaptotagmin xiii (SYT13, Accession NP_065877.1). Accordingly, utilities of GAM7052 include diagnosis, prevention and treatment of diseases and clinical conditions associated with SYT13.

Taf7-like rna polymerase ii, tata box binding protein (tbp)-associated factor, 50 kda (TAF7L, Accession NP_079161.1) is another GAM7052 target gene, herein designated TARGET GENE. TAF7L BINDING SITE is a target binding site found in the 3' untranslated region of mRNA encoded by TAF7L, corresponding to a target binding site such as BINDING SITE I, BINDING SITE II or BINDING SITE III of FIG. 8. Table 4 illustrates the complementarity of the nucleotide sequences of TAF7L BINDING SITE, designated SEQ ID:5620, to the nucleotide sequence of GAM7052 RNA, herein designated GAM RNA, also designated SEQ ID:296.

Another function of GAM7052 is therefore inhibition of Taf7-like rna polymerase ii, tata box binding protein (tbp)-associated factor, 50 kda (TAF7L, Accession NP_079161.1). Accordingly, utilities of GAM7052 include diagnosis, prevention and treatment of diseases and clinical conditions associated with TAF7L.

Tap binding protein (tapasin) (TAPBP, Accession NP_003181.3) is another GAM7052 target gene, herein designated TARGET GENE. TAPBP BINDING SITE is a target binding site found in the 3' untranslated region of multiple transcripts of mRNA encoded by TAPBP, corresponding to a target binding site such as BINDING SITE I, BINDING SITE II or BINDING SITE III of FIG. 8. Table 4 illustrates the complementarity of the nucleotide sequences of TAPBP BINDING SITE, designated SEQ ID:2176, to the nucleotide sequence of GAM7052 RNA, herein designated GAM RNA, also designated SEQ ID:296.

Another function of GAM7052 is therefore inhibition of Tap binding protein (tapasin) (TAPBP, Accession NP_003181.3), a gene which is involved in MHC class I-restricted antigen processing. Accordingly, utilities of GAM7052 include diagnosis, prevention and treatment of diseases and clinical conditions associated with TAPBP.

The function of TAPBP and its association with various diseases and clinical conditions, has been established by previous studies, as described hereinabove with reference to GAM136.1. T-box 5 (TBX5, Accession NP_542448.1) is another GAM7052 target gene, herein designated TARGET GENE. TBX5 BINDING SITE is a target binding site found in the 5' untranslated region of multiple transcripts of mRNA encoded by TBX5, corresponding to a target binding site such as BINDING SITE I, BINDING SITE II or BINDING SITE III of FIG. 8. Table 4 illustrates the complementarity of the nucleotide sequences of TBX5 BINDING SITE, designated SEQ ID:11145, to the nucleotide sequence of GAM7052 RNA, herein designated GAM RNA, also designated SEQ ID:296.

Another function of GAM7052 is therefore inhibition of T-box 5 (TBX5, Accession NP_542448.1). Accordingly, utilities of GAM7052 include diagnosis, prevention and treatment of diseases and clinical conditions associated with TBX5.

T-box 5 (TBX5, Accession NP_000183.2) is another GAM7052 target gene, herein designated TARGET GENE. TBX5 BINDING SITE is a target binding site found in the 5' untranslated region of multiple transcripts of mRNA encoded by TBX5, corresponding to a target binding site such as BINDING SITE I, BINDING SITE II or BINDING SITE III of FIG. 8. Table 4 illustrates the complementarity of the nucleotide sequences of TBX5 BINDING SITE, designated SEQ ID:11145, to the nucleotide sequence of GAM7052 RNA, herein designated GAM RNA, also designated SEQ ID:296.

Another function of GAM7052 is therefore inhibition of T-box 5 (TBX5, Accession NP_000183.2). Accordingly, utilities of GAM7052 include diagnosis, prevention and treatment of diseases and clinical conditions associated with TBX5.

T-cell leukemia/lymphoma 6 (TCL6, Accession NP_055233.1) is another GAM7052 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:3638, to the nucleotide sequence of GAM7052 RNA, herein designated GAM RNA, also designated SEQ ID:296.

Another function of GAM7052 is therefore inhibition of T-cell leukemia/lymphoma 6 (TCL6, Accession NP_055233.1). Accordingly, utilities of GAM7052 include diagnosis, prevention and treatment of diseases and clinical conditions associated with TCL6.

T-cell leukemia/lymphoma 6 (TCL6, Accession NP_065575.1) is another GAM7052 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:3638, to the nucleotide sequence of GAM7052 RNA, herein designated GAM RNA, also designated SEQ ID:296.

Another function of GAM7052 is therefore inhibition of T-cell leukemia/lymphoma 6 (TCL6, Accession NP_065575.1). Accordingly, utilities of GAM7052 include diagnosis, prevention and treatment of diseases and clinical conditions associated with TCL6.

T-cell leukemia/lymphoma 6 (TCL6, Accession NP_036600.2) is another GAM7052 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:3638, to the nucleotide sequence of GAM7052 RNA, herein designated GAM RNA, also designated SEQ ID:296.

Another function of GAM7052 is therefore inhibition of T-cell leukemia/lymphoma 6 (TCL6, Accession NP_036600.2). Accordingly, utilities of GAM7052 include diagnosis, prevention and treatment of diseases and clinical conditions associated with TCL6.

T-cell leukemia/lymphoma 6 (TCL6, Accession NP_065577.2) is another GAM7052 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:3638, to the nucleotide sequence of GAM7052 RNA, herein designated GAM RNA, also designated SEQ ID:296.

Another function of GAM7052 is therefore inhibition of T-cell leukemia/lymphoma 6 (TCL6, Accession NP_065577.2). Accordingly, utilities of GAM7052 include diagnosis, prevention and treatment of diseases and clinical conditions associated with TCL6.

Telomeric repeat binding factor (nima-interacting) 1 (TERF1, Accession NP_003209.1) is another GAM7052 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:18226, to the nucleotide sequence of GAM7052 RNA, herein designated GAM RNA, also designated SEQ ID:296.

Another function of GAM7052 is therefore inhibition of Telomeric repeat binding factor (nima-interacting) 1 (TERF1, Accession NP_003209.1), a gene which negatively regulates telomere length, involves in regulation of the mitotic spindle. Accordingly, utilities of GAM7052 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor (nima-interacting) 1 (TERF1, Accession NP_059523.1) is another GAM7052 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:18226, to the nucleotide sequence of GAM7052 RNA, herein designated GAM RNA, also designated SEQ ID:296.

Another function of GAM7052 is therefore inhibition of Telomeric repeat binding factor (nima-interacting) 1 (TERF1, Accession NP_059523.1), a gene which negatively regulates telomere length, involves in regulation of the mitotic spindle. Accordingly, utilities of GAM7052 include diagnosis, prevention and treatment of diseases and clinical conditions associated with TERF1.

The function of TERF1 and its association with various diseases and clinical conditions, has been established by previous studies, as described hereinabove with reference to GAM189.1. Tgfb-induced factor 2 (tale family homeobox) (TGIF2, Accession NP_068581.1) is another GAM7052 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:8013, to the nucleotide sequence of GAM7052 RNA, herein designated GAM RNA, also designated SEQ ID:296.

Another function of GAM7052 is therefore inhibition of Tgfb-induced factor 2 (tale family homeobox) (TGIF2, Accession NP_068581.1). Accordingly, utilities of GAM7052 include diagnosis, prevention and treatment of diseases and clinical conditions associated with TGIF2.

Thyroid hormone receptor, alpha (erythroblastic leukemia viral (v-erb-a) oncogene homolog, avian) (THRA, Accession NP_003241.2) is another GAM7052 target gene, herein designated TARGET GENE. THRA BINDING SITE is a target binding site found in the 3' untranslated region of mRNA encoded by THRA, corresponding to a target binding site such as BINDING SITE I, BINDING SITE II or BINDING SITE III of FIG. 8. Table 4 illustrates the complementarity of the nucleotide sequences of THRA BINDING SITE, designated SEQ ID:4481, to the nucleotide sequence of GAM7052 RNA, herein designated GAM RNA, also designated SEQ ID:296.

Another function of GAM7052 is therefore inhibition of Thyroid hormone receptor, alpha (erythroblastic leukemia viral (v-erb-a) oncogene homolog, avian) (THRA, Accession NP_003241.2), a gene which is a high affinity receptor for thyroid hormone and therefore may be associated with Nonfunctioning pituitary adenoma. Accordingly, utilities of GAM7052 include diagnosis, prevention and treatment of Nonfunctioning pituitary adenoma, and of other diseases and clinical conditions associated with THRA.

The function of THRA and its association with various diseases and clinical conditions, has been established by previous studies, as described hereinabove with reference to GAM31.1. Toll-like receptor 5 (TLR5, Accession NP_003259.2) is another GAM7052 target gene, herein designated TARGET GENE. TLR5 BINDING SITE is a target binding site found in the 5' untranslated region of mRNA encoded by TLR5, corresponding to a target binding site such as BINDING SITE I, BINDING SITE II or BINDING SITE III of FIG. 8. Table 4 illustrates the complementarity of the nucleotide sequences of TLR5 BINDING SITE, designated SEQ ID:8290, to the nucleotide sequence of GAM7052 RNA, herein designated GAM RNA, also designated SEQ ID:296.

Another function of GAM7052 is therefore inhibition of Toll-like receptor 5 (TLR5, Accession NP_003259.2), a gene which participates in the innate immune response to bacterial flagellins. Accordingly, utilities of GAM7052 include diagnosis, prevention and treatment of diseases and clinical conditions associated with TLR5.

The function of TLR5 and its association with various diseases and clinical conditions, has been established by previous studies, as described hereinabove with reference to GAM40.1. Transmembrane, cochlear expressed, 1 (TMC1, Accession NP_619636.2) is another GAM7052 target gene, herein designated TARGET GENE. TMC1 BINDING SITE is a target binding site found in the 5' untranslated region of mRNA encoded by TMC1, corresponding to a target binding site such as BINDING SITE I, BINDING SITE II or BINDING SITE III of FIG. 8. Table 4 illustrates the complementarity of the nucleotide sequences of TMC1 BINDING SITE, designated SEQ ID:13103, to the nucleotide sequence of GAM7052 RNA, herein designated GAM RNA, also designated SEQ ID:296.

Another function of GAM7052 is therefore inhibition of Transmembrane, cochlear expressed, 1 (TMC1, Accession NP_619636.2), a gene which is required for normal function of cochlear hair cells and therefore may be associated with Autosomal recessive nonsyndromic neurosensory deafness and autosomal dominant nonsyndromic sensorineural hearing loss. Accordingly, utilities of GAM7052 include diagnosis, prevention and treatment of Autosomal recessive nonsyndromic neurosensory deafness and autosomal dominant nonsyndromic sensorineural hearing loss ., and of other diseases and clinical conditions associated with TMC1.

The function of TMC1 and its association with various diseases and clinical conditions, has been established by previous studies, as described hereinabove with reference to GAM136.1. Tumor necrosis factor, alpha-induced protein 2 (TNFAIP2, Accession NP_006282.2) is another GAM7052 target gene, herein designated TARGET GENE. TNFAIP2 BINDING SITE is a target binding site found in the 3' untranslated region of mRNA encoded by TNFAIP2, corresponding to a target binding site such as BINDING SITE I, BINDING SITE II or BINDING SITE III of FIG. 8. Table 4 illustrates the complementarity of the nucleotide sequences of TNFAIP2 BINDING SITE, designated SEQ ID:8132, to the nucleotide sequence of GAM7052 RNA, herein designated GAM RNA, also designated SEQ ID:296.

Another function of GAM7052 is therefore inhibition of Tumor necrosis factor, alpha-induced protein 2 (TNFAIP2, Accession NP_006282.2). Accordingly, utilities of GAM7052 include diagnosis, prevention and treatment of diseases and clinical conditions associated with TNFAIP2.

Tumor necrosis factor receptor superfamily, member 10b (TNFRSF10B, Accession NP_671716.1) is another GAM7052 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:19950, to the nucleotide sequence of GAM7052 RNA, herein designated GAM RNA, also designated SEQ ID:296.

Another function of GAM7052 is therefore inhibition of Tumor necrosis factor receptor superfamily, member 10b (TNFRSF10B, Accession NP_671716.1), a gene which forms complex that induces apoptosis. and therefore may be associated with Squamous cell carcinoma. Accordingly, utilities of GAM7052 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 10b (TNFRSF10B, Accession NP_003833.3) is another GAM7052 target gene, herein designated TARGET GENE. TNFRSF10B BINDING SITE is a target binding site found in the 3' untranslated region of multiple transcripts of mRNA encoded by TNFRSF10B, corresponding to a target binding site such as BINDING SITE I, BINDING SITE II or BINDING SITE III of FIG. 8. Table 4 illustrates the complementarity of the nucleotide sequences of TNFRSF10B BINDING SITE, designated SEQ ID:19950, to the nucleotide sequence of GAM7052 RNA, herein designated GAM RNA, also designated SEQ ID:296.

Another function of GAM7052 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM7052 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 11a, activator of nfkb (TNFRSF11A, Accession NP_003830.1) is another GAM7052 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:7043, to the nucleotide sequence of GAM7052 RNA, herein designated GAM RNA, also designated SEQ ID:296.

Another function of GAM7052 is therefore inhibition of Tumor necrosis factor receptor superfamily, member 11a, activator of nfkb (TNFRSF11A, Accession NP_003830.1). Accordingly, utilities of GAM7052 include diagnosis, prevention and treatment of diseases and clinical conditions associated with TNFRSF11A.

Translocase of outer mitochondrial membrane 40 homolog (yeast) (TOMM40, Accession NP_006105.1) is another GAM7052 target gene, herein designated TARGET GENE. TOMM40 BINDING SITE is a target binding site found in the 3' untranslated region of mRNA encoded by TOMM40, corresponding to a target binding site such as BINDING SITE I, BINDING SITE II or BINDING SITE III of FIG. 8. Table 4 illustrates the complementarity of the nucleotide sequences of TOMM40 BINDING SITE, designated SEQ ID:15424, to the nucleotide sequence of GAM7052 RNA, herein designated GAM RNA, also designated SEQ ID:296.

Another function of GAM7052 is therefore inhibition of Translocase of outer mitochondrial membrane 40 homolog (yeast) (TOMM40, Accession NP_006105.1). Accordingly, utilities of GAM7052 include diagnosis, prevention and treatment of diseases and clinical conditions associated with TOMM40.

Torsin family 1, member b (torsin b) (TOR1B, Accession NP_055321.1) is another GAM7052 target gene, herein designated TARGET GENE. TOR1B BINDING SITE is a target binding site found in the 3' untranslated region of mRNA encoded by TOR1B, corresponding to a target binding site such as BINDING SITE I, BINDING SITE II or BINDING SITE III of FIG. 8. Table 4 illustrates the complementarity of the nucleotide sequences of TOR1B BINDING SITE, designated SEQ ID:11224, to the nucleotide sequence of GAM7052 RNA, herein designated GAM RNA, also designated SEQ ID:296.

Another function of GAM7052 is therefore inhibition of Torsin family 1, member b (torsin b) (TOR1B, Accession NP_055321.1). Accordingly, utilities of GAM7052 include diagnosis, prevention and treatment of diseases and clinical conditions associated with TOR1B.

Thiopurine s-methyltransferase (TPMT, Accession NP_000358.1) is another GAM7052 target gene, herein designated TARGET GENE. TPMT BINDING SITE is a target binding site found in the 3' untranslated region of mRNA encoded by TPMT, corresponding to a target binding site such as BINDING SITE I, BINDING SITE II or BINDING SITE III of FIG. 8. Table 4 illustrates the complementarity of the nucleotide sequences of TPMT BINDING SITE, designated SEQ ID:1523, to the nucleotide sequence of GAM7052 RNA, herein designated GAM RNA, also designated SEQ ID:296.

Another function of GAM7052 is therefore inhibition of Thiopurine s-methyltransferase (TPMT, Accession NP_000358.1), a gene which catalyzes the s-methylation of thiopurine drugs such as 6-mercaptopurine. and therefore may be associated with Thiopurine s-methyltransferase polymorphism. Accordingly, utilities of GAM7052 include diagnosis, prevention and treatment of Thiopurine s-methyltransferase polymorphism, and of other diseases and clinical conditions associated with TPMT.

The function of TPMT and its association with various diseases and clinical conditions, has been established by previous studies, as described hereinabove with reference to GAM130.1. Tryptase gamma 1 (TPSG1, Accession NP_036599.1) is another GAM7052 target gene, herein designated TARGET GENE. TPSG1 BINDING SITE is a target binding site found in the 5' untranslated region of mRNA encoded by TPSG1, corresponding to a target binding site such as BINDING SITE I, BINDING SITE II or BINDING SITE III of FIG. 8. Table 4 illustrates the complementarity of the nucleotide sequences of TPSG1 BINDING SITE, designated SEQ ID:13903, to the nucleotide sequence of GAM7052 RNA, herein designated GAM RNA, also designated SEQ ID:296.

Another function of GAM7052 is therefore inhibition of Tryptase gamma 1 (TPSG1, Accession NP_036599.1). Accordingly, utilities of GAM7052 include diagnosis, prevention and treatment of diseases and clinical conditions associated with TPSG1.

Tnf receptor-associated factor 5 (TRAF5, Accession NP_004610.1) is another GAM7052 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:12522, to the nucleotide sequence of GAM7052 RNA, herein designated GAM RNA, also designated SEQ ID:296.

Another function of GAM7052 is therefore inhibition of Tnf receptor-associated factor 5 (TRAF5, Accession NP_004610.1), a gene which Member of a family of proteins that interact with TNF receptors; binds the lymphotoxin beta receptor (LTBR). Accordingly, utilities of GAM7052 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tnf receptor-associated factor 5 (TRAF5, Accession NP_665702.1) is another GAM7052 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:12522, to the nucleotide sequence of GAM7052 RNA, herein designated GAM RNA, also designated SEQ ID:296.

Another function of GAM7052 is therefore inhibition of Tnf receptor-associated factor 5 (TRAF5, Accession NP_665702.1), a gene which Member of a family of proteins that interact with TNF receptors; binds the lymphotoxin beta receptor (LTBR). Accordingly, utilities of GAM7052 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tripartite motif-containing 16 (TRIM16, Accession NP_006461.2) is another GAM7052 target gene, herein designated TARGET GENE. TRIM16 BINDING SITE1 and TRIM16 BINDING SITE2 are target binding sites found in untranslated regions of mRNA encoded by TRIM16, corresponding to target binding sites such as BINDING SITE I, BINDING SITE II or BINDING SITE III of FIG. 8. Table 4 illustrates the complementarity of the nucleotide sequences of TRIM16 BINDING SITE1 and TRIM16 BINDING SITE2, designated SEQ ID:18408 and SEQ ID:3032 respectively, to the nucleotide sequence of GAM7052 RNA, herein designated GAM RNA, also designated SEQ ID:296.

Another function of GAM7052 is therefore inhibition of Tripartite motif-containing 16 (TRIM16, Accession NP_006461.2). Accordingly, utilities of GAM7052 include diagnosis, prevention and treatment of diseases and clinical conditions associated with TRIM16.

Tripartite motif-containing 5 (TRIM5, Accession NP_149023.1) is another GAM7052 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:3638, to the nucleotide sequence of GAM7052 RNA, herein designated GAM RNA, also designated SEQ ID:296.

Another function of GAM7052 is therefore inhibition of Tripartite motif-containing 5 (TRIM5, Accession NP_149023.1). Accordingly, utilities of GAM7052 include diagnosis, prevention and treatment of diseases and clinical conditions associated with TRIM5.

Tripartite motif-containing 6 (TRIM6, Accession NP_477514.1) is another GAM7052 target gene, herein designated TARGET GENE. TRIM6 BINDING SITE is a target binding site found in the 3' untranslated region of mRNA encoded by TRIM6, corresponding to a target binding site such as BINDING SITE I, BINDING SITE II or BINDING SITE III of FIG. 8. Table 4 illustrates the complementarity of the nucleotide sequences of TRIM6 BINDING SITE, designated SEQ ID:17246, to the nucleotide sequence of GAM7052 RNA, herein designated GAM RNA, also designated SEQ ID:296.

Another function of GAM7052 is therefore inhibition of Tripartite motif-containing 6 (TRIM6, Accession NP_477514.1). Accordingly, utilities of GAM7052 include diagnosis, prevention and treatment of diseases and clinical conditions associated with TRIM6.

Transient receptor potential cation channel, subfamily v, member 1 (TRPV1, Accession NP_542435.1) is another GAM7052 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:18293, to the nucleotide sequence of GAM7052 RNA, herein designated GAM RNA, also designated SEQ ID:296.

Another function of GAM7052 is therefore inhibition of Transient receptor potential cation channel, subfamily v, member 1 (TRPV1, Accession NP_542435.1), a gene which functions as a receptor for capsaicin. Accordingly, utilities of GAM7052 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542436.1) is another GAM7052 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:18293, to the nucleotide sequence of GAM7052 RNA, herein designated GAM RNA, also designated SEQ ID:296.

Another function of GAM7052 is therefore inhibition of Transient receptor potential cation channel, subfamily v, member 1 (TRPV1, Accession NP_542436.1), a gene which functions as a receptor for capsaicin. Accordingly, utilities of GAM7052 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_061197.3) is another GAM7052 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:18293, to the nucleotide sequence of GAM7052 RNA, herein designated GAM RNA, also designated SEQ ID:296.

Another function of GAM7052 is therefore inhibition of Transient receptor potential cation channel, subfamily v, member 1 (TRPV1, Accession NP_061197.3), a gene which functions as a receptor for capsaicin. Accordingly, utilities of GAM7052 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542437.1) is another GAM7052 target gene, herein designated TARGET GENE. TRPV1 BINDING SITE is a target binding site found in the 3' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:18293, to the nucleotide sequence of GAM7052 RNA, herein designated GAM RNA, also designated SEQ ID:296.

Another function of GAM7052 is therefore inhibition of Transient receptor potential cation channel, subfamily v, member 1 (TRPV1, Accession NP_542437.1), a gene which functions as a receptor for capsaicin. Accordingly, utilities of GAM7052 include diagnosis, prevention and treatment of diseases and clinical conditions associated with TRPV1.

The function of TRPV1 and its association with various diseases and clinical conditions, has been established by previous studies, as described hereinabove with reference to GAM130.1. TSAP6 (Accession NP_060704.1) is another GAM7052 target gene, herein designated TARGET GENE. TSAP6 BINDING SITE is a target binding site found in the 5' untranslated region of mRNA encoded by TSAP6, corresponding to a target binding site such as BINDING SITE I, BINDING SITE II or BINDING SITE III of FIG. 8. Table 4 illustrates the complementarity of the nucleotide sequences of TSAP6 BINDING SITE, designated SEQ ID:12675, to the nucleotide sequence of GAM7052 RNA, herein designated GAM RNA, also designated SEQ ID:296.

Another function of GAM7052 is therefore inhibition of TSAP6 (Accession NP_060704.1). Accordingly, utilities of GAM7052 include diagnosis, prevention and treatment of diseases and clinical conditions associated with TSAP6.

TU12B1-TY (Accession NP_057659.1) is another GAM7052 target gene, herein designated TARGET GENE. TU12B1-TY BINDING SITE1 through TU12B1-TY BINDING SITE3 are target binding sites found in untranslated regions of mRNA encoded by TU12B1-TY, corresponding to target binding sites such as BINDING SITE I, BINDING SITE II or BINDING SITE III of FIG. 8. Table 4 illustrates the complementarity of the nucleotide sequences of TU12B1-TY BINDING SITE1 through TU12B1-TY BINDING SITE3, designated SEQ ID:2107, SEQ ID:2823 and SEQ ID:8615 respectively, to the nucleotide sequence of GAM7052 RNA, herein designated GAM RNA, also designated SEQ ID:296.

Another function of GAM7052 is therefore inhibition of TU12B1-TY (Accession NP_057659.1). Accordingly, utilities of GAM7052 include diagnosis, prevention and treatment of diseases and clinical conditions associated with TU12B1-TY.

TUCAN (Accession NP_055774.1) is another GAM7052 target gene, herein designated TARGET GENE. TUCAN BINDING SITE is a target binding site found in the 3' untranslated region of mRNA encoded by TUCAN, corresponding to a target binding site such as BINDING SITE I, BINDING SITE II or BINDING SITE III of FIG. 8. Table 4 illustrates the complementarity of the nucleotide sequences of TUCAN BINDING SITE, designated SEQ ID:16723, to the nucleotide sequence of GAM7052 RNA, herein designated GAM RNA, also designated SEQ ID:296.

Another function of GAM7052 is therefore inhibition of TUCAN (Accession NP_055774.1). Accordingly, utilities of GAM7052 include diagnosis, prevention and treatment of diseases and clinical conditions associated with TUCAN.

Thioredoxin-like 2 (TXNL2, Accession NP_006532.1) is another GAM7052 target gene, herein designated TARGET GENE. TXNL2 BINDING SITE is a target binding site found in the 3' untranslated region of mRNA encoded by TXNL2, corresponding to a target binding site such as BINDING SITE I, BINDING SITE II or BINDING SITE III of FIG. 8. Table 4 illustrates the complementarity of the nucleotide sequences of TXNL2 BINDING SITE, designated SEQ ID:9280, to the nucleotide sequence of GAM7052 RNA, herein designated GAM RNA, also designated SEQ ID:296.

Another function of GAM7052 is therefore inhibition of Thioredoxin-like 2 (TXNL2, Accession NP_006532.1). Accordingly, utilities of GAM7052 include diagnosis, prevention and treatment of diseases and clinical conditions associated with TXNL2.

UBF-fl (Accession NP_116217.1) is another GAM7052 target gene, herein designated TARGET GENE. UBF-fl BINDING SITE is a target binding site found in the 3' untranslated region of mRNA encoded by UBF-fl, corresponding to a target binding site such as BINDING SITE I, BINDING SITE II or BINDING SITE III of FIG. 8. Table 4 illustrates the complementarity of the nucleotide sequences of UBF-fl BINDING SITE, designated SEQ ID:16551, to the nucleotide sequence of GAM7052 RNA, herein designated GAM RNA, also designated SEQ ID:296.

Another function of GAM7052 is therefore inhibition of UBF-fl (Accession NP_116217.1). Accordingly, utilities of GAM7052 include diagnosis, prevention and treatment of diseases and clinical conditions associated with UBF-fl.

Uroplakin 1b (UPK1B, Accession NP_008883.1) is another GAM7052 target gene, herein designated TARGET GENE. UPK1B BINDING SITE is a target binding site found in the 3' untranslated region of mRNA encoded by UPK1B, corresponding to a target binding site such as BINDING SITE I, BINDING SITE II or BINDING SITE III of FIG. 8. Table 4 illustrates the complementarity of the nucleotide sequences of UPK1B BINDING SITE, designated SEQ ID:16344, to the nucleotide sequence of GAM7052 RNA, herein designated GAM RNA, also designated SEQ ID:296.

Another function of GAM7052 is therefore inhibition of Uroplakin 1b (UPK1B, Accession NP_008883.1), a gene which strengthens and stabilizes the urothelial apical surface of the asymmetric unit membrane of mammalian bladder epithelium. Accordingly, utilities of GAM7052 include diagnosis, prevention and treatment of diseases and clinical conditions associated with UPK1B.

The function of UPK1B and its association with various diseases and clinical conditions, has been established by previous studies, as described hereinabove with reference to GAM223.1. VDU1 (Accession NP_055832.2) is another GAM7052 target gene, herein designated TARGET GENE. VDU1 BINDING SITE is a target binding site found in the 3' untranslated region of mRNA encoded by VDU1, corresponding to a target binding site such as BINDING SITE I, BINDING SITE II or BINDING SITE III of FIG. 8. Table 4 illustrates the complementarity of the nucleotide sequences of VDU1 BINDING SITE, designated SEQ ID:9640, to the nucleotide sequence of GAM7052 RNA, herein designated GAM RNA, also designated SEQ ID:296.

Another function of GAM7052 is therefore inhibition of VDU1 (Accession NP_055832.2). Accordingly, utilities of GAM7052 include diagnosis, prevention and treatment of diseases and clinical conditions associated with VDU1.

Von hippel-lindau syndrome (VHL, Accession NP_000542.1) is another GAM7052 target gene, herein designated TARGET GENE. VHL BINDING SITE1 and VHL BINDING SITE2 are target binding sites found in untranslated regions of mRNA encoded by VHL, corresponding to target binding sites such as BINDING SITE I, BINDING SITE II or BINDING SITE III of FIG. 8. Table 4 illustrates the complementarity of the nucleotide sequences of VHL BINDING SITE1 and VHL BINDING SITE2, designated SEQ ID:19938 and SEQ ID:17725 respectively, to the nucleotide sequence of GAM7052 RNA, herein designated GAM RNA, also designated SEQ ID:296.

Another function of GAM7052 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM7052 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. Vasoactive intestinal peptide receptor 2 (VIPR2, Accession NP_003373.2) is another GAM7052 target gene, herein designated TARGET GENE. VIPR2 BINDING SITE is a target binding site found in the 3' untranslated region of mRNA encoded by VIPR2, corresponding to a target binding site such as BINDING SITE I, BINDING SITE II or BINDING SITE III of FIG. 8. Table 4 illustrates the complementarity of the nucleotide sequences of VIPR2 BINDING SITE, designated SEQ ID:8429, to the nucleotide sequence of GAM7052 RNA, herein designated GAM RNA, also designated SEQ ID:296.

Another function of GAM7052 is therefore inhibition of Vasoactive intestinal peptide receptor 2 (VIPR2, Accession NP_003373.2). Accordingly, utilities of GAM7052 include diagnosis, prevention and treatment of diseases and clinical conditions associated with VIPR2.

Vacuolar protein sorting 33a (yeast) (VPS33A, Accession NP_075067.2) is another GAM7052 target gene, herein designated TARGET GENE. VPS33A BINDING SITE is a target binding site found in the 3' untranslated region of mRNA encoded by VPS33A, corresponding to a target binding site such as BINDING SITE I, BINDING SITE II or BINDING SITE III of FIG. 8. Table 4 illustrates the complementarity of the nucleotide sequences of VPS33A BINDING SITE, designated SEQ ID:18973, to the nucleotide sequence of GAM7052 RNA, herein designated GAM RNA, also designated SEQ ID:296.

Another function of GAM7052 is therefore inhibition of Vacuolar protein sorting 33a (yeast) (VPS33A, Accession NP_075067.2). Accordingly, utilities of GAM7052 include diagnosis, prevention and treatment of diseases and clinical conditions associated with VPS33A.

Williams-beuren syndrome chromosome region 23 (WB-SCR23, Accession NP_079318.1) is another GAM7052 target gene, herein designated TARGET GENE. WBSCR23 BINDING SITE is a target binding site found in the 3' untranslated region of mRNA encoded by WBSCR23, corresponding to a target binding site such as BINDING SITE I, BINDING SITE II or BINDING SITE III of FIG. 8. Table 4 illustrates the complementarity of the nucleotide sequences of WBSCR23 BINDING SITE, designated SEQ ID:17673, to the nucleotide sequence of GAM7052 RNA, herein designated GAM RNA, also designated SEQ ID:296.

Another function of GAM7052 is therefore inhibition of Williams-beuren syndrome chromosome region 23 (WBSCR23, Accession NP_079318.1). Accordingly, utilities of GAM7052 include diagnosis, prevention and treatment of diseases and clinical conditions associated with WBSCR23.

ZFP30 (Accession NP_055713.1) is another GAM7052 target gene, herein designated TARGET GENE. ZFP30 BINDING SITE is a target binding site found in the 3' untranslated region of mRNA encoded by ZFP30, corresponding to a target binding site such as BINDING SITE I, BINDING SITE II or BINDING SITE III of FIG. 8. Table 4 illustrates the complementarity of the nucleotide sequences of ZFP30 BINDING SITE, designated SEQ ID:2558, to the nucleotide sequence of GAM7052 RNA, herein designated GAM RNA, also designated SEQ ID:296.

Another function of GAM7052 is therefore inhibition of ZFP30 (Accession NP_055713.1). Accordingly, utilities of GAM7052 include diagnosis, prevention and treatment of diseases and clinical conditions associated with ZFP30.

Zic family member 2 (odd-paired homolog, drosophila) (ZIC2, Accession NP_009060.2) is another GAM7052 target gene, herein designated TARGET GENE. ZIC2 BINDING SITE is a target binding site found in the 3' untranslated region of mRNA encoded by ZIC2, corresponding to a target binding site such as BINDING SITE I, BINDING SITE II or BINDING SITE III of FIG. 8. Table 4 illustrates the complementarity of the nucleotide sequences of ZIC2 BINDING SITE, designated SEQ ID:5098, to the nucleotide sequence of GAM7052 RNA, herein designated GAM RNA, also designated SEQ ID:296.

Another function of GAM7052 is therefore inhibition of Zic family member 2 (odd-paired homolog, drosophila) (ZIC2, Accession NP_009060.2). Accordingly, utilities of GAM7052 include diagnosis, prevention and treatment of diseases and clinical conditions associated with ZIC2.

ZMYND17 (Accession NP_848546.1) is another GAM7052 target gene, herein designated TARGET GENE. ZMYND17 BINDING SITE is a target binding site found in the 3' untranslated region of mRNA encoded by ZMYND17, corresponding to a target binding site such as BINDING SITE I, BINDING SITE II or BINDING SITE III of FIG. 8. Table 4 illustrates the complementarity of the nucleotide sequences of ZMYND17 BINDING SITE, designated SEQ ID:13356, to the nucleotide sequence of GAM7052 RNA, herein designated GAM RNA, also designated SEQ ID:296.

Another function of GAM7052 is therefore inhibition of ZMYND17 (Accession NP_848546.1). Accordingly, utilities of GAM7052 include diagnosis, prevention and treatment of diseases and clinical conditions associated with ZMYND17.

Zinc finger protein 137 (clone phz-30) (ZNF137, Accession NP_003429.1) is another GAM7052 target gene, herein designated TARGET GENE. ZNF137 BINDING SITE is a target binding site found in the 3' untranslated region of mRNA encoded by ZNF137, corresponding to a target binding site such as BINDING SITE I, BINDING SITE II or BINDING SITE III of FIG. 8. Table 4 illustrates the complementarity of the nucleotide sequences of ZNF137 BINDING SITE, designated SEQ ID:11225, to the nucleotide sequence of GAM7052 RNA, herein designated GAM RNA, also designated SEQ ID:296.

Another function of GAM7052 is therefore inhibition of Zinc finger protein 137 (clone phz-30) (ZNF137, Accession NP_003429.1). Accordingly, utilities of GAM7052 include diagnosis, prevention and treatment of diseases and clinical conditions associated with ZNF137.

Zinc finger protein 253 (ZNF253, Accession NP_066385.1) is another GAM7052 target gene, herein designated TARGET GENE. ZNF253 BINDING SITE is a target binding site found in the 3' untranslated region of mRNA encoded by ZNF253, corresponding to a target binding site such as BINDING SITE I, BINDING SITE II or BINDING SITE III of FIG. 8. Table 4 illustrates the complementarity of the nucleotide sequences of ZNF253 BINDING SITE, designated SEQ ID:3638, to the nucleotide sequence of GAM7052 RNA, herein designated GAM RNA, also designated SEQ ID:296.

Another function of GAM7052 is therefore inhibition of Zinc finger protein 253 (ZNF253, Accession NP_066385.1). Accordingly, utilities of GAM7052 include diagnosis, prevention and treatment of diseases and clinical conditions associated with ZNF253.

Zinc finger protein 264 (ZNF264, Accession NP_003408.1) is another GAM7052 target gene, herein designated TARGET GENE. ZNF264 BINDING SITE is a target binding site found in the 3' untranslated region of mRNA encoded by ZNF264, corresponding to a target binding site such as BINDING SITE I, BINDING SITE II or BINDING SITE III of FIG. 8. Table 4 illustrates the complementarity of the nucleotide sequences of ZNF264 BINDING SITE, designated SEQ ID:9691, to the nucleotide sequence of GAM7052 RNA, herein designated GAM RNA, also designated SEQ ID:296.

Another function of GAM7052 is therefore inhibition of Zinc finger protein 264 (ZNF264, Accession NP_003408.1). Accordingly, utilities of GAM7052 include diagnosis, prevention and treatment of diseases and clinical conditions associated with ZNF264.

Zinc finger protein 273 (ZNF273, Accession XP_088082.1) is another GAM7052 target gene, herein designated TARGET GENE. ZNF273 BINDING SITE is a target binding site found in the 3' untranslated region of mRNA encoded by ZNF273, corresponding to a target binding site such as BINDING SITE I, BINDING SITE II or BINDING SITE III of FIG. 8. Table 4 illustrates the complementarity of the nucleotide sequences of ZNF273 BINDING SITE, designated SEQ ID:12971, to the nucleotide sequence of GAM7052 RNA, herein designated GAM RNA, also designated SEQ ID:296.

Another function of GAM7052 is therefore inhibition of Zinc finger protein 273 (ZNF273, Accession XP_088082.1). Accordingly, utilities of GAM7052 include diagnosis, prevention and treatment of diseases and clinical conditions associated with ZNF273.

Zinc finger protein 305 (ZNF305, Accession NP_055539.1) is another GAM7052 target gene, herein designated TARGET GENE. ZNF305 BINDING SITE is a target binding site found in the 3' untranslated region of mRNA encoded by ZNF305, corresponding to a target binding site such as BINDING SITE I, BINDING SITE II or BINDING SITE III of FIG. 8. Table 4 illustrates the complementarity of the nucleotide sequences of ZNF305 BINDING SITE, designated SEQ ID:16268, to the nucleotide sequence of GAM7052 RNA, herein designated GAM RNA, also designated SEQ ID:296.

Another function of GAM7052 is therefore inhibition of Zinc finger protein 305 (ZNF305, Accession NP_055539.1). Accordingly, utilities of GAM7052 include diagnosis, prevention and treatment of diseases and clinical conditions associated with ZNF305.

ZNF432 (Accession NP_055465.1) is another GAM7052 target gene, herein designated TARGET GENE. ZNF432 BINDING SITE is a target binding site found in the 3' untranslated region of mRNA encoded by ZNF432, corresponding to a target binding site such as BINDING SITE I, BINDING SITE II or BINDING SITE III of FIG. 8. Table 4 illustrates the complementarity of the nucleotide sequences of ZNF432 BINDING SITE, designated SEQ ID:12735, to the nucleotide sequence of GAM7052 RNA, herein designated GAM RNA, also designated SEQ ID:296.

Another function of GAM7052 is therefore inhibition of ZNF432 (Accession NP_055465.1). Accordingly, utilities of GAM7052 include diagnosis, prevention and treatment of diseases and clinical conditions associated with ZNF432.

ZNF440 (Accession NP_689570.1) is another GAM7052 target gene, herein designated TARGET GENE. ZNF440 BINDING SITE is a target binding site found in the 3' untranslated region of mRNA encoded by ZNF440, corresponding to a target binding site such as BINDING SITE I, BINDING SITE II or BINDING SITE III of FIG. 8. Table 4 illustrates the complementarity of the nucleotide sequences of ZNF440 BINDING SITE, designated SEQ ID:13692, to the nucleotide sequence of GAM7052 RNA, herein designated GAM RNA, also designated SEQ ID:296.

Another function of GAM7052 is therefore inhibition of ZNF440 (Accession NP_689570.1). Accordingly, utilities of GAM7052 include diagnosis, prevention and treatment of diseases and clinical conditions associated with ZNF440.

Zinc finger protein 70 (cos17) (ZNF70, Accession NP_852101.1) is another GAM7052 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:19261, to the nucleotide sequence of GAM7052 RNA, herein designated GAM RNA, also designated SEQ ID:296.

Another function of GAM7052 is therefore inhibition of Zinc finger protein 70 (cos17) (ZNF70, Accession NP_852101.1). Accordingly, utilities of GAM7052 include diagnosis, prevention and treatment of diseases and clinical conditions associated with ZNF70.

Zinc finger protein 70 (cos17) (ZNF70, Accession NP_068735.1) is another GAM7052 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:19261, to the nucleotide sequence of GAM7052 RNA, herein designated GAM RNA, also designated SEQ ID:296.

Another function of GAM7052 is therefore inhibition of Zinc finger protein 70 (cos17) (ZNF70, Accession NP_068735.1). Accordingly, utilities of GAM7052 include diagnosis, prevention and treatment of diseases and clinical conditions associated with ZNF70.

FIG. 8 further provides a conceptual description of a novel bioinformatically detected of the present invention, referred to here as Genomic Address Messenger 7080 (GAM7080), which modulates expression of respective target genes thereof, the function and utility of which target genes is known in the art.

GAM7080 is a novel bioinformatically detected regulatory, non protein coding, micro RNA (miRNA) gene. The method by which GAM7080 was detected is described hereinabove with reference to FIGS. 8-15.

GAM7080 gene, herein designated GAM GENE, and GAM7080 target gene, herein designated TARGET GENE, are human genes contained in the human genome.

GAM7080 gene encodes a GAM7080 precursor RNA, herein designated GAM PRECURSOR RNA. Similar to other miRNA genes, and unlike most ordinary genes, GAM7080 precursor RNA does not encode a protein. A nucleotide sequence identical or highly similar to the nucleotide sequence of GAM7080 precursor RNA is designated SEQ ID:183, and is provided hereinbelow with reference to the sequence listing part.

GAM7080 precursor RNA folds onto itself, forming GAM7080 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM7080 precursor RNA folds onto itself, forming GAM7080 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM7080 precursor RNA, designated SEQ-ID:183, and a schematic representation of a predicted secondary folding of GAM7080 folded precursor RNA are further described with reference to Table 2, hereby incorporated by reference.

An enzyme complex designated DICER COMPLEX, 'dices' the GAM7080 folded precursor RNA into GAM7080 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM7080 RNA is designated SEQ ID:399, and is provided hereinbelow with references to the sequence listing part and Table 3, hereby incorporated by reference.

GAM7080 target gene, herein designated TARGET GENE, encodes a corresponding messenger RNA, GAM7080 target RNA, herein designated GAM TARGET RNA. GAM7080 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM7080 RNA, herein designated GAM RNA, binds complementarily to one or more target binding sites located in untranslated regions of GAM7080 target RNA, herein designated GAM TARGET RNA. This complementary binding is due to the fact that the nucleotide sequence of GAM7080

RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM7080 RNA may have a different number of target binding sites in untranslated regions of a GAM7080 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM7080 RNA, herein designated GAM RNA, to target binding sites on GAM7080 target RNA, herein designated GAM TARGET RNA, such as BINDING SITE I, BINDING SITE II and BINDING SITE III, inhibits translation of GAM7080 target RNA into GAM7080 target protein, herein designated GAM TARGET PROTEIN. GAM target protein is therefore outlined by a broken line.

It is appreciated that GAM7080 target gene, herein designated TARGET GENE, in fact represents a plurality of GAM7080 target genes. The mRNA of each one of this plurality of GAM7080 target genes comprises one or more target binding sites, each having a nucleotide sequence which is at least partly complementary to GAM7080 RNA, herein designated GAM RNA, and which when bound by GAM7080 RNA causes inhibition of translation of respective one or more GAM7080 target proteins.

It is further appreciated by one skilled in the art that the mode of translational inhibition illustrated by FIG. 8 with specific reference to translational inhibition exerted by GAM7080 gene, herein designated GAM GENE, on one or more GAM7080 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM7080 correlate with, and may be deduced from, the identity of the target genes which GAM7080 binds and inhibits, and the function of these target genes, as elaborated hereinbelow.

Alpha-1-b glycoprotein (A1BG, Accession NP_570602.2) is a GAM7080 target gene, herein designated TARGET GENE. A1BG BINDING SITE is a target binding site found in the 3' untranslated region of mRNA encoded by A1BG, corresponding to a target binding site such as BINDING SITE I, BINDING SITE II or BINDING SITE III of FIG. 8. Table 4 illustrates the complementarity of the nucleotide sequences of A1BG BINDING SITE, designated SEQ ID:10195, to the nucleotide sequence of GAM7080 RNA, herein designated GAM RNA, also designated SEQ ID:399.

A function of GAM7080 is therefore inhibition of Alpha-1-b glycoprotein (A1BG, Accession NP_570602.2), a gene which a plasma protein of unknown function. Accordingly, utilities of GAM7080 include diagnosis, prevention and treatment of diseases and clinical conditions associated with A1BG.

The function of A1BG and its association with various diseases and clinical conditions, has been established by previous studies, as described hereinabove with reference to GAM130.1. Atp-binding cassette, sub-family b (mdr/tap), member 9 (ABCB9, Accession NP_062571.1) is another GAM7080 target gene, herein designated TARGET GENE. ABCB9 BINDING SITE is a target binding site found in the 5' untranslated region of multiple transcripts of mRNA encoded by ABCB9, corresponding to a target binding site such as BINDING SITE I, BINDING SITE II or BINDING SITE III of FIG. 8. Table 4 illustrates the complementarity of the nucleotide sequences of ABCB9 BINDING SITE, designated SEQ ID:10223, to the nucleotide sequence of GAM7080 RNA, herein designated GAM RNA, also designated SEQ ID:399.

Another function of GAM7080 is therefore inhibition of Atp-binding cassette, sub-family b (mdr/tap), member 9 (ABCB9, Accession NP_062571.1), a gene which ATP binding cassette transporter B9; has transmembrane domain, nucleotide-binding domain with Walker motifs. Accordingly, utilities of GAM7080 include diagnosis, prevention and treatment of diseases and clinical conditions associated with ABCB9.

The function of ABCB9 and its association with various diseases and clinical conditions, has been established by previous studies, as described hereinabove with reference to GAM47.1. Atp-binding cassette, sub-family b (mdr/tap), member 9 (ABCB9, Accession NP_062570.1) is another GAM7080 target gene, herein designated TARGET GENE. ABCB9 BINDING SITE is a target binding site found in the 5' untranslated region of multiple transcripts of mRNA encoded by ABCB9, corresponding to a target binding site such as BINDING SITE I, BINDING SITE II or BINDING SITE III of FIG. 8. Table 4 illustrates the complementarity of the nucleotide sequences of ABCB9 BINDING SITE, designated SEQ ID:10223, to the nucleotide sequence of GAM7080 RNA, herein designated GAM RNA, also designated SEQ ID:399.

Another function of GAM7080 is therefore inhibition of Atp-binding cassette, sub-family b (mdr/tap), member 9 (ABCB9, Accession NP_062570.1), a gene which ATP binding cassette transporter B9; has transmembrane domain, nucleotide-binding domain with Walker motifs. Accordingly, utilities of GAM7080 include diagnosis, prevention and treatment of diseases and clinical conditions associated with ABCB9.

The function of ABCB9 and its association with various diseases and clinical conditions, has been established by previous studies, as described hereinabove with reference to GAM47.1. ACTR10 (Accession NP_060947.1) is another GAM7080 target gene, herein designated TARGET GENE. ACTR10 BINDING SITE is a target binding site found in the 5' untranslated region of mRNA encoded by ACTR10, corresponding to a target binding site such as BINDING SITE I, BINDING SITE II or BINDING SITE III of FIG. 8. Table 4 illustrates the complementarity of the nucleotide sequences of ACTR10 BINDING SITE, designated SEQ ID:11903, to the nucleotide sequence of GAM7080 RNA, herein designated GAM RNA, also designated SEQ ID:399.

Another function of GAM7080 is therefore inhibition of ACTR10 (Accession NP_060947.1). Accordingly, utilities of GAM7080 include diagnosis, prevention and treatment of diseases and clinical conditions associated with ACTR10.

Adrenergic, alpha-2b-, receptor (ADRA2B, Accession NP_000673.1) is another GAM7080 target gene, herein designated TARGET GENE. ADRA2B BINDING SITE is a target binding site found in the 3' untranslated region of mRNA encoded by ADRA2B, corresponding to a target binding site such as BINDING SITE I, BINDING SITE II or BINDING SITE III of FIG. 8. Table 4 illustrates the complementarity of the nucleotide sequences of ADRA2B BINDING SITE, designated SEQ ID:7602, to the nucleotide sequence of GAM7080 RNA, herein designated GAM RNA, also designated SEQ ID:399.

Another function of GAM7080 is therefore inhibition of Adrenergic, alpha-2b-, receptor (ADRA2B, Accession NP_000673.1), a gene which mediate the catecholamine-induced inhibition of adenylate cyclase through the action of g proteins. Accordingly, utilities of GAM7080 include diagnosis, prevention and treatment of diseases and clinical conditions associated with ADRA2B.

The function of ADRA2B and its association with various diseases and clinical conditions, has been established by previous studies, as described hereinabove with reference to GAM264.1. Adaptor-related protein complex 3, sigma 2 subunit (AP3S2, Accession NP_005820.1) is another GAM7080 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:5422, to the nucleotide sequence of GAM7080 RNA, herein designated GAM RNA, also designated SEQ ID:399.

Another function of GAM7080 is therefore inhibition of Adaptor-related protein complex 3, sigma 2 subunit (AP3S2, Accession NP_005820.1). Accordingly, utilities of GAM7080 include diagnosis, prevention and treatment of diseases and clinical conditions associated with AP3S2.

Rho gtpase activating protein 12 (ARHGAP12, Accession NP_060757.4) is another GAM7080 target gene, herein designated TARGET GENE. ARHGAP12 BINDING SITE is a target binding site found in the 3' untranslated region of mRNA encoded by ARHGAP12, corresponding to a target binding site such as BINDING SITE I, BINDING SITE II or BINDING SITE III of FIG. 8. Table 4 illustrates the complementarity of the nucleotide sequences of ARHGAP12 BINDING SITE, designated SEQ ID:13878, to the nucleotide sequence of GAM7080 RNA, herein designated GAM RNA, also designated SEQ ID:399.

Another function of GAM7080 is therefore inhibition of Rho gtpase activating protein 12 (ARHGAP12, Accession NP_060757.4). Accordingly, utilities of GAM7080 include diagnosis, prevention and treatment of diseases and clinical conditions associated with ARHGAP12.

Attractin (ATRN, Accession NP_647537.1) is another GAM7080 target gene, herein designated TARGET GENE. ATRN BINDING SITE is a target binding site found in the 3' untranslated region of multiple transcripts of mRNA encoded by ATRN, corresponding to a target binding site such as BINDING SITE I, BINDING SITE II or BINDING SITE III of FIG. 8. Table 4 illustrates the complementarity of the nucleotide sequences of ATRN BINDING SITE, designated SEQ ID:4659, to the nucleotide sequence of GAM7080 RNA, herein designated GAM RNA, also designated SEQ ID:399.

Another function of GAM7080 is therefore inhibition of Attractin (ATRN, Accession NP_647537.1), a gene which is involved in the initial immune cell clustering during inflammatory response. Accordingly, utilities of GAM7080 include diagnosis, prevention and treatment of diseases and clinical conditions associated with ATRN.

The function of ATRN and its association with various diseases and clinical conditions, has been established by previous studies, as described hereinabove with reference to GAM47.1. Btb and cnc homology 1, basic leucine zipper transcription factor 2 (BACH2, Accession NP_068585.1) is another GAM7080 target gene, herein designated TARGET GENE. BACH2 BINDING SITE is a target binding site found in the 3' untranslated region of mRNA encoded by BACH2, corresponding to a target binding site such as BINDING SITE I, BINDING SITE II or BINDING SITE III of FIG. 8. Table 4 illustrates the complementarity of the nucleotide sequences of BACH2 BINDING SITE, designated SEQ ID:16479, to the nucleotide sequence of GAM7080 RNA, herein designated GAM RNA, also designated SEQ ID:399.

Another function of GAM7080 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM7080 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. Beaded filament structural protein 2, phakinin (BFSP2, Accession NP_003562.1) is another GAM7080 target gene, herein designated TARGET GENE. BFSP2 BINDING SITE is a target binding site found in the 3' untranslated region of mRNA encoded by BFSP2, corresponding to a target binding site such as BINDING SITE I, BINDING SITE II or BINDING SITE III of FIG. 8. Table 4 illustrates the complementarity of the nucleotide sequences of BFSP2 BINDING SITE, designated SEQ ID:3480, to the nucleotide sequence of GAM7080 RNA, herein designated GAM RNA, also designated SEQ ID:399.

Another function of GAM7080 is therefore inhibition of Beaded filament structural protein 2, phakinin (BFSP2, Accession NP_003562.1), a gene which is an intermediate filament protein that interacts with CP115 (BFSP1) to form beaded filament and therefore is associated with Juvenile-onset cataract. Accordingly, utilities of GAM7080 include diagnosis, prevention and treatment of Juvenile-onset cataract, and of other diseases and clinical conditions associated with BFSP2.

The function of BFSP2 and its association with various diseases and clinical conditions, has been established by previous studies, as described hereinabove with reference to GAM1089.1. Bridging integrator 3 (BIN3, Accession NP_061158.1) is another GAM7080 target gene, herein designated TARGET GENE. BIN3 BINDING SITE is a target binding site found in the 3' untranslated region of mRNA encoded by BIN3, corresponding to a target binding site such as BINDING SITE I, BINDING SITE II or BINDING SITE III of FIG. 8. Table 4 illustrates the complementarity of the nucleotide sequences of BIN3 BINDING SITE, designated SEQ ID:3365, to the nucleotide sequence of GAM7080 RNA, herein designated GAM RNA, also designated SEQ ID:399.

Another function of GAM7080 is therefore inhibition of Bridging integrator 3 (BIN3, Accession NP_061158.1). Accordingly, utilities of GAM7080 include diagnosis, prevention and treatment of diseases and clinical conditions associated with BIN3.

B lymphoma mo-mlv insertion region (mouse) (BMI1, Accession NP_005171.4) is another GAM7080 target gene, herein designated TARGET GENE. BMI1 BINDING SITE is a target binding site found in the 3' untranslated region of mRNA encoded by BMI1, corresponding to a target binding site such as BINDING SITE I, BINDING SITE II or BINDING SITE III of FIG. 8. Table 4 illustrates the complementarity of the nucleotide sequences of BMI1 BINDING SITE, designated SEQ ID:9667, to the nucleotide sequence of GAM7080 RNA, herein designated GAM RNA, also designated SEQ ID:399.

Another function of GAM7080 is therefore inhibition of B lymphoma mo-mlv insertion region (mouse) (BMI1, Accession NP_005171.4). Accordingly, utilities of GAM7080 include diagnosis, prevention and treatment of diseases and clinical conditions associated with BMI1.

Bassoon (presynaptic cytomatrix protein) (BSN, Accession NP_003449.1) is another GAM7080 target gene, herein designated TARGET GENE. BSN BINDING SITE is a target binding site found in the 3' untranslated region of mRNA encoded by BSN, corresponding to a target binding site such as BINDING SITE I, BINDING SITE II or BINDING SITE III of FIG. 8. Table 4 illustrates the complementarity of the nucleotide sequences of BSN BINDING SITE, designated SEQ ID:13114, to the nucleotide sequence of GAM7080 RNA, herein designated GAM RNA, also designated SEQ ID:399.

Another function of GAM7080 is therefore inhibition of Bassoon (presynaptic cytomatrix protein) (BSN, Accession NP_003449.1), a gene which may be involved in cytomatrix organization at the site of neurotransmitter release and therefore may be associated with Multiple system atrophy (msa). Accordingly, utilities of GAM7080 include diagnosis, prevention and treatment of Multiple system atrophy (msa), and of other diseases and clinical conditions associated with BSN.

The function of BSN and its association with various diseases and clinical conditions, has been established by previous studies, as described hereinabove with reference to GAM146.1. C14orf132 (Accession NP_064600.1) is another GAM7080 target gene, herein designated TARGET GENE. C14orf132 BINDING SITE is a target binding site found in the 3' untranslated region of mRNA encoded by C14orf132, corresponding to a target binding site such as BINDING SITE I, BINDING SITE II or BINDING SITE III of FIG. 8. Table 4 illustrates the complementarity of the nucleotide sequences of C14orf132 BINDING SITE, designated SEQ ID:16767, to the nucleotide sequence of GAM7080 RNA, herein designated GAM RNA, also designated SEQ ID:399.

Another function of GAM7080 is therefore inhibition of C14orf132 (Accession NP_064600.1). Accordingly, utilities of GAM7080 include diagnosis, prevention and treatment of diseases and clinical conditions associated with C14orf132.

Chromosome 14 open reading frame 35 (C14orf35, Accession XP_058661.2) is another GAM7080 target gene, herein designated TARGET GENE. C14orf35 BINDING SITE is a target binding site found in the 5' untranslated region of mRNA encoded by C14orf35, corresponding to a target binding site such as BINDING SITE I, BINDING SITE II or BINDING SITE III of FIG. 8. Table 4 illustrates the complementarity of the nucleotide sequences of C14orf35 BINDING SITE, designated SEQ ID:7617, to the nucleotide sequence of GAM7080 RNA, herein designated GAM RNA, also designated SEQ ID:399.

Another function of GAM7080 is therefore inhibition of Chromosome 14 open reading frame 35 (C14orf35, Accession XP_058661.2). Accordingly, utilities of GAM7080 include diagnosis, prevention and treatment of diseases and clinical conditions associated with C14orf35.

C17orf35 (Accession NP_003867.1) is another GAM7080 target gene, herein designated TARGET GENE. C17orf35 BINDING SITE is a target binding site found in the 5' untranslated region of mRNA encoded by C17orf35, corresponding to a target binding site such as BINDING SITE I, BINDING SITE II or BINDING SITE III of FIG. 8. Table 4 illustrates the complementarity of the nucleotide sequences of C17orf35 BINDING SITE, designated SEQ ID:8416, to the nucleotide sequence of GAM7080 RNA, herein designated GAM RNA, also designated SEQ ID:399.

Another function of GAM7080 is therefore inhibition of C17orf35 (Accession NP_003867.1). Accordingly, utilities of GAM7080 include diagnosis, prevention and treatment of diseases and clinical conditions associated with C17orf35.

C1orf38 (Accession NP_004839.1) is another GAM7080 target gene, herein designated TARGET GENE. C1orf38 BINDING SITE is a target binding site found in the 3' untranslated region of mRNA encoded by C1orf38, corresponding to a target binding site such as BINDING SITE I, BINDING SITE II or BINDING SITE III of FIG. 8. Table 4 illustrates the complementarity of the nucleotide sequences of C1orf38 BINDING SITE, designated SEQ ID:9052, to the nucleotide sequence of GAM7080 RNA, herein designated GAM RNA, also designated SEQ ID:399.

Another function of GAM7080 is therefore inhibition of C1orf38 (Accession NP_004839.1). Accordingly, utilities of GAM7080 include diagnosis, prevention and treatment of diseases and clinical conditions associated with C1orf38.

Chromosome 20 open reading frame 12 (C20orf12, Accession NP_060622.2) is another GAM7080 target gene, herein designated TARGET GENE. C20orf12 BINDING SITE is a target binding site found in the 5' untranslated region of mRNA encoded by C20orf12, corresponding to a target binding site such as BINDING SITE I, BINDING SITE II or BINDING SITE III of FIG. 8. Table 4 illustrates the complementarity of the nucleotide sequences of C20orf12 BINDING SITE, designated SEQ ID:14702, to the nucleotide sequence of GAM7080 RNA, herein designated GAM RNA, also designated SEQ ID:399.

Another function of GAM7080 is therefore inhibition of Chromosome 20 open reading frame 12 (C20orf12, Accession NP_060622.2). Accordingly, utilities of GAM7080 include diagnosis, prevention and treatment of diseases and clinical conditions associated with C20orf12.

Chromosome 9 open reading frame 14 (C9orf14, Accession XP_098859.2) is another GAM7080 target gene, herein designated TARGET GENE. C9orf14 BINDING SITE is a target binding site found in the 3' untranslated region of mRNA encoded by C9orf14, corresponding to a target binding site such as BINDING SITE I, BINDING SITE II or BINDING SITE III of FIG. 8. Table 4 illustrates the complementarity of the nucleotide sequences of C9orf14 BINDING SITE, designated SEQ ID:2384, to the nucleotide sequence of GAM7080 RNA, herein designated GAM RNA, also designated SEQ ID:399.

Another function of GAM7080 is therefore inhibition of Chromosome 9 open reading frame 14 (C9orf14, Accession XP_098859.2). Accordingly, utilities of GAM7080 include diagnosis, prevention and treatment of diseases and clinical conditions associated with C9orf14.

CABIN1 (Accession NP_036427.1) is another GAM7080 target gene, herein designated TARGET GENE. CABIN1 BINDING SITE is a target binding site found in the 5' untranslated region of mRNA encoded by CABIN1, corresponding to a target binding site such as BINDING SITE I, BINDING SITE II or BINDING SITE III of FIG. 8. Table 4 illustrates the complementarity of the nucleotide sequences of CABIN1 BINDING SITE, designated SEQ ID:4584, to the nucleotide sequence of GAM7080 RNA, herein designated GAM RNA, also designated SEQ ID:399.

Another function of GAM7080 is therefore inhibition of CABIN1 (Accession NP_036427.1). Accordingly, utilities of GAM7080 include diagnosis, prevention and treatment of diseases and clinical conditions associated with CABIN1.

Calbindin 2, 29 kda (calretinin) (CALB2, Accession NP_001731.1) is another GAM7080 target gene, herein designated TARGET GENE. CALB2 BINDING SITE is a target binding site found in the 3' untranslated region of multiple transcripts of mRNA encoded by CALB2, corresponding to a target binding site such as BINDING SITE I, BINDING SITE II or BINDING SITE III of FIG. 8. Table 4 illustrates the complementarity of the nucleotide sequences of CALB2 BINDING SITE, designated SEQ ID:14269, to the nucleotide sequence of GAM7080 RNA, herein designated GAM RNA, also designated SEQ ID:399.

Another function of GAM7080 is therefore inhibition of Calbindin 2, 29 kda (calretinin) (CALB2, Accession NP_001731.1), a gene which plays a major role at the network level in cerebellar physiology. Accordingly, utilities of GAM7080 include diagnosis, prevention and treatment of diseases and clinical conditions associated with CALB2.

The function of CALB2 and its association with various diseases and clinical conditions, has been established by previous studies, as described hereinabove with reference to GAM842.2. Calbindin 2, 29 kda (calretinin) (CALB2, Accession NP_009019.1) is another GAM7080 target gene, herein designated TARGET GENE. CALB2 BINDING SITE is a target binding site found in the 3' untranslated region of multiple transcripts of mRNA encoded by CALB2, corresponding to a target binding site such as BINDING SITE I, BINDING SITE II or BINDING SITE III of FIG. 8. Table 4 illustrates the complementarity of the nucleotide sequences of CALB2 BINDING SITE, designated SEQ ID:14269, to the nucleotide sequence of GAM7080 RNA, herein designated GAM RNA, also designated SEQ ID:399.

Another function of GAM7080 is therefore inhibition of Calbindin 2, 29 kda (calretinin) (CALB2, Accession NP_009019.1), a gene which plays a major role at the network level in cerebellar physiology. Accordingly, utilities of GAM7080 include diagnosis, prevention and treatment of diseases and clinical conditions associated with CALB2.

The function of CALB2 and its association with various diseases and clinical conditions, has been established by previous studies, as described hereinabove with reference to GAM842.2. Calbindin 2, 29 kda (calretinin) (CALB2, Accession NP_009018.1) is another GAM7080 target gene, herein designated TARGET GENE. CALB2 BINDING SITE is a target binding site found in the 3' untranslated region of multiple transcripts of mRNA encoded by CALB2, corresponding to a target binding site such as BINDING SITE I, BINDING SITE II or BINDING SITE III of FIG. 8. Table 4 illustrates the complementarity of the nucleotide sequences of CALB2 BINDING SITE, designated SEQ ID:14269, to the nucleotide sequence of GAM7080 RNA, herein designated GAM RNA, also designated SEQ ID:399.

Another function of GAM7080 is therefore inhibition of Calbindin 2, 29 kda (calretinin) (CALB2, Accession NP_009018.1), a gene which plays a major role at the network level in cerebellar physiology. Accordingly, utilities of GAM7080 include diagnosis, prevention and treatment of diseases and clinical conditions associated with CALB2.

The function of CALB2 and its association with various diseases and clinical conditions, has been established by previous studies, as described hereinabove with reference to GAM842.2. Calcium/calmodulin-dependent protein kinase (cam kinase) ii gamma (CAMK2G, Accession NP_751910.1) is another GAM7080 target gene, herein designated TARGET GENE. CAMK2G BINDING SITE is a target binding site found in the 3' untranslated region of multiple transcripts of mRNA encoded by CAMK2G, corresponding to a target binding site such as BINDING SITE I, BINDING SITE II or BINDING SITE III of FIG. 8. Table 4 illustrates the complementarity of the nucleotide sequences of CAMK2G BINDING SITE, designated SEQ ID:8935, to the nucleotide sequence of GAM7080 RNA, herein designated GAM RNA, also designated SEQ ID:399.

Another function of GAM7080 is therefore inhibition of Calcium/calmodulin-dependent protein kinase (cam kinase) ii gamma (CAMK2G, Accession NP_751910.1). Accordingly, utilities of GAM7080 include diagnosis, prevention and treatment of diseases and clinical conditions associated with CAMK2G.

Calcium/calmodulin-dependent protein kinase (cam kinase) ii gamma (CAMK2G, Accession NP_751911.1) is another GAM7080 target gene, herein designated TARGET GENE. CAMK2G BINDING SITE is a target binding site found in the 3' untranslated region of multiple transcripts of mRNA encoded by CAMK2G, corresponding to a target binding site such as BINDING SITE I, BINDING SITE II or BINDING SITE III of FIG. 8. Table 4 illustrates the complementarity of the nucleotide sequences of CAMK2G BINDING SITE, designated SEQ ID:8935, to the nucleotide sequence of GAM7080 RNA, herein designated GAM RNA, also designated SEQ ID:399.

Another function of GAM7080 is therefore inhibition of Calcium/calmodulin-dependent protein kinase (cam kinase) ii gamma (CAMK2G, Accession NP_751911.1). Accordingly, utilities of GAM7080 include diagnosis, prevention and treatment of diseases and clinical conditions associated with CAMK2G.

Calcium/calmodulin-dependent protein kinase (cam kinase) ii gamma (CAMK2G, Accession NP_751909.1) is another GAM7080 target gene, herein designated TARGET GENE. CAMK2G BINDING SITE is a target binding site found in the 3' untranslated region of multiple transcripts of mRNA encoded by CAMK2G, corresponding to a target binding site such as BINDING SITE I, BINDING SITE II or BINDING SITE III of FIG. 8. Table 4 illustrates the complementarity of the nucleotide sequences of CAMK2G BINDING SITE, designated SEQ ID:8935, to the nucleotide sequence of GAM7080 RNA, herein designated GAM RNA, also designated SEQ ID:399.

Another function of GAM7080 is therefore inhibition of Calcium/calmodulin-dependent protein kinase (cam kinase) ii gamma (CAMK2G, Accession NP_751909.1). Accordingly, utilities of GAM7080 include diagnosis, prevention and treatment of diseases and clinical conditions associated with CAMK2G.

Calcium/calmodulin-dependent protein kinase (cam kinase) ii gamma (CAMK2G, Accession NP_751912.1) is another GAM7080 target gene, herein designated TARGET GENE. CAMK2G BINDING SITE is a target binding site found in the 3' untranslated region of multiple transcripts of mRNA encoded by CAMK2G, corresponding to a target binding site such as BINDING SITE I, BINDING SITE II or BINDING SITE III of FIG. 8. Table 4 illustrates the complementarity of the nucleotide sequences of CAMK2G BINDING SITE, designated SEQ ID:8935, to the nucleotide sequence of GAM7080 RNA, herein designated GAM RNA, also designated SEQ ID:399.

Another function of GAM7080 is therefore inhibition of Calcium/calmodulin-dependent protein kinase (cam kinase) ii gamma (CAMK2G, Accession NP_751912.1). Accordingly, utilities of GAM7080 include diagnosis, prevention and treatment of diseases and clinical conditions associated with CAMK2G.

Calcium/calmodulin-dependent protein kinase (cam kinase) ii gamma (CAMK2G, Accession NP_001213.2) is another GAM7080 target gene, herein designated TARGET GENE. CAMK2G BINDING SITE is a target binding site found in the 3' untranslated region of multiple transcripts of mRNA encoded by CAMK2G, corresponding to a target binding site such as BINDING SITE I, BINDING SITE II or BINDING SITE III of FIG. 8. Table 4 illustrates the complementarity of the nucleotide sequences of CAMK2G BINDING SITE, designated SEQ ID:8935, to the nucleotide sequence of GAM7080 RNA, herein designated GAM RNA, also designated SEQ ID:399.

Another function of GAM7080 is therefore inhibition of Calcium/calmodulin-dependent protein kinase (cam kinase) ii gamma (CAMK2G, Accession NP_001213.2). Accordingly, utilities of GAM7080 include diagnosis, prevention and treatment of diseases and clinical conditions associated with CAMK2G.

Calcium/calmodulin-dependent protein kinase (cam kinase) ii gamma (CAMK2G, Accession NP_751913.1) is another GAM7080 target gene, herein designated TARGET GENE. CAMK2G BINDING SITE is a target binding site found in the 3' untranslated region of multiple transcripts of mRNA encoded by CAMK2G, corresponding to a target binding site such as BINDING SITE I, BINDING SITE II or BINDING SITE III of FIG. 8. Table 4 illustrates the complementarity of the nucleotide sequences of CAMK2G BINDING SITE, designated SEQ ID:8935, to the nucleotide sequence of GAM7080 RNA, herein designated GAM RNA, also designated SEQ ID:399.

Another function of GAM7080 is therefore inhibition of Calcium/calmodulin-dependent protein kinase (cam kinase) ii gamma (CAMK2G, Accession NP_751913.1). Accordingly, utilities of GAM7080 include diagnosis, prevention and treatment of diseases and clinical conditions associated with CAMK2G.

Calpastatin (CAST, Accession NP_775085.1) is another GAM7080 target gene, herein designated TARGET GENE. CAST BINDING SITE is a target binding site found in the 5' untranslated region of multiple transcripts of mRNA encoded by CAST, corresponding to a target binding site such as BINDING SITE I, BINDING SITE II or BINDING SITE III of FIG. 8. Table 4 illustrates the complementarity of the nucleotide sequences of CAST BINDING SITE, designated SEQ ID:6367, to the nucleotide sequence of GAM7080 RNA, herein designated GAM RNA, also designated SEQ ID:399.

Another function of GAM7080 is therefore inhibition of Calpastatin (CAST, Accession NP_775085.1), a gene which is the natural inhibitor of calpain. and therefore may be associated with Rheumatic diseases. Accordingly, utilities of GAM7080 include diagnosis, prevention and treatment of Rheumatic diseases, and of other diseases and clinical conditions associated with CAST.

The function of CAST and its association with various diseases and clinical conditions, has been established by previous studies, as described hereinabove with reference to GAM893.1. Chromobox homolog 1 (hp1 beta homolog drosophila) (CBX1, Accession NP_006798.1) is another GAM7080 target gene, herein designated TARGET GENE. CBX1 BINDING SITE is a target binding site found in the 3' untranslated region of mRNA encoded by CBX1, corresponding to a target binding site such as BINDING SITE I, BINDING SITE II or BINDING SITE III of FIG. 8. Table 4 illustrates the complementarity of the nucleotide sequences of CBX1 BINDING SITE, designated SEQ ID:1246, to the nucleotide sequence of GAM7080 RNA, herein designated GAM RNA, also designated SEQ ID:399.

Another function of GAM7080 is therefore inhibition of Chromobox homolog 1 (hp1 beta homolog drosophila) (CBX1, Accession NP_006798.1). Accordingly, utilities of GAM7080 include diagnosis, prevention and treatment of diseases and clinical conditions associated with CBX1.

Cdc14 cell division cycle 14 homolog b (s. cerevisiae) (CDC14B, Accession NP_201588.1) is another GAM7080 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:14202, to the nucleotide sequence of GAM7080 RNA, herein designated GAM RNA, also designated SEQ ID:399.

Another function of GAM7080 is therefore inhibition of Cdc14 cell division cycle 14 homolog b (s. cerevisiae) (CDC14B, Accession NP_201588.1). Accordingly, utilities of GAM7080 include diagnosis, prevention and treatment of diseases and clinical conditions associated with CDC14B.

Cdc14 cell division cycle 14 homolog b (s. cerevisiae) (CDC14B, Accession NP_003662.1) is another GAM7080 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:14202, to the nucleotide sequence of GAM7080 RNA, herein designated GAM RNA, also designated SEQ ID:399.

Another function of GAM7080 is therefore inhibition of Cdc14 cell division cycle 14 homolog b (s. cerevisiae) (CDC14B, Accession NP_003662.1). Accordingly, utilities of GAM7080 include diagnosis, prevention and treatment of diseases and clinical conditions associated with CDC14B.

CDK11 (Accession XP_166324.1) is another GAM7080 target gene, herein designated TARGET GENE. CDK11 BINDING SITE is a target binding site found in the 3' untranslated region of multiple transcripts of mRNA encoded by CDK11, corresponding to a target binding site such as BINDING SITE I, BINDING SITE II or BINDING SITE III of FIG. 8. Table 4 illustrates the complementarity of the nucleotide sequences of CDK11 BINDING SITE, designated SEQ ID:15392, to the nucleotide sequence of GAM7080 RNA, herein designated GAM RNA, also designated SEQ ID:399.

Another function of GAM7080 is therefore inhibition of CDK11 (Accession XP_166324.1). Accordingly, utilities of GAM7080 include diagnosis, prevention and treatment of diseases and clinical conditions associated with CDK11.

Complexin 1 (CPLX1, Accession NP_006642.1) is another GAM7080 target gene, herein designated TARGET GENE. CPLX1 BINDING SITE is a target binding site found in the 5' untranslated region of mRNA encoded by CPLX1, corresponding to a target binding site such as BINDING SITE I, BINDING SITE II or BINDING SITE III of FIG. 8. Table 4 illustrates the complementarity of the nucleotide sequences of CPLX1 BINDING SITE, designated SEQ ID:2150, to the nucleotide sequence of GAM7080 RNA, herein designated GAM RNA, also designated SEQ ID:399.

Another function of GAM7080 is therefore inhibition of Complexin 1 (CPLX1, Accession NP_006642.1). Accordingly, utilities of GAM7080 include diagnosis, prevention and treatment of diseases and clinical conditions associated with CPLX1.

Deiodinase, iodothyronine, type i (DIO1, Accession NP_000783.2) is another GAM7080 target gene, herein designated TARGET GENE. DIO1 BINDING SITE is a target binding site found in the 3' untranslated region of mRNA encoded by DIO1, corresponding to a target binding site such as BINDING SITE I, BINDING SITE II or BINDING SITE III of FIG. 8. Table 4 illustrates the complementarity of the nucleotide sequences of DIO1 BINDING SITE, designated SEQ ID:977, to the nucleotide sequence of GAM7080 RNA, herein designated GAM RNA, also designated SEQ ID:399.

Another function of GAM7080 is therefore inhibition of Deiodinase, iodothyronine, type i (DIO1, Accession NP_000783.2). Accordingly, utilities of GAM7080 include diagnosis, prevention and treatment of diseases and clinical conditions associated with DIO1.

Deiodinase, iodothyronine, type ii (DIO2, Accession NP_054644.1) is another GAM7080 target gene, herein designated TARGET GENE. DIO2 BINDING SITE is a target binding site found in the 3' untranslated region of multiple transcripts of mRNA encoded by DIO2, corresponding to a target binding site such as BINDING SITE I, BINDING SITE II or BINDING SITE III of FIG. 8. Table 4 illustrates the complementarity of the nucleotide sequences of DIO2 BINDING SITE, designated SEQ ID:16860, to the nucleotide sequence of GAM7080 RNA, herein designated GAM RNA, also designated SEQ ID:399.

Another function of GAM7080 is therefore inhibition of Deiodinase, iodothyronine, type ii (DIO2, Accession NP_054644.1). Accordingly, utilities of GAM7080 include diagnosis, prevention and treatment of diseases and clinical conditions associated with DIO2.

Deiodinase, iodothyronine, type ii (DIO2, Accession NP_000784.2) is another GAM7080 target gene, herein designated TARGET GENE. DIO2 BINDING SITE is a target binding site found in the 3' untranslated region of multiple transcripts of mRNA encoded by DIO2, corresponding to a target binding site such as BINDING SITE I, BINDING SITE II or BINDING SITE III of FIG. 8. Table 4 illustrates the complementarity of the nucleotide sequences of DIO2 BINDING SITE, designated SEQ ID:16860, to the nucleotide sequence of GAM7080 RNA, herein designated GAM RNA, also designated SEQ ID:399.

Another function of GAM7080 is therefore inhibition of Deiodinase, iodothyronine, type ii (DIO2, Accession NP_000784.2). Accordingly, utilities of GAM7080 include diagnosis, prevention and treatment of diseases and clinical conditions associated with DIO2.

Disrupted in schizophrenia 1 (DISC1, Accession NP_061132.1) is another GAM7080 target gene, herein designated TARGET GENE. DISC1 BINDING SITE is a target binding site found in the 3' untranslated region of mRNA encoded by DISC1, corresponding to a target binding site such as BINDING SITE I, BINDING SITE II or BINDING SITE III of FIG. 8. Table 4 illustrates the complementarity of the nucleotide sequences of DISC1 BINDING SITE, designated SEQ ID:9394, to the nucleotide sequence of GAM7080 RNA, herein designated GAM RNA, also designated SEQ ID:399.

Another function of GAM7080 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM7080 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. DKFZP434C212 (Accession XP_044196.3) is another GAM7080 target gene, herein designated TARGET GENE. DKFZP434C212 BINDING SITE is a target binding site found in the 3' untranslated region of mRNA encoded by DKFZP434C212, corresponding to a target binding site such as BINDING SITE I, BINDING SITE II or BINDING SITE III of FIG. 8. Table 4 illustrates the complementarity of the nucleotide sequences of DKFZP434C212 BINDING SITE, designated SEQ ID:8194, to the nucleotide sequence of GAM7080 RNA, herein designated GAM RNA, also designated SEQ ID:399.

Another function of GAM7080 is therefore inhibition of DKFZP434C212 (Accession XP_044196.3). Accordingly, utilities of GAM7080 include diagnosis, prevention and treatment of diseases and clinical conditions associated with DKFZP434C212.

DKFZP434F122 (Accession NP_056458.1) is another GAM7080 target gene, herein designated TARGET GENE. DKFZP434F122 BINDING SITE is a target binding site found in the 3' untranslated region of mRNA encoded by DKFZP434F122, corresponding to a target binding site such as BINDING SITE I, BINDING SITE II or BINDING SITE III of FIG. 8. Table 4 illustrates the complementarity of the nucleotide sequences of DKFZP434F122 BINDING SITE, designated SEQ ID:8462, to the nucleotide sequence of GAM7080 RNA, herein designated GAM RNA, also designated SEQ ID:399.

Another function of GAM7080 is therefore inhibition of DKFZP434F122 (Accession NP_056458.1). Accordingly, utilities of GAM7080 include diagnosis, prevention and treatment of diseases and clinical conditions associated with DKFZP434F122.

DKFZp566D234 (Accession NP_064501.1) is another GAM7080 target gene, herein designated TARGET GENE. DKFZp566D234 BINDING SITE is a target binding site found in the 3' untranslated region of mRNA encoded by DKFZp566D234, corresponding to a target binding site such as BINDING SITE I, BINDING SITE II or BINDING SITE III of FIG. 8. Table 4 illustrates the complementarity of the nucleotide sequences of DKFZp566D234 BINDING SITE, designated SEQ ID:18331, to the nucleotide sequence of GAM7080 RNA, herein designated GAM RNA, also designated SEQ ID:399.

Another function of GAM7080 is therefore inhibition of DKFZp566D234 (Accession NP_064501.1). Accordingly, utilities of GAM7080 include diagnosis, prevention and treatment of diseases and clinical conditions associated with DKFZp566D234.

DKFZp761A078 (Accession XP_089143.5) is another GAM7080 target gene, herein designated TARGET GENE. DKFZp761A078 BINDING SITE is a target binding site found in the 3' untranslated region of mRNA encoded by DKFZp761A078, corresponding to a target binding site such as BINDING SITE I, BINDING SITE II or BINDING SITE III of FIG. 8. Table 4 illustrates the complementarity of the nucleotide sequences of DKFZp761A078 BINDING SITE, designated SEQ ID:11577, to the nucleotide sequence of GAM7080 RNA, herein designated GAM RNA, also designated SEQ ID:399.

Another function of GAM7080 is therefore inhibition of DKFZp761A078 (Accession XP_089143.5). Accordingly, utilities of GAM7080 include diagnosis, prevention and treatment of diseases and clinical conditions associated with DKFZp761A078.

DKFZp761H0421 (Accession NP_775102.1) is another GAM7080 target gene, herein designated TARGET GENE. DKFZp761H0421 BINDING SITE is a target binding site found in the 3' untranslated region of mRNA encoded by DKFZp761H0421, corresponding to a target binding site such as BINDING SITE I, BINDING SITE II or BINDING SITE III of FIG. 8. Table 4 illustrates the complementarity of the nucleotide sequences of DKFZp761H0421 BINDING SITE, designated SEQ ID:4006, to the nucleotide sequence of GAM7080 RNA, herein designated GAM RNA, also designated SEQ ID:399.

Another function of GAM7080 is therefore inhibition of DKFZp761H0421 (Accession NP_775102.1). Accordingly, utilities of GAM7080 include diagnosis, prevention and treatment of diseases and clinical conditions associated with DKFZp761H0421.

Dentin matrix acidic phosphoprotein (DMP1, Accession NP_004398.1) is another GAM7080 target gene, herein designated TARGET GENE. DMP1 BINDING SITE is a target binding site found in the 3' untranslated region of mRNA encoded by DMP1, corresponding to a target binding site such as BINDING SITE I, BINDING SITE II or BINDING SITE III of FIG. 8. Table 4 illustrates the complementarity of the nucleotide sequences of DMP1 BINDING SITE, designated SEQ ID:895, to the nucleotide sequence of GAM7080 RNA, herein designated GAM RNA, also designated SEQ ID:399.

Another function of GAM7080 is therefore inhibition of Dentin matrix acidic phosphoprotein (DMP1, Accession NP_004398.1), a gene which regulates mineralization of bone and dentin. Accordingly, utilities of GAM7080 include diagnosis, prevention and treatment of diseases and clinical conditions associated with DMP1.

The function of DMP1 and its association with various diseases and clinical conditions, has been established by previous studies, as described hereinabove with reference to GAM100.1. Dna (cytosine-5-)-methyltransferase 3 alpha (DNMT3A, Accession NP_715640.1) is another GAM7080 target gene, herein designated TARGET GENE. DNMT3A BINDING SITE is a target binding site found in the 5' untranslated region of multiple transcripts of mRNA encoded by DNMT3A, corresponding to a target binding site such as BINDING SITE I, BINDING SITE II or BINDING SITE III of FIG. 8. Table 4 illustrates the complementarity of the nucleotide sequences of DNMT3A BINDING SITE, designated SEQ ID:6530, to the nucleotide sequence of GAM7080 RNA, herein designated GAM RNA, also designated SEQ ID:399.

Another function of GAM7080 is therefore inhibition of Dna (cytosine-5-)-methyltransferase 3 alpha (DNMT3A, Accession NP_715640.1), a gene which intervenes in de novo methylation of DNA. Accordingly, utilities of GAM7080 include diagnosis, prevention and treatment of diseases and clinical conditions associated with DNMT3A.

The function of DNMT3A and its association with various diseases and clinical conditions, has been established by previous studies, as described hereinabove with reference to GAM47.1. Dihydropyrimidinase (DPy, Accession NP_001376.1) is another GAM7080 target gene, herein designated TARGET GENE. DPYS BINDING SITE is a target binding site found in the 3' untranslated region of mRNA encoded by DPy, corresponding to a target binding site such as BINDING SITE I, BINDING SITE II or BINDING SITE III of FIG. 8. Table 4 illustrates the complementarity of the nucleotide sequences of DPYS BINDING SITE, designated SEQ ID:2493, to the nucleotide sequence of GAM7080 RNA, herein designated GAM RNA, also designated SEQ ID:399.

Another function of GAM7080 is therefore inhibition of Dihydropyrimidinase (DPy, Accession NP_001376.1). Accordingly, utilities of GAM7080 include diagnosis, prevention and treatment of diseases and clinical conditions associated with DPYS.

Ets homologous factor (EHF, Accession NP_758433.1) is another GAM7080 target gene, herein designated TARGET GENE. EHF BINDING SITE is a target binding site found in the 3' untranslated region of multiple transcripts of mRNA encoded by EHF, corresponding to a target binding site such as BINDING SITE I, BINDING SITE II or BINDING SITE III of FIG. 8. Table 4 illustrates the complementarity of the nucleotide sequences of EHF BINDING SITE, designated SEQ ID:8009, to the nucleotide sequence of GAM7080 RNA, herein designated GAM RNA, also designated SEQ ID:399.

Another function of GAM7080 is therefore inhibition of Ets homologous factor (EHF, Accession NP_758433.1), a gene which is Member of the ESE subfamily of Ets transcription factors. Accordingly, utilities of GAM7080 include diagnosis, prevention and treatment of diseases and clinical conditions associated with EHF.

The function of EHF and its association with various diseases and clinical conditions, has been established by previous studies, as described hereinabove with reference to GAM47.1. Ets homologous factor (EHF, Accession NP_036285.2) is another GAM7080 target gene, herein designated TARGET GENE. EHF BINDING SITE is a target binding site found in the 3' untranslated region of multiple transcripts of mRNA encoded by EHF, corresponding to a target binding site such as BINDING SITE I, BINDING SITE II or BINDING SITE III of FIG. 8. Table 4 illustrates the complementarity of the nucleotide sequences of EHF BINDING SITE, designated SEQ ID:8009, to the nucleotide sequence of GAM7080 RNA, herein designated GAM RNA, also designated SEQ ID:399.

Another function of GAM7080 is therefore inhibition of Ets homologous factor (EHF, Accession NP_036285.2), a gene which is Member of the ESE subfamily of Ets transcription factors. Accordingly, utilities of GAM7080 include diagnosis, prevention and treatment of diseases and clinical conditions associated with EHF.

The function of EHF and its association with various diseases and clinical conditions, has been established by previous studies, as described hereinabove with reference to GAM47.1. ELYS (Accession NP_056261.1) is another GAM7080 target gene, herein designated TARGET GENE. ELYS BINDING SITE is a target binding site found in the 5' untranslated region of mRNA encoded by ELy, corresponding to a target binding site such as BINDING SITE I, BINDING SITE II or BINDING SITE III of FIG. 8. Table 4 illustrates the complementarity of the nucleotide sequences of ELYS BINDING SITE, designated SEQ ID:16818, to the nucleotide sequence of GAM7080 RNA, herein designated GAM RNA, also designated SEQ ID:399.

Another function of GAM7080 is therefore inhibition of ELYS (Accession NP_056261.1). Accordingly, utilities of GAM7080 include diagnosis, prevention and treatment of diseases and clinical conditions associated with ELYS.

ENTH (Accession NP_055481.1) is another GAM7080 target gene, herein designated TARGET GENE. ENTH BINDING SITE is a target binding site found in the 3' untranslated region of mRNA encoded by ENTH, corresponding to a target binding site such as BINDING SITE I, BINDING SITE II or BINDING SITE III of FIG. 8. Table 4 illustrates the complementarity of the nucleotide sequences of ENTH BINDING SITE, designated SEQ ID:9793, to the nucleotide sequence of GAM7080 RNA, herein designated GAM RNA, also designated SEQ ID:399.

Another function of GAM7080 is therefore inhibition of ENTH (Accession NP_055481.1). Accordingly, utilities of GAM7080 include diagnosis, prevention and treatment of diseases and clinical conditions associated with ENTH.

Epha3 (EPHA3, Accession NP_005224.2) is another GAM7080 target gene, herein designated TARGET GENE. EPHA3 BINDING SITE is a target binding site found in the 3' untranslated region of mRNA encoded by EPHA3, corresponding to a target binding site such as BINDING SITE I, BINDING SITE II or BINDING SITE III of FIG. 8. Table 4 illustrates the complementarity of the nucleotide sequences of EPHA3 BINDING SITE, designated SEQ ID:2129, to the nucleotide sequence of GAM7080 RNA, herein designated GAM RNA, also designated SEQ ID:399.

Another function of GAM7080 is therefore inhibition of Epha3 (EPHA3, Accession NP_005224.2), a gene which binds to ephrin-a2, -a3, -a4 and -a5. could play a role in lymphoid function. Accordingly, utilities of GAM7080 include diagnosis, prevention and treatment of diseases and clinical conditions associated with EPHA3.

The function of EPHA3 and its association with various diseases and clinical conditions, has been established by previous studies, as described hereinabove with reference to GAM653.1. Erbb2 interacting protein (ERBB2IP, Accession NP_061165.1) is another GAM7080 target gene, herein designated TARGET GENE. ERBB2IP BINDING SITE is a target binding site found in the 3' untranslated region of mRNA encoded by ERBB2IP, corresponding to a target binding site such as BINDING SITE I, BINDING SITE II or BINDING SITE III of FIG. 8. Table 4 illustrates the complementarity of the nucleotide sequences of ERBB2IP BINDING SITE, designated SEQ ID:13817, to the nucleotide sequence of GAM7080 RNA, herein designated GAM RNA, also designated SEQ ID:399.

Another function of GAM7080 is therefore inhibition of Erbb2 interacting protein (ERBB2IP, Accession NP_061165.1), a gene which ERBB2 interacting protein; acts as an adaptor for the receptor ERBB2/HER2. Accordingly, utilities of GAM7080 include diagnosis, prevention and treatment of diseases and clinical conditions associated with ERBB2IP.

The function of ERBB2IP and its association with various diseases and clinical conditions, has been established by previous studies, as described hereinabove with reference to GAM388.1. FLJ10945 (Accession NP_060750.1) is another GAM7080 target gene, herein designated TARGET GENE. FLJ10945 BINDING SITE is a target binding site found in the 3' untranslated region of mRNA encoded by FLJ10945, corresponding to a target binding site such as BINDING SITE I, BINDING SITE II or BINDING SITE III of FIG. 8. Table 4 illustrates the complementarity of the nucleotide sequences of FLJ10945 BINDING SITE, designated SEQ ID:11146, to the nucleotide sequence of GAM7080 RNA, herein designated GAM RNA, also designated SEQ ID:399.

Another function of GAM7080 is therefore inhibition of FLJ10945 (Accession NP_060750.1). Accordingly, utilities of GAM7080 include diagnosis, prevention and treatment of diseases and clinical conditions associated with FLJ10945.

FLJ11016 (Accession NP_060771.1) is another GAM7080 target gene, herein designated TARGET GENE. FLJ11016 BINDING SITE is a target binding site found in the 5' untranslated region of mRNA encoded by FLJ11016, corresponding to a target binding site such as BINDING SITE I, BINDING SITE II or BINDING SITE III of FIG. 8. Table 4 illustrates the complementarity of the nucleotide sequences of FLJ11016 BINDING SITE, designated SEQ ID:424, to the nucleotide sequence of GAM7080 RNA, herein designated GAM RNA, also designated SEQ ID:399.

Another function of GAM7080 is therefore inhibition of FLJ11016 (Accession NP_060771.1). Accordingly, utilities of GAM7080 include diagnosis, prevention and treatment of diseases and clinical conditions associated with FLJ11016.

FLJ11088 (Accession NP_060788.1) is another GAM7080 target gene, herein designated TARGET GENE. FLJ11088 BINDING SITE is a target binding site found in the 5' untranslated region of mRNA encoded by FLJ11088, corresponding to a target binding site such as BINDING SITE I, BINDING SITE II or BINDING SITE III of FIG. 8. Table 4 illustrates the complementarity of the nucleotide sequences of FLJ11088 BINDING SITE, designated SEQ ID:4825, to the nucleotide sequence of GAM7080 RNA, herein designated GAM RNA, also designated SEQ ID:399.

Another function of GAM7080 is therefore inhibition of FLJ11088 (Accession NP_060788.1). Accordingly, utilities of GAM7080 include diagnosis, prevention and treatment of diseases and clinical conditions associated with FLJ11088.

FLJ12770 (Accession NP_115550.2) is another GAM7080 target gene, herein designated TARGET GENE. FLJ12770 BINDING SITE is a target binding site found in the 3' untranslated region of mRNA encoded by FLJ12770, corresponding to a target binding site such as BINDING SITE I, BINDING SITE II or BINDING SITE III of FIG. 8. Table 4 illustrates the complementarity of the nucleotide sequences of FLJ12770 BINDING SITE, designated SEQ ID:10912, to the nucleotide sequence of GAM7080 RNA, herein designated GAM RNA, also designated SEQ ID:399.

Another function of GAM7080 is therefore inhibition of FLJ12770 (Accession NP_115550.2). Accordingly, utilities of GAM7080 include diagnosis, prevention and treatment of diseases and clinical conditions associated with FLJ12770.

FLJ14166 (Accession NP_078841.1) is another GAM7080 target gene, herein designated TARGET GENE. FLJ14166 BINDING SITE is a target binding site found in the 3' untranslated region of mRNA encoded by FLJ14166, corresponding to a target binding site such as BINDING SITE I, BINDING SITE II or BINDING SITE III of FIG. 8. Table 4 illustrates the complementarity of the nucleotide sequences of FLJ14166 BINDING SITE, designated SEQ ID:17295, to the nucleotide sequence of GAM7080 RNA, herein designated GAM RNA, also designated SEQ ID:399.

Another function of GAM7080 is therefore inhibition of FLJ14166 (Accession NP_078841.1). Accordingly, utilities of GAM7080 include diagnosis, prevention and treatment of diseases and clinical conditions associated with FLJ14166.

FLJ20748 (Accession NP_061893.1) is another GAM7080 target gene, herein designated TARGET GENE. FLJ20748 BINDING SITE is a target binding site found in the 3' untranslated region of mRNA encoded by FLJ20748, corresponding to a target binding site such as BINDING SITE I, BINDING SITE II or BINDING SITE III of FIG. 8. Table 4 illustrates the complementarity of the nucleotide sequences of FLJ20748 BINDING SITE, designated SEQ ID:7141, to the nucleotide sequence of GAM7080 RNA, herein designated GAM RNA, also designated SEQ ID:399.

Another function of GAM7080 is therefore inhibition of FLJ20748 (Accession NP_061893.1). Accordingly, utilities of GAM7080 include diagnosis, prevention and treatment of diseases and clinical conditions associated with FLJ20748.

FLJ21596 (Accession NP_079099.1) is another GAM7080 target gene, herein designated TARGET GENE. FLJ21596 BINDING SITE is a target binding site found in the 3' untranslated region of mRNA encoded by FLJ21596, corresponding to a target binding site such as BINDING SITE I, BINDING SITE II or BINDING SITE III of FIG. 8. Table 4 illustrates the complementarity of the nucleotide sequences of FLJ21596 BINDING SITE, designated SEQ ID:8448, to the nucleotide sequence of GAM7080 RNA, herein designated GAM RNA, also designated SEQ ID:399.

Another function of GAM7080 is therefore inhibition of FLJ21596 (Accession NP_079099.1). Accordingly, utilities of GAM7080 include diagnosis, prevention and treatment of diseases and clinical conditions associated with FLJ21596.

FLJ21742 (Accession NP_115583.1) is another GAM7080 target gene, herein designated TARGET GENE. FLJ21742 BINDING SITE is a target binding site found in the 3' untranslated region of mRNA encoded by FLJ21742, corresponding to a target binding site such as BINDING SITE I, BINDING SITE II or BINDING SITE III of FIG. 8. Table 4 illustrates the complementarity of the nucleotide sequences of FLJ21742 BINDING SITE, designated SEQ ID:8081, to the nucleotide sequence of GAM7080 RNA, herein designated GAM RNA, also designated SEQ ID:399.

Another function of GAM7080 is therefore inhibition of FLJ21742 (Accession NP_115583.1). Accordingly, utilities of GAM7080 include diagnosis, prevention and treatment of diseases and clinical conditions associated with FLJ21742.

FLJ23056 (Accession NP_078858.1) is another GAM7080 target gene, herein designated TARGET GENE. FLJ23056 BINDING SITE is a target binding site found in the 3' untranslated region of mRNA encoded by FLJ23056, corresponding to a target binding site such as BINDING SITE I, BINDING SITE II or BINDING SITE III of FIG. 8. Table 4 illustrates the complementarity of the nucleotide sequences of FLJ23056 BINDING SITE, designated SEQ ID:1870, to the nucleotide sequence of GAM7080 RNA, herein designated GAM RNA, also designated SEQ ID:399.

Another function of GAM7080 is therefore inhibition of FLJ23056 (Accession NP_078858.1). Accordingly, utilities of GAM7080 include diagnosis, prevention and treatment of diseases and clinical conditions associated with FLJ23056.

FLJ32549 (Accession NP_689653.1) is another GAM7080 target gene, herein designated TARGET GENE. FLJ32549 BINDING SITE is a target binding site found in the 3' untranslated region of mRNA encoded by FLJ32549, corresponding to a target binding site such as BINDING SITE I, BINDING SITE II or BINDING SITE III of FIG. 8. Table 4 illustrates the complementarity of the nucleotide sequences of FLJ32549 BINDING SITE, designated SEQ ID:4634, to the nucleotide sequence of GAM7080 RNA, herein designated GAM RNA, also designated SEQ ID:399.

Another function of GAM7080 is therefore inhibition of FLJ32549 (Accession NP_689653.1). Accordingly, utilities of GAM7080 include diagnosis, prevention and treatment of diseases and clinical conditions associated with FLJ32549.

FLJ32926 (Accession NP_653178.1) is another GAM7080 target gene, herein designated TARGET GENE. FLJ32926 BINDING SITE is a target binding site found in the 3' untranslated region of mRNA encoded by FLJ32926, corresponding to a target binding site such as BINDING SITE I, BINDING SITE II or BINDING SITE III of FIG. 8. Table 4 illustrates the complementarity of the nucleotide sequences of FLJ32926 BINDING SITE, designated SEQ ID:9432, to the nucleotide sequence of GAM7080 RNA, herein designated GAM RNA, also designated SEQ ID:399.

Another function of GAM7080 is therefore inhibition of FLJ32926 (Accession NP_653178.1). Accordingly, utilities of GAM7080 include diagnosis, prevention and treatment of diseases and clinical conditions associated with FLJ32926.

FLJ36331 (Accession XP_211925.1) is another GAM7080 target gene, herein designated TARGET GENE. FLJ36331 BINDING SITE is a target binding site found in the 3' untranslated region of mRNA encoded by FLJ36331, corresponding to a target binding site such as BINDING SITE I, BINDING SITE II or BINDING SITE III of FIG. 8. Table 4 illustrates the complementarity of the nucleotide sequences of FLJ36331 BINDING SITE, designated SEQ ID:18131, to the nucleotide sequence of GAM7080 RNA, herein designated GAM RNA, also designated SEQ ID:399.

Another function of GAM7080 is therefore inhibition of FLJ36331 (Accession XP_211925.1). Accordingly, utilities of GAM7080 include diagnosis, prevention and treatment of diseases and clinical conditions associated with FLJ36331.

FLJ38773 (Accession NP_848623.1) is another GAM7080 target gene, herein designated TARGET GENE. FLJ38773 BINDING SITE is a target binding site found in the 5' untranslated region of mRNA encoded by FLJ38773, corresponding to a target binding site such as BINDING SITE I, BINDING SITE II or BINDING SITE III of FIG. 8. Table 4 illustrates the complementarity of the nucleotide sequences of FLJ38773 BINDING SITE, designated SEQ ID:6074, to the nucleotide sequence of GAM7080 RNA, herein designated GAM RNA, also designated SEQ ID:399.

Another function of GAM7080 is therefore inhibition of FLJ38773 (Accession NP_848623.1). Accordingly, utilities of GAM7080 include diagnosis, prevention and treatment of diseases and clinical conditions associated with FLJ38773.

Frequently rearranged in advanced t-cell lymphomas 2 (FRAT2, Accession NP_036215.1) is another GAM7080 target gene, herein designated TARGET GENE. FRAT2 BINDING SITE is a target binding site found in the 3' untranslated region of mRNA encoded by FRAT2, corresponding to a target binding site such as BINDING SITE I, BINDING SITE II or BINDING SITE III of FIG. 8. Table 4 illustrates the complementarity of the nucleotide sequences of FRAT2 BINDING SITE, designated SEQ ID:9254, to the nucleotide sequence of GAM7080 RNA, herein designated GAM RNA, also designated SEQ ID:399.

Another function of GAM7080 is therefore inhibition of Frequently rearranged in advanced t-cell lymphomas 2 (FRAT2, Accession NP_036215.1), a gene which binds gsk-3 and prevents gsk-3-dependent phosphorylation. and therefore may be associated with Cancer. Accordingly, utilities of GAM7080 include diagnosis, prevention and treatment of cancer, and of other diseases and clinical conditions associated with FRAT2.

The function of FRAT2 and its association with various diseases and clinical conditions, has been established by previous studies, as described hereinabove with reference to GAM1044.1. Gdnf family receptor alpha 1 (GFRA1, Accession NP_665736.1) is another GAM7080 target gene, herein designated TARGET GENE. GFRA1 BINDING SITE is a target binding site found in the 3' untranslated region of multiple transcripts of mRNA encoded by GFRA1, corresponding to a target binding site such as BINDING SITE I, BINDING SITE II or BINDING SITE III of FIG. 8. Table 4 illustrates the complementarity of the nucleotide sequences of GFRA1 BINDING SITE, designated SEQ ID:2463, to the nucleotide sequence of GAM7080 RNA, herein designated GAM RNA, also designated SEQ ID:399.

Another function of GAM7080 is therefore inhibition of Gdnf family receptor alpha 1 (GFRA1, Accession NP_665736.1), a gene which mediates the gdnf-induced autophosphorylation and activation of the ret receptor (by similarity). and therefore may be associated with Hirschsprung disease. Accordingly, utilities of GAM7080 include diagnosis, prevention and treatment of Hirschsprung disease, and of other diseases and clinical conditions associated with GFRA1.

The function of GFRA1 and its association with various diseases and clinical conditions, has been established by previous studies, as described hereinabove with reference to GAM64.1. Gdnf family receptor alpha 1 (GFRA1, Accession NP_005255.1) is another GAM7080 target gene, herein designated TARGET GENE. GFRA1 BINDING SITE is a target binding site found in the 3' untranslated region of multiple transcripts of mRNA encoded by GFRA1, corresponding to a target binding site such as BINDING SITE I, BINDING SITE II or BINDING SITE III of FIG. 8. Table 4 illustrates the complementarity of the nucleotide sequences of GFRA1 BINDING SITE, designated SEQ ID:2463, to the nucleotide sequence of GAM7080 RNA, herein designated GAM RNA, also designated SEQ ID:399.

Another function of GAM7080 is therefore inhibition of Gdnf family receptor alpha 1 (GFRA1, Accession NP_005255.1), a gene which mediates the gdnf-induced autophosphorylation and activation of the ret receptor (by similarity). and therefore may be associated with Hirschsprung disease. Accordingly, utilities of GAM7080 include diagnosis, prevention and treatment of Hirschsprung disease, and of other diseases and clinical conditions associated with GFRA1.

The function of GFRA1 and its association with various diseases and clinical conditions, has been established by previous studies, as described hereinabove with reference to GAM64.1. Guanine nucleotide binding protein (g protein), q polypeptide (GNAQ, Accession NP_002063.1) is another GAM7080 target gene, herein designated TARGET GENE. GNAQ BINDING SITE is a target binding site found in the 3' untranslated region of mRNA encoded by GNAQ, corresponding to a target binding site such as BINDING SITE I, BINDING SITE II or BINDING SITE III of FIG. 8. Table 4 illustrates the complementarity of the nucleotide sequences of GNAQ BINDING SITE, designated SEQ ID:11690, to the nucleotide sequence of GAM7080 RNA, herein designated GAM RNA, also designated SEQ ID:399.

Another function of GAM7080 is therefore inhibition of Guanine nucleotide binding protein (g protein), q polypeptide (GNAQ, Accession NP_002063.1), a gene which transduces signals from G protein-coupled receptors and mediates activation of phospholipase C beta. Accordingly, utilities of GAM7080 include diagnosis, prevention and treatment of diseases and clinical conditions associated with GNAQ.

The function of GNAQ and its association with various diseases and clinical conditions, has been established by previous studies, as described hereinabove with reference to GAM522.1. G protein pathway suppressor 2 (GPS2, Accession NP_116329.1) is another GAM7080 target gene, herein designated TARGET GENE. GPS2 BINDING SITE is a target binding site found in the 5' untranslated region of multiple transcripts of mRNA encoded by GPS2, corresponding to a target binding site such as BINDING SITE I, BINDING SITE II or BINDING SITE III of FIG. 8. Table 4 illustrates the complementarity of the nucleotide sequences of GPS2 BINDING SITE, designated SEQ ID:5146, to the nucleotide sequence of GAM7080 RNA, herein designated GAM RNA, also designated SEQ ID:399.

Another function of GAM7080 is therefore inhibition of G protein pathway suppressor 2 (GPS2, Accession NP_116329.1). Accordingly, utilities of GAM7080 include diagnosis, prevention and treatment of diseases and clinical conditions associated with GPS2.

G protein pathway suppressor 2 (GPS2, Accession NP_004480.1) is another GAM7080 target gene, herein designated TARGET GENE. GPS2 BINDING SITE is a target binding site found in the 5' untranslated region of multiple transcripts of mRNA encoded by GPS2, corresponding to a target binding site such as BINDING SITE I, BINDING SITE II or BINDING SITE III of FIG. 8. Table 4 illustrates the complementarity of the nucleotide sequences of GPS2 BINDING SITE, designated SEQ ID:5146, to the nucleotide sequence of GAM7080 RNA, herein designated GAM RNA, also designated SEQ ID:399.

Another function of GAM7080 is therefore inhibition of G protein pathway suppressor 2 (GPS2, Accession NP_004480.1). Accordingly, utilities of GAM7080 include diagnosis, prevention and treatment of diseases and clinical conditions associated with GPS2.

Glutamate receptor, metabotropic 4 (GRM4, Accession NP_000832.1) is another GAM7080 target gene, herein designated TARGET GENE. GRM4 BINDING SITE is a target binding site found in the 3' untranslated region of mRNA encoded by GRM4, corresponding to a target binding site such as BINDING SITE I, BINDING SITE II or BINDING SITE III of FIG. 8. Table 4 illustrates the complementarity of the nucleotide sequences of GRM4 BINDING SITE, designated SEQ ID:9216, to the nucleotide sequence of GAM7080 RNA, herein designated GAM RNA, also designated SEQ ID:399.

Another function of GAM7080 is therefore inhibition of Glutamate receptor, metabotropic 4 (GRM4, Accession NP_000832.1), a gene which is mediated by a g-protein that inhibits adenylate cyclase activity. Accordingly, utilities of GAM7080 include diagnosis, prevention and treatment of diseases and clinical conditions associated with GRM4.

The function of GRM4 and its association with various diseases and clinical conditions, has been established by previous studies, as described hereinabove with reference to GAM223.1. Gastrin-releasing peptide receptor (GRPR, Accession NP_005305.1) is another GAM7080 target gene, herein designated TARGET GENE. GRPR BINDING SITE is a target binding site found in the 5' untranslated region of mRNA encoded by GRPR, corresponding to a target binding site such as BINDING SITE I, BINDING SITE II or BINDING SITE III of FIG. 8. Table 4 illustrates the complementarity of the nucleotide sequences of GRPR BINDING SITE, designated SEQ ID:12903, to the nucleotide sequence of GAM7080 RNA, herein designated GAM RNA, also designated SEQ ID:399.

Another function of GAM7080 is therefore inhibition of Gastrin-releasing peptide receptor (GRPR, Accession NP_005305.1), a gene which mediates its action by association with g proteins that activate a phosphatidylinositol-calcium second messenger system. Accordingly, utilities of GAM7080 include diagnosis, prevention and treatment of diseases and clinical conditions associated with GRPR.

The function of GRPR and its association with various diseases and clinical conditions, has been established by previous studies, as described hereinabove with reference to GAM106.1. Glutathione s-transferase m3 (brain) (GSTM3, Accession NP_000840.2) is another GAM7080 target gene, herein designated TARGET GENE. GSTM3 BINDING SITE is a target binding site found in the 5' untranslated region of mRNA encoded by GSTM3, corresponding to a target binding site such as BINDING SITE I, BINDING SITE II or BINDING SITE III of FIG. 8. Table 4 illustrates the complementarity of the nucleotide sequences of GSTM3 BINDING SITE, designated SEQ ID:10695, to the nucleotide sequence of GAM7080 RNA, herein designated GAM RNA, also designated SEQ ID:399.

Another function of GAM7080 is therefore inhibition of Glutathione s-transferase m3 (brain) (GSTM3, Accession NP_000840.2), a gene which conjugates reduced glutathione to a wide number of exogenous and endogenous hydrophobic electrophiles. Accordingly, utilities of GAM7080 include diagnosis, prevention and treatment of diseases and clinical conditions associated with GSTM3.

The function of GSTM3 and its association with various diseases and clinical conditions, has been established by previous studies, as described hereinabove with reference to GAM442.1. H2AV (Accession NP_619541.1) is another GAM7080 target gene, herein designated TARGET GENE. H2AV BINDING SITE is a target binding site found in the 3' untranslated region of multiple transcripts of mRNA encoded by H2AV, corresponding to a target binding site such as BINDING SITE I, BINDING SITE II or BINDING SITE III of FIG. 8. Table 4 illustrates the complementarity of the nucleotide sequences of H2AV BINDING SITE, designated SEQ ID:9227, to the nucleotide sequence of GAM7080 RNA, herein designated GAM RNA, also designated SEQ ID:399.

Another function of GAM7080 is therefore inhibition of H2AV (Accession NP_619541.1). Accordingly, utilities of GAM7080 include diagnosis, prevention and treatment of diseases and clinical conditions associated with H2AV.

Histone deacetylase 9 (HDAC9, Accession NP_055522.1) is another GAM7080 target gene, herein designated TARGET GENE. HDAC9 BINDING SITE is a target binding site found in the 3' untranslated region of multiple transcripts of mRNA encoded by HDAC9, corresponding to a target binding site such as BINDING SITE I, BINDING SITE II or BINDING SITE III of FIG. 8. Table 4 illustrates the complementarity of the nucleotide sequences of HDAC9 BINDING SITE, designated SEQ ID:2779, to the nucleotide sequence of GAM7080 RNA, herein designated GAM RNA, also designated SEQ ID:399.

Another function of GAM7080 is therefore inhibition of Histone deacetylase 9 (HDAC9, Accession NP_055522.1). Accordingly, utilities of GAM7080 include diagnosis, prevention and treatment of diseases and clinical conditions associated with HDAC9.

Hect domain and rld 3 (HERC3, Accession NP_055421.1) is another GAM7080 target gene, herein designated TARGET GENE. HERC3 BINDING SITE is a target binding site found in the 3' untranslated region of mRNA encoded by HERC3, corresponding to a target binding site such as BINDING SITE I, BINDING SITE II or BINDING SITE III of FIG. 8. Table 4 illustrates the complementarity of the nucleotide sequences of HERC3 BINDING SITE, designated SEQ ID:4462, to the nucleotide sequence of GAM7080 RNA, herein designated GAM RNA, also designated SEQ ID:399.

Another function of GAM7080 is therefore inhibition of Hect domain and rld 3 (HERC3, Accession NP_055421.1). Accordingly, utilities of GAM7080 include diagnosis, prevention and treatment of diseases and clinical conditions associated with HERC3.

High-mobility group 20a (HMG20A, Accession NP_060670.1) is another GAM7080 target gene, herein designated TARGET GENE. HMG20A BINDING SITE is a target binding site found in the 5' untranslated region of mRNA encoded by HMG20A, corresponding to a target binding site such as BINDING SITE I, BINDING SITE II or BINDING SITE III of FIG. 8. Table 4 illustrates the complementarity of the nucleotide sequences of HMG20A BINDING SITE, designated SEQ ID:15708, to the nucleotide sequence of GAM7080 RNA, herein designated GAM RNA, also designated SEQ ID:399.

Another function of GAM7080 is therefore inhibition of High-mobility group 20a (HMG20A, Accession NP_060670.1). Accordingly, utilities of GAM7080 include diagnosis, prevention and treatment of diseases and clinical conditions associated with HMG20A.

HSPC052 (Accession NP_054869.1) is another GAM7080 target gene, herein designated TARGET GENE. HSPC052 BINDING SITE is a target binding site found in the 3' untranslated region of mRNA encoded by HSPC052, corresponding to a target binding site such as BINDING SITE I, BINDING SITE II or BINDING SITE III of FIG. 8. Table 4 illustrates the complementarity of the nucleotide sequences of HSPC052 BINDING SITE, designated SEQ ID:19338, to the nucleotide sequence of GAM7080 RNA, herein designated GAM RNA, also designated SEQ ID:399.

Another function of GAM7080 is therefore inhibition of HSPC052 (Accession NP_054869.1). Accordingly, utilities of GAM7080 include diagnosis, prevention and treatment of diseases and clinical conditions associated with HSPC052.

HSPC132 (Accession NP_057483.1) is another GAM7080 target gene, herein designated TARGET GENE. HSPC132 BINDING SITE is a target binding site found in the 3' untranslated region of mRNA encoded by HSPC132, corresponding to a target binding site such as BINDING SITE I, BINDING SITE II or BINDING SITE III of FIG. 8. Table 4 illustrates the complementarity of the nucleotide sequences of HSPC132 BINDING SITE, designated SEQ ID:9884, to the nucleotide sequence of GAM7080 RNA, herein designated GAM RNA, also designated SEQ ID:399.

Another function of GAM7080 is therefore inhibition of HSPC132 (Accession NP_057483.1). Accordingly, utilities of GAM7080 include diagnosis, prevention and treatment of diseases and clinical conditions associated with HSPC132.

5-hydroxytryptamine (serotonin) receptor 2c (HTR2C, Accession NP_000859.1) is another GAM7080 target gene, herein designated TARGET GENE. HTR2C BINDING SITE is a target binding site found in the 3' untranslated region of mRNA encoded by HTR2C, corresponding to a target binding site such as BINDING SITE I, BINDING SITE II or BINDING SITE III of FIG. 8. Table 4 illustrates the complementarity of the nucleotide sequences of HTR2C BINDING SITE, designated SEQ ID:17294, to the nucleotide sequence of GAM7080 RNA, herein designated GAM RNA, also designated SEQ ID:399.

Another function of GAM7080 is therefore inhibition of 5-hydroxytryptamine (serotonin) receptor 2c (HTR2C, Accession NP_000859.1), a gene which activates phospholipase C and regulates intracellular calcium flux. Accordingly, utilities of GAM7080 include diagnosis, prevention and treatment of diseases and clinical conditions associated with HTR2C.

The function of HTR2C and its association with various diseases and clinical conditions, has been established by previous studies, as described hereinabove with reference to GAM536.1. Islet cell autoantigen 1, 69 kda (ICA1, Accession NP_071683.1) is another GAM7080 target gene, herein designated TARGET GENE. ICA1 BINDING SITE is a target binding site found in the 3' untranslated region of multiple transcripts of mRNA encoded by ICA1, corresponding to a target binding site such as BINDING SITE I, BINDING SITE II or BINDING SITE III of FIG. 8. Table 4 illustrates the complementarity of the nucleotide sequences of ICA1 BIND- ING SITE, designated SEQ ID:8564, to the nucleotide sequence of GAM7080 RNA, herein designated GAM RNA, also designated SEQ ID:399.

Another function of GAM7080 is therefore inhibition of Islet cell autoantigen 1, 69 kda (ICA1, Accession NP_071683.1), a gene which encodes Islet cell autoantigen 1 and therefore may be associated with Insulin- dependent diabetes mellitus. Accordingly, utilities of GAM7080 include diagnosis, prevention and treatment of Insulin-dependent diabetes mellitus, and of other diseases and clinical conditions associated with ICA1.

The function of ICA1 and its association with various diseases and clinical conditions, has been established by previous studies, as described hereinabove with reference to GAM94.1. Islet cell autoantigen 1, 69 kda (ICA1, Accession NP_004959.1) is another GAM7080 target gene, herein designated TARGET GENE. ICA1 BINDING SITE is a target binding site found in the 3' untranslated region of multiple transcripts of mRNA encoded by ICA1, corresponding to a target binding site such as BINDING SITE I, BINDING SITE II or BINDING SITE III of FIG. 8. Table 4 illustrates the complementarity of the nucleotide sequences of ICA1 BINDING SITE, designated SEQ ID:8564, to the nucleotide sequence of GAM7080 RNA, herein designated GAM RNA, also designated SEQ ID:399.

Another function of GAM7080 is therefore inhibition of Islet cell autoantigen 1, 69 kda (ICA1, Accession NP_004959.1), a gene which encodes Islet cell autoantigen 1 and therefore may be associated with Insulin- dependent diabetes mellitus. Accordingly, utilities of GAM7080 include diagnosis, prevention and treatment of Insulin-dependent diabetes mellitus, and of other diseases and clinical conditions associated with ICA1.

The function of ICA1 and its association with various diseases and clinical conditions, has been established by previous studies, as described hereinabove with reference to GAM94.1. Interleukin 24 (IL24, Accession NP_006841.1) is another GAM7080 target gene, herein designated TARGET GENE. IL24 BINDING SITE is a target binding site found in the 5' untranslated region of multiple transcripts of mRNA encoded by IL24, corresponding to a target binding site such as BINDING SITE I, BINDING SITE II or BINDING SITE III of FIG. 8. Table 4 illustrates the complementarity of the nucleotide sequences of IL24 BINDING SITE, designated SEQ ID:6880, to the nucleotide sequence of GAM7080 RNA, herein designated GAM RNA, also designated SEQ ID:399.

Another function of GAM7080 is therefore inhibition of Interleukin 24 (IL24, Accession NP_006841.1), a gene which may contribute to terminal cell differentiation. Accordingly, utilities of GAM7080 include diagnosis, prevention and treatment of diseases and clinical conditions associated with IL24.

The function of IL24 and its association with various diseases and clinical conditions, has been established by previous studies, as described hereinabove with reference to GAM426.2. Interleukin 6 signal transducer (gp130, oncostatin m receptor) (IL6ST, Accession NP_786943.1) is another GAM7080 target gene, herein designated TARGET GENE. IL6ST BINDING SITE is a target binding site found in the 5' untranslated region of multiple transcripts of mRNA encoded by IL6ST, corresponding to a target binding site such as BINDING SITE I, BINDING SITE II or BINDING SITE III of FIG. 8. Table 4 illustrates the complementarity of the nucleotide sequences of IL6ST BINDING SITE, designated SEQ ID:18250, to the nucleotide sequence of GAM7080 RNA, herein designated GAM RNA, also designated SEQ ID:399.

Another function of GAM7080 is therefore inhibition of Interleukin 6 signal transducer (gp130, oncostatin m receptor) (IL6ST, Accession NP_786943.1), a gene which is the interleukin-6 signal transducer. and therefore may be associated with Compensatory cardiac hypertrophy and heart failure. Accordingly, utilities of GAM7080 include diagnosis, prevention and treatment of Compensatory cardiac hypertrophy and heart failure, and of other diseases and clinical conditions associated with IL6ST.

The function of IL6ST and its association with various diseases and clinical conditions, has been established by previous studies, as described hereinabove with reference to GAM365.1. Interleukin 6 signal transducer (gp130, oncostatin m receptor) (IL6ST, Accession NP_002175.2) is another GAM7080 target gene, herein designated TARGET GENE. IL6ST BINDING SITE is a target binding site found in the 5' untranslated region of multiple transcripts of mRNA encoded by IL6ST, corresponding to a target binding site such as BINDING SITE I, BINDING SITE II or BINDING SITE III of FIG. 8. Table 4 illustrates the complementarity of the nucleotide sequences of IL6ST BINDING SITE, designated SEQ ID:18250, to the nucleotide sequence of GAM7080 RNA, herein designated GAM RNA, also designated SEQ ID:399.

Another function of GAM7080 is therefore inhibition of Interleukin 6 signal transducer (gp130, oncostatin m receptor) (IL6ST, Accession NP_002175.2), a gene which is the interleukin-6 signal transducer. and therefore may be associated with Compensatory cardiac hypertrophy and heart failure. Accordingly, utilities of GAM7080 include diagnosis, prevention and treatment of Compensatory cardiac hypertrophy and heart failure, and of other diseases and clinical conditions associated with IL6ST.

The function of IL6ST and its association with various diseases and clinical conditions, has been established by previous studies, as described hereinabove with reference to GAM365.1. ITR (Accession NP_851320.1) is another GAM7080 target gene, herein designated TARGET GENE. ITR BINDING SITE is a target binding site found in the 3' untranslated region of mRNA encoded by ITR, corresponding to a target binding site such as BINDING SITE I, BINDING SITE II or BINDING SITE III of FIG. 8. Table 4 illustrates the complementarity of the nucleotide sequences of ITR BINDING SITE, designated SEQ ID:19486, to the nucleotide sequence of GAM7080 RNA, herein designated GAM RNA, also designated SEQ ID:399.

Another function of GAM7080 is therefore inhibition of ITR (Accession NP_851320.1). Accordingly, utilities of GAM7080 include diagnosis, prevention and treatment of diseases and clinical conditions associated with ITR.

Potassium voltage-gated channel, kqt-like subfamily, member 2 (KCNQ2, Accession NP_004509.2) is another GAM7080 target gene, herein designated TARGET GENE. KCNQ2 BINDING SITE is a target binding site found in the 3' untranslated region of multiple transcripts of mRNA encoded by KCNQ2, corresponding to a target binding site such as BINDING SITE I, BINDING SITE II or BINDING SITE III of FIG. 8. Table 4 illustrates the complementarity of the nucleotide sequences of KCNQ2 BINDING SITE, designated SEQ ID:18822, to the nucleotide sequence of GAM7080 RNA, herein designated GAM RNA, also designated SEQ ID:399.

Another function of GAM7080 is therefore inhibition of Potassium voltage-gated channel, kqt-like subfamily, member 2 (KCNQ2, Accession NP_004509.2), a gene which is probably important in the regulation of neuronal excitability. and therefore is associated with Epilepsy, benign neonatal, 1.

Accordingly, utilities of GAM7080 include diagnosis, prevention and treatment of Epilepsy, benign neonatal, 1, and of other diseases and clinical conditions associated with KCNQ2.

The function of KCNQ2 and its association with various diseases and clinical conditions, has been established by previous studies, as described hereinabove with reference to GAM47.1. Potassium voltage-gated channel, kqt-like subfamily, member 2 (KCNQ2, Accession NP_004509.2) is another GAM7080 target gene, herein designated TARGET GENE. KCNQ2 BINDING SITE is a target binding site found in the 3' untranslated region of multiple transcripts of mRNA encoded by KCNQ2, corresponding to a target binding site such as BINDING SITE I, BINDING SITE II or BINDING SITE III of FIG. 8. Table 4 illustrates the complementarity of the nucleotide sequences of KCNQ2 BINDING SITE, designated SEQ ID:18822, to the nucleotide sequence of GAM7080 RNA, herein designated GAM RNA, also designated SEQ ID:399.

Another function of GAM7080 is therefore inhibition of Potassium voltage-gated channel, kqt-like subfamily, member 2 (KCNQ2, Accession NP_004509.2), a gene which is probably important in the regulation of neuronal excitability. and therefore is associated with Epilepsy, benign neonatal, 1. Accordingly, utilities of GAM7080 include diagnosis, prevention and treatment of Epilepsy, benign neonatal, 1, and of other diseases and clinical conditions associated with KCNQ2.

The function of KCNQ2 and its association with various diseases and clinical conditions, has been established by previous studies, as described hereinabove with reference to GAM47.1. KIAA0194 (Accession XP_038362.3) is another GAM7080 target gene, herein designated TARGET GENE. KIAA0194 BINDING SITE is a target binding site found in the 3' untranslated region of mRNA encoded by KIAA0194, corresponding to a target binding site such as BINDING SITE I, BINDING SITE II or BINDING SITE III of FIG. 8. Table 4 illustrates the complementarity of the nucleotide sequences of KIAA0194 BINDING SITE, designated SEQ ID:11451, to the nucleotide sequence of GAM7080 RNA, herein designated GAM RNA, also designated SEQ ID:399.

Another function of GAM7080 is therefore inhibition of KIAA0194 (Accession XP_038362.3). Accordingly, utilities of GAM7080 include diagnosis, prevention and treatment of diseases and clinical conditions associated with KIAA0194.

KIAA0295 (Accession XP_042833.2) is another GAM7080 target gene, herein designated TARGET GENE. KIAA0295 BINDING SITE is a target binding site found in the 3' untranslated region of mRNA encoded by KIAA0295, corresponding to a target binding site such as BINDING SITE I, BINDING SITE II or BINDING SITE III of FIG. 8. Table 4 illustrates the complementarity of the nucleotide sequences of KIAA0295 BINDING SITE, designated SEQ ID:7477, to the nucleotide sequence of GAM7080 RNA, herein designated GAM RNA, also designated SEQ ID:399.

Another function of GAM7080 is therefore inhibition of KIAA0295 (Accession XP_042833.2). Accordingly, utilities of GAM7080 include diagnosis, prevention and treatment of diseases and clinical conditions associated with KIAA0295.

KIAA0298 (Accession XP_084529.6) is another GAM7080 target gene, herein designated TARGET GENE. KIAA0298 BINDING SITE is a target binding site found in the 3' untranslated region of mRNA encoded by KIAA0298, corresponding to a target binding site such as BINDING SITE I, BINDING SITE II or BINDING SITE III of FIG. 8. Table 4 illustrates the complementarity of the nucleotide sequences of KIAA0298 BINDING SITE, designated SEQ ID:17364, to the nucleotide sequence of GAM7080 RNA, herein designated GAM RNA, also designated SEQ ID:399.

Another function of GAM7080 is therefore inhibition of KIAA0298 (Accession XP_084529.6). Accordingly, utilities of GAM7080 include diagnosis, prevention and treatment of diseases and clinical conditions associated with KIAA0298.

KIAA0648 (Accession NP_056015.1) is another GAM7080 target gene, herein designated TARGET GENE. KIAA0648 BINDING SITE is a target binding site found in the 3' untranslated region of mRNA encoded by KIAA0648, corresponding to a target binding site such as BINDING SITE I, BINDING SITE II or BINDING SITE III of FIG. 8. Table 4 illustrates the complementarity of the nucleotide sequences of KIAA0648 BINDING SITE, designated SEQ ID:616, to the nucleotide sequence of GAM7080 RNA, herein designated GAM RNA, also designated SEQ ID:399.

Another function of GAM7080 is therefore inhibition of KIAA0648 (Accession NP_056015.1). Accordingly, utilities of GAM7080 include diagnosis, prevention and treatment of diseases and clinical conditions associated with KIAA0648.

KIAA0711 (Accession NP_055682.1) is another GAM7080 target gene, herein designated TARGET GENE. KIAA0711 BINDING SITE is a target binding site found in the 3' untranslated region of mRNA encoded by KIAA0711, corresponding to a target binding site such as BINDING SITE I, BINDING SITE II or BINDING SITE III of FIG. 8. Table 4 illustrates the complementarity of the nucleotide sequences of KIAA0711 BINDING SITE, designated SEQ ID:10952, to the nucleotide sequence of GAM7080 RNA, herein designated GAM RNA, also designated SEQ ID:399.

Another function of GAM7080 is therefore inhibition of KIAA0711 (Accession NP_055682.1). Accordingly, utilities of GAM7080 include diagnosis, prevention and treatment of diseases and clinical conditions associated with KIAA0711.

KIAA0960 (Accession XP_166543.3) is another GAM7080 target gene, herein designated TARGET GENE. KIAA0960 BINDING SITE is a target binding site found in the 3' untranslated region of mRNA encoded by KIAA0960, corresponding to a target binding site such as BINDING SITE I, BINDING SITE II or BINDING SITE III of FIG. 8. Table 4 illustrates the complementarity of the nucleotide sequences of KIAA0960 BINDING SITE, designated SEQ ID:3532, to the nucleotide sequence of GAM7080 RNA, herein designated GAM RNA, also designated SEQ ID:399.

Another function of GAM7080 is therefore inhibition of KIAA0960 (Accession XP_166543.3). Accordingly, utilities of GAM7080 include diagnosis, prevention and treatment of diseases and clinical conditions associated with KIAA0960.

KIAA1036 (Accession NP_055724.1) is another GAM7080 target gene, herein designated TARGET GENE. KIAA1036 BINDING SITE1 and KIAA1036 BINDING SITE2 are target binding sites found in untranslated regions of mRNA encoded by KIAA1036, corresponding to target binding sites such as BINDING SITE I, BINDING SITE II or BINDING SITE III of FIG. 8. Table 4 illustrates the complementarity of the nucleotide sequences of KIAA1036 BINDING SITE1 and KIAA1036 BINDING SITE2, designated SEQ ID:10200 and SEQ ID:1597 respectively, to the nucleotide sequence of GAM7080 RNA, herein designated GAM RNA, also designated SEQ ID:399.

Another function of GAM7080 is therefore inhibition of KIAA1036 (Accession NP_055724.1). Accordingly, utilities of GAM7080 include diagnosis, prevention and treatment of diseases and clinical conditions associated with KIAA1036.

KIAA1046 (Accession NP_055743.1) is another GAM7080 target gene, herein designated TARGET GENE. KIAA1046 BINDING SITE is a target binding site found in the 3' untranslated region of mRNA encoded by KIAA1046, corresponding to a target binding site such as BINDING SITE I, BINDING SITE II or BINDING SITE III of FIG. 8. Table 4 illustrates the complementarity of the nucleotide sequences of KIAA1046 BINDING SITE, designated SEQ ID:2608, to the nucleotide sequence of GAM7080 RNA, herein designated GAM RNA, also designated SEQ ID:399.

Another function of GAM7080 is therefore inhibition of KIAA1046 (Accession NP_055743.1). Accordingly, utilities of GAM7080 include diagnosis, prevention and treatment of diseases and clinical conditions associated with KIAA1046.

KIAA1069 (Accession XP_042635.3) is another GAM7080 target gene, herein designated TARGET GENE. KIAA1069 BINDING SITE is a target binding site found in the 3' untranslated region of mRNA encoded by KIAA1069, corresponding to a target binding site such as BINDING SITE I, BINDING SITE II or BINDING SITE III of FIG. 8. Table 4 illustrates the complementarity of the nucleotide sequences of KIAA1069 BINDING SITE, designated SEQ ID:3207, to the nucleotide sequence of GAM7080 RNA, herein designated GAM RNA, also designated SEQ ID:399.

Another function of GAM7080 is therefore inhibition of KIAA1069 (Accession XP_042635.3). Accordingly, utilities of GAM7080 include diagnosis, prevention and treatment of diseases and clinical conditions associated with KIAA1069.

KIAA1117 (Accession NP_055833.1) is another GAM7080 target gene, herein designated TARGET GENE. KIAA1117 BINDING SITE is a target binding site found in the 5' untranslated region of mRNA encoded by KIAA1117, corresponding to a target binding site such as BINDING SITE I, BINDING SITE II or BINDING SITE III of FIG. 8. Table 4 illustrates the complementarity of the nucleotide sequences of KIAA1117 BINDING SITE, designated SEQ ID:3218, to the nucleotide sequence of GAM7080 RNA, herein designated GAM RNA, also designated SEQ ID:399.

Another function of GAM7080 is therefore inhibition of KIAA1117 (Accession NP_055833.1). Accordingly, utilities of GAM7080 include diagnosis, prevention and treatment of diseases and clinical conditions associated with KIAA1117.

KIAA1450 (Accession XP_038035.4) is another GAM7080 target gene, herein designated TARGET GENE. KIAA1450 BINDING SITE is a target binding site found in the 3' untranslated region of mRNA encoded by KIAA1450, corresponding to a target binding site such as BINDING SITE I, BINDING SITE II or BINDING SITE III of FIG. 8. Table 4 illustrates the complementarity of the nucleotide sequences of KIAA1450 BINDING SITE, designated SEQ ID:11038, to the nucleotide sequence of GAM7080 RNA, herein designated GAM RNA, also designated SEQ ID:399.

Another function of GAM7080 is therefore inhibition of KIAA1450 (Accession XP_038035.4). Accordingly, utilities of GAM7080 include diagnosis, prevention and treatment of diseases and clinical conditions associated with KIAA1450.

KIAA1917 (Accession XP_290732.1) is another GAM7080 target gene, herein designated TARGET GENE. KIAA1917 BINDING SITE is a target binding site found in the 3' untranslated region of mRNA encoded by KIAA1917, corresponding to a target binding site such as BINDING SITE I, BINDING SITE II or BINDING SITE III of FIG. 8. Table 4 illustrates the complementarity of the nucleotide sequences of KIAA1917 BINDING SITE, designated SEQ ID:459, to the nucleotide sequence of GAM7080 RNA, herein designated GAM RNA, also designated SEQ ID:399.

Another function of GAM7080 is therefore inhibition of KIAA1917 (Accession XP_290732.1). Accordingly, utilities of GAM7080 include diagnosis, prevention and treatment of diseases and clinical conditions associated with KIAA1917.

KIAA2020 (Accession XP_290463.1) is another GAM7080 target gene, herein designated TARGET GENE. KIAA2020 BINDING SITE is a target binding site found in the 5' untranslated region of mRNA encoded by KIAA2020, corresponding to a target binding site such as BINDING SITE I, BINDING SITE II or BINDING SITE III of FIG. 8. Table 4 illustrates the complementarity of the nucleotide sequences of KIAA2020 BINDING SITE, designated SEQ ID:15054, to the nucleotide sequence of GAM7080 RNA, herein designated GAM RNA, also designated SEQ ID:399.

Another function of GAM7080 is therefore inhibition of KIAA2020 (Accession XP_290463.1). Accordingly, utilities of GAM7080 include diagnosis, prevention and treatment of diseases and clinical conditions associated with KIAA2020.

LOC115129 (Accession XP_055292.1) is another GAM7080 target gene, herein designated TARGET GENE. LOC115129 BINDING SITE is a target binding site found in the 5' untranslated region of mRNA encoded by LOC115129, corresponding to a target binding site such as BINDING SITE I, BINDING SITE II or BINDING SITE III of FIG. 8. Table 4 illustrates the complementarity of the nucleotide sequences of LOC115129 BINDING SITE, designated SEQ ID:15815, to the nucleotide sequence of GAM7080 RNA, herein designated GAM RNA, also designated SEQ ID:399.

Another function of GAM7080 is therefore inhibition of LOC115129 (Accession XP_055292.1). Accordingly, utilities of GAM7080 include diagnosis, prevention and treatment of diseases and clinical conditions associated with LOC115129.

LOC124895 (Accession XP_058863.4) is another GAM7080 target gene, herein designated TARGET GENE. LOC124895 BINDING SITE is a target binding site found in the 5' untranslated region of mRNA encoded by LOC124895, corresponding to a target binding site such as BINDING SITE I, BINDING SITE II or BINDING SITE III of FIG. 8. Table 4 illustrates the complementarity of the nucleotide sequences of LOC124895 BINDING SITE, designated SEQ ID:8762, to the nucleotide sequence of GAM7080 RNA, herein designated GAM RNA, also designated SEQ ID:399.

Another function of GAM7080 is therefore inhibition of LOC124895 (Accession XP_058863.4). Accordingly, utilities of GAM7080 include diagnosis, prevention and treatment of diseases and clinical conditions associated with LOC124895.

LOC144319 (Accession XP_096576.1) is another GAM7080 target gene, herein designated TARGET GENE. LOC144319 BINDING SITE is a target binding site found in the 5' untranslated region of mRNA encoded by LOC144319, corresponding to a target binding site such as BINDING SITE I, BINDING SITE II or BINDING SITE III of FIG. 8. Table 4 illustrates the complementarity of the nucleotide sequences of LOC144319 BINDING SITE, designated SEQ ID:15953, to the nucleotide sequence of GAM7080 RNA, herein designated GAM RNA, also designated SEQ ID:399.

Another function of GAM7080 is therefore inhibition of LOC144319 (Accession XP_096576.1). Accordingly, utilities of GAM7080 include diagnosis, prevention and treatment of diseases and clinical conditions associated with LOC144319.

LOC146713 (Accession XP_097071.2) is another GAM7080 target gene, herein designated TARGET GENE. LOC146713 BINDING SITE is a target binding site found in the 3' untranslated region of mRNA encoded by LOC146713, corresponding to a target binding site such as BINDING SITE I, BINDING SITE II or BINDING SITE III of FIG. 8. Table 4 illustrates the complementarity of the nucleotide sequences of LOC146713 BINDING SITE, designated SEQ ID:965, to the nucleotide sequence of GAM7080 RNA, herein designated GAM RNA, also designated SEQ ID:399.

Another function of GAM7080 is therefore inhibition of LOC146713 (Accession XP_097071.2). Accordingly, utilities of GAM7080 include diagnosis, prevention and treatment of diseases and clinical conditions associated with LOC146713.

LOC147229 (Accession XP_085742.1) is another GAM7080 target gene, herein designated TARGET GENE. LOC147229 BINDING SITE is a target binding site found in the 5' untranslated region of mRNA encoded by LOC147229, corresponding to a target binding site such as BINDING SITE I, BINDING SITE II or BINDING SITE III of FIG. 8. Table 4 illustrates the complementarity of the nucleotide sequences of LOC147229 BINDING SITE, designated SEQ ID:18084, to the nucleotide sequence of GAM7080 RNA, herein designated GAM RNA, also designated SEQ ID:399.

Another function of GAM7080 is therefore inhibition of LOC147229 (Accession XP_085742.1). Accordingly, utilities of GAM7080 include diagnosis, prevention and treatment of diseases and clinical conditions associated with LOC147229.

LOC149672 (Accession XP_086669.2) is another GAM7080 target gene, herein designated TARGET GENE. LOC149672 BINDING SITE is a target binding site found in the 3' untranslated region of mRNA encoded by LOC149672, corresponding to a target binding site such as BINDING SITE I, BINDING SITE II or BINDING SITE III of FIG. 8. Table 4 illustrates the complementarity of the nucleotide sequences of LOC149672 BINDING SITE, designated SEQ ID:7399, to the nucleotide sequence of GAM7080 RNA, herein designated GAM RNA, also designated SEQ ID:399.

Another function of GAM7080 is therefore inhibition of LOC149672 (Accession XP_086669.2). Accordingly, utilities of GAM7080 include diagnosis, prevention and treatment of diseases and clinical conditions associated with LOC149672.

LOC150051 (Accession XP_097792.1) is another GAM7080 target gene, herein designated TARGET GENE. LOC150051 BINDING SITE1 and LOC150051 BINDING SITE2 are target binding sites found in untranslated regions of mRNA encoded by LOC150051, corresponding to target binding sites such as BINDING SITE I, BINDING SITE II or BINDING SITE III of FIG. 8. Table 4 illustrates the complementarity of the nucleotide sequences of LOC150051 BINDING SITE1 and LOC150051 BINDING SITE2, designated SEQ ID:9570 and SEQ ID:499 respectively, to the nucleotide sequence of GAM7080 RNA, herein designated GAM RNA, also designated SEQ ID:399.

Another function of GAM7080 is therefore inhibition of LOC150051 (Accession XP_097792.1). Accordingly, utilities of GAM7080 include diagnosis, prevention and treatment of diseases and clinical conditions associated with LOC150051.

LOC157556 (Accession XP_098783.1) is another GAM7080 target gene, herein designated TARGET GENE. LOC157556 BINDING SITE is a target binding site found in the 3' untranslated region of mRNA encoded by LOC157556, corresponding to a target binding site such as BINDING SITE I, BINDING SITE II or BINDING SITE III of FIG. 8. Table 4 illustrates the complementarity of the nucleotide sequences of LOC157556 BINDING SITE, designated SEQ ID:4249, to the nucleotide sequence of GAM7080 RNA, herein designated GAM RNA, also designated SEQ ID:399.

Another function of GAM7080 is therefore inhibition of LOC157556 (Accession XP_098783.1). Accordingly, utilities of GAM7080 include diagnosis, prevention and treatment of diseases and clinical conditions associated with LOC157556.

LOC157737 (Accession XP_098819.1) is another GAM7080 target gene, herein designated TARGET GENE. LOC157737 BINDING SITE is a target binding site found in the 5' untranslated region of mRNA encoded by LOC157737, corresponding to a target binding site such as BINDING SITE I, BINDING SITE II or BINDING SITE III of FIG. 8. Table 4 illustrates the complementarity of the nucleotide sequences of LOC157737 BINDING SITE, designated SEQ ID:17175, to the nucleotide sequence of GAM7080 RNA, herein designated GAM RNA, also designated SEQ ID:399.

Another function of GAM7080 is therefore inhibition of LOC157737 (Accession XP_098819.1). Accordingly, utilities of GAM7080 include diagnosis, prevention and treatment of diseases and clinical conditions associated with LOC157737.

LOC160897 (Accession XP_090573.3) is another GAM7080 target gene, herein designated TARGET GENE. LOC160897 BINDING SITE is a target binding site found in the 3' untranslated region of mRNA encoded by LOC160897, corresponding to a target binding site such as BINDING SITE I, BINDING SITE II or BINDING SITE III of FIG. 8. Table 4 illustrates the complementarity of the nucleotide sequences of LOC160897 BINDING SITE, designated SEQ ID:19486, to the nucleotide sequence of GAM7080 RNA, herein designated GAM RNA, also designated SEQ ID:399.

Another function of GAM7080 is therefore inhibition of LOC160897 (Accession XP_090573.3). Accordingly, utilities of GAM7080 include diagnosis, prevention and treatment of diseases and clinical conditions associated with LOC160897.

LOC164633 (Accession XP_092894.3) is another GAM7080 target gene, herein designated TARGET GENE. LOC164633 BINDING SITE is a target binding site found in the 3' untranslated region of mRNA encoded by LOC164633, corresponding to a target binding site such as BINDING SITE I, BINDING SITE II or BINDING SITE III of FIG. 8. Table 4 illustrates the complementarity of the nucleotide sequences of LOC164633 BINDING SITE, designated SEQ ID:3527, to the nucleotide sequence of GAM7080 RNA, herein designated GAM RNA, also designated SEQ ID:399.

Another function of GAM7080 is therefore inhibition of LOC164633 (Accession XP_092894.3). Accordingly, utilities of GAM7080 include diagnosis, prevention and treatment of diseases and clinical conditions associated with LOC164633.

LOC199858 (Accession XP_114040.1) is another GAM7080 target gene, herein designated TARGET GENE. LOC199858 BINDING SITE is a target binding site found in the 5' untranslated region of mRNA encoded by LOC199858, corresponding to a target binding site such as BINDING SITE I, BINDING SITE II or BINDING SITE III of FIG. 8. Table 4 illustrates the complementarity of the nucleotide sequences of LOC199858 BINDING SITE, designated SEQ ID:1893, to the nucleotide sequence of GAM7080 RNA, herein designated GAM RNA, also designated SEQ ID:399.

Another function of GAM7080 is therefore inhibition of LOC199858 (Accession XP_114040.1). Accordingly, utilities of GAM7080 include diagnosis, prevention and treatment of diseases and clinical conditions associated with LOC199858.

LOC199920 (Accession XP_114056.3) is another GAM7080 target gene, herein designated TARGET GENE. LOC199920 BINDING SITE is a target binding site found in the 3' untranslated region of mRNA encoded by LOC199920, corresponding to a target binding site such as BINDING SITE I, BINDING SITE II or BINDING SITE III of FIG. 8. Table 4 illustrates the complementarity of the nucleotide sequences of LOC199920 BINDING SITE, designated SEQ ID:4186, to the nucleotide sequence of GAM7080 RNA, herein designated GAM RNA, also designated SEQ ID:399.

Another function of GAM7080 is therefore inhibition of LOC199920 (Accession XP_114056.3). Accordingly, utilities of GAM7080 include diagnosis, prevention and treatment of diseases and clinical conditions associated with LOC199920.

LOC200230 (Accession XP_114166.1) is another GAM7080 target gene, herein designated TARGET GENE. LOC200230 BINDING SITE is a target binding site found in the 3' untranslated region of mRNA encoded by LOC200230, corresponding to a target binding site such as BINDING SITE I, BINDING SITE II or BINDING SITE III of FIG. 8. Table 4 illustrates the complementarity of the nucleotide sequences of LOC200230 BINDING SITE, designated SEQ ID:8763, to the nucleotide sequence of GAM7080 RNA, herein designated GAM RNA, also designated SEQ ID:399.

Another function of GAM7080 is therefore inhibition of LOC200230 (Accession XP_114166.1). Accordingly, utilities of GAM7080 include diagnosis, prevention and treatment of diseases and clinical conditions associated with LOC200230.

LOC254826 (Accession XP_173188.1) is another GAM7080 target gene, herein designated TARGET GENE. LOC254826 BINDING SITE is a target binding site found in the 3' untranslated region of mRNA encoded by LOC254826, corresponding to a target binding site such as BINDING SITE I, BINDING SITE II or BINDING SITE III of FIG. 8. Table 4 illustrates the complementarity of the nucleotide sequences of LOC254826 BINDING SITE, designated SEQ ID:8776, to the nucleotide sequence of GAM7080 RNA, herein designated GAM RNA, also designated SEQ ID:399.

Another function of GAM7080 is therefore inhibition of LOC254826 (Accession XP_173188.1). Accordingly, utilities of GAM7080 include diagnosis, prevention and treatment of diseases and clinical conditions associated with LOC254826.

LOC255458 (Accession XP_173150.1) is another GAM7080 target gene, herein designated TARGET GENE. LOC255458 BINDING SITE is a target binding site found in the 5' untranslated region of mRNA encoded by LOC255458, corresponding to a target binding site such as BINDING SITE I, BINDING SITE II or BINDING SITE III of FIG. 8. Table 4 illustrates the complementarity of the nucleotide sequences of LOC255458 BINDING SITE, designated SEQ ID:6761, to the nucleotide sequence of GAM7080 RNA, herein designated GAM RNA, also designated SEQ ID:399.

Another function of GAM7080 is therefore inhibition of LOC255458 (Accession XP_173150.1). Accordingly, utilities of GAM7080 include diagnosis, prevention and treatment of diseases and clinical conditions associated with LOC255458.

LOC256401 (Accession XP_171149.1) is another GAM7080 target gene, herein designated TARGET GENE. LOC256401 BINDING SITE is a target binding site found in the 3' untranslated region of mRNA encoded by LOC256401, corresponding to a target binding site such as BINDING SITE I, BINDING SITE II or BINDING SITE III of FIG. 8. Table 4 illustrates the complementarity of the nucleotide sequences of LOC256401 BINDING SITE, designated SEQ ID:14202, to the nucleotide sequence of GAM7080 RNA, herein designated GAM RNA, also designated SEQ ID:399.

Another function of GAM7080 is therefore inhibition of LOC256401 (Accession XP_171149.1). Accordingly, utilities of GAM7080 include diagnosis, prevention and treatment of diseases and clinical conditions associated with LOC256401.

LOC283035 (Accession XP_208488.1) is another GAM7080 target gene, herein designated TARGET GENE. LOC283035 BINDING SITE is a target binding site found in the 3' untranslated region of mRNA encoded by LOC283035, corresponding to a target binding site such as BINDING SITE I, BINDING SITE II or BINDING SITE III of FIG. 8. Table 4 illustrates the complementarity of the nucleotide sequences of LOC283035 BINDING SITE, designated SEQ ID:17378, to the nucleotide sequence of GAM7080 RNA, herein designated GAM RNA, also designated SEQ ID:399.

Another function of GAM7080 is therefore inhibition of LOC283035 (Accession XP_208488.1). Accordingly, utilities of GAM7080 include diagnosis, prevention and treatment of diseases and clinical conditions associated with LOC283035.

LOC283196 (Accession XP_210930.1) is another GAM7080 target gene, herein designated TARGET GENE. LOC283196 BINDING SITE is a target binding site found in the 5' untranslated region of mRNA encoded by LOC283196, corresponding to a target binding site such as BINDING SITE I, BINDING SITE II or BINDING SITE III of FIG. 8. Table 4 illustrates the complementarity of the nucleotide sequences of LOC283196 BINDING SITE, designated SEQ ID:5966, to the nucleotide sequence of GAM7080 RNA, herein designated GAM RNA, also designated SEQ ID:399.

Another function of GAM7080 is therefore inhibition of LOC283196 (Accession XP_210930.1). Accordingly, utilities of GAM7080 include diagnosis, prevention and treatment of diseases and clinical conditions associated with LOC283196.

LOC283352 (Accession XP_210989.1) is another GAM7080 target gene, herein designated TARGET GENE. LOC283352 BINDING SITE is a target binding site found in the 3' untranslated region of mRNA encoded by LOC283352, corresponding to a target binding site such as BINDING SITE I, BINDING SITE II or BINDING SITE III of FIG. 8. Table 4 illustrates the complementarity of the nucleotide sequences of LOC283352 BINDING SITE, designated SEQ ID:10759, to the nucleotide sequence of GAM7080 RNA, herein designated GAM RNA, also designated SEQ ID:399.

Another function of GAM7080 is therefore inhibition of LOC283352 (Accession XP_210989.1). Accordingly, utilities of GAM7080 include diagnosis, prevention and treatment of diseases and clinical conditions associated with LOC283352.

LOC283392 (Accession XP_211010.1) is another GAM7080 target gene, herein designated TARGET GENE.

LOC283392 BINDING SITE is a target binding site found in the 3' untranslated region of mRNA encoded by LOC283392, corresponding to a target binding site such as BINDING SITE I, BINDING SITE II or BINDING SITE III of FIG. 8. Table 4 illustrates the complementarity of the nucleotide sequences of LOC283392 BINDING SITE, designated SEQ ID:8184, to the nucleotide sequence of GAM7080 RNA, herein designated GAM RNA, also designated SEQ ID:399.

Another function of GAM7080 is therefore inhibition of LOC283392 (Accession XP_211010.1). Accordingly, utilities of GAM7080 include diagnosis, prevention and treatment of diseases and clinical conditions associated with LOC283392.

LOC283475 (Accession XP_211056.1) is another GAM7080 target gene, herein designated TARGET GENE. LOC283475 BINDING SITE is a target binding site found in the 3' untranslated region of mRNA encoded by LOC283475, corresponding to a target binding site such as BINDING SITE I, BINDING SITE II or BINDING SITE III of FIG. 8. Table 4 illustrates the complementarity of the nucleotide sequences of LOC283475 BINDING SITE, designated SEQ ID:11008, to the nucleotide sequence of GAM7080 RNA, herein designated GAM RNA, also designated SEQ ID:399.

Another function of GAM7080 is therefore inhibition of LOC283475 (Accession XP_211056.1). Accordingly, utilities of GAM7080 include diagnosis, prevention and treatment of diseases and clinical conditions associated with LOC283475.

LOC283487 (Accession XP_211062.1) is another GAM7080 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:9217, to the nucleotide sequence of GAM7080 RNA, herein designated GAM RNA, also designated SEQ ID:399.

Another function of GAM7080 is therefore inhibition of LOC283487 (Accession XP_211062.1). Accordingly, utilities of GAM7080 include diagnosis, prevention and treatment of diseases and clinical conditions associated with LOC283487.

LOC283551 (Accession XP_211110.1) is another GAM7080 target gene, herein designated TARGET GENE. LOC283551 BINDING SITE is a target binding site found in the 3' untranslated region of mRNA encoded by LOC283551, corresponding to a target binding site such as BINDING SITE I, BINDING SITE II or BINDING SITE III of FIG. 8. Table 4 illustrates the complementarity of the nucleotide sequences of LOC283551 BINDING SITE, designated SEQ ID:10098, to the nucleotide sequence of GAM7080 RNA, herein designated GAM RNA, also designated SEQ ID:399.

Another function of GAM7080 is therefore inhibition of LOC283551 (Accession XP_211110.1). Accordingly, utilities of GAM7080 include diagnosis, prevention and treatment of diseases and clinical conditions associated with LOC283551.

LOC283678 (Accession XP_211159.2) is another GAM7080 target gene, herein designated TARGET GENE. LOC283678 BINDING SITE is a target binding site found in the 3' untranslated region of mRNA encoded by LOC283678, corresponding to a target binding site such as BINDING SITE I, BINDING SITE II or BINDING SITE III of FIG. 8. Table 4 illustrates the complementarity of the nucleotide sequences of LOC283678 BINDING SITE, designated SEQ ID:15253, to the nucleotide sequence of GAM7080 RNA, herein designated GAM RNA, also designated SEQ ID:399.

Another function of GAM7080 is therefore inhibition of LOC283678 (Accession XP_211159.2). Accordingly, utilities of GAM7080 include diagnosis, prevention and treatment of diseases and clinical conditions associated with LOC283678.

LOC284155 (Accession XP_211354.1) is another GAM7080 target gene, herein designated TARGET GENE. LOC284155 BINDING SITE is a target binding site found in the 3' untranslated region of mRNA encoded by LOC284155, corresponding to a target binding site such as BINDING SITE I, BINDING SITE II or BINDING SITE III of FIG. 8. Table 4 illustrates the complementarity of the nucleotide sequences of LOC284155 BINDING SITE, designated SEQ ID:19691, to the nucleotide sequence of GAM7080 RNA, herein designated GAM RNA, also designated SEQ ID:399.

Another function of GAM7080 is therefore inhibition of LOC284155 (Accession XP_211354.1). Accordingly, utilities of GAM7080 include diagnosis, prevention and treatment of diseases and clinical conditions associated with LOC284155.

LOC284456 (Accession XP_211470.1) is another GAM7080 target gene, herein designated TARGET GENE. LOC284456 BINDING SITE is a target binding site found in the 3' untranslated region of mRNA encoded by LOC284456, corresponding to a target binding site such as BINDING SITE I, BINDING SITE II or BINDING SITE III of FIG. 8. Table 4 illustrates the complementarity of the nucleotide sequences of LOC284456 BINDING SITE, designated SEQ ID:6823, to the nucleotide sequence of GAM7080 RNA, herein designated GAM RNA, also designated SEQ ID:399.

Another function of GAM7080 is therefore inhibition of LOC284456 (Accession XP_211470.1). Accordingly, utilities of GAM7080 include diagnosis, prevention and treatment of diseases and clinical conditions associated with LOC284456.

LOC284613 (Accession XP_209289.1) is another GAM7080 target gene, herein designated TARGET GENE. LOC284613 BINDING SITE is a target binding site found in the 3' untranslated region of mRNA encoded by LOC284613, corresponding to a target binding site such as BINDING SITE I, BINDING SITE II or BINDING SITE III of FIG. 8. Table 4 illustrates the complementarity of the nucleotide sequences of LOC284613 BINDING SITE, designated SEQ ID:984, to the nucleotide sequence of GAM7080 RNA, herein designated GAM RNA, also designated SEQ ID:399.

Another function of GAM7080 is therefore inhibition of LOC284613 (Accession XP_209289.1). Accordingly, utilities of GAM7080 include diagnosis, prevention and treatment of diseases and clinical conditions associated with LOC284613.

LOC284697 (Accession XP_209326.1) is another GAM7080 target gene, herein designated TARGET GENE. LOC284697 BINDING SITE is a target binding site found in the 5' untranslated region of mRNA encoded by LOC284697, corresponding to a target binding site such as BINDING SITE I, BINDING SITE II or BINDING SITE III of FIG. 8. Table 4 illustrates the complementarity of the nucleotide sequences of LOC284697 BINDING SITE, designated SEQ ID:3202, to the nucleotide sequence of GAM7080 RNA, herein designated GAM RNA, also designated SEQ ID:399.

Another function of GAM7080 is therefore inhibition of LOC284697 (Accession XP_209326.1). Accordingly, utilities of GAM7080 include diagnosis, prevention and treatment of diseases and clinical conditions associated with LOC284697.

LOC284808 (Accession XP_209372.1) is another GAM7080 target gene, herein designated TARGET GENE. LOC284808 BINDING SITE is a target binding site found in the 5' untranslated region of mRNA encoded by LOC284808, corresponding to a target binding site such as BINDING SITE I, BINDING SITE II or BINDING SITE III of FIG. 8. Table 4 illustrates the complementarity of the nucleotide sequences of LOC284808 BINDING SITE, designated SEQ ID:6074, to the nucleotide sequence of GAM7080 RNA, herein designated GAM RNA, also designated SEQ ID:399.

Another function of GAM7080 is therefore inhibition of LOC284808 (Accession XP_209372.1). Accordingly, utilities of GAM7080 include diagnosis, prevention and treatment of diseases and clinical conditions associated with LOC284808.

LOC284836 (Accession XP_211654.1) is another GAM7080 target gene, herein designated TARGET GENE. LOC284836 BINDING SITE is a target binding site found in the 5' untranslated region of mRNA encoded by LOC284836, corresponding to a target binding site such as BINDING SITE I, BINDING SITE II or BINDING SITE III of FIG. 8. Table 4 illustrates the complementarity of the nucleotide sequences of LOC284836 BINDING SITE, designated SEQ ID:7599, to the nucleotide sequence of GAM7080 RNA, herein designated GAM RNA, also designated SEQ ID:399.

Another function of GAM7080 is therefore inhibition of LOC284836 (Accession XP_211654.1). Accordingly, utilities of GAM7080 include diagnosis, prevention and treatment of diseases and clinical conditions associated with LOC284836.

LOC285035 (Accession XP_209446.1) is another GAM7080 target gene, herein designated TARGET GENE. LOC285035 BINDING SITE is a target binding site found in the 5' untranslated region of mRNA encoded by LOC285035, corresponding to a target binding site such as BINDING SITE I, BINDING SITE II or BINDING SITE III of FIG. 8. Table 4 illustrates the complementarity of the nucleotide sequences of LOC285035 BINDING SITE, designated SEQ ID:3915, to the nucleotide sequence of GAM7080 RNA, herein designated GAM RNA, also designated SEQ ID:399.

Another function of GAM7080 is therefore inhibition of LOC285035 (Accession XP_209446.1). Accordingly, utilities of GAM7080 include diagnosis, prevention and treatment of diseases and clinical conditions associated with LOC285035.

LOC285262 (Accession XP_208309.1) is another GAM7080 target gene, herein designated TARGET GENE. LOC285262 BINDING SITE is a target binding site found in the 3' untranslated region of mRNA encoded by LOC285262, corresponding to a target binding site such as BINDING SITE I, BINDING SITE II or BINDING SITE III of FIG. 8. Table 4 illustrates the complementarity of the nucleotide sequences of LOC285262 BINDING SITE, designated SEQ ID:7389, to the nucleotide sequence of GAM7080 RNA, herein designated GAM RNA, also designated SEQ ID:399.

Another function of GAM7080 is therefore inhibition of LOC285262 (Accession XP_208309.1). Accordingly, utilities of GAM7080 include diagnosis, prevention and treatment of diseases and clinical conditions associated with LOC285262.

LOC285533 (Accession NP_775933.1) is another GAM7080 target gene, herein designated TARGET GENE. LOC285533 BINDING SITE is a target binding site found in the 3' untranslated region of mRNA encoded by LOC285533, corresponding to a target binding site such as BINDING SITE I, BINDING SITE II or BINDING SITE III of FIG. 8. Table 4 illustrates the complementarity of the nucleotide sequences of LOC285533 BINDING SITE, designated SEQ ID:1910, to the nucleotide sequence of GAM7080 RNA, herein designated GAM RNA, also designated SEQ ID:399.

Another function of GAM7080 is therefore inhibition of LOC285533 (Accession NP_775933.1). Accordingly, utilities of GAM7080 include diagnosis, prevention and treatment of diseases and clinical conditions associated with LOC285533.

LOC285616 (Accession XP_211951.1) is another GAM7080 target gene, herein designated TARGET GENE. LOC285616 BINDING SITE is a target binding site found in the 3' untranslated region of mRNA encoded by LOC285616, corresponding to a target binding site such as BINDING SITE I, BINDING SITE II or BINDING SITE III of FIG. 8. Table 4 illustrates the complementarity of the nucleotide sequences of LOC285616 BINDING SITE, designated SEQ ID:15058, to the nucleotide sequence of GAM7080 RNA, herein designated GAM RNA, also designated SEQ ID:399.

Another function of GAM7080 is therefore inhibition of LOC285616 (Accession XP_211951.1). Accordingly, utilities of GAM7080 include diagnosis, prevention and treatment of diseases and clinical conditions associated with LOC285616.

LOC285678 (Accession XP_209717.1) is another GAM7080 target gene, herein designated TARGET GENE. LOC285678 BINDING SITE is a target binding site found in the 5' untranslated region of mRNA encoded by LOC285678, corresponding to a target binding site such as BINDING SITE I, BINDING SITE II or BINDING SITE III of FIG. 8. Table 4 illustrates the complementarity of the nucleotide sequences of LOC285678 BINDING SITE, designated SEQ ID:16233, to the nucleotide sequence of GAM7080 RNA, herein designated GAM RNA, also designated SEQ ID:399.

Another function of GAM7080 is therefore inhibition of LOC285678 (Accession XP_209717.1). Accordingly, utilities of GAM7080 include diagnosis, prevention and treatment of diseases and clinical conditions associated with LOC285678.

LOC285831 (Accession XP_212625.1) is another GAM7080 target gene, herein designated TARGET GENE. LOC285831 BINDING SITE is a target binding site found in the 5' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:10911, to the nucleotide sequence of GAM7080 RNA, herein designated GAM RNA, also designated SEQ ID:399.

Another function of GAM7080 is therefore inhibition of LOC285831 (Accession XP_212625.1). Accordingly, utilities of GAM7080 include diagnosis, prevention and treatment of diseases and clinical conditions associated with LOC285831.

LOC285831 (Accession XP_212577.1) is another GAM7080 target gene, herein designated TARGET GENE. LOC285831 BINDING SITE is a target binding site found in the 5' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:10911, to the nucleotide sequence of GAM7080 RNA, herein designated GAM RNA, also designated SEQ ID:399.

Another function of GAM7080 is therefore inhibition of LOC285831 (Accession XP_212577.1). Accordingly, utilities of GAM7080 include diagnosis, prevention and treatment of diseases and clinical conditions associated with LOC285831.

LOC285831 (Accession XP_209784.1) is another GAM7080 target gene, herein designated TARGET GENE. LOC285831 BINDING SITE is a target binding site found in the 5' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:10911, to the nucleotide sequence of GAM7080 RNA, herein designated GAM RNA, also designated SEQ ID:399.

Another function of GAM7080 is therefore inhibition of LOC285831 (Accession XP_209784.1). Accordingly, utilities of GAM7080 include diagnosis, prevention and treatment of diseases and clinical conditions associated with LOC285831.

LOC285954 (Accession XP_212085.1) is another GAM7080 target gene, herein designated TARGET GENE. LOC285954 BINDING SITE is a target binding site found in the 5' untranslated region of mRNA encoded by LOC285954, corresponding to a target binding site such as BINDING SITE I, BINDING SITE II or BINDING SITE III of FIG. 8. Table 4 illustrates the complementarity of the nucleotide sequences of LOC285954 BINDING SITE, designated SEQ ID:20134, to the nucleotide sequence of GAM7080 RNA, herein designated GAM RNA, also designated SEQ ID:399.

Another function of GAM7080 is therefore inhibition of LOC285954 (Accession XP_212085.1). Accordingly, utilities of GAM7080 include diagnosis, prevention and treatment of diseases and clinical conditions associated with LOC285954.

LOC285958 (Accession XP_212099.1) is another GAM7080 target gene, herein designated TARGET GENE. LOC285958 BINDING SITE is a target binding site found in the 5' untranslated region of mRNA encoded by LOC285958, corresponding to a target binding site such as BINDING SITE I, BINDING SITE II or BINDING SITE III of FIG. 8. Table 4 illustrates the complementarity of the nucleotide sequences of LOC285958 BINDING SITE, designated SEQ ID:12641, to the nucleotide sequence of GAM7080 RNA, herein designated GAM RNA, also designated SEQ ID:399.

Another function of GAM7080 is therefore inhibition of LOC285958 (Accession XP_212099.1). Accordingly, utilities of GAM7080 include diagnosis, prevention and treatment of diseases and clinical conditions associated with LOC285958.

LOC286090 (Accession XP_212166.3) is another GAM7080 target gene, herein designated TARGET GENE. LOC286090 BINDING SITE is a target binding site found in the 5' untranslated region of mRNA encoded by LOC286090, corresponding to a target binding site such as BINDING SITE I, BINDING SITE II or BINDING SITE III of FIG. 8. Table 4 illustrates the complementarity of the nucleotide sequences of LOC286090 BINDING SITE, designated SEQ ID:2162, to the nucleotide sequence of GAM7080 RNA, herein designated GAM RNA, also designated SEQ ID:399.

Another function of GAM7080 is therefore inhibition of LOC286090 (Accession XP_212166.3). Accordingly, utilities of GAM7080 include diagnosis, prevention and treatment of diseases and clinical conditions associated with LOC286090.

LOC286404 (Accession XP_210036.1) is another GAM7080 target gene, herein designated TARGET GENE. LOC286404 BINDING SITE is a target binding site found in the 3' untranslated region of multiple transcripts of mRNA encoded by LOC286404, corresponding to a target binding site such as BINDING SITE I, BINDING SITE II or BINDING SITE III of FIG. 8. Table 4 illustrates the complementarity of the nucleotide sequences of LOC286404 BINDING SITE, designated SEQ ID:4159, to the nucleotide sequence of GAM7080 RNA, herein designated GAM RNA, also designated SEQ ID:399.

Another function of GAM7080 is therefore inhibition of LOC286404 (Accession XP_210036.1). Accordingly, utilities of GAM7080 include diagnosis, prevention and treatment of diseases and clinical conditions associated with LOC286404.

LOC286430 (Accession XP_210044.1) is another GAM7080 target gene, herein designated TARGET GENE. LOC286430 BINDING SITE is a target binding site found in the 5' untranslated region of mRNA encoded by LOC286430, corresponding to a target binding site such as BINDING SITE I, BINDING SITE II or BINDING SITE III of FIG. 8. Table 4 illustrates the complementarity of the nucleotide sequences of LOC286430 BINDING SITE, designated SEQ ID:7177, to the nucleotide sequence of GAM7080 RNA, herein designated GAM RNA, also designated SEQ ID:399.

Another function of GAM7080 is therefore inhibition of LOC286430 (Accession XP_210044.1). Accordingly, utilities of GAM7080 include diagnosis, prevention and treatment of diseases and clinical conditions associated with LOC286430.

LOC286448 (Accession XP_212322.1) is another GAM7080 target gene, herein designated TARGET GENE. LOC286448 BINDING SITE is a target binding site found in the 3' untranslated region of mRNA encoded by LOC286448, corresponding to a target binding site such as BINDING SITE I, BINDING SITE II or BINDING SITE III of FIG. 8. Table 4 illustrates the complementarity of the nucleotide sequences of LOC286448 BINDING SITE, designated SEQ ID:1246, to the nucleotide sequence of GAM7080 RNA, herein designated GAM RNA, also designated SEQ ID:399.

Another function of GAM7080 is therefore inhibition of LOC286448 (Accession XP_212322.1). Accordingly, utilities of GAM7080 include diagnosis, prevention and treatment of diseases and clinical conditions associated with LOC286448.

LOC338841 (Accession XP_290597.1) is another GAM7080 target gene, herein designated TARGET GENE. LOC338841 BINDING SITE is a target binding site found in the 3' untranslated region of mRNA encoded by LOC338841, corresponding to a target binding site such as BINDING SITE I, BINDING SITE II or BINDING SITE III of FIG. 8. Table 4 illustrates the complementarity of the nucleotide sequences of LOC338841 BINDING SITE, designated SEQ ID:19377, to the nucleotide sequence of GAM7080 RNA, herein designated GAM RNA, also designated SEQ ID:399.

Another function of GAM7080 is therefore inhibition of LOC338841 (Accession XP_290597.1). Accordingly, utilities of GAM7080 include diagnosis, prevention and treatment of diseases and clinical conditions associated with LOC338841.

LOC338852 (Accession XP_294733.1) is another GAM7080 target gene, herein designated TARGET GENE. LOC338852 BINDING SITE is a target binding site found in the 5' untranslated region of mRNA encoded by LOC338852, corresponding to a target binding site such as BINDING SITE I, BINDING SITE II or BINDING SITE III of FIG. 8. Table 4 illustrates the complementarity of the nucleotide sequences of LOC338852 BINDING SITE, designated SEQ ID:526, to the nucleotide sequence of GAM7080 RNA, herein designated GAM RNA, also designated SEQ ID:399.

Another function of GAM7080 is therefore inhibition of LOC338852 (Accession XP_294733.1). Accordingly, utilities of GAM7080 include diagnosis, prevention and treatment of diseases and clinical conditions associated with LOC338852.

LOC339543 (Accession XP_294623.1) is another GAM7080 target gene, herein designated TARGET GENE. LOC339543 BINDING SITE is a target binding site found in the 3' untranslated region of mRNA encoded by LOC339543, corresponding to a target binding site such as BINDING SITE I, BINDING SITE II or BINDING SITE III of FIG. 8. Table 4 illustrates the complementarity of the nucleotide sequences of LOC339543 BINDING SITE, designated SEQ ID:6991, to the nucleotide sequence of GAM7080 RNA, herein designated GAM RNA, also designated SEQ ID:399.

Another function of GAM7080 is therefore inhibition of LOC339543 (Accession XP_294623.1). Accordingly, utilities of GAM7080 include diagnosis, prevention and treatment of diseases and clinical conditions associated with LOC339543.

LOC339896 (Accession XP_291059.1) is another GAM7080 target gene, herein designated TARGET GENE. LOC339896 BINDING SITE is a target binding site found in the 3' untranslated region of mRNA encoded by LOC339896, corresponding to a target binding site such as BINDING SITE I, BINDING SITE II or BINDING SITE III of FIG. 8. Table 4 illustrates the complementarity of the nucleotide sequences of LOC339896 BINDING SITE, designated SEQ ID:15682, to the nucleotide sequence of GAM7080 RNA, herein designated GAM RNA, also designated SEQ ID:399.

Another function of GAM7080 is therefore inhibition of LOC339896 (Accession XP_291059.1). Accordingly, utilities of GAM7080 include diagnosis, prevention and treatment of diseases and clinical conditions associated with LOC339896.

LOC339907 (Accession XP_291065.1) is another GAM7080 target gene, herein designated TARGET GENE. LOC339907 BINDING SITE is a target binding site found in the 3' untranslated region of mRNA encoded by LOC339907, corresponding to a target binding site such as BINDING SITE I, BINDING SITE II or BINDING SITE III of FIG. 8. Table 4 illustrates the complementarity of the nucleotide sequences of LOC339907 BINDING SITE, designated SEQ ID:10378, to the nucleotide sequence of GAM7080 RNA, herein designated GAM RNA, also designated SEQ ID:399.

Another function of GAM7080 is therefore inhibition of LOC339907 (Accession XP_291065.1). Accordingly, utilities of GAM7080 include diagnosis, prevention and treatment of diseases and clinical conditions associated with LOC339907.

LOC339975 (Accession XP_295115.1) is another GAM7080 target gene, herein designated TARGET GENE. LOC339975 BINDING SITE is a target binding site found in the 5' untranslated region of mRNA encoded by LOC339975, corresponding to a target binding site such as BINDING SITE I, BINDING SITE II or BINDING SITE III of FIG. 8. Table 4 illustrates the complementarity of the nucleotide sequences of LOC339975 BINDING SITE, designated SEQ ID:1546, to the nucleotide sequence of GAM7080 RNA, herein designated GAM RNA, also designated SEQ ID:399.

Another function of GAM7080 is therefore inhibition of LOC339975 (Accession XP_295115.1). Accordingly, utilities of GAM7080 include diagnosis, prevention and treatment of diseases and clinical conditions associated with LOC339975.

LOC340238 (Accession XP_295188.1) is another GAM7080 target gene, herein designated TARGET GENE. LOC340238 BINDING SITE is a target binding site found in the 5' untranslated region of mRNA encoded by LOC340238, corresponding to a target binding site such as BINDING SITE I, BINDING SITE II or BINDING SITE III of FIG. 8. Table 4 illustrates the complementarity of the nucleotide sequences of LOC340238 BINDING SITE, designated SEQ ID:11781, to the nucleotide sequence of GAM7080 RNA, herein designated GAM RNA, also designated SEQ ID:399.

Another function of GAM7080 is therefore inhibition of LOC340238 (Accession XP_295188.1). Accordingly, utilities of GAM7080 include diagnosis, prevention and treatment of diseases and clinical conditions associated with LOC340238.

LOC340241 (Accession XP_295191.1) is another GAM7080 target gene, herein designated TARGET GENE. LOC340241 BINDING SITE is a target binding site found in the 5' untranslated region of mRNA encoded by LOC340241, corresponding to a target binding site such as BINDING SITE I, BINDING SITE II or BINDING SITE III of FIG. 8. Table 4 illustrates the complementarity of the nucleotide sequences of LOC340241 BINDING SITE, designated SEQ ID:11781, to the nucleotide sequence of GAM7080 RNA, herein designated GAM RNA, also designated SEQ ID:399.

Another function of GAM7080 is therefore inhibition of LOC340241 (Accession XP_295191.1). Accordingly, utilities of GAM7080 include diagnosis, prevention and treatment of diseases and clinical conditions associated with LOC340241.

LOC340493 (Accession XP_291312.1) is another GAM7080 target gene, herein designated TARGET GENE. LOC340493 BINDING SITE is a target binding site found in the 3' untranslated region of mRNA encoded by LOC340493, corresponding to a target binding site such as BINDING SITE I, BINDING SITE II or BINDING SITE III of FIG. 8. Table 4 illustrates the complementarity of the nucleotide sequences of LOC340493 BINDING SITE, designated SEQ ID:14512, to the nucleotide sequence of GAM7080 RNA, herein designated GAM RNA, also designated SEQ ID:399.

Another function of GAM7080 is therefore inhibition of LOC340493 (Accession XP_291312.1). Accordingly, utilities of GAM7080 include diagnosis, prevention and treatment of diseases and clinical conditions associated with LOC340493.

LOC347804 (Accession XP_166630.4) is another GAM7080 target gene, herein designated TARGET GENE. LOC347804 BINDING SITE is a target binding site found in the 5' untranslated region of mRNA encoded by LOC347804, corresponding to a target binding site such as BINDING SITE I, BINDING SITE II or BINDING SITE III of FIG. 8. Table 4 illustrates the complementarity of the nucleotide sequences of LOC347804 BINDING SITE, designated SEQ ID:15054, to the nucleotide sequence of GAM7080 RNA, herein designated GAM RNA, also designated SEQ ID:399.

Another function of GAM7080 is therefore inhibition of LOC347804 (Accession XP_166630.4). Accordingly, utilities of GAM7080 include diagnosis, prevention and treatment of diseases and clinical conditions associated with LOC347804.

LOC348155 (Accession XP_211219.1) is another GAM7080 target gene, herein designated TARGET GENE. LOC348155 BINDING SITE is a target binding site found in the 5' untranslated region of mRNA encoded by LOC348155, corresponding to a target binding site such as BINDING SITE I, BINDING SITE II or BINDING SITE III of FIG. 8. Table 4 illustrates the complementarity of the nucleotide sequences of LOC348155 BINDING SITE, designated SEQ ID:17092, to the nucleotide sequence of GAM7080 RNA, herein designated GAM RNA, also designated SEQ ID:399.

Another function of GAM7080 is therefore inhibition of LOC348155 (Accession XP_211219.1). Accordingly, utilities of GAM7080 include diagnosis, prevention and treatment of diseases and clinical conditions associated with LOC348155.

LOC348378 (Accession XP_300723.1) is another GAM7080 target gene, herein designated TARGET GENE. LOC348378 BINDING SITE is a target binding site found in the 3' untranslated region of mRNA encoded by LOC348378, corresponding to a target binding site such as BINDING SITE I, BINDING SITE II or BINDING SITE III of FIG. 8. Table 4 illustrates the complementarity of the nucleotide sequences of LOC348378 BINDING SITE, designated SEQ ID:16073, to the nucleotide sequence of GAM7080 RNA, herein designated GAM RNA, also designated SEQ ID:399.

Another function of GAM7080 is therefore inhibition of LOC348378 (Accession XP_300723.1). Accordingly, utilities of GAM7080 include diagnosis, prevention and treatment of diseases and clinical conditions associated with LOC348378.

LOC348461 (Accession XP_302764.1) is another GAM7080 target gene, herein designated TARGET GENE. LOC348461 BINDING SITE1 and LOC348461 BINDING SITE2 are target binding sites found in untranslated regions of mRNA encoded by LOC348461, corresponding to target binding sites such as BINDING SITE I, BINDING SITE II or BINDING SITE III of FIG. 8. Table 4 illustrates the complementarity of the nucleotide sequences of LOC348461 BINDING SITE1 and LOC348461 BINDING SITE2, designated SEQ ID:13532 and SEQ ID:10426 respectively, to the nucleotide sequence of GAM7080 RNA, herein designated GAM RNA, also designated SEQ ID:399.

Another function of GAM7080 is therefore inhibition of LOC348461 (Accession XP_302764.1). Accordingly, utilities of GAM7080 include diagnosis, prevention and treatment of diseases and clinical conditions associated with LOC348461.

LOC352051 (Accession XP_305365.1) is another GAM7080 target gene, herein designated TARGET GENE. LOC352051 BINDING SITE is a target binding site found in the 5' untranslated region of mRNA encoded by LOC352051, corresponding to a target binding site such as BINDING SITE I, BINDING SITE II or BINDING SITE III of FIG. 8. Table 4 illustrates the complementarity of the nucleotide sequences of LOC352051 BINDING SITE, designated SEQ ID:16506, to the nucleotide sequence of GAM7080 RNA, herein designated GAM RNA, also designated SEQ ID:399.

Another function of GAM7080 is therefore inhibition of LOC352051 (Accession XP_305365.1). Accordingly, utilities of GAM7080 include diagnosis, prevention and treatment of diseases and clinical conditions associated with LOC352051.

LOC90786 (Accession XP_034127.1) is another GAM7080 target gene, herein designated TARGET GENE. LOC90786 BINDING SITE is a target binding site found in the 5' untranslated region of mRNA encoded by LOC90786, corresponding to a target binding site such as BINDING SITE I, BINDING SITE II or BINDING SITE III of FIG. 8. Table 4 illustrates the complementarity of the nucleotide sequences of LOC90786 BINDING SITE, designated SEQ ID:6662, to the nucleotide sequence of GAM7080 RNA, herein designated GAM RNA, also designated SEQ ID:399.

Another function of GAM7080 is therefore inhibition of LOC90786 (Accession XP_034127.1). Accordingly, utilities of GAM7080 include diagnosis, prevention and treatment of diseases and clinical conditions associated with LOC90786.

LOC90906 (Accession XP_034809.1) is another GAM7080 target gene, herein designated TARGET GENE. LOC90906 BINDING SITE is a target binding site found in the 3' untranslated region of mRNA encoded by LOC90906, corresponding to a target binding site such as BINDING SITE I, BINDING SITE II or BINDING SITE III of FIG. 8. Table 4 illustrates the complementarity of the nucleotide sequences of LOC90906 BINDING SITE, designated SEQ ID:8870, to the nucleotide sequence of GAM7080 RNA, herein designated GAM RNA, also designated SEQ ID:399.

Another function of GAM7080 is therefore inhibition of LOC90906 (Accession XP_034809.1). Accordingly, utilities of GAM7080 include diagnosis, prevention and treatment of diseases and clinical conditions associated with LOC90906.

LOC91948 (Accession XP_041723.1) is another GAM7080 target gene, herein designated TARGET GENE. LOC91948 BINDING SITE is a target binding site found in the 3' untranslated region of mRNA encoded by LOC91948, corresponding to a target binding site such as BINDING SITE I, BINDING SITE II or BINDING SITE III of FIG. 8. Table 4 illustrates the complementarity of the nucleotide sequences of LOC91948 BINDING SITE, designated SEQ ID:9979, to the nucleotide sequence of GAM7080 RNA, herein designated GAM RNA, also designated SEQ ID:399.

Another function of GAM7080 is therefore inhibition of LOC91948 (Accession XP_041723.1). Accordingly, utilities of GAM7080 include diagnosis, prevention and treatment of diseases and clinical conditions associated with LOC91948.

Mitogen-activated protein kinase kinase kinase 12 (MAP3K12, Accession NP_006292.2) is another GAM7080 target gene, herein designated TARGET GENE. MAP3K12 BINDING SITE is a target binding site found in the 3' untranslated region of mRNA encoded by MAP3K12, corresponding to a target binding site such as BINDING SITE I, BINDING SITE II or BINDING SITE III of FIG. 8. Table 4 illustrates the complementarity of the nucleotide sequences of MAP3K12 BINDING SITE, designated SEQ ID:6350, to the nucleotide sequence of GAM7080 RNA, herein designated GAM RNA, also designated SEQ ID:399.

Another function of GAM7080 is therefore inhibition of Mitogen-activated protein kinase kinase kinase 12 (MAP3K12, Accession NP_006292.2). Accordingly, utilities of GAM7080 include diagnosis, prevention and treatment of diseases and clinical conditions associated with MAP3K12.

MAPKBP1 (Accession XP_031706.7) is another GAM7080 target gene, herein designated TARGET GENE. MAPKBP1 BINDING SITE is a target binding site found in the 5' untranslated region of mRNA encoded by MAPKBP1, corresponding to a target binding site such as BINDING SITE I, BINDING SITE II or BINDING SITE III of FIG. 8. Table 4 illustrates the complementarity of the nucleotide sequences of MAPKBP1 BINDING SITE, designated SEQ ID:6124, to the nucleotide sequence of GAM7080 RNA, herein designated GAM RNA, also designated SEQ ID:399.

Another function of GAM7080 is therefore inhibition of MAPKBP1 (Accession XP_031706.7). Accordingly, utilities of GAM7080 include diagnosis, prevention and treatment of diseases and clinical conditions associated with MAPKBP1.

MGC26484 (Accession NP_689840.1) is another GAM7080 target gene, herein designated TARGET GENE. MGC26484 BINDING SITE is a target binding site found in the 3' untranslated region of mRNA encoded by MGC26484, corresponding to a target binding site such as BINDING SITE I, BINDING SITE II or BINDING SITE III of FIG. 8. Table 4 illustrates the complementarity of the nucleotide sequences of MGC26484 BINDING SITE, designated SEQ ID:14202, to the nucleotide sequence of GAM7080 RNA, herein designated GAM RNA, also designated SEQ ID:399.

Another function of GAM7080 is therefore inhibition of MGC26484 (Accession NP_689840.1). Accordingly, utilities of GAM7080 include diagnosis, prevention and treatment of diseases and clinical conditions associated with MGC26484.

MGC5391 (Accession NP_116129.2) is another GAM7080 target gene, herein designated TARGET GENE. MGC5391 BINDING SITE is a target binding site found in the 3' untranslated region of mRNA encoded by MGC5391, corresponding to a target binding site such as BINDING SITE I, BINDING SITE II or BINDING SITE III of FIG. 8. Table 4 illustrates the complementarity of the nucleotide sequences of MGC5391 BINDING SITE, designated SEQ ID:11363, to the nucleotide sequence of GAM7080 RNA, herein designated GAM RNA, also designated SEQ ID:399.

Another function of GAM7080 is therefore inhibition of MGC5391 (Accession NP_116129.2). Accordingly, utilities of GAM7080 include diagnosis, prevention and treatment of diseases and clinical conditions associated with MGC5391.

Microsomal glutathione s-transferase 1 (MGST1, Accession NP_064696.1) is another GAM7080 target gene, herein designated TARGET GENE. MGST1 BINDING SITE is a target binding site found in the 3' untranslated region of multiple transcripts of mRNA encoded by MGST1, corresponding to a target binding site such as BINDING SITE I, BINDING SITE II or BINDING SITE III of FIG. 8. Table 4 illustrates the complementarity of the nucleotide sequences of MGST1 BINDING SITE, designated SEQ ID:18899, to the nucleotide sequence of GAM7080 RNA, herein designated GAM RNA, also designated SEQ ID:399.

Another function of GAM7080 is therefore inhibition of Microsomal glutathione s-transferase 1 (MGST1, Accession NP_064696.1). Accordingly, utilities of GAM7080 include diagnosis, prevention and treatment of diseases and clinical conditions associated with MGST1.

Microsomal glutathione s-transferase 1 (MGST1, Accession NP_665707.1) is another GAM7080 target gene, herein designated TARGET GENE. MGST1 BINDING SITE is a target binding site found in the 3' untranslated region of multiple transcripts of mRNA encoded by MGST1, corresponding to a target binding site such as BINDING SITE I, BINDING SITE II or BINDING SITE III of FIG. 8. Table 4 illustrates the complementarity of the nucleotide sequences of MGST1 BINDING SITE, designated SEQ ID:18899, to the nucleotide sequence of GAM7080 RNA, herein designated GAM RNA, also designated SEQ ID:399.

Another function of GAM7080 is therefore inhibition of Microsomal glutathione s-transferase 1 (MGST1, Accession NP_665707.1). Accordingly, utilities of GAM7080 include diagnosis, prevention and treatment of diseases and clinical conditions associated with MGST1.

Microsomal glutathione s-transferase 1 (MGST1, Accession NP_665734.1) is another GAM7080 target gene, herein designated TARGET GENE. MGST1 BINDING SITE is a target binding site found in the 3' untranslated region of multiple transcripts of mRNA encoded by MGST1, corresponding to a target binding site such as BINDING SITE I, BINDING SITE II or BINDING SITE III of FIG. 8. Table 4 illustrates the complementarity of the nucleotide sequences of MGST1 BINDING SITE, designated SEQ ID:18899, to the nucleotide sequence of GAM7080 RNA, herein designated GAM RNA, also designated SEQ ID:399.

Another function of GAM7080 is therefore inhibition of Microsomal glutathione s-transferase 1 (MGST1, Accession NP_665734.1). Accordingly, utilities of GAM7080 include diagnosis, prevention and treatment of diseases and clinical conditions associated with MGST1.

Microsomal glutathione s-transferase 1 (MGST1, Accession NP_665735.1) is another GAM7080 target gene, herein designated TARGET GENE. MGST1 BINDING SITE is a target binding site found in the 3' untranslated region of multiple transcripts of mRNA encoded by MGST1, corresponding to a target binding site such as BINDING SITE I, BINDING SITE II or BINDING SITE III of FIG. 8. Table 4 illustrates the complementarity of the nucleotide sequences of MGST1 BINDING SITE, designated SEQ ID:18899, to the nucleotide sequence of GAM7080 RNA, herein designated GAM RNA, also designated SEQ ID:399.

Another function of GAM7080 is therefore inhibition of Microsomal glutathione s-transferase 1 (MGST1, Accession NP_665735.1). Accordingly, utilities of GAM7080 include diagnosis, prevention and treatment of diseases and clinical conditions associated with MGST1.

Makorin, ring finger protein, 1 (MKRN1, Accession NP_038474.1) is another GAM7080 target gene, herein designated TARGET GENE. MKRN1 BINDING SITE is a target binding site found in the 3' untranslated region of mRNA encoded by MKRN1, corresponding to a target binding site such as BINDING SITE I, BINDING SITE II or BINDING SITE III of FIG. 8. Table 4 illustrates the complementarity of the nucleotide sequences of MKRN1 BINDING SITE, designated SEQ ID:5996, to the nucleotide sequence of GAM7080 RNA, herein designated GAM RNA, also designated SEQ ID:399.

Another function of GAM7080 is therefore inhibition of Makorin, ring finger protein, 1 (MKRN1, Accession NP_038474.1). Accordingly, utilities of GAM7080 include diagnosis, prevention and treatment of diseases and clinical conditions associated with MKRN1.

MMAB (Accession NP_443077.1) is another GAM7080 target gene, herein designated TARGET GENE. MMAB BINDING SITE is a target binding site found in the 3' untranslated region of mRNA encoded by MMAB, corresponding to a target binding site such as BINDING SITE I, BINDING SITE II or BINDING SITE III of FIG. 8. Table 4 illustrates the complementarity of the nucleotide sequences of MMAB BINDING SITE, designated SEQ ID:4890, to the nucleotide sequence of GAM7080 RNA, herein designated GAM RNA, also designated SEQ ID:399.

Another function of GAM7080 is therefore inhibition of MMAB (Accession NP_443077.1). Accordingly, utilities of GAM7080 include diagnosis, prevention and treatment of diseases and clinical conditions associated with MMAB.

Molybdenum cofactor synthesis 2 (MOCS2, Accession NP_004522.1) is another GAM7080 target gene, herein designated TARGET GENE. MOCS2 BINDING SITE is a target binding site found in the 5' untranslated region of multiple transcripts of mRNA encoded by MOCS2, corresponding to a target binding site such as BINDING SITE I, BINDING SITE II or BINDING SITE III of FIG. 8. Table 4 illustrates the complementarity of the nucleotide sequences of MOCS2 BINDING SITE, designated SEQ ID:18450, to the nucleotide sequence of GAM7080 RNA, herein designated GAM RNA, also designated SEQ ID:399.

Another function of GAM7080 is therefore inhibition of Molybdenum cofactor synthesis 2 (MOCS2, Accession NP_004522.1). Accordingly, utilities of GAM7080 include diagnosis, prevention and treatment of diseases and clinical conditions associated with MOCS2.

Nijmegen breakage syndrome 1 (nibrin) (NBS1, Accession NP_002476.1) is another GAM7080 target gene, herein designated TARGET GENE. NBS1 BINDING SITE is a target binding site found in the 5' untranslated region of mRNA encoded by NBS1, corresponding to a target binding site such as BINDING SITE I, BINDING SITE II or BINDING SITE III of FIG. 8. Table 4 illustrates the complementarity of the nucleotide sequences of NBS1 BINDING SITE, designated SEQ ID:9084, to the nucleotide sequence of GAM7080 RNA, herein designated GAM RNA, also designated SEQ ID:399.

Another function of GAM7080 is therefore inhibition of Nijmegen breakage syndrome 1 (nibrin) (NBS1, Accession NP_002476.1), a gene which may be involved in repair of DNA double-strand breaks and therefore may be associated with Nijmegen breakage syndrome. Accordingly, utilities of GAM7080 include diagnosis, prevention and treatment of Nijmegen breakage syndrome, and of other diseases and clinical conditions associated with NBS1.

The function of NBS1 and its association with various diseases and clinical conditions, has been established by previous studies, as described hereinabove with reference to GAM861.2. Neural precursor cell expressed, developmentally down-regulated 5 (NEDD5, Accession NP_004395.1) is another GAM7080 target gene, herein designated TARGET GENE. NEDD5 BINDING SITE is a target binding site found in the 3' untranslated region of mRNA encoded by NEDD5, corresponding to a target binding site such as BINDING SITE I, BINDING SITE II or BINDING SITE III of FIG. 8. Table 4 illustrates the complementarity of the nucleotide sequences of NEDD5 BINDING SITE, designated SEQ ID:5197, to the nucleotide sequence of GAM7080 RNA, herein designated GAM RNA, also designated SEQ ID:399.

Another function of GAM7080 is therefore inhibition of Neural precursor cell expressed, developmentally down-regulated 5 (NEDD5, Accession NP_004395.1). Accordingly, utilities of GAM7080 include diagnosis, prevention and treatment of diseases and clinical conditions associated with NEDD5.

Nei like 2 (e. coli) (NEIL2, Accession NP_659480.1) is another GAM7080 target gene, herein designated TARGET GENE. NEIL2 BINDING SITE is a target binding site found in the 3' untranslated region of mRNA encoded by NEIL2, corresponding to a target binding site such as BINDING SITE I, BINDING SITE II or BINDING SITE III of FIG. 8. Table 4 illustrates the complementarity of the nucleotide sequences of NEIL2 BINDING SITE, designated SEQ ID:18237, to the nucleotide sequence of GAM7080 RNA, herein designated GAM RNA, also designated SEQ ID:399.

Another function of GAM7080 is therefore inhibition of Nei like 2 (e. coli) (NEIL2, Accession NP_659480.1). Accordingly, utilities of GAM7080 include diagnosis, prevention and treatment of diseases and clinical conditions associated with NEIL2.

8-oxoguanine dna glycosylase (OGG1, Accession NP_058438.1) is another GAM7080 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:9506, to the nucleotide sequence of GAM7080 RNA, herein designated GAM RNA, also designated SEQ ID:399.

Another function of GAM7080 is therefore inhibition of 8-oxoguanine dna glycosylase (OGG1, Accession NP_058438.1), a gene which is involved in base excision DNA repair and removal of 8-oxyguanine and therefore may be associated with Tumorigenesis. Accordingly, utilities of GAM7080 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_058214.1) is another GAM7080 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:9506, to the nucleotide sequence of GAM7080 RNA, herein designated GAM RNA, also designated SEQ ID:399.

Another function of GAM7080 is therefore inhibition of 8-oxoguanine dna glycosylase (OGG1, Accession NP_058214.1), a gene which is involved in base excision DNA repair and removal of 8-oxyguanine and therefore may be associated with Tumorigenesis. Accordingly, utilities of GAM7080 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_058434.1) is another GAM7080 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:9506, to the nucleotide sequence of GAM7080 RNA, herein designated GAM RNA, also designated SEQ ID:399.

Another function of GAM7080 is therefore inhibition of 8-oxoguanine dna glycosylase (OGG1, Accession NP_058434.1), a gene which is involved in base excision DNA repair and removal of 8-oxyguanine and therefore may be associated with Tumorigenesis. Accordingly, utilities of GAM7080 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_058213.1) is another GAM7080 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:9506, to the nucleotide sequence of GAM7080 RNA, herein designated GAM RNA, also designated SEQ ID:399.

Another function of GAM7080 is therefore inhibition of 8-oxoguanine dna glycosylase (OGG1, Accession NP_058213.1), a gene which is involved in base excision DNA repair and removal of 8-oxyguanine and therefore may be associated with Tumorigenesis. Accordingly, utilities of GAM7080 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_058436.1) is another GAM7080 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:9506, to the nucleotide sequence of GAM7080 RNA, herein designated GAM RNA, also designated SEQ ID:399.

Another function of GAM7080 is therefore inhibition of 8-oxoguanine dna glycosylase (OGG1, Accession NP_058436.1), a gene which is involved in base excision DNA repair and removal of 8-oxyguanine and therefore may be associated with Tumorigenesis. Accordingly, utilities of GAM7080 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_058437.1) is another GAM7080 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:9506, to the nucleotide sequence of GAM7080 RNA, herein designated GAM RNA, also designated SEQ ID:399.

Another function of GAM7080 is therefore inhibition of 8-oxoguanine dna glycosylase (OGG1, Accession NP_058437.1), a gene which is involved in base excision DNA repair and removal of 8-oxyguanine and therefore may be associated with Tumorigenesis. Accordingly, utilities of GAM7080 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_002533.1) is another GAM7080 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:9506, to the nucleotide sequence of GAM7080 RNA, herein designated GAM RNA, also designated SEQ ID:399.

Another function of GAM7080 is therefore inhibition of 8-oxoguanine dna glycosylase (OGG1, Accession NP_002533.1), a gene which is involved in base excision DNA repair and removal of 8-oxyguanine and therefore may be associated with Tumorigenesis. Accordingly, utilities of GAM7080 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_058212.1) is another GAM7080 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:9506, to the nucleotide sequence of GAM7080 RNA, herein designated GAM RNA, also designated SEQ ID:399.

Another function of GAM7080 is therefore inhibition of 8-oxoguanine dna glycosylase (OGG1, Accession NP_058212.1), a gene which is involved in base excision DNA repair and removal of 8-oxyguanine and therefore may be associated with Tumorigenesis. Accordingly, utilities of GAM7080 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1. Oligodendrocyte lineage transcription factor 2 (OLIG2, Accession NP_005797.1) is another GAM7080 target gene, herein designated TARGET GENE. OLIG2 BINDING SITE is a target binding site found in the 3' untranslated region of mRNA encoded by OLIG2, corresponding to a target binding site such as BINDING SITE I, BINDING SITE II or BINDING SITE III of FIG. 8. Table 4 illustrates the complementarity of the nucleotide sequences of OLIG2 BINDING SITE, designated SEQ ID:1833, to the nucleotide sequence of GAM7080 RNA, herein designated GAM RNA, also designated SEQ ID:399.

Another function of GAM7080 is therefore inhibition of Oligodendrocyte lineage transcription factor 2 (OLIG2, Accession NP_005797.1), a gene which may bind DNA and contains a helix-loop-helix DNA-binding domain. Accordingly, utilities of GAM7080 include diagnosis, prevention and treatment of diseases and clinical conditions associated with OLIG2.

The function of OLIG2 and its association with various diseases and clinical conditions, has been established by previous studies, as described hereinabove with reference to GAM163.1. PCSCL (Accession XP_027668.7) is another GAM7080 target gene, herein designated TARGET GENE. PCSCL BINDING SITE is a target binding site found in the 3' untranslated region of mRNA encoded by PCSCL, corresponding to a target binding site such as BINDING SITE I, BINDING SITE II or BINDING SITE III of FIG. 8. Table 4 illustrates the complementarity of the nucleotide sequences of PCSCL BINDING SITE, designated SEQ ID:13407, to the nucleotide sequence of GAM7080 RNA, herein designated GAM RNA, also designated SEQ ID:399.

Another function of GAM7080 is therefore inhibition of PCSCL (Accession XP_027668.7). Accordingly, utilities of GAM7080 include diagnosis, prevention and treatment of diseases and clinical conditions associated with PCSCL.

Paternally expressed 10 (PEG10, Accession NP_055883.1) is another GAM7080 target gene, herein designated TARGET GENE. PEG10 BINDING SITE is a target binding site found in the 3' untranslated region of mRNA encoded by PEG10, corresponding to a target binding site such as BINDING SITE I, BINDING SITE II or BINDING SITE III of FIG. 8. Table 4 illustrates the complementarity of the nucleotide sequences of PEG10 BINDING SITE, designated SEQ ID:7017, to the nucleotide sequence of GAM7080 RNA, herein designated GAM RNA, also designated SEQ ID:399.

Another function of GAM7080 is therefore inhibition of Paternally expressed 10 (PEG10, Accession NP_055883.1). Accordingly, utilities of GAM7080 include diagnosis, prevention and treatment of diseases and clinical conditions associated with PEG10.

Phosphatidylinositol-4-phosphate 5-kinase, type i, gamma (PIP5K1C, Accession XP_047620.2) is another GAM7080 target gene, herein designated TARGET GENE. PIP5K1C BINDING SITE is a target binding site found in the 3' untranslated region of multiple transcripts of mRNA encoded by PIP5K1C, corresponding to a target binding site such as BINDING SITE I, BINDING SITE II or BINDING SITE III of FIG. 8. Table 4 illustrates the complementarity of the nucleotide sequences of PIP5K1C BINDING SITE, designated SEQ ID:5961, to the nucleotide sequence of GAM7080 RNA, herein designated GAM RNA, also designated SEQ ID:399.

Another function of GAM7080 is therefore inhibition of Phosphatidylinositol-4-phosphate 5-kinase, type i, gamma (PIP5K1C, Accession XP_047620.2). Accordingly, utilities of GAM7080 include diagnosis, prevention and treatment of diseases and clinical conditions associated with PIP5K1C.

Phosphatidylinositol-4-phosphate 5-kinase, type i, gamma (PIP5K1C, Accession NP_036530.1) is another GAM7080 target gene, herein designated TARGET GENE. PIP5K1C BINDING SITE is a target binding site found in the 3' untranslated region of multiple transcripts of mRNA encoded by PIP5K1C, corresponding to a target binding site such as BINDING SITE I, BINDING SITE II or BINDING SITE III of FIG. 8. Table 4 illustrates the complementarity of the nucleotide sequences of PIP5K1C BINDING SITE, designated SEQ ID:5961, to the nucleotide sequence of GAM7080 RNA, herein designated GAM RNA, also designated SEQ ID:399.

Another function of GAM7080 is therefore inhibition of Phosphatidylinositol-4-phosphate 5-kinase, type i, gamma (PIP5K1C, Accession NP_036530.1). Accordingly, utilities of GAM7080 include diagnosis, prevention and treatment of diseases and clinical conditions associated with PIP5K1C.

PLEKHE1 (Accession XP_166290.1) is another GAM7080 target gene, herein designated TARGET GENE. PLEKHE1 BINDING SITE is a target binding site found in the 5' untranslated region of mRNA encoded by PLEKHE1, corresponding to a target binding site such as BINDING SITE I, BINDING SITE II or BINDING SITE III of FIG. 8. Table 4 illustrates the complementarity of the nucleotide sequences of PLEKHE1 BINDING SITE, designated SEQ ID:996, to the nucleotide sequence of GAM7080 RNA, herein designated GAM RNA, also designated SEQ ID:399.

Another function of GAM7080 is therefore inhibition of PLEKHE1 (Accession XP_166290.1). Accordingly, utilities of GAM7080 include diagnosis, prevention and treatment of diseases and clinical conditions associated with PLEKHE1.

Protein phosphatase, ef hand calcium-binding domain 1 (PPEF1, Accession NP_689411.1) is another GAM7080 target gene, herein designated TARGET GENE. PPEF1 BINDING SITE1 and PPEF1 BINDING SITE2 are target binding sites found in untranslated regions of multiple transcripts of mRNA encoded by PPEF1, corresponding to target binding sites such as BINDING SITE I, BINDING SITE II or BINDING SITE III of FIG. 8. Table 4 illustrates the complementarity of the nucleotide sequences of PPEF1 BINDING SITE1 and PPEF1 BINDING SITE2, designated SEQ ID:10928 and SEQ ID:3646 respectively, to the nucleotide sequence of GAM7080 RNA, herein designated GAM RNA, also designated SEQ ID:399.

Another function of GAM7080 is therefore inhibition of Protein phosphatase, ef hand calcium-binding domain 1 (PPEF1, Accession NP_689411.1), a gene which may have a role in the recovery or adaptation response of photoreceptors and therefore may be associated with X-linked juvenile retinoschisis. Accordingly, utilities of GAM7080 include diagnosis, prevention and treatment of X-linked juvenile retinoschisis, and of other diseases and clinical conditions associated with PPEF1.

The function of PPEF1 and its association with various diseases and clinical conditions, has been established by previous studies, as described hereinabove with reference to GAM65.2. Protein phosphatase 1a (formerly 2c), magnesium-dependent, alpha isoform (PPM1A, Accession NP_808820.1) is another GAM7080 target gene, herein designated TARGET GENE. PPM1A BINDING SITE is a target binding site found in the 5' untranslated region of multiple transcripts of mRNA encoded by PPM1A, corresponding to a target binding site such as BINDING SITE I, BINDING SITE II or BINDING SITE III of FIG. 8. Table 4 illustrates the complementarity of the nucleotide sequences of PPM1A BINDING SITE, designated SEQ ID:11868, to the nucleotide sequence of GAM7080 RNA, herein designated GAM RNA, also designated SEQ ID:399.

Another function of GAM7080 is therefore inhibition of Protein phosphatase 1a (formerly 2c), magnesium-dependent, alpha isoform (PPM1A, Accession NP_808820.1). Accordingly, utilities of GAM7080 include diagnosis, prevention and treatment of diseases and clinical conditions associated with PPM1A.

Protein phosphatase 1, regulatory (inhibitor) subunit 9a (PPP1R9A, Accession NP_060120.1) is another GAM7080 target gene, herein designated TARGET GENE. PPP1R9A BINDING SITE is a target binding site found in the 3' untranslated region of mRNA encoded by PPP1R9A, corresponding to a target binding site such as BINDING SITE I, BINDING SITE II or BINDING SITE III of FIG. 8. Table 4 illustrates the complementarity of the nucleotide sequences of PPP1R9A BINDING SITE, designated SEQ ID:3742, to the nucleotide sequence of GAM7080 RNA, herein designated GAM RNA, also designated SEQ ID:399.

Another function of GAM7080 is therefore inhibition of Protein phosphatase 1, regulatory (inhibitor) subunit 9a (PPP1R9A, Accession NP_060120.1). Accordingly, utilities of GAM7080 include diagnosis, prevention and treatment of diseases and clinical conditions associated with PPP1R9A.

ProSAPiP2 (Accession NP_055541.1) is another GAM7080 target gene, herein designated TARGET GENE. ProSAPiP2 BINDING SITE is a target binding site found in the 3' untranslated region of mRNA encoded by ProSAPiP2, corresponding to a target binding site such as BINDING SITE I, BINDING SITE II or BINDING SITE III of FIG. 8. Table 4 illustrates the complementarity of the nucleotide sequences of ProSAPiP2 BINDING SITE, designated SEQ ID:12114, to the nucleotide sequence of GAM7080 RNA, herein designated GAM RNA, also designated SEQ ID:399.

Another function of GAM7080 is therefore inhibition of ProSAPiP2 (Accession NP_055541.1). Accordingly, utilities of GAM7080 include diagnosis, prevention and treatment of diseases and clinical conditions associated with ProSAPiP2.

Rab35, member ras oncogene family (RAB35, Accession NP_006852.1) is another GAM7080 target gene, herein designated TARGET GENE. RAB35 BINDING SITE is a target binding site found in the 3' untranslated region of mRNA encoded by RAB35, corresponding to a target binding site such as BINDING SITE I, BINDING SITE II or BINDING SITE III of FIG. 8. Table 4 illustrates the complementarity of the nucleotide sequences of RAB35 BINDING SITE, designated SEQ ID:18480, to the nucleotide sequence of GAM7080 RNA, herein designated GAM RNA, also designated SEQ ID:399.

Another function of GAM7080 is therefore inhibition of Rab35, member ras oncogene family (RAB35, Accession NP_006852.1). Accordingly, utilities of GAM7080 include diagnosis, prevention and treatment of diseases and clinical conditions associated with RAB35.

Rab6a, member ras oncogene family (RAB6A, Accession NP_002860.2) is another GAM7080 target gene, herein designated TARGET GENE. RAB6A BINDING SITE is a target binding site found in the 5' untranslated region of mRNA encoded by RAB6A, corresponding to a target binding site such as BINDING SITE I, BINDING SITE II or BINDING SITE III of FIG. 8. Table 4 illustrates the complementarity of the nucleotide sequences of RAB6A BINDING SITE, designated SEQ ID:6689, to the nucleotide sequence of GAM7080 RNA, herein designated GAM RNA, also designated SEQ ID:399.

Another function of GAM7080 is therefore inhibition of Rab6a, member ras oncogene family (RAB6A, Accession NP_002860.2), a gene which is involved in protein trafficking. Accordingly, utilities of GAM7080 include diagnosis, prevention and treatment of diseases and clinical conditions associated with RAB6A.

The function of RAB6A and its association with various diseases and clinical conditions, has been established by previous studies, as described hereinabove with reference to GAM374.2. REC8 (Accession NP_005123.1) is another GAM7080 target gene, herein designated TARGET GENE. REC8 BINDING SITE is a target binding site found in the 5' untranslated region of mRNA encoded by REC8, corresponding to a target binding site such as BINDING SITE I, BINDING SITE II or BINDING SITE III of FIG. 8. Table 4 illustrates the complementarity of the nucleotide sequences of REC8 BINDING SITE, designated SEQ ID:18238, to the nucleotide sequence of GAM7080 RNA, herein designated GAM RNA, also designated SEQ ID:399.

Another function of GAM7080 is therefore inhibition of REC8 (Accession NP_005123.1). Accordingly, utilities of GAM7080 include diagnosis, prevention and treatment of diseases and clinical conditions associated with REC8.

SCN3B (Accession NP_060870.1) is another GAM7080 target gene, herein designated TARGET GENE. SCN3B BINDING SITE is a target binding site found in the 3' untranslated region of mRNA encoded by SCN3B, corresponding to a target binding site such as BINDING SITE I, BINDING SITE II or BINDING SITE III of FIG. 8. Table 4 illustrates the complementarity of the nucleotide sequences of SCN3B BINDING SITE, designated SEQ ID:15263, to the nucleotide sequence of GAM7080 RNA, herein designated GAM RNA, also designated SEQ ID:399.

Another function of GAM7080 is therefore inhibition of SCN3B (Accession NP_060870.1). Accordingly, utilities of GAM7080 include diagnosis, prevention and treatment of diseases and clinical conditions associated with SCN3B.

SF4 (Accession NP_066987.1) is another GAM7080 target gene, herein designated TARGET GENE. SF4 BINDING SITE is a target binding site found in the 3' untranslated region of mRNA encoded by SF4, corresponding to a target binding site such as BINDING SITE I, BINDING SITE II or BINDING SITE III of FIG. 8. Table 4 illustrates the complementarity of the nucleotide sequences of SF4 BINDING SITE, designated SEQ ID:5616, to the nucleotide sequence of GAM7080 RNA, herein designated GAM RNA, also designated SEQ ID:399.

Another function of GAM7080 is therefore inhibition of SF4 (Accession NP_066987.1). Accordingly, utilities of GAM7080 include diagnosis, prevention and treatment of diseases and clinical conditions associated with SF4.

SHAPY (Accession NP_620148.1) is another GAM7080 target gene, herein designated TARGET GENE. SHAPY BINDING SITE is a target binding site found in the 5' untranslated region of mRNA encoded by SHAPY, corresponding to a target binding site such as BINDING SITE I, BINDING SITE II or BINDING SITE III of FIG. 8. Table 4 illustrates the complementarity of the nucleotide sequences of SHAPY BINDING SITE, designated SEQ ID:7951, to the nucleotide sequence of GAM7080 RNA, herein designated GAM RNA, also designated SEQ ID:399.

Another function of GAM7080 is therefore inhibition of SHAPY (Accession NP_620148.1). Accordingly, utilities of GAM7080 include diagnosis, prevention and treatment of diseases and clinical conditions associated with SHAPY.

Solute carrier family 26, member 9 (SLC26A9, Accession NP_443166.1) is another GAM7080 target gene, herein designated TARGET GENE. SLC26A9 BINDING SITE is a target binding site found in the 3' untranslated region of multiple transcripts of mRNA encoded by SLC26A9, corresponding to a target binding site such as BINDING SITE I, BINDING SITE II or BINDING SITE III of FIG. 8. Table 4 illustrates the complementarity of the nucleotide sequences of SLC26A9 BINDING SITE, designated SEQ ID:10994, to the nucleotide sequence of GAM7080 RNA, herein designated GAM RNA, also designated SEQ ID:399.

Another function of GAM7080 is therefore inhibition of Solute carrier family 26, member 9 (SLC26A9, Accession NP_443166.1). Accordingly, utilities of GAM7080 include diagnosis, prevention and treatment of diseases and clinical conditions associated with SLC26A9.

Solute carrier family 26, member 9 (SLC26A9, Accession NP_599152.1) is another GAM7080 target gene, herein designated TARGET GENE. SLC26A9 BINDING SITE is a target binding site found in the 3' untranslated region of multiple transcripts of mRNA encoded by SLC26A9, corresponding to a target binding site such as BINDING SITE I, BINDING SITE II or BINDING SITE III of FIG. 8. Table 4 illustrates the complementarity of the nucleotide sequences of SLC26A9 BINDING SITE, designated SEQ ID:10994, to the nucleotide sequence of GAM7080 RNA, herein designated GAM RNA, also designated SEQ ID:399.

Another function of GAM7080 is therefore inhibition of Solute carrier family 26, member 9 (SLC26A9, Accession NP_599152.1). Accordingly, utilities of GAM7080 include diagnosis, prevention and treatment of diseases and clinical conditions associated with SLC26A9.

Syntaphilin (SNPH, Accession NP_055538.1) is another GAM7080 target gene, herein designated TARGET GENE. SNPH BINDING SITE is a target binding site found in the 3' untranslated region of mRNA encoded by SNPH, corresponding to a target binding site such as BINDING SITE I, BINDING SITE II or BINDING SITE III of FIG. 8. Table 4 illustrates the complementarity of the nucleotide sequences of SNPH BINDING SITE, designated SEQ ID:6584, to the nucleotide sequence of GAM7080 RNA, herein designated GAM RNA, also designated SEQ ID:399.

Another function of GAM7080 is therefore inhibition of Syntaphilin (SNPH, Accession NP_055538.1). Accordingly, utilities of GAM7080 include diagnosis, prevention and treatment of diseases and clinical conditions associated with SNPH.

Sulfotransferase family 4a, member 1 (SULT4A1, Accession NP_795343.1) is another GAM7080 target gene, herein designated TARGET GENE. SULT4A1 BINDING SITE1 and SULT4A1 BINDING SITE2 are target binding sites found in untranslated regions of multiple transcripts of mRNA encoded by SULT4A1, corresponding to target binding sites such as BINDING SITE I, BINDING SITE II or BINDING SITE III of FIG. 8. Table 4 illustrates the complementarity of the nucleotide sequences of SULT4A1 BINDING SITE1 and SULT4A1 BINDING SITE2, designated SEQ ID:1964 and SEQ ID:1964 respectively, to the nucleotide sequence of GAM7080 RNA, herein designated GAM RNA, also designated SEQ ID:399.

Another function of GAM7080 is therefore inhibition of Sulfotransferase family 4a, member 1 (SULT4A1, Accession NP_795343.1). Accordingly, utilities of GAM7080 include diagnosis, prevention and treatment of diseases and clinical conditions associated with SULT4A1.

Sulfotransferase family 4a, member 1 (SULT4A1, Accession NP_795343.1) is another GAM7080 target gene, herein designated TARGET GENE. SULT4A1 BINDING SITE1 and SULT4A1 BINDING SITE2 are target binding sites found in untranslated regions of multiple transcripts of mRNA encoded by SULT4A1, corresponding to target binding sites such as BINDING SITE I, BINDING SITE II or BINDING SITE III of FIG. 8. Table 4 illustrates the complementarity of the nucleotide sequences of SULT4A1 BINDING SITE1 and SULT4A1 BINDING SITE2, designated SEQ ID:19791 and SEQ ID:443 respectively, to the nucleotide sequence of GAM7080 RNA, herein designated GAM RNA, also designated SEQ ID:399.

Another function of GAM7080 is therefore inhibition of Sulfotransferase family 4a, member 1 (SULT4A1, Accession NP_795343.1). Accordingly, utilities of GAM7080 include diagnosis, prevention and treatment of diseases and clinical conditions associated with SULT4A1.

Tbc1 domain family, member 5 (TBC1D5, Accession NP_055559.1) is another GAM7080 target gene, herein designated TARGET GENE. TBC1D5 BINDING SITE is a target binding site found in the 3' untranslated region of mRNA encoded by TBC1D5, corresponding to a target binding site such as BINDING SITE I, BINDING SITE II or BINDING SITE III of FIG. 8. Table 4 illustrates the complementarity of the nucleotide sequences of TBC1D5 BINDING SITE, designated SEQ ID:7853, to the nucleotide sequence of GAM7080 RNA, herein designated GAM RNA, also designated SEQ ID:399.

Another function of GAM7080 is therefore inhibition of Tbc1 domain family, member 5 (TBC1D5, Accession NP_055559.1). Accordingly, utilities of GAM7080 include diagnosis, prevention and treatment of diseases and clinical conditions associated with TBC1D5.

Tubulin-specific chaperone d (TBCD, Accession NP_005984.2) is another GAM7080 target gene, herein designated TARGET GENE. TBCD BINDING SITE is a target binding site found in the 3' untranslated region of mRNA encoded by TBCD, corresponding to a target binding site such as BINDING SITE I, BINDING SITE II or BINDING SITE III of FIG. 8. Table 4 illustrates the complementarity of the nucleotide sequences of TBCD BINDING SITE, designated SEQ ID:687, to the nucleotide sequence of GAM7080 RNA, herein designated GAM RNA, also designated SEQ ID:399.

Another function of GAM7080 is therefore inhibition of Tubulin-specific chaperone d (TBCD, Accession NP_005984.2), a gene which modulates microtubule dynmaics by capturing GTP-bound TUBB. Accordingly, utilities of GAM7080 include diagnosis, prevention and treatment of diseases and clinical conditions associated with TBCD.

The function of TBCD and its association with various diseases and clinical conditions, has been established by previous studies, as described hereinabove with reference to GAM2205.1. Transducin (beta)-like 1x-linked (TBL1X, Accession NP_005638.1) is another GAM7080 target gene, herein designated TARGET GENE. TBL1X BINDING SITE is a target binding site found in the 3' untranslated region of mRNA encoded by TBL1X, corresponding to a target binding site such as BINDING SITE I, BINDING SITE II or BINDING SITE III of FIG. 8. Table 4 illustrates the complementarity of the nucleotide sequences of TBL1X BINDING SITE, designated SEQ ID:13310, to the nucleotide sequence of GAM7080 RNA, herein designated GAM RNA, also designated SEQ ID:399.

Another function of GAM7080 is therefore inhibition of Transducin (beta)-like 1x-linked (TBL1X, Accession NP_005638.1), a gene which activates latent HDAC3 activity. Accordingly, utilities of GAM7080 include diagnosis, prevention and treatment of diseases and clinical conditions associated with TBL1X.

The function of TBL1X and its association with various diseases and clinical conditions, has been established by previous studies, as described hereinabove with reference to GAM28.1. Transcription factor 3 (e2a immunoglobulin enhancer binding factors e12/e47) (TCF3, Accession NP_003191.1) is another GAM7080 target gene, herein designated TARGET GENE. TCF3 BINDING SITE is a target binding site found in the 3' untranslated region of mRNA encoded by TCF3, corresponding to a target binding site such as BINDING SITE I, BINDING SITE II or BINDING SITE III of FIG. 8. Table 4 illustrates the complementarity of the nucleotide sequences of TCF3 BINDING SITE, designated SEQ ID:19748, to the nucleotide sequence of GAM7080 RNA, herein designated GAM RNA, also designated SEQ ID:399.

Another function of GAM7080 is therefore inhibition of Transcription factor 3 (e2a immunoglobulin enhancer binding factors e12/e47) (TCF3, Accession NP_003191.1), a gene which plays major roles in determining tissue-specific cell fate during embryogenesis. Accordingly, utilities of GAM7080 include diagnosis, prevention and treatment of diseases and clinical conditions associated with TCF3.

The function of TCF3 and its association with various diseases and clinical conditions, has been established by previous studies, as described hereinabove with reference to GAM460.1. Tgfb-induced factor (tale family homeobox) (TGIF, Accession NP_733796.2) is another GAM7080 target gene, herein designated TARGET GENE. TGIF BINDING SITE is a target binding site found in the 5' untranslated region of multiple transcripts of mRNA encoded by TGIF, corresponding to a target binding site such as BINDING SITE I, BINDING SITE II or BINDING SITE III of FIG. 8. Table 4 illustrates the complementarity of the nucleotide sequences of TGIF BINDING SITE, designated SEQ ID:14220, to the nucleotide sequence of GAM7080 RNA, herein designated GAM RNA, also designated SEQ ID:399.

Another function of GAM7080 is therefore inhibition of Tgfb-induced factor (tale family homeobox) (TGIF, Accession NP_733796.2). Accordingly, utilities of GAM7080 include diagnosis, prevention and treatment of diseases and clinical conditions associated with TGIF.

Th1-like (drosophila) (TH1L, Accession NP_057481.1) is another GAM7080 target gene, herein designated TARGET GENE. TH1L BINDING SITE is a target binding site found in the 3' untranslated region of mRNA encoded by TH1L, corresponding to a target binding site such as BINDING SITE I, BINDING SITE II or BINDING SITE III of FIG. 8. Table 4 illustrates the complementarity of the nucleotide sequences of TH1L BINDING SITE, designated SEQ ID:11801, to the nucleotide sequence of GAM7080 RNA, herein designated GAM RNA, also designated SEQ ID:399.

Another function of GAM7080 is therefore inhibition of Th1-like (drosophila) (TH1L, Accession NP_057481.1). Accordingly, utilities of GAM7080 include diagnosis, prevention and treatment of diseases and clinical conditions associated with TH1L.

Toll-like receptor 4 (TLR4, Accession NP_612567.1) is another GAM7080 target gene, herein designated TARGET GENE. TLR4 BINDING SITE is a target binding site found in the 5' untranslated region of multiple transcripts of mRNA encoded by TLR4, corresponding to a target binding site such as BINDING SITE I, BINDING SITE II or BINDING SITE III of FIG. 8. Table 4 illustrates the complementarity of the nucleotide sequences of TLR4 BINDING SITE, designated SEQ ID:14153, to the nucleotide sequence of GAM7080 RNA, herein designated GAM RNA, also designated SEQ ID:399.

Another function of GAM7080 is therefore inhibition of Toll-like receptor 4 (TLR4, Accession NP_612567.1). Accordingly, utilities of GAM7080 include diagnosis, prevention and treatment of diseases and clinical conditions associated with TLR4.

Tumor necrosis factor (ligand) superfamily, member 15 (TNFSF15, Accession NP_005109.2) is another GAM7080 target gene, herein designated TARGET GENE. TNFSF15 BINDING SITE is a target binding site found in the 3' untranslated region of mRNA encoded by TNFSF15, corresponding to a target binding site such as BINDING SITE I, BINDING SITE II or BINDING SITE III of FIG. 8. Table 4 illustrates the complementarity of the nucleotide sequences of TNFSF15 BINDING SITE, designated SEQ ID:1718, to the nucleotide sequence of GAM7080 RNA, herein designated GAM RNA, also designated SEQ ID:399.

Another function of GAM7080 is therefore inhibition of Tumor necrosis factor (ligand) superfamily, member 15 (TNFSF15, Accession NP_005109.2), a gene which acts as an autocrine factor to induce apoptosis in endothelial cells. Accordingly, utilities of GAM7080 include diagnosis, prevention and treatment of diseases and clinical conditions associated with TNFSF15.

The function of TNFSF15 and its association with various diseases and clinical conditions, has been established by previous studies, as described hereinabove with reference to GAM100.1. Torsin family 1, member b (torsin b) (TOR1B, Accession NP_055321.1) is another GAM7080 target gene, herein designated TARGET GENE. TOR1B BINDING SITE is a target binding site found in the 3' untranslated region of mRNA encoded by TOR1B, corresponding to a target binding site such as BINDING SITE I, BINDING SITE II or BINDING SITE III of FIG. 8. Table 4 illustrates the complementarity of the nucleotide sequences of TOR1B BINDING SITE, designated SEQ ID:15595, to the nucleotide sequence of GAM7080 RNA, herein designated GAM RNA, also designated SEQ ID:399.

Another function of GAM7080 is therefore inhibition of Torsin family 1, member b (torsin b) (TOR1B, Accession NP_055321.1). Accordingly, utilities of GAM7080 include diagnosis, prevention and treatment of diseases and clinical conditions associated with TOR1B.

Tropomyosin 3 (TPM3, Accession NP_705935.1) is another GAM7080 target gene, herein designated TARGET GENE. TPM3 BINDING SITE is a target binding site found in the 3' untranslated region of multiple transcripts of mRNA encoded by TPM3, corresponding to a target binding site such as BINDING SITE I, BINDING SITE II or BINDING SITE III of FIG. 8. Table 4 illustrates the complementarity of the nucleotide sequences of TPM3 BINDING SITE, designated SEQ ID:5328, to the nucleotide sequence of GAM7080 RNA, herein designated GAM RNA, also designated SEQ ID:399.

Another function of GAM7080 is therefore inhibition of Tropomyosin 3 (TPM3, Accession NP_705935.1). Accordingly, utilities of GAM7080 include diagnosis, prevention and treatment of diseases and clinical conditions associated with TPM3.

TREM5 (Accession NP_777552.1) is another GAM7080 target gene, herein designated TARGET GENE. TREM5 BINDING SITE is a target binding site found in the 3' untranslated region of mRNA encoded by TREM5, corresponding to a target binding site such as BINDING SITE I, BINDING SITE II or BINDING SITE III of FIG. 8. Table 4 illustrates the complementarity of the nucleotide sequences of TREM5 BINDING SITE, designated SEQ ID:10274, to the nucleotide sequence of GAM7080 RNA, herein designated GAM RNA, also designated SEQ ID:399.

Another function of GAM7080 is therefore inhibition of TREM5 (Accession NP_777552.1). Accordingly, utilities of GAM7080 include diagnosis, prevention and treatment of diseases and clinical conditions associated with TREM5.

TRIM41 (Accession NP_291027.2) is another GAM7080 target gene, herein designated TARGET GENE. TRIM41 BINDING SITE is a target binding site found in the 3' untranslated region of mRNA encoded by TRIM41, corresponding to a target binding site such as BINDING SITE I, BINDING SITE II or BINDING SITE III of FIG. 8. Table 4 illustrates the complementarity of the nucleotide sequences of TRIM41 BINDING SITE, designated SEQ ID:12798, to the nucleotide sequence of GAM7080 RNA, herein designated GAM RNA, also designated SEQ ID:399.

Another function of GAM7080 is therefore inhibition of TRIM41 (Accession NP_291027.2). Accordingly, utilities of GAM7080 include diagnosis, prevention and treatment of diseases and clinical conditions associated with TRIM41.

Thioredoxin reductase 1 (TXNRD1, Accession NP_003321.1) is another GAM7080 target gene, herein designated TARGET GENE. TXNRD1 BINDING SITE is a target binding site found in the 5' untranslated region of mRNA encoded by TXNRD1, corresponding to a target binding site such as BINDING SITE I, BINDING SITE II or BINDING SITE III of FIG. 8. Table 4 illustrates the complementarity of the nucleotide sequences of TXNRD1 BINDING SITE, designated SEQ ID:10465, to the nucleotide sequence of GAM7080 RNA, herein designated GAM RNA, also designated SEQ ID:399.

Another function of GAM7080 is therefore inhibition of Thioredoxin reductase 1 (TXNRD1, Accession NP_003321.1), a gene which acts as an antioxidant enzyme and is involved in maintaining redox balance. Accordingly, utilities of GAM7080 include diagnosis, prevention and treatment of diseases and clinical conditions associated with TXNRD1.

The function of TXNRD1 and its association with various diseases and clinical conditions, has been established by previous studies, as described hereinabove with reference to GAM425.1. Ubiquitin-like 1 (sentrin) (UBL1, Accession NP_003343.1) is another GAM7080 target gene, herein designated TARGET GENE. UBL1 BINDING SITE is a target binding site found in the 3' untranslated region of mRNA encoded by UBL1, corresponding to a target binding site such as BINDING SITE I, BINDING SITE II or BINDING SITE III of FIG. 8. Table 4 illustrates the complementarity of the nucleotide sequences of UBL1 BINDING SITE, designated SEQ ID:4385, to the nucleotide sequence of GAM7080 RNA, herein designated GAM RNA, also designated SEQ ID:399.

Another function of GAM7080 is therefore inhibition of Ubiquitin-like 1 (sentrin) (UBL1, Accession NP_003343.1), a gene which generates proteins resistant to degradation through its modification. Accordingly, utilities of GAM7080 include diagnosis, prevention and treatment of diseases and clinical conditions associated with UBL1.

The function of UBL1 and its association with various diseases and clinical conditions, has been established by previous studies, as described hereinabove with reference to GAM500.2. Unc-51-like kinase 1 (c. elegans) (ULK1, Accession NP_003556.1) is another GAM7080 target gene, herein designated TARGET GENE. ULK1 BINDING SITE is a target binding site found in the 3' untranslated region of mRNA encoded by ULK1, corresponding to a target binding site such as BINDING SITE I, BINDING SITE II or BINDING SITE III of FIG. 8. Table 4 illustrates the complementarity of the nucleotide sequences of ULK1 BINDING SITE, designated SEQ ID:19009, to the nucleotide sequence of GAM7080 RNA, herein designated GAM RNA, also designated SEQ ID:399.

Another function of GAM7080 is therefore inhibition of Unc-51-like kinase 1 (c. elegans) (ULK1, Accession NP_003556.1). Accordingly, utilities of GAM7080 include diagnosis, prevention and treatment of diseases and clinical conditions associated with ULK1.

WIT-1 (Accession NP_056939.1) is another GAM7080 target gene, herein designated TARGET GENE. WIT-1 BINDING SITE is a target binding site found in the 5' untranslated region of mRNA encoded by WIT-1, corresponding to a target binding site such as BINDING SITE I, BINDING SITE II or BINDING SITE III of FIG. 8. Table 4 illustrates the complementarity of the nucleotide sequences of WIT-1 BINDING SITE, designated SEQ ID:4885, to the nucleotide sequence of GAM7080 RNA, herein designated GAM RNA, also designated SEQ ID:399.

Another function of GAM7080 is therefore inhibition of WIT-1 (Accession NP_056939.1). Accordingly, utilities of GAM7080 include diagnosis, prevention and treatment of diseases and clinical conditions associated with WIT-1.

Zinc finger protein 10 (kox 1) (ZNF10, Accession NP_056209.2) is another GAM7080 target gene, herein designated TARGET GENE. ZNF10 BINDING SITE is a target binding site found in the 3' untranslated region of mRNA encoded by ZNF10, corresponding to a target binding site such as BINDING SITE I, BINDING SITE II or BINDING SITE III of FIG. 8. Table 4 illustrates the complementarity of the nucleotide sequences of ZNF10 BINDING SITE, designated SEQ ID:7309, to the nucleotide sequence of GAM7080 RNA, herein designated GAM RNA, also designated SEQ ID:399.

Another function of GAM7080 is therefore inhibition of Zinc finger protein 10 (kox 1) (ZNF10, Accession NP_056209.2), a gene which may function as a transcriptional regulator. Accordingly, utilities of GAM7080 include diagnosis, prevention and treatment of diseases and clinical conditions associated with ZNF10.

The function of ZNF10 and its association with various diseases and clinical conditions, has been established by previous studies, as described hereinabove with reference to GAM322.1. Zinc finger protein 197 (ZNF197, Accession NP_008922.1) is another GAM7080 target gene, herein designated TARGET GENE. ZNF197 BINDING SITE is a target binding site found in the 3' untranslated region of mRNA encoded by ZNF197, corresponding to a target binding site such as BINDING SITE I, BINDING SITE II or BINDING SITE III of FIG. 8. Table 4 illustrates the complementarity of the nucleotide sequences of ZNF197 BINDING SITE, designated SEQ ID:16525, to the nucleotide sequence of GAM7080 RNA, herein designated GAM RNA, also designated SEQ ID:399.

Another function of GAM7080 is therefore inhibition of Zinc finger protein 197 (ZNF197, Accession NP_008922.1). Accordingly, utilities of GAM7080 include diagnosis, prevention and treatment of diseases and clinical conditions associated with ZNF197.

Zinc finger protein 263 (ZNF263, Accession NP_005732.2) is another GAM7080 target gene, herein designated TARGET GENE. ZNF263 BINDING SITE is a target binding site found in the 3' untranslated region of mRNA encoded by ZNF263, corresponding to a target binding site such as BINDING SITE I, BINDING SITE II or BINDING SITE III of FIG. 8. Table 4 illustrates the complementarity of the nucleotide sequences of ZNF263 BINDING SITE, designated SEQ ID:4318, to the nucleotide sequence of GAM7080 RNA, herein designated GAM RNA, also designated SEQ ID:399.

Another function of GAM7080 is therefore inhibition of Zinc finger protein 263 (ZNF263, Accession NP_005732.2). Accordingly, utilities of GAM7080 include diagnosis, prevention and treatment of diseases and clinical conditions associated with ZNF263.

FIG. 8 further provides a conceptual description of a novel bioinformatically detected of the present invention, referred to here as Genomic Address Messenger 7553 (GAM7553), which modulates expression of respective target genes thereof, the function and utility of which target genes is known in the art.

GAM7553 is a novel bioinformatically detected regulatory, non protein coding, micro RNA (miRNA) gene. The method by which GAM7553 was detected is described hereinabove with reference to FIGS. 8-15.

GAM7553 gene, herein designated GAM GENE, and GAM7553 target gene, herein designated TARGET GENE, are human genes contained in the human genome.

GAM7553 gene encodes a GAM7553 precursor RNA, herein designated GAM PRECURSOR RNA. Similar to other miRNA genes, and unlike most ordinary genes, GAM7553 precursor RNA does not encode a protein. A nucleotide sequence identical or highly similar to the nucleotide sequence of GAM7553 precursor RNA is designated SEQ ID:48, and is provided hereinbelow with reference to the sequence listing part. Nucleotide sequence SEQ ID:48 is located at position 26917454 relative to chromosome 7.

GAM7553 precursor RNA folds onto itself, forming GAM7553 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM7553 precursor RNA folds onto itself, forming GAM7553 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM7553 precursor RNA, designated SEQ-ID:48, and a schematic representation of a predicted secondary folding of GAM7553 folded precursor RNA are further described with reference to Table 2, hereby incorporated by reference.

An enzyme complex designated DICER COMPLEX, 'dices' the GAM7553 folded precursor RNA into GAM7553 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM7553 RNA is designated SEQ ID:354, and is provided hereinbelow with references to the sequence listing part and Table 3, hereby incorporated by reference.

GAM7553 target gene, herein designated TARGET GENE, encodes a corresponding messenger RNA, GAM7553 target RNA, herein designated GAM TARGET RNA. GAM7553 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM7553 RNA, herein designated GAM RNA, binds complementarily to one or more target binding sites located in untranslated regions of GAM7553 target RNA, herein designated GAM TARGET RNA. This complementary binding is due to the fact that the nucleotide sequence of GAM7553 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM7553 RNA may have a different number of target binding sites in untranslated regions of a GAM7553 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM7553 RNA, herein designated GAM RNA, to target binding sites on GAM7553 target RNA, herein designated GAM TARGET RNA, such as BINDING SITE I, BINDING SITE II and BINDING SITE III, inhibits translation of GAM7553 target RNA into GAM7553 target protein, herein designated GAM TARGET PROTEIN. GAM target protein is therefore outlined by a broken line.

It is appreciated that GAM7553 target gene, herein designated TARGET GENE, in fact represents a plurality of GAM7553 target genes. The mRNA of each one of this plurality of GAM7553 target genes comprises one or more target binding sites, each having a nucleotide sequence which is at least partly complementary to GAM7553 RNA, herein designated GAM RNA, and which when bound by GAM7553 RNA causes inhibition of translation of respective one or more GAM7553 target proteins.

It is further appreciated by one skilled in the art that the mode of translational inhibition illustrated by FIG. 8 with specific reference to translational inhibition exerted by GAM7553 gene, herein designated GAM GENE, on one or more GAM7553 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM7553 correlate with, and may be deduced from, the identity of the target genes which GAM7553 binds and inhibits, and the function of these target genes, as elaborated hereinbelow.

(Accession NP_061085.1) is a GAM7553 target gene, herein designated TARGET GENE. BINDING SITE is a target binding site found in the 3' untranslated region of multiple transcripts of mRNA encoded by, corresponding to a target binding site such as BINDING SITE I, BINDING SITE II or BINDING SITE III of FIG. 8. Table 4 illustrates the complementarity of the nucleotide sequences of BINDING SITE, designated SEQ ID:5708, to the nucleotide sequence of GAM7553 RNA, herein designated GAM RNA, also designated SEQ ID:354.

A function of GAM7553 is therefore inhibition of (Accession NP_061085.1). Accordingly, utilities of GAM7553 include diagnosis, prevention and treatment of diseases and clinical conditions associated with .

Adenosine a3 receptor (ADORA3, Accession NP_000668.1) is another GAM7553 target gene, herein designated TARGET GENE. ADORA3 BINDING SITE is a target binding site found in the 5' untranslated region of mRNA encoded by ADORA3, corresponding to a target binding site such as BINDING SITE I, BINDING SITE II or BINDING SITE III of FIG. 8. Table 4 illustrates the complementarity of the nucleotide sequences of ADORA3 BINDING SITE, designated SEQ ID:12859, to the nucleotide sequence of GAM7553 RNA, herein designated GAM RNA, also designated SEQ ID:354.

Another function of GAM7553 is therefore inhibition of Adenosine a3 receptor (ADORA3, Accession NP_000668.1), a gene which the activity of this receptor is mediated by g proteins which inhibits adenylyl cyclase. Accordingly, utilities of GAM7553 include diagnosis, prevention and treatment of diseases and clinical conditions associated with ADORA3.

The function of ADORA3 and its association with various diseases and clinical conditions, has been established by previous studies, as described hereinabove with reference to GAM291.1. Adaptor-related protein complex 1, sigma 2 subunit (AP1S2, Accession NP_003907.3) is another GAM7553 target gene, herein designated TARGET GENE. AP1S2 BINDING SITE is a target binding site found in the 3' untranslated region of mRNA encoded by AP1S2, corresponding to a target binding site such as BINDING SITE I, BINDING SITE II or BINDING SITE III of FIG. 8. Table 4 illustrates the complementarity of the nucleotide sequences of AP1S2 BINDING SITE, designated SEQ ID:16481, to the nucleotide sequence of GAM7553 RNA, herein designated GAM RNA, also designated SEQ ID:354.

Another function of GAM7553 is therefore inhibition of Adaptor-related protein complex 1, sigma 2 subunit (AP1S2, Accession NP_003907.3). Accordingly, utilities of GAM7553 include diagnosis, prevention and treatment of diseases and clinical conditions associated with AP1S2.

Ankyrin repeat and socs box-containing 13 (ASB13, Accession NP_078977.2) is another GAM7553 target gene, herein designated TARGET GENE. ASB13 BINDING SITE is a target binding site found in the 3' untranslated region of mRNA encoded by ASB13, corresponding to a target binding site such as BINDING SITE I, BINDING SITE II or BINDING SITE III of FIG. 8. Table 4 illustrates the complementarity of the nucleotide sequences of ASB13 BINDING SITE, designated SEQ ID:2982, to the nucleotide sequence of GAM7553 RNA, herein designated GAM RNA, also designated SEQ ID:354.

Another function of GAM7553 is therefore inhibition of Ankyrin repeat and socs box-containing 13 (ASB13, Accession NP_078977.2) . Accordingly, utilities of GAM7553 include diagnosis, prevention and treatment of diseases and clinical conditions associated with ASB13.

BIG1 (Accession NP_006412.1) is another GAM7553 target gene, herein designated TARGET GENE. BIG1 BINDING SITE is a target binding site found in the 3' untranslated region of mRNA encoded by BIG1, corresponding to a target binding site such as BINDING SITE I, BINDING SITE II or BINDING SITE III of FIG. 8. Table 4 illustrates the complementarity of the nucleotide sequences of BIG1 BINDING SITE, designated SEQ ID:13008, to the nucleotide sequence of GAM7553 RNA, herein designated GAM RNA, also designated SEQ ID:354.

Another function of GAM7553 is therefore inhibition of BIG1 (Accession NP_006412.1), a gene which is a guanine nucleotide-exchange protein, has a role in vesicular transport. Accordingly, utilities of GAM7553 include diagnosis, prevention and treatment of diseases and clinical conditions associated with BIG1.

The function of BIG1 and its association with various diseases and clinical conditions, has been established by previous studies, as described hereinabove with reference to GAM47.1. BIKE (Accession NP_060063.1) is another GAM7553 target gene, herein designated TARGET GENE. BIKE BINDING SITE is a target binding site found in the 3' untranslated region of mRNA encoded by BIKE, corresponding to a target binding site such as BINDING SITE I, BINDING SITE II or BINDING SITE III of FIG. 8. Table 4 illustrates the complementarity of the nucleotide sequences of BIKE BINDING SITE, designated SEQ ID:2961, to the nucleotide sequence of GAM7553 RNA, herein designated GAM RNA, also designated SEQ ID:354.

Another function of GAM7553 is therefore inhibition of BIKE (Accession NP_060063.1). Accordingly, utilities of GAM7553 include diagnosis, prevention and treatment of diseases and clinical conditions associated with BIKE.

BLAME (Accession NP_064510.1) is another GAM7553 target gene, herein designated TARGET GENE. BLAME BINDING SITE is a target binding site found in the 3' untranslated region of mRNA encoded by BLAME, corresponding to a target binding site such as BINDING SITE I, BINDING SITE II or BINDING SITE III of FIG. 8. Table 4 illustrates the complementarity of the nucleotide sequences of BLAME BINDING SITE, designated SEQ ID:19073, to the nucleotide sequence of GAM7553 RNA, herein designated GAM RNA, also designated SEQ ID:354.

Another function of GAM7553 is therefore inhibition of BLAME (Accession NP_064510.1). Accordingly, utilities of GAM7553 include diagnosis, prevention and treatment of diseases and clinical conditions associated with BLAME.

Blepharophimosis, epicanthus inversus and ptosis, candidate 1 (BPESC1, Accession NP_068584.1) is another GAM7553 target gene, herein designated TARGET GENE. BPESC1 BINDING SITE is a target binding site found in the 3' untranslated region of mRNA encoded by BPESC1, corresponding to a target binding site such as BINDING SITE I, BINDING SITE II or BINDING SITE III of FIG. 8. Table 4 illustrates the complementarity of the nucleotide sequences of BPESC1 BINDING SITE, designated SEQ ID:5329, to the nucleotide sequence of GAM7553 RNA, herein designated GAM RNA, also designated SEQ ID:354.

Another function of GAM7553 is therefore inhibition of Blepharophimosis, epicanthus inversus and ptosis, candidate 1 (BPESC1, Accession NP_068584.1). Accordingly, utilities of GAM7553 include diagnosis, prevention and treatment of diseases and clinical conditions associated with BPESC1.

C14orf65 (Accession NP_777639.1) is another GAM7553 target gene, herein designated TARGET GENE. C14orf65 BINDING SITE is a target binding site found in the 3' untranslated region of mRNA encoded by C14orf65, corresponding to a target binding site such as BINDING SITE I, BINDING SITE II or BINDING SITE III of FIG. 8. Table 4 illustrates the complementarity of the nucleotide sequences of C14orf65 BINDING SITE, designated SEQ ID:4755, to the nucleotide sequence of GAM7553 RNA, herein designated GAM RNA, also designated SEQ ID:354.

Another function of GAM7553 is therefore inhibition of C14orf65 (Accession NP_777639.1). Accordingly, utilities of GAM7553 include diagnosis, prevention and treatment of diseases and clinical conditions associated with C14orf65.

Calneuron 1 (CALN1, Accession NP_113656.1) is another GAM7553 target gene, herein designated TARGET GENE. CALN1 BINDING SITE is a target binding site found in the 3' untranslated region of mRNA encoded by CALN1, corresponding to a target binding site such as BINDING SITE I, BINDING SITE II or BINDING SITE III of FIG. 8. Table 4 illustrates the complementarity of the nucleotide sequences of CALN1 BINDING SITE, designated SEQ ID:19469, to the nucleotide sequence of GAM7553 RNA, herein designated GAM RNA, also designated SEQ ID:354.

Another function of GAM7553 is therefore inhibition of Calneuron 1 (CALN1, Accession NP_113656.1). Accordingly, utilities of GAM7553 include diagnosis, prevention and treatment of diseases and clinical conditions associated with CALN1.

Caspase 7, apoptosis-related cysteine protease (CASP7, Accession NP_203125.1) is another GAM7553 target gene, herein designated TARGET GENE. CASP7 BINDING SITE is a target binding site found in the 3' untranslated region of multiple transcripts of mRNA encoded by CASP7, corresponding to a target binding site such as BINDING SITE I, BINDING SITE II or BINDING SITE III of FIG. 8. Table 4 illustrates the complementarity of the nucleotide sequences of CASP7 BINDING SITE, designated SEQ ID:3279, to the nucleotide sequence of GAM7553 RNA, herein designated GAM RNA, also designated SEQ ID:354.

Another function of GAM7553 is therefore inhibition of Caspase 7, apoptosis-related cysteine protease (CASP7, Accession NP_203125.1), a gene which is an apoptosis-related caspase and involves in the activation of executing caspases. Accordingly, utilities of GAM7553 include diagnosis, prevention and treatment of diseases and clinical conditions associated with CASP7.

The function of CASP7 and its association with various diseases and clinical conditions, has been established by previous studies, as described hereinabove with reference to GAM408.2. Caspase 7, apoptosis-related cysteine protease (CASP7, Accession NP_203124.1) is another GAM7553 target gene, herein designated TARGET GENE. CASP7 BINDING SITE is a target binding site found in the 3' untranslated region of multiple transcripts of mRNA encoded by CASP7, corresponding to a target binding site such as BINDING SITE I, BINDING SITE II or BINDING SITE III of FIG. 8. Table 4 illustrates the complementarity of the nucleotide sequences of CASP7 BINDING SITE, designated SEQ ID:3279, to the nucleotide sequence of GAM7553 RNA, herein designated GAM RNA, also designated SEQ ID:354.

Another function of GAM7553 is therefore inhibition of Caspase 7, apoptosis-related cysteine protease (CASP7, Accession NP_203124.1), a gene which is an apoptosis-related caspase and involves in the activation of executing caspases. Accordingly, utilities of GAM7553 include diagnosis, prevention and treatment of diseases and clinical conditions associated with CASP7.

The function of CASP7 and its association with various diseases and clinical conditions, has been established by previous studies, as described hereinabove with reference to GAM408.2. Caspase 7, apoptosis-related cysteine protease (CASP7, Accession NP_001218.1) is another GAM7553 target gene, herein designated TARGET GENE. CASP7 BINDING SITE is a target binding site found in the 3' untranslated region of multiple transcripts of mRNA encoded by CASP7, corresponding to a target binding site such as BINDING SITE I, BINDING SITE II or BINDING SITE III of FIG. 8. Table 4 illustrates the complementarity of the nucleotide sequences of CASP7 BINDING SITE, designated SEQ ID:3279, to the nucleotide sequence of GAM7553 RNA, herein designated GAM RNA, also designated SEQ ID:354.

Another function of GAM7553 is therefore inhibition of Caspase 7, apoptosis-related cysteine protease (CASP7, Accession NP_001218.1), a gene which is an apoptosis-related caspase and involves in the activation of executing caspases. Accordingly, utilities of GAM7553 include diagnosis, prevention and treatment of diseases and clinical conditions associated with CASP7.

The function of CASP7 and its association with various diseases and clinical conditions, has been established by previous studies, as described hereinabove with reference to GAM408.2. Caspase 7, apoptosis-related cysteine protease (CASP7, Accession NP_203126.1) is another GAM7553 target gene, herein designated TARGET GENE. CASP7 BINDING SITE is a target binding site found in the 3' untranslated region of multiple transcripts of mRNA encoded by CASP7, corresponding to a target binding site such as BINDING SITE I, BINDING SITE II or BINDING SITE III of FIG. 8. Table 4 illustrates the complementarity of the nucleotide sequences of CASP7 BINDING SITE, designated SEQ ID:3279, to the nucleotide sequence of GAM7553 RNA, herein designated GAM RNA, also designated SEQ ID:354.

Another function of GAM7553 is therefore inhibition of Caspase 7, apoptosis-related cysteine protease (CASP7, Accession NP_203126.1), a gene which is an apoptosis-related caspase and involves in the activation of executing caspases. Accordingly, utilities of GAM7553 include diagnosis, prevention and treatment of diseases and clinical conditions associated with CASP7.

The function of CASP7 and its association with various diseases and clinical conditions, has been established by previous studies, as described hereinabove with reference to GAM408.2. Caveolin 1, caveolae protein, 22 kda (CAV1, Accession NP_001744.2) is another GAM7553 target gene, herein designated TARGET GENE. CAV1 BINDING SITE is a target binding site found in the 3' untranslated region of mRNA encoded by CAV1, corresponding to a target binding site such as BINDING SITE I, BINDING SITE II or BINDING SITE III of FIG. 8. Table 4 illustrates the complementarity of the nucleotide sequences of CAV1 BINDING SITE, designated SEQ ID:16480, to the nucleotide sequence of GAM7553 RNA, herein designated GAM RNA, also designated SEQ ID:354.

Another function of GAM7553 is therefore inhibition of Caveolin 1, caveolae protein, 22 kda (CAV1, Accession NP_001744.2), a gene which may act as a scaffolding protein within caveolar membranes, and interacts directly with g-protein alpha subunits and can functionally regulate their activity and therefore may be associated with Cancer. Accordingly, utilities of GAM7553 include diagnosis, prevention and treatment of Cancer, and of other diseases and clinical conditions associated with CAV1.

The function of CAV1 and its association with various diseases and clinical conditions, has been established by previous studies, as described hereinabove with reference to GAM342.2. Cholecystokinin b receptor (CCKBR, Accession NP_000722.2) is another GAM7553 target gene, herein designated TARGET GENE. CCKBR BINDING SITE is a target binding site found in the 3' untranslated region of multiple transcripts of mRNA encoded by CCKBR, corresponding to a target binding site such as BINDING SITE I, BINDING SITE II or BINDING SITE III of FIG. 8. Table 4 illustrates the complementarity of the nucleotide sequences of CCKBR BINDING SITE, designated SEQ ID:12352, to the nucleotide sequence of GAM7553 RNA, herein designated GAM RNA, also designated SEQ ID:354.

Another function of GAM7553 is therefore inhibition of Cholecystokinin b receptor (CCKBR, Accession NP_000722.2), a gene which bonds cholecystokinin, regulates emotion and gastric acid secretion. Accordingly, utilities of GAM7553 include diagnosis, prevention and treatment of diseases and clinical conditions associated with CCKBR.

The function of CCKBR and its association with various diseases and clinical conditions, has been established by previous studies, as described hereinabove with reference to GAM44.1. Cholecystokinin b receptor (CCKBR, Accession NP_795344.1) is another GAM7553 target gene, herein designated TARGET GENE. CCKBR BINDING SITE is a target binding site found in the 3' untranslated region of multiple transcripts of mRNA encoded by CCKBR, corresponding to a target binding site such as BINDING SITE I, BINDING SITE II or BINDING SITE III of FIG. 8. Table 4 illustrates the complementarity of the nucleotide sequences of CCKBR BINDING SITE, designated SEQ ID:12352, to the nucleotide sequence of GAM7553 RNA, herein designated GAM RNA, also designated SEQ ID:354.

Another function of GAM7553 is therefore inhibition of Cholecystokinin b receptor (CCKBR, Accession NP_795344.1), a gene which bonds cholecystokinin, regulates emotion and gastric acid secretion. Accordingly, utilities of GAM7553 include diagnosis, prevention and treatment of diseases and clinical conditions associated with CCKBR.

The function of CCKBR and its association with various diseases and clinical conditions, has been established by previous studies, as described hereinabove with reference to GAM44.1. Cdc-like kinase 2 (CLK2, Accession NP_001282.1) is another GAM7553 target gene, herein designated TARGET GENE. CLK2 BINDING SITE is a target binding site found in the 3' untranslated region of multiple transcripts of mRNA encoded by CLK2, corresponding to a target binding site such as BINDING SITE I, BINDING SITE II or BINDING SITE III of FIG. 8. Table 4 illustrates the complementarity of the nucleotide sequences of CLK2 BINDING SITE, designated SEQ ID:8616, to the nucleotide sequence of GAM7553 RNA, herein designated GAM RNA, also designated SEQ ID:354.

Another function of GAM7553 is therefore inhibition of Cdc-like kinase 2 (CLK2, Accession NP_001282.1), a gene which catalyzes the phosphorylation of proteins. Accordingly, utilities of GAM7553 include diagnosis, prevention and treatment of diseases and clinical conditions associated with CLK2.

The function of CLK2 and its association with various diseases and clinical conditions, has been established by previous studies, as described hereinabove with reference to GAM291.1. COBL (Accession NP_056013.2) is another GAM7553 target gene, herein designated TARGET GENE. COBL BINDING SITE is a target binding site found in the 3' untranslated region of mRNA encoded by COBL, corresponding to a target binding site such as BINDING SITE I, BINDING SITE II or BINDING SITE III of FIG. 8. Table 4 illustrates the complementarity of the nucleotide sequences of COBL BINDING SITE, designated SEQ ID:14286, to the nucleotide sequence of GAM7553 RNA, herein designated GAM RNA, also designated SEQ ID:354.

Another function of GAM7553 is therefore inhibition of COBL (Accession NP_056013.2). Accordingly, utilities of GAM7553 include diagnosis, prevention and treatment of diseases and clinical conditions associated with COBL.

Coronin, actin binding protein, 1c (CORO1C, Accession NP_055140.1) is another GAM7553 target gene, herein designated TARGET GENE. CORO1C BINDING SITE is a target binding site found in the 3' untranslated region of mRNA encoded by CORO1C, corresponding to a target binding site such as BINDING SITE I, BINDING SITE II or BINDING SITE III of FIG. 8. Table 4 illustrates the complementarity of the nucleotide sequences of CORO1C BINDING SITE, designated SEQ ID:5674, to the nucleotide sequence of GAM7553 RNA, herein designated GAM RNA, also designated SEQ ID:354.

Another function of GAM7553 is therefore inhibition of Coronin, actin binding protein, 1c (CORO1C, Accession NP_055140.1). Accordingly, utilities of GAM7553 include diagnosis, prevention and treatment of diseases and clinical conditions associated with CORO1C.

Chemokine (c-x-c motif) ligand 12 (stromal cell-derived factor 1) (CXCL12, Accession NP_000600.1) is another GAM7553 target gene, herein designated TARGET GENE. CXCL12 BINDING SITE is a target binding site found in the 3' untranslated region of mRNA encoded by CXCL12, corresponding to a target binding site such as BINDING SITE I, BINDING SITE II or BINDING SITE III of FIG. 8. Table 4 illustrates the complementarity of the nucleotide sequences of CXCL12 BINDING SITE, designated SEQ ID:14753, to the nucleotide sequence of GAM7553 RNA, herein designated GAM RNA, also designated SEQ ID:354.

Another function of GAM7553 is therefore inhibition of Chemokine (c-x-c motif) ligand 12 (stromal cell-derived factor 1) (CXCL12, Accession NP_000600.1). Accordingly, utilities of GAM7553 include diagnosis, prevention and treatment of diseases and clinical conditions associated with CXCL12.

Cytochrome p450, subfamily iib (phenobarbital-inducible), polypeptide 6 (CYP2B6, Accession NP_000758.1) is another GAM7553 target gene, herein designated TARGET GENE. CYP2B6 BINDING SITE is a target binding site found in the 3' untranslated region of mRNA encoded by CYP2B6, corresponding to a target binding site such as BINDING SITE I, BINDING SITE II or BINDING SITE III of FIG. 8. Table 4 illustrates the complementarity of the nucleotide sequences of CYP2B6 BINDING SITE, designated SEQ ID:7396, to the nucleotide sequence of GAM7553 RNA, herein designated GAM RNA, also designated SEQ ID:354.

Another function of GAM7553 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM7553 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. DKFZP564I0422 (Accession NP_113623.1) is another GAM7553 target gene, herein designated TARGET GENE. DKFZP564I0422 BINDING SITE is a target binding site found in the 3' untranslated region of mRNA encoded by DKFZP564I0422, corresponding to a target binding site such as BINDING SITE I, BINDING SITE II or BINDING SITE III of FIG. 8. Table 4 illustrates the complementarity of the nucleotide sequences of DKFZP564I0422 BINDING SITE, designated SEQ ID:10761, to the nucleotide sequence of GAM7553 RNA, herein designated GAM RNA, also designated SEQ ID:354.

Another function of GAM7553 is therefore inhibition of DKFZP564I0422 (Accession NP_113623.1). Accordingly, utilities of GAM7553 include diagnosis, prevention and treatment of diseases and clinical conditions associated with DKFZP564I0422.

Dna (cytosine-5-)-methyltransferase 3 alpha (DNMT3A, Accession NP_072046.2) is another GAM7553 target gene, herein designated TARGET GENE. DNMT3A BINDING SITE is a target binding site found in the 3' untranslated region of multiple transcripts of mRNA encoded by DNMT3A, corresponding to a target binding site such as BINDING SITE I, BINDING SITE II or BINDING SITE III of FIG. 8. Table 4 illustrates the complementarity of the nucleotide sequences of DNMT3A BINDING SITE, designated SEQ ID:17093, to the nucleotide sequence of GAM7553 RNA, herein designated GAM RNA, also designated SEQ ID:354.

Another function of GAM7553 is therefore inhibition of Dna (cytosine-5-)-methyltransferase 3 alpha (DNMT3A, Accession NP_072046.2), a gene which intervenes in de novo methylation of DNA. Accordingly, utilities of GAM7553 include diagnosis, prevention and treatment of diseases and clinical conditions associated with DNMT3A.

The function of DNMT3A and its association with various diseases and clinical conditions, has been established by previous studies, as described hereinabove with reference to GAM47.1. Dna (cytosine-5-)-methyltransferase 3 alpha (DNMT3A, Accession NP_715640.1) is another GAM7553 target gene, herein designated TARGET GENE. DNMT3A BINDING SITE is a target binding site found in the 3' untranslated region of multiple transcripts of mRNA encoded by DNMT3A, corresponding to a target binding site such as BINDING SITE I, BINDING SITE II or BINDING SITE III of FIG. 8. Table 4 illustrates the complementarity of the nucleotide sequences of DNMT3A BINDING SITE, designated SEQ ID:17093, to the nucleotide sequence of GAM7553 RNA, herein designated GAM RNA, also designated SEQ ID:354.

Another function of GAM7553 is therefore inhibition of Dna (cytosine-5-)-methyltransferase 3 alpha (DNMT3A, Accession NP_715640.1), a gene which intervenes in de novo methylation of DNA. Accordingly, utilities of GAM7553 include diagnosis, prevention and treatment of diseases and clinical conditions associated with DNMT3A.

The function of DNMT3A and its association with various diseases and clinical conditions, has been established by previous studies, as described hereinabove with reference to GAM47.1. Dna (cytosine-5-)-methyltransferase 3 alpha (DNMT3A, Accession NP_783328.1) is another GAM7553 target gene, herein designated TARGET GENE. DNMT3A BINDING SITE is a target binding site found in the 3' untranslated region of multiple transcripts of mRNA encoded by DNMT3A, corresponding to a target binding site such as BINDING SITE I, BINDING SITE II or BINDING SITE III of FIG. 8. Table 4 illustrates the complementarity of the nucleotide sequences of DNMT3A BINDING SITE, designated SEQ ID:17093, to the nucleotide sequence of GAM7553 RNA, herein designated GAM RNA, also designated SEQ ID:354.

Another function of GAM7553 is therefore inhibition of Dna (cytosine-5-)-methyltransferase 3 alpha (DNMT3A, Accession NP_783328.1), a gene which intervenes in de novo methylation of DNA. Accordingly, utilities of GAM7553 include diagnosis, prevention and treatment of diseases and clinical conditions associated with DNMT3A.

The function of DNMT3A and its association with various diseases and clinical conditions, has been established by previous studies, as described hereinabove with reference to GAM47.1. Echinoderm microtubule associated protein like 1 (EML1, Accession NP_004425.1) is another GAM7553 target gene, herein designated TARGET GENE. EML1 BINDING SITE is a target binding site found in the 5' untranslated region of mRNA encoded by EML1, corresponding to a target binding site such as BINDING SITE I, BINDING SITE II or BINDING SITE III of FIG. 8. Table 4 illustrates the complementarity of the nucleotide sequences of EML1 BINDING SITE, designated SEQ ID:12454, to the nucleotide sequence of GAM7553 RNA, herein designated GAM RNA, also designated SEQ ID:354.

Another function of GAM7553 is therefore inhibition of Echinoderm microtubule associated protein like 1 (EML1, Accession NP_004425.1). Accordingly, utilities of GAM7553 include diagnosis, prevention and treatment of diseases and clinical conditions associated with EML1.

Epithelial membrane protein 1 (EMP1, Accession NP_001414.1) is another GAM7553 target gene, herein designated TARGET GENE. EMP1 BINDING SITE is a target binding site found in the 5' untranslated region of mRNA encoded by EMP1, corresponding to a target binding site such as BINDING SITE I, BINDING SITE II or BINDING SITE III of FIG. 8. Table 4 illustrates the complementarity of the nucleotide sequences of EMP1 BINDING SITE, designated SEQ ID:3219, to the nucleotide sequence of GAM7553 RNA, herein designated GAM RNA, also designated SEQ ID:354.

Another function of GAM7553 is therefore inhibition of Epithelial membrane protein 1 (EMP1, Accession NP_001414.1), a gene which plays a role in squamous cell differentiation; member of the PMP22/EMP/MP20 family of membrane glycoproteins. Accordingly, utilities of GAM7553 include diagnosis, prevention and treatment of diseases and clinical conditions associated with EMP1.

The function of EMP1 and its association with various diseases and clinical conditions, has been established by previous studies, as described hereinabove with reference to GAM40.1. FBXW5 (Accession NP_839890.1) is another GAM7553 target gene, herein designated TARGET GENE. FBXW5 BINDING SITE is a target binding site found in the 3' untranslated region of multiple transcripts of mRNA encoded by FBXW5, corresponding to a target binding site such as BINDING SITE I, BINDING SITE II or BINDING SITE III of FIG. 8. Table 4 illustrates the complementarity of the nucleotide sequences of FBXW5 BINDING SITE, designated SEQ ID:3849, to the nucleotide sequence of GAM7553 RNA, herein designated GAM RNA, also designated SEQ ID:354.

Another function of GAM7553 is therefore inhibition of FBXW5 (Accession NP_839890.1). Accordingly, utilities of GAM7553 include diagnosis, prevention and treatment of diseases and clinical conditions associated with FBXW5.

FBXW5 (Accession NP_839891.1) is another GAM7553 target gene, herein designated TARGET GENE. FBXW5 BINDING SITE is a target binding site found in the 3' untranslated region of multiple transcripts of mRNA encoded by FBXW5, corresponding to a target binding site such as BINDING SITE I, BINDING SITE II or BINDING SITE III of FIG. 8. Table 4 illustrates the complementarity of the nucleotide sequences of FBXW5 BINDING SITE, designated SEQ ID:3849, to the nucleotide sequence of GAM7553 RNA, herein designated GAM RNA, also designated SEQ ID:354.

Another function of GAM7553 is therefore inhibition of FBXW5 (Accession NP_839891.1). Accordingly, utilities of GAM7553 include diagnosis, prevention and treatment of diseases and clinical conditions associated with FBXW5.

FLJ10120 (Accession NP_060471.1) is another GAM7553 target gene, herein designated TARGET GENE. FLJ10120 BINDING SITE is a target binding site found in the 3' untranslated region of mRNA encoded by FLJ10120, corresponding to a target binding site such as BINDING SITE I, BINDING SITE II or BINDING SITE III of FIG. 8. Table 4 illustrates the complementarity of the nucleotide sequences of FLJ10120 BINDING SITE, designated SEQ ID:16520, to the nucleotide sequence of GAM7553 RNA, herein designated GAM RNA, also designated SEQ ID:354.

Another function of GAM7553 is therefore inhibition of FLJ10120 (Accession NP_060471.1). Accordingly, utilities of GAM7553 include diagnosis, prevention and treatment of diseases and clinical conditions associated with FLJ10120.

FLJ11142 (Accession NP_060808.2) is another GAM7553 target gene, herein designated TARGET GENE. FLJ11142 BINDING SITE is a target binding site found in the 3' untranslated region of mRNA encoded by FLJ11142, corresponding to a target binding site such as BINDING SITE I, BINDING SITE II or BINDING SITE III of FIG. 8. Table 4 illustrates the complementarity of the nucleotide sequences of FLJ11142 BINDING SITE, designated SEQ ID:16418, to the nucleotide sequence of GAM7553 RNA, herein designated GAM RNA, also designated SEQ ID:354.

Another function of GAM7553 is therefore inhibition of FLJ11142 (Accession NP_060808.2). Accordingly, utilities of GAM7553 include diagnosis, prevention and treatment of diseases and clinical conditions associated with FLJ11142.

FLJ12586 (Accession NP_078896.2) is another GAM7553 target gene, herein designated TARGET GENE. FLJ12586 BINDING SITE is a target binding site found in the 3' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:9318, to the nucleotide sequence of GAM7553 RNA, herein designated GAM RNA, also designated SEQ ID:354.

Another function of GAM7553 is therefore inhibition of FLJ12586 (Accession NP_078896.2). Accordingly, utilities of GAM7553 include diagnosis, prevention and treatment of diseases and clinical conditions associated with FLJ12586.

FLJ20156 (Accession NP_060161.1) is another GAM7553 target gene, herein designated TARGET GENE. FLJ20156 BINDING SITE1 and FLJ20156 BINDING SITE2 are target binding sites found in untranslated regions of mRNA encoded by FLJ20156, corresponding to target binding sites such as BINDING SITE I, BINDING SITE II or BINDING SITE III of FIG. 8. Table 4 illustrates the complementarity of the nucleotide sequences of FLJ20156 BINDING SITE1 and FLJ20156 BINDING SITE2, designated SEQ ID:15489 and SEQ ID:9513 respectively, to the nucleotide sequence of GAM7553 RNA, herein designated GAM RNA, also designated SEQ ID:354.

Another function of GAM7553 is therefore inhibition of FLJ20156 (Accession NP_060161.1). Accordingly, utilities of GAM7553 include diagnosis, prevention and treatment of diseases and clinical conditions associated with FLJ20156.

FLJ20294 (Accession NP_060219.1) is another GAM7553 target gene, herein designated TARGET GENE. FLJ20294 BINDING SITE is a target binding site found in the 3' untranslated region of mRNA encoded by FLJ20294, corresponding to a target binding site such as BINDING SITE I, BINDING SITE II or BINDING SITE III of FIG. 8. Table 4 illustrates the complementarity of the nucleotide sequences of FLJ20294 BINDING SITE, designated SEQ ID:9807, to the nucleotide sequence of GAM7553 RNA, herein designated GAM RNA, also designated SEQ ID:354.

Another function of GAM7553 is therefore inhibition of FLJ20294 (Accession NP_060219.1). Accordingly, utilities of GAM7553 include diagnosis, prevention and treatment of diseases and clinical conditions associated with FLJ20294.

FLJ20582 (Accession XP_090970.4) is another GAM7553 target gene, herein designated TARGET GENE. FLJ20582 BINDING SITE is a target binding site found in the 5' untranslated region of mRNA encoded by FLJ20582, corresponding to a target binding site such as BINDING SITE I, BINDING SITE II or BINDING SITE III of FIG. 8. Table 4 illustrates the complementarity of the nucleotide sequences of FLJ20582 BINDING SITE, designated SEQ ID:9319, to the nucleotide sequence of GAM7553 RNA, herein designated GAM RNA, also designated SEQ ID:354.

Another function of GAM7553 is therefore inhibition of FLJ20582 (Accession XP_090970.4). Accordingly, utilities of GAM7553 include diagnosis, prevention and treatment of diseases and clinical conditions associated with FLJ20582.

FLJ21588 (Accession NP_115580.2) is another GAM7553 target gene, herein designated TARGET GENE. FLJ21588 BINDING SITE is a target binding site found in the 3' untranslated region of mRNA encoded by FLJ21588, corresponding to a target binding site such as BINDING SITE I, BINDING SITE II or BINDING SITE III of FIG. 8. Table 4 illustrates the complementarity of the nucleotide sequences of FLJ21588 BINDING SITE, designated SEQ ID:7169, to the nucleotide sequence of GAM7553 RNA, herein designated GAM RNA, also designated SEQ ID:354.

Another function of GAM7553 is therefore inhibition of FLJ21588 (Accession NP_115580.2). Accordingly, utilities of GAM7553 include diagnosis, prevention and treatment of diseases and clinical conditions associated with FLJ21588.

FLJ22625 (Accession NP_078991.2) is another GAM7553 target gene, herein designated TARGET GENE. FLJ22625 BINDING SITE is a target binding site found in the 5' untranslated region of mRNA encoded by FLJ22625, corresponding to a target binding site such as BINDING SITE I, BINDING SITE II or BINDING SITE III of FIG. 8. Table 4 illustrates the complementarity of the nucleotide sequences of FLJ22625 BINDING SITE, designated SEQ ID:10995, to the nucleotide sequence of GAM7553 RNA, herein designated GAM RNA, also designated SEQ ID:354.

Another function of GAM7553 is therefore inhibition of FLJ22625 (Accession NP_078991.2). Accordingly, utilities of GAM7553 include diagnosis, prevention and treatment of diseases and clinical conditions associated with FLJ22625.

FLJ23375 (Accession NP_079232.2) is another GAM7553 target gene, herein designated TARGET GENE. FLJ23375 BINDING SITE is a target binding site found in the 5' untranslated region of mRNA encoded by FLJ23375, corresponding to a target binding site such as BINDING SITE I, BINDING SITE II or BINDING SITE III of FIG. 8. Table 4 illustrates the complementarity of the nucleotide sequences of FLJ23375 BINDING SITE, designated SEQ ID:2294, to the nucleotide sequence of GAM7553 RNA, herein designated GAM RNA, also designated SEQ ID:354.

Another function of GAM7553 is therefore inhibition of FLJ23375 (Accession NP_079232.2). Accordingly, utilities of GAM7553 include diagnosis, prevention and treatment of diseases and clinical conditions associated with FLJ23375.

FLJ23467 (Accession NP_078851.1) is another GAM7553 target gene, herein designated TARGET GENE. FLJ23467 BINDING SITE is a target binding site found in the 3' untranslated region of mRNA encoded by FLJ23467, corresponding to a target binding site such as BINDING SITE I, BINDING SITE II or BINDING SITE III of FIG. 8. Table 4 illustrates the complementarity of the nucleotide sequences of FLJ23467 BINDING SITE, designated SEQ ID:6368, to the nucleotide sequence of GAM7553 RNA, herein designated GAM RNA, also designated SEQ ID:354.

Another function of GAM7553 is therefore inhibition of FLJ23467 (Accession NP_078851.1). Accordingly, utilities of GAM7553 include diagnosis, prevention and treatment of diseases and clinical conditions associated with FLJ23467.

FLJ23754 (Accession NP_689888.1) is another GAM7553 target gene, herein designated TARGET GENE. FLJ23754 BINDING SITE is a target binding site found in the 3' untranslated region of mRNA encoded by FLJ23754, corresponding to a target binding site such as BINDING SITE I, BINDING SITE II or BINDING SITE III of FIG. 8. Table 4 illustrates the complementarity of the nucleotide sequences of FLJ23754 BINDING SITE, designated SEQ ID:1290, to the nucleotide sequence of GAM7553 RNA, herein designated GAM RNA, also designated SEQ ID:354.

Another function of GAM7553 is therefore inhibition of FLJ23754 (Accession NP_689888.1). Accordingly, utilities of GAM7553 include diagnosis, prevention and treatment of diseases and clinical conditions associated with FLJ23754.

FLJ33318 (Accession NP_694961.1) is another GAM7553 target gene, herein designated TARGET GENE. FLJ33318 BINDING SITE is a target binding site found in the 3' untranslated region of mRNA encoded by FLJ33318, corresponding to a target binding site such as BINDING SITE I, BINDING SITE II or BINDING SITE III of FIG. 8. Table 4 illustrates the complementarity of the nucleotide sequences of FLJ33318 BINDING SITE, designated SEQ ID:17788, to the nucleotide sequence of GAM7553 RNA, herein designated GAM RNA, also designated SEQ ID:354.

Another function of GAM7553 is therefore inhibition of FLJ33318 (Accession NP_694961.1). Accordingly, utilities of GAM7553 include diagnosis, prevention and treatment of diseases and clinical conditions associated with FLJ33318.

FLJ33708 (Accession NP_775946.1) is another GAM7553 target gene, herein designated TARGET GENE. FLJ33708 BINDING SITE is a target binding site found in the 3' untranslated region of mRNA encoded by FLJ33708, corresponding to a target binding site such as BINDING SITE I, BINDING SITE II or BINDING SITE III of FIG. 8. Table 4 illustrates the complementarity of the nucleotide sequences of FLJ33708 BINDING SITE, designated SEQ ID:11952, to the nucleotide sequence of GAM7553 RNA, herein designated GAM RNA, also designated SEQ ID:354.

Another function of GAM7553 is therefore inhibition of FLJ33708 (Accession NP_775946.1). Accordingly, utilities of GAM7553 include diagnosis, prevention and treatment of diseases and clinical conditions associated with FLJ33708.

FLJ37034 (Accession NP_689734.1) is another GAM7553 target gene, herein designated TARGET GENE. FLJ37034 BINDING SITE is a target binding site found in the 3' untranslated region of mRNA encoded by FLJ37034, corresponding to a target binding site such as BINDING SITE I, BINDING SITE II or BINDING SITE III of FIG. 8. Table 4 illustrates the complementarity of the nucleotide sequences of FLJ37034 BINDING SITE, designated SEQ ID:13349, to the nucleotide sequence of GAM7553 RNA, herein designated GAM RNA, also designated SEQ ID:354.

Another function of GAM7553 is therefore inhibition of FLJ37034 (Accession NP_689734.1). Accordingly, utilities of GAM7553 include diagnosis, prevention and treatment of diseases and clinical conditions associated with FLJ37034.

FUK (Accession NP_659496.1) is another GAM7553 target gene, herein designated TARGET GENE. FUK BINDING SITE is a target binding site found in the 3' untranslated region of mRNA encoded by FUK, corresponding to a target binding site such as BINDING SITE I, BINDING SITE II or BINDING SITE III of FIG. 8. Table 4 illustrates the complementarity of the nucleotide sequences of FUK BINDING SITE, designated SEQ ID:13518, to the nucleotide sequence of GAM7553 RNA, herein designated GAM RNA, also designated SEQ ID:354.

Another function of GAM7553 is therefore inhibition of FUK (Accession NP_659496.1). Accordingly, utilities of GAM7553 include diagnosis, prevention and treatment of diseases and clinical conditions associated with FUK.

Fyve and coiled-coil domain containing 1 (FYCO1, Accession NP_078789.1) is another GAM7553 target gene, herein designated TARGET GENE. FYCO1 BINDING SITE is a target binding site found in the 3' untranslated region of mRNA encoded by FYCO1, corresponding to a target binding site such as BINDING SITE I, BINDING SITE II or BINDING SITE III of FIG. 8. Table 4 illustrates the complementarity of the nucleotide sequences of FYCO1 BINDING SITE, designated SEQ ID:1084, to the nucleotide sequence of GAM7553 RNA, herein designated GAM RNA, also designated SEQ ID:354.

Another function of GAM7553 is therefore inhibition of Fyve and coiled-coil domain containing 1 (FYCO1, Accession NP_078789.1). Accordingly, utilities of GAM7553 include diagnosis, prevention and treatment of diseases and clinical conditions associated with FYCO1.

Glucose-6-phosphatase, transport (glucose-6-phosphate) protein 1 (G6PT1, Accession NP_001458.1) is another GAM7553 target gene, herein designated TARGET GENE. G6PT1 BINDING SITE is a target binding site found in the 3' untranslated region of mRNA encoded by G6PT1, corresponding to a target binding site such as BINDING SITE I, BINDING SITE II or BINDING SITE III of FIG. 8. Table 4 illustrates the complementarity of the nucleotide sequences of G6PT1 BINDING SITE, designated SEQ ID:13519, to the nucleotide sequence of GAM7553 RNA, herein designated GAM RNA, also designated SEQ ID:354.

Another function of GAM7553 is therefore inhibition of Glucose-6-phosphatase, transport (glucose-6-phosphate) protein 1 (G6PT1, Accession NP_001458.1). Accordingly, utilities of GAM7553 include diagnosis, prevention and treatment of diseases and clinical conditions associated with G6PT1.

Gata binding protein 6 (GATA6, Accession NP_005248.1) is another GAM7553 target gene, herein designated TARGET GENE. GATA6 BINDING SITE is a target binding site found in the 3' untranslated region of mRNA encoded by GATA6, corresponding to a target binding site such as BINDING SITE I, BINDING SITE II or BINDING SITE III of FIG. 8. Table 4 illustrates the complementarity of the nucleotide sequences of GATA6 BINDING SITE, designated SEQ ID:2438, to the nucleotide sequence of GAM7553 RNA, herein designated GAM RNA, also designated SEQ ID:354.

Another function of GAM7553 is therefore inhibition of Gata binding protein 6 (GATA6, Accession NP_005248.1), a gene which is thought to be important for regulating terminal differentiation and/or proliferation. and therefore may be associated with Sex cord-derived ovarian tumors. Accordingly, utilities of GAM7553 include diagnosis, prevention and treatment of Sex cord-derived ovarian tumors, and of other diseases and clinical conditions associated with GATA6.

The function of GATA6 and its association with various diseases and clinical conditions, has been established by previous studies, as described hereinabove with reference to GAM488.1. GATS (Accession NP_849153.1) is another GAM7553 target gene, herein designated TARGET GENE. GATS BINDING SITE is a target binding site found in the 3' untranslated region of mRNA encoded by GATS, corresponding to a target binding site such as BINDING SITE I, BINDING SITE II or BINDING SITE III of FIG. 8. Table 4 illustrates the complementarity of the nucleotide sequences of GATS BINDING SITE, designated SEQ ID:5950, to the nucleotide sequence of GAM7553 RNA, herein designated GAM RNA, also designated SEQ ID:354.

Another function of GAM7553 is therefore inhibition of GATS (Accession NP_849153.1). Accordingly, utilities of GAM7553 include diagnosis, prevention and treatment of diseases and clinical conditions associated with GATS.

Golgi apparatus protein 1 (GLG1, Accession NP_036333.1) is another GAM7553 target gene, herein designated TARGET GENE. GLG1 BINDING SITE is a target binding site found in the 3' untranslated region of mRNA encoded by GLG1, corresponding to a target binding site such as BINDING SITE I, BINDING SITE II or BINDING SITE III of FIG. 8. Table 4 illustrates the complementarity of the nucleotide sequences of GLG1 BINDING SITE, designated SEQ ID:1019, to the nucleotide sequence of GAM7553 RNA, herein designated GAM RNA, also designated SEQ ID:354.

Another function of GAM7553 is therefore inhibition of Golgi apparatus protein 1 (GLG1, Accession NP_036333.1). Accordingly, utilities of GAM7553 include diagnosis, prevention and treatment of diseases and clinical conditions associated with GLG1.

Guanosine monophosphate reductase 2 (GMPR2, Accession NP_057660.1) is another GAM7553 target gene, herein designated TARGET GENE. GMPR2 BINDING SITE is a target binding site found in the 5' untranslated region of mRNA encoded by GMPR2, corresponding to a target binding site such as BINDING SITE I, BINDING SITE II or BINDING SITE III of FIG. 8. Table 4 illustrates the complementarity of the nucleotide sequences of GMPR2 BINDING SITE, designated SEQ ID:8654, to the nucleotide sequence of GAM7553 RNA, herein designated GAM RNA, also designated SEQ ID:354.

Another function of GAM7553 is therefore inhibition of Guanosine monophosphate reductase 2 (GMPR2, Accession NP_057660.1). Accordingly, utilities of GAM7553 include diagnosis, prevention and treatment of diseases and clinical conditions associated with GMPR2.

GOR (Accession NP_758439.1) is another GAM7553 target gene, herein designated TARGET GENE. GOR BINDING SITE is a target binding site found in the 5' untranslated region of mRNA encoded by GOR, corresponding to a target binding site such as BINDING SITE I, BINDING SITE II or BINDING SITE III of FIG. 8. Table 4 illustrates the complementarity of the nucleotide sequences of GOR BINDING SITE, designated SEQ ID:7795, to the nucleotide sequence of GAM7553 RNA, herein designated GAM RNA, also designated SEQ ID:354.

Another function of GAM7553 is therefore inhibition of GOR (Accession NP_758439.1). Accordingly, utilities of GAM7553 include diagnosis, prevention and treatment of diseases and clinical conditions associated with GOR.

Glutamate receptor, ionotropic, ampa 1 (GRIA1, Accession NP_000818.1) is another GAM7553 target gene, herein designated TARGET GENE. GRIA1 BINDING SITE is a target binding site found in the 3' untranslated region of mRNA encoded by GRIA1, corresponding to a target binding site such as BINDING SITE I, BINDING SITE II or BINDING SITE III of FIG. 8. Table 4 illustrates the complementarity of the nucleotide sequences of GRIA1 BINDING SITE, designated SEQ ID:8118, to the nucleotide sequence of GAM7553 RNA, herein designated GAM RNA, also designated SEQ ID:354.

Another function of GAM7553 is therefore inhibition of Glutamate receptor, ionotropic, ampa 1 (GRIA1, Accession NP_000818.1), a gene which acts as an excitatory neurotransmitter at many synapses in the central nervous system. Accordingly, utilities of GAM7553 include diagnosis, prevention and treatment of diseases and clinical conditions associated with GRIA1.

The function of GRIA1 and its association with various diseases and clinical conditions, has been established by previous studies, as described hereinabove with reference to GAM412.1. Homeo box b8 (HOXB8, Accession NP_076921.1) is another GAM7553 target gene, herein designated TARGET GENE. HOXB8 BINDING SITE is a target binding site found in the 3' untranslated region of mRNA encoded by HOXB8, corresponding to a target binding site such as BINDING SITE I, BINDING SITE II or BINDING SITE III of FIG. 8. Table 4 illustrates the complementarity of the nucleotide sequences of HOXB8 BINDING SITE, designated SEQ ID:19126, to the nucleotide sequence of GAM7553 RNA, herein designated GAM RNA, also designated SEQ ID:354.

Another function of GAM7553 is therefore inhibition of Homeo box b8 (HOXB8, Accession NP_076921.1), a gene which is part of a developmental regulatory system. Accordingly, utilities of GAM7553 include diagnosis, prevention and treatment of diseases and clinical conditions associated with HOXB8.

The function of HOXB8 and its association with various diseases and clinical conditions, has been established by previous studies, as described hereinabove with reference to GAM47.1. Heparanase (HPSE, Accession NP_006656.1) is another GAM7553 target gene, herein designated TARGET GENE. HPSE BINDING SITE is a target binding site found in the 3' untranslated region of mRNA encoded by HPSE, corresponding to a target binding site such as BINDING SITE I, BINDING SITE II or BINDING SITE III of FIG. 8. Table 4 illustrates the complementarity of the nucleotide sequences of HPSE BINDING SITE, designated SEQ ID:15551, to the nucleotide sequence of GAM7553 RNA, herein designated GAM RNA, also designated SEQ ID:354.

Another function of GAM7553 is therefore inhibition of Heparanase (HPSE, Accession NP_006656.1), a gene which is an endoglycosidase that cleaves heparan sulfate, and therefore may be associated with Breast cancer. Accordingly, utilities of GAM7553 include diagnosis, prevention and treatment of Breast cancer, and of other diseases and clinical conditions associated with HPSE.

The function of HPSE and its association with various diseases and clinical conditions, has been established by previous studies, as described hereinabove with reference to GAM66.2. HSC3 (Accession NP_660157.1) is another GAM7553 target gene, herein designated TARGET GENE. HSC3 BINDING SITE is a target binding site found in the 3' untranslated region of mRNA encoded by HSC3, corresponding to a target binding site such as BINDING SITE I, BINDING SITE II or BINDING SITE III of FIG. 8. Table 4 illustrates the complementarity of the nucleotide sequences of HSC3 BINDING SITE, designated SEQ ID:9997, to the nucleotide sequence of GAM7553 RNA, herein designated GAM RNA, also designated SEQ ID:354.

Another function of GAM7553 is therefore inhibition of HSC3 (Accession NP_660157.1). Accordingly, utilities of GAM7553 include diagnosis, prevention and treatment of diseases and clinical conditions associated with HSC3.

Hydroxy-delta-5-steroid dehydrogenase, 3 beta- and steroid delta-isomerase 1 (HSD3B1, Accession NP_000853.1) is another GAM7553 target gene, herein designated TARGET GENE. HSD3B1 BINDING SITE is a target binding site found in the 3' untranslated region of mRNA encoded by HSD3B1, corresponding to a target binding site such as BINDING SITE I, BINDING SITE II or BINDING SITE III of FIG. 8. Table 4 illustrates the complementarity of the nucleotide sequences of HSD3B1 BINDING SITE, designated SEQ ID:13457, to the nucleotide sequence of GAM7553 RNA, herein designated GAM RNA, also designated SEQ ID:354.

Another function of GAM7553 is therefore inhibition of Hydroxy-delta-5-steroid dehydrogenase, 3 beta- and steroid delta-isomerase 1 (HSD3B1, Accession NP_000853.1), a gene which is a 3-@ beta-hydroxysteroid dehydrogenase. Accordingly, utilities of GAM7553 include diagnosis, prevention and treatment of diseases and clinical conditions associated with HSD3B1.

The function of HSD3B1 and its association with various diseases and clinical conditions, has been established by previous studies, as described hereinabove with reference to GAM507.1. HSPC063 (Accession NP_054874.1) is another GAM7553 target gene, herein designated TARGET GENE. HSPC063 BINDING SITE is a target binding site found in the 3' untranslated region of mRNA encoded by HSPC063, corresponding to a target binding site such as BINDING SITE I, BINDING SITE II or BINDING SITE III of FIG. 8. Table 4 illustrates the complementarity of the nucleotide sequences of HSPC063 BINDING SITE, designated SEQ ID:5807, to the nucleotide sequence of GAM7553 RNA, herein designated GAM RNA, also designated SEQ ID:354.

Another function of GAM7553 is therefore inhibition of HSPC063 (Accession NP_054874.1). Accordingly, utilities of GAM7553 include diagnosis, prevention and treatment of diseases and clinical conditions associated with HSPC063.

HSPC065 (Accession NP_054876.2) is another GAM7553 target gene, herein designated TARGET GENE. HSPC065 BINDING SITE is a target binding site found in the 3' untranslated region of mRNA encoded by HSPC065, corresponding to a target binding site such as BINDING SITE I, BINDING SITE II or BINDING SITE III of FIG. 8. Table 4 illustrates the complementarity of the nucleotide sequences of HSPC065 BINDING SITE, designated SEQ ID:1070, to the nucleotide sequence of GAM7553 RNA, herein designated GAM RNA, also designated SEQ ID:354.

Another function of GAM7553 is therefore inhibition of HSPC065 (Accession NP_054876.2). Accordingly, utilities of GAM7553 include diagnosis, prevention and treatment of diseases and clinical conditions associated with HSPC065.

Isoleucine-trna synthetase (IARS, Accession NP_002152.1) is another GAM7553 target gene, herein designated TARGET GENE. IARS BINDING SITE is a target binding site found in the 3' untranslated region of multiple transcripts of mRNA encoded by IARS, corresponding to a target binding site such as BINDING SITE I, BINDING SITE II or BINDING SITE III of FIG. 8. Table 4 illustrates the complementarity of the nucleotide sequences of IARS BINDING SITE, designated SEQ ID:8969, to the nucleotide sequence of GAM7553 RNA, herein designated GAM RNA, also designated SEQ ID:354.

Another function of GAM7553 is therefore inhibition of Isoleucine-trna synthetase (IARS, Accession NP_002152.1), a gene which functions in protein biosynthesis. Accordingly, utilities of GAM7553 include diagnosis, prevention and treatment of diseases and clinical conditions associated with IARS.

The function of IARS and its association with various diseases and clinical conditions, has been established by previous studies, as described hereinabove with reference to GAM291.1. Isoleucine-trna synthetase (IARS, Accession NP_038203.1) is another GAM7553 target gene, herein designated TARGET GENE. IARS BINDING SITE is a target binding site found in the 3' untranslated region of multiple transcripts of mRNA encoded by IARS, corresponding to a target binding site such as BINDING SITE I, BINDING SITE II or BINDING SITE III of FIG. 8. Table 4 illustrates the complementarity of the nucleotide sequences of IARS BINDING SITE, designated SEQ ID:8969, to the nucleotide sequence of GAM7553 RNA, herein designated GAM RNA, also designated SEQ ID:354.

Another function of GAM7553 is therefore inhibition of Isoleucine-trna synthetase (IARS, Accession NP_038203.1), a gene which functions in protein biosynthesis. Accordingly, utilities of GAM7553 include diagnosis, prevention and treatment of diseases and clinical conditions associated with IARS.

The function of IARS and its association with various diseases and clinical conditions, has been established by previous studies, as described hereinabove with reference to GAM291.1. Interleukin 22 receptor, alpha 2 (IL22RA2, Accession NP_443194.1) is another GAM7553 target gene, herein designated TARGET GENE. IL22RA2 BINDING SITE is a target binding site found in the 3' untranslated region of multiple transcripts of mRNA encoded by IL22RA2, corresponding to a target binding site such as BINDING SITE I, BINDING SITE II or BINDING SITE III of FIG. 8. Table 4 illustrates the complementarity of the nucleotide sequences of IL22RA2 BINDING SITE, designated SEQ ID:8508, to the nucleotide sequence of GAM7553 RNA, herein designated GAM RNA, also designated SEQ ID:354.

Another function of GAM7553 is therefore inhibition of Interleukin 22 receptor, alpha 2 (IL22RA2, Accession NP_443194.1), a gene which induces the production of acute-phase reactants. Accordingly, utilities of GAM7553 include diagnosis, prevention and treatment of diseases and clinical conditions associated with IL22RA2.

The function of IL22RA2 and its association with various diseases and clinical conditions, has been established by previous studies, as described hereinabove with reference to GAM291.1. Interleukin 22 receptor, alpha 2 (IL22RA2, Accession NP_851827.1) is another GAM7553 target gene, herein designated TARGET GENE. IL22RA2 BINDING SITE is a target binding site found in the 3' untranslated region of multiple transcripts of mRNA encoded by IL22RA2, corresponding to a target binding site such as BINDING SITE I, BINDING SITE II or BINDING SITE III of FIG. 8. Table 4 illustrates the complementarity of the nucleotide sequences of IL22RA2 BINDING SITE, designated SEQ ID:8508, to the nucleotide sequence of GAM7553 RNA, herein designated GAM RNA, also designated SEQ ID:354.

Another function of GAM7553 is therefore inhibition of Interleukin 22 receptor, alpha 2 (IL22RA2, Accession NP_851827.1), a gene which induces the production of acute-phase reactants. Accordingly, utilities of GAM7553 include diagnosis, prevention and treatment of diseases and clinical conditions associated with IL22RA2.

The function of IL22RA2 and its association with various diseases and clinical conditions, has been established by previous studies, as described hereinabove with reference to GAM291.1. Interleukin 22 receptor, alpha 2 (IL22RA2, Accession NP_851826.1) is another GAM7553 target gene, herein designated TARGET GENE. IL22RA2 BINDING SITE is a target binding site found in the 3' untranslated region of multiple transcripts of mRNA encoded by IL22RA2, corresponding to a target binding site such as BINDING SITE I, BINDING SITE II or BINDING SITE III of FIG. 8. Table 4 illustrates the complementarity of the nucleotide sequences of IL22RA2 BINDING SITE, designated SEQ ID:8508, to the nucleotide sequence of GAM7553 RNA, herein designated GAM RNA, also designated SEQ ID:354.

Another function of GAM7553 is therefore inhibition of Interleukin 22 receptor, alpha 2 (IL22RA2, Accession NP_851826.1), a gene which induces the production of acute-phase reactants. Accordingly, utilities of GAM7553 include diagnosis, prevention and treatment of diseases and clinical conditions associated with IL22RA2.

The function of IL22RA2 and its association with various diseases and clinical conditions, has been established by previous studies, as described hereinabove with reference to GAM291.1. Potassium voltage-gated channel, isk-related family, member 3 (KCNE3, Accession NP_005463.1) is another GAM7553 target gene, herein designated TARGET GENE. KCNE3 BINDING SITE1 and KCNE3 BINDING SITE2 are target binding sites found in untranslated regions of mRNA encoded by KCNE3, corresponding to target binding sites such as BINDING SITE I, BINDING SITE II or BINDING SITE III of FIG. 8. Table 4 illustrates the complementarity of the nucleotide sequences of KCNE3 BINDING SITE1 and KCNE3 BINDING SITE2, designated SEQ ID:15160 and SEQ ID:682 respectively, to the nucleotide sequence of GAM7553 RNA, herein designated GAM RNA, also designated SEQ ID:354.

Another function of GAM7553 is therefore inhibition of Potassium voltage-gated channel, isk-related family, member 3 (KCNE3, Accession NP_005463.1), a gene which ancillary protein that co-assemble with a potassium channel alpha-subunit to modulate the gating kinetics and enhance stability of the multimeric complex (by similarity). and therefore may be associated with Hypokalemic periodic paralysis. Accordingly, utilities of GAM7553 include diagnosis, prevention and treatment of Hypokalemic periodic paralysis, and of other diseases and clinical conditions associated with KCNE3.

The function of KCNE3 and its association with various diseases and clinical conditions, has been established by previous studies, as described hereinabove with reference to GAM234.1. KIAA0205 (Accession NP_055688.1) is another GAM7553 target gene, herein designated TARGET GENE. KIAA0205 BINDING SITE is a target binding site found in the 3' untranslated region of mRNA encoded by KIAA0205, corresponding to a target binding site such as BINDING SITE I, BINDING SITE II or BINDING SITE III of FIG. 8. Table 4 illustrates the complementarity of the nucleotide sequences of KIAA0205 BINDING SITE, designated SEQ ID:8043, to the nucleotide sequence of GAM7553 RNA, herein designated GAM RNA, also designated SEQ ID:354.

Another function of GAM7553 is therefore inhibition of KIAA0205 (Accession NP_055688.1). Accordingly, utilities of GAM7553 include diagnosis, prevention and treatment of diseases and clinical conditions associated with KIAA0205.

KIAA0255 (Accession NP_055557.1) is another GAM7553 target gene, herein designated TARGET GENE. KIAA0255 BINDING SITE is a target binding site found in the 3' untranslated region of mRNA encoded by KIAA0255, corresponding to a target binding site such as BINDING SITE I, BINDING SITE II or BINDING SITE III of FIG. 8. Table 4 illustrates the complementarity of the nucleotide sequences of KIAA0255 BINDING SITE, designated SEQ ID:3428, to the nucleotide sequence of GAM7553 RNA, herein designated GAM RNA, also designated SEQ ID:354.

Another function of GAM7553 is therefore inhibition of KIAA0255 (Accession NP_055557.1). Accordingly, utilities of GAM7553 include diagnosis, prevention and treatment of diseases and clinical conditions associated with KIAA0255.

KIAA0495 (Accession XP_031397.1) is another GAM7553 target gene, herein designated TARGET GENE. KIAA0495 BINDING SITE is a target binding site found in the 3' untranslated region of mRNA encoded by KIAA0495, corresponding to a target binding site such as BINDING SITE I, BINDING SITE II or BINDING SITE III of FIG. 8. Table 4 illustrates the complementarity of the nucleotide sequences of KIAA0495 BINDING SITE, designated SEQ ID:5785, to the nucleotide sequence of GAM7553 RNA, herein designated GAM RNA, also designated SEQ ID:354.

Another function of GAM7553 is therefore inhibition of KIAA0495 (Accession XP_031397.1). Accordingly, utilities of GAM7553 include diagnosis, prevention and treatment of diseases and clinical conditions associated with KIAA0495.

KIAA0802 (Accession XP_031357.4) is another GAM7553 target gene, herein designated TARGET GENE. KIAA0802 BINDING SITE is a target binding site found in the 3' untranslated region of mRNA encoded by KIAA0802, corresponding to a target binding site such as BINDING SITE I, BINDING SITE II or BINDING SITE III of FIG. 8. Table 4 illustrates the complementarity of the nucleotide sequences of KIAA0802 BINDING SITE, designated SEQ ID:6556, to the nucleotide sequence of GAM7553 RNA, herein designated GAM RNA, also designated SEQ ID:354.

Another function of GAM7553 is therefore inhibition of KIAA0802 (Accession XP_031357.4). Accordingly, utilities of GAM7553 include diagnosis, prevention and treatment of diseases and clinical conditions associated with KIAA0802.

KIAA1920 (Accession XP_085210.1) is another GAM7553 target gene, herein designated TARGET GENE. KIAA1920 BINDING SITE is a target binding site found in the 5' untranslated region of mRNA encoded by KIAA1920, corresponding to a target binding site such as BINDING SITE I, BINDING SITE II or BINDING SITE III of FIG. 8. Table 4 illustrates the complementarity of the nucleotide sequences of KIAA1920 BINDING SITE, designated SEQ ID:6303, to the nucleotide sequence of GAM7553 RNA, herein designated GAM RNA, also designated SEQ ID:354.

Another function of GAM7553 is therefore inhibition of KIAA1920 (Accession XP_085210.1). Accordingly, utilities of GAM7553 include diagnosis, prevention and treatment of diseases and clinical conditions associated with KIAA1920.

LCMT2 (Accession NP_055608.2) is another GAM7553 target gene, herein designated TARGET GENE. LCMT2 BINDING SITE is a target binding site found in the 3' untranslated region of mRNA encoded by LCMT2, corresponding to a target binding site such as BINDING SITE I, BINDING SITE II or BINDING SITE III of FIG. 8. Table 4 illustrates the complementarity of the nucleotide sequences of LCMT2 BINDING SITE, designated SEQ ID:14172, to the nucleotide sequence of GAM7553 RNA, herein designated GAM RNA, also designated SEQ ID:354.

Another function of GAM7553 is therefore inhibition of LCMT2 (Accession NP_055608.2). Accordingly, utilities of GAM7553 include diagnosis, prevention and treatment of diseases and clinical conditions associated with LCMT2.

Lipoma hmgic fusion partner-like 2 (LHFPL2, Accession XP_046054.1) is another GAM7553 target gene, herein designated TARGET GENE. LHFPL2 BINDING SITE is a target binding site found in the 3' untranslated region of mRNA encoded by LHFPL2, corresponding to a target binding site such as BINDING SITE I, BINDING SITE II or BINDING SITE III of FIG. 8. Table 4 illustrates the complementarity of the nucleotide sequences of LHFPL2 BINDING SITE, designated SEQ ID:6663, to the nucleotide sequence of GAM7553 RNA, herein designated GAM RNA, also designated SEQ ID:354.

Another function of GAM7553 is therefore inhibition of Lipoma hmgic fusion partner-like 2 (LHFPL2, Accession XP_046054.1). Accordingly, utilities of GAM7553 include diagnosis, prevention and treatment of diseases and clinical conditions associated with LHFPL2.

LOC120224 (Accession NP_620143.1) is another GAM7553 target gene, herein designated TARGET GENE. LOC120224 BINDING SITE is a target binding site found in the 3' untranslated region of mRNA encoded by LOC120224, corresponding to a target binding site such as BINDING SITE I, BINDING SITE II or BINDING SITE III of FIG. 8. Table 4 illustrates the complementarity of the nucleotide sequences of LOC120224 BINDING SITE, designated SEQ ID:17035, to the nucleotide sequence of GAM7553 RNA, herein designated GAM RNA, also designated SEQ ID:354.

Another function of GAM7553 is therefore inhibition of LOC120224 (Accession NP_620143.1). Accordingly, utilities of GAM7553 include diagnosis, prevention and treatment of diseases and clinical conditions associated with LOC120224.

LOC138649 (Accession XP_059987.2) is another GAM7553 target gene, herein designated TARGET GENE. LOC138649 BINDING SITE is a target binding site found in the 3' untranslated region of mRNA encoded by LOC138649, corresponding to a target binding site such as BINDING SITE I, BINDING SITE II or BINDING SITE III of FIG. 8. Table 4 illustrates the complementarity of the nucleotide sequences of LOC138649 BINDING SITE, designated SEQ ID:9140, to the nucleotide sequence of GAM7553 RNA, herein designated GAM RNA, also designated SEQ ID:354.

Another function of GAM7553 is therefore inhibition of LOC138649 (Accession XP_059987.2). Accordingly, utilities of GAM7553 include diagnosis, prevention and treatment of diseases and clinical conditions associated with LOC138649.

LOC144438 (Accession XP_084860.1) is another GAM7553 target gene, herein designated TARGET GENE. LOC144438 BINDING SITE is a target binding site found in the 5' untranslated region of mRNA encoded by LOC144438, corresponding to a target binding site such as BINDING SITE I, BINDING SITE II or BINDING SITE III of FIG. 8. Table 4 illustrates the complementarity of the nucleotide sequences of LOC144438 BINDING SITE, designated SEQ ID:2439, to the nucleotide sequence of GAM7553 RNA, herein designated GAM RNA, also designated SEQ ID:354.

Another function of GAM7553 is therefore inhibition of LOC144438 (Accession XP_084860.1). Accordingly, utilities of GAM7553 include diagnosis, prevention and treatment of diseases and clinical conditions associated with LOC144438.

LOC145921 (Accession XP_071845.2) is another GAM7553 target gene, herein designated TARGET GENE. LOC145921 BINDING SITE is a target binding site found in the 5' untranslated region of mRNA encoded by LOC145921, corresponding to a target binding site such as BINDING SITE I, BINDING SITE II or BINDING SITE III of FIG. 8. Table 4 illustrates the complementarity of the nucleotide sequences of LOC145921 BINDING SITE, designated SEQ ID:8430, to the nucleotide sequence of GAM7553 RNA, herein designated GAM RNA, also designated SEQ ID:354.

Another function of GAM7553 is therefore inhibition of LOC145921 (Accession XP_071845.2). Accordingly, utilities of GAM7553 include diagnosis, prevention and treatment of diseases and clinical conditions associated with LOC145921.

LOC149149 (Accession XP_097598.1) is another GAM7553 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:14584, to the nucleotide sequence of GAM7553 RNA, herein designated GAM RNA, also designated SEQ ID:354.

Another function of GAM7553 is therefore inhibition of LOC149149 (Accession XP_097598.1). Accordingly, utilities of GAM7553 include diagnosis, prevention and treatment of diseases and clinical conditions associated with LOC149149.

LOC150759 (Accession NP_787049.1) is another GAM7553 target gene, herein designated TARGET GENE. LOC150759 BINDING SITE is a target binding site found in the 3' untranslated region of mRNA encoded by LOC150759, corresponding to a target binding site such as BINDING SITE I, BINDING SITE II or BINDING SITE III of FIG. 8. Table 4 illustrates the complementarity of the nucleotide sequences of LOC150759 BINDING SITE, designated SEQ ID:5023, to the nucleotide sequence of GAM7553 RNA, herein designated GAM RNA, also designated SEQ ID:354.

Another function of GAM7553 is therefore inhibition of LOC150759 (Accession NP_787049.1). Accordingly, utilities of GAM7553 include diagnosis, prevention and treatment of diseases and clinical conditions associated with LOC150759.

LOC153959 (Accession XP_098450.1) is another GAM7553 target gene, herein designated TARGET GENE. LOC153959 BINDING SITE is a target binding site found in the 5' untranslated region of mRNA encoded by LOC153959, corresponding to a target binding site such as BINDING SITE I, BINDING SITE II or BINDING SITE III of FIG. 8. Table 4 illustrates the complementarity of the nucleotide sequences of LOC153959 BINDING SITE, designated SEQ ID:19972, to the nucleotide sequence of GAM7553 RNA, herein designated GAM RNA, also designated SEQ ID:354.

Another function of GAM7553 is therefore inhibition of LOC153959 (Accession XP_098450.1). Accordingly, utilities of GAM7553 include diagnosis, prevention and treatment of diseases and clinical conditions associated with LOC153959.

LOC155036 (Accession XP_098651.1) is another GAM7553 target gene, herein designated TARGET GENE. LOC155036 BINDING SITE is a target binding site found in the 3' untranslated region of mRNA encoded by LOC155036, corresponding to a target binding site such as BINDING SITE I, BINDING SITE II or BINDING SITE III of FIG. 8. Table 4 illustrates the complementarity of the nucleotide sequences of LOC155036 BINDING SITE, designated SEQ ID:19733, to the nucleotide sequence of GAM7553 RNA, herein designated GAM RNA, also designated SEQ ID:354.

Another function of GAM7553 is therefore inhibition of LOC155036 (Accession XP_098651.1). Accordingly, utilities of GAM7553 include diagnosis, prevention and treatment of diseases and clinical conditions associated with LOC155036.

LOC200399 (Accession XP_114226.1) is another GAM7553 target gene, herein designated TARGET GENE. LOC200399 BINDING SITE is a target binding site found in the 3' untranslated region of mRNA encoded by LOC200399, corresponding to a target binding site such as BINDING SITE I, BINDING SITE II or BINDING SITE III of FIG. 8. Table 4 illustrates the complementarity of the nucleotide sequences of LOC200399 BINDING SITE, designated SEQ ID:3065, to the nucleotide sequence of GAM7553 RNA, herein designated GAM RNA, also designated SEQ ID:354.

Another function of GAM7553 is therefore inhibition of LOC200399 (Accession XP_114226.1). Accordingly, utilities of GAM7553 include diagnosis, prevention and treatment of diseases and clinical conditions associated with LOC200399.

LOC201501 (Accession XP_113971.1) is another GAM7553 target gene, herein designated TARGET GENE. LOC201501 BINDING SITE is a target binding site found in the 3' untranslated region of mRNA encoded by LOC201501, corresponding to a target binding site such as BINDING SITE I, BINDING SITE II or BINDING SITE III of FIG. 8. Table 4 illustrates the complementarity of the nucleotide sequences of LOC201501 BINDING SITE, designated SEQ ID:9241, to the nucleotide sequence of GAM7553 RNA, herein designated GAM RNA, also designated SEQ ID:354.

Another function of GAM7553 is therefore inhibition of LOC201501 (Accession XP_113971.1). Accordingly, utilities of GAM7553 include diagnosis, prevention and treatment of diseases and clinical conditions associated with LOC201501.

LOC220686 (Accession XP_167540.4) is another GAM7553 target gene, herein designated TARGET GENE. LOC220686 BINDING SITE is a target binding site found in the 3' untranslated region of mRNA encoded by LOC220686, corresponding to a target binding site such as BINDING SITE I, BINDING SITE II or BINDING SITE III of FIG. 8. Table 4 illustrates the complementarity of the nucleotide sequences of LOC220686 BINDING SITE, designated SEQ ID:5260, to the nucleotide sequence of GAM7553 RNA, herein designated GAM RNA, also designated SEQ ID:354.

Another function of GAM7553 is therefore inhibition of LOC220686 (Accession XP_167540.4). Accordingly, utilities of GAM7553 include diagnosis, prevention and treatment of diseases and clinical conditions associated with LOC220686.

LOC221495 (Accession XP_168136.1) is another GAM7553 target gene, herein designated TARGET GENE. LOC221495 BINDING SITE is a target binding site found in the 3' untranslated region of mRNA encoded by LOC221495, corresponding to a target binding site such as BINDING SITE I, BINDING SITE II or BINDING SITE III of FIG. 8. Table 4 illustrates the complementarity of the nucleotide sequences of LOC221495 BINDING SITE, designated SEQ ID:2379, to the nucleotide sequence of GAM7553 RNA, herein designated GAM RNA, also designated SEQ ID:354.

Another function of GAM7553 is therefore inhibition of LOC221495 (Accession XP_168136.1). Accordingly, utilities of GAM7553 include diagnosis, prevention and treatment of diseases and clinical conditions associated with LOC221495.

LOC221922 (Accession XP_166555.2) is another GAM7553 target gene, herein designated TARGET GENE. LOC221922 BINDING SITE is a target binding site found in the 3' untranslated region of mRNA encoded by LOC221922, corresponding to a target binding site such as BINDING SITE I, BINDING SITE II or BINDING SITE III of FIG. 8. Table 4 illustrates the complementarity of the nucleotide sequences of LOC221922 BINDING SITE, designated SEQ ID:19315, to the nucleotide sequence of GAM7553 RNA, herein designated GAM RNA, also designated SEQ ID:354.

Another function of GAM7553 is therefore inhibition of LOC221922 (Accession XP_166555.2). Accordingly, utilities of GAM7553 include diagnosis, prevention and treatment of diseases and clinical conditions associated with LOC221922.

LOC221938 (Accession XP_166542.2) is another GAM7553 target gene, herein designated TARGET GENE. LOC221938 BINDING SITE is a target binding site found in the 3' untranslated region of mRNA encoded by LOC221938, corresponding to a target binding site such as BINDING SITE I, BINDING SITE II or BINDING SITE III of FIG. 8. Table 4 illustrates the complementarity of the nucleotide sequences of LOC221938 BINDING SITE, designated SEQ ID:13252, to the nucleotide sequence of GAM7553 RNA, herein designated GAM RNA, also designated SEQ ID:354.

Another function of GAM7553 is therefore inhibition of LOC221938 (Accession XP_166542.2). Accordingly, utilities of GAM7553 include diagnosis, prevention and treatment of diseases and clinical conditions associated with LOC221938.

LOC253982 (Accession XP_170804.3) is another GAM7553 target gene, herein designated TARGET GENE. LOC253982 BINDING SITE is a target binding site found in the 3' untranslated region of mRNA encoded by LOC253982, corresponding to a target binding site such as BINDING SITE I, BINDING SITE II or BINDING SITE III of FIG. 8. Table 4 illustrates the complementarity of the nucleotide sequences of LOC253982 BINDING SITE, designated SEQ ID:11790, to the nucleotide sequence of GAM7553 RNA, herein designated GAM RNA, also designated SEQ ID:354.

Another function of GAM7553 is therefore inhibition of LOC253982 (Accession XP_170804.3). Accordingly, utilities of GAM7553 include diagnosis, prevention and treatment of diseases and clinical conditions associated with LOC253982.

LOC283487 (Accession XP_211062.1) is another GAM7553 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:19068, to the nucleotide sequence of GAM7553 RNA, herein designated GAM RNA, also designated SEQ ID:354.

Another function of GAM7553 is therefore inhibition of LOC283487 (Accession XP_211062.1). Accordingly, utilities of GAM7553 include diagnosis, prevention and treatment of diseases and clinical conditions associated with LOC283487.

LOC283686 (Accession XP_211164.1) is another GAM7553 target gene, herein designated TARGET GENE. LOC283686 BINDING SITE is a target binding site found in the 5' untranslated region of mRNA encoded by LOC283686, corresponding to a target binding site such as BINDING SITE I, BINDING SITE II or BINDING SITE III of FIG. 8. Table 4 illustrates the complementarity of the nucleotide sequences of LOC283686 BINDING SITE, designated SEQ ID:15683, to the nucleotide sequence of GAM7553 RNA, herein designated GAM RNA, also designated SEQ ID:354.

Another function of GAM7553 is therefore inhibition of LOC283686 (Accession XP_211164.1). Accordingly, utilities of GAM7553 include diagnosis, prevention and treatment of diseases and clinical conditions associated with LOC283686.

LOC283868 (Accession XP_211243.1) is another GAM7553 target gene, herein designated TARGET GENE. LOC283868 BINDING SITE is a target binding site found in the 5' untranslated region of mRNA encoded by LOC283868, corresponding to a target binding site such as BINDING SITE I, BINDING SITE II or BINDING SITE III of FIG. 8. Table 4 illustrates the complementarity of the nucleotide sequences of LOC283868 BINDING SITE, designated SEQ ID:20068, to the nucleotide sequence of GAM7553 RNA, herein designated GAM RNA, also designated SEQ ID:354.

Another function of GAM7553 is therefore inhibition of LOC283868 (Accession XP_211243.1). Accordingly, utilities of GAM7553 include diagnosis, prevention and treatment of diseases and clinical conditions associated with LOC283868.

LOC283925 (Accession XP_208907.1) is another GAM7553 target gene, herein designated TARGET GENE. LOC283925 BINDING SITE is a target binding site found in the 5' untranslated region of mRNA encoded by LOC283925, corresponding to a target binding site such as BINDING SITE I, BINDING SITE II or BINDING SITE III of FIG. 8. Table 4 illustrates the complementarity of the nucleotide sequences of LOC283925 BINDING SITE, designated SEQ ID:12361, to the nucleotide sequence of GAM7553 RNA, herein designated GAM RNA, also designated SEQ ID:354.

Another function of GAM7553 is therefore inhibition of LOC283925 (Accession XP_208907.1). Accordingly, utilities of GAM7553 include diagnosis, prevention and treatment of diseases and clinical conditions associated with LOC283925.

LOC284080 (Accession XP_211322.1) is another GAM7553 target gene, herein designated TARGET GENE. LOC284080 BINDING SITE is a target binding site found in the 5' untranslated region of mRNA encoded by LOC284080, corresponding to a target binding site such as BINDING SITE I, BINDING SITE II or BINDING SITE III of FIG. 8. Table 4 illustrates the complementarity of the nucleotide sequences of LOC284080 BINDING SITE, designated SEQ ID:4066, to the nucleotide sequence of GAM7553 RNA, herein designated GAM RNA, also designated SEQ ID:354.

Another function of GAM7553 is therefore inhibition of LOC284080 (Accession XP_211322.1). Accordingly, utilities of GAM7553 include diagnosis, prevention and treatment of diseases and clinical conditions associated with LOC284080.

LOC284693 (Accession XP_209323.1) is another GAM7553 target gene, herein designated TARGET GENE. LOC284693 BINDING SITE is a target binding site found in the 5' untranslated region of mRNA encoded by LOC284693, corresponding to a target binding site such as BINDING SITE I, BINDING SITE II or BINDING SITE III of FIG. 8. Table 4 illustrates the complementarity of the nucleotide sequences of LOC284693 BINDING SITE, designated SEQ ID:1014, to the nucleotide sequence of GAM7553 RNA, herein designated GAM RNA, also designated SEQ ID:354.

Another function of GAM7553 is therefore inhibition of LOC284693 (Accession XP_209323.1). Accordingly, utilities of GAM7553 include diagnosis, prevention and treatment of diseases and clinical conditions associated with LOC284693.

LOC284994 (Accession XP_209434.1) is another GAM7553 target gene, herein designated TARGET GENE. LOC284994 BINDING SITE is a target binding site found in the 3' untranslated region of mRNA encoded by LOC284994, corresponding to a target binding site such as BINDING SITE I, BINDING SITE II or BINDING SITE III of FIG. 8. Table 4 illustrates the complementarity of the nucleotide sequences of LOC284994 BINDING SITE, designated SEQ ID:5023, to the nucleotide sequence of GAM7553 RNA, herein designated GAM RNA, also designated SEQ ID:354.

Another function of GAM7553 is therefore inhibition of LOC284994 (Accession XP_209434.1). Accordingly, utilities of GAM7553 include diagnosis, prevention and treatment of diseases and clinical conditions associated with LOC284994.

LOC285166 (Accession XP_211791.1) is another GAM7553 target gene, herein designated TARGET GENE. LOC285166 BINDING SITE is a target binding site found in the 3' untranslated region of mRNA encoded by LOC285166, corresponding to a target binding site such as BINDING SITE I, BINDING SITE II or BINDING SITE III of FIG. 8. Table 4 illustrates the complementarity of the nucleotide sequences of LOC285166 BINDING SITE, designated SEQ ID:14257, to the nucleotide sequence of GAM7553 RNA, herein designated GAM RNA, also designated SEQ ID:354.

Another function of GAM7553 is therefore inhibition of LOC285166 (Accession XP_211791.1). Accordingly, utilities of GAM7553 include diagnosis, prevention and treatment of diseases and clinical conditions associated with LOC285166.

LOC285484 (Accession XP_209630.1) is another GAM7553 target gene, herein designated TARGET GENE. LOC285484 BINDING SITE is a target binding site found in the 3' untranslated region of mRNA encoded by LOC285484, corresponding to a target binding site such as BINDING SITE I, BINDING SITE II or BINDING SITE III of FIG. 8. Table 4 illustrates the complementarity of the nucleotide sequences of LOC285484 BINDING SITE, designated SEQ ID:5962, to the nucleotide sequence of GAM7553 RNA, herein designated GAM RNA, also designated SEQ ID:354.

Another function of GAM7553 is therefore inhibition of LOC285484 (Accession XP_209630.1). Accordingly, utilities of GAM7553 include diagnosis, prevention and treatment of diseases and clinical conditions associated with LOC285484.

LOC285729 (Accession XP_212001.1) is another GAM7553 target gene, herein designated TARGET GENE. LOC285729 BINDING SITE is a target binding site found in the 3' untranslated region of mRNA encoded by LOC285729, corresponding to a target binding site such as BINDING SITE I, BINDING SITE II or BINDING SITE III of FIG. 8. Table 4 illustrates the complementarity of the nucleotide sequences of LOC285729 BINDING SITE, designated SEQ ID:15629, to the nucleotide sequence of GAM7553 RNA, herein designated GAM RNA, also designated SEQ ID:354.

Another function of GAM7553 is therefore inhibition of LOC285729 (Accession XP_212001.1). Accordingly, utilities of GAM7553 include diagnosis, prevention and treatment of diseases and clinical conditions associated with LOC285729.

LOC285831 (Accession XP_212625.1) is another GAM7553 target gene, herein designated TARGET GENE. LOC285831 BINDING SITE is a target binding site found in the 3' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:5709, to the nucleotide sequence of GAM7553 RNA, herein designated GAM RNA, also designated SEQ ID:354.

Another function of GAM7553 is therefore inhibition of LOC285831 (Accession XP_212625.1). Accordingly, utilities of GAM7553 include diagnosis, prevention and treatment of diseases and clinical conditions associated with LOC285831.

LOC285831 (Accession XP_212577.1) is another GAM7553 target gene, herein designated TARGET GENE. LOC285831 BINDING SITE is a target binding site found in the 3' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:5709, to the nucleotide sequence of GAM7553 RNA, herein designated GAM RNA, also designated SEQ ID:354.

Another function of GAM7553 is therefore inhibition of LOC285831 (Accession XP_212577.1). Accordingly, utilities of GAM7553 include diagnosis, prevention and treatment of diseases and clinical conditions associated with LOC285831.

LOC285831 (Accession XP_209784.1) is another GAM7553 target gene, herein designated TARGET GENE. LOC285831 BINDING SITE is a target binding site found in the 3' untranslated region of multiple transcripts of mRNA encoded by LOC285831, corresponding to a target binding site such as BINDING SITE I, BINDING SITE II or BINDING SITE III of FIG. 8. Table 4 illustrates the complementarity of the nucleotide sequences of LOC285831 BINDING SITE, designated SEQ ID:5709, to the nucleotide sequence of GAM7553 RNA, herein designated GAM RNA, also designated SEQ ID:354.

Another function of GAM7553 is therefore inhibition of LOC285831 (Accession XP_209784.1). Accordingly, utilities of GAM7553 include diagnosis, prevention and treatment of diseases and clinical conditions associated with LOC285831.

LOC338862 (Accession XP_290601.1) is another GAM7553 target gene, herein designated TARGET GENE. LOC338862 BINDING SITE is a target binding site found in the 3' untranslated region of mRNA encoded by LOC338862, corresponding to a target binding site such as BINDING SITE I, BINDING SITE II or BINDING SITE III of FIG. 8. Table 4 illustrates the complementarity of the nucleotide sequences of LOC338862 BINDING SITE, designated SEQ ID:2464, to the nucleotide sequence of GAM7553 RNA, herein designated GAM RNA, also designated SEQ ID:354.

Another function of GAM7553 is therefore inhibition of LOC338862 (Accession XP_290601.1). Accordingly, utilities of GAM7553 include diagnosis, prevention and treatment of diseases and clinical conditions associated with LOC338862.

LOC338866 (Accession XP_294736.1) is another GAM7553 target gene, herein designated TARGET GENE. LOC338866 BINDING SITE is a target binding site found in the 5' untranslated region of mRNA encoded by LOC338866, corresponding to a target binding site such as BINDING SITE I, BINDING SITE II or BINDING SITE III of FIG. 8. Table 4 illustrates the complementarity of the nucleotide sequences of LOC338866 BINDING SITE, designated SEQ ID:5837, to the nucleotide sequence of GAM7553 RNA, herein designated GAM RNA, also designated SEQ ID:354.

Another function of GAM7553 is therefore inhibition of LOC338866 (Accession XP_294736.1). Accordingly, utilities of GAM7553 include diagnosis, prevention and treatment of diseases and clinical conditions associated with LOC338866.

LOC338909 (Accession XP_294744.1) is another GAM7553 target gene, herein designated TARGET GENE. LOC338909 BINDING SITE is a target binding site found in the 5' untranslated region of mRNA encoded by LOC338909, corresponding to a target binding site such as BINDING SITE I, BINDING SITE II or BINDING SITE III of FIG. 8. Table 4 illustrates the complementarity of the nucleotide sequences of LOC338909 BINDING SITE, designated SEQ ID:11382, to the nucleotide sequence of GAM7553 RNA, herein designated GAM RNA, also designated SEQ ID:354.

Another function of GAM7553 is therefore inhibition of LOC338909 (Accession XP_294744.1). Accordingly, utilities of GAM7553 include diagnosis, prevention and treatment of diseases and clinical conditions associated with LOC338909.

LOC338981 (Accession XP_294767.2) is another GAM7553 target gene, herein designated TARGET GENE. LOC338981 BINDING SITE is a target binding site found in the 5' untranslated region of mRNA encoded by LOC338981, corresponding to a target binding site such as BINDING SITE I, BINDING SITE II or BINDING SITE III of FIG. 8. Table 4 illustrates the complementarity of the nucleotide sequences of LOC338981 BINDING SITE, designated SEQ ID:10252, to the nucleotide sequence of GAM7553 RNA, herein designated GAM RNA, also designated SEQ ID:354.

Another function of GAM7553 is therefore inhibition of LOC338981 (Accession XP_294767.2). Accordingly, utilities of GAM7553 include diagnosis, prevention and treatment of diseases and clinical conditions associated with LOC338981.

LOC339290 (Accession XP_294901.1) is another GAM7553 target gene, herein designated TARGET GENE. LOC339290 BINDING SITE is a target binding site found in the 5' untranslated region of mRNA encoded by LOC339290, corresponding to a target binding site such as BINDING SITE I, BINDING SITE II or BINDING SITE III of FIG. 8. Table 4 illustrates the complementarity of the nucleotide sequences of LOC339290 BINDING SITE, designated SEQ ID:14173, to the nucleotide sequence of GAM7553 RNA, herein designated GAM RNA, also designated SEQ ID:354.

Another function of GAM7553 is therefore inhibition of LOC339290 (Accession XP_294901.1). Accordingly, utilities of GAM7553 include diagnosis, prevention and treatment of diseases and clinical conditions associated with LOC339290.

LOC339789 (Accession XP_295067.1) is another GAM7553 target gene, herein designated TARGET GENE. LOC339789 BINDING SITE is a target binding site found in the 3' untranslated region of mRNA encoded by LOC339789, corresponding to a target binding site such as BINDING SITE I, BINDING SITE II or BINDING SITE III of FIG. 8. Table 4 illustrates the complementarity of the nucleotide sequences of LOC339789 BINDING SITE, designated SEQ ID:19316, to the nucleotide sequence of GAM7553 RNA, herein designated GAM RNA, also designated SEQ ID:354.

Another function of GAM7553 is therefore inhibition of LOC339789 (Accession XP_295067.1). Accordingly, utilities of GAM7553 include diagnosis, prevention and treatment of diseases and clinical conditions associated with LOC339789.

LOC339832 (Accession XP_295079.1) is another GAM7553 target gene, herein designated TARGET GENE. LOC339832 BINDING SITE is a target binding site found in the 5' untranslated region of mRNA encoded by LOC339832, corresponding to a target binding site such as BINDING SITE I, BINDING SITE II or BINDING SITE III of FIG. 8. Table 4 illustrates the complementarity of the nucleotide sequences of LOC339832 BINDING SITE, designated SEQ ID:2461, to the nucleotide sequence of GAM7553 RNA, herein designated GAM RNA, also designated SEQ ID:354.

Another function of GAM7553 is therefore inhibition of LOC339832 (Accession XP_295079.1). Accordingly, utilities of GAM7553 include diagnosis, prevention and treatment of diseases and clinical conditions associated with LOC339832.

LOC339872 (Accession XP_291050.1) is another GAM7553 target gene, herein designated TARGET GENE. LOC339872 BINDING SITE is a target binding site found in the 5' untranslated region of mRNA encoded by LOC339872, corresponding to a target binding site such as BINDING SITE I, BINDING SITE II or BINDING SITE III of FIG. 8. Table 4 illustrates the complementarity of the nucleotide sequences of LOC339872 BINDING SITE, designated SEQ ID:6271, to the nucleotide sequence of GAM7553 RNA, herein designated GAM RNA, also designated SEQ ID:354.

Another function of GAM7553 is therefore inhibition of LOC339872 (Accession XP_291050.1). Accordingly, utilities of GAM7553 include diagnosis, prevention and treatment of diseases and clinical conditions associated with LOC339872.

LOC340449 (Accession XP_290424.2) is another GAM7553 target gene, herein designated TARGET GENE. LOC340449 BINDING SITE is a target binding site found in the 5' untranslated region of mRNA encoded by LOC340449, corresponding to a target binding site such as BINDING SITE I, BINDING SITE II or BINDING SITE III of FIG. 8. Table 4 illustrates the complementarity of the nucleotide sequences of LOC340449 BINDING SITE, designated SEQ ID:7795, to the nucleotide sequence of GAM7553 RNA, herein designated GAM RNA, also designated SEQ ID:354.

Another function of GAM7553 is therefore inhibition of LOC340449 (Accession XP_290424.2). Accordingly, utilities of GAM7553 include diagnosis, prevention and treatment of diseases and clinical conditions associated with LOC340449.

LOC342663 (Accession XP_297028.1) is another GAM7553 target gene, herein designated TARGET GENE. LOC342663 BINDING SITE is a target binding site found in the 3' untranslated region of mRNA encoded by LOC342663, corresponding to a target binding site such as BINDING SITE I, BINDING SITE II or BINDING SITE III of FIG. 8. Table 4 illustrates the complementarity of the nucleotide sequences of LOC342663 BINDING SITE, designated SEQ ID:2579, to the nucleotide sequence of GAM7553 RNA, herein designated GAM RNA, also designated SEQ ID:354.

Another function of GAM7553 is therefore inhibition of LOC342663 (Accession XP_297028.1). Accordingly, utilities of GAM7553 include diagnosis, prevention and treatment of diseases and clinical conditions associated with LOC342663.

LOC344886 (Accession XP_298385.1) is another GAM7553 target gene, herein designated TARGET GENE. LOC344886 BINDING SITE is a target binding site found in the 3' untranslated region of mRNA encoded by LOC344886, corresponding to a target binding site such as BINDING SITE I, BINDING SITE II or BINDING SITE III of FIG. 8. Table 4 illustrates the complementarity of the nucleotide sequences of LOC344886 BINDING SITE, designated SEQ ID:20037, to the nucleotide sequence of GAM7553 RNA, herein designated GAM RNA, also designated SEQ ID:354.

Another function of GAM7553 is therefore inhibition of LOC344886 (Accession XP_298385.1). Accordingly, utilities of GAM7553 include diagnosis, prevention and treatment of diseases and clinical conditions associated with LOC344886.

LOC348127 (Accession XP_302662.1) is another GAM7553 target gene, herein designated TARGET GENE. LOC348127 BINDING SITE is a target binding site found in the 5' untranslated region of mRNA encoded by LOC348127, corresponding to a target binding site such as BINDING SITE I, BINDING SITE II or BINDING SITE III of FIG. 8. Table 4 illustrates the complementarity of the nucleotide sequences of LOC348127 BINDING SITE, designated SEQ ID:10252, to the nucleotide sequence of GAM7553 RNA, herein designated GAM RNA, also designated SEQ ID:354.

Another function of GAM7553 is therefore inhibition of LOC348127 (Accession XP_302662.1). Accordingly, utilities of GAM7553 include diagnosis, prevention and treatment of diseases and clinical conditions associated with LOC348127.

LOC348130 (Accession XP_302666.1) is another GAM7553 target gene, herein designated TARGET GENE. LOC348130 BINDING SITE is a target binding site found in the 5' untranslated region of mRNA encoded by LOC348130, corresponding to a target binding site such as BINDING SITE I, BINDING SITE II or BINDING SITE III of FIG. 8. Table 4 illustrates the complementarity of the nucleotide sequences of LOC348130 BINDING SITE, designated SEQ ID:10252, to the nucleotide sequence of GAM7553 RNA, herein designated GAM RNA, also designated SEQ ID:354.

Another function of GAM7553 is therefore inhibition of LOC348130 (Accession XP_302666.1). Accordingly, utilities of GAM7553 include diagnosis, prevention and treatment of diseases and clinical conditions associated with LOC348130.

LOC348544 (Accession XP_300243.1) is another GAM7553 target gene, herein designated TARGET GENE. LOC348544 BINDING SITE is a target binding site found in the 3' untranslated region of mRNA encoded by LOC348544, corresponding to a target binding site such as BINDING SITE I, BINDING SITE II or BINDING SITE III of FIG. 8. Table 4 illustrates the complementarity of the nucleotide sequences of LOC348544 BINDING SITE, designated SEQ ID:10979, to the nucleotide sequence of GAM7553 RNA, herein designated GAM RNA, also designated SEQ ID:354.

Another function of GAM7553 is therefore inhibition of LOC348544 (Accession XP_300243.1). Accordingly, utilities of GAM7553 include diagnosis, prevention and treatment of diseases and clinical conditions associated with LOC348544.

LOC348600 (Accession XP_300790.1) is another GAM7553 target gene, herein designated TARGET GENE. LOC348600 BINDING SITE is a target binding site found in the 3' untranslated region of mRNA encoded by LOC348600, corresponding to a target binding site such as BINDING SITE I, BINDING SITE II or BINDING SITE III of FIG. 8. Table 4 illustrates the complementarity of the nucleotide sequences of LOC348600 BINDING SITE, designated SEQ ID:5260, to the nucleotide sequence of GAM7553 RNA, herein designated GAM RNA, also designated SEQ ID:354.

Another function of GAM7553 is therefore inhibition of LOC348600 (Accession XP_300790.1). Accordingly, utilities of GAM7553 include diagnosis, prevention and treatment of diseases and clinical conditions associated with LOC348600.

LOC349140 (Accession XP_291247.1) is another GAM7553 target gene, herein designated TARGET GENE. LOC349140 BINDING SITE is a target binding site found in the 3' untranslated region of mRNA encoded by LOC349140, corresponding to a target binding site such as BINDING SITE I, BINDING SITE II or BINDING SITE III of FIG. 8. Table 4 illustrates the complementarity of the nucleotide sequences of LOC349140 BINDING SITE, designated SEQ ID:3138, to the nucleotide sequence of GAM7553 RNA, herein designated GAM RNA, also designated SEQ ID:354.

Another function of GAM7553 is therefore inhibition of LOC349140 (Accession XP_291247.1). Accordingly, utilities of GAM7553 include diagnosis, prevention and treatment of diseases and clinical conditions associated with LOC349140.

LOC349287 (Accession XP_301010.1) is another GAM7553 target gene, herein designated TARGET GENE. LOC349287 BINDING SITE is a target binding site found in the 3' untranslated region of mRNA encoded by LOC349287, corresponding to a target binding site such as BINDING SITE I, BINDING SITE II or BINDING SITE III of FIG. 8. Table 4 illustrates the complementarity of the nucleotide sequences of LOC349287 BINDING SITE, designated SEQ ID:17133, to the nucleotide sequence of GAM7553 RNA, herein designated GAM RNA, also designated SEQ ID:354.

Another function of GAM7553 is therefore inhibition of LOC349287 (Accession XP_301010.1). Accordingly, utilities of GAM7553 include diagnosis, prevention and treatment of diseases and clinical conditions associated with LOC349287.

LOC349309 (Accession XP_301020.1) is another GAM7553 target gene, herein designated TARGET GENE. LOC349309 BINDING SITE is a target binding site found in the 3' untranslated region of mRNA encoded by LOC349309, corresponding to a target binding site such as BINDING SITE I, BINDING SITE II or BINDING SITE III of FIG. 8. Table 4 illustrates the complementarity of the nucleotide sequences of LOC349309 BINDING SITE, designated SEQ ID:15332, to the nucleotide sequence of GAM7553 RNA, herein designated GAM RNA, also designated SEQ ID:354.

Another function of GAM7553 is therefore inhibition of LOC349309 (Accession XP_301020.1). Accordingly, utilities of GAM7553 include diagnosis, prevention and treatment of diseases and clinical conditions associated with LOC349309.

LOC80298 (Accession NP_079474.2) is another GAM7553 target gene, herein designated TARGET GENE. LOC80298 BINDING SITE is a target binding site found in the 5' untranslated region of mRNA encoded by LOC80298, corresponding to a target binding site such as BINDING SITE I, BINDING SITE II or BINDING SITE III of FIG. 8. Table 4 illustrates the complementarity of the nucleotide sequences of LOC80298 BINDING SITE, designated SEQ ID:19304, to the nucleotide sequence of GAM7553 RNA, herein designated GAM RNA, also designated SEQ ID:354.

Another function of GAM7553 is therefore inhibition of LOC80298 (Accession NP_079474.2). Accordingly, utilities of GAM7553 include diagnosis, prevention and treatment of diseases and clinical conditions associated with LOC80298.

LOC85026 (Accession NP_116326.1) is another GAM7553 target gene, herein designated TARGET GENE. LOC85026 BINDING SITE is a target binding site found in the 5' untranslated region of mRNA encoded by LOC85026, corresponding to a target binding site such as BINDING SITE I, BINDING SITE II or BINDING SITE III of FIG. 8. Table 4 illustrates the complementarity of the nucleotide sequences of LOC85026 BINDING SITE, designated SEQ ID:13738, to the nucleotide sequence of GAM7553 RNA, herein designated GAM RNA, also designated SEQ ID:354.

Another function of GAM7553 is therefore inhibition of LOC85026 (Accession NP_116326.1). Accordingly, utilities of GAM7553 include diagnosis, prevention and treatment of diseases and clinical conditions associated with LOC85026.

LOC90906 (Accession XP_034809.1) is another GAM7553 target gene, herein designated TARGET GENE. LOC90906 BINDING SITE is a target binding site found in the 5' untranslated region of mRNA encoded by LOC90906, corresponding to a target binding site such as BINDING SITE I, BINDING SITE II or BINDING SITE III of FIG. 8. Table 4 illustrates the complementarity of the nucleotide sequences of LOC90906 BINDING SITE, designated SEQ ID:15110, to the nucleotide sequence of GAM7553 RNA, herein designated GAM RNA, also designated SEQ ID:354.

Another function of GAM7553 is therefore inhibition of LOC90906 (Accession XP_034809.1). Accordingly, utilities of GAM7553 include diagnosis, prevention and treatment of diseases and clinical conditions associated with LOC90906.

MBNL2 (Accession NP_005748.1) is another GAM7553 target gene, herein designated TARGET GENE. MBNL2 BINDING SITE is a target binding site found in the 3' untranslated region of multiple transcripts of mRNA encoded by MBNL2, corresponding to a target binding site such as BINDING SITE I, BINDING SITE II or BINDING SITE III of FIG. 8. Table 4 illustrates the complementarity of the nucleotide sequences of MBNL2 BINDING SITE, designated SEQ ID:5708, to the nucleotide sequence of GAM7553 RNA, herein designated GAM RNA, also designated SEQ ID:354.

Another function of GAM7553 is therefore inhibition of MBNL2 (Accession NP_005748.1). Accordingly, utilities of GAM7553 include diagnosis, prevention and treatment of diseases and clinical conditions associated with MBNL2.

MBNL2 (Accession NP_659002.1) is another GAM7553 target gene, herein designated TARGET GENE. MBNL2 BINDING SITE is a target binding site found in the 3' untranslated region of multiple transcripts of mRNA encoded by MBNL2, corresponding to a target binding site such as BINDING SITE I, BINDING SITE II or BINDING SITE III of FIG. 8. Table 4 illustrates the complementarity of the nucleotide sequences of MBNL2 BINDING SITE, designated SEQ ID:5708, to the nucleotide sequence of GAM7553 RNA, herein designated GAM RNA, also designated SEQ ID:354.

Another function of GAM7553 is therefore inhibition of MBNL2 (Accession NP_659002.1). Accordingly, utilities of GAM7553 include diagnosis, prevention and treatment of diseases and clinical conditions associated with MBNL2.

Microfibrillar-associated protein 1 (MFAP1, Accession NP_005917.1) is another GAM7553 target gene, herein designated TARGET GENE. MFAP1 BINDING SITE is a target binding site found in the 3' untranslated region of mRNA encoded by MFAP1, corresponding to a target binding site such as BINDING SITE I, BINDING SITE II or BINDING SITE III of FIG. 8. Table 4 illustrates the complementarity of the nucleotide sequences of MFAP1 BINDING SITE, designated SEQ ID:18621, to the nucleotide sequence of GAM7553 RNA, herein designated GAM RNA, also designated SEQ ID:354.

Another function of GAM7553 is therefore inhibition of Microfibrillar-associated protein 1 (MFAP1, Accession NP_005917.1), a gene which are an important component of the extracellular matrix of many tissues. Accordingly, utilities of GAM7553 include diagnosis, prevention and treatment of diseases and clinical conditions associated with MFAP1.

The function of MFAP1 and its association with various diseases and clinical conditions, has been established by previous studies, as described hereinabove with reference to GAM572.1. MGC10233 (Accession NP_689928.1) is another GAM7553 target gene, herein designated TARGET GENE. MGC10233 BINDING SITE is a target binding site found in the 5' untranslated region of mRNA encoded by MGC10233, corresponding to a target binding site such as BINDING SITE I, BINDING SITE II or BINDING SITE III of FIG. 8. Table 4 illustrates the complementarity of the nucleotide sequences of MGC10233 BINDING SITE, designated SEQ ID:3443, to the nucleotide sequence of GAM7553 RNA, herein designated GAM RNA, also designated SEQ ID:354.

Another function of GAM7553 is therefore inhibition of MGC10233 (Accession NP_689928.1). Accordingly, utilities of GAM7553 include diagnosis, prevention and treatment of diseases and clinical conditions associated with MGC10233.

MGC11386 (Accession NP_116322.1) is another GAM7553 target gene, herein designated TARGET GENE. MGC11386 BINDING SITE1 through MGC11386 BIND- ING SITE3 are target binding sites found in untranslated regions of mRNA encoded by MGC11386, corresponding to target binding sites such as BINDING SITE I, BINDING SITE II or BINDING SITE III of FIG. 8. Table 4 illustrates the complementarity of the nucleotide sequences of MGC11386 BINDING SITE1 through MGC11386 BINDING SITE3, designated SEQ ID:5617, SEQ ID:11951 and SEQ ID:13670 respectively, to the nucleotide sequence of GAM7553 RNA, herein designated GAM RNA, also designated SEQ ID:354.

Another function of GAM7553 is therefore inhibition of MGC11386 (Accession NP_116322.1). Accordingly, utilities of GAM7553 include diagnosis, prevention and treatment of diseases and clinical conditions associated with MGC11386.

MGC13114 (Accession NP_115742.2) is another GAM7553 target gene, herein designated TARGET GENE. MGC13114 BINDING SITE is a target binding site found in the 3' untranslated region of mRNA encoded by MGC13114, corresponding to a target binding site such as BINDING SITE I, BINDING SITE II or BINDING SITE III of FIG. 8. Table 4 illustrates the complementarity of the nucleotide sequences of MGC13114 BINDING SITE, designated SEQ ID:11612, to the nucleotide sequence of GAM7553 RNA, herein designated GAM RNA, also designated SEQ ID:354.

Another function of GAM7553 is therefore inhibition of MGC13114 (Accession NP_115742.2). Accordingly, utilities of GAM7553 include diagnosis, prevention and treatment of diseases and clinical conditions associated with MGC13114.

MGC13251 (Accession NP_116103.1) is another GAM7553 target gene, herein designated TARGET GENE. MGC13251 BINDING SITE is a target binding site found in the 3' untranslated region of mRNA encoded by MGC13251, corresponding to a target binding site such as BINDING SITE I, BINDING SITE II or BINDING SITE III of FIG. 8. Table 4 illustrates the complementarity of the nucleotide sequences of MGC13251 BINDING SITE, designated SEQ ID:18632, to the nucleotide sequence of GAM7553 RNA, herein designated GAM RNA, also designated SEQ ID:354.

Another function of GAM7553 is therefore inhibition of MGC13251 (Accession NP_116103.1). Accordingly, utilities of GAM7553 include diagnosis, prevention and treatment of diseases and clinical conditions associated with MGC13251.

MGC16186 (Accession NP_115748.1) is another GAM7553 target gene, herein designated TARGET GENE. MGC16186 BINDING SITE is a target binding site found in the 5' untranslated region of mRNA encoded by MGC16186, corresponding to a target binding site such as BINDING SITE I, BINDING SITE II or BINDING SITE III of FIG. 8. Table 4 illustrates the complementarity of the nucleotide sequences of MGC16186 BINDING SITE, designated SEQ ID:10586, to the nucleotide sequence of GAM7553 RNA, herein designated GAM RNA, also designated SEQ ID:354.

Another function of GAM7553 is therefore inhibition of MGC16186 (Accession NP_115748.1). Accordingly, utilities of GAM7553 include diagnosis, prevention and treatment of diseases and clinical conditions associated with MGC16186.

MGC21854 (Accession NP_443094.2) is another GAM7553 target gene, herein designated TARGET GENE. MGC21854 BINDING SITE is a target binding site found in the 3' untranslated region of mRNA encoded by MGC21854, corresponding to a target binding site such as BINDING SITE I, BINDING SITE II or BINDING SITE III of FIG. 8. Table 4 illustrates the complementarity of the nucleotide sequences of MGC21854 BINDING SITE, designated SEQ ID:11923, to the nucleotide sequence of GAM7553 RNA, herein designated GAM RNA, also designated SEQ ID:354.

Another function of GAM7553 is therefore inhibition of MGC21854 (Accession NP_443094.2). Accordingly, utilities of GAM7553 include diagnosis, prevention and treatment of diseases and clinical conditions associated with MGC21854.

MGC26885 (Accession NP_689552.2) is another GAM7553 target gene, herein designated TARGET GENE. MGC26885 BINDING SITE is a target binding site found in the 3' untranslated region of mRNA encoded by MGC26885, corresponding to a target binding site such as BINDING SITE I, BINDING SITE II or BINDING SITE III of FIG. 8. Table 4 illustrates the complementarity of the nucleotide sequences of MGC26885 BINDING SITE, designated SEQ ID:11130, to the nucleotide sequence of GAM7553 RNA, herein designated GAM RNA, also designated SEQ ID:354.

Another function of GAM7553 is therefore inhibition of MGC26885 (Accession NP_689552.2). Accordingly, utilities of GAM7553 include diagnosis, prevention and treatment of diseases and clinical conditions associated with MGC26885.

MGC3020 (Accession NP_076953.2) is another GAM7553 target gene, herein designated TARGET GENE. MGC3020 BINDING SITE is a target binding site found in the 3' untranslated region of mRNA encoded by MGC3020, corresponding to a target binding site such as BINDING SITE I, BINDING SITE II or BINDING SITE III of FIG. 8. Table 4 illustrates the complementarity of the nucleotide sequences of MGC3020 BINDING SITE, designated SEQ ID:13408, to the nucleotide sequence of GAM7553 RNA, herein designated GAM RNA, also designated SEQ ID:354.

Another function of GAM7553 is therefore inhibition of MGC3020 (Accession NP_076953.2). Accordingly, utilities of GAM7553 include diagnosis, prevention and treatment of diseases and clinical conditions associated with MGC3020.

MGC3040 (Accession XP_039805.6) is another GAM7553 target gene, herein designated TARGET GENE. MGC3040 BINDING SITE is a target binding site found in the 3' untranslated region of mRNA encoded by MGC3040, corresponding to a target binding site such as BINDING SITE I, BINDING SITE II or BINDING SITE III of FIG. 8. Table 4 illustrates the complementarity of the nucleotide sequences of MGC3040 BINDING SITE, designated SEQ ID:11387, to the nucleotide sequence of GAM7553 RNA, herein designated GAM RNA, also designated SEQ ID:354.

Another function of GAM7553 is therefore inhibition of MGC3040 (Accession XP_039805.6). Accordingly, utilities of GAM7553 include diagnosis, prevention and treatment of diseases and clinical conditions associated with MGC3040.

MGC34761 (Accession NP_775890.1) is another GAM7553 target gene, herein designated TARGET GENE. MGC34761 BINDING SITE is a target binding site found in the 5' untranslated region of mRNA encoded by MGC34761, corresponding to a target binding site such as BINDING SITE I, BINDING SITE II or BINDING SITE III of FIG. 8. Table 4 illustrates the complementarity of the nucleotide sequences of MGC34761 BINDING SITE, designated SEQ ID:10760, to the nucleotide sequence of GAM7553 RNA, herein designated GAM RNA, also designated SEQ ID:354.

Another function of GAM7553 is therefore inhibition of MGC34761 (Accession NP_775890.1). Accordingly, utilities of GAM7553 include diagnosis, prevention and treatment of diseases and clinical conditions associated with MGC34761.

MGC35048 (Accession NP_694940.1) is another GAM7553 target gene, herein designated TARGET GENE.

MGC35048 BINDING SITE is a target binding site found in the 3' untranslated region of mRNA encoded by MGC35048, corresponding to a target binding site such as BINDING SITE I, BINDING SITE II or BINDING SITE III of FIG. 8. Table 4 illustrates the complementarity of the nucleotide sequences of MGC35048 BINDING SITE, designated SEQ ID:17290, to the nucleotide sequence of GAM7553 RNA, herein designated GAM RNA, also designated SEQ ID:354.

Another function of GAM7553 is therefore inhibition of MGC35048 (Accession NP_694940.1). Accordingly, utilities of GAM7553 include diagnosis, prevention and treatment of diseases and clinical conditions associated with MGC35048.

Nadh dehydrogenase 4l (MTND4L, Accession NP_776060.1) is another GAM7553 target gene, herein designated TARGET GENE. MTND4L BINDING SITE is a target binding site found in the 3' untranslated region of mRNA encoded by MTND4L, corresponding to a target binding site such as BINDING SITE I, BINDING SITE II or BINDING SITE III of FIG. 8. Table 4 illustrates the complementarity of the nucleotide sequences of MTND4L BINDING SITE, designated SEQ ID:1170, to the nucleotide sequence of GAM7553 RNA, herein designated GAM RNA, also designated SEQ ID:354.

Another function of GAM7553 is therefore inhibition of Nadh dehydrogenase 4l (MTND4L, Accession NP_776060.1). Accordingly, utilities of GAM7553 include diagnosis, prevention and treatment of diseases and clinical conditions associated with MTND4L.

Myeloma overexpressed gene (in a subset of t(11;14) positive multiple myelomas) (MYEOV, Accession NP_620123.1) is another GAM7553 target gene, herein designated TARGET GENE. MYEOV BINDING SITE is a target binding site found in the 3' untranslated region of mRNA encoded by MYEOV, corresponding to a target binding site such as BINDING SITE I, BINDING SITE II or BINDING SITE III of FIG. 8. Table 4 illustrates the complementarity of the nucleotide sequences of MYEOV BINDING SITE, designated SEQ ID:1311, to the nucleotide sequence of GAM7553 RNA, herein designated GAM RNA, also designated SEQ ID:354.

Another function of GAM7553 is therefore inhibition of Myeloma overexpressed gene (in a subset of t(11;14) positive multiple myelomas) (MYEOV, Accession NP_620123.1), a gene which is encoded by MYELOMA OVEREXPRESSED GENE. and therefore may be associated with Multiple myeloma. Accordingly, utilities of GAM7553 include diagnosis, prevention and treatment of Multiple myeloma, and of other diseases and clinical conditions associated with MYEOV.

The function of MYEOV and its association with various diseases and clinical conditions, has been established by previous studies, as described hereinabove with reference to GAM842.2. NPCR (Accession NP_660361.1) is another GAM7553 target gene, herein designated TARGET GENE. NPCR BINDING SITE is a target binding site found in the 5' untranslated region of mRNA encoded by NPCR, corresponding to a target binding site such as BINDING SITE I, BINDING SITE II or BINDING SITE III of FIG. 8. Table 4 illustrates the complementarity of the nucleotide sequences of NPCR BINDING SITE, designated SEQ ID:2329, to the nucleotide sequence of GAM7553 RNA, herein designated GAM RNA, also designated SEQ ID:354.

Another function of GAM7553 is therefore inhibition of NPCR (Accession NP_660361.1). Accordingly, utilities of GAM7553 include diagnosis, prevention and treatment of diseases and clinical conditions associated with NPCR.

OIP5 (Accession NP_009211.1) is another GAM7553 target gene, herein designated TARGET GENE. OIP5 BINDING SITE is a target binding site found in the 3' untranslated region of mRNA encoded by OIP5, corresponding to a target binding site such as BINDING SITE I, BINDING SITE II or BINDING SITE III of FIG. 8. Table 4 illustrates the complementarity of the nucleotide sequences of OIP5 BINDING SITE, designated SEQ ID:14429, to the nucleotide sequence of GAM7553 RNA, herein designated GAM RNA, also designated SEQ ID:354.

Another function of GAM7553 is therefore inhibition of OIP5 (Accession NP_009211.1). Accordingly, utilities of GAM7553 include diagnosis, prevention and treatment of diseases and clinical conditions associated with OIP5.

P5326 (Accession NP_113638.1) is another GAM7553 target gene, herein designated TARGET GENE. P5326 BINDING SITE is a target binding site found in the 3' untranslated region of mRNA encoded by P5326, corresponding to a target binding site such as BINDING SITE I, BINDING SITE II or BINDING SITE III of FIG. 8. Table 4 illustrates the complementarity of the nucleotide sequences of P5326 BINDING SITE, designated SEQ ID:5216, to the nucleotide sequence of GAM7553 RNA, herein designated GAM RNA, also designated SEQ ID:354.

Another function of GAM7553 is therefore inhibition of P5326 (Accession NP_113638.1). Accordingly, utilities of GAM7553 include diagnosis, prevention and treatment of diseases and clinical conditions associated with P5326.

Proprotein convertase subtilisin/kexin type 1 (PCSK1, Accession NP_000430.3) is another GAM7553 target gene, herein designated TARGET GENE. PCSK1 BINDING SITE is a target binding site found in the 3' untranslated region of mRNA encoded by PCSK1, corresponding to a target binding site such as BINDING SITE I, BINDING SITE II or BINDING SITE III of FIG. 8. Table 4 illustrates the complementarity of the nucleotide sequences of PCSK1 BINDING SITE, designated SEQ ID:5073, to the nucleotide sequence of GAM7553 RNA, herein designated GAM RNA, also designated SEQ ID:354.

Another function of GAM7553 is therefore inhibition of Proprotein convertase subtilisin/kexin type 1 (PCSK1, Accession NP_000430.3), a gene which processes hormone precursors by cleaving paired basic amino acids; serine protease of the subtilase family. and therefore may be associated with Obesity. Accordingly, utilities of GAM7553 include diagnosis, prevention and treatment of Obesity, and of other diseases and clinical conditions associated with PCSK1.

The function of PCSK1 and its association with various diseases and clinical conditions, has been established by previous studies, as described hereinabove with reference to GAM346.1. PH-4 (Accession NP_060202.2) is another GAM7553 target gene, herein designated TARGET GENE. PH-4 BINDING SITE is a target binding site found in the 3' untranslated region of multiple transcripts of mRNA encoded by PH-4, corresponding to a target binding site such as BINDING SITE I, BINDING SITE II or BINDING SITE III of FIG. 8. Table 4 illustrates the complementarity of the nucleotide sequences of PH-4 BINDING SITE, designated SEQ ID:6158, to the nucleotide sequence of GAM7553 RNA, herein designated GAM RNA, also designated SEQ ID:354.

Another function of GAM7553 is therefore inhibition of PH-4 (Accession NP_060202.2). Accordingly, utilities of GAM7553 include diagnosis, prevention and treatment of diseases and clinical conditions associated with PH-4.

Phosphatidylinositol 4-kinase, catalytic, beta polypeptide (PIK4CB, Accession NP_002642.1) is another GAM7553 target gene, herein designated TARGET GENE. PIK4CB BINDING SITE is a target binding site found in the 3' untranslated region of mRNA encoded by PIK4CB, corresponding to a target binding site such as BINDING SITE I, BINDING SITE II or BINDING SITE III of FIG. 8. Table 4 illustrates the complementarity of the nucleotide sequences of PIK4CB BINDING SITE, designated SEQ ID:19981, to the nucleotide sequence of GAM7553 RNA, herein designated GAM RNA, also designated SEQ ID:354.

Another function of GAM7553 is therefore inhibition of Phosphatidylinositol 4-kinase, catalytic, beta polypeptide (PIK4CB, Accession NP_002642.1), a gene which phosphorylates the 4-OH position of phosphatidyl inositol. Accordingly, utilities of GAM7553 include diagnosis, prevention and treatment of diseases and clinical conditions associated with PIK4CB.

The function of PIK4CB and its association with various diseases and clinical conditions, has been established by previous studies, as described hereinabove with reference to GAM139.1. Phospholipid scramblase 2 (PLSCR2, Accession NP_065092.1) is another GAM7553 target gene, herein designated TARGET GENE. PLSCR2 BINDING SITE is a target binding site found in the 5' untranslated region of mRNA encoded by PLSCR2, corresponding to a target binding site such as BINDING SITE I, BINDING SITE II or BINDING SITE III of FIG. 8. Table 4 illustrates the complementarity of the nucleotide sequences of PLSCR2 BINDING SITE, designated SEQ ID:12505, to the nucleotide sequence of GAM7553 RNA, herein designated GAM RNA, also designated SEQ ID:354.

Another function of GAM7553 is therefore inhibition of Phospholipid scramblase 2 (PLSCR2, Accession NP_065092.1). Accordingly, utilities of GAM7553 include diagnosis, prevention and treatment of diseases and clinical conditions associated with PLSCR2.

PRO2730 (Accession NP_079498.1) is another GAM7553 target gene, herein designated TARGET GENE. PRO2730 BINDING SITE is a target binding site found in the 3' untranslated region of mRNA encoded by PRO2730, corresponding to a target binding site such as BINDING SITE I, BINDING SITE II or BINDING SITE III of FIG. 8. Table 4 illustrates the complementarity of the nucleotide sequences of PRO2730 BINDING SITE, designated SEQ ID:10196, to the nucleotide sequence of GAM7553 RNA, herein designated GAM RNA, also designated SEQ ID:354.

Another function of GAM7553 is therefore inhibition of PRO2730 (Accession NP_079498.1). Accordingly, utilities of GAM7553 include diagnosis, prevention and treatment of diseases and clinical conditions associated with PRO2730.

Prp4 pre-mrna processing factor 4 homolog b (yeast) (PRPF4B, Accession NP_003904.2) is another GAM7553 target gene, herein designated TARGET GENE. PRPF4B BINDING SITE is a target binding site found in the 3' untranslated region of multiple transcripts of mRNA encoded by PRPF4B, corresponding to a target binding site such as BINDING SITE I, BINDING SITE II or BINDING SITE III of FIG. 8. Table 4 illustrates the complementarity of the nucleotide sequences of PRPF4B BINDING SITE, designated SEQ ID:7882, to the nucleotide sequence of GAM7553 RNA, herein designated GAM RNA, also designated SEQ ID:354.

Another function of GAM7553 is therefore inhibition of Prp4 pre-mrna processing factor 4 homolog b (yeast) (PRPF4B, Accession NP_003904.2). Accordingly, utilities of GAM7553 include diagnosis, prevention and treatment of diseases and clinical conditions associated with PRPF4B.

Regulator of g-protein signalling 18 (RGS18, Accession NP_570138.1) is another GAM7553 target gene, herein designated TARGET GENE. RGS18 BINDING SITE is a target binding site found in the 3' untranslated region of mRNA encoded by RGS18, corresponding to a target binding site such as BINDING SITE I, BINDING SITE II or BINDING SITE III of FIG. 8. Table 4 illustrates the complementarity of the nucleotide sequences of RGS18 BINDING SITE, designated SEQ ID:19908, to the nucleotide sequence of GAM7553 RNA, herein designated GAM RNA, also designated SEQ ID:354.

Another function of GAM7553 is therefore inhibition of Regulator of g-protein signalling 18 (RGS18, Accession NP_570138.1). Accordingly, utilities of GAM7553 include diagnosis, prevention and treatment of diseases and clinical conditions associated with RGS18.

RP4-622L5 (Accession NP_061991.2) is another GAM7553 target gene, herein designated TARGET GENE. RP4-622L5 BINDING SITE is a target binding site found in the 3' untranslated region of mRNA encoded by RP4-622L5, corresponding to a target binding site such as BINDING SITE I, BINDING SITE II or BINDING SITE III of FIG. 8. Table 4 illustrates the complementarity of the nucleotide sequences of RP4-622L5 BINDING SITE, designated SEQ ID:12523, to the nucleotide sequence of GAM7553 RNA, herein designated GAM RNA, also designated SEQ ID:354.

Another function of GAM7553 is therefore inhibition of RP4-622L5 (Accession NP_061991.2). Accordingly, utilities of GAM7553 include diagnosis, prevention and treatment of diseases and clinical conditions associated with RP4-622L5.

Splicing factor 3a, subunit 3, 60 kda (SF3A3, Accession NP_006793.1) is another GAM7553 target gene, herein designated TARGET GENE. SF3A3 BINDING SITE is a target binding site found in the 3' untranslated region of mRNA encoded by SF3A3, corresponding to a target binding site such as BINDING SITE I, BINDING SITE II or BINDING SITE III of FIG. 8. Table 4 illustrates the complementarity of the nucleotide sequences of SF3A3 BINDING SITE, designated SEQ ID:9859, to the nucleotide sequence of GAM7553 RNA, herein designated GAM RNA, also designated SEQ ID:354.

Another function of GAM7553 is therefore inhibition of Splicing factor 3a, subunit 3, 60 kda (SF3A3, Accession NP_006793.1). Accordingly, utilities of GAM7553 include diagnosis, prevention and treatment of diseases and clinical conditions associated with SF3A3.

Solute carrier family 21 (organic anion transporter), member 6 (SLC21A6, Accession NP_006437.2) is another GAM7553 target gene, herein designated TARGET GENE. SLC21A6 BINDING SITE is a target binding site found in the 5' untranslated region of mRNA encoded by SLC21A6, corresponding to a target binding site such as BINDING SITE I, BINDING SITE II or BINDING SITE III of FIG. 8. Table 4 illustrates the complementarity of the nucleotide sequences of SLC21A6 BINDING SITE, designated SEQ ID:10610, to the nucleotide sequence of GAM7553 RNA, herein designated GAM RNA, also designated SEQ ID:354.

Another function of GAM7553 is therefore inhibition of Solute carrier family 21 (organic anion transporter), member 6 (SLC21A6, Accession NP_006437.2). Accordingly, utilities of GAM7553 include diagnosis, prevention and treatment of diseases and clinical conditions associated with SLC21A6.

SLC35E2 (Accession XP_049733.6) is another GAM7553 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:617, to the nucleotide sequence of GAM7553 RNA, herein designated GAM RNA, also designated SEQ ID:354.

Another function of GAM7553 is therefore inhibition of SLC35E2 (Accession XP_049733.6). Accordingly, utilities of GAM7553 include diagnosis, prevention and treatment of diseases and clinical conditions associated with SLC35E2.

Signal transducing adaptor molecule (sh3 domain and itam motif) 1 (STAM, Accession NP_003464.1) is another GAM7553 target gene, herein designated TARGET GENE. STAM BINDING SITE is a target binding site found in the 3' untranslated region of mRNA encoded by STAM, corresponding to a target binding site such as BINDING SITE I, BINDING SITE II or BINDING SITE III of FIG. 8. Table 4 illustrates the complementarity of the nucleotide sequences of STAM BINDING SITE, designated SEQ ID:12483, to the nucleotide sequence of GAM7553 RNA, herein designated GAM RNA, also designated SEQ ID:354.

Another function of GAM7553 is therefore inhibition of Signal transducing adaptor molecule (sh3 domain and itam motif) 1 (STAM, Accession NP_003464.1), a gene which is as an adaptor molecule involved in the downstream signaling of cytokine receptors. Accordingly, utilities of GAM7553 include diagnosis, prevention and treatment of diseases and clinical conditions associated with STAM.

The function of STAM and its association with various diseases and clinical conditions, has been established by previous studies, as described hereinabove with reference to GAM106.2. Tumor-associated calcium signal transducer 2 (TACSTD2, Accession NP_002344.1) is another GAM7553 target gene, herein designated TARGET GENE. TACSTD2 BINDING SITE is a target binding site found in the 3' untranslated region of mRNA encoded by TACSTD2, corresponding to a target binding site such as BINDING SITE I, BINDING SITE II or BINDING SITE III of FIG. 8. Table 4 illustrates the complementarity of the nucleotide sequences of TACSTD2 BINDING SITE, designated SEQ ID:2226, to the nucleotide sequence of GAM7553 RNA, herein designated GAM RNA, also designated SEQ ID:354.

Another function of GAM7553 is therefore inhibition of Tumor-associated calcium signal transducer 2 (TACSTD2, Accession NP_002344.1), a gene which belongs to ga733 tumor-associated antigen gene family and may function as growth factor receptors. Accordingly, utilities of GAM7553 include diagnosis, prevention and treatment of diseases and clinical conditions associated with TACSTD2.

The function of TACSTD2 and its association with various diseases and clinical conditions, has been established by previous studies, as described hereinabove with reference to GAM952.1. Transcobalamin ii; macrocytic anemia (TCN2, Accession NP_000346.2) is another GAM7553 target gene, herein designated TARGET GENE. TCN2 BINDING SITE is a target binding site found in the 3' untranslated region of mRNA encoded by TCN2, corresponding to a target binding site such as BINDING SITE I, BINDING SITE II or BINDING SITE III of FIG. 8. Table 4 illustrates the complementarity of the nucleotide sequences of TCN2 BINDING SITE, designated SEQ ID:2859, to the nucleotide sequence of GAM7553 RNA, herein designated GAM RNA, also designated SEQ ID:354.

Another function of GAM7553 is therefore inhibition of Transcobalamin ii; macrocytic anemia (TCN2, Accession NP_000346.2). Accordingly, utilities of GAM7553 include diagnosis, prevention and treatment of diseases and clinical conditions associated with TCN2.

Teratocarcinoma-derived growth factor 1 (TDGF1, Accession NP_003203.1) is another GAM7553 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:2899, to the nucleotide sequence of GAM7553 RNA, herein designated GAM RNA, also designated SEQ ID:354.

Another function of GAM7553 is therefore inhibition of Teratocarcinoma-derived growth factor 1 (TDGF1, Accession NP_003203.1), a gene which can play a role in the determination of the epiblastic cells that subsequently give rise to the mesoderm. and therefore may be associated with Forebrain defects. Accordingly, utilities of GAM7553 include diagnosis, prevention and treatment of Forebrain defects, and of other diseases and clinical conditions associated with TDGF1.

The function of TDGF1 and its association with various diseases and clinical conditions, has been established by previous studies, as described hereinabove with reference to GAM30.1. Tudor domain containing 1 (TDRD1, Accession NP_112568.1) is another GAM7553 target gene, herein designated TARGET GENE. TDRD1 BINDING SITE is a target binding site found in the 5' untranslated region of mRNA encoded by TDRD1, corresponding to a target binding site such as BINDING SITE I, BINDING SITE II or BINDING SITE III of FIG. 8. Table 4 illustrates the complementarity of the nucleotide sequences of TDRD1 BINDING SITE, designated SEQ ID:18304, to the nucleotide sequence of GAM7553 RNA, herein designated GAM RNA, also designated SEQ ID:354.

Another function of GAM7553 is therefore inhibition of Tudor domain containing 1 (TDRD1, Accession NP_112568.1). Accordingly, utilities of GAM7553 include diagnosis, prevention and treatment of diseases and clinical conditions associated with TDRD1.

Tumor necrosis factor (ligand) superfamily, member 8 (TNFSF8, Accession NP_001235.1) is another GAM7553 target gene, herein designated TARGET GENE. TNFSF8 BINDING SITE is a target binding site found in the 3' untranslated region of mRNA encoded by TNFSF8, corresponding to a target binding site such as BINDING SITE I, BINDING SITE II or BINDING SITE III of FIG. 8. Table 4 illustrates the complementarity of the nucleotide sequences of TNFSF8 BINDING SITE, designated SEQ ID:2875, to the nucleotide sequence of GAM7553 RNA, herein designated GAM RNA, also designated SEQ ID:354.

Another function of GAM7553 is therefore inhibition of Tumor necrosis factor (ligand) superfamily, member 8 (TNFSF8, Accession NP_001235.1), a gene which cytokine that binds to tnfrsf8/cd30. induces proliferation of t cells. Accordingly, utilities of GAM7553 include diagnosis, prevention and treatment of diseases and clinical conditions associated with TNFSF8.

The function of TNFSF8 and its association with various diseases and clinical conditions, has been established by previous studies, as described hereinabove with reference to GAM487.1. Tnf receptor-associated factor 6 (TRAF6, Accession NP_665802.1) is another GAM7553 target gene, herein designated TARGET GENE. TRAF6 BINDING SITE is a target binding site found in the 3' untranslated region of multiple transcripts of mRNA encoded by TRAF6, corresponding to a target binding site such as BINDING SITE I, BINDING SITE II or BINDING SITE III of FIG. 8. Table 4 illustrates the complementarity of the nucleotide sequences of TRAF6 BINDING SITE, designated SEQ ID:13703, to the nucleotide sequence of GAM7553 RNA, herein designated GAM RNA, also designated SEQ ID:354.

Another function of GAM7553 is therefore inhibition of Tnf receptor-associated factor 6 (TRAF6, Accession NP_665802.1). Accordingly, utilities of GAM7553 include diagnosis, prevention and treatment of diseases and clinical conditions associated with TRAF6.

Tnf receptor-associated factor 6 (TRAF6, Accession NP_004611.1) is another GAM7553 target gene, herein designated TARGET GENE. TRAF6 BINDING SITE is a target binding site found in the 3' untranslated region of multiple transcripts of mRNA encoded by TRAF6, corresponding to a target binding site such as BINDING SITE I, BINDING SITE II or BINDING SITE III of FIG. 8. Table 4 illustrates the complementarity of the nucleotide sequences of TRAF6 BINDING SITE, designated SEQ ID:13703, to the nucleotide sequence of GAM7553 RNA, herein designated GAM RNA, also designated SEQ ID:354.

Another function of GAM7553 is therefore inhibition of Tnf receptor-associated factor 6 (TRAF6, Accession NP_004611.1). Accordingly, utilities of GAM7553 include diagnosis, prevention and treatment of diseases and clinical conditions associated with TRAF6.

Ubiquitination factor e4a (ufd2 homolog, yeast) (UBE4A, Accession NP_004779.1) is another GAM7553 target gene, herein designated TARGET GENE. UBE4A BINDING SITE is a target binding site found in the 3' untranslated region of mRNA encoded by UBE4A, corresponding to a target binding site such as BINDING SITE I, BINDING SITE II or BINDING SITE III of FIG. 8. Table 4 illustrates the complementarity of the nucleotide sequences of UBE4A BINDING SITE, designated SEQ ID:1390, to the nucleotide sequence of GAM7553 RNA, herein designated GAM RNA, also designated SEQ ID:354.

Another function of GAM7553 is therefore inhibition of Ubiquitination factor e4a (ufd2 homolog, yeast) (UBE4A, Accession NP_004779.1), a gene which binds to the ubiquitin moieties of preformed conjugates and catalyzes ubiquitin chain assembly in conjunction with E1, E2, and E3. Accordingly, utilities of GAM7553 include diagnosis, prevention and treatment of diseases and clinical conditions associated with UBE4A.

The function of UBE4A and its association with various diseases and clinical conditions, has been established by previous studies, as described hereinabove with reference to GAM139.2. X123 (Accession NP_004807.1) is another GAM7553 target gene, herein designated TARGET GENE. X123 BINDING SITE is a target binding site found in the 3' untranslated region of mRNA encoded by X123, corresponding to a target binding site such as BINDING SITE I, BINDING SITE II or BINDING SITE III of FIG. 8. Table 4 illustrates the complementarity of the nucleotide sequences of X123 BINDING SITE, designated SEQ ID:17404, to the nucleotide sequence of GAM7553 RNA, herein designated GAM RNA, also designated SEQ ID:354.

Another function of GAM7553 is therefore inhibition of X123 (Accession NP_004807.1). Accordingly, utilities of GAM7553 include diagnosis, prevention and treatment of diseases and clinical conditions associated with X123.

Zinc finger protein 24 (kox 17) (ZNF24, Accession NP_008896.1) is another GAM7553 target gene, herein designated TARGET GENE. ZNF24 BINDING SITE is a target binding site found in the 3' untranslated region of mRNA encoded by ZNF24, corresponding to a target binding site such as BINDING SITE I, BINDING SITE II or BINDING SITE III of FIG. 8. Table 4 illustrates the complementarity of the nucleotide sequences of ZNF24 BINDING SITE, designated SEQ ID:19115, to the nucleotide sequence of GAM7553 RNA, herein designated GAM RNA, also designated SEQ ID:354.

Another function of GAM7553 is therefore inhibition of Zinc finger protein 24 (kox 17) (ZNF24, Accession NP_008896.1). Accordingly, utilities of GAM7553 include diagnosis, prevention and treatment of diseases and clinical conditions associated with ZNF24.

FIG. 8 further provides a conceptual description of a novel bioinformatically detected of the present invention, referred to here as Genomic Address Messenger 7776 (GAM7776), which modulates expression of respective target genes thereof, the function and utility of which target genes is known in the art.

GAM7776 is a novel bioinformatically detected regulatory, non protein coding, micro RNA (miRNA) gene. The method by which GAM7776 was detected is described hereinabove with reference to FIGS. 8-15.

GAM7776 gene, herein designated GAM GENE, and GAM7776 target gene, herein designated TARGET GENE, are human genes contained in the human genome.

GAM7776 gene encodes a GAM7776 precursor RNA, herein designated GAM PRECURSOR RNA. Similar to other miRNA genes, and unlike most ordinary genes, GAM7776 precursor RNA does not encode a protein. A nucleotide sequence identical or highly similar to the nucleotide sequence of GAM7776 precursor RNA is designated SEQ ID:110, and is provided hereinbelow with reference to the sequence listing part.

GAM7776 precursor RNA folds onto itself, forming GAM7776 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM7776 precursor RNA folds onto itself, forming GAM7776 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM7776 precursor RNA, designated SEQ-ID:110, and a schematic representation of a predicted secondary folding of GAM7776 folded precursor RNA are further described with reference to Table 2, hereby incorporated by reference.

An enzyme complex designated DICER COMPLEX, 'dices' the GAM7776 folded precursor RNA into GAM7776 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM7776 RNA is designated SEQ ID:246, and is provided hereinbelow with references to the sequence listing part and Table 3, hereby incorporated by reference.

GAM7776 target gene, herein designated TARGET GENE, encodes a corresponding messenger RNA, GAM7776 target RNA, herein designated GAM TARGET RNA. GAM7776 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM7776 RNA, herein designated GAM RNA, binds complementarily to one or more target binding sites located in untranslated regions of GAM7776 target RNA, herein designated GAM TARGET RNA. This complementary binding is due to the fact that the nucleotide sequence of GAM7776 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM7776 RNA may have a different number of target binding sites in untranslated regions of a GAM7776 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM7776 RNA, herein designated GAM RNA, to target binding sites on GAM7776 target RNA, herein designated GAM TARGET RNA, such as BINDING SITE I, BINDING SITE II and BINDING SITE III, inhibits translation of GAM7776 target RNA into GAM7776 target protein, herein designated GAM TARGET PROTEIN. GAM target protein is therefore outlined by a broken line.

It is appreciated that GAM7776 target gene, herein designated TARGET GENE, in fact represents a plurality of GAM7776 target genes. The mRNA of each one of this plurality of GAM7776 target genes comprises one or more target binding sites, each having a nucleotide sequence which is at least partly complementary to GAM7776 RNA, herein designated GAM RNA, and which when bound by GAM7776 RNA causes inhibition of translation of respective one or more GAM7776 target proteins.

It is further appreciated by one skilled in the art that the mode of translational inhibition illustrated by FIG. 8 with specific reference to translational inhibition exerted by GAM7776 gene, herein designated GAM GENE, on one or more GAM7776 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM7776 correlate with, and may be deduced from, the identity of the target genes which GAM7776 binds and inhibits, and the function of these target genes, as elaborated hereinbelow.

15E1.2 (Accession XP_290596.1) is a GAM7776 target gene, herein designated TARGET GENE. 15E1.2 BINDING SITE is a target binding site found in the 3' untranslated region of mRNA encoded by 15E1.2, corresponding to a target binding site such as BINDING SITE I, BINDING SITE II or BINDING SITE III of FIG. 8. Table 4 illustrates the complementarity of the nucleotide sequences of 15E1.2 BINDING SITE, designated SEQ ID:12868, to the nucleotide sequence of GAM7776 RNA, herein designated GAM RNA, also designated SEQ ID:246.

A function of GAM7776 is therefore inhibition of 15E1.2 (Accession XP_290596.1). Accordingly, utilities of GAM7776 include diagnosis, prevention and treatment of diseases and clinical conditions associated with 15E1.2.

Alpha-1-b glycoprotein (A1BG, Accession NP_570602.2) is another GAM7776 target gene, herein designated TARGET GENE. A1BG BINDING SITE1 and A1BG BINDING SITE2 are target binding sites found in untranslated regions of mRNA encoded by A1BG, corresponding to target binding sites such as BINDING SITE I, BINDING SITE II or BINDING SITE III of FIG. 8. Table 4 illustrates the complementarity of the nucleotide sequences of A1BG BINDING SITE1 and A1BG BINDING SITE2, designated SEQ ID:18868 and SEQ ID:2534 respectively, to the nucleotide sequence of GAM7776 RNA, herein designated GAM RNA, also designated SEQ ID:246.

Another function of GAM7776 is therefore inhibition of Alpha-1-b glycoprotein (A1BG, Accession NP_570602.2), a gene which a plasma protein of unknown function. Accordingly, utilities of GAM7776 include diagnosis, prevention and treatment of diseases and clinical conditions associated with A1BG.

The function of A1BG and its association with various diseases and clinical conditions, has been established by previous studies, as described hereinabove with reference to GAM130.1. Aminoadipate-semialdehyde synthase (AASS, Accession NP_005754.2) is another GAM7776 target gene, herein designated TARGET GENE. AASS BINDING SITE is a target binding site found in the 3' untranslated region of mRNA encoded by AASS, corresponding to a target binding site such as BINDING SITE I, BINDING SITE II or BINDING SITE III of FIG. 8. Table 4 illustrates the complementarity of the nucleotide sequences of AASS BINDING SITE, designated SEQ ID:6339, to the nucleotide sequence of GAM7776 RNA, herein designated GAM RNA, also designated SEQ ID:246.

Another function of GAM7776 is therefore inhibition of Aminoadipate-semialdehyde synthase (AASS, Accession NP_005754.2). Accordingly, utilities of GAM7776 include diagnosis, prevention and treatment of diseases and clinical conditions associated with AASS.

ABCA13 (Accession NP_689914.2) is another GAM7776 target gene, herein designated TARGET GENE. ABCA13 BINDING SITE is a target binding site found in the 3' untranslated region of mRNA encoded by ABCA13, corresponding to a target binding site such as BINDING SITE I, BINDING SITE II or BINDING SITE III of FIG. 8. Table 4 illustrates the complementarity of the nucleotide sequences of ABCA13 BINDING SITE, designated SEQ ID:7385, to the nucleotide sequence of GAM7776 RNA, herein designated GAM RNA, also designated SEQ ID:246.

Another function of GAM7776 is therefore inhibition of ABCA13 (Accession NP_689914.2). Accordingly, utilities of GAM7776 include diagnosis, prevention and treatment of diseases and clinical conditions associated with ABCA13.

Atp-binding cassette, sub-family c (cftr/mrp), member 11 (ABCC11, Accession NP_149163.2) is another GAM7776 target gene, herein designated TARGET GENE. ABCC11 BINDING SITE is a target binding site found in the 5' untranslated region of multiple transcripts of mRNA encoded by ABCC11, corresponding to a target binding site such as BINDING SITE I, BINDING SITE II or BINDING SITE III of FIG. 8. Table 4 illustrates the complementarity of the nucleotide sequences of ABCC11 BINDING SITE, designated SEQ ID:7022, to the nucleotide sequence of GAM7776 RNA, herein designated GAM RNA, also designated SEQ ID:246.

Another function of GAM7776 is therefore inhibition of Atp-binding cassette, sub-family c (cftr/mrp), member 11 (ABCC11, Accession NP_149163.2), a gene which acts as a multispecific organic anion pump which can transport nucleotide analogs (by similarity). Accordingly, utilities of GAM7776 include diagnosis, prevention and treatment of diseases and clinical conditions associated with ABCC11.

The function of ABCC11 and its association with various diseases and clinical conditions, has been established by previous studies, as described hereinabove with reference to GAM189.1. Atp-binding cassette, sub-family d (ald), member 3 (ABCD3, Accession NP_002849.1) is another GAM7776 target gene, herein designated TARGET GENE. ABCD3 BINDING SITE is a target binding site found in the 3' untranslated region of mRNA encoded by ABCD3, corresponding to a target binding site such as BINDING SITE I, BINDING SITE II or BINDING SITE III of FIG. 8. Table 4 illustrates the complementarity of the nucleotide sequences of ABCD3 BINDING SITE, designated SEQ ID:14444, to the nucleotide sequence of GAM7776 RNA, herein designated GAM RNA, also designated SEQ ID:246.

Another function of GAM7776 is therefore inhibition of Atp-binding cassette, sub-family d (ald), member 3 (ABCD3, Accession NP_002849.1), a gene which a probable transporter. and therefore is associated with Zellweger syndrome-2 (zws-2). Accordingly, utilities of GAM7776 include diagnosis, prevention and treatment of Zellweger syndrome-2 (zws-2), and of other diseases and clinical conditions associated with ABCD3.

The function of ABCD3 and its association with various diseases and clinical conditions, has been established by previous studies, as described hereinabove with reference to GAM189.1. Acyl-coenzyme a dehydrogenase, short/branched chain (ACADSB, Accession NP_001600.1) is another GAM7776 target gene, herein designated TARGET GENE. ACADSB BINDING SITE is a target binding site found in the 3' untranslated region of mRNA encoded by ACADSB, corresponding to a target binding site such as BINDING SITE I, BINDING SITE II or BINDING SITE III of FIG. 8. Table 4 illustrates the complementarity of the nucleotide sequences of ACADSB BINDING SITE, designated SEQ ID:16689, to the nucleotide sequence of GAM7776 RNA, herein designated GAM RNA, also designated SEQ ID:246.

Another function of GAM7776 is therefore inhibition of Acyl-coenzyme a dehydrogenase, short/branched chain (ACADSB, Accession NP_001600.1). Accordingly, utilities of GAM7776 include diagnosis, prevention and treatment of diseases and clinical conditions associated with ACADSB.

Acid phosphatase 5, tartrate resistant (ACP5, Accession NP_001602.1) is another GAM7776 target gene, herein designated TARGET GENE. ACP5 BINDING SITE is a target binding site found in the 3' untranslated region of mRNA encoded by ACP5, corresponding to a target binding site such as BINDING SITE I, BINDING SITE II or BINDING SITE III of FIG. 8. Table 4 illustrates the complementarity of the nucleotide sequences of ACP5 BINDING SITE, designated SEQ ID:6638, to the nucleotide sequence of GAM7776 RNA, herein designated GAM RNA, also designated SEQ ID:246.

Another function of GAM7776 is therefore inhibition of Acid phosphatase 5, tartrate resistant (ACP5, Accession NP_001602.1). Accordingly, utilities of GAM7776 include diagnosis, prevention and treatment of diseases and clinical conditions associated with ACP5.

A disintegrin-like and metalloprotease (reprolysin type) with thrombospondin type 1 motif, 4 (ADAMTS4, Accession NP_005090.1) is another GAM7776 target gene, herein designated TARGET GENE. ADAMTS4 BINDING SITE1 and ADAMTS4 BINDING SITE2 are target binding sites found in untranslated regions of mRNA encoded by ADAMTS4, corresponding to target binding sites such as BINDING SITE I, BINDING SITE II or BINDING SITE III of FIG. 8. Table 4 illustrates the complementarity of the nucleotide sequences of ADAMTS4 BINDING SITE1 and ADAMTS4 BINDING SITE2, designated SEQ ID:1651 and SEQ ID:13757 respectively, to the nucleotide sequence of GAM7776 RNA, herein designated GAM RNA, also designated SEQ ID:246.

Another function of GAM7776 is therefore inhibition of A disintegrin-like and metalloprotease (reprolysin type) with thrombospondin type 1 motif, 4 (ADAMTS4, Accession NP_005090.1), a gene which cleaves aggrecan, a cartilage proteoglycan, and may be involved in its turnover. Accordingly, utilities of GAM7776 include diagnosis, prevention and treatment of diseases and clinical conditions associated with ADAMTS4.

The function of ADAMTS4 and its association with various diseases and clinical conditions, has been established by previous studies, as described hereinabove with reference to GAM189.1. Adenylate cyclase 6 (ADCY6, Accession NP_066193.1) is another GAM7776 target gene, herein designated TARGET GENE. ADCY6 BINDING SITE1 and ADCY6 BINDING SITE2 are target binding sites found in untranslated regions of multiple transcripts of mRNA encoded by ADCY6, corresponding to target binding sites such as BINDING SITE I, BINDING SITE II or BINDING SITE III of FIG. 8. Table 4 illustrates the complementarity of the nucleotide sequences of ADCY6 BINDING SITE1 and ADCY6 BINDING SITE2, designated SEQ ID:15161 and SEQ ID:15161 respectively, to the nucleotide sequence of GAM7776 RNA, herein designated GAM RNA, also designated SEQ ID:246.

Another function of GAM7776 is therefore inhibition of Adenylate cyclase 6 (ADCY6, Accession NP_066193.1), a gene which this a membrane-bound, ca(2+)-inhibitable adenylyl cyclase (by similarity). Accordingly, utilities of GAM7776 include diagnosis, prevention and treatment of diseases and clinical conditions associated with ADCY6.

The function of ADCY6 and its association with various diseases and clinical conditions, has been established by previous studies, as described hereinabove with reference to GAM67.2. Adenylate cyclase 6 (ADCY6, Accession NP_056085.1) is another GAM7776 target gene, herein designated TARGET GENE. ADCY6 BINDING SITE1 and ADCY6 BINDING SITE2 are target binding sites found in untranslated regions of multiple transcripts of mRNA encoded by ADCY6, corresponding to target binding sites such as BINDING SITE I, BINDING SITE II or BINDING SITE III of FIG. 8. Table 4 illustrates the complementarity of the nucleotide sequences of ADCY6 BINDING SITE1 and ADCY6 BINDING SITE2, designated SEQ ID:16688 and SEQ ID:19456 respectively, to the nucleotide sequence of GAM7776 RNA, herein designated GAM RNA, also designated SEQ ID:246.

Another function of GAM7776 is therefore inhibition of Adenylate cyclase 6 (ADCY6, Accession NP_056085.1), a gene which this a membrane-bound, ca(2+)-inhibitable adenylyl cyclase (by similarity). Accordingly, utilities of GAM7776 include diagnosis, prevention and treatment of diseases and clinical conditions associated with ADCY6.

The function of ADCY6 and its association with various diseases and clinical conditions, has been established by previous studies, as described hereinabove with reference to GAM67.2. Agmatine ureohydrolase (agmatinase) (AGMAT, Accession NP_079034.2) is another GAM7776 target gene, herein designated TARGET GENE. AGMAT BINDING SITE is a target binding site found in the 3' untranslated region of mRNA encoded by AGMAT, corresponding to a target binding site such as BINDING SITE I, BINDING SITE II or BINDING SITE III of FIG. 8. Table 4 illustrates the complementarity of the nucleotide sequences of AGMAT BINDING SITE, designated SEQ ID:9193, to the nucleotide sequence of GAM7776 RNA, herein designated GAM RNA, also designated SEQ ID:246.

Another function of GAM7776 is therefore inhibition of Agmatine ureohydrolase (agmatinase) (AGMAT, Accession NP_079034.2). Accordingly, utilities of GAM7776 include diagnosis, prevention and treatment of diseases and clinical conditions associated with AGMAT.

Aryl hydrocarbon receptor (AHR, Accession NP_001612.1) is another GAM7776 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:8217, to the nucleotide sequence of GAM7776 RNA, herein designated GAM RNA, also designated SEQ ID:246.

Another function of GAM7776 is therefore inhibition of Aryl hydrocarbon receptor (AHR, Accession NP_001612.1), a gene which plays a role in modulating carcinogenesis through the induction of xenobiotic-metabolizing enzymes and therefore may be associated with Stomach tumors. Accordingly, utilities of GAM7776 include diagnosis, prevention and treatment of Stomach tumors, and of other diseases and clinical conditions associated with AHR.

The function of AHR and its association with various diseases and clinical conditions, has been established by previous studies, as described hereinabove with reference to GAM30.1. Absent in melanoma 1 (AIM1, Accession XP_166300.1) is another GAM7776 target gene, herein designated TARGET GENE. AIM1 BINDING SITE is a target binding site found in the 3' untranslated region of mRNA encoded by AIM1, corresponding to a target binding site such as BINDING SITE I, BINDING SITE II or BINDING SITE III of FIG. 8. Table 4 illustrates the complementarity of the nucleotide sequences of AIM1 BINDING SITE, designated SEQ ID:16864, to the nucleotide sequence of GAM7776 RNA, herein designated GAM RNA, also designated SEQ ID:246.

Another function of GAM7776 is therefore inhibition of Absent in melanoma 1 (AIM1, Accession XP_166300.1), a gene which is altered in association with tumor suppression in a model of human melanoma and therefore may be associated with Malignant melanoma. Accordingly, utilities of GAM7776 include diagnosis, prevention and treatment of Malignant melanoma, and of other diseases and clinical conditions associated with AIM1.

The function of AIM1 and its association with various diseases and clinical conditions, has been established by previous studies, as described hereinabove with reference to GAM136.1. Aldo-keto reductase family 1, member d1 (delta 4-3-ketosteroid-5-beta-reductase) (AKR1D1, Accession NP_005980.1) is another GAM7776 target gene, herein designated TARGET GENE. AKR1D1 BINDING SITE is a target binding site found in the 3' untranslated region of mRNA encoded by AKR1D1, corresponding to a target binding site such as BINDING SITE I, BINDING SITE II or BINDING SITE III of FIG. 8. Table 4 illustrates the complementarity of the nucleotide sequences of AKR1D1 BINDING SITE, designated SEQ ID:8063, to the nucleotide sequence of GAM7776 RNA, herein designated GAM RNA, also designated SEQ ID:246.

Another function of GAM7776 is therefore inhibition of Aldo-keto reductase family 1, member d1 (delta 4-3-ketosteroid-5-beta-reductase) (AKR1D1, Accession NP_005980.1). Accordingly, utilities of GAM7776 include diagnosis, prevention and treatment of diseases and clinical conditions associated with AKR1D1.

Aldehyde dehydrogenase 1 family, member b1 (ALDH1B1, Accession NP_000683.3) is another GAM7776 target gene, herein designated TARGET GENE. ALDH1B1 BINDING SITE is a target binding site found in the 3' untranslated region of mRNA encoded by ALDH1B1, corresponding to a target binding site such as BINDING SITE I, BINDING SITE II or BINDING SITE III of FIG. 8. Table 4 illustrates the complementarity of the nucleotide sequences of ALDH1B1 BINDING SITE, designated SEQ ID:2153, to the nucleotide sequence of GAM7776 RNA, herein designated GAM RNA, also designated SEQ ID:246.

Another function of GAM7776 is therefore inhibition of Aldehyde dehydrogenase 1 family, member b1 (ALDH1B1, Accession NP_000683.3). Accordingly, utilities of GAM7776 include diagnosis, prevention and treatment of diseases and clinical conditions associated with ALDH1B1.

Arachidonate 15-lipoxygenase (ALOX15, Accession NP_001131.1) is another GAM7776 target gene, herein designated TARGET GENE. ALOX15 BINDING SITE is a target binding site found in the 3' untranslated region of mRNA encoded by ALOX15, corresponding to a target binding site such as BINDING SITE I, BINDING SITE II or BINDING SITE III of FIG. 8. Table 4 illustrates the complementarity of the nucleotide sequences of ALOX15 BINDING SITE, designated SEQ ID:19939, to the nucleotide sequence of GAM7776 RNA, herein designated GAM RNA, also designated SEQ ID:246.

Another function of GAM7776 is therefore inhibition of Arachidonate 15-lipoxygenase (ALOX15, Accession NP_001131.1), a gene which converts arachidonic acid to 15s-hydroperoxyeicosatetraenoic acid. Accordingly, utilities of GAM7776 include diagnosis, prevention and treatment of diseases and clinical conditions associated with ALOX15.

The function of ALOX15 and its association with various diseases and clinical conditions, has been established by previous studies, as described hereinabove with reference to GAM189.1. AMID (Accession NP_116186.1) is another GAM7776 target gene, herein designated TARGET GENE. AMID BINDING SITE is a target binding site found in the 3' untranslated region of mRNA encoded by AMID, corresponding to a target binding site such as BINDING SITE I, BINDING SITE II or BINDING SITE III of FIG. 8. Table 4 illustrates the complementarity of the nucleotide sequences of AMID BINDING SITE, designated SEQ ID:5895, to the nucleotide sequence of GAM7776 RNA, herein designated GAM RNA, also designated SEQ ID:246.

Another function of GAM7776 is therefore inhibition of AMID (Accession NP_116186.1). Accordingly, utilities of GAM7776 include diagnosis, prevention and treatment of diseases and clinical conditions associated with AMID.

Ankyrin repeat domain 6 (ANKRD6, Accession NP_055757.1) is another GAM7776 target gene, herein designated TARGET GENE. ANKRD6 BINDING SITE is a target binding site found in the 3' untranslated region of mRNA encoded by ANKRD6, corresponding to a target binding site such as BINDING SITE I, BINDING SITE II or BINDING SITE III of FIG. 8. Table 4 illustrates the complementarity of the nucleotide sequences of ANKRD6 BINDING SITE, designated SEQ ID:1746, to the nucleotide sequence of GAM7776 RNA, herein designated GAM RNA, also designated SEQ ID:246.

Another function of GAM7776 is therefore inhibition of Ankyrin repeat domain 6 (ANKRD6, Accession NP_055757.1). Accordingly, utilities of GAM7776 include diagnosis, prevention and treatment of diseases and clinical conditions associated with ANKRD6.

Adaptor-related protein complex 3, sigma 2 subunit (AP3S2, Accession NP_005820.1) is another GAM7776 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:19874, to the nucleotide sequence of GAM7776 RNA, herein designated GAM RNA, also designated SEQ ID:246.

Another function of GAM7776 is therefore inhibition of Adaptor-related protein complex 3, sigma 2 subunit (AP3S2, Accession NP_005820.1). Accordingly, utilities of GAM7776 include diagnosis, prevention and treatment of diseases and clinical conditions associated with AP3S2.

Apoptotic protease activating factor (APAF1, Accession NP_037361.1) is another GAM7776 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:19360 and SEQ ID:16578 respectively, to the nucleotide sequence of GAM7776 RNA, herein designated GAM RNA, also designated SEQ ID:246.

Another function of GAM7776 is therefore inhibition of Apoptotic protease activating factor (APAF1, Accession NP_037361.1), a gene which functions in the mitochondrial apoptotic pathway that leads to caspase 9 dependent activation of caspase 3 and therefore may be associated with Cancer. Accordingly, utilities of GAM7776 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apoptotic protease activating factor (APAF1, Accession NP_001151.1) is another GAM7776 target gene, herein designated TARGET GENE. APAF1 BINDING SITE1 and APAF1 BINDING SITE2 are target binding sites found in untranslated regions of multiple transcripts of mRNA encoded by APAF1, corresponding to target binding sites such as BINDING SITE I, BINDING SITE II or BINDING SITE III of FIG. 8. Table 4 illustrates the complementarity of the nucleotide sequences of APAF1 BINDING SITE1 and APAF1 BINDING SITE2, designated SEQ ID:16578 and SEQ ID:19360 respectively, to the nucleotide sequence of GAM7776 RNA, herein designated GAM RNA, also designated SEQ ID:246.

Another function of GAM7776 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM7776 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. APM1 (Accession NP_004788.1) is another GAM7776 target gene, herein designated TARGET GENE. APM1 BINDING SITE1 and APM1 BINDING SITE2 are target binding sites found in untranslated regions of mRNA encoded by APM1, corresponding to target binding sites such as BINDING SITE I, BINDING SITE II or BINDING SITE III of FIG. 8. Table 4 illustrates the complementarity of the nucleotide sequences of APM1 BINDING SITE1 and APM1 BINDING SITE2, designated SEQ ID:5598 and SEQ ID:20035 respectively, to the nucleotide sequence of GAM7776 RNA, herein designated GAM RNA, also designated SEQ ID:246.

Another function of GAM7776 is therefore inhibition of APM1 (Accession NP_004788.1). Accordingly, utilities of GAM7776 include diagnosis, prevention and treatment of diseases and clinical conditions associated with APM1.

Apolipoprotein b mrna editing enzyme, catalytic polypeptide-like 3f (APOBEC3F, Accession NP_660341.2) is another GAM7776 target gene, herein designated TARGET GENE. APOBEC3F BINDING SITE is a target binding site found in the 3' untranslated region of mRNA encoded by APOBEC3F, corresponding to a target binding site such as BINDING SITE I, BINDING SITE II or BINDING SITE III of FIG. 8. Table 4 illustrates the complementarity of the nucleotide sequences of APOBEC3F BINDING SITE, designated SEQ ID:5622, to the nucleotide sequence of GAM7776 RNA, herein designated GAM RNA, also designated SEQ ID:246.

Another function of GAM7776 is therefore inhibition of Apolipoprotein b mrna editing enzyme, catalytic polypeptide-like 3f (APOBEC3F, Accession NP_660341.2). Accordingly, utilities of GAM7776 include diagnosis, prevention and treatment of diseases and clinical conditions associated with APOBEC3F.

Apolipoprotein l, 1 (APOL1, Accession NP_663318.1) is another GAM7776 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:9574, to the nucleotide sequence of GAM7776 RNA, herein designated GAM RNA, also designated SEQ ID:246.

Another function of GAM7776 is therefore inhibition of Apolipoprotein l, 1 (APOL1, Accession NP_663318.1), a gene which may participate in reverse cholesterol transport from peripheral cells to the liver. and therefore may be associated with Schizophrenia. Accordingly, utilities of GAM7776 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Apolipoprotein 1, 1 (APOL1, Accession NP_003652.2) is another GAM7776 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:9574, to the nucleotide sequence of GAM7776 RNA, herein designated GAM RNA, also designated SEQ ID:246.

Another function of GAM7776 is therefore inhibition of Apolipoprotein 1, 1 (APOL1, Accession NP_003652.2), a gene which may participate in reverse cholesterol transport from peripheral cells to the liver. and therefore may be associated with Schizophrenia. Accordingly, utilities of GAM7776 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Apolipoprotein 1, 2 (APOL2, Accession NP_663612.1) is another GAM7776 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:8064, to the nucleotide sequence of GAM7776 RNA, herein designated GAM RNA, also designated SEQ ID:246.

Another function of GAM7776 is therefore inhibition of Apolipoprotein 1, 2 (APOL2, Accession NP_663612.1). Accordingly, utilities of GAM7776 include diagnosis, prevention and treatment of diseases and clinical conditions associated with APOL2.

Apolipoprotein 1, 2 (APOL2, Accession NP_112092.1) is another GAM7776 target gene, herein designated TARGET GENE. APOL2 BINDING SITE is a target binding site found in the 3' untranslated region of multiple transcripts of mRNA encoded by APOL2, corresponding to a target binding site such as BINDING SITE I, BINDING SITE II or BINDING SITE III of FIG. 8. Table 4 illustrates the complementarity of the nucleotide sequences of APOL2 BINDING SITE, designated SEQ ID:8064, to the nucleotide sequence of GAM7776 RNA, herein designated GAM RNA, also designated SEQ ID:246.

Another function of GAM7776 is therefore inhibition of Apolipoprotein 1, 2 (APOL2, Accession NP_112092.1). Accordingly, utilities of GAM7776 include diagnosis, prevention and treatment of diseases and clinical conditions associated with APOL2.

Amyloid beta precursor protein (cytoplasmic tail) binding protein 2 (APPBP2, Accession NP_006371.2) is another GAM7776 target gene, herein designated TARGET GENE. APPBP2 BINDING SITE is a target binding site found in the 3' untranslated region of mRNA encoded by APPBP2, corresponding to a target binding site such as BINDING SITE I, BINDING SITE II or BINDING SITE III of FIG. 8. Table 4 illustrates the complementarity of the nucleotide sequences of APPBP2 BINDING SITE, designated SEQ ID:4095, to the nucleotide sequence of GAM7776 RNA, herein designated GAM RNA, also designated SEQ ID:246.

Another function of GAM7776 is therefore inhibition of Amyloid beta precursor protein (cytoplasmic tail) binding protein 2 (APPBP2, Accession NP_006371.2), a gene which interacts with the basolateral sorting signal of amyloid precursor protein. and therefore may be associated with Alzheimer's disease. Accordingly, utilities of GAM7776 include diagnosis, prevention and treatment of Alzheimer's disease, and of other diseases and clinical conditions associated with APPBP2.

The function of APPBP2 and its association with various diseases and clinical conditions, has been established by previous studies, as described hereinabove with reference to GAM130.1. APPL (Accession NP_036228.1) is another GAM7776 target gene, herein designated TARGET GENE. APPL BINDING SITE is a target binding site found in the 3' untranslated region of mRNA encoded by APPL, corresponding to a target binding site such as BINDING SITE I, BINDING SITE II or BINDING SITE III of FIG. 8. Table 4 illustrates the complementarity of the nucleotide sequences of APPL BINDING SITE, designated SEQ ID:12068, to the nucleotide sequence of GAM7776 RNA, herein designated GAM RNA, also designated SEQ ID:246.

Another function of GAM7776 is therefore inhibition of APPL (Accession NP_036228.1). Accordingly, utilities of GAM7776 include diagnosis, prevention and treatment of diseases and clinical conditions associated with APPL.

Aquaporin 2 (collecting duct) (AQP2, Accession NP_000477.1) is another GAM7776 target gene, herein designated TARGET GENE. AQP2 BINDING SITE is a target binding site found in the 3' untranslated region of mRNA encoded by AQP2, corresponding to a target binding site such as BINDING SITE I, BINDING SITE II or BINDING SITE III of FIG. 8. Table 4 illustrates the complementarity of the nucleotide sequences of AQP2 BINDING SITE, designated SEQ ID:18318, to the nucleotide sequence of GAM7776 RNA, herein designated GAM RNA, also designated SEQ ID:246.

Another function of GAM7776 is therefore inhibition of Aquaporin 2 (collecting duct) (AQP2, Accession NP_000477.1). Accordingly, utilities of GAM7776 include diagnosis, prevention and treatment of diseases and clinical conditions associated with AQP2.

Aquaporin 6, kidney specific (AQP6, Accession NP_445738.1) is another GAM7776 target gene, herein designated TARGET GENE. AQP6 BINDING SITE1 through AQP6 BINDING SITE3 are target binding sites found in untranslated regions of multiple transcripts of mRNA encoded by AQP6, corresponding to target binding sites such as BINDING SITE I, BINDING SITE II or BINDING SITE III of FIG. 8. Table 4 illustrates the complementarity of the nucleotide sequences of AQP6 BINDING SITE1 through AQP6 BINDING SITE3, designated SEQ ID:3169, SEQ ID:3169 and SEQ ID:7869 respectively, to the nucleotide sequence of GAM7776 RNA, herein designated GAM RNA, also designated SEQ ID:246.

Another function of GAM7776 is therefore inhibition of Aquaporin 6, kidney specific (AQP6, Accession NP_445738.1), a gene which participates in distinct physiologic function such as glomerular filtration, tubular endocytosis, and acid-base-metabolism. Accordingly, utilities of GAM7776 include diagnosis, prevention and treatment of diseases and clinical conditions associated with AQP6.

The function of AQP6 and its association with various diseases and clinical conditions, has been established by previous studies, as described hereinabove with reference to GAM51.1. Aquaporin 6, kidney specific (AQP6, Accession NP_001643.1) is another GAM7776 target gene, herein designated TARGET GENE. AQP6 BINDING SITE1 through AQP6 BINDING SITE3 are target binding sites found in untranslated regions of multiple transcripts of mRNA encoded by AQP6, corresponding to target binding sites such as BINDING SITE I, BINDING SITE II or BINDING SITE III of FIG. 8. Table 4 illustrates the complementarity of the nucleotide sequences of AQP6 BINDING SITE1 through AQP6 BINDING SITE3, designated SEQ ID:8069, SEQ ID:13747 and SEQ ID:6901 respectively, to the nucleotide sequence of GAM7776 RNA, herein designated GAM RNA, also designated SEQ ID:246.

Another function of GAM7776 is therefore inhibition of Aquaporin 6, kidney specific (AQP6, Accession NP_001643.1), a gene which participates in distinct physiologic function such as glomerular filtration, tubular endocytosis, and acid-base-metabolism. Accordingly, utilities of GAM7776 include diagnosis, prevention and treatment of diseases and clinical conditions associated with AQP6.

The function of AQP6 and its association with various diseases and clinical conditions, has been established by previous studies, as described hereinabove with reference to GAM51.1. Rho gtpase activating protein 1 (ARHGAP1, Accession NP_004299.1) is another GAM7776 target gene, herein designated TARGET GENE. ARHGAP1 BINDING SITE is a target binding site found in the 3' untranslated region of mRNA encoded by ARHGAP1, corresponding to a target binding site such as BINDING SITE I, BINDING SITE II or BINDING SITE III of FIG. 8. Table 4 illustrates the complementarity of the nucleotide sequences of ARHGAP1 BINDING SITE, designated SEQ ID:4096, to the nucleotide sequence of GAM7776 RNA, herein designated GAM RNA, also designated SEQ ID:246.

Another function of GAM7776 is therefore inhibition of Rho gtpase activating protein 1 (ARHGAP1, Accession NP_004299.1). Accordingly, utilities of GAM7776 include diagnosis, prevention and treatment of diseases and clinical conditions associated with ARHGAP1.

ARHGAP11A (Accession NP_055598.1) is another GAM7776 target gene, herein designated TARGET GENE. ARHGAP11A BINDING SITE is a target binding site found in the 3' untranslated region of mRNA encoded by ARHGAP11A, corresponding to a target binding site such as BINDING SITE I, BINDING SITE II or BINDING SITE III of FIG. 8. Table 4 illustrates the complementarity of the nucleotide sequences of ARHGAP11A BINDING SITE, designated SEQ ID:17742, to the nucleotide sequence of GAM7776 RNA, herein designated GAM RNA, also designated SEQ ID:246.

Another function of GAM7776 is therefore inhibition of ARHGAP11A (Accession NP_055598.1). Accordingly, utilities of GAM7776 include diagnosis, prevention and treatment of diseases and clinical conditions associated with ARHGAP11A.

ARK5 (Accession NP_055655.1) is another GAM7776 target gene, herein designated TARGET GENE. ARK5 BINDING SITE is a target binding site found in the 3' untranslated region of mRNA encoded by ARK5, corresponding to a target binding site such as BINDING SITE I, BINDING SITE II or BINDING SITE III of FIG. 8. Table 4 illustrates the complementarity of the nucleotide sequences of ARK5 BINDING SITE, designated SEQ ID:17859, to the nucleotide sequence of GAM7776 RNA, herein designated GAM RNA, also designated SEQ ID:246.

Another function of GAM7776 is therefore inhibition of ARK5 (Accession NP_055655.1). Accordingly, utilities of GAM7776 include diagnosis, prevention and treatment of diseases and clinical conditions associated with ARK5.

ARPP-19 (Accession NP_006619.1) is another GAM7776 target gene, herein designated TARGET GENE. ARPP-19 BINDING SITE is a target binding site found in the 3' untranslated region of mRNA encoded by ARPP-19, corresponding to a target binding site such as BINDING SITE I, BINDING SITE II or BINDING SITE III of FIG. 8. Table 4 illustrates the complementarity of the nucleotide sequences of ARPP-19 BINDING SITE, designated SEQ ID:944, to the nucleotide sequence of GAM7776 RNA, herein designated GAM RNA, also designated SEQ ID:246.

Another function of GAM7776 is therefore inhibition of ARPP-19 (Accession NP_006619.1). Accordingly, utilities of GAM7776 include diagnosis, prevention and treatment of diseases and clinical conditions associated with ARPP-19.

Ankyrin repeat and socs box-containing 16 (ASB16, Accession NP_543139.4) is another GAM7776 target gene, herein designated TARGET GENE. ASB16 BINDING SITE is a target binding site found in the 3' untranslated region of mRNA encoded by ASB16, corresponding to a target binding site such as BINDING SITE I, BINDING SITE II or BINDING SITE III of FIG. 8. Table 4 illustrates the complementarity of the nucleotide sequences of ASB16 BINDING SITE, designated SEQ ID:14722, to the nucleotide sequence of GAM7776 RNA, herein designated GAM RNA, also designated SEQ ID:246.

Another function of GAM7776 is therefore inhibition of Ankyrin repeat and socs box-containing 16 (ASB16, Accession NP_543139.4) . Accordingly, utilities of GAM7776 include diagnosis, prevention and treatment of diseases and clinical conditions associated with ASB16.

Ankyrin repeat and socs box-containing 6 (ASB6, Accession NP_060343.1) is another GAM7776 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:2196 and SEQ ID:10305 respectively, to the nucleotide sequence of GAM7776 RNA, herein designated GAM RNA, also designated SEQ ID:246.

Another function of GAM7776 is therefore inhibition of Ankyrin repeat and socs box-containing 6 (ASB6, Accession NP_060343.1). Accordingly, utilities of GAM7776 include diagnosis, prevention and treatment of diseases and clinical conditions associated with ASB6.

Ankyrin repeat and socs box-containing 6 (ASB6, Accession NP_060343.1) is another GAM7776 target gene, herein designated TARGET GENE. ASB6 BINDING SITE1 and ASB6 BINDING SITE2 are target binding sites found in untranslated regions of multiple transcripts of mRNA encoded by ASB6, corresponding to target binding sites such as BINDING SITE I, BINDING SITE II or BINDING SITE III of FIG. 8. Table 4 illustrates the complementarity of the nucleotide sequences of ASB6 BINDING SITE1 and ASB6 BINDING SITE2, designated SEQ ID:10305 and SEQ ID:2196 respectively, to the nucleotide sequence of GAM7776 RNA, herein designated GAM RNA, also designated SEQ ID:246.

Another function of GAM7776 is therefore inhibition of Ankyrin repeat and socs box-containing 6 (ASB6, Accession NP_060343.1). Accordingly, utilities of GAM7776 include diagnosis, prevention and treatment of diseases and clinical conditions associated with ASB6.

ASE-1 (Accession NP_036231.1) is another GAM7776 target gene, herein designated TARGET GENE. ASE-1 BINDING SITE1 and ASE-1 BINDING SITE2 are target binding sites found in untranslated regions of mRNA encoded by ASE-1, corresponding to target binding sites such as BINDING SITE I, BINDING SITE II or BINDING SITE III of FIG. 8. Table 4 illustrates the complementarity of the nucleotide sequences of ASE-1 BINDING SITE1 and ASE-1 BINDING SITE2, designated SEQ ID:3101 and SEQ ID:1741 respectively, to the nucleotide sequence of GAM7776 RNA, herein designated GAM RNA, also designated SEQ ID:246.

Another function of GAM7776 is therefore inhibition of ASE-1 (Accession NP_036231.1). Accordingly, utilities of GAM7776 include diagnosis, prevention and treatment of diseases and clinical conditions associated with ASE-1.

ATF7IP2 (Accession NP_079273.1) is another GAM7776 target gene, herein designated TARGET GENE. ATF7IP2 BINDING SITE is a target binding site found in the 3' untranslated region of mRNA encoded by ATF7IP2, corresponding to a target binding site such as BINDING SITE I, BINDING SITE II or BINDING SITE III of FIG. 8. Table 4 illustrates the complementarity of the nucleotide sequences of ATF7IP2 BINDING SITE, designated SEQ ID:9602, to the nucleotide sequence of GAM7776 RNA, herein designated GAM RNA, also designated SEQ ID:246.

Another function of GAM7776 is therefore inhibition of ATF7IP2 (Accession NP_079273.1). Accordingly, utilities of GAM7776 include diagnosis, prevention and treatment of diseases and clinical conditions associated with ATF7IP2.

Ataxia telangiectasia mutated (includes complementation groups a, c and d) (ATM, Accession NP_612150.1) is another GAM7776 target gene, herein designated TARGET GENE. ATM BINDING SITE is a target binding site found in the 3' untranslated region of multiple transcripts of mRNA encoded by ATM, corresponding to a target binding site such as BINDING SITE I, BINDING SITE II or BINDING SITE III of FIG. 8. Table 4 illustrates the complementarity of the nucleotide sequences of ATM BINDING SITE, designated SEQ ID:1837, to the nucleotide sequence of GAM7776 RNA, herein designated GAM RNA, also designated SEQ ID:246.

Another function of GAM7776 is therefore inhibition of Ataxia telangiectasia mutated (includes complementation groups a, c and d) (ATM, Accession NP_612150.1). Accordingly, utilities of GAM7776 include diagnosis, prevention and treatment of diseases and clinical conditions associated with ATM.

Atpase, na+/k+ transporting, beta 2 polypeptide (ATP1B2, Accession NP_001669.1) is another GAM7776 target gene, herein designated TARGET GENE. ATP1B2 BINDING SITE is a target binding site found in the 3' untranslated region of mRNA encoded by ATP1B2, corresponding to a target binding site such as BINDING SITE I, BINDING SITE II or BINDING SITE III of FIG. 8. Table 4 illustrates the complementarity of the nucleotide sequences of ATP1B2 BINDING SITE, designated SEQ ID:16916, to the nucleotide sequence of GAM7776 RNA, herein designated GAM RNA, also designated SEQ ID:246.

Another function of GAM7776 is therefore inhibition of Atpase, na+/k+ transporting, beta 2 polypeptide (ATP1B2, Accession NP_001669.1), a gene which catalyzes the hydrolysis of ATP coupled with the exchange of Na+/K+ ions across the plasma membrane. Accordingly, utilities of GAM7776 include diagnosis, prevention and treatment of diseases and clinical conditions associated with ATP1B2.

The function of ATP1B2 and its association with various diseases and clinical conditions, has been established by previous studies, as described hereinabove with reference to GAM130.1. Atpase, (na+)/k+ transporting, beta 4 polypeptide (ATP1B4, Accession NP_036201.1) is another GAM7776 target gene, herein designated TARGET GENE. ATP1B4 BINDING SITE is a target binding site found in the 3' untranslated region of mRNA encoded by ATP1B4, corresponding to a target binding site such as BINDING SITE I, BINDING SITE II or BINDING SITE III of FIG. 8. Table 4 illustrates the complementarity of the nucleotide sequences of ATP1B4 BINDING SITE, designated SEQ ID:13042, to the nucleotide sequence of GAM7776 RNA, herein designated GAM RNA, also designated SEQ ID:246.

Another function of GAM7776 is therefore inhibition of Atpase, (na+)/k+ transporting, beta 4 polypeptide (ATP1B4, Accession NP_036201.1). Accordingly, utilities of GAM7776 include diagnosis, prevention and treatment of diseases and clinical conditions associated with ATP1B4.

Atpase, h+ transporting, lysosomal 38 kda, v0 subunit d isoform 2 (ATP6V0D2, Accession NP_689778.1) is another GAM7776 target gene, herein designated TARGET GENE. ATP6V0D2 BINDING SITE is a target binding site found in the 3' untranslated region of mRNA encoded by ATP6V0D2, corresponding to a target binding site such as BINDING SITE I, BINDING SITE II or BINDING SITE III of FIG. 8. Table 4 illustrates the complementarity of the nucleotide sequences of ATP6V0D2 BINDING SITE, designated SEQ ID:15039, to the nucleotide sequence of GAM7776 RNA, herein designated GAM RNA, also designated SEQ ID:246.

Another function of GAM7776 is therefore inhibition of Atpase, h+ transporting, lysosomal 38 kda, v0 subunit d isoform 2 (ATP6V0D2, Accession NP_689778.1). Accordingly, utilities of GAM7776 include diagnosis, prevention and treatment of diseases and clinical conditions associated with ATP6V0D2.

ATP6V1A (Accession NP_001681.2) is another GAM7776 target gene, herein designated TARGET GENE. ATP6V1A BINDING SITE is a target binding site found in the 3' untranslated region of mRNA encoded by ATP6V1A, corresponding to a target binding site such as BINDING SITE I, BINDING SITE II or BINDING SITE III of FIG. 8. Table 4 illustrates the complementarity of the nucleotide sequences of ATP6V1A BINDING SITE, designated SEQ ID:18868, to the nucleotide sequence of GAM7776 RNA, herein designated GAM RNA, also designated SEQ ID:246.

Another function of GAM7776 is therefore inhibition of ATP6V1A (Accession NP_001681.2). Accordingly, utilities of GAM7776 include diagnosis, prevention and treatment of diseases and clinical conditions associated with ATP6V1A.

Atpase, cu++ transporting, alpha polypeptide (menkes syndrome) (ATP7A, Accession NP_000043.1) is another GAM7776 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:4112, to the nucleotide sequence of GAM7776 RNA, herein designated GAM RNA, also designated SEQ ID:246.

Another function of GAM7776 is therefore inhibition of Atpase, cu++ transporting, alpha polypeptide (menkes syndrome) (ATP7A, Accession NP_000043.1). Accordingly, utilities of GAM7776 include diagnosis, prevention and treatment of diseases and clinical conditions associated with ATP7A.

Atpase, class i, type 8b, member 2 (ATP8B2, Accession XP_290875.1) is another GAM7776 target gene, herein designated TARGET GENE. ATP8B2 BINDING SITE is a target binding site found in the 3' untranslated region of mRNA encoded by ATP8B2, corresponding to a target binding site such as BINDING SITE I, BINDING SITE II or BINDING SITE III of FIG. 8. Table 4 illustrates the complementarity of the nucleotide sequences of ATP8B2 BINDING SITE, designated SEQ ID:8634, to the nucleotide sequence of GAM7776 RNA, herein designated GAM RNA, also designated SEQ ID:246.

Another function of GAM7776 is therefore inhibition of Atpase, class i, type 8b, member 2 (ATP8B2, Accession XP_290875.1). Accordingly, utilities of GAM7776 include diagnosis, prevention and treatment of diseases and clinical conditions associated with ATP8B2.

Axl receptor tyrosine kinase (AXL, Accession NP_001690.2) is another GAM7776 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:11802, to the nucleotide sequence of GAM7776 RNA, herein designated GAM RNA, also designated SEQ ID:246.

Another function of GAM7776 is therefore inhibition of Axl receptor tyrosine kinase (AXL, Accession NP_001690.2). Accordingly, utilities of GAM7776 include diagnosis, prevention and treatment of diseases and clinical conditions associated with AXL.

Axl receptor tyrosine kinase (AXL, Accession NP_068713.2) is another GAM7776 target gene, herein designated TARGET GENE. AXL BINDING SITE is a target binding site found in the 3' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:11802, to the nucleotide sequence of GAM7776 RNA, herein designated GAM RNA, also designated SEQ ID:246.

Another function of GAM7776 is therefore inhibition of Axl receptor tyrosine kinase (AXL, Accession NP_068713.2). Accordingly, utilities of GAM7776 include diagnosis, prevention and treatment of diseases and clinical conditions associated with AXL.

Udp-gal:betaglcnac beta 1,4-galactosyltransferase, polypeptide 4 (B4GALT4, Accession NP_003769.1) is another GAM7776 target gene, herein designated TARGET GENE. B4GALT4 BINDING SITE is a target binding site found in the 3' untranslated region of mRNA encoded by B4GALT4, corresponding to a target binding site such as BINDING SITE I, BINDING SITE II or BINDING SITE III of FIG. 8. Table 4 illustrates the complementarity of the nucleotide sequences of B4GALT4 BINDING SITE, designated SEQ ID:11028, to the nucleotide sequence of GAM7776 RNA, herein designated GAM RNA, also designated SEQ ID:246.

Another function of GAM7776 is therefore inhibition of Udp-gal:betaglcnac beta 1,4-galactosyltransferase, polypeptide 4 (B4GALT4, Accession NP_003769.1). Accordingly, utilities of GAM7776 include diagnosis, prevention and treatment of diseases and clinical conditions associated with B4GALT4.

Xylosylprotein beta 1,4-galactosyltransferase, polypeptide 7 (galactosyltransferase i) (B4GALT7, Accession NP_009186.1) is another GAM7776 target gene, herein designated TARGET GENE. B4GALT7 BINDING SITE is a target binding site found in the 3' untranslated region of mRNA encoded by B4GALT7, corresponding to a target binding site such as BINDING SITE I, BINDING SITE II or BINDING SITE III of FIG. 8. Table 4 illustrates the complementarity of the nucleotide sequences of B4GALT7 BINDING SITE, designated SEQ ID:18475, to the nucleotide sequence of GAM7776 RNA, herein designated GAM RNA, also designated SEQ ID:246.

Another function of GAM7776 is therefore inhibition of Xylosylprotein beta 1,4-galactosyltransferase, polypeptide 7 (galactosyltransferase i) (B4GALT7, Accession NP_009186.1). Accordingly, utilities of GAM7776 include diagnosis, prevention and treatment of diseases and clinical conditions associated with B4GALT7.

BA108L7.2 (Accession NP_112233.2) is another GAM7776 target gene, herein designated TARGET GENE. BA108L7.2 BINDING SITE is a target binding site found in the 3' untranslated region of mRNA encoded by BA108L7.2, corresponding to a target binding site such as BINDING SITE I, BINDING SITE II or BINDING SITE III of FIG. 8. Table 4 illustrates the complementarity of the nucleotide sequences of BA108L7.2 BINDING SITE, designated SEQ ID:10888, to the nucleotide sequence of GAM7776 RNA, herein designated GAM RNA, also designated SEQ ID:246.

Another function of GAM7776 is therefore inhibition of BA108L7.2 (Accession NP_112233.2). Accordingly, utilities of GAM7776 include diagnosis, prevention and treatment of diseases and clinical conditions associated with BA108L7.2.

Beta-site app-cleaving enzyme 2 (BACE2, Accession NP_620477.1) is another GAM7776 target gene, herein designated TARGET GENE. BACE2 BINDING SITE is a target binding site found in the 3' untranslated region of multiple transcripts of mRNA encoded by BACE2, corresponding to a target binding site such as BINDING SITE I, BINDING SITE II or BINDING SITE III of FIG. 8. Table 4 illustrates the complementarity of the nucleotide sequences of BACE2 BINDING SITE, designated SEQ ID:11052, to the nucleotide sequence of GAM7776 RNA, herein designated GAM RNA, also designated SEQ ID:246.

Another function of GAM7776 is therefore inhibition of Beta-site app-cleaving enzyme 2 (BACE2, Accession NP_620477.1), a gene which cleaves intracellularly the b-secretase site of amyloid precursor protein and therefore may be associated with Alzheimer's disease and down syndrome. Accordingly, utilities of GAM7776 include diagnosis, prevention and treatment of Alzheimer's disease and down syndrome, and of other diseases and clinical conditions associated with BACE2.

The function of BACE2 and its association with various diseases and clinical conditions, has been established by previous studies, as described hereinabove with reference to GAM139.1. Beta-site app-cleaving enzyme 2 (BACE2, Accession NP_036237.2) is another GAM7776 target gene, herein designated TARGET GENE. BACE2 BINDING SITE is a target binding site found in the 3' untranslated region of multiple transcripts of mRNA encoded by BACE2, corresponding to a target binding site such as BINDING SITE I, BINDING SITE II or BINDING SITE III of FIG. 8. Table 4 illustrates the complementarity of the nucleotide sequences of BACE2 BINDING SITE, designated SEQ ID:11052, to the nucleotide sequence of GAM7776 RNA, herein designated GAM RNA, also designated SEQ ID:246.

Another function of GAM7776 is therefore inhibition of Beta-site app-cleaving enzyme 2 (BACE2, Accession NP_036237.2), a gene which cleaves intracellularly the b-secretase site of amyloid precursor protein and therefore may be associated with Alzheimer's disease and down syndrome. Accordingly, utilities of GAM7776 include diagnosis, prevention and treatment of Alzheimer's disease and down syndrome, and of other diseases and clinical conditions associated with BACE2.

The function of BACE2 and its association with various diseases and clinical conditions, has been established by previous studies, as described hereinabove with reference to GAM139.1. Beta-site app-cleaving enzyme 2 (BACE2, Accession NP_620476.1) is another GAM7776 target gene, herein designated TARGET GENE. BACE2 BINDING SITE is a target binding site found in the 3' untranslated region of multiple transcripts of mRNA encoded by BACE2, corresponding to a target binding site such as BINDING SITE I, BINDING SITE II or BINDING SITE III of FIG. 8. Table 4 illustrates the complementarity of the nucleotide sequences of BACE2 BINDING SITE, designated SEQ ID:11052, to the nucleotide sequence of GAM7776 RNA, herein designated GAM RNA, also designated SEQ ID:246.

Another function of GAM7776 is therefore inhibition of Beta-site app-cleaving enzyme 2 (BACE2, Accession NP_620476.1), a gene which cleaves intracellularly the b-secretase site of amyloid precursor protein and therefore may be associated with Alzheimer's disease and down syndrome. Accordingly, utilities of GAM7776 include diagnosis, prevention and treatment of Alzheimer's disease and down syndrome, and of other diseases and clinical conditions associated with BACE2.

The function of BACE2 and its association with various diseases and clinical conditions, has been established by previous studies, as described hereinabove with reference to GAM139.1. Bcl2-associated athanogene 5 (BAG5, Accession NP_004864.1) is another GAM7776 target gene, herein designated TARGET GENE. BAG5 BINDING SITE is a target binding site found in the 3' untranslated region of mRNA encoded by BAG5, corresponding to a target binding site such as BINDING SITE I, BINDING SITE II or BINDING SITE III of FIG. 8. Table 4 illustrates the complementarity of the nucleotide sequences of BAG5 BINDING SITE, designated SEQ ID:5695, to the nucleotide sequence of GAM7776 RNA, herein designated GAM RNA, also designated SEQ ID:246.

Another function of GAM7776 is therefore inhibition of Bcl2-associated athanogene 5 (BAG5, Accession NP_004864.1). Accordingly, utilities of GAM7776 include diagnosis, prevention and treatment of diseases and clinical conditions associated with BAG5.

BART1 (Accession NP_036238.1) is another GAM7776 target gene, herein designated TARGET GENE. BART1 BINDING SITE is a target binding site found in the 3' untranslated region of mRNA encoded by BART1, corresponding to a target binding site such as BINDING SITE I, BINDING SITE II or BINDING SITE III of FIG. 8. Table 4 illustrates the complementarity of the nucleotide sequences of BART1 BINDING SITE, designated SEQ ID:16830, to the nucleotide sequence of GAM7776 RNA, herein designated GAM RNA, also designated SEQ ID:246.

Another function of GAM7776 is therefore inhibition of BART1 (Accession NP_036238.1). Accordingly, utilities of GAM7776 include diagnosis, prevention and treatment of diseases and clinical conditions associated with BART1.

Bromodomain adjacent to zinc finger domain, 2a (BAZ2A, Accession NP_038477.1) is another GAM7776 target gene, herein designated TARGET GENE. BAZ2A BINDING SITE is a target binding site found in the 5' untranslated region of mRNA encoded by BAZ2A, corresponding to a target binding site such as BINDING SITE I, BINDING SITE II or BINDING SITE III of FIG. 8. Table 4 illustrates the complementarity of the nucleotide sequences of BAZ2A BINDING SITE, designated SEQ ID:8852, to the nucleotide sequence of GAM7776 RNA, herein designated GAM RNA, also designated SEQ ID:246.

Another function of GAM7776 is therefore inhibition of Bromodomain adjacent to zinc finger domain, 2a (BAZ2A, Accession NP_038477.1) . Accordingly, utilities of GAM7776 include diagnosis, prevention and treatment of diseases and clinical conditions associated with BAZ2A.

BCAP31 (Accession NP_005736.2) is another GAM7776 target gene, herein designated TARGET GENE. BCAP31 BINDING SITE is a target binding site found in the 3' untranslated region of mRNA encoded by BCAP31, corresponding to a target binding site such as BINDING SITE I, BINDING SITE II or BINDING SITE III of FIG. 8. Table 4 illustrates the complementarity of the nucleotide sequences of BCAP31 BINDING SITE, designated SEQ ID:4861, to the nucleotide sequence of GAM7776 RNA, herein designated GAM RNA, also designated SEQ ID:246.

Another function of GAM7776 is therefore inhibition of BCAP31 (Accession NP_005736.2). Accordingly, utilities of GAM7776 include diagnosis, prevention and treatment of diseases and clinical conditions associated with BCAP31.

B-cell cll/lymphoma 10 (BCL10, Accession NP_003912.1) is another GAM7776 target gene, herein designated TARGET GENE. BCL10 BINDING SITE is a target binding site found in the 3' untranslated region of mRNA encoded by BCL10, corresponding to a target binding site such as BINDING SITE I, BINDING SITE II or BINDING SITE III of FIG. 8. Table 4 illustrates the complementarity of the nucleotide sequences of BCL10 BINDING SITE, designated SEQ ID:19576, to the nucleotide sequence of GAM7776 RNA, herein designated GAM RNA, also designated SEQ ID:246.

Another function of GAM7776 is therefore inhibition of B-cell cll/lymphoma 10 (BCL10, Accession NP_003912.1), a gene which is a positive regulator of lymphocyte proliferation, NF-kappaB activator. and therefore may be associated with Malt lymphoma, follicular lymphoma. Accordingly, utilities of GAM7776 include diagnosis, prevention and treatment of Malt lymphoma, follicular lymphoma, and of other diseases and clinical conditions associated with BCL10.

The function of BCL10 and its association with various diseases and clinical conditions, has been established by previous studies, as described hereinabove with reference to GAM136.1. B double prime 1, subunit of rna polymerase iii transcription initiation factor iiib (BDP1, Accession NP_060899.1) is another GAM7776 target gene, herein designated TARGET GENE. BDP1 BINDING SITE is a target binding site found in the 3' untranslated region of mRNA encoded by BDP1, corresponding to a target binding site such as BINDING SITE I, BINDING SITE II or BINDING SITE III of FIG. 8. Table 4 illustrates the complementarity of the nucleotide sequences of BDP1 BINDING SITE, designated SEQ ID:19556, to the nucleotide sequence of GAM7776 RNA, herein designated GAM RNA, also designated SEQ ID:246.

Another function of GAM7776 is therefore inhibition of B double prime 1, subunit of rna polymerase iii transcription initiation factor iiib (BDP1, Accession NP_060899.1), a gene which activates RNA polymerase III transcription.

Accordingly, utilities of GAM7776 include diagnosis, prevention and treatment of diseases and clinical conditions associated with BDP1.

The function of BDP1 and its association with various diseases and clinical conditions, has been established by previous studies, as described hereinabove with reference to GAM146.1. BENE (Accession NP_005425.1) is another GAM7776 target gene, herein designated TARGET GENE. BENE BINDING SITE is a target binding site found in the 3' untranslated region of mRNA encoded by BENE, corresponding to a target binding site such as BINDING SITE I, BINDING SITE II or BINDING SITE III of FIG. 8. Table 4 illustrates the complementarity of the nucleotide sequences of BENE BINDING SITE, designated SEQ ID:6009, to the nucleotide sequence of GAM7776 RNA, herein designated GAM RNA, also designated SEQ ID:246.

Another function of GAM7776 is therefore inhibition of BENE (Accession NP_005425.1). Accordingly, utilities of GAM7776 include diagnosis, prevention and treatment of diseases and clinical conditions associated with BENE.

BHD (Accession NP_659434.2) is another GAM7776 target gene, herein designated TARGET GENE. BHD BINDING SITE is a target binding site found in the 3' untranslated region of multiple transcripts of mRNA encoded by BHD, corresponding to a target binding site such as BINDING SITE I, BINDING SITE II or BINDING SITE III of FIG. 8. Table 4 illustrates the complementarity of the nucleotide sequences of BHD BINDING SITE, designated SEQ ID:9036, to the nucleotide sequence of GAM7776 RNA, herein designated GAM RNA, also designated SEQ ID:246.

Another function of GAM7776 is therefore inhibition of BHD (Accession NP_659434.2). Accordingly, utilities of GAM7776 include diagnosis, prevention and treatment of diseases and clinical conditions associated with BHD.

BMF (Accession NP_277038.1) is another GAM7776 target gene, herein designated TARGET GENE. BMF BINDING SITE is a target binding site found in the 3' untranslated region of mRNA encoded by BMF, corresponding to a target binding site such as BINDING SITE I, BINDING SITE II or BINDING SITE III of FIG. 8. Table 4 illustrates the complementarity of the nucleotide sequences of BMF BINDING SITE, designated SEQ ID:759, to the nucleotide sequence of GAM7776 RNA, herein designated GAM RNA, also designated SEQ ID:246.

Another function of GAM7776 is therefore inhibition of BMF (Accession NP_277038.1). Accordingly, utilities of GAM7776 include diagnosis, prevention and treatment of diseases and clinical conditions associated with BMF.

BNIP-S (Accession NP_612122.1) is another GAM7776 target gene, herein designated TARGET GENE. BNIP-S BINDING SITE is a target binding site found in the 3' untranslated region of multiple transcripts of mRNA encoded by BNIP-S, corresponding to a target binding site such as BINDING SITE I, BINDING SITE II or BINDING SITE III of FIG. 8. Table 4 illustrates the complementarity of the nucleotide sequences of BNIP-S BINDING SITE, designated SEQ ID:5845, to the nucleotide sequence of GAM7776 RNA, herein designated GAM RNA, also designated SEQ ID:246.

Another function of GAM7776 is therefore inhibition of BNIP-S (Accession NP_612122.1). Accordingly, utilities of GAM7776 include diagnosis, prevention and treatment of diseases and clinical conditions associated with BNIP-S.

BRIP1 (Accession NP_114432.1) is another GAM7776 target gene, herein designated TARGET GENE. BRIP1 BINDING SITE is a target binding site found in the 3' untranslated region of mRNA encoded by BRIP1, corresponding to a target binding site such as BINDING SITE I, BINDING SITE II or BINDING SITE III of FIG. 8. Table 4 illustrates the complementarity of the nucleotide sequences of BRIP1 BINDING SITE, designated SEQ ID:13904, to the nucleotide sequence of GAM7776 RNA, herein designated GAM RNA, also designated SEQ ID:246.

Another function of GAM7776 is therefore inhibition of BRIP1 (Accession NP_114432.1). Accordingly, utilities of GAM7776 include diagnosis, prevention and treatment of diseases and clinical conditions associated with BRIP1.

Butyrophilin, subfamily 3, member a1 (BTN3A1, Accession NP_008979.2) is another GAM7776 target gene, herein designated TARGET GENE. BTN3A1 BINDING SITE is a target binding site found in the 3' untranslated region of mRNA encoded by BTN3A1, corresponding to a target binding site such as BINDING SITE I, BINDING SITE II or BINDING SITE III of FIG. 8. Table 4 illustrates the complementarity of the nucleotide sequences of BTN3A1 BINDING SITE, designated SEQ ID:2067, to the nucleotide sequence of GAM7776 RNA, herein designated GAM RNA, also designated SEQ ID:246.

Another function of GAM7776 is therefore inhibition of Butyrophilin, subfamily 3, member a1 (BTN3A1, Accession NP_008979.2). Accordingly, utilities of GAM7776 include diagnosis, prevention and treatment of diseases and clinical conditions associated with BTN3A1.

BXDC1 (Accession XP_166303.1) is another GAM7776 target gene, herein designated TARGET GENE. BXDC1 BINDING SITE1 and BXDC1 BINDING SITE2 are target binding sites found in untranslated regions of mRNA encoded by BXDC1, corresponding to target binding sites such as BINDING SITE I, BINDING SITE II or BINDING SITE III of FIG. 8. Table 4 illustrates the complementarity of the nucleotide sequences of BXDC1 BINDING SITE1 and BXDC1 BINDING SITE2, designated SEQ ID:12129 and SEQ ID:4549 respectively, to the nucleotide sequence of GAM7776 RNA, herein designated GAM RNA, also designated SEQ ID:246.

Another function of GAM7776 is therefore inhibition of BXDC1 (Accession XP_166303.1). Accordingly, utilities of GAM7776 include diagnosis, prevention and treatment of diseases and clinical conditions associated with BXDC1.

Chromosome 11 open reading frame 17 (C11orf17, Accession NP_065693.2) is another GAM7776 target gene, herein designated TARGET GENE. C11orf17 BINDING SITE is a target binding site found in the 3' untranslated region of mRNA encoded by C11orf17, corresponding to a target binding site such as BINDING SITE I, BINDING SITE II or BINDING SITE III of FIG. 8. Table 4 illustrates the complementarity of the nucleotide sequences of C11orf17 BINDING SITE, designated SEQ ID:11525, to the nucleotide sequence of GAM7776 RNA, herein designated GAM RNA, also designated SEQ ID:246.

Another function of GAM7776 is therefore inhibition of Chromosome 11 open reading frame 17 (C11orf17, Accession NP_065693.2). Accordingly, utilities of GAM7776 include diagnosis, prevention and treatment of diseases and clinical conditions associated with C11orf17.

Chromosome 13 open reading frame 1 (C13orf1, Accession NP_065189.1) is another GAM7776 target gene, herein designated TARGET GENE. C13orf1 BINDING SITE is a target binding site found in the 3' untranslated region of mRNA encoded by C13orf1, corresponding to a target binding site such as BINDING SITE I, BINDING SITE II or BINDING SITE III of FIG. 8. Table 4 illustrates the complementarity of the nucleotide sequences of C13orf1 BINDING SITE, designated SEQ ID:5746, to the nucleotide sequence of GAM7776 RNA, herein designated GAM RNA, also designated SEQ ID:246.

Another function of GAM7776 is therefore inhibition of Chromosome 13 open reading frame 1 (C13orf1, Accession NP_065189.1). Accordingly, utilities of GAM7776 include diagnosis, prevention and treatment of diseases and clinical conditions associated with C13orf1.

Chromosome 14 open reading frame 1 (C14orf1, Accession NP_009107.1) is another GAM7776 target gene, herein designated TARGET GENE. C14orf1 BINDING SITE is a target binding site found in the 3' untranslated region of mRNA encoded by C14orf1, corresponding to a target binding site such as BINDING SITE I, BINDING SITE II or BINDING SITE III of FIG. 8. Table 4 illustrates the complementarity of the nucleotide sequences of C14orf1 BINDING SITE, designated SEQ ID:12744, to the nucleotide sequence of GAM7776 RNA, herein designated GAM RNA, also designated SEQ ID:246.

Another function of GAM7776 is therefore inhibition of Chromosome 14 open reading frame 1 (C14orf1, Accession NP_009107.1). Accordingly, utilities of GAM7776 include diagnosis, prevention and treatment of diseases and clinical conditions associated with C14orf1.

C14orf113 (Accession NP_060100.1) is another GAM7776 target gene, herein designated TARGET GENE. C14orf113 BINDING SITE1 and C14orf113 BINDING SITE2 are target binding sites found in untranslated regions of mRNA encoded by C14orf113, corresponding to target binding sites such as BINDING SITE I, BINDING SITE II or BINDING SITE III of FIG. 8. Table 4 illustrates the complementarity of the nucleotide sequences of C14orf113 BINDING SITE1 and C14orf113 BINDING SITE2, designated SEQ ID:18863 and SEQ ID:5052 respectively, to the nucleotide sequence of GAM7776 RNA, herein designated GAM RNA, also designated SEQ ID:246.

Another function of GAM7776 is therefore inhibition of C14orf113 (Accession NP_060100.1). Accordingly, utilities of GAM7776 include diagnosis, prevention and treatment of diseases and clinical conditions associated with C14orf113.

C14orf143 (Accession NP_660274.1) is another GAM7776 target gene, herein designated TARGET GENE. C14orf143 BINDING SITE is a target binding site found in the 3' untranslated region of mRNA encoded by C14orf143, corresponding to a target binding site such as BINDING SITE I, BINDING SITE II or BINDING SITE III of FIG. 8. Table 4 illustrates the complementarity of the nucleotide sequences of C14orf143 BINDING SITE, designated SEQ ID:17955, to the nucleotide sequence of GAM7776 RNA, herein designated GAM RNA, also designated SEQ ID:246.

Another function of GAM7776 is therefore inhibition of C14orf143 (Accession NP_660274.1). Accordingly, utilities of GAM7776 include diagnosis, prevention and treatment of diseases and clinical conditions associated with C14orf143.

C14orf92 (Accession NP_055643.1) is another GAM7776 target gene, herein designated TARGET GENE. C14orf92 BINDING SITE is a target binding site found in the 3' untranslated region of mRNA encoded by C14orf92, corresponding to a target binding site such as BINDING SITE I, BINDING SITE II or BINDING SITE III of FIG. 8. Table 4 illustrates the complementarity of the nucleotide sequences of C14orf92 BINDING SITE, designated SEQ ID:14861, to the nucleotide sequence of GAM7776 RNA, herein designated GAM RNA, also designated SEQ ID:246.

Another function of GAM7776 is therefore inhibition of C14orf92 (Accession NP_055643.1). Accordingly, utilities of GAM7776 include diagnosis, prevention and treatment of diseases and clinical conditions associated with C14orf92.

Chromosome 1 open reading frame 24 (C1orf24, Accession NP_443198.1) is another GAM7776 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:19538, to the nucleotide sequence of GAM7776 RNA, herein designated GAM RNA, also designated SEQ ID:246.

Another function of GAM7776 is therefore inhibition of Chromosome 1 open reading frame 24 (C1orf24, Accession NP_443198.1). Accordingly, utilities of GAM7776 include diagnosis, prevention and treatment of diseases and clinical conditions associated with C1orf24.

C1q and tumor necrosis factor related protein 6 (C1QTNF6, Accession NP_114116.2) is another GAM7776 target gene, herein designated TARGET GENE. C1QTNF6 BINDING SITE is a target binding site found in the 3' untranslated region of mRNA encoded by C1QTNF6, corresponding to a target binding site such as BINDING SITE I, BINDING SITE II or BINDING SITE III of FIG. 8. Table 4 illustrates the complementarity of the nucleotide sequences of C1QTNF6 BINDING SITE, designated SEQ ID:14882, to the nucleotide sequence of GAM7776 RNA, herein designated GAM RNA, also designated SEQ ID:246.

Another function of GAM7776 is therefore inhibition of C1q and tumor necrosis factor related protein 6 (C1QTNF6, Accession NP_114116.2). Accordingly, utilities of GAM7776 include diagnosis, prevention and treatment of diseases and clinical conditions associated with C1QTNF6.

Chromosome 20 open reading frame 147 (C20orf147, Accession NP_689880.1) is another GAM7776 target gene, herein designated TARGET GENE. C20orf147 BINDING SITE is a target binding site found in the 3' untranslated region of mRNA encoded by C20orf147, corresponding to a target binding site such as BINDING SITE I, BINDING SITE II or BINDING SITE III of FIG. 8. Table 4 illustrates the complementarity of the nucleotide sequences of C20orf147 BINDING SITE, designated SEQ ID:16257, to the nucleotide sequence of GAM7776 RNA, herein designated GAM RNA, also designated SEQ ID:246.

Another function of GAM7776 is therefore inhibition of Chromosome 20 open reading frame 147 (C20orf147, Accession NP_689880.1). Accordingly, utilities of GAM7776 include diagnosis, prevention and treatment of diseases and clinical conditions associated with C20orf147.

Chromosome 21 open reading frame 67 (C21orf67, Accession NP_478068.1) is another GAM7776 target gene, herein designated TARGET GENE. C21orf67 BINDING SITE is a target binding site found in the 5' untranslated region of mRNA encoded by C21orf67, corresponding to a target binding site such as BINDING SITE I, BINDING SITE II or BINDING SITE III of FIG. 8. Table 4 illustrates the complementarity of the nucleotide sequences of C21orf67 BINDING SITE, designated SEQ ID:6569, to the nucleotide sequence of GAM7776 RNA, herein designated GAM RNA, also designated SEQ ID:246.

Another function of GAM7776 is therefore inhibition of Chromosome 21 open reading frame 67 (C21orf67, Accession NP_478068.1). Accordingly, utilities of GAM7776 include diagnosis, prevention and treatment of diseases and clinical conditions associated with C21orf67.

Chromosome 22 open reading frame 19 (C22orf19, Accession NP_003669.2) is another GAM7776 target gene, herein designated TARGET GENE. C22orf19 BINDING SITE is a target binding site found in the 3' untranslated region of mRNA encoded by C22orf19, corresponding to a target binding site such as BINDING SITE I, BINDING SITE II or BINDING SITE III of FIG. 8. Table 4 illustrates the complementarity of the nucleotide sequences of C22orf19 BINDING SITE, designated SEQ ID:18897, to the nucleotide sequence of GAM7776 RNA, herein designated GAM RNA, also designated SEQ ID:246.

Another function of GAM7776 is therefore inhibition of Chromosome 22 open reading frame 19 (C22orf19, Accession NP_003669.2). Accordingly, utilities of GAM7776 include diagnosis, prevention and treatment of diseases and clinical conditions associated with C22orf19.

C4orf9 (Accession XP_035572.1) is another GAM7776 target gene, herein designated TARGET GENE. C4orf9 BINDING SITE is a target binding site found in the 3' untranslated region of mRNA encoded by C4orf9, corresponding to a target binding site such as BINDING SITE I, BINDING SITE II or BINDING SITE III of FIG. 8. Table 4 illustrates the complementarity of the nucleotide sequences of C4orf9 BINDING SITE, designated SEQ ID:15574, to the nucleotide sequence of GAM7776 RNA, herein designated GAM RNA, also designated SEQ ID:246.

Another function of GAM7776 is therefore inhibition of C4orf9 (Accession XP_035572.1). Accordingly, utilities of GAM7776 include diagnosis, prevention and treatment of diseases and clinical conditions associated with C4orf9.

Chromosome 6 open reading frame 33 (C6orf33, Accession NP_588608.1) is another GAM7776 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:6896, to the nucleotide sequence of GAM7776 RNA, herein designated GAM RNA, also designated SEQ ID:246.

Another function of GAM7776 is therefore inhibition of Chromosome 6 open reading frame 33 (C6orf33, Accession NP_588608.1). Accordingly, utilities of GAM7776 include diagnosis, prevention and treatment of diseases and clinical conditions associated with C6orf33.

C6orf5 (Accession NP_056339.2) is another GAM7776 target gene, herein designated TARGET GENE. C6orf5 BINDING SITE1 and C6orf5 BINDING SITE2 are target binding sites found in untranslated regions of mRNA encoded by C6orf5, corresponding to target binding sites such as BINDING SITE I, BINDING SITE II or BINDING SITE III of FIG. 8. Table 4 illustrates the complementarity of the nucleotide sequences of C6orf5 BINDING SITE1 and C6orf5 BINDING SITE2, designated SEQ ID:10099 and SEQ ID:12805 respectively, to the nucleotide sequence of GAM7776 RNA, herein designated GAM RNA, also designated SEQ ID:246.

Another function of GAM7776 is therefore inhibition of C6orf5 (Accession NP_056339.2). Accordingly, utilities of GAM7776 include diagnosis, prevention and treatment of diseases and clinical conditions associated with C6orf5.

C6orf57 (Accession NP_660310.1) is another GAM7776 target gene, herein designated TARGET GENE. C6orf57 BINDING SITE is a target binding site found in the 3' untranslated region of mRNA encoded by C6orf57, corresponding to a target binding site such as BINDING SITE I, BINDING SITE II or BINDING SITE III of FIG. 8. Table 4 illustrates the complementarity of the nucleotide sequences of C6orf57 BINDING SITE, designated SEQ ID:2114, to the nucleotide sequence of GAM7776 RNA, herein designated GAM RNA, also designated SEQ ID:246.

Another function of GAM7776 is therefore inhibition of C6orf57 (Accession NP_660310.1). Accordingly, utilities of GAM7776 include diagnosis, prevention and treatment of diseases and clinical conditions associated with C6orf57.

Complement component 7 (C7, Accession NP_000578.1) is another GAM7776 target gene, herein designated TARGET GENE. C7 BINDING SITE is a target binding site found in the 3' untranslated region of mRNA encoded by C7, corresponding to a target binding site such as BINDING SITE I, BINDING SITE II or BINDING SITE III of FIG. 8. Table 4 illustrates the complementarity of the nucleotide sequences of C7 BINDING SITE, designated SEQ ID:17778, to the nucleotide sequence of GAM7776 RNA, herein designated GAM RNA, also designated SEQ ID:246.

Another function of GAM7776 is therefore inhibition of Complement component 7 (C7, Accession NP_000578.1). Accordingly, utilities of GAM7776 include diagnosis, prevention and treatment of diseases and clinical conditions associated with C7.

Chromosome 9 open reading frame 5 (C9orf5, Accession NP_114401.1) is another GAM7776 target gene, herein designated TARGET GENE. C9orf5 BINDING SITE is a target binding site found in the 3' untranslated region of mRNA encoded by C9orf5, corresponding to a target binding site such as BINDING SITE I, BINDING SITE II or BINDING SITE III of FIG. 8. Table 4 illustrates the complementarity of the nucleotide sequences of C9orf5 BINDING SITE, designated SEQ ID:14258, to the nucleotide sequence of GAM7776 RNA, herein designated GAM RNA, also designated SEQ ID:246.

Another function of GAM7776 is therefore inhibition of Chromosome 9 open reading frame 5 (C9orf5, Accession NP_114401.1). Accordingly, utilities of GAM7776 include diagnosis, prevention and treatment of diseases and clinical conditions associated with C9orf5.

Chromosome 9 open reading frame 9 (C9orf9, Accession NP_061829.2) is another GAM7776 target gene, herein designated TARGET GENE. C9orf9 BINDING SITE1 and C9orf9 BINDING SITE2 are target binding sites found in untranslated regions of mRNA encoded by C9orf9, corresponding to target binding sites such as BINDING SITE I, BINDING SITE II or BINDING SITE III of FIG. 8. Table 4 illustrates the complementarity of the nucleotide sequences of C9orf9 BINDING SITE1 and C9orf9 BINDING SITE2, designated SEQ ID:5477 and SEQ ID:11520 respectively, to the nucleotide sequence of GAM7776 RNA, herein designated GAM RNA, also designated SEQ ID:246.

Another function of GAM7776 is therefore inhibition of Chromosome 9 open reading frame 9 (C9orf9, Accession NP_061829.2). Accordingly, utilities of GAM7776 include diagnosis, prevention and treatment of diseases and clinical conditions associated with C9orf9.

CAB2 (Accession NP_219487.2) is another GAM7776 target gene, herein designated TARGET GENE. CAB2 BINDING SITE is a target binding site found in the 3' untranslated region of mRNA encoded by CAB2, corresponding to a target binding site such as BINDING SITE I, BINDING SITE II or BINDING SITE III of FIG. 8. Table 4 illustrates the complementarity of the nucleotide sequences of CAB2 BINDING SITE, designated SEQ ID:9181, to the nucleotide sequence of GAM7776 RNA, herein designated GAM RNA, also designated SEQ ID:246.

Another function of GAM7776 is therefore inhibition of CAB2 (Accession NP_219487.2). Accordingly, utilities of GAM7776 include diagnosis, prevention and treatment of diseases and clinical conditions associated with CAB2.

Calcium binding protein 4 (CABP4, Accession NP_660201.1) is another GAM7776 target gene, herein designated TARGET GENE. CABP4 BINDING SITE is a target binding site found in the 5' untranslated region of mRNA encoded by CABP4, corresponding to a target binding site such as BINDING SITE I, BINDING SITE II or BINDING SITE III of FIG. 8. Table 4 illustrates the complementarity of the nucleotide sequences of CABP4 BINDING SITE, designated SEQ ID:7624, to the nucleotide sequence of GAM7776 RNA, herein designated GAM RNA, also designated SEQ ID:246.

Another function of GAM7776 is therefore inhibition of Calcium binding protein 4 (CABP4, Accession NP_660201.1). Accordingly, utilities of GAM7776 include diagnosis, prevention and treatment of diseases and clinical conditions associated with CABP4.

Calneuron 1 (CALN1, Accession NP_113656.1) is another GAM7776 target gene, herein designated TARGET GENE. CALN1 BINDING SITE is a target binding site found in the 3' untranslated region of mRNA encoded by CALN1, corresponding to a target binding site such as BINDING SITE I, BINDING SITE II or BINDING SITE III of FIG. 8. Table 4 illustrates the complementarity of the nucleotide sequences of CALN1 BINDING SITE, designated SEQ ID:17850, to the nucleotide sequence of GAM7776 RNA, herein designated GAM RNA, also designated SEQ ID:246.

Another function of GAM7776 is therefore inhibition of Calneuron 1 (CALN1, Accession NP_113656.1). Accordingly, utilities of GAM7776 include diagnosis, prevention and treatment of diseases and clinical conditions associated with CALN1.

Calcium modulating ligand (CAMLG, Accession NP_001736.1) is another GAM7776 target gene, herein designated TARGET GENE. CAMLG BINDING SITE is a target binding site found in the 3' untranslated region of mRNA encoded by CAMLG, corresponding to a target binding site such as BINDING SITE I, BINDING SITE II or BINDING SITE III of FIG. 8. Table 4 illustrates the complementarity of the nucleotide sequences of CAMLG BINDING SITE, designated SEQ ID:18944, to the nucleotide sequence of GAM7776 RNA, herein designated GAM RNA, also designated SEQ ID:246.

Another function of GAM7776 is therefore inhibition of Calcium modulating ligand (CAMLG, Accession NP_001736.1), a gene which is likely involved in the mobilization of calcium as a result of the tcr/cd3 complex interaction. Accordingly, utilities of GAM7776 include diagnosis, prevention and treatment of diseases and clinical conditions associated with CAMLG.

The function of CAMLG and its association with various diseases and clinical conditions, has been established by previous studies, as described hereinabove with reference to GAM130.1. Calpain 6 (CAPN6, Accession NP_055104.2) is another GAM7776 target gene, herein designated TARGET GENE. CAPN6 BINDING SITE is a target binding site found in the 3' untranslated region of mRNA encoded by CAPN6, corresponding to a target binding site such as BINDING SITE I, BINDING SITE II or BINDING SITE III of FIG. 8. Table 4 illustrates the complementarity of the nucleotide sequences of CAPN6 BINDING SITE, designated SEQ ID:2208, to the nucleotide sequence of GAM7776 RNA, herein designated GAM RNA, also designated SEQ ID:246.

Another function of GAM7776 is therefore inhibition of Calpain 6 (CAPN6, Accession NP_055104.2). Accordingly, utilities of GAM7776 include diagnosis, prevention and treatment of diseases and clinical conditions associated with CAPN6.

CAPRI (Accession NP_008920.3) is another GAM7776 target gene, herein designated TARGET GENE. CAPRI BINDING SITE is a target binding site found in the 3' untranslated region of mRNA encoded by CAPRI, corresponding to a target binding site such as BINDING SITE I, BINDING SITE II or BINDING SITE III of FIG. 8. Table 4 illustrates the complementarity of the nucleotide sequences of CAPRI BINDING SITE, designated SEQ ID:4271, to the nucleotide sequence of GAM7776 RNA, herein designated GAM RNA, also designated SEQ ID:246.

Another function of GAM7776 is therefore inhibition of CAPRI (Accession NP_008920.3). Accordingly, utilities of GAM7776 include diagnosis, prevention and treatment of diseases and clinical conditions associated with CAPRI.

Caspase recruitment domain family, member 6 (CARD6, Accession NP_115976.2) is another GAM7776 target gene, herein designated TARGET GENE. CARD6 BINDING SITE is a target binding site found in the 3' untranslated region of mRNA encoded by CARD6, corresponding to a target binding site such as BINDING SITE I, BINDING SITE II or BINDING SITE III of FIG. 8. Table 4 illustrates the complementarity of the nucleotide sequences of CARD6 BINDING SITE, designated SEQ ID:9036, to the nucleotide sequence of GAM7776 RNA, herein designated GAM RNA, also designated SEQ ID:246.

Another function of GAM7776 is therefore inhibition of Caspase recruitment domain family, member 6 (CARD6, Accession NP_115976.2) . Accordingly, utilities of GAM7776 include diagnosis, prevention and treatment of diseases and clinical conditions associated with CARD6.

Caspase 2, apoptosis-related cysteine protease (neural precursor cell expressed, developmentally down-regulated 2) (CASP2, Accession NP_116765.1) is another GAM7776 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM7776 RNA, herein designated GAM RNA, also designated SEQ ID:246.

Another function of GAM7776 is therefore inhibition of Caspase 2, apoptosis-related cysteine protease (neural precursor cell expressed, developmentally down-regulated 2) (CASP2, Accession NP_116765.1), a gene which involves in the activation cascade of caspases responsible for apoptosis execution. Accordingly, utilities of GAM7776 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_001215.1) is another GAM7776 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM7776 RNA, herein designated GAM RNA, also designated SEQ ID:246.

Another function of GAM7776 is therefore inhibition of Caspase 2, apoptosis-related cysteine protease (neural precursor cell expressed, developmentally down-regulated 2) (CASP2, Accession NP_001215.1), a gene which involves in the activation cascade of caspases responsible for apoptosis execution. Accordingly, utilities of GAM7776 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116766.1) is another GAM7776 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM7776 RNA, herein designated GAM RNA, also designated SEQ ID:246.

Another function of GAM7776 is therefore inhibition of Caspase 2, apoptosis-related cysteine protease (neural precursor cell expressed, developmentally down-regulated 2) (CASP2, Accession NP_116766.1), a gene which involves in the activation cascade of caspases responsible for apoptosis execution. Accordingly, utilities of GAM7776 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116764.1) is another GAM7776 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:16398, to the nucleotide sequence of GAM7776 RNA, herein designated GAM RNA, also designated SEQ ID:246.

Another function of GAM7776 is therefore inhibition of Caspase 2, apoptosis-related cysteine protease (neural precursor cell expressed, developmentally down-regulated 2) (CASP2, Accession NP_116764.1), a gene which involves in the activation cascade of caspases responsible for apoptosis execution. Accordingly, utilities of GAM7776 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 8, apoptosis-related cysteine protease (CASP8, Accession NP_203519.1) is another GAM7776 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM7776 RNA, herein designated GAM RNA, also designated SEQ ID:246.

Another function of GAM7776 is therefore inhibition of Caspase 8, apoptosis-related cysteine protease (CASP8, Accession NP_203519.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM7776 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203520.1) is another GAM7776 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM7776 RNA, herein designated GAM RNA, also designated SEQ ID:246.

Another function of GAM7776 is therefore inhibition of Caspase 8, apoptosis-related cysteine protease (CASP8, Accession NP_203520.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM7776 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203521.1) is another GAM7776 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM7776 RNA, herein designated GAM RNA, also designated SEQ ID:246.

Another function of GAM7776 is therefore inhibition of Caspase 8, apoptosis-related cysteine protease (CASP8, Accession NP_203521.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM7776 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_001219.2) is another GAM7776 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:15049, to the nucleotide sequence of GAM7776 RNA, herein designated GAM RNA, also designated SEQ ID:246.

Another function of GAM7776 is therefore inhibition of Caspase 8, apoptosis-related cysteine protease (CASP8, Accession NP_001219.2), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM7776 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. CASPR4 (Accession NP_620481.1) is another GAM7776 target gene, herein designated TARGET GENE. CASPR4 BINDING SITE is a target binding site found in the 3' untranslated region of multiple transcripts of mRNA encoded by CASPR4, corresponding to a target binding site such as BINDING SITE I, BINDING SITE II or BINDING SITE III of FIG. 8. Table 4 illustrates the complementarity of the nucleotide sequences of CASPR4 BINDING SITE, designated SEQ ID:13634, to the nucleotide sequence of GAM7776 RNA, herein designated GAM RNA, also designated SEQ ID:246.

Another function of GAM7776 is therefore inhibition of CASPR4 (Accession NP_620481.1). Accordingly, utilities of GAM7776 include diagnosis, prevention and treatment of diseases and clinical conditions associated with CASPR4.

Core-binding factor, runt domain, alpha subunit 2; translocated to, 2 (CBFA2T2, Accession NP_787060.1) is another GAM7776 target gene, herein designated TARGET GENE. CBFA2T2 BINDING SITE1 and CBFA2T2 BINDING SITE2 are target binding sites found in untranslated regions of multiple transcripts of mRNA encoded by CBFA2T2, corresponding to target binding sites such as BINDING SITE I, BINDING SITE II or BINDING SITE III of FIG. 8. Table 4 illustrates the complementarity of the nucleotide sequences of CBFA2T2 BINDING SITE1 and CBFA2T2 BINDING SITE2, designated SEQ ID:8242 and SEQ ID:8572 respectively, to the nucleotide sequence of GAM7776 RNA, herein designated GAM RNA, also designated SEQ ID:246.

Another function of GAM7776 is therefore inhibition of Core-binding factor, runt domain, alpha subunit 2; translocated to, 2 (CBFA2T2, Accession NP_787060.1), a gene which is a putative transcription factor. Accordingly, utilities of GAM7776 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Core-binding factor, runt domain, alpha subunit 2; translocated to, 2 (CBFA2T2, Accession NP_787060.1) is another GAM7776 target gene, herein designated TARGET GENE. CBFA2T2 BINDING SITE1 and CBFA2T2 BINDING SITE2 are target binding sites found in untranslated regions of multiple transcripts of mRNA encoded by CBFA2T2, corresponding to target binding sites such as BINDING SITE I, BINDING SITE II or BINDING SITE III of FIG. 8. Table 4 illustrates the complementarity of the nucleotide sequences of CBFA2T2 BINDING SITE1 and CBFA2T2 BINDING SITE2, designated SEQ ID:8572 and SEQ ID:9543 respectively, to the nucleotide sequence of GAM7776 RNA, herein designated GAM RNA, also designated SEQ ID:246.

Another function of GAM7776 is therefore inhibition of Core-binding factor, runt domain, alpha subunit 2; translocated to, 2 (CBFA2T2, Accession NP_787060.1), a gene which is a putative transcription factor. Accordingly, utilities of GAM7776 include diagnosis, prevention and treatment of diseases and clinical conditions associated with CBFA2T2.

The function of CBFA2T2 and its association with various diseases and clinical conditions, has been established by previous studies, as described hereinabove with reference to GAM55.1. Chemokine (c-c motif) ligand 22 (CCL22, Accession NP_002981.2) is another GAM7776 target gene, herein designated TARGET GENE. CCL22 BINDING SITE1 and CCL22 BINDING SITE2 are target binding sites found in untranslated regions of mRNA encoded by CCL22, corresponding to target binding sites such as BINDING SITE I, BINDING SITE II or BINDING SITE III of FIG. 8. Table 4 illustrates the complementarity of the nucleotide sequences of CCL22 BINDING SITE1 and CCL22 BINDING SITE2, designated SEQ ID:15049 and SEQ ID:1679 respectively, to the nucleotide sequence of GAM7776 RNA, herein designated GAM RNA, also designated SEQ ID:246.

Another function of GAM7776 is therefore inhibition of Chemokine (c-c motif) ligand 22 (CCL22, Accession NP_002981.2). Accordingly, utilities of GAM7776 include diagnosis, prevention and treatment of diseases and clinical conditions associated with CCL22.

Cyclin f (CCNF, Accession NP_001752.1) is another GAM7776 target gene, herein designated TARGET GENE. CCNF BINDING SITE is a target binding site found in the 3' untranslated region of mRNA encoded by CCNF, corresponding to a target binding site such as BINDING SITE I, BINDING SITE II or BINDING SITE III of FIG. 8. Table 4 illustrates the complementarity of the nucleotide sequences of CCNF BINDING SITE, designated SEQ ID:17624, to the nucleotide sequence of GAM7776 RNA, herein designated GAM RNA, also designated SEQ ID:246.

Another function of GAM7776 is therefore inhibition of Cyclin f (CCNF, Accession NP_001752.1), a gene which likely to be involved in the control of the cell cycle during s phase and g2. Accordingly, utilities of GAM7776 include diagnosis, prevention and treatment of diseases and clinical conditions associated with CCNF.

The function of CCNF and its association with various diseases and clinical conditions, has been established by previous studies, as described hereinabove with reference to GAM130.1. Ccr4 carbon catabolite repression 4-like (s. cerevisiae) (CCRN4L, Accession NP_036250.2) is another GAM7776 target gene, herein designated TARGET GENE. CCRN4L BINDING SITE is a target binding site found in the 3' untranslated region of mRNA encoded by CCRN4L, corresponding to a target binding site such as BINDING SITE I, BINDING SITE II or BINDING SITE III of FIG. 8. Table 4 illustrates the complementarity of the nucleotide sequences of CCRN4L BINDING SITE, designated SEQ ID:4698, to the nucleotide sequence of GAM7776 RNA, herein designated GAM RNA, also designated SEQ ID:246.

Another function of GAM7776 is therefore inhibition of Ccr4 carbon catabolite repression 4-like (s. cerevisiae) (CCRN4L, Accession NP_036250.2). Accordingly, utilities of GAM7776 include diagnosis, prevention and treatment of diseases and clinical conditions associated with CCRN4L.

Cd209 antigen (CD209, Accession NP_066978.1) is another GAM7776 target gene, herein designated TARGET GENE. CD209 BINDING SITE1 and CD209 BINDING SITE2 are target binding sites found in untranslated regions of mRNA encoded by CD209, corresponding to target binding sites such as BINDING SITE I, BINDING SITE II or BINDING SITE III of FIG. 8. Table 4 illustrates the complementarity of the nucleotide sequences of CD209 BINDING SITE1 and CD209 BINDING SITE2, designated SEQ ID:17051 and SEQ ID:4298 respectively, to the nucleotide sequence of GAM7776 RNA, herein designated GAM RNA, also designated SEQ ID:246.

Another function of GAM7776 is therefore inhibition of Cd209 antigen (CD209, Accession NP_066978.1), a gene which may play an important role in the CD4-independent association of HIV with cells. Accordingly, utilities of GAM7776 include diagnosis, prevention and treatment of diseases and clinical conditions associated with CD209.

The function of CD209 and its association with various diseases and clinical conditions, has been established by previous studies, as described hereinabove with reference to GAM96.1. Cd24 antigen (small cell lung carcinoma cluster 4 antigen) (CD24, Accession NP_037362.1) is another GAM7776 target gene, herein designated TARGET GENE. CD24 BINDING SITE is a target binding site found in the 3' untranslated region of mRNA encoded by CD24, corresponding to a target binding site such as BINDING SITE I, BINDING SITE II or BINDING SITE III of FIG. 8. Table 4 illustrates the complementarity of the nucleotide sequences of CD24 BINDING SITE, designated SEQ ID:19572, to the nucleotide sequence of GAM7776 RNA, herein designated GAM RNA, also designated SEQ ID:246.

Another function of GAM7776 is therefore inhibition of Cd24 antigen (small cell lung carcinoma cluster 4 antigen) (CD24, Accession NP_037362.1). Accordingly, utilities of GAM7776 include diagnosis, prevention and treatment of diseases and clinical conditions associated with CD24.

Cd5 antigen (p56-62) (CD5, Accession NP_055022.1) is another GAM7776 target gene, herein designated TARGET GENE. CD5 BINDING SITE is a target binding site found in the 5' untranslated region of mRNA encoded by CD5, corresponding to a target binding site such as BINDING SITE I, BINDING SITE II or BINDING SITE III of FIG. 8. Table 4 illustrates the complementarity of the nucleotide sequences of CD5 BINDING SITE, designated SEQ ID:1049, to the nucleotide sequence of GAM7776 RNA, herein designated GAM RNA, also designated SEQ ID:246.

Another function of GAM7776 is therefore inhibition of Cd5 antigen (p56-62) (CD5, Accession NP_055022.1). Accordingly, utilities of GAM7776 include diagnosis, prevention and treatment of diseases and clinical conditions associated with CD5.

Cd84 antigen (leukocyte antigen) (CD84, Accession NP_003865.1) is another GAM7776 target gene, herein designated TARGET GENE. CD84 BINDING SITE is a target binding site found in the 3' untranslated region of mRNA encoded by CD84, corresponding to a target binding site such as BINDING SITE I, BINDING SITE II or BINDING SITE III of FIG. 8. Table 4 illustrates the complementarity of the nucleotide sequences of CD84 BINDING SITE, designated SEQ ID:514, to the nucleotide sequence of GAM7776 RNA, herein designated GAM RNA, also designated SEQ ID:246.

Another function of GAM7776 is therefore inhibition of Cd84 antigen (leukocyte antigen) (CD84, Accession NP_003865.1). Accordingly, utilities of GAM7776 include diagnosis, prevention and treatment of diseases and clinical conditions associated with CD84.

Cdc14 cell division cycle 14 homolog b (s. cerevisiae) (CDC14B, Accession NP_201589.1) is another GAM7776 target gene, herein designated TARGET GENE. CDC14B BINDING SITE is a target binding site found in the 3' untranslated region of multiple transcripts of mRNA encoded by CDC14B, corresponding to a target binding site such as BINDING SITE I, BINDING SITE II or BINDING SITE III of FIG. 8. Table 4 illustrates the complementarity of the nucleotide sequences of CDC14B BINDING SITE, designated SEQ ID:17127, to the nucleotide sequence of GAM7776 RNA, herein designated GAM RNA, also designated SEQ ID:246.

Another function of GAM7776 is therefore inhibition of Cdc14 cell division cycle 14 homolog b (s. cerevisiae) (CDC14B, Accession NP_201589.1). Accordingly, utilities of GAM7776 include diagnosis, prevention and treatment of diseases and clinical conditions associated with CDC14B.

Cell division cycle 2-like 2 (CDC2L2, Accession NP_296370.1) is another GAM7776 target gene, herein designated TARGET GENE. CDC2L2 BINDING SITE is a target binding site found in the 5' untranslated region of multiple transcripts of mRNA encoded by CDC2L2, corresponding to a target binding site such as BINDING SITE I, BINDING SITE II or BINDING SITE III of FIG. 8. Table 4 illustrates the complementarity of the nucleotide sequences of CDC2L2 BINDING SITE, designated SEQ ID:15084, to the nucleotide sequence of GAM7776 RNA, herein designated GAM RNA, also designated SEQ ID:246.

Another function of GAM7776 is therefore inhibition of Cell division cycle 2-like 2 (CDC2L2, Accession NP_296370.1). Accordingly, utilities of GAM7776 include diagnosis, prevention and treatment of diseases and clinical conditions associated with CDC2L2.

Cdc6 cell division cycle 6 homolog (s. cerevisiae) (CDC6, Accession NP_001245.1) is another GAM7776 target gene, herein designated TARGET GENE. CDC6 BINDING SITE is a target binding site found in the 3' untranslated region of mRNA encoded by CDC6, corresponding to a target binding site such as BINDING SITE I, BINDING SITE II or BINDING SITE III of FIG. 8. Table 4 illustrates the complementarity of the nucleotide sequences of CDC6 BINDING SITE, designated SEQ ID:9211, to the nucleotide sequence of GAM7776 RNA, herein designated GAM RNA, also designated SEQ ID:246.

Another function of GAM7776 is therefore inhibition of Cdc6 cell division cycle 6 homolog (s. cerevisiae) (CDC6, Accession NP_001245.1), a gene which is a component of the origin recognition complex (orc) that binds origins of replication. Accordingly, utilities of GAM7776 include diagnosis, prevention and treatment of diseases and clinical conditions associated with CDC6.

The function of CDC6 and its association with various diseases and clinical conditions, has been established by previous studies, as described hereinabove with reference to GAM189.1. CDCP1 (Accession NP_073753.3) is another GAM7776 target gene, herein designated TARGET GENE. CDCP1 BINDING SITE is a target binding site found in the 3' untranslated region of multiple transcripts of mRNA encoded by CDCP1, corresponding to a target binding site such as BINDING SITE I, BINDING SITE II or BINDING SITE III of FIG. 8. Table 4 illustrates the complementarity of the nucleotide sequences of CDCP1 BINDING SITE, designated SEQ ID:12091, to the nucleotide sequence of GAM7776 RNA, herein designated GAM RNA, also designated SEQ ID:246.

Another function of GAM7776 is therefore inhibition of CDCP1 (Accession NP_073753.3). Accordingly, utilities of GAM7776 include diagnosis, prevention and treatment of diseases and clinical conditions associated with CDCP1.

Cadherin 1, type 1, e-cadherin (epithelial) (CDH1, Accession NP_004351.1) is another GAM7776 target gene, herein designated TARGET GENE. CDH1 BINDING SITE1 and CDH1 BINDING SITE2 are target binding sites found in untranslated regions of mRNA encoded by CDH1, corresponding to target binding sites such as BINDING SITE I, BINDING SITE II or BINDING SITE III of FIG. 8. Table 4 illustrates the complementarity of the nucleotide sequences of CDH1 BINDING SITE1 and CDH1 BINDING SITE2, designated SEQ ID:12580 and SEQ ID:5514 respectively, to the nucleotide sequence of GAM7776 RNA, herein designated GAM RNA, also designated SEQ ID:246.

Another function of GAM7776 is therefore inhibition of Cadherin 1, type 1, e-cadherin (epithelial) (CDH1, Accession NP_004351.1). Accordingly, utilities of GAM7776 include diagnosis, prevention and treatment of diseases and clinical conditions associated with CDH1.

Cadherin 17, li cadherin (liver-intestine) (CDH17, Accession NP_004054.2) is another GAM7776 target gene, herein designated TARGET GENE. CDH17 BINDING SITE is a target binding site found in the 3' untranslated region of mRNA encoded by CDH17, corresponding to a target binding site such as BINDING SITE I, BINDING SITE II or BINDING SITE III of FIG. 8. Table 4 illustrates the complementarity of the nucleotide sequences of CDH17 BINDING SITE, designated SEQ ID:13851, to the nucleotide sequence of GAM7776 RNA, herein designated GAM RNA, also designated SEQ ID:246.

Another function of GAM7776 is therefore inhibition of Cadherin 17, li cadherin (liver-intestine) (CDH17, Accession NP_004054.2), a gene which may have a role in the morphological organization of liver and intestine and involved in intestinal peptide transport. Accordingly, utilities of GAM7776 include diagnosis, prevention and treatment of diseases and clinical conditions associated with CDH17.

The function of CDH17 and its association with various diseases and clinical conditions, has been established by previous studies, as described hereinabove with reference to GAM161.1. CDK11 (Accession XP_166324.1) is another GAM7776 target gene, herein designated TARGET GENE. CDK11 BINDING SITE is a target binding site found in the 3' untranslated region of multiple transcripts of mRNA encoded by CDK11, corresponding to a target binding site such as BINDING SITE I, BINDING SITE II or BINDING SITE III of FIG. 8. Table 4 illustrates the complementarity of the nucleotide sequences of CDK11 BINDING SITE, designated SEQ ID:8162, to the nucleotide sequence of GAM7776 RNA, herein designated GAM RNA, also designated SEQ ID:246.

Another function of GAM7776 is therefore inhibition of CDK11 (Accession XP_166324.1). Accordingly, utilities of GAM7776 include diagnosis, prevention and treatment of diseases and clinical conditions associated with CDK11.

CDKAL1 (Accession NP_060244.1) is another GAM7776 target gene, herein designated TARGET GENE. CDKAL1 BINDING SITE is a target binding site found in the 3' untranslated region of mRNA encoded by CDKAL1, corresponding to a target binding site such as BINDING SITE I, BINDING SITE II or BINDING SITE III of FIG. 8. Table 4 illustrates the complementarity of the nucleotide sequences of CDKAL1 BINDING SITE, designated SEQ ID:1255, to the nucleotide sequence of GAM7776 RNA, herein designated GAM RNA, also designated SEQ ID:246.

Another function of GAM7776 is therefore inhibition of CDKAL1 (Accession NP_060244.1). Accordingly, utilities of GAM7776 include diagnosis, prevention and treatment of diseases and clinical conditions associated with CDKAL1.

Carcinoembryonic antigen-related cell adhesion molecule 8 (CEACAM8, Accession NP_001807.2) is another GAM7776 target gene, herein designated TARGET GENE. CEACAM8 BINDING SITE is a target binding site found in the 3' untranslated region of mRNA encoded by CEACAM8, corresponding to a target binding site such as BINDING SITE I, BINDING SITE II or BINDING SITE III of FIG. 8. Table 4 illustrates the complementarity of the nucleotide sequences of CEACAM8 BINDING SITE, designated SEQ ID:17969, to the nucleotide sequence of GAM7776 RNA, herein designated GAM RNA, also designated SEQ ID:246.

Another function of GAM7776 is therefore inhibition of Carcinoembryonic antigen-related cell adhesion molecule 8 (CEACAM8, Accession NP_001807.2). Accordingly, utilities of GAM7776 include diagnosis, prevention and treatment of diseases and clinical conditions associated with CEACAM8.

Cat eye syndrome chromosome region, candidate 1 (CECR1, Accession NP_059120.2) is another GAM7776 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:4574 and SEQ ID:9037 respectively, to the nucleotide sequence of GAM7776 RNA, herein designated GAM RNA, also designated SEQ ID:246.

Another function of GAM7776 is therefore inhibition of Cat eye syndrome chromosome region, candidate 1 (CECR1, Accession NP_059120.2). Accordingly, utilities of GAM7776 include diagnosis, prevention and treatment of diseases and clinical conditions associated with CECR1.

Cat eye syndrome chromosome region, candidate 1 (CECR1, Accession NP_803124.1) is another GAM7776 target gene, herein designated TARGET GENE. CECR1 BINDING SITE1 and CECR1 BINDING SITE2 are target binding sites found in untranslated regions of multiple transcripts of mRNA encoded by CECR1, corresponding to target binding sites such as BINDING SITE I, BINDING SITE II or BINDING SITE III of FIG. 8. Table 4 illustrates the complementarity of the nucleotide sequences of CECR1 BINDING SITE1 and CECR1 BINDING SITE2, designated SEQ ID:9037 and SEQ ID:4574 respectively, to the nucleotide sequence of GAM7776 RNA, herein designated GAM RNA, also designated SEQ ID:246.

Another function of GAM7776 is therefore inhibition of Cat eye syndrome chromosome region, candidate 1 (CECR1, Accession NP_803124.1). Accordingly, utilities of GAM7776 include diagnosis, prevention and treatment of diseases and clinical conditions associated with CECR1.

Centromere protein h (CENPH, Accession NP_075060.1) is another GAM7776 target gene, herein designated TARGET GENE. CENPH BINDING SITE is a target binding site found in the 3' untranslated region of mRNA encoded by CENPH, corresponding to a target binding site such as BINDING SITE I, BINDING SITE II or BINDING SITE III of FIG. 8. Table 4 illustrates the complementarity of the nucleotide sequences of CENPH BINDING SITE, designated SEQ ID:19549, to the nucleotide sequence of GAM7776 RNA, herein designated GAM RNA, also designated SEQ ID:246.

Another function of GAM7776 is therefore inhibition of Centromere protein h (CENPH, Accession NP_075060.1). Accordingly, utilities of GAM7776 include diagnosis, prevention and treatment of diseases and clinical conditions associated with CENPH.

Centromere protein j (CENPJ, Accession NP_060921.2) is another GAM7776 target gene, herein designated TARGET GENE. CENPJ BINDING SITE is a target binding site found in the 5' untranslated region of mRNA encoded by CENPJ, corresponding to a target binding site such as BINDING SITE I, BINDING SITE II or BINDING SITE III of FIG. 8. Table 4 illustrates the complementarity of the nucleotide sequences of CENPJ BINDING SITE, designated SEQ ID:13565, to the nucleotide sequence of GAM7776 RNA, herein designated GAM RNA, also designated SEQ ID:246.

Another function of GAM7776 is therefore inhibition of Centromere protein j (CENPJ, Accession NP_060921.2). Accordingly, utilities of GAM7776 include diagnosis, prevention and treatment of diseases and clinical conditions associated with CENPJ.

CGI-150 (Accession NP_057164.1) is another GAM7776 target gene, herein designated TARGET GENE. CGI-150 BINDING SITE is a target binding site found in the 5' untranslated region of mRNA encoded by CGI-150, corresponding to a target binding site such as BINDING SITE I, BINDING SITE II or BINDING SITE III of FIG. 8. Table 4 illustrates the complementarity of the nucleotide sequences of CGI-150 BINDING SITE, designated SEQ ID:2191, to the nucleotide sequence of GAM7776 RNA, herein designated GAM RNA, also designated SEQ ID:246.

Another function of GAM7776 is therefore inhibition of CGI-150 (Accession NP_057164.1). Accordingly, utilities of GAM7776 include diagnosis, prevention and treatment of diseases and clinical conditions associated with CGI-150.

CGI-18 (Accession NP_057031.1) is another GAM7776 target gene, herein designated TARGET GENE. CGI-18 BINDING SITE is a target binding site found in the 5' untranslated region of mRNA encoded by CGI-18, corresponding to a target binding site such as BINDING SITE I, BINDING SITE II or BINDING SITE III of FIG. 8. Table 4 illustrates the complementarity of the nucleotide sequences of CGI-18 BINDING SITE, designated SEQ ID:18313, to the nucleotide sequence of GAM7776 RNA, herein designated GAM RNA, also designated SEQ ID:246.

Another function of GAM7776 is therefore inhibition of CGI-18 (Accession NP_057031.1). Accordingly, utilities of GAM7776 include diagnosis, prevention and treatment of diseases and clinical conditions associated with CGI-18.

CGI-43 (Accession NP_056437.1) is another GAM7776 target gene, herein designated TARGET GENE. CGI-43 BINDING SITE is a target binding site found in the 3' untranslated region of mRNA encoded by CGI-43, corresponding to a target binding site such as BINDING SITE I, BINDING SITE II or BINDING SITE III of FIG. 8. Table 4 illustrates the complementarity of the nucleotide sequences of CGI-43 BINDING SITE, designated SEQ ID:14860, to the nucleotide sequence of GAM7776 RNA, herein designated GAM RNA, also designated SEQ ID:246.

Another function of GAM7776 is therefore inhibition of CGI-43 (Accession NP_056437.1). Accordingly, utilities of GAM7776 include diagnosis, prevention and treatment of diseases and clinical conditions associated with CGI-43.

Chromosome condensation 1-like (CHC1L, Accession NP_001259.1) is another GAM7776 target gene, herein designated TARGET GENE. CHC1L BINDING SITE is a target binding site found in the 5' untranslated region of mRNA encoded by CHC1L, corresponding to a target binding site such as BINDING SITE I, BINDING SITE II or BINDING SITE III of FIG. 8. Table 4 illustrates the complementarity of the nucleotide sequences of CHC1L BINDING SITE, designated SEQ ID:15582, to the nucleotide sequence of GAM7776 RNA, herein designated GAM RNA, also designated SEQ ID:246.

Another function of GAM7776 is therefore inhibition of Chromosome condensation 1-like (CHC1L, Accession NP_001259.1). Accordingly, utilities of GAM7776 include diagnosis, prevention and treatment of diseases and clinical conditions associated with CHC1L.

Chromatin accessibility complex 1 (CHRAC1, Accession NP_059140.1) is another GAM7776 target gene, herein designated TARGET GENE. CHRAC1 BINDING SITE is a target binding site found in the 3' untranslated region of mRNA encoded by CHRAC1, corresponding to a target binding site such as BINDING SITE I, BINDING SITE II or BINDING SITE III of FIG. 8. Table 4 illustrates the complementarity of the nucleotide sequences of CHRAC1 BINDING SITE, designated SEQ ID:9475, to the nucleotide sequence of GAM7776 RNA, herein designated GAM RNA, also designated SEQ ID:246.

Another function of GAM7776 is therefore inhibition of Chromatin accessibility complex 1 (CHRAC1, Accession NP_059140.1). Accordingly, utilities of GAM7776 include diagnosis, prevention and treatment of diseases and clinical conditions associated with CHRAC1.

Carbohydrate (chondroitin) synthase 1 (CHSY1, Accession NP_055733.2) is another GAM7776 target gene, herein designated TARGET GENE. CHSY1 BINDING SITE is a target binding site found in the 3' untranslated region of mRNA encoded by CHSY1, corresponding to a target binding site such as BINDING SITE I, BINDING SITE II or BINDING SITE III of FIG. 8. Table 4 illustrates the complementarity of the nucleotide sequences of CHSY1 BINDING SITE, designated SEQ ID:11924, to the nucleotide sequence of GAM7776 RNA, herein designated GAM RNA, also designated SEQ ID:246.

Another function of GAM7776 is therefore inhibition of Carbohydrate (chondroitin) synthase 1 (CHSY1, Accession NP_055733.2). Accordingly, utilities of GAM7776 include diagnosis, prevention and treatment of diseases and clinical conditions associated with CHSY1.

Cold autoinflammatory syndrome 1 (CIAS1, Accession NP_004886.2) is another GAM7776 target gene, herein designated TARGET GENE. CIAS1 BINDING SITE is a target binding site found in the 5' untranslated region of mRNA encoded by CIAS1, corresponding to a target binding site such as BINDING SITE I, BINDING SITE II or BINDING SITE III of FIG. 8. Table 4 illustrates the complementarity of the nucleotide sequences of CIAS1 BINDING SITE, designated SEQ ID:13461, to the nucleotide sequence of GAM7776 RNA, herein designated GAM RNA, also designated SEQ ID:246.

Another function of GAM7776 is therefore inhibition of Cold autoinflammatory syndrome 1 (CIAS1, Accession NP_004886.2), a gene which may mediate protein-protein interactions; contains a leucine rich repeat and therefore may be associated with Familial cold autoinflammatory syndrome, muckle-wells syndrome. Accordingly, utilities of GAM7776 include diagnosis, prevention and treatment of Familial cold autoinflammatory syndrome, muckle-wells syndrome, and of other diseases and clinical conditions associated with CIAS1.

The function of CIAS1 and its association with various diseases and clinical conditions, has been established by previous studies, as described hereinabove with reference to GAM90.1. CIP29 (Accession NP_115740.3) is another GAM7776 target gene, herein designated TARGET GENE. CIP29 BINDING SITE1 and CIP29 BINDING SITE2 are target binding sites found in untranslated regions of mRNA encoded by CIP29, corresponding to target binding sites such as BINDING SITE I, BINDING SITE II or BINDING SITE III of FIG. 8. Table 4 illustrates the complementarity of the nucleotide sequences of CIP29 BINDING SITE1 and CIP29 BINDING SITE2, designated SEQ ID:3509 and SEQ ID:20120 respectively, to the nucleotide sequence of GAM7776 RNA, herein designated GAM RNA, also designated SEQ ID:246.

Another function of GAM7776 is therefore inhibition of CIP29 (Accession NP_115740.3). Accordingly, utilities of GAM7776 include diagnosis, prevention and treatment of diseases and clinical conditions associated with CIP29.

Claudin 19 (CLDN19, Accession NP_683763.1) is another GAM7776 target gene, herein designated TARGET GENE. CLDN19 BINDING SITE is a target binding site found in the 3' untranslated region of mRNA encoded by CLDN19, corresponding to a target binding site such as BINDING SITE I, BINDING SITE II or BINDING SITE III of FIG. 8. Table 4 illustrates the complementarity of the nucleotide sequences of CLDN19 BINDING SITE, designated SEQ ID:5914, to the nucleotide sequence of GAM7776 RNA, herein designated GAM RNA, also designated SEQ ID:246.

Another function of GAM7776 is therefore inhibition of Claudin 19 (CLDN19, Accession NP_683763.1). Accordingly, utilities of GAM7776 include diagnosis, prevention and treatment of diseases and clinical conditions associated with CLDN19.

C-type (calcium dependent, carbohydrate-recognition domain) lectin, superfamily member 12 (CLECSF12, Accession NP_072092.2) is another GAM7776 target gene, herein designated TARGET GENE. CLECSF12 BINDING SITE1 and CLECSF12 BINDING SITE2 are target binding sites found in untranslated regions of mRNA encoded by CLECSF12, corresponding to target binding sites such as BINDING SITE I, BINDING SITE II or BINDING SITE III of FIG. 8. Table 4 illustrates the complementarity of the nucleotide sequences of CLECSF12 BINDING SITE1 and CLECSF12 BINDING SITE2, designated SEQ ID:16192 and SEQ ID:15296 respectively, to the nucleotide sequence of GAM7776 RNA, herein designated GAM RNA, also designated SEQ ID:246.

Another function of GAM7776 is therefore inhibition of C-type (calcium dependent, carbohydrate-recognition domain) lectin, superfamily member 12 (CLECSF12, Accession NP_072092.2), a gene which is a pattern- recognition receptor . Accordingly, utilities of GAM7776 include diagnosis, prevention and treatment of diseases and clinical conditions associated with CLECSF12.

The function of CLECSF12 and its association with various diseases and clinical conditions, has been established by previous studies, as described hereinabove with reference to GAM47.1. Chloride intracellular channel 5 (CLIC5, Accession NP_058625.1) is another GAM7776 target gene, herein designated TARGET GENE. CLIC5 BINDING SITE is a target binding site found in the 5' untranslated region of mRNA encoded by CLIC5, corresponding to a target binding site such as BINDING SITE I, BINDING SITE II or BINDING SITE III of FIG. 8. Table 4 illustrates the complementarity of the nucleotide sequences of CLIC5 BINDING SITE, designated SEQ ID:19116, to the nucleotide sequence of GAM7776 RNA, herein designated GAM RNA, also designated SEQ ID:246.

Another function of GAM7776 is therefore inhibition of Chloride intracellular channel 5 (CLIC5, Accession NP_058625.1). Accordingly, utilities of GAM7776 include diagnosis, prevention and treatment of diseases and clinical conditions associated with CLIC5.

Ceroid-lipofuscinosis, neuronal 8 (epilepsy, progressive with mental retardation) (CLN8, Accession NP_061764.2) is another GAM7776 target gene, herein designated TARGET GENE. CLN8 BINDING SITE is a target binding site found in the 3' untranslated region of mRNA encoded by CLN8, corresponding to a target binding site such as BINDING SITE I, BINDING SITE II or BINDING SITE III of FIG. 8. Table 4 illustrates the complementarity of the nucleotide sequences of CLN8 BINDING SITE, designated SEQ ID:515, to the nucleotide sequence of GAM7776 RNA, herein designated GAM RNA, also designated SEQ ID:246.

Another function of GAM7776 is therefore inhibition of Ceroid-lipofuscinosis, neuronal 8 (epilepsy, progressive with mental retardation) (CLN8, Accession NP_061764.2). Accordingly, utilities of GAM7776 include diagnosis, prevention and treatment of diseases and clinical conditions associated with CLN8.

Chloride channel, nucleotide-sensitive, 1a (CLNS1A, Accession NP_001284.1) is another GAM7776 target gene, herein designated TARGET GENE. CLNS1A BINDING SITE is a target binding site found in the 3' untranslated region of mRNA encoded by CLNS1A, corresponding to a target binding site such as BINDING SITE I, BINDING SITE II or BINDING SITE III of FIG. 8. Table 4 illustrates the complementarity of the nucleotide sequences of CLNS1A BINDING SITE, designated SEQ ID:18823, to the nucleotide sequence of GAM7776 RNA, herein designated GAM RNA, also designated SEQ ID:246.

Another function of GAM7776 is therefore inhibition of Chloride channel, nucleotide-sensitive, 1a (CLNS1A, Accession NP_001284.1), a gene which may participate in cellular volume control. Accordingly, utilities of GAM7776 include diagnosis, prevention and treatment of diseases and clinical conditions associated with CLNS1A.

The function of CLNS1A and its association with various diseases and clinical conditions, has been established by previous studies, as described hereinabove with reference to GAM96.1. Cell matrix adhesion regulator (CMAR, Accession NP_005191.2) is another GAM7776 target gene, herein designated TARGET GENE. CMAR BINDING SITE1 and CMAR BINDING SITE2 are target binding sites found in untranslated regions of mRNA encoded by CMAR, corresponding to target binding sites such as BINDING SITE I, BINDING SITE II or BINDING SITE III of FIG. 8. Table 4 illustrates the complementarity of the nucleotide sequences of CMAR BINDING SITE1 and CMAR BINDING SITE2, designated SEQ ID:18767 and SEQ ID:5053 respectively, to the nucleotide sequence of GAM7776 RNA, herein designated GAM RNA, also designated SEQ ID:246.

Another function of GAM7776 is therefore inhibition of Cell matrix adhesion regulator (CMAR, Accession NP_005191.2). Accordingly, utilities of GAM7776 include diagnosis, prevention and treatment of diseases and clinical conditions associated with CMAR.

Calponin 2 (CNN2, Accession NP_004359.1) is another GAM7776 target gene, herein designated TARGET GENE. CNN2 BINDING SITE is a target binding site found in the 3' untranslated region of mRNA encoded by CNN2, corresponding to a target binding site such as BINDING SITE I, BINDING SITE II or BINDING SITE III of FIG. 8. Table 4 illustrates the complementarity of the nucleotide sequences of CNN2 BINDING SITE, designated SEQ ID:9959, to the nucleotide sequence of GAM7776 RNA, herein designated GAM RNA, also designated SEQ ID:246.

Another function of GAM7776 is therefore inhibition of Calponin 2 (CNN2, Accession NP_004359.1), a gene which may be involved in the structural organization and/or anchorage of actin filaments. Accordingly, utilities of GAM7776 include diagnosis, prevention and treatment of diseases and clinical conditions associated with CNN2.

The function of CNN2 and its association with various diseases and clinical conditions, has been established by previous studies, as described hereinabove with reference to GAM136.1. 2',3'-cyclic nucleotide 3' phosphodiesterase (CNP, Accession NP_149124.1) is another GAM7776 target gene, herein designated TARGET GENE. CNP BINDING SITE is a target binding site found in the 3' untranslated region of mRNA encoded by CNP, corresponding to a target binding site such as BINDING SITE I, BINDING SITE II or BINDING SITE III of FIG. 8. Table 4 illustrates the complementarity of the nucleotide sequences of CNP BINDING SITE, designated SEQ ID:606, to the nucleotide sequence of GAM7776 RNA, herein designated GAM RNA, also designated SEQ ID:246.

Another function of GAM7776 is therefore inhibition of 2',3'-cyclic nucleotide 3' phosphodiesterase (CNP, Accession NP_149124.1), a gene which can link tubulin to membranes and may regulate cytoplasmic microtubule distribution. Accordingly, utilities of GAM7776 include diagnosis, prevention and treatment of diseases and clinical conditions associated with CNP.

The function of CNP and its association with various diseases and clinical conditions, has been established by previous studies, as described hereinabove with reference to GAM189.1. Collectin sub-family member 12 (COLEC12, Accession NP_110408.2) is another GAM7776 target gene, herein designated TARGET GENE. COLEC12 BINDING SITE is a target binding site found in the 3' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:11525, to the nucleotide sequence of GAM7776 RNA, herein designated GAM RNA, also designated SEQ ID:246.

Another function of GAM7776 is therefore inhibition of Collectin sub-family member 12 (COLEC12, Accession NP_110408.2). Accordingly, utilities of GAM7776 include diagnosis, prevention and treatment of diseases and clinical conditions associated with COLEC12.

Coronin, actin binding protein, 1c (CORO1C, Accession NP_055140.1) is another GAM7776 target gene, herein designated TARGET GENE. CORO1C BINDING SITE is a target binding site found in the 3' untranslated region of mRNA encoded by CORO1C, corresponding to a target binding site such as BINDING SITE I, BINDING SITE II or BINDING SITE III of FIG. 8. Table 4 illustrates the complementarity of the nucleotide sequences of CORO1C BINDING SITE, designated SEQ ID:13595, to the nucleotide sequence of GAM7776 RNA, herein designated GAM RNA, also designated SEQ ID:246.

Another function of GAM7776 is therefore inhibition of Coronin, actin binding protein, 1c (CORO1C, Accession NP_055140.1). Accordingly, utilities of GAM7776 include diagnosis, prevention and treatment of diseases and clinical conditions associated with CORO1C.

Cox15 homolog, cytochrome c oxidase assembly protein (yeast) (COX15, Accession NP_510870.1) is another GAM7776 target gene, herein designated TARGET GENE. COX15 BINDING SITE is a target binding site found in the 3' untranslated region of multiple transcripts of mRNA encoded by COX15, corresponding to a target binding site such as BINDING SITE I, BINDING SITE II or BINDING SITE III of FIG. 8. Table 4 illustrates the complementarity of the nucleotide sequences of COX15 BINDING SITE, designated SEQ ID:7552, to the nucleotide sequence of GAM7776 RNA, herein designated GAM RNA, also designated SEQ ID:246.

Another function of GAM7776 is therefore inhibition of Cox15 homolog, cytochrome c oxidase assembly protein (yeast) (COX15, Accession NP_510870.1). Accordingly, utilities of GAM7776 include diagnosis, prevention and treatment of diseases and clinical conditions associated with COX15.

Carboxypeptidase a4 (CPA4, Accession NP_057436.1) is another GAM7776 target gene, herein designated TARGET GENE. CPA4 BINDING SITE is a target binding site found in the 3' untranslated region of mRNA encoded by CPA4, corresponding to a target binding site such as BINDING SITE I, BINDING SITE II or BINDING SITE III of FIG. 8. Table 4 illustrates the complementarity of the nucleotide sequences of CPA4 BINDING SITE, designated SEQ ID:8942, to the nucleotide sequence of GAM7776 RNA, herein designated GAM RNA, also designated SEQ ID:246.

Another function of GAM7776 is therefore inhibition of Carboxypeptidase a4 (CPA4, Accession NP_057436.1). Accordingly, utilities of GAM7776 include diagnosis, prevention and treatment of diseases and clinical conditions associated with CPA4.

CPR8 (Accession NP_065790.1) is another GAM7776 target gene, herein designated TARGET GENE. CPR8 BINDING SITE is a target binding site found in the 3' untranslated region of multiple transcripts of mRNA encoded by CPR8, corresponding to a target binding site such as BINDING SITE I, BINDING SITE II or BINDING SITE III of FIG. 8. Table 4 illustrates the complementarity of the nucleotide sequences of CPR8 BINDING SITE, designated SEQ ID:13999, to the nucleotide sequence of GAM7776 RNA, herein designated GAM RNA, also designated SEQ ID:246.

Another function of GAM7776 is therefore inhibition of CPR8 (Accession NP_065790.1). Accordingly, utilities of GAM7776 include diagnosis, prevention and treatment of diseases and clinical conditions associated with CPR8.

Carbamoyl-phosphate synthetase 1, mitochondrial (CPS1, Accession NP_001866.2) is another GAM7776 target gene, herein designated TARGET GENE. CPS1 BINDING SITE is a target binding site found in the 3' untranslated region of mRNA encoded by CPS1, corresponding to a target binding site such as BINDING SITE I, BINDING SITE II or BINDING SITE III of FIG. 8. Table 4 illustrates the complementarity of the nucleotide sequences of CPS1 BINDING SITE, designated SEQ ID:14493, to the nucleotide sequence of GAM7776 RNA, herein designated GAM RNA, also designated SEQ ID:246.

Another function of GAM7776 is therefore inhibition of Carbamoyl-phosphate synthetase 1, mitochondrial (CPS1, Accession NP_001866.2). Accordingly, utilities of GAM7776 include diagnosis, prevention and treatment of diseases and clinical conditions associated with CPS1.

Cleavage and polyadenylation specific factor 2, 100 kda (CPSF2, Accession XP_029311.2) is another GAM7776 target gene, herein designated TARGET GENE. CPSF2 BINDING SITE1 and CPSF2 BINDING SITE2 are target binding sites found in untranslated regions of mRNA encoded by CPSF2, corresponding to target binding sites such as BINDING SITE I, BINDING SITE II or BINDING SITE III of FIG. 8. Table 4 illustrates the complementarity of the nucleotide sequences of CPSF2 BINDING SITE1 and CPSF2 BINDING SITE2, designated SEQ ID:1877 and SEQ ID:591 respectively, to the nucleotide sequence of GAM7776 RNA, herein designated GAM RNA, also designated SEQ ID:246.

Another function of GAM7776 is therefore inhibition of Cleavage and polyadenylation specific factor 2, 100 kda (CPSF2, Accession XP_029311.2). Accordingly, utilities of GAM7776 include diagnosis, prevention and treatment of diseases and clinical conditions associated with CPSF2.

Complement component (3b/4b) receptor 1, including knops blood group system (CR1, Accession NP_000564.1) is another GAM7776 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:17292, to the nucleotide sequence of GAM7776 RNA, herein designated GAM RNA, also designated SEQ ID:246.

Another function of GAM7776 is therefore inhibition of Complement component (3b/4b) receptor 1, including knops blood group system (CR1, Accession NP_000564.1). Accordingly, utilities of GAM7776 include diagnosis, prevention and treatment of diseases and clinical conditions associated with CR1.

Complement component (3b/4b) receptor 1, including knops blood group system (CR1, Accession NP_000642.2) is another GAM7776 target gene, herein designated TARGET GENE. CR1 BINDING SITE is a target binding site found in the 3' untranslated region of multiple transcripts of mRNA encoded by CR1, corresponding to a target binding site such as BINDING SITE I, BINDING SITE II or BINDING SITE III of FIG. 8. Table 4 illustrates the complementarity of the nucleotide sequences of CR1 BINDING SITE, designated SEQ ID:17292, to the nucleotide sequence of GAM7776 RNA, herein designated GAM RNA, also designated SEQ ID:246.

Another function of GAM7776 is therefore inhibition of Complement component (3b/4b) receptor 1, including knops blood group system (CR1, Accession NP_000642.2). Accordingly, utilities of GAM7776 include diagnosis, prevention and treatment of diseases and clinical conditions associated with CR1.

Cytokine receptor-like factor 3 (CRLF3, Accession NP_057070.2) is another GAM7776 target gene, herein designated TARGET GENE. CRLF3 BINDING SITE is a target binding site found in the 3' untranslated region of mRNA encoded by CRLF3, corresponding to a target binding site such as BINDING SITE I, BINDING SITE II or BINDING SITE III of FIG. 8. Table 4 illustrates the complementarity of the nucleotide sequences of CRLF3 BINDING SITE, designated SEQ ID:7105, to the nucleotide sequence of GAM7776 RNA, herein designated GAM RNA, also designated SEQ ID:246.

Another function of GAM7776 is therefore inhibition of Cytokine receptor-like factor 3 (CRLF3, Accession NP_057070.2). Accordingly, utilities of GAM7776 include diagnosis, prevention and treatment of diseases and clinical conditions associated with CRLF3.

Cofactor required for sp1 transcriptional activation, subunit 6, 77 kda (CRSP6, Accession NP_004259.3) is another GAM7776 target gene, herein designated TARGET GENE. CRSP6 BINDING SITE is a target binding site found in the 3' untranslated region of mRNA encoded by CRSP6, corresponding to a target binding site such as BINDING SITE I, BINDING SITE II or BINDING SITE III of FIG. 8. Table 4 illustrates the complementarity of the nucleotide sequences of CRSP6 BINDING SITE, designated SEQ ID:7661, to the nucleotide sequence of GAM7776 RNA, herein designated GAM RNA, also designated SEQ ID:246.

Another function of GAM7776 is therefore inhibition of Cofactor required for sp1 transcriptional activation, subunit 6, 77 kda (CRSP6, Accession NP_004259.3), a gene which is required for Sp1 mediated transcriptional activation with TAF (II)s. Accordingly, utilities of GAM7776 include diagnosis, prevention and treatment of diseases and clinical conditions associated with CRSP6.

The function of CRSP6 and its association with various diseases and clinical conditions, has been established by previous studies, as described hereinabove with reference to GAM189.1. Cartilage associated protein (CRTAP, Accession NP_006362.1) is another GAM7776 target gene, herein designated TARGET GENE. CRTAP BINDING SITE is a target binding site found in the 3' untranslated region of mRNA encoded by CRTAP, corresponding to a target binding site such as BINDING SITE I, BINDING SITE II or BINDING SITE III of FIG. 8. Table 4 illustrates the complementarity of the nucleotide sequences of CRTAP BINDING SITE, designated SEQ ID:7107, to the nucleotide sequence of GAM7776 RNA, herein designated GAM RNA, also designated SEQ ID:246.

Another function of GAM7776 is therefore inhibition of Cartilage associated protein (CRTAP, Accession NP_006362.1), a gene which is a novel developmentally regulated chick embryo protein. Accordingly, utilities of GAM7776 include diagnosis, prevention and treatment of diseases and clinical conditions associated with CRTAP.

The function of CRTAP and its association with various diseases and clinical conditions, has been established by previous studies, as described hereinabove with reference to GAM136.1. CSE-C (Accession NP_061851.1) is another GAM7776 target gene, herein designated TARGET GENE. CSE-C BINDING SITE is a target binding site found in the 5' untranslated region of multiple transcripts of mRNA encoded by CSE-C, corresponding to a target binding site such as BINDING SITE I, BINDING SITE II or BINDING SITE III of FIG. 8. Table 4 illustrates the complementarity of the nucleotide sequences of CSE-C BINDING SITE, designated SEQ ID:2336, to the nucleotide sequence of GAM7776 RNA, herein designated GAM RNA, also designated SEQ ID:246.

Another function of GAM7776 is therefore inhibition of CSE-C (Accession NP_061851.1). Accordingly, utilities of GAM7776 include diagnosis, prevention and treatment of diseases and clinical conditions associated with CSE-C.

Cse1 chromosome segregation 1-like (yeast) (CSE1L, Accession NP_803185.1) is another GAM7776 target gene, herein designated TARGET GENE. CSE1L BINDING SITE is a target binding site found in the 3' untranslated region of multiple transcripts of mRNA encoded by CSE1L, corresponding to a target binding site such as BINDING SITE I, BINDING SITE II or BINDING SITE III of FIG. 8. Table 4 illustrates the complementarity of the nucleotide sequences of CSE1L BINDING SITE, designated SEQ ID:6312, to the nucleotide sequence of GAM7776 RNA, herein designated GAM RNA, also designated SEQ ID:246.

Another function of GAM7776 is therefore inhibition of Cse1 chromosome segregation 1-like (yeast) (CSE1L, Accession NP_803185.1). Accordingly, utilities of GAM7776 include diagnosis, prevention and treatment of diseases and clinical conditions associated with CSE1L.

Casein kinase 2, alpha prime polypeptide (CSNK2A2, Accession NP_001887.1) is another GAM7776 target gene, herein designated TARGET GENE. CSNK2A2 BINDING SITE is a target binding site found in the 5' untranslated region of mRNA encoded by CSNK2A2, corresponding to a target binding site such as BINDING SITE I, BINDING SITE II or BINDING SITE III of FIG. 8. Table 4 illustrates the complementarity of the nucleotide sequences of CSNK2A2 BINDING SITE, designated SEQ ID:15382, to the nucleotide sequence of GAM7776 RNA, herein designated GAM RNA, also designated SEQ ID:246.

Another function of GAM7776 is therefore inhibition of Casein kinase 2, alpha prime polypeptide (CSNK2A2, Accession NP_001887.1), a gene which catalyzes the phosphorylation of serine or threonine residues in proteins. Accordingly, utilities of GAM7776 include diagnosis, prevention and treatment of diseases and clinical conditions associated with CSNK2A2.

The function of CSNK2A2 and its association with various diseases and clinical conditions, has been established by previous studies, as described hereinabove with reference to GAM189.1. CTEN (Accession NP_116254.3) is another GAM7776 target gene, herein designated TARGET GENE. CTEN BINDING SITE is a target binding site found in the 3' untranslated region of mRNA encoded by CTEN, corresponding to a target binding site such as BINDING SITE I, BINDING SITE II or BINDING SITE III of FIG. 8. Table 4 illustrates the complementarity of the nucleotide sequences of CTEN BINDING SITE, designated SEQ ID:14746, to the nucleotide sequence of GAM7776 RNA, herein designated GAM RNA, also designated SEQ ID:246.

Another function of GAM7776 is therefore inhibition of CTEN (Accession NP_116254.3). Accordingly, utilities of GAM7776 include diagnosis, prevention and treatment of diseases and clinical conditions associated with CTEN.

Cardiotrophin 1 (CTF1, Accession NP_001321.1) is another GAM7776 target gene, herein designated TARGET GENE. CTF1 BINDING SITE is a target binding site found in the 3' untranslated region of mRNA encoded by CTF1, corresponding to a target binding site such as BINDING SITE I, BINDING SITE II or BINDING SITE III of FIG. 8. Table 4 illustrates the complementarity of the nucleotide sequences of CTF1 BINDING SITE, designated SEQ ID:13287, to the nucleotide sequence of GAM7776 RNA, herein designated GAM RNA, also designated SEQ ID:246.

Another function of GAM7776 is therefore inhibition of Cardiotrophin 1 (CTF1, Accession NP_001321.1), a gene which may play a role in cardiac hypertrophy. and therefore may be associated with Cardiac hypertrophy. Accordingly, utilities of GAM7776 include diagnosis, prevention and treatment of Cardiac hypertrophy, and of other diseases and clinical conditions associated with CTF1.

The function of CTF1 and its association with various diseases and clinical conditions, has been established by previous studies, as described hereinabove with reference to GAM189.1. Cathepsin s (CTSS, Accession NP_004070.3) is another GAM7776 target gene, herein designated TARGET GENE. CTSS BINDING SITE is a target binding site found in the 3' untranslated region of mRNA encoded by CTSS, corresponding to a target binding site such as BINDING SITE I, BINDING SITE II or BINDING SITE III of FIG. 8. Table 4 illustrates the complementarity of the nucleotide sequences of CTSS BINDING SITE, designated SEQ ID:4517, to the nucleotide sequence of GAM7776 RNA, herein designated GAM RNA, also designated SEQ ID:246.

Another function of GAM7776 is therefore inhibition of Cathepsin s (CTSS, Accession NP_004070.3), a gene which is a lysosomal cysteine (thiol) protease that cleaves elastin. Accordingly, utilities of GAM7776 include diagnosis, prevention and treatment of diseases and clinical conditions associated with CTSS.

The function of CTSS and its association with various diseases and clinical conditions, has been established by previous studies, as described hereinabove with reference to GAM72.1. Chemokine (c-x-c motif) ligand 16 (CXCL16, Accession NP_071342.1) is another GAM7776 target gene, herein designated TARGET GENE. CXCL16 BINDING SITE is a target binding site found in the 3' untranslated region of mRNA encoded by CXCL16, corresponding to a target binding site such as BINDING SITE I, BINDING SITE II or BINDING SITE III of FIG. 8. Table 4 illustrates the complementarity of the nucleotide sequences of CXCL16 BINDING SITE, designated SEQ ID:17688, to the nucleotide sequence of GAM7776 RNA, herein designated GAM RNA, also designated SEQ ID:246.

Another function of GAM7776 is therefore inhibition of Chemokine (c-x-c motif) ligand 16 (CXCL16, Accession NP_071342.1), a gene which induces calcium mobilization. Accordingly, utilities of GAM7776 include diagnosis, prevention and treatment of diseases and clinical conditions associated with CXCL16.

The function of CXCL16 and its association with various diseases and clinical conditions, has been established by previous studies, as described hereinabove with reference to GAM189.1. CYCS (Accession NP_061820.1) is another GAM7776 target gene, herein designated TARGET GENE. CYCS BINDING SITE1 through CYCS BINDING SITE3 are target binding sites found in untranslated regions of mRNA encoded by CYCS, corresponding to target binding sites such as BINDING SITE I, BINDING SITE II or BINDING SITE III of FIG. 8. Table 4 illustrates the complementarity of the nucleotide sequences of CYCS BINDING SITE1 through CYCS BINDING SITE3, designated SEQ ID:18868, SEQ ID:9339 and SEQ ID:18991 respectively, to the nucleotide sequence of GAM7776 RNA, herein designated GAM RNA, also designated SEQ ID:246.

Another function of GAM7776 is therefore inhibition of CYCS (Accession NP_061820.1). Accordingly, utilities of GAM7776 include diagnosis, prevention and treatment of diseases and clinical conditions associated with CYCS.

Cylicin, basic protein of sperm head cytoskeleton 2 (CYLC2, Accession NP_001331.1) is another GAM7776 target gene, herein designated TARGET GENE. CYLC2 BINDING SITE is a target binding site found in the 3' untranslated region of mRNA encoded by CYLC2, corresponding to a target binding site such as BINDING SITE I, BINDING SITE II or BINDING SITE III of FIG. 8. Table 4 illustrates the complementarity of the nucleotide sequences of CYLC2 BINDING SITE, designated SEQ ID:15540, to the nucleotide sequence of GAM7776 RNA, herein designated GAM RNA, also designated SEQ ID:246.

Another function of GAM7776 is therefore inhibition of Cylicin, basic protein of sperm head cytoskeleton 2 (CYLC2, Accession NP_001331.1). Accordingly, utilities of GAM7776 include diagnosis, prevention and treatment of diseases and clinical conditions associated with CYLC2.

Cytochrome p450, subfamily i (aromatic compound-inducible), polypeptide 2 (CYP1A2, Accession NP_000752.1) is another GAM7776 target gene, herein designated TARGET GENE. CYP1A2 BINDING SITE1 through CYP1A2 BINDING SITE3 are target binding sites found in untranslated regions of mRNA encoded by CYP1A2, corresponding to target binding sites such as BINDING SITE I, BINDING SITE II or BINDING SITE III of FIG. 8. Table 4 illustrates the complementarity of the nucleotide sequences of CYP1A2 BINDING SITE1 through CYP1A2 BINDING SITE3, designated SEQ ID:6637, SEQ ID:13576 and SEQ ID:18279 respectively, to the nucleotide sequence of GAM7776 RNA, herein designated GAM RNA, also designated SEQ ID:246.

Another function of GAM7776 is therefore inhibition of Cytochrome p450, subfamily i (aromatic compound-inducible), polypeptide 2 (CYP1A2, Accession NP_000752.1), a gene which intervenes in an NADPH-dependent electron transport pathway. and therefore may be associated with Porphyria cutanea tarda. Accordingly, utilities of GAM7776 include diagnosis, prevention and treatment of Porphyria cutanea tarda, and of other diseases and clinical conditions associated with CYP1A2.

The function of CYP1A2 and its association with various diseases and clinical conditions, has been established by previous studies, as described hereinabove with reference to GAM30.1. Cytochrome p450, subfamily iib (phenobarbital-inducible), polypeptide 6 (CYP2B6, Accession NP_000758.1) is another GAM7776 target gene, herein designated TARGET GENE. CYP2B6 BINDING SITE1 and CYP2B6 BINDING SITE2 are target binding sites found in untranslated regions of mRNA encoded by CYP2B6, corresponding to target binding sites such as BINDING SITE I, BINDING SITE II or BINDING SITE III of FIG. 8. Table 4 illustrates the complementarity of the nucleotide sequences of CYP2B6 BINDING SITE1 and CYP2B6 BINDING SITE2, designated SEQ ID:2194 and SEQ ID:10618 respectively, to the nucleotide sequence of GAM7776 RNA, herein designated GAM RNA, also designated SEQ ID:246.

Another function of GAM7776 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM7776 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. Cytochrome p450, subfamily ivf, polypeptide 3 (leukotriene b4 omega hydroxylase) (CYP4F3, Accession NP_000887.1) is another GAM7776 target gene, herein designated TARGET GENE. CYP4F3 BINDING SITE is a target binding site found in the 3' untranslated region of mRNA encoded by CYP4F3, corresponding to a target binding site such as BINDING SITE I, BINDING SITE II or BINDING SITE III of FIG. 8. Table 4 illustrates the complementarity of the nucleotide sequences of CYP4F3 BINDING SITE, designated SEQ ID:9158, to the nucleotide sequence of GAM7776 RNA, herein designated GAM RNA, also designated SEQ ID:246.

Another function of GAM7776 is therefore inhibition of Cytochrome p450, subfamily ivf, polypeptide 3 (leukotriene b4 omega hydroxylase) (CYP4F3, Accession NP_000887.1), a gene which converts leukotriene B4 into the less active 20-hydroxy-leukotriene B4. Accordingly, utilities of GAM7776 include diagnosis, prevention and treatment of diseases and clinical conditions associated with CYP4F3.

The function of CYP4F3 and its association with various diseases and clinical conditions, has been established by previous studies, as described hereinabove with reference to GAM67.1. CYP51A1 (Accession NP_000777.1) is another GAM7776 target gene, herein designated TARGET GENE. CYP51A1 BINDING SITE is a target binding site found in the 3' untranslated region of mRNA encoded by CYP51A1, corresponding to a target binding site such as BINDING SITE I, BINDING SITE II or BINDING SITE III of FIG. 8. Table 4 illustrates the complementarity of the nucleotide sequences of CYP51A1 BINDING SITE, designated SEQ ID:2152, to the nucleotide sequence of GAM7776 RNA, herein designated GAM RNA, also designated SEQ ID:246.

Another function of GAM7776 is therefore inhibition of CYP51A1 (Accession NP_000777.1). Accordingly, utilities of GAM7776 include diagnosis, prevention and treatment of diseases and clinical conditions associated with CYP51A1.

Cytochrome p450, subfamily viiib (sterol 12-alpha-hydroxylase), polypeptide 1 (CYP8B1, Accession NP_004382.1) is another GAM7776 target gene, herein designated TARGET GENE. CYP8B1 BINDING SITE is a target binding site found in the 3' untranslated region of mRNA encoded by CYP8B1, corresponding to a target binding site such as BINDING SITE I, BINDING SITE II or BINDING SITE III of FIG. 8. Table 4 illustrates the complementarity of the nucleotide sequences of CYP8B1 BINDING SITE, designated SEQ ID:5978, to the nucleotide sequence of GAM7776 RNA, herein designated GAM RNA, also designated SEQ ID:246.

Another function of GAM7776 is therefore inhibition of Cytochrome p450, subfamily viiib (sterol 12-alpha-hydroxylase), polypeptide 1 (CYP8B1, Accession NP_004382.1), a gene which functions in bile acid biosynthesis. Accordingly, utilities of GAM7776 include diagnosis, prevention and treatment of diseases and clinical conditions associated with CYP8B1.

The function of CYP8B1 and its association with various diseases and clinical conditions, has been established by previous studies, as described hereinabove with reference to GAM47.1. Debranching enzyme homolog 1 (s. cerevisiae) (DBR1, Accession NP_057300.1) is another GAM7776 target gene, herein designated TARGET GENE. DBR1 BINDING SITE is a target binding site found in the 3' untranslated region of mRNA encoded by DBR1, corresponding to a target binding site such as BINDING SITE I, BINDING SITE II or BINDING SITE III of FIG. 8. Table 4 illustrates the complementarity of the nucleotide sequences of DBR1 BINDING SITE, designated SEQ ID:7961, to the nucleotide sequence of GAM7776 RNA, herein designated GAM RNA, also designated SEQ ID:246.

Another function of GAM7776 is therefore inhibition of Debranching enzyme homolog 1 (s. cerevisiae) (DBR1, Accession NP_057300.1). Accordingly, utilities of GAM7776 include diagnosis, prevention and treatment of diseases and clinical conditions associated with DBR1.

Doublecortex; lissencephaly, x-linked (doublecortin) (DCX, Accession NP_835365.1) is another GAM7776 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM7776 RNA, herein designated GAM RNA, also designated SEQ ID:246.

Another function of GAM7776 is therefore inhibition of Doublecortex; lissencephaly, x-linked (doublecortin) (DCX, Accession NP_835365.1). Accordingly, utilities of GAM7776 include diagnosis, prevention and treatment of diseases and clinical conditions associated with DCX.

Doublecortex; lissencephaly, x-linked (doublecortin) (DCX, Accession NP_000546.2) is another GAM7776 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM7776 RNA, herein designated GAM RNA, also designated SEQ ID:246.

Another function of GAM7776 is therefore inhibition of Doublecortex; lissencephaly, x-linked (doublecortin) (DCX, Accession NP_000546.2). Accordingly, utilities of GAM7776 include diagnosis, prevention and treatment of diseases and clinical conditions associated with DCX.

Doublecortex; lissencephaly, x-linked (doublecortin) (DCX, Accession NP_835364.1) is another GAM7776 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM7776 RNA, herein designated GAM RNA, also designated SEQ ID:246.

Another function of GAM7776 is therefore inhibition of Doublecortex; lissencephaly, x-linked (doublecortin) (DCX, Accession NP_835364.1). Accordingly, utilities of GAM7776 include diagnosis, prevention and treatment of diseases and clinical conditions associated with DCX.

Doublecortex; lissencephaly, x-linked (doublecortin) (DCX, Accession NP_835366.1) is another GAM7776 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:16590, to the nucleotide sequence of GAM7776 RNA, herein designated GAM RNA, also designated SEQ ID:246.

Another function of GAM7776 is therefore inhibition of Doublecortex; lissencephaly, x-linked (doublecortin) (DCX, Accession NP_835366.1). Accordingly, utilities of GAM7776 include diagnosis, prevention and treatment of diseases and clinical conditions associated with DCX.

Desmin (DES, Accession NP_001918.2) is another GAM7776 target gene, herein designated TARGET GENE. DES BINDING SITE is a target binding site found in the 3' untranslated region of mRNA encoded by DES, corresponding to a target binding site such as BINDING SITE I, BINDING SITE II or BINDING SITE III of FIG. 8. Table 4 illustrates the complementarity of the nucleotide sequences of DES BINDING SITE, designated SEQ ID:14498, to the nucleotide sequence of GAM7776 RNA, herein designated GAM RNA, also designated SEQ ID:246.

Another function of GAM7776 is therefore inhibition of Desmin (DES, Accession NP_001918.2). Accordingly, utilities of GAM7776 include diagnosis, prevention and treatment of diseases and clinical conditions associated with DES.

Dna fragmentation factor, 40 kda, beta polypeptide (caspase-activated dnase) (DFFB, Accession NP_004393.1) is another GAM7776 target gene, herein designated TARGET GENE. DFFB BINDING SITE1 and DFFB BINDING SITE2 are target binding sites found in untranslated regions of mRNA encoded by DFFB, corresponding to target binding sites such as BINDING SITE I, BINDING SITE II or BINDING SITE III of FIG. 8. Table 4 illustrates the complementarity of the nucleotide sequences of DFFB BINDING SITE1 and DFFB BINDING SITE2, designated SEQ ID:9091 and SEQ ID:2019 respectively, to the nucleotide sequence of GAM7776 RNA, herein designated GAM RNA, also designated SEQ ID:246.

Another function of GAM7776 is therefore inhibition of Dna fragmentation factor, 40 kda, beta polypeptide (caspase-activated dnase) (DFFB, Accession NP_004393.1), a gene which induces DNA fragmentation and chromatin condensation during apoptosis. Accordingly, utilities of GAM7776 include diagnosis, prevention and treatment of diseases and clinical conditions associated with DFFB.

The function of DFFB and its association with various diseases and clinical conditions, has been established by previous studies, as described hereinabove with reference to GAM130.1. Dihydrofolate reductase (DHFR, Accession NP_000782.1) is another GAM7776 target gene, herein designated TARGET GENE. DHFR BINDING SITE is a target binding site found in the 3' untranslated region of mRNA encoded by DHFR, corresponding to a target binding site such as BINDING SITE I, BINDING SITE II or BINDING SITE III of FIG. 8. Table 4 illustrates the complementarity of the nucleotide sequences of DHFR BINDING SITE, designated SEQ ID:8052, to the nucleotide sequence of GAM7776 RNA, herein designated GAM RNA, also designated SEQ ID:246.

Another function of GAM7776 is therefore inhibition of Dihydrofolate reductase (DHFR, Accession NP_000782.1), a gene which converts dihydrofolate into tetrahydrofolate. Accordingly, utilities of GAM7776 include diagnosis, prevention and treatment of diseases and clinical conditions associated with DHFR.

The function of DHFR and its association with various diseases and clinical conditions, has been established by previous studies, as described hereinabove with reference to GAM64.1. Diaphanous homolog 2 (drosophila) (DIAPH2, Accession NP_006720.1) is another GAM7776 target gene, herein designated TARGET GENE. DIAPH2 BINDING SITE is a target binding site found in the 3' untranslated region of multiple transcripts of mRNA encoded by DIAPH2, corresponding to a target binding site such as BINDING SITE I, BINDING SITE II or BINDING SITE III of FIG. 8. Table 4 illustrates the complementarity of the nucleotide sequences of DIAPH2 BINDING SITE, designated SEQ ID:14492, to the nucleotide sequence of GAM7776 RNA, herein designated GAM RNA, also designated SEQ ID:246.

Another function of GAM7776 is therefore inhibition of Diaphanous homolog 2 (drosophila) (DIAPH2, Accession NP_006720.1), a gene which may affect in oogenesis and therefore may be associated with Premature ovarian failure. Accordingly, utilities of GAM7776 include diagnosis, prevention and treatment of Premature ovarian failure., and of other diseases and clinical conditions associated with DIAPH2.

The function of DIAPH2 and its association with various diseases and clinical conditions, has been established by previous studies, as described hereinabove with reference to GAM66.1. Disrupted in schizophrenia 1 (DISC1, Accession NP_061132.1) is another GAM7776 target gene, herein designated TARGET GENE. DISC1 BINDING SITE is a target binding site found in the 3' untranslated region of mRNA encoded by DISC1, corresponding to a target binding site such as BINDING SITE I, BINDING SITE II or BINDING SITE III of FIG. 8. Table 4 illustrates the complementarity of the nucleotide sequences of DISC1 BINDING SITE, designated SEQ ID:1298, to the nucleotide sequence of GAM7776 RNA, herein designated GAM RNA, also designated SEQ ID:246.

Another function of GAM7776 is therefore inhibition of Disrupted in schizophrenia 1 (DISC1, Accession NP_061132.1), a gene which has globular N-terminal domain(s) and a helical C-terminal domain. and therefore may be associated with Schizophrenia. Accordingly, utilities of GAM7776 include diagnosis, prevention and treatment of Schizophrenia, and of other diseases and clinical conditions associated with DISC1.

The function of DISC1 and its association with various diseases and clinical conditions, has been established by previous studies, as described hereinabove with reference to GAM116.1. DKFZP434B1727 (Accession NP_115519.1) is another GAM7776 target gene, herein designated TARGET GENE. DKFZP434B1727 BINDING SITE is a target binding site found in the 3' untranslated region of mRNA encoded by DKFZP434B1727, corresponding to a target binding site such as BINDING SITE I, BINDING SITE II or BINDING SITE III of FIG. 8. Table 4 illustrates the complementarity of the nucleotide sequences of DKFZP434B1727 BINDING SITE, designated SEQ ID:4014, to the nucleotide sequence of GAM7776 RNA, herein designated GAM RNA, also designated SEQ ID:246.

Another function of GAM7776 is therefore inhibition of DKFZP434B1727 (Accession NP_115519.1). Accordingly, utilities of GAM7776 include diagnosis, prevention and treatment of diseases and clinical conditions associated with DKFZP434B1727.

DKFZp434C0923 (Accession NP_060068.1) is another GAM7776 target gene, herein designated TARGET GENE. DKFZp434C0923 BINDING SITE is a target binding site found in the 3' untranslated region of mRNA encoded by DKFZp434C0923, corresponding to a target binding site such as BINDING SITE I, BINDING SITE II or BINDING SITE III of FIG. 8. Table 4 illustrates the complementarity of the nucleotide sequences of DKFZp434C0923 BINDING SITE, designated SEQ ID:8235, to the nucleotide sequence of GAM7776 RNA, herein designated GAM RNA, also designated SEQ ID:246.

Another function of GAM7776 is therefore inhibition of DKFZp434C0923 (Accession NP_060068.1). Accordingly, utilities of GAM7776 include diagnosis, prevention and treatment of diseases and clinical conditions associated with DKFZp434C0923.

DKFZP434C212 (Accession XP_044196.3) is another GAM7776 target gene, herein designated TARGET GENE. DKFZP434C212 BINDING SITE is a target binding site found in the 3' untranslated region of mRNA encoded by DKFZP434C212, corresponding to a target binding site such as BINDING SITE I, BINDING SITE II or BINDING SITE III of FIG. 8. Table 4 illustrates the complementarity of the nucleotide sequences of DKFZP434C212 BINDING SITE, designated SEQ ID:8661, to the nucleotide sequence of GAM7776 RNA, herein designated GAM RNA, also designated SEQ ID:246.

Another function of GAM7776 is therefore inhibition of DKFZP434C212 (Accession XP_044196.3). Accordingly, utilities of GAM7776 include diagnosis, prevention and treatment of diseases and clinical conditions associated with DKFZP434C212.

DKFZP434D146 (Accession NP_056410.2) is another GAM7776 target gene, herein designated TARGET GENE. DKFZP434D146 BINDING SITE is a target binding site found in the 3' untranslated region of mRNA encoded by DKFZP434D146, corresponding to a target binding site such as BINDING SITE I, BINDING SITE II or BINDING SITE III of FIG. 8. Table 4 illustrates the complementarity of the nucleotide sequences of DKFZP434D146 BINDING SITE, designated SEQ ID:2209, to the nucleotide sequence of GAM7776 RNA, herein designated GAM RNA, also designated SEQ ID:246.

Another function of GAM7776 is therefore inhibition of DKFZP434D146 (Accession NP_056410.2). Accordingly, utilities of GAM7776 include diagnosis, prevention and treatment of diseases and clinical conditions associated with DKFZP434D146.

DKFZp434E2220 (Accession NP_060082.1) is another GAM7776 target gene, herein designated TARGET GENE. DKFZp434E2220 BINDING SITE is a target binding site found in the 5' untranslated region of mRNA encoded by DKFZp434E2220, corresponding to a target binding site such as BINDING SITE I, BINDING SITE II or BINDING SITE III of FIG. 8. Table 4 illustrates the complementarity of the nucleotide sequences of DKFZp434E2220 BINDING SITE, designated SEQ ID:11326, to the nucleotide sequence of GAM7776 RNA, herein designated GAM RNA, also designated SEQ ID:246.

Another function of GAM7776 is therefore inhibition of DKFZp434E2220 (Accession NP_060082.1). Accordingly, utilities of GAM7776 include diagnosis, prevention and treatment of diseases and clinical conditions associated with DKFZp434E2220.

DKFZP434F0318 (Accession NP_110444.1) is another GAM7776 target gene, herein designated TARGET GENE. DKFZP434F0318 BINDING SITE is a target binding site found in the 3' untranslated region of mRNA encoded by DKFZP434F0318, corresponding to a target binding site such as BINDING SITE I, BINDING SITE II or BINDING SITE III of FIG. 8. Table 4 illustrates the complementarity of the nucleotide sequences of DKFZP434F0318 BINDING SITE, designated SEQ ID:16771, to the nucleotide sequence of GAM7776 RNA, herein designated GAM RNA, also designated SEQ ID:246.

Another function of GAM7776 is therefore inhibition of DKFZP434F0318 (Accession NP_110444.1). Accordingly, utilities of GAM7776 include diagnosis, prevention and treatment of diseases and clinical conditions associated with DKFZP434F0318.

DKFZp434F1719 (Accession NP_115624.1) is another GAM7776 target gene, herein designated TARGET GENE. DKFZp434F1719 BINDING SITE is a target binding site found in the 3' untranslated region of mRNA encoded by DKFZp434F1719, corresponding to a target binding site such as BINDING SITE I, BINDING SITE II or BINDING SITE III of FIG. 8. Table 4 illustrates the complementarity of the nucleotide sequences of DKFZp434F1719 BINDING SITE, designated SEQ ID:3951, to the nucleotide sequence of GAM7776 RNA, herein designated GAM RNA, also designated SEQ ID:246.

Another function of GAM7776 is therefore inhibition of DKFZp434F1719 (Accession NP_115624.1). Accordingly, utilities of GAM7776 include diagnosis, prevention and treatment of diseases and clinical conditions associated with DKFZp434F1719.

DKFZp434K1210 (Accession NP_060076.1) is another GAM7776 target gene, herein designated TARGET GENE. DKFZp434K1210 BINDING SITE is a target binding site found in the 3' untranslated region of mRNA encoded by DKFZp434K1210, corresponding to a target binding site such as BINDING SITE I, BINDING SITE II or BINDING SITE III of FIG. 8. Table 4 illustrates the complementarity of the nucleotide sequences of DKFZp434K1210 BINDING SITE, designated SEQ ID:4195, to the nucleotide sequence of GAM7776 RNA, herein designated GAM RNA, also designated SEQ ID:246.

Another function of GAM7776 is therefore inhibition of DKFZp434K1210 (Accession NP_060076.1). Accordingly, utilities of GAM7776 include diagnosis, prevention and treatment of diseases and clinical conditions associated with DKFZp434K1210.

DKFZp547H025 (Accession NP_064546.1) is another GAM7776 target gene, herein designated TARGET GENE. DKFZp547H025 BINDING SITE is a target binding site found in the 3' untranslated region of mRNA encoded by DKFZp547H025, corresponding to a target binding site such as BINDING SITE I, BINDING SITE II or BINDING SITE III of FIG. 8. Table 4 illustrates the complementarity of the nucleotide sequences of DKFZp547H025 BINDING SITE, designated SEQ ID:14246, to the nucleotide sequence of GAM7776 RNA, herein designated GAM RNA, also designated SEQ ID:246.

Another function of GAM7776 is therefore inhibition of DKFZp547H025 (Accession NP_064546.1). Accordingly, utilities of GAM7776 include diagnosis, prevention and treatment of diseases and clinical conditions associated with DKFZp547H025.

DKFZp547P234 (Accession NP_694590.1) is another GAM7776 target gene, herein designated TARGET GENE. DKFZp547P234 BINDING SITE is a target binding site found in the 3' untranslated region of mRNA encoded by DKFZp547P234, corresponding to a target binding site such as BINDING SITE I, BINDING SITE II or BINDING SITE III of FIG. 8. Table 4 illustrates the complementarity of the nucleotide sequences of DKFZp547P234 BINDING SITE, designated SEQ ID:11057, to the nucleotide sequence of GAM7776 RNA, herein designated GAM RNA, also designated SEQ ID:246.

Another function of GAM7776 is therefore inhibition of DKFZp547P234 (Accession NP_694590.1). Accordingly, utilities of GAM7776 include diagnosis, prevention and treatment of diseases and clinical conditions associated with DKFZp547P234.

DKFZP564G092 (Accession NP_056416.1) is another GAM7776 target gene, herein designated TARGET GENE. DKFZP564G092 BINDING SITE is a target binding site found in the 5' untranslated region of mRNA encoded by DKFZP564G092, corresponding to a target binding site such as BINDING SITE I, BINDING SITE II or BINDING SITE III of FIG. 8. Table 4 illustrates the complementarity of the nucleotide sequences of DKFZP564G092 BINDING SITE, designated SEQ ID:2662, to the nucleotide sequence of GAM7776 RNA, herein designated GAM RNA, also designated SEQ ID:246.

Another function of GAM7776 is therefore inhibition of DKFZP564G092 (Accession NP_056416.1). Accordingly, utilities of GAM7776 include diagnosis, prevention and treatment of diseases and clinical conditions associated with DKFZP564G092.

DKFZP564I122 (Accession XP_032397.1) is another GAM7776 target gene, herein designated TARGET GENE. DKFZP564I122 BINDING SITE is a target binding site found in the 3' untranslated region of mRNA encoded by DKFZP564I122, corresponding to a target binding site such as BINDING SITE I, BINDING SITE II or BINDING SITE III of FIG. 8. Table 4 illustrates the complementarity of the nucleotide sequences of DKFZP564I122 BINDING SITE, designated SEQ ID:16590, to the nucleotide sequence of GAM7776 RNA, herein designated GAM RNA, also designated SEQ ID:246.

Another function of GAM7776 is therefore inhibition of DKFZP564I122 (Accession XP_032397.1). Accordingly, utilities of GAM7776 include diagnosis, prevention and treatment of diseases and clinical conditions associated with DKFZP564I122.

DKFZP564K0322 (Accession NP_114429.1) is another GAM7776 target gene, herein designated TARGET GENE. DKFZP564K0322 BINDING SITE is a target binding site found in the 3' untranslated region of mRNA encoded by DKFZP564K0322, corresponding to a target binding site such as BINDING SITE I, BINDING SITE II or BINDING SITE III of FIG. 8. Table 4 illustrates the complementarity of the nucleotide sequences of DKFZP564K0322 BINDING SITE, designated SEQ ID:17964, to the nucleotide sequence of GAM7776 RNA, herein designated GAM RNA, also designated SEQ ID:246.

Another function of GAM7776 is therefore inhibition of DKFZP564K0322 (Accession NP_114429.1). Accordingly, utilities of GAM7776 include diagnosis, prevention and treatment of diseases and clinical conditions associated with DKFZP564K0322.

DKFZp564K142 (Accession NP_115497.2) is another GAM7776 target gene, herein designated TARGET GENE. DKFZp564K142 BINDING SITE is a target binding site found in the 3' untranslated region of mRNA encoded by DKFZp564K142, corresponding to a target binding site such as BINDING SITE I, BINDING SITE II or BINDING SITE III of FIG. 8. Table 4 illustrates the complementarity of the nucleotide sequences of DKFZp564K142 BINDING SITE, designated SEQ ID:2663, to the nucleotide sequence of GAM7776 RNA, herein designated GAM RNA, also designated SEQ ID:246.

Another function of GAM7776 is therefore inhibition of DKFZp564K142 (Accession NP_115497.2). Accordingly, utilities of GAM7776 include diagnosis, prevention and treatment of diseases and clinical conditions associated with DKFZp564K142.

DKFZP564O0523 (Accession NP_115496.1) is another GAM7776 target gene, herein designated TARGET GENE. DKFZP564O0523 BINDING SITE is a target binding site found in the 3' untranslated region of mRNA encoded by DKFZP564O0523, corresponding to a target binding site such as BINDING SITE I, BINDING SITE II or BINDING SITE III of FIG. 8. Table 4 illustrates the complementarity of the nucleotide sequences of DKFZP564O0523 BINDING SITE, designated SEQ ID:3686, to the nucleotide sequence of GAM7776 RNA, herein designated GAM RNA, also designated SEQ ID:246.

Another function of GAM7776 is therefore inhibition of DKFZP564O0523 (Accession NP_115496.1). Accordingly, utilities of GAM7776 include diagnosis, prevention and treatment of diseases and clinical conditions associated with DKFZP564O0523.

DKFZP566D1346 (Accession NP_110443.1) is another GAM7776 target gene, herein designated TARGET GENE. DKFZP566D1346 BINDING SITE is a target binding site found in the 5' untranslated region of mRNA encoded by DKFZP566D1346, corresponding to a target binding site such as BINDING SITE I, BINDING SITE II or BINDING SITE III of FIG. 8. Table 4 illustrates the complementarity of the nucleotide sequences of DKFZP566D1346 BINDING SITE, designated SEQ ID:10539, to the nucleotide sequence of GAM7776 RNA, herein designated GAM RNA, also designated SEQ ID:246.

Another function of GAM7776 is therefore inhibition of DKFZP566D1346 (Accession NP_110443.1). Accordingly, utilities of GAM7776 include diagnosis, prevention and treatment of diseases and clinical conditions associated with DKFZP566D1346.

DKFZP566I1024 (Accession NP_056226.1) is another GAM7776 target gene, herein designated TARGET GENE. DKFZP566I1024 BINDING SITE is a target binding site found in the 3' untranslated region of mRNA encoded by DKFZP566I1024, corresponding to a target binding site such as BINDING SITE I, BINDING SITE II or BINDING SITE III of FIG. 8. Table 4 illustrates the complementarity of the nucleotide sequences of DKFZP566I1024 BINDING SITE, designated SEQ ID:12353, to the nucleotide sequence of GAM7776 RNA, herein designated GAM RNA, also designated SEQ ID:246.

Another function of GAM7776 is therefore inhibition of DKFZP566I1024 (Accession NP_056226.1). Accordingly, utilities of GAM7776 include diagnosis, prevention and treatment of diseases and clinical conditions associated with DKFZP566I1024.

DKFZp586C0721 (Accession XP_098416.1) is another GAM7776 target gene, herein designated TARGET GENE. DKFZp586C0721 BINDING SITE is a target binding site found in the 3' untranslated region of mRNA encoded by DKFZp586C0721, corresponding to a target binding site such as BINDING SITE I, BINDING SITE II or BINDING SITE III of FIG. 8. Table 4 illustrates the complementarity of the nucleotide sequences of DKFZp586C0721 BINDING SITE, designated SEQ ID:12173, to the nucleotide sequence of GAM7776 RNA, herein designated GAM RNA, also designated SEQ ID:246.

Another function of GAM7776 is therefore inhibition of DKFZp586C0721 (Accession XP_098416.1). Accordingly, utilities of GAM7776 include diagnosis, prevention and treatment of diseases and clinical conditions associated with DKFZp586C0721.

DKFZP586D0919 (Accession NP_056248.1) is another GAM7776 target gene, herein designated TARGET GENE. DKFZP586D0919 BINDING SITE is a target binding site found in the 3' untranslated region of mRNA encoded by DKFZP586D0919, corresponding to a target binding site such as BINDING SITE I, BINDING SITE II or BINDING SITE III of FIG. 8. Table 4 illustrates the complementarity of the nucleotide sequences of DKFZP586D0919 BINDING SITE, designated SEQ ID:11134, to the nucleotide sequence of GAM7776 RNA, herein designated GAM RNA, also designated SEQ ID:246.

Another function of GAM7776 is therefore inhibition of DKFZP586D0919 (Accession NP_056248.1). Accordingly, utilities of GAM7776 include diagnosis, prevention and treatment of diseases and clinical conditions associated with DKFZP586D0919.

DKFZp667B1218 (Accession NP_808881.1) is another GAM7776 target gene, herein designated TARGET GENE. DKFZp667B1218 BINDING SITE is a target binding site found in the 3' untranslated region of mRNA encoded by DKFZp667B1218, corresponding to a target binding site such as BINDING SITE I, BINDING SITE II or BINDING SITE III of FIG. 8. Table 4 illustrates the complementarity of the nucleotide sequences of DKFZp667B1218 BINDING SITE, designated SEQ ID:15574, to the nucleotide sequence of GAM7776 RNA, herein designated GAM RNA, also designated SEQ ID:246.

Another function of GAM7776 is therefore inhibition of DKFZp667B1218 (Accession NP_808881.1). Accordingly, utilities of GAM7776 include diagnosis, prevention and treatment of diseases and clinical conditions associated with DKFZp667B1218.

DKFZp667E0512 (Accession XP_117353.1) is another GAM7776 target gene, herein designated TARGET GENE. DKFZp667E0512 BINDING SITE is a target binding site found in the 3' untranslated region of mRNA encoded by DKFZp667E0512, corresponding to a target binding site such as BINDING SITE I, BINDING SITE II or BINDING SITE III of FIG. 8. Table 4 illustrates the complementarity of the nucleotide sequences of DKFZp667E0512 BINDING SITE, designated SEQ ID:8492, to the nucleotide sequence of GAM7776 RNA, herein designated GAM RNA, also designated SEQ ID:246.

Another function of GAM7776 is therefore inhibition of DKFZp667E0512 (Accession XP_117353.1). Accordingly, utilities of GAM7776 include diagnosis, prevention and treatment of diseases and clinical conditions associated with DKFZp667E0512.

DKFZp761B107 (Accession NP_775734.1) is another GAM7776 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:13571, to the nucleotide sequence of GAM7776 RNA, herein designated GAM RNA, also designated SEQ ID:246.

Another function of GAM7776 is therefore inhibition of DKFZp761B107 (Accession NP_775734.1). Accordingly, utilities of GAM7776 include diagnosis, prevention and treatment of diseases and clinical conditions associated with DKFZp761B107.

DKFZp761B128 (Accession NP_689650.1) is another GAM7776 target gene, herein designated TARGET GENE. DKFZp761B128 BINDING SITE is a target binding site found in the 5' untranslated region of mRNA encoded by DKFZp761B128, corresponding to a target binding site such as BINDING SITE I, BINDING SITE II or BINDING SITE III of FIG. 8. Table 4 illustrates the complementarity of the nucleotide sequences of DKFZp761B128 BINDING SITE, designated SEQ ID:17969, to the nucleotide sequence of GAM7776 RNA, herein designated GAM RNA, also designated SEQ ID:246.

Another function of GAM7776 is therefore inhibition of DKFZp761B128 (Accession NP_689650.1). Accordingly, utilities of GAM7776 include diagnosis, prevention and treatment of diseases and clinical conditions associated with DKFZp761B128.

DKFZp761G2113 (Accession XP_046017.3) is another GAM7776 target gene, herein designated TARGET GENE. DKFZp761G2113 BINDING SITE is a target binding site found in the 3' untranslated region of mRNA encoded by DKFZp761G2113, corresponding to a target binding site such as BINDING SITE I, BINDING SITE II or BINDING SITE III of FIG. 8. Table 4 illustrates the complementarity of the nucleotide sequences of DKFZp761G2113 BINDING SITE, designated SEQ ID:7769, to the nucleotide sequence of GAM7776 RNA, herein designated GAM RNA, also designated SEQ ID:246.

Another function of GAM7776 is therefore inhibition of DKFZp761G2113 (Accession XP_046017.3). Accordingly, utilities of GAM7776 include diagnosis, prevention and treatment of diseases and clinical conditions associated with DKFZp761G2113.

DKFZp761H039 (Accession NP_061181.1) is another GAM7776 target gene, herein designated TARGET GENE. DKFZp761H039 BINDING SITE is a target binding site found in the 3' untranslated region of mRNA encoded by DKFZp761H039, corresponding to a target binding site such as BINDING SITE I, BINDING SITE II or BINDING SITE III of FIG. 8. Table 4 illustrates the complementarity of the nucleotide sequences of DKFZp761H039 BINDING SITE, designated SEQ ID:15190, to the nucleotide sequence of GAM7776 RNA, herein designated GAM RNA, also designated SEQ ID:246.

Another function of GAM7776 is therefore inhibition of DKFZp761H039 (Accession NP_061181.1). Accordingly, utilities of GAM7776 include diagnosis, prevention and treatment of diseases and clinical conditions associated with DKFZp761H039.

DKFZp761J139 (Accession NP_115656.1) is another GAM7776 target gene, herein designated TARGET GENE. DKFZp761J139 BINDING SITE is a target binding site found in the 5' untranslated region of mRNA encoded by DKFZp761J139, corresponding to a target binding site such as BINDING SITE I, BINDING SITE II or BINDING SITE III of FIG. 8. Table 4 illustrates the complementarity of the nucleotide sequences of DKFZp761J139 BINDING SITE, designated SEQ ID:5768, to the nucleotide sequence of GAM7776 RNA, herein designated GAM RNA, also designated SEQ ID:246.

Another function of GAM7776 is therefore inhibition of DKFZp761J139 (Accession NP_115656.1). Accordingly, utilities of GAM7776 include diagnosis, prevention and treatment of diseases and clinical conditions associated with DKFZp761J139.

DKFZp761K1423 (Accession NP_060892.1) is another GAM7776 target gene, herein designated TARGET GENE. DKFZp761K1423 BINDING SITE is a target binding site found in the 5' untranslated region of mRNA encoded by DKFZp761K1423, corresponding to a target binding site such as BINDING SITE I, BINDING SITE II or BINDING SITE III of FIG. 8. Table 4 illustrates the complementarity of the nucleotide sequences of DKFZp761K1423 BINDING SITE, designated SEQ ID:1317, to the nucleotide sequence of GAM7776 RNA, herein designated GAM RNA, also designated SEQ ID:246.

Another function of GAM7776 is therefore inhibition of DKFZp761K1423 (Accession NP_060892.1). Accordingly, utilities of GAM7776 include diagnosis, prevention and treatment of diseases and clinical conditions associated with DKFZp761K1423.

DKFZp761N1114 (Accession XP_086327.6) is another GAM7776 target gene, herein designated TARGET GENE. DKFZp761N1114 BINDING SITE is a target binding site found in the 3' untranslated region of mRNA encoded by DKFZp761N1114, corresponding to a target binding site such as BINDING SITE I, BINDING SITE II or BINDING SITE III of FIG. 8. Table 4 illustrates the complementarity of the nucleotide sequences of DKFZp761N1114 BINDING SITE, designated SEQ ID:13529, to the nucleotide sequence of GAM7776 RNA, herein designated GAM RNA, also designated SEQ ID:246.

Another function of GAM7776 is therefore inhibition of DKFZp761N1114 (Accession XP_086327.6). Accordingly, utilities of GAM7776 include diagnosis, prevention and treatment of diseases and clinical conditions associated with DKFZp761N1114.

DKFZp761O0113 (Accession NP_060879.1) is another GAM7776 target gene, herein designated TARGET GENE. DKFZp761O0113 BINDING SITE is a target binding site found in the 5' untranslated region of mRNA encoded by DKFZp761O0113, corresponding to a target binding site such as BINDING SITE I, BINDING SITE II or BINDING SITE III of FIG. 8. Table 4 illustrates the complementarity of the nucleotide sequences of DKFZp761O0113 BINDING SITE, designated SEQ ID:7699, to the nucleotide sequence of GAM7776 RNA, herein designated GAM RNA, also designated SEQ ID:246.

Another function of GAM7776 is therefore inhibition of DKFZp761O0113 (Accession NP_060879.1). Accordingly, utilities of GAM7776 include diagnosis, prevention and treatment of diseases and clinical conditions associated with DKFZp761O0113.

DKFZp761P1121 (Accession NP_690870.1) is another GAM7776 target gene, herein designated TARGET GENE. DKFZp761P1121 BINDING SITE is a target binding site found in the 3' untranslated region of mRNA encoded by DKFZp761P1121, corresponding to a target binding site such as BINDING SITE I, BINDING SITE II or BINDING SITE III of FIG. 8. Table 4 illustrates the complementarity of the nucleotide sequences of DKFZp761P1121 BINDING SITE, designated SEQ ID:9147, to the nucleotide sequence of GAM7776 RNA, herein designated GAM RNA, also designated SEQ ID:246.

Another function of GAM7776 is therefore inhibition of DKFZp761P1121 (Accession NP_690870.1). Accordingly, utilities of GAM7776 include diagnosis, prevention and treatment of diseases and clinical conditions associated with DKFZp761P1121.

DKFZp762C2414 (Accession NP_848637.1) is another GAM7776 target gene, herein designated TARGET GENE. DKFZp762C2414 BINDING SITE is a target binding site found in the 3' untranslated region of mRNA encoded by DKFZp762C2414, corresponding to a target binding site such as BINDING SITE I, BINDING SITE II or BINDING SITE III of FIG. 8. Table 4 illustrates the complementarity of the nucleotide sequences of DKFZp762C2414 BINDING SITE, designated SEQ ID:4056, to the nucleotide sequence of GAM7776 RNA, herein designated GAM RNA, also designated SEQ ID:246.

Another function of GAM7776 is therefore inhibition of DKFZp762C2414 (Accession NP_848637.1). Accordingly, utilities of GAM7776 include diagnosis, prevention and treatment of diseases and clinical conditions associated with DKFZp762C2414.

DKFZp762I137 (Accession NP_689624.1) is another GAM7776 target gene, herein designated TARGET GENE. DKFZp762I137 BINDING SITE is a target binding site found in the 3' untranslated region of mRNA encoded by DKFZp762I137, corresponding to a target binding site such as BINDING SITE I, BINDING SITE II or BINDING SITE III of FIG. 8. Table 4 illustrates the complementarity of the nucleotide sequences of DKFZp762I137 BINDING SITE, designated SEQ ID:1744, to the nucleotide sequence of GAM7776 RNA, herein designated GAM RNA, also designated SEQ ID:246.

Another function of GAM7776 is therefore inhibition of DKFZp762I137 (Accession NP_689624.1). Accordingly, utilities of GAM7776 include diagnosis, prevention and treatment of diseases and clinical conditions associated with DKFZp762I137.

DKFZp762I194 (Accession NP_689597.1) is another GAM7776 target gene, herein designated TARGET GENE. DKFZp762I194 BINDING SITE is a target binding site found in the 3' untranslated region of mRNA encoded by DKFZp762I194, corresponding to a target binding site such as BINDING SITE I, BINDING SITE II or BINDING SITE III of FIG. 8. Table 4 illustrates the complementarity of the nucleotide sequences of DKFZp762I194 BINDING SITE, designated SEQ ID:6884, to the nucleotide sequence of GAM7776 RNA, herein designated GAM RNA, also designated SEQ ID:246.

Another function of GAM7776 is therefore inhibition of DKFZp762I194 (Accession NP_689597.1). Accordingly, utilities of GAM7776 include diagnosis, prevention and treatment of diseases and clinical conditions associated with DKFZp762I194.

DKFZp762L0311 (Accession NP_061189.2) is another GAM7776 target gene, herein designated TARGET GENE. DKFZp762L0311 BINDING SITE is a target binding site found in the 3' untranslated region of mRNA encoded by DKFZp762L0311, corresponding to a target binding site such as BINDING SITE I, BINDING SITE II or BINDING SITE III of FIG. 8. Table 4 illustrates the complementarity of the nucleotide sequences of DKFZp762L0311 BINDING SITE, designated SEQ ID:9194, to the nucleotide sequence of GAM7776 RNA, herein designated GAM RNA, also designated SEQ ID:246.

Another function of GAM7776 is therefore inhibition of DKFZp762L0311 (Accession NP_061189.2). Accordingly, utilities of GAM7776 include diagnosis, prevention and treatment of diseases and clinical conditions associated with DKFZp762L0311.

Dickkopf homolog 3 (xenopus laevis) (DKK3, Accession NP_037385.1) is another GAM7776 target gene, herein designated TARGET GENE. DKK3 BINDING SITE is a target binding site found in the 3' untranslated region of multiple transcripts of mRNA encoded by DKK3, corresponding to a target binding site such as BINDING SITE I, BINDING SITE II or BINDING SITE III of FIG. 8. Table 4 illustrates the complementarity of the nucleotide sequences of DKK3 BINDING SITE, designated SEQ ID:20069, to the nucleotide sequence of GAM7776 RNA, herein designated GAM RNA, also designated SEQ ID:246.

Another function of GAM7776 is therefore inhibition of Dickkopf homolog 3 (xenopus laevis) (DKK3, Accession NP_037385.1). Accordingly, utilities of GAM7776 include diagnosis, prevention and treatment of diseases and clinical conditions associated with DKK3.

Dickkopf homolog 3 (xenopus laevis) (DKK3, Accession NP_056965.2) is another GAM7776 target gene, herein designated TARGET GENE. DKK3 BINDING SITE is a target binding site found in the 3' untranslated region of multiple transcripts of mRNA encoded by DKK3, corresponding to a target binding site such as BINDING SITE I, BINDING SITE II or BINDING SITE III of FIG. 8. Table 4 illustrates the complementarity of the nucleotide sequences of DKK3 BINDING SITE, designated SEQ ID:20069, to the nucleotide sequence of GAM7776 RNA, herein designated GAM RNA, also designated SEQ ID:246.

Another function of GAM7776 is therefore inhibition of Dickkopf homolog 3 (xenopus laevis) (DKK3, Accession NP_056965.2). Accordingly, utilities of GAM7776 include diagnosis, prevention and treatment of diseases and clinical conditions associated with DKK3.

Dynein, axonemal, heavy polypeptide 11 (DNAH11, Accession NP_003768.1) is another GAM7776 target gene, herein designated TARGET GENE. DNAH11 BINDING SITE is a target binding site found in the 3' untranslated region of mRNA encoded by DNAH11, corresponding to a target binding site such as BINDING SITE I, BINDING SITE II or BINDING SITE III of FIG. 8. Table 4 illustrates the complementarity of the nucleotide sequences of DNAH11 BINDING SITE, designated SEQ ID:1214, to the nucleotide sequence of GAM7776 RNA, herein designated GAM RNA, also designated SEQ ID:246.

Another function of GAM7776 is therefore inhibition of Dynein, axonemal, heavy polypeptide 11 (DNAH11, Accession NP_003768.1), a gene which may function as a motor protein. Accordingly, utilities of GAM7776 include diagnosis, prevention and treatment of diseases and clinical conditions associated with DNAH11.

The function of DNAH11 and its association with various diseases and clinical conditions, has been established by previous studies, as described hereinabove with reference to GAM189.1. Dnaj (hsp40) homolog, subfamily b, member 5 (DNAJB5, Accession NP_036398.2) is another GAM7776 target gene, herein designated TARGET GENE. DNAJB5 BINDING SITE is a target binding site found in the 3' untranslated region of mRNA encoded by DNAJB5, corresponding to a target binding site such as BINDING SITE I, BINDING SITE II or BINDING SITE III of FIG. 8. Table 4 illustrates the complementarity of the nucleotide sequences of DNAJB5 BINDING SITE, designated SEQ ID:5815, to the nucleotide sequence of GAM7776 RNA, herein designated GAM RNA, also designated SEQ ID:246.

Another function of GAM7776 is therefore inhibition of Dnaj (hsp40) homolog, subfamily b, member 5 (DNAJB5, Accession NP_036398.2). Accordingly, utilities of GAM7776 include diagnosis, prevention and treatment of diseases and clinical conditions associated with DNAJB5.

DRIM (Accession NP_055318.1) is another GAM7776 target gene, herein designated TARGET GENE. DRIM BINDING SITE is a target binding site found in the 3' untranslated region of mRNA encoded by DRIM, corresponding to a target binding site such as BINDING SITE I, BINDING SITE II or BINDING SITE III of FIG. 8. Table 4 illustrates the complementarity of the nucleotide sequences of DRIM BINDING SITE, designated SEQ ID:6633, to the nucleotide sequence of GAM7776 RNA, herein designated GAM RNA, also designated SEQ ID:246.

Another function of GAM7776 is therefore inhibition of DRIM (Accession NP_055318.1). Accordingly, utilities of GAM7776 include diagnosis, prevention and treatment of diseases and clinical conditions associated with DRIM.

Dentatorubral-pallidoluysian atrophy (atrophin-1) (DRPLA, Accession NP_001931.1) is another GAM7776 target gene, herein designated TARGET GENE. DRPLA BINDING SITE is a target binding site found in the 5' untranslated region of mRNA encoded by DRPLA, corresponding to a target binding site such as BINDING SITE I, BINDING SITE II or BINDING SITE III of FIG. 8. Table 4 illustrates the complementarity of the nucleotide sequences of DRPLA BINDING SITE, designated SEQ ID:9796, to the nucleotide sequence of GAM7776 RNA, herein designated GAM RNA, also designated SEQ ID:246.

Another function of GAM7776 is therefore inhibition of Dentatorubral-pallidoluysian atrophy (atrophin-1) (DRPLA, Accession NP_001931.1). Accordingly, utilities of GAM7776 include diagnosis, prevention and treatment of diseases and clinical conditions associated with DRPLA.

Desmocollin 3 (DSC3, Accession NP__077741.1) is another GAM7776 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:7559, to the nucleotide sequence of GAM7776 RNA, herein designated GAM RNA, also designated SEQ ID:246.

Another function of GAM7776 is therefore inhibition of Desmocollin 3 (DSC3, Accession NP__077741.1), a gene which is a component of intercellular desmosome junctions. Accordingly, utilities of GAM7776 include diagnosis, prevention and treatment of diseases and clinical conditions associated with DSC3.

The function of DSC3 and its association with various diseases and clinical conditions, has been established by previous studies, as described hereinabove with reference to GAM30.1. Desmocollin 3 (DSC3, Accession NP_001932.1) is another GAM7776 target gene, herein designated TARGET GENE. DSC3 BINDING SITE is a target binding site found in the 3' untranslated region of multiple transcripts of mRNA encoded by DSC3, corresponding to a target binding site such as BINDING SITE I, BINDING SITE II or BINDING SITE III of FIG. 8. Table 4 illustrates the complementarity of the nucleotide sequences of DSC3 BINDING SITE, designated SEQ ID:7559, to the nucleotide sequence of GAM7776 RNA, herein designated GAM RNA, also designated SEQ ID:246.

Another function of GAM7776 is therefore inhibition of Desmocollin 3 (DSC3, Accession NP_001932.1), a gene which is a component of intercellular desmosome junctions. Accordingly, utilities of GAM7776 include diagnosis, prevention and treatment of diseases and clinical conditions associated with DSC3.

The function of DSC3 and its association with various diseases and clinical conditions, has been established by previous studies, as described hereinabove with reference to GAM30.1. Down syndrome critical region gene 6 (DSCR6, Accession NP__061835.1) is another GAM7776 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:14954, to the nucleotide sequence of GAM7776 RNA, herein designated GAM RNA, also designated SEQ ID:246.

Another function of GAM7776 is therefore inhibition of Down syndrome critical region gene 6 (DSCR6, Accession NP__061835.1). Accordingly, utilities of GAM7776 include diagnosis, prevention and treatment of diseases and clinical conditions associated with DSCR6.

Dual specificity phosphatase 19 (DUSP19, Accession NP__543152.1) is another GAM7776 target gene, herein designated TARGET GENE. DUSP19 BINDING SITE1 and DUSP19 BINDING SITE2 are target binding sites found in untranslated regions of mRNA encoded by DUSP19, corresponding to target binding sites such as BINDING SITE I, BINDING SITE II or BINDING SITE III of FIG. 8. Table 4 illustrates the complementarity of the nucleotide sequences of DUSP19 BINDING SITE1 and DUSP19 BINDING SITE2, designated SEQ ID:15367 and SEQ ID:5768 respectively, to the nucleotide sequence of GAM7776 RNA, herein designated GAM RNA, also designated SEQ ID:246.

Another function of GAM7776 is therefore inhibition of Dual specificity phosphatase 19 (DUSP19, Accession NP__543152.1). Accordingly, utilities of GAM7776 include diagnosis, prevention and treatment of diseases and clinical conditions associated with DUSP19.

Endometrial bleeding associated factor (left-right determination, factor a; transforming growth factor beta superfamily) (EBAF, Accession NP__003231.2) is another GAM7776 target gene, herein designated TARGET GENE. EBAF BINDING SITE is a target binding site found in the 3' untranslated region of mRNA encoded by EBAF, corresponding to a target binding site such as BINDING SITE I, BINDING SITE II or BINDING SITE III of FIG. 8. Table 4 illustrates the complementarity of the nucleotide sequences of EBAF BINDING SITE, designated SEQ ID:18275, to the nucleotide sequence of GAM7776 RNA, herein designated GAM RNA, also designated SEQ ID:246.

Another function of GAM7776 is therefore inhibition of Endometrial bleeding associated factor (left-right determination, factor a; transforming growth factor beta superfamily) (EBAF, Accession NP__003231.2), a gene which LEFT-RIGHT AXIS MALFORMATIONS and therefore is associated with Left-right axis malformations. Accordingly, utilities of GAM7776 include diagnosis, prevention and treatment of Left-right axis malformations, and of other diseases and clinical conditions associated with EBAF.

The function of EBAF and its association with various diseases and clinical conditions, has been established by previous studies, as described hereinabove with reference to GAM189.1. Endothelial differentiation, sphingolipid g-protein-coupled receptor, 8 (EDG8, Accession NP__110387.1) is another GAM7776 target gene, herein designated TARGET GENE. EDG8 BINDING SITE is a target binding site found in the 3' untranslated region of mRNA encoded by EDG8, corresponding to a target binding site such as BINDING SITE I, BINDING SITE II or BINDING SITE III of FIG. 8. Table 4 illustrates the complementarity of the nucleotide sequences of EDG8 BINDING SITE, designated SEQ ID:12263, to the nucleotide sequence of GAM7776 RNA, herein designated GAM RNA, also designated SEQ ID:246.

Another function of GAM7776 is therefore inhibition of Endothelial differentiation, sphingolipid g-protein-coupled receptor, 8 (EDG8, Accession NP__110387.1). Accordingly, utilities of GAM7776 include diagnosis, prevention and treatment of diseases and clinical conditions associated with EDG8.

EEF2K (Accession NP__037434.1) is another GAM7776 target gene, herein designated TARGET GENE. EEF2K BINDING SITE is a target binding site found in the 3' untranslated region of mRNA encoded by EEF2K, corresponding to a target binding site such as BINDING SITE I, BINDING SITE II or BINDING SITE III of FIG. 8. Table 4 illustrates the complementarity of the nucleotide sequences of EEF2K BINDING SITE, designated SEQ ID:2595, to the nucleotide sequence of GAM7776 RNA, herein designated GAM RNA, also designated SEQ ID:246.

Another function of GAM7776 is therefore inhibition of EEF2K (Accession NP__037434.1), a gene which phosphorylates serine or threonine on the eukaryotic elongation factor-2 and therefore may be associated with Systemic lupus erythematosus and cancer. Accordingly, utilities of GAM7776 include diagnosis, prevention and treatment of Systemic lupus erythematosus and cancer, and of other diseases and clinical conditions associated with EEF2K.

The function of EEF2K and its association with various diseases and clinical conditions, has been established by previous studies, as described hereinabove with reference to GAM189.1. Eh-domain containing 1 (EHD1, Accession NP_006786.2) is another GAM7776 target gene, herein designated TARGET GENE. EHD1 BINDING SITE is a target binding site found in the 3' untranslated region of mRNA encoded by EHD1, corresponding to a target binding site such as BINDING SITE I, BINDING SITE II or BINDING SITE III of FIG. 8. Table 4 illustrates the complementarity of the nucleotide sequences of EHD1 BINDING SITE, designated SEQ ID:7065, to the nucleotide sequence of GAM7776 RNA, herein designated GAM RNA, also designated SEQ ID:246.

Another function of GAM7776 is therefore inhibition of Eh-domain containing 1 (EHD1, Accession NP_006786.2), a gene which may be involved in ligand-initiated endocytosis. Accordingly, utilities of GAM7776 include diagnosis, prevention and treatment of diseases and clinical conditions associated with EHD1.

The function of EHD1 and its association with various diseases and clinical conditions, has been established by previous studies, as described hereinabove with reference to GAM65.1. Eh-domain containing 2 (EHD2, Accession NP_055416.2) is another GAM7776 target gene, herein designated TARGET GENE. EHD2 BINDING SITE is a target binding site found in the 3' untranslated region of mRNA encoded by EHD2, corresponding to a target binding site such as BINDING SITE I, BINDING SITE II or BINDING SITE III of FIG. 8. Table 4 illustrates the complementarity of the nucleotide sequences of EHD2 BINDING SITE, designated SEQ ID:4837, to the nucleotide sequence of GAM7776 RNA, herein designated GAM RNA, also designated SEQ ID:246.

Another function of GAM7776 is therefore inhibition of Eh-domain containing 2 (EHD2, Accession NP_055416.2). Accordingly, utilities of GAM7776 include diagnosis, prevention and treatment of diseases and clinical conditions associated with EHD2.

Eukaryotic translation initiation factor 2, subunit 3 gamma, 52 kda (EIF2S3, Accession NP_001406.1) is another GAM7776 target gene, herein designated TARGET GENE. EIF2S3 BINDING SITE is a target binding site found in the 3' untranslated region of mRNA encoded by EIF2S3, corresponding to a target binding site such as BINDING SITE I, BINDING SITE II or BINDING SITE III of FIG. 8. Table 4 illustrates the complementarity of the nucleotide sequences of EIF2S3 BINDING SITE, designated SEQ ID:1744, to the nucleotide sequence of GAM7776 RNA, herein designated GAM RNA, also designated SEQ ID:246.

Another function of GAM7776 is therefore inhibition of Eukaryotic translation initiation factor 2, subunit 3 gamma, 52 kda (EIF2S3, Accession NP_001406.1), a gene which functions in the early steps of protein synthesis. Accordingly, utilities of GAM7776 include diagnosis, prevention and treatment of diseases and clinical conditions associated with EIF2S3.

The function of EIF2S3 and its association with various diseases and clinical conditions, has been established by previous studies, as described hereinabove with reference to GAM189.1. Eukaryotic translation initiation factor 5a2 (EIF5A2, Accession NP_065123.1) is another GAM7776 target gene, herein designated TARGET GENE. EIF5A2 BINDING SITE is a target binding site found in the 3' untranslated region of mRNA encoded by EIF5A2, corresponding to a target binding site such as BINDING SITE I, BINDING SITE II or BINDING SITE III of FIG. 8. Table 4 illustrates the complementarity of the nucleotide sequences of EIF5A2 BINDING SITE, designated SEQ ID:8340, to the nucleotide sequence of GAM7776 RNA, herein designated GAM RNA, also designated SEQ ID:246.

Another function of GAM7776 is therefore inhibition of Eukaryotic translation initiation factor 5a2 (EIF5A2, Accession NP_065123.1). Accordingly, utilities of GAM7776 include diagnosis, prevention and treatment of diseases and clinical conditions associated with EIF5A2.

ELP3 (Accession NP_060561.3) is another GAM7776 target gene, herein designated TARGET GENE. ELP3 BINDING SITE is a target binding site found in the 3' untranslated region of mRNA encoded by ELP3, corresponding to a target binding site such as BINDING SITE I, BINDING SITE II or BINDING SITE III of FIG. 8. Table 4 illustrates the complementarity of the nucleotide sequences of ELP3 BINDING SITE, designated SEQ ID:14236, to the nucleotide sequence of GAM7776 RNA, herein designated GAM RNA, also designated SEQ ID:246.

Another function of GAM7776 is therefore inhibition of ELP3 (Accession NP_060561.3). Accordingly, utilities of GAM7776 include diagnosis, prevention and treatment of diseases and clinical conditions associated with ELP3.

Egf-like module containing, mucin-like, hormone receptor-like sequence 2 (EMR2, Accession NP_690880.1) is another GAM7776 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:13462 and SEQ ID:17743 respectively, to the nucleotide sequence of GAM7776 RNA, herein designated GAM RNA, also designated SEQ ID:246.

Another function of GAM7776 is therefore inhibition of Egf-like module containing, mucin-like, hormone receptor-like sequence 2 (EMR2, Accession NP_690880.1). Accordingly, utilities of GAM7776 include diagnosis, prevention and treatment of diseases and clinical conditions associated with EMR2.

Egf-like module containing, mucin-like, hormone receptor-like sequence 2 (EMR2, Accession NP_690880.1) is another GAM7776 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:17743 and SEQ ID:17743 respectively, to the nucleotide sequence of GAM7776 RNA, herein designated GAM RNA, also designated SEQ ID:246.

Another function of GAM7776 is therefore inhibition of Egf-like module containing, mucin-like, hormone receptor-like sequence 2 (EMR2, Accession NP_690880.1). Accordingly, utilities of GAM7776 include diagnosis, prevention and treatment of diseases and clinical conditions associated with EMR2.

Egf-like module containing, mucin-like, hormone receptor-like sequence 2 (EMR2, Accession NP_690882.1) is another GAM7776 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:13462 and SEQ ID:13462 respectively, to the nucleotide sequence of GAM7776 RNA, herein designated GAM RNA, also designated SEQ ID:246.

Another function of GAM7776 is therefore inhibition of Egf-like module containing, mucin-like, hormone receptor-like sequence 2 (EMR2, Accession NP_690882.1). Accordingly, utilities of GAM7776 include diagnosis, prevention and treatment of diseases and clinical conditions associated with EMR2.

Egf-like module containing, mucin-like, hormone receptor-like sequence 2 (EMR2, Accession NP_690881.1) is another GAM7776 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:13462 and SEQ ID:17743 respectively, to the nucleotide sequence of GAM7776 RNA, herein designated GAM RNA, also designated SEQ ID:246.

Another function of GAM7776 is therefore inhibition of Egf-like module containing, mucin-like, hormone receptor-like sequence 2 (EMR2, Accession NP_690881.1). Accordingly, utilities of GAM7776 include diagnosis, prevention and treatment of diseases and clinical conditions associated with EMR2.

Egf-like module containing, mucin-like, hormone receptor-like sequence 2 (EMR2, Accession NP_690885.1) is another GAM7776 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:13462 and SEQ ID:17743 respectively, to the nucleotide sequence of GAM7776 RNA, herein designated GAM RNA, also designated SEQ ID:246.

Another function of GAM7776 is therefore inhibition of Egf-like module containing, mucin-like, hormone receptor-like sequence 2 (EMR2, Accession NP_690885.1). Accordingly, utilities of GAM7776 include diagnosis, prevention and treatment of diseases and clinical conditions associated with EMR2.

Egf-like module containing, mucin-like, hormone receptor-like sequence 2 (EMR2, Accession NP_038475.2) is another GAM7776 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:13462 and SEQ ID:13462 respectively, to the nucleotide sequence of GAM7776 RNA, herein designated GAM RNA, also designated SEQ ID:246.

Another function of GAM7776 is therefore inhibition of Egf-like module containing, mucin-like, hormone receptor-like sequence 2 (EMR2, Accession NP_038475.2). Accordingly, utilities of GAM7776 include diagnosis, prevention and treatment of diseases and clinical conditions associated with EMR2.

Egf-like module containing, mucin-like, hormone receptor-like sequence 2 (EMR2, Accession NP_690881.1) is another GAM7776 target gene, herein designated TARGET GENE. EMR2 BINDING SITE1 and EMR2 BINDING SITE2 are target binding sites found in untranslated regions of multiple transcripts of mRNA encoded by EMR2, corresponding to target binding sites such as BINDING SITE I, BINDING SITE II or BINDING SITE III of FIG. 8. Table 4 illustrates the complementarity of the nucleotide sequences of EMR2 BINDING SITE1 and EMR2 BINDING SITE2, designated SEQ ID:17743 and SEQ ID:17743 respectively, to the nucleotide sequence of GAM7776 RNA, herein designated GAM RNA, also designated SEQ ID:246.

Another function of GAM7776 is therefore inhibition of Egf-like module containing, mucin-like, hormone receptor-like sequence 2 (EMR2, Accession NP_690881.1). Accordingly, utilities of GAM7776 include diagnosis, prevention and treatment of diseases and clinical conditions associated with EMR2.

Endonuclease g-like 1 (ENDOGL1, Accession NP_005098.1) is another GAM7776 target gene, herein designated TARGET GENE. ENDOGL1 BINDING SITE is a target binding site found in the 3' untranslated region of mRNA encoded by ENDOGL1, corresponding to a target binding site such as BINDING SITE I, BINDING SITE II or BINDING SITE III of FIG. 8. Table 4 illustrates the complementarity of the nucleotide sequences of ENDOGL1 BINDING SITE, designated SEQ ID:5031, to the nucleotide sequence of GAM7776 RNA, herein designated GAM RNA, also designated SEQ ID:246.

Another function of GAM7776 is therefore inhibition of Endonuclease g-like 1 (ENDOGL1, Accession NP_005098.1). Accordingly, utilities of GAM7776 include diagnosis, prevention and treatment of diseases and clinical conditions associated with ENDOGL1.

Epha8 (EPHA8, Accession NP_065387.1) is another GAM7776 target gene, herein designated TARGET GENE. EPHA8 BINDING SITE is a target binding site found in the 3' untranslated region of mRNA encoded by EPHA8, corresponding to a target binding site such as BINDING SITE I, BINDING SITE II or BINDING SITE III of FIG. 8. Table 4 illustrates the complementarity of the nucleotide sequences of EPHA8 BINDING SITE, designated SEQ ID:1229, to the nucleotide sequence of GAM7776 RNA, herein designated GAM RNA, also designated SEQ ID:246.

Another function of GAM7776 is therefore inhibition of Epha8 (EPHA8, Accession NP_065387.1), a gene which Eph-related receptor tyrosine kinase A8. Accordingly, utilities of GAM7776 include diagnosis, prevention and treatment of diseases and clinical conditions associated with EPHA8.

The function of EPHA8 and its association with various diseases and clinical conditions, has been established by previous studies, as described hereinabove with reference to GAM189.1. Epiregulin (EREG, Accession NP_001423.1) is another GAM7776 target gene, herein designated TARGET GENE. EREG BINDING SITE is a target binding site found in the 3' untranslated region of mRNA encoded by EREG, corresponding to a target binding site such as BINDING SITE I, BINDING SITE II or BINDING SITE III of FIG. 8. Table 4 illustrates the complementarity of the nucleotide sequences of EREG BINDING SITE, designated SEQ ID:17956, to the nucleotide sequence of GAM7776 RNA, herein designated GAM RNA, also designated SEQ ID:246.

Another function of GAM7776 is therefore inhibition of Epiregulin (EREG, Accession NP_001423.1). Accordingly, utilities of GAM7776 include diagnosis, prevention and treatment of diseases and clinical conditions associated with EREG.

Ellis van creveld syndrome (EVC, Accession NP_714928.1) is another GAM7776 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:18115, to the nucleotide sequence of GAM7776 RNA, herein designated GAM RNA, also designated SEQ ID:246.

Another function of GAM7776 is therefore inhibition of Ellis van creveld syndrome (EVC, Accession NP_714928.1). Accordingly, utilities of GAM7776 include diagnosis, prevention and treatment of diseases and clinical conditions associated with EVC.

Ellis van creveld syndrome (EVC, Accession NP_055371.1) is another GAM7776 target gene, herein designated TARGET GENE. EVC BINDING SITE is a target binding site found in the 3' untranslated region of multiple transcripts of mRNA encoded by EVC, corresponding to a target binding site such as BINDING SITE I, BINDING SITE II or BINDING SITE III of FIG. 8. Table 4 illustrates the complementarity of the nucleotide sequences of EVC BINDING SITE, designated SEQ ID:18115, to the nucleotide sequence of GAM7776 RNA, herein designated GAM RNA, also designated SEQ ID:246.

Another function of GAM7776 is therefore inhibition of Ellis van creveld syndrome (EVC, Accession NP_055371.1). Accordingly, utilities of GAM7776 include diagnosis, prevention and treatment of diseases and clinical conditions associated with EVC.

Ecotropic viral integration site 5 (EVI5, Accession NP_005656.2) is another GAM7776 target gene, herein designated TARGET GENE. EVI5 BINDING SITE1 and EVI5 BINDING SITE2 are target binding sites found in untranslated regions of mRNA encoded by EVI5, corresponding to target binding sites such as BINDING SITE I, BINDING SITE II or BINDING SITE III of FIG. 8. Table 4 illustrates the complementarity of the nucleotide sequences of EVI5 BINDING SITE1 and EVI5 BINDING SITE2, designated SEQ ID:7219 and SEQ ID:11607 respectively, to the nucleotide sequence of GAM7776 RNA, herein designated GAM RNA, also designated SEQ ID:246.

Another function of GAM7776 is therefore inhibition of Ecotropic viral integration site 5 (EVI5, Accession NP_005656.2). Accordingly, utilities of GAM7776 include diagnosis, prevention and treatment of diseases and clinical conditions associated with EVI5.

Enhancer of zeste homolog 1 (drosophila) (EZH1, Accession NP_001982.2) is another GAM7776 target gene, herein designated TARGET GENE. EZH1 BINDING SITE is a target binding site found in the 3' untranslated region of mRNA encoded by EZH1, corresponding to a target binding site such as BINDING SITE I, BINDING SITE II or BINDING SITE III of FIG. 8. Table 4 illustrates the complementarity of the nucleotide sequences of EZH1 BINDING SITE, designated SEQ ID:14083, to the nucleotide sequence of GAM7776 RNA, herein designated GAM RNA, also designated SEQ ID:246.

Another function of GAM7776 is therefore inhibition of Enhancer of zeste homolog 1 (drosophila) (EZH1, Accession NP_001982.2), a gene which may act in transcriptional regulation and heterochromatin maintenance. Accordingly, utilities of GAM7776 include diagnosis, prevention and treatment of diseases and clinical conditions associated with EZH1.

The function of EZH1 and its association with various diseases and clinical conditions, has been established by previous studies, as described hereinabove with reference to GAM189.1. F11R (Accession NP_653086.1) is another GAM7776 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM7776 RNA, herein designated GAM RNA, also designated SEQ ID:246.

Another function of GAM7776 is therefore inhibition of F11R (Accession NP_653086.1). Accordingly, utilities of GAM7776 include diagnosis, prevention and treatment of diseases and clinical conditions associated with F11R.

F11R (Accession NP_058642.1) is another GAM7776 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM7776 RNA, herein designated GAM RNA, also designated SEQ ID:246.

Another function of GAM7776 is therefore inhibition of F11R (Accession NP_058642.1). Accordingly, utilities of GAM7776 include diagnosis, prevention and treatment of diseases and clinical conditions associated with F11R.

F11R (Accession NP_653085.1) is another GAM7776 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM7776 RNA, herein designated GAM RNA, also designated SEQ ID:246.

Another function of GAM7776 is therefore inhibition of F11R (Accession NP_653085.1). Accordingly, utilities of GAM7776 include diagnosis, prevention and treatment of diseases and clinical conditions associated with F11R.

F11R (Accession NP_653087.1) is another GAM7776 target gene, herein designated TARGET GENE. F11R BINDING SITE is a target binding site found in the 3' untranslated region of multiple transcripts of mRNA encoded by F11R, corresponding to a target binding site such as BINDING SITE I, BINDING SITE II or BINDING SITE III of FIG. 8. Table 4 illustrates the complementarity of the nucleotide sequences of F11R BINDING SITE, designated SEQ ID:2664, to the nucleotide sequence of GAM7776 RNA, herein designated GAM RNA, also designated SEQ ID:246.

Another function of GAM7776 is therefore inhibition of F11R (Accession NP_653087.1). Accordingly, utilities of GAM7776 include diagnosis, prevention and treatment of diseases and clinical conditions associated with F11R.

Coagulation factor ii (thrombin) receptor-like 3 (F2RL3, Accession NP_003941.1) is another GAM7776 target gene, herein designated TARGET GENE. F2RL3 BINDING SITE is a target binding site found in the 3' untranslated region of mRNA encoded by F2RL3, corresponding to a target binding site such as BINDING SITE I, BINDING SITE II or BINDING SITE III of FIG. 8. Table 4 illustrates the complementarity of the nucleotide sequences of F2RL3 BINDING SITE, designated SEQ ID:4234, to the nucleotide sequence of GAM7776 RNA, herein designated GAM RNA, also designated SEQ ID:246.

Another function of GAM7776 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM7776 include diagnosis, prevention and treatment of diseases and clinical conditions associated with F2RL3.

The function of F2RL3 and its association with various diseases and clinical conditions, has been established by previous studies, as described hereinabove with reference to GAM72.1. Coagulation factor iii (thromboplastin, tissue factor) (F3, Accession NP_001984.1) is another GAM7776 target gene, herein designated TARGET GENE. F3 BINDING SITE is a target binding site found in the 3' untranslated region of mRNA encoded by F3, corresponding to a target binding site such as BINDING SITE I, BINDING SITE II or BINDING SITE III of FIG. 8. Table 4 illustrates the complementarity of the nucleotide sequences of F3 BINDING SITE, designated SEQ ID:18492, to the nucleotide sequence of GAM7776 RNA, herein designated GAM RNA, also designated SEQ ID:246.

Another function of GAM7776 is therefore inhibition of Coagulation factor iii (thromboplastin, tissue factor) (F3, Accession NP_001984.1), a gene which functions in normal hemostasis. Accordingly, utilities of GAM7776 include diagnosis, prevention and treatment of diseases and clinical conditions associated with F3.

The function of F3 and its association with various diseases and clinical conditions, has been established by previous studies, as described hereinabove with reference to GAM136.1. Coagulation factor v (proaccelerin, labile factor) (F5, Accession NP_000121.1) is another GAM7776 target gene, herein designated TARGET GENE. F5 BINDING SITE is a target binding site found in the 5' untranslated region of mRNA encoded by F5, corresponding to a target binding site such as BINDING SITE I, BINDING SITE II or BINDING SITE III of FIG. 8. Table 4 illustrates the complementarity of the nucleotide sequences of F5 BINDING SITE, designated SEQ ID:7269, to the nucleotide sequence of GAM7776 RNA, herein designated GAM RNA, also designated SEQ ID:246.

Another function of GAM7776 is therefore inhibition of Coagulation factor v (proaccelerin, labile factor) (F5, Accession NP_000121.1). Accordingly, utilities of GAM7776 include diagnosis, prevention and treatment of diseases and clinical conditions associated with F5.

Fatty acid binding protein 2, intestinal (FABP2, Accession NP_000125.1) is another GAM7776 target gene, herein designated TARGET GENE. FABP2 BINDING SITE is a target binding site found in the 3' untranslated region of mRNA encoded by FABP2, corresponding to a target binding site such as BINDING SITE I, BINDING SITE II or BINDING SITE III of FIG. 8. Table 4 illustrates the complementarity of the nucleotide sequences of FABP2 BINDING SITE, designated SEQ ID:2195, to the nucleotide sequence of GAM7776 RNA, herein designated GAM RNA, also designated SEQ ID:246.

Another function of GAM7776 is therefore inhibition of Fatty acid binding protein 2, intestinal (FABP2, Accession NP_000125.1), a gene which may have a role in dietary fat uptake or processing. and therefore may be associated with Cardiovascular disease and type 2 diabetes. Accordingly, utilities of GAM7776 include diagnosis, prevention and treatment of Cardiovascular disease and type 2 diabetes, and of other diseases and clinical conditions associated with FABP2.

The function of FABP2 and its association with various diseases and clinical conditions, has been established by previous studies, as described hereinabove with reference to GAM189.1. Fanconi anemia, complementation group e (FANCE, Accession NP_068741.1) is another GAM7776 target gene, herein designated TARGET GENE. FANCE BINDING SITE is a target binding site found in the 3' untranslated region of mRNA encoded by FANCE, corresponding to a target binding site such as BINDING SITE I, BINDING SITE II or BINDING SITE III of FIG. 8. Table 4 illustrates the complementarity of the nucleotide sequences of FANCE BINDING SITE, designated SEQ ID:5597, to the nucleotide sequence of GAM7776 RNA, herein designated GAM RNA, also designated SEQ ID:246.

Another function of GAM7776 is therefore inhibition of Fanconi anemia, complementation group e (FANCE, Accession NP_068741.1), a gene which is a possible regulator of lymphocyte and platelet function. and therefore is associated with Fanconi anemia, complementation group e. Accordingly, utilities of GAM7776 include diagnosis, prevention and treatment of Fanconi anemia, complementation group e., and of other diseases and clinical conditions associated with FANCE.

The function of FANCE and its association with various diseases and clinical conditions, has been established by previous studies, as described hereinabove with reference to GAM189.1. Fanconi anemia, complementation group f (FANCF, Accession NP_073562.1) is another GAM7776 target gene, herein designated TARGET GENE. FANCF BINDING SITE is a target binding site found in the 3' untranslated region of mRNA encoded by FANCF, corresponding to a target binding site such as BINDING SITE I, BINDING SITE II or BINDING SITE III of FIG. 8. Table 4 illustrates the complementarity of the nucleotide sequences of FANCF BINDING SITE, designated SEQ ID:5816, to the nucleotide sequence of GAM7776 RNA, herein designated GAM RNA, also designated SEQ ID:246.

Another function of GAM7776 is therefore inhibition of Fanconi anemia, complementation group f (FANCF, Accession NP_073562.1). Accordingly, utilities of GAM7776 include diagnosis, prevention and treatment of diseases and clinical conditions associated with FANCF.

FAT3 (Accession XP_061871.5) is another GAM7776 target gene, herein designated TARGET GENE. FAT3 BINDING SITE is a target binding site found in the 3' untranslated region of mRNA encoded by FAT3, corresponding to a target binding site such as BINDING SITE I, BINDING SITE II or BINDING SITE III of FIG. 8. Table 4 illustrates the complementarity of the nucleotide sequences of FAT3 BINDING SITE, designated SEQ ID:8236, to the nucleotide sequence of GAM7776 RNA, herein designated GAM RNA, also designated SEQ ID:246.

Another function of GAM7776 is therefore inhibition of FAT3 (Accession XP_061871.5). Accordingly, utilities of GAM7776 include diagnosis, prevention and treatment of diseases and clinical conditions associated with FAT3.

FBXW8 (Accession NP_699179.2) is another GAM7776 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:11845, to the nucleotide sequence of GAM7776 RNA, herein designated GAM RNA, also designated SEQ ID:246.

Another function of GAM7776 is therefore inhibition of FBXW8 (Accession NP_699179.2). Accordingly, utilities of GAM7776 include diagnosis, prevention and treatment of diseases and clinical conditions associated with FBXW8.

FBXW8 (Accession NP_036306.1) is another GAM7776 target gene, herein designated TARGET GENE. FBXW8 BINDING SITE is a target binding site found in the 3' untranslated region of multiple transcripts of mRNA encoded by FBXW8, corresponding to a target binding site such as BINDING SITE I, BINDING SITE II or BINDING SITE III of FIG. 8. Table 4 illustrates the complementarity of the nucleotide sequences of FBXW8 BINDING SITE, designated SEQ ID:11845, to the nucleotide sequence of GAM7776 RNA, herein designated GAM RNA, also designated SEQ ID:246.

Another function of GAM7776 is therefore inhibition of FBXW8 (Accession NP_036306.1). Accordingly, utilities of GAM7776 include diagnosis, prevention and treatment of diseases and clinical conditions associated with FBXW8.

Fc fragment of iga, receptor for (FCAR, Accession NP_579806.1) is another GAM7776 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10448, SEQ ID:10448 and SEQ ID:10448 respectively, to the nucleotide sequence of GAM7776 RNA, herein designated GAM RNA, also designated SEQ ID:246.

Another function of GAM7776 is therefore inhibition of Fc fragment of iga, receptor for (FCAR, Accession NP_579806.1), a gene which binds to the fc region of immunoglobulins alpha and mediates several functions including cytokine production. and therefore may be associated with Iga nephropathy. Accordingly, utilities of GAM7776 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579803.1) is another GAM7776 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10448, SEQ ID:10448 and SEQ ID:10448 respectively, to the nucleotide sequence of GAM7776 RNA, herein designated GAM RNA, also designated SEQ ID:246.

Another function of GAM7776 is therefore inhibition of Fc fragment of iga, receptor for (FCAR, Accession NP_579803.1), a gene which binds to the fc region of immunoglobulins alpha and mediates several functions including cytokine production. and therefore may be associated with Iga nephropathy. Accordingly, utilities of GAM7776 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579807.1) is another GAM7776 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:10448, SEQ ID:3819 and SEQ ID:17643 respectively, to the nucleotide sequence of GAM7776 RNA, herein designated GAM RNA, also designated SEQ ID:246.

Another function of GAM7776 is therefore inhibition of Fc fragment of iga, receptor for (FCAR, Accession NP_579807.1), a gene which binds to the fc region of immunoglobulins alpha and mediates several functions including cytokine production. and therefore may be associated with Iga nephropathy. Accordingly, utilities of GAM7776 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579813.1) is another GAM7776 target gene, herein designated TARGET GENE. FCAR BINDING SITE1 through FCAR BINDING SITE3 are target binding sites found in untranslated regions of multiple transcripts of mRNA encoded by FCAR, corresponding to target binding sites such as BINDING SITE I, BINDING SITE II or BINDING SITE III of FIG. 8. Table 4 illustrates the complementarity of the nucleotide sequences of FCAR BINDING SITE1 through FCAR BINDING SITE3, designated SEQ ID:17643, SEQ ID:497 and SEQ ID:11291 respectively, to the nucleotide sequence of GAM7776 RNA, herein designated GAM RNA, also designated SEQ ID:246.

Another function of GAM7776 is therefore inhibition of Fc fragment of iga, receptor for (FCAR, Accession NP_579813.1), a gene which binds to the fc region of immunoglobulins alpha and mediates several functions including cytokine production. and therefore may be associated with Iga nephropathy. Accordingly, utilities of GAM7776 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fer-1-like 4 (c. elegans) (FER1L4, Accession XP_300246.1) is another GAM7776 target gene, herein designated TARGET GENE. FER1L4 BINDING SITE is a target binding site found in the 3' untranslated region of mRNA encoded by FER1L4, corresponding to a target binding site such as BINDING SITE I, BINDING SITE II or BINDING SITE III of FIG. 8. Table 4 illustrates the complementarity of the nucleotide sequences of FER1L4 BINDING SITE, designated SEQ ID:11291, to the nucleotide sequence of GAM7776 RNA, herein designated GAM RNA, also designated SEQ ID:246.

Another function of GAM7776 is therefore inhibition of Fer-1-like 4 (c. elegans) (FER1L4, Accession XP_300246.1). Accordingly, utilities of GAM7776 include diagnosis, prevention and treatment of diseases and clinical conditions associated with FER1L4.

Fasciculation and elongation protein zeta 1 (zygin i) (FEZ1, Accession NP_072043.1) is another GAM7776 target gene, herein designated TARGET GENE. FEZ1 BINDING SITE is a target binding site found in the 3' untranslated region of multiple transcripts of mRNA encoded by FEZ1, corresponding to a target binding site such as BINDING SITE I, BINDING SITE II or BINDING SITE III of FIG. 8. Table 4 illustrates the complementarity of the nucleotide sequences of FEZ1 BINDING SITE, designated SEQ ID:5204, to the nucleotide sequence of GAM7776 RNA, herein designated GAM RNA, also designated SEQ ID:246.

Another function of GAM7776 is therefore inhibition of Fasciculation and elongation protein zeta 1 (zygin i) (FEZ1, Accession NP_072043.1), a gene which Zygin 1; may have a role in axonal outgrowth; has similarity to C. elegans UNC-76. Accordingly, utilities of GAM7776 include diagnosis, prevention and treatment of diseases and clinical conditions associated with FEZ1.

The function of FEZ1 and its association with various diseases and clinical conditions, has been established by previous studies, as described hereinabove with reference to GAM30.1. Fibroblast growth factor 5 (FGF5, Accession NP_004455.1) is another GAM7776 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:14382, to the nucleotide sequence of GAM7776 RNA, herein designated GAM RNA, also designated SEQ ID:246.

Another function of GAM7776 is therefore inhibition of Fibroblast growth factor 5 (FGF5, Accession NP_004455.1), a gene which induces transformation and may regulate neuronal differentiation. Accordingly, utilities of GAM7776 include diagnosis, prevention and treatment of diseases and clinical conditions associated with FGF5.

The function of FGF5 and its association with various diseases and clinical conditions, has been established by previous studies, as described hereinabove with reference to GAM106.1. Fibroblast growth factor 5 (FGF5, Accession NP_149134.1) is another GAM7776 target gene, herein designated TARGET GENE. FGF5 BINDING SITE is a target binding site found in the 3' untranslated region of multiple transcripts of mRNA encoded by FGF5, corresponding to a target binding site such as BINDING SITE I, BINDING SITE II or BINDING SITE III of FIG. 8. Table 4 illustrates the complementarity of the nucleotide sequences of FGF5 BINDING SITE, designated SEQ ID:14382, to the nucleotide sequence of GAM7776 RNA, herein designated GAM RNA, also designated SEQ ID:246.

Another function of GAM7776 is therefore inhibition of Fibroblast growth factor 5 (FGF5, Accession NP_149134.1), a gene which induces transformation and may regulate neuronal differentiation. Accordingly, utilities of GAM7776 include diagnosis, prevention and treatment of diseases and clinical conditions associated with FGF5.

The function of FGF5 and its association with various diseases and clinical conditions, has been established by previous studies, as described hereinabove with reference to GAM106.1. Four and a half lim domains 2 (FHL2, Accession NP_001441.2) is another GAM7776 target gene, herein designated TARGET GENE. FHL2 BINDING SITE is a target binding site found in the 5' untranslated region of mRNA encoded by FHL2, corresponding to a target binding site such as BINDING SITE I, BINDING SITE II or BINDING SITE III of FIG. 8. Table 4 illustrates the complementarity of the nucleotide sequences of FHL2 BINDING SITE, designated SEQ ID:16589, to the nucleotide sequence of GAM7776 RNA, herein designated GAM RNA, also designated SEQ ID:246.

Another function of GAM7776 is therefore inhibition of Four and a half lim domains 2 (FHL2, Accession NP_001441.2), a gene which Contains four LIM domains and an additional zinc finger. Accordingly, utilities of GAM7776 include diagnosis, prevention and treatment of diseases and clinical conditions associated with FHL2.

The function of FHL2 and its association with various diseases and clinical conditions, has been established by previous studies, as described hereinabove with reference to GAM189.1. FISH (Accession NP_055446.1) is another GAM7776 target gene, herein designated TARGET GENE. FISH BINDING SITE is a target binding site found in the 5' untranslated region of mRNA encoded by FISH, corresponding to a target binding site such as BINDING SITE I, BINDING SITE II or BINDING SITE III of FIG. 8. Table 4 illustrates the complementarity of the nucleotide sequences of FISH BINDING SITE, designated SEQ ID:13261, to the nucleotide sequence of GAM7776 RNA, herein designated GAM RNA, also designated SEQ ID:246.

Another function of GAM7776 is therefore inhibition of FISH (Accession NP_055446.1). Accordingly, utilities of GAM7776 include diagnosis, prevention and treatment of diseases and clinical conditions associated with FISH.

Fk506 binding protein 9, 63 kda (FKBP9, Accession NP_009201.1) is another GAM7776 target gene, herein designated TARGET GENE. FKBP9 BINDING SITE is a target binding site found in the 3' untranslated region of mRNA encoded by FKBP9, corresponding to a target binding site such as BINDING SITE I, BINDING SITE II or BINDING SITE III of FIG. 8. Table 4 illustrates the complementarity of the nucleotide sequences of FKBP9 BINDING SITE, designated SEQ ID:7851, to the nucleotide sequence of GAM7776 RNA, herein designated GAM RNA, also designated SEQ ID:246.

Another function of GAM7776 is therefore inhibition of Fk506 binding protein 9, 63 kda (FKBP9, Accession NP_009201.1) . Accordingly, utilities of GAM7776 include diagnosis, prevention and treatment of diseases and clinical conditions associated with FKBP9.

FLJ00001 (Accession XP_088525.2) is another GAM7776 target gene, herein designated TARGET GENE. FLJ00001 BINDING SITE is a target binding site found in the 3' untranslated region of mRNA encoded by FLJ00001, corresponding to a target binding site such as BINDING SITE I, BINDING SITE II or BINDING SITE III of FIG. 8. Table 4 illustrates the complementarity of the nucleotide sequences of FLJ00001 BINDING SITE, designated SEQ ID:14844, to the nucleotide sequence of GAM7776 RNA, herein designated GAM RNA, also designated SEQ ID:246.

Another function of GAM7776 is therefore inhibition of FLJ00001 (Accession XP_088525.2). Accordingly, utilities of GAM7776 include diagnosis, prevention and treatment of diseases and clinical conditions associated with FLJ00001.

FLJ00060 (Accession XP_028154.1) is another GAM7776 target gene, herein designated TARGET GENE. FLJ00060 BINDING SITE is a target binding site found in the 5' untranslated region of mRNA encoded by FLJ00060, corresponding to a target binding site such as BINDING SITE I, BINDING SITE II or BINDING SITE III of FIG. 8. Table 4 illustrates the complementarity of the nucleotide sequences of FLJ00060 BINDING SITE, designated SEQ ID:11528, to the nucleotide sequence of GAM7776 RNA, herein designated GAM RNA, also designated SEQ ID:246.

Another function of GAM7776 is therefore inhibition of FLJ00060 (Accession XP_028154.1). Accordingly, utilities of GAM7776 include diagnosis, prevention and treatment of diseases and clinical conditions associated with FLJ00060.

FLJ10101 (Accession NP_078994.1) is another GAM7776 target gene, herein designated TARGET GENE. FLJ10101 BINDING SITE is a target binding site found in the 3' untranslated region of mRNA encoded by FLJ10101, corresponding to a target binding site such as BINDING SITE I, BINDING SITE II or BINDING SITE III of FIG. 8. Table 4 illustrates the complementarity of the nucleotide sequences of FLJ10101 BINDING SITE, designated SEQ ID:9189, to the nucleotide sequence of GAM7776 RNA, herein designated GAM RNA, also designated SEQ ID:246.

Another function of GAM7776 is therefore inhibition of FLJ10101 (Accession NP_078994.1). Accordingly, utilities of GAM7776 include diagnosis, prevention and treatment of diseases and clinical conditions associated with FLJ10101.

FLJ10232 (Accession NP_060503.1) is another GAM7776 target gene, herein designated TARGET GENE. FLJ10232 BINDING SITE is a target binding site found in the 3' untranslated region of mRNA encoded by FLJ10232, corresponding to a target binding site such as BINDING SITE I, BINDING SITE II or BINDING SITE III of FIG. 8. Table 4 illustrates the complementarity of the nucleotide sequences of FLJ10232 BINDING SITE, designated SEQ ID:19236, to the nucleotide sequence of GAM7776 RNA, herein designated GAM RNA, also designated SEQ ID:246.

Another function of GAM7776 is therefore inhibition of FLJ10232 (Accession NP_060503.1). Accordingly, utilities of GAM7776 include diagnosis, prevention and treatment of diseases and clinical conditions associated with FLJ10232.

FLJ10298 (Accession NP_060520.2) is another GAM7776 target gene, herein designated TARGET GENE. FLJ10298 BINDING SITE is a target binding site found in the 3' untranslated region of mRNA encoded by FLJ10298, corresponding to a target binding site such as BINDING SITE I, BINDING SITE II or BINDING SITE III of FIG. 8. Table 4 illustrates the complementarity of the nucleotide sequences of FLJ10298 BINDING SITE, designated SEQ ID:2615, to the nucleotide sequence of GAM7776 RNA, herein designated GAM RNA, also designated SEQ ID:246.

Another function of GAM7776 is therefore inhibition of FLJ10298 (Accession NP_060520.2). Accordingly, utilities of GAM7776 include diagnosis, prevention and treatment of diseases and clinical conditions associated with FLJ10298.

FLJ10346 (Accession NP_060535.1) is another GAM7776 target gene, herein designated TARGET GENE. FLJ10346 BINDING SITE is a target binding site found in the 5' untranslated region of mRNA encoded by FLJ10346, corresponding to a target binding site such as BINDING SITE I, BINDING SITE II or BINDING SITE III of FIG. 8. Table 4 illustrates the complementarity of the nucleotide sequences of FLJ10346 BINDING SITE, designated SEQ ID:19219, to the nucleotide sequence of GAM7776 RNA, herein designated GAM RNA, also designated SEQ ID:246.

Another function of GAM7776 is therefore inhibition of FLJ10346 (Accession NP_060535.1). Accordingly, utilities of GAM7776 include diagnosis, prevention and treatment of diseases and clinical conditions associated with FLJ10346.

FLJ10520 (Accession NP_060594.2) is another GAM7776 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:4272, to the nucleotide sequence of GAM7776 RNA, herein designated GAM RNA, also designated SEQ ID:246.

Another function of GAM7776 is therefore inhibition of FLJ10520 (Accession NP_060594.2). Accordingly, utilities of GAM7776 include diagnosis, prevention and treatment of diseases and clinical conditions associated with FLJ10520.

FLJ10535 (Accession NP_060599.1) is another GAM7776 target gene, herein designated TARGET GENE. FLJ10535 BINDING SITE is a target binding site found in the 3' untranslated region of mRNA encoded by FLJ10535, corresponding to a target binding site such as BINDING SITE I, BINDING SITE II or BINDING SITE III of FIG. 8. Table 4 illustrates the complementarity of the nucleotide sequences of FLJ10535 BINDING SITE, designated SEQ ID:9543, to the nucleotide sequence of GAM7776 RNA, herein designated GAM RNA, also designated SEQ ID:246.

Another function of GAM7776 is therefore inhibition of FLJ10535 (Accession NP_060599.1). Accordingly, utilities of GAM7776 include diagnosis, prevention and treatment of diseases and clinical conditions associated with FLJ10535.

FLJ10560 (Accession NP_060608.1) is another GAM7776 target gene, herein designated TARGET GENE. FLJ10560 BINDING SITE is a target binding site found in the 3' untranslated region of mRNA encoded by FLJ10560, corresponding to a target binding site such as BINDING SITE I, BINDING SITE II or BINDING SITE III of FIG. 8. Table 4 illustrates the complementarity of the nucleotide sequences of FLJ10560 BINDING SITE, designated SEQ ID:15591, to the nucleotide sequence of GAM7776 RNA, herein designated GAM RNA, also designated SEQ ID:246.

Another function of GAM7776 is therefore inhibition of FLJ10560 (Accession NP_060608.1). Accordingly, utilities of GAM7776 include diagnosis, prevention and treatment of diseases and clinical conditions associated with FLJ10560.

FLJ10713 (Accession NP_060659.1) is another GAM7776 target gene, herein designated TARGET GENE. FLJ10713 BINDING SITE is a target binding site found in the 3' untranslated region of mRNA encoded by FLJ10713, corresponding to a target binding site such as BINDING SITE I, BINDING SITE II or BINDING SITE III of FIG. 8. Table 4 illustrates the complementarity of the nucleotide sequences of FLJ10713 BINDING SITE, designated SEQ ID:7909, to the nucleotide sequence of GAM7776 RNA, herein designated GAM RNA, also designated SEQ ID:246.

Another function of GAM7776 is therefore inhibition of FLJ10713 (Accession NP_060659.1). Accordingly, utilities of GAM7776 include diagnosis, prevention and treatment of diseases and clinical conditions associated with FLJ10713.

FLJ10846 (Accession NP_060711.1) is another GAM7776 target gene, herein designated TARGET GENE. FLJ10846 BINDING SITE is a target binding site found in the 3' untranslated region of mRNA encoded by FLJ10846, corresponding to a target binding site such as BINDING SITE I, BINDING SITE II or BINDING SITE III of FIG. 8. Table 4 illustrates the complementarity of the nucleotide sequences of FLJ10846 BINDING SITE, designated SEQ ID:11528, to the nucleotide sequence of GAM7776 RNA, herein designated GAM RNA, also designated SEQ ID:246.

Another function of GAM7776 is therefore inhibition of FLJ10846 (Accession NP_060711.1). Accordingly, utilities of GAM7776 include diagnosis, prevention and treatment of diseases and clinical conditions associated with FLJ10846.

FLJ10847 (Accession NP_060712.2) is another GAM7776 target gene, herein designated TARGET GENE. FLJ10847 BINDING SITE is a target binding site found in the 3' untranslated region of mRNA encoded by FLJ10847, corresponding to a target binding site such as BINDING SITE I, BINDING SITE II or BINDING SITE III of FIG. 8. Table 4 illustrates the complementarity of the nucleotide sequences of FLJ10847 BINDING SITE, designated SEQ ID:19357, to the nucleotide sequence of GAM7776 RNA, herein designated GAM RNA, also designated SEQ ID:246.

Another function of GAM7776 is therefore inhibition of FLJ10847 (Accession NP_060712.2). Accordingly, utilities of GAM7776 include diagnosis, prevention and treatment of diseases and clinical conditions associated with FLJ10847.

FLJ10922 (Accession NP_060743.1) is another GAM7776 target gene, herein designated TARGET GENE. FLJ10922 BINDING SITE is a target binding site found in the 3' untranslated region of mRNA encoded by FLJ10922, corresponding to a target binding site such as BINDING SITE I, BINDING SITE II or BINDING SITE III of FIG. 8. Table 4 illustrates the complementarity of the nucleotide sequences of FLJ10922 BINDING SITE, designated SEQ ID:18818, to the nucleotide sequence of GAM7776 RNA, herein designated GAM RNA, also designated SEQ ID:246.

Another function of GAM7776 is therefore inhibition of FLJ10922 (Accession NP_060743.1). Accordingly, utilities of GAM7776 include diagnosis, prevention and treatment of diseases and clinical conditions associated with FLJ10922.

FLJ11323 (Accession NP_060860.1) is another GAM7776 target gene, herein designated TARGET GENE. FLJ11323 BINDING SITE is a target binding site found in the 3' untranslated region of multiple transcripts of mRNA encoded by FLJ11323, corresponding to a target binding site such as BINDING SITE I, BINDING SITE II or BINDING SITE III of FIG. 8. Table 4 illustrates the complementarity of the nucleotide sequences of FLJ11323 BINDING SITE, designated SEQ ID:2044, to the nucleotide sequence of GAM7776 RNA, herein designated GAM RNA, also designated SEQ ID:246.

Another function of GAM7776 is therefore inhibition of FLJ11323 (Accession NP_060860.1). Accordingly, utilities of GAM7776 include diagnosis, prevention and treatment of diseases and clinical conditions associated with FLJ11323.

FLJ11467 (Accession NP_079239.2) is another GAM7776 target gene, herein designated TARGET GENE. FLJ11467 BINDING SITE is a target binding site found in the 3' untranslated region of mRNA encoded by FLJ11467, corresponding to a target binding site such as BINDING SITE I, BINDING SITE II or BINDING SITE III of FIG. 8. Table 4 illustrates the complementarity of the nucleotide sequences of FLJ11467 BINDING SITE, designated SEQ ID:834, to the nucleotide sequence of GAM7776 RNA, herein designated GAM RNA, also designated SEQ ID:246.

Another function of GAM7776 is therefore inhibition of FLJ11467 (Accession NP_079239.2). Accordingly, utilities of GAM7776 include diagnosis, prevention and treatment of diseases and clinical conditions associated with FLJ11467.

FLJ11710 (Accession NP_079122.1) is another GAM7776 target gene, herein designated TARGET GENE. FLJ11710 BINDING SITE is a target binding site found in the 3' untranslated region of mRNA encoded by FLJ11710, corresponding to a target binding site such as BINDING SITE I, BINDING SITE II or BINDING SITE III of FIG. 8. Table 4 illustrates the complementarity of the nucleotide sequences of FLJ11710 BINDING SITE, designated SEQ ID:9688, to the nucleotide sequence of GAM7776 RNA, herein designated GAM RNA, also designated SEQ ID:246.

Another function of GAM7776 is therefore inhibition of FLJ11710 (Accession NP_079122.1). Accordingly, utilities of GAM7776 include diagnosis, prevention and treatment of diseases and clinical conditions associated with FLJ11710.

FLJ11715 (Accession NP_078840.1) is another GAM7776 target gene, herein designated TARGET GENE. FLJ11715 BINDING SITE is a target binding site found in the 3' untranslated region of mRNA encoded by FLJ11715, corresponding to a target binding site such as BINDING SITE I, BINDING SITE II or BINDING SITE III of FIG. 8. Table 4 illustrates the complementarity of the nucleotide sequences of FLJ11715 BINDING SITE, designated SEQ ID:3305, to the nucleotide sequence of GAM7776 RNA, herein designated GAM RNA, also designated SEQ ID:246.

Another function of GAM7776 is therefore inhibition of FLJ11715 (Accession NP_078840.1). Accordingly, utilities of GAM7776 include diagnosis, prevention and treatment of diseases and clinical conditions associated with FLJ11715.

FLJ11800 (Accession NP_079250.1) is another GAM7776 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:10847, to the nucleotide sequence of GAM7776 RNA, herein designated GAM RNA, also designated SEQ ID:246.

Another function of GAM7776 is therefore inhibition of FLJ11800 (Accession NP_079250.1). Accordingly, utilities of GAM7776 include diagnosis, prevention and treatment of diseases and clinical conditions associated with FLJ11800.

FLJ12076 (Accession NP_079463.2) is another GAM7776 target gene, herein designated TARGET GENE. FLJ12076 BINDING SITE is a target binding site found in the 3' untranslated region of mRNA encoded by FLJ12076, corresponding to a target binding site such as BINDING SITE I, BINDING SITE II or BINDING SITE III of FIG. 8. Table 4 illustrates the complementarity of the nucleotide sequences of FLJ12076 BINDING SITE, designated SEQ ID:8886, to the nucleotide sequence of GAM7776 RNA, herein designated GAM RNA, also designated SEQ ID:246.

Another function of GAM7776 is therefore inhibition of FLJ12076 (Accession NP_079463.2). Accordingly, utilities of GAM7776 include diagnosis, prevention and treatment of diseases and clinical conditions associated with FLJ12076.

FLJ12363 (Accession NP_115543.1) is another GAM7776 target gene, herein designated TARGET GENE. FLJ12363 BINDING SITE is a target binding site found in the 3' untranslated region of mRNA encoded by FLJ12363, corresponding to a target binding site such as BINDING SITE I, BINDING SITE II or BINDING SITE III of FIG. 8. Table 4 illustrates the complementarity of the nucleotide sequences of FLJ12363 BINDING SITE, designated SEQ ID:17722, to the nucleotide sequence of GAM7776 RNA, herein designated GAM RNA, also designated SEQ ID:246.

Another function of GAM7776 is therefore inhibition of FLJ12363 (Accession NP_115543.1). Accordingly, utilities of GAM7776 include diagnosis, prevention and treatment of diseases and clinical conditions associated with FLJ12363.

FLJ12572 (Accession NP_075056.2) is another GAM7776 target gene, herein designated TARGET GENE. FLJ12572 BINDING SITE is a target binding site found in the 5' untranslated region of mRNA encoded by FLJ12572, corresponding to a target binding site such as BINDING SITE I, BINDING SITE II or BINDING SITE III of FIG. 8. Table 4 illustrates the complementarity of the nucleotide sequences of FLJ12572 BINDING SITE, designated SEQ ID:17515, to the nucleotide sequence of GAM7776 RNA, herein designated GAM RNA, also designated SEQ ID:246.

Another function of GAM7776 is therefore inhibition of FLJ12572 (Accession NP_075056.2). Accordingly, utilities of GAM7776 include diagnosis, prevention and treatment of diseases and clinical conditions associated with FLJ12572.

FLJ12586 (Accession NP_078896.2) is another GAM7776 target gene, herein designated TARGET GENE. FLJ12586 BINDING SITE is a target binding site found in the 5' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:10410, to the nucleotide sequence of GAM7776 RNA, herein designated GAM RNA, also designated SEQ ID:246.

Another function of GAM7776 is therefore inhibition of FLJ12586 (Accession NP_078896.2). Accordingly, utilities of GAM7776 include diagnosis, prevention and treatment of diseases and clinical conditions associated with FLJ12586.

FLJ12649 (Accession XP_291344.1) is another GAM7776 target gene, herein designated TARGET GENE. FLJ12649 BINDING SITE is a target binding site found in the 3' untranslated region of mRNA encoded by FLJ12649, corresponding to a target binding site such as BINDING SITE I, BINDING SITE II or BINDING SITE III of FIG. 8. Table 4 illustrates the complementarity of the nucleotide sequences of FLJ12649 BINDING SITE, designated SEQ ID:3686, to the nucleotide sequence of GAM7776 RNA, herein designated GAM RNA, also designated SEQ ID:246.

Another function of GAM7776 is therefore inhibition of FLJ12649 (Accession XP_291344.1). Accordingly, utilities of GAM7776 include diagnosis, prevention and treatment of diseases and clinical conditions associated with FLJ12649.

FLJ12687 (Accession NP_079193.2) is another GAM7776 target gene, herein designated TARGET GENE. FLJ12687 BINDING SITE is a target binding site found in the 3' untranslated region of mRNA encoded by FLJ12687, corresponding to a target binding site such as BINDING SITE I, BINDING SITE II or BINDING SITE III of FIG. 8. Table 4 illustrates the complementarity of the nucleotide sequences of FLJ12687 BINDING SITE, designated SEQ ID:3324, to the nucleotide sequence of GAM7776 RNA, herein designated GAM RNA, also designated SEQ ID:246.

Another function of GAM7776 is therefore inhibition of FLJ12687 (Accession NP_079193.2). Accordingly, utilities of GAM7776 include diagnosis, prevention and treatment of diseases and clinical conditions associated with FLJ12687.

FLJ12747 (Accession XP_290972.1) is another GAM7776 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:10683, to the nucleotide sequence of GAM7776 RNA, herein designated GAM RNA, also designated SEQ ID:246.

Another function of GAM7776 is therefore inhibition of FLJ12747 (Accession XP_290972.1). Accordingly, utilities of GAM7776 include diagnosis, prevention and treatment of diseases and clinical conditions associated with FLJ12747.

FLJ12787 (Accession NP_115551.1) is another GAM7776 target gene, herein designated TARGET GENE. FLJ12787 BINDING SITE is a target binding site found in the 3' untranslated region of mRNA encoded by FLJ12787, corresponding to a target binding site such as BINDING SITE I, BINDING SITE II or BINDING SITE III of FIG. 8. Table 4 illustrates the complementarity of the nucleotide sequences of FLJ12787 BINDING SITE, designated SEQ ID:14839, to the nucleotide sequence of GAM7776 RNA, herein designated GAM RNA, also designated SEQ ID:246.

Another function of GAM7776 is therefore inhibition of FLJ12787 (Accession NP_115551.1). Accordingly, utilities of GAM7776 include diagnosis, prevention and treatment of diseases and clinical conditions associated with FLJ12787.

FLJ12800 (Accession NP_075054.1) is another GAM7776 target gene, herein designated TARGET GENE. FLJ12800 BINDING SITE is a target binding site found in the 3' untranslated region of mRNA encoded by FLJ12800, corresponding to a target binding site such as BINDING SITE I, BINDING SITE II or BINDING SITE III of FIG. 8. Table 4 illustrates the complementarity of the nucleotide sequences of FLJ12800 BINDING SITE, designated SEQ ID:4261, to the nucleotide sequence of GAM7776 RNA, herein designated GAM RNA, also designated SEQ ID:246.

Another function of GAM7776 is therefore inhibition of FLJ12800 (Accession NP_075054.1). Accordingly, utilities of GAM7776 include diagnosis, prevention and treatment of diseases and clinical conditions associated with FLJ12800.

FLJ12888 (Accession NP_079221.1) is another GAM7776 target gene, herein designated TARGET GENE. FLJ12888 BINDING SITE is a target binding site found in the 3' untranslated region of mRNA encoded by FLJ12888, corresponding to a target binding site such as BINDING SITE I, BINDING SITE II or BINDING SITE III of FIG. 8. Table 4 illustrates the complementarity of the nucleotide sequences of FLJ12888 BINDING SITE, designated SEQ ID:17723, to the nucleotide sequence of GAM7776 RNA, herein designated GAM RNA, also designated SEQ ID:246.

Another function of GAM7776 is therefore inhibition of FLJ12888 (Accession NP_079221.1). Accordingly, utilities of GAM7776 include diagnosis, prevention and treatment of diseases and clinical conditions associated with FLJ12888.

FLJ12903 (Accession NP_073590.1) is another GAM7776 target gene, herein designated TARGET GENE. FLJ12903 BINDING SITE is a target binding site found in the 3' untranslated region of mRNA encoded by FLJ12903, corresponding to a target binding site such as BINDING SITE I, BINDING SITE II or BINDING SITE III of FIG. 8. Table 4 illustrates the complementarity of the nucleotide sequences of FLJ12903 BINDING SITE, designated SEQ ID:10224, to the nucleotide sequence of GAM7776 RNA, herein designated GAM RNA, also designated SEQ ID:246.

Another function of GAM7776 is therefore inhibition of FLJ12903 (Accession NP_073590.1). Accordingly, utilities of GAM7776 include diagnosis, prevention and treatment of diseases and clinical conditions associated with FLJ12903.

FLJ12960 (Accession NP_078914.1) is another GAM7776 target gene, herein designated TARGET GENE. FLJ12960 BINDING SITE is a target binding site found in the 3' untranslated region of mRNA encoded by FLJ12960, corresponding to a target binding site such as BINDING SITE I, BINDING SITE II or BINDING SITE III of FIG. 8. Table 4 illustrates the complementarity of the nucleotide sequences of FLJ12960 BINDING SITE, designated SEQ ID:11523, to the nucleotide sequence of GAM7776 RNA, herein designated GAM RNA, also designated SEQ ID:246.

Another function of GAM7776 is therefore inhibition of FLJ12960 (Accession NP_078914.1). Accordingly, utilities of GAM7776 include diagnosis, prevention and treatment of diseases and clinical conditions associated with FLJ12960.

FLJ12973 (Accession NP_079184.1) is another GAM7776 target gene, herein designated TARGET GENE. FLJ12973 BINDING SITE is a target binding site found in the 3' untranslated region of mRNA encoded by FLJ12973, corresponding to a target binding site such as BINDING SITE I, BINDING SITE II or BINDING SITE III of FIG. 8. Table 4 illustrates the complementarity of the nucleotide sequences of FLJ12973 BINDING SITE, designated SEQ ID:5230, to the nucleotide sequence of GAM7776 RNA, herein designated GAM RNA, also designated SEQ ID:246.

Another function of GAM7776 is therefore inhibition of FLJ12973 (Accession NP_079184.1). Accordingly, utilities of GAM7776 include diagnosis, prevention and treatment of diseases and clinical conditions associated with FLJ12973.

FLJ12975 (Accession NP_079085.2) is another GAM7776 target gene, herein designated TARGET GENE. FLJ12975 BINDING SITE is a target binding site found in the 3' untranslated region of mRNA encoded by FLJ12975, corresponding to a target binding site such as BINDING SITE I, BINDING SITE II or BINDING SITE III of FIG. 8. Table 4 illustrates the complementarity of the nucleotide sequences of FLJ12975 BINDING SITE, designated SEQ ID:2409, to the nucleotide sequence of GAM7776 RNA, herein designated GAM RNA, also designated SEQ ID:246.

Another function of GAM7776 is therefore inhibition of FLJ12975 (Accession NP_079085.2). Accordingly, utilities of GAM7776 include diagnosis, prevention and treatment of diseases and clinical conditions associated with FLJ12975.

FLJ12986 (Accession XP_290685.1) is another GAM7776 target gene, herein designated TARGET GENE. FLJ12986 BINDING SITE is a target binding site found in the 3' untranslated region of mRNA encoded by FLJ12986, corresponding to a target binding site such as BINDING SITE I, BINDING SITE II or BINDING SITE III of FIG. 8. Table 4 illustrates the complementarity of the nucleotide sequences of FLJ12986 BINDING SITE, designated SEQ ID:6037, to the nucleotide sequence of GAM7776 RNA, herein designated GAM RNA, also designated SEQ ID:246.

Another function of GAM7776 is therefore inhibition of FLJ12986 (Accession XP_290685.1). Accordingly, utilities of GAM7776 include diagnosis, prevention and treatment of diseases and clinical conditions associated with FLJ12986.

FLJ13072 (Accession XP_117117.2) is another GAM7776 target gene, herein designated TARGET GENE. FLJ13072 BINDING SITE1 and FLJ13072 BINDING SITE2 are target binding sites found in untranslated regions of mRNA encoded by FLJ13072, corresponding to target binding sites such as BINDING SITE I, BINDING SITE II or BINDING SITE III of FIG. 8. Table 4 illustrates the complementarity of the nucleotide sequences of FLJ13072 BINDING SITE1 and FLJ13072 BINDING SITE2, designated SEQ ID:13729 and SEQ ID:2223 respectively, to the nucleotide sequence of GAM7776 RNA, herein designated GAM RNA, also designated SEQ ID:246.

Another function of GAM7776 is therefore inhibition of FLJ13072 (Accession XP_117117.2). Accordingly, utilities of GAM7776 include diagnosis, prevention and treatment of diseases and clinical conditions associated with FLJ13072.

FLJ13114 (Accession NP_078817.1) is another GAM7776 target gene, herein designated TARGET GENE. FLJ13114 BINDING SITE is a target binding site found in the 3' untranslated region of mRNA encoded by FLJ13114, corresponding to a target binding site such as BINDING SITE I, BINDING SITE II or BINDING SITE III of FIG. 8. Table 4 illustrates the complementarity of the nucleotide sequences of FLJ13114 BINDING SITE, designated SEQ ID:11919, to the nucleotide sequence of GAM7776 RNA, herein designated GAM RNA, also designated SEQ ID:246.

Another function of GAM7776 is therefore inhibition of FLJ13114 (Accession NP_078817.1). Accordingly, utilities of GAM7776 include diagnosis, prevention and treatment of diseases and clinical conditions associated with FLJ13114.

FLJ13197 (Accession NP_078890.1) is another GAM7776 target gene, herein designated TARGET GENE. FLJ13197 BINDING SITE is a target binding site found in the 3' untranslated region of mRNA encoded by FLJ13197, corresponding to a target binding site such as BINDING SITE I, BINDING SITE II or BINDING SITE III of FIG. 8. Table 4 illustrates the complementarity of the nucleotide sequences of FLJ13197 BINDING SITE, designated SEQ ID:8231, to the nucleotide sequence of GAM7776 RNA, herein designated GAM RNA, also designated SEQ ID:246.

Another function of GAM7776 is therefore inhibition of FLJ13197 (Accession NP_078890.1). Accordingly, utilities of GAM7776 include diagnosis, prevention and treatment of diseases and clinical conditions associated with FLJ13197.

FLJ13352 (Accession NP_078868.1) is another GAM7776 target gene, herein designated TARGET GENE. FLJ13352 BINDING SITE1 and FLJ13352 BINDING SITE2 are target binding sites found in untranslated regions of mRNA encoded by FLJ13352, corresponding to target binding sites such as BINDING SITE I, BINDING SITE II or BINDING SITE III of FIG. 8. Table 4 illustrates the complementarity of the nucleotide sequences of FLJ13352 BINDING SITE1 and FLJ13352 BINDING SITE2, designated SEQ ID:10493 and SEQ ID:13318 respectively, to the nucleotide sequence of GAM7776 RNA, herein designated GAM RNA, also designated SEQ ID:246.

Another function of GAM7776 is therefore inhibition of FLJ13352 (Accession NP_078868.1). Accordingly, utilities of GAM7776 include diagnosis, prevention and treatment of diseases and clinical conditions associated with FLJ13352.

FLJ13456 (Accession XP_038291.5) is another GAM7776 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:8163, to the nucleotide sequence of GAM7776 RNA, herein designated GAM RNA, also designated SEQ ID:246.

Another function of GAM7776 is therefore inhibition of FLJ13456 (Accession XP_038291.5). Accordingly, utilities of GAM7776 include diagnosis, prevention and treatment of diseases and clinical conditions associated with FLJ13456.

FLJ13910 (Accession NP_073617.1) is another GAM7776 target gene, herein designated TARGET GENE. FLJ13910 BINDING SITE is a target binding site found in the 3' untranslated region of mRNA encoded by FLJ13910, corresponding to a target binding site such as BINDING SITE I, BINDING SITE II or BINDING SITE III of FIG. 8. Table 4 illustrates the complementarity of the nucleotide sequences of FLJ13910 BINDING SITE, designated SEQ ID:7691, to the nucleotide sequence of GAM7776 RNA, herein designated GAM RNA, also designated SEQ ID:246.

Another function of GAM7776 is therefore inhibition of FLJ13910 (Accession NP_073617.1). Accordingly, utilities of GAM7776 include diagnosis, prevention and treatment of diseases and clinical conditions associated with FLJ13910.

FLJ13984 (Accession NP_079046.1) is another GAM7776 target gene, herein designated TARGET GENE. FLJ13984 BINDING SITE1 and FLJ13984 BINDING SITE2 are target binding sites found in untranslated regions of mRNA encoded by FLJ13984, corresponding to target binding sites such as BINDING SITE I, BINDING SITE II or BINDING SITE III of FIG. 8. Table 4 illustrates the complementarity of the nucleotide sequences of FLJ13984 BINDING SITE1 and FLJ13984 BINDING SITE2, designated SEQ ID:4819 and SEQ ID:10809 respectively, to the nucleotide sequence of GAM7776 RNA, herein designated GAM RNA, also designated SEQ ID:246.

Another function of GAM7776 is therefore inhibition of FLJ13984 (Accession NP_079046.1). Accordingly, utilities of GAM7776 include diagnosis, prevention and treatment of diseases and clinical conditions associated with FLJ13984.

FLJ14100 (Accession NP_079301.1) is another GAM7776 target gene, herein designated TARGET GENE. FLJ14100 BINDING SITE is a target binding site found in the 3' untranslated region of mRNA encoded by FLJ14100, corresponding to a target binding site such as BINDING SITE I, BINDING SITE II or BINDING SITE III of FIG. 8. Table 4 illustrates the complementarity of the nucleotide sequences of FLJ14100 BINDING SITE, designated SEQ ID:12143, to the nucleotide sequence of GAM7776 RNA, herein designated GAM RNA, also designated SEQ ID:246.

Another function of GAM7776 is therefore inhibition of FLJ14100 (Accession NP_079301.1). Accordingly, utilities of GAM7776 include diagnosis, prevention and treatment of diseases and clinical conditions associated with FLJ14100.

FLJ14260 (Accession NP_079303.2) is another GAM7776 target gene, herein designated TARGET GENE. FLJ14260 BINDING SITE is a target binding site found in the 3' untranslated region of mRNA encoded by FLJ14260, corresponding to a target binding site such as BINDING SITE I, BINDING SITE II or BINDING SITE III of FIG. 8. Table 4 illustrates the complementarity of the nucleotide sequences of FLJ14260 BINDING SITE, designated SEQ ID:921, to the nucleotide sequence of GAM7776 RNA, herein designated GAM RNA, also designated SEQ ID:246.

Another function of GAM7776 is therefore inhibition of FLJ14260 (Accession NP_079303.2). Accordingly, utilities of GAM7776 include diagnosis, prevention and treatment of diseases and clinical conditions associated with FLJ14260.

FLJ14351 (Accession NP_079008.1) is another GAM7776 target gene, herein designated TARGET GENE. FLJ14351 BINDING SITE is a target binding site found in the 3' untranslated region of mRNA encoded by FLJ14351, corresponding to a target binding site such as BINDING SITE I, BINDING SITE II or BINDING SITE III of FIG. 8. Table 4 illustrates the complementarity of the nucleotide sequences of FLJ14351 BINDING SITE, designated SEQ ID:8586, to the nucleotide sequence of GAM7776 RNA, herein designated GAM RNA, also designated SEQ ID:246.

Another function of GAM7776 is therefore inhibition of FLJ14351 (Accession NP_079008.1). Accordingly, utilities of GAM7776 include diagnosis, prevention and treatment of diseases and clinical conditions associated with FLJ14351.

FLJ14442 (Accession NP_116174.1) is another GAM7776 target gene, herein designated TARGET GENE. FLJ14442 BINDING SITE is a target binding site found in the 3' untranslated region of mRNA encoded by FLJ14442, corresponding to a target binding site such as BINDING SITE I, BINDING SITE II or BINDING SITE III of FIG. 8. Table 4 illustrates the complementarity of the nucleotide sequences of FLJ14442 BINDING SITE, designated SEQ ID:16259, to the nucleotide sequence of GAM7776 RNA, herein designated GAM RNA, also designated SEQ ID:246.

Another function of GAM7776 is therefore inhibition of FLJ14442 (Accession NP_116174.1). Accordingly, utilities of GAM7776 include diagnosis, prevention and treatment of diseases and clinical conditions associated with FLJ14442.

FLJ14803 (Accession NP_116231.1) is another GAM7776 target gene, herein designated TARGET GENE. FLJ14803 BINDING SITE is a target binding site found in the 3' untranslated region of mRNA encoded by FLJ14803, corresponding to a target binding site such as BINDING SITE I, BINDING SITE II or BINDING SITE III of FIG. 8. Table 4 illustrates the complementarity of the nucleotide sequences of FLJ14803 BINDING SITE, designated SEQ ID:939, to the nucleotide sequence of GAM7776 RNA, herein designated GAM RNA, also designated SEQ ID:246.

Another function of GAM7776 is therefore inhibition of FLJ14803 (Accession NP_116231.1). Accordingly, utilities of GAM7776 include diagnosis, prevention and treatment of diseases and clinical conditions associated with FLJ14803.

FLJ14957 (Accession NP_116255.1) is another GAM7776 target gene, herein designated TARGET GENE. FLJ14957 BINDING SITE is a target binding site found in the 3' untranslated region of mRNA encoded by FLJ14957, corresponding to a target binding site such as BINDING SITE I, BINDING SITE II or BINDING SITE III of FIG. 8. Table 4 illustrates the complementarity of the nucleotide sequences of FLJ14957 BINDING SITE, designated SEQ ID:13527, to the nucleotide sequence of GAM7776 RNA, herein designated GAM RNA, also designated SEQ ID:246.

Another function of GAM7776 is therefore inhibition of FLJ14957 (Accession NP_116255.1). Accordingly, utilities of GAM7776 include diagnosis, prevention and treatment of diseases and clinical conditions associated with FLJ14957.

FLJ20045 (Accession NP_060108.1) is another GAM7776 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:12557, to the nucleotide sequence of GAM7776 RNA, herein designated GAM RNA, also designated SEQ ID:246.

Another function of GAM7776 is therefore inhibition of FLJ20045 (Accession NP_060108.1). Accordingly, utilities of GAM7776 include diagnosis, prevention and treatment of diseases and clinical conditions associated with FLJ20045.

FLJ20070 (Accession NP_060122.1) is another GAM7776 target gene, herein designated TARGET GENE. FLJ20070 BINDING SITE is a target binding site found in the 3' untranslated region of mRNA encoded by FLJ20070, corresponding to a target binding site such as BINDING SITE I, BINDING SITE II or BINDING SITE III of FIG. 8. Table 4 illustrates the complementarity of the nucleotide sequences of FLJ20070 BINDING SITE, designated SEQ ID:7530, to the nucleotide sequence of GAM7776 RNA, herein designated GAM RNA, also designated SEQ ID:246.

Another function of GAM7776 is therefore inhibition of FLJ20070 (Accession NP_060122.1). Accordingly, utilities of GAM7776 include diagnosis, prevention and treatment of diseases and clinical conditions associated with FLJ20070.

FLJ20079 (Accession NP_060126.1) is another GAM7776 target gene, herein designated TARGET GENE.

FLJ20079 BINDING SITE is a target binding site found in the 3' untranslated region of mRNA encoded by FLJ20079, corresponding to a target binding site such as BINDING SITE I, BINDING SITE II or BINDING SITE III of FIG. 8. Table 4 illustrates the complementarity of the nucleotide sequences of FLJ20079 BINDING SITE, designated SEQ ID:14265, to the nucleotide sequence of GAM7776 RNA, herein designated GAM RNA, also designated SEQ ID:246.

Another function of GAM7776 is therefore inhibition of FLJ20079 (Accession NP_060126.1). Accordingly, utilities of GAM7776 include diagnosis, prevention and treatment of diseases and clinical conditions associated with FLJ20079.

FLJ20095 (Accession NP_060136.1) is another GAM7776 target gene, herein designated TARGET GENE. FLJ20095 BINDING SITE is a target binding site found in the 3' untranslated region of mRNA encoded by FLJ20095, corresponding to a target binding site such as BINDING SITE I, BINDING SITE II or BINDING SITE III of FIG. 8. Table 4 illustrates the complementarity of the nucleotide sequences of FLJ20095 BINDING SITE, designated SEQ ID:7385, to the nucleotide sequence of GAM7776 RNA, herein designated GAM RNA, also designated SEQ ID:246.

Another function of GAM7776 is therefore inhibition of FLJ20095 (Accession NP_060136.1). Accordingly, utilities of GAM7776 include diagnosis, prevention and treatment of diseases and clinical conditions associated with FLJ20095.

FLJ20136 (Accession NP_060154.1) is another GAM7776 target gene, herein designated TARGET GENE. FLJ20136 BINDING SITE is a target binding site found in the 3' untranslated region of mRNA encoded by FLJ20136, corresponding to a target binding site such as BINDING SITE I, BINDING SITE II or BINDING SITE III of FIG. 8. Table 4 illustrates the complementarity of the nucleotide sequences of FLJ20136 BINDING SITE, designated SEQ ID:4536, to the nucleotide sequence of GAM7776 RNA, herein designated GAM RNA, also designated SEQ ID:246.

Another function of GAM7776 is therefore inhibition of FLJ20136 (Accession NP_060154.1). Accordingly, utilities of GAM7776 include diagnosis, prevention and treatment of diseases and clinical conditions associated with FLJ20136.

FLJ20147 (Accession NP_060157.1) is another GAM7776 target gene, herein designated TARGET GENE. FLJ20147 BINDING SITE is a target binding site found in the 3' untranslated region of mRNA encoded by FLJ20147, corresponding to a target binding site such as BINDING SITE I, BINDING SITE II or BINDING SITE III of FIG. 8. Table 4 illustrates the complementarity of the nucleotide sequences of FLJ20147 BINDING SITE, designated SEQ ID:2624, to the nucleotide sequence of GAM7776 RNA, herein designated GAM RNA, also designated SEQ ID:246.

Another function of GAM7776 is therefore inhibition of FLJ20147 (Accession NP_060157.1). Accordingly, utilities of GAM7776 include diagnosis, prevention and treatment of diseases and clinical conditions associated with FLJ20147.

FLJ20245 (Accession NP_060193.1) is another GAM7776 target gene, herein designated TARGET GENE. FLJ20245 BINDING SITE1 and FLJ20245 BINDING SITE2 are target binding sites found in untranslated regions of mRNA encoded by FLJ20245, corresponding to target binding sites such as BINDING SITE I, BINDING SITE II or BINDING SITE III of FIG. 8. Table 4 illustrates the complementarity of the nucleotide sequences of FLJ20245 BINDING SITE1 and FLJ20245 BINDING SITE2, designated SEQ ID:8581 and SEQ ID:5275 respectively, to the nucleotide sequence of GAM7776 RNA, herein designated GAM RNA, also designated SEQ ID:246.

Another function of GAM7776 is therefore inhibition of FLJ20245 (Accession NP_060193.1). Accordingly, utilities of GAM7776 include diagnosis, prevention and treatment of diseases and clinical conditions associated with FLJ20245.

FLJ20257 (Accession NP_062552.1) is another GAM7776 target gene, herein designated TARGET GENE. FLJ20257 BINDING SITE is a target binding site found in the 3' untranslated region of mRNA encoded by FLJ20257, corresponding to a target binding site such as BINDING SITE I, BINDING SITE II or BINDING SITE III of FIG. 8. Table 4 illustrates the complementarity of the nucleotide sequences of FLJ20257 BINDING SITE, designated SEQ ID:7206, to the nucleotide sequence of GAM7776 RNA, herein designated GAM RNA, also designated SEQ ID:246.

Another function of GAM7776 is therefore inhibition of FLJ20257 (Accession NP_062552.1). Accordingly, utilities of GAM7776 include diagnosis, prevention and treatment of diseases and clinical conditions associated with FLJ20257.

FLJ20344 (Accession NP_060246.1) is another GAM7776 target gene, herein designated TARGET GENE. FLJ20344 BINDING SITE is a target binding site found in the 3' untranslated region of mRNA encoded by FLJ20344, corresponding to a target binding site such as BINDING SITE I, BINDING SITE II or BINDING SITE III of FIG. 8. Table 4 illustrates the complementarity of the nucleotide sequences of FLJ20344 BINDING SITE, designated SEQ ID:4079, to the nucleotide sequence of GAM7776 RNA, herein designated GAM RNA, also designated SEQ ID:246.

Another function of GAM7776 is therefore inhibition of FLJ20344 (Accession NP_060246.1). Accordingly, utilities of GAM7776 include diagnosis, prevention and treatment of diseases and clinical conditions associated with FLJ20344.

FLJ20359 (Accession NP_060251.1) is another GAM7776 target gene, herein designated TARGET GENE. FLJ20359 BINDING SITE is a target binding site found in the 3' untranslated region of mRNA encoded by FLJ20359, corresponding to a target binding site such as BINDING SITE I, BINDING SITE II or BINDING SITE III of FIG. 8. Table 4 illustrates the complementarity of the nucleotide sequences of FLJ20359 BINDING SITE, designated SEQ ID:11024, to the nucleotide sequence of GAM7776 RNA, herein designated GAM RNA, also designated SEQ ID:246.

Another function of GAM7776 is therefore inhibition of FLJ20359 (Accession NP_060251.1). Accordingly, utilities of GAM7776 include diagnosis, prevention and treatment of diseases and clinical conditions associated with FLJ20359.

FLJ20375 (Accession NP_060264.2) is another GAM7776 target gene, herein designated TARGET GENE. FLJ20375 BINDING SITE is a target binding site found in the 3' untranslated region of mRNA encoded by FLJ20375, corresponding to a target binding site such as BINDING SITE I, BINDING SITE II or BINDING SITE III of FIG. 8. Table 4 illustrates the complementarity of the nucleotide sequences of FLJ20375 BINDING SITE, designated SEQ ID:9357, to the nucleotide sequence of GAM7776 RNA, herein designated GAM RNA, also designated SEQ ID:246.

Another function of GAM7776 is therefore inhibition of FLJ20375 (Accession NP_060264.2). Accordingly, utilities of GAM7776 include diagnosis, prevention and treatment of diseases and clinical conditions associated with FLJ20375.

FLJ20511 (Accession NP_060323.1) is another GAM7776 target gene, herein designated TARGET GENE. FLJ20511 BINDING SITE is a target binding site found in the 3' untranslated region of mRNA encoded by FLJ20511, corresponding to a target binding site such as BINDING SITE I, BINDING SITE II or BINDING SITE III of FIG. 8. Table 4 illustrates the complementarity of the nucleotide sequences of FLJ20511 BINDING SITE, designated SEQ ID:17759, to the nucleotide sequence of GAM7776 RNA, herein designated GAM RNA, also designated SEQ ID:246.

Another function of GAM7776 is therefore inhibition of FLJ20511 (Accession NP_060323.1). Accordingly, utilities of GAM7776 include diagnosis, prevention and treatment of diseases and clinical conditions associated with FLJ20511.

FLJ20527 (Accession NP_060333.1) is another GAM7776 target gene, herein designated TARGET GENE. FLJ20527 BINDING SITE is a target binding site found in the 5' untranslated region of mRNA encoded by FLJ20527, corresponding to a target binding site such as BINDING SITE I, BINDING SITE II or BINDING SITE III of FIG. 8. Table 4 illustrates the complementarity of the nucleotide sequences of FLJ20527 BINDING SITE, designated SEQ ID:17075, to the nucleotide sequence of GAM7776 RNA, herein designated GAM RNA, also designated SEQ ID:246.

Another function of GAM7776 is therefore inhibition of FLJ20527 (Accession NP_060333.1). Accordingly, utilities of GAM7776 include diagnosis, prevention and treatment of diseases and clinical conditions associated with FLJ20527.

FLJ20671 (Accession NP_060394.1) is another GAM7776 target gene, herein designated TARGET GENE. FLJ20671 BINDING SITE1 and FLJ20671 BINDING SITE2 are target binding sites found in untranslated regions of mRNA encoded by FLJ20671, corresponding to target binding sites such as BINDING SITE I, BINDING SITE II or BINDING SITE III of FIG. 8. Table 4 illustrates the complementarity of the nucleotide sequences of FLJ20671 BINDING SITE1 and FLJ20671 BINDING SITE2, designated SEQ ID:16491 and SEQ ID:13041 respectively, to the nucleotide sequence of GAM7776 RNA, herein designated GAM RNA, also designated SEQ ID:246.

Another function of GAM7776 is therefore inhibition of FLJ20671 (Accession NP_060394.1). Accordingly, utilities of GAM7776 include diagnosis, prevention and treatment of diseases and clinical conditions associated with FLJ20671.

FLJ20700 (Accession NP_060402.1) is another GAM7776 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:18943, to the nucleotide sequence of GAM7776 RNA, herein designated GAM RNA, also designated SEQ ID:246.

Another function of GAM7776 is therefore inhibition of FLJ20700 (Accession NP_060402.1). Accordingly, utilities of GAM7776 include diagnosis, prevention and treatment of diseases and clinical conditions associated with FLJ20700.

FLJ20813 (Accession NP_060431.1) is another GAM7776 target gene, herein designated TARGET GENE. FLJ20813 BINDING SITE is a target binding site found in the 3' untranslated region of mRNA encoded by FLJ20813, corresponding to a target binding site such as BINDING SITE I, BINDING SITE II or BINDING SITE III of FIG. 8. Table 4 illustrates the complementarity of the nucleotide sequences of FLJ20813 BINDING SITE, designated SEQ ID:10574, to the nucleotide sequence of GAM7776 RNA, herein designated GAM RNA, also designated SEQ ID:246.

Another function of GAM7776 is therefore inhibition of FLJ20813 (Accession NP_060431.1). Accordingly, utilities of GAM7776 include diagnosis, prevention and treatment of diseases and clinical conditions associated with FLJ20813.

FLJ21128 (Accession NP_079359.2) is another GAM7776 target gene, herein designated TARGET GENE. FLJ21128 BINDING SITE is a target binding site found in the 3' untranslated region of mRNA encoded by FLJ21128, corresponding to a target binding site such as BINDING SITE I, BINDING SITE II or BINDING SITE III of FIG. 8. Table 4 illustrates the complementarity of the nucleotide sequences of FLJ21128 BINDING SITE, designated SEQ ID:17516, to the nucleotide sequence of GAM7776 RNA, herein designated GAM RNA, also designated SEQ ID:246.

Another function of GAM7776 is therefore inhibition of FLJ21128 (Accession NP_079359.2). Accordingly, utilities of GAM7776 include diagnosis, prevention and treatment of diseases and clinical conditions associated with FLJ21128.

FLJ21603 (Accession NP_079038.1) is another GAM7776 target gene, herein designated TARGET GENE. FLJ21603 BINDING SITE is a target binding site found in the 3' untranslated region of mRNA encoded by FLJ21603, corresponding to a target binding site such as BINDING SITE I, BINDING SITE II or BINDING SITE III of FIG. 8. Table 4 illustrates the complementarity of the nucleotide sequences of FLJ21603 BINDING SITE, designated SEQ ID:15047, to the nucleotide sequence of GAM7776 RNA, herein designated GAM RNA, also designated SEQ ID:246.

Another function of GAM7776 is therefore inhibition of FLJ21603 (Accession NP_079038.1). Accordingly, utilities of GAM7776 include diagnosis, prevention and treatment of diseases and clinical conditions associated with FLJ21603.

FLJ21673 (Accession NP_112160.1) is another GAM7776 target gene, herein designated TARGET GENE. FLJ21673 BINDING SITE is a target binding site found in the 5' untranslated region of mRNA encoded by FLJ21673, corresponding to a target binding site such as BINDING SITE I, BINDING SITE II or BINDING SITE III of FIG. 8. Table 4 illustrates the complementarity of the nucleotide sequences of FLJ21673 BINDING SITE, designated SEQ ID:1435, to the nucleotide sequence of GAM7776 RNA, herein designated GAM RNA, also designated SEQ ID:246.

Another function of GAM7776 is therefore inhibition of FLJ21673 (Accession NP_112160.1). Accordingly, utilities of GAM7776 include diagnosis, prevention and treatment of diseases and clinical conditions associated with FLJ21673.

FLJ21777 (Accession NP_115585.1) is another GAM7776 target gene, herein designated TARGET GENE. FLJ21777 BINDING SITE is a target binding site found in the 3' untranslated region of mRNA encoded by FLJ21777, corresponding to a target binding site such as BINDING SITE I, BINDING SITE II or BINDING SITE III of FIG. 8. Table 4 illustrates the complementarity of the nucleotide sequences of FLJ21777 BINDING SITE, designated SEQ ID:4203, to the nucleotide sequence of GAM7776 RNA, herein designated GAM RNA, also designated SEQ ID:246.

Another function of GAM7776 is therefore inhibition of FLJ21777 (Accession NP_115585.1). Accordingly, utilities of GAM7776 include diagnosis, prevention and treatment of diseases and clinical conditions associated with FLJ21777.

FLJ22329 (Accession NP_078932.2) is another GAM7776 target gene, herein designated TARGET GENE. FLJ22329 BINDING SITE is a target binding site found in the 3' untranslated region of mRNA encoded by FLJ22329, corresponding to a target binding site such as BINDING SITE I, BINDING SITE II or BINDING SITE III of FIG. 8. Table 4 illustrates the complementarity of the nucleotide sequences of FLJ22329 BINDING SITE, designated SEQ ID:9543, to the nucleotide sequence of GAM7776 RNA, herein designated GAM RNA, also designated SEQ ID:246.

Another function of GAM7776 is therefore inhibition of FLJ22329 (Accession NP_078932.2). Accordingly, utilities of GAM7776 include diagnosis, prevention and treatment of diseases and clinical conditions associated with FLJ22329.

FLJ22531 (Accession NP_078926.2) is another GAM7776 target gene, herein designated TARGET GENE. FLJ22531 BINDING SITE is a target binding site found in the 5' untranslated region of mRNA encoded by FLJ22531, corresponding to a target binding site such as BINDING SITE I, BINDING SITE II or BINDING SITE III of FIG. 8. Table 4 illustrates the complementarity of the nucleotide sequences of FLJ22531 BINDING SITE, designated SEQ ID:5636, to the nucleotide sequence of GAM7776 RNA, herein designated GAM RNA, also designated SEQ ID:246.

Another function of GAM7776 is therefore inhibition of FLJ22531 (Accession NP_078926.2). Accordingly, utilities of GAM7776 include diagnosis, prevention and treatment of diseases and clinical conditions associated with FLJ22531.

FLJ22794 (Accession NP_071357.1) is another GAM7776 target gene, herein designated TARGET GENE. FLJ22794 BINDING SITE is a target binding site found in the 3' untranslated region of mRNA encoded by FLJ22794, corresponding to a target binding site such as BINDING SITE I, BINDING SITE II or BINDING SITE III of FIG. 8. Table 4 illustrates the complementarity of the nucleotide sequences of FLJ22794 BINDING SITE, designated SEQ ID:5559, to the nucleotide sequence of GAM7776 RNA, herein designated GAM RNA, also designated SEQ ID:246.

Another function of GAM7776 is therefore inhibition of FLJ22794 (Accession NP_071357.1). Accordingly, utilities of GAM7776 include diagnosis, prevention and treatment of diseases and clinical conditions associated with FLJ22794.

FLJ22965 (Accession NP_071384.1) is another GAM7776 target gene, herein designated TARGET GENE. FLJ22965 BINDING SITE is a target binding site found in the 3' untranslated region of mRNA encoded by FLJ22965, corresponding to a target binding site such as BINDING SITE I, BINDING SITE II or BINDING SITE III of FIG. 8. Table 4 illustrates the complementarity of the nucleotide sequences of FLJ22965 BINDING SITE, designated SEQ ID:2808, to the nucleotide sequence of GAM7776 RNA, herein designated GAM RNA, also designated SEQ ID:246.

Another function of GAM7776 is therefore inhibition of FLJ22965 (Accession NP_071384.1). Accordingly, utilities of GAM7776 include diagnosis, prevention and treatment of diseases and clinical conditions associated with FLJ22965.

FLJ23024 (Accession NP_079212.1) is another GAM7776 target gene, herein designated TARGET GENE. FLJ23024 BINDING SITE is a target binding site found in the 3' untranslated region of mRNA encoded by FLJ23024, corresponding to a target binding site such as BINDING SITE I, BINDING SITE II or BINDING SITE III of FIG. 8. Table 4 illustrates the complementarity of the nucleotide sequences of FLJ23024 BINDING SITE, designated SEQ ID:9682, to the nucleotide sequence of GAM7776 RNA, herein designated GAM RNA, also designated SEQ ID:246.

Another function of GAM7776 is therefore inhibition of FLJ23024 (Accession NP_079212.1). Accordingly, utilities of GAM7776 include diagnosis, prevention and treatment of diseases and clinical conditions associated with FLJ23024.

FLJ23053 (Accession NP_075058.1) is another GAM7776 target gene, herein designated TARGET GENE. FLJ23053 BINDING SITE is a target binding site found in the 3' untranslated region of mRNA encoded by FLJ23053, corresponding to a target binding site such as BINDING SITE I, BINDING SITE II or BINDING SITE III of FIG. 8. Table 4 illustrates the complementarity of the nucleotide sequences of FLJ23053 BINDING SITE, designated SEQ ID:8693, to the nucleotide sequence of GAM7776 RNA, herein designated GAM RNA, also designated SEQ ID:246.

Another function of GAM7776 is therefore inhibition of FLJ23053 (Accession NP_075058.1). Accordingly, utilities of GAM7776 include diagnosis, prevention and treatment of diseases and clinical conditions associated with FLJ23053.

FLJ23186 (Accession NP_078892.1) is another GAM7776 target gene, herein designated TARGET GENE. FLJ23186 BINDING SITE is a target binding site found in the 3' untranslated region of mRNA encoded by FLJ23186, corresponding to a target binding site such as BINDING SITE I, BINDING SITE II or BINDING SITE III of FIG. 8. Table 4 illustrates the complementarity of the nucleotide sequences of FLJ23186 BINDING SITE, designated SEQ ID:1340, to the nucleotide sequence of GAM7776 RNA, herein designated GAM RNA, also designated SEQ ID:246.

Another function of GAM7776 is therefore inhibition of FLJ23186 (Accession NP_078892.1). Accordingly, utilities of GAM7776 include diagnosis, prevention and treatment of diseases and clinical conditions associated with FLJ23186.

FLJ23263 (Accession NP_079391.1) is another GAM7776 target gene, herein designated TARGET GENE. FLJ23263 BINDING SITE is a target binding site found in the 5' untranslated region of mRNA encoded by FLJ23263, corresponding to a target binding site such as BINDING SITE I, BINDING SITE II or BINDING SITE III of FIG. 8. Table 4 illustrates the complementarity of the nucleotide sequences of FLJ23263 BINDING SITE, designated SEQ ID:11523, to the nucleotide sequence of GAM7776 RNA, herein designated GAM RNA, also designated SEQ ID:246.

Another function of GAM7776 is therefore inhibition of FLJ23263 (Accession NP_079391.1). Accordingly, utilities of GAM7776 include diagnosis, prevention and treatment of diseases and clinical conditions associated with FLJ23263.

FLJ23356 (Accession NP_115613.1) is another GAM7776 target gene, herein designated TARGET GENE. FLJ23356 BINDING SITE is a target binding site found in the 3' untranslated region of mRNA encoded by FLJ23356, corresponding to a target binding site such as BINDING SITE I, BINDING SITE II or BINDING SITE III of FIG. 8. Table 4 illustrates the complementarity of the nucleotide sequences of FLJ23356 BINDING SITE, designated SEQ ID:12273, to the nucleotide sequence of GAM7776 RNA, herein designated GAM RNA, also designated SEQ ID:246.

Another function of GAM7776 is therefore inhibition of FLJ23356 (Accession NP_115613.1). Accordingly, utilities of GAM7776 include diagnosis, prevention and treatment of diseases and clinical conditions associated with FLJ23356.

FLJ23392 (Accession NP_079060.1) is another GAM7776 target gene, herein designated TARGET GENE. FLJ23392 BINDING SITE1 through FLJ23392 BINDING SITE3 are target binding sites found in untranslated regions of mRNA encoded by FLJ23392, corresponding to target binding sites such as BINDING SITE I, BINDING SITE II or BINDING SITE III of FIG. 8. Table 4 illustrates the complementarity of the nucleotide sequences of FLJ23392 BINDING SITE1 through FLJ23392 BINDING SITE3, designated SEQ ID:20052, SEQ ID:5554 and SEQ ID:9148 respectively, to the nucleotide sequence of GAM7776 RNA, herein designated GAM RNA, also designated SEQ ID:246.

Another function of GAM7776 is therefore inhibition of FLJ23392 (Accession NP_079060.1). Accordingly, utilities of GAM7776 include diagnosis, prevention and treatment of diseases and clinical conditions associated with FLJ23392.

FLJ23416 (Accession NP_115614.1) is another GAM7776 target gene, herein designated TARGET GENE. FLJ23416 BINDING SITE is a target binding site found in the 3' untranslated region of mRNA encoded by FLJ23416, corresponding to a target binding site such as BINDING SITE I, BINDING SITE II or BINDING SITE III of FIG. 8. Table 4 illustrates the complementarity of the nucleotide sequences of FLJ23416 BINDING SITE, designated SEQ ID:2152, to the nucleotide sequence of GAM7776 RNA, herein designated GAM RNA, also designated SEQ ID:246.

Another function of GAM7776 is therefore inhibition of FLJ23416 (Accession NP_115614.1). Accordingly, utilities of GAM7776 include diagnosis, prevention and treatment of diseases and clinical conditions associated with FLJ23416.

FLJ23556 (Accession NP_079156.1) is another GAM7776 target gene, herein designated TARGET GENE. FLJ23556 BINDING SITE is a target binding site found in the 3' untranslated region of mRNA encoded by FLJ23556, corresponding to a target binding site such as BINDING SITE I, BINDING SITE II or BINDING SITE III of FIG. 8. Table 4 illustrates the complementarity of the nucleotide sequences of FLJ23556 BINDING SITE, designated SEQ ID:17969, to the nucleotide sequence of GAM7776 RNA, herein designated GAM RNA, also designated SEQ ID:246.

Another function of GAM7776 is therefore inhibition of FLJ23556 (Accession NP_079156.1). Accordingly, utilities of GAM7776 include diagnosis, prevention and treatment of diseases and clinical conditions associated with FLJ23556.

FLJ23563 (Accession XP_041701.4) is another GAM7776 target gene, herein designated TARGET GENE. FLJ23563 BINDING SITE is a target binding site found in the 3' untranslated region of mRNA encoded by FLJ23563, corresponding to a target binding site such as BINDING SITE I, BINDING SITE II or BINDING SITE III of FIG. 8. Table 4 illustrates the complementarity of the nucleotide sequences of FLJ23563 BINDING SITE, designated SEQ ID:15048, to the nucleotide sequence of GAM7776 RNA, herein designated GAM RNA, also designated SEQ ID:246.

Another function of GAM7776 is therefore inhibition of FLJ23563 (Accession XP_041701.4). Accordingly, utilities of GAM7776 include diagnosis, prevention and treatment of diseases and clinical conditions associated with FLJ23563.

FLJ23867 (Accession NP_689875.1) is another GAM7776 target gene, herein designated TARGET GENE. FLJ23867 BINDING SITE is a target binding site found in the 3' untranslated region of mRNA encoded by FLJ23867, corresponding to a target binding site such as BINDING SITE I, BINDING SITE II or BINDING SITE III of FIG. 8. Table 4 illustrates the complementarity of the nucleotide sequences of FLJ23867 BINDING SITE, designated SEQ ID:1374, to the nucleotide sequence of GAM7776 RNA, herein designated GAM RNA, also designated SEQ ID:246.

Another function of GAM7776 is therefore inhibition of FLJ23867 (Accession NP_689875.1). Accordingly, utilities of GAM7776 include diagnosis, prevention and treatment of diseases and clinical conditions associated with FLJ23867.

FLJ25416 (Accession NP_659455.2) is another GAM7776 target gene, herein designated TARGET GENE. FLJ25416 BINDING SITE is a target binding site found in the 5' untranslated region of mRNA encoded by FLJ25416, corresponding to a target binding site such as BINDING SITE I, BINDING SITE II or BINDING SITE III of FIG. 8. Table 4 illustrates the complementarity of the nucleotide sequences of FLJ25416 BINDING SITE, designated SEQ ID:16915, to the nucleotide sequence of GAM7776 RNA, herein designated GAM RNA, also designated SEQ ID:246.

Another function of GAM7776 is therefore inhibition of FLJ25416 (Accession NP_659455.2). Accordingly, utilities of GAM7776 include diagnosis, prevention and treatment of diseases and clinical conditions associated with FLJ25416.

FLJ25795 (Accession NP_689633.1) is another GAM7776 target gene, herein designated TARGET GENE. FLJ25795 BINDING SITE is a target binding site found in the 3' untranslated region of mRNA encoded by FLJ25795, corresponding to a target binding site such as BINDING SITE I, BINDING SITE II or BINDING SITE III of FIG. 8. Table 4 illustrates the complementarity of the nucleotide sequences of FLJ25795 BINDING SITE, designated SEQ ID:934, to the nucleotide sequence of GAM7776 RNA, herein designated GAM RNA, also designated SEQ ID:246.

Another function of GAM7776 is therefore inhibition of FLJ25795 (Accession NP_689633.1). Accordingly, utilities of GAM7776 include diagnosis, prevention and treatment of diseases and clinical conditions associated with FLJ25795.

FLJ30507 (Accession NP_694555.1) is another GAM7776 target gene, herein designated TARGET GENE. FLJ30507 BINDING SITE is a target binding site found in the 5' untranslated region of mRNA encoded by FLJ30507, corresponding to a target binding site such as BINDING SITE I, BINDING SITE II or BINDING SITE III of FIG. 8. Table 4 illustrates the complementarity of the nucleotide sequences of FLJ30507 BINDING SITE, designated SEQ ID:17957, to the nucleotide sequence of GAM7776 RNA, herein designated GAM RNA, also designated SEQ ID:246.

Another function of GAM7776 is therefore inhibition of FLJ30507 (Accession NP_694555.1). Accordingly, utilities of GAM7776 include diagnosis, prevention and treatment of diseases and clinical conditions associated with FLJ30507.

FLJ30532 (Accession NP_653325.1) is another GAM7776 target gene, herein designated TARGET GENE. FLJ30532 BINDING SITE is a target binding site found in the 3' untranslated region of mRNA encoded by FLJ30532, corresponding to a target binding site such as BINDING SITE I, BINDING SITE II or BINDING SITE III of FIG. 8. Table 4 illustrates the complementarity of the nucleotide sequences of FLJ30532 BINDING SITE, designated SEQ ID:19834, to the nucleotide sequence of GAM7776 RNA, herein designated GAM RNA, also designated SEQ ID:246.

Another function of GAM7776 is therefore inhibition of FLJ30532 (Accession NP_653325.1). Accordingly, utilities of GAM7776 include diagnosis, prevention and treatment of diseases and clinical conditions associated with FLJ30532.

FLJ31139 (Accession NP_775928.1) is another GAM7776 target gene, herein designated TARGET GENE. FLJ31139 BINDING SITE1 through FLJ31139 BINDING SITE3 are target binding sites found in untranslated regions of mRNA encoded by FLJ31139, corresponding to target binding sites such as BINDING SITE I, BINDING SITE II or BINDING SITE III of FIG. 8. Table 4 illustrates the complementarity of the nucleotide sequences of FLJ31139 BINDING SITE1 through FLJ31139 BINDING SITE3, designated SEQ ID:3952, SEQ ID:18868 and SEQ ID:15200 respectively, to the nucleotide sequence of GAM7776 RNA, herein designated GAM RNA, also designated SEQ ID:246.

Another function of GAM7776 is therefore inhibition of FLJ31139 (Accession NP_775928.1). Accordingly, utilities of GAM7776 include diagnosis, prevention and treatment of diseases and clinical conditions associated with FLJ31139.

FLJ31153 (Accession NP_653201.1) is another GAM7776 target gene, herein designated TARGET GENE. FLJ31153 BINDING SITE is a target binding site found in the 3' untranslated region of mRNA encoded by FLJ31153, corresponding to a target binding site such as BINDING SITE I, BINDING SITE II or BINDING SITE III of FIG. 8. Table 4 illustrates the complementarity of the nucleotide sequences of FLJ31153 BINDING SITE, designated SEQ ID:7373, to the nucleotide sequence of GAM7776 RNA, herein designated GAM RNA, also designated SEQ ID:246.

Another function of GAM7776 is therefore inhibition of FLJ31153 (Accession NP_653201.1). Accordingly, utilities of GAM7776 include diagnosis, prevention and treatment of diseases and clinical conditions associated with FLJ31153.

FLJ31166 (Accession NP_694567.1) is another GAM7776 target gene, herein designated TARGET GENE. FLJ31166 BINDING SITE is a target binding site found in the 3' untranslated region of mRNA encoded by FLJ31166, corresponding to a target binding site such as BINDING SITE I, BINDING SITE II or BINDING SITE III of FIG. 8. Table 4 illustrates the complementarity of the nucleotide sequences of FLJ31166 BINDING SITE, designated SEQ ID:19301, to the nucleotide sequence of GAM7776 RNA, herein designated GAM RNA, also designated SEQ ID:246.

Another function of GAM7776 is therefore inhibition of FLJ31166 (Accession NP_694567.1). Accordingly, utilities of GAM7776 include diagnosis, prevention and treatment of diseases and clinical conditions associated with FLJ31166.

FLJ31338 (Accession NP_689682.1) is another GAM7776 target gene, herein designated TARGET GENE. FLJ31338 BINDING SITE is a target binding site found in the 3' untranslated region of mRNA encoded by FLJ31338, corresponding to a target binding site such as BINDING SITE I, BINDING SITE II or BINDING SITE III of FIG. 8. Table 4 illustrates the complementarity of the nucleotide sequences of FLJ31338 BINDING SITE, designated SEQ ID:1672, to the nucleotide sequence of GAM7776 RNA, herein designated GAM RNA, also designated SEQ ID:246.

Another function of GAM7776 is therefore inhibition of FLJ31338 (Accession NP_689682.1). Accordingly, utilities of GAM7776 include diagnosis, prevention and treatment of diseases and clinical conditions associated with FLJ31338.

FLJ31384 (Accession NP_689685.1) is another GAM7776 target gene, herein designated TARGET GENE. FLJ31384 BINDING SITE is a target binding site found in the 3' untranslated region of mRNA encoded by FLJ31384, corresponding to a target binding site such as BINDING SITE I, BINDING SITE II or BINDING SITE III of FIG. 8. Table 4 illustrates the complementarity of the nucleotide sequences of FLJ31384 BINDING SITE, designated SEQ ID:14326, to the nucleotide sequence of GAM7776 RNA, herein designated GAM RNA, also designated SEQ ID:246.

Another function of GAM7776 is therefore inhibition of FLJ31384 (Accession NP_689685.1). Accordingly, utilities of GAM7776 include diagnosis, prevention and treatment of diseases and clinical conditions associated with FLJ31384.

FLJ31393 (Accession NP_694569.1) is another GAM7776 target gene, herein designated TARGET GENE. FLJ31393 BINDING SITE is a target binding site found in the 5' untranslated region of mRNA encoded by FLJ31393, corresponding to a target binding site such as BINDING SITE I, BINDING SITE II or BINDING SITE III of FIG. 8. Table 4 illustrates the complementarity of the nucleotide sequences of FLJ31393 BINDING SITE, designated SEQ ID:9670, to the nucleotide sequence of GAM7776 RNA, herein designated GAM RNA, also designated SEQ ID:246.

Another function of GAM7776 is therefore inhibition of FLJ31393 (Accession NP_694569.1). Accordingly, utilities of GAM7776 include diagnosis, prevention and treatment of diseases and clinical conditions associated with FLJ31393.

FLJ31401 (Accession NP_689877.1) is another GAM7776 target gene, herein designated TARGET GENE. FLJ31401 BINDING SITE is a target binding site found in the 3' untranslated region of mRNA encoded by FLJ31401, corresponding to a target binding site such as BINDING SITE I, BINDING SITE II or BINDING SITE III of FIG. 8. Table 4 illustrates the complementarity of the nucleotide sequences of FLJ31401 BINDING SITE, designated SEQ ID:16543, to the nucleotide sequence of GAM7776 RNA, herein designated GAM RNA, also designated SEQ ID:246.

Another function of GAM7776 is therefore inhibition of FLJ31401 (Accession NP_689877.1). Accordingly, utilities of GAM7776 include diagnosis, prevention and treatment of diseases and clinical conditions associated with FLJ31401.

FLJ32096 (Accession NP_776156.1) is another GAM7776 target gene, herein designated TARGET GENE. FLJ32096 BINDING SITE1 and FLJ32096 BINDING SITE2 are target binding sites found in untranslated regions of mRNA encoded by FLJ32096, corresponding to target binding sites such as BINDING SITE I, BINDING SITE II or BINDING SITE III of FIG. 8. Table 4 illustrates the complementarity of the nucleotide sequences of FLJ32096 BINDING SITE1 and FLJ32096 BINDING SITE2, designated SEQ ID:16043 and SEQ ID:1025 respectively, to the nucleotide sequence of GAM7776 RNA, herein designated GAM RNA, also designated SEQ ID:246.

Another function of GAM7776 is therefore inhibition of FLJ32096 (Accession NP_776156.1). Accordingly, utilities of GAM7776 include diagnosis, prevention and treatment of diseases and clinical conditions associated with FLJ32096.

FLJ32130 (Accession NP_689671.2) is another GAM7776 target gene, herein designated TARGET GENE. FLJ32130 BINDING SITE1 through FLJ32130 BINDING SITE3 are target binding sites found in untranslated regions of mRNA encoded by FLJ32130, corresponding to target binding sites such as BINDING SITE I, BINDING SITE II or BINDING SITE III of FIG. 8. Table 4 illustrates the complementarity of the nucleotide sequences of FLJ32130 BINDING SITE1 through FLJ32130 BINDING SITE3, designated SEQ ID:4630, SEQ ID:15049 and SEQ ID:2061 respectively, to the nucleotide sequence of GAM7776 RNA, herein designated GAM RNA, also designated SEQ ID:246.

Another function of GAM7776 is therefore inhibition of FLJ32130 (Accession NP_689671.2). Accordingly, utilities of GAM7776 include diagnosis, prevention and treatment of diseases and clinical conditions associated with FLJ32130.

FLJ32206 (Accession NP_689710.1) is another GAM7776 target gene, herein designated TARGET GENE. FLJ32206 BINDING SITE is a target binding site found in the 3' untranslated region of mRNA encoded by FLJ32206, corresponding to a target binding site such as BINDING SITE I, BINDING SITE II or BINDING SITE III of FIG. 8. Table 4 illustrates the complementarity of the nucleotide sequences of FLJ32206 BINDING SITE, designated SEQ ID:3860, to the nucleotide sequence of GAM7776 RNA, herein designated GAM RNA, also designated SEQ ID:246.

Another function of GAM7776 is therefore inhibition of FLJ32206 (Accession NP_689710.1). Accordingly, utilities of GAM7776 include diagnosis, prevention and treatment of diseases and clinical conditions associated with FLJ32206.

FLJ32334 (Accession NP_653166.1) is another GAM7776 target gene, herein designated TARGET GENE. FLJ32334 BINDING SITE is a target binding site found in the 3' untranslated region of mRNA encoded by FLJ32334, corresponding to a target binding site such as BINDING SITE I, BINDING SITE II or BINDING SITE III of FIG. 8. Table 4 illustrates the complementarity of the nucleotide sequences of FLJ32334 BINDING SITE, designated SEQ ID:8493, to the nucleotide sequence of GAM7776 RNA, herein designated GAM RNA, also designated SEQ ID:246.

Another function of GAM7776 is therefore inhibition of FLJ32334 (Accession NP_653166.1). Accordingly, utilities of GAM7776 include diagnosis, prevention and treatment of diseases and clinical conditions associated with FLJ32334.

FLJ32499 (Accession NP_653208.1) is another GAM7776 target gene, herein designated TARGET GENE. FLJ32499 BINDING SITE is a target binding site found in the 3' untranslated region of mRNA encoded by FLJ32499, corresponding to a target binding site such as BINDING SITE I, BINDING SITE II or BINDING SITE III of FIG. 8. Table 4 illustrates the complementarity of the nucleotide sequences of FLJ32499 BINDING SITE, designated SEQ ID:4681, to the nucleotide sequence of GAM7776 RNA, herein designated GAM RNA, also designated SEQ ID:246.

Another function of GAM7776 is therefore inhibition of FLJ32499 (Accession NP_653208.1). Accordingly, utilities of GAM7776 include diagnosis, prevention and treatment of diseases and clinical conditions associated with FLJ32499.

FLJ32731 (Accession NP_689632.1) is another GAM7776 target gene, herein designated TARGET GENE. FLJ32731 BINDING SITE is a target binding site found in the 3' untranslated region of mRNA encoded by FLJ32731, corresponding to a target binding site such as BINDING SITE I, BINDING SITE II or BINDING SITE III of FIG. 8. Table 4 illustrates the complementarity of the nucleotide sequences of FLJ32731 BINDING SITE, designated SEQ ID:16099, to the nucleotide sequence of GAM7776 RNA, herein designated GAM RNA, also designated SEQ ID:246.

Another function of GAM7776 is therefore inhibition of FLJ32731 (Accession NP_689632.1). Accordingly, utilities of GAM7776 include diagnosis, prevention and treatment of diseases and clinical conditions associated with FLJ32731.

FLJ32803 (Accession NP_694584.1) is another GAM7776 target gene, herein designated TARGET GENE. FLJ32803 BINDING SITE is a target binding site found in the 3' untranslated region of mRNA encoded by FLJ32803, corresponding to a target binding site such as BINDING SITE I, BINDING SITE II or BINDING SITE III of FIG. 8. Table 4 illustrates the complementarity of the nucleotide sequences of FLJ32803 BINDING SITE, designated SEQ ID:1856, to the nucleotide sequence of GAM7776 RNA, herein designated GAM RNA, also designated SEQ ID:246.

Another function of GAM7776 is therefore inhibition of FLJ32803 (Accession NP_694584.1). Accordingly, utilities of GAM7776 include diagnosis, prevention and treatment of diseases and clinical conditions associated with FLJ32803.

FLJ32865 (Accession NP_653214.1) is another GAM7776 target gene, herein designated TARGET GENE. FLJ32865 BINDING SITE is a target binding site found in the 3' untranslated region of mRNA encoded by FLJ32865, corresponding to a target binding site such as BINDING SITE I, BINDING SITE II or BINDING SITE III of FIG. 8. Table 4 illustrates the complementarity of the nucleotide sequences of FLJ32865 BINDING SITE, designated SEQ ID:2146, to the nucleotide sequence of GAM7776 RNA, herein designated GAM RNA, also designated SEQ ID:246.

Another function of GAM7776 is therefore inhibition of FLJ32865 (Accession NP_653214.1). Accordingly, utilities of GAM7776 include diagnosis, prevention and treatment of diseases and clinical conditions associated with FLJ32865.

FLJ32894 (Accession NP_653268.1) is another GAM7776 target gene, herein designated TARGET GENE. FLJ32894 BINDING SITE is a target binding site found in the 3' untranslated region of mRNA encoded by FLJ32894, corresponding to a target binding site such as BINDING SITE I, BINDING SITE II or BINDING SITE III of FIG. 8. Table 4 illustrates the complementarity of the nucleotide sequences of FLJ32894 BINDING SITE, designated SEQ ID:7467, to the nucleotide sequence of GAM7776 RNA, herein designated GAM RNA, also designated SEQ ID:246.

Another function of GAM7776 is therefore inhibition of FLJ32894 (Accession NP_653268.1). Accordingly, utilities of GAM7776 include diagnosis, prevention and treatment of diseases and clinical conditions associated with FLJ32894.

FLJ32932 (Accession NP_690873.1) is another GAM7776 target gene, herein designated TARGET GENE. FLJ32932 BINDING SITE is a target binding site found in the 3' untranslated region of mRNA encoded by FLJ32932, corresponding to a target binding site such as BINDING SITE I, BINDING SITE II or BINDING SITE III of FIG. 8. Table 4 illustrates the complementarity of the nucleotide sequences of FLJ32932 BINDING SITE, designated SEQ ID:9555, to the nucleotide sequence of GAM7776 RNA, herein designated GAM RNA, also designated SEQ ID:246.

Another function of GAM7776 is therefore inhibition of FLJ32932 (Accession NP_690873.1). Accordingly, utilities of GAM7776 include diagnosis, prevention and treatment of diseases and clinical conditions associated with FLJ32932.

FLJ33505 (Accession NP_689530.1) is another GAM7776 target gene, herein designated TARGET GENE. FLJ33505 BINDING SITE is a target binding site found in the 3' untranslated region of mRNA encoded by FLJ33505, corresponding to a target binding site such as BINDING SITE I, BINDING SITE II or BINDING SITE III of FIG. 8. Table 4 illustrates the complementarity of the nucleotide sequences of FLJ33505 BINDING SITE, designated SEQ ID:13693, to the nucleotide sequence of GAM7776 RNA, herein designated GAM RNA, also designated SEQ ID:246.

Another function of GAM7776 is therefore inhibition of FLJ33505 (Accession NP_689530.1). Accordingly, utilities of GAM7776 include diagnosis, prevention and treatment of diseases and clinical conditions associated with FLJ33505.

FLJ33655 (Accession NP_775912.1) is another GAM7776 target gene, herein designated TARGET GENE. FLJ33655 BINDING SITE is a target binding site found in the 3' untranslated region of mRNA encoded by FLJ33655, corresponding to a target binding site such as BINDING SITE I, BINDING SITE II or BINDING SITE III of FIG. 8. Table 4 illustrates the complementarity of the nucleotide sequences of FLJ33655 BINDING SITE, designated SEQ ID:16113, to the nucleotide sequence of GAM7776 RNA, herein designated GAM RNA, also designated SEQ ID:246.

Another function of GAM7776 is therefore inhibition of FLJ33655 (Accession NP_775912.1). Accordingly, utilities of GAM7776 include diagnosis, prevention and treatment of diseases and clinical conditions associated with FLJ33655.

FLJ34817 (Accession NP_689516.1) is another GAM7776 target gene, herein designated TARGET GENE. FLJ34817 BINDING SITE1 and FLJ34817 BINDING SITE2 are target binding sites found in untranslated regions of mRNA encoded by FLJ34817, corresponding to target binding sites such as BINDING SITE I, BINDING SITE II or BINDING SITE III of FIG. 8. Table 4 illustrates the complementarity of the nucleotide sequences of FLJ34817 BINDING SITE1 and FLJ34817 BINDING SITE2, designated SEQ ID:4004 and SEQ ID:7075 respectively, to the nucleotide sequence of GAM7776 RNA, herein designated GAM RNA, also designated SEQ ID:246.

Another function of GAM7776 is therefore inhibition of FLJ34817 (Accession NP_689516.1). Accordingly, utilities of GAM7776 include diagnosis, prevention and treatment of diseases and clinical conditions associated with FLJ34817.

FLJ34922 (Accession NP_689483.1) is another GAM7776 target gene, herein designated TARGET GENE. FLJ34922 BINDING SITE is a target binding site found in the 5' untranslated region of mRNA encoded by FLJ34922, corresponding to a target binding site such as BINDING SITE I, BINDING SITE II or BINDING SITE III of FIG. 8. Table 4 illustrates the complementarity of the nucleotide sequences of FLJ34922 BINDING SITE, designated SEQ ID:18132, to the nucleotide sequence of GAM7776 RNA, herein designated GAM RNA, also designated SEQ ID:246.

Another function of GAM7776 is therefore inhibition of FLJ34922 (Accession NP_689483.1). Accordingly, utilities of GAM7776 include diagnosis, prevention and treatment of diseases and clinical conditions associated with FLJ34922.

FLJ34969 (Accession XP_114353.1) is another GAM7776 target gene, herein designated TARGET GENE. FLJ34969 BINDING SITE is a target binding site found in the 3' untranslated region of mRNA encoded by FLJ34969, corresponding to a target binding site such as BINDING SITE I, BINDING SITE II or BINDING SITE III of FIG. 8. Table 4 illustrates the complementarity of the nucleotide sequences of FLJ34969 BINDING SITE, designated SEQ ID:581, to the nucleotide sequence of GAM7776 RNA, herein designated GAM RNA, also designated SEQ ID:246.

Another function of GAM7776 is therefore inhibition of FLJ34969 (Accession XP_114353.1). Accordingly, utilities of GAM7776 include diagnosis, prevention and treatment of diseases and clinical conditions associated with FLJ34969.

FLJ35105 (Accession NP_689890.1) is another GAM7776 target gene, herein designated TARGET GENE. FLJ35105 BINDING SITE is a target binding site found in the 5' untranslated region of mRNA encoded by FLJ35105, corresponding to a target binding site such as BINDING SITE I, BINDING SITE II or BINDING SITE III of FIG. 8. Table 4 illustrates the complementarity of the nucleotide sequences of FLJ35105 BINDING SITE, designated SEQ ID:18938, to the nucleotide sequence of GAM7776 RNA, herein designated GAM RNA, also designated SEQ ID:246.

Another function of GAM7776 is therefore inhibition of FLJ35105 (Accession NP_689890.1). Accordingly, utilities of GAM7776 include diagnosis, prevention and treatment of diseases and clinical conditions associated with FLJ35105.

FLJ35681 (Accession NP_787096.1) is another GAM7776 target gene, herein designated TARGET GENE. FLJ35681 BINDING SITE1 and FLJ35681 BINDING SITE2 are target binding sites found in untranslated regions of mRNA encoded by FLJ35681, corresponding to target binding sites such as BINDING SITE I, BINDING SITE II or BINDING SITE III of FIG. 8. Table 4 illustrates the complementarity of the nucleotide sequences of FLJ35681 BINDING SITE1 and FLJ35681 BINDING SITE2, designated SEQ ID:1653 and SEQ ID:11521 respectively, to the nucleotide sequence of GAM7776 RNA, herein designated GAM RNA, also designated SEQ ID:246.

Another function of GAM7776 is therefore inhibition of FLJ35681 (Accession NP_787096.1). Accordingly, utilities of GAM7776 include diagnosis, prevention and treatment of diseases and clinical conditions associated with FLJ35681.

FLJ35848 (Accession XP_290755.1) is another GAM7776 target gene, herein designated TARGET GENE. FLJ35848 BINDING SITE is a target binding site found in the 3' untranslated region of mRNA encoded by FLJ35848, corresponding to a target binding site such as BINDING SITE I, BINDING SITE II or BINDING SITE III of FIG. 8. Table 4 illustrates the complementarity of the nucleotide sequences of FLJ35848 BINDING SITE, designated SEQ ID:14986, to the nucleotide sequence of GAM7776 RNA, herein designated GAM RNA, also designated SEQ ID:246.

Another function of GAM7776 is therefore inhibition of FLJ35848 (Accession XP_290755.1). Accordingly, utilities of GAM7776 include diagnosis, prevention and treatment of diseases and clinical conditions associated with FLJ35848.

FLJ36445 (Accession NP_694965.1) is another GAM7776 target gene, herein designated TARGET GENE. FLJ36445 BINDING SITE is a target binding site found in the 3' untranslated region of mRNA encoded by FLJ36445, corresponding to a target binding site such as BINDING SITE I, BINDING SITE II or BINDING SITE III of FIG. 8. Table 4 illustrates the complementarity of the nucleotide sequences of FLJ36445 BINDING SITE, designated SEQ ID:2147, to the nucleotide sequence of GAM7776 RNA, herein designated GAM RNA, also designated SEQ ID:246.

Another function of GAM7776 is therefore inhibition of FLJ36445 (Accession NP_694965.1). Accordingly, utilities of GAM7776 include diagnosis, prevention and treatment of diseases and clinical conditions associated with FLJ36445.

FLJ37045 (Accession NP_787085.1) is another GAM7776 target gene, herein designated TARGET GENE. FLJ37045 BINDING SITE is a target binding site found in the 3' untranslated region of mRNA encoded by FLJ37045, corresponding to a target binding site such as BINDING SITE I, BINDING SITE II or BINDING SITE III of FIG. 8. Table 4 illustrates the complementarity of the nucleotide sequences of FLJ37045 BINDING SITE, designated SEQ ID:9497, to the nucleotide sequence of GAM7776 RNA, herein designated GAM RNA, also designated SEQ ID:246.

Another function of GAM7776 is therefore inhibition of FLJ37045 (Accession NP_787085.1). Accordingly, utilities of GAM7776 include diagnosis, prevention and treatment of diseases and clinical conditions associated with FLJ37045.

FLJ37078 (Accession NP_694588.1) is another GAM7776 target gene, herein designated TARGET GENE. FLJ37078 BINDING SITE is a target binding site found in the 5' untranslated region of mRNA encoded by FLJ37078, corresponding to a target binding site such as BINDING SITE I, BINDING SITE II or BINDING SITE III of FIG. 8. Table 4 illustrates the complementarity of the nucleotide sequences of FLJ37078 BINDING SITE, designated SEQ ID:11528, to the nucleotide sequence of GAM7776 RNA, herein designated GAM RNA, also designated SEQ ID:246.

Another function of GAM7776 is therefore inhibition of FLJ37078 (Accession NP_694588.1). Accordingly, utilities of GAM7776 include diagnosis, prevention and treatment of diseases and clinical conditions associated with FLJ37078.

FLJ37433 (Accession NP_848612.1) is another GAM7776 target gene, herein designated TARGET GENE. FLJ37433 BINDING SITE is a target binding site found in the 3' untranslated region of mRNA encoded by FLJ37433, corresponding to a target binding site such as BINDING SITE I, BINDING SITE II or BINDING SITE III of FIG. 8. Table 4 illustrates the complementarity of the nucleotide sequences of FLJ37433 BINDING SITE, designated SEQ ID:8582, to the nucleotide sequence of GAM7776 RNA, herein designated GAM RNA, also designated SEQ ID:246.

Another function of GAM7776 is therefore inhibition of FLJ37433 (Accession NP_848612.1). Accordingly, utilities of GAM7776 include diagnosis, prevention and treatment of diseases and clinical conditions associated with FLJ37433.

FLJ37543 (Accession NP_775938.1) is another GAM7776 target gene, herein designated TARGET GENE. FLJ37543 BINDING SITE is a target binding site found in the 3' untranslated region of mRNA encoded by FLJ37543, corresponding to a target binding site such as BINDING SITE I, BINDING SITE II or BINDING SITE III of FIG. 8. Table 4 illustrates the complementarity of the nucleotide sequences of FLJ37543 BINDING SITE, designated SEQ ID:5495, to the nucleotide sequence of GAM7776 RNA, herein designated GAM RNA, also designated SEQ ID:246.

Another function of GAM7776 is therefore inhibition of FLJ37543 (Accession NP_775938.1). Accordingly, utilities of GAM7776 include diagnosis, prevention and treatment of diseases and clinical conditions associated with FLJ37543.

FLJ38101 (Accession NP_694993.2) is another GAM7776 target gene, herein designated TARGET GENE. FLJ38101 BINDING SITE is a target binding site found in the 3' untranslated region of mRNA encoded by FLJ38101, corresponding to a target binding site such as BINDING SITE I, BINDING SITE II or BINDING SITE III of FIG. 8. Table 4 illustrates the complementarity of the nucleotide sequences of FLJ38101 BINDING SITE, designated SEQ ID:5589, to the nucleotide sequence of GAM7776 RNA, herein designated GAM RNA, also designated SEQ ID:246.

Another function of GAM7776 is therefore inhibition of FLJ38101 (Accession NP_694993.2). Accordingly, utilities of GAM7776 include diagnosis, prevention and treatment of diseases and clinical conditions associated with FLJ38101.

FLJ38149 (Accession XP_091919.5) is another GAM7776 target gene, herein designated TARGET GENE. FLJ38149 BINDING SITE1 through FLJ38149 BINDING SITE3 are target binding sites found in untranslated regions of mRNA encoded by FLJ38149, corresponding to target binding sites such as BINDING SITE I, BINDING SITE II or BINDING SITE III of FIG. 8. Table 4 illustrates the complementarity of the nucleotide sequences of FLJ38149 BINDING SITE1 through FLJ38149 BINDING SITE3, designated SEQ ID:15044, SEQ ID:18971 and SEQ ID:9373 respectively, to the nucleotide sequence of GAM7776 RNA, herein designated GAM RNA, also designated SEQ ID:246.

Another function of GAM7776 is therefore inhibition of FLJ38149 (Accession XP_091919.5). Accordingly, utilities of GAM7776 include diagnosis, prevention and treatment of diseases and clinical conditions associated with FLJ38149.

FLJ38281 (Accession NP_689814.1) is another GAM7776 target gene, herein designated TARGET GENE. FLJ38281 BINDING SITE1 and FLJ38281 BINDING SITE2 are target binding sites found in untranslated regions of mRNA encoded by FLJ38281, corresponding to target binding sites such as BINDING SITE I, BINDING SITE II or BINDING SITE III of FIG. 8. Table 4 illustrates the complementarity of the nucleotide sequences of FLJ38281 BINDING SITE1 and FLJ38281 BINDING SITE2, designated SEQ ID:6885 and SEQ ID:9492 respectively, to the nucleotide sequence of GAM7776 RNA, herein designated GAM RNA, also designated SEQ ID:246.

Another function of GAM7776 is therefore inhibition of FLJ38281 (Accession NP_689814.1). Accordingly, utilities of GAM7776 include diagnosis, prevention and treatment of diseases and clinical conditions associated with FLJ38281.

FLJ38607 (Accession NP_689867.1) is another GAM7776 target gene, herein designated TARGET GENE. FLJ38607 BINDING SITE1 and FLJ38607 BINDING SITE2 are target binding sites found in untranslated regions of mRNA encoded by FLJ38607, corresponding to target binding sites such as BINDING SITE I, BINDING SITE II or BINDING SITE III of FIG. 8. Table 4 illustrates the complementarity of the nucleotide sequences of FLJ38607 BINDING SITE1 and FLJ38607 BINDING SITE2, designated SEQ ID:16688 and SEQ ID:7382 respectively, to the nucleotide sequence of GAM7776 RNA, herein designated GAM RNA, also designated SEQ ID:246.

Another function of GAM7776 is therefore inhibition of FLJ38607 (Accession NP_689867.1). Accordingly, utilities of GAM7776 include diagnosis, prevention and treatment of diseases and clinical conditions associated with FLJ38607.

FLJ38792 (Accession NP_848615.1) is another GAM7776 target gene, herein designated TARGET GENE. FLJ38792 BINDING SITE is a target binding site found in the 3' untranslated region of mRNA encoded by FLJ38792, corresponding to a target binding site such as BINDING SITE I, BINDING SITE II or BINDING SITE III of FIG. 8. Table 4 illustrates the complementarity of the nucleotide sequences of FLJ38792 BINDING SITE, designated SEQ ID:14861, to the nucleotide sequence of GAM7776 RNA, herein designated GAM RNA, also designated SEQ ID:246.

Another function of GAM7776 is therefore inhibition of FLJ38792 (Accession NP_848615.1). Accordingly, utilities of GAM7776 include diagnosis, prevention and treatment of diseases and clinical conditions associated with FLJ38792.

FLJ38819 (Accession NP_665872.1) is another GAM7776 target gene, herein designated TARGET GENE. FLJ38819 BINDING SITE1 and FLJ38819 BINDING SITE2 are target binding sites found in untranslated regions of mRNA encoded by FLJ38819, corresponding to target binding sites such as BINDING SITE I, BINDING SITE II or BINDING SITE III of FIG. 8. Table 4 illustrates the complementarity of the nucleotide sequences of FLJ38819 BINDING SITE1 and FLJ38819 BINDING SITE2, designated SEQ ID:9791 and SEQ ID:18642 respectively, to the nucleotide sequence of GAM7776 RNA, herein designated GAM RNA, also designated SEQ ID:246.

Another function of GAM7776 is therefore inhibition of FLJ38819 (Accession NP_665872.1). Accordingly, utilities of GAM7776 include diagnosis, prevention and treatment of diseases and clinical conditions associated with FLJ38819.

FLJ38991 (Accession NP_776188.1) is another GAM7776 target gene, herein designated TARGET GENE. FLJ38991 BINDING SITE1 and FLJ38991 BINDING SITE2 are target binding sites found in untranslated regions of mRNA encoded by FLJ38991, corresponding to target binding sites such as BINDING SITE I, BINDING SITE II or BINDING SITE III of FIG. 8. Table 4 illustrates the complementarity of the nucleotide sequences of FLJ38991 BINDING SITE1 and FLJ38991 BINDING SITE2, designated SEQ ID:14236 and SEQ ID:10356 respectively, to the nucleotide sequence of GAM7776 RNA, herein designated GAM RNA, also designated SEQ ID:246.

Another function of GAM7776 is therefore inhibition of FLJ38991 (Accession NP_776188.1). Accordingly, utilities of GAM7776 include diagnosis, prevention and treatment of diseases and clinical conditions associated with FLJ38991.

FLJ39415 (Accession NP_775952.1) is another GAM7776 target gene, herein designated TARGET GENE. FLJ39415 BINDING SITE is a target binding site found in the 3' untranslated region of mRNA encoded by FLJ39415, corresponding to a target binding site such as BINDING SITE I, BINDING SITE II or BINDING SITE III of FIG. 8. Table 4 illustrates the complementarity of the nucleotide sequences of FLJ39415 BINDING SITE, designated SEQ ID:11673, to the nucleotide sequence of GAM7776 RNA, herein designated GAM RNA, also designated SEQ ID:246.

Another function of GAM7776 is therefore inhibition of FLJ39415 (Accession NP_775952.1). Accordingly, utilities of GAM7776 include diagnosis, prevention and treatment of diseases and clinical conditions associated with FLJ39415.

FLJ39599 (Accession NP_776164.1) is another GAM7776 target gene, herein designated TARGET GENE. FLJ39599 BINDING SITE1 and FLJ39599 BINDING SITE2 are target binding sites found in untranslated regions of mRNA encoded by FLJ39599, corresponding to target binding sites such as BINDING SITE I, BINDING SITE II or BINDING SITE III of FIG. 8. Table 4 illustrates the complementarity of the nucleotide sequences of FLJ39599 BINDING SITE1 and FLJ39599 BINDING SITE2, designated SEQ ID:16001 and SEQ ID:8232 respectively, to the nucleotide sequence of GAM7776 RNA, herein designated GAM RNA, also designated SEQ ID:246.

Another function of GAM7776 is therefore inhibition of FLJ39599 (Accession NP_776164.1). Accordingly, utilities of GAM7776 include diagnosis, prevention and treatment of diseases and clinical conditions associated with FLJ39599.

FLJ39639 (Accession XP_290687.1) is another GAM7776 target gene, herein designated TARGET GENE. FLJ39639 BINDING SITE is a target binding site found in the 3' untranslated region of mRNA encoded by FLJ39639, corresponding to a target binding site such as BINDING SITE I, BINDING SITE II or BINDING SITE III of FIG. 8. Table 4 illustrates the complementarity of the nucleotide sequences of FLJ39639 BINDING SITE, designated SEQ ID:9190, to the nucleotide sequence of GAM7776 RNA, herein designated GAM RNA, also designated SEQ ID:246.

Another function of GAM7776 is therefore inhibition of FLJ39639 (Accession XP_290687.1). Accordingly, utilities of GAM7776 include diagnosis, prevention and treatment of diseases and clinical conditions associated with FLJ39639.

FLJ90231 (Accession NP_775852.1) is another GAM7776 target gene, herein designated TARGET GENE. FLJ90231 BINDING SITE is a target binding site found in the 3' untranslated region of mRNA encoded by FLJ90231, corresponding to a target binding site such as BINDING SITE I, BINDING SITE II or BINDING SITE III of FIG. 8. Table 4 illustrates the complementarity of the nucleotide sequences of FLJ90231 BINDING SITE, designated SEQ ID:10357, to the nucleotide sequence of GAM7776 RNA, herein designated GAM RNA, also designated SEQ ID:246.

Another function of GAM7776 is therefore inhibition of FLJ90231 (Accession NP_775852.1). Accordingly, utilities of GAM7776 include diagnosis, prevention and treatment of diseases and clinical conditions associated with FLJ90231.

FLJ90723 (Accession NP_787115.1) is another GAM7776 target gene, herein designated TARGET GENE. FLJ90723 BINDING SITE is a target binding site found in the 3' untranslated region of mRNA encoded by FLJ90723, corresponding to a target binding site such as BINDING SITE I, BINDING SITE II or BINDING SITE III of FIG. 8. Table 4 illustrates the complementarity of the nucleotide sequences of FLJ90723 BINDING SITE, designated SEQ ID:19889, to the nucleotide sequence of GAM7776 RNA, herein designated GAM RNA, also designated SEQ ID:246.

Another function of GAM7776 is therefore inhibition of FLJ90723 (Accession NP_787115.1). Accordingly, utilities of GAM7776 include diagnosis, prevention and treatment of diseases and clinical conditions associated with FLJ90723.

Formin binding protein 1 (FNBP1, Accession XP_052666.3) is another GAM7776 target gene, herein designated TARGET GENE. FNBP1 BINDING SITE is a target binding site found in the 3' untranslated region of mRNA encoded by FNBP1, corresponding to a target binding site such as BINDING SITE I, BINDING SITE II or BINDING SITE III of FIG. 8. Table 4 illustrates the complementarity of the nucleotide sequences of FNBP1 BINDING SITE, designated SEQ ID:16354, to the nucleotide sequence of GAM7776 RNA, herein designated GAM RNA, also designated SEQ ID:246.

Another function of GAM7776 is therefore inhibition of Formin binding protein 1 (FNBP1, Accession XP_052666.3). Accordingly, utilities of GAM7776 include diagnosis, prevention and treatment of diseases and clinical conditions associated with FNBP1.

Forkhead box e2 (FOXE2, Accession NP_036317.1) is another GAM7776 target gene, herein designated TARGET GENE. FOXE2 BINDING SITE is a target binding site found in the 5' untranslated region of mRNA encoded by FOXE2, corresponding to a target binding site such as BINDING SITE I, BINDING SITE II or BINDING SITE III of FIG. 8. Table 4 illustrates the complementarity of the nucleotide sequences of FOXE2 BINDING SITE, designated SEQ ID:15626, to the nucleotide sequence of GAM7776 RNA, herein designated GAM RNA, also designated SEQ ID:246.

Another function of GAM7776 is therefore inhibition of Forkhead box e2 (FOXE2, Accession NP_036317.1). Accordingly, utilities of GAM7776 include diagnosis, prevention and treatment of diseases and clinical conditions associated with FOXE2.

Forkhead box o1a (rhabdomyosarcoma) (FOXO1A, Accession NP_002006.2) is another GAM7776 target gene, herein designated TARGET GENE. FOXO1A BINDING SITE is a target binding site found in the 3' untranslated region of mRNA encoded by FOXO1A, corresponding to a target binding site such as BINDING SITE I, BINDING SITE II or BINDING SITE III of FIG. 8. Table 4 illustrates the complementarity of the nucleotide sequences of FOXO1A BINDING SITE, designated SEQ ID:736, to the nucleotide sequence of GAM7776 RNA, herein designated GAM RNA, also designated SEQ ID:246.

Another function of GAM7776 is therefore inhibition of Forkhead box o1a (rhabdomyosarcoma) (FOXO1A, Accession NP_002006.2), a gene which is a probable transcription factor. and therefore may be associated with Alveolar rhabdomyosarcoma-2. Accordingly, utilities of GAM7776 include diagnosis, prevention and treatment of Alveolar rhabdomyosarcoma-2., and of other diseases and clinical conditions associated with FOXO1A.

The function of FOXO1A and its association with various diseases and clinical conditions, has been established by previous studies, as described hereinabove with reference to GAM189.1. Fsh primary response (lrpr1 homolog, rat) 1 (FSHPRH1, Accession NP_006724.1) is another GAM7776 target gene, herein designated TARGET GENE. FSHPRH1 BINDING SITE is a target binding site found in the 5' untranslated region of mRNA encoded by FSHPRH1, corresponding to a target binding site such as BINDING SITE I, BINDING SITE II or BINDING SITE III of FIG. 8. Table 4 illustrates the complementarity of the nucleotide sequences of FSHPRH1 BINDING SITE, designated SEQ ID:11528, to the nucleotide sequence of GAM7776 RNA, herein designated GAM RNA, also designated SEQ ID:246.

Another function of GAM7776 is therefore inhibition of Fsh primary response (lrpr1 homolog, rat) 1 (FSHPRH1, Accession NP_006724.1), a gene which is involved in the response of gonadal tissues to follicle- stimulating hormone. and therefore may be associated with Hypergonadotropic ovarian dysgenesis (odg), x-linked disorders of gonadal development. Accordingly, utilities of GAM7776 include diagnosis, prevention and treatment of Hypergonadotropic ovarian dysgenesis (odg), x-linked disorders of gonadal development, and of other diseases and clinical conditions associated with FSHPRH1.

The function of FSHPRH1 and its association with various diseases and clinical conditions, has been established by previous studies, as described hereinabove with reference to GAM189.1. Fucosyltransferase 1 (galactoside 2-alpha-l-fucosyltransferase, bombay phenotype included) (FUT1, Accession NP_000139.1) is another GAM7776 target gene, herein designated TARGET GENE. FUT1 BINDING SITE1 and FUT1 BINDING SITE2 are target binding sites found in untranslated regions of mRNA encoded by FUT1, corresponding to target binding sites such as BINDING SITE I, BINDING SITE II or BINDING SITE III of FIG. 8. Table 4 illustrates the complementarity of the nucleotide sequences of FUT1 BINDING SITE1 and FUT1 BINDING SITE2, designated SEQ ID:11525 and SEQ ID:16365 respectively, to the nucleotide sequence of GAM7776 RNA, herein designated GAM RNA, also designated SEQ ID:246.

Another function of GAM7776 is therefore inhibition of Fucosyltransferase 1 (galactoside 2-alpha-l-fucosyltransferase, bombay phenotype included) (FUT1, Accession NP_000139.1). Accordingly, utilities of GAM7776 include diagnosis, prevention and treatment of diseases and clinical conditions associated with FUT1.

Frizzled homolog 4 (drosophila) (FZD4, Accession NP_036325.2) is another GAM7776 target gene, herein designated TARGET GENE. FZD4 BINDING SITE is a target binding site found in the 3' untranslated region of mRNA encoded by FZD4, corresponding to a target binding site such as BINDING SITE I, BINDING SITE II or BINDING SITE III of FIG. 8. Table 4 illustrates the complementarity of the nucleotide sequences of FZD4 BINDING SITE, designated SEQ ID:4487, to the nucleotide sequence of GAM7776 RNA, herein designated GAM RNA, also designated SEQ ID:246.

Another function of GAM7776 is therefore inhibition of Frizzled homolog 4 (drosophila) (FZD4, Accession NP_036325.2), a gene which may function in cell polarity, cell fate specification and cancer; similar to frizzled receptor family, has seven transmembrane domains and therefore may be associated with Familial exudative vitreoretinopathy. Accordingly, utilities of GAM7776 include diagnosis, prevention and treatment of Familial exudative vitreoretinopathy, and of other diseases and clinical conditions associated with FZD4.

The function of FZD4 and its association with various diseases and clinical conditions, has been established by previous studies, as described hereinabove with reference to GAM67.1. G2A (Accession NP_037477.1) is another GAM7776 target gene, herein designated TARGET GENE. G2A BINDING SITE is a target binding site found in the 3' untranslated region of mRNA encoded by G2A, corresponding to a target binding site such as BINDING SITE I, BINDING SITE II or BINDING SITE III of FIG. 8. Table 4 illustrates the complementarity of the nucleotide sequences of G2A BINDING SITE, designated SEQ ID:8714, to the nucleotide sequence of GAM7776 RNA, herein designated GAM RNA, also designated SEQ ID:246.

Another function of GAM7776 is therefore inhibition of G2A (Accession NP_037477.1), a gene which may mediate some of the effects of extracellular atp on insulin secretion. and therefore may be associated with Autoimmune disease. Accordingly, utilities of GAM7776 include diagnosis, prevention and treatment of Autoimmune disease, and of other diseases and clinical conditions associated with G2A.

The function of G2A and its association with various diseases and clinical conditions, has been established by previous studies, as described hereinabove with reference to GAM189.1. Glucose-6-phosphatase, catalytic (glycogen storage disease type i, von gierke disease) (G6PC, Accession NP_000142.1) is another GAM7776 target gene, herein designated TARGET GENE. G6PC BINDING SITE is a target binding site found in the 3' untranslated region of mRNA encoded by G6PC, corresponding to a target binding site such as BINDING SITE I, BINDING SITE II or BINDING SITE III of FIG. 8. Table 4 illustrates the complementarity of the nucleotide sequences of G6PC BINDING SITE, designated SEQ ID:4204, to the nucleotide sequence of GAM7776 RNA, herein designated GAM RNA, also designated SEQ ID:246.

Another function of GAM7776 is therefore inhibition of Glucose-6-phosphatase, catalytic (glycogen storage disease type i, von gierke disease) (G6PC, Accession NP_000142.1). Accordingly, utilities of GAM7776 include diagnosis, prevention and treatment of diseases and clinical conditions associated with G6PC.

GAL3ST-4 (Accession NP_078913.3) is another GAM7776 target gene, herein designated TARGET GENE. GAL3ST-4 BINDING SITE is a target binding site found in the 3' untranslated region of mRNA encoded by GAL3ST-4, corresponding to a target binding site such as BINDING SITE I, BINDING SITE II or BINDING SITE III of FIG. 8. Table 4 illustrates the complementarity of the nucleotide sequences of GAL3ST-4 BINDING SITE, designated SEQ ID:4518, to the nucleotide sequence of GAM7776 RNA, herein designated GAM RNA, also designated SEQ ID:246.

Another function of GAM7776 is therefore inhibition of GAL3ST-4 (Accession NP_078913.3). Accordingly, utilities of GAM7776 include diagnosis, prevention and treatment of diseases and clinical conditions associated with GAL3ST-4.

Gata binding protein 2 (GATA2, Accession NP_116027.2) is another GAM7776 target gene, herein designated TARGET GENE. GATA2 BINDING SITE is a target binding site found in the 3' untranslated region of mRNA encoded by GATA2, corresponding to a target binding site such as BINDING SITE I, BINDING SITE II or BINDING SITE III of FIG. 8. Table 4 illustrates the complementarity of the nucleotide sequences of GATA2 BINDING SITE, designated SEQ ID:16014, to the nucleotide sequence of GAM7776 RNA, herein designated GAM RNA, also designated SEQ ID:246.

Another function of GAM7776 is therefore inhibition of Gata binding protein 2 (GATA2, Accession NP_116027.2). Accordingly, utilities of GAM7776 include diagnosis, prevention and treatment of diseases and clinical conditions associated with GATA2.

Golgi associated, gamma adaptin ear containing, arf binding protein 2 (GGA2, Accession NP_055859.1) is another GAM7776 target gene, herein designated TARGET GENE. GGA2 BINDING SITE1 and GGA2 BINDING SITE2 are target binding sites found in untranslated regions of multiple transcripts of mRNA encoded by GGA2, corresponding to target binding sites such as BINDING SITE I, BINDING SITE II or BINDING SITE III of FIG. 8. Table 4 illustrates the complementarity of the nucleotide sequences of GGA2 BINDING SITE1 and GGA2 BINDING SITE2, designated SEQ ID:6391 and SEQ ID:5631 respectively, to the nucleotide sequence of GAM7776 RNA, herein designated GAM RNA, also designated SEQ ID:246.

Another function of GAM7776 is therefore inhibition of Golgi associated, gamma adaptin ear containing, arf binding protein 2 (GGA2, Accession NP_055859.1). Accordingly, utilities of GAM7776 include diagnosis, prevention and treatment of diseases and clinical conditions associated with GGA2.

Golgi associated, gamma adaptin ear containing, arf binding protein 2 (GGA2, Accession NP_055859.1) is another GAM7776 target gene, herein designated TARGET GENE. GGA2 BINDING SITE1 and GGA2 BINDING SITE2 are target binding sites found in untranslated regions of multiple transcripts of mRNA encoded by GGA2, corresponding to target binding sites such as BINDING SITE I, BINDING SITE II or BINDING SITE III of FIG. 8. Table 4 illustrates the complementarity of the nucleotide sequences of GGA2 BINDING SITE1 and GGA2 BINDING SITE2, designated SEQ ID:5631 and SEQ ID:6391 respectively, to the nucleotide sequence of GAM7776 RNA, herein designated GAM RNA, also designated SEQ ID:246.

Another function of GAM7776 is therefore inhibition of Golgi associated, gamma adaptin ear containing, arf binding protein 2 (GGA2, Accession NP_055859.1). Accordingly, utilities of GAM7776 include diagnosis, prevention and treatment of diseases and clinical conditions associated with GGA2.

Gm2 ganglioside activator protein (GM2A, Accession NP_000396.1) is another GAM7776 target gene, herein designated TARGET GENE. GM2A BINDING SITE is a target binding site found in the 3' untranslated region of mRNA encoded by GM2A, corresponding to a target binding site such as BINDING SITE I, BINDING SITE II or BINDING SITE III of FIG. 8. Table 4 illustrates the complementarity of the nucleotide sequences of GM2A BINDING SITE, designated SEQ ID:11286, to the nucleotide sequence of GAM7776 RNA, herein designated GAM RNA, also designated SEQ ID:246.

Another function of GAM7776 is therefore inhibition of Gm2 ganglioside activator protein (GM2A, Accession NP_000396.1). Accordingly, utilities of GAM7776 include diagnosis, prevention and treatment of diseases and clinical conditions associated with GM2A.

GNE (Accession NP_005467.1) is another GAM7776 target gene, herein designated TARGET GENE. GNE BINDING SITE is a target binding site found in the 3' untranslated region of mRNA encoded by GNE, corresponding to a target binding site such as BINDING SITE I, BINDING SITE II or BINDING SITE III of FIG. 8. Table 4 illustrates the complementarity of the nucleotide sequences of GNE BINDING SITE, designated SEQ ID:8367, to the nucleotide sequence of GAM7776 RNA, herein designated GAM RNA, also designated SEQ ID:246.

Another function of GAM7776 is therefore inhibition of GNE (Accession NP_005467.1), a gene which has roles in sialic acid biosynthesis and regulates cell surface sialylation. Accordingly, utilities of GAM7776 include diagnosis, prevention and treatment of diseases and clinical conditions associated with GNE.

The function of GNE and its association with various diseases and clinical conditions, has been established by previous studies, as described hereinabove with reference to GAM189.1. Guanine nucleotide binding protein (g protein), gamma 4 (GNG4, Accession NP_004476.1) is another GAM7776 target gene, herein designated TARGET GENE. GNG4 BINDING SITE is a target binding site found in the 3' untranslated region of mRNA encoded by GNG4, corresponding to a target binding site such as BINDING SITE I, BINDING SITE II or BINDING SITE III of FIG. 8. Table 4 illustrates the complementarity of the nucleotide sequences of GNG4 BINDING SITE, designated SEQ ID:559, to the nucleotide sequence of GAM7776 RNA, herein designated GAM RNA, also designated SEQ ID:246.

Another function of GAM7776 is therefore inhibition of Guanine nucleotide binding protein (g protein), gamma 4 (GNG4, Accession NP_004476.1). Accordingly, utilities of GAM7776 include diagnosis, prevention and treatment of diseases and clinical conditions associated with GNG4.

GNPNAT1 (Accession XP_085119.1) is another GAM7776 target gene, herein designated TARGET GENE. GNPNAT1 BINDING SITE is a target binding site found in the 3' untranslated region of mRNA encoded by GNPNAT1, corresponding to a target binding site such as BINDING SITE I, BINDING SITE II or BINDING SITE III of FIG. 8. Table 4 illustrates the complementarity of the nucleotide sequences of GNPNAT1 BINDING SITE, designated SEQ ID:8464, to the nucleotide sequence of GAM7776 RNA, herein designated GAM RNA, also designated SEQ ID:246.

Another function of GAM7776 is therefore inhibition of GNPNAT1 (Accession XP_085119.1). Accordingly, utilities of GAM7776 include diagnosis, prevention and treatment of diseases and clinical conditions associated with GNPNAT1.

GNRPX (Accession NP_060519.1) is another GAM7776 target gene, herein designated TARGET GENE. GNRPX BINDING SITE is a target binding site found in the 3' untranslated region of mRNA encoded by GNRPX, corresponding to a target binding site such as BINDING SITE I, BINDING SITE II or BINDING SITE III of FIG. 8. Table 4 illustrates the complementarity of the nucleotide sequences of GNRPX BINDING SITE, designated SEQ ID:12243, to the nucleotide sequence of GAM7776 RNA, herein designated GAM RNA, also designated SEQ ID:246.

Another function of GAM7776 is therefore inhibition of GNRPX (Accession NP_060519.1). Accordingly, utilities of GAM7776 include diagnosis, prevention and treatment of diseases and clinical conditions associated with GNRPX.

Golgi autoantigen, golgin subfamily a, 3 (GOLGA3, Accession NP_005886.2) is another GAM7776 target gene, herein designated TARGET GENE. GOLGA3 BINDING SITE is a target binding site found in the 3' untranslated region of multiple transcripts of mRNA encoded by GOLGA3, corresponding to a target binding site such as BINDING SITE I, BINDING SITE II or BINDING SITE III of FIG. 8. Table 4 illustrates the complementarity of the nucleotide sequences of GOLGA3 BINDING SITE, designated SEQ ID:15049, to the nucleotide sequence of GAM7776 RNA, herein designated GAM RNA, also designated SEQ ID:246.

Another function of GAM7776 is therefore inhibition of Golgi autoantigen, golgin subfamily a, 3 (GOLGA3, Accession NP_005886.2) . Accordingly, utilities of GAM7776 include diagnosis, prevention and treatment of diseases and clinical conditions associated with GOLGA3.

Glycoprotein v (platelet) (GP5, Accession NP_004479.1) is another GAM7776 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:5681, to the nucleotide sequence of GAM7776 RNA, herein designated GAM RNA, also designated SEQ ID:246.

Another function of GAM7776 is therefore inhibition of Glycoprotein v (platelet) (GP5, Accession NP_004479.1). Accordingly, utilities of GAM7776 include diagnosis, prevention and treatment of diseases and clinical conditions associated with GP5.

GPP34R (Accession NP_060648.2) is another GAM7776 target gene, herein designated TARGET GENE. GPP34R BINDING SITE is a target binding site found in the 3' untranslated region of mRNA encoded by GPP34R, corresponding to a target binding site such as BINDING SITE I, BINDING SITE II or BINDING SITE III of FIG. 8. Table 4 illustrates the complementarity of the nucleotide sequences of GPP34R BINDING SITE, designated SEQ ID:14203, to the nucleotide sequence of GAM7776 RNA, herein designated GAM RNA, also designated SEQ ID:246.

Another function of GAM7776 is therefore inhibition of GPP34R (Accession NP_060648.2). Accordingly, utilities of GAM7776 include diagnosis, prevention and treatment of diseases and clinical conditions associated with GPP34R.

G protein-coupled receptor 26 (GPR26, Accession NP_703143.1) is another GAM7776 target gene, herein designated TARGET GENE. GPR26 BINDING SITE is a target binding site found in the 3' untranslated region of mRNA encoded by GPR26, corresponding to a target binding site such as BINDING SITE I, BINDING SITE II or BINDING SITE III of FIG. 8. Table 4 illustrates the complementarity of the nucleotide sequences of GPR26 BINDING SITE, designated SEQ ID:3010, to the nucleotide sequence of GAM7776 RNA, herein designated GAM RNA, also designated SEQ ID:246.

Another function of GAM7776 is therefore inhibition of G protein-coupled receptor 26 (GPR26, Accession NP_703143.1). Accordingly, utilities of GAM7776 include diagnosis, prevention and treatment of diseases and clinical conditions associated with GPR26.

G protein-coupled receptor 4 (GPR4, Accession NP_005273.1) is another GAM7776 target gene, herein designated TARGET GENE. GPR4 BINDING SITE is a target binding site found in the 3' untranslated region of mRNA encoded by GPR4, corresponding to a target binding site such as BINDING SITE I, BINDING SITE II or BINDING SITE III of FIG. 8. Table 4 illustrates the complementarity of the nucleotide sequences of GPR4 BINDING SITE, designated SEQ ID:4965, to the nucleotide sequence of GAM7776 RNA, herein designated GAM RNA, also designated SEQ ID:246.

Another function of GAM7776 is therefore inhibition of G protein-coupled receptor 4 (GPR4, Accession NP_005273.1), a gene which stimulates to produce increased calcium by both SPC and LPC . Accordingly, utilities of GAM7776 include diagnosis, prevention and treatment of diseases and clinical conditions associated with GPR4.

The function of GPR4 and its association with various diseases and clinical conditions, has been established by previous studies, as described hereinabove with reference to GAM189.1. G protein-coupled receptor 56 (GPR56, Accession NP_005673.2) is another GAM7776 target gene, herein designated TARGET GENE. GPR56 BINDING SITE is a target binding site found in the 5' untranslated region of mRNA encoded by GPR56, corresponding to a target binding site such as BINDING SITE I, BINDING SITE II or BINDING SITE III of FIG. 8. Table 4 illustrates the complementarity of the nucleotide sequences of GPR56 BINDING SITE, designated SEQ ID:8622, to the nucleotide sequence of GAM7776 RNA, herein designated GAM RNA, also designated SEQ ID:246.

Another function of GAM7776 is therefore inhibition of G protein-coupled receptor 56 (GPR56, Accession NP_005673.2), a gene which transduces extracellular signals through heterotrimeric G proteins. Accordingly, utilities of GAM7776 include diagnosis, prevention and treatment of diseases and clinical conditions associated with GPR56.

The function of GPR56 and its association with various diseases and clinical conditions, has been established by previous studies, as described hereinabove with reference to GAM63.1. G protein-coupled receptor 66 (GPR66, Accession NP_006047.2) is another GAM7776 target gene, herein designated TARGET GENE. GPR66 BINDING SITE is a target binding site found in the 3' untranslated region of mRNA encoded by GPR66, corresponding to a target binding site such as BINDING SITE I, BINDING SITE II or BINDING SITE III of FIG. 8. Table 4 illustrates the complementarity of the nucleotide sequences of GPR66 BINDING SITE, designated SEQ ID:19237, to the nucleotide sequence of GAM7776 RNA, herein designated GAM RNA, also designated SEQ ID:246.

Another function of GAM7776 is therefore inhibition of G protein-coupled receptor 66 (GPR66, Accession NP_006047.2). Accordingly, utilities of GAM7776 include diagnosis, prevention and treatment of diseases and clinical conditions associated with GPR66.

G protein-coupled receptor 81 (GPR81, Accession NP_115943.1) is another GAM7776 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:13260, to the nucleotide sequence of GAM7776 RNA, herein designated GAM RNA, also designated SEQ ID:246.

Another function of GAM7776 is therefore inhibition of G protein-coupled receptor 81 (GPR81, Accession NP_115943.1). Accordingly, utilities of GAM7776 include diagnosis, prevention and treatment of diseases and clinical conditions associated with GPR81.

GR6 (Accession NP_031380.1) is another GAM7776 target gene, herein designated TARGET GENE. GR6 BINDING SITE is a target binding site found in the 5' untranslated region of mRNA encoded by GR6, corresponding to a target binding site such as BINDING SITE I, BINDING SITE II or BINDING SITE III of FIG. 8. Table 4 illustrates the complementarity of the nucleotide sequences of GR6 BINDING SITE, designated SEQ ID:2604, to the nucleotide sequence of GAM7776 RNA, herein designated GAM RNA, also designated SEQ ID:246.

Another function of GAM7776 is therefore inhibition of GR6 (Accession NP_031380.1). Accordingly, utilities of GAM7776 include diagnosis, prevention and treatment of diseases and clinical conditions associated with GR6.

GRAF (Accession NP_055886.1) is another GAM7776 target gene, herein designated TARGET GENE. GRAF BINDING SITE is a target binding site found in the 3' untranslated region of mRNA encoded by GRAF, corresponding to a target binding site such as BINDING SITE I, BINDING SITE II or BINDING SITE III of FIG. 8. Table 4 illustrates the complementarity of the nucleotide sequences of GRAF BINDING SITE, designated SEQ ID:4362, to the nucleotide sequence of GAM7776 RNA, herein designated GAM RNA, also designated SEQ ID:246.

Another function of GAM7776 is therefore inhibition of GRAF (Accession NP_055886.1), a gene which ia a GTPase activating protein for p21-rac and therefore may be associated with Juvenile myelomonocytic leukemia. Accordingly, utilities of GAM7776 include diagnosis, prevention and treatment of Juvenile myelomonocytic leukemia, and of other diseases and clinical conditions associated with GRAF.

The function of GRAF and its association with various diseases and clinical conditions, has been established by previous studies, as described hereinabove with reference to GAM189.1. GREB1 (Accession NP_055483.2) is another GAM7776 target gene, herein designated TARGET GENE. GREB1 BINDING SITE1 through GREB1 BINDING SITE3 are target binding sites found in untranslated regions of multiple transcripts of mRNA encoded by GREB1, corresponding to target binding sites such as BINDING SITE I, BINDING SITE II or BINDING SITE III of FIG. 8. Table 4 illustrates the complementarity of the nucleotide sequences of GREB1 BINDING SITE1 through GREB1 BINDING SITE3, designated SEQ ID:9792, SEQ ID:11815 and SEQ ID:14861 respectively, to the nucleotide sequence of GAM7776 RNA, herein designated GAM RNA, also designated SEQ ID:246.

Another function of GAM7776 is therefore inhibition of GREB1 (Accession NP_055483.2). Accordingly, utilities of GAM7776 include diagnosis, prevention and treatment of diseases and clinical conditions associated with GREB1.

Glutamate receptor, ionotropic, delta 1 (GRID1, Accession XP_043613.8) is another GAM7776 target gene, herein designated TARGET GENE. GRID1 BINDING SITE is a target binding site found in the 3' untranslated region of mRNA encoded by GRID1, corresponding to a target binding site such as BINDING SITE I, BINDING SITE II or BINDING SITE III of FIG. 8. Table 4 illustrates the complementarity of the nucleotide sequences of GRID1 BINDING SITE, designated SEQ ID:17390, to the nucleotide sequence of GAM7776 RNA, herein designated GAM RNA, also designated SEQ ID:246.

Another function of GAM7776 is therefore inhibition of Glutamate receptor, ionotropic, delta 1 (GRID1, Accession XP_043613.8). Accordingly, utilities of GAM7776 include diagnosis, prevention and treatment of diseases and clinical conditions associated with GRID1.

Glutamate receptor, ionotropic, n-methyl d-aspartate-like 1a (GRINL1A, Accession NP_056347.1) is another GAM7776 target gene, herein designated TARGET GENE. GRINL1A BINDING SITE is a target binding site found in the 3' untranslated region of mRNA encoded by GRINL1A, corresponding to a target binding site such as BINDING SITE I, BINDING SITE II or BINDING SITE III of FIG. 8. Table 4 illustrates the complementarity of the nucleotide sequences of GRINL1A BINDING SITE, designated SEQ ID:5433, to the nucleotide sequence of GAM7776 RNA, herein designated GAM RNA, also designated SEQ ID:246.

Another function of GAM7776 is therefore inhibition of Glutamate receptor, ionotropic, n-methyl d-aspartate-like 1a (GRINL1A, Accession NP_056347.1), a gene which plays a role in the development and function of the mammalian brain. Accordingly, utilities of GAM7776 include diagnosis, prevention and treatment of diseases and clinical conditions associated with GRINL1A.

The function of GRINL1A and its association with various diseases and clinical conditions, has been established by previous studies, as described hereinabove with reference to GAM189.1. Glutamate receptor, metabotropic 6 (GRM6, Accession NP_000834.1) is another GAM7776 target gene, herein designated TARGET GENE. GRM6 BINDING SITE is a target binding site found in the 3' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:10398, to the nucleotide sequence of GAM7776 RNA, herein designated GAM RNA, also designated SEQ ID:246.

Another function of GAM7776 is therefore inhibition of Glutamate receptor, metabotropic 6 (GRM6, Accession NP_000834.1). Accordingly, utilities of GAM7776 include diagnosis, prevention and treatment of diseases and clinical conditions associated with GRM6.

GRWD (Accession NP_113673.2) is another GAM7776 target gene, herein designated TARGET GENE. GRWD BINDING SITE is a target binding site found in the 3' untranslated region of mRNA encoded by GRWD, corresponding to a target binding site such as BINDING SITE I, BINDING SITE II or BINDING SITE III of FIG. 8. Table 4 illustrates the complementarity of the nucleotide sequences of GRWD BINDING SITE, designated SEQ ID:7996, to the nucleotide sequence of GAM7776 RNA, herein designated GAM RNA, also designated SEQ ID:246.

Another function of GAM7776 is therefore inhibition of GRWD (Accession NP_113673.2). Accordingly, utilities of GAM7776 include diagnosis, prevention and treatment of diseases and clinical conditions associated with GRWD.

GSDM (Accession NP_835465.1) is another GAM7776 target gene, herein designated TARGET GENE. GSDM BINDING SITE is a target binding site found in the 3' untranslated region of multiple transcripts of mRNA encoded by GSDM, corresponding to a target binding site such as BINDING SITE I, BINDING SITE II or BINDING SITE III of FIG. 8. Table 4 illustrates the complementarity of the nucleotide sequences of GSDM BINDING SITE, designated SEQ ID:3199, to the nucleotide sequence of GAM7776 RNA, herein designated GAM RNA, also designated SEQ ID:246.

Another function of GAM7776 is therefore inhibition of GSDM (Accession NP_835465.1). Accordingly, utilities of GAM7776 include diagnosis, prevention and treatment of diseases and clinical conditions associated with GSDM.

GSDM (Accession XP_209009.1) is another GAM7776 target gene, herein designated TARGET GENE. GSDM BINDING SITE is a target binding site found in the 3' untranslated region of multiple transcripts of mRNA encoded by GSDM, corresponding to a target binding site such as BINDING SITE I, BINDING SITE II or BINDING SITE III of FIG. 8. Table 4 illustrates the complementarity of the nucleotide sequences of GSDM BINDING SITE, designated SEQ ID:3199, to the nucleotide sequence of GAM7776 RNA, herein designated GAM RNA, also designated SEQ ID:246.

Another function of GAM7776 is therefore inhibition of GSDM (Accession XP_209009.1). Accordingly, utilities of GAM7776 include diagnosis, prevention and treatment of diseases and clinical conditions associated with GSDM.

Glutathione s-transferase m1 (GSTM1, Accession NP_666533.1) is another GAM7776 target gene, herein designated TARGET GENE. GSTM1 BINDING SITE is a target binding site found in the 3' untranslated region of multiple transcripts of mRNA encoded by GSTM1, corresponding to a target binding site such as BINDING SITE I, BINDING SITE II or BINDING SITE III of FIG. 8. Table 4 illustrates the complementarity of the nucleotide sequences of GSTM1 BINDING SITE, designated SEQ ID:12752, to the nucleotide sequence of GAM7776 RNA, herein designated GAM RNA, also designated SEQ ID:246.

Another function of GAM7776 is therefore inhibition of Glutathione s-transferase m1 (GSTM1, Accession NP_666533.1), a gene which is conjugation of reduced glutathione to a wide number of exogenous and endogenous hydrophobic electrophiles. and therefore may be associated with Aplastic anemia and cancer. Accordingly, utilities of GAM7776 include diagnosis, prevention and treatment of Aplastic anemia and cancer, and of other diseases and clinical conditions associated with GSTM1.

The function of GSTM1 and its association with various diseases and clinical conditions, has been established by previous studies, as described hereinabove with reference to GAM189.1. Glutathione s-transferase m1 (GSTM1, Accession NP_000552.2) is another GAM7776 target gene, herein designated TARGET GENE. GSTM1 BINDING SITE is a target binding site found in the 3' untranslated region of multiple transcripts of mRNA encoded by GSTM1, corresponding to a target binding site such as BINDING SITE I, BINDING SITE II or BINDING SITE III of FIG. 8. Table 4 illustrates the complementarity of the nucleotide sequences of GSTM1 BINDING SITE, designated SEQ ID:12752, to the nucleotide sequence of GAM7776 RNA, herein designated GAM RNA, also designated SEQ ID:246.

Another function of GAM7776 is therefore inhibition of Glutathione s-transferase m1 (GSTM1, Accession NP_000552.2), a gene which is conjugation of reduced glutathione to a wide number of exogenous and endogenous hydrophobic electrophiles. and therefore may be associated with Aplastic anemia and cancer. Accordingly, utilities of GAM7776 include diagnosis, prevention and treatment of Aplastic anemia and cancer, and of other diseases and clinical conditions associated with GSTM1.

The function of GSTM1 and its association with various diseases and clinical conditions, has been established by previous studies, as described hereinabove with reference to GAM189.1. Glutathione s-transferase m2 (muscle) (GSTM2, Accession NP_000839.1) is another GAM7776 target gene, herein designated TARGET GENE. GSTM2 BINDING SITE is a target binding site found in the 3' untranslated region of mRNA encoded by GSTM2, corresponding to a target binding site such as BINDING SITE I, BINDING SITE II or BINDING SITE III of FIG. 8. Table 4 illustrates the complementarity of the nucleotide sequences of GSTM2 BINDING SITE, designated SEQ ID:12752, to the nucleotide sequence of GAM7776 RNA, herein designated GAM RNA, also designated SEQ ID:246.

Another function of GAM7776 is therefore inhibition of Glutathione s-transferase m2 (muscle) (GSTM2, Accession NP_000839.1). Accordingly, utilities of GAM7776 include diagnosis, prevention and treatment of diseases and clinical conditions associated with GSTM2.

Glutathione s-transferase m4 (GSTM4, Accession NP_671490.1) is another GAM7776 target gene, herein designated TARGET GENE. GSTM4 BINDING SITE is a target binding site found in the 3' untranslated region of multiple transcripts of mRNA encoded by GSTM4, corresponding to a target binding site such as BINDING SITE I, BINDING SITE II or BINDING SITE III of FIG. 8. Table 4 illustrates the complementarity of the nucleotide sequences of GSTM4 BINDING SITE, designated SEQ ID:12752, to the nucleotide sequence of GAM7776 RNA, herein designated GAM RNA, also designated SEQ ID:246.

Another function of GAM7776 is therefore inhibition of Glutathione s-transferase m4 (GSTM4, Accession NP_671490.1), a gene which conjugates reduced glutathione to a wide number of exogenous and endogenous hydrophobic electrophiles. Accordingly, utilities of GAM7776 include diagnosis, prevention and treatment of diseases and clinical conditions associated with GSTM4.

The function of GSTM4 and its association with various diseases and clinical conditions, has been established by previous studies, as described hereinabove with reference to GAM189.1. Glutathione s-transferase m4 (GSTM4, Accession NP_000841.1) is another GAM7776 target gene, herein designated TARGET GENE. GSTM4 BINDING SITE is a target binding site found in the 3' untranslated region of multiple transcripts of mRNA encoded by GSTM4, corresponding to a target binding site such as BINDING SITE I, BINDING SITE II or BINDING SITE III of FIG. 8. Table 4 illustrates the complementarity of the nucleotide sequences of GSTM4 BINDING SITE, designated SEQ ID:12752, to the nucleotide sequence of GAM7776 RNA, herein designated GAM RNA, also designated SEQ ID:246.

Another function of GAM7776 is therefore inhibition of Glutathione s-transferase m4 (GSTM4, Accession NP_000841.1), a gene which conjugates reduced glutathione to a wide number of exogenous and endogenous hydrophobic electrophiles. Accordingly, utilities of GAM7776 include diagnosis, prevention and treatment of diseases and clinical conditions associated with GSTM4.

The function of GSTM4 and its association with various diseases and clinical conditions, has been established by previous studies, as described hereinabove with reference to GAM189.1. General transcription factor iie, polypeptide 1, alpha 56 kda (GTF2E1, Accession NP_005504.1) is another GAM7776 target gene, herein designated TARGET GENE. GTF2E1 BINDING SITE is a target binding site found in the 3' untranslated region of mRNA encoded by GTF2E1, corresponding to a target binding site such as BINDING SITE I, BINDING SITE II or BINDING SITE III of FIG. 8. Table 4 illustrates the complementarity of the nucleotide sequences of GTF2E1 BINDING SITE, designated SEQ ID:15661, to the nucleotide sequence of GAM7776 RNA, herein designated GAM RNA, also designated SEQ ID:246.

Another function of GAM7776 is therefore inhibition of General transcription factor iie, polypeptide 1, alpha 56 kda (GTF2E1, Accession NP_005504.1). Accordingly, utilities of GAM7776 include diagnosis, prevention and treatment of diseases and clinical conditions associated with GTF2E1.

GTF2IRD2 (Accession NP_115579.3) is another GAM7776 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:11522, to the nucleotide sequence of GAM7776 RNA, herein designated GAM RNA, also designated SEQ ID:246.

Another function of GAM7776 is therefore inhibition of GTF2IRD2 (Accession NP_115579.3). Accordingly, utilities of GAM7776 include diagnosis, prevention and treatment of diseases and clinical conditions associated with GTF2IRD2.

GTF2IRD2 (Accession NP_775808.1) is another GAM7776 target gene, herein designated TARGET GENE. GTF2IRD2 BINDING SITE is a target binding site found in the 3' untranslated region of multiple transcripts of mRNA encoded by GTF2IRD2, corresponding to a target binding site such as BINDING SITE I, BINDING SITE II or BINDING SITE III of FIG. 8. Table 4 illustrates the complementarity of the nucleotide sequences of GTF2IRD2 BINDING SITE, designated SEQ ID:11522, to the nucleotide sequence of GAM7776 RNA, herein designated GAM RNA, also designated SEQ ID:246.

Another function of GAM7776 is therefore inhibition of GTF2IRD2 (Accession NP_775808.1). Accordingly, utilities of GAM7776 include diagnosis, prevention and treatment of diseases and clinical conditions associated with GTF2IRD2.

GTPBG3 (Accession NP_116009.1) is another GAM7776 target gene, herein designated TARGET GENE. GTPBG3 BINDING SITE1 and GTPBG3 BINDING SITE2 are target binding sites found in untranslated regions of mRNA encoded by GTPBG3, corresponding to target binding sites such as BINDING SITE I, BINDING SITE II or BINDING SITE III of FIG. 8. Table 4 illustrates the complementarity of the nucleotide sequences of GTPBG3 BINDING SITE1 and GTPBG3 BINDING SITE2, designated SEQ ID:7812 and SEQ ID:10292 respectively, to the nucleotide sequence of GAM7776 RNA, herein designated GAM RNA, also designated SEQ ID:246.

Another function of GAM7776 is therefore inhibition of GTPBG3 (Accession NP_116009.1). Accordingly, utilities of GAM7776 include diagnosis, prevention and treatment of diseases and clinical conditions associated with GTPBG3.

Glycogenin (Gy, Accession NP_004121.2) is another GAM7776 target gene, herein designated TARGET GENE. GYG BINDING SITE is a target binding site found in the 3' untranslated region of mRNA encoded by Gy, corresponding to a target binding site such as BINDING SITE I, BINDING SITE II or BINDING SITE III of FIG. 8. Table 4 illustrates the complementarity of the nucleotide sequences of GYG BINDING SITE, designated SEQ ID:4258, to the nucleotide sequence of GAM7776 RNA, herein designated GAM RNA, also designated SEQ ID:246.

Another function of GAM7776 is therefore inhibition of Glycogenin (Gy, Accession NP_004121.2), a gene which primes de novo glycogen synthesis. Accordingly, utilities of GAM7776 include diagnosis, prevention and treatment of diseases and clinical conditions associated with GYG.

The function of GYG and its association with various diseases and clinical conditions, has been established by previous studies, as described hereinabove with reference to GAM189.1. H-plk (Accession NP_056936.1) is another GAM7776 target gene, herein designated TARGET GENE. H-plk BINDING SITE is a target binding site found in the 5' untranslated region of mRNA encoded by H-plk, corresponding to a target binding site such as BINDING SITE I, BINDING SITE II or BINDING SITE III of FIG. 8. Table 4 illustrates the complementarity of the nucleotide sequences of H-plk BINDING SITE, designated SEQ ID:12753, to the nucleotide sequence of GAM7776 RNA, herein designated GAM RNA, also designated SEQ ID:246.

Another function of GAM7776 is therefore inhibition of H-plk (Accession NP_056936.1). Accordingly, utilities of GAM7776 include diagnosis, prevention and treatment of diseases and clinical conditions associated with H-plk.

H2AV (Accession NP_619541.1) is another GAM7776 target gene, herein designated TARGET GENE. H2AV BINDING SITE is a target binding site found in the 3' untranslated region of multiple transcripts of mRNA encoded by H2AV, corresponding to a target binding site such as BINDING SITE I, BINDING SITE II or BINDING SITE III of FIG. 8. Table 4 illustrates the complementarity of the nucleotide sequences of H2AV BINDING SITE, designated SEQ ID:18864, to the nucleotide sequence of GAM7776 RNA, herein designated GAM RNA, also designated SEQ ID:246.

Another function of GAM7776 is therefore inhibition of H2AV (Accession NP_619541.1). Accordingly, utilities of GAM7776 include diagnosis, prevention and treatment of diseases and clinical conditions associated with H2AV.

H63 (Accession NP_612432.2) is another GAM7776 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:4554, to the nucleotide sequence of GAM7776 RNA, herein designated GAM RNA, also designated SEQ ID:246.

Another function of GAM7776 is therefore inhibition of H63 (Accession NP_612432.2). Accordingly, utilities of GAM7776 include diagnosis, prevention and treatment of diseases and clinical conditions associated with H63.

H63 (Accession NP_816929.1) is another GAM7776 target gene, herein designated TARGET GENE. H63 BINDING SITE is a target binding site found in the 3' untranslated region of multiple transcripts of mRNA encoded by H63, corresponding to a target binding site such as BINDING SITE I, BINDING SITE II or BINDING SITE III of FIG. 8. Table 4 illustrates the complementarity of the nucleotide sequences of H63 BINDING SITE, designated SEQ ID:4554, to the nucleotide sequence of GAM7776 RNA, herein designated GAM RNA, also designated SEQ ID:246.

Another function of GAM7776 is therefore inhibition of H63 (Accession NP_816929.1). Accordingly, utilities of GAM7776 include diagnosis, prevention and treatment of diseases and clinical conditions associated with H63.

Hepatitis a virus cellular receptor 2 (HAVCR2, Accession NP_116171.2) is another GAM7776 target gene, herein designated TARGET GENE. HAVCR2 BINDING SITE is a target binding site found in the 3' untranslated region of mRNA encoded by HAVCR2, corresponding to a target binding site such as BINDING SITE I, BINDING SITE II or BINDING SITE III of FIG. 8. Table 4 illustrates the complementarity of the nucleotide sequences of HAVCR2 BINDING SITE, designated SEQ ID:16260, to the nucleotide sequence of GAM7776 RNA, herein designated GAM RNA, also designated SEQ ID:246.

Another function of GAM7776 is therefore inhibition of Hepatitis a virus cellular receptor 2 (HAVCR2, Accession NP_116171.2). Accordingly, utilities of GAM7776 include diagnosis, prevention and treatment of diseases and clinical conditions associated with HAVCR2.

HE9 (Accession NP_741997.1) is another GAM7776 target gene, herein designated TARGET GENE. HE9 BINDING SITE is a target binding site found in the 3' untranslated region of mRNA encoded by HE9, corresponding to a target binding site such as BINDING SITE I, BINDING SITE II or BINDING SITE III of FIG. 8. Table 4 illustrates the complementarity of the nucleotide sequences of HE9 BINDING SITE, designated SEQ ID:7942, to the nucleotide sequence of GAM7776 RNA, herein designated GAM RNA, also designated SEQ ID:246.

Another function of GAM7776 is therefore inhibition of HE9 (Accession NP_741997.1). Accordingly, utilities of GAM7776 include diagnosis, prevention and treatment of diseases and clinical conditions associated with HE9.

Hephaestin (HEPH, Accession NP_055614.1) is another GAM7776 target gene, herein designated TARGET GENE. HEPH BINDING SITE is a target binding site found in the 5' untranslated region of multiple transcripts of mRNA encoded by HEPH, corresponding to a target binding site such as BINDING SITE I, BINDING SITE II or BINDING SITE III of FIG. 8. Table 4 illustrates the complementarity of the nucleotide sequences of HEPH BINDING SITE, designated SEQ ID:15338, to the nucleotide sequence of GAM7776 RNA, herein designated GAM RNA, also designated SEQ ID:246.

Another function of GAM7776 is therefore inhibition of Hephaestin (HEPH, Accession NP_055614.1), a gene which is thought to be a membrane-bound protein responsible for transport of dietary iron from epithelial cells of the intestinal lumen into the circulatory system. Accordingly, utilities of GAM7776 include diagnosis, prevention and treatment of diseases and clinical conditions associated with HEPH.

The function of HEPH and its association with various diseases and clinical conditions, has been established by previous studies, as described hereinabove with reference to GAM189.1. Hexosaminidase a (alpha polypeptide) (HEXA, Accession NP_000511.1) is another GAM7776 target gene, herein designated TARGET GENE. HEXA BINDING SITE is a target binding site found in the 3' untranslated region of mRNA encoded by HEXA, corresponding to a target binding site such as BINDING SITE I, BINDING SITE II or BINDING SITE III of FIG. 8. Table 4 illustrates the complementarity of the nucleotide sequences of HEXA BINDING SITE, designated SEQ ID:14035, to the nucleotide sequence of GAM7776 RNA, herein designated GAM RNA, also designated SEQ ID:246.

Another function of GAM7776 is therefore inhibition of Hexosaminidase a (alpha polypeptide) (HEXA, Accession NP_000511.1). Accordingly, utilities of GAM7776 include diagnosis, prevention and treatment of diseases and clinical conditions associated with HEXA.

Holocarboxylase synthetase (biotin-[proprionyl-coenzyme a-carboxylase (atp-hydrolysing)] ligase) (HLCS, Accession NP_000402.2) is another GAM7776 target gene, herein designated TARGET GENE. HLCS BINDING SITE is a target binding site found in the 5' untranslated region of mRNA encoded by HLCS, corresponding to a target binding site such as BINDING SITE I, BINDING SITE II or BINDING SITE III of FIG. 8. Table 4 illustrates the complementarity of the nucleotide sequences of HLCS BINDING SITE, designated SEQ ID:2142, to the nucleotide sequence of GAM7776 RNA, herein designated GAM RNA, also designated SEQ ID:246.

Another function of GAM7776 is therefore inhibition of Holocarboxylase synthetase (biotin-[proprionyl-coenzyme a-carboxylase (atp-hydrolysing)] ligase) (HLCS, Accession NP_000402.2). Accordingly, utilities of GAM7776 include diagnosis, prevention and treatment of diseases and clinical conditions associated with HLCS.

High-mobility group 20a (HMG20A, Accession NP_060670.1) is another GAM7776 target gene, herein designated TARGET GENE. HMG20A BINDING SITE is a target binding site found in the 3' untranslated region of mRNA encoded by HMG20A, corresponding to a target binding site such as BINDING SITE I, BINDING SITE II or BINDING SITE III of FIG. 8. Table 4 illustrates the complementarity of the nucleotide sequences of HMG20A BINDING SITE, designated SEQ ID:5040, to the nucleotide sequence of GAM7776 RNA, herein designated GAM RNA, also designated SEQ ID:246.

Another function of GAM7776 is therefore inhibition of High-mobility group 20a (HMG20A, Accession NP_060670.1). Accordingly, utilities of GAM7776 include diagnosis, prevention and treatment of diseases and clinical conditions associated with HMG20A.

HPRN (Accession NP_071938.1) is another GAM7776 target gene, herein designated TARGET GENE. HPRN BINDING SITE is a target binding site found in the 3' untranslated region of mRNA encoded by HPRN, corresponding to a target binding site such as BINDING SITE I, BINDING SITE II or BINDING SITE III of FIG. 8. Table 4 illustrates the complementarity of the nucleotide sequences of HPRN BINDING SITE, designated SEQ ID:12916, to the nucleotide sequence of GAM7776 RNA, herein designated GAM RNA, also designated SEQ ID:246.

Another function of GAM7776 is therefore inhibition of HPRN (Accession NP_071938.1). Accordingly, utilities of GAM7776 include diagnosis, prevention and treatment of diseases and clinical conditions associated with HPRN.

Histamine receptor h4 (HRH4, Accession NP_067637.2) is another GAM7776 target gene, herein designated TARGET GENE. HRH4 BINDING SITE1 and HRH4 BINDING SITE2 are target binding sites found in untranslated regions of mRNA encoded by HRH4, corresponding to target binding sites such as BINDING SITE I, BINDING SITE II or BINDING SITE III of FIG. 8. Table 4 illustrates the complementarity of the nucleotide sequences of HRH4 BINDING SITE1 and HRH4 BINDING SITE2, designated SEQ ID:3116 and SEQ ID:18211 respectively, to the nucleotide sequence of GAM7776 RNA, herein designated GAM RNA, also designated SEQ ID:246.

Another function of GAM7776 is therefore inhibition of Histamine receptor h4 (HRH4, Accession NP_067637.2). Accordingly, utilities of GAM7776 include diagnosis, prevention and treatment of diseases and clinical conditions associated with HRH4.

Hmt1 hnrnp methyltransferase-like 3 (s. cerevisiae) (HRMT1L3, Accession NP_062828.2) is another GAM7776 target gene, herein designated TARGET GENE. HRMT1L3 BINDING SITE is a target binding site found in the 5' untranslated region of mRNA encoded by HRMT1L3, corresponding to a target binding site such as BINDING SITE I, BINDING SITE II or BINDING SITE III of FIG. 8. Table 4 illustrates the complementarity of the nucleotide sequences of HRMT1L3 BINDING SITE, designated SEQ ID:18437, to the nucleotide sequence of GAM7776 RNA, herein designated GAM RNA, also designated SEQ ID:246.

Another function of GAM7776 is therefore inhibition of Hmt1 hnrnp methyltransferase-like 3 (s. cerevisiae) (HRMT1L3, Accession NP_062828.2). Accordingly, utilities of GAM7776 include diagnosis, prevention and treatment of diseases and clinical conditions associated with HRMT1L3.

HSD3B7 (Accession NP_079469.2) is another GAM7776 target gene, herein designated TARGET GENE. HSD3B7 BINDING SITE is a target binding site found in the 3' untranslated region of mRNA encoded by HSD3B7, corresponding to a target binding site such as BINDING SITE I, BINDING SITE II or BINDING SITE III of FIG. 8. Table 4 illustrates the complementarity of the nucleotide sequences of HSD3B7 BINDING SITE, designated SEQ ID:2674, to the nucleotide sequence of GAM7776 RNA, herein designated GAM RNA, also designated SEQ ID:246.

Another function of GAM7776 is therefore inhibition of HSD3B7 (Accession NP_079469.2). Accordingly, utilities of GAM7776 include diagnosis, prevention and treatment of diseases and clinical conditions associated with HSD3B7.

HSMPP8 (Accession XP_167894.1) is another GAM7776 target gene, herein designated TARGET GENE. HSMPP8 BINDING SITE is a target binding site found in the 3' untranslated region of mRNA encoded by HSMPP8, corresponding to a target binding site such as BINDING SITE I, BINDING SITE II or BINDING SITE III of FIG. 8. Table 4 illustrates the complementarity of the nucleotide sequences of HSMPP8 BINDING SITE, designated SEQ ID:7797, to the nucleotide sequence of GAM7776 RNA, herein designated GAM RNA, also designated SEQ ID:246.

Another function of GAM7776 is therefore inhibition of HSMPP8 (Accession XP_167894.1). Accordingly, utilities of GAM7776 include diagnosis, prevention and treatment of diseases and clinical conditions associated with HSMPP8.

Heat shock 70 kda protein 4 (HSPA4, Accession XP_114482.1) is another GAM7776 target gene, herein designated TARGET GENE. HSPA4 BINDING SITE is a target binding site found in the 3' untranslated region of mRNA encoded by HSPA4, corresponding to a target binding site such as BINDING SITE I, BINDING SITE II or BINDING SITE III of FIG. 8. Table 4 illustrates the complementarity of the nucleotide sequences of HSPA4 BINDING SITE, designated SEQ ID:15189, to the nucleotide sequence of GAM7776 RNA, herein designated GAM RNA, also designated SEQ ID:246.

Another function of GAM7776 is therefore inhibition of Heat shock 70 kda protein 4 (HSPA4, Accession XP_114482.1). Accordingly, utilities of GAM7776 include diagnosis, prevention and treatment of diseases and clinical conditions associated with HSPA4.

HSPC065 (Accession NP_054876.2) is another GAM7776 target gene, herein designated TARGET GENE. HSPC065 BINDING SITE1 and HSPC065 BINDING SITE2 are target binding sites found in untranslated regions of mRNA encoded by HSPC065, corresponding to target binding sites such as BINDING SITE I, BINDING SITE II or BINDING SITE III of FIG. 8. Table 4 illustrates the complementarity of the nucleotide sequences of HSPC065 BINDING SITE1 and HSPC065 BINDING SITE2, designated SEQ ID:713 and SEQ ID:4676 respectively, to the nucleotide sequence of GAM7776 RNA, herein designated GAM RNA, also designated SEQ ID:246.

Another function of GAM7776 is therefore inhibition of HSPC065 (Accession NP_054876.2). Accordingly, utilities of GAM7776 include diagnosis, prevention and treatment of diseases and clinical conditions associated with HSPC065.

5-hydroxytryptamine (serotonin) receptor 1d (HTR1D, Accession NP_000855.1) is another GAM7776 target gene, herein designated TARGET GENE. HTR1D BINDING SITE is a target binding site found in the 3' untranslated region of mRNA encoded by HTR1D, corresponding to a target binding site such as BINDING SITE I, BINDING SITE II or BINDING SITE III of FIG. 8. Table 4 illustrates the complementarity of the nucleotide sequences of HTR1D BINDING SITE, designated SEQ ID:2563, to the nucleotide sequence of GAM7776 RNA, herein designated GAM RNA, also designated SEQ ID:246.

Another function of GAM7776 is therefore inhibition of 5-hydroxytryptamine (serotonin) receptor 1d (HTR1D, Accession NP_000855.1), a gene which belongs to g-protein coupled receptor. Accordingly, utilities of GAM7776 include diagnosis, prevention and treatment of diseases and clinical conditions associated with HTR1D.

The function of HTR1D and its association with various diseases and clinical conditions, has been established by previous studies, as described hereinabove with reference to GAM189.1. Hormonally upregulated neu-associated kinase (HUNK, Accession NP_055401.1) is another GAM7776 target gene, herein designated TARGET GENE. HUNK BINDING SITE is a target binding site found in the 3' untranslated region of mRNA encoded by HUNK, corresponding to a target binding site such as BINDING SITE I, BINDING SITE II or BINDING SITE III of FIG. 8. Table 4 illustrates the complementarity of the nucleotide sequences of HUNK BINDING SITE, designated SEQ ID:17952, to the nucleotide sequence of GAM7776 RNA, herein designated GAM RNA, also designated SEQ ID:246.

Another function of GAM7776 is therefore inhibition of Hormonally upregulated neu-associated kinase (HUNK, Accession NP_055401.1). Accordingly, utilities of GAM7776 include diagnosis, prevention and treatment of diseases and clinical conditions associated with HUNK.

Hus1 checkpoint homolog (s. pombe) (HUS1, Accession NP_004498.1) is another GAM7776 target gene, herein designated TARGET GENE. HUS1 BINDING SITE is a target binding site found in the 3' untranslated region of mRNA encoded by HUS1, corresponding to a target binding site such as BINDING SITE I, BINDING SITE II or BINDING SITE III of FIG. 8. Table 4 illustrates the complementarity of the nucleotide sequences of HUS1 BINDING SITE, designated SEQ ID:14238, to the nucleotide sequence of GAM7776 RNA, herein designated GAM RNA, also designated SEQ ID:246.

Another function of GAM7776 is therefore inhibition of Hus1 checkpoint homolog (s. pombe) (HUS1, Accession NP_004498.1), a gene which May form DNA damage-responsive protein complex. Accordingly, utilities of GAM7776 include diagnosis, prevention and treatment of diseases and clinical conditions associated with HUS1.

The function of HUS1 and its association with various diseases and clinical conditions, has been established by previous studies, as described hereinabove with reference to GAM189.1. Hyaluronoglucosaminidase 4 (HYAL4, Accession NP_036401.1) is another GAM7776 target gene, herein designated TARGET GENE. HYAL4 BINDING SITE is a target binding site found in the 5' untranslated region of mRNA encoded by HYAL4, corresponding to a target binding site such as BINDING SITE I, BINDING SITE II or BINDING SITE III of FIG. 8. Table 4 illustrates the complementarity of the nucleotide sequences of HYAL4 BINDING SITE, designated SEQ ID:2143, to the nucleotide sequence of GAM7776 RNA, herein designated GAM RNA, also designated SEQ ID:246.

Another function of GAM7776 is therefore inhibition of Hyaluronoglucosaminidase 4 (HYAL4, Accession NP_036401.1). Accordingly, utilities of GAM7776 include diagnosis, prevention and treatment of diseases and clinical conditions associated with HYAL4.

HYPB (Accession NP_036403.1) is another GAM7776 target gene, herein designated TARGET GENE. HYPB BINDING SITE is a target binding site found in the 3' untranslated region of multiple transcripts of mRNA encoded by HYPB, corresponding to a target binding site such as BINDING SITE I, BINDING SITE II or BINDING SITE III of FIG. 8. Table 4 illustrates the complementarity of the nucleotide sequences of HYPB BINDING SITE, designated SEQ ID:14422, to the nucleotide sequence of GAM7776 RNA, herein designated GAM RNA, also designated SEQ ID:246.

Another function of GAM7776 is therefore inhibition of HYPB (Accession NP_036403.1). Accordingly, utilities of GAM7776 include diagnosis, prevention and treatment of diseases and clinical conditions associated with HYPB.

Intercellular adhesion molecule 1 (cd54), human rhinovirus receptor (ICAM1, Accession NP_000192.1) is another GAM7776 target gene, herein designated TARGET GENE. ICAM1 BINDING SITE is a target binding site found in the 3' untranslated region of mRNA encoded by ICAM1, corresponding to a target binding site such as BINDING SITE I, BINDING SITE II or BINDING SITE III of FIG. 8. Table 4 illustrates the complementarity of the nucleotide sequences of ICAM1 BINDING SITE, designated SEQ ID:12075, to the nucleotide sequence of GAM7776 RNA, herein designated GAM RNA, also designated SEQ ID:246.

Another function of GAM7776 is therefore inhibition of Intercellular adhesion molecule 1 (cd54), human rhinovirus receptor (ICAM1, Accession NP_000192.1), a gene which binds the integrin LFA-1 (ITGB2) and promotes adhesion; member of the immunoglobulin superfamily and therefore may be associated with Malaria, cerebral, susceptibility to. Accordingly, utilities of GAM7776 include diagnosis, prevention and treatment of Malaria, cerebral, susceptibility to, and of other diseases and clinical conditions associated with ICAM1.

The function of ICAM1 and its association with various diseases and clinical conditions, has been established by previous studies, as described hereinabove with reference to GAM189.1. ICK (Accession NP_055735.1) is another GAM7776 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:7385, to the nucleotide sequence of GAM7776 RNA, herein designated GAM RNA, also designated SEQ ID:246.

Another function of GAM7776 is therefore inhibition of ICK (Accession NP_055735.1). Accordingly, utilities of GAM7776 include diagnosis, prevention and treatment of diseases and clinical conditions associated with ICK.

ICK (Accession NP_057597.2) is another GAM7776 target gene, herein designated TARGET GENE. ICK BINDING SITE is a target binding site found in the 3' untranslated region of multiple transcripts of mRNA encoded by ICK, corresponding to a target binding site such as BINDING SITE I, BINDING SITE II or BINDING SITE III of FIG. 8. Table 4 illustrates the complementarity of the nucleotide sequences of ICK BINDING SITE, designated SEQ ID:7385, to the nucleotide sequence of GAM7776 RNA, herein designated GAM RNA, also designated SEQ ID:246.

Another function of GAM7776 is therefore inhibition of ICK (Accession NP_057597.2). Accordingly, utilities of GAM7776 include diagnosis, prevention and treatment of diseases and clinical conditions associated with ICK.

Insulin-like growth factor 1 (somatomedin c) (IGF1, Accession NP_000609.1) is another GAM7776 target gene, herein designated TARGET GENE. IGF1 BINDING SITE is a target binding site found in the 3' untranslated region of mRNA encoded by IGF1, corresponding to a target binding site such as BINDING SITE I, BINDING SITE II or BINDING SITE III of FIG. 8. Table 4 illustrates the complementarity of the nucleotide sequences of IGF1 BINDING SITE, designated SEQ ID:6279, to the nucleotide sequence of GAM7776 RNA, herein designated GAM RNA, also designated SEQ ID:246.

Another function of GAM7776 is therefore inhibition of Insulin-like growth factor 1 (somatomedin c) (IGF1, Accession NP_000609.1), a gene which are structurally and functionally related to insulin but have a much higher growth-promoting activity and therefore may be associated with Growth retardation with sensorineural deafness and mental retardation. Accordingly, utilities of GAM7776 include diagnosis, prevention and treatment of Growth retardation with sensorineural deafness and mental retardation, and of other diseases and clinical conditions associated with IGF1.

The function of IGF1 and its association with various diseases and clinical conditions, has been established by previous studies, as described hereinabove with reference to GAM66.2. Immunoglobulin mu binding protein 2 (IGHMBP2, Accession NP_002171.1) is another GAM7776 target gene, herein designated TARGET GENE. IGHMBP2 BINDING SITE is a target binding site found in the 5' untranslated region of mRNA encoded by IGHMBP2, corresponding to a target binding site such as BINDING SITE I, BINDING SITE II or BINDING SITE III of FIG. 8. Table 4 illustrates the complementarity of the nucleotide sequences of IGHMBP2 BINDING SITE, designated SEQ ID:17385, to the nucleotide sequence of GAM7776 RNA, herein designated GAM RNA, also designated SEQ ID:246.

Another function of GAM7776 is therefore inhibition of Immunoglobulin mu binding protein 2 (IGHMBP2, Accession NP_002171.1). Accordingly, utilities of GAM7776 include diagnosis, prevention and treatment of diseases and clinical conditions associated with IGHMBP2.

Immunoglobulin lambda-like polypeptide 1 (IGLL1, Accession NP_064455.1) is another GAM7776 target gene, herein designated TARGET GENE. IGLL1 BINDING SITE is a target binding site found in the 5' untranslated region of multiple transcripts of mRNA encoded by IGLL1, corresponding to a target binding site such as BINDING SITE I, BINDING SITE II or BINDING SITE III of FIG. 8. Table 4 illustrates the complementarity of the nucleotide sequences of IGLL1 BINDING SITE, designated SEQ ID:4573, to the nucleotide sequence of GAM7776 RNA, herein designated GAM RNA, also designated SEQ ID:246.

Another function of GAM7776 is therefore inhibition of Immunoglobulin lambda-like polypeptide 1 (IGLL1, Accession NP_064455.1), a gene which expressed only in pre-b-cells and a special b-cell line (which is surface ig negative). and therefore may be associated with Agammaglobulinemia, autosomal recessive. Accordingly, utilities of GAM7776 include diagnosis, prevention and treatment of Agammaglobulinemia, autosomal recessive, and of other diseases and clinical conditions associated with IGLL1.

The function of IGLL1 and its association with various diseases and clinical conditions, has been established by previous studies, as described hereinabove with reference to GAM189.1. Immunoglobulin lambda-like polypeptide 1 (IGLL1, Accession NP_690594.1) is another GAM7776 target gene, herein designated TARGET GENE. IGLL1 BINDING SITE is a target binding site found in the 5' untranslated region of multiple transcripts of mRNA encoded by IGLL1, corresponding to a target binding site such as BINDING SITE I, BINDING SITE II or BINDING SITE III of FIG. 8. Table 4 illustrates the complementarity of the nucleotide sequences of IGLL1 BINDING SITE, designated SEQ ID:4573, to the nucleotide sequence of GAM7776 RNA, herein designated GAM RNA, also designated SEQ ID:246.

Another function of GAM7776 is therefore inhibition of Immunoglobulin lambda-like polypeptide 1 (IGLL1, Accession NP_690594.1), a gene which expressed only in pre-b-cells and a special b-cell line (which is surface ig negative). and therefore may be associated with Agammaglobulinemia, autosomal recessive. Accordingly, utilities of GAM7776 include diagnosis, prevention and treatment of Agammaglobulinemia, autosomal recessive, and of other diseases and clinical conditions associated with IGLL1.

The function of IGLL1 and its association with various diseases and clinical conditions, has been established by previous studies, as described hereinabove with reference to GAM189.1. Interleukin 11 (IL11, Accession NP_000632.1) is another GAM7776 target gene, herein designated TARGET GENE. IL11 BINDING SITE is a target binding site found in the 3' untranslated region of mRNA encoded by IL11, corresponding to a target binding site such as BINDING SITE I, BINDING SITE II or BINDING SITE III of FIG. 8. Table 4 illustrates the complementarity of the nucleotide sequences of IL11 BINDING SITE, designated SEQ ID:11544, to the nucleotide sequence of GAM7776 RNA, herein designated GAM RNA, also designated SEQ ID:246.

Another function of GAM7776 is therefore inhibition of Interleukin 11 (IL11, Accession NP_000632.1), a gene which stimulates the proliferation of hematopoietic stem cells and megakaryocyte progenitor cells and induces megakaryocyte maturation. Accordingly, utilities of GAM7776 include diagnosis, prevention and treatment of diseases and clinical conditions associated with IL11.

The function of IL11 and its association with various diseases and clinical conditions, has been established by previous studies, as described hereinabove with reference to GAM41.1. Interleukin 12 receptor, beta 1 (IL12RB1, Accession NP__714912.1) is another GAM7776 target gene, herein designated TARGET GENE. IL12RB1 BINDING SITE is a target binding site found in the 3' untranslated region of multiple transcripts of mRNA encoded by IL12RB1, corresponding to a target binding site such as BINDING SITE I, BINDING SITE II or BINDING SITE III of FIG. 8. Table 4 illustrates the complementarity of the nucleotide sequences of IL12RB1 BINDING SITE, designated SEQ ID:10756, to the nucleotide sequence of GAM7776 RNA, herein designated GAM RNA, also designated SEQ ID:246.

Another function of GAM7776 is therefore inhibition of Interleukin 12 receptor, beta 1 (IL12RB1, Accession NP__714912.1). Accordingly, utilities of GAM7776 include diagnosis, prevention and treatment of diseases and clinical conditions associated with IL12RB1.

Interleukin 16 (lymphocyte chemoattractant factor) (IL16, Accession NP__757366.1) is another GAM7776 target gene, herein designated TARGET GENE. IL16 BINDING SITE is a target binding site found in the 5' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:19554, to the nucleotide sequence of GAM7776 RNA, herein designated GAM RNA, also designated SEQ ID:246.

Another function of GAM7776 is therefore inhibition of Interleukin 16 (lymphocyte chemoattractant factor) (IL16, Accession NP__757366.1), a gene which modulates T-cell activation. Accordingly, utilities of GAM7776 include diagnosis, prevention and treatment of diseases and clinical conditions associated with IL16.

The function of IL16 and its association with various diseases and clinical conditions, has been established by previous studies, as described hereinabove with reference to GAM66.1. Interleukin 21 receptor (IL21R, Accession NP__851564.1) is another GAM7776 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM7776 RNA, herein designated GAM RNA, also designated SEQ ID:246.

Another function of GAM7776 is therefore inhibition of Interleukin 21 receptor (IL21R, Accession NP__851564.1), a gene which is involved in receptor mediated endocytosis and transduces the mitogenic signals of il- 2. Accordingly, utilities of GAM7776 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 21 receptor (IL21R, Accession NP__851565.1) is another GAM7776 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM7776 RNA, herein designated GAM RNA, also designated SEQ ID:246.

Another function of GAM7776 is therefore inhibition of Interleukin 21 receptor (IL21R, Accession NP__851565.1), a gene which is involved in receptor mediated endocytosis and transduces the mitogenic signals of il- 2. Accordingly, utilities of GAM7776 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 21 receptor (IL21R, Accession NP__068570.1) is another GAM7776 target gene, herein designated TARGET GENE. IL21R BINDING SITE is a target binding site found in the 3' untranslated region of multiple transcripts of mRNA encoded by IL21R, corresponding to a target binding site such as BINDING SITE I, BINDING SITE II or BINDING SITE III of FIG. 8. Table 4 illustrates the complementarity of the nucleotide sequences of IL21R BINDING SITE, designated SEQ ID:498, to the nucleotide sequence of GAM7776 RNA, herein designated GAM RNA, also designated SEQ ID:246.

Another function of GAM7776 is therefore inhibition of Interleukin 21 receptor (IL21R, Accession NP__068570.1), a gene which is involved in receptor mediated endocytosis and transduces the mitogenic signals of il- 2. Accordingly, utilities of GAM7776 include diagnosis, prevention and treatment of diseases and clinical conditions associated with IL21R.

The function of IL21R and its association with various diseases and clinical conditions, has been established by previous studies, as described hereinabove with reference to GAM69.2. Interleukin 28 receptor, alpha (IL28RA, Accession NP__775087.1) is another GAM7776 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM7776 RNA, herein designated GAM RNA, also designated SEQ ID:246.

Another function of GAM7776 is therefore inhibition of Interleukin 28 receptor, alpha (IL28RA, Accession NP__775087.1). Accordingly, utilities of GAM7776 include diagnosis, prevention and treatment of diseases and clinical conditions associated with IL28RA.

Interleukin 28 receptor, alpha (IL28RA, Accession NP__734464.1) is another GAM7776 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM7776 RNA, herein designated GAM RNA, also designated SEQ ID:246.

Another function of GAM7776 is therefore inhibition of Interleukin 28 receptor, alpha (IL28RA, Accession NP__734464.1). Accordingly, utilities of GAM7776 include diagnosis, prevention and treatment of diseases and clinical conditions associated with IL28RA.

Interleukin 28 receptor, alpha (IL28RA, Accession NP_775088.1) is another GAM7776 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:7046, to the nucleotide sequence of GAM7776 RNA, herein designated GAM RNA, also designated SEQ ID:246.

Another function of GAM7776 is therefore inhibition of Interleukin 28 receptor, alpha (IL28RA, Accession NP_775088.1). Accordingly, utilities of GAM7776 include diagnosis, prevention and treatment of diseases and clinical conditions associated with IL28RA.

Interleukin 5 receptor, alpha (IL5RA, Accession NP_783853.1) is another GAM7776 target gene, herein designated TARGET GENE. IL5RA BINDING SITE is a target binding site found in the 3' untranslated region of multiple transcripts of mRNA encoded by IL5RA, corresponding to a target binding site such as BINDING SITE I, BINDING SITE II or BINDING SITE III of FIG. 8. Table 4 illustrates the complementarity of the nucleotide sequences of IL5RA BINDING SITE, designated SEQ ID:8557, to the nucleotide sequence of GAM7776 RNA, herein designated GAM RNA, also designated SEQ ID:246.

Another function of GAM7776 is therefore inhibition of Interleukin 5 receptor, alpha (IL5RA, Accession NP_783853.1), a gene which is the receptor for interleukin-5. the alpha chain binds to il-5. Accordingly, utilities of GAM7776 include diagnosis, prevention and treatment of diseases and clinical conditions associated with IL5RA.

The function of IL5RA and its association with various diseases and clinical conditions, has been established by previous studies, as described hereinabove with reference to GAM189.1. Interleukin 5 receptor, alpha (IL5RA, Accession NP_000555.2) is another GAM7776 target gene, herein designated TARGET GENE. IL5RA BINDING SITE is a target binding site found in the 3' untranslated region of multiple transcripts of mRNA encoded by IL5RA, corresponding to a target binding site such as BINDING SITE I, BINDING SITE II or BINDING SITE III of FIG. 8. Table 4 illustrates the complementarity of the nucleotide sequences of IL5RA BINDING SITE, designated SEQ ID:8557, to the nucleotide sequence of GAM7776 RNA, herein designated GAM RNA, also designated SEQ ID:246.

Another function of GAM7776 is therefore inhibition of Interleukin 5 receptor, alpha (IL5RA, Accession NP_000555.2), a gene which is the receptor for interleukin-5. the alpha chain binds to il-5. Accordingly, utilities of GAM7776 include diagnosis, prevention and treatment of diseases and clinical conditions associated with IL5RA.

The function of IL5RA and its association with various diseases and clinical conditions, has been established by previous studies, as described hereinabove with reference to GAM189.1. Interleukin enhancer binding factor 3, 90 kda (ILF3, Accession NP_036350.2) is another GAM7776 target gene, herein designated TARGET GENE. ILF3 BINDING SITE is a target binding site found in the 3' untranslated region of multiple transcripts of mRNA encoded by ILF3, corresponding to a target binding site such as BINDING SITE I, BINDING SITE II or BINDING SITE III of FIG. 8. Table 4 illustrates the complementarity of the nucleotide sequences of ILF3 BINDING SITE, designated SEQ ID:17287, to the nucleotide sequence of GAM7776 RNA, herein designated GAM RNA, also designated SEQ ID:246.

Another function of GAM7776 is therefore inhibition of Interleukin enhancer binding factor 3, 90 kda (ILF3, Accession NP_036350.2). Accordingly, utilities of GAM7776 include diagnosis, prevention and treatment of diseases and clinical conditions associated with ILF3.

IMPACT (Accession NP_060909.1) is another GAM7776 target gene, herein designated TARGET GENE. IMPACT BINDING SITE is a target binding site found in the 3' untranslated region of mRNA encoded by IMPACT, corresponding to a target binding site such as BINDING SITE I, BINDING SITE II or BINDING SITE III of FIG. 8. Table 4 illustrates the complementarity of the nucleotide sequences of IMPACT BINDING SITE, designated SEQ ID:8975, to the nucleotide sequence of GAM7776 RNA, herein designated GAM RNA, also designated SEQ ID:246.

Another function of GAM7776 is therefore inhibition of IMPACT (Accession NP_060909.1). Accordingly, utilities of GAM7776 include diagnosis, prevention and treatment of diseases and clinical conditions associated with IMPACT.

INHBE (Accession NP_113667.1) is another GAM7776 target gene, herein designated TARGET GENE. INHBE BINDING SITE is a target binding site found in the 3' untranslated region of mRNA encoded by INHBE, corresponding to a target binding site such as BINDING SITE I, BINDING SITE II or BINDING SITE III of FIG. 8. Table 4 illustrates the complementarity of the nucleotide sequences of INHBE BINDING SITE, designated SEQ ID:16283, to the nucleotide sequence of GAM7776 RNA, herein designated GAM RNA, also designated SEQ ID:246.

Another function of GAM7776 is therefore inhibition of INHBE (Accession NP_113667.1). Accordingly, utilities of GAM7776 include diagnosis, prevention and treatment of diseases and clinical conditions associated with INHBE.

Indolethylamine n-methyltransferase (INMT, Accession NP_006765.3) is another GAM7776 target gene, herein designated TARGET GENE. INMT BINDING SITE1 and INMT BINDING SITE2 are target binding sites found in untranslated regions of mRNA encoded by INMT, corresponding to target binding sites such as BINDING SITE I, BINDING SITE II or BINDING SITE III of FIG. 8. Table 4 illustrates the complementarity of the nucleotide sequences of INMT BINDING SITE1 and INMT BINDING SITE2, designated SEQ ID:9149 and SEQ ID:11523 respectively, to the nucleotide sequence of GAM7776 RNA, herein designated GAM RNA, also designated SEQ ID:246.

Another function of GAM7776 is therefore inhibition of Indolethylamine n-methyltransferase (INMT, Accession NP_006765.3). Accordingly, utilities of GAM7776 include diagnosis, prevention and treatment of diseases and clinical conditions associated with INMT.

Interferon regulatory factor 4 (IRF4, Accession NP_002451.1) is another GAM7776 target gene, herein designated TARGET GENE. IRF4 BINDING SITE1 and IRF4 BINDING SITE2 are target binding sites found in untranslated regions of mRNA encoded by IRF4, corresponding to target binding sites such as BINDING SITE I, BINDING SITE II or BINDING SITE III of FIG. 8. Table 4 illustrates the complementarity of the nucleotide sequences of IRF4 BINDING SITE1 and IRF4 BINDING SITE2, designated SEQ ID:2698 and SEQ ID:1517 respectively, to the nucleotide sequence of GAM7776 RNA, herein designated GAM RNA, also designated SEQ ID:246.

Another function of GAM7776 is therefore inhibition of Interferon regulatory factor 4 (IRF4, Accession NP_002451.1). Accordingly, utilities of GAM7776 include diagnosis, prevention and treatment of diseases and clinical conditions associated with IRF4.

Integrin, alpha x (antigen cd11c (p150), alpha polypeptide) (ITGAX, Accession NP_000878.1) is another GAM7776 target gene, herein designated TARGET GENE. ITGAX BINDING SITE is a target binding site found in the 3' untranslated region of mRNA encoded by ITGAX, corresponding to a target binding site such as BINDING SITE I, BINDING SITE II or BINDING SITE III of FIG. 8. Table 4 illustrates the complementarity of the nucleotide sequences of ITGAX BINDING SITE, designated SEQ ID:559, to the nucleotide sequence of GAM7776 RNA, herein designated GAM RNA, also designated SEQ ID:246.

Another function of GAM7776 is therefore inhibition of Integrin, alpha x (antigen cd11c (p150), alpha polypeptide) (ITGAX, Accession NP_000878.1). Accordingly, utilities of GAM7776 include diagnosis, prevention and treatment of diseases and clinical conditions associated with ITGAX.

Janus kinase 3 (a protein tyrosine kinase, leukocyte) (JAK3, Accession NP_000206.1) is another GAM7776 target gene, herein designated TARGET GENE. JAK3 BINDING SITE is a target binding site found in the 3' untranslated region of mRNA encoded by JAK3, corresponding to a target binding site such as BINDING SITE I, BINDING SITE II or BINDING SITE III of FIG. 8. Table 4 illustrates the complementarity of the nucleotide sequences of JAK3 BINDING SITE, designated SEQ ID:18060, to the nucleotide sequence of GAM7776 RNA, herein designated GAM RNA, also designated SEQ ID:246.

Another function of GAM7776 is therefore inhibition of Janus kinase 3 (a protein tyrosine kinase, leukocyte) (JAK3, Accession NP_000206.1). Accordingly, utilities of GAM7776 include diagnosis, prevention and treatment of diseases and clinical conditions associated with JAK3.

JM11 (Accession NP_296375.1) is another GAM7776 target gene, herein designated TARGET GENE. JM11 BINDING SITE is a target binding site found in the 3' untranslated region of mRNA encoded by JM11, corresponding to a target binding site such as BINDING SITE I, BINDING SITE II or BINDING SITE III of FIG. 8. Table 4 illustrates the complementarity of the nucleotide sequences of JM11 BINDING SITE, designated SEQ ID:10197, to the nucleotide sequence of GAM7776 RNA, herein designated GAM RNA, also designated SEQ ID:246.

Another function of GAM7776 is therefore inhibition of JM11 (Accession NP_296375.1). Accordingly, utilities of GAM7776 include diagnosis, prevention and treatment of diseases and clinical conditions associated with JM11.

Jerky homolog (mouse) (JRK, Accession NP_003715.1) is another GAM7776 target gene, herein designated TARGET GENE. JRK BINDING SITE is a target binding site found in the 3' untranslated region of mRNA encoded by JRK, corresponding to a target binding site such as BINDING SITE I, BINDING SITE II or BINDING SITE III of FIG. 8. Table 4 illustrates the complementarity of the nucleotide sequences of JRK BINDING SITE, designated SEQ ID:3927, to the nucleotide sequence of GAM7776 RNA, herein designated GAM RNA, also designated SEQ ID:246.

Another function of GAM7776 is therefore inhibition of Jerky homolog (mouse) (JRK, Accession NP_003715.1), a gene which might function as a DNA-binding protein. and therefore may be associated with Absence epilepsy. Accordingly, utilities of GAM7776 include diagnosis, prevention and treatment of Absence epilepsy, and of other diseases and clinical conditions associated with JRK.

The function of JRK and its association with various diseases and clinical conditions, has been established by previous studies, as described hereinabove with reference to GAM65.2. Potassium inwardly-rectifying channel, subfamily j, member 11 (KCNJ11, Accession NP_000516.2) is another GAM7776 target gene, herein designated TARGET GENE. KCNJ11 BINDING SITE is a target binding site found in the 5' untranslated region of mRNA encoded by KCNJ11, corresponding to a target binding site such as BINDING SITE I, BINDING SITE II or BINDING SITE III of FIG. 8. Table 4 illustrates the complementarity of the nucleotide sequences of KCNJ11 BINDING SITE, designated SEQ ID:15049, to the nucleotide sequence of GAM7776 RNA, herein designated GAM RNA, also designated SEQ ID:246.

Another function of GAM7776 is therefore inhibition of Potassium inwardly-rectifying channel, subfamily j, member 11 (KCNJ11, Accession NP_000516.2), a gene which is controlled by g proteins. inward rectifier k+ channels are characterized by a greater tendency to allow potassium to flow into the cell rather than out of it. and therefore is associated with Persistent hyperinsulinemic hypoglycemia of infancy. Accordingly, utilities of GAM7776 include diagnosis, prevention and treatment of Persistent hyperinsulinemic hypoglycemia of infancy, and of other diseases and clinical conditions associated with KCNJ11.

The function of KCNJ11 and its association with various diseases and clinical conditions, has been established by previous studies, as described hereinabove with reference to GAM189.1. Potassium inwardly-rectifying channel, subfamily j, member 16 (KCNJ16, Accession NP_061128.1) is another GAM7776 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM7776 RNA, herein designated GAM RNA, also designated SEQ ID:246.

Another function of GAM7776 is therefore inhibition of Potassium inwardly-rectifying channel, subfamily j, member 16 (KCNJ16, Accession NP_061128.1). Accordingly, utilities of GAM7776 include diagnosis, prevention and treatment of diseases and clinical conditions associated with KCNJ16.

Potassium inwardly-rectifying channel, subfamily j, member 16 (KCNJ16, Accession NP_733938.1) is another GAM7776 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM7776 RNA, herein designated GAM RNA, also designated SEQ ID:246.

Another function of GAM7776 is therefore inhibition of Potassium inwardly-rectifying channel, subfamily j, member 16 (KCNJ16, Accession NP_733938.1). Accordingly, utilities of GAM7776 include diagnosis, prevention and treatment of diseases and clinical conditions associated with KCNJ16.

Potassium inwardly-rectifying channel, subfamily j, member 16 (KCNJ16, Accession NP_733937.1) is another GAM7776 target gene, herein designated TARGET GENE. KCNJ16 BINDING SITE is a target binding site found in the 3' untranslated region of multiple transcripts of mRNA encoded by KCNJ16, corresponding to a target binding site such as BINDING SITE I, BINDING SITE II or BINDING SITE III of FIG. 8. Table 4 illustrates the complementarity of the nucleotide sequences of KCNJ16 BINDING SITE, designated SEQ ID:2456, to the nucleotide sequence of GAM7776 RNA, herein designated GAM RNA, also designated SEQ ID:246.

Another function of GAM7776 is therefore inhibition of Potassium inwardly-rectifying channel, subfamily j, member 16 (KCNJ16, Accession NP_733937.1). Accordingly, utilities of GAM7776 include diagnosis, prevention and treatment of diseases and clinical conditions associated with KCNJ16.

KENAE (Accession NP_789786.1) is another GAM7776 target gene, herein designated TARGET GENE. KENAE BINDING SITE is a target binding site found in the 3' untranslated region of mRNA encoded by KENAE, corresponding to a target binding site such as BINDING SITE I, BINDING SITE II or BINDING SITE III of FIG. 8. Table 4 illustrates the complementarity of the nucleotide sequences of KENAE BINDING SITE, designated SEQ ID:14862, to the nucleotide sequence of GAM7776 RNA, herein designated GAM RNA, also designated SEQ ID:246.

Another function of GAM7776 is therefore inhibition of KENAE (Accession NP_789786.1). Accordingly, utilities of GAM7776 include diagnosis, prevention and treatment of diseases and clinical conditions associated with KENAE.

KIAA0063 (Accession NP_055691.1) is another GAM7776 target gene, herein designated TARGET GENE. KIAA0063 BINDING SITE is a target binding site found in the 3' untranslated region of mRNA encoded by KIAA0063, corresponding to a target binding site such as BINDING SITE I, BINDING SITE II or BINDING SITE III of FIG. 8. Table 4 illustrates the complementarity of the nucleotide sequences of KIAA0063 BINDING SITE, designated SEQ ID:5884, to the nucleotide sequence of GAM7776 RNA, herein designated GAM RNA, also designated SEQ ID:246.

Another function of GAM7776 is therefore inhibition of KIAA0063 (Accession NP_055691.1). Accordingly, utilities of GAM7776 include diagnosis, prevention and treatment of diseases and clinical conditions associated with KIAA0063.

KIAA0082 (Accession NP_055865.1) is another GAM7776 target gene, herein designated TARGET GENE. KIAA0082 BINDING SITE is a target binding site found in the 3' untranslated region of mRNA encoded by KIAA0082, corresponding to a target binding site such as BINDING SITE I, BINDING SITE II or BINDING SITE III of FIG. 8. Table 4 illustrates the complementarity of the nucleotide sequences of KIAA0082 BINDING SITE, designated SEQ ID:18751, to the nucleotide sequence of GAM7776 RNA, herein designated GAM RNA, also designated SEQ ID:246.

Another function of GAM7776 is therefore inhibition of KIAA0082 (Accession NP_055865.1). Accordingly, utilities of GAM7776 include diagnosis, prevention and treatment of diseases and clinical conditions associated with KIAA0082.

KIAA0087 (Accession NP_055584.1) is another GAM7776 target gene, herein designated TARGET GENE. KIAA0087 BINDING SITE1 and KIAA0087 BINDING SITE2 are target binding sites found in untranslated regions of mRNA encoded by KIAA0087, corresponding to target binding sites such as BINDING SITE I, BINDING SITE II or BINDING SITE III of FIG. 8. Table 4 illustrates the complementarity of the nucleotide sequences of KIAA0087 BINDING SITE1 and KIAA0087 BINDING SITE2, designated SEQ ID:7956 and SEQ ID:10179 respectively, to the nucleotide sequence of GAM7776 RNA, herein designated GAM RNA, also designated SEQ ID:246.

Another function of GAM7776 is therefore inhibition of KIAA0087 (Accession NP_055584.1). Accordingly, utilities of GAM7776 include diagnosis, prevention and treatment of diseases and clinical conditions associated with KIAA0087.

KIAA0117 (Accession XP_290939.1) is another GAM7776 target gene, herein designated TARGET GENE. KIAA0117 BINDING SITE is a target binding site found in the 3' untranslated region of mRNA encoded by KIAA0117, corresponding to a target binding site such as BINDING SITE I, BINDING SITE II or BINDING SITE III of FIG. 8. Table 4 illustrates the complementarity of the nucleotide sequences of KIAA0117 BINDING SITE, designated SEQ ID:9255, to the nucleotide sequence of GAM7776 RNA, herein designated GAM RNA, also designated SEQ ID:246.

Another function of GAM7776 is therefore inhibition of KIAA0117 (Accession XP_290939.1). Accordingly, utilities of GAM7776 include diagnosis, prevention and treatment of diseases and clinical conditions associated with KIAA0117.

KIAA0182 (Accession XP_050495.4) is another GAM7776 target gene, herein designated TARGET GENE. KIAA0182 BINDING SITE is a target binding site found in the 3' untranslated region of mRNA encoded by KIAA0182, corresponding to a target binding site such as BINDING SITE I, BINDING SITE II or BINDING SITE III of FIG. 8. Table 4 illustrates the complementarity of the nucleotide sequences of KIAA0182 BINDING SITE, designated SEQ ID:2218, to the nucleotide sequence of GAM7776 RNA, herein designated GAM RNA, also designated SEQ ID:246.

Another function of GAM7776 is therefore inhibition of KIAA0182 (Accession XP_050495.4). Accordingly, utilities of GAM7776 include diagnosis, prevention and treatment of diseases and clinical conditions associated with KIAA0182.

KIAA0186 (Accession NP_066545.1) is another GAM7776 target gene, herein designated TARGET GENE. KIAA0186 BINDING SITE is a target binding site found in the 3' untranslated region of mRNA encoded by KIAA0186, corresponding to a target binding site such as BINDING SITE I, BINDING SITE II or BINDING SITE III of FIG. 8. Table 4 illustrates the complementarity of the nucleotide sequences of KIAA0186 BINDING SITE, designated SEQ ID:2625, to the nucleotide sequence of GAM7776 RNA, herein designated GAM RNA, also designated SEQ ID:246.

Another function of GAM7776 is therefore inhibition of KIAA0186 (Accession NP_066545.1). Accordingly, utilities of GAM7776 include diagnosis, prevention and treatment of diseases and clinical conditions associated with KIAA0186.

KIAA0205 (Accession NP_055688.1) is another GAM7776 target gene, herein designated TARGET GENE. KIAA0205 BINDING SITE is a target binding site found in the 3' untranslated region of mRNA encoded by KIAA0205, corresponding to a target binding site such as BINDING SITE I, BINDING SITE II or BINDING SITE III of FIG. 8. Table 4 illustrates the complementarity of the nucleotide sequences of KIAA0205 BINDING SITE, designated SEQ ID:3429, to the nucleotide sequence of GAM7776 RNA, herein designated GAM RNA, also designated SEQ ID:246.

Another function of GAM7776 is therefore inhibition of KIAA0205 (Accession NP_055688.1). Accordingly, utilities of GAM7776 include diagnosis, prevention and treatment of diseases and clinical conditions associated with KIAA0205.

KIAA0237 (Accession NP_055562.1) is another GAM7776 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:17386, to the nucleotide sequence of GAM7776 RNA, herein designated GAM RNA, also designated SEQ ID:246.

Another function of GAM7776 is therefore inhibition of KIAA0237 (Accession NP_055562.1). Accordingly, utilities of GAM7776 include diagnosis, prevention and treatment of diseases and clinical conditions associated with KIAA0237.

KIAA0295 (Accession XP_042833.2) is another GAM7776 target gene, herein designated TARGET GENE. KIAA0295 BINDING SITE is a target binding site found in the 3' untranslated region of mRNA encoded by KIAA0295, corresponding to a target binding site such as BINDING SITE I, BINDING SITE II or BINDING SITE III of FIG. 8. Table 4 illustrates the complementarity of the nucleotide sequences of KIAA0295 BINDING SITE, designated SEQ ID:10742, to the nucleotide sequence of GAM7776 RNA, herein designated GAM RNA, also designated SEQ ID:246.

Another function of GAM7776 is therefore inhibition of KIAA0295 (Accession XP_042833.2). Accordingly, utilities of GAM7776 include diagnosis, prevention and treatment of diseases and clinical conditions associated with KIAA0295.

KIAA0435 (Accession NP_055616.1) is another GAM7776 target gene, herein designated TARGET GENE. KIAA0435 BINDING SITE is a target binding site found in the 5' untranslated region of mRNA encoded by KIAA0435, corresponding to a target binding site such as BINDING SITE I, BINDING SITE II or BINDING SITE III of FIG. 8. Table 4 illustrates the complementarity of the nucleotide sequences of KIAA0435 BINDING SITE, designated SEQ ID:5041, to the nucleotide sequence of GAM7776 RNA, herein designated GAM RNA, also designated SEQ ID:246.

Another function of GAM7776 is therefore inhibition of KIAA0435 (Accession NP_055616.1). Accordingly, utilities of GAM7776 include diagnosis, prevention and treatment of diseases and clinical conditions associated with KIAA0435.

KIAA0446 (Accession XP_044155.1) is another GAM7776 target gene, herein designated TARGET GENE. KIAA0446 BINDING SITE is a target binding site found in the 5' untranslated region of mRNA encoded by KIAA0446, corresponding to a target binding site such as BINDING SITE I, BINDING SITE II or BINDING SITE III of FIG. 8. Table 4 illustrates the complementarity of the nucleotide sequences of KIAA0446 BINDING SITE, designated SEQ ID:1475, to the nucleotide sequence of GAM7776 RNA, herein designated GAM RNA, also designated SEQ ID:246.

Another function of GAM7776 is therefore inhibition of KIAA0446 (Accession XP_044155.1). Accordingly, utilities of GAM7776 include diagnosis, prevention and treatment of diseases and clinical conditions associated with KIAA0446.

KIAA0459 (Accession XP_027862.1) is another GAM7776 target gene, herein designated TARGET GENE. KIAA0459 BINDING SITE is a target binding site found in the 3' untranslated region of mRNA encoded by KIAA0459, corresponding to a target binding site such as BINDING SITE I, BINDING SITE II or BINDING SITE III of FIG. 8. Table 4 illustrates the complementarity of the nucleotide sequences of KIAA0459 BINDING SITE, designated SEQ ID:4531, to the nucleotide sequence of GAM7776 RNA, herein designated GAM RNA, also designated SEQ ID:246.

Another function of GAM7776 is therefore inhibition of KIAA0459 (Accession XP_027862.1). Accordingly, utilities of GAM7776 include diagnosis, prevention and treatment of diseases and clinical conditions associated with KIAA0459.

KIAA0469 (Accession NP_055666.1) is another GAM7776 target gene, herein designated TARGET GENE. KIAA0469 BINDING SITE1 and KIAA0469 BINDING SITE2 are target binding sites found in untranslated regions of mRNA encoded by KIAA0469, corresponding to target binding sites such as BINDING SITE I, BINDING SITE II or BINDING SITE III of FIG. 8. Table 4 illustrates the complementarity of the nucleotide sequences of KIAA0469 BINDING SITE1 and KIAA0469 BINDING SITE2, designated SEQ ID:9147 and SEQ ID:9493 respectively, to the nucleotide sequence of GAM7776 RNA, herein designated GAM RNA, also designated SEQ ID:246.

Another function of GAM7776 is therefore inhibition of KIAA0469 (Accession NP_055666.1). Accordingly, utilities of GAM7776 include diagnosis, prevention and treatment of diseases and clinical conditions associated with KIAA0469.

KIAA0475 (Accession NP_055679.1) is another GAM7776 target gene, herein designated TARGET GENE. KIAA0475 BINDING SITE is a target binding site found in the 3' untranslated region of mRNA encoded by KIAA0475, corresponding to a target binding site such as BINDING SITE I, BINDING SITE II or BINDING SITE III of FIG. 8. Table 4 illustrates the complementarity of the nucleotide sequences of KIAA0475 BINDING SITE, designated SEQ ID:16940, to the nucleotide sequence of GAM7776 RNA, herein designated GAM RNA, also designated SEQ ID:246.

Another function of GAM7776 is therefore inhibition of KIAA0475 (Accession NP_055679.1). Accordingly, utilities of GAM7776 include diagnosis, prevention and treatment of diseases and clinical conditions associated with KIAA0475.

KIAA0493 (Accession XP_034717.1) is another GAM7776 target gene, herein designated TARGET GENE. KIAA0493 BINDING SITE is a target binding site found in the 5' untranslated region of mRNA encoded by KIAA0493, corresponding to a target binding site such as BINDING SITE I, BINDING SITE II or BINDING SITE III of FIG. 8. Table 4 illustrates the complementarity of the nucleotide sequences of KIAA0493 BINDING SITE, designated SEQ ID:17206, to the nucleotide sequence of GAM7776 RNA, herein designated GAM RNA, also designated SEQ ID:246.

Another function of GAM7776 is therefore inhibition of KIAA0493 (Accession XP_034717.1). Accordingly, utilities of GAM7776 include diagnosis, prevention and treatment of diseases and clinical conditions associated with KIAA0493.

KIAA0495 (Accession XP_031397.1) is another GAM7776 target gene, herein designated TARGET GENE. KIAA0495 BINDING SITE1 and KIAA0495 BINDING SITE2 are target binding sites found in untranslated regions of mRNA encoded by KIAA0495, corresponding to target binding sites such as BINDING SITE I, BINDING SITE II or BINDING SITE III of FIG. 8. Table 4 illustrates the complementarity of the nucleotide sequences of KIAA0495 BINDING SITE1 and KIAA0495 BINDING SITE2, designated SEQ ID:14759 and SEQ ID:5442 respectively, to the nucleotide sequence of GAM7776 RNA, herein designated GAM RNA, also designated SEQ ID:246.

Another function of GAM7776 is therefore inhibition of KIAA0495 (Accession XP_031397.1). Accordingly, utilities of GAM7776 include diagnosis, prevention and treatment of diseases and clinical conditions associated with KIAA0495.

KIAA0513 (Accession NP_055547.1) is another GAM7776 target gene, herein designated TARGET GENE. KIAA0513 BINDING SITE is a target binding site found in the 3' untranslated region of mRNA encoded by KIAA0513, corresponding to a target binding site such as BINDING SITE I, BINDING SITE II or BINDING SITE III of FIG. 8. Table 4 illustrates the complementarity of the nucleotide sequences of KIAA0513 BINDING SITE, designated SEQ ID:3931, to the nucleotide sequence of GAM7776 RNA, herein designated GAM RNA, also designated SEQ ID:246.

Another function of GAM7776 is therefore inhibition of KIAA0513 (Accession NP_055547.1). Accordingly, utilities of GAM7776 include diagnosis, prevention and treatment of diseases and clinical conditions associated with KIAA0513.

KIAA0527 (Accession XP_171054.1) is another GAM7776 target gene, herein designated TARGET GENE. KIAA0527 BINDING SITE is a target binding site found in the 3' untranslated region of mRNA encoded by KIAA0527, corresponding to a target binding site such as BINDING SITE I, BINDING SITE II or BINDING SITE III of FIG. 8. Table 4 illustrates the complementarity of the nucleotide sequences of KIAA0527 BINDING SITE, designated SEQ ID:19745, to the nucleotide sequence of GAM7776 RNA, herein designated GAM RNA, also designated SEQ ID:246.

Another function of GAM7776 is therefore inhibition of KIAA0527 (Accession XP_171054.1). Accordingly, utilities of GAM7776 include diagnosis, prevention and treatment of diseases and clinical conditions associated with KIAA0527.

KIAA0532 (Accession XP_047659.6) is another GAM7776 target gene, herein designated TARGET GENE. KIAA0532 BINDING SITE is a target binding site found in the 3' untranslated region of mRNA encoded by KIAA0532, corresponding to a target binding site such as BINDING SITE I, BINDING SITE II or BINDING SITE III of FIG. 8. Table 4 illustrates the complementarity of the nucleotide sequences of KIAA0532 BINDING SITE, designated SEQ ID:12455, to the nucleotide sequence of GAM7776 RNA, herein designated GAM RNA, also designated SEQ ID:246.

Another function of GAM7776 is therefore inhibition of KIAA0532 (Accession XP_047659.6). Accordingly, utilities of GAM7776 include diagnosis, prevention and treatment of diseases and clinical conditions associated with KIAA0532.

KIAA0555 (Accession NP_055605.1) is another GAM7776 target gene, herein designated TARGET GENE. KIAA0555 BINDING SITE is a target binding site found in the 3' untranslated region of mRNA encoded by KIAA0555, corresponding to a target binding site such as BINDING SITE I, BINDING SITE II or BINDING SITE III of FIG. 8. Table 4 illustrates the complementarity of the nucleotide sequences of KIAA0555 BINDING SITE, designated SEQ ID:5555, to the nucleotide sequence of GAM7776 RNA, herein designated GAM RNA, also designated SEQ ID:246.

Another function of GAM7776 is therefore inhibition of KIAA0555 (Accession NP_055605.1). Accordingly, utilities of GAM7776 include diagnosis, prevention and treatment of diseases and clinical conditions associated with KIAA0555.

KIAA0561 (Accession XP_038150.2) is another GAM7776 target gene, herein designated TARGET GENE. KIAA0561 BINDING SITE is a target binding site found in the 3' untranslated region of mRNA encoded by KIAA0561, corresponding to a target binding site such as BINDING SITE I, BINDING SITE II or BINDING SITE III of FIG. 8. Table 4 illustrates the complementarity of the nucleotide sequences of KIAA0561 BINDING SITE, designated SEQ ID:9629, to the nucleotide sequence of GAM7776 RNA, herein designated GAM RNA, also designated SEQ ID:246.

Another function of GAM7776 is therefore inhibition of KIAA0561 (Accession XP_038150.2). Accordingly, utilities of GAM7776 include diagnosis, prevention and treatment of diseases and clinical conditions associated with KIAA0561.

KIAA0562 (Accession NP_055519.1) is another GAM7776 target gene, herein designated TARGET GENE. KIAA0562 BINDING SITE is a target binding site found in the 3' untranslated region of mRNA encoded by KIAA0562, corresponding to a target binding site such as BINDING SITE I, BINDING SITE II or BINDING SITE III of FIG. 8. Table 4 illustrates the complementarity of the nucleotide sequences of KIAA0562 BINDING SITE, designated SEQ ID:16544, to the nucleotide sequence of GAM7776 RNA, herein designated GAM RNA, also designated SEQ ID:246.

Another function of GAM7776 is therefore inhibition of KIAA0562 (Accession NP_055519.1). Accordingly, utilities of GAM7776 include diagnosis, prevention and treatment of diseases and clinical conditions associated with KIAA0562.

KIAA0563 (Accession NP_055649.1) is another GAM7776 target gene, herein designated TARGET GENE. KIAA0563 BINDING SITE is a target binding site found in the 5' untranslated region of mRNA encoded by KIAA0563, corresponding to a target binding site such as BINDING SITE I, BINDING SITE II or BINDING SITE III of FIG. 8. Table 4 illustrates the complementarity of the nucleotide sequences of KIAA0563 BINDING SITE, designated SEQ ID:16377, to the nucleotide sequence of GAM7776 RNA, herein designated GAM RNA, also designated SEQ ID:246.

Another function of GAM7776 is therefore inhibition of KIAA0563 (Accession NP_055649.1). Accordingly, utilities of GAM7776 include diagnosis, prevention and treatment of diseases and clinical conditions associated with KIAA0563.

KIAA0682 (Accession NP_055667.1) is another GAM7776 target gene, herein designated TARGET GENE. KIAA0682 BINDING SITE is a target binding site found in the 3' untranslated region of multiple transcripts of mRNA encoded by KIAA0682, corresponding to a target binding site such as BINDING SITE I, BINDING SITE II or BINDING SITE III of FIG. 8. Table 4 illustrates the complementarity of the nucleotide sequences of KIAA0682 BINDING SITE, designated SEQ ID:6522, to the nucleotide sequence of GAM7776 RNA, herein designated GAM RNA, also designated SEQ ID:246.

Another function of GAM7776 is therefore inhibition of KIAA0682 (Accession NP_055667.1). Accordingly, utilities of GAM7776 include diagnosis, prevention and treatment of diseases and clinical conditions associated with KIAA0682.

KIAA0804 (Accession XP_291080.1) is another GAM7776 target gene, herein designated TARGET GENE. KIAA0804 BINDING SITE is a target binding site found in the 3' untranslated region of mRNA encoded by KIAA0804, corresponding to a target binding site such as BINDING SITE I, BINDING SITE II or BINDING SITE III of FIG. 8. Table 4 illustrates the complementarity of the nucleotide sequences of KIAA0804 BINDING SITE, designated SEQ ID:14656, to the nucleotide sequence of GAM7776 RNA, herein designated GAM RNA, also designated SEQ ID:246.

Another function of GAM7776 is therefore inhibition of KIAA0804 (Accession XP_291080.1). Accordingly, utilities of GAM7776 include diagnosis, prevention and treatment of diseases and clinical conditions associated with KIAA0804.

KIAA0831 (Accession NP_055739.1) is another GAM7776 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:3260, to the nucleotide sequence of GAM7776 RNA, herein designated GAM RNA, also designated SEQ ID:246.

Another function of GAM7776 is therefore inhibition of KIAA0831 (Accession NP_055739.1). Accordingly, utilities of GAM7776 include diagnosis, prevention and treatment of diseases and clinical conditions associated with KIAA0831.

KIAA0841 (Accession XP_049237.1) is another GAM7776 target gene, herein designated TARGET GENE. KIAA0841 BINDING SITE1 and KIAA0841 BINDING SITE2 are target binding sites found in untranslated regions of mRNA encoded by KIAA0841, corresponding to target binding sites such as BINDING SITE I, BINDING SITE II or BINDING SITE III of FIG. 8. Table 4 illustrates the complementarity of the nucleotide sequences of KIAA0841 BINDING SITE1 and KIAA0841 BINDING SITE2, designated SEQ ID:8185 and SEQ ID:5490 respectively, to the nucleotide sequence of GAM7776 RNA, herein designated GAM RNA, also designated SEQ ID:246.

Another function of GAM7776 is therefore inhibition of KIAA0841 (Accession XP_049237.1). Accordingly, utilities of GAM7776 include diagnosis, prevention and treatment of diseases and clinical conditions associated with KIAA0841.

KIAA0861 (Accession NP_055893.2) is another GAM7776 target gene, herein designated TARGET GENE. KIAA0861 BINDING SITE is a target binding site found in the 3' untranslated region of mRNA encoded by KIAA0861, corresponding to a target binding site such as BINDING SITE I, BINDING SITE II or BINDING SITE III of FIG. 8. Table 4 illustrates the complementarity of the nucleotide sequences of KIAA0861 BINDING SITE, designated SEQ ID:2153, to the nucleotide sequence of GAM7776 RNA, herein designated GAM RNA, also designated SEQ ID:246.

Another function of GAM7776 is therefore inhibition of KIAA0861 (Accession NP_055893.2). Accordingly, utilities of GAM7776 include diagnosis, prevention and treatment of diseases and clinical conditions associated with KIAA0861.

KIAA0889 (Accession NP_056192.1) is another GAM7776 target gene, herein designated TARGET GENE. KIAA0889 BINDING SITE is a target binding site found in the 3' untranslated region of multiple transcripts of mRNA encoded by KIAA0889, corresponding to a target binding site such as BINDING SITE I, BINDING SITE II or BINDING SITE III of FIG. 8. Table 4 illustrates the complementarity of the nucleotide sequences of KIAA0889 BINDING SITE, designated SEQ ID:13271, to the nucleotide sequence of GAM7776 RNA, herein designated GAM RNA, also designated SEQ ID:246.

Another function of GAM7776 is therefore inhibition of KIAA0889 (Accession NP_056192.1). Accordingly, utilities of GAM7776 include diagnosis, prevention and treatment of diseases and clinical conditions associated with KIAA0889.

KIAA0924 (Accession NP_055712.1) is another GAM7776 target gene, herein designated TARGET GENE. KIAA0924 BINDING SITE1 and KIAA0924 BINDING SITE2 are target binding sites found in untranslated regions of mRNA encoded by KIAA0924, corresponding to target binding sites such as BINDING SITE I, BINDING SITE II or BINDING SITE III of FIG. 8. Table 4 illustrates the complementarity of the nucleotide sequences of KIAA0924 BINDING SITE1 and KIAA0924 BINDING SITE2, designated SEQ ID:13297 and SEQ ID:7655 respectively, to the nucleotide sequence of GAM7776 RNA, herein designated GAM RNA, also designated SEQ ID:246.

Another function of GAM7776 is therefore inhibition of KIAA0924 (Accession NP_055712.1). Accordingly, utilities of GAM7776 include diagnosis, prevention and treatment of diseases and clinical conditions associated with KIAA0924.

KIAA0931 (Accession XP_041191.2) is another GAM7776 target gene, herein designated TARGET GENE. KIAA0931 BINDING SITE is a target binding site found in the 3' untranslated region of mRNA encoded by KIAA0931, corresponding to a target binding site such as BINDING SITE I, BINDING SITE II or BINDING SITE III of FIG. 8. Table 4 illustrates the complementarity of the nucleotide sequences of KIAA0931 BINDING SITE, designated SEQ ID:14272, to the nucleotide sequence of GAM7776 RNA, herein designated GAM RNA, also designated SEQ ID:246.

Another function of GAM7776 is therefore inhibition of KIAA0931 (Accession XP_041191.2). Accordingly, utilities of GAM7776 include diagnosis, prevention and treatment of diseases and clinical conditions associated with KIAA0931.

KIAA0935 (Accession XP_052620.6) is another GAM7776 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:11958, to the nucleotide sequence of GAM7776 RNA, herein designated GAM RNA, also designated SEQ ID:246.

Another function of GAM7776 is therefore inhibition of KIAA0935 (Accession XP_052620.6). Accordingly, utilities of GAM7776 include diagnosis, prevention and treatment of diseases and clinical conditions associated with KIAA0935.

KIAA0962 (Accession XP_290942.1) is another GAM7776 target gene, herein designated TARGET GENE. KIAA0962 BINDING SITE is a target binding site found in the 3' untranslated region of mRNA encoded by KIAA0962, corresponding to a target binding site such as BINDING SITE I, BINDING SITE II or BINDING SITE III of FIG. 8. Table 4 illustrates the complementarity of the nucleotide sequences of KIAA0962 BINDING SITE, designated SEQ ID:8976, to the nucleotide sequence of GAM7776 RNA, herein designated GAM RNA, also designated SEQ ID:246.

Another function of GAM7776 is therefore inhibition of KIAA0962 (Accession XP_290942.1). Accordingly, utilities of GAM7776 include diagnosis, prevention and treatment of diseases and clinical conditions associated with KIAA0962.

KIAA1002 (Accession XP_290584.1) is another GAM7776 target gene, herein designated TARGET GENE.

KIAA1002 BINDING SITE is a target binding site found in the 5' untranslated region of mRNA encoded by KIAA1002, corresponding to a target binding site such as BINDING SITE I, BINDING SITE II or BINDING SITE III of FIG. 8. Table 4 illustrates the complementarity of the nucleotide sequences of KIAA1002 BINDING SITE, designated SEQ ID:12518, to the nucleotide sequence of GAM7776 RNA, herein designated GAM RNA, also designated SEQ ID:246.

Another function of GAM7776 is therefore inhibition of KIAA1002 (Accession XP_290584.1). Accordingly, utilities of GAM7776 include diagnosis, prevention and treatment of diseases and clinical conditions associated with KIAA1002.

KIAA1040 (Accession XP_051091.3) is another GAM7776 target gene, herein designated TARGET GENE. KIAA1040 BINDING SITE is a target binding site found in the 3' untranslated region of mRNA encoded by KIAA1040, corresponding to a target binding site such as BINDING SITE I, BINDING SITE II or BINDING SITE III of FIG. 8. Table 4 illustrates the complementarity of the nucleotide sequences of KIAA1040 BINDING SITE, designated SEQ ID:11846, to the nucleotide sequence of GAM7776 RNA, herein designated GAM RNA, also designated SEQ ID:246.

Another function of GAM7776 is therefore inhibition of KIAA1040 (Accession XP_051091.3). Accordingly, utilities of GAM7776 include diagnosis, prevention and treatment of diseases and clinical conditions associated with KIAA1040.

KIAA1041 (Accession NP_055762.1) is another GAM7776 target gene, herein designated TARGET GENE. KIAA1041 BINDING SITE is a target binding site found in the 3' untranslated region of mRNA encoded by KIAA1041, corresponding to a target binding site such as BINDING SITE I, BINDING SITE II or BINDING SITE III of FIG. 8. Table 4 illustrates the complementarity of the nucleotide sequences of KIAA1041 BINDING SITE, designated SEQ ID:3653, to the nucleotide sequence of GAM7776 RNA, herein designated GAM RNA, also designated SEQ ID:246.

Another function of GAM7776 is therefore inhibition of KIAA1041 (Accession NP_055762.1). Accordingly, utilities of GAM7776 include diagnosis, prevention and treatment of diseases and clinical conditions associated with KIAA1041.

KIAA1054 (Accession XP_043493.5) is another GAM7776 target gene, herein designated TARGET GENE. KIAA1054 BINDING SITE is a target binding site found in the 3' untranslated region of mRNA encoded by KIAA1054, corresponding to a target binding site such as BINDING SITE I, BINDING SITE II or BINDING SITE III of FIG. 8. Table 4 illustrates the complementarity of the nucleotide sequences of KIAA1054 BINDING SITE, designated SEQ ID:14832, to the nucleotide sequence of GAM7776 RNA, herein designated GAM RNA, also designated SEQ ID:246.

Another function of GAM7776 is therefore inhibition of KIAA1054 (Accession XP_043493.5). Accordingly, utilities of GAM7776 include diagnosis, prevention and treatment of diseases and clinical conditions associated with KIAA1054.

KIAA1115 (Accession NP_055746.1) is another GAM7776 target gene, herein designated TARGET GENE. KIAA1115 BINDING SITE is a target binding site found in the 3' untranslated region of mRNA encoded by KIAA1115, corresponding to a target binding site such as BINDING SITE I, BINDING SITE II or BINDING SITE III of FIG. 8. Table 4 illustrates the complementarity of the nucleotide sequences of KIAA1115 BINDING SITE, designated SEQ ID:9842, to the nucleotide sequence of GAM7776 RNA, herein designated GAM RNA, also designated SEQ ID:246.

Another function of GAM7776 is therefore inhibition of KIAA1115 (Accession NP_055746.1). Accordingly, utilities of GAM7776 include diagnosis, prevention and treatment of diseases and clinical conditions associated with KIAA1115.

KIAA1128 (Accession NP_061872.1) is another GAM7776 target gene, herein designated TARGET GENE. KIAA1128 BINDING SITE is a target binding site found in the 3' untranslated region of mRNA encoded by KIAA1128, corresponding to a target binding site such as BINDING SITE I, BINDING SITE II or BINDING SITE III of FIG. 8. Table 4 illustrates the complementarity of the nucleotide sequences of KIAA1128 BINDING SITE, designated SEQ ID:5783, to the nucleotide sequence of GAM7776 RNA, herein designated GAM RNA, also designated SEQ ID:246.

Another function of GAM7776 is therefore inhibition of KIAA1128 (Accession NP_061872.1). Accordingly, utilities of GAM7776 include diagnosis, prevention and treatment of diseases and clinical conditions associated with KIAA1128.

KIAA1143 (Accession XP_044014.1) is another GAM7776 target gene, herein designated TARGET GENE. KIAA1143 BINDING SITE is a target binding site found in the 3' untranslated region of mRNA encoded by KIAA1143, corresponding to a target binding site such as BINDING SITE I, BINDING SITE II or BINDING SITE III of FIG. 8. Table 4 illustrates the complementarity of the nucleotide sequences of KIAA1143 BINDING SITE, designated SEQ ID:7385, to the nucleotide sequence of GAM7776 RNA, herein designated GAM RNA, also designated SEQ ID:246.

Another function of GAM7776 is therefore inhibition of KIAA1143 (Accession XP_044014.1). Accordingly, utilities of GAM7776 include diagnosis, prevention and treatment of diseases and clinical conditions associated with KIAA1143.

KIAA1145 (Accession NP_065749.1) is another GAM7776 target gene, herein designated TARGET GENE. KIAA1145 BINDING SITE is a target binding site found in the 3' untranslated region of mRNA encoded by KIAA1145, corresponding to a target binding site such as BINDING SITE I, BINDING SITE II or BINDING SITE III of FIG. 8. Table 4 illustrates the complementarity of the nucleotide sequences of KIAA1145 BINDING SITE, designated SEQ ID:17532, to the nucleotide sequence of GAM7776 RNA, herein designated GAM RNA, also designated SEQ ID:246.

Another function of GAM7776 is therefore inhibition of KIAA1145 (Accession NP_065749.1). Accordingly, utilities of GAM7776 include diagnosis, prevention and treatment of diseases and clinical conditions associated with KIAA1145.

KIAA1155 (Accession XP_030864.2) is another GAM7776 target gene, herein designated TARGET GENE. KIAA1155 BINDING SITE is a target binding site found in the 3' untranslated region of mRNA encoded by KIAA1155, corresponding to a target binding site such as BINDING SITE I, BINDING SITE II or BINDING SITE III of FIG. 8. Table 4 illustrates the complementarity of the nucleotide sequences of KIAA1155 BINDING SITE, designated SEQ ID:2664, to the nucleotide sequence of GAM7776 RNA, herein designated GAM RNA, also designated SEQ ID:246.

Another function of GAM7776 is therefore inhibition of KIAA1155 (Accession XP_030864.2). Accordingly, utilities of GAM7776 include diagnosis, prevention and treatment of diseases and clinical conditions associated with KIAA1155.

KIAA1170 (Accession XP_045907.2) is another GAM7776 target gene, herein designated TARGET GENE. KIAA1170 BINDING SITE is a target binding site found in the 3' untranslated region of mRNA encoded by KIAA1170, corresponding to a target binding site such as BINDING SITE I, BINDING SITE II or BINDING SITE III of FIG. 8. Table 4 illustrates the complementarity of the nucleotide sequences of KIAA1170 BINDING SITE, designated SEQ ID:10162, to the nucleotide sequence of GAM7776 RNA, herein designated GAM RNA, also designated SEQ ID:246.

Another function of GAM7776 is therefore inhibition of KIAA1170 (Accession XP_045907.2). Accordingly, utilities of GAM7776 include diagnosis, prevention and treatment of diseases and clinical conditions associated with KIAA1170.

KIAA1185 (Accession NP_065761.1) is another GAM7776 target gene, herein designated TARGET GENE. KIAA1185 BINDING SITE is a target binding site found in the 3' untranslated region of mRNA encoded by KIAA1185, corresponding to a target binding site such as BINDING SITE I, BINDING SITE II or BINDING SITE III of FIG. 8. Table 4 illustrates the complementarity of the nucleotide sequences of KIAA1185 BINDING SITE, designated SEQ ID:5755, to the nucleotide sequence of GAM7776 RNA, herein designated GAM RNA, also designated SEQ ID:246.

Another function of GAM7776 is therefore inhibition of KIAA1185 (Accession NP_065761.1). Accordingly, utilities of GAM7776 include diagnosis, prevention and treatment of diseases and clinical conditions associated with KIAA1185.

KIAA1193 (Accession XP_041843.1) is another GAM7776 target gene, herein designated TARGET GENE. KIAA1193 BINDING SITE is a target binding site found in the 3' untranslated region of mRNA encoded by KIAA1193, corresponding to a target binding site such as BINDING SITE I, BINDING SITE II or BINDING SITE III of FIG. 8. Table 4 illustrates the complementarity of the nucleotide sequences of KIAA1193 BINDING SITE, designated SEQ ID:17517, to the nucleotide sequence of GAM7776 RNA, herein designated GAM RNA, also designated SEQ ID:246.

Another function of GAM7776 is therefore inhibition of KIAA1193 (Accession XP_041843.1). Accordingly, utilities of GAM7776 include diagnosis, prevention and treatment of diseases and clinical conditions associated with KIAA1193.

KIAA1198 (Accession NP_065765.1) is another GAM7776 target gene, herein designated TARGET GENE. KIAA1198 BINDING SITE1 through KIAA1198 BINDING SITE5 are target binding sites found in untranslated regions of mRNA encoded by KIAA1198, corresponding to target binding sites such as BINDING SITE I, BINDING SITE II or BINDING SITE III of FIG. 8. Table 4 illustrates the complementarity of the nucleotide sequences of KIAA1198 BINDING SITE1 through KIAA1198 BINDING SITE5, designated SEQ ID:13749, SEQ ID:16471, SEQ ID:12389, SEQ ID:16088 and SEQ ID:12478 respectively, to the nucleotide sequence of GAM7776 RNA, herein designated GAM RNA, also designated SEQ ID:246.

Another function of GAM7776 is therefore inhibition of KIAA1198 (Accession NP_065765.1). Accordingly, utilities of GAM7776 include diagnosis, prevention and treatment of diseases and clinical conditions associated with KIAA1198.

KIAA1209 (Accession XP_027307.2) is another GAM7776 target gene, herein designated TARGET GENE. KIAA1209 BINDING SITE is a target binding site found in the 3' untranslated region of mRNA encoded by KIAA1209, corresponding to a target binding site such as BINDING SITE I, BINDING SITE II or BINDING SITE III of FIG. 8. Table 4 illustrates the complementarity of the nucleotide sequences of KIAA1209 BINDING SITE, designated SEQ ID:8271, to the nucleotide sequence of GAM7776 RNA, herein designated GAM RNA, also designated SEQ ID:246.

Another function of GAM7776 is therefore inhibition of KIAA1209 (Accession XP_027307.2). Accordingly, utilities of GAM7776 include diagnosis, prevention and treatment of diseases and clinical conditions associated with KIAA1209.

KIAA1210 (Accession XP_172801.1) is another GAM7776 target gene, herein designated TARGET GENE. KIAA1210 BINDING SITE is a target binding site found in the 3' untranslated region of mRNA encoded by KIAA1210, corresponding to a target binding site such as BINDING SITE I, BINDING SITE II or BINDING SITE III of FIG. 8. Table 4 illustrates the complementarity of the nucleotide sequences of KIAA1210 BINDING SITE, designated SEQ ID:9144, to the nucleotide sequence of GAM7776 RNA, herein designated GAM RNA, also designated SEQ ID:246.

Another function of GAM7776 is therefore inhibition of KIAA1210 (Accession XP_172801.1). Accordingly, utilities of GAM7776 include diagnosis, prevention and treatment of diseases and clinical conditions associated with KIAA1210.

KIAA1257 (Accession XP_031577.2) is another GAM7776 target gene, herein designated TARGET GENE. KIAA1257 BINDING SITE1 and KIAA1257 BINDING SITE2 are target binding sites found in untranslated regions of mRNA encoded by KIAA1257, corresponding to target binding sites such as BINDING SITE I, BINDING SITE II or BINDING SITE III of FIG. 8. Table 4 illustrates the complementarity of the nucleotide sequences of KIAA1257 BINDING SITE1 and KIAA1257 BINDING SITE2, designated SEQ ID:11523 and SEQ ID:9032 respectively, to the nucleotide sequence of GAM7776 RNA, herein designated GAM RNA, also designated SEQ ID:246.

Another function of GAM7776 is therefore inhibition of KIAA1257 (Accession XP_031577.2). Accordingly, utilities of GAM7776 include diagnosis, prevention and treatment of diseases and clinical conditions associated with KIAA1257.

KIAA1268 (Accession XP_291055.1) is another GAM7776 target gene, herein designated TARGET GENE. KIAA1268 BINDING SITE is a target binding site found in the 3' untranslated region of mRNA encoded by KIAA1268, corresponding to a target binding site such as BINDING SITE I, BINDING SITE II or BINDING SITE III of FIG. 8. Table 4 illustrates the complementarity of the nucleotide sequences of KIAA1268 BINDING SITE, designated SEQ ID:3236, to the nucleotide sequence of GAM7776 RNA, herein designated GAM RNA, also designated SEQ ID:246.

Another function of GAM7776 is therefore inhibition of KIAA1268 (Accession XP_291055.1). Accordingly, utilities of GAM7776 include diagnosis, prevention and treatment of diseases and clinical conditions associated with KIAA1268.

KIAA1273 (Accession XP_300760.1) is another GAM7776 target gene, herein designated TARGET GENE. KIAA1273 BINDING SITE1 and KIAA1273 BINDING SITE2 are target binding sites found in untranslated regions of mRNA encoded by KIAA1273, corresponding to target binding sites such as BINDING SITE I, BINDING SITE II or BINDING SITE III of FIG. 8. Table 4 illustrates the complementarity of the nucleotide sequences of KIAA1273 BINDING SITE1 and KIAA1273 BINDING SITE2, designated SEQ ID:4555 and SEQ ID:7374 respectively, to the nucleotide sequence of GAM7776 RNA, herein designated GAM RNA, also designated SEQ ID:246.

Another function of GAM7776 is therefore inhibition of KIAA1273 (Accession XP_300760.1). Accordingly, utilities of GAM7776 include diagnosis, prevention and treatment of diseases and clinical conditions associated with KIAA1273.

KIAA1276 (Accession XP_039169.1) is another GAM7776 target gene, herein designated TARGET GENE. KIAA1276 BINDING SITE is a target binding site found in the 5' untranslated region of mRNA encoded by KIAA1276, corresponding to a target binding site such as BINDING SITE I, BINDING SITE II or BINDING SITE III of FIG. 8. Table 4 illustrates the complementarity of the nucleotide sequences of KIAA1276 BINDING SITE, designated SEQ ID:1905, to the nucleotide sequence of GAM7776 RNA, herein designated GAM RNA, also designated SEQ ID:246.

Another function of GAM7776 is therefore inhibition of KIAA1276 (Accession XP_039169.1). Accordingly, utilities of GAM7776 include diagnosis, prevention and treatment of diseases and clinical conditions associated with KIAA1276.

KIAA1287 (Accession NP_065799.1) is another GAM7776 target gene, herein designated TARGET GENE. KIAA1287 BINDING SITE is a target binding site found in the 3' untranslated region of mRNA encoded by KIAA1287, corresponding to a target binding site such as BINDING SITE I, BINDING SITE II or BINDING SITE III of FIG. 8. Table 4 illustrates the complementarity of the nucleotide sequences of KIAA1287 BINDING SITE, designated SEQ ID:9573, to the nucleotide sequence of GAM7776 RNA, herein designated GAM RNA, also designated SEQ ID:246.

Another function of GAM7776 is therefore inhibition of KIAA1287 (Accession NP_065799.1). Accordingly, utilities of GAM7776 include diagnosis, prevention and treatment of diseases and clinical conditions associated with KIAA1287.

KIAA1393 (Accession XP_050793.2) is another GAM7776 target gene, herein designated TARGET GENE. KIAA1393 BINDING SITE is a target binding site found in the 3' untranslated region of mRNA encoded by KIAA1393, corresponding to a target binding site such as BINDING SITE I, BINDING SITE II or BINDING SITE III of FIG. 8. Table 4 illustrates the complementarity of the nucleotide sequences of KIAA1393 BINDING SITE, designated SEQ ID:10123, to the nucleotide sequence of GAM7776 RNA, herein designated GAM RNA, also designated SEQ ID:246.

Another function of GAM7776 is therefore inhibition of KIAA1393 (Accession XP_050793.2). Accordingly, utilities of GAM7776 include diagnosis, prevention and treatment of diseases and clinical conditions associated with KIAA1393.

KIAA1443 (Accession NP_065885.1) is another GAM7776 target gene, herein designated TARGET GENE. KIAA1443 BINDING SITE is a target binding site found in the 3' untranslated region of mRNA encoded by KIAA1443, corresponding to a target binding site such as BINDING SITE I, BINDING SITE II or BINDING SITE III of FIG. 8. Table 4 illustrates the complementarity of the nucleotide sequences of KIAA1443 BINDING SITE, designated SEQ ID:15171, to the nucleotide sequence of GAM7776 RNA, herein designated GAM RNA, also designated SEQ ID:246.

Another function of GAM7776 is therefore inhibition of KIAA1443 (Accession NP_065885.1). Accordingly, utilities of GAM7776 include diagnosis, prevention and treatment of diseases and clinical conditions associated with KIAA1443.

KIAA1456 (Accession XP_040100.3) is another GAM7776 target gene, herein designated TARGET GENE. KIAA1456 BINDING SITE is a target binding site found in the 3' untranslated region of mRNA encoded by KIAA1456, corresponding to a target binding site such as BINDING SITE I, BINDING SITE II or BINDING SITE III of FIG. 8. Table 4 illustrates the complementarity of the nucleotide sequences of KIAA1456 BINDING SITE, designated SEQ ID:5529, to the nucleotide sequence of GAM7776 RNA, herein designated GAM RNA, also designated SEQ ID:246.

Another function of GAM7776 is therefore inhibition of KIAA1456 (Accession XP_040100.3). Accordingly, utilities of GAM7776 include diagnosis, prevention and treatment of diseases and clinical conditions associated with KIAA1456.

KIAA1463 (Accession XP_051160.2) is another GAM7776 target gene, herein designated TARGET GENE. KIAA1463 BINDING SITE is a target binding site found in the 3' untranslated region of mRNA encoded by KIAA1463, corresponding to a target binding site such as BINDING SITE I, BINDING SITE II or BINDING SITE III of FIG. 8. Table 4 illustrates the complementarity of the nucleotide sequences of KIAA1463 BINDING SITE, designated SEQ ID:1667, to the nucleotide sequence of GAM7776 RNA, herein designated GAM RNA, also designated SEQ ID:246.

Another function of GAM7776 is therefore inhibition of KIAA1463 (Accession XP_051160.2). Accordingly, utilities of GAM7776 include diagnosis, prevention and treatment of diseases and clinical conditions associated with KIAA1463.

KIAA1465 (Accession XP_027396.4) is another GAM7776 target gene, herein designated TARGET GENE. KIAA1465 BINDING SITE1 and KIAA1465 BINDING SITE2 are target binding sites found in untranslated regions of mRNA encoded by KIAA1465, corresponding to target binding sites such as BINDING SITE I, BINDING SITE II or BINDING SITE III of FIG. 8. Table 4 illustrates the complementarity of the nucleotide sequences of KIAA1465 BINDING SITE1 and KIAA1465 BINDING SITE2, designated SEQ ID:18838 and SEQ ID:18992 respectively, to the nucleotide sequence of GAM7776 RNA, herein designated GAM RNA, also designated SEQ ID:246.

Another function of GAM7776 is therefore inhibition of KIAA1465 (Accession XP_027396.4). Accordingly, utilities of GAM7776 include diagnosis, prevention and treatment of diseases and clinical conditions associated with KIAA1465.

KIAA1493 (Accession XP_034415.1) is another GAM7776 target gene, herein designated TARGET GENE. KIAA1493 BINDING SITE is a target binding site found in the 3' untranslated region of mRNA encoded by KIAA1493, corresponding to a target binding site such as BINDING SITE I, BINDING SITE II or BINDING SITE III of FIG. 8. Table 4 illustrates the complementarity of the nucleotide sequences of KIAA1493 BINDING SITE, designated SEQ ID:15045, to the nucleotide sequence of GAM7776 RNA, herein designated GAM RNA, also designated SEQ ID:246.

Another function of GAM7776 is therefore inhibition of KIAA1493 (Accession XP_034415.1). Accordingly, utilities of GAM7776 include diagnosis, prevention and treatment of diseases and clinical conditions associated with KIAA1493.

KIAA1508 (Accession XP_290952.1) is another GAM7776 target gene, herein designated TARGET GENE.

KIAA1508 BINDING SITE is a target binding site found in the 3' untranslated region of mRNA encoded by KIAA1508, corresponding to a target binding site such as BINDING SITE I, BINDING SITE II or BINDING SITE III of FIG. 8. Table 4 illustrates the complementarity of the nucleotide sequences of KIAA1508 BINDING SITE, designated SEQ ID:8820, to the nucleotide sequence of GAM7776 RNA, herein designated GAM RNA, also designated SEQ ID:246.

Another function of GAM7776 is therefore inhibition of KIAA1508 (Accession XP_290952.1). Accordingly, utilities of GAM7776 include diagnosis, prevention and treatment of diseases and clinical conditions associated with KIAA1508.

KIAA1518 (Accession XP_170889.1) is another GAM7776 target gene, herein designated TARGET GENE. KIAA1518 BINDING SITE is a target binding site found in the 3' untranslated region of multiple transcripts of mRNA encoded by KIAA1518, corresponding to a target binding site such as BINDING SITE I, BINDING SITE II or BINDING SITE III of FIG. 8. Table 4 illustrates the complementarity of the nucleotide sequences of KIAA1518 BINDING SITE, designated SEQ ID:13383, to the nucleotide sequence of GAM7776 RNA, herein designated GAM RNA, also designated SEQ ID:246.

Another function of GAM7776 is therefore inhibition of KIAA1518 (Accession XP_170889.1). Accordingly, utilities of GAM7776 include diagnosis, prevention and treatment of diseases and clinical conditions associated with KIAA1518.

KIAA1530 (Accession XP_042661.5) is another GAM7776 target gene, herein designated TARGET GENE. KIAA1530 BINDING SITE1 and KIAA1530 BINDING SITE2 are target binding sites found in untranslated regions of mRNA encoded by KIAA1530, corresponding to target binding sites such as BINDING SITE I, BINDING SITE II or BINDING SITE III of FIG. 8. Table 4 illustrates the complementarity of the nucleotide sequences of KIAA1530 BINDING SITE1 and KIAA1530 BINDING SITE2, designated SEQ ID:4028 and SEQ ID:15284 respectively, to the nucleotide sequence of GAM7776 RNA, herein designated GAM RNA, also designated SEQ ID:246.

Another function of GAM7776 is therefore inhibition of KIAA1530 (Accession XP_042661.5). Accordingly, utilities of GAM7776 include diagnosis, prevention and treatment of diseases and clinical conditions associated with KIAA1530.

KIAA1550 (Accession XP_039393.3) is another GAM7776 target gene, herein designated TARGET GENE. KIAA1550 BINDING SITE is a target binding site found in the 3' untranslated region of mRNA encoded by KIAA1550, corresponding to a target binding site such as BINDING SITE I, BINDING SITE II or BINDING SITE III of FIG. 8. Table 4 illustrates the complementarity of the nucleotide sequences of KIAA1550 BINDING SITE, designated SEQ ID:3790, to the nucleotide sequence of GAM7776 RNA, herein designated GAM RNA, also designated SEQ ID:246.

Another function of GAM7776 is therefore inhibition of KIAA1550 (Accession XP_039393.3). Accordingly, utilities of GAM7776 include diagnosis, prevention and treatment of diseases and clinical conditions associated with KIAA1550.

KIAA1559 (Accession XP_054472.2) is another GAM7776 target gene, herein designated TARGET GENE. KIAA1559 BINDING SITE is a target binding site found in the 3' untranslated region of mRNA encoded by KIAA1559, corresponding to a target binding site such as BINDING SITE I, BINDING SITE II or BINDING SITE III of FIG. 8. Table 4 illustrates the complementarity of the nucleotide sequences of KIAA1559 BINDING SITE, designated SEQ ID:4029, to the nucleotide sequence of GAM7776 RNA, herein designated GAM RNA, also designated SEQ ID:246.

Another function of GAM7776 is therefore inhibition of KIAA1559 (Accession XP_054472.2). Accordingly, utilities of GAM7776 include diagnosis, prevention and treatment of diseases and clinical conditions associated with KIAA1559.

KIAA1571 (Accession XP_027744.1) is another GAM7776 target gene, herein designated TARGET GENE. KIAA1571 BINDING SITE is a target binding site found in the 3' untranslated region of mRNA encoded by KIAA1571, corresponding to a target binding site such as BINDING SITE I, BINDING SITE II or BINDING SITE III of FIG. 8. Table 4 illustrates the complementarity of the nucleotide sequences of KIAA1571 BINDING SITE, designated SEQ ID:14154, to the nucleotide sequence of GAM7776 RNA, herein designated GAM RNA, also designated SEQ ID:246.

Another function of GAM7776 is therefore inhibition of KIAA1571 (Accession XP_027744.1). Accordingly, utilities of GAM7776 include diagnosis, prevention and treatment of diseases and clinical conditions associated with KIAA1571.

KIAA1615 (Accession NP_066002.1) is another GAM7776 target gene, herein designated TARGET GENE. KIAA1615 BINDING SITE1 and KIAA1615 BINDING SITE2 are target binding sites found in untranslated regions of mRNA encoded by KIAA1615, corresponding to target binding sites such as BINDING SITE I, BINDING SITE II or BINDING SITE III of FIG. 8. Table 4 illustrates the complementarity of the nucleotide sequences of KIAA1615 BINDING SITE1 and KIAA1615 BINDING SITE2, designated SEQ ID:10111 and SEQ ID:8549 respectively, to the nucleotide sequence of GAM7776 RNA, herein designated GAM RNA, also designated SEQ ID:246.

Another function of GAM7776 is therefore inhibition of KIAA1615 (Accession NP_066002.1). Accordingly, utilities of GAM7776 include diagnosis, prevention and treatment of diseases and clinical conditions associated with KIAA1615.

KIAA1671 (Accession XP_037809.1) is another GAM7776 target gene, herein designated TARGET GENE. KIAA1671 BINDING SITE1 and KIAA1671 BINDING SITE2 are target binding sites found in untranslated regions of mRNA encoded by KIAA1671, corresponding to target binding sites such as BINDING SITE I, BINDING SITE II or BINDING SITE III of FIG. 8. Table 4 illustrates the complementarity of the nucleotide sequences of KIAA1671 BINDING SITE1 and KIAA1671 BINDING SITE2, designated SEQ ID:17191 and SEQ ID:7194 respectively, to the nucleotide sequence of GAM7776 RNA, herein designated GAM RNA, also designated SEQ ID:246.

Another function of GAM7776 is therefore inhibition of KIAA1671 (Accession XP_037809.1). Accordingly, utilities of GAM7776 include diagnosis, prevention and treatment of diseases and clinical conditions associated with KIAA1671.

KIAA1712 (Accession XP_041497.2) is another GAM7776 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:14165 and SEQ ID:1142 respectively, to the nucleotide sequence of GAM7776 RNA, herein designated GAM RNA, also designated SEQ ID:246.

Another function of GAM7776 is therefore inhibition of KIAA1712 (Accession XP_041497.2). Accordingly, utilities of GAM7776 include diagnosis, prevention and treatment of diseases and clinical conditions associated with KIAA1712.

KIAA1712 (Accession XP_041497.2) is another GAM7776 target gene, herein designated TARGET GENE. KIAA1712 BINDING SITE1 and KIAA1712 BINDING SITE2 are target binding sites found in untranslated regions of multiple transcripts of mRNA encoded by KIAA1712, corresponding to target binding sites such as BINDING SITE I, BINDING SITE II or BINDING SITE III of FIG. 8. Table 4 illustrates the complementarity of the nucleotide sequences of KIAA1712 BINDING SITE1 and KIAA1712 BINDING SITE2, designated SEQ ID:1142 and SEQ ID:14165 respectively, to the nucleotide sequence of GAM7776 RNA, herein designated GAM RNA, also designated SEQ ID:246.

Another function of GAM7776 is therefore inhibition of KIAA1712 (Accession XP_041497.2). Accordingly, utilities of GAM7776 include diagnosis, prevention and treatment of diseases and clinical conditions associated with KIAA1712.

KIAA1724 (Accession XP_040280.2) is another GAM7776 target gene, herein designated TARGET GENE. KIAA1724 BINDING SITE is a target binding site found in the 5' untranslated region of mRNA encoded by KIAA1724, corresponding to a target binding site such as BINDING SITE I, BINDING SITE II or BINDING SITE III of FIG. 8. Table 4 illustrates the complementarity of the nucleotide sequences of KIAA1724 BINDING SITE, designated SEQ ID:14630, to the nucleotide sequence of GAM7776 RNA, herein designated GAM RNA, also designated SEQ ID:246.

Another function of GAM7776 is therefore inhibition of KIAA1724 (Accession XP_040280.2). Accordingly, utilities of GAM7776 include diagnosis, prevention and treatment of diseases and clinical conditions associated with KIAA1724.

KIAA1737 (Accession NP_219494.1) is another GAM7776 target gene, herein designated TARGET GENE. KIAA1737 BINDING SITE is a target binding site found in the 3' untranslated region of mRNA encoded by KIAA1737, corresponding to a target binding site such as BINDING SITE I, BINDING SITE II or BINDING SITE III of FIG. 8. Table 4 illustrates the complementarity of the nucleotide sequences of KIAA1737 BINDING SITE, designated SEQ ID:10602, to the nucleotide sequence of GAM7776 RNA, herein designated GAM RNA, also designated SEQ ID:246.

Another function of GAM7776 is therefore inhibition of KIAA1737 (Accession NP_219494.1). Accordingly, utilities of GAM7776 include diagnosis, prevention and treatment of diseases and clinical conditions associated with KIAA1737.

KIAA1775 (Accession NP_149091.1) is another GAM7776 target gene, herein designated TARGET GENE. KIAA1775 BINDING SITE is a target binding site found in the 3' untranslated region of mRNA encoded by KIAA1775, corresponding to a target binding site such as BINDING SITE I, BINDING SITE II or BINDING SITE III of FIG. 8. Table 4 illustrates the complementarity of the nucleotide sequences of KIAA1775 BINDING SITE, designated SEQ ID:1618, to the nucleotide sequence of GAM7776 RNA, herein designated GAM RNA, also designated SEQ ID:246.

Another function of GAM7776 is therefore inhibition of KIAA1775 (Accession NP_149091.1). Accordingly, utilities of GAM7776 include diagnosis, prevention and treatment of diseases and clinical conditions associated with KIAA1775.

KIAA1784 (Accession NP_115820.1) is another GAM7776 target gene, herein designated TARGET GENE. KIAA1784 BINDING SITE is a target binding site found in the 3' untranslated region of mRNA encoded by KIAA1784, corresponding to a target binding site such as BINDING SITE I, BINDING SITE II or BINDING SITE III of FIG. 8. Table 4 illustrates the complementarity of the nucleotide sequences of KIAA1784 BINDING SITE, designated SEQ ID:11058, to the nucleotide sequence of GAM7776 RNA, herein designated GAM RNA, also designated SEQ ID:246.

Another function of GAM7776 is therefore inhibition of KIAA1784 (Accession NP_115820.1). Accordingly, utilities of GAM7776 include diagnosis, prevention and treatment of diseases and clinical conditions associated with KIAA1784.

KIAA1822 (Accession XP_041566.2) is another GAM7776 target gene, herein designated TARGET GENE. KIAA1822 BINDING SITE is a target binding site found in the 3' untranslated region of mRNA encoded by KIAA1822, corresponding to a target binding site such as BINDING SITE I, BINDING SITE II or BINDING SITE III of FIG. 8. Table 4 illustrates the complementarity of the nucleotide sequences of KIAA1822 BINDING SITE, designated SEQ ID:10095, to the nucleotide sequence of GAM7776 RNA, herein designated GAM RNA, also designated SEQ ID:246.

Another function of GAM7776 is therefore inhibition of KIAA1822 (Accession XP_041566.2). Accordingly, utilities of GAM7776 include diagnosis, prevention and treatment of diseases and clinical conditions associated with KIAA1822.

KIAA1827 (Accession XP_290834.1) is another GAM7776 target gene, herein designated TARGET GENE. KIAA1827 BINDING SITE1 and KIAA1827 BINDING SITE2 are target binding sites found in untranslated regions of mRNA encoded by KIAA1827, corresponding to target binding sites such as BINDING SITE I, BINDING SITE II or BINDING SITE III of FIG. 8. Table 4 illustrates the complementarity of the nucleotide sequences of KIAA1827 BINDING SITE1 and KIAA1827 BINDING SITE2, designated SEQ ID:2143 and SEQ ID:12636 respectively, to the nucleotide sequence of GAM7776 RNA, herein designated GAM RNA, also designated SEQ ID:246.

Another function of GAM7776 is therefore inhibition of KIAA1827 (Accession XP_290834.1). Accordingly, utilities of GAM7776 include diagnosis, prevention and treatment of diseases and clinical conditions associated with KIAA1827.

KIAA1829 (Accession XP_030378.2) is another GAM7776 target gene, herein designated TARGET GENE. KIAA1829 BINDING SITE is a target binding site found in the 3' untranslated region of mRNA encoded by KIAA1829, corresponding to a target binding site such as BINDING SITE I, BINDING SITE II or BINDING SITE III of FIG. 8. Table 4 illustrates the complementarity of the nucleotide sequences of KIAA1829 BINDING SITE, designated SEQ ID:14863, to the nucleotide sequence of GAM7776 RNA, herein designated GAM RNA, also designated SEQ ID:246.

Another function of GAM7776 is therefore inhibition of KIAA1829 (Accession XP_030378.2). Accordingly, utilities of GAM7776 include diagnosis, prevention and treatment of diseases and clinical conditions associated with KIAA1829.

KIAA1836 (Accession XP_114087.2) is another GAM7776 target gene, herein designated TARGET GENE.

KIAA1836 BINDING SITE is a target binding site found in the 3' untranslated region of mRNA encoded by KIAA1836, corresponding to a target binding site such as BINDING SITE I, BINDING SITE II or BINDING SITE III of FIG. 8. Table 4 illustrates the complementarity of the nucleotide sequences of KIAA1836 BINDING SITE, designated SEQ ID:12627, to the nucleotide sequence of GAM7776 RNA, herein designated GAM RNA, also designated SEQ ID:246.

Another function of GAM7776 is therefore inhibition of KIAA1836 (Accession XP_114087.2). Accordingly, utilities of GAM7776 include diagnosis, prevention and treatment of diseases and clinical conditions associated with KIAA1836.

KIAA1853 (Accession XP_045184.1) is another GAM7776 target gene, herein designated TARGET GENE. KIAA1853 BINDING SITE is a target binding site found in the 3' untranslated region of mRNA encoded by KIAA1853, corresponding to a target binding site such as BINDING SITE I, BINDING SITE II or BINDING SITE III of FIG. 8. Table 4 illustrates the complementarity of the nucleotide sequences of KIAA1853 BINDING SITE, designated SEQ ID:19095, to the nucleotide sequence of GAM7776 RNA, herein designated GAM RNA, also designated SEQ ID:246.

Another function of GAM7776 is therefore inhibition of KIAA1853 (Accession XP_045184.1). Accordingly, utilities of GAM7776 include diagnosis, prevention and treatment of diseases and clinical conditions associated with KIAA1853.

KIAA1904 (Accession XP_056282.1) is another GAM7776 target gene, herein designated TARGET GENE. KIAA1904 BINDING SITE is a target binding site found in the 3' untranslated region of mRNA encoded by KIAA1904, corresponding to a target binding site such as BINDING SITE I, BINDING SITE II or BINDING SITE III of FIG. 8. Table 4 illustrates the complementarity of the nucleotide sequences of KIAA1904 BINDING SITE, designated SEQ ID:16492, to the nucleotide sequence of GAM7776 RNA, herein designated GAM RNA, also designated SEQ ID:246.

Another function of GAM7776 is therefore inhibition of KIAA1904 (Accession XP_056282.1). Accordingly, utilities of GAM7776 include diagnosis, prevention and treatment of diseases and clinical conditions associated with KIAA1904.

KIAA1922 (Accession XP_057040.1) is another GAM7776 target gene, herein designated TARGET GENE. KIAA1922 BINDING SITE is a target binding site found in the 5' untranslated region of mRNA encoded by KIAA1922, corresponding to a target binding site such as BINDING SITE I, BINDING SITE II or BINDING SITE III of FIG. 8. Table 4 illustrates the complementarity of the nucleotide sequences of KIAA1922 BINDING SITE, designated SEQ ID:7553, to the nucleotide sequence of GAM7776 RNA, herein designated GAM RNA, also designated SEQ ID:246.

Another function of GAM7776 is therefore inhibition of KIAA1922 (Accession XP_057040.1). Accordingly, utilities of GAM7776 include diagnosis, prevention and treatment of diseases and clinical conditions associated with KIAA1922.

KIAA1924 (Accession NP_694971.2) is another GAM7776 target gene, herein designated TARGET GENE. KIAA1924 BINDING SITE1 and KIAA1924 BINDING SITE2 are target binding sites found in untranslated regions of mRNA encoded by KIAA1924, corresponding to target binding sites such as BINDING SITE I, BINDING SITE II or BINDING SITE III of FIG. 8. Table 4 illustrates the complementarity of the nucleotide sequences of KIAA1924 BINDING SITE1 and KIAA1924 BINDING SITE2, designated SEQ ID:8341 and SEQ ID:1857 respectively, to the nucleotide sequence of GAM7776 RNA, herein designated GAM RNA, also designated SEQ ID:246.

Another function of GAM7776 is therefore inhibition of KIAA1924 (Accession NP_694971.2). Accordingly, utilities of GAM7776 include diagnosis, prevention and treatment of diseases and clinical conditions associated with KIAA1924.

KIAA1937 (Accession XP_057107.3) is another GAM7776 target gene, herein designated TARGET GENE. KIAA1937 BINDING SITE is a target binding site found in the 5' untranslated region of mRNA encoded by KIAA1937, corresponding to a target binding site such as BINDING SITE I, BINDING SITE II or BINDING SITE III of FIG. 8. Table 4 illustrates the complementarity of the nucleotide sequences of KIAA1937 BINDING SITE, designated SEQ ID:2983, to the nucleotide sequence of GAM7776 RNA, herein designated GAM RNA, also designated SEQ ID:246.

Another function of GAM7776 is therefore inhibition of KIAA1937 (Accession XP_057107.3). Accordingly, utilities of GAM7776 include diagnosis, prevention and treatment of diseases and clinical conditions associated with KIAA1937.

KIAA1971 (Accession XP_058720.4) is another GAM7776 target gene, herein designated TARGET GENE. KIAA1971 BINDING SITE1 and KIAA1971 BINDING SITE2 are target binding sites found in untranslated regions of mRNA encoded by KIAA1971, corresponding to target binding sites such as BINDING SITE I, BINDING SITE II or BINDING SITE III of FIG. 8. Table 4 illustrates the complementarity of the nucleotide sequences of KIAA1971 BINDING SITE1 and KIAA1971 BINDING SITE2, designated SEQ ID:6902 and SEQ ID:11506 respectively, to the nucleotide sequence of GAM7776 RNA, herein designated GAM RNA, also designated SEQ ID:246.

Another function of GAM7776 is therefore inhibition of KIAA1971 (Accession XP_058720.4). Accordingly, utilities of GAM7776 include diagnosis, prevention and treatment of diseases and clinical conditions associated with KIAA1971.

KIAA1987 (Accession XP_113870.1) is another GAM7776 target gene, herein designated TARGET GENE. KIAA1987 BINDING SITE is a target binding site found in the 5' untranslated region of mRNA encoded by KIAA1987, corresponding to a target binding site such as BINDING SITE I, BINDING SITE II or BINDING SITE III of FIG. 8. Table 4 illustrates the complementarity of the nucleotide sequences of KIAA1987 BINDING SITE, designated SEQ ID:7554, to the nucleotide sequence of GAM7776 RNA, herein designated GAM RNA, also designated SEQ ID:246.

Another function of GAM7776 is therefore inhibition of KIAA1987 (Accession XP_113870.1). Accordingly, utilities of GAM7776 include diagnosis, prevention and treatment of diseases and clinical conditions associated with KIAA1987.

KIAA2028 (Accession XP_059415.2) is another GAM7776 target gene, herein designated TARGET GENE. KIAA2028 BINDING SITE is a target binding site found in the 3' untranslated region of mRNA encoded by KIAA2028, corresponding to a target binding site such as BINDING SITE I, BINDING SITE II or BINDING SITE III of FIG. 8. Table 4 illustrates the complementarity of the nucleotide sequences of KIAA2028 BINDING SITE, designated SEQ ID:12100, to the nucleotide sequence of GAM7776 RNA, herein designated GAM RNA, also designated SEQ ID:246.

Another function of GAM7776 is therefore inhibition of KIAA2028 (Accession XP_059415.2). Accordingly, utilities of GAM7776 include diagnosis, prevention and treatment of diseases and clinical conditions associated with KIAA2028.

Kruppel-like factor 12 (KLF12, Accession NP_009180.3) is another GAM7776 target gene, herein designated TARGET GENE. KLF12 BINDING SITE is a target binding site found in the 3' untranslated region of multiple transcripts of mRNA encoded by KLF12, corresponding to a target binding site such as BINDING SITE I, BINDING SITE II or BINDING SITE III of FIG. 8. Table 4 illustrates the complementarity of the nucleotide sequences of KLF12 BINDING SITE, designated SEQ ID:1127, to the nucleotide sequence of GAM7776 RNA, herein designated GAM RNA, also designated SEQ ID:246.

Another function of GAM7776 is therefore inhibition of Kruppel-like factor 12 (KLF12, Accession NP_009180.3). Accordingly, utilities of GAM7776 include diagnosis, prevention and treatment of diseases and clinical conditions associated with KLF12.

Killer cell lectin-like receptor subfamily d, member 1 (KLRD1, Accession NP_031360.1) is another GAM7776 target gene, herein designated TARGET GENE. KLRD1 BINDING SITE is a target binding site found in the 3' untranslated region of multiple transcripts of mRNA encoded by KLRD1, corresponding to a target binding site such as BINDING SITE I, BINDING SITE II or BINDING SITE III of FIG. 8. Table 4 illustrates the complementarity of the nucleotide sequences of KLRD1 BINDING SITE, designated SEQ ID:2353, to the nucleotide sequence of GAM7776 RNA, herein designated GAM RNA, also designated SEQ ID:246.

Another function of GAM7776 is therefore inhibition of Killer cell lectin-like receptor subfamily d, member 1 (KLRD1, Accession NP_031360.1), a gene which is a receptor for the recognition of mhc class i hla- e molecules by nk cells and some cytotoxic t-cells. Accordingly, utilities of GAM7776 include diagnosis, prevention and treatment of diseases and clinical conditions associated with KLRD1.

The function of KLRD1 and its association with various diseases and clinical conditions, has been established by previous studies, as described hereinabove with reference to GAM189.1. Killer cell lectin-like receptor subfamily d, member 1 (KLRD1, Accession NP_002253.1) is another GAM7776 target gene, herein designated TARGET GENE. KLRD1 BINDING SITE is a target binding site found in the 3' untranslated region of multiple transcripts of mRNA encoded by KLRD1, corresponding to a target binding site such as BINDING SITE I, BINDING SITE II or BINDING SITE III of FIG. 8. Table 4 illustrates the complementarity of the nucleotide sequences of KLRD1 BINDING SITE, designated SEQ ID:2353, to the nucleotide sequence of GAM7776 RNA, herein designated GAM RNA, also designated SEQ ID:246.

Another function of GAM7776 is therefore inhibition of Killer cell lectin-like receptor subfamily d, member 1 (KLRD1, Accession NP_002253.1), a gene which is a receptor for the recognition of mhc class i hla- e molecules by nk cells and some cytotoxic t-cells. Accordingly, utilities of GAM7776 include diagnosis, prevention and treatment of diseases and clinical conditions associated with KLRD1.

The function of KLRD1 and its association with various diseases and clinical conditions, has been established by previous studies, as described hereinabove with reference to GAM189.1. Kynurenine 3-monooxygenase (kynurenine 3-hydroxylase) (KMO, Accession NP_003670.1) is another GAM7776 target gene, herein designated TARGET GENE. KMO BINDING SITE is a target binding site found in the 3' untranslated region of mRNA encoded by KMO, corresponding to a target binding site such as BINDING SITE I, BINDING SITE II or BINDING SITE III of FIG. 8. Table 4 illustrates the complementarity of the nucleotide sequences of KMO BINDING SITE, designated SEQ ID:6338, to the nucleotide sequence of GAM7776 RNA, herein designated GAM RNA, also designated SEQ ID:246.

Another function of GAM7776 is therefore inhibition of Kynurenine 3-monooxygenase (kynurenine 3-hydroxylase) (KMO, Accession NP_003670.1), a gene which may play a role in encephalic photoreception. Accordingly, utilities of GAM7776 include diagnosis, prevention and treatment of diseases and clinical conditions associated with KMO.

The function of KMO and its association with various diseases and clinical conditions, has been established by previous studies, as described hereinabove with reference to GAM30.1. Lysosomal-associated membrane protein 3 (LAMP3, Accession NP_055213.1) is another GAM7776 target gene, herein designated TARGET GENE. LAMP3 BINDING SITE is a target binding site found in the 3' untranslated region of mRNA encoded by LAMP3, corresponding to a target binding site such as BINDING SITE I, BINDING SITE II or BINDING SITE III of FIG. 8. Table 4 illustrates the complementarity of the nucleotide sequences of LAMP3 BINDING SITE, designated SEQ ID:17760, to the nucleotide sequence of GAM7776 RNA, herein designated GAM RNA, also designated SEQ ID:246.

Another function of GAM7776 is therefore inhibition of Lysosomal-associated membrane protein 3 (LAMP3, Accession NP_055213.1). Accordingly, utilities of GAM7776 include diagnosis, prevention and treatment of diseases and clinical conditions associated with LAMP3.

Leucyl-trna synthetase (LARS, Accession NP_064502.8) is another GAM7776 target gene, herein designated TARGET GENE. LARS BINDING SITE is a target binding site found in the 5' untranslated region of mRNA encoded by LARS, corresponding to a target binding site such as BINDING SITE I, BINDING SITE II or BINDING SITE III of FIG. 8. Table 4 illustrates the complementarity of the nucleotide sequences of LARS BINDING SITE, designated SEQ ID:2620, to the nucleotide sequence of GAM7776 RNA, herein designated GAM RNA, also designated SEQ ID:246.

Another function of GAM7776 is therefore inhibition of Leucyl-trna synthetase (LARS, Accession NP_064502.8). Accordingly, utilities of GAM7776 include diagnosis, prevention and treatment of diseases and clinical conditions associated with LARS.

Lim and sh3 protein 1 (LASP1, Accession NP_006139.1) is another GAM7776 target gene, herein designated TARGET GENE. LASP1 BINDING SITE is a target binding site found in the 3' untranslated region of mRNA encoded by LASP1, corresponding to a target binding site such as BINDING SITE I, BINDING SITE II or BINDING SITE III of FIG. 8. Table 4 illustrates the complementarity of the nucleotide sequences of LASP1 BINDING SITE, designated SEQ ID:17709, to the nucleotide sequence of GAM7776 RNA, herein designated GAM RNA, also designated SEQ ID:246.

Another function of GAM7776 is therefore inhibition of Lim and sh3 protein 1 (LASP1, Accession NP_006139.1). Accordingly, utilities of GAM7776 include diagnosis, prevention and treatment of diseases and clinical conditions associated with LASP1.

Lipocalin 7 (LCN7, Accession NP_071447.1) is another GAM7776 target gene, herein designated TARGET GENE. LCN7 BINDING SITE is a target binding site found in the 3' untranslated region of mRNA encoded by LCN7, corresponding to a target binding site such as BINDING SITE I, BINDING SITE II or BINDING SITE III of FIG. 8. Table 4 illustrates the complementarity of the nucleotide sequences of LCN7 BINDING SITE, designated SEQ ID:15937, to the nucleotide sequence of GAM7776 RNA, herein designated GAM RNA, also designated SEQ ID:246.

Another function of GAM7776 is therefore inhibition of Lipocalin 7 (LCN7, Accession NP_071447.1). Accordingly, utilities of GAM7776 include diagnosis, prevention and treatment of diseases and clinical conditions associated with LCN7.

Leucine zipper-ef-hand containing transmembrane protein 1 (LETM1, Accession NP_036450.1) is another GAM7776 target gene, herein designated TARGET GENE. LETM1 BINDING SITE is a target binding site found in the 3' untranslated region of mRNA encoded by LETM1, corresponding to a target binding site such as BINDING SITE I, BINDING SITE II or BINDING SITE III of FIG. 8. Table 4 illustrates the complementarity of the nucleotide sequences of LETM1 BINDING SITE, designated SEQ ID:18695, to the nucleotide sequence of GAM7776 RNA, herein designated GAM RNA, also designated SEQ ID:246.

Another function of GAM7776 is therefore inhibition of Leucine zipper-ef-hand containing transmembrane protein 1 (LETM1, Accession NP_036450.1). Accordingly, utilities of GAM7776 include diagnosis, prevention and treatment of diseases and clinical conditions associated with LETM1.

LGP2 (Accession NP_077024.1) is another GAM7776 target gene, herein designated TARGET GENE. LGP2 BINDING SITE is a target binding site found in the 5' untranslated region of mRNA encoded by LGP2, corresponding to a target binding site such as BINDING SITE I, BINDING SITE II or BINDING SITE III of FIG. 8. Table 4 illustrates the complementarity of the nucleotide sequences of LGP2 BINDING SITE, designated SEQ ID:8032, to the nucleotide sequence of GAM7776 RNA, herein designated GAM RNA, also designated SEQ ID:246.

Another function of GAM7776 is therefore inhibition of LGP2 (Accession NP_077024.1). Accordingly, utilities of GAM7776 include diagnosis, prevention and treatment of diseases and clinical conditions associated with LGP2.

Lim homeobox protein 2 (LHX2, Accession NP_004780.3) is another GAM7776 target gene, herein designated TARGET GENE. LHX2 BINDING SITE is a target binding site found in the 5' untranslated region of mRNA encoded by LHX2, corresponding to a target binding site such as BINDING SITE I, BINDING SITE II or BINDING SITE III of FIG. 8. Table 4 illustrates the complementarity of the nucleotide sequences of LHX2 BINDING SITE, designated SEQ ID:4178, to the nucleotide sequence of GAM7776 RNA, herein designated GAM RNA, also designated SEQ ID:246.

Another function of GAM7776 is therefore inhibition of Lim homeobox protein 2 (LHX2, Accession NP_004780.3). Accordingly, utilities of GAM7776 include diagnosis, prevention and treatment of diseases and clinical conditions associated with LHX2.

LIN-28 (Accession NP_078950.1) is another GAM7776 target gene, herein designated TARGET GENE. LIN-28 BINDING SITE is a target binding site found in the 3' untranslated region of mRNA encoded by LIN-28, corresponding to a target binding site such as BINDING SITE I, BINDING SITE II or BINDING SITE III of FIG. 8. Table 4 illustrates the complementarity of the nucleotide sequences of LIN-28 BINDING SITE, designated SEQ ID:4726, to the nucleotide sequence of GAM7776 RNA, herein designated GAM RNA, also designated SEQ ID:246.

Another function of GAM7776 is therefore inhibition of LIN-28 (Accession NP_078950.1). Accordingly, utilities of GAM7776 include diagnosis, prevention and treatment of diseases and clinical conditions associated with LIN-28.

Link-GEFII (Accession NP_057423.1) is another GAM7776 target gene, herein designated TARGET GENE. Link-GEFII BINDING SITE is a target binding site found in the 3' untranslated region of mRNA encoded by Link-GEFII, corresponding to a target binding site such as BINDING SITE I, BINDING SITE II or BINDING SITE III of FIG. 8. Table 4 illustrates the complementarity of the nucleotide sequences of Link-GEFII BINDING SITE, designated SEQ ID:19936, to the nucleotide sequence of GAM7776 RNA, herein designated GAM RNA, also designated SEQ ID:246.

Another function of GAM7776 is therefore inhibition of Link-GEFII (Accession NP_057423.1). Accordingly, utilities of GAM7776 include diagnosis, prevention and treatment of diseases and clinical conditions associated with Link-GEFII.

Lipase, member h (LIPH, Accession NP_640341.1) is another GAM7776 target gene, herein designated TARGET GENE. LIPH BINDING SITE is a target binding site found in the 3' untranslated region of mRNA encoded by LIPH, corresponding to a target binding site such as BINDING SITE I, BINDING SITE II or BINDING SITE III of FIG. 8. Table 4 illustrates the complementarity of the nucleotide sequences of LIPH BINDING SITE, designated SEQ ID:10379, to the nucleotide sequence of GAM7776 RNA, herein designated GAM RNA, also designated SEQ ID:246.

Another function of GAM7776 is therefore inhibition of Lipase, member h (LIPH, Accession NP_640341.1). Accordingly, utilities of GAM7776 include diagnosis, prevention and treatment of diseases and clinical conditions associated with LIPH.

Lethal giant larvae homolog 2 (drosophila) (LLGL2, Accession NP_004515.1) is another GAM7776 target gene, herein designated TARGET GENE. LLGL2 BINDING SITE is a target binding site found in the 3' untranslated region of mRNA encoded by LLGL2, corresponding to a target binding site such as BINDING SITE I, BINDING SITE II or BINDING SITE III of FIG. 8. Table 4 illustrates the complementarity of the nucleotide sequences of LLGL2 BINDING SITE, designated SEQ ID:15172, to the nucleotide sequence of GAM7776 RNA, herein designated GAM RNA, also designated SEQ ID:246.

Another function of GAM7776 is therefore inhibition of Lethal giant larvae homolog 2 (drosophila) (LLGL2, Accession NP_004515.1) . Accordingly, utilities of GAM7776 include diagnosis, prevention and treatment of diseases and clinical conditions associated with LLGL2.

LNK (Accession NP_005466.1) is another GAM7776 target gene, herein designated TARGET GENE. LNK BINDING SITE1 and LNK BINDING SITE2 are target binding sites found in untranslated regions of mRNA encoded by LNK, corresponding to target binding sites such as BINDING SITE I, BINDING SITE II or BINDING SITE III of FIG. 8. Table 4 illustrates the complementarity of the nucleotide sequences of LNK BINDING SITE1 and LNK BINDING SITE2, designated SEQ ID:13992 and SEQ ID:1866 respectively, to the nucleotide sequence of GAM7776 RNA, herein designated GAM RNA, also designated SEQ ID:246.

Another function of GAM7776 is therefore inhibition of LNK (Accession NP_005466.1), a gene which links T-cell receptor activation signal to phospholipase c-gamma-1, grb-2 and phosphatidylinositol 3-kinase (by similarity). Accordingly, utilities of GAM7776 include diagnosis, prevention and treatment of diseases and clinical conditions associated with LNK.

The function of LNK and its association with various diseases and clinical conditions, has been established by previous studies, as described hereinabove with reference to GAM130.1. LOC112687 (Accession XP_053145.1) is another GAM7776 target gene, herein designated TARGET GENE. LOC112687 BINDING SITE1 through LOC112687 BINDING SITE3 are target binding sites found in untranslated regions of mRNA encoded by LOC112687, corresponding to target binding sites such as BINDING SITE I, BINDING SITE II or BINDING SITE III of FIG. 8. Table 4 illustrates the complementarity of the nucleotide sequences of LOC112687 BINDING SITE1 through LOC112687 BINDING SITE3, designated SEQ ID:7988, SEQ ID:16673 and SEQ ID:793 respectively, to the nucleotide sequence of GAM7776 RNA, herein designated GAM RNA, also designated SEQ ID:246.

Another function of GAM7776 is therefore inhibition of LOC112687 (Accession XP_053145.1). Accordingly, utilities of GAM7776 include diagnosis, prevention and treatment of diseases and clinical conditions associated with LOC112687.

LOC112817 (Accession NP_612422.2) is another GAM7776 target gene, herein designated TARGET GENE. LOC112817 BINDING SITE is a target binding site found in the 3' untranslated region of mRNA encoded by LOC112817, corresponding to a target binding site such as BINDING SITE I, BINDING SITE II or BINDING SITE III of FIG. 8. Table 4 illustrates the complementarity of the nucleotide sequences of LOC112817 BINDING SITE, designated SEQ ID:16256, to the nucleotide sequence of GAM7776 RNA, herein designated GAM RNA, also designated SEQ ID:246.

Another function of GAM7776 is therefore inhibition of LOC112817 (Accession NP_612422.2). Accordingly, utilities of GAM7776 include diagnosis, prevention and treatment of diseases and clinical conditions associated with LOC112817.

LOC113444 (Accession NP_612437.2) is another GAM7776 target gene, herein designated TARGET GENE. LOC113444 BINDING SITE1 through LOC113444 BINDING SITE3 are target binding sites found in untranslated regions of mRNA encoded by LOC113444, corresponding to target binding sites such as BINDING SITE I, BINDING SITE II or BINDING SITE III of FIG. 8. Table 4 illustrates the complementarity of the nucleotide sequences of LOC113444 BINDING SITE1 through LOC113444 BINDING SITE3, designated SEQ ID:5336, SEQ ID:15899 and SEQ ID:18294 respectively, to the nucleotide sequence of GAM7776 RNA, herein designated GAM RNA, also designated SEQ ID:246.

Another function of GAM7776 is therefore inhibition of LOC113444 (Accession NP_612437.2). Accordingly, utilities of GAM7776 include diagnosis, prevention and treatment of diseases and clinical conditions associated with LOC113444.

LOC113828 (Accession NP_612444.1) is another GAM7776 target gene, herein designated TARGET GENE. LOC113828 BINDING SITE is a target binding site found in the 5' untranslated region of mRNA encoded by LOC113828, corresponding to a target binding site such as BINDING SITE I, BINDING SITE II or BINDING SITE III of FIG. 8. Table 4 illustrates the complementarity of the nucleotide sequences of LOC113828 BINDING SITE, designated SEQ ID:5632, to the nucleotide sequence of GAM7776 RNA, herein designated GAM RNA, also designated SEQ ID:246.

Another function of GAM7776 is therefore inhibition of LOC113828 (Accession NP_612444.1). Accordingly, utilities of GAM7776 include diagnosis, prevention and treatment of diseases and clinical conditions associated with LOC113828.

LOC115123 (Accession XP_055276.1) is another GAM7776 target gene, herein designated TARGET GENE. LOC115123 BINDING SITE is a target binding site found in the 5' untranslated region of mRNA encoded by LOC115123, corresponding to a target binding site such as BINDING SITE I, BINDING SITE II or BINDING SITE III of FIG. 8. Table 4 illustrates the complementarity of the nucleotide sequences of LOC115123 BINDING SITE, designated SEQ ID:15271, to the nucleotide sequence of GAM7776 RNA, herein designated GAM RNA, also designated SEQ ID:246.

Another function of GAM7776 is therefore inhibition of LOC115123 (Accession XP_055276.1). Accordingly, utilities of GAM7776 include diagnosis, prevention and treatment of diseases and clinical conditions associated with LOC115123.

LOC115219 (Accession XP_055499.2) is another GAM7776 target gene, herein designated TARGET GENE. LOC115219 BINDING SITE is a target binding site found in the 5' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:12422, to the nucleotide sequence of GAM7776 RNA, herein designated GAM RNA, also designated SEQ ID:246.

Another function of GAM7776 is therefore inhibition of LOC115219 (Accession XP_055499.2). Accordingly, utilities of GAM7776 include diagnosis, prevention and treatment of diseases and clinical conditions associated with LOC115219.

LOC115648 (Accession NP_663299.1) is another GAM7776 target gene, herein designated TARGET GENE. LOC115648 BINDING SITE is a target binding site found in the 3' untranslated region of mRNA encoded by LOC115648, corresponding to a target binding site such as BINDING SITE I, BINDING SITE II or BINDING SITE III of FIG. 8. Table 4 illustrates the complementarity of the nucleotide sequences of LOC115648 BINDING SITE, designated SEQ ID:7429, to the nucleotide sequence of GAM7776 RNA, herein designated GAM RNA, also designated SEQ ID:246.

Another function of GAM7776 is therefore inhibition of LOC115648 (Accession NP_663299.1). Accordingly, utilities of GAM7776 include diagnosis, prevention and treatment of diseases and clinical conditions associated with LOC115648.

LOC116411 (Accession XP_058095.1) is another GAM7776 target gene, herein designated TARGET GENE. LOC116411 BINDING SITE is a target binding site found in the 5' untranslated region of mRNA encoded by LOC116411, corresponding to a target binding site such as BINDING SITE I, BINDING SITE II or BINDING SITE III of FIG. 8. Table 4 illustrates the complementarity of the nucleotide sequences of LOC116411 BINDING SITE, designated SEQ ID:14720, to the nucleotide sequence of GAM7776 RNA, herein designated GAM RNA, also designated SEQ ID:246.

Another function of GAM7776 is therefore inhibition of LOC116411 (Accession XP_058095.1). Accordingly, utilities of GAM7776 include diagnosis, prevention and treatment of diseases and clinical conditions associated with LOC116411.

LOC118490 (Accession XP_060981.3) is another GAM7776 target gene, herein designated TARGET GENE. LOC118490 BINDING SITE is a target binding site found in the 3' untranslated region of mRNA encoded by LOC118490, corresponding to a target binding site such as BINDING SITE I, BINDING SITE II or BINDING SITE III of FIG. 8. Table 4 illustrates the complementarity of the nucleotide sequences of LOC118490 BINDING SITE, designated SEQ ID:456, to the nucleotide sequence of GAM7776 RNA, herein designated GAM RNA, also designated SEQ ID:246.

Another function of GAM7776 is therefore inhibition of LOC118490 (Accession XP_060981.3). Accordingly, utilities of GAM7776 include diagnosis, prevention and treatment of diseases and clinical conditions associated with LOC118490.

LOC118812 (Accession XP_058346.2) is another GAM7776 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:2649, to the nucleotide sequence of GAM7776 RNA, herein designated GAM RNA, also designated SEQ ID:246.

Another function of GAM7776 is therefore inhibition of LOC118812 (Accession XP_058346.2). Accordingly, utilities of GAM7776 include diagnosis, prevention and treatment of diseases and clinical conditions associated with LOC118812.

LOC118812 (Accession NP_849154.1) is another GAM7776 target gene, herein designated TARGET GENE. LOC118812 BINDING SITE is a target binding site found in the 3' untranslated region of multiple transcripts of mRNA encoded by LOC118812, corresponding to a target binding site such as BINDING SITE I, BINDING SITE II or BINDING SITE III of FIG. 8. Table 4 illustrates the complementarity of the nucleotide sequences of LOC118812 BINDING SITE, designated SEQ ID:2649, to the nucleotide sequence of GAM7776 RNA, herein designated GAM RNA, also designated SEQ ID:246.

Another function of GAM7776 is therefore inhibition of LOC118812 (Accession NP_849154.1). Accordingly, utilities of GAM7776 include diagnosis, prevention and treatment of diseases and clinical conditions associated with LOC118812.

LOC119395 (Accession XP_061446.3) is another GAM7776 target gene, herein designated TARGET GENE. LOC119395 BINDING SITE is a target binding site found in the 5' untranslated region of mRNA encoded by LOC119395, corresponding to a target binding site such as BINDING SITE I, BINDING SITE II or BINDING SITE III of FIG. 8. Table 4 illustrates the complementarity of the nucleotide sequences of LOC119395 BINDING SITE, designated SEQ ID:745, to the nucleotide sequence of GAM7776 RNA, herein designated GAM RNA, also designated SEQ ID:246.

Another function of GAM7776 is therefore inhibition of LOC119395 (Accession XP_061446.3). Accordingly, utilities of GAM7776 include diagnosis, prevention and treatment of diseases and clinical conditions associated with LOC119395.

LOC120526 (Accession XP_058475.1) is another GAM7776 target gene, herein designated TARGET GENE. LOC120526 BINDING SITE is a target binding site found in the 3' untranslated region of mRNA encoded by LOC120526, corresponding to a target binding site such as BINDING SITE I, BINDING SITE II or BINDING SITE III of FIG. 8. Table 4 illustrates the complementarity of the nucleotide sequences of LOC120526 BINDING SITE, designated SEQ ID:17112, to the nucleotide sequence of GAM7776 RNA, herein designated GAM RNA, also designated SEQ ID:246.

Another function of GAM7776 is therefore inhibition of LOC120526 (Accession XP_058475.1). Accordingly, utilities of GAM7776 include diagnosis, prevention and treatment of diseases and clinical conditions associated with LOC120526.

LOC121952 (Accession XP_062872.2) is another GAM7776 target gene, herein designated TARGET GENE. LOC121952 BINDING SITE is a target binding site found in the 5' untranslated region of mRNA encoded by LOC121952, corresponding to a target binding site such as BINDING SITE I, BINDING SITE II or BINDING SITE III of FIG. 8. Table 4 illustrates the complementarity of the nucleotide sequences of LOC121952 BINDING SITE, designated SEQ ID:9891, to the nucleotide sequence of GAM7776 RNA, herein designated GAM RNA, also designated SEQ ID:246.

Another function of GAM7776 is therefore inhibition of LOC121952 (Accession XP_062872.2). Accordingly, utilities of GAM7776 include diagnosis, prevention and treatment of diseases and clinical conditions associated with LOC121952.

LOC124221 (Accession XP_058785.3) is another GAM7776 target gene, herein designated TARGET GENE. LOC124221 BINDING SITE is a target binding site found in the 5' untranslated region of mRNA encoded by LOC124221, corresponding to a target binding site such as BINDING SITE I, BINDING SITE II or BINDING SITE III of FIG. 8. Table 4 illustrates the complementarity of the nucleotide sequences of LOC124221 BINDING SITE, designated SEQ ID:14576, to the nucleotide sequence of GAM7776 RNA, herein designated GAM RNA, also designated SEQ ID:246.

Another function of GAM7776 is therefore inhibition of LOC124221 (Accession XP_058785.3). Accordingly, utilities of GAM7776 include diagnosis, prevention and treatment of diseases and clinical conditions associated with LOC124221.

LOC125061 (Accession XP_058889.3) is another GAM7776 target gene, herein designated TARGET GENE. LOC125061 BINDING SITE is a target binding site found in the 3' untranslated region of mRNA encoded by LOC125061, corresponding to a target binding site such as BINDING SITE I, BINDING SITE II or BINDING SITE III of FIG. 8. Table 4 illustrates the complementarity of the nucleotide sequences of LOC125061 BINDING SITE, designated SEQ ID:1744, to the nucleotide sequence of GAM7776 RNA, herein designated GAM RNA, also designated SEQ ID:246.

Another function of GAM7776 is therefore inhibition of LOC125061 (Accession XP_058889.3). Accordingly, utilities of GAM7776 include diagnosis, prevention and treatment of diseases and clinical conditions associated with LOC125061.

LOC126669 (Accession XP_060121.4) is another GAM7776 target gene, herein designated TARGET GENE. LOC126669 BINDING SITE is a target binding site found in the 3' untranslated region of mRNA encoded by LOC126669, corresponding to a target binding site such as BINDING SITE I, BINDING SITE II or BINDING SITE III of FIG. 8. Table 4 illustrates the complementarity of the nucleotide sequences of LOC126669 BINDING SITE, designated SEQ ID:3477, to the nucleotide sequence of GAM7776 RNA, herein designated GAM RNA, also designated SEQ ID:246.

Another function of GAM7776 is therefore inhibition of LOC126669 (Accession XP_060121.4). Accordingly, utilities of GAM7776 include diagnosis, prevention and treatment of diseases and clinical conditions associated with LOC126669.

LOC127253 (Accession XP_059122.1) is another GAM7776 target gene, herein designated TARGET GENE. LOC127253 BINDING SITE is a target binding site found in the 3' untranslated region of mRNA encoded by LOC127253, corresponding to a target binding site such as BINDING SITE I, BINDING SITE II or BINDING SITE III of FIG. 8. Table 4 illustrates the complementarity of the nucleotide sequences of LOC127253 BINDING SITE, designated SEQ ID:18918, to the nucleotide sequence of GAM7776 RNA, herein designated GAM RNA, also designated SEQ ID:246.

Another function of GAM7776 is therefore inhibition of LOC127253 (Accession XP_059122.1). Accordingly, utilities of GAM7776 include diagnosis, prevention and treatment of diseases and clinical conditions associated with LOC127253.

LOC127841 (Accession XP_059184.1) is another GAM7776 target gene, herein designated TARGET GENE. LOC127841 BINDING SITE is a target binding site found in the 5' untranslated region of mRNA encoded by LOC127841, corresponding to a target binding site such as BINDING SITE I, BINDING SITE II or BINDING SITE III of FIG. 8. Table 4 illustrates the complementarity of the nucleotide sequences of LOC127841 BINDING SITE, designated SEQ ID:18516, to the nucleotide sequence of GAM7776 RNA, herein designated GAM RNA, also designated SEQ ID:246.

Another function of GAM7776 is therefore inhibition of LOC127841 (Accession XP_059184.1). Accordingly, utilities of GAM7776 include diagnosis, prevention and treatment of diseases and clinical conditions associated with LOC127841.

LOC128387 (Accession XP_059243.2) is another GAM7776 target gene, herein designated TARGET GENE. LOC128387 BINDING SITE is a target binding site found in the 3' untranslated region of mRNA encoded by LOC128387, corresponding to a target binding site such as BINDING SITE I, BINDING SITE II or BINDING SITE III of FIG. 8. Table 4 illustrates the complementarity of the nucleotide sequences of LOC128387 BINDING SITE, designated SEQ ID:15173, to the nucleotide sequence of GAM7776 RNA, herein designated GAM RNA, also designated SEQ ID:246.

Another function of GAM7776 is therefore inhibition of LOC128387 (Accession XP_059243.2). Accordingly, utilities of GAM7776 include diagnosis, prevention and treatment of diseases and clinical conditions associated with LOC128387.

LOC132241 (Accession XP_059583.1) is another GAM7776 target gene, herein designated TARGET GENE. LOC132241 BINDING SITE is a target binding site found in the 5' untranslated region of mRNA encoded by LOC132241, corresponding to a target binding site such as BINDING SITE I, BINDING SITE II or BINDING SITE III of FIG. 8. Table 4 illustrates the complementarity of the nucleotide sequences of LOC132241 BINDING SITE, designated SEQ ID:509, to the nucleotide sequence of GAM7776 RNA, herein designated GAM RNA, also designated SEQ ID:246.

Another function of GAM7776 is therefore inhibition of LOC132241 (Accession XP_059583.1). Accordingly, utilities of GAM7776 include diagnosis, prevention and treatment of diseases and clinical conditions associated with LOC132241.

LOC135293 (Accession XP_072402.4) is another GAM7776 target gene, herein designated TARGET GENE. LOC135293 BINDING SITE1 and LOC135293 BINDING SITE2 are target binding sites found in untranslated regions of mRNA encoded by LOC135293, corresponding to target binding sites such as BINDING SITE I, BINDING SITE II or BINDING SITE III of FIG. 8. Table 4 illustrates the complementarity of the nucleotide sequences of LOC135293 BINDING SITE1 and LOC135293 BINDING SITE2, designated SEQ ID:3512 and SEQ ID:10443 respectively, to the nucleotide sequence of GAM7776 RNA, herein designated GAM RNA, also designated SEQ ID:246.

Another function of GAM7776 is therefore inhibition of LOC135293 (Accession XP_072402.4). Accordingly, utilities of GAM7776 include diagnosis, prevention and treatment of diseases and clinical conditions associated with LOC135293.

LOC135763 (Accession NP_612639.1) is another GAM7776 target gene, herein designated TARGET GENE. LOC135763 BINDING SITE is a target binding site found in the 3' untranslated region of mRNA encoded by LOC135763, corresponding to a target binding site such as BINDING SITE I, BINDING SITE II or BINDING SITE III of FIG. 8. Table 4 illustrates the complementarity of the nucleotide sequences of LOC135763 BINDING SITE, designated SEQ ID:17207, to the nucleotide sequence of GAM7776 RNA, herein designated GAM RNA, also designated SEQ ID:246.

Another function of GAM7776 is therefore inhibition of LOC135763 (Accession NP_612639.1). Accordingly, utilities of GAM7776 include diagnosis, prevention and treatment of diseases and clinical conditions associated with LOC135763.

LOC135818 (Accession XP_059804.4) is another GAM7776 target gene, herein designated TARGET GENE. LOC135818 BINDING SITE is a target binding site found in the 3' untranslated region of mRNA encoded by LOC135818, corresponding to a target binding site such as BINDING SITE I, BINDING SITE II or BINDING SITE III of FIG. 8. Table 4 illustrates the complementarity of the nucleotide sequences of LOC135818 BINDING SITE, designated SEQ ID:19136, to the nucleotide sequence of GAM7776 RNA, herein designated GAM RNA, also designated SEQ ID:246.

Another function of GAM7776 is therefore inhibition of LOC135818 (Accession XP_059804.4). Accordingly, utilities of GAM7776 include diagnosis, prevention and treatment of diseases and clinical conditions associated with LOC135818.

LOC137886 (Accession XP_059929.3) is another GAM7776 target gene, herein designated TARGET GENE. LOC137886 BINDING SITE is a target binding site found in the 3' untranslated region of mRNA encoded by LOC137886, corresponding to a target binding site such as BINDING SITE I, BINDING SITE II or BINDING SITE III of FIG. 8. Table 4 illustrates the complementarity of the nucleotide sequences of LOC137886 BINDING SITE, designated SEQ ID:19990, to the nucleotide sequence of GAM7776 RNA, herein designated GAM RNA, also designated SEQ ID:246.

Another function of GAM7776 is therefore inhibition of LOC137886 (Accession XP_059929.3). Accordingly, utilities of GAM7776 include diagnosis, prevention and treatment of diseases and clinical conditions associated with LOC137886.

LOC139422 (Accession XP_066687.2) is another GAM7776 target gene, herein designated TARGET GENE. LOC139422 BINDING SITE is a target binding site found in the 5' untranslated region of mRNA encoded by LOC139422, corresponding to a target binding site such as BINDING SITE I, BINDING SITE II or BINDING SITE III of FIG. 8. Table 4 illustrates the complementarity of the nucleotide sequences of LOC139422 BINDING SITE, designated SEQ ID:9489, to the nucleotide sequence of GAM7776 RNA, herein designated GAM RNA, also designated SEQ ID:246.

Another function of GAM7776 is therefore inhibition of LOC139422 (Accession XP_066687.2). Accordingly, utilities of GAM7776 include diagnosis, prevention and treatment of diseases and clinical conditions associated with LOC139422.

LOC143241 (Accession NP_620167.1) is another GAM7776 target gene, herein designated TARGET GENE. LOC143241 BINDING SITE is a target binding site found in the 5' untranslated region of mRNA encoded by LOC143241, corresponding to a target binding site such as BINDING SITE I, BINDING SITE II or BINDING SITE III of FIG. 8. Table 4 illustrates the complementarity of the nucleotide sequences of LOC143241 BINDING SITE, designated SEQ ID:15574, to the nucleotide sequence of GAM7776 RNA, herein designated GAM RNA, also designated SEQ ID:246.

Another function of GAM7776 is therefore inhibition of LOC143241 (Accession NP_620167.1). Accordingly, utilities of GAM7776 include diagnosis, prevention and treatment of diseases and clinical conditions associated with LOC143241.

LOC144248 (Accession XP_084786.1) is another GAM7776 target gene, herein designated TARGET GENE. LOC144248 BINDING SITE is a target binding site found in the 5' untranslated region of mRNA encoded by LOC144248, corresponding to a target binding site such as BINDING SITE I, BINDING SITE II or BINDING SITE III of FIG. 8. Table 4 illustrates the complementarity of the nucleotide sequences of LOC144248 BINDING SITE, designated SEQ ID:3159, to the nucleotide sequence of GAM7776 RNA, herein designated GAM RNA, also designated SEQ ID:246.

Another function of GAM7776 is therefore inhibition of LOC144248 (Accession XP_084786.1). Accordingly, utilities of GAM7776 include diagnosis, prevention and treatment of diseases and clinical conditions associated with LOC144248.

LOC144266 (Accession XP_084795.1) is another GAM7776 target gene, herein designated TARGET GENE. LOC144266 BINDING SITE is a target binding site found in the 5' untranslated region of mRNA encoded by LOC144266, corresponding to a target binding site such as BINDING SITE I, BINDING SITE II or BINDING SITE III of FIG. 8. Table 4 illustrates the complementarity of the nucleotide sequences of LOC144266 BINDING SITE, designated SEQ ID:17498, to the nucleotide sequence of GAM7776 RNA, herein designated GAM RNA, also designated SEQ ID:246.

Another function of GAM7776 is therefore inhibition of LOC144266 (Accession XP_084795.1). Accordingly, utilities of GAM7776 include diagnosis, prevention and treatment of diseases and clinical conditions associated with LOC144266.

LOC144404 (Accession XP_084852.6) is another GAM7776 target gene, herein designated TARGET GENE. LOC144404 BINDING SITE1 through LOC144404 BINDING SITE3 are target binding sites found in untranslated regions of mRNA encoded by LOC144404, corresponding to target binding sites such as BINDING SITE I, BINDING SITE II or BINDING SITE III of FIG. 8. Table 4 illustrates the complementarity of the nucleotide sequences of LOC144404 BINDING SITE1 through LOC144404 BINDING SITE3, designated SEQ ID:1633, SEQ ID:15352 and SEQ ID:5897 respectively, to the nucleotide sequence of GAM7776 RNA, herein designated GAM RNA, also designated SEQ ID:246.

Another function of GAM7776 is therefore inhibition of LOC144404 (Accession XP_084852.6). Accordingly, utilities of GAM7776 include diagnosis, prevention and treatment of diseases and clinical conditions associated with LOC144404.

LOC144467 (Accession NP_612482.1) is another GAM7776 target gene, herein designated TARGET GENE. LOC144467 BINDING SITE is a target binding site found in the 5' untranslated region of mRNA encoded by LOC144467, corresponding to a target binding site such as BINDING SITE I, BINDING SITE II or BINDING SITE III of FIG. 8. Table 4 illustrates the complementarity of the nucleotide sequences of LOC144467 BINDING SITE, designated SEQ ID:5733, to the nucleotide sequence of GAM7776 RNA, herein designated GAM RNA, also designated SEQ ID:246.

Another function of GAM7776 is therefore inhibition of LOC144467 (Accession NP_612482.1). Accordingly, utilities of GAM7776 include diagnosis, prevention and treatment of diseases and clinical conditions associated with LOC144467.

LOC144481 (Accession XP_096611.2) is another GAM7776 target gene, herein designated TARGET GENE. LOC144481 BINDING SITE is a target binding site found in the 3' untranslated region of mRNA encoded by LOC144481, corresponding to a target binding site such as BINDING SITE I, BINDING SITE II or BINDING SITE III of FIG. 8. Table 4 illustrates the complementarity of the nucleotide sequences of LOC144481 BINDING SITE, designated SEQ ID:19220, to the nucleotide sequence of GAM7776 RNA, herein designated GAM RNA, also designated SEQ ID:246.

Another function of GAM7776 is therefore inhibition of LOC144481 (Accession XP_096611.2). Accordingly, utilities of GAM7776 include diagnosis, prevention and treatment of diseases and clinical conditions associated with LOC144481.

LOC144667 (Accession XP_096648.1) is another GAM7776 target gene, herein designated TARGET GENE. LOC144667 BINDING SITE is a target binding site found in the 3' untranslated region of mRNA encoded by LOC144667, corresponding to a target binding site such as BINDING SITE I, BINDING SITE II or BINDING SITE III of FIG. 8. Table 4 illustrates the complementarity of the nucleotide sequences of LOC144667 BINDING SITE, designated SEQ ID:12712, to the nucleotide sequence of GAM7776 RNA, herein designated GAM RNA, also designated SEQ ID:246.

Another function of GAM7776 is therefore inhibition of LOC144667 (Accession XP_096648.1). Accordingly, utilities of GAM7776 include diagnosis, prevention and treatment of diseases and clinical conditions associated with LOC144667.

LOC144742 (Accession XP_084949.1) is another GAM7776 target gene, herein designated TARGET GENE. LOC144742 BINDING SITE is a target binding site found in the 5' untranslated region of mRNA encoded by LOC144742, corresponding to a target binding site such as BINDING SITE I, BINDING SITE II or BINDING SITE III of FIG. 8. Table 4 illustrates the complementarity of the nucleotide sequences of LOC144742 BINDING SITE, designated SEQ ID:17736, to the nucleotide sequence of GAM7776 RNA, herein designated GAM RNA, also designated SEQ ID:246.

Another function of GAM7776 is therefore inhibition of LOC144742 (Accession XP_084949.1). Accordingly, utilities of GAM7776 include diagnosis, prevention and treatment of diseases and clinical conditions associated with LOC144742.

LOC144766 (Accession XP_084963.2) is another GAM7776 target gene, herein designated TARGET GENE. LOC144766 BINDING SITE is a target binding site found in the 5' untranslated region of mRNA encoded by LOC144766, corresponding to a target binding site such as BINDING SITE I, BINDING SITE II or BINDING SITE III of FIG. 8. Table 4 illustrates the complementarity of the nucleotide sequences of LOC144766 BINDING SITE, designated SEQ ID:8972, to the nucleotide sequence of GAM7776 RNA, herein designated GAM RNA, also designated SEQ ID:246.

Another function of GAM7776 is therefore inhibition of LOC144766 (Accession XP_084963.2). Accordingly, utilities of GAM7776 include diagnosis, prevention and treatment of diseases and clinical conditions associated with LOC144766.

LOC144776 (Accession XP_084964.1) is another GAM7776 target gene, herein designated TARGET GENE. LOC144776 BINDING SITE1 and LOC144776 BINDING SITE2 are target binding sites found in untranslated regions of mRNA encoded by LOC144776, corresponding to target binding sites such as BINDING SITE I, BINDING SITE II or BINDING SITE III of FIG. 8. Table 4 illustrates the complementarity of the nucleotide sequences of LOC144776 BINDING SITE1 and LOC144776 BINDING SITE2, designated SEQ ID:444 and SEQ ID:16275 respectively, to the nucleotide sequence of GAM7776 RNA, herein designated GAM RNA, also designated SEQ ID:246.

Another function of GAM7776 is therefore inhibition of LOC144776 (Accession XP_084964.1). Accordingly, utilities of GAM7776 include diagnosis, prevention and treatment of diseases and clinical conditions associated with LOC144776.

LOC144817 (Accession XP_084972.1) is another GAM7776 target gene, herein designated TARGET GENE. LOC144817 BINDING SITE is a target binding site found in the 5' untranslated region of mRNA encoded by LOC144817, corresponding to a target binding site such as BINDING SITE I, BINDING SITE II or BINDING SITE III of FIG. 8. Table 4 illustrates the complementarity of the nucleotide sequences of LOC144817 BINDING SITE, designated SEQ ID:12065, to the nucleotide sequence of GAM7776 RNA, herein designated GAM RNA, also designated SEQ ID:246.

Another function of GAM7776 is therefore inhibition of LOC144817 (Accession XP_084972.1). Accordingly, utilities of GAM7776 include diagnosis, prevention and treatment of diseases and clinical conditions associated with LOC144817.

LOC144962 (Accession XP_084990.1) is another GAM7776 target gene, herein designated TARGET GENE. LOC144962 BINDING SITE is a target binding site found in the 5' untranslated region of mRNA encoded by LOC144962, corresponding to a target binding site such as BINDING SITE I, BINDING SITE II or BINDING SITE III of FIG. 8. Table 4 illustrates the complementarity of the nucleotide sequences of LOC144962 BINDING SITE, designated SEQ ID:12130, to the nucleotide sequence of GAM7776 RNA, herein designated GAM RNA, also designated SEQ ID:246.

Another function of GAM7776 is therefore inhibition of LOC144962 (Accession XP_084990.1). Accordingly, utilities of GAM7776 include diagnosis, prevention and treatment of diseases and clinical conditions associated with LOC144962.

LOC145098 (Accession XP_085022.1) is another GAM7776 target gene, herein designated TARGET GENE. LOC145098 BINDING SITE is a target binding site found in the 5' untranslated region of mRNA encoded by LOC145098, corresponding to a target binding site such as BINDING SITE I, BINDING SITE II or BINDING SITE III of FIG. 8. Table 4 illustrates the complementarity of the nucleotide sequences of LOC145098 BINDING SITE, designated SEQ ID:675, to the nucleotide sequence of GAM7776 RNA, herein designated GAM RNA, also designated SEQ ID:246.

Another function of GAM7776 is therefore inhibition of LOC145098 (Accession XP_085022.1). Accordingly, utilities of GAM7776 include diagnosis, prevention and treatment of diseases and clinical conditions associated with LOC145098.

LOC145231 (Accession XP_096740.1) is another GAM7776 target gene, herein designated TARGET GENE. LOC145231 BINDING SITE is a target binding site found in the 3' untranslated region of mRNA encoded by LOC145231, corresponding to a target binding site such as BINDING SITE I, BINDING SITE II or BINDING SITE III of FIG. 8. Table 4 illustrates the complementarity of the nucleotide sequences of LOC145231 BINDING SITE, designated SEQ ID:6417, to the nucleotide sequence of GAM7776 RNA, herein designated GAM RNA, also designated SEQ ID:246.

Another function of GAM7776 is therefore inhibition of LOC145231 (Accession XP_096740.1). Accordingly, utilities of GAM7776 include diagnosis, prevention and treatment of diseases and clinical conditions associated with LOC145231.

LOC145268 (Accession XP_085072.1) is another GAM7776 target gene, herein designated TARGET GENE. LOC145268 BINDING SITE is a target binding site found in the 5' untranslated region of mRNA encoded by LOC145268, corresponding to a target binding site such as BINDING SITE I, BINDING SITE II or BINDING SITE III of FIG. 8. Table 4 illustrates the complementarity of the nucleotide sequences of LOC145268 BINDING SITE, designated SEQ ID:18805, to the nucleotide sequence of GAM7776 RNA, herein designated GAM RNA, also designated SEQ ID:246.

Another function of GAM7776 is therefore inhibition of LOC145268 (Accession XP_085072.1). Accordingly, utilities of GAM7776 include diagnosis, prevention and treatment of diseases and clinical conditions associated with LOC145268.

LOC145725 (Accession XP_085211.1) is another GAM7776 target gene, herein designated TARGET GENE. LOC145725 BINDING SITE is a target binding site found in the 3' untranslated region of mRNA encoded by LOC145725, corresponding to a target binding site such as BINDING SITE I, BINDING SITE II or BINDING SITE III of FIG. 8. Table 4 illustrates the complementarity of the nucleotide sequences of LOC145725 BINDING SITE, designated SEQ ID:4773, to the nucleotide sequence of GAM7776 RNA, herein designated GAM RNA, also designated SEQ ID:246.

Another function of GAM7776 is therefore inhibition of LOC145725 (Accession XP_085211.1). Accordingly, utilities of GAM7776 include diagnosis, prevention and treatment of diseases and clinical conditions associated with LOC145725.

LOC145757 (Accession XP_085227.1) is another GAM7776 target gene, herein designated TARGET GENE. LOC145757 BINDING SITE1 and LOC145757 BINDING SITE2 are target binding sites found in untranslated regions of mRNA encoded by LOC145757, corresponding to target binding sites such as BINDING SITE I, BINDING SITE II or BINDING SITE III of FIG. 8. Table 4 illustrates the complementarity of the nucleotide sequences of LOC145757 BINDING SITE1 and LOC145757 BINDING SITE2, designated SEQ ID:7370 and SEQ ID:11523 respectively, to the nucleotide sequence of GAM7776 RNA, herein designated GAM RNA, also designated SEQ ID:246.

Another function of GAM7776 is therefore inhibition of LOC145757 (Accession XP_085227.1). Accordingly, utilities of GAM7776 include diagnosis, prevention and treatment of diseases and clinical conditions associated with LOC145757.

LOC145783 (Accession XP_085231.2) is another GAM7776 target gene, herein designated TARGET GENE.

LOC145783 BINDING SITE is a target binding site found in the 5' untranslated region of mRNA encoded by LOC145783, corresponding to a target binding site such as BINDING SITE I, BINDING SITE II or BINDING SITE III of FIG. 8. Table 4 illustrates the complementarity of the nucleotide sequences of LOC145783 BINDING SITE, designated SEQ ID:2196, to the nucleotide sequence of GAM7776 RNA, herein designated GAM RNA, also designated SEQ ID:246.

Another function of GAM7776 is therefore inhibition of LOC145783 (Accession XP_085231.2). Accordingly, utilities of GAM7776 include diagnosis, prevention and treatment of diseases and clinical conditions associated with LOC145783.

LOC145813 (Accession XP_096873.1) is another GAM7776 target gene, herein designated TARGET GENE. LOC145813 BINDING SITE is a target binding site found in the 5' untranslated region of mRNA encoded by LOC145813, corresponding to a target binding site such as BINDING SITE I, BINDING SITE II or BINDING SITE III of FIG. 8. Table 4 illustrates the complementarity of the nucleotide sequences of LOC145813 BINDING SITE, designated SEQ ID:16256, to the nucleotide sequence of GAM7776 RNA, herein designated GAM RNA, also designated SEQ ID:246.

Another function of GAM7776 is therefore inhibition of LOC145813 (Accession XP_096873.1). Accordingly, utilities of GAM7776 include diagnosis, prevention and treatment of diseases and clinical conditions associated with LOC145813.

LOC145988 (Accession XP_085290.3) is another GAM7776 target gene, herein designated TARGET GENE. LOC145988 BINDING SITE is a target binding site found in the 5' untranslated region of mRNA encoded by LOC145988, corresponding to a target binding site such as BINDING SITE I, BINDING SITE II or BINDING SITE III of FIG. 8. Table 4 illustrates the complementarity of the nucleotide sequences of LOC145988 BINDING SITE, designated SEQ ID:11009, to the nucleotide sequence of GAM7776 RNA, herein designated GAM RNA, also designated SEQ ID:246.

Another function of GAM7776 is therefore inhibition of LOC145988 (Accession XP_085290.3). Accordingly, utilities of GAM7776 include diagnosis, prevention and treatment of diseases and clinical conditions associated with LOC145988.

LOC146177 (Accession NP_778229.1) is another GAM7776 target gene, herein designated TARGET GENE. LOC146177 BINDING SITE is a target binding site found in the 5' untranslated region of mRNA encoded by LOC146177, corresponding to a target binding site such as BINDING SITE I, BINDING SITE II or BINDING SITE III of FIG. 8. Table 4 illustrates the complementarity of the nucleotide sequences of LOC146177 BINDING SITE, designated SEQ ID:16175, to the nucleotide sequence of GAM7776 RNA, herein designated GAM RNA, also designated SEQ ID:246.

Another function of GAM7776 is therefore inhibition of LOC146177 (Accession NP_778229.1). Accordingly, utilities of GAM7776 include diagnosis, prevention and treatment of diseases and clinical conditions associated with LOC146177.

LOC146229 (Accession XP_085387.1) is another GAM7776 target gene, herein designated TARGET GENE. LOC146229 BINDING SITE1 through LOC146229 BINDING SITE4 are target binding sites found in untranslated regions of mRNA encoded by LOC146229, corresponding to target binding sites such as BINDING SITE I, BINDING SITE II or BINDING SITE III of FIG. 8. Table 4 illustrates the complementarity of the nucleotide sequences of LOC146229 BINDING SITE1 through LOC146229 BINDING SITE4, designated SEQ ID:5672, SEQ ID:8706, SEQ ID:5551 and SEQ ID:1644 respectively, to the nucleotide sequence of GAM7776 RNA, herein designated GAM RNA, also designated SEQ ID:246.

Another function of GAM7776 is therefore inhibition of LOC146229 (Accession XP_085387.1). Accordingly, utilities of GAM7776 include diagnosis, prevention and treatment of diseases and clinical conditions associated with LOC146229.

LOC146346 (Accession XP_085430.1) is another GAM7776 target gene, herein designated TARGET GENE. LOC146346 BINDING SITE1 and LOC146346 BINDING SITE2 are target binding sites found in untranslated regions of mRNA encoded by LOC146346, corresponding to target binding sites such as BINDING SITE I, BINDING SITE II or BINDING SITE III of FIG. 8. Table 4 illustrates the complementarity of the nucleotide sequences of LOC146346 BINDING SITE1 and LOC146346 BINDING SITE2, designated SEQ ID:5798 and SEQ ID:17670 respectively, to the nucleotide sequence of GAM7776 RNA, herein designated GAM RNA, also designated SEQ ID:246.

Another function of GAM7776 is therefore inhibition of LOC146346 (Accession XP_085430.1). Accordingly, utilities of GAM7776 include diagnosis, prevention and treatment of diseases and clinical conditions associated with LOC146346.

LOC146429 (Accession XP_096998.2) is another GAM7776 target gene, herein designated TARGET GENE. LOC146429 BINDING SITE is a target binding site found in the 5' untranslated region of mRNA encoded by LOC146429, corresponding to a target binding site such as BINDING SITE I, BINDING SITE II or BINDING SITE III of FIG. 8. Table 4 illustrates the complementarity of the nucleotide sequences of LOC146429 BINDING SITE, designated SEQ ID:2457, to the nucleotide sequence of GAM7776 RNA, herein designated GAM RNA, also designated SEQ ID:246.

Another function of GAM7776 is therefore inhibition of LOC146429 (Accession XP_096998.2). Accordingly, utilities of GAM7776 include diagnosis, prevention and treatment of diseases and clinical conditions associated with LOC146429.

LOC146443 (Accession XP_085461.6) is another GAM7776 target gene, herein designated TARGET GENE. LOC146443 BINDING SITE is a target binding site found in the 5' untranslated region of mRNA encoded by LOC146443, corresponding to a target binding site such as BINDING SITE I, BINDING SITE II or BINDING SITE III of FIG. 8. Table 4 illustrates the complementarity of the nucleotide sequences of LOC146443 BINDING SITE, designated SEQ ID:813, to the nucleotide sequence of GAM7776 RNA, herein designated GAM RNA, also designated SEQ ID:246.

Another function of GAM7776 is therefore inhibition of LOC146443 (Accession XP_085461.6). Accordingly, utilities of GAM7776 include diagnosis, prevention and treatment of diseases and clinical conditions associated with LOC146443.

LOC146475 (Accession XP_097006.1) is another GAM7776 target gene, herein designated TARGET GENE. LOC146475 BINDING SITE is a target binding site found in the 5' untranslated region of mRNA encoded by LOC146475, corresponding to a target binding site such as BINDING SITE I, BINDING SITE II or BINDING SITE III of FIG. 8. Table 4 illustrates the complementarity of the nucleotide sequences of LOC146475 BINDING SITE, designated SEQ ID:9246, to the nucleotide sequence of GAM7776 RNA, herein designated GAM RNA, also designated SEQ ID:246.

Another function of GAM7776 is therefore inhibition of LOC146475 (Accession XP_097006.1). Accordingly, utilities of GAM7776 include diagnosis, prevention and treatment of diseases and clinical conditions associated with LOC146475.

LOC146513 (Accession XP_097013.1) is another GAM7776 target gene, herein designated TARGET GENE. LOC146513 BINDING SITE is a target binding site found in the 3' untranslated region of mRNA encoded by LOC146513, corresponding to a target binding site such as BINDING SITE I, BINDING SITE II or BINDING SITE III of FIG. 8. Table 4 illustrates the complementarity of the nucleotide sequences of LOC146513 BINDING SITE, designated SEQ ID:3374, to the nucleotide sequence of GAM7776 RNA, herein designated GAM RNA, also designated SEQ ID:246.

Another function of GAM7776 is therefore inhibition of LOC146513 (Accession XP_097013.1). Accordingly, utilities of GAM7776 include diagnosis, prevention and treatment of diseases and clinical conditions associated with LOC146513.

LOC146603 (Accession XP_085514.2) is another GAM7776 target gene, herein designated TARGET GENE. LOC146603 BINDING SITE is a target binding site found in the 5' untranslated region of mRNA encoded by LOC146603, corresponding to a target binding site such as BINDING SITE I, BINDING SITE II or BINDING SITE III of FIG. 8. Table 4 illustrates the complementarity of the nucleotide sequences of LOC146603 BINDING SITE, designated SEQ ID:7382, to the nucleotide sequence of GAM7776 RNA, herein designated GAM RNA, also designated SEQ ID:246.

Another function of GAM7776 is therefore inhibition of LOC146603 (Accession XP_085514.2). Accordingly, utilities of GAM7776 include diagnosis, prevention and treatment of diseases and clinical conditions associated with LOC146603.

LOC146784 (Accession XP_085588.1) is another GAM7776 target gene, herein designated TARGET GENE. LOC146784 BINDING SITE is a target binding site found in the 5' untranslated region of mRNA encoded by LOC146784, corresponding to a target binding site such as BINDING SITE I, BINDING SITE II or BINDING SITE III of FIG. 8. Table 4 illustrates the complementarity of the nucleotide sequences of LOC146784 BINDING SITE, designated SEQ ID:13448, to the nucleotide sequence of GAM7776 RNA, herein designated GAM RNA, also designated SEQ ID:246.

Another function of GAM7776 is therefore inhibition of LOC146784 (Accession XP_085588.1). Accordingly, utilities of GAM7776 include diagnosis, prevention and treatment of diseases and clinical conditions associated with LOC146784.

LOC146839 (Accession XP_097107.1) is another GAM7776 target gene, herein designated TARGET GENE. LOC146839 BINDING SITE is a target binding site found in the 3' untranslated region of mRNA encoded by LOC146839, corresponding to a target binding site such as BINDING SITE I, BINDING SITE II or BINDING SITE III of FIG. 8. Table 4 illustrates the complementarity of the nucleotide sequences of LOC146839 BINDING SITE, designated SEQ ID:1745, to the nucleotide sequence of GAM7776 RNA, herein designated GAM RNA, also designated SEQ ID:246.

Another function of GAM7776 is therefore inhibition of LOC146839 (Accession XP_097107.1). Accordingly, utilities of GAM7776 include diagnosis, prevention and treatment of diseases and clinical conditions associated with LOC146839.

LOC146894 (Accession NP_660316.1) is another GAM7776 target gene, herein designated TARGET GENE. LOC146894 BINDING SITE is a target binding site found in the 3' untranslated region of mRNA encoded by LOC146894, corresponding to a target binding site such as BINDING SITE I, BINDING SITE II or BINDING SITE III of FIG. 8. Table 4 illustrates the complementarity of the nucleotide sequences of LOC146894 BINDING SITE, designated SEQ ID:8315, to the nucleotide sequence of GAM7776 RNA, herein designated GAM RNA, also designated SEQ ID:246.

Another function of GAM7776 is therefore inhibition of LOC146894 (Accession NP_660316.1). Accordingly, utilities of GAM7776 include diagnosis, prevention and treatment of diseases and clinical conditions associated with LOC146894.

LOC146895 (Accession XP_097120.1) is another GAM7776 target gene, herein designated TARGET GENE. LOC146895 BINDING SITE is a target binding site found in the 5' untranslated region of mRNA encoded by LOC146895, corresponding to a target binding site such as BINDING SITE I, BINDING SITE II or BINDING SITE III of FIG. 8. Table 4 illustrates the complementarity of the nucleotide sequences of LOC146895 BINDING SITE, designated SEQ ID:8232, to the nucleotide sequence of GAM7776 RNA, herein designated GAM RNA, also designated SEQ ID:246.

Another function of GAM7776 is therefore inhibition of LOC146895 (Accession XP_097120.1). Accordingly, utilities of GAM7776 include diagnosis, prevention and treatment of diseases and clinical conditions associated with LOC146895.

LOC146901 (Accession XP_097121.1) is another GAM7776 target gene, herein designated TARGET GENE. LOC146901 BINDING SITE is a target binding site found in the 3' untranslated region of mRNA encoded by LOC146901, corresponding to a target binding site such as BINDING SITE I, BINDING SITE II or BINDING SITE III of FIG. 8. Table 4 illustrates the complementarity of the nucleotide sequences of LOC146901 BINDING SITE, designated SEQ ID:6392, to the nucleotide sequence of GAM7776 RNA, herein designated GAM RNA, also designated SEQ ID:246.

Another function of GAM7776 is therefore inhibition of LOC146901 (Accession XP_097121.1). Accordingly, utilities of GAM7776 include diagnosis, prevention and treatment of diseases and clinical conditions associated with LOC146901.

LOC146909 (Accession XP_085634.2) is another GAM7776 target gene, herein designated TARGET GENE. LOC146909 BINDING SITE1 and LOC146909 BINDING SITE2 are target binding sites found in untranslated regions of mRNA encoded by LOC146909, corresponding to target binding sites such as BINDING SITE I, BINDING SITE II or BINDING SITE III of FIG. 8. Table 4 illustrates the complementarity of the nucleotide sequences of LOC146909 BINDING SITE1 and LOC146909 BINDING SITE2, designated SEQ ID:9492 and SEQ ID:19550 respectively, to the nucleotide sequence of GAM7776 RNA, herein designated GAM RNA, also designated SEQ ID:246.

Another function of GAM7776 is therefore inhibition of LOC146909 (Accession XP_085634.2). Accordingly, utilities of GAM7776 include diagnosis, prevention and treatment of diseases and clinical conditions associated with LOC146909.

LOC147071 (Accession XP_054031.5) is another GAM7776 target gene, herein designated TARGET GENE. LOC147071 BINDING SITE is a target binding site found in the 5' untranslated region of mRNA encoded by LOC147071, corresponding to a target binding site such as BINDING SITE I, BINDING SITE II or BINDING SITE III of FIG. 8. Table 4 illustrates the complementarity of the nucleotide sequences of LOC147071 BINDING SITE, designated SEQ ID:16699, to the nucleotide sequence of GAM7776 RNA, herein designated GAM RNA, also designated SEQ ID:246.

Another function of GAM7776 is therefore inhibition of LOC147071 (Accession XP_054031.5). Accordingly, utilities of GAM7776 include diagnosis, prevention and treatment of diseases and clinical conditions associated with LOC147071.

LOC147080 (Accession XP_097182.1) is another GAM7776 target gene, herein designated TARGET GENE. LOC147080 BINDING SITE is a target binding site found in the 5' untranslated region of mRNA encoded by LOC147080, corresponding to a target binding site such as BINDING SITE I, BINDING SITE II or BINDING SITE III of FIG. 8. Table 4 illustrates the complementarity of the nucleotide sequences of LOC147080 BINDING SITE, designated SEQ ID:12558, to the nucleotide sequence of GAM7776 RNA, herein designated GAM RNA, also designated SEQ ID:246.

Another function of GAM7776 is therefore inhibition of LOC147080 (Accession XP_097182.1). Accordingly, utilities of GAM7776 include diagnosis, prevention and treatment of diseases and clinical conditions associated with LOC147080.

LOC147166 (Accession XP_085722.2) is another GAM7776 target gene, herein designated TARGET GENE. LOC147166 BINDING SITE is a target binding site found in the 3' untranslated region of mRNA encoded by LOC147166, corresponding to a target binding site such as BINDING SITE I, BINDING SITE II or BINDING SITE III of FIG. 8. Table 4 illustrates the complementarity of the nucleotide sequences of LOC147166 BINDING SITE, designated SEQ ID:10618, to the nucleotide sequence of GAM7776 RNA, herein designated GAM RNA, also designated SEQ ID:246.

Another function of GAM7776 is therefore inhibition of LOC147166 (Accession XP_085722.2). Accordingly, utilities of GAM7776 include diagnosis, prevention and treatment of diseases and clinical conditions associated with LOC147166.

LOC147381 (Accession XP_097230.2) is another GAM7776 target gene, herein designated TARGET GENE. LOC147381 BINDING SITE is a target binding site found in the 3' untranslated region of mRNA encoded by LOC147381, corresponding to a target binding site such as BINDING SITE I, BINDING SITE II or BINDING SITE III of FIG. 8. Table 4 illustrates the complementarity of the nucleotide sequences of LOC147381 BINDING SITE, designated SEQ ID:19915, to the nucleotide sequence of GAM7776 RNA, herein designated GAM RNA, also designated SEQ ID:246.

Another function of GAM7776 is therefore inhibition of LOC147381 (Accession XP_097230.2). Accordingly, utilities of GAM7776 include diagnosis, prevention and treatment of diseases and clinical conditions associated with LOC147381.

LOC147407 (Accession XP_084000.1) is another GAM7776 target gene, herein designated TARGET GENE. LOC147407 BINDING SITE is a target binding site found in the 3' untranslated region of mRNA encoded by LOC147407, corresponding to a target binding site such as BINDING SITE I, BINDING SITE II or BINDING SITE III of FIG. 8. Table 4 illustrates the complementarity of the nucleotide sequences of LOC147407 BINDING SITE, designated SEQ ID:12065, to the nucleotide sequence of GAM7776 RNA, herein designated GAM RNA, also designated SEQ ID:246.

Another function of GAM7776 is therefore inhibition of LOC147407 (Accession XP_084000.1). Accordingly, utilities of GAM7776 include diagnosis, prevention and treatment of diseases and clinical conditions associated with LOC147407.

LOC147817 (Accession XP_085903.1) is another GAM7776 target gene, herein designated TARGET GENE. LOC147817 BINDING SITE1 and LOC147817 BINDING SITE2 are target binding sites found in untranslated regions of mRNA encoded by LOC147817, corresponding to target binding sites such as BINDING SITE I, BINDING SITE II or BINDING SITE III of FIG. 8. Table 4 illustrates the complementarity of the nucleotide sequences of LOC147817 BINDING SITE1 and LOC147817 BINDING SITE2, designated SEQ ID:19233 and SEQ ID:1634 respectively, to the nucleotide sequence of GAM7776 RNA, herein designated GAM RNA, also designated SEQ ID:246.

Another function of GAM7776 is therefore inhibition of LOC147817 (Accession XP_085903.1). Accordingly, utilities of GAM7776 include diagnosis, prevention and treatment of diseases and clinical conditions associated with LOC147817.

LOC147841 (Accession XP_085924.2) is another GAM7776 target gene, herein designated TARGET GENE. LOC147841 BINDING SITE1 and LOC147841 BINDING SITE2 are target binding sites found in untranslated regions of mRNA encoded by LOC147841, corresponding to target binding sites such as BINDING SITE I, BINDING SITE II or BINDING SITE III of FIG. 8. Table 4 illustrates the complementarity of the nucleotide sequences of LOC147841 BINDING SITE1 and LOC147841 BINDING SITE2, designated SEQ ID:12065 and SEQ ID:8642 respectively, to the nucleotide sequence of GAM7776 RNA, herein designated GAM RNA, also designated SEQ ID:246.

Another function of GAM7776 is therefore inhibition of LOC147841 (Accession XP_085924.2). Accordingly, utilities of GAM7776 include diagnosis, prevention and treatment of diseases and clinical conditions associated with LOC147841.

LOC147947 (Accession XP_085974.1) is another GAM7776 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:17952, to the nucleotide sequence of GAM7776 RNA, herein designated GAM RNA, also designated SEQ ID:246.

Another function of GAM7776 is therefore inhibition of LOC147947 (Accession XP_085974.1). Accordingly, utilities of GAM7776 include diagnosis, prevention and treatment of diseases and clinical conditions associated with LOC147947.

LOC148137 (Accession NP_653293.1) is another GAM7776 target gene, herein designated TARGET GENE. LOC148137 BINDING SITE1 and LOC148137 BINDING SITE2 are target binding sites found in untranslated regions of mRNA encoded by LOC148137, corresponding to target binding sites such as BINDING SITE I, BINDING SITE II or BINDING SITE III of FIG. 8. Table 4 illustrates the complementarity of the nucleotide sequences of LOC148137 BINDING SITE1 and LOC148137 BINDING SITE2, designated SEQ ID:17935 and SEQ ID:5784 respectively, to the nucleotide sequence of GAM7776 RNA, herein designated GAM RNA, also designated SEQ ID:246.

Another function of GAM7776 is therefore inhibition of LOC148137 (Accession NP_653293.1). Accordingly, utilities of GAM7776 include diagnosis, prevention and treatment of diseases and clinical conditions associated with LOC148137.

LOC148198 (Accession XP_047554.4) is another GAM7776 target gene, herein designated TARGET GENE. LOC148198 BINDING SITE is a target binding site found in the 3' untranslated region of mRNA encoded by LOC148198, corresponding to a target binding site such as BINDING SITE I, BINDING SITE II or BINDING SITE III of FIG. 8. Table 4 illustrates the complementarity of the nucleotide sequences of LOC148198 BINDING SITE, designated SEQ ID:11563, to the nucleotide sequence of GAM7776 RNA, herein designated GAM RNA, also designated SEQ ID:246.

Another function of GAM7776 is therefore inhibition of LOC148198 (Accession XP_047554.4). Accordingly, utilities of GAM7776 include diagnosis, prevention and treatment of diseases and clinical conditions associated with LOC148198.

LOC148708 (Accession XP_086286.4) is another GAM7776 target gene, herein designated TARGET GENE. LOC148708 BINDING SITE is a target binding site found in the 3' untranslated region of mRNA encoded by LOC148708, corresponding to a target binding site such as BINDING SITE I, BINDING SITE II or BINDING SITE III of FIG. 8. Table 4 illustrates the complementarity of the nucleotide sequences of LOC148708 BINDING SITE, designated SEQ ID:15671, to the nucleotide sequence of GAM7776 RNA, herein designated GAM RNA, also designated SEQ ID:246.

Another function of GAM7776 is therefore inhibition of LOC148708 (Accession XP_086286.4). Accordingly, utilities of GAM7776 include diagnosis, prevention and treatment of diseases and clinical conditions associated with LOC148708.

LOC148709 (Accession XP_086281.1) is another GAM7776 target gene, herein designated TARGET GENE. LOC148709 BINDING SITE1 and LOC148709 BINDING SITE2 are target binding sites found in untranslated regions of mRNA encoded by LOC148709, corresponding to target binding sites such as BINDING SITE I, BINDING SITE II or BINDING SITE III of FIG. 8. Table 4 illustrates the complementarity of the nucleotide sequences of LOC148709 BINDING SITE1 and LOC148709 BINDING SITE2, designated SEQ ID:9201 and SEQ ID:6922 respectively, to the nucleotide sequence of GAM7776 RNA, herein designated GAM RNA, also designated SEQ ID:246.

Another function of GAM7776 is therefore inhibition of LOC148709 (Accession XP_086281.1). Accordingly, utilities of GAM7776 include diagnosis, prevention and treatment of diseases and clinical conditions associated with LOC148709.

LOC149149 (Accession XP_097598.1) is another GAM7776 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:2184, to the nucleotide sequence of GAM7776 RNA, herein designated GAM RNA, also designated SEQ ID:246.

Another function of GAM7776 is therefore inhibition of LOC149149 (Accession XP_097598.1). Accordingly, utilities of GAM7776 include diagnosis, prevention and treatment of diseases and clinical conditions associated with LOC149149.

LOC149194 (Accession XP_086458.1) is another GAM7776 target gene, herein designated TARGET GENE. LOC149194 BINDING SITE is a target binding site found in the 3' untranslated region of mRNA encoded by LOC149194, corresponding to a target binding site such as BINDING SITE I, BINDING SITE II or BINDING SITE III of FIG. 8. Table 4 illustrates the complementarity of the nucleotide sequences of LOC149194 BINDING SITE, designated SEQ ID:12637, to the nucleotide sequence of GAM7776 RNA, herein designated GAM RNA, also designated SEQ ID:246.

Another function of GAM7776 is therefore inhibition of LOC149194 (Accession XP_086458.1). Accordingly, utilities of GAM7776 include diagnosis, prevention and treatment of diseases and clinical conditions associated with LOC149194.

LOC149371 (Accession NP_787072.1) is another GAM7776 target gene, herein designated TARGET GENE. LOC149371 BINDING SITE is a target binding site found in the 3' untranslated region of mRNA encoded by LOC149371, corresponding to a target binding site such as BINDING SITE I, BINDING SITE II or BINDING SITE III of FIG. 8. Table 4 illustrates the complementarity of the nucleotide sequences of LOC149371 BINDING SITE, designated SEQ ID:13354, to the nucleotide sequence of GAM7776 RNA, herein designated GAM RNA, also designated SEQ ID:246.

Another function of GAM7776 is therefore inhibition of LOC149371 (Accession NP_787072.1). Accordingly, utilities of GAM7776 include diagnosis, prevention and treatment of diseases and clinical conditions associated with LOC149371.

LOC149466 (Accession XP_086546.1) is another GAM7776 target gene, herein designated TARGET GENE. LOC149466 BINDING SITE is a target binding site found in the 3' untranslated region of mRNA encoded by LOC149466, corresponding to a target binding site such as BINDING SITE I, BINDING SITE II or BINDING SITE III of FIG. 8. Table 4 illustrates the complementarity of the nucleotide sequences of LOC149466 BINDING SITE, designated SEQ ID:16260, to the nucleotide sequence of GAM7776 RNA, herein designated GAM RNA, also designated SEQ ID:246.

Another function of GAM7776 is therefore inhibition of LOC149466 (Accession XP_086546.1). Accordingly, utilities of GAM7776 include diagnosis, prevention and treatment of diseases and clinical conditions associated with LOC149466.

LOC149478 (Accession XP_086536.1) is another GAM7776 target gene, herein designated TARGET GENE. LOC149478 BINDING SITE is a target binding site found in the 3' untranslated region of mRNA encoded by LOC149478, corresponding to a target binding site such as BINDING SITE I, BINDING SITE II or BINDING SITE III of FIG. 8. Table 4 illustrates the complementarity of the nucleotide sequences of LOC149478 BINDING SITE, designated SEQ ID:5016, to the nucleotide sequence of GAM7776 RNA, herein designated GAM RNA, also designated SEQ ID:246.

Another function of GAM7776 is therefore inhibition of LOC149478 (Accession XP_086536.1). Accordingly, utilities of GAM7776 include diagnosis, prevention and treatment of diseases and clinical conditions associated with LOC149478.

LOC149506 (Accession XP_097661.1) is another GAM7776 target gene, herein designated TARGET GENE. LOC149506 BINDING SITE is a target binding site found in the 3' untranslated region of mRNA encoded by LOC149506, corresponding to a target binding site such as BINDING SITE I, BINDING SITE II or BINDING SITE III of FIG. 8. Table 4 illustrates the complementarity of the nucleotide sequences of LOC149506 BINDING SITE, designated SEQ ID:2139, to the nucleotide sequence of GAM7776 RNA, herein designated GAM RNA, also designated SEQ ID:246.

Another function of GAM7776 is therefore inhibition of LOC149506 (Accession XP_097661.1). Accordingly, utilities of GAM7776 include diagnosis, prevention and treatment of diseases and clinical conditions associated with LOC149506.

LOC149606 (Accession XP_086600.1) is another GAM7776 target gene, herein designated TARGET GENE. LOC149606 BINDING SITE is a target binding site found in the 3' untranslated region of mRNA encoded by LOC149606, corresponding to a target binding site such as BINDING SITE I, BINDING SITE II or BINDING SITE III of FIG. 8. Table 4 illustrates the complementarity of the nucleotide sequences of LOC149606 BINDING SITE, designated SEQ ID:8887, to the nucleotide sequence of GAM7776 RNA, herein designated GAM RNA, also designated SEQ ID:246.

Another function of GAM7776 is therefore inhibition of LOC149606 (Accession XP_086600.1). Accordingly, utilities of GAM7776 include diagnosis, prevention and treatment of diseases and clinical conditions associated with LOC149606.

LOC149692 (Accession XP_097706.1) is another GAM7776 target gene, herein designated TARGET GENE. LOC149692 BINDING SITE is a target binding site found in the 3' untranslated region of mRNA encoded by LOC149692, corresponding to a target binding site such as BINDING SITE I, BINDING SITE II or BINDING SITE III of FIG. 8. Table 4 illustrates the complementarity of the nucleotide sequences of LOC149692 BINDING SITE, designated SEQ ID:11025, to the nucleotide sequence of GAM7776 RNA, herein designated GAM RNA, also designated SEQ ID:246.

Another function of GAM7776 is therefore inhibition of LOC149692 (Accession XP_097706.1). Accordingly, utilities of GAM7776 include diagnosis, prevention and treatment of diseases and clinical conditions associated with LOC149692.

LOC149703 (Accession XP_097719.1) is another GAM7776 target gene, herein designated TARGET GENE. LOC149703 BINDING SITE is a target binding site found in the 5' untranslated region of mRNA encoded by LOC149703, corresponding to a target binding site such as BINDING SITE I, BINDING SITE II or BINDING SITE III of FIG. 8. Table 4 illustrates the complementarity of the nucleotide sequences of LOC149703 BINDING SITE, designated SEQ ID:10508, to the nucleotide sequence of GAM7776 RNA, herein designated GAM RNA, also designated SEQ ID:246.

Another function of GAM7776 is therefore inhibition of LOC149703 (Accession XP_097719.1). Accordingly, utilities of GAM7776 include diagnosis, prevention and treatment of diseases and clinical conditions associated with LOC149703.

LOC149832 (Accession XP_097733.1) is another GAM7776 target gene, herein designated TARGET GENE. LOC149832 BINDING SITE is a target binding site found in the 5' untranslated region of mRNA encoded by LOC149832, corresponding to a target binding site such as BINDING SITE I, BINDING SITE II or BINDING SITE III of FIG. 8. Table 4 illustrates the complementarity of the nucleotide sequences of LOC149832 BINDING SITE, designated SEQ ID:17917, to the nucleotide sequence of GAM7776 RNA, herein designated GAM RNA, also designated SEQ ID:246.

Another function of GAM7776 is therefore inhibition of LOC149832 (Accession XP_097733.1). Accordingly, utilities of GAM7776 include diagnosis, prevention and treatment of diseases and clinical conditions associated with LOC149832.

LOC150054 (Accession XP_097797.1) is another GAM7776 target gene, herein designated TARGET GENE. LOC150054 BINDING SITE is a target binding site found in the 5' untranslated region of mRNA encoded by LOC150054, corresponding to a target binding site such as BINDING SITE I, BINDING SITE II or BINDING SITE III of FIG. 8. Table 4 illustrates the complementarity of the nucleotide sequences of LOC150054 BINDING SITE, designated SEQ ID:5157, to the nucleotide sequence of GAM7776 RNA, herein designated GAM RNA, also designated SEQ ID:246.

Another function of GAM7776 is therefore inhibition of LOC150054 (Accession XP_097797.1). Accordingly, utilities of GAM7776 include diagnosis, prevention and treatment of diseases and clinical conditions associated with LOC150054.

LOC150225 (Accession XP_097870.1) is another GAM7776 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:7207, to the nucleotide sequence of GAM7776 RNA, herein designated GAM RNA, also designated SEQ ID:246.

Another function of GAM7776 is therefore inhibition of LOC150225 (Accession XP_097870.1). Accordingly, utilities of GAM7776 include diagnosis, prevention and treatment of diseases and clinical conditions associated with LOC150225.

LOC150384 (Accession XP_097894.1) is another GAM7776 target gene, herein designated TARGET GENE. LOC150384 BINDING SITE is a target binding site found in the 5' untranslated region of mRNA encoded by LOC150384, corresponding to a target binding site such as BINDING SITE I, BINDING SITE II or BINDING SITE III of FIG. 8. Table 4 illustrates the complementarity of the nucleotide sequences of LOC150384 BINDING SITE, designated SEQ ID:7485, to the nucleotide sequence of GAM7776 RNA, herein designated GAM RNA, also designated SEQ ID:246.

Another function of GAM7776 is therefore inhibition of LOC150384 (Accession XP_097894.1). Accordingly, utilities of GAM7776 include diagnosis, prevention and treatment of diseases and clinical conditions associated with LOC150384.

LOC150397 (Accession XP_086907.1) is another GAM7776 target gene, herein designated TARGET GENE. LOC150397 BINDING SITE is a target binding site found in the 3' untranslated region of mRNA encoded by LOC150397, corresponding to a target binding site such as BINDING SITE I, BINDING SITE II or BINDING SITE III of FIG. 8. Table 4 illustrates the complementarity of the nucleotide sequences of LOC150397 BINDING SITE, designated SEQ ID:19467, to the nucleotide sequence of GAM7776 RNA, herein designated GAM RNA, also designated SEQ ID:246.

Another function of GAM7776 is therefore inhibition of LOC150397 (Accession XP_086907.1). Accordingly, utilities of GAM7776 include diagnosis, prevention and treatment of diseases and clinical conditions associated with LOC150397.

LOC150587 (Accession XP_097917.1) is another GAM7776 target gene, herein designated TARGET GENE. LOC150587 BINDING SITE is a target binding site found in the 5' untranslated region of mRNA encoded by LOC150587, corresponding to a target binding site such as BINDING SITE I, BINDING SITE II or BINDING SITE III of FIG. 8. Table 4 illustrates the complementarity of the nucleotide sequences of LOC150587 BINDING SITE, designated SEQ ID:16940, to the nucleotide sequence of GAM7776 RNA, herein designated GAM RNA, also designated SEQ ID:246.

Another function of GAM7776 is therefore inhibition of LOC150587 (Accession XP_097917.1). Accordingly, utilities of GAM7776 include diagnosis, prevention and treatment of diseases and clinical conditions associated with LOC150587.

LOC151057 (Accession XP_097998.1) is another GAM7776 target gene, herein designated TARGET GENE. LOC151057 BINDING SITE is a target binding site found in the 3' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:12075, to the nucleotide sequence of GAM7776 RNA, herein designated GAM RNA, also designated SEQ ID:246.

Another function of GAM7776 is therefore inhibition of LOC151057 (Accession XP_097998.1). Accordingly, utilities of GAM7776 include diagnosis, prevention and treatment of diseases and clinical conditions associated with LOC151057.

LOC151196 (Accession XP_098019.1) is another GAM7776 target gene, herein designated TARGET GENE. LOC151196 BINDING SITE is a target binding site found in the 3' untranslated region of mRNA encoded by LOC151196, corresponding to a target binding site such as BINDING SITE I, BINDING SITE II or BINDING SITE III of FIG. 8. Table 4 illustrates the complementarity of the nucleotide sequences of LOC151196 BINDING SITE, designated SEQ ID:19774, to the nucleotide sequence of GAM7776 RNA, herein designated GAM RNA, also designated SEQ ID:246.

Another function of GAM7776 is therefore inhibition of LOC151196 (Accession XP_098019.1). Accordingly, utilities of GAM7776 include diagnosis, prevention and treatment of diseases and clinical conditions associated with LOC151196.

LOC151201 (Accession XP_098021.1) is another GAM7776 target gene, herein designated TARGET GENE. LOC151201 BINDING SITE1 and LOC151201 BINDING SITE2 are target binding sites found in untranslated regions of mRNA encoded by LOC151201, corresponding to target binding sites such as BINDING SITE I, BINDING SITE II or BINDING SITE III of FIG. 8. Table 4 illustrates the complementarity of the nucleotide sequences of LOC151201 BINDING SITE1 and LOC151201 BINDING SITE2, designated SEQ ID:12725 and SEQ ID:2572 respectively, to the nucleotide sequence of GAM7776 RNA, herein designated GAM RNA, also designated SEQ ID:246.

Another function of GAM7776 is therefore inhibition of LOC151201 (Accession XP_098021.1). Accordingly, utilities of GAM7776 include diagnosis, prevention and treatment of diseases and clinical conditions associated with LOC151201.

LOC151475 (Accession XP_098063.1) is another GAM7776 target gene, herein designated TARGET GENE. LOC151475 BINDING SITE1 and LOC151475 BINDING SITE2 are target binding sites found in untranslated regions of mRNA encoded by LOC151475, corresponding to target binding sites such as BINDING SITE I, BINDING SITE II or BINDING SITE III of FIG. 8. Table 4 illustrates the complementarity of the nucleotide sequences of LOC151475 BINDING SITE1 and LOC151475 BINDING SITE2, designated SEQ ID:4174 and SEQ ID:4371 respectively, to the nucleotide sequence of GAM7776 RNA, herein designated GAM RNA, also designated SEQ ID:246.

Another function of GAM7776 is therefore inhibition of LOC151475 (Accession XP_098063.1). Accordingly, utilities of GAM7776 include diagnosis, prevention and treatment of diseases and clinical conditions associated with LOC151475.

LOC151610 (Accession XP_087245.1) is another GAM7776 target gene, herein designated TARGET GENE. LOC151610 BINDING SITE is a target binding site found in the 5' untranslated region of mRNA encoded by LOC151610, corresponding to a target binding site such as BINDING SITE I, BINDING SITE II or BINDING SITE III of FIG. 8. Table 4 illustrates the complementarity of the nucleotide sequences of LOC151610 BINDING SITE, designated SEQ ID:2599, to the nucleotide sequence of GAM7776 RNA, herein designated GAM RNA, also designated SEQ ID:246.

Another function of GAM7776 is therefore inhibition of LOC151610 (Accession XP_087245.1). Accordingly, utilities of GAM7776 include diagnosis, prevention and treatment of diseases and clinical conditions associated with LOC151610.

LOC151636 (Accession NP_612144.1) is another GAM7776 target gene, herein designated TARGET GENE. LOC151636 BINDING SITE1 through LOC151636 BINDING SITE3 are target binding sites found in untranslated regions of mRNA encoded by LOC151636, corresponding to target binding sites such as BINDING SITE I, BINDING SITE II or BINDING SITE III of FIG. 8. Table 4 illustrates the complementarity of the nucleotide sequences of LOC151636 BINDING SITE1 through LOC151636 BINDING SITE3, designated SEQ ID:2693, SEQ ID:4151 and SEQ ID:14731 respectively, to the nucleotide sequence of GAM7776 RNA, herein designated GAM RNA, also designated SEQ ID:246.

Another function of GAM7776 is therefore inhibition of LOC151636 (Accession NP_612144.1). Accordingly, utilities of GAM7776 include diagnosis, prevention and treatment of diseases and clinical conditions associated with LOC151636.

LOC151657 (Accession XP_098100.2) is another GAM7776 target gene, herein designated TARGET GENE. LOC151657 BINDING SITE is a target binding site found in the 5' untranslated region of mRNA encoded by LOC151657, corresponding to a target binding site such as BINDING SITE I, BINDING SITE II or BINDING SITE III of FIG. 8. Table 4 illustrates the complementarity of the nucleotide sequences of LOC151657 BINDING SITE, designated SEQ ID:4248, to the nucleotide sequence of GAM7776 RNA, herein designated GAM RNA, also designated SEQ ID:246.

Another function of GAM7776 is therefore inhibition of LOC151657 (Accession XP_098100.2). Accordingly, utilities of GAM7776 include diagnosis, prevention and treatment of diseases and clinical conditions associated with LOC151657.

LOC151877 (Accession XP_098132.1) is another GAM7776 target gene, herein designated TARGET GENE. LOC151877 BINDING SITE is a target binding site found in the 3' untranslated region of mRNA encoded by LOC151877, corresponding to a target binding site such as BINDING SITE I, BINDING SITE II or BINDING SITE III of FIG. 8. Table 4 illustrates the complementarity of the nucleotide sequences of LOC151877 BINDING SITE, designated SEQ ID:4677, to the nucleotide sequence of GAM7776 RNA, herein designated GAM RNA, also designated SEQ ID:246.

Another function of GAM7776 is therefore inhibition of LOC151877 (Accession XP_098132.1). Accordingly, utilities of GAM7776 include diagnosis, prevention and treatment of diseases and clinical conditions associated with LOC151877.

LOC152245 (Accession XP_098182.1) is another GAM7776 target gene, herein designated TARGET GENE. LOC152245 BINDING SITE is a target binding site found in the 3' untranslated region of mRNA encoded by LOC152245, corresponding to a target binding site such as BINDING SITE I, BINDING SITE II or BINDING SITE III of FIG. 8. Table 4 illustrates the complementarity of the nucleotide sequences of LOC152245 BINDING SITE, designated SEQ ID:9470, to the nucleotide sequence of GAM7776 RNA, herein designated GAM RNA, also designated SEQ ID:246.

Another function of GAM7776 is therefore inhibition of LOC152245 (Accession XP_098182.1). Accordingly, utilities of GAM7776 include diagnosis, prevention and treatment of diseases and clinical conditions associated with LOC152245.

LOC152445 (Accession XP_098231.1) is another GAM7776 target gene, herein designated TARGET GENE. LOC152445 BINDING SITE is a target binding site found in the 3' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:2922, to the nucleotide sequence of GAM7776 RNA, herein designated GAM RNA, also designated SEQ ID:246.

Another function of GAM7776 is therefore inhibition of LOC152445 (Accession XP_098231.1). Accordingly, utilities of GAM7776 include diagnosis, prevention and treatment of diseases and clinical conditions associated with LOC152445.

LOC152620 (Accession XP_011108.2) is another GAM7776 target gene, herein designated TARGET GENE. LOC152620 BINDING SITE is a target binding site found in the 3' untranslated region of mRNA encoded by LOC152620, corresponding to a target binding site such as BINDING SITE I, BINDING SITE II or BINDING SITE III of FIG. 8. Table 4 illustrates the complementarity of the nucleotide sequences of LOC152620 BINDING SITE, designated SEQ ID:1745, to the nucleotide sequence of GAM7776 RNA, herein designated GAM RNA, also designated SEQ ID:246.

Another function of GAM7776 is therefore inhibition of LOC152620 (Accession XP_011108.2). Accordingly, utilities of GAM7776 include diagnosis, prevention and treatment of diseases and clinical conditions associated with LOC152620.

LOC152719 (Accession XP_098257.1) is another GAM7776 target gene, herein designated TARGET GENE. LOC152719 BINDING SITE1 and LOC152719 BINDING SITE2 are target binding sites found in untranslated regions of mRNA encoded by LOC152719, corresponding to target binding sites such as BINDING SITE I, BINDING SITE II or BINDING SITE III of FIG. 8. Table 4 illustrates the complementarity of the nucleotide sequences of LOC152719 BINDING SITE1 and LOC152719 BINDING SITE2, designated SEQ ID:11919 and SEQ ID:17637 respectively, to the nucleotide sequence of GAM7776 RNA, herein designated GAM RNA, also designated SEQ ID:246.

Another function of GAM7776 is therefore inhibition of LOC152719 (Accession XP_098257.1). Accordingly, utilities of GAM7776 include diagnosis, prevention and treatment of diseases and clinical conditions associated with LOC152719.

LOC152794 (Accession XP_087525.1) is another GAM7776 target gene, herein designated TARGET GENE. LOC152794 BINDING SITE is a target binding site found in the 5' untranslated region of mRNA encoded by LOC152794, corresponding to a target binding site such as BINDING SITE I, BINDING SITE II or BINDING SITE III of FIG. 8. Table 4 illustrates the complementarity of the nucleotide sequences of LOC152794 BINDING SITE, designated SEQ ID:2010, to the nucleotide sequence of GAM7776 RNA, herein designated GAM RNA, also designated SEQ ID:246.

Another function of GAM7776 is therefore inhibition of LOC152794 (Accession XP_087525.1). Accordingly, utilities of GAM7776 include diagnosis, prevention and treatment of diseases and clinical conditions associated with LOC152794.

LOC152804 (Accession XP_098266.2) is another GAM7776 target gene, herein designated TARGET GENE. LOC152804 BINDING SITE is a target binding site found in the 3' untranslated region of mRNA encoded by LOC152804, corresponding to a target binding site such as BINDING SITE I, BINDING SITE II or BINDING SITE III of FIG. 8. Table 4 illustrates the complementarity of the nucleotide sequences of LOC152804 BINDING SITE, designated SEQ ID:9568, to the nucleotide sequence of GAM7776 RNA, herein designated GAM RNA, also designated SEQ ID:246.

Another function of GAM7776 is therefore inhibition of LOC152804 (Accession XP_098266.2). Accordingly, utilities of GAM7776 include diagnosis, prevention and treatment of diseases and clinical conditions associated with LOC152804.

LOC153077 (Accession XP_098307.1) is another GAM7776 target gene, herein designated TARGET GENE. LOC153077 BINDING SITE is a target binding site found in the 3' untranslated region of mRNA encoded by LOC153077, corresponding to a target binding site such as BINDING SITE I, BINDING SITE II or BINDING SITE III of FIG. 8. Table 4 illustrates the complementarity of the nucleotide sequences of LOC153077 BINDING SITE, designated SEQ ID:5304, to the nucleotide sequence of GAM7776 RNA, herein designated GAM RNA, also designated SEQ ID:246.

Another function of GAM7776 is therefore inhibition of LOC153077 (Accession XP_098307.1). Accordingly, utilities of GAM7776 include diagnosis, prevention and treatment of diseases and clinical conditions associated with LOC153077.

LOC153811 (Accession XP_087779.2) is another GAM7776 target gene, herein designated TARGET GENE. LOC153811 BINDING SITE1 through LOC153811 BINDING SITE3 are target binding sites found in untranslated regions of mRNA encoded by LOC153811, corresponding to target binding sites such as BINDING SITE I, BINDING SITE II or BINDING SITE III of FIG. 8. Table 4 illustrates the complementarity of the nucleotide sequences of LOC153811 BINDING SITE1 through LOC153811 BINDING SITE3, designated SEQ ID:9683, SEQ ID:17512 and SEQ ID:19665 respectively, to the nucleotide sequence of GAM7776 RNA, herein designated GAM RNA, also designated SEQ ID:246.

Another function of GAM7776 is therefore inhibition of LOC153811 (Accession XP_087779.2). Accordingly, utilities of GAM7776 include diagnosis, prevention and treatment of diseases and clinical conditions associated with LOC153811.

LOC153883 (Accession XP_087798.1) is another GAM7776 target gene, herein designated TARGET GENE. LOC153883 BINDING SITE is a target binding site found in the 5' untranslated region of mRNA encoded by LOC153883, corresponding to a target binding site such as BINDING SITE I, BINDING SITE II or BINDING SITE III of FIG. 8. Table 4 illustrates the complementarity of the nucleotide sequences of LOC153883 BINDING SITE, designated SEQ ID:15929, to the nucleotide sequence of GAM7776 RNA, herein designated GAM RNA, also designated SEQ ID:246.

Another function of GAM7776 is therefore inhibition of LOC153883 (Accession XP_087798.1). Accordingly, utilities of GAM7776 include diagnosis, prevention and treatment of diseases and clinical conditions associated with LOC153883.

LOC153910 (Accession XP_087801.1) is another GAM7776 target gene, herein designated TARGET GENE. LOC153910 BINDING SITE is a target binding site found in the 5' untranslated region of mRNA encoded by LOC153910, corresponding to a target binding site such as BINDING SITE I, BINDING SITE II or BINDING SITE III of FIG. 8. Table 4 illustrates the complementarity of the nucleotide sequences of LOC153910 BINDING SITE, designated SEQ ID:2882, to the nucleotide sequence of GAM7776 RNA, herein designated GAM RNA, also designated SEQ ID:246.

Another function of GAM7776 is therefore inhibition of LOC153910 (Accession XP_087801.1). Accordingly, utilities of GAM7776 include diagnosis, prevention and treatment of diseases and clinical conditions associated with LOC153910.

LOC154282 (Accession XP_098505.1) is another GAM7776 target gene, herein designated TARGET GENE. LOC154282 BINDING SITE is a target binding site found in the 5' untranslated region of mRNA encoded by LOC154282, corresponding to a target binding site such as BINDING SITE I, BINDING SITE II or BINDING SITE III of FIG. 8. Table 4 illustrates the complementarity of the nucleotide sequences of LOC154282 BINDING SITE, designated SEQ ID:4307, to the nucleotide sequence of GAM7776 RNA, herein designated GAM RNA, also designated SEQ ID:246.

Another function of GAM7776 is therefore inhibition of LOC154282 (Accession XP_098505.1). Accordingly, utilities of GAM7776 include diagnosis, prevention and treatment of diseases and clinical conditions associated with LOC154282.

LOC154822 (Accession XP_098618.3) is another GAM7776 target gene, herein designated TARGET GENE. LOC154822 BINDING SITE is a target binding site found in the 5' untranslated region of mRNA encoded by LOC154822, corresponding to a target binding site such as BINDING SITE I, BINDING SITE II or BINDING SITE III of FIG. 8. Table 4 illustrates the complementarity of the nucleotide sequences of LOC154822 BINDING SITE, designated SEQ ID:19205, to the nucleotide sequence of GAM7776 RNA, herein designated GAM RNA, also designated SEQ ID:246.

Another function of GAM7776 is therefore inhibition of LOC154822 (Accession XP_098618.3). Accordingly, utilities of GAM7776 include diagnosis, prevention and treatment of diseases and clinical conditions associated with LOC154822.

LOC154877 (Accession XP_098626.1) is another GAM7776 target gene, herein designated TARGET GENE. LOC154877 BINDING SITE1 through LOC154877 BINDING SITE3 are target binding sites found in untranslated regions of mRNA encoded by LOC154877, corresponding to target binding sites such as BINDING SITE I, BINDING SITE II or BINDING SITE III of FIG. 8. Table 4 illustrates the complementarity of the nucleotide sequences of LOC154877 BINDING SITE1 through LOC154877 BINDING SITE3, designated SEQ ID:17731, SEQ ID:3200 and SEQ ID:16089 respectively, to the nucleotide sequence of GAM7776 RNA, herein designated GAM RNA, also designated SEQ ID:246.

Another function of GAM7776 is therefore inhibition of LOC154877 (Accession XP_098626.1). Accordingly, utilities of GAM7776 include diagnosis, prevention and treatment of diseases and clinical conditions associated with LOC154877.

LOC155066 (Accession XP_088142.4) is another GAM7776 target gene, herein designated TARGET GENE. LOC155066 BINDING SITE is a target binding site found in the 3' untranslated region of mRNA encoded by LOC155066, corresponding to a target binding site such as BINDING SITE I, BINDING SITE II or BINDING SITE III of FIG. 8. Table 4 illustrates the complementarity of the nucleotide sequences of LOC155066 BINDING SITE, designated SEQ ID:17980, to the nucleotide sequence of GAM7776 RNA, herein designated GAM RNA, also designated SEQ ID:246.

Another function of GAM7776 is therefore inhibition of LOC155066 (Accession XP_088142.4). Accordingly, utilities of GAM7776 include diagnosis, prevention and treatment of diseases and clinical conditions associated with LOC155066.

LOC158014 (Accession XP_088442.1) is another GAM7776 target gene, herein designated TARGET GENE. LOC158014 BINDING SITE is a target binding site found in the 5' untranslated region of mRNA encoded by LOC158014, corresponding to a target binding site such as BINDING SITE I, BINDING SITE II or BINDING SITE III of FIG. 8. Table 4 illustrates the complementarity of the nucleotide sequences of LOC158014 BINDING SITE, designated SEQ ID:2542, to the nucleotide sequence of GAM7776 RNA, herein designated GAM RNA, also designated SEQ ID:246.

Another function of GAM7776 is therefore inhibition of LOC158014 (Accession XP_088442.1). Accordingly, utilities of GAM7776 include diagnosis, prevention and treatment of diseases and clinical conditions associated with LOC158014.

LOC158228 (Accession XP_098903.4) is another GAM7776 target gene, herein designated TARGET GENE. LOC158228 BINDING SITE is a target binding site found in the 3' untranslated region of mRNA encoded by LOC158228, corresponding to a target binding site such as BINDING SITE I, BINDING SITE II or BINDING SITE III of FIG. 8. Table 4 illustrates the complementarity of the nucleotide sequences of LOC158228 BINDING SITE, designated SEQ ID:5779, to the nucleotide sequence of GAM7776 RNA, herein designated GAM RNA, also designated SEQ ID:246.

Another function of GAM7776 is therefore inhibition of LOC158228 (Accession XP_098903.4). Accordingly, utilities of GAM7776 include diagnosis, prevention and treatment of diseases and clinical conditions associated with LOC158228.

LOC158310 (Accession XP_098919.1) is another GAM7776 target gene, herein designated TARGET GENE. LOC158310 BINDING SITE is a target binding site found in the 5' untranslated region of mRNA encoded by LOC158310, corresponding to a target binding site such as BINDING SITE I, BINDING SITE II or BINDING SITE III of FIG. 8. Table 4 illustrates the complementarity of the nucleotide sequences of LOC158310 BINDING SITE, designated SEQ ID:14859, to the nucleotide sequence of GAM7776 RNA, herein designated GAM RNA, also designated SEQ ID:246.

Another function of GAM7776 is therefore inhibition of LOC158310 (Accession XP_098919.1). Accordingly, utilities of GAM7776 include diagnosis, prevention and treatment of diseases and clinical conditions associated with LOC158310.

LOC158381 (Accession XP_048461.1) is another GAM7776 target gene, herein designated TARGET GENE. LOC158381 BINDING SITE is a target binding site found in the 5' untranslated region of mRNA encoded by LOC158381, corresponding to a target binding site such as BINDING SITE I, BINDING SITE II or BINDING SITE III of FIG. 8. Table 4 illustrates the complementarity of the nucleotide sequences of LOC158381 BINDING SITE, designated SEQ ID:6212, to the nucleotide sequence of GAM7776 RNA, herein designated GAM RNA, also designated SEQ ID:246.

Another function of GAM7776 is therefore inhibition of LOC158381 (Accession XP_048461.1). Accordingly, utilities of GAM7776 include diagnosis, prevention and treatment of diseases and clinical conditions associated with LOC158381.

LOC158402 (Accession XP_098936.1) is another GAM7776 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:17964, to the nucleotide sequence of GAM7776 RNA, herein designated GAM RNA, also designated SEQ ID:246.

Another function of GAM7776 is therefore inhibition of LOC158402 (Accession XP_098936.1). Accordingly, utilities of GAM7776 include diagnosis, prevention and treatment of diseases and clinical conditions associated with LOC158402.

LOC158436 (Accession XP_098942.1) is another GAM7776 target gene, herein designated TARGET GENE. LOC158436 BINDING SITE is a target binding site found in the 3' untranslated region of mRNA encoded by LOC158436, corresponding to a target binding site such as BINDING SITE I, BINDING SITE II or BINDING SITE III of FIG. 8. Table 4 illustrates the complementarity of the nucleotide sequences of LOC158436 BINDING SITE, designated SEQ ID:1263, to the nucleotide sequence of GAM7776 RNA, herein designated GAM RNA, also designated SEQ ID:246.

Another function of GAM7776 is therefore inhibition of LOC158436 (Accession XP_098942.1). Accordingly, utilities of GAM7776 include diagnosis, prevention and treatment of diseases and clinical conditions associated with LOC158436.

LOC158476 (Accession XP_098955.1) is another GAM7776 target gene, herein designated TARGET GENE. LOC158476 BINDING SITE is a target binding site found in the 3' untranslated region of mRNA encoded by LOC158476, corresponding to a target binding site such as BINDING SITE I, BINDING SITE II or BINDING SITE III of FIG. 8. Table 4 illustrates the complementarity of the nucleotide sequences of LOC158476 BINDING SITE, designated SEQ ID:935, to the nucleotide sequence of GAM7776 RNA, herein designated GAM RNA, also designated SEQ ID:246.

Another function of GAM7776 is therefore inhibition of LOC158476 (Accession XP_098955.1). Accordingly, utilities of GAM7776 include diagnosis, prevention and treatment of diseases and clinical conditions associated with LOC158476.

LOC158572 (Accession XP_088608.1) is another GAM7776 target gene, herein designated TARGET GENE. LOC158572 BINDING SITE is a target binding site found in the 3' untranslated region of mRNA encoded by LOC158572, corresponding to a target binding site such as BINDING SITE I, BINDING SITE II or BINDING SITE III of FIG. 8. Table 4 illustrates the complementarity of the nucleotide sequences of LOC158572 BINDING SITE, designated SEQ ID:12003, to the nucleotide sequence of GAM7776 RNA, herein designated GAM RNA, also designated SEQ ID:246.

Another function of GAM7776 is therefore inhibition of LOC158572 (Accession XP_088608.1). Accordingly, utilities of GAM7776 include diagnosis, prevention and treatment of diseases and clinical conditions associated with LOC158572.

LOC158668 (Accession XP_045161.1) is another GAM7776 target gene, herein designated TARGET GENE. LOC158668 BINDING SITE is a target binding site found in the 3' untranslated region of mRNA encoded by LOC158668, corresponding to a target binding site such as BINDING SITE I, BINDING SITE II or BINDING SITE III of FIG. 8. Table 4 illustrates the complementarity of the nucleotide sequences of LOC158668 BINDING SITE, designated SEQ ID:16260, to the nucleotide sequence of GAM7776 RNA, herein designated GAM RNA, also designated SEQ ID:246.

Another function of GAM7776 is therefore inhibition of LOC158668 (Accession XP_045161.1). Accordingly, utilities of GAM7776 include diagnosis, prevention and treatment of diseases and clinical conditions associated with LOC158668.

LOC160897 (Accession XP_090573.3) is another GAM7776 target gene, herein designated TARGET GENE. LOC160897 BINDING SITE is a target binding site found in the 5' untranslated region of mRNA encoded by LOC160897, corresponding to a target binding site such as BINDING SITE I, BINDING SITE II or BINDING SITE III of FIG. 8. Table 4 illustrates the complementarity of the nucleotide sequences of LOC160897 BINDING SITE, designated SEQ ID:17208, to the nucleotide sequence of GAM7776 RNA, herein designated GAM RNA, also designated SEQ ID:246.

Another function of GAM7776 is therefore inhibition of LOC160897 (Accession XP_090573.3). Accordingly, utilities of GAM7776 include diagnosis, prevention and treatment of diseases and clinical conditions associated with LOC160897.

LOC162427 (Accession NP_835227.1) is another GAM7776 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:8231 and SEQ ID:8231 respectively, to the nucleotide sequence of GAM7776 RNA, herein designated GAM RNA, also designated SEQ ID:246.

Another function of GAM7776 is therefore inhibition of LOC162427 (Accession NP_835227.1). Accordingly, utilities of GAM7776 include diagnosis, prevention and treatment of diseases and clinical conditions associated with LOC162427.

LOC162427 (Accession NP_835227.1) is another GAM7776 target gene, herein designated TARGET GENE. LOC162427 BINDING SITE1 and LOC162427 BINDING SITE2 are target binding sites found in untranslated regions of multiple transcripts of mRNA encoded by LOC162427, corresponding to target binding sites such as BINDING SITE I, BINDING SITE II or BINDING SITE III of FIG. 8. Table 4 illustrates the complementarity of the nucleotide sequences of LOC162427 BINDING SITE1 and LOC162427 BINDING SITE2, designated SEQ ID:12068 and SEQ ID:12068 respectively, to the nucleotide sequence of GAM7776 RNA, herein designated GAM RNA, also designated SEQ ID:246.

Another function of GAM7776 is therefore inhibition of LOC162427 (Accession NP_835227.1). Accordingly, utilities of GAM7776 include diagnosis, prevention and treatment of diseases and clinical conditions associated with LOC162427.

LOC162962 (Accession XP_091886.7) is another GAM7776 target gene, herein designated TARGET GENE. LOC162962 BINDING SITE is a target binding site found in the 3' untranslated region of mRNA encoded by LOC162962, corresponding to a target binding site such as BINDING SITE I, BINDING SITE II or BINDING SITE III of FIG. 8. Table 4 illustrates the complementarity of the nucleotide sequences of LOC162962 BINDING SITE, designated SEQ ID:3249, to the nucleotide sequence of GAM7776 RNA, herein designated GAM RNA, also designated SEQ ID:246.

Another function of GAM7776 is therefore inhibition of LOC162962 (Accession XP_091886.7). Accordingly, utilities of GAM7776 include diagnosis, prevention and treatment of diseases and clinical conditions associated with LOC162962.

LOC162967 (Accession XP_091890.6) is another GAM7776 target gene, herein designated TARGET GENE. LOC162967 BINDING SITE is a target binding site found in the 3' untranslated region of mRNA encoded by LOC162967, corresponding to a target binding site such as BINDING SITE I, BINDING SITE II or BINDING SITE III of FIG. 8. Table 4 illustrates the complementarity of the nucleotide sequences of LOC162967 BINDING SITE, designated SEQ ID:13831, to the nucleotide sequence of GAM7776 RNA, herein designated GAM RNA, also designated SEQ ID:246.

Another function of GAM7776 is therefore inhibition of LOC162967 (Accession XP_091890.6). Accordingly, utilities of GAM7776 include diagnosis, prevention and treatment of diseases and clinical conditions associated with LOC162967.

LOC163227 (Accession NP_775802.1) is another GAM7776 target gene, herein designated TARGET GENE. LOC163227 BINDING SITE1 and LOC163227 BINDING SITE2 are target binding sites found in untranslated regions of mRNA encoded by LOC163227, corresponding to target binding sites such as BINDING SITE I, BINDING SITE II or BINDING SITE III of FIG. 8. Table 4 illustrates the complementarity of the nucleotide sequences of LOC163227 BINDING SITE1 and LOC163227 BINDING SITE2, designated SEQ ID:9147 and SEQ ID:11854 respectively, to the nucleotide sequence of GAM7776 RNA, herein designated GAM RNA, also designated SEQ ID:246.

Another function of GAM7776 is therefore inhibition of LOC163227 (Accession NP_775802.1). Accordingly, utilities of GAM7776 include diagnosis, prevention and treatment of diseases and clinical conditions associated with LOC163227.

LOC164091 (Accession XP_089356.1) is another GAM7776 target gene, herein designated TARGET GENE. LOC164091 BINDING SITE is a target binding site found in the 3' untranslated region of mRNA encoded by LOC164091, corresponding to a target binding site such as BINDING SITE I, BINDING SITE II or BINDING SITE III of FIG. 8. Table 4 illustrates the complementarity of the nucleotide sequences of LOC164091 BINDING SITE, designated SEQ ID:7989, to the nucleotide sequence of GAM7776 RNA, herein designated GAM RNA, also designated SEQ ID:246.

Another function of GAM7776 is therefore inhibition of LOC164091 (Accession XP_089356.1). Accordingly, utilities of GAM7776 include diagnosis, prevention and treatment of diseases and clinical conditions associated with LOC164091.

LOC168451 (Accession XP_095114.2) is another GAM7776 target gene, herein designated TARGET GENE. LOC168451 BINDING SITE is a target binding site found in the 3' untranslated region of mRNA encoded by LOC168451, corresponding to a target binding site such as BINDING SITE I, BINDING SITE II or BINDING SITE III of FIG. 8. Table 4 illustrates the complementarity of the nucleotide sequences of LOC168451 BINDING SITE, designated SEQ ID:19786, to the nucleotide sequence of GAM7776 RNA, herein designated GAM RNA, also designated SEQ ID:246.

Another function of GAM7776 is therefore inhibition of LOC168451 (Accession XP_095114.2). Accordingly, utilities of GAM7776 include diagnosis, prevention and treatment of diseases and clinical conditions associated with LOC168451.

LOC170409 (Accession XP_096330.1) is another GAM7776 target gene, herein designated TARGET GENE. LOC170409 BINDING SITE is a target binding site found in the 5' untranslated region of mRNA encoded by LOC170409, corresponding to a target binding site such as BINDING SITE I, BINDING SITE II or BINDING SITE III of FIG. 8. Table 4 illustrates the complementarity of the nucleotide sequences of LOC170409 BINDING SITE, designated SEQ ID:15561, to the nucleotide sequence of GAM7776 RNA, herein designated GAM RNA, also designated SEQ ID:246.

Another function of GAM7776 is therefore inhibition of LOC170409 (Accession XP_096330.1). Accordingly, utilities of GAM7776 include diagnosis, prevention and treatment of diseases and clinical conditions associated with LOC170409.

LOC196264 (Accession XP_113683.1) is another GAM7776 target gene, herein designated TARGET GENE. LOC196264 BINDING SITE is a target binding site found in the 3' untranslated region of mRNA encoded by LOC196264, corresponding to a target binding site such as BINDING SITE I, BINDING SITE II or BINDING SITE III of FIG. 8. Table 4 illustrates the complementarity of the nucleotide sequences of LOC196264 BINDING SITE, designated SEQ ID:2452, to the nucleotide sequence of GAM7776 RNA, herein designated GAM RNA, also designated SEQ ID:246.

Another function of GAM7776 is therefore inhibition of LOC196264 (Accession XP_113683.1). Accordingly, utilities of GAM7776 include diagnosis, prevention and treatment of diseases and clinical conditions associated with LOC196264.

LOC197342 (Accession XP_113869.1) is another GAM7776 target gene, herein designated TARGET GENE. LOC197342 BINDING SITE is a target binding site found in the 3' untranslated region of mRNA encoded by LOC197342, corresponding to a target binding site such as BINDING SITE I, BINDING SITE II or BINDING SITE III of FIG. 8. Table 4 illustrates the complementarity of the nucleotide sequences of LOC197342 BINDING SITE, designated SEQ ID:2432, to the nucleotide sequence of GAM7776 RNA, herein designated GAM RNA, also designated SEQ ID:246.

Another function of GAM7776 is therefore inhibition of LOC197342 (Accession XP_113869.1). Accordingly, utilities of GAM7776 include diagnosis, prevention and treatment of diseases and clinical conditions associated with LOC197342.

LOC197358 (Accession XP_113872.2) is another GAM7776 target gene, herein designated TARGET GENE. LOC197358 BINDING SITE1 and LOC197358 BINDING SITE2 are target binding sites found in untranslated regions of mRNA encoded by LOC197358, corresponding to target binding sites such as BINDING SITE I, BINDING SITE II or BINDING SITE III of FIG. 8. Table 4 illustrates the complementarity of the nucleotide sequences of LOC197358 BINDING SITE1 and LOC197358 BINDING SITE2, designated SEQ ID:4625 and SEQ ID:6387 respectively, to the nucleotide sequence of GAM7776 RNA, herein designated GAM RNA, also designated SEQ ID:246.

Another function of GAM7776 is therefore inhibition of LOC197358 (Accession XP_113872.2). Accordingly, utilities of GAM7776 include diagnosis, prevention and treatment of diseases and clinical conditions associated with LOC197358.

LOC199725 (Accession XP_117119.1) is another GAM7776 target gene, herein designated TARGET GENE. LOC199725 BINDING SITE is a target binding site found in the 5' untranslated region of mRNA encoded by LOC199725, corresponding to a target binding site such as BINDING SITE I, BINDING SITE II or BINDING SITE III of FIG. 8. Table 4 illustrates the complementarity of the nucleotide sequences of LOC199725 BINDING SITE, designated SEQ ID:10884, to the nucleotide sequence of GAM7776 RNA, herein designated GAM RNA, also designated SEQ ID:246.

Another function of GAM7776 is therefore inhibition of LOC199725 (Accession XP_117119.1). Accordingly, utilities of GAM7776 include diagnosis, prevention and treatment of diseases and clinical conditions associated with LOC199725.

LOC199899 (Accession XP_117153.1) is another GAM7776 target gene, herein designated TARGET GENE. LOC199899 BINDING SITE1 and LOC199899 BINDING SITE2 are target binding sites found in untranslated regions of mRNA encoded by LOC199899, corresponding to target binding sites such as BINDING SITE I, BINDING SITE II or BINDING SITE III of FIG. 8. Table 4 illustrates the complementarity of the nucleotide sequences of LOC199899 BINDING SITE1 and LOC199899 BINDING SITE2, designated SEQ ID:8292 and SEQ ID:5253 respectively, to the nucleotide sequence of GAM7776 RNA, herein designated GAM RNA, also designated SEQ ID:246.

Another function of GAM7776 is therefore inhibition of LOC199899 (Accession XP_117153.1). Accordingly, utilities of GAM7776 include diagnosis, prevention and treatment of diseases and clinical conditions associated with LOC199899.

LOC199906 (Accession XP_114052.1) is another GAM7776 target gene, herein designated TARGET GENE. LOC199906 BINDING SITE is a target binding site found in the 3' untranslated region of mRNA encoded by LOC199906, corresponding to a target binding site such as BINDING SITE I, BINDING SITE II or BINDING SITE III of FIG. 8. Table 4 illustrates the complementarity of the nucleotide sequences of LOC199906 BINDING SITE, designated SEQ ID:19756, to the nucleotide sequence of GAM7776 RNA, herein designated GAM RNA, also designated SEQ ID:246.

Another function of GAM7776 is therefore inhibition of LOC199906 (Accession XP_114052.1). Accordingly, utilities of GAM7776 include diagnosis, prevention and treatment of diseases and clinical conditions associated with LOC199906.

LOC200169 (Accession XP_211599.1) is another GAM7776 target gene, herein designated TARGET GENE. LOC200169 BINDING SITE1 and LOC200169 BINDING SITE2 are target binding sites found in untranslated regions of multiple transcripts of mRNA encoded by LOC200169, corresponding to target binding sites such as BINDING SITE I, BINDING SITE II or BINDING SITE III of FIG. 8. Table 4 illustrates the complementarity of the nucleotide sequences of LOC200169 BINDING SITE1 and LOC200169 BINDING SITE2, designated SEQ ID:5066 and SEQ ID:6122 respectively, to the nucleotide sequence of GAM7776 RNA, herein designated GAM RNA, also designated SEQ ID:246.

Another function of GAM7776 is therefore inhibition of LOC200169 (Accession XP_211599.1). Accordingly, utilities of GAM7776 include diagnosis, prevention and treatment of diseases and clinical conditions associated with LOC200169.

LOC200844 (Accession XP_114306.1) is another GAM7776 target gene, herein designated TARGET GENE. LOC200844 BINDING SITE is a target binding site found in the 5' untranslated region of mRNA encoded by LOC200844, corresponding to a target binding site such as BINDING SITE I, BINDING SITE II or BINDING SITE III of FIG. 8. Table 4 illustrates the complementarity of the nucleotide sequences of LOC200844 BINDING SITE, designated SEQ ID:16540, to the nucleotide sequence of GAM7776 RNA, herein designated GAM RNA, also designated SEQ ID:246.

Another function of GAM7776 is therefore inhibition of LOC200844 (Accession XP_114306.1). Accordingly, utilities of GAM7776 include diagnosis, prevention and treatment of diseases and clinical conditions associated with LOC200844.

LOC200860 (Accession XP_117289.1) is another GAM7776 target gene, herein designated TARGET GENE. LOC200860 BINDING SITE1 and LOC200860 BINDING SITE2 are target binding sites found in untranslated regions of mRNA encoded by LOC200860, corresponding to target binding sites such as BINDING SITE I, BINDING SITE II or BINDING SITE III of FIG. 8. Table 4 illustrates the complementarity of the nucleotide sequences of LOC200860 BINDING SITE1 and LOC200860 BINDING SITE2, designated SEQ ID:4175 and SEQ ID:12075 respectively, to the nucleotide sequence of GAM7776 RNA, herein designated GAM RNA, also designated SEQ ID:246.

Another function of GAM7776 is therefore inhibition of LOC200860 (Accession XP_117289.1). Accordingly, utilities of GAM7776 include diagnosis, prevention and treatment of diseases and clinical conditions associated with LOC200860.

LOC200895 (Accession NP_789785.1) is another GAM7776 target gene, herein designated TARGET GENE. LOC200895 BINDING SITE1 and LOC200895 BINDING SITE2 are target binding sites found in untranslated regions of mRNA encoded by LOC200895, corresponding to target binding sites such as BINDING SITE I, BINDING SITE II or BINDING SITE III of FIG. 8. Table 4 illustrates the complementarity of the nucleotide sequences of LOC200895 BINDING SITE1 and LOC200895 BINDING SITE2, designated SEQ ID:11863 and SEQ ID:17681 respectively, to the nucleotide sequence of GAM7776 RNA, herein designated GAM RNA, also designated SEQ ID:246.

Another function of GAM7776 is therefore inhibition of LOC200895 (Accession NP_789785.1). Accordingly, utilities of GAM7776 include diagnosis, prevention and treatment of diseases and clinical conditions associated with LOC200895.

LOC200916 (Accession XP_114317.3) is another GAM7776 target gene, herein designated TARGET GENE. LOC200916 BINDING SITE is a target binding site found in the 3' untranslated region of mRNA encoded by LOC200916, corresponding to a target binding site such as BINDING SITE I, BINDING SITE II or BINDING SITE III of FIG. 8. Table 4 illustrates the complementarity of the nucleotide sequences of LOC200916 BINDING SITE, designated SEQ ID:3465, to the nucleotide sequence of GAM7776 RNA, herein designated GAM RNA, also designated SEQ ID:246.

Another function of GAM7776 is therefore inhibition of LOC200916 (Accession XP_114317.3). Accordingly, utilities of GAM7776 include diagnosis, prevention and treatment of diseases and clinical conditions associated with LOC200916.

LOC201164 (Accession XP_290750.1) is another GAM7776 target gene, herein designated TARGET GENE. LOC201164 BINDING SITE1 and LOC201164 BINDING SITE2 are target binding sites found in untranslated regions of multiple transcripts of mRNA encoded by LOC201164, corresponding to target binding sites such as BINDING SITE I, BINDING SITE II or BINDING SITE III of FIG. 8. Table 4 illustrates the complementarity of the nucleotide sequences of LOC201164 BINDING SITE1 and LOC201164 BINDING SITE2, designated SEQ ID:13384 and SEQ ID:16993 respectively, to the nucleotide sequence of GAM7776 RNA, herein designated GAM RNA, also designated SEQ ID:246.

Another function of GAM7776 is therefore inhibition of LOC201164 (Accession XP_290750.1). Accordingly, utilities of GAM7776 include diagnosis, prevention and treatment of diseases and clinical conditions associated with LOC201164.

LOC201292 (Accession NP_775818.1) is another GAM7776 target gene, herein designated TARGET GENE. LOC201292 BINDING SITE is a target binding site found in the 3' untranslated region of mRNA encoded by LOC201292, corresponding to a target binding site such as BINDING SITE I, BINDING SITE II or BINDING SITE III of FIG. 8. Table 4 illustrates the complementarity of the nucleotide sequences of LOC201292 BINDING SITE, designated SEQ ID:4556, to the nucleotide sequence of GAM7776 RNA, herein designated GAM RNA, also designated SEQ ID:246.

Another function of GAM7776 is therefore inhibition of LOC201292 (Accession NP_775818.1). Accordingly, utilities of GAM7776 include diagnosis, prevention and treatment of diseases and clinical conditions associated with LOC201292.

LOC201562 (Accession XP_114343.2) is another GAM7776 target gene, herein designated TARGET GENE. LOC201562 BINDING SITE is a target binding site found in the 3' untranslated region of mRNA encoded by LOC201562, corresponding to a target binding site such as BINDING SITE I, BINDING SITE II or BINDING SITE III of FIG. 8. Table 4 illustrates the complementarity of the nucleotide sequences of LOC201562 BINDING SITE, designated SEQ ID:15044, to the nucleotide sequence of GAM7776 RNA, herein designated GAM RNA, also designated SEQ ID:246.

Another function of GAM7776 is therefore inhibition of LOC201562 (Accession XP_114343.2). Accordingly, utilities of GAM7776 include diagnosis, prevention and treatment of diseases and clinical conditions associated with LOC201562.

LOC201725 (Accession XP_114370.1) is another GAM7776 target gene, herein designated TARGET GENE. LOC201725 BINDING SITE is a target binding site found in the 3' untranslated region of mRNA encoded by LOC201725, corresponding to a target binding site such as BINDING SITE I, BINDING SITE II or BINDING SITE III of FIG. 8. Table 4 illustrates the complementarity of the nucleotide sequences of LOC201725 BINDING SITE, designated SEQ ID:5492, to the nucleotide sequence of GAM7776 RNA, herein designated GAM RNA, also designated SEQ ID:246.

Another function of GAM7776 is therefore inhibition of LOC201725 (Accession XP_114370.1). Accordingly, utilities of GAM7776 include diagnosis, prevention and treatment of diseases and clinical conditions associated with LOC201725.

LOC202400 (Accession XP_117397.1) is another GAM7776 target gene, herein designated TARGET GENE. LOC202400 BINDING SITE is a target binding site found in the 5' untranslated region of mRNA encoded by LOC202400, corresponding to a target binding site such as BINDING SITE I, BINDING SITE II or BINDING SITE III of FIG. 8. Table 4 illustrates the complementarity of the nucleotide sequences of LOC202400 BINDING SITE, designated SEQ ID:9145, to the nucleotide sequence of GAM7776 RNA, herein designated GAM RNA, also designated SEQ ID:246.

Another function of GAM7776 is therefore inhibition of LOC202400 (Accession XP_117397.1). Accordingly, utilities of GAM7776 include diagnosis, prevention and treatment of diseases and clinical conditions associated with LOC202400.

LOC202404 (Accession XP_114481.4) is another GAM7776 target gene, herein designated TARGET GENE. LOC202404 BINDING SITE is a target binding site found in the 3' untranslated region of mRNA encoded by LOC202404, corresponding to a target binding site such as BINDING SITE I, BINDING SITE II or BINDING SITE III of FIG. 8. Table 4 illustrates the complementarity of the nucleotide sequences of LOC202404 BINDING SITE, designated SEQ ID:18628, to the nucleotide sequence of GAM7776 RNA, herein designated GAM RNA, also designated SEQ ID:246.

Another function of GAM7776 is therefore inhibition of LOC202404 (Accession XP_114481.4). Accordingly, utilities of GAM7776 include diagnosis, prevention and treatment of diseases and clinical conditions associated with LOC202404.

LOC202460 (Accession XP_114493.1) is another GAM7776 target gene, herein designated TARGET GENE. LOC202460 BINDING SITE is a target binding site found in the 5' untranslated region of mRNA encoded by LOC202460, corresponding to a target binding site such as BINDING SITE I, BINDING SITE II or BINDING SITE III of FIG. 8. Table 4 illustrates the complementarity of the nucleotide sequences of LOC202460 BINDING SITE, designated SEQ ID:16450, to the nucleotide sequence of GAM7776 RNA, herein designated GAM RNA, also designated SEQ ID:246.

Another function of GAM7776 is therefore inhibition of LOC202460 (Accession XP_114493.1). Accordingly, utilities of GAM7776 include diagnosis, prevention and treatment of diseases and clinical conditions associated with LOC202460.

LOC202934 (Accession XP_117486.2) is another GAM7776 target gene, herein designated TARGET GENE. LOC202934 BINDING SITE1 and LOC202934 BINDING SITE2 are target binding sites found in untranslated regions of mRNA encoded by LOC202934, corresponding to target binding sites such as BINDING SITE I, BINDING SITE II or BINDING SITE III of FIG. 8. Table 4 illustrates the complementarity of the nucleotide sequences of LOC202934 BINDING SITE1 and LOC202934 BINDING SITE2, designated SEQ ID:1729 and SEQ ID:4820 respectively, to the nucleotide sequence of GAM7776 RNA, herein designated GAM RNA, also designated SEQ ID:246.

Another function of GAM7776 is therefore inhibition of LOC202934 (Accession XP_117486.2). Accordingly, utilities of GAM7776 include diagnosis, prevention and treatment of diseases and clinical conditions associated with LOC202934.

LOC203547 (Accession XP_114719.1) is another GAM7776 target gene, herein designated TARGET GENE. LOC203547 BINDING SITE1 and LOC203547 BINDING SITE2 are target binding sites found in untranslated regions of mRNA encoded by LOC203547, corresponding to target binding sites such as BINDING SITE I, BINDING SITE II or BINDING SITE III of FIG. 8. Table 4 illustrates the complementarity of the nucleotide sequences of LOC203547 BINDING SITE1 and LOC203547 BINDING SITE2, designated SEQ ID:9545 and SEQ ID:2351 respectively, to the nucleotide sequence of GAM7776 RNA, herein designated GAM RNA, also designated SEQ ID:246.

Another function of GAM7776 is therefore inhibition of LOC203547 (Accession XP_114719.1). Accordingly, utilities of GAM7776 include diagnosis, prevention and treatment of diseases and clinical conditions associated with LOC203547.

LOC204288 (Accession XP_115295.1) is another GAM7776 target gene, herein designated TARGET GENE. LOC204288 BINDING SITE is a target binding site found in the 3' untranslated region of mRNA encoded by LOC204288, corresponding to a target binding site such as BINDING SITE I, BINDING SITE II or BINDING SITE III of FIG. 8. Table 4 illustrates the complementarity of the nucleotide sequences of LOC204288 BINDING SITE, designated SEQ ID:10724, to the nucleotide sequence of GAM7776 RNA, herein designated GAM RNA, also designated SEQ ID:246.

Another function of GAM7776 is therefore inhibition of LOC204288 (Accession XP_115295.1). Accordingly, utilities of GAM7776 include diagnosis, prevention and treatment of diseases and clinical conditions associated with LOC204288.

LOC219293 (Accession XP_166599.2) is another GAM7776 target gene, herein designated TARGET GENE. LOC219293 BINDING SITE is a target binding site found in the 3' untranslated region of mRNA encoded by LOC219293, corresponding to a target binding site such as BINDING SITE I, BINDING SITE II or BINDING SITE III of FIG. 8. Table 4 illustrates the complementarity of the nucleotide sequences of LOC219293 BINDING SITE, designated SEQ ID:19361, to the nucleotide sequence of GAM7776 RNA, herein designated GAM RNA, also designated SEQ ID:246.

Another function of GAM7776 is therefore inhibition of LOC219293 (Accession XP_166599.2). Accordingly, utilities of GAM7776 include diagnosis, prevention and treatment of diseases and clinical conditions associated with LOC219293.

LOC219700 (Accession XP_167570.1) is another GAM7776 target gene, herein designated TARGET GENE. LOC219700 BINDING SITE is a target binding site found in the 5' untranslated region of mRNA encoded by LOC219700, corresponding to a target binding site such as BINDING SITE I, BINDING SITE II or BINDING SITE III of FIG. 8. Table 4 illustrates the complementarity of the nucleotide sequences of LOC219700 BINDING SITE, designated SEQ ID:2410, to the nucleotide sequence of GAM7776 RNA, herein designated GAM RNA, also designated SEQ ID:246.

Another function of GAM7776 is therefore inhibition of LOC219700 (Accession XP_167570.1). Accordingly, utilities of GAM7776 include diagnosis, prevention and treatment of diseases and clinical conditions associated with LOC219700.

LOC219731 (Accession XP_167596.1) is another GAM7776 target gene, herein designated TARGET GENE. LOC219731 BINDING SITE is a target binding site found in the 5' untranslated region of mRNA encoded by LOC219731, corresponding to a target binding site such as BINDING SITE I, BINDING SITE II or BINDING SITE III of FIG. 8. Table 4 illustrates the complementarity of the nucleotide sequences of LOC219731 BINDING SITE, designated SEQ ID:4678, to the nucleotide sequence of GAM7776 RNA, herein designated GAM RNA, also designated SEQ ID:246.

Another function of GAM7776 is therefore inhibition of LOC219731 (Accession XP_167596.1). Accordingly, utilities of GAM7776 include diagnosis, prevention and treatment of diseases and clinical conditions associated with LOC219731.

LOC219735 (Accession XP_167601.1) is another GAM7776 target gene, herein designated TARGET GENE. LOC219735 BINDING SITE is a target binding site found in the 3' untranslated region of mRNA encoded by LOC219735, corresponding to a target binding site such as BINDING SITE I, BINDING SITE II or BINDING SITE III of FIG. 8. Table 4 illustrates the complementarity of the nucleotide sequences of LOC219735 BINDING SITE, designated SEQ ID:18913, to the nucleotide sequence of GAM7776 RNA, herein designated GAM RNA, also designated SEQ ID:246.

Another function of GAM7776 is therefore inhibition of LOC219735 (Accession XP_167601.1). Accordingly, utilities of GAM7776 include diagnosis, prevention and treatment of diseases and clinical conditions associated with LOC219735.

LOC219894 (Accession XP_167782.1) is another GAM7776 target gene, herein designated TARGET GENE. LOC219894 BINDING SITE is a target binding site found in the 3' untranslated region of mRNA encoded by LOC219894, corresponding to a target binding site such as BINDING SITE I, BINDING SITE II or BINDING SITE III of FIG. 8. Table 4 illustrates the complementarity of the nucleotide sequences of LOC219894 BINDING SITE, designated SEQ ID:14588, to the nucleotide sequence of GAM7776 RNA, herein designated GAM RNA, also designated SEQ ID:246.

Another function of GAM7776 is therefore inhibition of LOC219894 (Accession XP_167782.1). Accordingly, utilities of GAM7776 include diagnosis, prevention and treatment of diseases and clinical conditions associated with LOC219894.

LOC220074 (Accession NP_660352.1) is another GAM7776 target gene, herein designated TARGET GENE. LOC220074 BINDING SITE1 through LOC220074 BINDING SITE3 are target binding sites found in untranslated regions of mRNA encoded by LOC220074, corresponding to target binding sites such as BINDING SITE I, BINDING SITE II or BINDING SITE III of FIG. 8. Table 4 illustrates the complementarity of the nucleotide sequences of LOC220074 BINDING SITE1 through LOC220074 BINDING SITE3, designated SEQ ID:16838, SEQ ID:9147 and SEQ ID:6497 respectively, to the nucleotide sequence of GAM7776 RNA, herein designated GAM RNA, also designated SEQ ID:246.

Another function of GAM7776 is therefore inhibition of LOC220074 (Accession NP_660352.1). Accordingly, utilities of GAM7776 include diagnosis, prevention and treatment of diseases and clinical conditions associated with LOC220074.

LOC221174 (Accession XP_167915.1) is another GAM7776 target gene, herein designated TARGET GENE. LOC221174 BINDING SITE is a target binding site found in the 5' untranslated region of mRNA encoded by LOC221174, corresponding to a target binding site such as BINDING SITE I, BINDING SITE II or BINDING SITE III of FIG. 8. Table 4 illustrates the complementarity of the nucleotide sequences of LOC221174 BINDING SITE, designated SEQ ID:17256, to the nucleotide sequence of GAM7776 RNA, herein designated GAM RNA, also designated SEQ ID:246.

Another function of GAM7776 is therefore inhibition of LOC221174 (Accession XP_167915.1). Accordingly, utilities of GAM7776 include diagnosis, prevention and treatment of diseases and clinical conditions associated with LOC221174.

LOC221663 (Accession XP_168131.1) is another GAM7776 target gene, herein designated TARGET GENE. LOC221663 BINDING SITE is a target binding site found in the 5' untranslated region of mRNA encoded by LOC221663, corresponding to a target binding site such as BINDING SITE I, BINDING SITE II or BINDING SITE III of FIG. 8. Table 4 illustrates the complementarity of the nucleotide sequences of LOC221663 BINDING SITE, designated SEQ ID:1939, to the nucleotide sequence of GAM7776 RNA, herein designated GAM RNA, also designated SEQ ID:246.

Another function of GAM7776 is therefore inhibition of LOC221663 (Accession XP_168131.1). Accordingly, utilities of GAM7776 include diagnosis, prevention and treatment of diseases and clinical conditions associated with LOC221663.

LOC221946 (Accession XP_168340.1) is another GAM7776 target gene, herein designated TARGET GENE. LOC221946 BINDING SITE is a target binding site found in the 3' untranslated region of mRNA encoded by LOC221946, corresponding to a target binding site such as BINDING SITE I, BINDING SITE II or BINDING SITE III of FIG. 8. Table 4 illustrates the complementarity of the nucleotide sequences of LOC221946 BINDING SITE, designated SEQ ID:15948, to the nucleotide sequence of GAM7776 RNA, herein designated GAM RNA, also designated SEQ ID:246.

Another function of GAM7776 is therefore inhibition of LOC221946 (Accession XP_168340.1). Accordingly, utilities of GAM7776 include diagnosis, prevention and treatment of diseases and clinical conditions associated with LOC221946.

LOC221960 (Accession XP_165859.1) is another GAM7776 target gene, herein designated TARGET GENE. LOC221960 BINDING SITE is a target binding site found in the 3' untranslated region of mRNA encoded by LOC221960, corresponding to a target binding site such as BINDING SITE I, BINDING SITE II or BINDING SITE III of FIG. 8. Table 4 illustrates the complementarity of the nucleotide sequences of LOC221960 BINDING SITE, designated SEQ ID:14860, to the nucleotide sequence of GAM7776 RNA, herein designated GAM RNA, also designated SEQ ID:246.

Another function of GAM7776 is therefore inhibition of LOC221960 (Accession XP_165859.1). Accordingly, utilities of GAM7776 include diagnosis, prevention and treatment of diseases and clinical conditions associated with LOC221960.

LOC221964 (Accession XP_168342.1) is another GAM7776 target gene, herein designated TARGET GENE. LOC221964 BINDING SITE is a target binding site found in the 3' untranslated region of mRNA encoded by LOC221964, corresponding to a target binding site such as BINDING SITE I, BINDING SITE II or BINDING SITE III of FIG. 8. Table 4 illustrates the complementarity of the nucleotide sequences of LOC221964 BINDING SITE, designated SEQ ID:17029, to the nucleotide sequence of GAM7776 RNA, herein designated GAM RNA, also designated SEQ ID:246.

Another function of GAM7776 is therefore inhibition of LOC221964 (Accession XP_168342.1). Accordingly, utilities of GAM7776 include diagnosis, prevention and treatment of diseases and clinical conditions associated with LOC221964.

LOC222057 (Accession XP_166594.2) is another GAM7776 target gene, herein designated TARGET GENE. LOC222057 BINDING SITE is a target binding site found in the 5' untranslated region of mRNA encoded by LOC222057, corresponding to a target binding site such as BINDING SITE I, BINDING SITE II or BINDING SITE III of FIG. 8. Table 4 illustrates the complementarity of the nucleotide sequences of LOC222057 BINDING SITE, designated SEQ ID:12803, to the nucleotide sequence of GAM7776 RNA, herein designated GAM RNA, also designated SEQ ID:246.

Another function of GAM7776 is therefore inhibition of LOC222057 (Accession XP_166594.2). Accordingly, utilities of GAM7776 include diagnosis, prevention and treatment of diseases and clinical conditions associated with LOC222057.

LOC222068 (Accession XP_166556.1) is another GAM7776 target gene, herein designated TARGET GENE. LOC222068 BINDING SITE is a target binding site found in the 3' untranslated region of mRNA encoded by LOC222068, corresponding to a target binding site such as BINDING SITE I, BINDING SITE II or BINDING SITE III of FIG. 8. Table 4 illustrates the complementarity of the nucleotide sequences of LOC222068 BINDING SITE, designated SEQ ID:3232, to the nucleotide sequence of GAM7776 RNA, herein designated GAM RNA, also designated SEQ ID:246.

Another function of GAM7776 is therefore inhibition of LOC222068 (Accession XP_166556.1). Accordingly, utilities of GAM7776 include diagnosis, prevention and treatment of diseases and clinical conditions associated with LOC222068.

LOC222159 (Accession XP_212100.1) is another GAM7776 target gene, herein designated TARGET GENE. LOC222159 BINDING SITE is a target binding site found in the 5' untranslated region of multiple transcripts of mRNA encoded by LOC222159, corresponding to a target binding site such as BINDING SITE I, BINDING SITE II or BINDING SITE III of FIG. 8. Table 4 illustrates the complementarity of the nucleotide sequences of LOC222159 BINDING SITE, designated SEQ ID:16228, to the nucleotide sequence of GAM7776 RNA, herein designated GAM RNA, also designated SEQ ID:246.

Another function of GAM7776 is therefore inhibition of LOC222159 (Accession XP_212100.1). Accordingly, utilities of GAM7776 include diagnosis, prevention and treatment of diseases and clinical conditions associated with LOC222159.

LOC252983 (Accession XP_170858.2) is another GAM7776 target gene, herein designated TARGET GENE. LOC252983 BINDING SITE is a target binding site found in the 3' untranslated region of mRNA encoded by LOC252983, corresponding to a target binding site such as BINDING SITE I, BINDING SITE II or BINDING SITE III of FIG. 8. Table 4 illustrates the complementarity of the nucleotide sequences of LOC252983 BINDING SITE, designated SEQ ID:2959, to the nucleotide sequence of GAM7776 RNA, herein designated GAM RNA, also designated SEQ ID:246.

Another function of GAM7776 is therefore inhibition of LOC252983 (Accession XP_170858.2). Accordingly, utilities of GAM7776 include diagnosis, prevention and treatment of diseases and clinical conditions associated with LOC252983.

LOC253612 (Accession XP_172985.2) is another GAM7776 target gene, herein designated TARGET GENE. LOC253612 BINDING SITE is a target binding site found in the 5' untranslated region of mRNA encoded by LOC253612, corresponding to a target binding site such as BINDING SITE I, BINDING SITE II or BINDING SITE III of FIG. 8. Table 4 illustrates the complementarity of the nucleotide sequences of LOC253612 BINDING SITE, designated SEQ ID:5487, to the nucleotide sequence of GAM7776 RNA, herein designated GAM RNA, also designated SEQ ID:246.

Another function of GAM7776 is therefore inhibition of LOC253612 (Accession XP_172985.2). Accordingly, utilities of GAM7776 include diagnosis, prevention and treatment of diseases and clinical conditions associated with LOC253612.

LOC253805 (Accession XP_172854.1) is another GAM7776 target gene, herein designated TARGET GENE. LOC253805 BINDING SITE is a target binding site found in the 3' untranslated region of mRNA encoded by LOC253805, corresponding to a target binding site such as BINDING SITE I, BINDING SITE II or BINDING SITE III of FIG. 8. Table 4 illustrates the complementarity of the nucleotide sequences of LOC253805 BINDING SITE, designated SEQ ID:4532, to the nucleotide sequence of GAM7776 RNA, herein designated GAM RNA, also designated SEQ ID:246.

Another function of GAM7776 is therefore inhibition of LOC253805 (Accession XP_172854.1). Accordingly, utilities of GAM7776 include diagnosis, prevention and treatment of diseases and clinical conditions associated with LOC253805.

LOC254875 (Accession XP_171170.1) is another GAM7776 target gene, herein designated TARGET GENE. LOC254875 BINDING SITE is a target binding site found in the 3' untranslated region of mRNA encoded by LOC254875, corresponding to a target binding site such as BINDING SITE I, BINDING SITE II or BINDING SITE III of FIG. 8. Table 4 illustrates the complementarity of the nucleotide sequences of LOC254875 BINDING SITE, designated SEQ ID:6188, to the nucleotide sequence of GAM7776 RNA, herein designated GAM RNA, also designated SEQ ID:246.

Another function of GAM7776 is therefore inhibition of LOC254875 (Accession XP_171170.1). Accordingly, utilities of GAM7776 include diagnosis, prevention and treatment of diseases and clinical conditions associated with LOC254875.

LOC255031 (Accession XP_173187.1) is another GAM7776 target gene, herein designated TARGET GENE. LOC255031 BINDING SITE is a target binding site found in the 3' untranslated region of mRNA encoded by LOC255031, corresponding to a target binding site such as BINDING SITE I, BINDING SITE II or BINDING SITE III of FIG. 8. Table 4 illustrates the complementarity of the nucleotide sequences of LOC255031 BINDING SITE, designated SEQ ID:3261, to the nucleotide sequence of GAM7776 RNA, herein designated GAM RNA, also designated SEQ ID:246.

Another function of GAM7776 is therefore inhibition of LOC255031 (Accession XP_173187.1). Accordingly, utilities of GAM7776 include diagnosis, prevention and treatment of diseases and clinical conditions associated with LOC255031.

LOC255177 (Accession XP_172941.1) is another GAM7776 target gene, herein designated TARGET GENE. LOC255177 BINDING SITE is a target binding site found in the 3' untranslated region of mRNA encoded by LOC255177, corresponding to a target binding site such as BINDING SITE I, BINDING SITE II or BINDING SITE III of FIG. 8. Table 4 illustrates the complementarity of the nucleotide sequences of LOC255177 BINDING SITE, designated SEQ ID:6294, to the nucleotide sequence of GAM7776 RNA, herein designated GAM RNA, also designated SEQ ID:246.

Another function of GAM7776 is therefore inhibition of LOC255177 (Accession XP_172941.1). Accordingly, utilities of GAM7776 include diagnosis, prevention and treatment of diseases and clinical conditions associated with LOC255177.

LOC255458 (Accession XP_173150.1) is another GAM7776 target gene, herein designated TARGET GENE. LOC255458 BINDING SITE is a target binding site found in the 5' untranslated region of mRNA encoded by LOC255458, corresponding to a target binding site such as BINDING SITE I, BINDING SITE II or BINDING SITE III of FIG. 8. Table 4 illustrates the complementarity of the nucleotide sequences of LOC255458 BINDING SITE, designated SEQ ID:6365, to the nucleotide sequence of GAM7776 RNA, herein designated GAM RNA, also designated SEQ ID:246.

Another function of GAM7776 is therefore inhibition of LOC255458 (Accession XP_173150.1). Accordingly, utilities of GAM7776 include diagnosis, prevention and treatment of diseases and clinical conditions associated with LOC255458.

LOC255488 (Accession XP_172581.2) is another GAM7776 target gene, herein designated TARGET GENE. LOC255488 BINDING SITE is a target binding site found in the 3' untranslated region of mRNA encoded by LOC255488, corresponding to a target binding site such as BINDING SITE I, BINDING SITE II or BINDING SITE III of FIG. 8. Table 4 illustrates the complementarity of the nucleotide sequences of LOC255488 BINDING SITE, designated SEQ ID:3150, to the nucleotide sequence of GAM7776 RNA, herein designated GAM RNA, also designated SEQ ID:246.

Another function of GAM7776 is therefore inhibition of LOC255488 (Accession XP_172581.2). Accordingly, utilities of GAM7776 include diagnosis, prevention and treatment of diseases and clinical conditions associated with LOC255488.

LOC255975 (Accession XP_171083.2) is another GAM7776 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:12803, to the nucleotide sequence of GAM7776 RNA, herein designated GAM RNA, also designated SEQ ID:246.

Another function of GAM7776 is therefore inhibition of LOC255975 (Accession XP_171083.2). Accordingly, utilities of GAM7776 include diagnosis, prevention and treatment of diseases and clinical conditions associated with LOC255975.

LOC256614 (Accession XP_172864.1) is another GAM7776 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:7385, to the nucleotide sequence of GAM7776 RNA, herein designated GAM RNA, also designated SEQ ID:246.

Another function of GAM7776 is therefore inhibition of LOC256614 (Accession XP_172864.1). Accordingly, utilities of GAM7776 include diagnosis, prevention and treatment of diseases and clinical conditions associated with LOC256614.

LOC282905 (Accession XP_212606.1) is another GAM7776 target gene, herein designated TARGET GENE. LOC282905 BINDING SITE is a target binding site found in the 5' untranslated region of mRNA encoded by LOC282905, corresponding to a target binding site such as BINDING SITE I, BINDING SITE II or BINDING SITE III of FIG. 8. Table 4 illustrates the complementarity of the nucleotide sequences of LOC282905 BINDING SITE, designated SEQ ID:986, to the nucleotide sequence of GAM7776 RNA, herein designated GAM RNA, also designated SEQ ID:246.

Another function of GAM7776 is therefore inhibition of LOC282905 (Accession XP_212606.1). Accordingly, utilities of GAM7776 include diagnosis, prevention and treatment of diseases and clinical conditions associated with LOC282905.

LOC282943 (Accession XP_212647.1) is another GAM7776 target gene, herein designated TARGET GENE.

LOC282943 BINDING SITE is a target binding site found in the 5' untranslated region of mRNA encoded by LOC282943, corresponding to a target binding site such as BINDING SITE I, BINDING SITE II or BINDING SITE III of FIG. 8. Table 4 illustrates the complementarity of the nucleotide sequences of LOC282943 BINDING SITE, designated SEQ ID:986, to the nucleotide sequence of GAM7776 RNA, herein designated GAM RNA, also designated SEQ ID:246.

Another function of GAM7776 is therefore inhibition of LOC282943 (Accession XP_212647.1). Accordingly, utilities of GAM7776 include diagnosis, prevention and treatment of diseases and clinical conditions associated with LOC282943.

LOC282963 (Accession XP_210834.1) is another GAM7776 target gene, herein designated TARGET GENE. LOC282963 BINDING SITE is a target binding site found in the 3' untranslated region of mRNA encoded by LOC282963, corresponding to a target binding site such as BINDING SITE I, BINDING SITE II or BINDING SITE III of FIG. 8. Table 4 illustrates the complementarity of the nucleotide sequences of LOC282963 BINDING SITE, designated SEQ ID:814, to the nucleotide sequence of GAM7776 RNA, herein designated GAM RNA, also designated SEQ ID:246.

Another function of GAM7776 is therefore inhibition of LOC282963 (Accession XP_210834.1). Accordingly, utilities of GAM7776 include diagnosis, prevention and treatment of diseases and clinical conditions associated with LOC282963.

LOC282972 (Accession XP_210837.1) is another GAM7776 target gene, herein designated TARGET GENE. LOC282972 BINDING SITE is a target binding site found in the 3' untranslated region of mRNA encoded by LOC282972, corresponding to a target binding site such as BINDING SITE I, BINDING SITE II or BINDING SITE III of FIG. 8. Table 4 illustrates the complementarity of the nucleotide sequences of LOC282972 BINDING SITE, designated SEQ ID:18172, to the nucleotide sequence of GAM7776 RNA, herein designated GAM RNA, also designated SEQ ID:246.

Another function of GAM7776 is therefore inhibition of LOC282972 (Accession XP_210837.1). Accordingly, utilities of GAM7776 include diagnosis, prevention and treatment of diseases and clinical conditions associated with LOC282972.

LOC282987 (Accession XP_210845.1) is another GAM7776 target gene, herein designated TARGET GENE. LOC282987 BINDING SITE1 and LOC282987 BINDING SITE2 are target binding sites found in untranslated regions of mRNA encoded by LOC282987, corresponding to target binding sites such as BINDING SITE I, BINDING SITE II or BINDING SITE III of FIG. 8. Table 4 illustrates the complementarity of the nucleotide sequences of LOC282987 BINDING SITE1 and LOC282987 BINDING SITE2, designated SEQ ID:12068 and SEQ ID:16541 respectively, to the nucleotide sequence of GAM7776 RNA, herein designated GAM RNA, also designated SEQ ID:246.

Another function of GAM7776 is therefore inhibition of LOC282987 (Accession XP_210845.1). Accordingly, utilities of GAM7776 include diagnosis, prevention and treatment of diseases and clinical conditions associated with LOC282987.

LOC282997 (Accession XP_208473.1) is another GAM7776 target gene, herein designated TARGET GENE. LOC282997 BINDING SITE is a target binding site found in the 3' untranslated region of mRNA encoded by LOC282997, corresponding to a target binding site such as BINDING SITE I, BINDING SITE II or BINDING SITE III of FIG. 8. Table 4 illustrates the complementarity of the nucleotide sequences of LOC282997 BINDING SITE, designated SEQ ID:11798, to the nucleotide sequence of GAM7776 RNA, herein designated GAM RNA, also designated SEQ ID:246.

Another function of GAM7776 is therefore inhibition of LOC282997 (Accession XP_208473.1). Accordingly, utilities of GAM7776 include diagnosis, prevention and treatment of diseases and clinical conditions associated with LOC282997.

LOC283047 (Accession XP_210870.1) is another GAM7776 target gene, herein designated TARGET GENE. LOC283047 BINDING SITE is a target binding site found in the 3' untranslated region of mRNA encoded by LOC283047, corresponding to a target binding site such as BINDING SITE I, BINDING SITE II or BINDING SITE III of FIG. 8. Table 4 illustrates the complementarity of the nucleotide sequences of LOC283047 BINDING SITE, designated SEQ ID:17587, to the nucleotide sequence of GAM7776 RNA, herein designated GAM RNA, also designated SEQ ID:246.

Another function of GAM7776 is therefore inhibition of LOC283047 (Accession XP_210870.1). Accordingly, utilities of GAM7776 include diagnosis, prevention and treatment of diseases and clinical conditions associated with LOC283047.

LOC283061 (Accession XP_210875.1) is another GAM7776 target gene, herein designated TARGET GENE. LOC283061 BINDING SITE is a target binding site found in the 3' untranslated region of mRNA encoded by LOC283061, corresponding to a target binding site such as BINDING SITE I, BINDING SITE II or BINDING SITE III of FIG. 8. Table 4 illustrates the complementarity of the nucleotide sequences of LOC283061 BINDING SITE, designated SEQ ID:7252, to the nucleotide sequence of GAM7776 RNA, herein designated GAM RNA, also designated SEQ ID:246.

Another function of GAM7776 is therefore inhibition of LOC283061 (Accession XP_210875.1). Accordingly, utilities of GAM7776 include diagnosis, prevention and treatment of diseases and clinical conditions associated with LOC283061.

LOC283087 (Accession XP_208509.1) is another GAM7776 target gene, herein designated TARGET GENE. LOC283087 BINDING SITE is a target binding site found in the 3' untranslated region of mRNA encoded by LOC283087, corresponding to a target binding site such as BINDING SITE I, BINDING SITE II or BINDING SITE III of FIG. 8. Table 4 illustrates the complementarity of the nucleotide sequences of LOC283087 BINDING SITE, designated SEQ ID:4176, to the nucleotide sequence of GAM7776 RNA, herein designated GAM RNA, also designated SEQ ID:246.

Another function of GAM7776 is therefore inhibition of LOC283087 (Accession XP_208509.1). Accordingly, utilities of GAM7776 include diagnosis, prevention and treatment of diseases and clinical conditions associated with LOC283087.

LOC283089 (Accession XP_210885.1) is another GAM7776 target gene, herein designated TARGET GENE. LOC283089 BINDING SITE is a target binding site found in the 5' untranslated region of mRNA encoded by LOC283089, corresponding to a target binding site such as BINDING SITE I, BINDING SITE II or BINDING SITE III of FIG. 8. Table 4 illustrates the complementarity of the nucleotide sequences of LOC283089 BINDING SITE, designated SEQ ID:2219, to the nucleotide sequence of GAM7776 RNA, herein designated GAM RNA, also designated SEQ ID:246.

Another function of GAM7776 is therefore inhibition of LOC283089 (Accession XP_210885.1). Accordingly, utilities of GAM7776 include diagnosis, prevention and treatment of diseases and clinical conditions associated with LOC283089.

LOC283119 (Accession XP_210895.1) is another GAM7776 target gene, herein designated TARGET GENE. LOC283119 BINDING SITE is a target binding site found in the 3' untranslated region of mRNA encoded by LOC283119, corresponding to a target binding site such as BINDING SITE I, BINDING SITE II or BINDING SITE III of FIG. 8. Table 4 illustrates the complementarity of the nucleotide sequences of LOC283119 BINDING SITE, designated SEQ ID:16397, to the nucleotide sequence of GAM7776 RNA, herein designated GAM RNA, also designated SEQ ID:246.

Another function of GAM7776 is therefore inhibition of LOC283119 (Accession XP_210895.1). Accordingly, utilities of GAM7776 include diagnosis, prevention and treatment of diseases and clinical conditions associated with LOC283119.

LOC283130 (Accession XP_208525.3) is another GAM7776 target gene, herein designated TARGET GENE. LOC283130 BINDING SITE is a target binding site found in the 3' untranslated region of mRNA encoded by LOC283130, corresponding to a target binding site such as BINDING SITE I, BINDING SITE II or BINDING SITE III of FIG. 8. Table 4 illustrates the complementarity of the nucleotide sequences of LOC283130 BINDING SITE, designated SEQ ID:5323, to the nucleotide sequence of GAM7776 RNA, herein designated GAM RNA, also designated SEQ ID:246.

Another function of GAM7776 is therefore inhibition of LOC283130 (Accession XP_208525.3). Accordingly, utilities of GAM7776 include diagnosis, prevention and treatment of diseases and clinical conditions associated with LOC283130.

LOC283140 (Accession XP_210911.1) is another GAM7776 target gene, herein designated TARGET GENE. LOC283140 BINDING SITE is a target binding site found in the 3' untranslated region of mRNA encoded by LOC283140, corresponding to a target binding site such as BINDING SITE I, BINDING SITE II or BINDING SITE III of FIG. 8. Table 4 illustrates the complementarity of the nucleotide sequences of LOC283140 BINDING SITE, designated SEQ ID:12544, to the nucleotide sequence of GAM7776 RNA, herein designated GAM RNA, also designated SEQ ID:246.

Another function of GAM7776 is therefore inhibition of LOC283140 (Accession XP_210911.1). Accordingly, utilities of GAM7776 include diagnosis, prevention and treatment of diseases and clinical conditions associated with LOC283140.

LOC283142 (Accession XP_210925.1) is another GAM7776 target gene, herein designated TARGET GENE. LOC283142 BINDING SITE is a target binding site found in the 3' untranslated region of mRNA encoded by LOC283142, corresponding to a target binding site such as BINDING SITE I, BINDING SITE II or BINDING SITE III of FIG. 8. Table 4 illustrates the complementarity of the nucleotide sequences of LOC283142 BINDING SITE, designated SEQ ID:19977, to the nucleotide sequence of GAM7776 RNA, herein designated GAM RNA, also designated SEQ ID:246.

Another function of GAM7776 is therefore inhibition of LOC283142 (Accession XP_210925.1). Accordingly, utilities of GAM7776 include diagnosis, prevention and treatment of diseases and clinical conditions associated with LOC283142.

LOC283143 (Accession XP_210920.1) is another GAM7776 target gene, herein designated TARGET GENE. LOC283143 BINDING SITE is a target binding site found in the 3' untranslated region of mRNA encoded by LOC283143, corresponding to a target binding site such as BINDING SITE I, BINDING SITE II or BINDING SITE III of FIG. 8. Table 4 illustrates the complementarity of the nucleotide sequences of LOC283143 BINDING SITE, designated SEQ ID:2650, to the nucleotide sequence of GAM7776 RNA, herein designated GAM RNA, also designated SEQ ID:246.

Another function of GAM7776 is therefore inhibition of LOC283143 (Accession XP_210920.1). Accordingly, utilities of GAM7776 include diagnosis, prevention and treatment of diseases and clinical conditions associated with LOC283143.

LOC283152 (Accession XP_210917.2) is another GAM7776 target gene, herein designated TARGET GENE. LOC283152 BINDING SITE is a target binding site found in the 5' untranslated region of mRNA encoded by LOC283152, corresponding to a target binding site such as BINDING SITE I, BINDING SITE II or BINDING SITE III of FIG. 8. Table 4 illustrates the complementarity of the nucleotide sequences of LOC283152 BINDING SITE, designated SEQ ID:19812, to the nucleotide sequence of GAM7776 RNA, herein designated GAM RNA, also designated SEQ ID:246.

Another function of GAM7776 is therefore inhibition of LOC283152 (Accession XP_210917.2). Accordingly, utilities of GAM7776 include diagnosis, prevention and treatment of diseases and clinical conditions associated with LOC283152.

LOC283170 (Accession XP_208535.1) is another GAM7776 target gene, herein designated TARGET GENE. LOC283170 BINDING SITE is a target binding site found in the 3' untranslated region of mRNA encoded by LOC283170, corresponding to a target binding site such as BINDING SITE I, BINDING SITE II or BINDING SITE III of FIG. 8. Table 4 illustrates the complementarity of the nucleotide sequences of LOC283170 BINDING SITE, designated SEQ ID:4979, to the nucleotide sequence of GAM7776 RNA, herein designated GAM RNA, also designated SEQ ID:246.

Another function of GAM7776 is therefore inhibition of LOC283170 (Accession XP_208535.1). Accordingly, utilities of GAM7776 include diagnosis, prevention and treatment of diseases and clinical conditions associated with LOC283170.

LOC283177 (Accession XP_210903.1) is another GAM7776 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:15574, to the nucleotide sequence of GAM7776 RNA, herein designated GAM RNA, also designated SEQ ID:246.

Another function of GAM7776 is therefore inhibition of LOC283177 (Accession XP_210903.1). Accordingly, utilities of GAM7776 include diagnosis, prevention and treatment of diseases and clinical conditions associated with LOC283177.

LOC283215 (Accession XP_208555.2) is another GAM7776 target gene, herein designated TARGET GENE. LOC283215 BINDING SITE is a target binding site found in the 3' untranslated region of mRNA encoded by LOC283215, corresponding to a target binding site such as BINDING SITE I, BINDING SITE II or BINDING SITE III of FIG. 8. Table 4 illustrates the complementarity of the nucleotide sequences of LOC283215 BINDING SITE, designated SEQ ID:10112, to the nucleotide sequence of GAM7776 RNA, herein designated GAM RNA, also designated SEQ ID:246.

Another function of GAM7776 is therefore inhibition of LOC283215 (Accession XP_208555.2). Accordingly, utilities of GAM7776 include diagnosis, prevention and treatment of diseases and clinical conditions associated with LOC283215.

LOC283241 (Accession NP_787089.1) is another GAM7776 target gene, herein designated TARGET GENE. LOC283241 BINDING SITE is a target binding site found in the 5' untranslated region of mRNA encoded by LOC283241, corresponding to a target binding site such as BINDING SITE I, BINDING SITE II or BINDING SITE III of FIG. 8. Table 4 illustrates the complementarity of the nucleotide sequences of LOC283241 BINDING SITE, designated SEQ ID:9525, to the nucleotide sequence of GAM7776 RNA, herein designated GAM RNA, also designated SEQ ID:246.

Another function of GAM7776 is therefore inhibition of LOC283241 (Accession NP_787089.1). Accordingly, utilities of GAM7776 include diagnosis, prevention and treatment of diseases and clinical conditions associated with LOC283241.

LOC283244 (Accession XP_208583.2) is another GAM7776 target gene, herein designated TARGET GENE. LOC283244 BINDING SITE is a target binding site found in the 3' untranslated region of mRNA encoded by LOC283244, corresponding to a target binding site such as BINDING SITE I, BINDING SITE II or BINDING SITE III of FIG. 8. Table 4 illustrates the complementarity of the nucleotide sequences of LOC283244 BINDING SITE, designated SEQ ID:4496, to the nucleotide sequence of GAM7776 RNA, herein designated GAM RNA, also designated SEQ ID:246.

Another function of GAM7776 is therefore inhibition of LOC283244 (Accession XP_208583.2). Accordingly, utilities of GAM7776 include diagnosis, prevention and treatment of diseases and clinical conditions associated with LOC283244.

LOC283262 (Accession XP_210952.1) is another GAM7776 target gene, herein designated TARGET GENE. LOC283262 BINDING SITE is a target binding site found in the 5' untranslated region of mRNA encoded by LOC283262, corresponding to a target binding site such as BINDING SITE I, BINDING SITE II or BINDING SITE III of FIG. 8. Table 4 illustrates the complementarity of the nucleotide sequences of LOC283262 BINDING SITE, designated SEQ ID:8223, to the nucleotide sequence of GAM7776 RNA, herein designated GAM RNA, also designated SEQ ID:246.

Another function of GAM7776 is therefore inhibition of LOC283262 (Accession XP_210952.1). Accordingly, utilities of GAM7776 include diagnosis, prevention and treatment of diseases and clinical conditions associated with LOC283262.

LOC283278 (Accession XP_210961.1) is another GAM7776 target gene, herein designated TARGET GENE. LOC283278 BINDING SITE is a target binding site found in the 3' untranslated region of mRNA encoded by LOC283278, corresponding to a target binding site such as BINDING SITE I, BINDING SITE II or BINDING SITE III of FIG. 8. Table 4 illustrates the complementarity of the nucleotide sequences of LOC283278 BINDING SITE, designated SEQ ID:9036, to the nucleotide sequence of GAM7776 RNA, herein designated GAM RNA, also designated SEQ ID:246.

Another function of GAM7776 is therefore inhibition of LOC283278 (Accession XP_210961.1). Accordingly, utilities of GAM7776 include diagnosis, prevention and treatment of diseases and clinical conditions associated with LOC283278.

LOC283293 (Accession XP_210962.1) is another GAM7776 target gene, herein designated TARGET GENE. LOC283293 BINDING SITE is a target binding site found in the 3' untranslated region of mRNA encoded by LOC283293, corresponding to a target binding site such as BINDING SITE I, BINDING SITE II or BINDING SITE III of FIG. 8. Table 4 illustrates the complementarity of the nucleotide sequences of LOC283293 BINDING SITE, designated SEQ ID:17952, to the nucleotide sequence of GAM7776 RNA, herein designated GAM RNA, also designated SEQ ID:246.

Another function of GAM7776 is therefore inhibition of LOC283293 (Accession XP_210962.1). Accordingly, utilities of GAM7776 include diagnosis, prevention and treatment of diseases and clinical conditions associated with LOC283293.

LOC283299 (Accession XP_210965.1) is another GAM7776 target gene, herein designated TARGET GENE. LOC283299 BINDING SITE is a target binding site found in the 5' untranslated region of mRNA encoded by LOC283299, corresponding to a target binding site such as BINDING SITE I, BINDING SITE II or BINDING SITE III of FIG. 8. Table 4 illustrates the complementarity of the nucleotide sequences of LOC283299 BINDING SITE, designated SEQ ID:9585, to the nucleotide sequence of GAM7776 RNA, herein designated GAM RNA, also designated SEQ ID:246.

Another function of GAM7776 is therefore inhibition of LOC283299 (Accession XP_210965.1). Accordingly, utilities of GAM7776 include diagnosis, prevention and treatment of diseases and clinical conditions associated with LOC283299.

LOC283329 (Accession XP_210978.1) is another GAM7776 target gene, herein designated TARGET GENE. LOC283329 BINDING SITE is a target binding site found in the 5' untranslated region of mRNA encoded by LOC283329, corresponding to a target binding site such as BINDING SITE I, BINDING SITE II or BINDING SITE III of FIG. 8. Table 4 illustrates the complementarity of the nucleotide sequences of LOC283329 BINDING SITE, designated SEQ ID:2201, to the nucleotide sequence of GAM7776 RNA, herein designated GAM RNA, also designated SEQ ID:246.

Another function of GAM7776 is therefore inhibition of LOC283329 (Accession XP_210978.1). Accordingly, utilities of GAM7776 include diagnosis, prevention and treatment of diseases and clinical conditions associated with LOC283329.

LOC283335 (Accession XP_210981.1) is another GAM7776 target gene, herein designated TARGET GENE. LOC283335 BINDING SITE1 and LOC283335 BINDING SITE2 are target binding sites found in untranslated regions of mRNA encoded by LOC283335, corresponding to target binding sites such as BINDING SITE I, BINDING SITE II or BINDING SITE III of FIG. 8. Table 4 illustrates the complementarity of the nucleotide sequences of LOC283335 BINDING SITE1 and LOC283335 BINDING SITE2, designated SEQ ID:2143 and SEQ ID:16144 respectively, to the nucleotide sequence of GAM7776 RNA, herein designated GAM RNA, also designated SEQ ID:246.

Another function of GAM7776 is therefore inhibition of LOC283335 (Accession XP_210981.1). Accordingly, utilities of GAM7776 include diagnosis, prevention and treatment of diseases and clinical conditions associated with LOC283335.

LOC283377 (Accession XP_208647.1) is another GAM7776 target gene, herein designated TARGET GENE. LOC283377 BINDING SITE is a target binding site found in the 3' untranslated region of mRNA encoded by LOC283377, corresponding to a target binding site such as BINDING SITE I, BINDING SITE II or BINDING SITE III of FIG. 8. Table 4 illustrates the complementarity of the nucleotide sequences of LOC283377 BINDING SITE, designated SEQ ID:8232, to the nucleotide sequence of GAM7776 RNA, herein designated GAM RNA, also designated SEQ ID:246.

Another function of GAM7776 is therefore inhibition of LOC283377 (Accession XP_208647.1). Accordingly, utilities of GAM7776 include diagnosis, prevention and treatment of diseases and clinical conditions associated with LOC283377.

LOC283387 (Accession XP_211007.1) is another GAM7776 target gene, herein designated TARGET GENE. LOC283387 BINDING SITE is a target binding site found in the 3' untranslated region of mRNA encoded by LOC283387, corresponding to a target binding site such as BINDING SITE I, BINDING SITE II or BINDING SITE III of FIG. 8. Table 4 illustrates the complementarity of the nucleotide sequences of LOC283387 BINDING SITE, designated SEQ ID:7265, to the nucleotide sequence of GAM7776 RNA, herein designated GAM RNA, also designated SEQ ID:246.

Another function of GAM7776 is therefore inhibition of LOC283387 (Accession XP_211007.1). Accordingly, utilities of GAM7776 include diagnosis, prevention and treatment of diseases and clinical conditions associated with LOC283387.

LOC283394 (Accession XP_211021.1) is another GAM7776 target gene, herein designated TARGET GENE. LOC283394 BINDING SITE is a target binding site found in the 5' untranslated region of mRNA encoded by LOC283394, corresponding to a target binding site such as BINDING SITE I, BINDING SITE II or BINDING SITE III of FIG. 8. Table 4 illustrates the complementarity of the nucleotide sequences of LOC283394 BINDING SITE, designated SEQ ID:1730, to the nucleotide sequence of GAM7776 RNA, herein designated GAM RNA, also designated SEQ ID:246.

Another function of GAM7776 is therefore inhibition of LOC283394 (Accession XP_211021.1). Accordingly, utilities of GAM7776 include diagnosis, prevention and treatment of diseases and clinical conditions associated with LOC283394.

LOC283395 (Accession XP_211020.1) is another GAM7776 target gene, herein designated TARGET GENE. LOC283395 BINDING SITE is a target binding site found in the 3' untranslated region of mRNA encoded by LOC283395, corresponding to a target binding site such as BINDING SITE I, BINDING SITE II or BINDING SITE III of FIG. 8. Table 4 illustrates the complementarity of the nucleotide sequences of LOC283395 BINDING SITE, designated SEQ ID:9003, to the nucleotide sequence of GAM7776 RNA, herein designated GAM RNA, also designated SEQ ID:246.

Another function of GAM7776 is therefore inhibition of LOC283395 (Accession XP_211020.1). Accordingly, utilities of GAM7776 include diagnosis, prevention and treatment of diseases and clinical conditions associated with LOC283395.

LOC283400 (Accession XP_211024.1) is another GAM7776 target gene, herein designated TARGET GENE. LOC283400 BINDING SITE is a target binding site found in the 5' untranslated region of mRNA encoded by LOC283400, corresponding to a target binding site such as BINDING SITE I, BINDING SITE II or BINDING SITE III of FIG. 8. Table 4 illustrates the complementarity of the nucleotide sequences of LOC283400 BINDING SITE, designated SEQ ID:19206, to the nucleotide sequence of GAM7776 RNA, herein designated GAM RNA, also designated SEQ ID:246.

Another function of GAM7776 is therefore inhibition of LOC283400 (Accession XP_211024.1). Accordingly, utilities of GAM7776 include diagnosis, prevention and treatment of diseases and clinical conditions associated with LOC283400.

LOC283432 (Accession XP_211032.1) is another GAM7776 target gene, herein designated TARGET GENE. LOC283432 BINDING SITE is a target binding site found in the 5' untranslated region of mRNA encoded by LOC283432, corresponding to a target binding site such as BINDING SITE I, BINDING SITE II or BINDING SITE III of FIG. 8. Table 4 illustrates the complementarity of the nucleotide sequences of LOC283432 BINDING SITE, designated SEQ ID:16658, to the nucleotide sequence of GAM7776 RNA, herein designated GAM RNA, also designated SEQ ID:246.

Another function of GAM7776 is therefore inhibition of LOC283432 (Accession XP_211032.1). Accordingly, utilities of GAM7776 include diagnosis, prevention and treatment of diseases and clinical conditions associated with LOC283432.

LOC283441 (Accession XP_211043.1) is another GAM7776 target gene, herein designated TARGET GENE. LOC283441 BINDING SITE is a target binding site found in the 3' untranslated region of mRNA encoded by LOC283441, corresponding to a target binding site such as BINDING SITE I, BINDING SITE II or BINDING SITE III of FIG. 8. Table 4 illustrates the complementarity of the nucleotide sequences of LOC283441 BINDING SITE, designated SEQ ID:2220, to the nucleotide sequence of GAM7776 RNA, herein designated GAM RNA, also designated SEQ ID:246.

Another function of GAM7776 is therefore inhibition of LOC283441 (Accession XP_211043.1). Accordingly, utilities of GAM7776 include diagnosis, prevention and treatment of diseases and clinical conditions associated with LOC283441.

LOC283442 (Accession XP_211037.1) is another GAM7776 target gene, herein designated TARGET GENE. LOC283442 BINDING SITE is a target binding site found in the 5' untranslated region of mRNA encoded by LOC283442, corresponding to a target binding site such as BINDING SITE I, BINDING SITE II or BINDING SITE III of FIG. 8. Table 4 illustrates the complementarity of the nucleotide sequences of LOC283442 BINDING SITE, designated SEQ ID:10032, to the nucleotide sequence of GAM7776 RNA, herein designated GAM RNA, also designated SEQ ID:246.

Another function of GAM7776 is therefore inhibition of LOC283442 (Accession XP_211037.1). Accordingly, utilities of GAM7776 include diagnosis, prevention and treatment of diseases and clinical conditions associated with LOC283442.

LOC283445 (Accession XP_211044.1) is another GAM7776 target gene, herein designated TARGET GENE. LOC283445 BINDING SITE is a target binding site found in the 5' untranslated region of mRNA encoded by LOC283445, corresponding to a target binding site such as BINDING SITE I, BINDING SITE II or BINDING SITE III of FIG. 8. Table 4 illustrates the complementarity of the nucleotide sequences of LOC283445 BINDING SITE, designated SEQ ID:5683, to the nucleotide sequence of GAM7776 RNA, herein designated GAM RNA, also designated SEQ ID:246.

Another function of GAM7776 is therefore inhibition of LOC283445 (Accession XP_211044.1). Accordingly, utilities of GAM7776 include diagnosis, prevention and treatment of diseases and clinical conditions associated with LOC283445.

LOC283452 (Accession XP_208679.1) is another GAM7776 target gene, herein designated TARGET GENE. LOC283452 BINDING SITE is a target binding site found in the 5' untranslated region of mRNA encoded by LOC283452, corresponding to a target binding site such as BINDING SITE I, BINDING SITE II or BINDING SITE III of FIG. 8. Table 4 illustrates the complementarity of the nucleotide sequences of LOC283452 BINDING SITE, designated SEQ ID:7397, to the nucleotide sequence of GAM7776 RNA, herein designated GAM RNA, also designated SEQ ID:246.

Another function of GAM7776 is therefore inhibition of LOC283452 (Accession XP_208679.1). Accordingly, utilities of GAM7776 include diagnosis, prevention and treatment of diseases and clinical conditions associated with LOC283452.

LOC283454 (Accession XP_211049.1) is another GAM7776 target gene, herein designated TARGET GENE. LOC283454 BINDING SITE is a target binding site found in the 5' untranslated region of mRNA encoded by LOC283454, corresponding to a target binding site such as BINDING SITE I, BINDING SITE II or BINDING SITE III of FIG. 8. Table 4 illustrates the complementarity of the nucleotide sequences of LOC283454 BINDING SITE, designated SEQ ID:14861, to the nucleotide sequence of GAM7776 RNA, herein designated GAM RNA, also designated SEQ ID:246.

Another function of GAM7776 is therefore inhibition of LOC283454 (Accession XP_211049.1). Accordingly, utilities of GAM7776 include diagnosis, prevention and treatment of diseases and clinical conditions associated with LOC283454.

LOC283467 (Accession XP_211050.1) is another GAM7776 target gene, herein designated TARGET GENE. LOC283467 BINDING SITE is a target binding site found in the 3' untranslated region of mRNA encoded by LOC283467, corresponding to a target binding site such as BINDING SITE I, BINDING SITE II or BINDING SITE III of FIG. 8. Table 4 illustrates the complementarity of the nucleotide sequences of LOC283467 BINDING SITE, designated SEQ ID:13967, to the nucleotide sequence of GAM7776 RNA, herein designated GAM RNA, also designated SEQ ID:246.

Another function of GAM7776 is therefore inhibition of LOC283467 (Accession XP_211050.1). Accordingly, utilities of GAM7776 include diagnosis, prevention and treatment of diseases and clinical conditions associated with LOC283467.

LOC283475 (Accession XP_211056.1) is another GAM7776 target gene, herein designated TARGET GENE. LOC283475 BINDING SITE is a target binding site found in the 3' untranslated region of mRNA encoded by LOC283475, corresponding to a target binding site such as BINDING SITE I, BINDING SITE II or BINDING SITE III of FIG. 8. Table 4 illustrates the complementarity of the nucleotide sequences of LOC283475 BINDING SITE, designated SEQ ID:9892, to the nucleotide sequence of GAM7776 RNA, herein designated GAM RNA, also designated SEQ ID:246.

Another function of GAM7776 is therefore inhibition of LOC283475 (Accession XP_211056.1). Accordingly, utilities of GAM7776 include diagnosis, prevention and treatment of diseases and clinical conditions associated with LOC283475.

LOC283484 (Accession XP_211053.1) is another GAM7776 target gene, herein designated TARGET GENE. LOC283484 BINDING SITE is a target binding site found in the 5' untranslated region of mRNA encoded by LOC283484, corresponding to a target binding site such as BINDING SITE I, BINDING SITE II or BINDING SITE III of FIG. 8. Table 4 illustrates the complementarity of the nucleotide sequences of LOC283484 BINDING SITE, designated SEQ ID:17710, to the nucleotide sequence of GAM7776 RNA, herein designated GAM RNA, also designated SEQ ID:246.

Another function of GAM7776 is therefore inhibition of LOC283484 (Accession XP_211053.1). Accordingly, utilities of GAM7776 include diagnosis, prevention and treatment of diseases and clinical conditions associated with LOC283484.

LOC283487 (Accession XP_211062.1) is another GAM7776 target gene, herein designated TARGET GENE. LOC283487 BINDING SITE is a target binding site found in the 3' untranslated region of multiple transcripts of mRNA encoded by LOC283487, corresponding to a target binding site such as BINDING SITE I, BINDING SITE II or BINDING SITE III of FIG. 8. Table 4 illustrates the complementarity of the nucleotide sequences of LOC283487 BINDING SITE, designated SEQ ID:7371, to the nucleotide sequence of GAM7776 RNA, herein designated GAM RNA, also designated SEQ ID:246.

Another function of GAM7776 is therefore inhibition of LOC283487 (Accession XP_211062.1). Accordingly, utilities of GAM7776 include diagnosis, prevention and treatment of diseases and clinical conditions associated with LOC283487.

LOC283507 (Accession XP_211075.1) is another GAM7776 target gene, herein designated TARGET GENE. LOC283507 BINDING SITE is a target binding site found in the 3' untranslated region of mRNA encoded by LOC283507, corresponding to a target binding site such as BINDING SITE I, BINDING SITE II or BINDING SITE III of FIG. 8. Table 4 illustrates the complementarity of the nucleotide sequences of LOC283507 BINDING SITE, designated SEQ ID:12075, to the nucleotide sequence of GAM7776 RNA, herein designated GAM RNA, also designated SEQ ID:246.

Another function of GAM7776 is therefore inhibition of LOC283507 (Accession XP_211075.1). Accordingly, utilities of GAM7776 include diagnosis, prevention and treatment of diseases and clinical conditions associated with LOC283507.

LOC283534 (Accession XP_211083.1) is another GAM7776 target gene, herein designated TARGET GENE. LOC283534 BINDING SITE is a target binding site found in the 3' untranslated region of mRNA encoded by LOC283534, corresponding to a target binding site such as BINDING SITE I, BINDING SITE II or BINDING SITE III of FIG. 8. Table 4 illustrates the complementarity of the nucleotide sequences of LOC283534 BINDING SITE, designated SEQ ID:3199, to the nucleotide sequence of GAM7776 RNA, herein designated GAM RNA, also designated SEQ ID:246.

Another function of GAM7776 is therefore inhibition of LOC283534 (Accession XP_211083.1). Accordingly, utilities of GAM7776 include diagnosis, prevention and treatment of diseases and clinical conditions associated with LOC283534.

LOC283570 (Accession XP_211118.1) is another GAM7776 target gene, herein designated TARGET GENE. LOC283570 BINDING SITE is a target binding site found in the 3' untranslated region of mRNA encoded by LOC283570, corresponding to a target binding site such as BINDING SITE I, BINDING SITE II or BINDING SITE III of FIG. 8. Table 4 illustrates the complementarity of the nucleotide sequences of LOC283570 BINDING SITE, designated SEQ ID:13652, to the nucleotide sequence of GAM7776 RNA, herein designated GAM RNA, also designated SEQ ID:246.

Another function of GAM7776 is therefore inhibition of LOC283570 (Accession XP_211118.1). Accordingly, utilities of GAM7776 include diagnosis, prevention and treatment of diseases and clinical conditions associated with LOC283570.

LOC283575 (Accession XP_211095.1) is another GAM7776 target gene, herein designated TARGET GENE. LOC283575 BINDING SITE1 and LOC283575 BINDING SITE2 are target binding sites found in untranslated regions of mRNA encoded by LOC283575, corresponding to target binding sites such as BINDING SITE I, BINDING SITE II or BINDING SITE III of FIG. 8. Table 4 illustrates the complementarity of the nucleotide sequences of LOC283575 BINDING SITE1 and LOC283575 BINDING SITE2, designated SEQ ID:10067 and SEQ ID:6183 respectively, to the nucleotide sequence of GAM7776 RNA, herein designated GAM RNA, also designated SEQ ID:246.

Another function of GAM7776 is therefore inhibition of LOC283575 (Accession XP_211095.1). Accordingly, utilities of GAM7776 include diagnosis, prevention and treatment of diseases and clinical conditions associated with LOC283575.

LOC283585 (Accession XP_294741.1) is another GAM7776 target gene, herein designated TARGET GENE. LOC283585 BINDING SITE is a target binding site found in the 5' untranslated region of mRNA encoded by LOC283585, corresponding to a target binding site such as BINDING SITE I, BINDING SITE II or BINDING SITE III of FIG. 8. Table 4 illustrates the complementarity of the nucleotide sequences of LOC283585 BINDING SITE, designated SEQ ID:10466, to the nucleotide sequence of GAM7776 RNA, herein designated GAM RNA, also designated SEQ ID:246.

Another function of GAM7776 is therefore inhibition of LOC283585 (Accession XP_294741.1). Accordingly, utilities of GAM7776 include diagnosis, prevention and treatment of diseases and clinical conditions associated with LOC283585.

LOC283588 (Accession NP_787093.1) is another GAM7776 target gene, herein designated TARGET GENE. LOC283588 BINDING SITE is a target binding site found in the 3' untranslated region of mRNA encoded by LOC283588, corresponding to a target binding site such as BINDING SITE I, BINDING SITE II or BINDING SITE III of FIG. 8. Table 4 illustrates the complementarity of the nucleotide sequences of LOC283588 BINDING SITE, designated SEQ ID:10638, to the nucleotide sequence of GAM7776 RNA, herein designated GAM RNA, also designated SEQ ID:246.

Another function of GAM7776 is therefore inhibition of LOC283588 (Accession NP_787093.1). Accordingly, utilities of GAM7776 include diagnosis, prevention and treatment of diseases and clinical conditions associated with LOC283588.

LOC283624 (Accession XP_211126.1) is another GAM7776 target gene, herein designated TARGET GENE. LOC283624 BINDING SITE is a target binding site found in the 5' untranslated region of mRNA encoded by LOC283624, corresponding to a target binding site such as BINDING SITE I, BINDING SITE II or BINDING SITE III of FIG. 8. Table 4 illustrates the complementarity of the nucleotide sequences of LOC283624 BINDING SITE, designated SEQ ID:4420, to the nucleotide sequence of GAM7776 RNA, herein designated GAM RNA, also designated SEQ ID:246.

Another function of GAM7776 is therefore inhibition of LOC283624 (Accession XP_211126.1). Accordingly, utilities of GAM7776 include diagnosis, prevention and treatment of diseases and clinical conditions associated with LOC283624.

LOC283637 (Accession XP_211134.1) is another GAM7776 target gene, herein designated TARGET GENE. LOC283637 BINDING SITE1 and LOC283637 BINDING SITE2 are target binding sites found in untranslated regions of mRNA encoded by LOC283637, corresponding to target binding sites such as BINDING SITE I, BINDING SITE II or BINDING SITE III of FIG. 8. Table 4 illustrates the complementarity of the nucleotide sequences of LOC283637 BINDING SITE1 and LOC283637 BINDING SITE2, designated SEQ ID:14859 and SEQ ID:3581 respectively, to the nucleotide sequence of GAM7776 RNA, herein designated GAM RNA, also designated SEQ ID:246.

Another function of GAM7776 is therefore inhibition of LOC283637 (Accession XP_211134.1). Accordingly, utilities of GAM7776 include diagnosis, prevention and treatment of diseases and clinical conditions associated with LOC283637.

LOC283641 (Accession XP_208764.1) is another GAM7776 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:17964, to the nucleotide sequence of GAM7776 RNA, herein designated GAM RNA, also designated SEQ ID:246.

Another function of GAM7776 is therefore inhibition of LOC283641 (Accession XP_208764.1). Accordingly, utilities of GAM7776 include diagnosis, prevention and treatment of diseases and clinical conditions associated with LOC283641.

LOC283663 (Accession XP_211147.1) is another GAM7776 target gene, herein designated TARGET GENE. LOC283663 BINDING SITE is a target binding site found in the 5' untranslated region of mRNA encoded by LOC283663, corresponding to a target binding site such as BINDING SITE I, BINDING SITE II or BINDING SITE III of FIG. 8. Table 4 illustrates the complementarity of the nucleotide sequences of LOC283663 BINDING SITE, designated SEQ ID:16674, to the nucleotide sequence of GAM7776 RNA, herein designated GAM RNA, also designated SEQ ID:246.

Another function of GAM7776 is therefore inhibition of LOC283663 (Accession XP_211147.1). Accordingly, utilities of GAM7776 include diagnosis, prevention and treatment of diseases and clinical conditions associated with LOC283663.

LOC283664 (Accession XP_208773.1) is another GAM7776 target gene, herein designated TARGET GENE. LOC283664 BINDING SITE is a target binding site found in the 5' untranslated region of mRNA encoded by LOC283664, corresponding to a target binding site such as BINDING SITE I, BINDING SITE II or BINDING SITE III of FIG. 8. Table 4 illustrates the complementarity of the nucleotide sequences of LOC283664 BINDING SITE, designated SEQ ID:8450, to the nucleotide sequence of GAM7776 RNA, herein designated GAM RNA, also designated SEQ ID:246.

Another function of GAM7776 is therefore inhibition of LOC283664 (Accession XP_208773.1). Accordingly, utilities of GAM7776 include diagnosis, prevention and treatment of diseases and clinical conditions associated with LOC283664.

LOC283672 (Accession XP_211152.1) is another GAM7776 target gene, herein designated TARGET GENE. LOC283672 BINDING SITE is a target binding site found in the 5' untranslated region of mRNA encoded by LOC283672, corresponding to a target binding site such as BINDING SITE I, BINDING SITE II or BINDING SITE III of FIG. 8. Table 4 illustrates the complementarity of the nucleotide sequences of LOC283672 BINDING SITE, designated SEQ ID:1730, to the nucleotide sequence of GAM7776 RNA, herein designated GAM RNA, also designated SEQ ID:246.

Another function of GAM7776 is therefore inhibition of LOC283672 (Accession XP_211152.1). Accordingly, utilities of GAM7776 include diagnosis, prevention and treatment of diseases and clinical conditions associated with LOC283672.

LOC283687 (Accession NP_787094.1) is another GAM7776 target gene, herein designated TARGET GENE. LOC283687 BINDING SITE is a target binding site found in the 3' untranslated region of mRNA encoded by LOC283687, corresponding to a target binding site such as BINDING SITE I, BINDING SITE II or BINDING SITE III of FIG. 8. Table 4 illustrates the complementarity of the nucleotide sequences of LOC283687 BINDING SITE, designated SEQ ID:11904, to the nucleotide sequence of GAM7776 RNA, herein designated GAM RNA, also designated SEQ ID:246.

Another function of GAM7776 is therefore inhibition of LOC283687 (Accession NP_787094.1). Accordingly, utilities of GAM7776 include diagnosis, prevention and treatment of diseases and clinical conditions associated with LOC283687.

LOC283693 (Accession XP_208788.1) is another GAM7776 target gene, herein designated TARGET GENE. LOC283693 BINDING SITE is a target binding site found in the 3' untranslated region of mRNA encoded by LOC283693, corresponding to a target binding site such as BINDING SITE I, BINDING SITE II or BINDING SITE III of FIG. 8. Table 4 illustrates the complementarity of the nucleotide sequences of LOC283693 BINDING SITE, designated SEQ ID:5305, to the nucleotide sequence of GAM7776 RNA, herein designated GAM RNA, also designated SEQ ID:246.

Another function of GAM7776 is therefore inhibition of LOC283693 (Accession XP_208788.1). Accordingly, utilities of GAM7776 include diagnosis, prevention and treatment of diseases and clinical conditions associated with LOC283693.

LOC283701 (Accession XP_211170.3) is another GAM7776 target gene, herein designated TARGET GENE. LOC283701 BINDING SITE1 and LOC283701 BINDING SITE2 are target binding sites found in untranslated regions of mRNA encoded by LOC283701, corresponding to target binding sites such as BINDING SITE I, BINDING SITE II or BINDING SITE III of FIG. 8. Table 4 illustrates the complementarity of the nucleotide sequences of LOC283701 BINDING SITE1 and LOC283701 BINDING SITE2, designated SEQ ID:13716 and SEQ ID:14381 respectively, to the nucleotide sequence of GAM7776 RNA, herein designated GAM RNA, also designated SEQ ID:246.

Another function of GAM7776 is therefore inhibition of LOC283701 (Accession XP_211170.3). Accordingly, utilities of GAM7776 include diagnosis, prevention and treatment of diseases and clinical conditions associated with LOC283701.

LOC283723 (Accession XP_211176.1) is another GAM7776 target gene, herein designated TARGET GENE. LOC283723 BINDING SITE is a target binding site found in the 5' untranslated region of mRNA encoded by LOC283723, corresponding to a target binding site such as BINDING SITE I, BINDING SITE II or BINDING SITE III of FIG. 8. Table 4 illustrates the complementarity of the nucleotide sequences of LOC283723 BINDING SITE, designated SEQ ID:9256, to the nucleotide sequence of GAM7776 RNA, herein designated GAM RNA, also designated SEQ ID:246.

Another function of GAM7776 is therefore inhibition of LOC283723 (Accession XP_211176.1). Accordingly, utilities of GAM7776 include diagnosis, prevention and treatment of diseases and clinical conditions associated with LOC283723.

LOC283741 (Accession XP_208115.1) is another GAM7776 target gene, herein designated TARGET GENE. LOC283741 BINDING SITE is a target binding site found in the 3' untranslated region of mRNA encoded by LOC283741, corresponding to a target binding site such as BINDING SITE I, BINDING SITE II or BINDING SITE III of FIG. 8. Table 4 illustrates the complementarity of the nucleotide sequences of LOC283741 BINDING SITE, designated SEQ ID:11523, to the nucleotide sequence of GAM7776 RNA, herein designated GAM RNA, also designated SEQ ID:246.

Another function of GAM7776 is therefore inhibition of LOC283741 (Accession XP_208115.1). Accordingly, utilities of GAM7776 include diagnosis, prevention and treatment of diseases and clinical conditions associated with LOC283741.

LOC283767 (Accession XP_208835.1) is another GAM7776 target gene, herein designated TARGET GENE. LOC283767 BINDING SITE is a target binding site found in the 3' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:12479, to the nucleotide sequence of GAM7776 RNA, herein designated GAM RNA, also designated SEQ ID:246.

Another function of GAM7776 is therefore inhibition of LOC283767 (Accession XP_208835.1). Accordingly, utilities of GAM7776 include diagnosis, prevention and treatment of diseases and clinical conditions associated with LOC283767.

LOC283778 (Accession XP_211199.1) is another GAM7776 target gene, herein designated TARGET GENE. LOC283778 BINDING SITE is a target binding site found in the 5' untranslated region of mRNA encoded by LOC283778, corresponding to a target binding site such as BINDING SITE I, BINDING SITE II or BINDING SITE III of FIG. 8. Table 4 illustrates the complementarity of the nucleotide sequences of LOC283778 BINDING SITE, designated SEQ ID:4370, to the nucleotide sequence of GAM7776 RNA, herein designated GAM RNA, also designated SEQ ID:246.

Another function of GAM7776 is therefore inhibition of LOC283778 (Accession XP_211199.1). Accordingly, utilities of GAM7776 include diagnosis, prevention and treatment of diseases and clinical conditions associated with LOC283778.

LOC283779 (Accession XP_211198.1) is another GAM7776 target gene, herein designated TARGET GENE. LOC283779 BINDING SITE is a target binding site found in the 3' untranslated region of mRNA encoded by LOC283779, corresponding to a target binding site such as BINDING SITE I, BINDING SITE II or BINDING SITE III of FIG. 8. Table 4 illustrates the complementarity of the nucleotide sequences of LOC283779 BINDING SITE, designated SEQ ID:17644, to the nucleotide sequence of GAM7776 RNA, herein designated GAM RNA, also designated SEQ ID:246.

Another function of GAM7776 is therefore inhibition of LOC283779 (Accession XP_211198.1). Accordingly, utilities of GAM7776 include diagnosis, prevention and treatment of diseases and clinical conditions associated with LOC283779.

LOC283801 (Accession XP_208122.1) is another GAM7776 target gene, herein designated TARGET GENE. LOC283801 BINDING SITE is a target binding site found in the 3' untranslated region of mRNA encoded by LOC283801, corresponding to a target binding site such as BINDING SITE I, BINDING SITE II or BINDING SITE III of FIG. 8. Table 4 illustrates the complementarity of the nucleotide sequences of LOC283801 BINDING SITE, designated SEQ ID:6265, to the nucleotide sequence of GAM7776 RNA, herein designated GAM RNA, also designated SEQ ID:246.

Another function of GAM7776 is therefore inhibition of LOC283801 (Accession XP_208122.1). Accordingly, utilities of GAM7776 include diagnosis, prevention and treatment of diseases and clinical conditions associated with LOC283801.

LOC283802 (Accession XP_208850.1) is another GAM7776 target gene, herein designated TARGET GENE. LOC283802 BINDING SITE is a target binding site found in the 3' untranslated region of mRNA encoded by LOC283802, corresponding to a target binding site such as BINDING SITE I, BINDING SITE II or BINDING SITE III of FIG. 8. Table 4 illustrates the complementarity of the nucleotide sequences of LOC283802 BINDING SITE, designated SEQ ID:16700, to the nucleotide sequence of GAM7776 RNA, herein designated GAM RNA, also designated SEQ ID:246.

Another function of GAM7776 is therefore inhibition of LOC283802 (Accession XP_208850.1). Accordingly, utilities of GAM7776 include diagnosis, prevention and treatment of diseases and clinical conditions associated with LOC283802.

LOC283818 (Accession XP_211218.1) is another GAM7776 target gene, herein designated TARGET GENE. LOC283818 BINDING SITE is a target binding site found in the 3' untranslated region of mRNA encoded by LOC283818, corresponding to a target binding site such as BINDING SITE I, BINDING SITE II or BINDING SITE III of FIG. 8. Table 4 illustrates the complementarity of the nucleotide sequences of LOC283818 BINDING SITE, designated SEQ ID:9546, to the nucleotide sequence of GAM7776 RNA, herein designated GAM RNA, also designated SEQ ID:246.

Another function of GAM7776 is therefore inhibition of LOC283818 (Accession XP_211218.1). Accordingly, utilities of GAM7776 include diagnosis, prevention and treatment of diseases and clinical conditions associated with LOC283818.

LOC283849 (Accession XP_208870.1) is another GAM7776 target gene, herein designated TARGET GENE. LOC283849 BINDING SITE is a target binding site found in the 5' untranslated region of multiple transcripts of mRNA encoded by LOC283849, corresponding to a target binding site such as BINDING SITE I, BINDING SITE II or BINDING SITE III of FIG. 8. Table 4 illustrates the complementarity of the nucleotide sequences of LOC283849 BINDING SITE, designated SEQ ID:4308, to the nucleotide sequence of GAM7776 RNA, herein designated GAM RNA, also designated SEQ ID:246.

Another function of GAM7776 is therefore inhibition of LOC283849 (Accession XP_208870.1). Accordingly, utilities of GAM7776 include diagnosis, prevention and treatment of diseases and clinical conditions associated with LOC283849.

LOC283849 (Accession NP_848611.1) is another GAM7776 target gene, herein designated TARGET GENE. LOC283849 BINDING SITE is a target binding site found in the 5' untranslated region of multiple transcripts of mRNA encoded by LOC283849, corresponding to a target binding site such as BINDING SITE I, BINDING SITE II or BINDING SITE III of FIG. 8. Table 4 illustrates the complementarity of the nucleotide sequences of LOC283849 BINDING SITE, designated SEQ ID:4308, to the nucleotide sequence of GAM7776 RNA, herein designated GAM RNA, also designated SEQ ID:246.

Another function of GAM7776 is therefore inhibition of LOC283849 (Accession NP_848611.1). Accordingly, utilities of GAM7776 include diagnosis, prevention and treatment of diseases and clinical conditions associated with LOC283849.

LOC283851 (Accession XP_211229.1) is another GAM7776 target gene, herein designated TARGET GENE. LOC283851 BINDING SITE is a target binding site found in the 3' untranslated region of mRNA encoded by LOC283851, corresponding to a target binding site such as BINDING SITE I, BINDING SITE II or BINDING SITE III of FIG. 8. Table 4 illustrates the complementarity of the nucleotide sequences of LOC283851 BINDING SITE, designated SEQ ID:4974, to the nucleotide sequence of GAM7776 RNA, herein designated GAM RNA, also designated SEQ ID:246.

Another function of GAM7776 is therefore inhibition of LOC283851 (Accession XP_211229.1). Accordingly, utilities of GAM7776 include diagnosis, prevention and treatment of diseases and clinical conditions associated with LOC283851.

LOC283856 (Accession XP_211233.1) is another GAM7776 target gene, herein designated TARGET GENE. LOC283856 BINDING SITE is a target binding site found in the 3' untranslated region of mRNA encoded by LOC283856, corresponding to a target binding site such as BINDING SITE I, BINDING SITE II or BINDING SITE III of FIG. 8. Table 4 illustrates the complementarity of the nucleotide sequences of LOC283856 BINDING SITE, designated SEQ ID:6184, to the nucleotide sequence of GAM7776 RNA, herein designated GAM RNA, also designated SEQ ID:246.

Another function of GAM7776 is therefore inhibition of LOC283856 (Accession XP_211233.1). Accordingly, utilities of GAM7776 include diagnosis, prevention and treatment of diseases and clinical conditions associated with LOC283856.

LOC283861 (Accession NP_787095.1) is another GAM7776 target gene, herein designated TARGET GENE. LOC283861 BINDING SITE1 and LOC283861 BINDING SITE2 are target binding sites found in untranslated regions of mRNA encoded by LOC283861, corresponding to target binding sites such as BINDING SITE I, BINDING SITE II or BINDING SITE III of FIG. 8. Table 4 illustrates the complementarity of the nucleotide sequences of LOC283861 BINDING SITE1 and LOC283861 BINDING SITE2, designated SEQ ID:1401 and SEQ ID:1635 respectively, to the nucleotide sequence of GAM7776 RNA, herein designated GAM RNA, also designated SEQ ID:246.

Another function of GAM7776 is therefore inhibition of LOC283861 (Accession NP_787095.1). Accordingly, utilities of GAM7776 include diagnosis, prevention and treatment of diseases and clinical conditions associated with LOC283861.

LOC283863 (Accession XP_208875.1) is another GAM7776 target gene, herein designated TARGET GENE. LOC283863 BINDING SITE is a target binding site found in the 3' untranslated region of mRNA encoded by LOC283863, corresponding to a target binding site such as BINDING SITE I, BINDING SITE II or BINDING SITE III of FIG. 8. Table 4 illustrates the complementarity of the nucleotide sequences of LOC283863 BINDING SITE, designated SEQ ID:13285, to the nucleotide sequence of GAM7776 RNA, herein designated GAM RNA, also designated SEQ ID:246.

Another function of GAM7776 is therefore inhibition of LOC283863 (Accession XP_208875.1). Accordingly, utilities of GAM7776 include diagnosis, prevention and treatment of diseases and clinical conditions associated with LOC283863.

LOC283887 (Accession XP_211248.2) is another GAM7776 target gene, herein designated TARGET GENE.

LOC283887 BINDING SITE is a target binding site found in the 5' untranslated region of mRNA encoded by LOC283887, corresponding to a target binding site such as BINDING SITE I, BINDING SITE II or BINDING SITE III of FIG. 8. Table 4 illustrates the complementarity of the nucleotide sequences of LOC283887 BINDING SITE, designated SEQ ID:18993, to the nucleotide sequence of GAM7776 RNA, herein designated GAM RNA, also designated SEQ ID:246.

Another function of GAM7776 is therefore inhibition of LOC283887 (Accession XP_211248.2). Accordingly, utilities of GAM7776 include diagnosis, prevention and treatment of diseases and clinical conditions associated with LOC283887.

LOC283888 (Accession XP_211249.1) is another GAM7776 target gene, herein designated TARGET GENE. LOC283888 BINDING SITE1 and LOC283888 BINDING SITE2 are target binding sites found in untranslated regions of mRNA encoded by LOC283888, corresponding to target binding sites such as BINDING SITE I, BINDING SITE II or BINDING SITE III of FIG. 8. Table 4 illustrates the complementarity of the nucleotide sequences of LOC283888 BINDING SITE1 and LOC283888 BINDING SITE2, designated SEQ ID:14104 and SEQ ID:11072 respectively, to the nucleotide sequence of GAM7776 RNA, herein designated GAM RNA, also designated SEQ ID:246.

Another function of GAM7776 is therefore inhibition of LOC283888 (Accession XP_211249.1). Accordingly, utilities of GAM7776 include diagnosis, prevention and treatment of diseases and clinical conditions associated with LOC283888.

LOC283889 (Accession XP_208899.1) is another GAM7776 target gene, herein designated TARGET GENE. LOC283889 BINDING SITE1 and LOC283889 BINDING SITE2 are target binding sites found in untranslated regions of mRNA encoded by LOC283889, corresponding to target binding sites such as BINDING SITE I, BINDING SITE II or BINDING SITE III of FIG. 8. Table 4 illustrates the complementarity of the nucleotide sequences of LOC283889 BINDING SITE1 and LOC283889 BINDING SITE2, designated SEQ ID:10739 and SEQ ID:3899 respectively, to the nucleotide sequence of GAM7776 RNA, herein designated GAM RNA, also designated SEQ ID:246.

Another function of GAM7776 is therefore inhibition of LOC283889 (Accession XP_208899.1). Accordingly, utilities of GAM7776 include diagnosis, prevention and treatment of diseases and clinical conditions associated with LOC283889.

LOC283928 (Accession XP_208909.1) is another GAM7776 target gene, herein designated TARGET GENE. LOC283928 BINDING SITE1 and LOC283928 BINDING SITE2 are target binding sites found in untranslated regions of mRNA encoded by LOC283928, corresponding to target binding sites such as BINDING SITE I, BINDING SITE II or BINDING SITE III of FIG. 8. Table 4 illustrates the complementarity of the nucleotide sequences of LOC283928 BINDING SITE1 and LOC283928 BINDING SITE2, designated SEQ ID:20101 and SEQ ID:4703 respectively, to the nucleotide sequence of GAM7776 RNA, herein designated GAM RNA, also designated SEQ ID:246.

Another function of GAM7776 is therefore inhibition of LOC283928 (Accession XP_208909.1). Accordingly, utilities of GAM7776 include diagnosis, prevention and treatment of diseases and clinical conditions associated with LOC283928.

LOC283929 (Accession XP_208905.2) is another GAM7776 target gene, herein designated TARGET GENE. LOC283929 BINDING SITE is a target binding site found in the 5' untranslated region of mRNA encoded by LOC283929, corresponding to a target binding site such as BINDING SITE I, BINDING SITE II or BINDING SITE III of FIG. 8. Table 4 illustrates the complementarity of the nucleotide sequences of LOC283929 BINDING SITE, designated SEQ ID:15775, to the nucleotide sequence of GAM7776 RNA, herein designated GAM RNA, also designated SEQ ID:246.

Another function of GAM7776 is therefore inhibition of LOC283929 (Accession XP_208905.2). Accordingly, utilities of GAM7776 include diagnosis, prevention and treatment of diseases and clinical conditions associated with LOC283929.

LOC283964 (Accession XP_208145.2) is another GAM7776 target gene, herein designated TARGET GENE. LOC283964 BINDING SITE is a target binding site found in the 3' untranslated region of mRNA encoded by LOC283964, corresponding to a target binding site such as BINDING SITE I, BINDING SITE II or BINDING SITE III of FIG. 8. Table 4 illustrates the complementarity of the nucleotide sequences of LOC283964 BINDING SITE, designated SEQ ID:19569, to the nucleotide sequence of GAM7776 RNA, herein designated GAM RNA, also designated SEQ ID:246.

Another function of GAM7776 is therefore inhibition of LOC283964 (Accession XP_208145.2). Accordingly, utilities of GAM7776 include diagnosis, prevention and treatment of diseases and clinical conditions associated with LOC283964.

LOC284001 (Accession XP_208958.2) is another GAM7776 target gene, herein designated TARGET GENE. LOC284001 BINDING SITE1 and LOC284001 BINDING SITE2 are target binding sites found in untranslated regions of mRNA encoded by LOC284001, corresponding to target binding sites such as BINDING SITE I, BINDING SITE II or BINDING SITE III of FIG. 8. Table 4 illustrates the complementarity of the nucleotide sequences of LOC284001 BINDING SITE1 and LOC284001 BINDING SITE2, designated SEQ ID:11764 and SEQ ID:18161 respectively, to the nucleotide sequence of GAM7776 RNA, herein designated GAM RNA, also designated SEQ ID:246.

Another function of GAM7776 is therefore inhibition of LOC284001 (Accession XP_208958.2). Accordingly, utilities of GAM7776 include diagnosis, prevention and treatment of diseases and clinical conditions associated with LOC284001.

LOC284016 (Accession XP_211298.1) is another GAM7776 target gene, herein designated TARGET GENE. LOC284016 BINDING SITE is a target binding site found in the 3' untranslated region of mRNA encoded by LOC284016, corresponding to a target binding site such as BINDING SITE I, BINDING SITE II or BINDING SITE III of FIG. 8. Table 4 illustrates the complementarity of the nucleotide sequences of LOC284016 BINDING SITE, designated SEQ ID:3244, to the nucleotide sequence of GAM7776 RNA, herein designated GAM RNA, also designated SEQ ID:246.

Another function of GAM7776 is therefore inhibition of LOC284016 (Accession XP_211298.1). Accordingly, utilities of GAM7776 include diagnosis, prevention and treatment of diseases and clinical conditions associated with LOC284016.

LOC284017 (Accession XP_208961.1) is another GAM7776 target gene, herein designated TARGET GENE. LOC284017 BINDING SITE is a target binding site found in the 3' untranslated region of mRNA encoded by LOC284017, corresponding to a target binding site such as BINDING SITE I, BINDING SITE II or BINDING SITE III of FIG. 8. Table 4 illustrates the complementarity of the nucleotide sequences of LOC284017 BINDING SITE, designated SEQ ID:18610, to the nucleotide sequence of GAM7776 RNA, herein designated GAM RNA, also designated SEQ ID:246.

Another function of GAM7776 is therefore inhibition of LOC284017 (Accession XP_208961.1). Accordingly, utilities of GAM7776 include diagnosis, prevention and treatment of diseases and clinical conditions associated with LOC284017.

LOC284019 (Accession XP_211302.1) is another GAM7776 target gene, herein designated TARGET GENE. LOC284019 BINDING SITE is a target binding site found in the 3' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:10124, to the nucleotide sequence of GAM7776 RNA, herein designated GAM RNA, also designated SEQ ID:246.

Another function of GAM7776 is therefore inhibition of LOC284019 (Accession XP_211302.1). Accordingly, utilities of GAM7776 include diagnosis, prevention and treatment of diseases and clinical conditions associated with LOC284019.

LOC284023 (Accession XP_208983.3) is another GAM7776 target gene, herein designated TARGET GENE. LOC284023 BINDING SITE1 and LOC284023 BINDING SITE2 are target binding sites found in untranslated regions of mRNA encoded by LOC284023, corresponding to target binding sites such as BINDING SITE I, BINDING SITE II or BINDING SITE III of FIG. 8. Table 4 illustrates the complementarity of the nucleotide sequences of LOC284023 BINDING SITE1 and LOC284023 BINDING SITE2, designated SEQ ID:14597 and SEQ ID:17953 respectively, to the nucleotide sequence of GAM7776 RNA, herein designated GAM RNA, also designated SEQ ID:246.

Another function of GAM7776 is therefore inhibition of LOC284023 (Accession XP_208983.3). Accordingly, utilities of GAM7776 include diagnosis, prevention and treatment of diseases and clinical conditions associated with LOC284023.

LOC284048 (Accession XP_208152.1) is another GAM7776 target gene, herein designated TARGET GENE. LOC284048 BINDING SITE is a target binding site found in the 3' untranslated region of mRNA encoded by LOC284048, corresponding to a target binding site such as BINDING SITE I, BINDING SITE II or BINDING SITE III of FIG. 8. Table 4 illustrates the complementarity of the nucleotide sequences of LOC284048 BINDING SITE, designated SEQ ID:10847, to the nucleotide sequence of GAM7776 RNA, herein designated GAM RNA, also designated SEQ ID:246.

Another function of GAM7776 is therefore inhibition of LOC284048 (Accession XP_208152.1). Accordingly, utilities of GAM7776 include diagnosis, prevention and treatment of diseases and clinical conditions associated with LOC284048.

LOC284074 (Accession XP_211321.1) is another GAM7776 target gene, herein designated TARGET GENE. LOC284074 BINDING SITE1 and LOC284074 BINDING SITE2 are target binding sites found in untranslated regions of mRNA encoded by LOC284074, corresponding to target binding sites such as BINDING SITE I, BINDING SITE II or BINDING SITE III of FIG. 8. Table 4 illustrates the complementarity of the nucleotide sequences of LOC284074 BINDING SITE1 and LOC284074 BINDING SITE2, designated SEQ ID:15531 and SEQ ID:1596 respectively, to the nucleotide sequence of GAM7776 RNA, herein designated GAM RNA, also designated SEQ ID:246.

Another function of GAM7776 is therefore inhibition of LOC284074 (Accession XP_211321.1). Accordingly, utilities of GAM7776 include diagnosis, prevention and treatment of diseases and clinical conditions associated with LOC284074.

LOC284082 (Accession XP_211323.1) is another GAM7776 target gene, herein designated TARGET GENE. LOC284082 BINDING SITE is a target binding site found in the 3' untranslated region of mRNA encoded by LOC284082, corresponding to a target binding site such as BINDING SITE I, BINDING SITE II or BINDING SITE III of FIG. 8. Table 4 illustrates the complementarity of the nucleotide sequences of LOC284082 BINDING SITE, designated SEQ ID:18527, to the nucleotide sequence of GAM7776 RNA, herein designated GAM RNA, also designated SEQ ID:246.

Another function of GAM7776 is therefore inhibition of LOC284082 (Accession XP_211323.1). Accordingly, utilities of GAM7776 include diagnosis, prevention and treatment of diseases and clinical conditions associated with LOC284082.

LOC284095 (Accession XP_211324.1) is another GAM7776 target gene, herein designated TARGET GENE. LOC284095 BINDING SITE1 through LOC284095 BINDING SITE3 are target binding sites found in untranslated regions of mRNA encoded by LOC284095, corresponding to target binding sites such as BINDING SITE I, BINDING SITE II or BINDING SITE III of FIG. 8. Table 4 illustrates the complementarity of the nucleotide sequences of LOC284095 BINDING SITE1 through LOC284095 BINDING SITE3, designated SEQ ID:11799, SEQ ID:15513 and SEQ ID:7333 respectively, to the nucleotide sequence of GAM7776 RNA, herein designated GAM RNA, also designated SEQ ID:246.

Another function of GAM7776 is therefore inhibition of LOC284095 (Accession XP_211324.1). Accordingly, utilities of GAM7776 include diagnosis, prevention and treatment of diseases and clinical conditions associated with LOC284095.

LOC284098 (Accession XP_209008.3) is another GAM7776 target gene, herein designated TARGET GENE. LOC284098 BINDING SITE is a target binding site found in the 3' untranslated region of mRNA encoded by LOC284098, corresponding to a target binding site such as BINDING SITE I, BINDING SITE II or BINDING SITE III of FIG. 8. Table 4 illustrates the complementarity of the nucleotide sequences of LOC284098 BINDING SITE, designated SEQ ID:8582, to the nucleotide sequence of GAM7776 RNA, herein designated GAM RNA, also designated SEQ ID:246.

Another function of GAM7776 is therefore inhibition of LOC284098 (Accession XP_209008.3). Accordingly, utilities of GAM7776 include diagnosis, prevention and treatment of diseases and clinical conditions associated with LOC284098.

LOC284100 (Accession XP_209015.1) is another GAM7776 target gene, herein designated TARGET GENE. LOC284100 BINDING SITE is a target binding site found in the 3' untranslated region of mRNA encoded by LOC284100, corresponding to a target binding site such as BINDING SITE I, BINDING SITE II or BINDING SITE III of FIG. 8. Table 4 illustrates the complementarity of the nucleotide sequences of LOC284100 BINDING SITE, designated SEQ ID:1777, to the nucleotide sequence of GAM7776 RNA, herein designated GAM RNA, also designated SEQ ID:246.

Another function of GAM7776 is therefore inhibition of LOC284100 (Accession XP_209015.1). Accordingly, utilities of GAM7776 include diagnosis, prevention and treatment of diseases and clinical conditions associated with LOC284100.

LOC284101 (Accession XP_209019.1) is another GAM7776 target gene, herein designated TARGET GENE. LOC284101 BINDING SITE is a target binding site found in the 5' untranslated region of mRNA encoded by LOC284101, corresponding to a target binding site such as BINDING SITE I, BINDING SITE II or BINDING SITE III of FIG. 8. Table 4 illustrates the complementarity of the nucleotide sequences of LOC284101 BINDING SITE, designated SEQ ID:19537, to the nucleotide sequence of GAM7776 RNA, herein designated GAM RNA, also designated SEQ ID:246.

Another function of GAM7776 is therefore inhibition of LOC284101 (Accession XP_209019.1). Accordingly, utilities of GAM7776 include diagnosis, prevention and treatment of diseases and clinical conditions associated with LOC284101.

LOC284102 (Accession XP_211327.3) is another GAM7776 target gene, herein designated TARGET GENE. LOC284102 BINDING SITE1 through LOC284102 BINDING SITE3 are target binding sites found in untranslated regions of mRNA encoded by LOC284102, corresponding to target binding sites such as BINDING SITE I, BINDING SITE II or BINDING SITE III of FIG. 8. Table 4 illustrates the complementarity of the nucleotide sequences of LOC284102 BINDING SITE1 through LOC284102 BINDING SITE3, designated SEQ ID:18149, SEQ ID:7745 and SEQ ID:3233 respectively, to the nucleotide sequence of GAM7776 RNA, herein designated GAM RNA, also designated SEQ ID:246.

Another function of GAM7776 is therefore inhibition of LOC284102 (Accession XP_211327.3). Accordingly, utilities of GAM7776 include diagnosis, prevention and treatment of diseases and clinical conditions associated with LOC284102.

LOC284128 (Accession XP_211342.1) is another GAM7776 target gene, herein designated TARGET GENE. LOC284128 BINDING SITE1 and LOC284128 BINDING SITE2 are target binding sites found in untranslated regions of mRNA encoded by LOC284128, corresponding to target binding sites such as BINDING SITE I, BINDING SITE II or BINDING SITE III of FIG. 8. Table 4 illustrates the complementarity of the nucleotide sequences of LOC284128 BINDING SITE1 and LOC284128 BINDING SITE2, designated SEQ ID:1966 and SEQ ID:17271 respectively, to the nucleotide sequence of GAM7776 RNA, herein designated GAM RNA, also designated SEQ ID:246.

Another function of GAM7776 is therefore inhibition of LOC284128 (Accession XP_211342.1). Accordingly, utilities of GAM7776 include diagnosis, prevention and treatment of diseases and clinical conditions associated with LOC284128.

LOC284135 (Accession XP_209032.1) is another GAM7776 target gene, herein designated TARGET GENE. LOC284135 BINDING SITE is a target binding site found in the 3' untranslated region of mRNA encoded by LOC284135, corresponding to a target binding site such as BINDING SITE I, BINDING SITE II or BINDING SITE III of FIG. 8. Table 4 illustrates the complementarity of the nucleotide sequences of LOC284135 BINDING SITE, designated SEQ ID:12779, to the nucleotide sequence of GAM7776 RNA, herein designated GAM RNA, also designated SEQ ID:246.

Another function of GAM7776 is therefore inhibition of LOC284135 (Accession XP_209032.1). Accordingly, utilities of GAM7776 include diagnosis, prevention and treatment of diseases and clinical conditions associated with LOC284135.

LOC284145 (Accession XP_211353.1) is another GAM7776 target gene, herein designated TARGET GENE. LOC284145 BINDING SITE is a target binding site found in the 5' untranslated region of mRNA encoded by LOC284145, corresponding to a target binding site such as BINDING SITE I, BINDING SITE II or BINDING SITE III of FIG. 8. Table 4 illustrates the complementarity of the nucleotide sequences of LOC284145 BINDING SITE, designated SEQ ID:4102, to the nucleotide sequence of GAM7776 RNA, herein designated GAM RNA, also designated SEQ ID:246.

Another function of GAM7776 is therefore inhibition of LOC284145 (Accession XP_211353.1). Accordingly, utilities of GAM7776 include diagnosis, prevention and treatment of diseases and clinical conditions associated with LOC284145.

LOC284171 (Accession XP_209051.1) is another GAM7776 target gene, herein designated TARGET GENE. LOC284171 BINDING SITE is a target binding site found in the 3' untranslated region of mRNA encoded by LOC284171, corresponding to a target binding site such as BINDING SITE I, BINDING SITE II or BINDING SITE III of FIG. 8. Table 4 illustrates the complementarity of the nucleotide sequences of LOC284171 BINDING SITE, designated SEQ ID:11530, to the nucleotide sequence of GAM7776 RNA, herein designated GAM RNA, also designated SEQ ID:246.

Another function of GAM7776 is therefore inhibition of LOC284171 (Accession XP_209051.1). Accordingly, utilities of GAM7776 include diagnosis, prevention and treatment of diseases and clinical conditions associated with LOC284171.

LOC284183 (Accession XP_209059.1) is another GAM7776 target gene, herein designated TARGET GENE. LOC284183 BINDING SITE1 and LOC284183 BINDING SITE2 are target binding sites found in untranslated regions of mRNA encoded by LOC284183, corresponding to target binding sites such as BINDING SITE I, BINDING SITE II or BINDING SITE III of FIG. 8. Table 4 illustrates the complementarity of the nucleotide sequences of LOC284183 BINDING SITE1 and LOC284183 BINDING SITE2, designated SEQ ID:1111 and SEQ ID:9456 respectively, to the nucleotide sequence of GAM7776 RNA, herein designated GAM RNA, also designated SEQ ID:246.

Another function of GAM7776 is therefore inhibition of LOC284183 (Accession XP_209059.1). Accordingly, utilities of GAM7776 include diagnosis, prevention and treatment of diseases and clinical conditions associated with LOC284183.

LOC284186 (Accession XP_209060.2) is another GAM7776 target gene, herein designated TARGET GENE. LOC284186 BINDING SITE is a target binding site found in the 3' untranslated region of mRNA encoded by LOC284186, corresponding to a target binding site such as BINDING SITE I, BINDING SITE II or BINDING SITE III of FIG. 8. Table 4 illustrates the complementarity of the nucleotide sequences of LOC284186 BINDING SITE, designated SEQ ID:14861, to the nucleotide sequence of GAM7776 RNA, herein designated GAM RNA, also designated SEQ ID:246.

Another function of GAM7776 is therefore inhibition of LOC284186 (Accession XP_209060.2). Accordingly, utilities of GAM7776 include diagnosis, prevention and treatment of diseases and clinical conditions associated with LOC284186.

LOC284191 (Accession XP_211377.1) is another GAM7776 target gene, herein designated TARGET GENE. LOC284191 BINDING SITE is a target binding site found in the 5' untranslated region of mRNA encoded by LOC284191, corresponding to a target binding site such as BINDING SITE I, BINDING SITE II or BINDING SITE III of FIG. 8. Table 4 illustrates the complementarity of the nucleotide sequences of LOC284191 BINDING SITE, designated SEQ ID:4421, to the nucleotide sequence of GAM7776 RNA, herein designated GAM RNA, also designated SEQ ID:246.

Another function of GAM7776 is therefore inhibition of LOC284191 (Accession XP_211377.1). Accordingly, utilities of GAM7776 include diagnosis, prevention and treatment of diseases and clinical conditions associated with LOC284191.

LOC284202 (Accession XP_208174.2) is another GAM7776 target gene, herein designated TARGET GENE. LOC284202 BINDING SITE is a target binding site found in the 3' untranslated region of mRNA encoded by LOC284202, corresponding to a target binding site such as BINDING SITE I, BINDING SITE II or BINDING SITE III of FIG. 8. Table 4 illustrates the complementarity of the nucleotide sequences of LOC284202 BINDING SITE, designated SEQ ID:3800, to the nucleotide sequence of GAM7776 RNA, herein designated GAM RNA, also designated SEQ ID:246.

Another function of GAM7776 is therefore inhibition of LOC284202 (Accession XP_208174.2). Accordingly, utilities of GAM7776 include diagnosis, prevention and treatment of diseases and clinical conditions associated with LOC284202.

LOC284267 (Accession XP_211411.1) is another GAM7776 target gene, herein designated TARGET GENE. LOC284267 BINDING SITE is a target binding site found in the 5' untranslated region of mRNA encoded by LOC284267, corresponding to a target binding site such as BINDING SITE I, BINDING SITE II or BINDING SITE III of FIG. 8. Table 4 illustrates the complementarity of the nucleotide sequences of LOC284267 BINDING SITE, designated SEQ ID:8494, to the nucleotide sequence of GAM7776 RNA, herein designated GAM RNA, also designated SEQ ID:246.

Another function of GAM7776 is therefore inhibition of LOC284267 (Accession XP_211411.1). Accordingly, utilities of GAM7776 include diagnosis, prevention and treatment of diseases and clinical conditions associated with LOC284267.

LOC284276 (Accession XP_211412.1) is another GAM7776 target gene, herein designated TARGET GENE. LOC284276 BINDING SITE is a target binding site found in the 5' untranslated region of mRNA encoded by LOC284276, corresponding to a target binding site such as BINDING SITE I, BINDING SITE II or BINDING SITE III of FIG. 8. Table 4 illustrates the complementarity of the nucleotide sequences of LOC284276 BINDING SITE, designated SEQ ID:1026, to the nucleotide sequence of GAM7776 RNA, herein designated GAM RNA, also designated SEQ ID:246.

Another function of GAM7776 is therefore inhibition of LOC284276 (Accession XP_211412.1). Accordingly, utilities of GAM7776 include diagnosis, prevention and treatment of diseases and clinical conditions associated with LOC284276.

LOC284286 (Accession XP_211419.1) is another GAM7776 target gene, herein designated TARGET GENE. LOC284286 BINDING SITE is a target binding site found in the 3' untranslated region of mRNA encoded by LOC284286, corresponding to a target binding site such as BINDING SITE I, BINDING SITE II or BINDING SITE III of FIG. 8. Table 4 illustrates the complementarity of the nucleotide sequences of LOC284286 BINDING SITE, designated SEQ ID:19875, to the nucleotide sequence of GAM7776 RNA, herein designated GAM RNA, also designated SEQ ID:246.

Another function of GAM7776 is therefore inhibition of LOC284286 (Accession XP_211419.1). Accordingly, utilities of GAM7776 include diagnosis, prevention and treatment of diseases and clinical conditions associated with LOC284286.

LOC284289 (Accession XP_209105.1) is another GAM7776 target gene, herein designated TARGET GENE. LOC284289 BINDING SITE1 and LOC284289 BINDING SITE2 are target binding sites found in untranslated regions of mRNA encoded by LOC284289, corresponding to target binding sites such as BINDING SITE I, BINDING SITE II or BINDING SITE III of FIG. 8. Table 4 illustrates the complementarity of the nucleotide sequences of LOC284289 BINDING SITE1 and LOC284289 BINDING SITE2, designated SEQ ID:16648 and SEQ ID:1885 respectively, to the nucleotide sequence of GAM7776 RNA, herein designated GAM RNA, also designated SEQ ID:246.

Another function of GAM7776 is therefore inhibition of LOC284289 (Accession XP_209105.1). Accordingly, utilities of GAM7776 include diagnosis, prevention and treatment of diseases and clinical conditions associated with LOC284289.

LOC284297 (Accession XP_209112.1) is another GAM7776 target gene, herein designated TARGET GENE. LOC284297 BINDING SITE is a target binding site found in the 3' untranslated region of mRNA encoded by LOC284297, corresponding to a target binding site such as BINDING SITE I, BINDING SITE II or BINDING SITE III of FIG. 8. Table 4 illustrates the complementarity of the nucleotide sequences of LOC284297 BINDING SITE, designated SEQ ID:1751, to the nucleotide sequence of GAM7776 RNA, herein designated GAM RNA, also designated SEQ ID:246.

Another function of GAM7776 is therefore inhibition of LOC284297 (Accession XP_209112.1). Accordingly, utilities of GAM7776 include diagnosis, prevention and treatment of diseases and clinical conditions associated with LOC284297.

LOC284304 (Accession XP_211426.1) is another GAM7776 target gene, herein designated TARGET GENE. LOC284304 BINDING SITE is a target binding site found in the 3' untranslated region of mRNA encoded by LOC284304, corresponding to a target binding site such as BINDING SITE I, BINDING SITE II or BINDING SITE III of FIG. 8. Table 4 illustrates the complementarity of the nucleotide sequences of LOC284304 BINDING SITE, designated SEQ ID:4849, to the nucleotide sequence of GAM7776 RNA, herein designated GAM RNA, also designated SEQ ID:246.

Another function of GAM7776 is therefore inhibition of LOC284304 (Accession XP_211426.1). Accordingly, utilities of GAM7776 include diagnosis, prevention and treatment of diseases and clinical conditions associated with LOC284304.

LOC284317 (Accession XP_209162.1) is another GAM7776 target gene, herein designated TARGET GENE. LOC284317 BINDING SITE1 and LOC284317 BINDING SITE2 are target binding sites found in untranslated regions of mRNA encoded by LOC284317, corresponding to target binding sites such as BINDING SITE I, BINDING SITE II or BINDING SITE III of FIG. 8. Table 4 illustrates the complementarity of the nucleotide sequences of LOC284317 BINDING SITE1 and LOC284317 BINDING SITE2, designated SEQ ID:7077 and SEQ ID:3386 respectively, to the nucleotide sequence of GAM7776 RNA, herein designated GAM RNA, also designated SEQ ID:246.

Another function of GAM7776 is therefore inhibition of LOC284317 (Accession XP_209162.1). Accordingly, utilities of GAM7776 include diagnosis, prevention and treatment of diseases and clinical conditions associated with LOC284317.

LOC284325 (Accession XP_209143.1) is another GAM7776 target gene, herein designated TARGET GENE. LOC284325 BINDING SITE is a target binding site found in the 3' untranslated region of mRNA encoded by LOC284325, corresponding to a target binding site such as BINDING SITE I, BINDING SITE II or BINDING SITE III of FIG. 8. Table 4 illustrates the complementarity of the nucleotide sequences of LOC284325 BINDING SITE, designated SEQ ID:1731, to the nucleotide sequence of GAM7776 RNA, herein designated GAM RNA, also designated SEQ ID:246.

Another function of GAM7776 is therefore inhibition of LOC284325 (Accession XP_209143.1). Accordingly, utilities of GAM7776 include diagnosis, prevention and treatment of diseases and clinical conditions associated with LOC284325.

LOC284356 (Accession XP_211437.1) is another GAM7776 target gene, herein designated TARGET GENE. LOC284356 BINDING SITE is a target binding site found in the 3' untranslated region of mRNA encoded by LOC284356, corresponding to a target binding site such as BINDING SITE I, BINDING SITE II or BINDING SITE III of FIG. 8. Table 4 illustrates the complementarity of the nucleotide sequences of LOC284356 BINDING SITE, designated SEQ ID:11986, to the nucleotide sequence of GAM7776 RNA, herein designated GAM RNA, also designated SEQ ID:246.

Another function of GAM7776 is therefore inhibition of LOC284356 (Accession XP_211437.1). Accordingly, utilities of GAM7776 include diagnosis, prevention and treatment of diseases and clinical conditions associated with LOC284356.

LOC284362 (Accession XP_211435.1) is another GAM7776 target gene, herein designated TARGET GENE. LOC284362 BINDING SITE is a target binding site found in the 3' untranslated region of mRNA encoded by LOC284362, corresponding to a target binding site such as BINDING SITE I, BINDING SITE II or BINDING SITE III of FIG. 8. Table 4 illustrates the complementarity of the nucleotide sequences of LOC284362 BINDING SITE, designated SEQ ID:18898, to the nucleotide sequence of GAM7776 RNA, herein designated GAM RNA, also designated SEQ ID:246.

Another function of GAM7776 is therefore inhibition of LOC284362 (Accession XP_211435.1). Accordingly, utilities of GAM7776 include diagnosis, prevention and treatment of diseases and clinical conditions associated with LOC284362.

LOC284375 (Accession XP_209154.1) is another GAM7776 target gene, herein designated TARGET GENE. LOC284375 BINDING SITE is a target binding site found in the 3' untranslated region of mRNA encoded by LOC284375, corresponding to a target binding site such as BINDING SITE I, BINDING SITE II or BINDING SITE III of FIG. 8. Table 4 illustrates the complementarity of the nucleotide sequences of LOC284375 BINDING SITE, designated SEQ ID:16701, to the nucleotide sequence of GAM7776 RNA, herein designated GAM RNA, also designated SEQ ID:246.

Another function of GAM7776 is therefore inhibition of LOC284375 (Accession XP_209154.1). Accordingly, utilities of GAM7776 include diagnosis, prevention and treatment of diseases and clinical conditions associated with LOC284375.

LOC284376 (Accession XP_209157.1) is another GAM7776 target gene, herein designated TARGET GENE. LOC284376 BINDING SITE is a target binding site found in the 3' untranslated region of mRNA encoded by LOC284376, corresponding to a target binding site such as BINDING SITE I, BINDING SITE II or BINDING SITE III of FIG. 8. Table 4 illustrates the complementarity of the nucleotide sequences of LOC284376 BINDING SITE, designated SEQ ID:19718, to the nucleotide sequence of GAM7776 RNA, herein designated GAM RNA, also designated SEQ ID:246.

Another function of GAM7776 is therefore inhibition of LOC284376 (Accession XP_209157.1). Accordingly, utilities of GAM7776 include diagnosis, prevention and treatment of diseases and clinical conditions associated with LOC284376.

LOC284379 (Accession XP_209163.1) is another GAM7776 target gene, herein designated TARGET GENE. LOC284379 BINDING SITE is a target binding site found in the 3' untranslated region of mRNA encoded by LOC284379, corresponding to a target binding site such as BINDING SITE I, BINDING SITE II or BINDING SITE III of FIG. 8. Table 4 illustrates the complementarity of the nucleotide sequences of LOC284379 BINDING SITE, designated SEQ ID:9312, to the nucleotide sequence of GAM7776 RNA, herein designated GAM RNA, also designated SEQ ID:246.

Another function of GAM7776 is therefore inhibition of LOC284379 (Accession XP_209163.1). Accordingly, utilities of GAM7776 include diagnosis, prevention and treatment of diseases and clinical conditions associated with LOC284379.

LOC284395 (Accession XP_211454.1) is another GAM7776 target gene, herein designated TARGET GENE. LOC284395 BINDING SITE is a target binding site found in the 5' untranslated region of mRNA encoded by LOC284395, corresponding to a target binding site such as BINDING SITE I, BINDING SITE II or BINDING SITE III of FIG. 8. Table 4 illustrates the complementarity of the nucleotide sequences of LOC284395 BINDING SITE, designated SEQ ID:16459, to the nucleotide sequence of GAM7776 RNA, herein designated GAM RNA, also designated SEQ ID:246.

Another function of GAM7776 is therefore inhibition of LOC284395 (Accession XP_211454.1). Accordingly, utilities of GAM7776 include diagnosis, prevention and treatment of diseases and clinical conditions associated with LOC284395.

LOC284396 (Accession XP_211452.1) is another GAM7776 target gene, herein designated TARGET GENE. LOC284396 BINDING SITE is a target binding site found in the 3' untranslated region of mRNA encoded by LOC284396, corresponding to a target binding site such as BINDING SITE I, BINDING SITE II or BINDING SITE III of FIG. 8. Table 4 illustrates the complementarity of the nucleotide sequences of LOC284396 BINDING SITE, designated SEQ ID:10399, to the nucleotide sequence of GAM7776 RNA, herein designated GAM RNA, also designated SEQ ID:246.

Another function of GAM7776 is therefore inhibition of LOC284396 (Accession XP_211452.1). Accordingly, utilities of GAM7776 include diagnosis, prevention and treatment of diseases and clinical conditions associated with LOC284396.

LOC284405 (Accession XP_209183.2) is another GAM7776 target gene, herein designated TARGET GENE. LOC284405 BINDING SITE1 and LOC284405 BINDING SITE2 are target binding sites found in untranslated regions of mRNA encoded by LOC284405, corresponding to target binding sites such as BINDING SITE I, BINDING SITE II or BINDING SITE III of FIG. 8. Table 4 illustrates the complementarity of the nucleotide sequences of LOC284405 BINDING SITE1 and LOC284405 BINDING SITE2, designated SEQ ID:19462 and SEQ ID:2645 respectively, to the nucleotide sequence of GAM7776 RNA, herein designated GAM RNA, also designated SEQ ID:246.

Another function of GAM7776 is therefore inhibition of LOC284405 (Accession XP_209183.2). Accordingly, utilities of GAM7776 include diagnosis, prevention and treatment of diseases and clinical conditions associated with LOC284405.

LOC284408 (Accession XP_211443.1) is another GAM7776 target gene, herein designated TARGET GENE. LOC284408 BINDING SITE is a target binding site found in the 5' untranslated region of mRNA encoded by LOC284408, corresponding to a target binding site such as BINDING SITE I, BINDING SITE II or BINDING SITE III of FIG. 8. Table 4 illustrates the complementarity of the nucleotide sequences of LOC284408 BINDING SITE, designated SEQ ID:14364, to the nucleotide sequence of GAM7776 RNA, herein designated GAM RNA, also designated SEQ ID:246.

Another function of GAM7776 is therefore inhibition of LOC284408 (Accession XP_211443.1). Accordingly, utilities of GAM7776 include diagnosis, prevention and treatment of diseases and clinical conditions associated with LOC284408.

LOC284410 (Accession XP_211449.1) is another GAM7776 target gene, herein designated TARGET GENE. LOC284410 BINDING SITE is a target binding site found in the 3' untranslated region of mRNA encoded by LOC284410, corresponding to a target binding site such as BINDING SITE I, BINDING SITE II or BINDING SITE III of FIG. 8. Table 4 illustrates the complementarity of the nucleotide sequences of LOC284410 BINDING SITE, designated SEQ ID:17304, to the nucleotide sequence of GAM7776 RNA, herein designated GAM RNA, also designated SEQ ID:246.

Another function of GAM7776 is therefore inhibition of LOC284410 (Accession XP_211449.1). Accordingly, utilities of GAM7776 include diagnosis, prevention and treatment of diseases and clinical conditions associated with LOC284410.

LOC284421 (Accession XP_209200.1) is another GAM7776 target gene, herein designated TARGET GENE. LOC284421 BINDING SITE1 and LOC284421 BINDING SITE2 are target binding sites found in untranslated regions of mRNA encoded by LOC284421, corresponding to target binding sites such as BINDING SITE I, BINDING SITE II or BINDING SITE III of FIG. 8. Table 4 illustrates the complementarity of the nucleotide sequences of LOC284421 BINDING SITE1 and LOC284421 BINDING SITE2, designated SEQ ID:4533 and SEQ ID:15844 respectively, to the nucleotide sequence of GAM7776 RNA, herein designated GAM RNA, also designated SEQ ID:246.

Another function of GAM7776 is therefore inhibition of LOC284421 (Accession XP_209200.1). Accordingly, utilities of GAM7776 include diagnosis, prevention and treatment of diseases and clinical conditions associated with LOC284421.

LOC284421 (Accession XP_209200.1) is another GAM7776 target gene, herein designated TARGET GENE. LOC284421 BINDING SITE1 and LOC284421 BINDING SITE2 are target binding sites found in untranslated regions of mRNA encoded by LOC284421, corresponding to target binding sites such as BINDING SITE I, BINDING SITE II or BINDING SITE III of FIG. 8. Table 4 illustrates the complementarity of the nucleotide sequences of LOC284421 BINDING SITE1 and LOC284421 BINDING SITE2, designated SEQ ID:15844 and SEQ ID:13177 respectively, to the nucleotide sequence of GAM7776 RNA, herein designated GAM RNA, also designated SEQ ID:246.

Another function of GAM7776 is therefore inhibition of LOC284421 (Accession XP_209200.1). Accordingly, utilities of GAM7776 include diagnosis, prevention and treatment of diseases and clinical conditions associated with LOC284421.

LOC284426 (Accession XP_209198.1) is another GAM7776 target gene, herein designated TARGET GENE. LOC284426 BINDING SITE1 through LOC284426 BINDING SITE3 are target binding sites found in untranslated regions of mRNA encoded by LOC284426, corresponding to target binding sites such as BINDING SITE I, BINDING SITE II or BINDING SITE III of FIG. 8. Table 4 illustrates the complementarity of the nucleotide sequences of LOC284426 BINDING SITE1 through LOC284426 BINDING SITE3, designated SEQ ID:4975, SEQ ID:5357 and SEQ ID:8752 respectively, to the nucleotide sequence of GAM7776 RNA, herein designated GAM RNA, also designated SEQ ID:246.

Another function of GAM7776 is therefore inhibition of LOC284426 (Accession XP_209198.1). Accordingly, utilities of GAM7776 include diagnosis, prevention and treatment of diseases and clinical conditions associated with LOC284426.

LOC284454 (Accession XP_209216.1) is another GAM7776 target gene, herein designated TARGET GENE. LOC284454 BINDING SITE1 through LOC284454 BINDING SITE3 are target binding sites found in untranslated regions of mRNA encoded by LOC284454, corresponding to target binding sites such as BINDING SITE I, BINDING SITE II or BINDING SITE III of FIG. 8. Table 4 illustrates the complementarity of the nucleotide sequences of LOC284454 BINDING SITE1 through LOC284454 BINDING SITE3, designated SEQ ID:19117, SEQ ID:3999 and SEQ ID:16031 respectively, to the nucleotide sequence of GAM7776 RNA, herein designated GAM RNA, also designated SEQ ID:246.

Another function of GAM7776 is therefore inhibition of LOC284454 (Accession XP_209216.1). Accordingly, utilities of GAM7776 include diagnosis, prevention and treatment of diseases and clinical conditions associated with LOC284454.

LOC284456 (Accession XP_211470.1) is another GAM7776 target gene, herein designated TARGET GENE. LOC284456 BINDING SITE is a target binding site found in the 3' untranslated region of mRNA encoded by LOC284456, corresponding to a target binding site such as BINDING SITE I, BINDING SITE II or BINDING SITE III of FIG. 8. Table 4 illustrates the complementarity of the nucleotide sequences of LOC284456 BINDING SITE, designated SEQ ID:18777, to the nucleotide sequence of GAM7776 RNA, herein designated GAM RNA, also designated SEQ ID:246.

Another function of GAM7776 is therefore inhibition of LOC284456 (Accession XP_211470.1). Accordingly, utilities of GAM7776 include diagnosis, prevention and treatment of diseases and clinical conditions associated with LOC284456.

LOC284471 (Accession XP_209225.1) is another GAM7776 target gene, herein designated TARGET GENE. LOC284471 BINDING SITE is a target binding site found in the 3' untranslated region of mRNA encoded by LOC284471, corresponding to a target binding site such as BINDING SITE I, BINDING SITE II or BINDING SITE III of FIG. 8. Table 4 illustrates the complementarity of the nucleotide sequences of LOC284471 BINDING SITE, designated SEQ ID:19286, to the nucleotide sequence of GAM7776 RNA, herein designated GAM RNA, also designated SEQ ID:246.

Another function of GAM7776 is therefore inhibition of LOC284471 (Accession XP_209225.1). Accordingly, utilities of GAM7776 include diagnosis, prevention and treatment of diseases and clinical conditions associated with LOC284471.

LOC284512 (Accession XP_211500.1) is another GAM7776 target gene, herein designated TARGET GENE. LOC284512 BINDING SITE is a target binding site found in the 3' untranslated region of mRNA encoded by LOC284512, corresponding to a target binding site such as BINDING SITE I, BINDING SITE II or BINDING SITE III of FIG. 8. Table 4 illustrates the complementarity of the nucleotide sequences of LOC284512 BINDING SITE, designated SEQ ID:14119, to the nucleotide sequence of GAM7776 RNA, herein designated GAM RNA, also designated SEQ ID:246.

Another function of GAM7776 is therefore inhibition of LOC284512 (Accession XP_211500.1). Accordingly, utilities of GAM7776 include diagnosis, prevention and treatment of diseases and clinical conditions associated with LOC284512.

LOC284513 (Accession XP_211502.1) is another GAM7776 target gene, herein designated TARGET GENE. LOC284513 BINDING SITE is a target binding site found in the 5' untranslated region of mRNA encoded by LOC284513, corresponding to a target binding site such as BINDING SITE I, BINDING SITE II or BINDING SITE III of FIG. 8. Table 4 illustrates the complementarity of the nucleotide sequences of LOC284513 BINDING SITE, designated SEQ ID:18865, to the nucleotide sequence of GAM7776 RNA, herein designated GAM RNA, also designated SEQ ID:246.

Another function of GAM7776 is therefore inhibition of LOC284513 (Accession XP_211502.1). Accordingly, utilities of GAM7776 include diagnosis, prevention and treatment of diseases and clinical conditions associated with LOC284513.

LOC284549 (Accession XP_211514.1) is another GAM7776 target gene, herein designated TARGET GENE. LOC284549 BINDING SITE is a target binding site found in the 5' untranslated region of mRNA encoded by LOC284549, corresponding to a target binding site such as BINDING SITE I, BINDING SITE II or BINDING SITE III of FIG. 8. Table 4 illustrates the complementarity of the nucleotide sequences of LOC284549 BINDING SITE, designated SEQ ID:19112, to the nucleotide sequence of GAM7776 RNA, herein designated GAM RNA, also designated SEQ ID:246.

Another function of GAM7776 is therefore inhibition of LOC284549 (Accession XP_211514.1). Accordingly, utilities of GAM7776 include diagnosis, prevention and treatment of diseases and clinical conditions associated with LOC284549.

LOC284551 (Accession XP_211515.1) is another GAM7776 target gene, herein designated TARGET GENE. LOC284551 BINDING SITE is a target binding site found in the 3' untranslated region of mRNA encoded by LOC284551, corresponding to a target binding site such as BINDING SITE I, BINDING SITE II or BINDING SITE III of FIG. 8. Table 4 illustrates the complementarity of the nucleotide sequences of LOC284551 BINDING SITE, designated SEQ ID:9493, to the nucleotide sequence of GAM7776 RNA, herein designated GAM RNA, also designated SEQ ID:246.

Another function of GAM7776 is therefore inhibition of LOC284551 (Accession XP_211515.1). Accordingly, utilities of GAM7776 include diagnosis, prevention and treatment of diseases and clinical conditions associated with LOC284551.

LOC284577 (Accession XP_211522.1) is another GAM7776 target gene, herein designated TARGET GENE. LOC284577 BINDING SITE is a target binding site found in the 3' untranslated region of mRNA encoded by LOC284577, corresponding to a target binding site such as BINDING SITE I, BINDING SITE II or BINDING SITE III of FIG. 8. Table 4 illustrates the complementarity of the nucleotide sequences of LOC284577 BINDING SITE, designated SEQ ID:19533, to the nucleotide sequence of GAM7776 RNA, herein designated GAM RNA, also designated SEQ ID:246.

Another function of GAM7776 is therefore inhibition of LOC284577 (Accession XP_211522.1). Accordingly, utilities of GAM7776 include diagnosis, prevention and treatment of diseases and clinical conditions associated with LOC284577.

LOC284587 (Accession XP_209278.3) is another GAM7776 target gene, herein designated TARGET GENE. LOC284587 BINDING SITE is a target binding site found in the 5' untranslated region of mRNA encoded by LOC284587, corresponding to a target binding site such as BINDING SITE I, BINDING SITE II or BINDING SITE III of FIG. 8. Table 4 illustrates the complementarity of the nucleotide sequences of LOC284587 BINDING SITE, designated SEQ ID:12803, to the nucleotide sequence of GAM7776 RNA, herein designated GAM RNA, also designated SEQ ID:246.

Another function of GAM7776 is therefore inhibition of LOC284587 (Accession XP_209278.3). Accordingly, utilities of GAM7776 include diagnosis, prevention and treatment of diseases and clinical conditions associated with LOC284587.

LOC284611 (Accession XP_211552.1) is another GAM7776 target gene, herein designated TARGET GENE. LOC284611 BINDING SITE is a target binding site found in the 3' untranslated region of mRNA encoded by LOC284611, corresponding to a target binding site such as BINDING SITE I, BINDING SITE II or BINDING SITE III of FIG. 8. Table 4 illustrates the complementarity of the nucleotide sequences of LOC284611 BINDING SITE, designated SEQ ID:12497, to the nucleotide sequence of GAM7776 RNA, herein designated GAM RNA, also designated SEQ ID:246.

Another function of GAM7776 is therefore inhibition of LOC284611 (Accession XP_211552.1). Accordingly, utilities of GAM7776 include diagnosis, prevention and treatment of diseases and clinical conditions associated with LOC284611.

LOC284628 (Accession XP_211561.1) is another GAM7776 target gene, herein designated TARGET GENE. LOC284628 BINDING SITE is a target binding site found in the 5' untranslated region of mRNA encoded by LOC284628, corresponding to a target binding site such as BINDING SITE I, BINDING SITE II or BINDING SITE III of FIG. 8. Table 4 illustrates the complementarity of the nucleotide sequences of LOC284628 BINDING SITE, designated SEQ ID:18882, to the nucleotide sequence of GAM7776 RNA, herein designated GAM RNA, also designated SEQ ID:246.

Another function of GAM7776 is therefore inhibition of LOC284628 (Accession XP_211561.1). Accordingly, utilities of GAM7776 include diagnosis, prevention and treatment of diseases and clinical conditions associated with LOC284628.

LOC284675 (Accession XP_209319.1) is another GAM7776 target gene, herein designated TARGET GENE. LOC284675 BINDING SITE1 and LOC284675 BINDING SITE2 are target binding sites found in untranslated regions of mRNA encoded by LOC284675, corresponding to target binding sites such as BINDING SITE I, BINDING SITE II or BINDING SITE III of FIG. 8. Table 4 illustrates the complementarity of the nucleotide sequences of LOC284675 BINDING SITE1 and LOC284675 BINDING SITE2, designated SEQ ID:501 and SEQ ID:2389 respectively, to the nucleotide sequence of GAM7776 RNA, herein designated GAM RNA, also designated SEQ ID:246.

Another function of GAM7776 is therefore inhibition of LOC284675 (Accession XP_209319.1). Accordingly, utilities of GAM7776 include diagnosis, prevention and treatment of diseases and clinical conditions associated with LOC284675.

LOC284683 (Accession XP_208236.1) is another GAM7776 target gene, herein designated TARGET GENE.

LOC284683 BINDING SITE is a target binding site found in the 3' untranslated region of mRNA encoded by LOC284683, corresponding to a target binding site such as BINDING SITE I, BINDING SITE II or BINDING SITE III of FIG. 8. Table 4 illustrates the complementarity of the nucleotide sequences of LOC284683 BINDING SITE, designated SEQ ID:5926, to the nucleotide sequence of GAM7776 RNA, herein designated GAM RNA, also designated SEQ ID:246.

Another function of GAM7776 is therefore inhibition of LOC284683 (Accession XP_208236.1). Accordingly, utilities of GAM7776 include diagnosis, prevention and treatment of diseases and clinical conditions associated with LOC284683.

LOC284701 (Accession XP_294994.1) is another GAM7776 target gene, herein designated TARGET GENE. LOC284701 BINDING SITE is a target binding site found in the 5' untranslated region of mRNA encoded by LOC284701, corresponding to a target binding site such as BINDING SITE I, BINDING SITE II or BINDING SITE III of FIG. 8. Table 4 illustrates the complementarity of the nucleotide sequences of LOC284701 BINDING SITE, designated SEQ ID:12803, to the nucleotide sequence of GAM7776 RNA, herein designated GAM RNA, also designated SEQ ID:246.

Another function of GAM7776 is therefore inhibition of LOC284701 (Accession XP_294994.1). Accordingly, utilities of GAM7776 include diagnosis, prevention and treatment of diseases and clinical conditions associated with LOC284701.

LOC284708 (Accession XP_209332.1) is another GAM7776 target gene, herein designated TARGET GENE. LOC284708 BINDING SITE is a target binding site found in the 3' untranslated region of mRNA encoded by LOC284708, corresponding to a target binding site such as BINDING SITE I, BINDING SITE II or BINDING SITE III of FIG. 8. Table 4 illustrates the complementarity of the nucleotide sequences of LOC284708 BINDING SITE, designated SEQ ID:5153, to the nucleotide sequence of GAM7776 RNA, herein designated GAM RNA, also designated SEQ ID:246.

Another function of GAM7776 is therefore inhibition of LOC284708 (Accession XP_209332.1). Accordingly, utilities of GAM7776 include diagnosis, prevention and treatment of diseases and clinical conditions associated with LOC284708.

LOC284723 (Accession XP_211602.1) is another GAM7776 target gene, herein designated TARGET GENE. LOC284723 BINDING SITE1 through LOC284723 BINDING SITE3 are target binding sites found in untranslated regions of mRNA encoded by LOC284723, corresponding to target binding sites such as BINDING SITE I, BINDING SITE II or BINDING SITE III of FIG. 8. Table 4 illustrates the complementarity of the nucleotide sequences of LOC284723 BINDING SITE1 through LOC284723 BINDING SITE3, designated SEQ ID:6498, SEQ ID:3182 and SEQ ID:2215 respectively, to the nucleotide sequence of GAM7776 RNA, herein designated GAM RNA, also designated SEQ ID:246.

Another function of GAM7776 is therefore inhibition of LOC284723 (Accession XP_211602.1). Accordingly, utilities of GAM7776 include diagnosis, prevention and treatment of diseases and clinical conditions associated with LOC284723.

LOC284805 (Accession XP_209371.1) is another GAM7776 target gene, herein designated TARGET GENE. LOC284805 BINDING SITE1 through LOC284805 BINDING SITE3 are target binding sites found in untranslated regions of mRNA encoded by LOC284805, corresponding to target binding sites such as BINDING SITE I, BINDING SITE II or BINDING SITE III of FIG. 8. Table 4 illustrates the complementarity of the nucleotide sequences of LOC284805 BINDING SITE1 through LOC284805 BINDING SITE3, designated SEQ ID:8046, SEQ ID:1544 and SEQ ID:853 respectively, to the nucleotide sequence of GAM7776 RNA, herein designated GAM RNA, also designated SEQ ID:246.

Another function of GAM7776 is therefore inhibition of LOC284805 (Accession XP_209371.1). Accordingly, utilities of GAM7776 include diagnosis, prevention and treatment of diseases and clinical conditions associated with LOC284805.

LOC284839 (Accession XP_211661.1) is another GAM7776 target gene, herein designated TARGET GENE. LOC284839 BINDING SITE is a target binding site found in the 5' untranslated region of mRNA encoded by LOC284839, corresponding to a target binding site such as BINDING SITE I, BINDING SITE II or BINDING SITE III of FIG. 8. Table 4 illustrates the complementarity of the nucleotide sequences of LOC284839 BINDING SITE, designated SEQ ID:19401, to the nucleotide sequence of GAM7776 RNA, herein designated GAM RNA, also designated SEQ ID:246.

Another function of GAM7776 is therefore inhibition of LOC284839 (Accession XP_211661.1). Accordingly, utilities of GAM7776 include diagnosis, prevention and treatment of diseases and clinical conditions associated with LOC284839.

LOC284853 (Accession XP_209383.1) is another GAM7776 target gene, herein designated TARGET GENE. LOC284853 BINDING SITE is a target binding site found in the 3' untranslated region of mRNA encoded by LOC284853, corresponding to a target binding site such as BINDING SITE I, BINDING SITE II or BINDING SITE III of FIG. 8. Table 4 illustrates the complementarity of the nucleotide sequences of LOC284853 BINDING SITE, designated SEQ ID:3582, to the nucleotide sequence of GAM7776 RNA, herein designated GAM RNA, also designated SEQ ID:246.

Another function of GAM7776 is therefore inhibition of LOC284853 (Accession XP_209383.1). Accordingly, utilities of GAM7776 include diagnosis, prevention and treatment of diseases and clinical conditions associated with LOC284853.

LOC284856 (Accession XP_302835.1) is another GAM7776 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:12736, to the nucleotide sequence of GAM7776 RNA, herein designated GAM RNA, also designated SEQ ID:246.

Another function of GAM7776 is therefore inhibition of LOC284856 (Accession XP_302835.1). Accordingly, utilities of GAM7776 include diagnosis, prevention and treatment of diseases and clinical conditions associated with LOC284856.

LOC284856 (Accession XP_211668.2) is another GAM7776 target gene, herein designated TARGET GENE. LOC284856 BINDING SITE is a target binding site found in the 3' untranslated region of multiple transcripts of mRNA encoded by LOC284856, corresponding to a target binding site such as BINDING SITE I, BINDING SITE II or BINDING SITE III of FIG. 8. Table 4 illustrates the complementarity of the nucleotide sequences of LOC284856 BINDING SITE, designated SEQ ID:12736, to the nucleotide sequence of GAM7776 RNA, herein designated GAM RNA, also designated SEQ ID:246.

Another function of GAM7776 is therefore inhibition of LOC284856 (Accession XP_211668.2). Accordingly, utilities of GAM7776 include diagnosis, prevention and treatment of diseases and clinical conditions associated with LOC284856.

LOC284859 (Accession XP_209384.2) is another GAM7776 target gene, herein designated TARGET GENE. LOC284859 BINDING SITE is a target binding site found in the 3' untranslated region of mRNA encoded by LOC284859, corresponding to a target binding site such as BINDING SITE I, BINDING SITE II or BINDING SITE III of FIG. 8. Table 4 illustrates the complementarity of the nucleotide sequences of LOC284859 BINDING SITE, designated SEQ ID:16785, to the nucleotide sequence of GAM7776 RNA, herein designated GAM RNA, also designated SEQ ID:246.

Another function of GAM7776 is therefore inhibition of LOC284859 (Accession XP_209384.2). Accordingly, utilities of GAM7776 include diagnosis, prevention and treatment of diseases and clinical conditions associated with LOC284859.

LOC284861 (Accession XP_211670.2) is another GAM7776 target gene, herein designated TARGET GENE. LOC284861 BINDING SITE is a target binding site found in the 5' untranslated region of mRNA encoded by LOC284861, corresponding to a target binding site such as BINDING SITE I, BINDING SITE II or BINDING SITE III of FIG. 8. Table 4 illustrates the complementarity of the nucleotide sequences of LOC284861 BINDING SITE, designated SEQ ID:16785, to the nucleotide sequence of GAM7776 RNA, herein designated GAM RNA, also designated SEQ ID:246.

Another function of GAM7776 is therefore inhibition of LOC284861 (Accession XP_211670.2). Accordingly, utilities of GAM7776 include diagnosis, prevention and treatment of diseases and clinical conditions associated with LOC284861.

LOC284865 (Accession XP_211672.1) is another GAM7776 target gene, herein designated TARGET GENE. LOC284865 BINDING SITE is a target binding site found in the 3' untranslated region of mRNA encoded by LOC284865, corresponding to a target binding site such as BINDING SITE I, BINDING SITE II or BINDING SITE III of FIG. 8. Table 4 illustrates the complementarity of the nucleotide sequences of LOC284865 BINDING SITE, designated SEQ ID:1645, to the nucleotide sequence of GAM7776 RNA, herein designated GAM RNA, also designated SEQ ID:246.

Another function of GAM7776 is therefore inhibition of LOC284865 (Accession XP_211672.1). Accordingly, utilities of GAM7776 include diagnosis, prevention and treatment of diseases and clinical conditions associated with LOC284865.

LOC284873 (Accession XP_209412.1) is another GAM7776 target gene, herein designated TARGET GENE. LOC284873 BINDING SITE is a target binding site found in the 3' untranslated region of mRNA encoded by LOC284873, corresponding to a target binding site such as BINDING SITE I, BINDING SITE II or BINDING SITE III of FIG. 8. Table 4 illustrates the complementarity of the nucleotide sequences of LOC284873 BINDING SITE, designated SEQ ID:16785, to the nucleotide sequence of GAM7776 RNA, herein designated GAM RNA, also designated SEQ ID:246.

Another function of GAM7776 is therefore inhibition of LOC284873 (Accession XP_209412.1). Accordingly, utilities of GAM7776 include diagnosis, prevention and treatment of diseases and clinical conditions associated with LOC284873.

LOC284874 (Accession XP_209394.1) is another GAM7776 target gene, herein designated TARGET GENE. LOC284874 BINDING SITE1 and LOC284874 BINDING SITE2 are target binding sites found in untranslated regions of mRNA encoded by LOC284874, corresponding to target binding sites such as BINDING SITE I, BINDING SITE II or BINDING SITE III of FIG. 8. Table 4 illustrates the complementarity of the nucleotide sequences of LOC284874 BINDING SITE1 and LOC284874 BINDING SITE2, designated SEQ ID:3846 and SEQ ID:16244 respectively, to the nucleotide sequence of GAM7776 RNA, herein designated GAM RNA, also designated SEQ ID:246.

Another function of GAM7776 is therefore inhibition of LOC284874 (Accession XP_209394.1). Accordingly, utilities of GAM7776 include diagnosis, prevention and treatment of diseases and clinical conditions associated with LOC284874.

LOC284934 (Accession XP_211696.1) is another GAM7776 target gene, herein designated TARGET GENE. LOC284934 BINDING SITE is a target binding site found in the 5' untranslated region of mRNA encoded by LOC284934, corresponding to a target binding site such as BINDING SITE I, BINDING SITE II or BINDING SITE III of FIG. 8. Table 4 illustrates the complementarity of the nucleotide sequences of LOC284934 BINDING SITE, designated SEQ ID:14894, to the nucleotide sequence of GAM7776 RNA, herein designated GAM RNA, also designated SEQ ID:246.

Another function of GAM7776 is therefore inhibition of LOC284934 (Accession XP_211696.1). Accordingly, utilities of GAM7776 include diagnosis, prevention and treatment of diseases and clinical conditions associated with LOC284934.

LOC284947 (Accession XP_211705.1) is another GAM7776 target gene, herein designated TARGET GENE. LOC284947 BINDING SITE is a target binding site found in the 3' untranslated region of mRNA encoded by LOC284947, corresponding to a target binding site such as BINDING SITE I, BINDING SITE II or BINDING SITE III of FIG. 8. Table 4 illustrates the complementarity of the nucleotide sequences of LOC284947 BINDING SITE, designated SEQ ID:5465, to the nucleotide sequence of GAM7776 RNA, herein designated GAM RNA, also designated SEQ ID:246.

Another function of GAM7776 is therefore inhibition of LOC284947 (Accession XP_211705.1). Accordingly, utilities of GAM7776 include diagnosis, prevention and treatment of diseases and clinical conditions associated with LOC284947.

LOC284950 (Accession XP_211703.1) is another GAM7776 target gene, herein designated TARGET GENE. LOC284950 BINDING SITE is a target binding site found in the 3' untranslated region of mRNA encoded by LOC284950, corresponding to a target binding site such as BINDING SITE I, BINDING SITE II or BINDING SITE III of FIG. 8. Table 4 illustrates the complementarity of the nucleotide sequences of LOC284950 BINDING SITE, designated SEQ ID:4025, to the nucleotide sequence of GAM7776 RNA, herein designated GAM RNA, also designated SEQ ID:246.

Another function of GAM7776 is therefore inhibition of LOC284950 (Accession XP_211703.1). Accordingly, utilities of GAM7776 include diagnosis, prevention and treatment of diseases and clinical conditions associated with LOC284950.

LOC285002 (Accession XP_211731.2) is another GAM7776 target gene, herein designated TARGET GENE. LOC285002 BINDING SITE is a target binding site found in the 3' untranslated region of mRNA encoded by LOC285002, corresponding to a target binding site such as BINDING SITE I, BINDING SITE II or BINDING SITE III of FIG. 8. Table 4 illustrates the complementarity of the nucleotide sequences of LOC285002 BINDING SITE, designated SEQ ID:3500, to the nucleotide sequence of GAM7776 RNA, herein designated GAM RNA, also designated SEQ ID:246.

Another function of GAM7776 is therefore inhibition of LOC285002 (Accession XP_211731.2). Accordingly, utilities of GAM7776 include diagnosis, prevention and treatment of diseases and clinical conditions associated with LOC285002.

LOC285026 (Accession XP_209440.1) is another GAM7776 target gene, herein designated TARGET GENE. LOC285026 BINDING SITE is a target binding site found in the 3' untranslated region of mRNA encoded by LOC285026, corresponding to a target binding site such as BINDING SITE I, BINDING SITE II or BINDING SITE III of FIG. 8. Table 4 illustrates the complementarity of the nucleotide sequences of LOC285026 BINDING SITE, designated SEQ ID:17523, to the nucleotide sequence of GAM7776 RNA, herein designated GAM RNA, also designated SEQ ID:246.

Another function of GAM7776 is therefore inhibition of LOC285026 (Accession XP_209440.1). Accordingly, utilities of GAM7776 include diagnosis, prevention and treatment of diseases and clinical conditions associated with LOC285026.

LOC285052 (Accession XP_211751.1) is another GAM7776 target gene, herein designated TARGET GENE. LOC285052 BINDING SITE is a target binding site found in the 3' untranslated region of mRNA encoded by LOC285052, corresponding to a target binding site such as BINDING SITE I, BINDING SITE II or BINDING SITE III of FIG. 8. Table 4 illustrates the complementarity of the nucleotide sequences of LOC285052 BINDING SITE, designated SEQ ID:2174, to the nucleotide sequence of GAM7776 RNA, herein designated GAM RNA, also designated SEQ ID:246.

Another function of GAM7776 is therefore inhibition of LOC285052 (Accession XP_211751.1). Accordingly, utilities of GAM7776 include diagnosis, prevention and treatment of diseases and clinical conditions associated with LOC285052.

LOC285058 (Accession XP_211753.1) is another GAM7776 target gene, herein designated TARGET GENE. LOC285058 BINDING SITE is a target binding site found in the 5' untranslated region of mRNA encoded by LOC285058, corresponding to a target binding site such as BINDING SITE I, BINDING SITE II or BINDING SITE III of FIG. 8. Table 4 illustrates the complementarity of the nucleotide sequences of LOC285058 BINDING SITE, designated SEQ ID:20023, to the nucleotide sequence of GAM7776 RNA, herein designated GAM RNA, also designated SEQ ID:246.

Another function of GAM7776 is therefore inhibition of LOC285058 (Accession XP_211753.1). Accordingly, utilities of GAM7776 include diagnosis, prevention and treatment of diseases and clinical conditions associated with LOC285058.

LOC285083 (Accession XP_209464.1) is another GAM7776 target gene, herein designated TARGET GENE. LOC285083 BINDING SITE is a target binding site found in the 3' untranslated region of mRNA encoded by LOC285083, corresponding to a target binding site such as BINDING SITE I, BINDING SITE II or BINDING SITE III of FIG. 8. Table 4 illustrates the complementarity of the nucleotide sequences of LOC285083 BINDING SITE, designated SEQ ID:5667, to the nucleotide sequence of GAM7776 RNA, herein designated GAM RNA, also designated SEQ ID:246.

Another function of GAM7776 is therefore inhibition of LOC285083 (Accession XP_209464.1). Accordingly, utilities of GAM7776 include diagnosis, prevention and treatment of diseases and clinical conditions associated with LOC285083.

LOC285088 (Accession XP_209465.1) is another GAM7776 target gene, herein designated TARGET GENE. LOC285088 BINDING SITE is a target binding site found in the 3' untranslated region of mRNA encoded by LOC285088, corresponding to a target binding site such as BINDING SITE I, BINDING SITE II or BINDING SITE III of FIG. 8. Table 4 illustrates the complementarity of the nucleotide sequences of LOC285088 BINDING SITE, designated SEQ ID:6092, to the nucleotide sequence of GAM7776 RNA, herein designated GAM RNA, also designated SEQ ID:246.

Another function of GAM7776 is therefore inhibition of LOC285088 (Accession XP_209465.1). Accordingly, utilities of GAM7776 include diagnosis, prevention and treatment of diseases and clinical conditions associated with LOC285088.

LOC285123 (Accession XP_211773.1) is another GAM7776 target gene, herein designated TARGET GENE. LOC285123 BINDING SITE is a target binding site found in the 3' untranslated region of mRNA encoded by LOC285123, corresponding to a target binding site such as BINDING SITE I, BINDING SITE II or BINDING SITE III of FIG. 8. Table 4 illustrates the complementarity of the nucleotide sequences of LOC285123 BINDING SITE, designated SEQ ID:17113, to the nucleotide sequence of GAM7776 RNA, herein designated GAM RNA, also designated SEQ ID:246.

Another function of GAM7776 is therefore inhibition of LOC285123 (Accession XP_211773.1). Accordingly, utilities of GAM7776 include diagnosis, prevention and treatment of diseases and clinical conditions associated with LOC285123.

LOC285127 (Accession XP_211771.1) is another GAM7776 target gene, herein designated TARGET GENE. LOC285127 BINDING SITE1 and LOC285127 BINDING SITE2 are target binding sites found in untranslated regions of mRNA encoded by LOC285127, corresponding to target binding sites such as BINDING SITE I, BINDING SITE II or BINDING SITE III of FIG. 8. Table 4 illustrates the complementarity of the nucleotide sequences of LOC285127 BINDING SITE1 and LOC285127 BINDING SITE2, designated SEQ ID:11528 and SEQ ID:5921 respectively, to the nucleotide sequence of GAM7776 RNA, herein designated GAM RNA, also designated SEQ ID:246.

Another function of GAM7776 is therefore inhibition of LOC285127 (Accession XP_211771.1). Accordingly, utilities of GAM7776 include diagnosis, prevention and treatment of diseases and clinical conditions associated with LOC285127.

LOC285166 (Accession XP_211791.1) is another GAM7776 target gene, herein designated TARGET GENE. LOC285166 BINDING SITE is a target binding site found in the 3' untranslated region of mRNA encoded by LOC285166, corresponding to a target binding site such as BINDING SITE I, BINDING SITE II or BINDING SITE III of FIG. 8. Table 4 illustrates the complementarity of the nucleotide sequences of LOC285166 BINDING SITE, designated SEQ ID:4283, to the nucleotide sequence of GAM7776 RNA, herein designated GAM RNA, also designated SEQ ID:246.

Another function of GAM7776 is therefore inhibition of LOC285166 (Accession XP_211791.1). Accordingly, utilities of GAM7776 include diagnosis, prevention and treatment of diseases and clinical conditions associated with LOC285166.

LOC285176 (Accession XP_209500.1) is another GAM7776 target gene, herein designated TARGET GENE.

LOC285176 BINDING SITE is a target binding site found in the 3' untranslated region of mRNA encoded by LOC285176, corresponding to a target binding site such as BINDING SITE I, BINDING SITE II or BINDING SITE III of FIG. 8. Table 4 illustrates the complementarity of the nucleotide sequences of LOC285176 BINDING SITE, designated SEQ ID:7860, to the nucleotide sequence of GAM7776 RNA, herein designated GAM RNA, also designated SEQ ID:246.

Another function of GAM7776 is therefore inhibition of LOC285176 (Accession XP_209500.1). Accordingly, utilities of GAM7776 include diagnosis, prevention and treatment of diseases and clinical conditions associated with LOC285176.

LOC285193 (Accession XP_209509.1) is another GAM7776 target gene, herein designated TARGET GENE. LOC285193 BINDING SITE is a target binding site found in the 3' untranslated region of mRNA encoded by LOC285193, corresponding to a target binding site such as BINDING SITE I, BINDING SITE II or BINDING SITE III of FIG. 8. Table 4 illustrates the complementarity of the nucleotide sequences of LOC285193 BINDING SITE, designated SEQ ID:1745, to the nucleotide sequence of GAM7776 RNA, herein designated GAM RNA, also designated SEQ ID:246.

Another function of GAM7776 is therefore inhibition of LOC285193 (Accession XP_209509.1). Accordingly, utilities of GAM7776 include diagnosis, prevention and treatment of diseases and clinical conditions associated with LOC285193.

LOC285221 (Accession XP_209521.1) is another GAM7776 target gene, herein designated TARGET GENE. LOC285221 BINDING SITE is a target binding site found in the 5' untranslated region of mRNA encoded by LOC285221, corresponding to a target binding site such as BINDING SITE I, BINDING SITE II or BINDING SITE III of FIG. 8. Table 4 illustrates the complementarity of the nucleotide sequences of LOC285221 BINDING SITE, designated SEQ ID:13597, to the nucleotide sequence of GAM7776 RNA, herein designated GAM RNA, also designated SEQ ID:246.

Another function of GAM7776 is therefore inhibition of LOC285221 (Accession XP_209521.1). Accordingly, utilities of GAM7776 include diagnosis, prevention and treatment of diseases and clinical conditions associated with LOC285221.

LOC285231 (Accession XP_211813.1) is another GAM7776 target gene, herein designated TARGET GENE. LOC285231 BINDING SITE1 through LOC285231 BINDING SITE3 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231 BINDING SITE1 through LOC285231 BINDING SITE3, designated SEQ ID:8001, SEQ ID:15366 and SEQ ID:8001 respectively, to the nucleotide sequence of GAM7776 RNA, herein designated GAM RNA, also designated SEQ ID:246.

Another function of GAM7776 is therefore inhibition of LOC285231 (Accession XP_211813.1). Accordingly, utilities of GAM7776 include diagnosis, prevention and treatment of diseases and clinical conditions associated with LOC285231.

LOC285231 (Accession XP_211813.1) is another GAM7776 target gene, herein designated TARGET GENE. LOC285231 BINDING SITE1 through LOC285231 BINDING SITE3 are target binding sites found in untranslated regions of mRNA encoded by LOC285231, corresponding to target binding sites such as BINDING SITE I, BINDING SITE II or BINDING SITE III of FIG. 8. Table 4 illustrates the complementarity of the nucleotide sequences of LOC285231 BINDING SITE1 through LOC285231 BINDING SITE3, designated SEQ ID:9352, SEQ ID:15575 and SEQ ID:9374 respectively, to the nucleotide sequence of GAM7776 RNA, herein designated GAM RNA, also designated SEQ ID:246.

Another function of GAM7776 is therefore inhibition of LOC285231 (Accession XP_211813.1). Accordingly, utilities of GAM7776 include diagnosis, prevention and treatment of diseases and clinical conditions associated with LOC285231.

LOC285334 (Accession XP_211844.1) is another GAM7776 target gene, herein designated TARGET GENE. LOC285334 BINDING SITE is a target binding site found in the 3' untranslated region of mRNA encoded by LOC285334, corresponding to a target binding site such as BINDING SITE I, BINDING SITE II or BINDING SITE III of FIG. 8. Table 4 illustrates the complementarity of the nucleotide sequences of LOC285334 BINDING SITE, designated SEQ ID:1027, to the nucleotide sequence of GAM7776 RNA, herein designated GAM RNA, also designated SEQ ID:246.

Another function of GAM7776 is therefore inhibition of LOC285334 (Accession XP_211844.1). Accordingly, utilities of GAM7776 include diagnosis, prevention and treatment of diseases and clinical conditions associated with LOC285334.

LOC285345 (Accession XP_211854.1) is another GAM7776 target gene, herein designated TARGET GENE. LOC285345 BINDING SITE1 and LOC285345 BINDING SITE2 are target binding sites found in untranslated regions of mRNA encoded by LOC285345, corresponding to target binding sites such as BINDING SITE I, BINDING SITE II or BINDING SITE III of FIG. 8. Table 4 illustrates the complementarity of the nucleotide sequences of LOC285345 BINDING SITE1 and LOC285345 BINDING SITE2, designated SEQ ID:18883 and SEQ ID:556 respectively, to the nucleotide sequence of GAM7776 RNA, herein designated GAM RNA, also designated SEQ ID:246.

Another function of GAM7776 is therefore inhibition of LOC285345 (Accession XP_211854.1). Accordingly, utilities of GAM7776 include diagnosis, prevention and treatment of diseases and clinical conditions associated with LOC285345.

LOC285366 (Accession XP_209581.1) is another GAM7776 target gene, herein designated TARGET GENE. LOC285366 BINDING SITE is a target binding site found in the 3' untranslated region of mRNA encoded by LOC285366, corresponding to a target binding site such as BINDING SITE I, BINDING SITE II or BINDING SITE III of FIG. 8. Table 4 illustrates the complementarity of the nucleotide sequences of LOC285366 BINDING SITE, designated SEQ ID:6117, to the nucleotide sequence of GAM7776 RNA, herein designated GAM RNA, also designated SEQ ID:246.

Another function of GAM7776 is therefore inhibition of LOC285366 (Accession XP_209581.1). Accordingly, utilities of GAM7776 include diagnosis, prevention and treatment of diseases and clinical conditions associated with LOC285366.

LOC285369 (Accession XP_211861.3) is another GAM7776 target gene, herein designated TARGET GENE. LOC285369 BINDING SITE is a target binding site found in the 3' untranslated region of mRNA encoded by LOC285369, corresponding to a target binding site such as BINDING SITE I, BINDING SITE II or BINDING SITE III of FIG. 8. Table 4 illustrates the complementarity of the nucleotide sequences of LOC285369 BINDING SITE, designated SEQ ID:10352, to the nucleotide sequence of GAM7776 RNA, herein designated GAM RNA, also designated SEQ ID:246.

Another function of GAM7776 is therefore inhibition of LOC285369 (Accession XP_211861.3). Accordingly, utilities of GAM7776 include diagnosis, prevention and treatment of diseases and clinical conditions associated with LOC285369.

LOC285389 (Accession XP_211873.1) is another GAM7776 target gene, herein designated TARGET GENE. LOC285389 BINDING SITE is a target binding site found in the 3' untranslated region of mRNA encoded by LOC285389, corresponding to a target binding site such as BINDING SITE I, BINDING SITE II or BINDING SITE III of FIG. 8. Table 4 illustrates the complementarity of the nucleotide sequences of LOC285389 BINDING SITE, designated SEQ ID:19692, to the nucleotide sequence of GAM7776 RNA, herein designated GAM RNA, also designated SEQ ID:246.

Another function of GAM7776 is therefore inhibition of LOC285389 (Accession XP_211873.1). Accordingly, utilities of GAM7776 include diagnosis, prevention and treatment of diseases and clinical conditions associated with LOC285389.

LOC285392 (Accession XP_211879.1) is another GAM7776 target gene, herein designated TARGET GENE. LOC285392 BINDING SITE1 and LOC285392 BINDING SITE2 are target binding sites found in untranslated regions of mRNA encoded by LOC285392, corresponding to target binding sites such as BINDING SITE I, BINDING SITE II or BINDING SITE III of FIG. 8. Table 4 illustrates the complementarity of the nucleotide sequences of LOC285392 BINDING SITE1 and LOC285392 BINDING SITE2, designated SEQ ID:9688 and SEQ ID:17969 respectively, to the nucleotide sequence of GAM7776 RNA, herein designated GAM RNA, also designated SEQ ID:246.

Another function of GAM7776 is therefore inhibition of LOC285392 (Accession XP_211879.1). Accordingly, utilities of GAM7776 include diagnosis, prevention and treatment of diseases and clinical conditions associated with LOC285392.

LOC285398 (Accession XP_209593.1) is another GAM7776 target gene, herein designated TARGET GENE. LOC285398 BINDING SITE1 and LOC285398 BINDING SITE2 are target binding sites found in untranslated regions of mRNA encoded by LOC285398, corresponding to target binding sites such as BINDING SITE I, BINDING SITE II or BINDING SITE III of FIG. 8. Table 4 illustrates the complementarity of the nucleotide sequences of LOC285398 BINDING SITE1 and LOC285398 BINDING SITE2, designated SEQ ID:13286 and SEQ ID:4655 respectively, to the nucleotide sequence of GAM7776 RNA, herein designated GAM RNA, also designated SEQ ID:246.

Another function of GAM7776 is therefore inhibition of LOC285398 (Accession XP_209593.1). Accordingly, utilities of GAM7776 include diagnosis, prevention and treatment of diseases and clinical conditions associated with LOC285398.

LOC285429 (Accession XP_209607.3) is another GAM7776 target gene, herein designated TARGET GENE. LOC285429 BINDING SITE is a target binding site found in the 3' untranslated region of mRNA encoded by LOC285429, corresponding to a target binding site such as BINDING SITE I, BINDING SITE II or BINDING SITE III of FIG. 8. Table 4 illustrates the complementarity of the nucleotide sequences of LOC285429 BINDING SITE, designated SEQ ID:4171, to the nucleotide sequence of GAM7776 RNA, herein designated GAM RNA, also designated SEQ ID:246.

Another function of GAM7776 is therefore inhibition of LOC285429 (Accession XP_209607.3). Accordingly, utilities of GAM7776 include diagnosis, prevention and treatment of diseases and clinical conditions associated with LOC285429.

LOC285488 (Accession XP_211914.1) is another GAM7776 target gene, herein designated TARGET GENE. LOC285488 BINDING SITE is a target binding site found in the 5' untranslated region of mRNA encoded by LOC285488, corresponding to a target binding site such as BINDING SITE I, BINDING SITE II or BINDING SITE III of FIG. 8. Table 4 illustrates the complementarity of the nucleotide sequences of LOC285488 BINDING SITE, designated SEQ ID:13804, to the nucleotide sequence of GAM7776 RNA, herein designated GAM RNA, also designated SEQ ID:246.

Another function of GAM7776 is therefore inhibition of LOC285488 (Accession XP_211914.1). Accordingly, utilities of GAM7776 include diagnosis, prevention and treatment of diseases and clinical conditions associated with LOC285488.

LOC285491 (Accession XP_211917.1) is another GAM7776 target gene, herein designated TARGET GENE. LOC285491 BINDING SITE is a target binding site found in the 3' untranslated region of mRNA encoded by LOC285491, corresponding to a target binding site such as BINDING SITE I, BINDING SITE II or BINDING SITE III of FIG. 8. Table 4 illustrates the complementarity of the nucleotide sequences of LOC285491 BINDING SITE, designated SEQ ID:11239, to the nucleotide sequence of GAM7776 RNA, herein designated GAM RNA, also designated SEQ ID:246.

Another function of GAM7776 is therefore inhibition of LOC285491 (Accession XP_211917.1). Accordingly, utilities of GAM7776 include diagnosis, prevention and treatment of diseases and clinical conditions associated with LOC285491.

LOC285509 (Accession XP_211923.1) is another GAM7776 target gene, herein designated TARGET GENE. LOC285509 BINDING SITE is a target binding site found in the 5' untranslated region of mRNA encoded by LOC285509, corresponding to a target binding site such as BINDING SITE I, BINDING SITE II or BINDING SITE III of FIG. 8. Table 4 illustrates the complementarity of the nucleotide sequences of LOC285509 BINDING SITE, designated SEQ ID:3519, to the nucleotide sequence of GAM7776 RNA, herein designated GAM RNA, also designated SEQ ID:246.

Another function of GAM7776 is therefore inhibition of LOC285509 (Accession XP_211923.1). Accordingly, utilities of GAM7776 include diagnosis, prevention and treatment of diseases and clinical conditions associated with LOC285509.

LOC285510 (Accession XP_209643.1) is another GAM7776 target gene, herein designated TARGET GENE. LOC285510 BINDING SITE is a target binding site found in the 3' untranslated region of mRNA encoded by LOC285510, corresponding to a target binding site such as BINDING SITE I, BINDING SITE II or BINDING SITE III of FIG. 8. Table 4 illustrates the complementarity of the nucleotide sequences of LOC285510 BINDING SITE, designated SEQ ID:14552, to the nucleotide sequence of GAM7776 RNA, herein designated GAM RNA, also designated SEQ ID:246.

Another function of GAM7776 is therefore inhibition of LOC285510 (Accession XP_209643.1). Accordingly, utilities of GAM7776 include diagnosis, prevention and treatment of diseases and clinical conditions associated with LOC285510.

LOC285540 (Accession XP_209654.1) is another GAM7776 target gene, herein designated TARGET GENE. LOC285540 BINDING SITE1 and LOC285540 BINDING SITE2 are target binding sites found in untranslated regions of mRNA encoded by LOC285540, corresponding to target binding sites such as BINDING SITE I, BINDING SITE II or BINDING SITE III of FIG. 8. Table 4 illustrates the complementarity of the nucleotide sequences of LOC285540 BINDING SITE1 and LOC285540 BINDING SITE2, designated SEQ ID:9543 and SEQ ID:6961 respectively, to the nucleotide sequence of GAM7776 RNA, herein designated GAM RNA, also designated SEQ ID:246.

Another function of GAM7776 is therefore inhibition of LOC285540 (Accession XP_209654.1). Accordingly, utilities of GAM7776 include diagnosis, prevention and treatment of diseases and clinical conditions associated with LOC285540.

LOC285560 (Accession XP_209660.1) is another GAM7776 target gene, herein designated TARGET GENE. LOC285560 BINDING SITE is a target binding site found in the 3' untranslated region of mRNA encoded by LOC285560, corresponding to a target binding site such as BINDING SITE I, BINDING SITE II or BINDING SITE III of FIG. 8. Table 4 illustrates the complementarity of the nucleotide sequences of LOC285560 BINDING SITE, designated SEQ ID:8718, to the nucleotide sequence of GAM7776 RNA, herein designated GAM RNA, also designated SEQ ID:246.

Another function of GAM7776 is therefore inhibition of LOC285560 (Accession XP_209660.1). Accordingly, utilities of GAM7776 include diagnosis, prevention and treatment of diseases and clinical conditions associated with LOC285560.

LOC285589 (Accession XP_209671.1) is another GAM7776 target gene, herein designated TARGET GENE. LOC285589 BINDING SITE1 and LOC285589 BINDING SITE2 are target binding sites found in untranslated regions of mRNA encoded by LOC285589, corresponding to target binding sites such as BINDING SITE I, BINDING SITE II or BINDING SITE III of FIG. 8. Table 4 illustrates the complementarity of the nucleotide sequences of LOC285589 BINDING SITE1 and LOC285589 BINDING SITE2, designated SEQ ID:17087 and SEQ ID:12804 respectively, to the nucleotide sequence of GAM7776 RNA, herein designated GAM RNA, also designated SEQ ID:246.

Another function of GAM7776 is therefore inhibition of LOC285589 (Accession XP_209671.1). Accordingly, utilities of GAM7776 include diagnosis, prevention and treatment of diseases and clinical conditions associated with LOC285589.

LOC285626 (Accession XP_211959.1) is another GAM7776 target gene, herein designated TARGET GENE. LOC285626 BINDING SITE is a target binding site found in the 5' untranslated region of mRNA encoded by LOC285626, corresponding to a target binding site such as BINDING SITE I, BINDING SITE II or BINDING SITE III of FIG. 8. Table 4 illustrates the complementarity of the nucleotide sequences of LOC285626 BINDING SITE, designated SEQ ID:13843, to the nucleotide sequence of GAM7776 RNA, herein designated GAM RNA, also designated SEQ ID:246.

Another function of GAM7776 is therefore inhibition of LOC285626 (Accession XP_211959.1). Accordingly, utilities of GAM7776 include diagnosis, prevention and treatment of diseases and clinical conditions associated with LOC285626.

LOC285638 (Accession XP_209693.1) is another GAM7776 target gene, herein designated TARGET GENE. LOC285638 BINDING SITE is a target binding site found in the 5' untranslated region of mRNA encoded by LOC285638, corresponding to a target binding site such as BINDING SITE I, BINDING SITE II or BINDING SITE III of FIG. 8. Table 4 illustrates the complementarity of the nucleotide sequences of LOC285638 BINDING SITE, designated SEQ ID:4949, to the nucleotide sequence of GAM7776 RNA, herein designated GAM RNA, also designated SEQ ID:246.

Another function of GAM7776 is therefore inhibition of LOC285638 (Accession XP_209693.1). Accordingly, utilities of GAM7776 include diagnosis, prevention and treatment of diseases and clinical conditions associated with LOC285638.

LOC285679 (Accession XP_209719.2) is another GAM7776 target gene, herein designated TARGET GENE. LOC285679 BINDING SITE is a target binding site found in the 3' untranslated region of mRNA encoded by LOC285679, corresponding to a target binding site such as BINDING SITE I, BINDING SITE II or BINDING SITE III of FIG. 8. Table 4 illustrates the complementarity of the nucleotide sequences of LOC285679 BINDING SITE, designated SEQ ID:19299, to the nucleotide sequence of GAM7776 RNA, herein designated GAM RNA, also designated SEQ ID:246.

Another function of GAM7776 is therefore inhibition of LOC285679 (Accession XP_209719.2). Accordingly, utilities of GAM7776 include diagnosis, prevention and treatment of diseases and clinical conditions associated with LOC285679.

LOC285689 (Accession XP_209724.1) is another GAM7776 target gene, herein designated TARGET GENE. LOC285689 BINDING SITE is a target binding site found in the 3' untranslated region of mRNA encoded by LOC285689, corresponding to a target binding site such as BINDING SITE I, BINDING SITE II or BINDING SITE III of FIG. 8. Table 4 illustrates the complementarity of the nucleotide sequences of LOC285689 BINDING SITE, designated SEQ ID:17726, to the nucleotide sequence of GAM7776 RNA, herein designated GAM RNA, also designated SEQ ID:246.

Another function of GAM7776 is therefore inhibition of LOC285689 (Accession XP_209724.1). Accordingly, utilities of GAM7776 include diagnosis, prevention and treatment of diseases and clinical conditions associated with LOC285689.

LOC285693 (Accession XP_211981.1) is another GAM7776 target gene, herein designated TARGET GENE. LOC285693 BINDING SITE is a target binding site found in the 5' untranslated region of mRNA encoded by LOC285693, corresponding to a target binding site such as BINDING SITE I, BINDING SITE II or BINDING SITE III of FIG. 8. Table 4 illustrates the complementarity of the nucleotide sequences of LOC285693 BINDING SITE, designated SEQ ID:16940, to the nucleotide sequence of GAM7776 RNA, herein designated GAM RNA, also designated SEQ ID:246.

Another function of GAM7776 is therefore inhibition of LOC285693 (Accession XP_211981.1). Accordingly, utilities of GAM7776 include diagnosis, prevention and treatment of diseases and clinical conditions associated with LOC285693.

LOC285722 (Accession XP_211997.1) is another GAM7776 target gene, herein designated TARGET GENE. LOC285722 BINDING SITE is a target binding site found in the 5' untranslated region of mRNA encoded by LOC285722, corresponding to a target binding site such as BINDING SITE I, BINDING SITE II or BINDING SITE III of FIG. 8. Table 4 illustrates the complementarity of the nucleotide sequences of LOC285722 BINDING SITE, designated SEQ ID:18012, to the nucleotide sequence of GAM7776 RNA, herein designated GAM RNA, also designated SEQ ID:246.

Another function of GAM7776 is therefore inhibition of LOC285722 (Accession XP_211997.1). Accordingly, utilities of GAM7776 include diagnosis, prevention and treatment of diseases and clinical conditions associated with LOC285722.

LOC285744 (Accession XP_209743.1) is another GAM7776 target gene, herein designated TARGET GENE. LOC285744 BINDING SITE is a target binding site found in the 3' untranslated region of mRNA encoded by LOC285744, corresponding to a target binding site such as BINDING SITE I, BINDING SITE II or BINDING SITE III of FIG. 8. Table 4 illustrates the complementarity of the nucleotide sequences of LOC285744 BINDING SITE, designated SEQ ID:11141, to the nucleotide sequence of GAM7776 RNA, herein designated GAM RNA, also designated SEQ ID:246.

Another function of GAM7776 is therefore inhibition of LOC285744 (Accession XP_209743.1). Accordingly, utilities of GAM7776 include diagnosis, prevention and treatment of diseases and clinical conditions associated with LOC285744.

LOC285747 (Accession XP_209742.1) is another GAM7776 target gene, herein designated TARGET GENE. LOC285747 BINDING SITE is a target binding site found in the 3' untranslated region of mRNA encoded by LOC285747, corresponding to a target binding site such as BINDING SITE I, BINDING SITE II or BINDING SITE III of FIG. 8. Table 4 illustrates the complementarity of the nucleotide sequences of LOC285747 BINDING SITE, designated SEQ ID:11528, to the nucleotide sequence of GAM7776 RNA, herein designated GAM RNA, also designated SEQ ID:246.

Another function of GAM7776 is therefore inhibition of LOC285747 (Accession XP_209742.1). Accordingly, utilities of GAM7776 include diagnosis, prevention and treatment of diseases and clinical conditions associated with LOC285747.

LOC285760 (Accession XP_209750.1) is another GAM7776 target gene, herein designated TARGET GENE. LOC285760 BINDING SITE is a target binding site found in the 3' untranslated region of mRNA encoded by LOC285760, corresponding to a target binding site such as BINDING SITE I, BINDING SITE II or BINDING SITE III of FIG. 8. Table 4 illustrates the complementarity of the nucleotide sequences of LOC285760 BINDING SITE, designated SEQ ID:13412, to the nucleotide sequence of GAM7776 RNA, herein designated GAM RNA, also designated SEQ ID:246.

Another function of GAM7776 is therefore inhibition of LOC285760 (Accession XP_209750.1). Accordingly, utilities of GAM7776 include diagnosis, prevention and treatment of diseases and clinical conditions associated with LOC285760.

LOC285777 (Accession XP_212013.1) is another GAM7776 target gene, herein designated TARGET GENE. LOC285777 BINDING SITE is a target binding site found in the 5' untranslated region of mRNA encoded by LOC285777, corresponding to a target binding site such as BINDING SITE I, BINDING SITE II or BINDING SITE III of FIG. 8. Table 4 illustrates the complementarity of the nucleotide sequences of LOC285777 BINDING SITE, designated SEQ ID:16810, to the nucleotide sequence of GAM7776 RNA, herein designated GAM RNA, also designated SEQ ID:246.

Another function of GAM7776 is therefore inhibition of LOC285777 (Accession XP_212013.1). Accordingly, utilities of GAM7776 include diagnosis, prevention and treatment of diseases and clinical conditions associated with LOC285777.

LOC285812 (Accession XP_212055.1) is another GAM7776 target gene, herein designated TARGET GENE. LOC285812 BINDING SITE is a target binding site found in the 3' untranslated region of mRNA encoded by LOC285812, corresponding to a target binding site such as BINDING SITE I, BINDING SITE II or BINDING SITE III of FIG. 8. Table 4 illustrates the complementarity of the nucleotide sequences of LOC285812 BINDING SITE, designated SEQ ID:559, to the nucleotide sequence of GAM7776 RNA, herein designated GAM RNA, also designated SEQ ID:246.

Another function of GAM7776 is therefore inhibition of LOC285812 (Accession XP_212055.1). Accordingly, utilities of GAM7776 include diagnosis, prevention and treatment of diseases and clinical conditions associated with LOC285812.

LOC285813 (Accession XP_212036.1) is another GAM7776 target gene, herein designated TARGET GENE. LOC285813 BINDING SITE is a target binding site found in the 5' untranslated region of mRNA encoded by LOC285813, corresponding to a target binding site such as BINDING SITE I, BINDING SITE II or BINDING SITE III of FIG. 8. Table 4 illustrates the complementarity of the nucleotide sequences of LOC285813 BINDING SITE, designated SEQ ID:12389, to the nucleotide sequence of GAM7776 RNA, herein designated GAM RNA, also designated SEQ ID:246.

Another function of GAM7776 is therefore inhibition of LOC285813 (Accession XP_212036.1). Accordingly, utilities of GAM7776 include diagnosis, prevention and treatment of diseases and clinical conditions associated with LOC285813.

LOC285822 (Accession XP_209777.1) is another GAM7776 target gene, herein designated TARGET GENE. LOC285822 BINDING SITE1 and LOC285822 BINDING SITE2 are target binding sites found in untranslated regions of mRNA encoded by LOC285822, corresponding to target binding sites such as BINDING SITE I, BINDING SITE II or BINDING SITE III of FIG. 8. Table 4 illustrates the complementarity of the nucleotide sequences of LOC285822 BINDING SITE1 and LOC285822 BINDING SITE2, designated SEQ ID:1847 and SEQ ID:9753 respectively, to the nucleotide sequence of GAM7776 RNA, herein designated GAM RNA, also designated SEQ ID:246.

Another function of GAM7776 is therefore inhibition of LOC285822 (Accession XP_209777.1). Accordingly, utilities of GAM7776 include diagnosis, prevention and treatment of diseases and clinical conditions associated with LOC285822.

LOC285830 (Accession XP_212043.1) is another GAM7776 target gene, herein designated TARGET GENE. LOC285830 BINDING SITE is a target binding site found in the 5' untranslated region of mRNA encoded by LOC285830, corresponding to a target binding site such as BINDING SITE I, BINDING SITE II or BINDING SITE III of FIG. 8. Table 4 illustrates the complementarity of the nucleotide sequences of LOC285830 BINDING SITE, designated SEQ ID:986, to the nucleotide sequence of GAM7776 RNA, herein designated GAM RNA, also designated SEQ ID:246.

Another function of GAM7776 is therefore inhibition of LOC285830 (Accession XP_212043.1). Accordingly, utilities of GAM7776 include diagnosis, prevention and treatment of diseases and clinical conditions associated with LOC285830.

LOC285843 (Accession XP_212034.1) is another GAM7776 target gene, herein designated TARGET GENE. LOC285843 BINDING SITE is a target binding site found in the 3' untranslated region of mRNA encoded by LOC285843, corresponding to a target binding site such as BINDING SITE I, BINDING SITE II or BINDING SITE III of FIG. 8. Table 4 illustrates the complementarity of the nucleotide sequences of LOC285843 BINDING SITE, designated SEQ ID:17964, to the nucleotide sequence of GAM7776 RNA, herein designated GAM RNA, also designated SEQ ID:246.

Another function of GAM7776 is therefore inhibition of LOC285843 (Accession XP_212034.1). Accordingly, utilities of GAM7776 include diagnosis, prevention and treatment of diseases and clinical conditions associated with LOC285843.

LOC285847 (Accession XP_212045.1) is another GAM7776 target gene, herein designated TARGET GENE. LOC285847 BINDING SITE is a target binding site found in the 5' untranslated region of mRNA encoded by LOC285847, corresponding to a target binding site such as BINDING SITE I, BINDING SITE II or BINDING SITE III of FIG. 8. Table 4 illustrates the complementarity of the nucleotide sequences of LOC285847 BINDING SITE, designated SEQ ID:18945, to the nucleotide sequence of GAM7776 RNA, herein designated GAM RNA, also designated SEQ ID:246.

Another function of GAM7776 is therefore inhibition of LOC285847 (Accession XP_212045.1). Accordingly, utilities of GAM7776 include diagnosis, prevention and treatment of diseases and clinical conditions associated with LOC285847.

LOC285872 (Accession XP_212061.1) is another GAM7776 target gene, herein designated TARGET GENE. LOC285872 BINDING SITE is a target binding site found in the 3' untranslated region of mRNA encoded by LOC285872, corresponding to a target binding site such as BINDING SITE I, BINDING SITE II or BINDING SITE III of FIG. 8. Table 4 illustrates the complementarity of the nucleotide sequences of LOC285872 BINDING SITE, designated SEQ ID:10885, to the nucleotide sequence of GAM7776 RNA, herein designated GAM RNA, also designated SEQ ID:246.

Another function of GAM7776 is therefore inhibition of LOC285872 (Accession XP_212061.1). Accordingly, utilities of GAM7776 include diagnosis, prevention and treatment of diseases and clinical conditions associated with LOC285872.

LOC285914 (Accession XP_209810.1) is another GAM7776 target gene, herein designated TARGET GENE. LOC285914 BINDING SITE is a target binding site found in the 3' untranslated region of mRNA encoded by LOC285914, corresponding to a target binding site such as BINDING SITE I, BINDING SITE II or BINDING SITE III of FIG. 8. Table 4 illustrates the complementarity of the nucleotide sequences of LOC285914 BINDING SITE, designated SEQ ID:6188, to the nucleotide sequence of GAM7776 RNA, herein designated GAM RNA, also designated SEQ ID:246.

Another function of GAM7776 is therefore inhibition of LOC285914 (Accession XP_209810.1). Accordingly, utilities of GAM7776 include diagnosis, prevention and treatment of diseases and clinical conditions associated with LOC285914.

LOC285923 (Accession XP_212104.1) is another GAM7776 target gene, herein designated TARGET GENE. LOC285923 BINDING SITE is a target binding site found in the 3' untranslated region of mRNA encoded by LOC285923, corresponding to a target binding site such as BINDING SITE I, BINDING SITE II or BINDING SITE III of FIG. 8. Table 4 illustrates the complementarity of the nucleotide sequences of LOC285923 BINDING SITE, designated SEQ ID:19536, to the nucleotide sequence of GAM7776 RNA, herein designated GAM RNA, also designated SEQ ID:246.

Another function of GAM7776 is therefore inhibition of LOC285923 (Accession XP_212104.1). Accordingly, utilities of GAM7776 include diagnosis, prevention and treatment of diseases and clinical conditions associated with LOC285923.

LOC285924 (Accession XP_209816.1) is another GAM7776 target gene, herein designated TARGET GENE. LOC285924 BINDING SITE is a target binding site found in the 3' untranslated region of mRNA encoded by LOC285924, corresponding to a target binding site such as BINDING SITE I, BINDING SITE II or BINDING SITE III of FIG. 8. Table 4 illustrates the complementarity of the nucleotide sequences of LOC285924 BINDING SITE, designated SEQ ID:17126, to the nucleotide sequence of GAM7776 RNA, herein designated GAM RNA, also designated SEQ ID:246.

Another function of GAM7776 is therefore inhibition of LOC285924 (Accession XP_209816.1). Accordingly, utilities of GAM7776 include diagnosis, prevention and treatment of diseases and clinical conditions associated with LOC285924.

LOC285945 (Accession XP_212092.1) is another GAM7776 target gene, herein designated TARGET GENE. LOC285945 BINDING SITE is a target binding site found in the 5' untranslated region of mRNA encoded by LOC285945, corresponding to a target binding site such as BINDING SITE I, BINDING SITE II or BINDING SITE III of FIG. 8. Table 4 illustrates the complementarity of the nucleotide sequences of LOC285945 BINDING SITE, designated SEQ ID:12075, to the nucleotide sequence of GAM7776 RNA, herein designated GAM RNA, also designated SEQ ID:246.

Another function of GAM7776 is therefore inhibition of LOC285945 (Accession XP_212092.1). Accordingly, utilities of GAM7776 include diagnosis, prevention and treatment of diseases and clinical conditions associated with LOC285945.

LOC285952 (Accession XP_209821.1) is another GAM7776 target gene, herein designated TARGET GENE. LOC285952 BINDING SITE is a target binding site found in the 3' untranslated region of mRNA encoded by LOC285952, corresponding to a target binding site such as BINDING SITE I, BINDING SITE II or BINDING SITE III of FIG. 8. Table 4 illustrates the complementarity of the nucleotide sequences of LOC285952 BINDING SITE, designated SEQ ID:15323, to the nucleotide sequence of GAM7776 RNA, herein designated GAM RNA, also designated SEQ ID:246.

Another function of GAM7776 is therefore inhibition of LOC285952 (Accession XP_209821.1). Accordingly, utilities of GAM7776 include diagnosis, prevention and treatment of diseases and clinical conditions associated with LOC285952.

LOC285961 (Accession XP_209833.1) is another GAM7776 target gene, herein designated TARGET GENE. LOC285961 BINDING SITE is a target binding site found in the 5' untranslated region of mRNA encoded by LOC285961, corresponding to a target binding site such as BINDING SITE I, BINDING SITE II or BINDING SITE III of FIG. 8. Table 4 illustrates the complementarity of the nucleotide sequences of LOC285961 BINDING SITE, designated SEQ ID:2604, to the nucleotide sequence of GAM7776 RNA, herein designated GAM RNA, also designated SEQ ID:246.

Another function of GAM7776 is therefore inhibition of LOC285961 (Accession XP_209833.1). Accordingly, utilities of GAM7776 include diagnosis, prevention and treatment of diseases and clinical conditions associated with LOC285961.

LOC285972 (Accession XP_212105.1) is another GAM7776 target gene, herein designated TARGET GENE. LOC285972 BINDING SITE is a target binding site found in the 3' untranslated region of mRNA encoded by LOC285972, corresponding to a target binding site such as BINDING SITE I, BINDING SITE II or BINDING SITE III of FIG. 8. Table 4 illustrates the complementarity of the nucleotide sequences of LOC285972 BINDING SITE, designated SEQ ID:5318, to the nucleotide sequence of GAM7776 RNA, herein designated GAM RNA, also designated SEQ ID:246.

Another function of GAM7776 is therefore inhibition of LOC285972 (Accession XP_212105.1). Accordingly, utilities of GAM7776 include diagnosis, prevention and treatment of diseases and clinical conditions associated with LOC285972.

LOC285979 (Accession XP_212117.1) is another GAM7776 target gene, herein designated TARGET GENE. LOC285979 BINDING SITE1 and LOC285979 BINDING SITE2 are target binding sites found in untranslated regions of mRNA encoded by LOC285979, corresponding to target binding sites such as BINDING SITE I, BINDING SITE II or BINDING SITE III of FIG. 8. Table 4 illustrates the complementarity of the nucleotide sequences of LOC285979 BINDING SITE1 and LOC285979 BINDING SITE2, designated SEQ ID:6388 and SEQ ID:1397 respectively, to the nucleotide sequence of GAM7776 RNA, herein designated GAM RNA, also designated SEQ ID:246.

Another function of GAM7776 is therefore inhibition of LOC285979 (Accession XP_212117.1). Accordingly, utilities of GAM7776 include diagnosis, prevention and treatment of diseases and clinical conditions associated with LOC285979.

LOC285989 (Accession XP_212111.1) is another GAM7776 target gene, herein designated TARGET GENE. LOC285989 BINDING SITE is a target binding site found in the 3' untranslated region of mRNA encoded by LOC285989, corresponding to a target binding site such as BINDING SITE I, BINDING SITE II or BINDING SITE III of FIG. 8. Table 4 illustrates the complementarity of the nucleotide sequences of LOC285989 BINDING SITE, designated SEQ ID:11742, to the nucleotide sequence of GAM7776 RNA, herein designated GAM RNA, also designated SEQ ID:246.

Another function of GAM7776 is therefore inhibition of LOC285989 (Accession XP_212111.1). Accordingly, utilities of GAM7776 include diagnosis, prevention and treatment of diseases and clinical conditions associated with LOC285989.

LOC285999 (Accession XP_212120.1) is another GAM7776 target gene, herein designated TARGET GENE. LOC285999 BINDING SITE is a target binding site found in the 3' untranslated region of mRNA encoded by LOC285999, corresponding to a target binding site such as BINDING SITE I, BINDING SITE II or BINDING SITE III of FIG. 8. Table 4 illustrates the complementarity of the nucleotide sequences of LOC285999 BINDING SITE, designated SEQ ID:3647, to the nucleotide sequence of GAM7776 RNA, herein designated GAM RNA, also designated SEQ ID:246.

Another function of GAM7776 is therefore inhibition of LOC285999 (Accession XP_212120.1). Accordingly, utilities of GAM7776 include diagnosis, prevention and treatment of diseases and clinical conditions associated with LOC285999.

LOC286029 (Accession XP_209866.1) is another GAM7776 target gene, herein designated TARGET GENE. LOC286029 BINDING SITE is a target binding site found in the 3' untranslated region of mRNA encoded by LOC286029, corresponding to a target binding site such as BINDING SITE I, BINDING SITE II or BINDING SITE III of FIG. 8. Table 4 illustrates the complementarity of the nucleotide sequences of LOC286029 BINDING SITE, designated SEQ ID:15231, to the nucleotide sequence of GAM7776 RNA, herein designated GAM RNA, also designated SEQ ID:246.

Another function of GAM7776 is therefore inhibition of LOC286029 (Accession XP_209866.1). Accordingly, utilities of GAM7776 include diagnosis, prevention and treatment of diseases and clinical conditions associated with LOC286029.

LOC286030 (Accession XP_209868.1) is another GAM7776 target gene, herein designated TARGET GENE. LOC286030 BINDING SITE is a target binding site found in the 5' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:2244, to the nucleotide sequence of GAM7776 RNA, herein designated GAM RNA, also designated SEQ ID:246.

Another function of GAM7776 is therefore inhibition of LOC286030 (Accession XP_209868.1). Accordingly, utilities of GAM7776 include diagnosis, prevention and treatment of diseases and clinical conditions associated with LOC286030.

LOC286039 (Accession XP_209873.1) is another GAM7776 target gene, herein designated TARGET GENE. LOC286039 BINDING SITE is a target binding site found in the 5' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:11035, to the nucleotide sequence of GAM7776 RNA, herein designated GAM RNA, also designated SEQ ID:246.

Another function of GAM7776 is therefore inhibition of LOC286039 (Accession XP_209873.1). Accordingly, utilities of GAM7776 include diagnosis, prevention and treatment of diseases and clinical conditions associated with LOC286039.

LOC286052 (Accession XP_212152.1) is another GAM7776 target gene, herein designated TARGET GENE. LOC286052 BINDING SITE is a target binding site found in the 3' untranslated region of mRNA encoded by LOC286052, corresponding to a target binding site such as BINDING SITE I, BINDING SITE II or BINDING SITE III of FIG. 8. Table 4 illustrates the complementarity of the nucleotide sequences of LOC286052 BINDING SITE, designated SEQ ID:9367, to the nucleotide sequence of GAM7776 RNA, herein designated GAM RNA, also designated SEQ ID:246.

Another function of GAM7776 is therefore inhibition of LOC286052 (Accession XP_212152.1). Accordingly, utilities of GAM7776 include diagnosis, prevention and treatment of diseases and clinical conditions associated with LOC286052.

LOC286075 (Accession NP_776192.1) is another GAM7776 target gene, herein designated TARGET GENE. LOC286075 BINDING SITE is a target binding site found in the 5' untranslated region of mRNA encoded by LOC286075, corresponding to a target binding site such as BINDING SITE I, BINDING SITE II or BINDING SITE III of FIG. 8. Table 4 illustrates the complementarity of the nucleotide sequences of LOC286075 BINDING SITE, designated SEQ ID:17965, to the nucleotide sequence of GAM7776 RNA, herein designated GAM RNA, also designated SEQ ID:246.

Another function of GAM7776 is therefore inhibition of LOC286075 (Accession NP_776192.1). Accordingly, utilities of GAM7776 include diagnosis, prevention and treatment of diseases and clinical conditions associated with LOC286075.

LOC286078 (Accession XP_212163.1) is another GAM7776 target gene, herein designated TARGET GENE. LOC286078 BINDING SITE1 through LOC286078 BINDING SITE5 are target binding sites found in untranslated regions of mRNA encoded by LOC286078, corresponding to target binding sites such as BINDING SITE I, BINDING SITE II or BINDING SITE III of FIG. 8. Table 4 illustrates the complementarity of the nucleotide sequences of LOC286078 BINDING SITE1 through LOC286078 BINDING SITE5, designated SEQ ID:16716, SEQ ID:15083, SEQ ID:3810, SEQ ID:13100 and SEQ ID:15589 respectively, to the nucleotide sequence of GAM7776 RNA, herein designated GAM RNA, also designated SEQ ID:246.

Another function of GAM7776 is therefore inhibition of LOC286078 (Accession XP_212163.1). Accordingly, utilities of GAM7776 include diagnosis, prevention and treatment of diseases and clinical conditions associated with LOC286078.

LOC286090 (Accession XP_212166.3) is another GAM7776 target gene, herein designated TARGET GENE. LOC286090 BINDING SITE is a target binding site found in the 5' untranslated region of mRNA encoded by LOC286090, corresponding to a target binding site such as BINDING SITE I, BINDING SITE II or BINDING SITE III of FIG. 8. Table 4 illustrates the complementarity of the nucleotide sequences of LOC286090 BINDING SITE, designated SEQ ID:16409, to the nucleotide sequence of GAM7776 RNA, herein designated GAM RNA, also designated SEQ ID:246.

Another function of GAM7776 is therefore inhibition of LOC286090 (Accession XP_212166.3). Accordingly, utilities of GAM7776 include diagnosis, prevention and treatment of diseases and clinical conditions associated with LOC286090.

LOC286126 (Accession XP_212185.1) is another GAM7776 target gene, herein designated TARGET GENE. LOC286126 BINDING SITE is a target binding site found in the 3' untranslated region of mRNA encoded by LOC286126, corresponding to a target binding site such as BINDING SITE I, BINDING SITE II or BINDING SITE III of FIG. 8. Table 4 illustrates the complementarity of the nucleotide sequences of LOC286126 BINDING SITE, designated SEQ ID:7847, to the nucleotide sequence of GAM7776 RNA, herein designated GAM RNA, also designated SEQ ID:246.

Another function of GAM7776 is therefore inhibition of LOC286126 (Accession XP_212185.1). Accordingly, utilities of GAM7776 include diagnosis, prevention and treatment of diseases and clinical conditions associated with LOC286126.

LOC286132 (Accession XP_212194.1) is another GAM7776 target gene, herein designated TARGET GENE. LOC286132 BINDING SITE is a target binding site found in the 5' untranslated region of mRNA encoded by LOC286132, corresponding to a target binding site such as BINDING SITE I, BINDING SITE II or BINDING SITE III of FIG. 8. Table 4 illustrates the complementarity of the nucleotide sequences of LOC286132 BINDING SITE, designated SEQ ID:7113, to the nucleotide sequence of GAM7776 RNA, herein designated GAM RNA, also designated SEQ ID:246.

Another function of GAM7776 is therefore inhibition of LOC286132 (Accession XP_212194.1). Accordingly, utilities of GAM7776 include diagnosis, prevention and treatment of diseases and clinical conditions associated with LOC286132.

LOC286135 (Accession XP_212196.1) is another GAM7776 target gene, herein designated TARGET GENE. LOC286135 BINDING SITE is a target binding site found in the 3' untranslated region of mRNA encoded by LOC286135, corresponding to a target binding site such as BINDING SITE I, BINDING SITE II or BINDING SITE III of FIG. 8. Table 4 illustrates the complementarity of the nucleotide sequences of LOC286135 BINDING SITE, designated SEQ ID:9746, to the nucleotide sequence of GAM7776 RNA, herein designated GAM RNA, also designated SEQ ID:246.

Another function of GAM7776 is therefore inhibition of LOC286135 (Accession XP_212196.1). Accordingly, utilities of GAM7776 include diagnosis, prevention and treatment of diseases and clinical conditions associated with LOC286135.

LOC286166 (Accession XP_209925.1) is another GAM7776 target gene, herein designated TARGET GENE. LOC286166 BINDING SITE is a target binding site found in the 5' untranslated region of mRNA encoded by LOC286166, corresponding to a target binding site such as BINDING SITE I, BINDING SITE II or BINDING SITE III of FIG. 8. Table 4 illustrates the complementarity of the nucleotide sequences of LOC286166 BINDING SITE, designated SEQ ID:3927, to the nucleotide sequence of GAM7776 RNA, herein designated GAM RNA, also designated SEQ ID:246.

Another function of GAM7776 is therefore inhibition of LOC286166 (Accession XP_209925.1). Accordingly, utilities of GAM7776 include diagnosis, prevention and treatment of diseases and clinical conditions associated with LOC286166.

LOC286170 (Accession XP_212211.1) is another GAM7776 target gene, herein designated TARGET GENE. LOC286170 BINDING SITE is a target binding site found in the 5' untranslated region of mRNA encoded by LOC286170, corresponding to a target binding site such as BINDING SITE I, BINDING SITE II or BINDING SITE III of FIG. 8. Table 4 illustrates the complementarity of the nucleotide sequences of LOC286170 BINDING SITE, designated SEQ ID:8426, to the nucleotide sequence of GAM7776 RNA, herein designated GAM RNA, also designated SEQ ID:246.

Another function of GAM7776 is therefore inhibition of LOC286170 (Accession XP_212211.1). Accordingly, utilities of GAM7776 include diagnosis, prevention and treatment of diseases and clinical conditions associated with LOC286170.

LOC286186 (Accession XP_212219.1) is another GAM7776 target gene, herein designated TARGET GENE. LOC286186 BINDING SITE1 and LOC286186 BINDING SITE2 are target binding sites found in untranslated regions of mRNA encoded by LOC286186, corresponding to target binding sites such as BINDING SITE I, BINDING SITE II or BINDING SITE III of FIG. 8. Table 4 illustrates the complementarity of the nucleotide sequences of LOC286186 BINDING SITE1 and LOC286186 BINDING SITE2, designated SEQ ID:3430 and SEQ ID:18020 respectively, to the nucleotide sequence of GAM7776 RNA, herein designated GAM RNA, also designated SEQ ID:246.

Another function of GAM7776 is therefore inhibition of LOC286186 (Accession XP_212219.1). Accordingly, utilities of GAM7776 include diagnosis, prevention and treatment of diseases and clinical conditions associated with LOC286186.

LOC286206 (Accession XP_209953.1) is another GAM7776 target gene, herein designated TARGET GENE. LOC286206 BINDING SITE is a target binding site found in the 3' untranslated region of mRNA encoded by LOC286206, corresponding to a target binding site such as BINDING SITE I, BINDING SITE II or BINDING SITE III of FIG. 8. Table 4 illustrates the complementarity of the nucleotide sequences of LOC286206 BINDING SITE, designated SEQ ID:2600, to the nucleotide sequence of GAM7776 RNA, herein designated GAM RNA, also designated SEQ ID:246.

Another function of GAM7776 is therefore inhibition of LOC286206 (Accession XP_209953.1). Accordingly, utilities of GAM7776 include diagnosis, prevention and treatment of diseases and clinical conditions associated with LOC286206.

LOC286207 (Accession XP_209941.1) is another GAM7776 target gene, herein designated TARGET GENE. LOC286207 BINDING SITE is a target binding site found in the 3' untranslated region of mRNA encoded by LOC286207, corresponding to a target binding site such as BINDING SITE I, BINDING SITE II or BINDING SITE III of FIG. 8. Table 4 illustrates the complementarity of the nucleotide sequences of LOC286207 BINDING SITE, designated SEQ ID:19893, to the nucleotide sequence of GAM7776 RNA, herein designated GAM RNA, also designated SEQ ID:246.

Another function of GAM7776 is therefore inhibition of LOC286207 (Accession XP_209941.1). Accordingly, utilities of GAM7776 include diagnosis, prevention and treatment of diseases and clinical conditions associated with LOC286207.

LOC286208 (Accession XP_212230.1) is another GAM7776 target gene, herein designated TARGET GENE. LOC286208 BINDING SITE1 through LOC286208 BINDING SITE3 are target binding sites found in untranslated regions of mRNA encoded by LOC286208, corresponding to target binding sites such as BINDING SITE I, BINDING SITE II or BINDING SITE III of FIG. 8. Table 4 illustrates the complementarity of the nucleotide sequences of LOC286208 BINDING SITE1 through LOC286208 BINDING SITE3, designated SEQ ID:4372, SEQ ID:9724 and SEQ ID:2849 respectively, to the nucleotide sequence of GAM7776 RNA, herein designated GAM RNA, also designated SEQ ID:246.

Another function of GAM7776 is therefore inhibition of LOC286208 (Accession XP_212230.1). Accordingly, utilities of GAM7776 include diagnosis, prevention and treatment of diseases and clinical conditions associated with LOC286208.

LOC286215 (Accession XP_212228.1) is another GAM7776 target gene, herein designated TARGET GENE. LOC286215 BINDING SITE is a target binding site found in the 5' untranslated region of mRNA encoded by LOC286215, corresponding to a target binding site such as BINDING SITE I, BINDING SITE II or BINDING SITE III of FIG. 8. Table 4 illustrates the complementarity of the nucleotide sequences of LOC286215 BINDING SITE, designated SEQ ID:19240, to the nucleotide sequence of GAM7776 RNA, herein designated GAM RNA, also designated SEQ ID:246.

Another function of GAM7776 is therefore inhibition of LOC286215 (Accession XP_212228.1). Accordingly, utilities of GAM7776 include diagnosis, prevention and treatment of diseases and clinical conditions associated with LOC286215.

LOC286221 (Accession XP_212233.1) is another GAM7776 target gene, herein designated TARGET GENE. LOC286221 BINDING SITE is a target binding site found in the 5' untranslated region of mRNA encoded by LOC286221, corresponding to a target binding site such as BINDING SITE I, BINDING SITE II or BINDING SITE III of FIG. 8. Table 4 illustrates the complementarity of the nucleotide sequences of LOC286221 BINDING SITE, designated SEQ ID:7774, to the nucleotide sequence of GAM7776 RNA, herein designated GAM RNA, also designated SEQ ID:246.

Another function of GAM7776 is therefore inhibition of LOC286221 (Accession XP_212233.1). Accordingly, utilities of GAM7776 include diagnosis, prevention and treatment of diseases and clinical conditions associated with LOC286221.

LOC286223 (Accession XP_209956.1) is another GAM7776 target gene, herein designated TARGET GENE. LOC286223 BINDING SITE is a target binding site found in the 3' untranslated region of mRNA encoded by LOC286223, corresponding to a target binding site such as BINDING SITE I, BINDING SITE II or BINDING SITE III of FIG. 8. Table 4 illustrates the complementarity of the nucleotide sequences of LOC286223 BINDING SITE, designated SEQ ID:6118, to the nucleotide sequence of GAM7776 RNA, herein designated GAM RNA, also designated SEQ ID:246.

Another function of GAM7776 is therefore inhibition of LOC286223 (Accession XP_209956.1). Accordingly, utilities of GAM7776 include diagnosis, prevention and treatment of diseases and clinical conditions associated with LOC286223.

LOC286245 (Accession XP_212244.1) is another GAM7776 target gene, herein designated TARGET GENE. LOC286245 BINDING SITE is a target binding site found in the 5' untranslated region of mRNA encoded by LOC286245, corresponding to a target binding site such as BINDING SITE I, BINDING SITE II or BINDING SITE III of FIG. 8. Table 4 illustrates the complementarity of the nucleotide sequences of LOC286245 BINDING SITE, designated SEQ ID:6868, to the nucleotide sequence of GAM7776 RNA, herein designated GAM RNA, also designated SEQ ID:246.

Another function of GAM7776 is therefore inhibition of LOC286245 (Accession XP_212244.1). Accordingly, utilities of GAM7776 include diagnosis, prevention and treatment of diseases and clinical conditions associated with LOC286245.

LOC286341 (Accession XP_212278.1) is another GAM7776 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:15975, to the nucleotide sequence of GAM7776 RNA, herein designated GAM RNA, also designated SEQ ID:246.

Another function of GAM7776 is therefore inhibition of LOC286341 (Accession XP_212278.1). Accordingly, utilities of GAM7776 include diagnosis, prevention and treatment of diseases and clinical conditions associated with LOC286341.

LOC286347 (Accession XP_208408.1) is another GAM7776 target gene, herein designated TARGET GENE. LOC286347 BINDING SITE is a target binding site found in the 5' untranslated region of mRNA encoded by LOC286347, corresponding to a target binding site such as BINDING SITE I, BINDING SITE II or BINDING SITE III of FIG. 8. Table 4 illustrates the complementarity of the nucleotide sequences of LOC286347 BINDING SITE, designated SEQ ID:522, to the nucleotide sequence of GAM7776 RNA, herein designated GAM RNA, also designated SEQ ID:246.

Another function of GAM7776 is therefore inhibition of LOC286347 (Accession XP_208408.1). Accordingly, utilities of GAM7776 include diagnosis, prevention and treatment of diseases and clinical conditions associated with LOC286347.

LOC286354 (Accession XP_212286.1) is another GAM7776 target gene, herein designated TARGET GENE. LOC286354 BINDING SITE is a target binding site found in the 5' untranslated region of mRNA encoded by LOC286354, corresponding to a target binding site such as BINDING SITE I, BINDING SITE II or BINDING SITE III of FIG. 8. Table 4 illustrates the complementarity of the nucleotide sequences of LOC286354 BINDING SITE, designated SEQ ID:15730, to the nucleotide sequence of GAM7776 RNA, herein designated GAM RNA, also designated SEQ ID:246.

Another function of GAM7776 is therefore inhibition of LOC286354 (Accession XP_212286.1). Accordingly, utilities of GAM7776 include diagnosis, prevention and treatment of diseases and clinical conditions associated with LOC286354.

LOC286356 (Accession XP_212290.1) is another GAM7776 target gene, herein designated TARGET GENE. LOC286356 BINDING SITE is a target binding site found in the 5' untranslated region of mRNA encoded by LOC286356, corresponding to a target binding site such as BINDING SITE I, BINDING SITE II or BINDING SITE III of FIG. 8. Table 4 illustrates the complementarity of the nucleotide sequences of LOC286356 BINDING SITE, designated SEQ ID:7385, to the nucleotide sequence of GAM7776 RNA, herein designated GAM RNA, also designated SEQ ID:246.

Another function of GAM7776 is therefore inhibition of LOC286356 (Accession XP_212290.1). Accordingly, utilities of GAM7776 include diagnosis, prevention and treatment of diseases and clinical conditions associated with LOC286356.

LOC286357 (Accession XP_212285.1) is another GAM7776 target gene, herein designated TARGET GENE. LOC286357 BINDING SITE is a target binding site found in the 5' untranslated region of mRNA encoded by LOC286357, corresponding to a target binding site such as BINDING SITE I, BINDING SITE II or BINDING SITE III of FIG. 8. Table 4 illustrates the complementarity of the nucleotide sequences of LOC286357 BINDING SITE, designated SEQ ID:14974, to the nucleotide sequence of GAM7776 RNA, herein designated GAM RNA, also designated SEQ ID:246.

Another function of GAM7776 is therefore inhibition of LOC286357 (Accession XP_212285.1). Accordingly, utilities of GAM7776 include diagnosis, prevention and treatment of diseases and clinical conditions associated with LOC286357.

LOC286371 (Accession XP_212291.1) is another GAM7776 target gene, herein designated TARGET GENE. LOC286371 BINDING SITE is a target binding site found in the 3' untranslated region of mRNA encoded by LOC286371, corresponding to a target binding site such as BINDING SITE I, BINDING SITE II or BINDING SITE III of FIG. 8. Table 4 illustrates the complementarity of the nucleotide sequences of LOC286371 BINDING SITE, designated SEQ ID:3785, to the nucleotide sequence of GAM7776 RNA, herein designated GAM RNA, also designated SEQ ID:246.

Another function of GAM7776 is therefore inhibition of LOC286371 (Accession XP_212291.1). Accordingly, utilities of GAM7776 include diagnosis, prevention and treatment of diseases and clinical conditions associated with LOC286371.

LOC286395 (Accession XP_212308.1) is another GAM7776 target gene, herein designated TARGET GENE. LOC286395 BINDING SITE is a target binding site found in the 5' untranslated region of mRNA encoded by LOC286395, corresponding to a target binding site such as BINDING SITE I, BINDING SITE II or BINDING SITE III of FIG. 8. Table 4 illustrates the complementarity of the nucleotide sequences of LOC286395 BINDING SITE, designated SEQ ID:2722, to the nucleotide sequence of GAM7776 RNA, herein designated GAM RNA, also designated SEQ ID:246.

Another function of GAM7776 is therefore inhibition of LOC286395 (Accession XP_212308.1). Accordingly, utilities of GAM7776 include diagnosis, prevention and treatment of diseases and clinical conditions associated with LOC286395.

LOC286401 (Accession XP_212310.1) is another GAM7776 target gene, herein designated TARGET GENE. LOC286401 BINDING SITE is a target binding site found in the 5' untranslated region of mRNA encoded by LOC286401, corresponding to a target binding site such as BINDING SITE I, BINDING SITE II or BINDING SITE III of FIG. 8. Table 4 illustrates the complementarity of the nucleotide sequences of LOC286401 BINDING SITE, designated SEQ ID:1038, to the nucleotide sequence of GAM7776 RNA, herein designated GAM RNA, also designated SEQ ID:246.

Another function of GAM7776 is therefore inhibition of LOC286401 (Accession XP_212310.1). Accordingly, utilities of GAM7776 include diagnosis, prevention and treatment of diseases and clinical conditions associated with LOC286401.

LOC286441 (Accession XP_212319.1) is another GAM7776 target gene, herein designated TARGET GENE. LOC286441 BINDING SITE is a target binding site found in the 3' untranslated region of mRNA encoded by LOC286441, corresponding to a target binding site such as BINDING SITE I, BINDING SITE II or BINDING SITE III of FIG. 8. Table 4 illustrates the complementarity of the nucleotide sequences of LOC286441 BINDING SITE, designated SEQ ID:2754, to the nucleotide sequence of GAM7776 RNA, herein designated GAM RNA, also designated SEQ ID:246.

Another function of GAM7776 is therefore inhibition of LOC286441 (Accession XP_212319.1). Accordingly, utilities of GAM7776 include diagnosis, prevention and treatment of diseases and clinical conditions associated with LOC286441.

LOC286467 (Accession XP_210063.1) is another GAM7776 target gene, herein designated TARGET GENE. LOC286467 BINDING SITE is a target binding site found in the 3' untranslated region of mRNA encoded by LOC286467, corresponding to a target binding site such as BINDING SITE I, BINDING SITE II or BINDING SITE III of FIG. 8. Table 4 illustrates the complementarity of the nucleotide sequences of LOC286467 BINDING SITE, designated SEQ ID:9580, to the nucleotide sequence of GAM7776 RNA, herein designated GAM RNA, also designated SEQ ID:246.

Another function of GAM7776 is therefore inhibition of LOC286467 (Accession XP_210063.1). Accordingly, utilities of GAM7776 include diagnosis, prevention and treatment of diseases and clinical conditions associated with LOC286467.

LOC286553 (Accession XP_212340.1) is another GAM7776 target gene, herein designated TARGET GENE. LOC286553 BINDING SITE is a target binding site found in the 3' untranslated region of mRNA encoded by LOC286553, corresponding to a target binding site such as BINDING SITE I, BINDING SITE II or BINDING SITE III of FIG. 8. Table 4 illustrates the complementarity of the nucleotide sequences of LOC286553 BINDING SITE, designated SEQ ID:3183, to the nucleotide sequence of GAM7776 RNA, herein designated GAM RNA, also designated SEQ ID:246.

Another function of GAM7776 is therefore inhibition of LOC286553 (Accession XP_212340.1). Accordingly, utilities of GAM7776 include diagnosis, prevention and treatment of diseases and clinical conditions associated with LOC286553.

LOC286558 (Accession XP_210106.1) is another GAM7776 target gene, herein designated TARGET GENE. LOC286558 BINDING SITE is a target binding site found in the 3' untranslated region of mRNA encoded by LOC286558, corresponding to a target binding site such as BINDING SITE I, BINDING SITE II or BINDING SITE III of FIG. 8. Table 4 illustrates the complementarity of the nucleotide sequences of LOC286558 BINDING SITE, designated SEQ ID:9264, to the nucleotide sequence of GAM7776 RNA, herein designated GAM RNA, also designated SEQ ID:246.

Another function of GAM7776 is therefore inhibition of LOC286558 (Accession XP_210106.1). Accordingly, utilities of GAM7776 include diagnosis, prevention and treatment of diseases and clinical conditions associated with LOC286558.

LOC286564 (Accession XP_210108.1) is another GAM7776 target gene, herein designated TARGET GENE. LOC286564 BINDING SITE is a target binding site found in the 3' untranslated region of mRNA encoded by LOC286564, corresponding to a target binding site such as BINDING SITE I, BINDING SITE II or BINDING SITE III of FIG. 8. Table 4 illustrates the complementarity of the nucleotide sequences of LOC286564 BINDING SITE, designated SEQ ID:9264, to the nucleotide sequence of GAM7776 RNA, herein designated GAM RNA, also designated SEQ ID:246.

Another function of GAM7776 is therefore inhibition of LOC286564 (Accession XP_210108.1). Accordingly, utilities of GAM7776 include diagnosis, prevention and treatment of diseases and clinical conditions associated with LOC286564.

LOC338562 (Accession XP_294654.1) is another GAM7776 target gene, herein designated TARGET GENE. LOC338562 BINDING SITE is a target binding site found in the 3' untranslated region of mRNA encoded by LOC338562, corresponding to a target binding site such as BINDING SITE I, BINDING SITE II or BINDING SITE III of FIG. 8. Table 4 illustrates the complementarity of the nucleotide sequences of LOC338562 BINDING SITE, designated SEQ ID:13760, to the nucleotide sequence of GAM7776 RNA, herein designated GAM RNA, also designated SEQ ID:246.

Another function of GAM7776 is therefore inhibition of LOC338562 (Accession XP_294654.1). Accordingly, utilities of GAM7776 include diagnosis, prevention and treatment of diseases and clinical conditions associated with LOC338562.

LOC338565 (Accession XP_294653.1) is another GAM7776 target gene, herein designated TARGET GENE. LOC338565 BINDING SITE is a target binding site found in the 3' untranslated region of mRNA encoded by LOC338565, corresponding to a target binding site such as BINDING SITE I, BINDING SITE II or BINDING SITE III of FIG. 8. Table 4 illustrates the complementarity of the nucleotide sequences of LOC338565 BINDING SITE, designated SEQ ID:12867, to the nucleotide sequence of GAM7776 RNA, herein designated GAM RNA, also designated SEQ ID:246.

Another function of GAM7776 is therefore inhibition of LOC338565 (Accession XP_294653.1). Accordingly, utilities of GAM7776 include diagnosis, prevention and treatment of diseases and clinical conditions associated with LOC338565.

LOC338575 (Accession XP_290473.1) is another GAM7776 target gene, herein designated TARGET GENE. LOC338575 BINDING SITE is a target binding site found in the 3' untranslated region of mRNA encoded by LOC338575, corresponding to a target binding site such as BINDING SITE I, BINDING SITE II or BINDING SITE III of FIG. 8. Table 4 illustrates the complementarity of the nucleotide sequences of LOC338575 BINDING SITE, designated SEQ ID:14074, to the nucleotide sequence of GAM7776 RNA, herein designated GAM RNA, also designated SEQ ID:246.

Another function of GAM7776 is therefore inhibition of LOC338575 (Accession XP_290473.1). Accordingly, utilities of GAM7776 include diagnosis, prevention and treatment of diseases and clinical conditions associated with LOC338575.

LOC338579 (Accession XP_290472.1) is another GAM7776 target gene, herein designated TARGET GENE. LOC338579 BINDING SITE is a target binding site found in the 3' untranslated region of mRNA encoded by LOC338579, corresponding to a target binding site such as BINDING SITE I, BINDING SITE II or BINDING SITE III of FIG. 8. Table 4 illustrates the complementarity of the nucleotide sequences of LOC338579 BINDING SITE, designated SEQ ID:4528, to the nucleotide sequence of GAM7776 RNA, herein designated GAM RNA, also designated SEQ ID:246.

Another function of GAM7776 is therefore inhibition of LOC338579 (Accession XP_290472.1). Accordingly, utilities of GAM7776 include diagnosis, prevention and treatment of diseases and clinical conditions associated with LOC338579.

LOC338585 (Accession XP_294658.1) is another GAM7776 target gene, herein designated TARGET GENE. LOC338585 BINDING SITE is a target binding site found in the 5' untranslated region of mRNA encoded by LOC338585, corresponding to a target binding site such as BINDING SITE I, BINDING SITE II or BINDING SITE III of FIG. 8. Table 4 illustrates the complementarity of the nucleotide sequences of LOC338585 BINDING SITE, designated SEQ ID:7523, to the nucleotide sequence of GAM7776 RNA, herein designated GAM RNA, also designated SEQ ID:246.

Another function of GAM7776 is therefore inhibition of LOC338585 (Accession XP_294658.1). Accordingly, utilities of GAM7776 include diagnosis, prevention and treatment of diseases and clinical conditions associated with LOC338585.

LOC338645 (Accession XP_290494.1) is another GAM7776 target gene, herein designated TARGET GENE. LOC338645 BINDING SITE is a target binding site found in the 3' untranslated region of mRNA encoded by LOC338645, corresponding to a target binding site such as BINDING SITE I, BINDING SITE II or BINDING SITE III of FIG. 8. Table 4 illustrates the complementarity of the nucleotide sequences of LOC338645 BINDING SITE, designated SEQ ID:6626, to the nucleotide sequence of GAM7776 RNA, herein designated GAM RNA, also designated SEQ ID:246.

Another function of GAM7776 is therefore inhibition of LOC338645 (Accession XP_290494.1). Accordingly, utilities of GAM7776 include diagnosis, prevention and treatment of diseases and clinical conditions associated with LOC338645.

LOC338709 (Accession XP_211595.2) is another GAM7776 target gene, herein designated TARGET GENE. LOC338709 BINDING SITE is a target binding site found in the 5' untranslated region of mRNA encoded by LOC338709, corresponding to a target binding site such as BINDING SITE I, BINDING SITE II or BINDING SITE III of FIG. 8. Table 4 illustrates the complementarity of the nucleotide sequences of LOC338709 BINDING SITE, designated SEQ ID:12803, to the nucleotide sequence of GAM7776 RNA, herein designated GAM RNA, also designated SEQ ID:246.

Another function of GAM7776 is therefore inhibition of LOC338709 (Accession XP_211595.2). Accordingly, utilities of GAM7776 include diagnosis, prevention and treatment of diseases and clinical conditions associated with LOC338709.

LOC338731 (Accession XP_294688.1) is another GAM7776 target gene, herein designated TARGET GENE. LOC338731 BINDING SITE is a target binding site found in the 3' untranslated region of mRNA encoded by LOC338731, corresponding to a target binding site such as BINDING SITE I, BINDING SITE II or BINDING SITE III of FIG. 8. Table 4 illustrates the complementarity of the nucleotide sequences of LOC338731 BINDING SITE, designated SEQ ID:6518, to the nucleotide sequence of GAM7776 RNA, herein designated GAM RNA, also designated SEQ ID:246.

Another function of GAM7776 is therefore inhibition of LOC338731 (Accession XP_294688.1). Accordingly, utilities of GAM7776 include diagnosis, prevention and treatment of diseases and clinical conditions associated with LOC338731.

LOC338739 (Accession XP_294690.1) is another GAM7776 target gene, herein designated TARGET GENE. LOC338739 BINDING SITE1 and LOC338739 BINDING SITE2 are target binding sites found in untranslated regions of mRNA encoded by LOC338739, corresponding to target binding sites such as BINDING SITE I, BINDING SITE II or BINDING SITE III of FIG. 8. Table 4 illustrates the complementarity of the nucleotide sequences of LOC338739 BINDING SITE1 and LOC338739 BINDING SITE2, designated SEQ ID:15044 and SEQ ID:14732 respectively, to the nucleotide sequence of GAM7776 RNA, herein designated GAM RNA, also designated SEQ ID:246.

Another function of GAM7776 is therefore inhibition of LOC338739 (Accession XP_294690.1). Accordingly, utilities of GAM7776 include diagnosis, prevention and treatment of diseases and clinical conditions associated with LOC338739.

LOC338773 (Accession XP_290570.1) is another GAM7776 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:16493, to the nucleotide sequence of GAM7776 RNA, herein designated GAM RNA, also designated SEQ ID:246.

Another function of GAM7776 is therefore inhibition of LOC338773 (Accession XP_290570.1). Accordingly, utilities of GAM7776 include diagnosis, prevention and treatment of diseases and clinical conditions associated with LOC338773.

LOC338819 (Accession XP_290216.1) is another GAM7776 target gene, herein designated TARGET GENE. LOC338819 BINDING SITE is a target binding site found in the 3' untranslated region of mRNA encoded by LOC338819, corresponding to a target binding site such as BINDING SITE I, BINDING SITE II or BINDING SITE III of FIG. 8. Table 4 illustrates the complementarity of the nucleotide sequences of LOC338819 BINDING SITE, designated SEQ ID:11507, to the nucleotide sequence of GAM7776 RNA, herein designated GAM RNA, also designated SEQ ID:246.

Another function of GAM7776 is therefore inhibition of LOC338819 (Accession XP_290216.1). Accordingly, utilities of GAM7776 include diagnosis, prevention and treatment of diseases and clinical conditions associated with LOC338819.

LOC338899 (Accession XP_294740.1) is another GAM7776 target gene, herein designated TARGET GENE. LOC338899 BINDING SITE is a target binding site found in the 5' untranslated region of mRNA encoded by LOC338899, corresponding to a target binding site such as BINDING SITE I, BINDING SITE II or BINDING SITE III of FIG. 8. Table 4 illustrates the complementarity of the nucleotide sequences of LOC338899 BINDING SITE, designated SEQ ID:12341, to the nucleotide sequence of GAM7776 RNA, herein designated GAM RNA, also designated SEQ ID:246.

Another function of GAM7776 is therefore inhibition of LOC338899 (Accession XP_294740.1). Accordingly, utilities of GAM7776 include diagnosis, prevention and treatment of diseases and clinical conditions associated with LOC338899.

LOC338923 (Accession XP_294742.1) is another GAM7776 target gene, herein designated TARGET GENE. LOC338923 BINDING SITE1 and LOC338923 BINDING SITE2 are target binding sites found in untranslated regions of mRNA encoded by LOC338923, corresponding to target binding sites such as BINDING SITE I, BINDING SITE II or BINDING SITE III of FIG. 8. Table 4 illustrates the complementarity of the nucleotide sequences of LOC338923 BINDING SITE1 and LOC338923 BINDING SITE2, designated SEQ ID:8559 and SEQ ID:4298 respectively, to the nucleotide sequence of GAM7776 RNA, herein designated GAM RNA, also designated SEQ ID:246.

Another function of GAM7776 is therefore inhibition of LOC338923 (Accession XP_294742.1). Accordingly, utilities of GAM7776 include diagnosis, prevention and treatment of diseases and clinical conditions associated with LOC338923.

LOC338963 (Accession XP_294757.1) is another GAM7776 target gene, herein designated TARGET GENE. LOC338963 BINDING SITE is a target binding site found in the 3' untranslated region of mRNA encoded by LOC338963, corresponding to a target binding site such as BINDING SITE I, BINDING SITE II or BINDING SITE III of FIG. 8. Table 4 illustrates the complementarity of the nucleotide sequences of LOC338963 BINDING SITE, designated SEQ ID:3348, to the nucleotide sequence of GAM7776 RNA, herein designated GAM RNA, also designated SEQ ID:246.

Another function of GAM7776 is therefore inhibition of LOC338963 (Accession XP_294757.1). Accordingly, utilities of GAM7776 include diagnosis, prevention and treatment of diseases and clinical conditions associated with LOC338963.

LOC338991 (Accession XP_290663.1) is another GAM7776 target gene, herein designated TARGET GENE. LOC338991 BINDING SITE is a target binding site found in the 3' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:12479, to the nucleotide sequence of GAM7776 RNA, herein designated GAM RNA, also designated SEQ ID:246.

Another function of GAM7776 is therefore inhibition of LOC338991 (Accession XP_290663.1). Accordingly, utilities of GAM7776 include diagnosis, prevention and treatment of diseases and clinical conditions associated with LOC338991.

LOC338999 (Accession XP_290659.1) is another GAM7776 target gene, herein designated TARGET GENE. LOC338999 BINDING SITE is a target binding site found in the 3' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:12479, to the nucleotide sequence of GAM7776 RNA, herein designated GAM RNA, also designated SEQ ID:246.

Another function of GAM7776 is therefore inhibition of LOC338999 (Accession XP_290659.1). Accordingly, utilities of GAM7776 include diagnosis, prevention and treatment of diseases and clinical conditions associated with LOC338999.

LOC339077 (Accession XP_294802.2) is another GAM7776 target gene, herein designated TARGET GENE. LOC339077 BINDING SITE is a target binding site found in the 3' untranslated region of mRNA encoded by LOC339077, corresponding to a target binding site such as BINDING SITE I, BINDING SITE II or BINDING SITE III of FIG. 8. Table 4 illustrates the complementarity of the nucleotide sequences of LOC339077 BINDING SITE, designated SEQ ID:17484, to the nucleotide sequence of GAM7776 RNA, herein designated GAM RNA, also designated SEQ ID:246.

Another function of GAM7776 is therefore inhibition of LOC339077 (Accession XP_294802.2). Accordingly, utilities of GAM7776 include diagnosis, prevention and treatment of diseases and clinical conditions associated with LOC339077.

LOC339078 (Accession XP_290692.1) is another GAM7776 target gene, herein designated TARGET GENE. LOC339078 BINDING SITE is a target binding site found in the 3' untranslated region of mRNA encoded by LOC339078, corresponding to a target binding site such as BINDING SITE I, BINDING SITE II or BINDING SITE III of FIG. 8. Table 4 illustrates the complementarity of the nucleotide sequences of LOC339078 BINDING SITE, designated SEQ ID:9543, to the nucleotide sequence of GAM7776 RNA, herein designated GAM RNA, also designated SEQ ID:246.

Another function of GAM7776 is therefore inhibition of LOC339078 (Accession XP_290692.1). Accordingly, utilities of GAM7776 include diagnosis, prevention and treatment of diseases and clinical conditions associated with LOC339078.

LOC339083 (Accession XP_290697.2) is another GAM7776 target gene, herein designated TARGET GENE. LOC339083 BINDING SITE is a target binding site found in the 5' untranslated region of mRNA encoded by LOC339083, corresponding to a target binding site such as BINDING SITE I, BINDING SITE II or BINDING SITE III of FIG. 8. Table 4 illustrates the complementarity of the nucleotide sequences of LOC339083 BINDING SITE, designated SEQ ID:1843, to the nucleotide sequence of GAM7776 RNA, herein designated GAM RNA, also designated SEQ ID:246.

Another function of GAM7776 is therefore inhibition of LOC339083 (Accession XP_290697.2). Accordingly, utilities of GAM7776 include diagnosis, prevention and treatment of diseases and clinical conditions associated with LOC339083.

LOC339108 (Accession XP_290711.1) is another GAM7776 target gene, herein designated TARGET GENE. LOC339108 BINDING SITE is a target binding site found in the 5' untranslated region of mRNA encoded by LOC339108, corresponding to a target binding site such as BINDING SITE I, BINDING SITE II or BINDING SITE III of FIG. 8. Table 4 illustrates the complementarity of the nucleotide sequences of LOC339108 BINDING SITE, designated SEQ ID:14266, to the nucleotide sequence of GAM7776 RNA, herein designated GAM RNA, also designated SEQ ID:246.

Another function of GAM7776 is therefore inhibition of LOC339108 (Accession XP_290711.1). Accordingly, utilities of GAM7776 include diagnosis, prevention and treatment of diseases and clinical conditions associated with LOC339108.

LOC339146 (Accession XP_294825.1) is another GAM7776 target gene, herein designated TARGET GENE. LOC339146 BINDING SITE is a target binding site found in the 5' untranslated region of mRNA encoded by LOC339146, corresponding to a target binding site such as BINDING SITE I, BINDING SITE II or BINDING SITE III of FIG. 8. Table 4 illustrates the complementarity of the nucleotide sequences of LOC339146 BINDING SITE, designated SEQ ID:15614, to the nucleotide sequence of GAM7776 RNA, herein designated GAM RNA, also designated SEQ ID:246.

Another function of GAM7776 is therefore inhibition of LOC339146 (Accession XP_294825.1). Accordingly, utilities of GAM7776 include diagnosis, prevention and treatment of diseases and clinical conditions associated with LOC339146.

LOC339178 (Accession XP_290742.1) is another GAM7776 target gene, herein designated TARGET GENE. LOC339178 BINDING SITE is a target binding site found in the 3' untranslated region of mRNA encoded by LOC339178, corresponding to a target binding site such as BINDING SITE I, BINDING SITE II or BINDING SITE III of FIG. 8. Table 4 illustrates the complementarity of the nucleotide sequences of LOC339178 BINDING SITE, designated SEQ ID:16261, to the nucleotide sequence of GAM7776 RNA, herein designated GAM RNA, also designated SEQ ID:246.

Another function of GAM7776 is therefore inhibition of LOC339178 (Accession XP_290742.1). Accordingly, utilities of GAM7776 include diagnosis, prevention and treatment of diseases and clinical conditions associated with LOC339178.

LOC339201 (Accession XP_290756.1) is another GAM7776 target gene, herein designated TARGET GENE. LOC339201 BINDING SITE is a target binding site found in the 3' untranslated region of mRNA encoded by LOC339201, corresponding to a target binding site such as BINDING SITE I, BINDING SITE II or BINDING SITE III of FIG. 8. Table 4 illustrates the complementarity of the nucleotide sequences of LOC339201 BINDING SITE, designated SEQ ID:4056, to the nucleotide sequence of GAM7776 RNA, herein designated GAM RNA, also designated SEQ ID:246.

Another function of GAM7776 is therefore inhibition of LOC339201 (Accession XP_290756.1). Accordingly, utilities of GAM7776 include diagnosis, prevention and treatment of diseases and clinical conditions associated with LOC339201.

LOC339216 (Accession XP_290762.2) is another GAM7776 target gene, herein designated TARGET GENE. LOC339216 BINDING SITE is a target binding site found in the 5' untranslated region of mRNA encoded by LOC339216, corresponding to a target binding site such as BINDING SITE I, BINDING SITE II or BINDING SITE III of FIG. 8. Table 4 illustrates the complementarity of the nucleotide sequences of LOC339216 BINDING SITE, designated SEQ ID:19537, to the nucleotide sequence of GAM7776 RNA, herein designated GAM RNA, also designated SEQ ID:246.

Another function of GAM7776 is therefore inhibition of LOC339216 (Accession XP_290762.2). Accordingly, utilities of GAM7776 include diagnosis, prevention and treatment of diseases and clinical conditions associated with LOC339216.

LOC339248 (Accession XP_294879.1) is another GAM7776 target gene, herein designated TARGET GENE. LOC339248 BINDING SITE is a target binding site found in the 3' untranslated region of mRNA encoded by LOC339248, corresponding to a target binding site such as BINDING SITE I, BINDING SITE II or BINDING SITE III of FIG. 8. Table 4 illustrates the complementarity of the nucleotide sequences of LOC339248 BINDING SITE, designated SEQ ID:19597, to the nucleotide sequence of GAM7776 RNA, herein designated GAM RNA, also designated SEQ ID:246.

Another function of GAM7776 is therefore inhibition of LOC339248 (Accession XP_294879.1). Accordingly, utilities of GAM7776 include diagnosis, prevention and treatment of diseases and clinical conditions associated with LOC339248.

LOC339250 (Accession XP_294883.1) is another GAM7776 target gene, herein designated TARGET GENE. LOC339250 BINDING SITE is a target binding site found in the 3' untranslated region of mRNA encoded by LOC339250, corresponding to a target binding site such as BINDING SITE I, BINDING SITE II or BINDING SITE III of FIG. 8. Table 4 illustrates the complementarity of the nucleotide sequences of LOC339250 BINDING SITE, designated SEQ ID:19597, to the nucleotide sequence of GAM7776 RNA, herein designated GAM RNA, also designated SEQ ID:246.

Another function of GAM7776 is therefore inhibition of LOC339250 (Accession XP_294883.1). Accordingly, utilities of GAM7776 include diagnosis, prevention and treatment of diseases and clinical conditions associated with LOC339250.

LOC339282 (Accession XP_294900.2) is another GAM7776 target gene, herein designated TARGET GENE. LOC339282 BINDING SITE is a target binding site found in the 5' untranslated region of mRNA encoded by LOC339282, corresponding to a target binding site such as BINDING SITE I, BINDING SITE II or BINDING SITE III of FIG. 8. Table 4 illustrates the complementarity of the nucleotide sequences of LOC339282 BINDING SITE, designated SEQ ID:19537, to the nucleotide sequence of GAM7776 RNA, herein designated GAM RNA, also designated SEQ ID:246.

Another function of GAM7776 is therefore inhibition of LOC339282 (Accession XP_294900.2). Accordingly, utilities of GAM7776 include diagnosis, prevention and treatment of diseases and clinical conditions associated with LOC339282.

LOC339283 (Accession XP_294899.2) is another GAM7776 target gene, herein designated TARGET GENE. LOC339283 BINDING SITE is a target binding site found in the 5' untranslated region of mRNA encoded by LOC339283, corresponding to a target binding site such as BINDING SITE I, BINDING SITE II or BINDING SITE III of FIG. 8. Table 4 illustrates the complementarity of the nucleotide sequences of LOC339283 BINDING SITE, designated SEQ ID:11314, to the nucleotide sequence of GAM7776 RNA, herein designated GAM RNA, also designated SEQ ID:246.

Another function of GAM7776 is therefore inhibition of LOC339283 (Accession XP_294899.2). Accordingly, utilities of GAM7776 include diagnosis, prevention and treatment of diseases and clinical conditions associated with LOC339283.

LOC339324 (Accession XP_290838.1) is another GAM7776 target gene, herein designated TARGET GENE. LOC339324 BINDING SITE is a target binding site found in the 3' untranslated region of mRNA encoded by LOC339324, corresponding to a target binding site such as BINDING SITE I, BINDING SITE II or BINDING SITE III of FIG. 8. Table 4 illustrates the complementarity of the nucleotide sequences of LOC339324 BINDING SITE, designated SEQ ID:9544, to the nucleotide sequence of GAM7776 RNA, herein designated GAM RNA, also designated SEQ ID:246.

Another function of GAM7776 is therefore inhibition of LOC339324 (Accession XP_290838.1). Accordingly, utilities of GAM7776 include diagnosis, prevention and treatment of diseases and clinical conditions associated with LOC339324.

LOC339325 (Accession XP_290830.1) is another GAM7776 target gene, herein designated TARGET GENE. LOC339325 BINDING SITE1 and LOC339325 BINDING SITE2 are target binding sites found in untranslated regions of mRNA encoded by LOC339325, corresponding to target binding sites such as BINDING SITE I, BINDING SITE II or BINDING SITE III of FIG. 8. Table 4 illustrates the complementarity of the nucleotide sequences of LOC339325 BINDING SITE1 and LOC339325 BINDING SITE2, designated SEQ ID:17114 and SEQ ID:16940 respectively, to the nucleotide sequence of GAM7776 RNA, herein designated GAM RNA, also designated SEQ ID:246.

Another function of GAM7776 is therefore inhibition of LOC339325 (Accession XP_290830.1). Accordingly, utilities of GAM7776 include diagnosis, prevention and treatment of diseases and clinical conditions associated with LOC339325.

LOC339417 (Accession XP_294944.1) is another GAM7776 target gene, herein designated TARGET GENE. LOC339417 BINDING SITE is a target binding site found in the 5' untranslated region of mRNA encoded by LOC339417, corresponding to a target binding site such as BINDING SITE I, BINDING SITE II or BINDING SITE III of FIG. 8. Table 4 illustrates the complementarity of the nucleotide sequences of LOC339417 BINDING SITE, designated SEQ ID:2027, to the nucleotide sequence of GAM7776 RNA, herein designated GAM RNA, also designated SEQ ID:246.

Another function of GAM7776 is therefore inhibition of LOC339417 (Accession XP_294944.1). Accordingly, utilities of GAM7776 include diagnosis, prevention and treatment of diseases and clinical conditions associated with LOC339417.

LOC339448 (Accession XP_290902.1) is another GAM7776 target gene, herein designated TARGET GENE. LOC339448 BINDING SITE is a target binding site found in the 3' untranslated region of mRNA encoded by LOC339448, corresponding to a target binding site such as BINDING SITE I, BINDING SITE II or BINDING SITE III of FIG. 8. Table 4 illustrates the complementarity of the nucleotide sequences of LOC339448 BINDING SITE, designated SEQ ID:10679, to the nucleotide sequence of GAM7776 RNA, herein designated GAM RNA, also designated SEQ ID:246.

Another function of GAM7776 is therefore inhibition of LOC339448 (Accession XP_290902.1). Accordingly, utilities of GAM7776 include diagnosis, prevention and treatment of diseases and clinical conditions associated with LOC339448.

LOC339458 (Accession XP_290911.1) is another GAM7776 target gene, herein designated TARGET GENE. LOC339458 BINDING SITE is a target binding site found in the 3' untranslated region of mRNA encoded by LOC339458, corresponding to a target binding site such as BINDING SITE I, BINDING SITE II or BINDING SITE III of FIG. 8. Table 4 illustrates the complementarity of the nucleotide sequences of LOC339458 BINDING SITE, designated SEQ ID:5488, to the nucleotide sequence of GAM7776 RNA, herein designated GAM RNA, also designated SEQ ID:246.

Another function of GAM7776 is therefore inhibition of LOC339458 (Accession XP_290911.1). Accordingly, utilities of GAM7776 include diagnosis, prevention and treatment of diseases and clinical conditions associated with LOC339458.

LOC339459 (Accession XP_290907.2) is another GAM7776 target gene, herein designated TARGET GENE. LOC339459 BINDING SITE is a target binding site found in the 3' untranslated region of mRNA encoded by LOC339459, corresponding to a target binding site such as BINDING SITE I, BINDING SITE II or BINDING SITE III of FIG. 8. Table 4 illustrates the complementarity of the nucleotide sequences of LOC339459 BINDING SITE, designated SEQ ID:13513, to the nucleotide sequence of GAM7776 RNA, herein designated GAM RNA, also designated SEQ ID:246.

Another function of GAM7776 is therefore inhibition of LOC339459 (Accession XP_290907.2). Accordingly, utilities of GAM7776 include diagnosis, prevention and treatment of diseases and clinical conditions associated with LOC339459.

LOC339492 (Accession XP_290919.1) is another GAM7776 target gene, herein designated TARGET GENE. LOC339492 BINDING SITE1 through LOC339492 BINDING SITE3 are target binding sites found in untranslated regions of mRNA encoded by LOC339492, corresponding to target binding sites such as BINDING SITE I, BINDING SITE II or BINDING SITE III of FIG. 8. Table 4 illustrates the complementarity of the nucleotide sequences of LOC339492 BINDING SITE1 through LOC339492 BINDING SITE3, designated SEQ ID:7386, SEQ ID:8590 and SEQ ID:695 respectively, to the nucleotide sequence of GAM7776 RNA, herein designated GAM RNA, also designated SEQ ID:246.

Another function of GAM7776 is therefore inhibition of LOC339492 (Accession XP_290919.1). Accordingly, utilities of GAM7776 include diagnosis, prevention and treatment of diseases and clinical conditions associated with LOC339492.

LOC339577 (Accession XP_295005.1) is another GAM7776 target gene, herein designated TARGET GENE. LOC339577 BINDING SITE1 and LOC339577 BINDING SITE2 are target binding sites found in untranslated regions of mRNA encoded by LOC339577, corresponding to target binding sites such as BINDING SITE I, BINDING SITE II or BINDING SITE III of FIG. 8. Table 4 illustrates the complementarity of the nucleotide sequences of LOC339577 BINDING SITE1 and LOC339577 BINDING SITE2, designated SEQ ID:14733 and SEQ ID:12075 respectively, to the nucleotide sequence of GAM7776 RNA, herein designated GAM RNA, also designated SEQ ID:246.

Another function of GAM7776 is therefore inhibition of LOC339577 (Accession XP_295005.1). Accordingly, utilities of GAM7776 include diagnosis, prevention and treatment of diseases and clinical conditions associated with LOC339577.

LOC339600 (Accession XP_295014.1) is another GAM7776 target gene, herein designated TARGET GENE. LOC339600 BINDING SITE is a target binding site found in the 3' untranslated region of mRNA encoded by LOC339600, corresponding to a target binding site such as BINDING SITE I, BINDING SITE II or BINDING SITE III of FIG. 8. Table 4 illustrates the complementarity of the nucleotide sequences of LOC339600 BINDING SITE, designated SEQ ID:15295, to the nucleotide sequence of GAM7776 RNA, herein designated GAM RNA, also designated SEQ ID:246.

Another function of GAM7776 is therefore inhibition of LOC339600 (Accession XP_295014.1). Accordingly, utilities of GAM7776 include diagnosis, prevention and treatment of diseases and clinical conditions associated with LOC339600.

LOC339659 (Accession XP_290981.1) is another GAM7776 target gene, herein designated TARGET GENE. LOC339659 BINDING SITE is a target binding site found in the 3' untranslated region of mRNA encoded by LOC339659, corresponding to a target binding site such as BINDING SITE I, BINDING SITE II or BINDING SITE III of FIG. 8. Table 4 illustrates the complementarity of the nucleotide sequences of LOC339659 BINDING SITE, designated SEQ ID:17076, to the nucleotide sequence of GAM7776 RNA, herein designated GAM RNA, also designated SEQ ID:246.

Another function of GAM7776 is therefore inhibition of LOC339659 (Accession XP_290981.1). Accordingly, utilities of GAM7776 include diagnosis, prevention and treatment of diseases and clinical conditions associated with LOC339659.

LOC339685 (Accession XP_295032.1) is another GAM7776 target gene, herein designated TARGET GENE. LOC339685 BINDING SITE is a target binding site found in the 5' untranslated region of mRNA encoded by LOC339685, corresponding to a target binding site such as BINDING SITE I, BINDING SITE II or BINDING SITE III of FIG. 8. Table 4 illustrates the complementarity of the nucleotide sequences of LOC339685 BINDING SITE, designated SEQ ID:1982, to the nucleotide sequence of GAM7776 RNA, herein designated GAM RNA, also designated SEQ ID:246.

Another function of GAM7776 is therefore inhibition of LOC339685 (Accession XP_295032.1). Accordingly, utilities of GAM7776 include diagnosis, prevention and treatment of diseases and clinical conditions associated with LOC339685.

LOC339694 (Accession XP_295035.1) is another GAM7776 target gene, herein designated TARGET GENE. LOC339694 BINDING SITE is a target binding site found in the 5' untranslated region of mRNA encoded by LOC339694, corresponding to a target binding site such as BINDING SITE I, BINDING SITE II or BINDING SITE III of FIG. 8. Table 4 illustrates the complementarity of the nucleotide sequences of LOC339694 BINDING SITE, designated SEQ ID:15954, to the nucleotide sequence of GAM7776 RNA, herein designated GAM RNA, also designated SEQ ID:246.

Another function of GAM7776 is therefore inhibition of LOC339694 (Accession XP_295035.1). Accordingly, utilities of GAM7776 include diagnosis, prevention and treatment of diseases and clinical conditions associated with LOC339694.

LOC339711 (Accession XP_295038.1) is another GAM7776 target gene, herein designated TARGET GENE. LOC339711 BINDING SITE is a target binding site found in the 3' untranslated region of mRNA encoded by LOC339711, corresponding to a target binding site such as BINDING SITE I, BINDING SITE II or BINDING SITE III of FIG. 8. Table 4 illustrates the complementarity of the nucleotide sequences of LOC339711 BINDING SITE, designated SEQ ID:11528, to the nucleotide sequence of GAM7776 RNA, herein designated GAM RNA, also designated SEQ ID:246.

Another function of GAM7776 is therefore inhibition of LOC339711 (Accession XP_295038.1). Accordingly, utilities of GAM7776 include diagnosis, prevention and treatment of diseases and clinical conditions associated with LOC339711.

LOC339720 (Accession XP_295041.1) is another GAM7776 target gene, herein designated TARGET GENE. LOC339720 BINDING SITE is a target binding site found in the 5' untranslated region of mRNA encoded by LOC339720, corresponding to a target binding site such as BINDING SITE I, BINDING SITE II or BINDING SITE III of FIG. 8. Table 4 illustrates the complementarity of the nucleotide sequences of LOC339720 BINDING SITE, designated SEQ ID:16942, to the nucleotide sequence of GAM7776 RNA, herein designated GAM RNA, also designated SEQ ID:246.

Another function of GAM7776 is therefore inhibition of LOC339720 (Accession XP_295041.1). Accordingly, utilities of GAM7776 include diagnosis, prevention and treatment of diseases and clinical conditions associated with LOC339720.

LOC339803 (Accession XP_295072.1) is another GAM7776 target gene, herein designated TARGET GENE.

LOC339803 BINDING SITE is a target binding site found in the 3' untranslated region of mRNA encoded by LOC339803, corresponding to a target binding site such as BINDING SITE I, BINDING SITE II or BINDING SITE III of FIG. 8. Table 4 illustrates the complementarity of the nucleotide sequences of LOC339803 BINDING SITE, designated SEQ ID:13337, to the nucleotide sequence of GAM7776 RNA, herein designated GAM RNA, also designated SEQ ID:246.

Another function of GAM7776 is therefore inhibition of LOC339803 (Accession XP_295072.1). Accordingly, utilities of GAM7776 include diagnosis, prevention and treatment of diseases and clinical conditions associated with LOC339803.

LOC339808 (Accession XP_295071.1) is another GAM7776 target gene, herein designated TARGET GENE. LOC339808 BINDING SITE is a target binding site found in the 3' untranslated region of mRNA encoded by LOC339808, corresponding to a target binding site such as BINDING SITE I, BINDING SITE II or BINDING SITE III of FIG. 8. Table 4 illustrates the complementarity of the nucleotide sequences of LOC339808 BINDING SITE, designated SEQ ID:6146, to the nucleotide sequence of GAM7776 RNA, herein designated GAM RNA, also designated SEQ ID:246.

Another function of GAM7776 is therefore inhibition of LOC339808 (Accession XP_295071.1). Accordingly, utilities of GAM7776 include diagnosis, prevention and treatment of diseases and clinical conditions associated with LOC339808.

LOC339809 (Accession XP_291020.1) is another GAM7776 target gene, herein designated TARGET GENE. LOC339809 BINDING SITE1 and LOC339809 BINDING SITE2 are target binding sites found in untranslated regions of mRNA encoded by LOC339809, corresponding to target binding sites such as BINDING SITE I, BINDING SITE II or BINDING SITE III of FIG. 8. Table 4 illustrates the complementarity of the nucleotide sequences of LOC339809 BINDING SITE1 and LOC339809 BINDING SITE2, designated SEQ ID:1744 and SEQ ID:17750 respectively, to the nucleotide sequence of GAM7776 RNA, herein designated GAM RNA, also designated SEQ ID:246.

Another function of GAM7776 is therefore inhibition of LOC339809 (Accession XP_291020.1). Accordingly, utilities of GAM7776 include diagnosis, prevention and treatment of diseases and clinical conditions associated with LOC339809.

LOC339833 (Accession XP_291031.1) is another GAM7776 target gene, herein designated TARGET GENE. LOC339833 BINDING SITE1 and LOC339833 BINDING SITE2 are target binding sites found in untranslated regions of mRNA encoded by LOC339833, corresponding to target binding sites such as BINDING SITE I, BINDING SITE II or BINDING SITE III of FIG. 8. Table 4 illustrates the complementarity of the nucleotide sequences of LOC339833 BINDING SITE1 and LOC339833 BINDING SITE2, designated SEQ ID:7633 and SEQ ID:10421 respectively, to the nucleotide sequence of GAM7776 RNA, herein designated GAM RNA, also designated SEQ ID:246.

Another function of GAM7776 is therefore inhibition of LOC339833 (Accession XP_291031.1). Accordingly, utilities of GAM7776 include diagnosis, prevention and treatment of diseases and clinical conditions associated with LOC339833.

LOC339834 (Accession NP_835467.1) is another GAM7776 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:14645, to the nucleotide sequence of GAM7776 RNA, herein designated GAM RNA, also designated SEQ ID:246.

Another function of GAM7776 is therefore inhibition of LOC339834 (Accession NP_835467.1). Accordingly, utilities of GAM7776 include diagnosis, prevention and treatment of diseases and clinical conditions associated with LOC339834.

LOC339834 (Accession XP_291033.1) is another GAM7776 target gene, herein designated TARGET GENE. LOC339834 BINDING SITE is a target binding site found in the 5' untranslated region of multiple transcripts of mRNA encoded by LOC339834, corresponding to a target binding site such as BINDING SITE I, BINDING SITE II or BINDING SITE III of FIG. 8. Table 4 illustrates the complementarity of the nucleotide sequences of LOC339834 BINDING SITE, designated SEQ ID:14645, to the nucleotide sequence of GAM7776 RNA, herein designated GAM RNA, also designated SEQ ID:246.

Another function of GAM7776 is therefore inhibition of LOC339834 (Accession XP_291033.1). Accordingly, utilities of GAM7776 include diagnosis, prevention and treatment of diseases and clinical conditions associated with LOC339834.

LOC339872 (Accession XP_291050.1) is another GAM7776 target gene, herein designated TARGET GENE. LOC339872 BINDING SITE1 through LOC339872 BINDING SITE3 are target binding sites found in untranslated regions of mRNA encoded by LOC339872, corresponding to target binding sites such as BINDING SITE I, BINDING SITE II or BINDING SITE III of FIG. 8. Table 4 illustrates the complementarity of the nucleotide sequences of LOC339872 BINDING SITE1 through LOC339872 BINDING SITE3, designated SEQ ID:9299, SEQ ID:4026 and SEQ ID:5858 respectively, to the nucleotide sequence of GAM7776 RNA, herein designated GAM RNA, also designated SEQ ID:246.

Another function of GAM7776 is therefore inhibition of LOC339872 (Accession XP_291050.1). Accordingly, utilities of GAM7776 include diagnosis, prevention and treatment of diseases and clinical conditions associated with LOC339872.

LOC339894 (Accession XP_295095.1) is another GAM7776 target gene, herein designated TARGET GENE. LOC339894 BINDING SITE is a target binding site found in the 5' untranslated region of mRNA encoded by LOC339894, corresponding to a target binding site such as BINDING SITE I, BINDING SITE II or BINDING SITE III of FIG. 8. Table 4 illustrates the complementarity of the nucleotide sequences of LOC339894 BINDING SITE, designated SEQ ID:1081, to the nucleotide sequence of GAM7776 RNA, herein designated GAM RNA, also designated SEQ ID:246.

Another function of GAM7776 is therefore inhibition of LOC339894 (Accession XP_295095.1). Accordingly, utilities of GAM7776 include diagnosis, prevention and treatment of diseases and clinical conditions associated with LOC339894.

LOC339907 (Accession XP_291065.1) is another GAM7776 target gene, herein designated TARGET GENE. LOC339907 BINDING SITE is a target binding site found in the 3' untranslated region of mRNA encoded by LOC339907, corresponding to a target binding site such as BINDING SITE I, BINDING SITE II or BINDING SITE III of FIG. 8. Table 4 illustrates the complementarity of the nucleotide sequences of LOC339907 BINDING SITE, designated SEQ ID:3425, to the nucleotide sequence of GAM7776 RNA, herein designated GAM RNA, also designated SEQ ID:246.

Another function of GAM7776 is therefore inhibition of LOC339907 (Accession XP_291065.1). Accordingly, utilities of GAM7776 include diagnosis, prevention and treatment of diseases and clinical conditions associated with LOC339907.

LOC339909 (Accession XP_291069.1) is another GAM7776 target gene, herein designated TARGET GENE. LOC339909 BINDING SITE is a target binding site found in the 5' untranslated region of mRNA encoded by LOC339909, corresponding to a target binding site such as BINDING SITE I, BINDING SITE II or BINDING SITE III of FIG. 8. Table 4 illustrates the complementarity of the nucleotide sequences of LOC339909 BINDING SITE, designated SEQ ID:10709, to the nucleotide sequence of GAM7776 RNA, herein designated GAM RNA, also designated SEQ ID:246.

Another function of GAM7776 is therefore inhibition of LOC339909 (Accession XP_291069.1). Accordingly, utilities of GAM7776 include diagnosis, prevention and treatment of diseases and clinical conditions associated with LOC339909.

LOC339914 (Accession XP_295099.1) is another GAM7776 target gene, herein designated TARGET GENE. LOC339914 BINDING SITE is a target binding site found in the 5' untranslated region of mRNA encoded by LOC339914, corresponding to a target binding site such as BINDING SITE I, BINDING SITE II or BINDING SITE III of FIG. 8. Table 4 illustrates the complementarity of the nucleotide sequences of LOC339914 BINDING SITE, designated SEQ ID:714, to the nucleotide sequence of GAM7776 RNA, herein designated GAM RNA, also designated SEQ ID:246.

Another function of GAM7776 is therefore inhibition of LOC339914 (Accession XP_295099.1). Accordingly, utilities of GAM7776 include diagnosis, prevention and treatment of diseases and clinical conditions associated with LOC339914.

LOC339970 (Accession XP_291095.1) is another GAM7776 target gene, herein designated TARGET GENE. LOC339970 BINDING SITE is a target binding site found in the 3' untranslated region of mRNA encoded by LOC339970, corresponding to a target binding site such as BINDING SITE I, BINDING SITE II or BINDING SITE III of FIG. 8. Table 4 illustrates the complementarity of the nucleotide sequences of LOC339970 BINDING SITE, designated SEQ ID:16942, to the nucleotide sequence of GAM7776 RNA, herein designated GAM RNA, also designated SEQ ID:246.

Another function of GAM7776 is therefore inhibition of LOC339970 (Accession XP_291095.1). Accordingly, utilities of GAM7776 include diagnosis, prevention and treatment of diseases and clinical conditions associated with LOC339970.

LOC340037 (Accession XP_295137.1) is another GAM7776 target gene, herein designated TARGET GENE. LOC340037 BINDING SITE is a target binding site found in the 3' untranslated region of mRNA encoded by LOC340037, corresponding to a target binding site such as BINDING SITE I, BINDING SITE II or BINDING SITE III of FIG. 8. Table 4 illustrates the complementarity of the nucleotide sequences of LOC340037 BINDING SITE, designated SEQ ID:12244, to the nucleotide sequence of GAM7776 RNA, herein designated GAM RNA, also designated SEQ ID:246.

Another function of GAM7776 is therefore inhibition of LOC340037 (Accession XP_295137.1). Accordingly, utilities of GAM7776 include diagnosis, prevention and treatment of diseases and clinical conditions associated with LOC340037.

LOC340125 (Accession XP_291150.1) is another GAM7776 target gene, herein designated TARGET GENE. LOC340125 BINDING SITE is a target binding site found in the 5' untranslated region of mRNA encoded by LOC340125, corresponding to a target binding site such as BINDING SITE I, BINDING SITE II or BINDING SITE III of FIG. 8. Table 4 illustrates the complementarity of the nucleotide sequences of LOC340125 BINDING SITE, designated SEQ ID:12803, to the nucleotide sequence of GAM7776 RNA, herein designated GAM RNA, also designated SEQ ID:246.

Another function of GAM7776 is therefore inhibition of LOC340125 (Accession XP_291150.1). Accordingly, utilities of GAM7776 include diagnosis, prevention and treatment of diseases and clinical conditions associated with LOC340125.

LOC340138 (Accession XP_291153.1) is another GAM7776 target gene, herein designated TARGET GENE. LOC340138 BINDING SITE is a target binding site found in the 3' untranslated region of mRNA encoded by LOC340138, corresponding to a target binding site such as BINDING SITE I, BINDING SITE II or BINDING SITE III of FIG. 8. Table 4 illustrates the complementarity of the nucleotide sequences of LOC340138 BINDING SITE, designated SEQ ID:11753, to the nucleotide sequence of GAM7776 RNA, herein designated GAM RNA, also designated SEQ ID:246.

Another function of GAM7776 is therefore inhibition of LOC340138 (Accession XP_291153.1). Accordingly, utilities of GAM7776 include diagnosis, prevention and treatment of diseases and clinical conditions associated with LOC340138.

LOC340156 (Accession XP_291158.1) is another GAM7776 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:10096, to the nucleotide sequence of GAM7776 RNA, herein designated GAM RNA, also designated SEQ ID:246.

Another function of GAM7776 is therefore inhibition of LOC340156 (Accession XP_291158.1). Accordingly, utilities of GAM7776 include diagnosis, prevention and treatment of diseases and clinical conditions associated with LOC340156.

LOC340227 (Accession XP_291203.1) is another GAM7776 target gene, herein designated TARGET GENE. LOC340227 BINDING SITE is a target binding site found in the 5' untranslated region of mRNA encoded by LOC340227, corresponding to a target binding site such as BINDING SITE I, BINDING SITE II or BINDING SITE III of FIG. 8. Table 4 illustrates the complementarity of the nucleotide sequences of LOC340227 BINDING SITE, designated SEQ ID:12803, to the nucleotide sequence of GAM7776 RNA, herein designated GAM RNA, also designated SEQ ID:246.

Another function of GAM7776 is therefore inhibition of LOC340227 (Accession XP_291203.1). Accordingly, utilities of GAM7776 include diagnosis, prevention and treatment of diseases and clinical conditions associated with LOC340227.

LOC340238 (Accession XP_295188.1) is another GAM7776 target gene, herein designated TARGET GENE. LOC340238 BINDING SITE is a target binding site found in the 5' untranslated region of mRNA encoded by LOC340238, corresponding to a target binding site such as BINDING SITE I, BINDING SITE II or BINDING SITE III of FIG. 8. Table 4 illustrates the complementarity of the nucleotide sequences of LOC340238 BINDING SITE, designated SEQ ID:2179, to the nucleotide sequence of GAM7776 RNA, herein designated GAM RNA, also designated SEQ ID:246.

Another function of GAM7776 is therefore inhibition of LOC340238 (Accession XP_295188.1). Accordingly, utilities of GAM7776 include diagnosis, prevention and treatment of diseases and clinical conditions associated with LOC340238.

LOC340259 (Accession XP_295190.1) is another GAM7776 target gene, herein designated TARGET GENE. LOC340259 BINDING SITE is a target binding site found in the 5' untranslated region of mRNA encoded by LOC340259, corresponding to a target binding site such as BINDING SITE I, BINDING SITE II or BINDING SITE III of FIG. 8. Table 4 illustrates the complementarity of the nucleotide sequences of LOC340259 BINDING SITE, designated SEQ ID:18147, to the nucleotide sequence of GAM7776 RNA, herein designated GAM RNA, also designated SEQ ID:246.

Another function of GAM7776 is therefore inhibition of LOC340259 (Accession XP_295190.1). Accordingly, utilities of GAM7776 include diagnosis, prevention and treatment of diseases and clinical conditions associated with LOC340259.

LOC340290 (Accession XP_291214.1) is another GAM7776 target gene, herein designated TARGET GENE. LOC340290 BINDING SITE is a target binding site found in the 5' untranslated region of mRNA encoded by LOC340290, corresponding to a target binding site such as BINDING SITE I, BINDING SITE II or BINDING SITE III of FIG. 8. Table 4 illustrates the complementarity of the nucleotide sequences of LOC340290 BINDING SITE, designated SEQ ID:15740, to the nucleotide sequence of GAM7776 RNA, herein designated GAM RNA, also designated SEQ ID:246.

Another function of GAM7776 is therefore inhibition of LOC340290 (Accession XP_291214.1). Accordingly, utilities of GAM7776 include diagnosis, prevention and treatment of diseases and clinical conditions associated with LOC340290.

LOC340390 (Accession XP_291269.1) is another GAM7776 target gene, herein designated TARGET GENE. LOC340390 BINDING SITE is a target binding site found in the 3' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:18868, to the nucleotide sequence of GAM7776 RNA, herein designated GAM RNA, also designated SEQ ID:246.

Another function of GAM7776 is therefore inhibition of LOC340390 (Accession XP_291269.1). Accordingly, utilities of GAM7776 include diagnosis, prevention and treatment of diseases and clinical conditions associated with LOC340390.

LOC340408 (Accession XP_291274.1) is another GAM7776 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:1309, to the nucleotide sequence of GAM7776 RNA, herein designated GAM RNA, also designated SEQ ID:246.

Another function of GAM7776 is therefore inhibition of LOC340408 (Accession XP_291274.1). Accordingly, utilities of GAM7776 include diagnosis, prevention and treatment of diseases and clinical conditions associated with LOC340408.

LOC340414 (Accession XP_295240.1) is another GAM7776 target gene, herein designated TARGET GENE. LOC340414 BINDING SITE is a target binding site found in the 3' untranslated region of mRNA encoded by LOC340414, corresponding to a target binding site such as BINDING SITE I, BINDING SITE II or BINDING SITE III of FIG. 8. Table 4 illustrates the complementarity of the nucleotide sequences of LOC340414 BINDING SITE, designated SEQ ID:1744, to the nucleotide sequence of GAM7776 RNA, herein designated GAM RNA, also designated SEQ ID:246.

Another function of GAM7776 is therefore inhibition of LOC340414 (Accession XP_295240.1). Accordingly, utilities of GAM7776 include diagnosis, prevention and treatment of diseases and clinical conditions associated with LOC340414.

LOC340450 (Accession XP_295252.1) is another GAM7776 target gene, herein designated TARGET GENE. LOC340450 BINDING SITE is a target binding site found in the 5' untranslated region of mRNA encoded by LOC340450, corresponding to a target binding site such as BINDING SITE I, BINDING SITE II or BINDING SITE III of FIG. 8. Table 4 illustrates the complementarity of the nucleotide sequences of LOC340450 BINDING SITE, designated SEQ ID:1744, to the nucleotide sequence of GAM7776 RNA, herein designated GAM RNA, also designated SEQ ID:246.

Another function of GAM7776 is therefore inhibition of LOC340450 (Accession XP_295252.1). Accordingly, utilities of GAM7776 include diagnosis, prevention and treatment of diseases and clinical conditions associated with LOC340450.

LOC340528 (Accession XP_295268.1) is another GAM7776 target gene, herein designated TARGET GENE. LOC340528 BINDING SITE is a target binding site found in the 5' untranslated region of mRNA encoded by LOC340528, corresponding to a target binding site such as BINDING SITE I, BINDING SITE II or BINDING SITE III of FIG. 8. Table 4 illustrates the complementarity of the nucleotide sequences of LOC340528 BINDING SITE, designated SEQ ID:13053, to the nucleotide sequence of GAM7776 RNA, herein designated GAM RNA, also designated SEQ ID:246.

Another function of GAM7776 is therefore inhibition of LOC340528 (Accession XP_295268.1). Accordingly, utilities of GAM7776 include diagnosis, prevention and treatment of diseases and clinical conditions associated with LOC340528.

LOC342926 (Accession XP_292790.2) is another GAM7776 target gene, herein designated TARGET GENE. LOC342926 BINDING SITE is a target binding site found in the 3' untranslated region of mRNA encoded by LOC342926, corresponding to a target binding site such as BINDING SITE I, BINDING SITE II or BINDING SITE III of FIG. 8. Table 4 illustrates the complementarity of the nucleotide sequences of LOC342926 BINDING SITE, designated SEQ ID:13464, to the nucleotide sequence of GAM7776 RNA, herein designated GAM RNA, also designated SEQ ID:246.

Another function of GAM7776 is therefore inhibition of LOC342926 (Accession XP_292790.2). Accordingly, utilities of GAM7776 include diagnosis, prevention and treatment of diseases and clinical conditions associated with LOC342926.

LOC343435 (Accession XP_295563.1) is another GAM7776 target gene, herein designated TARGET GENE. LOC343435 BINDING SITE is a target binding site found in the 5' untranslated region of mRNA encoded by LOC343435, corresponding to a target binding site such as BINDING SITE I, BINDING SITE II or BINDING SITE III of FIG. 8. Table 4 illustrates the complementarity of the nucleotide sequences of LOC343435 BINDING SITE, designated SEQ ID:439, to the nucleotide sequence of GAM7776 RNA, herein designated GAM RNA, also designated SEQ ID:246.

Another function of GAM7776 is therefore inhibition of LOC343435 (Accession XP_295563.1). Accordingly, utilities of GAM7776 include diagnosis, prevention and treatment of diseases and clinical conditions associated with LOC343435.

LOC345275 (Accession NP_835236.1) is another GAM7776 target gene, herein designated TARGET GENE. LOC345275 BINDING SITE is a target binding site found in the 3' untranslated region of multiple transcripts of mRNA encoded by LOC345275, corresponding to a target binding site such as BINDING SITE I, BINDING SITE II or BINDING SITE III of FIG. 8. Table 4 illustrates the complementarity of the nucleotide sequences of LOC345275 BINDING SITE, designated SEQ ID:523, to the nucleotide sequence of GAM7776 RNA, herein designated GAM RNA, also designated SEQ ID:246.

Another function of GAM7776 is therefore inhibition of LOC345275 (Accession NP_835236.1). Accordingly, utilities of GAM7776 include diagnosis, prevention and treatment of diseases and clinical conditions associated with LOC345275.

LOC345878 (Accession XP_293993.2) is another GAM7776 target gene, herein designated TARGET GENE. LOC345878 BINDING SITE is a target binding site found in the 5' untranslated region of mRNA encoded by LOC345878, corresponding to a target binding site such as BINDING SITE I, BINDING SITE II or BINDING SITE III of FIG. 8. Table 4 illustrates the complementarity of the nucleotide sequences of LOC345878 BINDING SITE, designated SEQ ID:12611, to the nucleotide sequence of GAM7776 RNA, herein designated GAM RNA, also designated SEQ ID:246.

Another function of GAM7776 is therefore inhibition of LOC345878 (Accession XP_293993.2). Accordingly, utilities of GAM7776 include diagnosis, prevention and treatment of diseases and clinical conditions associated with LOC345878.

LOC346653 (Accession XP_294357.2) is another GAM7776 target gene, herein designated TARGET GENE. LOC346653 BINDING SITE is a target binding site found in the 3' untranslated region of mRNA encoded by LOC346653, corresponding to a target binding site such as BINDING SITE I, BINDING SITE II or BINDING SITE III of FIG. 8. Table 4 illustrates the complementarity of the nucleotide sequences of LOC346653 BINDING SITE, designated SEQ ID:17927, to the nucleotide sequence of GAM7776 RNA, herein designated GAM RNA, also designated SEQ ID:246.

Another function of GAM7776 is therefore inhibition of LOC346653 (Accession XP_294357.2). Accordingly, utilities of GAM7776 include diagnosis, prevention and treatment of diseases and clinical conditions associated with LOC346653.

LOC347648 (Accession XP_300226.1) is another GAM7776 target gene, herein designated TARGET GENE. LOC347648 BINDING SITE is a target binding site found in the 3' untranslated region of mRNA encoded by LOC347648, corresponding to a target binding site such as BINDING SITE I, BINDING SITE II or BINDING SITE III of FIG. 8. Table 4 illustrates the complementarity of the nucleotide sequences of LOC347648 BINDING SITE, designated SEQ ID:9837, to the nucleotide sequence of GAM7776 RNA, herein designated GAM RNA, also designated SEQ ID:246.

Another function of GAM7776 is therefore inhibition of LOC347648 (Accession XP_300226.1). Accordingly, utilities of GAM7776 include diagnosis, prevention and treatment of diseases and clinical conditions associated with LOC347648.

LOC347764 (Accession XP_300530.1) is another GAM7776 target gene, herein designated TARGET GENE. LOC347764 BINDING SITE is a target binding site found in the 5' untranslated region of mRNA encoded by LOC347764, corresponding to a target binding site such as BINDING SITE I, BINDING SITE II or BINDING SITE III of FIG. 8. Table 4 illustrates the complementarity of the nucleotide sequences of LOC347764 BINDING SITE, designated SEQ ID:11420, to the nucleotide sequence of GAM7776 RNA, herein designated GAM RNA, also designated SEQ ID:246.

Another function of GAM7776 is therefore inhibition of LOC347764 (Accession XP_300530.1). Accordingly, utilities of GAM7776 include diagnosis, prevention and treatment of diseases and clinical conditions associated with LOC347764.

LOC347905 (Accession XP_302624.1) is another GAM7776 target gene, herein designated TARGET GENE. LOC347905 BINDING SITE is a target binding site found in the 5' untranslated region of mRNA encoded by LOC347905, corresponding to a target binding site such as BINDING SITE I, BINDING SITE II or BINDING SITE III of FIG. 8. Table 4 illustrates the complementarity of the nucleotide sequences of LOC347905 BINDING SITE, designated SEQ ID:9505, to the nucleotide sequence of GAM7776 RNA, herein designated GAM RNA, also designated SEQ ID:246.

Another function of GAM7776 is therefore inhibition of LOC347905 (Accession XP_302624.1). Accordingly, utilities of GAM7776 include diagnosis, prevention and treatment of diseases and clinical conditions associated with LOC347905.

LOC347918 (Accession XP_300565.1) is another GAM7776 target gene, herein designated TARGET GENE. LOC347918 BINDING SITE is a target binding site found in the 5' untranslated region of mRNA encoded by LOC347918, corresponding to a target binding site such as BINDING SITE I, BINDING SITE II or BINDING SITE III of FIG. 8. Table 4 illustrates the complementarity of the nucleotide sequences of LOC347918 BINDING SITE, designated SEQ ID:17689, to the nucleotide sequence of GAM7776 RNA, herein designated GAM RNA, also designated SEQ ID:246.

Another function of GAM7776 is therefore inhibition of LOC347918 (Accession XP_300565.1). Accordingly, utilities of GAM7776 include diagnosis, prevention and treatment of diseases and clinical conditions associated with LOC347918.

LOC348075 (Accession XP_302653.1) is another GAM7776 target gene, herein designated TARGET GENE. LOC348075 BINDING SITE1 and LOC348075 BINDING SITE2 are target binding sites found in untranslated regions of mRNA encoded by LOC348075, corresponding to target binding sites such as BINDING SITE I, BINDING SITE II or BINDING SITE III of FIG. 8. Table 4 illustrates the complementarity of the nucleotide sequences of LOC348075 BINDING SITE1 and LOC348075 BINDING SITE2, designated SEQ ID:13716 and SEQ ID:14381 respectively, to the nucleotide sequence of GAM7776 RNA, herein designated GAM RNA, also designated SEQ ID:246.

Another function of GAM7776 is therefore inhibition of LOC348075 (Accession XP_302653.1). Accordingly, utilities of GAM7776 include diagnosis, prevention and treatment of diseases and clinical conditions associated with LOC348075.

LOC348094 (Accession XP_300615.1) is another GAM7776 target gene, herein designated TARGET GENE. LOC348094 BINDING SITE1 and LOC348094 BINDING SITE2 are target binding sites found in untranslated regions of mRNA encoded by LOC348094, corresponding to target binding sites such as BINDING SITE I, BINDING SITE II or BINDING SITE III of FIG. 8. Table 4 illustrates the complementarity of the nucleotide sequences of LOC348094 BINDING SITE1 and LOC348094 BINDING SITE2, designated SEQ ID:13332 and SEQ ID:16473 respectively, to the nucleotide sequence of GAM7776 RNA, herein designated GAM RNA, also designated SEQ ID:246.

Another function of GAM7776 is therefore inhibition of LOC348094 (Accession XP_300615.1). Accordingly, utilities of GAM7776 include diagnosis, prevention and treatment of diseases and clinical conditions associated with LOC348094.

LOC348113 (Accession XP_300623.1) is another GAM7776 target gene, herein designated TARGET GENE. LOC348113 BINDING SITE is a target binding site found in the 3' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:12479, to the nucleotide sequence of GAM7776 RNA, herein designated GAM RNA, also designated SEQ ID:246.

Another function of GAM7776 is therefore inhibition of LOC348113 (Accession XP_300623.1). Accordingly, utilities of GAM7776 include diagnosis, prevention and treatment of diseases and clinical conditions associated with LOC348113.

LOC348115 (Accession XP_300626.1) is another GAM7776 target gene, herein designated TARGET GENE. LOC348115 BINDING SITE is a target binding site found in the 5' untranslated region of mRNA encoded by LOC348115, corresponding to a target binding site such as BINDING SITE I, BINDING SITE II or BINDING SITE III of FIG. 8. Table 4 illustrates the complementarity of the nucleotide sequences of LOC348115 BINDING SITE, designated SEQ ID:13705, to the nucleotide sequence of GAM7776 RNA, herein designated GAM RNA, also designated SEQ ID:246.

Another function of GAM7776 is therefore inhibition of LOC348115 (Accession XP_300626.1). Accordingly, utilities of GAM7776 include diagnosis, prevention and treatment of diseases and clinical conditions associated with LOC348115.

LOC348137 (Accession XP_300635.1) is another GAM7776 target gene, herein designated TARGET GENE. LOC348137 BINDING SITE is a target binding site found in the 3' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:12479, to the nucleotide sequence of GAM7776 RNA, herein designated GAM RNA, also designated SEQ ID:246.

Another function of GAM7776 is therefore inhibition of LOC348137 (Accession XP_300635.1). Accordingly, utilities of GAM7776 include diagnosis, prevention and treatment of diseases and clinical conditions associated with LOC348137.

LOC348142 (Accession XP_300636.1) is another GAM7776 target gene, herein designated TARGET GENE. LOC348142 BINDING SITE is a target binding site found in the 3' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:12479, to the nucleotide sequence of GAM7776 RNA, herein designated GAM RNA, also designated SEQ ID:246.

Another function of GAM7776 is therefore inhibition of LOC348142 (Accession XP_300636.1). Accordingly, utilities of GAM7776 include diagnosis, prevention and treatment of diseases and clinical conditions associated with LOC348142.

LOC348235 (Accession XP_300670.1) is another GAM7776 target gene, herein designated TARGET GENE. LOC348235 BINDING SITE is a target binding site found in the 3' untranslated region of mRNA encoded by LOC348235, corresponding to a target binding site such as BINDING SITE I, BINDING SITE II or BINDING SITE III of FIG. 8. Table 4 illustrates the complementarity of the nucleotide sequences of LOC348235 BINDING SITE, designated SEQ ID:15852, to the nucleotide sequence of GAM7776 RNA, herein designated GAM RNA, also designated SEQ ID:246.

Another function of GAM7776 is therefore inhibition of LOC348235 (Accession XP_300670.1). Accordingly, utilities of GAM7776 include diagnosis, prevention and treatment of diseases and clinical conditions associated with LOC348235.

LOC348262 (Accession XP_300683.1) is another GAM7776 target gene, herein designated TARGET GENE. LOC348262 BINDING SITE is a target binding site found in the 5' untranslated region of mRNA encoded by LOC348262, corresponding to a target binding site such as BINDING SITE I, BINDING SITE II or BINDING SITE III of FIG. 8. Table 4 illustrates the complementarity of the nucleotide sequences of LOC348262 BINDING SITE, designated SEQ ID:7306, to the nucleotide sequence of GAM7776 RNA, herein designated GAM RNA, also designated SEQ ID:246.

Another function of GAM7776 is therefore inhibition of LOC348262 (Accession XP_300683.1). Accordingly, utilities of GAM7776 include diagnosis, prevention and treatment of diseases and clinical conditions associated with LOC348262.

LOC348314 (Accession XP_302716.1) is another GAM7776 target gene, herein designated TARGET GENE. LOC348314 BINDING SITE is a target binding site found in the 5' untranslated region of mRNA encoded by LOC348314, corresponding to a target binding site such as BINDING SITE I, BINDING SITE II or BINDING SITE III of FIG. 8. Table 4 illustrates the complementarity of the nucleotide sequences of LOC348314 BINDING SITE, designated SEQ ID:16669, to the nucleotide sequence of GAM7776 RNA, herein designated GAM RNA, also designated SEQ ID:246.

Another function of GAM7776 is therefore inhibition of LOC348314 (Accession XP_302716.1). Accordingly, utilities of GAM7776 include diagnosis, prevention and treatment of diseases and clinical conditions associated with LOC348314.

LOC348326 (Accession XP_300696.1) is another GAM7776 target gene, herein designated TARGET GENE. LOC348326 BINDING SITE is a target binding site found in the 3' untranslated region of mRNA encoded by LOC348326, corresponding to a target binding site such as BINDING SITE I, BINDING SITE II or BINDING SITE III of FIG. 8. Table 4 illustrates the complementarity of the nucleotide sequences of LOC348326 BINDING SITE, designated SEQ ID:19778, to the nucleotide sequence of GAM7776 RNA, herein designated GAM RNA, also designated SEQ ID:246.

Another function of GAM7776 is therefore inhibition of LOC348326 (Accession XP_300696.1). Accordingly, utilities of GAM7776 include diagnosis, prevention and treatment of diseases and clinical conditions associated with LOC348326.

LOC348327 (Accession XP_030209.2) is another GAM7776 target gene, herein designated TARGET GENE. LOC348327 BINDING SITE is a target binding site found in the 3' untranslated region of mRNA encoded by LOC348327, corresponding to a target binding site such as BINDING SITE I, BINDING SITE II or BINDING SITE III of FIG. 8. Table 4 illustrates the complementarity of the nucleotide sequences of LOC348327 BINDING SITE, designated SEQ ID:8820, to the nucleotide sequence of GAM7776 RNA, herein designated GAM RNA, also designated SEQ ID:246.

Another function of GAM7776 is therefore inhibition of LOC348327 (Accession XP_030209.2). Accordingly, utilities of GAM7776 include diagnosis, prevention and treatment of diseases and clinical conditions associated with LOC348327.

LOC348393 (Accession XP_302741.1) is another GAM7776 target gene, herein designated TARGET GENE. LOC348393 BINDING SITE1 and LOC348393 BINDING SITE2 are target binding sites found in untranslated regions of mRNA encoded by LOC348393, corresponding to target binding sites such as BINDING SITE I, BINDING SITE II or BINDING SITE III of FIG. 8. Table 4 illustrates the complementarity of the nucleotide sequences of LOC348393 BINDING SITE1 and LOC348393 BINDING SITE2, designated SEQ ID:872 and SEQ ID:11192 respectively, to the nucleotide sequence of GAM7776 RNA, herein designated GAM RNA, also designated SEQ ID:246.

Another function of GAM7776 is therefore inhibition of LOC348393 (Accession XP_302741.1). Accordingly, utilities of GAM7776 include diagnosis, prevention and treatment of diseases and clinical conditions associated with LOC348393.

LOC348396 (Accession XP_300729.1) is another GAM7776 target gene, herein designated TARGET GENE. LOC348396 BINDING SITE1 through LOC348396 BINDING SITE3 are target binding sites found in untranslated regions of mRNA encoded by LOC348396, corresponding to target binding sites such as BINDING SITE I, BINDING SITE II or BINDING SITE III of FIG. 8. Table 4 illustrates the complementarity of the nucleotide sequences of LOC348396 BINDING SITE1 through LOC348396 BINDING SITE3, designated SEQ ID:10270, SEQ ID:1569 and SEQ ID:9545 respectively, to the nucleotide sequence of GAM7776 RNA, herein designated GAM RNA, also designated SEQ ID:246.

Another function of GAM7776 is therefore inhibition of LOC348396 (Accession XP_300729.1). Accordingly, utilities of GAM7776 include diagnosis, prevention and treatment of diseases and clinical conditions associated with LOC348396.

LOC348402 (Accession XP_300730.1) is another GAM7776 target gene, herein designated TARGET GENE. LOC348402 BINDING SITE1 through LOC348402 BINDING SITE3 are target binding sites found in untranslated regions of mRNA encoded by LOC348402, corresponding to target binding sites such as BINDING SITE I, BINDING SITE II or BINDING SITE III of FIG. 8. Table 4 illustrates the complementarity of the nucleotide sequences of LOC348402 BINDING SITE1 through LOC348402 BINDING SITE3, designated SEQ ID:695, SEQ ID:7386 and SEQ ID:8590 respectively, to the nucleotide sequence of GAM7776 RNA, herein designated GAM RNA, also designated SEQ ID:246.

Another function of GAM7776 is therefore inhibition of LOC348402 (Accession XP_300730.1). Accordingly, utilities of GAM7776 include diagnosis, prevention and treatment of diseases and clinical conditions associated with LOC348402.

LOC348445 (Accession XP_300738.1) is another GAM7776 target gene, herein designated TARGET GENE. LOC348445 BINDING SITE is a target binding site found in the 3' untranslated region of mRNA encoded by LOC348445, corresponding to a target binding site such as BINDING SITE I, BINDING SITE II or BINDING SITE III of FIG. 8. Table 4 illustrates the complementarity of the nucleotide sequences of LOC348445 BINDING SITE, designated SEQ ID:19778, to the nucleotide sequence of GAM7776 RNA, herein designated GAM RNA, also designated SEQ ID:246.

Another function of GAM7776 is therefore inhibition of LOC348445 (Accession XP_300738.1). Accordingly, utilities of GAM7776 include diagnosis, prevention and treatment of diseases and clinical conditions associated with LOC348445.

LOC348455 (Accession XP_302760.1) is another GAM7776 target gene, herein designated TARGET GENE. LOC348455 BINDING SITE is a target binding site found in the 3' untranslated region of mRNA encoded by LOC348455, corresponding to a target binding site such as BINDING SITE I, BINDING SITE II or BINDING SITE III of FIG. 8. Table 4 illustrates the complementarity of the nucleotide sequences of LOC348455 BINDING SITE, designated SEQ ID:15049, to the nucleotide sequence of GAM7776 RNA, herein designated GAM RNA, also designated SEQ ID:246.

Another function of GAM7776 is therefore inhibition of LOC348455 (Accession XP_302760.1). Accordingly, utilities of GAM7776 include diagnosis, prevention and treatment of diseases and clinical conditions associated with LOC348455.

LOC348460 (Accession XP_300743.1) is another GAM7776 target gene, herein designated TARGET GENE. LOC348460 BINDING SITE1 and LOC348460 BINDING SITE2 are target binding sites found in untranslated regions of mRNA encoded by LOC348460, corresponding to target binding sites such as BINDING SITE I, BINDING SITE II or BINDING SITE III of FIG. 8. Table 4 illustrates the complementarity of the nucleotide sequences of LOC348460 BINDING SITE1 and LOC348460 BINDING SITE2, designated SEQ ID:4143 and SEQ ID:13465 respectively, to the nucleotide sequence of GAM7776 RNA, herein designated GAM RNA, also designated SEQ ID:246.

Another function of GAM7776 is therefore inhibition of LOC348460 (Accession XP_300743.1). Accordingly, utilities of GAM7776 include diagnosis, prevention and treatment of diseases and clinical conditions associated with LOC348460.

LOC348474 (Accession XP_209299.2) is another GAM7776 target gene, herein designated TARGET GENE. LOC348474 BINDING SITE is a target binding site found in the 3' untranslated region of mRNA encoded by LOC348474, corresponding to a target binding site such as BINDING SITE I, BINDING SITE II or BINDING SITE III of FIG. 8. Table 4 illustrates the complementarity of the nucleotide sequences of LOC348474 BINDING SITE, designated SEQ ID:17206, to the nucleotide sequence of GAM7776 RNA, herein designated GAM RNA, also designated SEQ ID:246.

Another function of GAM7776 is therefore inhibition of LOC348474 (Accession XP_209299.2). Accordingly, utilities of GAM7776 include diagnosis, prevention and treatment of diseases and clinical conditions associated with LOC348474.

LOC348494 (Accession XP_302789.1) is another GAM7776 target gene, herein designated TARGET GENE.

LOC348494 BINDING SITE is a target binding site found in the 5' untranslated region of mRNA encoded by LOC348494, corresponding to a target binding site such as BINDING SITE I, BINDING SITE II or BINDING SITE III of FIG. 8. Table 4 illustrates the complementarity of the nucleotide sequences of LOC348494 BINDING SITE, designated SEQ ID:6119, to the nucleotide sequence of GAM7776 RNA, herein designated GAM RNA, also designated SEQ ID:246.

Another function of GAM7776 is therefore inhibition of LOC348494 (Accession XP_302789.1). Accordingly, utilities of GAM7776 include diagnosis, prevention and treatment of diseases and clinical conditions associated with LOC348494.

LOC348503 (Accession XP_300762.1) is another GAM7776 target gene, herein designated TARGET GENE. LOC348503 BINDING SITE is a target binding site found in the 3' untranslated region of mRNA encoded by LOC348503, corresponding to a target binding site such as BINDING SITE I, BINDING SITE II or BINDING SITE III of FIG. 8. Table 4 illustrates the complementarity of the nucleotide sequences of LOC348503 BINDING SITE, designated SEQ ID:19361, to the nucleotide sequence of GAM7776 RNA, herein designated GAM RNA, also designated SEQ ID:246.

Another function of GAM7776 is therefore inhibition of LOC348503 (Accession XP_300762.1). Accordingly, utilities of GAM7776 include diagnosis, prevention and treatment of diseases and clinical conditions associated with LOC348503.

LOC348508 (Accession XP_302806.1) is another GAM7776 target gene, herein designated TARGET GENE. LOC348508 BINDING SITE is a target binding site found in the 5' untranslated region of mRNA encoded by LOC348508, corresponding to a target binding site such as BINDING SITE I, BINDING SITE II or BINDING SITE III of FIG. 8. Table 4 illustrates the complementarity of the nucleotide sequences of LOC348508 BINDING SITE, designated SEQ ID:12803, to the nucleotide sequence of GAM7776 RNA, herein designated GAM RNA, also designated SEQ ID:246.

Another function of GAM7776 is therefore inhibition of LOC348508 (Accession XP_302806.1). Accordingly, utilities of GAM7776 include diagnosis, prevention and treatment of diseases and clinical conditions associated with LOC348508.

LOC348525 (Accession XP_300778.1) is another GAM7776 target gene, herein designated TARGET GENE. LOC348525 BINDING SITE is a target binding site found in the 3' untranslated region of mRNA encoded by LOC348525, corresponding to a target binding site such as BINDING SITE I, BINDING SITE II or BINDING SITE III of FIG. 8. Table 4 illustrates the complementarity of the nucleotide sequences of LOC348525 BINDING SITE, designated SEQ ID:5488, to the nucleotide sequence of GAM7776 RNA, herein designated GAM RNA, also designated SEQ ID:246.

Another function of GAM7776 is therefore inhibition of LOC348525 (Accession XP_300778.1). Accordingly, utilities of GAM7776 include diagnosis, prevention and treatment of diseases and clinical conditions associated with LOC348525.

LOC348532 (Accession XP_302818.1) is another GAM7776 target gene, herein designated TARGET GENE. LOC348532 BINDING SITE1 and LOC348532 BINDING SITE2 are target binding sites found in untranslated regions of mRNA encoded by LOC348532, corresponding to target binding sites such as BINDING SITE I, BINDING SITE II or BINDING SITE III of FIG. 8. Table 4 illustrates the complementarity of the nucleotide sequences of LOC348532 BINDING SITE1 and LOC348532 BINDING SITE2, designated SEQ ID:11192 and SEQ ID:872 respectively, to the nucleotide sequence of GAM7776 RNA, herein designated GAM RNA, also designated SEQ ID:246.

Another function of GAM7776 is therefore inhibition of LOC348532 (Accession XP_302818.1). Accordingly, utilities of GAM7776 include diagnosis, prevention and treatment of diseases and clinical conditions associated with LOC348532.

LOC348583 (Accession XP_302833.1) is another GAM7776 target gene, herein designated TARGET GENE. LOC348583 BINDING SITE is a target binding site found in the 3' untranslated region of mRNA encoded by LOC348583, corresponding to a target binding site such as BINDING SITE I, BINDING SITE II or BINDING SITE III of FIG. 8. Table 4 illustrates the complementarity of the nucleotide sequences of LOC348583 BINDING SITE, designated SEQ ID:8544, to the nucleotide sequence of GAM7776 RNA, herein designated GAM RNA, also designated SEQ ID:246.

Another function of GAM7776 is therefore inhibition of LOC348583 (Accession XP_302833.1). Accordingly, utilities of GAM7776 include diagnosis, prevention and treatment of diseases and clinical conditions associated with LOC348583.

LOC348594 (Accession XP_302834.1) is another GAM7776 target gene, herein designated TARGET GENE. LOC348594 BINDING SITE is a target binding site found in the 5' untranslated region of mRNA encoded by LOC348594, corresponding to a target binding site such as BINDING SITE I, BINDING SITE II or BINDING SITE III of FIG. 8. Table 4 illustrates the complementarity of the nucleotide sequences of LOC348594 BINDING SITE, designated SEQ ID:16785, to the nucleotide sequence of GAM7776 RNA, herein designated GAM RNA, also designated SEQ ID:246.

Another function of GAM7776 is therefore inhibition of LOC348594 (Accession XP_302834.1). Accordingly, utilities of GAM7776 include diagnosis, prevention and treatment of diseases and clinical conditions associated with LOC348594.

LOC348595 (Accession XP_302837.1) is another GAM7776 target gene, herein designated TARGET GENE. LOC348595 BINDING SITE is a target binding site found in the 3' untranslated region of mRNA encoded by LOC348595, corresponding to a target binding site such as BINDING SITE I, BINDING SITE II or BINDING SITE III of FIG. 8. Table 4 illustrates the complementarity of the nucleotide sequences of LOC348595 BINDING SITE, designated SEQ ID:16785, to the nucleotide sequence of GAM7776 RNA, herein designated GAM RNA, also designated SEQ ID:246.

Another function of GAM7776 is therefore inhibition of LOC348595 (Accession XP_302837.1). Accordingly, utilities of GAM7776 include diagnosis, prevention and treatment of diseases and clinical conditions associated with LOC348595.

LOC348603 (Accession XP_302844.1) is another GAM7776 target gene, herein designated TARGET GENE. LOC348603 BINDING SITE is a target binding site found in the 5' untranslated region of mRNA encoded by LOC348603, corresponding to a target binding site such as BINDING SITE I, BINDING SITE II or BINDING SITE III of FIG. 8. Table 4 illustrates the complementarity of the nucleotide sequences of LOC348603 BINDING SITE, designated SEQ ID:16785, to the nucleotide sequence of GAM7776 RNA, herein designated GAM RNA, also designated SEQ ID:246.

Another function of GAM7776 is therefore inhibition of LOC348603 (Accession XP_302844.1). Accordingly, utilities of GAM7776 include diagnosis, prevention and treatment of diseases and clinical conditions associated with LOC348603.

LOC348605 (Accession XP_300793.1) is another GAM7776 target gene, herein designated TARGET GENE. LOC348605 BINDING SITE is a target binding site found in the 3' untranslated region of mRNA encoded by LOC348605, corresponding to a target binding site such as BINDING SITE I, BINDING SITE II or BINDING SITE III of FIG. 8. Table 4 illustrates the complementarity of the nucleotide sequences of LOC348605 BINDING SITE, designated SEQ ID:16785, to the nucleotide sequence of GAM7776 RNA, herein designated GAM RNA, also designated SEQ ID:246.

Another function of GAM7776 is therefore inhibition of LOC348605 (Accession XP_300793.1). Accordingly, utilities of GAM7776 include diagnosis, prevention and treatment of diseases and clinical conditions associated with LOC348605.

LOC348702 (Accession XP_300808.1) is another GAM7776 target gene, herein designated TARGET GENE. LOC348702 BINDING SITE is a target binding site found in the 5' untranslated region of mRNA encoded by LOC348702, corresponding to a target binding site such as BINDING SITE I, BINDING SITE II or BINDING SITE III of FIG. 8. Table 4 illustrates the complementarity of the nucleotide sequences of LOC348702 BINDING SITE, designated SEQ ID:7387, to the nucleotide sequence of GAM7776 RNA, herein designated GAM RNA, also designated SEQ ID:246.

Another function of GAM7776 is therefore inhibition of LOC348702 (Accession XP_300808.1). Accordingly, utilities of GAM7776 include diagnosis, prevention and treatment of diseases and clinical conditions associated with LOC348702.

LOC348790 (Accession XP_300843.1) is another GAM7776 target gene, herein designated TARGET GENE. LOC348790 BINDING SITE is a target binding site found in the 3' untranslated region of mRNA encoded by LOC348790, corresponding to a target binding site such as BINDING SITE I, BINDING SITE II or BINDING SITE III of FIG. 8. Table 4 illustrates the complementarity of the nucleotide sequences of LOC348790 BINDING SITE, designated SEQ ID:810, to the nucleotide sequence of GAM7776 RNA, herein designated GAM RNA, also designated SEQ ID:246.

Another function of GAM7776 is therefore inhibition of LOC348790 (Accession XP_300843.1). Accordingly, utilities of GAM7776 include diagnosis, prevention and treatment of diseases and clinical conditions associated with LOC348790.

LOC348797 (Accession XP_302888.1) is another GAM7776 target gene, herein designated TARGET GENE. LOC348797 BINDING SITE is a target binding site found in the 3' untranslated region of mRNA encoded by LOC348797, corresponding to a target binding site such as BINDING SITE I, BINDING SITE II or BINDING SITE III of FIG. 8. Table 4 illustrates the complementarity of the nucleotide sequences of LOC348797 BINDING SITE, designated SEQ ID:7741, to the nucleotide sequence of GAM7776 RNA, herein designated GAM RNA, also designated SEQ ID:246.

Another function of GAM7776 is therefore inhibition of LOC348797 (Accession XP_302888.1). Accordingly, utilities of GAM7776 include diagnosis, prevention and treatment of diseases and clinical conditions associated with LOC348797.

LOC348798 (Accession XP_300845.1) is another GAM7776 target gene, herein designated TARGET GENE. LOC348798 BINDING SITE is a target binding site found in the 5' untranslated region of mRNA encoded by LOC348798, corresponding to a target binding site such as BINDING SITE I, BINDING SITE II or BINDING SITE III of FIG. 8. Table 4 illustrates the complementarity of the nucleotide sequences of LOC348798 BINDING SITE, designated SEQ ID:19402, to the nucleotide sequence of GAM7776 RNA, herein designated GAM RNA, also designated SEQ ID:246.

Another function of GAM7776 is therefore inhibition of LOC348798 (Accession XP_300845.1). Accordingly, utilities of GAM7776 include diagnosis, prevention and treatment of diseases and clinical conditions associated with LOC348798.

LOC348825 (Accession XP_300853.1) is another GAM7776 target gene, herein designated TARGET GENE. LOC348825 BINDING SITE is a target binding site found in the 5' untranslated region of mRNA encoded by LOC348825, corresponding to a target binding site such as BINDING SITE I, BINDING SITE II or BINDING SITE III of FIG. 8. Table 4 illustrates the complementarity of the nucleotide sequences of LOC348825 BINDING SITE, designated SEQ ID:15126, to the nucleotide sequence of GAM7776 RNA, herein designated GAM RNA, also designated SEQ ID:246.

Another function of GAM7776 is therefore inhibition of LOC348825 (Accession XP_300853.1). Accordingly, utilities of GAM7776 include diagnosis, prevention and treatment of diseases and clinical conditions associated with LOC348825.

LOC348842 (Accession XP_300861.1) is another GAM7776 target gene, herein designated TARGET GENE. LOC348842 BINDING SITE is a target binding site found in the 5' untranslated region of mRNA encoded by LOC348842, corresponding to a target binding site such as BINDING SITE I, BINDING SITE II or BINDING SITE III of FIG. 8. Table 4 illustrates the complementarity of the nucleotide sequences of LOC348842 BINDING SITE, designated SEQ ID:12803, to the nucleotide sequence of GAM7776 RNA, herein designated GAM RNA, also designated SEQ ID:246.

Another function of GAM7776 is therefore inhibition of LOC348842 (Accession XP_300861.1). Accordingly, utilities of GAM7776 include diagnosis, prevention and treatment of diseases and clinical conditions associated with LOC348842.

LOC348947 (Accession XP_302929.1) is another GAM7776 target gene, herein designated TARGET GENE. LOC348947 BINDING SITE is a target binding site found in the 3' untranslated region of mRNA encoded by LOC348947, corresponding to a target binding site such as BINDING SITE I, BINDING SITE II or BINDING SITE III of FIG. 8. Table 4 illustrates the complementarity of the nucleotide sequences of LOC348947 BINDING SITE, designated SEQ ID:8605, to the nucleotide sequence of GAM7776 RNA, herein designated GAM RNA, also designated SEQ ID:246.

Another function of GAM7776 is therefore inhibition of LOC348947 (Accession XP_302929.1). Accordingly, utilities of GAM7776 include diagnosis, prevention and treatment of diseases and clinical conditions associated with LOC348947.

LOC348995 (Accession XP_300434.1) is another GAM7776 target gene, herein designated TARGET GENE. LOC348995 BINDING SITE is a target binding site found in the 3' untranslated region of mRNA encoded by LOC348995, corresponding to a target binding site such as BINDING SITE I, BINDING SITE II or BINDING SITE III of FIG. 8. Table 4 illustrates the complementarity of the nucleotide sequences of LOC348995 BINDING SITE, designated SEQ ID:1900, to the nucleotide sequence of GAM7776 RNA, herein designated GAM RNA, also designated SEQ ID:246.

Another function of GAM7776 is therefore inhibition of LOC348995 (Accession XP_300434.1). Accordingly, utilities of GAM7776 include diagnosis, prevention and treatment of diseases and clinical conditions associated with LOC348995.

LOC349024 (Accession XP_300250.1) is another GAM7776 target gene, herein designated TARGET GENE. LOC349024 BINDING SITE1 and LOC349024 BINDING SITE2 are target binding sites found in untranslated regions of mRNA encoded by LOC349024, corresponding to target binding sites such as BINDING SITE I, BINDING SITE II or BINDING SITE III of FIG. 8. Table 4 illustrates the complementarity of the nucleotide sequences of LOC349024 BINDING SITE1 and LOC349024 BINDING SITE2, designated SEQ ID:1746 and SEQ ID:4617 respectively, to the nucleotide sequence of GAM7776 RNA, herein designated GAM RNA, also designated SEQ ID:246.

Another function of GAM7776 is therefore inhibition of LOC349024 (Accession XP_300250.1). Accordingly, utilities of GAM7776 include diagnosis, prevention and treatment of diseases and clinical conditions associated with LOC349024.

LOC349075 (Accession XP_300932.1) is another GAM7776 target gene, herein designated TARGET GENE. LOC349075 BINDING SITE is a target binding site found in the 3' untranslated region of mRNA encoded by LOC349075, corresponding to a target binding site such as BINDING SITE I, BINDING SITE II or BINDING SITE III of FIG. 8. Table 4 illustrates the complementarity of the nucleotide sequences of LOC349075 BINDING SITE, designated SEQ ID:16022, to the nucleotide sequence of GAM7776 RNA, herein designated GAM RNA, also designated SEQ ID:246.

Another function of GAM7776 is therefore inhibition of LOC349075 (Accession XP_300932.1). Accordingly, utilities of GAM7776 include diagnosis, prevention and treatment of diseases and clinical conditions associated with LOC349075.

LOC349096 (Accession XP_300937.1) is another GAM7776 target gene, herein designated TARGET GENE. LOC349096 BINDING SITE is a target binding site found in the 3' untranslated region of mRNA encoded by LOC349096, corresponding to a target binding site such as BINDING SITE I, BINDING SITE II or BINDING SITE III of FIG. 8. Table 4 illustrates the complementarity of the nucleotide sequences of LOC349096 BINDING SITE, designated SEQ ID:6188, to the nucleotide sequence of GAM7776 RNA, herein designated GAM RNA, also designated SEQ ID:246.

Another function of GAM7776 is therefore inhibition of LOC349096 (Accession XP_300937.1). Accordingly, utilities of GAM7776 include diagnosis, prevention and treatment of diseases and clinical conditions associated with LOC349096.

LOC349114 (Accession XP_302960.1) is another GAM7776 target gene, herein designated TARGET GENE. LOC349114 BINDING SITE is a target binding site found in the 5' untranslated region of mRNA encoded by LOC349114, corresponding to a target binding site such as BINDING SITE I, BINDING SITE II or BINDING SITE III of FIG. 8. Table 4 illustrates the complementarity of the nucleotide sequences of LOC349114 BINDING SITE, designated SEQ ID:12803, to the nucleotide sequence of GAM7776 RNA, herein designated GAM RNA, also designated SEQ ID:246.

Another function of GAM7776 is therefore inhibition of LOC349114 (Accession XP_302960.1). Accordingly, utilities of GAM7776 include diagnosis, prevention and treatment of diseases and clinical conditions associated with LOC349114.

LOC349170 (Accession XP_300969.1) is another GAM7776 target gene, herein designated TARGET GENE. LOC349170 BINDING SITE1 through LOC349170 BINDING SITE5 are target binding sites found in untranslated regions of mRNA encoded by LOC349170, corresponding to target binding sites such as BINDING SITE I, BINDING SITE II or BINDING SITE III of FIG. 8. Table 4 illustrates the complementarity of the nucleotide sequences of LOC349170 BINDING SITE1 through LOC349170 BINDING SITE5, designated SEQ ID:18074, SEQ ID:958, SEQ ID:3349, SEQ ID:11508 and SEQ ID:9545 respectively, to the nucleotide sequence of GAM7776 RNA, herein designated GAM RNA, also designated SEQ ID:246.

Another function of GAM7776 is therefore inhibition of LOC349170 (Accession XP_300969.1). Accordingly, utilities of GAM7776 include diagnosis, prevention and treatment of diseases and clinical conditions associated with LOC349170.

LOC349251 (Accession XP_300251.1) is another GAM7776 target gene, herein designated TARGET GENE. LOC349251 BINDING SITE1 and LOC349251 BINDING SITE2 are target binding sites found in untranslated regions of mRNA encoded by LOC349251, corresponding to target binding sites such as BINDING SITE I, BINDING SITE II or BINDING SITE III of FIG. 8. Table 4 illustrates the complementarity of the nucleotide sequences of LOC349251 BINDING SITE1 and LOC349251 BINDING SITE2, designated SEQ ID:4454 and SEQ ID:2323 respectively, to the nucleotide sequence of GAM7776 RNA, herein designated GAM RNA, also designated SEQ ID:246.

Another function of GAM7776 is therefore inhibition of LOC349251 (Accession XP_300251.1). Accordingly, utilities of GAM7776 include diagnosis, prevention and treatment of diseases and clinical conditions associated with LOC349251.

LOC349360 (Accession XP_088528.1) is another GAM7776 target gene, herein designated TARGET GENE. LOC349360 BINDING SITE is a target binding site found in the 5' untranslated region of mRNA encoded by LOC349360, corresponding to a target binding site such as BINDING SITE I, BINDING SITE II or BINDING SITE III of FIG. 8. Table 4 illustrates the complementarity of the nucleotide sequences of LOC349360 BINDING SITE, designated SEQ ID:10639, to the nucleotide sequence of GAM7776 RNA, herein designated GAM RNA, also designated SEQ ID:246.

Another function of GAM7776 is therefore inhibition of LOC349360 (Accession XP_088528.1). Accordingly, utilities of GAM7776 include diagnosis, prevention and treatment of diseases and clinical conditions associated with LOC349360.

LOC349408 (Accession XP_303044.1) is another GAM7776 target gene, herein designated TARGET GENE. LOC349408 BINDING SITE is a target binding site found in the 5' untranslated region of mRNA encoded by LOC349408, corresponding to a target binding site such as BINDING SITE I, BINDING SITE II or BINDING SITE III of FIG. 8. Table 4 illustrates the complementarity of the nucleotide sequences of LOC349408 BINDING SITE, designated SEQ ID:13466, to the nucleotide sequence of GAM7776 RNA, herein designated GAM RNA, also designated SEQ ID:246.

Another function of GAM7776 is therefore inhibition of LOC349408 (Accession XP_303044.1). Accordingly, utilities of GAM7776 include diagnosis, prevention and treatment of diseases and clinical conditions associated with LOC349408.

LOC349440 (Accession XP_300513.1) is another GAM7776 target gene, herein designated TARGET GENE.

LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:4112, to the nucleotide sequence of GAM7776 RNA, herein designated GAM RNA, also designated SEQ ID:246.

Another function of GAM7776 is therefore inhibition of LOC349440 (Accession XP_300513.1). Accordingly, utilities of GAM7776 include diagnosis, prevention and treatment of diseases and clinical conditions associated with LOC349440.

LOC350106 (Accession XP_303810.1) is another GAM7776 target gene, herein designated TARGET GENE. LOC350106 BINDING SITE is a target binding site found in the 5' untranslated region of mRNA encoded by LOC350106, corresponding to a target binding site such as BINDING SITE I, BINDING SITE II or BINDING SITE III of FIG. 8. Table 4 illustrates the complementarity of the nucleotide sequences of LOC350106 BINDING SITE, designated SEQ ID:18715, to the nucleotide sequence of GAM7776 RNA, herein designated GAM RNA, also designated SEQ ID:246.

Another function of GAM7776 is therefore inhibition of LOC350106 (Accession XP_303810.1). Accordingly, utilities of GAM7776 include diagnosis, prevention and treatment of diseases and clinical conditions associated with LOC350106.

LOC350914 (Accession XP_304556.1) is another GAM7776 target gene, herein designated TARGET GENE. LOC350914 BINDING SITE is a target binding site found in the 5' untranslated region of mRNA encoded by LOC350914, corresponding to a target binding site such as BINDING SITE I, BINDING SITE II or BINDING SITE III of FIG. 8. Table 4 illustrates the complementarity of the nucleotide sequences of LOC350914 BINDING SITE, designated SEQ ID:19860, to the nucleotide sequence of GAM7776 RNA, herein designated GAM RNA, also designated SEQ ID:246.

Another function of GAM7776 is therefore inhibition of LOC350914 (Accession XP_304556.1). Accordingly, utilities of GAM7776 include diagnosis, prevention and treatment of diseases and clinical conditions associated with LOC350914.

LOC51058 (Accession NP_056995.1) is another GAM7776 target gene, herein designated TARGET GENE. LOC51058 BINDING SITE is a target binding site found in the 3' untranslated region of mRNA encoded by LOC51058, corresponding to a target binding site such as BINDING SITE I, BINDING SITE II or BINDING SITE III of FIG. 8. Table 4 illustrates the complementarity of the nucleotide sequences of LOC51058 BINDING SITE, designated SEQ ID:5678, to the nucleotide sequence of GAM7776 RNA, herein designated GAM RNA, also designated SEQ ID:246.

Another function of GAM7776 is therefore inhibition of LOC51058 (Accession NP_056995.1). Accordingly, utilities of GAM7776 include diagnosis, prevention and treatment of diseases and clinical conditions associated with LOC51058.

LOC51193 (Accession NP_057415.1) is another GAM7776 target gene, herein designated TARGET GENE. LOC51193 BINDING SITE1 and LOC51193 BINDING SITE2 are target binding sites found in untranslated regions of mRNA encoded by LOC51193, corresponding to target binding sites such as BINDING SITE I, BINDING SITE II or BINDING SITE III of FIG. 8. Table 4 illustrates the complementarity of the nucleotide sequences of LOC51193 BINDING SITE1 and LOC51193 BINDING SITE2, designated SEQ ID:14721 and SEQ ID:3111 respectively, to the nucleotide sequence of GAM7776 RNA, herein designated GAM RNA, also designated SEQ ID:246.

Another function of GAM7776 is therefore inhibition of LOC51193 (Accession NP_057415.1). Accordingly, utilities of GAM7776 include diagnosis, prevention and treatment of diseases and clinical conditions associated with LOC51193.

LOC51257 (Accession NP_057580.2) is another GAM7776 target gene, herein designated TARGET GENE. LOC51257 BINDING SITE is a target binding site found in the 5' untranslated region of mRNA encoded by LOC51257, corresponding to a target binding site such as BINDING SITE I, BINDING SITE II or BINDING SITE III of FIG. 8. Table 4 illustrates the complementarity of the nucleotide sequences of LOC51257 BINDING SITE, designated SEQ ID:14855, to the nucleotide sequence of GAM7776 RNA, herein designated GAM RNA, also designated SEQ ID:246.

Another function of GAM7776 is therefore inhibition of LOC51257 (Accession NP_057580.2). Accordingly, utilities of GAM7776 include diagnosis, prevention and treatment of diseases and clinical conditions associated with LOC51257.

LOC51334 (Accession NP_057728.1) is another GAM7776 target gene, herein designated TARGET GENE. LOC51334 BINDING SITE is a target binding site found in the 5' untranslated region of mRNA encoded by LOC51334, corresponding to a target binding site such as BINDING SITE I, BINDING SITE II or BINDING SITE III of FIG. 8. Table 4 illustrates the complementarity of the nucleotide sequences of LOC51334 BINDING SITE, designated SEQ ID:8243, to the nucleotide sequence of GAM7776 RNA, herein designated GAM RNA, also designated SEQ ID:246.

Another function of GAM7776 is therefore inhibition of LOC51334 (Accession NP_057728.1). Accordingly, utilities of GAM7776 include diagnosis, prevention and treatment of diseases and clinical conditions associated with LOC51334.

LOC51336 (Accession NP_057730.1) is another GAM7776 target gene, herein designated TARGET GENE. LOC51336 BINDING SITE is a target binding site found in the 3' untranslated region of mRNA encoded by LOC51336, corresponding to a target binding site such as BINDING SITE I, BINDING SITE II or BINDING SITE III of FIG. 8. Table 4 illustrates the complementarity of the nucleotide sequences of LOC51336 BINDING SITE, designated SEQ ID:18703, to the nucleotide sequence of GAM7776 RNA, herein designated GAM RNA, also designated SEQ ID:246.

Another function of GAM7776 is therefore inhibition of LOC51336 (Accession NP_057730.1). Accordingly, utilities of GAM7776 include diagnosis, prevention and treatment of diseases and clinical conditions associated with LOC51336.

LOC55954 (Accession NP_061976.1) is another GAM7776 target gene, herein designated TARGET GENE. LOC55954 BINDING SITE is a target binding site found in the 5' untranslated region of mRNA encoded by LOC55954, corresponding to a target binding site such as BINDING SITE I, BINDING SITE II or BINDING SITE III of FIG. 8. Table 4 illustrates the complementarity of the nucleotide sequences of LOC55954 BINDING SITE, designated SEQ ID:17853, to the nucleotide sequence of GAM7776 RNA, herein designated GAM RNA, also designated SEQ ID:246.

Another function of GAM7776 is therefore inhibition of LOC55954 (Accession NP_061976.1). Accordingly, utilities of GAM7776 include diagnosis, prevention and treatment of diseases and clinical conditions associated with LOC55954.

LOC56902 (Accession NP_064528.1) is another GAM7776 target gene, herein designated TARGET GENE. LOC56902 BINDING SITE is a target binding site found in the 3' untranslated region of mRNA encoded by LOC56902, corresponding to a target binding site such as BINDING SITE I, BINDING SITE II or BINDING SITE III of FIG. 8. Table 4 illustrates the complementarity of the nucleotide sequences of LOC56902 BINDING SITE, designated SEQ ID:5945, to the nucleotide sequence of GAM7776 RNA, herein designated GAM RNA, also designated SEQ ID:246.

Another function of GAM7776 is therefore inhibition of LOC56902 (Accession NP_064528.1). Accordingly, utilities of GAM7776 include diagnosis, prevention and treatment of diseases and clinical conditions associated with LOC56902.

LOC56926 (Accession NP_064555.1) is another GAM7776 target gene, herein designated TARGET GENE. LOC56926 BINDING SITE is a target binding site found in the 3' untranslated region of mRNA encoded by LOC56926, corresponding to a target binding site such as BINDING SITE I, BINDING SITE II or BINDING SITE III of FIG. 8. Table 4 illustrates the complementarity of the nucleotide sequences of LOC56926 BINDING SITE, designated SEQ ID:8643, to the nucleotide sequence of GAM7776 RNA, herein designated GAM RNA, also designated SEQ ID:246.

Another function of GAM7776 is therefore inhibition of LOC56926 (Accession NP_064555.1). Accordingly, utilities of GAM7776 include diagnosis, prevention and treatment of diseases and clinical conditions associated with LOC56926.

LOC57107 (Accession NP_065114.2) is another GAM7776 target gene, herein designated TARGET GENE. LOC57107 BINDING SITE is a target binding site found in the 3' untranslated region of mRNA encoded by LOC57107, corresponding to a target binding site such as BINDING SITE I, BINDING SITE II or BINDING SITE III of FIG. 8. Table 4 illustrates the complementarity of the nucleotide sequences of LOC57107 BINDING SITE, designated SEQ ID:16916, to the nucleotide sequence of GAM7776 RNA, herein designated GAM RNA, also designated SEQ ID:246.

Another function of GAM7776 is therefore inhibition of LOC57107 (Accession NP_065114.2). Accordingly, utilities of GAM7776 include diagnosis, prevention and treatment of diseases and clinical conditions associated with LOC57107.

LOC57146 (Accession NP_065155.2) is another GAM7776 target gene, herein designated TARGET GENE. LOC57146 BINDING SITE is a target binding site found in the 3' untranslated region of mRNA encoded by LOC57146, corresponding to a target binding site such as BINDING SITE I, BINDING SITE II or BINDING SITE III of FIG. 8. Table 4 illustrates the complementarity of the nucleotide sequences of LOC57146 BINDING SITE, designated SEQ ID:11036, to the nucleotide sequence of GAM7776 RNA, herein designated GAM RNA, also designated SEQ ID:246.

Another function of GAM7776 is therefore inhibition of LOC57146 (Accession NP_065155.2). Accordingly, utilities of GAM7776 include diagnosis, prevention and treatment of diseases and clinical conditions associated with LOC57146.

LOC89894 (Accession NP_612350.1) is another GAM7776 target gene, herein designated TARGET GENE. LOC89894 BINDING SITE is a target binding site found in the 5' untranslated region of mRNA encoded by LOC89894, corresponding to a target binding site such as BINDING SITE I, BINDING SITE II or BINDING SITE III of FIG. 8. Table 4 illustrates the complementarity of the nucleotide sequences of LOC89894 BINDING SITE, designated SEQ ID:14184, to the nucleotide sequence of GAM7776 RNA, herein designated GAM RNA, also designated SEQ ID:246.

Another function of GAM7776 is therefore inhibition of LOC89894 (Accession NP_612350.1). Accordingly, utilities of GAM7776 include diagnosis, prevention and treatment of diseases and clinical conditions associated with LOC89894.

LOC90408 (Accession XP_031517.1) is another GAM7776 target gene, herein designated TARGET GENE. LOC90408 BINDING SITE is a target binding site found in the 5' untranslated region of mRNA encoded by LOC90408, corresponding to a target binding site such as BINDING SITE I, BINDING SITE II or BINDING SITE III of FIG. 8. Table 4 illustrates the complementarity of the nucleotide sequences of LOC90408 BINDING SITE, designated SEQ ID:7704, to the nucleotide sequence of GAM7776 RNA, herein designated GAM RNA, also designated SEQ ID:246.

Another function of GAM7776 is therefore inhibition of LOC90408 (Accession XP_031517.1). Accordingly, utilities of GAM7776 include diagnosis, prevention and treatment of diseases and clinical conditions associated with LOC90408.

LOC90485 (Accession XP_032059.1) is another GAM7776 target gene, herein designated TARGET GENE. LOC90485 BINDING SITE1 and LOC90485 BINDING SITE2 are target binding sites found in untranslated regions of mRNA encoded by LOC90485, corresponding to target binding sites such as BINDING SITE I, BINDING SITE II or BINDING SITE III of FIG. 8. Table 4 illustrates the complementarity of the nucleotide sequences of LOC90485 BINDING SITE1 and LOC90485 BINDING SITE2, designated SEQ ID:18698 and SEQ ID:6896 respectively, to the nucleotide sequence of GAM7776 RNA, herein designated GAM RNA, also designated SEQ ID:246.

Another function of GAM7776 is therefore inhibition of LOC90485 (Accession XP_032059.1). Accordingly, utilities of GAM7776 include diagnosis, prevention and treatment of diseases and clinical conditions associated with LOC90485.

LOC90719 (Accession XP_033704.1) is another GAM7776 target gene, herein designated TARGET GENE. LOC90719 BINDING SITE is a target binding site found in the 3' untranslated region of mRNA encoded by LOC90719, corresponding to a target binding site such as BINDING SITE I, BINDING SITE II or BINDING SITE III of FIG. 8. Table 4 illustrates the complementarity of the nucleotide sequences of LOC90719 BINDING SITE, designated SEQ ID:13994, to the nucleotide sequence of GAM7776 RNA, herein designated GAM RNA, also designated SEQ ID:246.

Another function of GAM7776 is therefore inhibition of LOC90719 (Accession XP_033704.1). Accordingly, utilities of GAM7776 include diagnosis, prevention and treatment of diseases and clinical conditions associated with LOC90719.

LOC90999 (Accession XP_035410.1) is another GAM7776 target gene, herein designated TARGET GENE. LOC90999 BINDING SITE is a target binding site found in the 3' untranslated region of mRNA encoded by LOC90999, corresponding to a target binding site such as BINDING SITE I, BINDING SITE II or BINDING SITE III of FIG. 8. Table 4 illustrates the complementarity of the nucleotide sequences of LOC90999 BINDING SITE, designated SEQ ID:15038, to the nucleotide sequence of GAM7776 RNA, herein designated GAM RNA, also designated SEQ ID:246.

Another function of GAM7776 is therefore inhibition of LOC90999 (Accession XP_035410.1). Accordingly, utilities of GAM7776 include diagnosis, prevention and treatment of diseases and clinical conditions associated with LOC90999.

LOC91115 (Accession XP_036218.1) is another GAM7776 target gene, herein designated TARGET GENE. LOC91115 BINDING SITE1 through LOC91115 BINDING SITE3 are target binding sites found in untranslated regions of mRNA encoded by LOC91115, corresponding to target binding sites such as BINDING SITE I, BINDING SITE II or BINDING SITE III of FIG. 8. Table 4 illustrates the complementarity of the nucleotide sequences of LOC91115 BINDING SITE1 through LOC91115 BINDING SITE3, designated SEQ ID:12591, SEQ ID:19989 and SEQ ID:17831 respectively, to the nucleotide sequence of GAM7776 RNA, herein designated GAM RNA, also designated SEQ ID:246.

Another function of GAM7776 is therefore inhibition of LOC91115 (Accession XP_036218.1). Accordingly, utilities of GAM7776 include diagnosis, prevention and treatment of diseases and clinical conditions associated with LOC91115.

LOC91170 (Accession XP_036612.1) is another GAM7776 target gene, herein designated TARGET GENE. LOC91170 BINDING SITE is a target binding site found in the 5' untranslated region of mRNA encoded by LOC91170, corresponding to a target binding site such as BINDING SITE I, BINDING SITE II or BINDING SITE III of FIG. 8. Table 4 illustrates the complementarity of the nucleotide sequences of LOC91170 BINDING SITE, designated SEQ ID:16178, to the nucleotide sequence of GAM7776 RNA, herein designated GAM RNA, also designated SEQ ID:246.

Another function of GAM7776 is therefore inhibition of LOC91170 (Accession XP_036612.1). Accordingly, utilities of GAM7776 include diagnosis, prevention and treatment of diseases and clinical conditions associated with LOC91170.

LOC91250 (Accession XP_037135.1) is another GAM7776 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:8577, to the nucleotide sequence of GAM7776 RNA, herein designated GAM RNA, also designated SEQ ID:246.

Another function of GAM7776 is therefore inhibition of LOC91250 (Accession XP_037135.1). Accordingly, utilities of GAM7776 include diagnosis, prevention and treatment of diseases and clinical conditions associated with LOC91250.

LOC91266 (Accession XP_037268.1) is another GAM7776 target gene, herein designated TARGET GENE. LOC91266 BINDING SITE is a target binding site found in the 5' untranslated region of mRNA encoded by LOC91266, corresponding to a target binding site such as BINDING SITE I, BINDING SITE II or BINDING SITE III of FIG. 8. Table 4 illustrates the complementarity of the nucleotide sequences of LOC91266 BINDING SITE, designated SEQ ID:18355, to the nucleotide sequence of GAM7776 RNA, herein designated GAM RNA, also designated SEQ ID:246.

Another function of GAM7776 is therefore inhibition of LOC91266 (Accession XP_037268.1). Accordingly, utilities of GAM7776 include diagnosis, prevention and treatment of diseases and clinical conditions associated with LOC91266.

LOC91373 (Accession XP_038063.5) is another GAM7776 target gene, herein designated TARGET GENE. LOC91373 BINDING SITE is a target binding site found in the 3' untranslated region of mRNA encoded by LOC91373, corresponding to a target binding site such as BINDING SITE I, BINDING SITE II or BINDING SITE III of FIG. 8. Table 4 illustrates the complementarity of the nucleotide sequences of LOC91373 BINDING SITE, designated SEQ ID:9077, to the nucleotide sequence of GAM7776 RNA, herein designated GAM RNA, also designated SEQ ID:246.

Another function of GAM7776 is therefore inhibition of LOC91373 (Accession XP_038063.5). Accordingly, utilities of GAM7776 include diagnosis, prevention and treatment of diseases and clinical conditions associated with LOC91373.

LOC91549 (Accession XP_039115.1) is another GAM7776 target gene, herein designated TARGET GENE. LOC91549 BINDING SITE is a target binding site found in the 5' untranslated region of mRNA encoded by LOC91549, corresponding to a target binding site such as BINDING SITE I, BINDING SITE II or BINDING SITE III of FIG. 8. Table 4 illustrates the complementarity of the nucleotide sequences of LOC91549 BINDING SITE, designated SEQ ID:17238, to the nucleotide sequence of GAM7776 RNA, herein designated GAM RNA, also designated SEQ ID:246.

Another function of GAM7776 is therefore inhibition of LOC91549 (Accession XP_039115.1). Accordingly, utilities of GAM7776 include diagnosis, prevention and treatment of diseases and clinical conditions associated with LOC91549.

LOC91661 (Accession NP_612381.1) is another GAM7776 target gene, herein designated TARGET GENE. LOC91661 BINDING SITE is a target binding site found in the 3' untranslated region of mRNA encoded by LOC91661, corresponding to a target binding site such as BINDING SITE I, BINDING SITE II or BINDING SITE III of FIG. 8. Table 4 illustrates the complementarity of the nucleotide sequences of LOC91661 BINDING SITE, designated SEQ ID:8303, to the nucleotide sequence of GAM7776 RNA, herein designated GAM RNA, also designated SEQ ID:246.

Another function of GAM7776 is therefore inhibition of LOC91661 (Accession NP_612381.1). Accordingly, utilities of GAM7776 include diagnosis, prevention and treatment of diseases and clinical conditions associated with LOC91661.

LOC91663 (Accession NP_612382.1) is another GAM7776 target gene, herein designated TARGET GENE. LOC91663 BINDING SITE is a target binding site found in the 3' untranslated region of mRNA encoded by LOC91663, corresponding to a target binding site such as BINDING SITE I, BINDING SITE II or BINDING SITE III of FIG. 8. Table 4 illustrates the complementarity of the nucleotide sequences of LOC91663 BINDING SITE, designated SEQ ID:8075, to the nucleotide sequence of GAM7776 RNA, herein designated GAM RNA, also designated SEQ ID:246.

Another function of GAM7776 is therefore inhibition of LOC91663 (Accession NP_612382.1). Accordingly, utilities of GAM7776 include diagnosis, prevention and treatment of diseases and clinical conditions associated with LOC91663.

LOC91893 (Accession XP_041340.1) is another GAM7776 target gene, herein designated TARGET GENE. LOC91893 BINDING SITE is a target binding site found in the 3' untranslated region of mRNA encoded by LOC91893, corresponding to a target binding site such as BINDING SITE I, BINDING SITE II or BINDING SITE III of FIG. 8. Table 4 illustrates the complementarity of the nucleotide sequences of LOC91893 BINDING SITE, designated SEQ ID:14589, to the nucleotide sequence of GAM7776 RNA, herein designated GAM RNA, also designated SEQ ID:246.

Another function of GAM7776 is therefore inhibition of LOC91893 (Accession XP_041340.1). Accordingly, utilities of GAM7776 include diagnosis, prevention and treatment of diseases and clinical conditions associated with LOC91893.

LOC92148 (Accession XP_043160.1) is another GAM7776 target gene, herein designated TARGET GENE. LOC92148 BINDING SITE is a target binding site found in the 5' untranslated region of mRNA encoded by LOC92148, corresponding to a target binding site such as BINDING SITE I, BINDING SITE II or BINDING SITE III of FIG. 8. Table 4 illustrates the complementarity of the nucleotide sequences of LOC92148 BINDING SITE, designated SEQ ID:4097, to the nucleotide sequence of GAM7776 RNA, herein designated GAM RNA, also designated SEQ ID:246.

Another function of GAM7776 is therefore inhibition of LOC92148 (Accession XP_043160.1). Accordingly, utilities of GAM7776 include diagnosis, prevention and treatment of diseases and clinical conditions associated with LOC92148.

LOC92597 (Accession NP_775739.1) is another GAM7776 target gene, herein designated TARGET GENE. LOC92597 BINDING SITE is a target binding site found in the 3' untranslated region of mRNA encoded by LOC92597, corresponding to a target binding site such as BINDING SITE I, BINDING SITE II or BINDING SITE III of FIG. 8. Table 4 illustrates the complementarity of the nucleotide sequences of LOC92597 BINDING SITE, designated SEQ ID:19339, to the nucleotide sequence of GAM7776 RNA, herein designated GAM RNA, also designated SEQ ID:246.

Another function of GAM7776 is therefore inhibition of LOC92597 (Accession NP_775739.1). Accordingly, utilities of GAM7776 include diagnosis, prevention and treatment of diseases and clinical conditions associated with LOC92597.

LOC93132 (Accession XP_049396.1) is another GAM7776 target gene, herein designated TARGET GENE. LOC93132 BINDING SITE is a target binding site found in the 5' untranslated region of mRNA encoded by LOC93132, corresponding to a target binding site such as BINDING SITE I, BINDING SITE II or BINDING SITE III of FIG. 8. Table 4 illustrates the complementarity of the nucleotide sequences of LOC93132 BINDING SITE, designated SEQ ID:9953, to the nucleotide sequence of GAM7776 RNA, herein designated GAM RNA, also designated SEQ ID:246.

Another function of GAM7776 is therefore inhibition of LOC93132 (Accession XP_049396.1). Accordingly, utilities of GAM7776 include diagnosis, prevention and treatment of diseases and clinical conditions associated with LOC93132.

Lanosterol synthase (2,3-oxidosqualene-lanosterol cyclase) (LSS, Accession NP_002331.2) is another GAM7776 target gene, herein designated TARGET GENE. LSS BINDING SITE is a target binding site found in the 3' untranslated region of mRNA encoded by LSS, corresponding to a target binding site such as BINDING SITE I, BINDING SITE II or BINDING SITE III of FIG. 8. Table 4 illustrates the complementarity of the nucleotide sequences of LSS BINDING SITE, designated SEQ ID:6091, to the nucleotide sequence of GAM7776 RNA, herein designated GAM RNA, also designated SEQ ID:246.

Another function of GAM7776 is therefore inhibition of Lanosterol synthase (2,3-oxidosqualene-lanosterol cyclase) (LSS, Accession NP_002331.2). Accordingly, utilities of GAM7776 include diagnosis, prevention and treatment of diseases and clinical conditions associated with LSS.

Leukotriene b4 receptor (LTB4R, Accession NP_000743.1) is another GAM7776 target gene, herein designated TARGET GENE. LTB4R BINDING SITE is a target binding site found in the 5' untranslated region of mRNA encoded by LTB4R, corresponding to a target binding site such as BINDING SITE I, BINDING SITE II or BINDING SITE III of FIG. 8. Table 4 illustrates the complementarity of the nucleotide sequences of LTB4R BINDING SITE, designated SEQ ID:1022, to the nucleotide sequence of GAM7776 RNA, herein designated GAM RNA, also designated SEQ ID:246.

Another function of GAM7776 is therefore inhibition of Leukotriene b4 receptor (LTB4R, Accession NP_000743.1), a gene which may be the cardiac p2y receptor involved in the regulation of cardiac muscle contraction through modulation of l-type calcium currents. Accordingly, utilities of GAM7776 include diagnosis, prevention and treatment of diseases and clinical conditions associated with LTB4R.

The function of LTB4R and its association with various diseases and clinical conditions, has been established by previous studies, as described hereinabove with reference to GAM30.1. Leukotriene b4 receptor 2 (LTB4R2, Accession NP_062813.1) is another GAM7776 target gene, herein designated TARGET GENE. LTB4R2 BINDING SITE is a target binding site found in the 5' untranslated region of mRNA encoded by LTB4R2, corresponding to a target binding site such as BINDING SITE I, BINDING SITE II or BINDING SITE III of FIG. 8. Table 4 illustrates the complementarity of the nucleotide sequences of LTB4R2 BINDING SITE, designated SEQ ID:15504, to the nucleotide sequence of GAM7776 RNA, herein designated GAM RNA, also designated SEQ ID:246.

Another function of GAM7776 is therefore inhibition of Leukotriene b4 receptor 2 (LTB4R2, Accession NP_062813.1). Accordingly, utilities of GAM7776 include diagnosis, prevention and treatment of diseases and clinical conditions associated with LTB4R2.

Lymphocyte antigen 75 (LY75, Accession NP_002340.1) is another GAM7776 target gene, herein designated TARGET GENE. LY75 BINDING SITE is a target binding site found in the 3' untranslated region of mRNA encoded by LY75, corresponding to a target binding site such as BINDING SITE I, BINDING SITE II or BINDING SITE III of FIG. 8. Table 4 illustrates the complementarity of the nucleotide sequences of LY75 BINDING SITE, designated SEQ ID:17724, to the nucleotide sequence of GAM7776 RNA, herein designated GAM RNA, also designated SEQ ID:246.

Another function of GAM7776 is therefore inhibition of Lymphocyte antigen 75 (LY75, Accession NP_002340.1). Accordingly, utilities of GAM7776 include diagnosis, prevention and treatment of diseases and clinical conditions associated with LY75.

Lysozyme (renal amyloidosis) (Ly, Accession NP_000230.1) is another GAM7776 target gene, herein designated TARGET GENE. LYZ BINDING SITE is a target binding site found in the 3' untranslated region of mRNA encoded by Ly, corresponding to a target binding site such as BINDING SITE I, BINDING SITE II or BINDING SITE III of FIG. 8. Table 4 illustrates the complementarity of the nucleotide sequences of LYZ BINDING SITE, designated SEQ ID:7382, to the nucleotide sequence of GAM7776 RNA, herein designated GAM RNA, also designated SEQ ID:246.

Another function of GAM7776 is therefore inhibition of Lysozyme (renal amyloidosis) (Ly, Accession NP_000230.1), a gene which a bacteriolytic enzyme. and therefore may be associated with Renal amyloidosis. Accordingly, utilities of GAM7776 include diagnosis, prevention and treatment of Renal amyloidosis, and of other diseases and clinical conditions associated with LYZ.

The function of LYZ and its association with various diseases and clinical conditions, has been established by previous studies, as described hereinabove with reference to GAM189.1. Leucine zipper, putative tumor suppressor 1 (LZTS1, Accession NP_066300.1) is another GAM7776 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:4518, to the nucleotide sequence of GAM7776 RNA, herein designated GAM RNA, also designated SEQ ID:246.

Another function of GAM7776 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM7776 include diagnosis, prevention and treatment of diseases and clinical conditions associated with LZTS1.

The function of LZTS1 and its association with various diseases and clinical conditions, has been established by previous studies, as described hereinabove with reference to GAM130.1. MAC30 (Accession XP_031536.2) is another GAM7776 target gene, herein designated TARGET GENE. MAC30 BINDING SITE is a target binding site found in the 3' untranslated region of mRNA encoded by MAC30, corresponding to a target binding site such as BINDING SITE I, BINDING SITE II or BINDING SITE III of FIG. 8. Table 4 illustrates the complementarity of the nucleotide sequences of MAC30 BINDING SITE, designated SEQ ID:5069, to the nucleotide sequence of GAM7776 RNA, herein designated GAM RNA, also designated SEQ ID:246.

Another function of GAM7776 is therefore inhibition of MAC30 (Accession XP_031536.2). Accordingly, utilities of GAM7776 include diagnosis, prevention and treatment of diseases and clinical conditions associated with MAC30.

MAIL (Accession NP_113607.1) is another GAM7776 target gene, herein designated TARGET GENE. MAIL BINDING SITE is a target binding site found in the 3' untranslated region of mRNA encoded by MAIL, corresponding to a target binding site such as BINDING SITE I, BINDING SITE II or BINDING SITE III of FIG. 8. Table 4 illustrates the complementarity of the nucleotide sequences of MAIL BINDING SITE, designated SEQ ID:2338, to the nucleotide sequence of GAM7776 RNA, herein designated GAM RNA, also designated SEQ ID:246.

Another function of GAM7776 is therefore inhibition of MAIL (Accession NP_113607.1). Accordingly, utilities of GAM7776 include diagnosis, prevention and treatment of diseases and clinical conditions associated with MAIL.

Male germ cell-associated kinase (MAK, Accession NP_005897.1) is another GAM7776 target gene, herein designated TARGET GENE. MAK BINDING SITE is a target binding site found in the 3' untranslated region of mRNA encoded by MAK, corresponding to a target binding site such as BINDING SITE I, BINDING SITE II or BINDING SITE III of FIG. 8. Table 4 illustrates the complementarity of the nucleotide sequences of MAK BINDING SITE, designated SEQ ID:1989, to the nucleotide sequence of GAM7776 RNA, herein designated GAM RNA, also designated SEQ ID:246.

Another function of GAM7776 is therefore inhibition of Male germ cell-associated kinase (MAK, Accession NP_005897.1), a gene which plays an important role in spermatogenesis. Accordingly, utilities of GAM7776 include diagnosis, prevention and treatment of diseases and clinical conditions associated with MAK.

The function of MAK and its association with various diseases and clinical conditions, has been established by previous studies, as described hereinabove with reference to GAM30.1. MAPA (Accession NP_660299.1) is another GAM7776 target gene, herein designated TARGET GENE. MAPA BINDING SITE is a target binding site found in the 3' untranslated region of mRNA encoded by MAPA, corresponding to a target binding site such as BINDING SITE I, BINDING SITE II or BINDING SITE III of FIG. 8. Table 4 illustrates the complementarity of the nucleotide sequences of MAPA BINDING SITE, designated SEQ ID:5231, to the nucleotide sequence of GAM7776 RNA, herein designated GAM RNA, also designated SEQ ID:246.

Another function of GAM7776 is therefore inhibition of MAPA (Accession NP_660299.1). Accordingly, utilities of GAM7776 include diagnosis, prevention and treatment of diseases and clinical conditions associated with MAPA.

Mitogen-activated protein kinase 8 interacting protein 3 (MAPK8IP3, Accession NP_203750.1) is another GAM7776 target gene, herein designated TARGET GENE. MAPK8IP3 BINDING SITE is a target binding site found in the 3' untranslated region of multiple transcripts of mRNA encoded by MAPK8IP3, corresponding to a target binding site such as BINDING SITE I, BINDING SITE II or BINDING SITE III of FIG. 8. Table 4 illustrates the complementarity of the nucleotide sequences of MAPK8IP3 BINDING SITE, designated SEQ ID:14298, to the nucleotide sequence of GAM7776 RNA, herein designated GAM RNA, also designated SEQ ID:246.

Another function of GAM7776 is therefore inhibition of Mitogen-activated protein kinase 8 interacting protein 3 (MAPK8IP3, Accession NP_203750.1). Accordingly, utilities of GAM7776 include diagnosis, prevention and treatment of diseases and clinical conditions associated with MAPK8IP3.

MCLC (Accession NP_055942.1) is another GAM7776 target gene, herein designated TARGET GENE. MCLC BINDING SITE is a target binding site found in the 3' untranslated region of mRNA encoded by MCLC, corresponding to a target binding site such as BINDING SITE I, BINDING SITE II or BINDING SITE III of FIG. 8. Table 4 illustrates the complementarity of the nucleotide sequences of MCLC BINDING SITE, designated SEQ ID:7270, to the nucleotide sequence of GAM7776 RNA, herein designated GAM RNA, also designated SEQ ID:246.

Another function of GAM7776 is therefore inhibition of MCLC (Accession NP_055942.1). Accordingly, utilities of GAM7776 include diagnosis, prevention and treatment of diseases and clinical conditions associated with MCLC.

Mdm2, transformed 3t3 cell double minute 2, p53 binding protein (mouse) (MDM2, Accession NP_006873.1) is another GAM7776 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM7776 RNA, herein designated GAM RNA, also designated SEQ ID:246.

Another function of GAM7776 is therefore inhibition of Mdm2, transformed 3t3 cell double minute 2, p53 binding protein (mouse) (MDM2, Accession NP_006873.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM7776 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006870.1) is another GAM7776 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM7776 RNA, herein designated GAM RNA, also designated SEQ ID:246.

Another function of GAM7776 is therefore inhibition of Mdm2, transformed 3t3 cell double minute 2, p53 binding protein (mouse) (MDM2, Accession NP_006870.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM7776 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006871.1) is another GAM7776 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM7776 RNA, herein designated GAM RNA, also designated SEQ ID:246.

Another function of GAM7776 is therefore inhibition of Mdm2, transformed 3t3 cell double minute 2, p53 binding protein (mouse) (MDM2, Accession NP_006871.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM7776 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006869.1) is another GAM7776 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM7776 RNA, herein designated GAM RNA, also designated SEQ ID:246.

Another function of GAM7776 is therefore inhibition of Mdm2, transformed 3t3 cell double minute 2, p53 binding protein (mouse) (MDM2, Accession NP_006869.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM7776 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_002383.1) is another GAM7776 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM7776 RNA, herein designated GAM RNA, also designated SEQ ID:246.

Another function of GAM7776 is therefore inhibition of Mdm2, transformed 3t3 cell double minute 2, p53 binding protein (mouse) (MDM2, Accession NP_002383.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM7776 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm2, transformed 3t3 cell double minute 2, p53 binding protein (mouse) (MDM2, Accession NP_006872.1) is another GAM7776 target gene, herein designated TARGET GENE. MDM2 BINDING SITE is a target binding site found in the 3' untranslated region of multiple transcripts of mRNA encoded by MDM2, corresponding to a target binding site such as BINDING SITE I, BINDING SITE II or BINDING SITE III of FIG. 8. Table 4 illustrates the complementarity of the nucleotide sequences of MDM2 BINDING SITE, designated SEQ ID:6671, to the nucleotide sequence of GAM7776 RNA, herein designated GAM RNA, also designated SEQ ID:246.

Another function of GAM7776 is therefore inhibition of Mdm2, transformed 3t3 cell double minute 2, p53 binding protein (mouse) (MDM2, Accession NP_006872.1), a gene which binds to and downmodulates p53 (TP53) and retinoblastoma protein (RB1) function. and therefore may be associated with Tumors (including soft tissue sarcomas, osteosarcomas and gliomas). Accordingly, utilities of GAM7776 include diagnosis, prevention and treatment of Tumors (including soft tissue sarcomas, osteosarcomas and gliomas), and of other diseases and clinical conditions associated with MDM2.

The function of MDM2 and its association with various diseases and clinical conditions, has been established by previous studies, as described hereinabove with reference to GAM189.1. Mdm4, transformed 3t3 cell double minute 4, p53 binding protein (mouse) (MDM4, Accession NP_002384.1) is another GAM7776 target gene, herein designated TARGET GENE. MDM4 BINDING SITE is a target binding site found in the 3' untranslated region of mRNA encoded by MDM4, corresponding to a target binding site such as BINDING SITE I, BINDING SITE II or BINDING SITE III of FIG. 8. Table 4 illustrates the complementarity of the nucleotide sequences of MDM4 BINDING SITE, designated SEQ ID:7078, to the nucleotide sequence of GAM7776 RNA, herein designated GAM RNA, also designated SEQ ID:246.

Another function of GAM7776 is therefore inhibition of Mdm4, transformed 3t3 cell double minute 4, p53 binding protein (mouse) (MDM4, Accession NP_002384.1), a gene which Strongly similar to murine Mdm4; may interact with p53. Accordingly, utilities of GAM7776 include diagnosis, prevention and treatment of diseases and clinical conditions associated with MDM4.

The function of MDM4 and its association with various diseases and clinical conditions, has been established by previous studies, as described hereinabove with reference to GAM189.1. Mediterranean fever (MEFV, Accession NP_000234.1) is another GAM7776 target gene, herein designated TARGET GENE. MEFV BINDING SITE1 and MEFV BINDING SITE2 are target binding sites found in untranslated regions of mRNA encoded by MEFV, corresponding to target binding sites such as BINDING SITE I, BINDING SITE II or BINDING SITE III of FIG. 8. Table 4 illustrates the complementarity of the nucleotide sequences of MEFV BINDING SITE1 and MEFV BINDING SITE2, designated SEQ ID:5443 and SEQ ID:19829 respectively, to the nucleotide sequence of GAM7776 RNA, herein designated GAM RNA, also designated SEQ ID:246.

Another function of GAM7776 is therefore inhibition of Mediterranean fever (MEFV, Accession NP_000234.1). Accordingly, utilities of GAM7776 include diagnosis, prevention and treatment of diseases and clinical conditions associated with MEFV.

Mesoderm development candidate 2 (MESDC2, Accession XP_051854.1) is another GAM7776 target gene, herein designated TARGET GENE. MESDC2 BINDING SITE is a target binding site found in the 3' untranslated region of mRNA encoded by MESDC2, corresponding to a target binding site such as BINDING SITE I, BINDING SITE II or BINDING SITE III of FIG. 8. Table 4 illustrates the complementarity of the nucleotide sequences of MESDC2 BINDING SITE, designated SEQ ID:6523, to the nucleotide sequence of GAM7776 RNA, herein designated GAM RNA, also designated SEQ ID:246.

Another function of GAM7776 is therefore inhibition of Mesoderm development candidate 2 (MESDC2, Accession XP_051854.1). Accordingly, utilities of GAM7776 include diagnosis, prevention and treatment of diseases and clinical conditions associated with MESDC2.

MFTC (Accession NP_110407.2) is another GAM7776 target gene, herein designated TARGET GENE. MFTC BINDING SITE is a target binding site found in the 3' untranslated region of mRNA encoded by MFTC, corresponding to a target binding site such as BINDING SITE I, BINDING SITE II or BINDING SITE III of FIG. 8. Table 4 illustrates the complementarity of the nucleotide sequences of MFTC BINDING SITE, designated SEQ ID:16545, to the nucleotide sequence of GAM7776 RNA, herein designated GAM RNA, also designated SEQ ID:246.

Another function of GAM7776 is therefore inhibition of MFTC (Accession NP_110407.2). Accordingly, utilities of GAM7776 include diagnosis, prevention and treatment of diseases and clinical conditions associated with MFTC.

Mannosyl (alpha-1,6-)-glycoprotein beta-1,2-n-acetylglucosaminyltransferase (MGAT2, Accession NP_079374.1) is another GAM7776 target gene, herein designated TARGET GENE. MGAT2 BINDING SITE is a target binding site found in the 3' untranslated region of multiple transcripts of mRNA encoded by MGAT2, corresponding to a target binding site such as BINDING SITE I, BINDING SITE II or BINDING SITE III of FIG. 8. Table 4 illustrates the complementarity of the nucleotide sequences of MGAT2 BINDING SITE, designated SEQ ID:9699, to the nucleotide sequence of GAM7776 RNA, herein designated GAM RNA, also designated SEQ ID:246.

Another function of GAM7776 is therefore inhibition of Mannosyl (alpha-1,6-)-glycoprotein beta-1,2-n-acetylglucosaminyltransferase (MGAT2, Accession NP_079374.1). Accordingly, utilities of GAM7776 include diagnosis, prevention and treatment of diseases and clinical conditions associated with MGAT2.

MGC10772 (Accession NP_085044.2) is another GAM7776 target gene, herein designated TARGET GENE. MGC10772 BINDING SITE is a target binding site found in the 5' untranslated region of mRNA encoded by MGC10772, corresponding to a target binding site such as BINDING SITE I, BINDING SITE II or BINDING SITE III of FIG. 8. Table 4 illustrates the complementarity of the nucleotide sequences of MGC10772 BINDING SITE, designated SEQ ID:5386, to the nucleotide sequence of GAM7776 RNA, herein designated GAM RNA, also designated SEQ ID:246.

Another function of GAM7776 is therefore inhibition of MGC10772 (Accession NP_085044.2). Accordingly, utilities of GAM7776 include diagnosis, prevention and treatment of diseases and clinical conditions associated with MGC10772.

MGC10818 (Accession NP_085045.2) is another GAM7776 target gene, herein designated TARGET GENE. MGC10818 BINDING SITE is a target binding site found in the 3' untranslated region of mRNA encoded by MGC10818, corresponding to a target binding site such as BINDING SITE I, BINDING SITE II or BINDING SITE III of FIG. 8. Table 4 illustrates the complementarity of the nucleotide sequences of MGC10818 BINDING SITE, designated SEQ ID:2199, to the nucleotide sequence of GAM7776 RNA, herein designated GAM RNA, also designated SEQ ID:246.

Another function of GAM7776 is therefore inhibition of MGC10818 (Accession NP_085045.2). Accordingly, utilities of GAM7776 include diagnosis, prevention and treatment of diseases and clinical conditions associated with MGC10818.

MGC11102 (Accession NP_115701.2) is another GAM7776 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:17609, to the nucleotide sequence of GAM7776 RNA, herein designated GAM RNA, also designated SEQ ID:246.

Another function of GAM7776 is therefore inhibition of MGC11102 (Accession NP__115701.2). Accordingly, utilities of GAM7776 include diagnosis, prevention and treatment of diseases and clinical conditions associated with MGC11102.

MGC12262 (Accession NP__116085.1) is another GAM7776 target gene, herein designated TARGET GENE. MGC12262 BINDING SITE is a target binding site found in the 5' untranslated region of mRNA encoded by MGC12262, corresponding to a target binding site such as BINDING SITE I, BINDING SITE II or BINDING SITE III of FIG. 8. Table 4 illustrates the complementarity of the nucleotide sequences of MGC12262 BINDING SITE, designated SEQ ID:12220, to the nucleotide sequence of GAM7776 RNA, herein designated GAM RNA, also designated SEQ ID:246.

Another function of GAM7776 is therefore inhibition of MGC12262 (Accession NP__116085.1). Accordingly, utilities of GAM7776 include diagnosis, prevention and treatment of diseases and clinical conditions associated with MGC12262.

MGC12518 (Accession NP__291026.1) is another GAM7776 target gene, herein designated TARGET GENE. MGC12518 BINDING SITE is a target binding site found in the 3' untranslated region of mRNA encoded by MGC12518, corresponding to a target binding site such as BINDING SITE I, BINDING SITE II or BINDING SITE III of FIG. 8. Table 4 illustrates the complementarity of the nucleotide sequences of MGC12518 BINDING SITE, designated SEQ ID:18251, to the nucleotide sequence of GAM7776 RNA, herein designated GAM RNA, also designated SEQ ID:246.

Another function of GAM7776 is therefore inhibition of MGC12518 (Accession NP__291026.1). Accordingly, utilities of GAM7776 include diagnosis, prevention and treatment of diseases and clinical conditions associated with MGC12518.

MGC13017 (Accession NP__542387.1) is another GAM7776 target gene, herein designated TARGET GENE. MGC13017 BINDING SITE is a target binding site found in the 3' untranslated region of mRNA encoded by MGC13017, corresponding to a target binding site such as BINDING SITE I, BINDING SITE II or BINDING SITE III of FIG. 8. Table 4 illustrates the complementarity of the nucleotide sequences of MGC13017 BINDING SITE, designated SEQ ID:11562, to the nucleotide sequence of GAM7776 RNA, herein designated GAM RNA, also designated SEQ ID:246.

Another function of GAM7776 is therefore inhibition of MGC13017 (Accession NP__542387.1). Accordingly, utilities of GAM7776 include diagnosis, prevention and treatment of diseases and clinical conditions associated with MGC13017.

MGC13024 (Accession NP__689501.1) is another GAM7776 target gene, herein designated TARGET GENE. MGC13024 BINDING SITE is a target binding site found in the 3' untranslated region of mRNA encoded by MGC13024, corresponding to a target binding site such as BINDING SITE I, BINDING SITE II or BINDING SITE III of FIG. 8. Table 4 illustrates the complementarity of the nucleotide sequences of MGC13024 BINDING SITE, designated SEQ ID:13564, to the nucleotide sequence of GAM7776 RNA, herein designated GAM RNA, also designated SEQ ID:246.

Another function of GAM7776 is therefore inhibition of MGC13024 (Accession NP__689501.1). Accordingly, utilities of GAM7776 include diagnosis, prevention and treatment of diseases and clinical conditions associated with MGC13024.

MGC13138 (Accession NP__219363.1) is another GAM7776 target gene, herein designated TARGET GENE. MGC13138 BINDING SITE1 and MGC13138 BINDING SITE2 are target binding sites found in untranslated regions of mRNA encoded by MGC13138, corresponding to target binding sites such as BINDING SITE I, BINDING SITE II or BINDING SITE III of FIG. 8. Table 4 illustrates the complementarity of the nucleotide sequences of MGC13138 BINDING SITE1 and MGC13138 BINDING SITE2, designated SEQ ID:6646 and SEQ ID:9543 respectively, to the nucleotide sequence of GAM7776 RNA, herein designated GAM RNA, also designated SEQ ID:246.

Another function of GAM7776 is therefore inhibition of MGC13138 (Accession NP__219363.1). Accordingly, utilities of GAM7776 include diagnosis, prevention and treatment of diseases and clinical conditions associated with MGC13138.

MGC13170 (Accession NP__116101.1) is another GAM7776 target gene, herein designated TARGET GENE. MGC13170 BINDING SITE is a target binding site found in the 3' untranslated region of mRNA encoded by MGC13170, corresponding to a target binding site such as BINDING SITE I, BINDING SITE II or BINDING SITE III of FIG. 8. Table 4 illustrates the complementarity of the nucleotide sequences of MGC13170 BINDING SITE, designated SEQ ID:20116, to the nucleotide sequence of GAM7776 RNA, herein designated GAM RNA, also designated SEQ ID:246.

Another function of GAM7776 is therefore inhibition of MGC13170 (Accession NP__116101.1). Accordingly, utilities of GAM7776 include diagnosis, prevention and treatment of diseases and clinical conditions associated with MGC13170.

MGC13204 (Accession NP__113653.1) is another GAM7776 target gene, herein designated TARGET GENE. MGC13204 BINDING SITE is a target binding site found in the 3' untranslated region of mRNA encoded by MGC13204, corresponding to a target binding site such as BINDING SITE I, BINDING SITE II or BINDING SITE III of FIG. 8. Table 4 illustrates the complementarity of the nucleotide sequences of MGC13204 BINDING SITE, designated SEQ ID:9494, to the nucleotide sequence of GAM7776 RNA, herein designated GAM RNA, also designated SEQ ID:246.

Another function of GAM7776 is therefore inhibition of MGC13204 (Accession NP__113653.1). Accordingly, utilities of GAM7776 include diagnosis, prevention and treatment of diseases and clinical conditions associated with MGC13204.

MGC14289 (Accession NP__542391.1) is another GAM7776 target gene, herein designated TARGET GENE. MGC14289 BINDING SITE is a target binding site found in the 3' untranslated region of mRNA encoded by MGC14289, corresponding to a target binding site such as BINDING SITE I, BINDING SITE II or BINDING SITE III of FIG. 8. Table 4 illustrates the complementarity of the nucleotide sequences of MGC14289 BINDING SITE, designated SEQ ID:3677, to the nucleotide sequence of GAM7776 RNA, herein designated GAM RNA, also designated SEQ ID:246.

Another function of GAM7776 is therefore inhibition of MGC14289 (Accession NP__542391.1). Accordingly, utilities of GAM7776 include diagnosis, prevention and treatment of diseases and clinical conditions associated with MGC14289.

MGC14436 (Accession NP_116286.1) is another GAM7776 target gene, herein designated TARGET GENE. MGC14436 BINDING SITE is a target binding site found in the 5' untranslated region of mRNA encoded by MGC14436, corresponding to a target binding site such as BINDING SITE I, BINDING SITE II or BINDING SITE III of FIG. 8. Table 4 illustrates the complementarity of the nucleotide sequences of MGC14436 BINDING SITE, designated SEQ ID:17347, to the nucleotide sequence of GAM7776 RNA, herein designated GAM RNA, also designated SEQ ID:246.

Another function of GAM7776 is therefore inhibition of MGC14436 (Accession NP_116286.1). Accordingly, utilities of GAM7776 include diagnosis, prevention and treatment of diseases and clinical conditions associated with MGC14436.

MGC14836 (Accession NP_219480.1) is another GAM7776 target gene, herein designated TARGET GENE. MGC14836 BINDING SITE is a target binding site found in the 3' untranslated region of mRNA encoded by MGC14836, corresponding to a target binding site such as BINDING SITE I, BINDING SITE II or BINDING SITE III of FIG. 8. Table 4 illustrates the complementarity of the nucleotide sequences of MGC14836 BINDING SITE, designated SEQ ID:15044, to the nucleotide sequence of GAM7776 RNA, herein designated GAM RNA, also designated SEQ ID:246.

Another function of GAM7776 is therefore inhibition of MGC14836 (Accession NP_219480.1). Accordingly, utilities of GAM7776 include diagnosis, prevention and treatment of diseases and clinical conditions associated with MGC14836.

MGC15419 (Accession NP_079011.2) is another GAM7776 target gene, herein designated TARGET GENE. MGC15419 BINDING SITE is a target binding site found in the 3' untranslated region of mRNA encoded by MGC15419, corresponding to a target binding site such as BINDING SITE I, BINDING SITE II or BINDING SITE III of FIG. 8. Table 4 illustrates the complementarity of the nucleotide sequences of MGC15419 BINDING SITE, designated SEQ ID:15115, to the nucleotide sequence of GAM7776 RNA, herein designated GAM RNA, also designated SEQ ID:246.

Another function of GAM7776 is therefore inhibition of MGC15419 (Accession NP_079011.2). Accordingly, utilities of GAM7776 include diagnosis, prevention and treatment of diseases and clinical conditions associated with MGC15419.

MGC15606 (Accession NP_659474.1) is another GAM7776 target gene, herein designated TARGET GENE. MGC15606 BINDING SITE is a target binding site found in the 5' untranslated region of mRNA encoded by MGC15606, corresponding to a target binding site such as BINDING SITE I, BINDING SITE II or BINDING SITE III of FIG. 8. Table 4 illustrates the complementarity of the nucleotide sequences of MGC15606 BINDING SITE, designated SEQ ID:10968, to the nucleotide sequence of GAM7776 RNA, herein designated GAM RNA, also designated SEQ ID:246.

Another function of GAM7776 is therefore inhibition of MGC15606 (Accession NP_659474.1). Accordingly, utilities of GAM7776 include diagnosis, prevention and treatment of diseases and clinical conditions associated with MGC15606.

MGC15668 (Accession NP_116145.1) is another GAM7776 target gene, herein designated TARGET GENE. MGC15668 BINDING SITE is a target binding site found in the 3' untranslated region of mRNA encoded by MGC15668, corresponding to a target binding site such as BINDING SITE I, BINDING SITE II or BINDING SITE III of FIG. 8. Table 4 illustrates the complementarity of the nucleotide sequences of MGC15668 BINDING SITE, designated SEQ ID:3620, to the nucleotide sequence of GAM7776 RNA, herein designated GAM RNA, also designated SEQ ID:246.

Another function of GAM7776 is therefore inhibition of MGC15668 (Accession NP_116145.1). Accordingly, utilities of GAM7776 include diagnosis, prevention and treatment of diseases and clinical conditions associated with MGC15668.

MGC15873 (Accession NP_116309.1) is another GAM7776 target gene, herein designated TARGET GENE. MGC15873 BINDING SITE is a target binding site found in the 5' untranslated region of mRNA encoded by MGC15873, corresponding to a target binding site such as BINDING SITE I, BINDING SITE II or BINDING SITE III of FIG. 8. Table 4 illustrates the complementarity of the nucleotide sequences of MGC15873 BINDING SITE, designated SEQ ID:2894, to the nucleotide sequence of GAM7776 RNA, herein designated GAM RNA, also designated SEQ ID:246.

Another function of GAM7776 is therefore inhibition of MGC15873 (Accession NP_116309.1). Accordingly, utilities of GAM7776 include diagnosis, prevention and treatment of diseases and clinical conditions associated with MGC15873.

MGC1842 (Accession XP_037797.2) is another GAM7776 target gene, herein designated TARGET GENE. MGC1842 BINDING SITE is a target binding site found in the 3' untranslated region of mRNA encoded by MGC1842, corresponding to a target binding site such as BINDING SITE I, BINDING SITE II or BINDING SITE III of FIG. 8. Table 4 illustrates the complementarity of the nucleotide sequences of MGC1842 BINDING SITE, designated SEQ ID:15046, to the nucleotide sequence of GAM7776 RNA, herein designated GAM RNA, also designated SEQ ID:246.

Another function of GAM7776 is therefore inhibition of MGC1842 (Accession XP_037797.2). Accordingly, utilities of GAM7776 include diagnosis, prevention and treatment of diseases and clinical conditions associated with MGC1842.

MGC21675 (Accession NP_443093.1) is another GAM7776 target gene, herein designated TARGET GENE. MGC21675 BINDING SITE is a target binding site found in the 3' untranslated region of mRNA encoded by MGC21675, corresponding to a target binding site such as BINDING SITE I, BINDING SITE II or BINDING SITE III of FIG. 8. Table 4 illustrates the complementarity of the nucleotide sequences of MGC21675 BINDING SITE, designated SEQ ID:16916, to the nucleotide sequence of GAM7776 RNA, herein designated GAM RNA, also designated SEQ ID:246.

Another function of GAM7776 is therefore inhibition of MGC21675 (Accession NP_443093.1). Accordingly, utilities of GAM7776 include diagnosis, prevention and treatment of diseases and clinical conditions associated with MGC21675.

MGC21738 (Accession NP_659481.1) is another GAM7776 target gene, herein designated TARGET GENE. MGC21738 BINDING SITE is a target binding site found in the 3' untranslated region of mRNA encoded by MGC21738, corresponding to a target binding site such as BINDING SITE I, BINDING SITE II or BINDING SITE III of FIG. 8. Table 4 illustrates the complementarity of the nucleotide sequences of MGC21738 BINDING SITE, designated SEQ ID:8134, to the nucleotide sequence of GAM7776 RNA, herein designated GAM RNA, also designated SEQ ID:246.

Another function of GAM7776 is therefore inhibition of MGC21738 (Accession NP_659481.1). Accordingly, utilities of GAM7776 include diagnosis, prevention and treatment of diseases and clinical conditions associated with MGC21738.

MGC2306 (Accession NP_002041.2) is another GAM7776 target gene, herein designated TARGET GENE. MGC2306 BINDING SITE is a target binding site found in the 3' untranslated region of mRNA encoded by MGC2306, corresponding to a target binding site such as BINDING SITE I, BINDING SITE II or BINDING SITE III of FIG. 8. Table 4 illustrates the complementarity of the nucleotide sequences of MGC2306 BINDING SITE, designated SEQ ID:7160, to the nucleotide sequence of GAM7776 RNA, herein designated GAM RNA, also designated SEQ ID:246.

Another function of GAM7776 is therefore inhibition of MGC2306 (Accession NP_002041.2). Accordingly, utilities of GAM7776 include diagnosis, prevention and treatment of diseases and clinical conditions associated with MGC2306.

MGC2474 (Accession NP_076420.1) is another GAM7776 target gene, herein designated TARGET GENE. MGC2474 BINDING SITE1 and MGC2474 BINDING SITE2 are target binding sites found in untranslated regions of mRNA encoded by MGC2474, corresponding to target binding sites such as BINDING SITE I, BINDING SITE II or BINDING SITE III of FIG. 8. Table 4 illustrates the complementarity of the nucleotide sequences of MGC2474 BINDING SITE1 and MGC2474 BINDING SITE2, designated SEQ ID:18665 and SEQ ID:7797 respectively, to the nucleotide sequence of GAM7776 RNA, herein designated GAM RNA, also designated SEQ ID:246.

Another function of GAM7776 is therefore inhibition of MGC2474 (Accession NP_076420.1). Accordingly, utilities of GAM7776 include diagnosis, prevention and treatment of diseases and clinical conditions associated with MGC2474.

MGC2477 (Accession NP_077004.1) is another GAM7776 target gene, herein designated TARGET GENE. MGC2477 BINDING SITE1 through MGC2477 BINDING SITE3 are target binding sites found in untranslated regions of mRNA encoded by MGC2477, corresponding to target binding sites such as BINDING SITE I, BINDING SITE II or BINDING SITE III of FIG. 8. Table 4 illustrates the complementarity of the nucleotide sequences of MGC2477 BINDING SITE1 through MGC2477 BINDING SITE3, designated SEQ ID:19729, SEQ ID:5609 and SEQ ID:8610 respectively, to the nucleotide sequence of GAM7776 RNA, herein designated GAM RNA, also designated SEQ ID:246.

Another function of GAM7776 is therefore inhibition of MGC2477 (Accession NP_077004.1). Accordingly, utilities of GAM7776 include diagnosis, prevention and treatment of diseases and clinical conditions associated with MGC2477.

MGC2603 (Accession NP_076942.1) is another GAM7776 target gene, herein designated TARGET GENE. MGC2603 BINDING SITE is a target binding site found in the 3' untranslated region of mRNA encoded by MGC2603, corresponding to a target binding site such as BINDING SITE I, BINDING SITE II or BINDING SITE III of FIG. 8. Table 4 illustrates the complementarity of the nucleotide sequences of MGC2603 BINDING SITE, designated SEQ ID:5845, to the nucleotide sequence of GAM7776 RNA, herein designated GAM RNA, also designated SEQ ID:246.

Another function of GAM7776 is therefore inhibition of MGC2603 (Accession NP_076942.1). Accordingly, utilities of GAM7776 include diagnosis, prevention and treatment of diseases and clinical conditions associated with MGC2603.

MGC2718 (Accession NP_076972.2) is another GAM7776 target gene, herein designated TARGET GENE. MGC2718 BINDING SITE is a target binding site found in the 3' untranslated region of mRNA encoded by MGC2718, corresponding to a target binding site such as BINDING SITE I, BINDING SITE II or BINDING SITE III of FIG. 8. Table 4 illustrates the complementarity of the nucleotide sequences of MGC2718 BINDING SITE, designated SEQ ID:3976, to the nucleotide sequence of GAM7776 RNA, herein designated GAM RNA, also designated SEQ ID:246.

Another function of GAM7776 is therefore inhibition of MGC2718 (Accession NP_076972.2). Accordingly, utilities of GAM7776 include diagnosis, prevention and treatment of diseases and clinical conditions associated with MGC2718.

MGC27345 (Accession XP_300964.1) is another GAM7776 target gene, herein designated TARGET GENE. MGC27345 BINDING SITE1 and MGC27345 BINDING SITE2 are target binding sites found in untranslated regions of multiple transcripts of mRNA encoded by MGC27345, corresponding to target binding sites such as BINDING SITE I, BINDING SITE II or BINDING SITE III of FIG. 8. Table 4 illustrates the complementarity of the nucleotide sequences of MGC27345 BINDING SITE1 and MGC27345 BINDING SITE2, designated SEQ ID:19385 and SEQ ID:18352 respectively, to the nucleotide sequence of GAM7776 RNA, herein designated GAM RNA, also designated SEQ ID:246.

Another function of GAM7776 is therefore inhibition of MGC27345 (Accession XP_300964.1). Accordingly, utilities of GAM7776 include diagnosis, prevention and treatment of diseases and clinical conditions associated with MGC27345.

MGC29891 (Accession NP_653219.1) is another GAM7776 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:14858, to the nucleotide sequence of GAM7776 RNA, herein designated GAM RNA, also designated SEQ ID:246.

Another function of GAM7776 is therefore inhibition of MGC29891 (Accession NP_653219.1). Accordingly, utilities of GAM7776 include diagnosis, prevention and treatment of diseases and clinical conditions associated with MGC29891.

MGC29898 (Accession NP_659485.1) is another GAM7776 target gene, herein designated TARGET GENE. MGC29898 BINDING SITE is a target binding site found in the 3' untranslated region of mRNA encoded by MGC29898, corresponding to a target binding site such as BINDING SITE I, BINDING SITE II or BINDING SITE III of FIG. 8. Table 4 illustrates the complementarity of the nucleotide sequences of MGC29898 BINDING SITE, designated SEQ ID:16672, to the nucleotide sequence of GAM7776 RNA, herein designated GAM RNA, also designated SEQ ID:246.

Another function of GAM7776 is therefore inhibition of MGC29898 (Accession NP_659485.1). Accordingly, utilities of GAM7776 include diagnosis, prevention and treatment of diseases and clinical conditions associated with MGC29898.

MGC3113 (Accession NP_076940.1) is another GAM7776 target gene, herein designated TARGET GENE. MGC3113 BINDING SITE is a target binding site found in the 3' untranslated region of mRNA encoded by MGC3113, corresponding to a target binding site such as BINDING SITE I, BINDING SITE II or BINDING SITE III of FIG. 8. Table 4 illustrates the complementarity of the nucleotide sequences of MGC3113 BINDING SITE, designated SEQ ID:10136, to the nucleotide sequence of GAM7776 RNA, herein designated GAM RNA, also designated SEQ ID:246.

Another function of GAM7776 is therefore inhibition of MGC3113 (Accession NP_076940.1). Accordingly, utilities of GAM7776 include diagnosis, prevention and treatment of diseases and clinical conditions associated with MGC3113.

MGC3207 (Accession NP_115661.1) is another GAM7776 target gene, herein designated TARGET GENE. MGC3207 BINDING SITE1 and MGC3207 BINDING SITE2 are target binding sites found in untranslated regions of mRNA encoded by MGC3207, corresponding to target binding sites such as BINDING SITE I, BINDING SITE II or BINDING SITE III of FIG. 8. Table 4 illustrates the complementarity of the nucleotide sequences of MGC3207 BINDING SITE1 and MGC3207 BINDING SITE2, designated SEQ ID:5157 and SEQ ID:13812 respectively, to the nucleotide sequence of GAM7776 RNA, herein designated GAM RNA, also designated SEQ ID:246.

Another function of GAM7776 is therefore inhibition of MGC3207 (Accession NP_115661.1). Accordingly, utilities of GAM7776 include diagnosis, prevention and treatment of diseases and clinical conditions associated with MGC3207.

MGC3329 (Accession NP_076991.2) is another GAM7776 target gene, herein designated TARGET GENE. MGC3329 BINDING SITE is a target binding site found in the 3' untranslated region of mRNA encoded by MGC3329, corresponding to a target binding site such as BINDING SITE I, BINDING SITE II or BINDING SITE III of FIG. 8. Table 4 illustrates the complementarity of the nucleotide sequences of MGC3329 BINDING SITE, designated SEQ ID:4477, to the nucleotide sequence of GAM7776 RNA, herein designated GAM RNA, also designated SEQ ID:246.

Another function of GAM7776 is therefore inhibition of MGC3329 (Accession NP_076991.2). Accordingly, utilities of GAM7776 include diagnosis, prevention and treatment of diseases and clinical conditions associated with MGC3329.

MGC33637 (Accession NP_689809.1) is another GAM7776 target gene, herein designated TARGET GENE. MGC33637 BINDING SITE is a target binding site found in the 3' untranslated region of mRNA encoded by MGC33637, corresponding to a target binding site such as BINDING SITE I, BINDING SITE II or BINDING SITE III of FIG. 8. Table 4 illustrates the complementarity of the nucleotide sequences of MGC33637 BINDING SITE, designated SEQ ID:12069, to the nucleotide sequence of GAM7776 RNA, herein designated GAM RNA, also designated SEQ ID:246.

Another function of GAM7776 is therefore inhibition of MGC33637 (Accession NP_689809.1). Accordingly, utilities of GAM7776 include diagnosis, prevention and treatment of diseases and clinical conditions associated with MGC33637.

MGC33887 (Accession NP_659473.1) is another GAM7776 target gene, herein designated TARGET GENE. MGC33887 BINDING SITE is a target binding site found in the 3' untranslated region of mRNA encoded by MGC33887, corresponding to a target binding site such as BINDING SITE I, BINDING SITE II or BINDING SITE III of FIG. 8. Table 4 illustrates the complementarity of the nucleotide sequences of MGC33887 BINDING SITE, designated SEQ ID:8724, to the nucleotide sequence of GAM7776 RNA, herein designated GAM RNA, also designated SEQ ID:246.

Another function of GAM7776 is therefore inhibition of MGC33887 (Accession NP_659473.1). Accordingly, utilities of GAM7776 include diagnosis, prevention and treatment of diseases and clinical conditions associated with MGC33887.

MGC34034 (Accession NP_694956.1) is another GAM7776 target gene, herein designated TARGET GENE. MGC34034 BINDING SITE is a target binding site found in the 5' untranslated region of mRNA encoded by MGC34034, corresponding to a target binding site such as BINDING SITE I, BINDING SITE II or BINDING SITE III of FIG. 8. Table 4 illustrates the complementarity of the nucleotide sequences of MGC34034 BINDING SITE, designated SEQ ID:9529, to the nucleotide sequence of GAM7776 RNA, herein designated GAM RNA, also designated SEQ ID:246.

Another function of GAM7776 is therefore inhibition of MGC34034 (Accession NP_694956.1). Accordingly, utilities of GAM7776 include diagnosis, prevention and treatment of diseases and clinical conditions associated with MGC34034.

MGC34079 (Accession NP_689688.1) is another GAM7776 target gene, herein designated TARGET GENE. MGC34079 BINDING SITE is a target binding site found in the 3' untranslated region of mRNA encoded by MGC34079, corresponding to a target binding site such as BINDING SITE I, BINDING SITE II or BINDING SITE III of FIG. 8. Table 4 illustrates the complementarity of the nucleotide sequences of MGC34079 BINDING SITE, designated SEQ ID:19817, to the nucleotide sequence of GAM7776 RNA, herein designated GAM RNA, also designated SEQ ID:246.

Another function of GAM7776 is therefore inhibition of MGC34079 (Accession NP_689688.1). Accordingly, utilities of GAM7776 include diagnosis, prevention and treatment of diseases and clinical conditions associated with MGC34079.

MGC34132 (Accession XP_291029.1) is another GAM7776 target gene, herein designated TARGET GENE. MGC34132 BINDING SITE1 and MGC34132 BINDING SITE2 are target binding sites found in untranslated regions of mRNA encoded by MGC34132, corresponding to target binding sites such as BINDING SITE I, BINDING SITE II or BINDING SITE III of FIG. 8. Table 4 illustrates the complementarity of the nucleotide sequences of MGC34132 BINDING SITE1 and MGC34132 BINDING SITE2, designated SEQ ID:9087 and SEQ ID:8232 respectively, to the nucleotide sequence of GAM7776 RNA, herein designated GAM RNA, also designated SEQ ID:246.

Another function of GAM7776 is therefore inhibition of MGC34132 (Accession XP_291029.1). Accordingly, utilities of GAM7776 include diagnosis, prevention and treatment of diseases and clinical conditions associated with MGC34132.

MGC35136 (Accession NP_689640.1) is another GAM7776 target gene, herein designated TARGET GENE. MGC35136 BINDING SITE is a target binding site found in the 5' untranslated region of mRNA encoded by MGC35136, corresponding to a target binding site such as BINDING SITE I, BINDING SITE II or BINDING SITE III of FIG. 8. Table 4 illustrates the complementarity of the nucleotide sequences of MGC35136 BINDING SITE, designated SEQ ID:8535, to the nucleotide sequence of GAM7776 RNA, herein designated GAM RNA, also designated SEQ ID:246.

Another function of GAM7776 is therefore inhibition of MGC35136 (Accession NP_689640.1). Accordingly, utilities of GAM7776 include diagnosis, prevention and treatment of diseases and clinical conditions associated with MGC35136.

MGC35440 (Accession NP_694952.1) is another GAM7776 target gene, herein designated TARGET GENE. MGC35440 BINDING SITE1 and MGC35440 BINDING SITE2 are target binding sites found in untranslated regions of mRNA encoded by MGC35440, corresponding to target binding sites such as BINDING SITE I, BINDING SITE II or BINDING SITE III of FIG. 8. Table 4 illustrates the complementarity of the nucleotide sequences of MGC35440 BINDING SITE1 and MGC35440 BINDING SITE2, designated SEQ ID:6886 and SEQ ID:7378 respectively, to the nucleotide sequence of GAM7776 RNA, herein designated GAM RNA, also designated SEQ ID:246.

Another function of GAM7776 is therefore inhibition of MGC35440 (Accession NP_694952.1). Accordingly, utilities of GAM7776 include diagnosis, prevention and treatment of diseases and clinical conditions associated with MGC35440.

MGC35468 (Accession NP_694976.1) is another GAM7776 target gene, herein designated TARGET GENE. MGC35468 BINDING SITE is a target binding site found in the 3' untranslated region of mRNA encoded by MGC35468, corresponding to a target binding site such as BINDING SITE I, BINDING SITE II or BINDING SITE III of FIG. 8. Table 4 illustrates the complementarity of the nucleotide sequences of MGC35468 BINDING SITE, designated SEQ ID:7484, to the nucleotide sequence of GAM7776 RNA, herein designated GAM RNA, also designated SEQ ID:246.

Another function of GAM7776 is therefore inhibition of MGC35468 (Accession NP_694976.1). Accordingly, utilities of GAM7776 include diagnosis, prevention and treatment of diseases and clinical conditions associated with MGC35468.

MGC35521 (Accession NP_659502.1) is another GAM7776 target gene, herein designated TARGET GENE. MGC35521 BINDING SITE is a target binding site found in the 3' untranslated region of mRNA encoded by MGC35521, corresponding to a target binding site such as BINDING SITE I, BINDING SITE II or BINDING SITE III of FIG. 8. Table 4 illustrates the complementarity of the nucleotide sequences of MGC35521 BINDING SITE, designated SEQ ID:18741, to the nucleotide sequence of GAM7776 RNA, herein designated GAM RNA, also designated SEQ ID:246.

Another function of GAM7776 is therefore inhibition of MGC35521 (Accession NP_659502.1). Accordingly, utilities of GAM7776 include diagnosis, prevention and treatment of diseases and clinical conditions associated with MGC35521.

MGC3771 (Accession NP_112232.1) is another GAM7776 target gene, herein designated TARGET GENE. MGC3771 BINDING SITE is a target binding site found in the 5' untranslated region of mRNA encoded by MGC3771, corresponding to a target binding site such as BINDING SITE I, BINDING SITE II or BINDING SITE III of FIG. 8. Table 4 illustrates the complementarity of the nucleotide sequences of MGC3771 BINDING SITE, designated SEQ ID:3231, to the nucleotide sequence of GAM7776 RNA, herein designated GAM RNA, also designated SEQ ID:246.

Another function of GAM7776 is therefore inhibition of MGC3771 (Accession NP_112232.1). Accordingly, utilities of GAM7776 include diagnosis, prevention and treatment of diseases and clinical conditions associated with MGC3771.

MGC39320 (Accession NP_689642.2) is another GAM7776 target gene, herein designated TARGET GENE. MGC39320 BINDING SITE is a target binding site found in the 3' untranslated region of mRNA encoded by MGC39320, corresponding to a target binding site such as BINDING SITE I, BINDING SITE II or BINDING SITE III of FIG. 8. Table 4 illustrates the complementarity of the nucleotide sequences of MGC39320 BINDING SITE, designated SEQ ID:13428, to the nucleotide sequence of GAM7776 RNA, herein designated GAM RNA, also designated SEQ ID:246.

Another function of GAM7776 is therefore inhibition of MGC39320 (Accession NP_689642.2). Accordingly, utilities of GAM7776 include diagnosis, prevention and treatment of diseases and clinical conditions associated with MGC39320.

MGC40157 (Accession NP_689563.1) is another GAM7776 target gene, herein designated TARGET GENE. MGC40157 BINDING SITE is a target binding site found in the 3' untranslated region of mRNA encoded by MGC40157, corresponding to a target binding site such as BINDING SITE I, BINDING SITE II or BINDING SITE III of FIG. 8. Table 4 illustrates the complementarity of the nucleotide sequences of MGC40157 BINDING SITE, designated SEQ ID:10743, to the nucleotide sequence of GAM7776 RNA, herein designated GAM RNA, also designated SEQ ID:246.

Another function of GAM7776 is therefore inhibition of MGC40157 (Accession NP_689563.1). Accordingly, utilities of GAM7776 include diagnosis, prevention and treatment of diseases and clinical conditions associated with MGC40157.

MGC40168 (Accession NP_714920.1) is another GAM7776 target gene, herein designated TARGET GENE. MGC40168 BINDING SITE is a target binding site found in the 5' untranslated region of mRNA encoded by MGC40168, corresponding to a target binding site such as BINDING SITE I, BINDING SITE II or BINDING SITE III of FIG. 8. Table 4 illustrates the complementarity of the nucleotide sequences of MGC40168 BINDING SITE, designated SEQ ID:7220, to the nucleotide sequence of GAM7776 RNA, herein designated GAM RNA, also designated SEQ ID:246.

Another function of GAM7776 is therefore inhibition of MGC40168 (Accession NP_714920.1). Accordingly, utilities of GAM7776 include diagnosis, prevention and treatment of diseases and clinical conditions associated with MGC40168.

MGC40579 (Accession NP_689989.1) is another GAM7776 target gene, herein designated TARGET GENE. MGC40579 BINDING SITE1 and MGC40579 BINDING SITE2 are target binding sites found in untranslated regions of mRNA encoded by MGC40579, corresponding to target binding sites such as BINDING SITE I, BINDING SITE II or BINDING SITE III of FIG. 8. Table 4 illustrates the complementarity of the nucleotide sequences of MGC40579 BINDING SITE1 and MGC40579 BINDING SITE2, designated SEQ ID:16218 and SEQ ID:19220 respectively, to the nucleotide sequence of GAM7776 RNA, herein designated GAM RNA, also designated SEQ ID:246.

Another function of GAM7776 is therefore inhibition of MGC40579 (Accession NP_689989.1). Accordingly, utilities of GAM7776 include diagnosis, prevention and treatment of diseases and clinical conditions associated with MGC40579.

MGC4248 (Accession NP_115709.2) is another GAM7776 target gene, herein designated TARGET GENE. MGC4248 BINDING SITE is a target binding site found in the 3' untranslated region of mRNA encoded by MGC4248, corresponding to a target binding site such as BINDING SITE I, BINDING SITE II or BINDING SITE III of FIG. 8. Table 4 illustrates the complementarity of the nucleotide sequences of MGC4248 BINDING SITE, designated SEQ ID:3338, to the nucleotide sequence of GAM7776 RNA, herein designated GAM RNA, also designated SEQ ID:246.

Another function of GAM7776 is therefore inhibition of MGC4248 (Accession NP_115709.2). Accordingly, utilities of GAM7776 include diagnosis, prevention and treatment of diseases and clinical conditions associated with MGC4248.

MGC43122 (Accession NP_775784.1) is another GAM7776 target gene, herein designated TARGET GENE. MGC43122 BINDING SITE is a target binding site found in the 3' untranslated region of mRNA encoded by MGC43122, corresponding to a target binding site such as BINDING SITE I, BINDING SITE II or BINDING SITE III of FIG. 8. Table 4 illustrates the complementarity of the nucleotide sequences of MGC43122 BINDING SITE, designated SEQ ID:12783, to the nucleotide sequence of GAM7776 RNA, herein designated GAM RNA, also designated SEQ ID:246.

Another function of GAM7776 is therefore inhibition of MGC43122 (Accession NP_775784.1). Accordingly, utilities of GAM7776 include diagnosis, prevention and treatment of diseases and clinical conditions associated with MGC43122.

MGC50337 (Accession NP_848604.1) is another GAM7776 target gene, herein designated TARGET GENE. MGC50337 BINDING SITE is a target binding site found in the 3' untranslated region of mRNA encoded by MGC50337, corresponding to a target binding site such as BINDING SITE I, BINDING SITE II or BINDING SITE III of FIG. 8. Table 4 illustrates the complementarity of the nucleotide sequences of MGC50337 BINDING SITE, designated SEQ ID:2959, to the nucleotide sequence of GAM7776 RNA, herein designated GAM RNA, also designated SEQ ID:246.

Another function of GAM7776 is therefore inhibition of MGC50337 (Accession NP_848604.1). Accordingly, utilities of GAM7776 include diagnosis, prevention and treatment of diseases and clinical conditions associated with MGC50337.

MGC50452 (Accession NP_775733.1) is another GAM7776 target gene, herein designated TARGET GENE. MGC50452 BINDING SITE is a target binding site found in the 3' untranslated region of mRNA encoded by MGC50452, corresponding to a target binding site such as BINDING SITE I, BINDING SITE II or BINDING SITE III of FIG. 8. Table 4 illustrates the complementarity of the nucleotide sequences of MGC50452 BINDING SITE, designated SEQ ID:16867, to the nucleotide sequence of GAM7776 RNA, herein designated GAM RNA, also designated SEQ ID:246.

Another function of GAM7776 is therefore inhibition of MGC50452 (Accession NP_775733.1). Accordingly, utilities of GAM7776 include diagnosis, prevention and treatment of diseases and clinical conditions associated with MGC50452.

MGC50559 (Accession NP_776163.1) is another GAM7776 target gene, herein designated TARGET GENE. MGC50559 BINDING SITE1 and MGC50559 BINDING SITE2 are target binding sites found in untranslated regions of mRNA encoded by MGC50559, corresponding to target binding sites such as BINDING SITE I, BINDING SITE II or BINDING SITE III of FIG. 8. Table 4 illustrates the complementarity of the nucleotide sequences of MGC50559 BINDING SITE1 and MGC50559 BINDING SITE2, designated SEQ ID:15151 and SEQ ID:11296 respectively, to the nucleotide sequence of GAM7776 RNA, herein designated GAM RNA, also designated SEQ ID:246.

Another function of GAM7776 is therefore inhibition of MGC50559 (Accession NP_776163.1). Accordingly, utilities of GAM7776 include diagnosis, prevention and treatment of diseases and clinical conditions associated with MGC50559.

MGC9912 (Accession NP_542395.1) is another GAM7776 target gene, herein designated TARGET GENE. MGC9912 BINDING SITE is a target binding site found in the 3' untranslated region of mRNA encoded by MGC9912, corresponding to a target binding site such as BINDING SITE I, BINDING SITE II or BINDING SITE III of FIG. 8. Table 4 illustrates the complementarity of the nucleotide sequences of MGC9912 BINDING SITE, designated SEQ ID:12221, to the nucleotide sequence of GAM7776 RNA, herein designated GAM RNA, also designated SEQ ID:246.

Another function of GAM7776 is therefore inhibition of MGC9912 (Accession NP_542395.1). Accordingly, utilities of GAM7776 include diagnosis, prevention and treatment of diseases and clinical conditions associated with MGC9912.

MGRN1 (Accession XP_048119.4) is another GAM7776 target gene, herein designated TARGET GENE. MGRN1 BINDING SITE is a target binding site found in the 3' untranslated region of mRNA encoded by MGRN1, corresponding to a target binding site such as BINDING SITE I, BINDING SITE II or BINDING SITE III of FIG. 8. Table 4 illustrates the complementarity of the nucleotide sequences of MGRN1 BINDING SITE, designated SEQ ID:16616, to the nucleotide sequence of GAM7776 RNA, herein designated GAM RNA, also designated SEQ ID:246.

Another function of GAM7776 is therefore inhibition of MGRN1 (Accession XP_048119.4). Accordingly, utilities of GAM7776 include diagnosis, prevention and treatment of diseases and clinical conditions associated with MGRN1.

Mhc class ii transactivator (MHC2TA, Accession NP_000237.1) is another GAM7776 target gene, herein designated TARGET GENE. MHC2TA BINDING SITE1 through MHC2TA BINDING SITE3 are target binding sites found in untranslated regions of mRNA encoded by MHC2TA, corresponding to target binding sites such as BINDING SITE I, BINDING SITE II or BINDING SITE III of FIG. 8. Table 4 illustrates the complementarity of the nucleotide sequences of MHC2TA BINDING SITE1 through MHC2TA BINDING SITE3, designated SEQ ID:922, SEQ ID:783 and SEQ ID:2053 respectively, to the nucleotide sequence of GAM7776 RNA, herein designated GAM RNA, also designated SEQ ID:246.

Another function of GAM7776 is therefore inhibition of Mhc class ii transactivator (MHC2TA, Accession NP_000237.1). Accordingly, utilities of GAM7776 include diagnosis, prevention and treatment of diseases and clinical conditions associated with MHC2TA.

MIRAB13 (Accession NP_203744.1) is another GAM7776 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:11523, to the nucleotide sequence of GAM7776 RNA, herein designated GAM RNA, also designated SEQ ID:246.

Another function of GAM7776 is therefore inhibition of MIRAB13 (Accession NP_203744.1). Accordingly, utilities of GAM7776 include diagnosis, prevention and treatment of diseases and clinical conditions associated with MIRAB13.

MIRAB13 (Accession XP_039236.6) is another GAM7776 target gene, herein designated TARGET GENE. MIRAB13 BINDING SITE is a target binding site found in the 3' untranslated region of multiple transcripts of mRNA encoded by MIRAB13, corresponding to a target binding site such as BINDING SITE I, BINDING SITE II or BINDING SITE III of FIG. 8. Table 4 illustrates the complementarity of the nucleotide sequences of MIRAB13 BINDING SITE, designated SEQ ID:11523, to the nucleotide sequence of GAM7776 RNA, herein designated GAM RNA, also designated SEQ ID:246.

Another function of GAM7776 is therefore inhibition of MIRAB13 (Accession XP_039236.6). Accordingly, utilities of GAM7776 include diagnosis, prevention and treatment of diseases and clinical conditions associated with MIRAB13.

Makorin, ring finger protein, 4 (MKRN4, Accession NP_110384.1) is another GAM7776 target gene, herein designated TARGET GENE. MKRN4 BINDING SITE is a target binding site found in the 3' untranslated region of mRNA encoded by MKRN4, corresponding to a target binding site such as BINDING SITE I, BINDING SITE II or BINDING SITE III of FIG. 8. Table 4 illustrates the complementarity of the nucleotide sequences of MKRN4 BINDING SITE, designated SEQ ID:12075, to the nucleotide sequence of GAM7776 RNA, herein designated GAM RNA, also designated SEQ ID:246.

Another function of GAM7776 is therefore inhibition of Makorin, ring finger protein, 4 (MKRN4, Accession NP_110384.1). Accordingly, utilities of GAM7776 include diagnosis, prevention and treatment of diseases and clinical conditions associated with MKRN4.

Melan-a (MLANA, Accession NP_005502.1) is another GAM7776 target gene, herein designated TARGET GENE. MLANA BINDING SITE is a target binding site found in the 3' untranslated region of mRNA encoded by MLANA, corresponding to a target binding site such as BINDING SITE I, BINDING SITE II or BINDING SITE III of FIG. 8. Table 4 illustrates the complementarity of the nucleotide sequences of MLANA BINDING SITE, designated SEQ ID:13029, to the nucleotide sequence of GAM7776 RNA, herein designated GAM RNA, also designated SEQ ID:246.

Another function of GAM7776 is therefore inhibition of Melan-a (MLANA, Accession NP_005502.1). Accordingly, utilities of GAM7776 include diagnosis, prevention and treatment of diseases and clinical conditions associated with MLANA.

Megalencephalic leukoencephalopathy with subcortical cysts 1 (MLC1, Accession NP_055981.1) is another GAM7776 target gene, herein designated TARGET GENE. MLC1 BINDING SITE1 and MLC1 BINDING SITE2 are target binding sites found in untranslated regions of multiple transcripts of mRNA encoded by MLC1, corresponding to target binding sites such as BINDING SITE I, BINDING SITE II or BINDING SITE III of FIG. 8. Table 4 illustrates the complementarity of the nucleotide sequences of MLC1 BINDING SITE1 and MLC1 BINDING SITE2, designated SEQ ID:14833 and SEQ ID:19859 respectively, to the nucleotide sequence of GAM7776 RNA, herein designated GAM RNA, also designated SEQ ID:246.

Another function of GAM7776 is therefore inhibition of Megalencephalic leukoencephalopathy with subcortical cysts 1 (MLC1, Accession NP_055981.1). Accordingly, utilities of GAM7776 include diagnosis, prevention and treatment of diseases and clinical conditions associated with MLC1.

Megalencephalic leukoencephalopathy with subcortical cysts 1 (MLC1, Accession NP_631941.1) is another GAM7776 target gene, herein designated TARGET GENE. MLC1 BINDING SITE1 and MLC1 BINDING SITE2 are target binding sites found in untranslated regions of multiple transcripts of mRNA encoded by MLC1, corresponding to target binding sites such as BINDING SITE I, BINDING SITE II or BINDING SITE III of FIG. 8. Table 4 illustrates the complementarity of the nucleotide sequences of MLC1 BINDING SITE1 and MLC1 BINDING SITE2, designated SEQ ID:19859 and SEQ ID:19859 respectively, to the nucleotide sequence of GAM7776 RNA, herein designated GAM RNA, also designated SEQ ID:246.

Another function of GAM7776 is therefore inhibition of Megalencephalic leukoencephalopathy with subcortical cysts 1 (MLC1, Accession NP_631941.1). Accordingly, utilities of GAM7776 include diagnosis, prevention and treatment of diseases and clinical conditions associated with MLC1.

Megalencephalic leukoencephalopathy with subcortical cysts 1 (MLC1, Accession NP_631941.1) is another GAM7776 target gene, herein designated TARGET GENE. MLC1 BINDING SITE1 and MLC1 BINDING SITE2 are target binding sites found in untranslated regions of multiple transcripts of mRNA encoded by MLC1, corresponding to target binding sites such as BINDING SITE I, BINDING SITE II or BINDING SITE III of FIG. 8. Table 4 illustrates the complementarity of the nucleotide sequences of MLC1 BINDING SITE1 and MLC1 BINDING SITE2, designated SEQ ID:14833 and SEQ ID:19859 respectively, to the nucleotide sequence of GAM7776 RNA, herein designated GAM RNA, also designated SEQ ID:246.

Another function of GAM7776 is therefore inhibition of Megalencephalic leukoencephalopathy with subcortical cysts 1 (MLC1, Accession NP_631941.1). Accordingly, utilities of GAM7776 include diagnosis, prevention and treatment of diseases and clinical conditions associated with MLC1.

Melanoma-derived leucine zipper, extra-nuclear factor (MLZE, Accession NP_113603.1) is another GAM7776 target gene, herein designated TARGET GENE. MLZE BINDING SITE is a target binding site found in the 5' untranslated region of mRNA encoded by MLZE, corresponding to a target binding site such as BINDING SITE I, BINDING SITE II or BINDING SITE III of FIG. 8. Table 4 illustrates the complementarity of the nucleotide sequences of MLZE BINDING SITE, designated SEQ ID:9728, to the nucleotide sequence of GAM7776 RNA, herein designated GAM RNA, also designated SEQ ID:246.

Another function of GAM7776 is therefore inhibition of Melanoma-derived leucine zipper, extra-nuclear factor (MLZE, Accession NP_113603.1). Accordingly, utilities of GAM7776 include diagnosis, prevention and treatment of diseases and clinical conditions associated with MLZE.

Matrix metalloproteinase-like 1 (MMPL1, Accession NP_004133.1) is another GAM7776 target gene, herein designated TARGET GENE. MMPL1 BINDING SITE is a target binding site found in the 3' untranslated region of mRNA encoded by MMPL1, corresponding to a target binding site such as BINDING SITE I, BINDING SITE II or BINDING SITE III of FIG. 8. Table 4 illustrates the complementarity of the nucleotide sequences of MMPL1 BINDING SITE, designated SEQ ID:4374, to the nucleotide sequence of GAM7776 RNA, herein designated GAM RNA, also designated SEQ ID:246.

Another function of GAM7776 is therefore inhibition of Matrix metalloproteinase-like 1 (MMPL1, Accession NP_004133.1). Accordingly, utilities of GAM7776 include diagnosis, prevention and treatment of diseases and clinical conditions associated with MMPL1.

Modulator of apoptosis 1 (MOAP1, Accession NP_071434.2) is another GAM7776 target gene, herein designated TARGET GENE. MOAP1 BINDING SITE is a target binding site found in the 3' untranslated region of mRNA encoded by MOAP1, corresponding to a target binding site such as BINDING SITE I, BINDING SITE II or BINDING SITE III of FIG. 8. Table 4 illustrates the complementarity of the nucleotide sequences of MOAP1 BINDING SITE, designated SEQ ID:1744, to the nucleotide sequence of GAM7776 RNA, herein designated GAM RNA, also designated SEQ ID:246.

Another function of GAM7776 is therefore inhibition of Modulator of apoptosis 1 (MOAP1, Accession NP_071434.2). Accordingly, utilities of GAM7776 include diagnosis, prevention and treatment of diseases and clinical conditions associated with MOAP1.

moblak (Accession NP_570719.1) is another GAM7776 target gene, herein designated TARGET GENE. moblak BINDING SITE is a target binding site found in the 3' untranslated region of mRNA encoded by moblak, corresponding to a target binding site such as BINDING SITE I, BINDING SITE II or BINDING SITE III of FIG. 8. Table 4 illustrates the complementarity of the nucleotide sequences of moblak BINDING SITE, designated SEQ ID:19657, to the nucleotide sequence of GAM7776 RNA, herein designated GAM RNA, also designated SEQ ID:246.

Another function of GAM7776 is therefore inhibition of moblak (Accession NP_570719.1). Accordingly, utilities of GAM7776 include diagnosis, prevention and treatment of diseases and clinical conditions associated with moblak.

Molybdenum cofactor synthesis 3 (MOCS3, Accession NP_055299.1) is another GAM7776 target gene, herein designated TARGET GENE. MOCS3 BINDING SITE is a target binding site found in the 3' untranslated region of mRNA encoded by MOCS3, corresponding to a target binding site such as BINDING SITE I, BINDING SITE II or BINDING SITE III of FIG. 8. Table 4 illustrates the complementarity of the nucleotide sequences of MOCS3 BINDING SITE, designated SEQ ID:12064, to the nucleotide sequence of GAM7776 RNA, herein designated GAM RNA, also designated SEQ ID:246.

Another function of GAM7776 is therefore inhibition of Molybdenum cofactor synthesis 3 (MOCS3, Accession NP_055299.1). Accordingly, utilities of GAM7776 include diagnosis, prevention and treatment of diseases and clinical conditions associated with MOCS3.

Myeloproliferative leukemia virus oncogene (MPL, Accession NP_005364.1) is another GAM7776 target gene, herein designated TARGET GENE. MPL BINDING SITE1 and MPL BINDING SITE2 are target binding sites found in untranslated regions of mRNA encoded by MPL, corresponding to target binding sites such as BINDING SITE I, BINDING SITE II or BINDING SITE III of FIG. 8. Table 4 illustrates the complementarity of the nucleotide sequences of MPL BINDING SITE1 and MPL BINDING SITE2, designated SEQ ID:11185 and SEQ ID:16608 respectively, to the nucleotide sequence of GAM7776 RNA, herein designated GAM RNA, also designated SEQ ID:246.

Another function of GAM7776 is therefore inhibition of Myeloproliferative leukemia virus oncogene (MPL, Accession NP_005364.1). Accordingly, utilities of GAM7776 include diagnosis, prevention and treatment of diseases and clinical conditions associated with MPL.

Mitochondrial ribosomal protein l35 (MRPL35, Accession NP_057706.2) is another GAM7776 target gene, herein designated TARGET GENE. MRPL35 BINDING SITE is a target binding site found in the 3' untranslated region of multiple transcripts of mRNA encoded by MRPL35, corresponding to a target binding site such as BINDING SITE I, BINDING SITE II or BINDING SITE III of FIG. 8. Table 4 illustrates the complementarity of the nucleotide sequences of MRPL35 BINDING SITE, designated SEQ ID:9545, to the nucleotide sequence of GAM7776 RNA, herein designated GAM RNA, also designated SEQ ID:246.

Another function of GAM7776 is therefore inhibition of Mitochondrial ribosomal protein l35 (MRPL35, Accession NP_057706.2). Accordingly, utilities of GAM7776 include diagnosis, prevention and treatment of diseases and clinical conditions associated with MRPL35.

Mitochondrial ribosomal protein l44 (MRPL44, Accession NP_075066.1) is another GAM7776 target gene, herein designated TARGET GENE. MRPL44 BINDING SITE is a target binding site found in the 3' untranslated region of mRNA encoded by MRPL44, corresponding to a target binding site such as BINDING SITE I, BINDING SITE II or BINDING SITE III of FIG. 8. Table 4 illustrates the complementarity of the nucleotide sequences of MRPL44 BINDING SITE, designated SEQ ID:14596, to the nucleotide sequence of GAM7776 RNA, herein designated GAM RNA, also designated SEQ ID:246.

Another function of GAM7776 is therefore inhibition of Mitochondrial ribosomal protein l44 (MRPL44, Accession NP_075066.1). Accordingly, utilities of GAM7776 include diagnosis, prevention and treatment of diseases and clinical conditions associated with MRPL44.

Mitochondrial ribosomal protein l49 (MRPL49, Accession NP_004918.1) is another GAM7776 target gene, herein designated TARGET GENE. MRPL49 BINDING SITE is a target binding site found in the 3' untranslated region of mRNA encoded by MRPL49, corresponding to a target binding site such as BINDING SITE I, BINDING SITE II or BINDING SITE III of FIG. 8. Table 4 illustrates the complementarity of the nucleotide sequences of MRPL49 BINDING SITE, designated SEQ ID:5438, to the nucleotide sequence of GAM7776 RNA, herein designated GAM RNA, also designated SEQ ID:246.

Another function of GAM7776 is therefore inhibition of Mitochondrial ribosomal protein l49 (MRPL49, Accession NP_004918.1). Accordingly, utilities of GAM7776 include diagnosis, prevention and treatment of diseases and clinical conditions associated with MRPL49.

Mitochondrial ribosomal protein s27 (MRPS27, Accession NP_055899.1) is another GAM7776 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:4179, to the nucleotide sequence of GAM7776 RNA, herein designated GAM RNA, also designated SEQ ID:246.

Another function of GAM7776 is therefore inhibition of Mitochondrial ribosomal protein s27 (MRPS27, Accession NP_055899.1). Accordingly, utilities of GAM7776 include diagnosis, prevention and treatment of diseases and clinical conditions associated with MRPS27.

MSTP028 (Accession NP_114160.1) is another GAM7776 target gene, herein designated TARGET GENE. MSTP028 BINDING SITE is a target binding site found in the 3' untranslated region of mRNA encoded by MSTP028, corresponding to a target binding site such as BINDING SITE I, BINDING SITE II or BINDING SITE III of FIG. 8. Table 4 illustrates the complementarity of the nucleotide sequences of MSTP028 BINDING SITE, designated SEQ ID:12951, to the nucleotide sequence of GAM7776 RNA, herein designated GAM RNA, also designated SEQ ID:246.

Another function of GAM7776 is therefore inhibition of MSTP028 (Accession NP_114160.1). Accordingly, utilities of GAM7776 include diagnosis, prevention and treatment of diseases and clinical conditions associated with MSTP028.

MTH2 (Accession NP_060753.1) is another GAM7776 target gene, herein designated TARGET GENE. MTH2 BINDING SITE is a target binding site found in the 3' untranslated region of mRNA encoded by MTH2, corresponding to a target binding site such as BINDING SITE I, BINDING SITE II or BINDING SITE III of FIG. 8. Table 4 illustrates the complementarity of the nucleotide sequences of MTH2 BINDING SITE, designated SEQ ID:15874, to the nucleotide sequence of GAM7776 RNA, herein designated GAM RNA, also designated SEQ ID:246.

Another function of GAM7776 is therefore inhibition of MTH2 (Accession NP_060753.1). Accordingly, utilities of GAM7776 include diagnosis, prevention and treatment of diseases and clinical conditions associated with MTH2.

V-myc myelocytomatosis viral oncogene homolog 2 (avian) (MYCL2, Accession NP_005368.1) is another GAM7776 target gene, herein designated TARGET GENE. MYCL2 BINDING SITE is a target binding site found in the 3' untranslated region of mRNA encoded by MYCL2, corresponding to a target binding site such as BINDING SITE I, BINDING SITE II or BINDING SITE III of FIG. 8. Table 4 illustrates the complementarity of the nucleotide sequences of MYCL2 BINDING SITE, designated SEQ ID:16868, to the nucleotide sequence of GAM7776 RNA, herein designated GAM RNA, also designated SEQ ID:246.

Another function of GAM7776 is therefore inhibition of V-myc myelocytomatosis viral oncogene homolog 2 (avian) (MYCL2, Accession NP_005368.1). Accordingly, utilities of GAM7776 include diagnosis, prevention and treatment of diseases and clinical conditions associated with MYCL2.

MYLC2PL (Accession NP_612412.1) is another GAM7776 target gene, herein designated TARGET GENE. MYLC2PL BINDING SITE is a target binding site found in the 5' untranslated region of mRNA encoded by MYLC2PL, corresponding to a target binding site such as BINDING SITE I, BINDING SITE II or BINDING SITE III of FIG. 8. Table 4 illustrates the complementarity of the nucleotide sequences of MYLC2PL BINDING SITE, designated SEQ ID:3580, to the nucleotide sequence of GAM7776 RNA, herein designated GAM RNA, also designated SEQ ID:246.

Another function of GAM7776 is therefore inhibition of MYLC2PL (Accession NP_612412.1). Accordingly, utilities of GAM7776 include diagnosis, prevention and treatment of diseases and clinical conditions associated with MYLC2PL.

Myosin 5c (MYO5C, Accession NP_061198.1) is another GAM7776 target gene, herein designated TARGET GENE. MYO5C BINDING SITE is a target binding site found in the 3' untranslated region of mRNA encoded by MYO5C, corresponding to a target binding site such as BINDING SITE I, BINDING SITE II or BINDING SITE III of FIG. 8. Table 4 illustrates the complementarity of the nucleotide sequences of MYO5C BINDING SITE, designated SEQ ID:4306, to the nucleotide sequence of GAM7776 RNA, herein designated GAM RNA, also designated SEQ ID:246.

Another function of GAM7776 is therefore inhibition of Myosin 5c (MYO5C, Accession NP_061198.1). Accordingly, utilities of GAM7776 include diagnosis, prevention and treatment of diseases and clinical conditions associated with MYO5C.

NACT (Accession NP_808218.1) is another GAM7776 target gene, herein designated TARGET GENE. NACT BINDING SITE is a target binding site found in the 3' untranslated region of mRNA encoded by NACT, corresponding to a target binding site such as BINDING SITE I, BINDING SITE II or BINDING SITE III of FIG. 8. Table 4 illustrates the complementarity of the nucleotide sequences of NACT BINDING SITE, designated SEQ ID:19968, to the nucleotide sequence of GAM7776 RNA, herein designated GAM RNA, also designated SEQ ID:246.

Another function of GAM7776 is therefore inhibition of NACT (Accession NP_808218.1). Accordingly, utilities of GAM7776 include diagnosis, prevention and treatment of diseases and clinical conditions associated with NACT.

Nanog (Accession NP_079141.1) is another GAM7776 target gene, herein designated TARGET GENE. Nanog BINDING SITE is a target binding site found in the 3' untranslated region of mRNA encoded by Nanog, corresponding to a target binding site such as BINDING SITE I, BINDING SITE II or BINDING SITE III of FIG. 8. Table 4 illustrates the complementarity of the nucleotide sequences of Nanog BINDING SITE, designated SEQ ID:11523, to the nucleotide sequence of GAM7776 RNA, herein designated GAM RNA, also designated SEQ ID:246.

Another function of GAM7776 is therefore inhibition of Nanog (Accession NP_079141.1). Accordingly, utilities of GAM7776 include diagnosis, prevention and treatment of diseases and clinical conditions associated with Nanog.

NCAG1 (Accession NP_115536.1) is another GAM7776 target gene, herein designated TARGET GENE. NCAG1 BINDING SITE is a target binding site found in the 3' untranslated region of mRNA encoded by NCAG1, corresponding to a target binding site such as BINDING SITE I, BINDING SITE II or BINDING SITE III of FIG. 8. Table 4 illustrates the complementarity of the nucleotide sequences of NCAG1 BINDING SITE, designated SEQ ID:3766, to the nucleotide sequence of GAM7776 RNA, herein designated GAM RNA, also designated SEQ ID:246.

Another function of GAM7776 is therefore inhibition of NCAG1 (Accession NP_115536.1). Accordingly, utilities of GAM7776 include diagnosis, prevention and treatment of diseases and clinical conditions associated with NCAG1.

Nuclear receptor coactivator 6 (NCOA6, Accession NP_054790.1) is another GAM7776 target gene, herein designated TARGET GENE. NCOA6 BINDING SITE1 and NCOA6 BINDING SITE2 are target binding sites found in untranslated regions of mRNA encoded by NCOA6, corresponding to target binding sites such as BINDING SITE I, BINDING SITE II or BINDING SITE III of FIG. 8. Table 4 illustrates the complementarity of the nucleotide sequences of NCOA6 BINDING SITE1 and NCOA6 BINDING SITE2, designated SEQ ID:12826 and SEQ ID:19446 respectively, to the nucleotide sequence of GAM7776 RNA, herein designated GAM RNA, also designated SEQ ID:246.

Another function of GAM7776 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM7776 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Nuclear receptor coactivator 6 interacting protein (NCOA6IP, Accession NP_079107.5) is another GAM7776 target gene, herein designated TARGET GENE. NCOA6IP BINDING SITE1 and NCOA6IP BINDING SITE2 are target binding sites found in untranslated regions of mRNA encoded by NCOA6IP, corresponding to target binding sites such as BINDING SITE I, BINDING SITE II or BINDING SITE III of FIG. 8. Table 4 illustrates the complementarity of the nucleotide sequences of NCOA6IP BINDING SITE1 and NCOA6IP BINDING SITE2, designated SEQ ID:8841 and SEQ ID:10534 respectively, to the nucleotide sequence of GAM7776 RNA, herein designated GAM RNA, also designated SEQ ID:246.

Another function of GAM7776 is therefore inhibition of Nuclear receptor coactivator 6 interacting protein (NCOA6IP, Accession NP_079107.5). Accordingly, utilities of GAM7776 include diagnosis, prevention and treatment of diseases and clinical conditions associated with NCOA6IP.

NDP52 (Accession NP_005822.1) is another GAM7776 target gene, herein designated TARGET GENE. NDP52 BINDING SITE is a target binding site found in the 3' untranslated region of mRNA encoded by NDP52, corresponding to a target binding site such as BINDING SITE I, BINDING SITE II or BINDING SITE III of FIG. 8. Table 4 illustrates the complementarity of the nucleotide sequences of NDP52 BINDING SITE, designated SEQ ID:15337, to the nucleotide sequence of GAM7776 RNA, herein designated GAM RNA, also designated SEQ ID:246.

Another function of GAM7776 is therefore inhibition of NDP52 (Accession NP_005822.1). Accordingly, utilities of GAM7776 include diagnosis, prevention and treatment of diseases and clinical conditions associated with NDP52.

Ndrg family member 3 (NDRG3, Accession NP_114402.1) is another GAM7776 target gene, herein designated TARGET GENE. NDRG3 BINDING SITE is a target binding site found in the 3' untranslated region of multiple transcripts of mRNA encoded by NDRG3, corresponding to a target binding site such as BINDING SITE I, BINDING SITE II or BINDING SITE III of FIG. 8. Table 4 illustrates the complementarity of the nucleotide sequences of NDRG3 BINDING SITE, designated SEQ ID:15102, to the nucleotide sequence of GAM7776 RNA, herein designated GAM RNA, also designated SEQ ID:246.

Another function of GAM7776 is therefore inhibition of Ndrg family member 3 (NDRG3, Accession NP_114402.1). Accordingly, utilities of GAM7776 include diagnosis, prevention and treatment of diseases and clinical conditions associated with NDRG3.

Nadh dehydrogenase (ubiquinone) 1, subcomplex unknown, 2, 14.5 kda (NDUFC2, Accession NP_004540.1) is another GAM7776 target gene, herein designated TARGET GENE. NDUFC2 BINDING SITE is a target binding site found in the 3' untranslated region of mRNA encoded by NDUFC2, corresponding to a target binding site such as BINDING SITE I, BINDING SITE II or BINDING SITE III of FIG. 8. Table 4 illustrates the complementarity of the nucleotide sequences of NDUFC2 BINDING SITE, designated SEQ ID:10192, to the nucleotide sequence of GAM7776 RNA, herein designated GAM RNA, also designated SEQ ID:246.

Another function of GAM7776 is therefore inhibition of Nadh dehydrogenase (ubiquinone) 1, subcomplex unknown, 2, 14.5 kda (NDUFC2, Accession NP_004540.1). Accordingly, utilities of GAM7776 include diagnosis, prevention and treatment of diseases and clinical conditions associated with NDUFC2.

Sialidase 3 (membrane sialidase) (NEU3, Accession NP_006647.2) is another GAM7776 target gene, herein designated TARGET GENE. NEU3 BINDING SITE is a target binding site found in the 5' untranslated region of mRNA encoded by NEU3, corresponding to a target binding site such as BINDING SITE I, BINDING SITE II or BINDING SITE III of FIG. 8. Table 4 illustrates the complementarity of the nucleotide sequences of NEU3 BINDING SITE, designated SEQ ID:12075, to the nucleotide sequence of GAM7776 RNA, herein designated GAM RNA, also designated SEQ ID:246.

Another function of GAM7776 is therefore inhibition of Sialidase 3 (membrane sialidase) (NEU3, Accession NP_006647.2). Accordingly, utilities of GAM7776 include diagnosis, prevention and treatment of diseases and clinical conditions associated with NEU3.

Neurofibromin 2 (bilateral acoustic neuroma) (NF2, Accession NP_057502.1) is another GAM7776 target gene, herein designated TARGET GENE. NF2 BINDING SITE is a target binding site found in the 5' untranslated region of multiple transcripts of mRNA encoded by NF2, corresponding to a target binding site such as BINDING SITE I, BINDING SITE II or BINDING SITE III of FIG. 8. Table 4 illustrates the complementarity of the nucleotide sequences of NF2 BINDING SITE, designated SEQ ID:9169, to the nucleotide sequence of GAM7776 RNA, herein designated GAM RNA, also designated SEQ ID:246.

Another function of GAM7776 is therefore inhibition of Neurofibromin 2 (bilateral acoustic neuroma) (NF2, Accession NP_057502.1). Accordingly, utilities of GAM7776 include diagnosis, prevention and treatment of diseases and clinical conditions associated with NF2.

Non-pou domain containing, octamer-binding (NONO, Accession NP_031389.2) is another GAM7776 target gene, herein designated TARGET GENE. NONO BINDING SITE is a target binding site found in the 3' untranslated region of mRNA encoded by NONO, corresponding to a target binding site such as BINDING SITE I, BINDING SITE II or BINDING SITE III of FIG. 8. Table 4 illustrates the complementarity of the nucleotide sequences of NONO BINDING SITE, designated SEQ ID:17960, to the nucleotide sequence of GAM7776 RNA, herein designated GAM RNA, also designated SEQ ID:246.

Another function of GAM7776 is therefore inhibition of Non-pou domain containing, octamer-binding (NONO, Accession NP_031389.2), a gene which is a nuclear protein which contains RNA recognition motifs. Accordingly, utilities of GAM7776 include diagnosis, prevention and treatment of diseases and clinical conditions associated with NONO.

The function of NONO and its association with various diseases and clinical conditions, has been established by previous studies, as described hereinabove with reference to GAM189.1. NOSIP (Accession NP_057037.1) is another GAM7776 target gene, herein designated TARGET GENE. NOSIP BINDING SITE is a target binding site found in the 5' untranslated region of mRNA encoded by NOSIP, corresponding to a target binding site such as BINDING SITE I, BINDING SITE II or BINDING SITE III of FIG. 8. Table 4 illustrates the complementarity of the nucleotide sequences of NOSIP BINDING SITE, designated SEQ ID:7311, to the nucleotide sequence of GAM7776 RNA, herein designated GAM RNA, also designated SEQ ID:246.

Another function of GAM7776 is therefore inhibition of NOSIP (Accession NP_057037.1). Accordingly, utilities of GAM7776 include diagnosis, prevention and treatment of diseases and clinical conditions associated with NOSIP.

Neuronal pentraxin receptor (NPTXR, Accession NP_055108.2) is another GAM7776 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:5189, to the nucleotide sequence of GAM7776 RNA, herein designated GAM RNA, also designated SEQ ID:246.

Another function of GAM7776 is therefore inhibition of Neuronal pentraxin receptor (NPTXR, Accession NP_055108.2). Accordingly, utilities of GAM7776 include diagnosis, prevention and treatment of diseases and clinical conditions associated with NPTXR.

Neuronal pentraxin receptor (NPTXR, Accession NP_478058.1) is another GAM7776 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:5189, to the nucleotide sequence of GAM7776 RNA, herein designated GAM RNA, also designated SEQ ID:246.

Another function of GAM7776 is therefore inhibition of Neuronal pentraxin receptor (NPTXR, Accession NP_478058.1). Accordingly, utilities of GAM7776 include diagnosis, prevention and treatment of diseases and clinical conditions associated with NPTXR.

Nad(p)h dehydrogenase, quinone 1 (NQO1, Accession NP_000894.1) is another GAM7776 target gene, herein designated TARGET GENE. NQO1 BINDING SITE is a target binding site found in the 3' untranslated region of mRNA encoded by NQO1, corresponding to a target binding site such as BINDING SITE I, BINDING SITE II or BINDING SITE III of FIG. 8. Table 4 illustrates the complementarity of the nucleotide sequences of NQO1 BINDING SITE, designated SEQ ID:14855, to the nucleotide sequence of GAM7776 RNA, herein designated GAM RNA, also designated SEQ ID:246.

Another function of GAM7776 is therefore inhibition of Nad(p)h dehydrogenase, quinone 1 (NQO1, Accession NP_000894.1), a gene which is cytochrome b5 reductase which reduces redox dyes and quinones. Accordingly, utilities of GAM7776 include diagnosis, prevention and treatment of diseases and clinical conditions associated with NQO1.

The function of NQO1 and its association with various diseases and clinical conditions, has been established by previous studies, as described hereinabove with reference to GAM189.1. Nuclear receptor subfamily 2, group e, member 1 (NR2E1, Accession NP_003260.1) is another GAM7776 target gene, herein designated TARGET GENE. NR2E1 BINDING SITE is a target binding site found in the 5' untranslated region of mRNA encoded by NR2E1, corresponding to a target binding site such as BINDING SITE I, BINDING SITE II or BINDING SITE III of FIG. 8. Table 4 illustrates the complementarity of the nucleotide sequences of NR2E1 BINDING SITE, designated SEQ ID:13178, to the nucleotide sequence of GAM7776 RNA, herein designated GAM RNA, also designated SEQ ID:246.

Another function of GAM7776 is therefore inhibition of Nuclear receptor subfamily 2, group e, member 1 (NR2E1, Accession NP_003260.1), a gene which may be required for brain development and be involved in the regulation of retinal development. Accordingly, utilities of GAM7776 include diagnosis, prevention and treatment of diseases and clinical conditions associated with NR2E1.

The function of NR2E1 and its association with various diseases and clinical conditions, has been established by previous studies, as described hereinabove with reference to GAM189.1. NRLN1 (Accession NP_660277.1) is another GAM7776 target gene, herein designated TARGET GENE. NRLN1 BINDING SITE is a target binding site found in the 5' untranslated region of mRNA encoded by NRLN1, corresponding to a target binding site such as BINDING SITE I, BINDING SITE II or BINDING SITE III of FIG. 8. Table 4 illustrates the complementarity of the nucleotide sequences of NRLN1 BINDING SITE, designated SEQ ID:15825, to the nucleotide sequence of GAM7776 RNA, herein designated GAM RNA, also designated SEQ ID:246.

Another function of GAM7776 is therefore inhibition of NRLN1 (Accession NP_660277.1). Accordingly, utilities of GAM7776 include diagnosis, prevention and treatment of diseases and clinical conditions associated with NRLN1.

5'-nucleotidase, cytosolic ii (NT5C2, Accession NP_036361.1) is another GAM7776 target gene, herein designated TARGET GENE. NT5C2 BINDING SITE is a target binding site found in the 5' untranslated region of mRNA encoded by NT5C2, corresponding to a target binding site such as BINDING SITE I, BINDING SITE II or BINDING SITE III of FIG. 8. Table 4 illustrates the complementarity of the nucleotide sequences of NT5C2 BINDING SITE, designated SEQ ID:4030, to the nucleotide sequence of GAM7776 RNA, herein designated GAM RNA, also designated SEQ ID:246.

Another function of GAM7776 is therefore inhibition of 5'-nucleotidase, cytosolic ii (NT5C2, Accession NP_036361.1). Accordingly, utilities of GAM7776 include diagnosis, prevention and treatment of diseases and clinical conditions associated with NT5C2.

Nudix (nucleoside diphosphate linked moiety x)-type motif 4 (NUDT4, Accession NP_061967.2) is another GAM7776 target gene, herein designated TARGET GENE. NUDT4 BINDING SITE is a target binding site found in the 3' untranslated region of mRNA encoded by NUDT4, corresponding to a target binding site such as BINDING SITE I, BINDING SITE II or BINDING SITE III of FIG. 8. Table 4 illustrates the complementarity of the nucleotide sequences of NUDT4 BINDING SITE, designated SEQ ID:18879, to the nucleotide sequence of GAM7776 RNA, herein designated GAM RNA, also designated SEQ ID:246.

Another function of GAM7776 is therefore inhibition of Nudix (nucleoside diphosphate linked moiety x)-type motif 4 (NUDT4, Accession NP_061967.2). Accordingly, utilities of GAM7776 include diagnosis, prevention and treatment of diseases and clinical conditions associated with NUDT4.

Nuclear mitotic apparatus protein 1 (NUMA1, Accession NP_006176.1) is another GAM7776 target gene, herein designated TARGET GENE. NUMA1 BINDING SITE is a target binding site found in the 5' untranslated region of mRNA encoded by NUMA1, corresponding to a target binding site such as BINDING SITE I, BINDING SITE II or BINDING SITE III of FIG. 8. Table 4 illustrates the complementarity of the nucleotide sequences of NUMA1 BINDING SITE, designated SEQ ID:14343, to the nucleotide sequence of GAM7776 RNA, herein designated GAM RNA, also designated SEQ ID:246.

Another function of GAM7776 is therefore inhibition of Nuclear mitotic apparatus protein 1 (NUMA1, Accession NP_006176.1), a gene which is nuclear mitotic apparatus protein. Accordingly, utilities of GAM7776 include diagnosis, prevention and treatment of diseases and clinical conditions associated with NUMA1.

The function of NUMA1 and its association with various diseases and clinical conditions, has been established by previous studies, as described hereinabove with reference to GAM133.1. NUP43 (Accession NP_078923.2) is another GAM7776 target gene, herein designated TARGET GENE. NUP43 BINDING SITE is a target binding site found in the 3' untranslated region of mRNA encoded by NUP43, corresponding to a target binding site such as BINDING SITE I, BINDING SITE II or BINDING SITE III of FIG. 8. Table 4 illustrates the complementarity of the nucleotide sequences of NUP43 BINDING SITE, designated SEQ ID:1900, to the nucleotide sequence of GAM7776 RNA, herein designated GAM RNA, also designated SEQ ID:246.

Another function of GAM7776 is therefore inhibition of NUP43 (Accession NP_078923.2). Accordingly, utilities of GAM7776 include diagnosis, prevention and treatment of diseases and clinical conditions associated with NUP43.

Nucleoredoxin (NXN, Accession NP_071908.1) is another GAM7776 target gene, herein designated TARGET GENE. NXN BINDING SITE is a target binding site found in the 3' untranslated region of mRNA encoded by NXN, corresponding to a target binding site such as BINDING SITE I, BINDING SITE II or BINDING SITE III of FIG. 8. Table 4 illustrates the complementarity of the nucleotide sequences of NXN BINDING SITE, designated SEQ ID:935, to the nucleotide sequence of GAM7776 RNA, herein designated GAM RNA, also designated SEQ ID:246.

Another function of GAM7776 is therefore inhibition of Nucleoredoxin (NXN, Accession NP_071908.1). Accordingly, utilities of GAM7776 include diagnosis, prevention and treatment of diseases and clinical conditions associated with NXN.

Olfactory receptor, family 51, subfamily e, member 2 (OR51E2, Accession NP_110401.1) is another GAM7776 target gene, herein designated TARGET GENE. OR51E2 BINDING SITE is a target binding site found in the 3' untranslated region of mRNA encoded by OR51E2, corresponding to a target binding site such as BINDING SITE I, BINDING SITE II or BINDING SITE III of FIG. 8. Table 4 illustrates the complementarity of the nucleotide sequences of OR51E2 BINDING SITE, designated SEQ ID:4096, to the nucleotide sequence of GAM7776 RNA, herein designated GAM RNA, also designated SEQ ID:246.

Another function of GAM7776 is therefore inhibition of Olfactory receptor, family 51, subfamily e, member 2 (OR51E2, Accession NP_110401.1). Accordingly, utilities of GAM7776 include diagnosis, prevention and treatment of diseases and clinical conditions associated with OR51E2.

Origin recognition complex, subunit 1-like (yeast) (ORC1L, Accession NP_004144.1) is another GAM7776 target gene, herein designated TARGET GENE. ORC1L BINDING SITE is a target binding site found in the 3' untranslated region of mRNA encoded by ORC1L, corresponding to a target binding site such as BINDING SITE I, BINDING SITE II or BINDING SITE III of FIG. 8. Table 4 illustrates the complementarity of the nucleotide sequences of ORC1L BINDING SITE, designated SEQ ID:17969, to the nucleotide sequence of GAM7776 RNA, herein designated GAM RNA, also designated SEQ ID:246.

Another function of GAM7776 is therefore inhibition of Origin recognition complex, subunit 1-like (yeast) (ORC1L, Accession NP_004144.1), a gene which may be required for initiation of DNA replication. Accordingly, utilities of GAM7776 include diagnosis, prevention and treatment of diseases and clinical conditions associated with ORC1L.

The function of ORC1L and its association with various diseases and clinical conditions, has been established by previous studies, as described hereinabove with reference to GAM136.1. Oxysterol binding protein-like 2 (OSBPL2, Accession NP_055650.1) is another GAM7776 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:7553, to the nucleotide sequence of GAM7776 RNA, herein designated GAM RNA, also designated SEQ ID:246.

Another function of GAM7776 is therefore inhibition of Oxysterol binding protein-like 2 (OSBPL2, Accession NP_055650.1). Accordingly, utilities of GAM7776 include diagnosis, prevention and treatment of diseases and clinical conditions associated with OSBPL2.

Oxysterol binding protein-like 2 (OSBPL2, Accession NP_653081.1) is another GAM7776 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:7553, to the nucleotide sequence of GAM7776 RNA, herein designated GAM RNA, also designated SEQ ID:246.

Another function of GAM7776 is therefore inhibition of Oxysterol binding protein-like 2 (OSBPL2, Accession NP_653081.1). Accordingly, utilities of GAM7776 include diagnosis, prevention and treatment of diseases and clinical conditions associated with OSBPL2.

Purinergic receptor p2x-like 1, orphan receptor (P2RXL1, Accession NP_005437.1) is another GAM7776 target gene, herein designated TARGET GENE. P2RXL1 BINDING SITE is a target binding site found in the 3' untranslated region of mRNA encoded by P2RXL1, corresponding to a target binding site such as BINDING SITE I, BINDING SITE II or BINDING SITE III of FIG. 8. Table 4 illustrates the complementarity of the nucleotide sequences of P2RXL1 BINDING SITE, designated SEQ ID:4425, to the nucleotide sequence of GAM7776 RNA, herein designated GAM RNA, also designated SEQ ID:246.

Another function of GAM7776 is therefore inhibition of Purinergic receptor p2x-like 1, orphan receptor (P2RXL1, Accession NP_005437.1). Accordingly, utilities of GAM7776 include diagnosis, prevention and treatment of diseases and clinical conditions associated with P2RXL1.

Purinergic receptor p2y, g-protein coupled, 1 (P2RY1, Accession NP_002554.1) is another GAM7776 target gene, herein designated TARGET GENE. P2RY1 BINDING SITE is a target binding site found in the 3' untranslated region of mRNA encoded by P2RY1, corresponding to a target binding site such as BINDING SITE I, BINDING SITE II or BINDING SITE III of FIG. 8. Table 4 illustrates the complementarity of the nucleotide sequences of P2RY1 BINDING SITE, designated SEQ ID:8453, to the nucleotide sequence of GAM7776 RNA, herein designated GAM RNA, also designated SEQ ID:246.

Another function of GAM7776 is therefore inhibition of Purinergic receptor p2y, g-protein coupled, 1 (P2RY1, Accession NP_002554.1), a gene which plays an essential role in thrombotic states. Accordingly, utilities of GAM7776 include diagnosis, prevention and treatment of diseases and clinical conditions associated with P2RY1.

The function of P2RY1 and its association with various diseases and clinical conditions, has been established by previous studies, as described hereinabove with reference to GAM189.1. P450RAI-2 (Accession NP_063938.1) is another GAM7776 target gene, herein designated TARGET GENE. P450RAI-2 BINDING SITE is a target binding site found in the 3' untranslated region of mRNA encoded by P450RAI-2, corresponding to a target binding site such as BINDING SITE I, BINDING SITE II or BINDING SITE III of FIG. 8. Table 4 illustrates the complementarity of the nucleotide sequences of P450RAI-2 BINDING SITE, designated SEQ ID:18160, to the nucleotide sequence of GAM7776 RNA, herein designated GAM RNA, also designated SEQ ID:246.

Another function of GAM7776 is therefore inhibition of P450RAI-2 (Accession NP_063938.1). Accordingly, utilities of GAM7776 include diagnosis, prevention and treatment of diseases and clinical conditions associated with P450RAI-2.

Phosphoribosylaminoimidazole carboxylase, phosphoribosylaminoimidazole succinocarboxamide synthetase (PAICS, Accession NP_006443.1) is another GAM7776 target gene, herein designated TARGET GENE. PAICS BINDING SITE is a target binding site found in the 3' untranslated region of mRNA encoded by PAICS, corresponding to a target binding site such as BINDING SITE I, BINDING SITE II or BINDING SITE III of FIG. 8. Table 4 illustrates the complementarity of the nucleotide sequences of PAICS BINDING SITE, designated SEQ ID:16852, to the nucleotide sequence of GAM7776 RNA, herein designated GAM RNA, also designated SEQ ID:246.

Another function of GAM7776 is therefore inhibition of Phosphoribosylaminoimidazole carboxylase, phosphoribosylaminoimidazole succinocarboxamide synthetase (PAICS, Accession NP_006443.1), a gene which is required for purine biosynthesis. Accordingly, utilities of GAM7776 include diagnosis, prevention and treatment of diseases and clinical conditions associated with PAICS.

The function of PAICS and its association with various diseases and clinical conditions, has been established by previous studies, as described hereinabove with reference to GAM96.1. Pas domain containing serine/threonine kinase (PASK, Accession NP_055963.1) is another GAM7776 target gene, herein designated TARGET GENE. PASK BINDING SITE is a target binding site found in the 5' untranslated region of mRNA encoded by PASK, corresponding to a target binding site such as BINDING SITE I, BINDING SITE II or BINDING SITE III of FIG. 8. Table 4 illustrates the complementarity of the nucleotide sequences of PASK BINDING SITE, designated SEQ ID:2769, to the nucleotide sequence of GAM7776 RNA, herein designated GAM RNA, also designated SEQ ID:246.

Another function of GAM7776 is therefore inhibition of Pas domain containing serine/threonine kinase (PASK, Accession NP_055963.1). Accordingly, utilities of GAM7776 include diagnosis, prevention and treatment of diseases and clinical conditions associated with PASK.

Protocadherin alpha 9 (PCDHA9, Accession NP_054724.1) is another GAM7776 target gene, herein designated TARGET GENE. PCDHA9 BINDING SITE1 and PCDHA9 BINDING SITE2 are target binding sites found in untranslated regions of multiple transcripts of mRNA encoded by PCDHA9, corresponding to target binding sites such as BINDING SITE I, BINDING SITE II or BINDING SITE III of FIG. 8. Table 4 illustrates the complementarity of the nucleotide sequences of PCDHA9 BINDING SITE1 and PCDHA9 BINDING SITE2, designated SEQ ID:16048 and SEQ ID:10427 respectively, to the nucleotide sequence of GAM7776 RNA, herein designated GAM RNA, also designated SEQ ID:246.

Another function of GAM7776 is therefore inhibition of Protocadherin alpha 9 (PCDHA9, Accession NP_054724.1), a gene which is a calcium-dependent cell-adhesion protein. Accordingly, utilities of GAM7776 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Protocadherin beta 11 (PCDHB11, Accession NP_061754.1) is another GAM7776 target gene, herein designated TARGET GENE. PCDHB11 BINDING SITE is a target binding site found in the 3' untranslated region of mRNA encoded by PCDHB11, corresponding to a target binding site such as BINDING SITE I, BINDING SITE II or BINDING SITE III of FIG. 8. Table 4 illustrates the complementarity of the nucleotide sequences of PCDHB11 BINDING SITE, designated SEQ ID:10723, to the nucleotide sequence of GAM7776 RNA, herein designated GAM RNA, also designated SEQ ID:246.

Another function of GAM7776 is therefore inhibition of Protocadherin beta 11 (PCDHB11, Accession NP_061754.1). Accordingly, utilities of GAM7776 include diagnosis, prevention and treatment of diseases and clinical conditions associated with PCDHB11.

Protocadherin beta 16 (PCDHB16, Accession NP_066008.1) is another GAM7776 target gene, herein designated TARGET GENE. PCDHB16 BINDING SITE is a target binding site found in the 3' untranslated region of mRNA encoded by PCDHB16, corresponding to a target binding site such as BINDING SITE I, BINDING SITE II or BINDING SITE III of FIG. 8. Table 4 illustrates the complementarity of the nucleotide sequences of PCDHB16 BINDING SITE, designated SEQ ID:4617, to the nucleotide sequence of GAM7776 RNA, herein designated GAM RNA, also designated SEQ ID:246.

Another function of GAM7776 is therefore inhibition of Protocadherin beta 16 (PCDHB16, Accession NP_066008.1), a gene which is a potential calcium-dependent cell-adhesion protein. Accordingly, utilities of GAM7776 include diagnosis, prevention and treatment of diseases and clinical conditions associated with PCDHB16.

The function of PCDHB16 and its association with various diseases and clinical conditions, has been established by previous studies, as described hereinabove with reference to GAM189.1. Protocadherin beta 9 (PCDHB9, Accession NP_061992.2) is another GAM7776 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:11523, to the nucleotide sequence of GAM7776 RNA, herein designated GAM RNA, also designated SEQ ID:246.

Another function of GAM7776 is therefore inhibition of Protocadherin beta 9 (PCDHB9, Accession NP_061992.2), a gene which is a potential calcium-dependent cell-adhesion protein. Accordingly, utilities of GAM7776 include diagnosis, prevention and treatment of diseases and clinical conditions associated with PCDHB9.

The function of PCDHB9 and its association with various diseases and clinical conditions, has been established by previous studies, as described hereinabove with reference to GAM72.1. Phosphodiesterase 6b, cgmp-specific, rod, beta (congenital stationary night blindness 3, autosomal dominant) (PDE6B, Accession NP_000274.1) is another GAM7776 target gene, herein designated TARGET GENE. PDE6B BINDING SITE is a target binding site found in the 3' untranslated region of mRNA encoded by PDE6B, corresponding to a target binding site such as BINDING SITE I, BINDING SITE II or BINDING SITE III of FIG. 8. Table 4 illustrates the complementarity of the nucleotide sequences of PDE6B BINDING SITE, designated SEQ ID:936, to the nucleotide sequence of GAM7776 RNA, herein designated GAM RNA, also designated SEQ ID:246.

Another function of GAM7776 is therefore inhibition of Phosphodiesterase 6b, cgmp-specific, rod, beta (congenital stationary night blindness 3, autosomal dominant) (PDE6B, Accession NP_000274.1). Accordingly, utilities of GAM7776 include diagnosis, prevention and treatment of diseases and clinical conditions associated with PDE6B.

Platelet derived growth factor c (PDGFC, Accession NP_057289.1) is another GAM7776 target gene, herein designated TARGET GENE. PDGFC BINDING SITE is a target binding site found in the 3' untranslated region of mRNA encoded by PDGFC, corresponding to a target binding site such as BINDING SITE I, BINDING SITE II or BINDING SITE III of FIG. 8. Table 4 illustrates the complementarity of the nucleotide sequences of PDGFC BINDING SITE, designated SEQ ID:905, to the nucleotide sequence of GAM7776 RNA, herein designated GAM RNA, also designated SEQ ID:246.

Another function of GAM7776 is therefore inhibition of Platelet derived growth factor c (PDGFC, Accession NP_057289.1). Accordingly, utilities of GAM7776 include diagnosis, prevention and treatment of diseases and clinical conditions associated with PDGFC.

Pdz and lim domain 2 (mystique) (PDLIM2, Accession NP_789847.1) is another GAM7776 target gene, herein designated TARGET GENE. PDLIM2 BINDING SITE is a target binding site found in the 3' untranslated region of multiple transcripts of mRNA encoded by PDLIM2, corresponding to a target binding site such as BINDING SITE I, BINDING SITE II or BINDING SITE III of FIG. 8. Table 4 illustrates the complementarity of the nucleotide sequences of PDLIM2 BINDING SITE, designated SEQ ID:14973, to the nucleotide sequence of GAM7776 RNA, herein designated GAM RNA, also designated SEQ ID:246.

Another function of GAM7776 is therefore inhibition of Pdz and lim domain 2 (mystique) (PDLIM2, Accession NP_789847.1). Accordingly, utilities of GAM7776 include diagnosis, prevention and treatment of diseases and clinical conditions associated with PDLIM2.

Pdz domain containing 1 (PDZK1, Accession NP_002605.2) is another GAM7776 target gene, herein designated TARGET GENE. PDZK1 BINDING SITE is a target binding site found in the 5' untranslated region of mRNA encoded by PDZK1, corresponding to a target binding site such as BINDING SITE I, BINDING SITE II or BINDING SITE III of FIG. 8. Table 4 illustrates the complementarity of the nucleotide sequences of PDZK1 BINDING SITE, designated SEQ ID:4194, to the nucleotide sequence of GAM7776 RNA, herein designated GAM RNA, also designated SEQ ID:246.

Another function of GAM7776 is therefore inhibition of Pdz domain containing 1 (PDZK1, Accession NP_002605.2), a gene which is a contains PDZ interaction domains, interacts with MAP17, a protein involved in control of cell proliferation. and therefore may be associated with Autosomal dominant hypophosphatemic rickets. Accordingly, utilities of GAM7776 include diagnosis, prevention and treatment of Autosomal dominant hypophosphatemic rickets, and of other diseases and clinical conditions associated with PDZK1.

The function of PDZK1 and its association with various diseases and clinical conditions, has been established by previous studies, as described hereinabove with reference to GAM136.1. PDZRN1 (Accession NP_699202.1) is another GAM7776 target gene, herein designated TARGET GENE. PDZRN1 BINDING SITE is a target binding site found in the 3' untranslated region of mRNA encoded by PDZRN1, corresponding to a target binding site such as BINDING SITE I, BINDING SITE II or BINDING SITE III of FIG. 8. Table 4 illustrates the complementarity of the nucleotide sequences of PDZRN1 BINDING SITE, designated SEQ ID:5270, to the nucleotide sequence of GAM7776 RNA, herein designated GAM RNA, also designated SEQ ID:246.

Another function of GAM7776 is therefore inhibition of PDZRN1 (Accession NP_699202.1). Accordingly, utilities of GAM7776 include diagnosis, prevention and treatment of diseases and clinical conditions associated with PDZRN1.

Pellino homolog 1 (drosophila) (PELI1, Accession NP_065702.2) is another GAM7776 target gene, herein designated TARGET GENE. PELI1 BINDING SITE1 through PELI1 BINDING SITE3 are target binding sites found in untranslated regions of mRNA encoded by PELI1, corresponding to target binding sites such as BINDING SITE I, BINDING SITE II or BINDING SITE III of FIG. 8. Table 4 illustrates the complementarity of the nucleotide sequences of PELI1 BINDING SITE1 through PELI1 BINDING SITE3, designated SEQ ID:7382, SEQ ID:14861 and SEQ ID:5491 respectively, to the nucleotide sequence of GAM7776 RNA, herein designated GAM RNA, also designated SEQ ID:246.

Another function of GAM7776 is therefore inhibition of Pellino homolog 1 (drosophila) (PELI1, Accession NP_065702.2). Accordingly, utilities of GAM7776 include diagnosis, prevention and treatment of diseases and clinical conditions associated with PELI1.

Period homolog 2 (drosophila) (PER2, Accession NP_073728.1) is another GAM7776 target gene, herein designated TARGET GENE. PER2 BINDING SITE is a target binding site found in the 3' untranslated region of multiple transcripts of mRNA encoded by PER2, corresponding to a target binding site such as BINDING SITE I, BINDING SITE II or BINDING SITE III of FIG. 8. Table 4 illustrates the complementarity of the nucleotide sequences of PER2 BINDING SITE, designated SEQ ID:19703, to the nucleotide sequence of GAM7776 RNA, herein designated GAM RNA, also designated SEQ ID:246.

Another function of GAM7776 is therefore inhibition of Period homolog 2 (drosophila) (PER2, Accession NP_073728.1), a gene which Period homolog 2; putative circadian clock protein; has a PAS dimerization domain and therefore may be associated with Familial advanced sleep-phase syndrome. Accordingly, utilities of GAM7776 include diagnosis, prevention and treatment of Familial advanced sleep-phase syndrome, and of other diseases and clinical conditions associated with PER2.

The function of PER2 and its association with various diseases and clinical conditions, has been established by previous studies, as described hereinabove with reference to GAM130.1. Phosphoribosylformylglycinamidine synthase (fgar amidotransferase) (PFAS, Accession NP_036525.1) is another GAM7776 target gene, herein designated TARGET GENE. PFAS BINDING SITE is a target binding site found in the 3' untranslated region of mRNA encoded by PFAS, corresponding to a target binding site such as BINDING SITE I, BINDING SITE II or BINDING SITE III of FIG. 8. Table 4 illustrates the complementarity of the nucleotide sequences of PFAS BINDING SITE, designated SEQ ID:16261, to the nucleotide sequence of GAM7776 RNA, herein designated GAM RNA, also designated SEQ ID:246.

Another function of GAM7776 is therefore inhibition of Phosphoribosylformylglycinamidine synthase (fgar amidotransferase) (PFAS, Accession NP_036525.1). Accordingly, utilities of GAM7776 include diagnosis, prevention and treatment of diseases and clinical conditions associated with PFAS.

PHAX (Accession NP_115553.1) is another GAM7776 target gene, herein designated TARGET GENE. PHAX BINDING SITE is a target binding site found in the 3' untranslated region of mRNA encoded by PHAX, corresponding to a target binding site such as BINDING SITE I, BINDING SITE II or BINDING SITE III of FIG. 8. Table 4 illustrates the complementarity of the nucleotide sequences of PHAX BINDING SITE, designated SEQ ID:12159, to the nucleotide sequence of GAM7776 RNA, herein designated GAM RNA, also designated SEQ ID:246.

Another function of GAM7776 is therefore inhibition of PHAX (Accession NP_115553.1). Accordingly, utilities of GAM7776 include diagnosis, prevention and treatment of diseases and clinical conditions associated with PHAX.

Polymeric immunoglobulin receptor (PIGR, Accession NP_002635.2) is another GAM7776 target gene, herein designated TARGET GENE. PIGR BINDING SITE is a target binding site found in the 3' untranslated region of mRNA encoded by PIGR, corresponding to a target binding site such as BINDING SITE I, BINDING SITE II or BINDING SITE III of FIG. 8. Table 4 illustrates the complementarity of the nucleotide sequences of PIGR BINDING SITE, designated SEQ ID:11059, to the nucleotide sequence of GAM7776 RNA, herein designated GAM RNA, also designated SEQ ID:246.

Another function of GAM7776 is therefore inhibition of Polymeric immunoglobulin receptor (PIGR, Accession NP_002635.2). Accordingly, utilities of GAM7776 include diagnosis, prevention and treatment of diseases and clinical conditions associated with PIGR.

Phosphoinositide-3-kinase, class 2, beta polypeptide (PIK3C2B, Accession NP_002637.2) is another GAM7776 target gene, herein designated TARGET GENE. PIK3C2B BINDING SITE is a target binding site found in the 3' untranslated region of mRNA encoded by PIK3C2B, corresponding to a target binding site such as BINDING SITE I, BINDING SITE II or BINDING SITE III of FIG. 8. Table 4 illustrates the complementarity of the nucleotide sequences of PIK3C2B BINDING SITE, designated SEQ ID:10488, to the nucleotide sequence of GAM7776 RNA, herein designated GAM RNA, also designated SEQ ID:246.

Another function of GAM7776 is therefore inhibition of Phosphoinositide-3-kinase, class 2, beta polypeptide (PIK3C2B, Accession NP_002637.2). Accordingly, utilities of GAM7776 include diagnosis, prevention and treatment of diseases and clinical conditions associated with PIK3C2B.

Phosphoinositide-3-kinase, class 3 (PIK3C3, Accession NP_002638.1) is another GAM7776 target gene, herein designated TARGET GENE. PIK3C3 BINDING SITE is a target binding site found in the 3' untranslated region of mRNA encoded by PIK3C3, corresponding to a target binding site such as BINDING SITE I, BINDING SITE II or BINDING SITE III of FIG. 8. Table 4 illustrates the complementarity of the nucleotide sequences of PIK3C3 BINDING SITE, designated SEQ ID:8874, to the nucleotide sequence of GAM7776 RNA, herein designated GAM RNA, also designated SEQ ID:246.

Another function of GAM7776 is therefore inhibition of Phosphoinositide-3-kinase, class 3 (PIK3C3, Accession NP_002638.1). Accordingly, utilities of GAM7776 include diagnosis, prevention and treatment of diseases and clinical conditions associated with PIK3C3.

Phosphoinositide-3-kinase, catalytic, delta polypeptide (PIK3CD, Accession NP_005017.2) is another GAM7776 target gene, herein designated TARGET GENE. PIK3CD BINDING SITE is a target binding site found in the 3' untranslated region of mRNA encoded by PIK3CD, corresponding to a target binding site such as BINDING SITE I, BINDING SITE II or BINDING SITE III of FIG. 8. Table 4 illustrates the complementarity of the nucleotide sequences of PIK3CD BINDING SITE, designated SEQ ID:9545, to the nucleotide sequence of GAM7776 RNA, herein designated GAM RNA, also designated SEQ ID:246.

Another function of GAM7776 is therefore inhibition of Phosphoinositide-3-kinase, catalytic, delta polypeptide (PIK3CD, Accession NP_005017.2), a gene which regulating cell growth. Accordingly, utilities of GAM7776 include diagnosis, prevention and treatment of diseases and clinical conditions associated with PIK3CD.

The function of PIK3CD and its association with various diseases and clinical conditions, has been established by previous studies, as described hereinabove with reference to GAM136.1. Pbx/knotted 1 homeobox (PKNOX1, Accession NP_004562.2) is another GAM7776 target gene, herein designated TARGET GENE. PKNOX1 BINDING SITE is a target binding site found in the 3' untranslated region of mRNA encoded by PKNOX1, corresponding to a target binding site such as BINDING SITE I, BINDING SITE II or BINDING SITE III of FIG. 8. Table 4 illustrates the complementarity of the nucleotide sequences of PKNOX1 BINDING SITE, designated SEQ ID:8826, to the nucleotide sequence of GAM7776 RNA, herein designated GAM RNA, also designated SEQ ID:246.

Another function of GAM7776 is therefore inhibition of Pbx/knotted 1 homeobox (PKNOX1, Accession NP_004562.2), a gene which may regulate gene expression and control cell differentiation. Accordingly, utilities of GAM7776 include diagnosis, prevention and treatment of diseases and clinical conditions associated with PKNOX1.

The function of PKNOX1 and its association with various diseases and clinical conditions, has been established by previous studies, as described hereinabove with reference to GAM55.1. Phospholipase a2, group vi (cytosolic, calcium-independent) (PLA2G6, Accession NP_003551.1) is another GAM7776 target gene, herein designated TARGET GENE. PLA2G6 BINDING SITE is a target binding site found in the 3' untranslated region of mRNA encoded by PLA2G6, corresponding to a target binding site such as BINDING SITE I, BINDING SITE II or BINDING SITE III of FIG. 8. Table 4 illustrates the complementarity of the nucleotide sequences of PLA2G6 BINDING SITE, designated SEQ ID:16143, to the nucleotide sequence of GAM7776 RNA, herein designated GAM RNA, also designated SEQ ID:246.

Another function of GAM7776 is therefore inhibition of Phospholipase a2, group vi (cytosolic, calcium-independent) (PLA2G6, Accession NP_003551.1). Accordingly, utilities of GAM7776 include diagnosis, prevention and treatment of diseases and clinical conditions associated with PLA2G6.

Pro-melanin-concentrating hormone-like 1 (PMCHL1, Accession NP_114093.1) is another GAM7776 target gene, herein designated TARGET GENE. PMCHL1 BINDING SITE is a target binding site found in the 3' untranslated region of mRNA encoded by PMCHL1, corresponding to a target binding site such as BINDING SITE I, BINDING SITE II or BINDING SITE III of FIG. 8. Table 4 illustrates the complementarity of the nucleotide sequences of PMCHL1 BINDING SITE, designated SEQ ID:16917, to the nucleotide sequence of GAM7776 RNA, herein designated GAM RNA, also designated SEQ ID:246.

Another function of GAM7776 is therefore inhibition of Pro-melanin-concentrating hormone-like 1 (PMCHL1, Accession NP_114093.1). Accordingly, utilities of GAM7776 include diagnosis, prevention and treatment of diseases and clinical conditions associated with PMCHL1.

Pro-melanin-concentrating hormone-like 2 (PMCHL2, Accession NP_114094.1) is another GAM7776 target gene, herein designated TARGET GENE. PMCHL2 BINDING SITE is a target binding site found in the 3' untranslated region of mRNA encoded by PMCHL2, corresponding to a target binding site such as BINDING SITE I, BINDING SITE II or BINDING SITE III of FIG. 8. Table 4 illustrates the complementarity of the nucleotide sequences of PMCHL2 BINDING SITE, designated SEQ ID:16917, to the nucleotide sequence of GAM7776 RNA, herein designated GAM RNA, also designated SEQ ID:246.

Another function of GAM7776 is therefore inhibition of Pro-melanin-concentrating hormone-like 2 (PMCHL2, Accession NP_114094.1). Accordingly, utilities of GAM7776 include diagnosis, prevention and treatment of diseases and clinical conditions associated with PMCHL2.

PMPCA (Accession NP_055975.1) is another GAM7776 target gene, herein designated TARGET GENE. PMPCA BINDING SITE is a target binding site found in the 3' untranslated region of mRNA encoded by PMPCA, corresponding to a target binding site such as BINDING SITE I, BINDING SITE II or BINDING SITE III of FIG. 8. Table 4 illustrates the complementarity of the nucleotide sequences of PMPCA BINDING SITE, designated SEQ ID:7640, to the nucleotide sequence of GAM7776 RNA, herein designated GAM RNA, also designated SEQ ID:246.

Another function of GAM7776 is therefore inhibition of PMPCA (Accession NP_055975.1). Accordingly, utilities of GAM7776 include diagnosis, prevention and treatment of diseases and clinical conditions associated with PMPCA.

Paraneoplastic antigen ma2 (PNMA2, Accession NP_009188.1) is another GAM7776 target gene, herein designated TARGET GENE. PNMA2 BINDING SITE1 and PNMA2 BINDING SITE2 are target binding sites found in untranslated regions of mRNA encoded by PNMA2, corresponding to target binding sites such as BINDING SITE I, BINDING SITE II or BINDING SITE III of FIG. 8. Table 4 illustrates the complementarity of the nucleotide sequences of PNMA2 BINDING SITE1 and PNMA2 BINDING SITE2, designated SEQ ID:8006 and SEQ ID:17067 respectively, to the nucleotide sequence of GAM7776 RNA, herein designated GAM RNA, also designated SEQ ID:246.

Another function of GAM7776 is therefore inhibition of Paraneoplastic antigen ma2 (PNMA2, Accession NP_009188.1). Accordingly, utilities of GAM7776 include diagnosis, prevention and treatment of diseases and clinical conditions associated with PNMA2.

Protein o-fucosyltransferase 1 (POFUT1, Accession NP_056167.1) is another GAM7776 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:11287, to the nucleotide sequence of GAM7776 RNA, herein designated GAM RNA, also designated SEQ ID:246.

Another function of GAM7776 is therefore inhibition of Protein o-fucosyltransferase 1 (POFUT1, Accession NP_056167.1). Accordingly, utilities of GAM7776 include diagnosis, prevention and treatment of diseases and clinical conditions associated with POFUT1.

Polymerase (dna directed), epsilon 3 (p17 subunit) (POLE3, Accession NP_059139.2) is another GAM7776 target gene, herein designated TARGET GENE. POLE3 BINDING SITE is a target binding site found in the 3' untranslated region of mRNA encoded by POLE3, corresponding to a target binding site such as BINDING SITE I, BINDING SITE II or BINDING SITE III of FIG. 8. Table 4 illustrates the complementarity of the nucleotide sequences of POLE3 BINDING SITE, designated SEQ ID:6151, to the nucleotide sequence of GAM7776 RNA, herein designated GAM RNA, also designated SEQ ID:246.

Another function of GAM7776 is therefore inhibition of Polymerase (dna directed), epsilon 3 (p17 subunit) (POLE3, Accession NP_059139.2). Accordingly, utilities of GAM7776 include diagnosis, prevention and treatment of diseases and clinical conditions associated with POLE3.

Polymerase (rna) ii (dna directed) polypeptide d (POLR2D, Accession NP_004796.1) is another GAM7776 target gene, herein designated TARGET GENE. POLR2D BINDING SITE1 and POLR2D BINDING SITE2 are target binding sites found in untranslated regions of mRNA encoded by POLR2D, corresponding to target binding sites such as BINDING SITE I, BINDING SITE II or BINDING SITE III of FIG. 8. Table 4 illustrates the complementarity of the nucleotide sequences of POLR2D BINDING SITE1 and POLR2D BINDING SITE2, designated SEQ ID:2798 and SEQ ID:5412 respectively, to the nucleotide sequence of GAM7776 RNA, herein designated GAM RNA, also designated SEQ ID:246.

Another function of GAM7776 is therefore inhibition of Polymerase (rna) ii (dna directed) polypeptide d (POLR2D, Accession NP_004796.1). Accordingly, utilities of GAM7776 include diagnosis, prevention and treatment of diseases and clinical conditions associated with POLR2D.

Paraoxonase 1 (PON1, Accession NP_000437.3) is another GAM7776 target gene, herein designated TARGET GENE. PON1 BINDING SITE is a target binding site found in the 3' untranslated region of mRNA encoded by PON1, corresponding to a target binding site such as BINDING SITE I, BINDING SITE II or BINDING SITE III of FIG. 8. Table 4 illustrates the complementarity of the nucleotide sequences of PON1 BINDING SITE, designated SEQ ID:2152, to the nucleotide sequence of GAM7776 RNA, herein designated GAM RNA, also designated SEQ ID:246.

Another function of GAM7776 is therefore inhibition of Paraoxonase 1 (PON1, Accession NP_000437.3), a gene which hydrolyzes the toxic metabolites of a variety of organophosphorus insecticides. Accordingly, utilities of GAM7776 include diagnosis, prevention and treatment of diseases and clinical conditions associated with PON1.

The function of PON1 and its association with various diseases and clinical conditions, has been established by previous studies, as described hereinabove with reference to GAM189.1. Pou domain, class 2, associating factor 1 (POU2AF1, Accession NP_006226.1) is another GAM7776 target gene, herein designated TARGET GENE. POU2AF1 BINDING SITE is a target binding site found in the 3' untranslated region of mRNA encoded by POU2AF1, corresponding to a target binding site such as BINDING SITE I, BINDING SITE II or BINDING SITE III of FIG. 8. Table 4 illustrates the complementarity of the nucleotide sequences of POU2AF1 BINDING SITE, designated SEQ ID:20135, to the nucleotide sequence of GAM7776 RNA, herein designated GAM RNA, also designated SEQ ID:246.

Another function of GAM7776 is therefore inhibition of Pou domain, class 2, associating factor 1 (POU2AF1, Accession NP_006226.1), a gene which is a transcriptional coactivator that specifically associates with either oct1 or oct2 and therefore may be associated with A form of b-cell leukemia. Accordingly, utilities of GAM7776 include diagnosis, prevention and treatment of A form of b-cell leukemia, and of other diseases and clinical conditions associated with POU2AF1.

The function of POU2AF1 and its association with various diseases and clinical conditions, has been established by previous studies, as described hereinabove with reference to GAM30.1. Pou domain, class 2, transcription factor 3 (POU2F3, Accession NP_055167.1) is another GAM7776 target gene, herein designated TARGET GENE. POU2F3 BINDING SITE is a target binding site found in the 3' untranslated region of mRNA encoded by POU2F3, corresponding to a target binding site such as BINDING SITE I, BINDING SITE II or BINDING SITE III of FIG. 8. Table 4 illustrates the complementarity of the nucleotide sequences of POU2F3 BINDING SITE, designated SEQ ID:16114, to the nucleotide sequence of GAM7776 RNA, herein designated GAM RNA, also designated SEQ ID:246.

Another function of GAM7776 is therefore inhibition of Pou domain, class 2, transcription factor 3 (POU2F3, Accession NP_055167.1). Accordingly, utilities of GAM7776 include diagnosis, prevention and treatment of diseases and clinical conditions associated with POU2F3.

PP1628 (Accession NP_079477.1) is another GAM7776 target gene, herein designated TARGET GENE. PP1628 BINDING SITE is a target binding site found in the 5' untranslated region of mRNA encoded by PP1628, corresponding to a target binding site such as BINDING SITE I, BINDING SITE II or BINDING SITE III of FIG. 8. Table 4 illustrates the complementarity of the nucleotide sequences of PP1628 BINDING SITE, designated SEQ ID:10180, to the nucleotide sequence of GAM7776 RNA, herein designated GAM RNA, also designated SEQ ID:246.

Another function of GAM7776 is therefore inhibition of PP1628 (Accession NP_079477.1). Accordingly, utilities of GAM7776 include diagnosis, prevention and treatment of diseases and clinical conditions associated with PP1628.

PP3111 (Accession NP_071439.2) is another GAM7776 target gene, herein designated TARGET GENE. PP3111 BINDING SITE is a target binding site found in the 3' untranslated region of mRNA encoded by PP3111, corresponding to a target binding site such as BINDING SITE I, BINDING SITE II or BINDING SITE III of FIG. 8. Table 4 illustrates the complementarity of the nucleotide sequences of PP3111 BINDING SITE, designated SEQ ID:10883, to the nucleotide sequence of GAM7776 RNA, herein designated GAM RNA, also designated SEQ ID:246.

Another function of GAM7776 is therefore inhibition of PP3111 (Accession NP_071439.2). Accordingly, utilities of GAM7776 include diagnosis, prevention and treatment of diseases and clinical conditions associated with PP3111.

PP3856 (Accession NP_660202.1) is another GAM7776 target gene, herein designated TARGET GENE. PP3856 BINDING SITE is a target binding site found in the 5' untranslated region of mRNA encoded by PP3856, corresponding to a target binding site such as BINDING SITE I, BINDING SITE II or BINDING SITE III of FIG. 8. Table 4 illustrates the complementarity of the nucleotide sequences of PP3856 BINDING SITE, designated SEQ ID:10744, to the nucleotide sequence of GAM7776 RNA, herein designated GAM RNA, also designated SEQ ID:246.

Another function of GAM7776 is therefore inhibition of PP3856 (Accession NP_660202.1). Accordingly, utilities of GAM7776 include diagnosis, prevention and treatment of diseases and clinical conditions associated with PP3856.

Phosphatidic acid phosphatase type 2c (PPAP2C, Accession NP_003703.1) is another GAM7776 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM7776 RNA, herein designated GAM RNA, also designated SEQ ID:246.

Another function of GAM7776 is therefore inhibition of Phosphatidic acid phosphatase type 2c (PPAP2C, Accession NP_003703.1). Accordingly, utilities of GAM7776 include diagnosis, prevention and treatment of diseases and clinical conditions associated with PPAP2C.

Phosphatidic acid phosphatase type 2c (PPAP2C, Accession NP_803545.1) is another GAM7776 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM7776 RNA, herein designated GAM RNA, also designated SEQ ID:246.

Another function of GAM7776 is therefore inhibition of Phosphatidic acid phosphatase type 2c (PPAP2C, Accession NP_803545.1). Accordingly, utilities of GAM7776 include diagnosis, prevention and treatment of diseases and clinical conditions associated with PPAP2C.

Phosphatidic acid phosphatase type 2c (PPAP2C, Accession NP_808211.1) is another GAM7776 target gene, herein designated TARGET GENE. PPAP2C BINDING SITE is a target binding site found in the 3' untranslated region of multiple transcripts of mRNA encoded by PPAP2C, corresponding to a target binding site such as BINDING SITE I, BINDING SITE II or BINDING SITE III of FIG. 8. Table 4 illustrates the complementarity of the nucleotide sequences of PPAP2C BINDING SITE, designated SEQ ID:7299, to the nucleotide sequence of GAM7776 RNA, herein designated GAM RNA, also designated SEQ ID:246.

Another function of GAM7776 is therefore inhibition of Phosphatidic acid phosphatase type 2c (PPAP2C, Accession NP_808211.1). Accordingly, utilities of GAM7776 include diagnosis, prevention and treatment of diseases and clinical conditions associated with PPAP2C.

Protein phosphatase, ef hand calcium-binding domain 2 (PPEF2, Accession NP_690911.1) is another GAM7776 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM7776 RNA, herein designated GAM RNA, also designated SEQ ID:246.

Another function of GAM7776 is therefore inhibition of Protein phosphatase, ef hand calcium-binding domain 2 (PPEF2, Accession NP_690911.1), a gene which is a homolog of Drosophila rdgC. Accordingly, utilities of GAM7776 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_690910.1) is another GAM7776 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM7776 RNA, herein designated GAM RNA, also designated SEQ ID:246.

Another function of GAM7776 is therefore inhibition of Protein phosphatase, ef hand calcium-binding domain 2 (PPEF2, Accession NP_690910.1), a gene which is a homolog of Drosophila rdgC. Accordingly, utilities of GAM7776 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein phosphatase, ef hand calcium-binding domain 2 (PPEF2, Accession NP_006230.2) is another GAM7776 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:2954, to the nucleotide sequence of GAM7776 RNA, herein designated GAM RNA, also designated SEQ ID:246.

Another function of GAM7776 is therefore inhibition of Protein phosphatase, ef hand calcium-binding domain 2 (PPEF2, Accession NP_006230.2), a gene which is a homolog of Drosophila rdgC. Accordingly, utilities of GAM7776 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein tyrosine phosphatase, receptor type, f polypeptide (ptprf), interacting protein (liprin), alpha 4 (PPFIA4, Accession XP_046751.3) is another GAM7776 target gene, herein designated TARGET GENE. PPFIA4 BINDING SITE is a target binding site found in the 5' untranslated region of mRNA encoded by PPFIA4, corresponding to a target binding site such as BINDING SITE I, BINDING SITE II or BINDING SITE III of FIG. 8. Table 4 illustrates the complementarity of the nucleotide sequences of PPFIA4 BINDING SITE, designated SEQ ID:16851, to the nucleotide sequence of GAM7776 RNA, herein designated GAM RNA, also designated SEQ ID:246.

Another function of GAM7776 is therefore inhibition of Protein tyrosine phosphatase, receptor type, f polypeptide (ptprf), interacting protein (liprin), alpha 4 (PPFIA4, Accession XP_046751.3). Accordingly, utilities of GAM7776 include diagnosis, prevention and treatment of diseases and clinical conditions associated with PPFIA4.

Ptprf interacting protein, binding protein 1 (liprin beta 1) (PPFIBP1, Accession NP_003613.2) is another GAM7776 target gene, herein designated TARGET GENE. PPFIBP1 BINDING SITE1 through PPFIBP1 BINDING SITE3 are target binding sites found in untranslated regions of multiple transcripts of mRNA encoded by PPFIBP1, corresponding to target binding sites such as BINDING SITE I, BINDING SITE II or BINDING SITE III of FIG. 8. Table 4 illustrates the complementarity of the nucleotide sequences of PPFIBP1 BINDING SITE1 through PPFIBP1 BINDING SITE3, designated SEQ ID:12217, SEQ ID:10708 and SEQ ID:8231 respectively, to the nucleotide sequence of GAM7776 RNA, herein designated GAM RNA, also designated SEQ ID:246.

Another function of GAM7776 is therefore inhibition of Ptprf interacting protein, binding protein 1 (liprin beta 1) (PPFIBP1, Accession NP_003613.2). Accordingly, utilities of GAM7776 include diagnosis, prevention and treatment of diseases and clinical conditions associated with PPFIBP1.

Peptidylprolyl isomerase d (cyclophilin d) (PPID, Accession NP_005029.1) is another GAM7776 target gene, herein designated TARGET GENE. PPID BINDING SITE is a target binding site found in the 3' untranslated region of mRNA encoded by PPID, corresponding to a target binding site such as BINDING SITE I, BINDING SITE II or BINDING SITE III of FIG. 8. Table 4 illustrates the complementarity of the nucleotide sequences of PPID BINDING SITE, designated SEQ ID:7378, to the nucleotide sequence of GAM7776 RNA, herein designated GAM RNA, also designated SEQ ID:246.

Another function of GAM7776 is therefore inhibition of Peptidylprolyl isomerase d (cyclophilin d) (PPID, Accession NP_005029.1), a gene which catalyzes the cis-trans isomerization of proline imidic peptide bonds in oligopeptides. Accordingly, utilities of GAM7776 include diagnosis, prevention and treatment of diseases and clinical conditions associated with PPID.

The function of PPID and its association with various diseases and clinical conditions, has been established by previous studies, as described hereinabove with reference to GAM136.1. Peptidylprolyl isomerase (cyclophilin)-like 2 (PPIL2, Accession NP_055152.1) is another GAM7776 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:13122, to the nucleotide sequence of GAM7776 RNA, herein designated GAM RNA, also designated SEQ ID:246.

Another function of GAM7776 is therefore inhibition of Peptidylprolyl isomerase (cyclophilin)-like 2 (PPIL2, Accession NP_055152.1). Accordingly, utilities of GAM7776 include diagnosis, prevention and treatment of diseases and clinical conditions associated with PPIL2.

Protein phosphatase 1, regulatory (inhibitor) subunit 12b (PPP1R12B, Accession NP_002472.1) is another GAM7776 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:3861, to the nucleotide sequence of GAM7776 RNA, herein designated GAM RNA, also designated SEQ ID:246.

Another function of GAM7776 is therefore inhibition of Protein phosphatase 1, regulatory (inhibitor) subunit 12b (PPP1R12B, Accession NP_002472.1). Accordingly, utilities of GAM7776 include diagnosis, prevention and treatment of diseases and clinical conditions associated with PPP1R12B.

Protein phosphatase 1, regulatory (inhibitor) subunit 12b (PPP1R12B, Accession NP_115288.1) is another GAM7776 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:3861, to the nucleotide sequence of GAM7776 RNA, herein designated GAM RNA, also designated SEQ ID:246.

Another function of GAM7776 is therefore inhibition of Protein phosphatase 1, regulatory (inhibitor) subunit 12b (PPP1R12B, Accession NP_115288.1). Accordingly, utilities of GAM7776 include diagnosis, prevention and treatment of diseases and clinical conditions associated with PPP1R12B.

Protein kinase, interferon-inducible double stranded rna dependent (PRKR, Accession NP_002750.1) is another GAM7776 target gene, herein designated TARGET GENE. PRKR BINDING SITE is a target binding site found in the 3' untranslated region of mRNA encoded by PRKR, corresponding to a target binding site such as BINDING SITE I, BINDING SITE II or BINDING SITE III of FIG. 8. Table 4 illustrates the complementarity of the nucleotide sequences of PRKR BINDING SITE, designated SEQ ID:4790, to the nucleotide sequence of GAM7776 RNA, herein designated GAM RNA, also designated SEQ ID:246.

Another function of GAM7776 is therefore inhibition of Protein kinase, interferon-inducible double stranded rna dependent (PRKR, Accession NP_002750.1), a gene which catalyze the phosphorylation of the alpha subunit of eif2. and therefore may be associated with Huntington's disease. Accordingly, utilities of GAM7776 include diagnosis, prevention and treatment of Huntington's disease, and of other diseases and clinical conditions associated with PRKR.

The function of PRKR and its association with various diseases and clinical conditions, has been established by previous studies, as described hereinabove with reference to GAM136.1. Protein kinase, lysine deficient 3 (PRKWNK3, Accession NP_065973.1) is another GAM7776 target gene, herein designated TARGET GENE. PRKWNK3 BINDING SITE is a target binding site found in the 3' untranslated region of mRNA encoded by PRKWNK3, corresponding to a target binding site such as BINDING SITE I, BINDING SITE II or BINDING SITE III of FIG. 8. Table 4 illustrates the complementarity of the nucleotide sequences of PRKWNK3 BINDING SITE, designated SEQ ID:14862, to the nucleotide sequence of GAM7776 RNA, herein designated GAM RNA, also designated SEQ ID:246.

Another function of GAM7776 is therefore inhibition of Protein kinase, lysine deficient 3 (PRKWNK3, Accession NP_065973.1). Accordingly, utilities of GAM7776 include diagnosis, prevention and treatment of diseases and clinical conditions associated with PRKWNK3.

Prion protein 2 (dublet) (PRND, Accession NP_036541.1) is another GAM7776 target gene, herein designated TARGET GENE. PRND BINDING SITE1 and PRND BINDING SITE2 are target binding sites found in untranslated regions of mRNA encoded by PRND, corresponding to target binding sites such as BINDING SITE I, BINDING SITE II or BINDING SITE III of FIG. 8. Table 4 illustrates the complementarity of the nucleotide sequences of PRND BINDING SITE1 and PRND BINDING SITE2, designated SEQ ID:1539 and SEQ ID:4170 respectively, to the nucleotide sequence of GAM7776 RNA, herein designated GAM RNA, also designated SEQ ID:246.

Another function of GAM7776 is therefore inhibition of Prion protein 2 (dublet) (PRND, Accession NP_036541.1), a gene which is similar to prion protein PRNP. Accordingly, utilities of GAM7776 include diagnosis, prevention and treatment of diseases and clinical conditions associated with PRND.

The function of PRND and its association with various diseases and clinical conditions, has been established by previous studies, as described hereinabove with reference to GAM116.1. PRO0297 (Accession NP_054800.1) is another GAM7776 target gene, herein designated TARGET GENE. PRO0297 BINDING SITE is a target binding site found in the 5' untranslated region of mRNA encoded by PRO0297, corresponding to a target binding site such as BINDING SITE I, BINDING SITE II or BINDING SITE III of FIG. 8. Table 4 illustrates the complementarity of the nucleotide sequences of PRO0297 BINDING SITE, designated SEQ ID:10574, to the nucleotide sequence of GAM7776 RNA, herein designated GAM RNA, also designated SEQ ID:246.

Another function of GAM7776 is therefore inhibition of PRO0297 (Accession NP_054800.1). Accordingly, utilities of GAM7776 include diagnosis, prevention and treatment of diseases and clinical conditions associated with PRO0297.

PRO0365 (Accession NP_054845.1) is another GAM7776 target gene, herein designated TARGET GENE. PRO0365 BINDING SITE is a target binding site found in the 5' untranslated region of mRNA encoded by PRO0365, corresponding to a target binding site such as BINDING SITE I, BINDING SITE II or BINDING SITE III of FIG. 8. Table 4 illustrates the complementarity of the nucleotide sequences of PRO0365 BINDING SITE, designated SEQ ID:18148, to the nucleotide sequence of GAM7776 RNA, herein designated GAM RNA, also designated SEQ ID:246.

Another function of GAM7776 is therefore inhibition of PRO0365 (Accession NP_054845.1). Accordingly, utilities of GAM7776 include diagnosis, prevention and treatment of diseases and clinical conditions associated with PRO0365.

PRO1048 (Accession NP_060967.1) is another GAM7776 target gene, herein designated TARGET GENE. PRO1048 BINDING SITE is a target binding site found in the 3' untranslated region of mRNA encoded by PRO1048, corresponding to a target binding site such as BINDING SITE I, BINDING SITE II or BINDING SITE III of FIG. 8. Table 4 illustrates the complementarity of the nucleotide sequences of PRO1048 BINDING SITE, designated SEQ ID:12596, to the nucleotide sequence of GAM7776 RNA, herein designated GAM RNA, also designated SEQ ID:246.

Another function of GAM7776 is therefore inhibition of PRO1048 (Accession NP_060967.1). Accordingly, utilities of GAM7776 include diagnosis, prevention and treatment of diseases and clinical conditions associated with PRO1048.

PRO2730 (Accession NP_079498.1) is another GAM7776 target gene, herein designated TARGET GENE. PRO2730 BINDING SITE is a target binding site found in the 3' untranslated region of mRNA encoded by PRO2730, corresponding to a target binding site such as BINDING SITE I, BINDING SITE II or BINDING SITE III of FIG. 8. Table 4 illustrates the complementarity of the nucleotide sequences of PRO2730 BINDING SITE, designated SEQ ID:2048, to the nucleotide sequence of GAM7776 RNA, herein designated GAM RNA, also designated SEQ ID:246.

Another function of GAM7776 is therefore inhibition of PRO2730 (Accession NP_079498.1). Accordingly, utilities of GAM7776 include diagnosis, prevention and treatment of diseases and clinical conditions associated with PRO2730.

PROM2 (Accession NP_653308.1) is another GAM7776 target gene, herein designated TARGET GENE. PROM2 BINDING SITE1 and PROM2 BINDING SITE2 are target binding sites found in untranslated regions of mRNA encoded by PROM2, corresponding to target binding sites such as BINDING SITE I, BINDING SITE II or BINDING SITE III of FIG. 8. Table 4 illustrates the complementarity of the nucleotide sequences of PROM2 BINDING SITE1 and PROM2 BINDING SITE2, designated SEQ ID:13176 and SEQ ID:2147 respectively, to the nucleotide sequence of GAM7776 RNA, herein designated GAM RNA, also designated SEQ ID:246.

Another function of GAM7776 is therefore inhibition of PROM2 (Accession NP_653308.1). Accordingly, utilities of GAM7776 include diagnosis, prevention and treatment of diseases and clinical conditions associated with PROM2.

Prp31 pre-mrna processing factor 31 homolog (yeast) (PRPF31, Accession NP_056444.1) is another GAM7776 target gene, herein designated TARGET GENE. PRPF31 BINDING SITE is a target binding site found in the 3' untranslated region of mRNA encoded by PRPF31, corresponding to a target binding site such as BINDING SITE I, BINDING SITE II or BINDING SITE III of FIG. 8. Table 4 illustrates the complementarity of the nucleotide sequences of PRPF31 BINDING SITE, designated SEQ ID:11313, to the nucleotide sequence of GAM7776 RNA, herein designated GAM RNA, also designated SEQ ID:246.

Another function of GAM7776 is therefore inhibition of Prp31 pre-mrna processing factor 31 homolog (yeast) (PRPF31, Accession NP_056444.1), a gene which is likely to be involved in pre-mRNA splicing and therefore is associated with Retinitis pigmentosa. Accordingly, utilities of GAM7776 include diagnosis, prevention and treatment of Retinitis pigmentosa, and of other diseases and clinical conditions associated with PRPF31.

The function of PRPF31 and its association with various diseases and clinical conditions, has been established by previous studies, as described hereinabove with reference to GAM189.1. Proteasome (prosome, macropain) 26s subunit, non-atpase, 9 (PSMD9, Accession NP_002804.2) is another GAM7776 target gene, herein designated TARGET GENE. PSMD9 BINDING SITE is a target binding site found in the 3' untranslated region of mRNA encoded by PSMD9, corresponding to a target binding site such as BINDING SITE I, BINDING SITE II or BINDING SITE III of FIG. 8. Table 4 illustrates the complementarity of the nucleotide sequences of PSMD9 BINDING SITE, designated SEQ ID:17758, to the nucleotide sequence of GAM7776 RNA, herein designated GAM RNA, also designated SEQ ID:246.

Another function of GAM7776 is therefore inhibition of Proteasome (prosome, macropain) 26s subunit, non-atpase, 9 (PSMD9, Accession NP_002804.2), a gene which acts as a regulatory subunit of the 26 proteasome. Accordingly, utilities of GAM7776 include diagnosis, prevention and treatment of diseases and clinical conditions associated with PSMD9.

The function of PSMD9 and its association with various diseases and clinical conditions, has been established by previous studies, as described hereinabove with reference to GAM30.1. Phosphoserine phosphatase (PSPH, Accession NP_004568.1) is another GAM7776 target gene, herein designated TARGET GENE. PSPH BINDING SITE is a target binding site found in the 3' untranslated region of mRNA encoded by PSPH, corresponding to a target binding site such as BINDING SITE I, BINDING SITE II or BINDING SITE III of FIG. 8. Table 4 illustrates the complementarity of the nucleotide sequences of PSPH BINDING SITE, designated SEQ ID:15044, to the nucleotide sequence of GAM7776 RNA, herein designated GAM RNA, also designated SEQ ID:246.

Another function of GAM7776 is therefore inhibition of Phosphoserine phosphatase (PSPH, Accession NP_004568.1). Accordingly, utilities of GAM7776 include diagnosis, prevention and treatment of diseases and clinical conditions associated with PSPH.

Prostaglandin e synthase (PTGES, Accession NP_004869.1) is another GAM7776 target gene, herein designated TARGET GENE. PTGES BINDING SITE is a target binding site found in the 3' untranslated region of mRNA encoded by PTGES, corresponding to a target binding site such as BINDING SITE I, BINDING SITE II or BINDING SITE III of FIG. 8. Table 4 illustrates the complementarity of the nucleotide sequences of PTGES BINDING SITE, designated SEQ ID:16070, to the nucleotide sequence of GAM7776 RNA, herein designated GAM RNA, also designated SEQ ID:246.

Another function of GAM7776 is therefore inhibition of Prostaglandin e synthase (PTGES, Accession NP_004869.1). Accordingly, utilities of GAM7776 include diagnosis, prevention and treatment of diseases and clinical conditions associated with PTGES.

Prostaglandin i2 (prostacyclin) synthase (PTGIS, Accession NP_000952.1) is another GAM7776 target gene, herein designated TARGET GENE. PTGIS BINDING SITE1 and PTGIS BINDING SITE2 are target binding sites found in untranslated regions of mRNA encoded by PTGIS, corresponding to target binding sites such as BINDING SITE I, BINDING SITE II or BINDING SITE III of FIG. 8. Table 4 illustrates the complementarity of the nucleotide sequences of PTGIS BINDING SITE1 and PTGIS BINDING SITE2, designated SEQ ID:17361 and SEQ ID:10783 respectively, to the nucleotide sequence of GAM7776 RNA, herein designated GAM RNA, also designated SEQ ID:246.

Another function of GAM7776 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM7776 include diagnosis, prevention and treatment of diseases and clinical conditions associated with PTGIS.

The function of PTGIS and its association with various diseases and clinical conditions, has been established by previous studies, as described hereinabove with reference to GAM30.1. Ptk2 protein tyrosine kinase 2 (PTK2, Accession NP_005598.3) is another GAM7776 target gene, herein designated TARGET GENE. PTK2 BINDING SITE is a target binding site found in the 5' untranslated region of multiple transcripts of mRNA encoded by PTK2, corresponding to a target binding site such as BINDING SITE I, BINDING SITE II or BINDING SITE III of FIG. 8. Table 4 illustrates the complementarity of the nucleotide sequences of PTK2 BINDING SITE, designated SEQ ID:10355, to the nucleotide sequence of GAM7776 RNA, herein designated GAM RNA, also designated SEQ ID:246.

Another function of GAM7776 is therefore inhibition of Ptk2 protein tyrosine kinase 2 (PTK2, Accession NP_005598.3), a gene which involves in intracellular signal transduction pathway and is a putative homolog of chicken focal adhesion associated kinase. Accordingly, utilities of GAM7776 include diagnosis, prevention and treatment of diseases and clinical conditions associated with PTK2.

The function of PTK2 and its association with various diseases and clinical conditions, has been established by previous studies, as described hereinabove with reference to GAM65.2. Phosphorylase, glycogen; muscle (mcardle syndrome, glycogen storage disease type v) (PYGM, Accession NP_005600.1) is another GAM7776 target gene, herein designated TARGET GENE. PYGM BINDING SITE is a target binding site found in the 5' untranslated region of mRNA encoded by PYGM, corresponding to a target binding site such as BINDING SITE I, BINDING SITE II or BINDING SITE III of FIG. 8. Table 4 illustrates the complementarity of the nucleotide sequences of PYGM BINDING SITE, designated SEQ ID:15938, to the nucleotide sequence of GAM7776 RNA, herein designated GAM RNA, also designated SEQ ID:246.

Another function of GAM7776 is therefore inhibition of Phosphorylase, glycogen; muscle (mcardle syndrome, glycogen storage disease type v) (PYGM, Accession NP_005600.1). Accordingly, utilities of GAM7776 include diagnosis, prevention and treatment of diseases and clinical conditions associated with PYGM.

RAB11-FIP4 (Accession NP_116321.2) is another GAM7776 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:13848, to the nucleotide sequence of GAM7776 RNA, herein designated GAM RNA, also designated SEQ ID:246.

Another function of GAM7776 is therefore inhibition of RAB11-FIP4 (Accession NP_116321.2). Accordingly, utilities of GAM7776 include diagnosis, prevention and treatment of diseases and clinical conditions associated with RAB11-FIP4.

Rab21, member ras oncogene family (RAB21, Accession NP_055814.1) is another GAM7776 target gene, herein designated TARGET GENE. RAB21 BINDING SITE is a target binding site found in the 3' untranslated region of mRNA encoded by RAB21, corresponding to a target binding site such as BINDING SITE I, BINDING SITE II or BINDING SITE III of FIG. 8. Table 4 illustrates the complementarity of the nucleotide sequences of RAB21 BINDING SITE, designated SEQ ID:7076, to the nucleotide sequence of GAM7776 RNA, herein designated GAM RNA, also designated SEQ ID:246.

Another function of GAM7776 is therefore inhibition of Rab21, member ras oncogene family (RAB21, Accession NP_055814.1). Accordingly, utilities of GAM7776 include diagnosis, prevention and treatment of diseases and clinical conditions associated with RAB21.

Rab33b, member ras oncogene family (RAB33B, Accession NP_112586.1) is another GAM7776 target gene, herein designated TARGET GENE. RAB33B BINDING SITE is a target binding site found in the 3' untranslated region of mRNA encoded by RAB33B, corresponding to a target binding site such as BINDING SITE I, BINDING SITE II or BINDING SITE III of FIG. 8. Table 4 illustrates the complementarity of the nucleotide sequences of RAB33B BINDING SITE, designated SEQ ID:7910, to the nucleotide sequence of GAM7776 RNA, herein designated GAM RNA, also designated SEQ ID:246.

Another function of GAM7776 is therefore inhibition of Rab33b, member ras oncogene family (RAB33B, Accession NP_112586.1). Accordingly, utilities of GAM7776 include diagnosis, prevention and treatment of diseases and clinical conditions associated with RAB33B.

Rab36, member ras oncogene family (RAB36, Accession NP_004905.1) is another GAM7776 target gene, herein designated TARGET GENE. RAB36 BINDING SITE1 and RAB36 BINDING SITE2 are target binding sites found in untranslated regions of mRNA encoded by RAB36, corresponding to target binding sites such as BINDING SITE I, BINDING SITE II or BINDING SITE III of FIG. 8. Table 4 illustrates the complementarity of the nucleotide sequences of RAB36 BINDING SITE1 and RAB36 BINDING SITE2, designated SEQ ID:1652 and SEQ ID:808 respectively, to the nucleotide sequence of GAM7776 RNA, herein designated GAM RNA, also designated SEQ ID:246.

Another function of GAM7776 is therefore inhibition of Rab36, member ras oncogene family (RAB36, Accession NP_004905.1), a gene which is involved in protein transport. Accordingly, utilities of GAM7776 include diagnosis, prevention and treatment of diseases and clinical conditions associated with RAB36.

The function of RAB36 and its association with various diseases and clinical conditions, has been established by previous studies, as described hereinabove with reference to GAM130.1. Rab39, member ras oncogene family (RAB39, Accession XP_084662.1) is another GAM7776 target gene, herein designated TARGET GENE. RAB39 BINDING SITE is a target binding site found in the 3' untranslated region of mRNA encoded by RAB39, corresponding to a target binding site such as BINDING SITE I, BINDING SITE II or BINDING SITE III of FIG. 8. Table 4 illustrates the complementarity of the nucleotide sequences of RAB39 BINDING SITE, designated SEQ ID:3754, to the nucleotide sequence of GAM7776 RNA, herein designated GAM RNA, also designated SEQ ID:246.

Another function of GAM7776 is therefore inhibition of Rab39, member ras oncogene family (RAB39, Accession XP_084662.1). Accordingly, utilities of GAM7776 include diagnosis, prevention and treatment of diseases and clinical conditions associated with RAB39.

Rab4a, member ras oncogene family (RAB4A, Accession NP_004569.2) is another GAM7776 target gene, herein designated TARGET GENE. RAB4A BINDING SITE is a target binding site found in the 5' untranslated region of mRNA encoded by RAB4A, corresponding to a target binding site such as BINDING SITE I, BINDING SITE II or BINDING SITE III of FIG. 8. Table 4 illustrates the complementarity of the nucleotide sequences of RAB4A BINDING SITE, designated SEQ ID:16568, to the nucleotide sequence of GAM7776 RNA, herein designated GAM RNA, also designated SEQ ID:246.

Another function of GAM7776 is therefore inhibition of Rab4a, member ras oncogene family (RAB4A, Accession NP_004569.2), a gene which is involved in protein transport. Accordingly, utilities of GAM7776 include diagnosis, prevention and treatment of diseases and clinical conditions associated with RAB4A.

The function of RAB4A and its association with various diseases and clinical conditions, has been established by previous studies, as described hereinabove with reference to GAM55.2. Rab, member of ras oncogene family-like 2a (RABL2A, Accession NP_038198.1) is another GAM7776 target gene, herein designated TARGET GENE. RABL2A BINDING SITE is a target binding site found in the 3' untranslated region of multiple transcripts of mRNA encoded by RABL2A, corresponding to a target binding site such as BINDING SITE I, BINDING SITE II or BINDING SITE III of FIG. 8. Table 4 illustrates the complementarity of the nucleotide sequences of RABL2A BINDING SITE, designated SEQ ID:2648, to the nucleotide sequence of GAM7776 RNA, herein designated GAM RNA, also designated SEQ ID:246.

Another function of GAM7776 is therefore inhibition of Rab, member of ras oncogene family-like 2a (RABL2A, Accession NP_038198.1). Accordingly, utilities of GAM7776 include diagnosis, prevention and treatment of diseases and clinical conditions associated with RABL2A.

Rab, member of ras oncogene family-like 2b (RABL2B, Accession NP_009012.1) is another GAM7776 target gene, herein designated TARGET GENE. RABL2B BINDING SITE is a target binding site found in the 3' untranslated region of mRNA encoded by RABL2B, corresponding to a target binding site such as BINDING SITE I, BINDING SITE II or BINDING SITE III of FIG. 8. Table 4 illustrates the complementarity of the nucleotide sequences of RABL2B BINDING SITE, designated SEQ ID:2648, to the nucleotide sequence of GAM7776 RNA, herein designated GAM RNA, also designated SEQ ID:246.

Another function of GAM7776 is therefore inhibition of Rab, member of ras oncogene family-like 2b (RABL2B, Accession NP_009012.1). Accordingly, utilities of GAM7776 include diagnosis, prevention and treatment of diseases and clinical conditions associated with RABL2B.

RAI (Accession NP_006654.1) is another GAM7776 target gene, herein designated TARGET GENE. RAI BINDING SITE is a target binding site found in the 5' untranslated region of mRNA encoded by RAI, corresponding to a target binding site such as BINDING SITE I, BINDING SITE II or BINDING SITE III of FIG. 8. Table 4 illustrates the complementarity of the nucleotide sequences of RAI BINDING SITE, designated SEQ ID:8937, to the nucleotide sequence of GAM7776 RNA, herein designated GAM RNA, also designated SEQ ID:246.

Another function of GAM7776 is therefore inhibition of RAI (Accession NP_006654.1). Accordingly, utilities of GAM7776 include diagnosis, prevention and treatment of diseases and clinical conditions associated with RAI.

Retinoic acid induced 16 (RAI16, Accession NP_073586.3) is another GAM7776 target gene, herein designated TARGET GENE. RAI16 BINDING SITE is a target binding site found in the 3' untranslated region of mRNA encoded by RAI16, corresponding to a target binding site such as BINDING SITE I, BINDING SITE II or BINDING SITE III of FIG. 8. Table 4 illustrates the complementarity of the nucleotide sequences of RAI16 BINDING SITE, designated SEQ ID:4335, to the nucleotide sequence of GAM7776 RNA, herein designated GAM RNA, also designated SEQ ID:246.

Another function of GAM7776 is therefore inhibition of Retinoic acid induced 16 (RAI16, Accession NP_073586.3). Accordingly, utilities of GAM7776 include diagnosis, prevention and treatment of diseases and clinical conditions associated with RAI16.

Retinoic acid induced 17 (RAI17, Accession XP_166091.2) is another GAM7776 target gene, herein designated TARGET GENE. RAI17 BINDING SITE is a target binding site found in the 3' untranslated region of multiple transcripts of mRNA encoded by RAI17, corresponding to a target binding site such as BINDING SITE I, BINDING SITE II or BINDING SITE III of FIG. 8. Table 4 illustrates the complementarity of the nucleotide sequences of RAI17 BINDING SITE, designated SEQ ID:7523, to the nucleotide sequence of GAM7776 RNA, herein designated GAM RNA, also designated SEQ ID:246.

Another function of GAM7776 is therefore inhibition of Retinoic acid induced 17 (RAI17, Accession XP_166091.2). Accordingly, utilities of GAM7776 include diagnosis, prevention and treatment of diseases and clinical conditions associated with RAI17.

Retinoic acid induced 17 (RAI17, Accession NP_065071.1) is another GAM7776 target gene, herein designated TARGET GENE. RAI17 BINDING SITE is a target binding site found in the 3' untranslated region of multiple transcripts of mRNA encoded by RAI17, corresponding to a target binding site such as BINDING SITE I, BINDING SITE II or BINDING SITE III of FIG. 8. Table 4 illustrates the complementarity of the nucleotide sequences of RAI17 BINDING SITE, designated SEQ ID:7523, to the nucleotide sequence of GAM7776 RNA, herein designated GAM RNA, also designated SEQ ID:246.

Another function of GAM7776 is therefore inhibition of Retinoic acid induced 17 (RAI17, Accession NP_065071.1). Accordingly, utilities of GAM7776 include diagnosis, prevention and treatment of diseases and clinical conditions associated with RAI17.

Retinoic acid induced 3 (RAI3, Accession NP_003970.1) is another GAM7776 target gene, herein designated TARGET GENE. RAI3 BINDING SITE is a target binding site found in the 3' untranslated region of mRNA encoded by RAI3, corresponding to a target binding site such as BINDING SITE I, BINDING SITE II or BINDING SITE III of FIG. 8. Table 4 illustrates the complementarity of the nucleotide sequences of RAI3 BINDING SITE, designated SEQ ID:12784, to the nucleotide sequence of GAM7776 RNA, herein designated GAM RNA, also designated SEQ ID:246.

Another function of GAM7776 is therefore inhibition of Retinoic acid induced 3 (RAI3, Accession NP_003970.1). Accordingly, utilities of GAM7776 include diagnosis, prevention and treatment of diseases and clinical conditions associated with RAI3.

RAP140 (Accession NP_056039.1) is another GAM7776 target gene, herein designated TARGET GENE. RAP140 BINDING SITE is a target binding site found in the 3' untranslated region of mRNA encoded by RAP140, corresponding to a target binding site such as BINDING SITE I, BINDING SITE II or BINDING SITE III of FIG. 8. Table 4 illustrates the complementarity of the nucleotide sequences of RAP140 BINDING SITE, designated SEQ ID:16472, to the nucleotide sequence of GAM7776 RNA, herein designated GAM RNA, also designated SEQ ID:246.

Another function of GAM7776 is therefore inhibition of RAP140 (Accession NP_056039.1). Accordingly, utilities of GAM7776 include diagnosis, prevention and treatment of diseases and clinical conditions associated with RAP140.

Retinoic acid receptor, gamma (RARG, Accession NP_000957.1) is another GAM7776 target gene, herein designated TARGET GENE. RARG BINDING SITE is a target binding site found in the 5' untranslated region of mRNA encoded by RARG, corresponding to a target binding site such as BINDING SITE I, BINDING SITE II or BINDING SITE III of FIG. 8. Table 4 illustrates the complementarity of the nucleotide sequences of RARG BINDING SITE, designated SEQ ID:11090, to the nucleotide sequence of GAM7776 RNA, herein designated GAM RNA, also designated SEQ ID:246.

Another function of GAM7776 is therefore inhibition of Retinoic acid receptor, gamma (RARG, Accession NP_000957.1). Accordingly, utilities of GAM7776 include diagnosis, prevention and treatment of diseases and clinical conditions associated with RARG.

Ras association (ralgds/af-6) domain family 2 (RASSF2, Accession NP_739579.1) is another GAM7776 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM7776 RNA, herein designated GAM RNA, also designated SEQ ID:246.

Another function of GAM7776 is therefore inhibition of Ras association (ralgds/af-6) domain family 2 (RASSF2, Accession NP_739579.1). Accordingly, utilities of GAM7776 include diagnosis, prevention and treatment of diseases and clinical conditions associated with RASSF2.

Ras association (ralgds/af-6) domain family 2 (RASSF2, Accession NP_739580.1) is another GAM7776 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM7776 RNA, herein designated GAM RNA, also designated SEQ ID:246.

Another function of GAM7776 is therefore inhibition of Ras association (ralgds/af-6) domain family 2 (RASSF2, Accession NP_739580.1). Accordingly, utilities of GAM7776 include diagnosis, prevention and treatment of diseases and clinical conditions associated with RASSF2.

Ras association (ralgds/af-6) domain family 2 (RASSF2, Accession NP_055552.1) is another GAM7776 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:19336, to the nucleotide sequence of GAM7776 RNA, herein designated GAM RNA, also designated SEQ ID:246.

Another function of GAM7776 is therefore inhibition of Ras association (ralgds/af-6) domain family 2 (RASSF2, Accession NP_055552.1). Accordingly, utilities of GAM7776 include diagnosis, prevention and treatment of diseases and clinical conditions associated with RASSF2.

Retinoblastoma binding protein 1 (RBBP1, Accession NP_075376.1) is another GAM7776 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:11014, to the nucleotide sequence of GAM7776 RNA, herein designated GAM RNA, also designated SEQ ID:246.

Another function of GAM7776 is therefore inhibition of Retinoblastoma binding protein 1 (RBBP1, Accession NP_075376.1). Accordingly, utilities of GAM7776 include diagnosis, prevention and treatment of diseases and clinical conditions associated with RBBP1.

Retinoblastoma binding protein 1 (RBBP1, Accession NP_002883.2) is another GAM7776 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:11014, to the nucleotide sequence of GAM7776 RNA, herein designated GAM RNA, also designated SEQ ID:246.

Another function of GAM7776 is therefore inhibition of Retinoblastoma binding protein 1 (RBBP1, Accession NP_002883.2). Accordingly, utilities of GAM7776 include diagnosis, prevention and treatment of diseases and clinical conditions associated with RBBP1.

Retinoblastoma binding protein 1 (RBBP1, Accession NP_075377.1) is another GAM7776 target gene, herein designated TARGET GENE. RBBP1 BINDING SITE is a target binding site found in the 3' untranslated region of multiple transcripts of mRNA encoded by RBBP1, corresponding to a target binding site such as BINDING SITE I, BINDING SITE II or BINDING SITE III of FIG. 8. Table 4 illustrates the complementarity of the nucleotide sequences of RBBP1 BINDING SITE, designated SEQ ID:11014, to the nucleotide sequence of GAM7776 RNA, herein designated GAM RNA, also designated SEQ ID:246.

Another function of GAM7776 is therefore inhibition of Retinoblastoma binding protein 1 (RBBP1, Accession NP_075377.1). Accordingly, utilities of GAM7776 include diagnosis, prevention and treatment of diseases and clinical conditions associated with RBBP1.

Retinoblastoma binding protein 9 (RBBP9, Accession NP_006597.2) is another GAM7776 target gene, herein designated TARGET GENE. RBBP9 BINDING SITE is a target binding site found in the 3' untranslated region of multiple transcripts of mRNA encoded by RBBP9, corresponding to a target binding site such as BINDING SITE I, BINDING SITE II or BINDING SITE III of FIG. 8. Table 4 illustrates the complementarity of the nucleotide sequences of RBBP9 BINDING SITE, designated SEQ ID:16100, to the nucleotide sequence of GAM7776 RNA, herein designated GAM RNA, also designated SEQ ID:246.

Another function of GAM7776 is therefore inhibition of Retinoblastoma binding protein 9 (RBBP9, Accession NP_006597.2). Accordingly, utilities of GAM7776 include diagnosis, prevention and treatment of diseases and clinical conditions associated with RBBP9.

Retinoblastoma-like 2 (p130) (RBL2, Accession NP_005602.2) is another GAM7776 target gene, herein designated TARGET GENE. RBL2 BINDING SITE is a target binding site found in the 3' untranslated region of mRNA encoded by RBL2, corresponding to a target binding site such as BINDING SITE I, BINDING SITE II or BINDING SITE III of FIG. 8. Table 4 illustrates the complementarity of the nucleotide sequences of RBL2 BINDING SITE, designated SEQ ID:6615, to the nucleotide sequence of GAM7776 RNA, herein designated GAM RNA, also designated SEQ ID:246.

Another function of GAM7776 is therefore inhibition of Retinoblastoma-like 2 (p130) (RBL2, Accession NP_005602.2), a gene which may be a tumor suppressor and therefore may be associated with Cancer. Accordingly, utilities of GAM7776 include diagnosis, prevention and treatment of Cancer, and of other diseases and clinical conditions associated with RBL2.

The function of RBL2 and its association with various diseases and clinical conditions, has been established by previous studies, as described hereinabove with reference to GAM189.1. RCBTB1 (Accession NP_060661.2) is another GAM7776 target gene, herein designated TARGET GENE.

RCBTB1 BINDING SITE is a target binding site found in the 5' untranslated region of mRNA encoded by RCBTB1, corresponding to a target binding site such as BINDING SITE I, BINDING SITE II or BINDING SITE III of FIG. 8. Table 4 illustrates the complementarity of the nucleotide sequences of RCBTB1 BINDING SITE, designated SEQ ID:13829, to the nucleotide sequence of GAM7776 RNA, herein designated GAM RNA, also designated SEQ ID:246.

Another function of GAM7776 is therefore inhibition of RCBTB1 (Accession NP_060661.2). Accordingly, utilities of GAM7776 include diagnosis, prevention and treatment of diseases and clinical conditions associated with RCBTB1.

RCD-8 (Accession NP_055144.2) is another GAM7776 target gene, herein designated TARGET GENE. RCD-8 BINDING SITE is a target binding site found in the 3' untranslated region of mRNA encoded by RCD-8, corresponding to a target binding site such as BINDING SITE I, BINDING SITE II or BINDING SITE III of FIG. 8. Table 4 illustrates the complementarity of the nucleotide sequences of RCD-8 BINDING SITE, designated SEQ ID:13335, to the nucleotide sequence of GAM7776 RNA, herein designated GAM RNA, also designated SEQ ID:246.

Another function of GAM7776 is therefore inhibition of RCD-8 (Accession NP_055144.2). Accordingly, utilities of GAM7776 include diagnosis, prevention and treatment of diseases and clinical conditions associated with RCD-8.

RDH13 (Accession NP_612421.1) is another GAM7776 target gene, herein designated TARGET GENE. RDH13 BINDING SITE is a target binding site found in the 5' untranslated region of mRNA encoded by RDH13, corresponding to a target binding site such as BINDING SITE I, BINDING SITE II or BINDING SITE III of FIG. 8. Table 4 illustrates the complementarity of the nucleotide sequences of RDH13 BINDING SITE, designated SEQ ID:9713, to the nucleotide sequence of GAM7776 RNA, herein designated GAM RNA, also designated SEQ ID:246.

Another function of GAM7776 is therefore inhibition of RDH13 (Accession NP_612421.1). Accordingly, utilities of GAM7776 include diagnosis, prevention and treatment of diseases and clinical conditions associated with RDH13.

Regulator of g-protein signalling 3 (RGS3, Accession NP_570613.1) is another GAM7776 target gene, herein designated TARGET GENE. RGS3 BINDING SITE is a target binding site found in the 5' untranslated region of multiple transcripts of mRNA encoded by RGS3, corresponding to a target binding site such as BINDING SITE I, BINDING SITE II or BINDING SITE III of FIG. 8. Table 4 illustrates the complementarity of the nucleotide sequences of RGS3 BINDING SITE, designated SEQ ID:3344, to the nucleotide sequence of GAM7776 RNA, herein designated GAM RNA, also designated SEQ ID:246.

Another function of GAM7776 is therefore inhibition of Regulator of g-protein signalling 3 (RGS3, Accession NP_570613.1), a gene which negatively regulates G protein-coupled receptor signalling. Accordingly, utilities of GAM7776 include diagnosis, prevention and treatment of diseases and clinical conditions associated with RGS3.

The function of RGS3 and its association with various diseases and clinical conditions, has been established by previous studies, as described hereinabove with reference to GAM146.1. Rhesus blood group, d antigen (RHD, Accession NP_057208.2) is another GAM7776 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:13465 and SEQ ID:13465 respectively, to the nucleotide sequence of GAM7776 RNA, herein designated GAM RNA, also designated SEQ ID:246.

Another function of GAM7776 is therefore inhibition of Rhesus blood group, d antigen (RHD, Accession NP_057208.2), a gene which Major antigen of the RH system. Accordingly, utilities of GAM7776 include diagnosis, prevention and treatment of diseases and clinical conditions associated with RHD.

The function of RHD and its association with various diseases and clinical conditions, has been established by previous studies, as described hereinabove with reference to GAM161.1. Rhesus blood group, d antigen (RHD, Accession NP_057309.2) is another GAM7776 target gene, herein designated TARGET GENE. RHD BINDING SITE1 and RHD BINDING SITE2 are target binding sites found in untranslated regions of multiple transcripts of mRNA encoded by RHD, corresponding to target binding sites such as BINDING SITE I, BINDING SITE II or BINDING SITE III of FIG. 8. Table 4 illustrates the complementarity of the nucleotide sequences of RHD BINDING SITE1 and RHD BINDING SITE2, designated SEQ ID:4143 and SEQ ID:4143 respectively, to the nucleotide sequence of GAM7776 RNA, herein designated GAM RNA, also designated SEQ ID:246.

Another function of GAM7776 is therefore inhibition of Rhesus blood group, d antigen (RHD, Accession NP_057309.2), a gene which Major antigen of the RH system. Accordingly, utilities of GAM7776 include diagnosis, prevention and treatment of diseases and clinical conditions associated with RHD.

The function of RHD and its association with various diseases and clinical conditions, has been established by previous studies, as described hereinabove with reference to GAM161.1. RHPN2 (Accession NP_149094.2) is another GAM7776 target gene, herein designated TARGET GENE. RHPN2 BINDING SITE is a target binding site found in the 3' untranslated region of mRNA encoded by RHPN2, corresponding to a target binding site such as BINDING SITE I, BINDING SITE II or BINDING SITE III of FIG. 8. Table 4 illustrates the complementarity of the nucleotide sequences of RHPN2 BINDING SITE, designated SEQ ID:11803, to the nucleotide sequence of GAM7776 RNA, herein designated GAM RNA, also designated SEQ ID:246.

Another function of GAM7776 is therefore inhibition of RHPN2 (Accession NP_149094.2). Accordingly, utilities of GAM7776 include diagnosis, prevention and treatment of diseases and clinical conditions associated with RHPN2.

RIP60 (Accession NP_037532.1) is another GAM7776 target gene, herein designated TARGET GENE. RIP60 BINDING SITE is a target binding site found in the 3' untranslated region of multiple transcripts of mRNA encoded by RIP60, corresponding to a target binding site such as BINDING SITE I, BINDING SITE II or BINDING SITE III of FIG. 8. Table 4 illustrates the complementarity of the nucleotide sequences of RIP60 BINDING SITE, designated SEQ ID:5556, to the nucleotide sequence of GAM7776 RNA, herein designated GAM RNA, also designated SEQ ID:246.

Another function of GAM7776 is therefore inhibition of RIP60 (Accession NP_037532.1). Accordingly, utilities of GAM7776 include diagnosis, prevention and treatment of diseases and clinical conditions associated with RIP60.

RIP60 (Accession NP_055189.1) is another GAM7776 target gene, herein designated TARGET GENE. RIP60 BINDING SITE is a target binding site found in the 3' untranslated region of multiple transcripts of mRNA encoded by RIP60, corresponding to a target binding site such as BINDING SITE I, BINDING SITE II or BINDING SITE III of FIG. 8. Table 4 illustrates the complementarity of the nucleotide sequences of RIP60 BINDING SITE, designated SEQ ID:5556, to the nucleotide sequence of GAM7776 RNA, herein designated GAM RNA, also designated SEQ ID:246.

Another function of GAM7776 is therefore inhibition of RIP60 (Accession NP_055189.1). Accordingly, utilities of GAM7776 include diagnosis, prevention and treatment of diseases and clinical conditions associated with RIP60.

RNF137 (Accession NP_060543.4) is another GAM7776 target gene, herein designated TARGET GENE. RNF137 BINDING SITE1 and RNF137 BINDING SITE2 are target binding sites found in untranslated regions of mRNA encoded by RNF137, corresponding to target binding sites such as BINDING SITE I, BINDING SITE II or BINDING SITE III of FIG. 8. Table 4 illustrates the complementarity of the nucleotide sequences of RNF137 BINDING SITE1 and RNF137 BINDING SITE2, designated SEQ ID:7446 and SEQ ID:16940 respectively, to the nucleotide sequence of GAM7776 RNA, herein designated GAM RNA, also designated SEQ ID:246.

Another function of GAM7776 is therefore inhibition of RNF137 (Accession NP_060543.4). Accordingly, utilities of GAM7776 include diagnosis, prevention and treatment of diseases and clinical conditions associated with RNF137.

RNF144 (Accession NP_055561.1) is another GAM7776 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:4727, to the nucleotide sequence of GAM7776 RNA, herein designated GAM RNA, also designated SEQ ID:246.

Another function of GAM7776 is therefore inhibition of RNF144 (Accession NP_055561.1). Accordingly, utilities of GAM7776 include diagnosis, prevention and treatment of diseases and clinical conditions associated with RNF144.

Ring finger protein (c3hc4 type) 8 (RNF8, Accession NP_003949.1) is another GAM7776 target gene, herein designated TARGET GENE. RNF8 BINDING SITE1 and RNF8 BINDING SITE2 are target binding sites found in untranslated regions of mRNA encoded by RNF8, corresponding to target binding sites such as BINDING SITE I, BINDING SITE II or BINDING SITE III of FIG. 8. Table 4 illustrates the complementarity of the nucleotide sequences of RNF8 BINDING SITE1 and RNF8 BINDING SITE2, designated SEQ ID:9745 and SEQ ID:13778 respectively, to the nucleotide sequence of GAM7776 RNA, herein designated GAM RNA, also designated SEQ ID:246.

Another function of GAM7776 is therefore inhibition of Ring finger protein (c3hc4 type) 8 (RNF8, Accession NP_003949.1). Accordingly, utilities of GAM7776 include diagnosis, prevention and treatment of diseases and clinical conditions associated with RNF8.

Retinitis pigmentosa 2 (x-linked recessive) (RP2, Accession NP_008846.1) is another GAM7776 target gene, herein designated TARGET GENE. RP2 BINDING SITE is a target binding site found in the 3' untranslated region of mRNA encoded by RP2, corresponding to a target binding site such as BINDING SITE I, BINDING SITE II or BINDING SITE III of FIG. 8. Table 4 illustrates the complementarity of the nucleotide sequences of RP2 BINDING SITE, designated SEQ ID:6582, to the nucleotide sequence of GAM7776 RNA, herein designated GAM RNA, also designated SEQ ID:246.

Another function of GAM7776 is therefore inhibition of Retinitis pigmentosa 2 (x-linked recessive) (RP2, Accession NP_008846.1). Accordingly, utilities of GAM7776 include diagnosis, prevention and treatment of diseases and clinical conditions associated with RP2.

Rabphilin 3a-like (without c2 domains) (RPH3AL, Accession NP_008918.1) is another GAM7776 target gene, herein designated TARGET GENE. RPH3AL BINDING SITE is a target binding site found in the 3' untranslated region of mRNA encoded by RPH3AL, corresponding to a target binding site such as BINDING SITE I, BINDING SITE II or BINDING SITE III of FIG. 8. Table 4 illustrates the complementarity of the nucleotide sequences of RPH3AL BINDING SITE, designated SEQ ID:2614, to the nucleotide sequence of GAM7776 RNA, herein designated GAM RNA, also designated SEQ ID:246.

Another function of GAM7776 is therefore inhibition of Rabphilin 3a-like (without c2 domains) (RPH3AL, Accession NP_008918.1), a gene which is a protein transporter. could play a role in neurotransmitter release by regulating membrane flow in the nerve terminal. Accordingly, utilities of GAM7776 include diagnosis, prevention and treatment of diseases and clinical conditions associated with RPH3AL.

The function of RPH3AL and its association with various diseases and clinical conditions, has been established by previous studies, as described hereinabove with reference to GAM189.1. RPP30 (Accession NP_006404.1) is another GAM7776 target gene, herein designated TARGET GENE. RPP30 BINDING SITE1 and RPP30 BINDING SITE2 are target binding sites found in untranslated regions of mRNA encoded by RPP30, corresponding to target binding sites such as BINDING SITE I, BINDING SITE II or BINDING SITE III of FIG. 8. Table 4 illustrates the complementarity of the nucleotide sequences of RPP30 BINDING SITE1 and RPP30 BINDING SITE2, designated SEQ ID:445 and SEQ ID:19325 respectively, to the nucleotide sequence of GAM7776 RNA, herein designated GAM RNA, also designated SEQ ID:246.

Another function of GAM7776 is therefore inhibition of RPP30 (Accession NP_006404.1), a gene which is a component of ribonuclease p that processes 5' ends of precursor tRNAs. Accordingly, utilities of GAM7776 include diagnosis, prevention and treatment of diseases and clinical conditions associated with RPP30.

The function of RPP30 and its association with various diseases and clinical conditions, has been established by previous studies, as described hereinabove with reference to GAM136.1. S100A15 (Accession NP_789793.1) is another GAM7776 target gene, herein designated TARGET GENE. S100A15 BINDING SITE is a target binding site found in the 3' untranslated region of mRNA encoded by S100A15, corresponding to a target binding site such as BINDING SITE I, BINDING SITE II or BINDING SITE III of FIG. 8. Table 4 illustrates the complementarity of the nucleotide sequences of S100A15 BINDING SITE, designated SEQ ID:19723, to the nucleotide sequence of GAM7776 RNA, herein designated GAM RNA, also designated SEQ ID:246.

Another function of GAM7776 is therefore inhibition of S100A15 (Accession NP_789793.1). Accordingly, utilities of GAM7776 include diagnosis, prevention and treatment of diseases and clinical conditions associated with S100A15.

SARM1 (Accession NP_055892.1) is another GAM7776 target gene, herein designated TARGET GENE. SARM1 BINDING SITE1 and SARM1 BINDING SITE2 are target binding sites found in untranslated regions of mRNA encoded by SARM1, corresponding to target binding sites such as BINDING SITE I, BINDING SITE II or BINDING SITE III of FIG. 8. Table 4 illustrates the complementarity of the nucleotide sequences of SARM1 BINDING SITE1 and SARM1 BINDING SITE2, designated SEQ ID:7147 and SEQ ID:4282 respectively, to the nucleotide sequence of GAM7776 RNA, herein designated GAM RNA, also designated SEQ ID:246.

Another function of GAM7776 is therefore inhibition of SARM1 (Accession NP_055892.1). Accordingly, utilities of GAM7776 include diagnosis, prevention and treatment of diseases and clinical conditions associated with SARM1.

Sarcoma amplified sequence (SAS, Accession NP_005972.1) is another GAM7776 target gene, herein designated TARGET GENE. SAS BINDING SITE is a target binding site found in the 3' untranslated region of mRNA encoded by SAS, corresponding to a target binding site such as BINDING SITE I, BINDING SITE II or BINDING SITE III of FIG. 8. Table 4 illustrates the complementarity of the nucleotide sequences of SAS BINDING SITE, designated SEQ ID:17726, to the nucleotide sequence of GAM7776 RNA, herein designated GAM RNA, also designated SEQ ID:246.

Another function of GAM7776 is therefore inhibition of Sarcoma amplified sequence (SAS, Accession NP_005972.1), a gene which is a member of the transmembrane 4 superfamily (TM4SF) and may be involved in growth-related cellular processes T. Accordingly, utilities of GAM7776 include diagnosis, prevention and treatment of diseases and clinical conditions associated with SAS.

The function of SAS and its association with various diseases and clinical conditions, has been established by previous studies, as described hereinabove with reference to GAM88.1. SBLF (Accession NP_006864.2) is another GAM7776 target gene, herein designated TARGET GENE. SBLF BINDING SITE is a target binding site found in the 3' untranslated region of mRNA encoded by SBLF, corresponding to a target binding site such as BINDING SITE I, BINDING SITE II or BINDING SITE III of FIG. 8. Table 4 illustrates the complementarity of the nucleotide sequences of SBLF BINDING SITE, designated SEQ ID:14551, to the nucleotide sequence of GAM7776 RNA, herein designated GAM RNA, also designated SEQ ID:246.

Another function of GAM7776 is therefore inhibition of SBLF (Accession NP_006864.2). Accordingly, utilities of GAM7776 include diagnosis, prevention and treatment of diseases and clinical conditions associated with SBLF.

SCAMP-4 (Accession NP_524558.1) is another GAM7776 target gene, herein designated TARGET GENE. SCAMP-4 BINDING SITE is a target binding site found in the 3' untranslated region of mRNA encoded by SCAMP-4, corresponding to a target binding site such as BINDING SITE I, BINDING SITE II or BINDING SITE III of FIG. 8. Table 4 illustrates the complementarity of the nucleotide sequences of SCAMP-4 BINDING SITE, designated SEQ ID:2153, to the nucleotide sequence of GAM7776 RNA, herein designated GAM RNA, also designated SEQ ID:246.

Another function of GAM7776 is therefore inhibition of SCAMP-4 (Accession NP_524558.1). Accordingly, utilities of GAM7776 include diagnosis, prevention and treatment of diseases and clinical conditions associated with SCAMP-4.

Scan domain containing 2 (SCAND2, Accession NP_071333.2) is another GAM7776 target gene, herein designated TARGET GENE. SCAND2 BINDING SITE is a target binding site found in the 3' untranslated region of multiple transcripts of mRNA encoded by SCAND2, corresponding to a target binding site such as BINDING SITE I, BINDING SITE II or BINDING SITE III of FIG. 8. Table 4 illustrates the complementarity of the nucleotide sequences of SCAND2 BINDING SITE, designated SEQ ID:7179, to the nucleotide sequence of GAM7776 RNA, herein designated GAM RNA, also designated SEQ ID:246.

Another function of GAM7776 is therefore inhibition of Scan domain containing 2 (SCAND2, Accession NP_071333.2). Accordingly, utilities of GAM7776 include diagnosis, prevention and treatment of diseases and clinical conditions associated with SCAND2.

Scavenger receptor class f, member 1 (SCARF1, Accession NP_003684.1) is another GAM7776 target gene, herein designated TARGET GENE. SCARF1 BINDING SITE is a target binding site found in the 3' untranslated region of mRNA encoded by SCARF1, corresponding to a target binding site such as BINDING SITE I, BINDING SITE II or BINDING SITE III of FIG. 8. Table 4 illustrates the complementarity of the nucleotide sequences of SCARF1 BINDING SITE, designated SEQ ID:5158, to the nucleotide sequence of GAM7776 RNA, herein designated GAM RNA, also designated SEQ ID:246.

Another function of GAM7776 is therefore inhibition of Scavenger receptor class f, member 1 (SCARF1, Accession NP_003684.1). Accordingly, utilities of GAM7776 include diagnosis, prevention and treatment of diseases and clinical conditions associated with SCARF1.

Stearoyl-coa desaturase (delta-9-desaturase) (SCD, Accession NP_005054.2) is another GAM7776 target gene, herein designated TARGET GENE. SCD BINDING SITE is a target binding site found in the 3' untranslated region of mRNA encoded by SCD, corresponding to a target binding site such as BINDING SITE I, BINDING SITE II or BINDING SITE III of FIG. 8. Table 4 illustrates the complementarity of the nucleotide sequences of SCD BINDING SITE, designated SEQ ID:3800, to the nucleotide sequence of GAM7776 RNA, herein designated GAM RNA, also designated SEQ ID:246.

Another function of GAM7776 is therefore inhibition of Stearoyl-coa desaturase (delta-9-desaturase) (SCD, Accession NP_005054.2), a gene which functions in the synthesis of unsaturated fatty acids. Accordingly, utilities of GAM7776 include diagnosis, prevention and treatment of diseases and clinical conditions associated with SCD.

The function of SCD and its association with various diseases and clinical conditions, has been established by previous studies, as described hereinabove with reference to GAM144.1. Sex comb on midleg-like 2 (drosophila) (SCML2, Accession NP_006080.1) is another GAM7776 target gene, herein designated TARGET GENE. SCML2 BINDING SITE is a target binding site found in the 3' untranslated region of mRNA encoded by SCML2, corresponding to a target binding site such as BINDING SITE I, BINDING SITE II or BINDING SITE III of FIG. 8. Table 4 illustrates the complementarity of the nucleotide sequences of SCML2 BINDING SITE, designated SEQ ID:3898, to the nucleotide sequence of GAM7776 RNA, herein designated GAM RNA, also designated SEQ ID:246.

Another function of GAM7776 is therefore inhibition of Sex comb on midleg-like 2 (drosophila) (SCML2, Accession NP_006080.1). Accordingly, utilities of GAM7776 include diagnosis, prevention and treatment of diseases and clinical conditions associated with SCML2.

Sodium channel, voltage-gated, type ii, beta polypeptide (SCN2B, Accession NP_004579.1) is another GAM7776 target gene, herein designated TARGET GENE. SCN2B BINDING SITE is a target binding site found in the 3' untranslated region of mRNA encoded by SCN2B, corresponding to a target binding site such as BINDING SITE I, BINDING SITE II or BINDING SITE III of FIG. 8. Table 4 illustrates the complementarity of the nucleotide sequences of SCN2B BINDING SITE, designated SEQ ID:13704, to the nucleotide sequence of GAM7776 RNA, herein designated GAM RNA, also designated SEQ ID:246.

Another function of GAM7776 is therefore inhibition of Sodium channel, voltage-gated, type ii, beta polypeptide (SCN2B, Accession NP_004579.1), a gene which modulates channel properties. Accordingly, utilities of GAM7776 include diagnosis, prevention and treatment of diseases and clinical conditions associated with SCN2B.

The function of SCN2B and its association with various diseases and clinical conditions, has been established by previous studies, as described hereinabove with reference to GAM189.1. SCN3B (Accession NP_060870.1) is another GAM7776 target gene, herein designated TARGET GENE. SCN3B BINDING SITE is a target binding site found in the 3' untranslated region of mRNA encoded by SCN3B, corresponding to a target binding site such as BINDING SITE I, BINDING SITE II or BINDING SITE III of FIG. 8. Table 4 illustrates the complementarity of the nucleotide sequences of SCN3B BINDING SITE, designated SEQ ID:4399, to the nucleotide sequence of GAM7776 RNA, herein designated GAM RNA, also designated SEQ ID:246.

Another function of GAM7776 is therefore inhibition of SCN3B (Accession NP_060870.1). Accordingly, utilities of GAM7776 include diagnosis, prevention and treatment of diseases and clinical conditions associated with SCN3B.

SDS-RS1 (Accession NP_612441.1) is another GAM7776 target gene, herein designated TARGET GENE. SDS-RS1 BINDING SITE is a target binding site found in the 5' untranslated region of mRNA encoded by SDS-RS1, corresponding to a target binding site such as BINDING SITE I, BINDING SITE II or BINDING SITE III of FIG. 8. Table 4 illustrates the complementarity of the nucleotide sequences of SDS-RS1 BINDING SITE, designated SEQ ID:14127, to the nucleotide sequence of GAM7776 RNA, herein designated GAM RNA, also designated SEQ ID:246.

Another function of GAM7776 is therefore inhibition of SDS-RS1 (Accession NP_612441.1). Accordingly, utilities of GAM7776 include diagnosis, prevention and treatment of diseases and clinical conditions associated with SDS-RS1.

Spondyloepiphyseal dysplasia, late (SEDL, Accession NP_055378.1) is another GAM7776 target gene, herein designated TARGET GENE. SEDL BINDING SITE1 through SEDL BINDING SITE3 are target binding sites found in untranslated regions of mRNA encoded by SEDL, corresponding to target binding sites such as BINDING SITE I, BINDING SITE II or BINDING SITE III of FIG. 8. Table 4 illustrates the complementarity of the nucleotide sequences of SEDL BINDING SITE1 through SEDL BINDING SITE3, designated SEQ ID:15576, SEQ ID:11591 and SEQ ID:926 respectively, to the nucleotide sequence of GAM7776 RNA, herein designated GAM RNA, also designated SEQ ID:246.

Another function of GAM7776 is therefore inhibition of Spondyloepiphyseal dysplasia, late (SEDL, Accession NP_055378.1), a gene which may play role in vesicular transport from endoplasmic reticulum to golgi. and therefore may be associated with Spondyloepiphyseal dysplasia. Accordingly, utilities of GAM7776 include diagnosis, prevention and treatment of Spondyloepiphyseal dysplasia, and of other diseases and clinical conditions associated with SEDL.

The function of SEDL and its association with various diseases and clinical conditions, has been established by previous studies, as described hereinabove with reference to GAM30.1. Sema domain, immunoglobulin domain (ig), short basic domain, secreted, (semaphorin) 3e (SEMA3E, Accession NP_036563.1) is another GAM7776 target gene, herein designated TARGET GENE. SEMA3E BINDING SITE is a target binding site found in the 3' untranslated region of mRNA encoded by SEMA3E, corresponding to a target binding site such as BINDING SITE I, BINDING SITE II or BINDING SITE III of FIG. 8. Table 4 illustrates the complementarity of the nucleotide sequences of SEMA3E BINDING SITE, designated SEQ ID:13353, to the nucleotide sequence of GAM7776 RNA, herein designated GAM RNA, also designated SEQ ID:246.

Another function of GAM7776 is therefore inhibition of Sema domain, immunoglobulin domain (ig), short basic domain, secreted, (semaphorin) 3e (SEMA3E, Accession NP_036563.1). Accordingly, utilities of GAM7776 include diagnosis, prevention and treatment of diseases and clinical conditions associated with SEMA3E.

Selenoprotein n, 1 (SEPN1, Accession NP_065184.1) is another GAM7776 target gene, herein designated TARGET GENE. SEPN1 BINDING SITE is a target binding site found in the 3' untranslated region of mRNA encoded by SEPN1, corresponding to a target binding site such as BINDING SITE I, BINDING SITE II or BINDING SITE III of FIG. 8. Table 4 illustrates the complementarity of the nucleotide sequences of SEPN1 BINDING SITE, designated SEQ ID:18255, to the nucleotide sequence of GAM7776 RNA, herein designated GAM RNA, also designated SEQ ID:246.

Another function of GAM7776 is therefore inhibition of Selenoprotein n, 1 (SEPN1, Accession NP_065184.1). Accordingly, utilities of GAM7776 include diagnosis, prevention and treatment of diseases and clinical conditions associated with SEPN1.

Small edrk-rich factor 1a (telomeric) (SERF1A, Accession NP_068802.1) is another GAM7776 target gene, herein designated TARGET GENE. SERF1A BINDING SITE1 and SERF1A BINDING SITE2 are target binding sites found in untranslated regions of mRNA encoded by SERF1A, corresponding to target binding sites such as BINDING SITE I, BINDING SITE II or BINDING SITE III of FIG. 8. Table 4 illustrates the complementarity of the nucleotide sequences of SERF1A BINDING SITE1 and SERF1A BINDING SITE2, designated SEQ ID:15849 and SEQ ID:9219 respectively, to the nucleotide sequence of GAM7776 RNA, herein designated GAM RNA, also designated SEQ ID:246.

Another function of GAM7776 is therefore inhibition of Small edrk-rich factor 1a (telomeric) (SERF1A, Accession NP_068802.1). Accordingly, utilities of GAM7776 include diagnosis, prevention and treatment of diseases and clinical conditions associated with SERF1A.

Small edrk-rich factor 1b (centromeric) (SERF1B, Accession NP_075267.1) is another GAM7776 target gene, herein designated TARGET GENE. SERF1B BINDING SITE1 and SERF1B BINDING SITE2 are target binding sites found in untranslated regions of mRNA encoded by SERF1B, corresponding to target binding sites such as BINDING SITE I, BINDING SITE II or BINDING SITE III of FIG. 8. Table 4 illustrates the complementarity of the nucleotide sequences of SERF1B BINDING SITE1 and SERF1B BINDING SITE2, designated SEQ ID:9219 and SEQ ID:15849 respectively, to the nucleotide sequence of GAM7776 RNA, herein designated GAM RNA, also designated SEQ ID:246.

Another function of GAM7776 is therefore inhibition of Small edrk-rich factor 1b (centromeric) (SERF1B, Accession NP_075267.1). Accordingly, utilities of GAM7776 include diagnosis, prevention and treatment of diseases and clinical conditions associated with SERF1B.

Serine (or cysteine) proteinase inhibitor, clade b (ovalbumin), member 9 (SERPINB9, Accession NP_004146.1) is another GAM7776 target gene, herein designated TARGET GENE. SERPINB9 BINDING SITE1 and SERPINB9 BINDING SITE2 are target binding sites found in untranslated regions of mRNA encoded by SERPINB9, corresponding to target binding sites such as BINDING SITE I, BINDING SITE II or BINDING SITE III of FIG. 8. Table 4 illustrates the complementarity of the nucleotide sequences of SERPINB9 BINDING SITE1 and SERPINB9 BINDING SITE2, designated SEQ ID:9152 and SEQ ID:4363 respectively, to the nucleotide sequence of GAM7776 RNA, herein designated GAM RNA, also designated SEQ ID:246.

Another function of GAM7776 is therefore inhibition of Serine (or cysteine) proteinase inhibitor, clade b (ovalbumin), member 9 (SERPINB9, Accession NP_004146.1), a gene which may be a serpin serine protease inhibitor that interacts with granzyme B (GZMB). Accordingly, utilities of GAM7776 include diagnosis, prevention and treatment of diseases and clinical conditions associated with SERPINB9.

The function of SERPINB9 and its association with various diseases and clinical conditions, has been established by previous studies, as described hereinabove with reference to GAM88.2. Sideroflexin 2 (SFXN2, Accession XP_058359.2) is another GAM7776 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:3678, to the nucleotide sequence of GAM7776 RNA, herein designated GAM RNA, also designated SEQ ID:246.

Another function of GAM7776 is therefore inhibition of Sideroflexin 2 (SFXN2, Accession XP_058359.2). Accordingly, utilities of GAM7776 include diagnosis, prevention and treatment of diseases and clinical conditions associated with SFXN2.

Sideroflexin 2 (SFXN2, Accession NP_849189.1) is another GAM7776 target gene, herein designated TARGET GENE. SFXN2 BINDING SITE is a target binding site found in the 3' untranslated region of multiple transcripts of mRNA encoded by SFXN2, corresponding to a target binding site such as BINDING SITE I, BINDING SITE II or BINDING SITE III of FIG. 8. Table 4 illustrates the complementarity of the nucleotide sequences of SFXN2 BINDING SITE, designated SEQ ID:3678, to the nucleotide sequence of GAM7776 RNA, herein designated GAM RNA, also designated SEQ ID:246.

Another function of GAM7776 is therefore inhibition of Sideroflexin 2 (SFXN2, Accession NP_849189.1). Accordingly, utilities of GAM7776 include diagnosis, prevention and treatment of diseases and clinical conditions associated with SFXN2.

Sh3 domain binding glutamic acid-rich protein like 2 (SH3BGRL2, Accession NP_113657.1) is another GAM7776 target gene, herein designated TARGET GENE. SH3BGRL2 BINDING SITE is a target binding site found in the 3' untranslated region of mRNA encoded by SH3BGRL2, corresponding to a target binding site such as BINDING SITE I, BINDING SITE II or BINDING SITE III of FIG. 8. Table 4 illustrates the complementarity of the nucleotide sequences of SH3BGRL2 BINDING SITE, designated SEQ ID:2741, to the nucleotide sequence of GAM7776 RNA, herein designated GAM RNA, also designated SEQ ID:246.

Another function of GAM7776 is therefore inhibition of Sh3 domain binding glutamic acid-rich protein like 2 (SH3BGRL2, Accession NP_113657.1). Accordingly, utilities of GAM7776 include diagnosis, prevention and treatment of diseases and clinical conditions associated with SH3BGRL2.

Sh3-domain binding protein 2 (SH3BP2, Accession NP_003014.2) is another GAM7776 target gene, herein designated TARGET GENE. SH3BP2 BINDING SITE1 through SH3BP2 BINDING SITE3 are target binding sites found in untranslated regions of mRNA encoded by SH3BP2, corresponding to target binding sites such as BINDING SITE I, BINDING SITE II or BINDING SITE III of FIG. 8. Table 4 illustrates the complementarity of the nucleotide sequences of SH3BP2 BINDING SITE1 through SH3BP2 BINDING SITE3, designated SEQ ID:9440, SEQ ID:1122 and SEQ ID:3836 respectively, to the nucleotide sequence of GAM7776 RNA, herein designated GAM RNA, also designated SEQ ID:246.

Another function of GAM7776 is therefore inhibition of Sh3-domain binding protein 2 (SH3BP2, Accession NP_003014.2). Accordingly, utilities of GAM7776 include diagnosis, prevention and treatment of diseases and clinical conditions associated with SH3BP2.

Short stature homeobox (SHOX, Accession NP_006874.1) is another GAM7776 target gene, herein designated TARGET GENE. SHOX BINDING SITE is a target binding site found in the 3' untranslated region of multiple transcripts of mRNA encoded by SHOX, corresponding to a target binding site such as BINDING SITE I, BINDING SITE II or BINDING SITE III of FIG. 8. Table 4 illustrates the complementarity of the nucleotide sequences of SHOX BINDING SITE, designated SEQ ID:4375, to the nucleotide sequence of GAM7776 RNA, herein designated GAM RNA, also designated SEQ ID:246.

Another function of GAM7776 is therefore inhibition of Short stature homeobox (SHOX, Accession NP_006874.1). Accordingly, utilities of GAM7776 include diagnosis, prevention and treatment of diseases and clinical conditions associated with SHOX.

Sialic acid binding ig-like lectin 8 (SIGLEC8, Accession NP_055257.1) is another GAM7776 target gene, herein designated TARGET GENE. SIGLEC8 BINDING SITE is a target binding site found in the 3' untranslated region of mRNA encoded by SIGLEC8, corresponding to a target binding site such as BINDING SITE I, BINDING SITE II or BINDING SITE III of FIG. 8. Table 4 illustrates the complementarity of the nucleotide sequences of SIGLEC8 BINDING SITE, designated SEQ ID:4513, to the nucleotide sequence of GAM7776 RNA, herein designated GAM RNA, also designated SEQ ID:246.

Another function of GAM7776 is therefore inhibition of Sialic acid binding ig-like lectin 8 (SIGLEC8, Accession NP_055257.1), a gene which is a cell adhesion molecule for postnatal neural development. Accordingly, utilities of GAM7776 include diagnosis, prevention and treatment of diseases and clinical conditions associated with SIGLEC8.

The function of SIGLEC8 and its association with various diseases and clinical conditions, has been established by previous studies, as described hereinabove with reference to GAM63.1. Tal1 (scl) interrupting locus (SIL, Accession NP_003026.1) is another GAM7776 target gene, herein designated TARGET GENE. SIL BINDING SITE is a target binding site found in the 3' untranslated region of mRNA encoded by SIL, corresponding to a target binding site such as BINDING SITE I, BINDING SITE II or BINDING SITE III of FIG. 8. Table 4 illustrates the complementarity of the nucleotide sequences of SIL BINDING SITE, designated SEQ ID:12411, to the nucleotide sequence of GAM7776 RNA, herein designated GAM RNA, also designated SEQ ID:246.

Another function of GAM7776 is therefore inhibition of Tal1 (scl) interrupting locus (SIL, Accession NP_003026.1), a gene which may be required for axial development and left-right specification and therefore may be associated with Prominent midline neural tube defects, abnormal left-right development. Accordingly, utilities of GAM7776 include diagnosis, prevention and treatment of Prominent midline neural tube defects, abnormal left-right development, and of other diseases and clinical conditions associated with SIL.

The function of SIL and its association with various diseases and clinical conditions, has been established by previous studies, as described hereinabove with reference to GAM30.1. Signal-regulatory protein beta 1 (SIRPB1, Accession NP_006056.1) is another GAM7776 target gene, herein designated TARGET GENE. SIRPB1 BINDING SITE is a target binding site found in the 3' untranslated region of mRNA encoded by SIRPB1, corresponding to a target binding site such as BINDING SITE I, BINDING SITE II or BINDING SITE III of FIG. 8. Table 4 illustrates the complementarity of the nucleotide sequences of SIRPB1 BINDING SITE, designated SEQ ID:14771, to the nucleotide sequence of GAM7776 RNA, herein designated GAM RNA, also designated SEQ ID:246.

Another function of GAM7776 is therefore inhibition of Signal-regulatory protein beta 1 (SIRPB1, Accession NP_006056.1). Accordingly, utilities of GAM7776 include diagnosis, prevention and treatment of diseases and clinical conditions associated with SIRPB1.

Src-like-adaptor 2 (SLA2, Accession NP_778252.1) is another GAM7776 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:19573, to the nucleotide sequence of GAM7776 RNA, herein designated GAM RNA, also designated SEQ ID:246.

Another function of GAM7776 is therefore inhibition of Src-like-adaptor 2 (SLA2, Accession NP_778252.1). Accordingly, utilities of GAM7776 include diagnosis, prevention and treatment of diseases and clinical conditions associated with SLA2.

Src-like-adaptor 2 (SLA2, Accession NP_115590.1) is another GAM7776 target gene, herein designated TARGET GENE. SLA2 BINDING SITE is a target binding site found in the 3' untranslated region of multiple transcripts of mRNA encoded by SLA2, corresponding to a target binding site such as BINDING SITE I, BINDING SITE II or BINDING SITE III of FIG. 8. Table 4 illustrates the complementarity of the nucleotide sequences of SLA2 BINDING SITE, designated SEQ ID:19573, to the nucleotide sequence of GAM7776 RNA, herein designated GAM RNA, also designated SEQ ID:246.

Another function of GAM7776 is therefore inhibition of Src-like-adaptor 2 (SLA2, Accession NP_115590.1). Accordingly, utilities of GAM7776 include diagnosis, prevention and treatment of diseases and clinical conditions associated with SLA2.

Solute carrier family 12 (potassium/chloride transporters), member 8 (SLC12A8, Accession NP_078904.1) is another GAM7776 target gene, herein designated TARGET GENE. SLC12A8 BINDING SITE is a target binding site found in the 3' untranslated region of mRNA encoded by SLC12A8, corresponding to a target binding site such as BINDING SITE I, BINDING SITE II or BINDING SITE III of FIG. 8. Table 4 illustrates the complementarity of the nucleotide sequences of SLC12A8 BINDING SITE, designated SEQ ID:5190, to the nucleotide sequence of GAM7776 RNA, herein designated GAM RNA, also designated SEQ ID:246.

Another function of GAM7776 is therefore inhibition of Solute carrier family 12 (potassium/chloride transporters), member 8 (SLC12A8, Accession NP_078904.1). Accordingly, utilities of GAM7776 include diagnosis, prevention and treatment of diseases and clinical conditions associated with SLC12A8.

Solute carrier family 13 (sodium/sulfate symporters), member 1 (SLC13A1, Accession NP_071889.2) is another GAM7776 target gene, herein designated TARGET GENE. SLC13A1 BINDING SITE is a target binding site found in the 3' untranslated region of mRNA encoded by SLC13A1, corresponding to a target binding site such as BINDING SITE I, BINDING SITE II or BINDING SITE III of FIG. 8. Table 4 illustrates the complementarity of the nucleotide sequences of SLC13A1 BINDING SITE, designated SEQ ID:4370, to the nucleotide sequence of GAM7776 RNA, herein designated GAM RNA, also designated SEQ ID:246.

Another function of GAM7776 is therefore inhibition of Solute carrier family 13 (sodium/sulfate symporters), member 1 (SLC13A1, Accession NP_071889.2). Accordingly, utilities of GAM7776 include diagnosis, prevention and treatment of diseases and clinical conditions associated with SLC13A1.

Solute carrier family 14 (urea transporter), member 2 (SLC14A2, Accession NP_009094.2) is another GAM7776 target gene, herein designated TARGET GENE. SLC14A2 BINDING SITE is a target binding site found in the 5' untranslated region of mRNA encoded by SLC14A2, corresponding to a target binding site such as BINDING SITE I, BINDING SITE II or BINDING SITE III of FIG. 8. Table 4 illustrates the complementarity of the nucleotide sequences of SLC14A2 BINDING SITE, designated SEQ ID:4514, to the nucleotide sequence of GAM7776 RNA, herein designated GAM RNA, also designated SEQ ID:246.

Another function of GAM7776 is therefore inhibition of Solute carrier family 14 (urea transporter), member 2 (SLC14A2, Accession NP_009094.2), a gene which is a renal urea transporter 2. and therefore may be associated with Orthostatic hypotension. Accordingly, utilities of GAM7776 include diagnosis, prevention and treatment of Orthostatic hypotension, and of other diseases and clinical conditions associated with SLC14A2.

The function of SLC14A2 and its association with various diseases and clinical conditions, has been established by previous studies, as described hereinabove with reference to GAM97.1. Solute carrier family 15 (oligopeptide transporter), member 1 (SLC15A1, Accession NP_005064.1) is another GAM7776 target gene, herein designated TARGET GENE. SLC15A1 BINDING SITE is a target binding site found in the 3' untranslated region of mRNA encoded by SLC15A1, corresponding to a target binding site such as BINDING SITE I, BINDING SITE II or BINDING SITE III of FIG. 8. Table 4 illustrates the complementarity of the nucleotide sequences of SLC15A1 BINDING SITE, designated SEQ ID:18930, to the nucleotide sequence of GAM7776 RNA, herein designated GAM RNA, also designated SEQ ID:246.

Another function of GAM7776 is therefore inhibition of Solute carrier family 15 (oligopeptide transporter), member 1 (SLC15A1, Accession NP_005064.1), a gene which is a H(+)-coupled peptide transporter. Accordingly, utilities of GAM7776 include diagnosis, prevention and treatment of diseases and clinical conditions associated with SLC15A1.

The function of SLC15A1 and its association with various diseases and clinical conditions, has been established by previous studies, as described hereinabove with reference to GAM30.1. Solute carrier family 16 (monocarboxylic acid transporters), member 4 (SLC16A4, Accession NP_004687.1) is another GAM7776 target gene, herein designated TARGET GENE. SLC16A4 BINDING SITE is a target binding site found in the 3' untranslated region of mRNA encoded by SLC16A4, corresponding to a target binding site such as BINDING SITE I, BINDING SITE II or BINDING SITE III of FIG. 8. Table 4 illustrates the complementarity of the nucleotide sequences of SLC16A4 BINDING SITE, designated SEQ ID:611, to the nucleotide sequence of GAM7776 RNA, herein designated GAM RNA, also designated SEQ ID:246.

Another function of GAM7776 is therefore inhibition of Solute carrier family 16 (monocarboxylic acid transporters), member 4 (SLC16A4, Accession NP_004687.1). Accordingly, utilities of GAM7776 include diagnosis, prevention and treatment of diseases and clinical conditions associated with SLC16A4.

Solute carrier family 19, member 3 (SLC19A3, Accession NP_079519.1) is another GAM7776 target gene, herein designated TARGET GENE. SLC19A3 BINDING SITE is a target binding site found in the 3' untranslated region of mRNA encoded by SLC19A3, corresponding to a target binding site such as BINDING SITE I, BINDING SITE II or BINDING SITE III of FIG. 8. Table 4 illustrates the complementarity of the nucleotide sequences of SLC19A3 BINDING SITE, designated SEQ ID:6713, to the nucleotide sequence of GAM7776 RNA, herein designated GAM RNA, also designated SEQ ID:246.

Another function of GAM7776 is therefore inhibition of Solute carrier family 19, member 3 (SLC19A3, Accession NP_079519.1). Accordingly, utilities of GAM7776 include diagnosis, prevention and treatment of diseases and clinical conditions associated with SLC19A3.

Solute carrier family 1 (neutral amino acid transporter), member 5 (SLC1A5, Accession NP_005619.1) is another GAM7776 target gene, herein designated TARGET GENE. SLC1A5 BINDING SITE is a target binding site found in the 3' untranslated region of mRNA encoded by SLC1A5, corresponding to a target binding site such as BINDING SITE I, BINDING SITE II or BINDING SITE III of FIG. 8. Table 4 illustrates the complementarity of the nucleotide sequences of SLC1A5 BINDING SITE, designated SEQ ID:1277, to the nucleotide sequence of GAM7776 RNA, herein designated GAM RNA, also designated SEQ ID:246.

Another function of GAM7776 is therefore inhibition of Solute carrier family 1 (neutral amino acid transporter), member 5 (SLC1A5, Accession NP_005619.1). Accordingly, utilities of GAM7776 include diagnosis, prevention and treatment of diseases and clinical conditions associated with SLC1A5.

Solute carrier family 24 (sodium/potassium/calcium exchanger), member 1 (SLC24A1, Accession NP_004718.1) is another GAM7776 target gene, herein designated TARGET GENE. SLC24A1 BINDING SITE is a target binding site found in the 3' untranslated region of mRNA encoded by SLC24A1, corresponding to a target binding site such as BINDING SITE I, BINDING SITE II or BINDING SITE III of FIG. 8. Table 4 illustrates the complementarity of the nucleotide sequences of SLC24A1 BINDING SITE, designated SEQ ID:10966, to the nucleotide sequence of GAM7776 RNA, herein designated GAM RNA, also designated SEQ ID:246.

Another function of GAM7776 is therefore inhibition of Solute carrier family 24 (sodium/potassium/calcium exchanger), member 1 (SLC24A1, Accession NP_004718.1), a gene which is a critical component of the visual transduction cascade, controlling the calcium concentration of outer segments during light and darkness. Accordingly, utilities of GAM7776 include diagnosis, prevention and treatment of diseases and clinical conditions associated with SLC24A1.

The function of SLC24A1 and its association with various diseases and clinical conditions, has been established by previous studies, as described hereinabove with reference to GAM130.1. SLC30A5 (Accession NP_076960.1) is another GAM7776 target gene, herein designated TARGET GENE. SLC30A5 BINDING SITE is a target binding site found in the 3' untranslated region of multiple transcripts of mRNA encoded by SLC30A5, corresponding to a target binding site such as BINDING SITE I, BINDING SITE II or BINDING SITE III of FIG. 8. Table 4 illustrates the complementarity of the nucleotide sequences of SLC30A5 BINDING SITE, designated SEQ ID:3692, to the nucleotide sequence of GAM7776 RNA, herein designated GAM RNA, also designated SEQ ID:246.

Another function of GAM7776 is therefore inhibition of SLC30A5 (Accession NP_076960.1). Accordingly, utilities of GAM7776 include diagnosis, prevention and treatment of diseases and clinical conditions associated with SLC30A5.

SLC30A6 (Accession NP_060434.2) is another GAM7776 target gene, herein designated TARGET GENE. SLC30A6 BINDING SITE is a target binding site found in the 3' untranslated region of mRNA encoded by SLC30A6, corresponding to a target binding site such as BINDING SITE I, BINDING SITE II or BINDING SITE III of FIG. 8. Table 4 illustrates the complementarity of the nucleotide sequences of SLC30A6 BINDING SITE, designated SEQ ID:5362, to the nucleotide sequence of GAM7776 RNA, herein designated GAM RNA, also designated SEQ ID:246.

Another function of GAM7776 is therefore inhibition of SLC30A6 (Accession NP_060434.2). Accordingly, utilities of GAM7776 include diagnosis, prevention and treatment of diseases and clinical conditions associated with SLC30A6.

SLC35E2 (Accession XP_049733.6) is another GAM7776 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:13336, to the nucleotide sequence of GAM7776 RNA, herein designated GAM RNA, also designated SEQ ID:246.

Another function of GAM7776 is therefore inhibition of SLC35E2 (Accession XP_049733.6). Accordingly, utilities of GAM7776 include diagnosis, prevention and treatment of diseases and clinical conditions associated with SLC35E2.

Solute carrier family 39 (zinc transporter), member 1 (SLC39A1, Accession NP_055252.2) is another GAM7776 target gene, herein designated TARGET GENE. SLC39A1 BINDING SITE is a target binding site found in the 5' untranslated region of mRNA encoded by SLC39A1, corresponding to a target binding site such as BINDING SITE I, BINDING SITE II or BINDING SITE III of FIG. 8. Table 4 illustrates the complementarity of the nucleotide sequences of SLC39A1 BINDING SITE, designated SEQ ID:9528, to the nucleotide sequence of GAM7776 RNA, herein designated GAM RNA, also designated SEQ ID:246.

Another function of GAM7776 is therefore inhibition of Solute carrier family 39 (zinc transporter), member 1 (SLC39A1, Accession NP_055252.2), a gene which is a divalent (zinc/iron) metal ion transporter. Accordingly, utilities of GAM7776 include diagnosis, prevention and treatment of diseases and clinical conditions associated with SLC39A1.

The function of SLC39A1 and its association with various diseases and clinical conditions, has been established by previous studies, as described hereinabove with reference to GAM175.1. Solute carrier family 4, sodium bicarbonate transporter-like, member 11 (SLC4A11, Accession NP_114423.1) is another GAM7776 target gene, herein designated TARGET GENE. SLC4A11 BINDING SITE is a target binding site found in the 3' untranslated region of mRNA encoded by SLC4A11, corresponding to a target binding site such as BINDING SITE I, BINDING SITE II or BINDING SITE III of FIG. 8. Table 4 illustrates the complementarity of the nucleotide sequences of SLC4A11 BINDING SITE, designated SEQ ID:806, to the nucleotide sequence of GAM7776 RNA, herein designated GAM RNA, also designated SEQ ID:246.

Another function of GAM7776 is therefore inhibition of Solute carrier family 4, sodium bicarbonate transporter-like, member 11 (SLC4A11, Accession NP_114423.1). Accordingly, utilities of GAM7776 include diagnosis, prevention and treatment of diseases and clinical conditions associated with SLC4A11.

Solute carrier family 5 (sodium/glucose cotransporter), member 1 (SLC5A1, Accession NP_000334.1) is another GAM7776 target gene, herein designated TARGET GENE. SLC5A1 BINDING SITE is a target binding site found in the 3' untranslated region of mRNA encoded by SLC5A1, corresponding to a target binding site such as BINDING SITE I, BINDING SITE II or BINDING SITE III of FIG. 8. Table 4 illustrates the complementarity of the nucleotide sequences of SLC5A1 BINDING SITE, designated SEQ ID:2571, to the nucleotide sequence of GAM7776 RNA, herein designated GAM RNA, also designated SEQ ID:246.

Another function of GAM7776 is therefore inhibition of Solute carrier family 5 (sodium/glucose cotransporter), member 1 (SLC5A1, Accession NP_000334.1). Accordingly, utilities of GAM7776 include diagnosis, prevention and treatment of diseases and clinical conditions associated with SLC5A1.

Solute carrier family 6 (neurotransmitter transporter), member 14 (SLC6A14, Accession NP_009162.1) is another GAM7776 target gene, herein designated TARGET GENE. SLC6A14 BINDING SITE is a target binding site found in the 3' untranslated region of mRNA encoded by SLC6A14, corresponding to a target binding site such as BINDING SITE I, BINDING SITE II or BINDING SITE III of FIG. 8. Table 4 illustrates the complementarity of the nucleotide sequences of SLC6A14 BINDING SITE, designated SEQ ID:13830, to the nucleotide sequence of GAM7776 RNA, herein designated GAM RNA, also designated SEQ ID:246.

Another function of GAM7776 is therefore inhibition of Solute carrier family 6 (neurotransmitter transporter), member 14 (SLC6A14, Accession NP_009162.1). Accordingly, utilities of GAM7776 include diagnosis, prevention and treatment of diseases and clinical conditions associated with SLC6A14.

Solute carrier family 6 (neurotransmitter transporter, dopamine), member 3 (SLC6A3, Accession NP_001035.1) is another GAM7776 target gene, herein designated TARGET GENE. SLC6A3 BINDING SITE is a target binding site found in the 3' untranslated region of mRNA encoded by SLC6A3, corresponding to a target binding site such as BINDING SITE I, BINDING SITE II or BINDING SITE III of FIG. 8. Table 4 illustrates the complementarity of the nucleotide sequences of SLC6A3 BINDING SITE, designated SEQ ID:12941, to the nucleotide sequence of GAM7776 RNA, herein designated GAM RNA, also designated SEQ ID:246.

Another function of GAM7776 is therefore inhibition of Solute carrier family 6 (neurotransmitter transporter, dopamine), member 3 (SLC6A3, Accession NP_001035.1), a gene which terminates the action of dopamine by its high affinity sodium-dependent reuptake into presynaptic terminals. Accordingly, utilities of GAM7776 include diagnosis, prevention and treatment of diseases and clinical conditions associated with SLC6A3.

The function of SLC6A3 and its association with various diseases and clinical conditions, has been established by previous studies, as described hereinabove with reference to GAM189.1. SMAC (Accession NP_620308.1) is another GAM7776 target gene, herein designated TARGET GENE. SMAC BINDING SITE1 and SMAC BINDING SITE2 are target binding sites found in untranslated regions of multiple transcripts of mRNA encoded by SMAC, corresponding to target binding sites such as BINDING SITE I, BINDING SITE II or BINDING SITE III of FIG. 8. Table 4 illustrates the complementarity of the nucleotide sequences of SMAC BINDING SITE1 and SMAC BINDING SITE2, designated SEQ ID:1861 and SEQ ID:18165 respectively, to the nucleotide sequence of GAM7776 RNA, herein designated GAM RNA, also designated SEQ ID:246.

Another function of GAM7776 is therefore inhibition of SMAC (Accession NP_620308.1), a gene which promotes apoptosis via caspase activation. Accordingly, utilities of GAM7776 include diagnosis, prevention and treatment of diseases and clinical conditions associated with SMAC.

The function of SMAC and its association with various diseases and clinical conditions, has been established by previous studies, as described hereinabove with reference to GAM136.1. Synaptosomal-associated protein, 23 kda (SNAP23, Accession NP_570710.1) is another GAM7776 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:19007, to the nucleotide sequence of GAM7776 RNA, herein designated GAM RNA, also designated SEQ ID:246.

Another function of GAM7776 is therefore inhibition of Synaptosomal-associated protein, 23 kda (SNAP23, Accession NP_570710.1), a gene which is essential component of the high affinity receptor for the general membrane fusion machinery. Accordingly, utilities of GAM7776 include diagnosis, prevention and treatment of diseases and clinical conditions associated with SNAP23.

The function of SNAP23 and its association with various diseases and clinical conditions, has been established by previous studies, as described hereinabove with reference to GAM30.1. Synaptosomal-associated protein, 23 kda (SNAP23, Accession NP_003816.2) is another GAM7776 target gene, herein designated TARGET GENE. SNAP23 BINDING SITE is a target binding site found in the 3' untranslated region of multiple transcripts of mRNA encoded by SNAP23, corresponding to a target binding site such as BINDING SITE I, BINDING SITE II or BINDING SITE III of FIG. 8. Table 4 illustrates the complementarity of the nucleotide sequences of SNAP23 BINDING SITE, designated SEQ ID:19007, to the nucleotide sequence of GAM7776 RNA, herein designated GAM RNA, also designated SEQ ID:246.

Another function of GAM7776 is therefore inhibition of Synaptosomal-associated protein, 23 kda (SNAP23, Accession NP_003816.2), a gene which is essential component of the high affinity receptor for the general membrane fusion machinery. Accordingly, utilities of GAM7776 include diagnosis, prevention and treatment of diseases and clinical conditions associated with SNAP23.

The function of SNAP23 and its association with various diseases and clinical conditions, has been established by previous studies, as described hereinabove with reference to GAM30.1. SNARK (Accession NP_112214.1) is another GAM7776 target gene, herein designated TARGET GENE. SNARK BINDING SITE is a target binding site found in the 3' untranslated region of mRNA encoded by SNARK, corresponding to a target binding site such as BINDING SITE I, BINDING SITE II or BINDING SITE III of FIG. 8. Table 4 illustrates the complementarity of the nucleotide sequences of SNARK BINDING SITE, designated SEQ ID:18622, to the nucleotide sequence of GAM7776 RNA, herein designated GAM RNA, also designated SEQ ID:246.

Another function of GAM7776 is therefore inhibition of SNARK (Accession NP_112214.1). Accordingly, utilities of GAM7776 include diagnosis, prevention and treatment of diseases and clinical conditions associated with SNARK.

Syntaphilin (SNPH, Accession NP_055538.1) is another GAM7776 target gene, herein designated TARGET GENE. SNPH BINDING SITE is a target binding site found in the 3' untranslated region of mRNA encoded by SNPH, corresponding to a target binding site such as BINDING SITE I, BINDING SITE II or BINDING SITE III of FIG. 8. Table 4 illustrates the complementarity of the nucleotide sequences of SNPH BINDING SITE, designated SEQ ID:15041, to the nucleotide sequence of GAM7776 RNA, herein designated GAM RNA, also designated SEQ ID:246.

Another function of GAM7776 is therefore inhibition of Syntaphilin (SNPH, Accession NP_055538.1). Accordingly, utilities of GAM7776 include diagnosis, prevention and treatment of diseases and clinical conditions associated with SNPH.

Sorting nexin 15 (SNX15, Accession NP_037438.2) is another GAM7776 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:7625, to the nucleotide sequence of GAM7776 RNA, herein designated GAM RNA, also designated SEQ ID:246.

Another function of GAM7776 is therefore inhibition of Sorting nexin 15 (SNX15, Accession NP_037438.2). Accordingly, utilities of GAM7776 include diagnosis, prevention and treatment of diseases and clinical conditions associated with SNX15.

Sorting nexin 15 (SNX15, Accession NP_680086.1) is another GAM7776 target gene, herein designated TARGET GENE. SNX15 BINDING SITE is a target binding site found in the 3' untranslated region of multiple transcripts of mRNA encoded by SNX15, corresponding to a target binding site such as BINDING SITE I, BINDING SITE II or BINDING SITE III of FIG. 8. Table 4 illustrates the complementarity of the nucleotide sequences of SNX15 BINDING SITE, designated SEQ ID:7625, to the nucleotide sequence of GAM7776 RNA, herein designated GAM RNA, also designated SEQ ID:246.

Another function of GAM7776 is therefore inhibition of Sorting nexin 15 (SNX15, Accession NP_680086.1). Accordingly, utilities of GAM7776 include diagnosis, prevention and treatment of diseases and clinical conditions associated with SNX15.

SNX22 (Accession NP_079074.1) is another GAM7776 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:13596, to the nucleotide sequence of GAM7776 RNA, herein designated GAM RNA, also designated SEQ ID:246.

Another function of GAM7776 is therefore inhibition of SNX22 (Accession NP_079074.1). Accordingly, utilities of GAM7776 include diagnosis, prevention and treatment of diseases and clinical conditions associated with SNX22.

SNX27 (Accession NP_112180.4) is another GAM7776 target gene, herein designated TARGET GENE. SNX27 BINDING SITE is a target binding site found in the 3' untranslated region of mRNA encoded by SNX27, corresponding to a target binding site such as BINDING SITE I, BINDING SITE II or BINDING SITE III of FIG. 8. Table 4 illustrates the complementarity of the nucleotide sequences of SNX27 BINDING SITE, designated SEQ ID:16941, to the nucleotide sequence of GAM7776 RNA, herein designated GAM RNA, also designated SEQ ID:246.

Another function of GAM7776 is therefore inhibition of SNX27 (Accession NP_112180.4). Accordingly, utilities of GAM7776 include diagnosis, prevention and treatment of diseases and clinical conditions associated with SNX27.

Sialophorin (gpl115, leukosialin, cd43) (SPN, Accession NP_003114.1) is another GAM7776 target gene, herein designated TARGET GENE. SPN BINDING SITE is a target binding site found in the 3' untranslated region of mRNA encoded by SPN, corresponding to a target binding site such as BINDING SITE I, BINDING SITE II or BINDING SITE III of FIG. 8. Table 4 illustrates the complementarity of the nucleotide sequences of SPN BINDING SITE, designated SEQ ID:16209, to the nucleotide sequence of GAM7776 RNA, herein designated GAM RNA, also designated SEQ ID:246.

Another function of GAM7776 is therefore inhibition of Sialophorin (gpl115, leukosialin, cd43) (SPN, Accession NP_003114.1), a gene which plays a role in the physicochemical properties of the t-cell surface and in lectin binding. presents carbohydrate ligands to selectins. . and therefore may be associated with Wiskott-aldrich syndrome. Accordingly, utilities of GAM7776 include diagnosis, prevention and treatment of Wiskott-aldrich syndrome, and of other diseases and clinical conditions associated with SPN.

The function of SPN and its association with various diseases and clinical conditions, has been established by previous studies, as described hereinabove with reference to GAM130.1. Speckle-type poz protein (SPOP, Accession NP_003554.1) is another GAM7776 target gene, herein designated TARGET GENE. SPOP BINDING SITE is a target binding site found in the 5' untranslated region of mRNA encoded by SPOP, corresponding to a target binding site such as BINDING SITE I, BINDING SITE II or BINDING SITE III of FIG. 8. Table 4 illustrates the complementarity of the nucleotide sequences of SPOP BINDING SITE, designated SEQ ID:5610, to the nucleotide sequence of GAM7776 RNA, herein designated GAM RNA, also designated SEQ ID:246.

Another function of GAM7776 is therefore inhibition of Speckle-type poz protein (SPOP, Accession NP_003554.1). Accordingly, utilities of GAM7776 include diagnosis, prevention and treatment of diseases and clinical conditions associated with SPOP.

SQV7L (Accession XP_047287.1) is another GAM7776 target gene, herein designated TARGET GENE. SQV7L BINDING SITE is a target binding site found in the 5' untranslated region of mRNA encoded by SQV7L, corresponding to a target binding site such as BINDING SITE I, BINDING SITE II or BINDING SITE III of FIG. 8. Table 4 illustrates the complementarity of the nucleotide sequences of SQV7L BINDING SITE, designated SEQ ID:7375, to the nucleotide sequence of GAM7776 RNA, herein designated GAM RNA, also designated SEQ ID:246.

Another function of GAM7776 is therefore inhibition of SQV7L (Accession XP_047287.1). Accordingly, utilities of GAM7776 include diagnosis, prevention and treatment of diseases and clinical conditions associated with SQV7L.

Sarcalumenin (SRL, Accession XP_064152.3) is another GAM7776 target gene, herein designated TARGET GENE. SRL BINDING SITE is a target binding site found in the 3' untranslated region of mRNA encoded by SRL, corresponding to a target binding site such as BINDING SITE I, BINDING SITE II or BINDING SITE III of FIG. 8. Table 4 illustrates the complementarity of the nucleotide sequences of SRL BINDING SITE, designated SEQ ID:6681, to the nucleotide sequence of GAM7776 RNA, herein designated GAM RNA, also designated SEQ ID:246.

Another function of GAM7776 is therefore inhibition of Sarcalumenin (SRL, Accession XP_064152.3). Accordingly, utilities of GAM7776 include diagnosis, prevention and treatment of diseases and clinical conditions associated with SRL.

Serine/arginine repetitive matrix 2 (SRRM2, Accession NP_057417.2) is another GAM7776 target gene, herein designated TARGET GENE. SRRM2 BINDING SITE is a target binding site found in the 5' untranslated region of mRNA encoded by SRRM2, corresponding to a target binding site such as BINDING SITE I, BINDING SITE II or BINDING SITE III of FIG. 8. Table 4 illustrates the complementarity of the nucleotide sequences of SRRM2 BINDING SITE, designated SEQ ID:18975, to the nucleotide sequence of GAM7776 RNA, herein designated GAM RNA, also designated SEQ ID:246.

Another function of GAM7776 is therefore inhibition of Serine/arginine repetitive matrix 2 (SRRM2, Accession NP_057417.2), a gene which RELATED NUCLEAR MATRIX PROTEIN. Accordingly, utilities of GAM7776 include diagnosis, prevention and treatment of diseases and clinical conditions associated with SRRM2.

The function of SRRM2 and its association with various diseases and clinical conditions, has been established by previous studies, as described hereinabove with reference to GAM189.1. Synovial sarcoma translocation, chromosome 18 (SS18, Accession NP_005628.1) is another GAM7776 target gene, herein designated TARGET GENE. SS18 BINDING SITE is a target binding site found in the 3' untranslated region of mRNA encoded by SS18, corresponding to a target binding site such as BINDING SITE I, BINDING SITE II or BINDING SITE III of FIG. 8. Table 4 illustrates the complementarity of the nucleotide sequences of SS18 BINDING SITE, designated SEQ ID:17762, to the nucleotide sequence of GAM7776 RNA, herein designated GAM RNA, also designated SEQ ID:246.

Another function of GAM7776 is therefore inhibition of Synovial sarcoma translocation, chromosome 18 (SS18, Accession NP_005628.1), a gene which is a putative transcriptional activator. and therefore is associated with Human synovial sarcomas. Accordingly, utilities of GAM7776 include diagnosis, prevention and treatment of Human synovial sarcomas, and of other diseases and clinical conditions associated with SS18.

The function of SS18 and its association with various diseases and clinical conditions, has been established by previous studies, as described hereinabove with reference to GAM130.1. STAF65(gamma) (Accession NP_055675.1) is another GAM7776 target gene, herein designated TARGET GENE. STAF65(gamma) BINDING SITE is a target binding site found in the 3' untranslated region of mRNA encoded by STAF65(gamma), corresponding to a target binding site such as BINDING SITE I, BINDING SITE II or BINDING SITE III of FIG. 8. Table 4 illustrates the complementarity of the nucleotide sequences of STAF65(gamma) BINDING SITE, designated SEQ ID:2196, to the nucleotide sequence of GAM7776 RNA, herein designated GAM RNA, also designated SEQ ID:246.

Another function of GAM7776 is therefore inhibition of STAF65(gamma) (Accession NP_055675.1). Accordingly, utilities of GAM7776 include diagnosis, prevention and treatment of diseases and clinical conditions associated with STAF65(gamma).

Staufen, rna binding protein (drosophila) (STAU, Accession NP_004593.1) is another GAM7776 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:3950, to the nucleotide sequence of GAM7776 RNA, herein designated GAM RNA, also designated SEQ ID:246.

Another function of GAM7776 is therefore inhibition of Staufen, rna binding protein (drosophila) (STAU, Accession NP_004593.1), a gene which may play a role in specific positioning of mrnas at given sites in the cell and in stimulating their translation at the site. Accordingly, utilities of GAM7776 include diagnosis, prevention and treatment of diseases and clinical conditions associated with STAU.

The function of STAU and its association with various diseases and clinical conditions, has been established by previous studies, as described hereinabove with reference to GAM37.1. Sulfotransferase, estrogen-preferring (STE, Accession NP_005411.1) is another GAM7776 target gene, herein designated TARGET GENE. STE BINDING SITE is a target binding site found in the 3' untranslated region of mRNA encoded by STE, corresponding to a target binding site such as BINDING SITE I, BINDING SITE II or BINDING SITE III of FIG. 8. Table 4 illustrates the complementarity of the nucleotide sequences of STE BINDING SITE, designated SEQ ID:3303, to the nucleotide sequence of GAM7776 RNA, herein designated GAM RNA, also designated SEQ ID:246.

Another function of GAM7776 is therefore inhibition of Sulfotransferase, estrogen-preferring (STE, Accession NP_005411.1), a gene which sulfates estrone and dehydroepiandrosterone, but not dopamine. Accordingly, utilities of GAM7776 include diagnosis, prevention and treatment of diseases and clinical conditions associated with STE.

The function of STE and its association with various diseases and clinical conditions, has been established by previous studies, as described hereinabove with reference to GAM189.1. Six transmembrane epithelial antigen of prostate 2 (STEAP2, Accession NP_694544.1) is another GAM7776 target gene, herein designated TARGET GENE. STEAP2 BINDING SITE is a target binding site found in the 3' untranslated region of mRNA encoded by STEAP2, corresponding to a target binding site such as BINDING SITE I, BINDING SITE II or BINDING SITE III of FIG. 8. Table 4 illustrates the complementarity of the nucleotide sequences of STEAP2 BINDING SITE, designated SEQ ID:9147, to the nucleotide sequence of GAM7776 RNA, herein designated GAM RNA, also designated SEQ ID:246.

Another function of GAM7776 is therefore inhibition of Six transmembrane epithelial antigen of prostate 2 (STEAP2, Accession NP_694544.1). Accordingly, utilities of GAM7776 include diagnosis, prevention and treatment of diseases and clinical conditions associated with STEAP2.

Stomatin (STOM, Accession NP_004090.3) is another GAM7776 target gene, herein designated TARGET GENE. STOM BINDING SITE is a target binding site found in the 3' untranslated region of mRNA encoded by STOM, corresponding to a target binding site such as BINDING SITE I, BINDING SITE II or BINDING SITE III of FIG. 8. Table 4 illustrates the complementarity of the nucleotide sequences of STOM BINDING SITE, designated SEQ ID:2907, to the nucleotide sequence of GAM7776 RNA, herein designated GAM RNA, also designated SEQ ID:246.

Another function of GAM7776 is therefore inhibition of Stomatin (STOM, Accession NP_004090.3). Accordingly, utilities of GAM7776 include diagnosis, prevention and treatment of diseases and clinical conditions associated with STOM.

Syntaxin 12 (STX12, Accession NP_803173.1) is another GAM7776 target gene, herein designated TARGET GENE. STX12 BINDING SITE is a target binding site found in the 3' untranslated region of mRNA encoded by STX12, corresponding to a target binding site such as BINDING SITE I, BINDING SITE II or BINDING SITE III of FIG. 8. Table 4 illustrates the complementarity of the nucleotide sequences of STX12 BINDING SITE, designated SEQ ID:12575, to the nucleotide sequence of GAM7776 RNA, herein designated GAM RNA, also designated SEQ ID:246.

Another function of GAM7776 is therefore inhibition of Syntaxin 12 (STX12, Accession NP_803173.1). Accordingly, utilities of GAM7776 include diagnosis, prevention and treatment of diseases and clinical conditions associated with STX12.

Synaptotagmin xi (SYT11, Accession NP_689493.2) is another GAM7776 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:9033, to the nucleotide sequence of GAM7776 RNA, herein designated GAM RNA, also designated SEQ ID:246.

Another function of GAM7776 is therefore inhibition of Synaptotagmin xi (SYT11, Accession NP_689493.2). Accordingly, utilities of GAM7776 include diagnosis, prevention and treatment of diseases and clinical conditions associated with SYT11.

Synaptotagmin xiii (SYT13, Accession NP_065877.1) is another GAM7776 target gene, herein designated TARGET GENE. SYT13 BINDING SITE is a target binding site found in the 3' untranslated region of mRNA encoded by SYT13, corresponding to a target binding site such as BINDING SITE I, BINDING SITE II or BINDING SITE III of FIG. 8. Table 4 illustrates the complementarity of the nucleotide sequences of SYT13 BINDING SITE, designated SEQ ID:15294, to the nucleotide sequence of GAM7776 RNA, herein designated GAM RNA, also designated SEQ ID:246.

Another function of GAM7776 is therefore inhibition of Synaptotagmin xiii (SYT13, Accession NP_065877.1). Accordingly, utilities of GAM7776 include diagnosis, prevention and treatment of diseases and clinical conditions associated with SYT13.

TADA3L (Accession NP_597814.1) is another GAM7776 target gene, herein designated TARGET GENE. TADA3L BINDING SITE is a target binding site found in the 3' untranslated region of multiple transcripts of mRNA encoded by TADA3L, corresponding to a target binding site such as BINDING SITE I, BINDING SITE II or BINDING SITE III of FIG. 8. Table 4 illustrates the complementarity of the nucleotide sequences of TADA3L BINDING SITE, designated SEQ ID:9087, to the nucleotide sequence of GAM7776 RNA, herein designated GAM RNA, also designated SEQ ID:246.

Another function of GAM7776 is therefore inhibition of TADA3L (Accession NP_597814.1). Accordingly, utilities of GAM7776 include diagnosis, prevention and treatment of diseases and clinical conditions associated with TADA3L.

T-cell acute lymphocytic leukemia 1 (TAL1, Accession NP_003180.1) is another GAM7776 target gene, herein designated TARGET GENE. TAL1 BINDING SITE is a target binding site found in the 3' untranslated region of mRNA encoded by TAL1, corresponding to a target binding site such as BINDING SITE I, BINDING SITE II or BINDING SITE III of FIG. 8. Table 4 illustrates the complementarity of the nucleotide sequences of TAL1 BINDING SITE, designated SEQ ID:18260, to the nucleotide sequence of GAM7776 RNA, herein designated GAM RNA, also designated SEQ ID:246.

Another function of GAM7776 is therefore inhibition of T-cell acute lymphocytic leukemia 1 (TAL1, Accession NP_003180.1), a gene which may help control cell growth and differentiation. Accordingly, utilities of GAM7776 include diagnosis, prevention and treatment of diseases and clinical conditions associated with TAL1.

The function of TAL1 and its association with various diseases and clinical conditions, has been established by previous studies, as described hereinabove with reference to GAM30.1. Tap binding protein (tapasin) (TAPBP, Accession NP_003181.3) is another GAM7776 target gene, herein designated TARGET GENE. TAPBP BINDING SITE1 through TAPBP BINDING SITE3 are target binding sites found in untranslated regions of multiple transcripts of mRNA encoded by TAPBP, corresponding to target binding sites such as BINDING SITE I, BINDING SITE II or BINDING SITE III of FIG. 8. Table 4 illustrates the complementarity of the nucleotide sequences of TAPBP BINDING SITE1 through TAPBP BINDING SITE3, designated SEQ ID:16940, SEQ ID:11523 and SEQ ID:12247 respectively, to the nucleotide sequence of GAM7776 RNA, herein designated GAM RNA, also designated SEQ ID:246.

Another function of GAM7776 is therefore inhibition of Tap binding protein (tapasin) (TAPBP, Accession NP_003181.3), a gene which is involved in MHC class I-restricted antigen processing. Accordingly, utilities of GAM7776 include diagnosis, prevention and treatment of diseases and clinical conditions associated with TAPBP.

The function of TAPBP and its association with various diseases and clinical conditions, has been established by previous studies, as described hereinabove with reference to GAM136.1. Tyrosine aminotransferase (TAT, Accession NP_000344.1) is another GAM7776 target gene, herein designated TARGET GENE. TAT BINDING SITE is a target binding site found in the 3' untranslated region of mRNA encoded by TAT, corresponding to a target binding site such as BINDING SITE I, BINDING SITE II or BINDING SITE III of FIG. 8. Table 4 illustrates the complementarity of the nucleotide sequences of TAT BINDING SITE, designated SEQ ID:18942, to the nucleotide sequence of GAM7776 RNA, herein designated GAM RNA, also designated SEQ ID:246.

Another function of GAM7776 is therefore inhibition of Tyrosine aminotransferase (TAT, Accession NP_000344.1), a gene which is tyrosine aminotransferase and strongly similar to rat Rn.9947, which plays a role in gluconeogenesis. Accordingly, utilities of GAM7776 include diagnosis, prevention and treatment of diseases and clinical conditions associated with TAT.

The function of TAT and its association with various diseases and clinical conditions, has been established by previous studies, as described hereinabove with reference to GAM189.1. Tbc1 domain family, member 5 (TBC1D5, Accession NP_055559.1) is another GAM7776 target gene, herein designated TARGET GENE. TBC1D5 BINDING SITE1 and TBC1D5 BINDING SITE2 are target binding sites found in untranslated regions of mRNA encoded by TBC1D5, corresponding to target binding sites such as BINDING SITE I, BINDING SITE II or BINDING SITE III of FIG. 8. Table 4 illustrates the complementarity of the nucleotide sequences of TBC1D5 BINDING SITE1 and TBC1D5 BINDING SITE2, designated SEQ ID:16449 and SEQ ID:14859 respectively, to the nucleotide sequence of GAM7776 RNA, herein designated GAM RNA, also designated SEQ ID:246.

Another function of GAM7776 is therefore inhibition of Tbc1 domain family, member 5 (TBC1D5, Accession NP_055559.1). Accordingly, utilities of GAM7776 include diagnosis, prevention and treatment of diseases and clinical conditions associated with TBC1D5.

T-box 3 (ulnar mammary syndrome) (TBX3, Accession NP_005987.2) is another GAM7776 target gene, herein designated TARGET GENE. TBX3 BINDING SITE is a target binding site found in the 5' untranslated region of multiple transcripts of mRNA encoded by TBX3, corresponding to a target binding site such as BINDING SITE I, BINDING SITE II or BINDING SITE III of FIG. 8. Table 4 illustrates the complementarity of the nucleotide sequences of TBX3 BINDING SITE, designated SEQ ID:19690, to the nucleotide sequence of GAM7776 RNA, herein designated GAM RNA, also designated SEQ ID:246.

Another function of GAM7776 is therefore inhibition of T-box 3 (ulnar mammary syndrome) (TBX3, Accession NP_005987.2). Accordingly, utilities of GAM7776 include diagnosis, prevention and treatment of diseases and clinical conditions associated with TBX3.

T-box 3 (ulnar mammary syndrome) (TBX3, Accession NP_057653.2) is another GAM7776 target gene, herein designated TARGET GENE. TBX3 BINDING SITE is a target binding site found in the 5' untranslated region of multiple transcripts of mRNA encoded by TBX3, corresponding to a target binding site such as BINDING SITE I, BINDING SITE II or BINDING SITE III of FIG. 8. Table 4 illustrates the complementarity of the nucleotide sequences of TBX3 BINDING SITE, designated SEQ ID:19690, to the nucleotide sequence of GAM7776 RNA, herein designated GAM RNA, also designated SEQ ID:246.

Another function of GAM7776 is therefore inhibition of T-box 3 (ulnar mammary syndrome) (TBX3, Accession NP_057653.2). Accordingly, utilities of GAM7776 include diagnosis, prevention and treatment of diseases and clinical conditions associated with TBX3.

Transcription factor 2, hepatic; lf-b3; variant hepatic nuclear factor (TCF2, Accession NP_006472.1) is another GAM7776 target gene, herein designated TARGET GENE. TCF2 BINDING SITE is a target binding site found in the 3' untranslated region of multiple transcripts of mRNA encoded by TCF2, corresponding to a target binding site such as BINDING SITE I, BINDING SITE II or BINDING SITE III of FIG. 8. Table 4 illustrates the complementarity of the nucleotide sequences of TCF2 BINDING SITE, designated SEQ ID:625, to the nucleotide sequence of GAM7776 RNA, herein designated GAM RNA, also designated SEQ ID:246.

Another function of GAM7776 is therefore inhibition of Transcription factor 2, hepatic; lf-b3; variant hepatic nuclear factor (TCF2, Accession NP_006472.1), a gene which probably binds to the inverted palindrome 5'-gttaatnattaac-3'. and therefore is associated with Maturity-onset diabetes of the young type 5 (mody5), familial hypoplastic glomerulocystic kidney disease (gckd). Accordingly, utilities of GAM7776 include diagnosis, prevention and treatment of Maturity-onset diabetes of the young type 5 (mody5), familial hypoplastic glomerulocystic kidney disease (gckd), and of other diseases and clinical conditions associated with TCF2.

The function of TCF2 and its association with various diseases and clinical conditions, has been established by previous studies, as described hereinabove with reference to GAM144.1. T-cell leukemia/lymphoma 6 (TCL6, Accession NP_065575.1) is another GAM7776 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17450, to the nucleotide sequence of GAM7776 RNA, herein designated GAM RNA, also designated SEQ ID:246.

Another function of GAM7776 is therefore inhibition of T-cell leukemia/lymphoma 6 (TCL6, Accession NP_065575.1). Accordingly, utilities of GAM7776 include diagnosis, prevention and treatment of diseases and clinical conditions associated with TCL6.

T-cell leukemia/lymphoma 6 (TCL6, Accession NP_036600.2) is another GAM7776 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17450, to the nucleotide sequence of GAM7776 RNA, herein designated GAM RNA, also designated SEQ ID:246.

Another function of GAM7776 is therefore inhibition of T-cell leukemia/lymphoma 6 (TCL6, Accession NP_036600.2). Accordingly, utilities of GAM7776 include diagnosis, prevention and treatment of diseases and clinical conditions associated with TCL6.

T-cell leukemia/lymphoma 6 (TCL6, Accession NP_055233.1) is another GAM7776 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17450, to the nucleotide sequence of GAM7776 RNA, herein designated GAM RNA, also designated SEQ ID:246.

Another function of GAM7776 is therefore inhibition of T-cell leukemia/lymphoma 6 (TCL6, Accession NP_055233.1). Accordingly, utilities of GAM7776 include diagnosis, prevention and treatment of diseases and clinical conditions associated with TCL6.

T-cell leukemia/lymphoma 6 (TCL6, Accession NP_065577.2) is another GAM7776 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:17450, to the nucleotide sequence of GAM7776 RNA, herein designated GAM RNA, also designated SEQ ID:246.

Another function of GAM7776 is therefore inhibition of T-cell leukemia/lymphoma 6 (TCL6, Accession NP_065577.2). Accordingly, utilities of GAM7776 include diagnosis, prevention and treatment of diseases and clinical conditions associated with TCL6.

Teratocarcinoma-derived growth factor 1 (TDGF1, Accession NP_003203.1) is another GAM7776 target gene, herein designated TARGET GENE. TDGF1 BINDING SITE is a target binding site found in the 3' untranslated region of mRNA encoded by TDGF1, corresponding to a target binding site such as BINDING SITE I, BINDING SITE II or BINDING SITE III of FIG. 8. Table 4 illustrates the complementarity of the nucleotide sequences of TDGF1 BINDING SITE, designated SEQ ID:8563, to the nucleotide sequence of GAM7776 RNA, herein designated GAM RNA, also designated SEQ ID:246.

Another function of GAM7776 is therefore inhibition of Teratocarcinoma-derived growth factor 1 (TDGF1, Accession NP_003203.1), a gene which can play a role in the determination of the epiblastic cells that subsequently give rise to the mesoderm. and therefore may be associated with Forebrain defects. Accordingly, utilities of GAM7776 include diagnosis, prevention and treatment of Forebrain defects, and of other diseases and clinical conditions associated with TDGF1.

The function of TDGF1 and its association with various diseases and clinical conditions, has been established by previous studies, as described hereinabove with reference to GAM30.1. TERA (Accession NP_067061.1) is another GAM7776 target gene, herein designated TARGET GENE. TERA BINDING SITE1 and TERA BINDING SITE2 are target binding sites found in untranslated regions of mRNA encoded by TERA, corresponding to target binding sites such as BINDING SITE I, BINDING SITE II or BINDING SITE III of FIG. 8. Table 4 illustrates the complementarity of the nucleotide sequences of TERA BINDING SITE1 and TERA BINDING SITE2, designated SEQ ID:14491 and SEQ ID:17755 respectively, to the nucleotide sequence of GAM7776 RNA, herein designated GAM RNA, also designated SEQ ID:246.

Another function of GAM7776 is therefore inhibition of TERA (Accession NP_067061.1). Accordingly, utilities of GAM7776 include diagnosis, prevention and treatment of diseases and clinical conditions associated with TERA.

Telomeric repeat binding factor (nima-interacting) 1 (TERF1, Accession NP_003209.1) is another GAM7776 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:1745, to the nucleotide sequence of GAM7776 RNA, herein designated GAM RNA, also designated SEQ ID:246.

Another function of GAM7776 is therefore inhibition of Telomeric repeat binding factor (nima-interacting) 1 (TERF1, Accession NP_003209.1), a gene which negatively regulates telomere length, involves in regulation of the mitotic spindle. Accordingly, utilities of GAM7776 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor (nima-interacting) 1 (TERF1, Accession NP_059523.1) is another GAM7776 target gene, herein designated TARGET GENE. TERF1 BINDING SITE is a target binding site found in the 3' untranslated region of multiple transcripts of mRNA encoded by TERF1, corresponding to a target binding site such as BINDING SITE I, BINDING SITE II or BINDING SITE III of FIG. 8. Table 4 illustrates the complementarity of the nucleotide sequences of TERF1 BINDING SITE, designated SEQ ID:1745, to the nucleotide sequence of GAM7776 RNA, herein designated GAM RNA, also designated SEQ ID:246.

Another function of GAM7776 is therefore inhibition of Telomeric repeat binding factor (nima-interacting) 1 (TERF1, Accession NP_059523.1), a gene which negatively regulates telomere length, involves in regulation of the mitotic spindle. Accordingly, utilities of GAM7776 include diagnosis, prevention and treatment of diseases and clinical conditions associated with TERF1.

The function of TERF1 and its association with various diseases and clinical conditions, has been established by previous studies, as described hereinabove with reference to GAM189.1. Telomeric repeat binding factor 2 (TERF2, Accession NP_005643.1) is another GAM7776 target gene, herein designated TARGET GENE. TERF2 BINDING SITE is a target binding site found in the 3' untranslated region of mRNA encoded by TERF2, corresponding to a target binding site such as BINDING SITE I, BINDING SITE II or BINDING SITE III of FIG. 8. Table 4 illustrates the complementarity of the nucleotide sequences of TERF2 BINDING SITE, designated SEQ ID:1744, to the nucleotide sequence of GAM7776 RNA, herein designated GAM RNA, also designated SEQ ID:246.

Another function of GAM7776 is therefore inhibition of Telomeric repeat binding factor 2 (TERF2, Accession NP_005643.1), a gene which plays a key role in the protective activity of telomeres. Accordingly, utilities of GAM7776 include diagnosis, prevention and treatment of diseases and clinical conditions associated with TERF2.

The function of TERF2 and its association with various diseases and clinical conditions, has been established by previous studies, as described hereinabove with reference to GAM133.2. Tgfb-induced factor 2 (tale family homeobox)

(TGIF2, Accession NP_068581.1) is another GAM7776 target gene, herein designated TARGET GENE. TGIF2 BINDING SITE is a target binding site found in the 3' untranslated region of mRNA encoded by TGIF2, corresponding to a target binding site such as BINDING SITE I, BINDING SITE II or BINDING SITE III of FIG. 8. Table 4 illustrates the complementarity of the nucleotide sequences of TGIF2 BINDING SITE, designated SEQ ID:6881, to the nucleotide sequence of GAM7776 RNA, herein designated GAM RNA, also designated SEQ ID:246.

Another function of GAM7776 is therefore inhibition of Tgfb-induced factor 2 (tale family homeobox) (TGIF2, Accession NP_068581.1). Accordingly, utilities of GAM7776 include diagnosis, prevention and treatment of diseases and clinical conditions associated with TGIF2.

Tigger transposable element derived 6 (TIGD6, Accession NP_112215.1) is another GAM7776 target gene, herein designated TARGET GENE. TIGD6 BINDING SITE is a target binding site found in the 3' untranslated region of mRNA encoded by TIGD6, corresponding to a target binding site such as BINDING SITE I, BINDING SITE II or BINDING SITE III of FIG. 8. Table 4 illustrates the complementarity of the nucleotide sequences of TIGD6 BINDING SITE, designated SEQ ID:4933, to the nucleotide sequence of GAM7776 RNA, herein designated GAM RNA, also designated SEQ ID:246.

Another function of GAM7776 is therefore inhibition of Tigger transposable element derived 6 (TIGD6, Accession NP_112215.1). Accordingly, utilities of GAM7776 include diagnosis, prevention and treatment of diseases and clinical conditions associated with TIGD6.

TIM50L (Accession XP_053074.2) is another GAM7776 target gene, herein designated TARGET GENE. TIM50L BINDING SITE1 and TIM50L BINDING SITE2 are target binding sites found in untranslated regions of mRNA encoded by TIM50L, corresponding to target binding sites such as BINDING SITE I, BINDING SITE II or BINDING SITE III of FIG. 8. Table 4 illustrates the complementarity of the nucleotide sequences of TIM50L BINDING SITE1 and TIM50L BINDING SITE2, designated SEQ ID:5989 and SEQ ID:10157 respectively, to the nucleotide sequence of GAM7776 RNA, herein designated GAM RNA, also designated SEQ ID:246.

Another function of GAM7776 is therefore inhibition of TIM50L (Accession XP_053074.2). Accordingly, utilities of GAM7776 include diagnosis, prevention and treatment of diseases and clinical conditions associated with TIM50L.

Tousled-like kinase 1 (TLK1, Accession NP_036422.2) is another GAM7776 target gene, herein designated TARGET GENE. TLK1 BINDING SITE is a target binding site found in the 5' untranslated region of mRNA encoded by TLK1, corresponding to a target binding site such as BINDING SITE I, BINDING SITE II or BINDING SITE III of FIG. 8. Table 4 illustrates the complementarity of the nucleotide sequences of TLK1 BINDING SITE, designated SEQ ID:6551, to the nucleotide sequence of GAM7776 RNA, herein designated GAM RNA, also designated SEQ ID:246.

Another function of GAM7776 is therefore inhibition of Tousled-like kinase 1 (TLK1, Accession NP_036422.2). Accordingly, utilities of GAM7776 include diagnosis, prevention and treatment of diseases and clinical conditions associated with TLK1.

Toll-like receptor 5 (TLR5, Accession NP_003259.2) is another GAM7776 target gene, herein designated TARGET GENE. TLR5 BINDING SITE is a target binding site found in the 5' untranslated region of mRNA encoded by TLR5, corresponding to a target binding site such as BINDING SITE I, BINDING SITE II or BINDING SITE III of FIG. 8. Table 4 illustrates the complementarity of the nucleotide sequences of TLR5 BINDING SITE, designated SEQ ID:16229, to the nucleotide sequence of GAM7776 RNA, herein designated GAM RNA, also designated SEQ ID:246.

Another function of GAM7776 is therefore inhibition of Toll-like receptor 5 (TLR5, Accession NP_003259.2), a gene which participates in the innate immune response to bacterial flagellins. Accordingly, utilities of GAM7776 include diagnosis, prevention and treatment of diseases and clinical conditions associated with TLR5.

The function of TLR5 and its association with various diseases and clinical conditions, has been established by previous studies, as described hereinabove with reference to GAM40.1. Transmembrane, cochlear expressed, 1 (TMC1, Accession NP_619636.2) is another GAM7776 target gene, herein designated TARGET GENE. TMC1 BINDING SITE is a target binding site found in the 5' untranslated region of mRNA encoded by TMC1, corresponding to a target binding site such as BINDING SITE I, BINDING SITE II or BINDING SITE III of FIG. 8. Table 4 illustrates the complementarity of the nucleotide sequences of TMC1 BINDING SITE, designated SEQ ID:2152, to the nucleotide sequence of GAM7776 RNA, herein designated GAM RNA, also designated SEQ ID:246.

Another function of GAM7776 is therefore inhibition of Transmembrane, cochlear expressed, 1 (TMC1, Accession NP_619636.2), a gene which is required for normal function of cochlear hair cells and therefore may be associated with Autosomal recessive nonsyndromic neurosensory deafness and autosomal dominant nonsyndromic sensorineural hearing loss. Accordingly, utilities of GAM7776 include diagnosis, prevention and treatment of Autosomal recessive nonsyndromic neurosensory deafness and autosomal dominant nonsyndromic sensorineural hearing loss., and of other diseases and clinical conditions associated with TMC1.

The function of TMC1 and its association with various diseases and clinical conditions, has been established by previous studies, as described hereinabove with reference to GAM136.1. TMEM14A (Accession NP_054770.1) is another GAM7776 target gene, herein designated TARGET GENE. TMEM14A BINDING SITE is a target binding site found in the 5' untranslated region of mRNA encoded by TMEM14A, corresponding to a target binding site such as BINDING SITE I, BINDING SITE II or BINDING SITE III of FIG. 8. Table 4 illustrates the complementarity of the nucleotide sequences of TMEM14A BINDING SITE, designated SEQ ID:5271, to the nucleotide sequence of GAM7776 RNA, herein designated GAM RNA, also designated SEQ ID:246.

Another function of GAM7776 is therefore inhibition of TMEM14A (Accession NP_054770.1). Accordingly, utilities of GAM7776 include diagnosis, prevention and treatment of diseases and clinical conditions associated with TMEM14A.

Transmembrane protease, serine 3 (TMPRSS3, Accession NP_076927.1) is another GAM7776 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM7776 RNA, herein designated GAM RNA, also designated SEQ ID:246.

Another function of GAM7776 is therefore inhibition of Transmembrane protease, serine 3 (TMPRSS3, Accession NP_076927.1). Accordingly, utilities of GAM7776 include diagnosis, prevention and treatment of diseases and clinical conditions associated with TMPRSS3.

Transmembrane protease, serine 3 (TMPRSS3, Accession NP_115777.1) is another GAM7776 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM7776 RNA, herein designated GAM RNA, also designated SEQ ID:246.

Another function of GAM7776 is therefore inhibition of Transmembrane protease, serine 3 (TMPRSS3, Accession NP_115777.1). Accordingly, utilities of GAM7776 include diagnosis, prevention and treatment of diseases and clinical conditions associated with TMPRSS3.

Transmembrane protease, serine 3 (TMPRSS3, Accession NP_115780.1) is another GAM7776 target gene, herein designated TARGET GENE. TMPRSS3 BINDING SITE is a target binding site found in the 3' untranslated region of multiple transcripts of mRNA encoded by TMPRSS3, corresponding to a target binding site such as BINDING SITE I, BINDING SITE II or BINDING SITE III of FIG. 8. Table 4 illustrates the complementarity of the nucleotide sequences of TMPRSS3 BINDING SITE, designated SEQ ID:6625, to the nucleotide sequence of GAM7776 RNA, herein designated GAM RNA, also designated SEQ ID:246.

Another function of GAM7776 is therefore inhibition of Transmembrane protease, serine 3 (TMPRSS3, Accession NP_115780.1). Accordingly, utilities of GAM7776 include diagnosis, prevention and treatment of diseases and clinical conditions associated with TMPRSS3.

Tumor necrosis factor, alpha-induced protein 2 (TNFAIP2, Accession NP_006282.2) is another GAM7776 target gene, herein designated TARGET GENE. TNFAIP2 BINDING SITE1 and TNFAIP2 BINDING SITE2 are target binding sites found in untranslated regions of mRNA encoded by TNFAIP2, corresponding to target binding sites such as BINDING SITE I, BINDING SITE II or BINDING SITE III of FIG. 8. Table 4 illustrates the complementarity of the nucleotide sequences of TNFAIP2 BINDING SITE1 and TNFAIP2 BINDING SITE2, designated SEQ ID:13948 and SEQ ID:17621 respectively, to the nucleotide sequence of GAM7776 RNA, herein designated GAM RNA, also designated SEQ ID:246.

Another function of GAM7776 is therefore inhibition of Tumor necrosis factor, alpha-induced protein 2 (TNFAIP2, Accession NP_006282.2). Accordingly, utilities of GAM7776 include diagnosis, prevention and treatment of diseases and clinical conditions associated with TNFAIP2.

Tumor necrosis factor receptor superfamily, member 10b (TNFRSF10B, Accession NP_003833.3) is another GAM7776 target gene, herein designated TARGET GENE. TNFRSF10B BINDING SITE1 and TNFRSF10B BINDING SITE2 are target binding sites found in untranslated regions of multiple transcripts of mRNA encoded by TNFRSF10B, corresponding to target binding sites such as BINDING SITE I, BINDING SITE II or BINDING SITE III of FIG. 8. Table 4 illustrates the complementarity of the nucleotide sequences of TNFRSF10B BINDING SITE1 and TNFRSF10B BINDING SITE2, designated SEQ ID:4398 and SEQ ID:4398 respectively, to the nucleotide sequence of GAM7776 RNA, herein designated GAM RNA, also designated SEQ ID:246.

Another function of GAM7776 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM7776 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 10b (TNFRSF10B, Accession NP_003833.3) is another GAM7776 target gene, herein designated TARGET GENE. TNFRSF10B BINDING SITE1 and TNFRSF10B BINDING SITE2 are target binding sites found in untranslated regions of multiple transcripts of mRNA encoded by TNFRSF10B, corresponding to target binding sites such as BINDING SITE I, BINDING SITE II or BINDING SITE III of FIG. 8. Table 4 illustrates the complementarity of the nucleotide sequences of TNFRSF10B BINDING SITE1 and TNFRSF10B BINDING SITE2, designated SEQ ID:15107 and SEQ ID:15107 respectively, to the nucleotide sequence of GAM7776 RNA, herein designated GAM RNA, also designated SEQ ID:246.

Another function of GAM7776 is therefore inhibition of Tumor necrosis factor receptor superfamily, member 10b (TNFRSF10B, Accession NP_003833.3), a gene which forms complex that induces apoptosis. and therefore may be associated with Squamous cell carcinoma. Accordingly, utilities of GAM7776 include diagnosis, prevention and treatment of Squamous cell carcinoma, and of other diseases and clinical conditions associated with TNFRSF10B.

The function of TNFRSF10B and its association with various diseases and clinical conditions, has been established by previous studies, as described hereinabove with reference to GAM30.1. Tumor necrosis factor receptor superfamily, member 11a, activator of nfkb (TNFRSF11A, Accession NP_003830.1) is another GAM7776 target gene, herein designated TARGET GENE. TNFRSF11A BINDING SITE is a target binding site found in the 3' untranslated region of mRNA encoded by TNFRSF11A, corresponding to a target binding site such as BINDING SITE I, BINDING SITE II or BINDING SITE III of FIG. 8. Table 4 illustrates the complementarity of the nucleotide sequences of TNFRSF11A BINDING SITE, designated SEQ ID:2200, to the nucleotide sequence of GAM7776 RNA, herein designated GAM RNA, also designated SEQ ID:246.

Another function of GAM7776 is therefore inhibition of Tumor necrosis factor receptor superfamily, member 11a, activator of nfkb (TNFRSF11A, Accession NP_003830.1). Accordingly, utilities of GAM7776 include diagnosis, prevention and treatment of diseases and clinical conditions associated with TNFRSF11A.

Tumor necrosis factor receptor superfamily, member 21 (TNFRSF21, Accession NP_055267.1) is another GAM7776 target gene, herein designated TARGET GENE. TNFRSF21 BINDING SITE is a target binding site found in the 3' untranslated region of mRNA encoded by TNFRSF21, corresponding to a target binding site such as BINDING SITE I, BINDING SITE II or BINDING SITE III of FIG. 8. Table 4 illustrates the complementarity of the nucleotide sequences of TNFRSF21 BINDING SITE, designated SEQ ID:16759, to the nucleotide sequence of GAM7776 RNA, herein designated GAM RNA, also designated SEQ ID:246.

Another function of GAM7776 is therefore inhibition of Tumor necrosis factor receptor superfamily, member 21 (TNFRSF21, Accession NP_055267.1). Accordingly, utilities of GAM7776 include diagnosis, prevention and treatment of diseases and clinical conditions associated with TNFRSF21.

Tumor necrosis factor receptor superfamily, member 9 (TNFRSF9, Accession NP_001552.2) is another GAM7776 target gene, herein designated TARGET GENE. TNFRSF9 BINDING SITE is a target binding site found in the 3' untranslated region of mRNA encoded by TNFRSF9, corresponding to a target binding site such as BINDING SITE I, BINDING SITE II or BINDING SITE III of FIG. 8. Table 4 illustrates the complementarity of the nucleotide sequences of TNFRSF9 BINDING SITE, designated SEQ ID:13464, to the nucleotide sequence of GAM7776 RNA, herein designated GAM RNA, also designated SEQ ID:246.

Another function of GAM7776 is therefore inhibition of Tumor necrosis factor receptor superfamily, member 9 (TNFRSF9, Accession NP_001552.2), a gene which inhibits proliferation of activated T lymphocytes. Accordingly, utilities of GAM7776 include diagnosis, prevention and treatment of diseases and clinical conditions associated with TNFRSF9.

The function of TNFRSF9 and its association with various diseases and clinical conditions, has been established by previous studies, as described hereinabove with reference to GAM189.1. Tensin (TNS, Accession NP_072174.2) is another GAM7776 target gene, herein designated TARGET GENE. TNS BINDING SITE is a target binding site found in the 3' untranslated region of mRNA encoded by TNS, corresponding to a target binding site such as BINDING SITE I, BINDING SITE II or BINDING SITE III of FIG. 8. Table 4 illustrates the complementarity of the nucleotide sequences of TNS BINDING SITE, designated SEQ ID:8787, to the nucleotide sequence of GAM7776 RNA, herein designated GAM RNA, also designated SEQ ID:246.

Another function of GAM7776 is therefore inhibition of Tensin (TNS, Accession NP_072174.2). Accordingly, utilities of GAM7776 include diagnosis, prevention and treatment of diseases and clinical conditions associated with TNS.

TOLLIP (Accession NP_061882.2) is another GAM7776 target gene, herein designated TARGET GENE. TOLLIP BINDING SITE1 and TOLLIP BINDING SITE2 are target binding sites found in untranslated regions of mRNA encoded by TOLLIP, corresponding to target binding sites such as BINDING SITE I, BINDING SITE II or BINDING SITE III of FIG. 8. Table 4 illustrates the complementarity of the nucleotide sequences of TOLLIP BINDING SITE1 and TOLLIP BINDING SITE2, designated SEQ ID:13694 and SEQ ID:3306 respectively, to the nucleotide sequence of GAM7776 RNA, herein designated GAM RNA, also designated SEQ ID:246.

Another function of GAM7776 is therefore inhibition of TOLLIP (Accession NP_061882.2). Accordingly, utilities of GAM7776 include diagnosis, prevention and treatment of diseases and clinical conditions associated with TOLLIP.

Topoisomerase (dna) iii beta (TOP3B, Accession NP_003926.1) is another GAM7776 target gene, herein designated TARGET GENE. TOP3B BINDING SITE is a target binding site found in the 3' untranslated region of mRNA encoded by TOP3B, corresponding to a target binding site such as BINDING SITE I, BINDING SITE II or BINDING SITE III of FIG. 8. Table 4 illustrates the complementarity of the nucleotide sequences of TOP3B BINDING SITE, designated SEQ ID:4495, to the nucleotide sequence of GAM7776 RNA, herein designated GAM RNA, also designated SEQ ID:246.

Another function of GAM7776 is therefore inhibition of Topoisomerase (dna) iii beta (TOP3B, Accession NP_003926.1). Accordingly, utilities of GAM7776 include diagnosis, prevention and treatment of diseases and clinical conditions associated with TOP3B.

Torsin family 1, member b (torsin b) (TOR1B, Accession NP_055321.1) is another GAM7776 target gene, herein designated TARGET GENE. TOR1B BINDING SITE is a target binding site found in the 3' untranslated region of mRNA encoded by TOR1B, corresponding to a target binding site such as BINDING SITE I, BINDING SITE II or BINDING SITE III of FIG. 8. Table 4 illustrates the complementarity of the nucleotide sequences of TOR1B BINDING SITE, designated SEQ ID:14221, to the nucleotide sequence of GAM7776 RNA, herein designated GAM RNA, also designated SEQ ID:246.

Another function of GAM7776 is therefore inhibition of Torsin family 1, member b (torsin b) (TOR1B, Accession NP_055321.1). Accordingly, utilities of GAM7776 include diagnosis, prevention and treatment of diseases and clinical conditions associated with TOR1B.

TOSO (Accession NP_005440.1) is another GAM7776 target gene, herein designated TARGET GENE. TOSO BINDING SITE is a target binding site found in the 3' untranslated region of mRNA encoded by TOSO, corresponding to a target binding site such as BINDING SITE I, BINDING SITE II or BINDING SITE III of FIG. 8. Table 4 illustrates the complementarity of the nucleotide sequences of TOSO BINDING SITE, designated SEQ ID:5682, to the nucleotide sequence of GAM7776 RNA, herein designated GAM RNA, also designated SEQ ID:246.

Another function of GAM7776 is therefore inhibition of TOSO (Accession NP_005440.1). Accordingly, utilities of GAM7776 include diagnosis, prevention and treatment of diseases and clinical conditions associated with TOSO.

Tumor protein p53 (li-fraumeni syndrome) (TP53, Accession NP_000537.2) is another GAM7776 target gene, herein designated TARGET GENE. TP53 BINDING SITE is a target binding site found in the 3' untranslated region of mRNA encoded by TP53, corresponding to a target binding site such as BINDING SITE I, BINDING SITE II or BINDING SITE III of FIG. 8. Table 4 illustrates the complementarity of the nucleotide sequences of TP53 BINDING SITE, designated SEQ ID:4654, to the nucleotide sequence of GAM7776 RNA, herein designated GAM RNA, also designated SEQ ID:246.

Another function of GAM7776 is therefore inhibition of Tumor protein p53 (li-fraumeni syndrome) (TP53, Accession NP_000537.2). Accordingly, utilities of GAM7776 include diagnosis, prevention and treatment of diseases and clinical conditions associated with TP53.

TP53I11 (Accession XP_029347.6) is another GAM7776 target gene, herein designated TARGET GENE. TP53I11 BINDING SITE is a target binding site found in the 5' untranslated region of multiple transcripts of mRNA encoded by TP53I11, corresponding to a target binding site such as BINDING SITE I, BINDING SITE II or BINDING SITE III of FIG. 8. Table 4 illustrates the complementarity of the nucleotide sequences of TP53I11 BINDING SITE, designated SEQ ID:14987, to the nucleotide sequence of GAM7776 RNA, herein designated GAM RNA, also designated SEQ ID:246.

Another function of GAM7776 is therefore inhibition of TP53I11 (Accession XP_029347.6). Accordingly, utilities of GAM7776 include diagnosis, prevention and treatment of diseases and clinical conditions associated with TP53I11.

Thiopurine s-methyltransferase (TPMT, Accession NP_000358.1) is another GAM7776 target gene, herein designated TARGET GENE. TPMT BINDING SITE is a target binding site found in the 3' untranslated region of mRNA encoded by TPMT, corresponding to a target binding site such as BINDING SITE I, BINDING SITE II or BINDING SITE III of FIG. 8. Table 4 illustrates the complementarity of the nucleotide sequences of TPMT BINDING SITE, designated SEQ ID:19670, to the nucleotide sequence of GAM7776 RNA, herein designated GAM RNA, also designated SEQ ID:246.

Another function of GAM7776 is therefore inhibition of Thiopurine s-methyltransferase (TPMT, Accession NP_000358.1), a gene which catalyzes the s-methylation of thiopurine drugs such as 6-mercaptopurine. and therefore may be associated with Thiopurine s-methyltransferase polymorphism. Accordingly, utilities of GAM7776 include diagnosis, prevention and treatment of Thiopurine s-methyltransferase polymorphism, and of other diseases and clinical conditions associated with TPMT.

The function of TPMT and its association with various diseases and clinical conditions, has been established by previous studies, as described hereinabove with reference to GAM130.1. Tnf receptor-associated factor 5 (TRAF5, Accession NP_665702.1) is another GAM7776 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:7045, to the nucleotide sequence of GAM7776 RNA, herein designated GAM RNA, also designated SEQ ID:246.

Another function of GAM7776 is therefore inhibition of Tnf receptor-associated factor 5 (TRAF5, Accession NP_665702.1), a gene which Member of a family of proteins that interact with TNF receptors; binds the lymphotoxin beta receptor (LTBR). Accordingly, utilities of GAM7776 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tnf receptor-associated factor 5 (TRAF5, Accession NP_004610.1) is another GAM7776 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:7045, to the nucleotide sequence of GAM7776 RNA, herein designated GAM RNA, also designated SEQ ID:246.

Another function of GAM7776 is therefore inhibition of Tnf receptor-associated factor 5 (TRAF5, Accession NP_004610.1), a gene which Member of a family of proteins that interact with TNF receptors; binds the lymphotoxin beta receptor (LTBR). Accordingly, utilities of GAM7776 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tripartite motif-containing 16 (TRIM16, Accession NP_006461.2) is another GAM7776 target gene, herein designated TARGET GENE. TRIM16 BINDING SITE is a target binding site found in the 3' untranslated region of mRNA encoded by TRIM16, corresponding to a target binding site such as BINDING SITE I, BINDING SITE II or BINDING SITE III of FIG. 8. Table 4 illustrates the complementarity of the nucleotide sequences of TRIM16 BINDING SITE, designated SEQ ID:4601, to the nucleotide sequence of GAM7776 RNA, herein designated GAM RNA, also designated SEQ ID:246.

Another function of GAM7776 is therefore inhibition of Tripartite motif-containing 16 (TRIM16, Accession NP_006461.2). Accordingly, utilities of GAM7776 include diagnosis, prevention and treatment of diseases and clinical conditions associated with TRIM16.

Tripartite motif-containing 5 (TRIM5, Accession NP_149023.1) is another GAM7776 target gene, herein designated TARGET GENE. TRIM5 BINDING SITE is a target binding site found in the 3' untranslated region of multiple transcripts of mRNA encoded by TRIM5, corresponding to a target binding site such as BINDING SITE I, BINDING SITE II or BINDING SITE III of FIG. 8. Table 4 illustrates the complementarity of the nucleotide sequences of TRIM5 BINDING SITE, designated SEQ ID:5879, to the nucleotide sequence of GAM7776 RNA, herein designated GAM RNA, also designated SEQ ID:246.

Another function of GAM7776 is therefore inhibition of Tripartite motif-containing 5 (TRIM5, Accession NP_149023.1). Accordingly, utilities of GAM7776 include diagnosis, prevention and treatment of diseases and clinical conditions associated with TRIM5.

Tripartite motif-containing 6 (TRIM6, Accession NP_477514.1) is another GAM7776 target gene, herein designated TARGET GENE. TRIM6 BINDING SITE is a target binding site found in the 3' untranslated region of mRNA encoded by TRIM6, corresponding to a target binding site such as BINDING SITE I, BINDING SITE II or BINDING SITE III of FIG. 8. Table 4 illustrates the complementarity of the nucleotide sequences of TRIM6 BINDING SITE, designated SEQ ID:13572, to the nucleotide sequence of GAM7776 RNA, herein designated GAM RNA, also designated SEQ ID:246.

Another function of GAM7776 is therefore inhibition of Tripartite motif-containing 6 (TRIM6, Accession NP_477514.1). Accordingly, utilities of GAM7776 include diagnosis, prevention and treatment of diseases and clinical conditions associated with TRIM6.

TRIP-Br2 (Accession NP_055570.1) is another GAM7776 target gene, herein designated TARGET GENE. TRIP-Br2 BINDING SITE is a target binding site found in the 3' untranslated region of mRNA encoded by TRIP-Br2, corresponding to a target binding site such as BINDING SITE I, BINDING SITE II or BINDING SITE III of FIG. 8. Table 4 illustrates the complementarity of the nucleotide sequences of TRIP-Br2 BINDING SITE, designated SEQ ID:19574, to the nucleotide sequence of GAM7776 RNA, herein designated GAM RNA, also designated SEQ ID:246.

Another function of GAM7776 is therefore inhibition of TRIP-Br2 (Accession NP_055570.1). Accordingly, utilities of GAM7776 include diagnosis, prevention and treatment of diseases and clinical conditions associated with TRIP-Br2.

Transient receptor potential cation channel, subfamily m, member 6 (TRPM6, Accession NP_060132.3) is another GAM7776 target gene, herein designated TARGET GENE. TRPM6 BINDING SITE is a target binding site found in the 3' untranslated region of mRNA encoded by TRPM6, corresponding to a target binding site such as BINDING SITE I, BINDING SITE II or BINDING SITE III of FIG. 8. Table 4 illustrates the complementarity of the nucleotide sequences of TRPM6 BINDING SITE, designated SEQ ID:18177, to the nucleotide sequence of GAM7776 RNA, herein designated GAM RNA, also designated SEQ ID:246.

Another function of GAM7776 is therefore inhibition of Transient receptor potential cation channel, subfamily m, member 6 (TRPM6, Accession NP_060132.3), a gene which contains a predicted ion channel domain and a protein kinase domain. and therefore is associated with Hypomagnesemia with secondary hypocalcemia. Accordingly, utilities of GAM7776 include diagnosis, prevention and treatment of Hypomagnesemia with secondary hypocalcemia, and of other diseases and clinical conditions associated with TRPM6.

The function of TRPM6 and its association with various diseases and clinical conditions, has been established by previous studies, as described hereinabove with reference to GAM130.1. Transient receptor potential cation channel, subfamily v, member 1 (TRPV1, Accession NP_061197.3) is another GAM7776 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:19833 and SEQ ID:19833 respectively, to the nucleotide sequence of GAM7776 RNA, herein designated GAM RNA, also designated SEQ ID:246.

Another function of GAM7776 is therefore inhibition of Transient receptor potential cation channel, subfamily v, member 1 (TRPV1, Accession NP_061197.3), a gene which functions as a receptor for capsaicin. Accordingly, utilities of GAM7776 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542435.1) is another GAM7776 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:16980 and SEQ ID:19833 respectively, to the nucleotide sequence of GAM7776 RNA, herein designated GAM RNA, also designated SEQ ID:246.

Another function of GAM7776 is therefore inhibition of Transient receptor potential cation channel, subfamily v, member 1 (TRPV1, Accession NP_542435.1), a gene which functions as a receptor for capsaicin. Accordingly, utilities of GAM7776 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_061197.3) is another GAM7776 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:16980 and SEQ ID:19833 respectively, to the nucleotide sequence of GAM7776 RNA, herein designated GAM RNA, also designated SEQ ID:246.

Another function of GAM7776 is therefore inhibition of Transient receptor potential cation channel, subfamily v, member 1 (TRPV1, Accession NP_061197.3), a gene which functions as a receptor for capsaicin. Accordingly, utilities of GAM7776 include diagnosis, prevention and treatment of diseases and clinical conditions associated with TRPV1.

The function of TRPV1 and its association with various diseases and clinical conditions, has been established by previous studies, as described hereinabove with reference to GAM130.1. Transient receptor potential cation channel, subfamily v, member 1 (TRPV1, Accession NP_542437.1) is another GAM7776 target gene, herein designated TARGET GENE. TRPV1 BINDING SITE1 and TRPV1 BINDING SITE2 are target binding sites found in untranslated regions of multiple transcripts of mRNA encoded by TRPV1, corresponding to target binding sites such as BINDING SITE I, BINDING SITE II or BINDING SITE III of FIG. 8. Table 4 illustrates the complementarity of the nucleotide sequences of TRPV1 BINDING SITE1 and TRPV1 BINDING SITE2, designated SEQ ID:16980 and SEQ ID:16980 respectively, to the nucleotide sequence of GAM7776 RNA, herein designated GAM RNA, also designated SEQ ID:246.

Another function of GAM7776 is therefore inhibition of Transient receptor potential cation channel, subfamily v, member 1 (TRPV1, Accession NP_542437.1), a gene which functions as a receptor for capsaicin. Accordingly, utilities of GAM7776 include diagnosis, prevention and treatment of diseases and clinical conditions associated with TRPV1.

The function of TRPV1 and its association with various diseases and clinical conditions, has been established by previous studies, as described hereinabove with reference to GAM130.1. Tuberous sclerosis 1 (TSC1, Accession NP_000359.1) is another GAM7776 target gene, herein designated TARGET GENE. TSC1 BINDING SITE is a target binding site found in the 3' untranslated region of mRNA encoded by TSC1, corresponding to a target binding site such as BINDING SITE I, BINDING SITE II or BINDING SITE III of FIG. 8. Table 4 illustrates the complementarity of the nucleotide sequences of TSC1 BINDING SITE, designated SEQ ID:15082, to the nucleotide sequence of GAM7776 RNA, herein designated GAM RNA, also designated SEQ ID:246.

Another function of GAM7776 is therefore inhibition of Tuberous sclerosis 1 (TSC1, Accession NP_000359.1). Accordingly, utilities of GAM7776 include diagnosis, prevention and treatment of diseases and clinical conditions associated with TSC1.

Tspy-like (TSPy, Accession XP_166325.1) is another GAM7776 target gene, herein designated TARGET GENE. TSPYL BINDING SITE is a target binding site found in the 3' untranslated region of mRNA encoded by TSPy, corresponding to a target binding site such as BINDING SITE I, BINDING SITE II or BINDING SITE III of FIG. 8. Table 4 illustrates the complementarity of the nucleotide sequences of TSPYL BINDING SITE, designated SEQ ID:15042, to the nucleotide sequence of GAM7776 RNA, herein designated GAM RNA, also designated SEQ ID:246.

Another function of GAM7776 is therefore inhibition of Tspy-like (TSPy, Accession XP_166325.1). Accordingly, utilities of GAM7776 include diagnosis, prevention and treatment of diseases and clinical conditions associated with TSPYL.

TTY7 (Accession NP__114132.1) is another GAM7776 target gene, herein designated TARGET GENE. TTY7 BINDING SITE is a target binding site found in the 5' untranslated region of mRNA encoded by TTY7, corresponding to a target binding site such as BINDING SITE I, BINDING SITE II or BINDING SITE III of FIG. 8. Table 4 illustrates the complementarity of the nucleotide sequences of TTY7 BINDING SITE, designated SEQ ID:1016, to the nucleotide sequence of GAM7776 RNA, herein designated GAM RNA, also designated SEQ ID:246.

Another function of GAM7776 is therefore inhibition of TTY7 (Accession NP__114132.1). Accordingly, utilities of GAM7776 include diagnosis, prevention and treatment of diseases and clinical conditions associated with TTY7.

TU12B1-TY (Accession NP__057659.1) is another GAM7776 target gene, herein designated TARGET GENE. TU12B1-TY BINDING SITE1 through TU12B1-TY BINDING SITE3 are target binding sites found in untranslated regions of mRNA encoded by TU12B1-TY, corresponding to target binding sites such as BINDING SITE I, BINDING SITE II or BINDING SITE III of FIG. 8. Table 4 illustrates the complementarity of the nucleotide sequences of TU12B1-TY BINDING SITE1 through TU12B1-TY BINDING SITE3, designated SEQ ID:4256, SEQ ID:16036 and SEQ ID:15780 respectively, to the nucleotide sequence of GAM7776 RNA, herein designated GAM RNA, also designated SEQ ID:246.

Another function of GAM7776 is therefore inhibition of TU12B1-TY (Accession NP__057659.1). Accordingly, utilities of GAM7776 include diagnosis, prevention and treatment of diseases and clinical conditions associated with TU12B1-TY.

TUCAN (Accession NP__055774.1) is another GAM7776 target gene, herein designated TARGET GENE. TUCAN BINDING SITE1 and TUCAN BINDING SITE2 are target binding sites found in untranslated regions of mRNA encoded by TUCAN, corresponding to target binding sites such as BINDING SITE I, BINDING SITE II or BINDING SITE III of FIG. 8. Table 4 illustrates the complementarity of the nucleotide sequences of TUCAN BINDING SITE1 and TUCAN BINDING SITE2, designated SEQ ID:9530 and SEQ ID:7106 respectively, to the nucleotide sequence of GAM7776 RNA, herein designated GAM RNA, also designated SEQ ID:246.

Another function of GAM7776 is therefore inhibition of TUCAN (Accession NP__055774.1). Accordingly, utilities of GAM7776 include diagnosis, prevention and treatment of diseases and clinical conditions associated with TUCAN.

TXL-2 (Accession NP__835231.1) is another GAM7776 target gene, herein designated TARGET GENE. TXL-2 BINDING SITE is a target binding site found in the 5' untranslated region of mRNA encoded by TXL-2, corresponding to a target binding site such as BINDING SITE I, BINDING SITE II or BINDING SITE III of FIG. 8. Table 4 illustrates the complementarity of the nucleotide sequences of TXL-2 BINDING SITE, designated SEQ ID:15381, to the nucleotide sequence of GAM7776 RNA, herein designated GAM RNA, also designated SEQ ID:246.

Another function of GAM7776 is therefore inhibition of TXL-2 (Accession NP__835231.1). Accordingly, utilities of GAM7776 include diagnosis, prevention and treatment of diseases and clinical conditions associated with TXL-2.

Thioredoxin-like 2 (TXNL2, Accession NP__006532.1) is another GAM7776 target gene, herein designated TARGET GENE. TXNL2 BINDING SITE1 and TXNL2 BINDING SITE2 are target binding sites found in untranslated regions of mRNA encoded by TXNL2, corresponding to target binding sites such as BINDING SITE I, BINDING SITE II or BINDING SITE III of FIG. 8. Table 4 illustrates the complementarity of the nucleotide sequences of TXNL2 BINDING SITE1 and TXNL2 BINDING SITE2, designated SEQ ID:9147 and SEQ ID:19232 respectively, to the nucleotide sequence of GAM7776 RNA, herein designated GAM RNA, also designated SEQ ID:246.

Another function of GAM7776 is therefore inhibition of Thioredoxin-like 2 (TXNL2, Accession NP__006532.1). Accordingly, utilities of GAM7776 include diagnosis, prevention and treatment of diseases and clinical conditions associated with TXNL2.

U1SNRNPBP (Accession NP__851030.1) is another GAM7776 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM7776 RNA, herein designated GAM RNA, also designated SEQ ID:246.

Another function of GAM7776 is therefore inhibition of U1SNRNPBP (Accession NP__851030.1). Accordingly, utilities of GAM7776 include diagnosis, prevention and treatment of diseases and clinical conditions associated with U1SNRNPBP.

U1SNRNPBP (Accession NP__851034.1) is another GAM7776 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM7776 RNA, herein designated GAM RNA, also designated SEQ ID:246.

Another function of GAM7776 is therefore inhibition of U1SNRNPBP (Accession NP__851034.1). Accordingly, utilities of GAM7776 include diagnosis, prevention and treatment of diseases and clinical conditions associated with U1SNRNPBP.

U1SNRNPBP (Accession NP__008951.1) is another GAM7776 target gene, herein designated TARGET GENE. U1SNRNPBP BINDING SITE is a target binding site found in the 5' untranslated region of multiple transcripts of mRNA encoded by U1SNRNPBP, corresponding to a target binding site such as BINDING SITE I, BINDING SITE II or BINDING SITE III of FIG. 8. Table 4 illustrates the complementarity of the nucleotide sequences of U1SNRNPBP BINDING SITE, designated SEQ ID:9590, to the nucleotide sequence of GAM7776 RNA, herein designated GAM RNA, also designated SEQ ID:246.

Another function of GAM7776 is therefore inhibition of U1SNRNPBP (Accession NP__008951.1). Accordingly, utilities of GAM7776 include diagnosis, prevention and treatment of diseases and clinical conditions associated with U1SNRNPBP.

UCK1 (Accession NP__113620.1) is another GAM7776 target gene, herein designated TARGET GENE. UCK1 BINDING SITE is a target binding site found in the 3' untranslated region of mRNA encoded by UCK1, corresponding to a target binding site such as BINDING SITE I, BINDING SITE II or BINDING SITE III of FIG. 8. Table 4 illustrates the complementarity of the nucleotide sequences of UCK1 BINDING SITE, designated SEQ ID:11791, to the nucleotide sequence of GAM7776 RNA, herein designated GAM RNA, also designated SEQ ID:246.

Another function of GAM7776 is therefore inhibition of UCK1 (Accession NP_113620.1). Accordingly, utilities of GAM7776 include diagnosis, prevention and treatment of diseases and clinical conditions associated with UCK1.

Udp-glucose dehydrogenase (UGDH, Accession NP_003350.1) is another GAM7776 target gene, herein designated TARGET GENE. UGDH BINDING SITE is a target binding site found in the 3' untranslated region of mRNA encoded by UGDH, corresponding to a target binding site such as BINDING SITE I, BINDING SITE II or BINDING SITE III of FIG. 8. Table 4 illustrates the complementarity of the nucleotide sequences of UGDH BINDING SITE, designated SEQ ID:7909, to the nucleotide sequence of GAM7776 RNA, herein designated GAM RNA, also designated SEQ ID:246.

Another function of GAM7776 is therefore inhibition of Udp-glucose dehydrogenase (UGDH, Accession NP_003350.1), a gene which is an UDP- glucose dehydrogenase. Accordingly, utilities of GAM7776 include diagnosis, prevention and treatment of diseases and clinical conditions associated with UGDH.

The function of UGDH and its association with various diseases and clinical conditions, has been established by previous studies, as described hereinabove with reference to GAM69.2. Udp glycosyltransferase 1 family, polypeptide a1 (UGT1A1, Accession NP_000454.1) is another GAM7776 target gene, herein designated TARGET GENE. UGT1A1 BINDING SITE is a target binding site found in the 3' untranslated region of mRNA encoded by UGT1A1, corresponding to a target binding site such as BINDING SITE I, BINDING SITE II or BINDING SITE III of FIG. 8. Table 4 illustrates the complementarity of the nucleotide sequences of UGT1A1 BINDING SITE, designated SEQ ID:10967, to the nucleotide sequence of GAM7776 RNA, herein designated GAM RNA, also designated SEQ ID:246.

Another function of GAM7776 is therefore inhibition of Udp glycosyltransferase 1 family, polypeptide a1 (UGT1A1, Accession NP_000454.1). Accordingly, utilities of GAM7776 include diagnosis, prevention and treatment of diseases and clinical conditions associated with UGT1A1.

Udp glycosyltransferase 1 family, polypeptide a10 (UGT1A10, Accession NP_061948.1) is another GAM7776 target gene, herein designated TARGET GENE. UGT1A10 BINDING SITE is a target binding site found in the 3' untranslated region of mRNA encoded by UGT1A10, corresponding to a target binding site such as BINDING SITE I, BINDING SITE II or BINDING SITE III of FIG. 8. Table 4 illustrates the complementarity of the nucleotide sequences of UGT1A10 BINDING SITE, designated SEQ ID:10967, to the nucleotide sequence of GAM7776 RNA, herein designated GAM RNA, also designated SEQ ID:246.

Another function of GAM7776 is therefore inhibition of Udp glycosyltransferase 1 family, polypeptide a10 (UGT1A10, Accession NP_061948.1). Accordingly, utilities of GAM7776 include diagnosis, prevention and treatment of diseases and clinical conditions associated with UGT1A10.

Udp glycosyltransferase 1 family, polypeptide a4 (UGT1A4, Accession NP_009051.1) is another GAM7776 target gene, herein designated TARGET GENE. UGT1A4 BINDING SITE is a target binding site found in the 3' untranslated region of mRNA encoded by UGT1A4, corresponding to a target binding site such as BINDING SITE I, BINDING SITE II or BINDING SITE III of FIG. 8. Table 4 illustrates the complementarity of the nucleotide sequences of UGT1A4 BINDING SITE, designated SEQ ID:10967, to the nucleotide sequence of GAM7776 RNA, herein designated GAM RNA, also designated SEQ ID:246.

Another function of GAM7776 is therefore inhibition of Udp glycosyltransferase 1 family, polypeptide a4 (UGT1A4, Accession NP_009051.1), a gene which is of major importance in the conjugation and subsequent elimination of potentially toxic xenobiotics and endogenous compounds. and therefore may be associated with Gilbert's syndrome, crigler-najjar. Accordingly, utilities of GAM7776 include diagnosis, prevention and treatment of Gilbert's syndrome, crigler-najjar, and of other diseases and clinical conditions associated with UGT1A4.

The function of UGT1A4 and its association with various diseases and clinical conditions, has been established by previous studies, as described hereinabove with reference to GAM189.1. Udp glycosyltransferase 1 family, polypeptide a6 (UGT1A6, Accession NP_001063.1) is another GAM7776 target gene, herein designated TARGET GENE. UGT1A6 BINDING SITE is a target binding site found in the 3' untranslated region of mRNA encoded by UGT1A6, corresponding to a target binding site such as BINDING SITE I, BINDING SITE II or BINDING SITE III of FIG. 8. Table 4 illustrates the complementarity of the nucleotide sequences of UGT1A6 BINDING SITE, designated SEQ ID:10967, to the nucleotide sequence of GAM7776 RNA, herein designated GAM RNA, also designated SEQ ID:246.

Another function of GAM7776 is therefore inhibition of Udp glycosyltransferase 1 family, polypeptide a6 (UGT1A6, Accession NP_001063.1). Accordingly, utilities of GAM7776 include diagnosis, prevention and treatment of diseases and clinical conditions associated with UGT1A6.

Udp glycosyltransferase 1 family, polypeptide a8 (UGT1A8, Accession NP_061949.3) is another GAM7776 target gene, herein designated TARGET GENE. UGT1A8 BINDING SITE is a target binding site found in the 3' untranslated region of mRNA encoded by UGT1A8, corresponding to a target binding site such as BINDING SITE I, BINDING SITE II or BINDING SITE III of FIG. 8. Table 4 illustrates the complementarity of the nucleotide sequences of UGT1A8 BINDING SITE, designated SEQ ID:10967, to the nucleotide sequence of GAM7776 RNA, herein designated GAM RNA, also designated SEQ ID:246.

Another function of GAM7776 is therefore inhibition of Udp glycosyltransferase 1 family, polypeptide a8 (UGT1A8, Accession NP_061949.3), a gene which is of major importance in the conjugation and subsequent elimination of potentially toxic xenobiotics and endogenous compounds. Accordingly, utilities of GAM7776 include diagnosis, prevention and treatment of diseases and clinical conditions associated with UGT1A8.

The function of UGT1A8 and its association with various diseases and clinical conditions, has been established by previous studies, as described hereinabove with reference to GAM189.1. Udp glycosyltransferase 1 family, polypeptide a9 (UGT1A9, Accession NP_066307.1) is another GAM7776 target gene, herein designated TARGET GENE. UGT1A9 BINDING SITE is a target binding site found in the 3' untranslated region of mRNA encoded by UGT1A9, corresponding to a target binding site such as BINDING SITE I, BINDING SITE II or BINDING SITE III of FIG. 8. Table 4 illustrates the complementarity of the nucleotide sequences of UGT1A9 BINDING SITE, designated SEQ ID:10967, to the nucleotide sequence of GAM7776 RNA, herein designated GAM RNA, also designated SEQ ID:246.

Another function of GAM7776 is therefore inhibition of Udp glycosyltransferase 1 family, polypeptide a9 (UGT1A9, Accession NP_066307.1), a gene which is of major importance in the conjugation and subsequent elimination of potentially toxic xenobiotics and endogenous compounds. Accordingly, utilities of GAM7776 include diagnosis, prevention and treatment of diseases and clinical conditions associated with UGT1A9.

The function of UGT1A9 and its association with various diseases and clinical conditions, has been established by previous studies, as described hereinabove with reference to GAM189.1. Uridine monophosphate synthetase (orotate phosphoribosyl transferase and orotidine-5'-decarboxylase) (UMPS, Accession NP_000364.1) is another GAM7776 target gene, herein designated TARGET GENE. UMPS BINDING SITE is a target binding site found in the 3' untranslated region of mRNA encoded by UMPS, corresponding to a target binding site such as BINDING SITE I, BINDING SITE II or BINDING SITE III of FIG. 8. Table 4 illustrates the complementarity of the nucleotide sequences of UMPS BINDING SITE, designated SEQ ID:2144, to the nucleotide sequence of GAM7776 RNA, herein designated GAM RNA, also designated SEQ ID:246.

Another function of GAM7776 is therefore inhibition of Uridine monophosphate synthetase (orotate phosphoribosyl transferase and orotidine-5'-decarboxylase) (UMPS, Accession NP_000364.1). Accordingly, utilities of GAM7776 include diagnosis, prevention and treatment of diseases and clinical conditions associated with UMPS.

Unc-84 homolog a (c. elegans) (UNC84B, Accession NP_056189.1) is another GAM7776 target gene, herein designated TARGET GENE. UNC84B BINDING SITE is a target binding site found in the 3' untranslated region of multiple transcripts of mRNA encoded by UNC84B, corresponding to a target binding site such as BINDING SITE I, BINDING SITE II or BINDING SITE III of FIG. 8. Table 4 illustrates the complementarity of the nucleotide sequences of UNC84B BINDING SITE, designated SEQ ID:13541, to the nucleotide sequence of GAM7776 RNA, herein designated GAM RNA, also designated SEQ ID:246.

Another function of GAM7776 is therefore inhibition of Unc-84 homolog a (c. elegans) (UNC84B, Accession NP_056189.1). Accordingly, utilities of GAM7776 include diagnosis, prevention and treatment of diseases and clinical conditions associated with UNC84B.

Unc-84 homolog a (c. elegans) (UNC84B, Accession XP_039332.1) is another GAM7776 target gene, herein designated TARGET GENE. UNC84B BINDING SITE is a target binding site found in the 3' untranslated region of multiple transcripts of mRNA encoded by UNC84B, corresponding to a target binding site such as BINDING SITE I, BINDING SITE II or BINDING SITE III of FIG. 8. Table 4 illustrates the complementarity of the nucleotide sequences of UNC84B BINDING SITE, designated SEQ ID:13541, to the nucleotide sequence of GAM7776 RNA, herein designated GAM RNA, also designated SEQ ID:246.

Another function of GAM7776 is therefore inhibition of Unc-84 homolog a (c. elegans) (UNC84B, Accession XP_039332.1). Accordingly, utilities of GAM7776 include diagnosis, prevention and treatment of diseases and clinical conditions associated with UNC84B.

URG4 (Accession NP_060390.2) is another GAM7776 target gene, herein designated TARGET GENE. URG4 BINDING SITE is a target binding site found in the 3' untranslated region of mRNA encoded by URG4, corresponding to a target binding site such as BINDING SITE I, BINDING SITE II or BINDING SITE III of FIG. 8. Table 4 illustrates the complementarity of the nucleotide sequences of URG4 BINDING SITE, designated SEQ ID:6788, to the nucleotide sequence of GAM7776 RNA, herein designated GAM RNA, also designated SEQ ID:246.

Another function of GAM7776 is therefore inhibition of URG4 (Accession NP_060390.2). Accordingly, utilities of GAM7776 include diagnosis, prevention and treatment of diseases and clinical conditions associated with URG4.

Ubiquitin specific protease 22 (USP22, Accession XP_042698.2) is another GAM7776 target gene, herein designated TARGET GENE. USP22 BINDING SITE is a target binding site found in the 3' untranslated region of mRNA encoded by USP22, corresponding to a target binding site such as BINDING SITE I, BINDING SITE II or BINDING SITE III of FIG. 8. Table 4 illustrates the complementarity of the nucleotide sequences of USP22 BINDING SITE, designated SEQ ID:11288, to the nucleotide sequence of GAM7776 RNA, herein designated GAM RNA, also designated SEQ ID:246.

Another function of GAM7776 is therefore inhibition of Ubiquitin specific protease 22 (USP22, Accession XP_042698.2). Accordingly, utilities of GAM7776 include diagnosis, prevention and treatment of diseases and clinical conditions associated with USP22.

VDU1 (Accession NP_055832.2) is another GAM7776 target gene, herein designated TARGET GENE. VDU1 BINDING SITE is a target binding site found in the 3' untranslated region of mRNA encoded by VDU1, corresponding to a target binding site such as BINDING SITE I, BINDING SITE II or BINDING SITE III of FIG. 8. Table 4 illustrates the complementarity of the nucleotide sequences of VDU1 BINDING SITE, designated SEQ ID:3187, to the nucleotide sequence of GAM7776 RNA, herein designated GAM RNA, also designated SEQ ID:246.

Another function of GAM7776 is therefore inhibition of VDU1 (Accession NP_055832.2). Accordingly, utilities of GAM7776 include diagnosis, prevention and treatment of diseases and clinical conditions associated with VDU1.

Vent-like homeobox 2 (VENTX2, Accession NP_055283.1) is another GAM7776 target gene, herein designated TARGET GENE. VENTX2 BINDING SITE is a target binding site found in the 3' untranslated region of mRNA encoded by VENTX2, corresponding to a target binding site such as BINDING SITE I, BINDING SITE II or BINDING SITE III of FIG. 8. Table 4 illustrates the complementarity of the nucleotide sequences of VENTX2 BINDING SITE, designated SEQ ID:19331, to the nucleotide sequence of GAM7776 RNA, herein designated GAM RNA, also designated SEQ ID:246.

Another function of GAM7776 is therefore inhibition of Vent-like homeobox 2 (VENTX2, Accession NP_055283.1). Accordingly, utilities of GAM7776 include diagnosis, prevention and treatment of diseases and clinical conditions associated with VENTX2.

Von hippel-lindau syndrome (VHL, Accession NP_000542.1) is another GAM7776 target gene, herein designated TARGET GENE. VHL BINDING SITE1 and VHL BINDING SITE2 are target binding sites found in untranslated regions of mRNA encoded by VHL, corresponding to target binding sites such as BINDING SITE I, BINDING SITE II or BINDING SITE III of FIG. 8. Table 4 illustrates the complementarity of the nucleotide sequences of VHL BINDING SITE1 and VHL BINDING SITE2, designated SEQ ID:3873 and SEQ ID:8786 respectively, to the nucleotide sequence of GAM7776 RNA, herein designated GAM RNA, also designated SEQ ID:246.

Another function of GAM7776 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM7776 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. Vasoactive intestinal peptide receptor 2 (VIPR2, Accession NP_003373.2) is another GAM7776 target gene, herein designated TARGET GENE. VIPR2 BINDING SITE is a target binding site found in the 3' untranslated region of mRNA encoded by VIPR2, corresponding to a target binding site such as BINDING SITE I, BINDING SITE II or BINDING SITE III of FIG. 8. Table 4 illustrates the complementarity of the nucleotide sequences of VIPR2 BINDING SITE, designated SEQ ID:7754, to the nucleotide sequence of GAM7776 RNA, herein designated GAM RNA, also designated SEQ ID:246.

Another function of GAM7776 is therefore inhibition of Vasoactive intestinal peptide receptor 2 (VIPR2, Accession NP_003373.2). Accordingly, utilities of GAM7776 include diagnosis, prevention and treatment of diseases and clinical conditions associated with VIPR2.

VPS39 (Accession XP_031720.2) is another GAM7776 target gene, herein designated TARGET GENE. VPS39 BINDING SITE is a target binding site found in the 3' untranslated region of mRNA encoded by VPS39, corresponding to a target binding site such as BINDING SITE I, BINDING SITE II or BINDING SITE III of FIG. 8. Table 4 illustrates the complementarity of the nucleotide sequences of VPS39 BINDING SITE, designated SEQ ID:18246, to the nucleotide sequence of GAM7776 RNA, herein designated GAM RNA, also designated SEQ ID:246.

Another function of GAM7776 is therefore inhibition of VPS39 (Accession XP_031720.2). Accordingly, utilities of GAM7776 include diagnosis, prevention and treatment of diseases and clinical conditions associated with VPS39.

Vesicle transport through interaction with t-snares homolog 1a (yeast) (VTI1A, Accession NP_660207.1) is another GAM7776 target gene, herein designated TARGET GENE. VTI1A BINDING SITE is a target binding site found in the 3' untranslated region of mRNA encoded by VTI1A, corresponding to a target binding site such as BINDING SITE I, BINDING SITE II or BINDING SITE III of FIG. 8. Table 4 illustrates the complementarity of the nucleotide sequences of VTI1A BINDING SITE, designated SEQ ID:2313, to the nucleotide sequence of GAM7776 RNA, herein designated GAM RNA, also designated SEQ ID:246.

Another function of GAM7776 is therefore inhibition of Vesicle transport through interaction with t-snares homolog 1a (yeast) (VTI1A, Accession NP_660207.1). Accordingly, utilities of GAM7776 include diagnosis, prevention and treatment of diseases and clinical conditions associated with VTI1A.

Williams beuren syndrome chromosome region 18 (WBSCR18, Accession NP_115693.2) is another GAM7776 target gene, herein designated TARGET GENE. WBSCR18 BINDING SITE is a target binding site found in the 3' untranslated region of mRNA encoded by WBSCR18, corresponding to a target binding site such as BINDING SITE I, BINDING SITE II or BINDING SITE III of FIG. 8. Table 4 illustrates the complementarity of the nucleotide sequences of WBSCR18 BINDING SITE, designated SEQ ID:2152, to the nucleotide sequence of GAM7776 RNA, herein designated GAM RNA, also designated SEQ ID:246.

Another function of GAM7776 is therefore inhibition of Williams beuren syndrome chromosome region 18 (WBSCR18, Accession NP_115693.2). Accordingly, utilities of GAM7776 include diagnosis, prevention and treatment of diseases and clinical conditions associated with WBSCR18.

Wd repeat domain 6 (WDR6, Accession NP_439891.1) is another GAM7776 target gene, herein designated TARGET GENE. WDR6 BINDING SITE is a target binding site found in the 5' untranslated region of multiple transcripts of mRNA encoded by WDR6, corresponding to a target binding site such as BINDING SITE I, BINDING SITE II or BINDING SITE III of FIG. 8. Table 4 illustrates the complementarity of the nucleotide sequences of WDR6 BINDING SITE, designated SEQ ID:12628, to the nucleotide sequence of GAM7776 RNA, herein designated GAM RNA, also designated SEQ ID:246.

Another function of GAM7776 is therefore inhibition of Wd repeat domain 6 (WDR6, Accession NP_439891.1). Accordingly, utilities of GAM7776 include diagnosis, prevention and treatment of diseases and clinical conditions associated with WDR6.

Wolf-hirschhorn syndrome candidate 1 (WHSC1, Accession NP_579889.1) is another GAM7776 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:9245, to the nucleotide sequence of GAM7776 RNA, herein designated GAM RNA, also designated SEQ ID:246.

Another function of GAM7776 is therefore inhibition of Wolf-hirschhorn syndrome candidate 1 (WHSC1, Accession NP_579889.1), a gene which binds covalently to and repairs g/t mismatches. and therefore may be associated with Wolf-hirschhorn syndrome. Accordingly, utilities of GAM7776 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wingless-type mmtv integration site family, member 5a (WNT5A, Accession NP_003383.1) is another GAM7776 target gene, herein designated TARGET GENE. WNT5A BINDING SITE is a target binding site found in the 5' untranslated region of mRNA encoded by WNT5A, corresponding to a target binding site such as BINDING SITE I, BINDING SITE II or BINDING SITE III of FIG. 8. Table 4 illustrates the complementarity of the nucleotide sequences of WNT5A BINDING SITE, designated SEQ ID:10269, to the nucleotide sequence of GAM7776 RNA, herein designated GAM RNA, also designated SEQ ID:246.

Another function of GAM7776 is therefore inhibition of Wingless-type mmtv integration site family, member 5a (WNT5A, Accession NP_003383.1), a gene which is a ligand for members of the frizzled family of seven transmembrane receptors and is probablely a developmental protein. Accordingly, utilities of GAM7776 include diagnosis, prevention and treatment of diseases and clinical conditions associated with WNT5A.

The function of WNT5A and its association with various diseases and clinical conditions, has been established by previous studies, as described hereinabove with reference to GAM116.1. X-ray repair complementing defective repair in chinese hamster cells 2 (XRCC2, Accession NP_005422.1)

is another GAM7776 target gene, herein designated TARGET GENE. XRCC2 BINDING SITE1 through XRCC2 BINDING SITE3 are target binding sites found in untranslated regions of mRNA encoded by XRCC2, corresponding to target binding sites such as BINDING SITE I, BINDING SITE II or BINDING SITE III of FIG. 8. Table 4 illustrates the complementarity of the nucleotide sequences of XRCC2 BINDING SITE1 through XRCC2 BINDING SITE3, designated SEQ ID:9688, SEQ ID:10148 and SEQ ID:12605 respectively, to the nucleotide sequence of GAM7776 RNA, herein designated GAM RNA, also designated SEQ ID:246.

Another function of GAM7776 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM7776 include diagnosis, prevention and treatment of diseases and clinical conditions associated with XRCC2.

The function of XRCC2 and its association with various diseases and clinical conditions, has been established by previous studies, as described hereinabove with reference to GAM72.1. V-yes-1 yamaguchi sarcoma viral oncogene homolog 1 (YES1, Accession NP_005424.1) is another GAM7776 target gene, herein designated TARGET GENE. YES1 BINDING SITE is a target binding site found in the 3' untranslated region of mRNA encoded by YES1, corresponding to a target binding site such as BINDING SITE I, BINDING SITE II or BINDING SITE III of FIG. 8. Table 4 illustrates the complementarity of the nucleotide sequences of YES1 BINDING SITE, designated SEQ ID:16112, to the nucleotide sequence of GAM7776 RNA, herein designated GAM RNA, also designated SEQ ID:246.

Another function of GAM7776 is therefore inhibition of V-yes-1 yamaguchi sarcoma viral oncogene homolog 1 (YES1, Accession NP_005424.1), a gene which is a putative protein-tyrosine kinase. Accordingly, utilities of GAM7776 include diagnosis, prevention and treatment of diseases and clinical conditions associated with YES1.

The function of YES1 and its association with various diseases and clinical conditions, has been established by previous studies, as described hereinabove with reference to GAM30.1. ZAP (Accession NP_064504.2) is another GAM7776 target gene, herein designated TARGET GENE. ZAP BINDING SITE1 and ZAP BINDING SITE2 are target binding sites found in untranslated regions of multiple transcripts of mRNA encoded by ZAP, corresponding to target binding sites such as BINDING SITE I, BINDING SITE II or BINDING SITE III of FIG. 8. Table 4 illustrates the complementarity of the nucleotide sequences of ZAP BINDING SITE1 and ZAP BINDING SITE2, designated SEQ ID:508 and SEQ ID:3071 respectively, to the nucleotide sequence of GAM7776 RNA, herein designated GAM RNA, also designated SEQ ID:246.

Another function of GAM7776 is therefore inhibition of ZAP (Accession NP_064504.2). Accordingly, utilities of GAM7776 include diagnosis, prevention and treatment of diseases and clinical conditions associated with ZAP.

ZFP30 (Accession NP_055713.1) is another GAM7776 target gene, herein designated TARGET GENE. ZFP30 BINDING SITE is a target binding site found in the 3' untranslated region of mRNA encoded by ZFP30, corresponding to a target binding site such as BINDING SITE I, BINDING SITE II or BINDING SITE III of FIG. 8. Table 4 illustrates the complementarity of the nucleotide sequences of ZFP30 BINDING SITE, designated SEQ ID:9331, to the nucleotide sequence of GAM7776 RNA, herein designated GAM RNA, also designated SEQ ID:246.

Another function of GAM7776 is therefore inhibition of ZFP30 (Accession NP_055713.1). Accordingly, utilities of GAM7776 include diagnosis, prevention and treatment of diseases and clinical conditions associated with ZFP30.

ZFP42 (Accession NP_777560.1) is another GAM7776 target gene, herein designated TARGET GENE. ZFP42 BINDING SITE is a target binding site found in the 3' untranslated region of mRNA encoded by ZFP42, corresponding to a target binding site such as BINDING SITE I, BINDING SITE II or BINDING SITE III of FIG. 8. Table 4 illustrates the complementarity of the nucleotide sequences of ZFP42 BINDING SITE, designated SEQ ID:10587, to the nucleotide sequence of GAM7776 RNA, herein designated GAM RNA, also designated SEQ ID:246.

Another function of GAM7776 is therefore inhibition of ZFP42 (Accession NP_777560.1). Accordingly, utilities of GAM7776 include diagnosis, prevention and treatment of diseases and clinical conditions associated with ZFP42.

Zinc finger protein 64 homolog (mouse) (ZFP64, Accession NP_060667.1) is another GAM7776 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:15043, to the nucleotide sequence of GAM7776 RNA, herein designated GAM RNA, also designated SEQ ID:246.

Another function of GAM7776 is therefore inhibition of Zinc finger protein 64 homolog (mouse) (ZFP64, Accession NP_060667.1). Accordingly, utilities of GAM7776 include diagnosis, prevention and treatment of diseases and clinical conditions associated with ZFP64.

Zinc finger protein 64 homolog (mouse) (ZFP64, Accession NP_071371.2) is another GAM7776 target gene, herein designated TARGET GENE. ZFP64 BINDING SITE is a target binding site found in the 3' untranslated region of multiple transcripts of mRNA encoded by ZFP64, corresponding to a target binding site such as BINDING SITE I, BINDING SITE II or BINDING SITE III of FIG. 8. Table 4 illustrates the complementarity of the nucleotide sequences of ZFP64 BINDING SITE, designated SEQ ID:15043, to the nucleotide sequence of GAM7776 RNA, herein designated GAM RNA, also designated SEQ ID:246.

Another function of GAM7776 is therefore inhibition of Zinc finger protein 64 homolog (mouse) (ZFP64, Accession NP_071371.2). Accordingly, utilities of GAM7776 include diagnosis, prevention and treatment of diseases and clinical conditions associated with ZFP64.

ZFYVE26 (Accession XP_031077.1) is another GAM7776 target gene, herein designated TARGET GENE. ZFYVE26 BINDING SITE is a target binding site found in the 3' untranslated region of mRNA encoded by ZFYVE26, corresponding to a target binding site such as BINDING SITE I, BINDING SITE II or BINDING SITE III of FIG. 8. Table 4 illustrates the complementarity of the nucleotide sequences of ZFYVE26 BINDING SITE, designated SEQ ID:12160, to the nucleotide sequence of GAM7776 RNA, herein designated GAM RNA, also designated SEQ ID:246.

Another function of GAM7776 is therefore inhibition of ZFYVE26 (Accession XP_031077.1). Accordingly, utilities of GAM7776 include diagnosis, prevention and treatment of diseases and clinical conditions associated with ZFYVE26.

ZMYND17 (Accession NP_848546.1) is another GAM7776 target gene, herein designated TARGET GENE. ZMYND17 BINDING SITE is a target binding site found in the 3' untranslated region of mRNA encoded by ZMYND17, corresponding to a target binding site such as BINDING SITE I, BINDING SITE II or BINDING SITE III of FIG. 8. Table 4 illustrates the complementarity of the nucleotide sequences of ZMYND17 BINDING SITE, designated SEQ ID:456, to the nucleotide sequence of GAM7776 RNA, herein designated GAM RNA, also designated SEQ ID:246.

Another function of GAM7776 is therefore inhibition of ZMYND17 (Accession NP_848546.1). Accordingly, utilities of GAM7776 include diagnosis, prevention and treatment of diseases and clinical conditions associated with ZMYND17.

Zinc finger protein 18 (kox 11) (ZNF18, Accession XP_085596.2) is another GAM7776 target gene, herein designated TARGET GENE. ZNF18 BINDING SITE is a target binding site found in the 5' untranslated region of mRNA encoded by ZNF18, corresponding to a target binding site such as BINDING SITE I, BINDING SITE II or BINDING SITE III of FIG. 8. Table 4 illustrates the complementarity of the nucleotide sequences of ZNF18 BINDING SITE, designated SEQ ID:19151, to the nucleotide sequence of GAM7776 RNA, herein designated GAM RNA, also designated SEQ ID:246.

Another function of GAM7776 is therefore inhibition of Zinc finger protein 18 (kox 11) (ZNF18, Accession XP_085596.2). Accordingly, utilities of GAM7776 include diagnosis, prevention and treatment of diseases and clinical conditions associated with ZNF18.

Zinc finger protein 253 (ZNF253, Accession NP_066385.1) is another GAM7776 target gene, herein designated TARGET GENE. ZNF253 BINDING SITE is a target binding site found in the 3' untranslated region of mRNA encoded by ZNF253, corresponding to a target binding site such as BINDING SITE I, BINDING SITE II or BINDING SITE III of FIG. 8. Table 4 illustrates the complementarity of the nucleotide sequences of ZNF253 BINDING SITE, designated SEQ ID:19746, to the nucleotide sequence of GAM7776 RNA, herein designated GAM RNA, also designated SEQ ID:246.

Another function of GAM7776 is therefore inhibition of Zinc finger protein 253 (ZNF253, Accession NP_066385.1). Accordingly, utilities of GAM7776 include diagnosis, prevention and treatment of diseases and clinical conditions associated with ZNF253.

Zinc finger protein 264 (ZNF264, Accession NP_003408.1) is another GAM7776 target gene, herein designated TARGET GENE. ZNF264 BINDING SITE1 and ZNF264 BINDING SITE2 are target binding sites found in untranslated regions of mRNA encoded by ZNF264, corresponding to target binding sites such as BINDING SITE I, BINDING SITE II or BINDING SITE III of FIG. 8. Table 4 illustrates the complementarity of the nucleotide sequences of ZNF264 BINDING SITE1 and ZNF264 BINDING SITE2, designated SEQ ID:9147 and SEQ ID:3319 respectively, to the nucleotide sequence of GAM7776 RNA, herein designated GAM RNA, also designated SEQ ID:246.

Another function of GAM7776 is therefore inhibition of Zinc finger protein 264 (ZNF264, Accession NP_003408.1). Accordingly, utilities of GAM7776 include diagnosis, prevention and treatment of diseases and clinical conditions associated with ZNF264.

Zinc finger protein 273 (ZNF273, Accession XP_088082.1) is another GAM7776 target gene, herein designated TARGET GENE. ZNF273 BINDING SITE is a target binding site found in the 3' untranslated region of mRNA encoded by ZNF273, corresponding to a target binding site such as BINDING SITE I, BINDING SITE II or BINDING SITE III of FIG. 8. Table 4 illustrates the complementarity of the nucleotide sequences of ZNF273 BINDING SITE, designated SEQ ID:18868, to the nucleotide sequence of GAM7776 RNA, herein designated GAM RNA, also designated SEQ ID:246.

Another function of GAM7776 is therefore inhibition of Zinc finger protein 273 (ZNF273, Accession XP_088082.1). Accordingly, utilities of GAM7776 include diagnosis, prevention and treatment of diseases and clinical conditions associated with ZNF273.

Zinc finger protein 281 (ZNF281, Accession NP_036614.1) is another GAM7776 target gene, herein designated TARGET GENE. ZNF281 BINDING SITE is a target binding site found in the 3' untranslated region of mRNA encoded by ZNF281, corresponding to a target binding site such as BINDING SITE I, BINDING SITE II or BINDING SITE III of FIG. 8. Table 4 illustrates the complementarity of the nucleotide sequences of ZNF281 BINDING SITE, designated SEQ ID:16434, to the nucleotide sequence of GAM7776 RNA, herein designated GAM RNA, also designated SEQ ID:246.

Another function of GAM7776 is therefore inhibition of Zinc finger protein 281 (ZNF281, Accession NP_036614.1). Accordingly, utilities of GAM7776 include diagnosis, prevention and treatment of diseases and clinical conditions associated with ZNF281.

Zinc finger protein 289, id1 regulated (ZNF289, Accession NP_115765.2) is another GAM7776 target gene, herein designated TARGET GENE. ZNF289 BINDING SITE is a target binding site found in the 3' untranslated region of mRNA encoded by ZNF289, corresponding to a target binding site such as BINDING SITE I, BINDING SITE II or BINDING SITE III of FIG. 8. Table 4 illustrates the complementarity of the nucleotide sequences of ZNF289 BINDING SITE, designated SEQ ID:13159, to the nucleotide sequence of GAM7776 RNA, herein designated GAM RNA, also designated SEQ ID:246.

Another function of GAM7776 is therefore inhibition of Zinc finger protein 289, id1 regulated (ZNF289, Accession NP_115765.2). Accordingly, utilities of GAM7776 include diagnosis, prevention and treatment of diseases and clinical conditions associated with ZNF289.

Zinc finger protein 305 (ZNF305, Accession NP_055539.1) is another GAM7776 target gene, herein designated TARGET GENE. ZNF305 BINDING SITE is a target binding site found in the 3' untranslated region of mRNA encoded by ZNF305, corresponding to a target binding site such as BINDING SITE I, BINDING SITE II or BINDING SITE III of FIG. 8. Table 4 illustrates the complementarity of the nucleotide sequences of ZNF305 BINDING SITE, designated SEQ ID:18505, to the nucleotide sequence of GAM7776 RNA, herein designated GAM RNA, also designated SEQ ID:246.

Another function of GAM7776 is therefore inhibition of Zinc finger protein 305 (ZNF305, Accession NP_055539.1). Accordingly, utilities of GAM7776 include diagnosis, prevention and treatment of diseases and clinical conditions associated with ZNF305.

Zinc finger protein 334 (ZNF334, Accession NP_060572.2) is another GAM7776 target gene, herein designated TARGET GENE. ZNF334 BINDING SITE1 and ZNF334 BINDING SITE2 are target binding sites found in untranslated regions of mRNA encoded by ZNF334, corresponding to target binding sites such as BINDING SITE I, BINDING SITE II or BINDING SITE III of FIG. 8. Table 4 illustrates the complementarity of the nucleotide sequences of ZNF334 BINDING SITE1 and ZNF334 BINDING SITE2, designated SEQ ID:9628 and SEQ ID:5064 respectively, to the nucleotide sequence of GAM7776 RNA, herein designated GAM RNA, also designated SEQ ID:246.

Another function of GAM7776 is therefore inhibition of Zinc finger protein 334 (ZNF334, Accession NP__060572.2). Accordingly, utilities of GAM7776 include diagnosis, prevention and treatment of diseases and clinical conditions associated with ZNF334.

Zinc finger protein 339 (ZNF339, Accession NP__067043.1) is another GAM7776 target gene, herein designated TARGET GENE. ZNF339 BINDING SITE is a target binding site found in the 3' untranslated region of mRNA encoded by ZNF339, corresponding to a target binding site such as BINDING SITE I, BINDING SITE II or BINDING SITE III of FIG. 8. Table 4 illustrates the complementarity of the nucleotide sequences of ZNF339 BINDING SITE, designated SEQ ID:1729, to the nucleotide sequence of GAM7776 RNA, herein designated GAM RNA, also designated SEQ ID:246.

Another function of GAM7776 is therefore inhibition of Zinc finger protein 339 (ZNF339, Accession NP__067043.1). Accordingly, utilities of GAM7776 include diagnosis, prevention and treatment of diseases and clinical conditions associated with ZNF339.

Zinc finger protein 345 (ZNF345, Accession NP__003410.1) is another GAM7776 target gene, herein designated TARGET GENE. ZNF345 BINDING SITE is a target binding site found in the 3' untranslated region of mRNA encoded by ZNF345, corresponding to a target binding site such as BINDING SITE I, BINDING SITE II or BINDING SITE III of FIG. 8. Table 4 illustrates the complementarity of the nucleotide sequences of ZNF345 BINDING SITE, designated SEQ ID:1011, to the nucleotide sequence of GAM7776 RNA, herein designated GAM RNA, also designated SEQ ID:246.

Another function of GAM7776 is therefore inhibition of Zinc finger protein 345 (ZNF345, Accession NP__003410.1). Accordingly, utilities of GAM7776 include diagnosis, prevention and treatment of diseases and clinical conditions associated with ZNF345.

Zinc finger protein 398 (ZNF398, Accession NP__065832.1) is another GAM7776 target gene, herein designated TARGET GENE. ZNF398 BINDING SITE is a target binding site found in the 5' untranslated region of multiple transcripts of mRNA encoded by ZNF398, corresponding to a target binding site such as BINDING SITE I, BINDING SITE II or BINDING SITE III of FIG. 8. Table 4 illustrates the complementarity of the nucleotide sequences of ZNF398 BINDING SITE, designated SEQ ID:8530, to the nucleotide sequence of GAM7776 RNA, herein designated GAM RNA, also designated SEQ ID:246.

Another function of GAM7776 is therefore inhibition of Zinc finger protein 398 (ZNF398, Accession NP__065832.1). Accordingly, utilities of GAM7776 include diagnosis, prevention and treatment of diseases and clinical conditions associated with ZNF398.

ZNF409 (Accession NP__055709.1) is another GAM7776 target gene, herein designated TARGET GENE. ZNF409 BINDING SITE is a target binding site found in the 5' untranslated region of mRNA encoded by ZNF409, corresponding to a target binding site such as BINDING SITE I, BINDING SITE II or BINDING SITE III of FIG. 8. Table 4 illustrates the complementarity of the nucleotide sequences of ZNF409 BINDING SITE, designated SEQ ID:2388, to the nucleotide sequence of GAM7776 RNA, herein designated GAM RNA, also designated SEQ ID:246.

Another function of GAM7776 is therefore inhibition of ZNF409 (Accession NP__055709.1). Accordingly, utilities of GAM7776 include diagnosis, prevention and treatment of diseases and clinical conditions associated with ZNF409.

ZNF431 (Accession XP__086098.2) is another GAM7776 target gene, herein designated TARGET GENE. ZNF431 BINDING SITE is a target binding site found in the 3' untranslated region of mRNA encoded by ZNF431, corresponding to a target binding site such as BINDING SITE I, BINDING SITE II or BINDING SITE III of FIG. 8. Table 4 illustrates the complementarity of the nucleotide sequences of ZNF431 BINDING SITE, designated SEQ ID:8477, to the nucleotide sequence of GAM7776 RNA, herein designated GAM RNA, also designated SEQ ID:246.

Another function of GAM7776 is therefore inhibition of ZNF431 (Accession XP__086098.2). Accordingly, utilities of GAM7776 include diagnosis, prevention and treatment of diseases and clinical conditions associated with ZNF431.

ZNF432 (Accession NP__055465.1) is another GAM7776 target gene, herein designated TARGET GENE. ZNF432 BINDING SITE is a target binding site found in the 3' untranslated region of mRNA encoded by ZNF432, corresponding to a target binding site such as BINDING SITE I, BINDING SITE II or BINDING SITE III of FIG. 8. Table 4 illustrates the complementarity of the nucleotide sequences of ZNF432 BINDING SITE, designated SEQ ID:5065, to the nucleotide sequence of GAM7776 RNA, herein designated GAM RNA, also designated SEQ ID:246.

Another function of GAM7776 is therefore inhibition of ZNF432 (Accession NP__055465.1). Accordingly, utilities of GAM7776 include diagnosis, prevention and treatment of diseases and clinical conditions associated with ZNF432.

ZNF440 (Accession NP__689570.1) is another GAM7776 target gene, herein designated TARGET GENE. ZNF440 BINDING SITE is a target binding site found in the 3' untranslated region of mRNA encoded by ZNF440, corresponding to a target binding site such as BINDING SITE I, BINDING SITE II or BINDING SITE III of FIG. 8. Table 4 illustrates the complementarity of the nucleotide sequences of ZNF440 BINDING SITE, designated SEQ ID:1744, to the nucleotide sequence of GAM7776 RNA, herein designated GAM RNA, also designated SEQ ID:246.

Another function of GAM7776 is therefore inhibition of ZNF440 (Accession NP__689570.1). Accordingly, utilities of GAM7776 include diagnosis, prevention and treatment of diseases and clinical conditions associated with ZNF440.

Zinc finger protein 70 (cos17) (ZNF70, Accession NP_068735.1) is another GAM7776 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:17076, to the nucleotide sequence of GAM7776 RNA, herein designated GAM RNA, also designated SEQ ID:246.

Another function of GAM7776 is therefore inhibition of Zinc finger protein 70 (cos17) (ZNF70, Accession NP__068735.1). Accordingly, utilities of GAM7776 include diagnosis, prevention and treatment of diseases and clinical conditions associated with ZNF70.

Zinc finger protein 70 (cos17) (ZNF70, Accession NP__852101.1) is another GAM7776 target gene, herein designated TARGET GENE. ZNF70 BINDING SITE is a target binding site found in the 3' untranslated region of multiple transcripts of mRNA encoded by ZNF70, corresponding to a target binding site such as BINDING SITE I, BINDING SITE II or BINDING SITE III of FIG. 8. Table 4 illustrates the complementarity of the nucleotide sequences of ZNF70 BINDING SITE, designated SEQ ID:17076, to the nucleotide sequence of GAM7776 RNA, herein designated GAM RNA, also designated SEQ ID:246.

Another function of GAM7776 is therefore inhibition of Zinc finger protein 70 (cos17) (ZNF70, Accession NP_852101.1). Accordingly, utilities of GAM7776 include diagnosis, prevention and treatment of diseases and clinical conditions associated with ZNF70.

Zinc finger protein 74 (cos52) (ZNF74, Accession NP_003417.1) is another GAM7776 target gene, herein designated TARGET GENE. ZNF74 BINDING SITE is a target binding site found in the 5' untranslated region of mRNA encoded by ZNF74, corresponding to a target binding site such as BINDING SITE I, BINDING SITE II or BINDING SITE III of FIG. 8. Table 4 illustrates the complementarity of the nucleotide sequences of ZNF74 BINDING SITE, designated SEQ ID:12340, to the nucleotide sequence of GAM7776 RNA, herein designated GAM RNA, also designated SEQ ID:246.

Another function of GAM7776 is therefore inhibition of Zinc finger protein 74 (cos52) (ZNF74, Accession NP_003417.1). Accordingly, utilities of GAM7776 include diagnosis, prevention and treatment of diseases and clinical conditions associated with ZNF74.

FIG. 8 further provides a conceptual description of a novel bioinformatically detected of the present invention, referred to here as Genomic Address Messenger 7809 (GAM7809), which modulates expression of respective target genes thereof, the function and utility of which target genes is known in the art.

GAM7809 is a novel bioinformatically detected regulatory, non protein coding, micro RNA (miRNA) gene. The method by which GAM7809 was detected is described hereinabove with reference to FIGS. 8-15.

GAM7809 gene, herein designated GAM GENE, and GAM7809 target gene, herein designated TARGET GENE, are human genes contained in the human genome.

GAM7809 gene encodes a GAM7809 precursor RNA, herein designated GAM PRECURSOR RNA. Similar to other miRNA genes, and unlike most ordinary genes, GAM7809 precursor RNA does not encode a protein. A nucleotide sequence identical or highly similar to the nucleotide sequence of GAM7809 precursor RNA is designated SEQ ID:180, and is provided hereinbelow with reference to the sequence listing part.

GAM7809 precursor RNA folds onto itself, forming GAM7809 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM7809 precursor RNA folds onto itself, forming GAM7809 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM7809 precursor RNA, designated SEQ-ID:180, and a schematic representation of a predicted secondary folding of GAM7809 folded precursor RNA are further described with reference to Table 2, hereby incorporated by reference.

An enzyme complex designated DICER COMPLEX, 'dices' the GAM7809 folded precursor RNA into GAM7809 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM7809 RNA is designated SEQ ID:398, and is provided hereinbelow with references to the sequence listing part and Table 3, hereby incorporated by reference.

GAM7809 target gene, herein designated TARGET GENE, encodes a corresponding messenger RNA, GAM7809 target RNA, herein designated GAM TARGET RNA. GAM7809 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM7809 RNA, herein designated GAM RNA, binds complementarily to one or more target binding sites located in untranslated regions of GAM7809 target RNA, herein designated GAM TARGET RNA. This complementary binding is due to the fact that the nucleotide sequence of GAM7809 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM7809 RNA may have a different number of target binding sites in untranslated regions of a GAM7809 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM7809 RNA, herein designated GAM RNA, to target binding sites on GAM7809 target RNA, herein designated GAM TARGET RNA, such as BINDING SITE I, BINDING SITE II and BINDING SITE III, inhibits translation of GAM7809 target RNA into GAM7809 target protein, herein designated GAM TARGET PROTEIN. GAM target protein is therefore outlined by a broken line.

It is appreciated that GAM7809 target gene, herein designated TARGET GENE, in fact represents a plurality of GAM7809 target genes. The mRNA of each one of this plurality of GAM7809 target genes comprises one or more target binding sites, each having a nucleotide sequence which is at least partly complementary to GAM7809 RNA, herein designated GAM RNA, and which when bound by GAM7809 RNA causes inhibition of translation of respective one or more GAM7809 target proteins.

It is further appreciated by one skilled in the art that the mode of translational inhibition illustrated by FIG. 8 with specific reference to translational inhibition exerted by GAM7809 gene, herein designated GAM GENE, on one or more GAM7809 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM7809 correlate with, and may be deduced from, the identity of the target genes which GAM7809 binds and inhibits, and the function of these target genes, as elaborated hereinbelow.

Apoptotic protease activating factor (APAF1, Accession NP_001151.1) is a GAM7809 target gene, herein designated TARGET GENE. APAF1 BINDING SITE is a target binding site found in the 3' untranslated region of multiple transcripts of mRNA encoded by APAF1, corresponding to a target binding site such as BINDING SITE I, BINDING SITE II or BINDING SITE III of FIG. 8. Table 4 illustrates the complementarity of the nucleotide sequences of APAF1 BINDING SITE, designated SEQ ID:11564, to the nucleotide sequence of GAM7809 RNA, herein designated GAM RNA, also designated SEQ ID:398.

A function of GAM7809 is therefore inhibition of Apoptotic protease activating factor (APAF1, Accession NP_001151.1), a gene which functions in the mitochondrial apoptotic pathway that leads to caspase 9 dependent activation of caspase 3 and therefore may be associated with Cancer. Accordingly, utilities of GAM7809 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. Apoptotic protease activating factor (APAF1, Accession NP_037361.1) is another GAM7809 target gene, herein designated TARGET GENE. APAF1 BINDING SITE is a target binding site found in the 3' untranslated region of multiple transcripts of mRNA encoded by APAF1, corresponding to a target binding site such as BINDING SITE I, BINDING SITE II or BINDING SITE III of FIG. 8. Table 4 illustrates the complementarity of the nucleotide sequences of APAF1 BINDING SITE, designated SEQ ID:11564, to the nucleotide sequence of GAM7809 RNA, herein designated GAM RNA, also designated SEQ ID:398.

Another function of GAM7809 is therefore inhibition of Apoptotic protease activating factor (APAF1, Accession NP_037361.1), a gene which functions in the mitochondrial apoptotic pathway that leads to caspase 9 dependent activation of caspase 3 and therefore may be associated with Cancer. Accordingly, utilities of GAM7809 include diagnosis, prevention and treatment of Cancer, and of other diseases and clinical conditions associated with APAF1.

The function of APAF1 and its association with various diseases and clinical conditions, has been established by previous studies, as described hereinabove with reference to GAM30.1. C10orf5 (Accession NP_848931.1) is another GAM7809 target gene, herein designated TARGET GENE. C10orf5 BINDING SITE is a target binding site found in the 3' untranslated region of multiple transcripts of mRNA encoded by C10orf5, corresponding to a target binding site such as BINDING SITE I, BINDING SITE II or BINDING SITE III of FIG. 8. Table 4 illustrates the complementarity of the nucleotide sequences of C10orf5 BINDING SITE, designated SEQ ID:3002, to the nucleotide sequence of GAM7809 RNA, herein designated GAM RNA, also designated SEQ ID:398.

Another function of GAM7809 is therefore inhibition of C10orf5 (Accession NP_848931.1). Accordingly, utilities of GAM7809 include diagnosis, prevention and treatment of diseases and clinical conditions associated with C10orf5.

Chromosome 20 open reading frame 173 (C20orf173, Accession NP_543018.1) is another GAM7809 target gene, herein designated TARGET GENE. C20orf173 BINDING SITE is a target binding site found in the 3' untranslated region of mRNA encoded by C20orf173, corresponding to a target binding site such as BINDING SITE I, BINDING SITE II or BINDING SITE III of FIG. 8. Table 4 illustrates the complementarity of the nucleotide sequences of C20orf173 BINDING SITE, designated SEQ ID:8641, to the nucleotide sequence of GAM7809 RNA, herein designated GAM RNA, also designated SEQ ID:398.

Another function of GAM7809 is therefore inhibition of Chromosome 20 open reading frame 173 (C20orf173, Accession NP_543018.1). Accordingly, utilities of GAM7809 include diagnosis, prevention and treatment of diseases and clinical conditions associated with C20orf173.

Chromosome 8 open reading frame 7 (C8orf7, Accession XP_088376.1) is another GAM7809 target gene, herein designated TARGET GENE. C8orf7 BINDING SITE is a target binding site found in the 3' untranslated region of mRNA encoded by C8orf7, corresponding to a target binding site such as BINDING SITE I, BINDING SITE II or BINDING SITE III of FIG. 8. Table 4 illustrates the complementarity of the nucleotide sequences of C8orf7 BINDING SITE, designated SEQ ID:2030, to the nucleotide sequence of GAM7809 RNA, herein designated GAM RNA, also designated SEQ ID:398.

Another function of GAM7809 is therefore inhibition of Chromosome 8 open reading frame 7 (C8orf7, Accession XP_088376.1). Accordingly, utilities of GAM7809 include diagnosis, prevention and treatment of diseases and clinical conditions associated with C8orf7.

Chemokine (c-c motif) ligand 1 (CCL1, Accession NP_002972.1) is another GAM7809 target gene, herein designated TARGET GENE. CCL1 BINDING SITE is a target binding site found in the 3' untranslated region of mRNA encoded by CCL1, corresponding to a target binding site such as BINDING SITE I, BINDING SITE II or BINDING SITE III of FIG. 8. Table 4 illustrates the complementarity of the nucleotide sequences of CCL1 BINDING SITE, designated SEQ ID:10810, to the nucleotide sequence of GAM7809 RNA, herein designated GAM RNA, also designated SEQ ID:398.

Another function of GAM7809 is therefore inhibition of Chemokine (c-c motif) ligand 1 (CCL1, Accession NP_002972.1). Accordingly, utilities of GAM7809 include diagnosis, prevention and treatment of diseases and clinical conditions associated with CCL1.

Cytochrome c oxidase subunit viia polypeptide 2 like (COX7A2L, Accession NP_004709.2) is another GAM7809 target gene, herein designated TARGET GENE. COX7A2L BINDING SITE is a target binding site found in the 3' untranslated region of mRNA encoded by COX7A2L, corresponding to a target binding site such as BINDING SITE I, BINDING SITE II or BINDING SITE III of FIG. 8. Table 4 illustrates the complementarity of the nucleotide sequences of COX7A2L BINDING SITE, designated SEQ ID:3657, to the nucleotide sequence of GAM7809 RNA, herein designated GAM RNA, also designated SEQ ID:398.

Another function of GAM7809 is therefore inhibition of Cytochrome c oxidase subunit viia polypeptide 2 like (COX7A2L, Accession NP_004709.2). Accordingly, utilities of GAM7809 include diagnosis, prevention and treatment of diseases and clinical conditions associated with COX7A2L.

Catenin (cadherin-associated protein), delta 1 (CTNND1, Accession NP_001322.1) is another GAM7809 target gene, herein designated TARGET GENE. CTNND1 BINDING SITE is a target binding site found in the 3' untranslated region of mRNA encoded by CTNND1, corresponding to a target binding site such as BINDING SITE I, BINDING SITE II or BINDING SITE III of FIG. 8. Table 4 illustrates the complementarity of the nucleotide sequences of CTNND1 BINDING SITE, designated SEQ ID:15144, to the nucleotide sequence of GAM7809 RNA, herein designated GAM RNA, also designated SEQ ID:398.

Another function of GAM7809 is therefore inhibition of Catenin (cadherin-associated protein), delta 1 (CTNND1, Accession NP_001322.1). Accordingly, utilities of GAM7809 include diagnosis, prevention and treatment of diseases and clinical conditions associated with CTNND1.

Dead/h (asp-glu-ala-asp/his) box polypeptide 11 (chl1-like helicase homolog, s. cerevisiae) (DDX11, Accession NP_085913.1) is another GAM7809 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:7637, to the nucleotide sequence of GAM7809 RNA, herein designated GAM RNA, also designated SEQ ID:398.

Another function of GAM7809 is therefore inhibition of Dead/h (asp-glu-ala-asp/his) box polypeptide 11 (chl1-like helicase homolog, s. cerevisiae) (DDX11, Accession NP_085913.1), a gene which could be an ATP-dependent DNA-binding helicase and may intervene in cell cycle regulation. Accordingly, utilities of GAM7809 include diagnosis, prevention and treatment of diseases and clinical conditions associated with DDX11.

The function of DDX11 and its association with various diseases and clinical conditions, has been established by previous studies, as described hereinabove with reference to GAM63.1. Dead/h (asp-glu-ala-asp/his) box polypeptide 39 (DDX39, Accession NP_620551.1) is another GAM7809 target gene, herein designated TARGET GENE. DDX39 BINDING SITE is a target binding site found in the 3' untranslated region of multiple transcripts of mRNA encoded by DDX39, corresponding to a target binding site such as BINDING SITE I, BINDING SITE II or BINDING SITE III of FIG. 8. Table 4 illustrates the complementarity of the nucleotide sequences of DDX39 BINDING SITE, designated SEQ ID:8028, to the nucleotide sequence of GAM7809 RNA, herein designated GAM RNA, also designated SEQ ID:398.

Another function of GAM7809 is therefore inhibition of Dead/h (asp-glu-ala-asp/his) box polypeptide 39 (DDX39, Accession NP_620551.1). Accordingly, utilities of GAM7809 include diagnosis, prevention and treatment of diseases and clinical conditions associated with DDX39.

Diacylglycerol o-acyltransferase homolog 1 (mouse) (DGAT1, Accession NP_036211.1) is another GAM7809 target gene, herein designated TARGET GENE. DGAT1 BINDING SITE is a target binding site found in the 3' untranslated region of mRNA encoded by DGAT1, corresponding to a target binding site such as BINDING SITE I, BINDING SITE II or BINDING SITE III of FIG. 8. Table 4 illustrates the complementarity of the nucleotide sequences of DGAT1 BINDING SITE, designated SEQ ID:9487, to the nucleotide sequence of GAM7809 RNA, herein designated GAM RNA, also designated SEQ ID:398.

Another function of GAM7809 is therefore inhibition of Diacylglycerol o-acyltransferase homolog 1 (mouse) (DGAT1, Accession NP_036211.1). Accordingly, utilities of GAM7809 include diagnosis, prevention and treatment of diseases and clinical conditions associated with DGAT1.

Deiodinase, iodothyronine, type ii (DIO2, Accession NP_000784.2) is another GAM7809 target gene, herein designated TARGET GENE. DIO2 BINDING SITE is a target binding site found in the 3' untranslated region of multiple transcripts of mRNA encoded by DIO2, corresponding to a target binding site such as BINDING SITE I, BINDING SITE II or BINDING SITE III of FIG. 8. Table 4 illustrates the complementarity of the nucleotide sequences of DIO2 BINDING SITE, designated SEQ ID:17701, to the nucleotide sequence of GAM7809 RNA, herein designated GAM RNA, also designated SEQ ID:398.

Another function of GAM7809 is therefore inhibition of Deiodinase, iodothyronine, type ii (DIO2, Accession NP_000784.2). Accordingly, utilities of GAM7809 include diagnosis, prevention and treatment of diseases and clinical conditions associated with DIO2.

Deiodinase, iodothyronine, type ii (DIO2, Accession NP_054644.1) is another GAM7809 target gene, herein designated TARGET GENE. DIO2 BINDING SITE is a target binding site found in the 3' untranslated region of multiple transcripts of mRNA encoded by DIO2, corresponding to a target binding site such as BINDING SITE I, BINDING SITE II or BINDING SITE III of FIG. 8. Table 4 illustrates the complementarity of the nucleotide sequences of DIO2 BINDING SITE, designated SEQ ID:17701, to the nucleotide sequence of GAM7809 RNA, herein designated GAM RNA, also designated SEQ ID:398.

Another function of GAM7809 is therefore inhibition of Deiodinase, iodothyronine, type ii (DIO2, Accession NP_054644.1). Accordingly, utilities of GAM7809 include diagnosis, prevention and treatment of diseases and clinical conditions associated with DIO2.

DKFZp434C0328 (Accession NP_060047.1) is another GAM7809 target gene, herein designated TARGET GENE. DKFZp434C0328 BINDING SITE is a target binding site found in the 5' untranslated region of mRNA encoded by DKFZp434C0328, corresponding to a target binding site such as BINDING SITE I, BINDING SITE II or BINDING SITE III of FIG. 8. Table 4 illustrates the complementarity of the nucleotide sequences of DKFZp434C0328 BINDING SITE, designated SEQ ID:11265, to the nucleotide sequence of GAM7809 RNA, herein designated GAM RNA, also designated SEQ ID:398.

Another function of GAM7809 is therefore inhibition of DKFZp434C0328 (Accession NP_060047.1). Accordingly, utilities of GAM7809 include diagnosis, prevention and treatment of diseases and clinical conditions associated with DKFZp434C0328.

DKFZP434L1717 (Accession NP_115512.2) is another GAM7809 target gene, herein designated TARGET GENE. DKFZP434L1717 BINDING SITE is a target binding site found in the 3' untranslated region of mRNA encoded by DKFZP434L1717, corresponding to a target binding site such as BINDING SITE I, BINDING SITE II or BINDING SITE III of FIG. 8. Table 4 illustrates the complementarity of the nucleotide sequences of DKFZP434L1717 BINDING SITE, designated SEQ ID:9242, to the nucleotide sequence of GAM7809 RNA, herein designated GAM RNA, also designated SEQ ID:398.

Another function of GAM7809 is therefore inhibition of DKFZP434L1717 (Accession NP_115512.2). Accordingly, utilities of GAM7809 include diagnosis, prevention and treatment of diseases and clinical conditions associated with DKFZP434L1717.

DKFZP564O1863 (Accession NP_056448.1) is another GAM7809 target gene, herein designated TARGET GENE. DKFZP564O1863 BINDING SITE is a target binding site found in the 3' untranslated region of mRNA encoded by DKFZP564O1863, corresponding to a target binding site such as BINDING SITE I, BINDING SITE II or BINDING SITE III of FIG. 8. Table 4 illustrates the complementarity of the nucleotide sequences of DKFZP564O1863 BINDING SITE, designated SEQ ID:4432, to the nucleotide sequence of GAM7809 RNA, herein designated GAM RNA, also designated SEQ ID:398.

Another function of GAM7809 is therefore inhibition of DKFZP564O1863 (Accession NP_056448.1). Accordingly, utilities of GAM7809 include diagnosis, prevention and treatment of diseases and clinical conditions associated with DKFZP564O1863.

DKFZp761D112 (Accession NP_115673.1) is another GAM7809 target gene, herein designated TARGET GENE. DKFZp761D112 BINDING SITE is a target binding site found in the 3' untranslated region of mRNA encoded by DKFZp761D112, corresponding to a target binding site such as BINDING SITE I, BINDING SITE II or BINDING SITE III of FIG. 8. Table 4 illustrates the complementarity of the nucleotide sequences of DKFZp761D112 BINDING SITE, designated SEQ ID:7056, to the nucleotide sequence of GAM7809 RNA, herein designated GAM RNA, also designated SEQ ID:398.

Another function of GAM7809 is therefore inhibition of DKFZp761D112 (Accession NP_115673.1). Accordingly, utilities of GAM7809 include diagnosis, prevention and treatment of diseases and clinical conditions associated with DKFZp761D112.

DKFZp761P1121 (Accession NP_690870.1) is another GAM7809 target gene, herein designated TARGET GENE. DKFZp761P1121 BINDING SITE is a target binding site found in the 3' untranslated region of mRNA encoded by DKFZp761P1121, corresponding to a target binding site such as BINDING SITE I, BINDING SITE II or BINDING SITE III of FIG. 8. Table 4 illustrates the complementarity of the nucleotide sequences of DKFZp761P1121 BINDING SITE, designated SEQ ID:15876, to the nucleotide sequence of GAM7809 RNA, herein designated GAM RNA, also designated SEQ ID:398.

Another function of GAM7809 is therefore inhibition of DKFZp761P1121 (Accession NP_690870.1). Accordingly, utilities of GAM7809 include diagnosis, prevention and treatment of diseases and clinical conditions associated with DKFZp761P1121.

Dual specificity phosphatase 16 (DUSP16, Accession XP_039106.1) is another GAM7809 target gene, herein designated TARGET GENE. DUSP16 BINDING SITE is a target binding site found in the 3' untranslated region of mRNA encoded by DUSP16, corresponding to a target binding site such as BINDING SITE I, BINDING SITE II or BINDING SITE III of FIG. 8. Table 4 illustrates the complementarity of the nucleotide sequences of DUSP16 BINDING SITE, designated SEQ ID:12004, to the nucleotide sequence of GAM7809 RNA, herein designated GAM RNA, also designated SEQ ID:398.

Another function of GAM7809 is therefore inhibition of Dual specificity phosphatase 16 (DUSP16, Accession XP_039106.1). Accordingly, utilities of GAM7809 include diagnosis, prevention and treatment of diseases and clinical conditions associated with DUSP16.

Endothelial differentiation, sphingolipid g-protein-coupled receptor, 3 (EDG3, Accession NP_005217.1) is another GAM7809 target gene, herein designated TARGET GENE. EDG3 BINDING SITE is a target binding site found in the 5' untranslated region of mRNA encoded by EDG3, corresponding to a target binding site such as BINDING SITE I, BINDING SITE II or BINDING SITE III of FIG. 8. Table 4 illustrates the complementarity of the nucleotide sequences of EDG3 BINDING SITE, designated SEQ ID:16612, to the nucleotide sequence of GAM7809 RNA, herein designated GAM RNA, also designated SEQ ID:398.

Another function of GAM7809 is therefore inhibition of Endothelial differentiation, sphingolipid g-protein-coupled receptor, 3 (EDG3, Accession NP_005217.1). Accordingly, utilities of GAM7809 include diagnosis, prevention and treatment of diseases and clinical conditions associated with EDG3.

FLJ12363 (Accession NP_115543.1) is another GAM7809 target gene, herein designated TARGET GENE. FLJ12363 BINDING SITE is a target binding site found in the 3' untranslated region of mRNA encoded by FLJ12363, corresponding to a target binding site such as BINDING SITE I, BINDING SITE II or BINDING SITE III of FIG. 8. Table 4 illustrates the complementarity of the nucleotide sequences of FLJ12363 BINDING SITE, designated SEQ ID:766, to the nucleotide sequence of GAM7809 RNA, herein designated GAM RNA, also designated SEQ ID:398.

Another function of GAM7809 is therefore inhibition of FLJ12363 (Accession NP_115543.1). Accordingly, utilities of GAM7809 include diagnosis, prevention and treatment of diseases and clinical conditions associated with FLJ12363.

FLJ22833 (Accession NP_073748.1) is another GAM7809 target gene, herein designated TARGET GENE. FLJ22833 BINDING SITE is a target binding site found in the 3' untranslated region of mRNA encoded by FLJ22833, corresponding to a target binding site such as BINDING SITE I, BINDING SITE II or BINDING SITE III of FIG. 8. Table 4 illustrates the complementarity of the nucleotide sequences of FLJ22833 BINDING SITE, designated SEQ ID:4756, to the nucleotide sequence of GAM7809 RNA, herein designated GAM RNA, also designated SEQ ID:398.

Another function of GAM7809 is therefore inhibition of FLJ22833 (Accession NP_073748.1). Accordingly, utilities of GAM7809 include diagnosis, prevention and treatment of diseases and clinical conditions associated with FLJ22833.

Forkhead box p1 (FOXP1, Accession NP_116071.2) is another GAM7809 target gene, herein designated TARGET GENE. FOXP1 BINDING SITE is a target binding site found in the 3' untranslated region of mRNA encoded by FOXP1, corresponding to a target binding site such as BINDING SITE I, BINDING SITE II or BINDING SITE III of FIG. 8. Table 4 illustrates the complementarity of the nucleotide sequences of FOXP1 BINDING SITE, designated SEQ ID:4211, to the nucleotide sequence of GAM7809 RNA, herein designated GAM RNA, also designated SEQ ID:398.

Another function of GAM7809 is therefore inhibition of Forkhead box p1 (FOXP1, Accession NP_116071.2). Accordingly, utilities of GAM7809 include diagnosis, prevention and treatment of diseases and clinical conditions associated with FOXP1.

HGNT-IV-H (Accession NP_037376.1) is another GAM7809 target gene, herein designated TARGET GENE.

HGNT-IV-H BINDING SITE is a target binding site found in the 3' untranslated region of mRNA encoded by HGNT-IV-H, corresponding to a target binding site such as BINDING SITE I, BINDING SITE II or BINDING SITE III of FIG. 8. Table 4 illustrates the complementarity of the nucleotide sequences of HGNT-IV-H BINDING SITE, designated SEQ ID:8444, to the nucleotide sequence of GAM7809 RNA, herein designated GAM RNA, also designated SEQ ID:398.

Another function of GAM7809 is therefore inhibition of HGNT-IV-H (Accession NP_037376.1). Accordingly, utilities of GAM7809 include diagnosis, prevention and treatment of diseases and clinical conditions associated with HGNT-IV-H.

Histamine n-methyltransferase (HNMT, Accession NP_008826.1) is another GAM7809 target gene, herein designated TARGET GENE. HNMT BINDING SITE is a target binding site found in the 3' untranslated region of mRNA encoded by HNMT, corresponding to a target binding site such as BINDING SITE I, BINDING SITE II or BINDING SITE III of FIG. 8. Table 4 illustrates the complementarity of the nucleotide sequences of HNMT BINDING SITE, designated SEQ ID:558, to the nucleotide sequence of GAM7809 RNA, herein designated GAM RNA, also designated SEQ ID:398.

Another function of GAM7809 is therefore inhibition of Histamine n-methyltransferase (HNMT, Accession NP_008826.1), a gene which inactivates histamine by n-methylation and therefore may be associated with Caucasian asthmatic. Accordingly, utilities of GAM7809 include diagnosis, prevention and treatment of Caucasian asthmatic, and of other diseases and clinical conditions associated with HNMT.

The function of HNMT and its association with various diseases and clinical conditions, has been established by previous studies, as described hereinabove with reference to GAM1926.2. HSMPP8 (Accession XP_167894.1) is another GAM7809 target gene, herein designated TARGET GENE. HSMPP8 BINDING SITE is a target binding site found in the 3' untranslated region of mRNA encoded by HSMPP8, corresponding to a target binding site such as BINDING SITE I, BINDING SITE II or BINDING SITE III of FIG. 8. Table 4 illustrates the complementarity of the nucleotide sequences of HSMPP8 BINDING SITE, designated SEQ ID:14992, to the nucleotide sequence of GAM7809 RNA, herein designated GAM RNA, also designated SEQ ID:398.

Another function of GAM7809 is therefore inhibition of HSMPP8 (Accession XP_167894.1). Accordingly, utilities of GAM7809 include diagnosis, prevention and treatment of diseases and clinical conditions associated with HSMPP8.

Integrin, beta 2 (antigen cd18 (p95), lymphocyte function-associated antigen 1; macrophage antigen 1 (mac-1) beta subunit) (ITGB2, Accession NP_000202.1) is another GAM7809 target gene, herein designated TARGET GENE. ITGB2 BINDING SITE is a target binding site found in the 3' untranslated region of mRNA encoded by ITGB2, corresponding to a target binding site such as BINDING SITE I, BINDING SITE II or BINDING SITE III of FIG. 8. Table 4 illustrates the complementarity of the nucleotide sequences of ITGB2 BINDING SITE, designated SEQ ID:2700, to the nucleotide sequence of GAM7809 RNA, herein designated GAM RNA, also designated SEQ ID:398.

Another function of GAM7809 is therefore inhibition of Integrin, beta 2 (antigen cd18 (p95), lymphocyte function-associated antigen 1; macrophage antigen 1 (mac-1) beta subunit) (ITGB2, Accession NP_000202.1), a gene which is involved in cell-cell and cell-matrix interactions. and therefore is associated with Leukocyte adhesion deficiency. Accordingly, utilities of GAM7809 include diagnosis, prevention and treatment of Leukocyte adhesion deficiency, and of other diseases and clinical conditions associated with ITGB2.

The function of ITGB2 and its association with various diseases and clinical conditions, has been established by previous studies, as described hereinabove with reference to GAM842.2. KIAA0471 (Accession NP_055672.1) is another GAM7809 target gene, herein designated TARGET GENE. KIAA0471 BINDING SITE is a target binding site found in the 3' untranslated region of mRNA encoded by KIAA0471, corresponding to a target binding site such as BINDING SITE I, BINDING SITE II or BINDING SITE III of FIG. 8. Table 4 illustrates the complementarity of the nucleotide sequences of KIAA0471 BINDING SITE, designated SEQ ID:9743, to the nucleotide sequence of GAM7809 RNA, herein designated GAM RNA, also designated SEQ ID:398.

Another function of GAM7809 is therefore inhibition of KIAA0471 (Accession NP_055672.1). Accordingly, utilities of GAM7809 include diagnosis, prevention and treatment of diseases and clinical conditions associated with KIAA0471.

KIAA0746 (Accession XP_045277.3) is another GAM7809 target gene, herein designated TARGET GENE. KIAA0746 BINDING SITE is a target binding site found in the 5' untranslated region of mRNA encoded by KIAA0746, corresponding to a target binding site such as BINDING SITE I, BINDING SITE II or BINDING SITE III of FIG. 8. Table 4 illustrates the complementarity of the nucleotide sequences of KIAA0746 BINDING SITE, designated SEQ ID:6982, to the nucleotide sequence of GAM7809 RNA, herein designated GAM RNA, also designated SEQ ID:398.

Another function of GAM7809 is therefore inhibition of KIAA0746 (Accession XP_045277.3). Accordingly, utilities of GAM7809 include diagnosis, prevention and treatment of diseases and clinical conditions associated with KIAA0746.

KIAA1018 (Accession NP_055782.1) is another GAM7809 target gene, herein designated TARGET GENE. KIAA1018 BINDING SITE is a target binding site found in the 3' untranslated region of mRNA encoded by KIAA1018, corresponding to a target binding site such as BINDING SITE I, BINDING SITE II or BINDING SITE III of FIG. 8. Table 4 illustrates the complementarity of the nucleotide sequences of KIAA1018 BINDING SITE, designated SEQ ID:12780, to the nucleotide sequence of GAM7809 RNA, herein designated GAM RNA, also designated SEQ ID:398.

Another function of GAM7809 is therefore inhibition of KIAA1018 (Accession NP_055782.1). Accordingly, utilities of GAM7809 include diagnosis, prevention and treatment of diseases and clinical conditions associated with KIAA1018.

KIAA1671 (Accession XP_037809.1) is another GAM7809 target gene, herein designated TARGET GENE. KIAA1671 BINDING SITE is a target binding site found in the 3' untranslated region of mRNA encoded by KIAA1671, corresponding to a target binding site such as BINDING SITE I, BINDING SITE II or BINDING SITE III of FIG. 8. Table 4 illustrates the complementarity of the nucleotide sequences of KIAA1671 BINDING SITE, designated SEQ ID:7267, to the nucleotide sequence of GAM7809 RNA, herein designated GAM RNA, also designated SEQ ID:398.

Another function of GAM7809 is therefore inhibition of KIAA1671 (Accession XP_037809.1). Accordingly, utilities of GAM7809 include diagnosis, prevention and treatment of diseases and clinical conditions associated with KIAA1671.

KIAA1726 (Accession XP_040860.3) is another GAM7809 target gene, herein designated TARGET GENE. KIAA1726 BINDING SITE is a target binding site found in the 3' untranslated region of mRNA encoded by KIAA1726, corresponding to a target binding site such as BINDING SITE I, BINDING SITE II or BINDING SITE III of FIG. 8. Table 4 illustrates the complementarity of the nucleotide sequences of KIAA1726 BINDING SITE, designated SEQ ID:9351, to the nucleotide sequence of GAM7809 RNA, herein designated GAM RNA, also designated SEQ ID:398.

Another function of GAM7809 is therefore inhibition of KIAA1726 (Accession XP_040860.3). Accordingly, utilities of GAM7809 include diagnosis, prevention and treatment of diseases and clinical conditions associated with KIAA1726.

LOC121838 (Accession XP_071772.1) is another GAM7809 target gene, herein designated TARGET GENE. LOC121838 BINDING SITE is a target binding site found in the 5' untranslated region of mRNA encoded by LOC121838, corresponding to a target binding site such as BINDING SITE I, BINDING SITE II or BINDING SITE III of FIG. 8. Table 4 illustrates the complementarity of the nucleotide sequences of LOC121838 BINDING SITE, designated SEQ ID:17414, to the nucleotide sequence of GAM7809 RNA, herein designated GAM RNA, also designated SEQ ID:398.

Another function of GAM7809 is therefore inhibition of LOC121838 (Accession XP_071772.1). Accordingly, utilities of GAM7809 include diagnosis, prevention and treatment of diseases and clinical conditions associated with LOC121838.

LOC130536 (Accession XP_065771.1) is another GAM7809 target gene, herein designated TARGET GENE. LOC130536 BINDING SITE is a target binding site found in the 5' untranslated region of mRNA encoded by LOC130536, corresponding to a target binding site such as BINDING SITE I, BINDING SITE II or BINDING SITE III of FIG. 8. Table 4 illustrates the complementarity of the nucleotide sequences of LOC130536 BINDING SITE, designated SEQ ID:15342, to the nucleotide sequence of GAM7809 RNA, herein designated GAM RNA, also designated SEQ ID:398.

Another function of GAM7809 is therefore inhibition of LOC130536 (Accession XP_065771.1). Accordingly, utilities of GAM7809 include diagnosis, prevention and treatment of diseases and clinical conditions associated with LOC130536.

LOC148709 (Accession XP_086281.1) is another GAM7809 target gene, herein designated TARGET GENE. LOC148709 BINDING SITE is a target binding site found in the 5' untranslated region of mRNA encoded by LOC148709, corresponding to a target binding site such as BINDING SITE I, BINDING SITE II or BINDING SITE III of FIG. 8. Table 4 illustrates the complementarity of the nucleotide sequences of LOC148709 BINDING SITE, designated SEQ ID:19661, to the nucleotide sequence of GAM7809 RNA, herein designated GAM RNA, also designated SEQ ID:398.

Another function of GAM7809 is therefore inhibition of LOC148709 (Accession XP_086281.1). Accordingly, utilities of GAM7809 include diagnosis, prevention and treatment of diseases and clinical conditions associated with LOC148709.

LOC149600 (Accession XP_097686.1) is another GAM7809 target gene, herein designated TARGET GENE. LOC149600 BINDING SITE is a target binding site found in the 3' untranslated region of mRNA encoded by LOC149600, corresponding to a target binding site such as BINDING SITE I, BINDING SITE II or BINDING SITE III of FIG. 8. Table 4 illustrates the complementarity of the nucleotide sequences of LOC149600 BINDING SITE, designated SEQ ID:15051, to the nucleotide sequence of GAM7809 RNA, herein designated GAM RNA, also designated SEQ ID:398.

Another function of GAM7809 is therefore inhibition of LOC149600 (Accession XP_097686.1). Accordingly, utilities of GAM7809 include diagnosis, prevention and treatment of diseases and clinical conditions associated with LOC149600.

LOC151057 (Accession XP_097998.1) is another GAM7809 target gene, herein designated TARGET GENE. LOC151057 BINDING SITE is a target binding site found in the 3' untranslated region of mRNA encoded by LOC151057, corresponding to a target binding site such as BINDING SITE I, BINDING SITE II or BINDING SITE III of FIG. 8. Table 4 illustrates the complementarity of the nucleotide sequences of LOC151057 BINDING SITE, designated SEQ ID:6610, to the nucleotide sequence of GAM7809 RNA, herein designated GAM RNA, also designated SEQ ID:398.

Another function of GAM7809 is therefore inhibition of LOC151057 (Accession XP_097998.1). Accordingly, utilities of GAM7809 include diagnosis, prevention and treatment of diseases and clinical conditions associated with LOC151057.

LOC152200 (Accession XP_098174.1) is another GAM7809 target gene, herein designated TARGET GENE. LOC152200 BINDING SITE is a target binding site found in the 3' untranslated region of mRNA encoded by LOC152200, corresponding to a target binding site such as BINDING SITE I, BINDING SITE II or BINDING SITE III of FIG. 8. Table 4 illustrates the complementarity of the nucleotide sequences of LOC152200 BINDING SITE, designated SEQ ID:19176, to the nucleotide sequence of GAM7809 RNA, herein designated GAM RNA, also designated SEQ ID:398.

Another function of GAM7809 is therefore inhibition of LOC152200 (Accession XP_098174.1). Accordingly, utilities of GAM7809 include diagnosis, prevention and treatment of diseases and clinical conditions associated with LOC152200.

LOC157503 (Accession XP_098767.1) is another GAM7809 target gene, herein designated TARGET GENE. LOC157503 BINDING SITE1 and LOC157503 BINDING SITE2 are target binding sites found in untranslated regions of mRNA encoded by LOC157503, corresponding to target binding sites such as BINDING SITE I, BINDING SITE II or BINDING SITE III of FIG. 8. Table 4 illustrates the complementarity of the nucleotide sequences of LOC157503 BINDING SITE1 and LOC157503 BINDING SITE2, designated SEQ ID:10657 and SEQ ID:20114 respectively, to the nucleotide sequence of GAM7809 RNA, herein designated GAM RNA, also designated SEQ ID:398.

Another function of GAM7809 is therefore inhibition of LOC157503 (Accession XP_098767.1). Accordingly, utilities of GAM7809 include diagnosis, prevention and treatment of diseases and clinical conditions associated with LOC157503.

LOC157567 (Accession XP_088328.1) is another GAM7809 target gene, herein designated TARGET GENE. LOC157567 BINDING SITE is a target binding site found in the 3' untranslated region of mRNA encoded by LOC157567, corresponding to a target binding site such as BINDING SITE I, BINDING SITE II or BINDING SITE III of FIG. 8. Table 4 illustrates the complementarity of the nucleotide sequences of LOC157567 BINDING SITE, designated SEQ ID:1783, to the nucleotide sequence of GAM7809 RNA, herein designated GAM RNA, also designated SEQ ID:398.

Another function of GAM7809 is therefore inhibition of LOC157567 (Accession XP_088328.1). Accordingly, utilities of GAM7809 include diagnosis, prevention and treatment of diseases and clinical conditions associated with LOC157567.

LOC283007 (Accession XP_210849.1) is another GAM7809 target gene, herein designated TARGET GENE. LOC283007 BINDING SITE is a target binding site found in the 5' untranslated region of mRNA encoded by LOC283007, corresponding to a target binding site such as BINDING SITE I, BINDING SITE II or BINDING SITE III of FIG. 8. Table 4 illustrates the complementarity of the nucleotide sequences of LOC283007 BINDING SITE, designated SEQ ID:14565, to the nucleotide sequence of GAM7809 RNA, herein designated GAM RNA, also designated SEQ ID:398.

Another function of GAM7809 is therefore inhibition of LOC283007 (Accession XP_210849.1). Accordingly, utilities of GAM7809 include diagnosis, prevention and treatment of diseases and clinical conditions associated with LOC283007.

LOC283641 (Accession XP_208764.1) is another GAM7809 target gene, herein designated TARGET GENE. LOC283641 BINDING SITE is a target binding site found in the 3' untranslated region of mRNA encoded by LOC283641, corresponding to a target binding site such as BINDING SITE I, BINDING SITE II or BINDING SITE III of FIG. 8. Table 4 illustrates the complementarity of the nucleotide sequences of LOC283641 BINDING SITE, designated SEQ ID:9650, to the nucleotide sequence of GAM7809 RNA, herein designated GAM RNA, also designated SEQ ID:398.

Another function of GAM7809 is therefore inhibition of LOC283641 (Accession XP_208764.1). Accordingly, utilities of GAM7809 include diagnosis, prevention and treatment of diseases and clinical conditions associated with LOC283641.

LOC284019 (Accession XP_211302.1) is another GAM7809 target gene, herein designated TARGET GENE. LOC284019 BINDING SITE is a target binding site found in the 3' untranslated region of mRNA encoded by LOC284019, corresponding to a target binding site such as BINDING SITE I, BINDING SITE II or BINDING SITE III of FIG. 8. Table 4 illustrates the complementarity of the nucleotide sequences of LOC284019 BINDING SITE, designated SEQ ID:16558, to the nucleotide sequence of GAM7809 RNA, herein designated GAM RNA, also designated SEQ ID:398.

Another function of GAM7809 is therefore inhibition of LOC284019 (Accession XP_211302.1). Accordingly, utilities of GAM7809 include diagnosis, prevention and treatment of diseases and clinical conditions associated with LOC284019.

LOC284394 (Accession XP_210786.1) is another GAM7809 target gene, herein designated TARGET GENE. LOC284394 BINDING SITE is a target binding site found in the 5' untranslated region of mRNA encoded by LOC284394, corresponding to a target binding site such as BINDING SITE I, BINDING SITE II or BINDING SITE III of FIG. 8. Table 4 illustrates the complementarity of the nucleotide sequences of LOC284394 BINDING SITE, designated SEQ ID:9920, to the nucleotide sequence of GAM7809 RNA, herein designated GAM RNA, also designated SEQ ID:398.

Another function of GAM7809 is therefore inhibition of LOC284394 (Accession XP_210786.1). Accordingly, utilities of GAM7809 include diagnosis, prevention and treatment of diseases and clinical conditions associated with LOC284394.

LOC285219 (Accession XP_209518.1) is another GAM7809 target gene, herein designated TARGET GENE. LOC285219 BINDING SITE is a target binding site found in the 5' untranslated region of mRNA encoded by LOC285219, corresponding to a target binding site such as BINDING SITE I, BINDING SITE II or BINDING SITE III of FIG. 8. Table 4 illustrates the complementarity of the nucleotide sequences of LOC285219 BINDING SITE, designated SEQ ID:5963, to the nucleotide sequence of GAM7809 RNA, herein designated GAM RNA, also designated SEQ ID:398.

Another function of GAM7809 is therefore inhibition of LOC285219 (Accession XP_209518.1). Accordingly, utilities of GAM7809 include diagnosis, prevention and treatment of diseases and clinical conditions associated with LOC285219.

LOC285483 (Accession XP_209631.1) is another GAM7809 target gene, herein designated TARGET GENE. LOC285483 BINDING SITE is a target binding site found in the 3' untranslated region of mRNA encoded by LOC285483, corresponding to a target binding site such as BINDING SITE I, BINDING SITE II or BINDING SITE III of FIG. 8. Table 4 illustrates the complementarity of the nucleotide sequences of LOC285483 BINDING SITE, designated SEQ ID:6690, to the nucleotide sequence of GAM7809 RNA, herein designated GAM RNA, also designated SEQ ID:398.

Another function of GAM7809 is therefore inhibition of LOC285483 (Accession XP_209631.1). Accordingly, utilities of GAM7809 include diagnosis, prevention and treatment of diseases and clinical conditions associated with LOC285483.

LOC286039 (Accession XP_209873.1) is another GAM7809 target gene, herein designated TARGET GENE. LOC286039 BINDING SITE is a target binding site found in the 5' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:2701, to the nucleotide sequence of GAM7809 RNA, herein designated GAM RNA, also designated SEQ ID:398.

Another function of GAM7809 is therefore inhibition of LOC286039 (Accession XP_209873.1). Accordingly, utilities of GAM7809 include diagnosis, prevention and treatment of diseases and clinical conditions associated with LOC286039.

LOC286163 (Accession XP_209922.1) is another GAM7809 target gene, herein designated TARGET GENE. LOC286163 BINDING SITE is a target binding site found in the 3' untranslated region of mRNA encoded by LOC286163, corresponding to a target binding site such as BINDING SITE I, BINDING SITE II or BINDING SITE III of FIG. 8. Table 4 illustrates the complementarity of the nucleotide sequences of LOC286163 BINDING SITE, designated SEQ ID:16153, to the nucleotide sequence of GAM7809 RNA, herein designated GAM RNA, also designated SEQ ID:398.

Another function of GAM7809 is therefore inhibition of LOC286163 (Accession XP_209922.1). Accordingly, utilities of GAM7809 include diagnosis, prevention and treatment of diseases and clinical conditions associated with LOC286163.

LOC286425 (Accession XP_208420.1) is another GAM7809 target gene, herein designated TARGET GENE. LOC286425 BINDING SITE is a target binding site found in the 5' untranslated region of mRNA encoded by LOC286425, corresponding to a target binding site such as BINDING SITE I, BINDING SITE II or BINDING SITE III of FIG. 8. Table 4 illustrates the complementarity of the nucleotide sequences of LOC286425 BINDING SITE, designated SEQ ID:13979, to the nucleotide sequence of GAM7809 RNA, herein designated GAM RNA, also designated SEQ ID:398.

Another function of GAM7809 is therefore inhibition of LOC286425 (Accession XP_208420.1). Accordingly, utilities of GAM7809 include diagnosis, prevention and treatment of diseases and clinical conditions associated with LOC286425.

LOC338558 (Accession XP_290465.1) is another GAM7809 target gene, herein designated TARGET GENE. LOC338558 BINDING SITE is a target binding site found in the 5' untranslated region of mRNA encoded by LOC338558, corresponding to a target binding site such as BINDING SITE I, BINDING SITE II or BINDING SITE III of FIG. 8. Table 4 illustrates the complementarity of the nucleotide sequences of LOC338558 BINDING SITE, designated SEQ ID:15746, to the nucleotide sequence of GAM7809 RNA, herein designated GAM RNA, also designated SEQ ID:398.

Another function of GAM7809 is therefore inhibition of LOC338558 (Accession XP_290465.1). Accordingly, utilities of GAM7809 include diagnosis, prevention and treatment of diseases and clinical conditions associated with LOC338558.

LOC340184 (Accession XP_295183.1) is another GAM7809 target gene, herein designated TARGET GENE. LOC340184 BINDING SITE is a target binding site found in the 3' untranslated region of mRNA encoded by LOC340184, corresponding to a target binding site such as BINDING SITE I, BINDING SITE II or BINDING SITE III of FIG. 8. Table 4 illustrates the complementarity of the nucleotide sequences of LOC340184 BINDING SITE, designated SEQ ID:8010, to the nucleotide sequence of GAM7809 RNA, herein designated GAM RNA, also designated SEQ ID:398.

Another function of GAM7809 is therefore inhibition of LOC340184 (Accession XP_295183.1). Accordingly, utilities of GAM7809 include diagnosis, prevention and treatment of diseases and clinical conditions associated with LOC340184.

LOC340408 (Accession XP_291274.1) is another GAM7809 target gene, herein designated TARGET GENE. LOC340408 BINDING SITE is a target binding site found in the 5' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:2701, to the nucleotide sequence of GAM7809 RNA, herein designated GAM RNA, also designated SEQ ID:398.

Another function of GAM7809 is therefore inhibition of LOC340408 (Accession XP_291274.1). Accordingly, utilities of GAM7809 include diagnosis, prevention and treatment of diseases and clinical conditions associated with LOC340408.

LOC340852 (Accession XP_291740.1) is another GAM7809 target gene, herein designated TARGET GENE. LOC340852 BINDING SITE is a target binding site found in the 5' untranslated region of mRNA encoded by LOC340852, corresponding to a target binding site such as BINDING SITE I, BINDING SITE II or BINDING SITE III of FIG. 8. Table 4 illustrates the complementarity of the nucleotide sequences of LOC340852 BINDING SITE, designated SEQ ID:19394, to the nucleotide sequence of GAM7809 RNA, herein designated GAM RNA, also designated SEQ ID:398.

Another function of GAM7809 is therefore inhibition of LOC340852 (Accession XP_291740.1). Accordingly, utilities of GAM7809 include diagnosis, prevention and treatment of diseases and clinical conditions associated with LOC340852.

LOC345119 (Accession XP_298539.1) is another GAM7809 target gene, herein designated TARGET GENE. LOC345119 BINDING SITE is a target binding site found in the 5' untranslated region of mRNA encoded by LOC345119, corresponding to a target binding site such as BINDING SITE I, BINDING SITE II or BINDING SITE III of FIG. 8. Table 4 illustrates the complementarity of the nucleotide sequences of LOC345119 BINDING SITE, designated SEQ ID:5096, to the nucleotide sequence of GAM7809 RNA, herein designated GAM RNA, also designated SEQ ID:398.

Another function of GAM7809 is therefore inhibition of LOC345119 (Accession XP_298539.1). Accordingly, utilities of GAM7809 include diagnosis, prevention and treatment of diseases and clinical conditions associated with LOC345119.

LOC346653 (Accession XP_294357.2) is another GAM7809 target gene, herein designated TARGET GENE. LOC346653 BINDING SITE is a target binding site found in the 3' untranslated region of mRNA encoded by LOC346653, corresponding to a target binding site such as BINDING SITE I, BINDING SITE II or BINDING SITE III of FIG. 8. Table 4 illustrates the complementarity of the nucleotide sequences of LOC346653 BINDING SITE, designated SEQ ID:18192, to the nucleotide sequence of GAM7809 RNA, herein designated GAM RNA, also designated SEQ ID:398.

Another function of GAM7809 is therefore inhibition of LOC346653 (Accession XP_294357.2). Accordingly, utilities of GAM7809 include diagnosis, prevention and treatment of diseases and clinical conditions associated with LOC346653.

LOC349289 (Accession XP_300477.1) is another GAM7809 target gene, herein designated TARGET GENE. LOC349289 BINDING SITE is a target binding site found in the 3' untranslated region of mRNA encoded by LOC349289, corresponding to a target binding site such as BINDING SITE I, BINDING SITE II or BINDING SITE III of FIG. 8. Table 4 illustrates the complementarity of the nucleotide sequences of LOC349289 BINDING SITE, designated SEQ ID:9015, to the nucleotide sequence of GAM7809 RNA, herein designated GAM RNA, also designated SEQ ID:398.

Another function of GAM7809 is therefore inhibition of LOC349289 (Accession XP_300477.1). Accordingly, utilities of GAM7809 include diagnosis, prevention and treatment of diseases and clinical conditions associated with LOC349289.

LOC56906 (Accession NP_064532.1) is another GAM7809 target gene, herein designated TARGET GENE. LOC56906 BINDING SITE is a target binding site found in the 3' untranslated region of mRNA encoded by LOC56906, corresponding to a target binding site such as BINDING SITE I, BINDING SITE II or BINDING SITE III of FIG. 8. Table 4 illustrates the complementarity of the nucleotide sequences of LOC56906 BINDING SITE, designated SEQ ID:16105, to the nucleotide sequence of GAM7809 RNA, herein designated GAM RNA, also designated SEQ ID:398.

Another function of GAM7809 is therefore inhibition of LOC56906 (Accession NP_064532.1). Accordingly, utilities of GAM7809 include diagnosis, prevention and treatment of diseases and clinical conditions associated with LOC56906.

LOC92912 (Accession NP_775740.1) is another GAM7809 target gene, herein designated TARGET GENE. LOC92912 BINDING SITE is a target binding site found in the 3' untranslated region of mRNA encoded by LOC92912, corresponding to a target binding site such as BINDING SITE I, BINDING SITE II or BINDING SITE III of FIG. 8. Table 4 illustrates the complementarity of the nucleotide sequences of LOC92912 BINDING SITE, designated SEQ ID:11212, to the nucleotide sequence of GAM7809 RNA, herein designated GAM RNA, also designated SEQ ID:398.

Another function of GAM7809 is therefore inhibition of LOC92912 (Accession NP_775740.1). Accordingly, utilities of GAM7809 include diagnosis, prevention and treatment of diseases and clinical conditions associated with LOC92912.

MEGF11 (Accession NP_115821.1) is another GAM7809 target gene, herein designated TARGET GENE. MEGF11 BINDING SITE is a target binding site found in the 3' untranslated region of mRNA encoded by MEGF11, corresponding to a target binding site such as BINDING SITE I, BINDING SITE II or BINDING SITE III of FIG. 8. Table 4 illustrates the complementarity of the nucleotide sequences of MEGF11 BINDING SITE, designated SEQ ID:9381, to the nucleotide sequence of GAM7809 RNA, herein designated GAM RNA, also designated SEQ ID:398.

Another function of GAM7809 is therefore inhibition of MEGF11 (Accession NP_115821.1). Accordingly, utilities of GAM7809 include diagnosis, prevention and treatment of diseases and clinical conditions associated with MEGF11.

MGC14407 (Accession NP_116297.1) is another GAM7809 target gene, herein designated TARGET GENE. MGC14407 BINDING SITE is a target binding site found in the 3' untranslated region of mRNA encoded by MGC14407, corresponding to a target binding site such as BINDING SITE I, BINDING SITE II or BINDING SITE III of FIG. 8. Table 4 illustrates the complementarity of the nucleotide sequences of MGC14407 BINDING SITE, designated SEQ ID:10181, to the nucleotide sequence of GAM7809 RNA, herein designated GAM RNA, also designated SEQ ID:398.

Another function of GAM7809 is therefore inhibition of MGC14407 (Accession NP_116297.1). Accordingly, utilities of GAM7809 include diagnosis, prevention and treatment of diseases and clinical conditions associated with MGC14407.

MGC19556 (Accession NP_291029.1) is another GAM7809 target gene, herein designated TARGET GENE. MGC19556 BINDING SITE is a target binding site found in the 5' untranslated region of mRNA encoded by MGC19556, corresponding to a target binding site such as BINDING SITE I, BINDING SITE II or BINDING SITE III of FIG. 8. Table 4 illustrates the complementarity of the nucleotide sequences of MGC19556 BINDING SITE, designated SEQ ID:4710, to the nucleotide sequence of GAM7809 RNA, herein designated GAM RNA, also designated SEQ ID:398.

Another function of GAM7809 is therefore inhibition of MGC19556 (Accession NP_291029.1). Accordingly, utilities of GAM7809 include diagnosis, prevention and treatment of diseases and clinical conditions associated with MGC19556.

MGC26647 (Accession NP_689919.1) is another GAM7809 target gene, herein designated TARGET GENE. MGC26647 BINDING SITE is a target binding site found in the 5' untranslated region of mRNA encoded by MGC26647, corresponding to a target binding site such as BINDING SITE I, BINDING SITE II or BINDING SITE III of FIG. 8. Table 4 illustrates the complementarity of the nucleotide sequences of MGC26647 BINDING SITE, designated SEQ ID:11055, to the nucleotide sequence of GAM7809 RNA, herein designated GAM RNA, also designated SEQ ID:398.

Another function of GAM7809 is therefore inhibition of MGC26647 (Accession NP_689919.1). Accordingly, utilities of GAM7809 include diagnosis, prevention and treatment of diseases and clinical conditions associated with MGC26647.

MGC39616 (Accession NP_775847.1) is another GAM7809 target gene, herein designated TARGET GENE. MGC39616 BINDING SITE is a target binding site found in the 3' untranslated region of mRNA encoded by MGC39616, corresponding to a target binding site such as BINDING SITE I, BINDING SITE II or BINDING SITE III of FIG. 8. Table 4 illustrates the complementarity of the nucleotide sequences of MGC39616 BINDING SITE, designated SEQ ID:4954, to the nucleotide sequence of GAM7809 RNA, herein designated GAM RNA, also designated SEQ ID:398.

Another function of GAM7809 is therefore inhibition of MGC39616 (Accession NP_775847.1). Accordingly, utilities of GAM7809 include diagnosis, prevention and treatment of diseases and clinical conditions associated with MGC39616.

MGC4737 (Accession NP_113654.1) is another GAM7809 target gene, herein designated TARGET GENE. MGC4737 BINDING SITE is a target binding site found in the 5' untranslated region of mRNA encoded by MGC4737, corresponding to a target binding site such as BINDING SITE I, BINDING SITE II or BINDING SITE III of FIG. 8. Table 4 illustrates the complementarity of the nucleotide sequences of MGC4737 BINDING SITE, designated SEQ ID:13111, to the nucleotide sequence of GAM7809 RNA, herein designated GAM RNA, also designated SEQ ID:398.

Another function of GAM7809 is therefore inhibition of MGC4737 (Accession NP_113654.1). Accordingly, utilities of GAM7809 include diagnosis, prevention and treatment of diseases and clinical conditions associated with MGC4737.

Mhc class ii transactivator (MHC2TA, Accession NP_000237.1) is another GAM7809 target gene, herein designated TARGET GENE. MHC2TA BINDING SITE is a target binding site found in the 3' untranslated region of mRNA encoded by MHC2TA, corresponding to a target binding site such as BINDING SITE I, BINDING SITE II or BINDING SITE III of FIG. 8. Table 4 illustrates the complementarity of the nucleotide sequences of MHC2TA BINDING SITE, designated SEQ ID:16477, to the nucleotide sequence of GAM7809 RNA, herein designated GAM RNA, also designated SEQ ID:398.

Another function of GAM7809 is therefore inhibition of Mhc class ii transactivator (MHC2TA, Accession NP_000237.1). Accordingly, utilities of GAM7809 include diagnosis, prevention and treatment of diseases and clinical conditions associated with MHC2TA.

Mki67 (fha domain) interacting nucleolar phosphoprotein (MKI67IP, Accession NP_115766.2) is another GAM7809 target gene, herein designated TARGET GENE. MKI67IP BINDING SITE is a target binding site found in the 3' untranslated region of mRNA encoded by MKI67IP, corresponding to a target binding site such as BINDING SITE I, BINDING SITE II or BINDING SITE III of FIG. 8. Table 4 illustrates the complementarity of the nucleotide sequences of MKI67IP BINDING SITE, designated SEQ ID:14713, to the nucleotide sequence of GAM7809 RNA, herein designated GAM RNA, also designated SEQ ID:398.

Another function of GAM7809 is therefore inhibition of Mki67 (fha domain) interacting nucleolar phosphoprotein (MKI67IP, Accession NP_115766.2). Accordingly, utilities of GAM7809 include diagnosis, prevention and treatment of diseases and clinical conditions associated with MKI67IP.

Membrane-spanning 4-domains, subfamily a, member 6a (MS4A6A, Accession NP_071744.2) is another GAM7809 target gene, herein designated TARGET GENE. MS4A6A BINDING SITE is a target binding site found in the 3' untranslated region of multiple transcripts of mRNA encoded by MS4A6A, corresponding to a target binding site such as BINDING SITE I, BINDING SITE II or BINDING SITE III of FIG. 8. Table 4 illustrates the complementarity of the nucleotide sequences of MS4A6A BINDING SITE, designated SEQ ID:9874, to the nucleotide sequence of GAM7809 RNA, herein designated GAM RNA, also designated SEQ ID:398.

Another function of GAM7809 is therefore inhibition of Membrane-spanning 4-domains, subfamily a, member 6a (MS4A6A, Accession NP_071744.2), a gene which binds to the fc region of immunoglobulins epsilon. Accordingly, utilities of GAM7809 include diagnosis, prevention and treatment of diseases and clinical conditions associated with MS4A6A.

The function of MS4A6A and its association with various diseases and clinical conditions, has been established by previous studies, as described hereinabove with reference to GAM180.1. NET-2 (Accession NP_036470.1) is another GAM7809 target gene, herein designated TARGET GENE. NET-2 BINDING SITE is a target binding site found in the 3' untranslated region of mRNA encoded by NET-2, corresponding to a target binding site such as BINDING SITE I, BINDING SITE II or BINDING SITE III of FIG. 8. Table 4 illustrates the complementarity of the nucleotide sequences of NET-2 BINDING SITE, designated SEQ ID:14668, to the nucleotide sequence of GAM7809 RNA, herein designated GAM RNA, also designated SEQ ID:398.

Another function of GAM7809 is therefore inhibition of NET-2 (Accession NP_036470.1). Accordingly, utilities of GAM7809 include diagnosis, prevention and treatment of diseases and clinical conditions associated with NET-2.

Nuclear factor i/b (NFIB, Accession NP_005587.1) is another GAM7809 target gene, herein designated TARGET GENE. NFIB BINDING SITE is a target binding site found in the 3' untranslated region of mRNA encoded by NFIB, corresponding to a target binding site such as BINDING SITE I, BINDING SITE II or BINDING SITE III of FIG. 8. Table 4 illustrates the complementarity of the nucleotide sequences of NFIB BINDING SITE, designated SEQ ID:1182, to the nucleotide sequence of GAM7809 RNA, herein designated GAM RNA, also designated SEQ ID:398.

Another function of GAM7809 is therefore inhibition of Nuclear factor i/b (NFIB, Accession NP_005587.1), a gene which recognizes and binds the palindromic sequence 5'-ttg-gcnnnnngccaa-3' present in viral and cellular promoters. Accordingly, utilities of GAM7809 include diagnosis, prevention and treatment of diseases and clinical conditions associated with NFIB.

The function of NFIB and its association with various diseases and clinical conditions, has been established by previous studies, as described hereinabove with reference to GAM94.1. Neurotrophic tyrosine kinase, receptor, type 2 (NTRK2, Accession NP_006171.2) is another GAM7809 target gene, herein designated TARGET GENE. NTRK2 BINDING SITE is a target binding site found in the 5' untranslated region of mRNA encoded by NTRK2, corresponding to a target binding site such as BINDING SITE I, BINDING SITE II or BINDING SITE III of FIG. 8. Table 4 illustrates the complementarity of the nucleotide sequences of NTRK2 BINDING SITE, designated SEQ ID:9600, to the nucleotide sequence of GAM7809 RNA, herein designated GAM RNA, also designated SEQ ID:398.

Another function of GAM7809 is therefore inhibition of Neurotrophic tyrosine kinase, receptor, type 2 (NTRK2, Accession NP_006171.2), a gene which is involved in the development and/or maintenance of the nervous system. Accordingly, utilities of GAM7809 include diagnosis, prevention and treatment of diseases and clinical conditions associated with NTRK2.

The function of NTRK2 and its association with various diseases and clinical conditions, has been established by previous studies, as described hereinabove with reference to GAM120.1. NY-REN-25 (Accession XP_027116.6) is another GAM7809 target gene, herein designated TARGET GENE. NY-REN-25 BINDING SITE is a target binding site found in the 3' untranslated region of mRNA encoded by NY-REN-25, corresponding to a target binding site such as BINDING SITE I, BINDING SITE II or BINDING SITE III of FIG. 8. Table 4 illustrates the complementarity of the nucleotide sequences of NY-REN-25 BINDING SITE, designated SEQ ID:14494, to the nucleotide sequence of GAM7809 RNA, herein designated GAM RNA, also designated SEQ ID:398.

Another function of GAM7809 is therefore inhibition of NY-REN-25 (Accession XP_027116.6). Accordingly, utilities of GAM7809 include diagnosis, prevention and treatment of diseases and clinical conditions associated with NY-REN-25.

NYD-SP11 (Accession NP_114157.2) is another GAM7809 target gene, herein designated TARGET GENE. NYD-SP11 BINDING SITE is a target binding site found in the 5' untranslated region of mRNA encoded by NYD-SP11, corresponding to a target binding site such as BINDING SITE I, BINDING SITE II or BINDING SITE III of FIG. 8. Table 4 illustrates the complementarity of the nucleotide sequences of NYD-SP11 BINDING SITE, designated SEQ ID:19585, to the nucleotide sequence of GAM7809 RNA, herein designated GAM RNA, also designated SEQ ID:398.

Another function of GAM7809 is therefore inhibition of NYD-SP11 (Accession NP_114157.2). Accordingly, utilities of GAM7809 include diagnosis, prevention and treatment of diseases and clinical conditions associated with NYD-SP11.

OTOP3 (Accession XP_292588.2) is another GAM7809 target gene, herein designated TARGET GENE. OTOP3 BINDING SITE is a target binding site found in the 5' untranslated region of mRNA encoded by OTOP3, corresponding to a target binding site such as BINDING SITE I, BINDING SITE II or BINDING SITE III of FIG. 8. Table 4 illustrates the complementarity of the nucleotide sequences of OTOP3 BINDING SITE, designated SEQ ID:17220, to the nucleotide sequence of GAM7809 RNA, herein designated GAM RNA, also designated SEQ ID:398.

Another function of GAM7809 is therefore inhibition of OTOP3 (Accession XP_292588.2). Accordingly, utilities of GAM7809 include diagnosis, prevention and treatment of diseases and clinical conditions associated with OTOP3.

Piccolo (presynaptic cytomatrix protein) (PCLO, Accession XP_168530.1) is another GAM7809 target gene, herein designated TARGET GENE. PCLO BINDING SITE is a target binding site found in the 3' untranslated region of mRNA encoded by PCLO, corresponding to a target binding site such as BINDING SITE I, BINDING SITE II or BINDING SITE III of FIG. 8. Table 4 illustrates the complementarity of the nucleotide sequences of PCLO BINDING SITE, designated SEQ ID:17329, to the nucleotide sequence of GAM7809 RNA, herein designated GAM RNA, also designated SEQ ID:398.

Another function of GAM7809 is therefore inhibition of Piccolo (presynaptic cytomatrix protein) (PCLO, Accession XP_168530.1), a gene which involves in the cycling of synaptic vesicles. Accordingly, utilities of GAM7809 include diagnosis, prevention and treatment of diseases and clinical conditions associated with PCLO.

The function of PCLO and its association with various diseases and clinical conditions, has been established by previous studies, as described hereinabove with reference to GAM133.2. Platelet-derived growth factor receptor, beta polypeptide (PDGFRB, Accession NP_002600.1) is another GAM7809 target gene, herein designated TARGET GENE. PDGFRB BINDING SITE is a target binding site found in the 5' untranslated region of mRNA encoded by PDGFRB, corresponding to a target binding site such as BINDING SITE I, BINDING SITE II or BINDING SITE III of FIG. 8. Table 4 illustrates the complementarity of the nucleotide sequences of PDGFRB BINDING SITE, designated SEQ ID:8445, to the nucleotide sequence of GAM7809 RNA, herein designated GAM RNA, also designated SEQ ID:398.

Another function of GAM7809 is therefore inhibition of Platelet-derived growth factor receptor, beta polypeptide (PDGFRB, Accession NP_002600.1), a gene which Platelet-derived growth factor receptor beta chain; tyrosine kinase receptor. and therefore may be associated with Chronic myeloproliferative diseases. Accordingly, utilities of GAM7809 include diagnosis, prevention and treatment of Chronic myeloproliferative diseases, and of other diseases and clinical conditions associated with PDGFRB.

The function of PDGFRB and its association with various diseases and clinical conditions, has been established by previous studies, as described hereinabove with reference to GAM579.1. PDZK3 (Accession NP_835260.1) is another GAM7809 target gene, herein designated TARGET GENE. PDZK3 BINDING SITE is a target binding site found in the 3' untranslated region of multiple transcripts of mRNA encoded by PDZK3, corresponding to a target binding site such as BINDING SITE I, BINDING SITE II or BINDING SITE III of FIG. 8. Table 4 illustrates the complementarity of the nucleotide sequences of PDZK3 BINDING SITE, designated SEQ ID:13968, to the nucleotide sequence of GAM7809 RNA, herein designated GAM RNA, also designated SEQ ID:398.

Another function of GAM7809 is therefore inhibition of PDZK3 (Accession NP_835260.1). Accordingly, utilities of GAM7809 include diagnosis, prevention and treatment of diseases and clinical conditions associated with PDZK3.

PDZK3 (Accession NP_055837.2) is another GAM7809 target gene, herein designated TARGET GENE. PDZK3 BINDING SITE is a target binding site found in the 3' untranslated region of multiple transcripts of mRNA encoded by PDZK3, corresponding to a target binding site such as BINDING SITE I, BINDING SITE II or BINDING SITE III of FIG. 8. Table 4 illustrates the complementarity of the nucleotide sequences of PDZK3 BINDING SITE, designated SEQ ID:13968, to the nucleotide sequence of GAM7809 RNA, herein designated GAM RNA, also designated SEQ ID:398.

Another function of GAM7809 is therefore inhibition of PDZK3 (Accession NP_055837.2). Accordingly, utilities of GAM7809 include diagnosis, prevention and treatment of diseases and clinical conditions associated with PDZK3.

Phytanoyl-coa hydroxylase interacting protein (PHYHIP, Accession NP_055574.1) is another GAM7809 target gene, herein designated TARGET GENE. PHYHIP BINDING SITE is a target binding site found in the 3' untranslated region of mRNA encoded by PHYHIP, corresponding to a target binding site such as BINDING SITE I, BINDING SITE II or BINDING SITE III of FIG. 8. Table 4 illustrates the complementarity of the nucleotide sequences of PHYHIP BINDING SITE, designated SEQ ID:4208, to the nucleotide sequence of GAM7809 RNA, herein designated GAM RNA, also designated SEQ ID:398.

Another function of GAM7809 is therefore inhibition of Phytanoyl-coa hydroxylase interacting protein (PHYHIP, Accession NP_055574.1). Accordingly, utilities of GAM7809 include diagnosis, prevention and treatment of diseases and clinical conditions associated with PHYHIP.

PRO0365 (Accession NP_054845.1) is another GAM7809 target gene, herein designated TARGET GENE. PRO0365 BINDING SITE is a target binding site found in the 3' untranslated region of mRNA encoded by PRO0365, corresponding to a target binding site such as BINDING SITE I, BINDING SITE II or BINDING SITE III of FIG. 8. Table 4 illustrates the complementarity of the nucleotide sequences of PRO0365 BINDING SITE, designated SEQ ID:15355, to the nucleotide sequence of GAM7809 RNA, herein designated GAM RNA, also designated SEQ ID:398.

Another function of GAM7809 is therefore inhibition of PRO0365 (Accession NP_054845.1). Accordingly, utilities of GAM7809 include diagnosis, prevention and treatment of diseases and clinical conditions associated with PRO0365.

Prp4 pre-mrna processing factor 4 homolog b (yeast) (PRPF4B, Accession NP_003904.2) is another GAM7809 target gene, herein designated TARGET GENE. PRPF4B BINDING SITE is a target binding site found in the 3' untranslated region of multiple transcripts of mRNA encoded by PRPF4B, corresponding to a target binding site such as BINDING SITE I, BINDING SITE II or BINDING SITE III of FIG. 8. Table 4 illustrates the complementarity of the nucleotide sequences of PRPF4B BINDING SITE, designated SEQ ID:11905, to the nucleotide sequence of GAM7809 RNA, herein designated GAM RNA, also designated SEQ ID:398.

Another function of GAM7809 is therefore inhibition of Prp4 pre-mrna processing factor 4 homolog b (yeast) (PRPF4B, Accession NP_003904.2). Accordingly, utilities of GAM7809 include diagnosis, prevention and treatment of diseases and clinical conditions associated with PRPF4B.

Protein tyrosine phosphatase, receptor type, h (PTPRH, Accession NP_002833.1) is another GAM7809 target gene, herein designated TARGET GENE. PTPRH BINDING SITE is a target binding site found in the 3' untranslated region of mRNA encoded by PTPRH, corresponding to a target binding site such as BINDING SITE I, BINDING SITE II or BINDING SITE III of FIG. 8. Table 4 illustrates the complementarity of the nucleotide sequences of PTPRH BINDING SITE, designated SEQ ID:14651, to the nucleotide sequence of GAM7809 RNA, herein designated GAM RNA, also designated SEQ ID:398.

Another function of GAM7809 is therefore inhibition of Protein tyrosine phosphatase, receptor type, h (PTPRH, Accession NP_002833.1). Accordingly, utilities of GAM7809 include diagnosis, prevention and treatment of diseases and clinical conditions associated with PTPRH.

Ran binding protein 17 (RANBP17, Accession NP_075048.1) is another GAM7809 target gene, herein designated TARGET GENE. RANBP17 BINDING SITE is a target binding site found in the 3' untranslated region of mRNA encoded by RANBP17, corresponding to a target binding site such as BINDING SITE I, BINDING SITE II or BINDING SITE III of FIG. 8. Table 4 illustrates the complementarity of the nucleotide sequences of RANBP17 BINDING SITE, designated SEQ ID:18307, to the nucleotide sequence of GAM7809 RNA, herein designated GAM RNA, also designated SEQ ID:398.

Another function of GAM7809 is therefore inhibition of Ran binding protein 17 (RANBP17, Accession NP_075048.1). Accordingly, utilities of GAM7809 include diagnosis, prevention and treatment of diseases and clinical conditions associated with RANBP17.

Reversion-inducing-cysteine-rich protein with kazal motifs (RECK, Accession NP_066934.1) is another GAM7809 target gene, herein designated TARGET GENE. RECK BINDING SITE is a target binding site found in the 3' untranslated region of mRNA encoded by RECK, corresponding to a target binding site such as BINDING SITE I, BINDING SITE II or BINDING SITE III of FIG. 8. Table 4 illustrates the complementarity of the nucleotide sequences of RECK BINDING SITE, designated SEQ ID:6244, to the nucleotide sequence of GAM7809 RNA, herein designated GAM RNA, also designated SEQ ID:398.

Another function of GAM7809 is therefore inhibition of Reversion-inducing-cysteine-rich protein with kazal motifs (RECK, Accession NP_066934.1), a gene which plays a role in regulation of cancer progression and tumor angiogenesis. and therefore may be associated with Cancerous tumors. Accordingly, utilities of GAM7809 include diagnosis, prevention and treatment of Cancerous tumors, and of other diseases and clinical conditions associated with RECK.

The function of RECK and its association with various diseases and clinical conditions, has been established by previous studies, as described hereinabove with reference to GAM377.1. Serologically defined colon cancer antigen 33 (SDCCAG33, Accession NP_005777.2) is another GAM7809 target gene, herein designated TARGET GENE. SDCCAG33 BINDING SITE is a target binding site found in the 3' untranslated region of mRNA encoded by SDCCAG33, corresponding to a target binding site such as BINDING SITE I, BINDING SITE II or BINDING SITE III of FIG. 8. Table 4 illustrates the complementarity of the nucleotide sequences of SDCCAG33 BINDING SITE, designated SEQ ID:6557, to the nucleotide sequence of GAM7809 RNA, herein designated GAM RNA, also designated SEQ ID:398.

Another function of GAM7809 is therefore inhibition of Serologically defined colon cancer antigen 33 (SDCCAG33, Accession NP_005777.2). Accordingly, utilities of GAM7809 include diagnosis, prevention and treatment of diseases and clinical conditions associated with SDCCAG33.

Splicing factor, arginine/serine-rich 11 (SFRS11, Accession NP_004759.1) is another GAM7809 target gene, herein designated TARGET GENE. SFRS11 BINDING SITE is a target binding site found in the 3' untranslated region of mRNA encoded by SFRS11, corresponding to a target binding site such as BINDING SITE I, BINDING SITE II or BINDING SITE III of FIG. 8. Table 4 illustrates the complementarity of the nucleotide sequences of SFRS11 BINDING SITE, designated SEQ ID:14777, to the nucleotide sequence of GAM7809 RNA, herein designated GAM RNA, also designated SEQ ID:398.

Another function of GAM7809 is therefore inhibition of Splicing factor, arginine/serine-rich 11 (SFRS11, Accession NP_004759.1). Accordingly, utilities of GAM7809 include diagnosis, prevention and treatment of diseases and clinical conditions associated with SFRS11.

Sry (sex determining region y)-box 5 (SOX5, Accession NP_694534.1) is another GAM7809 target gene, herein designated TARGET GENE. SOX5 BINDING SITE is a target binding site found in the 3' untranslated region of multiple transcripts of mRNA encoded by SOX5, corresponding to a target binding site such as BINDING SITE I, BINDING SITE II or BINDING SITE III of FIG. 8. Table 4 illustrates the complementarity of the nucleotide sequences of SOX5 BINDING SITE, designated SEQ ID:9808, to the nucleotide sequence of GAM7809 RNA, herein designated GAM RNA, also designated SEQ ID:398.

Another function of GAM7809 is therefore inhibition of Sry (sex determining region y)-box 5 (SOX5, Accession NP_694534.1), a gene which binds specifically to the dna sequence 5'-aacaat-3'. Accordingly, utilities of GAM7809 include diagnosis, prevention and treatment of diseases and clinical conditions associated with SOX5.

The function of SOX5 and its association with various diseases and clinical conditions, has been established by previous studies, as described hereinabove with reference to GAM488.1. Sry (sex determining region y)-box 5 (SOX5, Accession NP_008871.3) is another GAM7809 target gene, herein designated TARGET GENE. SOX5 BINDING SITE is a target binding site found in the 3' untranslated region of multiple transcripts of mRNA encoded by SOX5, corresponding to a target binding site such as BINDING SITE I, BINDING SITE II or BINDING SITE III of FIG. 8. Table 4 illustrates the complementarity of the nucleotide sequences of SOX5 BINDING SITE, designated SEQ ID:9808, to the nucleotide sequence of GAM7809 RNA, herein designated GAM RNA, also designated SEQ ID:398.

Another function of GAM7809 is therefore inhibition of Sry (sex determining region y)-box 5 (SOX5, Accession NP_008871.3), a gene which binds specifically to the dna sequence 5'-aacaat-3'. Accordingly, utilities of GAM7809 include diagnosis, prevention and treatment of diseases and clinical conditions associated with SOX5.

The function of SOX5 and its association with various diseases and clinical conditions, has been established by previous studies, as described hereinabove with reference to GAM488.1. Sry (sex determining region y)-box 5 (SOX5, Accession NP_821078.1) is another GAM7809 target gene, herein designated TARGET GENE. SOX5 BINDING SITE is a target binding site found in the 3' untranslated region of multiple transcripts of mRNA encoded by SOX5, corresponding to a target binding site such as BINDING SITE I, BINDING SITE II or BINDING SITE III of FIG. 8. Table 4 illustrates the complementarity of the nucleotide sequences of SOX5 BINDING SITE, designated SEQ ID:9808, to the nucleotide sequence of GAM7809 RNA, herein designated GAM RNA, also designated SEQ ID:398.

Another function of GAM7809 is therefore inhibition of Sry (sex determining region y)-box 5 (SOX5, Accession NP_821078.1), a gene which binds specifically to the dna sequence 5'-aacaat-3'. Accordingly, utilities of GAM7809 include diagnosis, prevention and treatment of diseases and clinical conditions associated with SOX5.

The function of SOX5 and its association with various diseases and clinical conditions, has been established by previous studies, as described hereinabove with reference to GAM488.1. Sparc/osteonectin, cwcv and kazal-like domains proteoglycan (testican) (SPOCK, Accession NP_004589.1) is another GAM7809 target gene, herein designated TARGET GENE. SPOCK BINDING SITE is a target binding site found in the 3' untranslated region of mRNA encoded by SPOCK, corresponding to a target binding site such as BINDING SITE I, BINDING SITE II or BINDING SITE III of FIG. 8. Table 4 illustrates the complementarity of the nucleotide sequences of SPOCK BINDING SITE, designated SEQ ID:10241, to the nucleotide sequence of GAM7809 RNA, herein designated GAM RNA, also designated SEQ ID:398.

Another function of GAM7809 is therefore inhibition of Sparc/osteonectin, cwcv and kazal-like domains proteoglycan (testican) (SPOCK, Accession NP_004589.1). Accordingly, utilities of GAM7809 include diagnosis, prevention and treatment of diseases and clinical conditions associated with SPOCK.

SRGAP2 (Accession NP_055665.1) is another GAM7809 target gene, herein designated TARGET GENE. SRGAP2 BINDING SITE is a target binding site found in the 3' untranslated region of mRNA encoded by SRGAP2, corresponding to a target binding site such as BINDING SITE I, BINDING SITE II or BINDING SITE III of FIG. 8. Table 4 illustrates the complementarity of the nucleotide sequences of SRGAP2 BINDING SITE, designated SEQ ID:14316, to the nucleotide sequence of GAM7809 RNA, herein designated GAM RNA, also designated SEQ ID:398.

Another function of GAM7809 is therefore inhibition of SRGAP2 (Accession NP_055665.1). Accordingly, utilities of GAM7809 include diagnosis, prevention and treatment of diseases and clinical conditions associated with SRGAP2.

STAF65(gamma) (Accession NP_055675.1) is another GAM7809 target gene, herein designated TARGET GENE. STAF65(gamma) BINDING SITE is a target binding site found in the 3' untranslated region of mRNA encoded by STAF65(gamma), corresponding to a target binding site such as BINDING SITE I, BINDING SITE II or BINDING SITE III of FIG. 8. Table 4 illustrates the complementarity of the nucleotide sequences of STAF65(gamma) BINDING SITE, designated SEQ ID:1623, to the nucleotide sequence of GAM7809 RNA, herein designated GAM RNA, also designated SEQ ID:398.

Another function of GAM7809 is therefore inhibition of STAF65(gamma) (Accession NP_055675.1). Accordingly, utilities of GAM7809 include diagnosis, prevention and treatment of diseases and clinical conditions associated with STAF65(gamma).

Start domain containing 4, sterol regulated (STARD4, Accession NP_631903.1) is another GAM7809 target gene, herein designated TARGET GENE. STARD4 BINDING SITE is a target binding site found in the 3' untranslated region of mRNA encoded by STARD4, corresponding to a target binding site such as BINDING SITE I, BINDING SITE II or BINDING SITE III of FIG. 8. Table 4 illustrates the complementarity of the nucleotide sequences of STARD4 BINDING SITE, designated SEQ ID:7431, to the nucleotide sequence of GAM7809 RNA, herein designated GAM RNA, also designated SEQ ID:398.

Another function of GAM7809 is therefore inhibition of Start domain containing 4, sterol regulated (STARD4, Accession NP_631903.1). Accordingly, utilities of GAM7809 include diagnosis, prevention and treatment of diseases and clinical conditions associated with STARD4.

Taf1-like rna polymerase ii, tata box binding protein (tbp)-associated factor, 210 kda (TAF1L, Accession NP_722516.1) is another GAM7809 target gene, herein designated TARGET GENE. TAF1L BINDING SITE is a target binding site found in the 3' untranslated region of mRNA encoded by TAF1L, corresponding to a target binding site such as BINDING SITE I, BINDING SITE II or BINDING SITE III of FIG. 8. Table 4 illustrates the complementarity of the nucleotide sequences of TAF1L BINDING SITE, designated SEQ ID:10086, to the nucleotide sequence of GAM7809 RNA, herein designated GAM RNA, also designated SEQ ID:398.

Another function of GAM7809 is therefore inhibition of Taf1-like rna polymerase ii, tata box binding protein (tbp)-associated factor, 210 kda (TAF1L, Accession NP_722516.1). Accordingly, utilities of GAM7809 include diagnosis, prevention and treatment of diseases and clinical conditions associated with TAF1L.

Transforming growth factor, beta-induced, 68 kda (TGFBI, Accession NP_000349.1) is another GAM7809 target gene, herein designated TARGET GENE. TGFBI BINDING SITE is a target binding site found in the 3' untranslated region of mRNA encoded by TGFBI, corresponding to a target binding site such as BINDING SITE I, BINDING SITE II or BINDING SITE III of FIG. 8. Table 4 illustrates the complementarity of the nucleotide sequences of TGFBI BINDING SITE, designated SEQ ID:14063, to the nucleotide sequence of GAM7809 RNA, herein designated GAM RNA, also designated SEQ ID:398.

Another function of GAM7809 is therefore inhibition of Transforming growth factor, beta-induced, 68 kda (TGFBI, Accession NP_000349.1). Accordingly, utilities of GAM7809 include diagnosis, prevention and treatment of diseases and clinical conditions associated with TGFBI.

Ttk protein kinase (TTK, Accession NP_003309.2) is another GAM7809 target gene, herein designated TARGET GENE. TTK BINDING SITE is a target binding site found in the 3' untranslated region of mRNA encoded by TTK, corresponding to a target binding site such as BINDING SITE I, BINDING SITE II or BINDING SITE III of FIG. 8. Table 4 illustrates the complementarity of the nucleotide sequences of TTK BINDING SITE, designated SEQ ID:10374, to the nucleotide sequence of GAM7809 RNA, herein designated GAM RNA, also designated SEQ ID:398.

Another function of GAM7809 is therefore inhibition of Ttk protein kinase (TTK, Accession NP_003309.2), a gene which phosphorylates proteins on serine, threonine, and tyrosine; and is probably associated with cell proliferation. Accordingly, utilities of GAM7809 include diagnosis, prevention and treatment of diseases and clinical conditions associated with TTK.

The function of TTK has been established by previous studies. Using Xenopus egg extracts, Abrieu et al. (2001) isolated a homolog of yeast Mps1 and showed that it is a kinetochore-associated kinase whose activity is necessary to establish and maintain the mitotic checkpoint. Since high levels of Mad2 (OMIM Ref. No. 601467) overcame checkpoint loss in Mps1-depleted extracts, Mps1 acts upstream of Mad2-mediated inhibition of the anaphase-promoting complex/cyclosome (APC/C). The authors stated that Mps1 is essential for the checkpoint because it is required for recruitment and retention of active CENPE (OMIM Ref. No. 117143) at kinetochores, which in turn is necessary for kinetochore association of Mad1 (OMIM Ref. No. 602686) and Mad2. Fisk and Winey (2001) demonstrated that the mouse Mps1 ortholog, Esk, regulates centrosome duplication. Endogenous Esk and overexpressed GFP-Esk localized to centrosomes and kinetochores in mouse cells. Overexpression of GFP-Esk caused reduplication of centrosomes during S-phase arrest. In contrast, a kinase-deficient mutant blocked centrosome duplication altogether. The authors found that control of centrosome duplication by Esk requires Cdk2 (OMIM Ref. No. 116953). Inhibition of Cdk2 prevented centrosome reduplication and destabilized Esk, causing its subsequent loss from centrosomes, suggesting that Cdk2 promotes the centrosome duplication function of Esk by regulating its stability during S phase. Thus, Esk, an in vitro Cdk2 substrate, regulates centrosome duplication jointly with Cdk2.

Full details of the abovementioned studies are described in the following publications, the disclosure of which are hereby incorporated by reference:

Abrieu, A.; Magnaghi-Jaulin, L.; Kahana, J. A.; Peter, M.; Castro, A.; Vigneron, S.; Lorca, T.; Cleveland, D. W.; Labbe, J.-C.: Mps1 is a kinetochore- associated kinase essential for the vertebrate mitotic checkpoint. Cell 106:83-93, 2001; and Fisk, H. A.; Winey, M.: The mouse Mps1p-like kinase regulates centrosome duplication. Cell 106:95-104, 2001.

Further studies establishing the function and utilities of TTK are found in John Hopkins OMIM database record ID 604092, and in cited publications listed in Table 5, which are hereby incorporated by reference. Udp-n-acteylglucosamine pyrophosphorylase 1 (UAP1, Accession NP_003106.2) is another GAM7809 target gene, herein designated TARGET GENE. UAP1 BINDING SITE is a target binding site found in the 3' untranslated region of mRNA encoded by UAP1, corresponding to a target binding site such as BINDING SITE I, BINDING SITE II or BINDING SITE III of FIG. 8. Table 4 illustrates the complementarity of the nucleotide sequences of UAP1 BINDING SITE, designated SEQ ID:14376, to the nucleotide sequence of GAM7809 RNA, herein designated GAM RNA, also designated SEQ ID:398.

Another function of GAM7809 is therefore inhibition of Udp-n-acteylglucosamine pyrophosphorylase 1 (UAP1, Accession NP_003106.2). Accordingly, utilities of GAM7809 include diagnosis, prevention and treatment of diseases and clinical conditions associated with UAP1.

Williams beuren syndrome chromosome region 21 (WBSCR21, Accession NP_683713.1) is another GAM7809 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:9104, to the nucleotide sequence of GAM7809 RNA, herein designated GAM RNA, also designated SEQ ID:398.

Another function of GAM7809 is therefore inhibition of Williams beuren syndrome chromosome region 21 (WBSCR21, Accession NP_683713.1). Accordingly, utilities of GAM7809 include diagnosis, prevention and treatment of diseases and clinical conditions associated with WBSCR21.

Williams beuren syndrome chromosome region 21 (WBSCR21, Accession NP_112585.2) is another GAM7809 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:9104, to the nucleotide sequence of GAM7809 RNA, herein designated GAM RNA, also designated SEQ ID:398.

Another function of GAM7809 is therefore inhibition of Williams beuren syndrome chromosome region 21 (WBSCR21, Accession NP_112585.2). Accordingly, utilities of GAM7809 include diagnosis, prevention and treatment of diseases and clinical conditions associated with WBSCR21.

WFDC13 (Accession NP_742002.1) is another GAM7809 target gene, herein designated TARGET GENE. WFDC13 BINDING SITE is a target binding site found in the 3' untranslated region of mRNA encoded by WFDC13, corresponding to a target binding site such as BINDING SITE I, BINDING SITE II or BINDING SITE III of FIG. 8. Table 4 illustrates the complementarity of the nucleotide sequences of WFDC13 BINDING SITE, designated SEQ ID:17697, to the nucleotide sequence of GAM7809 RNA, herein designated GAM RNA, also designated SEQ ID:398.

Another function of GAM7809 is therefore inhibition of WFDC13 (Accession NP_742002.1). Accordingly, utilities of GAM7809 include diagnosis, prevention and treatment of diseases and clinical conditions associated with WFDC13.

ZBTB1 (Accession NP_055765.1) is another GAM7809 target gene, herein designated TARGET GENE. ZBTB1 BINDING SITE is a target binding site found in the 3' untranslated region of mRNA encoded by ZBTB1, corresponding to a target binding site such as BINDING SITE I, BINDING SITE II or BINDING SITE III of FIG. 8. Table 4 illustrates the complementarity of the nucleotide sequences of ZBTB1 BINDING SITE, designated SEQ ID:19264, to the nucleotide sequence of GAM7809 RNA, herein designated GAM RNA, also designated SEQ ID:398.

Another function of GAM7809 is therefore inhibition of ZBTB1 (Accession NP_055765.1). Accordingly, utilities of GAM7809 include diagnosis, prevention and treatment of diseases and clinical conditions associated with ZBTB1.

Zinc finger protein 228 (ZNF228, Accession NP_037512.1) is another GAM7809 target gene, herein designated TARGET GENE. ZNF228 BINDING SITE is a target binding site found in the 3' untranslated region of mRNA encoded by ZNF228, corresponding to a target binding site such as BINDING SITE I, BINDING SITE II or BINDING SITE III of FIG. 8. Table 4 illustrates the complementarity of the nucleotide sequences of ZNF228 BINDING SITE, designated SEQ ID:14011, to the nucleotide sequence of GAM7809 RNA, herein designated GAM RNA, also designated SEQ ID:398.

Another function of GAM7809 is therefore inhibition of Zinc finger protein 228 (ZNF228, Accession NP_037512.1). Accordingly, utilities of GAM7809 include diagnosis, prevention and treatment of diseases and clinical conditions associated with ZNF228.

FIG. 8 further provides a conceptual description of a novel bioinformatically detected of the present invention, referred to here as Genomic Address Messenger 7933 (GAM7933), which modulates expression of respective target genes thereof, the function and utility of which target genes is known in the art.

GAM7933 is a novel bioinformatically detected regulatory, non protein coding, micro RNA (miRNA) gene. The method by which GAM7933 was detected is described hereinabove with reference to FIGS. 8-15.

GAM7933 gene, herein designated GAM GENE, and GAM7933 target gene, herein designated TARGET GENE, are human genes contained in the human genome.

GAM7933 gene encodes a GAM7933 precursor RNA, herein designated GAM PRECURSOR RNA. Similar to other miRNA genes, and unlike most ordinary genes, GAM7933 precursor RNA does not encode a protein. A nucleotide sequence identical or highly similar to the nucleotide sequence of GAM7933 precursor RNA is designated SEQ ID:145, and is provided hereinbelow with reference to the sequence listing part. Nucleotide sequence SEQ ID:145 is located at position 3260217 relative to chromosome 7.

GAM7933 precursor RNA folds onto itself, forming GAM7933 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM7933 precursor RNA folds onto itself, forming GAM7933 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM7933 precursor RNA, designated SEQ-ID:145, and a schematic representation of a predicted secondary folding of GAM7933 folded precursor RNA are further described with reference to Table 2, hereby incorporated by reference.

An enzyme complex designated DICER COMPLEX, 'dices' the GAM7933 folded precursor RNA into GAM7933 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: A) nucleotide sequence of GAM7933 RNA is designated SEQ ID:203, and is provided hereinbelow with references to the sequence listing part and Table 3, hereby incorporated by reference.

GAM7933 target gene, herein designated TARGET GENE, encodes a corresponding messenger RNA, GAM7933 target RNA, herein designated GAM TARGET RNA. GAM7933 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM7933 RNA, herein designated GAM RNA, binds complementarily to one or more target binding sites located in untranslated regions of GAM7933 target RNA, herein designated GAM TARGET RNA. This complementary binding is due to the fact that the nucleotide sequence of GAM7933 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM7933 RNA may have a different number of target binding sites in untranslated regions of a GAM7933 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM7933 RNA, herein designated GAM RNA, to target binding sites on GAM7933 target RNA, herein designated GAM TARGET RNA, such as BINDING SITE I, BINDING SITE II and BINDING SITE III, inhibits translation of GAM7933 target RNA into GAM7933 target protein, herein designated GAM TARGET PROTEIN. GAM target protein is therefore outlined by a broken line.

It is appreciated that GAM7933 target gene, herein designated TARGET GENE, in fact represents a plurality of GAM7933 target genes. The mRNA of each one of this plurality of GAM7933 target genes comprises one or more target binding sites, each having a nucleotide sequence which is at least partly complementary to GAM7933 RNA, herein designated GAM RNA, and which when bound by GAM7933 RNA causes inhibition of translation of respective one or more GAM7933 target proteins.

It is further appreciated by one skilled in the art that the mode of translational inhibition illustrated by FIG. 8 with specific reference to translational inhibition exerted by GAM7933 gene, herein designated GAM GENE, on one or more GAM7933 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM7933 correlate with, and may be deduced from, the identity of the target genes which GAM7933 binds and inhibits, and the function of these target genes, as elaborated hereinbelow.

A disintegrin and metalloproteinase domain 10 (ADAM10, Accession NP_001101.1) is a GAM7933 target gene, herein designated TARGET GENE. ADAM10 BINDING SITE is a target binding site found in the 5' untranslated region of mRNA encoded by ADAM10, corresponding to a target binding site such as BINDING SITE I, BINDING SITE II or BINDING SITE III of FIG. 8. Table 4 illustrates the complementarity of the nucleotide sequences of ADAM10 BINDING SITE, designated SEQ ID:17173, to the nucleotide sequence of GAM7933 RNA, herein designated GAM RNA, also designated SEQ ID:203.

A function of GAM7933 is therefore inhibition of A disintegrin and metalloproteinase domain 10 (ADAM10, Accession NP_001101.1), a gene which Member of ADAM family of zinc metalloproteases. Accordingly, utilities of GAM7933 include diagnosis, prevention and treatment of diseases and clinical conditions associated with ADAM10.

The function of ADAM10 and its association with various diseases and clinical conditions, has been established by previous studies, as described hereinabove with reference to GAM47.1. A disintegrin-like and metalloprotease (reprolysin type) with thrombospondin type 1 motif, 13 (ADAMTS13, Accession NP_620597.1) is another GAM7933 target gene, herein designated TARGET GENE. ADAMTS13 BINDING SITE is a target binding site found in the 3' untranslated region of multiple transcripts of mRNA encoded by ADAMTS13, corresponding to a target binding site such as BINDING SITE I, BINDING SITE II or BINDING SITE III of FIG. 8. Table 4 illustrates the complementarity of the nucleotide sequences of ADAMTS13 BINDING SITE, designated SEQ ID:11726, to the nucleotide sequence of GAM7933 RNA, herein designated GAM RNA, also designated SEQ ID:203.

Another function of GAM7933 is therefore inhibition of A disintegrin-like and metalloprotease (reprolysin type) with thrombospondin type 1 motif, 13 (ADAMTS13, Accession NP_620597.1), a gene which cleaves aggrecan, a cartilage proteoglycan, and may be involved in its turnover. Accordingly, utilities of GAM7933 include diagnosis, prevention and treatment of diseases and clinical conditions associated with ADAMTS13.

The function of ADAMTS13 and its association with various diseases and clinical conditions, has been established by previous studies, as described hereinabove with reference to GAM71.1. Rho guanine nucleotide exchange factor (gef) 12 (ARHGEF12, Accession NP_056128.1) is another GAM7933 target gene, herein designated TARGET GENE. ARHGEF12 BINDING SITE is a target binding site found in the 3' untranslated region of mRNA encoded by ARHGEF12, corresponding to a target binding site such as BINDING SITE I, BINDING SITE II or BINDING SITE III of FIG. 8. Table 4 illustrates the complementarity of the nucleotide sequences of ARHGEF12 BINDING SITE, designated SEQ ID:19923, to the nucleotide sequence of GAM7933 RNA, herein designated GAM RNA, also designated SEQ ID:203.

Another function of GAM7933 is therefore inhibition of Rho guanine nucleotide exchange factor (gef) 12 (ARHGEF12, Accession NP_056128.1). Accordingly, utilities of GAM7933 include diagnosis, prevention and treatment of diseases and clinical conditions associated with ARHGEF12.

Bromodomain containing 2 (BRD2, Accession NP_005095.1) is another GAM7933 target gene, herein designated TARGET GENE. BRD2 BINDING SITE is a target binding site found in the 5' untranslated region of mRNA encoded by BRD2, corresponding to a target binding site such as BINDING SITE I, BINDING SITE II or BINDING SITE III of FIG. 8. Table 4 illustrates the complementarity of the nucleotide sequences of BRD2 BINDING SITE, designated SEQ ID:14556, to the nucleotide sequence of GAM7933 RNA, herein designated GAM RNA, also designated SEQ ID:203.

Another function of GAM7933 is therefore inhibition of Bromodomain containing 2 (BRD2, Accession NP_005095.1). Accordingly, utilities of GAM7933 include diagnosis, prevention and treatment of diseases and clinical conditions associated with BRD2.

Chromosome 1 open reading frame 21 (C1orf21, Accession NP_110433.1) is another GAM7933 target gene, herein designated TARGET GENE. C1orf21 BINDING SITE is a target binding site found in the 3' untranslated region of mRNA encoded by C1orf21, corresponding to a target binding site such as BINDING SITE I, BINDING SITE II or BINDING SITE III of FIG. 8. Table 4 illustrates the complementarity of the nucleotide sequences of C1orf21 BINDING SITE, designated SEQ ID:12125, to the nucleotide sequence of GAM7933 RNA, herein designated GAM RNA, also designated SEQ ID:203.

Another function of GAM7933 is therefore inhibition of Chromosome 1 open reading frame 21 (C1orf21, Accession NP_110433.1). Accordingly, utilities of GAM7933 include diagnosis, prevention and treatment of diseases and clinical conditions associated with C1orf21.

Chemokine (c-c motif) ligand 28 (CCL28, Accession NP_062820.1) is another GAM7933 target gene, herein designated TARGET GENE. CCL28 BINDING SITE is a target binding site found in the 3' untranslated region of multiple transcripts of mRNA encoded by CCL28, corresponding to a target binding site such as BINDING SITE I, BINDING SITE II or BINDING SITE III of FIG. 8. Table 4 illustrates the complementarity of the nucleotide sequences of CCL28 BINDING SITE, designated SEQ ID:10807, to the nucleotide sequence of GAM7933 RNA, herein designated GAM RNA, also designated SEQ ID:203.

Another function of GAM7933 is therefore inhibition of Chemokine (c-c motif) ligand 28 (CCL28, Accession NP_062820.1). Accordingly, utilities of GAM7933 include diagnosis, prevention and treatment of diseases and clinical conditions associated with CCL28.

Centaurin, delta 1 (CENTD1, Accession NP_631921.1) is another GAM7933 target gene, herein designated TARGET GENE. CENTD1 BINDING SITE is a target binding site found in the 5' untranslated region of multiple transcripts of mRNA encoded by CENTD1, corresponding to a target binding site such as BINDING SITE I, BINDING SITE II or BINDING SITE III of FIG. 8. Table 4 illustrates the complementarity of the nucleotide sequences of CENTD1 BINDING SITE, designated SEQ ID:9614, to the nucleotide sequence of GAM7933 RNA, herein designated GAM RNA, also designated SEQ ID:203.

Another function of GAM7933 is therefore inhibition of Centaurin, delta 1 (CENTD1, Accession NP_631921.1), a gene which is nvolved in cell signaling/communication. Accordingly, utilities of GAM7933 include diagnosis, prevention and treatment of diseases and clinical conditions associated with CENTD1.

The function of CENTD1 and its association with various diseases and clinical conditions, has been established by previous studies, as described hereinabove with reference to GAM116.1. Crebbp/ep300 inhibitory protein 1 (CRI1, Accession NP_055150.1) is another GAM7933 target gene, herein designated TARGET GENE. CRI1 BINDING SITE is a target binding site found in the 3' untranslated region of mRNA encoded by CRI1, corresponding to a target binding site such as BINDING SITE I, BINDING SITE II or BINDING SITE III of FIG. 8. Table 4 illustrates the complementarity of the nucleotide sequences of CRI1 BINDING SITE, designated SEQ ID:16632, to the nucleotide sequence of GAM7933 RNA, herein designated GAM RNA, also designated SEQ ID:203.

Another function of GAM7933 is therefore inhibition of Crebbp/ep300 inhibitory protein 1 (CRI1, Accession NP_055150.1), a gene which regulates cell cycle as well as tissue-specific transcription and differentiation. Accordingly, utilities of GAM7933 include diagnosis, prevention and treatment of diseases and clinical conditions associated with CRI1.

The function of CRI1 and its association with various diseases and clinical conditions, has been established by previous studies, as described hereinabove with reference to GAM229.1. DKFZp547J144 (Accession XP_091486.2) is another GAM7933 target gene, herein designated TARGET GENE. DKFZp547J144 BINDING SITE is a target binding site found in the 3' untranslated region of mRNA encoded by DKFZp547J144, corresponding to a target binding site such as BINDING SITE I, BINDING SITE II or BINDING SITE III of FIG. 8. Table 4 illustrates the complementarity of the nucleotide sequences of DKFZp547J144 BINDING SITE, designated SEQ ID:4932, to the nucleotide sequence of GAM7933 RNA, herein designated GAM RNA, also designated SEQ ID:203.

Another function of GAM7933 is therefore inhibition of DKFZp547J144 (Accession XP_091486.2). Accordingly, utilities of GAM7933 include diagnosis, prevention and treatment of diseases and clinical conditions associated with DKFZp547J144.

DKFZP761M1511 (Accession XP_295135.1) is another GAM7933 target gene, herein designated TARGET GENE. DKFZP761M1511 BINDING SITE is a target binding site found in the 3' untranslated region of mRNA encoded by DKFZP761M1511, corresponding to a target binding site such as BINDING SITE I, BINDING SITE II or BINDING SITE III of FIG. 8. Table 4 illustrates the complementarity of the nucleotide sequences of DKFZP761M1511 BINDING SITE, designated SEQ ID:16574, to the nucleotide sequence of GAM7933 RNA, herein designated GAM RNA, also designated SEQ ID:203.

Another function of GAM7933 is therefore inhibition of DKFZP761M1511 (Accession XP_295135.1). Accordingly, utilities of GAM7933 include diagnosis, prevention and treatment of diseases and clinical conditions associated with DKFZP761M1511.

DKFZp762K222 (Accession XP_048721.1) is another GAM7933 target gene, herein designated TARGET GENE. DKFZp762K222 BINDING SITE is a target binding site found in the 3' untranslated region of mRNA encoded by DKFZp762K222, corresponding to a target binding site such as BINDING SITE I, BINDING SITE II or BINDING SITE III of FIG. 8. Table 4 illustrates the complementarity of the nucleotide sequences of DKFZp762K222 BINDING SITE, designated SEQ ID:17576, to the nucleotide sequence of GAM7933 RNA, herein designated GAM RNA, also designated SEQ ID:203.

Another function of GAM7933 is therefore inhibition of DKFZp762K222 (Accession XP_048721.1). Accordingly, utilities of GAM7933 include diagnosis, prevention and treatment of diseases and clinical conditions associated with DKFZp762K222.

Cyclin d binding myb-like transcription factor 1 (DMTF1, Accession NP_066968.1) is another GAM7933 target gene, herein designated TARGET GENE. DMTF1 BINDING SITE is a target binding site found in the 3' untranslated region of mRNA encoded by DMTF1, corresponding to a target binding site such as BINDING SITE I, BINDING SITE II or BINDING SITE III of FIG. 8. Table 4 illustrates the complementarity of the nucleotide sequences of DMTF1 BINDING SITE, designated SEQ ID:15923, to the nucleotide sequence of GAM7933 RNA, herein designated GAM RNA, also designated SEQ ID:203.

Another function of GAM7933 is therefore inhibition of Cyclin d binding myb-like transcription factor 1 (DMTF1, Accession NP_066968.1). Accordingly, utilities of GAM7933 include diagnosis, prevention and treatment of diseases and clinical conditions associated with DMTF1.

Egf-like-domain, multiple 5 (EGFL5, Accession XP_098838.1) is another GAM7933 target gene, herein designated TARGET GENE. EGFL5 BINDING SITE is a target binding site found in the 5' untranslated region of mRNA encoded by EGFL5, corresponding to a target binding site such as BINDING SITE I, BINDING SITE II or BINDING SITE III of FIG. 8. Table 4 illustrates the complementarity of the nucleotide sequences of EGFL5 BINDING SITE, designated SEQ ID:10302, to the nucleotide sequence of GAM7933 RNA, herein designated GAM RNA, also designated SEQ ID:203.

Another function of GAM7933 is therefore inhibition of Egf-like-domain, multiple 5 (EGFL5, Accession XP_098838.1). Accordingly, utilities of GAM7933 include diagnosis, prevention and treatment of diseases and clinical conditions associated with EGFL5.

Enamelin (ENAM, Accession NP_114095.1) is another GAM7933 target gene, herein designated TARGET GENE. ENAM BINDING SITE is a target binding site found in the 3' untranslated region of mRNA encoded by ENAM, corresponding to a target binding site such as BINDING SITE I, BINDING SITE II or BINDING SITE III of FIG. 8. Table 4 illustrates the complementarity of the nucleotide sequences of ENAM BINDING SITE, designated SEQ ID:16108, to the nucleotide sequence of GAM7933 RNA, herein designated GAM RNA, also designated SEQ ID:203.

Another function of GAM7933 is therefore inhibition of Enamelin (ENAM, Accession NP_114095.1). Accordingly, utilities of GAM7933 include diagnosis, prevention and treatment of diseases and clinical conditions associated with ENAM.

Erythrocyte membrane protein band 4.1 like 4b (EPB41L4B, Accession NP_060894.1) is another GAM7933 target gene, herein designated TARGET GENE. EPB41L4B BINDING SITE is a target binding site found in the 3' untranslated region of multiple transcripts of mRNA encoded by EPB41L4B, corresponding to a target binding site such as BINDING SITE I, BINDING SITE II or BINDING SITE III of FIG. 8. Table 4 illustrates the complementarity of the nucleotide sequences of EPB41L4B BINDING SITE, designated SEQ ID:4101, to the nucleotide sequence of GAM7933 RNA, herein designated GAM RNA, also designated SEQ ID:203.

Another function of GAM7933 is therefore inhibition of Erythrocyte membrane protein band 4.1 like 4b (EPB41L4B, Accession NP_060894.1). Accordingly, utilities of GAM7933 include diagnosis, prevention and treatment of diseases and clinical conditions associated with EPB41L4B.

Enhancer of zeste homolog 1 (drosophila) (EZH1, Accession NP_001982.2) is another GAM7933 target gene, herein designated TARGET GENE. EZH1 BINDING SITE is a target binding site found in the 3' untranslated region of mRNA encoded by EZH1, corresponding to a target binding site such as BINDING SITE I, BINDING SITE II or BINDING SITE III of FIG. 8. Table 4 illustrates the complementarity of the nucleotide sequences of EZH1 BINDING SITE, designated SEQ ID:4202, to the nucleotide sequence of GAM7933 RNA, herein designated GAM RNA, also designated SEQ ID:203.

Another function of GAM7933 is therefore inhibition of Enhancer of zeste homolog 1 (drosophila) (EZH1, Accession NP_001982.2), a gene which may act in transcriptional regulation and heterochromatin maintenance. Accordingly, utilities of GAM7933 include diagnosis, prevention and treatment of diseases and clinical conditions associated with EZH1.

The function of EZH1 and its association with various diseases and clinical conditions, has been established by previous studies, as described hereinabove with reference to GAM189.1. Fatty-acid-coenzyme a ligase, long-chain 4 (FACL4, Accession NP_075266.1) is another GAM7933 target gene, herein designated TARGET GENE. FACL4 BINDING SITE is a target binding site found in the 3' untranslated region of multiple transcripts of mRNA encoded by FACL4, corresponding to a target binding site such as BINDING SITE I, BINDING SITE II or BINDING SITE III of FIG. 8. Table 4 illustrates the complementarity of the nucleotide sequences of FACL4 BINDING SITE, designated SEQ ID:7615, to the nucleotide sequence of GAM7933 RNA, herein designated GAM RNA, also designated SEQ ID:203.

Another function of GAM7933 is therefore inhibition of Fatty-acid-coenzyme a ligase, long-chain 4 (FACL4, Accession NP_075266.1) . Accordingly, utilities of GAM7933 include diagnosis, prevention and treatment of diseases and clinical conditions associated with FACL4.

Fatty-acid-coenzyme a ligase, long-chain 4 (FACL4, Accession NP_004449.1) is another GAM7933 target gene, herein designated TARGET GENE. FACL4 BINDING SITE is a target binding site found in the 3' untranslated region of multiple transcripts of mRNA encoded by FACL4, corresponding to a target binding site such as BINDING SITE I, BINDING SITE II or BINDING SITE III of FIG. 8. Table 4 illustrates the complementarity of the nucleotide sequences of FACL4 BINDING SITE, designated SEQ ID:7615, to the nucleotide sequence of GAM7933 RNA, herein designated GAM RNA, also designated SEQ ID:203.

Another function of GAM7933 is therefore inhibition of Fatty-acid-coenzyme a ligase, long-chain 4 (FACL4, Accession NP_004449.1). Accordingly, utilities of GAM7933 include diagnosis, prevention and treatment of diseases and clinical conditions associated with FACL4.

Fibroblast growth factor 2 (basic) (FGF2, Accession NP_001997.3) is another GAM7933 target gene, herein designated TARGET GENE. FGF2 BINDING SITE is a target binding site found in the 3' untranslated region of mRNA encoded by FGF2, corresponding to a target binding site such as BINDING SITE I, BINDING SITE II or BINDING SITE III of FIG. 8. Table 4 illustrates the complementarity of the nucleotide sequences of FGF2 BINDING SITE, designated SEQ ID:1793, to the nucleotide sequence of GAM7933 RNA, herein designated GAM RNA, also designated SEQ ID:203.

Another function of GAM7933 is therefore inhibition of Fibroblast growth factor 2 (basic) (FGF2, Accession NP_001997.3), a gene which the Basic fibroblast growth factor 2; is mitogenic, angiogenic, and neurotrophic factor. Accordingly, utilities of GAM7933 include diagnosis, prevention and treatment of diseases and clinical conditions associated with FGF2.

The function of FGF2 and its association with various diseases and clinical conditions, has been established by previous studies, as described hereinabove with reference to GAM36.1. FLJ10520 (Accession NP_060594.2) is another GAM7933 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:17571, to the nucleotide sequence of GAM7933 RNA, herein designated GAM RNA, also designated SEQ ID:203.

Another function of GAM7933 is therefore inhibition of FLJ10520 (Accession NP_060594.2). Accordingly, utilities of GAM7933 include diagnosis, prevention and treatment of diseases and clinical conditions associated with FLJ10520.

FLJ10702 (Accession NP_060654.1) is another GAM7933 target gene, herein designated TARGET GENE. FLJ10702 BINDING SITE is a target binding site found in the 3' untranslated region of mRNA encoded by FLJ10702, corresponding to a target binding site such as BINDING SITE I, BINDING SITE II or BINDING SITE III of FIG. 8. Table 4 illustrates the complementarity of the nucleotide sequences of FLJ10702 BINDING SITE, designated SEQ ID:17057, to the nucleotide sequence of GAM7933 RNA, herein designated GAM RNA, also designated SEQ ID:203.

Another function of GAM7933 is therefore inhibition of FLJ10702 (Accession NP_060654.1). Accordingly, utilities of GAM7933 include diagnosis, prevention and treatment of diseases and clinical conditions associated with FLJ10702.

FLJ10874 (Accession NP_060722.1) is another GAM7933 target gene, herein designated TARGET GENE. FLJ10874 BINDING SITE is a target binding site found in the 3' untranslated region of mRNA encoded by FLJ10874, corresponding to a target binding site such as BINDING SITE I, BINDING SITE II or BINDING SITE III of FIG. 8. Table 4 illustrates the complementarity of the nucleotide sequences of FLJ10874 BINDING SITE, designated SEQ ID:5958, to the nucleotide sequence of GAM7933 RNA, herein designated GAM RNA, also designated SEQ ID:203.

Another function of GAM7933 is therefore inhibition of FLJ10874 (Accession NP_060722.1). Accordingly, utilities of GAM7933 include diagnosis, prevention and treatment of diseases and clinical conditions associated with FLJ10874.

FLJ10891 (Accession NP_060730.1) is another GAM7933 target gene, herein designated TARGET GENE. FLJ10891 BINDING SITE is a target binding site found in the 3' untranslated region of mRNA encoded by FLJ10891, corresponding to a target binding site such as BINDING SITE I, BINDING SITE II or BINDING SITE III of FIG. 8. Table 4 illustrates the complementarity of the nucleotide sequences of FLJ10891 BINDING SITE, designated SEQ ID:8768, to the nucleotide sequence of GAM7933 RNA, herein designated GAM RNA, also designated SEQ ID:203.

Another function of GAM7933 is therefore inhibition of FLJ10891 (Accession NP_060730.1). Accordingly, utilities of GAM7933 include diagnosis, prevention and treatment of diseases and clinical conditions associated with FLJ10891.

FLJ12747 (Accession XP_290972.1) is another GAM7933 target gene, herein designated TARGET GENE. FLJ12747 BINDING SITE is a target binding site found in the 3' untranslated region of mRNA encoded by FLJ12747, corresponding to a target binding site such as BINDING SITE I, BINDING SITE II or BINDING SITE III of FIG. 8. Table 4 illustrates the complementarity of the nucleotide sequences of FLJ12747 BINDING SITE, designated SEQ ID:13605, to the nucleotide sequence of GAM7933 RNA, herein designated GAM RNA, also designated SEQ ID:203.

Another function of GAM7933 is therefore inhibition of FLJ12747 (Accession XP_290972.1). Accordingly, utilities of GAM7933 include diagnosis, prevention and treatment of diseases and clinical conditions associated with FLJ12747.

FLJ12888 (Accession NP_079221.1) is another GAM7933 target gene, herein designated TARGET GENE. FLJ12888 BINDING SITE is a target binding site found in the 5' untranslated region of mRNA encoded by FLJ12888, corresponding to a target binding site such as BINDING SITE I, BINDING SITE II or BINDING SITE III of FIG. 8. Table 4 illustrates the complementarity of the nucleotide sequences of FLJ12888 BINDING SITE, designated SEQ ID:3021, to the nucleotide sequence of GAM7933 RNA, herein designated GAM RNA, also designated SEQ ID:203.

Another function of GAM7933 is therefore inhibition of FLJ12888 (Accession NP_079221.1). Accordingly, utilities of GAM7933 include diagnosis, prevention and treatment of diseases and clinical conditions associated with FLJ12888.

FLJ13057 (Accession NP_848526.1) is another GAM7933 target gene, herein designated TARGET GENE. FLJ13057 BINDING SITE is a target binding site found in the 3' untranslated region of mRNA encoded by FLJ13057, corresponding to a target binding site such as BINDING SITE I, BINDING SITE II or BINDING SITE III of FIG. 8. Table 4 illustrates the complementarity of the nucleotide sequences of FLJ13057 BINDING SITE, designated SEQ ID:18278, to the nucleotide sequence of GAM7933 RNA, herein designated GAM RNA, also designated SEQ ID:203.

Another function of GAM7933 is therefore inhibition of FLJ13057 (Accession NP_848526.1). Accordingly, utilities of GAM7933 include diagnosis, prevention and treatment of diseases and clinical conditions associated with FLJ13057.

FLJ13204 (Accession NP_079037.2) is another GAM7933 target gene, herein designated TARGET GENE. FLJ13204 BINDING SITE is a target binding site found in the 3' untranslated region of mRNA encoded by FLJ13204, corresponding to a target binding site such as BINDING SITE I, BINDING SITE II or BINDING SITE III of FIG. 8. Table 4 illustrates the complementarity of the nucleotide sequences of FLJ13204 BINDING SITE, designated SEQ ID:2848, to the nucleotide sequence of GAM7933 RNA, herein designated GAM RNA, also designated SEQ ID:203.

Another function of GAM7933 is therefore inhibition of FLJ13204 (Accession NP_079037.2). Accordingly, utilities of GAM7933 include diagnosis, prevention and treatment of diseases and clinical conditions associated with FLJ13204.

FLJ14675 (Accession NP_116212.3) is another GAM7933 target gene, herein designated TARGET GENE. FLJ14675 BINDING SITE is a target binding site found in the 3' untranslated region of mRNA encoded by FLJ14675, corresponding to a target binding site such as BINDING SITE I, BINDING SITE II or BINDING SITE III of FIG. 8. Table 4 illustrates the complementarity of the nucleotide sequences of FLJ14675 BINDING SITE, designated SEQ ID:14019, to the nucleotide sequence of GAM7933 RNA, herein designated GAM RNA, also designated SEQ ID:203.

Another function of GAM7933 is therefore inhibition of FLJ14675 (Accession NP_116212.3). Accordingly, utilities of GAM7933 include diagnosis, prevention and treatment of diseases and clinical conditions associated with FLJ14675.

FLJ20274 (Accession NP_060206.1) is another GAM7933 target gene, herein designated TARGET GENE. FLJ20274 BINDING SITE is a target binding site found in the 3' untranslated region of mRNA encoded by FLJ20274, corresponding to a target binding site such as BINDING SITE I, BINDING SITE II or BINDING SITE III of FIG. 8. Table 4 illustrates the complementarity of the nucleotide sequences of FLJ20274 BINDING SITE, designated SEQ ID:19345, to the nucleotide sequence of GAM7933 RNA, herein designated GAM RNA, also designated SEQ ID:203.

Another function of GAM7933 is therefore inhibition of FLJ20274 (Accession NP_060206.1). Accordingly, utilities of GAM7933 include diagnosis, prevention and treatment of diseases and clinical conditions associated with FLJ20274.

FLJ23056 (Accession NP_078858.1) is another GAM7933 target gene, herein designated TARGET GENE. FLJ23056 BINDING SITE is a target binding site found in the 3' untranslated region of mRNA encoded by FLJ23056, corresponding to a target binding site such as BINDING SITE I, BINDING SITE II or BINDING SITE III of FIG. 8. Table 4 illustrates the complementarity of the nucleotide sequences of FLJ23056 BINDING SITE, designated SEQ ID:17879, to the nucleotide sequence of GAM7933 RNA, herein designated GAM RNA, also designated SEQ ID:203.

Another function of GAM7933 is therefore inhibition of FLJ23056 (Accession NP_078858.1). Accordingly, utilities of GAM7933 include diagnosis, prevention and treatment of diseases and clinical conditions associated with FLJ23056.

FLJ31978 (Accession NP_653270.1) is another GAM7933 target gene, herein designated TARGET GENE. FLJ31978 BINDING SITE is a target binding site found in the 3' untranslated region of mRNA encoded by FLJ31978, corresponding to a target binding site such as BINDING SITE I, BINDING SITE II or BINDING SITE III of FIG. 8. Table 4 illustrates the complementarity of the nucleotide sequences of FLJ31978 BINDING SITE, designated SEQ ID:1522, to the nucleotide sequence of GAM7933 RNA, herein designated GAM RNA, also designated SEQ ID:203.

Another function of GAM7933 is therefore inhibition of FLJ31978 (Accession NP_653270.1). Accordingly, utilities of GAM7933 include diagnosis, prevention and treatment of diseases and clinical conditions associated with FLJ31978.

FLJ32535 (Accession NP_689760.1) is another GAM7933 target gene, herein designated TARGET GENE. FLJ32535 BINDING SITE is a target binding site found in the 5' untranslated region of mRNA encoded by FLJ32535, corresponding to a target binding site such as BINDING SITE I, BINDING SITE II or BINDING SITE III of FIG. 8. Table 4 illustrates the complementarity of the nucleotide sequences of FLJ32535 BINDING SITE, designated SEQ ID:8740, to the nucleotide sequence of GAM7933 RNA, herein designated GAM RNA, also designated SEQ ID:203.

Another function of GAM7933 is therefore inhibition of FLJ32535 (Accession NP_689760.1). Accordingly, utilities of GAM7933 include diagnosis, prevention and treatment of diseases and clinical conditions associated with FLJ32535.

FLJ32685 (Accession NP_689747.1) is another GAM7933 target gene, herein designated TARGET GENE. FLJ32685 BINDING SITE is a target binding site found in the 3' untranslated region of mRNA encoded by FLJ32685, corresponding to a target binding site such as BINDING SITE I, BINDING SITE II or BINDING SITE III of FIG. 8. Table 4 illustrates the complementarity of the nucleotide sequences of FLJ32685 BINDING SITE, designated SEQ ID:14845, to the nucleotide sequence of GAM7933 RNA, herein designated GAM RNA, also designated SEQ ID:203.

Another function of GAM7933 is therefore inhibition of FLJ32685 (Accession NP_689747.1). Accordingly, utilities of GAM7933 include diagnosis, prevention and treatment of diseases and clinical conditions associated with FLJ32685.

FLJ39370 (Accession NP_689613.1) is another GAM7933 target gene, herein designated TARGET GENE. FLJ39370 BINDING SITE is a target binding site found in the 3' untranslated region of mRNA encoded by FLJ39370, corresponding to a target binding site such as BINDING SITE I, BINDING SITE II or BINDING SITE III of FIG. 8. Table 4 illustrates the complementarity of the nucleotide sequences of FLJ39370 BINDING SITE, designated SEQ ID:8161, to the nucleotide sequence of GAM7933 RNA, herein designated GAM RNA, also designated SEQ ID:203.

Another function of GAM7933 is therefore inhibition of FLJ39370 (Accession NP_689613.1). Accordingly, utilities of GAM7933 include diagnosis, prevention and treatment of diseases and clinical conditions associated with FLJ39370.

Gamma-aminobutyric acid (gaba) a receptor, pi (GABRP, Accession NP_055026.1) is another GAM7933 target gene, herein designated TARGET GENE. GABRP BINDING SITE is a target binding site found in the 3' untranslated region of mRNA encoded by GABRP, corresponding to a target binding site such as BINDING SITE I, BINDING SITE II or BINDING SITE III of FIG. 8. Table 4 illustrates the complementarity of the nucleotide sequences of GABRP BINDING SITE, designated SEQ ID:9698, to the nucleotide sequence of GAM7933 RNA, herein designated GAM RNA, also designated SEQ ID:203.

Another function of GAM7933 is therefore inhibition of Gamma-aminobutyric acid (gaba) a receptor, pi (GABRP, Accession NP_055026.1), a gene which mediates neuronal inhibition by binding to the gaba/benzodiazepine receptor and opening an integral chloride channel. Accordingly, utilities of GAM7933 include diagnosis, prevention and treatment of diseases and clinical conditions associated with GABRP.

The function of GABRP and its association with various diseases and clinical conditions, has been established by previous studies, as described hereinabove with reference to GAM295.1. Gdp dissociation inhibitor 2 (GDI2, Accession NP_001485.2) is another GAM7933 target gene, herein designated TARGET GENE. GDI2 BINDING SITE is a target binding site found in the 3' untranslated region of mRNA encoded by GDI2, corresponding to a target binding site such as BINDING SITE I, BINDING SITE II or BINDING SITE III of FIG. 8. Table 4 illustrates the complementarity of the nucleotide sequences of GDI2 BINDING SITE, designated SEQ ID:3115, to the nucleotide sequence of GAM7933 RNA, herein designated GAM RNA, also designated SEQ ID:203.

Another function of GAM7933 is therefore inhibition of Gdp dissociation inhibitor 2 (GDI2, Accession NP_001485.2), a gene which regulates the gdp/gtp exchange reaction of most rab proteins by inhibiting the dissociation of gdp from them, and the subsequent binding of gtp to them. Accordingly, utilities of GAM7933 include diagnosis, prevention and treatment of diseases and clinical conditions associated with GDI2.

The function of GDI2 and its association with various diseases and clinical conditions, has been established by previous studies, as described hereinabove with reference to GAM139.1. GPIG4 (Accession NP_689758.1) is another GAM7933 target gene, herein designated TARGET GENE. GPIG4 BINDING SITE is a target binding site found in the 3' untranslated region of mRNA encoded by GPIG4, corresponding to a target binding site such as BINDING SITE I, BINDING SITE II or BINDING SITE III of FIG. 8. Table 4 illustrates the complementarity of the nucleotide sequences of GPIG4 BINDING SITE, designated SEQ ID:1050, to the nucleotide sequence of GAM7933 RNA, herein designated GAM RNA, also designated SEQ ID:203.

Another function of GAM7933 is therefore inhibition of GPIG4 (Accession NP_689758.1). Accordingly, utilities of GAM7933 include diagnosis, prevention and treatment of diseases and clinical conditions associated with GPIG4.

Potassium large conductance calcium-activated channel, subfamily m, beta member 4 (KCNMB4, Accession NP_055320.4) is another GAM7933 target gene, herein designated TARGET GENE. KCNMB4 BINDING SITE is a target binding site found in the 3' untranslated region of mRNA encoded by KCNMB4, corresponding to a target binding site such as BINDING SITE I, BINDING SITE II or BINDING SITE III of FIG. 8. Table 4 illustrates the complementarity of the nucleotide sequences of KCNMB4 BINDING SITE, designated SEQ ID:7510, to the nucleotide sequence of GAM7933 RNA, herein designated GAM RNA, also designated SEQ ID:203.

Another function of GAM7933 is therefore inhibition of Potassium large conductance calcium-activated channel, subfamily m, beta member 4 (KCNMB4, Accession NP_055320.4), a gene which regulates gating kinetics of slow K channels in a Ca-sensitive manner. Accordingly, utilities of GAM7933 include diagnosis, prevention and treatment of diseases and clinical conditions associated with KCNMB4.

The function of KCNMB4 and its association with various diseases and clinical conditions, has been established by previous studies, as described hereinabove with reference to GAM144.1. KIAA0179 (Accession XP_035973.4) is another GAM7933 target gene, herein designated TARGET GENE. KIAA0179 BINDING SITE is a target binding site found in the 3' untranslated region of mRNA encoded by KIAA0179, corresponding to a target binding site such as BINDING SITE I, BINDING SITE II or BINDING SITE III of FIG. 8. Table 4 illustrates the complementarity of the nucleotide sequences of KIAA0179 BINDING SITE, designated SEQ ID:4948, to the nucleotide sequence of GAM7933 RNA, herein designated GAM RNA, also designated SEQ ID:203.

Another function of GAM7933 is therefore inhibition of KIAA0179 (Accession XP_035973.4). Accordingly, utilities of GAM7933 include diagnosis, prevention and treatment of diseases and clinical conditions associated with KIAA0179.

KIAA0218 (Accession NP_055575.1) is another GAM7933 target gene, herein designated TARGET GENE. KIAA0218 BINDING SITE is a target binding site found in the 3' untranslated region of mRNA encoded by KIAA0218, corresponding to a target binding site such as BINDING SITE I, BINDING SITE II or BINDING SITE III of FIG. 8. Table 4 illustrates the complementarity of the nucleotide sequences of KIAA0218 BINDING SITE, designated SEQ ID:8133, to the nucleotide sequence of GAM7933 RNA, herein designated GAM RNA, also designated SEQ ID:203.

Another function of GAM7933 is therefore inhibition of KIAA0218 (Accession NP_055575.1). Accordingly, utilities of GAM7933 include diagnosis, prevention and treatment of diseases and clinical conditions associated with KIAA0218.

KIAA0247 (Accession NP_055549.1) is another GAM7933 target gene, herein designated TARGET GENE. KIAA0247 BINDING SITE is a target binding site found in the 3' untranslated region of mRNA encoded by KIAA0247, corresponding to a target binding site such as BINDING SITE I, BINDING SITE II or BINDING SITE III of FIG. 8. Table 4 illustrates the complementarity of the nucleotide sequences of KIAA0247 BINDING SITE, designated SEQ ID:13278, to the nucleotide sequence of GAM7933 RNA, herein designated GAM RNA, also designated SEQ ID:203.

Another function of GAM7933 is therefore inhibition of KIAA0247 (Accession NP_055549.1). Accordingly, utilities of GAM7933 include diagnosis, prevention and treatment of diseases and clinical conditions associated with KIAA0247.

KIAA0645 (Accession NP_055477.1) is another GAM7933 target gene, herein designated TARGET GENE. KIAA0645 BINDING SITE is a target binding site found in the 3' untranslated region of mRNA encoded by KIAA0645, corresponding to a target binding site such as BINDING SITE I, BINDING SITE II or BINDING SITE III of FIG. 8. Table 4 illustrates the complementarity of the nucleotide sequences of KIAA0645 BINDING SITE, designated SEQ ID:3596, to the nucleotide sequence of GAM7933 RNA, herein designated GAM RNA, also designated SEQ ID:203.

Another function of GAM7933 is therefore inhibition of KIAA0645 (Accession NP_055477.1). Accordingly, utilities of GAM7933 include diagnosis, prevention and treatment of diseases and clinical conditions associated with KIAA0645.

KIAA1164 (Accession XP_045358.2) is another GAM7933 target gene, herein designated TARGET GENE. KIAA1164 BINDING SITE is a target binding site found in the 3' untranslated region of mRNA encoded by KIAA1164, corresponding to a target binding site such as BINDING SITE I, BINDING SITE II or BINDING SITE III of FIG. 8. Table 4 illustrates the complementarity of the nucleotide sequences of KIAA1164 BINDING SITE, designated SEQ ID:1382, to the nucleotide sequence of GAM7933 RNA, herein designated GAM RNA, also designated SEQ ID:203.

Another function of GAM7933 is therefore inhibition of KIAA1164 (Accession XP_045358.2). Accordingly, utilities of GAM7933 include diagnosis, prevention and treatment of diseases and clinical conditions associated with KIAA1164.

KIAA1305 (Accession NP_079357.1) is another GAM7933 target gene, herein designated TARGET GENE. KIAA1305 BINDING SITE is a target binding site found in the 3' untranslated region of mRNA encoded by KIAA1305, corresponding to a target binding site such as BINDING SITE I, BINDING SITE II or BINDING SITE III of FIG. 8. Table 4 illustrates the complementarity of the nucleotide sequences of KIAA1305 BINDING SITE, designated SEQ ID:19660, to the nucleotide sequence of GAM7933 RNA, herein designated GAM RNA, also designated SEQ ID:203.

Another function of GAM7933 is therefore inhibition of KIAA1305 (Accession NP_079357.1). Accordingly, utilities of GAM7933 include diagnosis, prevention and treatment of diseases and clinical conditions associated with KIAA1305.

KIAA1726 (Accession XP_040860.3) is another GAM7933 target gene, herein designated TARGET GENE. KIAA1726 BINDING SITE is a target binding site found in the 3' untranslated region of mRNA encoded by KIAA1726, corresponding to a target binding site such as BINDING SITE I, BINDING SITE II or BINDING SITE III of FIG. 8. Table 4 illustrates the complementarity of the nucleotide sequences of KIAA1726 BINDING SITE, designated SEQ ID:13195, to the nucleotide sequence of GAM7933 RNA, herein designated GAM RNA, also designated SEQ ID:203.

Another function of GAM7933 is therefore inhibition of KIAA1726 (Accession XP_040860.3). Accordingly, utilities of GAM7933 include diagnosis, prevention and treatment of diseases and clinical conditions associated with KIAA1726.

Kinesin-associated protein 3 (KIFAP3, Accession NP_055785.2) is another GAM7933 target gene, herein designated TARGET GENE. KIFAP3 BINDING SITE is a target binding site found in the 3' untranslated region of mRNA encoded by KIFAP3, corresponding to a target binding site such as BINDING SITE I, BINDING SITE II or BINDING SITE III of FIG. 8. Table 4 illustrates the complementarity of the nucleotide sequences of KIFAP3 BINDING SITE, designated SEQ ID:5824, to the nucleotide sequence of GAM7933 RNA, herein designated GAM RNA, also designated SEQ ID:203.

Another function of GAM7933 is therefore inhibition of Kinesin-associated protein 3 (KIFAP3, Accession NP_055785.2). Accordingly, utilities of GAM7933 include diagnosis, prevention and treatment of diseases and clinical conditions associated with KIFAP3.

LOC113612 (Accession XP_054492.1) is another GAM7933 target gene, herein designated TARGET GENE. LOC113612 BINDING SITE is a target binding site found in the 3' untranslated region of mRNA encoded by LOC113612, corresponding to a target binding site such as BINDING SITE I, BINDING SITE II or BINDING SITE III of FIG. 8. Table 4 illustrates the complementarity of the nucleotide sequences of LOC113612 BINDING SITE, designated SEQ ID:6871, to the nucleotide sequence of GAM7933 RNA, herein designated GAM RNA, also designated SEQ ID:203.

Another function of GAM7933 is therefore inhibition of LOC113612 (Accession XP_054492.1). Accordingly, utilities of GAM7933 include diagnosis, prevention and treatment of diseases and clinical conditions associated with LOC113612.

LOC145652 (Accession XP_096827.1) is another GAM7933 target gene, herein designated TARGET GENE. LOC145652 BINDING SITE is a target binding site found in the 5' untranslated region of mRNA encoded by LOC145652, corresponding to a target binding site such as BINDING SITE I, BINDING SITE II or BINDING SITE III of FIG. 8. Table 4 illustrates the complementarity of the nucleotide sequences of LOC145652 BINDING SITE, designated SEQ ID:12056, to the nucleotide sequence of GAM7933 RNA, herein designated GAM RNA, also designated SEQ ID:203.

Another function of GAM7933 is therefore inhibition of LOC145652 (Accession XP_096827.1). Accordingly, utilities of GAM7933 include diagnosis, prevention and treatment of diseases and clinical conditions associated with LOC145652.

LOC153222 (Accession NP_705835.1) is another GAM7933 target gene, herein designated TARGET GENE. LOC153222 BINDING SITE is a target binding site found in the 3' untranslated region of mRNA encoded by LOC153222, corresponding to a target binding site such as BINDING SITE I, BINDING SITE II or BINDING SITE III of FIG. 8. Table 4 illustrates the complementarity of the nucleotide sequences of LOC153222 BINDING SITE, designated SEQ ID:7489, to the nucleotide sequence of GAM7933 RNA, herein designated GAM RNA, also designated SEQ ID:203.

Another function of GAM7933 is therefore inhibition of LOC153222 (Accession NP_705835.1). Accordingly, utilities of GAM7933 include diagnosis, prevention and treatment of diseases and clinical conditions associated with LOC153222.

LOC153883 (Accession XP_087798.1) is another GAM7933 target gene, herein designated TARGET GENE. LOC153883 BINDING SITE is a target binding site found in the 5' untranslated region of mRNA encoded by LOC153883, corresponding to a target binding site such as BINDING SITE I, BINDING SITE II or BINDING SITE III of FIG. 8. Table 4 illustrates the complementarity of the nucleotide sequences of LOC153883 BINDING SITE, designated SEQ ID:18705, to the nucleotide sequence of GAM7933 RNA, herein designated GAM RNA, also designated SEQ ID:203.

Another function of GAM7933 is therefore inhibition of LOC153883 (Accession XP_087798.1). Accordingly, utilities of GAM7933 include diagnosis, prevention and treatment of diseases and clinical conditions associated with LOC153883.

LOC220926 (Accession XP_166128.1) is another GAM7933 target gene, herein designated TARGET GENE. LOC220926 BINDING SITE is a target binding site found in the 5' untranslated region of mRNA encoded by LOC220926, corresponding to a target binding site such as BINDING SITE I, BINDING SITE II or BINDING SITE III of FIG. 8. Table 4 illustrates the complementarity of the nucleotide sequences of LOC220926 BINDING SITE, designated SEQ ID:11165, to the nucleotide sequence of GAM7933 RNA, herein designated GAM RNA, also designated SEQ ID:203.

Another function of GAM7933 is therefore inhibition of LOC220926 (Accession XP_166128.1). Accordingly, utilities of GAM7933 include diagnosis, prevention and treatment of diseases and clinical conditions associated with LOC220926.

LOC221035 (Accession XP_167640.1) is another GAM7933 target gene, herein designated TARGET GENE. LOC221035 BINDING SITE is a target binding site found in the 3' untranslated region of mRNA encoded by LOC221035, corresponding to a target binding site such as BINDING SITE I, BINDING SITE II or BINDING SITE III of FIG. 8. Table 4 illustrates the complementarity of the nucleotide sequences of LOC221035 BINDING SITE, designated SEQ ID:17864, to the nucleotide sequence of GAM7933 RNA, herein designated GAM RNA, also designated SEQ ID:203.

Another function of GAM7933 is therefore inhibition of LOC221035 (Accession XP_167640.1). Accordingly, utilities of GAM7933 include diagnosis, prevention and treatment of diseases and clinical conditions associated with LOC221035.

LOC222674 (Accession XP_167095.3) is another GAM7933 target gene, herein designated TARGET GENE. LOC222674 BINDING SITE is a target binding site found in the 3' untranslated region of mRNA encoded by LOC222674, corresponding to a target binding site such as BINDING SITE I, BINDING SITE II or BINDING SITE III of FIG. 8. Table 4 illustrates the complementarity of the nucleotide sequences of LOC222674 BINDING SITE, designated SEQ ID:4311, to the nucleotide sequence of GAM7933 RNA, herein designated GAM RNA, also designated SEQ ID:203.

Another function of GAM7933 is therefore inhibition of LOC222674 (Accession XP_167095.3). Accordingly, utilities of GAM7933 include diagnosis, prevention and treatment of diseases and clinical conditions associated with LOC222674.

LOC255328 (Accession XP_172920.1) is another GAM7933 target gene, herein designated TARGET GENE. LOC255328 BINDING SITE is a target binding site found in the 3' untranslated region of mRNA encoded by LOC255328, corresponding to a target binding site such as BINDING SITE I, BINDING SITE II or BINDING SITE III of FIG. 8. Table 4 illustrates the complementarity of the nucleotide sequences of LOC255328 BINDING SITE, designated SEQ ID:10238, to the nucleotide sequence of GAM7933 RNA, herein designated GAM RNA, also designated SEQ ID:203.

Another function of GAM7933 is therefore inhibition of LOC255328 (Accession XP_172920.1). Accordingly, utilities of GAM7933 include diagnosis, prevention and treatment of diseases and clinical conditions associated with LOC255328.

LOC256598 (Accession XP_172816.1) is another GAM7933 target gene, herein designated TARGET GENE. LOC256598 BINDING SITE is a target binding site found in the 5' untranslated region of mRNA encoded by LOC256598, corresponding to a target binding site such as BINDING SITE I, BINDING SITE II or BINDING SITE III of FIG. 8. Table 4 illustrates the complementarity of the nucleotide sequences of LOC256598 BINDING SITE, designated SEQ ID:8974, to the nucleotide sequence of GAM7933 RNA, herein designated GAM RNA, also designated SEQ ID:203.

Another function of GAM7933 is therefore inhibition of LOC256598 (Accession XP_172816.1). Accordingly, utilities of GAM7933 include diagnosis, prevention and treatment of diseases and clinical conditions associated with LOC256598.

LOC257122 (Accession XP_171239.1) is another GAM7933 target gene, herein designated TARGET GENE. LOC257122 BINDING SITE is a target binding site found in the 5' untranslated region of mRNA encoded by LOC257122, corresponding to a target binding site such as BINDING SITE I, BINDING SITE II or BINDING SITE III of FIG. 8. Table 4 illustrates the complementarity of the nucleotide sequences of LOC257122 BINDING SITE, designated SEQ ID:12899, to the nucleotide sequence of GAM7933 RNA, herein designated GAM RNA, also designated SEQ ID:203.

Another function of GAM7933 is therefore inhibition of LOC257122 (Accession XP_171239.1). Accordingly, utilities of GAM7933 include diagnosis, prevention and treatment of diseases and clinical conditions associated with LOC257122.

LOC257408 (Accession XP_171176.1) is another GAM7933 target gene, herein designated TARGET GENE. LOC257408 BINDING SITE is a target binding site found in the 3' untranslated region of mRNA encoded by LOC257408, corresponding to a target binding site such as BINDING SITE I, BINDING SITE II or BINDING SITE III of FIG. 8. Table 4 illustrates the complementarity of the nucleotide sequences of LOC257408 BINDING SITE, designated SEQ ID:12573, to the nucleotide sequence of GAM7933 RNA, herein designated GAM RNA, also designated SEQ ID:203.

Another function of GAM7933 is therefore inhibition of LOC257408 (Accession XP_171176.1). Accordingly, utilities of GAM7933 include diagnosis, prevention and treatment of diseases and clinical conditions associated with LOC257408.

LOC282959 (Accession XP_212622.1) is another GAM7933 target gene, herein designated TARGET GENE. LOC282959 BINDING SITE is a target binding site found in the 3' untranslated region of mRNA encoded by LOC282959, corresponding to a target binding site such as BINDING SITE I, BINDING SITE II or BINDING SITE III of FIG. 8. Table 4 illustrates the complementarity of the nucleotide sequences of LOC282959 BINDING SITE, designated SEQ ID:4311, to the nucleotide sequence of GAM7933 RNA, herein designated GAM RNA, also designated SEQ ID:203.

Another function of GAM7933 is therefore inhibition of LOC282959 (Accession XP_212622.1). Accordingly, utilities of GAM7933 include diagnosis, prevention and treatment of diseases and clinical conditions associated with LOC282959.

LOC283213 (Accession XP_208566.1) is another GAM7933 target gene, herein designated TARGET GENE. LOC283213 BINDING SITE is a target binding site found in the 3' untranslated region of mRNA encoded by LOC283213, corresponding to a target binding site such as BINDING SITE I, BINDING SITE II or BINDING SITE III of FIG. 8. Table 4 illustrates the complementarity of the nucleotide sequences of LOC283213 BINDING SITE, designated SEQ ID:13264, to the nucleotide sequence of GAM7933 RNA, herein designated GAM RNA, also designated SEQ ID:203.

Another function of GAM7933 is therefore inhibition of LOC283213 (Accession XP_208566.1). Accordingly, utilities of GAM7933 include diagnosis, prevention and treatment of diseases and clinical conditions associated with LOC283213.

LOC283423 (Accession XP_211031.1) is another GAM7933 target gene, herein designated TARGET GENE. LOC283423 BINDING SITE is a target binding site found in the 3' untranslated region of mRNA encoded by LOC283423, corresponding to a target binding site such as BINDING SITE I, BINDING SITE II or BINDING SITE III of FIG. 8. Table 4 illustrates the complementarity of the nucleotide sequences of LOC283423 BINDING SITE, designated SEQ ID:492, to the nucleotide sequence of GAM7933 RNA, herein designated GAM RNA, also designated SEQ ID:203.

Another function of GAM7933 is therefore inhibition of LOC283423 (Accession XP_211031.1). Accordingly, utilities of GAM7933 include diagnosis, prevention and treatment of diseases and clinical conditions associated with LOC283423.

LOC283715 (Accession XP_208800.1) is another GAM7933 target gene, herein designated TARGET GENE. LOC283715 BINDING SITE is a target binding site found in the 5' untranslated region of mRNA encoded by LOC283715, corresponding to a target binding site such as BINDING SITE I, BINDING SITE II or BINDING SITE III of FIG. 8. Table 4 illustrates the complementarity of the nucleotide sequences of LOC283715 BINDING SITE, designated SEQ ID:4062, to the nucleotide sequence of GAM7933 RNA, herein designated GAM RNA, also designated SEQ ID:203.

Another function of GAM7933 is therefore inhibition of LOC283715 (Accession XP_208800.1). Accordingly, utilities of GAM7933 include diagnosis, prevention and treatment of diseases and clinical conditions associated with LOC283715.

LOC283731 (Accession XP_211184.1) is another GAM7933 target gene, herein designated TARGET GENE. LOC283731 BINDING SITE is a target binding site found in the 3' untranslated region of mRNA encoded by LOC283731, corresponding to a target binding site such as BINDING SITE I, BINDING SITE II or BINDING SITE III of FIG. 8. Table 4 illustrates the complementarity of the nucleotide sequences of LOC283731 BINDING SITE, designated SEQ ID:16313, to the nucleotide sequence of GAM7933 RNA, herein designated GAM RNA, also designated SEQ ID:203.

Another function of GAM7933 is therefore inhibition of LOC283731 (Accession XP_211184.1). Accordingly, utilities of GAM7933 include diagnosis, prevention and treatment of diseases and clinical conditions associated with LOC283731.

LOC283820 (Accession NP_775885.1) is another GAM7933 target gene, herein designated TARGET GENE. LOC283820 BINDING SITE is a target binding site found in the 3' untranslated region of mRNA encoded by LOC283820, corresponding to a target binding site such as BINDING SITE I, BINDING SITE II or BINDING SITE III of FIG. 8. Table 4 illustrates the complementarity of the nucleotide sequences of LOC283820 BINDING SITE, designated SEQ ID:6496, to the nucleotide sequence of GAM7933 RNA, herein designated GAM RNA, also designated SEQ ID:203.

Another function of GAM7933 is therefore inhibition of LOC283820 (Accession NP_775885.1). Accordingly, utilities of GAM7933 include diagnosis, prevention and treatment of diseases and clinical conditions associated with LOC283820.

LOC284647 (Accession XP_211569.1) is another GAM7933 target gene, herein designated TARGET GENE. LOC284647 BINDING SITE is a target binding site found in the 3' untranslated region of mRNA encoded by LOC284647, corresponding to a target binding site such as BINDING SITE I, BINDING SITE II or BINDING SITE III of FIG. 8. Table 4 illustrates the complementarity of the nucleotide sequences of LOC284647 BINDING SITE, designated SEQ ID:15385, to the nucleotide sequence of GAM7933 RNA, herein designated GAM RNA, also designated SEQ ID:203.

Another function of GAM7933 is therefore inhibition of LOC284647 (Accession XP_211569.1). Accordingly, utilities of GAM7933 include diagnosis, prevention and treatment of diseases and clinical conditions associated with LOC284647.

LOC285283 (Accession XP_208017.1) is another GAM7933 target gene, herein designated TARGET GENE. LOC285283 BINDING SITE is a target binding site found in the 3' untranslated region of mRNA encoded by LOC285283, corresponding to a target binding site such as BINDING SITE I, BINDING SITE II or BINDING SITE III of FIG. 8. Table 4 illustrates the complementarity of the nucleotide sequences of LOC285283 BINDING SITE, designated SEQ ID:8711, to the nucleotide sequence of GAM7933 RNA, herein designated GAM RNA, also designated SEQ ID:203.

Another function of GAM7933 is therefore inhibition of LOC285283 (Accession XP_208017.1). Accordingly, utilities of GAM7933 include diagnosis, prevention and treatment of diseases and clinical conditions associated with LOC285283.

LOC285334 (Accession XP_211844.1) is another GAM7933 target gene, herein designated TARGET GENE. LOC285334 BINDING SITE is a target binding site found in the 3' untranslated region of mRNA encoded by LOC285334, corresponding to a target binding site such as BINDING SITE I, BINDING SITE II or BINDING SITE III of FIG. 8. Table 4 illustrates the complementarity of the nucleotide sequences of LOC285334 BINDING SITE, designated SEQ ID:19928, to the nucleotide sequence of GAM7933 RNA, herein designated GAM RNA, also designated SEQ ID:203.

Another function of GAM7933 is therefore inhibition of LOC285334 (Accession XP_211844.1). Accordingly, utilities of GAM7933 include diagnosis, prevention and treatment of diseases and clinical conditions associated with LOC285334.

LOC285769 (Accession XP_209755.1) is another GAM7933 target gene, herein designated TARGET GENE. LOC285769 BINDING SITE1 and LOC285769 BINDING SITE2 are target binding sites found in untranslated regions of mRNA encoded by LOC285769, corresponding to target binding sites such as BINDING SITE I, BINDING SITE II or BINDING SITE III of FIG. 8. Table 4 illustrates the complementarity of the nucleotide sequences of LOC285769 BINDING SITE1 and LOC285769 BINDING SITE2, designated SEQ ID:4221 and SEQ ID:8378 respectively, to the nucleotide sequence of GAM7933 RNA, herein designated GAM RNA, also designated SEQ ID:203.

Another function of GAM7933 is therefore inhibition of LOC285769 (Accession XP_209755.1). Accordingly, utilities of GAM7933 include diagnosis, prevention and treatment of diseases and clinical conditions associated with LOC285769.

LOC285797 (Accession XP_212026.1) is another GAM7933 target gene, herein designated TARGET GENE. LOC285797 BINDING SITE is a target binding site found in the 3' untranslated region of mRNA encoded by LOC285797, corresponding to a target binding site such as BINDING SITE I, BINDING SITE II or BINDING SITE III of FIG. 8. Table 4 illustrates the complementarity of the nucleotide sequences of LOC285797 BINDING SITE, designated SEQ ID:4100, to the nucleotide sequence of GAM7933 RNA, herein designated GAM RNA, also designated SEQ ID:203.

Another function of GAM7933 is therefore inhibition of LOC285797 (Accession XP_212026.1). Accordingly, utilities of GAM7933 include diagnosis, prevention and treatment of diseases and clinical conditions associated with LOC285797.

LOC285798 (Accession XP_212024.1) is another GAM7933 target gene, herein designated TARGET GENE. LOC285798 BINDING SITE is a target binding site found in the 3' untranslated region of mRNA encoded by LOC285798, corresponding to a target binding site such as BINDING SITE I, BINDING SITE II or BINDING SITE III of FIG. 8. Table 4 illustrates the complementarity of the nucleotide sequences of LOC285798 BINDING SITE, designated SEQ ID:2760, to the nucleotide sequence of GAM7933 RNA, herein designated GAM RNA, also designated SEQ ID:203.

Another function of GAM7933 is therefore inhibition of LOC285798 (Accession XP_212024.1). Accordingly, utilities of GAM7933 include diagnosis, prevention and treatment of diseases and clinical conditions associated with LOC285798.

LOC338981 (Accession XP_294767.2) is another GAM7933 target gene, herein designated TARGET GENE. LOC338981 BINDING SITE is a target binding site found in the 5' untranslated region of mRNA encoded by LOC338981, corresponding to a target binding site such as BINDING SITE I, BINDING SITE II or BINDING SITE III of FIG. 8. Table 4 illustrates the complementarity of the nucleotide sequences of LOC338981 BINDING SITE, designated SEQ ID:610, to the nucleotide sequence of GAM7933 RNA, herein designated GAM RNA, also designated SEQ ID:203.

Another function of GAM7933 is therefore inhibition of LOC338981 (Accession XP_294767.2). Accordingly, utilities of GAM7933 include diagnosis, prevention and treatment of diseases and clinical conditions associated with LOC338981.

LOC340286 (Accession XP_295200.1) is another GAM7933 target gene, herein designated TARGET GENE. LOC340286 BINDING SITE is a target binding site found in the 3' untranslated region of mRNA encoded by LOC340286, corresponding to a target binding site such as BINDING SITE I, BINDING SITE II or BINDING SITE III of FIG. 8. Table 4 illustrates the complementarity of the nucleotide sequences of LOC340286 BINDING SITE, designated SEQ ID:17638, to the nucleotide sequence of GAM7933 RNA, herein designated GAM RNA, also designated SEQ ID:203.

Another function of GAM7933 is therefore inhibition of LOC340286 (Accession XP_295200.1). Accordingly, utilities of GAM7933 include diagnosis, prevention and treatment of diseases and clinical conditions associated with LOC340286.

LOC348127 (Accession XP_302662.1) is another GAM7933 target gene, herein designated TARGET GENE. LOC348127 BINDING SITE is a target binding site found in the 5' untranslated region of mRNA encoded by LOC348127, corresponding to a target binding site such as BINDING SITE I, BINDING SITE II or BINDING SITE III of FIG. 8. Table 4 illustrates the complementarity of the nucleotide sequences of LOC348127 BINDING SITE, designated SEQ ID:610, to the nucleotide sequence of GAM7933 RNA, herein designated GAM RNA, also designated SEQ ID:203.

Another function of GAM7933 is therefore inhibition of LOC348127 (Accession XP_302662.1). Accordingly, utilities of GAM7933 include diagnosis, prevention and treatment of diseases and clinical conditions associated with LOC348127.

LOC348130 (Accession XP_302666.1) is another GAM7933 target gene, herein designated TARGET GENE. LOC348130 BINDING SITE is a target binding site found in the 5' untranslated region of mRNA encoded by LOC348130, corresponding to a target binding site such as BINDING SITE I, BINDING SITE II or BINDING SITE III of FIG. 8. Table 4 illustrates the complementarity of the nucleotide sequences of LOC348130 BINDING SITE, designated SEQ ID:610, to the nucleotide sequence of GAM7933 RNA, herein designated GAM RNA, also designated SEQ ID:203.

Another function of GAM7933 is therefore inhibition of LOC348130 (Accession XP_302666.1). Accordingly, utilities of GAM7933 include diagnosis, prevention and treatment of diseases and clinical conditions associated with LOC348130.

LOC348817 (Accession XP_302901.1) is another GAM7933 target gene, herein designated TARGET GENE. LOC348817 BINDING SITE is a target binding site found in the 3' untranslated region of mRNA encoded by LOC348817, corresponding to a target binding site such as BINDING SITE I, BINDING SITE II or BINDING SITE III of FIG. 8. Table 4 illustrates the complementarity of the nucleotide sequences of LOC348817 BINDING SITE, designated SEQ ID:7451, to the nucleotide sequence of GAM7933 RNA, herein designated GAM RNA, also designated SEQ ID:203.

Another function of GAM7933 is therefore inhibition of LOC348817 (Accession XP_302901.1). Accordingly, utilities of GAM7933 include diagnosis, prevention and treatment of diseases and clinical conditions associated with LOC348817.

LOC349081 (Accession XP_300935.1) is another GAM7933 target gene, herein designated TARGET GENE. LOC349081 BINDING SITE is a target binding site found in the 3' untranslated region of mRNA encoded by LOC349081, corresponding to a target binding site such as BINDING SITE I, BINDING SITE II or BINDING SITE III of FIG. 8. Table 4 illustrates the complementarity of the nucleotide sequences of LOC349081 BINDING SITE, designated SEQ ID:4500, to the nucleotide sequence of GAM7933 RNA, herein designated GAM RNA, also designated SEQ ID:203.

Another function of GAM7933 is therefore inhibition of LOC349081 (Accession XP_300935.1). Accordingly, utilities of GAM7933 include diagnosis, prevention and treatment of diseases and clinical conditions associated with LOC349081.

LOC349161 (Accession XP_302970.1) is another GAM7933 target gene, herein designated TARGET GENE. LOC349161 BINDING SITE is a target binding site found in the 5' untranslated region of mRNA encoded by LOC349161, corresponding to a target binding site such as BINDING SITE I, BINDING SITE II or BINDING SITE III of FIG. 8. Table 4 illustrates the complementarity of the nucleotide sequences of LOC349161 BINDING SITE, designated SEQ ID:13194, to the nucleotide sequence of GAM7933 RNA, herein designated GAM RNA, also designated SEQ ID:203.

Another function of GAM7933 is therefore inhibition of LOC349161 (Accession XP_302970.1). Accordingly, utilities of GAM7933 include diagnosis, prevention and treatment of diseases and clinical conditions associated with LOC349161.

Leucine-rich repeat protein, neuronal 3 (LRRN3, Accession NP_060804.2) is another GAM7933 target gene, herein designated TARGET GENE. LRRN3 BINDING SITE is a target binding site found in the 5' untranslated region of mRNA encoded by LRRN3, corresponding to a target binding site such as BINDING SITE I, BINDING SITE II or BINDING SITE III of FIG. 8. Table 4 illustrates the complementarity of the nucleotide sequences of LRRN3 BINDING SITE, designated SEQ ID:11739, to the nucleotide sequence of GAM7933 RNA, herein designated GAM RNA, also designated SEQ ID:203.

Another function of GAM7933 is therefore inhibition of Leucine-rich repeat protein, neuronal 3 (LRRN3, Accession NP_060804.2). Accordingly, utilities of GAM7933 include diagnosis, prevention and treatment of diseases and clinical conditions associated with LRRN3.

Leucine zipper, putative tumor suppressor 1 (LZTS1, Accession NP_066300.1) is another GAM7933 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:5068, to the nucleotide sequence of GAM7933 RNA, herein designated GAM RNA, also designated SEQ ID:203.

Another function of GAM7933 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM7933 include diagnosis, prevention and treatment of diseases and clinical conditions associated with LZTS1.

The function of LZTS1 and its association with various diseases and clinical conditions, has been established by previous studies, as described hereinabove with reference to GAM130.1. Mad, mothers against decapentaplegic homolog 7 (drosophila) (MADH7, Accession NP_005895.1) is another GAM7933 target gene, herein designated TARGET GENE. MADH7 BINDING SITE is a target binding site found in the 3' untranslated region of mRNA encoded by MADH7, corresponding to a target binding site such as BINDING SITE I, BINDING SITE II or BINDING SITE III of FIG. 8. Table 4 illustrates the complementarity of the nucleotide sequences of MADH7 BINDING SITE, designated SEQ ID:2946, to the nucleotide sequence of GAM7933 RNA, herein designated GAM RNA, also designated SEQ ID:203.

Another function of GAM7933 is therefore inhibition of Mad, mothers against decapentaplegic homolog 7 (drosophila) (MADH7, Accession NP_005895.1), a gene which may affect transcription in response to TGF-beta superfamily signaling pathway, inhibits BMP/Smad1 (MADH1) signaling and therefore may be associated with Scleroderma. Accordingly, utilities of GAM7933 include diagnosis, prevention and treatment of Scleroderma, and of other diseases and clinical conditions associated with MADH7.

The function of MADH7 and its association with various diseases and clinical conditions, has been established by previous studies, as described hereinabove with reference to GAM354.1. MAGEG1 (Accession NP_619649.1) is another GAM7933 target gene, herein designated TARGET GENE. MAGEG1 BINDING SITE is a target binding site found in the 3' untranslated region of mRNA encoded by MAGEG1, corresponding to a target binding site such as BINDING SITE I, BINDING SITE II or BINDING SITE III of FIG. 8. Table 4 illustrates the complementarity of the nucleotide sequences of MAGEG1 BINDING SITE, designated SEQ ID:10063, to the nucleotide sequence of GAM7933 RNA, herein designated GAM RNA, also designated SEQ ID:203.

Another function of GAM7933 is therefore inhibition of MAGEG1 (Accession NP_619649.1). Accordingly, utilities of GAM7933 include diagnosis, prevention and treatment of diseases and clinical conditions associated with MAGEG1.

MGC16733 (Accession NP_291025.1) is another GAM7933 target gene, herein designated TARGET GENE. MGC16733 BINDING SITE is a target binding site found in the 3' untranslated region of mRNA encoded by MGC16733, corresponding to a target binding site such as BINDING SITE I, BINDING SITE II or BINDING SITE III of FIG. 8. Table 4 illustrates the complementarity of the nucleotide sequences of MGC16733 BINDING SITE, designated SEQ ID:13414, to the nucleotide sequence of GAM7933 RNA, herein designated GAM RNA, also designated SEQ ID:203.

Another function of GAM7933 is therefore inhibition of MGC16733 (Accession NP_291025.1). Accordingly, utilities of GAM7933 include diagnosis, prevention and treatment of diseases and clinical conditions associated with MGC16733.

MGC29891 (Accession NP_653219.1) is another GAM7933 target gene, herein designated TARGET GENE. MGC29891 BINDING SITE is a target binding site found in the 3' untranslated region of mRNA encoded by MGC29891, corresponding to a target binding site such as BINDING SITE I, BINDING SITE II or BINDING SITE III of FIG. 8. Table 4 illustrates the complementarity of the nucleotide sequences of MGC29891 BINDING SITE, designated SEQ ID:9508, to the nucleotide sequence of GAM7933 RNA, herein designated GAM RNA, also designated SEQ ID:203.

Another function of GAM7933 is therefore inhibition of MGC29891 (Accession NP_653219.1). Accordingly, utilities of GAM7933 include diagnosis, prevention and treatment of diseases and clinical conditions associated with MGC29891.

MGC5576 (Accession NP_076961.1) is another GAM7933 target gene, herein designated TARGET GENE. MGC5576 BINDING SITE is a target binding site found in the 3' untranslated region of mRNA encoded by MGC5576, corresponding to a target binding site such as BINDING SITE I, BINDING SITE II or BINDING SITE III of FIG. 8. Table 4 illustrates the complementarity of the nucleotide sequences of MGC5576 BINDING SITE, designated SEQ ID:7009, to the nucleotide sequence of GAM7933 RNA, herein designated GAM RNA, also designated SEQ ID:203.

Another function of GAM7933 is therefore inhibition of MGC5576 (Accession NP_076961.1). Accordingly, utilities of GAM7933 include diagnosis, prevention and treatment of diseases and clinical conditions associated with MGC5576.

Matrix metalloproteinase 16 (membrane-inserted) (MMP16, Accession NP_005932.2) is another GAM7933 target gene, herein designated TARGET GENE. MMP16 BINDING SITE is a target binding site found in the 3' untranslated region of multiple transcripts of mRNA encoded by MMP16, corresponding to a target binding site such as BINDING SITE I, BINDING SITE II or BINDING SITE III of FIG. 8. Table 4 illustrates the complementarity of the nucleotide sequences of MMP16 BINDING SITE, designated SEQ ID:5291, to the nucleotide sequence of GAM7933 RNA, herein designated GAM RNA, also designated SEQ ID:203.

Another function of GAM7933 is therefore inhibition of Matrix metalloproteinase 16 (membrane-inserted) (MMP16, Accession NP_005932.2). Accordingly, utilities of GAM7933 include diagnosis, prevention and treatment of diseases and clinical conditions associated with MMP16.

Nk3 transcription factor related, locus 1 (drosophila) (NKX3-1, Accession NP_006158.2) is another GAM7933 target gene, herein designated TARGET GENE. NKX3-1 BINDING SITE is a target binding site found in the 3' untranslated region of mRNA encoded by NKX3-1, corresponding to a target binding site such as BINDING SITE I, BINDING SITE II or BINDING SITE III of FIG. 8. Table 4 illustrates the complementarity of the nucleotide sequences of NKX3-1 BINDING SITE, designated SEQ ID:15691, to the nucleotide sequence of GAM7933 RNA, herein designated GAM RNA, also designated SEQ ID:203.

Another function of GAM7933 is therefore inhibition of Nk3 transcription factor related, locus 1 (drosophila) (NKX3-1, Accession NP_006158.2). Accordingly, utilities of GAM7933 include diagnosis, prevention and treatment of diseases and clinical conditions associated with NKX3-1.

Nucleoporin 153 kda (NUP153, Accession NP_005115.2) is another GAM7933 target gene, herein designated TARGET GENE. NUP153 BINDING SITE is a target binding site found in the 3' untranslated region of mRNA encoded by NUP153, corresponding to a target binding site such as BINDING SITE I, BINDING SITE II or BINDING SITE III of FIG. 8. Table 4 illustrates the complementarity of the nucleotide sequences of NUP153 BINDING SITE, designated SEQ ID:18750, to the nucleotide sequence of GAM7933 RNA, herein designated GAM RNA, also designated SEQ ID:203.

Another function of GAM7933 is therefore inhibition of Nucleoporin 153 kda (NUP153, Accession NP_005115.2). Accordingly, utilities of GAM7933 include diagnosis, prevention and treatment of diseases and clinical conditions associated with NUP153.

Pleiomorphic adenoma gene 1 (PLAG1, Accession NP_002646.1) is another GAM7933 target gene, herein designated TARGET GENE. PLAG1 BINDING SITE is a target binding site found in the 3' untranslated region of mRNA encoded by PLAG1, corresponding to a target binding site such as BINDING SITE I, BINDING SITE II or BINDING SITE III of FIG. 8. Table 4 illustrates the complementarity of the nucleotide sequences of PLAG1 BINDING SITE, designated SEQ ID:8200, to the nucleotide sequence of GAM7933 RNA, herein designated GAM RNA, also designated SEQ ID:203.

Another function of GAM7933 is therefore inhibition of Pleiomorphic adenoma gene 1 (PLAG1, Accession NP_002646.1), a gene which contains a zinc finger domain. Accordingly, utilities of GAM7933 include diagnosis, prevention and treatment of diseases and clinical conditions associated with PLAG1.

The function of PLAG1 and its association with various diseases and clinical conditions, has been established by previous studies, as described hereinabove with reference to GAM47.1. Plastin 1 (i isoform) (PLS1, Accession NP_002661.1) is another GAM7933 target gene, herein designated TARGET GENE. PLS1 BINDING SITE is a target binding site found in the 3' untranslated region of mRNA encoded by PLS1, corresponding to a target binding site such as BINDING SITE I, BINDING SITE II or BINDING SITE III of FIG. 8. Table 4 illustrates the complementarity of the nucleotide sequences of PLS1 BINDING SITE, designated SEQ ID:14544, to the nucleotide sequence of GAM7933 RNA, herein designated GAM RNA, also designated SEQ ID:203.

Another function of GAM7933 is therefore inhibition of Plastin 1 (i isoform) (PLS1, Accession NP_002661.1). Accordingly, utilities of GAM7933 include diagnosis, prevention and treatment of diseases and clinical conditions associated with PLS1.

PM5 (Accession NP_055102.2) is another GAM7933 target gene, herein designated TARGET GENE. PM5 BINDING SITE is a target binding site found in the 3' untranslated region of mRNA encoded by PM5, corresponding to a target binding site such as BINDING SITE I, BINDING SITE II or BINDING SITE III of FIG. 8. Table 4 illustrates the complementarity of the nucleotide sequences of PM5 BINDING SITE, designated SEQ ID:6496, to the nucleotide sequence of GAM7933 RNA, herein designated GAM RNA, also designated SEQ ID:203.

Another function of GAM7933 is therefore inhibition of PM5 (Accession NP_055102.2). Accordingly, utilities of GAM7933 include diagnosis, prevention and treatment of diseases and clinical conditions associated with PM5.

PP35 (Accession NP_853559.1) is another GAM7933 target gene, herein designated TARGET GENE. PP35 BINDING SITE is a target binding site found in the 3' untranslated region of multiple transcripts of mRNA encoded by PP35, corresponding to a target binding site such as BINDING SITE I, BINDING SITE II or BINDING SITE III of FIG. 8. Table 4 illustrates the complementarity of the nucleotide sequences of PP35 BINDING SITE, designated SEQ ID:15536, to the nucleotide sequence of GAM7933 RNA, herein designated GAM RNA, also designated SEQ ID:203.

Another function of GAM7933 is therefore inhibition of PP35 (Accession NP_853559.1). Accordingly, utilities of GAM7933 include diagnosis, prevention and treatment of diseases and clinical conditions associated with PP35.

PP35 (Accession NP_008947.1) is another GAM7933 target gene, herein designated TARGET GENE. PP35 BINDING SITE is a target binding site found in the 3' untranslated region of multiple transcripts of mRNA encoded by PP35, corresponding to a target binding site such as BINDING SITE I, BINDING SITE II or BINDING SITE III of FIG. 8. Table 4 illustrates the complementarity of the nucleotide sequences of PP35 BINDING SITE, designated SEQ ID:15536, to the nucleotide sequence of GAM7933 RNA, herein designated GAM RNA, also designated SEQ ID:203.

Another function of GAM7933 is therefore inhibition of PP35 (Accession NP_008947.1). Accordingly, utilities of GAM7933 include diagnosis, prevention and treatment of diseases and clinical conditions associated with PP35.

Protein phosphatase 1d magnesium-dependent, delta isoform (PPM1D, Accession NP_003611.1) is another GAM7933 target gene, herein designated TARGET GENE. PPM1D BINDING SITE is a target binding site found in the 3' untranslated region of mRNA encoded by PPM1D, corresponding to a target binding site such as BINDING SITE I, BINDING SITE II or BINDING SITE III of FIG. 8. Table 4 illustrates the complementarity of the nucleotide sequences of PPM1D BINDING SITE, designated SEQ ID:10407, to the nucleotide sequence of GAM7933 RNA, herein designated GAM RNA, also designated SEQ ID:203.

Another function of GAM7933 is therefore inhibition of Protein phosphatase 1d magnesium-dependent, delta isoform (PPM1D, Accession NP_003611.1), a gene which might contribute to growth inhibitory pathways activated in response to dna damage in a manner. and therefore may be associated with Breast cancer. Accordingly, utilities of GAM7933 include diagnosis, prevention and treatment of Breast cancer, and of other diseases and clinical conditions associated with PPM1D.

The function of PPM1D and its association with various diseases and clinical conditions, has been established by previous studies, as described hereinabove with reference to GAM2337.1. Protein phosphatase 1, regulatory (inhibitor) subunit 3a (glycogen and sarcoplasmic reticulum binding subunit, skeletal muscle) (PPP1R3A, Accession NP_002702.1) is another GAM7933 target gene, herein designated TARGET GENE. PPP1R3A BINDING SITE is a target binding site found in the 3' untranslated region of mRNA encoded by PPP1R3A, corresponding to a target binding site such as BINDING SITE I, BINDING SITE II or BINDING SITE III of FIG. 8. Table 4 illustrates the complementarity of the nucleotide sequences of PPP1R3A BINDING SITE, designated SEQ ID:500, to the nucleotide sequence of GAM7933 RNA, herein designated GAM RNA, also designated SEQ ID:203.

Another function of GAM7933 is therefore inhibition of Protein phosphatase 1, regulatory (inhibitor) subunit 3a (glycogen and sarcoplasmic reticulum binding subunit, skeletal muscle) (PPP1R3A, Accession NP_002702.1), a gene which regulates phosphatase activity towards glycogen synthase, active in skeletal muscle and therefore may be associated with Insulin resistance and glycemia variation. Accordingly, utilities of GAM7933 include diagnosis, prevention and treatment of Insulin resistance and glycemia variation, and of other diseases and clinical conditions associated with PPP1R3A.

The function of PPP1R3A and its association with various diseases and clinical conditions, has been established by previous studies, as described hereinabove with reference to GAM44.1. Palmitoyl-protein thioesterase 2 (PPT2, Accession NP_620312.1) is another GAM7933 target gene, herein designated TARGET GENE. PPT2 BINDING SITE is a target binding site found in the 3' untranslated region of multiple transcripts of mRNA encoded by PPT2, corresponding to a target binding site such as BINDING SITE I, BINDING SITE II or BINDING SITE III of FIG. 8. Table 4 illustrates the complementarity of the nucleotide sequences of PPT2 BINDING SITE, designated SEQ ID:7654, to the nucleotide sequence of GAM7933 RNA, herein designated GAM RNA, also designated SEQ ID:203.

Another function of GAM7933 is therefore inhibition of Palmitoyl-protein thioesterase 2 (PPT2, Accession NP_620312.1), a gene which is a palmitoyl-protein thioesterase 2 which possesses a different substrate specificity than PPT1. Accordingly, utilities of GAM7933 include diagnosis, prevention and treatment of diseases and clinical conditions associated with PPT2.

The function of PPT2 and its association with various diseases and clinical conditions, has been established by previous studies, as described hereinabove with reference to GAM63.1. PRO0327 (Accession NP_054844.1) is another GAM7933 target gene, herein designated TARGET GENE. PRO0327 BINDING SITE is a target binding site found in the 3' untranslated region of mRNA encoded by PRO0327, corresponding to a target binding site such as BINDING SITE I, BINDING SITE II or BINDING SITE III of FIG. 8. Table 4 illustrates the complementarity of the nucleotide sequences of PRO0327 BINDING SITE, designated SEQ ID:8711, to the nucleotide sequence of GAM7933 RNA, herein designated GAM RNA, also designated SEQ ID:203.

Another function of GAM7933 is therefore inhibition of PRO0327 (Accession NP_054844.1). Accordingly, utilities of GAM7933 include diagnosis, prevention and treatment of diseases and clinical conditions associated with PRO0327.

Proteasome (prosome, macropain) 26s subunit, non-atpase, 7 (mov34 homolog) (PSMD7, Accession NP_002802.2) is another GAM7933 target gene, herein designated TARGET GENE. PSMD7 BINDING SITE is a target binding site found in the 3' untranslated region of mRNA encoded by PSMD7, corresponding to a target binding site such as BINDING SITE I, BINDING SITE II or BINDING SITE III of FIG. 8. Table 4 illustrates the complementarity of the nucleotide sequences of PSMD7 BINDING SITE, designated SEQ ID:11380, to the nucleotide sequence of GAM7933 RNA, herein designated GAM RNA, also designated SEQ ID:203.

Another function of GAM7933 is therefore inhibition of Proteasome (prosome, macropain) 26s subunit, non-atpase, 7 (mov34 homolog) (PSMD7, Accession NP_002802.2). Accordingly, utilities of GAM7933 include diagnosis, prevention and treatment of diseases and clinical conditions associated with PSMD7.

Rab3b, member ras oncogene family (RAB3B, Accession NP_002858.2) is another GAM7933 target gene, herein designated TARGET GENE. RAB3B BINDING SITE is a target binding site found in the 3' untranslated region of mRNA encoded by RAB3B, corresponding to a target binding site such as BINDING SITE I, BINDING SITE II or BINDING SITE III of FIG. 8. Table 4 illustrates the complementarity of the nucleotide sequences of RAB3B BINDING SITE, designated SEQ ID:17468, to the nucleotide sequence of GAM7933 RNA, herein designated GAM RNA, also designated SEQ ID:203.

Another function of GAM7933 is therefore inhibition of Rab3b, member ras oncogene family (RAB3B, Accession NP_002858.2). Accordingly, utilities of GAM7933 include diagnosis, prevention and treatment of diseases and clinical conditions associated with RAB3B.

Reversion-inducing-cysteine-rich protein with kazal motifs (RECK, Accession NP_066934.1) is another GAM7933 target gene, herein designated TARGET GENE. RECK BINDING SITE is a target binding site found in the 3' untranslated region of mRNA encoded by RECK, corresponding to a target binding site such as BINDING SITE I, BINDING SITE II or BINDING SITE III of FIG. 8. Table 4 illustrates the complementarity of the nucleotide sequences of RECK BINDING SITE, designated SEQ ID:11196, to the nucleotide sequence of GAM7933 RNA, herein designated GAM RNA, also designated SEQ ID:203.

Another function of GAM7933 is therefore inhibition of Reversion-inducing-cysteine-rich protein with kazal motifs (RECK, Accession NP_066934.1), a gene which plays a role in regulation of cancer progression and tumor angiogenesis. and therefore may be associated with Cancerous tumors. Accordingly, utilities of GAM7933 include diagnosis, prevention and treatment of Cancerous tumors, and of other diseases and clinical conditions associated with RECK.

The function of RECK and its association with various diseases and clinical conditions, has been established by previous studies, as described hereinabove with reference to GAM377.1. Regulatory factor x, 3 (influences hla class ii expression) (RFX3, Accession NP_002910.1) is another GAM7933 target gene, herein designated TARGET GENE. RFX3 BINDING SITE is a target binding site found in the 3' untranslated region of multiple transcripts of mRNA encoded by RFX3, corresponding to a target binding site such as BINDING SITE I, BINDING SITE II or BINDING SITE III of FIG. 8. Table 4 illustrates the complementarity of the nucleotide sequences of RFX3 BINDING SITE, designated SEQ ID:19639, to the nucleotide sequence of GAM7933 RNA, herein designated GAM RNA, also designated SEQ ID:203.

Another function of GAM7933 is therefore inhibition of Regulatory factor x, 3 (influences hla class ii expression) (RFX3, Accession NP_002910.1). Accordingly, utilities of GAM7933 include diagnosis, prevention and treatment of diseases and clinical conditions associated with RFX3.

RNAC (Accession NP_005763.2) is another GAM7933 target gene, herein designated TARGET GENE. RNAC BINDING SITE is a target binding site found in the 3' untranslated region of mRNA encoded by RNAC, corresponding to a target binding site such as BINDING SITE I, BINDING SITE II or BINDING SITE III of FIG. 8. Table 4 illustrates the complementarity of the nucleotide sequences of RNAC BINDING SITE, designated SEQ ID:12142, to the nucleotide sequence of GAM7933 RNA, herein designated GAM RNA, also designated SEQ ID:203.

Another function of GAM7933 is therefore inhibition of RNAC (Accession NP_005763.2). Accordingly, utilities of GAM7933 include diagnosis, prevention and treatment of diseases and clinical conditions associated with RNAC.

Spinocerebellar ataxia 1 (olivopontocerebellar ataxia 1, autosomal dominant, ataxin 1) (SCA1, Accession NP_000323.1) is another GAM7933 target gene, herein designated TARGET GENE. SCA1 BINDING SITE is a target binding site found in the 5' untranslated region of mRNA encoded by SCA1, corresponding to a target binding site such as BINDING SITE I, BINDING SITE II or BINDING SITE III of FIG. 8. Table 4 illustrates the complementarity of the nucleotide sequences of SCA1 BINDING SITE, designated SEQ ID:8968, to the nucleotide sequence of GAM7933 RNA, herein designated GAM RNA, also designated SEQ ID:203.

Another function of GAM7933 is therefore inhibition of Spinocerebellar ataxia 1 (olivopontocerebellar ataxia 1, autosomal dominant, ataxin 1) (SCA1, Accession NP_000323.1). Accordingly, utilities of GAM7933 include diagnosis, prevention and treatment of diseases and clinical conditions associated with SCA1.

SE20-4 (Accession NP_071400.1) is another GAM7933 target gene, herein designated TARGET GENE. SE20-4 BINDING SITE is a target binding site found in the 3' untranslated region of mRNA encoded by SE20-4, corresponding to a target binding site such as BINDING SITE I, BINDING SITE II or BINDING SITE III of FIG. 8. Table 4 illustrates the complementarity of the nucleotide sequences of SE20-4 BINDING SITE, designated SEQ ID:3595, to the nucleotide sequence of GAM7933 RNA, herein designated GAM RNA, also designated SEQ ID:203.

Another function of GAM7933 is therefore inhibition of SE20-4 (Accession NP_071400.1). Accordingly, utilities of GAM7933 include diagnosis, prevention and treatment of diseases and clinical conditions associated with SE20-4.

Sh3-domain binding protein 2 (SH3BP2, Accession NP_003014.2) is another GAM7933 target gene, herein designated TARGET GENE. SH3BP2 BINDING SITE is a target binding site found in the 3' untranslated region of mRNA encoded by SH3BP2, corresponding to a target binding site such as BINDING SITE I, BINDING SITE II or BINDING SITE III of FIG. 8. Table 4 illustrates the complementarity of the nucleotide sequences of SH3BP2 BINDING SITE, designated SEQ ID:13854, to the nucleotide sequence of GAM7933 RNA, herein designated GAM RNA, also designated SEQ ID:203.

Another function of GAM7933 is therefore inhibition of Sh3-domain binding protein 2 (SH3BP2, Accession NP_003014.2). Accordingly, utilities of GAM7933 include diagnosis, prevention and treatment of diseases and clinical conditions associated with SH3BP2.

Seven in absentia homolog 1 (drosophila) (SIAH1, Accession NP_003022.1) is another GAM7933 target gene, herein designated TARGET GENE. SIAH1 BINDING SITE is a target binding site found in the 3' untranslated region of mRNA encoded by SIAH1, corresponding to a target binding site such as BINDING SITE I, BINDING SITE II or BINDING SITE III of FIG. 8. Table 4 illustrates the complementarity of the nucleotide sequences of SIAH1 BINDING SITE, designated SEQ ID:11362, to the nucleotide sequence of GAM7933 RNA, herein designated GAM RNA, also designated SEQ ID:203.

Another function of GAM7933 is therefore inhibition of Seven in absentia homolog 1 (drosophila) (SIAH1, Accession NP_003022.1), a gene which mediates a beta-catenin degradation pathway linking p53 activation to cell cycle control. Accordingly, utilities of GAM7933 include diagnosis, prevention and treatment of diseases and clinical conditions associated with SIAH1.

The function of SIAH1 and its association with various diseases and clinical conditions, has been established by previous studies, as described hereinabove with reference to GAM100.1. Sialic acid binding ig-like lectin 8 (SIGLEC8, Accession NP_055257.1) is another GAM7933 target gene, herein designated TARGET GENE. SIGLEC8 BINDING SITE is a target binding site found in the 5' untranslated region of mRNA encoded by SIGLEC8, corresponding to a target binding site such as BINDING SITE I, BINDING SITE II or BINDING SITE III of FIG. 8. Table 4 illustrates the complementarity of the nucleotide sequences of SIGLEC8 BINDING SITE, designated SEQ ID:18948, to the nucleotide sequence of GAM7933 RNA, herein designated GAM RNA, also designated SEQ ID:203.

Another function of GAM7933 is therefore inhibition of Sialic acid binding ig-like lectin 8 (SIGLEC8, Accession NP_055257.1), a gene which is a cell adhesion molecule for postnatal neural development. Accordingly, utilities of GAM7933 include diagnosis, prevention and treatment of diseases and clinical conditions associated with SIGLEC8.

The function of SIGLEC8 and its association with various diseases and clinical conditions, has been established by previous studies, as described hereinabove with reference to GAM63.1. SKIP (Accession XP_051221.2) is another GAM7933 target gene, herein designated TARGET GENE. SKIP BINDING SITE is a target binding site found in the 3' untranslated region of multiple transcripts of mRNA encoded by SKIP, corresponding to a target binding site such as BINDING SITE I, BINDING SITE II or BINDING SITE III of FIG. 8. Table 4 illustrates the complementarity of the nucleotide sequences of SKIP BINDING SITE, designated SEQ ID:13806, to the nucleotide sequence of GAM7933 RNA, herein designated GAM RNA, also designated SEQ ID:203.

Another function of GAM7933 is therefore inhibition of SKIP (Accession XP_051221.2). Accordingly, utilities of GAM7933 include diagnosis, prevention and treatment of diseases and clinical conditions associated with SKIP.

Son dna binding protein (SON, Accession NP_115571.1) is another GAM7933 target gene, herein designated TARGET GENE. SON BINDING SITE is a target binding site found in the 3' untranslated region of multiple transcripts of mRNA encoded by SON, corresponding to a target binding site such as BINDING SITE I, BINDING SITE II or BINDING SITE III of FIG. 8. Table 4 illustrates the complementarity of the nucleotide sequences of SON BINDING SITE, designated SEQ ID:7402, to the nucleotide sequence of GAM7933 RNA, herein designated GAM RNA, also designated SEQ ID:203.

Another function of GAM7933 is therefore inhibition of Son dna binding protein (SON, Accession NP_115571.1). Accordingly, utilities of GAM7933 include diagnosis, prevention and treatment of diseases and clinical conditions associated with SON.

Spastic paraplegia 7, paraplegin (pure and complicated autosomal recessive) (SPG7, Accession NP_003110.1) is another GAM7933 target gene, herein designated TARGET GENE. SPG7 BINDING SITE is a target binding site found in the 5' untranslated region of mRNA encoded by SPG7, corresponding to a target binding site such as BINDING SITE I, BINDING SITE II or BINDING SITE III of FIG. 8. Table 4 illustrates the complementarity of the nucleotide sequences of SPG7 BINDING SITE, designated SEQ ID:5110, to the nucleotide sequence of GAM7933 RNA, herein designated GAM RNA, also designated SEQ ID:203.

Another function of GAM7933 is therefore inhibition of Spastic paraplegia 7, paraplegin (pure and complicated autosomal recessive) (SPG7, Accession NP_003110.1), a gene which act as an atp-dependent zinc metallopeptidase. involved in the degradation of sigma-32. Accordingly, utilities of GAM7933 include diagnosis, prevention and treatment of diseases and clinical conditions associated with SPG7.

The function of SPG7 and its association with various diseases and clinical conditions, has been established by previous studies, as described hereinabove with reference to GAM1668.1. Syntaxin binding protein 1 (STXBP1, Accession NP_003156.1) is another GAM7933 target gene, herein designated TARGET GENE. STXBP1 BINDING SITE is a target binding site found in the 3' untranslated region of mRNA encoded by STXBP1, corresponding to a target binding site such as BINDING SITE I, BINDING SITE II or BINDING SITE III of FIG. 8. Table 4 illustrates the complementarity of the nucleotide sequences of STXBP1 BINDING SITE, designated SEQ ID:11449, to the nucleotide sequence of GAM7933 RNA, herein designated GAM RNA, also designated SEQ ID:203.

Another function of GAM7933 is therefore inhibition of Syntaxin binding protein 1 (STXBP1, Accession NP_003156.1), a gene which may play a role in determining the specificity of intracellular fusion reactions. Accordingly, utilities of GAM7933 include diagnosis, prevention and treatment of diseases and clinical conditions associated with STXBP1.

The function of STXBP1 and its association with various diseases and clinical conditions, has been established by previous studies, as described hereinabove with reference to GAM207.2. Transcription factor ap-2 alpha (activating enhancer binding protein 2 alpha) (TFAP2A, Accession NP_003211.1) is another GAM7933 target gene, herein designated TARGET GENE. TFAP2A BINDING SITE is a target binding site found in the 3' untranslated region of mRNA encoded by TFAP2A, corresponding to a target binding site such as BINDING SITE I, BINDING SITE II or BINDING SITE III of FIG. 8. Table 4 illustrates the complementarity of the nucleotide sequences of TFAP2A BINDING SITE, designated SEQ ID:8195, to the nucleotide sequence of GAM7933 RNA, herein designated GAM RNA, also designated SEQ ID:203.

Another function of GAM7933 is therefore inhibition of Transcription factor ap-2 alpha (activating enhancer binding protein 2 alpha) (TFAP2A, Accession NP_003211.1), a gene which may be involved in anterior eye chamber development. Accordingly, utilities of GAM7933 include diagnosis, prevention and treatment of diseases and clinical conditions associated with TFAP2A.

The function of TFAP2A and its association with various diseases and clinical conditions, has been established by previous studies, as described hereinabove with reference to GAM967.1. UNC5H2 (Accession NP_734465.1) is another GAM7933 target gene, herein designated TARGET GENE. UNC5H2 BINDING SITE is a target binding site found in the 3' untranslated region of mRNA encoded by UNC5H2, corresponding to a target binding site such as BINDING SITE I, BINDING SITE II or BINDING SITE III of FIG. 8. Table 4 illustrates the complementarity of the nucleotide sequences of UNC5H2 BINDING SITE, designated SEQ ID:13226, to the nucleotide sequence of GAM7933 RNA, herein designated GAM RNA, also designated SEQ ID:203.

Another function of GAM7933 is therefore inhibition of UNC5H2 (Accession NP_734465.1). Accordingly, utilities of GAM7933 include diagnosis, prevention and treatment of diseases and clinical conditions associated with UNC5H2.

Wd repeat domain 5b (WDR5B, Accession NP_061942.2) is another GAM7933 target gene, herein designated TARGET GENE. WDR5B BINDING SITE is a target binding site found in the 5' untranslated region of mRNA encoded by WDR5B, corresponding to a target binding site such as BINDING SITE I, BINDING SITE II or BINDING SITE III of FIG. 8. Table 4 illustrates the complementarity of the nucleotide sequences of WDR5B BINDING SITE, designated SEQ ID:20162, to the nucleotide sequence of GAM7933 RNA, herein designated GAM RNA, also designated SEQ ID:203.

Another function of GAM7933 is therefore inhibition of Wd repeat domain 5b (WDR5B, Accession NP_061942.2). Accordingly, utilities of GAM7933 include diagnosis, prevention and treatment of diseases and clinical conditions associated with WDR5B.

Wolf-hirschhorn syndrome candidate 1 (WHSC1, Accession NP_579889.1) is another GAM7933 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:12260, to the nucleotide sequence of GAM7933 RNA, herein designated GAM RNA, also designated SEQ ID:203.

Another function of GAM7933 is therefore inhibition of Wolf-hirschhorn syndrome candidate 1 (WHSC1, Accession NP_579889.1), a gene which binds covalently to and repairs g/t mismatches. and therefore may be associated with Wolf-hirschhorn syndrome. Accordingly, utilities of GAM7933 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. ZFYVE1 (Accession NP_067083.1) is another GAM7933 target gene, herein designated TARGET GENE. ZFYVE1 BINDING SITE is a target binding site found in the 5' untranslated region of multiple transcripts of mRNA encoded by ZFYVE1, corresponding to a target binding site such as BINDING SITE I, BINDING SITE II or BINDING SITE III of FIG. 8. Table 4 illustrates the complementarity of the nucleotide sequences of ZFYVE1 BINDING SITE, designated SEQ ID:16631, to the nucleotide sequence of GAM7933 RNA, herein designated GAM RNA, also designated SEQ ID:203.

Another function of GAM7933 is therefore inhibition of ZFYVE1 (Accession NP_067083.1). Accordingly, utilities of GAM7933 include diagnosis, prevention and treatment of diseases and clinical conditions associated with ZFYVE1.

ZFYVE1 (Accession XP_027302.5) is another GAM7933 target gene, herein designated TARGET GENE. ZFYVE1 BINDING SITE is a target binding site found in the 5' untranslated region of multiple transcripts of mRNA encoded by ZFYVE1, corresponding to a target binding site such as BINDING SITE I, BINDING SITE II or BINDING SITE III of FIG. 8. Table 4 illustrates the complementarity of the nucleotide sequences of ZFYVE1 BINDING SITE, designated SEQ ID:16631, to the nucleotide sequence of GAM7933 RNA, herein designated GAM RNA, also designated SEQ ID:203.

Another function of GAM7933 is therefore inhibition of ZFYVE1 (Accession XP_027302.5). Accordingly, utilities of GAM7933 include diagnosis, prevention and treatment of diseases and clinical conditions associated with ZFYVE1.

FIG. 8 further provides a conceptual description of a novel bioinformatically detected of the present invention, referred to here as Genomic Address Messenger 7957 (GAM7957), which modulates expression of respective target genes thereof, the function and utility of which target genes is known in the art.

GAM7957 is a novel bioinformatically detected regulatory, non protein coding, micro RNA (miRNA) gene. The method by which GAM7957 was detected is described hereinabove with reference to FIGS. 8-15.

GAM7957 gene, herein designated GAM GENE, and GAM7957 target gene, herein designated TARGET GENE, are human genes contained in the human genome.

GAM7957 gene encodes a GAM7957 precursor RNA, herein designated GAM PRECURSOR RNA. Similar to other miRNA genes, and unlike most ordinary genes, GAM7957 precursor RNA does not encode a protein. A nucleotide sequence identical or highly similar to the nucleotide sequence of GAM7957 precursor RNA is designated SEQ ID:42, and is provided hereinbelow with reference to the sequence listing part.

GAM7957 precursor RNA folds onto itself, forming GAM7957 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM7957 precursor RNA folds onto itself, forming GAM7957 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM7957 precursor RNA, designated SEQ-ID:42, and a schematic representation of a predicted secondary folding of GAM7957 folded precursor RNA are further described with reference to Table 2, hereby incorporated by reference.

An enzyme complex designated DICER COMPLEX, 'dices' the GAM7957 folded precursor RNA into GAM7957 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM7957 RNA is designated SEQ ID:297, and is provided hereinbelow with references to the sequence listing part and Table 3, hereby incorporated by reference.

GAM7957 target gene, herein designated TARGET GENE, encodes a corresponding messenger RNA, GAM7957 target RNA, herein designated GAM TARGET RNA. GAM7957 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM7957 RNA, herein designated GAM RNA, binds complementarily to one or more target binding sites located in untranslated regions of GAM7957 target RNA, herein designated GAM TARGET RNA. This complementary binding is due to the fact that the nucleotide sequence of GAM7957 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM7957 RNA may have a different number of target binding sites in untranslated regions of a GAM7957 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM7957 RNA, herein designated GAM RNA, to target binding sites on GAM7957 target RNA, herein designated GAM TARGET RNA, such as BINDING SITE I, BINDING SITE II and BINDING SITE III, inhibits translation of GAM7957 target RNA into GAM7957 target protein, herein designated GAM TARGET PROTEIN. GAM target protein is therefore outlined by a broken line.

It is appreciated that GAM7957 target gene, herein designated TARGET GENE, in fact represents a plurality of GAM7957 target genes. The mRNA of each one of this plurality of GAM7957 target genes comprises one or more target binding sites, each having a nucleotide sequence which is at least partly complementary to GAM7957 RNA, herein designated GAM RNA, and which when bound by GAM7957 RNA causes inhibition of translation of respective one or more GAM7957 target proteins.

It is further appreciated by one skilled in the art that the mode of translational inhibition illustrated by FIG. 8 with specific reference to translational inhibition exerted by GAM7957 gene, herein designated GAM GENE, on one or more GAM7957 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM7957 correlate with, and may be deduced from, the identity of the target genes which GAM7957 binds and inhibits, and the function of these target genes, as elaborated hereinbelow.

15E1.2 (Accession XP_290596.1) is a GAM7957 target gene, herein designated TARGET GENE. 15E1.2 BINDING SITE is a target binding site found in the 3' untranslated region of mRNA encoded by 15E1.2, corresponding to a target binding site such as BINDING SITE I, BINDING SITE II or BINDING SITE III of FIG. 8. Table 4 illustrates the complementarity of the nucleotide sequences of 15E1.2 BINDING SITE, designated SEQ ID:13155, to the nucleotide sequence of GAM7957 RNA, herein designated GAM RNA, also designated SEQ ID:297.

A function of GAM7957 is therefore inhibition of 15E1.2 (Accession XP_290596.1). Accordingly, utilities of GAM7957 include diagnosis, prevention and treatment of diseases and clinical conditions associated with 15E1.2.

3PAP (Accession NP_061934.2) is another GAM7957 target gene, herein designated TARGET GENE. 3PAP BINDING SITE is a target binding site found in the 3' untranslated region of mRNA encoded by 3PAP, corresponding to a target binding site such as BINDING SITE I, BINDING SITE II or BINDING SITE III of FIG. 8. Table 4 illustrates the complementarity of the nucleotide sequences of 3PAP BINDING SITE, designated SEQ ID:868, to the nucleotide sequence of GAM7957 RNA, herein designated GAM RNA, also designated SEQ ID:297.

Another function of GAM7957 is therefore inhibition of 3PAP (Accession NP_061934.2). Accordingly, utilities of GAM7957 include diagnosis, prevention and treatment of diseases and clinical conditions associated with 3PAP.

Atp-binding cassette, sub-family c (cftr/mrp), member 13 (ABCC13, Accession NP_742021.1) is another GAM7957 target gene, herein designated TARGET GENE. ABCC13 BINDING SITE is a target binding site found in the 3' untranslated region of multiple transcripts of mRNA encoded by ABCC13, corresponding to a target binding site such as BINDING SITE I, BINDING SITE II or BINDING SITE III of FIG. 8. Table 4 illustrates the complementarity of the nucleotide sequences of ABCC13 BINDING SITE, designated SEQ ID:2331, to the nucleotide sequence of GAM7957 RNA, herein designated GAM RNA, also designated SEQ ID:297.

Another function of GAM7957 is therefore inhibition of Atp-binding cassette, sub-family c (cftr/mrp), member 13 (ABCC13, Accession NP_742021.1). Accordingly, utilities of GAM7957 include diagnosis, prevention and treatment of diseases and clinical conditions associated with ABCC13.

Atp-binding cassette, sub-family f (gcn20), member 2 (ABCF2, Accession NP_009120.1) is another GAM7957 target gene, herein designated TARGET GENE. ABCF2 BINDING SITE1 and ABCF2 BINDING SITE2 are target binding sites found in untranslated regions of multiple transcripts of mRNA encoded by ABCF2, corresponding to target binding sites such as BINDING SITE I, BINDING SITE II or BINDING SITE III of FIG. 8. Table 4 illustrates the complementarity of the nucleotide sequences of ABCF2 BINDING SITE1 and ABCF2 BINDING SITE2, designated SEQ ID:7251 and SEQ ID:3809 respectively, to the nucleotide sequence of GAM7957 RNA, herein designated GAM RNA, also designated SEQ ID:297.

Another function of GAM7957 is therefore inhibition of Atp-binding cassette, sub-family f (gcn20), member 2 (ABCF2, Accession NP_009120.1). Accordingly, utilities of GAM7957 include diagnosis, prevention and treatment of diseases and clinical conditions associated with ABCF2.

V-abl abelson murine leukemia viral oncogene homolog 1 (ABL1, Accession NP_005148.1) is another GAM7957 target gene, herein designated TARGET GENE. ABL1 BINDING SITE is a target binding site found in the 3' untranslated region of multiple transcripts of mRNA encoded by ABL1, corresponding to a target binding site such as BINDING SITE I, BINDING SITE II or BINDING SITE III of FIG. 8. Table 4 illustrates the complementarity of the nucleotide sequences of ABL1 BINDING SITE, designated SEQ ID:4947, to the nucleotide sequence of GAM7957 RNA, herein designated GAM RNA, also designated SEQ ID:297.

Another function of GAM7957 is therefore inhibition of V-abl abelson murine leukemia viral oncogene homolog 1 (ABL1, Accession NP_005148.1). Accordingly, utilities of GAM7957 include diagnosis, prevention and treatment of diseases and clinical conditions associated with ABL1.

V-abl abelson murine leukemia viral oncogene homolog 1 (ABL1, Accession NP_009297.1) is another GAM7957 target gene, herein designated TARGET GENE. ABL1 BINDING SITE is a target binding site found in the 3' untranslated region of multiple transcripts of mRNA encoded by ABL1, corresponding to a target binding site such as BINDING SITE I, BINDING SITE II or BINDING SITE III of FIG. 8. Table 4 illustrates the complementarity of the nucleotide sequences of ABL1 BINDING SITE, designated SEQ ID:4947, to the nucleotide sequence of GAM7957 RNA, herein designated GAM RNA, also designated SEQ ID:297.

Another function of GAM7957 is therefore inhibition of V-abl abelson murine leukemia viral oncogene homolog 1 (ABL1, Accession NP_009297.1). Accordingly, utilities of GAM7957 include diagnosis, prevention and treatment of diseases and clinical conditions associated with ABL1.

Actin binding lim protein 1 (ABLIM1, Accession NP_002304.2) is another GAM7957 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:16503, to the nucleotide sequence of GAM7957 RNA, herein designated GAM RNA, also designated SEQ ID:297.

Another function of GAM7957 is therefore inhibition of Actin binding lim protein 1 (ABLIM1, Accession NP_002304.2). Accordingly, utilities of GAM7957 include diagnosis, prevention and treatment of diseases and clinical conditions associated with ABLIM1.

Actin binding lim protein 1 (ABLIM1, Accession NP_006711.2) is another GAM7957 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:16503, to the nucleotide sequence of GAM7957 RNA, herein designated GAM RNA, also designated SEQ ID:297.

Another function of GAM7957 is therefore inhibition of Actin binding lim protein 1 (ABLIM1, Accession NP_006711.2). Accordingly, utilities of GAM7957 include diagnosis, prevention and treatment of diseases and clinical conditions associated with ABLIM1.

Actin binding lim protein 1 (ABLIM1, Accession NP_006710.2) is another GAM7957 target gene, herein designated TARGET GENE. ABLIM1 BINDING SITE is a target binding site found in the 3' untranslated region of multiple transcripts of mRNA encoded by ABLIM1, corresponding to a target binding site such as BINDING SITE I, BINDING SITE II or BINDING SITE III of FIG. 8. Table 4 illustrates the complementarity of the nucleotide sequences of ABLIM1 BINDING SITE, designated SEQ ID:16503, to the nucleotide sequence of GAM7957 RNA, herein designated GAM RNA, also designated SEQ ID:297.

Another function of GAM7957 is therefore inhibition of Actin binding lim protein 1 (ABLIM1, Accession NP_006710.2). Accordingly, utilities of GAM7957 include diagnosis, prevention and treatment of diseases and clinical conditions associated with ABLIM1.

ACATE2 (Accession NP_036464.1) is another GAM7957 target gene, herein designated TARGET GENE. ACATE2 BINDING SITE is a target binding site found in the 3' untranslated region of mRNA encoded by ACATE2, corresponding to a target binding site such as BINDING SITE I, BINDING SITE II or BINDING SITE III of FIG. 8. Table 4 illustrates the complementarity of the nucleotide sequences of ACATE2 BINDING SITE, designated SEQ ID:10237, to the nucleotide sequence of GAM7957 RNA, herein designated GAM RNA, also designated SEQ ID:297.

Another function of GAM7957 is therefore inhibition of ACATE2 (Accession NP_036464.1). Accordingly, utilities of GAM7957 include diagnosis, prevention and treatment of diseases and clinical conditions associated with ACATE2.

Angiotensin i converting enzyme (peptidyl-dipeptidase a) 1 (ACE, Accession NP_690044.1) is another GAM7957 target gene, herein designated TARGET GENE. ACE BINDING SITE is a target binding site found in the 3' untranslated region of multiple transcripts of mRNA encoded by ACE, corresponding to a target binding site such as BINDING SITE I, BINDING SITE II or BINDING SITE III of FIG. 8. Table 4 illustrates the complementarity of the nucleotide sequences of ACE BINDING SITE, designated SEQ ID:3398, to the nucleotide sequence of GAM7957 RNA, herein designated GAM RNA, also designated SEQ ID:297.

Another function of GAM7957 is therefore inhibition of Angiotensin i converting enzyme (peptidyl-dipeptidase a) 1 (ACE, Accession NP_690044.1), a gene which Angiotensin I-converting enzyme (dipeptidyl carboxypeptidase 1).

Accordingly, utilities of GAM7957 include diagnosis, prevention and treatment of diseases and clinical conditions associated with ACE.

The function of ACE and its association with various diseases and clinical conditions, has been established by previous studies, as described hereinabove with reference to GAM44.1. A disintegrin-like and metalloprotease (reprolysin type) with thrombospondin type 1 motif, 12 (ADAMTS12, Accession NP_112217.1) is another GAM7957 target gene, herein designated TARGET GENE. ADAMTS12 BINDING SITE is a target binding site found in the 5' untranslated region of mRNA encoded by ADAMTS12, corresponding to a target binding site such as BINDING SITE I, BINDING SITE II or BINDING SITE III of FIG. 8. Table 4 illustrates the complementarity of the nucleotide sequences of ADAMTS12 BINDING SITE, designated SEQ ID:7897, to the nucleotide sequence of GAM7957 RNA, herein designated GAM RNA, also designated SEQ ID:297.

Another function of GAM7957 is therefore inhibition of A disintegrin-like and metalloprotease (reprolysin type) with thrombospondin type 1 motif, 12 (ADAMTS12, Accession NP_112217.1). Accordingly, utilities of GAM7957 include diagnosis, prevention and treatment of diseases and clinical conditions associated with ADAMTS12.

A disintegrin-like and metalloprotease (reprolysin type) with thrombospondin type 1 motif, 4 (ADAMTS4, Accession NP_005090.1) is another GAM7957 target gene, herein designated TARGET GENE. ADAMTS4 BINDING SITE is a target binding site found in the 3' untranslated region of mRNA encoded by ADAMTS4, corresponding to a target binding site such as BINDING SITE I, BINDING SITE II or BINDING SITE III of FIG. 8. Table 4 illustrates the complementarity of the nucleotide sequences of ADAMTS4 BINDING SITE, designated SEQ ID:15594, to the nucleotide sequence of GAM7957 RNA, herein designated GAM RNA, also designated SEQ ID:297.

Another function of GAM7957 is therefore inhibition of A disintegrin-like and metalloprotease (reprolysin type) with thrombospondin type 1 motif, 4 (ADAMTS4, Accession NP_005090.1), a gene which cleaves aggrecan, a cartilage proteoglycan, and may be involved in its turnover. Accordingly, utilities of GAM7957 include diagnosis, prevention and treatment of diseases and clinical conditions associated with ADAMTS4.

The function of ADAMTS4 and its association with various diseases and clinical conditions, has been established by previous studies, as described hereinabove with reference to GAM189.1. ADAR3 (Accession NP_061172.1) is another GAM7957 target gene, herein designated TARGET GENE. ADAR3 BINDING SITE is a target binding site found in the 5' untranslated region of mRNA encoded by ADAR3, corresponding to a target binding site such as BINDING SITE I, BINDING SITE II or BINDING SITE III of FIG. 8. Table 4 illustrates the complementarity of the nucleotide sequences of ADAR3 BINDING SITE, designated SEQ ID:6712, to the nucleotide sequence of GAM7957 RNA, herein designated GAM RNA, also designated SEQ ID:297.

Another function of GAM7957 is therefore inhibition of ADAR3 (Accession NP_061172.1). Accordingly, utilities of GAM7957 include diagnosis, prevention and treatment of diseases and clinical conditions associated with ADAR3.

Adenosine deaminase, trna-specific 1 (ADAT1, Accession NP_036223.1) is another GAM7957 target gene, herein designated TARGET GENE. ADAT1 BINDING SITE is a target binding site found in the 3' untranslated region of mRNA encoded by ADAT1, corresponding to a target binding site such as BINDING SITE I, BINDING SITE II or BINDING SITE III of FIG. 8. Table 4 illustrates the complementarity of the nucleotide sequences of ADAT1 BINDING SITE, designated SEQ ID:15089, to the nucleotide sequence of GAM7957 RNA, herein designated GAM RNA, also designated SEQ ID:297.

Another function of GAM7957 is therefore inhibition of Adenosine deaminase, trna-specific 1 (ADAT1, Accession NP_036223.1), a gene which TRNA-specific adenosine deaminase; deaminates A(37) in the anticodon loop of tRNA (Ala). Accordingly, utilities of GAM7957 include diagnosis, prevention and treatment of diseases and clinical conditions associated with ADAT1.

The function of ADAT1 and its association with various diseases and clinical conditions, has been established by previous studies, as described hereinabove with reference to GAM236.1. Adenylate cyclase 1 (brain) (ADCY1, Accession NP_066939.1) is another GAM7957 target gene, herein designated TARGET GENE. ADCY1 BINDING SITE1 and ADCY1 BINDING SITE2 are target binding sites found in untranslated regions of multiple transcripts of mRNA encoded by ADCY1, corresponding to target binding sites such as BINDING SITE I, BINDING SITE II or BINDING SITE III of FIG. 8. Table 4 illustrates the complementarity of the nucleotide sequences of ADCY1 BINDING SITE1 and ADCY1 BINDING SITE2, designated SEQ ID:18690 and SEQ ID:17764 respectively, to the nucleotide sequence of GAM7957 RNA, herein designated GAM RNA, also designated SEQ ID:297.

Another function of GAM7957 is therefore inhibition of Adenylate cyclase 1 (brain) (ADCY1, Accession NP_066939.1), a gene which a calmodulin-sensitive adenylyl cyclase. it may play a role in memory acquisition and learning. Accordingly, utilities of GAM7957 include diagnosis, prevention and treatment of diseases and clinical conditions associated with ADCY1.

The function of ADCY1 and its association with various diseases and clinical conditions, has been established by previous studies, as described hereinabove with reference to GAM144.1. Adenylate cyclase activating polypeptide 1 (pituitary) (ADCYAP1, Accession NP_001108.1) is another GAM7957 target gene, herein designated TARGET GENE. ADCYAP1 BINDING SITE is a target binding site found in the 3' untranslated region of mRNA encoded by ADCYAP1, corresponding to a target binding site such as BINDING SITE I, BINDING SITE II or BINDING SITE III of FIG. 8. Table 4 illustrates the complementarity of the nucleotide sequences of ADCYAP1 BINDING SITE, designated SEQ ID:13163, to the nucleotide sequence of GAM7957 RNA, herein designated GAM RNA, also designated SEQ ID:297.

Another function of GAM7957 is therefore inhibition of Adenylate cyclase activating polypeptide 1 (pituitary) (ADCYAP1, Accession NP_001108.1). Accordingly, utilities of GAM7957 include diagnosis, prevention and treatment of diseases and clinical conditions associated with ADCYAP1.

Alcohol dehydrogenase 4 (class ii), pi polypeptide (ADH4, Accession NP_000661.1) is another GAM7957 target gene, herein designated TARGET GENE. ADH4 BINDING SITE is a target binding site found in the 5' untranslated region of mRNA encoded by ADH4, corresponding to a target binding site such as BINDING SITE I, BINDING SITE II or BINDING SITE III of FIG. 8. Table 4 illustrates the complementarity of the nucleotide sequences of ADH4 BINDING SITE, designated SEQ ID:8767, to the nucleotide sequence of GAM7957 RNA, herein designated GAM RNA, also designated SEQ ID:297.

Another function of GAM7957 is therefore inhibition of Alcohol dehydrogenase 4 (class ii), pi polypeptide (ADH4, Accession NP_000661.1). Accordingly, utilities of GAM7957 include diagnosis, prevention and treatment of diseases and clinical conditions associated with ADH4.

AF020591 (Accession NP_055295.1) is another GAM7957 target gene, herein designated TARGET GENE. AF020591 BINDING SITE1 and AF020591 BINDING SITE2 are target binding sites found in untranslated regions of mRNA encoded by AF020591, corresponding to target binding sites such as BINDING SITE I, BINDING SITE II or BINDING SITE III of FIG. 8. Table 4 illustrates the complementarity of the nucleotide sequences of AF020591 BINDING SITE1 and AF020591 BINDING SITE2, designated SEQ ID:5252 and SEQ ID:10612 respectively, to the nucleotide sequence of GAM7957 RNA, herein designated GAM RNA, also designated SEQ ID:297.

Another function of GAM7957 is therefore inhibition of AF020591 (Accession NP_055295.1). Accordingly, utilities of GAM7957 include diagnosis, prevention and treatment of diseases and clinical conditions associated with AF020591.

Agmatine ureohydrolase (agmatinase) (AGMAT, Accession NP_079034.2) is another GAM7957 target gene, herein designated TARGET GENE. AGMAT BINDING SITE is a target binding site found in the 3' untranslated region of mRNA encoded by AGMAT, corresponding to a target binding site such as BINDING SITE I, BINDING SITE II or BINDING SITE III of FIG. 8. Table 4 illustrates the complementarity of the nucleotide sequences of AGMAT BINDING SITE, designated SEQ ID:17097, to the nucleotide sequence of GAM7957 RNA, herein designated GAM RNA, also designated SEQ ID:297.

Another function of GAM7957 is therefore inhibition of Agmatine ureohydrolase (agmatinase) (AGMAT, Accession NP_079034.2). Accordingly, utilities of GAM7957 include diagnosis, prevention and treatment of diseases and clinical conditions associated with AGMAT.

Agouti related protein homolog (mouse) (AGRP, Accession NP_001129.1) is another GAM7957 target gene, herein designated TARGET GENE. AGRP BINDING SITE is a target binding site found in the 5' untranslated region of multiple transcripts of mRNA encoded by AGRP, corresponding to a target binding site such as BINDING SITE I, BINDING SITE II or BINDING SITE III of FIG. 8. Table 4 illustrates the complementarity of the nucleotide sequences of AGRP BINDING SITE, designated SEQ ID:6741, to the nucleotide sequence of GAM7957 RNA, herein designated GAM RNA, also designated SEQ ID:297.

Another function of GAM7957 is therefore inhibition of Agouti related protein homolog (mouse) (AGRP, Accession NP_001129.1), a gene which plays a role in weight homeostasis. and therefore may be associated with Obesity. Accordingly, utilities of GAM7957 include diagnosis, prevention and treatment of Obesity, and of other diseases and clinical conditions associated with AGRP.

The function of AGRP and its association with various diseases and clinical conditions, has been established by previous studies, as described hereinabove with reference to GAM385.2. Aryl hydrocarbon receptor (AHR, Accession NP_001612.1) is another GAM7957 target gene, herein designated TARGET GENE. AHR BINDING SITE is a target binding site found in the 3' untranslated region of mRNA encoded by AHR, corresponding to a target binding site such as BINDING SITE I, BINDING SITE II or BINDING SITE III of FIG. 8. Table 4 illustrates the complementarity of the nucleotide sequences of AHR BINDING SITE, designated SEQ ID:4150, to the nucleotide sequence of GAM7957 RNA, herein designated GAM RNA, also designated SEQ ID:297.

Another function of GAM7957 is therefore inhibition of Aryl hydrocarbon receptor (AHR, Accession NP_001612.1), a gene which plays a role in modulating carcinogenesis through the induction of xenobiotic-metabolizing enzymes and therefore may be associated with Stomach tumors. Accordingly, utilities of GAM7957 include diagnosis, prevention and treatment of Stomach tumors, and of other diseases and clinical conditions associated with AHR.

The function of AHR and its association with various diseases and clinical conditions, has been established by previous studies, as described hereinabove with reference to GAM30.1. Aryl hydrocarbon receptor interacting protein-like 1 (AIPL1, Accession NP_055151.2) is another GAM7957 target gene, herein designated TARGET GENE. AIPL1 BINDING SITE is a target binding site found in the 3' untranslated region of mRNA encoded by AIPL1, corresponding to a target binding site such as BINDING SITE I, BINDING SITE II or BINDING SITE III of FIG. 8. Table 4 illustrates the complementarity of the nucleotide sequences of AIPL1 BINDING SITE, designated SEQ ID:14786, to the nucleotide sequence of GAM7957 RNA, herein designated GAM RNA, also designated SEQ ID:297.

Another function of GAM7957 is therefore inhibition of Aryl hydrocarbon receptor interacting protein-like 1 (AIPL1, Accession NP_055151.2). Accordingly, utilities of GAM7957 include diagnosis, prevention and treatment of diseases and clinical conditions associated with AIPL1.

Autoimmune regulator (autoimmmune polyendocrinopathy candidiasis ectodermal dystrophy) (AIRE, Accession NP_000374.1) is another GAM7957 target gene, herein designated TARGET GENE. AIRE BINDING SITE is a target binding site found in the 3' untranslated region of multiple transcripts of mRNA encoded by AIRE, corresponding to a target binding site such as BINDING SITE I, BINDING SITE II or BINDING SITE III of FIG. 8. Table 4 illustrates the complementarity of the nucleotide sequences of AIRE BINDING SITE, designated SEQ ID:18688, to the nucleotide sequence of GAM7957 RNA, herein designated GAM RNA, also designated SEQ ID:297.

Another function of GAM7957 is therefore inhibition of Autoimmune regulator (autoimmmune polyendocrinopathy candidiasis ectodermal dystrophy) (AIRE, Accession NP_000374.1), a gene which Putative transcription factor; contains two PHD- type zinc finger motifs. and therefore is associated with Autoimmune poly-endocrinopathy syndrome. Accordingly, utilities of GAM7957 include diagnosis, prevention and treatment of Autoimmune poly-endocrinopathy syndrome, and of other diseases and clinical conditions associated with AIRE.

The function of AIRE and its association with various diseases and clinical conditions, has been established by previous studies, as described hereinabove with reference to GAM347.1. A kinase (prka) anchor protein 11 (AKAP11, Accession NP_652761.1) is another GAM7957 target gene, herein designated TARGET GENE. AKAP11 BINDING SITE is a target binding site found in the 3' untranslated region of multiple transcripts of mRNA encoded by AKAP11, corresponding to a target binding site such as BINDING SITE I, BINDING SITE II or BINDING SITE III of FIG. 8. Table 4 illustrates the complementarity of the nucleotide sequences of AKAP11 BINDING SITE, designated SEQ ID:3323, to the nucleotide sequence of GAM7957 RNA, herein designated GAM RNA, also designated SEQ ID:297.

Another function of GAM7957 is therefore inhibition of A kinase (prka) anchor protein 11 (AKAP11, Accession NP_652761.1). Accordingly, utilities of GAM7957 include diagnosis, prevention and treatment of diseases and clinical conditions associated with AKAP11.

Aldo-keto reductase family 1, member b10 (aldose reductase) (AKR1B10, Accession NP_064695.2) is another GAM7957 target gene, herein designated TARGET GENE. AKR1B10 BINDING SITE1 and AKR1B10 BINDING SITE2 are target binding sites found in untranslated regions of mRNA encoded by AKR1B10, corresponding to target binding sites such as BINDING SITE I, BINDING SITE II or BINDING SITE III of FIG. 8. Table 4 illustrates the complementarity of the nucleotide sequences of AKR1B10 BINDING SITE1 and AKR1B10 BINDING SITE2, designated SEQ ID:10437 and SEQ ID:15089 respectively, to the nucleotide sequence of GAM7957 RNA, herein designated GAM RNA, also designated SEQ ID:297.

Another function of GAM7957 is therefore inhibition of Aldo-keto reductase family 1, member b10 (aldose reductase) (AKR1B10, Accession NP_064695.2). Accordingly, utilities of GAM7957 include diagnosis, prevention and treatment of diseases and clinical conditions associated with AKR1B10.

Aldo-keto reductase family 1, member d1 (delta 4-3-ketosteroid-5-beta-reductase) (AKR1D1, Accession NP_005980.1) is another GAM7957 target gene, herein designated TARGET GENE. AKR1D1 BINDING SITE is a target binding site found in the 3' untranslated region of mRNA encoded by AKR1D1, corresponding to a target binding site such as BINDING SITE I, BINDING SITE II or BINDING SITE III of FIG. 8. Table 4 illustrates the complementarity of the nucleotide sequences of AKR1D1 BINDING SITE, designated SEQ ID:19497, to the nucleotide sequence of GAM7957 RNA, herein designated GAM RNA, also designated SEQ ID:297.

Another function of GAM7957 is therefore inhibition of Aldo-keto reductase family 1, member d1 (delta 4-3-ketosteroid-5-beta-reductase) (AKR1D1, Accession NP_005980.1). Accordingly, utilities of GAM7957 include diagnosis, prevention and treatment of diseases and clinical conditions associated with AKR1D1.

Aldehyde dehydrogenase 3 family, member b1 (ALDH3B1, Accession NP_000685.1) is another GAM7957 target gene, herein designated TARGET GENE. ALDH3B1 BINDING SITE1 through ALDH3B1 BINDING SITE3 are target binding sites found in untranslated regions of mRNA encoded by ALDH3B1, corresponding to target binding sites such as BINDING SITE I, BINDING SITE II or BINDING SITE III of FIG. 8. Table 4 illustrates the complementarity of the nucleotide sequences of ALDH3B1 BINDING SITE1 through ALDH3B1 BINDING SITE3, designated SEQ ID:15516, SEQ ID:14700 and SEQ ID:10057 respectively, to the nucleotide sequence of GAM7957 RNA, herein designated GAM RNA, also designated SEQ ID:297.

Another function of GAM7957 is therefore inhibition of Aldehyde dehydrogenase 3 family, member b1 (ALDH3B1, Accession NP_000685.1), a gene which may play a major role in the detoxification of aldehydes generated by alcohol metabolism and lipid peroxidation. Accordingly, utilities of GAM7957 include diagnosis, prevention and treatment of diseases and clinical conditions associated with ALDH3B1.

The function of ALDH3B1 and its association with various diseases and clinical conditions, has been established by previous studies, as described hereinabove with reference to GAM223.1. Aldehyde dehydrogenase 5 family, member a1 (succinate-semialdehyde dehydrogenase) (ALDH5A1, Accession NP_733936.1) is another GAM7957 target gene, herein designated TARGET GENE. ALDH5A1 BINDING SITE is a target binding site found in the 3' untranslated region of multiple transcripts of mRNA encoded by ALDH5A1, corresponding to a target binding site such as BINDING SITE I, BINDING SITE II or BINDING SITE III of FIG. 8. Table 4 illustrates the complementarity of the nucleotide sequences of ALDH5A1 BINDING SITE, designated SEQ ID:6817, to the nucleotide sequence of GAM7957 RNA, herein designated GAM RNA, also designated SEQ ID:297.

Another function of GAM7957 is therefore inhibition of Aldehyde dehydrogenase 5 family, member a1 (succinate-semialdehyde dehydrogenase) (ALDH5A1, Accession NP_733936.1). Accordingly, utilities of GAM7957 include diagnosis, prevention and treatment of diseases and clinical conditions associated with ALDH5A1.

Aldehyde dehydrogenase 5 family, member a1 (succinate-semialdehyde dehydrogenase) (ALDH5A1, Accession NP_001071.1) is another GAM7957 target gene, herein designated TARGET GENE. ALDH5A1 BINDING SITE is a target binding site found in the 3' untranslated region of multiple transcripts of mRNA encoded by ALDH5A1, corresponding to a target binding site such as BINDING SITE I, BINDING SITE II or BINDING SITE III of FIG. 8. Table 4 illustrates the complementarity of the nucleotide sequences of ALDH5A1 BINDING SITE, designated SEQ ID:6817, to the nucleotide sequence of GAM7957 RNA, herein designated GAM RNA, also designated SEQ ID:297.

Another function of GAM7957 is therefore inhibition of Aldehyde dehydrogenase 5 family, member a1 (succinate-semialdehyde dehydrogenase) (ALDH5A1, Accession NP_001071.1). Accordingly, utilities of GAM7957 include diagnosis, prevention and treatment of diseases and clinical conditions associated with ALDH5A1.

Aldehyde dehydrogenase 8 family, member a1 (ALDH8A1, Accession NP_739577.1) is another GAM7957 target gene, herein designated TARGET GENE. ALDH8A1 BINDING SITE is a target binding site found in the 3' untranslated region of multiple transcripts of mRNA encoded by ALDH8A1, corresponding to a target binding site such as BINDING SITE I, BINDING SITE II or BINDING SITE III of FIG. 8. Table 4 illustrates the complementarity of the nucleotide sequences of ALDH8A1 BINDING SITE, designated SEQ ID:15129, to the nucleotide sequence of GAM7957 RNA, herein designated GAM RNA, also designated SEQ ID:297.

Another function of GAM7957 is therefore inhibition of Aldehyde dehydrogenase 8 family, member a1 (ALDH8A1, Accession NP_739577.1). Accordingly, utilities of GAM7957 include diagnosis, prevention and treatment of diseases and clinical conditions associated with ALDH8A1.

Aldehyde dehydrogenase 8 family, member a1 (ALDH8A1, Accession NP_072090.1) is another GAM7957 target gene, herein designated TARGET GENE. ALDH8A1 BINDING SITE is a target binding site found in the 3' untranslated region of multiple transcripts of mRNA encoded by ALDH8A1, corresponding to a target binding site such as BINDING SITE I, BINDING SITE II or BINDING SITE III of FIG. 8. Table 4 illustrates the complementarity of the nucleotide sequences of ALDH8A1 BINDING SITE, designated SEQ ID:15129, to the nucleotide sequence of GAM7957 RNA, herein designated GAM RNA, also designated SEQ ID:297.

Another function of GAM7957 is therefore inhibition of Aldehyde dehydrogenase 8 family, member a1 (ALDH8A1, Accession NP_072090.1). Accordingly, utilities of GAM7957 include diagnosis, prevention and treatment of diseases and clinical conditions associated with ALDH8A1.

Alkaline phosphatase, placental (regan isozyme) (ALPP, Accession NP_001623.2) is another GAM7957 target gene, herein designated TARGET GENE. ALPP BINDING SITE is a target binding site found in the 3' untranslated region of mRNA encoded by ALPP, corresponding to a target binding site such as BINDING SITE I, BINDING SITE II or BINDING SITE III of FIG. 8. Table 4 illustrates the complementarity of the nucleotide sequences of ALPP BINDING SITE, designated SEQ ID:15341, to the nucleotide sequence of GAM7957 RNA, herein designated GAM RNA, also designated SEQ ID:297.

Another function of GAM7957 is therefore inhibition of Alkaline phosphatase, placental (regan isozyme) (ALPP, Accession NP_001623.2), a gene which is a placental alkaline phosphatase. Accordingly, utilities of GAM7957 include diagnosis, prevention and treatment of diseases and clinical conditions associated with ALPP.

The function of ALPP and its association with various diseases and clinical conditions, has been established by previous studies, as described hereinabove with reference to GAM206.1. Reserved (ALS2CR9, Accession NP_079528.1) is another GAM7957 target gene, herein designated TARGET GENE. ALS2CR9 BINDING SITE is a target binding site found in the 5' untranslated region of mRNA encoded by ALS2CR9, corresponding to a target binding site such as BINDING SITE I, BINDING SITE II or BINDING SITE III of FIG. 8. Table 4 illustrates the complementarity of the nucleotide sequences of ALS2CR9 BINDING SITE, designated SEQ ID:16955, to the nucleotide sequence of GAM7957 RNA, herein designated GAM RNA, also designated SEQ ID:297.

Another function of GAM7957 is therefore inhibition of Reserved (ALS2CR9, Accession NP_079528.1). Accordingly, utilities of GAM7957 include diagnosis, prevention and treatment of diseases and clinical conditions associated with ALS2CR9.

Ac-like transposable element (ALTE, Accession NP_004720.1) is another GAM7957 target gene, herein designated TARGET GENE. ALTE BINDING SITE is a target binding site found in the 3' untranslated region of mRNA encoded by ALTE, corresponding to a target binding site such as BINDING SITE I, BINDING SITE II or BINDING SITE III of FIG. 8. Table 4 illustrates the complementarity of the nucleotide sequences of ALTE BINDING SITE, designated SEQ ID:6238, to the nucleotide sequence of GAM7957 RNA, herein designated GAM RNA, also designated SEQ ID:297.

Another function of GAM7957 is therefore inhibition of Ac-like transposable element (ALTE, Accession NP_004720.1). Accordingly, utilities of GAM7957 include diagnosis, prevention and treatment of diseases and clinical conditions associated with ALTE.

ANAPC7 (Accession NP_057322.1) is another GAM7957 target gene, herein designated TARGET GENE. ANAPC7 BINDING SITE is a target binding site found in the 5' untranslated region of mRNA encoded by ANAPC7, corresponding to a target binding site such as BINDING SITE I, BINDING SITE II or BINDING SITE III of FIG. 8. Table 4 illustrates the complementarity of the nucleotide sequences of ANAPC7 BINDING SITE, designated SEQ ID:17768, to the nucleotide sequence of GAM7957 RNA, herein designated GAM RNA, also designated SEQ ID:297.

Another function of GAM7957 is therefore inhibition of ANAPC7 (Accession NP_057322.1). Accordingly, utilities of GAM7957 include diagnosis, prevention and treatment of diseases and clinical conditions associated with ANAPC7.

ANKFY1 (Accession NP_057460.2) is another GAM7957 target gene, herein designated TARGET GENE. ANKFY1 BINDING SITE is a target binding site found in the 3' untranslated region of multiple transcripts of mRNA encoded by ANKFY1, corresponding to a target binding site such as BINDING SITE I, BINDING SITE II or BINDING SITE III of FIG. 8. Table 4 illustrates the complementarity of the nucleotide sequences of ANKFY1 BINDING SITE, designated SEQ ID:17805, to the nucleotide sequence of GAM7957 RNA, herein designated GAM RNA, also designated SEQ ID:297.

Another function of GAM7957 is therefore inhibition of ANKFY1 (Accession NP_057460.2). Accordingly, utilities of GAM7957 include diagnosis, prevention and treatment of diseases and clinical conditions associated with ANKFY1.

Ankylosis, progressive homolog (mouse) (ANKH, Accession NP_473368.1) is another GAM7957 target gene, herein designated TARGET GENE. ANKH BINDING SITE is a target binding site found in the 3' untranslated region of multiple transcripts of mRNA encoded by ANKH, corresponding to a target binding site such as BINDING SITE I, BINDING SITE II or BINDING SITE III of FIG. 8. Table 4 illustrates the complementarity of the nucleotide sequences of ANKH BINDING SITE, designated SEQ ID:6937, to the nucleotide sequence of GAM7957 RNA, herein designated GAM RNA, also designated SEQ ID:297.

Another function of GAM7957 is therefore inhibition of Ankylosis, progressive homolog (mouse) (ANKH, Accession NP_473368.1), a gene which regulates intra- and extracellular levels of inorganic pyrophosphate (ppi), probably functioning as ppi transporter. and therefore is associated with Craniometaphyseal dysplasia. Accordingly, utilities of GAM7957 include diagnosis, prevention and treatment of Craniometaphyseal dysplasia, and of other diseases and clinical conditions associated with ANKH.

The function of ANKH and its association with various diseases and clinical conditions, has been established by previous studies, as described hereinabove with reference to GAM347.2. Acyloxyacyl hydrolase (neutrophil) (AOAH, Accession NP_001628.1) is another GAM7957 target gene, herein designated TARGET GENE. AOAH BINDING SITE is a target binding site found in the 3' untranslated region of mRNA encoded by AOAH, corresponding to a target binding site such as BINDING SITE I, BINDING SITE II or BINDING SITE III of FIG. 8. Table 4 illustrates the complementarity of the nucleotide sequences of AOAH BINDING SITE, designated SEQ ID:3636, to the nucleotide sequence of GAM7957 RNA, herein designated GAM RNA, also designated SEQ ID:297.

Another function of GAM7957 is therefore inhibition of Acyloxyacyl hydrolase (neutrophil) (AOAH, Accession NP_001628.1), a gene which removes the secondary (acyloxyacyl-linked) fatty acyl chains from the lipid a region of bacterial lipopolysaccharides. and therefore may be associated with Gram-negative bacterium infection. Accordingly, utilities of GAM7957 include diagnosis, prevention and treatment of Gram-negative bacterium infection., and of other diseases and clinical conditions associated with AOAH.

The function of AOAH and its association with various diseases and clinical conditions, has been established by previous studies, as described hereinabove with reference to GAM1255.2. Ap1 gamma subunit binding protein 1 (AP1GBP1, Accession NP_542118.1) is another GAM7957 target gene, herein designated TARGET GENE. AP1GBP1 BINDING SITE is a target binding site found in the 3' untranslated region of multiple transcripts of mRNA encoded by AP1GBP1, corresponding to a target binding site such as BINDING SITE I, BINDING SITE II or BINDING SITE III of FIG. 8. Table 4 illustrates the complementarity of the nucleotide sequences of AP1GBP1 BINDING SITE, designated SEQ ID:9627, to the nucleotide sequence of GAM7957 RNA, herein designated GAM RNA, also designated SEQ ID:297.

Another function of GAM7957 is therefore inhibition of Ap1 gamma subunit binding protein 1 (AP1GBP1, Accession NP_542118.1). Accordingly, utilities of GAM7957 include diagnosis, prevention and treatment of diseases and clinical conditions associated with AP1GBP1.

AP1S3 (Accession NP_848929.1) is another GAM7957 target gene, herein designated TARGET GENE. AP1S3 BINDING SITE1 and AP1S3 BINDING SITE2 are target binding sites found in untranslated regions of multiple transcripts of mRNA encoded by AP1S3, corresponding to target binding sites such as BINDING SITE I, BINDING SITE II or BINDING SITE III of FIG. 8. Table 4 illustrates the complementarity of the nucleotide sequences of AP1S3 BINDING SITE1 and AP1S3 BINDING SITE2, designated SEQ ID:10435 and SEQ ID:14818 respectively, to the nucleotide sequence of GAM7957 RNA, herein designated GAM RNA, also designated SEQ ID:297.

Another function of GAM7957 is therefore inhibition of AP1S3 (Accession NP_848929.1). Accordingly, utilities of GAM7957 include diagnosis, prevention and treatment of diseases and clinical conditions associated with AP1S3.

Adaptor-related protein complex 4, sigma 1 subunit (AP4S1, Accession NP_009008.2) is another GAM7957 target gene, herein designated TARGET GENE. AP4S1 BINDING SITE is a target binding site found in the 3' untranslated region of mRNA encoded by AP4S1, corresponding to a target binding site such as BINDING SITE I, BINDING SITE II or BINDING SITE III of FIG. 8. Table 4 illustrates the complementarity of the nucleotide sequences of AP4S1 BINDING SITE, designated SEQ ID:17888, to the nucleotide sequence of GAM7957 RNA, herein designated GAM RNA, also designated SEQ ID:297.

Another function of GAM7957 is therefore inhibition of Adaptor-related protein complex 4, sigma 1 subunit (AP4S1, Accession NP_009008.2). Accordingly, utilities of GAM7957 include diagnosis, prevention and treatment of diseases and clinical conditions associated with AP4S1.

APBB3 (Accession NP_006042.2) is another GAM7957 target gene, herein designated TARGET GENE. APBB3 BINDING SITE is a target binding site found in the 5' untranslated region of multiple transcripts of mRNA encoded by APBB3, corresponding to a target binding site such as BINDING SITE I, BINDING SITE II or BINDING SITE III of FIG. 8. Table 4 illustrates the complementarity of the nucleotide sequences of APBB3 BINDING SITE, designated SEQ ID:479, to the nucleotide sequence of GAM7957 RNA, herein designated GAM RNA, also designated SEQ ID:297.

Another function of GAM7957 is therefore inhibition of APBB3 (Accession NP_006042.2). Accordingly, utilities of GAM7957 include diagnosis, prevention and treatment of diseases and clinical conditions associated with APBB3.

APBB3 (Accession NP_573422.1) is another GAM7957 target gene, herein designated TARGET GENE. APBB3 BINDING SITE is a target binding site found in the 5' untranslated region of multiple transcripts of mRNA encoded by APBB3, corresponding to a target binding site such as BINDING SITE I, BINDING SITE II or BINDING SITE III of FIG. 8. Table 4 illustrates the complementarity of the nucleotide sequences of APBB3 BINDING SITE, designated SEQ ID:479, to the nucleotide sequence of GAM7957 RNA, herein designated GAM RNA, also designated SEQ ID:297.

Another function of GAM7957 is therefore inhibition of APBB3 (Accession NP_573422.1). Accordingly, utilities of GAM7957 include diagnosis, prevention and treatment of diseases and clinical conditions associated with APBB3.

APBB3 (Accession NP_573419.1) is another GAM7957 target gene, herein designated TARGET GENE. APBB3 BINDING SITE is a target binding site found in the 5' untranslated region of multiple transcripts of mRNA encoded by APBB3, corresponding to a target binding site such as BINDING SITE I, BINDING SITE II or BINDING SITE III of FIG. 8. Table 4 illustrates the complementarity of the nucleotide sequences of APBB3 BINDING SITE, designated SEQ ID:479, to the nucleotide sequence of GAM7957 RNA, herein designated GAM RNA, also designated SEQ ID:297.

Another function of GAM7957 is therefore inhibition of APBB3 (Accession NP_573419.1). Accordingly, utilities of GAM7957 include diagnosis, prevention and treatment of diseases and clinical conditions associated with APBB3.

APBB3 (Accession NP_573420.1) is another GAM7957 target gene, herein designated TARGET GENE. APBB3 BINDING SITE is a target binding site found in the 5' untranslated region of multiple transcripts of mRNA encoded by APBB3, corresponding to a target binding site such as BINDING SITE I, BINDING SITE II or BINDING SITE III of FIG. 8. Table 4 illustrates the complementarity of the nucleotide sequences of APBB3 BINDING SITE, designated SEQ ID:479, to the nucleotide sequence of GAM7957 RNA, herein designated GAM RNA, also designated SEQ ID:297.

Another function of GAM7957 is therefore inhibition of APBB3 (Accession NP_573420.1). Accordingly, utilities of GAM7957 include diagnosis, prevention and treatment of diseases and clinical conditions associated with APBB3.

APBB3 (Accession NP_573418.1) is another GAM7957 target gene, herein designated TARGET GENE. APBB3 BINDING SITE is a target binding site found in the 5' untranslated region of multiple transcripts of mRNA encoded by APBB3, corresponding to a target binding site such as BINDING SITE I, BINDING SITE II or BINDING SITE III of FIG. 8. Table 4 illustrates the complementarity of the nucleotide sequences of APBB3 BINDING SITE, designated SEQ ID:479, to the nucleotide sequence of GAM7957 RNA, herein designated GAM RNA, also designated SEQ ID:297.

Another function of GAM7957 is therefore inhibition of APBB3 (Accession NP_573418.1). Accordingly, utilities of GAM7957 include diagnosis, prevention and treatment of diseases and clinical conditions associated with APBB3.

APBB3 (Accession NP_573421.1) is another GAM7957 target gene, herein designated TARGET GENE. APBB3 BINDING SITE is a target binding site found in the 5' untranslated region of multiple transcripts of mRNA encoded by APBB3, corresponding to a target binding site such as BINDING SITE I, BINDING SITE II or BINDING SITE III of FIG. 8. Table 4 illustrates the complementarity of the nucleotide sequences of APBB3 BINDING SITE, designated SEQ ID:479, to the nucleotide sequence of GAM7957 RNA, herein designated GAM RNA, also designated SEQ ID:297.

Another function of GAM7957 is therefore inhibition of APBB3 (Accession NP_573421.1). Accordingly, utilities of GAM7957 include diagnosis, prevention and treatment of diseases and clinical conditions associated with APBB3.

APG10L (Accession NP_113670.1) is another GAM7957 target gene, herein designated TARGET GENE. APG10L BINDING SITE is a target binding site found in the 3' untranslated region of mRNA encoded by APG10L, corresponding to a target binding site such as BINDING SITE I, BINDING SITE II or BINDING SITE III of FIG. 8. Table 4 illustrates the complementarity of the nucleotide sequences of APG10L BINDING SITE, designated SEQ ID:10656, to the nucleotide sequence of GAM7957 RNA, herein designated GAM RNA, also designated SEQ ID:297.

Another function of GAM7957 is therefore inhibition of APG10L (Accession NP_113670.1). Accordingly, utilities of GAM7957 include diagnosis, prevention and treatment of diseases and clinical conditions associated with APG10L.

Apolipoprotein b mrna editing enzyme, catalytic polypeptide-like 3a (APOBEC3A, Accession NP_663745.1) is another GAM7957 target gene, herein designated TARGET GENE. APOBEC3A BINDING SITE is a target binding site found in the 3' untranslated region of mRNA encoded by APOBEC3A, corresponding to a target binding site such as BINDING SITE I, BINDING SITE II or BINDING SITE III of FIG. 8. Table 4 illustrates the complementarity of the nucleotide sequences of APOBEC3A BINDING SITE, designated SEQ ID:7049, to the nucleotide sequence of GAM7957 RNA, herein designated GAM RNA, also designated SEQ ID:297.

Another function of GAM7957 is therefore inhibition of Apolipoprotein b mrna editing enzyme, catalytic polypeptide-like 3a (APOBEC3A, Accession NP_663745.1). Accordingly, utilities of GAM7957 include diagnosis, prevention and treatment of diseases and clinical conditions associated with APOBEC3A.

Apolipoprotein b mrna editing enzyme, catalytic polypeptide-like 3f (APOBEC3F, Accession NP_660341.2) is another GAM7957 target gene, herein designated TARGET GENE. APOBEC3F BINDING SITE is a target binding site found in the 3' untranslated region of mRNA encoded by APOBEC3F, corresponding to a target binding site such as BINDING SITE I, BINDING SITE II or BINDING SITE III of FIG. 8. Table 4 illustrates the complementarity of the nucleotide sequences of APOBEC3F BINDING SITE, designated SEQ ID:10042, to the nucleotide sequence of GAM7957 RNA, herein designated GAM RNA, also designated SEQ ID:297.

Another function of GAM7957 is therefore inhibition of Apolipoprotein b mrna editing enzyme, catalytic polypeptide-like 3f (APOBEC3F, Accession NP_660341.2). Accordingly, utilities of GAM7957 include diagnosis, prevention and treatment of diseases and clinical conditions associated with APOBEC3F.

Apolipoprotein l, 1 (APOL1, Accession NP_663318.1) is another GAM7957 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:4061, to the nucleotide sequence of GAM7957 RNA, herein designated GAM RNA, also designated SEQ ID:297.

Another function of GAM7957 is therefore inhibition of Apolipoprotein l, 1 (APOL1, Accession NP_663318.1), a gene which may participate in reverse cholesterol transport from peripheral cells to the liver. and therefore may be associated with Schizophrenia. Accordingly, utilities of GAM7957 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. Apolipoprotein l, 1 (APOL1, Accession NP_003652.2) is another GAM7957 target gene, herein designated TARGET GENE. APOL1 BINDING SITE is a target binding site found in the 3' untranslated region of multiple transcripts of mRNA encoded by APOL1, corresponding to a target binding site such as BINDING SITE I, BINDING SITE II or BINDING SITE III of FIG. 8. Table 4 illustrates the complementarity of the nucleotide sequences of APOL1 BINDING SITE, designated SEQ ID:4061, to the nucleotide sequence of GAM7957 RNA, herein designated GAM RNA, also designated SEQ ID:297.

Another function of GAM7957 is therefore inhibition of Apolipoprotein l, 1 (APOL1, Accession NP_003652.2), a gene which may participate in reverse cholesterol transport from peripheral cells to the liver. and therefore may be associated with Schizophrenia. Accordingly, utilities of GAM7957 include diagnosis, prevention and treatment of Schizophrenia, and of other diseases and clinical conditions associated with APOL1.

The function of APOL1 and its association with various diseases and clinical conditions, has been established by previous studies, as described hereinabove with reference to GAM30.1. APXL2 (Accession NP_597713.1) is another GAM7957 target gene, herein designated TARGET GENE. APXL2 BINDING SITE is a target binding site found in the 3' untranslated region of mRNA encoded by APXL2, corresponding to a target binding site such as BINDING SITE I, BINDING SITE II or BINDING SITE III of FIG. 8. Table 4 illustrates the complementarity of the nucleotide sequences of APXL2 BINDING SITE, designated SEQ ID:14254, to the nucleotide sequence of GAM7957 RNA, herein designated GAM RNA, also designated SEQ ID:297.

Another function of GAM7957 is therefore inhibition of APXL2 (Accession NP_597713.1). Accordingly, utilities of GAM7957 include diagnosis, prevention and treatment of diseases and clinical conditions associated with APXL2.

Rac/cdc42 guanine nucleotide exchange factor (gef) 6 (ARHGEF6, Accession NP_004831.1) is another GAM7957 target gene, herein designated TARGET GENE. ARHGEF6 BINDING SITE is a target binding site found in the 3' untranslated region of mRNA encoded by ARHGEF6, corresponding to a target binding site such as BINDING SITE I, BINDING SITE II or BINDING SITE III of FIG. 8. Table 4 illustrates the complementarity of the nucleotide sequences of ARHGEF6 BINDING SITE, designated SEQ ID:14790, to the nucleotide sequence of GAM7957 RNA, herein designated GAM RNA, also designated SEQ ID:297.

Another function of GAM7957 is therefore inhibition of Rac/cdc42 guanine nucleotide exchange factor (gef) 6 (ARHGEF6, Accession NP_004831.1). Accordingly, utilities of GAM7957 include diagnosis, prevention and treatment of diseases and clinical conditions associated with ARHGEF6.

ARLTS1 (Accession NP_612459.1) is another GAM7957 target gene, herein designated TARGET GENE. ARLTS1 BINDING SITE1 and ARLTS1 BINDING SITE2 are target binding sites found in untranslated regions of mRNA encoded by ARLTS1, corresponding to target binding sites such as BINDING SITE I, BINDING SITE II or BINDING SITE III of FIG. 8. Table 4 illustrates the complementarity of the nucleotide sequences of ARLTS1 BINDING SITE1 and ARLTS1 BINDING SITE2, designated SEQ ID:1904 and SEQ ID:11695 respectively, to the nucleotide sequence of GAM7957 RNA, herein designated GAM RNA, also designated SEQ ID:297.

Another function of GAM7957 is therefore inhibition of ARLTS1 (Accession NP_612459.1). Accordingly, utilities of GAM7957 include diagnosis, prevention and treatment of diseases and clinical conditions associated with ARLTS1.

Aryl-hydrocarbon receptor nuclear translocator 2 (ARNT2, Accession NP_055677.1) is another GAM7957 target gene, herein designated TARGET GENE. ARNT2 BINDING SITE is a target binding site found in the 3' untranslated region of mRNA encoded by ARNT2, corresponding to a target binding site such as BINDING SITE I, BINDING SITE II or BINDING SITE III of FIG. 8. Table 4 illustrates the complementarity of the nucleotide sequences of ARNT2 BINDING SITE, designated SEQ ID:13998, to the nucleotide sequence of GAM7957 RNA, herein designated GAM RNA, also designated SEQ ID:297.

Another function of GAM7957 is therefore inhibition of Aryl-hydrocarbon receptor nuclear translocator 2 (ARNT2, Accession NP_055677.1), a gene which specifically recognizes the xenobiotic response element (xre). Accordingly, utilities of GAM7957 include diagnosis, prevention and treatment of diseases and clinical conditions associated with ARNT2.

The function of ARNT2 and its association with various diseases and clinical conditions, has been established by previous studies, as described hereinabove with reference to GAM67.1. Ankyrin repeat and socs box-containing 8 (ASB8, Accession NP_077000.1) is another GAM7957 target gene, herein designated TARGET GENE. ASB8 BINDING SITE is a target binding site found in the 3' untranslated region of mRNA encoded by ASB8, corresponding to a target binding site such as BINDING SITE I, BINDING SITE II or BINDING SITE III of FIG. 8. Table 4 illustrates the complementarity of the nucleotide sequences of ASB8 BINDING SITE, designated SEQ ID:4423, to the nucleotide sequence of GAM7957 RNA, herein designated GAM RNA, also designated SEQ ID:297.

Another function of GAM7957 is therefore inhibition of Ankyrin repeat and socs box-containing 8 (ASB8, Accession NP_077000.1). Accordingly, utilities of GAM7957 include diagnosis, prevention and treatment of diseases and clinical conditions associated with ASB8.

ASK (Accession NP_006707.1) is another GAM7957 target gene, herein designated TARGET GENE. ASK BINDING SITE is a target binding site found in the 3' untranslated region of mRNA encoded by ASK, corresponding to a target binding site such as BINDING SITE I, BINDING SITE II or BINDING SITE III of FIG. 8. Table 4 illustrates the complementarity of the nucleotide sequences of ASK BINDING SITE, designated SEQ ID:838, to the nucleotide sequence of GAM7957 RNA, herein designated GAM RNA, also designated SEQ ID:297.

Another function of GAM7957 is therefore inhibition of ASK (Accession NP_006707.1). Accordingly, utilities of GAM7957 include diagnosis, prevention and treatment of diseases and clinical conditions associated with ASK.

Astrotactin 2 (ASTN2, Accession NP_054729.1) is another GAM7957 target gene, herein designated TARGET GENE. ASTN2 BINDING SITE is a target binding site found in the 3' untranslated region of mRNA encoded by ASTN2, corresponding to a target binding site such as BINDING SITE I, BINDING SITE II or BINDING SITE III of FIG. 8. Table 4 illustrates the complementarity of the nucleotide sequences of ASTN2 BINDING SITE, designated SEQ ID:14819, to the nucleotide sequence of GAM7957 RNA, herein designated GAM RNA, also designated SEQ ID:297.

Another function of GAM7957 is therefore inhibition of Astrotactin 2 (ASTN2, Accession NP_054729.1). Accordingly, utilities of GAM7957 include diagnosis, prevention and treatment of diseases and clinical conditions associated with ASTN2.

Atpase, na+/k+ transporting, alpha 2 (+) polypeptide (ATP1A2, Accession NP_000693.1) is another GAM7957 target gene, herein designated TARGET GENE. ATP1A2 BINDING SITE is a target binding site found in the 3' untranslated region of mRNA encoded by ATP1A2, corresponding to a target binding site such as BINDING SITE I, BINDING SITE II or BINDING SITE III of FIG. 8. Table 4 illustrates the complementarity of the nucleotide sequences of ATP1A2 BINDING SITE, designated SEQ ID:15326, to the nucleotide sequence of GAM7957 RNA, herein designated GAM RNA, also designated SEQ ID:297.

Another function of GAM7957 is therefore inhibition of Atpase, na+/k+ transporting, alpha 2 (+) polypeptide (ATP1A2, Accession NP_000693.1). Accordingly, utilities of GAM7957 include diagnosis, prevention and treatment of diseases and clinical conditions associated with ATP1A2.

Atpase, (na+)/k+ transporting, beta 4 polypeptide (ATP1B4, Accession NP_036201.1) is another GAM7957 target gene, herein designated TARGET GENE. ATP1B4 BINDING SITE is a target binding site found in the 3' untranslated region of mRNA encoded by ATP1B4, corresponding to a target binding site such as BINDING SITE I, BINDING SITE II or BINDING SITE III of FIG. 8. Table 4 illustrates the complementarity of the nucleotide sequences of ATP1B4 BINDING SITE, designated SEQ ID:13338, to the nucleotide sequence of GAM7957 RNA, herein designated GAM RNA, also designated SEQ ID:297.

Another function of GAM7957 is therefore inhibition of Atpase, (na+)/k+ transporting, beta 4 polypeptide (ATP1B4, Accession NP_036201.1). Accordingly, utilities of GAM7957 include diagnosis, prevention and treatment of diseases and clinical conditions associated with ATP1B4.

Axl receptor tyrosine kinase (AXL, Accession NP_068713.2) is another GAM7957 target gene, herein designated TARGET GENE. AXL BINDING SITE is a target binding site found in the 5' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:1792, to the nucleotide sequence of GAM7957 RNA, herein designated GAM RNA, also designated SEQ ID:297.

Another function of GAM7957 is therefore inhibition of Axl receptor tyrosine kinase (AXL, Accession NP_068713.2). Accordingly, utilities of GAM7957 include diagnosis, prevention and treatment of diseases and clinical conditions associated with AXL.

Axl receptor tyrosine kinase (AXL, Accession NP_001690.2) is another GAM7957 target gene, herein designated TARGET GENE. AXL BINDING SITE is a target binding site found in the 5' untranslated region of multiple transcripts of mRNA encoded by AXL, corresponding to a target binding site such as BINDING SITE I, BINDING SITE II or BINDING SITE III of FIG. 8. Table 4 illustrates the complementarity of the nucleotide sequences of AXL BINDING SITE, designated SEQ ID:1792, to the nucleotide sequence of GAM7957 RNA, herein designated GAM RNA, also designated SEQ ID:297.

Another function of GAM7957 is therefore inhibition of Axl receptor tyrosine kinase (AXL, Accession NP_001690.2). Accordingly, utilities of GAM7957 include diagnosis, prevention and treatment of diseases and clinical conditions associated with AXL.

Udp-gal:betaglcnac beta 1,4-galactosyltransferase, polypeptide 2 (B4GALT2, Accession NP_003771.1) is another GAM7957 target gene, herein designated TARGET GENE. B4GALT2 BINDING SITE is a target binding site found in the 3' untranslated region of multiple transcripts of mRNA encoded by B4GALT2, corresponding to a target binding site such as BINDING SITE I, BINDING SITE II or BINDING SITE III of FIG. 8. Table 4 illustrates the complementarity of the nucleotide sequences of B4GALT2 BINDING SITE, designated SEQ ID:2774, to the nucleotide sequence of GAM7957 RNA, herein designated GAM RNA, also designated SEQ ID:297.

Another function of GAM7957 is therefore inhibition of Udp-gal:betaglcnac beta 1,4-galactosyltransferase, polypeptide 2 (B4GALT2, Accession NP__003771.1). Accordingly, utilities of GAM7957 include diagnosis, prevention and treatment of diseases and clinical conditions associated with B4GALT2.

Udp-gal:betaglcnac beta 1,4-galactosyltransferase, polypeptide 2 (B4GALT2, Accession NP__085076.1) is another GAM7957 target gene, herein designated TARGET GENE. B4GALT2 BINDING SITE is a target binding site found in the 3' untranslated region of multiple transcripts of mRNA encoded by B4GALT2, corresponding to a target binding site such as BINDING SITE I, BINDING SITE II or BINDING SITE III of FIG. 8. Table 4 illustrates the complementarity of the nucleotide sequences of B4GALT2 BINDING SITE, designated SEQ ID:2774, to the nucleotide sequence of GAM7957 RNA, herein designated GAM RNA, also designated SEQ ID:297.

Another function of GAM7957 is therefore inhibition of Udp-gal:betaglcnac beta 1,4-galactosyltransferase, polypeptide 2 (B4GALT2, Accession NP__085076.1). Accordingly, utilities of GAM7957 include diagnosis, prevention and treatment of diseases and clinical conditions associated with B4GALT2.

BANP (Accession NP__524576.1) is another GAM7957 target gene, herein designated TARGET GENE. BANP BINDING SITE is a target binding site found in the 3' untranslated region of multiple transcripts of mRNA encoded by BANP, corresponding to a target binding site such as BINDING SITE I, BINDING SITE II or BINDING SITE III of FIG. 8. Table 4 illustrates the complementarity of the nucleotide sequences of BANP BINDING SITE, designated SEQ ID:13451, to the nucleotide sequence of GAM7957 RNA, herein designated GAM RNA, also designated SEQ ID:297.

Another function of GAM7957 is therefore inhibition of BANP (Accession NP__524576.1). Accordingly, utilities of GAM7957 include diagnosis, prevention and treatment of diseases and clinical conditions associated with BANP.

BANP (Accession NP__060339.2) is another GAM7957 target gene, herein designated TARGET GENE. BANP BINDING SITE is a target binding site found in the 3' untranslated region of multiple transcripts of mRNA encoded by BANP, corresponding to a target binding site such as BINDING SITE I, BINDING SITE II or BINDING SITE III of FIG. 8. Table 4 illustrates the complementarity of the nucleotide sequences of BANP BINDING SITE, designated SEQ ID:13451, to the nucleotide sequence of GAM7957 RNA, herein designated GAM RNA, also designated SEQ ID:297.

Another function of GAM7957 is therefore inhibition of BANP (Accession NP__060339.2). Accordingly, utilities of GAM7957 include diagnosis, prevention and treatment of diseases and clinical conditions associated with BANP.

Breast cancer anti-estrogen resistance 1 (BCAR1, Accession NP__055382.1) is another GAM7957 target gene, herein designated TARGET GENE. BCAR1 BINDING SITE is a target binding site found in the 3' untranslated region of mRNA encoded by BCAR1, corresponding to a target binding site such as BINDING SITE I, BINDING SITE II or BINDING SITE III of FIG. 8. Table 4 illustrates the complementarity of the nucleotide sequences of BCAR1 BINDING SITE, designated SEQ ID:16661, to the nucleotide sequence of GAM7957 RNA, herein designated GAM RNA, also designated SEQ ID:297.

Another function of GAM7957 is therefore inhibition of Breast cancer anti-estrogen resistance 1 (BCAR1, Accession NP__055382.1), a gene which plays a role for tyrosine-kinase-based signaling to cell adhesion. Accordingly, utilities of GAM7957 include diagnosis, prevention and treatment of diseases and clinical conditions associated with BCAR1.

The function of BCAR1 and its association with various diseases and clinical conditions, has been established by previous studies, as described hereinabove with reference to GAM234.1. Breast carcinoma amplified sequence 1 (BCAS1, Accession NP__003648.1) is another GAM7957 target gene, herein designated TARGET GENE. BCAS1 BINDING SITE is a target binding site found in the 3' untranslated region of mRNA encoded by BCAS1, corresponding to a target binding site such as BINDING SITE I, BINDING SITE II or BINDING SITE III of FIG. 8. Table 4 illustrates the complementarity of the nucleotide sequences of BCAS1 BINDING SITE, designated SEQ ID:13893, to the nucleotide sequence of GAM7957 RNA, herein designated GAM RNA, also designated SEQ ID:297.

Another function of GAM7957 is therefore inhibition of Breast carcinoma amplified sequence 1 (BCAS1, Accession NP__003648.1). Accordingly, utilities of GAM7957 include diagnosis, prevention and treatment of diseases and clinical conditions associated with BCAS1.

Bifunctional apoptosis regulator (BFAR, Accession NP__057645.1) is another GAM7957 target gene, herein designated TARGET GENE. BFAR BINDING SITE is a target binding site found in the 3' untranslated region of mRNA encoded by BFAR, corresponding to a target binding site such as BINDING SITE I, BINDING SITE II or BINDING SITE III of FIG. 8. Table 4 illustrates the complementarity of the nucleotide sequences of BFAR BINDING SITE, designated SEQ ID:15922, to the nucleotide sequence of GAM7957 RNA, herein designated GAM RNA, also designated SEQ ID:297.

Another function of GAM7957 is therefore inhibition of Bifunctional apoptosis regulator (BFAR, Accession NP__057645.1). Accordingly, utilities of GAM7957 include diagnosis, prevention and treatment of diseases and clinical conditions associated with BFAR.

Betaine-homocysteine methyltransferase 2 (BHMT2, Accession NP__060084.2) is another GAM7957 target gene, herein designated TARGET GENE. BHMT2 BINDING SITE1 and BHMT2 BINDING SITE2 are target binding sites found in untranslated regions of mRNA encoded by BHMT2, corresponding to target binding sites such as BINDING SITE I, BINDING SITE II or BINDING SITE III of FIG. 8. Table 4 illustrates the complementarity of the nucleotide sequences of BHMT2 BINDING SITE1 and BHMT2 BINDING SITE2, designated SEQ ID:5830 and SEQ ID:10571 respectively, to the nucleotide sequence of GAM7957 RNA, herein designated GAM RNA, also designated SEQ ID:297.

Another function of GAM7957 is therefore inhibition of Betaine-homocysteine methyltransferase 2 (BHMT2, Accession NP__060084.2). Accordingly, utilities of GAM7957 include diagnosis, prevention and treatment of diseases and clinical conditions associated with BHMT2.

Baculoviral iap repeat-containing 1 (BIRC1, Accession NP__004527.1) is another GAM7957 target gene, herein designated TARGET GENE. BIRC1 BINDING SITE is a target binding site found in the 3' untranslated region of mRNA encoded by BIRC1, corresponding to a target binding site such as BINDING SITE I, BINDING SITE II or BINDING SITE III of FIG. 8. Table 4 illustrates the complementarity of the nucleotide sequences of BIRC1 BINDING SITE, designated SEQ ID:12796, to the nucleotide sequence of GAM7957 RNA, herein designated GAM RNA, also designated SEQ ID:297.

Another function of GAM7957 is therefore inhibition of Baculoviral iap repeat-containing 1 (BIRC1, Accession NP_004527.1). Accordingly, utilities of GAM7957 include diagnosis, prevention and treatment of diseases and clinical conditions associated with BIRC1.

Baculoviral iap repeat-containing 5 (survivin) (BIRC5, Accession NP_001159.1) is another GAM7957 target gene, herein designated TARGET GENE. BIRC5 BINDING SITE is a target binding site found in the 5' untranslated region of mRNA encoded by BIRC5, corresponding to a target binding site such as BINDING SITE I, BINDING SITE II or BINDING SITE III of FIG. 8. Table 4 illustrates the complementarity of the nucleotide sequences of BIRC5 BINDING SITE, designated SEQ ID:1829, to the nucleotide sequence of GAM7957 RNA, herein designated GAM RNA, also designated SEQ ID:297.

Another function of GAM7957 is therefore inhibition of Baculoviral iap repeat-containing 5 (survivin) (BIRC5, Accession NP_001159.1). Accordingly, utilities of GAM7957 include diagnosis, prevention and treatment of diseases and clinical conditions associated with BIRC5.

Basic, immunoglobulin-like variable motif containing (BIVM, Accession NP_060163.2) is another GAM7957 target gene, herein designated TARGET GENE. BIVM BINDING SITE is a target binding site found in the 3' untranslated region of mRNA encoded by BIVM, corresponding to a target binding site such as BINDING SITE I, BINDING SITE II or BINDING SITE III of FIG. 8. Table 4 illustrates the complementarity of the nucleotide sequences of BIVM BINDING SITE, designated SEQ ID:14233, to the nucleotide sequence of GAM7957 RNA, herein designated GAM RNA, also designated SEQ ID:297.

Another function of GAM7957 is therefore inhibition of Basic, immunoglobulin-like variable motif containing (BIVM, Accession NP_060163.2). Accordingly, utilities of GAM7957 include diagnosis, prevention and treatment of diseases and clinical conditions associated with BIVM.

BMF (Accession NP_277038.1) is another GAM7957 target gene, herein designated TARGET GENE. BMF BINDING SITE is a target binding site found in the 3' untranslated region of mRNA encoded by BMF, corresponding to a target binding site such as BINDING SITE I, BINDING SITE II or BINDING SITE III of FIG. 8. Table 4 illustrates the complementarity of the nucleotide sequences of BMF BINDING SITE, designated SEQ ID:1509, to the nucleotide sequence of GAM7957 RNA, herein designated GAM RNA, also designated SEQ ID:297.

Another function of GAM7957 is therefore inhibition of BMF (Accession NP_277038.1). Accordingly, utilities of GAM7957 include diagnosis, prevention and treatment of diseases and clinical conditions associated with BMF.

Bone morphogenetic protein 8 (osteogenic protein 2) (BMP8, Accession NP_001711.2) is another GAM7957 target gene, herein designated TARGET GENE. BMP8 BINDING SITE is a target binding site found in the 3' untranslated region of mRNA encoded by BMP8, corresponding to a target binding site such as BINDING SITE I, BINDING SITE II or BINDING SITE III of FIG. 8. Table 4 illustrates the complementarity of the nucleotide sequences of BMP8 BINDING SITE, designated SEQ ID:11740, to the nucleotide sequence of GAM7957 RNA, herein designated GAM RNA, also designated SEQ ID:297.

Another function of GAM7957 is therefore inhibition of Bone morphogenetic protein 8 (osteogenic protein 2) (BMP8, Accession NP_001711.2), a gene which plays a role in calcium regulation and bone homeostasis. Accordingly, utilities of GAM7957 include diagnosis, prevention and treatment of diseases and clinical conditions associated with BMP8.

The function of BMP8 and its association with various diseases and clinical conditions, has been established by previous studies, as described hereinabove with reference to GAM347.1.3'(2'), 5'-bisphosphate nucleotidase 1 (BPNT1, Accession XP_035738.1) is another GAM7957 target gene, herein designated TARGET GENE. BPNT1 BINDING SITE1 and BPNT1 BINDING SITE2 are target binding sites found in untranslated regions of multiple transcripts of mRNA encoded by BPNT1, corresponding to target binding sites such as BINDING SITE I, BINDING SITE II or BINDING SITE III of FIG. 8. Table 4 illustrates the complementarity of the nucleotide sequences of BPNT1 BINDING SITE1 and BPNT1 BINDING SITE2, designated SEQ ID:3936 and SEQ ID:3605 respectively, to the nucleotide sequence of GAM7957 RNA, herein designated GAM RNA, also designated SEQ ID:297.

Another function of GAM7957 is therefore inhibition of 3'(2'), 5'-bisphosphate nucleotidase 1 (BPNT1, Accession XP_035738.1). Accordingly, utilities of GAM7957 include diagnosis, prevention and treatment of diseases and clinical conditions associated with BPNT1.

Breast cancer 1, early onset (BRCA1, Accession NP_009229.1) is another GAM7957 target gene, herein designated TARGET GENE. BRCA1 BINDING SITE1 and BRCA1 BINDING SITE2 are target binding sites found in untranslated regions of multiple transcripts of mRNA encoded by BRCA1, corresponding to target binding sites such as BINDING SITE I, BINDING SITE II or BINDING SITE III of FIG. 8. Table 4 illustrates the complementarity of the nucleotide sequences of BRCA1 BINDING SITE1 and BRCA1 BINDING SITE2, designated SEQ ID:19976 and SEQ ID:19976 respectively, to the nucleotide sequence of GAM7957 RNA, herein designated GAM RNA, also designated SEQ ID:297.

Another function of GAM7957 is therefore inhibition of Breast cancer 1, early onset (BRCA1, Accession NP_009229.1). Accordingly, utilities of GAM7957 include diagnosis, prevention and treatment of diseases and clinical conditions associated with BRCA1.

Breast cancer 1, early onset (BRCA1, Accession NP_009231.1) is another GAM7957 target gene, herein designated TARGET GENE. BRCA1 BINDING SITE1 and BRCA1 BINDING SITE2 are target binding sites found in untranslated regions of multiple transcripts of mRNA encoded by BRCA1, corresponding to target binding sites such as BINDING SITE I, BINDING SITE II or BINDING SITE III of FIG. 8. Table 4 illustrates the complementarity of the nucleotide sequences of BRCA1 BINDING SITE1 and BRCA1 BINDING SITE2, designated SEQ ID:19976 and SEQ ID:19976 respectively, to the nucleotide sequence of GAM7957 RNA, herein designated GAM RNA, also designated SEQ ID:297.

Another function of GAM7957 is therefore inhibition of Breast cancer 1, early onset (BRCA1, Accession NP_009231.1). Accordingly, utilities of GAM7957 include diagnosis, prevention and treatment of diseases and clinical conditions associated with BRCA1.

Breast cancer 1, early onset (BRCA1, Accession NP_009232.1) is another GAM7957 target gene, herein designated TARGET GENE. BRCA1 BINDING SITE1 and BRCA1 BINDING SITE2 are target binding sites found in untranslated regions of multiple transcripts of mRNA encoded by BRCA1, corresponding to target binding sites such as BINDING SITE I, BINDING SITE II or BINDING SITE III of FIG. 8. Table 4 illustrates the complementarity of the nucleotide sequences of BRCA1 BINDING SITE1 and BRCA1 BINDING SITE2, designated SEQ ID:19976 and SEQ ID:19976 respectively, to the nucleotide sequence of GAM7957 RNA, herein designated GAM RNA, also designated SEQ ID:297.

Another function of GAM7957 is therefore inhibition of Breast cancer 1, early onset (BRCA1, Accession NP_009232.1). Accordingly, utilities of GAM7957 include diagnosis, prevention and treatment of diseases and clinical conditions associated with BRCA1.

Breast cancer 1, early onset (BRCA1, Accession NP_009230.1) is another GAM7957 target gene, herein designated TARGET GENE. BRCA1 BINDING SITE1 and BRCA1 BINDING SITE2 are target binding sites found in untranslated regions of multiple transcripts of mRNA encoded by BRCA1, corresponding to target binding sites such as BINDING SITE I, BINDING SITE II or BINDING SITE III of FIG. 8. Table 4 illustrates the complementarity of the nucleotide sequences of BRCA1 BINDING SITE1 and BRCA1 BINDING SITE2, designated SEQ ID:19976 and SEQ ID:19976 respectively, to the nucleotide sequence of GAM7957 RNA, herein designated GAM RNA, also designated SEQ ID:297.

Another function of GAM7957 is therefore inhibition of Breast cancer 1, early onset (BRCA1, Accession NP_009230.1). Accordingly, utilities of GAM7957 include diagnosis, prevention and treatment of diseases and clinical conditions associated with BRCA1.

Breast cancer 1, early onset (BRCA1, Accession NP_009235.1) is another GAM7957 target gene, herein designated TARGET GENE. BRCA1 BINDING SITE1 and BRCA1 BINDING SITE2 are target binding sites found in untranslated regions of multiple transcripts of mRNA encoded by BRCA1, corresponding to target binding sites such as BINDING SITE I, BINDING SITE II or BINDING SITE III of FIG. 8. Table 4 illustrates the complementarity of the nucleotide sequences of BRCA1 BINDING SITE1 and BRCA1 BINDING SITE2, designated SEQ ID:19976 and SEQ ID:19976 respectively, to the nucleotide sequence of GAM7957 RNA, herein designated GAM RNA, also designated SEQ ID:297.

Another function of GAM7957 is therefore inhibition of Breast cancer 1, early onset (BRCA1, Accession NP_009235.1). Accordingly, utilities of GAM7957 include diagnosis, prevention and treatment of diseases and clinical conditions associated with BRCA1.

Breast cancer 1, early onset (BRCA1, Accession NP_009236.1) is another GAM7957 target gene, herein designated TARGET GENE. BRCA1 BINDING SITE1 and BRCA1 BINDING SITE2 are target binding sites found in untranslated regions of multiple transcripts of mRNA encoded by BRCA1, corresponding to target binding sites such as BINDING SITE I, BINDING SITE II or BINDING SITE III of FIG. 8. Table 4 illustrates the complementarity of the nucleotide sequences of BRCA1 BINDING SITE1 and BRCA1 BINDING SITE2, designated SEQ ID:19976 and SEQ ID:9421 respectively, to the nucleotide sequence of GAM7957 RNA, herein designated GAM RNA, also designated SEQ ID:297.

Another function of GAM7957 is therefore inhibition of Breast cancer 1, early onset (BRCA1, Accession NP_009236.1). Accordingly, utilities of GAM7957 include diagnosis, prevention and treatment of diseases and clinical conditions associated with BRCA1.

Breast cancer 1, early onset (BRCA1, Accession NP_009225.1) is another GAM7957 target gene, herein designated TARGET GENE. BRCA1 BINDING SITE1 and BRCA1 BINDING SITE2 are target binding sites found in untranslated regions of multiple transcripts of mRNA encoded by BRCA1, corresponding to target binding sites such as BINDING SITE I, BINDING SITE II or BINDING SITE III of FIG. 8. Table 4 illustrates the complementarity of the nucleotide sequences of BRCA1 BINDING SITE1 and BRCA1 BINDING SITE2, designated SEQ ID:19976 and SEQ ID:19976 respectively, to the nucleotide sequence of GAM7957 RNA, herein designated GAM RNA, also designated SEQ ID:297.

Another function of GAM7957 is therefore inhibition of Breast cancer 1, early onset (BRCA1, Accession NP_009225.1). Accordingly, utilities of GAM7957 include diagnosis, prevention and treatment of diseases and clinical conditions associated with BRCA1.

Btb (poz) domain containing 5 (BTBD5, Accession NP_060128.1) is another GAM7957 target gene, herein designated TARGET GENE. BTBD5 BINDING SITE is a target binding site found in the 3' untranslated region of mRNA encoded by BTBD5, corresponding to a target binding site such as BINDING SITE I, BINDING SITE II or BINDING SITE III of FIG. 8. Table 4 illustrates the complementarity of the nucleotide sequences of BTBD5 BINDING SITE, designated SEQ ID:1201, to the nucleotide sequence of GAM7957 RNA, herein designated GAM RNA, also designated SEQ ID:297.

Another function of GAM7957 is therefore inhibition of Btb (poz) domain containing 5 (BTBD5, Accession NP_060128.1). Accordingly, utilities of GAM7957 include diagnosis, prevention and treatment of diseases and clinical conditions associated with BTBD5.

Butyrophilin, subfamily 3, member a2 (BTN3A2, Accession NP_008978.1) is another GAM7957 target gene, herein designated TARGET GENE. BTN3A2 BINDING SITE1 and BTN3A2 BINDING SITE2 are target binding sites found in untranslated regions of mRNA encoded by BTN3A2, corresponding to target binding sites such as BINDING SITE I, BINDING SITE II or BINDING SITE III of FIG. 8. Table 4 illustrates the complementarity of the nucleotide sequences of BTN3A2 BINDING SITE1 and BTN3A2 BINDING SITE2, designated SEQ ID:14305 and SEQ ID:15108 respectively, to the nucleotide sequence of GAM7957 RNA, herein designated GAM RNA, also designated SEQ ID:297.

Another function of GAM7957 is therefore inhibition of Butyrophilin, subfamily 3, member a2 (BTN3A2, Accession NP_008978.1). Accordingly, utilities of GAM7957 include diagnosis, prevention and treatment of diseases and clinical conditions associated with BTN3A2.

Chromosome 12 open reading frame 2 (C12orf2, Accession NP_009142.2) is another GAM7957 target gene, herein designated TARGET GENE. C12orf2 BINDING SITE is a target binding site found in the 3' untranslated region of mRNA encoded by C12orf2, corresponding to a target binding site such as BINDING SITE I, BINDING SITE II or BINDING SITE III of FIG. 8. Table 4 illustrates the complementarity of the nucleotide sequences of C12orf2 BINDING SITE, designated SEQ ID:9765, to the nucleotide sequence of GAM7957 RNA, herein designated GAM RNA, also designated SEQ ID:297.

Another function of GAM7957 is therefore inhibition of Chromosome 12 open reading frame 2 (C12orf2, Accession NP_009142.2). Accordingly, utilities of GAM7957 include diagnosis, prevention and treatment of diseases and clinical conditions associated with C12orf2.

Chromosome 13 open reading frame 1 (C13orf1, Accession NP_065189.1) is another GAM7957 target gene, herein designated TARGET GENE. C13orf1 BINDING SITE is a target binding site found in the 3' untranslated region of mRNA encoded by C13orf1, corresponding to a target binding site such as BINDING SITE I, BINDING SITE II or BINDING SITE III of FIG. 8. Table 4 illustrates the complementarity of the nucleotide sequences of C13orf1 BINDING SITE, designated SEQ ID:13358, to the nucleotide sequence of GAM7957 RNA, herein designated GAM RNA, also designated SEQ ID:297.

Another function of GAM7957 is therefore inhibition of Chromosome 13 open reading frame 1 (C13orf1, Accession NP_065189.1). Accordingly, utilities of GAM7957 include diagnosis, prevention and treatment of diseases and clinical conditions associated with C13orf1.

C14orf102 (Accession NP_060440.1) is another GAM7957 target gene, herein designated TARGET GENE. C14orf102 BINDING SITE is a target binding site found in the 3' untranslated region of mRNA encoded by C14orf102, corresponding to a target binding site such as BINDING SITE I, BINDING SITE II or BINDING SITE III of FIG. 8. Table 4 illustrates the complementarity of the nucleotide sequences of C14orf102 BINDING SITE, designated SEQ ID:11463, to the nucleotide sequence of GAM7957 RNA, herein designated GAM RNA, also designated SEQ ID:297.

Another function of GAM7957 is therefore inhibition of C14orf102 (Accession NP_060440.1). Accordingly, utilities of GAM7957 include diagnosis, prevention and treatment of diseases and clinical conditions associated with C14orf102.

C14orf105 (Accession NP_060638.1) is another GAM7957 target gene, herein designated TARGET GENE. C14orf105 BINDING SITE is a target binding site found in the 3' untranslated region of mRNA encoded by C14orf105, corresponding to a target binding site such as BINDING SITE I, BINDING SITE II or BINDING SITE III of FIG. 8. Table 4 illustrates the complementarity of the nucleotide sequences of C14orf105 BINDING SITE, designated SEQ ID:13632, to the nucleotide sequence of GAM7957 RNA, herein designated GAM RNA, also designated SEQ ID:297.

Another function of GAM7957 is therefore inhibition of C14orf105 (Accession NP_060638.1). Accordingly, utilities of GAM7957 include diagnosis, prevention and treatment of diseases and clinical conditions associated with C14orf105.

C14orf117 (Accession NP_061148.1) is another GAM7957 target gene, herein designated TARGET GENE. C14orf117 BINDING SITE is a target binding site found in the 3' untranslated region of mRNA encoded by C14orf117, corresponding to a target binding site such as BINDING SITE I, BINDING SITE II or BINDING SITE III of FIG. 8. Table 4 illustrates the complementarity of the nucleotide sequences of C14orf117 BINDING SITE, designated SEQ ID:4003, to the nucleotide sequence of GAM7957 RNA, herein designated GAM RNA, also designated SEQ ID:297.

Another function of GAM7957 is therefore inhibition of C14orf117 (Accession NP_061148.1). Accordingly, utilities of GAM7957 include diagnosis, prevention and treatment of diseases and clinical conditions associated with C14orf117.

C14orf139 (Accession NP_078909.1) is another GAM7957 target gene, herein designated TARGET GENE. C14orf139 BINDING SITE is a target binding site found in the 3' untranslated region of mRNA encoded by C14orf139, corresponding to a target binding site such as BINDING SITE I, BINDING SITE II or BINDING SITE III of FIG. 8. Table 4 illustrates the complementarity of the nucleotide sequences of C14orf139 BINDING SITE, designated SEQ ID:19330, to the nucleotide sequence of GAM7957 RNA, herein designated GAM RNA, also designated SEQ ID:297.

Another function of GAM7957 is therefore inhibition of C14orf139 (Accession NP_078909.1). Accordingly, utilities of GAM7957 include diagnosis, prevention and treatment of diseases and clinical conditions associated with C14orf139.

C14orf143 (Accession NP_660274.1) is another GAM7957 target gene, herein designated TARGET GENE. C14orf143 BINDING SITE1 and C14orf143 BINDING SITE2 are target binding sites found in untranslated regions of mRNA encoded by C14orf143, corresponding to target binding sites such as BINDING SITE I, BINDING SITE II or BINDING SITE III of FIG. 8. Table 4 illustrates the complementarity of the nucleotide sequences of C14orf143 BINDING SITE1 and C14orf143 BINDING SITE2, designated SEQ ID:2780 and SEQ ID:4559 respectively, to the nucleotide sequence of GAM7957 RNA, herein designated GAM RNA, also designated SEQ ID:297.

Another function of GAM7957 is therefore inhibition of C14orf143 (Accession NP_660274.1). Accordingly, utilities of GAM7957 include diagnosis, prevention and treatment of diseases and clinical conditions associated with C14orf143.

Chromosome 14 open reading frame 23 (C14orf23, Accession XP_096757.2) is another GAM7957 target gene, herein designated TARGET GENE. C14orf23 BINDING SITE1 and C14orf23 BINDING SITE2 are target binding sites found in untranslated regions of mRNA encoded by C14orf23, corresponding to target binding sites such as BINDING SITE I, BINDING SITE II or BINDING SITE III of FIG. 8. Table 4 illustrates the complementarity of the nucleotide sequences of C14orf23 BINDING SITE1 and C14orf23 BINDING SITE2, designated SEQ ID:13155 and SEQ ID:8019 respectively, to the nucleotide sequence of GAM7957 RNA, herein designated GAM RNA, also designated SEQ ID:297.

Another function of GAM7957 is therefore inhibition of Chromosome 14 open reading frame 23 (C14orf23, Accession XP_096757.2). Accordingly, utilities of GAM7957 include diagnosis, prevention and treatment of diseases and clinical conditions associated with C14orf23.

C14orf24 (Accession NP_775878.1) is another GAM7957 target gene, herein designated TARGET GENE. C14orf24 BINDING SITE1 and C14orf24 BINDING SITE2 are target binding sites found in untranslated regions of mRNA encoded by C14orf24, corresponding to target binding sites such as BINDING SITE I, BINDING SITE II or BINDING SITE III of FIG. 8. Table 4 illustrates the complementarity of the nucleotide sequences of C14orf24 BINDING SITE1 and C14orf24 BINDING SITE2, designated SEQ ID:7122 and SEQ ID:16828 respectively, to the nucleotide sequence of GAM7957 RNA, herein designated GAM RNA, also designated SEQ ID:297.

Another function of GAM7957 is therefore inhibition of C14orf24 (Accession NP_775878.1). Accordingly, utilities of GAM7957 include diagnosis, prevention and treatment of diseases and clinical conditions associated with C14orf24.

Chromosome 14 open reading frame 4 (C14orf4, Accession XP_041104.1) is another GAM7957 target gene, herein designated TARGET GENE. C14orf4 BINDING SITE is a target binding site found in the 5' untranslated region of mRNA encoded by C14orf4, corresponding to a target binding site such as BINDING SITE I, BINDING SITE II or BINDING SITE III of FIG. 8. Table 4 illustrates the complementarity of the nucleotide sequences of C14orf4 BINDING SITE, designated SEQ ID:10582, to the nucleotide sequence of GAM7957 RNA, herein designated GAM RNA, also designated SEQ ID:297.

Another function of GAM7957 is therefore inhibition of Chromosome 14 open reading frame 4 (C14orf4, Accession XP_041104.1). Accordingly, utilities of GAM7957 include diagnosis, prevention and treatment of diseases and clinical conditions associated with C14orf4.

Chromosome 14 open reading frame 43 (C14orf43, Accession XP_040343.3) is another GAM7957 target gene, herein designated TARGET GENE. C14orf43 BINDING SITE is a target binding site found in the 3' untranslated region of mRNA encoded by C14orf43, corresponding to a target binding site such as BINDING SITE I, BINDING SITE II or BINDING SITE III of FIG. 8. Table 4 illustrates the complementarity of the nucleotide sequences of C14orf43 BINDING SITE, designated SEQ ID:14786, to the nucleotide sequence of GAM7957 RNA, herein designated GAM RNA, also designated SEQ ID:297.

Another function of GAM7957 is therefore inhibition of Chromosome 14 open reading frame 43 (C14orf43, Accession XP_040343.3). Accordingly, utilities of GAM7957 include diagnosis, prevention and treatment of diseases and clinical conditions associated with C14orf43.

Chromosome 14 open reading frame 46 (C14orf46, Accession XP_040376.1) is another GAM7957 target gene, herein designated TARGET GENE. C14orf46 BINDING SITE is a target binding site found in the 3' untranslated region of mRNA encoded by C14orf46, corresponding to a target binding site such as BINDING SITE I, BINDING SITE II or BINDING SITE III of FIG. 8. Table 4 illustrates the complementarity of the nucleotide sequences of C14orf46 BINDING SITE, designated SEQ ID:4702, to the nucleotide sequence of GAM7957 RNA, herein designated GAM RNA, also designated SEQ ID:297.

Another function of GAM7957 is therefore inhibition of Chromosome 14 open reading frame 46 (C14orf46, Accession XP_040376.1). Accordingly, utilities of GAM7957 include diagnosis, prevention and treatment of diseases and clinical conditions associated with C14orf46.

C14orf70 (Accession XP_211096.1) is another GAM7957 target gene, herein designated TARGET GENE. C14orf70 BINDING SITE is a target binding site found in the 5' untranslated region of mRNA encoded by C14orf70, corresponding to a target binding site such as BINDING SITE I, BINDING SITE II or BINDING SITE III of FIG. 8. Table 4 illustrates the complementarity of the nucleotide sequences of C14orf70 BINDING SITE, designated SEQ ID:14106, to the nucleotide sequence of GAM7957 RNA, herein designated GAM RNA, also designated SEQ ID:297.

Another function of GAM7957 is therefore inhibition of C14orf70 (Accession XP_211096.1). Accordingly, utilities of GAM7957 include diagnosis, prevention and treatment of diseases and clinical conditions associated with C14orf70.

Chromosome 1 open reading frame 24 (C1orf24, Accession NP_443198.1) is another GAM7957 target gene, herein designated TARGET GENE. C1orf24 BINDING SITE is a target binding site found in the 3' untranslated region of multiple transcripts of mRNA encoded by C1orf24, corresponding to a target binding site such as BINDING SITE I, BINDING SITE II or BINDING SITE III of FIG. 8. Table 4 illustrates the complementarity of the nucleotide sequences of C1orf24 BINDING SITE, designated SEQ ID:10419, to the nucleotide sequence of GAM7957 RNA, herein designated GAM RNA, also designated SEQ ID:297.

Another function of GAM7957 is therefore inhibition of Chromosome 1 open reading frame 24 (C1orf24, Accession NP_443198.1). Accordingly, utilities of GAM7957 include diagnosis, prevention and treatment of diseases and clinical conditions associated with C1orf24.

Chromosome 1 open reading frame 33 (C1orf33, Accession NP_057267.2) is another GAM7957 target gene, herein designated TARGET GENE. C1orf33 BINDING SITE is a target binding site found in the 3' untranslated region of mRNA encoded by C1orf33, corresponding to a target binding site such as BINDING SITE I, BINDING SITE II or BINDING SITE III of FIG. 8. Table 4 illustrates the complementarity of the nucleotide sequences of C1orf33 BINDING SITE, designated SEQ ID:15057, to the nucleotide sequence of GAM7957 RNA, herein designated GAM RNA, also designated SEQ ID:297.

Another function of GAM7957 is therefore inhibition of Chromosome 1 open reading frame 33 (C1orf33, Accession NP_057267.2). Accordingly, utilities of GAM7957 include diagnosis, prevention and treatment of diseases and clinical conditions associated with C1orf33.

Chromosome 1 open reading frame 34 (C1orf34, Accession XP_027172.1) is another GAM7957 target gene, herein designated TARGET GENE. C1orf34 BINDING SITE1 and C1orf34 BINDING SITE2 are target binding sites found in untranslated regions of mRNA encoded by C1orf34, corresponding to target binding sites such as BINDING SITE I, BINDING SITE II or BINDING SITE III of FIG. 8. Table 4 illustrates the complementarity of the nucleotide sequences of C1orf34 BINDING SITE1 and C1orf34 BINDING SITE2, designated SEQ ID:18827 and SEQ ID:18691 respectively, to the nucleotide sequence of GAM7957 RNA, herein designated GAM RNA, also designated SEQ ID:297.

Another function of GAM7957 is therefore inhibition of Chromosome 1 open reading frame 34 (C1orf34, Accession XP_027172.1). Accordingly, utilities of GAM7957 include diagnosis, prevention and treatment of diseases and clinical conditions associated with C1orf34.

Chromosome 20 open reading frame 108 (C20orf108, Accession NP_543011.1) is another GAM7957 target gene, herein designated TARGET GENE. C20orf108 BINDING SITE is a target binding site found in the 3' untranslated region of mRNA encoded by C20orf108, corresponding to a target binding site such as BINDING SITE I, BINDING SITE II or BINDING SITE III of FIG. 8. Table 4 illustrates the complementarity of the nucleotide sequences of C20orf108 BINDING SITE, designated SEQ ID:9763, to the nucleotide sequence of GAM7957 RNA, herein designated GAM RNA, also designated SEQ ID:297.

Another function of GAM7957 is therefore inhibition of Chromosome 20 open reading frame 108 (C20orf108, Accession NP_543011.1). Accordingly, utilities of GAM7957 include diagnosis, prevention and treatment of diseases and clinical conditions associated with C20orf108.

Chromosome 20 open reading frame 12 (C20orf12, Accession NP_060622.2) is another GAM7957 target gene, herein designated TARGET GENE. C20orf12 BINDING SITE is a target binding site found in the 3' untranslated region of mRNA encoded by C20orf12, corresponding to a target binding site such as BINDING SITE I, BINDING SITE II or BINDING SITE III of FIG. 8. Table 4 illustrates the complementarity of the nucleotide sequences of C20orf12 BINDING SITE, designated SEQ ID:4680, to the nucleotide sequence of GAM7957 RNA, herein designated GAM RNA, also designated SEQ ID:297.

Another function of GAM7957 is therefore inhibition of Chromosome 20 open reading frame 12 (C20orf12, Accession NP_060622.2). Accordingly, utilities of GAM7957 include diagnosis, prevention and treatment of diseases and clinical conditions associated with C20orf12.

Chromosome 20 open reading frame 142 (C20orf142, Accession XP_300782.1) is another GAM7957 target gene, herein designated TARGET GENE. C20orf142 BINDING SITE is a target binding site found in the 3' untranslated region of mRNA encoded by C20orf142, corresponding to a target binding site such as BINDING SITE I, BINDING SITE II or BINDING SITE III of FIG. 8. Table 4 illustrates the complementarity of the nucleotide sequences of C20orf142 BINDING SITE, designated SEQ ID:12434, to the nucleotide sequence of GAM7957 RNA, herein designated GAM RNA, also designated SEQ ID:297.

Another function of GAM7957 is therefore inhibition of Chromosome 20 open reading frame 142 (C20orf142, Accession XP_300782.1). Accordingly, utilities of GAM7957 include diagnosis, prevention and treatment of diseases and clinical conditions associated with C20orf142.

Chromosome 20 open reading frame 172 (C20orf172, Accession NP_079194.2) is another GAM7957 target gene, herein designated TARGET GENE. C20orf172 BINDING SITE is a target binding site found in the 3' untranslated region of mRNA encoded by C20orf172, corresponding to a target binding site such as BINDING SITE I, BINDING SITE II or BINDING SITE III of FIG. 8. Table 4 illustrates the complementarity of the nucleotide sequences of C20orf172 BINDING SITE, designated SEQ ID:5441, to the nucleotide sequence of GAM7957 RNA, herein designated GAM RNA, also designated SEQ ID:297.

Another function of GAM7957 is therefore inhibition of Chromosome 20 open reading frame 172 (C20orf172, Accession NP_079194.2). Accordingly, utilities of GAM7957 include diagnosis, prevention and treatment of diseases and clinical conditions associated with C20orf172.

Chromosome 20 open reading frame 175 (C20orf175, Accession NP_543019.1) is another GAM7957 target gene, herein designated TARGET GENE. C20orf175 BINDING SITE is a target binding site found in the 3' untranslated region of mRNA encoded by C20orf175, corresponding to a target binding site such as BINDING SITE I, BINDING SITE II or BINDING SITE III of FIG. 8. Table 4 illustrates the complementarity of the nucleotide sequences of C20orf175 BINDING SITE, designated SEQ ID:2547, to the nucleotide sequence of GAM7957 RNA, herein designated GAM RNA, also designated SEQ ID:297.

Another function of GAM7957 is therefore inhibition of Chromosome 20 open reading frame 175 (C20orf175, Accession NP_543019.1). Accordingly, utilities of GAM7957 include diagnosis, prevention and treatment of diseases and clinical conditions associated with C20orf175.

Chromosome 20 open reading frame 177 (C20orf177, Accession XP_290955.1) is another GAM7957 target gene, herein designated TARGET GENE. C20orf177 BINDING SITE is a target binding site found in the 3' untranslated region of mRNA encoded by C20orf177, corresponding to a target binding site such as BINDING SITE I, BINDING SITE II or BINDING SITE III of FIG. 8. Table 4 illustrates the complementarity of the nucleotide sequences of C20orf177 BINDING SITE, designated SEQ ID:18683, to the nucleotide sequence of GAM7957 RNA, herein designated GAM RNA, also designated SEQ ID:297.

Another function of GAM7957 is therefore inhibition of Chromosome 20 open reading frame 177 (C20orf177, Accession XP_290955.1). Accordingly, utilities of GAM7957 include diagnosis, prevention and treatment of diseases and clinical conditions associated with C20orf177.

Chromosome 20 open reading frame 29 (C20orf29, Accession NP_060817.1) is another GAM7957 target gene, herein designated TARGET GENE. C20orf29 BINDING SITE1 and C20orf29 BINDING SITE2 are target binding sites found in untranslated regions of mRNA encoded by C20orf29, corresponding to target binding sites such as BINDING SITE I, BINDING SITE II or BINDING SITE III of FIG. 8. Table 4 illustrates the complementarity of the nucleotide sequences of C20orf29 BINDING SITE1 and C20orf29 BINDING SITE2, designated SEQ ID:17737 and SEQ ID:19584 respectively, to the nucleotide sequence of GAM7957 RNA, herein designated GAM RNA, also designated SEQ ID:297.

Another function of GAM7957 is therefore inhibition of Chromosome 20 open reading frame 29 (C20orf29, Accession NP_060817.1). Accordingly, utilities of GAM7957 include diagnosis, prevention and treatment of diseases and clinical conditions associated with C20orf29.

Chromosome 21 open reading frame 108 (C21orf108, Accession XP_114191.2) is another GAM7957 target gene, herein designated TARGET GENE. C21orf108 BINDING SITE is a target binding site found in the 3' untranslated region of mRNA encoded by C21orf108, corresponding to a target binding site such as BINDING SITE I, BINDING SITE II or BINDING SITE III of FIG. 8. Table 4 illustrates the complementarity of the nucleotide sequences of C21orf108 BINDING SITE, designated SEQ ID:5823, to the nucleotide sequence of GAM7957 RNA, herein designated GAM RNA, also designated SEQ ID:297.

Another function of GAM7957 is therefore inhibition of Chromosome 21 open reading frame 108 (C21orf108, Accession XP_114191.2). Accordingly, utilities of GAM7957 include diagnosis, prevention and treatment of diseases and clinical conditions associated with C21orf108.

Chromosome 21 open reading frame 62 (C21orf62, Accession NP_062542.1) is another GAM7957 target gene, herein designated TARGET GENE. C21orf62 BINDING SITE is a target binding site found in the 5' untranslated region of mRNA encoded by C21orf62, corresponding to a target binding site such as BINDING SITE I, BINDING SITE II or BINDING SITE III of FIG. 8. Table 4 illustrates the complementarity of the nucleotide sequences of C21orf62 BINDING SITE, designated SEQ ID:8800, to the nucleotide sequence of GAM7957 RNA, herein designated GAM RNA, also designated SEQ ID:297.

Another function of GAM7957 is therefore inhibition of Chromosome 21 open reading frame 62 (C21orf62, Accession NP_062542.1). Accordingly, utilities of GAM7957 include diagnosis, prevention and treatment of diseases and clinical conditions associated with C21orf62.

Chromosome 21 open reading frame 97 (C21orf97, Accession NP_068760.1) is another GAM7957 target gene, herein designated TARGET GENE. C21orf97 BINDING SITE is a target binding site found in the 3' untranslated region of mRNA encoded by C21orf97, corresponding to a target binding site such as BINDING SITE I, BINDING SITE II or BINDING SITE III of FIG. 8. Table 4 illustrates the complementarity of the nucleotide sequences of C21orf97 BINDING SITE, designated SEQ ID:14711, to the nucleotide sequence of GAM7957 RNA, herein designated GAM RNA, also designated SEQ ID:297.

Another function of GAM7957 is therefore inhibition of Chromosome 21 open reading frame 97 (C21orf97, Accession NP_068760.1). Accordingly, utilities of GAM7957 include diagnosis, prevention and treatment of diseases and clinical conditions associated with C21orf97.

Chromosome 22 open reading frame 19 (C22orf19, Accession NP_003669.2) is another GAM7957 target gene, herein designated TARGET GENE. C22orf19 BINDING SITE1 through C22orf19 BINDING SITE3 are target binding sites found in untranslated regions of mRNA encoded by C22orf19, corresponding to target binding sites such as BINDING SITE I, BINDING SITE II or BINDING SITE III of FIG. 8. Table 4 illustrates the complementarity of the nucleotide sequences of C22orf19 BINDING SITE1 through C22orf19 BINDING SITE3, designated SEQ ID:4658, SEQ ID:9519 and SEQ ID:15217 respectively, to the nucleotide sequence of GAM7957 RNA, herein designated GAM RNA, also designated SEQ ID:297.

Another function of GAM7957 is therefore inhibition of Chromosome 22 open reading frame 19 (C22orf19, Accession NP_003669.2). Accordingly, utilities of GAM7957 include diagnosis, prevention and treatment of diseases and clinical conditions associated with C22orf19.

Chromosome 22 open reading frame 20 (C22orf20, Accession NP_079501.2) is another GAM7957 target gene, herein designated TARGET GENE. C22orf20 BINDING SITE is a target binding site found in the 3' untranslated region of mRNA encoded by C22orf20, corresponding to a target binding site such as BINDING SITE I, BINDING SITE II or BINDING SITE III of FIG. 8. Table 4 illustrates the complementarity of the nucleotide sequences of C22orf20 BINDING SITE, designated SEQ ID:18684, to the nucleotide sequence of GAM7957 RNA, herein designated GAM RNA, also designated SEQ ID:297.

Another function of GAM7957 is therefore inhibition of Chromosome 22 open reading frame 20 (C22orf20, Accession NP_079501.2). Accordingly, utilities of GAM7957 include diagnosis, prevention and treatment of diseases and clinical conditions associated with C22orf20.

C6orf149 (Accession NP_065141.2) is another GAM7957 target gene, herein designated TARGET GENE. C6orf149 BINDING SITE is a target binding site found in the 3' untranslated region of mRNA encoded by C6orf149, corresponding to a target binding site such as BINDING SITE I, BINDING SITE II or BINDING SITE III of FIG. 8. Table 4 illustrates the complementarity of the nucleotide sequences of C6orf149 BINDING SITE, designated SEQ ID:1454, to the nucleotide sequence of GAM7957 RNA, herein designated GAM RNA, also designated SEQ ID:297.

Another function of GAM7957 is therefore inhibition of C6orf149 (Accession NP_065141.2). Accordingly, utilities of GAM7957 include diagnosis, prevention and treatment of diseases and clinical conditions associated with C6orf149.

C6orf150 (Accession NP_612450.1) is another GAM7957 target gene, herein designated TARGET GENE. C6orf150 BINDING SITE is a target binding site found in the 3' untranslated region of mRNA encoded by C6orf150, corresponding to a target binding site such as BINDING SITE I, BINDING SITE II or BINDING SITE III of FIG. 8. Table 4 illustrates the complementarity of the nucleotide sequences of C6orf150 BINDING SITE, designated SEQ ID:14568, to the nucleotide sequence of GAM7957 RNA, herein designated GAM RNA, also designated SEQ ID:297.

Another function of GAM7957 is therefore inhibition of C6orf150 (Accession NP_612450.1). Accordingly, utilities of GAM7957 include diagnosis, prevention and treatment of diseases and clinical conditions associated with C6orf150.

C6orf166 (Accession NP_060534.1) is another GAM7957 target gene, herein designated TARGET GENE. C6orf166 BINDING SITE is a target binding site found in the 5' untranslated region of mRNA encoded by C6orf166, corresponding to a target binding site such as BINDING SITE I, BINDING SITE II or BINDING SITE III of FIG. 8. Table 4 illustrates the complementarity of the nucleotide sequences of C6orf166 BINDING SITE, designated SEQ ID:10236, to the nucleotide sequence of GAM7957 RNA, herein designated GAM RNA, also designated SEQ ID:297.

Another function of GAM7957 is therefore inhibition of C6orf166 (Accession NP_060534.1). Accordingly, utilities of GAM7957 include diagnosis, prevention and treatment of diseases and clinical conditions associated with C6orf166.

Chromosome 6 open reading frame 29 (C6orf29, Accession NP_116183.1) is another GAM7957 target gene, herein designated TARGET GENE. C6orf29 BINDING SITE1 and C6orf29 BINDING SITE2 are target binding sites found in untranslated regions of multiple transcripts of mRNA encoded by C6orf29, corresponding to target binding sites such as BINDING SITE I, BINDING SITE II or BINDING SITE III of FIG. 8. Table 4 illustrates the complementarity of the nucleotide sequences of C6orf29 BINDING SITE1 and C6orf29 BINDING SITE2, designated SEQ ID:10438 and SEQ ID:5830 respectively, to the nucleotide sequence of GAM7957 RNA, herein designated GAM RNA, also designated SEQ ID:297.

Another function of GAM7957 is therefore inhibition of Chromosome 6 open reading frame 29 (C6orf29, Accession NP_116183.1). Accordingly, utilities of GAM7957 include diagnosis, prevention and treatment of diseases and clinical conditions associated with C6orf29.

C6orf5 (Accession NP_056339.2) is another GAM7957 target gene, herein designated TARGET GENE. C6orf5 BINDING SITE1 through C6orf5 BINDING SITE3 are target binding sites found in untranslated regions of mRNA encoded by C6orf5, corresponding to target binding sites such as BINDING SITE I, BINDING SITE II or BINDING SITE III of FIG. 8. Table 4 illustrates the complementarity of the nucleotide sequences of C6orf5 BINDING SITE1 through C6orf5 BINDING SITE3, designated SEQ ID:1492, SEQ ID:10438 and SEQ ID:2576 respectively, to the nucleotide sequence of GAM7957 RNA, herein designated GAM RNA, also designated SEQ ID:297.

Another function of GAM7957 is therefore inhibition of C6orf5 (Accession NP_056339.2). Accordingly, utilities of GAM7957 include diagnosis, prevention and treatment of diseases and clinical conditions associated with C6orf5.

C6orf57 (Accession NP_660310.1) is another GAM7957 target gene, herein designated TARGET GENE. C6orf57 BINDING SITE is a target binding site found in the 3' untranslated region of mRNA encoded by C6orf57, corresponding to a target binding site such as BINDING SITE I, BINDING SITE II or BINDING SITE III of FIG. 8. Table 4 illustrates the complementarity of the nucleotide sequences of C6orf57 BINDING SITE, designated SEQ ID:17417, to the nucleotide sequence of GAM7957 RNA, herein designated GAM RNA, also designated SEQ ID:297.

Another function of GAM7957 is therefore inhibition of C6orf57 (Accession NP_660310.1). Accordingly, utilities of GAM7957 include diagnosis, prevention and treatment of diseases and clinical conditions associated with C6orf57.

C6orf96 (Accession NP_060379.1) is another GAM7957 target gene, herein designated TARGET GENE. C6orf96 BINDING SITE is a target binding site found in the 3' untranslated region of mRNA encoded by C6orf96, corresponding to a target binding site such as BINDING SITE I, BINDING SITE II or BINDING SITE III of FIG. 8. Table 4 illustrates the complementarity of the nucleotide sequences of C6orf96 BINDING SITE, designated SEQ ID:15978, to the nucleotide sequence of GAM7957 RNA, herein designated GAM RNA, also designated SEQ ID:297.

Another function of GAM7957 is therefore inhibition of C6orf96 (Accession NP_060379.1). Accordingly, utilities of GAM7957 include diagnosis, prevention and treatment of diseases and clinical conditions associated with C6orf96.

Chromosome 7 open reading frame 3 (C7orf3, Accession XP_049384.6) is another GAM7957 target gene, herein designated TARGET GENE. C7orf3 BINDING SITE is a target binding site found in the 3' untranslated region of mRNA encoded by C7orf3, corresponding to a target binding site such as BINDING SITE I, BINDING SITE II or BINDING SITE III of FIG. 8. Table 4 illustrates the complementarity of the nucleotide sequences of C7orf3 BINDING SITE, designated SEQ ID:11428, to the nucleotide sequence of GAM7957 RNA, herein designated GAM RNA, also designated SEQ ID:297.

Another function of GAM7957 is therefore inhibition of Chromosome 7 open reading frame 3 (C7orf3, Accession XP_049384.6). Accordingly, utilities of GAM7957 include diagnosis, prevention and treatment of diseases and clinical conditions associated with C7orf3.

Chromosome 8 open reading frame 17 (C8orf17, Accession NP_064622.1) is another GAM7957 target gene, herein designated TARGET GENE. C8orf17 BINDING SITE is a target binding site found in the 3' untranslated region of mRNA encoded by C8orf17, corresponding to a target binding site such as BINDING SITE I, BINDING SITE II or BINDING SITE III of FIG. 8. Table 4 illustrates the complementarity of the nucleotide sequences of C8orf17 BINDING SITE, designated SEQ ID:19452, to the nucleotide sequence of GAM7957 RNA, herein designated GAM RNA, also designated SEQ ID:297.

Another function of GAM7957 is therefore inhibition of Chromosome 8 open reading frame 17 (C8orf17, Accession NP_064622.1). Accordingly, utilities of GAM7957 include diagnosis, prevention and treatment of diseases and clinical conditions associated with C8orf17.

Chromosome 9 open reading frame 5 (C9orf5, Accession NP_114401.1) is another GAM7957 target gene, herein designated TARGET GENE. C9orf5 BINDING SITE is a target binding site found in the 3' untranslated region of mRNA encoded by C9orf5, corresponding to a target binding site such as BINDING SITE I, BINDING SITE II or BINDING SITE III of FIG. 8. Table 4 illustrates the complementarity of the nucleotide sequences of C9orf5 BINDING SITE, designated SEQ ID:2784, to the nucleotide sequence of GAM7957 RNA, herein designated GAM RNA, also designated SEQ ID:297.

Another function of GAM7957 is therefore inhibition of Chromosome 9 open reading frame 5 (C9orf5, Accession NP_114401.1). Accordingly, utilities of GAM7957 include diagnosis, prevention and treatment of diseases and clinical conditions associated with C9orf5.

CAB56184 (Accession NP_115909.1) is another GAM7957 target gene, herein designated TARGET GENE. CAB56184 BINDING SITE is a target binding site found in the 3' untranslated region of mRNA encoded by CAB56184, corresponding to a target binding site such as BINDING SITE I, BINDING SITE II or BINDING SITE III of FIG. 8. Table 4 illustrates the complementarity of the nucleotide sequences of CAB56184 BINDING SITE, designated SEQ ID:18474, to the nucleotide sequence of GAM7957 RNA, herein designated GAM RNA, also designated SEQ ID:297.

Another function of GAM7957 is therefore inhibition of CAB56184 (Accession NP_115909.1). Accordingly, utilities of GAM7957 include diagnosis, prevention and treatment of diseases and clinical conditions associated with CAB56184.

Calcium channel, voltage-dependent, gamma subunit 1 (CACNG1, Accession NP_000718.1) is another GAM7957 target gene, herein designated TARGET GENE. CACNG1 BINDING SITE is a target binding site found in the 3' untranslated region of mRNA encoded by CACNG1, corresponding to a target binding site such as BINDING SITE I, BINDING SITE II or BINDING SITE III of FIG. 8. Table 4 illustrates the complementarity of the nucleotide sequences of CACNG1 BINDING SITE, designated SEQ ID:7002, to the nucleotide sequence of GAM7957 RNA, herein designated GAM RNA, also designated SEQ ID:297.

Another function of GAM7957 is therefore inhibition of Calcium channel, voltage-dependent, gamma subunit 1 (CACNG1, Accession NP_000718.1), a gene which plays a role in excitation-contraction coupling. Accordingly, utilities of GAM7957 include diagnosis, prevention and treatment of diseases and clinical conditions associated with CACNG1.

The function of CACNG1 and its association with various diseases and clinical conditions, has been established by previous studies, as described hereinabove with reference to GAM40.2. CAM-KIIN (Accession NP_150284.1) is another GAM7957 target gene, herein designated TARGET GENE. CAM-KIIN BINDING SITE is a target binding site found in the 5' untranslated region of mRNA encoded by CAM-KIIN, corresponding to a target binding site such as BINDING SITE I, BINDING SITE II or BINDING SITE III of FIG. 8. Table 4 illustrates the complementarity of the nucleotide sequences of CAM-KIIN BINDING SITE, designated SEQ ID:10376, to the nucleotide sequence of GAM7957 RNA, herein designated GAM RNA, also designated SEQ ID:297.

Another function of GAM7957 is therefore inhibition of CAM-KIIN (Accession NP_150284.1). Accordingly, utilities of GAM7957 include diagnosis, prevention and treatment of diseases and clinical conditions associated with CAM-KIIN.

Calcium/calmodulin-dependent protein kinase kinase 1, alpha (CAMKK1, Accession NP_115670.1) is another GAM7957 target gene, herein designated TARGET GENE. CAMKK1 BINDING SITE is a target binding site found in the 3' untranslated region of multiple transcripts of mRNA encoded by CAMKK1, corresponding to a target binding site such as BINDING SITE I, BINDING SITE II or BINDING SITE III of FIG. 8. Table 4 illustrates the complementarity of the nucleotide sequences of CAMKK1 BINDING SITE, designated SEQ ID:8891, to the nucleotide sequence of GAM7957 RNA, herein designated GAM RNA, also designated SEQ ID:297.

Another function of GAM7957 is therefore inhibition of Calcium/calmodulin-dependent protein kinase kinase 1, alpha (CAMKK1, Accession NP_115670.1). Accordingly, utilities of GAM7957 include diagnosis, prevention and treatment of diseases and clinical conditions associated with CAMKK1.

Calcium/calmodulin-dependent protein kinase kinase 1, alpha (CAMKK1, Accession NP_757343.1) is another GAM7957 target gene, herein designated TARGET GENE. CAMKK1 BINDING SITE is a target binding site found in the 3' untranslated region of multiple transcripts of mRNA encoded by CAMKK1, corresponding to a target binding site such as BINDING SITE I, BINDING SITE II or BINDING SITE III of FIG. 8. Table 4 illustrates the complementarity of the nucleotide sequences of CAMKK1 BINDING SITE, designated SEQ ID:8891, to the nucleotide sequence of GAM7957 RNA, herein designated GAM RNA, also designated SEQ ID:297.

Another function of GAM7957 is therefore inhibition of Calcium/calmodulin-dependent protein kinase kinase 1, alpha (CAMKK1, Accession NP_757343.1). Accordingly, utilities of GAM7957 include diagnosis, prevention and treatment of diseases and clinical conditions associated with CAMKK1.

Calcium/calmodulin-dependent protein kinase kinase 2, beta (CAMKK2, Accession NP_006540.3) is another GAM7957 target gene, herein designated TARGET GENE. CAMKK2 BINDING SITE1 and CAMKK2 BINDING SITE2 are target binding sites found in untranslated regions of multiple transcripts of mRNA encoded by CAMKK2, corresponding to target binding sites such as BINDING SITE I, BINDING SITE II or BINDING SITE III of FIG. 8. Table 4 illustrates the complementarity of the nucleotide sequences of CAMKK2 BINDING SITE1 and CAMKK2 BINDING SITE2, designated SEQ ID:6443 and SEQ ID:6443 respectively, to the nucleotide sequence of GAM7957 RNA, herein designated GAM RNA, also designated SEQ ID:297.

Another function of GAM7957 is therefore inhibition of Calcium/calmodulin-dependent protein kinase kinase 2, beta (CAMKK2, Accession NP_006540.3). Accordingly, utilities of GAM7957 include diagnosis, prevention and treatment of diseases and clinical conditions associated with CAMKK2.

Calcium/calmodulin-dependent protein kinase kinase 2, beta (CAMKK2, Accession NP_757363.1) is another GAM7957 target gene, herein designated TARGET GENE. CAMKK2 BINDING SITE1 and CAMKK2 BINDING SITE2 are target binding sites found in untranslated regions of multiple transcripts of mRNA encoded by CAMKK2, corresponding to target binding sites such as BINDING SITE I, BINDING SITE II or BINDING SITE III of FIG. 8. Table 4 illustrates the complementarity of the nucleotide sequences of CAMKK2 BINDING SITE1 and CAMKK2 BINDING SITE2, designated SEQ ID:6443 and SEQ ID:6443 respectively, to the nucleotide sequence of GAM7957 RNA, herein designated GAM RNA, also designated SEQ ID:297.

Another function of GAM7957 is therefore inhibition of Calcium/calmodulin-dependent protein kinase kinase 2, beta (CAMKK2, Accession NP_757363.1). Accordingly, utilities of GAM7957 include diagnosis, prevention and treatment of diseases and clinical conditions associated with CAMKK2.

Calcium/calmodulin-dependent protein kinase kinase 2, beta (CAMKK2, Accession NP_757365.1) is another GAM7957 target gene, herein designated TARGET GENE. CAMKK2 BINDING SITE1 and CAMKK2 BINDING SITE2 are target binding sites found in untranslated regions of multiple transcripts of mRNA encoded by CAMKK2, corresponding to target binding sites such as BINDING SITE I, BINDING SITE II or BINDING SITE III of FIG. 8. Table 4 illustrates the complementarity of the nucleotide sequences of CAMKK2 BINDING SITE1 and CAMKK2 BINDING SITE2, designated SEQ ID:6443 and SEQ ID:9311 respectively, to the nucleotide sequence of GAM7957 RNA, herein designated GAM RNA, also designated SEQ ID:297.

Another function of GAM7957 is therefore inhibition of Calcium/calmodulin-dependent protein kinase kinase 2, beta (CAMKK2, Accession NP_757365.1). Accordingly, utilities of GAM7957 include diagnosis, prevention and treatment of diseases and clinical conditions associated with CAMKK2.

Calcium/calmodulin-dependent protein kinase kinase 2, beta (CAMKK2, Accession NP_757364.1) is another GAM7957 target gene, herein designated TARGET GENE. CAMKK2 BINDING SITE1 and CAMKK2 BINDING SITE2 are target binding sites found in untranslated regions of multiple transcripts of mRNA encoded by CAMKK2, corresponding to target binding sites such as BINDING SITE I, BINDING SITE II or BINDING SITE III of FIG. 8. Table 4 illustrates the complementarity of the nucleotide sequences of CAMKK2 BINDING SITE1 and CAMKK2 BINDING SITE2, designated SEQ ID:6443 and SEQ ID:16561 respectively, to the nucleotide sequence of GAM7957 RNA, herein designated GAM RNA, also designated SEQ ID:297.

Another function of GAM7957 is therefore inhibition of Calcium/calmodulin-dependent protein kinase kinase 2, beta (CAMKK2, Accession NP_757364.1). Accordingly, utilities of GAM7957 include diagnosis, prevention and treatment of diseases and clinical conditions associated with CAMKK2.

Calpain, small subunit 1 (CAPNS1, Accession NP_001740.1) is another GAM7957 target gene, herein designated TARGET GENE. CAPNS1 BINDING SITE is a target binding site found in the 5' untranslated region of mRNA encoded by CAPNS1, corresponding to a target binding site such as BINDING SITE I, BINDING SITE II or BINDING SITE III of FIG. 8. Table 4 illustrates the complementarity of the nucleotide sequences of CAPNS1 BINDING SITE, designated SEQ ID:16623, to the nucleotide sequence of GAM7957 RNA, herein designated GAM RNA, also designated SEQ ID:297.

Another function of GAM7957 is therefore inhibition of Calpain, small subunit 1 (CAPNS1, Accession NP_001740.1), a gene which calcium- regulated non-lysosomal thiol-protease which catalyze limited proteolysis of substrates involved in cytoskeletal remodelling and signal tranduction. Accordingly, utilities of GAM7957 include diagnosis, prevention and treatment of diseases and clinical conditions associated with CAPNS1.

The function of CAPNS1 and its association with various diseases and clinical conditions, has been established by previous studies, as described hereinabove with reference to GAM496.1. Carbohydrate kinase-like (CARKL, Accession NP_037408.1) is another GAM7957 target gene, herein designated TARGET GENE. CARKL BINDING SITE is a target binding site found in the 3' untranslated region of mRNA encoded by CARKL, corresponding to a target binding site such as BINDING SITE I, BINDING SITE II or BINDING SITE III of FIG. 8. Table 4 illustrates the complementarity of the nucleotide sequences of CARKL BINDING SITE, designated SEQ ID:13435, to the nucleotide sequence of GAM7957 RNA, herein designated GAM RNA, also designated SEQ ID:297.

Another function of GAM7957 is therefore inhibition of Carbohydrate kinase-like (CARKL, Accession NP_037408.1), a gene which is a putative carbohydrate kinase and may be a modifier for the cystinosis phenotype. Accordingly, utilities of GAM7957 include diagnosis, prevention and treatment of diseases and clinical conditions associated with CARKL.

The function of CARKL and its association with various diseases and clinical conditions, has been established by previous studies, as described hereinabove with reference to GAM190.1. Caspase 10, apoptosis-related cysteine protease (CASP10, Accession NP_001221.1) is another GAM7957 target gene, herein designated TARGET GENE. CASP10 BINDING SITE1 and CASP10 BINDING SITE2 are target binding sites found in untranslated regions of multiple transcripts of mRNA encoded by CASP10, corresponding to target binding sites such as BINDING SITE I, BINDING SITE II or BINDING SITE III of FIG. 8. Table 4 illustrates the complementarity of the nucleotide sequences of CASP10 BINDING SITE1 and CASP10 BINDING SITE2, designated SEQ ID:1694 and SEQ ID:1694 respectively, to the nucleotide sequence of GAM7957 RNA, herein designated GAM RNA, also designated SEQ ID:297.

Another function of GAM7957 is therefore inhibition of Caspase 10, apoptosis-related cysteine protease (CASP10, Accession NP_001221.1), a gene which is one aspartatespecific cysteine protease and important in death receptor signaling or other cellular processes and therefore may be associated with Gastric cancers. Accordingly, utilities of GAM7957 include diagnosis, prevention and treatment of Gastric cancers., and of other diseases and clinical conditions associated with CASP10.

The function of CASP10 and its association with various diseases and clinical conditions, has been established by previous studies, as described hereinabove with reference to GAM44.1. Caspase 10, apoptosis-related cysteine protease (CASP10, Accession NP_116759.1) is another GAM7957 target gene, herein designated TARGET GENE. CASP10 BINDING SITE1 and CASP10 BINDING SITE2 are target binding sites found in untranslated regions of multiple transcripts of mRNA encoded by CASP10, corresponding to target binding sites such as BINDING SITE I, BINDING SITE II or BINDING SITE III of FIG. 8. Table 4 illustrates the complementarity of the nucleotide sequences of CASP10 BINDING SITE1 and CASP10 BINDING SITE2, designated SEQ ID:17083 and SEQ ID:17083 respectively, to the nucleotide sequence of GAM7957 RNA, herein designated GAM RNA, also designated SEQ ID:297.

Another function of GAM7957 is therefore inhibition of Caspase 10, apoptosis-related cysteine protease (CASP10, Accession NP_116759.1), a gene which is one aspartate-specific cysteine protease and important in death receptor signaling or other cellular processes and therefore may be associated with Gastric cancers. Accordingly, utilities of GAM7957 include diagnosis, prevention and treatment of Gastric cancers., and of other diseases and clinical conditions associated with CASP10.

The function of CASP10 and its association with various diseases and clinical conditions, has been established by previous studies, as described hereinabove with reference to GAM44.1. Caspase 10, apoptosis-related cysteine protease (CASP10, Accession NP_116758.1) is another GAM7957 target gene, herein designated TARGET GENE. CASP10 BINDING SITE1 and CASP10 BINDING SITE2 are target binding sites found in untranslated regions of multiple transcripts of mRNA encoded by CASP10, corresponding to target binding sites such as BINDING SITE I, BINDING SITE II or BINDING SITE III of FIG. 8. Table 4 illustrates the complementarity of the nucleotide sequences of CASP10 BINDING SITE1 and CASP10 BINDING SITE2, designated SEQ ID:1694 and SEQ ID:17083 respectively, to the nucleotide sequence of GAM7957 RNA, herein designated GAM RNA, also designated SEQ ID:297.

Another function of GAM7957 is therefore inhibition of Caspase 10, apoptosis-related cysteine protease (CASP10, Accession NP_116758.1), a gene which is one aspartate-specific cysteine protease and important in death receptor signaling or other cellular processes and therefore may be associated with Gastric cancers. Accordingly, utilities of GAM7957 include diagnosis, prevention and treatment of Gastric cancers., and of other diseases and clinical conditions associated with CASP10.

The function of CASP10 and its association with various diseases and clinical conditions, has been established by previous studies, as described hereinabove with reference to GAM44.1. Caspase 8, apoptosis-related cysteine protease (CASP8, Accession NP_203521.1) is another GAM7957 target gene, herein designated TARGET GENE. CASP8 BINDING SITE is a target binding site found in the 5' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:7316, to the nucleotide sequence of GAM7957 RNA, herein designated GAM RNA, also designated SEQ ID:297.

Another function of GAM7957 is therefore inhibition of Caspase 8, apoptosis-related cysteine protease (CASP8, Accession NP_203521.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM7957 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Caspase 8, apoptosis-related cysteine protease (CASP8, Accession NP_203519.1) is another GAM7957 target gene, herein designated TARGET GENE. CASP8 BINDING SITE is a target binding site found in the 5' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:7316, to the nucleotide sequence of GAM7957 RNA, herein designated GAM RNA, also designated SEQ ID:297.

Another function of GAM7957 is therefore inhibition of Caspase 8, apoptosis-related cysteine protease (CASP8, Accession NP_203519.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM7957 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. CBCIP2 (Accession NP_116220.1) is another GAM7957 target gene, herein designated TARGET GENE. CBCIP2 BINDING SITE is a target binding site found in the 3' untranslated region of mRNA encoded by CBCIP2, corresponding to a target binding site such as BINDING SITE I, BINDING SITE II or BINDING SITE III of FIG. 8. Table 4 illustrates the complementarity of the nucleotide sequences of CBCIP2 BINDING SITE, designated SEQ ID:614, to the nucleotide sequence of GAM7957 RNA, herein designated GAM RNA, also designated SEQ ID:297.

Another function of GAM7957 is therefore inhibition of CBCIP2 (Accession NP_116220.1). Accordingly, utilities of GAM7957 include diagnosis, prevention and treatment of diseases and clinical conditions associated with CBCIP2.

Chemokine (c-c motif) ligand 5 (CCL5, Accession NP_002976.2) is another GAM7957 target gene, herein designated TARGET GENE. CCL5 BINDING SITE1 through CCL5 BINDING SITE3 are target binding sites found in untranslated regions of mRNA encoded by CCL5, corresponding to target binding sites such as BINDING SITE I, BINDING SITE II or BINDING SITE III of FIG. 8. Table 4 illustrates the complementarity of the nucleotide sequences of CCL5 BINDING SITE1 through CCL5 BINDING SITE3, designated SEQ ID:3753, SEQ ID:15343 and SEQ ID:13155 respectively, to the nucleotide sequence of GAM7957 RNA, herein designated GAM RNA, also designated SEQ ID:297.

Another function of GAM7957 is therefore inhibition of Chemokine (c-c motif) ligand 5 (CCL5, Accession NP_002976.2). Accordingly, utilities of GAM7957 include diagnosis, prevention and treatment of diseases and clinical conditions associated with CCL5.

CCNL2 (Accession NP_112199.1) is another GAM7957 target gene, herein designated TARGET GENE. CCNL2 BINDING SITE is a target binding site found in the 3' untranslated region of mRNA encoded by CCNL2, corresponding to a target binding site such as BINDING SITE I, BINDING SITE II or BINDING SITE III of FIG. 8. Table 4 illustrates the complementarity of the nucleotide sequences of CCNL2 BINDING SITE, designated SEQ ID:2911, to the nucleotide sequence of GAM7957 RNA, herein designated GAM RNA, also designated SEQ ID:297.

Another function of GAM7957 is therefore inhibition of CCNL2 (Accession NP_112199.1). Accordingly, utilities of GAM7957 include diagnosis, prevention and treatment of diseases and clinical conditions associated with CCNL2.

Chemokine (c-c motif) receptor 6 (CCR6, Accession NP_004358.1) is another GAM7957 target gene, herein designated TARGET GENE. CCR6 BINDING SITE is a target binding site found in the 3' untranslated region of multiple transcripts of mRNA encoded by CCR6, corresponding to a target binding site such as BINDING SITE I, BINDING SITE II or BINDING SITE III of FIG. 8. Table 4 illustrates the complementarity of the nucleotide sequences of CCR6 BINDING SITE, designated SEQ ID:12792, to the nucleotide sequence of GAM7957 RNA, herein designated GAM RNA, also designated SEQ ID:297.

Another function of GAM7957 is therefore inhibition of Chemokine (c-c motif) receptor 6 (CCR6, Accession NP_004358.1). Accordingly, utilities of GAM7957 include diagnosis, prevention and treatment of diseases and clinical conditions associated with CCR6.

Chemokine (c-c motif) receptor 6 (CCR6, Accession NP_113597.1) is another GAM7957 target gene, herein designated TARGET GENE. CCR6 BINDING SITE is a target binding site found in the 3' untranslated region of multiple transcripts of mRNA encoded by CCR6, corresponding to a target binding site such as BINDING SITE I, BINDING SITE II or BINDING SITE III of FIG. 8. Table 4 illustrates the complementarity of the nucleotide sequences of CCR6 BINDING SITE, designated SEQ ID:12792, to the nucleotide sequence of GAM7957 RNA, herein designated GAM RNA, also designated SEQ ID:297.

Another function of GAM7957 is therefore inhibition of Chemokine (c-c motif) receptor 6 (CCR6, Accession NP_113597.1). Accordingly, utilities of GAM7957 include diagnosis, prevention and treatment of diseases and clinical conditions associated with CCR6.

Cd19 antigen (CD19, Accession NP_001761.2) is another GAM7957 target gene, herein designated TARGET GENE. CD19 BINDING SITE is a target binding site found in the 3' untranslated region of mRNA encoded by CD19, corresponding to a target binding site such as BINDING SITE I, BINDING SITE II or BINDING SITE III of FIG. 8. Table 4 illustrates the complementarity of the nucleotide sequences of CD19 BINDING SITE, designated SEQ ID:8851, to the nucleotide sequence of GAM7957 RNA, herein designated GAM RNA, also designated SEQ ID:297.

Another function of GAM7957 is therefore inhibition of Cd19 antigen (CD19, Accession NP_001761.2). Accordingly, utilities of GAM7957 include diagnosis, prevention and treatment of diseases and clinical conditions associated with CD19.

Cd28 antigen (tp44) (CD28, Accession NP_006130.1) is another GAM7957 target gene, herein designated TARGET GENE. CD28 BINDING SITE is a target binding site found in the 3' untranslated region of mRNA encoded by CD28, corresponding to a target binding site such as BINDING SITE I, BINDING SITE II or BINDING SITE III of FIG. 8. Table 4 illustrates the complementarity of the nucleotide sequences of CD28 BINDING SITE, designated SEQ ID:13593, to the nucleotide sequence of GAM7957 RNA, herein designated GAM RNA, also designated SEQ ID:297.

Another function of GAM7957 is therefore inhibition of Cd28 antigen (tp44) (CD28, Accession NP_006130.1), a gene which possibly involved in t-cell activation. Accordingly, utilities of GAM7957 include diagnosis, prevention and treatment of diseases and clinical conditions associated with CD28.

The function of CD28 and its association with various diseases and clinical conditions, has been established by previous studies, as described hereinabove with reference to GAM94.1. Cd59 antigen p18-20 (antigen identified by monoclonal antibodies 16.3a5, ej16, ej30, el32 and g344) (CD59, Accession NP_000602.1) is another GAM7957 target gene, herein designated TARGET GENE. CD59 BINDING SITE is a target binding site found in the 3' untranslated region of mRNA encoded by CD59, corresponding to a target binding site such as BINDING SITE I, BINDING SITE II or BINDING SITE III of FIG. 8. Table 4 illustrates the complementarity of the nucleotide sequences of CD59 BINDING SITE, designated SEQ ID:6036, to the nucleotide sequence of GAM7957 RNA, herein designated GAM RNA, also designated SEQ ID:297.

Another function of GAM7957 is therefore inhibition of Cd59 antigen p18-20 (antigen identified by monoclonal antibodies 16.3a5, ej16, ej30, el32 and g344) (CD59, Accession NP_000602.1), a gene which restricts lysis of human erythrocytes and leukocytes by homologous complement. and therefore may be associated with Cd59 deficiency (hemolytic anemia and thrombosis). Accordingly, utilities of GAM7957 include diagnosis, prevention and treatment of Cd59 deficiency (hemolytic anemia and thrombosis), and of other diseases and clinical conditions associated with CD59.

The function of CD59 and its association with various diseases and clinical conditions, has been established by previous studies, as described hereinabove with reference to GAM401.1. Cd68 antigen (CD68, Accession NP_001242.1) is another GAM7957 target gene, herein designated TARGET GENE. CD68 BINDING SITE is a target binding site found in the 3' untranslated region of mRNA encoded by CD68, corresponding to a target binding site such as BINDING SITE I, BINDING SITE II or BINDING SITE III of FIG. 8. Table 4 illustrates the complementarity of the nucleotide sequences of CD68 BINDING SITE, designated SEQ ID:17185, to the nucleotide sequence of GAM7957 RNA, herein designated GAM RNA, also designated SEQ ID:297.

Another function of GAM7957 is therefore inhibition of Cd68 antigen (CD68, Accession NP_001242.1), a gene which is highly expressed by human monocytes and tissue macrophages. Accordingly, utilities of GAM7957 include diagnosis, prevention and treatment of diseases and clinical conditions associated with CD68.

The function of CD68 and its association with various diseases and clinical conditions, has been established by previous studies, as described hereinabove with reference to GAM347.1. Cd84 antigen (leukocyte antigen) (CD84, Accession NP_003865.1) is another GAM7957 target gene, herein designated TARGET GENE. CD84 BINDING SITE is a target binding site found in the 3' untranslated region of mRNA encoded by CD84, corresponding to a target binding site such as BINDING SITE I, BINDING SITE II or BINDING SITE III of FIG. 8. Table 4 illustrates the complementarity of the nucleotide sequences of CD84 BINDING SITE, designated SEQ ID:3814, to the nucleotide sequence of GAM7957 RNA, herein designated GAM RNA, also designated SEQ ID:297.

Another function of GAM7957 is therefore inhibition of Cd84 antigen (leukocyte antigen) (CD84, Accession NP_003865.1). Accordingly, utilities of GAM7957 include diagnosis, prevention and treatment of diseases and clinical conditions associated with CD84.

Congenital dyserythropoietic anemia, type i (CDAN1, Accession XP_085300.3) is another GAM7957 target gene, herein designated TARGET GENE. CDAN1 BINDING SITE is a target binding site found in the 3' untranslated region of mRNA encoded by CDAN1, corresponding to a target binding site such as BINDING SITE I, BINDING SITE II or BINDING SITE III of FIG. 8. Table 4 illustrates the complementarity of the nucleotide sequences of CDAN1 BINDING SITE, designated SEQ ID:6264, to the nucleotide sequence of GAM7957 RNA, herein designated GAM RNA, also designated SEQ ID:297.

Another function of GAM7957 is therefore inhibition of Congenital dyserythropoietic anemia, type i (CDAN1, Accession XP_085300.3). Accordingly, utilities of GAM7957 include diagnosis, prevention and treatment of diseases and clinical conditions associated with CDAN1.

Cdc42 effector protein (rho gtpase binding) 3 (CDC42EP3, Accession NP_006440.2) is another GAM7957 target gene, herein designated TARGET GENE. CDC42EP3 BINDING SITE is a target binding site found in the 5' untranslated region of mRNA encoded by CDC42EP3, corresponding to a target binding site such as BINDING SITE I, BINDING SITE II or BINDING SITE III of FIG. 8. Table 4 illustrates the complementarity of the nucleotide sequences of CDC42EP3 BINDING SITE, designated SEQ ID:8291, to the nucleotide sequence of GAM7957 RNA, herein designated GAM RNA, also designated SEQ ID:297.

Another function of GAM7957 is therefore inhibition of Cdc42 effector protein (rho gtpase binding) 3 (CDC42EP3, Accession NP_006440.2). Accordingly, utilities of GAM7957 include diagnosis, prevention and treatment of diseases and clinical conditions associated with CDC42EP3.

Cell division cycle associated 4 (CDCA4, Accession NP_060425.2) is another GAM7957 target gene, herein designated TARGET GENE. CDCA4 BINDING SITE is a target binding site found in the 3' untranslated region of multiple transcripts of mRNA encoded by CDCA4, corresponding to a target binding site such as BINDING SITE I, BINDING SITE II or BINDING SITE III of FIG. 8. Table 4 illustrates the complementarity of the nucleotide sequences of CDCA4 BINDING SITE, designated SEQ ID:6066, to the nucleotide sequence of GAM7957 RNA, herein designated GAM RNA, also designated SEQ ID:297.

Another function of GAM7957 is therefore inhibition of Cell division cycle associated 4 (CDCA4, Accession NP_060425.2). Accordingly, utilities of GAM7957 include diagnosis, prevention and treatment of diseases and clinical conditions associated with CDCA4.

Cadherin 6, type 2, k-cadherin (fetal kidney) (CDH6, Accession NP_004923.1) is another GAM7957 target gene, herein designated TARGET GENE. CDH6 BINDING SITE is a target binding site found in the 5' untranslated region of mRNA encoded by CDH6, corresponding to a target binding site such as BINDING SITE I, BINDING SITE II or BINDING SITE III of FIG. 8. Table 4 illustrates the complementarity of the nucleotide sequences of CDH6 BINDING SITE, designated SEQ ID:19638, to the nucleotide sequence of GAM7957 RNA, herein designated GAM RNA, also designated SEQ ID:297.

Another function of GAM7957 is therefore inhibition of Cadherin 6, type 2, k-cadherin (fetal kidney) (CDH6, Accession NP_004923.1), a gene which is a calcium dependent cell adhesion protein. Accordingly, utilities of GAM7957 include diagnosis, prevention and treatment of diseases and clinical conditions associated with CDH6.

The function of CDH6 and its association with various diseases and clinical conditions, has been established by previous studies, as described hereinabove with reference to GAM282.2. CDT1 (Accession NP_112190.1) is another GAM7957 target gene, herein designated TARGET GENE. CDT1 BINDING SITE is a target binding site found in the 3' untranslated region of mRNA encoded by CDT1, corresponding to a target binding site such as BINDING SITE I, BINDING SITE II or BINDING SITE III of FIG. 8. Table 4 illustrates the complementarity of the nucleotide sequences of CDT1 BINDING SITE, designated SEQ ID:5446, to the nucleotide sequence of GAM7957 RNA, herein designated GAM RNA, also designated SEQ ID:297.

Another function of GAM7957 is therefore inhibition of CDT1 (Accession NP_112190.1). Accordingly, utilities of GAM7957 include diagnosis, prevention and treatment of diseases and clinical conditions associated with CDT1.

Carcinoembryonic antigen-related cell adhesion molecule 5 (CEACAM5, Accession NP_004354.1) is another GAM7957 target gene, herein designated TARGET GENE. CEACAM5 BINDING SITE1 and CEACAM5 BINDING SITE2 are target binding sites found in untranslated regions of mRNA encoded by CEACAM5, corresponding to target binding sites such as BINDING SITE I, BINDING SITE II or BINDING SITE III of FIG. 8. Table 4 illustrates the complementarity of the nucleotide sequences of CEACAM5 BINDING SITE1 and CEACAM5 BINDING SITE2, designated SEQ ID:3562 and SEQ ID:14555 respectively, to the nucleotide sequence of GAM7957 RNA, herein designated GAM RNA, also designated SEQ ID:297.

Another function of GAM7957 is therefore inhibition of Carcinoembryonic antigen-related cell adhesion molecule 5 (CEACAM5, Accession NP_004354.1), a gene which is a complex immunoreactive glycoprotein and therefore may be associated with Liver metastasis. Accordingly, utilities of GAM7957 include diagnosis, prevention and treatment of Liver metastasis, and of other diseases and clinical conditions associated with CEACAM5.

The function of CEACAM5 and its association with various diseases and clinical conditions, has been established by previous studies, as described hereinabove with reference to GAM347.1. Centaurin, gamma 1 (CENTG1, Accession NP_055585.1) is another GAM7957 target gene, herein designated TARGET GENE. CENTG1 BINDING SITE is a target binding site found in the 3' untranslated region of mRNA encoded by CENTG1, corresponding to a target binding site such as BINDING SITE I, BINDING SITE II or BINDING SITE III of FIG. 8. Table 4 illustrates the complementarity of the nucleotide sequences of CENTG1 BINDING SITE, designated SEQ ID:15422, to the nucleotide sequence of GAM7957 RNA, herein designated GAM RNA, also designated SEQ ID:297.

Another function of GAM7957 is therefore inhibition of Centaurin, gamma 1 (CENTG1, Accession NP_055585.1). Accordingly, utilities of GAM7957 include diagnosis, prevention and treatment of diseases and clinical conditions associated with CENTG1.

Ceramide kinase (CERK, Accession NP_073603.2) is another GAM7957 target gene, herein designated TARGET GENE. CERK BINDING SITE is a target binding site found in the 3' untranslated region of mRNA encoded by CERK, corresponding to a target binding site such as BINDING SITE I, BINDING SITE II or BINDING SITE III of FIG. 8. Table 4 illustrates the complementarity of the nucleotide sequences of CERK BINDING SITE, designated SEQ ID:1617, to the nucleotide sequence of GAM7957 RNA, herein designated GAM RNA, also designated SEQ ID:297.

Another function of GAM7957 is therefore inhibition of Ceramide kinase (CERK, Accession NP_073603.2). Accordingly, utilities of GAM7957 include diagnosis, prevention and treatment of diseases and clinical conditions associated with CERK.

CG012 (Accession XP_096710.1) is another GAM7957 target gene, herein designated TARGET GENE. CG012 BINDING SITE1 through CG012 BINDING SITE4 are target binding sites found in untranslated regions of mRNA encoded by CG012, corresponding to target binding sites such as BINDING SITE I, BINDING SITE II or BINDING SITE III of FIG. 8. Table 4 illustrates the complementarity of the nucleotide sequences of CG012 BINDING SITE1 through CG012 BINDING SITE4, designated SEQ ID:5067, SEQ ID:15105, SEQ ID:11098 and SEQ ID:10655 respectively, to the nucleotide sequence of GAM7957 RNA, herein designated GAM RNA, also designated SEQ ID:297.

Another function of GAM7957 is therefore inhibition of CG012 (Accession XP_096710.1). Accordingly, utilities of GAM7957 include diagnosis, prevention and treatment of diseases and clinical conditions associated with CG012.

CGI-119 (Accession NP_057140.1) is another GAM7957 target gene, herein designated TARGET GENE. CGI-119 BINDING SITE is a target binding site found in the 3' untranslated region of mRNA encoded by CGI-119, corresponding to a target binding site such as BINDING SITE I, BINDING SITE II or BINDING SITE III of FIG. 8. Table 4 illustrates the complementarity of the nucleotide sequences of CGI-119 BINDING SITE, designated SEQ ID:7927, to the nucleotide sequence of GAM7957 RNA, herein designated GAM RNA, also designated SEQ ID:297.

Another function of GAM7957 is therefore inhibition of CGI-119 (Accession NP_057140.1). Accordingly, utilities of GAM7957 include diagnosis, prevention and treatment of diseases and clinical conditions associated with CGI-119.

CGI-57 (Accession NP_056495.2) is another GAM7957 target gene, herein designated TARGET GENE. CGI-57 BINDING SITE is a target binding site found in the 5' untranslated region of mRNA encoded by CGI-57, corresponding to a target binding site such as BINDING SITE I, BINDING SITE II or BINDING SITE III of FIG. 8. Table 4 illustrates the complementarity of the nucleotide sequences of CGI-57 BINDING SITE, designated SEQ ID:4207, to the nucleotide sequence of GAM7957 RNA, herein designated GAM RNA, also designated SEQ ID:297.

Another function of GAM7957 is therefore inhibition of CGI-57 (Accession NP_056495.2). Accordingly, utilities of GAM7957 include diagnosis, prevention and treatment of diseases and clinical conditions associated with CGI-57.

Chrna7 (cholinergic receptor, nicotinic, alpha polypeptide 7, exons 5-10) and fam7a (family with sequence similarity 7a, exons a-e) fusion (CHRFAM7A, Accession NP_683709.1) is another GAM7957 target gene, herein designated TARGET GENE. CHRFAM7A BINDING SITE is a target binding site found in the 5' untranslated region of multiple transcripts of mRNA encoded by CHRFAM7A, corresponding to a target binding site such as BINDING SITE I, BINDING SITE II or BINDING SITE III of FIG. 8. Table 4 illustrates the complementarity of the nucleotide sequences of CHRFAM7A BINDING SITE, designated SEQ ID:19583, to the nucleotide sequence of GAM7957 RNA, herein designated GAM RNA, also designated SEQ ID:297.

Another function of GAM7957 is therefore inhibition of Chrna7 (cholinergic receptor, nicotinic, alpha polypeptide 7, exons 5-10) and fam7a (family with sequence similarity 7a, exons a-e) fusion (CHRFAM7A, Accession NP_683709.1). Accordingly, utilities of GAM7957 include diagnosis, prevention and treatment of diseases and clinical conditions associated with CHRFAM7A.

CKLiK (Accession NP_705718.1) is another GAM7957 target gene, herein designated TARGET GENE. CKLiK BINDING SITE1 and CKLiK BINDING SITE2 are target binding sites found in untranslated regions of multiple transcripts of mRNA encoded by CKLiK, corresponding to target binding sites such as BINDING SITE I, BINDING SITE II or BINDING SITE III of FIG. 8. Table 4 illustrates the complementarity of the nucleotide sequences of CKLiK BINDING SITE1 and CKLiK BINDING SITE2, designated SEQ ID:1797 and SEQ ID:15089 respectively, to the nucleotide sequence of GAM7957 RNA, herein designated GAM RNA, also designated SEQ ID:297.

Another function of GAM7957 is therefore inhibition of CKLiK (Accession NP_705718.1). Accordingly, utilities of GAM7957 include diagnosis, prevention and treatment of diseases and clinical conditions associated with CKLiK.

Chloride channel 7 (CLCN7, Accession NP_001278.1) is another GAM7957 target gene, herein designated TARGET GENE. CLCN7 BINDING SITE is a target binding site found in the 3' untranslated region of mRNA encoded by CLCN7, corresponding to a target binding site such as BINDING SITE I, BINDING SITE II or BINDING SITE III of FIG. 8. Table 4 illustrates the complementarity of the nucleotide sequences of CLCN7 BINDING SITE, designated SEQ ID:11937, to the nucleotide sequence of GAM7957 RNA, herein designated GAM RNA, also designated SEQ ID:297.

Another function of GAM7957 is therefore inhibition of Chloride channel 7 (CLCN7, Accession NP_001278.1), a gene which is voltage- gated chloride channel. and therefore is associated with Osteopetrosis. Accordingly, utilities of GAM7957 include diagnosis, prevention and treatment of Osteopetrosis, and of other diseases and clinical conditions associated with CLCN7.

The function of CLCN7 and its association with various diseases and clinical conditions, has been established by previous studies, as described hereinabove with reference to GAM483.1. Claudin 15 (CLDN15, Accession NP_055158.1) is another GAM7957 target gene, herein designated TARGET GENE. CLDN15 BINDING SITE is a target binding site found in the 5' untranslated region of multiple transcripts of mRNA encoded by CLDN15, corresponding to a target binding site such as BINDING SITE I, BINDING SITE II or BINDING SITE III of FIG. 8. Table 4 illustrates the complementarity of the nucleotide sequences of CLDN15 BINDING SITE, designated SEQ ID:4226, to the nucleotide sequence of GAM7957 RNA, herein designated GAM RNA, also designated SEQ ID:297.

Another function of GAM7957 is therefore inhibition of Claudin 15 (CLDN15, Accession NP_055158.1). Accordingly, utilities of GAM7957 include diagnosis, prevention and treatment of diseases and clinical conditions associated with CLDN15.

Claudin 15 (CLDN15, Accession NP_612438.1) is another GAM7957 target gene, herein designated TARGET GENE. CLDN15 BINDING SITE is a target binding site found in the 5' untranslated region of multiple transcripts of mRNA encoded by CLDN15, corresponding to a target binding site such as BINDING SITE I, BINDING SITE II or BINDING SITE III of FIG. 8. Table 4 illustrates the complementarity of the nucleotide sequences of CLDN15 BINDING SITE, designated SEQ ID:4226, to the nucleotide sequence of GAM7957 RNA, herein designated GAM RNA, also designated SEQ ID:297.

Another function of GAM7957 is therefore inhibition of Claudin 15 (CLDN15, Accession NP_612438.1). Accordingly, utilities of GAM7957 include diagnosis, prevention and treatment of diseases and clinical conditions associated with CLDN15.

Claudin 19 (CLDN19, Accession NP_683763.1) is another GAM7957 target gene, herein designated TARGET GENE. CLDN19 BINDING SITE1 and CLDN19 BINDING SITE2 are target binding sites found in untranslated regions of mRNA encoded by CLDN19, corresponding to target binding sites such as BINDING SITE I, BINDING SITE II or BINDING SITE III of FIG. 8. Table 4 illustrates the complementarity of the nucleotide sequences of CLDN19 BINDING SITE1 and CLDN19 BINDING SITE2, designated SEQ ID:10568 and SEQ ID:5830 respectively, to the nucleotide sequence of GAM7957 RNA, herein designated GAM RNA, also designated SEQ ID:297.

Another function of GAM7957 is therefore inhibition of Claudin 19 (CLDN19, Accession NP_683763.1). Accordingly, utilities of GAM7957 include diagnosis, prevention and treatment of diseases and clinical conditions associated with CLDN19.

Ceroid-lipofuscinosis, neuronal 8 (epilepsy, progressive with mental retardation) (CLN8, Accession NP_061764.2) is another GAM7957 target gene, herein designated TARGET GENE. CLN8 BINDING SITE1 and CLN8 BINDING SITE2 are target binding sites found in untranslated regions of mRNA encoded by CLN8, corresponding to target binding sites such as BINDING SITE I, BINDING SITE II or BINDING SITE III of FIG. 8. Table 4 illustrates the complementarity of the nucleotide sequences of CLN8 BINDING SITE1 and CLN8 BINDING SITE2, designated SEQ ID:18690 and SEQ ID:8497 respectively, to the nucleotide sequence of GAM7957 RNA, herein designated GAM RNA, also designated SEQ ID:297.

Another function of GAM7957 is therefore inhibition of Ceroid-lipofuscinosis, neuronal 8 (epilepsy, progressive with mental retardation) (CLN8, Accession NP_061764.2). Accordingly, utilities of GAM7957 include diagnosis, prevention and treatment of diseases and clinical conditions associated with CLN8.

Claspin homolog (xenopus laevis) (CLSPN, Accession NP_071394.2) is another GAM7957 target gene, herein designated TARGET GENE. CLSPN BINDING SITE is a target binding site found in the 5' untranslated region of mRNA encoded by CLSPN, corresponding to a target binding site such as BINDING SITE I, BINDING SITE II or BINDING SITE III of FIG. 8. Table 4 illustrates the complementarity of the nucleotide sequences of CLSPN BINDING SITE, designated SEQ ID:15905, to the nucleotide sequence of GAM7957 RNA, herein designated GAM RNA, also designated SEQ ID:297.

Another function of GAM7957 is therefore inhibition of Claspin homolog (xenopus laevis) (CLSPN, Accession NP_071394.2). Accordingly, utilities of GAM7957 include diagnosis, prevention and treatment of diseases and clinical conditions associated with CLSPN.

Cyclin m1 (CNNM1, Accession NP_065081.1) is another GAM7957 target gene, herein designated TARGET GENE. CNNM1 BINDING SITE1 and CNNM1 BINDING SITE2 are target binding sites found in untranslated regions of mRNA encoded by CNNM1, corresponding to target binding sites such as BINDING SITE I, BINDING SITE II or BINDING SITE III of FIG. 8. Table 4 illustrates the complementarity of the nucleotide sequences of CNNM1 BINDING SITE1 and CNNM1 BINDING SITE2, designated SEQ ID:5830 and SEQ ID:10439 respectively, to the nucleotide sequence of GAM7957 RNA, herein designated GAM RNA, also designated SEQ ID:297.

Another function of GAM7957 is therefore inhibition of Cyclin m1 (CNNM1, Accession NP_065081.1). Accordingly, utilities of GAM7957 include diagnosis, prevention and treatment of diseases and clinical conditions associated with CNNM1.

COE2 (Accession XP_034639.1) is another GAM7957 target gene, herein designated TARGET GENE. COE2 BINDING SITE is a target binding site found in the 3' untranslated region of mRNA encoded by COE2, corresponding to a target binding site such as BINDING SITE I, BINDING SITE II or BINDING SITE III of FIG. 8. Table 4 illustrates the complementarity of the nucleotide sequences of COE2 BINDING SITE, designated SEQ ID:13624, to the nucleotide sequence of GAM7957 RNA, herein designated GAM RNA, also designated SEQ ID:297.

Another function of GAM7957 is therefore inhibition of COE2 (Accession XP_034639.1). Accordingly, utilities of GAM7957 include diagnosis, prevention and treatment of diseases and clinical conditions associated with COE2.

Cop9 constitutive photomorphogenic homolog subunit 7b (arabidopsis) (COPS7B, Accession NP_073567.1) is another GAM7957 target gene, herein designated TARGET GENE. COPS7B BINDING SITE is a target binding site found in the 5' untranslated region of mRNA encoded by COPS7B, corresponding to a target binding site such as BINDING SITE I, BINDING SITE II or BINDING SITE III of FIG. 8. Table 4 illustrates the complementarity of the nucleotide sequences of COPS7B BINDING SITE, designated SEQ ID:5797, to the nucleotide sequence of GAM7957 RNA, herein designated GAM RNA, also designated SEQ ID:297.

Another function of GAM7957 is therefore inhibition of Cop9 constitutive photomorphogenic homolog subunit 7b (arabidopsis) (COPS7B, Accession NP_073567.1). Accordingly, utilities of GAM7957 include diagnosis, prevention and treatment of diseases and clinical conditions associated with COPS7B.

Carboxypeptidase m (CPM, Accession NP_001865.1) is another GAM7957 target gene, herein designated TARGET GENE. CPM BINDING SITE1 and CPM BINDING SITE2 are target binding sites found in untranslated regions of mRNA encoded by CPM, corresponding to target binding sites such as BINDING SITE I, BINDING SITE II or BINDING SITE III of FIG. 8. Table 4 illustrates the complementarity of the nucleotide sequences of CPM BINDING SITE1 and CPM BINDING SITE2, designated SEQ ID:5015 and SEQ ID:14439 respectively, to the nucleotide sequence of GAM7957 RNA, herein designated GAM RNA, also designated SEQ ID:297.

Another function of GAM7957 is therefore inhibition of Carboxypeptidase m (CPM, Accession NP_001865.1), a gene which specifically removes COOH- terminal basic amino acids (arginine or lysine). Accordingly, utilities of GAM7957 include diagnosis, prevention and treatment of diseases and clinical conditions associated with CPM.

The function of CPM and its association with various diseases and clinical conditions, has been established by previous studies, as described hereinabove with reference to GAM72.1. CPR2 (Accession NP_112162.1) is another GAM7957 target gene, herein designated TARGET GENE. CPR2 BINDING SITE is a target binding site found in the 3' untranslated region of multiple transcripts of mRNA encoded by CPR2, corresponding to a target binding site such as BINDING SITE I, BINDING SITE II or BINDING SITE III of FIG. 8. Table 4 illustrates the complementarity of the nucleotide sequences of CPR2 BINDING SITE, designated SEQ ID:3265, to the nucleotide sequence of GAM7957 RNA, herein designated GAM RNA, also designated SEQ ID:297.

Another function of GAM7957 is therefore inhibition of CPR2 (Accession NP_112162.1). Accordingly, utilities of GAM7957 include diagnosis, prevention and treatment of diseases and clinical conditions associated with CPR2.

Carnitine palmitoyltransferase ii (CPT2, Accession NP_000089.1) is another GAM7957 target gene, herein designated TARGET GENE. CPT2 BINDING SITE is a target binding site found in the 3' untranslated region of mRNA encoded by CPT2, corresponding to a target binding site such as BINDING SITE I, BINDING SITE II or BINDING SITE III of FIG. 8. Table 4 illustrates the complementarity of the nucleotide sequences of CPT2 BINDING SITE, designated SEQ ID:15223, to the nucleotide sequence of GAM7957 RNA, herein designated GAM RNA, also designated SEQ ID:297.

Another function of GAM7957 is therefore inhibition of Carnitine palmitoyltransferase ii (CPT2, Accession NP_000089.1). Accordingly, utilities of GAM7957 include diagnosis, prevention and treatment of diseases and clinical conditions associated with CPT2.

CRACC (Accession NP_067004.3) is another GAM7957 target gene, herein designated TARGET GENE. CRACC BINDING SITE is a target binding site found in the 3' untranslated region of mRNA encoded by CRACC, corresponding to a target binding site such as BINDING SITE I, BINDING SITE II or BINDING SITE III of FIG. 8. Table 4 illustrates the complementarity of the nucleotide sequences of CRACC BINDING SITE, designated SEQ ID:9770, to the nucleotide sequence of GAM7957 RNA, herein designated GAM RNA, also designated SEQ ID:297.

Another function of GAM7957 is therefore inhibition of CRACC (Accession NP_067004.3), a gene which may participate in adhesion reactions between t lymphocytes and accessory cells. Accordingly, utilities of GAM7957 include diagnosis, prevention and treatment of diseases and clinical conditions associated with CRACC.

The function of CRACC and its association with various diseases and clinical conditions, has been established by previous studies, as described hereinabove with reference to GAM347.1. Crm, cramped-like (drosophila) (CRAMP1L, Accession XP_034570.4) is another GAM7957 target gene, herein designated TARGET GENE. CRAMP1L BINDING SITE is a target binding site found in the 3' untranslated region of mRNA encoded by CRAMP1L, corresponding to a target binding site such as BINDING SITE I, BINDING SITE II or BINDING SITE III of FIG. 8. Table 4 illustrates the complementarity of the nucleotide sequences of CRAMP1L BINDING SITE, designated SEQ ID:7133, to the nucleotide sequence of GAM7957 RNA, herein designated GAM RNA, also designated SEQ ID:297.

Another function of GAM7957 is therefore inhibition of Crm, cramped-like (drosophila) (CRAMP1L, Accession XP_034570.4). Accordingly, utilities of GAM7957 include diagnosis, prevention and treatment of diseases and clinical conditions associated with CRAMP1L.

Camp responsive element binding protein 1 (CREB1, Accession NP_604391.1) is another GAM7957 target gene, herein designated TARGET GENE. CREB1 BINDING SITE1 and CREB1 BINDING SITE2 are target binding sites found in untranslated regions of multiple transcripts of mRNA encoded by CREB1, corresponding to target binding sites such as BINDING SITE I, BINDING SITE II or BINDING SITE III of FIG. 8. Table 4 illustrates the complementarity of the nucleotide sequences of CREB1 BINDING SITE1 and CREB1 BINDING SITE2, designated SEQ ID:5925 and SEQ ID:14278 respectively, to the nucleotide sequence of GAM7957 RNA, herein designated GAM RNA, also designated SEQ ID:297.

Another function of GAM7957 is therefore inhibition of Camp responsive element binding protein 1 (CREB1, Accession NP_604391.1), a gene which regulates expression of cAMP-inducible genes. and therefore may be associated with Malignancy. Accordingly, utilities of GAM7957 include diagnosis, prevention and treatment of Malignancy, and of other diseases and clinical conditions associated with CREB1.

The function of CREB1 and its association with various diseases and clinical conditions, has been established by previous studies, as described hereinabove with reference to GAM260.1. Camp responsive element binding protein 1 (CREB1, Accession NP_004370.1) is another GAM7957 target gene, herein designated TARGET GENE. CREB1 BINDING SITE1 and CREB1 BINDING SITE2 are target binding sites found in untranslated regions of multiple transcripts of mRNA encoded by CREB1, corresponding to target binding sites such as BINDING SITE I, BINDING SITE II or BINDING SITE III of FIG. 8. Table 4 illustrates the complementarity of the nucleotide sequences of CREB1 BINDING SITE1 and CREB1 BINDING SITE2, designated SEQ ID:5925 and SEQ ID:14278 respectively, to the nucleotide sequence of GAM7957 RNA, herein designated GAM RNA, also designated SEQ ID:297.

Another function of GAM7957 is therefore inhibition of Camp responsive element binding protein 1 (CREB1, Accession NP_004370.1), a gene which regulates expression of cAMP-inducible genes. and therefore may be associated with Malignancy. Accordingly, utilities of GAM7957 include diagnosis, prevention and treatment of Malignancy, and of other diseases and clinical conditions associated with CREB1.

The function of CREB1 and its association with various diseases and clinical conditions, has been established by previous studies, as described hereinabove with reference to GAM260.1. Carnitine o-octanoyltransferase (CROT, Accession NP_066974.2) is another GAM7957 target gene, herein designated TARGET GENE. CROT BINDING SITE is a target binding site found in the 3' untranslated region of mRNA encoded by CROT, corresponding to a target binding site such as BINDING SITE I, BINDING SITE II or BINDING SITE III of FIG. 8. Table 4 illustrates the complementarity of the nucleotide sequences of CROT BINDING SITE, designated SEQ ID:13250, to the nucleotide sequence of GAM7957 RNA, herein designated GAM RNA, also designated SEQ ID:297.

Another function of GAM7957 is therefore inhibition of Carnitine o-octanoyltransferase (CROT, Accession NP_066974.2), a gene which CROT plays a crucial role in the beta-oxidation of branched-chain fatty acids including pristanic acid. Accordingly, utilities of GAM7957 include diagnosis, prevention and treatment of diseases and clinical conditions associated with CROT.

The function of CROT and its association with various diseases and clinical conditions, has been established by previous studies, as described hereinabove with reference to GAM72.1. CRTAM (Accession NP_062550.1) is another GAM7957 target gene, herein designated TARGET GENE. CRTAM BINDING SITE is a target binding site found in the 3' untranslated region of mRNA encoded by CRTAM, corresponding to a target binding site such as BINDING SITE I, BINDING SITE II or BINDING SITE III of FIG. 8. Table 4 illustrates the complementarity of the nucleotide sequences of CRTAM BINDING SITE, designated SEQ ID:2833, to the nucleotide sequence of GAM7957 RNA, herein designated GAM RNA, also designated SEQ ID:297.

Another function of GAM7957 is therefore inhibition of CRTAM (Accession NP_062550.1). Accordingly, utilities of GAM7957 include diagnosis, prevention and treatment of diseases and clinical conditions associated with CRTAM.

Cryptochrome 2 (photolyase-like) (CRY2, Accession NP_066940.1) is another GAM7957 target gene, herein designated TARGET GENE. CRY2 BINDING SITE is a target binding site found in the 3' untranslated region of mRNA encoded by CRY2, corresponding to a target binding site such as BINDING SITE I, BINDING SITE II or BINDING SITE III of FIG. 8. Table 4 illustrates the complementarity of the nucleotide sequences of CRY2 BINDING SITE, designated SEQ ID:17056, to the nucleotide sequence of GAM7957 RNA, herein designated GAM RNA, also designated SEQ ID:297.

Another function of GAM7957 is therefore inhibition of Cryptochrome 2 (photolyase-like) (CRY2, Accession NP_066940.1), a gene which has a role in circadian photoreception in mammals. Accordingly, utilities of GAM7957 include diagnosis, prevention and treatment of diseases and clinical conditions associated with CRY2.

The function of CRY2 and its association with various diseases and clinical conditions, has been established by previous studies, as described hereinabove with reference to GAM347.1. Crystallin, zeta (quinone reductase)-like 1 (CRYZL1, Accession NP_660354.1) is another GAM7957 target gene, herein designated TARGET GENE. CRYZL1 BINDING SITE is a target binding site found in the 3' untranslated region of multiple transcripts of mRNA encoded by CRYZL1, corresponding to a target binding site such as BINDING SITE I, BINDING SITE II or BINDING SITE III of FIG. 8. Table 4 illustrates the complementarity of the nucleotide sequences of CRYZL1 BINDING SITE, designated SEQ ID:5251, to the nucleotide sequence of GAM7957 RNA, herein designated GAM RNA, also designated SEQ ID:297.

Another function of GAM7957 is therefore inhibition of Crystallin, zeta (quinone reductase)-like 1 (CRYZL1, Accession NP_660354.1). Accordingly, utilities of GAM7957 include diagnosis, prevention and treatment of diseases and clinical conditions associated with CRYZL1.

Cysteine sulfinic acid decarboxylase (CSAD, Accession NP_057073.2) is another GAM7957 target gene, herein designated TARGET GENE. CSAD BINDING SITE is a target binding site found in the 3' untranslated region of mRNA encoded by CSAD, corresponding to a target binding site such as BINDING SITE I, BINDING SITE II or BINDING SITE III of FIG. 8. Table 4 illustrates the complementarity of the nucleotide sequences of CSAD BINDING SITE, designated SEQ ID:6679, to the nucleotide sequence of GAM7957 RNA, herein designated GAM RNA, also designated SEQ ID:297.

Another function of GAM7957 is therefore inhibition of Cysteine sulfinic acid decarboxylase (CSAD, Accession NP_057073.2). Accordingly, utilities of GAM7957 include diagnosis, prevention and treatment of diseases and clinical conditions associated with CSAD.

CTMP (Accession NP_444283.1) is another GAM7957 target gene, herein designated TARGET GENE. CTMP BINDING SITE is a target binding site found in the 3' untranslated region of multiple transcripts of mRNA encoded by CTMP, corresponding to a target binding site such as BINDING SITE I, BINDING SITE II or BINDING SITE III of FIG. 8. Table 4 illustrates the complementarity of the nucleotide sequences of CTMP BINDING SITE, designated SEQ ID:16622, to the nucleotide sequence of GAM7957 RNA, herein designated GAM RNA, also designated SEQ ID:297.

Another function of GAM7957 is therefore inhibition of CTMP (Accession NP_444283.1). Accordingly, utilities of GAM7957 include diagnosis, prevention and treatment of diseases and clinical conditions associated with CTMP.

CTMP (Accession NP_789823.1) is another GAM7957 target gene, herein designated TARGET GENE. CTMP BINDING SITE is a target binding site found in the 3' untranslated region of multiple transcripts of mRNA encoded by CTMP, corresponding to a target binding site such as BINDING SITE I, BINDING SITE II or BINDING SITE III of FIG. 8. Table 4 illustrates the complementarity of the nucleotide sequences of CTMP BINDING SITE, designated SEQ ID:16622, to the nucleotide sequence of GAM7957 RNA, herein designated GAM RNA, also designated SEQ ID:297.

Another function of GAM7957 is therefore inhibition of CTMP (Accession NP_789823.1). Accordingly, utilities of GAM7957 include diagnosis, prevention and treatment of diseases and clinical conditions associated with CTMP.

Cathepsin s (CTSS, Accession NP_004070.3) is another GAM7957 target gene, herein designated TARGET GENE. CTSS BINDING SITE is a target binding site found in the 3' untranslated region of mRNA encoded by CTSS, corresponding to a target binding site such as BINDING SITE I, BINDING SITE II or BINDING SITE III of FIG. 8. Table 4 illustrates the complementarity of the nucleotide sequences of CTSS BINDING SITE, designated SEQ ID:1951, to the nucleotide sequence of GAM7957 RNA, herein designated GAM RNA, also designated SEQ ID:297.

Another function of GAM7957 is therefore inhibition of Cathepsin s (CTSS, Accession NP_004070.3), a gene which is a lysosomal cysteine (thiol) protease that cleaves elastin. Accordingly, utilities of GAM7957 include diagnosis, prevention and treatment of diseases and clinical conditions associated with CTSS.

The function of CTSS and its association with various diseases and clinical conditions, has been established by previous studies, as described hereinabove with reference to GAM72.1. Cubilin (intrinsic factor-cobalamin receptor) (CUBN, Accession NP_001072.1) is another GAM7957 target gene, herein designated TARGET GENE. CUBN BINDING SITE is a target binding site found in the 3' untranslated region of mRNA encoded by CUBN, corresponding to a target binding site such as BINDING SITE I, BINDING SITE II or BINDING SITE III of FIG. 8. Table 4 illustrates the complementarity of the nucleotide sequences of CUBN BINDING SITE, designated SEQ ID:13063, to the nucleotide sequence of GAM7957 RNA, herein designated GAM RNA, also designated SEQ ID:297.

Another function of GAM7957 is therefore inhibition of Cubilin (intrinsic factor-cobalamin receptor) (CUBN, Accession NP_001072.1). Accordingly, utilities of GAM7957 include diagnosis, prevention and treatment of diseases and clinical conditions associated with CUBN.

CX40.1 (Accession NP_699199.1) is another GAM7957 target gene, herein designated TARGET GENE. CX40.1 BINDING SITE is a target binding site found in the 3' untranslated region of mRNA encoded by CX40.1, corresponding to a target binding site such as BINDING SITE I, BINDING SITE II or BINDING SITE III of FIG. 8. Table 4 illustrates the complementarity of the nucleotide sequences of CX40.1 BINDING SITE, designated SEQ ID:4730, to the nucleotide sequence of GAM7957 RNA, herein designated GAM RNA, also designated SEQ ID:297.

Another function of GAM7957 is therefore inhibition of CX40.1 (Accession NP_699199.1). Accordingly, utilities of GAM7957 include diagnosis, prevention and treatment of diseases and clinical conditions associated with CX40.1.

Chromosome x open reading frame 12 (CXorf12, Accession NP_003483.1) is another GAM7957 target gene, herein designated TARGET GENE. CXorf12 BINDING SITE is a target binding site found in the 5' untranslated region of mRNA encoded by CXorf12, corresponding to a target binding site such as BINDING SITE I, BINDING SITE II or BINDING SITE III of FIG. 8. Table 4 illustrates the complementarity of the nucleotide sequences of CXorf12 BINDING SITE, designated SEQ ID:9618, to the nucleotide sequence of GAM7957 RNA, herein designated GAM RNA, also designated SEQ ID:297.

Another function of GAM7957 is therefore inhibition of Chromosome x open reading frame 12 (CXorf12, Accession NP_003483.1). Accordingly, utilities of GAM7957 include diagnosis, prevention and treatment of diseases and clinical conditions associated with CXorf12.

CXYorf1 (Accession XP_088704.2) is another GAM7957 target gene, herein designated TARGET GENE. CXYorf1 BINDING SITE is a target binding site found in the 3' untranslated region of mRNA encoded by CXYorf1, corresponding to a target binding site such as BINDING SITE I, BINDING SITE II or BINDING SITE III of FIG. 8. Table 4 illustrates the complementarity of the nucleotide sequences of CXYorf1 BINDING SITE, designated SEQ ID:8398, to the nucleotide sequence of GAM7957 RNA, herein designated GAM RNA, also designated SEQ ID:297.

Another function of GAM7957 is therefore inhibition of CXYorf1 (Accession XP_088704.2). Accordingly, utilities of GAM7957 include diagnosis, prevention and treatment of diseases and clinical conditions associated with CXYorf1.

Cytochrome b-561 (CYB561, Accession NP_001906.2) is another GAM7957 target gene, herein designated TARGET GENE. CYB561 BINDING SITE is a target binding site found in the 3' untranslated region of mRNA encoded by CYB561, corresponding to a target binding site such as BINDING SITE I, BINDING SITE II or BINDING SITE III of FIG. 8. Table 4 illustrates the complementarity of the nucleotide sequences of CYB561 BINDING SITE, designated SEQ ID:7117, to the nucleotide sequence of GAM7957 RNA, herein designated GAM RNA, also designated SEQ ID:297.

Another function of GAM7957 is therefore inhibition of Cytochrome b-561 (CYB561, Accession NP_001906.2), a gene which is a secretory vesicle-specific electron transport protein. Accordingly, utilities of GAM7957 include diagnosis, prevention and treatment of diseases and clinical conditions associated with CYB561.

The function of CYB561 and its association with various diseases and clinical conditions, has been established by previous studies, as described hereinabove with reference to GAM65.2. CYCS (Accession NP_061820.1) is another GAM7957 target gene, herein designated TARGET GENE. CYCS BINDING SITE is a target binding site found in the 3' untranslated region of mRNA encoded by CYCS, corresponding to a target binding site such as BINDING SITE I, BINDING SITE II or BINDING SITE III of FIG. 8. Table 4 illustrates the complementarity of the nucleotide sequences of CYCS BINDING SITE, designated SEQ ID:18947, to the nucleotide sequence of GAM7957 RNA, herein designated GAM RNA, also designated SEQ ID:297.

Another function of GAM7957 is therefore inhibition of CYCS (Accession NP_061820.1). Accordingly, utilities of GAM7957 include diagnosis, prevention and treatment of diseases and clinical conditions associated with CYCS.

Chromosome y open reading frame 14 (CYorf14, Accession NP_061012.1) is another GAM7957 target gene, herein designated TARGET GENE. CYorf14 BINDING SITE is a target binding site found in the 3' untranslated region of mRNA encoded by CYorf14, corresponding to a target binding site such as BINDING SITE I, BINDING SITE II or BINDING SITE III of FIG. 8. Table 4 illustrates the complementarity of the nucleotide sequences of CYorf14 BINDING SITE, designated SEQ ID:14752, to the nucleotide sequence of GAM7957 RNA, herein designated GAM RNA, also designated SEQ ID:297.

Another function of GAM7957 is therefore inhibition of Chromosome y open reading frame 14 (CYorf14, Accession NP_061012.1). Accordingly, utilities of GAM7957 include diagnosis, prevention and treatment of diseases and clinical conditions associated with CYorf14.

Cytochrome p450, subfamily ivf, polypeptide 3 (leukotriene b4 omega hydroxylase) (CYP4F3, Accession NP_000887.1) is another GAM7957 target gene, herein designated TARGET GENE. CYP4F3 BINDING SITE1 and CYP4F3 BINDING SITE2 are target binding sites found in untranslated regions of mRNA encoded by CYP4F3, corresponding to target binding sites such as BINDING SITE I, BINDING SITE II or BINDING SITE III of FIG. 8. Table 4 illustrates the complementarity of the nucleotide sequences of CYP4F3 BINDING SITE1 and CYP4F3 BINDING SITE2, designated SEQ ID:18962 and SEQ ID:16247 respectively, to the nucleotide sequence of GAM7957 RNA, herein designated GAM RNA, also designated SEQ ID:297.

Another function of GAM7957 is therefore inhibition of Cytochrome p450, subfamily ivf, polypeptide 3 (leukotriene b4 omega hydroxylase) (CYP4F3, Accession NP_000887.1), a gene which converts leukotriene B4 into the less active 20-hydroxy-leukotriene B4. Accordingly, utilities of GAM7957 include diagnosis, prevention and treatment of diseases and clinical conditions associated with CYP4F3.

The function of CYP4F3 and its association with various diseases and clinical conditions, has been established by previous studies, as described hereinabove with reference to GAM67.1. D21S2056E (Accession NP_003674.1) is another GAM7957 target gene, herein designated TARGET GENE. D21S2056E BINDING SITE1 and D21S2056E BINDING SITE2 are target binding sites found in untranslated regions of mRNA encoded by D21S2056E, corresponding to target binding sites such as BINDING SITE I, BINDING SITE II or BINDING SITE III of FIG. 8. Table 4 illustrates the complementarity of the nucleotide sequences of D21S2056E BINDING SITE1 and D21S2056E BINDING SITE2, designated SEQ ID:13060 and SEQ ID:15089 respectively, to the nucleotide sequence of GAM7957 RNA, herein designated GAM RNA, also designated SEQ ID:297.

Another function of GAM7957 is therefore inhibition of D21S2056E (Accession NP_003674.1). Accordingly, utilities of GAM7957 include diagnosis, prevention and treatment of diseases and clinical conditions associated with D21S2056E.

Dual adaptor of phosphotyrosine and 3-phosphoinositides (DAPP1, Accession NP_055210.1) is another GAM7957 target gene, herein designated TARGET GENE. DAPP1 BINDING SITE is a target binding site found in the 3' untranslated region of mRNA encoded by DAPP1, corresponding to a target binding site such as BINDING SITE I, BINDING SITE II or BINDING SITE III of FIG. 8. Table 4 illustrates the complementarity of the nucleotide sequences of DAPP1 BINDING SITE, designated SEQ ID:2773, to the nucleotide sequence of GAM7957 RNA, herein designated GAM RNA, also designated SEQ ID:297.

Another function of GAM7957 is therefore inhibition of Dual adaptor of phosphotyrosine and 3-phosphoinositides (DAPP1, Accession NP_055210.1), a gene which regulates the ras-cyclic amp pathway. Accordingly, utilities of GAM7957 include diagnosis, prevention and treatment of diseases and clinical conditions associated with DAPP1.

The function of DAPP1 and its association with various diseases and clinical conditions, has been established by previous studies, as described hereinabove with reference to GAM72.1. Deleted in bladder cancer chromosome region candidate 1 (DBCCR1, Accession NP_055433.1) is another GAM7957 target gene, herein designated TARGET GENE. DBCCR1 BINDING SITE is a target binding site found in the 5' untranslated region of mRNA encoded by DBCCR1, corresponding to a target binding site such as BINDING SITE I, BINDING SITE II or BINDING SITE III of FIG. 8. Table 4 illustrates the complementarity of the nucleotide sequences of DBCCR1 BINDING SITE, designated SEQ ID:2272, to the nucleotide sequence of GAM7957 RNA, herein designated GAM RNA, also designated SEQ ID:297.

Another function of GAM7957 is therefore inhibition of Deleted in bladder cancer chromosome region candidate 1 (DBCCR1, Accession NP_055433.1), a gene which might be a target for hypermethylation.and therefore may be associated with Transitional cell carcinoma of the bladder. Accordingly, utilities of GAM7957 include diagnosis, prevention and treatment of Transitional cell carcinoma of the bladder, and of other diseases and clinical conditions associated with DBCCR1.

The function of DBCCR1 and its association with various diseases and clinical conditions, has been established by previous studies, as described hereinabove with reference to GAM401.1. Dihydrolipoamide branched chain transacylase (e2 component of branched chain keto acid dehydrogenase complex; maple syrup urine disease) (DBT, Accession NP_001909.1) is another GAM7957 target gene, herein designated TARGET GENE. DBT BINDING SITE is a target binding site found in the 3' untranslated region of mRNA encoded by DBT, corresponding to a target binding site such as BINDING SITE I, BINDING SITE II or BINDING SITE III of FIG. 8. Table 4 illustrates the complementarity of the nucleotide sequences of DBT BINDING SITE, designated SEQ ID:9770, to the nucleotide sequence of GAM7957 RNA, herein designated GAM RNA, also designated SEQ ID:297.

Another function of GAM7957 is therefore inhibition of Dihydrolipoamide branched chain transacylase (e2 component of branched chain keto acid dehydrogenase complex; maple syrup urine disease) (DBT, Accession NP_001909.1). Accordingly, utilities of GAM7957 include diagnosis, prevention and treatment of diseases and clinical conditions associated with DBT.

Dna cross-link repair 1c (pso2 homolog, s. cerevisiae) (DCLRE1C, Accession NP_071932.1) is another GAM7957 target gene, herein designated TARGET GENE. DCLRE1C BINDING SITE1 and DCLRE1C BINDING SITE2 are target binding sites found in untranslated regions of mRNA encoded by DCLRE1C, corresponding to target binding sites such as BINDING SITE I, BINDING SITE II or BINDING SITE III of FIG. 8. Table 4 illustrates the complementarity of the nucleotide sequences of DCLRE1C BINDING SITE1 and DCLRE1C BINDING SITE2, designated SEQ ID:9270 and SEQ ID:9533 respectively, to the nucleotide sequence of GAM7957 RNA, herein designated GAM RNA, also designated SEQ ID:297.

Another function of GAM7957 is therefore inhibition of Dna cross-link repair 1c (pso2 homolog, s. cerevisiae) (DCLRE1C, Accession NP_071932.1), a gene which intervenes in V(D)J recombination/DNA repair. and therefore may be associated with Severe combined immunodeficiency with sensitivity to ionizing radiation . Accordingly, utilities of GAM7957 include diagnosis, prevention and treatment of Severe combined immunodeficiency with sensitivity to ionizing radiation ., and of other diseases and clinical conditions associated with DCLRE1C.

The function of DCLRE1C and its association with various diseases and clinical conditions, has been established by previous studies, as described hereinabove with reference to GAM72.1. Dolichyl-diphosphooligosaccharide-protein glycosyltransferase (DDOST, Accession NP_005207.2) is another GAM7957 target gene, herein designated TARGET GENE. DDOST BINDING SITE1 and DDOST BINDING SITE2 are target binding sites found in untranslated regions of mRNA encoded by DDOST, corresponding to target binding sites such as BINDING SITE I, BINDING SITE II or BINDING SITE III of FIG. 8. Table 4 illustrates the complementarity of the nucleotide sequences of DDOST BINDING SITE1 and DDOST BINDING SITE2, designated SEQ ID:15593 and SEQ ID:17654 respectively, to the nucleotide sequence of GAM7957 RNA, herein designated GAM RNA, also designated SEQ ID:297.

Another function of GAM7957 is therefore inhibition of Dolichyl-diphosphooligosaccharide-protein glycosyltransferase (DDOST, Accession NP_005207.2), a gene which transfers high-mannose oligosaccharides to nascent polypeptides. Accordingly, utilities of GAM7957 include diagnosis, prevention and treatment of diseases and clinical conditions associated with DDOST.

The function of DDOST and its association with various diseases and clinical conditions, has been established by previous studies, as described hereinabove with reference to GAM347.2. Dead/h (asp-glu-ala-asp/his) box polypeptide 34 (DDX34, Accession NP_055496.1) is another GAM7957 target gene, herein designated TARGET GENE. DDX34 BINDING SITE1 and DDX34 BINDING SITE2 are target binding sites found in untranslated regions of mRNA encoded by DDX34, corresponding to target binding sites such as BINDING SITE I, BINDING SITE II or BINDING SITE III of FIG. 8. Table 4 illustrates the complementarity of the nucleotide sequences of DDX34 BINDING SITE1 and DDX34 BINDING SITE2, designated SEQ ID:7047 and SEQ ID:2125 respectively, to the nucleotide sequence of GAM7957 RNA, herein designated GAM RNA, also designated SEQ ID:297.

Another function of GAM7957 is therefore inhibition of Dead/h (asp-glu-ala-asp/his) box polypeptide 34 (DDX34, Accession NP_055496.1). Accordingly, utilities of GAM7957 include diagnosis, prevention and treatment of diseases and clinical conditions associated with DDX34.

DDX51 (Accession NP_778236.1) is another GAM7957 target gene, herein designated TARGET GENE. DDX51

BINDING SITE is a target binding site found in the 3' untranslated region of mRNA encoded by DDX51, corresponding to a target binding site such as BINDING SITE I, BINDING SITE II or BINDING SITE III of FIG. 8. Table 4 illustrates the complementarity of the nucleotide sequences of DDX51 BINDING SITE, designated SEQ ID:17424, to the nucleotide sequence of GAM7957 RNA, herein designated GAM RNA, also designated SEQ ID:297.

Another function of GAM7957 is therefore inhibition of DDX51 (Accession NP_778236.1). Accordingly, utilities of GAM7957 include diagnosis, prevention and treatment of diseases and clinical conditions associated with DDX51.

Degenerative spermatocyte homolog, lipid desaturase (drosophila) (DEGS, Accession NP_659004.1) is another GAM7957 target gene, herein designated TARGET GENE. DEGS BINDING SITE is a target binding site found in the 3' untranslated region of multiple transcripts of mRNA encoded by DEGS, corresponding to a target binding site such as BINDING SITE I, BINDING SITE II or BINDING SITE III of FIG. 8. Table 4 illustrates the complementarity of the nucleotide sequences of DEGS BINDING SITE, designated SEQ ID:2834, to the nucleotide sequence of GAM7957 RNA, herein designated GAM RNA, also designated SEQ ID:297.

Another function of GAM7957 is therefore inhibition of Degenerative spermatocyte homolog, lipid desaturase (drosophila) (DEGS, Accession NP_659004.1). Accordingly, utilities of GAM7957 include diagnosis, prevention and treatment of diseases and clinical conditions associated with DEGS.

Degenerative spermatocyte homolog, lipid desaturase (drosophila) (DEGS, Accession NP_003667.1) is another GAM7957 target gene, herein designated TARGET GENE. DEGS BINDING SITE is a target binding site found in the 3' untranslated region of multiple transcripts of mRNA encoded by DEGS, corresponding to a target binding site such as BINDING SITE I, BINDING SITE II or BINDING SITE III of FIG. 8. Table 4 illustrates the complementarity of the nucleotide sequences of DEGS BINDING SITE, designated SEQ ID:2834, to the nucleotide sequence of GAM7957 RNA, herein designated GAM RNA, also designated SEQ ID:297.

Another function of GAM7957 is therefore inhibition of Degenerative spermatocyte homolog, lipid desaturase (drosophila) (DEGS, Accession NP_003667.1). Accordingly, utilities of GAM7957 include diagnosis, prevention and treatment of diseases and clinical conditions associated with DEGS.

D component of complement (adipsin) (DF, Accession NP_001919.1) is another GAM7957 target gene, herein designated TARGET GENE. DF BINDING SITE is a target binding site found in the 3' untranslated region of mRNA encoded by DF, corresponding to a target binding site such as BINDING SITE I, BINDING SITE II or BINDING SITE III of FIG. 8. Table 4 illustrates the complementarity of the nucleotide sequences of DF BINDING SITE, designated SEQ ID:8534, to the nucleotide sequence of GAM7957 RNA, herein designated GAM RNA, also designated SEQ ID:297.

Another function of GAM7957 is therefore inhibition of D component of complement (adipsin) (DF, Accession NP_001919.1). Accordingly, utilities of GAM7957 include diagnosis, prevention and treatment of diseases and clinical conditions associated with DF.

Dna fragmentation factor, 45 kda, alpha polypeptide (DFFA, Accession NP_004392.1) is another GAM7957 target gene, herein designated TARGET GENE. DFFA BINDING SITE is a target binding site found in the 3' untranslated region of mRNA encoded by DFFA, corresponding to a target binding site such as BINDING SITE I, BINDING SITE II or BINDING SITE III of FIG. 8. Table 4 illustrates the complementarity of the nucleotide sequences of DFFA BINDING SITE, designated SEQ ID:19036, to the nucleotide sequence of GAM7957 RNA, herein designated GAM RNA, also designated SEQ ID:297.

Another function of GAM7957 is therefore inhibition of Dna fragmentation factor, 45 kda, alpha polypeptide (DFFA, Accession NP_004392.1), a gene which is the substrate for caspase-3 and triggers DNA fragmentation during apoptosis. Accordingly, utilities of GAM7957 include diagnosis, prevention and treatment of diseases and clinical conditions associated with DFFA.

The function of DFFA and its association with various diseases and clinical conditions, has been established by previous studies, as described hereinabove with reference to GAM347.2. Diacylglycerol kinase, iota (DGKI, Accession NP_004708.1) is another GAM7957 target gene, herein designated TARGET GENE. DGKI BINDING SITE is a target binding site found in the 5' untranslated region of mRNA encoded by DGKI, corresponding to a target binding site such as BINDING SITE I, BINDING SITE II or BINDING SITE III of FIG. 8. Table 4 illustrates the complementarity of the nucleotide sequences of DGKI BINDING SITE, designated SEQ ID:13155, to the nucleotide sequence of GAM7957 RNA, herein designated GAM RNA, also designated SEQ ID:297.

Another function of GAM7957 is therefore inhibition of Diacylglycerol kinase, iota (DGKI, Accession NP_004708.1), a gene which regulates the intracellular concentration of the second messenger diacylglycerol (DAG). Accordingly, utilities of GAM7957 include diagnosis, prevention and treatment of diseases and clinical conditions associated with DGKI.

The function of DGKI and its association with various diseases and clinical conditions, has been established by previous studies, as described hereinabove with reference to GAM207.2. DIS3 (Accession NP_055768.2) is another GAM7957 target gene, herein designated TARGET GENE. DIS3 BINDING SITE1 and DIS3 BINDING SITE2 are target binding sites found in untranslated regions of mRNA encoded by DIS3, corresponding to target binding sites such as BINDING SITE I, BINDING SITE II or BINDING SITE III of FIG. 8. Table 4 illustrates the complementarity of the nucleotide sequences of DIS3 BINDING SITE1 and DIS3 BINDING SITE2, designated SEQ ID:17399 and SEQ ID:15204 respectively, to the nucleotide sequence of GAM7957 RNA, herein designated GAM RNA, also designated SEQ ID:297.

Another function of GAM7957 is therefore inhibition of DIS3 (Accession NP_055768.2). Accordingly, utilities of GAM7957 include diagnosis, prevention and treatment of diseases and clinical conditions associated with DIS3.

DJ122O8.2 (Accession NP_065199.1) is another GAM7957 target gene, herein designated TARGET GENE. DJ122O8.2 BINDING SITE is a target binding site found in the 3' untranslated region of mRNA encoded by DJ122O8.2, corresponding to a target binding site such as BINDING SITE I, BINDING SITE II or BINDING SITE III of FIG. 8. Table 4 illustrates the complementarity of the nucleotide sequences of DJ122O8.2 BINDING SITE, designated SEQ ID:3814, to the nucleotide sequence of GAM7957 RNA, herein designated GAM RNA, also designated SEQ ID:297.

Another function of GAM7957 is therefore inhibition of DJ122O8.2 (Accession NP_065199.1). Accordingly, utilities of GAM7957 include diagnosis, prevention and treatment of diseases and clinical conditions associated with DJ122O8.2.

DKFZp313G1735 (Accession XP_087728.2) is another GAM7957 target gene, herein designated TARGET GENE. DKFZp313G1735 BINDING SITE is a target binding site found in the 3' untranslated region of mRNA encoded by DKFZp313G1735, corresponding to a target binding site such as BINDING SITE I, BINDING SITE II or BINDING SITE III of FIG. 8. Table 4 illustrates the complementarity of the nucleotide sequences of DKFZp313G1735 BINDING SITE, designated SEQ ID:9281, to the nucleotide sequence of GAM7957 RNA, herein designated GAM RNA, also designated SEQ ID:297.

Another function of GAM7957 is therefore inhibition of DKFZp313G1735 (Accession XP_087728.2). Accordingly, utilities of GAM7957 include diagnosis, prevention and treatment of diseases and clinical conditions associated with DKFZp313G1735.

DKFZp313N0621 (Accession NP_776187.1) is another GAM7957 target gene, herein designated TARGET GENE. DKFZp313N0621 BINDING SITE is a target binding site found in the 3' untranslated region of mRNA encoded by DKFZp313N0621, corresponding to a target binding site such as BINDING SITE I, BINDING SITE II or BINDING SITE III of FIG. 8. Table 4 illustrates the complementarity of the nucleotide sequences of DKFZp313N0621 BINDING SITE, designated SEQ ID:7349, to the nucleotide sequence of GAM7957 RNA, herein designated GAM RNA, also designated SEQ ID:297.

Another function of GAM7957 is therefore inhibition of DKFZp313N0621 (Accession NP_776187.1). Accordingly, utilities of GAM7957 include diagnosis, prevention and treatment of diseases and clinical conditions associated with DKFZp313N0621.

DKFZP434A0131 (Accession NP_061864.1) is another GAM7957 target gene, herein designated TARGET GENE. DKFZP434A0131 BINDING SITE is a target binding site found in the 3' untranslated region of mRNA encoded by DKFZP434A0131, corresponding to a target binding site such as BINDING SITE I, BINDING SITE II or BINDING SITE III of FIG. 8. Table 4 illustrates the complementarity of the nucleotide sequences of DKFZP434A0131 BINDING SITE, designated SEQ ID:8751, to the nucleotide sequence of GAM7957 RNA, herein designated GAM RNA, also designated SEQ ID:297.

Another function of GAM7957 is therefore inhibition of DKFZP434A0131 (Accession NP_061864.1). Accordingly, utilities of GAM7957 include diagnosis, prevention and treatment of diseases and clinical conditions associated with DKFZP434A0131.

DKFZP434B0335 (Accession XP_166485.3) is another GAM7957 target gene, herein designated TARGET GENE. DKFZP434B0335 BINDING SITE1 and DKFZP434B0335 BINDING SITE2 are target binding sites found in untranslated regions of mRNA encoded by DKFZP434B0335, corresponding to target binding sites such as BINDING SITE I, BINDING SITE II or BINDING SITE III of FIG. 8. Table 4 illustrates the complementarity of the nucleotide sequences of DKFZP434B0335 BINDING SITE1 and DKFZP434B0335 BINDING SITE2, designated SEQ ID:4428 and SEQ ID:7885 respectively, to the nucleotide sequence of GAM7957 RNA, herein designated GAM RNA, also designated SEQ ID:297.

Another function of GAM7957 is therefore inhibition of DKFZP434B0335 (Accession XP_166485.3). Accordingly, utilities of GAM7957 include diagnosis, prevention and treatment of diseases and clinical conditions associated with DKFZP434B0335.

DKFZP434B103 (Accession NP_056459.1) is another GAM7957 target gene, herein designated TARGET GENE. DKFZP434B103 BINDING SITE is a target binding site found in the 5' untranslated region of mRNA encoded by DKFZP434B103, corresponding to a target binding site such as BINDING SITE I, BINDING SITE II or BINDING SITE III of FIG. 8. Table 4 illustrates the complementarity of the nucleotide sequences of DKFZP434B103 BINDING SITE, designated SEQ ID:11706, to the nucleotide sequence of GAM7957 RNA, herein designated GAM RNA, also designated SEQ ID:297.

Another function of GAM7957 is therefore inhibition of DKFZP434B103 (Accession NP_056459.1). Accordingly, utilities of GAM7957 include diagnosis, prevention and treatment of diseases and clinical conditions associated with DKFZP434B103.

DKFZP434B168 (Accession NP_056249.1) is another GAM7957 target gene, herein designated TARGET GENE. DKFZP434B168 BINDING SITE is a target binding site found in the 3' untranslated region of mRNA encoded by DKFZP434B168, corresponding to a target binding site such as BINDING SITE I, BINDING SITE II or BINDING SITE III of FIG. 8. Table 4 illustrates the complementarity of the nucleotide sequences of DKFZP434B168 BINDING SITE, designated SEQ ID:2483, to the nucleotide sequence of GAM7957 RNA, herein designated GAM RNA, also designated SEQ ID:297.

Another function of GAM7957 is therefore inhibition of DKFZP434B168 (Accession NP_056249.1). Accordingly, utilities of GAM7957 include diagnosis, prevention and treatment of diseases and clinical conditions associated with DKFZP434B168.

DKFZP434C171 (Accession NP_056436.1) is another GAM7957 target gene, herein designated TARGET GENE. DKFZP434C171 BINDING SITE is a target binding site found in the 3' untranslated region of mRNA encoded by DKFZP434C171, corresponding to a target binding site such as BINDING SITE I, BINDING SITE II or BINDING SITE III of FIG. 8. Table 4 illustrates the complementarity of the nucleotide sequences of DKFZP434C171 BINDING SITE, designated SEQ ID:17129, to the nucleotide sequence of GAM7957 RNA, herein designated GAM RNA, also designated SEQ ID:297.

Another function of GAM7957 is therefore inhibition of DKFZP434C171 (Accession NP_056436.1). Accordingly, utilities of GAM7957 include diagnosis, prevention and treatment of diseases and clinical conditions associated with DKFZP434C171.

DKFZp434E0519 (Accession NP_115623.1) is another GAM7957 target gene, herein designated TARGET GENE. DKFZp434E0519 BINDING SITE is a target binding site found in the 3' untranslated region of mRNA encoded by DKFZp434E0519, corresponding to a target binding site such as BINDING SITE I, BINDING SITE II or BINDING SITE III of FIG. 8. Table 4 illustrates the complementarity of the nucleotide sequences of DKFZp434E0519 BINDING SITE, designated SEQ ID:6416, to the nucleotide sequence of GAM7957 RNA, herein designated GAM RNA, also designated SEQ ID:297.

Another function of GAM7957 is therefore inhibition of DKFZp434E0519 (Accession NP_115623.1). Accordingly, utilities of GAM7957 include diagnosis, prevention and treatment of diseases and clinical conditions associated with DKFZp434E0519.

DKFZp434E2220 (Accession NP_060082.1) is another GAM7957 target gene, herein designated TARGET GENE. DKFZp434E2220 BINDING SITE is a target binding site found in the 5' untranslated region of mRNA encoded by DKFZp434E2220, corresponding to a target binding site such as BINDING SITE I, BINDING SITE II or BINDING SITE III of FIG. 8. Table 4 illustrates the complementarity of the nucleotide sequences of DKFZp434E2220 BINDING SITE, designated SEQ ID:14786, to the nucleotide sequence of GAM7957 RNA, herein designated GAM RNA, also designated SEQ ID:297.

Another function of GAM7957 is therefore inhibition of DKFZp434E2220 (Accession NP_060082.1). Accordingly, utilities of GAM7957 include diagnosis, prevention and treatment of diseases and clinical conditions associated with DKFZp434E2220.

DKFZP434F091 (Accession NP_056268.1) is another GAM7957 target gene, herein designated TARGET GENE. DKFZP434F091 BINDING SITE is a target binding site found in the 3' untranslated region of mRNA encoded by DKFZP434F091, corresponding to a target binding site such as BINDING SITE I, BINDING SITE II or BINDING SITE III of FIG. 8. Table 4 illustrates the complementarity of the nucleotide sequences of DKFZP434F091 BINDING SITE, designated SEQ ID:744, to the nucleotide sequence of GAM7957 RNA, herein designated GAM RNA, also designated SEQ ID:297.

Another function of GAM7957 is therefore inhibition of DKFZP434F091 (Accession NP_056268.1). Accordingly, utilities of GAM7957 include diagnosis, prevention and treatment of diseases and clinical conditions associated with DKFZP434F091.

DKFZp434H247 (Accession XP_290829.1) is another GAM7957 target gene, herein designated TARGET GENE. DKFZp434H247 BINDING SITE1 and DKFZp434H247 BINDING SITE2 are target binding sites found in untranslated regions of mRNA encoded by DKFZp434H247, corresponding to target binding sites such as BINDING SITE I, BINDING SITE II or BINDING SITE III of FIG. 8. Table 4 illustrates the complementarity of the nucleotide sequences of DKFZp434H247 BINDING SITE1 and DKFZp434H247 BINDING SITE2, designated SEQ ID:17399 and SEQ ID:4428 respectively, to the nucleotide sequence of GAM7957 RNA, herein designated GAM RNA, also designated SEQ ID:297.

Another function of GAM7957 is therefore inhibition of DKFZp434H247 (Accession XP_290829.1). Accordingly, utilities of GAM7957 include diagnosis, prevention and treatment of diseases and clinical conditions associated with DKFZp434H247.

DKFZP434I1735 (Accession XP_113763.3) is another GAM7957 target gene, herein designated TARGET GENE. DKFZP434I1735 BINDING SITE is a target binding site found in the 3' untranslated region of mRNA encoded by DKFZP434I1735, corresponding to a target binding site such as BINDING SITE I, BINDING SITE II or BINDING SITE III of FIG. 8. Table 4 illustrates the complementarity of the nucleotide sequences of DKFZP434I1735 BINDING SITE, designated SEQ ID:3132, to the nucleotide sequence of GAM7957 RNA, herein designated GAM RNA, also designated SEQ ID:297.

Another function of GAM7957 is therefore inhibition of DKFZP434I1735 (Accession XP_113763.3). Accordingly, utilities of GAM7957 include diagnosis, prevention and treatment of diseases and clinical conditions associated with DKFZP434I1735.

DKFZP434L187 (Accession XP_044070.6) is another GAM7957 target gene, herein designated TARGET GENE. DKFZP434L187 BINDING SITE is a target binding site found in the 3' untranslated region of mRNA encoded by DKFZP434L187, corresponding to a target binding site such as BINDING SITE I, BINDING SITE II or BINDING SITE III of FIG. 8. Table 4 illustrates the complementarity of the nucleotide sequences of DKFZP434L187 BINDING SITE, designated SEQ ID:17403, to the nucleotide sequence of GAM7957 RNA, herein designated GAM RNA, also designated SEQ ID:297.

Another function of GAM7957 is therefore inhibition of DKFZP434L187 (Accession XP_044070.6). Accordingly, utilities of GAM7957 include diagnosis, prevention and treatment of diseases and clinical conditions associated with DKFZP434L187.

DKFZP434P0111 (Accession XP_041116.1) is another GAM7957 target gene, herein designated TARGET GENE. DKFZP434P0111 BINDING SITE is a target binding site found in the 3' untranslated region of mRNA encoded by DKFZP434P0111, corresponding to a target binding site such as BINDING SITE I, BINDING SITE II or BINDING SITE III of FIG. 8. Table 4 illustrates the complementarity of the nucleotide sequences of DKFZP434P0111 BINDING SITE, designated SEQ ID:7178, to the nucleotide sequence of GAM7957 RNA, herein designated GAM RNA, also designated SEQ ID:297.

Another function of GAM7957 is therefore inhibition of DKFZP434P0111 (Accession XP_041116.1). Accordingly, utilities of GAM7957 include diagnosis, prevention and treatment of diseases and clinical conditions associated with DKFZP434P0111.

DKFZP434P211 (Accession NP_055364.1) is another GAM7957 target gene, herein designated TARGET GENE. DKFZP434P211 BINDING SITE is a target binding site found in the 3' untranslated region of mRNA encoded by DKFZP434P211, corresponding to a target binding site such as BINDING SITE I, BINDING SITE II or BINDING SITE III of FIG. 8. Table 4 illustrates the complementarity of the nucleotide sequences of DKFZP434P211 BINDING SITE, designated SEQ ID:6448, to the nucleotide sequence of GAM7957 RNA, herein designated GAM RNA, also designated SEQ ID:297.

Another function of GAM7957 is therefore inhibition of DKFZP434P211 (Accession NP_055364.1). Accordingly, utilities of GAM7957 include diagnosis, prevention and treatment of diseases and clinical conditions associated with DKFZP434P211.

DKFZp547C176 (Accession XP_040799.2) is another GAM7957 target gene, herein designated TARGET GENE. DKFZp547C176 BINDING SITE is a target binding site found in the 3' untranslated region of mRNA encoded by DKFZp547C176, corresponding to a target binding site such as BINDING SITE I, BINDING SITE II or BINDING SITE III of FIG. 8. Table 4 illustrates the complementarity of the nucleotide sequences of DKFZp547C176 BINDING SITE, designated SEQ ID:5830, to the nucleotide sequence of GAM7957 RNA, herein designated GAM RNA, also designated SEQ ID:297.

Another function of GAM7957 is therefore inhibition of DKFZp547C176 (Accession XP_040799.2). Accordingly, utilities of GAM7957 include diagnosis, prevention and treatment of diseases and clinical conditions associated with DKFZp547C176.

DKFZp547G183 (Accession NP_061175.1) is another GAM7957 target gene, herein designated TARGET GENE. DKFZp547G183 BINDING SITE1 and DKFZp547G183 BINDING SITE2 are target binding sites found in untranslated regions of mRNA encoded by DKFZp547G183, corresponding to target binding sites such as BINDING SITE I, BINDING SITE II or BINDING SITE III of FIG. 8. Table 4 illustrates the complementarity of the nucleotide sequences of DKFZp547G183 BINDING SITE1 and DKFZp547G183 BINDING SITE2, designated SEQ ID:9762 and SEQ ID:18018 respectively, to the nucleotide sequence of GAM7957 RNA, herein designated GAM RNA, also designated SEQ ID:297.

Another function of GAM7957 is therefore inhibition of DKFZp547G183 (Accession NP_061175.1). Accordingly, utilities of GAM7957 include diagnosis, prevention and treatment of diseases and clinical conditions associated with DKFZp547G183.

DKFZp547I094 (Accession NP_115531.1) is another GAM7957 target gene, herein designated TARGET GENE. DKFZp547I094 BINDING SITE is a target binding site found in the 3' untranslated region of mRNA encoded by DKFZp547I094, corresponding to a target binding site such as BINDING SITE I, BINDING SITE II or BINDING SITE III of FIG. 8. Table 4 illustrates the complementarity of the nucleotide sequences of DKFZp547I094 BINDING SITE, designated SEQ ID:11012, to the nucleotide sequence of GAM7957 RNA, herein designated GAM RNA, also designated SEQ ID:297.

Another function of GAM7957 is therefore inhibition of DKFZp547I094 (Accession NP_115531.1). Accordingly, utilities of GAM7957 include diagnosis, prevention and treatment of diseases and clinical conditions associated with DKFZp547I094.

DKFZP564I122 (Accession XP_032397.1) is another GAM7957 target gene, herein designated TARGET GENE. DKFZP564I122 BINDING SITE is a target binding site found in the 3' untranslated region of mRNA encoded by DKFZP564I122, corresponding to a target binding site such as BINDING SITE I, BINDING SITE II or BINDING SITE III of FIG. 8. Table 4 illustrates the complementarity of the nucleotide sequences of DKFZP564I122 BINDING SITE, designated SEQ ID:8377, to the nucleotide sequence of GAM7957 RNA, herein designated GAM RNA, also designated SEQ ID:297.

Another function of GAM7957 is therefore inhibition of DKFZP564I122 (Accession XP_032397.1). Accordingly, utilities of GAM7957 include diagnosis, prevention and treatment of diseases and clinical conditions associated with DKFZP564I122.

DKFZP564J0863 (Accession NP_056274.1) is another GAM7957 target gene, herein designated TARGET GENE. DKFZP564J0863 BINDING SITE is a target binding site found in the 3' untranslated region of mRNA encoded by DKFZP564J0863, corresponding to a target binding site such as BINDING SITE I, BINDING SITE II or BINDING SITE III of FIG. 8. Table 4 illustrates the complementarity of the nucleotide sequences of DKFZP564J0863 BINDING SITE, designated SEQ ID:14509, to the nucleotide sequence of GAM7957 RNA, herein designated GAM RNA, also designated SEQ ID:297.

Another function of GAM7957 is therefore inhibition of DKFZP564J0863 (Accession NP_056274.1). Accordingly, utilities of GAM7957 include diagnosis, prevention and treatment of diseases and clinical conditions associated with DKFZP564J0863.

DKFZp564K142 (Accession NP_115497.2) is another GAM7957 target gene, herein designated TARGET GENE. DKFZp564K142 BINDING SITE is a target binding site found in the 3' untranslated region of mRNA encoded by DKFZp564K142, corresponding to a target binding site such as BINDING SITE I, BINDING SITE II or BINDING SITE III of FIG. 8. Table 4 illustrates the complementarity of the nucleotide sequences of DKFZp564K142 BINDING SITE, designated SEQ ID:1903, to the nucleotide sequence of GAM7957 RNA, herein designated GAM RNA, also designated SEQ ID:297.

Another function of GAM7957 is therefore inhibition of DKFZp564K142 (Accession NP_115497.2). Accordingly, utilities of GAM7957 include diagnosis, prevention and treatment of diseases and clinical conditions associated with DKFZp564K142.

DKFZP564M182 (Accession XP_085525.3) is another GAM7957 target gene, herein designated TARGET GENE. DKFZP564M182 BINDING SITE1 and DKFZP564M182 BINDING SITE2 are target binding sites found in untranslated regions of mRNA encoded by DKFZP564M182, corresponding to target binding sites such as BINDING SITE I, BINDING SITE II or BINDING SITE III of FIG. 8. Table 4 illustrates the complementarity of the nucleotide sequences of DKFZP564M182 BINDING SITE1 and DKFZP564M182 BINDING SITE2, designated SEQ ID:16630 and SEQ ID:7401 respectively, to the nucleotide sequence of GAM7957 RNA, herein designated GAM RNA, also designated SEQ ID:297.

Another function of GAM7957 is therefore inhibition of DKFZP564M182 (Accession XP_085525.3). Accordingly, utilities of GAM7957 include diagnosis, prevention and treatment of diseases and clinical conditions associated with DKFZP564M182.

DKFZP564O0423 (Accession XP_166254.2) is another GAM7957 target gene, herein designated TARGET GENE. DKFZP564O0423 BINDING SITE is a target binding site found in the 3' untranslated region of mRNA encoded by DKFZP564O0423, corresponding to a target binding site such as BINDING SITE I, BINDING SITE II or BINDING SITE III of FIG. 8. Table 4 illustrates the complementarity of the nucleotide sequences of DKFZP564O0423 BINDING SITE, designated SEQ ID:2876, to the nucleotide sequence of GAM7957 RNA, herein designated GAM RNA, also designated SEQ ID:297.

Another function of GAM7957 is therefore inhibition of DKFZP564O0423 (Accession XP_166254.2). Accordingly, utilities of GAM7957 include diagnosis, prevention and treatment of diseases and clinical conditions associated with DKFZP564O0423.

DKFZp566H0824 (Accession NP_060005.1) is another GAM7957 target gene, herein designated TARGET GENE. DKFZp566H0824 BINDING SITE1 and DKFZp566H0824 BINDING SITE2 are target binding sites found in untranslated regions of mRNA encoded by DKFZp566H0824, corresponding to target binding sites such as BINDING SITE I, BINDING SITE II or BINDING SITE III of FIG. 8. Table 4 illustrates the complementarity of the nucleotide sequences of DKFZp566H0824 BINDING SITE1 and DKFZp566H0824 BINDING SITE2, designated SEQ ID:8019 and SEQ ID:7863 respectively, to the nucleotide sequence of GAM7957 RNA, herein designated GAM RNA, also designated SEQ ID:297.

Another function of GAM7957 is therefore inhibition of DKFZp566H0824 (Accession NP_060005.1). Accordingly, utilities of GAM7957 include diagnosis, prevention and treatment of diseases and clinical conditions associated with DKFZp566H0824.

DKFZP566J2046 (Accession NP_112485.1) is another GAM7957 target gene, herein designated TARGET GENE. DKFZP566J2046 BINDING SITE is a target binding site found in the 3' untranslated region of mRNA encoded by DKFZP566J2046, corresponding to a target binding site such as BINDING SITE I, BINDING SITE II or BINDING SITE III of FIG. 8. Table 4 illustrates the complementarity of the nucleotide sequences of DKFZP566J2046 BINDING SITE, designated SEQ ID:1200, to the nucleotide sequence of GAM7957 RNA, herein designated GAM RNA, also designated SEQ ID:297.

Another function of GAM7957 is therefore inhibition of DKFZP566J2046 (Accession NP__112485.1). Accordingly, utilities of GAM7957 include diagnosis, prevention and treatment of diseases and clinical conditions associated with DKFZP566J2046.

DKFZP566K0524 (Accession NP__056420.1) is another GAM7957 target gene, herein designated TARGET GENE. DKFZP566K0524 BINDING SITE is a target binding site found in the 5' untranslated region of mRNA encoded by DKFZP566K0524, corresponding to a target binding site such as BINDING SITE I, BINDING SITE II or BINDING SITE III of FIG. 8. Table 4 illustrates the complementarity of the nucleotide sequences of DKFZP566K0524 BINDING SITE, designated SEQ ID:12521, to the nucleotide sequence of GAM7957 RNA, herein designated GAM RNA, also designated SEQ ID:297.

Another function of GAM7957 is therefore inhibition of DKFZP566K0524 (Accession NP__056420.1). Accordingly, utilities of GAM7957 include diagnosis, prevention and treatment of diseases and clinical conditions associated with DKFZP566K0524.

DKFZp586C0721 (Accession XP__098416.1) is another GAM7957 target gene, herein designated TARGET GENE. DKFZp586C0721 BINDING SITE is a target binding site found in the 3' untranslated region of mRNA encoded by DKFZp586C0721, corresponding to a target binding site such as BINDING SITE I, BINDING SITE II or BINDING SITE III of FIG. 8. Table 4 illustrates the complementarity of the nucleotide sequences of DKFZp586C0721 BINDING SITE, designated SEQ ID:19501, to the nucleotide sequence of GAM7957 RNA, herein designated GAM RNA, also designated SEQ ID:297.

Another function of GAM7957 is therefore inhibition of DKFZp586C0721 (Accession XP__098416.1). Accordingly, utilities of GAM7957 include diagnosis, prevention and treatment of diseases and clinical conditions associated with DKFZp586C0721.

DKFZP586C1324 (Accession XP__045876.1) is another GAM7957 target gene, herein designated TARGET GENE. DKFZP586C1324 BINDING SITE is a target binding site found in the 3' untranslated region of mRNA encoded by DKFZP586C1324, corresponding to a target binding site such as BINDING SITE I, BINDING SITE II or BINDING SITE III of FIG. 8. Table 4 illustrates the complementarity of the nucleotide sequences of DKFZP586C1324 BINDING SITE, designated SEQ ID:6014, to the nucleotide sequence of GAM7957 RNA, herein designated GAM RNA, also designated SEQ ID:297.

Another function of GAM7957 is therefore inhibition of DKFZP586C1324 (Accession XP__045876.1). Accordingly, utilities of GAM7957 include diagnosis, prevention and treatment of diseases and clinical conditions associated with DKFZP586C1324.

DKFZP586M1120 (Accession NP__112584.1) is another GAM7957 target gene, herein designated TARGET GENE. DKFZP586M1120 BINDING SITE is a target binding site found in the 3' untranslated region of mRNA encoded by DKFZP586M1120, corresponding to a target binding site such as BINDING SITE I, BINDING SITE II or BINDING SITE III of FIG. 8. Table 4 illustrates the complementarity of the nucleotide sequences of DKFZP586M1120 BINDING SITE, designated SEQ ID:5614, to the nucleotide sequence of GAM7957 RNA, herein designated GAM RNA, also designated SEQ ID:297.

Another function of GAM7957 is therefore inhibition of DKFZP586M1120 (Accession NP__112584.1). Accordingly, utilities of GAM7957 include diagnosis, prevention and treatment of diseases and clinical conditions associated with DKFZP586M1120.

DKFZp727A071 (Accession NP__689481.1) is another GAM7957 target gene, herein designated TARGET GENE. DKFZp727A071 BINDING SITE is a target binding site found in the 5' untranslated region of mRNA encoded by DKFZp727A071, corresponding to a target binding site such as BINDING SITE I, BINDING SITE II or BINDING SITE III of FIG. 8. Table 4 illustrates the complementarity of the nucleotide sequences of DKFZp727A071 BINDING SITE, designated SEQ ID:9974, to the nucleotide sequence of GAM7957 RNA, herein designated GAM RNA, also designated SEQ ID:297.

Another function of GAM7957 is therefore inhibition of DKFZp727A071 (Accession NP__689481.1). Accordingly, utilities of GAM7957 include diagnosis, prevention and treatment of diseases and clinical conditions associated with DKFZp727A071.

DKFZP727C091 (Accession XP__038689.1) is another GAM7957 target gene, herein designated TARGET GENE. DKFZP727C091 BINDING SITE is a target binding site found in the 5' untranslated region of mRNA encoded by DKFZP727C091, corresponding to a target binding site such as BINDING SITE I, BINDING SITE II or BINDING SITE III of FIG. 8. Table 4 illustrates the complementarity of the nucleotide sequences of DKFZP727C091 BINDING SITE, designated SEQ ID:7653, to the nucleotide sequence of GAM7957 RNA, herein designated GAM RNA, also designated SEQ ID:297.

Another function of GAM7957 is therefore inhibition of DKFZP727C091 (Accession XP__038689.1). Accordingly, utilities of GAM7957 include diagnosis, prevention and treatment of diseases and clinical conditions associated with DKFZP727C091.

DKFZp727G131 (Accession NP__659802.1) is another GAM7957 target gene, herein designated TARGET GENE. DKFZp727G131 BINDING SITE is a target binding site found in the 3' untranslated region of mRNA encoded by DKFZp727G131, corresponding to a target binding site such as BINDING SITE I, BINDING SITE II or BINDING SITE III of FIG. 8. Table 4 illustrates the complementarity of the nucleotide sequences of DKFZp727G131 BINDING SITE, designated SEQ ID:1693, to the nucleotide sequence of GAM7957 RNA, herein designated GAM RNA, also designated SEQ ID:297.

Another function of GAM7957 is therefore inhibition of DKFZp727G131 (Accession NP__659802.1). Accordingly, utilities of GAM7957 include diagnosis, prevention and treatment of diseases and clinical conditions associated with DKFZp727G131.

DKFZp761A052 (Accession XP__054098.4) is another GAM7957 target gene, herein designated TARGET GENE. DKFZp761A052 BINDING SITE is a target binding site found in the 3' untranslated region of mRNA encoded by DKFZp761A052, corresponding to a target binding site such as BINDING SITE I, BINDING SITE II or BINDING SITE III of FIG. 8. Table 4 illustrates the complementarity of the nucleotide sequences of DKFZp761A052 BINDING SITE, designated SEQ ID:5957, to the nucleotide sequence of GAM7957 RNA, herein designated GAM RNA, also designated SEQ ID:297.

Another function of GAM7957 is therefore inhibition of DKFZp761A052 (Accession XP_054098.4). Accordingly, utilities of GAM7957 include diagnosis, prevention and treatment of diseases and clinical conditions associated with DKFZp761A052.

DKFZp761G0122 (Accession NP_689874.1) is another GAM7957 target gene, herein designated TARGET GENE. DKFZp761G0122 BINDING SITE is a target binding site found in the 3' untranslated region of mRNA encoded by DKFZp761G0122, corresponding to a target binding site such as BINDING SITE I, BINDING SITE II or BINDING SITE III of FIG. 8. Table 4 illustrates the complementarity of the nucleotide sequences of DKFZp761G0122 BINDING SITE, designated SEQ ID:920, to the nucleotide sequence of GAM7957 RNA, herein designated GAM RNA, also designated SEQ ID:297.

Another function of GAM7957 is therefore inhibition of DKFZp761G0122 (Accession NP_689874.1). Accordingly, utilities of GAM7957 include diagnosis, prevention and treatment of diseases and clinical conditions associated with DKFZp761G0122.

DKFZp761G2113 (Accession XP_046017.3) is another GAM7957 target gene, herein designated TARGET GENE. DKFZp761G2113 BINDING SITE is a target binding site found in the 3' untranslated region of mRNA encoded by DKFZp761G2113, corresponding to a target binding site such as BINDING SITE I, BINDING SITE II or BINDING SITE III of FIG. 8. Table 4 illustrates the complementarity of the nucleotide sequences of DKFZp761G2113 BINDING SITE, designated SEQ ID:10014, to the nucleotide sequence of GAM7957 RNA, herein designated GAM RNA, also designated SEQ ID:297.

Another function of GAM7957 is therefore inhibition of DKFZp761G2113 (Accession XP_046017.3). Accordingly, utilities of GAM7957 include diagnosis, prevention and treatment of diseases and clinical conditions associated with DKFZp761G2113.

DKFZp761H0421 (Accession NP_775102.1) is another GAM7957 target gene, herein designated TARGET GENE. DKFZp761H0421 BINDING SITE1 and DKFZp761H0421 BINDING SITE2 are target binding sites found in untranslated regions of mRNA encoded by DKFZp761H0421, corresponding to target binding sites such as BINDING SITE I, BINDING SITE II or BINDING SITE III of FIG. 8. Table 4 illustrates the complementarity of the nucleotide sequences of DKFZp761H0421 BINDING SITE1 and DKFZp761H0421 BINDING SITE2, designated SEQ ID:13155 and SEQ ID:15340 respectively, to the nucleotide sequence of GAM7957 RNA, herein designated GAM RNA, also designated SEQ ID:297.

Another function of GAM7957 is therefore inhibition of DKFZp761H0421 (Accession NP_775102.1). Accordingly, utilities of GAM7957 include diagnosis, prevention and treatment of diseases and clinical conditions associated with DKFZp761H0421.

DKFZp761I2123 (Accession XP_166582.2) is another GAM7957 target gene, herein designated TARGET GENE. DKFZp761I2123 BINDING SITE is a target binding site found in the 3' untranslated region of mRNA encoded by DKFZp761I2123, corresponding to a target binding site such as BINDING SITE I, BINDING SITE II or BINDING SITE III of FIG. 8. Table 4 illustrates the complementarity of the nucleotide sequences of DKFZp761I2123 BINDING SITE, designated SEQ ID:17403, to the nucleotide sequence of GAM7957 RNA, herein designated GAM RNA, also designated SEQ ID:297.

Another function of GAM7957 is therefore inhibition of DKFZp761I2123 (Accession XP_166582.2). Accordingly, utilities of GAM7957 include diagnosis, prevention and treatment of diseases and clinical conditions associated with DKFZp761I2123.

DKFZp761J139 (Accession NP_115656.1) is another GAM7957 target gene, herein designated TARGET GENE. DKFZp761J139 BINDING SITE is a target binding site found in the 5' untranslated region of mRNA encoded by DKFZp761J139, corresponding to a target binding site such as BINDING SITE I, BINDING SITE II or BINDING SITE III of FIG. 8. Table 4 illustrates the complementarity of the nucleotide sequences of DKFZp761J139 BINDING SITE, designated SEQ ID:9330, to the nucleotide sequence of GAM7957 RNA, herein designated GAM RNA, also designated SEQ ID:297.

Another function of GAM7957 is therefore inhibition of DKFZp761J139 (Accession NP_115656.1). Accordingly, utilities of GAM7957 include diagnosis, prevention and treatment of diseases and clinical conditions associated with DKFZp761J139.

DKFZp761L1417 (Accession NP_690877.1) is another GAM7957 target gene, herein designated TARGET GENE. DKFZp761L1417 BINDING SITE1 and DKFZp761L1417 BINDING SITE2 are target binding sites found in untranslated regions of mRNA encoded by DKFZp761L1417, corresponding to target binding sites such as BINDING SITE I, BINDING SITE II or BINDING SITE III of FIG. 8. Table 4 illustrates the complementarity of the nucleotide sequences of DKFZp761L1417 BINDING SITE1 and DKFZp761L1417 BINDING SITE2, designated SEQ ID:6861 and SEQ ID:11920 respectively, to the nucleotide sequence of GAM7957 RNA, herein designated GAM RNA, also designated SEQ ID:297.

Another function of GAM7957 is therefore inhibition of DKFZp761L1417 (Accession NP_690877.1). Accordingly, utilities of GAM7957 include diagnosis, prevention and treatment of diseases and clinical conditions associated with DKFZp761L1417.

DKFZp761L1518 (Accession XP_294685.2) is another GAM7957 target gene, herein designated TARGET GENE. DKFZp761L1518 BINDING SITE is a target binding site found in the 5' untranslated region of mRNA encoded by DKFZp761L1518, corresponding to a target binding site such as BINDING SITE I, BINDING SITE II or BINDING SITE III of FIG. 8. Table 4 illustrates the complementarity of the nucleotide sequences of DKFZp761L1518 BINDING SITE, designated SEQ ID:19710, to the nucleotide sequence of GAM7957 RNA, herein designated GAM RNA, also designated SEQ ID:297.

Another function of GAM7957 is therefore inhibition of DKFZp761L1518 (Accession XP_294685.2). Accordingly, utilities of GAM7957 include diagnosis, prevention and treatment of diseases and clinical conditions associated with DKFZp761L1518.

DKFZp762I137 (Accession NP_689624.1) is another GAM7957 target gene, herein designated TARGET GENE. DKFZp762I137 BINDING SITE is a target binding site found in the 3' untranslated region of mRNA encoded by DKFZp762I137, corresponding to a target binding site such as BINDING SITE I, BINDING SITE II or BINDING SITE III of FIG. 8. Table 4 illustrates the complementarity of the nucleotide sequences of DKFZp762I137 BINDING SITE, designated SEQ ID:2921, to the nucleotide sequence of GAM7957 RNA, herein designated GAM RNA, also designated SEQ ID:297.

Another function of GAM7957 is therefore inhibition of DKFZp762I137 (Accession NP_689624.1). Accordingly, utilities of GAM7957 include diagnosis, prevention and treatment of diseases and clinical conditions associated with DKFZp762I137.

DKFZp762N1910 (Accession XP_290525.1) is another GAM7957 target gene, herein designated TARGET GENE. DKFZp762N1910 BINDING SITE is a target binding site found in the 5' untranslated region of mRNA encoded by DKFZp762N1910, corresponding to a target binding site such as BINDING SITE I, BINDING SITE II or BINDING SITE III of FIG. 8. Table 4 illustrates the complementarity of the nucleotide sequences of DKFZp762N1910 BINDING SITE, designated SEQ ID:8890, to the nucleotide sequence of GAM7957 RNA, herein designated GAM RNA, also designated SEQ ID:297.

Another function of GAM7957 is therefore inhibition of DKFZp762N1910 (Accession XP_290525.1). Accordingly, utilities of GAM7957 include diagnosis, prevention and treatment of diseases and clinical conditions associated with DKFZp762N1910.

Dmc1 dosage suppressor of mck1 homolog, meiosis-specific homologous recombination (yeast) (DMC1, Accession NP_008999.2) is another GAM7957 target gene, herein designated TARGET GENE. DMC1 BINDING SITE is a target binding site found in the 3' untranslated region of mRNA encoded by DMC1, corresponding to a target binding site such as BINDING SITE I, BINDING SITE II or BINDING SITE III of FIG. 8. Table 4 illustrates the complementarity of the nucleotide sequences of DMC1 BINDING SITE, designated SEQ ID:6684, to the nucleotide sequence of GAM7957 RNA, herein designated GAM RNA, also designated SEQ ID:297.

Another function of GAM7957 is therefore inhibition of Dmc1 dosage suppressor of mck1 homolog, meiosis-specific homologous recombination (yeast) (DMC1, Accession NP_008999.2). Accordingly, utilities of GAM7957 include diagnosis, prevention and treatment of diseases and clinical conditions associated with DMC1.

DNAM-1 (Accession NP_006557.1) is another GAM7957 target gene, herein designated TARGET GENE. DNAM-1 BINDING SITE is a target binding site found in the 5' untranslated region of mRNA encoded by DNAM-1, corresponding to a target binding site such as BINDING SITE I, BINDING SITE II or BINDING SITE III of FIG. 8. Table 4 illustrates the complementarity of the nucleotide sequences of DNAM-1 BINDING SITE, designated SEQ ID:14329, to the nucleotide sequence of GAM7957 RNA, herein designated GAM RNA, also designated SEQ ID:297.

Another function of GAM7957 is therefore inhibition of DNAM-1 (Accession NP_006557.1). Accordingly, utilities of GAM7957 include diagnosis, prevention and treatment of diseases and clinical conditions associated with DNAM-1.

Deoxyribonuclease ii, lysosomal (DNASE2, Accession NP_001366.1) is another GAM7957 target gene, herein designated TARGET GENE. DNASE2 BINDING SITE1 and DNASE2 BINDING SITE2 are target binding sites found in untranslated regions of mRNA encoded by DNASE2, corresponding to target binding sites such as BINDING SITE I, BINDING SITE II or BINDING SITE III of FIG. 8. Table 4 illustrates the complementarity of the nucleotide sequences of DNASE2 BINDING SITE1 and DNASE2 BINDING SITE2, designated SEQ ID:17444 and SEQ ID:12684 respectively, to the nucleotide sequence of GAM7957 RNA, herein designated GAM RNA, also designated SEQ ID:297.

Another function of GAM7957 is therefore inhibition of Deoxyribonuclease ii, lysosomal (DNASE2, Accession NP_001366.1), a gene which has a possible role in apoptosis. Accordingly, utilities of GAM7957 include diagnosis, prevention and treatment of diseases and clinical conditions associated with DNASE2.

The function of DNASE2 and its association with various diseases and clinical conditions, has been established by previous studies, as described hereinabove with reference to GAM72.1. Dynein, cytoplasmic, light polypeptide 2a (DNCL2A, Accession NP_808853.1) is another GAM7957 target gene, herein designated TARGET GENE. DNCL2A BINDING SITE is a target binding site found in the 5' untranslated region of multiple transcripts of mRNA encoded by DNCL2A, corresponding to a target binding site such as BINDING SITE I, BINDING SITE II or BINDING SITE III of FIG. 8. Table 4 illustrates the complementarity of the nucleotide sequences of DNCL2A BINDING SITE, designated SEQ ID:9496, to the nucleotide sequence of GAM7957 RNA, herein designated GAM RNA, also designated SEQ ID:297.

Another function of GAM7957 is therefore inhibition of Dynein, cytoplasmic, light polypeptide 2a (DNCL2A, Accession NP_808853.1). Accordingly, utilities of GAM7957 include diagnosis, prevention and treatment of diseases and clinical conditions associated with DNCL2A.

Dynein, cytoplasmic, light polypeptide 2a (DNCL2A, Accession NP_054902.1) is another GAM7957 target gene, herein designated TARGET GENE. DNCL2A BINDING SITE is a target binding site found in the 5' untranslated region of multiple transcripts of mRNA encoded by DNCL2A, corresponding to a target binding site such as BINDING SITE I, BINDING SITE II or BINDING SITE III of FIG. 8. Table 4 illustrates the complementarity of the nucleotide sequences of DNCL2A BINDING SITE, designated SEQ ID:9496, to the nucleotide sequence of GAM7957 RNA, herein designated GAM RNA, also designated SEQ ID:297.

Another function of GAM7957 is therefore inhibition of Dynein, cytoplasmic, light polypeptide 2a (DNCL2A, Accession NP_054902.1). Accordingly, utilities of GAM7957 include diagnosis, prevention and treatment of diseases and clinical conditions associated with DNCL2A.

Dynein, cytoplasmic, light polypeptide 2b (DNCL2B, Accession NP_570967.1) is another GAM7957 target gene, herein designated TARGET GENE. DNCL2B BINDING SITE is a target binding site found in the 5' untranslated region of mRNA encoded by DNCL2B, corresponding to a target binding site such as BINDING SITE I, BINDING SITE II or BINDING SITE III of FIG. 8. Table 4 illustrates the complementarity of the nucleotide sequences of DNCL2B BINDING SITE, designated SEQ ID:908, to the nucleotide sequence of GAM7957 RNA, herein designated GAM RNA, also designated SEQ ID:297.

Another function of GAM7957 is therefore inhibition of Dynein, cytoplasmic, light polypeptide 2b (DNCL2B, Accession NP_570967.1). Accordingly, utilities of GAM7957 include diagnosis, prevention and treatment of diseases and clinical conditions associated with DNCL2B.

Dipeptidylpeptidase 9 (DPP9, Accession NP_631898.1) is another GAM7957 target gene, herein designated TARGET GENE. DPP9 BINDING SITE1 and DPP9 BINDING SITE2 are target binding sites found in untranslated regions of mRNA encoded by DPP9, corresponding to target binding sites such as BINDING SITE I, BINDING SITE II or BINDING SITE III of FIG. 8. Table 4 illustrates the complementarity of the nucleotide sequences of DPP9 BINDING SITE1 and DPP9 BINDING SITE2, designated SEQ ID:5830 and SEQ ID:9761 respectively, to the nucleotide sequence of GAM7957 RNA, herein designated GAM RNA, also designated SEQ ID:297.

Another function of GAM7957 is therefore inhibition of Dipeptidylpeptidase 9 (DPP9, Accession NP_631898.1). Accordingly, utilities of GAM7957 include diagnosis, prevention and treatment of diseases and clinical conditions associated with DPP9.

DRF1 (Accession NP_079380.1) is another GAM7957 target gene, herein designated TARGET GENE. DRF1 BINDING SITE1 and DRF1 BINDING SITE2 are target binding sites found in untranslated regions of multiple transcripts of mRNA encoded by DRF1, corresponding to target binding sites such as BINDING SITE I, BINDING SITE II or BINDING SITE III of FIG. 8. Table 4 illustrates the complementarity of the nucleotide sequences of DRF1 BINDING SITE1 and DRF1 BINDING SITE2, designated SEQ ID:11050 and SEQ ID:19029 respectively, to the nucleotide sequence of GAM7957 RNA, herein designated GAM RNA, also designated SEQ ID:297.

Another function of GAM7957 is therefore inhibition of DRF1 (Accession NP_079380.1). Accordingly, utilities of GAM7957 include diagnosis, prevention and treatment of diseases and clinical conditions associated with DRF1.

DRIM (Accession NP_055318.1) is another GAM7957 target gene, herein designated TARGET GENE. DRIM BINDING SITE is a target binding site found in the 3' untranslated region of mRNA encoded by DRIM, corresponding to a target binding site such as BINDING SITE I, BINDING SITE II or BINDING SITE III of FIG. 8. Table 4 illustrates the complementarity of the nucleotide sequences of DRIM BINDING SITE, designated SEQ ID:18872, to the nucleotide sequence of GAM7957 RNA, herein designated GAM RNA, also designated SEQ ID:297.

Another function of GAM7957 is therefore inhibition of DRIM (Accession NP_055318.1). Accordingly, utilities of GAM7957 include diagnosis, prevention and treatment of diseases and clinical conditions associated with DRIM.

Desmocollin 1 (DSC1, Accession NP_077739.1) is another GAM7957 target gene, herein designated TARGET GENE. DSC1 BINDING SITE is a target binding site found in the 3' untranslated region of multiple transcripts of mRNA encoded by DSC1, corresponding to a target binding site such as BINDING SITE I, BINDING SITE II or BINDING SITE III of FIG. 8. Table 4 illustrates the complementarity of the nucleotide sequences of DSC1 BINDING SITE, designated SEQ ID:1568, to the nucleotide sequence of GAM7957 RNA, herein designated GAM RNA, also designated SEQ ID:297.

Another function of GAM7957 is therefore inhibition of Desmocollin 1 (DSC1, Accession NP_077739.1), a gene which is a component of intercellular desmosome junctions. Accordingly, utilities of GAM7957 include diagnosis, prevention and treatment of diseases and clinical conditions associated with DSC1.

The function of DSC1 and its association with various diseases and clinical conditions, has been established by previous studies, as described hereinabove with reference to GAM195.1. Desmocollin 1 (DSC1, Accession NP_004939.1) is another GAM7957 target gene, herein designated TARGET GENE. DSC1 BINDING SITE is a target binding site found in the 3' untranslated region of multiple transcripts of mRNA encoded by DSC1, corresponding to a target binding site such as BINDING SITE I, BINDING SITE II or BINDING SITE III of FIG. 8. Table 4 illustrates the complementarity of the nucleotide sequences of DSC1 BINDING SITE, designated SEQ ID:1568, to the nucleotide sequence of GAM7957 RNA, herein designated GAM RNA, also designated SEQ ID:297.

Another function of GAM7957 is therefore inhibition of Desmocollin 1 (DSC1, Accession NP_004939.1), a gene which is a component of intercellular desmosome junctions. Accordingly, utilities of GAM7957 include diagnosis, prevention and treatment of diseases and clinical conditions associated with DSC1.

The function of DSC1 and its association with various diseases and clinical conditions, has been established by previous studies, as described hereinabove with reference to GAM195.1. Desmocollin 2 (DSC2, Accession NP_004940.1) is another GAM7957 target gene, herein designated TARGET GENE. DSC2 BINDING SITE is a target binding site found in the 3' untranslated region of multiple transcripts of mRNA encoded by DSC2, corresponding to a target binding site such as BINDING SITE I, BINDING SITE II or BINDING SITE III of FIG. 8. Table 4 illustrates the complementarity of the nucleotide sequences of DSC2 BINDING SITE, designated SEQ ID:19615, to the nucleotide sequence of GAM7957 RNA, herein designated GAM RNA, also designated SEQ ID:297.

Another function of GAM7957 is therefore inhibition of Desmocollin 2 (DSC2, Accession NP_004940.1), a gene which is a component of intercellular desmosome junctions. Accordingly, utilities of GAM7957 include diagnosis, prevention and treatment of diseases and clinical conditions associated with DSC2.

The function of DSC2 and its association with various diseases and clinical conditions, has been established by previous studies, as described hereinabove with reference to GAM401.1. Down syndrome critical region gene 6 (DSCR6, Accession NP_061835.1) is another GAM7957 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:13664, to the nucleotide sequence of GAM7957 RNA, herein designated GAM RNA, also designated SEQ ID:297.

Another function of GAM7957 is therefore inhibition of Down syndrome critical region gene 6 (DSCR6, Accession NP_061835.1). Accordingly, utilities of GAM7957 include diagnosis, prevention and treatment of diseases and clinical conditions associated with DSCR6.

Dystrobrevin, beta (DTNB, Accession NP_068707.1) is another GAM7957 target gene, herein designated TARGET GENE. DTNB BINDING SITE is a target binding site found in the 3' untranslated region of multiple transcripts of mRNA encoded by DTNB, corresponding to a target binding site such as BINDING SITE I, BINDING SITE II or BINDING SITE III of FIG. 8. Table 4 illustrates the complementarity of the nucleotide sequences of DTNB BINDING SITE, designated SEQ ID:2938, to the nucleotide sequence of GAM7957 RNA, herein designated GAM RNA, also designated SEQ ID:297.

Another function of GAM7957 is therefore inhibition of Dystrobrevin, beta (DTNB, Accession NP_068707.1), a gene which is a part of a dystrophin- associated protein complex. and therefore may be associated with Limb-girdle muscular dystrophy. Accordingly, utilities of GAM7957 include diagnosis, prevention and treatment of Limb-girdle muscular dystrophy, and of other diseases and clinical conditions associated with DTNB.

The function of DTNB and its association with various diseases and clinical conditions, has been established by previous studies, as described hereinabove with reference to GAM100.1. Dystrobrevin, beta (DTNB, Accession NP_149160.1) is another GAM7957 target gene, herein designated TARGET GENE. DTNB BINDING SITE is a target binding site found in the 3' untranslated region of multiple transcripts of mRNA encoded by DTNB, corresponding to a target binding site such as BINDING SITE I, BINDING SITE II or BINDING SITE III of FIG. 8. Table 4 illustrates the complementarity of the nucleotide sequences of DTNB BINDING SITE, designated SEQ ID:2938, to the nucleotide sequence of GAM7957 RNA, herein designated GAM RNA, also designated SEQ ID:297.

Another function of GAM7957 is therefore inhibition of Dystrobrevin, beta (DTNB, Accession NP_149160.1), a gene which is a part of a dystrophin- associated protein complex. and therefore may be associated with Limb-girdle muscular dystrophy. Accordingly, utilities of GAM7957 include diagnosis, prevention and treatment of Limb-girdle muscular dystrophy, and of other diseases and clinical conditions associated with DTNB.

The function of DTNB and its association with various diseases and clinical conditions, has been established by previous studies, as described hereinabove with reference to GAM100.1. Dishevelled, dsh homolog 3 (drosophila) (DVL3, Accession NP_004414.2) is another GAM7957 target gene, herein designated TARGET GENE. DVL3 BINDING SITE is a target binding site found in the 3' untranslated region of mRNA encoded by DVL3, corresponding to a target binding site such as BINDING SITE I, BINDING SITE II or BINDING SITE III of FIG. 8. Table 4 illustrates the complementarity of the nucleotide sequences of DVL3 BINDING SITE, designated SEQ ID:7466, to the nucleotide sequence of GAM7957 RNA, herein designated GAM RNA, also designated SEQ ID:297.

Another function of GAM7957 is therefore inhibition of Dishevelled, dsh homolog 3 (drosophila) (DVL3, Accession NP_004414.2), a gene which regulates cell proliferation. Accordingly, utilities of GAM7957 include diagnosis, prevention and treatment of diseases and clinical conditions associated with DVL3.

The function of DVL3 and its association with various diseases and clinical conditions, has been established by previous studies, as described hereinabove with reference to GAM47.1. Endothelial differentiation, sphingolipid g-protein-coupled receptor, 3 (EDG3, Accession NP_005217.1) is another GAM7957 target gene, herein designated TARGET GENE. EDG3 BINDING SITE1 and EDG3 BINDING SITE2 are target binding sites found in untranslated regions of mRNA encoded by EDG3, corresponding to target binding sites such as BINDING SITE I, BINDING SITE II or BINDING SITE III of FIG. 8. Table 4 illustrates the complementarity of the nucleotide sequences of EDG3 BINDING SITE1 and EDG3 BINDING SITE2, designated SEQ ID:19288 and SEQ ID:6041 respectively, to the nucleotide sequence of GAM7957 RNA, herein designated GAM RNA, also designated SEQ ID:297.

Another function of GAM7957 is therefore inhibition of Endothelial differentiation, sphingolipid g-protein-coupled receptor, 3 (EDG3, Accession NP_005217.1). Accordingly, utilities of GAM7957 include diagnosis, prevention and treatment of diseases and clinical conditions associated with EDG3.

Egf-like-domain, multiple 4 (EGFL4, Accession XP_290821.1) is another GAM7957 target gene, herein designated TARGET GENE. EGFL4 BINDING SITE is a target binding site found in the 3' untranslated region of mRNA encoded by EGFL4, corresponding to a target binding site such as BINDING SITE I, BINDING SITE II or BINDING SITE III of FIG. 8. Table 4 illustrates the complementarity of the nucleotide sequences of EGFL4 BINDING SITE, designated SEQ ID:15055, to the nucleotide sequence of GAM7957 RNA, herein designated GAM RNA, also designated SEQ ID:297.

Another function of GAM7957 is therefore inhibition of Egf-like-domain, multiple 4 (EGFL4, Accession XP_290821.1). Accordingly, utilities of GAM7957 include diagnosis, prevention and treatment of diseases and clinical conditions associated with EGFL4.

Egf-like-domain, multiple 5 (EGFL5, Accession XP_098838.1) is another GAM7957 target gene, herein designated TARGET GENE. EGFL5 BINDING SITE is a target binding site found in the 3' untranslated region of mRNA encoded by EGFL5, corresponding to a target binding site such as BINDING SITE I, BINDING SITE II or BINDING SITE III of FIG. 8. Table 4 illustrates the complementarity of the nucleotide sequences of EGFL5 BINDING SITE, designated SEQ ID:4534, to the nucleotide sequence of GAM7957 RNA, herein designated GAM RNA, also designated SEQ ID:297.

Another function of GAM7957 is therefore inhibition of Egf-like-domain, multiple 5 (EGFL5, Accession XP_098838.1). Accordingly, utilities of GAM7957 include diagnosis, prevention and treatment of diseases and clinical conditions associated with EGFL5.

Eh-domain containing 1 (EHD1, Accession NP_006786.2) is another GAM7957 target gene, herein designated TARGET GENE. EHD1 BINDING SITE is a target binding site found in the 3' untranslated region of mRNA encoded by EHD1, corresponding to a target binding site such as BINDING SITE I, BINDING SITE II or BINDING SITE III of FIG. 8. Table 4 illustrates the complementarity of the nucleotide sequences of EHD1 BINDING SITE, designated SEQ ID:15638, to the nucleotide sequence of GAM7957 RNA, herein designated GAM RNA, also designated SEQ ID:297.

Another function of GAM7957 is therefore inhibition of Eh-domain containing 1 (EHD1, Accession NP_006786.2), a gene which may be involved in ligand-initiated endocytosis. Accordingly, utilities of GAM7957 include diagnosis, prevention and treatment of diseases and clinical conditions associated with EHD1.

The function of EHD1 and its association with various diseases and clinical conditions, has been established by previous studies, as described hereinabove with reference to GAM65.1. Eukaryotic translation initiation factor 1a (EIF1A, Accession NP_001403.1) is another GAM7957 target gene, herein designated TARGET GENE. EIF1A BINDING SITE is a target binding site found in the 3' untranslated region of mRNA encoded by EIF1A, corresponding to a target binding site such as BINDING SITE I, BINDING SITE II or BINDING SITE III of FIG. 8. Table 4 illustrates the complementarity of the nucleotide sequences of EIF1A BINDING SITE, designated SEQ ID:13049, to the nucleotide sequence of GAM7957 RNA, herein designated GAM RNA, also designated SEQ ID:297.

Another function of GAM7957 is therefore inhibition of Eukaryotic translation initiation factor 1a (EIF1A, Accession NP_001403.1), a gene which seems to be required for maximal rate of protein biosynthesis. Accordingly, utilities of GAM7957 include diagnosis, prevention and treatment of diseases and clinical conditions associated with EIF1A.

The function of EIF1A and its association with various diseases and clinical conditions, has been established by previous studies, as described hereinabove with reference to GAM1345.1. Eukaryotic translation initiation factor 2 alpha kinase 4 (EIF2AK4, Accession XP_031612.6) is another GAM7957 target gene, herein designated TARGET GENE. EIF2AK4 BINDING SITE is a target binding site found in the 3' untranslated region of mRNA encoded by EIF2AK4, corresponding to a target binding site such as BINDING SITE I, BINDING SITE II or BINDING SITE III of FIG. 8. Table 4 illustrates the complementarity of the nucleotide sequences of EIF2AK4 BINDING SITE, designated SEQ ID:11505, to the nucleotide sequence of GAM7957 RNA, herein designated GAM RNA, also designated SEQ ID:297.

Another function of GAM7957 is therefore inhibition of Eukaryotic translation initiation factor 2 alpha kinase 4 (EIF2AK4, Accession XP_031612.6). Accordingly, utilities of GAM7957 include diagnosis, prevention and treatment of diseases and clinical conditions associated with EIF2AK4.

Eukaryotic translation initiation factor 3, subunit 2 beta, 36 kda (EIF3S2, Accession NP_003748.1) is another GAM7957 target gene, herein designated TARGET GENE. EIF3S2 BINDING SITE is a target binding site found in the 3' untranslated region of mRNA encoded by EIF3S2, corresponding to a target binding site such as BINDING SITE I, BINDING SITE II or BINDING SITE III of FIG. 8. Table 4 illustrates the complementarity of the nucleotide sequences of EIF3S2 BINDING SITE, designated SEQ ID:17403, to the nucleotide sequence of GAM7957 RNA, herein designated GAM RNA, also designated SEQ ID:297.

Another function of GAM7957 is therefore inhibition of Eukaryotic translation initiation factor 3, subunit 2 beta, 36 kda (EIF3S2, Accession NP_003748.1), a gene which binds to the 40s ribosome and promotes the binding of methionyl-trnai and mrna. Accordingly, utilities of GAM7957 include diagnosis, prevention and treatment of diseases and clinical conditions associated with EIF3S2.

The function of EIF3S2 and its association with various diseases and clinical conditions, has been established by previous studies, as described hereinabove with reference to GAM207.2. Elav (embryonic lethal, abnormal vision, drosophila)-like 2 (hu antigen b) (ELAVL2, Accession NP_004423.1) is another GAM7957 target gene, herein designated TARGET GENE. ELAVL2 BINDING SITE is a target binding site found in the 5' untranslated region of mRNA encoded by ELAVL2, corresponding to a target binding site such as BINDING SITE I, BINDING SITE II or BINDING SITE III of FIG. 8. Table 4 illustrates the complementarity of the nucleotide sequences of ELAVL2 BINDING SITE, designated SEQ ID:6187, to the nucleotide sequence of GAM7957 RNA, herein designated GAM RNA, also designated SEQ ID:297.

Another function of GAM7957 is therefore inhibition of Elav (embryonic lethal, abnormal vision, drosophila)-like 2 (hu antigen b) (ELAVL2, Accession NP_004423.1), a gene which binds rna. seems to recognize a gaaa motif. can bind to its own 3' untranslated region (3'utr), the c-fos 3'utr and the id 3'utr. Accordingly, utilities of GAM7957 include diagnosis, prevention and treatment of diseases and clinical conditions associated with ELAVL2.

The function of ELAVL2 and its association with various diseases and clinical conditions, has been established by previous studies, as described hereinabove with reference to GAM439.1. E1a binding protein p300 (EP300, Accession NP_001420.1) is another GAM7957 target gene, herein designated TARGET GENE. EP300 BINDING SITE is a target binding site found in the 5' untranslated region of mRNA encoded by EP300, corresponding to a target binding site such as BINDING SITE I, BINDING SITE II or BINDING SITE III of FIG. 8. Table 4 illustrates the complementarity of the nucleotide sequences of EP300 BINDING SITE, designated SEQ ID:14306, to the nucleotide sequence of GAM7957 RNA, herein designated GAM RNA, also designated SEQ ID:297.

Another function of GAM7957 is therefore inhibition of E1a binding protein p300 (EP300, Accession NP_001420.1), a gene which may have a function in cell cycle regulation. and therefore may be associated with Colorectal cancer. Accordingly, utilities of GAM7957 include diagnosis, prevention and treatment of Colorectal cancer, and of other diseases and clinical conditions associated with EP300.

The function of EP300 and its association with various diseases and clinical conditions, has been established by previous studies, as described hereinabove with reference to GAM473.1. Ephb1 (EPHB1, Accession NP_004432.1) is another GAM7957 target gene, herein designated TARGET GENE. EPHB1 BINDING SITE is a target binding site found in the 3' untranslated region of mRNA encoded by EPHB1, corresponding to a target binding site such as BINDING SITE I, BINDING SITE II or BINDING SITE III of FIG. 8. Table 4 illustrates the complementarity of the nucleotide sequences of EPHB1 BINDING SITE, designated SEQ ID:3606, to the nucleotide sequence of GAM7957 RNA, herein designated GAM RNA, also designated SEQ ID:297.

Another function of GAM7957 is therefore inhibition of Ephb1 (EPHB1, Accession NP_004432.1), a gene which receptor for members of the ephrin-b family. binds to ephrin-b1, -b2 and -b3. Accordingly, utilities of GAM7957 include diagnosis, prevention and treatment of diseases and clinical conditions associated with EPHB1.

The function of EPHB1 and its association with various diseases and clinical conditions, has been established by previous studies, as described hereinabove with reference to GAM96.1. ERAP140 (Accession XP_059748.2) is another GAM7957 target gene, herein designated TARGET GENE. ERAP140 BINDING SITE1 and ERAP140 BINDING SITE2 are target binding sites found in untranslated regions of mRNA encoded by ERAP140, corresponding to target binding sites such as BINDING SITE I, BINDING SITE II or BINDING SITE III of FIG. 8. Table 4 illustrates the complementarity of the nucleotide sequences of ERAP140 BINDING SITE1 and ERAP140 BINDING SITE2, designated SEQ ID:15089 and SEQ ID:12831 respectively, to the nucleotide sequence of GAM7957 RNA, herein designated GAM RNA, also designated SEQ ID:297.

Another function of GAM7957 is therefore inhibition of ERAP140 (Accession XP_059748.2). Accordingly, utilities of GAM7957 include diagnosis, prevention and treatment of diseases and clinical conditions associated with ERAP140.

ET (Accession NP_077287.1) is another GAM7957 target gene, herein designated TARGET GENE. ET BINDING SITE is a target binding site found in the 3' untranslated region of mRNA encoded by ET, corresponding to a target binding site such as BINDING SITE I, BINDING SITE II or BINDING SITE III of FIG. 8. Table 4 illustrates the complementarity of the nucleotide sequences of ET BINDING SITE, designated SEQ ID:11097, to the nucleotide sequence of GAM7957 RNA, herein designated GAM RNA, also designated SEQ ID:297.

Another function of GAM7957 is therefore inhibition of ET (Accession NP_077287.1). Accordingly, utilities of GAM7957 include diagnosis, prevention and treatment of diseases and clinical conditions associated with ET.

EXO70 (Accession NP_056034.1) is another GAM7957 target gene, herein designated TARGET GENE. EXO70 BINDING SITE is a target binding site found in the 3' untranslated region of mRNA encoded by EXO70, corresponding to a target binding site such as BINDING SITE I, BINDING SITE II or BINDING SITE III of FIG. 8. Table 4 illustrates the complementarity of the nucleotide sequences of EXO70 BINDING SITE, designated SEQ ID:6447, to the nucleotide sequence of GAM7957 RNA, herein designated GAM RNA, also designated SEQ ID:297.

Another function of GAM7957 is therefore inhibition of EXO70 (Accession NP_056034.1). Accordingly, utilities of GAM7957 include diagnosis, prevention and treatment of diseases and clinical conditions associated with EXO70.

Coagulation factor ii (thrombin) receptor-like 3 (F2RL3, Accession NP_003941.1) is another GAM7957 target gene, herein designated TARGET GENE. F2RL3 BINDING SITE1 through F2RL3 BINDING SITE4 are target binding sites found in untranslated regions of mRNA encoded by F2RL3, corresponding to target binding sites such as BINDING SITE I, BINDING SITE II or BINDING SITE III of FIG. 8. Table 4 illustrates the complementarity of the nucleotide sequences of F2RL3 BINDING SITE1 through F2RL3 BINDING SITE4, designated SEQ ID:13066, SEQ ID:10569, SEQ ID:4424 and SEQ ID:18740 respectively, to the nucleotide sequence of GAM7957 RNA, herein designated GAM RNA, also designated SEQ ID:297.

Another function of GAM7957 is therefore inhibition of Coagulation factor ii (thrombin) receptor-like 3 (F2RL3, Accession NP_003941.1), a gene which Protease-activated receptor 4; G protein-coupled receptor that increases phosphoinositide hydrolysis. Accordingly, utilities of GAM7957 include diagnosis, prevention and treatment of diseases and clinical conditions associated with F2RL3.

The function of F2RL3 and its association with various diseases and clinical conditions, has been established by previous studies, as described hereinabove with reference to GAM72.1. Fatty acid desaturase 1 (FADS1, Accession NP_037534.2) is another GAM7957 target gene, herein designated TARGET GENE. FADS1 BINDING SITE is a target binding site found in the 3' untranslated region of mRNA encoded by FADS1, corresponding to a target binding site such as BINDING SITE I, BINDING SITE II or BINDING SITE III of FIG. 8. Table 4 illustrates the complementarity of the nucleotide sequences of FADS1 BINDING SITE, designated SEQ ID:10611, to the nucleotide sequence of GAM7957 RNA, herein designated GAM RNA, also designated SEQ ID:297.

Another function of GAM7957 is therefore inhibition of Fatty acid desaturase 1 (FADS1, Accession NP_037534.2). Accordingly, utilities of GAM7957 include diagnosis, prevention and treatment of diseases and clinical conditions associated with FADS1.

Fatty acid desaturase 2 (FADS2, Accession NP_004256.1) is another GAM7957 target gene, herein designated TARGET GENE. FADS2 BINDING SITE is a target binding site found in the 5' untranslated region of mRNA encoded by FADS2, corresponding to a target binding site such as BINDING SITE I, BINDING SITE II or BINDING SITE III of FIG. 8. Table 4 illustrates the complementarity of the nucleotide sequences of FADS2 BINDING SITE, designated SEQ ID:7605, to the nucleotide sequence of GAM7957 RNA, herein designated GAM RNA, also designated SEQ ID:297.

Another function of GAM7957 is therefore inhibition of Fatty acid desaturase 2 (FADS2, Accession NP_004256.1). Accordingly, utilities of GAM7957 include diagnosis, prevention and treatment of diseases and clinical conditions associated with FADS2.

Fanconi anemia, complementation group c (FANCC, Accession NP_000127.1) is another GAM7957 target gene, herein designated TARGET GENE. FANCC BINDING SITE is a target binding site found in the 3' untranslated region of mRNA encoded by FANCC, corresponding to a target binding site such as BINDING SITE I, BINDING SITE II or BINDING SITE III of FIG. 8. Table 4 illustrates the complementarity of the nucleotide sequences of FANCC BINDING SITE, designated SEQ ID:16815, to the nucleotide sequence of GAM7957 RNA, herein designated GAM RNA, also designated SEQ ID:297.

Another function of GAM7957 is therefore inhibition of Fanconi anemia, complementation group c (FANCC, Accession NP_000127.1). Accordingly, utilities of GAM7957 include diagnosis, prevention and treatment of diseases and clinical conditions associated with FANCC.

FBLP-1 (Accession NP_060026.1) is another GAM7957 target gene, herein designated TARGET GENE. FBLP-1 BINDING SITE1 and FBLP-1 BINDING SITE2 are target binding sites found in untranslated regions of multiple transcripts of mRNA encoded by FBLP-1, corresponding to target binding sites such as BINDING SITE I, BINDING SITE II or BINDING SITE III of FIG. 8. Table 4 illustrates the complementarity of the nucleotide sequences of FBLP-1 BINDING SITE1 and FBLP-1 BINDING SITE2, designated SEQ ID:15697 and SEQ ID:13065 respectively, to the nucleotide sequence of GAM7957 RNA, herein designated GAM RNA, also designated SEQ ID:297.

Another function of GAM7957 is therefore inhibition of FBLP-1 (Accession NP_060026.1). Accordingly, utilities of GAM7957 include diagnosis, prevention and treatment of diseases and clinical conditions associated with FBLP-1.

FBLP-1 (Accession XP_290943.1) is another GAM7957 target gene, herein designated TARGET GENE. FBLP-1 BINDING SITE1 and FBLP-1 BINDING SITE2 are target binding sites found in untranslated regions of multiple transcripts of mRNA encoded by FBLP-1, corresponding to target binding sites such as BINDING SITE I, BINDING SITE II or BINDING SITE III of FIG. 8. Table 4 illustrates the complementarity of the nucleotide sequences of FBLP-1 BINDING SITE1 and FBLP-1 BINDING SITE2, designated SEQ ID:15697 and SEQ ID:5802 respectively, to the nucleotide sequence of GAM7957 RNA, herein designated GAM RNA, also designated SEQ ID:297.

Another function of GAM7957 is therefore inhibition of FBLP-1 (Accession XP_290943.1). Accordingly, utilities of GAM7957 include diagnosis, prevention and treatment of diseases and clinical conditions associated with FBLP-1.

F-box only protein 26 (FBXO26, Accession NP_079183.4) is another GAM7957 target gene, herein designated TARGET GENE. FBXO26 BINDING SITE is a target binding site found in the 3' untranslated region of multiple transcripts of mRNA encoded by FBXO26, corresponding to a target binding site such as BINDING SITE I, BINDING SITE II or BINDING SITE III of FIG. 8. Table 4 illustrates the complementarity of the nucleotide sequences of FBXO26 BINDING SITE, designated SEQ ID:6268, to the nucleotide sequence of GAM7957 RNA, herein designated GAM RNA, also designated SEQ ID:297.

Another function of GAM7957 is therefore inhibition of F-box only protein 26 (FBXO26, Accession NP_079183.4). Accordingly, utilities of GAM7957 include diagnosis, prevention and treatment of diseases and clinical conditions associated with FBXO26.

F-box only protein 26 (FBXO26, Accession NP_680474.1) is another GAM7957 target gene, herein designated TARGET GENE. FBXO26 BINDING SITE is a target binding site found in the 3' untranslated region of multiple transcripts of mRNA encoded by FBXO26, corresponding to a target binding site such as BINDING SITE I, BINDING SITE II or BINDING SITE III of FIG. 8. Table 4 illustrates the complementarity of the nucleotide sequences of FBXO26 BINDING SITE, designated SEQ ID:6268, to the nucleotide sequence of GAM7957 RNA, herein designated GAM RNA, also designated SEQ ID:297.

Another function of GAM7957 is therefore inhibition of F-box only protein 26 (FBXO26, Accession NP_680474.1). Accordingly, utilities of GAM7957 include diagnosis, prevention and treatment of diseases and clinical conditions associated with FBXO26.

F-box only protein 27 (FBXO27, Accession XP_059045.1) is another GAM7957 target gene, herein designated TARGET GENE. FBXO27 BINDING SITE1 and FBXO27 BINDING SITE2 are target binding sites found in untranslated regions of multiple transcripts of mRNA encoded by FBXO27, corresponding to target binding sites such as BINDING SITE I, BINDING SITE II or BINDING SITE III of FIG. 8. Table 4 illustrates the complementarity of the nucleotide sequences of FBXO27 BINDING SITE1 and FBXO27 BINDING SITE2, designated SEQ ID:15089 and SEQ ID:19101 respectively, to the nucleotide sequence of GAM7957 RNA, herein designated GAM RNA, also designated SEQ ID:297.

Another function of GAM7957 is therefore inhibition of F-box only protein 27 (FBXO27, Accession XP_059045.1). Accordingly, utilities of GAM7957 include diagnosis, prevention and treatment of diseases and clinical conditions associated with FBXO27.

F-box only protein 27 (FBXO27, Accession NP_849142.1) is another GAM7957 target gene, herein designated TARGET GENE. FBXO27 BINDING SITE1 and FBXO27 BINDING SITE2 are target binding sites found in untranslated regions of multiple transcripts of mRNA encoded by FBXO27, corresponding to target binding sites such as BINDING SITE I, BINDING SITE II or BINDING SITE III of FIG. 8. Table 4 illustrates the complementarity of the nucleotide sequences of FBXO27 BINDING SITE1 and FBXO27 BINDING SITE2, designated SEQ ID:15089 and SEQ ID:19101 respectively, to the nucleotide sequence of GAM7957 RNA, herein designated GAM RNA, also designated SEQ ID:297.

Another function of GAM7957 is therefore inhibition of F-box only protein 27 (FBXO27, Accession NP_849142.1). Accordingly, utilities of GAM7957 include diagnosis, prevention and treatment of diseases and clinical conditions associated with FBXO27.

F-box only protein 6 (FBXO6, Accession NP_060908.1) is another GAM7957 target gene, herein designated TARGET GENE. FBXO6 BINDING SITE is a target binding site found in the 3' untranslated region of mRNA encoded by FBXO6, corresponding to a target binding site such as BINDING SITE I, BINDING SITE II or BINDING SITE III of FIG. 8. Table 4 illustrates the complementarity of the nucleotide sequences of FBXO6 BINDING SITE, designated SEQ ID:14305, to the nucleotide sequence of GAM7957 RNA, herein designated GAM RNA, also designated SEQ ID:297.

Another function of GAM7957 is therefore inhibition of F-box only protein 6 (FBXO6, Accession NP_060908.1). Accordingly, utilities of GAM7957 include diagnosis, prevention and treatment of diseases and clinical conditions associated with FBXO6.

F-box only protein 9 (FBXO9, Accession NP_258441.1) is another GAM7957 target gene, herein designated TARGET GENE. FBXO9 BINDING SITE is a target binding site found in the 3' untranslated region of multiple transcripts of mRNA encoded by FBXO9, corresponding to a target binding site such as BINDING SITE I, BINDING SITE II or BINDING SITE III of FIG. 8. Table 4 illustrates the complementarity of the nucleotide sequences of FBXO9 BINDING SITE, designated SEQ ID:7864, to the nucleotide sequence of GAM7957 RNA, herein designated GAM RNA, also designated SEQ ID:297.

Another function of GAM7957 is therefore inhibition of F-box only protein 9 (FBXO9, Accession NP_258441.1). Accordingly, utilities of GAM7957 include diagnosis, prevention and treatment of diseases and clinical conditions associated with FBXO9.

Fc fragment of iga, receptor for (FCAR, Accession NP_579814.1) is another GAM7957 target gene, herein designated TARGET GENE. FCAR BINDING SITE is a target binding site found in the 3' untranslated region of multiple transcripts of mRNA encoded by FCAR, corresponding to a target binding site such as BINDING SITE I, BINDING SITE II or BINDING SITE III of FIG. 8. Table 4 illustrates the complementarity of the nucleotide sequences of FCAR BINDING SITE, designated SEQ ID:9833, to the nucleotide sequence of GAM7957 RNA, herein designated GAM RNA, also designated SEQ ID:297.

Another function of GAM7957 is therefore inhibition of Fc fragment of iga, receptor for (FCAR, Accession NP_579814.1), a gene which binds to the fc region of immunoglobulins alpha and mediates several functions including cytokine production. and therefore may be associated with Iga nephropathy. Accordingly, utilities of GAM7957 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fc fragment of iga, receptor for (FCAR, Accession NP_579813.1) is another GAM7957 target gene, herein designated TARGET GENE. FCAR BINDING SITE is a target binding site found in the 3' untranslated region of multiple transcripts of mRNA encoded by FCAR, corresponding to a target binding site such as BINDING SITE I, BINDING SITE II or BINDING SITE III of FIG. 8. Table 4 illustrates the complementarity of the nucleotide sequences of FCAR BINDING SITE, designated SEQ ID:9833, to the nucleotide sequence of GAM7957 RNA, herein designated GAM RNA, also designated SEQ ID:297.

Another function of GAM7957 is therefore inhibition of Fc fragment of iga, receptor for (FCAR, Accession NP_579813.1), a gene which binds to the fc region of immunoglobulins alpha and mediates several functions including cytokine production. and therefore may be associated with Iga nephropathy. Accordingly, utilities of GAM7957 include diagnosis, prevention and treatment of Iga nephropathy, and of other diseases and clinical conditions associated with FCAR.

The function of FCAR and its association with various diseases and clinical conditions, has been established by previous studies, as described hereinabove with reference to GAM136.1. Fukuyama type congenital muscular dystrophy (fukutin) (FCMD, Accession NP_006722.1) is another GAM7957 target gene, herein designated TARGET GENE. FCMD BINDING SITE is a target binding site found in the 3' untranslated region of mRNA encoded by FCMD, corresponding to a target binding site such as BINDING SITE I, BINDING SITE II or BINDING SITE III of FIG. 8. Table 4 illustrates the complementarity of the nucleotide sequences of FCMD BINDING SITE, designated SEQ ID:1356, to the nucleotide sequence of GAM7957 RNA, herein designated GAM RNA, also designated SEQ ID:297.

Another function of GAM7957 is therefore inhibition of Fukuyama type congenital muscular dystrophy (fukutin) (FCMD, Accession NP_006722.1). Accordingly, utilities of GAM7957 include diagnosis, prevention and treatment of diseases and clinical conditions associated with FCMD.

Ficolin (collagen/fibrinogen domain containing lectin) 2 (hucolin) (FCN2, Accession NP_056653.1) is another GAM7957 target gene, herein designated TARGET GENE. FCN2 BINDING SITE is a target binding site found in the 3' untranslated region of multiple transcripts of mRNA encoded by FCN2, corresponding to a target binding site such as BINDING SITE I, BINDING SITE II or BINDING SITE III of FIG. 8. Table 4 illustrates the complementarity of the nucleotide sequences of FCN2 BINDING SITE, designated SEQ ID:12186, to the nucleotide sequence of GAM7957 RNA, herein designated GAM RNA, also designated SEQ ID:297.

Another function of GAM7957 is therefore inhibition of Ficolin (collagen/fibrinogen domain containing lectin) 2 (hucolin) (FCN2, Accession NP_056653.1), a gene which is involved in phagocytosis of pathogens. Accordingly, utilities of GAM7957 include diagnosis, prevention and treatment of diseases and clinical conditions associated with FCN2.

The function of FCN2 and its association with various diseases and clinical conditions, has been established by previous studies, as described hereinabove with reference to GAM223.1. Ficolin (collagen/fibrinogen domain containing lectin) 2 (hucolin) (FCN2, Accession NP_056654.1) is another GAM7957 target gene, herein designated TARGET GENE. FCN2 BINDING SITE is a target binding site found in the 3' untranslated region of multiple transcripts of mRNA encoded by FCN2, corresponding to a target binding site such as BINDING SITE I, BINDING SITE II or BINDING SITE III of FIG. 8. Table 4 illustrates the complementarity of the nucleotide sequences of FCN2 BINDING SITE, designated SEQ ID:12186, to the nucleotide sequence of GAM7957 RNA, herein designated GAM RNA, also designated SEQ ID:297.

Another function of GAM7957 is therefore inhibition of Ficolin (collagen/fibrinogen domain containing lectin) 2 (hucolin) (FCN2, Accession NP_056654.1), a gene which is involved in phagocytosis of pathogens. Accordingly, utilities of GAM7957 include diagnosis, prevention and treatment of diseases and clinical conditions associated with FCN2.

The function of FCN2 and its association with various diseases and clinical conditions, has been established by previous studies, as described hereinabove with reference to GAM223.1. Fibroblast growth factor 2 (basic) (FGF2, Accession NP_001997.3) is another GAM7957 target gene, herein designated TARGET GENE. FGF2 BINDING SITE is a target binding site found in the 3' untranslated region of mRNA encoded by FGF2, corresponding to a target binding site such as BINDING SITE I, BINDING SITE II or BINDING SITE III of FIG. 8. Table 4 illustrates the complementarity of the nucleotide sequences of FGF2 BINDING SITE, designated SEQ ID:15312, to the nucleotide sequence of GAM7957 RNA, herein designated GAM RNA, also designated SEQ ID:297.

Another function of GAM7957 is therefore inhibition of Fibroblast growth factor 2 (basic) (FGF2, Accession NP_001997.3), a gene which the Basic fibroblast growth factor 2; is mitogenic, angiogenic, and neurotrophic factor. Accordingly, utilities of GAM7957 include diagnosis, prevention and treatment of diseases and clinical conditions associated with FGF2.

The function of FGF2 and its association with various diseases and clinical conditions, has been established by previous studies, as described hereinabove with reference to GAM36.1. Fibroblast growth factor receptor 1 (fms-related tyrosine kinase 2, pfeiffer syndrome) (FGFR1, Accession NP_075595.1) is another GAM7957 target gene, herein designated TARGET GENE. FGFR1 BINDING SITE is a target binding site found in the 3' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:16118, to the nucleotide sequence of GAM7957 RNA, herein designated GAM RNA, also designated SEQ ID:297.

Another function of GAM7957 is therefore inhibition of Fibroblast growth factor receptor 1 (fms-related tyrosine kinase 2, pfeiffer syndrome) (FGFR1, Accession NP_075595.1). Accordingly, utilities of GAM7957 include diagnosis, prevention and treatment of diseases and clinical conditions associated with FGFR1.

Fibroblast growth factor receptor 1 (fms-related tyrosine kinase 2, pfeiffer syndrome) (FGFR1, Accession NP_075596.1) is another GAM7957 target gene, herein designated TARGET GENE. FGFR1 BINDING SITE is a target binding site found in the 3' untranslated region of multiple transcripts of mRNA encoded by FGFR1, corresponding to a target binding site such as BINDING SITE I, BINDING SITE II or BINDING SITE III of FIG. 8. Table 4 illustrates the complementarity of the nucleotide sequences of FGFR1 BINDING SITE, designated SEQ ID:16118, to the nucleotide sequence of GAM7957 RNA, herein designated GAM RNA, also designated SEQ ID:297.

Another function of GAM7957 is therefore inhibition of Fibroblast growth factor receptor 1 (fms-related tyrosine kinase 2, pfeiffer syndrome) (FGFR1, Accession NP_075596.1). Accordingly, utilities of GAM7957 include diagnosis, prevention and treatment of diseases and clinical conditions associated with FGFR1.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075263.1) is another GAM7957 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:5528, to the nucleotide sequence of GAM7957 RNA, herein designated GAM RNA, also designated SEQ ID:297.

Another function of GAM7957 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075263.1). Accordingly, utilities of GAM7957 include diagnosis, prevention and treatment of diseases and clinical conditions associated with FGFR2.

Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075262.1) is another GAM7957 target gene, herein designated TARGET GENE. FGFR2 BINDING SITE is a target binding site found in the 3' untranslated region of multiple transcripts of mRNA encoded by FGFR2, corresponding to a target binding site such as BINDING SITE I, BINDING SITE II or BINDING SITE III of FIG. 8. Table 4 illustrates the complementarity of the nucleotide sequences of FGFR2 BINDING SITE, designated SEQ ID:5528, to the nucleotide sequence of GAM7957 RNA, herein designated GAM RNA, also designated SEQ ID:297.

Another function of GAM7957 is therefore inhibition of Fibroblast growth factor receptor 2 (bacteria-expressed kinase, keratinocyte growth factor receptor, craniofacial dysostosis 1, crouzon syndrome, pfeiffer syndrome, jackson-weiss syndrome) (FGFR2, Accession NP_075262.1). Accordingly, utilities of GAM7957 include diagnosis, prevention and treatment of diseases and clinical conditions associated with FGFR2.

Fibroblast growth factor receptor-like 1 (FGFRL1, Accession NP_068742.1) is another GAM7957 target gene, herein designated TARGET GENE. FGFRL1 BINDING SITE is a target binding site found in the 3' untranslated region of mRNA encoded by FGFRL1, corresponding to a target binding site such as BINDING SITE I, BINDING SITE II or BINDING SITE III of FIG. 8. Table 4 illustrates the complementarity of the nucleotide sequences of FGFRL1 BINDING SITE, designated SEQ ID:19614, to the nucleotide sequence of GAM7957 RNA, herein designated GAM RNA, also designated SEQ ID:297.

Another function of GAM7957 is therefore inhibition of Fibroblast growth factor receptor-like 1 (FGFRL1, Accession NP_068742.1). Accordingly, utilities of GAM7957 include diagnosis, prevention and treatment of diseases and clinical conditions associated with FGFRL1.

Fk506 binding protein 14, 22 kda (FKBP14, Accession NP_060416.1) is another GAM7957 target gene, herein designated TARGET GENE. FKBP14 BINDING SITE1 and FKBP14 BINDING SITE2 are target binding sites found in untranslated regions of mRNA encoded by FKBP14, corresponding to target binding sites such as BINDING SITE I, BINDING SITE II or BINDING SITE III of FIG. 8. Table 4 illustrates the complementarity of the nucleotide sequences of FKBP14 BINDING SITE1 and FKBP14 BINDING SITE2, designated SEQ ID:19054 and SEQ ID:6269 respectively, to the nucleotide sequence of GAM7957 RNA, herein designated GAM RNA, also designated SEQ ID:297.

Another function of GAM7957 is therefore inhibition of Fk506 binding protein 14, 22 kda (FKBP14, Accession NP_060416.1). Accordingly, utilities of GAM7957 include diagnosis, prevention and treatment of diseases and clinical conditions associated with FKBP14.

FKSG17 (Accession NP_114420.1) is another GAM7957 target gene, herein designated TARGET GENE. FKSG17 BINDING SITE is a target binding site found in the 3' untranslated region of mRNA encoded by FKSG17, corresponding to a target binding site such as BINDING SITE I, BINDING SITE II or BINDING SITE III of FIG. 8. Table 4 illustrates the complementarity of the nucleotide sequences of FKSG17 BINDING SITE, designated SEQ ID:9322, to the nucleotide sequence of GAM7957 RNA, herein designated GAM RNA, also designated SEQ ID:297.

Another function of GAM7957 is therefore inhibition of FKSG17 (Accession NP_114420.1). Accordingly, utilities of GAM7957 include diagnosis, prevention and treatment of diseases and clinical conditions associated with FKSG17.

FLJ00060 (Accession XP_028154.1) is another GAM7957 target gene, herein designated TARGET GENE. FLJ00060 BINDING SITE is a target binding site found in the 3' untranslated region of mRNA encoded by FLJ00060, corresponding to a target binding site such as BINDING SITE I, BINDING SITE II or BINDING SITE III of FIG. 8. Table 4 illustrates the complementarity of the nucleotide sequences of FLJ00060 BINDING SITE, designated SEQ ID:11462, to the nucleotide sequence of GAM7957 RNA, herein designated GAM RNA, also designated SEQ ID:297.

Another function of GAM7957 is therefore inhibition of FLJ00060 (Accession XP_028154.1). Accordingly, utilities of GAM7957 include diagnosis, prevention and treatment of diseases and clinical conditions associated with FLJ00060.

FLJ00225 (Accession XP_084552.3) is another GAM7957 target gene, herein designated TARGET GENE. FLJ00225 BINDING SITE is a target binding site found in the 3' untranslated region of mRNA encoded by FLJ00225, corresponding to a target binding site such as BINDING SITE I, BINDING SITE II or BINDING SITE III of FIG. 8. Table 4 illustrates the complementarity of the nucleotide sequences of FLJ00225 BINDING SITE, designated SEQ ID:8941, to the nucleotide sequence of GAM7957 RNA, herein designated GAM RNA, also designated SEQ ID:297.

Another function of GAM7957 is therefore inhibition of FLJ00225 (Accession XP_084552.3). Accordingly, utilities of GAM7957 include diagnosis, prevention and treatment of diseases and clinical conditions associated with FLJ00225.

FLJ10058 (Accession NP_060455.1) is another GAM7957 target gene, herein designated TARGET GENE. FLJ10058 BINDING SITE is a target binding site found in the 3' untranslated region of mRNA encoded by FLJ10058, corresponding to a target binding site such as BINDING SITE I, BINDING SITE II or BINDING SITE III of FIG. 8. Table 4 illustrates the complementarity of the nucleotide sequences of FLJ10058 BINDING SITE, designated SEQ ID:6015, to the nucleotide sequence of GAM7957 RNA, herein designated GAM RNA, also designated SEQ ID:297.

Another function of GAM7957 is therefore inhibition of FLJ10058 (Accession NP_060455.1). Accordingly, utilities of GAM7957 include diagnosis, prevention and treatment of diseases and clinical conditions associated with FLJ10058.

FLJ10120 (Accession NP_060471.1) is another GAM7957 target gene, herein designated TARGET GENE. FLJ10120 BINDING SITE is a target binding site found in the 3' untranslated region of mRNA encoded by FLJ10120, corresponding to a target binding site such as BINDING SITE I, BINDING SITE II or BINDING SITE III of FIG. 8. Table 4 illustrates the complementarity of the nucleotide sequences of FLJ10120 BINDING SITE, designated SEQ ID:5141, to the nucleotide sequence of GAM7957 RNA, herein designated GAM RNA, also designated SEQ ID:297.

Another function of GAM7957 is therefore inhibition of FLJ10120 (Accession NP_060471.1). Accordingly, utilities of GAM7957 include diagnosis, prevention and treatment of diseases and clinical conditions associated with FLJ10120.

FLJ10139 (Accession NP_060475.1) is another GAM7957 target gene, herein designated TARGET GENE. FLJ10139 BINDING SITE is a target binding site found in the 3' untranslated region of mRNA encoded by FLJ10139, corresponding to a target binding site such as BINDING SITE I, BINDING SITE II or BINDING SITE III of FIG. 8. Table 4 illustrates the complementarity of the nucleotide sequences of FLJ10139 BINDING SITE, designated SEQ ID:17277, to the nucleotide sequence of GAM7957 RNA, herein designated GAM RNA, also designated SEQ ID:297.

Another function of GAM7957 is therefore inhibition of FLJ10139 (Accession NP_060475.1). Accordingly, utilities of GAM7957 include diagnosis, prevention and treatment of diseases and clinical conditions associated with FLJ10139.

FLJ10244 (Accession NP_060507.1) is another GAM7957 target gene, herein designated TARGET GENE. FLJ10244 BINDING SITE is a target binding site found in the 3' untranslated region of mRNA encoded by FLJ10244, corresponding to a target binding site such as BINDING SITE I, BINDING SITE II or BINDING SITE III of FIG. 8. Table 4 illustrates the complementarity of the nucleotide sequences of FLJ10244 BINDING SITE, designated SEQ ID:11741, to the nucleotide sequence of GAM7957 RNA, herein designated GAM RNA, also designated SEQ ID:297.

Another function of GAM7957 is therefore inhibition of FLJ10244 (Accession NP_060507.1). Accordingly, utilities of GAM7957 include diagnosis, prevention and treatment of diseases and clinical conditions associated with FLJ10244.

FLJ10300 (Accession NP_060521.2) is another GAM7957 target gene, herein designated TARGET GENE. FLJ10300 BINDING SITE is a target binding site found in the 5' untranslated region of mRNA encoded by FLJ10300, corresponding to a target binding site such as BINDING SITE I, BINDING SITE II or BINDING SITE III of FIG. 8. Table 4 illustrates the complementarity of the nucleotide sequences of FLJ10300 BINDING SITE, designated SEQ ID:2126, to the nucleotide sequence of GAM7957 RNA, herein designated GAM RNA, also designated SEQ ID:297.

Another function of GAM7957 is therefore inhibition of FLJ10300 (Accession NP_060521.2). Accordingly, utilities of GAM7957 include diagnosis, prevention and treatment of diseases and clinical conditions associated with FLJ10300.

FLJ10357 (Accession NP_060541.2) is another GAM7957 target gene, herein designated TARGET GENE. FLJ10357 BINDING SITE is a target binding site found in the 5' untranslated region of mRNA encoded by FLJ10357, corresponding to a target binding site such as BINDING SITE I, BINDING SITE II or BINDING SITE III of FIG. 8. Table 4 illustrates the complementarity of the nucleotide sequences of FLJ10357 BINDING SITE, designated SEQ ID:5754, to the nucleotide sequence of GAM7957 RNA, herein designated GAM RNA, also designated SEQ ID:297.

Another function of GAM7957 is therefore inhibition of FLJ10357 (Accession NP_060541.2). Accordingly, utilities of GAM7957 include diagnosis, prevention and treatment of diseases and clinical conditions associated with FLJ10357.

FLJ10460 (Accession NP_060567.1) is another GAM7957 target gene, herein designated TARGET GENE. FLJ10460 BINDING SITE is a target binding site found in the 3' untranslated region of mRNA encoded by FLJ10460, corresponding to a target binding site such as BINDING SITE I, BINDING SITE II or BINDING SITE III of FIG. 8. Table 4 illustrates the complementarity of the nucleotide sequences of FLJ10460 BINDING SITE, designated SEQ ID:3325, to the nucleotide sequence of GAM7957 RNA, herein designated GAM RNA, also designated SEQ ID:297.

Another function of GAM7957 is therefore inhibition of FLJ10460 (Accession NP_060567.1). Accordingly, utilities of GAM7957 include diagnosis, prevention and treatment of diseases and clinical conditions associated with FLJ10460.

FLJ10520 (Accession NP_060594.2) is another GAM7957 target gene, herein designated TARGET GENE. FLJ10520 BINDING SITE is a target binding site found in the 3' untranslated region of mRNA encoded by FLJ10520, corresponding to a target binding site such as BINDING SITE I, BINDING SITE II or BINDING SITE III of FIG. 8. Table 4 illustrates the complementarity of the nucleotide sequences of FLJ10520 BINDING SITE, designated SEQ ID:2838, to the nucleotide sequence of GAM7957 RNA, herein designated GAM RNA, also designated SEQ ID:297.

Another function of GAM7957 is therefore inhibition of FLJ10520 (Accession NP_060594.2). Accordingly, utilities of GAM7957 include diagnosis, prevention and treatment of diseases and clinical conditions associated with FLJ10520.

FLJ10534 (Accession NP_060598.2) is another GAM7957 target gene, herein designated TARGET GENE. FLJ10534 BINDING SITE is a target binding site found in the 3' untranslated region of mRNA encoded by FLJ10534, corresponding to a target binding site such as BINDING SITE I, BINDING SITE II or BINDING SITE III of FIG. 8. Table 4 illustrates the complementarity of the nucleotide sequences of FLJ10534 BINDING SITE, designated SEQ ID:6240, to the nucleotide sequence of GAM7957 RNA, herein designated GAM RNA, also designated SEQ ID:297.

Another function of GAM7957 is therefore inhibition of FLJ10534 (Accession NP_060598.2). Accordingly, utilities of GAM7957 include diagnosis, prevention and treatment of diseases and clinical conditions associated with FLJ10534.

FLJ10547 (Accession NP_060604.1) is another GAM7957 target gene, herein designated TARGET GENE. FLJ10547 BINDING SITE is a target binding site found in the 3' untranslated region of mRNA encoded by FLJ10547, corresponding to a target binding site such as BINDING SITE I, BINDING SITE II or BINDING SITE III of FIG. 8. Table 4 illustrates the complementarity of the nucleotide sequences of FLJ10547 BINDING SITE, designated SEQ ID:18846, to the nucleotide sequence of GAM7957 RNA, herein designated GAM RNA, also designated SEQ ID:297.

Another function of GAM7957 is therefore inhibition of FLJ10547 (Accession NP_060604.1). Accordingly, utilities of GAM7957 include diagnosis, prevention and treatment of diseases and clinical conditions associated with FLJ10547.

FLJ10781 (Accession NP_060685.1) is another GAM7957 target gene, herein designated TARGET GENE. FLJ10781 BINDING SITE is a target binding site found in the 3' untranslated region of mRNA encoded by FLJ10781, corresponding to a target binding site such as BINDING SITE I, BINDING SITE II or BINDING SITE III of FIG. 8. Table 4 illustrates the complementarity of the nucleotide sequences of FLJ10781 BINDING SITE, designated SEQ ID:909, to the nucleotide sequence of GAM7957 RNA, herein designated GAM RNA, also designated SEQ ID:297.

Another function of GAM7957 is therefore inhibition of FLJ10781 (Accession NP_060685.1). Accordingly, utilities of GAM7957 include diagnosis, prevention and treatment of diseases and clinical conditions associated with FLJ10781.

FLJ10803 (Accession NP_060694.1) is another GAM7957 target gene, herein designated TARGET GENE. FLJ10803 BINDING SITE is a target binding site found in the 3' untranslated region of mRNA encoded by FLJ10803, corresponding to a target binding site such as BINDING SITE I, BINDING SITE II or BINDING SITE III of FIG. 8. Table 4 illustrates the complementarity of the nucleotide sequences of FLJ10803 BINDING SITE, designated SEQ ID:15983, to the nucleotide sequence of GAM7957 RNA, herein designated GAM RNA, also designated SEQ ID:297.

Another function of GAM7957 is therefore inhibition of FLJ10803 (Accession NP_060694.1). Accordingly, utilities of GAM7957 include diagnosis, prevention and treatment of diseases and clinical conditions associated with FLJ10803.

FLJ10826 (Accession NP_060703.1) is another GAM7957 target gene, herein designated TARGET GENE. FLJ10826 BINDING SITE is a target binding site found in the 3' untranslated region of mRNA encoded by FLJ10826, corresponding to a target binding site such as BINDING SITE I, BINDING SITE II or BINDING SITE III of FIG. 8. Table 4 illustrates the complementarity of the nucleotide sequences of FLJ10826 BINDING SITE, designated SEQ ID:19057, to the nucleotide sequence of GAM7957 RNA, herein designated GAM RNA, also designated SEQ ID:297.

Another function of GAM7957 is therefore inhibition of FLJ10826 (Accession NP_060703.1). Accordingly, utilities of GAM7957 include diagnosis, prevention and treatment of diseases and clinical conditions associated with FLJ10826.

FLJ10932 (Accession NP_060747.1) is another GAM7957 target gene, herein designated TARGET GENE. FLJ10932 BINDING SITE is a target binding site found in the 3' untranslated region of mRNA encoded by FLJ10932, corresponding to a target binding site such as BINDING SITE I, BINDING SITE II or BINDING SITE III of FIG. 8. Table 4 illustrates the complementarity of the nucleotide sequences of FLJ10932 BINDING SITE, designated SEQ ID:15224, to the nucleotide sequence of GAM7957 RNA, herein designated GAM RNA, also designated SEQ ID:297.

Another function of GAM7957 is therefore inhibition of FLJ10932 (Accession NP_060747.1). Accordingly, utilities of GAM7957 include diagnosis, prevention and treatment of diseases and clinical conditions associated with FLJ10932.

FLJ10936 (Accession NP_060749.2) is another GAM7957 target gene, herein designated TARGET GENE. FLJ10936 BINDING SITE1 and FLJ10936 BINDING SITE2 are target binding sites found in untranslated regions of mRNA encoded by FLJ10936, corresponding to target binding sites such as BINDING SITE I, BINDING SITE II or BINDING SITE III of FIG. 8. Table 4 illustrates the complementarity of the nucleotide sequences of FLJ10936 BINDING SITE1 and FLJ10936 BINDING SITE2, designated SEQ ID:1291 and SEQ ID:16966 respectively, to the nucleotide sequence of GAM7957 RNA, herein designated GAM RNA, also designated SEQ ID:297.

Another function of GAM7957 is therefore inhibition of FLJ10936 (Accession NP_060749.2). Accordingly, utilities of GAM7957 include diagnosis, prevention and treatment of diseases and clinical conditions associated with FLJ10936.

FLJ11029 (Accession NP_060774.1) is another GAM7957 target gene, herein designated TARGET GENE. FLJ11029 BINDING SITE1 through FLJ11029 BINDING SITE3 are target binding sites found in untranslated regions of mRNA encoded by FLJ11029, corresponding to target binding sites such as BINDING SITE I, BINDING SITE II or BINDING SITE III of FIG. 8. Table 4 illustrates the complementarity of the nucleotide sequences of FLJ11029 BINDING SITE1 through FLJ11029 BINDING SITE3, designated SEQ ID:18691, SEQ ID:17631 and SEQ ID:8904 respectively, to the nucleotide sequence of GAM7957 RNA, herein designated GAM RNA, also designated SEQ ID:297.

Another function of GAM7957 is therefore inhibition of FLJ11029 (Accession NP_060774.1). Accordingly, utilities of GAM7957 include diagnosis, prevention and treatment of diseases and clinical conditions associated with FLJ11029.

FLJ11036 (Accession NP_060776.2) is another GAM7957 target gene, herein designated TARGET GENE. FLJ11036 BINDING SITE is a target binding site found in the 3' untranslated region of mRNA encoded by FLJ11036, corresponding to a target binding site such as BINDING SITE I, BINDING SITE II or BINDING SITE III of FIG. 8. Table 4 illustrates the complementarity of the nucleotide sequences of FLJ11036 BINDING SITE, designated SEQ ID:7218, to the nucleotide sequence of GAM7957 RNA, herein designated GAM RNA, also designated SEQ ID:297.

Another function of GAM7957 is therefore inhibition of FLJ11036 (Accession NP_060776.2). Accordingly, utilities of GAM7957 include diagnosis, prevention and treatment of diseases and clinical conditions associated with FLJ11036.

FLJ11042 (Accession NP_060778.1) is another GAM7957 target gene, herein designated TARGET GENE. FLJ11042 BINDING SITE is a target binding site found in the 3' untranslated region of mRNA encoded by FLJ11042, corresponding to a target binding site such as BINDING SITE I, BINDING SITE II or BINDING SITE III of FIG. 8. Table 4 illustrates the complementarity of the nucleotide sequences of FLJ11042 BINDING SITE, designated SEQ ID:19379, to the nucleotide sequence of GAM7957 RNA, herein designated GAM RNA, also designated SEQ ID:297.

Another function of GAM7957 is therefore inhibition of FLJ11042 (Accession NP_060778.1). Accordingly, utilities of GAM7957 include diagnosis, prevention and treatment of diseases and clinical conditions associated with FLJ11042.

FLJ11106 (Accession NP_060794.1) is another GAM7957 target gene, herein designated TARGET GENE. FLJ11106 BINDING SITE1 and FLJ11106 BINDING SITE2 are target binding sites found in untranslated regions of mRNA encoded by FLJ11106, corresponding to target binding sites such as BINDING SITE I, BINDING SITE II or BINDING SITE III of FIG. 8. Table 4 illustrates the complementarity of the nucleotide sequences of FLJ11106 BINDING SITE1 and FLJ11106 BINDING SITE2, designated SEQ ID:10375 and SEQ ID:4880 respectively, to the nucleotide sequence of GAM7957 RNA, herein designated GAM RNA, also designated SEQ ID:297.

Another function of GAM7957 is therefore inhibition of FLJ11106 (Accession NP_060794.1). Accordingly, utilities of GAM7957 include diagnosis, prevention and treatment of diseases and clinical conditions associated with FLJ11106.

FLJ11126 (Accession NP_060802.1) is another GAM7957 target gene, herein designated TARGET GENE. FLJ11126 BINDING SITE is a target binding site found in the 3' untranslated region of mRNA encoded by FLJ11126, corresponding to a target binding site such as BINDING SITE I, BINDING SITE II or BINDING SITE III of FIG. 8. Table 4 illustrates the complementarity of the nucleotide sequences of FLJ11126 BINDING SITE, designated SEQ ID:11721, to the nucleotide sequence of GAM7957 RNA, herein designated GAM RNA, also designated SEQ ID:297.

Another function of GAM7957 is therefore inhibition of FLJ11126 (Accession NP_060802.1). Accordingly, utilities of GAM7957 include diagnosis, prevention and treatment of diseases and clinical conditions associated with FLJ11126.

FLJ11151 (Accession NP_060810.1) is another GAM7957 target gene, herein designated TARGET GENE. FLJ11151 BINDING SITE1 and FLJ11151 BINDING SITE2 are target binding sites found in untranslated regions of mRNA encoded by FLJ11151, corresponding to target binding sites such as BINDING SITE I, BINDING SITE II or BINDING SITE III of FIG. 8. Table 4 illustrates the complementarity of the nucleotide sequences of FLJ11151 BINDING SITE1 and FLJ11151 BINDING SITE2, designated SEQ ID:12335 and SEQ ID:3794 respectively, to the nucleotide sequence of GAM7957 RNA, herein designated GAM RNA, also designated SEQ ID:297.

Another function of GAM7957 is therefore inhibition of FLJ11151 (Accession NP_060810.1). Accordingly, utilities of GAM7957 include diagnosis, prevention and treatment of diseases and clinical conditions associated with FLJ11151.

FLJ11259 (Accession NP_060840.1) is another GAM7957 target gene, herein designated TARGET GENE. FLJ11259 BINDING SITE is a target binding site found in the 3' untranslated region of mRNA encoded by FLJ11259, corresponding to a target binding site such as BINDING SITE I, BINDING SITE II or BINDING SITE III of FIG. 8. Table 4 illustrates the complementarity of the nucleotide sequences of FLJ11259 BINDING SITE, designated SEQ ID:18025, to the nucleotide sequence of GAM7957 RNA, herein designated GAM RNA, also designated SEQ ID:297.

Another function of GAM7957 is therefore inhibition of FLJ11259 (Accession NP_060840.1). Accordingly, utilities of GAM7957 include diagnosis, prevention and treatment of diseases and clinical conditions associated with FLJ11259.

FLJ11301 (Accession NP_060855.1) is another GAM7957 target gene, herein designated TARGET GENE. FLJ11301 BINDING SITE1 and FLJ11301 BINDING SITE2 are target binding sites found in untranslated regions of mRNA encoded by FLJ11301, corresponding to target binding sites such as BINDING SITE I, BINDING SITE II or BINDING SITE III of FIG. 8. Table 4 illustrates the complementarity of the nucleotide sequences of FLJ11301 BINDING SITE1 and FLJ11301 BINDING SITE2, designated SEQ ID:1492 and SEQ ID:5229 respectively, to the nucleotide sequence of GAM7957 RNA, herein designated GAM RNA, also designated SEQ ID:297.

Another function of GAM7957 is therefore inhibition of FLJ11301 (Accession NP_060855.1). Accordingly, utilities of GAM7957 include diagnosis, prevention and treatment of diseases and clinical conditions associated with FLJ11301.

FLJ11370 (Accession NP_079237.1) is another GAM7957 target gene, herein designated TARGET GENE. FLJ11370 BINDING SITE is a target binding site found in the 3' untranslated region of mRNA encoded by FLJ11370, corresponding to a target binding site such as BINDING SITE I, BINDING SITE II or BINDING SITE III of FIG. 8. Table 4 illustrates the complementarity of the nucleotide sequences of FLJ11370 BINDING SITE, designated SEQ ID:1492, to the nucleotide sequence of GAM7957 RNA, herein designated GAM RNA, also designated SEQ ID:297.

Another function of GAM7957 is therefore inhibition of FLJ11370 (Accession NP_079237.1). Accordingly, utilities of GAM7957 include diagnosis, prevention and treatment of diseases and clinical conditions associated with FLJ11370.

FLJ11577 (Accession NP_079435.1) is another GAM7957 target gene, herein designated TARGET GENE. FLJ11577 BINDING SITE is a target binding site found in the 3' untranslated region of mRNA encoded by FLJ11577, corresponding to a target binding site such as BINDING SITE I, BINDING SITE II or BINDING SITE III of FIG. 8. Table 4 illustrates the complementarity of the nucleotide sequences of FLJ11577 BINDING SITE, designated SEQ ID:4977, to the nucleotide sequence of GAM7957 RNA, herein designated GAM RNA, also designated SEQ ID:297.

Another function of GAM7957 is therefore inhibition of FLJ11577 (Accession NP_079435.1). Accordingly, utilities of GAM7957 include diagnosis, prevention and treatment of diseases and clinical conditions associated with FLJ11577.

FLJ11700 (Accession NP_079168.1) is another GAM7957 target gene, herein designated TARGET GENE. FLJ11700 BINDING SITE is a target binding site found in the 3' untranslated region of mRNA encoded by FLJ11700, corresponding to a target binding site such as BINDING SITE I, BINDING SITE II or BINDING SITE III of FIG. 8. Table 4 illustrates the complementarity of the nucleotide sequences of FLJ11700 BINDING SITE, designated SEQ ID:8533, to the nucleotide sequence of GAM7957 RNA, herein designated GAM RNA, also designated SEQ ID:297.

Another function of GAM7957 is therefore inhibition of FLJ11700 (Accession NP_079168.1). Accordingly, utilities of GAM7957 include diagnosis, prevention and treatment of diseases and clinical conditions associated with FLJ11700.

FLJ11710 (Accession NP_079122.1) is another GAM7957 target gene, herein designated TARGET GENE. FLJ11710 BINDING SITE is a target binding site found in the 5' untranslated region of mRNA encoded by FLJ11710, corresponding to a target binding site such as BINDING SITE I, BINDING SITE II or BINDING SITE III of FIG. 8. Table 4 illustrates the complementarity of the nucleotide sequences of FLJ11710 BINDING SITE, designated SEQ ID:12055, to the nucleotide sequence of GAM7957 RNA, herein designated GAM RNA, also designated SEQ ID:297.

Another function of GAM7957 is therefore inhibition of FLJ11710 (Accession NP_079122.1). Accordingly, utilities of GAM7957 include diagnosis, prevention and treatment of diseases and clinical conditions associated with FLJ11710.

FLJ11715 (Accession NP_078840.1) is another GAM7957 target gene, herein designated TARGET GENE. FLJ11715 BINDING SITE is a target binding site found in the 3' untranslated region of mRNA encoded by FLJ11715, corresponding to a target binding site such as BINDING SITE I, BINDING SITE II or BINDING SITE III of FIG. 8. Table 4 illustrates the complementarity of the nucleotide sequences of FLJ11715 BINDING SITE, designated SEQ ID:16495, to the nucleotide sequence of GAM7957 RNA, herein designated GAM RNA, also designated SEQ ID:297.

Another function of GAM7957 is therefore inhibition of FLJ11715 (Accession NP_078840.1). Accordingly, utilities of GAM7957 include diagnosis, prevention and treatment of diseases and clinical conditions associated with FLJ11715.

FLJ11722 (Accession NP_079246.1) is another GAM7957 target gene, herein designated TARGET GENE. FLJ11722 BINDING SITE is a target binding site found in the 3' untranslated region of mRNA encoded by FLJ11722, corresponding to a target binding site such as BINDING SITE I, BINDING SITE II or BINDING SITE III of FIG. 8. Table 4 illustrates the complementarity of the nucleotide sequences of FLJ11722 BINDING SITE, designated SEQ ID:8840, to the nucleotide sequence of GAM7957 RNA, herein designated GAM RNA, also designated SEQ ID:297.

Another function of GAM7957 is therefore inhibition of FLJ11722 (Accession NP_079246.1). Accordingly, utilities of GAM7957 include diagnosis, prevention and treatment of diseases and clinical conditions associated with FLJ11722.

FLJ11800 (Accession NP_079250.1) is another GAM7957 target gene, herein designated TARGET GENE. FLJ11800 BINDING SITE is a target binding site found in the 3' untranslated region of mRNA encoded by FLJ11800, corresponding to a target binding site such as BINDING SITE I, BINDING SITE II or BINDING SITE III of FIG. 8. Table 4 illustrates the complementarity of the nucleotide sequences of FLJ11800 BINDING SITE, designated SEQ ID:10310, to the nucleotide sequence of GAM7957 RNA, herein designated GAM RNA, also designated SEQ ID:297.

Another function of GAM7957 is therefore inhibition of FLJ11800 (Accession NP_079250.1). Accordingly, utilities of GAM7957 include diagnosis, prevention and treatment of diseases and clinical conditions associated with FLJ11800.

FLJ11996 (Accession NP_079252.1) is another GAM7957 target gene, herein designated TARGET GENE. FLJ11996 BINDING SITE1 and FLJ11996 BINDING SITE2 are target binding sites found in untranslated regions of mRNA encoded by FLJ11996, corresponding to target binding sites such as BINDING SITE I, BINDING SITE II or BINDING SITE III of FIG. 8. Table 4 illustrates the complementarity of the nucleotide sequences of FLJ11996 BINDING SITE1 and FLJ11996 BINDING SITE2, designated SEQ ID:3322 and SEQ ID:12331 respectively, to the nucleotide sequence of GAM7957 RNA, herein designated GAM RNA, also designated SEQ ID:297.

Another function of GAM7957 is therefore inhibition of FLJ11996 (Accession NP_079252.1). Accordingly, utilities of GAM7957 include diagnosis, prevention and treatment of diseases and clinical conditions associated with FLJ11996.

FLJ12056 (Accession NP_079209.1) is another GAM7957 target gene, herein designated TARGET GENE. FLJ12056 BINDING SITE1 and FLJ12056 BINDING SITE2 are target binding sites found in untranslated regions of mRNA encoded by FLJ12056, corresponding to target binding sites such as BINDING SITE I, BINDING SITE II or BINDING SITE III of FIG. 8. Table 4 illustrates the complementarity of the nucleotide sequences of FLJ12056 BINDING SITE1 and FLJ12056 BINDING SITE2, designated SEQ ID:12398 and SEQ ID:5828 respectively, to the nucleotide sequence of GAM7957 RNA, herein designated GAM RNA, also designated SEQ ID:297.

Another function of GAM7957 is therefore inhibition of FLJ12056 (Accession NP_079209.1). Accordingly, utilities of GAM7957 include diagnosis, prevention and treatment of diseases and clinical conditions associated with FLJ12056.

FLJ12078 (Accession NP_079253.1) is another GAM7957 target gene, herein designated TARGET GENE. FLJ12078 BINDING SITE1 and FLJ12078 BINDING SITE2 are target binding sites found in untranslated regions of mRNA encoded by FLJ12078, corresponding to target binding sites such as BINDING SITE I, BINDING SITE II or BINDING SITE III of FIG. 8. Table 4 illustrates the complementarity of the nucleotide sequences of FLJ12078 BINDING SITE1 and FLJ12078 BINDING SITE2, designated SEQ ID:13066 and SEQ ID:8723 respectively, to the nucleotide sequence of GAM7957 RNA, herein designated GAM RNA, also designated SEQ ID:297.

Another function of GAM7957 is therefore inhibition of FLJ12078 (Accession NP_079253.1). Accordingly, utilities of GAM7957 include diagnosis, prevention and treatment of diseases and clinical conditions associated with FLJ12078.

FLJ12190 (Accession NP_079347.1) is another GAM7957 target gene, herein designated TARGET GENE. FLJ12190 BINDING SITE is a target binding site found in the 3' untranslated region of mRNA encoded by FLJ12190, corresponding to a target binding site such as BINDING SITE I, BINDING SITE II or BINDING SITE III of FIG. 8. Table 4 illustrates the complementarity of the nucleotide sequences of FLJ12190 BINDING SITE, designated SEQ ID:10438, to the nucleotide sequence of GAM7957 RNA, herein designated GAM RNA, also designated SEQ ID:297.

Another function of GAM7957 is therefore inhibition of FLJ12190 (Accession NP_079347.1). Accordingly, utilities of GAM7957 include diagnosis, prevention and treatment of diseases and clinical conditions associated with FLJ12190.

FLJ12298 (Accession NP_115540.1) is another GAM7957 target gene, herein designated TARGET GENE. FLJ12298 BINDING SITE is a target binding site found in the 3' untranslated region of mRNA encoded by FLJ12298, corresponding to a target binding site such as BINDING SITE I, BINDING SITE II or BINDING SITE III of FIG. 8. Table 4 illustrates the complementarity of the nucleotide sequences of FLJ12298 BINDING SITE, designated SEQ ID:6415, to the nucleotide sequence of GAM7957 RNA, herein designated GAM RNA, also designated SEQ ID:297.

Another function of GAM7957 is therefore inhibition of FLJ12298 (Accession NP_115540.1). Accordingly, utilities of GAM7957 include diagnosis, prevention and treatment of diseases and clinical conditions associated with FLJ12298.

FLJ12303 (Accession NP_115541.1) is another GAM7957 target gene, herein designated TARGET GENE. FLJ12303 BINDING SITE1 and FLJ12303 BINDING SITE2 are target binding sites found in untranslated regions of mRNA encoded by FLJ12303, corresponding to target binding sites such as BINDING SITE I, BINDING SITE II or BINDING SITE III of FIG. 8. Table 4 illustrates the complementarity of the nucleotide sequences of FLJ12303 BINDING SITE1 and FLJ12303 BINDING SITE2, designated SEQ ID:16879 and SEQ ID:16943 respectively, to the nucleotide sequence of GAM7957 RNA, herein designated GAM RNA, also designated SEQ ID:297.

Another function of GAM7957 is therefore inhibition of FLJ12303 (Accession NP_115541.1). Accordingly, utilities of GAM7957 include diagnosis, prevention and treatment of diseases and clinical conditions associated with FLJ12303.

FLJ12331 (Accession NP_079262.1) is another GAM7957 target gene, herein designated TARGET GENE. FLJ12331 BINDING SITE is a target binding site found in the 3' untranslated region of mRNA encoded by FLJ12331, corresponding to a target binding site such as BINDING SITE I, BINDING SITE II or BINDING SITE III of FIG. 8. Table 4 illustrates the complementarity of the nucleotide sequences of FLJ12331 BINDING SITE, designated SEQ ID:10982, to the nucleotide sequence of GAM7957 RNA, herein designated GAM RNA, also designated SEQ ID:297.

Another function of GAM7957 is therefore inhibition of FLJ12331 (Accession NP_079262.1). Accordingly, utilities of GAM7957 include diagnosis, prevention and treatment of diseases and clinical conditions associated with FLJ12331.

FLJ12448 (Accession NP_075046.1) is another GAM7957 target gene, herein designated TARGET GENE. FLJ12448 BINDING SITE is a target binding site found in the 3' untranslated region of mRNA encoded by FLJ12448, corresponding to a target binding site such as BINDING SITE I, BINDING SITE II or BINDING SITE III of FIG. 8. Table 4 illustrates the complementarity of the nucleotide sequences of FLJ12448 BINDING SITE, designated SEQ ID:13668, to the nucleotide sequence of GAM7957 RNA, herein designated GAM RNA, also designated SEQ ID:297.

Another function of GAM7957 is therefore inhibition of FLJ12448 (Accession NP_075046.1). Accordingly, utilities of GAM7957 include diagnosis, prevention and treatment of diseases and clinical conditions associated with FLJ12448.

FLJ12484 (Accession NP_073604.2) is another GAM7957 target gene, herein designated TARGET GENE. FLJ12484 BINDING SITE is a target binding site found in the 3' untranslated region of mRNA encoded by FLJ12484, corresponding to a target binding site such as BINDING SITE I, BINDING SITE II or BINDING SITE III of FIG. 8. Table 4 illustrates the complementarity of the nucleotide sequences of FLJ12484 BINDING SITE, designated SEQ ID:2963, to the nucleotide sequence of GAM7957 RNA, herein designated GAM RNA, also designated SEQ ID:297.

Another function of GAM7957 is therefore inhibition of FLJ12484 (Accession NP_073604.2). Accordingly, utilities of GAM7957 include diagnosis, prevention and treatment of diseases and clinical conditions associated with FLJ12484.

FLJ12586 (Accession NP_078896.2) is another GAM7957 target gene, herein designated TARGET GENE. FLJ12586 BINDING SITE is a target binding site found in the 3' untranslated region of mRNA encoded by FLJ12586, corresponding to a target binding site such as BINDING SITE I, BINDING SITE II or BINDING SITE III of FIG. 8. Table 4 illustrates the complementarity of the nucleotide sequences of FLJ12586 BINDING SITE, designated SEQ ID:1908, to the nucleotide sequence of GAM7957 RNA, herein designated GAM RNA, also designated SEQ ID:297.

Another function of GAM7957 is therefore inhibition of FLJ12586 (Accession NP_078896.2). Accordingly, utilities of GAM7957 include diagnosis, prevention and treatment of diseases and clinical conditions associated with FLJ12586.

FLJ12606 (Accession NP_079080.1) is another GAM7957 target gene, herein designated TARGET GENE. FLJ12606 BINDING SITE is a target binding site found in the 3' untranslated region of mRNA encoded by FLJ12606, corresponding to a target binding site such as BINDING SITE I, BINDING SITE II or BINDING SITE III of FIG. 8. Table 4 illustrates the complementarity of the nucleotide sequences of FLJ12606 BINDING SITE, designated SEQ ID:5039, to the nucleotide sequence of GAM7957 RNA, herein designated GAM RNA, also designated SEQ ID:297.

Another function of GAM7957 is therefore inhibition of FLJ12606 (Accession NP_079080.1). Accordingly, utilities of GAM7957 include diagnosis, prevention and treatment of diseases and clinical conditions associated with FLJ12606.

FLJ12618 (Accession NP_079160.1) is another GAM7957 target gene, herein designated TARGET GENE. FLJ12618 BINDING SITE is a target binding site found in the 3' untranslated region of mRNA encoded by FLJ12618, corresponding to a target binding site such as BINDING SITE I, BINDING SITE II or BINDING SITE III of FIG. 8. Table 4 illustrates the complementarity of the nucleotide sequences of FLJ12618 BINDING SITE, designated SEQ ID:17753, to the nucleotide sequence of GAM7957 RNA, herein designated GAM RNA, also designated SEQ ID:297.

Another function of GAM7957 is therefore inhibition of FLJ12618 (Accession NP_079160.1). Accordingly, utilities of GAM7957 include diagnosis, prevention and treatment of diseases and clinical conditions associated with FLJ12618.

FLJ12660 (Accession NP_079428.1) is another GAM7957 target gene, herein designated TARGET GENE. FLJ12660 BINDING SITE1 and FLJ12660 BINDING SITE2 are target binding sites found in untranslated regions of mRNA encoded by FLJ12660, corresponding to target binding sites such as BINDING SITE I, BINDING SITE II or BINDING SITE III of FIG. 8. Table 4 illustrates the complementarity of the nucleotide sequences of FLJ12660 BINDING SITE1 and FLJ12660 BINDING SITE2, designated SEQ ID:7966 and SEQ ID:8107 respectively, to the nucleotide sequence of GAM7957 RNA, herein designated GAM RNA, also designated SEQ ID:297.

Another function of GAM7957 is therefore inhibition of FLJ12660 (Accession NP_079428.1). Accordingly, utilities of GAM7957 include diagnosis, prevention and treatment of diseases and clinical conditions associated with FLJ12660.

FLJ12666 (Accession NP_078871.1) is another GAM7957 target gene, herein designated TARGET GENE. FLJ12666 BINDING SITE is a target binding site found in the 3' untranslated region of mRNA encoded by FLJ12666, corresponding to a target binding site such as BINDING SITE I, BINDING SITE II or BINDING SITE III of FIG. 8. Table 4 illustrates the complementarity of the nucleotide sequences of FLJ12666 BINDING SITE, designated SEQ ID:19695, to the nucleotide sequence of GAM7957 RNA, herein designated GAM RNA, also designated SEQ ID:297.

Another function of GAM7957 is therefore inhibition of FLJ12666 (Accession NP_078871.1). Accordingly, utilities of GAM7957 include diagnosis, prevention and treatment of diseases and clinical conditions associated with FLJ12666.

FLJ12671 (Accession NP_112242.1) is another GAM7957 target gene, herein designated TARGET GENE. FLJ12671 BINDING SITE is a target binding site found in the 3' untranslated region of mRNA encoded by FLJ12671, corresponding to a target binding site such as BINDING SITE I, BINDING SITE II or BINDING SITE III of FIG. 8. Table 4 illustrates the complementarity of the nucleotide sequences of FLJ12671 BINDING SITE, designated SEQ ID:14567, to the nucleotide sequence of GAM7957 RNA, herein designated GAM RNA, also designated SEQ ID:297.

Another function of GAM7957 is therefore inhibition of FLJ12671 (Accession NP_112242.1). Accordingly, utilities of GAM7957 include diagnosis, prevention and treatment of diseases and clinical conditions associated with FLJ12671.

FLJ12687 (Accession NP_079193.2) is another GAM7957 target gene, herein designated TARGET GENE. FLJ12687 BINDING SITE1 and FLJ12687 BINDING SITE2 are target binding sites found in untranslated regions of mRNA encoded by FLJ12687, corresponding to target binding sites such as BINDING SITE I, BINDING SITE II or BINDING SITE III of FIG. 8. Table 4 illustrates the complementarity of the nucleotide sequences of FLJ12687 BINDING SITE1 and FLJ12687 BINDING SITE2, designated SEQ ID:6150 and SEQ ID:13584 respectively, to the nucleotide sequence of GAM7957 RNA, herein designated GAM RNA, also designated SEQ ID:297.

Another function of GAM7957 is therefore inhibition of FLJ12687 (Accession NP_079193.2). Accordingly, utilities of GAM7957 include diagnosis, prevention and treatment of diseases and clinical conditions associated with FLJ12687.

FLJ12800 (Accession NP_075054.1) is another GAM7957 target gene, herein designated TARGET GENE. FLJ12800 BINDING SITE is a target binding site found in the 3' untranslated region of mRNA encoded by FLJ12800, corresponding to a target binding site such as BINDING SITE I, BINDING SITE II or BINDING SITE III of FIG. 8. Table 4 illustrates the complementarity of the nucleotide sequences of FLJ12800 BINDING SITE, designated SEQ ID:1400, to the nucleotide sequence of GAM7957 RNA, herein designated GAM RNA, also designated SEQ ID:297.

Another function of GAM7957 is therefore inhibition of FLJ12800 (Accession NP_075054.1). Accordingly, utilities of GAM7957 include diagnosis, prevention and treatment of diseases and clinical conditions associated with FLJ12800.

FLJ12921 (Accession NP_079151.1) is another GAM7957 target gene, herein designated TARGET GENE. FLJ12921 BINDING SITE1 and FLJ12921 BINDING SITE2 are target binding sites found in untranslated regions of mRNA encoded by FLJ12921, corresponding to target binding sites such as BINDING SITE I, BINDING SITE II or BINDING SITE III of FIG. 8. Table 4 illustrates the complementarity of the nucleotide sequences of FLJ12921 BINDING SITE1 and FLJ12921 BINDING SITE2, designated SEQ ID:15316 and SEQ ID:15108 respectively, to the nucleotide sequence of GAM7957 RNA, herein designated GAM RNA, also designated SEQ ID:297.

Another function of GAM7957 is therefore inhibition of FLJ12921 (Accession NP_079151.1). Accordingly, utilities of GAM7957 include diagnosis, prevention and treatment of diseases and clinical conditions associated with FLJ12921.

FLJ12986 (Accession XP_290685.1) is another GAM7957 target gene, herein designated TARGET GENE. FLJ12986 BINDING SITE is a target binding site found in the 3' untranslated region of mRNA encoded by FLJ12986, corresponding to a target binding site such as BINDING SITE I, BINDING SITE II or BINDING SITE III of FIG. 8. Table 4 illustrates the complementarity of the nucleotide sequences of FLJ12986 BINDING SITE, designated SEQ ID:6600, to the nucleotide sequence of GAM7957 RNA, herein designated GAM RNA, also designated SEQ ID:297.

Another function of GAM7957 is therefore inhibition of FLJ12986 (Accession XP__290685.1). Accordingly, utilities of GAM7957 include diagnosis, prevention and treatment of diseases and clinical conditions associated with FLJ12986.

FLJ13154 (Accession NP__078874.1) is another GAM7957 target gene, herein designated TARGET GENE. FLJ13154 BINDING SITE is a target binding site found in the 5' untranslated region of mRNA encoded by FLJ13154, corresponding to a target binding site such as BINDING SITE I, BINDING SITE II or BINDING SITE III of FIG. 8. Table 4 illustrates the complementarity of the nucleotide sequences of FLJ13154 BINDING SITE, designated SEQ ID:13134, to the nucleotide sequence of GAM7957 RNA, herein designated GAM RNA, also designated SEQ ID:297.

Another function of GAM7957 is therefore inhibition of FLJ13154 (Accession NP__078874.1). Accordingly, utilities of GAM7957 include diagnosis, prevention and treatment of diseases and clinical conditions associated with FLJ13154.

FLJ13162 (Accession NP__079278.1) is another GAM7957 target gene, herein designated TARGET GENE. FLJ13162 BINDING SITE is a target binding site found in the 3' untranslated region of mRNA encoded by FLJ13162, corresponding to a target binding site such as BINDING SITE I, BINDING SITE II or BINDING SITE III of FIG. 8. Table 4 illustrates the complementarity of the nucleotide sequences of FLJ13162 BINDING SITE, designated SEQ ID:19052, to the nucleotide sequence of GAM7957 RNA, herein designated GAM RNA, also designated SEQ ID:297.

Another function of GAM7957 is therefore inhibition of FLJ13162 (Accession NP__079278.1). Accordingly, utilities of GAM7957 include diagnosis, prevention and treatment of diseases and clinical conditions associated with FLJ13162.

FLJ13171 (Accession NP__076412.1) is another GAM7957 target gene, herein designated TARGET GENE. FLJ13171 BINDING SITE is a target binding site found in the 3' untranslated region of mRNA encoded by FLJ13171, corresponding to a target binding site such as BINDING SITE I, BINDING SITE II or BINDING SITE III of FIG. 8. Table 4 illustrates the complementarity of the nucleotide sequences of FLJ13171 BINDING SITE, designated SEQ ID:9763, to the nucleotide sequence of GAM7957 RNA, herein designated GAM RNA, also designated SEQ ID:297.

Another function of GAM7957 is therefore inhibition of FLJ13171 (Accession NP__076412.1). Accordingly, utilities of GAM7957 include diagnosis, prevention and treatment of diseases and clinical conditions associated with FLJ13171.

FLJ13236 (Accession NP__079178.2) is another GAM7957 target gene, herein designated TARGET GENE. FLJ13236 BINDING SITE is a target binding site found in the 3' untranslated region of mRNA encoded by FLJ13236, corresponding to a target binding site such as BINDING SITE I, BINDING SITE II or BINDING SITE III of FIG. 8. Table 4 illustrates the complementarity of the nucleotide sequences of FLJ13236 BINDING SITE, designated SEQ ID:6757, to the nucleotide sequence of GAM7957 RNA, herein designated GAM RNA, also designated SEQ ID:297.

Another function of GAM7957 is therefore inhibition of FLJ13236 (Accession NP__079178.2). Accordingly, utilities of GAM7957 include diagnosis, prevention and treatment of diseases and clinical conditions associated with FLJ13236.

FLJ13241 (Accession NP__079364.1) is another GAM7957 target gene, herein designated TARGET GENE. FLJ13241 BINDING SITE is a target binding site found in the 3' untranslated region of mRNA encoded by FLJ13241, corresponding to a target binding site such as BINDING SITE I, BINDING SITE II or BINDING SITE III of FIG. 8. Table 4 illustrates the complementarity of the nucleotide sequences of FLJ13241 BINDING SITE, designated SEQ ID:9173, to the nucleotide sequence of GAM7957 RNA, herein designated GAM RNA, also designated SEQ ID:297.

Another function of GAM7957 is therefore inhibition of FLJ13241 (Accession NP__079364.1). Accordingly, utilities of GAM7957 include diagnosis, prevention and treatment of diseases and clinical conditions associated with FLJ13241.

FLJ13305 (Accession XP__291019.1) is another GAM7957 target gene, herein designated TARGET GENE. FLJ13305 BINDING SITE1 and FLJ13305 BINDING SITE2 are target binding sites found in untranslated regions of mRNA encoded by FLJ13305, corresponding to target binding sites such as BINDING SITE I, BINDING SITE II or BINDING SITE III of FIG. 8. Table 4 illustrates the complementarity of the nucleotide sequences of FLJ13305 BINDING SITE1 and FLJ13305 BINDING SITE2, designated SEQ ID:8647 and SEQ ID:7048 respectively, to the nucleotide sequence of GAM7957 RNA, herein designated GAM RNA, also designated SEQ ID:297.

Another function of GAM7957 is therefore inhibition of FLJ13305 (Accession XP__291019.1). Accordingly, utilities of GAM7957 include diagnosis, prevention and treatment of diseases and clinical conditions associated with FLJ13305.

FLJ13448 (Accession NP__079423.1) is another GAM7957 target gene, herein designated TARGET GENE. FLJ13448 BINDING SITE is a target binding site found in the 3' untranslated region of mRNA encoded by FLJ13448, corresponding to a target binding site such as BINDING SITE I, BINDING SITE II or BINDING SITE III of FIG. 8. Table 4 illustrates the complementarity of the nucleotide sequences of FLJ13448 BINDING SITE, designated SEQ ID:17453, to the nucleotide sequence of GAM7957 RNA, herein designated GAM RNA, also designated SEQ ID:297.

Another function of GAM7957 is therefore inhibition of FLJ13448 (Accession NP__079423.1). Accordingly, utilities of GAM7957 include diagnosis, prevention and treatment of diseases and clinical conditions associated with FLJ13448.

FLJ13456 (Accession XP__038291.5) is another GAM7957 target gene, herein designated TARGET GENE. FLJ13456 BINDING SITE is a target binding site found in the 3' untranslated region of mRNA encoded by FLJ13456, corresponding to a target binding site such as BINDING SITE I, BINDING SITE II or BINDING SITE III of FIG. 8. Table 4 illustrates the complementarity of the nucleotide sequences of FLJ13456 BINDING SITE, designated SEQ ID:8296, to the nucleotide sequence of GAM7957 RNA, herein designated GAM RNA, also designated SEQ ID:297.

Another function of GAM7957 is therefore inhibition of FLJ13456 (Accession XP__038291.5). Accordingly, utilities of GAM7957 include diagnosis, prevention and treatment of diseases and clinical conditions associated with FLJ13456.

FLJ13544 (Accession NP__079284.1) is another GAM7957 target gene, herein designated TARGET GENE. FLJ13544 BINDING SITE is a target binding site found in the 3' untranslated region of mRNA encoded by FLJ13544, corresponding to a target binding site such as BINDING SITE I, BINDING SITE II or BINDING SITE III of FIG. 8. Table 4 illustrates the complementarity of the nucleotide sequences of FLJ13544 BINDING SITE, designated SEQ ID:16514, to the nucleotide sequence of GAM7957 RNA, herein designated GAM RNA, also designated SEQ ID:297.

Another function of GAM7957 is therefore inhibition of FLJ13544 (Accession NP__079284.1). Accordingly, utilities of GAM7957 include diagnosis, prevention and treatment of diseases and clinical conditions associated with FLJ13544.

FLJ13611 (Accession NP__079217.1) is another GAM7957 target gene, herein designated TARGET GENE.

FLJ13611 BINDING SITE is a target binding site found in the 3' untranslated region of mRNA encoded by FLJ13611, corresponding to a target binding site such as BINDING SITE I, BINDING SITE II or BINDING SITE III of FIG. 8. Table 4 illustrates the complementarity of the nucleotide sequences of FLJ13611 BINDING SITE, designated SEQ ID:12723, to the nucleotide sequence of GAM7957 RNA, herein designated GAM RNA, also designated SEQ ID:297.

Another function of GAM7957 is therefore inhibition of FLJ13611 (Accession NP_079217.1). Accordingly, utilities of GAM7957 include diagnosis, prevention and treatment of diseases and clinical conditions associated with FLJ13611.

FLJ13621 (Accession NP_079285.1) is another GAM7957 target gene, herein designated TARGET GENE. FLJ13621 BINDING SITE is a target binding site found in the 3' untranslated region of mRNA encoded by FLJ13621, corresponding to a target binding site such as BINDING SITE I, BINDING SITE II or BINDING SITE III of FIG. 8. Table 4 illustrates the complementarity of the nucleotide sequences of FLJ13621 BINDING SITE, designated SEQ ID:15343, to the nucleotide sequence of GAM7957 RNA, herein designated GAM RNA, also designated SEQ ID:297.

Another function of GAM7957 is therefore inhibition of FLJ13621 (Accession NP_079285.1). Accordingly, utilities of GAM7957 include diagnosis, prevention and treatment of diseases and clinical conditions associated with FLJ13621.

FLJ13769 (Accession NP_079288.1) is another GAM7957 target gene, herein designated TARGET GENE. FLJ13769 BINDING SITE1 and FLJ13769 BINDING SITE2 are target binding sites found in untranslated regions of mRNA encoded by FLJ13769, corresponding to target binding sites such as BINDING SITE I, BINDING SITE II or BINDING SITE III of FIG. 8. Table 4 illustrates the complementarity of the nucleotide sequences of FLJ13769 BINDING SITE1 and FLJ13769 BINDING SITE2, designated SEQ ID:15089 and SEQ ID:19422 respectively, to the nucleotide sequence of GAM7957 RNA, herein designated GAM RNA, also designated SEQ ID:297.

Another function of GAM7957 is therefore inhibition of FLJ13769 (Accession NP_079288.1). Accordingly, utilities of GAM7957 include diagnosis, prevention and treatment of diseases and clinical conditions associated with FLJ13769.

FLJ13984 (Accession NP_079046.1) is another GAM7957 target gene, herein designated TARGET GENE. FLJ13984 BINDING SITE is a target binding site found in the 3' untranslated region of mRNA encoded by FLJ13984, corresponding to a target binding site such as BINDING SITE I, BINDING SITE II or BINDING SITE III of FIG. 8. Table 4 illustrates the complementarity of the nucleotide sequences of FLJ13984 BINDING SITE, designated SEQ ID:7450, to the nucleotide sequence of GAM7957 RNA, herein designated GAM RNA, also designated SEQ ID:297.

Another function of GAM7957 is therefore inhibition of FLJ13984 (Accession NP_079046.1). Accordingly, utilities of GAM7957 include diagnosis, prevention and treatment of diseases and clinical conditions associated with FLJ13984.

FLJ14069 (Accession NP_079299.1) is another GAM7957 target gene, herein designated TARGET GENE. FLJ14069 BINDING SITE is a target binding site found in the 3' untranslated region of mRNA encoded by FLJ14069, corresponding to a target binding site such as BINDING SITE I, BINDING SITE II or BINDING SITE III of FIG. 8. Table 4 illustrates the complementarity of the nucleotide sequences of FLJ14069 BINDING SITE, designated SEQ ID:19033, to the nucleotide sequence of GAM7957 RNA, herein designated GAM RNA, also designated SEQ ID:297.

Another function of GAM7957 is therefore inhibition of FLJ14069 (Accession NP_079299.1). Accordingly, utilities of GAM7957 include diagnosis, prevention and treatment of diseases and clinical conditions associated with FLJ14069.

FLJ14100 (Accession NP_079301.1) is another GAM7957 target gene, herein designated TARGET GENE. FLJ14100 BINDING SITE1 and FLJ14100 BINDING SITE2 are target binding sites found in untranslated regions of mRNA encoded by FLJ14100, corresponding to target binding sites such as BINDING SITE I, BINDING SITE II or BINDING SITE III of FIG. 8. Table 4 illustrates the complementarity of the nucleotide sequences of FLJ14100 BINDING SITE1 and FLJ14100 BINDING SITE2, designated SEQ ID:4880 and SEQ ID:4061 respectively, to the nucleotide sequence of GAM7957 RNA, herein designated GAM RNA, also designated SEQ ID:297.

Another function of GAM7957 is therefore inhibition of FLJ14100 (Accession NP_079301.1). Accordingly, utilities of GAM7957 include diagnosis, prevention and treatment of diseases and clinical conditions associated with FLJ14100.

FLJ14117 (Accession NP_073614.1) is another GAM7957 target gene, herein designated TARGET GENE. FLJ14117 BINDING SITE1 through FLJ14117 BINDING SITE3 are target binding sites found in untranslated regions of mRNA encoded by FLJ14117, corresponding to target binding sites such as BINDING SITE I, BINDING SITE II or BINDING SITE III of FIG. 8. Table 4 illustrates the complementarity of the nucleotide sequences of FLJ14117 BINDING SITE1 through FLJ14117 BINDING SITE3, designated SEQ ID:7796, SEQ ID:4313 and SEQ ID:10125 respectively, to the nucleotide sequence of GAM7957 RNA, herein designated GAM RNA, also designated SEQ ID:297.

Another function of GAM7957 is therefore inhibition of FLJ14117 (Accession NP_073614.1). Accordingly, utilities of GAM7957 include diagnosis, prevention and treatment of diseases and clinical conditions associated with FLJ14117.

FLJ14129 (Accession NP_112157.1) is another GAM7957 target gene, herein designated TARGET GENE. FLJ14129 BINDING SITE is a target binding site found in the 3' untranslated region of mRNA encoded by FLJ14129, corresponding to a target binding site such as BINDING SITE I, BINDING SITE II or BINDING SITE III of FIG. 8. Table 4 illustrates the complementarity of the nucleotide sequences of FLJ14129 BINDING SITE, designated SEQ ID:10918, to the nucleotide sequence of GAM7957 RNA, herein designated GAM RNA, also designated SEQ ID:297.

Another function of GAM7957 is therefore inhibition of FLJ14129 (Accession NP_112157.1). Accordingly, utilities of GAM7957 include diagnosis, prevention and treatment of diseases and clinical conditions associated with FLJ14129.

FLJ14327 (Accession NP_079188.1) is another GAM7957 target gene, herein designated TARGET GENE. FLJ14327 BINDING SITE1 and FLJ14327 BINDING SITE2 are target binding sites found in untranslated regions of mRNA encoded by FLJ14327, corresponding to target binding sites such as BINDING SITE I, BINDING SITE II or BINDING SITE III of FIG. 8. Table 4 illustrates the complementarity of the nucleotide sequences of FLJ14327 BINDING SITE1 and FLJ14327 BINDING SITE2, designated SEQ ID:17423 and SEQ ID:13517 respectively, to the nucleotide sequence of GAM7957 RNA, herein designated GAM RNA, also designated SEQ ID:297.

Another function of GAM7957 is therefore inhibition of FLJ14327 (Accession NP_079188.1). Accordingly, utilities of GAM7957 include diagnosis, prevention and treatment of diseases and clinical conditions associated with FLJ14327.

FLJ14345 (Accession NP_079009.1) is another GAM7957 target gene, herein designated TARGET GENE. FLJ14345 BINDING SITE1 and FLJ14345 BINDING SITE2 are target binding sites found in untranslated regions of mRNA encoded by FLJ14345, corresponding to target binding sites such as BINDING SITE I, BINDING SITE II or BINDING SITE III of FIG. 8. Table 4 illustrates the complementarity of the nucleotide sequences of FLJ14345 BINDING SITE1 and FLJ14345 BINDING SITE2, designated SEQ ID:14502 and SEQ ID:1492 respectively, to the nucleotide sequence of GAM7957 RNA, herein designated GAM RNA, also designated SEQ ID:297.

Another function of GAM7957 is therefore inhibition of FLJ14345 (Accession NP_079009.1). Accordingly, utilities of GAM7957 include diagnosis, prevention and treatment of diseases and clinical conditions associated with FLJ14345.

FLJ14397 (Accession NP_116168.2) is another GAM7957 target gene, herein designated TARGET GENE. FLJ14397 BINDING SITE1 and FLJ14397 BINDING SITE2 are target binding sites found in untranslated regions of mRNA encoded by FLJ14397, corresponding to target binding sites such as BINDING SITE I, BINDING SITE II or BINDING SITE III of FIG. 8. Table 4 illustrates the complementarity of the nucleotide sequences of FLJ14397 BINDING SITE1 and FLJ14397 BINDING SITE2, designated SEQ ID:15345 and SEQ ID:4880 respectively, to the nucleotide sequence of GAM7957 RNA, herein designated GAM RNA, also designated SEQ ID:297.

Another function of GAM7957 is therefore inhibition of FLJ14397 (Accession NP_116168.2). Accordingly, utilities of GAM7957 include diagnosis, prevention and treatment of diseases and clinical conditions associated with FLJ14397.

FLJ14457 (Accession NP_116177.1) is another GAM7957 target gene, herein designated TARGET GENE. FLJ14457 BINDING SITE is a target binding site found in the 3' untranslated region of mRNA encoded by FLJ14457, corresponding to a target binding site such as BINDING SITE I, BINDING SITE II or BINDING SITE III of FIG. 8. Table 4 illustrates the complementarity of the nucleotide sequences of FLJ14457 BINDING SITE, designated SEQ ID:18269, to the nucleotide sequence of GAM7957 RNA, herein designated GAM RNA, also designated SEQ ID:297.

Another function of GAM7957 is therefore inhibition of FLJ14457 (Accession NP_116177.1). Accordingly, utilities of GAM7957 include diagnosis, prevention and treatment of diseases and clinical conditions associated with FLJ14457.

FLJ14466 (Accession NP_116179.1) is another GAM7957 target gene, herein designated TARGET GENE. FLJ14466 BINDING SITE1 through FLJ14466 BINDING SITE3 are target binding sites found in untranslated regions of mRNA encoded by FLJ14466, corresponding to target binding sites such as BINDING SITE I, BINDING SITE II or BINDING SITE III of FIG. 8. Table 4 illustrates the complementarity of the nucleotide sequences of FLJ14466 BINDING SITE1 through FLJ14466 BINDING SITE3, designated SEQ ID:14789, SEQ ID:5830 and SEQ ID:16279 respectively, to the nucleotide sequence of GAM7957 RNA, herein designated GAM RNA, also designated SEQ ID:297.

Another function of GAM7957 is therefore inhibition of FLJ14466 (Accession NP_116179.1). Accordingly, utilities of GAM7957 include diagnosis, prevention and treatment of diseases and clinical conditions associated with FLJ14466.

FLJ14490 (Accession NP_116182.1) is another GAM7957 target gene, herein designated TARGET GENE. FLJ14490 BINDING SITE is a target binding site found in the 3' untranslated region of mRNA encoded by FLJ14490, corresponding to a target binding site such as BINDING SITE I, BINDING SITE II or BINDING SITE III of FIG. 8. Table 4 illustrates the complementarity of the nucleotide sequences of FLJ14490 BINDING SITE, designated SEQ ID:10571, to the nucleotide sequence of GAM7957 RNA, herein designated GAM RNA, also designated SEQ ID:297.

Another function of GAM7957 is therefore inhibition of FLJ14490 (Accession NP_116182.1). Accordingly, utilities of GAM7957 include diagnosis, prevention and treatment of diseases and clinical conditions associated with FLJ14490.

FLJ14642 (Accession NP_116207.1) is another GAM7957 target gene, herein designated TARGET GENE. FLJ14642 BINDING SITE is a target binding site found in the 3' untranslated region of mRNA encoded by FLJ14642, corresponding to a target binding site such as BINDING SITE I, BINDING SITE II or BINDING SITE III of FIG. 8. Table 4 illustrates the complementarity of the nucleotide sequences of FLJ14642 BINDING SITE, designated SEQ ID:16502, to the nucleotide sequence of GAM7957 RNA, herein designated GAM RNA, also designated SEQ ID:297.

Another function of GAM7957 is therefore inhibition of FLJ14642 (Accession NP_116207.1). Accordingly, utilities of GAM7957 include diagnosis, prevention and treatment of diseases and clinical conditions associated with FLJ14642.

FLJ20006 (Accession NP_060088.1) is another GAM7957 target gene, herein designated TARGET GENE. FLJ20006 BINDING SITE1 and FLJ20006 BINDING SITE2 are target binding sites found in untranslated regions of mRNA encoded by FLJ20006, corresponding to target binding sites such as BINDING SITE I, BINDING SITE II or BINDING SITE III of FIG. 8. Table 4 illustrates the complementarity of the nucleotide sequences of FLJ20006 BINDING SITE1 and FLJ20006 BINDING SITE2, designated SEQ ID:14201 and SEQ ID:6217 respectively, to the nucleotide sequence of GAM7957 RNA, herein designated GAM RNA, also designated SEQ ID:297.

Another function of GAM7957 is therefore inhibition of FLJ20006 (Accession NP_060088.1). Accordingly, utilities of GAM7957 include diagnosis, prevention and treatment of diseases and clinical conditions associated with FLJ20006.

FLJ20013 (Accession NP_060091.1) is another GAM7957 target gene, herein designated TARGET GENE. FLJ20013 BINDING SITE is a target binding site found in the 3' untranslated region of mRNA encoded by FLJ20013, corresponding to a target binding site such as BINDING SITE I, BINDING SITE II or BINDING SITE III of FIG. 8. Table 4 illustrates the complementarity of the nucleotide sequences of FLJ20013 BINDING SITE, designated SEQ ID:14786, to the nucleotide sequence of GAM7957 RNA, herein designated GAM RNA, also designated SEQ ID:297.

Another function of GAM7957 is therefore inhibition of FLJ20013 (Accession NP_060091.1). Accordingly, utilities of GAM7957 include diagnosis, prevention and treatment of diseases and clinical conditions associated with FLJ20013.

FLJ20019 (Accession NP_060094.1) is another GAM7957 target gene, herein designated TARGET GENE. FLJ20019 BINDING SITE is a target binding site found in the 3' untranslated region of mRNA encoded by FLJ20019, corresponding to a target binding site such as BINDING SITE I, BINDING SITE II or BINDING SITE III of FIG. 8. Table 4 illustrates the complementarity of the nucleotide sequences of FLJ20019 BINDING SITE, designated SEQ ID:10518, to the nucleotide sequence of GAM7957 RNA, herein designated GAM RNA, also designated SEQ ID:297.

Another function of GAM7957 is therefore inhibition of FLJ20019 (Accession NP_060094.1). Accordingly, utilities of GAM7957 include diagnosis, prevention and treatment of diseases and clinical conditions associated with FLJ20019.

FLJ20045 (Accession NP_060108.1) is another GAM7957 target gene, herein designated TARGET GENE. FLJ20045 BINDING SITE is a target binding site found in the 3' untranslated region of mRNA encoded by FLJ20045, corresponding to a target binding site such as BINDING SITE I, BINDING SITE II or BINDING SITE III of FIG. 8. Table 4 illustrates the complementarity of the nucleotide sequences of FLJ20045 BINDING SITE, designated SEQ ID:13209, to the nucleotide sequence of GAM7957 RNA, herein designated GAM RNA, also designated SEQ ID:297.

Another function of GAM7957 is therefore inhibition of FLJ20045 (Accession NP_060108.1). Accordingly, utilities of GAM7957 include diagnosis, prevention and treatment of diseases and clinical conditions associated with FLJ20045.

FLJ20069 (Accession NP_060121.3) is another GAM7957 target gene, herein designated TARGET GENE. FLJ20069 BINDING SITE is a target binding site found in the 3' untranslated region of mRNA encoded by FLJ20069, corresponding to a target binding site such as BINDING SITE I, BINDING SITE II or BINDING SITE III of FIG. 8. Table 4 illustrates the complementarity of the nucleotide sequences of FLJ20069 BINDING SITE, designated SEQ ID:17194, to the nucleotide sequence of GAM7957 RNA, herein designated GAM RNA, also designated SEQ ID:297.

Another function of GAM7957 is therefore inhibition of FLJ20069 (Accession NP_060121.3). Accordingly, utilities of GAM7957 include diagnosis, prevention and treatment of diseases and clinical conditions associated with FLJ20069.

FLJ20139 (Accession NP_060155.1) is another GAM7957 target gene, herein designated TARGET GENE. FLJ20139 BINDING SITE is a target binding site found in the 3' untranslated region of mRNA encoded by FLJ20139, corresponding to a target binding site such as BINDING SITE I, BINDING SITE II or BINDING SITE III of FIG. 8. Table 4 illustrates the complementarity of the nucleotide sequences of FLJ20139 BINDING SITE, designated SEQ ID:12593, to the nucleotide sequence of GAM7957 RNA, herein designated GAM RNA, also designated SEQ ID:297.

Another function of GAM7957 is therefore inhibition of FLJ20139 (Accession NP_060155.1). Accordingly, utilities of GAM7957 include diagnosis, prevention and treatment of diseases and clinical conditions associated with FLJ20139.

FLJ20151 (Accession NP_060159.1) is another GAM7957 target gene, herein designated TARGET GENE. FLJ20151 BINDING SITE is a target binding site found in the 3' untranslated region of mRNA encoded by FLJ20151, corresponding to a target binding site such as BINDING SITE I, BINDING SITE II or BINDING SITE III of FIG. 8. Table 4 illustrates the complementarity of the nucleotide sequences of FLJ20151 BINDING SITE, designated SEQ ID:17280, to the nucleotide sequence of GAM7957 RNA, herein designated GAM RNA, also designated SEQ ID:297.

Another function of GAM7957 is therefore inhibition of FLJ20151 (Accession NP_060159.1). Accordingly, utilities of GAM7957 include diagnosis, prevention and treatment of diseases and clinical conditions associated with FLJ20151.

FLJ20152 (Accession NP_061873.2) is another GAM7957 target gene, herein designated TARGET GENE. FLJ20152 BINDING SITE is a target binding site found in the 5' untranslated region of mRNA encoded by FLJ20152, corresponding to a target binding site such as BINDING SITE I, BINDING SITE II or BINDING SITE III of FIG. 8. Table 4 illustrates the complementarity of the nucleotide sequences of FLJ20152 BINDING SITE, designated SEQ ID:17311, to the nucleotide sequence of GAM7957 RNA, herein designated GAM RNA, also designated SEQ ID:297.

Another function of GAM7957 is therefore inhibition of FLJ20152 (Accession NP_061873.2). Accordingly, utilities of GAM7957 include diagnosis, prevention and treatment of diseases and clinical conditions associated with FLJ20152.

FLJ20203 (Accession NP_115668.2) is another GAM7957 target gene, herein designated TARGET GENE. FLJ20203 BINDING SITE1 and FLJ20203 BINDING SITE2 are target binding sites found in untranslated regions of multiple transcripts of mRNA encoded by FLJ20203, corresponding to target binding sites such as BINDING SITE I, BINDING SITE II or BINDING SITE III of FIG. 8. Table 4 illustrates the complementarity of the nucleotide sequences of FLJ20203 BINDING SITE1 and FLJ20203 BINDING SITE2, designated SEQ ID:15426 and SEQ ID:3492 respectively, to the nucleotide sequence of GAM7957 RNA, herein designated GAM RNA, also designated SEQ ID:297.

Another function of GAM7957 is therefore inhibition of FLJ20203 (Accession NP_115668.2). Accordingly, utilities of GAM7957 include diagnosis, prevention and treatment of diseases and clinical conditions associated with FLJ20203.

FLJ20211 (Accession NP_060183.1) is another GAM7957 target gene, herein designated TARGET GENE. FLJ20211 BINDING SITE is a target binding site found in the 3' untranslated region of mRNA encoded by FLJ20211, corresponding to a target binding site such as BINDING SITE I, BINDING SITE II or BINDING SITE III of FIG. 8. Table 4 illustrates the complementarity of the nucleotide sequences of FLJ20211 BINDING SITE, designated SEQ ID:13691, to the nucleotide sequence of GAM7957 RNA, herein designated GAM RNA, also designated SEQ ID:297.

Another function of GAM7957 is therefore inhibition of FLJ20211 (Accession NP_060183.1). Accordingly, utilities of GAM7957 include diagnosis, prevention and treatment of diseases and clinical conditions associated with FLJ20211.

FLJ20257 (Accession NP_062552.1) is another GAM7957 target gene, herein designated TARGET GENE. FLJ20257 BINDING SITE is a target binding site found in the 3' untranslated region of mRNA encoded by FLJ20257, corresponding to a target binding site such as BINDING SITE I, BINDING SITE II or BINDING SITE III of FIG. 8. Table 4 illustrates the complementarity of the nucleotide sequences of FLJ20257 BINDING SITE, designated SEQ ID:17007, to the nucleotide sequence of GAM7957 RNA, herein designated GAM RNA, also designated SEQ ID:297.

Another function of GAM7957 is therefore inhibition of FLJ20257 (Accession NP_062552.1). Accordingly, utilities of GAM7957 include diagnosis, prevention and treatment of diseases and clinical conditions associated with FLJ20257.

FLJ20280 (Accession NP_060211.1) is another GAM7957 target gene, herein designated TARGET GENE. FLJ20280 BINDING SITE is a target binding site found in the 3' untranslated region of mRNA encoded by FLJ20280, corresponding to a target binding site such as BINDING SITE I, BINDING SITE II or BINDING SITE III of FIG. 8. Table 4 illustrates the complementarity of the nucleotide sequences of FLJ20280 BINDING SITE, designated SEQ ID:12403, to the nucleotide sequence of GAM7957 RNA, herein designated GAM RNA, also designated SEQ ID:297.

Another function of GAM7957 is therefore inhibition of FLJ20280 (Accession NP_060211.1). Accordingly, utilities of GAM7957 include diagnosis, prevention and treatment of diseases and clinical conditions associated with FLJ20280.

FLJ20306 (Accession NP_060226.1) is another GAM7957 target gene, herein designated TARGET GENE. FLJ20306 BINDING SITE1 and FLJ20306 BINDING SITE2 are target binding sites found in untranslated regions of mRNA encoded by FLJ20306, corresponding to target binding sites such as BINDING SITE I, BINDING SITE II or BINDING SITE III of FIG. 8. Table 4 illustrates the complementarity of the nucleotide sequences of FLJ20306 BINDING SITE1 and FLJ20306 BINDING SITE2, designated SEQ ID:3975 and SEQ ID:15330 respectively, to the nucleotide sequence of GAM7957 RNA, herein designated GAM RNA, also designated SEQ ID:297.

Another function of GAM7957 is therefore inhibition of FLJ20306 (Accession NP_060226.1). Accordingly, utilities of GAM7957 include diagnosis, prevention and treatment of diseases and clinical conditions associated with FLJ20306.

FLJ20337 (Accession NP_060242.1) is another GAM7957 target gene, herein designated TARGET GENE. FLJ20337 BINDING SITE is a target binding site found in the 3' untranslated region of mRNA encoded by FLJ20337, corresponding to a target binding site such as BINDING SITE I, BINDING SITE II or BINDING SITE III of FIG. 8. Table 4 illustrates the complementarity of the nucleotide sequences of FLJ20337 BINDING SITE, designated SEQ ID:4177, to the nucleotide sequence of GAM7957 RNA, herein designated GAM RNA, also designated SEQ ID:297.

Another function of GAM7957 is therefore inhibition of FLJ20337 (Accession NP_060242.1). Accordingly, utilities of GAM7957 include diagnosis, prevention and treatment of diseases and clinical conditions associated with FLJ20337.

FLJ20413 (Accession NP_060278.1) is another GAM7957 target gene, herein designated TARGET GENE. FLJ20413 BINDING SITE1 and FLJ20413 BINDING SITE2 are target binding sites found in untranslated regions of mRNA encoded by FLJ20413, corresponding to target binding sites such as BINDING SITE I, BINDING SITE II or BINDING SITE III of FIG. 8. Table 4 illustrates the complementarity of the nucleotide sequences of FLJ20413 BINDING SITE1 and FLJ20413 BINDING SITE2, designated SEQ ID:10318 and SEQ ID:13155 respectively, to the nucleotide sequence of GAM7957 RNA, herein designated GAM RNA, also designated SEQ ID:297.

Another function of GAM7957 is therefore inhibition of FLJ20413 (Accession NP_060278.1). Accordingly, utilities of GAM7957 include diagnosis, prevention and treatment of diseases and clinical conditions associated with FLJ20413.

FLJ20452 (Accession NP_060298.2) is another GAM7957 target gene, herein designated TARGET GENE. FLJ20452 BINDING SITE is a target binding site found in the 3' untranslated region of mRNA encoded by FLJ20452, corresponding to a target binding site such as BINDING SITE I, BINDING SITE II or BINDING SITE III of FIG. 8. Table 4 illustrates the complementarity of the nucleotide sequences of FLJ20452 BINDING SITE, designated SEQ ID:11133, to the nucleotide sequence of GAM7957 RNA, herein designated GAM RNA, also designated SEQ ID:297.

Another function of GAM7957 is therefore inhibition of FLJ20452 (Accession NP_060298.2). Accordingly, utilities of GAM7957 include diagnosis, prevention and treatment of diseases and clinical conditions associated with FLJ20452.

FLJ20464 (Accession NP_060304.1) is another GAM7957 target gene, herein designated TARGET GENE. FLJ20464 BINDING SITE1 and FLJ20464 BINDING SITE2 are target binding sites found in untranslated regions of mRNA encoded by FLJ20464, corresponding to target binding sites such as BINDING SITE I, BINDING SITE II or BINDING SITE III of FIG. 8. Table 4 illustrates the complementarity of the nucleotide sequences of FLJ20464 BINDING SITE1 and FLJ20464 BINDING SITE2, designated SEQ ID:16904 and SEQ ID:15056 respectively, to the nucleotide sequence of GAM7957 RNA, herein designated GAM RNA, also designated SEQ ID:297.

Another function of GAM7957 is therefore inhibition of FLJ20464 (Accession NP_060304.1). Accordingly, utilities of GAM7957 include diagnosis, prevention and treatment of diseases and clinical conditions associated with FLJ20464.

FLJ20531 (Accession NP_060335.2) is another GAM7957 target gene, herein designated TARGET GENE. FLJ20531 BINDING SITE is a target binding site found in the 5' untranslated region of mRNA encoded by FLJ20531, corresponding to a target binding site such as BINDING SITE I, BINDING SITE II or BINDING SITE III of FIG. 8. Table 4 illustrates the complementarity of the nucleotide sequences of FLJ20531 BINDING SITE, designated SEQ ID:7783, to the nucleotide sequence of GAM7957 RNA, herein designated GAM RNA, also designated SEQ ID:297.

Another function of GAM7957 is therefore inhibition of FLJ20531 (Accession NP_060335.2). Accordingly, utilities of GAM7957 include diagnosis, prevention and treatment of diseases and clinical conditions associated with FLJ20531.

FLJ20671 (Accession NP_060394.1) is another GAM7957 target gene, herein designated TARGET GENE. FLJ20671 BINDING SITE is a target binding site found in the 3' untranslated region of mRNA encoded by FLJ20671, corresponding to a target binding site such as BINDING SITE I, BINDING SITE II or BINDING SITE III of FIG. 8. Table 4 illustrates the complementarity of the nucleotide sequences of FLJ20671 BINDING SITE, designated SEQ ID:19100, to the nucleotide sequence of GAM7957 RNA, herein designated GAM RNA, also designated SEQ ID:297.

Another function of GAM7957 is therefore inhibition of FLJ20671 (Accession NP_060394.1). Accordingly, utilities of GAM7957 include diagnosis, prevention and treatment of diseases and clinical conditions associated with FLJ20671.

FLJ20686 (Accession NP_060395.2) is another GAM7957 target gene, herein designated TARGET GENE. FLJ20686 BINDING SITE is a target binding site found in the 3' untranslated region of mRNA encoded by FLJ20686, corresponding to a target binding site such as BINDING SITE I, BINDING SITE II or BINDING SITE III of FIG. 8. Table 4 illustrates the complementarity of the nucleotide sequences of FLJ20686 BINDING SITE, designated SEQ ID:2852, to the nucleotide sequence of GAM7957 RNA, herein designated GAM RNA, also designated SEQ ID:297.

Another function of GAM7957 is therefore inhibition of FLJ20686 (Accession NP_060395.2). Accordingly, utilities of GAM7957 include diagnosis, prevention and treatment of diseases and clinical conditions associated with FLJ20686.

FLJ20694 (Accession NP_060398.1) is another GAM7957 target gene, herein designated TARGET GENE. FLJ20694 BINDING SITE is a target binding site found in the 3' untranslated region of mRNA encoded by FLJ20694, corresponding to a target binding site such as BINDING SITE I, BINDING SITE II or BINDING SITE III of FIG. 8. Table 4 illustrates the complementarity of the nucleotide sequences of FLJ20694 BINDING SITE, designated SEQ ID:17403, to the nucleotide sequence of GAM7957 RNA, herein designated GAM RNA, also designated SEQ ID:297.

Another function of GAM7957 is therefore inhibition of FLJ20694 (Accession NP_060398.1). Accordingly, utilities of GAM7957 include diagnosis, prevention and treatment of diseases and clinical conditions associated with FLJ20694.

FLJ20700 (Accession NP_060402.1) is another GAM7957 target gene, herein designated TARGET GENE. FLJ20700 BINDING SITE is a target binding site found in the 3' untranslated region of mRNA encoded by FLJ20700, corresponding to a target binding site such as BINDING SITE I, BINDING SITE II or BINDING SITE III of FIG. 8. Table 4 illustrates the complementarity of the nucleotide sequences of FLJ20700 BINDING SITE, designated SEQ ID:16856, to the nucleotide sequence of GAM7957 RNA, herein designated GAM RNA, also designated SEQ ID:297.

Another function of GAM7957 is therefore inhibition of FLJ20700 (Accession NP_060402.1). Accordingly, utilities of GAM7957 include diagnosis, prevention and treatment of diseases and clinical conditions associated with FLJ20700.

FLJ20802 (Accession NP_060429.1) is another GAM7957 target gene, herein designated TARGET GENE. FLJ20802 BINDING SITE is a target binding site found in the 3' untranslated region of mRNA encoded by FLJ20802, corresponding to a target binding site such as BINDING SITE I, BINDING SITE II or BINDING SITE III of FIG. 8. Table 4 illustrates the complementarity of the nucleotide sequences of FLJ20802 BINDING SITE, designated SEQ ID:4334, to the nucleotide sequence of GAM7957 RNA, herein designated GAM RNA, also designated SEQ ID:297.

Another function of GAM7957 is therefore inhibition of FLJ20802 (Accession NP_060429.1). Accordingly, utilities of GAM7957 include diagnosis, prevention and treatment of diseases and clinical conditions associated with FLJ20802.

FLJ20825 (Accession NP_060432.1) is another GAM7957 target gene, herein designated TARGET GENE. FLJ20825 BINDING SITE1 through FLJ20825 BINDING SITE5 are target binding sites found in untranslated regions of mRNA encoded by FLJ20825, corresponding to target binding sites such as BINDING SITE I, BINDING SITE II or BINDING SITE III of FIG. 8. Table 4 illustrates the complementarity of the nucleotide sequences of FLJ20825 BINDING SITE1 through FLJ20825 BINDING SITE5, designated SEQ ID:6889, SEQ ID:8889, SEQ ID:6040, SEQ ID:805 and SEQ ID:19263 respectively, to the nucleotide sequence of GAM7957 RNA, herein designated GAM RNA, also designated SEQ ID:297.

Another function of GAM7957 is therefore inhibition of FLJ20825 (Accession NP_060432.1). Accordingly, utilities of GAM7957 include diagnosis, prevention and treatment of diseases and clinical conditions associated with FLJ20825.

FLJ20909 (Accession NP_078969.2) is another GAM7957 target gene, herein designated TARGET GENE. FLJ20909 BINDING SITE is a target binding site found in the 3' untranslated region of mRNA encoded by FLJ20909, corresponding to a target binding site such as BINDING SITE I, BINDING SITE II or BINDING SITE III of FIG. 8. Table 4 illustrates the complementarity of the nucleotide sequences of FLJ20909 BINDING SITE, designated SEQ ID:18412, to the nucleotide sequence of GAM7957 RNA, herein designated GAM RNA, also designated SEQ ID:297.

Another function of GAM7957 is therefore inhibition of FLJ20909 (Accession NP_078969.2). Accordingly, utilities of GAM7957 include diagnosis, prevention and treatment of diseases and clinical conditions associated with FLJ20909.

FLJ20972 (Accession NP_079306.1) is another GAM7957 target gene, herein designated TARGET GENE. FLJ20972 BINDING SITE is a target binding site found in the 3' untranslated region of mRNA encoded by FLJ20972, corresponding to a target binding site such as BINDING SITE I, BINDING SITE II or BINDING SITE III of FIG. 8. Table 4 illustrates the complementarity of the nucleotide sequences of FLJ20972 BINDING SITE, designated SEQ ID:13690, to the nucleotide sequence of GAM7957 RNA, herein designated GAM RNA, also designated SEQ ID:297.

Another function of GAM7957 is therefore inhibition of FLJ20972 (Accession NP_079306.1). Accordingly, utilities of GAM7957 include diagnosis, prevention and treatment of diseases and clinical conditions associated with FLJ20972.

FLJ21135 (Accession NP_079142.1) is another GAM7957 target gene, herein designated TARGET GENE. FLJ21135 BINDING SITE is a target binding site found in the 3' untranslated region of mRNA encoded by FLJ21135, corresponding to a target binding site such as BINDING SITE I, BINDING SITE II or BINDING SITE III of FIG. 8. Table 4 illustrates the complementarity of the nucleotide sequences of FLJ21135 BINDING SITE, designated SEQ ID:14182, to the nucleotide sequence of GAM7957 RNA, herein designated GAM RNA, also designated SEQ ID:297.

Another function of GAM7957 is therefore inhibition of FLJ21135 (Accession NP_079142.1). Accordingly, utilities of GAM7957 include diagnosis, prevention and treatment of diseases and clinical conditions associated with FLJ21135.

FLJ21144 (Accession NP_073611.1) is another GAM7957 target gene, herein designated TARGET GENE. FLJ21144 BINDING SITE is a target binding site found in the 3' untranslated region of mRNA encoded by FLJ21144, corresponding to a target binding site such as BINDING SITE I, BINDING SITE II or BINDING SITE III of FIG. 8. Table 4 illustrates the complementarity of the nucleotide sequences of FLJ21144 BINDING SITE, designated SEQ ID:3619, to the nucleotide sequence of GAM7957 RNA, herein designated GAM RNA, also designated SEQ ID:297.

Another function of GAM7957 is therefore inhibition of FLJ21144 (Accession NP_073611.1). Accordingly, utilities of GAM7957 include diagnosis, prevention and treatment of diseases and clinical conditions associated with FLJ21144.

FLJ21240 (Accession NP_079123.1) is another GAM7957 target gene, herein designated TARGET GENE. FLJ21240 BINDING SITE is a target binding site found in the 3' untranslated region of mRNA encoded by FLJ21240, corresponding to a target binding site such as BINDING SITE I, BINDING SITE II or BINDING SITE III of FIG. 8. Table 4 illustrates the complementarity of the nucleotide sequences of FLJ21240 BINDING SITE, designated SEQ ID:16290, to the nucleotide sequence of GAM7957 RNA, herein designated GAM RNA, also designated SEQ ID:297.

Another function of GAM7957 is therefore inhibition of FLJ21240 (Accession NP_079123.1). Accordingly, utilities of GAM7957 include diagnosis, prevention and treatment of diseases and clinical conditions associated with FLJ21240.

FLJ21603 (Accession NP_079038.1) is another GAM7957 target gene, herein designated TARGET GENE. FLJ21603 BINDING SITE is a target binding site found in the 3' untranslated region of mRNA encoded by FLJ21603, corresponding to a target binding site such as BINDING SITE I, BINDING SITE II or BINDING SITE III of FIG. 8. Table 4 illustrates the complementarity of the nucleotide sequences of FLJ21603 BINDING SITE, designated SEQ ID:13858, to the nucleotide sequence of GAM7957 RNA, herein designated GAM RNA, also designated SEQ ID:297.

Another function of GAM7957 is therefore inhibition of FLJ21603 (Accession NP_079038.1). Accordingly, utilities of GAM7957 include diagnosis, prevention and treatment of diseases and clinical conditions associated with FLJ21603.

FLJ21657 (Accession NP_071928.2) is another GAM7957 target gene, herein designated TARGET GENE. FLJ21657 BINDING SITE is a target binding site found in the 3' untranslated region of mRNA encoded by FLJ21657, corresponding to a target binding site such as BINDING SITE I, BINDING SITE II or BINDING SITE III of FIG. 8. Table 4 illustrates the complementarity of the nucleotide sequences of FLJ21657 BINDING SITE, designated SEQ ID:13061, to the nucleotide sequence of GAM7957 RNA, herein designated GAM RNA, also designated SEQ ID:297.

Another function of GAM7957 is therefore inhibition of FLJ21657 (Accession NP_071928.2). Accordingly, utilities of GAM7957 include diagnosis, prevention and treatment of diseases and clinical conditions associated with FLJ21657.

FLJ21673 (Accession NP_112160.1) is another GAM7957 target gene, herein designated TARGET GENE. FLJ21673 BINDING SITE1 and FLJ21673 BINDING SITE2 are target binding sites found in untranslated regions of mRNA encoded by FLJ21673, corresponding to target binding sites such as BINDING SITE I, BINDING SITE II or BINDING SITE III of FIG. 8. Table 4 illustrates the complementarity of the nucleotide sequences of FLJ21673 BINDING SITE1 and FLJ21673 BINDING SITE2, designated SEQ ID:19796 and SEQ ID:16286 respectively, to the nucleotide sequence of GAM7957 RNA, herein designated GAM RNA, also designated SEQ ID:297.

Another function of GAM7957 is therefore inhibition of FLJ21673 (Accession NP_112160.1). Accordingly, utilities of GAM7957 include diagnosis, prevention and treatment of diseases and clinical conditions associated with FLJ21673.

FLJ21687 (Accession NP_079135.1) is another GAM7957 target gene, herein designated TARGET GENE. FLJ21687 BINDING SITE1 and FLJ21687 BINDING SITE2 are target binding sites found in untranslated regions of mRNA encoded by FLJ21687, corresponding to target binding sites such as BINDING SITE I, BINDING SITE II or BINDING SITE III of FIG. 8. Table 4 illustrates the complementarity of the nucleotide sequences of FLJ21687 BINDING SITE1 and FLJ21687 BINDING SITE2, designated SEQ ID:19018 and SEQ ID:17803 respectively, to the nucleotide sequence of GAM7957 RNA, herein designated GAM RNA, also designated SEQ ID:297.

Another function of GAM7957 is therefore inhibition of FLJ21687 (Accession NP_079135.1). Accordingly, utilities of GAM7957 include diagnosis, prevention and treatment of diseases and clinical conditions associated with FLJ21687.

FLJ21777 (Accession NP_115585.1) is another GAM7957 target gene, herein designated TARGET GENE. FLJ21777 BINDING SITE1 and FLJ21777 BINDING SITE2 are target binding sites found in untranslated regions of mRNA encoded by FLJ21777, corresponding to target binding sites such as BINDING SITE I, BINDING SITE II or BINDING SITE III of FIG. 8. Table 4 illustrates the complementarity of the nucleotide sequences of FLJ21777 BINDING SITE1 and FLJ21777 BINDING SITE2, designated SEQ ID:627 and SEQ ID:11407 respectively, to the nucleotide sequence of GAM7957 RNA, herein designated GAM RNA, also designated SEQ ID:297.

Another function of GAM7957 is therefore inhibition of FLJ21777 (Accession NP_115585.1). Accordingly, utilities of GAM7957 include diagnosis, prevention and treatment of diseases and clinical conditions associated with FLJ21777.

FLJ21870 (Accession NP_075392.1) is another GAM7957 target gene, herein designated TARGET GENE. FLJ21870 BINDING SITE is a target binding site found in the 3' untranslated region of mRNA encoded by FLJ21870, corresponding to a target binding site such as BINDING SITE I, BINDING SITE II or BINDING SITE III of FIG. 8. Table 4 illustrates the complementarity of the nucleotide sequences of FLJ21870 BINDING SITE, designated SEQ ID:6605, to the nucleotide sequence of GAM7957 RNA, herein designated GAM RNA, also designated SEQ ID:297.

Another function of GAM7957 is therefore inhibition of FLJ21870 (Accession NP_075392.1). Accordingly, utilities of GAM7957 include diagnosis, prevention and treatment of diseases and clinical conditions associated with FLJ21870.

FLJ22054 (Accession NP_078837.2) is another GAM7957 target gene, herein designated TARGET GENE. FLJ22054 BINDING SITE is a target binding site found in the 3' untranslated region of mRNA encoded by FLJ22054, corresponding to a target binding site such as BINDING SITE I, BINDING SITE II or BINDING SITE III of FIG. 8. Table 4 illustrates the complementarity of the nucleotide sequences of FLJ22054 BINDING SITE, designated SEQ ID:17423, to the nucleotide sequence of GAM7957 RNA, herein designated GAM RNA, also designated SEQ ID:297.

Another function of GAM7957 is therefore inhibition of FLJ22054 (Accession NP_078837.2). Accordingly, utilities of GAM7957 include diagnosis, prevention and treatment of diseases and clinical conditions associated with FLJ22054.

FLJ22173 (Accession NP_079317.1) is another GAM7957 target gene, herein designated TARGET GENE. FLJ22173 BINDING SITE is a target binding site found in the 5' untranslated region of mRNA encoded by FLJ22173, corresponding to a target binding site such as BINDING SITE I, BINDING SITE II or BINDING SITE III of FIG. 8. Table 4 illustrates the complementarity of the nucleotide sequences of FLJ22173 BINDING SITE, designated SEQ ID:17804, to the nucleotide sequence of GAM7957 RNA, herein designated GAM RNA, also designated SEQ ID:297.

Another function of GAM7957 is therefore inhibition of FLJ22173 (Accession NP_079317.1). Accordingly, utilities of GAM7957 include diagnosis, prevention and treatment of diseases and clinical conditions associated with FLJ22173.

FLJ22313 (Accession NP_071768.2) is another GAM7957 target gene, herein designated TARGET GENE. FLJ22313 BINDING SITE is a target binding site found in the 3' untranslated region of mRNA encoded by FLJ22313, corresponding to a target binding site such as BINDING SITE I, BINDING SITE II or BINDING SITE III of FIG. 8. Table 4 illustrates the complementarity of the nucleotide sequences of FLJ22313 BINDING SITE, designated SEQ ID:14789, to the nucleotide sequence of GAM7957 RNA, herein designated GAM RNA, also designated SEQ ID:297.

Another function of GAM7957 is therefore inhibition of FLJ22313 (Accession NP_071768.2). Accordingly, utilities of GAM7957 include diagnosis, prevention and treatment of diseases and clinical conditions associated with FLJ22313.

FLJ22415 (Accession NP_079045.1) is another GAM7957 target gene, herein designated TARGET GENE. FLJ22415 BINDING SITE is a target binding site found in the 3' untranslated region of mRNA encoded by FLJ22415, corresponding to a target binding site such as BINDING SITE I, BINDING SITE II or BINDING SITE III of FIG. 8. Table 4 illustrates the complementarity of the nucleotide sequences of FLJ22415 BINDING SITE, designated SEQ ID:4373, to the nucleotide sequence of GAM7957 RNA, herein designated GAM RNA, also designated SEQ ID:297.

Another function of GAM7957 is therefore inhibition of FLJ22415 (Accession NP_079045.1). Accordingly, utilities of GAM7957 include diagnosis, prevention and treatment of diseases and clinical conditions associated with FLJ22415.

FLJ22692 (Accession NP_079325.1) is another GAM7957 target gene, herein designated TARGET GENE. FLJ22692 BINDING SITE is a target binding site found in the 3' untranslated region of mRNA encoded by FLJ22692, corresponding to a target binding site such as BINDING SITE I, BINDING SITE II or BINDING SITE III of FIG. 8. Table 4 illustrates the complementarity of the nucleotide sequences of FLJ22692 BINDING SITE, designated SEQ ID:7048, to the nucleotide sequence of GAM7957 RNA, herein designated GAM RNA, also designated SEQ ID:297.

Another function of GAM7957 is therefore inhibition of FLJ22692 (Accession NP_079325.1). Accordingly, utilities of GAM7957 include diagnosis, prevention and treatment of diseases and clinical conditions associated with FLJ22692.

FLJ22814 (Accession NP_079192.1) is another GAM7957 target gene, herein designated TARGET GENE. FLJ22814 BINDING SITE1 through FLJ22814 BINDING SITE3 are target binding sites found in untranslated regions of mRNA encoded by FLJ22814, corresponding to target binding sites such as BINDING SITE I, BINDING SITE II or BINDING SITE III of FIG. 8. Table 4 illustrates the complementarity of the nucleotide sequences of FLJ22814 BINDING SITE1 through FLJ22814 BINDING SITE3, designated SEQ ID:2026, SEQ ID:8877 and SEQ ID:15203 respectively, to the nucleotide sequence of GAM7957 RNA, herein designated GAM RNA, also designated SEQ ID:297.

Another function of GAM7957 is therefore inhibition of FLJ22814 (Accession NP_079192.1). Accordingly, utilities of GAM7957 include diagnosis, prevention and treatment of diseases and clinical conditions associated with FLJ22814.

FLJ22965 (Accession NP_071384.1) is another GAM7957 target gene, herein designated TARGET GENE. FLJ22965 BINDING SITE1 and FLJ22965 BINDING SITE2 are target binding sites found in untranslated regions of mRNA encoded by FLJ22965, corresponding to target binding sites such as BINDING SITE I, BINDING SITE II or BINDING SITE III of FIG. 8. Table 4 illustrates the complementarity of the nucleotide sequences of FLJ22965 BINDING SITE1 and FLJ22965 BINDING SITE2, designated SEQ ID:18688 and SEQ ID:17741 respectively, to the nucleotide sequence of GAM7957 RNA, herein designated GAM RNA, also designated SEQ ID:297.

Another function of GAM7957 is therefore inhibition of FLJ22965 (Accession NP_071384.1). Accordingly, utilities of GAM7957 include diagnosis, prevention and treatment of diseases and clinical conditions associated with FLJ22965.

FLJ23022 (Accession NP_079327.1) is another GAM7957 target gene, herein designated TARGET GENE. FLJ23022 BINDING SITE1 and FLJ23022 BINDING SITE2 are target binding sites found in untranslated regions of mRNA encoded by FLJ23022, corresponding to target binding sites such as BINDING SITE I, BINDING SITE II or BINDING SITE III of FIG. 8. Table 4 illustrates the complementarity of the nucleotide sequences of FLJ23022 BINDING SITE1 and FLJ23022 BINDING SITE2, designated SEQ ID:5830 and SEQ ID:9765 respectively, to the nucleotide sequence of GAM7957 RNA, herein designated GAM RNA, also designated SEQ ID:297.

Another function of GAM7957 is therefore inhibition of FLJ23022 (Accession NP_079327.1). Accordingly, utilities of GAM7957 include diagnosis, prevention and treatment of diseases and clinical conditions associated with FLJ23022.

FLJ23040 (Accession NP_079450.1) is another GAM7957 target gene, herein designated TARGET GENE. FLJ23040 BINDING SITE is a target binding site found in the 3' untranslated region of mRNA encoded by FLJ23040, corresponding to a target binding site such as BINDING SITE I, BINDING SITE II or BINDING SITE III of FIG. 8. Table 4 illustrates the complementarity of the nucleotide sequences of FLJ23040 BINDING SITE, designated SEQ ID:5732, to the nucleotide sequence of GAM7957 RNA, herein designated GAM RNA, also designated SEQ ID:297.

Another function of GAM7957 is therefore inhibition of FLJ23040 (Accession NP_079450.1). Accordingly, utilities of GAM7957 include diagnosis, prevention and treatment of diseases and clinical conditions associated with FLJ23040.

FLJ23042 (Accession NP_079433.1) is another GAM7957 target gene, herein designated TARGET GENE. FLJ23042 BINDING SITE is a target binding site found in the 3' untranslated region of mRNA encoded by FLJ23042, corresponding to a target binding site such as BINDING SITE I, BINDING SITE II or BINDING SITE III of FIG. 8. Table 4 illustrates the complementarity of the nucleotide sequences of FLJ23042 BINDING SITE, designated SEQ ID:9948, to the nucleotide sequence of GAM7957 RNA, herein designated GAM RNA, also designated SEQ ID:297.

Another function of GAM7957 is therefore inhibition of FLJ23042 (Accession NP_079433.1). Accordingly, utilities of GAM7957 include diagnosis, prevention and treatment of diseases and clinical conditions associated with FLJ23042.

FLJ23185 (Accession NP_079332.1) is another GAM7957 target gene, herein designated TARGET GENE. FLJ23185 BINDING SITE1 and FLJ23185 BINDING SITE2 are target binding sites found in untranslated regions of mRNA encoded by FLJ23185, corresponding to target binding sites such as BINDING SITE I, BINDING SITE II or BINDING SITE III of FIG. 8. Table 4 illustrates the complementarity of the nucleotide sequences of FLJ23185 BINDING SITE1 and FLJ23185 BINDING SITE2, designated SEQ ID:11247 and SEQ ID:10998 respectively, to the nucleotide sequence of GAM7957 RNA, herein designated GAM RNA, also designated SEQ ID:297.

Another function of GAM7957 is therefore inhibition of FLJ23185 (Accession NP_079332.1). Accordingly, utilities of GAM7957 include diagnosis, prevention and treatment of diseases and clinical conditions associated with FLJ23185.

FLJ23235 (Accession NP_079219.1) is another GAM7957 target gene, herein designated TARGET GENE. FLJ23235 BINDING SITE is a target binding site found in the 3' untranslated region of mRNA encoded by FLJ23235, corresponding to a target binding site such as BINDING SITE I, BINDING SITE II or BINDING SITE III of FIG. 8. Table 4 illustrates the complementarity of the nucleotide sequences of FLJ23235 BINDING SITE, designated SEQ ID:17838, to the nucleotide sequence of GAM7957 RNA, herein designated GAM RNA, also designated SEQ ID:297.

Another function of GAM7957 is therefore inhibition of FLJ23235 (Accession NP_079219.1). Accordingly, utilities of GAM7957 include diagnosis, prevention and treatment of diseases and clinical conditions associated with FLJ23235.

FLJ23322 (Accession NP_079231.3) is another GAM7957 target gene, herein designated TARGET GENE. FLJ23322 BINDING SITE1 and FLJ23322 BINDING SITE2 are target binding sites found in untranslated regions of mRNA encoded by FLJ23322, corresponding to target binding sites such as BINDING SITE I, BINDING SITE II or BINDING SITE III of FIG. 8. Table 4 illustrates the complementarity of the nucleotide sequences of FLJ23322 BINDING SITE1 and FLJ23322 BINDING SITE2, designated SEQ ID:8548 and SEQ ID:11740 respectively, to the nucleotide sequence of GAM7957 RNA, herein designated GAM RNA, also designated SEQ ID:297.

Another function of GAM7957 is therefore inhibition of FLJ23322 (Accession NP_079231.3). Accordingly, utilities of GAM7957 include diagnosis, prevention and treatment of diseases and clinical conditions associated with FLJ23322.

FLJ23356 (Accession NP_115613.1) is another GAM7957 target gene, herein designated TARGET GENE. FLJ23356 BINDING SITE is a target binding site found in the 3' untranslated region of mRNA encoded by FLJ23356, corresponding to a target binding site such as BINDING SITE I, BINDING SITE II or BINDING SITE III of FIG. 8. Table 4 illustrates the complementarity of the nucleotide sequences of FLJ23356 BINDING SITE, designated SEQ ID:2436, to the nucleotide sequence of GAM7957 RNA, herein designated GAM RNA, also designated SEQ ID:297.

Another function of GAM7957 is therefore inhibition of FLJ23356 (Accession NP_115613.1). Accordingly, utilities of GAM7957 include diagnosis, prevention and treatment of diseases and clinical conditions associated with FLJ23356.

FLJ23360 (Accession NP_075564.1) is another GAM7957 target gene, herein designated TARGET GENE. FLJ23360 BINDING SITE1 and FLJ23360 BINDING SITE2 are target binding sites found in untranslated regions of mRNA encoded by FLJ23360, corresponding to target binding sites such as BINDING SITE I, BINDING SITE II or BINDING SITE III of FIG. 8. Table 4 illustrates the complementarity of the nucleotide sequences of FLJ23360 BINDING SITE1 and FLJ23360 BINDING SITE2, designated SEQ ID:13066 and SEQ ID:5830 respectively, to the nucleotide sequence of GAM7957 RNA, herein designated GAM RNA, also designated SEQ ID:297.

Another function of GAM7957 is therefore inhibition of FLJ23360 (Accession NP_075564.1). Accordingly, utilities of GAM7957 include diagnosis, prevention and treatment of diseases and clinical conditions associated with FLJ23360.

FLJ23436 (Accession NP_078947.2) is another GAM7957 target gene, herein designated TARGET GENE. FLJ23436 BINDING SITE is a target binding site found in the 5' untranslated region of mRNA encoded by FLJ23436, corresponding to a target binding site such as BINDING SITE I, BINDING SITE II or BINDING SITE III of FIG. 8. Table 4 illustrates the complementarity of the nucleotide sequences of FLJ23436 BINDING SITE, designated SEQ ID:8839, to the nucleotide sequence of GAM7957 RNA, herein designated GAM RNA, also designated SEQ ID:297.

Another function of GAM7957 is therefore inhibition of FLJ23436 (Accession NP_078947.2). Accordingly, utilities of GAM7957 include diagnosis, prevention and treatment of diseases and clinical conditions associated with FLJ23436.

FLJ23499 (Accession NP_073598.1) is another GAM7957 target gene, herein designated TARGET GENE. FLJ23499 BINDING SITE is a target binding site found in the 3' untranslated region of mRNA encoded by FLJ23499, corresponding to a target binding site such as BINDING SITE I, BINDING SITE II or BINDING SITE III of FIG. 8. Table 4 illustrates the complementarity of the nucleotide sequences of FLJ23499 BINDING SITE, designated SEQ ID:4310, to the nucleotide sequence of GAM7957 RNA, herein designated GAM RNA, also designated SEQ ID:297.

Another function of GAM7957 is therefore inhibition of FLJ23499 (Accession NP_073598.1). Accordingly, utilities of GAM7957 include diagnosis, prevention and treatment of diseases and clinical conditions associated with FLJ23499.

FLJ23537 (Accession NP_079165.1) is another GAM7957 target gene, herein designated TARGET GENE. FLJ23537 BINDING SITE is a target binding site found in the 3' untranslated region of mRNA encoded by FLJ23537, corresponding to a target binding site such as BINDING SITE I, BINDING SITE II or BINDING SITE III of FIG. 8. Table 4 illustrates the complementarity of the nucleotide sequences of FLJ23537 BINDING SITE, designated SEQ ID:10013, to the nucleotide sequence of GAM7957 RNA, herein designated GAM RNA, also designated SEQ ID:297.

Another function of GAM7957 is therefore inhibition of FLJ23537 (Accession NP_079165.1). Accordingly, utilities of GAM7957 include diagnosis, prevention and treatment of diseases and clinical conditions associated with FLJ23537.

FLJ23754 (Accession NP_689888.1) is another GAM7957 target gene, herein designated TARGET GENE. FLJ23754 BINDING SITE is a target binding site found in the 3' untranslated region of mRNA encoded by FLJ23754, corresponding to a target binding site such as BINDING SITE I, BINDING SITE II or BINDING SITE III of FIG. 8. Table 4 illustrates the complementarity of the nucleotide sequences of FLJ23754 BINDING SITE, designated SEQ ID:13853, to the nucleotide sequence of GAM7957 RNA, herein designated GAM RNA, also designated SEQ ID:297.

Another function of GAM7957 is therefore inhibition of FLJ23754 (Accession NP_689888.1). Accordingly, utilities of GAM7957 include diagnosis, prevention and treatment of diseases and clinical conditions associated with FLJ23754.

FLJ23865 (Accession NP_689882.1) is another GAM7957 target gene, herein designated TARGET GENE. FLJ23865 BINDING SITE is a target binding site found in the 3' untranslated region of mRNA encoded by FLJ23865, corresponding to a target binding site such as BINDING SITE I, BINDING SITE II or BINDING SITE III of FIG. 8. Table 4 illustrates the complementarity of the nucleotide sequences of FLJ23865 BINDING SITE, designated SEQ ID:7778, to the nucleotide sequence of GAM7957 RNA, herein designated GAM RNA, also designated SEQ ID:297.

Another function of GAM7957 is therefore inhibition of FLJ23865 (Accession NP_689882.1). Accordingly, utilities of GAM7957 include diagnosis, prevention and treatment of diseases and clinical conditions associated with FLJ23865.

FLJ23878 (Accession NP_659427.1) is another GAM7957 target gene, herein designated TARGET GENE. FLJ23878 BINDING SITE1 and FLJ23878 BINDING SITE2 are target binding sites found in untranslated regions of mRNA encoded by FLJ23878, corresponding to target binding sites such as BINDING SITE I, BINDING SITE II or BINDING SITE III of FIG. 8. Table 4 illustrates the complementarity of the nucleotide sequences of FLJ23878 BINDING SITE1 and FLJ23878 BINDING SITE2, designated SEQ ID:15315 and SEQ ID:19119 respectively, to the nucleotide sequence of GAM7957 RNA, herein designated GAM RNA, also designated SEQ ID:297.

Another function of GAM7957 is therefore inhibition of FLJ23878 (Accession NP_659427.1). Accordingly, utilities of GAM7957 include diagnosis, prevention and treatment of diseases and clinical conditions associated with FLJ23878.

FLJ25006 (Accession NP_653211.1) is another GAM7957 target gene, herein designated TARGET GENE. FLJ25006 BINDING SITE is a target binding site found in the 3' untranslated region of mRNA encoded by FLJ25006, corresponding to a target binding site such as BINDING SITE I, BINDING SITE II or BINDING SITE III of FIG. 8. Table 4 illustrates the complementarity of the nucleotide sequences of FLJ25006 BINDING SITE, designated SEQ ID:19211, to the nucleotide sequence of GAM7957 RNA, herein designated GAM RNA, also designated SEQ ID:297.

Another function of GAM7957 is therefore inhibition of FLJ25006 (Accession NP_653211.1). Accordingly, utilities of GAM7957 include diagnosis, prevention and treatment of diseases and clinical conditions associated with FLJ25006.

FLJ25613 (Accession NP_775865.1) is another GAM7957 target gene, herein designated TARGET GENE. FLJ25613 BINDING SITE is a target binding site found in the 3' untranslated region of mRNA encoded by FLJ25613, corresponding to a target binding site such as BINDING SITE I, BINDING SITE II or BINDING SITE III of FIG. 8. Table 4 illustrates the complementarity of the nucleotide sequences of FLJ25613 BINDING SITE, designated SEQ ID:8469, to the nucleotide sequence of GAM7957 RNA, herein designated GAM RNA, also designated SEQ ID:297.

Another function of GAM7957 is therefore inhibition of FLJ25613 (Accession NP_775865.1). Accordingly, utilities of GAM7957 include diagnosis, prevention and treatment of diseases and clinical conditions associated with FLJ25613.

FLJ30092 (Accession NP_659420.1) is another GAM7957 target gene, herein designated TARGET GENE. FLJ30092 BINDING SITE is a target binding site found in the 3' untranslated region of mRNA encoded by FLJ30092, corresponding to a target binding site such as BINDING SITE I, BINDING SITE II or BINDING SITE III of FIG. 8. Table 4 illustrates the complementarity of the nucleotide sequences of FLJ30092 BINDING SITE, designated SEQ ID:6927, to the nucleotide sequence of GAM7957 RNA, herein designated GAM RNA, also designated SEQ ID:297.

Another function of GAM7957 is therefore inhibition of FLJ30092 (Accession NP_659420.1). Accordingly, utilities of GAM7957 include diagnosis, prevention and treatment of diseases and clinical conditions associated with FLJ30092.

FLJ30317 (Accession NP_742148.1) is another GAM7957 target gene, herein designated TARGET GENE. FLJ30317 BINDING SITE1 and FLJ30317 BINDING SITE2 are target binding sites found in untranslated regions of mRNA encoded by FLJ30317, corresponding to target binding sites such as BINDING SITE I, BINDING SITE II or BINDING SITE III of FIG. 8. Table 4 illustrates the complementarity of the nucleotide sequences of FLJ30317 BINDING SITE1 and FLJ30317 BINDING SITE2, designated SEQ ID:7121 and SEQ ID:6683 respectively, to the nucleotide sequence of GAM7957 RNA, herein designated GAM RNA, also designated SEQ ID:297.

Another function of GAM7957 is therefore inhibition of FLJ30317 (Accession NP_742148.1). Accordingly, utilities of GAM7957 include diagnosis, prevention and treatment of diseases and clinical conditions associated with FLJ30317.

FLJ30507 (Accession NP_694555.1) is another GAM7957 target gene, herein designated TARGET GENE. FLJ30507 BINDING SITE is a target binding site found in the 5' untranslated region of mRNA encoded by FLJ30507, corresponding to a target binding site such as BINDING SITE I, BINDING SITE II or BINDING SITE III of FIG. 8. Table 4 illustrates the complementarity of the nucleotide sequences of FLJ30507 BINDING SITE, designated SEQ ID:5647, to the nucleotide sequence of GAM7957 RNA, herein designated GAM RNA, also designated SEQ ID:297.

Another function of GAM7957 is therefore inhibition of FLJ30507 (Accession NP_694555.1). Accordingly, utilities of GAM7957 include diagnosis, prevention and treatment of diseases and clinical conditions associated with FLJ30507.

FLJ30594 (Accession NP_694556.1) is another GAM7957 target gene, herein designated TARGET GENE. FLJ30594 BINDING SITE is a target binding site found in the 3' untranslated region of mRNA encoded by FLJ30594, corresponding to a target binding site such as BINDING SITE I, BINDING SITE II or BINDING SITE III of FIG. 8. Table 4 illustrates the complementarity of the nucleotide sequences of FLJ30594 BINDING SITE, designated SEQ ID:9422, to the nucleotide sequence of GAM7957 RNA, herein designated GAM RNA, also designated SEQ ID:297.

Another function of GAM7957 is therefore inhibition of FLJ30594 (Accession NP_694556.1). Accordingly, utilities of GAM7957 include diagnosis, prevention and treatment of diseases and clinical conditions associated with FLJ30594.

FLJ30679 (Accession NP_694562.1) is another GAM7957 target gene, herein designated TARGET GENE. FLJ30679 BINDING SITE is a target binding site found in the 3' untranslated region of mRNA encoded by FLJ30679, corresponding to a target binding site such as BINDING SITE I, BINDING SITE II or BINDING SITE III of FIG. 8. Table 4 illustrates the complementarity of the nucleotide sequences of FLJ30679 BINDING SITE, designated SEQ ID:8173, to the nucleotide sequence of GAM7957 RNA, herein designated GAM RNA, also designated SEQ ID:297.

Another function of GAM7957 is therefore inhibition of FLJ30679 (Accession NP_694562.1). Accordingly, utilities of GAM7957 include diagnosis, prevention and treatment of diseases and clinical conditions associated with FLJ30679.

FLJ30791 (Accession NP_653295.1) is another GAM7957 target gene, herein designated TARGET GENE. FLJ30791 BINDING SITE is a target binding site found in the 5' untranslated region of mRNA encoded by FLJ30791, corresponding to a target binding site such as BINDING SITE I, BINDING SITE II or BINDING SITE III of FIG. 8. Table 4 illustrates the complementarity of the nucleotide sequences of FLJ30791 BINDING SITE, designated SEQ ID:7170, to the nucleotide sequence of GAM7957 RNA, herein designated GAM RNA, also designated SEQ ID:297.

Another function of GAM7957 is therefore inhibition of FLJ30791 (Accession NP_653295.1). Accordingly, utilities of GAM7957 include diagnosis, prevention and treatment of diseases and clinical conditions associated with FLJ30791.

FLJ30899 (Accession NP_689943.1) is another GAM7957 target gene, herein designated TARGET GENE. FLJ30899 BINDING SITE is a target binding site found in the 3' untranslated region of mRNA encoded by FLJ30899, corresponding to a target binding site such as BINDING SITE I, BINDING SITE II or BINDING SITE III of FIG. 8. Table 4 illustrates the complementarity of the nucleotide sequences of FLJ30899 BINDING SITE, designated SEQ ID:19054, to the nucleotide sequence of GAM7957 RNA, herein designated GAM RNA, also designated SEQ ID:297.

Another function of GAM7957 is therefore inhibition of FLJ30899 (Accession NP_689943.1). Accordingly, utilities of GAM7957 include diagnosis, prevention and treatment of diseases and clinical conditions associated with FLJ30899.

FLJ31034 (Accession NP_689937.1) is another GAM7957 target gene, herein designated TARGET GENE. FLJ31034 BINDING SITE is a target binding site found in the 3' untranslated region of mRNA encoded by FLJ31034, corresponding to a target binding site such as BINDING SITE I, BINDING SITE II or BINDING SITE III of FIG. 8. Table 4 illustrates the complementarity of the nucleotide sequences of FLJ31034 BINDING SITE, designated SEQ ID:9589, to the nucleotide sequence of GAM7957 RNA, herein designated GAM RNA, also designated SEQ ID:297.

Another function of GAM7957 is therefore inhibition of FLJ31034 (Accession NP_689937.1). Accordingly, utilities of GAM7957 include diagnosis, prevention and treatment of diseases and clinical conditions associated with FLJ31034.

FLJ31052 (Accession NP_689591.1) is another GAM7957 target gene, herein designated TARGET GENE. FLJ31052 BINDING SITE is a target binding site found in the 5' untranslated region of mRNA encoded by FLJ31052, corresponding to a target binding site such as BINDING SITE I, BINDING SITE II or BINDING SITE III of FIG. 8. Table 4 illustrates the complementarity of the nucleotide sequences of FLJ31052 BINDING SITE, designated SEQ ID:15521, to the nucleotide sequence of GAM7957 RNA, herein designated GAM RNA, also designated SEQ ID:297.

Another function of GAM7957 is therefore inhibition of FLJ31052 (Accession NP_689591.1). Accordingly, utilities of GAM7957 include diagnosis, prevention and treatment of diseases and clinical conditions associated with FLJ31052.

FLJ31158 (Accession NP_689782.1) is another GAM7957 target gene, herein designated TARGET GENE.

FLJ31158 BINDING SITE is a target binding site found in the 3' untranslated region of mRNA encoded by FLJ31158, corresponding to a target binding site such as BINDING SITE I, BINDING SITE II or BINDING SITE III of FIG. 8. Table 4 illustrates the complementarity of the nucleotide sequences of FLJ31158 BINDING SITE, designated SEQ ID:2160, to the nucleotide sequence of GAM7957 RNA, herein designated GAM RNA, also designated SEQ ID:297.

Another function of GAM7957 is therefore inhibition of FLJ31158 (Accession NP_689782.1). Accordingly, utilities of GAM7957 include diagnosis, prevention and treatment of diseases and clinical conditions associated with FLJ31158.

FLJ31208 (Accession NP_694568.1) is another GAM7957 target gene, herein designated TARGET GENE. FLJ31208 BINDING SITE is a target binding site found in the 3' untranslated region of mRNA encoded by FLJ31208, corresponding to a target binding site such as BINDING SITE I, BINDING SITE II or BINDING SITE III of FIG. 8. Table 4 illustrates the complementarity of the nucleotide sequences of FLJ31208 BINDING SITE, designated SEQ ID:14200, to the nucleotide sequence of GAM7957 RNA, herein designated GAM RNA, also designated SEQ ID:297.

Another function of GAM7957 is therefore inhibition of FLJ31208 (Accession NP_694568.1). Accordingly, utilities of GAM7957 include diagnosis, prevention and treatment of diseases and clinical conditions associated with FLJ31208.

FLJ31322 (Accession NP_689600.1) is another GAM7957 target gene, herein designated TARGET GENE. FLJ31322 BINDING SITE1 and FLJ31322 BINDING SITE2 are target binding sites found in untranslated regions of mRNA encoded by FLJ31322, corresponding to target binding sites such as BINDING SITE I, BINDING SITE II or BINDING SITE III of FIG. 8. Table 4 illustrates the complementarity of the nucleotide sequences of FLJ31322 BINDING SITE1 and FLJ31322 BINDING SITE2, designated SEQ ID:6650 and SEQ ID:13125 respectively, to the nucleotide sequence of GAM7957 RNA, herein designated GAM RNA, also designated SEQ ID:297.

Another function of GAM7957 is therefore inhibition of FLJ31322 (Accession NP_689600.1). Accordingly, utilities of GAM7957 include diagnosis, prevention and treatment of diseases and clinical conditions associated with FLJ31322.

FLJ31331 (Accession NP_689743.1) is another GAM7957 target gene, herein designated TARGET GENE. FLJ31331 BINDING SITE is a target binding site found in the 3' untranslated region of mRNA encoded by FLJ31331, corresponding to a target binding site such as BINDING SITE I, BINDING SITE II or BINDING SITE III of FIG. 8. Table 4 illustrates the complementarity of the nucleotide sequences of FLJ31331 BINDING SITE, designated SEQ ID:9421, to the nucleotide sequence of GAM7957 RNA, herein designated GAM RNA, also designated SEQ ID:297.

Another function of GAM7957 is therefore inhibition of FLJ31331 (Accession NP_689743.1). Accordingly, utilities of GAM7957 include diagnosis, prevention and treatment of diseases and clinical conditions associated with FLJ31331.

FLJ31434 (Accession NP_689709.1) is another GAM7957 target gene, herein designated TARGET GENE. FLJ31434 BINDING SITE1 and FLJ31434 BINDING SITE2 are target binding sites found in untranslated regions of mRNA encoded by FLJ31434, corresponding to target binding sites such as BINDING SITE I, BINDING SITE II or BINDING SITE III of FIG. 8. Table 4 illustrates the complementarity of the nucleotide sequences of FLJ31434 BINDING SITE1 and FLJ31434 BINDING SITE2, designated SEQ ID:1420 and SEQ ID:15343 respectively, to the nucleotide sequence of GAM7957 RNA, herein designated GAM RNA, also designated SEQ ID:297.

Another function of GAM7957 is therefore inhibition of FLJ31434 (Accession NP_689709.1). Accordingly, utilities of GAM7957 include diagnosis, prevention and treatment of diseases and clinical conditions associated with FLJ31434.

FLJ31455 (Accession NP_659401.1) is another GAM7957 target gene, herein designated TARGET GENE. FLJ31455 BINDING SITE is a target binding site found in the 3' untranslated region of mRNA encoded by FLJ31455, corresponding to a target binding site such as BINDING SITE I, BINDING SITE II or BINDING SITE III of FIG. 8. Table 4 illustrates the complementarity of the nucleotide sequences of FLJ31455 BINDING SITE, designated SEQ ID:15977, to the nucleotide sequence of GAM7957 RNA, herein designated GAM RNA, also designated SEQ ID:297.

Another function of GAM7957 is therefore inhibition of FLJ31455 (Accession NP_659401.1). Accordingly, utilities of GAM7957 include diagnosis, prevention and treatment of diseases and clinical conditions associated with FLJ31455.

FLJ31568 (Accession NP_689722.1) is another GAM7957 target gene, herein designated TARGET GENE. FLJ31568 BINDING SITE1 and FLJ31568 BINDING SITE2 are target binding sites found in untranslated regions of mRNA encoded by FLJ31568, corresponding to target binding sites such as BINDING SITE I, BINDING SITE II or BINDING SITE III of FIG. 8. Table 4 illustrates the complementarity of the nucleotide sequences of FLJ31568 BINDING SITE1 and FLJ31568 BINDING SITE2, designated SEQ ID:18229 and SEQ ID:20105 respectively, to the nucleotide sequence of GAM7957 RNA, herein designated GAM RNA, also designated SEQ ID:297.

Another function of GAM7957 is therefore inhibition of FLJ31568 (Accession NP_689722.1). Accordingly, utilities of GAM7957 include diagnosis, prevention and treatment of diseases and clinical conditions associated with FLJ31568.

FLJ31737 (Accession NP_659421.1) is another GAM7957 target gene, herein designated TARGET GENE. FLJ31737 BINDING SITE is a target binding site found in the 3' untranslated region of mRNA encoded by FLJ31737, corresponding to a target binding site such as BINDING SITE I, BINDING SITE II or BINDING SITE III of FIG. 8. Table 4 illustrates the complementarity of the nucleotide sequences of FLJ31737 BINDING SITE, designated SEQ ID:6645, to the nucleotide sequence of GAM7957 RNA, herein designated GAM RNA, also designated SEQ ID:297.

Another function of GAM7957 is therefore inhibition of FLJ31737 (Accession NP_659421.1). Accordingly, utilities of GAM7957 include diagnosis, prevention and treatment of diseases and clinical conditions associated with FLJ31737.

FLJ31819 (Accession NP_689742.2) is another GAM7957 target gene, herein designated TARGET GENE. FLJ31819 BINDING SITE is a target binding site found in the 3' untranslated region of mRNA encoded by FLJ31819, corresponding to a target binding site such as BINDING SITE I, BINDING SITE II or BINDING SITE III of FIG. 8. Table 4 illustrates the complementarity of the nucleotide sequences of FLJ31819 BINDING SITE, designated SEQ ID:12402, to the nucleotide sequence of GAM7957 RNA, herein designated GAM RNA, also designated SEQ ID:297.

Another function of GAM7957 is therefore inhibition of FLJ31819 (Accession NP_689742.2). Accordingly, utilities of GAM7957 include diagnosis, prevention and treatment of diseases and clinical conditions associated with FLJ31819.

FLJ31842 (Accession NP_689700.1) is another GAM7957 target gene, herein designated TARGET GENE. FLJ31842 BINDING SITE1 and FLJ31842 BINDING SITE2 are target binding sites found in untranslated regions of mRNA encoded by FLJ31842, corresponding to target binding sites such as BINDING SITE I, BINDING SITE II or BINDING SITE III of FIG. 8. Table 4 illustrates the complementarity of the nucleotide sequences of FLJ31842 BINDING SITE1 and FLJ31842 BINDING SITE2, designated SEQ ID:5671 and SEQ ID:5830 respectively, to the nucleotide sequence of GAM7957 RNA, herein designated GAM RNA, also designated SEQ ID:297.

Another function of GAM7957 is therefore inhibition of FLJ31842 (Accession NP_689700.1). Accordingly, utilities of GAM7957 include diagnosis, prevention and treatment of diseases and clinical conditions associated with FLJ31842.

FLJ31846 (Accession NP_659411.1) is another GAM7957 target gene, herein designated TARGET GENE. FLJ31846 BINDING SITE is a target binding site found in the 5' untranslated region of mRNA encoded by FLJ31846, corresponding to a target binding site such as BINDING SITE I, BINDING SITE II or BINDING SITE III of FIG. 8. Table 4 illustrates the complementarity of the nucleotide sequences of FLJ31846 BINDING SITE, designated SEQ ID:17941, to the nucleotide sequence of GAM7957 RNA, herein designated GAM RNA, also designated SEQ ID:297.

Another function of GAM7957 is therefore inhibition of FLJ31846 (Accession NP_659411.1). Accordingly, utilities of GAM7957 include diagnosis, prevention and treatment of diseases and clinical conditions associated with FLJ31846.

FLJ31882 (Accession NP_689673.1) is another GAM7957 target gene, herein designated TARGET GENE. FLJ31882 BINDING SITE is a target binding site found in the 3' untranslated region of mRNA encoded by FLJ31882, corresponding to a target binding site such as BINDING SITE I, BINDING SITE II or BINDING SITE III of FIG. 8. Table 4 illustrates the complementarity of the nucleotide sequences of FLJ31882 BINDING SITE, designated SEQ ID:11921, to the nucleotide sequence of GAM7957 RNA, herein designated GAM RNA, also designated SEQ ID:297.

Another function of GAM7957 is therefore inhibition of FLJ31882 (Accession NP_689673.1). Accordingly, utilities of GAM7957 include diagnosis, prevention and treatment of diseases and clinical conditions associated with FLJ31882.

FLJ31952 (Accession NP_653283.1) is another GAM7957 target gene, herein designated TARGET GENE. FLJ31952 BINDING SITE is a target binding site found in the 3' untranslated region of mRNA encoded by FLJ31952, corresponding to a target binding site such as BINDING SITE I, BINDING SITE II or BINDING SITE III of FIG. 8. Table 4 illustrates the complementarity of the nucleotide sequences of FLJ31952 BINDING SITE, designated SEQ ID:8772, to the nucleotide sequence of GAM7957 RNA, herein designated GAM RNA, also designated SEQ ID:297.

Another function of GAM7957 is therefore inhibition of FLJ31952 (Accession NP_653283.1). Accordingly, utilities of GAM7957 include diagnosis, prevention and treatment of diseases and clinical conditions associated with FLJ31952.

FLJ31958 (Accession NP_694575.1) is another GAM7957 target gene, herein designated TARGET GENE. FLJ31958 BINDING SITE is a target binding site found in the 3' untranslated region of mRNA encoded by FLJ31958, corresponding to a target binding site such as BINDING SITE I, BINDING SITE II or BINDING SITE III of FIG. 8. Table 4 illustrates the complementarity of the nucleotide sequences of FLJ31958 BINDING SITE, designated SEQ ID:694, to the nucleotide sequence of GAM7957 RNA, herein designated GAM RNA, also designated SEQ ID:297.

Another function of GAM7957 is therefore inhibition of FLJ31958 (Accession NP_694575.1). Accordingly, utilities of GAM7957 include diagnosis, prevention and treatment of diseases and clinical conditions associated with FLJ31958.

FLJ32029 (Accession NP_775853.2) is another GAM7957 target gene, herein designated TARGET GENE. FLJ32029 BINDING SITE1 through FLJ32029 BINDING SITE3 are target binding sites found in untranslated regions of mRNA encoded by FLJ32029, corresponding to target binding sites such as BINDING SITE I, BINDING SITE II or BINDING SITE III of FIG. 8. Table 4 illustrates the complementarity of the nucleotide sequences of FLJ32029 BINDING SITE1 through FLJ32029 BINDING SITE3, designated SEQ ID:19975, SEQ ID:1492 and SEQ ID:15089 respectively, to the nucleotide sequence of GAM7957 RNA, herein designated GAM RNA, also designated SEQ ID:297.

Another function of GAM7957 is therefore inhibition of FLJ32029 (Accession NP_775853.2). Accordingly, utilities of GAM7957 include diagnosis, prevention and treatment of diseases and clinical conditions associated with FLJ32029.

FLJ32214 (Accession NP_689686.1) is another GAM7957 target gene, herein designated TARGET GENE. FLJ32214 BINDING SITE is a target binding site found in the 3' untranslated region of mRNA encoded by FLJ32214, corresponding to a target binding site such as BINDING SITE I, BINDING SITE II or BINDING SITE III of FIG. 8. Table 4 illustrates the complementarity of the nucleotide sequences of FLJ32214 BINDING SITE, designated SEQ ID:3464, to the nucleotide sequence of GAM7957 RNA, herein designated GAM RNA, also designated SEQ ID:297.

Another function of GAM7957 is therefore inhibition of FLJ32214 (Accession NP_689686.1). Accordingly, utilities of GAM7957 include diagnosis, prevention and treatment of diseases and clinical conditions associated with FLJ32214.

FLJ32384 (Accession NP_653209.1) is another GAM7957 target gene, herein designated TARGET GENE. FLJ32384 BINDING SITE is a target binding site found in the 3' untranslated region of mRNA encoded by FLJ32384, corresponding to a target binding site such as BINDING SITE I, BINDING SITE II or BINDING SITE III of FIG. 8. Table 4 illustrates the complementarity of the nucleotide sequences of FLJ32384 BINDING SITE, designated SEQ ID:12664, to the nucleotide sequence of GAM7957 RNA, herein designated GAM RNA, also designated SEQ ID:297.

Another function of GAM7957 is therefore inhibition of FLJ32384 (Accession NP_653209.1). Accordingly, utilities of GAM7957 include diagnosis, prevention and treatment of diseases and clinical conditions associated with FLJ32384.

FLJ32535 (Accession NP_689760.1) is another GAM7957 target gene, herein designated TARGET GENE. FLJ32535 BINDING SITE is a target binding site found in the 3' untranslated region of mRNA encoded by FLJ32535, corresponding to a target binding site such as BINDING SITE I, BINDING SITE II or BINDING SITE III of FIG. 8. Table 4 illustrates the complementarity of the nucleotide sequences of FLJ32535 BINDING SITE, designated SEQ ID:8019, to the nucleotide sequence of GAM7957 RNA, herein designated GAM RNA, also designated SEQ ID:297.

Another function of GAM7957 is therefore inhibition of FLJ32535 (Accession NP_689760.1). Accordingly, utilities of GAM7957 include diagnosis, prevention and treatment of diseases and clinical conditions associated with FLJ32535.

FLJ32915 (Accession NP_659451.1) is another GAM7957 target gene, herein designated TARGET GENE. FLJ32915 BINDING SITE is a target binding site found in the 5' untranslated region of mRNA encoded by FLJ32915, corresponding to a target binding site such as BINDING SITE I, BINDING SITE II or BINDING SITE III of FIG. 8. Table 4 illustrates the complementarity of the nucleotide sequences of FLJ32915 BINDING SITE, designated SEQ ID:8190, to the nucleotide sequence of GAM7957 RNA, herein designated GAM RNA, also designated SEQ ID:297.

Another function of GAM7957 is therefore inhibition of FLJ32915 (Accession NP_659451.1). Accordingly, utilities of GAM7957 include diagnosis, prevention and treatment of diseases and clinical conditions associated with FLJ32915.

FLJ33207 (Accession NP_848649.1) is another GAM7957 target gene, herein designated TARGET GENE. FLJ33207 BINDING SITE is a target binding site found in the 3' untranslated region of mRNA encoded by FLJ33207, corresponding to a target binding site such as BINDING SITE I, BINDING SITE II or BINDING SITE III of FIG. 8. Table 4 illustrates the complementarity of the nucleotide sequences of FLJ33207 BINDING SITE, designated SEQ ID:5805, to the nucleotide sequence of GAM7957 RNA, herein designated GAM RNA, also designated SEQ ID:297.

Another function of GAM7957 is therefore inhibition of FLJ33207 (Accession NP_848649.1). Accordingly, utilities of GAM7957 include diagnosis, prevention and treatment of diseases and clinical conditions associated with FLJ33207.

FLJ33298 (Accession NP_775907.1) is another GAM7957 target gene, herein designated TARGET GENE. FLJ33298 BINDING SITE is a target binding site found in the 3' untranslated region of mRNA encoded by FLJ33298, corresponding to a target binding site such as BINDING SITE I, BINDING SITE II or BINDING SITE III of FIG. 8. Table 4 illustrates the complementarity of the nucleotide sequences of FLJ33298 BINDING SITE, designated SEQ ID:4903, to the nucleotide sequence of GAM7957 RNA, herein designated GAM RNA, also designated SEQ ID:297.

Another function of GAM7957 is therefore inhibition of FLJ33298 (Accession NP_775907.1). Accordingly, utilities of GAM7957 include diagnosis, prevention and treatment of diseases and clinical conditions associated with FLJ33298.

FLJ33505 (Accession NP_689530.1) is another GAM7957 target gene, herein designated TARGET GENE. FLJ33505 BINDING SITE is a target binding site found in the 3' untranslated region of mRNA encoded by FLJ33505, corresponding to a target binding site such as BINDING SITE I, BINDING SITE II or BINDING SITE III of FIG. 8. Table 4 illustrates the complementarity of the nucleotide sequences of FLJ33505 BINDING SITE, designated SEQ ID:7314, to the nucleotide sequence of GAM7957 RNA, herein designated GAM RNA, also designated SEQ ID:297.

Another function of GAM7957 is therefore inhibition of FLJ33505 (Accession NP_689530.1). Accordingly, utilities of GAM7957 include diagnosis, prevention and treatment of diseases and clinical conditions associated with FLJ33505.

FLJ33610 (Accession NP_775968.1) is another GAM7957 target gene, herein designated TARGET GENE. FLJ33610 BINDING SITE is a target binding site found in the 3' untranslated region of mRNA encoded by FLJ33610, corresponding to a target binding site such as BINDING SITE I, BINDING SITE II or BINDING SITE III of FIG. 8. Table 4 illustrates the complementarity of the nucleotide sequences of FLJ33610 BINDING SITE, designated SEQ ID:11488, to the nucleotide sequence of GAM7957 RNA, herein designated GAM RNA, also designated SEQ ID:297.

Another function of GAM7957 is therefore inhibition of FLJ33610 (Accession NP_775968.1). Accordingly, utilities of GAM7957 include diagnosis, prevention and treatment of diseases and clinical conditions associated with FLJ33610.

FLJ33674 (Accession XP_291074.1) is another GAM7957 target gene, herein designated TARGET GENE. FLJ33674 BINDING SITE1 and FLJ33674 BINDING SITE2 are target binding sites found in untranslated regions of mRNA encoded by FLJ33674, corresponding to target binding sites such as BINDING SITE I, BINDING SITE II or BINDING SITE III of FIG. 8. Table 4 illustrates the complementarity of the nucleotide sequences of FLJ33674 BINDING SITE1 and FLJ33674 BINDING SITE2, designated SEQ ID:11561 and SEQ ID:1928 respectively, to the nucleotide sequence of GAM7957 RNA, herein designated GAM RNA, also designated SEQ ID:297.

Another function of GAM7957 is therefore inhibition of FLJ33674 (Accession XP_291074.1). Accordingly, utilities of GAM7957 include diagnosis, prevention and treatment of diseases and clinical conditions associated with FLJ33674.

FLJ33790 (Accession NP_775854.1) is another GAM7957 target gene, herein designated TARGET GENE. FLJ33790 BINDING SITE is a target binding site found in the 3' untranslated region of mRNA encoded by FLJ33790, corresponding to a target binding site such as BINDING SITE I, BINDING SITE II or BINDING SITE III of FIG. 8. Table 4 illustrates the complementarity of the nucleotide sequences of FLJ33790 BINDING SITE, designated SEQ ID:12060, to the nucleotide sequence of GAM7957 RNA, herein designated GAM RNA, also designated SEQ ID:297.

Another function of GAM7957 is therefore inhibition of FLJ33790 (Accession NP_775854.1). Accordingly, utilities of GAM7957 include diagnosis, prevention and treatment of diseases and clinical conditions associated with FLJ33790.

FLJ33979 (Accession NP_689849.1) is another GAM7957 target gene, herein designated TARGET GENE. FLJ33979 BINDING SITE is a target binding site found in the 3' untranslated region of mRNA encoded by FLJ33979, corresponding to a target binding site such as BINDING SITE I, BINDING SITE II or BINDING SITE III of FIG. 8. Table 4 illustrates the complementarity of the nucleotide sequences of FLJ33979 BINDING SITE, designated SEQ ID:592, to the nucleotide sequence of GAM7957 RNA, herein designated GAM RNA, also designated SEQ ID:297.

Another function of GAM7957 is therefore inhibition of FLJ33979 (Accession NP_689849.1). Accordingly, utilities of GAM7957 include diagnosis, prevention and treatment of diseases and clinical conditions associated with FLJ33979.

FLJ34047 (Accession NP_775940.1) is another GAM7957 target gene, herein designated TARGET GENE. FLJ34047 BINDING SITE is a target binding site found in the 3' untranslated region of mRNA encoded by FLJ34047, corresponding to a target binding site such as BINDING SITE I, BINDING SITE II or BINDING SITE III of FIG. 8. Table 4 illustrates the complementarity of the nucleotide sequences of FLJ34047 BINDING SITE, designated SEQ ID:15371, to the nucleotide sequence of GAM7957 RNA, herein designated GAM RNA, also designated SEQ ID:297.

Another function of GAM7957 is therefore inhibition of FLJ34047 (Accession NP_775940.1). Accordingly, utilities of GAM7957 include diagnosis, prevention and treatment of diseases and clinical conditions associated with FLJ34047.

FLJ34278 (Accession NP_775873.1) is another GAM7957 target gene, herein designated TARGET GENE. FLJ34278 BINDING SITE is a target binding site found in the 3' untranslated region of mRNA encoded by FLJ34278, corresponding to a target binding site such as BINDING SITE I, BINDING SITE II or BINDING SITE III of FIG. 8. Table 4 illustrates the complementarity of the nucleotide sequences of FLJ34278 BINDING SITE, designated SEQ ID:12930, to the nucleotide sequence of GAM7957 RNA, herein designated GAM RNA, also designated SEQ ID:297.

Another function of GAM7957 is therefore inhibition of FLJ34278 (Accession NP_775873.1). Accordingly, utilities of GAM7957 include diagnosis, prevention and treatment of diseases and clinical conditions associated with FLJ34278.

FLJ34817 (Accession NP_689516.1) is another GAM7957 target gene, herein designated TARGET GENE. FLJ34817 BINDING SITE is a target binding site found in the 3' untranslated region of mRNA encoded by FLJ34817, corresponding to a target binding site such as BINDING SITE I, BINDING SITE II or BINDING SITE III of FIG. 8. Table 4 illustrates the complementarity of the nucleotide sequences of FLJ34817 BINDING SITE, designated SEQ ID:9991, to the nucleotide sequence of GAM7957 RNA, herein designated GAM RNA, also designated SEQ ID:297.

Another function of GAM7957 is therefore inhibition of FLJ34817 (Accession NP_689516.1). Accordingly, utilities of GAM7957 include diagnosis, prevention and treatment of diseases and clinical conditions associated with FLJ34817.

FLJ34969 (Accession XP_114353.1) is another GAM7957 target gene, herein designated TARGET GENE. FLJ34969 BINDING SITE is a target binding site found in the 3' untranslated region of mRNA encoded by FLJ34969, corresponding to a target binding site such as BINDING SITE I, BINDING SITE II or BINDING SITE III of FIG. 8. Table 4 illustrates the complementarity of the nucleotide sequences of FLJ34969 BINDING SITE, designated SEQ ID:9420, to the nucleotide sequence of GAM7957 RNA, herein designated GAM RNA, also designated SEQ ID:297.

Another function of GAM7957 is therefore inhibition of FLJ34969 (Accession XP_114353.1). Accordingly, utilities of GAM7957 include diagnosis, prevention and treatment of diseases and clinical conditions associated with FLJ34969.

FLJ35119 (Accession NP_787067.1) is another GAM7957 target gene, herein designated TARGET GENE. FLJ35119 BINDING SITE1 and FLJ35119 BINDING SITE2 are target binding sites found in untranslated regions of mRNA encoded by FLJ35119, corresponding to target binding sites such as BINDING SITE I, BINDING SITE II or BINDING SITE III of FIG. 8. Table 4 illustrates the complementarity of the nucleotide sequences of FLJ35119 BINDING SITE1 and FLJ35119 BINDING SITE2, designated SEQ ID:13065 and SEQ ID:4404 respectively, to the nucleotide sequence of GAM7957 RNA, herein designated GAM RNA, also designated SEQ ID:297.

Another function of GAM7957 is therefore inhibition of FLJ35119 (Accession NP_787067.1). Accordingly, utilities of GAM7957 include diagnosis, prevention and treatment of diseases and clinical conditions associated with FLJ35119.

FLJ35681 (Accession NP_787096.1) is another GAM7957 target gene, herein designated TARGET GENE. FLJ35681 BINDING SITE is a target binding site found in the 3' untranslated region of mRNA encoded by FLJ35681, corresponding to a target binding site such as BINDING SITE I, BINDING SITE II or BINDING SITE III of FIG. 8. Table 4 illustrates the complementarity of the nucleotide sequences of FLJ35681 BINDING SITE, designated SEQ ID:13398, to the nucleotide sequence of GAM7957 RNA, herein designated GAM RNA, also designated SEQ ID:297.

Another function of GAM7957 is therefore inhibition of FLJ35681 (Accession NP_787096.1). Accordingly, utilities of GAM7957 include diagnosis, prevention and treatment of diseases and clinical conditions associated with FLJ35681.

FLJ35740 (Accession NP_671728.1) is another GAM7957 target gene, herein designated TARGET GENE. FLJ35740 BINDING SITE is a target binding site found in the 3' untranslated region of mRNA encoded by FLJ35740, corresponding to a target binding site such as BINDING SITE I, BINDING SITE II or BINDING SITE III of FIG. 8. Table 4 illustrates the complementarity of the nucleotide sequences of FLJ35740 BINDING SITE, designated SEQ ID:7183, to the nucleotide sequence of GAM7957 RNA, herein designated GAM RNA, also designated SEQ ID:297.

Another function of GAM7957 is therefore inhibition of FLJ35740 (Accession NP_671728.1). Accordingly, utilities of GAM7957 include diagnosis, prevention and treatment of diseases and clinical conditions associated with FLJ35740.

FLJ35848 (Accession XP_290755.1) is another GAM7957 target gene, herein designated TARGET GENE. FLJ35848 BINDING SITE is a target binding site found in the 3' untranslated region of mRNA encoded by FLJ35848, corresponding to a target binding site such as BINDING SITE I, BINDING SITE II or BINDING SITE III of FIG. 8. Table 4 illustrates the complementarity of the nucleotide sequences of FLJ35848 BINDING SITE, designated SEQ ID:9398, to the nucleotide sequence of GAM7957 RNA, herein designated GAM RNA, also designated SEQ ID:297.

Another function of GAM7957 is therefore inhibition of FLJ35848 (Accession XP_290755.1). Accordingly, utilities of GAM7957 include diagnosis, prevention and treatment of diseases and clinical conditions associated with FLJ35848.

FLJ35936 (Accession NP_775735.1) is another GAM7957 target gene, herein designated TARGET GENE. FLJ35936 BINDING SITE is a target binding site found in the 3' untranslated region of mRNA encoded by FLJ35936, corresponding to a target binding site such as BINDING SITE I, BINDING SITE II or BINDING SITE III of FIG. 8. Table 4 illustrates the complementarity of the nucleotide sequences of FLJ35936 BINDING SITE, designated SEQ ID:13467, to the nucleotide sequence of GAM7957 RNA, herein designated GAM RNA, also designated SEQ ID:297.

Another function of GAM7957 is therefore inhibition of FLJ35936 (Accession NP_775735.1). Accordingly, utilities of GAM7957 include diagnosis, prevention and treatment of diseases and clinical conditions associated with FLJ35936.

FLJ36812 (Accession NP_694992.1) is another GAM7957 target gene, herein designated TARGET GENE. FLJ36812 BINDING SITE1 and FLJ36812 BINDING SITE2 are target binding sites found in untranslated regions of mRNA encoded by FLJ36812, corresponding to target binding sites such as BINDING SITE I, BINDING SITE II or BINDING SITE III of FIG. 8. Table 4 illustrates the complementarity of the nucleotide sequences of FLJ36812 BINDING SITE1 and FLJ36812 BINDING SITE2, designated SEQ ID:12792 and SEQ ID:15984 respectively, to the nucleotide sequence of GAM7957 RNA, herein designated GAM RNA, also designated SEQ ID:297.

Another function of GAM7957 is therefore inhibition of FLJ36812 (Accession NP_694992.1). Accordingly, utilities of GAM7957 include diagnosis, prevention and treatment of diseases and clinical conditions associated with FLJ36812.

FLJ37131 (Accession NP_775958.1) is another GAM7957 target gene, herein designated TARGET GENE. FLJ37131 BINDING SITE is a target binding site found in the 3' untranslated region of mRNA encoded by FLJ37131, corresponding to a target binding site such as BINDING SITE I, BINDING SITE II or BINDING SITE III of FIG. 8. Table 4 illustrates the complementarity of the nucleotide sequences of FLJ37131 BINDING SITE, designated SEQ ID:19393, to the nucleotide sequence of GAM7957 RNA, herein designated GAM RNA, also designated SEQ ID:297.

Another function of GAM7957 is therefore inhibition of FLJ37131 (Accession NP_775958.1). Accordingly, utilities of GAM7957 include diagnosis, prevention and treatment of diseases and clinical conditions associated with FLJ37131.

FLJ37228 (Accession NP_787113.1) is another GAM7957 target gene, herein designated TARGET GENE.

FLJ37228 BINDING SITE is a target binding site found in the 3' untranslated region of mRNA encoded by FLJ37228, corresponding to a target binding site such as BINDING SITE I, BINDING SITE II or BINDING SITE III of FIG. 8. Table 4 illustrates the complementarity of the nucleotide sequences of FLJ37228 BINDING SITE, designated SEQ ID:12334, to the nucleotide sequence of GAM7957 RNA, herein designated GAM RNA, also designated SEQ ID:297.

Another function of GAM7957 is therefore inhibition of FLJ37228 (Accession NP_787113.1). Accordingly, utilities of GAM7957 include diagnosis, prevention and treatment of diseases and clinical conditions associated with FLJ37228.

FLJ37318 (Accession NP_689799.1) is another GAM7957 target gene, herein designated TARGET GENE. FLJ37318 BINDING SITE is a target binding site found in the 3' untranslated region of mRNA encoded by FLJ37318, corresponding to a target binding site such as BINDING SITE I, BINDING SITE II or BINDING SITE III of FIG. 8. Table 4 illustrates the complementarity of the nucleotide sequences of FLJ37318 BINDING SITE, designated SEQ ID:10438, to the nucleotide sequence of GAM7957 RNA, herein designated GAM RNA, also designated SEQ ID:297.

Another function of GAM7957 is therefore inhibition of FLJ37318 (Accession NP_689799.1). Accordingly, utilities of GAM7957 include diagnosis, prevention and treatment of diseases and clinical conditions associated with FLJ37318.

FLJ37562 (Accession NP_689622.1) is another GAM7957 target gene, herein designated TARGET GENE. FLJ37562 BINDING SITE is a target binding site found in the 3' untranslated region of mRNA encoded by FLJ37562, corresponding to a target binding site such as BINDING SITE I, BINDING SITE II or BINDING SITE III of FIG. 8. Table 4 illustrates the complementarity of the nucleotide sequences of FLJ37562 BINDING SITE, designated SEQ ID:11700, to the nucleotide sequence of GAM7957 RNA, herein designated GAM RNA, also designated SEQ ID:297.

Another function of GAM7957 is therefore inhibition of FLJ37562 (Accession NP_689622.1). Accordingly, utilities of GAM7957 include diagnosis, prevention and treatment of diseases and clinical conditions associated with FLJ37562.

FLJ38359 (Accession NP_689731.1) is another GAM7957 target gene, herein designated TARGET GENE. FLJ38359 BINDING SITE is a target binding site found in the 3' untranslated region of mRNA encoded by FLJ38359, corresponding to a target binding site such as BINDING SITE I, BINDING SITE II or BINDING SITE III of FIG. 8. Table 4 illustrates the complementarity of the nucleotide sequences of FLJ38359 BINDING SITE, designated SEQ ID:10720, to the nucleotide sequence of GAM7957 RNA, herein designated GAM RNA, also designated SEQ ID:297.

Another function of GAM7957 is therefore inhibition of FLJ38359 (Accession NP_689731.1). Accordingly, utilities of GAM7957 include diagnosis, prevention and treatment of diseases and clinical conditions associated with FLJ38359.

FLJ38426 (Accession NP_775882.1) is another GAM7957 target gene, herein designated TARGET GENE. FLJ38426 BINDING SITE is a target binding site found in the 3' untranslated region of mRNA encoded by FLJ38426, corresponding to a target binding site such as BINDING SITE I, BINDING SITE II or BINDING SITE III of FIG. 8. Table 4 illustrates the complementarity of the nucleotide sequences of FLJ38426 BINDING SITE, designated SEQ ID:11462, to the nucleotide sequence of GAM7957 RNA, herein designated GAM RNA, also designated SEQ ID:297.

Another function of GAM7957 is therefore inhibition of FLJ38426 (Accession NP_775882.1). Accordingly, utilities of GAM7957 include diagnosis, prevention and treatment of diseases and clinical conditions associated with FLJ38426.

FLJ38482 (Accession NP_689894.1) is another GAM7957 target gene, herein designated TARGET GENE. FLJ38482 BINDING SITE is a target binding site found in the 3' untranslated region of mRNA encoded by FLJ38482, corresponding to a target binding site such as BINDING SITE I, BINDING SITE II or BINDING SITE III of FIG. 8. Table 4 illustrates the complementarity of the nucleotide sequences of FLJ38482 BINDING SITE, designated SEQ ID:3131, to the nucleotide sequence of GAM7957 RNA, herein designated GAM RNA, also designated SEQ ID:297.

Another function of GAM7957 is therefore inhibition of FLJ38482 (Accession NP_689894.1). Accordingly, utilities of GAM7957 include diagnosis, prevention and treatment of diseases and clinical conditions associated with FLJ38482.

FLJ38663 (Accession NP_689482.1) is another GAM7957 target gene, herein designated TARGET GENE. FLJ38663 BINDING SITE1 and FLJ38663 BINDING SITE2 are target binding sites found in untranslated regions of mRNA encoded by FLJ38663, corresponding to target binding sites such as BINDING SITE I, BINDING SITE II or BINDING SITE III of FIG. 8. Table 4 illustrates the complementarity of the nucleotide sequences of FLJ38663 BINDING SITE1 and FLJ38663 BINDING SITE2, designated SEQ ID:19910 and SEQ ID:9420 respectively, to the nucleotide sequence of GAM7957 RNA, herein designated GAM RNA, also designated SEQ ID:297.

Another function of GAM7957 is therefore inhibition of FLJ38663 (Accession NP_689482.1). Accordingly, utilities of GAM7957 include diagnosis, prevention and treatment of diseases and clinical conditions associated with FLJ38663.

FLJ38690 (Accession NP_848608.1) is another GAM7957 target gene, herein designated TARGET GENE. FLJ38690 BINDING SITE1 through FLJ38690 BINDING SITE3 are target binding sites found in untranslated regions of mRNA encoded by FLJ38690, corresponding to target binding sites such as BINDING SITE I, BINDING SITE II or BINDING SITE III of FIG. 8. Table 4 illustrates the complementarity of the nucleotide sequences of FLJ38690 BINDING SITE1 through FLJ38690 BINDING SITE3, designated SEQ ID:15308, SEQ ID:1620 and SEQ ID:3523 respectively, to the nucleotide sequence of GAM7957 RNA, herein designated GAM RNA, also designated SEQ ID:297.

Another function of GAM7957 is therefore inhibition of FLJ38690 (Accession NP_848608.1). Accordingly, utilities of GAM7957 include diagnosis, prevention and treatment of diseases and clinical conditions associated with FLJ38690.

FLJ38773 (Accession NP_848623.1) is another GAM7957 target gene, herein designated TARGET GENE. FLJ38773 BINDING SITE1 through FLJ38773 BINDING SITE3 are target binding sites found in untranslated regions of mRNA encoded by FLJ38773, corresponding to target binding sites such as BINDING SITE I, BINDING SITE II or BINDING SITE III of FIG. 8. Table 4 illustrates the complementarity of the nucleotide sequences of FLJ38773 BINDING SITE1 through FLJ38773 BINDING SITE3, designated SEQ ID:18950, SEQ ID:19941 and SEQ ID:7759 respectively, to the nucleotide sequence of GAM7957 RNA, herein designated GAM RNA, also designated SEQ ID:297.

Another function of GAM7957 is therefore inhibition of FLJ38773 (Accession NP_848623.1). Accordingly, utilities of GAM7957 include diagnosis, prevention and treatment of diseases and clinical conditions associated with FLJ38773.

FLJ38944 (Accession NP_689574.1) is another GAM7957 target gene, herein designated TARGET GENE. FLJ38944 BINDING SITE1 and FLJ38944 BINDING SITE2 are target binding sites found in untranslated regions of mRNA encoded by FLJ38944, corresponding to target binding sites such as BINDING SITE I, BINDING SITE II or BINDING SITE III of FIG. 8. Table 4 illustrates the complementarity of the nucleotide sequences of FLJ38944 BINDING SITE1 and FLJ38944 BINDING SITE2, designated SEQ ID:1492 and SEQ ID:948 respectively, to the nucleotide sequence of GAM7957 RNA, herein designated GAM RNA, also designated SEQ ID:297.

Another function of GAM7957 is therefore inhibition of FLJ38944 (Accession NP_689574.1). Accordingly, utilities of GAM7957 include diagnosis, prevention and treatment of diseases and clinical conditions associated with FLJ38944.

FLJ38991 (Accession NP_776188.1) is another GAM7957 target gene, herein designated TARGET GENE. FLJ38991 BINDING SITE is a target binding site found in the 3' untranslated region of mRNA encoded by FLJ38991, corresponding to a target binding site such as BINDING SITE I, BINDING SITE II or BINDING SITE III of FIG. 8. Table 4 illustrates the complementarity of the nucleotide sequences of FLJ38991 BINDING SITE, designated SEQ ID:13139, to the nucleotide sequence of GAM7957 RNA, herein designated GAM RNA, also designated SEQ ID:297.

Another function of GAM7957 is therefore inhibition of FLJ38991 (Accession NP_776188.1). Accordingly, utilities of GAM7957 include diagnosis, prevention and treatment of diseases and clinical conditions associated with FLJ38991.

FLJ39005 (Accession NP_848616.1) is another GAM7957 target gene, herein designated TARGET GENE. FLJ39005 BINDING SITE is a target binding site found in the 3' untranslated region of mRNA encoded by FLJ39005, corresponding to a target binding site such as BINDING SITE I, BINDING SITE II or BINDING SITE III of FIG. 8. Table 4 illustrates the complementarity of the nucleotide sequences of FLJ39005 BINDING SITE, designated SEQ ID:12307, to the nucleotide sequence of GAM7957 RNA, herein designated GAM RNA, also designated SEQ ID:297.

Another function of GAM7957 is therefore inhibition of FLJ39005 (Accession NP_848616.1). Accordingly, utilities of GAM7957 include diagnosis, prevention and treatment of diseases and clinical conditions associated with FLJ39005.

FLJ39369 (Accession NP_689576.1) is another GAM7957 target gene, herein designated TARGET GENE. FLJ39369 BINDING SITE is a target binding site found in the 3' untranslated region of mRNA encoded by FLJ39369, corresponding to a target binding site such as BINDING SITE I, BINDING SITE II or BINDING SITE III of FIG. 8. Table 4 illustrates the complementarity of the nucleotide sequences of FLJ39369 BINDING SITE, designated SEQ ID:15223, to the nucleotide sequence of GAM7957 RNA, herein designated GAM RNA, also designated SEQ ID:297.

Another function of GAM7957 is therefore inhibition of FLJ39369 (Accession NP_689576.1). Accordingly, utilities of GAM7957 include diagnosis, prevention and treatment of diseases and clinical conditions associated with FLJ39369.

FLJ39415 (Accession NP_775952.1) is another GAM7957 target gene, herein designated TARGET GENE. FLJ39415 BINDING SITE is a target binding site found in the 3' untranslated region of mRNA encoded by FLJ39415, corresponding to a target binding site such as BINDING SITE I, BINDING SITE II or BINDING SITE III of FIG. 8. Table 4 illustrates the complementarity of the nucleotide sequences of FLJ39415 BINDING SITE, designated SEQ ID:14355, to the nucleotide sequence of GAM7957 RNA, herein designated GAM RNA, also designated SEQ ID:297.

Another function of GAM7957 is therefore inhibition of FLJ39415 (Accession NP_775952.1). Accordingly, utilities of GAM7957 include diagnosis, prevention and treatment of diseases and clinical conditions associated with FLJ39415.

FLJ39441 (Accession XP_084736.6) is another GAM7957 target gene, herein designated TARGET GENE. FLJ39441 BINDING SITE is a target binding site found in the 3' untranslated region of mRNA encoded by FLJ39441, corresponding to a target binding site such as BINDING SITE I, BINDING SITE II or BINDING SITE III of FIG. 8. Table 4 illustrates the complementarity of the nucleotide sequences of FLJ39441 BINDING SITE, designated SEQ ID:8873, to the nucleotide sequence of GAM7957 RNA, herein designated GAM RNA, also designated SEQ ID:297.

Another function of GAM7957 is therefore inhibition of FLJ39441 (Accession XP_084736.6). Accordingly, utilities of GAM7957 include diagnosis, prevention and treatment of diseases and clinical conditions associated with FLJ39441.

FLJ39653 (Accession NP_689897.1) is another GAM7957 target gene, herein designated TARGET GENE. FLJ39653 BINDING SITE1 and FLJ39653 BINDING SITE2 are target binding sites found in untranslated regions of mRNA encoded by FLJ39653, corresponding to target binding sites such as BINDING SITE I, BINDING SITE II or BINDING SITE III of FIG. 8. Table 4 illustrates the complementarity of the nucleotide sequences of FLJ39653 BINDING SITE1 and FLJ39653 BINDING SITE2, designated SEQ ID:13908 and SEQ ID:19119 respectively, to the nucleotide sequence of GAM7957 RNA, herein designated GAM RNA, also designated SEQ ID:297.

Another function of GAM7957 is therefore inhibition of FLJ39653 (Accession NP_689897.1). Accordingly, utilities of GAM7957 include diagnosis, prevention and treatment of diseases and clinical conditions associated with FLJ39653.

FLJ40160 (Accession NP_775755.2) is another GAM7957 target gene, herein designated TARGET GENE. FLJ40160 BINDING SITE is a target binding site found in the 3' untranslated region of mRNA encoded by FLJ40160, corresponding to a target binding site such as BINDING SITE I, BINDING SITE II or BINDING SITE III of FIG. 8. Table 4 illustrates the complementarity of the nucleotide sequences of FLJ40160 BINDING SITE, designated SEQ ID:15055, to the nucleotide sequence of GAM7957 RNA, herein designated GAM RNA, also designated SEQ ID:297.

Another function of GAM7957 is therefore inhibition of FLJ40160 (Accession NP_775755.2). Accordingly, utilities of GAM7957 include diagnosis, prevention and treatment of diseases and clinical conditions associated with FLJ40160.

FLJ40182 (Accession NP_775967.1) is another GAM7957 target gene, herein designated TARGET GENE. FLJ40182 BINDING SITE is a target binding site found in the 3' untranslated region of mRNA encoded by FLJ40182, corresponding to a target binding site such as BINDING SITE I, BINDING SITE II or BINDING SITE III of FIG. 8. Table 4 illustrates the complementarity of the nucleotide sequences of FLJ40182 BINDING SITE, designated SEQ ID:9550, to the nucleotide sequence of GAM7957 RNA, herein designated GAM RNA, also designated SEQ ID:297.

Another function of GAM7957 is therefore inhibition of FLJ40182 (Accession NP_775967.1). Accordingly, utilities of GAM7957 include diagnosis, prevention and treatment of diseases and clinical conditions associated with FLJ40182.

FLJ40288 (Accession NP_775953.1) is another GAM7957 target gene, herein designated TARGET GENE. FLJ40288 BINDING SITE is a target binding site found in the 3' untranslated region of mRNA encoded by FLJ40288, corresponding to a target binding site such as BINDING SITE I, BINDING SITE II or BINDING SITE III of FIG. 8. Table 4 illustrates the complementarity of the nucleotide sequences of FLJ40288 BINDING SITE, designated SEQ ID:17816, to the nucleotide sequence of GAM7957 RNA, herein designated GAM RNA, also designated SEQ ID:297.

Another function of GAM7957 is therefore inhibition of FLJ40288 (Accession NP_775953.1). Accordingly, utilities of GAM7957 include diagnosis, prevention and treatment of diseases and clinical conditions associated with FLJ40288.

FLJ40417 (Accession NP_775921.1) is another GAM7957 target gene, herein designated TARGET GENE. FLJ40417 BINDING SITE1 and FLJ40417 BINDING SITE2 are target binding sites found in untranslated regions of mRNA encoded by FLJ40417, corresponding to target binding sites such as BINDING SITE I, BINDING SITE II or BINDING SITE III of FIG. 8. Table 4 illustrates the complementarity of the nucleotide sequences of FLJ40417 BINDING SITE1 and FLJ40417 BINDING SITE2, designated SEQ ID:631 and SEQ ID:4629 respectively, to the nucleotide sequence of GAM7957 RNA, herein designated GAM RNA, also designated SEQ ID:297.

Another function of GAM7957 is therefore inhibition of FLJ40417 (Accession NP_775921.1). Accordingly, utilities of GAM7957 include diagnosis, prevention and treatment of diseases and clinical conditions associated with FLJ40417.

FLJ40542 (Accession NP_848598.1) is another GAM7957 target gene, herein designated TARGET GENE. FLJ40542 BINDING SITE is a target binding site found in the 3' untranslated region of mRNA encoded by FLJ40542, corresponding to a target binding site such as BINDING SITE I, BINDING SITE II or BINDING SITE III of FIG. 8. Table 4 illustrates the complementarity of the nucleotide sequences of FLJ40542 BINDING SITE, designated SEQ ID:14572, to the nucleotide sequence of GAM7957 RNA, herein designated GAM RNA, also designated SEQ ID:297.

Another function of GAM7957 is therefore inhibition of FLJ40542 (Accession NP_848598.1). Accordingly, utilities of GAM7957 include diagnosis, prevention and treatment of diseases and clinical conditions associated with FLJ40542.

FLJ90165 (Accession NP_699169.1) is another GAM7957 target gene, herein designated TARGET GENE. FLJ90165 BINDING SITE is a target binding site found in the 3' untranslated region of mRNA encoded by FLJ90165, corresponding to a target binding site such as BINDING SITE I, BINDING SITE II or BINDING SITE III of FIG. 8. Table 4 illustrates the complementarity of the nucleotide sequences of FLJ90165 BINDING SITE, designated SEQ ID:12468, to the nucleotide sequence of GAM7957 RNA, herein designated GAM RNA, also designated SEQ ID:297.

Another function of GAM7957 is therefore inhibition of FLJ90165 (Accession NP_699169.1). Accordingly, utilities of GAM7957 include diagnosis, prevention and treatment of diseases and clinical conditions associated with FLJ90165.

FLJ90652 (Accession NP_775889.1) is another GAM7957 target gene, herein designated TARGET GENE. FLJ90652 BINDING SITE is a target binding site found in the 3' untranslated region of mRNA encoded by FLJ90652, corresponding to a target binding site such as BINDING SITE I, BINDING SITE II or BINDING SITE III of FIG. 8. Table 4 illustrates the complementarity of the nucleotide sequences of FLJ90652 BINDING SITE, designated SEQ ID:7434, to the nucleotide sequence of GAM7957 RNA, herein designated GAM RNA, also designated SEQ ID:297.

Another function of GAM7957 is therefore inhibition of FLJ90652 (Accession NP_775889.1). Accordingly, utilities of GAM7957 include diagnosis, prevention and treatment of diseases and clinical conditions associated with FLJ90652.

FLJ90734 (Accession NP_699206.1) is another GAM7957 target gene, herein designated TARGET GENE. FLJ90734 BINDING SITE is a target binding site found in the 3' untranslated region of mRNA encoded by FLJ90734, corresponding to a target binding site such as BINDING SITE I, BINDING SITE II or BINDING SITE III of FIG. 8. Table 4 illustrates the complementarity of the nucleotide sequences of FLJ90734 BINDING SITE, designated SEQ ID:17403, to the nucleotide sequence of GAM7957 RNA, herein designated GAM RNA, also designated SEQ ID:297.

Another function of GAM7957 is therefore inhibition of FLJ90734 (Accession NP_699206.1). Accordingly, utilities of GAM7957 include diagnosis, prevention and treatment of diseases and clinical conditions associated with FLJ90734.

FLJ90798 (Accession NP_699198.1) is another GAM7957 target gene, herein designated TARGET GENE. FLJ90798 BINDING SITE is a target binding site found in the 3' untranslated region of mRNA encoded by FLJ90798, corresponding to a target binding site such as BINDING SITE I, BINDING SITE II or BINDING SITE III of FIG. 8. Table 4 illustrates the complementarity of the nucleotide sequences of FLJ90798 BINDING SITE, designated SEQ ID:19895, to the nucleotide sequence of GAM7957 RNA, herein designated GAM RNA, also designated SEQ ID:297.

Another function of GAM7957 is therefore inhibition of FLJ90798 (Accession NP_699198.1). Accordingly, utilities of GAM7957 include diagnosis, prevention and treatment of diseases and clinical conditions associated with FLJ90798.

FRSB (Accession NP_005678.2) is another GAM7957 target gene, herein designated TARGET GENE. FRSB BINDING SITE is a target binding site found in the 3' untranslated region of mRNA encoded by FRSB, corresponding to a target binding site such as BINDING SITE I, BINDING SITE II or BINDING SITE III of FIG. 8. Table 4 illustrates the complementarity of the nucleotide sequences of FRSB BINDING SITE, designated SEQ ID:9067, to the nucleotide sequence of GAM7957 RNA, herein designated GAM RNA, also designated SEQ ID:297.

Another function of GAM7957 is therefore inhibition of FRSB (Accession NP_005678.2). Accordingly, utilities of GAM7957 include diagnosis, prevention and treatment of diseases and clinical conditions associated with FRSB.

Fus interacting protein (serine-arginine rich) 1 (FUSIP1, Accession NP_473357.1) is another GAM7957 target gene, herein designated TARGET GENE. FUSIP1 BINDING SITE is a target binding site found in the 3' untranslated region of multiple transcripts of mRNA encoded by FUSIP1, corresponding to a target binding site such as BINDING SITE I, BINDING SITE II or BINDING SITE III of FIG. 8. Table 4 illustrates the complementarity of the nucleotide sequences of FUSIP1 BINDING SITE, designated SEQ ID:14886, to the nucleotide sequence of GAM7957 RNA, herein designated GAM RNA, also designated SEQ ID:297.

Another function of GAM7957 is therefore inhibition of Fus interacting protein (serine-arginine rich) 1 (FUSIP1, Accession NP_473357.1). Accordingly, utilities of GAM7957 include diagnosis, prevention and treatment of diseases and clinical conditions associated with FUSIP1.

Fucosyltransferase 6 (alpha (1,3) fucosyltransferase) (FUT6, Accession NP_000141.1) is another GAM7957 target gene, herein designated TARGET GENE. FUT6 BINDING SITE is a target binding site found in the 3' untranslated region of mRNA encoded by FUT6, corresponding to a target binding site such as BINDING SITE I, BINDING SITE II or BINDING SITE III of FIG. 8. Table 4 illustrates the complementarity of the nucleotide sequences of FUT6 BINDING SITE, designated SEQ ID:3076, to the nucleotide sequence of GAM7957 RNA, herein designated GAM RNA, also designated SEQ ID:297.

Another function of GAM7957 is therefore inhibition of Fucosyltransferase 6 (alpha (1,3) fucosyltransferase) (FUT6, Accession NP_000141.1), a gene which is involved in the biosynthesis of the e-selectin ligand, sialyl-lewis x. catalyzes the transfer of fucose from gdp-beta-fucose to alpha-2,3 sialylated substrates. Accordingly, utilities of GAM7957 include diagnosis, prevention and treatment of diseases and clinical conditions associated with FUT6.

The function of FUT6 and its association with various diseases and clinical conditions, has been established by previous studies, as described hereinabove with reference to GAM47.1. Frizzled homolog 2 (drosophila) (FZD2, Accession NP_001457.1) is another GAM7957 target gene, herein designated TARGET GENE. FZD2 BINDING SITE is a target binding site found in the 5' untranslated region of mRNA encoded by FZD2, corresponding to a target binding site such as BINDING SITE I, BINDING SITE II or BINDING SITE III of FIG. 8. Table 4 illustrates the complementarity of the nucleotide sequences of FZD2 BINDING SITE, designated SEQ ID:19131, to the nucleotide sequence of GAM7957 RNA, herein designated GAM RNA, also designated SEQ ID:297.

Another function of GAM7957 is therefore inhibition of Frizzled homolog 2 (drosophila) (FZD2, Accession NP_001457.1), a gene which is a putative receptor with a role in transmembrane signal transmission. Accordingly, utilities of GAM7957 include diagnosis, prevention and treatment of diseases and clinical conditions associated with FZD2.

The function of FZD2 and its association with various diseases and clinical conditions, has been established by previous studies, as described hereinabove with reference to GAM374.1. Udp-n-acetyl-alpha-d-galactosamine:polypeptide n-acetylgalactosaminyltransferase 6 (galnac-t6) (GALNT6, Accession NP_009141.1) is another GAM7957 target gene, herein designated TARGET GENE. GALNT6 BINDING SITE is a target binding site found in the 3' untranslated region of mRNA encoded by GALNT6, corresponding to a target binding site such as BINDING SITE I, BINDING SITE II or BINDING SITE III of FIG. 8. Table 4 illustrates the complementarity of the nucleotide sequences of GALNT6 BINDING SITE, designated SEQ ID:10435, to the nucleotide sequence of GAM7957 RNA, herein designated GAM RNA, also designated SEQ ID:297.

Another function of GAM7957 is therefore inhibition of Udp-n-acetyl-alpha-d-galactosamine:polypeptide n-acetylgalactosaminyltransferase 6 (galnac-t6) (GALNT6, Accession NP_009141.1). Accordingly, utilities of GAM7957 include diagnosis, prevention and treatment of diseases and clinical conditions associated with GALNT6.

Udp-n-acetyl-alpha-d-galactosamine:polypeptide n-acetylgalactosaminyltransferase 7 (galnac-t7) (GALNT7, Accession NP_473451.2) is another GAM7957 target gene, herein designated TARGET GENE. GALNT7 BINDING SITE is a target binding site found in the 3' untranslated region of multiple transcripts of mRNA encoded by GALNT7, corresponding to a target binding site such as BINDING SITE I, BINDING SITE II or BINDING SITE III of FIG. 8. Table 4 illustrates the complementarity of the nucleotide sequences of GALNT7 BINDING SITE, designated SEQ ID:17403, to the nucleotide sequence of GAM7957 RNA, herein designated GAM RNA, also designated SEQ ID:297.

Another function of GAM7957 is therefore inhibition of Udp-n-acetyl-alpha-d-galactosamine:polypeptide n-acetylgalactosaminyltransferase 7 (galnac-t7) (GALNT7, Accession NP_473451.2). Accordingly, utilities of GAM7957 include diagnosis, prevention and treatment of diseases and clinical conditions associated with GALNT7.

Galactose-1-phosphate uridylyltransferase (GALT, Accession NP_667342.1) is another GAM7957 target gene, herein designated TARGET GENE. GALT BINDING SITE is a target binding site found in the 3' untranslated region of multiple transcripts of mRNA encoded by GALT, corresponding to a target binding site such as BINDING SITE I, BINDING SITE II or BINDING SITE III of FIG. 8. Table 4 illustrates the complementarity of the nucleotide sequences of GALT BINDING SITE, designated SEQ ID:14368, to the nucleotide sequence of GAM7957 RNA, herein designated GAM RNA, also designated SEQ ID:297.

Another function of GAM7957 is therefore inhibition of Galactose-1-phosphate uridylyltransferase (GALT, Accession NP_667342.1). Accordingly, utilities of GAM7957 include diagnosis, prevention and treatment of diseases and clinical conditions associated with GALT.

Galactose-1-phosphate uridylyltransferase (GALT, Accession NP_667343.1) is another GAM7957 target gene, herein designated TARGET GENE. GALT BINDING SITE is a target binding site found in the 3' untranslated region of multiple transcripts of mRNA encoded by GALT, corresponding to a target binding site such as BINDING SITE I, BINDING SITE II or BINDING SITE III of FIG. 8. Table 4 illustrates the complementarity of the nucleotide sequences of GALT BINDING SITE, designated SEQ ID:14368, to the nucleotide sequence of GAM7957 RNA, herein designated GAM RNA, also designated SEQ ID:297.

Another function of GAM7957 is therefore inhibition of Galactose-1-phosphate uridylyltransferase (GALT, Accession NP_667343.1). Accordingly, utilities of GAM7957 include diagnosis, prevention and treatment of diseases and clinical conditions associated with GALT.

Growth arrest-specific 7 (GAS7, Accession NP_005881.1) is another GAM7957 target gene, herein designated TARGET GENE. GAS7 BINDING SITE is a target binding site found in the 3' untranslated region of multiple transcripts of mRNA encoded by GAS7, corresponding to a target binding site such as BINDING SITE I, BINDING SITE II or BINDING SITE III of FIG. 8. Table 4 illustrates the complementarity of the nucleotide sequences of GAS7 BINDING SITE, designated SEQ ID:19102, to the nucleotide sequence of GAM7957 RNA, herein designated GAM RNA, also designated SEQ ID:297.

Another function of GAM7957 is therefore inhibition of Growth arrest-specific 7 (GAS7, Accession NP_005881.1), a gene which may play a role in promoting maturation and morphological differentiation of cerebellar neurons. and therefore may be associated with Leukemias with myeloid/lymphoid (mll). Accordingly, utilities of GAM7957 include diagnosis, prevention and treatment of Leukemias with myeloid/lymphoid (mll), and of other diseases and clinical conditions associated with GAS7.

The function of GAS7 and its association with various diseases and clinical conditions, has been established by previous studies, as described hereinabove with reference to GAM72.1. GATS (Accession NP_849153.1) is another GAM7957 target gene, herein designated TARGET GENE. GATS BINDING SITE is a target binding site found in the 5' untranslated region of mRNA encoded by GATS, corresponding to a target binding site such as BINDING SITE I, BINDING SITE II or BINDING SITE III of FIG. 8. Table 4 illustrates the complementarity of the nucleotide sequences of GATS BINDING SITE, designated SEQ ID:19105, to the nucleotide sequence of GAM7957 RNA, herein designated GAM RNA, also designated SEQ ID:297.

Another function of GAM7957 is therefore inhibition of GATS (Accession NP_849153.1). Accordingly, utilities of GAM7957 include diagnosis, prevention and treatment of diseases and clinical conditions associated with GATS.

GBP4 (Accession NP_443173.2) is another GAM7957 target gene, herein designated TARGET GENE. GBP4 BINDING SITE1 and GBP4 BINDING SITE2 are target binding sites found in untranslated regions of mRNA encoded by GBP4, corresponding to target binding sites such as BINDING SITE I, BINDING SITE II or BINDING SITE III of FIG. 8. Table 4 illustrates the complementarity of the nucleotide sequences of GBP4 BINDING SITE1 and GBP4 BINDING SITE2, designated SEQ ID:4182 and SEQ ID:14599 respectively, to the nucleotide sequence of GAM7957 RNA, herein designated GAM RNA, also designated SEQ ID:297.

Another function of GAM7957 is therefore inhibition of GBP4 (Accession NP_443173.2). Accordingly, utilities of GAM7957 include diagnosis, prevention and treatment of diseases and clinical conditions associated with GBP4.

Glucosaminyl (n-acetyl) transferase 2, i-branching enzyme (GCNT2, Accession NP_001482.1) is another GAM7957 target gene, herein designated TARGET GENE. GCNT2 BINDING SITE is a target binding site found in the 5' untranslated region of multiple transcripts of mRNA encoded by GCNT2, corresponding to a target binding site such as BINDING SITE I, BINDING SITE II or BINDING SITE III of FIG. 8. Table 4 illustrates the complementarity of the nucleotide sequences of GCNT2 BINDING SITE, designated SEQ ID:9733, to the nucleotide sequence of GAM7957 RNA, herein designated GAM RNA, also designated SEQ ID:297.

Another function of GAM7957 is therefore inhibition of Glucosaminyl (n-acetyl) transferase 2, i-branching enzyme (GCNT2, Accession NP_001482.1), a gene which converts linear into branched poly-n-acetyllactosaminoglycans. Accordingly, utilities of GAM7957 include diagnosis, prevention and treatment of diseases and clinical conditions associated with GCNT2.

The function of GCNT2 and its association with various diseases and clinical conditions, has been established by previous studies, as described hereinabove with reference to GAM205.2. Growth differentiation factor 11 (GDF11, Accession NP_005802.1) is another GAM7957 target gene, herein designated TARGET GENE. GDF11 BINDING SITE is a target binding site found in the 3' untranslated region of mRNA encoded by GDF11, corresponding to a target binding site such as BINDING SITE I, BINDING SITE II or BINDING SITE III of FIG. 8. Table 4 illustrates the complementarity of the nucleotide sequences of GDF11 BINDING SITE, designated SEQ ID:5161, to the nucleotide sequence of GAM7957 RNA, herein designated GAM RNA, also designated SEQ ID:297.

Another function of GAM7957 is therefore inhibition of Growth differentiation factor 11 (GDF11, Accession NP_005802.1). Accordingly, utilities of GAM7957 include diagnosis, prevention and treatment of diseases and clinical conditions associated with GDF11.

Gamma-glutamyl carboxylase (GGCX, Accession NP_000812.2) is another GAM7957 target gene, herein designated TARGET GENE. GGCX BINDING SITE is a target binding site found in the 3' untranslated region of mRNA encoded by GGCX, corresponding to a target binding site such as BINDING SITE I, BINDING SITE II or BINDING SITE III of FIG. 8. Table 4 illustrates the complementarity of the nucleotide sequences of GGCX BINDING SITE, designated SEQ ID:17049, to the nucleotide sequence of GAM7957 RNA, herein designated GAM RNA, also designated SEQ ID:297.

Another function of GAM7957 is therefore inhibition of Gamma-glutamyl carboxylase (GGCX, Accession NP_000812.2). Accordingly, utilities of GAM7957 include diagnosis, prevention and treatment of diseases and clinical conditions associated with GGCX.

GL012 (Accession NP_110441.1) is another GAM7957 target gene, herein designated TARGET GENE. GL012 BINDING SITE is a target binding site found in the 3' untranslated region of mRNA encoded by GL012, corresponding to a target binding site such as BINDING SITE I, BINDING SITE II or BINDING SITE III of FIG. 8. Table 4 illustrates the complementarity of the nucleotide sequences of GL012 BINDING SITE, designated SEQ ID:1572, to the nucleotide sequence of GAM7957 RNA, herein designated GAM RNA, also designated SEQ ID:297.

Another function of GAM7957 is therefore inhibition of GL012 (Accession NP_110441.1). Accordingly, utilities of GAM7957 include diagnosis, prevention and treatment of diseases and clinical conditions associated with GL012.

GLTP (Accession NP_057517.1) is another GAM7957 target gene, herein designated TARGET GENE. GLTP BINDING SITE is a target binding site found in the 3' untranslated region of mRNA encoded by GLTP, corresponding to a target binding site such as BINDING SITE I, BINDING SITE II or BINDING SITE III of FIG. 8. Table 4 illustrates the complementarity of the nucleotide sequences of GLTP BINDING SITE, designated SEQ ID:17424, to the nucleotide sequence of GAM7957 RNA, herein designated GAM RNA, also designated SEQ ID:297.

Another function of GAM7957 is therefore inhibition of GLTP (Accession NP_057517.1). Accordingly, utilities of GAM7957 include diagnosis, prevention and treatment of diseases and clinical conditions associated with GLTP.

GNB4 (Accession NP_067642.1) is another GAM7957 target gene, herein designated TARGET GENE. GNB4 BINDING SITE1 and GNB4 BINDING SITE2 are target binding sites found in untranslated regions of mRNA encoded by GNB4, corresponding to target binding sites such as BINDING SITE I, BINDING SITE II or BINDING SITE III of FIG. 8. Table 4 illustrates the complementarity of the nucleotide sequences of GNB4 BINDING SITE1 and GNB4 BINDING SITE2, designated SEQ ID:10438 and SEQ ID:16402 respectively, to the nucleotide sequence of GAM7957 RNA, herein designated GAM RNA, also designated SEQ ID:297.

Another function of GAM7957 is therefore inhibition of GNB4 (Accession NP_067642.1). Accordingly, utilities of GAM7957 include diagnosis, prevention and treatment of diseases and clinical conditions associated with GNB4.

GNE (Accession NP_005467.1) is another GAM7957 target gene, herein designated TARGET GENE. GNE BINDING SITE is a target binding site found in the 3' untranslated region of mRNA encoded by GNE, corresponding to a target binding site such as BINDING SITE I, BINDING SITE II or BINDING SITE III of FIG. 8. Table 4 illustrates the complementarity of the nucleotide sequences of GNE BINDING SITE, designated SEQ ID:15108, to the nucleotide sequence of GAM7957 RNA, herein designated GAM RNA, also designated SEQ ID:297.

Another function of GAM7957 is therefore inhibition of GNE (Accession NP_005467.1), a gene which has roles in sialic acid biosynthesis and regulates cell surface sialylation.

Accordingly, utilities of GAM7957 include diagnosis, prevention and treatment of diseases and clinical conditions associated with GNE.

The function of GNE and its association with various diseases and clinical conditions, has been established by previous studies, as described hereinabove with reference to GAM189.1. Guanine nucleotide binding protein (g protein), gamma 11 (GNG11, Accession NP_004117.1) is another GAM7957 target gene, herein designated TARGET GENE. GNG11 BINDING SITE is a target binding site found in the 5' untranslated region of mRNA encoded by GNG11, corresponding to a target binding site such as BINDING SITE I, BINDING SITE II or BINDING SITE III of FIG. 8. Table 4 illustrates the complementarity of the nucleotide sequences of GNG11 BINDING SITE, designated SEQ ID:2988, to the nucleotide sequence of GAM7957 RNA, herein designated GAM RNA, also designated SEQ ID:297.

Another function of GAM7957 is therefore inhibition of Guanine nucleotide binding protein (g protein), gamma 11 (GNG11, Accession NP_004117.1). Accordingly, utilities of GAM7957 include diagnosis, prevention and treatment of diseases and clinical conditions associated with GNG11.

GNPNAT1 (Accession XP_085119.1) is another GAM7957 target gene, herein designated TARGET GENE. GNPNAT1 BINDING SITE is a target binding site found in the 3' untranslated region of mRNA encoded by GNPNAT1, corresponding to a target binding site such as BINDING SITE I, BINDING SITE II or BINDING SITE III of FIG. 8. Table 4 illustrates the complementarity of the nucleotide sequences of GNPNAT1 BINDING SITE, designated SEQ ID:17400, to the nucleotide sequence of GAM7957 RNA, herein designated GAM RNA, also designated SEQ ID:297.

Another function of GAM7957 is therefore inhibition of GNPNAT1 (Accession XP_085119.1). Accordingly, utilities of GAM7957 include diagnosis, prevention and treatment of diseases and clinical conditions associated with GNPNAT1.

Golgi autoantigen, golgin subfamily a, 2 (GOLGA2, Accession NP_004477.2) is another GAM7957 target gene, herein designated TARGET GENE. GOLGA2 BINDING SITE1 and GOLGA2 BINDING SITE2 are target binding sites found in untranslated regions of mRNA encoded by GOLGA2, corresponding to target binding sites such as BINDING SITE I, BINDING SITE II or BINDING SITE III of FIG. 8. Table 4 illustrates the complementarity of the nucleotide sequences of GOLGA2 BINDING SITE1 and GOLGA2 BINDING SITE2, designated SEQ ID:5830 and SEQ ID:6239 respectively, to the nucleotide sequence of GAM7957 RNA, herein designated GAM RNA, also designated SEQ ID:297.

Another function of GAM7957 is therefore inhibition of Golgi autoantigen, golgin subfamily a, 2 (GOLGA2, Accession NP_004477.2). Accordingly, utilities of GAM7957 include diagnosis, prevention and treatment of diseases and clinical conditions associated with GOLGA2.

GOLGIN-67 (Accession NP_851421.1) is another GAM7957 target gene, herein designated TARGET GENE. GOLGIN-67 BINDING SITE is a target binding site found in the 5' untranslated region of multiple transcripts of mRNA encoded by GOLGIN-67, corresponding to a target binding site such as BINDING SITE I, BINDING SITE II or BINDING SITE III of FIG. 8. Table 4 illustrates the complementarity of the nucleotide sequences of GOLGIN-67 BINDING SITE, designated SEQ ID:9854, to the nucleotide sequence of GAM7957 RNA, herein designated GAM RNA, also designated SEQ ID:297.

Another function of GAM7957 is therefore inhibition of GOLGIN-67 (Accession NP_851421.1). Accordingly, utilities of GAM7957 include diagnosis, prevention and treatment of diseases and clinical conditions associated with GOLGIN-67.

Glycoprotein 2 (zymogen granule membrane) (GP2, Accession NP_001493.1) is another GAM7957 target gene, herein designated TARGET GENE. GP2 BINDING SITE is a target binding site found in the 3' untranslated region of mRNA encoded by GP2, corresponding to a target binding site such as BINDING SITE I, BINDING SITE II or BINDING SITE III of FIG. 8. Table 4 illustrates the complementarity of the nucleotide sequences of GP2 BINDING SITE, designated SEQ ID:3379, to the nucleotide sequence of GAM7957 RNA, herein designated GAM RNA, also designated SEQ ID:297.

Another function of GAM7957 is therefore inhibition of Glycoprotein 2 (zymogen granule membrane) (GP2, Accession NP_001493.1), a gene which expresses in the secretory granule of the exocrine pancreas. Accordingly, utilities of GAM7957 include diagnosis, prevention and treatment of diseases and clinical conditions associated with GP2.

The function of GP2 and its association with various diseases and clinical conditions, has been established by previous studies, as described hereinabove with reference to GAM347.1. Glycoprotein v (platelet) (GP5, Accession NP_004479.1) is another GAM7957 target gene, herein designated TARGET GENE. GP5 BINDING SITE is a target binding site found in the 3' untranslated region of mRNA encoded by GP5, corresponding to a target binding site such as BINDING SITE I, BINDING SITE II or BINDING SITE III of FIG. 8. Table 4 illustrates the complementarity of the nucleotide sequences of GP5 BINDING SITE, designated SEQ ID:9421, to the nucleotide sequence of GAM7957 RNA, herein designated GAM RNA, also designated SEQ ID:297.

Another function of GAM7957 is therefore inhibition of Glycoprotein v (platelet) (GP5, Accession NP_004479.1). Accordingly, utilities of GAM7957 include diagnosis, prevention and treatment of diseases and clinical conditions associated with GP5.

Glycoprotein a33 (transmembrane) (GPA33, Accession NP_005805.1) is another GAM7957 target gene, herein designated TARGET GENE. GPA33 BINDING SITE is a target binding site found in the 5' untranslated region of mRNA encoded by GPA33, corresponding to a target binding site such as BINDING SITE I, BINDING SITE II or BINDING SITE III of FIG. 8. Table 4 illustrates the complementarity of the nucleotide sequences of GPA33 BINDING SITE, designated SEQ ID:16908, to the nucleotide sequence of GAM7957 RNA, herein designated GAM RNA, also designated SEQ ID:297.

Another function of GAM7957 is therefore inhibition of Glycoprotein a33 (transmembrane) (GPA33, Accession NP_005805.1). Accordingly, utilities of GAM7957 include diagnosis, prevention and treatment of diseases and clinical conditions associated with GPA33.

G protein-coupled receptor 1 (GPR1, Accession NP_005270.1) is another GAM7957 target gene, herein designated TARGET GENE. GPR1 BINDING SITE1 and GPR1 BINDING SITE2 are target binding sites found in untranslated regions of mRNA encoded by GPR1, corresponding to target binding sites such as BINDING SITE I, BINDING SITE II or BINDING SITE III of FIG. 8. Table 4 illustrates the complementarity of the nucleotide sequences of GPR1 BINDING SITE1 and GPR1 BINDING SITE2, designated SEQ ID:10434 and SEQ ID:2031 respectively, to the nucleotide sequence of GAM7957 RNA, herein designated GAM RNA, also designated SEQ ID:297.

Another function of GAM7957 is therefore inhibition of G protein-coupled receptor 1 (GPR1, Accession NP_005270.1), a gene which is an orphan receptor. Accordingly, utilities of GAM7957 include diagnosis, prevention and treatment of diseases and clinical conditions associated with GPR1.

The function of GPR1 and its association with various diseases and clinical conditions, has been established by previous studies, as described hereinabove with reference to GAM207.2. GRAF (Accession NP_055886.1) is another GAM7957 target gene, herein designated TARGET GENE. GRAF BINDING SITE is a target binding site found in the 3' untranslated region of mRNA encoded by GRAF, corresponding to a target binding site such as BINDING SITE I, BINDING SITE II or BINDING SITE III of FIG. 8. Table 4 illustrates the complementarity of the nucleotide sequences of GRAF BINDING SITE, designated SEQ ID:14162, to the nucleotide sequence of GAM7957 RNA, herein designated GAM RNA, also designated SEQ ID:297.

Another function of GAM7957 is therefore inhibition of GRAF (Accession NP_055886.1), a gene which ia a GTPase activating protein for p21-rac and therefore may be associated with Juvenile myelomonocytic leukemia. Accordingly, utilities of GAM7957 include diagnosis, prevention and treatment of Juvenile myelomonocytic leukemia, and of other diseases and clinical conditions associated with GRAF.

The function of GRAF and its association with various diseases and clinical conditions, has been established by previous studies, as described hereinabove with reference to GAM189.1. GREB1 (Accession NP_683701.1) is another GAM7957 target gene, herein designated TARGET GENE. GREB1 BINDING SITE is a target binding site found in the 3' untranslated region of multiple transcripts of mRNA encoded by GREB1, corresponding to a target binding site such as BINDING SITE I, BINDING SITE II or BINDING SITE III of FIG. 8. Table 4 illustrates the complementarity of the nucleotide sequences of GREB1 BINDING SITE, designated SEQ ID:13343, to the nucleotide sequence of GAM7957 RNA, herein designated GAM RNA, also designated SEQ ID:297.

Another function of GAM7957 is therefore inhibition of GREB1 (Accession NP_683701.1). Accordingly, utilities of GAM7957 include diagnosis, prevention and treatment of diseases and clinical conditions associated with GREB1.

Glutamate receptor, metabotropic 6 (GRM6, Accession NP_000834.1) is another GAM7957 target gene, herein designated TARGET GENE. GRM6 BINDING SITE is a target binding site found in the 3' untranslated region of mRNA encoded by GRM6, corresponding to a target binding site such as BINDING SITE I, BINDING SITE II or BINDING SITE III of FIG. 8. Table 4 illustrates the complementarity of the nucleotide sequences of GRM6 BINDING SITE, designated SEQ ID:9275, to the nucleotide sequence of GAM7957 RNA, herein designated GAM RNA, also designated SEQ ID:297.

Another function of GAM7957 is therefore inhibition of Glutamate receptor, metabotropic 6 (GRM6, Accession NP_000834.1). Accordingly, utilities of GAM7957 include diagnosis, prevention and treatment of diseases and clinical conditions associated with GRM6.

GRTP1 (Accession NP_078995.1) is another GAM7957 target gene, herein designated TARGET GENE. GRTP1 BINDING SITE is a target binding site found in the 3' untranslated region of mRNA encoded by GRTP1, corresponding to a target binding site such as BINDING SITE I, BINDING SITE II or BINDING SITE III of FIG. 8. Table 4 illustrates the complementarity of the nucleotide sequences of GRTP1 BINDING SITE, designated SEQ ID:18691, to the nucleotide sequence of GAM7957 RNA, herein designated GAM RNA, also designated SEQ ID:297.

Another function of GAM7957 is therefore inhibition of GRTP1 (Accession NP_078995.1). Accordingly, utilities of GAM7957 include diagnosis, prevention and treatment of diseases and clinical conditions associated with GRTP1.

GSG2 (Accession NP_114171.1) is another GAM7957 target gene, herein designated TARGET GENE. GSG2 BINDING SITE is a target binding site found in the 3' untranslated region of mRNA encoded by GSG2, corresponding to a target binding site such as BINDING SITE I, BINDING SITE II or BINDING SITE III of FIG. 8. Table 4 illustrates the complementarity of the nucleotide sequences of GSG2 BINDING SITE, designated SEQ ID:19193, to the nucleotide sequence of GAM7957 RNA, herein designated GAM RNA, also designated SEQ ID:297.

Another function of GAM7957 is therefore inhibition of GSG2 (Accession NP_114171.1). Accordingly, utilities of GAM7957 include diagnosis, prevention and treatment of diseases and clinical conditions associated with GSG2.

General transcription factor iif, polypeptide 1, 74 kda (GTF2F1, Accession NP_002087.1) is another GAM7957 target gene, herein designated TARGET GENE. GTF2F1 BINDING SITE is a target binding site found in the 3' untranslated region of mRNA encoded by GTF2F1, corresponding to a target binding site such as BINDING SITE I, BINDING SITE II or BINDING SITE III of FIG. 8. Table 4 illustrates the complementarity of the nucleotide sequences of GTF2F1 BINDING SITE, designated SEQ ID:13402, to the nucleotide sequence of GAM7957 RNA, herein designated GAM RNA, also designated SEQ ID:297.

Another function of GAM7957 is therefore inhibition of General transcription factor iif, polypeptide 1, 74 kda (GTF2F1, Accession NP_002087.1), a gene which helps to recruit it to the initiation complex in collaboration with tfiib. it promotes transcription elongation. Accordingly, utilities of GAM7957 include diagnosis, prevention and treatment of diseases and clinical conditions associated with GTF2F1.

The function of GTF2F1 and its association with various diseases and clinical conditions, has been established by previous studies, as described hereinabove with reference to GAM223.1. Gtp binding protein 5 (putative) (GTPBP5, Accession NP_056481.1) is another GAM7957 target gene, herein designated TARGET GENE. GTPBP5 BINDING SITE1 through GTPBP5 BINDING SITE3 are target binding sites found in untranslated regions of mRNA encoded by GTPBP5, corresponding to target binding sites such as BINDING SITE I, BINDING SITE II or BINDING SITE III of FIG. 8. Table 4 illustrates the complementarity of the nucleotide sequences of GTPBP5 BINDING SITE1 through GTPBP5 BINDING SITE3, designated SEQ ID:2483, SEQ ID:12059 and SEQ ID:15564 respectively, to the nucleotide sequence of GAM7957 RNA, herein designated GAM RNA, also designated SEQ ID:297.

Another function of GAM7957 is therefore inhibition of Gtp binding protein 5 (putative) (GTPBP5, Accession NP_056481.1). Accordingly, utilities of GAM7957 include diagnosis, prevention and treatment of diseases and clinical conditions associated with GTPBP5.

Granzyme h (cathepsin g-like 2, protein h-ccpx) (GZMH, Accession NP_219491.1) is another GAM7957 target gene, herein designated TARGET GENE. GZMH BINDING SITE is a target binding site found in the 3' untranslated region of mRNA encoded by GZMH, corresponding to a target binding site such as BINDING SITE I, BINDING SITE II or BINDING SITE III of FIG. 8. Table 4 illustrates the complementarity of the nucleotide sequences of GZMH BINDING SITE, designated SEQ ID:6446, to the nucleotide sequence of GAM7957 RNA, herein designated GAM RNA, also designated SEQ ID:297.

Another function of GAM7957 is therefore inhibition of Granzyme h (cathepsin g-like 2, protein h-ccpx) (GZMH, Accession NP_219491.1). Accordingly, utilities of GAM7957 include diagnosis, prevention and treatment of diseases and clinical conditions associated with GZMH.

H2-ALPHA (Accession XP_054284.3) is another GAM7957 target gene, herein designated TARGET GENE. H2-ALPHA BINDING SITE is a target binding site found in the 5' untranslated region of mRNA encoded by H2-ALPHA, corresponding to a target binding site such as BINDING SITE I, BINDING SITE II or BINDING SITE III of FIG. 8. Table 4 illustrates the complementarity of the nucleotide sequences of H2-ALPHA BINDING SITE, designated SEQ ID:15749, to the nucleotide sequence of GAM7957 RNA, herein designated GAM RNA, also designated SEQ ID:297.

Another function of GAM7957 is therefore inhibition of H2-ALPHA (Accession XP_054284.3). Accordingly, utilities of GAM7957 include diagnosis, prevention and treatment of diseases and clinical conditions associated with H2-ALPHA.

H2a histone family, member x (H2AFX, Accession NP_002096.1) is another GAM7957 target gene, herein designated TARGET GENE. H2AFX BINDING SITE is a target binding site found in the 3' untranslated region of mRNA encoded by H2AFX, corresponding to a target binding site such as BINDING SITE I, BINDING SITE II or BINDING SITE III of FIG. 8. Table 4 illustrates the complementarity of the nucleotide sequences of H2AFX BINDING SITE, designated SEQ ID:2926, to the nucleotide sequence of GAM7957 RNA, herein designated GAM RNA, also designated SEQ ID:297.

Another function of GAM7957 is therefore inhibition of H2a histone family, member x (H2AFX, Accession NP_002096.1). Accordingly, utilities of GAM7957 include diagnosis, prevention and treatment of diseases and clinical conditions associated with H2AFX.

Hbs1-like (s. cerevisiae) (HBS1L, Accession NP_006611.1) is another GAM7957 target gene, herein designated TARGET GENE. HBS1L BINDING SITE is a target binding site found in the 3' untranslated region of mRNA encoded by HBS1L, corresponding to a target binding site such as BINDING SITE I, BINDING SITE II or BINDING SITE III of FIG. 8. Table 4 illustrates the complementarity of the nucleotide sequences of HBS1L BINDING SITE, designated SEQ ID:12190, to the nucleotide sequence of GAM7957 RNA, herein designated GAM RNA, also designated SEQ ID:297.

Another function of GAM7957 is therefore inhibition of Hbs1-like (s. cerevisiae) (HBS1L, Accession NP_006611.1). Accordingly, utilities of GAM7957 include diagnosis, prevention and treatment of diseases and clinical conditions associated with HBS1L.

HCGIX (Accession NP_005835.2) is another GAM7957 target gene, herein designated TARGET GENE. HCGIX BINDING SITE is a target binding site found in the 3' untranslated region of mRNA encoded by HCGIX, corresponding to a target binding site such as BINDING SITE I, BINDING SITE II or BINDING SITE III of FIG. 8. Table 4 illustrates the complementarity of the nucleotide sequences of HCGIX BINDING SITE, designated SEQ ID:641, to the nucleotide sequence of GAM7957 RNA, herein designated GAM RNA, also designated SEQ ID:297.

Another function of GAM7957 is therefore inhibition of HCGIX (Accession NP_005835.2). Accordingly, utilities of GAM7957 include diagnosis, prevention and treatment of diseases and clinical conditions associated with HCGIX.

HCNGP (Accession NP_037392.1) is another GAM7957 target gene, herein designated TARGET GENE. HCNGP BINDING SITE1 and HCNGP BINDING SITE2 are target binding sites found in untranslated regions of mRNA encoded by HCNGP, corresponding to target binding sites such as BINDING SITE I, BINDING SITE II or BINDING SITE III of FIG. 8. Table 4 illustrates the complementarity of the nucleotide sequences of HCNGP BINDING SITE1 and HCNGP BINDING SITE2, designated SEQ ID:15274 and SEQ ID:20026 respectively, to the nucleotide sequence of GAM7957 RNA, herein designated GAM RNA, also designated SEQ ID:297.

Another function of GAM7957 is therefore inhibition of HCNGP (Accession NP_037392.1). Accordingly, utilities of GAM7957 include diagnosis, prevention and treatment of diseases and clinical conditions associated with HCNGP.

HEMK (Accession NP_057257.1) is another GAM7957 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:9386, to the nucleotide sequence of GAM7957 RNA, herein designated GAM RNA, also designated SEQ ID:297.

Another function of GAM7957 is therefore inhibition of HEMK (Accession NP_057257.1). Accordingly, utilities of GAM7957 include diagnosis, prevention and treatment of diseases and clinical conditions associated with HEMK.

HES2 (Accession XP_290879.1) is another GAM7957 target gene, herein designated TARGET GENE. HES2 BINDING SITE1 through HES2 BINDING SITE3 are target binding sites found in untranslated regions of mRNA encoded by HES2, corresponding to target binding sites such as BINDING SITE I, BINDING SITE II or BINDING SITE III of FIG. 8. Table 4 illustrates the complementarity of the nucleotide sequences of HES2 BINDING SITE1 through HES2 BINDING SITE3, designated SEQ ID:19032, SEQ ID:5827 and SEQ ID:15984 respectively, to the nucleotide sequence of GAM7957 RNA, herein designated GAM RNA, also designated SEQ ID:297.

Another function of GAM7957 is therefore inhibition of HES2 (Accession XP_290879.1). Accordingly, utilities of GAM7957 include diagnosis, prevention and treatment of diseases and clinical conditions associated with HES2.

Hairy and enhancer of split 6 (drosophila) (HES6, Accession NP_061115.2) is another GAM7957 target gene, herein designated TARGET GENE. HES6 BINDING SITE is a target binding site found in the 3' untranslated region of mRNA encoded by HES6, corresponding to a target binding site such as BINDING SITE I, BINDING SITE II or BINDING SITE III of FIG. 8. Table 4 illustrates the complementarity of the nucleotide sequences of HES6 BINDING SITE, designated SEQ ID:2945, to the nucleotide sequence of GAM7957 RNA, herein designated GAM RNA, also designated SEQ ID:297.

Another function of GAM7957 is therefore inhibition of Hairy and enhancer of split 6 (drosophila) (HES6, Accession NP_061115.2). Accordingly, utilities of GAM7957 include diagnosis, prevention and treatment of diseases and clinical conditions associated with HES6.

Herv-h ltr-associating 2 (HHLA2, Accession NP_009003.1) is another GAM7957 target gene, herein designated TARGET GENE. HHLA2 BINDING SITE is a target binding site found in the 5' untranslated region of mRNA encoded by HHLA2, corresponding to a target binding site such as BINDING SITE I, BINDING SITE II or BINDING SITE III of FIG. 8. Table 4 illustrates the complementarity of the nucleotide sequences of HHLA2 BINDING SITE, designated SEQ ID:5686, to the nucleotide sequence of GAM7957 RNA, herein designated GAM RNA, also designated SEQ ID:297.

Another function of GAM7957 is therefore inhibition of Herv-h ltr-associating 2 (HHLA2, Accession NP_009003.1). Accordingly, utilities of GAM7957 include diagnosis, prevention and treatment of diseases and clinical conditions associated with HHLA2.

HIC (Accession XP_041273.1) is another GAM7957 target gene, herein designated TARGET GENE. HIC BINDING SITE is a target binding site found in the 3' untranslated region of mRNA encoded by HIC, corresponding to a target binding site such as BINDING SITE I, BINDING SITE II or BINDING SITE III of FIG. 8. Table 4 illustrates the complementarity of the nucleotide sequences of HIC BINDING SITE, designated SEQ ID:19869, to the nucleotide sequence of GAM7957 RNA, herein designated GAM RNA, also designated SEQ ID:297.

Another function of GAM7957 is therefore inhibition of HIC (Accession XP_041273.1). Accordingly, utilities of GAM7957 include diagnosis, prevention and treatment of diseases and clinical conditions associated with HIC.

HIG2 (Accession NP_037464.1) is another GAM7957 target gene, herein designated TARGET GENE. HIG2 BINDING SITE is a target binding site found in the 3' untranslated region of mRNA encoded by HIG2, corresponding to a target binding site such as BINDING SITE I, BINDING SITE II or BINDING SITE III of FIG. 8. Table 4 illustrates the complementarity of the nucleotide sequences of HIG2 BINDING SITE, designated SEQ ID:2455, to the nucleotide sequence of GAM7957 RNA, herein designated GAM RNA, also designated SEQ ID:297.

Another function of GAM7957 is therefore inhibition of HIG2 (Accession NP_037464.1). Accordingly, utilities of GAM7957 include diagnosis, prevention and treatment of diseases and clinical conditions associated with HIG2.

Huntingtin interacting protein 1 (HIP1, Accession NP_005329.2) is another GAM7957 target gene, herein designated TARGET GENE. HIP1 BINDING SITE is a target binding site found in the 3' untranslated region of mRNA encoded by HIP1, corresponding to a target binding site such as BINDING SITE I, BINDING SITE II or BINDING SITE III of FIG. 8. Table 4 illustrates the complementarity of the nucleotide sequences of HIP1 BINDING SITE, designated SEQ ID:19132, to the nucleotide sequence of GAM7957 RNA, herein designated GAM RNA, also designated SEQ ID:297.

Another function of GAM7957 is therefore inhibition of Huntingtin interacting protein 1 (HIP1, Accession NP_005329.2), a gene which is a membrane protein and interacts with huntingtin. and therefore may be associated with Huntington disease. Accordingly, utilities of GAM7957 include diagnosis, prevention and treatment of Huntington disease, and of other diseases and clinical conditions associated with HIP1.

The function of HIP1 and its association with various diseases and clinical conditions, has been established by previous studies, as described hereinabove with reference to GAM72.1. Histocompatibility (minor) 13 (HM13, Accession NP_848697.1) is another GAM7957 target gene, herein designated TARGET GENE. HM13 BINDING SITE is a target binding site found in the 3' untranslated region of multiple transcripts of mRNA encoded by HM13, corresponding to a target binding site such as BINDING SITE I, BINDING SITE II or BINDING SITE III of FIG. 8. Table 4 illustrates the complementarity of the nucleotide sequences of HM13 BINDING SITE, designated SEQ ID:18691, to the nucleotide sequence of GAM7957 RNA, herein designated GAM RNA, also designated SEQ ID:297.

Another function of GAM7957 is therefore inhibition of Histocompatibility (minor) 13 (HM13, Accession NP_848697.1). Accordingly, utilities of GAM7957 include diagnosis, prevention and treatment of diseases and clinical conditions associated with HM13.

High mobility group at-hook 2 (HMGA2, Accession NP_003474.1) is another GAM7957 target gene, herein designated TARGET GENE. HMGA2 BINDING SITE is a target binding site found in the 3' untranslated region of mRNA encoded by HMGA2, corresponding to a target binding site such as BINDING SITE I, BINDING SITE II or BINDING SITE III of FIG. 8. Table 4 illustrates the complementarity of the nucleotide sequences of HMGA2 BINDING SITE, designated SEQ ID:3859, to the nucleotide sequence of GAM7957 RNA, herein designated GAM RNA, also designated SEQ ID:297.

Another function of GAM7957 is therefore inhibition of High mobility group at-hook 2 (HMGA2, Accession NP_003474.1), a gene which may affect transcription and cell differentiation; shares common DNA-binding motif with other HMG HMG I/Y family members. and therefore may be associated with Lipoma. Accordingly, utilities of GAM7957 include diagnosis, prevention and treatment of Lipoma, and of other diseases and clinical conditions associated with HMGA2.

The function of HMGA2 and its association with various diseases and clinical conditions, has been established by previous studies, as described hereinabove with reference to GAM203.1. Histamine receptor h1 (HRH1, Accession NP_000852.1) is another GAM7957 target gene, herein designated TARGET GENE. HRH1 BINDING SITE is a target binding site found in the 3' untranslated region of mRNA encoded by HRH1, corresponding to a target binding site such as BINDING SITE I, BINDING SITE II or BINDING SITE III of FIG. 8. Table 4 illustrates the complementarity of the nucleotide sequences of HRH1 BINDING SITE, designated SEQ ID:15027, to the nucleotide sequence of GAM7957 RNA, herein designated GAM RNA, also designated SEQ ID:297.

Another function of GAM7957 is therefore inhibition of Histamine receptor h1 (HRH1, Accession NP_000852.1), a gene which stimulates the synthesis of inositol phosphate. Accordingly, utilities of GAM7957 include diagnosis, prevention and treatment of diseases and clinical conditions associated with HRH1.

The function of HRH1 and its association with various diseases and clinical conditions, has been established by previous studies, as described hereinabove with reference to GAM47.1. Histamine receptor h4 (HRH4, Accession NP_067637.2) is another GAM7957 target gene, herein designated TARGET GENE. HRH4 BINDING SITE is a target binding site found in the 3' untranslated region of mRNA encoded by HRH4, corresponding to a target binding site such as BINDING SITE I, BINDING SITE II or BINDING SITE III of FIG. 8. Table 4 illustrates the complementarity of the nucleotide sequences of HRH4 BINDING SITE, designated SEQ ID:16196, to the nucleotide sequence of GAM7957 RNA, herein designated GAM RNA, also designated SEQ ID:297.

Another function of GAM7957 is therefore inhibition of Histamine receptor h4 (HRH4, Accession NP_067637.2). Accordingly, utilities of GAM7957 include diagnosis, prevention and treatment of diseases and clinical conditions associated with HRH4.

Hydroxysteroid (17-beta) dehydrogenase 7 (HSD17B7, Accession NP_057455.1) is another GAM7957 target gene, herein designated TARGET GENE. HSD17B7 BINDING SITE is a target binding site found in the 3' untranslated region of mRNA encoded by HSD17B7, corresponding to a target binding site such as BINDING SITE I, BINDING SITE II or BINDING SITE III of FIG. 8. Table 4 illustrates the complementarity of the nucleotide sequences of HSD17B7 BINDING SITE, designated SEQ ID:16464, to the nucleotide sequence of GAM7957 RNA, herein designated GAM RNA, also designated SEQ ID:297.

Another function of GAM7957 is therefore inhibition of Hydroxysteroid (17-beta) dehydrogenase 7 (HSD17B7, Accession NP_057455.1). Accordingly, utilities of GAM7957 include diagnosis, prevention and treatment of diseases and clinical conditions associated with HSD17B7.

HSH2 (Accession NP_116244.1) is another GAM7957 target gene, herein designated TARGET GENE. HSH2 BINDING SITE is a target binding site found in the 3' untranslated region of mRNA encoded by HSH2, corresponding to a target binding site such as BINDING SITE I, BINDING SITE II or BINDING SITE III of FIG. 8. Table 4 illustrates the complementarity of the nucleotide sequences of HSH2 BINDING SITE, designated SEQ ID:10438, to the nucleotide sequence of GAM7957 RNA, herein designated GAM RNA, also designated SEQ ID:297.

Another function of GAM7957 is therefore inhibition of HSH2 (Accession NP_116244.1). Accordingly, utilities of GAM7957 include diagnosis, prevention and treatment of diseases and clinical conditions associated with HSH2.

HSMPP8 (Accession XP_167894.1) is another GAM7957 target gene, herein designated TARGET GENE. HSMPP8 BINDING SITE is a target binding site found in the 3' untranslated region of mRNA encoded by HSMPP8, corresponding to a target binding site such as BINDING SITE I, BINDING SITE II or BINDING SITE III of FIG. 8. Table 4 illustrates the complementarity of the nucleotide sequences of HSMPP8 BINDING SITE, designated SEQ ID:4558, to the nucleotide sequence of GAM7957 RNA, herein designated GAM RNA, also designated SEQ ID:297.

Another function of GAM7957 is therefore inhibition of HSMPP8 (Accession XP_167894.1). Accordingly, utilities of GAM7957 include diagnosis, prevention and treatment of diseases and clinical conditions associated with HSMPP8.

Heat shock 70 kda protein 5 (glucose-regulated protein, 78 kda) (HSPA5, Accession NP_005338.1) is another GAM7957 target gene, herein designated TARGET GENE. HSPA5 BINDING SITE is a target binding site found in the 3' untranslated region of mRNA encoded by HSPA5, corresponding to a target binding site such as BINDING SITE I, BINDING SITE II or BINDING SITE III of FIG. 8. Table 4 illustrates the complementarity of the nucleotide sequences of HSPA5 BINDING SITE, designated SEQ ID:10438, to the nucleotide sequence of GAM7957 RNA, herein designated GAM RNA, also designated SEQ ID:297.

Another function of GAM7957 is therefore inhibition of Heat shock 70 kda protein 5 (glucose-regulated protein, 78 kda) (HSPA5, Accession NP_005338.1), a gene which is involved in the folding and assembly of proteins in the endoplasmic reticulum (ER). Accordingly, utilities of GAM7957 include diagnosis, prevention and treatment of diseases and clinical conditions associated with HSPA5.

The function of HSPA5 and its association with various diseases and clinical conditions, has been established by previous studies, as described hereinabove with reference to GAM72.1. HSPC043 (Accession NP_067041.1) is another GAM7957 target gene, herein designated TARGET GENE. HSPC043 BINDING SITE is a target binding site found in the 3' untranslated region of mRNA encoded by HSPC043, corresponding to a target binding site such as BINDING SITE I, BINDING SITE II or BINDING SITE III of FIG. 8. Table 4 illustrates the complementarity of the nucleotide sequences of HSPC043 BINDING SITE, designated SEQ ID:12141, to the nucleotide sequence of GAM7957 RNA, herein designated GAM RNA, also designated SEQ ID:297.

Another function of GAM7957 is therefore inhibition of HSPC043 (Accession NP_067041.1). Accordingly, utilities of GAM7957 include diagnosis, prevention and treatment of diseases and clinical conditions associated with HSPC043.

Hormonally upregulated neu-associated kinase (HUNK, Accession NP_055401.1) is another GAM7957 target gene, herein designated TARGET GENE. HUNK BINDING SITE is a target binding site found in the 3' untranslated region of mRNA encoded by HUNK, corresponding to a target binding site such as BINDING SITE I, BINDING SITE II or BINDING SITE III of FIG. 8. Table 4 illustrates the complementarity of the nucleotide sequences of HUNK BINDING SITE, designated SEQ ID:2603, to the nucleotide sequence of GAM7957 RNA, herein designated GAM RNA, also designated SEQ ID:297.

Another function of GAM7957 is therefore inhibition of Hormonally upregulated neu-associated kinase (HUNK, Accession NP_055401.1). Accordingly, utilities of GAM7957 include diagnosis, prevention and treatment of diseases and clinical conditions associated with HUNK.

HYPK (Accession NP_057484.3) is another GAM7957 target gene, herein designated TARGET GENE. HYPK BINDING SITE is a target binding site found in the 3' untranslated region of mRNA encoded by HYPK, corresponding to a target binding site such as BINDING SITE I, BINDING SITE II or BINDING SITE III of FIG. 8. Table 4 illustrates the complementarity of the nucleotide sequences of HYPK BINDING SITE, designated SEQ ID:9495, to the nucleotide sequence of GAM7957 RNA, herein designated GAM RNA, also designated SEQ ID:297.

Another function of GAM7957 is therefore inhibition of HYPK (Accession NP_057484.3). Accordingly, utilities of GAM7957 include diagnosis, prevention and treatment of diseases and clinical conditions associated with HYPK.

Islet amyloid polypeptide (IAPP, Accession NP_000406.1) is another GAM7957 target gene, herein designated TARGET GENE. IAPP BINDING SITE is a target binding site found in the 3' untranslated region of mRNA encoded by IAPP, corresponding to a target binding site such as BINDING SITE I, BINDING SITE II or BINDING SITE III of FIG. 8. Table 4 illustrates the complementarity of the nucleotide sequences of IAPP BINDING SITE, designated SEQ ID:19057, to the nucleotide sequence of GAM7957 RNA, herein designated GAM RNA, also designated SEQ ID:297.

Another function of GAM7957 is therefore inhibition of Islet amyloid polypeptide (IAPP, Accession NP_000406.1), a gene which selectively inhibits insulin-stimulated glucose utilization and glycogen deposition and therefore may be associated with Type ii diabetes. Accordingly, utilities of GAM7957 include diagnosis, prevention and treatment of Type ii diabetes., and of other diseases and clinical conditions associated with IAPP.

The function of IAPP and its association with various diseases and clinical conditions, has been established by previous studies, as described hereinabove with reference to GAM190.1. Interferon-induced protein with tetratricopeptide repeats 4 (IFIT4, Accession NP_001540.2) is another GAM7957 target gene, herein designated TARGET GENE. IFIT4 BINDING SITE is a target binding site found in the 3' untranslated region of mRNA encoded by IFIT4, corresponding to a target binding site such as BINDING SITE I, BINDING SITE II or BINDING SITE III of FIG. 8. Table 4 illustrates the complementarity of the nucleotide sequences of IFIT4 BINDING SITE, designated SEQ ID:3297, to the nucleotide sequence of GAM7957 RNA, herein designated GAM RNA, also designated SEQ ID:297.

Another function of GAM7957 is therefore inhibition of Interferon-induced protein with tetratricopeptide repeats 4 (IFIT4, Accession NP_001540.2), a gene which is an interferon-induced protein. Accordingly, utilities of GAM7957 include diagnosis, prevention and treatment of diseases and clinical conditions associated with IFIT4.

The function of IFIT4 and its association with various diseases and clinical conditions, has been established by previous studies, as described hereinabove with reference to GAM347.1. Interferon (alpha, beta and omega) receptor 1 (IFNAR1, Accession NP_000620.1) is another GAM7957 target gene, herein designated TARGET GENE. IFNAR1 BINDING SITE is a target binding site found in the 3' untranslated region of mRNA encoded by IFNAR1, corresponding to a target binding site such as BINDING SITE I, BINDING SITE II or BINDING SITE III of FIG. 8. Table 4 illustrates the complementarity of the nucleotide sequences of IFNAR1 BINDING SITE, designated SEQ ID:7044, to the nucleotide sequence of GAM7957 RNA, herein designated GAM RNA, also designated SEQ ID:297.

Another function of GAM7957 is therefore inhibition of Interferon (alpha, beta and omega) receptor 1 (IFNAR1, Accession NP_000620.1), a gene which is a receptor for interferons alpha and beta. Accordingly, utilities of GAM7957 include diagnosis, prevention and treatment of diseases and clinical conditions associated with IFNAR1.

The function of IFNAR1 and its association with various diseases and clinical conditions, has been established by previous studies, as described hereinabove with reference to GAM347.1. Interferon gamma receptor 2 (interferon gamma transducer 1) (IFNGR2, Accession NP_005525.1) is another GAM7957 target gene, herein designated TARGET GENE. IFNGR2 BINDING SITE is a target binding site found in the 5' untranslated region of mRNA encoded by IFNGR2, corresponding to a target binding site such as BINDING SITE I, BINDING SITE II or BINDING SITE III of FIG. 8. Table 4 illustrates the complementarity of the nucleotide sequences of IFNGR2 BINDING SITE, designated SEQ ID:17119, to the nucleotide sequence of GAM7957 RNA, herein designated GAM RNA, also designated SEQ ID:297.

Another function of GAM7957 is therefore inhibition of Interferon gamma receptor 2 (interferon gamma transducer 1) (IFNGR2, Accession NP_005525.1), a gene which is required for signal transduction. this accessory factor is an integral part of the ifn-gamma signal transduction pathway and is likely to interact with gaf, jak1, and/or jak2. and therefore may be associated with Atypical mycobacterial infection, familial disseminated. Accordingly, utilities of GAM7957 include diagnosis, prevention and treatment of Atypical mycobacterial infection, familial disseminated, and of other diseases and clinical conditions associated with IFNGR2.

The function of IFNGR2 and its association with various diseases and clinical conditions, has been established by previous studies, as described hereinabove with reference to GAM347.1. Inositol hexaphosphate kinase 3 (IHPK3, Accession NP_473452.1) is another GAM7957 target gene, herein designated TARGET GENE. IHPK3 BINDING SITE is a target binding site found in the 5' untranslated region of mRNA encoded by IHPK3, corresponding to a target binding site such as BINDING SITE I, BINDING SITE II or BINDING SITE III of FIG. 8. Table 4 illustrates the complementarity of the nucleotide sequences of IHPK3 BINDING SITE, designated SEQ ID:18598, to the nucleotide sequence of GAM7957 RNA, herein designated GAM RNA, also designated SEQ ID:297.

Another function of GAM7957 is therefore inhibition of Inositol hexaphosphate kinase 3 (IHPK3, Accession NP_473452.1). Accordingly, utilities of GAM7957 include diagnosis, prevention and treatment of diseases and clinical conditions associated with IHPK3.

Interleukin 10 (IL10, Accession NP_000563.1) is another GAM7957 target gene, herein designated TARGET GENE. IL10 BINDING SITE is a target binding site found in the 3' untranslated region of mRNA encoded by IL10, corresponding to a target binding site such as BINDING SITE I, BINDING SITE II or BINDING SITE III of FIG. 8. Table 4 illustrates the complementarity of the nucleotide sequences of IL10 BINDING SITE, designated SEQ ID:8482, to the nucleotide sequence of GAM7957 RNA, herein designated GAM RNA, also designated SEQ ID:297.

Another function of GAM7957 is therefore inhibition of Interleukin 10 (IL10, Accession NP_000563.1), a gene which inhibits the synthesis of a number of cytokines, including ifn-gamma, il-2, il-3, tnf and gm-csf produced by activated macrophages and by helper t cells. and therefore may be associated with Human immunodeficiency virus type 1, susceptibility to. Accordingly, utilities of GAM7957 include diagnosis, prevention and treatment of Human immunodeficiency virus type 1, susceptibility to, and of other diseases and clinical conditions associated with IL10.

The function of IL10 and its association with various diseases and clinical conditions, has been established by previous studies, as described hereinabove with reference to GAM347.2. Interleukin 10 receptor, beta (IL10RB, Accession NP_000619.3) is another GAM7957 target gene, herein designated TARGET GENE. IL10RB BINDING SITE is a target binding site found in the 3' untranslated region of mRNA encoded by IL10RB, corresponding to a target binding site such as BINDING SITE I, BINDING SITE II or BINDING SITE III of FIG. 8. Table 4 illustrates the complementarity of the nucleotide sequences of IL10RB BINDING SITE, designated SEQ ID:18976, to the nucleotide sequence of GAM7957 RNA, herein designated GAM RNA, also designated SEQ ID:297.

Another function of GAM7957 is therefore inhibition of Interleukin 10 receptor, beta (IL10RB, Accession NP_000619.3). Accordingly, utilities of GAM7957 include diagnosis, prevention and treatment of diseases and clinical conditions associated with IL10RB.

Interleukin 13 receptor, alpha 1 (IL13RA1, Accession NP_001551.1) is another GAM7957 target gene, herein designated TARGET GENE. IL13RA1 BINDING SITE is a target binding site found in the 3' untranslated region of mRNA encoded by IL13RA1, corresponding to a target binding site such as BINDING SITE I, BINDING SITE II or BINDING SITE III of FIG. 8. Table 4 illustrates the complementarity of the nucleotide sequences of IL13RA1 BINDING SITE, designated SEQ ID:11740, to the nucleotide sequence of GAM7957 RNA, herein designated GAM RNA, also designated SEQ ID:297.

Another function of GAM7957 is therefore inhibition of Interleukin 13 receptor, alpha 1 (IL13RA1, Accession NP_001551.1), a gene which binds il-13 with a low affinity. together with il-4r-alpha can form a functional receptor for il-13 and therefore may be associated with Asthma and athopy. Accordingly, utilities of GAM7957 include diagnosis, prevention and treatment of Asthma and athopy, and of other diseases and clinical conditions associated with IL13RA1.

The function of IL13RA1 and its association with various diseases and clinical conditions, has been established by previous studies, as described hereinabove with reference to GAM72.1. Interleukin 17 receptor (IL17R, Accession NP_055154.3) is another GAM7957 target gene, herein designated TARGET GENE. IL17R BINDING SITE is a target binding site found in the 3' untranslated region of mRNA encoded by IL17R, corresponding to a target binding site such as BINDING SITE I, BINDING SITE II or BINDING SITE III of FIG. 8. Table 4 illustrates the complementarity of the nucleotide sequences of IL17R BINDING SITE, designated SEQ ID:11720, to the nucleotide sequence of GAM7957 RNA, herein designated GAM RNA, also designated SEQ ID:297.

Another function of GAM7957 is therefore inhibition of Interleukin 17 receptor (IL17R, Accession NP_055154.3). Accordingly, utilities of GAM7957 include diagnosis, prevention and treatment of diseases and clinical conditions associated with IL17R.

Interleukin 18 (interferon-gamma-inducing factor) (IL18, Accession NP_001553.1) is another GAM7957 target gene, herein designated TARGET GENE. IL18 BINDING SITE is a target binding site found in the 3' untranslated region of mRNA encoded by IL18, corresponding to a target binding site such as BINDING SITE I, BINDING SITE II or BINDING SITE III of FIG. 8. Table 4 illustrates the complementarity of the nucleotide sequences of IL18 BINDING SITE, designated SEQ ID:9399, to the nucleotide sequence of GAM7957 RNA, herein designated GAM RNA, also designated SEQ ID:297.

Another function of GAM7957 is therefore inhibition of Interleukin 18 (interferon-gamma-inducing factor) (IL18, Accession NP_001553.1), a gene which augments natural killer cell activity in spleen cells and stimulates interferon gamma production in t helper type i cells. and therefore may be associated with Crohn disease. Accordingly, utilities of GAM7957 include diagnosis, prevention and treatment of Crohn disease, and of other diseases and clinical conditions associated with IL18.

The function of IL18 and its association with various diseases and clinical conditions, has been established by previous studies, as described hereinabove with reference to GAM72.1. Interleukin 1 receptor, type i (IL1R1, Accession NP_000868.1) is another GAM7957 target gene, herein designated TARGET GENE. IL1R1 BINDING SITE is a target binding site found in the 3' untranslated region of mRNA encoded by IL1R1, corresponding to a target binding site such as BINDING SITE I, BINDING SITE II or BINDING SITE III of FIG. 8. Table 4 illustrates the complementarity of the nucleotide sequences of IL1R1 BINDING SITE, designated SEQ ID:10406, to the nucleotide sequence of GAM7957 RNA, herein designated GAM RNA, also designated SEQ ID:297.

Another function of GAM7957 is therefore inhibition of Interleukin 1 receptor, type i (IL1R1, Accession NP_000868.1), a gene which is a receptor for interleukin-1 alpha (il-1a), beta (il-1b), and interleukin-1 receptor antagonist protein (il-1ra). Accordingly, utilities of GAM7957 include diagnosis, prevention and treatment of diseases and clinical conditions associated with IL1R1.

The function of IL1R1 and its association with various diseases and clinical conditions, has been established by previous studies, as described hereinabove with reference to GAM40.1. IL23R (Accession NP_653302.2) is another GAM7957 target gene, herein designated TARGET GENE. IL23R BINDING SITE is a target binding site found in the 3' untranslated region of mRNA encoded by IL23R, corresponding to a target binding site such as BINDING SITE I, BINDING SITE II or BINDING SITE III of FIG. 8. Table 4 illustrates the complementarity of the nucleotide sequences of IL23R BINDING SITE, designated SEQ ID:9056, to the nucleotide sequence of GAM7957 RNA, herein designated GAM RNA, also designated SEQ ID:297.

Another function of GAM7957 is therefore inhibition of IL23R (Accession NP_653302.2). Accordingly, utilities of GAM7957 include diagnosis, prevention and treatment of diseases and clinical conditions associated with IL23R.

Interleukin 28 receptor, alpha (IL28RA, Accession NP_775087.1) is another GAM7957 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:15436, to the nucleotide sequence of GAM7957 RNA, herein designated GAM RNA, also designated SEQ ID:297.

Another function of GAM7957 is therefore inhibition of Interleukin 28 receptor, alpha (IL28RA, Accession NP_775087.1). Accordingly, utilities of GAM7957 include diagnosis, prevention and treatment of diseases and clinical conditions associated with IL28RA.

Interleukin 28 receptor, alpha (IL28RA, Accession NP_734464.1) is another GAM7957 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:15436, to the nucleotide sequence of GAM7957 RNA, herein designated GAM RNA, also designated SEQ ID:297.

Another function of GAM7957 is therefore inhibition of Interleukin 28 receptor, alpha (IL28RA, Accession NP_734464.1). Accordingly, utilities of GAM7957 include diagnosis, prevention and treatment of diseases and clinical conditions associated with IL28RA.

Interleukin 28 receptor, alpha (IL28RA, Accession NP_775088.1) is another GAM7957 target gene, herein designated TARGET GENE. IL28RA BINDING SITE is a target binding site found in the 3' untranslated region of multiple transcripts of mRNA encoded by IL28RA, corresponding to a target binding site such as BINDING SITE I, BINDING SITE II or BINDING SITE III of FIG. 8. Table 4 illustrates the complementarity of the nucleotide sequences of IL28RA BINDING SITE, designated SEQ ID:15436, to the nucleotide sequence of GAM7957 RNA, herein designated GAM RNA, also designated SEQ ID:297.

Another function of GAM7957 is therefore inhibition of Interleukin 28 receptor, alpha (IL28RA, Accession NP_775088.1). Accordingly, utilities of GAM7957 include diagnosis, prevention and treatment of diseases and clinical conditions associated with IL28RA.

Interleukin 6 receptor (IL6R, Accession NP_852004.1) is another GAM7957 target gene, herein designated TARGET GENE. IL6R BINDING SITE is a target binding site found in the 3' untranslated region of multiple transcripts of mRNA encoded by IL6R, corresponding to a target binding site such as BINDING SITE I, BINDING SITE II or BINDING SITE III of FIG. 8. Table 4 illustrates the complementarity of the nucleotide sequences of IL6R BINDING SITE, designated SEQ ID:17754, to the nucleotide sequence of GAM7957 RNA, herein designated GAM RNA, also designated SEQ ID:297.

Another function of GAM7957 is therefore inhibition of Interleukin 6 receptor (IL6R, Accession NP_852004.1), a gene which is essential to the regulation of the immune response, hematopoiesis, and acute-phase reactions. Accordingly, utilities of GAM7957 include diagnosis, prevention and treatment of diseases and clinical conditions associated with IL6R.

The function of IL6R and its association with various diseases and clinical conditions, has been established by previous studies, as described hereinabove with reference to GAM94.1. Interleukin 6 receptor (IL6R, Accession NP_000556.1) is another GAM7957 target gene, herein designated TARGET GENE. IL6R BINDING SITE is a target binding site found in the 3' untranslated region of multiple transcripts of mRNA encoded by IL6R, corresponding to a target binding site such as BINDING SITE I, BINDING SITE II or BINDING SITE III of FIG. 8. Table 4 illustrates the complementarity of the nucleotide sequences of IL6R BINDING SITE, designated SEQ ID:17754, to the nucleotide sequence of GAM7957 RNA, herein designated GAM RNA, also designated SEQ ID:297.

Another function of GAM7957 is therefore inhibition of Interleukin 6 receptor (IL6R, Accession NP_000556.1), a gene which is essential to the regulation of the immune response, hematopoiesis, and acute-phase reactions. Accordingly, utilities of GAM7957 include diagnosis, prevention and treatment of diseases and clinical conditions associated with IL6R.

The function of IL6R and its association with various diseases and clinical conditions, has been established by previous studies, as described hereinabove with reference to GAM94.1. Interleukin 8 receptor, beta (IL8RB, Accession NP_001548.1) is another GAM7957 target gene, herein designated TARGET GENE. IL8RB BINDING SITE is a target binding site found in the 3' untranslated region of mRNA encoded by IL8RB, corresponding to a target binding site such as BINDING SITE I, BINDING SITE II or BINDING SITE III of FIG. 8. Table 4 illustrates the complementarity of the nucleotide sequences of IL8RB BINDING SITE, designated SEQ ID:10438, to the nucleotide sequence of GAM7957 RNA, herein designated GAM RNA, also designated SEQ ID:297.

Another function of GAM7957 is therefore inhibition of Interleukin 8 receptor, beta (IL8RB, Accession NP_001548.1). Accordingly, utilities of GAM7957 include diagnosis, prevention and treatment of diseases and clinical conditions associated with IL8RB.

Inactivation escape 1 (INE1, Accession NP_003660.1) is another GAM7957 target gene, herein designated TARGET GENE. INE1 BINDING SITE1 and INE1 BINDING SITE2 are target binding sites found in untranslated regions of mRNA encoded by INE1, corresponding to target binding sites such as BINDING SITE I, BINDING SITE II or BINDING SITE III of FIG. 8. Table 4 illustrates the complementarity of the nucleotide sequences of INE1 BINDING SITE1 and INE1 BINDING SITE2, designated SEQ ID:18648 and SEQ ID:13712 respectively, to the nucleotide sequence of GAM7957 RNA, herein designated GAM RNA, also designated SEQ ID:297.

Another function of GAM7957 is therefore inhibition of Inactivation escape 1 (INE1, Accession NP_003660.1). Accordingly, utilities of GAM7957 include diagnosis, prevention and treatment of diseases and clinical conditions associated with INE1.

Inhibitor of growth family, member 2 (ING2, Accession NP_477519.1) is another GAM7957 target gene, herein designated TARGET GENE. ING2 BINDING SITE is a target binding site found in the 3' untranslated region of mRNA encoded by ING2, corresponding to a target binding site such as BINDING SITE I, BINDING SITE II or BINDING SITE III of FIG. 8. Table 4 illustrates the complementarity of the nucleotide sequences of ING2 BINDING SITE, designated SEQ ID:13415, to the nucleotide sequence of GAM7957 RNA, herein designated GAM RNA, also designated SEQ ID:297.

Another function of GAM7957 is therefore inhibition of Inhibitor of growth family, member 2 (ING2, Accession NP_477519.1). Accordingly, utilities of GAM7957 include diagnosis, prevention and treatment of diseases and clinical conditions associated with ING2.

Inhibin, beta c (INHBC, Accession NP_005529.1) is another GAM7957 target gene, herein designated TARGET GENE. INHBC BINDING SITE is a target binding site found in the 3' untranslated region of mRNA encoded by INHBC, corresponding to a target binding site such as BINDING SITE I, BINDING SITE II or BINDING SITE III of FIG. 8. Table 4 illustrates the complementarity of the nucleotide sequences of INHBC BINDING SITE, designated SEQ ID:16412, to the nucleotide sequence of GAM7957 RNA, herein designated GAM RNA, also designated SEQ ID:297.

Another function of GAM7957 is therefore inhibition of Inhibin, beta c (INHBC, Accession NP_005529.1), a gene which inhibits the secretion of follitropin by the pituitary gland. Accordingly, utilities of GAM7957 include diagnosis, prevention and treatment of diseases and clinical conditions associated with INHBC.

The function of INHBC and its association with various diseases and clinical conditions, has been established by previous studies, as described hereinabove with reference to GAM401.1. Inositol polyphosphate-5-phosphatase, 75 kda (INPP5B, Accession XP_300739.1) is another GAM7957 target gene, herein designated TARGET GENE. INPP5B BINDING SITE1 and INPP5B BINDING SITE2 are target binding sites found in untranslated regions of mRNA encoded by INPP5B, corresponding to target binding sites such as BINDING SITE I, BINDING SITE II or BINDING SITE III of FIG. 8. Table 4 illustrates the complementarity of the nucleotide sequences of INPP5B BINDING SITE1 and INPP5B BINDING SITE2, designated SEQ ID:16413 and SEQ ID:12792 respectively, to the nucleotide sequence of GAM7957 RNA, herein designated GAM RNA, also designated SEQ ID:297.

Another function of GAM7957 is therefore inhibition of Inositol polyphosphate-5-phosphatase, 75 kda (INPP5B, Accession XP_300739.1), a gene which hydrolyzes the calcium-mobilizing second messenger ins(1,4,5)p3. Accordingly, utilities of GAM7957 include diagnosis, prevention and treatment of diseases and clinical conditions associated with INPP5B.

The function of INPP5B and its association with various diseases and clinical conditions, has been established by previous studies, as described hereinabove with reference to GAM347.1. Inositol polyphosphate-5-phosphatase, 145 kda (INPP5D, Accession NP_005532.1) is another GAM7957 target gene, herein designated TARGET GENE. INPP5D BINDING SITE is a target binding site found in the 5' untranslated region of mRNA encoded by INPP5D, corresponding to a target binding site such as BINDING SITE I, BINDING SITE II or BINDING SITE III of FIG. 8. Table 4 illustrates the complementarity of the nucleotide sequences of INPP5D BINDING SITE, designated SEQ ID:9965, to the nucleotide sequence of GAM7957 RNA, herein designated GAM RNA, also designated SEQ ID:297.

Another function of GAM7957 is therefore inhibition of Inositol polyphosphate-5-phosphatase, 145 kda (INPP5D, Accession NP_005532.1), a gene which hydrolyzes Ins(1,3,4,5)P4 and PtdIns(3,4,5)P3; contains an SH2-domain and therefore may be associated with Severe osteoporosis. Accordingly, utilities of GAM7957 include diagnosis, prevention and treatment of Severe osteoporosis, and of other diseases and clinical conditions associated with INPP5D.

The function of INPP5D and its association with various diseases and clinical conditions, has been established by previous studies, as described hereinabove with reference to GAM347.1. Intracisternal a particle-promoted polypeptide (IPP, Accession NP_005888.1) is another GAM7957 target gene, herein designated TARGET GENE. IPP BINDING SITE1 and IPP BINDING SITE2 are target binding sites found in untranslated regions of mRNA encoded by IPP, corresponding to target binding sites such as BINDING SITE I, BINDING SITE II or BINDING SITE III of FIG. 8. Table 4 illustrates the complementarity of the nucleotide sequences of IPP BINDING SITE1 and IPP BINDING SITE2, designated SEQ ID:7118 and SEQ ID:11184 respectively, to the nucleotide sequence of GAM7957 RNA, herein designated GAM RNA, also designated SEQ ID:297.

Another function of GAM7957 is therefore inhibition of Intracisternal a particle-promoted polypeptide (IPP, Accession NP_005888.1), a gene which may play a role in organizing the actin cytoskeleton. Accordingly, utilities of GAM7957 include diagnosis, prevention and treatment of diseases and clinical conditions associated with IPP.

The function of IPP and its association with various diseases and clinical conditions, has been established by previous studies, as described hereinabove with reference to GAM72.1. Interleukin-1 receptor-associated kinase 1 (IRAK1, Accession NP_001560.1) is another GAM7957 target gene, herein designated TARGET GENE. IRAK1 BINDING SITE is a target binding site found in the 3' untranslated region of mRNA encoded by IRAK1, corresponding to a target binding site such as BINDING SITE I, BINDING SITE II or BINDING SITE III of FIG. 8. Table 4 illustrates the complementarity of the nucleotide sequences of IRAK1 BINDING SITE, designated SEQ ID:12737, to the nucleotide sequence of GAM7957 RNA, herein designated GAM RNA, also designated SEQ ID:297.

Another function of GAM7957 is therefore inhibition of Interleukin-1 receptor-associated kinase 1 (IRAK1, Accession NP_001560.1). Accordingly, utilities of GAM7957 include diagnosis, prevention and treatment of diseases and clinical conditions associated with IRAK1.

Interleukin-1 receptor-associated kinase 4 (IRAK4, Accession NP_057207.1) is another GAM7957 target gene, herein designated TARGET GENE. IRAK4 BINDING SITE is a target binding site found in the 3' untranslated region of mRNA encoded by IRAK4, corresponding to a target binding site such as BINDING SITE I, BINDING SITE II or BINDING SITE III of FIG. 8. Table 4 illustrates the complementarity of the nucleotide sequences of IRAK4 BINDING SITE, designated SEQ ID:10607, to the nucleotide sequence of GAM7957 RNA, herein designated GAM RNA, also designated SEQ ID:297.

Another function of GAM7957 is therefore inhibition of Interleukin-1 receptor-associated kinase 4 (IRAK4, Accession NP_057207.1), a gene which may function as an IRAK1 kinase, triggering a cascade of phosphorylation events. and therefore may be associated with Renal tumors. Accordingly, utilities of GAM7957 include diagnosis, prevention and treatment of Renal tumors, and of other diseases and clinical conditions associated with IRAK4.

The function of IRAK4 and its association with various diseases and clinical conditions, has been established by previous studies, as described hereinabove with reference to GAM72.1. Integrin, alpha d (ITGAD, Accession XP_113880.1) is another GAM7957 target gene, herein designated TARGET GENE. ITGAD BINDING SITE is a target binding site found in the 3' untranslated region of mRNA encoded by ITGAD, corresponding to a target binding site such as BINDING SITE I, BINDING SITE II or BINDING SITE III of FIG. 8. Table 4 illustrates the complementarity of the nucleotide sequences of ITGAD BINDING SITE, designated SEQ ID:5341, to the nucleotide sequence of GAM7957 RNA, herein designated GAM RNA, also designated SEQ ID:297.

Another function of GAM7957 is therefore inhibition of Integrin, alpha d (ITGAD, Accession XP_113880.1). Accordingly, utilities of GAM7957 include diagnosis, prevention and treatment of diseases and clinical conditions associated with ITGAD.

Integrin, alpha l (antigen cd11a (p180), lymphocyte function-associated antigen 1; alpha polypeptide) (ITGAL, Accession NP_002200.1) is another GAM7957 target gene, herein designated TARGET GENE. ITGAL BINDING SITE is a target binding site found in the 3' untranslated region of mRNA encoded by ITGAL, corresponding to a target binding site such as BINDING SITE I, BINDING SITE II or BINDING SITE III of FIG. 8. Table 4 illustrates the complementarity of the nucleotide sequences of ITGAL BINDING SITE, designated SEQ ID:15224, to the nucleotide sequence of GAM7957 RNA, herein designated GAM RNA, also designated SEQ ID:297.

Another function of GAM7957 is therefore inhibition of Integrin, alpha l (antigen cd11a (p180), lymphocyte function-associated antigen 1; alpha polypeptide) (ITGAL, Accession NP_002200.1), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of GAM7957 include diagnosis, prevention and treatment of diseases and clinical conditions associated with ITGAL.

The function of ITGAL and its association with various diseases and clinical conditions, has been established by previous studies, as described hereinabove with reference to GAM148.1. Junctophilin 2 (JPH2, Accession NP_065166.2) is another GAM7957 target gene, herein designated TARGET GENE. JPH2 BINDING SITE is a target binding site found in the 3' untranslated region of multiple transcripts of mRNA encoded by JPH2, corresponding to a target binding site such as BINDING SITE I, BINDING SITE II or BIND- ING SITE III of FIG. 8. Table 4 illustrates the complementarity of the nucleotide sequences of JPH2 BINDING SITE, designated SEQ ID:7268, to the nucleotide sequence of GAM7957 RNA, herein designated GAM RNA, also designated SEQ ID:297.

Another function of GAM7957 is therefore inhibition of Junctophilin 2 (JPH2, Accession NP_065166.2), a gene which mediates cross talk between cell surface and intracellular ion channels. Accordingly, utilities of GAM7957 include diagnosis, prevention and treatment of diseases and clinical conditions associated with JPH2.

The function of JPH2 and its association with various diseases and clinical conditions, has been established by previous studies, as described hereinabove with reference to GAM346.2. Kangai 1 (suppression of tumorigenicity 6, prostate; cd82 antigen (r2 leukocyte antigen, antigen detected by monoclonal and antibody ia4)) (KAI1, Accession NP_002222.1) is another GAM7957 target gene, herein designated TARGET GENE. KAI1 BINDING SITE is a target binding site found in the 3' untranslated region of mRNA encoded by KAI1, corresponding to a target binding site such as BINDING SITE I, BINDING SITE II or BINDING SITE III of FIG. 8. Table 4 illustrates the complementarity of the nucleotide sequences of KAI1 BINDING SITE, designated SEQ ID:4535, to the nucleotide sequence of GAM7957 RNA, herein designated GAM RNA, also designated SEQ ID:297.

Another function of GAM7957 is therefore inhibition of Kangai 1 (suppression of tumorigenicity 6, prostate; cd82 antigen (r2 leukocyte antigen, antigen detected by monoclonal and antibody ia4)) (KAI1, Accession NP_002222.1), a gene which associates with cd4 or cd8 and delivers costimulatory signals for the tcr/cd3 pathway. and therefore may be associated with Prostate cancer. Accordingly, utilities of GAM7957 include diagnosis, prevention and treatment of Prostate cancer, and of other diseases and clinical conditions associated with KAI1.

The function of KAI1 and its association with various diseases and clinical conditions, has been established by previous studies, as described hereinabove with reference to GAM347.1. KBRAS2 (Accession NP_060065.2) is another GAM7957 target gene, herein designated TARGET GENE. KBRAS2 BINDING SITE is a target binding site found in the 3' untranslated region of mRNA encoded by KBRAS2, corresponding to a target binding site such as BINDING SITE I, BINDING SITE II or BINDING SITE III of FIG. 8. Table 4 illustrates the complementarity of the nucleotide sequences of KBRAS2 BINDING SITE, designated SEQ ID:3310, to the nucleotide sequence of GAM7957 RNA, herein designated GAM RNA, also designated SEQ ID:297.

Another function of GAM7957 is therefore inhibition of KBRAS2 (Accession NP_060065.2). Accordingly, utilities of GAM7957 include diagnosis, prevention and treatment of diseases and clinical conditions associated with KBRAS2.

Potassium voltage-gated channel, shaker-related subfamily, member 7 (KCNA7, Accession NP_114092.2) is another GAM7957 target gene, herein designated TARGET GENE. KCNA7 BINDING SITE1 and KCNA7 BINDING SITE2 are target binding sites found in untranslated regions of mRNA encoded by KCNA7, corresponding to target binding sites such as BINDING SITE I, BINDING SITE II or BINDING SITE III of FIG. 8. Table 4 illustrates the complementarity of the nucleotide sequences of KCNA7 BINDING SITE1 and KCNA7 BINDING SITE2, designated SEQ ID:15108 and SEQ ID:2483 respectively, to the nucleotide sequence of GAM7957 RNA, herein designated GAM RNA, also designated SEQ ID:297.

Another function of GAM7957 is therefore inhibition of Potassium voltage-gated channel, shaker-related subfamily, member 7 (KCNA7, Accession NP_114092.2), a gene which allows nerve cells to efficiently repolarize following an action potential. Accordingly, utilities of GAM7957 include diagnosis, prevention and treatment of diseases and clinical conditions associated with KCNA7.

The function of KCNA7 and its association with various diseases and clinical conditions, has been established by previous studies, as described hereinabove with reference to GAM72.1. Potassium voltage-gated channel, subfamily h (eag-related), member 6 (KCNH6, Accession NP_110406.1) is another GAM7957 target gene, herein designated TARGET GENE. KCNH6 BINDING SITE1 and KCNH6 BINDING SITE2 are target binding sites found in untranslated regions of multiple transcripts of mRNA encoded by KCNH6, corresponding to target binding sites such as BINDING SITE I, BINDING SITE II or BINDING SITE III of FIG. 8. Table 4 illustrates the complementarity of the nucleotide sequences of KCNH6 BINDING SITE1 and KCNH6 BINDING SITE2, designated SEQ ID:19242 and SEQ ID:18166 respectively, to the nucleotide sequence of GAM7957 RNA, herein designated GAM RNA, also designated SEQ ID:297.

Another function of GAM7957 is therefore inhibition of Potassium voltage-gated channel, subfamily h (eag-related), member 6 (KCNH6, Accession NP_110406.1). Accordingly, utilities of GAM7957 include diagnosis, prevention and treatment of diseases and clinical conditions associated with KCNH6.

Kv channel interacting protein 2 (KCNIP2, Accession NP_775286.1) is another GAM7957 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:14673, to the nucleotide sequence of GAM7957 RNA, herein designated GAM RNA, also designated SEQ ID:297.

Another function of GAM7957 is therefore inhibition of Kv channel interacting protein 2 (KCNIP2, Accession NP_775286.1). Accordingly, utilities of GAM7957 include diagnosis, prevention and treatment of diseases and clinical conditions associated with KCNIP2.

Kv channel interacting protein 2 (KCNIP2, Accession NP_775284.1) is another GAM7957 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:14673, to the nucleotide sequence of GAM7957 RNA, herein designated GAM RNA, also designated SEQ ID:297.

Another function of GAM7957 is therefore inhibition of Kv channel interacting protein 2 (KCNIP2, Accession NP_775284.1). Accordingly, utilities of GAM7957 include diagnosis, prevention and treatment of diseases and clinical conditions associated with KCNIP2.

Kv channel interacting protein 2 (KCNIP2, Accession NP_775464.1) is another GAM7957 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:14673, to the nucleotide sequence of GAM7957 RNA, herein designated GAM RNA, also designated SEQ ID:297.

Another function of GAM7957 is therefore inhibition of Kv channel interacting protein 2 (KCNIP2, Accession NP_775464.1). Accordingly, utilities of GAM7957 include diagnosis, prevention and treatment of diseases and clinical conditions associated with KCNIP2.

Kv channel interacting protein 2 (KCNIP2, Accession NP_775285.1) is another GAM7957 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:14673, to the nucleotide sequence of GAM7957 RNA, herein designated GAM RNA, also designated SEQ ID:297.

Another function of GAM7957 is therefore inhibition of Kv channel interacting protein 2 (KCNIP2, Accession NP_775285.1). Accordingly, utilities of GAM7957 include diagnosis, prevention and treatment of diseases and clinical conditions associated with KCNIP2.

Kv channel interacting protein 2 (KCNIP2, Accession NP_775287.1) is another GAM7957 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:14673, to the nucleotide sequence of GAM7957 RNA, herein designated GAM RNA, also designated SEQ ID:297.

Another function of GAM7957 is therefore inhibition of Kv channel interacting protein 2 (KCNIP2, Accession NP_775287.1). Accordingly, utilities of GAM7957 include diagnosis, prevention and treatment of diseases and clinical conditions associated with KCNIP2.

Kv channel interacting protein 2 (KCNIP2, Accession NP_775283.1) is another GAM7957 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:14673, to the nucleotide sequence of GAM7957 RNA, herein designated GAM RNA, also designated SEQ ID:297.

Another function of GAM7957 is therefore inhibition of Kv channel interacting protein 2 (KCNIP2, Accession NP_775283.1). Accordingly, utilities of GAM7957 include diagnosis, prevention and treatment of diseases and clinical conditions associated with KCNIP2.

Kv channel interacting protein 2 (KCNIP2, Accession NP_055406.2) is another GAM7957 target gene, herein designated TARGET GENE. KCNIP2 BINDING SITE is a target binding site found in the 3' untranslated region of multiple transcripts of mRNA encoded by KCNIP2, corresponding to a target binding site such as BINDING SITE I, BINDING SITE II or BINDING SITE III of FIG. 8. Table 4 illustrates the complementarity of the nucleotide sequences of KCNIP2 BINDING SITE, designated SEQ ID:14673, to the nucleotide sequence of GAM7957 RNA, herein designated GAM RNA, also designated SEQ ID:297.

Another function of GAM7957 is therefore inhibition of Kv channel interacting protein 2 (KCNIP2, Accession NP_055406.2). Accordingly, utilities of GAM7957 include diagnosis, prevention and treatment of diseases and clinical conditions associated with KCNIP2.

Potassium inwardly-rectifying channel, subfamily j, member 14 (KCNJ14, Accession NP_733838.1) is another GAM7957 target gene, herein designated TARGET GENE. KCNJ14 BINDING SITE is a target binding site found in the 5' untranslated region of multiple transcripts of mRNA encoded by KCNJ14, corresponding to a target binding site such as BINDING SITE I, BINDING SITE II or BINDING SITE III of FIG. 8. Table 4 illustrates the complementarity of the nucleotide sequences of KCNJ14 BINDING SITE, designated SEQ ID:18135, to the nucleotide sequence of GAM7957 RNA, herein designated GAM RNA, also designated SEQ ID:297.

Another function of GAM7957 is therefore inhibition of Potassium inwardly-rectifying channel, subfamily j, member 14 (KCNJ14, Accession NP_733838.1). Accordingly, utilities of GAM7957 include diagnosis, prevention and treatment of diseases and clinical conditions associated with KCNJ14.

Potassium inwardly-rectifying channel, subfamily j, member 5 (KCNJ5, Accession NP_000881.3) is another GAM7957 target gene, herein designated TARGET GENE. KCNJ5 BINDING SITE is a target binding site found in the 3' untranslated region of mRNA encoded by KCNJ5, corresponding to a target binding site such as BINDING SITE I, BINDING SITE II or BINDING SITE III of FIG. 8. Table 4 illustrates the complementarity of the nucleotide sequences of KCNJ5 BINDING SITE, designated SEQ ID:15224, to the nucleotide sequence of GAM7957 RNA, herein designated GAM RNA, also designated SEQ ID:297.

Another function of GAM7957 is therefore inhibition of Potassium inwardly-rectifying channel, subfamily j, member 5 (KCNJ5, Accession NP_000881.3), a gene which is a potassium inwardly-rectifying channel. Accordingly, utilities of GAM7957 include diagnosis, prevention and treatment of diseases and clinical conditions associated with KCNJ5.

The function of KCNJ5 and its association with various diseases and clinical conditions, has been established by previous studies, as described hereinabove with reference to GAM72.1. Potassium channel, subfamily k, member 6 (KCNK6, Accession NP_004814.1) is another GAM7957 target gene, herein designated TARGET GENE. KCNK6 BINDING SITE is a target binding site found in the 3' untranslated region of mRNA encoded by KCNK6, corresponding to a target binding site such as BINDING SITE I, BINDING SITE II or BINDING SITE III of FIG. 8. Table 4 illustrates the complementarity of the nucleotide sequences of KCNK6 BINDING SITE, designated SEQ ID:2853, to the nucleotide sequence of GAM7957 RNA, herein designated GAM RNA, also designated SEQ ID:297.

Another function of GAM7957 is therefore inhibition of Potassium channel, subfamily k, member 6 (KCNK6, Accession NP_004814.1), a gene which is an inward rectifying potassium channel protein. Accordingly, utilities of GAM7957 include diagnosis, prevention and treatment of diseases and clinical conditions associated with KCNK6.

The function of KCNK6 and its association with various diseases and clinical conditions, has been established by previous studies, as described hereinabove with reference to GAM72.1. Potassium large conductance calcium-activated channel, subfamily m beta member 3 (KCNMB3, Accession NP_741981.1) is another GAM7957 target gene, herein designated TARGET GENE. KCNMB3 BINDING SITE is a target binding site found in the 5' untranslated region of multiple transcripts of mRNA encoded by KCNMB3, corresponding to a target binding site such as BINDING SITE I, BINDING SITE II or BINDING SITE III of FIG. 8. Table 4 illustrates the complementarity of the nucleotide sequences of KCNMB3 BINDING SITE, designated SEQ ID:7035, to the nucleotide sequence of GAM7957 RNA, herein designated GAM RNA, also designated SEQ ID:297.

Another function of GAM7957 is therefore inhibition of Potassium large conductance calcium-activated channel, subfamily m beta member 3 (KCNMB3, Accession NP_741981.1), a gene which is similar to a regulatory subunit of Ca-activated potassium channel. Accordingly, utilities of GAM7957 include diagnosis, prevention and treatment of diseases and clinical conditions associated with KCNMB3.

The function of KCNMB3 and its association with various diseases and clinical conditions, has been established by previous studies, as described hereinabove with reference to GAM94.1. KIAA0125 (Accession NP_055607.1) is another GAM7957 target gene, herein designated TARGET GENE. KIAA0125 BINDING SITE is a target binding site found in the 3' untranslated region of mRNA encoded by KIAA0125, corresponding to a target binding site such as BINDING SITE I, BINDING SITE II or BINDING SITE III of FIG. 8. Table 4 illustrates the complementarity of the nucleotide sequences of KIAA0125 BINDING SITE, designated SEQ ID:4129, to the nucleotide sequence of GAM7957 RNA, herein designated GAM RNA, also designated SEQ ID:297.

Another function of GAM7957 is therefore inhibition of KIAA0125 (Accession NP_055607.1). Accordingly, utilities of GAM7957 include diagnosis, prevention and treatment of diseases and clinical conditions associated with KIAA0125.

KIAA0140 (Accession NP_055476.1) is another GAM7957 target gene, herein designated TARGET GENE. KIAA0140 BINDING SITE is a target binding site found in the 3' untranslated region of mRNA encoded by KIAA0140, corresponding to a target binding site such as BINDING SITE I, BINDING SITE II or BINDING SITE III of FIG. 8. Table 4 illustrates the complementarity of the nucleotide sequences of KIAA0140 BINDING SITE, designated SEQ ID:1809, to the nucleotide sequence of GAM7957 RNA, herein designated GAM RNA, also designated SEQ ID:297.

Another function of GAM7957 is therefore inhibition of KIAA0140 (Accession NP_055476.1). Accordingly, utilities of GAM7957 include diagnosis, prevention and treatment of diseases and clinical conditions associated with KIAA0140.

KIAA0211 (Accession NP_055445.1) is another GAM7957 target gene, herein designated TARGET GENE. KIAA0211 BINDING SITE is a target binding site found in the 5' untranslated region of mRNA encoded by KIAA0211, corresponding to a target binding site such as BINDING SITE I, BINDING SITE II or BINDING SITE III of FIG. 8. Table 4 illustrates the complementarity of the nucleotide sequences of KIAA0211 BINDING SITE, designated SEQ ID:12651, to the nucleotide sequence of GAM7957 RNA, herein designated GAM RNA, also designated SEQ ID:297.

Another function of GAM7957 is therefore inhibition of KIAA0211 (Accession NP_055445.1). Accordingly, utilities of GAM7957 include diagnosis, prevention and treatment of diseases and clinical conditions associated with KIAA0211.

KIAA0237 (Accession NP_055562.1) is another GAM7957 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:8698, to the nucleotide sequence of GAM7957 RNA, herein designated GAM RNA, also designated SEQ ID:297.

Another function of GAM7957 is therefore inhibition of KIAA0237 (Accession NP_055562.1). Accordingly, utilities of GAM7957 include diagnosis, prevention and treatment of diseases and clinical conditions associated with KIAA0237.

KIAA0266 (Accession NP_067677.1) is another GAM7957 target gene, herein designated TARGET GENE. KIAA0266 BINDING SITE is a target binding site found in the 3' untranslated region of mRNA encoded by KIAA0266, corresponding to a target binding site such as BINDING SITE I, BINDING SITE II or BINDING SITE III of FIG. 8. Table 4 illustrates the complementarity of the nucleotide sequences of KIAA0266 BINDING SITE, designated SEQ ID:15976, to the nucleotide sequence of GAM7957 RNA, herein designated GAM RNA, also designated SEQ ID:297.

Another function of GAM7957 is therefore inhibition of KIAA0266 (Accession NP_067677.1). Accordingly, utilities of GAM7957 include diagnosis, prevention and treatment of diseases and clinical conditions associated with KIAA0266.

KIAA0276 (Accession XP_048199.1) is another GAM7957 target gene, herein designated TARGET GENE. KIAA0276 BINDING SITE is a target binding site found in the 5' untranslated region of mRNA encoded by KIAA0276, corresponding to a target binding site such as BINDING SITE I, BINDING SITE II or BINDING SITE III of FIG. 8. Table 4 illustrates the complementarity of the nucleotide sequences of KIAA0276 BINDING SITE, designated SEQ ID:17630, to the nucleotide sequence of GAM7957 RNA, herein designated GAM RNA, also designated SEQ ID:297.

Another function of GAM7957 is therefore inhibition of KIAA0276 (Accession XP_048199.1). Accordingly, utilities of GAM7957 include diagnosis, prevention and treatment of diseases and clinical conditions associated with KIAA0276.

KIAA0355 (Accession NP_055501.1) is another GAM7957 target gene, herein designated TARGET GENE. KIAA0355 BINDING SITE is a target binding site found in the 3' untranslated region of mRNA encoded by KIAA0355, corresponding to a target binding site such as BINDING SITE I, BINDING SITE II or BINDING SITE III of FIG. 8. Table 4 illustrates the complementarity of the nucleotide sequences of KIAA0355 BINDING SITE, designated SEQ ID:6039, to the nucleotide sequence of GAM7957 RNA, herein designated GAM RNA, also designated SEQ ID:297.

Another function of GAM7957 is therefore inhibition of KIAA0355 (Accession NP_055501.1). Accordingly, utilities of GAM7957 include diagnosis, prevention and treatment of diseases and clinical conditions associated with KIAA0355.

KIAA0397 (Accession XP_029438.2) is another GAM7957 target gene, herein designated TARGET GENE. KIAA0397 BINDING SITE is a target binding site found in the 3' untranslated region of mRNA encoded by KIAA0397, corresponding to a target binding site such as BINDING SITE I, BINDING SITE II or BINDING SITE III of FIG. 8. Table 4 illustrates the complementarity of the nucleotide sequences of KIAA0397 BINDING SITE, designated SEQ ID:9795, to the nucleotide sequence of GAM7957 RNA, herein designated GAM RNA, also designated SEQ ID:297.

Another function of GAM7957 is therefore inhibition of KIAA0397 (Accession XP_029438.2). Accordingly, utilities of GAM7957 include diagnosis, prevention and treatment of diseases and clinical conditions associated with KIAA0397.

KIAA0408 (Accession NP_055517.1) is another GAM7957 target gene, herein designated TARGET GENE. KIAA0408 BINDING SITE is a target binding site found in the 3' untranslated region of mRNA encoded by KIAA0408, corresponding to a target binding site such as BINDING SITE I, BINDING SITE II or BINDING SITE III of FIG. 8. Table 4 illustrates the complementarity of the nucleotide sequences of KIAA0408 BINDING SITE, designated SEQ ID:11277, to the nucleotide sequence of GAM7957 RNA, herein designated GAM RNA, also designated SEQ ID:297.

Another function of GAM7957 is therefore inhibition of KIAA0408 (Accession NP_055517.1). Accordingly, utilities of GAM7957 include diagnosis, prevention and treatment of diseases and clinical conditions associated with KIAA0408.

KIAA0419 (Accession NP_055526.2) is another GAM7957 target gene, herein designated TARGET GENE. KIAA0419 BINDING SITE is a target binding site found in the 3' untranslated region of mRNA encoded by KIAA0419, corresponding to a target binding site such as BINDING SITE I, BINDING SITE II or BINDING SITE III of FIG. 8. Table 4 illustrates the complementarity of the nucleotide sequences of KIAA0419 BINDING SITE, designated SEQ ID:10439, to the nucleotide sequence of GAM7957 RNA, herein designated GAM RNA, also designated SEQ ID:297.

Another function of GAM7957 is therefore inhibition of KIAA0419 (Accession NP_055526.2). Accordingly, utilities of GAM7957 include diagnosis, prevention and treatment of diseases and clinical conditions associated with KIAA0419.

KIAA0427 (Accession NP_055587.1) is another GAM7957 target gene, herein designated TARGET GENE. KIAA0427 BINDING SITE is a target binding site found in the 3' untranslated region of mRNA encoded by KIAA0427, corresponding to a target binding site such as BINDING SITE I, BINDING SITE II or BINDING SITE III of FIG. 8. Table 4 illustrates the complementarity of the nucleotide sequences of KIAA0427 BINDING SITE, designated SEQ ID:5274, to the nucleotide sequence of GAM7957 RNA, herein designated GAM RNA, also designated SEQ ID:297.

Another function of GAM7957 is therefore inhibition of KIAA0427 (Accession NP_055587.1). Accordingly, utilities of GAM7957 include diagnosis, prevention and treatment of diseases and clinical conditions associated with KIAA0427.

KIAA0446 (Accession XP_044155.1) is another GAM7957 target gene, herein designated TARGET GENE. KIAA0446 BINDING SITE is a target binding site found in the 5' untranslated region of mRNA encoded by KIAA0446, corresponding to a target binding site such as BINDING SITE I, BINDING SITE II or BINDING SITE III of FIG. 8. Table 4 illustrates the complementarity of the nucleotide sequences of KIAA0446 BINDING SITE, designated SEQ ID:19849, to the nucleotide sequence of GAM7957 RNA, herein designated GAM RNA, also designated SEQ ID:297.

Another function of GAM7957 is therefore inhibition of KIAA0446 (Accession XP_044155.1). Accordingly, utilities of GAM7957 include diagnosis, prevention and treatment of diseases and clinical conditions associated with KIAA0446.

KIAA0449 (Accession NP_060066.1) is another GAM7957 target gene, herein designated TARGET GENE. KIAA0449 BINDING SITE is a target binding site found in the 3' untranslated region of mRNA encoded by KIAA0449, corresponding to a target binding site such as BINDING SITE I, BINDING SITE II or BINDING SITE III of FIG. 8. Table 4 illustrates the complementarity of the nucleotide sequences of KIAA0449 BINDING SITE, designated SEQ ID:19104, to the nucleotide sequence of GAM7957 RNA, herein designated GAM RNA, also designated SEQ ID:297.

Another function of GAM7957 is therefore inhibition of KIAA0449 (Accession NP_060066.1). Accordingly, utilities of GAM7957 include diagnosis, prevention and treatment of diseases and clinical conditions associated with KIAA0449.

KIAA0469 (Accession NP_055666.1) is another GAM7957 target gene, herein designated TARGET GENE. KIAA0469 BINDING SITE is a target binding site found in the 3' untranslated region of mRNA encoded by KIAA0469, corresponding to a target binding site such as BINDING SITE I, BINDING SITE II or BINDING SITE III of FIG. 8. Table 4 illustrates the complementarity of the nucleotide sequences of KIAA0469 BINDING SITE, designated SEQ ID:7582, to the nucleotide sequence of GAM7957 RNA, herein designated GAM RNA, also designated SEQ ID:297.

Another function of GAM7957 is therefore inhibition of KIAA0469 (Accession NP_055666.1). Accordingly, utilities of GAM7957 include diagnosis, prevention and treatment of diseases and clinical conditions associated with KIAA0469.

KIAA0471 (Accession NP_055672.1) is another GAM7957 target gene, herein designated TARGET GENE. KIAA0471 BINDING SITE is a target binding site found in the 3' untranslated region of mRNA encoded by KIAA0471, corresponding to a target binding site such as BINDING SITE I, BINDING SITE II or BINDING SITE III of FIG. 8. Table 4 illustrates the complementarity of the nucleotide sequences of KIAA0471 BINDING SITE, designated SEQ ID:2975, to the nucleotide sequence of GAM7957 RNA, herein designated GAM RNA, also designated SEQ ID:297.

Another function of GAM7957 is therefore inhibition of KIAA0471 (Accession NP_055672.1). Accordingly, utilities of GAM7957 include diagnosis, prevention and treatment of diseases and clinical conditions associated with KIAA0471.

KIAA0472 (Accession XP_290898.1) is another GAM7957 target gene, herein designated TARGET GENE. KIAA0472 BINDING SITE is a target binding site found in the 3' untranslated region of mRNA encoded by KIAA0472, corresponding to a target binding site such as BINDING SITE I, BINDING SITE II or BINDING SITE III of FIG. 8. Table 4 illustrates the complementarity of the nucleotide sequences of KIAA0472 BINDING SITE, designated SEQ ID:18691, to the nucleotide sequence of GAM7957 RNA, herein designated GAM RNA, also designated SEQ ID:297.

Another function of GAM7957 is therefore inhibition of KIAA0472 (Accession XP_290898.1). Accordingly, utilities of GAM7957 include diagnosis, prevention and treatment of diseases and clinical conditions associated with KIAA0472.

KIAA0475 (Accession NP_055679.1) is another GAM7957 target gene, herein designated TARGET GENE. KIAA0475 BINDING SITE1 and KIAA0475 BINDING SITE2 are target binding sites found in untranslated regions of mRNA encoded by KIAA0475, corresponding to target binding sites such as BINDING SITE I, BINDING SITE II or BINDING SITE III of FIG. 8. Table 4 illustrates the complementarity of the nucleotide sequences of KIAA0475 BINDING SITE1 and KIAA0475 BINDING SITE2, designated SEQ ID:1492 and SEQ ID:11624 respectively, to the nucleotide sequence of GAM7957 RNA, herein designated GAM RNA, also designated SEQ ID:297.

Another function of GAM7957 is therefore inhibition of KIAA0475 (Accession NP_055679.1). Accordingly, utilities of GAM7957 include diagnosis, prevention and treatment of diseases and clinical conditions associated with KIAA0475.

KIAA0476 (Accession NP_055671.1) is another GAM7957 target gene, herein designated TARGET GENE. KIAA0476 BINDING SITE is a target binding site found in the 5' untranslated region of mRNA encoded by KIAA0476, corresponding to a target binding site such as BINDING SITE I, BINDING SITE II or BINDING SITE III of FIG. 8. Table 4 illustrates the complementarity of the nucleotide sequences of KIAA0476 BINDING SITE, designated SEQ ID:10354, to the nucleotide sequence of GAM7957 RNA, herein designated GAM RNA, also designated SEQ ID:297.

Another function of GAM7957 is therefore inhibition of KIAA0476 (Accession NP_055671.1). Accordingly, utilities of GAM7957 include diagnosis, prevention and treatment of diseases and clinical conditions associated with KIAA0476.

KIAA0478 (Accession NP_055685.1) is another GAM7957 target gene, herein designated TARGET GENE. KIAA0478 BINDING SITE is a target binding site found in the 3' untranslated region of mRNA encoded by KIAA0478, corresponding to a target binding site such as BINDING SITE I, BINDING SITE II or BINDING SITE III of FIG. 8. Table 4 illustrates the complementarity of the nucleotide sequences of KIAA0478 BINDING SITE, designated SEQ ID:18191, to the nucleotide sequence of GAM7957 RNA, herein designated GAM RNA, also designated SEQ ID:297.

Another function of GAM7957 is therefore inhibition of KIAA0478 (Accession NP_055685.1). Accordingly, utilities of GAM7957 include diagnosis, prevention and treatment of diseases and clinical conditions associated with KIAA0478.

KIAA0514 (Accession NP_055511.1) is another GAM7957 target gene, herein designated TARGET GENE. KIAA0514 BINDING SITE is a target binding site found in the 3' untranslated region of mRNA encoded by KIAA0514, corresponding to a target binding site such as BINDING SITE I, BINDING SITE II or BINDING SITE III of FIG. 8. Table 4 illustrates the complementarity of the nucleotide sequences of KIAA0514 BINDING SITE, designated SEQ ID:1907, to the nucleotide sequence of GAM7957 RNA, herein designated GAM RNA, also designated SEQ ID:297.

Another function of GAM7957 is therefore inhibition of KIAA0514 (Accession NP_055511.1). Accordingly, utilities of GAM7957 include diagnosis, prevention and treatment of diseases and clinical conditions associated with KIAA0514.

KIAA0528 (Accession NP_055617.1) is another GAM7957 target gene, herein designated TARGET GENE. KIAA0528 BINDING SITE is a target binding site found in the 5' untranslated region of mRNA encoded by KIAA0528, corresponding to a target binding site such as BINDING SITE I, BINDING SITE II or BINDING SITE III of FIG. 8. Table 4 illustrates the complementarity of the nucleotide sequences of KIAA0528 BINDING SITE, designated SEQ ID:4002, to the nucleotide sequence of GAM7957 RNA, herein designated GAM RNA, also designated SEQ ID:297.

Another function of GAM7957 is therefore inhibition of KIAA0528 (Accession NP_055617.1). Accordingly, utilities of GAM7957 include diagnosis, prevention and treatment of diseases and clinical conditions associated with KIAA0528.

KIAA0557 (Accession XP_085507.1) is another GAM7957 target gene, herein designated TARGET GENE. KIAA0557 BINDING SITE1 and KIAA0557 BINDING SITE2 are target binding sites found in untranslated regions of mRNA encoded by KIAA0557, corresponding to target binding sites such as BINDING SITE I, BINDING SITE II or BINDING SITE III of FIG. 8. Table 4 illustrates the complementarity of the nucleotide sequences of KIAA0557 BINDING SITE1 and KIAA0557 BINDING SITE2, designated SEQ ID:2789 and SEQ ID:2342 respectively, to the nucleotide sequence of GAM7957 RNA, herein designated GAM RNA, also designated SEQ ID:297.

Another function of GAM7957 is therefore inhibition of KIAA0557 (Accession XP_085507.1). Accordingly, utilities of GAM7957 include diagnosis, prevention and treatment of diseases and clinical conditions associated with KIAA0557.

KIAA0563 (Accession NP_055649.1) is another GAM7957 target gene, herein designated TARGET GENE. KIAA0563 BINDING SITE1 and KIAA0563 BINDING SITE2 are target binding sites found in untranslated regions of mRNA encoded by KIAA0563, corresponding to target binding sites such as BINDING SITE I, BINDING SITE II or BINDING SITE III of FIG. 8. Table 4 illustrates the complementarity of the nucleotide sequences of KIAA0563 BINDING SITE1 and KIAA0563 BINDING SITE2, designated SEQ ID:15108 and SEQ ID:609 respectively, to the nucleotide sequence of GAM7957 RNA, herein designated GAM RNA, also designated SEQ ID:297.

Another function of GAM7957 is therefore inhibition of KIAA0563 (Accession NP_055649.1). Accordingly, utilities of GAM7957 include diagnosis, prevention and treatment of diseases and clinical conditions associated with KIAA0563.

KIAA0565 (Accession XP_039912.1) is another GAM7957 target gene, herein designated TARGET GENE. KIAA0565 BINDING SITE is a target binding site found in the 3' untranslated region of mRNA encoded by KIAA0565, corresponding to a target binding site such as BINDING SITE I, BINDING SITE II or BINDING SITE III of FIG. 8. Table 4 illustrates the complementarity of the nucleotide sequences of KIAA0565 BINDING SITE, designated SEQ ID:12789, to the nucleotide sequence of GAM7957 RNA, herein designated GAM RNA, also designated SEQ ID:297.

Another function of GAM7957 is therefore inhibition of KIAA0565 (Accession XP_039912.1). Accordingly, utilities of GAM7957 include diagnosis, prevention and treatment of diseases and clinical conditions associated with KIAA0565.

KIAA0590 (Accession NP_055529.1) is another GAM7957 target gene, herein designated TARGET GENE. KIAA0590 BINDING SITE is a target binding site found in the 5' untranslated region of mRNA encoded by KIAA0590, corresponding to a target binding site such as BINDING SITE I, BINDING SITE II or BINDING SITE III of FIG. 8. Table 4 illustrates the complementarity of the nucleotide sequences of KIAA0590 BINDING SITE, designated SEQ ID:9935, to the nucleotide sequence of GAM7957 RNA, herein designated GAM RNA, also designated SEQ ID:297.

Another function of GAM7957 is therefore inhibition of KIAA0590 (Accession NP_055529.1). Accordingly, utilities of GAM7957 include diagnosis, prevention and treatment of diseases and clinical conditions associated with KIAA0590.

KIAA0628 (Accession NP_055604.1) is another GAM7957 target gene, herein designated TARGET GENE. KIAA0628 BINDING SITE is a target binding site found in the 3' untranslated region of mRNA encoded by KIAA0628, corresponding to a target binding site such as BINDING SITE I, BINDING SITE II or BINDING SITE III of FIG. 8. Table 4 illustrates the complementarity of the nucleotide sequences of KIAA0628 BINDING SITE, designated SEQ ID:16922, to the nucleotide sequence of GAM7957 RNA, herein designated GAM RNA, also designated SEQ ID:297.

Another function of GAM7957 is therefore inhibition of KIAA0628 (Accession NP_055604.1). Accordingly, utilities of GAM7957 include diagnosis, prevention and treatment of diseases and clinical conditions associated with KIAA0628.

KIAA0645 (Accession NP_055477.1) is another GAM7957 target gene, herein designated TARGET GENE. KIAA0645 BINDING SITE is a target binding site found in the 3' untranslated region of mRNA encoded by KIAA0645, corresponding to a target binding site such as BINDING SITE I, BINDING SITE II or BINDING SITE III of FIG. 8. Table 4 illustrates the complementarity of the nucleotide sequences of KIAA0645 BINDING SITE, designated SEQ ID:17488, to the nucleotide sequence of GAM7957 RNA, herein designated GAM RNA, also designated SEQ ID:297.

Another function of GAM7957 is therefore inhibition of KIAA0645 (Accession NP_055477.1). Accordingly, utilities of GAM7957 include diagnosis, prevention and treatment of diseases and clinical conditions associated with KIAA0645.

KIAA0711 (Accession NP_055682.1) is another GAM7957 target gene, herein designated TARGET GENE. KIAA0711 BINDING SITE is a target binding site found in the 3' untranslated region of mRNA encoded by KIAA0711, corresponding to a target binding site such as BINDING SITE I, BINDING SITE II or BINDING SITE III of FIG. 8. Table 4 illustrates the complementarity of the nucleotide sequences of KIAA0711 BINDING SITE, designated SEQ ID:6186, to the nucleotide sequence of GAM7957 RNA, herein designated GAM RNA, also designated SEQ ID:297.

Another function of GAM7957 is therefore inhibition of KIAA0711 (Accession NP_055682.1). Accordingly, utilities of GAM7957 include diagnosis, prevention and treatment of diseases and clinical conditions associated with KIAA0711.

KIAA0759 (Accession NP_056120.1) is another GAM7957 target gene, herein designated TARGET GENE. KIAA0759 BINDING SITE is a target binding site found in the 5' untranslated region of mRNA encoded by KIAA0759, corresponding to a target binding site such as BINDING SITE I, BINDING SITE II or BINDING SITE III of FIG. 8. Table 4 illustrates the complementarity of the nucleotide sequences of KIAA0759 BINDING SITE, designated SEQ ID:16933, to the nucleotide sequence of GAM7957 RNA, herein designated GAM RNA, also designated SEQ ID:297.

Another function of GAM7957 is therefore inhibition of KIAA0759 (Accession NP_056120.1). Accordingly, utilities of GAM7957 include diagnosis, prevention and treatment of diseases and clinical conditions associated with KIAA0759.

KIAA0773 (Accession NP_055505.1) is another GAM7957 target gene, herein designated TARGET GENE. KIAA0773 BINDING SITE is a target binding site found in the 3' untranslated region of mRNA encoded by KIAA0773, corresponding to a target binding site such as BINDING SITE I, BINDING SITE II or BINDING SITE III of FIG. 8. Table 4 illustrates the complementarity of the nucleotide sequences of KIAA0773 BINDING SITE, designated SEQ ID:11119, to the nucleotide sequence of GAM7957 RNA, herein designated GAM RNA, also designated SEQ ID:297.

Another function of GAM7957 is therefore inhibition of KIAA0773 (Accession NP_055505.1). Accordingly, utilities of GAM7957 include diagnosis, prevention and treatment of diseases and clinical conditions associated with KIAA0773.

KIAA0825 (Accession XP_027906.5) is another GAM7957 target gene, herein designated TARGET GENE. KIAA0825 BINDING SITE is a target binding site found in the 3' untranslated region of mRNA encoded by KIAA0825, corresponding to a target binding site such as BINDING SITE I, BINDING SITE II or BINDING SITE III of FIG. 8. Table 4 illustrates the complementarity of the nucleotide sequences of KIAA0825 BINDING SITE, designated SEQ ID:15983, to the nucleotide sequence of GAM7957 RNA, herein designated GAM RNA, also designated SEQ ID:297.

Another function of GAM7957 is therefore inhibition of KIAA0825 (Accession XP_027906.5). Accordingly, utilities of GAM7957 include diagnosis, prevention and treatment of diseases and clinical conditions associated with KIAA0825.

KIAA0831 (Accession NP_055739.1) is another GAM7957 target gene, herein designated TARGET GENE. KIAA0831 BINDING SITE is a target binding site found in the 3' untranslated region of mRNA encoded by KIAA0831, corresponding to a target binding site such as BINDING SITE I, BINDING SITE II or BINDING SITE III of FIG. 8. Table 4 illustrates the complementarity of the nucleotide sequences of KIAA0831 BINDING SITE, designated SEQ ID:3413, to the nucleotide sequence of GAM7957 RNA, herein designated GAM RNA, also designated SEQ ID:297.

Another function of GAM7957 is therefore inhibition of KIAA0831 (Accession NP_055739.1). Accordingly, utilities of GAM7957 include diagnosis, prevention and treatment of diseases and clinical conditions associated with KIAA0831.

KIAA0872 (Accession NP_055755.1) is another GAM7957 target gene, herein designated TARGET GENE. KIAA0872 BINDING SITE1 and KIAA0872 BINDING SITE2 are target binding sites found in untranslated regions of mRNA encoded by KIAA0872, corresponding to target binding sites such as BINDING SITE I, BINDING SITE II or BINDING SITE III of FIG. 8. Table 4 illustrates the complementarity of the nucleotide sequences of KIAA0872 BINDING SITE1 and KIAA0872 BINDING SITE2, designated SEQ ID:4557 and SEQ ID:19196 respectively, to the nucleotide sequence of GAM7957 RNA, herein designated GAM RNA, also designated SEQ ID:297.

Another function of GAM7957 is therefore inhibition of KIAA0872 (Accession NP_055755.1). Accordingly, utilities of GAM7957 include diagnosis, prevention and treatment of diseases and clinical conditions associated with KIAA0872.

KIAA0884 (Accession XP_046660.4) is another GAM7957 target gene, herein designated TARGET GENE. KIAA0884 BINDING SITE1 and KIAA0884 BINDING SITE2 are target binding sites found in untranslated regions of mRNA encoded by KIAA0884, corresponding to target binding sites such as BINDING SITE I, BINDING SITE II or BINDING SITE III of FIG. 8. Table 4 illustrates the complementarity of the nucleotide sequences of KIAA0884 BINDING SITE1 and KIAA0884 BINDING SITE2, designated SEQ ID:5856 and SEQ ID:3610 respectively, to the nucleotide sequence of GAM7957 RNA, herein designated GAM RNA, also designated SEQ ID:297.

Another function of GAM7957 is therefore inhibition of KIAA0884 (Accession XP_046660.4). Accordingly, utilities of GAM7957 include diagnosis, prevention and treatment of diseases and clinical conditions associated with KIAA0884.

KIAA0889 (Accession NP_056192.1) is another GAM7957 target gene, herein designated TARGET GENE. KIAA0889 BINDING SITE1 through KIAA0889 BINDING SITE3 are target binding sites found in untranslated regions of multiple transcripts of mRNA encoded by KIAA0889, corresponding to target binding sites such as BINDING SITE I, BINDING SITE II or BINDING SITE III of FIG. 8. Table 4 illustrates the complementarity of the nucleotide sequences of KIAA0889 BINDING SITE1 through KIAA0889 BINDING SITE3, designated SEQ ID:13091, SEQ ID:13091 and SEQ ID:3264 respectively, to the nucleotide sequence of GAM7957 RNA, herein designated GAM RNA, also designated SEQ ID:297.

Another function of GAM7957 is therefore inhibition of KIAA0889 (Accession NP_056192.1). Accordingly, utilities of GAM7957 include diagnosis, prevention and treatment of diseases and clinical conditions associated with KIAA0889.

KIAA0889 (Accession NP_056192.1) is another GAM7957 target gene, herein designated TARGET GENE. KIAA0889 BINDING SITE1 through KIAA0889 BINDING SITE3 are target binding sites found in untranslated regions of multiple transcripts of mRNA encoded by KIAA0889, corresponding to target binding sites such as BINDING SITE I, BINDING SITE II or BINDING SITE III of FIG. 8. Table 4 illustrates the complementarity of the nucleotide sequences of KIAA0889 BINDING SITE1 through KIAA0889 BINDING SITE3, designated SEQ ID:7577, SEQ ID:12683 and SEQ ID:3136 respectively, to the nucleotide sequence of GAM7957 RNA, herein designated GAM RNA, also designated SEQ ID:297.

Another function of GAM7957 is therefore inhibition of KIAA0889 (Accession NP_056192.1). Accordingly, utilities of GAM7957 include diagnosis, prevention and treatment of diseases and clinical conditions associated with KIAA0889.

KIAA0907 (Accession NP_055764.1) is another GAM7957 target gene, herein designated TARGET GENE. KIAA0907 BINDING SITE1 and KIAA0907 BINDING SITE2 are target binding sites found in untranslated regions of mRNA encoded by KIAA0907, corresponding to target binding sites such as BINDING SITE I, BINDING SITE II or BINDING SITE III of FIG. 8. Table 4 illustrates the complementarity of the nucleotide sequences of KIAA0907 BINDING SITE1 and KIAA0907 BINDING SITE2, designated SEQ ID:11102 and SEQ ID:13066 respectively, to the nucleotide sequence of GAM7957 RNA, herein designated GAM RNA, also designated SEQ ID:297.

Another function of GAM7957 is therefore inhibition of KIAA0907 (Accession NP_055764.1). Accordingly, utilities of GAM7957 include diagnosis, prevention and treatment of diseases and clinical conditions associated with KIAA0907.

KIAA0924 (Accession NP_055712.1) is another GAM7957 target gene, herein designated TARGET GENE. KIAA0924 BINDING SITE is a target binding site found in the 3' untranslated region of mRNA encoded by KIAA0924, corresponding to a target binding site such as BINDING SITE I, BINDING SITE II or BINDING SITE III of FIG. 8. Table 4 illustrates the complementarity of the nucleotide sequences of KIAA0924 BINDING SITE, designated SEQ ID:10571, to the nucleotide sequence of GAM7957 RNA, herein designated GAM RNA, also designated SEQ ID:297.

Another function of GAM7957 is therefore inhibition of KIAA0924 (Accession NP_055712.1). Accordingly, utilities of GAM7957 include diagnosis, prevention and treatment of diseases and clinical conditions associated with KIAA0924.

KIAA0935 (Accession XP_052620.6) is another GAM7957 target gene, herein designated TARGET GENE. KIAA0935 BINDING SITE is a target binding site found in the 3' untranslated region of mRNA encoded by KIAA0935, corresponding to a target binding site such as BINDING SITE I, BINDING SITE II or BINDING SITE III of FIG. 8. Table 4 illustrates the complementarity of the nucleotide sequences of KIAA0935 BINDING SITE, designated SEQ ID:2363, to the nucleotide sequence of GAM7957 RNA, herein designated GAM RNA, also designated SEQ ID:297.

Another function of GAM7957 is therefore inhibition of KIAA0935 (Accession XP_052620.6). Accordingly, utilities of GAM7957 include diagnosis, prevention and treatment of diseases and clinical conditions associated with KIAA0935.

KIAA0981 (Accession XP_028867.2) is another GAM7957 target gene, herein designated TARGET GENE. KIAA0981 BINDING SITE is a target binding site found in the 3' untranslated region of mRNA encoded by KIAA0981, corresponding to a target binding site such as BINDING SITE I, BINDING SITE II or BINDING SITE III of FIG. 8. Table 4 illustrates the complementarity of the nucleotide sequences of KIAA0981 BINDING SITE, designated SEQ ID:2679, to the nucleotide sequence of GAM7957 RNA, herein designated GAM RNA, also designated SEQ ID:297.

Another function of GAM7957 is therefore inhibition of KIAA0981 (Accession XP_028867.2). Accordingly, utilities of GAM7957 include diagnosis, prevention and treatment of diseases and clinical conditions associated with KIAA0981.

KIAA1001 (Accession NP_055775.1) is another GAM7957 target gene, herein designated TARGET GENE. KIAA1001 BINDING SITE1 through KIAA1001 BINDING SITE3 are target binding sites found in untranslated regions of mRNA encoded by KIAA1001, corresponding to target binding sites such as BINDING SITE I, BINDING SITE II or BINDING SITE III of FIG. 8. Table 4 illustrates the complementarity of the nucleotide sequences of KIAA1001 BINDING SITE1 through KIAA1001 BINDING SITE3, designated SEQ ID:19927, SEQ ID:15875 and SEQ ID:1269 respectively, to the nucleotide sequence of GAM7957 RNA, herein designated GAM RNA, also designated SEQ ID:297.

Another function of GAM7957 is therefore inhibition of KIAA1001 (Accession NP_055775.1). Accordingly, utilities of GAM7957 include diagnosis, prevention and treatment of diseases and clinical conditions associated with KIAA1001.

KIAA1032 (Accession XP_038604.4) is another GAM7957 target gene, herein designated TARGET GENE. KIAA1032 BINDING SITE is a target binding site found in the 3' untranslated region of mRNA encoded by KIAA1032, corresponding to a target binding site such as BINDING SITE I, BINDING SITE II or BINDING SITE III of FIG. 8. Table 4 illustrates the complementarity of the nucleotide sequences of KIAA1032 BINDING SITE, designated SEQ ID:5109, to the nucleotide sequence of GAM7957 RNA, herein designated GAM RNA, also designated SEQ ID:297.

Another function of GAM7957 is therefore inhibition of KIAA1032 (Accession XP_038604.4). Accordingly, utilities of GAM7957 include diagnosis, prevention and treatment of diseases and clinical conditions associated with KIAA1032.

KIAA1036 (Accession NP_055724.1) is another GAM7957 target gene, herein designated TARGET GENE. KIAA1036 BINDING SITE is a target binding site found in the 3' untranslated region of mRNA encoded by KIAA1036, corresponding to a target binding site such as BINDING SITE I, BINDING SITE II or BINDING SITE III of FIG. 8. Table 4 illustrates the complementarity of the nucleotide sequences of KIAA1036 BINDING SITE, designated SEQ ID:9356, to the nucleotide sequence of GAM7957 RNA, herein designated GAM RNA, also designated SEQ ID:297.

Another function of GAM7957 is therefore inhibition of KIAA1036 (Accession NP_055724.1). Accordingly, utilities of GAM7957 include diagnosis, prevention and treatment of diseases and clinical conditions associated with KIAA1036.

KIAA1086 (Accession XP_047610.1) is another GAM7957 target gene, herein designated TARGET GENE. KIAA1086 BINDING SITE1 and KIAA1086 BINDING SITE2 are target binding sites found in untranslated regions of mRNA encoded by KIAA1086, corresponding to target binding sites such as BINDING SITE I, BINDING SITE II or BINDING SITE III of FIG. 8. Table 4 illustrates the complementarity of the nucleotide sequences of KIAA1086 BINDING SITE1 and KIAA1086 BINDING SITE2, designated SEQ ID:6649 and SEQ ID:1442 respectively, to the nucleotide sequence of GAM7957 RNA, herein designated GAM RNA, also designated SEQ ID:297.

Another function of GAM7957 is therefore inhibition of KIAA1086 (Accession XP_047610.1). Accordingly, utilities of GAM7957 include diagnosis, prevention and treatment of diseases and clinical conditions associated with KIAA1086.

KIAA1115 (Accession NP_055746.1) is another GAM7957 target gene, herein designated TARGET GENE. KIAA1115 BINDING SITE is a target binding site found in the 5' untranslated region of mRNA encoded by KIAA1115, corresponding to a target binding site such as BINDING SITE I, BINDING SITE II or BINDING SITE III of FIG. 8. Table 4 illustrates the complementarity of the nucleotide sequences of KIAA1115 BINDING SITE, designated SEQ ID:6299, to the nucleotide sequence of GAM7957 RNA, herein designated GAM RNA, also designated SEQ ID:297.

Another function of GAM7957 is therefore inhibition of KIAA1115 (Accession NP_055746.1). Accordingly, utilities of GAM7957 include diagnosis, prevention and treatment of diseases and clinical conditions associated with KIAA1115.

KIAA1126 (Accession XP_050325.1) is another GAM7957 target gene, herein designated TARGET GENE. KIAA1126 BINDING SITE1 and KIAA1126 BINDING SITE2 are target binding sites found in untranslated regions of mRNA encoded by KIAA1126, corresponding to target binding sites such as BINDING SITE I, BINDING SITE II or BINDING SITE III of FIG. 8. Table 4 illustrates the complementarity of the nucleotide sequences of KIAA1126 BINDING SITE1 and KIAA1126 BINDING SITE2, designated SEQ ID:2893 and SEQ ID:18121 respectively, to the nucleotide sequence of GAM7957 RNA, herein designated GAM RNA, also designated SEQ ID:297.

Another function of GAM7957 is therefore inhibition of KIAA1126 (Accession XP_050325.1). Accordingly, utilities of GAM7957 include diagnosis, prevention and treatment of diseases and clinical conditions associated with KIAA1126.

KIAA1136 (Accession XP_166110.3) is another GAM7957 target gene, herein designated TARGET GENE. KIAA1136 BINDING SITE is a target binding site found in the 5' untranslated region of mRNA encoded by KIAA1136, corresponding to a target binding site such as BINDING SITE I, BINDING SITE II or BINDING SITE III of FIG. 8. Table 4 illustrates the complementarity of the nucleotide sequences of KIAA1136 BINDING SITE, designated SEQ ID:6682, to the nucleotide sequence of GAM7957 RNA, herein designated GAM RNA, also designated SEQ ID:297.

Another function of GAM7957 is therefore inhibition of KIAA1136 (Accession XP_166110.3). Accordingly, utilities of GAM7957 include diagnosis, prevention and treatment of diseases and clinical conditions associated with KIAA1136.

KIAA1155 (Accession XP_030864.2) is another GAM7957 target gene, herein designated TARGET GENE. KIAA1155 BINDING SITE is a target binding site found in the 3' untranslated region of mRNA encoded by KIAA1155, corresponding to a target binding site such as BINDING SITE I, BINDING SITE II or BINDING SITE III of FIG. 8. Table 4 illustrates the complementarity of the nucleotide sequences of KIAA1155 BINDING SITE, designated SEQ ID:3204, to the nucleotide sequence of GAM7957 RNA, herein designated GAM RNA, also designated SEQ ID:297.

Another function of GAM7957 is therefore inhibition of KIAA1155 (Accession XP_030864.2). Accordingly, utilities of GAM7957 include diagnosis, prevention and treatment of diseases and clinical conditions associated with KIAA1155.

KIAA1164 (Accession XP_045358.2) is another GAM7957 target gene, herein designated TARGET GENE. KIAA1164 BINDING SITE1 and KIAA1164 BINDING SITE2 are target binding sites found in untranslated regions of mRNA encoded by KIAA1164, corresponding to target binding sites such as BINDING SITE I, BINDING SITE II or BINDING SITE III of FIG. 8. Table 4 illustrates the complementarity of the nucleotide sequences of KIAA1164 BINDING SITE1 and KIAA1164 BINDING SITE2, designated SEQ ID:6526 and SEQ ID:6420 respectively, to the nucleotide sequence of GAM7957 RNA, herein designated GAM RNA, also designated SEQ ID:297.

Another function of GAM7957 is therefore inhibition of KIAA1164 (Accession XP_045358.2). Accordingly, utilities of GAM7957 include diagnosis, prevention and treatment of diseases and clinical conditions associated with KIAA1164.

KIAA1181 (Accession NP_065195.1) is another GAM7957 target gene, herein designated TARGET GENE. KIAA1181 BINDING SITE1 and KIAA1181 BINDING SITE2 are target binding sites found in untranslated regions of mRNA encoded by KIAA1181, corresponding to target binding sites such as BINDING SITE I, BINDING SITE II or BINDING SITE III of FIG. 8. Table 4 illustrates the complementarity of the nucleotide sequences of KIAA1181 BINDING SITE1 and KIAA1181 BINDING SITE2, designated SEQ ID:9991 and SEQ ID:16802 respectively, to the nucleotide sequence of GAM7957 RNA, herein designated GAM RNA, also designated SEQ ID:297.

Another function of GAM7957 is therefore inhibition of KIAA1181 (Accession NP_065195.1). Accordingly, utilities of GAM7957 include diagnosis, prevention and treatment of diseases and clinical conditions associated with KIAA1181.

KIAA1193 (Accession XP_041843.1) is another GAM7957 target gene, herein designated TARGET GENE. KIAA1193 BINDING SITE1 and KIAA1193 BINDING SITE2 are target binding sites found in untranslated regions of mRNA encoded by KIAA1193, corresponding to target binding sites such as BINDING SITE I, BINDING SITE II or BINDING SITE III of FIG. 8. Table 4 illustrates the complementarity of the nucleotide sequences of KIAA1193 BINDING SITE1 and KIAA1193 BINDING SITE2, designated SEQ ID:8722 and SEQ ID:8382 respectively, to the nucleotide sequence of GAM7957 RNA, herein designated GAM RNA, also designated SEQ ID:297.

Another function of GAM7957 is therefore inhibition of KIAA1193 (Accession XP_041843.1). Accordingly, utilities of GAM7957 include diagnosis, prevention and treatment of diseases and clinical conditions associated with KIAA1193.

KIAA1202 (Accession XP_050478.1) is another GAM7957 target gene, herein designated TARGET GENE. KIAA1202 BINDING SITE1 and KIAA1202 BINDING SITE2 are target binding sites found in untranslated regions of mRNA encoded by KIAA1202, corresponding to target binding sites such as BINDING SITE I, BINDING SITE II or BINDING SITE III of FIG. 8. Table 4 illustrates the complementarity of the nucleotide sequences of KIAA1202 BINDING SITE1 and KIAA1202 BINDING SITE2, designated SEQ ID:15089 and SEQ ID:8547 respectively, to the nucleotide sequence of GAM7957 RNA, herein designated GAM RNA, also designated SEQ ID:297.

Another function of GAM7957 is therefore inhibition of KIAA1202 (Accession XP_050478.1). Accordingly, utilities of GAM7957 include diagnosis, prevention and treatment of diseases and clinical conditions associated with KIAA1202.

KIAA1228 (Accession XP_036408.3) is another GAM7957 target gene, herein designated TARGET GENE. KIAA1228 BINDING SITE1 and KIAA1228 BINDING SITE2 are target binding sites found in untranslated regions of mRNA encoded by KIAA1228, corresponding to target binding sites such as BINDING SITE I, BINDING SITE II or BINDING SITE III of FIG. 8. Table 4 illustrates the complementarity of the nucleotide sequences of KIAA1228 BINDING SITE1 and KIAA1228 BINDING SITE2, designated SEQ ID:15089 and SEQ ID:9422 respectively, to the nucleotide sequence of GAM7957 RNA, herein designated GAM RNA, also designated SEQ ID:297.

Another function of GAM7957 is therefore inhibition of KIAA1228 (Accession XP_036408.3). Accordingly, utilities of GAM7957 include diagnosis, prevention and treatment of diseases and clinical conditions associated with KIAA1228.

KIAA1240 (Accession XP_039676.1) is another GAM7957 target gene, herein designated TARGET GENE. KIAA1240 BINDING SITE is a target binding site found in the 3' untranslated region of mRNA encoded by KIAA1240, corresponding to a target binding site such as BINDING SITE I, BINDING SITE II or BINDING SITE III of FIG. 8. Table 4 illustrates the complementarity of the nucleotide sequences of KIAA1240 BINDING SITE, designated SEQ ID:15329, to the nucleotide sequence of GAM7957 RNA, herein designated GAM RNA, also designated SEQ ID:297.

Another function of GAM7957 is therefore inhibition of KIAA1240 (Accession XP_039676.1). Accordingly, utilities of GAM7957 include diagnosis, prevention and treatment of diseases and clinical conditions associated with KIAA1240.

KIAA1270 (Accession XP_291190.1) is another GAM7957 target gene, herein designated TARGET GENE. KIAA1270 BINDING SITE is a target binding site found in the 3' untranslated region of mRNA encoded by KIAA1270, corresponding to a target binding site such as BINDING SITE I, BINDING SITE II or BINDING SITE III of FIG. 8. Table 4 illustrates the complementarity of the nucleotide sequences of KIAA1270 BINDING SITE, designated SEQ ID:3813, to the nucleotide sequence of GAM7957 RNA, herein designated GAM RNA, also designated SEQ ID:297.

Another function of GAM7957 is therefore inhibition of KIAA1270 (Accession XP_291190.1). Accordingly, utilities of GAM7957 include diagnosis, prevention and treatment of diseases and clinical conditions associated with KIAA1270.

KIAA1271 (Accession XP_045472.1) is another GAM7957 target gene, herein designated TARGET GENE. KIAA1271 BINDING SITE is a target binding site found in the 3' untranslated region of mRNA encoded by KIAA1271, corresponding to a target binding site such as BINDING SITE I, BINDING SITE II or BINDING SITE III of FIG. 8. Table 4 illustrates the complementarity of the nucleotide sequences of KIAA1271 BINDING SITE, designated SEQ ID:18088, to the nucleotide sequence of GAM7957 RNA, herein designated GAM RNA, also designated SEQ ID:297.

Another function of GAM7957 is therefore inhibition of KIAA1271 (Accession XP_045472.1). Accordingly, utilities of GAM7957 include diagnosis, prevention and treatment of diseases and clinical conditions associated with KIAA1271.

KIAA1276 (Accession XP_039169.1) is another GAM7957 target gene, herein designated TARGET GENE. KIAA1276 BINDING SITE is a target binding site found in the 3' untranslated region of mRNA encoded by KIAA1276, corresponding to a target binding site such as BINDING SITE I, BINDING SITE II or BINDING SITE III of FIG. 8. Table 4 illustrates the complementarity of the nucleotide sequences of KIAA1276 BINDING SITE, designated SEQ ID:13059, to the nucleotide sequence of GAM7957 RNA, herein designated GAM RNA, also designated SEQ ID:297.

Another function of GAM7957 is therefore inhibition of KIAA1276 (Accession XP_039169.1). Accordingly, utilities of GAM7957 include diagnosis, prevention and treatment of diseases and clinical conditions associated with KIAA1276.

KIAA1277 (Accession XP_035114.3) is another GAM7957 target gene, herein designated TARGET GENE. KIAA1277 BINDING SITE is a target binding site found in the 3' untranslated region of mRNA encoded by KIAA1277, corresponding to a target binding site such as BINDING SITE I, BINDING SITE II or BINDING SITE III of FIG. 8. Table 4 illustrates the complementarity of the nucleotide sequences of KIAA1277 BINDING SITE, designated SEQ ID:3417, to the nucleotide sequence of GAM7957 RNA, herein designated GAM RNA, also designated SEQ ID:297.

Another function of GAM7957 is therefore inhibition of KIAA1277 (Accession XP_035114.3). Accordingly, utilities of GAM7957 include diagnosis, prevention and treatment of diseases and clinical conditions associated with KIAA1277.

KIAA1340 (Accession XP_044836.2) is another GAM7957 target gene, herein designated TARGET GENE. KIAA1340 BINDING SITE is a target binding site found in the 3' untranslated region of mRNA encoded by KIAA1340, corresponding to a target binding site such as BINDING SITE I, BINDING SITE II or BINDING SITE III of FIG. 8. Table 4 illustrates the complementarity of the nucleotide sequences of KIAA1340 BINDING SITE, designated SEQ ID:3882, to the nucleotide sequence of GAM7957 RNA, herein designated GAM RNA, also designated SEQ ID:297.

Another function of GAM7957 is therefore inhibition of KIAA1340 (Accession XP_044836.2). Accordingly, utilities of GAM7957 include diagnosis, prevention and treatment of diseases and clinical conditions associated with KIAA1340.

KIAA1348 (Accession XP_043826.2) is another GAM7957 target gene, herein designated TARGET GENE. KIAA1348 BINDING SITE1 and KIAA1348 BINDING SITE2 are target binding sites found in untranslated regions of mRNA encoded by KIAA1348, corresponding to target binding sites such as BINDING SITE I, BINDING SITE II or BINDING SITE III of FIG. 8. Table 4 illustrates the complementarity of the nucleotide sequences of KIAA1348 BINDING SITE1 and KIAA1348 BINDING SITE2, designated SEQ ID:9419 and SEQ ID:12559 respectively, to the nucleotide sequence of GAM7957 RNA, herein designated GAM RNA, also designated SEQ ID:297.

Another function of GAM7957 is therefore inhibition of KIAA1348 (Accession XP_043826.2). Accordingly, utilities of GAM7957 include diagnosis, prevention and treatment of diseases and clinical conditions associated with KIAA1348.

KIAA1377 (Accession XP_040708.2) is another GAM7957 target gene, herein designated TARGET GENE. KIAA1377 BINDING SITE is a target binding site found in the 3' untranslated region of mRNA encoded by KIAA1377, corresponding to a target binding site such as BINDING SITE I, BINDING SITE II or BINDING SITE III of FIG. 8. Table 4 illustrates the complementarity of the nucleotide sequences of KIAA1377 BINDING SITE, designated SEQ ID:20104, to the nucleotide sequence of GAM7957 RNA, herein designated GAM RNA, also designated SEQ ID:297.

Another function of GAM7957 is therefore inhibition of KIAA1377 (Accession XP_040708.2). Accordingly, utilities of GAM7957 include diagnosis, prevention and treatment of diseases and clinical conditions associated with KIAA1377.

KIAA1399 (Accession XP_046685.4) is another GAM7957 target gene, herein designated TARGET GENE. KIAA1399 BINDING SITE is a target binding site found in the 3' untranslated region of mRNA encoded by KIAA1399, corresponding to a target binding site such as BINDING SITE I, BINDING SITE II or BINDING SITE III of FIG. 8. Table 4 illustrates the complementarity of the nucleotide sequences of KIAA1399 BINDING SITE, designated SEQ ID:10279, to the nucleotide sequence of GAM7957 RNA, herein designated GAM RNA, also designated SEQ ID:297.

Another function of GAM7957 is therefore inhibition of KIAA1399 (Accession XP_046685.4). Accordingly, utilities of GAM7957 include diagnosis, prevention and treatment of diseases and clinical conditions associated with KIAA1399.

KIAA1404 (Accession NP_066363.1) is another GAM7957 target gene, herein designated TARGET GENE. KIAA1404 BINDING SITE is a target binding site found in the 3' untranslated region of mRNA encoded by KIAA1404, corresponding to a target binding site such as BINDING SITE I, BINDING SITE II or BINDING SITE III of FIG. 8. Table 4 illustrates the complementarity of the nucleotide sequences of KIAA1404 BINDING SITE, designated SEQ ID:6419, to the nucleotide sequence of GAM7957 RNA, herein designated GAM RNA, also designated SEQ ID:297.

Another function of GAM7957 is therefore inhibition of KIAA1404 (Accession NP_066363.1). Accordingly, utilities of GAM7957 include diagnosis, prevention and treatment of diseases and clinical conditions associated with KIAA1404.

KIAA1423 (Accession XP_029703.1) is another GAM7957 target gene, herein designated TARGET GENE. KIAA1423 BINDING SITE is a target binding site found in the 3' untranslated region of mRNA encoded by KIAA1423, corresponding to a target binding site such as BINDING SITE I, BINDING SITE II or BINDING SITE III of FIG. 8. Table 4 illustrates the complementarity of the nucleotide sequences of KIAA1423 BINDING SITE, designated SEQ ID:12788, to the nucleotide sequence of GAM7957 RNA, herein designated GAM RNA, also designated SEQ ID:297.

Another function of GAM7957 is therefore inhibition of KIAA1423 (Accession XP_029703.1). Accordingly, utilities of GAM7957 include diagnosis, prevention and treatment of diseases and clinical conditions associated with KIAA1423.

KIAA1447 (Accession XP_290770.2) is another GAM7957 target gene, herein designated TARGET GENE. KIAA1447 BINDING SITE is a target binding site found in the 5' untranslated region of mRNA encoded by KIAA1447, corresponding to a target binding site such as BINDING SITE I, BINDING SITE II or BINDING SITE III of FIG. 8. Table 4 illustrates the complementarity of the nucleotide sequences of KIAA1447 BINDING SITE, designated SEQ ID:10517, to the nucleotide sequence of GAM7957 RNA, herein designated GAM RNA, also designated SEQ ID:297.

Another function of GAM7957 is therefore inhibition of KIAA1447 (Accession XP_290770.2). Accordingly, utilities of GAM7957 include diagnosis, prevention and treatment of diseases and clinical conditions associated with KIAA1447.

KIAA1456 (Accession XP_040100.3) is another GAM7957 target gene, herein designated TARGET GENE. KIAA1456 BINDING SITE1 and KIAA1456 BINDING SITE2 are target binding sites found in untranslated regions of mRNA encoded by KIAA1456, corresponding to target binding sites such as BINDING SITE I, BINDING SITE II or BINDING SITE III of FIG. 8. Table 4 illustrates the complementarity of the nucleotide sequences of KIAA1456 BINDING SITE1 and KIAA1456 BINDING SITE2, designated SEQ ID:18691 and SEQ ID:3412 respectively, to the nucleotide sequence of GAM7957 RNA, herein designated GAM RNA, also designated SEQ ID:297.

Another function of GAM7957 is therefore inhibition of KIAA1456 (Accession XP_040100.3). Accordingly, utilities of GAM7957 include diagnosis, prevention and treatment of diseases and clinical conditions associated with KIAA1456.

KIAA1473 (Accession XP_047550.1) is another GAM7957 target gene, herein designated TARGET GENE. KIAA1473 BINDING SITE1 and KIAA1473 BINDING SITE2 are target binding sites found in untranslated regions of mRNA encoded by KIAA1473, corresponding to target binding sites such as BINDING SITE I, BINDING SITE II or BINDING SITE III of FIG. 8. Table 4 illustrates the complementarity of the nucleotide sequences of KIAA1473 BINDING SITE1 and KIAA1473 BINDING SITE2, designated SEQ ID:1492 and SEQ ID:5557 respectively, to the nucleotide sequence of GAM7957 RNA, herein designated GAM RNA, also designated SEQ ID:297.

Another function of GAM7957 is therefore inhibition of KIAA1473 (Accession XP_047550.1). Accordingly, utilities of GAM7957 include diagnosis, prevention and treatment of diseases and clinical conditions associated with KIAA1473.

KIAA1486 (Accession XP_041126.4) is another GAM7957 target gene, herein designated TARGET GENE. KIAA1486 BINDING SITE is a target binding site found in the 3' untranslated region of mRNA encoded by KIAA1486, corresponding to a target binding site such as BINDING SITE I, BINDING SITE II or BINDING SITE III of FIG. 8. Table 4 illustrates the complementarity of the nucleotide sequences of KIAA1486 BINDING SITE, designated SEQ ID:15677, to the nucleotide sequence of GAM7957 RNA, herein designated GAM RNA, also designated SEQ ID:297.

Another function of GAM7957 is therefore inhibition of KIAA1486 (Accession XP_041126.4). Accordingly, utilities of GAM7957 include diagnosis, prevention and treatment of diseases and clinical conditions associated with KIAA1486.

KIAA1518 (Accession XP_170889.1) is another GAM7957 target gene, herein designated TARGET GENE. KIAA1518 BINDING SITE1 through KIAA1518 BINDING SITE4 are target binding sites found in untranslated regions of multiple transcripts of mRNA encoded by KIAA1518, corresponding to target binding sites such as BINDING SITE I, BINDING SITE II or BINDING SITE III of FIG. 8. Table 4 illustrates the complementarity of the nucleotide sequences of KIAA1518 BINDING SITE1 through KIAA1518 BINDING SITE4, designated SEQ ID:18859, SEQ ID:14466, SEQ ID:10439 and SEQ ID:17403 respectively, to the nucleotide sequence of GAM7957 RNA, herein designated GAM RNA, also designated SEQ ID:297.

Another function of GAM7957 is therefore inhibition of KIAA1518 (Accession XP_170889.1). Accordingly, utilities of GAM7957 include diagnosis, prevention and treatment of diseases and clinical conditions associated with KIAA1518.

KIAA1538 (Accession XP_049474.4) is another GAM7957 target gene, herein designated TARGET GENE. KIAA1538 BINDING SITE1 and KIAA1538 BINDING SITE2 are target binding sites found in untranslated regions of mRNA encoded by KIAA1538, corresponding to target binding sites such as BINDING SITE I, BINDING SITE II or BINDING SITE III of FIG. 8. Table 4 illustrates the complementarity of the nucleotide sequences of KIAA1538 BINDING SITE1 and KIAA1538 BINDING SITE2, designated SEQ ID:17039 and SEQ ID:5273 respectively, to the nucleotide sequence of GAM7957 RNA, herein designated GAM RNA, also designated SEQ ID:297.

Another function of GAM7957 is therefore inhibition of KIAA1538 (Accession XP_049474.4). Accordingly, utilities of GAM7957 include diagnosis, prevention and treatment of diseases and clinical conditions associated with KIAA1538.

KIAA1542 (Accession XP_290536.2) is another GAM7957 target gene, herein designated TARGET GENE. KIAA1542 BINDING SITE is a target binding site found in the 5' untranslated region of mRNA encoded by KIAA1542, corresponding to a target binding site such as BINDING SITE I, BINDING SITE II or BINDING SITE III of FIG. 8. Table 4 illustrates the complementarity of the nucleotide sequences of KIAA1542 BINDING SITE, designated SEQ ID:9321, to the nucleotide sequence of GAM7957 RNA, herein designated GAM RNA, also designated SEQ ID:297.

Another function of GAM7957 is therefore inhibition of KIAA1542 (Accession XP_290536.2). Accordingly, utilities of GAM7957 include diagnosis, prevention and treatment of diseases and clinical conditions associated with KIAA1542.

KIAA1554 (Accession XP_290768.1) is another GAM7957 target gene, herein designated TARGET GENE. KIAA1554 BINDING SITE is a target binding site found in the 3' untranslated region of mRNA encoded by KIAA1554, corresponding to a target binding site such as BINDING SITE I, BINDING SITE II or BINDING SITE III of FIG. 8. Table 4 illustrates the complementarity of the nucleotide sequences of KIAA1554 BINDING SITE, designated SEQ ID:16064, to the nucleotide sequence of GAM7957 RNA, herein designated GAM RNA, also designated SEQ ID:297.

Another function of GAM7957 is therefore inhibition of KIAA1554 (Accession XP_290768.1). Accordingly, utilities of GAM7957 include diagnosis, prevention and treatment of diseases and clinical conditions associated with KIAA1554.

KIAA1559 (Accession XP_054472.2) is another GAM7957 target gene, herein designated TARGET GENE. KIAA1559 BINDING SITE is a target binding site found in the 3' untranslated region of mRNA encoded by KIAA1559, corresponding to a target binding site such as BINDING SITE I, BINDING SITE II or BINDING SITE III of FIG. 8. Table 4 illustrates the complementarity of the nucleotide sequences of KIAA1559 BINDING SITE, designated SEQ ID:15359, to the nucleotide sequence of GAM7957 RNA, herein designated GAM RNA, also designated SEQ ID:297.

Another function of GAM7957 is therefore inhibition of KIAA1559 (Accession XP_054472.2). Accordingly, utilities of GAM7957 include diagnosis, prevention and treatment of diseases and clinical conditions associated with KIAA1559.

KIAA1594 (Accession XP_050754.5) is another GAM7957 target gene, herein designated TARGET GENE. KIAA1594 BINDING SITE is a target binding site found in the 3' untranslated region of mRNA encoded by KIAA1594, corresponding to a target binding site such as BINDING SITE I, BINDING SITE II or BINDING SITE III of FIG. 8. Table 4 illustrates the complementarity of the nucleotide sequences of KIAA1594 BINDING SITE, designated SEQ ID:17403, to the nucleotide sequence of GAM7957 RNA, herein designated GAM RNA, also designated SEQ ID:297.

Another function of GAM7957 is therefore inhibition of KIAA1594 (Accession XP_050754.5). Accordingly, utilities of GAM7957 include diagnosis, prevention and treatment of diseases and clinical conditions associated with KIAA1594.

KIAA1614 (Accession XP_046531.1) is another GAM7957 target gene, herein designated TARGET GENE. KIAA1614 BINDING SITE is a target binding site found in the 3' untranslated region of mRNA encoded by KIAA1614, corresponding to a target binding site such as BINDING SITE I, BINDING SITE II or BINDING SITE III of FIG. 8. Table 4 illustrates the complementarity of the nucleotide sequences of KIAA1614 BINDING SITE, designated SEQ ID:12333, to the nucleotide sequence of GAM7957 RNA, herein designated GAM RNA, also designated SEQ ID:297.

Another function of GAM7957 is therefore inhibition of KIAA1614 (Accession XP_046531.1). Accordingly, utilities of GAM7957 include diagnosis, prevention and treatment of diseases and clinical conditions associated with KIAA1614.

KIAA1618 (Accession XP_290769.2) is another GAM7957 target gene, herein designated TARGET GENE. KIAA1618 BINDING SITE is a target binding site found in the 3' untranslated region of mRNA encoded by KIAA1618, corresponding to a target binding site such as BINDING SITE I, BINDING SITE II or BINDING SITE III of FIG. 8. Table 4 illustrates the complementarity of the nucleotide sequences of KIAA1618 BINDING SITE, designated SEQ ID:17901, to the nucleotide sequence of GAM7957 RNA, herein designated GAM RNA, also designated SEQ ID:297.

Another function of GAM7957 is therefore inhibition of KIAA1618 (Accession XP_290769.2). Accordingly, utilities of GAM7957 include diagnosis, prevention and treatment of diseases and clinical conditions associated with KIAA1618.

KIAA1630 (Accession NP_061176.2) is another GAM7957 target gene, herein designated TARGET GENE. KIAA1630 BINDING SITE is a target binding site found in the 3' untranslated region of mRNA encoded by KIAA1630, corresponding to a target binding site such as BINDING SITE I, BINDING SITE II or BINDING SITE III of FIG. 8. Table 4 illustrates the complementarity of the nucleotide sequences of KIAA1630 BINDING SITE, designated SEQ ID:15143, to the nucleotide sequence of GAM7957 RNA, herein designated GAM RNA, also designated SEQ ID:297.

Another function of GAM7957 is therefore inhibition of KIAA1630 (Accession NP_061176.2). Accordingly, utilities of GAM7957 include diagnosis, prevention and treatment of diseases and clinical conditions associated with KIAA1630.

KIAA1656 (Accession XP_038022.1) is another GAM7957 target gene, herein designated TARGET GENE. KIAA1656 BINDING SITE is a target binding site found in the 5' untranslated region of mRNA encoded by KIAA1656, corresponding to a target binding site such as BINDING SITE I, BINDING SITE II or BINDING SITE III of FIG. 8. Table 4 illustrates the complementarity of the nucleotide sequences of KIAA1656 BINDING SITE, designated SEQ ID:7120, to the nucleotide sequence of GAM7957 RNA, herein designated GAM RNA, also designated SEQ ID:297.

Another function of GAM7957 is therefore inhibition of KIAA1656 (Accession XP_038022.1). Accordingly, utilities of GAM7957 include diagnosis, prevention and treatment of diseases and clinical conditions associated with KIAA1656.

KIAA1673 (Accession XP_047672.4) is another GAM7957 target gene, herein designated TARGET GENE. KIAA1673 BINDING SITE is a target binding site found in the 5' untranslated region of mRNA encoded by KIAA1673, corresponding to a target binding site such as BINDING SITE I, BINDING SITE II or BINDING SITE III of FIG. 8. Table 4 illustrates the complementarity of the nucleotide sequences of KIAA1673 BINDING SITE, designated SEQ ID:17218, to the nucleotide sequence of GAM7957 RNA, herein designated GAM RNA, also designated SEQ ID:297.

Another function of GAM7957 is therefore inhibition of KIAA1673 (Accession XP_047672.4). Accordingly, utilities of GAM7957 include diagnosis, prevention and treatment of diseases and clinical conditions associated with KIAA1673.

KIAA1674 (Accession XP_290462.1) is another GAM7957 target gene, herein designated TARGET GENE. KIAA1674 BINDING SITE is a target binding site found in the 3' untranslated region of mRNA encoded by KIAA1674, corresponding to a target binding site such as BINDING SITE I, BINDING SITE II or BINDING SITE III of FIG. 8. Table 4 illustrates the complementarity of the nucleotide sequences of KIAA1674 BINDING SITE, designated SEQ ID:10619, to the nucleotide sequence of GAM7957 RNA, herein designated GAM RNA, also designated SEQ ID:297.

Another function of GAM7957 is therefore inhibition of KIAA1674 (Accession XP_290462.1). Accordingly, utilities of GAM7957 include diagnosis, prevention and treatment of diseases and clinical conditions associated with KIAA1674.

KIAA1712 (Accession NP_085136.1) is another GAM7957 target gene, herein designated TARGET GENE. KIAA1712 BINDING SITE is a target binding site found in the 5' untranslated region of multiple transcripts of mRNA encoded by KIAA1712, corresponding to a target binding site such as BINDING SITE I, BINDING SITE II or BINDING SITE III of FIG. 8. Table 4 illustrates the complementarity of the nucleotide sequences of KIAA1712 BINDING SITE, designated SEQ ID:1763, to the nucleotide sequence of GAM7957 RNA, herein designated GAM RNA, also designated SEQ ID:297.

Another function of GAM7957 is therefore inhibition of KIAA1712 (Accession NP_085136.1). Accordingly, utilities of GAM7957 include diagnosis, prevention and treatment of diseases and clinical conditions associated with KIAA1712.

KIAA1715 (Accession XP_042834.1) is another GAM7957 target gene, herein designated TARGET GENE. KIAA1715 BINDING SITE is a target binding site found in the 3' untranslated region of mRNA encoded by KIAA1715, corresponding to a target binding site such as BINDING SITE I, BINDING SITE II or BINDING SITE III of FIG. 8. Table 4 illustrates the complementarity of the nucleotide sequences of KIAA1715 BINDING SITE, designated SEQ ID:2721, to the nucleotide sequence of GAM7957 RNA, herein designated GAM RNA, also designated SEQ ID:297.

Another function of GAM7957 is therefore inhibition of KIAA1715 (Accession XP_042834.1). Accordingly, utilities of GAM7957 include diagnosis, prevention and treatment of diseases and clinical conditions associated with KIAA1715.

KIAA1724 (Accession XP_040280.2) is another GAM7957 target gene, herein designated TARGET GENE. KIAA1724 BINDING SITE is a target binding site found in the 3' untranslated region of mRNA encoded by KIAA1724, corresponding to a target binding site such as BINDING SITE I, BINDING SITE II or BINDING SITE III of FIG. 8. Table 4 illustrates the complementarity of the nucleotide sequences of KIAA1724 BINDING SITE, designated SEQ ID:7563, to the nucleotide sequence of GAM7957 RNA, herein designated GAM RNA, also designated SEQ ID:297.

Another function of GAM7957 is therefore inhibition of KIAA1724 (Accession XP_040280.2). Accordingly, utilities of GAM7957 include diagnosis, prevention and treatment of diseases and clinical conditions associated with KIAA1724.

KIAA1735 (Accession XP_290496.1) is another GAM7957 target gene, herein designated TARGET GENE. KIAA1735 BINDING SITE is a target binding site found in the 3' untranslated region of mRNA encoded by KIAA1735, corresponding to a target binding site such as BINDING SITE I, BINDING SITE II or BINDING SITE III of FIG. 8. Table 4 illustrates the complementarity of the nucleotide sequences of KIAA1735 BINDING SITE, designated SEQ ID:10758, to the nucleotide sequence of GAM7957 RNA, herein designated GAM RNA, also designated SEQ ID:297.

Another function of GAM7957 is therefore inhibition of KIAA1735 (Accession XP_290496.1). Accordingly, utilities of GAM7957 include diagnosis, prevention and treatment of diseases and clinical conditions associated with KIAA1735.

KIAA1771 (Accession XP_086404.1) is another GAM7957 target gene, herein designated TARGET GENE. KIAA1771 BINDING SITE is a target binding site found in the 3' untranslated region of mRNA encoded by KIAA1771, corresponding to a target binding site such as BINDING SITE I, BINDING SITE II or BINDING SITE III of FIG. 8. Table 4 illustrates the complementarity of the nucleotide sequences of KIAA1771 BINDING SITE, designated SEQ ID:3051, to the nucleotide sequence of GAM7957 RNA, herein designated GAM RNA, also designated SEQ ID:297.

Another function of GAM7957 is therefore inhibition of KIAA1771 (Accession XP_086404.1). Accordingly, utilities of GAM7957 include diagnosis, prevention and treatment of diseases and clinical conditions associated with KIAA1771.

KIAA1827 (Accession XP_290834.1) is another GAM7957 target gene, herein designated TARGET GENE. KIAA1827 BINDING SITE is a target binding site found in the 5' untranslated region of mRNA encoded by KIAA1827, corresponding to a target binding site such as BINDING SITE I, BINDING SITE II or BINDING SITE III of FIG. 8. Table 4 illustrates the complementarity of the nucleotide sequences of KIAA1827 BINDING SITE, designated SEQ ID:13774, to the nucleotide sequence of GAM7957 RNA, herein designated GAM RNA, also designated SEQ ID:297.

Another function of GAM7957 is therefore inhibition of KIAA1827 (Accession XP_290834.1). Accordingly, utilities of GAM7957 include diagnosis, prevention and treatment of diseases and clinical conditions associated with KIAA1827.

KIAA1836 (Accession XP_114087.2) is another GAM7957 target gene, herein designated TARGET GENE. KIAA1836 BINDING SITE is a target binding site found in the 3' untranslated region of mRNA encoded by KIAA1836, corresponding to a target binding site such as BINDING SITE I, BINDING SITE II or BINDING SITE III of FIG. 8. Table 4 illustrates the complementarity of the nucleotide sequences of KIAA1836 BINDING SITE, designated SEQ ID:9403, to the nucleotide sequence of GAM7957 RNA, herein designated GAM RNA, also designated SEQ ID:297.

Another function of GAM7957 is therefore inhibition of KIAA1836 (Accession XP_114087.2). Accordingly, utilities of GAM7957 include diagnosis, prevention and treatment of diseases and clinical conditions associated with KIAA1836.

KIAA1841 (Accession XP_087056.4) is another GAM7957 target gene, herein designated TARGET GENE. KIAA1841 BINDING SITE is a target binding site found in the 3' untranslated region of mRNA encoded by KIAA1841, corresponding to a target binding site such as BINDING SITE I, BINDING SITE II or BINDING SITE III of FIG. 8. Table 4 illustrates the complementarity of the nucleotide sequences of KIAA1841 BINDING SITE, designated SEQ ID:1419, to the nucleotide sequence of GAM7957 RNA, herein designated GAM RNA, also designated SEQ ID:297.

Another function of GAM7957 is therefore inhibition of KIAA1841 (Accession XP_087056.4). Accordingly, utilities of GAM7957 include diagnosis, prevention and treatment of diseases and clinical conditions associated with KIAA1841.

KIAA1856 (Accession XP_166549.1) is another GAM7957 target gene, herein designated TARGET GENE. KIAA1856 BINDING SITE is a target binding site found in the 5' untranslated region of mRNA encoded by KIAA1856, corresponding to a target binding site such as BINDING SITE I, BINDING SITE II or BINDING SITE III of FIG. 8. Table 4 illustrates the complementarity of the nucleotide sequences of KIAA1856 BINDING SITE, designated SEQ ID:17219, to the nucleotide sequence of GAM7957 RNA, herein designated GAM RNA, also designated SEQ ID:297.

Another function of GAM7957 is therefore inhibition of KIAA1856 (Accession XP_166549.1). Accordingly, utilities of GAM7957 include diagnosis, prevention and treatment of diseases and clinical conditions associated with KIAA1856.

KIAA1870 (Accession NP_116277.1) is another GAM7957 target gene, herein designated TARGET GENE. KIAA1870 BINDING SITE is a target binding site found in the 3' untranslated region of multiple transcripts of mRNA encoded by KIAA1870, corresponding to a target binding site such as BINDING SITE I, BINDING SITE II or BINDING SITE III of FIG. 8. Table 4 illustrates the complementarity of the nucleotide sequences of KIAA1870 BINDING SITE, designated SEQ ID:9531, to the nucleotide sequence of GAM7957 RNA, herein designated GAM RNA, also designated SEQ ID:297.

Another function of GAM7957 is therefore inhibition of KIAA1870 (Accession NP_116277.1). Accordingly, utilities of GAM7957 include diagnosis, prevention and treatment of diseases and clinical conditions associated with KIAA1870.

KIAA1871 (Accession XP_290737.1) is another GAM7957 target gene, herein designated TARGET GENE. KIAA1871 BINDING SITE is a target binding site found in the 3' untranslated region of mRNA encoded by KIAA1871, corresponding to a target binding site such as BINDING SITE I, BINDING SITE II or BINDING SITE III of FIG. 8. Table 4 illustrates the complementarity of the nucleotide sequences of KIAA1871 BINDING SITE, designated SEQ ID:17416, to the nucleotide sequence of GAM7957 RNA, herein designated GAM RNA, also designated SEQ ID:297.

Another function of GAM7957 is therefore inhibition of KIAA1871 (Accession XP_290737.1). Accordingly, utilities of GAM7957 include diagnosis, prevention and treatment of diseases and clinical conditions associated with KIAA1871.

KIAA1872 (Accession NP_149053.1) is another GAM7957 target gene, herein designated TARGET GENE. KIAA1872 BINDING SITE is a target binding site found in the 3' untranslated region of mRNA encoded by KIAA1872, corresponding to a target binding site such as BINDING SITE I, BINDING SITE II or BINDING SITE III of FIG. 8. Table 4 illustrates the complementarity of the nucleotide sequences of KIAA1872 BINDING SITE, designated SEQ ID:16024, to the nucleotide sequence of GAM7957 RNA, herein designated GAM RNA, also designated SEQ ID:297.

Another function of GAM7957 is therefore inhibition of KIAA1872 (Accession NP_149053.1). Accordingly, utilities of GAM7957 include diagnosis, prevention and treatment of diseases and clinical conditions associated with KIAA1872.

KIAA1879 (Accession XP_056635.1) is another GAM7957 target gene, herein designated TARGET GENE. KIAA1879 BINDING SITE is a target binding site found in the 3' untranslated region of mRNA encoded by KIAA1879, corresponding to a target binding site such as BINDING SITE I, BINDING SITE II or BINDING SITE III of FIG. 8. Table 4 illustrates the complementarity of the nucleotide sequences of KIAA1879 BINDING SITE, designated SEQ ID:5944, to the nucleotide sequence of GAM7957 RNA, herein designated GAM RNA, also designated SEQ ID:297.

Another function of GAM7957 is therefore inhibition of KIAA1879 (Accession XP_056635.1). Accordingly, utilities of GAM7957 include diagnosis, prevention and treatment of diseases and clinical conditions associated with KIAA1879.

KIAA1904 (Accession XP_056282.1) is another GAM7957 target gene, herein designated TARGET GENE. KIAA1904 BINDING SITE1 and KIAA1904 BINDING SITE2 are target binding sites found in untranslated regions of mRNA encoded by KIAA1904, corresponding to target binding sites such as BINDING SITE I, BINDING SITE II or BINDING SITE III of FIG. 8. Table 4 illustrates the complementarity of the nucleotide sequences of KIAA1904 BIND- ING SITE1 and KIAA1904 BINDING SITE2, designated SEQ ID:19541 and SEQ ID:2653 respectively, to the nucleotide sequence of GAM7957 RNA, herein designated GAM RNA, also designated SEQ ID:297.

Another function of GAM7957 is therefore inhibition of KIAA1904 (Accession XP_056282.1). Accordingly, utilities of GAM7957 include diagnosis, prevention and treatment of diseases and clinical conditions associated with KIAA1904.

KIAA1917 (Accession XP_290732.1) is another GAM7957 target gene, herein designated TARGET GENE. KIAA1917 BINDING SITE1 through KIAA1917 BINDING SITE3 are target binding sites found in untranslated regions of mRNA encoded by KIAA1917, corresponding to target binding sites such as BINDING SITE I, BINDING SITE II or BINDING SITE III of FIG. 8. Table 4 illustrates the complementarity of the nucleotide sequences of KIAA1917 BINDING SITE1 through KIAA1917 BINDING SITE3, designated SEQ ID:19051, SEQ ID:15343 and SEQ ID:5830 respectively, to the nucleotide sequence of GAM7957 RNA, herein designated GAM RNA, also designated SEQ ID:297.

Another function of GAM7957 is therefore inhibition of KIAA1917 (Accession XP_290732.1). Accordingly, utilities of GAM7957 include diagnosis, prevention and treatment of diseases and clinical conditions associated with KIAA1917.

KIAA1920 (Accession XP_085210.1) is another GAM7957 target gene, herein designated TARGET GENE. KIAA1920 BINDING SITE is a target binding site found in the 5' untranslated region of mRNA encoded by KIAA1920, corresponding to a target binding site such as BINDING SITE I, BINDING SITE II or BINDING SITE III of FIG. 8. Table 4 illustrates the complementarity of the nucleotide sequences of KIAA1920 BINDING SITE, designated SEQ ID:10532, to the nucleotide sequence of GAM7957 RNA, herein designated GAM RNA, also designated SEQ ID:297.

Another function of GAM7957 is therefore inhibition of KIAA1920 (Accession XP_085210.1). Accordingly, utilities of GAM7957 include diagnosis, prevention and treatment of diseases and clinical conditions associated with KIAA1920.

KIAA1936 (Accession XP_056082.5) is another GAM7957 target gene, herein designated TARGET GENE. KIAA1936 BINDING SITE1 through KIAA1936 BINDING SITE3 are target binding sites found in untranslated regions of mRNA encoded by KIAA1936, corresponding to target binding sites such as BINDING SITE I, BINDING SITE II or BINDING SITE III of FIG. 8. Table 4 illustrates the complementarity of the nucleotide sequences of KIAA1936 BINDING SITE1 through KIAA1936 BINDING SITE3, designated SEQ ID:14501, SEQ ID:9047 and SEQ ID:19057 respectively, to the nucleotide sequence of GAM7957 RNA, herein designated GAM RNA, also designated SEQ ID:297.

Another function of GAM7957 is therefore inhibition of KIAA1936 (Accession XP_056082.5). Accordingly, utilities of GAM7957 include diagnosis, prevention and treatment of diseases and clinical conditions associated with KIAA1936.

KIAA1940 (Accession XP_086981.2) is another GAM7957 target gene, herein designated TARGET GENE. KIAA1940 BINDING SITE is a target binding site found in the 3' untranslated region of mRNA encoded by KIAA1940, corresponding to a target binding site such as BINDING SITE I, BINDING SITE II or BINDING SITE III of FIG. 8. Table 4 illustrates the complementarity of the nucleotide sequences of KIAA1940 BINDING SITE, designated SEQ ID:10268, to the nucleotide sequence of GAM7957 RNA, herein designated GAM RNA, also designated SEQ ID:297.

Another function of GAM7957 is therefore inhibition of KIAA1940 (Accession XP_086981.2). Accordingly, utilities of GAM7957 include diagnosis, prevention and treatment of diseases and clinical conditions associated with KIAA1940.

KIAA1941 (Accession XP_059318.2) is another GAM7957 target gene, herein designated TARGET GENE. KIAA1941 BINDING SITE is a target binding site found in the 3' untranslated region of mRNA encoded by KIAA1941, corresponding to a target binding site such as BINDING SITE I, BINDING SITE II or BINDING SITE III of FIG. 8. Table 4 illustrates the complementarity of the nucleotide sequences of KIAA1941 BINDING SITE, designated SEQ ID:9414, to the nucleotide sequence of GAM7957 RNA, herein designated GAM RNA, also designated SEQ ID:297.

Another function of GAM7957 is therefore inhibition of KIAA1941 (Accession XP_059318.2). Accordingly, utilities of GAM7957 include diagnosis, prevention and treatment of diseases and clinical conditions associated with KIAA1941.

KIAA1949 (Accession XP_300202.1) is another GAM7957 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:17575, to the nucleotide sequence of GAM7957 RNA, herein designated GAM RNA, also designated SEQ ID:297.

Another function of GAM7957 is therefore inhibition of KIAA1949 (Accession XP_300202.1). Accordingly, utilities of GAM7957 include diagnosis, prevention and treatment of diseases and clinical conditions associated with KIAA1949.

KIAA1949 (Accession XP_166376.1) is another GAM7957 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:17575, to the nucleotide sequence of GAM7957 RNA, herein designated GAM RNA, also designated SEQ ID:297.

Another function of GAM7957 is therefore inhibition of KIAA1949 (Accession XP_166376.1). Accordingly, utilities of GAM7957 include diagnosis, prevention and treatment of diseases and clinical conditions associated with KIAA1949.

KIAA1949 (Accession XP_300167.1) is another GAM7957 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:17575, to the nucleotide sequence of GAM7957 RNA, herein designated GAM RNA, also designated SEQ ID:297.

Another function of GAM7957 is therefore inhibition of KIAA1949 (Accession XP_300167.1). Accordingly, utilities of GAM7957 include diagnosis, prevention and treatment of diseases and clinical conditions associated with KIAA1949.

KIAA1951 (Accession XP_057401.1) is another GAM7957 target gene, herein designated TARGET GENE. KIAA1951 BINDING SITE1 and KIAA1951 BINDING SITE2 are target binding sites found in untranslated regions of mRNA encoded by KIAA1951, corresponding to target binding sites such as BINDING SITE I, BINDING SITE II or BINDING SITE III of FIG. 8. Table 4 illustrates the complementarity of the nucleotide sequences of KIAA1951 BINDING SITE1 and KIAA1951 BINDING SITE2, designated SEQ ID:15343 and SEQ ID:13263 respectively, to the nucleotide sequence of GAM7957 RNA, herein designated GAM RNA, also designated SEQ ID:297.

Another function of GAM7957 is therefore inhibition of KIAA1951 (Accession XP_057401.1). Accordingly, utilities of GAM7957 include diagnosis, prevention and treatment of diseases and clinical conditions associated with KIAA1951.

KIAA1954 (Accession XP_085375.4) is another GAM7957 target gene, herein designated TARGET GENE. KIAA1954 BINDING SITE is a target binding site found in the 3' untranslated region of mRNA encoded by KIAA1954, corresponding to a target binding site such as BINDING SITE I, BINDING SITE II or BINDING SITE III of FIG. 8. Table 4 illustrates the complementarity of the nucleotide sequences of KIAA1954 BINDING SITE, designated SEQ ID:11132, to the nucleotide sequence of GAM7957 RNA, herein designated GAM RNA, also designated SEQ ID:297.

Another function of GAM7957 is therefore inhibition of KIAA1954 (Accession XP_085375.4). Accordingly, utilities of GAM7957 include diagnosis, prevention and treatment of diseases and clinical conditions associated with KIAA1954.

KIAA1956 (Accession XP_085836.1) is another GAM7957 target gene, herein designated TARGET GENE. KIAA1956 BINDING SITE is a target binding site found in the 5' untranslated region of mRNA encoded by KIAA1956, corresponding to a target binding site such as BINDING SITE I, BINDING SITE II or BINDING SITE III of FIG. 8. Table 4 illustrates the complementarity of the nucleotide sequences of KIAA1956 BINDING SITE, designated SEQ ID:4403, to the nucleotide sequence of GAM7957 RNA, herein designated GAM RNA, also designated SEQ ID:297.

Another function of GAM7957 is therefore inhibition of KIAA1956 (Accession XP_085836.1). Accordingly, utilities of GAM7957 include diagnosis, prevention and treatment of diseases and clinical conditions associated with KIAA1956.

KIAA1958 (Accession XP_088566.2) is another GAM7957 target gene, herein designated TARGET GENE. KIAA1958 BINDING SITE is a target binding site found in the 3' untranslated region of mRNA encoded by KIAA1958, corresponding to a target binding site such as BINDING SITE I, BINDING SITE II or BINDING SITE III of FIG. 8. Table 4 illustrates the complementarity of the nucleotide sequences of KIAA1958 BINDING SITE, designated SEQ ID:18691, to the nucleotide sequence of GAM7957 RNA, herein designated GAM RNA, also designated SEQ ID:297.

Another function of GAM7957 is therefore inhibition of KIAA1958 (Accession XP_088566.2). Accordingly, utilities of GAM7957 include diagnosis, prevention and treatment of diseases and clinical conditions associated with KIAA1958.

KIAA1979 (Accession XP_113984.2) is another GAM7957 target gene, herein designated TARGET GENE. KIAA1979 BINDING SITE1 and KIAA1979 BINDING SITE2 are target binding sites found in untranslated regions of mRNA encoded by KIAA1979, corresponding to target binding sites such as BINDING SITE I, BINDING SITE II or BINDING SITE III of FIG. 8. Table 4 illustrates the complementarity of the nucleotide sequences of KIAA1979 BINDING SITE1 and KIAA1979 BINDING SITE2, designated SEQ ID:10353 and SEQ ID:10065 respectively, to the nucleotide sequence of GAM7957 RNA, herein designated GAM RNA, also designated SEQ ID:297.

Another function of GAM7957 is therefore inhibition of KIAA1979 (Accession XP_113984.2). Accordingly, utilities of GAM7957 include diagnosis, prevention and treatment of diseases and clinical conditions associated with KIAA1979.

KIAA1981 (Accession XP_114000.1) is another GAM7957 target gene, herein designated TARGET GENE. KIAA1981 BINDING SITE is a target binding site found in the 3' untranslated region of mRNA encoded by KIAA1981, corresponding to a target binding site such as BINDING SITE I, BINDING SITE II or BINDING SITE III of FIG. 8. Table 4 illustrates the complementarity of the nucleotide sequences of KIAA1981 BINDING SITE, designated SEQ ID:7592, to the nucleotide sequence of GAM7957 RNA, herein designated GAM RNA, also designated SEQ ID:297.

Another function of GAM7957 is therefore inhibition of KIAA1981 (Accession XP_114000.1). Accordingly, utilities of GAM7957 include diagnosis, prevention and treatment of diseases and clinical conditions associated with KIAA1981.

KIAA1998 (Accession XP_068710.3) is another GAM7957 target gene, herein designated TARGET GENE. KIAA1998 BINDING SITE1 and KIAA1998 BINDING SITE2 are target binding sites found in untranslated regions of mRNA encoded by KIAA1998, corresponding to target binding sites such as BINDING SITE I, BINDING SITE II or BINDING SITE III of FIG. 8. Table 4 illustrates the complementarity of the nucleotide sequences of KIAA1998 BINDING SITE1 and KIAA1998 BINDING SITE2, designated SEQ ID:10487 and SEQ ID:10265 respectively, to the nucleotide sequence of GAM7957 RNA, herein designated GAM RNA, also designated SEQ ID:297.

Another function of GAM7957 is therefore inhibition of KIAA1998 (Accession XP_068710.3). Accordingly, utilities of GAM7957 include diagnosis, prevention and treatment of diseases and clinical conditions associated with KIAA1998.

KIF11 (Accession NP_004514.2) is another GAM7957 target gene, herein designated TARGET GENE. KIF11 BINDING SITE is a target binding site found in the 3' untranslated region of mRNA encoded by KIF11, corresponding to a target binding site such as BINDING SITE I, BINDING SITE II or BINDING SITE III of FIG. 8. Table 4 illustrates the complementarity of the nucleotide sequences of KIF11 BINDING SITE, designated SEQ ID:5160, to the nucleotide sequence of GAM7957 RNA, herein designated GAM RNA, also designated SEQ ID:297.

Another function of GAM7957 is therefore inhibition of KIF11 (Accession NP_004514.2). Accordingly, utilities of GAM7957 include diagnosis, prevention and treatment of diseases and clinical conditions associated with KIF11.

Kinesin family member 13b (KIF13B, Accession NP_056069.1) is another GAM7957 target gene, herein designated TARGET GENE. KIF13B BINDING SITE is a target binding site found in the 3' untranslated region of mRNA encoded by KIF13B, corresponding to a target binding site such as BINDING SITE I, BINDING SITE II or BINDING SITE III of FIG. 8. Table 4 illustrates the complementarity of the nucleotide sequences of KIF13B BINDING SITE, designated SEQ ID:19613, to the nucleotide sequence of GAM7957 RNA, herein designated GAM RNA, also designated SEQ ID:297.

Another function of GAM7957 is therefore inhibition of Kinesin family member 13b (KIF13B, Accession NP_056069.1). Accordingly, utilities of GAM7957 include diagnosis, prevention and treatment of diseases and clinical conditions associated with KIF13B.

Kinesin family member 14 (KIF14, Accession NP_055690.1) is another GAM7957 target gene, herein designated TARGET GENE. KIF14 BINDING SITE is a target binding site found in the 3' untranslated region of mRNA encoded by KIF14, corresponding to a target binding site such as BINDING SITE I, BINDING SITE II or BINDING SITE III of FIG. 8. Table 4 illustrates the complementarity of the nucleotide sequences of KIF14 BINDING SITE, designated SEQ ID:2937, to the nucleotide sequence of GAM7957 RNA, herein designated GAM RNA, also designated SEQ ID:297.

Another function of GAM7957 is therefore inhibition of Kinesin family member 14 (KIF14, Accession NP_055690.1). Accordingly, utilities of GAM7957 include diagnosis, prevention and treatment of diseases and clinical conditions associated with KIF14.

Kinesin family member 1b (KIF1B, Accession NP_055889.1) is another GAM7957 target gene, herein designated TARGET GENE. KIF1B BINDING SITE is a target binding site found in the 3' untranslated region of mRNA encoded by KIF1B, corresponding to a target binding site such as BINDING SITE I, BINDING SITE II or BINDING SITE III of FIG. 8. Table 4 illustrates the complementarity of the nucleotide sequences of KIF1B BINDING SITE, designated SEQ ID:10435, to the nucleotide sequence of GAM7957 RNA, herein designated GAM RNA, also designated SEQ ID:297.

Another function of GAM7957 is therefore inhibition of Kinesin family member 1b (KIF1B, Accession NP_055889.1), a gene which motor for anterograde transport of mitochondria. has a microtubule plus end-directed motility. and therefore is associated with Charcot-marie-tooth disease, neuronal type, a. Accordingly, utilities of GAM7957 include diagnosis, prevention and treatment of Charcot-marie- tooth disease, neuronal type, a, and of other diseases and clinical conditions associated with KIF1B.

The function of KIF1B and its association with various diseases and clinical conditions, has been established by previous studies, as described hereinabove with reference to GAM72.1. Kinesin family member 3b (KIF3B, Accession NP_004789.1) is another GAM7957 target gene, herein designated TARGET GENE. KIF3B BINDING SITE is a target binding site found in the 3' untranslated region of mRNA encoded by KIF3B, corresponding to a target binding site such as BINDING SITE I, BINDING SITE II or BINDING SITE III of FIG. 8. Table 4 illustrates the complementarity of the nucleotide sequences of KIF3B BINDING SITE, designated SEQ ID:17418, to the nucleotide sequence of GAM7957 RNA, herein designated GAM RNA, also designated SEQ ID:297.

Another function of GAM7957 is therefore inhibition of Kinesin family member 3b (KIF3B, Accession NP_004789.1), a gene which is a microtubule-based anterograde translocator for membranous organelles. Accordingly, utilities of GAM7957 include diagnosis, prevention and treatment of diseases and clinical conditions associated with KIF3B.

The function of KIF3B and its association with various diseases and clinical conditions, has been established by previous studies, as described hereinabove with reference to GAM72.1. Kinesin family member 5c (KIF5C, Accession NP_004513.1) is another GAM7957 target gene, herein designated TARGET GENE. KIF5C BINDING SITE is a target binding site found in the 3' untranslated region of mRNA encoded by KIF5C, corresponding to a target binding site such as BINDING SITE I, BINDING SITE II or BINDING SITE III of FIG. 8. Table 4 illustrates the complementarity of the nucleotide sequences of KIF5C BINDING SITE, designated SEQ ID:2807, to the nucleotide sequence of GAM7957 RNA, herein designated GAM RNA, also designated SEQ ID:297.

Another function of GAM7957 is therefore inhibition of Kinesin family member 5c (KIF5C, Accession NP_004513.1). Accordingly, utilities of GAM7957 include diagnosis, prevention and treatment of diseases and clinical conditions associated with KIF5C.

KLC2L (Accession NP_660318.1) is another GAM7957 target gene, herein designated TARGET GENE. KLC2L BINDING SITE is a target binding site found in the 3' untranslated region of multiple transcripts of mRNA encoded by KLC2L, corresponding to a target binding site such as BINDING SITE I, BINDING SITE II or BINDING SITE III of FIG. 8. Table 4 illustrates the complementarity of the nucleotide sequences of KLC2L BINDING SITE, designated SEQ ID:13397, to the nucleotide sequence of GAM7957 RNA, herein designated GAM RNA, also designated SEQ ID:297.

Another function of GAM7957 is therefore inhibition of KLC2L (Accession NP_660318.1). Accordingly, utilities of GAM7957 include diagnosis, prevention and treatment of diseases and clinical conditions associated with KLC2L.

Killer cell lectin-like receptor subfamily g, member 1 (KLRG1, Accession NP_005801.2) is another GAM7957 target gene, herein designated TARGET GENE. KLRG1 BINDING SITE is a target binding site found in the 3' untranslated region of mRNA encoded by KLRG1, corresponding to a target binding site such as BINDING SITE I, BINDING SITE II or BINDING SITE III of FIG. 8. Table 4 illustrates the complementarity of the nucleotide sequences of KLRG1 BINDING SITE, designated SEQ ID:13091, to the nucleotide sequence of GAM7957 RNA, herein designated GAM RNA, also designated SEQ ID:297.

Another function of GAM7957 is therefore inhibition of Killer cell lectin-like receptor subfamily g, member 1 (KLRG1, Accession NP_005801.2), a gene which plays a role in host defense;. Accordingly, utilities of GAM7957 include diagnosis, prevention and treatment of diseases and clinical conditions associated with KLRG1.

The function of KLRG1 and its association with various diseases and clinical conditions, has been established by previous studies, as described hereinabove with reference to GAM347.2. Kringle containing transmembrane protein 1 (KREMEN1, Accession NP_114434.3) is another GAM7957 target gene, herein designated TARGET GENE. KREMEN1 BINDING SITE1 and KREMEN1 BINDING SITE2 are target binding sites found in untranslated regions of multiple transcripts of mRNA encoded by KREMEN1, corresponding to target binding sites such as BINDING SITE I, BINDING SITE II or BINDING SITE III of FIG. 8. Table 4 illustrates the complementarity of the nucleotide sequences of KREMEN1 BINDING SITE1 and KREMEN1 BINDING SITE2, designated SEQ ID:14776 and SEQ ID:9420 respectively, to the nucleotide sequence of GAM7957 RNA, herein designated GAM RNA, also designated SEQ ID:297.

Another function of GAM7957 is therefore inhibition of Kringle containing transmembrane protein 1 (KREMEN1, Accession NP_114434.3). Accordingly, utilities of GAM7957 include diagnosis, prevention and treatment of diseases and clinical conditions associated with KREMEN1.

Kinase suppressor of ras (KSR, Accession XP_290793.1) is another GAM7957 target gene, herein designated TARGET GENE. KSR BINDING SITE is a target binding site found in the 5' untranslated region of mRNA encoded by KSR, corresponding to a target binding site such as BINDING SITE I, BINDING SITE II or BINDING SITE III of FIG. 8. Table 4 illustrates the complementarity of the nucleotide sequences of KSR BINDING SITE, designated SEQ ID:3327, to the nucleotide sequence of GAM7957 RNA, herein designated GAM RNA, also designated SEQ ID:297.

Another function of GAM7957 is therefore inhibition of Kinase suppressor of ras (KSR, Accession XP_290793.1). Accordingly, utilities of GAM7957 include diagnosis, prevention and treatment of diseases and clinical conditions associated with KSR.

Lysosomal-associated membrane protein 2 (LAMP2, Accession NP_054701.1) is another GAM7957 target gene, herein designated TARGET GENE. LAMP2 BINDING SITE1 and LAMP2 BINDING SITE2 are target binding sites found in untranslated regions of multiple transcripts of mRNA encoded by LAMP2, corresponding to target binding sites such as BINDING SITE I, BINDING SITE II or BINDING SITE III of FIG. 8. Table 4 illustrates the complementarity of the nucleotide sequences of LAMP2 BINDING SITE1 and LAMP2 BINDING SITE2, designated SEQ ID:10440 and SEQ ID:2602 respectively, to the nucleotide sequence of GAM7957 RNA, herein designated GAM RNA, also designated SEQ ID:297.

Another function of GAM7957 is therefore inhibition of Lysosomal-associated membrane protein 2 (LAMP2, Accession NP_054701.1). Accordingly, utilities of GAM7957 include diagnosis, prevention and treatment of diseases and clinical conditions associated with LAMP2.

LANO (Accession NP_079444.1) is another GAM7957 target gene, herein designated TARGET GENE. LANO BINDING SITE is a target binding site found in the 3' untranslated region of multiple transcripts of mRNA encoded by LANO, corresponding to a target binding site such as BINDING SITE I, BINDING SITE II or BINDING SITE III of FIG. 8. Table 4 illustrates the complementarity of the nucleotide sequences of LANO BINDING SITE, designated SEQ ID:4084, to the nucleotide sequence of GAM7957 RNA, herein designated GAM RNA, also designated SEQ ID:297.

Another function of GAM7957 is therefore inhibition of LANO (Accession NP_079444.1). Accordingly, utilities of GAM7957 include diagnosis, prevention and treatment of diseases and clinical conditions associated with LANO.

LAP1B (Accession NP_056417.1) is another GAM7957 target gene, herein designated TARGET GENE. LAP1B BINDING SITE is a target binding site found in the 3' untranslated region of mRNA encoded by LAP1B, corresponding to a target binding site such as BINDING SITE I, BINDING SITE II or BINDING SITE III of FIG. 8. Table 4 illustrates the complementarity of the nucleotide sequences of LAP1B BINDING SITE, designated SEQ ID:948, to the nucleotide sequence of GAM7957 RNA, herein designated GAM RNA, also designated SEQ ID:297.

Another function of GAM7957 is therefore inhibition of LAP1B (Accession NP_056417.1). Accordingly, utilities of GAM7957 include diagnosis, prevention and treatment of diseases and clinical conditions associated with LAP1B.

Lim and sh3 protein 1 (LASP1, Accession NP_006139.1) is another GAM7957 target gene, herein designated TARGET GENE. LASP1 BINDING SITE is a target binding site found in the 3' untranslated region of mRNA encoded by LASP1, corresponding to a target binding site such as BINDING SITE I, BINDING SITE II or BINDING SITE III of FIG. 8. Table 4 illustrates the complementarity of the nucleotide sequences of LASP1 BINDING SITE, designated SEQ ID:9055, to the nucleotide sequence of GAM7957 RNA, herein designated GAM RNA, also designated SEQ ID:297.

Another function of GAM7957 is therefore inhibition of Lim and sh3 protein 1 (LASP1, Accession NP_006139.1). Accordingly, utilities of GAM7957 include diagnosis, prevention and treatment of diseases and clinical conditions associated with LASP1.

Lim domain binding 3 (LDB3, Accession XP_084376.6) is another GAM7957 target gene, herein designated TARGET GENE. LDB3 BINDING SITE is a target binding site found in the 3' untranslated region of mRNA encoded by LDB3, corresponding to a target binding site such as BINDING SITE I, BINDING SITE II or BINDING SITE III of FIG. 8. Table 4 illustrates the complementarity of the nucleotide sequences of LDB3 BINDING SITE, designated SEQ ID:14268, to the nucleotide sequence of GAM7957 RNA, herein designated GAM RNA, also designated SEQ ID:297.

Another function of GAM7957 is therefore inhibition of Lim domain binding 3 (LDB3, Accession XP_084376.6), a gene which could play a role during mating. Accordingly, utilities of GAM7957 include diagnosis, prevention and treatment of diseases and clinical conditions associated with LDB3.

The function of LDB3 and its association with various diseases and clinical conditions, has been established by previous studies, as described hereinabove with reference to GAM40.1. Low density lipoprotein receptor (familial hypercholesterolemia) (LDLR, Accession NP_000518.1) is another GAM7957 target gene, herein designated TARGET GENE. LDLR BINDING SITE1 through LDLR BINDING SITE3 are target binding sites found in untranslated regions of mRNA encoded by LDLR, corresponding to target binding sites such as BINDING SITE I, BINDING SITE II or BINDING SITE III of FIG. 8. Table 4 illustrates the complementarity of the nucleotide sequences of LDLR BINDING SITE1 through LDLR BINDING SITE3, designated SEQ ID:4260, SEQ ID:8019 and SEQ ID:4880 respectively, to the nucleotide sequence of GAM7957 RNA, herein designated GAM RNA, also designated SEQ ID:297.

Another function of GAM7957 is therefore inhibition of Low density lipoprotein receptor (familial hypercholesterolemia) (LDLR, Accession NP_000518.1), a gene which also acts as a tumor suppressor. and therefore is associated with Familial hypercholesterolemia. Accordingly, utilities of GAM7957 include diagnosis, prevention and treatment of Familial hypercholesterolemia, and of other diseases and clinical conditions associated with LDLR.

The function of LDLR and its association with various diseases and clinical conditions, has been established by previous studies, as described hereinabove with reference to GAM99.1. Leptin (obesity homolog, mouse) (LEP, Accession NP_000221.1) is another GAM7957 target gene, herein designated TARGET GENE. LEP BINDING SITE is a target binding site found in the 3' untranslated region of mRNA encoded by LEP, corresponding to a target binding site such as BINDING SITE I, BINDING SITE II or BINDING SITE III of FIG. 8. Table 4 illustrates the complementarity of the nucleotide sequences of LEP BINDING SITE, designated SEQ ID:5562, to the nucleotide sequence of GAM7957 RNA, herein designated GAM RNA, also designated SEQ ID:297.

Another function of GAM7957 is therefore inhibition of Leptin (obesity homolog, mouse) (LEP, Accession NP_000221.1). Accordingly, utilities of GAM7957 include diagnosis, prevention and treatment of diseases and clinical conditions associated with LEP.

Leukocyte immunoglobulin-like receptor, subfamily b (with tm and itim domains), member 1 (LILRB1, Accession NP_006660.1) is another GAM7957 target gene, herein designated TARGET GENE. LILRB1 BINDING SITE is a target binding site found in the 3' untranslated region of mRNA encoded by LILRB1, corresponding to a target binding site such as BINDING SITE I, BINDING SITE II or BINDING SITE III of FIG. 8. Table 4 illustrates the complementarity of the nucleotide sequences of LILRB1 BINDING SITE, designated SEQ ID:7591, to the nucleotide sequence of GAM7957 RNA, herein designated GAM RNA, also designated SEQ ID:297.

Another function of GAM7957 is therefore inhibition of Leukocyte immunoglobulin-like receptor, subfamily b (with tm and itim domains), member 1 (LILRB1, Accession NP_006660.1). Accordingly, utilities of GAM7957 include diagnosis, prevention and treatment of diseases and clinical conditions associated with LILRB1.

LIM (Accession NP_006448.1) is another GAM7957 target gene, herein designated TARGET GENE. LIM BINDING SITE1 and LIM BINDING SITE2 are target binding sites found in untranslated regions of mRNA encoded by LIM, corresponding to target binding sites such as BINDING SITE I, BINDING SITE II or BINDING SITE III of FIG. 8. Table 4 illustrates the complementarity of the nucleotide sequences of LIM BINDING SITE1 and LIM BINDING SITE2, designated SEQ ID:15993 and SEQ ID:1052 respectively, to the nucleotide sequence of GAM7957 RNA, herein designated GAM RNA, also designated SEQ ID:297.

Another function of GAM7957 is therefore inhibition of LIM (Accession NP_006448.1). Accordingly, utilities of GAM7957 include diagnosis, prevention and treatment of diseases and clinical conditions associated with LIM.

Lamin b2 (LMNB2, Accession NP_116126.2) is another GAM7957 target gene, herein designated TARGET GENE. LMNB2 BINDING SITE is a target binding site found in the 3' untranslated region of mRNA encoded by LMNB2, corresponding to a target binding site such as BINDING SITE I, BINDING SITE II or BINDING SITE III of FIG. 8. Table 4 illustrates the complementarity of the nucleotide sequences of LMNB2 BINDING SITE, designated SEQ ID:5883, to the nucleotide sequence of GAM7957 RNA, herein designated GAM RNA, also designated SEQ ID:297.

Another function of GAM7957 is therefore inhibition of Lamin b2 (LMNB2, Accession NP_116126.2). Accordingly, utilities of GAM7957 include diagnosis, prevention and treatment of diseases and clinical conditions associated with LMNB2.

Leiomodin 1 (smooth muscle) (LMOD1, Accession NP_036266.1) is another GAM7957 target gene, herein designated TARGET GENE. LMOD1 BINDING SITE is a target binding site found in the 3' untranslated region of mRNA encoded by LMOD1, corresponding to a target binding site such as BINDING SITE I, BINDING SITE II or BINDING SITE III of FIG. 8. Table 4 illustrates the complementarity of the nucleotide sequences of LMOD1 BINDING SITE, designated SEQ ID:6842, to the nucleotide sequence of GAM7957 RNA, herein designated GAM RNA, also designated SEQ ID:297.

Another function of GAM7957 is therefore inhibition of Leiomodin 1 (smooth muscle) (LMOD1, Accession NP_036266.1). Accordingly, utilities of GAM7957 include diagnosis, prevention and treatment of diseases and clinical conditions associated with LMOD1.

Leiomodin 3 (fetal) (LMOD3, Accession XP_067529.3) is another GAM7957 target gene, herein designated TARGET GENE. LMOD3 BINDING SITE1 and LMOD3 BINDING SITE2 are target binding sites found in untranslated regions of mRNA encoded by LMOD3, corresponding to target binding sites such as BINDING SITE I, BINDING SITE II or BINDING SITE III of FIG. 8. Table 4 illustrates the complementarity of the nucleotide sequences of LMOD3 BINDING SITE1 and LMOD3 BINDING SITE2, designated SEQ ID:15089 and SEQ ID:14217 respectively, to the nucleotide sequence of GAM7957 RNA, herein designated GAM RNA, also designated SEQ ID:297.

Another function of GAM7957 is therefore inhibition of Leiomodin 3 (fetal) (LMOD3, Accession XP_067529.3). Accordingly, utilities of GAM7957 include diagnosis, prevention and treatment of diseases and clinical conditions associated with LMOD3.

LOC112687 (Accession XP_053145.1) is another GAM7957 target gene, herein designated TARGET GENE. LOC112687 BINDING SITE is a target binding site found in the 3' untranslated region of mRNA encoded by LOC112687, corresponding to a target binding site such as BINDING SITE I, BINDING SITE II or BINDING SITE III of FIG. 8. Table 4 illustrates the complementarity of the nucleotide sequences of LOC112687 BINDING SITE, designated SEQ ID:7318, to the nucleotide sequence of GAM7957 RNA, herein designated GAM RNA, also designated SEQ ID:297.

Another function of GAM7957 is therefore inhibition of LOC112687 (Accession XP_053145.1). Accordingly, utilities of GAM7957 include diagnosis, prevention and treatment of diseases and clinical conditions associated with LOC112687.

LOC112885 (Accession NP_612424.1) is another GAM7957 target gene, herein designated TARGET GENE. LOC112885 BINDING SITE is a target binding site found in the 3' untranslated region of mRNA encoded by LOC112885, corresponding to a target binding site such as BINDING SITE I, BINDING SITE II or BINDING SITE III of FIG. 8. Table 4 illustrates the complementarity of the nucleotide sequences of LOC112885 BINDING SITE, designated SEQ ID:12290, to the nucleotide sequence of GAM7957 RNA, herein designated GAM RNA, also designated SEQ ID:297.

Another function of GAM7957 is therefore inhibition of LOC112885 (Accession NP_612424.1). Accordingly, utilities of GAM7957 include diagnosis, prevention and treatment of diseases and clinical conditions associated with LOC112885.

LOC114987 (Accession NP_660284.1) is another GAM7957 target gene, herein designated TARGET GENE. LOC114987 BINDING SITE is a target binding site found in the 3' untranslated region of mRNA encoded by LOC114987, corresponding to a target binding site such as BINDING SITE I, BINDING SITE II or BINDING SITE III of FIG. 8. Table 4 illustrates the complementarity of the nucleotide sequences of LOC114987 BINDING SITE, designated SEQ ID:9417, to the nucleotide sequence of GAM7957 RNA, herein designated GAM RNA, also designated SEQ ID:297.

Another function of GAM7957 is therefore inhibition of LOC114987 (Accession NP_660284.1). Accordingly, utilities of GAM7957 include diagnosis, prevention and treatment of diseases and clinical conditions associated with LOC114987.

LOC115004 (Accession XP_291162.1) is another GAM7957 target gene, herein designated TARGET GENE. LOC115004 BINDING SITE is a target binding site found in the 3' untranslated region of mRNA encoded by LOC115004, corresponding to a target binding site such as BINDING SITE I, BINDING SITE II or BINDING SITE III of FIG. 8. Table 4 illustrates the complementarity of the nucleotide sequences of LOC115004 BINDING SITE, designated SEQ ID:9418, to the nucleotide sequence of GAM7957 RNA, herein designated GAM RNA, also designated SEQ ID:297.

Another function of GAM7957 is therefore inhibition of LOC115004 (Accession XP_291162.1). Accordingly, utilities of GAM7957 include diagnosis, prevention and treatment of diseases and clinical conditions associated with LOC115004.

LOC115129 (Accession XP_055292.1) is another GAM7957 target gene, herein designated TARGET GENE. LOC115129 BINDING SITE1 through LOC115129 BINDING SITE3 are target binding sites found in untranslated regions of mRNA encoded by LOC115129, corresponding to target binding sites such as BINDING SITE I, BINDING SITE II or BINDING SITE III of FIG. 8. Table 4 illustrates the complementarity of the nucleotide sequences of LOC115129 BINDING SITE1 through LOC115129 BINDING SITE3, designated SEQ ID:1418, SEQ ID:1147 and SEQ ID:9914 respectively, to the nucleotide sequence of GAM7957 RNA, herein designated GAM RNA, also designated SEQ ID:297.

Another function of GAM7957 is therefore inhibition of LOC115129 (Accession XP_055292.1). Accordingly, utilities of GAM7957 include diagnosis, prevention and treatment of diseases and clinical conditions associated with LOC115129.

LOC115704 (Accession NP_660288.1) is another GAM7957 target gene, herein designated TARGET GENE. LOC115704 BINDING SITE is a target binding site found in the 3' untranslated region of mRNA encoded by LOC115704, corresponding to a target binding site such as BINDING SITE I, BINDING SITE II or BINDING SITE III of FIG. 8. Table 4 illustrates the complementarity of the nucleotide sequences of LOC115704 BINDING SITE, designated SEQ ID:13386, to the nucleotide sequence of GAM7957 RNA, herein designated GAM RNA, also designated SEQ ID:297.

Another function of GAM7957 is therefore inhibition of LOC115704 (Accession NP_660288.1). Accordingly, utilities of GAM7957 include diagnosis, prevention and treatment of diseases and clinical conditions associated with LOC115704.

LOC116143 (Accession NP_612467.1) is another GAM7957 target gene, herein designated TARGET GENE. LOC116143 BINDING SITE1 and LOC116143 BINDING SITE2 are target binding sites found in untranslated regions of mRNA encoded by LOC116143, corresponding to target binding sites such as BINDING SITE I, BINDING SITE II or BINDING SITE III of FIG. 8. Table 4 illustrates the complementarity of the nucleotide sequences of LOC116143 BINDING SITE1 and LOC116143 BINDING SITE2, designated SEQ ID:3378 and SEQ ID:9421 respectively, to the nucleotide sequence of GAM7957 RNA, herein designated GAM RNA, also designated SEQ ID:297.

Another function of GAM7957 is therefore inhibition of LOC116143 (Accession NP_612467.1). Accordingly, utilities of GAM7957 include diagnosis, prevention and treatment of diseases and clinical conditions associated with LOC116143.

LOC116228 (Accession XP_300752.1) is another GAM7957 target gene, herein designated TARGET GENE. LOC116228 BINDING SITE1 and LOC116228 BINDING SITE2 are target binding sites found in untranslated regions of mRNA encoded by LOC116228, corresponding to target binding sites such as BINDING SITE I, BINDING SITE II or BINDING SITE III of FIG. 8. Table 4 illustrates the complementarity of the nucleotide sequences of LOC116228 BINDING SITE1 and LOC116228 BINDING SITE2, designated SEQ ID:1671 and SEQ ID:12210 respectively, to the nucleotide sequence of GAM7957 RNA, herein designated GAM RNA, also designated SEQ ID:297.

Another function of GAM7957 is therefore inhibition of LOC116228 (Accession XP_300752.1). Accordingly, utilities of GAM7957 include diagnosis, prevention and treatment of diseases and clinical conditions associated with LOC116228.

LOC116236 (Accession XP_057674.5) is another GAM7957 target gene, herein designated TARGET GENE. LOC116236 BINDING SITE1 and LOC116236 BINDING SITE2 are target binding sites found in untranslated regions of mRNA encoded by LOC116236, corresponding to target binding sites such as BINDING SITE I, BINDING SITE II or BINDING SITE III of FIG. 8. Table 4 illustrates the complementarity of the nucleotide sequences of LOC116236 BINDING SITE1 and LOC116236 BINDING SITE2, designated SEQ ID:2487 and SEQ ID:18886 respectively, to the nucleotide sequence of GAM7957 RNA, herein designated GAM RNA, also designated SEQ ID:297.

Another function of GAM7957 is therefore inhibition of LOC116236 (Accession XP_057674.5). Accordingly, utilities of GAM7957 include diagnosis, prevention and treatment of diseases and clinical conditions associated with LOC116236.

LOC116349 (Accession XP_057993.1) is another GAM7957 target gene, herein designated TARGET GENE. LOC116349 BINDING SITE1 and LOC116349 BINDING SITE2 are target binding sites found in untranslated regions of mRNA encoded by LOC116349, corresponding to target binding sites such as BINDING SITE I, BINDING SITE II or BINDING SITE III of FIG. 8. Table 4 illustrates the complementarity of the nucleotide sequences of LOC116349 BINDING SITE1 and LOC116349 BINDING SITE2, designated SEQ ID:10572 and SEQ ID:13155 respectively, to the nucleotide sequence of GAM7957 RNA, herein designated GAM RNA, also designated SEQ ID:297.

Another function of GAM7957 is therefore inhibition of LOC116349 (Accession XP_057993.1). Accordingly, utilities of GAM7957 include diagnosis, prevention and treatment of diseases and clinical conditions associated with LOC116349.

LOC118709 (Accession XP_058338.2) is another GAM7957 target gene, herein designated TARGET GENE. LOC118709 BINDING SITE is a target binding site found in the 5' untranslated region of mRNA encoded by LOC118709, corresponding to a target binding site such as BINDING SITE I, BINDING SITE II or BINDING SITE III of FIG. 8. Table 4 illustrates the complementarity of the nucleotide sequences of LOC118709 BINDING SITE, designated SEQ ID:11340, to the nucleotide sequence of GAM7957 RNA, herein designated GAM RNA, also designated SEQ ID:297.

Another function of GAM7957 is therefore inhibition of LOC118709 (Accession XP_058338.2). Accordingly, utilities of GAM7957 include diagnosis, prevention and treatment of diseases and clinical conditions associated with LOC118709.

LOC120224 (Accession NP_620143.1) is another GAM7957 target gene, herein designated TARGET GENE. LOC120224 BINDING SITE1 and LOC120224 BINDING SITE2 are target binding sites found in untranslated regions of mRNA encoded by LOC120224, corresponding to target binding sites such as BINDING SITE I, BINDING SITE II or BINDING SITE III of FIG. 8. Table 4 illustrates the complementarity of the nucleotide sequences of LOC120224 BINDING SITE1 and LOC120224 BINDING SITE2, designated SEQ ID:10567 and SEQ ID:20099 respectively, to the nucleotide sequence of GAM7957 RNA, herein designated GAM RNA, also designated SEQ ID:297.

Another function of GAM7957 is therefore inhibition of LOC120224 (Accession NP_620143.1). Accordingly, utilities of GAM7957 include diagnosis, prevention and treatment of diseases and clinical conditions associated with LOC120224.

LOC120406 (Accession XP_061976.2) is another GAM7957 target gene, herein designated TARGET GENE. LOC120406 BINDING SITE is a target binding site found in the 3' untranslated region of mRNA encoded by LOC120406, corresponding to a target binding site such as BINDING SITE I, BINDING SITE II or BINDING SITE III of FIG. 8. Table 4 illustrates the complementarity of the nucleotide sequences of LOC120406 BINDING SITE, designated SEQ ID:10342, to the nucleotide sequence of GAM7957 RNA, herein designated GAM RNA, also designated SEQ ID:297.

Another function of GAM7957 is therefore inhibition of LOC120406 (Accession XP_061976.2). Accordingly, utilities of GAM7957 include diagnosis, prevention and treatment of diseases and clinical conditions associated with LOC120406.

LOC121456 (Accession XP_062645.2) is another GAM7957 target gene, herein designated TARGET GENE. LOC121456 BINDING SITE1 and LOC121456 BINDING SITE2 are target binding sites found in untranslated regions of mRNA encoded by LOC121456, corresponding to target binding sites such as BINDING SITE I, BINDING SITE II or BINDING SITE III of FIG. 8. Table 4 illustrates the complementarity of the nucleotide sequences of LOC121456 BINDING SITE1 and LOC121456 BINDING SITE2, designated SEQ ID:3524 and SEQ ID:957 respectively, to the nucleotide sequence of GAM7957 RNA, herein designated GAM RNA, also designated SEQ ID:297.

Another function of GAM7957 is therefore inhibition of LOC121456 (Accession XP_062645.2). Accordingly, utilities of GAM7957 include diagnosis, prevention and treatment of diseases and clinical conditions associated with LOC121456.

LOC122704 (Accession XP_058647.1) is another GAM7957 target gene, herein designated TARGET GENE. LOC122704 BINDING SITE is a target binding site found in the 3' untranslated region of mRNA encoded by LOC122704, corresponding to a target binding site such as BINDING SITE I, BINDING SITE II or BINDING SITE III of FIG. 8. Table 4 illustrates the complementarity of the nucleotide sequences of LOC122704 BINDING SITE, designated SEQ ID:6651, to the nucleotide sequence of GAM7957 RNA, herein designated GAM RNA, also designated SEQ ID:297.

Another function of GAM7957 is therefore inhibition of LOC122704 (Accession XP_058647.1). Accordingly, utilities of GAM7957 include diagnosis, prevention and treatment of diseases and clinical conditions associated with LOC122704.

LOC123722 (Accession XP_058721.2) is another GAM7957 target gene, herein designated TARGET GENE. LOC123722 BINDING SITE1 through LOC123722 BINDING SITE3 are target binding sites found in untranslated regions of mRNA encoded by LOC123722, corresponding to target binding sites such as BINDING SITE I, BINDING SITE II or BINDING SITE III of FIG. 8. Table 4 illustrates the complementarity of the nucleotide sequences of LOC123722 BINDING SITE1 through LOC123722 BINDING SITE3, designated SEQ ID:15675, SEQ ID:13155 and SEQ ID:5759 respectively, to the nucleotide sequence of GAM7957 RNA, herein designated GAM RNA, also designated SEQ ID:297.

Another function of GAM7957 is therefore inhibition of LOC123722 (Accession XP_058721.2). Accordingly, utilities of GAM7957 include diagnosis, prevention and treatment of diseases and clinical conditions associated with LOC123722.

LOC124411 (Accession XP_058804.4) is another GAM7957 target gene, herein designated TARGET GENE. LOC124411 BINDING SITE is a target binding site found in the 3' untranslated region of mRNA encoded by LOC124411, corresponding to a target binding site such as BINDING SITE I, BINDING SITE II or BINDING SITE III of FIG. 8. Table 4 illustrates the complementarity of the nucleotide sequences of LOC124411 BINDING SITE, designated SEQ ID:12083, to the nucleotide sequence of GAM7957 RNA, herein designated GAM RNA, also designated SEQ ID:297.

Another function of GAM7957 is therefore inhibition of LOC124411 (Accession XP_058804.4). Accordingly, utilities of GAM7957 include diagnosis, prevention and treatment of diseases and clinical conditions associated with LOC124411.

LOC124751 (Accession XP_064298.4) is another GAM7957 target gene, herein designated TARGET GENE. LOC124751 BINDING SITE is a target binding site found in the 3' untranslated region of mRNA encoded by LOC124751, corresponding to a target binding site such as BINDING SITE I, BINDING SITE II or BINDING SITE III of FIG. 8. Table 4 illustrates the complementarity of the nucleotide sequences of LOC124751 BINDING SITE, designated SEQ ID:12792, to the nucleotide sequence of GAM7957 RNA, herein designated GAM RNA, also designated SEQ ID:297.

Another function of GAM7957 is therefore inhibition of LOC124751 (Accession XP_064298.4). Accordingly, utilities of GAM7957 include diagnosis, prevention and treatment of diseases and clinical conditions associated with LOC124751.

LOC126167 (Accession XP_058997.2) is another GAM7957 target gene, herein designated TARGET GENE. LOC126167 BINDING SITE1 and LOC126167 BINDING SITE2 are target binding sites found in untranslated regions of mRNA encoded by LOC126167, corresponding to target binding sites such as BINDING SITE I, BINDING SITE II or BINDING SITE III of FIG. 8. Table 4 illustrates the complementarity of the nucleotide sequences of LOC126167 BINDING SITE1 and LOC126167 BINDING SITE2, designated SEQ ID:5860 and SEQ ID:12793 respectively, to the nucleotide sequence of GAM7957 RNA, herein designated GAM RNA, also designated SEQ ID:297.

Another function of GAM7957 is therefore inhibition of LOC126167 (Accession XP_058997.2). Accordingly, utilities of GAM7957 include diagnosis, prevention and treatment of diseases and clinical conditions associated with LOC126167.

LOC126669 (Accession XP_060121.4) is another GAM7957 target gene, herein designated TARGET GENE. LOC126669 BINDING SITE1 and LOC126669 BINDING SITE2 are target binding sites found in untranslated regions of mRNA encoded by LOC126669, corresponding to target binding sites such as BINDING SITE I, BINDING SITE II or BINDING SITE III of FIG. 8. Table 4 illustrates the complementarity of the nucleotide sequences of LOC126669 BINDING SITE1 and LOC126669 BINDING SITE2, designated SEQ ID:14979 and SEQ ID:6238 respectively, to the nucleotide sequence of GAM7957 RNA, herein designated GAM RNA, also designated SEQ ID:297.

Another function of GAM7957 is therefore inhibition of LOC126669 (Accession XP_060121.4). Accordingly, utilities of GAM7957 include diagnosis, prevention and treatment of diseases and clinical conditions associated with LOC126669.

LOC127262 (Accession XP_072073.5) is another GAM7957 target gene, herein designated TARGET GENE. LOC127262 BINDING SITE is a target binding site found in the 3' untranslated region of mRNA encoded by LOC127262, corresponding to a target binding site such as BINDING SITE I, BINDING SITE II or BINDING SITE III of FIG. 8. Table 4 illustrates the complementarity of the nucleotide sequences of LOC127262 BINDING SITE, designated SEQ ID:5861, to the nucleotide sequence of GAM7957 RNA, herein designated GAM RNA, also designated SEQ ID:297.

Another function of GAM7957 is therefore inhibition of LOC127262 (Accession XP_072073.5). Accordingly, utilities of GAM7957 include diagnosis, prevention and treatment of diseases and clinical conditions associated with LOC127262.

LOC130026 (Accession NP_612477.3) is another GAM7957 target gene, herein designated TARGET GENE. LOC130026 BINDING SITE1 and LOC130026 BINDING SITE2 are target binding sites found in untranslated regions of mRNA encoded by LOC130026, corresponding to target binding sites such as BINDING SITE I, BINDING SITE II or BINDING SITE III of FIG. 8. Table 4 illustrates the complementarity of the nucleotide sequences of LOC130026 BINDING SITE1 and LOC130026 BINDING SITE2, designated SEQ ID:2487 and SEQ ID:3640 respectively, to the nucleotide sequence of GAM7957 RNA, herein designated GAM RNA, also designated SEQ ID:297.

Another function of GAM7957 is therefore inhibition of LOC130026 (Accession NP_612477.3). Accordingly, utilities of GAM7957 include diagnosis, prevention and treatment of diseases and clinical conditions associated with LOC130026.

LOC130589 (Accession NP_620156.1) is another GAM7957 target gene, herein designated TARGET GENE. LOC130589 BINDING SITE is a target binding site found in the 3' untranslated region of mRNA encoded by LOC130589, corresponding to a target binding site such as BINDING SITE I, BINDING SITE II or BINDING SITE III of FIG. 8. Table 4 illustrates the complementarity of the nucleotide sequences of LOC130589 BINDING SITE, designated SEQ ID:17423, to the nucleotide sequence of GAM7957 RNA, herein designated GAM RNA, also designated SEQ ID:297.

Another function of GAM7957 is therefore inhibition of LOC130589 (Accession NP_620156.1). Accordingly, utilities of GAM7957 include diagnosis, prevention and treatment of diseases and clinical conditions associated with LOC130589.

LOC133926 (Accession XP_059674.1) is another GAM7957 target gene, herein designated TARGET GENE. LOC133926 BINDING SITE1 and LOC133926 BINDING SITE2 are target binding sites found in untranslated regions of mRNA encoded by LOC133926, corresponding to target binding sites such as BINDING SITE I, BINDING SITE II or BINDING SITE III of FIG. 8. Table 4 illustrates the complementarity of the nucleotide sequences of LOC133926 BINDING SITE1 and LOC133926 BINDING SITE2, designated SEQ ID:12792 and SEQ ID:13155 respectively, to the nucleotide sequence of GAM7957 RNA, herein designated GAM RNA, also designated SEQ ID:297.

Another function of GAM7957 is therefore inhibition of LOC133926 (Accession XP_059674.1). Accordingly, utilities of GAM7957 include diagnosis, prevention and treatment of diseases and clinical conditions associated with LOC133926.

LOC134121 (Accession XP_059692.1) is another GAM7957 target gene, herein designated TARGET GENE. LOC134121 BINDING SITE is a target binding site found in the 3' untranslated region of mRNA encoded by LOC134121, corresponding to a target binding site such as BINDING SITE I, BINDING SITE II or BINDING SITE III of FIG. 8. Table 4 illustrates the complementarity of the nucleotide sequences of LOC134121 BINDING SITE, designated SEQ ID:8199, to the nucleotide sequence of GAM7957 RNA, herein designated GAM RNA, also designated SEQ ID:297.

Another function of GAM7957 is therefore inhibition of LOC134121 (Accession XP_059692.1). Accordingly, utilities of GAM7957 include diagnosis, prevention and treatment of diseases and clinical conditions associated with LOC134121.

LOC134147 (Accession NP_620164.1) is another GAM7957 target gene, herein designated TARGET GENE. LOC134147 BINDING SITE1 and LOC134147 BINDING SITE2 are target binding sites found in untranslated regions of mRNA encoded by LOC134147, corresponding to target binding sites such as BINDING SITE I, BINDING SITE II or BINDING SITE III of FIG. 8. Table 4 illustrates the complementarity of the nucleotide sequences of LOC134147 BINDING SITE1 and LOC134147 BINDING SITE2, designated SEQ ID:1453 and SEQ ID:9760 respectively, to the nucleotide sequence of GAM7957 RNA, herein designated GAM RNA, also designated SEQ ID:297.

Another function of GAM7957 is therefore inhibition of LOC134147 (Accession NP_620164.1). Accordingly, utilities of GAM7957 include diagnosis, prevention and treatment of diseases and clinical conditions associated with LOC134147.

LOC136263 (Accession NP_660311.1) is another GAM7957 target gene, herein designated TARGET GENE. LOC136263 BINDING SITE is a target binding site found in the 3' untranslated region of mRNA encoded by LOC136263, corresponding to a target binding site such as BINDING SITE I, BINDING SITE II or BINDING SITE III of FIG. 8. Table 4 illustrates the complementarity of the nucleotide sequences of LOC136263 BINDING SITE, designated SEQ ID:15223, to the nucleotide sequence of GAM7957 RNA, herein designated GAM RNA, also designated SEQ ID:297.

Another function of GAM7957 is therefore inhibition of LOC136263 (Accession NP_660311.1). Accordingly, utilities of GAM7957 include diagnosis, prevention and treatment of diseases and clinical conditions associated with LOC136263.

LOC138428 (Accession XP_059972.1) is another GAM7957 target gene, herein designated TARGET GENE. LOC138428 BINDING SITE is a target binding site found in the 3' untranslated region of mRNA encoded by LOC138428, corresponding to a target binding site such as BINDING SITE I, BINDING SITE II or BINDING SITE III of FIG. 8. Table 4 illustrates the complementarity of the nucleotide sequences of LOC138428 BINDING SITE, designated SEQ ID:10454, to the nucleotide sequence of GAM7957 RNA, herein designated GAM RNA, also designated SEQ ID:297.

Another function of GAM7957 is therefore inhibition of LOC138428 (Accession XP_059972.1). Accordingly, utilities of GAM7957 include diagnosis, prevention and treatment of diseases and clinical conditions associated with LOC138428.

LOC139422 (Accession XP_066687.2) is another GAM7957 target gene, herein designated TARGET GENE. LOC139422 BINDING SITE is a target binding site found in the 3' untranslated region of mRNA encoded by LOC139422, corresponding to a target binding site such as BINDING SITE I, BINDING SITE II or BINDING SITE III of FIG. 8. Table 4 illustrates the complementarity of the nucleotide sequences of LOC139422 BINDING SITE, designated SEQ ID:5043, to the nucleotide sequence of GAM7957 RNA, herein designated GAM RNA, also designated SEQ ID:297.

Another function of GAM7957 is therefore inhibition of LOC139422 (Accession XP_066687.2). Accordingly, utilities of GAM7957 include diagnosis, prevention and treatment of diseases and clinical conditions associated with LOC139422.

LOC139562 (Accession XP_066765.1) is another GAM7957 target gene, herein designated TARGET GENE. LOC139562 BINDING SITE1 through LOC139562 BINDING SITE3 are target binding sites found in untranslated regions of mRNA encoded by LOC139562, corresponding to target binding sites such as BINDING SITE I, BINDING SITE II or BINDING SITE III of FIG. 8. Table 4 illustrates the complementarity of the nucleotide sequences of LOC139562 BINDING SITE1 through LOC139562 BINDING SITE3, designated SEQ ID:7773, SEQ ID:7063 and SEQ ID:7286 respectively, to the nucleotide sequence of GAM7957 RNA, herein designated GAM RNA, also designated SEQ ID:297.

Another function of GAM7957 is therefore inhibition of LOC139562 (Accession XP_066765.1). Accordingly, utilities of GAM7957 include diagnosis, prevention and treatment of diseases and clinical conditions associated with LOC139562.

LOC142779 (Accession XP_084337.1) is another GAM7957 target gene, herein designated TARGET GENE. LOC142779 BINDING SITE is a target binding site found in the 3' untranslated region of mRNA encoded by LOC142779, corresponding to a target binding site such as BINDING SITE I, BINDING SITE II or BINDING SITE III of FIG. 8. Table 4 illustrates the complementarity of the nucleotide sequences of LOC142779 BINDING SITE, designated SEQ ID:5071, to the nucleotide sequence of GAM7957 RNA, herein designated GAM RNA, also designated SEQ ID:297.

Another function of GAM7957 is therefore inhibition of LOC142779 (Accession XP_084337.1). Accordingly, utilities of GAM7957 include diagnosis, prevention and treatment of diseases and clinical conditions associated with LOC142779.

LOC142826 (Accession XP_084355.1) is another GAM7957 target gene, herein designated TARGET GENE. LOC142826 BINDING SITE is a target binding site found in the 3' untranslated region of mRNA encoded by LOC142826, corresponding to a target binding site such as BINDING SITE I, BINDING SITE II or BINDING SITE III of FIG. 8. Table 4 illustrates the complementarity of the nucleotide sequences of LOC142826 BINDING SITE, designated SEQ ID:15983, to the nucleotide sequence of GAM7957 RNA, herein designated GAM RNA, also designated SEQ ID:297.

Another function of GAM7957 is therefore inhibition of LOC142826 (Accession XP_084355.1). Accordingly, utilities of GAM7957 include diagnosis, prevention and treatment of diseases and clinical conditions associated with LOC142826.

LOC142948 (Accession XP_096364.1) is another GAM7957 target gene, herein designated TARGET GENE. LOC142948 BINDING SITE is a target binding site found in the 3' untranslated region of mRNA encoded by LOC142948, corresponding to a target binding site such as BINDING SITE I, BINDING SITE II or BINDING SITE III of FIG. 8. Table 4 illustrates the complementarity of the nucleotide sequences of LOC142948 BINDING SITE, designated SEQ ID:8865, to the nucleotide sequence of GAM7957 RNA, herein designated GAM RNA, also designated SEQ ID:297.

Another function of GAM7957 is therefore inhibition of LOC142948 (Accession XP_096364.1). Accordingly, utilities of GAM7957 include diagnosis, prevention and treatment of diseases and clinical conditions associated with LOC142948.

LOC144481 (Accession XP_096611.2) is another GAM7957 target gene, herein designated TARGET GENE. LOC144481 BINDING SITE1 and LOC144481 BINDING SITE2 are target binding sites found in untranslated regions of mRNA encoded by LOC144481, corresponding to target binding sites such as BINDING SITE I, BINDING SITE II or BINDING SITE III of FIG. 8. Table 4 illustrates the complementarity of the nucleotide sequences of LOC144481 BINDING SITE1 and LOC144481 BINDING SITE2, designated SEQ ID:1996 and SEQ ID:10867 respectively, to the nucleotide sequence of GAM7957 RNA, herein designated GAM RNA, also designated SEQ ID:297.

Another function of GAM7957 is therefore inhibition of LOC144481 (Accession XP_096611.2). Accordingly, utilities of GAM7957 include diagnosis, prevention and treatment of diseases and clinical conditions associated with LOC144481.

LOC144817 (Accession XP_084972.1) is another GAM7957 target gene, herein designated TARGET GENE. LOC144817 BINDING SITE is a target binding site found in the 3' untranslated region of mRNA encoded by LOC144817, corresponding to a target binding site such as BINDING SITE I, BINDING SITE II or BINDING SITE III of FIG. 8. Table 4 illustrates the complementarity of the nucleotide sequences of LOC144817 BINDING SITE, designated SEQ ID:12140, to the nucleotide sequence of GAM7957 RNA, herein designated GAM RNA, also designated SEQ ID:297.

Another function of GAM7957 is therefore inhibition of LOC144817 (Accession XP_084972.1). Accordingly, utilities of GAM7957 include diagnosis, prevention and treatment of diseases and clinical conditions associated with LOC144817.

LOC144845 (Accession NP_612483.1) is another GAM7957 target gene, herein designated TARGET GENE. LOC144845 BINDING SITE1 and LOC144845 BINDING SITE2 are target binding sites found in untranslated regions of mRNA encoded by LOC144845, corresponding to target binding sites such as BINDING SITE I, BINDING SITE II or BINDING SITE III of FIG. 8. Table 4 illustrates the complementarity of the nucleotide sequences of LOC144845 BINDING SITE1 and LOC144845 BINDING SITE2, designated SEQ ID:12559 and SEQ ID:3092 respectively, to the nucleotide sequence of GAM7957 RNA, herein designated GAM RNA, also designated SEQ ID:297.

Another function of GAM7957 is therefore inhibition of LOC144845 (Accession NP_612483.1). Accordingly, utilities of GAM7957 include diagnosis, prevention and treatment of diseases and clinical conditions associated with LOC144845.

LOC145216 (Accession XP_096730.1) is another GAM7957 target gene, herein designated TARGET GENE. LOC145216 BINDING SITE is a target binding site found in the 3' untranslated region of mRNA encoded by LOC145216, corresponding to a target binding site such as BINDING SITE I, BINDING SITE II or BINDING SITE III of FIG. 8. Table 4 illustrates the complementarity of the nucleotide sequences of LOC145216 BINDING SITE, designated SEQ ID:10554, to the nucleotide sequence of GAM7957 RNA, herein designated GAM RNA, also designated SEQ ID:297.

Another function of GAM7957 is therefore inhibition of LOC145216 (Accession XP_096730.1). Accordingly, utilities of GAM7957 include diagnosis, prevention and treatment of diseases and clinical conditions associated with LOC145216.

LOC145231 (Accession XP_096740.1) is another GAM7957 target gene, herein designated TARGET GENE. LOC145231 BINDING SITE1 through LOC145231 BINDING SITE3 are target binding sites found in untranslated regions of mRNA encoded by LOC145231, corresponding to target binding sites such as BINDING SITE I, BINDING SITE II or BINDING SITE III of FIG. 8. Table 4 illustrates the complementarity of the nucleotide sequences of LOC145231 BINDING SITE1 through LOC145231 BINDING SITE3, designated SEQ ID:16122, SEQ ID:15089 and SEQ ID:19055 respectively, to the nucleotide sequence of GAM7957 RNA, herein designated GAM RNA, also designated SEQ ID:297.

Another function of GAM7957 is therefore inhibition of LOC145231 (Accession XP_096740.1). Accordingly, utilities of GAM7957 include diagnosis, prevention and treatment of diseases and clinical conditions associated with LOC145231.

LOC145387 (Accession XP_096791.1) is another GAM7957 target gene, herein designated TARGET GENE. LOC145387 BINDING SITE1 and LOC145387 BINDING SITE2 are target binding sites found in untranslated regions of mRNA encoded by LOC145387, corresponding to target binding sites such as BINDING SITE I, BINDING SITE II or BINDING SITE III of FIG. 8. Table 4 illustrates the complementarity of the nucleotide sequences of LOC145387 BINDING SITE1 and LOC145387 BINDING SITE2, designated SEQ ID:14786 and SEQ ID:2001 respectively, to the nucleotide sequence of GAM7957 RNA, herein designated GAM RNA, also designated SEQ ID:297.

Another function of GAM7957 is therefore inhibition of LOC145387 (Accession XP_096791.1). Accordingly, utilities of GAM7957 include diagnosis, prevention and treatment of diseases and clinical conditions associated with LOC145387.

LOC145453 (Accession XP_085120.1) is another GAM7957 target gene, herein designated TARGET GENE. LOC145453 BINDING SITE is a target binding site found in the 3' untranslated region of mRNA encoded by LOC145453, corresponding to a target binding site such as BINDING SITE I, BINDING SITE II or BINDING SITE III of FIG. 8. Table 4 illustrates the complementarity of the nucleotide sequences of LOC145453 BINDING SITE, designated SEQ ID:10439, to the nucleotide sequence of GAM7957 RNA, herein designated GAM RNA, also designated SEQ ID:297.

Another function of GAM7957 is therefore inhibition of LOC145453 (Accession XP_085120.1). Accordingly, utilities of GAM7957 include diagnosis, prevention and treatment of diseases and clinical conditions associated with LOC145453.

LOC145609 (Accession XP_096817.1) is another GAM7957 target gene, herein designated TARGET GENE. LOC145609 BINDING SITE1 and LOC145609 BINDING SITE2 are target binding sites found in untranslated regions of mRNA encoded by LOC145609, corresponding to target binding sites such as BINDING SITE I, BINDING SITE II or BINDING SITE III of FIG. 8. Table 4 illustrates the complementarity of the nucleotide sequences of LOC145609 BINDING SITE1 and LOC145609 BINDING SITE2, designated SEQ ID:5360 and SEQ ID:15343 respectively, to the nucleotide sequence of GAM7957 RNA, herein designated GAM RNA, also designated SEQ ID:297.

Another function of GAM7957 is therefore inhibition of LOC145609 (Accession XP_096817.1). Accordingly, utilities of GAM7957 include diagnosis, prevention and treatment of diseases and clinical conditions associated with LOC145609.

LOC145663 (Accession XP_096829.1) is another GAM7957 target gene, herein designated TARGET GENE. LOC145663 BINDING SITE is a target binding site found in the 3' untranslated region of mRNA encoded by LOC145663, corresponding to a target binding site such as BINDING SITE I, BINDING SITE II or BINDING SITE III of FIG. 8. Table 4 illustrates the complementarity of the nucleotide sequences of LOC145663 BINDING SITE, designated SEQ ID:13155, to the nucleotide sequence of GAM7957 RNA, herein designated GAM RNA, also designated SEQ ID:297.

Another function of GAM7957 is therefore inhibition of LOC145663 (Accession XP_096829.1). Accordingly, utilities of GAM7957 include diagnosis, prevention and treatment of diseases and clinical conditions associated with LOC145663.

LOC145693 (Accession XP_085205.1) is another GAM7957 target gene, herein designated TARGET GENE. LOC145693 BINDING SITE is a target binding site found in the 5' untranslated region of mRNA encoded by LOC145693, corresponding to a target binding site such as BINDING SITE I, BINDING SITE II or BINDING SITE III of FIG. 8. Table 4 illustrates the complementarity of the nucleotide sequences of LOC145693 BINDING SITE, designated SEQ ID:15903, to the nucleotide sequence of GAM7957 RNA, herein designated GAM RNA, also designated SEQ ID:297.

Another function of GAM7957 is therefore inhibition of LOC145693 (Accession XP_085205.1). Accordingly, utilities of GAM7957 include diagnosis, prevention and treatment of diseases and clinical conditions associated with LOC145693.

LOC145757 (Accession XP_085227.1) is another GAM7957 target gene, herein designated TARGET GENE. LOC145757 BINDING SITE is a target binding site found in the 3' untranslated region of mRNA encoded by LOC145757, corresponding to a target binding site such as BINDING SITE I, BINDING SITE II or BINDING SITE III of FIG. 8. Table 4 illustrates the complementarity of the nucleotide sequences of LOC145757 BINDING SITE, designated SEQ ID:11897, to the nucleotide sequence of GAM7957 RNA, herein designated GAM RNA, also designated SEQ ID:297.

Another function of GAM7957 is therefore inhibition of LOC145757 (Accession XP_085227.1). Accordingly, utilities of GAM7957 include diagnosis, prevention and treatment of diseases and clinical conditions associated with LOC145757.

LOC145758 (Accession XP_096858.1) is another GAM7957 target gene, herein designated TARGET GENE. LOC145758 BINDING SITE is a target binding site found in the 5' untranslated region of mRNA encoded by LOC145758, corresponding to a target binding site such as BINDING SITE I, BINDING SITE II or BINDING SITE III of FIG. 8. Table 4 illustrates the complementarity of the nucleotide sequences of LOC145758 BINDING SITE, designated SEQ ID:6791, to the nucleotide sequence of GAM7957 RNA, herein designated GAM RNA, also designated SEQ ID:297.

Another function of GAM7957 is therefore inhibition of LOC145758 (Accession XP_096858.1). Accordingly, utilities of GAM7957 include diagnosis, prevention and treatment of diseases and clinical conditions associated with LOC145758.

LOC145820 (Accession XP_085246.1) is another GAM7957 target gene, herein designated TARGET GENE. LOC145820 BINDING SITE is a target binding site found in the 3' untranslated region of mRNA encoded by LOC145820, corresponding to a target binding site such as BINDING SITE I, BINDING SITE II or BINDING SITE III of FIG. 8. Table 4 illustrates the complementarity of the nucleotide sequences of LOC145820 BINDING SITE, designated SEQ ID:15343, to the nucleotide sequence of GAM7957 RNA, herein designated GAM RNA, also designated SEQ ID:297.

Another function of GAM7957 is therefore inhibition of LOC145820 (Accession XP_085246.1). Accordingly, utilities of GAM7957 include diagnosis, prevention and treatment of diseases and clinical conditions associated with LOC145820.

LOC146229 (Accession XP_085387.1) is another GAM7957 target gene, herein designated TARGET GENE. LOC146229 BINDING SITE is a target binding site found in the 3' untranslated region of mRNA encoded by LOC146229, corresponding to a target binding site such as BINDING SITE I, BINDING SITE II or BINDING SITE III of FIG. 8. Table 4 illustrates the complementarity of the nucleotide sequences of LOC146229 BINDING SITE, designated SEQ ID:19900, to the nucleotide sequence of GAM7957 RNA, herein designated GAM RNA, also designated SEQ ID:297.

Another function of GAM7957 is therefore inhibition of LOC146229 (Accession XP_085387.1). Accordingly, utilities of GAM7957 include diagnosis, prevention and treatment of diseases and clinical conditions associated with LOC146229.

LOC146336 (Accession XP_085421.2) is another GAM7957 target gene, herein designated TARGET GENE. LOC146336 BINDING SITE is a target binding site found in the 3' untranslated region of mRNA encoded by LOC146336, corresponding to a target binding site such as BINDING SITE I, BINDING SITE II or BINDING SITE III of FIG. 8. Table 4 illustrates the complementarity of the nucleotide sequences of LOC146336 BINDING SITE, designated SEQ ID:18065, to the nucleotide sequence of GAM7957 RNA, herein designated GAM RNA, also designated SEQ ID:297.

Another function of GAM7957 is therefore inhibition of LOC146336 (Accession XP_085421.2). Accordingly, utilities of GAM7957 include diagnosis, prevention and treatment of diseases and clinical conditions associated with LOC146336.

LOC146713 (Accession XP_097071.2) is another GAM7957 target gene, herein designated TARGET GENE. LOC146713 BINDING SITE1 and LOC146713 BINDING SITE2 are target binding sites found in untranslated regions of mRNA encoded by LOC146713, corresponding to target binding sites such as BINDING SITE I, BINDING SITE II or BINDING SITE III of FIG. 8. Table 4 illustrates the complementarity of the nucleotide sequences of LOC146713 BINDING SITE1 and LOC146713 BINDING SITE2, designated SEQ ID:10438 and SEQ ID:14497 respectively, to the nucleotide sequence of GAM7957 RNA, herein designated GAM RNA, also designated SEQ ID:297.

Another function of GAM7957 is therefore inhibition of LOC146713 (Accession XP_097071.2). Accordingly, utilities of GAM7957 include diagnosis, prevention and treatment of diseases and clinical conditions associated with LOC146713.

LOC146728 (Accession XP_097074.1) is another GAM7957 target gene, herein designated TARGET GENE. LOC146728 BINDING SITE1 and LOC146728 BINDING SITE2 are target binding sites found in untranslated regions of mRNA encoded by LOC146728, corresponding to target binding sites such as BINDING SITE I, BINDING SITE II or BINDING SITE III of FIG. 8. Table 4 illustrates the complementarity of the nucleotide sequences of LOC146728 BINDING SITE1 and LOC146728 BINDING SITE2, designated SEQ ID:17996 and SEQ ID:9770 respectively, to the nucleotide sequence of GAM7957 RNA, herein designated GAM RNA, also designated SEQ ID:297.

Another function of GAM7957 is therefore inhibition of LOC146728 (Accession XP_097074.1). Accordingly, utilities of GAM7957 include diagnosis, prevention and treatment of diseases and clinical conditions associated with LOC146728.

LOC146756 (Accession XP_097085.5) is another GAM7957 target gene, herein designated TARGET GENE. LOC146756 BINDING SITE is a target binding site found in the 3' untranslated region of mRNA encoded by LOC146756, corresponding to a target binding site such as BINDING SITE I, BINDING SITE II or BINDING SITE III of FIG. 8. Table 4 illustrates the complementarity of the nucleotide sequences of LOC146756 BINDING SITE, designated SEQ ID:15343, to the nucleotide sequence of GAM7957 RNA, herein designated GAM RNA, also designated SEQ ID:297.

Another function of GAM7957 is therefore inhibition of LOC146756 (Accession XP_097085.5). Accordingly, utilities of GAM7957 include diagnosis, prevention and treatment of diseases and clinical conditions associated with LOC146756.

LOC146895 (Accession XP_097120.1) is another GAM7957 target gene, herein designated TARGET GENE. LOC146895 BINDING SITE is a target binding site found in the 3' untranslated region of mRNA encoded by LOC146895, corresponding to a target binding site such as BINDING SITE I, BINDING SITE II or BINDING SITE III of FIG. 8. Table 4 illustrates the complementarity of the nucleotide sequences of LOC146895 BINDING SITE, designated SEQ ID:4338, to the nucleotide sequence of GAM7957 RNA, herein designated GAM RNA, also designated SEQ ID:297.

Another function of GAM7957 is therefore inhibition of LOC146895 (Accession XP_097120.1). Accordingly, utilities of GAM7957 include diagnosis, prevention and treatment of diseases and clinical conditions associated with LOC146895.

LOC146901 (Accession XP_097121.1) is another GAM7957 target gene, herein designated TARGET GENE. LOC146901 BINDING SITE is a target binding site found in the 3' untranslated region of mRNA encoded by LOC146901, corresponding to a target binding site such as BINDING SITE I, BINDING SITE II or BINDING SITE III of FIG. 8. Table 4 illustrates the complementarity of the nucleotide sequences of LOC146901 BINDING SITE, designated SEQ ID:1262, to the nucleotide sequence of GAM7957 RNA, herein designated GAM RNA, also designated SEQ ID:297.

Another function of GAM7957 is therefore inhibition of LOC146901 (Accession XP_097121.1). Accordingly, utilities of GAM7957 include diagnosis, prevention and treatment of diseases and clinical conditions associated with LOC146901.

LOC146958 (Accession XP_097142.1) is another GAM7957 target gene, herein designated TARGET GENE. LOC146958 BINDING SITE is a target binding site found in the 3' untranslated region of mRNA encoded by LOC146958, corresponding to a target binding site such as BINDING SITE I, BINDING SITE II or BINDING SITE III of FIG. 8. Table 4 illustrates the complementarity of the nucleotide sequences of LOC146958 BINDING SITE, designated SEQ ID:12758, to the nucleotide sequence of GAM7957 RNA, herein designated GAM RNA, also designated SEQ ID:297.

Another function of GAM7957 is therefore inhibition of LOC146958 (Accession XP_097142.1). Accordingly, utilities of GAM7957 include diagnosis, prevention and treatment of diseases and clinical conditions associated with LOC146958.

LOC147071 (Accession XP_054031.5) is another GAM7957 target gene, herein designated TARGET GENE. LOC147071 BINDING SITE1 and LOC147071 BINDING SITE2 are target binding sites found in untranslated regions of mRNA encoded by LOC147071, corresponding to target binding sites such as BINDING SITE I, BINDING SITE II or BINDING SITE III of FIG. 8. Table 4 illustrates the complementarity of the nucleotide sequences of LOC147071 BINDING SITE1 and LOC147071 BINDING SITE2, designated SEQ ID:609 and SEQ ID:13155 respectively, to the nucleotide sequence of GAM7957 RNA, herein designated GAM RNA, also designated SEQ ID:297.

Another function of GAM7957 is therefore inhibition of LOC147071 (Accession XP_054031.5). Accordingly, utilities of GAM7957 include diagnosis, prevention and treatment of diseases and clinical conditions associated with LOC147071.

LOC147080 (Accession XP_097182.1) is another GAM7957 target gene, herein designated TARGET GENE. LOC147080 BINDING SITE is a target binding site found in the 3' untranslated region of mRNA encoded by LOC147080, corresponding to a target binding site such as BINDING SITE I, BINDING SITE II or BINDING SITE III of FIG. 8. Table 4 illustrates the complementarity of the nucleotide sequences of LOC147080 BINDING SITE, designated SEQ ID:9281, to the nucleotide sequence of GAM7957 RNA, herein designated GAM RNA, also designated SEQ ID:297.

Another function of GAM7957 is therefore inhibition of LOC147080 (Accession XP_097182.1). Accordingly, utilities of GAM7957 include diagnosis, prevention and treatment of diseases and clinical conditions associated with LOC147080.

LOC147093 (Accession XP_097184.4) is another GAM7957 target gene, herein designated TARGET GENE. LOC147093 BINDING SITE is a target binding site found in the 3' untranslated region of mRNA encoded by LOC147093, corresponding to a target binding site such as BINDING SITE I, BINDING SITE II or BINDING SITE III of FIG. 8. Table 4 illustrates the complementarity of the nucleotide sequences of LOC147093 BINDING SITE, designated SEQ ID:6900, to the nucleotide sequence of GAM7957 RNA, herein designated GAM RNA, also designated SEQ ID:297.

Another function of GAM7957 is therefore inhibition of LOC147093 (Accession XP_097184.4). Accordingly, utilities of GAM7957 include diagnosis, prevention and treatment of diseases and clinical conditions associated with LOC147093.

LOC147645 (Accession XP_085831.1) is another GAM7957 target gene, herein designated TARGET GENE. LOC147645 BINDING SITE is a target binding site found in the 5' untranslated region of mRNA encoded by LOC147645, corresponding to a target binding site such as BINDING SITE I, BINDING SITE II or BINDING SITE III of FIG. 8. Table 4 illustrates the complementarity of the nucleotide sequences of LOC147645 BINDING SITE, designated SEQ ID:10707, to the nucleotide sequence of GAM7957 RNA, herein designated GAM RNA, also designated SEQ ID:297.

Another function of GAM7957 is therefore inhibition of LOC147645 (Accession XP_085831.1). Accordingly, utilities of GAM7957 include diagnosis, prevention and treatment of diseases and clinical conditions associated with LOC147645.

LOC147649 (Accession XP_085830.1) is another GAM7957 target gene, herein designated TARGET GENE. LOC147649 BINDING SITE1 and LOC147649 BINDING SITE2 are target binding sites found in untranslated regions of mRNA encoded by LOC147649, corresponding to target binding sites such as BINDING SITE I, BINDING SITE II or BINDING SITE III of FIG. 8. Table 4 illustrates the complementarity of the nucleotide sequences of LOC147649 BINDING SITE1 and LOC147649 BINDING SITE2, designated SEQ ID:2487 and SEQ ID:13155 respectively, to the nucleotide sequence of GAM7957 RNA, herein designated GAM RNA, also designated SEQ ID:297.

Another function of GAM7957 is therefore inhibition of LOC147649 (Accession XP_085830.1). Accordingly, utilities of GAM7957 include diagnosis, prevention and treatment of diseases and clinical conditions associated with LOC147649.

LOC147669 (Accession XP_097262.1) is another GAM7957 target gene, herein designated TARGET GENE. LOC147669 BINDING SITE is a target binding site found in the 3' untranslated region of mRNA encoded by LOC147669, corresponding to a target binding site such as BINDING SITE I, BINDING SITE II or BINDING SITE III of FIG. 8. Table 4 illustrates the complementarity of the nucleotide sequences of LOC147669 BINDING SITE, designated SEQ ID:472, to the nucleotide sequence of GAM7957 RNA, herein designated GAM RNA, also designated SEQ ID:297.

Another function of GAM7957 is therefore inhibition of LOC147669 (Accession XP_097262.1). Accordingly, utilities of GAM7957 include diagnosis, prevention and treatment of diseases and clinical conditions associated with LOC147669.

LOC147727 (Accession XP_085862.1) is another GAM7957 target gene, herein designated TARGET GENE. LOC147727 BINDING SITE1 through LOC147727 BINDING SITE3 are target binding sites found in untranslated regions of mRNA encoded by LOC147727, corresponding to target binding sites such as BINDING SITE I, BINDING SITE II or BINDING SITE III of FIG. 8. Table 4 illustrates the complementarity of the nucleotide sequences of LOC147727 BINDING SITE1 through LOC147727 BINDING SITE3, designated SEQ ID:630, SEQ ID:16906 and SEQ ID:19057 respectively, to the nucleotide sequence of GAM7957 RNA, herein designated GAM RNA, also designated SEQ ID:297.

Another function of GAM7957 is therefore inhibition of LOC147727 (Accession XP_085862.1). Accordingly, utilities of GAM7957 include diagnosis, prevention and treatment of diseases and clinical conditions associated with LOC147727.

LOC147791 (Accession XP_097293.2) is another GAM7957 target gene, herein designated TARGET GENE. LOC147791 BINDING SITE is a target binding site found in the 3' untranslated region of mRNA encoded by LOC147791, corresponding to a target binding site such as BINDING SITE I, BINDING SITE II or BINDING SITE III of FIG. 8. Table 4 illustrates the complementarity of the nucleotide sequences of LOC147791 BINDING SITE, designated SEQ ID:12969, to the nucleotide sequence of GAM7957 RNA, herein designated GAM RNA, also designated SEQ ID:297.

Another function of GAM7957 is therefore inhibition of LOC147791 (Accession XP_097293.2). Accordingly, utilities of GAM7957 include diagnosis, prevention and treatment of diseases and clinical conditions associated with LOC147791.

LOC147837 (Accession NP_660319.1) is another GAM7957 target gene, herein designated TARGET GENE. LOC147837 BINDING SITE1 and LOC147837 BINDING SITE2 are target binding sites found in untranslated regions of mRNA encoded by LOC147837, corresponding to target binding sites such as BINDING SITE I, BINDING SITE II or BINDING SITE III of FIG. 8. Table 4 illustrates the complementarity of the nucleotide sequences of LOC147837 BINDING SITE1 and LOC147837 BINDING SITE2, designated SEQ ID:4707 and SEQ ID:18983 respectively, to the nucleotide sequence of GAM7957 RNA, herein designated GAM RNA, also designated SEQ ID:297.

Another function of GAM7957 is therefore inhibition of LOC147837 (Accession NP_660319.1). Accordingly, utilities of GAM7957 include diagnosis, prevention and treatment of diseases and clinical conditions associated with LOC147837.

LOC147947 (Accession XP_085974.1) is another GAM7957 target gene, herein designated TARGET GENE. LOC147947 BINDING SITE is a target binding site found in the 3' untranslated region of mRNA encoded by LOC147947, corresponding to a target binding site such as BINDING SITE I, BINDING SITE II or BINDING SITE III of FIG. 8. Table 4 illustrates the complementarity of the nucleotide sequences of LOC147947 BINDING SITE, designated SEQ ID:14271, to the nucleotide sequence of GAM7957 RNA, herein designated GAM RNA, also designated SEQ ID:297.

Another function of GAM7957 is therefore inhibition of LOC147947 (Accession XP_085974.1). Accordingly, utilities of GAM7957 include diagnosis, prevention and treatment of diseases and clinical conditions associated with LOC147947.

LOC148137 (Accession NP_653293.1) is another GAM7957 target gene, herein designated TARGET GENE. LOC148137 BINDING SITE is a target binding site found in the 3' untranslated region of mRNA encoded by LOC148137, corresponding to a target binding site such as BINDING SITE I, BINDING SITE II or BINDING SITE III of FIG. 8. Table 4 illustrates the complementarity of the nucleotide sequences of LOC148137 BINDING SITE, designated SEQ ID:10028, to the nucleotide sequence of GAM7957 RNA, herein designated GAM RNA, also designated SEQ ID:297.

Another function of GAM7957 is therefore inhibition of LOC148137 (Accession NP_653293.1). Accordingly, utilities of GAM7957 include diagnosis, prevention and treatment of diseases and clinical conditions associated with LOC148137.

LOC148166 (Accession XP_086077.1) is another GAM7957 target gene, herein designated TARGET GENE. LOC148166 BINDING SITE is a target binding site found in the 3' untranslated region of mRNA encoded by LOC148166, corresponding to a target binding site such as BINDING SITE I, BINDING SITE II or BINDING SITE III of FIG. 8. Table 4 illustrates the complementarity of the nucleotide sequences of LOC148166 BINDING SITE, designated SEQ ID:5018, to the nucleotide sequence of GAM7957 RNA, herein designated GAM RNA, also designated SEQ ID:297.

Another function of GAM7957 is therefore inhibition of LOC148166 (Accession XP_086077.1). Accordingly, utilities of GAM7957 include diagnosis, prevention and treatment of diseases and clinical conditions associated with LOC148166.

LOC148198 (Accession XP_047554.4) is another GAM7957 target gene, herein designated TARGET GENE. LOC148198 BINDING SITE1 and LOC148198 BINDING SITE2 are target binding sites found in untranslated regions of mRNA encoded by LOC148198, corresponding to target binding sites such as BINDING SITE I, BINDING SITE II or BINDING SITE III of FIG. 8. Table 4 illustrates the complementarity of the nucleotide sequences of LOC148198 BINDING SITE1 and LOC148198 BINDING SITE2, designated SEQ ID:10436 and SEQ ID:1492 respectively, to the nucleotide sequence of GAM7957 RNA, herein designated GAM RNA, also designated SEQ ID:297.

Another function of GAM7957 is therefore inhibition of LOC148198 (Accession XP_047554.4). Accordingly, utilities of GAM7957 include diagnosis, prevention and treatment of diseases and clinical conditions associated with LOC148198.

LOC148206 (Accession XP_086096.2) is another GAM7957 target gene, herein designated TARGET GENE. LOC148206 BINDING SITE1 and LOC148206 BINDING SITE2 are target binding sites found in untranslated regions of mRNA encoded by LOC148206, corresponding to target binding sites such as BINDING SITE I, BINDING SITE II or BINDING SITE III of FIG. 8. Table 4 illustrates the complementarity of the nucleotide sequences of LOC148206 BINDING SITE1 and LOC148206 BINDING SITE2, designated SEQ ID:17263 and SEQ ID:17399 respectively, to the nucleotide sequence of GAM7957 RNA, herein designated GAM RNA, also designated SEQ ID:297.

Another function of GAM7957 is therefore inhibition of LOC148206 (Accession XP_086096.2). Accordingly, utilities of GAM7957 include diagnosis, prevention and treatment of diseases and clinical conditions associated with LOC148206.

LOC148918 (Accession XP_086361.1) is another GAM7957 target gene, herein designated TARGET GENE. LOC148918 BINDING SITE is a target binding site found in the 5' untranslated region of mRNA encoded by LOC148918, corresponding to a target binding site such as BINDING SITE I, BINDING SITE II or BINDING SITE III of FIG. 8. Table 4 illustrates the complementarity of the nucleotide sequences of LOC148918 BINDING SITE, designated SEQ ID:9014, to the nucleotide sequence of GAM7957 RNA, herein designated GAM RNA, also designated SEQ ID:297.

Another function of GAM7957 is therefore inhibition of LOC148918 (Accession XP_086361.1). Accordingly, utilities of GAM7957 include diagnosis, prevention and treatment of diseases and clinical conditions associated with LOC148918.

LOC149194 (Accession XP_086458.1) is another GAM7957 target gene, herein designated TARGET GENE. LOC149194 BINDING SITE is a target binding site found in the 5' untranslated region of mRNA encoded by LOC149194, corresponding to a target binding site such as BINDING SITE I, BINDING SITE II or BINDING SITE III of FIG. 8. Table 4 illustrates the complementarity of the nucleotide sequences of LOC149194 BINDING SITE, designated SEQ ID:13065, to the nucleotide sequence of GAM7957 RNA, herein designated GAM RNA, also designated SEQ ID:297.

Another function of GAM7957 is therefore inhibition of LOC149194 (Accession XP_086458.1). Accordingly, utilities of GAM7957 include diagnosis, prevention and treatment of diseases and clinical conditions associated with LOC149194.

LOC149271 (Accession XP_086475.1) is another GAM7957 target gene, herein designated TARGET GENE. LOC149271 BINDING SITE is a target binding site found in the 3' untranslated region of mRNA encoded by LOC149271, corresponding to a target binding site such as BINDING SITE I, BINDING SITE II or BINDING SITE III of FIG. 8. Table 4 illustrates the complementarity of the nucleotide sequences of LOC149271 BINDING SITE, designated SEQ ID:17044, to the nucleotide sequence of GAM7957 RNA, herein designated GAM RNA, also designated SEQ ID:297.

Another function of GAM7957 is therefore inhibition of LOC149271 (Accession XP_086475.1). Accordingly, utilities of GAM7957 include diagnosis, prevention and treatment of diseases and clinical conditions associated with LOC149271.

LOC149448 (Accession XP_097642.1) is another GAM7957 target gene, herein designated TARGET GENE. LOC149448 BINDING SITE is a target binding site found in the 3' untranslated region of mRNA encoded by LOC149448, corresponding to a target binding site such as BINDING SITE I, BINDING SITE II or BINDING SITE III of FIG. 8. Table 4 illustrates the complementarity of the nucleotide sequences of LOC149448 BINDING SITE, designated SEQ ID:13110, to the nucleotide sequence of GAM7957 RNA, herein designated GAM RNA, also designated SEQ ID:297.

Another function of GAM7957 is therefore inhibition of LOC149448 (Accession XP_097642.1). Accordingly, utilities of GAM7957 include diagnosis, prevention and treatment of diseases and clinical conditions associated with LOC149448.

LOC149464 (Accession XP_097645.1) is another GAM7957 target gene, herein designated TARGET GENE. LOC149464 BINDING SITE1 and LOC149464 BINDING SITE2 are target binding sites found in untranslated regions of mRNA encoded by LOC149464, corresponding to target binding sites such as BINDING SITE I, BINDING SITE II or BINDING SITE III of FIG. 8. Table 4 illustrates the complementarity of the nucleotide sequences of LOC149464 BINDING SITE1 and LOC149464 BINDING SITE2, designated SEQ ID:17317 and SEQ ID:1492 respectively, to the nucleotide sequence of GAM7957 RNA, herein designated GAM RNA, also designated SEQ ID:297.

Another function of GAM7957 is therefore inhibition of LOC149464 (Accession XP_097645.1). Accordingly, utilities of GAM7957 include diagnosis, prevention and treatment of diseases and clinical conditions associated with LOC149464.

LOC149506 (Accession XP_097661.1) is another GAM7957 target gene, herein designated TARGET GENE. LOC149506 BINDING SITE is a target binding site found in the 3' untranslated region of mRNA encoded by LOC149506, corresponding to a target binding site such as BINDING SITE I, BINDING SITE II or BINDING SITE III of FIG. 8. Table 4 illustrates the complementarity of the nucleotide sequences of LOC149506 BINDING SITE, designated SEQ ID:6656, to the nucleotide sequence of GAM7957 RNA, herein designated GAM RNA, also designated SEQ ID:297.

Another function of GAM7957 is therefore inhibition of LOC149506 (Accession XP_097661.1). Accordingly, utilities of GAM7957 include diagnosis, prevention and treatment of diseases and clinical conditions associated with LOC149506.

LOC149672 (Accession XP_086669.2) is another GAM7957 target gene, herein designated TARGET GENE. LOC149672 BINDING SITE is a target binding site found in the 5' untranslated region of mRNA encoded by LOC149672, corresponding to a target binding site such as BINDING SITE I, BINDING SITE II or BINDING SITE III of FIG. 8. Table 4 illustrates the complementarity of the nucleotide sequences of LOC149672 BINDING SITE, designated SEQ ID:18837, to the nucleotide sequence of GAM7957 RNA, herein designated GAM RNA, also designated SEQ ID:297.

Another function of GAM7957 is therefore inhibition of LOC149672 (Accession XP_086669.2). Accordingly, utilities of GAM7957 include diagnosis, prevention and treatment of diseases and clinical conditions associated with LOC149672.

LOC149705 (Accession XP_097711.4) is another GAM7957 target gene, herein designated TARGET GENE. LOC149705 BINDING SITE1 and LOC149705 BINDING SITE2 are target binding sites found in untranslated regions of mRNA encoded by LOC149705, corresponding to target binding sites such as BINDING SITE I, BINDING SITE II or BINDING SITE III of FIG. 8. Table 4 illustrates the complementarity of the nucleotide sequences of LOC149705 BINDING SITE1 and LOC149705 BINDING SITE2, designated SEQ ID:5361 and SEQ ID:6755 respectively, to the nucleotide sequence of GAM7957 RNA, herein designated GAM RNA, also designated SEQ ID:297.

Another function of GAM7957 is therefore inhibition of LOC149705 (Accession XP_097711.4). Accordingly, utilities of GAM7957 include diagnosis, prevention and treatment of diseases and clinical conditions associated with LOC149705.

LOC150095 (Accession XP_097805.1) is another GAM7957 target gene, herein designated TARGET GENE. LOC150095 BINDING SITE1 and LOC150095 BINDING SITE2 are target binding sites found in untranslated regions of mRNA encoded by LOC150095, corresponding to target binding sites such as BINDING SITE I, BINDING SITE II or BINDING SITE III of FIG. 8. Table 4 illustrates the complementarity of the nucleotide sequences of LOC150095 BINDING SITE1 and LOC150095 BINDING SITE2, designated SEQ ID:2125 and SEQ ID:18254 respectively, to the nucleotide sequence of GAM7957 RNA, herein designated GAM RNA, also designated SEQ ID:297.

Another function of GAM7957 is therefore inhibition of LOC150095 (Accession XP_097805.1). Accordingly, utilities of GAM7957 include diagnosis, prevention and treatment of diseases and clinical conditions associated with LOC150095.

LOC150150 (Accession XP_097820.1) is another GAM7957 target gene, herein designated TARGET GENE. LOC150150 BINDING SITE1 and LOC150150 BINDING SITE2 are target binding sites found in untranslated regions of mRNA encoded by LOC150150, corresponding to target binding sites such as BINDING SITE I, BINDING SITE II or BINDING SITE III of FIG. 8. Table 4 illustrates the complementarity of the nucleotide sequences of LOC150150 BINDING SITE1 and LOC150150 BINDING SITE2, designated SEQ ID:2222 and SEQ ID:16255 respectively, to the nucleotide sequence of GAM7957 RNA, herein designated GAM RNA, also designated SEQ ID:297.

Another function of GAM7957 is therefore inhibition of LOC150150 (Accession XP_097820.1). Accordingly, utilities of GAM7957 include diagnosis, prevention and treatment of diseases and clinical conditions associated with LOC150150.

LOC150174 (Accession XP_086802.2) is another GAM7957 target gene, herein designated TARGET GENE. LOC150174 BINDING SITE1 and LOC150174 BINDING SITE2 are target binding sites found in untranslated regions of mRNA encoded by LOC150174, corresponding to target binding sites such as BINDING SITE I, BINDING SITE II or BINDING SITE III of FIG. 8. Table 4 illustrates the complementarity of the nucleotide sequences of LOC150174 BINDING SITE1 and LOC150174 BINDING SITE2, designated SEQ ID:6243 and SEQ ID:14331 respectively, to the nucleotide sequence of GAM7957 RNA, herein designated GAM RNA, also designated SEQ ID:297.

Another function of GAM7957 is therefore inhibition of LOC150174 (Accession XP_086802.2). Accordingly, utilities of GAM7957 include diagnosis, prevention and treatment of diseases and clinical conditions associated with LOC150174.

LOC150212 (Accession XP_086827.2) is another GAM7957 target gene, herein designated TARGET GENE. LOC150212 BINDING SITE1 through LOC150212 BINDING SITE5 are target binding sites found in untranslated regions of mRNA encoded by LOC150212, corresponding to target binding sites such as BINDING SITE I, BINDING SITE II or BINDING SITE III of FIG. 8. Table 4 illustrates the complementarity of the nucleotide sequences of LOC150212 BINDING SITE1 through LOC150212 BINDING SITE5, designated SEQ ID:3584, SEQ ID:2979, SEQ ID:5019, SEQ ID:17190 and SEQ ID:19451 respectively, to the nucleotide sequence of GAM7957 RNA, herein designated GAM RNA, also designated SEQ ID:297.

Another function of GAM7957 is therefore inhibition of LOC150212 (Accession XP_086827.2). Accordingly, utilities of GAM7957 include diagnosis, prevention and treatment of diseases and clinical conditions associated with LOC150212.

LOC150213 (Accession XP_059324.1) is another GAM7957 target gene, herein designated TARGET GENE. LOC150213 BINDING SITE1 and LOC150213 BINDING SITE2 are target binding sites found in untranslated regions of mRNA encoded by LOC150213, corresponding to target binding sites such as BINDING SITE I, BINDING SITE II or BINDING SITE III of FIG. 8. Table 4 illustrates the complementarity of the nucleotide sequences of LOC150213 BINDING SITE1 and LOC150213 BINDING SITE2, designated SEQ ID:14331 and SEQ ID:6243 respectively, to the nucleotide sequence of GAM7957 RNA, herein designated GAM RNA, also designated SEQ ID:297.

Another function of GAM7957 is therefore inhibition of LOC150213 (Accession XP_059324.1). Accordingly, utilities of GAM7957 include diagnosis, prevention and treatment of diseases and clinical conditions associated with LOC150213.

LOC150225 (Accession XP_097870.1) is another GAM7957 target gene, herein designated TARGET GENE. LOC150225 BINDING SITE is a target binding site found in the 3' untranslated region of mRNA encoded by LOC150225, corresponding to a target binding site such as BINDING SITE I, BINDING SITE II or BINDING SITE III of FIG. 8. Table 4 illustrates the complementarity of the nucleotide sequences of LOC150225 BINDING SITE, designated SEQ ID:9421, to the nucleotide sequence of GAM7957 RNA, herein designated GAM RNA, also designated SEQ ID:297.

Another function of GAM7957 is therefore inhibition of LOC150225 (Accession XP_097870.1). Accordingly, utilities of GAM7957 include diagnosis, prevention and treatment of diseases and clinical conditions associated with LOC150225.

LOC150271 (Accession XP_097859.2) is another GAM7957 target gene, herein designated TARGET GENE. LOC150271 BINDING SITE is a target binding site found in the 3' untranslated region of mRNA encoded by LOC150271, corresponding to a target binding site such as BINDING SITE I, BINDING SITE II or BINDING SITE III of FIG. 8. Table 4 illustrates the complementarity of the nucleotide sequences of LOC150271 BINDING SITE, designated SEQ ID:13945, to the nucleotide sequence of GAM7957 RNA, herein designated GAM RNA, also designated SEQ ID:297.

Another function of GAM7957 is therefore inhibition of LOC150271 (Accession XP_097859.2). Accordingly, utilities of GAM7957 include diagnosis, prevention and treatment of diseases and clinical conditions associated with LOC150271.

LOC150279 (Accession XP_086820.1) is another GAM7957 target gene, herein designated TARGET GENE. LOC150279 BINDING SITE is a target binding site found in the 3' untranslated region of mRNA encoded by LOC150279, corresponding to a target binding site such as BINDING SITE I, BINDING SITE II or BINDING SITE III of FIG. 8. Table 4 illustrates the complementarity of the nucleotide sequences of LOC150279 BINDING SITE, designated SEQ ID:6687, to the nucleotide sequence of GAM7957 RNA, herein designated GAM RNA, also designated SEQ ID:297.

Another function of GAM7957 is therefore inhibition of LOC150279 (Accession XP_086820.1). Accordingly, utilities of GAM7957 include diagnosis, prevention and treatment of diseases and clinical conditions associated with LOC150279.

LOC150299 (Accession XP_097869.2) is another GAM7957 target gene, herein designated TARGET GENE. LOC150299 BINDING SITE is a target binding site found in the 3' untranslated region of mRNA encoded by LOC150299, corresponding to a target binding site such as BINDING SITE I, BINDING SITE II or BINDING SITE III of FIG. 8. Table 4 illustrates the complementarity of the nucleotide sequences of LOC150299 BINDING SITE, designated SEQ ID:6090, to the nucleotide sequence of GAM7957 RNA, herein designated GAM RNA, also designated SEQ ID:297.

Another function of GAM7957 is therefore inhibition of LOC150299 (Accession XP_097869.2). Accordingly, utilities of GAM7957 include diagnosis, prevention and treatment of diseases and clinical conditions associated with LOC150299.

LOC150630 (Accession XP_097931.1) is another GAM7957 target gene, herein designated TARGET GENE. LOC150630 BINDING SITE1 and LOC150630 BINDING SITE2 are target binding sites found in untranslated regions of mRNA encoded by LOC150630, corresponding to target binding sites such as BINDING SITE I, BINDING SITE II or BINDING SITE III of FIG. 8. Table 4 illustrates the complementarity of the nucleotide sequences of LOC150630 BINDING SITE1 and LOC150630 BINDING SITE2, designated SEQ ID:4127 and SEQ ID:7317 respectively, to the nucleotide sequence of GAM7957 RNA, herein designated GAM RNA, also designated SEQ ID:297.

Another function of GAM7957 is therefore inhibition of LOC150630 (Accession XP_097931.1). Accordingly, utilities of GAM7957 include diagnosis, prevention and treatment of diseases and clinical conditions associated with LOC150630.

LOC150933 (Accession XP_097971.1) is another GAM7957 target gene, herein designated TARGET GENE. LOC150933 BINDING SITE is a target binding site found in the 5' untranslated region of mRNA encoded by LOC150933, corresponding to a target binding site such as BINDING SITE I, BINDING SITE II or BINDING SITE III of FIG. 8. Table 4 illustrates the complementarity of the nucleotide sequences of LOC150933 BINDING SITE, designated SEQ ID:17018, to the nucleotide sequence of GAM7957 RNA, herein designated GAM RNA, also designated SEQ ID:297.

Another function of GAM7957 is therefore inhibition of LOC150933 (Accession XP_097971.1). Accordingly, utilities of GAM7957 include diagnosis, prevention and treatment of diseases and clinical conditions associated with LOC150933.

LOC151146 (Accession XP_087106.2) is another GAM7957 target gene, herein designated TARGET GENE.

LOC151146 BINDING SITE is a target binding site found in the 5' untranslated region of mRNA encoded by LOC151146, corresponding to a target binding site such as BINDING SITE I, BINDING SITE II or BINDING SITE III of FIG. 8. Table 4 illustrates the complementarity of the nucleotide sequences of LOC151146 BINDING SITE, designated SEQ ID:20012, to the nucleotide sequence of GAM7957 RNA, herein designated GAM RNA, also designated SEQ ID:297.

Another function of GAM7957 is therefore inhibition of LOC151146 (Accession XP_087106.2). Accordingly, utilities of GAM7957 include diagnosis, prevention and treatment of diseases and clinical conditions associated with LOC151146.

LOC151194 (Accession NP_660323.2) is another GAM7957 target gene, herein designated TARGET GENE. LOC151194 BINDING SITE1 and LOC151194 BINDING SITE2 are target binding sites found in untranslated regions of mRNA encoded by LOC151194, corresponding to target binding sites such as BINDING SITE I, BINDING SITE II or BINDING SITE III of FIG. 8. Table 4 illustrates the complementarity of the nucleotide sequences of LOC151194 BINDING SITE1 and LOC151194 BINDING SITE2, designated SEQ ID:9002 and SEQ ID:9420 respectively, to the nucleotide sequence of GAM7957 RNA, herein designated GAM RNA, also designated SEQ ID:297.

Another function of GAM7957 is therefore inhibition of LOC151194 (Accession NP_660323.2). Accordingly, utilities of GAM7957 include diagnosis, prevention and treatment of diseases and clinical conditions associated with LOC151194.

LOC151623 (Accession XP_098096.5) is another GAM7957 target gene, herein designated TARGET GENE. LOC151623 BINDING SITE is a target binding site found in the 3' untranslated region of mRNA encoded by LOC151623, corresponding to a target binding site such as BINDING SITE I, BINDING SITE II or BINDING SITE III of FIG. 8. Table 4 illustrates the complementarity of the nucleotide sequences of LOC151623 BINDING SITE, designated SEQ ID:5532, to the nucleotide sequence of GAM7957 RNA, herein designated GAM RNA, also designated SEQ ID:297.

Another function of GAM7957 is therefore inhibition of LOC151623 (Accession XP_098096.5). Accordingly, utilities of GAM7957 include diagnosis, prevention and treatment of diseases and clinical conditions associated with LOC151623.

LOC151720 (Accession XP_087279.6) is another GAM7957 target gene, herein designated TARGET GENE. LOC151720 BINDING SITE is a target binding site found in the 3' untranslated region of mRNA encoded by LOC151720, corresponding to a target binding site such as BINDING SITE I, BINDING SITE II or BINDING SITE III of FIG. 8. Table 4 illustrates the complementarity of the nucleotide sequences of LOC151720 BINDING SITE, designated SEQ ID:16954, to the nucleotide sequence of GAM7957 RNA, herein designated GAM RNA, also designated SEQ ID:297.

Another function of GAM7957 is therefore inhibition of LOC151720 (Accession XP_087279.6). Accordingly, utilities of GAM7957 include diagnosis, prevention and treatment of diseases and clinical conditions associated with LOC151720.

LOC152024 (Accession XP_087365.1) is another GAM7957 target gene, herein designated TARGET GENE. LOC152024 BINDING SITE is a target binding site found in the 3' untranslated region of mRNA encoded by LOC152024, corresponding to a target binding site such as BINDING SITE I, BINDING SITE II or BINDING SITE III of FIG. 8. Table 4 illustrates the complementarity of the nucleotide sequences of LOC152024 BINDING SITE, designated SEQ ID:10971, to the nucleotide sequence of GAM7957 RNA, herein designated GAM RNA, also designated SEQ ID:297.

Another function of GAM7957 is therefore inhibition of LOC152024 (Accession XP_087365.1). Accordingly, utilities of GAM7957 include diagnosis, prevention and treatment of diseases and clinical conditions associated with LOC152024.

LOC152445 (Accession XP_098231.1) is another GAM7957 target gene, herein designated TARGET GENE. LOC152445 BINDING SITE is a target binding site found in the 3' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:10654, to the nucleotide sequence of GAM7957 RNA, herein designated GAM RNA, also designated SEQ ID:297.

Another function of GAM7957 is therefore inhibition of LOC152445 (Accession XP_098231.1). Accordingly, utilities of GAM7957 include diagnosis, prevention and treatment of diseases and clinical conditions associated with LOC152445.

LOC152627 (Accession XP_087495.1) is another GAM7957 target gene, herein designated TARGET GENE. LOC152627 BINDING SITE1 and LOC152627 BINDING SITE2 are target binding sites found in untranslated regions of mRNA encoded by LOC152627, corresponding to target binding sites such as BINDING SITE I, BINDING SITE II or BINDING SITE III of FIG. 8. Table 4 illustrates the complementarity of the nucleotide sequences of LOC152627 BINDING SITE1 and LOC152627 BINDING SITE2, designated SEQ ID:19899 and SEQ ID:7628 respectively, to the nucleotide sequence of GAM7957 RNA, herein designated GAM RNA, also designated SEQ ID:297.

Another function of GAM7957 is therefore inhibition of LOC152627 (Accession XP_087495.1). Accordingly, utilities of GAM7957 include diagnosis, prevention and treatment of diseases and clinical conditions associated with LOC152627.

LOC152804 (Accession XP_098266.2) is another GAM7957 target gene, herein designated TARGET GENE. LOC152804 BINDING SITE1 and LOC152804 BINDING SITE2 are target binding sites found in untranslated regions of mRNA encoded by LOC152804, corresponding to target binding sites such as BINDING SITE I, BINDING SITE II or BINDING SITE III of FIG. 8. Table 4 illustrates the complementarity of the nucleotide sequences of LOC152804 BINDING SITE1 and LOC152804 BINDING SITE2, designated SEQ ID:13066 and SEQ ID:14782 respectively, to the nucleotide sequence of GAM7957 RNA, herein designated GAM RNA, also designated SEQ ID:297.

Another function of GAM7957 is therefore inhibition of LOC152804 (Accession XP_098266.2). Accordingly, utilities of GAM7957 include diagnosis, prevention and treatment of diseases and clinical conditions associated with LOC152804.

LOC152829 (Accession XP_087532.1) is another GAM7957 target gene, herein designated TARGET GENE. LOC152829 BINDING SITE is a target binding site found in the 5' untranslated region of mRNA encoded by LOC152829, corresponding to a target binding site such as BINDING SITE I, BINDING SITE II or BINDING SITE III of FIG. 8. Table 4 illustrates the complementarity of the nucleotide sequences of LOC152829 BINDING SITE, designated SEQ ID:11843, to the nucleotide sequence of GAM7957 RNA, herein designated GAM RNA, also designated SEQ ID:297.

Another function of GAM7957 is therefore inhibition of LOC152829 (Accession XP_087532.1). Accordingly, utilities of GAM7957 include diagnosis, prevention and treatment of diseases and clinical conditions associated with LOC152829.

LOC153077 (Accession XP_098307.1) is another GAM7957 target gene, herein designated TARGET GENE. LOC153077 BINDING SITE1 and LOC153077 BINDING SITE2 are target binding sites found in untranslated regions of mRNA encoded by LOC153077, corresponding to target binding sites such as BINDING SITE I, BINDING SITE II or BINDING SITE III of FIG. 8. Table 4 illustrates the complementarity of the nucleotide sequences of LOC153077 BINDING SITE1 and LOC153077 BINDING SITE2, designated SEQ ID:15345 and SEQ ID:16654 respectively, to the nucleotide sequence of GAM7957 RNA, herein designated GAM RNA, also designated SEQ ID:297.

Another function of GAM7957 is therefore inhibition of LOC153077 (Accession XP_098307.1). Accordingly, utilities of GAM7957 include diagnosis, prevention and treatment of diseases and clinical conditions associated with LOC153077.

LOC153146 (Accession XP_098319.1) is another GAM7957 target gene, herein designated TARGET GENE. LOC153146 BINDING SITE is a target binding site found in the 3' untranslated region of mRNA encoded by LOC153146, corresponding to a target binding site such as BINDING SITE I, BINDING SITE II or BINDING SITE III of FIG. 8. Table 4 illustrates the complementarity of the nucleotide sequences of LOC153146 BINDING SITE, designated SEQ ID:13434, to the nucleotide sequence of GAM7957 RNA, herein designated GAM RNA, also designated SEQ ID:297.

Another function of GAM7957 is therefore inhibition of LOC153146 (Accession XP_098319.1). Accordingly, utilities of GAM7957 include diagnosis, prevention and treatment of diseases and clinical conditions associated with LOC153146.

LOC153338 (Accession XP_098361.1) is another GAM7957 target gene, herein designated TARGET GENE. LOC153338 BINDING SITE is a target binding site found in the 3' untranslated region of mRNA encoded by LOC153338, corresponding to a target binding site such as BINDING SITE I, BINDING SITE II or BINDING SITE III of FIG. 8. Table 4 illustrates the complementarity of the nucleotide sequences of LOC153338 BINDING SITE, designated SEQ ID:14393, to the nucleotide sequence of GAM7957 RNA, herein designated GAM RNA, also designated SEQ ID:297.

Another function of GAM7957 is therefore inhibition of LOC153338 (Accession XP_098361.1). Accordingly, utilities of GAM7957 include diagnosis, prevention and treatment of diseases and clinical conditions associated with LOC153338.

LOC153561 (Accession XP_087708.6) is another GAM7957 target gene, herein designated TARGET GENE. LOC153561 BINDING SITE1 and LOC153561 BINDING SITE2 are target binding sites found in untranslated regions of mRNA encoded by LOC153561, corresponding to target binding sites such as BINDING SITE I, BINDING SITE II or BINDING SITE III of FIG. 8. Table 4 illustrates the complementarity of the nucleotide sequences of LOC153561 BINDING SITE1 and LOC153561 BINDING SITE2, designated SEQ ID:8646 and SEQ ID:8369 respectively, to the nucleotide sequence of GAM7957 RNA, herein designated GAM RNA, also designated SEQ ID:297.

Another function of GAM7957 is therefore inhibition of LOC153561 (Accession XP_087708.6). Accordingly, utilities of GAM7957 include diagnosis, prevention and treatment of diseases and clinical conditions associated with LOC153561.

LOC153682 (Accession XP_098414.1) is another GAM7957 target gene, herein designated TARGET GENE. LOC153682 BINDING SITE is a target binding site found in the 3' untranslated region of mRNA encoded by LOC153682, corresponding to a target binding site such as BINDING SITE I, BINDING SITE II or BINDING SITE III of FIG. 8. Table 4 illustrates the complementarity of the nucleotide sequences of LOC153682 BINDING SITE, designated SEQ ID:609, to the nucleotide sequence of GAM7957 RNA, herein designated GAM RNA, also designated SEQ ID:297.

Another function of GAM7957 is therefore inhibition of LOC153682 (Accession XP_098414.1). Accordingly, utilities of GAM7957 include diagnosis, prevention and treatment of diseases and clinical conditions associated with LOC153682.

LOC153711 (Accession XP_098419.1) is another GAM7957 target gene, herein designated TARGET GENE. LOC153711 BINDING SITE is a target binding site found in the 3' untranslated region of mRNA encoded by LOC153711, corresponding to a target binding site such as BINDING SITE I, BINDING SITE II or BINDING SITE III of FIG. 8. Table 4 illustrates the complementarity of the nucleotide sequences of LOC153711 BINDING SITE, designated SEQ ID:14924, to the nucleotide sequence of GAM7957 RNA, herein designated GAM RNA, also designated SEQ ID:297.

Another function of GAM7957 is therefore inhibition of LOC153711 (Accession XP_098419.1). Accordingly, utilities of GAM7957 include diagnosis, prevention and treatment of diseases and clinical conditions associated with LOC153711.

LOC153727 (Accession XP_098422.1) is another GAM7957 target gene, herein designated TARGET GENE. LOC153727 BINDING SITE is a target binding site found in the 3' untranslated region of mRNA encoded by LOC153727, corresponding to a target binding site such as BINDING SITE I, BINDING SITE II or BINDING SITE III of FIG. 8. Table 4 illustrates the complementarity of the nucleotide sequences of LOC153727 BINDING SITE, designated SEQ ID:20181, to the nucleotide sequence of GAM7957 RNA, herein designated GAM RNA, also designated SEQ ID:297.

Another function of GAM7957 is therefore inhibition of LOC153727 (Accession XP_098422.1). Accordingly, utilities of GAM7957 include diagnosis, prevention and treatment of diseases and clinical conditions associated with LOC153727.

LOC154739 (Accession XP_098602.1) is another GAM7957 target gene, herein designated TARGET GENE. LOC154739 BINDING SITE is a target binding site found in the 3' untranslated region of mRNA encoded by LOC154739, corresponding to a target binding site such as BINDING SITE I, BINDING SITE II or BINDING SITE III of FIG. 8. Table 4 illustrates the complementarity of the nucleotide sequences of LOC154739 BINDING SITE, designated SEQ ID:7965, to the nucleotide sequence of GAM7957 RNA, herein designated GAM RNA, also designated SEQ ID:297.

Another function of GAM7957 is therefore inhibition of LOC154739 (Accession XP_098602.1). Accordingly, utilities of GAM7957 include diagnosis, prevention and treatment of diseases and clinical conditions associated with LOC154739.

LOC154791 (Accession XP_088045.1) is another GAM7957 target gene, herein designated TARGET GENE. LOC154791 BINDING SITE is a target binding site found in the 3' untranslated region of mRNA encoded by LOC154791, corresponding to a target binding site such as BINDING SITE I, BINDING SITE II or BINDING SITE III of FIG. 8. Table 4 illustrates the complementarity of the nucleotide sequences of LOC154791 BINDING SITE, designated SEQ ID:2550, to the nucleotide sequence of GAM7957 RNA, herein designated GAM RNA, also designated SEQ ID:297.

Another function of GAM7957 is therefore inhibition of LOC154791 (Accession XP_088045.1). Accordingly, utilities of GAM7957 include diagnosis, prevention and treatment of diseases and clinical conditions associated with LOC154791.

LOC154877 (Accession XP_098626.1) is another GAM7957 target gene, herein designated TARGET GENE. LOC154877 BINDING SITE is a target binding site found in the 3' untranslated region of mRNA encoded by LOC154877, corresponding to a target binding site such as BINDING SITE I, BINDING SITE II or BINDING SITE III of FIG. 8. Table 4 illustrates the complementarity of the nucleotide sequences of LOC154877 BINDING SITE, designated SEQ ID:9421, to the nucleotide sequence of GAM7957 RNA, herein designated GAM RNA, also designated SEQ ID:297.

Another function of GAM7957 is therefore inhibition of LOC154877 (Accession XP_098626.1). Accordingly, utilities of GAM7957 include diagnosis, prevention and treatment of diseases and clinical conditions associated with LOC154877.

LOC155006 (Accession XP_088117.1) is another GAM7957 target gene, herein designated TARGET GENE. LOC155006 BINDING SITE is a target binding site found in the 3' untranslated region of mRNA encoded by LOC155006, corresponding to a target binding site such as BINDING SITE I, BINDING SITE II or BINDING SITE III of FIG. 8. Table 4 illustrates the complementarity of the nucleotide sequences of LOC155006 BINDING SITE, designated SEQ ID:15060, to the nucleotide sequence of GAM7957 RNA, herein designated GAM RNA, also designated SEQ ID:297.

Another function of GAM7957 is therefore inhibition of LOC155006 (Accession XP_088117.1). Accordingly, utilities of GAM7957 include diagnosis, prevention and treatment of diseases and clinical conditions associated with LOC155006.

LOC155054 (Accession XP_088140.1) is another GAM7957 target gene, herein designated TARGET GENE. LOC155054 BINDING SITE is a target binding site found in the 3' untranslated region of mRNA encoded by LOC155054, corresponding to a target binding site such as BINDING SITE I, BINDING SITE II or BINDING SITE III of FIG. 8. Table 4 illustrates the complementarity of the nucleotide sequences of LOC155054 BINDING SITE, designated SEQ ID:1423, to the nucleotide sequence of GAM7957 RNA, herein designated GAM RNA, also designated SEQ ID:297.

Another function of GAM7957 is therefore inhibition of LOC155054 (Accession XP_088140.1). Accordingly, utilities of GAM7957 include diagnosis, prevention and treatment of diseases and clinical conditions associated with LOC155054.

LOC155072 (Accession XP_098661.1) is another GAM7957 target gene, herein designated TARGET GENE. LOC155072 BINDING SITE1 through LOC155072 BINDING SITE3 are target binding sites found in untranslated regions of mRNA encoded by LOC155072, corresponding to target binding sites such as BINDING SITE I, BINDING SITE II or BINDING SITE III of FIG. 8. Table 4 illustrates the complementarity of the nucleotide sequences of LOC155072 BINDING SITE1 through LOC155072 BINDING SITE3, designated SEQ ID:19036, SEQ ID:614 and SEQ ID:13155 respectively, to the nucleotide sequence of GAM7957 RNA, herein designated GAM RNA, also designated SEQ ID:297.

Another function of GAM7957 is therefore inhibition of LOC155072 (Accession XP_098661.1). Accordingly, utilities of GAM7957 include diagnosis, prevention and treatment of diseases and clinical conditions associated with LOC155072.

LOC155435 (Accession XP_088257.3) is another GAM7957 target gene, herein designated TARGET GENE. LOC155435 BINDING SITE is a target binding site found in the 5' untranslated region of mRNA encoded by LOC155435, corresponding to a target binding site such as BINDING SITE I, BINDING SITE II or BINDING SITE III of FIG. 8. Table 4 illustrates the complementarity of the nucleotide sequences of LOC155435 BINDING SITE, designated SEQ ID:1716, to the nucleotide sequence of GAM7957 RNA, herein designated GAM RNA, also designated SEQ ID:297.

Another function of GAM7957 is therefore inhibition of LOC155435 (Accession XP_088257.3). Accordingly, utilities of GAM7957 include diagnosis, prevention and treatment of diseases and clinical conditions associated with LOC155435.

LOC157278 (Accession XP_098741.2) is another GAM7957 target gene, herein designated TARGET GENE. LOC157278 BINDING SITE1 and LOC157278 BINDING SITE2 are target binding sites found in untranslated regions of mRNA encoded by LOC157278, corresponding to target binding sites such as BINDING SITE I, BINDING SITE II or BINDING SITE III of FIG. 8. Table 4 illustrates the complementarity of the nucleotide sequences of LOC157278 BINDING SITE1 and LOC157278 BINDING SITE2, designated SEQ ID:10646 and SEQ ID:15781 respectively, to the nucleotide sequence of GAM7957 RNA, herein designated GAM RNA, also designated SEQ ID:297.

Another function of GAM7957 is therefore inhibition of LOC157278 (Accession XP_098741.2). Accordingly, utilities of GAM7957 include diagnosis, prevention and treatment of diseases and clinical conditions associated with LOC157278.

LOC157570 (Accession XP_088331.2) is another GAM7957 target gene, herein designated TARGET GENE. LOC157570 BINDING SITE1 through LOC157570 BINDING SITE3 are target binding sites found in untranslated regions of mRNA encoded by LOC157570, corresponding to target binding sites such as BINDING SITE I, BINDING SITE II or BINDING SITE III of FIG. 8. Table 4 illustrates the complementarity of the nucleotide sequences of LOC157570 BINDING SITE1 through LOC157570 BINDING SITE3, designated SEQ ID:14946, SEQ ID:3765 and SEQ ID:13155 respectively, to the nucleotide sequence of GAM7957 RNA, herein designated GAM RNA, also designated SEQ ID:297.

Another function of GAM7957 is therefore inhibition of LOC157570 (Accession XP_088331.2). Accordingly, utilities of GAM7957 include diagnosis, prevention and treatment of diseases and clinical conditions associated with LOC157570.

LOC157657 (Accession NP_808880.1) is another GAM7957 target gene, herein designated TARGET GENE. LOC157657 BINDING SITE is a target binding site found in the 3' untranslated region of mRNA encoded by LOC157657, corresponding to a target binding site such as BINDING SITE I, BINDING SITE II or BINDING SITE III of FIG. 8. Table 4 illustrates the complementarity of the nucleotide sequences of LOC157657 BINDING SITE, designated SEQ ID:3676, to the nucleotide sequence of GAM7957 RNA, herein designated GAM RNA, also designated SEQ ID:297.

Another function of GAM7957 is therefore inhibition of LOC157657 (Accession NP_808880.1). Accordingly, utilities of GAM7957 include diagnosis, prevention and treatment of diseases and clinical conditions associated with LOC157657.

LOC157737 (Accession XP_098819.1) is another GAM7957 target gene, herein designated TARGET GENE. LOC157737 BINDING SITE is a target binding site found in the 3' untranslated region of mRNA encoded by LOC157737, corresponding to a target binding site such as BINDING SITE I, BINDING SITE II or BINDING SITE III of FIG. 8. Table 4 illustrates the complementarity of the nucleotide sequences of LOC157737 BINDING SITE, designated SEQ ID:14124, to the nucleotide sequence of GAM7957 RNA, herein designated GAM RNA, also designated SEQ ID:297.

Another function of GAM7957 is therefore inhibition of LOC157737 (Accession XP_098819.1). Accordingly, utilities of GAM7957 include diagnosis, prevention and treatment of diseases and clinical conditions associated with LOC157737.

LOC157813 (Accession XP_098828.1) is another GAM7957 target gene, herein designated TARGET GENE. LOC157813 BINDING SITE is a target binding site found in the 3' untranslated region of mRNA encoded by LOC157813, corresponding to a target binding site such as BINDING SITE I, BINDING SITE II or BINDING SITE III of FIG. 8. Table 4 illustrates the complementarity of the nucleotide sequences of LOC157813 BINDING SITE, designated SEQ ID:13066, to the nucleotide sequence of GAM7957 RNA, herein designated GAM RNA, also designated SEQ ID:297.

Another function of GAM7957 is therefore inhibition of LOC157813 (Accession XP_098828.1). Accordingly, utilities of GAM7957 include diagnosis, prevention and treatment of diseases and clinical conditions associated with LOC157813.

LOC157918 (Accession XP_098842.1) is another GAM7957 target gene, herein designated TARGET GENE. LOC157918 BINDING SITE is a target binding site found in the 3' untranslated region of mRNA encoded by LOC157918, corresponding to a target binding site such as BINDING SITE I, BINDING SITE II or BINDING SITE III of FIG. 8. Table 4 illustrates the complementarity of the nucleotide sequences of LOC157918 BINDING SITE, designated SEQ ID:4539, to the nucleotide sequence of GAM7957 RNA, herein designated GAM RNA, also designated SEQ ID:297.

Another function of GAM7957 is therefore inhibition of LOC157918 (Accession XP_098842.1). Accordingly, utilities of GAM7957 include diagnosis, prevention and treatment of diseases and clinical conditions associated with LOC157918.

LOC157919 (Accession XP_088420.1) is another GAM7957 target gene, herein designated TARGET GENE. LOC157919 BINDING SITE is a target binding site found in the 5' untranslated region of mRNA encoded by LOC157919, corresponding to a target binding site such as BINDING SITE I, BINDING SITE II or BINDING SITE III of FIG. 8. Table 4 illustrates the complementarity of the nucleotide sequences of LOC157919 BINDING SITE, designated SEQ ID:4539, to the nucleotide sequence of GAM7957 RNA, herein designated GAM RNA, also designated SEQ ID:297.

Another function of GAM7957 is therefore inhibition of LOC157919 (Accession XP_088420.1). Accordingly, utilities of GAM7957 include diagnosis, prevention and treatment of diseases and clinical conditions associated with LOC157919.

LOC158088 (Accession XP_098872.1) is another GAM7957 target gene, herein designated TARGET GENE. LOC158088 BINDING SITE is a target binding site found in the 3' untranslated region of mRNA encoded by LOC158088, corresponding to a target binding site such as BINDING SITE I, BINDING SITE II or BINDING SITE III of FIG. 8. Table 4 illustrates the complementarity of the nucleotide sequences of LOC158088 BINDING SITE, designated SEQ ID:10572, to the nucleotide sequence of GAM7957 RNA, herein designated GAM RNA, also designated SEQ ID:297.

Another function of GAM7957 is therefore inhibition of LOC158088 (Accession XP_098872.1). Accordingly, utilities of GAM7957 include diagnosis, prevention and treatment of diseases and clinical conditions associated with LOC158088.

LOC158160 (Accession XP_054490.2) is another GAM7957 target gene, herein designated TARGET GENE. LOC158160 BINDING SITE is a target binding site found in the 3' untranslated region of mRNA encoded by LOC158160, corresponding to a target binding site such as BINDING SITE I, BINDING SITE II or BINDING SITE III of FIG. 8. Table 4 illustrates the complementarity of the nucleotide sequences of LOC158160 BINDING SITE, designated SEQ ID:15220, to the nucleotide sequence of GAM7957 RNA, herein designated GAM RNA, also designated SEQ ID:297.

Another function of GAM7957 is therefore inhibition of LOC158160 (Accession XP_054490.2). Accordingly, utilities of GAM7957 include diagnosis, prevention and treatment of diseases and clinical conditions associated with LOC158160.

LOC158187 (Accession XP_098892.1) is another GAM7957 target gene, herein designated TARGET GENE. LOC158187 BINDING SITE is a target binding site found in the 3' untranslated region of mRNA encoded by LOC158187, corresponding to a target binding site such as BINDING SITE I, BINDING SITE II or BINDING SITE III of FIG. 8. Table 4 illustrates the complementarity of the nucleotide sequences of LOC158187 BINDING SITE, designated SEQ ID:13065, to the nucleotide sequence of GAM7957 RNA, herein designated GAM RNA, also designated SEQ ID:297.

Another function of GAM7957 is therefore inhibition of LOC158187 (Accession XP_098892.1). Accordingly, utilities of GAM7957 include diagnosis, prevention and treatment of diseases and clinical conditions associated with LOC158187.

LOC158819 (Accession XP_098995.1) is another GAM7957 target gene, herein designated TARGET GENE. LOC158819 BINDING SITE is a target binding site found in the 3' untranslated region of mRNA encoded by LOC158819, corresponding to a target binding site such as BINDING SITE I, BINDING SITE II or BINDING SITE III of FIG. 8. Table 4 illustrates the complementarity of the nucleotide sequences of LOC158819 BINDING SITE, designated SEQ ID:9422, to the nucleotide sequence of GAM7957 RNA, herein designated GAM RNA, also designated SEQ ID:297.

Another function of GAM7957 is therefore inhibition of LOC158819 (Accession XP_098995.1). Accordingly, utilities of GAM7957 include diagnosis, prevention and treatment of diseases and clinical conditions associated with LOC158819.

LOC159053 (Accession XP_099021.1) is another GAM7957 target gene, herein designated TARGET GENE. LOC159053 BINDING SITE1 and LOC159053 BINDING SITE2 are target binding sites found in untranslated regions of mRNA encoded by LOC159053, corresponding to target binding sites such as BINDING SITE I, BINDING SITE II or BINDING SITE III of FIG. 8. Table 4 illustrates the complementarity of the nucleotide sequences of LOC159053 BINDING SITE1 and LOC159053 BINDING SITE2, designated SEQ ID:13155 and SEQ ID:17424 respectively, to the nucleotide sequence of GAM7957 RNA, herein designated GAM RNA, also designated SEQ ID:297.

Another function of GAM7957 is therefore inhibition of LOC159053 (Accession XP_099021.1). Accordingly, utilities of GAM7957 include diagnosis, prevention and treatment of diseases and clinical conditions associated with LOC159053.

LOC159110 (Accession XP_088753.1) is another GAM7957 target gene, herein designated TARGET GENE. LOC159110 BINDING SITE is a target binding site found in the 3' untranslated region of mRNA encoded by LOC159110, corresponding to a target binding site such as BINDING SITE I, BINDING SITE II or BINDING SITE III of FIG. 8. Table 4 illustrates the complementarity of the nucleotide sequences of LOC159110 BINDING SITE, designated SEQ ID:18709, to the nucleotide sequence of GAM7957 RNA, herein designated GAM RNA, also designated SEQ ID:297.

Another function of GAM7957 is therefore inhibition of LOC159110 (Accession XP_088753.1). Accordingly, utilities of GAM7957 include diagnosis, prevention and treatment of diseases and clinical conditions associated with LOC159110.

LOC159176 (Accession XP_088768.3) is another GAM7957 target gene, herein designated TARGET GENE. LOC159176 BINDING SITE is a target binding site found in the 3' untranslated region of mRNA encoded by LOC159176, corresponding to a target binding site such as BINDING SITE I, BINDING SITE II or BINDING SITE III of FIG. 8. Table 4 illustrates the complementarity of the nucleotide sequences of LOC159176 BINDING SITE, designated SEQ ID:17699, to the nucleotide sequence of GAM7957 RNA, herein designated GAM RNA, also designated SEQ ID:297.

Another function of GAM7957 is therefore inhibition of LOC159176 (Accession XP_088768.3). Accordingly, utilities of GAM7957 include diagnosis, prevention and treatment of diseases and clinical conditions associated with LOC159176.

LOC161247 (Accession XP_090783.3) is another GAM7957 target gene, herein designated TARGET GENE. LOC161247 BINDING SITE is a target binding site found in the 5' untranslated region of mRNA encoded by LOC161247, corresponding to a target binding site such as BINDING SITE I, BINDING SITE II or BINDING SITE III of FIG. 8. Table 4 illustrates the complementarity of the nucleotide sequences of LOC161247 BINDING SITE, designated SEQ ID:5801, to the nucleotide sequence of GAM7957 RNA, herein designated GAM RNA, also designated SEQ ID:297.

Another function of GAM7957 is therefore inhibition of LOC161247 (Accession XP_090783.3). Accordingly, utilities of GAM7957 include diagnosis, prevention and treatment of diseases and clinical conditions associated with LOC161247.

LOC162968 (Accession XP_091892.3) is another GAM7957 target gene, herein designated TARGET GENE. LOC162968 BINDING SITE is a target binding site found in the 3' untranslated region of mRNA encoded by LOC162968, corresponding to a target binding site such as BINDING SITE I, BINDING SITE II or BINDING SITE III of FIG. 8. Table 4 illustrates the complementarity of the nucleotide sequences of LOC162968 BINDING SITE, designated SEQ ID:3275, to the nucleotide sequence of GAM7957 RNA, herein designated GAM RNA, also designated SEQ ID:297.

Another function of GAM7957 is therefore inhibition of LOC162968 (Accession XP_091892.3). Accordingly, utilities of GAM7957 include diagnosis, prevention and treatment of diseases and clinical conditions associated with LOC162968.

LOC163259 (Accession XP_088769.6) is another GAM7957 target gene, herein designated TARGET GENE. LOC163259 BINDING SITE is a target binding site found in the 3' untranslated region of mRNA encoded by LOC163259, corresponding to a target binding site such as BINDING SITE I, BINDING SITE II or BINDING SITE III of FIG. 8. Table 4 illustrates the complementarity of the nucleotide sequences of LOC163259 BINDING SITE, designated SEQ ID:17144, to the nucleotide sequence of GAM7957 RNA, herein designated GAM RNA, also designated SEQ ID:297.

Another function of GAM7957 is therefore inhibition of LOC163259 (Accession XP_088769.6). Accordingly, utilities of GAM7957 include diagnosis, prevention and treatment of diseases and clinical conditions associated with LOC163259.

LOC163556 (Accession XP_088979.6) is another GAM7957 target gene, herein designated TARGET GENE. LOC163556 BINDING SITE1 and LOC163556 BINDING SITE2 are target binding sites found in untranslated regions of mRNA encoded by LOC163556, corresponding to target binding sites such as BINDING SITE I, BINDING SITE II or BINDING SITE III of FIG. 8. Table 4 illustrates the complementarity of the nucleotide sequences of LOC163556 BINDING SITE1 and LOC163556 BINDING SITE2, designated SEQ ID:14783 and SEQ ID:11882 respectively, to the nucleotide sequence of GAM7957 RNA, herein designated GAM RNA, also designated SEQ ID:297.

Another function of GAM7957 is therefore inhibition of LOC163556 (Accession XP_088979.6). Accordingly, utilities of GAM7957 include diagnosis, prevention and treatment of diseases and clinical conditions associated with LOC163556.

LOC164580 (Accession XP_104562.1) is another GAM7957 target gene, herein designated TARGET GENE. LOC164580 BINDING SITE1 and LOC164580 BINDING SITE2 are target binding sites found in untranslated regions of mRNA encoded by LOC164580, corresponding to target binding sites such as BINDING SITE I, BINDING SITE II or BINDING SITE III of FIG. 8. Table 4 illustrates the complementarity of the nucleotide sequences of LOC164580 BINDING SITE1 and LOC164580 BINDING SITE2, designated SEQ ID:12796 and SEQ ID:15089 respectively, to the nucleotide sequence of GAM7957 RNA, herein designated GAM RNA, also designated SEQ ID:297.

Another function of GAM7957 is therefore inhibition of LOC164580 (Accession XP_104562.1). Accordingly, utilities of GAM7957 include diagnosis, prevention and treatment of diseases and clinical conditions associated with LOC164580.

LOC165324 (Accession XP_092518.1) is another GAM7957 target gene, herein designated TARGET GENE. LOC165324 BINDING SITE is a target binding site found in the 3' untranslated region of mRNA encoded by LOC165324, corresponding to a target binding site such as BINDING SITE I, BINDING SITE II or BINDING SITE III of FIG. 8. Table 4 illustrates the complementarity of the nucleotide sequences of LOC165324 BINDING SITE, designated SEQ ID:7877, to the nucleotide sequence of GAM7957 RNA, herein designated GAM RNA, also designated SEQ ID:297.

Another function of GAM7957 is therefore inhibition of LOC165324 (Accession XP_092518.1). Accordingly, utilities of GAM7957 include diagnosis, prevention and treatment of diseases and clinical conditions associated with LOC165324.

LOC166449 (Accession XP_093876.5) is another GAM7957 target gene, herein designated TARGET GENE. LOC166449 BINDING SITE is a target binding site found in the 3' untranslated region of mRNA encoded by LOC166449, corresponding to a target binding site such as BINDING SITE I, BINDING SITE II or BINDING SITE III of FIG. 8. Table 4 illustrates the complementarity of the nucleotide sequences of LOC166449 BINDING SITE, designated SEQ ID:14199, to the nucleotide sequence of GAM7957 RNA, herein designated GAM RNA, also designated SEQ ID:297.

Another function of GAM7957 is therefore inhibition of LOC166449 (Accession XP_093876.5). Accordingly, utilities of GAM7957 include diagnosis, prevention and treatment of diseases and clinical conditions associated with LOC166449.

LOC166522 (Accession XP_093920.5) is another GAM7957 target gene, herein designated TARGET GENE. LOC166522 BINDING SITE1 and LOC166522 BINDING SITE2 are target binding sites found in untranslated regions of mRNA encoded by LOC166522, corresponding to target binding sites such as BINDING SITE I, BINDING SITE II or BINDING SITE III of FIG. 8. Table 4 illustrates the complementarity of the nucleotide sequences of LOC166522 BINDING SITE1 and LOC166522 BINDING SITE2, designated SEQ ID:15343 and SEQ ID:4880 respectively, to the nucleotide sequence of GAM7957 RNA, herein designated GAM RNA, also designated SEQ ID:297.

Another function of GAM7957 is therefore inhibition of LOC166522 (Accession XP_093920.5). Accordingly, utilities of GAM7957 include diagnosis, prevention and treatment of diseases and clinical conditions associated with LOC166522.

LOC170393 (Accession NP_775812.1) is another GAM7957 target gene, herein designated TARGET GENE. LOC170393 BINDING SITE is a target binding site found in the 3' untranslated region of mRNA encoded by LOC170393, corresponding to a target binding site such as BINDING SITE I, BINDING SITE II or BINDING SITE III of FIG. 8. Table 4 illustrates the complementarity of the nucleotide sequences of LOC170393 BINDING SITE, designated SEQ ID:17945, to the nucleotide sequence of GAM7957 RNA, herein designated GAM RNA, also designated SEQ ID:297.

Another function of GAM7957 is therefore inhibition of LOC170393 (Accession NP_775812.1). Accordingly, utilities of GAM7957 include diagnosis, prevention and treatment of diseases and clinical conditions associated with LOC170393.

LOC170394 (Accession XP_096329.1) is another GAM7957 target gene, herein designated TARGET GENE. LOC170394 BINDING SITE is a target binding site found in the 5' untranslated region of mRNA encoded by LOC170394, corresponding to a target binding site such as BINDING SITE I, BINDING SITE II or BINDING SITE III of FIG. 8. Table 4 illustrates the complementarity of the nucleotide sequences of LOC170394 BINDING SITE, designated SEQ ID:4679, to the nucleotide sequence of GAM7957 RNA, herein designated GAM RNA, also designated SEQ ID:297.

Another function of GAM7957 is therefore inhibition of LOC170394 (Accession XP_096329.1). Accordingly, utilities of GAM7957 include diagnosis, prevention and treatment of diseases and clinical conditions associated with LOC170394.

LOC196214 (Accession XP_116897.1) is another GAM7957 target gene, herein designated TARGET GENE. LOC196214 BINDING SITE is a target binding site found in the 5' untranslated region of mRNA encoded by LOC196214, corresponding to a target binding site such as BINDING SITE I, BINDING SITE II or BINDING SITE III of FIG. 8. Table 4 illustrates the complementarity of the nucleotide sequences of LOC196214 BINDING SITE, designated SEQ ID:16370, to the nucleotide sequence of GAM7957 RNA, herein designated GAM RNA, also designated SEQ ID:297.

Another function of GAM7957 is therefore inhibition of LOC196214 (Accession XP_116897.1). Accordingly, utilities of GAM7957 include diagnosis, prevention and treatment of diseases and clinical conditions associated with LOC196214.

LOC196540 (Accession XP_116933.1) is another GAM7957 target gene, herein designated TARGET GENE. LOC196540 BINDING SITE is a target binding site found in the 3' untranslated region of mRNA encoded by LOC196540, corresponding to a target binding site such as BINDING SITE I, BINDING SITE II or BINDING SITE III of FIG. 8. Table 4 illustrates the complementarity of the nucleotide sequences of LOC196540 BINDING SITE, designated SEQ ID:18391, to the nucleotide sequence of GAM7957 RNA, herein designated GAM RNA, also designated SEQ ID:297.

Another function of GAM7957 is therefore inhibition of LOC196540 (Accession XP_116933.1). Accordingly, utilities of GAM7957 include diagnosis, prevention and treatment of diseases and clinical conditions associated with LOC196540.

LOC197201 (Accession XP_113839.2) is another GAM7957 target gene, herein designated TARGET GENE. LOC197201 BINDING SITE is a target binding site found in the 3' untranslated region of mRNA encoded by LOC197201, corresponding to a target binding site such as BINDING SITE I, BINDING SITE II or BINDING SITE III of FIG. 8. Table 4 illustrates the complementarity of the nucleotide sequences of LOC197201 BINDING SITE, designated SEQ ID:4083, to the nucleotide sequence of GAM7957 RNA, herein designated GAM RNA, also designated SEQ ID:297.

Another function of GAM7957 is therefore inhibition of LOC197201 (Accession XP_113839.2). Accordingly, utilities of GAM7957 include diagnosis, prevention and treatment of diseases and clinical conditions associated with LOC197201.

LOC197342 (Accession XP_113869.1) is another GAM7957 target gene, herein designated TARGET GENE. LOC197342 BINDING SITE is a target binding site found in the 3' untranslated region of mRNA encoded by LOC197342, corresponding to a target binding site such as BINDING SITE I, BINDING SITE II or BINDING SITE III of FIG. 8. Table 4 illustrates the complementarity of the nucleotide sequences of LOC197342 BINDING SITE, designated SEQ ID:18190, to the nucleotide sequence of GAM7957 RNA, herein designated GAM RNA, also designated SEQ ID:297.

Another function of GAM7957 is therefore inhibition of LOC197342 (Accession XP_113869.1). Accordingly, utilities of GAM7957 include diagnosis, prevention and treatment of diseases and clinical conditions associated with LOC197342.

LOC199676 (Accession XP_117107.2) is another GAM7957 target gene, herein designated TARGET GENE. LOC199676 BINDING SITE is a target binding site found in the 5' untranslated region of mRNA encoded by LOC199676, corresponding to a target binding site such as BINDING SITE I, BINDING SITE II or BINDING SITE III of FIG. 8. Table 4 illustrates the complementarity of the nucleotide sequences of LOC199676 BINDING SITE, designated SEQ ID:12792, to the nucleotide sequence of GAM7957 RNA, herein designated GAM RNA, also designated SEQ ID:297.

Another function of GAM7957 is therefore inhibition of LOC199676 (Accession XP_117107.2). Accordingly, utilities of GAM7957 include diagnosis, prevention and treatment of diseases and clinical conditions associated with LOC199676.

LOC199858 (Accession XP_114040.1) is another GAM7957 target gene, herein designated TARGET GENE. LOC199858 BINDING SITE is a target binding site found in the 3' untranslated region of mRNA encoded by LOC199858, corresponding to a target binding site such as BINDING SITE I, BINDING SITE II or BINDING SITE III of FIG. 8. Table 4 illustrates the complementarity of the nucleotide sequences of LOC199858 BINDING SITE, designated SEQ ID:15343, to the nucleotide sequence of GAM7957 RNA, herein designated GAM RNA, also designated SEQ ID:297.

Another function of GAM7957 is therefore inhibition of LOC199858 (Accession XP_114040.1). Accordingly, utilities of GAM7957 include diagnosis, prevention and treatment of diseases and clinical conditions associated with LOC199858.

LOC200298 (Accession XP_117217.2) is another GAM7957 target gene, herein designated TARGET GENE. LOC200298 BINDING SITE is a target binding site found in the 3' untranslated region of mRNA encoded by LOC200298, corresponding to a target binding site such as BINDING SITE I, BINDING SITE II or BINDING SITE III of FIG. 8. Table 4 illustrates the complementarity of the nucleotide sequences of LOC200298 BINDING SITE, designated SEQ ID:14572, to the nucleotide sequence of GAM7957 RNA, herein designated GAM RNA, also designated SEQ ID:297.

Another function of GAM7957 is therefore inhibition of LOC200298 (Accession XP_117217.2). Accordingly, utilities of GAM7957 include diagnosis, prevention and treatment of diseases and clinical conditions associated with LOC200298.

LOC200731 (Accession XP_117268.1) is another GAM7957 target gene, herein designated TARGET GENE. LOC200731 BINDING SITE is a target binding site found in the 3' untranslated region of mRNA encoded by LOC200731, corresponding to a target binding site such as BINDING SITE I, BINDING SITE II or BINDING SITE III of FIG. 8. Table 4 illustrates the complementarity of the nucleotide sequences of LOC200731 BINDING SITE, designated SEQ ID:3813, to the nucleotide sequence of GAM7957 RNA, herein designated GAM RNA, also designated SEQ ID:297.

Another function of GAM7957 is therefore inhibition of LOC200731 (Accession XP_117268.1). Accordingly, utilities of GAM7957 include diagnosis, prevention and treatment of diseases and clinical conditions associated with LOC200731.

LOC201705 (Accession XP_117329.2) is another GAM7957 target gene, herein designated TARGET GENE. LOC201705 BINDING SITE is a target binding site found in the 3' untranslated region of mRNA encoded by LOC201705, corresponding to a target binding site such as BINDING SITE I, BINDING SITE II or BINDING SITE III of FIG. 8. Table 4 illustrates the complementarity of the nucleotide sequences of LOC201705 BINDING SITE, designated SEQ ID:9125, to the nucleotide sequence of GAM7957 RNA, herein designated GAM RNA, also designated SEQ ID:297.

Another function of GAM7957 is therefore inhibition of LOC201705 (Accession XP_117329.2). Accordingly, utilities of GAM7957 include diagnosis, prevention and treatment of diseases and clinical conditions associated with LOC201705.

LOC201868 (Accession XP_114393.1) is another GAM7957 target gene, herein designated TARGET GENE. LOC201868 BINDING SITE1 and LOC201868 BINDING SITE2 are target binding sites found in untranslated regions of mRNA encoded by LOC201868, corresponding to target binding sites such as BINDING SITE I, BINDING SITE II or BINDING SITE III of FIG. 8. Table 4 illustrates the complementarity of the nucleotide sequences of LOC201868 BINDING SITE1 and LOC201868 BINDING SITE2, designated SEQ ID:19499 and SEQ ID:17081 respectively, to the nucleotide sequence of GAM7957 RNA, herein designated GAM RNA, also designated SEQ ID:297.

Another function of GAM7957 is therefore inhibition of LOC201868 (Accession XP_114393.1). Accordingly, utilities of GAM7957 include diagnosis, prevention and treatment of diseases and clinical conditions associated with LOC201868.

LOC201895 (Accession NP_777581.1) is another GAM7957 target gene, herein designated TARGET GENE. LOC201895 BINDING SITE is a target binding site found in the 3' untranslated region of mRNA encoded by LOC201895, corresponding to a target binding site such as BINDING SITE I, BINDING SITE II or BINDING SITE III of FIG. 8. Table 4 illustrates the complementarity of the nucleotide sequences of LOC201895 BINDING SITE, designated SEQ ID:2773, to the nucleotide sequence of GAM7957 RNA, herein designated GAM RNA, also designated SEQ ID:297.

Another function of GAM7957 is therefore inhibition of LOC201895 (Accession NP_777581.1). Accordingly, utilities of GAM7957 include diagnosis, prevention and treatment of diseases and clinical conditions associated with LOC201895.

LOC201911 (Accession XP_117339.1) is another GAM7957 target gene, herein designated TARGET GENE. LOC201911 BINDING SITE is a target binding site found in the 3' untranslated region of mRNA encoded by LOC201911, corresponding to a target binding site such as BINDING SITE I, BINDING SITE II or BINDING SITE III of FIG. 8. Table 4 illustrates the complementarity of the nucleotide sequences of LOC201911 BINDING SITE, designated SEQ ID:2545, to the nucleotide sequence of GAM7957 RNA, herein designated GAM RNA, also designated SEQ ID:297.

Another function of GAM7957 is therefore inhibition of LOC201911 (Accession XP_117339.1). Accordingly, utilities of GAM7957 include diagnosis, prevention and treatment of diseases and clinical conditions associated with LOC201911.

LOC202134 (Accession XP_117365.1) is another GAM7957 target gene, herein designated TARGET GENE. LOC202134 BINDING SITE is a target binding site found in the 5' untranslated region of mRNA encoded by LOC202134, corresponding to a target binding site such as BINDING SITE I, BINDING SITE II or BINDING SITE III of FIG. 8. Table 4 illustrates the complementarity of the nucleotide sequences of LOC202134 BINDING SITE, designated SEQ ID:15085, to the nucleotide sequence of GAM7957 RNA, herein designated GAM RNA, also designated SEQ ID:297.

Another function of GAM7957 is therefore inhibition of LOC202134 (Accession XP_117365.1). Accordingly, utilities of GAM7957 include diagnosis, prevention and treatment of diseases and clinical conditions associated with LOC202134.

LOC202460 (Accession XP_114493.1) is another GAM7957 target gene, herein designated TARGET GENE. LOC202460 BINDING SITE is a target binding site found in the 3' untranslated region of mRNA encoded by LOC202460, corresponding to a target binding site such as BINDING SITE I, BINDING SITE II or BINDING SITE III of FIG. 8. Table 4 illustrates the complementarity of the nucleotide sequences of LOC202460 BINDING SITE, designated SEQ ID:5365, to the nucleotide sequence of GAM7957 RNA, herein designated GAM RNA, also designated SEQ ID:297.

Another function of GAM7957 is therefore inhibition of LOC202460 (Accession XP_114493.1). Accordingly, utilities of GAM7957 include diagnosis, prevention and treatment of diseases and clinical conditions associated with LOC202460.

LOC202781 (Accession XP_117455.1) is another GAM7957 target gene, herein designated TARGET GENE. LOC202781 BINDING SITE is a target binding site found in the 3' untranslated region of mRNA encoded by LOC202781, corresponding to a target binding site such as BINDING SITE I, BINDING SITE II or BINDING SITE III of FIG. 8. Table 4 illustrates the complementarity of the nucleotide sequences of LOC202781 BINDING SITE, designated SEQ ID:17055, to the nucleotide sequence of GAM7957 RNA, herein designated GAM RNA, also designated SEQ ID:297.

Another function of GAM7957 is therefore inhibition of LOC202781 (Accession XP_117455.1). Accordingly, utilities of GAM7957 include diagnosis, prevention and treatment of diseases and clinical conditions associated with LOC202781.

LOC202868 (Accession XP_117477.1) is another GAM7957 target gene, herein designated TARGET GENE. LOC202868 BINDING SITE1 through LOC202868 BINDING SITE3 are target binding sites found in untranslated regions of mRNA encoded by LOC202868, corresponding to target binding sites such as BINDING SITE I, BINDING SITE II or BINDING SITE III of FIG. 8. Table 4 illustrates the complementarity of the nucleotide sequences of LOC202868 BINDING SITE1 through LOC202868 BINDING SITE3, designated SEQ ID:614, SEQ ID:15108 and SEQ ID:2487 respectively, to the nucleotide sequence of GAM7957 RNA, herein designated GAM RNA, also designated SEQ ID:297.

Another function of GAM7957 is therefore inhibition of LOC202868 (Accession XP_117477.1). Accordingly, utilities of GAM7957 include diagnosis, prevention and treatment of diseases and clinical conditions associated with LOC202868.

LOC202934 (Accession XP_117486.2) is another GAM7957 target gene, herein designated TARGET GENE. LOC202934 BINDING SITE1 and LOC202934 BINDING SITE2 are target binding sites found in untranslated regions of mRNA encoded by LOC202934, corresponding to target binding sites such as BINDING SITE I, BINDING SITE II or BINDING SITE III of FIG. 8. Table 4 illustrates the complementarity of the nucleotide sequences of LOC202934 BINDING SITE1 and LOC202934 BINDING SITE2, designated SEQ ID:13454 and SEQ ID:2071 respectively, to the nucleotide sequence of GAM7957 RNA, herein designated GAM RNA, also designated SEQ ID:297.

Another function of GAM7957 is therefore inhibition of LOC202934 (Accession XP_117486.2). Accordingly, utilities of GAM7957 include diagnosis, prevention and treatment of diseases and clinical conditions associated with LOC202934.

LOC203245 (Accession XP_114657.1) is another GAM7957 target gene, herein designated TARGET GENE. LOC203245 BINDING SITE1 and LOC203245 BINDING SITE2 are target binding sites found in untranslated regions of mRNA encoded by LOC203245, corresponding to target binding sites such as BINDING SITE I, BINDING SITE II or BINDING SITE III of FIG. 8. Table 4 illustrates the complementarity of the nucleotide sequences of LOC203245 BINDING SITE1 and LOC203245 BINDING SITE2, designated SEQ ID:3440 and SEQ ID:2549 respectively, to the nucleotide sequence of GAM7957 RNA, herein designated GAM RNA, also designated SEQ ID:297.

Another function of GAM7957 is therefore inhibition of LOC203245 (Accession XP_114657.1). Accordingly, utilities of GAM7957 include diagnosis, prevention and treatment of diseases and clinical conditions associated with LOC203245.

LOC204288 (Accession XP_115295.1) is another GAM7957 target gene, herein designated TARGET GENE. LOC204288 BINDING SITE is a target binding site found in the 3' untranslated region of mRNA encoded by LOC204288, corresponding to a target binding site such as BINDING SITE I, BINDING SITE II or BINDING SITE III of FIG. 8. Table 4 illustrates the complementarity of the nucleotide sequences of LOC204288 BINDING SITE, designated SEQ ID:11765, to the nucleotide sequence of GAM7957 RNA, herein designated GAM RNA, also designated SEQ ID:297.

Another function of GAM7957 is therefore inhibition of LOC204288 (Accession XP_115295.1). Accordingly, utilities of GAM7957 include diagnosis, prevention and treatment of diseases and clinical conditions associated with LOC204288.

LOC205272 (Accession XP_115760.2) is another GAM7957 target gene, herein designated TARGET GENE. LOC205272 BINDING SITE is a target binding site found in the 5' untranslated region of mRNA encoded by LOC205272, corresponding to a target binding site such as BINDING SITE I, BINDING SITE II or BINDING SITE III of FIG. 8. Table 4 illustrates the complementarity of the nucleotide sequences of LOC205272 BINDING SITE, designated SEQ ID:12156, to the nucleotide sequence of GAM7957 RNA, herein designated GAM RNA, also designated SEQ ID:297.

Another function of GAM7957 is therefore inhibition of LOC205272 (Accession XP_115760.2). Accordingly, utilities of GAM7957 include diagnosis, prevention and treatment of diseases and clinical conditions associated with LOC205272.

LOC206412 (Accession XP_116497.2) is another GAM7957 target gene, herein designated TARGET GENE. LOC206412 BINDING SITE1 and LOC206412 BINDING SITE2 are target binding sites found in untranslated regions of mRNA encoded by LOC206412, corresponding to target binding sites such as BINDING SITE I, BINDING SITE II or BINDING SITE III of FIG. 8. Table 4 illustrates the complementarity of the nucleotide sequences of LOC206412 BINDING SITE1 and LOC206412 BINDING SITE2, designated SEQ ID:1492 and SEQ ID:4032 respectively, to the nucleotide sequence of GAM7957 RNA, herein designated GAM RNA, also designated SEQ ID:297.

Another function of GAM7957 is therefore inhibition of LOC206412 (Accession XP_116497.2). Accordingly, utilities of GAM7957 include diagnosis, prevention and treatment of diseases and clinical conditions associated with LOC206412.

LOC219293 (Accession XP_166599.2) is another GAM7957 target gene, herein designated TARGET GENE. LOC219293 BINDING SITE1 through LOC219293 BINDING SITE4 are target binding sites found in untranslated regions of mRNA encoded by LOC219293, corresponding to target binding sites such as BINDING SITE I, BINDING SITE II or BINDING SITE III of FIG. 8. Table 4 illustrates the complementarity of the nucleotide sequences of LOC219293 BINDING SITE1 through LOC219293 BINDING SITE4, designated SEQ ID:17505, SEQ ID:13988, SEQ ID:9335 and SEQ ID:3056 respectively, to the nucleotide sequence of GAM7957 RNA, herein designated GAM RNA, also designated SEQ ID:297.

Another function of GAM7957 is therefore inhibition of LOC219293 (Accession XP_166599.2). Accordingly, utilities of GAM7957 include diagnosis, prevention and treatment of diseases and clinical conditions associated with LOC219293.

LOC219347 (Accession XP_167564.2) is another GAM7957 target gene, herein designated TARGET GENE. LOC219347 BINDING SITE is a target binding site found in the 3' untranslated region of mRNA encoded by LOC219347, corresponding to a target binding site such as BINDING SITE I, BINDING SITE II or BINDING SITE III of FIG. 8. Table 4 illustrates the complementarity of the nucleotide sequences of LOC219347 BINDING SITE, designated SEQ ID:614, to the nucleotide sequence of GAM7957 RNA, herein designated GAM RNA, also designated SEQ ID:297.

Another function of GAM7957 is therefore inhibition of LOC219347 (Accession XP_167564.2). Accordingly, utilities of GAM7957 include diagnosis, prevention and treatment of diseases and clinical conditions associated with LOC219347.

LOC219649 (Accession XP_167562.1) is another GAM7957 target gene, herein designated TARGET GENE. LOC219649 BINDING SITE1 through LOC219649 BINDING SITE3 are target binding sites found in untranslated regions of mRNA encoded by LOC219649, corresponding to target binding sites such as BINDING SITE I, BINDING SITE II or BINDING SITE III of FIG. 8. Table 4 illustrates the complementarity of the nucleotide sequences of LOC219649 BINDING SITE1 through LOC219649 BINDING SITE3, designated SEQ ID:4880, SEQ ID:19057 and SEQ ID:6149 respectively, to the nucleotide sequence of GAM7957 RNA, herein designated GAM RNA, also designated SEQ ID:297.

Another function of GAM7957 is therefore inhibition of LOC219649 (Accession XP_167562.1). Accordingly, utilities of GAM7957 include diagnosis, prevention and treatment of diseases and clinical conditions associated with LOC219649.

LOC219690 (Accession XP_167572.1) is another GAM7957 target gene, herein designated TARGET GENE. LOC219690 BINDING SITE is a target binding site found in the 3' untranslated region of mRNA encoded by LOC219690, corresponding to a target binding site such as BINDING SITE I, BINDING SITE II or BINDING SITE III of FIG. 8. Table 4 illustrates the complementarity of the nucleotide sequences of LOC219690 BINDING SITE, designated SEQ ID:5800, to the nucleotide sequence of GAM7957 RNA, herein designated GAM RNA, also designated SEQ ID:297.

Another function of GAM7957 is therefore inhibition of LOC219690 (Accession XP_167572.1). Accordingly, utilities of GAM7957 include diagnosis, prevention and treatment of diseases and clinical conditions associated with LOC219690.

LOC219722 (Accession XP_167593.1) is another GAM7957 target gene, herein designated TARGET GENE. LOC219722 BINDING SITE is a target binding site found in the 5' untranslated region of mRNA encoded by LOC219722, corresponding to a target binding site such as BINDING SITE I, BINDING SITE II or BINDING SITE III of FIG. 8. Table 4 illustrates the complementarity of the nucleotide sequences of LOC219722 BINDING SITE, designated SEQ ID:4908, to the nucleotide sequence of GAM7957 RNA, herein designated GAM RNA, also designated SEQ ID:297.

Another function of GAM7957 is therefore inhibition of LOC219722 (Accession XP_167593.1). Accordingly, utilities of GAM7957 include diagnosis, prevention and treatment of diseases and clinical conditions associated with LOC219722.

LOC219908 (Accession XP_169057.2) is another GAM7957 target gene, herein designated TARGET GENE. LOC219908 BINDING SITE is a target binding site found in the 3' untranslated region of mRNA encoded by LOC219908, corresponding to a target binding site such as BINDING SITE I, BINDING SITE II or BINDING SITE III of FIG. 8. Table 4 illustrates the complementarity of the nucleotide sequences of LOC219908 BINDING SITE, designated SEQ ID:15762, to the nucleotide sequence of GAM7957 RNA, herein designated GAM RNA, also designated SEQ ID:297.

Another function of GAM7957 is therefore inhibition of LOC219908 (Accession XP_169057.2). Accordingly, utilities of GAM7957 include diagnosis, prevention and treatment of diseases and clinical conditions associated with LOC219908.

LOC219919 (Accession XP_167785.1) is another GAM7957 target gene, herein designated TARGET GENE. LOC219919 BINDING SITE1 and LOC219919 BINDING SITE2 are target binding sites found in untranslated regions of mRNA encoded by LOC219919, corresponding to target binding sites such as BINDING SITE I, BINDING SITE II or BINDING SITE III of FIG. 8. Table 4 illustrates the complementarity of the nucleotide sequences of LOC219919 BINDING SITE1 and LOC219919 BINDING SITE2, designated SEQ ID:19952 and SEQ ID:1492 respectively, to the nucleotide sequence of GAM7957 RNA, herein designated GAM RNA, also designated SEQ ID:297.

Another function of GAM7957 is therefore inhibition of LOC219919 (Accession XP_167785.1). Accordingly, utilities of GAM7957 include diagnosis, prevention and treatment of diseases and clinical conditions associated with LOC219919.

LOC220070 (Accession NP_660351.1) is another GAM7957 target gene, herein designated TARGET GENE. LOC220070 BINDING SITE is a target binding site found in the 3' untranslated region of mRNA encoded by LOC220070, corresponding to a target binding site such as BINDING SITE I, BINDING SITE II or BINDING SITE III of FIG. 8. Table 4 illustrates the complementarity of the nucleotide sequences of LOC220070 BINDING SITE, designated SEQ ID:645, to the nucleotide sequence of GAM7957 RNA, herein designated GAM RNA, also designated SEQ ID:297.

Another function of GAM7957 is therefore inhibition of LOC220070 (Accession NP_660351.1). Accordingly, utilities of GAM7957 include diagnosis, prevention and treatment of diseases and clinical conditions associated with LOC220070.

LOC220906 (Accession XP_166133.1) is another GAM7957 target gene, herein designated TARGET GENE. LOC220906 BINDING SITE1 and LOC220906 BINDING SITE2 are target binding sites found in untranslated regions of mRNA encoded by LOC220906, corresponding to target binding sites such as BINDING SITE I, BINDING SITE II or BINDING SITE III of FIG. 8. Table 4 illustrates the complementarity of the nucleotide sequences of LOC220906 BINDING SITE1 and LOC220906 BINDING SITE2, designated SEQ ID:12432 and SEQ ID:5882 respectively, to the nucleotide sequence of GAM7957 RNA, herein designated GAM RNA, also designated SEQ ID:297.

Another function of GAM7957 is therefore inhibition of LOC220906 (Accession XP_166133.1). Accordingly, utilities of GAM7957 include diagnosis, prevention and treatment of diseases and clinical conditions associated with LOC220906.

LOC221042 (Accession XP_167669.2) is another GAM7957 target gene, herein designated TARGET GENE. LOC221042 BINDING SITE1 and LOC221042 BINDING SITE2 are target binding sites found in untranslated regions of mRNA encoded by LOC221042, corresponding to target binding sites such as BINDING SITE I, BINDING SITE II or BINDING SITE III of FIG. 8. Table 4 illustrates the complementarity of the nucleotide sequences of LOC221042 BINDING SITE1 and LOC221042 BINDING SITE2, designated SEQ ID:5830 and SEQ ID:10438 respectively, to the nucleotide sequence of GAM7957 RNA, herein designated GAM RNA, also designated SEQ ID:297.

Another function of GAM7957 is therefore inhibition of LOC221042 (Accession XP_167669.2). Accordingly, utilities of GAM7957 include diagnosis, prevention and treatment of diseases and clinical conditions associated with LOC221042.

LOC221091 (Accession XP_169026.1) is another GAM7957 target gene, herein designated TARGET GENE. LOC221091 BINDING SITE is a target binding site found in the 3' untranslated region of mRNA encoded by LOC221091, corresponding to a target binding site such as BINDING SITE I, BINDING SITE II or BINDING SITE III of FIG. 8. Table 4 illustrates the complementarity of the nucleotide sequences of LOC221091 BINDING SITE, designated SEQ ID:11627, to the nucleotide sequence of GAM7957 RNA, herein designated GAM RNA, also designated SEQ ID:297.

Another function of GAM7957 is therefore inhibition of LOC221091 (Accession XP_169026.1). Accordingly, utilities of GAM7957 include diagnosis, prevention and treatment of diseases and clinical conditions associated with LOC221091.

LOC221288 (Accession XP_168058.1) is another GAM7957 target gene, herein designated TARGET GENE. LOC221288 BINDING SITE1 and LOC221288 BINDING SITE2 are target binding sites found in untranslated regions of mRNA encoded by LOC221288, corresponding to target binding sites such as BINDING SITE I, BINDING SITE II or BINDING SITE III of FIG. 8. Table 4 illustrates the complementarity of the nucleotide sequences of LOC221288 BINDING SITE1 and LOC221288 BINDING SITE2, designated SEQ ID:17328 and SEQ ID:11276 respectively, to the nucleotide sequence of GAM7957 RNA, herein designated GAM RNA, also designated SEQ ID:297.

Another function of GAM7957 is therefore inhibition of LOC221288 (Accession XP_168058.1). Accordingly, utilities of GAM7957 include diagnosis, prevention and treatment of diseases and clinical conditions associated with LOC221288.

LOC221543 (Accession XP_168091.1) is another GAM7957 target gene, herein designated TARGET GENE. LOC221543 BINDING SITE1 and LOC221543 BINDING SITE2 are target binding sites found in untranslated regions of mRNA encoded by LOC221543, corresponding to target binding sites such as BINDING SITE I, BINDING SITE II or BINDING SITE III of FIG. 8. Table 4 illustrates the complementarity of the nucleotide sequences of LOC221543 BINDING SITE1 and LOC221543 BINDING SITE2, designated SEQ ID:5859 and SEQ ID:17535 respectively, to the nucleotide sequence of GAM7957 RNA, herein designated GAM RNA, also designated SEQ ID:297.

Another function of GAM7957 is therefore inhibition of LOC221543 (Accession XP_168091.1). Accordingly, utilities of GAM7957 include diagnosis, prevention and treatment of diseases and clinical conditions associated with LOC221543.

LOC221550 (Accession XP_166388.1) is another GAM7957 target gene, herein designated TARGET GENE. LOC221550 BINDING SITE is a target binding site found in the 3' untranslated region of mRNA encoded by LOC221550, corresponding to a target binding site such as BINDING SITE I, BINDING SITE II or BINDING SITE III of FIG. 8. Table 4 illustrates the complementarity of the nucleotide sequences of LOC221550 BINDING SITE, designated SEQ ID:16121, to the nucleotide sequence of GAM7957 RNA, herein designated GAM RNA, also designated SEQ ID:297.

Another function of GAM7957 is therefore inhibition of LOC221550 (Accession XP_166388.1). Accordingly, utilities of GAM7957 include diagnosis, prevention and treatment of diseases and clinical conditions associated with LOC221550.

LOC221889 (Accession XP_166513.1) is another GAM7957 target gene, herein designated TARGET GENE. LOC221889 BINDING SITE is a target binding site found in the 3' untranslated region of mRNA encoded by LOC221889, corresponding to a target binding site such as BINDING SITE I, BINDING SITE II or BINDING SITE III of FIG. 8. Table 4 illustrates the complementarity of the nucleotide sequences of LOC221889 BINDING SITE, designated SEQ ID:8562, to the nucleotide sequence of GAM7957 RNA, herein designated GAM RNA, also designated SEQ ID:297.

Another function of GAM7957 is therefore inhibition of LOC221889 (Accession XP_166513.1). Accordingly, utilities of GAM7957 include diagnosis, prevention and treatment of diseases and clinical conditions associated with LOC221889.

LOC221943 (Accession XP_168343.1) is another GAM7957 target gene, herein designated TARGET GENE. LOC221943 BINDING SITE1 and LOC221943 BINDING SITE2 are target binding sites found in untranslated regions of mRNA encoded by LOC221943, corresponding to target binding sites such as BINDING SITE I, BINDING SITE II or BINDING SITE III of FIG. 8. Table 4 illustrates the complementarity of the nucleotide sequences of LOC221943 BINDING SITE1 and LOC221943 BINDING SITE2, designated SEQ ID:3974 and SEQ ID:4428 respectively, to the nucleotide sequence of GAM7957 RNA, herein designated GAM RNA, also designated SEQ ID:297.

Another function of GAM7957 is therefore inhibition of LOC221943 (Accession XP_168343.1). Accordingly, utilities of GAM7957 include diagnosis, prevention and treatment of diseases and clinical conditions associated with LOC221943.

LOC221954 (Accession XP_168349.1) is another GAM7957 target gene, herein designated TARGET GENE. LOC221954 BINDING SITE1 and LOC221954 BINDING SITE2 are target binding sites found in untranslated regions of mRNA encoded by LOC221954, corresponding to target binding sites such as BINDING SITE I, BINDING SITE II or BINDING SITE III of FIG. 8. Table 4 illustrates the complementarity of the nucleotide sequences of LOC221954 BINDING SITE1 and LOC221954 BINDING SITE2, designated SEQ ID:5782 and SEQ ID:19058 respectively, to the nucleotide sequence of GAM7957 RNA, herein designated GAM RNA, also designated SEQ ID:297.

Another function of GAM7957 is therefore inhibition of LOC221954 (Accession XP_168349.1). Accordingly, utilities of GAM7957 include diagnosis, prevention and treatment of diseases and clinical conditions associated with LOC221954.

LOC221962 (Accession XP_166554.1) is another GAM7957 target gene, herein designated TARGET GENE. LOC221962 BINDING SITE1 and LOC221962 BINDING SITE2 are target binding sites found in untranslated regions of mRNA encoded by LOC221962, corresponding to target binding sites such as BINDING SITE I, BINDING SITE II or BINDING SITE III of FIG. 8. Table 4 illustrates the complementarity of the nucleotide sequences of LOC221962 BINDING SITE1 and LOC221962 BINDING SITE2, designated SEQ ID:14360 and SEQ ID:15781 respectively, to the nucleotide sequence of GAM7957 RNA, herein designated GAM RNA, also designated SEQ ID:297.

Another function of GAM7957 is therefore inhibition of LOC221962 (Accession XP_166554.1). Accordingly, utilities of GAM7957 include diagnosis, prevention and treatment of diseases and clinical conditions associated with LOC221962.

LOC222031 (Accession XP_168371.1) is another GAM7957 target gene, herein designated TARGET GENE. LOC222031 BINDING SITE is a target binding site found in the 3' untranslated region of mRNA encoded by LOC222031, corresponding to a target binding site such as BINDING SITE I, BINDING SITE II or BINDING SITE III of FIG. 8. Table 4 illustrates the complementarity of the nucleotide sequences of LOC222031 BINDING SITE, designated SEQ ID:10696, to the nucleotide sequence of GAM7957 RNA, herein designated GAM RNA, also designated SEQ ID:297.

Another function of GAM7957 is therefore inhibition of LOC222031 (Accession XP_168371.1). Accordingly, utilities of GAM7957 include diagnosis, prevention and treatment of diseases and clinical conditions associated with LOC222031.

LOC222060 (Accession XP_168427.1) is another GAM7957 target gene, herein designated TARGET GENE. LOC222060 BINDING SITE is a target binding site found in the 5' untranslated region of mRNA encoded by LOC222060, corresponding to a target binding site such as BINDING SITE I, BINDING SITE II or BINDING SITE III of FIG. 8. Table 4 illustrates the complementarity of the nucleotide sequences of LOC222060 BINDING SITE, designated SEQ ID:18690, to the nucleotide sequence of GAM7957 RNA, herein designated GAM RNA, also designated SEQ ID:297.

Another function of GAM7957 is therefore inhibition of LOC222060 (Accession XP_168427.1). Accordingly, utilities of GAM7957 include diagnosis, prevention and treatment of diseases and clinical conditions associated with LOC222060.

LOC222160 (Accession XP_168431.1) is another GAM7957 target gene, herein designated TARGET GENE. LOC222160 BINDING SITE1 through LOC222160 BINDING SITE4 are target binding sites found in untranslated regions of mRNA encoded by LOC222160, corresponding to target binding sites such as BINDING SITE I, BINDING SITE II or BINDING SITE III of FIG. 8. Table 4 illustrates the complementarity of the nucleotide sequences of LOC222160 BINDING SITE1 through LOC222160 BINDING SITE4, designated SEQ ID:9832, SEQ ID:10916, SEQ ID:2116 and SEQ ID:15984 respectively, to the nucleotide sequence of GAM7957 RNA, herein designated GAM RNA, also designated SEQ ID:297.

Another function of GAM7957 is therefore inhibition of LOC222160 (Accession XP_168431.1). Accordingly, utilities of GAM7957 include diagnosis, prevention and treatment of diseases and clinical conditions associated with LOC222160.

LOC222225 (Accession XP_168633.1) is another GAM7957 target gene, herein designated TARGET GENE. LOC222225 BINDING SITE is a target binding site found in the 3' untranslated region of mRNA encoded by LOC222225, corresponding to a target binding site such as BINDING SITE I, BINDING SITE II or BINDING SITE III of FIG. 8. Table 4 illustrates the complementarity of the nucleotide sequences of LOC222225 BINDING SITE, designated SEQ ID:18049, to the nucleotide sequence of GAM7957 RNA, herein designated GAM RNA, also designated SEQ ID:297.

Another function of GAM7957 is therefore inhibition of LOC222225 (Accession XP_168633.1). Accordingly, utilities of GAM7957 include diagnosis, prevention and treatment of diseases and clinical conditions associated with LOC222225.

LOC222662 (Accession XP_167086.2) is another GAM7957 target gene, herein designated TARGET GENE. LOC222662 BINDING SITE is a target binding site found in the 3' untranslated region of mRNA encoded by LOC222662, corresponding to a target binding site such as BINDING SITE I, BINDING SITE II or BINDING SITE III of FIG. 8. Table 4 illustrates the complementarity of the nucleotide sequences of LOC222662 BINDING SITE, designated SEQ ID:10395, to the nucleotide sequence of GAM7957 RNA, herein designated GAM RNA, also designated SEQ ID:297.

Another function of GAM7957 is therefore inhibition of LOC222662 (Accession XP_167086.2). Accordingly, utilities of GAM7957 include diagnosis, prevention and treatment of diseases and clinical conditions associated with LOC222662.

LOC222674 (Accession XP_167095.3) is another GAM7957 target gene, herein designated TARGET GENE. LOC222674 BINDING SITE is a target binding site found in the 3' untranslated region of mRNA encoded by LOC222674, corresponding to a target binding site such as BINDING SITE I, BINDING SITE II or BINDING SITE III of FIG. 8. Table 4 illustrates the complementarity of the nucleotide sequences of LOC222674 BINDING SITE, designated SEQ ID:10435, to the nucleotide sequence of GAM7957 RNA, herein designated GAM RNA, also designated SEQ ID:297.

Another function of GAM7957 is therefore inhibition of LOC222674 (Accession XP_167095.3). Accordingly, utilities of GAM7957 include diagnosis, prevention and treatment of diseases and clinical conditions associated with LOC222674.

LOC253216 (Accession XP_170765.2) is another GAM7957 target gene, herein designated TARGET GENE. LOC253216 BINDING SITE is a target binding site found in the 5' untranslated region of mRNA encoded by LOC253216, corresponding to a target binding site such as BINDING SITE I, BINDING SITE II or BINDING SITE III of FIG. 8. Table 4 illustrates the complementarity of the nucleotide sequences of LOC253216 BINDING SITE, designated SEQ ID:6471, to the nucleotide sequence of GAM7957 RNA, herein designated GAM RNA, also designated SEQ ID:297.

Another function of GAM7957 is therefore inhibition of LOC253216 (Accession XP_170765.2). Accordingly, utilities of GAM7957 include diagnosis, prevention and treatment of diseases and clinical conditions associated with LOC253216.

LOC253612 (Accession XP_172985.2) is another GAM7957 target gene, herein designated TARGET GENE. LOC253612 BINDING SITE1 and LOC253612 BINDING SITE2 are target binding sites found in untranslated regions of mRNA encoded by LOC253612, corresponding to target binding sites such as BINDING SITE I, BINDING SITE II or BINDING SITE III of FIG. 8. Table 4 illustrates the complementarity of the nucleotide sequences of LOC253612 BINDING SITE1 and LOC253612 BINDING SITE2, designated SEQ ID:10438 and SEQ ID:5924 respectively, to the nucleotide sequence of GAM7957 RNA, herein designated GAM RNA, also designated SEQ ID:297.

Another function of GAM7957 is therefore inhibition of LOC253612 (Accession XP_172985.2). Accordingly, utilities of GAM7957 include diagnosis, prevention and treatment of diseases and clinical conditions associated with LOC253612.

LOC254100 (Accession XP_172851.1) is another GAM7957 target gene, herein designated TARGET GENE. LOC254100 BINDING SITE is a target binding site found in the 3' untranslated region of mRNA encoded by LOC254100, corresponding to a target binding site such as BINDING SITE I, BINDING SITE II or BINDING SITE III of FIG. 8. Table 4 illustrates the complementarity of the nucleotide sequences of LOC254100 BINDING SITE, designated SEQ ID:14304, to the nucleotide sequence of GAM7957 RNA, herein designated GAM RNA, also designated SEQ ID:297.

Another function of GAM7957 is therefore inhibition of LOC254100 (Accession XP_172851.1). Accordingly, utilities of GAM7957 include diagnosis, prevention and treatment of diseases and clinical conditions associated with LOC254100.

LOC254266 (Accession XP_173221.1) is another GAM7957 target gene, herein designated TARGET GENE. LOC254266 BINDING SITE is a target binding site found in the 3' untranslated region of mRNA encoded by LOC254266, corresponding to a target binding site such as BINDING SITE I, BINDING SITE II or BINDING SITE III of FIG. 8. Table 4 illustrates the complementarity of the nucleotide sequences of LOC254266 BINDING SITE, designated SEQ ID:9572, to the nucleotide sequence of GAM7957 RNA, herein designated GAM RNA, also designated SEQ ID:297.

Another function of GAM7957 is therefore inhibition of LOC254266 (Accession XP_173221.1). Accordingly, utilities of GAM7957 include diagnosis, prevention and treatment of diseases and clinical conditions associated with LOC254266.

LOC254808 (Accession XP_173100.1) is another GAM7957 target gene, herein designated TARGET GENE. LOC254808 BINDING SITE is a target binding site found in the 3' untranslated region of mRNA encoded by LOC254808, corresponding to a target binding site such as BINDING SITE I, BINDING SITE II or BINDING SITE III of FIG. 8. Table 4 illustrates the complementarity of the nucleotide sequences of LOC254808 BINDING SITE, designated SEQ ID:15343, to the nucleotide sequence of GAM7957 RNA, herein designated GAM RNA, also designated SEQ ID:297.

Another function of GAM7957 is therefore inhibition of LOC254808 (Accession XP_173100.1). Accordingly, utilities of GAM7957 include diagnosis, prevention and treatment of diseases and clinical conditions associated with LOC254808.

LOC254875 (Accession XP_171170.1) is another GAM7957 target gene, herein designated TARGET GENE. LOC254875 BINDING SITE1 and LOC254875 BINDING SITE2 are target binding sites found in untranslated regions of mRNA encoded by LOC254875, corresponding to target binding sites such as BINDING SITE I, BINDING SITE II or BINDING SITE III of FIG. 8. Table 4 illustrates the complementarity of the nucleotide sequences of LOC254875 BINDING SITE1 and LOC254875 BINDING SITE2, designated SEQ ID:2306 and SEQ ID:7908 respectively, to the nucleotide sequence of GAM7957 RNA, herein designated GAM RNA, also designated SEQ ID:297.

Another function of GAM7957 is therefore inhibition of LOC254875 (Accession XP_171170.1). Accordingly, utilities of GAM7957 include diagnosis, prevention and treatment of diseases and clinical conditions associated with LOC254875.

LOC254946 (Accession XP_171161.2) is another GAM7957 target gene, herein designated TARGET GENE. LOC254946 BINDING SITE is a target binding site found in the 3' untranslated region of mRNA encoded by LOC254946, corresponding to a target binding site such as BINDING SITE I, BINDING SITE II or BINDING SITE III of FIG. 8. Table 4 illustrates the complementarity of the nucleotide sequences of LOC254946 BINDING SITE, designated SEQ ID:9560, to the nucleotide sequence of GAM7957 RNA, herein designated GAM RNA, also designated SEQ ID:297.

Another function of GAM7957 is therefore inhibition of LOC254946 (Accession XP_171161.2). Accordingly, utilities of GAM7957 include diagnosis, prevention and treatment of diseases and clinical conditions associated with LOC254946.

LOC255031 (Accession XP_173187.1) is another GAM7957 target gene, herein designated TARGET GENE. LOC255031 BINDING SITE is a target binding site found in the 3' untranslated region of mRNA encoded by LOC255031, corresponding to a target binding site such as BINDING SITE I, BINDING SITE II or BINDING SITE III of FIG. 8. Table 4 illustrates the complementarity of the nucleotide sequences of LOC255031 BINDING SITE, designated SEQ ID:8789, to the nucleotide sequence of GAM7957 RNA, herein designated GAM RNA, also designated SEQ ID:297.

Another function of GAM7957 is therefore inhibition of LOC255031 (Accession XP_173187.1). Accordingly, utilities of GAM7957 include diagnosis, prevention and treatment of diseases and clinical conditions associated with LOC255031.

LOC255177 (Accession XP_172941.1) is another GAM7957 target gene, herein designated TARGET GENE. LOC255177 BINDING SITE1 and LOC255177 BINDING SITE2 are target binding sites found in untranslated regions of mRNA encoded by LOC255177, corresponding to target binding sites such as BINDING SITE I, BINDING SITE II or BINDING SITE III of FIG. 8. Table 4 illustrates the complementarity of the nucleotide sequences of LOC255177 BINDING SITE1 and LOC255177 BINDING SITE2, designated SEQ ID:6524 and SEQ ID:1492 respectively, to the nucleotide sequence of GAM7957 RNA, herein designated GAM RNA, also designated SEQ ID:297.

Another function of GAM7957 is therefore inhibition of LOC255177 (Accession XP_172941.1). Accordingly, utilities of GAM7957 include diagnosis, prevention and treatment of diseases and clinical conditions associated with LOC255177.

LOC255328 (Accession XP_172920.1) is another GAM7957 target gene, herein designated TARGET GENE. LOC255328 BINDING SITE1 and LOC255328 BINDING SITE2 are target binding sites found in untranslated regions of mRNA encoded by LOC255328, corresponding to target binding sites such as BINDING SITE I, BINDING SITE II or BINDING SITE III of FIG. 8. Table 4 illustrates the complementarity of the nucleotide sequences of LOC255328 BINDING SITE1 and LOC255328 BINDING SITE2, designated SEQ ID:11775 and SEQ ID:1492 respectively, to the nucleotide sequence of GAM7957 RNA, herein designated GAM RNA, also designated SEQ ID:297.

Another function of GAM7957 is therefore inhibition of LOC255328 (Accession XP_172920.1). Accordingly, utilities of GAM7957 include diagnosis, prevention and treatment of diseases and clinical conditions associated with LOC255328.

LOC255374 (Accession XP_171171.1) is another GAM7957 target gene, herein designated TARGET GENE. LOC255374 BINDING SITE is a target binding site found in the 5' untranslated region of mRNA encoded by LOC255374, corresponding to a target binding site such as BINDING SITE I, BINDING SITE II or BINDING SITE III of FIG. 8. Table 4 illustrates the complementarity of the nucleotide sequences of LOC255374 BINDING SITE, designated SEQ ID:6760, to the nucleotide sequence of GAM7957 RNA, herein designated GAM RNA, also designated SEQ ID:297.

Another function of GAM7957 is therefore inhibition of LOC255374 (Accession XP_171171.1). Accordingly, utilities of GAM7957 include diagnosis, prevention and treatment of diseases and clinical conditions associated with LOC255374.

LOC255971 (Accession XP_172907.1) is another GAM7957 target gene, herein designated TARGET GENE. LOC255971 BINDING SITE is a target binding site found in the 3' untranslated region of mRNA encoded by LOC255971, corresponding to a target binding site such as BINDING SITE I, BINDING SITE II or BINDING SITE III of FIG. 8. Table 4 illustrates the complementarity of the nucleotide sequences of LOC255971 BINDING SITE, designated SEQ ID:5830, to the nucleotide sequence of GAM7957 RNA, herein designated GAM RNA, also designated SEQ ID:297.

Another function of GAM7957 is therefore inhibition of LOC255971 (Accession XP_172907.1). Accordingly, utilities of GAM7957 include diagnosis, prevention and treatment of diseases and clinical conditions associated with LOC255971.

LOC256019 (Accession XP_171084.1) is another GAM7957 target gene, herein designated TARGET GENE. LOC256019 BINDING SITE is a target binding site found in the 3' untranslated region of mRNA encoded by LOC256019, corresponding to a target binding site such as BINDING SITE I, BINDING SITE II or BINDING SITE III of FIG. 8. Table 4 illustrates the complementarity of the nucleotide sequences of LOC256019 BINDING SITE, designated SEQ ID:12654, to the nucleotide sequence of GAM7957 RNA, herein designated GAM RNA, also designated SEQ ID:297.

Another function of GAM7957 is therefore inhibition of LOC256019 (Accession XP_171084.1). Accordingly, utilities of GAM7957 include diagnosis, prevention and treatment of diseases and clinical conditions associated with LOC256019.

LOC256106 (Accession XP_172187.1) is another GAM7957 target gene, herein designated TARGET GENE. LOC256106 BINDING SITE is a target binding site found in the 3' untranslated region of mRNA encoded by LOC256106, corresponding to a target binding site such as BINDING SITE I, BINDING SITE II or BINDING SITE III of FIG. 8. Table 4 illustrates the complementarity of the nucleotide sequences of LOC256106 BINDING SITE, designated SEQ ID:18825, to the nucleotide sequence of GAM7957 RNA, herein designated GAM RNA, also designated SEQ ID:297.

Another function of GAM7957 is therefore inhibition of LOC256106 (Accession XP_172187.1). Accordingly, utilities of GAM7957 include diagnosis, prevention and treatment of diseases and clinical conditions associated with LOC256106.

LOC256470 (Accession XP_171439.1) is another GAM7957 target gene, herein designated TARGET GENE. LOC256470 BINDING SITE is a target binding site found in the 5' untranslated region of mRNA encoded by LOC256470, corresponding to a target binding site such as BINDING SITE I, BINDING SITE II or BINDING SITE III of FIG. 8. Table 4 illustrates the complementarity of the nucleotide sequences of LOC256470 BINDING SITE, designated SEQ ID:10018, to the nucleotide sequence of GAM7957 RNA, herein designated GAM RNA, also designated SEQ ID:297.

Another function of GAM7957 is therefore inhibition of LOC256470 (Accession XP_171439.1). Accordingly, utilities of GAM7957 include diagnosis, prevention and treatment of diseases and clinical conditions associated with LOC256470.

LOC256515 (Accession XP_172866.1) is another GAM7957 target gene, herein designated TARGET GENE. LOC256515 BINDING SITE1 and LOC256515 BINDING SITE2 are target binding sites found in untranslated regions of mRNA encoded by LOC256515, corresponding to target binding sites such as BINDING SITE I, BINDING SITE II or BINDING SITE III of FIG. 8. Table 4 illustrates the complementarity of the nucleotide sequences of LOC256515 BINDING SITE1 and LOC256515 BINDING SITE2, designated SEQ ID:7125 and SEQ ID:1492 respectively, to the nucleotide sequence of GAM7957 RNA, herein designated GAM RNA, also designated SEQ ID:297.

Another function of GAM7957 is therefore inhibition of LOC256515 (Accession XP_172866.1). Accordingly, utilities of GAM7957 include diagnosis, prevention and treatment of diseases and clinical conditions associated with LOC256515.

LOC256594 (Accession XP_173127.1) is another GAM7957 target gene, herein designated TARGET GENE. LOC256594 BINDING SITE1 and LOC256594 BINDING SITE2 are target binding sites found in untranslated regions of mRNA encoded by LOC256594, corresponding to target binding sites such as BINDING SITE I, BINDING SITE II or BINDING SITE III of FIG. 8. Table 4 illustrates the complementarity of the nucleotide sequences of LOC256594 BINDING SITE1 and LOC256594 BINDING SITE2, designated SEQ ID:1492 and SEQ ID:2732 respectively, to the nucleotide sequence of GAM7957 RNA, herein designated GAM RNA, also designated SEQ ID:297.

Another function of GAM7957 is therefore inhibition of LOC256594 (Accession XP_173127.1). Accordingly, utilities of GAM7957 include diagnosis, prevention and treatment of diseases and clinical conditions associated with LOC256594.

LOC282910 (Accession XP_212580.1) is another GAM7957 target gene, herein designated TARGET GENE. LOC282910 BINDING SITE is a target binding site found in the 3' untranslated region of mRNA encoded by LOC282910, corresponding to a target binding site such as BINDING SITE I, BINDING SITE II or BINDING SITE III of FIG. 8. Table 4 illustrates the complementarity of the nucleotide sequences of LOC282910 BINDING SITE, designated SEQ ID:16121, to the nucleotide sequence of GAM7957 RNA, herein designated GAM RNA, also designated SEQ ID:297.

Another function of GAM7957 is therefore inhibition of LOC282910 (Accession XP_212580.1). Accordingly, utilities of GAM7957 include diagnosis, prevention and treatment of diseases and clinical conditions associated with LOC282910.

LOC282915 (Accession XP_212579.1) is another GAM7957 target gene, herein designated TARGET GENE. LOC282915 BINDING SITE is a target binding site found in the 3' untranslated region of mRNA encoded by LOC282915, corresponding to a target binding site such as BINDING SITE I, BINDING SITE II or BINDING SITE III of FIG. 8. Table 4 illustrates the complementarity of the nucleotide sequences of LOC282915 BINDING SITE, designated SEQ ID:5928, to the nucleotide sequence of GAM7957 RNA, herein designated GAM RNA, also designated SEQ ID:297.

Another function of GAM7957 is therefore inhibition of LOC282915 (Accession XP_212579.1). Accordingly, utilities of GAM7957 include diagnosis, prevention and treatment of diseases and clinical conditions associated with LOC282915.

LOC282947 (Accession XP_212628.1) is another GAM7957 target gene, herein designated TARGET GENE. LOC282947 BINDING SITE is a target binding site found in the 3' untranslated region of mRNA encoded by LOC282947, corresponding to a target binding site such as BINDING SITE I, BINDING SITE II or BINDING SITE III of FIG. 8. Table 4 illustrates the complementarity of the nucleotide sequences of LOC282947 BINDING SITE, designated SEQ ID:16121, to the nucleotide sequence of GAM7957 RNA, herein designated GAM RNA, also designated SEQ ID:297.

Another function of GAM7957 is therefore inhibition of LOC282947 (Accession XP_212628.1). Accordingly, utilities of GAM7957 include diagnosis, prevention and treatment of diseases and clinical conditions associated with LOC282947.

LOC282951 (Accession XP_212627.1) is another GAM7957 target gene, herein designated TARGET GENE. LOC282951 BINDING SITE is a target binding site found in the 3' untranslated region of mRNA encoded by LOC282951, corresponding to a target binding site such as BINDING SITE I, BINDING SITE II or BINDING SITE III of FIG. 8. Table 4 illustrates the complementarity of the nucleotide sequences of LOC282951 BINDING SITE, designated SEQ ID:5928, to the nucleotide sequence of GAM7957 RNA, herein designated GAM RNA, also designated SEQ ID:297.

Another function of GAM7957 is therefore inhibition of LOC282951 (Accession XP_212627.1). Accordingly, utilities of GAM7957 include diagnosis, prevention and treatment of diseases and clinical conditions associated with LOC282951.

LOC282959 (Accession XP_212622.1) is another GAM7957 target gene, herein designated TARGET GENE. LOC282959 BINDING SITE is a target binding site found in the 3' untranslated region of mRNA encoded by LOC282959, corresponding to a target binding site such as BINDING SITE I, BINDING SITE II or BINDING SITE III of FIG. 8. Table 4 illustrates the complementarity of the nucleotide sequences of LOC282959 BINDING SITE, designated SEQ ID:10435, to the nucleotide sequence of GAM7957 RNA, herein designated GAM RNA, also designated SEQ ID:297.

Another function of GAM7957 is therefore inhibition of LOC282959 (Accession XP_212622.1). Accordingly, utilities of GAM7957 include diagnosis, prevention and treatment of diseases and clinical conditions associated with LOC282959.

LOC282963 (Accession XP_210834.1) is another GAM7957 target gene, herein designated TARGET GENE. LOC282963 BINDING SITE1 and LOC282963 BINDING SITE2 are target binding sites found in untranslated regions of mRNA encoded by LOC282963, corresponding to target binding sites such as BINDING SITE I, BINDING SITE II or BINDING SITE III of FIG. 8. Table 4 illustrates the complementarity of the nucleotide sequences of LOC282963 BINDING SITE1 and LOC282963 BINDING SITE2, designated SEQ ID:15343 and SEQ ID:15108 respectively, to the nucleotide sequence of GAM7957 RNA, herein designated GAM RNA, also designated SEQ ID:297.

Another function of GAM7957 is therefore inhibition of LOC282963 (Accession XP_210834.1). Accordingly, utilities of GAM7957 include diagnosis, prevention and treatment of diseases and clinical conditions associated with LOC282963.

LOC282987 (Accession XP_210845.1) is another GAM7957 target gene, herein designated TARGET GENE. LOC282987 BINDING SITE is a target binding site found in the 3' untranslated region of mRNA encoded by LOC282987, corresponding to a target binding site such as BINDING SITE I, BINDING SITE II or BINDING SITE III of FIG. 8. Table 4 illustrates the complementarity of the nucleotide sequences of LOC282987 BINDING SITE, designated SEQ ID:18905, to the nucleotide sequence of GAM7957 RNA, herein designated GAM RNA, also designated SEQ ID:297.

Another function of GAM7957 is therefore inhibition of LOC282987 (Accession XP_210845.1). Accordingly, utilities of GAM7957 include diagnosis, prevention and treatment of diseases and clinical conditions associated with LOC282987.

LOC283005 (Accession XP_208481.1) is another GAM7957 target gene, herein designated TARGET GENE. LOC283005 BINDING SITE is a target binding site found in the 3' untranslated region of mRNA encoded by LOC283005, corresponding to a target binding site such as BINDING SITE I, BINDING SITE II or BINDING SITE III of FIG. 8. Table 4 illustrates the complementarity of the nucleotide sequences of LOC283005 BINDING SITE, designated SEQ ID:9858, to the nucleotide sequence of GAM7957 RNA, herein designated GAM RNA, also designated SEQ ID:297.

Another function of GAM7957 is therefore inhibition of LOC283005 (Accession XP_208481.1). Accordingly, utilities of GAM7957 include diagnosis, prevention and treatment of diseases and clinical conditions associated with LOC283005.

LOC283050 (Accession XP_210872.1) is another GAM7957 target gene, herein designated TARGET GENE. LOC283050 BINDING SITE1 and LOC283050 BINDING SITE2 are target binding sites found in untranslated regions of mRNA encoded by LOC283050, corresponding to target binding sites such as BINDING SITE I, BINDING SITE II or BINDING SITE III of FIG. 8. Table 4 illustrates the complementarity of the nucleotide sequences of LOC283050 BINDING SITE1 and LOC283050 BINDING SITE2, designated SEQ ID:4180 and SEQ ID:1557 respectively, to the nucleotide sequence of GAM7957 RNA, herein designated GAM RNA, also designated SEQ ID:297.

Another function of GAM7957 is therefore inhibition of LOC283050 (Accession XP_210872.1). Accordingly, utilities of GAM7957 include diagnosis, prevention and treatment of diseases and clinical conditions associated with LOC283050.

LOC283061 (Accession XP_210875.1) is another GAM7957 target gene, herein designated TARGET GENE. LOC283061 BINDING SITE1 and LOC283061 BINDING SITE2 are target binding sites found in untranslated regions of mRNA encoded by LOC283061, corresponding to target binding sites such as BINDING SITE I, BINDING SITE II or BINDING SITE III of FIG. 8. Table 4 illustrates the complementarity of the nucleotide sequences of LOC283061 BINDING SITE1 and LOC283061 BINDING SITE2, designated SEQ ID:18041 and SEQ ID:19246 respectively, to the nucleotide sequence of GAM7957 RNA, herein designated GAM RNA, also designated SEQ ID:297.

Another function of GAM7957 is therefore inhibition of LOC283061 (Accession XP_210875.1). Accordingly, utilities of GAM7957 include diagnosis, prevention and treatment of diseases and clinical conditions associated with LOC283061.

LOC283083 (Accession XP_210883.1) is another GAM7957 target gene, herein designated TARGET GENE. LOC283083 BINDING SITE is a target binding site found in the 3' untranslated region of mRNA encoded by LOC283083, corresponding to a target binding site such as BINDING SITE I, BINDING SITE II or BINDING SITE III of FIG. 8. Table 4 illustrates the complementarity of the nucleotide sequences of LOC283083 BINDING SITE, designated SEQ ID:8877, to the nucleotide sequence of GAM7957 RNA, herein designated GAM RNA, also designated SEQ ID:297.

Another function of GAM7957 is therefore inhibition of LOC283083 (Accession XP_210883.1). Accordingly, utilities of GAM7957 include diagnosis, prevention and treatment of diseases and clinical conditions associated with LOC283083.

LOC283107 (Accession XP_210889.1) is another GAM7957 target gene, herein designated TARGET GENE. LOC283107 BINDING SITE is a target binding site found in the 3' untranslated region of mRNA encoded by LOC283107, corresponding to a target binding site such as BINDING SITE I, BINDING SITE II or BINDING SITE III of FIG. 8. Table 4 illustrates the complementarity of the nucleotide sequences of LOC283107 BINDING SITE, designated SEQ ID:16476, to the nucleotide sequence of GAM7957 RNA, herein designated GAM RNA, also designated SEQ ID:297.

Another function of GAM7957 is therefore inhibition of LOC283107 (Accession XP_210889.1). Accordingly, utilities of GAM7957 include diagnosis, prevention and treatment of diseases and clinical conditions associated with LOC283107.

LOC283125 (Accession XP_210897.1) is another GAM7957 target gene, herein designated TARGET GENE. LOC283125 BINDING SITE is a target binding site found in the 3' untranslated region of mRNA encoded by LOC283125, corresponding to a target binding site such as BINDING SITE I, BINDING SITE II or BINDING SITE III of FIG. 8. Table 4 illustrates the complementarity of the nucleotide sequences of LOC283125 BINDING SITE, designated SEQ ID:13229, to the nucleotide sequence of GAM7957 RNA, herein designated GAM RNA, also designated SEQ ID:297.

Another function of GAM7957 is therefore inhibition of LOC283125 (Accession XP_210897.1). Accordingly, utilities of GAM7957 include diagnosis, prevention and treatment of diseases and clinical conditions associated with LOC283125.

LOC283143 (Accession XP_210920.1) is another GAM7957 target gene, herein designated TARGET GENE. LOC283143 BINDING SITE is a target binding site found in the 3' untranslated region of mRNA encoded by LOC283143, corresponding to a target binding site such as BINDING SITE I, BINDING SITE II or BINDING SITE III of FIG. 8. Table 4 illustrates the complementarity of the nucleotide sequences of LOC283143 BINDING SITE, designated SEQ ID:16945, to the nucleotide sequence of GAM7957 RNA, herein designated GAM RNA, also designated SEQ ID:297.

Another function of GAM7957 is therefore inhibition of LOC283143 (Accession XP_210920.1). Accordingly, utilities of GAM7957 include diagnosis, prevention and treatment of diseases and clinical conditions associated with LOC283143.

LOC283168 (Accession XP_210910.1) is another GAM7957 target gene, herein designated TARGET GENE. LOC283168 BINDING SITE is a target binding site found in the 3' untranslated region of mRNA encoded by LOC283168, corresponding to a target binding site such as BINDING SITE I, BINDING SITE II or BINDING SITE III of FIG. 8. Table 4 illustrates the complementarity of the nucleotide sequences of LOC283168 BINDING SITE, designated SEQ ID:19057, to the nucleotide sequence of GAM7957 RNA, herein designated GAM RNA, also designated SEQ ID:297.

Another function of GAM7957 is therefore inhibition of LOC283168 (Accession XP_210910.1). Accordingly, utilities of GAM7957 include diagnosis, prevention and treatment of diseases and clinical conditions associated with LOC283168.

LOC283177 (Accession XP_210903.1) is another GAM7957 target gene, herein designated TARGET GENE. LOC283177 BINDING SITE is a target binding site found in the 3' untranslated region of mRNA encoded by LOC283177, corresponding to a target binding site such as BINDING SITE I, BINDING SITE II or BINDING SITE III of FIG. 8. Table 4 illustrates the complementarity of the nucleotide sequences of LOC283177 BINDING SITE, designated SEQ ID:12613, to the nucleotide sequence of GAM7957 RNA, herein designated GAM RNA, also designated SEQ ID:297.

Another function of GAM7957 is therefore inhibition of LOC283177 (Accession XP_210903.1). Accordingly, utilities of GAM7957 include diagnosis, prevention and treatment of diseases and clinical conditions associated with LOC283177.

LOC283208 (Accession XP_208559.2) is another GAM7957 target gene, herein designated TARGET GENE. LOC283208 BINDING SITE is a target binding site found in the 3' untranslated region of mRNA encoded by LOC283208, corresponding to a target binding site such as BINDING SITE I, BINDING SITE II or BINDING SITE III of FIG. 8. Table 4 illustrates the complementarity of the nucleotide sequences of LOC283208 BINDING SITE, designated SEQ ID:9151, to the nucleotide sequence of GAM7957 RNA, herein designated GAM RNA, also designated SEQ ID:297.

Another function of GAM7957 is therefore inhibition of LOC283208 (Accession XP_208559.2). Accordingly, utilities of GAM7957 include diagnosis, prevention and treatment of diseases and clinical conditions associated with LOC283208.

LOC283215 (Accession XP_208555.2) is another GAM7957 target gene, herein designated TARGET GENE. LOC283215 BINDING SITE1 and LOC283215 BINDING SITE2 are target binding sites found in untranslated regions of mRNA encoded by LOC283215, corresponding to target binding sites such as BINDING SITE I, BINDING SITE II or BINDING SITE III of FIG. 8. Table 4 illustrates the complementarity of the nucleotide sequences of LOC283215 BINDING SITE1 and LOC283215 BINDING SITE2, designated SEQ ID:8878 and SEQ ID:9770 respectively, to the nucleotide sequence of GAM7957 RNA, herein designated GAM RNA, also designated SEQ ID:297.

Another function of GAM7957 is therefore inhibition of LOC283215 (Accession XP_208555.2). Accordingly, utilities of GAM7957 include diagnosis, prevention and treatment of diseases and clinical conditions associated with LOC283215.

LOC283235 (Accession XP_208578.1) is another GAM7957 target gene, herein designated TARGET GENE. LOC283235 BINDING SITE is a target binding site found in the 3' untranslated region of mRNA encoded by LOC283235, corresponding to a target binding site such as BINDING SITE I, BINDING SITE II or BINDING SITE III of FIG. 8. Table 4 illustrates the complementarity of the nucleotide sequences of LOC283235 BINDING SITE, designated SEQ ID:18691, to the nucleotide sequence of GAM7957 RNA, herein designated GAM RNA, also designated SEQ ID:297.

Another function of GAM7957 is therefore inhibition of LOC283235 (Accession XP_208578.1). Accordingly, utilities of GAM7957 include diagnosis, prevention and treatment of diseases and clinical conditions associated with LOC283235.

LOC283243 (Accession XP_210947.2) is another GAM7957 target gene, herein designated TARGET GENE. LOC283243 BINDING SITE1 and LOC283243 BINDING SITE2 are target binding sites found in untranslated regions of mRNA encoded by LOC283243, corresponding to target binding sites such as BINDING SITE I, BINDING SITE II or BINDING SITE III of FIG. 8. Table 4 illustrates the complementarity of the nucleotide sequences of LOC283243 BINDING SITE1 and LOC283243 BINDING SITE2, designated SEQ ID:11352 and SEQ ID:14360 respectively, to the nucleotide sequence of GAM7957 RNA, herein designated GAM RNA, also designated SEQ ID:297.

Another function of GAM7957 is therefore inhibition of LOC283243 (Accession XP_210947.2). Accordingly, utilities of GAM7957 include diagnosis, prevention and treatment of diseases and clinical conditions associated with LOC283243.

LOC283244 (Accession XP_208583.2) is another GAM7957 target gene, herein designated TARGET GENE. LOC283244 BINDING SITE is a target binding site found in the 3' untranslated region of mRNA encoded by LOC283244, corresponding to a target binding site such as BINDING SITE I, BINDING SITE II or BINDING SITE III of FIG. 8. Table 4 illustrates the complementarity of the nucleotide sequences of LOC283244 BINDING SITE, designated SEQ ID:18377, to the nucleotide sequence of GAM7957 RNA, herein designated GAM RNA, also designated SEQ ID:297.

Another function of GAM7957 is therefore inhibition of LOC283244 (Accession XP_208583.2). Accordingly, utilities of GAM7957 include diagnosis, prevention and treatment of diseases and clinical conditions associated with LOC283244.

LOC283269 (Accession XP_210953.1) is another GAM7957 target gene, herein designated TARGET GENE. LOC283269 BINDING SITE is a target binding site found in the 3' untranslated region of mRNA encoded by LOC283269, corresponding to a target binding site such as BINDING SITE I, BINDING SITE II or BINDING SITE III of FIG. 8. Table 4 illustrates the complementarity of the nucleotide sequences of LOC283269 BINDING SITE, designated SEQ ID:1906, to the nucleotide sequence of GAM7957 RNA, herein designated GAM RNA, also designated SEQ ID:297.

Another function of GAM7957 is therefore inhibition of LOC283269 (Accession XP_210953.1). Accordingly, utilities of GAM7957 include diagnosis, prevention and treatment of diseases and clinical conditions associated with LOC283269.

LOC283283 (Accession XP_208601.1) is another GAM7957 target gene, herein designated TARGET GENE. LOC283283 BINDING SITE is a target binding site found in the 3' untranslated region of mRNA encoded by LOC283283, corresponding to a target binding site such as BINDING SITE I, BINDING SITE II or BINDING SITE III of FIG. 8. Table 4 illustrates the complementarity of the nucleotide sequences of LOC283283 BINDING SITE, designated SEQ ID:19053, to the nucleotide sequence of GAM7957 RNA, herein designated GAM RNA, also designated SEQ ID:297.

Another function of GAM7957 is therefore inhibition of LOC283283 (Accession XP_208601.1). Accordingly, utilities of GAM7957 include diagnosis, prevention and treatment of diseases and clinical conditions associated with LOC283283.

LOC283295 (Accession XP_210964.1) is another GAM7957 target gene, herein designated TARGET GENE. LOC283295 BINDING SITE is a target binding site found in the 3' untranslated region of mRNA encoded by LOC283295, corresponding to a target binding site such as BINDING SITE I, BINDING SITE II or BINDING SITE III of FIG. 8. Table 4 illustrates the complementarity of the nucleotide sequences of LOC283295 BINDING SITE, designated SEQ ID:12929, to the nucleotide sequence of GAM7957 RNA, herein designated GAM RNA, also designated SEQ ID:297.

Another function of GAM7957 is therefore inhibition of LOC283295 (Accession XP_210964.1). Accordingly, utilities of GAM7957 include diagnosis, prevention and treatment of diseases and clinical conditions associated with LOC283295.

LOC283299 (Accession XP_210965.1) is another GAM7957 target gene, herein designated TARGET GENE. LOC283299 BINDING SITE is a target binding site found in the 3' untranslated region of mRNA encoded by LOC283299, corresponding to a target binding site such as BINDING SITE I, BINDING SITE II or BINDING SITE III of FIG. 8. Table 4 illustrates the complementarity of the nucleotide sequences of LOC283299 BINDING SITE, designated SEQ ID:12796, to the nucleotide sequence of GAM7957 RNA, herein designated GAM RNA, also designated SEQ ID:297.

Another function of GAM7957 is therefore inhibition of LOC283299 (Accession XP_210965.1). Accordingly, utilities of GAM7957 include diagnosis, prevention and treatment of diseases and clinical conditions associated with LOC283299.

LOC283314 (Accession XP_210969.1) is another GAM7957 target gene, herein designated TARGET GENE. LOC283314 BINDING SITE1 and LOC283314 BINDING SITE2 are target binding sites found in untranslated regions of mRNA encoded by LOC283314, corresponding to target binding sites such as BINDING SITE I, BINDING SITE II or BINDING SITE III of FIG. 8. Table 4 illustrates the complementarity of the nucleotide sequences of LOC283314 BINDING SITE1 and LOC283314 BINDING SITE2, designated SEQ ID:14571 and SEQ ID:18826 respectively, to the nucleotide sequence of GAM7957 RNA, herein designated GAM RNA, also designated SEQ ID:297.

Another function of GAM7957 is therefore inhibition of LOC283314 (Accession XP_210969.1). Accordingly, utilities of GAM7957 include diagnosis, prevention and treatment of diseases and clinical conditions associated with LOC283314.

LOC283325 (Accession XP_208618.1) is another GAM7957 target gene, herein designated TARGET GENE. LOC283325 BINDING SITE is a target binding site found in the 3' untranslated region of mRNA encoded by LOC283325, corresponding to a target binding site such as BINDING SITE I, BINDING SITE II or BINDING SITE III of FIG. 8. Table 4 illustrates the complementarity of the nucleotide sequences of LOC283325 BINDING SITE, designated SEQ ID:15781, to the nucleotide sequence of GAM7957 RNA, herein designated GAM RNA, also designated SEQ ID:297.

Another function of GAM7957 is therefore inhibition of LOC283325 (Accession XP_208618.1). Accordingly, utilities of GAM7957 include diagnosis, prevention and treatment of diseases and clinical conditions associated with LOC283325.

LOC283329 (Accession XP_210978.1) is another GAM7957 target gene, herein designated TARGET GENE. LOC283329 BINDING SITE1 and LOC283329 BINDING SITE2 are target binding sites found in untranslated regions of mRNA encoded by LOC283329, corresponding to target binding sites such as BINDING SITE I, BINDING SITE II or BINDING SITE III of FIG. 8. Table 4 illustrates the complementarity of the nucleotide sequences of LOC283329 BINDING SITE1 and LOC283329 BINDING SITE2, designated SEQ ID:18024 and SEQ ID:12188 respectively, to the nucleotide sequence of GAM7957 RNA, herein designated GAM RNA, also designated SEQ ID:297.

Another function of GAM7957 is therefore inhibition of LOC283329 (Accession XP_210978.1). Accordingly, utilities of GAM7957 include diagnosis, prevention and treatment of diseases and clinical conditions associated with LOC283329.

LOC283357 (Accession XP_210991.1) is another GAM7957 target gene, herein designated TARGET GENE. LOC283357 BINDING SITE is a target binding site found in the 3' untranslated region of mRNA encoded by LOC283357, corresponding to a target binding site such as BINDING SITE I, BINDING SITE II or BINDING SITE III of FIG. 8. Table 4 illustrates the complementarity of the nucleotide sequences of LOC283357 BINDING SITE, designated SEQ ID:15018, to the nucleotide sequence of GAM7957 RNA, herein designated GAM RNA, also designated SEQ ID:297.

Another function of GAM7957 is therefore inhibition of LOC283357 (Accession XP_210991.1). Accordingly, utilities of GAM7957 include diagnosis, prevention and treatment of diseases and clinical conditions associated with LOC283357.

LOC283382 (Accession XP_211005.1) is another GAM7957 target gene, herein designated TARGET GENE. LOC283382 BINDING SITE is a target binding site found in the 3' untranslated region of mRNA encoded by LOC283382, corresponding to a target binding site such as BINDING SITE I, BINDING SITE II or BINDING SITE III of FIG. 8. Table 4 illustrates the complementarity of the nucleotide sequences of LOC283382 BINDING SITE, designated SEQ ID:9260, to the nucleotide sequence of GAM7957 RNA, herein designated GAM RNA, also designated SEQ ID:297.

Another function of GAM7957 is therefore inhibition of LOC283382 (Accession XP_211005.1). Accordingly, utilities of GAM7957 include diagnosis, prevention and treatment of diseases and clinical conditions associated with LOC283382.

LOC283394 (Accession XP_211021.1) is another GAM7957 target gene, herein designated TARGET GENE. LOC283394 BINDING SITE is a target binding site found in the 3' untranslated region of mRNA encoded by LOC283394, corresponding to a target binding site such as BINDING SITE I, BINDING SITE II or BINDING SITE III of FIG. 8. Table 4 illustrates the complementarity of the nucleotide sequences of LOC283394 BINDING SITE, designated SEQ ID:17398, to the nucleotide sequence of GAM7957 RNA, herein designated GAM RNA, also designated SEQ ID:297.

Another function of GAM7957 is therefore inhibition of LOC283394 (Accession XP_211021.1). Accordingly, utilities of GAM7957 include diagnosis, prevention and treatment of diseases and clinical conditions associated with LOC283394.

LOC283415 (Accession XP_208084.1) is another GAM7957 target gene, herein designated TARGET GENE. LOC283415 BINDING SITE is a target binding site found in the 3' untranslated region of mRNA encoded by LOC283415, corresponding to a target binding site such as BINDING SITE I, BINDING SITE II or BINDING SITE III of FIG. 8. Table 4 illustrates the complementarity of the nucleotide sequences of LOC283415 BINDING SITE, designated SEQ ID:19054, to the nucleotide sequence of GAM7957 RNA, herein designated GAM RNA, also designated SEQ ID:297.

Another function of GAM7957 is therefore inhibition of LOC283415 (Accession XP_208084.1). Accordingly, utilities of GAM7957 include diagnosis, prevention and treatment of diseases and clinical conditions associated with LOC283415.

LOC283437 (Accession XP_211038.1) is another GAM7957 target gene, herein designated TARGET GENE. LOC283437 BINDING SITE is a target binding site found in the 3' untranslated region of mRNA encoded by LOC283437, corresponding to a target binding site such as BINDING SITE I, BINDING SITE II or BINDING SITE III of FIG. 8. Table 4 illustrates the complementarity of the nucleotide sequences of LOC283437 BINDING SITE, designated SEQ ID:13667, to the nucleotide sequence of GAM7957 RNA, herein designated GAM RNA, also designated SEQ ID:297.

Another function of GAM7957 is therefore inhibition of LOC283437 (Accession XP_211038.1). Accordingly, utilities of GAM7957 include diagnosis, prevention and treatment of diseases and clinical conditions associated with LOC283437.

LOC283438 (Accession XP_211042.1) is another GAM7957 target gene, herein designated TARGET GENE. LOC283438 BINDING SITE is a target binding site found in the 5' untranslated region of mRNA encoded by LOC283438, corresponding to a target binding site such as BINDING SITE I, BINDING SITE II or BINDING SITE III of FIG. 8. Table 4 illustrates the complementarity of the nucleotide sequences of LOC283438 BINDING SITE, designated SEQ ID:15747, to the nucleotide sequence of GAM7957 RNA, herein designated GAM RNA, also designated SEQ ID:297.

Another function of GAM7957 is therefore inhibition of LOC283438 (Accession XP_211042.1). Accordingly, utilities of GAM7957 include diagnosis, prevention and treatment of diseases and clinical conditions associated with LOC283438.

LOC283442 (Accession XP_211037.1) is another GAM7957 target gene, herein designated TARGET GENE. LOC283442 BINDING SITE is a target binding site found in the 3' untranslated region of mRNA encoded by LOC283442, corresponding to a target binding site such as BINDING SITE I, BINDING SITE II or BINDING SITE III of FIG. 8. Table 4 illustrates the complementarity of the nucleotide sequences of LOC283442 BINDING SITE, designated SEQ ID:15984, to the nucleotide sequence of GAM7957 RNA, herein designated GAM RNA, also designated SEQ ID:297.

Another function of GAM7957 is therefore inhibition of LOC283442 (Accession XP_211037.1). Accordingly, utilities of GAM7957 include diagnosis, prevention and treatment of diseases and clinical conditions associated with LOC283442.

LOC283453 (Accession XP_211047.1) is another GAM7957 target gene, herein designated TARGET GENE. LOC283453 BINDING SITE is a target binding site found in the 5' untranslated region of mRNA encoded by LOC283453, corresponding to a target binding site such as BINDING SITE I, BINDING SITE II or BINDING SITE III of FIG. 8. Table 4 illustrates the complementarity of the nucleotide sequences of LOC283453 BINDING SITE, designated SEQ ID:19898, to the nucleotide sequence of GAM7957 RNA, herein designated GAM RNA, also designated SEQ ID:297.

Another function of GAM7957 is therefore inhibition of LOC283453 (Accession XP_211047.1). Accordingly, utilities of GAM7957 include diagnosis, prevention and treatment of diseases and clinical conditions associated with LOC283453.

LOC283460 (Accession XP_208682.1) is another GAM7957 target gene, herein designated TARGET GENE. LOC283460 BINDING SITE1 through LOC283460 BINDING SITE3 are target binding sites found in untranslated regions of mRNA encoded by LOC283460, corresponding to target binding sites such as BINDING SITE I, BINDING SITE II or BINDING SITE III of FIG. 8. Table 4 illustrates the complementarity of the nucleotide sequences of LOC283460 BINDING SITE1 through LOC283460 BINDING SITE3, designated SEQ ID:3523, SEQ ID:15308 and SEQ ID:1620 respectively, to the nucleotide sequence of GAM7957 RNA, herein designated GAM RNA, also designated SEQ ID:297.

Another function of GAM7957 is therefore inhibition of LOC283460 (Accession XP_208682.1). Accordingly, utilities of GAM7957 include diagnosis, prevention and treatment of diseases and clinical conditions associated with LOC283460.

LOC283467 (Accession XP_211050.1) is another GAM7957 target gene, herein designated TARGET GENE. LOC283467 BINDING SITE is a target binding site found in the 3' untranslated region of mRNA encoded by LOC283467, corresponding to a target binding site such as BINDING SITE I, BINDING SITE II or BINDING SITE III of FIG. 8. Table 4 illustrates the complementarity of the nucleotide sequences of LOC283467 BINDING SITE, designated SEQ ID:16897, to the nucleotide sequence of GAM7957 RNA, herein designated GAM RNA, also designated SEQ ID:297.

Another function of GAM7957 is therefore inhibition of LOC283467 (Accession XP_211050.1). Accordingly, utilities of GAM7957 include diagnosis, prevention and treatment of diseases and clinical conditions associated with LOC283467.

LOC283506 (Accession XP_211073.1) is another GAM7957 target gene, herein designated TARGET GENE. LOC283506 BINDING SITE is a target binding site found in the 3' untranslated region of mRNA encoded by LOC283506, corresponding to a target binding site such as BINDING SITE I, BINDING SITE II or BINDING SITE III of FIG. 8. Table 4 illustrates the complementarity of the nucleotide sequences of LOC283506 BINDING SITE, designated SEQ ID:15343, to the nucleotide sequence of GAM7957 RNA, herein designated GAM RNA, also designated SEQ ID:297.

Another function of GAM7957 is therefore inhibition of LOC283506 (Accession XP_211073.1). Accordingly, utilities of GAM7957 include diagnosis, prevention and treatment of diseases and clinical conditions associated with LOC283506.

LOC283508 (Accession XP_211070.1) is another GAM7957 target gene, herein designated TARGET GENE. LOC283508 BINDING SITE1 and LOC283508 BINDING SITE2 are target binding sites found in untranslated regions of mRNA encoded by LOC283508, corresponding to target binding sites such as BINDING SITE I, BINDING SITE II or BINDING SITE III of FIG. 8. Table 4 illustrates the complementarity of the nucleotide sequences of LOC283508 BINDING SITE1 and LOC283508 BINDING SITE2, designated SEQ ID:15089 and SEQ ID:14789 respectively, to the nucleotide sequence of GAM7957 RNA, herein designated GAM RNA, also designated SEQ ID:297.

Another function of GAM7957 is therefore inhibition of LOC283508 (Accession XP_211070.1). Accordingly, utilities of GAM7957 include diagnosis, prevention and treatment of diseases and clinical conditions associated with LOC283508.

LOC283531 (Accession XP_211078.1) is another GAM7957 target gene, herein designated TARGET GENE. LOC283531 BINDING SITE1 and LOC283531 BINDING SITE2 are target binding sites found in untranslated regions of mRNA encoded by LOC283531, corresponding to target binding sites such as BINDING SITE I, BINDING SITE II or BINDING SITE III of FIG. 8. Table 4 illustrates the complementarity of the nucleotide sequences of LOC283531 BINDING SITE1 and LOC283531 BINDING SITE2, designated SEQ ID:5830 and SEQ ID:14787 respectively, to the nucleotide sequence of GAM7957 RNA, herein designated GAM RNA, also designated SEQ ID:297.

Another function of GAM7957 is therefore inhibition of LOC283531 (Accession XP_211078.1). Accordingly, utilities of GAM7957 include diagnosis, prevention and treatment of diseases and clinical conditions associated with LOC283531.

LOC283566 (Accession XP_211114.1) is another GAM7957 target gene, herein designated TARGET GENE. LOC283566 BINDING SITE is a target binding site found in the 3' untranslated region of mRNA encoded by LOC283566, corresponding to a target binding site such as BINDING SITE I, BINDING SITE II or BINDING SITE III of FIG. 8. Table 4 illustrates the complementarity of the nucleotide sequences of LOC283566 BINDING SITE, designated SEQ ID:9763, to the nucleotide sequence of GAM7957 RNA, herein designated GAM RNA, also designated SEQ ID:297.

Another function of GAM7957 is therefore inhibition of LOC283566 (Accession XP_211114.1). Accordingly, utilities of GAM7957 include diagnosis, prevention and treatment of diseases and clinical conditions associated with LOC283566.

LOC283570 (Accession XP_211118.1) is another GAM7957 target gene, herein designated TARGET GENE. LOC283570 BINDING SITE1 and LOC283570 BINDING SITE2 are target binding sites found in untranslated regions of mRNA encoded by LOC283570, corresponding to target binding sites such as BINDING SITE I, BINDING SITE II or BINDING SITE III of FIG. 8. Table 4 illustrates the complementarity of the nucleotide sequences of LOC283570 BINDING SITE1 and LOC283570 BINDING SITE2, designated SEQ ID:18691 and SEQ ID:3025 respectively, to the nucleotide sequence of GAM7957 RNA, herein designated GAM RNA, also designated SEQ ID:297.

Another function of GAM7957 is therefore inhibition of LOC283570 (Accession XP_211118.1). Accordingly, utilities of GAM7957 include diagnosis, prevention and treatment of diseases and clinical conditions associated with LOC283570.

LOC283633 (Accession XP_208762.1) is another GAM7957 target gene, herein designated TARGET GENE. LOC283633 BINDING SITE is a target binding site found in the 5' untranslated region of mRNA encoded by LOC283633, corresponding to a target binding site such as BINDING SITE I, BINDING SITE II or BINDING SITE III of FIG. 8. Table 4 illustrates the complementarity of the nucleotide sequences of LOC283633 BINDING SITE, designated SEQ ID:1548, to the nucleotide sequence of GAM7957 RNA, herein designated GAM RNA, also designated SEQ ID:297.

Another function of GAM7957 is therefore inhibition of LOC283633 (Accession XP_208762.1). Accordingly, utilities of GAM7957 include diagnosis, prevention and treatment of diseases and clinical conditions associated with LOC283633.

LOC283655 (Accession XP_211144.1) is another GAM7957 target gene, herein designated TARGET GENE. LOC283655 BINDING SITE1 through LOC283655 BINDING SITE4 are target binding sites found in untranslated regions of mRNA encoded by LOC283655, corresponding to target binding sites such as BINDING SITE I, BINDING SITE II or BINDING SITE III of FIG. 8. Table 4 illustrates the complementarity of the nucleotide sequences of LOC283655 BINDING SITE1 through LOC283655 BINDING SITE4, designated SEQ ID:17452, SEQ ID:9536, SEQ ID:14905 and SEQ ID:13166 respectively, to the nucleotide sequence of GAM7957 RNA, herein designated GAM RNA, also designated SEQ ID:297.

Another function of GAM7957 is therefore inhibition of LOC283655 (Accession XP_211144.1). Accordingly, utilities of GAM7957 include diagnosis, prevention and treatment of diseases and clinical conditions associated with LOC283655.

LOC283686 (Accession XP_211164.1) is another GAM7957 target gene, herein designated TARGET GENE. LOC283686 BINDING SITE is a target binding site found in the 3' untranslated region of mRNA encoded by LOC283686, corresponding to a target binding site such as BINDING SITE I, BINDING SITE II or BINDING SITE III of FIG. 8. Table 4 illustrates the complementarity of the nucleotide sequences of LOC283686 BINDING SITE, designated SEQ ID:4155, to the nucleotide sequence of GAM7957 RNA, herein designated GAM RNA, also designated SEQ ID:297.

Another function of GAM7957 is therefore inhibition of LOC283686 (Accession XP_211164.1). Accordingly, utilities of GAM7957 include diagnosis, prevention and treatment of diseases and clinical conditions associated with LOC283686.

LOC283690 (Accession XP_211167.1) is another GAM7957 target gene, herein designated TARGET GENE. LOC283690 BINDING SITE is a target binding site found in the 3' untranslated region of mRNA encoded by LOC283690, corresponding to a target binding site such as BINDING SITE I, BINDING SITE II or BINDING SITE III of FIG. 8. Table 4 illustrates the complementarity of the nucleotide sequences of LOC283690 BINDING SITE, designated SEQ ID:9781, to the nucleotide sequence of GAM7957 RNA, herein designated GAM RNA, also designated SEQ ID:297.

Another function of GAM7957 is therefore inhibition of LOC283690 (Accession XP_211167.1). Accordingly, utilities of GAM7957 include diagnosis, prevention and treatment of diseases and clinical conditions associated with LOC283690.

LOC283693 (Accession XP_208788.1) is another GAM7957 target gene, herein designated TARGET GENE. LOC283693 BINDING SITE1 and LOC283693 BINDING SITE2 are target binding sites found in untranslated regions of mRNA encoded by LOC283693, corresponding to target binding sites such as BINDING SITE I, BINDING SITE II or BINDING SITE III of FIG. 8. Table 4 illustrates the complementarity of the nucleotide sequences of LOC283693 BINDING SITE1 and LOC283693 BINDING SITE2, designated SEQ ID:2070 and SEQ ID:5830 respectively, to the nucleotide sequence of GAM7957 RNA, herein designated GAM RNA, also designated SEQ ID:297.

Another function of GAM7957 is therefore inhibition of LOC283693 (Accession XP_208788.1). Accordingly, utilities of GAM7957 include diagnosis, prevention and treatment of diseases and clinical conditions associated with LOC283693.

LOC283697 (Accession XP_211173.1) is another GAM7957 target gene, herein designated TARGET GENE. LOC283697 BINDING SITE is a target binding site found in the 5' untranslated region of mRNA encoded by LOC283697, corresponding to a target binding site such as BINDING SITE I, BINDING SITE II or BINDING SITE III of FIG. 8. Table 4 illustrates the complementarity of the nucleotide sequences of LOC283697 BINDING SITE, designated SEQ ID:18836, to the nucleotide sequence of GAM7957 RNA, herein designated GAM RNA, also designated SEQ ID:297.

Another function of GAM7957 is therefore inhibition of LOC283697 (Accession XP_211173.1). Accordingly, utilities of GAM7957 include diagnosis, prevention and treatment of diseases and clinical conditions associated with LOC283697.

LOC283706 (Accession XP_208804.3) is another GAM7957 target gene, herein designated TARGET GENE. LOC283706 BINDING SITE1 and LOC283706 BINDING SITE2 are target binding sites found in untranslated regions of mRNA encoded by LOC283706, corresponding to target binding sites such as BINDING SITE I, BINDING SITE II or BINDING SITE III of FIG. 8. Table 4 illustrates the complementarity of the nucleotide sequences of LOC283706 BINDING SITE1 and LOC283706 BINDING SITE2, designated SEQ ID:2678 and SEQ ID:15592 respectively, to the nucleotide sequence of GAM7957 RNA, herein designated GAM RNA, also designated SEQ ID:297.

Another function of GAM7957 is therefore inhibition of LOC283706 (Accession XP_208804.3). Accordingly, utilities of GAM7957 include diagnosis, prevention and treatment of diseases and clinical conditions associated with LOC283706.

LOC283731 (Accession XP_211184.1) is another GAM7957 target gene, herein designated TARGET GENE. LOC283731 BINDING SITE is a target binding site found in the 3' untranslated region of mRNA encoded by LOC283731, corresponding to a target binding site such as BINDING SITE I, BINDING SITE II or BINDING SITE III of FIG. 8. Table 4 illustrates the complementarity of the nucleotide sequences of LOC283731 BINDING SITE, designated SEQ ID:8067, to the nucleotide sequence of GAM7957 RNA, herein designated GAM RNA, also designated SEQ ID:297.

Another function of GAM7957 is therefore inhibition of LOC283731 (Accession XP_211184.1). Accordingly, utilities of GAM7957 include diagnosis, prevention and treatment of diseases and clinical conditions associated with LOC283731.

LOC283740 (Accession XP_208819.1) is another GAM7957 target gene, herein designated TARGET GENE. LOC283740 BINDING SITE is a target binding site found in the 3' untranslated region of mRNA encoded by LOC283740, corresponding to a target binding site such as BINDING SITE I, BINDING SITE II or BINDING SITE III of FIG. 8. Table 4 illustrates the complementarity of the nucleotide sequences of LOC283740 BINDING SITE, designated SEQ ID:13155, to the nucleotide sequence of GAM7957 RNA, herein designated GAM RNA, also designated SEQ ID:297.

Another function of GAM7957 is therefore inhibition of LOC283740 (Accession XP_208819.1). Accordingly, utilities of GAM7957 include diagnosis, prevention and treatment of diseases and clinical conditions associated with LOC283740.

LOC283760 (Accession XP_208826.2) is another GAM7957 target gene, herein designated TARGET GENE. LOC283760 BINDING SITE is a target binding site found in the 3' untranslated region of mRNA encoded by LOC283760, corresponding to a target binding site such as BINDING SITE I, BINDING SITE II or BINDING SITE III of FIG. 8. Table 4 illustrates the complementarity of the nucleotide sequences of LOC283760 BINDING SITE, designated SEQ ID:14124, to the nucleotide sequence of GAM7957 RNA, herein designated GAM RNA, also designated SEQ ID:297.

Another function of GAM7957 is therefore inhibition of LOC283760 (Accession XP_208826.2). Accordingly, utilities of GAM7957 include diagnosis, prevention and treatment of diseases and clinical conditions associated with LOC283760.

LOC283767 (Accession XP_208835.1) is another GAM7957 target gene, herein designated TARGET GENE. LOC283767 BINDING SITE is a target binding site found in the 5' untranslated region of mRNA encoded by LOC283767, corresponding to a target binding site such as BINDING SITE I, BINDING SITE II or BINDING SITE III of FIG. 8. Table 4 illustrates the complementarity of the nucleotide sequences of LOC283767 BINDING SITE, designated SEQ ID:10439, to the nucleotide sequence of GAM7957 RNA, herein designated GAM RNA, also designated SEQ ID:297.

Another function of GAM7957 is therefore inhibition of LOC283767 (Accession XP_208835.1). Accordingly, utilities of GAM7957 include diagnosis, prevention and treatment of diseases and clinical conditions associated with LOC283767.

LOC283778 (Accession XP_211199.1) is another GAM7957 target gene, herein designated TARGET GENE. LOC283778 BINDING SITE1 and LOC283778 BINDING SITE2 are target binding sites found in untranslated regions of mRNA encoded by LOC283778, corresponding to target binding sites such as BINDING SITE I, BINDING SITE II or BINDING SITE III of FIG. 8. Table 4 illustrates the complementarity of the nucleotide sequences of LOC283778 BINDING SITE1 and LOC283778 BINDING SITE2, designated SEQ ID:14438 and SEQ ID:15089 respectively, to the nucleotide sequence of GAM7957 RNA, herein designated GAM RNA, also designated SEQ ID:297.

Another function of GAM7957 is therefore inhibition of LOC283778 (Accession XP_211199.1). Accordingly, utilities of GAM7957 include diagnosis, prevention and treatment of diseases and clinical conditions associated with LOC283778.

LOC283851 (Accession XP_211229.1) is another GAM7957 target gene, herein designated TARGET GENE. LOC283851 BINDING SITE is a target binding site found in the 3' untranslated region of mRNA encoded by LOC283851, corresponding to a target binding site such as BINDING SITE I, BINDING SITE II or BINDING SITE III of FIG. 8. Table 4 illustrates the complementarity of the nucleotide sequences of LOC283851 BINDING SITE, designated SEQ ID:16120, to the nucleotide sequence of GAM7957 RNA, herein designated GAM RNA, also designated SEQ ID:297.

Another function of GAM7957 is therefore inhibition of LOC283851 (Accession XP_211229.1). Accordingly, utilities of GAM7957 include diagnosis, prevention and treatment of diseases and clinical conditions associated with LOC283851.

LOC283863 (Accession XP_208875.1) is another GAM7957 target gene, herein designated TARGET GENE. LOC283863 BINDING SITE is a target binding site found in the 3' untranslated region of mRNA encoded by LOC283863, corresponding to a target binding site such as BINDING SITE I, BINDING SITE II or BINDING SITE III of FIG. 8. Table 4 illustrates the complementarity of the nucleotide sequences of LOC283863 BINDING SITE, designated SEQ ID:20057, to the nucleotide sequence of GAM7957 RNA, herein designated GAM RNA, also designated SEQ ID:297.

Another function of GAM7957 is therefore inhibition of LOC283863 (Accession XP_208875.1). Accordingly, utilities of GAM7957 include diagnosis, prevention and treatment of diseases and clinical conditions associated with LOC283863.

LOC283875 (Accession XP_211241.1) is another GAM7957 target gene, herein designated TARGET GENE. LOC283875 BINDING SITE is a target binding site found in the 3' untranslated region of mRNA encoded by LOC283875, corresponding to a target binding site such as BINDING SITE I, BINDING SITE II or BINDING SITE III of FIG. 8. Table 4 illustrates the complementarity of the nucleotide sequences of LOC283875 BINDING SITE, designated SEQ ID:8987, to the nucleotide sequence of GAM7957 RNA, herein designated GAM RNA, also designated SEQ ID:297.

Another function of GAM7957 is therefore inhibition of LOC283875 (Accession XP_211241.1). Accordingly, utilities of GAM7957 include diagnosis, prevention and treatment of diseases and clinical conditions associated with LOC283875.

LOC283889 (Accession XP_208899.1) is another GAM7957 target gene, herein designated TARGET GENE. LOC283889 BINDING SITE is a target binding site found in the 3' untranslated region of mRNA encoded by LOC283889, corresponding to a target binding site such as BINDING SITE I, BINDING SITE II or BINDING SITE III of FIG. 8. Table 4 illustrates the complementarity of the nucleotide sequences of LOC283889 BINDING SITE, designated SEQ ID:2881, to the nucleotide sequence of GAM7957 RNA, herein designated GAM RNA, also designated SEQ ID:297.

Another function of GAM7957 is therefore inhibition of LOC283889 (Accession XP_208899.1). Accordingly, utilities of GAM7957 include diagnosis, prevention and treatment of diseases and clinical conditions associated with LOC283889.

LOC283894 (Accession XP_211250.1) is another GAM7957 target gene, herein designated TARGET GENE. LOC283894 BINDING SITE is a target binding site found in the 3' untranslated region of mRNA encoded by LOC283894, corresponding to a target binding site such as BINDING SITE I, BINDING SITE II or BINDING SITE III of FIG. 8. Table 4 illustrates the complementarity of the nucleotide sequences of LOC283894 BINDING SITE, designated SEQ ID:9765, to the nucleotide sequence of GAM7957 RNA, herein designated GAM RNA, also designated SEQ ID:297.

Another function of GAM7957 is therefore inhibition of LOC283894 (Accession XP_211250.1). Accordingly, utilities of GAM7957 include diagnosis, prevention and treatment of diseases and clinical conditions associated with LOC283894.

LOC283909 (Accession XP_211256.1) is another GAM7957 target gene, herein designated TARGET GENE. LOC283909 BINDING SITE is a target binding site found in the 3' untranslated region of mRNA encoded by LOC283909, corresponding to a target binding site such as BINDING SITE I, BINDING SITE II or BINDING SITE III of FIG. 8. Table 4 illustrates the complementarity of the nucleotide sequences of LOC283909 BINDING SITE, designated SEQ ID:9765, to the nucleotide sequence of GAM7957 RNA, herein designated GAM RNA, also designated SEQ ID:297.

Another function of GAM7957 is therefore inhibition of LOC283909 (Accession XP_211256.1). Accordingly, utilities of GAM7957 include diagnosis, prevention and treatment of diseases and clinical conditions associated with LOC283909.

LOC283924 (Accession XP_208906.1) is another GAM7957 target gene, herein designated TARGET GENE. LOC283924 BINDING SITE1 and LOC283924 BINDING SITE2 are target binding sites found in untranslated regions of mRNA encoded by LOC283924, corresponding to target binding sites such as BINDING SITE I, BINDING SITE II or BINDING SITE III of FIG. 8. Table 4 illustrates the complementarity of the nucleotide sequences of LOC283924 BINDING SITE1 and LOC283924 BINDING SITE2, designated SEQ ID:4977 and SEQ ID:18690 respectively, to the nucleotide sequence of GAM7957 RNA, herein designated GAM RNA, also designated SEQ ID:297.

Another function of GAM7957 is therefore inhibition of LOC283924 (Accession XP_208906.1). Accordingly, utilities of GAM7957 include diagnosis, prevention and treatment of diseases and clinical conditions associated with LOC283924.

LOC283928 (Accession XP_208909.1) is another GAM7957 target gene, herein designated TARGET GENE.

LOC283928 BINDING SITE is a target binding site found in the 3' untranslated region of mRNA encoded by LOC283928, corresponding to a target binding site such as BINDING SITE I, BINDING SITE II or BINDING SITE III of FIG. 8. Table 4 illustrates the complementarity of the nucleotide sequences of LOC283928 BINDING SITE, designated SEQ ID:962, to the nucleotide sequence of GAM7957 RNA, herein designated GAM RNA, also designated SEQ ID:297.

Another function of GAM7957 is therefore inhibition of LOC283928 (Accession XP_208909.1). Accordingly, utilities of GAM7957 include diagnosis, prevention and treatment of diseases and clinical conditions associated with LOC283928.

LOC283929 (Accession XP_208905.2) is another GAM7957 target gene, herein designated TARGET GENE. LOC283929 BINDING SITE1 through LOC283929 BINDING SITE3 are target binding sites found in untranslated regions of mRNA encoded by LOC283929, corresponding to target binding sites such as BINDING SITE I, BINDING SITE II or BINDING SITE III of FIG. 8. Table 4 illustrates the complementarity of the nucleotide sequences of LOC283929 BINDING SITE1 through LOC283929 BINDING SITE3, designated SEQ ID:1734, SEQ ID:7877 and SEQ ID:9417 respectively, to the nucleotide sequence of GAM7957 RNA, herein designated GAM RNA, also designated SEQ ID:297.

Another function of GAM7957 is therefore inhibition of LOC283929 (Accession XP_208905.2). Accordingly, utilities of GAM7957 include diagnosis, prevention and treatment of diseases and clinical conditions associated with LOC283929.

LOC283932 (Accession NP_787097.1) is another GAM7957 target gene, herein designated TARGET GENE. LOC283932 BINDING SITE1 and LOC283932 BINDING SITE2 are target binding sites found in untranslated regions of mRNA encoded by LOC283932, corresponding to target binding sites such as BINDING SITE I, BINDING SITE II or BINDING SITE III of FIG. 8. Table 4 illustrates the complementarity of the nucleotide sequences of LOC283932 BINDING SITE1 and LOC283932 BINDING SITE2, designated SEQ ID:8956 and SEQ ID:6418 respectively, to the nucleotide sequence of GAM7957 RNA, herein designated GAM RNA, also designated SEQ ID:297.

Another function of GAM7957 is therefore inhibition of LOC283932 (Accession NP_787097.1). Accordingly, utilities of GAM7957 include diagnosis, prevention and treatment of diseases and clinical conditions associated with LOC283932.

LOC283949 (Accession XP_208928.1) is another GAM7957 target gene, herein designated TARGET GENE. LOC283949 BINDING SITE is a target binding site found in the 3' untranslated region of mRNA encoded by LOC283949, corresponding to a target binding site such as BINDING SITE I, BINDING SITE II or BINDING SITE III of FIG. 8. Table 4 illustrates the complementarity of the nucleotide sequences of LOC283949 BINDING SITE, designated SEQ ID:12303, to the nucleotide sequence of GAM7957 RNA, herein designated GAM RNA, also designated SEQ ID:297.

Another function of GAM7957 is therefore inhibition of LOC283949 (Accession XP_208928.1). Accordingly, utilities of GAM7957 include diagnosis, prevention and treatment of diseases and clinical conditions associated with LOC283949.

LOC283954 (Accession XP_208931.1) is another GAM7957 target gene, herein designated TARGET GENE. LOC283954 BINDING SITE is a target binding site found in the 3' untranslated region of mRNA encoded by LOC283954, corresponding to a target binding site such as BINDING SITE I, BINDING SITE II or BINDING SITE III of FIG. 8. Table 4 illustrates the complementarity of the nucleotide sequences of LOC283954 BINDING SITE, designated SEQ ID:18689, to the nucleotide sequence of GAM7957 RNA, herein designated GAM RNA, also designated SEQ ID:297.

Another function of GAM7957 is therefore inhibition of LOC283954 (Accession XP_208931.1). Accordingly, utilities of GAM7957 include diagnosis, prevention and treatment of diseases and clinical conditions associated with LOC283954.

LOC283972 (Accession XP_211282.1) is another GAM7957 target gene, herein designated TARGET GENE. LOC283972 BINDING SITE is a target binding site found in the 3' untranslated region of mRNA encoded by LOC283972, corresponding to a target binding site such as BINDING SITE I, BINDING SITE II or BINDING SITE III of FIG. 8. Table 4 illustrates the complementarity of the nucleotide sequences of LOC283972 BINDING SITE, designated SEQ ID:471, to the nucleotide sequence of GAM7957 RNA, herein designated GAM RNA, also designated SEQ ID:297.

Another function of GAM7957 is therefore inhibition of LOC283972 (Accession XP_211282.1). Accordingly, utilities of GAM7957 include diagnosis, prevention and treatment of diseases and clinical conditions associated with LOC283972.

LOC283981 (Accession XP_208941.1) is another GAM7957 target gene, herein designated TARGET GENE. LOC283981 BINDING SITE is a target binding site found in the 3' untranslated region of mRNA encoded by LOC283981, corresponding to a target binding site such as BINDING SITE I, BINDING SITE II or BINDING SITE III of FIG. 8. Table 4 illustrates the complementarity of the nucleotide sequences of LOC283981 BINDING SITE, designated SEQ ID:9983, to the nucleotide sequence of GAM7957 RNA, herein designated GAM RNA, also designated SEQ ID:297.

Another function of GAM7957 is therefore inhibition of LOC283981 (Accession XP_208941.1). Accordingly, utilities of GAM7957 include diagnosis, prevention and treatment of diseases and clinical conditions associated with LOC283981.

LOC283985 (Accession XP_208951.2) is another GAM7957 target gene, herein designated TARGET GENE. LOC283985 BINDING SITE is a target binding site found in the 3' untranslated region of multiple transcripts of mRNA encoded by LOC283985, corresponding to a target binding site such as BINDING SITE I, BINDING SITE II or BINDING SITE III of FIG. 8. Table 4 illustrates the complementarity of the nucleotide sequences of LOC283985 BINDING SITE, designated SEQ ID:15983, to the nucleotide sequence of GAM7957 RNA, herein designated GAM RNA, also designated SEQ ID:297.

Another function of GAM7957 is therefore inhibition of LOC283985 (Accession XP_208951.2). Accordingly, utilities of GAM7957 include diagnosis, prevention and treatment of diseases and clinical conditions associated with LOC283985.

LOC283985 (Accession NP_835229.1) is another GAM7957 target gene, herein designated TARGET GENE. LOC283985 BINDING SITE is a target binding site found in the 3' untranslated region of multiple transcripts of mRNA encoded by LOC283985, corresponding to a target binding site such as BINDING SITE I, BINDING SITE II or BINDING SITE III of FIG. 8. Table 4 illustrates the complementarity of the nucleotide sequences of LOC283985 BINDING SITE, designated SEQ ID:15983, to the nucleotide sequence of GAM7957 RNA, herein designated GAM RNA, also designated SEQ ID:297.

Another function of GAM7957 is therefore inhibition of LOC283985 (Accession NP_835229.1). Accordingly, utilities of GAM7957 include diagnosis, prevention and treatment of diseases and clinical conditions associated with LOC283985.

LOC283995 (Accession XP_208945.1) is another GAM7957 target gene, herein designated TARGET GENE. LOC283995 BINDING SITE is a target binding site found in the 3' untranslated region of mRNA encoded by LOC283995, corresponding to a target binding site such as BINDING SITE I, BINDING SITE II or BINDING SITE III of FIG. 8. Table 4 illustrates the complementarity of the nucleotide sequences of LOC283995 BINDING SITE, designated SEQ ID:11864, to the nucleotide sequence of GAM7957 RNA, herein designated GAM RNA, also designated SEQ ID:297.

Another function of GAM7957 is therefore inhibition of LOC283995 (Accession XP_208945.1). Accordingly, utilities of GAM7957 include diagnosis, prevention and treatment of diseases and clinical conditions associated with LOC283995.

LOC284001 (Accession XP_208958.2) is another GAM7957 target gene, herein designated TARGET GENE. LOC284001 BINDING SITE is a target binding site found in the 3' untranslated region of mRNA encoded by LOC284001, corresponding to a target binding site such as BINDING SITE I, BINDING SITE II or BINDING SITE III of FIG. 8. Table 4 illustrates the complementarity of the nucleotide sequences of LOC284001 BINDING SITE, designated SEQ ID:17795, to the nucleotide sequence of GAM7957 RNA, herein designated GAM RNA, also designated SEQ ID:297.

Another function of GAM7957 is therefore inhibition of LOC284001 (Accession XP_208958.2). Accordingly, utilities of GAM7957 include diagnosis, prevention and treatment of diseases and clinical conditions associated with LOC284001.

LOC284009 (Accession XP_211299.1) is another GAM7957 target gene, herein designated TARGET GENE. LOC284009 BINDING SITE is a target binding site found in the 5' untranslated region of mRNA encoded by LOC284009, corresponding to a target binding site such as BINDING SITE I, BINDING SITE II or BINDING SITE III of FIG. 8. Table 4 illustrates the complementarity of the nucleotide sequences of LOC284009 BINDING SITE, designated SEQ ID:12796, to the nucleotide sequence of GAM7957 RNA, herein designated GAM RNA, also designated SEQ ID:297.

Another function of GAM7957 is therefore inhibition of LOC284009 (Accession XP_211299.1). Accordingly, utilities of GAM7957 include diagnosis, prevention and treatment of diseases and clinical conditions associated with LOC284009.

LOC284014 (Accession XP_211300.2) is another GAM7957 target gene, herein designated TARGET GENE. LOC284014 BINDING SITE is a target binding site found in the 3' untranslated region of mRNA encoded by LOC284014, corresponding to a target binding site such as BINDING SITE I, BINDING SITE II or BINDING SITE III of FIG. 8. Table 4 illustrates the complementarity of the nucleotide sequences of LOC284014 BINDING SITE, designated SEQ ID:5830, to the nucleotide sequence of GAM7957 RNA, herein designated GAM RNA, also designated SEQ ID:297.

Another function of GAM7957 is therefore inhibition of LOC284014 (Accession XP_211300.2). Accordingly, utilities of GAM7957 include diagnosis, prevention and treatment of diseases and clinical conditions associated with LOC284014.

LOC284024 (Accession XP_208970.1) is another GAM7957 target gene, herein designated TARGET GENE. LOC284024 BINDING SITE is a target binding site found in the 3' untranslated region of mRNA encoded by LOC284024, corresponding to a target binding site such as BINDING SITE I, BINDING SITE II or BINDING SITE III of FIG. 8. Table 4 illustrates the complementarity of the nucleotide sequences of LOC284024 BINDING SITE, designated SEQ ID:9417, to the nucleotide sequence of GAM7957 RNA, herein designated GAM RNA, also designated SEQ ID:297.

Another function of GAM7957 is therefore inhibition of LOC284024 (Accession XP_208970.1). Accordingly, utilities of GAM7957 include diagnosis, prevention and treatment of diseases and clinical conditions associated with LOC284024.

LOC284031 (Accession XP_208982.1) is another GAM7957 target gene, herein designated TARGET GENE. LOC284031 BINDING SITE is a target binding site found in the 3' untranslated region of mRNA encoded by LOC284031, corresponding to a target binding site such as BINDING SITE I, BINDING SITE II or BINDING SITE III of FIG. 8. Table 4 illustrates the complementarity of the nucleotide sequences of LOC284031 BINDING SITE, designated SEQ ID:9422, to the nucleotide sequence of GAM7957 RNA, herein designated GAM RNA, also designated SEQ ID:297.

Another function of GAM7957 is therefore inhibition of LOC284031 (Accession XP_208982.1). Accordingly, utilities of GAM7957 include diagnosis, prevention and treatment of diseases and clinical conditions associated with LOC284031.

LOC284044 (Accession XP_211310.1) is another GAM7957 target gene, herein designated TARGET GENE. LOC284044 BINDING SITE is a target binding site found in the 3' untranslated region of mRNA encoded by LOC284044, corresponding to a target binding site such as BINDING SITE I, BINDING SITE II or BINDING SITE III of FIG. 8. Table 4 illustrates the complementarity of the nucleotide sequences of LOC284044 BINDING SITE, designated SEQ ID:723, to the nucleotide sequence of GAM7957 RNA, herein designated GAM RNA, also designated SEQ ID:297.

Another function of GAM7957 is therefore inhibition of LOC284044 (Accession XP_211310.1). Accordingly, utilities of GAM7957 include diagnosis, prevention and treatment of diseases and clinical conditions associated with LOC284044.

LOC284048 (Accession XP_208152.1) is another GAM7957 target gene, herein designated TARGET GENE. LOC284048 BINDING SITE is a target binding site found in the 3' untranslated region of mRNA encoded by LOC284048, corresponding to a target binding site such as BINDING SITE I, BINDING SITE II or BINDING SITE III of FIG. 8. Table 4 illustrates the complementarity of the nucleotide sequences of LOC284048 BINDING SITE, designated SEQ ID:12193, to the nucleotide sequence of GAM7957 RNA, herein designated GAM RNA, also designated SEQ ID:297.

Another function of GAM7957 is therefore inhibition of LOC284048 (Accession XP_208152.1). Accordingly, utilities of GAM7957 include diagnosis, prevention and treatment of diseases and clinical conditions associated with LOC284048.

LOC284062 (Accession XP_211316.1) is another GAM7957 target gene, herein designated TARGET GENE. LOC284062 BINDING SITE1 through LOC284062 BINDING SITE3 are target binding sites found in untranslated regions of mRNA encoded by LOC284062, corresponding to target binding sites such as BINDING SITE I, BINDING SITE II or BINDING SITE III of FIG. 8. Table 4 illustrates the complementarity of the nucleotide sequences of LOC284062 BINDING SITE1 through LOC284062 BINDING SITE3, designated SEQ ID:6320, SEQ ID:2483 and SEQ ID:8856 respectively, to the nucleotide sequence of GAM7957 RNA, herein designated GAM RNA, also designated SEQ ID:297.

Another function of GAM7957 is therefore inhibition of LOC284062 (Accession XP_211316.1). Accordingly, utilities of GAM7957 include diagnosis, prevention and treatment of diseases and clinical conditions associated with LOC284062.

LOC284072 (Accession XP_211319.1) is another GAM7957 target gene, herein designated TARGET GENE. LOC284072 BINDING SITE is a target binding site found in the 3' untranslated region of mRNA encoded by LOC284072, corresponding to a target binding site such as BINDING SITE I, BINDING SITE II or BINDING SITE III of FIG. 8. Table 4 illustrates the complementarity of the nucleotide sequences of LOC284072 BINDING SITE, designated SEQ ID:947, to the nucleotide sequence of GAM7957 RNA, herein designated GAM RNA, also designated SEQ ID:297.

Another function of GAM7957 is therefore inhibition of LOC284072 (Accession XP_211319.1). Accordingly, utilities of GAM7957 include diagnosis, prevention and treatment of diseases and clinical conditions associated with LOC284072.

LOC284074 (Accession XP_211321.1) is another GAM7957 target gene, herein designated TARGET GENE. LOC284074 BINDING SITE1 through LOC284074 BINDING SITE3 are target binding sites found in untranslated regions of mRNA encoded by LOC284074, corresponding to target binding sites such as BINDING SITE I, BINDING SITE II or BINDING SITE III of FIG. 8. Table 4 illustrates the complementarity of the nucleotide sequences of LOC284074 BINDING SITE1 through LOC284074 BINDING SITE3, designated SEQ ID:3337, SEQ ID:11071 and SEQ ID:1199 respectively, to the nucleotide sequence of GAM7957 RNA, herein designated GAM RNA, also designated SEQ ID:297.

Another function of GAM7957 is therefore inhibition of LOC284074 (Accession XP_211321.1). Accordingly, utilities of GAM7957 include diagnosis, prevention and treatment of diseases and clinical conditions associated with LOC284074.

LOC284101 (Accession XP_209019.1) is another GAM7957 target gene, herein designated TARGET GENE. LOC284101 BINDING SITE1 and LOC284101 BINDING SITE2 are target binding sites found in untranslated regions of mRNA encoded by LOC284101, corresponding to target binding sites such as BINDING SITE I, BINDING SITE II or BINDING SITE III of FIG. 8. Table 4 illustrates the complementarity of the nucleotide sequences of LOC284101 BINDING SITE1 and LOC284101 BINDING SITE2, designated SEQ ID:13155 and SEQ ID:8019 respectively, to the nucleotide sequence of GAM7957 RNA, herein designated GAM RNA, also designated SEQ ID:297.

Another function of GAM7957 is therefore inhibition of LOC284101 (Accession XP_209019.1). Accordingly, utilities of GAM7957 include diagnosis, prevention and treatment of diseases and clinical conditions associated with LOC284101.

LOC284102 (Accession XP_211327.3) is another GAM7957 target gene, herein designated TARGET GENE. LOC284102 BINDING SITE is a target binding site found in the 5' untranslated region of mRNA encoded by LOC284102, corresponding to a target binding site such as BINDING SITE I, BINDING SITE II or BINDING SITE III of FIG. 8. Table 4 illustrates the complementarity of the nucleotide sequences of LOC284102 BINDING SITE, designated SEQ ID:10901, to the nucleotide sequence of GAM7957 RNA, herein designated GAM RNA, also designated SEQ ID:297.

Another function of GAM7957 is therefore inhibition of LOC284102 (Accession XP_211327.3). Accordingly, utilities of GAM7957 include diagnosis, prevention and treatment of diseases and clinical conditions associated with LOC284102.

LOC284121 (Accession XP_209026.1) is another GAM7957 target gene, herein designated TARGET GENE. LOC284121 BINDING SITE is a target binding site found in the 3' untranslated region of mRNA encoded by LOC284121, corresponding to a target binding site such as BINDING SITE I, BINDING SITE II or BINDING SITE III of FIG. 8. Table 4 illustrates the complementarity of the nucleotide sequences of LOC284121 BINDING SITE, designated SEQ ID:4377, to the nucleotide sequence of GAM7957 RNA, herein designated GAM RNA, also designated SEQ ID:297.

Another function of GAM7957 is therefore inhibition of LOC284121 (Accession XP_209026.1). Accordingly, utilities of GAM7957 include diagnosis, prevention and treatment of diseases and clinical conditions associated with LOC284121.

LOC284145 (Accession XP_211353.1) is another GAM7957 target gene, herein designated TARGET GENE. LOC284145 BINDING SITE is a target binding site found in the 3' untranslated region of mRNA encoded by LOC284145, corresponding to a target binding site such as BINDING SITE I, BINDING SITE II or BINDING SITE III of FIG. 8. Table 4 illustrates the complementarity of the nucleotide sequences of LOC284145 BINDING SITE, designated SEQ ID:5042, to the nucleotide sequence of GAM7957 RNA, herein designated GAM RNA, also designated SEQ ID:297.

Another function of GAM7957 is therefore inhibition of LOC284145 (Accession XP_211353.1). Accordingly, utilities of GAM7957 include diagnosis, prevention and treatment of diseases and clinical conditions associated with LOC284145.

LOC284155 (Accession XP_211354.1) is another GAM7957 target gene, herein designated TARGET GENE. LOC284155 BINDING SITE is a target binding site found in the 5' untranslated region of mRNA encoded by LOC284155, corresponding to a target binding site such as BINDING SITE I, BINDING SITE II or BINDING SITE III of FIG. 8. Table 4 illustrates the complementarity of the nucleotide sequences of LOC284155 BINDING SITE, designated SEQ ID:12886, to the nucleotide sequence of GAM7957 RNA, herein designated GAM RNA, also designated SEQ ID:297.

Another function of GAM7957 is therefore inhibition of LOC284155 (Accession XP_211354.1). Accordingly, utilities of GAM7957 include diagnosis, prevention and treatment of diseases and clinical conditions associated with LOC284155.

LOC284158 (Accession XP_209041.1) is another GAM7957 target gene, herein designated TARGET GENE. LOC284158 BINDING SITE1 and LOC284158 BINDING SITE2 are target binding sites found in untranslated regions of mRNA encoded by LOC284158, corresponding to target binding sites such as BINDING SITE I, BINDING SITE II or BINDING SITE III of FIG. 8. Table 4 illustrates the complementarity of the nucleotide sequences of LOC284158 BINDING SITE1 and LOC284158 BINDING SITE2, designated SEQ ID:1163 and SEQ ID:3397 respectively, to the nucleotide sequence of GAM7957 RNA, herein designated GAM RNA, also designated SEQ ID:297.

Another function of GAM7957 is therefore inhibition of LOC284158 (Accession XP_209041.1). Accordingly, utilities of GAM7957 include diagnosis, prevention and treatment of diseases and clinical conditions associated with LOC284158.

LOC284161 (Accession XP_209047.2) is another GAM7957 target gene, herein designated TARGET GENE. LOC284161 BINDING SITE is a target binding site found in the 3' untranslated region of mRNA encoded by LOC284161, corresponding to a target binding site such as BINDING SITE I, BINDING SITE II or BINDING SITE III of FIG. 8. Table 4 illustrates the complementarity of the nucleotide sequences of LOC284161 BINDING SITE, designated SEQ ID:19278, to the nucleotide sequence of GAM7957 RNA, herein designated GAM RNA, also designated SEQ ID:297.

Another function of GAM7957 is therefore inhibition of LOC284161 (Accession XP_209047.2). Accordingly, utilities of GAM7957 include diagnosis, prevention and treatment of diseases and clinical conditions associated with LOC284161.

LOC284170 (Accession XP_211357.1) is another GAM7957 target gene, herein designated TARGET GENE. LOC284170 BINDING SITE is a target binding site found in the 5' untranslated region of mRNA encoded by LOC284170, corresponding to a target binding site such as BINDING SITE I, BINDING SITE II or BINDING SITE III of FIG. 8. Table 4 illustrates the complementarity of the nucleotide sequences of LOC284170 BINDING SITE, designated SEQ ID:18300, to the nucleotide sequence of GAM7957 RNA, herein designated GAM RNA, also designated SEQ ID:297.

Another function of GAM7957 is therefore inhibition of LOC284170 (Accession XP_211357.1). Accordingly, utilities of GAM7957 include diagnosis, prevention and treatment of diseases and clinical conditions associated with LOC284170.

LOC284174 (Accession XP_211363.1) is another GAM7957 target gene, herein designated TARGET GENE. LOC284174 BINDING SITE is a target binding site found in the 5' untranslated region of mRNA encoded by LOC284174, corresponding to a target binding site such as BINDING SITE I, BINDING SITE II or BINDING SITE III of FIG. 8. Table 4 illustrates the complementarity of the nucleotide sequences of LOC284174 BINDING SITE, designated SEQ ID:6740, to the nucleotide sequence of GAM7957 RNA, herein designated GAM RNA, also designated SEQ ID:297.

Another function of GAM7957 is therefore inhibition of LOC284174 (Accession XP_211363.1). Accordingly, utilities of GAM7957 include diagnosis, prevention and treatment of diseases and clinical conditions associated with LOC284174.

LOC284179 (Accession XP_211369.1) is another GAM7957 target gene, herein designated TARGET GENE. LOC284179 BINDING SITE is a target binding site found in the 3' untranslated region of mRNA encoded by LOC284179, corresponding to a target binding site such as BINDING SITE I, BINDING SITE II or BINDING SITE III of FIG. 8. Table 4 illustrates the complementarity of the nucleotide sequences of LOC284179 BINDING SITE, designated SEQ ID:11754, to the nucleotide sequence of GAM7957 RNA, herein designated GAM RNA, also designated SEQ ID:297.

Another function of GAM7957 is therefore inhibition of LOC284179 (Accession XP_211369.1). Accordingly, utilities of GAM7957 include diagnosis, prevention and treatment of diseases and clinical conditions associated with LOC284179.

LOC284181 (Accession XP_209061.1) is another GAM7957 target gene, herein designated TARGET GENE. LOC284181 BINDING SITE1 and LOC284181 BINDING SITE2 are target binding sites found in untranslated regions of mRNA encoded by LOC284181, corresponding to target binding sites such as BINDING SITE I, BINDING SITE II or BINDING SITE III of FIG. 8. Table 4 illustrates the complementarity of the nucleotide sequences of LOC284181 BINDING SITE1 and LOC284181 BINDING SITE2, designated SEQ ID:14790 and SEQ ID:7321 respectively, to the nucleotide sequence of GAM7957 RNA, herein designated GAM RNA, also designated SEQ ID:297.

Another function of GAM7957 is therefore inhibition of LOC284181 (Accession XP_209061.1). Accordingly, utilities of GAM7957 include diagnosis, prevention and treatment of diseases and clinical conditions associated with LOC284181.

LOC284183 (Accession XP_209059.1) is another GAM7957 target gene, herein designated TARGET GENE. LOC284183 BINDING SITE is a target binding site found in the 3' untranslated region of mRNA encoded by LOC284183, corresponding to a target binding site such as BINDING SITE I, BINDING SITE II or BINDING SITE III of FIG. 8. Table 4 illustrates the complementarity of the nucleotide sequences of LOC284183 BINDING SITE, designated SEQ ID:19195, to the nucleotide sequence of GAM7957 RNA, herein designated GAM RNA, also designated SEQ ID:297.

Another function of GAM7957 is therefore inhibition of LOC284183 (Accession XP_209059.1). Accordingly, utilities of GAM7957 include diagnosis, prevention and treatment of diseases and clinical conditions associated with LOC284183.

LOC284187 (Accession XP_211366.2) is another GAM7957 target gene, herein designated TARGET GENE. LOC284187 BINDING SITE1 through LOC284187 BINDING SITE3 are target binding sites found in untranslated regions of mRNA encoded by LOC284187, corresponding to target binding sites such as BINDING SITE I, BINDING SITE II or BINDING SITE III of FIG. 8. Table 4 illustrates the complementarity of the nucleotide sequences of LOC284187 BINDING SITE1 through LOC284187 BINDING SITE3, designated SEQ ID:5070, SEQ ID:19057 and SEQ ID:12259 respectively, to the nucleotide sequence of GAM7957 RNA, herein designated GAM RNA, also designated SEQ ID:297.

Another function of GAM7957 is therefore inhibition of LOC284187 (Accession XP_211366.2). Accordingly, utilities of GAM7957 include diagnosis, prevention and treatment of diseases and clinical conditions associated with LOC284187.

LOC284198 (Accession XP_211380.1) is another GAM7957 target gene, herein designated TARGET GENE. LOC284198 BINDING SITE is a target binding site found in the 5' untranslated region of mRNA encoded by LOC284198, corresponding to a target binding site such as BINDING SITE I, BINDING SITE II or BINDING SITE III of FIG. 8. Table 4 illustrates the complementarity of the nucleotide sequences of LOC284198 BINDING SITE, designated SEQ ID:4105, to the nucleotide sequence of GAM7957 RNA, herein designated GAM RNA, also designated SEQ ID:297.

Another function of GAM7957 is therefore inhibition of LOC284198 (Accession XP_211380.1). Accordingly, utilities of GAM7957 include diagnosis, prevention and treatment of diseases and clinical conditions associated with LOC284198.

LOC284211 (Accession XP_211386.1) is another GAM7957 target gene, herein designated TARGET GENE. LOC284211 BINDING SITE is a target binding site found in the 3' untranslated region of mRNA encoded by LOC284211, corresponding to a target binding site such as BINDING SITE I, BINDING SITE II or BINDING SITE III of FIG. 8. Table 4 illustrates the complementarity of the nucleotide sequences of LOC284211 BINDING SITE, designated SEQ ID:16896, to the nucleotide sequence of GAM7957 RNA, herein designated GAM RNA, also designated SEQ ID:297.

Another function of GAM7957 is therefore inhibition of LOC284211 (Accession XP_211386.1). Accordingly, utilities of GAM7957 include diagnosis, prevention and treatment of diseases and clinical conditions associated with LOC284211.

LOC284259 (Accession XP_211410.1) is another GAM7957 target gene, herein designated TARGET GENE. LOC284259 BINDING SITE is a target binding site found in the 3' untranslated region of mRNA encoded by LOC284259, corresponding to a target binding site such as BINDING SITE I, BINDING SITE II or BINDING SITE III of FIG. 8. Table 4 illustrates the complementarity of the nucleotide sequences of LOC284259 BINDING SITE, designated SEQ ID:11749, to the nucleotide sequence of GAM7957 RNA, herein designated GAM RNA, also designated SEQ ID:297.

Another function of GAM7957 is therefore inhibition of LOC284259 (Accession XP_211410.1). Accordingly, utilities of GAM7957 include diagnosis, prevention and treatment of diseases and clinical conditions associated with LOC284259.

LOC284266 (Accession XP_211403.1) is another GAM7957 target gene, herein designated TARGET GENE. LOC284266 BINDING SITE1 and LOC284266 BINDING SITE2 are target binding sites found in untranslated regions of mRNA encoded by LOC284266, corresponding to target binding sites such as BINDING SITE I, BINDING SITE II or BINDING SITE III of FIG. 8. Table 4 illustrates the complementarity of the nucleotide sequences of LOC284266 BINDING SITE1 and LOC284266 BINDING SITE2, designated SEQ ID:17403 and SEQ ID:1030 respectively, to the nucleotide sequence of GAM7957 RNA, herein designated GAM RNA, also designated SEQ ID:297.

Another function of GAM7957 is therefore inhibition of LOC284266 (Accession XP_211403.1). Accordingly, utilities of GAM7957 include diagnosis, prevention and treatment of diseases and clinical conditions associated with LOC284266.

LOC284267 (Accession XP_211411.1) is another GAM7957 target gene, herein designated TARGET GENE. LOC284267 BINDING SITE is a target binding site found in the 3' untranslated region of mRNA encoded by LOC284267, corresponding to a target binding site such as BINDING SITE I, BINDING SITE II or BINDING SITE III of FIG. 8. Table 4 illustrates the complementarity of the nucleotide sequences of LOC284267 BINDING SITE, designated SEQ ID:19637, to the nucleotide sequence of GAM7957 RNA, herein designated GAM RNA, also designated SEQ ID:297.

Another function of GAM7957 is therefore inhibition of LOC284267 (Accession XP_211411.1). Accordingly, utilities of GAM7957 include diagnosis, prevention and treatment of diseases and clinical conditions associated with LOC284267.

LOC284280 (Accession XP_211416.1) is another GAM7957 target gene, herein designated TARGET GENE. LOC284280 BINDING SITE is a target binding site found in the 5' untranslated region of mRNA encoded by LOC284280, corresponding to a target binding site such as BINDING SITE I, BINDING SITE II or BINDING SITE III of FIG. 8. Table 4 illustrates the complementarity of the nucleotide sequences of LOC284280 BINDING SITE, designated SEQ ID:7322, to the nucleotide sequence of GAM7957 RNA, herein designated GAM RNA, also designated SEQ ID:297.

Another function of GAM7957 is therefore inhibition of LOC284280 (Accession XP_211416.1). Accordingly, utilities of GAM7957 include diagnosis, prevention and treatment of diseases and clinical conditions associated with LOC284280.

LOC284304 (Accession XP_211426.1) is another GAM7957 target gene, herein designated TARGET GENE. LOC284304 BINDING SITE is a target binding site found in the 3' untranslated region of mRNA encoded by LOC284304, corresponding to a target binding site such as BINDING SITE I, BINDING SITE II or BINDING SITE III of FIG. 8. Table 4 illustrates the complementarity of the nucleotide sequences of LOC284304 BINDING SITE, designated SEQ ID:13066, to the nucleotide sequence of GAM7957 RNA, herein designated GAM RNA, also designated SEQ ID:297.

Another function of GAM7957 is therefore inhibition of LOC284304 (Accession XP_211426.1). Accordingly, utilities of GAM7957 include diagnosis, prevention and treatment of diseases and clinical conditions associated with LOC284304.

LOC284311 (Accession XP_302720.1) is another GAM7957 target gene, herein designated TARGET GENE. LOC284311 BINDING SITE is a target binding site found in the 3' untranslated region of mRNA encoded by LOC284311, corresponding to a target binding site such as BINDING SITE I, BINDING SITE II or BINDING SITE III of FIG. 8. Table 4 illustrates the complementarity of the nucleotide sequences of LOC284311 BINDING SITE, designated SEQ ID:14092, to the nucleotide sequence of GAM7957 RNA, herein designated GAM RNA, also designated SEQ ID:297.

Another function of GAM7957 is therefore inhibition of LOC284311 (Accession XP_302720.1). Accordingly, utilities of GAM7957 include diagnosis, prevention and treatment of diseases and clinical conditions associated with LOC284311.

LOC284313 (Accession XP_209116.1) is another GAM7957 target gene, herein designated TARGET GENE. LOC284313 BINDING SITE is a target binding site found in the 3' untranslated region of mRNA encoded by LOC284313, corresponding to a target binding site such as BINDING SITE I, BINDING SITE II or BINDING SITE III of FIG. 8. Table 4 illustrates the complementarity of the nucleotide sequences of LOC284313 BINDING SITE, designated SEQ ID:12307, to the nucleotide sequence of GAM7957 RNA, herein designated GAM RNA, also designated SEQ ID:297.

Another function of GAM7957 is therefore inhibition of LOC284313 (Accession XP_209116.1). Accordingly, utilities of GAM7957 include diagnosis, prevention and treatment of diseases and clinical conditions associated with LOC284313.

LOC284318 (Accession XP_209149.1) is another GAM7957 target gene, herein designated TARGET GENE. LOC284318 BINDING SITE is a target binding site found in the 3' untranslated region of mRNA encoded by LOC284318, corresponding to a target binding site such as BINDING SITE I, BINDING SITE II or BINDING SITE III of FIG. 8. Table 4 illustrates the complementarity of the nucleotide sequences of LOC284318 BINDING SITE, designated SEQ ID:13433, to the nucleotide sequence of GAM7957 RNA, herein designated GAM RNA, also designated SEQ ID:297.

Another function of GAM7957 is therefore inhibition of LOC284318 (Accession XP_209149.1). Accordingly, utilities of GAM7957 include diagnosis, prevention and treatment of diseases and clinical conditions associated with LOC284318.

LOC284347 (Accession XP_209120.1) is another GAM7957 target gene, herein designated TARGET GENE. LOC284347 BINDING SITE is a target binding site found in the 5' untranslated region of mRNA encoded by LOC284347, corresponding to a target binding site such as BINDING SITE I, BINDING SITE II or BINDING SITE III of FIG. 8. Table 4 illustrates the complementarity of the nucleotide sequences of LOC284347 BINDING SITE, designated SEQ ID:698, to the nucleotide sequence of GAM7957 RNA, herein designated GAM RNA, also designated SEQ ID:297.

Another function of GAM7957 is therefore inhibition of LOC284347 (Accession XP_209120.1). Accordingly, utilities of GAM7957 include diagnosis, prevention and treatment of diseases and clinical conditions associated with LOC284347.

LOC284371 (Accession XP_209155.1) is another GAM7957 target gene, herein designated TARGET GENE. LOC284371 BINDING SITE is a target binding site found in the 3' untranslated region of mRNA encoded by LOC284371, corresponding to a target binding site such as BINDING SITE I, BINDING SITE II or BINDING SITE III of FIG. 8. Table 4 illustrates the complementarity of the nucleotide sequences of LOC284371 BINDING SITE, designated SEQ ID:15609, to the nucleotide sequence of GAM7957 RNA, herein designated GAM RNA, also designated SEQ ID:297.

Another function of GAM7957 is therefore inhibition of LOC284371 (Accession XP_209155.1). Accordingly, utilities of GAM7957 include diagnosis, prevention and treatment of diseases and clinical conditions associated with LOC284371.

LOC284376 (Accession XP_209157.1) is another GAM7957 target gene, herein designated TARGET GENE. LOC284376 BINDING SITE is a target binding site found in the 3' untranslated region of mRNA encoded by LOC284376, corresponding to a target binding site such as BINDING SITE I, BINDING SITE II or BINDING SITE III of FIG. 8. Table 4 illustrates the complementarity of the nucleotide sequences of LOC284376 BINDING SITE, designated SEQ ID:7223, to the nucleotide sequence of GAM7957 RNA, herein designated GAM RNA, also designated SEQ ID:297.

Another function of GAM7957 is therefore inhibition of LOC284376 (Accession XP_209157.1). Accordingly, utilities of GAM7957 include diagnosis, prevention and treatment of diseases and clinical conditions associated with LOC284376.

LOC284407 (Accession XP_209185.1) is another GAM7957 target gene, herein designated TARGET GENE. LOC284407 BINDING SITE1 through LOC284407 BINDING SITE4 are target binding sites found in untranslated regions of mRNA encoded by LOC284407, corresponding to target binding sites such as BINDING SITE I, BINDING SITE II or BINDING SITE III of FIG. 8. Table 4 illustrates the complementarity of the nucleotide sequences of LOC284407 BINDING SITE1 through LOC284407 BINDING SITE4, designated SEQ ID:9857, SEQ ID:5830, SEQ ID:9066 and SEQ ID:5831 respectively, to the nucleotide sequence of GAM7957 RNA, herein designated GAM RNA, also designated SEQ ID:297.

Another function of GAM7957 is therefore inhibition of LOC284407 (Accession XP_209185.1). Accordingly, utilities of GAM7957 include diagnosis, prevention and treatment of diseases and clinical conditions associated with LOC284407.

LOC284410 (Accession XP_211449.1) is another GAM7957 target gene, herein designated TARGET GENE. LOC284410 BINDING SITE is a target binding site found in the 3' untranslated region of mRNA encoded by LOC284410, corresponding to a target binding site such as BINDING SITE I, BINDING SITE II or BINDING SITE III of FIG. 8. Table 4 illustrates the complementarity of the nucleotide sequences of LOC284410 BINDING SITE, designated SEQ ID:9500, to the nucleotide sequence of GAM7957 RNA, herein designated GAM RNA, also designated SEQ ID:297.

Another function of GAM7957 is therefore inhibition of LOC284410 (Accession XP_211449.1). Accordingly, utilities of GAM7957 include diagnosis, prevention and treatment of diseases and clinical conditions associated with LOC284410.

LOC284412 (Accession XP_209184.1) is another GAM7957 target gene, herein designated TARGET GENE. LOC284412 BINDING SITE is a target binding site found in the 5' untranslated region of mRNA encoded by LOC284412, corresponding to a target binding site such as BINDING SITE I, BINDING SITE II or BINDING SITE III of FIG. 8. Table 4 illustrates the complementarity of the nucleotide sequences of LOC284412 BINDING SITE, designated SEQ ID:9777, to the nucleotide sequence of GAM7957 RNA, herein designated GAM RNA, also designated SEQ ID:297.

Another function of GAM7957 is therefore inhibition of LOC284412 (Accession XP_209184.1). Accordingly, utilities of GAM7957 include diagnosis, prevention and treatment of diseases and clinical conditions associated with LOC284412.

LOC284417 (Accession XP_209187.1) is another GAM7957 target gene, herein designated TARGET GENE. LOC284417 BINDING SITE1 and LOC284417 BINDING SITE2 are target binding sites found in untranslated regions of mRNA encoded by LOC284417, corresponding to target binding sites such as BINDING SITE I, BINDING SITE II or BINDING SITE III of FIG. 8. Table 4 illustrates the complementarity of the nucleotide sequences of LOC284417 BINDING SITE1 and LOC284417 BINDING SITE2, designated SEQ ID:3681 and SEQ ID:17423 respectively, to the nucleotide sequence of GAM7957 RNA, herein designated GAM RNA, also designated SEQ ID:297.

Another function of GAM7957 is therefore inhibition of LOC284417 (Accession XP_209187.1). Accordingly, utilities of GAM7957 include diagnosis, prevention and treatment of diseases and clinical conditions associated with LOC284417.

LOC284419 (Accession XP_209193.1) is another GAM7957 target gene, herein designated TARGET GENE. LOC284419 BINDING SITE is a target binding site found in the 3' untranslated region of mRNA encoded by LOC284419, corresponding to a target binding site such as BINDING SITE I, BINDING SITE II or BINDING SITE III of FIG. 8. Table 4 illustrates the complementarity of the nucleotide sequences of LOC284419 BINDING SITE, designated SEQ ID:15017, to the nucleotide sequence of GAM7957 RNA, herein designated GAM RNA, also designated SEQ ID:297.

Another function of GAM7957 is therefore inhibition of LOC284419 (Accession XP_209193.1). Accordingly, utilities of GAM7957 include diagnosis, prevention and treatment of diseases and clinical conditions associated with LOC284419.

LOC284434 (Accession XP_211460.1) is another GAM7957 target gene, herein designated TARGET GENE. LOC284434 BINDING SITE1 and LOC284434 BINDING SITE2 are target binding sites found in untranslated regions of mRNA encoded by LOC284434, corresponding to target binding sites such as BINDING SITE I, BINDING SITE II or BINDING SITE III of FIG. 8. Table 4 illustrates the complementarity of the nucleotide sequences of LOC284434 BINDING SITE1 and LOC284434 BINDING SITE2, designated SEQ ID:18690 and SEQ ID:9421 respectively, to the nucleotide sequence of GAM7957 RNA, herein designated GAM RNA, also designated SEQ ID:297.

Another function of GAM7957 is therefore inhibition of LOC284434 (Accession XP_211460.1). Accordingly, utilities of GAM7957 include diagnosis, prevention and treatment of diseases and clinical conditions associated with LOC284434.

LOC284444 (Accession XP_209209.1) is another GAM7957 target gene, herein designated TARGET GENE. LOC284444 BINDING SITE is a target binding site found in the 3' untranslated region of mRNA encoded by LOC284444, corresponding to a target binding site such as BINDING SITE I, BINDING SITE II or BINDING SITE III of FIG. 8. Table 4 illustrates the complementarity of the nucleotide sequences of LOC284444 BINDING SITE, designated SEQ ID:11942, to the nucleotide sequence of GAM7957 RNA, herein designated GAM RNA, also designated SEQ ID:297.

Another function of GAM7957 is therefore inhibition of LOC284444 (Accession XP_209209.1). Accordingly, utilities of GAM7957 include diagnosis, prevention and treatment of diseases and clinical conditions associated with LOC284444.

LOC284486 (Accession XP_209231.1) is another GAM7957 target gene, herein designated TARGET GENE. LOC284486 BINDING SITE is a target binding site found in the 3' untranslated region of mRNA encoded by LOC284486, corresponding to a target binding site such as BINDING SITE I, BINDING SITE II or BINDING SITE III of FIG. 8. Table 4 illustrates the complementarity of the nucleotide sequences of LOC284486 BINDING SITE, designated SEQ ID:19196, to the nucleotide sequence of GAM7957 RNA, herein designated GAM RNA, also designated SEQ ID:297.

Another function of GAM7957 is therefore inhibition of LOC284486 (Accession XP_209231.1). Accordingly, utilities of GAM7957 include diagnosis, prevention and treatment of diseases and clinical conditions associated with LOC284486.

LOC284514 (Accession XP_209244.1) is another GAM7957 target gene, herein designated TARGET GENE. LOC284514 BINDING SITE is a target binding site found in the 3' untranslated region of mRNA encoded by LOC284514, corresponding to a target binding site such as BINDING SITE I, BINDING SITE II or BINDING SITE III of FIG. 8. Table 4 illustrates the complementarity of the nucleotide sequences of LOC284514 BINDING SITE, designated SEQ ID:15933, to the nucleotide sequence of GAM7957 RNA, herein designated GAM RNA, also designated SEQ ID:297.

Another function of GAM7957 is therefore inhibition of LOC284514 (Accession XP_209244.1). Accordingly, utilities of GAM7957 include diagnosis, prevention and treatment of diseases and clinical conditions associated with LOC284514.

LOC284542 (Accession XP_209254.1) is another GAM7957 target gene, herein designated TARGET GENE. LOC284542 BINDING SITE is a target binding site found in the 5' untranslated region of mRNA encoded by LOC284542, corresponding to a target binding site such as BINDING SITE I, BINDING SITE II or BINDING SITE III of FIG. 8. Table 4 illustrates the complementarity of the nucleotide sequences of LOC284542 BINDING SITE, designated SEQ ID:19461, to the nucleotide sequence of GAM7957 RNA, herein designated GAM RNA, also designated SEQ ID:297.

Another function of GAM7957 is therefore inhibition of LOC284542 (Accession XP_209254.1). Accordingly, utilities of GAM7957 include diagnosis, prevention and treatment of diseases and clinical conditions associated with LOC284542.

LOC284557 (Accession XP_209256.1) is another GAM7957 target gene, herein designated TARGET GENE. LOC284557 BINDING SITE is a target binding site found in the 5' untranslated region of mRNA encoded by LOC284557, corresponding to a target binding site such as BINDING SITE I, BINDING SITE II or BINDING SITE III of FIG. 8. Table 4 illustrates the complementarity of the nucleotide sequences of LOC284557 BINDING SITE, designated SEQ ID:7964, to the nucleotide sequence of GAM7957 RNA, herein designated GAM RNA, also designated SEQ ID:297.

Another function of GAM7957 is therefore inhibition of LOC284557 (Accession XP_209256.1). Accordingly, utilities of GAM7957 include diagnosis, prevention and treatment of diseases and clinical conditions associated with LOC284557.

LOC284574 (Accession XP_211527.1) is another GAM7957 target gene, herein designated TARGET GENE. LOC284574 BINDING SITE is a target binding site found in the 3' untranslated region of mRNA encoded by LOC284574, corresponding to a target binding site such as BINDING SITE I, BINDING SITE II or BINDING SITE III of FIG. 8. Table 4 illustrates the complementarity of the nucleotide sequences of LOC284574 BINDING SITE, designated SEQ ID:8381, to the nucleotide sequence of GAM7957 RNA, herein designated GAM RNA, also designated SEQ ID:297.

Another function of GAM7957 is therefore inhibition of LOC284574 (Accession XP_211527.1). Accordingly, utilities of GAM7957 include diagnosis, prevention and treatment of diseases and clinical conditions associated with LOC284574.

LOC284577 (Accession XP_211522.1) is another GAM7957 target gene, herein designated TARGET GENE. LOC284577 BINDING SITE is a target binding site found in the 3' untranslated region of mRNA encoded by LOC284577, corresponding to a target binding site such as BINDING SITE I, BINDING SITE II or BINDING SITE III of FIG. 8. Table 4 illustrates the complementarity of the nucleotide sequences of LOC284577 BINDING SITE, designated SEQ ID:15308, to the nucleotide sequence of GAM7957 RNA, herein designated GAM RNA, also designated SEQ ID:297.

Another function of GAM7957 is therefore inhibition of LOC284577 (Accession XP_211522.1). Accordingly, utilities of GAM7957 include diagnosis, prevention and treatment of diseases and clinical conditions associated with LOC284577.

LOC284600 (Accession XP_211548.1) is another GAM7957 target gene, herein designated TARGET GENE. LOC284600 BINDING SITE1 and LOC284600 BINDING SITE2 are target binding sites found in untranslated regions of mRNA encoded by LOC284600, corresponding to target binding sites such as BINDING SITE I, BINDING SITE II or BINDING SITE III of FIG. 8. Table 4 illustrates the complementarity of the nucleotide sequences of LOC284600 BINDING SITE1 and LOC284600 BINDING SITE2, designated SEQ ID:1244 and SEQ ID:16341 respectively, to the nucleotide sequence of GAM7957 RNA, herein designated GAM RNA, also designated SEQ ID:297.

Another function of GAM7957 is therefore inhibition of LOC284600 (Accession XP_211548.1). Accordingly, utilities of GAM7957 include diagnosis, prevention and treatment of diseases and clinical conditions associated with LOC284600.

LOC284628 (Accession XP_211561.1) is another GAM7957 target gene, herein designated TARGET GENE. LOC284628 BINDING SITE1 and LOC284628 BINDING SITE2 are target binding sites found in untranslated regions of mRNA encoded by LOC284628, corresponding to target binding sites such as BINDING SITE I, BINDING SITE II or BINDING SITE III of FIG. 8. Table 4 illustrates the complementarity of the nucleotide sequences of LOC284628 BINDING SITE1 and LOC284628 BINDING SITE2, designated SEQ ID:14786 and SEQ ID:9474 respectively, to the nucleotide sequence of GAM7957 RNA, herein designated GAM RNA, also designated SEQ ID:297.

Another function of GAM7957 is therefore inhibition of LOC284628 (Accession XP_211561.1). Accordingly, utilities of GAM7957 include diagnosis, prevention and treatment of diseases and clinical conditions associated with LOC284628.

LOC284630 (Accession XP_211562.1) is another GAM7957 target gene, herein designated TARGET GENE. LOC284630 BINDING SITE is a target binding site found in the 5' untranslated region of mRNA encoded by LOC284630, corresponding to a target binding site such as BINDING SITE I, BINDING SITE II or BINDING SITE III of FIG. 8. Table 4 illustrates the complementarity of the nucleotide sequences of LOC284630 BINDING SITE, designated SEQ ID:9946, to the nucleotide sequence of GAM7957 RNA, herein designated GAM RNA, also designated SEQ ID:297.

Another function of GAM7957 is therefore inhibition of LOC284630 (Accession XP_211562.1). Accordingly, utilities of GAM7957 include diagnosis, prevention and treatment of diseases and clinical conditions associated with LOC284630.

LOC284639 (Accession XP_211567.1) is another GAM7957 target gene, herein designated TARGET GENE. LOC284639 BINDING SITE is a target binding site found in the 3' untranslated region of mRNA encoded by LOC284639, corresponding to a target binding site such as BINDING SITE I, BINDING SITE II or BINDING SITE III of FIG. 8. Table 4 illustrates the complementarity of the nucleotide sequences of LOC284639 BINDING SITE, designated SEQ ID:17403, to the nucleotide sequence of GAM7957 RNA, herein designated GAM RNA, also designated SEQ ID:297.

Another function of GAM7957 is therefore inhibition of LOC284639 (Accession XP_211567.1). Accordingly, utilities of GAM7957 include diagnosis, prevention and treatment of diseases and clinical conditions associated with LOC284639.

LOC284650 (Accession XP_211571.1) is another GAM7957 target gene, herein designated TARGET GENE. LOC284650 BINDING SITE is a target binding site found in the 5' untranslated region of mRNA encoded by LOC284650, corresponding to a target binding site such as BINDING SITE I, BINDING SITE II or BINDING SITE III of FIG. 8. Table 4 illustrates the complementarity of the nucleotide sequences of LOC284650 BINDING SITE, designated SEQ ID:9422, to the nucleotide sequence of GAM7957 RNA, herein designated GAM RNA, also designated SEQ ID:297.

Another function of GAM7957 is therefore inhibition of LOC284650 (Accession XP_211571.1). Accordingly, utilities of GAM7957 include diagnosis, prevention and treatment of diseases and clinical conditions associated with LOC284650.

LOC284665 (Accession XP_211581.1) is another GAM7957 target gene, herein designated TARGET GENE. LOC284665 BINDING SITE is a target binding site found in the 5' untranslated region of mRNA encoded by LOC284665, corresponding to a target binding site such as BINDING SITE I, BINDING SITE II or BINDING SITE III of FIG. 8. Table 4 illustrates the complementarity of the nucleotide sequences of LOC284665 BINDING SITE, designated SEQ ID:2812, to the nucleotide sequence of GAM7957 RNA, herein designated GAM RNA, also designated SEQ ID:297.

Another function of GAM7957 is therefore inhibition of LOC284665 (Accession XP_211581.1). Accordingly, utilities of GAM7957 include diagnosis, prevention and treatment of diseases and clinical conditions associated with LOC284665.

LOC284673 (Accession XP_211591.1) is another GAM7957 target gene, herein designated TARGET GENE. LOC284673 BINDING SITE is a target binding site found in the 3' untranslated region of mRNA encoded by LOC284673, corresponding to a target binding site such as BINDING SITE I, BINDING SITE II or BINDING SITE III of FIG. 8. Table 4 illustrates the complementarity of the nucleotide sequences of LOC284673 BINDING SITE, designated SEQ ID:9421, to the nucleotide sequence of GAM7957 RNA, herein designated GAM RNA, also designated SEQ ID:297.

Another function of GAM7957 is therefore inhibition of LOC284673 (Accession XP_211591.1). Accordingly, utilities of GAM7957 include diagnosis, prevention and treatment of diseases and clinical conditions associated with LOC284673.

LOC284707 (Accession XP_211598.1) is another GAM7957 target gene, herein designated TARGET GENE. LOC284707 BINDING SITE1 through LOC284707 BINDING SITE3 are target binding sites found in untranslated regions of mRNA encoded by LOC284707, corresponding to target binding sites such as BINDING SITE I, BINDING SITE II or BINDING SITE III of FIG. 8. Table 4 illustrates the complementarity of the nucleotide sequences of LOC284707 BINDING SITE1 through LOC284707 BINDING SITE3, designated SEQ ID:8917, SEQ ID:18690 and SEQ ID:15308 respectively, to the nucleotide sequence of GAM7957 RNA, herein designated GAM RNA, also designated SEQ ID:297.

Another function of GAM7957 is therefore inhibition of LOC284707 (Accession XP_211598.1). Accordingly, utilities of GAM7957 include diagnosis, prevention and treatment of diseases and clinical conditions associated with LOC284707.

LOC284736 (Accession XP_209343.1) is another GAM7957 target gene, herein designated TARGET GENE. LOC284736 BINDING SITE1 and LOC284736 BINDING SITE2 are target binding sites found in untranslated regions of mRNA encoded by LOC284736, corresponding to target binding sites such as BINDING SITE I, BINDING SITE II or BINDING SITE III of FIG. 8. Table 4 illustrates the complementarity of the nucleotide sequences of LOC284736 BINDING SITE1 and LOC284736 BINDING SITE2, designated SEQ ID:12933 and SEQ ID:19053 respectively, to the nucleotide sequence of GAM7957 RNA, herein designated GAM RNA, also designated SEQ ID:297.

Another function of GAM7957 is therefore inhibition of LOC284736 (Accession XP_209343.1). Accordingly, utilities of GAM7957 include diagnosis, prevention and treatment of diseases and clinical conditions associated with LOC284736.

LOC284757 (Accession XP_211616.1) is another GAM7957 target gene, herein designated TARGET GENE. LOC284757 BINDING SITE is a target binding site found in the 3' untranslated region of mRNA encoded by LOC284757, corresponding to a target binding site such as BINDING SITE I, BINDING SITE II or BINDING SITE III of FIG. 8. Table 4 illustrates the complementarity of the nucleotide sequences of LOC284757 BINDING SITE, designated SEQ ID:17060, to the nucleotide sequence of GAM7957 RNA, herein designated GAM RNA, also designated SEQ ID:297.

Another function of GAM7957 is therefore inhibition of LOC284757 (Accession XP_211616.1). Accordingly, utilities of GAM7957 include diagnosis, prevention and treatment of diseases and clinical conditions associated with LOC284757.

LOC284803 (Accession XP_211642.1) is another GAM7957 target gene, herein designated TARGET GENE. LOC284803 BINDING SITE1 through LOC284803 BINDING SITE3 are target binding sites found in untranslated regions of mRNA encoded by LOC284803, corresponding to target binding sites such as BINDING SITE I, BINDING SITE II or BINDING SITE III of FIG. 8. Table 4 illustrates the complementarity of the nucleotide sequences of LOC284803 BINDING SITE1 through LOC284803 BINDING SITE3, designated SEQ ID:17328, SEQ ID:9535 and SEQ ID:13751 respectively, to the nucleotide sequence of GAM7957 RNA, herein designated GAM RNA, also designated SEQ ID:297.

Another function of GAM7957 is therefore inhibition of LOC284803 (Accession XP_211642.1). Accordingly, utilities of GAM7957 include diagnosis, prevention and treatment of diseases and clinical conditions associated with LOC284803.

LOC284808 (Accession XP_209372.1) is another GAM7957 target gene, herein designated TARGET GENE. LOC284808 BINDING SITE1 through LOC284808 BINDING SITE3 are target binding sites found in untranslated regions of mRNA encoded by LOC284808, corresponding to target binding sites such as BINDING SITE I, BINDING SITE II or BINDING SITE III of FIG. 8. Table 4 illustrates the complementarity of the nucleotide sequences of LOC284808 BINDING SITE1 through LOC284808 BINDING SITE3, designated SEQ ID:7759, SEQ ID:18950 and SEQ ID:19941 respectively, to the nucleotide sequence of GAM7957 RNA, herein designated GAM RNA, also designated SEQ ID:297.

Another function of GAM7957 is therefore inhibition of LOC284808 (Accession XP_209372.1). Accordingly, utilities of GAM7957 include diagnosis, prevention and treatment of diseases and clinical conditions associated with LOC284808.

LOC284844 (Accession XP_211662.1) is another GAM7957 target gene, herein designated TARGET GENE. LOC284844 BINDING SITE1 and LOC284844 BINDING SITE2 are target binding sites found in untranslated regions of mRNA encoded by LOC284844, corresponding to target binding sites such as BINDING SITE I, BINDING SITE II or BINDING SITE III of FIG. 8. Table 4 illustrates the complementarity of the nucleotide sequences of LOC284844 BINDING SITE1 and LOC284844 BINDING SITE2, designated SEQ ID:9844 and SEQ ID:3325 respectively, to the nucleotide sequence of GAM7957 RNA, herein designated GAM RNA, also designated SEQ ID:297.

Another function of GAM7957 is therefore inhibition of LOC284844 (Accession XP_211662.1). Accordingly, utilities of GAM7957 include diagnosis, prevention and treatment of diseases and clinical conditions associated with LOC284844.

LOC284845 (Accession XP_211663.1) is another GAM7957 target gene, herein designated TARGET GENE. LOC284845 BINDING SITE is a target binding site found in the 3' untranslated region of mRNA encoded by LOC284845, corresponding to a target binding site such as BINDING SITE I, BINDING SITE II or BINDING SITE III of FIG. 8. Table 4 illustrates the complementarity of the nucleotide sequences of LOC284845 BINDING SITE, designated SEQ ID:9422, to the nucleotide sequence of GAM7957 RNA, herein designated GAM RNA, also designated SEQ ID:297.

Another function of GAM7957 is therefore inhibition of LOC284845 (Accession XP_211663.1). Accordingly, utilities of GAM7957 include diagnosis, prevention and treatment of diseases and clinical conditions associated with LOC284845.

LOC284853 (Accession XP_209383.1) is another GAM7957 target gene, herein designated TARGET GENE. LOC284853 BINDING SITE is a target binding site found in the 3' untranslated region of mRNA encoded by LOC284853, corresponding to a target binding site such as BINDING SITE I, BINDING SITE II or BINDING SITE III of FIG. 8. Table 4 illustrates the complementarity of the nucleotide sequences of LOC284853 BINDING SITE, designated SEQ ID:15742, to the nucleotide sequence of GAM7957 RNA, herein designated GAM RNA, also designated SEQ ID:297.

Another function of GAM7957 is therefore inhibition of LOC284853 (Accession XP_209383.1). Accordingly, utilities of GAM7957 include diagnosis, prevention and treatment of diseases and clinical conditions associated with LOC284853.

LOC284857 (Accession XP_211671.1) is another GAM7957 target gene, herein designated TARGET GENE. LOC284857 BINDING SITE is a target binding site found in the 3' untranslated region of mRNA encoded by LOC284857, corresponding to a target binding site such as BINDING SITE I, BINDING SITE II or BINDING SITE III of FIG. 8. Table 4 illustrates the complementarity of the nucleotide sequences of LOC284857 BINDING SITE, designated SEQ ID:19058, to the nucleotide sequence of GAM7957 RNA, herein designated GAM RNA, also designated SEQ ID:297.

Another function of GAM7957 is therefore inhibition of LOC284857 (Accession XP_211671.1). Accordingly, utilities of GAM7957 include diagnosis, prevention and treatment of diseases and clinical conditions associated with LOC284857.

LOC284858 (Accession XP_209386.1) is another GAM7957 target gene, herein designated TARGET GENE. LOC284858 BINDING SITE1 through LOC284858 BINDING SITE4 are target binding sites found in untranslated regions of mRNA encoded by LOC284858, corresponding to target binding sites such as BINDING SITE I, BINDING SITE II or BINDING SITE III of FIG. 8. Table 4 illustrates the complementarity of the nucleotide sequences of LOC284858 BINDING SITE1 through LOC284858 BINDING SITE4, designated SEQ ID:2488, SEQ ID:19500, SEQ ID:13155 and SEQ ID:5830 respectively, to the nucleotide sequence of GAM7957 RNA, herein designated GAM RNA, also designated SEQ ID:297.

Another function of GAM7957 is therefore inhibition of LOC284858 (Accession XP_209386.1). Accordingly, utilities of GAM7957 include diagnosis, prevention and treatment of diseases and clinical conditions associated with LOC284858.

LOC284859 (Accession XP_209384.2) is another GAM7957 target gene, herein designated TARGET GENE. LOC284859 BINDING SITE is a target binding site found in the 3' untranslated region of mRNA encoded by LOC284859, corresponding to a target binding site such as BINDING SITE I, BINDING SITE II or BINDING SITE III of FIG. 8. Table 4 illustrates the complementarity of the nucleotide sequences of LOC284859 BINDING SITE, designated SEQ ID:16401, to the nucleotide sequence of GAM7957 RNA, herein designated GAM RNA, also designated SEQ ID:297.

Another function of GAM7957 is therefore inhibition of LOC284859 (Accession XP_209384.2). Accordingly, utilities of GAM7957 include diagnosis, prevention and treatment of diseases and clinical conditions associated with LOC284859.

LOC284861 (Accession XP_211670.2) is another GAM7957 target gene, herein designated TARGET GENE. LOC284861 BINDING SITE is a target binding site found in the 5' untranslated region of mRNA encoded by LOC284861, corresponding to a target binding site such as BINDING SITE I, BINDING SITE II or BINDING SITE III of FIG. 8. Table 4 illustrates the complementarity of the nucleotide sequences of LOC284861 BINDING SITE, designated SEQ ID:16401, to the nucleotide sequence of GAM7957 RNA, herein designated GAM RNA, also designated SEQ ID:297.

Another function of GAM7957 is therefore inhibition of LOC284861 (Accession XP_211670.2). Accordingly, utilities of GAM7957 include diagnosis, prevention and treatment of diseases and clinical conditions associated with LOC284861.

LOC284862 (Accession XP_211666.1) is another GAM7957 target gene, herein designated TARGET GENE. LOC284862 BINDING SITE is a target binding site found in the 3' untranslated region of mRNA encoded by LOC284862, corresponding to a target binding site such as BINDING SITE I, BINDING SITE II or BINDING SITE III of FIG. 8. Table 4 illustrates the complementarity of the nucleotide sequences of LOC284862 BINDING SITE, designated SEQ ID:9439, to the nucleotide sequence of GAM7957 RNA, herein designated GAM RNA, also designated SEQ ID:297.

Another function of GAM7957 is therefore inhibition of LOC284862 (Accession XP_211666.1). Accordingly, utilities of GAM7957 include diagnosis, prevention and treatment of diseases and clinical conditions associated with LOC284862.

LOC284873 (Accession XP_209412.1) is another GAM7957 target gene, herein designated TARGET GENE. LOC284873 BINDING SITE is a target binding site found in the 3' untranslated region of mRNA encoded by LOC284873, corresponding to a target binding site such as BINDING SITE I, BINDING SITE II or BINDING SITE III of FIG. 8. Table 4 illustrates the complementarity of the nucleotide sequences of LOC284873 BINDING SITE, designated SEQ ID:16401, to the nucleotide sequence of GAM7957 RNA, herein designated GAM RNA, also designated SEQ ID:297.

Another function of GAM7957 is therefore inhibition of LOC284873 (Accession XP_209412.1). Accordingly, utilities of GAM7957 include diagnosis, prevention and treatment of diseases and clinical conditions associated with LOC284873.

LOC284899 (Accession XP_211680.1) is another GAM7957 target gene, herein designated TARGET GENE. LOC284899 BINDING SITE1 through LOC284899 BINDING SITE4 are target binding sites found in untranslated regions of mRNA encoded by LOC284899, corresponding to target binding sites such as BINDING SITE I, BINDING SITE II or BINDING SITE III of FIG. 8. Table 4 illustrates the complementarity of the nucleotide sequences of LOC284899 BINDING SITE1 through LOC284899 BINDING SITE4, designated SEQ ID:17082, SEQ ID:12699, SEQ ID:2520 and SEQ ID:15979 respectively, to the nucleotide sequence of GAM7957 RNA, herein designated GAM RNA, also designated SEQ ID:297.

Another function of GAM7957 is therefore inhibition of LOC284899 (Accession XP_211680.1). Accordingly, utilities of GAM7957 include diagnosis, prevention and treatment of diseases and clinical conditions associated with LOC284899.

LOC284911 (Accession XP_211684.1) is another GAM7957 target gene, herein designated TARGET GENE. LOC284911 BINDING SITE1 and LOC284911 BINDING SITE2 are target binding sites found in untranslated regions of mRNA encoded by LOC284911, corresponding to target binding sites such as BINDING SITE I, BINDING SITE II or BINDING SITE III of FIG. 8. Table 4 illustrates the complementarity of the nucleotide sequences of LOC284911 BINDING SITE1 and LOC284911 BINDING SITE2, designated SEQ ID:13631 and SEQ ID:4952 respectively, to the nucleotide sequence of GAM7957 RNA, herein designated GAM RNA, also designated SEQ ID:297.

Another function of GAM7957 is therefore inhibition of LOC284911 (Accession XP_211684.1). Accordingly, utilities of GAM7957 include diagnosis, prevention and treatment of diseases and clinical conditions associated with LOC284911.

LOC284915 (Accession XP_209410.1) is another GAM7957 target gene, herein designated TARGET GENE. LOC284915 BINDING SITE1 and LOC284915 BINDING SITE2 are target binding sites found in untranslated regions of mRNA encoded by LOC284915, corresponding to target binding sites such as BINDING SITE I, BINDING SITE II or BINDING SITE III of FIG. 8. Table 4 illustrates the complementarity of the nucleotide sequences of LOC284915 BINDING SITE1 and LOC284915 BINDING SITE2, designated SEQ ID:16573 and SEQ ID:15344 respectively, to the nucleotide sequence of GAM7957 RNA, herein designated GAM RNA, also designated SEQ ID:297.

Another function of GAM7957 is therefore inhibition of LOC284915 (Accession XP_209410.1). Accordingly, utilities of GAM7957 include diagnosis, prevention and treatment of diseases and clinical conditions associated with LOC284915.

LOC284936 (Accession XP_211699.1) is another GAM7957 target gene, herein designated TARGET GENE. LOC284936 BINDING SITE1 through LOC284936 BINDING SITE3 are target binding sites found in untranslated regions of mRNA encoded by LOC284936, corresponding to target binding sites such as BINDING SITE I, BINDING SITE II or BINDING SITE III of FIG. 8. Table 4 illustrates the complementarity of the nucleotide sequences of LOC284936 BINDING SITE1 through LOC284936 BINDING SITE3, designated SEQ ID:9420, SEQ ID:17279 and SEQ ID:5093 respectively, to the nucleotide sequence of GAM7957 RNA, herein designated GAM RNA, also designated SEQ ID:297.

Another function of GAM7957 is therefore inhibition of LOC284936 (Accession XP_211699.1). Accordingly, utilities of GAM7957 include diagnosis, prevention and treatment of diseases and clinical conditions associated with LOC284936.

LOC284939 (Accession XP_211700.1) is another GAM7957 target gene, herein designated TARGET GENE. LOC284939 BINDING SITE is a target binding site found in the 5' untranslated region of mRNA encoded by LOC284939, corresponding to a target binding site such as BINDING SITE I, BINDING SITE II or BINDING SITE III of FIG. 8. Table 4 illustrates the complementarity of the nucleotide sequences of LOC284939 BINDING SITE, designated SEQ ID:14786, to the nucleotide sequence of GAM7957 RNA, herein designated GAM RNA, also designated SEQ ID:297.

Another function of GAM7957 is therefore inhibition of LOC284939 (Accession XP_211700.1). Accordingly, utilities of GAM7957 include diagnosis, prevention and treatment of diseases and clinical conditions associated with LOC284939.

LOC284959 (Accession XP_211708.1) is another GAM7957 target gene, herein designated TARGET GENE. LOC284959 BINDING SITE is a target binding site found in the 5' untranslated region of mRNA encoded by LOC284959, corresponding to a target binding site such as BINDING SITE I, BINDING SITE II or BINDING SITE III of FIG. 8. Table 4 illustrates the complementarity of the nucleotide sequences of LOC284959 BINDING SITE, designated SEQ ID:10463, to the nucleotide sequence of GAM7957 RNA, herein designated GAM RNA, also designated SEQ ID:297.

Another function of GAM7957 is therefore inhibition of LOC284959 (Accession XP_211708.1). Accordingly, utilities of GAM7957 include diagnosis, prevention and treatment of diseases and clinical conditions associated with LOC284959.

LOC284972 (Accession XP_211712.1) is another GAM7957 target gene, herein designated TARGET GENE. LOC284972 BINDING SITE is a target binding site found in the 5' untranslated region of mRNA encoded by LOC284972, corresponding to a target binding site such as BINDING SITE I, BINDING SITE II or BINDING SITE III of FIG. 8. Table 4 illustrates the complementarity of the nucleotide sequences of LOC284972 BINDING SITE, designated SEQ ID:6191, to the nucleotide sequence of GAM7957 RNA, herein designated GAM RNA, also designated SEQ ID:297.

Another function of GAM7957 is therefore inhibition of LOC284972 (Accession XP_211712.1). Accordingly, utilities of GAM7957 include diagnosis, prevention and treatment of diseases and clinical conditions associated with LOC284972.

LOC284975 (Accession XP_211711.1) is another GAM7957 target gene, herein designated TARGET GENE. LOC284975 BINDING SITE1 and LOC284975 BINDING SITE2 are target binding sites found in untranslated regions of mRNA encoded by LOC284975, corresponding to target binding sites such as BINDING SITE I, BINDING SITE II or BINDING SITE III of FIG. 8. Table 4 illustrates the complementarity of the nucleotide sequences of LOC284975 BINDING SITE1 and LOC284975 BINDING SITE2, designated SEQ ID:9420 and SEQ ID:12954 respectively, to the nucleotide sequence of GAM7957 RNA, herein designated GAM RNA, also designated SEQ ID:297.

Another function of GAM7957 is therefore inhibition of LOC284975 (Accession XP_211711.1). Accordingly, utilities of GAM7957 include diagnosis, prevention and treatment of diseases and clinical conditions associated with LOC284975.

LOC284976 (Accession XP_211714.1) is another GAM7957 target gene, herein designated TARGET GENE. LOC284976 BINDING SITE is a target binding site found in the 3' untranslated region of mRNA encoded by LOC284976, corresponding to a target binding site such as BINDING SITE I, BINDING SITE II or BINDING SITE III of FIG. 8. Table 4 illustrates the complementarity of the nucleotide sequences of LOC284976 BINDING SITE, designated SEQ ID:10672, to the nucleotide sequence of GAM7957 RNA, herein designated GAM RNA, also designated SEQ ID:297.

Another function of GAM7957 is therefore inhibition of LOC284976 (Accession XP_211714.1). Accordingly, utilities of GAM7957 include diagnosis, prevention and treatment of diseases and clinical conditions associated with LOC284976.

LOC284982 (Accession XP_211721.1) is another GAM7957 target gene, herein designated TARGET GENE. LOC284982 BINDING SITE is a target binding site found in the 3' untranslated region of mRNA encoded by LOC284982, corresponding to a target binding site such as BINDING SITE I, BINDING SITE II or BINDING SITE III of FIG. 8. Table 4 illustrates the complementarity of the nucleotide sequences of LOC284982 BINDING SITE, designated SEQ ID:2521, to the nucleotide sequence of GAM7957 RNA, herein designated GAM RNA, also designated SEQ ID:297.

Another function of GAM7957 is therefore inhibition of LOC284982 (Accession XP_211721.1). Accordingly, utilities of GAM7957 include diagnosis, prevention and treatment of diseases and clinical conditions associated with LOC284982.

LOC284993 (Accession XP_211722.1) is another GAM7957 target gene, herein designated TARGET GENE. LOC284993 BINDING SITE is a target binding site found in the 5' untranslated region of mRNA encoded by LOC284993, corresponding to a target binding site such as BINDING SITE I, BINDING SITE II or BINDING SITE III of FIG. 8. Table 4 illustrates the complementarity of the nucleotide sequences of LOC284993 BINDING SITE, designated SEQ ID:13912, to the nucleotide sequence of GAM7957 RNA, herein designated GAM RNA, also designated SEQ ID:297.

Another function of GAM7957 is therefore inhibition of LOC284993 (Accession XP_211722.1). Accordingly, utilities of GAM7957 include diagnosis, prevention and treatment of diseases and clinical conditions associated with LOC284993.

LOC284995 (Accession XP_211729.1) is another GAM7957 target gene, herein designated TARGET GENE. LOC284995 BINDING SITE1 and LOC284995 BINDING SITE2 are target binding sites found in untranslated regions of mRNA encoded by LOC284995, corresponding to target binding sites such as BINDING SITE I, BINDING SITE II or BINDING SITE III of FIG. 8. Table 4 illustrates the complementarity of the nucleotide sequences of LOC284995 BINDING SITE1 and LOC284995 BINDING SITE2, designated SEQ ID:1706 and SEQ ID:15343 respectively, to the nucleotide sequence of GAM7957 RNA, herein designated GAM RNA, also designated SEQ ID:297.

Another function of GAM7957 is therefore inhibition of LOC284995 (Accession XP_211729.1). Accordingly, utilities of GAM7957 include diagnosis, prevention and treatment of diseases and clinical conditions associated with LOC284995.

LOC285043 (Accession XP_211742.1) is another GAM7957 target gene, herein designated TARGET GENE. LOC285043 BINDING SITE is a target binding site found in the 5' untranslated region of mRNA encoded by LOC285043, corresponding to a target binding site such as BINDING SITE I, BINDING SITE II or BINDING SITE III of FIG. 8. Table 4 illustrates the complementarity of the nucleotide sequences of LOC285043 BINDING SITE, designated SEQ ID:9938, to the nucleotide sequence of GAM7957 RNA, herein designated GAM RNA, also designated SEQ ID:297.

Another function of GAM7957 is therefore inhibition of LOC285043 (Accession XP_211742.1). Accordingly, utilities of GAM7957 include diagnosis, prevention and treatment of diseases and clinical conditions associated with LOC285043.

LOC285058 (Accession XP_211753.1) is another GAM7957 target gene, herein designated TARGET GENE. LOC285058 BINDING SITE is a target binding site found in the 3' untranslated region of mRNA encoded by LOC285058, corresponding to a target binding site such as BINDING SITE I, BINDING SITE II or BINDING SITE III of FIG. 8. Table 4 illustrates the complementarity of the nucleotide sequences of LOC285058 BINDING SITE, designated SEQ ID:10474, to the nucleotide sequence of GAM7957 RNA, herein designated GAM RNA, also designated SEQ ID:297.

Another function of GAM7957 is therefore inhibition of LOC285058 (Accession XP_211753.1). Accordingly, utilities of GAM7957 include diagnosis, prevention and treatment of diseases and clinical conditions associated with LOC285058.

LOC285082 (Accession XP_211759.1) is another GAM7957 target gene, herein designated TARGET GENE.

LOC285082 BINDING SITE is a target binding site found in the 3' untranslated region of mRNA encoded by LOC285082, corresponding to a target binding site such as BINDING SITE I, BINDING SITE II or BINDING SITE III of FIG. 8. Table 4 illustrates the complementarity of the nucleotide sequences of LOC285082 BINDING SITE, designated SEQ ID:470, to the nucleotide sequence of GAM7957 RNA, herein designated GAM RNA, also designated SEQ ID:297.

Another function of GAM7957 is therefore inhibition of LOC285082 (Accession XP_211759.1). Accordingly, utilities of GAM7957 include diagnosis, prevention and treatment of diseases and clinical conditions associated with LOC285082.

LOC285083 (Accession XP_209464.1) is another GAM7957 target gene, herein designated TARGET GENE. LOC285083 BINDING SITE is a target binding site found in the 3' untranslated region of mRNA encoded by LOC285083, corresponding to a target binding site such as BINDING SITE I, BINDING SITE II or BINDING SITE III of FIG. 8. Table 4 illustrates the complementarity of the nucleotide sequences of LOC285083 BINDING SITE, designated SEQ ID:19057, to the nucleotide sequence of GAM7957 RNA, herein designated GAM RNA, also designated SEQ ID:297.

Another function of GAM7957 is therefore inhibition of LOC285083 (Accession XP_209464.1). Accordingly, utilities of GAM7957 include diagnosis, prevention and treatment of diseases and clinical conditions associated with LOC285083.

LOC285094 (Accession XP_209471.1) is another GAM7957 target gene, herein designated TARGET GENE. LOC285094 BINDING SITE is a target binding site found in the 5' untranslated region of mRNA encoded by LOC285094, corresponding to a target binding site such as BINDING SITE I, BINDING SITE II or BINDING SITE III of FIG. 8. Table 4 illustrates the complementarity of the nucleotide sequences of LOC285094 BINDING SITE, designated SEQ ID:8468, to the nucleotide sequence of GAM7957 RNA, herein designated GAM RNA, also designated SEQ ID:297.

Another function of GAM7957 is therefore inhibition of LOC285094 (Accession XP_209471.1). Accordingly, utilities of GAM7957 include diagnosis, prevention and treatment of diseases and clinical conditions associated with LOC285094.

LOC285103 (Accession XP_211766.1) is another GAM7957 target gene, herein designated TARGET GENE. LOC285103 BINDING SITE is a target binding site found in the 5' untranslated region of mRNA encoded by LOC285103, corresponding to a target binding site such as BINDING SITE I, BINDING SITE II or BINDING SITE III of FIG. 8. Table 4 illustrates the complementarity of the nucleotide sequences of LOC285103 BINDING SITE, designated SEQ ID:4060, to the nucleotide sequence of GAM7957 RNA, herein designated GAM RNA, also designated SEQ ID:297.

Another function of GAM7957 is therefore inhibition of LOC285103 (Accession XP_211766.1). Accordingly, utilities of GAM7957 include diagnosis, prevention and treatment of diseases and clinical conditions associated with LOC285103.

LOC285108 (Accession XP_209478.1) is another GAM7957 target gene, herein designated TARGET GENE. LOC285108 BINDING SITE is a target binding site found in the 3' untranslated region of mRNA encoded by LOC285108, corresponding to a target binding site such as BINDING SITE I, BINDING SITE II or BINDING SITE III of FIG. 8. Table 4 illustrates the complementarity of the nucleotide sequences of LOC285108 BINDING SITE, designated SEQ ID:12145, to the nucleotide sequence of GAM7957 RNA, herein designated GAM RNA, also designated SEQ ID:297.

Another function of GAM7957 is therefore inhibition of LOC285108 (Accession XP_209478.1). Accordingly, utilities of GAM7957 include diagnosis, prevention and treatment of diseases and clinical conditions associated with LOC285108.

LOC285125 (Accession XP_211769.1) is another GAM7957 target gene, herein designated TARGET GENE. LOC285125 BINDING SITE is a target binding site found in the 3' untranslated region of mRNA encoded by LOC285125, corresponding to a target binding site such as BINDING SITE I, BINDING SITE II or BINDING SITE III of FIG. 8. Table 4 illustrates the complementarity of the nucleotide sequences of LOC285125 BINDING SITE, designated SEQ ID:629, to the nucleotide sequence of GAM7957 RNA, herein designated GAM RNA, also designated SEQ ID:297.

Another function of GAM7957 is therefore inhibition of LOC285125 (Accession XP_211769.1). Accordingly, utilities of GAM7957 include diagnosis, prevention and treatment of diseases and clinical conditions associated with LOC285125.

LOC285127 (Accession XP_211771.1) is another GAM7957 target gene, herein designated TARGET GENE. LOC285127 BINDING SITE is a target binding site found in the 3' untranslated region of mRNA encoded by LOC285127, corresponding to a target binding site such as BINDING SITE I, BINDING SITE II or BINDING SITE III of FIG. 8. Table 4 illustrates the complementarity of the nucleotide sequences of LOC285127 BINDING SITE, designated SEQ ID:2936, to the nucleotide sequence of GAM7957 RNA, herein designated GAM RNA, also designated SEQ ID:297.

Another function of GAM7957 is therefore inhibition of LOC285127 (Accession XP_211771.1). Accordingly, utilities of GAM7957 include diagnosis, prevention and treatment of diseases and clinical conditions associated with LOC285127.

LOC285151 (Accession XP_211782.1) is another GAM7957 target gene, herein designated TARGET GENE. LOC285151 BINDING SITE is a target binding site found in the 5' untranslated region of mRNA encoded by LOC285151, corresponding to a target binding site such as BINDING SITE I, BINDING SITE II or BINDING SITE III of FIG. 8. Table 4 illustrates the complementarity of the nucleotide sequences of LOC285151 BINDING SITE, designated SEQ ID:9735, to the nucleotide sequence of GAM7957 RNA, herein designated GAM RNA, also designated SEQ ID:297.

Another function of GAM7957 is therefore inhibition of LOC285151 (Accession XP_211782.1). Accordingly, utilities of GAM7957 include diagnosis, prevention and treatment of diseases and clinical conditions associated with LOC285151.

LOC285166 (Accession XP_211791.1) is another GAM7957 target gene, herein designated TARGET GENE. LOC285166 BINDING SITE is a target binding site found in the 3' untranslated region of mRNA encoded by LOC285166, corresponding to a target binding site such as BINDING SITE I, BINDING SITE II or BINDING SITE III of FIG. 8. Table 4 illustrates the complementarity of the nucleotide sequences of LOC285166 BINDING SITE, designated SEQ ID:12791, to the nucleotide sequence of GAM7957 RNA, herein designated GAM RNA, also designated SEQ ID:297.

Another function of GAM7957 is therefore inhibition of LOC285166 (Accession XP_211791.1). Accordingly, utilities of GAM7957 include diagnosis, prevention and treatment of diseases and clinical conditions associated with LOC285166.

LOC285167 (Accession XP_211790.1) is another GAM7957 target gene, herein designated TARGET GENE. LOC285167 BINDING SITE1 through LOC285167 BINDING SITE4 are target binding sites found in untranslated regions of mRNA encoded by LOC285167, corresponding to target binding sites such as BINDING SITE I, BINDING SITE II or BINDING SITE III of FIG. 8. Table 4 illustrates the complementarity of the nucleotide sequences of LOC285167 BINDING SITE1 through LOC285167 BINDING SITE4, designated SEQ ID:7413, SEQ ID:7557, SEQ ID:18453 and SEQ ID:15370 respectively, to the nucleotide sequence of GAM7957 RNA, herein designated GAM RNA, also designated SEQ ID:297.

Another function of GAM7957 is therefore inhibition of LOC285167 (Accession XP_211790.1). Accordingly, utilities of GAM7957 include diagnosis, prevention and treatment of diseases and clinical conditions associated with LOC285167.

LOC285171 (Accession XP_211799.1) is another GAM7957 target gene, herein designated TARGET GENE. LOC285171 BINDING SITE1 through LOC285171 BINDING SITE4 are target binding sites found in untranslated regions of mRNA encoded by LOC285171, corresponding to target binding sites such as BINDING SITE I, BINDING SITE II or BINDING SITE III of FIG. 8. Table 4 illustrates the complementarity of the nucleotide sequences of LOC285171 BINDING SITE1 through LOC285171 BINDING SITE4, designated SEQ ID:5046, SEQ ID:19794, SEQ ID:13690 and SEQ ID:13155 respectively, to the nucleotide sequence of GAM7957 RNA, herein designated GAM RNA, also designated SEQ ID:297.

Another function of GAM7957 is therefore inhibition of LOC285171 (Accession XP_211799.1). Accordingly, utilities of GAM7957 include diagnosis, prevention and treatment of diseases and clinical conditions associated with LOC285171.

LOC285216 (Accession XP_209520.1) is another GAM7957 target gene, herein designated TARGET GENE. LOC285216 BINDING SITE is a target binding site found in the 5' untranslated region of mRNA encoded by LOC285216, corresponding to a target binding site such as BINDING SITE I, BINDING SITE II or BINDING SITE III of FIG. 8. Table 4 illustrates the complementarity of the nucleotide sequences of LOC285216 BINDING SITE, designated SEQ ID:13065, to the nucleotide sequence of GAM7957 RNA, herein designated GAM RNA, also designated SEQ ID:297.

Another function of GAM7957 is therefore inhibition of LOC285216 (Accession XP_209520.1). Accordingly, utilities of GAM7957 include diagnosis, prevention and treatment of diseases and clinical conditions associated with LOC285216.

LOC285219 (Accession XP_209518.1) is another GAM7957 target gene, herein designated TARGET GENE. LOC285219 BINDING SITE is a target binding site found in the 3' untranslated region of mRNA encoded by LOC285219, corresponding to a target binding site such as BINDING SITE I, BINDING SITE II or BINDING SITE III of FIG. 8. Table 4 illustrates the complementarity of the nucleotide sequences of LOC285219 BINDING SITE, designated SEQ ID:12792, to the nucleotide sequence of GAM7957 RNA, herein designated GAM RNA, also designated SEQ ID:297.

Another function of GAM7957 is therefore inhibition of LOC285219 (Accession XP_209518.1). Accordingly, utilities of GAM7957 include diagnosis, prevention and treatment of diseases and clinical conditions associated with LOC285219.

LOC285222 (Accession XP_211809.1) is another GAM7957 target gene, herein designated TARGET GENE. LOC285222 BINDING SITE is a target binding site found in the 5' untranslated region of mRNA encoded by LOC285222, corresponding to a target binding site such as BINDING SITE I, BINDING SITE II or BINDING SITE III of FIG. 8. Table 4 illustrates the complementarity of the nucleotide sequences of LOC285222 BINDING SITE, designated SEQ ID:9913, to the nucleotide sequence of GAM7957 RNA, herein designated GAM RNA, also designated SEQ ID:297.

Another function of GAM7957 is therefore inhibition of LOC285222 (Accession XP_211809.1). Accordingly, utilities of GAM7957 include diagnosis, prevention and treatment of diseases and clinical conditions associated with LOC285222.

LOC285230 (Accession XP_211814.1) is another GAM7957 target gene, herein designated TARGET GENE. LOC285230 BINDING SITE1 and LOC285230 BINDING SITE2 are target binding sites found in untranslated regions of mRNA encoded by LOC285230, corresponding to target binding sites such as BINDING SITE I, BINDING SITE II or BINDING SITE III of FIG. 8. Table 4 illustrates the complementarity of the nucleotide sequences of LOC285230 BINDING SITE1 and LOC285230 BINDING SITE2, designated SEQ ID:6423 and SEQ ID:2944 respectively, to the nucleotide sequence of GAM7957 RNA, herein designated GAM RNA, also designated SEQ ID:297.

Another function of GAM7957 is therefore inhibition of LOC285230 (Accession XP_211814.1). Accordingly, utilities of GAM7957 include diagnosis, prevention and treatment of diseases and clinical conditions associated with LOC285230.

LOC285263 (Accession XP_209537.1) is another GAM7957 target gene, herein designated TARGET GENE. LOC285263 BINDING SITE is a target binding site found in the 3' untranslated region of mRNA encoded by LOC285263, corresponding to a target binding site such as BINDING SITE I, BINDING SITE II or BINDING SITE III of FIG. 8. Table 4 illustrates the complementarity of the nucleotide sequences of LOC285263 BINDING SITE, designated SEQ ID:7927, to the nucleotide sequence of GAM7957 RNA, herein designated GAM RNA, also designated SEQ ID:297.

Another function of GAM7957 is therefore inhibition of LOC285263 (Accession XP_209537.1). Accordingly, utilities of GAM7957 include diagnosis, prevention and treatment of diseases and clinical conditions associated with LOC285263.

LOC285295 (Accession XP_211833.1) is another GAM7957 target gene, herein designated TARGET GENE. LOC285295 BINDING SITE is a target binding site found in the 3' untranslated region of mRNA encoded by LOC285295, corresponding to a target binding site such as BINDING SITE I, BINDING SITE II or BINDING SITE III of FIG. 8. Table 4 illustrates the complementarity of the nucleotide sequences of LOC285295 BINDING SITE, designated SEQ ID:5047, to the nucleotide sequence of GAM7957 RNA, herein designated GAM RNA, also designated SEQ ID:297.

Another function of GAM7957 is therefore inhibition of LOC285295 (Accession XP_211833.1). Accordingly, utilities of GAM7957 include diagnosis, prevention and treatment of diseases and clinical conditions associated with LOC285295.

LOC285309 (Accession XP_211839.1) is another GAM7957 target gene, herein designated TARGET GENE. LOC285309 BINDING SITE1 and LOC285309 BINDING SITE2 are target binding sites found in untranslated regions of mRNA encoded by LOC285309, corresponding to target binding sites such as BINDING SITE I, BINDING SITE II or BINDING SITE III of FIG. 8. Table 4 illustrates the complementarity of the nucleotide sequences of LOC285309 BINDING SITE1 and LOC285309 BINDING SITE2, designated SEQ ID:1492 and SEQ ID:9203 respectively, to the nucleotide sequence of GAM7957 RNA, herein designated GAM RNA, also designated SEQ ID:297.

Another function of GAM7957 is therefore inhibition of LOC285309 (Accession XP_211839.1). Accordingly, utilities of GAM7957 include diagnosis, prevention and treatment of diseases and clinical conditions associated with LOC285309.

LOC285332 (Accession XP_211845.1) is another GAM7957 target gene, herein designated TARGET GENE. LOC285332 BINDING SITE1 through LOC285332 BINDING SITE3 are target binding sites found in untranslated regions of mRNA encoded by LOC285332, corresponding to target binding sites such as BINDING SITE I, BINDING SITE II or BINDING SITE III of FIG. 8. Table 4 illustrates the complementarity of the nucleotide sequences of LOC285332 BINDING SITE1 through LOC285332 BINDING SITE3, designated SEQ ID:15405, SEQ ID:10634 and SEQ ID:10559 respectively, to the nucleotide sequence of GAM7957 RNA, herein designated GAM RNA, also designated SEQ ID:297.

Another function of GAM7957 is therefore inhibition of LOC285332 (Accession XP_211845.1). Accordingly, utilities of GAM7957 include diagnosis, prevention and treatment of diseases and clinical conditions associated with LOC285332.

LOC285359 (Accession XP_211858.1) is another GAM7957 target gene, herein designated TARGET GENE. LOC285359 BINDING SITE is a target binding site found in the 3' untranslated region of mRNA encoded by LOC285359, corresponding to a target binding site such as BINDING SITE I, BINDING SITE II or BINDING SITE III of FIG. 8. Table 4 illustrates the complementarity of the nucleotide sequences of LOC285359 BINDING SITE, designated SEQ ID:15984, to the nucleotide sequence of GAM7957 RNA, herein designated GAM RNA, also designated SEQ ID:297.

Another function of GAM7957 is therefore inhibition of LOC285359 (Accession XP_211858.1). Accordingly, utilities of GAM7957 include diagnosis, prevention and treatment of diseases and clinical conditions associated with LOC285359.

LOC285376 (Accession XP_211864.1) is another GAM7957 target gene, herein designated TARGET GENE. LOC285376 BINDING SITE is a target binding site found in the 3' untranslated region of mRNA encoded by LOC285376, corresponding to a target binding site such as BINDING SITE I, BINDING SITE II or BINDING SITE III of FIG. 8. Table 4 illustrates the complementarity of the nucleotide sequences of LOC285376 BINDING SITE, designated SEQ ID:18691, to the nucleotide sequence of GAM7957 RNA, herein designated GAM RNA, also designated SEQ ID:297.

Another function of GAM7957 is therefore inhibition of LOC285376 (Accession XP_211864.1). Accordingly, utilities of GAM7957 include diagnosis, prevention and treatment of diseases and clinical conditions associated with LOC285376.

LOC285378 (Accession XP_211859.1) is another GAM7957 target gene, herein designated TARGET GENE. LOC285378 BINDING SITE is a target binding site found in the 5' untranslated region of mRNA encoded by LOC285378, corresponding to a target binding site such as BINDING SITE I, BINDING SITE II or BINDING SITE III of FIG. 8. Table 4 illustrates the complementarity of the nucleotide sequences of LOC285378 BINDING SITE, designated SEQ ID:10435, to the nucleotide sequence of GAM7957 RNA, herein designated GAM RNA, also designated SEQ ID:297.

Another function of GAM7957 is therefore inhibition of LOC285378 (Accession XP_211859.1). Accordingly, utilities of GAM7957 include diagnosis, prevention and treatment of diseases and clinical conditions associated with LOC285378.

LOC285379 (Accession XP_211868.1) is another GAM7957 target gene, herein designated TARGET GENE. LOC285379 BINDING SITE1 and LOC285379 BINDING SITE2 are target binding sites found in untranslated regions of mRNA encoded by LOC285379, corresponding to target binding sites such as BINDING SITE I, BINDING SITE II or BINDING SITE III of FIG. 8. Table 4 illustrates the complementarity of the nucleotide sequences of LOC285379 BINDING SITE1 and LOC285379 BINDING SITE2, designated SEQ ID:1492 and SEQ ID:9203 respectively, to the nucleotide sequence of GAM7957 RNA, herein designated GAM RNA, also designated SEQ ID:297.

Another function of GAM7957 is therefore inhibition of LOC285379 (Accession XP_211868.1). Accordingly, utilities of GAM7957 include diagnosis, prevention and treatment of diseases and clinical conditions associated with LOC285379.

LOC285387 (Accession XP_209588.1) is another GAM7957 target gene, herein designated TARGET GENE. LOC285387 BINDING SITE is a target binding site found in the 3' untranslated region of mRNA encoded by LOC285387, corresponding to a target binding site such as BINDING SITE I, BINDING SITE II or BINDING SITE III of FIG. 8. Table 4 illustrates the complementarity of the nucleotide sequences of LOC285387 BINDING SITE, designated SEQ ID:15219, to the nucleotide sequence of GAM7957 RNA, herein designated GAM RNA, also designated SEQ ID:297.

Another function of GAM7957 is therefore inhibition of LOC285387 (Accession XP_209588.1). Accordingly, utilities of GAM7957 include diagnosis, prevention and treatment of diseases and clinical conditions associated with LOC285387.

LOC285395 (Accession XP_211875.1) is another GAM7957 target gene, herein designated TARGET GENE. LOC285395 BINDING SITE is a target binding site found in the 3' untranslated region of mRNA encoded by LOC285395, corresponding to a target binding site such as BINDING SITE I, BINDING SITE II or BINDING SITE III of FIG. 8. Table 4 illustrates the complementarity of the nucleotide sequences of LOC285395 BINDING SITE, designated SEQ ID:14204, to the nucleotide sequence of GAM7957 RNA, herein designated GAM RNA, also designated SEQ ID:297.

Another function of GAM7957 is therefore inhibition of LOC285395 (Accession XP_211875.1). Accordingly, utilities of GAM7957 include diagnosis, prevention and treatment of diseases and clinical conditions associated with LOC285395.

LOC285404 (Accession XP_211885.1) is another GAM7957 target gene, herein designated TARGET GENE. LOC285404 BINDING SITE is a target binding site found in the 3' untranslated region of mRNA encoded by LOC285404, corresponding to a target binding site such as BINDING SITE I, BINDING SITE II or BINDING SITE III of FIG. 8. Table 4 illustrates the complementarity of the nucleotide sequences of LOC285404 BINDING SITE, designated SEQ ID:15520, to the nucleotide sequence of GAM7957 RNA, herein designated GAM RNA, also designated SEQ ID:297.

Another function of GAM7957 is therefore inhibition of LOC285404 (Accession XP_211885.1). Accordingly, utilities of GAM7957 include diagnosis, prevention and treatment of diseases and clinical conditions associated with LOC285404.

LOC285408 (Accession XP_211886.3) is another GAM7957 target gene, herein designated TARGET GENE. LOC285408 BINDING SITE1 and LOC285408 BINDING SITE2 are target binding sites found in untranslated regions of mRNA encoded by LOC285408, corresponding to target binding sites such as BINDING SITE I, BINDING SITE II or BINDING SITE III of FIG. 8. Table 4 illustrates the complementarity of the nucleotide sequences of LOC285408 BINDING SITE1 and LOC285408 BINDING SITE2, designated SEQ ID:14360 and SEQ ID:14913 respectively, to the nucleotide sequence of GAM7957 RNA, herein designated GAM RNA, also designated SEQ ID:297.

Another function of GAM7957 is therefore inhibition of LOC285408 (Accession XP_211886.3). Accordingly, utilities of GAM7957 include diagnosis, prevention and treatment of diseases and clinical conditions associated with LOC285408.

LOC285447 (Accession XP_211900.1) is another GAM7957 target gene, herein designated TARGET GENE. LOC285447 BINDING SITE1 through LOC285447 BINDING SITE4 are target binding sites found in untranslated regions of mRNA encoded by LOC285447, corresponding to target binding sites such as BINDING SITE I, BINDING SITE II or BINDING SITE III of FIG. 8. Table 4 illustrates the complementarity of the nucleotide sequences of LOC285447 BINDING SITE1 through LOC285447 BINDING SITE4, designated SEQ ID:19799, SEQ ID:8585, SEQ ID:1571 and SEQ ID:5830 respectively, to the nucleotide sequence of GAM7957 RNA, herein designated GAM RNA, also designated SEQ ID:297.

Another function of GAM7957 is therefore inhibition of LOC285447 (Accession XP_211900.1). Accordingly, utilities of GAM7957 include diagnosis, prevention and treatment of diseases and clinical conditions associated with LOC285447.

LOC285465 (Accession XP_209622.1) is another GAM7957 target gene, herein designated TARGET GENE. LOC285465 BINDING SITE is a target binding site found in the 3' untranslated region of mRNA encoded by LOC285465, corresponding to a target binding site such as BINDING SITE I, BINDING SITE II or BINDING SITE III of FIG. 8. Table 4 illustrates the complementarity of the nucleotide sequences of LOC285465 BINDING SITE, designated SEQ ID:13061, to the nucleotide sequence of GAM7957 RNA, herein designated GAM RNA, also designated SEQ ID:297.

Another function of GAM7957 is therefore inhibition of LOC285465 (Accession XP_209622.1). Accordingly, utilities of GAM7957 include diagnosis, prevention and treatment of diseases and clinical conditions associated with LOC285465.

LOC285481 (Accession XP_211912.1) is another GAM7957 target gene, herein designated TARGET GENE. LOC285481 BINDING SITE is a target binding site found in the 5' untranslated region of mRNA encoded by LOC285481, corresponding to a target binding site such as BINDING SITE I, BINDING SITE II or BINDING SITE III of FIG. 8. Table 4 illustrates the complementarity of the nucleotide sequences of LOC285481 BINDING SITE, designated SEQ ID:8189, to the nucleotide sequence of GAM7957 RNA, herein designated GAM RNA, also designated SEQ ID:297.

Another function of GAM7957 is therefore inhibition of LOC285481 (Accession XP_211912.1). Accordingly, utilities of GAM7957 include diagnosis, prevention and treatment of diseases and clinical conditions associated with LOC285481.

LOC285484 (Accession XP_209630.1) is another GAM7957 target gene, herein designated TARGET GENE. LOC285484 BINDING SITE1 and LOC285484 BINDING SITE2 are target binding sites found in untranslated regions of mRNA encoded by LOC285484, corresponding to target binding sites such as BINDING SITE I, BINDING SITE II or BINDING SITE III of FIG. 8. Table 4 illustrates the complementarity of the nucleotide sequences of LOC285484 BINDING SITE1 and LOC285484 BINDING SITE2, designated SEQ ID:6846 and SEQ ID:10306 respectively, to the nucleotide sequence of GAM7957 RNA, herein designated GAM RNA, also designated SEQ ID:297.

Another function of GAM7957 is therefore inhibition of LOC285484 (Accession XP_209630.1). Accordingly, utilities of GAM7957 include diagnosis, prevention and treatment of diseases and clinical conditions associated with LOC285484.

LOC285485 (Accession XP_211913.1) is another GAM7957 target gene, herein designated TARGET GENE. LOC285485 BINDING SITE is a target binding site found in the 5' untranslated region of mRNA encoded by LOC285485, corresponding to a target binding site such as BINDING SITE I, BINDING SITE II or BINDING SITE III of FIG. 8. Table 4 illustrates the complementarity of the nucleotide sequences of LOC285485 BINDING SITE, designated SEQ ID:961, to the nucleotide sequence of GAM7957 RNA, herein designated GAM RNA, also designated SEQ ID:297.

Another function of GAM7957 is therefore inhibition of LOC285485 (Accession XP_211913.1). Accordingly, utilities of GAM7957 include diagnosis, prevention and treatment of diseases and clinical conditions associated with LOC285485.

LOC285495 (Accession XP_211918.1) is another GAM7957 target gene, herein designated TARGET GENE. LOC285495 BINDING SITE1 and LOC285495 BINDING SITE2 are target binding sites found in untranslated regions of mRNA encoded by LOC285495, corresponding to target binding sites such as BINDING SITE I, BINDING SITE II or BINDING SITE III of FIG. 8. Table 4 illustrates the complementarity of the nucleotide sequences of LOC285495 BINDING SITE1 and LOC285495 BINDING SITE2, designated SEQ ID:18458 and SEQ ID:8855 respectively, to the nucleotide sequence of GAM7957 RNA, herein designated GAM RNA, also designated SEQ ID:297.

Another function of GAM7957 is therefore inhibition of LOC285495 (Accession XP_211918.1). Accordingly, utilities of GAM7957 include diagnosis, prevention and treatment of diseases and clinical conditions associated with LOC285495.

LOC285531 (Accession XP_211929.1) is another GAM7957 target gene, herein designated TARGET GENE. LOC285531 BINDING SITE is a target binding site found in the 5' untranslated region of mRNA encoded by LOC285531, corresponding to a target binding site such as BINDING SITE I, BINDING SITE II or BINDING SITE III of FIG. 8. Table 4 illustrates the complementarity of the nucleotide sequences of LOC285531 BINDING SITE, designated SEQ ID:837, to the nucleotide sequence of GAM7957 RNA, herein designated GAM RNA, also designated SEQ ID:297.

Another function of GAM7957 is therefore inhibition of LOC285531 (Accession XP_211929.1). Accordingly, utilities of GAM7957 include diagnosis, prevention and treatment of diseases and clinical conditions associated with LOC285531.

LOC285592 (Accession XP_209669.1) is another GAM7957 target gene, herein designated TARGET GENE. LOC285592 BINDING SITE is a target binding site found in the 5' untranslated region of mRNA encoded by LOC285592, corresponding to a target binding site such as BINDING SITE I, BINDING SITE II or BINDING SITE III of FIG. 8. Table 4 illustrates the complementarity of the nucleotide sequences of LOC285592 BINDING SITE, designated SEQ ID:13066, to the nucleotide sequence of GAM7957 RNA, herein designated GAM RNA, also designated SEQ ID:297.

Another function of GAM7957 is therefore inhibition of LOC285592 (Accession XP_209669.1). Accordingly, utilities of GAM7957 include diagnosis, prevention and treatment of diseases and clinical conditions associated with LOC285592.

LOC285594 (Accession XP_211946.2) is another GAM7957 target gene, herein designated TARGET GENE. LOC285594 BINDING SITE is a target binding site found in the 3' untranslated region of mRNA encoded by LOC285594, corresponding to a target binding site such as BINDING SITE I, BINDING SITE II or BINDING SITE III of FIG. 8. Table 4 illustrates the complementarity of the nucleotide sequences of LOC285594 BINDING SITE, designated SEQ ID:13062, to the nucleotide sequence of GAM7957 RNA, herein designated GAM RNA, also designated SEQ ID:297.

Another function of GAM7957 is therefore inhibition of LOC285594 (Accession XP_211946.2). Accordingly, utilities of GAM7957 include diagnosis, prevention and treatment of diseases and clinical conditions associated with LOC285594.

LOC285608 (Accession XP_211952.1) is another GAM7957 target gene, herein designated TARGET GENE. LOC285608 BINDING SITE1 through LOC285608 BINDING SITE4 are target binding sites found in untranslated regions of mRNA encoded by LOC285608, corresponding to target binding sites such as BINDING SITE I, BINDING SITE II or BINDING SITE III of FIG. 8. Table 4 illustrates the complementarity of the nucleotide sequences of LOC285608 BINDING SITE1 through LOC285608 BINDING SITE4, designated SEQ ID:2726, SEQ ID:4337, SEQ ID:17557 and SEQ ID:1965 respectively, to the nucleotide sequence of GAM7957 RNA, herein designated GAM RNA, also designated SEQ ID:297.

Another function of GAM7957 is therefore inhibition of LOC285608 (Accession XP_211952.1). Accordingly, utilities of GAM7957 include diagnosis, prevention and treatment of diseases and clinical conditions associated with LOC285608.

LOC285614 (Accession XP_211953.1) is another GAM7957 target gene, herein designated TARGET GENE. LOC285614 BINDING SITE is a target binding site found in the 3' untranslated region of mRNA encoded by LOC285614, corresponding to a target binding site such as BINDING SITE I, BINDING SITE II or BINDING SITE III of FIG. 8. Table 4 illustrates the complementarity of the nucleotide sequences of LOC285614 BINDING SITE, designated SEQ ID:10438, to the nucleotide sequence of GAM7957 RNA, herein designated GAM RNA, also designated SEQ ID:297.

Another function of GAM7957 is therefore inhibition of LOC285614 (Accession XP_211953.1). Accordingly, utilities of GAM7957 include diagnosis, prevention and treatment of diseases and clinical conditions associated with LOC285614.

LOC285617 (Accession XP_211950.1) is another GAM7957 target gene, herein designated TARGET GENE. LOC285617 BINDING SITE1 and LOC285617 BINDING SITE2 are target binding sites found in untranslated regions of mRNA encoded by LOC285617, corresponding to target binding sites such as BINDING SITE I, BINDING SITE II or BINDING SITE III of FIG. 8. Table 4 illustrates the complementarity of the nucleotide sequences of LOC285617 BINDING SITE1 and LOC285617 BINDING SITE2, designated SEQ ID:15207 and SEQ ID:11452 respectively, to the nucleotide sequence of GAM7957 RNA, herein designated GAM RNA, also designated SEQ ID:297.

Another function of GAM7957 is therefore inhibition of LOC285617 (Accession XP_211950.1). Accordingly, utilities of GAM7957 include diagnosis, prevention and treatment of diseases and clinical conditions associated with LOC285617.

LOC285665 (Accession XP_211978.1) is another GAM7957 target gene, herein designated TARGET GENE. LOC285665 BINDING SITE is a target binding site found in the 3' untranslated region of mRNA encoded by LOC285665, corresponding to a target binding site such as BINDING SITE I, BINDING SITE II or BINDING SITE III of FIG. 8. Table 4 illustrates the complementarity of the nucleotide sequences of LOC285665 BINDING SITE, designated SEQ ID:10435, to the nucleotide sequence of GAM7957 RNA, herein designated GAM RNA, also designated SEQ ID:297.

Another function of GAM7957 is therefore inhibition of LOC285665 (Accession XP_211978.1). Accordingly, utilities of GAM7957 include diagnosis, prevention and treatment of diseases and clinical conditions associated with LOC285665.

LOC285666 (Accession XP_211977.1) is another GAM7957 target gene, herein designated TARGET GENE. LOC285666 BINDING SITE is a target binding site found in the 3' untranslated region of mRNA encoded by LOC285666, corresponding to a target binding site such as BINDING SITE I, BINDING SITE II or BINDING SITE III of FIG. 8. Table 4 illustrates the complementarity of the nucleotide sequences of LOC285666 BINDING SITE, designated SEQ ID:13322, to the nucleotide sequence of GAM7957 RNA, herein designated GAM RNA, also designated SEQ ID:297.

Another function of GAM7957 is therefore inhibition of LOC285666 (Accession XP_211977.1). Accordingly, utilities of GAM7957 include diagnosis, prevention and treatment of diseases and clinical conditions associated with LOC285666.

LOC285676 (Accession XP_209718.1) is another GAM7957 target gene, herein designated TARGET GENE. LOC285676 BINDING SITE1 and LOC285676 BINDING SITE2 are target binding sites found in untranslated regions of mRNA encoded by LOC285676, corresponding to target binding sites such as BINDING SITE I, BINDING SITE II or BINDING SITE III of FIG. 8. Table 4 illustrates the complementarity of the nucleotide sequences of LOC285676 BINDING SITE1 and LOC285676 BINDING SITE2, designated SEQ ID:15108 and SEQ ID:10438 respectively, to the nucleotide sequence of GAM7957 RNA, herein designated GAM RNA, also designated SEQ ID:297.

Another function of GAM7957 is therefore inhibition of LOC285676 (Accession XP_209718.1). Accordingly, utilities of GAM7957 include diagnosis, prevention and treatment of diseases and clinical conditions associated with LOC285676.

LOC285707 (Accession XP_211987.1) is another GAM7957 target gene, herein designated TARGET GENE. LOC285707 BINDING SITE is a target binding site found in the 5' untranslated region of mRNA encoded by LOC285707, corresponding to a target binding site such as BINDING SITE I, BINDING SITE II or BINDING SITE III of FIG. 8. Table 4 illustrates the complementarity of the nucleotide sequences of LOC285707 BINDING SITE, designated SEQ ID:2856, to the nucleotide sequence of GAM7957 RNA, herein designated GAM RNA, also designated SEQ ID:297.

Another function of GAM7957 is therefore inhibition of LOC285707 (Accession XP_211987.1). Accordingly, utilities of GAM7957 include diagnosis, prevention and treatment of diseases and clinical conditions associated with LOC285707.

LOC285713 (Accession XP_211992.1) is another GAM7957 target gene, herein designated TARGET GENE. LOC285713 BINDING SITE is a target binding site found in the 3' untranslated region of mRNA encoded by LOC285713, corresponding to a target binding site such as BINDING SITE I, BINDING SITE II or BINDING SITE III of FIG. 8. Table 4 illustrates the complementarity of the nucleotide sequences of LOC285713 BINDING SITE, designated SEQ ID:12495, to the nucleotide sequence of GAM7957 RNA, herein designated GAM RNA, also designated SEQ ID:297.

Another function of GAM7957 is therefore inhibition of LOC285713 (Accession XP_211992.1). Accordingly, utilities of GAM7957 include diagnosis, prevention and treatment of diseases and clinical conditions associated with LOC285713.

LOC285727 (Accession XP_212000.1) is another GAM7957 target gene, herein designated TARGET GENE. LOC285727 BINDING SITE is a target binding site found in the 3' untranslated region of mRNA encoded by LOC285727, corresponding to a target binding site such as BINDING SITE I, BINDING SITE II or BINDING SITE III of FIG. 8. Table 4 illustrates the complementarity of the nucleotide sequences of LOC285727 BINDING SITE, designated SEQ ID:1146, to the nucleotide sequence of GAM7957 RNA, herein designated GAM RNA, also designated SEQ ID:297.

Another function of GAM7957 is therefore inhibition of LOC285727 (Accession XP_212000.1). Accordingly, utilities of GAM7957 include diagnosis, prevention and treatment of diseases and clinical conditions associated with LOC285727.

LOC285745 (Accession XP_212007.1) is another GAM7957 target gene, herein designated TARGET GENE. LOC285745 BINDING SITE1 and LOC285745 BINDING SITE2 are target binding sites found in untranslated regions of mRNA encoded by LOC285745, corresponding to target binding sites such as BINDING SITE I, BINDING SITE II or BINDING SITE III of FIG. 8. Table 4 illustrates the complementarity of the nucleotide sequences of LOC285745 BINDING SITE1 and LOC285745 BINDING SITE2, designated SEQ ID:4824 and SEQ ID:19057 respectively, to the nucleotide sequence of GAM7957 RNA, herein designated GAM RNA, also designated SEQ ID:297.

Another function of GAM7957 is therefore inhibition of LOC285745 (Accession XP_212007.1). Accordingly, utilities of GAM7957 include diagnosis, prevention and treatment of diseases and clinical conditions associated with LOC285745.

LOC285747 (Accession XP_209742.1) is another GAM7957 target gene, herein designated TARGET GENE. LOC285747 BINDING SITE is a target binding site found in the 3' untranslated region of mRNA encoded by LOC285747, corresponding to a target binding site such as BINDING SITE I, BINDING SITE II or BINDING SITE III of FIG. 8. Table 4 illustrates the complementarity of the nucleotide sequences of LOC285747 BINDING SITE, designated SEQ ID:9762, to the nucleotide sequence of GAM7957 RNA, herein designated GAM RNA, also designated SEQ ID:297.

Another function of GAM7957 is therefore inhibition of LOC285747 (Accession XP_209742.1). Accordingly, utilities of GAM7957 include diagnosis, prevention and treatment of diseases and clinical conditions associated with LOC285747.

LOC285771 (Accession XP_212015.1) is another GAM7957 target gene, herein designated TARGET GENE. LOC285771 BINDING SITE is a target binding site found in the 5' untranslated region of mRNA encoded by LOC285771, corresponding to a target binding site such as BINDING SITE I, BINDING SITE II or BINDING SITE III of FIG. 8. Table 4 illustrates the complementarity of the nucleotide sequences of LOC285771 BINDING SITE, designated SEQ ID:10490, to the nucleotide sequence of GAM7957 RNA, herein designated GAM RNA, also designated SEQ ID:297.

Another function of GAM7957 is therefore inhibition of LOC285771 (Accession XP_212015.1). Accordingly, utilities of GAM7957 include diagnosis, prevention and treatment of diseases and clinical conditions associated with LOC285771.

LOC285806 (Accession XP_212028.1) is another GAM7957 target gene, herein designated TARGET GENE. LOC285806 BINDING SITE is a target binding site found in the 3' untranslated region of mRNA encoded by LOC285806, corresponding to a target binding site such as BINDING SITE I, BINDING SITE II or BINDING SITE III of FIG. 8. Table 4 illustrates the complementarity of the nucleotide sequences of LOC285806 BINDING SITE, designated SEQ ID:2460, to the nucleotide sequence of GAM7957 RNA, herein designated GAM RNA, also designated SEQ ID:297.

Another function of GAM7957 is therefore inhibition of LOC285806 (Accession XP_212028.1). Accordingly, utilities of GAM7957 include diagnosis, prevention and treatment of diseases and clinical conditions associated with LOC285806.

LOC285833 (Accession XP_209790.1) is another GAM7957 target gene, herein designated TARGET GENE. LOC285833 BINDING SITE is a target binding site found in the 3' untranslated region of mRNA encoded by LOC285833, corresponding to a target binding site such as BINDING SITE I, BINDING SITE II or BINDING SITE III of FIG. 8. Table 4 illustrates the complementarity of the nucleotide sequences of LOC285833 BINDING SITE, designated SEQ ID:5928, to the nucleotide sequence of GAM7957 RNA, herein designated GAM RNA, also designated SEQ ID:297.

Another function of GAM7957 is therefore inhibition of LOC285833 (Accession XP_209790.1). Accordingly, utilities of GAM7957 include diagnosis, prevention and treatment of diseases and clinical conditions associated with LOC285833.

LOC285842 (Accession XP_212041.1) is another GAM7957 target gene, herein designated TARGET GENE. LOC285842 BINDING SITE is a target binding site found in the 3' untranslated region of mRNA encoded by LOC285842, corresponding to a target binding site such as BINDING SITE I, BINDING SITE II or BINDING SITE III of FIG. 8. Table 4 illustrates the complementarity of the nucleotide sequences of LOC285842 BINDING SITE, designated SEQ ID:13726, to the nucleotide sequence of GAM7957 RNA, herein designated GAM RNA, also designated SEQ ID:297.

Another function of GAM7957 is therefore inhibition of LOC285842 (Accession XP_212041.1). Accordingly, utilities of GAM7957 include diagnosis, prevention and treatment of diseases and clinical conditions associated with LOC285842.

LOC285854 (Accession XP_209770.1) is another GAM7957 target gene, herein designated TARGET GENE. LOC285854 BINDING SITE is a target binding site found in the 3' untranslated region of mRNA encoded by LOC285854, corresponding to a target binding site such as BINDING SITE I, BINDING SITE II or BINDING SITE III of FIG. 8. Table 4 illustrates the complementarity of the nucleotide sequences of LOC285854 BINDING SITE, designated SEQ ID:8380, to the nucleotide sequence of GAM7957 RNA, herein designated GAM RNA, also designated SEQ ID:297.

Another function of GAM7957 is therefore inhibition of LOC285854 (Accession XP_209770.1). Accordingly, utilities of GAM7957 include diagnosis, prevention and treatment of diseases and clinical conditions associated with LOC285854.

LOC285855 (Accession XP_209769.1) is another GAM7957 target gene, herein designated TARGET GENE. LOC285855 BINDING SITE1 and LOC285855 BINDING SITE2 are target binding sites found in untranslated regions of mRNA encoded by LOC285855, corresponding to target binding sites such as BINDING SITE I, BINDING SITE II or BINDING SITE III of FIG. 8. Table 4 illustrates the complementarity of the nucleotide sequences of LOC285855 BINDING SITE1 and LOC285855 BINDING SITE2, designated SEQ ID:3330 and SEQ ID:5929 respectively, to the nucleotide sequence of GAM7957 RNA, herein designated GAM RNA, also designated SEQ ID:297.

Another function of GAM7957 is therefore inhibition of LOC285855 (Accession XP_209769.1). Accordingly, utilities of GAM7957 include diagnosis, prevention and treatment of diseases and clinical conditions associated with LOC285855.

LOC285859 (Accession XP_209775.1) is another GAM7957 target gene, herein designated TARGET GENE. LOC285859 BINDING SITE1 and LOC285859 BINDING SITE2 are target binding sites found in untranslated regions of mRNA encoded by LOC285859, corresponding to target binding sites such as BINDING SITE I, BINDING SITE II or BINDING SITE III of FIG. 8. Table 4 illustrates the complementarity of the nucleotide sequences of LOC285859 BINDING SITE1 and LOC285859 BINDING SITE2, designated SEQ ID:4206 and SEQ ID:15343 respectively, to the nucleotide sequence of GAM7957 RNA, herein designated GAM RNA, also designated SEQ ID:297.

Another function of GAM7957 is therefore inhibition of LOC285859 (Accession XP_209775.1). Accordingly, utilities of GAM7957 include diagnosis, prevention and treatment of diseases and clinical conditions associated with LOC285859.

LOC285869 (Accession XP_212058.1) is another GAM7957 target gene, herein designated TARGET GENE. LOC285869 BINDING SITE is a target binding site found in the 3' untranslated region of mRNA encoded by LOC285869, corresponding to a target binding site such as BINDING SITE I, BINDING SITE II or BINDING SITE III of FIG. 8. Table 4 illustrates the complementarity of the nucleotide sequences of LOC285869 BINDING SITE, designated SEQ ID:14367, to the nucleotide sequence of GAM7957 RNA, herein designated GAM RNA, also designated SEQ ID:297.

Another function of GAM7957 is therefore inhibition of LOC285869 (Accession XP_212058.1). Accordingly, utilities of GAM7957 include diagnosis, prevention and treatment of diseases and clinical conditions associated with LOC285869.

LOC285887 (Accession XP_212065.1) is another GAM7957 target gene, herein designated TARGET GENE. LOC285887 BINDING SITE1 and LOC285887 BINDING SITE2 are target binding sites found in untranslated regions of mRNA encoded by LOC285887, corresponding to target binding sites such as BINDING SITE I, BINDING SITE II or BINDING SITE III of FIG. 8. Table 4 illustrates the complementarity of the nucleotide sequences of LOC285887 BINDING SITE1 and LOC285887 BINDING SITE2, designated SEQ ID:13063 and SEQ ID:1492 respectively, to the nucleotide sequence of GAM7957 RNA, herein designated GAM RNA, also designated SEQ ID:297.

Another function of GAM7957 is therefore inhibition of LOC285887 (Accession XP_212065.1). Accordingly, utilities of GAM7957 include diagnosis, prevention and treatment of diseases and clinical conditions associated with LOC285887.

LOC285909 (Accession XP_209811.1) is another GAM7957 target gene, herein designated TARGET GENE. LOC285909 BINDING SITE is a target binding site found in the 3' untranslated region of mRNA encoded by LOC285909, corresponding to a target binding site such as BINDING SITE I, BINDING SITE II or BINDING SITE III of FIG. 8. Table 4 illustrates the complementarity of the nucleotide sequences of LOC285909 BINDING SITE, designated SEQ ID:11641, to the nucleotide sequence of GAM7957 RNA, herein designated GAM RNA, also designated SEQ ID:297.

Another function of GAM7957 is therefore inhibition of LOC285909 (Accession XP_209811.1). Accordingly, utilities of GAM7957 include diagnosis, prevention and treatment of diseases and clinical conditions associated with LOC285909.

LOC285912 (Accession XP_212078.1) is another GAM7957 target gene, herein designated TARGET GENE. LOC285912 BINDING SITE1 through LOC285912 BINDING SITE3 are target binding sites found in untranslated regions of mRNA encoded by LOC285912, corresponding to target binding sites such as BINDING SITE I, BINDING SITE II or BINDING SITE III of FIG. 8. Table 4 illustrates the complementarity of the nucleotide sequences of LOC285912 BINDING SITE1 through LOC285912 BINDING SITE3, designated SEQ ID:2159, SEQ ID:16843 and SEQ ID:16368 respectively, to the nucleotide sequence of GAM7957 RNA, herein designated GAM RNA, also designated SEQ ID:297.

Another function of GAM7957 is therefore inhibition of LOC285912 (Accession XP_212078.1). Accordingly, utilities of GAM7957 include diagnosis, prevention and treatment of diseases and clinical conditions associated with LOC285912.

LOC285913 (Accession XP_212074.1) is another GAM7957 target gene, herein designated TARGET GENE. LOC285913 BINDING SITE1 through LOC285913 BINDING SITE3 are target binding sites found in untranslated regions of mRNA encoded by LOC285913, corresponding to target binding sites such as BINDING SITE I, BINDING SITE II or BINDING SITE III of FIG. 8. Table 4 illustrates the complementarity of the nucleotide sequences of LOC285913 BINDING SITE1 through LOC285913 BINDING SITE3, designated SEQ ID:16843, SEQ ID:19036 and SEQ ID:16369 respectively, to the nucleotide sequence of GAM7957 RNA, herein designated GAM RNA, also designated SEQ ID:297.

Another function of GAM7957 is therefore inhibition of LOC285913 (Accession XP_212074.1). Accordingly, utilities of GAM7957 include diagnosis, prevention and treatment of diseases and clinical conditions associated with LOC285913.

LOC285914 (Accession XP_209810.1) is another GAM7957 target gene, herein designated TARGET GENE. LOC285914 BINDING SITE1 and LOC285914 BINDING SITE2 are target binding sites found in untranslated regions of mRNA encoded by LOC285914, corresponding to target binding sites such as BINDING SITE I, BINDING SITE II or BINDING SITE III of FIG. 8. Table 4 illustrates the complementarity of the nucleotide sequences of LOC285914 BINDING SITE1 and LOC285914 BINDING SITE2, designated SEQ ID:2306 and SEQ ID:7908 respectively, to the nucleotide sequence of GAM7957 RNA, herein designated GAM RNA, also designated SEQ ID:297.

Another function of GAM7957 is therefore inhibition of LOC285914 (Accession XP_209810.1). Accordingly, utilities of GAM7957 include diagnosis, prevention and treatment of diseases and clinical conditions associated with LOC285914.

LOC285916 (Accession XP_212082.1) is another GAM7957 target gene, herein designated TARGET GENE. LOC285916 BINDING SITE is a target binding site found in the 3' untranslated region of mRNA encoded by LOC285916, corresponding to a target binding site such as BINDING SITE I, BINDING SITE II or BINDING SITE III of FIG. 8. Table 4 illustrates the complementarity of the nucleotide sequences of LOC285916 BINDING SITE, designated SEQ ID:475, to the nucleotide sequence of GAM7957 RNA, herein designated GAM RNA, also designated SEQ ID:297.

Another function of GAM7957 is therefore inhibition of LOC285916 (Accession XP_212082.1). Accordingly, utilities of GAM7957 include diagnosis, prevention and treatment of diseases and clinical conditions associated with LOC285916.

LOC285920 (Accession XP_212091.1) is another GAM7957 target gene, herein designated TARGET GENE. LOC285920 BINDING SITE is a target binding site found in the 5' untranslated region of mRNA encoded by LOC285920, corresponding to a target binding site such as BINDING SITE I, BINDING SITE II or BINDING SITE III of FIG. 8. Table 4 illustrates the complementarity of the nucleotide sequences of LOC285920 BINDING SITE, designated SEQ ID:15752, to the nucleotide sequence of GAM7957 RNA, herein designated GAM RNA, also designated SEQ ID:297.

Another function of GAM7957 is therefore inhibition of LOC285920 (Accession XP_212091.1). Accordingly, utilities of GAM7957 include diagnosis, prevention and treatment of diseases and clinical conditions associated with LOC285920.

LOC285923 (Accession XP_212104.1) is another GAM7957 target gene, herein designated TARGET GENE. LOC285923 BINDING SITE is a target binding site found in the 3' untranslated region of mRNA encoded by LOC285923, corresponding to a target binding site such as BINDING SITE I, BINDING SITE II or BINDING SITE III of FIG. 8. Table 4 illustrates the complementarity of the nucleotide sequences of LOC285923 BINDING SITE, designated SEQ ID:9763, to the nucleotide sequence of GAM7957 RNA, herein designated GAM RNA, also designated SEQ ID:297.

Another function of GAM7957 is therefore inhibition of LOC285923 (Accession XP_212104.1). Accordingly, utilities of GAM7957 include diagnosis, prevention and treatment of diseases and clinical conditions associated with LOC285923.

LOC285924 (Accession XP_209816.1) is another GAM7957 target gene, herein designated TARGET GENE. LOC285924 BINDING SITE is a target binding site found in the 3' untranslated region of mRNA encoded by LOC285924, corresponding to a target binding site such as BINDING SITE I, BINDING SITE II or BINDING SITE III of FIG. 8. Table 4 illustrates the complementarity of the nucleotide sequences of LOC285924 BINDING SITE, designated SEQ ID:18617, to the nucleotide sequence of GAM7957 RNA, herein designated GAM RNA, also designated SEQ ID:297.

Another function of GAM7957 is therefore inhibition of LOC285924 (Accession XP_209816.1). Accordingly, utilities of GAM7957 include diagnosis, prevention and treatment of diseases and clinical conditions associated with LOC285924.

LOC285931 (Accession NP_777609.1) is another GAM7957 target gene, herein designated TARGET GENE. LOC285931 BINDING SITE is a target binding site found in the 3' untranslated region of mRNA encoded by LOC285931, corresponding to a target binding site such as BINDING SITE I, BINDING SITE II or BINDING SITE III of FIG. 8. Table 4 illustrates the complementarity of the nucleotide sequences of LOC285931 BINDING SITE, designated SEQ ID:15676, to the nucleotide sequence of GAM7957 RNA, herein designated GAM RNA, also designated SEQ ID:297.

Another function of GAM7957 is therefore inhibition of LOC285931 (Accession NP_777609.1). Accordingly, utilities of GAM7957 include diagnosis, prevention and treatment of diseases and clinical conditions associated with LOC285931.

LOC285953 (Accession XP_209820.1) is another GAM7957 target gene, herein designated TARGET GENE. LOC285953 BINDING SITE1 and LOC285953 BINDING SITE2 are target binding sites found in untranslated regions of mRNA encoded by LOC285953, corresponding to target binding sites such as BINDING SITE I, BINDING SITE II or BINDING SITE III of FIG. 8. Table 4 illustrates the complementarity of the nucleotide sequences of LOC285953 BINDING SITE1 and LOC285953 BINDING SITE2, designated SEQ ID:7352 and SEQ ID:9781 respectively, to the nucleotide sequence of GAM7957 RNA, herein designated GAM RNA, also designated SEQ ID:297.

Another function of GAM7957 is therefore inhibition of LOC285953 (Accession XP_209820.1). Accordingly, utilities of GAM7957 include diagnosis, prevention and treatment of diseases and clinical conditions associated with LOC285953.

LOC285960 (Accession XP_212088.1) is another GAM7957 target gene, herein designated TARGET GENE. LOC285960 BINDING SITE is a target binding site found in the 3' untranslated region of mRNA encoded by LOC285960, corresponding to a target binding site such as BINDING SITE I, BINDING SITE II or BINDING SITE III of FIG. 8. Table 4 illustrates the complementarity of the nucleotide sequences of LOC285960 BINDING SITE, designated SEQ ID:18690, to the nucleotide sequence of GAM7957 RNA, herein designated GAM RNA, also designated SEQ ID:297.

Another function of GAM7957 is therefore inhibition of LOC285960 (Accession XP_212088.1). Accordingly, utilities of GAM7957 include diagnosis, prevention and treatment of diseases and clinical conditions associated with LOC285960.

LOC285987 (Accession XP_212127.1) is another GAM7957 target gene, herein designated TARGET GENE. LOC285987 BINDING SITE is a target binding site found in the 3' untranslated region of mRNA encoded by LOC285987, corresponding to a target binding site such as BINDING SITE I, BINDING SITE II or BINDING SITE III of FIG. 8. Table 4 illustrates the complementarity of the nucleotide sequences of LOC285987 BINDING SITE, designated SEQ ID:3055, to the nucleotide sequence of GAM7957 RNA, herein designated GAM RNA, also designated SEQ ID:297.

Another function of GAM7957 is therefore inhibition of LOC285987 (Accession XP_212127.1). Accordingly, utilities of GAM7957 include diagnosis, prevention and treatment of diseases and clinical conditions associated with LOC285987.

LOC285989 (Accession XP_212111.1) is another GAM7957 target gene, herein designated TARGET GENE.

LOC285989 BINDING SITE is a target binding site found in the 5' untranslated region of mRNA encoded by LOC285989, corresponding to a target binding site such as BINDING SITE I, BINDING SITE II or BINDING SITE III of FIG. 8. Table 4 illustrates the complementarity of the nucleotide sequences of LOC285989 BINDING SITE, designated SEQ ID:11322, to the nucleotide sequence of GAM7957 RNA, herein designated GAM RNA, also designated SEQ ID:297.

Another function of GAM7957 is therefore inhibition of LOC285989 (Accession XP_212111.1). Accordingly, utilities of GAM7957 include diagnosis, prevention and treatment of diseases and clinical conditions associated with LOC285989.

LOC285996 (Accession XP_212128.1) is another GAM7957 target gene, herein designated TARGET GENE. LOC285996 BINDING SITE1 through LOC285996 BINDING SITE3 are target binding sites found in untranslated regions of mRNA encoded by LOC285996, corresponding to target binding sites such as BINDING SITE I, BINDING SITE II or BINDING SITE III of FIG. 8. Table 4 illustrates the complementarity of the nucleotide sequences of LOC285996 BINDING SITE1 through LOC285996 BINDING SITE3, designated SEQ ID:15983, SEQ ID:13066 and SEQ ID:15893 respectively, to the nucleotide sequence of GAM7957 RNA, herein designated GAM RNA, also designated SEQ ID:297.

Another function of GAM7957 is therefore inhibition of LOC285996 (Accession XP_212128.1). Accordingly, utilities of GAM7957 include diagnosis, prevention and treatment of diseases and clinical conditions associated with LOC285996.

LOC286007 (Accession XP_212133.1) is another GAM7957 target gene, herein designated TARGET GENE. LOC286007 BINDING SITE is a target binding site found in the 3' untranslated region of mRNA encoded by LOC286007, corresponding to a target binding site such as BINDING SITE I, BINDING SITE II or BINDING SITE III of FIG. 8. Table 4 illustrates the complementarity of the nucleotide sequences of LOC286007 BINDING SITE, designated SEQ ID:4082, to the nucleotide sequence of GAM7957 RNA, herein designated GAM RNA, also designated SEQ ID:297.

Another function of GAM7957 is therefore inhibition of LOC286007 (Accession XP_212133.1). Accordingly, utilities of GAM7957 include diagnosis, prevention and treatment of diseases and clinical conditions associated with LOC286007.

LOC286029 (Accession XP_209866.1) is another GAM7957 target gene, herein designated TARGET GENE. LOC286029 BINDING SITE1 and LOC286029 BINDING SITE2 are target binding sites found in untranslated regions of mRNA encoded by LOC286029, corresponding to target binding sites such as BINDING SITE I, BINDING SITE II or BINDING SITE III of FIG. 8. Table 4 illustrates the complementarity of the nucleotide sequences of LOC286029 BINDING SITE1 and LOC286029 BINDING SITE2, designated SEQ ID:19031 and SEQ ID:11466 respectively, to the nucleotide sequence of GAM7957 RNA, herein designated GAM RNA, also designated SEQ ID:297.

Another function of GAM7957 is therefore inhibition of LOC286029 (Accession XP_209866.1). Accordingly, utilities of GAM7957 include diagnosis, prevention and treatment of diseases and clinical conditions associated with LOC286029.

LOC286030 (Accession XP_209868.1) is another GAM7957 target gene, herein designated TARGET GENE. LOC286030 BINDING SITE is a target binding site found in the 3' untranslated region of mRNA encoded by LOC286030, corresponding to a target binding site such as BINDING SITE I, BINDING SITE II or BINDING SITE III of FIG. 8. Table 4 illustrates the complementarity of the nucleotide sequences of LOC286030 BINDING SITE, designated SEQ ID:925, to the nucleotide sequence of GAM7957 RNA, herein designated GAM RNA, also designated SEQ ID:297.

Another function of GAM7957 is therefore inhibition of LOC286030 (Accession XP_209868.1). Accordingly, utilities of GAM7957 include diagnosis, prevention and treatment of diseases and clinical conditions associated with LOC286030.

LOC286039 (Accession XP_209873.1) is another GAM7957 target gene, herein designated TARGET GENE. LOC286039 BINDING SITE is a target binding site found in the 3' untranslated region of mRNA encoded by LOC286039, corresponding to a target binding site such as BINDING SITE I, BINDING SITE II or BINDING SITE III of FIG. 8. Table 4 illustrates the complementarity of the nucleotide sequences of LOC286039 BINDING SITE, designated SEQ ID:925, to the nucleotide sequence of GAM7957 RNA, herein designated GAM RNA, also designated SEQ ID:297.

Another function of GAM7957 is therefore inhibition of LOC286039 (Accession XP_209873.1). Accordingly, utilities of GAM7957 include diagnosis, prevention and treatment of diseases and clinical conditions associated with LOC286039.

LOC286047 (Accession XP_209872.1) is another GAM7957 target gene, herein designated TARGET GENE. LOC286047 BINDING SITE is a target binding site found in the 3' untranslated region of mRNA encoded by LOC286047, corresponding to a target binding site such as BINDING SITE I, BINDING SITE II or BINDING SITE III of FIG. 8. Table 4 illustrates the complementarity of the nucleotide sequences of LOC286047 BINDING SITE, designated SEQ ID:4734, to the nucleotide sequence of GAM7957 RNA, herein designated GAM RNA, also designated SEQ ID:297.

Another function of GAM7957 is therefore inhibition of LOC286047 (Accession XP_209872.1). Accordingly, utilities of GAM7957 include diagnosis, prevention and treatment of diseases and clinical conditions associated with LOC286047.

LOC286048 (Accession XP_212141.3) is another GAM7957 target gene, herein designated TARGET GENE. LOC286048 BINDING SITE is a target binding site found in the 3' untranslated region of mRNA encoded by LOC286048, corresponding to a target binding site such as BINDING SITE I, BINDING SITE II or BINDING SITE III of FIG. 8. Table 4 illustrates the complementarity of the nucleotide sequences of LOC286048 BINDING SITE, designated SEQ ID:13065, to the nucleotide sequence of GAM7957 RNA, herein designated GAM RNA, also designated SEQ ID:297.

Another function of GAM7957 is therefore inhibition of LOC286048 (Accession XP_212141.3). Accordingly, utilities of GAM7957 include diagnosis, prevention and treatment of diseases and clinical conditions associated with LOC286048.

LOC286075 (Accession NP_776192.1) is another GAM7957 target gene, herein designated TARGET GENE. LOC286075 BINDING SITE is a target binding site found in the 3' untranslated region of mRNA encoded by LOC286075, corresponding to a target binding site such as BINDING SITE I, BINDING SITE II or BINDING SITE III of FIG. 8. Table 4 illustrates the complementarity of the nucleotide sequences of LOC286075 BINDING SITE, designated SEQ ID:9871, to the nucleotide sequence of GAM7957 RNA, herein designated GAM RNA, also designated SEQ ID:297.

Another function of GAM7957 is therefore inhibition of LOC286075 (Accession NP_776192.1). Accordingly, utilities of GAM7957 include diagnosis, prevention and treatment of diseases and clinical conditions associated with LOC286075.

LOC286112 (Accession XP_212176.1) is another GAM7957 target gene, herein designated TARGET GENE. LOC286112 BINDING SITE is a target binding site found in the 3' untranslated region of mRNA encoded by LOC286112, corresponding to a target binding site such as BINDING SITE I, BINDING SITE II or BINDING SITE III of FIG. 8. Table 4 illustrates the complementarity of the nucleotide sequences of LOC286112 BINDING SITE, designated SEQ ID:4600, to the nucleotide sequence of GAM7957 RNA, herein designated GAM RNA, also designated SEQ ID:297.

Another function of GAM7957 is therefore inhibition of LOC286112 (Accession XP_212176.1). Accordingly, utilities of GAM7957 include diagnosis, prevention and treatment of diseases and clinical conditions associated with LOC286112.

LOC286126 (Accession XP_212185.1) is another GAM7957 target gene, herein designated TARGET GENE. LOC286126 BINDING SITE is a target binding site found in the 3' untranslated region of mRNA encoded by LOC286126, corresponding to a target binding site such as BINDING SITE I, BINDING SITE II or BINDING SITE III of FIG. 8. Table 4 illustrates the complementarity of the nucleotide sequences of LOC286126 BINDING SITE, designated SEQ ID:8922, to the nucleotide sequence of GAM7957 RNA, herein designated GAM RNA, also designated SEQ ID:297.

Another function of GAM7957 is therefore inhibition of LOC286126 (Accession XP_212185.1). Accordingly, utilities of GAM7957 include diagnosis, prevention and treatment of diseases and clinical conditions associated with LOC286126.

LOC286147 (Accession XP_212199.2) is another GAM7957 target gene, herein designated TARGET GENE. LOC286147 BINDING SITE is a target binding site found in the 3' untranslated region of mRNA encoded by LOC286147, corresponding to a target binding site such as BINDING SITE I, BINDING SITE II or BINDING SITE III of FIG. 8. Table 4 illustrates the complementarity of the nucleotide sequences of LOC286147 BINDING SITE, designated SEQ ID:10132, to the nucleotide sequence of GAM7957 RNA, herein designated GAM RNA, also designated SEQ ID:297.

Another function of GAM7957 is therefore inhibition of LOC286147 (Accession XP_212199.2). Accordingly, utilities of GAM7957 include diagnosis, prevention and treatment of diseases and clinical conditions associated with LOC286147.

LOC286154 (Accession XP_212204.1) is another GAM7957 target gene, herein designated TARGET GENE. LOC286154 BINDING SITE is a target binding site found in the 5' untranslated region of mRNA encoded by LOC286154, corresponding to a target binding site such as BINDING SITE I, BINDING SITE II or BINDING SITE III of FIG. 8. Table 4 illustrates the complementarity of the nucleotide sequences of LOC286154 BINDING SITE, designated SEQ ID:2949, to the nucleotide sequence of GAM7957 RNA, herein designated GAM RNA, also designated SEQ ID:297.

Another function of GAM7957 is therefore inhibition of LOC286154 (Accession XP_212204.1). Accordingly, utilities of GAM7957 include diagnosis, prevention and treatment of diseases and clinical conditions associated with LOC286154.

LOC286166 (Accession XP_209925.1) is another GAM7957 target gene, herein designated TARGET GENE. LOC286166 BINDING SITE is a target binding site found in the 5' untranslated region of mRNA encoded by LOC286166, corresponding to a target binding site such as BINDING SITE I, BINDING SITE II or BINDING SITE III of FIG. 8. Table 4 illustrates the complementarity of the nucleotide sequences of LOC286166 BINDING SITE, designated SEQ ID:9764, to the nucleotide sequence of GAM7957 RNA, herein designated GAM RNA, also designated SEQ ID:297.

Another function of GAM7957 is therefore inhibition of LOC286166 (Accession XP_209925.1). Accordingly, utilities of GAM7957 include diagnosis, prevention and treatment of diseases and clinical conditions associated with LOC286166.

LOC286184 (Accession XP_212216.1) is another GAM7957 target gene, herein designated TARGET GENE. LOC286184 BINDING SITE is a target binding site found in the 5' untranslated region of mRNA encoded by LOC286184, corresponding to a target binding site such as BINDING SITE I, BINDING SITE II or BINDING SITE III of FIG. 8. Table 4 illustrates the complementarity of the nucleotide sequences of LOC286184 BINDING SITE, designated SEQ ID:6044, to the nucleotide sequence of GAM7957 RNA, herein designated GAM RNA, also designated SEQ ID:297.

Another function of GAM7957 is therefore inhibition of LOC286184 (Accession XP_212216.1). Accordingly, utilities of GAM7957 include diagnosis, prevention and treatment of diseases and clinical conditions associated with LOC286184.

LOC286186 (Accession XP_212219.1) is another GAM7957 target gene, herein designated TARGET GENE. LOC286186 BINDING SITE is a target binding site found in the 3' untranslated region of mRNA encoded by LOC286186, corresponding to a target binding site such as BINDING SITE I, BINDING SITE II or BINDING SITE III of FIG. 8. Table 4 illustrates the complementarity of the nucleotide sequences of LOC286186 BINDING SITE, designated SEQ ID:3979, to the nucleotide sequence of GAM7957 RNA, herein designated GAM RNA, also designated SEQ ID:297.

Another function of GAM7957 is therefore inhibition of LOC286186 (Accession XP_212219.1). Accordingly, utilities of GAM7957 include diagnosis, prevention and treatment of diseases and clinical conditions associated with LOC286186.

LOC286188 (Accession XP_209933.1) is another GAM7957 target gene, herein designated TARGET GENE. LOC286188 BINDING SITE is a target binding site found in the 3' untranslated region of mRNA encoded by LOC286188, corresponding to a target binding site such as BINDING SITE I, BINDING SITE II or BINDING SITE III of FIG. 8. Table 4 illustrates the complementarity of the nucleotide sequences of LOC286188 BINDING SITE, designated SEQ ID:17423, to the nucleotide sequence of GAM7957 RNA, herein designated GAM RNA, also designated SEQ ID:297.

Another function of GAM7957 is therefore inhibition of LOC286188 (Accession XP_209933.1). Accordingly, utilities of GAM7957 include diagnosis, prevention and treatment of diseases and clinical conditions associated with LOC286188.

LOC286197 (Accession XP_209940.1) is another GAM7957 target gene, herein designated TARGET GENE. LOC286197 BINDING SITE is a target binding site found in the 3' untranslated region of mRNA encoded by LOC286197, corresponding to a target binding site such as BINDING SITE I, BINDING SITE II or BINDING SITE III of FIG. 8. Table 4 illustrates the complementarity of the nucleotide sequences of LOC286197 BINDING SITE, designated SEQ ID:12144, to the nucleotide sequence of GAM7957 RNA, herein designated GAM RNA, also designated SEQ ID:297.

Another function of GAM7957 is therefore inhibition of LOC286197 (Accession XP_209940.1). Accordingly, utilities of GAM7957 include diagnosis, prevention and treatment of diseases and clinical conditions associated with LOC286197.

LOC286206 (Accession XP_209953.1) is another GAM7957 target gene, herein designated TARGET GENE. LOC286206 BINDING SITE is a target binding site found in the 3' untranslated region of mRNA encoded by LOC286206, corresponding to a target binding site such as BINDING SITE I, BINDING SITE II or BINDING SITE III of FIG. 8. Table 4 illustrates the complementarity of the nucleotide sequences of LOC286206 BINDING SITE, designated SEQ ID:11327, to the nucleotide sequence of GAM7957 RNA, herein designated GAM RNA, also designated SEQ ID:297.

Another function of GAM7957 is therefore inhibition of LOC286206 (Accession XP_209953.1). Accordingly, utilities of GAM7957 include diagnosis, prevention and treatment of diseases and clinical conditions associated with LOC286206.

LOC286208 (Accession XP_212230.1) is another GAM7957 target gene, herein designated TARGET GENE. LOC286208 BINDING SITE is a target binding site found in the 3' untranslated region of mRNA encoded by LOC286208, corresponding to a target binding site such as BINDING SITE I, BINDING SITE II or BINDING SITE III of FIG. 8. Table 4 illustrates the complementarity of the nucleotide sequences of LOC286208 BINDING SITE, designated SEQ ID:13066, to the nucleotide sequence of GAM7957 RNA, herein designated GAM RNA, also designated SEQ ID:297.

Another function of GAM7957 is therefore inhibition of LOC286208 (Accession XP_212230.1). Accordingly, utilities of GAM7957 include diagnosis, prevention and treatment of diseases and clinical conditions associated with LOC286208.

LOC286218 (Accession XP_212235.1) is another GAM7957 target gene, herein designated TARGET GENE. LOC286218 BINDING SITE is a target binding site found in the 3' untranslated region of mRNA encoded by LOC286218, corresponding to a target binding site such as BINDING SITE I, BINDING SITE II or BINDING SITE III of FIG. 8. Table 4 illustrates the complementarity of the nucleotide sequences of LOC286218 BINDING SITE, designated SEQ ID:5322, to the nucleotide sequence of GAM7957 RNA, herein designated GAM RNA, also designated SEQ ID:297.

Another function of GAM7957 is therefore inhibition of LOC286218 (Accession XP_212235.1). Accordingly, utilities of GAM7957 include diagnosis, prevention and treatment of diseases and clinical conditions associated with LOC286218.

LOC286219 (Accession XP_212236.1) is another GAM7957 target gene, herein designated TARGET GENE. LOC286219 BINDING SITE is a target binding site found in the 3' untranslated region of mRNA encoded by LOC286219, corresponding to a target binding site such as BINDING SITE I, BINDING SITE II or BINDING SITE III of FIG. 8. Table 4 illustrates the complementarity of the nucleotide sequences of LOC286219 BINDING SITE, designated SEQ ID:19821, to the nucleotide sequence of GAM7957 RNA, herein designated GAM RNA, also designated SEQ ID:297.

Another function of GAM7957 is therefore inhibition of LOC286219 (Accession XP_212236.1). Accordingly, utilities of GAM7957 include diagnosis, prevention and treatment of diseases and clinical conditions associated with LOC286219.

LOC286235 (Accession XP_212238.1) is another GAM7957 target gene, herein designated TARGET GENE. LOC286235 BINDING SITE is a target binding site found in the 3' untranslated region of mRNA encoded by LOC286235, corresponding to a target binding site such as BINDING SITE I, BINDING SITE II or BINDING SITE III of FIG. 8. Table 4 illustrates the complementarity of the nucleotide sequences of LOC286235 BINDING SITE, designated SEQ ID:8306, to the nucleotide sequence of GAM7957 RNA, herein designated GAM RNA, also designated SEQ ID:297.

Another function of GAM7957 is therefore inhibition of LOC286235 (Accession XP_212238.1). Accordingly, utilities of GAM7957 include diagnosis, prevention and treatment of diseases and clinical conditions associated with LOC286235.

LOC286237 (Accession XP_212241.1) is another GAM7957 target gene, herein designated TARGET GENE. LOC286237 BINDING SITE is a target binding site found in the 3' untranslated region of mRNA encoded by LOC286237, corresponding to a target binding site such as BINDING SITE I, BINDING SITE II or BINDING SITE III of FIG. 8. Table 4 illustrates the complementarity of the nucleotide sequences of LOC286237 BINDING SITE, designated SEQ ID:12289, to the nucleotide sequence of GAM7957 RNA, herein designated GAM RNA, also designated SEQ ID:297.

Another function of GAM7957 is therefore inhibition of LOC286237 (Accession XP_212241.1). Accordingly, utilities of GAM7957 include diagnosis, prevention and treatment of diseases and clinical conditions associated with LOC286237.

LOC286255 (Accession XP_209977.1) is another GAM7957 target gene, herein designated TARGET GENE. LOC286255 BINDING SITE is a target binding site found in the 5' untranslated region of mRNA encoded by LOC286255, corresponding to a target binding site such as BINDING SITE I, BINDING SITE II or BINDING SITE III of FIG. 8. Table 4 illustrates the complementarity of the nucleotide sequences of LOC286255 BINDING SITE, designated SEQ ID:13199, to the nucleotide sequence of GAM7957 RNA, herein designated GAM RNA, also designated SEQ ID:297.

Another function of GAM7957 is therefore inhibition of LOC286255 (Accession XP_209977.1). Accordingly, utilities of GAM7957 include diagnosis, prevention and treatment of diseases and clinical conditions associated with LOC286255.

LOC286258 (Accession XP_209972.1) is another GAM7957 target gene, herein designated TARGET GENE. LOC286258 BINDING SITE1 and LOC286258 BINDING SITE2 are target binding sites found in untranslated regions of mRNA encoded by LOC286258, corresponding to target binding sites such as BINDING SITE I, BINDING SITE II or BINDING SITE III of FIG. 8. Table 4 illustrates the complementarity of the nucleotide sequences of LOC286258 BINDING SITE1 and LOC286258 BINDING SITE2, designated SEQ ID:10659 and SEQ ID:17108 respectively, to the nucleotide sequence of GAM7957 RNA, herein designated GAM RNA, also designated SEQ ID:297.

Another function of GAM7957 is therefore inhibition of LOC286258 (Accession XP_209972.1). Accordingly, utilities of GAM7957 include diagnosis, prevention and treatment of diseases and clinical conditions associated with LOC286258.

LOC286260 (Accession XP_209976.1) is another GAM7957 target gene, herein designated TARGET GENE. LOC286260 BINDING SITE1 and LOC286260 BINDING SITE2 are target binding sites found in untranslated regions of mRNA encoded by LOC286260, corresponding to target binding sites such as BINDING SITE I, BINDING SITE II or BINDING SITE III of FIG. 8. Table 4 illustrates the complementarity of the nucleotide sequences of LOC286260 BINDING SITE1 and LOC286260 BINDING SITE2, designated SEQ ID:15984 and SEQ ID:2924 respectively, to the nucleotide sequence of GAM7957 RNA, herein designated GAM RNA, also designated SEQ ID:297.

Another function of GAM7957 is therefore inhibition of LOC286260 (Accession XP_209976.1). Accordingly, utilities of GAM7957 include diagnosis, prevention and treatment of diseases and clinical conditions associated with LOC286260.

LOC286337 (Accession XP_212274.3) is another GAM7957 target gene, herein designated TARGET GENE. LOC286337 BINDING SITE is a target binding site found in the 3' untranslated region of mRNA encoded by LOC286337, corresponding to a target binding site such as BINDING SITE I, BINDING SITE II or BINDING SITE III of FIG. 8. Table 4 illustrates the complementarity of the nucleotide sequences of LOC286337 BINDING SITE, designated SEQ ID:15675, to the nucleotide sequence of GAM7957 RNA, herein designated GAM RNA, also designated SEQ ID:297.

Another function of GAM7957 is therefore inhibition of LOC286337 (Accession XP_212274.3). Accordingly, utilities of GAM7957 include diagnosis, prevention and treatment of diseases and clinical conditions associated with LOC286337.

LOC286341 (Accession XP_212278.1) is another GAM7957 target gene, herein designated TARGET GENE. LOC286341 BINDING SITE is a target binding site found in the 3' untranslated region of mRNA encoded by LOC286341, corresponding to a target binding site such as BINDING SITE I, BINDING SITE II or BINDING SITE III of FIG. 8. Table 4 illustrates the complementarity of the nucleotide sequences of LOC286341 BINDING SITE, designated SEQ ID:7590, to the nucleotide sequence of GAM7957 RNA, herein designated GAM RNA, also designated SEQ ID:297.

Another function of GAM7957 is therefore inhibition of LOC286341 (Accession XP_212278.1). Accordingly, utilities of GAM7957 include diagnosis, prevention and treatment of diseases and clinical conditions associated with LOC286341.

LOC286356 (Accession XP_212290.1) is another GAM7957 target gene, herein designated TARGET GENE. LOC286356 BINDING SITE1 and LOC286356 BINDING SITE2 are target binding sites found in untranslated regions of mRNA encoded by LOC286356, corresponding to target binding sites such as BINDING SITE I, BINDING SITE II or BINDING SITE III of FIG. 8. Table 4 illustrates the complementarity of the nucleotide sequences of LOC286356 BINDING SITE1 and LOC286356 BINDING SITE2, designated SEQ ID:16262 and SEQ ID:3561 respectively, to the nucleotide sequence of GAM7957 RNA, herein designated GAM RNA, also designated SEQ ID:297.

Another function of GAM7957 is therefore inhibition of LOC286356 (Accession XP_212290.1). Accordingly, utilities of GAM7957 include diagnosis, prevention and treatment of diseases and clinical conditions associated with LOC286356.

LOC286372 (Accession XP_212294.1) is another GAM7957 target gene, herein designated TARGET GENE. LOC286372 BINDING SITE1 and LOC286372 BINDING SITE2 are target binding sites found in untranslated regions of mRNA encoded by LOC286372, corresponding to target binding sites such as BINDING SITE I, BINDING SITE II or BINDING SITE III of FIG. 8. Table 4 illustrates the complementarity of the nucleotide sequences of LOC286372 BINDING SITE1 and LOC286372 BINDING SITE2, designated SEQ ID:13155 and SEQ ID:9990 respectively, to the nucleotide sequence of GAM7957 RNA, herein designated GAM RNA, also designated SEQ ID:297.

Another function of GAM7957 is therefore inhibition of LOC286372 (Accession XP_212294.1). Accordingly, utilities of GAM7957 include diagnosis, prevention and treatment of diseases and clinical conditions associated with LOC286372.

LOC286374 (Accession XP_212293.1) is another GAM7957 target gene, herein designated TARGET GENE. LOC286374 BINDING SITE1 and LOC286374 BINDING SITE2 are target binding sites found in untranslated regions of mRNA encoded by LOC286374, corresponding to target binding sites such as BINDING SITE I, BINDING SITE II or BINDING SITE III of FIG. 8. Table 4 illustrates the complementarity of the nucleotide sequences of LOC286374 BINDING SITE1 and LOC286374 BINDING SITE2, designated SEQ ID:15343 and SEQ ID:14789 respectively, to the nucleotide sequence of GAM7957 RNA, herein designated GAM RNA, also designated SEQ ID:297.

Another function of GAM7957 is therefore inhibition of LOC286374 (Accession XP_212293.1). Accordingly, utilities of GAM7957 include diagnosis, prevention and treatment of diseases and clinical conditions associated with LOC286374.

LOC286376 (Accession XP_210027.1) is another GAM7957 target gene, herein designated TARGET GENE. LOC286376 BINDING SITE is a target binding site found in the 3' untranslated region of mRNA encoded by LOC286376, corresponding to a target binding site such as BINDING SITE I, BINDING SITE II or BINDING SITE III of FIG. 8. Table 4 illustrates the complementarity of the nucleotide sequences of LOC286376 BINDING SITE, designated SEQ ID:18691, to the nucleotide sequence of GAM7957 RNA, herein designated GAM RNA, also designated SEQ ID:297.

Another function of GAM7957 is therefore inhibition of LOC286376 (Accession XP_210027.1). Accordingly, utilities of GAM7957 include diagnosis, prevention and treatment of diseases and clinical conditions associated with LOC286376.

LOC286395 (Accession XP_212308.1) is another GAM7957 target gene, herein designated TARGET GENE. LOC286395 BINDING SITE1 through LOC286395 BINDING SITE3 are target binding sites found in untranslated regions of mRNA encoded by LOC286395, corresponding to target binding sites such as BINDING SITE I, BINDING SITE II or BINDING SITE III of FIG. 8. Table 4 illustrates the complementarity of the nucleotide sequences of LOC286395 BINDING SITE1 through LOC286395 BINDING SITE3, designated SEQ ID:14790, SEQ ID:3091 and SEQ ID:13180 respectively, to the nucleotide sequence of GAM7957 RNA, herein designated GAM RNA, also designated SEQ ID:297.

Another function of GAM7957 is therefore inhibition of LOC286395 (Accession XP_212308.1). Accordingly, utilities of GAM7957 include diagnosis, prevention and treatment of diseases and clinical conditions associated with LOC286395.

LOC286404 (Accession XP_210036.1) is another GAM7957 target gene, herein designated TARGET GENE. LOC286404 BINDING SITE is a target binding site found in the 3' untranslated region of multiple transcripts of mRNA encoded by LOC286404, corresponding to a target binding site such as BINDING SITE I, BINDING SITE II or BINDING SITE III of FIG. 8. Table 4 illustrates the complementarity of the nucleotide sequences of LOC286404 BINDING SITE, designated SEQ ID:7351, to the nucleotide sequence of GAM7957 RNA, herein designated GAM RNA, also designated SEQ ID:297.

Another function of GAM7957 is therefore inhibition of LOC286404 (Accession XP_210036.1). Accordingly, utilities of GAM7957 include diagnosis, prevention and treatment of diseases and clinical conditions associated with LOC286404.

LOC286411 (Accession XP_212312.1) is another GAM7957 target gene, herein designated TARGET GENE. LOC286411 BINDING SITE is a target binding site found in the 3' untranslated region of mRNA encoded by LOC286411, corresponding to a target binding site such as BINDING SITE I, BINDING SITE II or BINDING SITE III of FIG. 8. Table 4 illustrates the complementarity of the nucleotide sequences of LOC286411 BINDING SITE, designated SEQ ID:19200, to the nucleotide sequence of GAM7957 RNA, herein designated GAM RNA, also designated SEQ ID:297.

Another function of GAM7957 is therefore inhibition of LOC286411 (Accession XP_212312.1). Accordingly, utilities of GAM7957 include diagnosis, prevention and treatment of diseases and clinical conditions associated with LOC286411.

LOC286416 (Accession XP_210041.1) is another GAM7957 target gene, herein designated TARGET GENE. LOC286416 BINDING SITE is a target binding site found in the 3' untranslated region of mRNA encoded by LOC286416, corresponding to a target binding site such as BINDING SITE I, BINDING SITE II or BINDING SITE III of FIG. 8. Table 4 illustrates the complementarity of the nucleotide sequences of LOC286416 BINDING SITE, designated SEQ ID:3830, to the nucleotide sequence of GAM7957 RNA, herein designated GAM RNA, also designated SEQ ID:297.

Another function of GAM7957 is therefore inhibition of LOC286416 (Accession XP_210041.1). Accordingly, utilities of GAM7957 include diagnosis, prevention and treatment of diseases and clinical conditions associated with LOC286416.

LOC286431 (Accession XP_212316.1) is another GAM7957 target gene, herein designated TARGET GENE. LOC286431 BINDING SITE1 and LOC286431 BINDING SITE2 are target binding sites found in untranslated regions of mRNA encoded by LOC286431, corresponding to target binding sites such as BINDING SITE I, BINDING SITE II or BINDING SITE III of FIG. 8. Table 4 illustrates the complementarity of the nucleotide sequences of LOC286431 BINDING SITE1 and LOC286431 BINDING SITE2, designated SEQ ID:8014 and SEQ ID:6817 respectively, to the nucleotide sequence of GAM7957 RNA, herein designated GAM RNA, also designated SEQ ID:297.

Another function of GAM7957 is therefore inhibition of LOC286431 (Accession XP_212316.1). Accordingly, utilities of GAM7957 include diagnosis, prevention and treatment of diseases and clinical conditions associated with LOC286431.

LOC286435 (Accession XP_210047.1) is another GAM7957 target gene, herein designated TARGET GENE. LOC286435 BINDING SITE1 through LOC286435 BINDING SITE3 are target binding sites found in untranslated regions of mRNA encoded by LOC286435, corresponding to target binding sites such as BINDING SITE I, BINDING SITE II or BINDING SITE III of FIG. 8. Table 4 illustrates the complementarity of the nucleotide sequences of LOC286435 BINDING SITE1 through LOC286435 BINDING SITE3, designated SEQ ID:9769, SEQ ID:13491 and SEQ ID:5210 respectively, to the nucleotide sequence of GAM7957 RNA, herein designated GAM RNA, also designated SEQ ID:297.

Another function of GAM7957 is therefore inhibition of LOC286435 (Accession XP_210047.1). Accordingly, utilities of GAM7957 include diagnosis, prevention and treatment of diseases and clinical conditions associated with LOC286435.

LOC286470 (Accession XP_212325.1) is another GAM7957 target gene, herein designated TARGET GENE. LOC286470 BINDING SITE1 and LOC286470 BINDING SITE2 are target binding sites found in untranslated regions of mRNA encoded by LOC286470, corresponding to target binding sites such as BINDING SITE I, BINDING SITE II or BINDING SITE III of FIG. 8. Table 4 illustrates the complementarity of the nucleotide sequences of LOC286470 BINDING SITE1 and LOC286470 BINDING SITE2, designated SEQ ID:17423 and SEQ ID:6500 respectively, to the nucleotide sequence of GAM7957 RNA, herein designated GAM RNA, also designated SEQ ID:297.

Another function of GAM7957 is therefore inhibition of LOC286470 (Accession XP_212325.1). Accordingly, utilities of GAM7957 include diagnosis, prevention and treatment of diseases and clinical conditions associated with LOC286470.

LOC286486 (Accession XP_210077.1) is another GAM7957 target gene, herein designated TARGET GENE. LOC286486 BINDING SITE is a target binding site found in the 3' untranslated region of mRNA encoded by LOC286486, corresponding to a target binding site such as BINDING SITE I, BINDING SITE II or BINDING SITE III of FIG. 8. Table 4 illustrates the complementarity of the nucleotide sequences of LOC286486 BINDING SITE, designated SEQ ID:2822, to the nucleotide sequence of GAM7957 RNA, herein designated GAM RNA, also designated SEQ ID:297.

Another function of GAM7957 is therefore inhibition of LOC286486 (Accession XP_210077.1). Accordingly, utilities of GAM7957 include diagnosis, prevention and treatment of diseases and clinical conditions associated with LOC286486.

LOC286530 (Accession NP_835230.1) is another GAM7957 target gene, herein designated TARGET GENE. LOC286530 BINDING SITE is a target binding site found in the 3' untranslated region of multiple transcripts of mRNA encoded by LOC286530, corresponding to a target binding site such as BINDING SITE I, BINDING SITE II or BINDING SITE III of FIG. 8. Table 4 illustrates the complementarity of the nucleotide sequences of LOC286530 BINDING SITE, designated SEQ ID:8258, to the nucleotide sequence of GAM7957 RNA, herein designated GAM RNA, also designated SEQ ID:297.

Another function of GAM7957 is therefore inhibition of LOC286530 (Accession NP_835230.1). Accordingly, utilities of GAM7957 include diagnosis, prevention and treatment of diseases and clinical conditions associated with LOC286530.

LOC338545 (Accession XP_294650.1) is another GAM7957 target gene, herein designated TARGET GENE. LOC338545 BINDING SITE is a target binding site found in the 3' untranslated region of mRNA encoded by LOC338545, corresponding to a target binding site such as BINDING SITE I, BINDING SITE II or BINDING SITE III of FIG. 8. Table 4 illustrates the complementarity of the nucleotide sequences of LOC338545 BINDING SITE, designated SEQ ID:11411, to the nucleotide sequence of GAM7957 RNA, herein designated GAM RNA, also designated SEQ ID:297.

Another function of GAM7957 is therefore inhibition of LOC338545 (Accession XP_294650.1). Accordingly, utilities of GAM7957 include diagnosis, prevention and treatment of diseases and clinical conditions associated with LOC338545.

LOC338549 (Accession XP_294651.1) is another GAM7957 target gene, herein designated TARGET GENE. LOC338549 BINDING SITE1 through LOC338549 BINDING SITE3 are target binding sites found in untranslated regions of mRNA encoded by LOC338549, corresponding to target binding sites such as BINDING SITE I, BINDING SITE II or BINDING SITE III of FIG. 8. Table 4 illustrates the complementarity of the nucleotide sequences of LOC338549 BINDING SITE1 through LOC338549 BINDING SITE3, designated SEQ ID:5588, SEQ ID:10572 and SEQ ID:3956 respectively, to the nucleotide sequence of GAM7957 RNA, herein designated GAM RNA, also designated SEQ ID:297.

Another function of GAM7957 is therefore inhibition of LOC338549 (Accession XP_294651.1). Accordingly, utilities of GAM7957 include diagnosis, prevention and treatment of diseases and clinical conditions associated with LOC338549.

LOC338593 (Accession XP_290481.1) is another GAM7957 target gene, herein designated TARGET GENE. LOC338593 BINDING SITE is a target binding site found in the 3' untranslated region of mRNA encoded by LOC338593, corresponding to a target binding site such as BINDING SITE I, BINDING SITE II or BINDING SITE III of FIG. 8. Table 4 illustrates the complementarity of the nucleotide sequences of LOC338593 BINDING SITE, designated SEQ ID:7048, to the nucleotide sequence of GAM7957 RNA, herein designated GAM RNA, also designated SEQ ID:297.

Another function of GAM7957 is therefore inhibition of LOC338593 (Accession XP_290481.1). Accordingly, utilities of GAM7957 include diagnosis, prevention and treatment of diseases and clinical conditions associated with LOC338593.

LOC338594 (Accession XP_294660.1) is another GAM7957 target gene, herein designated TARGET GENE. LOC338594 BINDING SITE1 and LOC338594 BINDING SITE2 are target binding sites found in untranslated regions of mRNA encoded by LOC338594, corresponding to target binding sites such as BINDING SITE I, BINDING SITE II or BINDING SITE III of FIG. 8. Table 4 illustrates the complementarity of the nucleotide sequences of LOC338594 BINDING SITE1 and LOC338594 BINDING SITE2, designated SEQ ID:17423 and SEQ ID:15837 respectively, to the nucleotide sequence of GAM7957 RNA, herein designated GAM RNA, also designated SEQ ID:297.

Another function of GAM7957 is therefore inhibition of LOC338594 (Accession XP_294660.1). Accordingly, utilities of GAM7957 include diagnosis, prevention and treatment of diseases and clinical conditions associated with LOC338594.

LOC338604 (Accession XP_294665.1) is another GAM7957 target gene, herein designated TARGET GENE. LOC338604 BINDING SITE is a target binding site found in the 5' untranslated region of mRNA encoded by LOC338604, corresponding to a target binding site such as BINDING SITE I, BINDING SITE II or BINDING SITE III of FIG. 8. Table 4 illustrates the complementarity of the nucleotide sequences of LOC338604 BINDING SITE, designated SEQ ID:4376, to the nucleotide sequence of GAM7957 RNA, herein designated GAM RNA, also designated SEQ ID:297.

Another function of GAM7957 is therefore inhibition of LOC338604 (Accession XP_294665.1). Accordingly, utilities of GAM7957 include diagnosis, prevention and treatment of diseases and clinical conditions associated with LOC338604.

LOC338690 (Accession XP_290518.1) is another GAM7957 target gene, herein designated TARGET GENE. LOC338690 BINDING SITE1 and LOC338690 BINDING SITE2 are target binding sites found in untranslated regions of mRNA encoded by LOC338690, corresponding to target binding sites such as BINDING SITE I, BINDING SITE II or BINDING SITE III of FIG. 8. Table 4 illustrates the complementarity of the nucleotide sequences of LOC338690 BINDING SITE1 and LOC338690 BINDING SITE2, designated SEQ ID:14785 and SEQ ID:5830 respectively, to the nucleotide sequence of GAM7957 RNA, herein designated GAM RNA, also designated SEQ ID:297.

Another function of GAM7957 is therefore inhibition of LOC338690 (Accession XP_290518.1). Accordingly, utilities of GAM7957 include diagnosis, prevention and treatment of diseases and clinical conditions associated with LOC338690.

LOC338837 (Accession XP_294725.1) is another GAM7957 target gene, herein designated TARGET GENE. LOC338837 BINDING SITE1 and LOC338837 BINDING SITE2 are target binding sites found in untranslated regions of mRNA encoded by LOC338837, corresponding to target binding sites such as BINDING SITE I, BINDING SITE II or BINDING SITE III of FIG. 8. Table 4 illustrates the complementarity of the nucleotide sequences of LOC338837 BINDING SITE1 and LOC338837 BINDING SITE2, designated SEQ ID:12726 and SEQ ID:18690 respectively, to the nucleotide sequence of GAM7957 RNA, herein designated GAM RNA, also designated SEQ ID:297.

Another function of GAM7957 is therefore inhibition of LOC338837 (Accession XP_294725.1). Accordingly, utilities of GAM7957 include diagnosis, prevention and treatment of diseases and clinical conditions associated with LOC338837.

LOC338866 (Accession XP_294736.1) is another GAM7957 target gene, herein designated TARGET GENE. LOC338866 BINDING SITE1 and LOC338866 BINDING SITE2 are target binding sites found in untranslated regions of mRNA encoded by LOC338866, corresponding to target binding sites such as BINDING SITE I, BINDING SITE II or BINDING SITE III of FIG. 8. Table 4 illustrates the complementarity of the nucleotide sequences of LOC338866 BINDING SITE1 and LOC338866 BINDING SITE2, designated SEQ ID:9815 and SEQ ID:11040 respectively, to the nucleotide sequence of GAM7957 RNA, herein designated GAM RNA, also designated SEQ ID:297.

Another function of GAM7957 is therefore inhibition of LOC338866 (Accession XP_294736.1). Accordingly, utilities of GAM7957 include diagnosis, prevention and treatment of diseases and clinical conditions associated with LOC338866.

LOC338910 (Accession XP_290630.1) is another GAM7957 target gene, herein designated TARGET GENE. LOC338910 BINDING SITE is a target binding site found in the 3' untranslated region of mRNA encoded by LOC338910, corresponding to a target binding site such as BINDING SITE I, BINDING SITE II or BINDING SITE III of FIG. 8. Table 4 illustrates the complementarity of the nucleotide sequences of LOC338910 BINDING SITE, designated SEQ ID:6154, to the nucleotide sequence of GAM7957 RNA, herein designated GAM RNA, also designated SEQ ID:297.

Another function of GAM7957 is therefore inhibition of LOC338910 (Accession XP_290630.1). Accordingly, utilities of GAM7957 include diagnosis, prevention and treatment of diseases and clinical conditions associated with LOC338910.

LOC338923 (Accession XP_294742.1) is another GAM7957 target gene, herein designated TARGET GENE. LOC338923 BINDING SITE is a target binding site found in the 3' untranslated region of mRNA encoded by LOC338923, corresponding to a target binding site such as BINDING SITE I, BINDING SITE II or BINDING SITE III of FIG. 8. Table 4 illustrates the complementarity of the nucleotide sequences of LOC338923 BINDING SITE, designated SEQ ID:15384, to the nucleotide sequence of GAM7957 RNA, herein designated GAM RNA, also designated SEQ ID:297.

Another function of GAM7957 is therefore inhibition of LOC338923 (Accession XP_294742.1). Accordingly, utilities of GAM7957 include diagnosis, prevention and treatment of diseases and clinical conditions associated with LOC338923.

LOC338963 (Accession XP_294757.1) is another GAM7957 target gene, herein designated TARGET GENE. LOC338963 BINDING SITE1 and LOC338963 BINDING SITE2 are target binding sites found in untranslated regions of mRNA encoded by LOC338963, corresponding to target binding sites such as BINDING SITE I, BINDING SITE II or BINDING SITE III of FIG. 8. Table 4 illustrates the complementarity of the nucleotide sequences of LOC338963 BINDING SITE1 and LOC338963 BINDING SITE2, designated SEQ ID:6095 and SEQ ID:12559 respectively, to the nucleotide sequence of GAM7957 RNA, herein designated GAM RNA, also designated SEQ ID:297.

Another function of GAM7957 is therefore inhibition of LOC338963 (Accession XP_294757.1). Accordingly, utilities of GAM7957 include diagnosis, prevention and treatment of diseases and clinical conditions associated with LOC338963.

LOC338976 (Accession XP_294762.1) is another GAM7957 target gene, herein designated TARGET GENE. LOC338976 BINDING SITE is a target binding site found in the 5' untranslated region of mRNA encoded by LOC338976, corresponding to a target binding site such as BINDING SITE I, BINDING SITE II or BINDING SITE III of FIG. 8. Table 4 illustrates the complementarity of the nucleotide sequences of LOC338976 BINDING SITE, designated SEQ ID:17403, to the nucleotide sequence of GAM7957 RNA, herein designated GAM RNA, also designated SEQ ID:297.

Another function of GAM7957 is therefore inhibition of LOC338976 (Accession XP_294762.1). Accordingly, utilities of GAM7957 include diagnosis, prevention and treatment of diseases and clinical conditions associated with LOC338976.

LOC338991 (Accession XP_290663.1) is another GAM7957 target gene, herein designated TARGET GENE. LOC338991 BINDING SITE is a target binding site found in the 5' untranslated region of mRNA encoded by LOC338991, corresponding to a target binding site such as BINDING SITE I, BINDING SITE II or BINDING SITE III of FIG. 8. Table 4 illustrates the complementarity of the nucleotide sequences of LOC338991 BINDING SITE, designated SEQ ID:10439, to the nucleotide sequence of GAM7957 RNA, herein designated GAM RNA, also designated SEQ ID:297.

Another function of GAM7957 is therefore inhibition of LOC338991 (Accession XP_290663.1). Accordingly, utilities of GAM7957 include diagnosis, prevention and treatment of diseases and clinical conditions associated with LOC338991.

LOC338999 (Accession XP_290659.1) is another GAM7957 target gene, herein designated TARGET GENE. LOC338999 BINDING SITE is a target binding site found in the 5' untranslated region of mRNA encoded by LOC338999, corresponding to a target binding site such as BINDING SITE I, BINDING SITE II or BINDING SITE III of FIG. 8. Table 4 illustrates the complementarity of the nucleotide sequences of LOC338999 BINDING SITE, designated SEQ ID:10439, to the nucleotide sequence of GAM7957 RNA, herein designated GAM RNA, also designated SEQ ID:297.

Another function of GAM7957 is therefore inhibition of LOC338999 (Accession XP_290659.1). Accordingly, utilities of GAM7957 include diagnosis, prevention and treatment of diseases and clinical conditions associated with LOC338999.

LOC339059 (Accession XP_290682.1) is another GAM7957 target gene, herein designated TARGET GENE. LOC339059 BINDING SITE is a target binding site found in the 3' untranslated region of mRNA encoded by LOC339059, corresponding to a target binding site such as BINDING SITE I, BINDING SITE II or BINDING SITE III of FIG. 8. Table 4 illustrates the complementarity of the nucleotide sequences of LOC339059 BINDING SITE, designated SEQ ID:7867, to the nucleotide sequence of GAM7957 RNA, herein designated GAM RNA, also designated SEQ ID:297.

Another function of GAM7957 is therefore inhibition of LOC339059 (Accession XP_290682.1). Accordingly, utilities of GAM7957 include diagnosis, prevention and treatment of diseases and clinical conditions associated with LOC339059.

LOC339071 (Accession XP_294800.1) is another GAM7957 target gene, herein designated TARGET GENE. LOC339071 BINDING SITE is a target binding site found in the 3' untranslated region of mRNA encoded by LOC339071, corresponding to a target binding site such as BINDING SITE I, BINDING SITE II or BINDING SITE III of FIG. 8. Table 4 illustrates the complementarity of the nucleotide sequences of LOC339071 BINDING SITE, designated SEQ ID:14359, to the nucleotide sequence of GAM7957 RNA, herein designated GAM RNA, also designated SEQ ID:297.

Another function of GAM7957 is therefore inhibition of LOC339071 (Accession XP_294800.1). Accordingly, utilities of GAM7957 include diagnosis, prevention and treatment of diseases and clinical conditions associated with LOC339071.

LOC339078 (Accession XP_290692.1) is another GAM7957 target gene, herein designated TARGET GENE. LOC339078 BINDING SITE1 and LOC339078 BINDING SITE2 are target binding sites found in untranslated regions of mRNA encoded by LOC339078, corresponding to target binding sites such as BINDING SITE I, BINDING SITE II or BINDING SITE III of FIG. 8. Table 4 illustrates the complementarity of the nucleotide sequences of LOC339078 BINDING SITE1 and LOC339078 BINDING SITE2, designated SEQ ID:6790 and SEQ ID:12011 respectively, to the nucleotide sequence of GAM7957 RNA, herein designated GAM RNA, also designated SEQ ID:297.

Another function of GAM7957 is therefore inhibition of LOC339078 (Accession XP_290692.1). Accordingly, utilities of GAM7957 include diagnosis, prevention and treatment of diseases and clinical conditions associated with LOC339078.

LOC339083 (Accession XP_290697.2) is another GAM7957 target gene, herein designated TARGET GENE. LOC339083 BINDING SITE1 through LOC339083 BINDING SITE4 are target binding sites found in untranslated regions of mRNA encoded by LOC339083, corresponding to target binding sites such as BINDING SITE I, BINDING SITE II or BINDING SITE III of FIG. 8. Table 4 illustrates the complementarity of the nucleotide sequences of LOC339083 BINDING SITE1 through LOC339083 BINDING SITE4, designated SEQ ID:12337, SEQ ID:13093, SEQ ID:9420 and SEQ ID:2987 respectively, to the nucleotide sequence of GAM7957 RNA, herein designated GAM RNA, also designated SEQ ID:297.

Another function of GAM7957 is therefore inhibition of LOC339083 (Accession XP_290697.2). Accordingly, utilities of GAM7957 include diagnosis, prevention and treatment of diseases and clinical conditions associated with LOC339083.

LOC339111 (Accession XP_294813.2) is another GAM7957 target gene, herein designated TARGET GENE. LOC339111 BINDING SITE is a target binding site found in the 3' untranslated region of mRNA encoded by LOC339111, corresponding to a target binding site such as BINDING SITE I, BINDING SITE II or BINDING SITE III of FIG. 8. Table 4 illustrates the complementarity of the nucleotide sequences of LOC339111 BINDING SITE, designated SEQ ID:10720, to the nucleotide sequence of GAM7957 RNA, herein designated GAM RNA, also designated SEQ ID:297.

Another function of GAM7957 is therefore inhibition of LOC339111 (Accession XP_294813.2). Accordingly, utilities of GAM7957 include diagnosis, prevention and treatment of diseases and clinical conditions associated with LOC339111.

LOC339130 (Accession XP_290723.2) is another GAM7957 target gene, herein designated TARGET GENE. LOC339130 BINDING SITE is a target binding site found in the 5' untranslated region of mRNA encoded by LOC339130, corresponding to a target binding site such as BINDING SITE I, BINDING SITE II or BINDING SITE III of FIG. 8. Table 4 illustrates the complementarity of the nucleotide sequences of LOC339130 BINDING SITE, designated SEQ ID:10489, to the nucleotide sequence of GAM7957 RNA, herein designated GAM RNA, also designated SEQ ID:297.

Another function of GAM7957 is therefore inhibition of LOC339130 (Accession XP_290723.2). Accordingly, utilities of GAM7957 include diagnosis, prevention and treatment of diseases and clinical conditions associated with LOC339130.

LOC339146 (Accession XP_294825.1) is another GAM7957 target gene, herein designated TARGET GENE. LOC339146 BINDING SITE is a target binding site found in the 3' untranslated region of mRNA encoded by LOC339146, corresponding to a target binding site such as BINDING SITE I, BINDING SITE II or BINDING SITE III of FIG. 8. Table 4 illustrates the complementarity of the nucleotide sequences of LOC339146 BINDING SITE, designated SEQ ID:19056, to the nucleotide sequence of GAM7957 RNA, herein designated GAM RNA, also designated SEQ ID:297.

Another function of GAM7957 is therefore inhibition of LOC339146 (Accession XP_294825.1). Accordingly, utilities of GAM7957 include diagnosis, prevention and treatment of diseases and clinical conditions associated with LOC339146.

LOC339152 (Accession XP_294829.1) is another GAM7957 target gene, herein designated TARGET GENE. LOC339152 BINDING SITE is a target binding site found in the 3' untranslated region of mRNA encoded by LOC339152, corresponding to a target binding site such as BINDING SITE I, BINDING SITE II or BINDING SITE III of FIG. 8. Table 4 illustrates the complementarity of the nucleotide sequences of LOC339152 BINDING SITE, designated SEQ ID:4314, to the nucleotide sequence of GAM7957 RNA, herein designated GAM RNA, also designated SEQ ID:297.

Another function of GAM7957 is therefore inhibition of LOC339152 (Accession XP_294829.1). Accordingly, utilities of GAM7957 include diagnosis, prevention and treatment of diseases and clinical conditions associated with LOC339152.

LOC339184 (Accession XP_290743.1) is another GAM7957 target gene, herein designated TARGET GENE. LOC339184 BINDING SITE is a target binding site found in the 3' untranslated region of mRNA encoded by LOC339184, corresponding to a target binding site such as BINDING SITE I, BINDING SITE II or BINDING SITE III of FIG. 8. Table 4 illustrates the complementarity of the nucleotide sequences of LOC339184 BINDING SITE, designated SEQ ID:14392, to the nucleotide sequence of GAM7957 RNA, herein designated GAM RNA, also designated SEQ ID:297.

Another function of GAM7957 is therefore inhibition of LOC339184 (Accession XP_290743.1). Accordingly, utilities of GAM7957 include diagnosis, prevention and treatment of diseases and clinical conditions associated with LOC339184.

LOC339199 (Accession XP_290759.1) is another GAM7957 target gene, herein designated TARGET GENE. LOC339199 BINDING SITE is a target binding site found in the 3' untranslated region of mRNA encoded by LOC339199, corresponding to a target binding site such as BINDING SITE I, BINDING SITE II or BINDING SITE III of FIG. 8. Table 4 illustrates the complementarity of the nucleotide sequences of LOC339199 BINDING SITE, designated SEQ ID:15984, to the nucleotide sequence of GAM7957 RNA, herein designated GAM RNA, also designated SEQ ID:297.

Another function of GAM7957 is therefore inhibition of LOC339199 (Accession XP_290759.1). Accordingly, utilities of GAM7957 include diagnosis, prevention and treatment of diseases and clinical conditions associated with LOC339199.

LOC339216 (Accession XP_290762.2) is another GAM7957 target gene, herein designated TARGET GENE. LOC339216 BINDING SITE1 and LOC339216 BINDING SITE2 are target binding sites found in untranslated regions of mRNA encoded by LOC339216, corresponding to target binding sites such as BINDING SITE I, BINDING SITE II or BINDING SITE III of FIG. 8. Table 4 illustrates the complementarity of the nucleotide sequences of LOC339216 BINDING SITE1 and LOC339216 BINDING SITE2, designated SEQ ID:8019 and SEQ ID:13155 respectively, to the nucleotide sequence of GAM7957 RNA, herein designated GAM RNA, also designated SEQ ID:297.

Another function of GAM7957 is therefore inhibition of LOC339216 (Accession XP_290762.2). Accordingly, utilities of GAM7957 include diagnosis, prevention and treatment of diseases and clinical conditions associated with LOC339216.

LOC339223 (Accession XP_290774.1) is another GAM7957 target gene, herein designated TARGET GENE. LOC339223 BINDING SITE is a target binding site found in the 3' untranslated region of mRNA encoded by LOC339223, corresponding to a target binding site such as BINDING SITE I, BINDING SITE II or BINDING SITE III of FIG. 8. Table 4 illustrates the complementarity of the nucleotide sequences of LOC339223 BINDING SITE, designated SEQ ID:13438, to the nucleotide sequence of GAM7957 RNA, herein designated GAM RNA, also designated SEQ ID:297.

Another function of GAM7957 is therefore inhibition of LOC339223 (Accession XP_290774.1). Accordingly, utilities of GAM7957 include diagnosis, prevention and treatment of diseases and clinical conditions associated with LOC339223.

LOC339231 (Accession XP_290777.1) is another GAM7957 target gene, herein designated TARGET GENE.

LOC339231 BINDING SITE is a target binding site found in the 3' untranslated region of mRNA encoded by LOC339231, corresponding to a target binding site such as BINDING SITE I, BINDING SITE II or BINDING SITE III of FIG. 8. Table 4 illustrates the complementarity of the nucleotide sequences of LOC339231 BINDING SITE, designated SEQ ID:18686, to the nucleotide sequence of GAM7957 RNA, herein designated GAM RNA, also designated SEQ ID:297.

Another function of GAM7957 is therefore inhibition of LOC339231 (Accession XP_290777.1). Accordingly, utilities of GAM7957 include diagnosis, prevention and treatment of diseases and clinical conditions associated with LOC339231.

LOC339238 (Accession XP_290784.1) is another GAM7957 target gene, herein designated TARGET GENE. LOC339238 BINDING SITE is a target binding site found in the 3' untranslated region of multiple transcripts of mRNA encoded by LOC339238, corresponding to a target binding site such as BINDING SITE I, BINDING SITE II or BINDING SITE III of FIG. 8. Table 4 illustrates the complementarity of the nucleotide sequences of LOC339238 BINDING SITE, designated SEQ ID:18140, to the nucleotide sequence of GAM7957 RNA, herein designated GAM RNA, also designated SEQ ID:297.

Another function of GAM7957 is therefore inhibition of LOC339238 (Accession XP_290784.1). Accordingly, utilities of GAM7957 include diagnosis, prevention and treatment of diseases and clinical conditions associated with LOC339238.

LOC339238 (Accession XP_290783.1) is another GAM7957 target gene, herein designated TARGET GENE. LOC339238 BINDING SITE is a target binding site found in the 3' untranslated region of multiple transcripts of mRNA encoded by LOC339238, corresponding to a target binding site such as BINDING SITE I, BINDING SITE II or BINDING SITE III of FIG. 8. Table 4 illustrates the complementarity of the nucleotide sequences of LOC339238 BINDING SITE, designated SEQ ID:18140, to the nucleotide sequence of GAM7957 RNA, herein designated GAM RNA, also designated SEQ ID:297.

Another function of GAM7957 is therefore inhibition of LOC339238 (Accession XP_290783.1). Accordingly, utilities of GAM7957 include diagnosis, prevention and treatment of diseases and clinical conditions associated with LOC339238.

LOC339282 (Accession XP_294900.2) is another GAM7957 target gene, herein designated TARGET GENE. LOC339282 BINDING SITE1 and LOC339282 BINDING SITE2 are target binding sites found in untranslated regions of mRNA encoded by LOC339282, corresponding to target binding sites such as BINDING SITE I, BINDING SITE II or BINDING SITE III of FIG. 8. Table 4 illustrates the complementarity of the nucleotide sequences of LOC339282 BINDING SITE1 and LOC339282 BINDING SITE2, designated SEQ ID:8019 and SEQ ID:13155 respectively, to the nucleotide sequence of GAM7957 RNA, herein designated GAM RNA, also designated SEQ ID:297.

Another function of GAM7957 is therefore inhibition of LOC339282 (Accession XP_294900.2). Accordingly, utilities of GAM7957 include diagnosis, prevention and treatment of diseases and clinical conditions associated with LOC339282.

LOC339290 (Accession XP_294901.1) is another GAM7957 target gene, herein designated TARGET GENE. LOC339290 BINDING SITE1 and LOC339290 BINDING SITE2 are target binding sites found in untranslated regions of mRNA encoded by LOC339290, corresponding to target binding sites such as BINDING SITE I, BINDING SITE II or BINDING SITE III of FIG. 8. Table 4 illustrates the complementarity of the nucleotide sequences of LOC339290 BINDING SITE1 and LOC339290 BINDING SITE2, designated SEQ ID:1493 and SEQ ID:16582 respectively, to the nucleotide sequence of GAM7957 RNA, herein designated GAM RNA, also designated SEQ ID:297.

Another function of GAM7957 is therefore inhibition of LOC339290 (Accession XP_294901.1). Accordingly, utilities of GAM7957 include diagnosis, prevention and treatment of diseases and clinical conditions associated with LOC339290.

LOC339327 (Accession XP_290819.1) is another GAM7957 target gene, herein designated TARGET GENE. LOC339327 BINDING SITE is a target binding site found in the 3' untranslated region of mRNA encoded by LOC339327, corresponding to a target binding site such as BINDING SITE I, BINDING SITE II or BINDING SITE III of FIG. 8. Table 4 illustrates the complementarity of the nucleotide sequences of LOC339327 BINDING SITE, designated SEQ ID:1686, to the nucleotide sequence of GAM7957 RNA, herein designated GAM RNA, also designated SEQ ID:297.

Another function of GAM7957 is therefore inhibition of LOC339327 (Accession XP_290819.1). Accordingly, utilities of GAM7957 include diagnosis, prevention and treatment of diseases and clinical conditions associated with LOC339327.

LOC339343 (Accession XP_290846.1) is another GAM7957 target gene, herein designated TARGET GENE. LOC339343 BINDING SITE1 and LOC339343 BINDING SITE2 are target binding sites found in untranslated regions of mRNA encoded by LOC339343, corresponding to target binding sites such as BINDING SITE I, BINDING SITE II or BINDING SITE III of FIG. 8. Table 4 illustrates the complementarity of the nucleotide sequences of LOC339343 BINDING SITE1 and LOC339343 BINDING SITE2, designated SEQ ID:19994 and SEQ ID:5830 respectively, to the nucleotide sequence of GAM7957 RNA, herein designated GAM RNA, also designated SEQ ID:297.

Another function of GAM7957 is therefore inhibition of LOC339343 (Accession XP_290846.1). Accordingly, utilities of GAM7957 include diagnosis, prevention and treatment of diseases and clinical conditions associated with LOC339343.

LOC339373 (Accession XP_294921.1) is another GAM7957 target gene, herein designated TARGET GENE. LOC339373 BINDING SITE is a target binding site found in the 3' untranslated region of mRNA encoded by LOC339373, corresponding to a target binding site such as BINDING SITE I, BINDING SITE II or BINDING SITE III of FIG. 8. Table 4 illustrates the complementarity of the nucleotide sequences of LOC339373 BINDING SITE, designated SEQ ID:4402, to the nucleotide sequence of GAM7957 RNA, herein designated GAM RNA, also designated SEQ ID:297.

Another function of GAM7957 is therefore inhibition of LOC339373 (Accession XP_294921.1). Accordingly, utilities of GAM7957 include diagnosis, prevention and treatment of diseases and clinical conditions associated with LOC339373.

LOC339401 (Accession XP_294932.1) is another GAM7957 target gene, herein designated TARGET GENE. LOC339401 BINDING SITE is a target binding site found in the 5' untranslated region of mRNA encoded by LOC339401, corresponding to a target binding site such as BINDING SITE I, BINDING SITE II or BINDING SITE III of FIG. 8. Table 4 illustrates the complementarity of the nucleotide sequences of LOC339401 BINDING SITE, designated SEQ ID:14129, to the nucleotide sequence of GAM7957 RNA, herein designated GAM RNA, also designated SEQ ID:297.

Another function of GAM7957 is therefore inhibition of LOC339401 (Accession XP_294932.1). Accordingly, utilities of GAM7957 include diagnosis, prevention and treatment of diseases and clinical conditions associated with LOC339401.

LOC339417 (Accession XP_294944.1) is another GAM7957 target gene, herein designated TARGET GENE. LOC339417 BINDING SITE is a target binding site found in the 5' untranslated region of mRNA encoded by LOC339417, corresponding to a target binding site such as BINDING SITE I, BINDING SITE II or BINDING SITE III of FIG. 8. Table 4 illustrates the complementarity of the nucleotide sequences of LOC339417 BINDING SITE, designated SEQ ID:14425, to the nucleotide sequence of GAM7957 RNA, herein designated GAM RNA, also designated SEQ ID:297.

Another function of GAM7957 is therefore inhibition of LOC339417 (Accession XP_294944.1). Accordingly, utilities of GAM7957 include diagnosis, prevention and treatment of diseases and clinical conditions associated with LOC339417.

LOC339439 (Accession XP_294952.2) is another GAM7957 target gene, herein designated TARGET GENE. LOC339439 BINDING SITE is a target binding site found in the 3' untranslated region of mRNA encoded by LOC339439, corresponding to a target binding site such as BINDING SITE I, BINDING SITE II or BINDING SITE III of FIG. 8. Table 4 illustrates the complementarity of the nucleotide sequences of LOC339439 BINDING SITE, designated SEQ ID:12654, to the nucleotide sequence of GAM7957 RNA, herein designated GAM RNA, also designated SEQ ID:297.

Another function of GAM7957 is therefore inhibition of LOC339439 (Accession XP_294952.2). Accordingly, utilities of GAM7957 include diagnosis, prevention and treatment of diseases and clinical conditions associated with LOC339439.

LOC339452 (Accession XP_290903.1) is another GAM7957 target gene, herein designated TARGET GENE. LOC339452 BINDING SITE is a target binding site found in the 3' untranslated region of mRNA encoded by LOC339452, corresponding to a target binding site such as BINDING SITE I, BINDING SITE II or BINDING SITE III of FIG. 8. Table 4 illustrates the complementarity of the nucleotide sequences of LOC339452 BINDING SITE, designated SEQ ID:15409, to the nucleotide sequence of GAM7957 RNA, herein designated GAM RNA, also designated SEQ ID:297.

Another function of GAM7957 is therefore inhibition of LOC339452 (Accession XP_290903.1). Accordingly, utilities of GAM7957 include diagnosis, prevention and treatment of diseases and clinical conditions associated with LOC339452.

LOC339459 (Accession XP_290907.2) is another GAM7957 target gene, herein designated TARGET GENE. LOC339459 BINDING SITE is a target binding site found in the 3' untranslated region of mRNA encoded by LOC339459, corresponding to a target binding site such as BINDING SITE I, BINDING SITE II or BINDING SITE III of FIG. 8. Table 4 illustrates the complementarity of the nucleotide sequences of LOC339459 BINDING SITE, designated SEQ ID:18690, to the nucleotide sequence of GAM7957 RNA, herein designated GAM RNA, also designated SEQ ID:297.

Another function of GAM7957 is therefore inhibition of LOC339459 (Accession XP_290907.2). Accordingly, utilities of GAM7957 include diagnosis, prevention and treatment of diseases and clinical conditions associated with LOC339459.

LOC339462 (Accession XP_294966.1) is another GAM7957 target gene, herein designated TARGET GENE. LOC339462 BINDING SITE is a target binding site found in the 5' untranslated region of mRNA encoded by LOC339462, corresponding to a target binding site such as BINDING SITE I, BINDING SITE II or BINDING SITE III of FIG. 8. Table 4 illustrates the complementarity of the nucleotide sequences of LOC339462 BINDING SITE, designated SEQ ID:6550, to the nucleotide sequence of GAM7957 RNA, herein designated GAM RNA, also designated SEQ ID:297.

Another function of GAM7957 is therefore inhibition of LOC339462 (Accession XP_294966.1). Accordingly, utilities of GAM7957 include diagnosis, prevention and treatment of diseases and clinical conditions associated with LOC339462.

LOC339492 (Accession XP_290919.1) is another GAM7957 target gene, herein designated TARGET GENE. LOC339492 BINDING SITE is a target binding site found in the 3' untranslated region of mRNA encoded by LOC339492, corresponding to a target binding site such as BINDING SITE I, BINDING SITE II or BINDING SITE III of FIG. 8. Table 4 illustrates the complementarity of the nucleotide sequences of LOC339492 BINDING SITE, designated SEQ ID:6390, to the nucleotide sequence of GAM7957 RNA, herein designated GAM RNA, also designated SEQ ID:297.

Another function of GAM7957 is therefore inhibition of LOC339492 (Accession XP_290919.1). Accordingly, utilities of GAM7957 include diagnosis, prevention and treatment of diseases and clinical conditions associated with LOC339492.

LOC339493 (Accession XP_290927.1) is another GAM7957 target gene, herein designated TARGET GENE. LOC339493 BINDING SITE is a target binding site found in the 3' untranslated region of mRNA encoded by LOC339493, corresponding to a target binding site such as BINDING SITE I, BINDING SITE II or BINDING SITE III of FIG. 8. Table 4 illustrates the complementarity of the nucleotide sequences of LOC339493 BINDING SITE, designated SEQ ID:17699, to the nucleotide sequence of GAM7957 RNA, herein designated GAM RNA, also designated SEQ ID:297.

Another function of GAM7957 is therefore inhibition of LOC339493 (Accession XP_290927.1). Accordingly, utilities of GAM7957 include diagnosis, prevention and treatment of diseases and clinical conditions associated with LOC339493.

LOC339494 (Accession XP_290925.1) is another GAM7957 target gene, herein designated TARGET GENE. LOC339494 BINDING SITE is a target binding site found in the 3' untranslated region of mRNA encoded by LOC339494, corresponding to a target binding site such as BINDING SITE I, BINDING SITE II or BINDING SITE III of FIG. 8. Table 4 illustrates the complementarity of the nucleotide sequences of LOC339494 BINDING SITE, designated SEQ ID:13092, to the nucleotide sequence of GAM7957 RNA, herein designated GAM RNA, also designated SEQ ID:297.

Another function of GAM7957 is therefore inhibition of LOC339494 (Accession XP_290925.1). Accordingly, utilities of GAM7957 include diagnosis, prevention and treatment of diseases and clinical conditions associated with LOC339494.

LOC339559 (Accession XP_290953.1) is another GAM7957 target gene, herein designated TARGET GENE. LOC339559 BINDING SITE is a target binding site found in the 5' untranslated region of mRNA encoded by LOC339559, corresponding to a target binding site such as BINDING SITE I, BINDING SITE II or BINDING SITE III of FIG. 8. Table 4 illustrates the complementarity of the nucleotide sequences of LOC339559 BINDING SITE, designated SEQ ID:4458, to the nucleotide sequence of GAM7957 RNA, herein designated GAM RNA, also designated SEQ ID:297.

Another function of GAM7957 is therefore inhibition of LOC339559 (Accession XP_290953.1). Accordingly, utilities of GAM7957 include diagnosis, prevention and treatment of diseases and clinical conditions associated with LOC339559.

LOC339587 (Accession XP_290957.1) is another GAM7957 target gene, herein designated TARGET GENE. LOC339587 BINDING SITE is a target binding site found in the 3' untranslated region of mRNA encoded by LOC339587, corresponding to a target binding site such as BINDING SITE I, BINDING SITE II or BINDING SITE III of FIG. 8. Table 4 illustrates the complementarity of the nucleotide sequences of LOC339587 BINDING SITE, designated SEQ ID:15343, to the nucleotide sequence of GAM7957 RNA, herein designated GAM RNA, also designated SEQ ID:297.

Another function of GAM7957 is therefore inhibition of LOC339587 (Accession XP_290957.1). Accordingly, utilities of GAM7957 include diagnosis, prevention and treatment of diseases and clinical conditions associated with LOC339587.

LOC339740 (Accession XP_290339.1) is another GAM7957 target gene, herein designated TARGET GENE. LOC339740 BINDING SITE is a target binding site found in the 3' untranslated region of mRNA encoded by LOC339740, corresponding to a target binding site such as BINDING SITE I, BINDING SITE II or BINDING SITE III of FIG. 8. Table 4 illustrates the complementarity of the nucleotide sequences of LOC339740 BINDING SITE, designated SEQ ID:10720, to the nucleotide sequence of GAM7957 RNA, herein designated GAM RNA, also designated SEQ ID:297.

Another function of GAM7957 is therefore inhibition of LOC339740 (Accession XP_290339.1). Accordingly, utilities of GAM7957 include diagnosis, prevention and treatment of diseases and clinical conditions associated with LOC339740.

LOC339761 (Accession XP_291005.1) is another GAM7957 target gene, herein designated TARGET GENE. LOC339761 BINDING SITE1 through LOC339761 BINDING SITE4 are target binding sites found in untranslated regions of mRNA encoded by LOC339761, corresponding to target binding sites such as BINDING SITE I, BINDING SITE II or BINDING SITE III of FIG. 8. Table 4 illustrates the complementarity of the nucleotide sequences of LOC339761 BINDING SITE1 through LOC339761 BINDING SITE4, designated SEQ ID:4154, SEQ ID:12437, SEQ ID:17629 and SEQ ID:18770 respectively, to the nucleotide sequence of GAM7957 RNA, herein designated GAM RNA, also designated SEQ ID:297.

Another function of GAM7957 is therefore inhibition of LOC339761 (Accession XP_291005.1). Accordingly, utilities of GAM7957 include diagnosis, prevention and treatment of diseases and clinical conditions associated with LOC339761.

LOC339803 (Accession XP_295072.1) is another GAM7957 target gene, herein designated TARGET GENE. LOC339803 BINDING SITE is a target binding site found in the 3' untranslated region of mRNA encoded by LOC339803, corresponding to a target binding site such as BINDING SITE I, BINDING SITE II or BINDING SITE III of FIG. 8. Table 4 illustrates the complementarity of the nucleotide sequences of LOC339803 BINDING SITE, designated SEQ ID:16895, to the nucleotide sequence of GAM7957 RNA, herein designated GAM RNA, also designated SEQ ID:297.

Another function of GAM7957 is therefore inhibition of LOC339803 (Accession XP_295072.1). Accordingly, utilities of GAM7957 include diagnosis, prevention and treatment of diseases and clinical conditions associated with LOC339803.

LOC339808 (Accession XP_295071.1) is another GAM7957 target gene, herein designated TARGET GENE. LOC339808 BINDING SITE is a target binding site found in the 3' untranslated region of mRNA encoded by LOC339808, corresponding to a target binding site such as BINDING SITE I, BINDING SITE II or BINDING SITE III of FIG. 8. Table 4 illustrates the complementarity of the nucleotide sequences of LOC339808 BINDING SITE, designated SEQ ID:15343, to the nucleotide sequence of GAM7957 RNA, herein designated GAM RNA, also designated SEQ ID:297.

Another function of GAM7957 is therefore inhibition of LOC339808 (Accession XP_295071.1). Accordingly, utilities of GAM7957 include diagnosis, prevention and treatment of diseases and clinical conditions associated with LOC339808.

LOC339809 (Accession XP_291020.1) is another GAM7957 target gene, herein designated TARGET GENE. LOC339809 BINDING SITE is a target binding site found in the 5' untranslated region of mRNA encoded by LOC339809, corresponding to a target binding site such as BINDING SITE I, BINDING SITE II or BINDING SITE III of FIG. 8. Table 4 illustrates the complementarity of the nucleotide sequences of LOC339809 BINDING SITE, designated SEQ ID:13277, to the nucleotide sequence of GAM7957 RNA, herein designated GAM RNA, also designated SEQ ID:297.

Another function of GAM7957 is therefore inhibition of LOC339809 (Accession XP_291020.1). Accordingly, utilities of GAM7957 include diagnosis, prevention and treatment of diseases and clinical conditions associated with LOC339809.

LOC339831 (Accession XP_295080.1) is another GAM7957 target gene, herein designated TARGET GENE. LOC339831 BINDING SITE1 and LOC339831 BINDING SITE2 are target binding sites found in untranslated regions of mRNA encoded by LOC339831, corresponding to target binding sites such as BINDING SITE I, BINDING SITE II or BINDING SITE III of FIG. 8. Table 4 illustrates the complementarity of the nucleotide sequences of LOC339831 BINDING SITE1 and LOC339831 BINDING SITE2, designated SEQ ID:13584 and SEQ ID:11987 respectively, to the nucleotide sequence of GAM7957 RNA, herein designated GAM RNA, also designated SEQ ID:297.

Another function of GAM7957 is therefore inhibition of LOC339831 (Accession XP_295080.1). Accordingly, utilities of GAM7957 include diagnosis, prevention and treatment of diseases and clinical conditions associated with LOC339831.

LOC339832 (Accession XP_295079.1) is another GAM7957 target gene, herein designated TARGET GENE. LOC339832 BINDING SITE is a target binding site found in the 5' untranslated region of mRNA encoded by LOC339832, corresponding to a target binding site such as BINDING SITE I, BINDING SITE II or BINDING SITE III of FIG. 8. Table 4 illustrates the complementarity of the nucleotide sequences of LOC339832 BINDING SITE, designated SEQ ID:1325, to the nucleotide sequence of GAM7957 RNA, herein designated GAM RNA, also designated SEQ ID:297.

Another function of GAM7957 is therefore inhibition of LOC339832 (Accession XP_295079.1). Accordingly, utilities of GAM7957 include diagnosis, prevention and treatment of diseases and clinical conditions associated with LOC339832.

LOC339835 (Accession XP_291032.1) is another GAM7957 target gene, herein designated TARGET GENE. LOC339835 BINDING SITE is a target binding site found in the 5' untranslated region of mRNA encoded by LOC339835, corresponding to a target binding site such as BINDING SITE I, BINDING SITE II or BINDING SITE III of FIG. 8. Table 4 illustrates the complementarity of the nucleotide sequences of LOC339835 BINDING SITE, designated SEQ ID:17278, to the nucleotide sequence of GAM7957 RNA, herein designated GAM RNA, also designated SEQ ID:297.

Another function of GAM7957 is therefore inhibition of LOC339835 (Accession XP_291032.1). Accordingly, utilities of GAM7957 include diagnosis, prevention and treatment of diseases and clinical conditions associated with LOC339835.

LOC339841 (Accession XP_291038.1) is another GAM7957 target gene, herein designated TARGET GENE. LOC339841 BINDING SITE is a target binding site found in the 3' untranslated region of mRNA encoded by LOC339841, corresponding to a target binding site such as BINDING SITE I, BINDING SITE II or BINDING SITE III of FIG. 8. Table 4 illustrates the complementarity of the nucleotide sequences of LOC339841 BINDING SITE, designated SEQ ID:13065, to the nucleotide sequence of GAM7957 RNA, herein designated GAM RNA, also designated SEQ ID:297.

Another function of GAM7957 is therefore inhibition of LOC339841 (Accession XP_291038.1). Accordingly, utilities of GAM7957 include diagnosis, prevention and treatment of diseases and clinical conditions associated with LOC339841.

LOC339852 (Accession XP_295086.1) is another GAM7957 target gene, herein designated TARGET GENE. LOC339852 BINDING SITE1 and LOC339852 BINDING SITE2 are target binding sites found in untranslated regions of mRNA encoded by LOC339852, corresponding to target binding sites such as BINDING SITE I, BINDING SITE II or BINDING SITE III of FIG. 8. Table 4 illustrates the complementarity of the nucleotide sequences of LOC339852 BINDING SITE1 and LOC339852 BINDING SITE2, designated SEQ ID:15089 and SEQ ID:1816 respectively, to the nucleotide sequence of GAM7957 RNA, herein designated GAM RNA, also designated SEQ ID:297.

Another function of GAM7957 is therefore inhibition of LOC339852 (Accession XP_295086.1). Accordingly, utilities of GAM7957 include diagnosis, prevention and treatment of diseases and clinical conditions associated with LOC339852.

LOC339855 (Accession XP_291041.1) is another GAM7957 target gene, herein designated TARGET GENE. LOC339855 BINDING SITE is a target binding site found in the 3' untranslated region of mRNA encoded by LOC339855, corresponding to a target binding site such as BINDING SITE I, BINDING SITE II or BINDING SITE III of FIG. 8. Table 4 illustrates the complementarity of the nucleotide sequences of LOC339855 BINDING SITE, designated SEQ ID:5805, to the nucleotide sequence of GAM7957 RNA, herein designated GAM RNA, also designated SEQ ID:297.

Another function of GAM7957 is therefore inhibition of LOC339855 (Accession XP_291041.1). Accordingly, utilities of GAM7957 include diagnosis, prevention and treatment of diseases and clinical conditions associated with LOC339855.

LOC339865 (Accession XP_295089.1) is another GAM7957 target gene, herein designated TARGET GENE. LOC339865 BINDING SITE is a target binding site found in the 3' untranslated region of mRNA encoded by LOC339865, corresponding to a target binding site such as BINDING SITE I, BINDING SITE II or BINDING SITE III of FIG. 8. Table 4 illustrates the complementarity of the nucleotide sequences of LOC339865 BINDING SITE, designated SEQ ID:9765, to the nucleotide sequence of GAM7957 RNA, herein designated GAM RNA, also designated SEQ ID:297.

Another function of GAM7957 is therefore inhibition of LOC339865 (Accession XP_295089.1). Accordingly, utilities of GAM7957 include diagnosis, prevention and treatment of diseases and clinical conditions associated with LOC339865.

LOC339887 (Accession XP_295094.1) is another GAM7957 target gene, herein designated TARGET GENE. LOC339887 BINDING SITE is a target binding site found in the 3' untranslated region of mRNA encoded by LOC339887, corresponding to a target binding site such as BINDING SITE I, BINDING SITE II or BINDING SITE III of FIG. 8. Table 4 illustrates the complementarity of the nucleotide sequences of LOC339887 BINDING SITE, designated SEQ ID:13689, to the nucleotide sequence of GAM7957 RNA, herein designated GAM RNA, also designated SEQ ID:297.

Another function of GAM7957 is therefore inhibition of LOC339887 (Accession XP_295094.1). Accordingly, utilities of GAM7957 include diagnosis, prevention and treatment of diseases and clinical conditions associated with LOC339887.

LOC339929 (Accession XP_295105.1) is another GAM7957 target gene, herein designated TARGET GENE. LOC339929 BINDING SITE is a target binding site found in the 3' untranslated region of mRNA encoded by LOC339929, corresponding to a target binding site such as BINDING SITE I, BINDING SITE II or BINDING SITE III of FIG. 8. Table 4 illustrates the complementarity of the nucleotide sequences of LOC339929 BINDING SITE, designated SEQ ID:5256, to the nucleotide sequence of GAM7957 RNA, herein designated GAM RNA, also designated SEQ ID:297.

Another function of GAM7957 is therefore inhibition of LOC339929 (Accession XP_295105.1). Accordingly, utilities of GAM7957 include diagnosis, prevention and treatment of diseases and clinical conditions associated with LOC339929.

LOC340038 (Accession XP_291125.2) is another GAM7957 target gene, herein designated TARGET GENE. LOC340038 BINDING SITE is a target binding site found in the 3' untranslated region of mRNA encoded by LOC340038, corresponding to a target binding site such as BINDING SITE I, BINDING SITE II or BINDING SITE III of FIG. 8. Table 4 illustrates the complementarity of the nucleotide sequences of LOC340038 BINDING SITE, designated SEQ ID:9766, to the nucleotide sequence of GAM7957 RNA, herein designated GAM RNA, also designated SEQ ID:297.

Another function of GAM7957 is therefore inhibition of LOC340038 (Accession XP_291125.2). Accordingly, utilities of GAM7957 include diagnosis, prevention and treatment of diseases and clinical conditions associated with LOC340038.

LOC340085 (Accession XP_295152.1) is another GAM7957 target gene, herein designated TARGET GENE. LOC340085 BINDING SITE is a target binding site found in the 3' untranslated region of mRNA encoded by LOC340085, corresponding to a target binding site such as BINDING SITE I, BINDING SITE II or BINDING SITE III of FIG. 8. Table 4 illustrates the complementarity of the nucleotide sequences of LOC340085 BINDING SITE, designated SEQ ID:11266, to the nucleotide sequence of GAM7957 RNA, herein designated GAM RNA, also designated SEQ ID:297.

Another function of GAM7957 is therefore inhibition of LOC340085 (Accession XP_295152.1). Accordingly, utilities of GAM7957 include diagnosis, prevention and treatment of diseases and clinical conditions associated with LOC340085.

LOC340087 (Accession XP_295153.1) is another GAM7957 target gene, herein designated TARGET GENE. LOC340087 BINDING SITE is a target binding site found in the 3' untranslated region of mRNA encoded by LOC340087, corresponding to a target binding site such as BINDING SITE I, BINDING SITE II or BINDING SITE III of FIG. 8. Table 4 illustrates the complementarity of the nucleotide sequences of LOC340087 BINDING SITE, designated SEQ ID:3445, to the nucleotide sequence of GAM7957 RNA, herein designated GAM RNA, also designated SEQ ID:297.

Another function of GAM7957 is therefore inhibition of LOC340087 (Accession XP_295153.1). Accordingly, utilities of GAM7957 include diagnosis, prevention and treatment of diseases and clinical conditions associated with LOC340087.

LOC340128 (Accession XP_295164.2) is another GAM7957 target gene, herein designated TARGET GENE. LOC340128 BINDING SITE is a target binding site found in the 3' untranslated region of mRNA encoded by LOC340128, corresponding to a target binding site such as BINDING SITE I, BINDING SITE II or BINDING SITE III of FIG. 8. Table 4 illustrates the complementarity of the nucleotide sequences of LOC340128 BINDING SITE, designated SEQ ID:12654, to the nucleotide sequence of GAM7957 RNA, herein designated GAM RNA, also designated SEQ ID:297.

Another function of GAM7957 is therefore inhibition of LOC340128 (Accession XP_295164.2). Accordingly, utilities of GAM7957 include diagnosis, prevention and treatment of diseases and clinical conditions associated with LOC340128.

LOC340133 (Accession XP_291151.1) is another GAM7957 target gene, herein designated TARGET GENE. LOC340133 BINDING SITE is a target binding site found in the 3' untranslated region of mRNA encoded by LOC340133, corresponding to a target binding site such as BINDING SITE I, BINDING SITE II or BINDING SITE III of FIG. 8. Table 4 illustrates the complementarity of the nucleotide sequences of LOC340133 BINDING SITE, designated SEQ ID:12306, to the nucleotide sequence of GAM7957 RNA, herein designated GAM RNA, also designated SEQ ID:297.

Another function of GAM7957 is therefore inhibition of LOC340133 (Accession XP_291151.1). Accordingly, utilities of GAM7957 include diagnosis, prevention and treatment of diseases and clinical conditions associated with LOC340133.

LOC340138 (Accession XP_291153.1) is another GAM7957 target gene, herein designated TARGET GENE. LOC340138 BINDING SITE1 through LOC340138 BINDING SITE3 are target binding sites found in untranslated regions of mRNA encoded by LOC340138, corresponding to target binding sites such as BINDING SITE I, BINDING SITE II or BINDING SITE III of FIG. 8. Table 4 illustrates the complementarity of the nucleotide sequences of LOC340138 BINDING SITE1 through LOC340138 BINDING SITE3, designated SEQ ID:15675, SEQ ID:10571 and SEQ ID:13155 respectively, to the nucleotide sequence of GAM7957 RNA, herein designated GAM RNA, also designated SEQ ID:297.

Another function of GAM7957 is therefore inhibition of LOC340138 (Accession XP_291153.1). Accordingly, utilities of GAM7957 include diagnosis, prevention and treatment of diseases and clinical conditions associated with LOC340138.

LOC340153 (Accession XP_295176.1) is another GAM7957 target gene, herein designated TARGET GENE. LOC340153 BINDING SITE is a target binding site found in the 3' untranslated region of mRNA encoded by LOC340153, corresponding to a target binding site such as BINDING SITE I, BINDING SITE II or BINDING SITE III of FIG. 8. Table 4 illustrates the complementarity of the nucleotide sequences of LOC340153 BINDING SITE, designated SEQ ID:12654, to the nucleotide sequence of GAM7957 RNA, herein designated GAM RNA, also designated SEQ ID:297.

Another function of GAM7957 is therefore inhibition of LOC340153 (Accession XP_295176.1). Accordingly, utilities of GAM7957 include diagnosis, prevention and treatment of diseases and clinical conditions associated with LOC340153.

LOC340184 (Accession XP_295183.1) is another GAM7957 target gene, herein designated TARGET GENE. LOC340184 BINDING SITE1 and LOC340184 BINDING SITE2 are target binding sites found in untranslated regions of mRNA encoded by LOC340184, corresponding to target binding sites such as BINDING SITE I, BINDING SITE II or BINDING SITE III of FIG. 8. Table 4 illustrates the complementarity of the nucleotide sequences of LOC340184 BINDING SITE1 and LOC340184 BINDING SITE2, designated SEQ ID:19035 and SEQ ID:8198 respectively, to the nucleotide sequence of GAM7957 RNA, herein designated GAM RNA, also designated SEQ ID:297.

Another function of GAM7957 is therefore inhibition of LOC340184 (Accession XP_295183.1). Accordingly, utilities of GAM7957 include diagnosis, prevention and treatment of diseases and clinical conditions associated with LOC340184.

LOC340208 (Accession XP_295187.1) is another GAM7957 target gene, herein designated TARGET GENE. LOC340208 BINDING SITE1 through LOC340208 BINDING SITE3 are target binding sites found in untranslated regions of mRNA encoded by LOC340208, corresponding to target binding sites such as BINDING SITE I, BINDING SITE II or BINDING SITE III of FIG. 8. Table 4 illustrates the complementarity of the nucleotide sequences of LOC340208 BINDING SITE1 through LOC340208 BINDING SITE3, designated SEQ ID:15108, SEQ ID:9994 and SEQ ID:14091 respectively, to the nucleotide sequence of GAM7957 RNA, herein designated GAM RNA, also designated SEQ ID:297.

Another function of GAM7957 is therefore inhibition of LOC340208 (Accession XP_295187.1). Accordingly, utilities of GAM7957 include diagnosis, prevention and treatment of diseases and clinical conditions associated with LOC340208.

LOC340319 (Accession XP_295216.1) is another GAM7957 target gene, herein designated TARGET GENE. LOC340319 BINDING SITE is a target binding site found in the 3' untranslated region of mRNA encoded by LOC340319, corresponding to a target binding site such as BINDING SITE I, BINDING SITE II or BINDING SITE III of FIG. 8. Table 4 illustrates the complementarity of the nucleotide sequences of LOC340319 BINDING SITE, designated SEQ ID:3560, to the nucleotide sequence of GAM7957 RNA, herein designated GAM RNA, also designated SEQ ID:297.

Another function of GAM7957 is therefore inhibition of LOC340319 (Accession XP_295216.1). Accordingly, utilities of GAM7957 include diagnosis, prevention and treatment of diseases and clinical conditions associated with LOC340319.

LOC340321 (Accession XP_295212.1) is another GAM7957 target gene, herein designated TARGET GENE. LOC340321 BINDING SITE1 and LOC340321 BINDING SITE2 are target binding sites found in untranslated regions of mRNA encoded by LOC340321, corresponding to target binding sites such as BINDING SITE I, BINDING SITE II or BINDING SITE III of FIG. 8. Table 4 illustrates the complementarity of the nucleotide sequences of LOC340321 BINDING SITE1 and LOC340321 BINDING SITE2, designated SEQ ID:13857 and SEQ ID:8552 respectively, to the nucleotide sequence of GAM7957 RNA, herein designated GAM RNA, also designated SEQ ID:297.

Another function of GAM7957 is therefore inhibition of LOC340321 (Accession XP_295212.1). Accordingly, utilities of GAM7957 include diagnosis, prevention and treatment of diseases and clinical conditions associated with LOC340321.

LOC340324 (Accession XP_290402.1) is another GAM7957 target gene, herein designated TARGET GENE. LOC340324 BINDING SITE is a target binding site found in the 3' untranslated region of mRNA encoded by LOC340324, corresponding to a target binding site such as BINDING SITE I, BINDING SITE II or BINDING SITE III of FIG. 8. Table 4 illustrates the complementarity of the nucleotide sequences of LOC340324 BINDING SITE, designated SEQ ID:9208, to the nucleotide sequence of GAM7957 RNA, herein designated GAM RNA, also designated SEQ ID:297.

Another function of GAM7957 is therefore inhibition of LOC340324 (Accession XP_290402.1). Accordingly, utilities of GAM7957 include diagnosis, prevention and treatment of diseases and clinical conditions associated with LOC340324.

LOC340335 (Accession XP_295218.1) is another GAM7957 target gene, herein designated TARGET GENE. LOC340335 BINDING SITE1 and LOC340335 BINDING SITE2 are target binding sites found in untranslated regions of mRNA encoded by LOC340335, corresponding to target binding sites such as BINDING SITE I, BINDING SITE II or BINDING SITE III of FIG. 8. Table 4 illustrates the complementarity of the nucleotide sequences of LOC340335 BINDING SITE1 and LOC340335 BINDING SITE2, designated SEQ ID:9767 and SEQ ID:12218 respectively, to the nucleotide sequence of GAM7957 RNA, herein designated GAM RNA, also designated SEQ ID:297.

Another function of GAM7957 is therefore inhibition of LOC340335 (Accession XP_295218.1). Accordingly, utilities of GAM7957 include diagnosis, prevention and treatment of diseases and clinical conditions associated with LOC340335.

LOC340353 (Accession XP_295221.1) is another GAM7957 target gene, herein designated TARGET GENE. LOC340353 BINDING SITE is a target binding site found in the 5' untranslated region of mRNA encoded by LOC340353, corresponding to a target binding site such as BINDING SITE I, BINDING SITE II or BINDING SITE III of FIG. 8. Table 4 illustrates the complementarity of the nucleotide sequences of LOC340353 BINDING SITE, designated SEQ ID:3934, to the nucleotide sequence of GAM7957 RNA, herein designated GAM RNA, also designated SEQ ID:297.

Another function of GAM7957 is therefore inhibition of LOC340353 (Accession XP_295221.1). Accordingly, utilities of GAM7957 include diagnosis, prevention and treatment of diseases and clinical conditions associated with LOC340353.

LOC340362 (Accession XP_295225.1) is another GAM7957 target gene, herein designated TARGET GENE. LOC340362 BINDING SITE is a target binding site found in the 3' untranslated region of mRNA encoded by LOC340362, corresponding to a target binding site such as BINDING SITE I, BINDING SITE II or BINDING SITE III of FIG. 8. Table 4 illustrates the complementarity of the nucleotide sequences of LOC340362 BINDING SITE, designated SEQ ID:15223, to the nucleotide sequence of GAM7957 RNA, herein designated GAM RNA, also designated SEQ ID:297.

Another function of GAM7957 is therefore inhibition of LOC340362 (Accession XP_295225.1). Accordingly, utilities of GAM7957 include diagnosis, prevention and treatment of diseases and clinical conditions associated with LOC340362.

LOC340390 (Accession XP_291269.1) is another GAM7957 target gene, herein designated TARGET GENE. LOC340390 BINDING SITE is a target binding site found in the 5' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:15468, to the nucleotide sequence of GAM7957 RNA, herein designated GAM RNA, also designated SEQ ID:297.

Another function of GAM7957 is therefore inhibition of LOC340390 (Accession XP_291269.1). Accordingly, utilities of GAM7957 include diagnosis, prevention and treatment of diseases and clinical conditions associated with LOC340390.

LOC340394 (Accession XP_295235.1) is another GAM7957 target gene, herein designated TARGET GENE. LOC340394 BINDING SITE is a target binding site found in the 3' untranslated region of mRNA encoded by LOC340394, corresponding to a target binding site such as BINDING SITE I, BINDING SITE II or BINDING SITE III of FIG. 8. Table 4 illustrates the complementarity of the nucleotide sequences of LOC340394 BINDING SITE, designated SEQ ID:12796, to the nucleotide sequence of GAM7957 RNA, herein designated GAM RNA, also designated SEQ ID:297.

Another function of GAM7957 is therefore inhibition of LOC340394 (Accession XP_295235.1). Accordingly, utilities of GAM7957 include diagnosis, prevention and treatment of diseases and clinical conditions associated with LOC340394.

LOC340408 (Accession XP_291274.1) is another GAM7957 target gene, herein designated TARGET GENE. LOC340408 BINDING SITE is a target binding site found in the 3' untranslated region of mRNA encoded by LOC340408, corresponding to a target binding site such as BINDING SITE I, BINDING SITE II or BINDING SITE III of FIG. 8. Table 4 illustrates the complementarity of the nucleotide sequences of LOC340408 BINDING SITE, designated SEQ ID:925, to the nucleotide sequence of GAM7957 RNA, herein designated GAM RNA, also designated SEQ ID:297.

Another function of GAM7957 is therefore inhibition of LOC340408 (Accession XP_291274.1). Accordingly, utilities of GAM7957 include diagnosis, prevention and treatment of diseases and clinical conditions associated with LOC340408.

LOC340414 (Accession XP_295240.1) is another GAM7957 target gene, herein designated TARGET GENE. LOC340414 BINDING SITE is a target binding site found in the 3' untranslated region of mRNA encoded by LOC340414, corresponding to a target binding site such as BINDING SITE I, BINDING SITE II or BINDING SITE III of FIG. 8. Table 4 illustrates the complementarity of the nucleotide sequences of LOC340414 BINDING SITE, designated SEQ ID:4087, to the nucleotide sequence of GAM7957 RNA, herein designated GAM RNA, also designated SEQ ID:297.

Another function of GAM7957 is therefore inhibition of LOC340414 (Accession XP_295240.1). Accordingly, utilities of GAM7957 include diagnosis, prevention and treatment of diseases and clinical conditions associated with LOC340414.

LOC340456 (Accession XP_291298.1) is another GAM7957 target gene, herein designated TARGET GENE. LOC340456 BINDING SITE is a target binding site found in the 3' untranslated region of mRNA encoded by LOC340456, corresponding to a target binding site such as BINDING SITE I, BINDING SITE II or BINDING SITE III of FIG. 8. Table 4 illustrates the complementarity of the nucleotide sequences of LOC340456 BINDING SITE, designated SEQ ID:19885, to the nucleotide sequence of GAM7957 RNA, herein designated GAM RNA, also designated SEQ ID:297.

Another function of GAM7957 is therefore inhibition of LOC340456 (Accession XP_291298.1). Accordingly, utilities of GAM7957 include diagnosis, prevention and treatment of diseases and clinical conditions associated with LOC340456.

LOC340494 (Accession XP_290428.1) is another GAM7957 target gene, herein designated TARGET GENE. LOC340494 BINDING SITE1 and LOC340494 BINDING SITE2 are target binding sites found in untranslated regions of mRNA encoded by LOC340494, corresponding to target binding sites such as BINDING SITE I, BINDING SITE II or BINDING SITE III of FIG. 8. Table 4 illustrates the complementarity of the nucleotide sequences of LOC340494 BINDING SITE1 and LOC340494 BINDING SITE2, designated SEQ ID:7183 and SEQ ID:10536 respectively, to the nucleotide sequence of GAM7957 RNA, herein designated GAM RNA, also designated SEQ ID:297.

Another function of GAM7957 is therefore inhibition of LOC340494 (Accession XP_290428.1). Accordingly, utilities of GAM7957 include diagnosis, prevention and treatment of diseases and clinical conditions associated with LOC340494.

LOC340547 (Accession XP_291331.1) is another GAM7957 target gene, herein designated TARGET GENE. LOC340547 BINDING SITE is a target binding site found in the 3' untranslated region of mRNA encoded by LOC340547, corresponding to a target binding site such as BINDING SITE I, BINDING SITE II or BINDING SITE III of FIG. 8. Table 4 illustrates the complementarity of the nucleotide sequences of LOC340547 BINDING SITE, designated SEQ ID:15984, to the nucleotide sequence of GAM7957 RNA, herein designated GAM RNA, also designated SEQ ID:297.

Another function of GAM7957 is therefore inhibition of LOC340547 (Accession XP_291331.1). Accordingly, utilities of GAM7957 include diagnosis, prevention and treatment of diseases and clinical conditions associated with LOC340547.

LOC340615 (Accession XP_294645.1) is another GAM7957 target gene, herein designated TARGET GENE. LOC340615 BINDING SITE is a target binding site found in the 5' untranslated region of mRNA encoded by LOC340615, corresponding to a target binding site such as BINDING SITE I, BINDING SITE II or BINDING SITE III of FIG. 8. Table 4 illustrates the complementarity of the nucleotide sequences of LOC340615 BINDING SITE, designated SEQ ID:1950, to the nucleotide sequence of GAM7957 RNA, herein designated GAM RNA, also designated SEQ ID:297.

Another function of GAM7957 is therefore inhibition of LOC340615 (Accession XP_294645.1). Accordingly, utilities of GAM7957 include diagnosis, prevention and treatment of diseases and clinical conditions associated with LOC340615.

LOC343788 (Accession XP_297855.1) is another GAM7957 target gene, herein designated TARGET GENE. LOC343788 BINDING SITE is a target binding site found in the 5' untranslated region of mRNA encoded by LOC343788, corresponding to a target binding site such as BINDING SITE I, BINDING SITE II or BINDING SITE III of FIG. 8. Table 4 illustrates the complementarity of the nucleotide sequences of LOC343788 BINDING SITE, designated SEQ ID:3216, to the nucleotide sequence of GAM7957 RNA, herein designated GAM RNA, also designated SEQ ID:297.

Another function of GAM7957 is therefore inhibition of LOC343788 (Accession XP_297855.1). Accordingly, utilities of GAM7957 include diagnosis, prevention and treatment of diseases and clinical conditions associated with LOC343788.

LOC346110 (Accession XP_299316.1) is another GAM7957 target gene, herein designated TARGET GENE. LOC346110 BINDING SITE is a target binding site found in the 5' untranslated region of mRNA encoded by LOC346110, corresponding to a target binding site such as BINDING SITE I, BINDING SITE II or BINDING SITE III of FIG. 8. Table 4 illustrates the complementarity of the nucleotide sequences of LOC346110 BINDING SITE, designated SEQ ID:5901, to the nucleotide sequence of GAM7957 RNA, herein designated GAM RNA, also designated SEQ ID:297.

Another function of GAM7957 is therefore inhibition of LOC346110 (Accession XP_299316.1). Accordingly, utilities of GAM7957 include diagnosis, prevention and treatment of diseases and clinical conditions associated with LOC346110.

LOC347758 (Accession XP_300253.1) is another GAM7957 target gene, herein designated TARGET GENE. LOC347758 BINDING SITE1 and LOC347758 BINDING SITE2 are target binding sites found in untranslated regions of mRNA encoded by LOC347758, corresponding to target binding sites such as BINDING SITE I, BINDING SITE II or BINDING SITE III of FIG. 8. Table 4 illustrates the complementarity of the nucleotide sequences of LOC347758 BINDING SITE1 and LOC347758 BINDING SITE2, designated SEQ ID:8739 and SEQ ID:12606 respectively, to the nucleotide sequence of GAM7957 RNA, herein designated GAM RNA, also designated SEQ ID:297.

Another function of GAM7957 is therefore inhibition of LOC347758 (Accession XP_300253.1). Accordingly, utilities of GAM7957 include diagnosis, prevention and treatment of diseases and clinical conditions associated with LOC347758.

LOC347759 (Accession XP_084325.1) is another GAM7957 target gene, herein designated TARGET GENE. LOC347759 BINDING SITE1 and LOC347759 BINDING SITE2 are target binding sites found in untranslated regions of mRNA encoded by LOC347759, corresponding to target binding sites such as BINDING SITE I, BINDING SITE II or BINDING SITE III of FIG. 8. Table 4 illustrates the complementarity of the nucleotide sequences of LOC347759 BINDING SITE1 and LOC347759 BINDING SITE2, designated SEQ ID:12061 and SEQ ID:14817 respectively, to the nucleotide sequence of GAM7957 RNA, herein designated GAM RNA, also designated SEQ ID:297.

Another function of GAM7957 is therefore inhibition of LOC347759 (Accession XP_084325.1). Accordingly, utilities of GAM7957 include diagnosis, prevention and treatment of diseases and clinical conditions associated with LOC347759.

LOC347971 (Accession XP_302639.1) is another GAM7957 target gene, herein designated TARGET GENE. LOC347971 BINDING SITE is a target binding site found in the 3' untranslated region of mRNA encoded by LOC347971, corresponding to a target binding site such as BINDING SITE I, BINDING SITE II or BINDING SITE III of FIG. 8. Table 4 illustrates the complementarity of the nucleotide sequences of LOC347971 BINDING SITE, designated SEQ ID:1911, to the nucleotide sequence of GAM7957 RNA, herein designated GAM RNA, also designated SEQ ID:297.

Another function of GAM7957 is therefore inhibition of LOC347971 (Accession XP_302639.1). Accordingly, utilities of GAM7957 include diagnosis, prevention and treatment of diseases and clinical conditions associated with LOC347971.

LOC348071 (Accession XP_300620.1) is another GAM7957 target gene, herein designated TARGET GENE. LOC348071 BINDING SITE1 and LOC348071 BINDING SITE2 are target binding sites found in untranslated regions of mRNA encoded by LOC348071, corresponding to target binding sites such as BINDING SITE I, BINDING SITE II or BINDING SITE III of FIG. 8. Table 4 illustrates the complementarity of the nucleotide sequences of LOC348071 BINDING SITE1 and LOC348071 BINDING SITE2, designated SEQ ID:2678 and SEQ ID:15592 respectively, to the nucleotide sequence of GAM7957 RNA, herein designated GAM RNA, also designated SEQ ID:297.

Another function of GAM7957 is therefore inhibition of LOC348071 (Accession XP_300620.1). Accordingly, utilities of GAM7957 include diagnosis, prevention and treatment of diseases and clinical conditions associated with LOC348071.

LOC348072 (Accession XP_302652.1) is another GAM7957 target gene, herein designated TARGET GENE. LOC348072 BINDING SITE is a target binding site found in the 5' untranslated region of mRNA encoded by LOC348072, corresponding to a target binding site such as BINDING SITE I, BINDING SITE II or BINDING SITE III of FIG. 8. Table 4 illustrates the complementarity of the nucleotide sequences of LOC348072 BINDING SITE, designated SEQ ID:17403, to the nucleotide sequence of GAM7957 RNA, herein designated GAM RNA, also designated SEQ ID:297.

Another function of GAM7957 is therefore inhibition of LOC348072 (Accession XP_302652.1). Accordingly, utilities of GAM7957 include diagnosis, prevention and treatment of diseases and clinical conditions associated with LOC348072.

LOC348102 (Accession XP_302651.1) is another GAM7957 target gene, herein designated TARGET GENE. LOC348102 BINDING SITE is a target binding site found in the 5' untranslated region of mRNA encoded by LOC348102, corresponding to a target binding site such as BINDING SITE I, BINDING SITE II or BINDING SITE III of FIG. 8. Table 4 illustrates the complementarity of the nucleotide sequences of LOC348102 BINDING SITE, designated SEQ ID:13342, to the nucleotide sequence of GAM7957 RNA, herein designated GAM RNA, also designated SEQ ID:297.

Another function of GAM7957 is therefore inhibition of LOC348102 (Accession XP_302651.1). Accordingly, utilities of GAM7957 include diagnosis, prevention and treatment of diseases and clinical conditions associated with LOC348102.

LOC348113 (Accession XP_300623.1) is another GAM7957 target gene, herein designated TARGET GENE. LOC348113 BINDING SITE is a target binding site found in the 5' untranslated region of mRNA encoded by LOC348113, corresponding to a target binding site such as BINDING SITE I, BINDING SITE II or BINDING SITE III of FIG. 8. Table 4 illustrates the complementarity of the nucleotide sequences of LOC348113 BINDING SITE, designated SEQ ID:10439, to the nucleotide sequence of GAM7957 RNA, herein designated GAM RNA, also designated SEQ ID:297.

Another function of GAM7957 is therefore inhibition of LOC348113 (Accession XP_300623.1). Accordingly, utilities of GAM7957 include diagnosis, prevention and treatment of diseases and clinical conditions associated with LOC348113.

LOC348125 (Accession XP_302665.1) is another GAM7957 target gene, herein designated TARGET GENE. LOC348125 BINDING SITE is a target binding site found in the 5' untranslated region of mRNA encoded by LOC348125, corresponding to a target binding site such as BINDING SITE I, BINDING SITE II or BINDING SITE III of FIG. 8. Table 4 illustrates the complementarity of the nucleotide sequences of LOC348125 BINDING SITE, designated SEQ ID:6043, to the nucleotide sequence of GAM7957 RNA, herein designated GAM RNA, also designated SEQ ID:297.

Another function of GAM7957 is therefore inhibition of LOC348125 (Accession XP_302665.1). Accordingly, utilities of GAM7957 include diagnosis, prevention and treatment of diseases and clinical conditions associated with LOC348125.

LOC348137 (Accession XP_300635.1) is another GAM7957 target gene, herein designated TARGET GENE. LOC348137 BINDING SITE is a target binding site found in the 5' untranslated region of mRNA encoded by LOC348137, corresponding to a target binding site such as BINDING SITE I, BINDING SITE II or BINDING SITE III of FIG. 8. Table 4 illustrates the complementarity of the nucleotide sequences of LOC348137 BINDING SITE, designated SEQ ID:10439, to the nucleotide sequence of GAM7957 RNA, herein designated GAM RNA, also designated SEQ ID:297.

Another function of GAM7957 is therefore inhibition of LOC348137 (Accession XP_300635.1). Accordingly, utilities of GAM7957 include diagnosis, prevention and treatment of diseases and clinical conditions associated with LOC348137.

LOC348142 (Accession XP_300636.1) is another GAM7957 target gene, herein designated TARGET GENE. LOC348142 BINDING SITE is a target binding site found in the 5' untranslated region of mRNA encoded by LOC348142, corresponding to a target binding site such as BINDING SITE I, BINDING SITE II or BINDING SITE III of FIG. 8. Table 4 illustrates the complementarity of the nucleotide sequences of LOC348142 BINDING SITE, designated SEQ ID:10439, to the nucleotide sequence of GAM7957 RNA, herein designated GAM RNA, also designated SEQ ID:297.

Another function of GAM7957 is therefore inhibition of LOC348142 (Accession XP_300636.1). Accordingly, utilities of GAM7957 include diagnosis, prevention and treatment of diseases and clinical conditions associated with LOC348142.

LOC348161 (Accession XP_208864.1) is another GAM7957 target gene, herein designated TARGET GENE. LOC348161 BINDING SITE is a target binding site found in the 3' untranslated region of mRNA encoded by LOC348161, corresponding to a target binding site such as BINDING SITE I, BINDING SITE II or BINDING SITE III of FIG. 8. Table 4 illustrates the complementarity of the nucleotide sequences of LOC348161 BINDING SITE, designated SEQ ID:3778, to the nucleotide sequence of GAM7957 RNA, herein designated GAM RNA, also designated SEQ ID:297.

Another function of GAM7957 is therefore inhibition of LOC348161 (Accession XP_208864.1). Accordingly, utilities of GAM7957 include diagnosis, prevention and treatment of diseases and clinical conditions associated with LOC348161.

LOC348162 (Accession XP_300643.1) is another GAM7957 target gene, herein designated TARGET GENE.

LOC348162 BINDING SITE is a target binding site found in the 5' untranslated region of mRNA encoded by LOC348162, corresponding to a target binding site such as BINDING SITE I, BINDING SITE II or BINDING SITE III of FIG. 8. Table 4 illustrates the complementarity of the nucleotide sequences of LOC348162 BINDING SITE, designated SEQ ID:16944, to the nucleotide sequence of GAM7957 RNA, herein designated GAM RNA, also designated SEQ ID:297.

Another function of GAM7957 is therefore inhibition of LOC348162 (Accession XP_300643.1). Accordingly, utilities of GAM7957 include diagnosis, prevention and treatment of diseases and clinical conditions associated with LOC348162.

LOC348233 (Accession XP_302697.1) is another GAM7957 target gene, herein designated TARGET GENE. LOC348233 BINDING SITE is a target binding site found in the 3' untranslated region of mRNA encoded by LOC348233, corresponding to a target binding site such as BINDING SITE I, BINDING SITE II or BINDING SITE III of FIG. 8. Table 4 illustrates the complementarity of the nucleotide sequences of LOC348233 BINDING SITE, designated SEQ ID:7332, to the nucleotide sequence of GAM7957 RNA, herein designated GAM RNA, also designated SEQ ID:297.

Another function of GAM7957 is therefore inhibition of LOC348233 (Accession XP_302697.1). Accordingly, utilities of GAM7957 include diagnosis, prevention and treatment of diseases and clinical conditions associated with LOC348233.

LOC348245 (Accession XP_209014.1) is another GAM7957 target gene, herein designated TARGET GENE. LOC348245 BINDING SITE is a target binding site found in the 3' untranslated region of mRNA encoded by LOC348245, corresponding to a target binding site such as BINDING SITE I, BINDING SITE II or BINDING SITE III of FIG. 8. Table 4 illustrates the complementarity of the nucleotide sequences of LOC348245 BINDING SITE, designated SEQ ID:10439, to the nucleotide sequence of GAM7957 RNA, herein designated GAM RNA, also designated SEQ ID:297.

Another function of GAM7957 is therefore inhibition of LOC348245 (Accession XP_209014.1). Accordingly, utilities of GAM7957 include diagnosis, prevention and treatment of diseases and clinical conditions associated with LOC348245.

LOC348261 (Accession XP_302704.1) is another GAM7957 target gene, herein designated TARGET GENE. LOC348261 BINDING SITE is a target binding site found in the 3' untranslated region of mRNA encoded by LOC348261, corresponding to a target binding site such as BINDING SITE I, BINDING SITE II or BINDING SITE III of FIG. 8. Table 4 illustrates the complementarity of the nucleotide sequences of LOC348261 BINDING SITE, designated SEQ ID:11153, to the nucleotide sequence of GAM7957 RNA, herein designated GAM RNA, also designated SEQ ID:297.

Another function of GAM7957 is therefore inhibition of LOC348261 (Accession XP_302704.1). Accordingly, utilities of GAM7957 include diagnosis, prevention and treatment of diseases and clinical conditions associated with LOC348261.

LOC348264 (Accession XP_302706.1) is another GAM7957 target gene, herein designated TARGET GENE. LOC348264 BINDING SITE1 through LOC348264 BINDING SITE4 are target binding sites found in untranslated regions of mRNA encoded by LOC348264, corresponding to target binding sites such as BINDING SITE I, BINDING SITE II or BINDING SITE III of FIG. 8. Table 4 illustrates the complementarity of the nucleotide sequences of LOC348264 BINDING SITE1 through LOC348264 BINDING SITE4, designated SEQ ID:9499, SEQ ID:6470, SEQ ID:825 and SEQ ID:1479 respectively, to the nucleotide sequence of GAM7957 RNA, herein designated GAM RNA, also designated SEQ ID:297.

Another function of GAM7957 is therefore inhibition of LOC348264 (Accession XP_302706.1). Accordingly, utilities of GAM7957 include diagnosis, prevention and treatment of diseases and clinical conditions associated with LOC348264.

LOC348265 (Accession XP_302705.1) is another GAM7957 target gene, herein designated TARGET GENE. LOC348265 BINDING SITE1 through LOC348265 BINDING SITE4 are target binding sites found in untranslated regions of mRNA encoded by LOC348265, corresponding to target binding sites such as BINDING SITE I, BINDING SITE II or BINDING SITE III of FIG. 8. Table 4 illustrates the complementarity of the nucleotide sequences of LOC348265 BINDING SITE1 through LOC348265 BINDING SITE4, designated SEQ ID:1479, SEQ ID:6470, SEQ ID:825 and SEQ ID:9499 respectively, to the nucleotide sequence of GAM7957 RNA, herein designated GAM RNA, also designated SEQ ID:297.

Another function of GAM7957 is therefore inhibition of LOC348265 (Accession XP_302705.1). Accordingly, utilities of GAM7957 include diagnosis, prevention and treatment of diseases and clinical conditions associated with LOC348265.

LOC348369 (Accession XP_302732.1) is another GAM7957 target gene, herein designated TARGET GENE. LOC348369 BINDING SITE is a target binding site found in the 5' untranslated region of mRNA encoded by LOC348369, corresponding to a target binding site such as BINDING SITE I, BINDING SITE II or BINDING SITE III of FIG. 8. Table 4 illustrates the complementarity of the nucleotide sequences of LOC348369 BINDING SITE, designated SEQ ID:19588, to the nucleotide sequence of GAM7957 RNA, herein designated GAM RNA, also designated SEQ ID:297.

Another function of GAM7957 is therefore inhibition of LOC348369 (Accession XP_302732.1). Accordingly, utilities of GAM7957 include diagnosis, prevention and treatment of diseases and clinical conditions associated with LOC348369.

LOC348378 (Accession XP_300723.1) is another GAM7957 target gene, herein designated TARGET GENE. LOC348378 BINDING SITE is a target binding site found in the 3' untranslated region of mRNA encoded by LOC348378, corresponding to a target binding site such as BINDING SITE I, BINDING SITE II or BINDING SITE III of FIG. 8. Table 4 illustrates the complementarity of the nucleotide sequences of LOC348378 BINDING SITE, designated SEQ ID:9275, to the nucleotide sequence of GAM7957 RNA, herein designated GAM RNA, also designated SEQ ID:297.

Another function of GAM7957 is therefore inhibition of LOC348378 (Accession XP_300723.1). Accordingly, utilities of GAM7957 include diagnosis, prevention and treatment of diseases and clinical conditions associated with LOC348378.

LOC348393 (Accession XP_302741.1) is another GAM7957 target gene, herein designated TARGET GENE. LOC348393 BINDING SITE1 and LOC348393 BINDING SITE2 are target binding sites found in untranslated regions of mRNA encoded by LOC348393, corresponding to target binding sites such as BINDING SITE I, BINDING SITE II or BINDING SITE III of FIG. 8. Table 4 illustrates the complementarity of the nucleotide sequences of LOC348393 BINDING SITE1 and LOC348393 BINDING SITE2, designated SEQ ID:15307 and SEQ ID:15224 respectively, to the nucleotide sequence of GAM7957 RNA, herein designated GAM RNA, also designated SEQ ID:297.

Another function of GAM7957 is therefore inhibition of LOC348393 (Accession XP_302741.1). Accordingly, utilities of GAM7957 include diagnosis, prevention and treatment of diseases and clinical conditions associated with LOC348393.

LOC348402 (Accession XP_300730.1) is another GAM7957 target gene, herein designated TARGET GENE. LOC348402 BINDING SITE is a target binding site found in the 3' untranslated region of mRNA encoded by LOC348402, corresponding to a target binding site such as BINDING SITE I, BINDING SITE II or BINDING SITE III of FIG. 8. Table 4 illustrates the complementarity of the nucleotide sequences of LOC348402 BINDING SITE, designated SEQ ID:6390, to the nucleotide sequence of GAM7957 RNA, herein designated GAM RNA, also designated SEQ ID:297.

Another function of GAM7957 is therefore inhibition of LOC348402 (Accession XP_300730.1). Accordingly, utilities of GAM7957 include diagnosis, prevention and treatment of diseases and clinical conditions associated with LOC348402.

LOC348442 (Accession XP_057659.1) is another GAM7957 target gene, herein designated TARGET GENE. LOC348442 BINDING SITE1 and LOC348442 BINDING SITE2 are target binding sites found in untranslated regions of mRNA encoded by LOC348442, corresponding to target binding sites such as BINDING SITE I, BINDING SITE II or BINDING SITE III of FIG. 8. Table 4 illustrates the complementarity of the nucleotide sequences of LOC348442 BINDING SITE1 and LOC348442 BINDING SITE2, designated SEQ ID:12210 and SEQ ID:1671 respectively, to the nucleotide sequence of GAM7957 RNA, herein designated GAM RNA, also designated SEQ ID:297.

Another function of GAM7957 is therefore inhibition of LOC348442 (Accession XP_057659.1). Accordingly, utilities of GAM7957 include diagnosis, prevention and treatment of diseases and clinical conditions associated with LOC348442.

LOC348455 (Accession XP_302760.1) is another GAM7957 target gene, herein designated TARGET GENE. LOC348455 BINDING SITE is a target binding site found in the 3' untranslated region of mRNA encoded by LOC348455, corresponding to a target binding site such as BINDING SITE I, BINDING SITE II or BINDING SITE III of FIG. 8. Table 4 illustrates the complementarity of the nucleotide sequences of LOC348455 BINDING SITE, designated SEQ ID:18285, to the nucleotide sequence of GAM7957 RNA, herein designated GAM RNA, also designated SEQ ID:297.

Another function of GAM7957 is therefore inhibition of LOC348455 (Accession XP_302760.1). Accordingly, utilities of GAM7957 include diagnosis, prevention and treatment of diseases and clinical conditions associated with LOC348455.

LOC348456 (Accession XP_302761.1) is another GAM7957 target gene, herein designated TARGET GENE. LOC348456 BINDING SITE1 and LOC348456 BINDING SITE2 are target binding sites found in untranslated regions of mRNA encoded by LOC348456, corresponding to target binding sites such as BINDING SITE I, BINDING SITE II or BINDING SITE III of FIG. 8. Table 4 illustrates the complementarity of the nucleotide sequences of LOC348456 BINDING SITE1 and LOC348456 BINDING SITE2, designated SEQ ID:12336 and SEQ ID:2031 respectively, to the nucleotide sequence of GAM7957 RNA, herein designated GAM RNA, also designated SEQ ID:297.

Another function of GAM7957 is therefore inhibition of LOC348456 (Accession XP_302761.1). Accordingly, utilities of GAM7957 include diagnosis, prevention and treatment of diseases and clinical conditions associated with LOC348456.

LOC348461 (Accession XP_302764.1) is another GAM7957 target gene, herein designated TARGET GENE. LOC348461 BINDING SITE is a target binding site found in the 3' untranslated region of mRNA encoded by LOC348461, corresponding to a target binding site such as BINDING SITE I, BINDING SITE II or BINDING SITE III of FIG. 8. Table 4 illustrates the complementarity of the nucleotide sequences of LOC348461 BINDING SITE, designated SEQ ID:7449, to the nucleotide sequence of GAM7957 RNA, herein designated GAM RNA, also designated SEQ ID:297.

Another function of GAM7957 is therefore inhibition of LOC348461 (Accession XP_302764.1). Accordingly, utilities of GAM7957 include diagnosis, prevention and treatment of diseases and clinical conditions associated with LOC348461.

LOC348474 (Accession XP_209299.2) is another GAM7957 target gene, herein designated TARGET GENE. LOC348474 BINDING SITE is a target binding site found in the 3' untranslated region of mRNA encoded by LOC348474, corresponding to a target binding site such as BINDING SITE I, BINDING SITE II or BINDING SITE III of FIG. 8. Table 4 illustrates the complementarity of the nucleotide sequences of LOC348474 BINDING SITE, designated SEQ ID:4185, to the nucleotide sequence of GAM7957 RNA, herein designated GAM RNA, also designated SEQ ID:297.

Another function of GAM7957 is therefore inhibition of LOC348474 (Accession XP_209299.2). Accordingly, utilities of GAM7957 include diagnosis, prevention and treatment of diseases and clinical conditions associated with LOC348474.

LOC348475 (Accession XP_300748.1) is another GAM7957 target gene, herein designated TARGET GENE. LOC348475 BINDING SITE is a target binding site found in the 5' untranslated region of mRNA encoded by LOC348475, corresponding to a target binding site such as BINDING SITE I, BINDING SITE II or BINDING SITE III of FIG. 8. Table 4 illustrates the complementarity of the nucleotide sequences of LOC348475 BINDING SITE, designated SEQ ID:5613, to the nucleotide sequence of GAM7957 RNA, herein designated GAM RNA, also designated SEQ ID:297.

Another function of GAM7957 is therefore inhibition of LOC348475 (Accession XP_300748.1). Accordingly, utilities of GAM7957 include diagnosis, prevention and treatment of diseases and clinical conditions associated with LOC348475.

LOC348480 (Accession XP_302773.1) is another GAM7957 target gene, herein designated TARGET GENE. LOC348480 BINDING SITE is a target binding site found in the 3' untranslated region of mRNA encoded by LOC348480, corresponding to a target binding site such as BINDING SITE I, BINDING SITE II or BINDING SITE III of FIG. 8. Table 4 illustrates the complementarity of the nucleotide sequences of LOC348480 BINDING SITE, designated SEQ ID:5321, to the nucleotide sequence of GAM7957 RNA, herein designated GAM RNA, also designated SEQ ID:297.

Another function of GAM7957 is therefore inhibition of LOC348480 (Accession XP_302773.1). Accordingly, utilities of GAM7957 include diagnosis, prevention and treatment of diseases and clinical conditions associated with LOC348480.

LOC348482 (Accession XP_300753.1) is another GAM7957 target gene, herein designated TARGET GENE.

LOC348482 BINDING SITE is a target binding site found in the 5' untranslated region of mRNA encoded by LOC348482, corresponding to a target binding site such as BINDING SITE I, BINDING SITE II or BINDING SITE III of FIG. 8. Table 4 illustrates the complementarity of the nucleotide sequences of LOC348482 BINDING SITE, designated SEQ ID:5613, to the nucleotide sequence of GAM7957 RNA, herein designated GAM RNA, also designated SEQ ID:297.

Another function of GAM7957 is therefore inhibition of LOC348482 (Accession XP_300753.1). Accordingly, utilities of GAM7957 include diagnosis, prevention and treatment of diseases and clinical conditions associated with LOC348482.

LOC348488 (Accession XP_300352.1) is another GAM7957 target gene, herein designated TARGET GENE. LOC348488 BINDING SITE1 and LOC348488 BINDING SITE2 are target binding sites found in untranslated regions of mRNA encoded by LOC348488, corresponding to target binding sites such as BINDING SITE I, BINDING SITE II or BINDING SITE III of FIG. 8. Table 4 illustrates the complementarity of the nucleotide sequences of LOC348488 BINDING SITE1 and LOC348488 BINDING SITE2, designated SEQ ID:19709 and SEQ ID:3203 respectively, to the nucleotide sequence of GAM7957 RNA, herein designated GAM RNA, also designated SEQ ID:297.

Another function of GAM7957 is therefore inhibition of LOC348488 (Accession XP_300352.1). Accordingly, utilities of GAM7957 include diagnosis, prevention and treatment of diseases and clinical conditions associated with LOC348488.

LOC348496 (Accession XP_302795.1) is another GAM7957 target gene, herein designated TARGET GENE. LOC348496 BINDING SITE1 and LOC348496 BINDING SITE2 are target binding sites found in untranslated regions of mRNA encoded by LOC348496, corresponding to target binding sites such as BINDING SITE I, BINDING SITE II or BINDING SITE III of FIG. 8. Table 4 illustrates the complementarity of the nucleotide sequences of LOC348496 BINDING SITE1 and LOC348496 BINDING SITE2, designated SEQ ID:5830 and SEQ ID:7670 respectively, to the nucleotide sequence of GAM7957 RNA, herein designated GAM RNA, also designated SEQ ID:297.

Another function of GAM7957 is therefore inhibition of LOC348496 (Accession XP_302795.1). Accordingly, utilities of GAM7957 include diagnosis, prevention and treatment of diseases and clinical conditions associated with LOC348496.

LOC348503 (Accession XP_300762.1) is another GAM7957 target gene, herein designated TARGET GENE. LOC348503 BINDING SITE1 and LOC348503 BINDING SITE2 are target binding sites found in untranslated regions of mRNA encoded by LOC348503, corresponding to target binding sites such as BINDING SITE I, BINDING SITE II or BINDING SITE III of FIG. 8. Table 4 illustrates the complementarity of the nucleotide sequences of LOC348503 BINDING SITE1 and LOC348503 BINDING SITE2, designated SEQ ID:13988 and SEQ ID:9335 respectively, to the nucleotide sequence of GAM7957 RNA, herein designated GAM RNA, also designated SEQ ID:297.

Another function of GAM7957 is therefore inhibition of LOC348503 (Accession XP_300762.1). Accordingly, utilities of GAM7957 include diagnosis, prevention and treatment of diseases and clinical conditions associated with LOC348503.

LOC348504 (Accession XP_300769.1) is another GAM7957 target gene, herein designated TARGET GENE. LOC348504 BINDING SITE is a target binding site found in the 5' untranslated region of mRNA encoded by LOC348504, corresponding to a target binding site such as BINDING SITE I, BINDING SITE II or BINDING SITE III of FIG. 8. Table 4 illustrates the complementarity of the nucleotide sequences of LOC348504 BINDING SITE, designated SEQ ID:17081, to the nucleotide sequence of GAM7957 RNA, herein designated GAM RNA, also designated SEQ ID:297.

Another function of GAM7957 is therefore inhibition of LOC348504 (Accession XP_300769.1). Accordingly, utilities of GAM7957 include diagnosis, prevention and treatment of diseases and clinical conditions associated with LOC348504.

LOC348520 (Accession XP_300772.1) is another GAM7957 target gene, herein designated TARGET GENE. LOC348520 BINDING SITE is a target binding site found in the 3' untranslated region of mRNA encoded by LOC348520, corresponding to a target binding site such as BINDING SITE I, BINDING SITE II or BINDING SITE III of FIG. 8. Table 4 illustrates the complementarity of the nucleotide sequences of LOC348520 BINDING SITE, designated SEQ ID:6989, to the nucleotide sequence of GAM7957 RNA, herein designated GAM RNA, also designated SEQ ID:297.

Another function of GAM7957 is therefore inhibition of LOC348520 (Accession XP_300772.1). Accordingly, utilities of GAM7957 include diagnosis, prevention and treatment of diseases and clinical conditions associated with LOC348520.

LOC348522 (Accession XP_300774.1) is another GAM7957 target gene, herein designated TARGET GENE. LOC348522 BINDING SITE is a target binding site found in the 3' untranslated region of mRNA encoded by LOC348522, corresponding to a target binding site such as BINDING SITE I, BINDING SITE II or BINDING SITE III of FIG. 8. Table 4 illustrates the complementarity of the nucleotide sequences of LOC348522 BINDING SITE, designated SEQ ID:15409, to the nucleotide sequence of GAM7957 RNA, herein designated GAM RNA, also designated SEQ ID:297.

Another function of GAM7957 is therefore inhibition of LOC348522 (Accession XP_300774.1). Accordingly, utilities of GAM7957 include diagnosis, prevention and treatment of diseases and clinical conditions associated with LOC348522.

LOC348527 (Accession XP_300779.1) is another GAM7957 target gene, herein designated TARGET GENE. LOC348527 BINDING SITE1 through LOC348527 BINDING SITE4 are target binding sites found in untranslated regions of mRNA encoded by LOC348527, corresponding to target binding sites such as BINDING SITE I, BINDING SITE II or BINDING SITE III of FIG. 8. Table 4 illustrates the complementarity of the nucleotide sequences of LOC348527 BINDING SITE1 through LOC348527 BINDING SITE4, designated SEQ ID:12336, SEQ ID:2031, SEQ ID:3911 and SEQ ID:18885 respectively, to the nucleotide sequence of GAM7957 RNA, herein designated GAM RNA, also designated SEQ ID:297.

Another function of GAM7957 is therefore inhibition of LOC348527 (Accession XP_300779.1). Accordingly, utilities of GAM7957 include diagnosis, prevention and treatment of diseases and clinical conditions associated with LOC348527.

LOC348532 (Accession XP_302818.1) is another GAM7957 target gene, herein designated TARGET GENE. LOC348532 BINDING SITE1 and LOC348532 BINDING SITE2 are target binding sites found in untranslated regions of mRNA encoded by LOC348532, corresponding to target binding sites such as BINDING SITE I, BINDING SITE II or BINDING SITE III of FIG. 8. Table 4 illustrates the complementarity of the nucleotide sequences of LOC348532 BINDING SITE1 and LOC348532 BINDING SITE2, designated SEQ ID:15307 and SEQ ID:15224 respectively, to the nucleotide sequence of GAM7957 RNA, herein designated GAM RNA, also designated SEQ ID:297.

Another function of GAM7957 is therefore inhibition of LOC348532 (Accession XP_302818.1). Accordingly, utilities of GAM7957 include diagnosis, prevention and treatment of diseases and clinical conditions associated with LOC348532.

LOC348533 (Accession XP_302819.1) is another GAM7957 target gene, herein designated TARGET GENE. LOC348533 BINDING SITE is a target binding site found in the 3' untranslated region of mRNA encoded by LOC348533, corresponding to a target binding site such as BINDING SITE I, BINDING SITE II or BINDING SITE III of FIG. 8. Table 4 illustrates the complementarity of the nucleotide sequences of LOC348533 BINDING SITE, designated SEQ ID:12654, to the nucleotide sequence of GAM7957 RNA, herein designated GAM RNA, also designated SEQ ID:297.

Another function of GAM7957 is therefore inhibition of LOC348533 (Accession XP_302819.1). Accordingly, utilities of GAM7957 include diagnosis, prevention and treatment of diseases and clinical conditions associated with LOC348533.

LOC348541 (Accession XP_302820.1) is another GAM7957 target gene, herein designated TARGET GENE. LOC348541 BINDING SITE is a target binding site found in the 3' untranslated region of mRNA encoded by LOC348541, corresponding to a target binding site such as BINDING SITE I, BINDING SITE II or BINDING SITE III of FIG. 8. Table 4 illustrates the complementarity of the nucleotide sequences of LOC348541 BINDING SITE, designated SEQ ID:13091, to the nucleotide sequence of GAM7957 RNA, herein designated GAM RNA, also designated SEQ ID:297.

Another function of GAM7957 is therefore inhibition of LOC348541 (Accession XP_302820.1). Accordingly, utilities of GAM7957 include diagnosis, prevention and treatment of diseases and clinical conditions associated with LOC348541.

LOC348544 (Accession XP_300243.1) is another GAM7957 target gene, herein designated TARGET GENE. LOC348544 BINDING SITE1 through LOC348544 BINDING SITE3 are target binding sites found in untranslated regions of mRNA encoded by LOC348544, corresponding to target binding sites such as BINDING SITE I, BINDING SITE II or BINDING SITE III of FIG. 8. Table 4 illustrates the complementarity of the nucleotide sequences of LOC348544 BINDING SITE1 through LOC348544 BINDING SITE3, designated SEQ ID:16953, SEQ ID:5164 and SEQ ID:1492 respectively, to the nucleotide sequence of GAM7957 RNA, herein designated GAM RNA, also designated SEQ ID:297.

Another function of GAM7957 is therefore inhibition of LOC348544 (Accession XP_300243.1). Accordingly, utilities of GAM7957 include diagnosis, prevention and treatment of diseases and clinical conditions associated with LOC348544.

LOC348594 (Accession XP_302834.1) is another GAM7957 target gene, herein designated TARGET GENE. LOC348594 BINDING SITE is a target binding site found in the 5' untranslated region of mRNA encoded by LOC348594, corresponding to a target binding site such as BINDING SITE I, BINDING SITE II or BINDING SITE III of FIG. 8. Table 4 illustrates the complementarity of the nucleotide sequences of LOC348594 BINDING SITE, designated SEQ ID:16401, to the nucleotide sequence of GAM7957 RNA, herein designated GAM RNA, also designated SEQ ID:297.

Another function of GAM7957 is therefore inhibition of LOC348594 (Accession XP_302834.1). Accordingly, utilities of GAM7957 include diagnosis, prevention and treatment of diseases and clinical conditions associated with LOC348594.

LOC348595 (Accession XP_302837.1) is another GAM7957 target gene, herein designated TARGET GENE. LOC348595 BINDING SITE is a target binding site found in the 3' untranslated region of mRNA encoded by LOC348595, corresponding to a target binding site such as BINDING SITE I, BINDING SITE II or BINDING SITE III of FIG. 8. Table 4 illustrates the complementarity of the nucleotide sequences of LOC348595 BINDING SITE, designated SEQ ID:16401, to the nucleotide sequence of GAM7957 RNA, herein designated GAM RNA, also designated SEQ ID:297.

Another function of GAM7957 is therefore inhibition of LOC348595 (Accession XP_302837.1). Accordingly, utilities of GAM7957 include diagnosis, prevention and treatment of diseases and clinical conditions associated with LOC348595.

LOC348603 (Accession XP_302844.1) is another GAM7957 target gene, herein designated TARGET GENE. LOC348603 BINDING SITE is a target binding site found in the 5' untranslated region of mRNA encoded by LOC348603, corresponding to a target binding site such as BINDING SITE I, BINDING SITE II or BINDING SITE III of FIG. 8. Table 4 illustrates the complementarity of the nucleotide sequences of LOC348603 BINDING SITE, designated SEQ ID:16401, to the nucleotide sequence of GAM7957 RNA, herein designated GAM RNA, also designated SEQ ID:297.

Another function of GAM7957 is therefore inhibition of LOC348603 (Accession XP_302844.1). Accordingly, utilities of GAM7957 include diagnosis, prevention and treatment of diseases and clinical conditions associated with LOC348603.

LOC348605 (Accession XP_300793.1) is another GAM7957 target gene, herein designated TARGET GENE. LOC348605 BINDING SITE is a target binding site found in the 3' untranslated region of mRNA encoded by LOC348605, corresponding to a target binding site such as BINDING SITE I, BINDING SITE II or BINDING SITE III of FIG. 8. Table 4 illustrates the complementarity of the nucleotide sequences of LOC348605 BINDING SITE, designated SEQ ID:16401, to the nucleotide sequence of GAM7957 RNA, herein designated GAM RNA, also designated SEQ ID:297.

Another function of GAM7957 is therefore inhibition of LOC348605 (Accession XP_300793.1). Accordingly, utilities of GAM7957 include diagnosis, prevention and treatment of diseases and clinical conditions associated with LOC348605.

LOC348629 (Accession XP_209400.1) is another GAM7957 target gene, herein designated TARGET GENE. LOC348629 BINDING SITE is a target binding site found in the 3' untranslated region of mRNA encoded by LOC348629, corresponding to a target binding site such as BINDING SITE I, BINDING SITE II or BINDING SITE III of FIG. 8. Table 4 illustrates the complementarity of the nucleotide sequences of LOC348629 BINDING SITE, designated SEQ ID:14111, to the nucleotide sequence of GAM7957 RNA, herein designated GAM RNA, also designated SEQ ID:297.

Another function of GAM7957 is therefore inhibition of LOC348629 (Accession XP_209400.1). Accordingly, utilities of GAM7957 include diagnosis, prevention and treatment of diseases and clinical conditions associated with LOC348629.

LOC348699 (Accession XP_300816.1) is another GAM7957 target gene, herein designated TARGET GENE.

LOC348699 BINDING SITE is a target binding site found in the 5' untranslated region of mRNA encoded by LOC348699, corresponding to a target binding site such as BINDING SITE I, BINDING SITE II or BINDING SITE III of FIG. 8. Table 4 illustrates the complementarity of the nucleotide sequences of LOC348699 BINDING SITE, designated SEQ ID:15983, to the nucleotide sequence of GAM7957 RNA, herein designated GAM RNA, also designated SEQ ID:297.

Another function of GAM7957 is therefore inhibition of LOC348699 (Accession XP_300816.1). Accordingly, utilities of GAM7957 include diagnosis, prevention and treatment of diseases and clinical conditions associated with LOC348699.

LOC348738 (Accession XP_300826.1) is another GAM7957 target gene, herein designated TARGET GENE. LOC348738 BINDING SITE is a target binding site found in the 3' untranslated region of mRNA encoded by LOC348738, corresponding to a target binding site such as BINDING SITE I, BINDING SITE II or BINDING SITE III of FIG. 8. Table 4 illustrates the complementarity of the nucleotide sequences of LOC348738 BINDING SITE, designated SEQ ID:7320, to the nucleotide sequence of GAM7957 RNA, herein designated GAM RNA, also designated SEQ ID:297.

Another function of GAM7957 is therefore inhibition of LOC348738 (Accession XP_300826.1). Accordingly, utilities of GAM7957 include diagnosis, prevention and treatment of diseases and clinical conditions associated with LOC348738.

LOC348790 (Accession XP_300843.1) is another GAM7957 target gene, herein designated TARGET GENE. LOC348790 BINDING SITE1 and LOC348790 BINDING SITE2 are target binding sites found in untranslated regions of mRNA encoded by LOC348790, corresponding to target binding sites such as BINDING SITE I, BINDING SITE II or BINDING SITE III of FIG. 8. Table 4 illustrates the complementarity of the nucleotide sequences of LOC348790 BINDING SITE1 and LOC348790 BINDING SITE2, designated SEQ ID:10423 and SEQ ID:16164 respectively, to the nucleotide sequence of GAM7957 RNA, herein designated GAM RNA, also designated SEQ ID:297.

Another function of GAM7957 is therefore inhibition of LOC348790 (Accession XP_300843.1). Accordingly, utilities of GAM7957 include diagnosis, prevention and treatment of diseases and clinical conditions associated with LOC348790.

LOC348835 (Accession XP_302902.1) is another GAM7957 target gene, herein designated TARGET GENE. LOC348835 BINDING SITE is a target binding site found in the 3' untranslated region of mRNA encoded by LOC348835, corresponding to a target binding site such as BINDING SITE I, BINDING SITE II or BINDING SITE III of FIG. 8. Table 4 illustrates the complementarity of the nucleotide sequences of LOC348835 BINDING SITE, designated SEQ ID:18336, to the nucleotide sequence of GAM7957 RNA, herein designated GAM RNA, also designated SEQ ID:297.

Another function of GAM7957 is therefore inhibition of LOC348835 (Accession XP_302902.1). Accordingly, utilities of GAM7957 include diagnosis, prevention and treatment of diseases and clinical conditions associated with LOC348835.

LOC348843 (Accession XP_302903.1) is another GAM7957 target gene, herein designated TARGET GENE. LOC348843 BINDING SITE1 and LOC348843 BINDING SITE2 are target binding sites found in untranslated regions of mRNA encoded by LOC348843, corresponding to target binding sites such as BINDING SITE I, BINDING SITE II or BINDING SITE III of FIG. 8. Table 4 illustrates the complementarity of the nucleotide sequences of LOC348843 BINDING SITE1 and LOC348843 BINDING SITE2, designated SEQ ID:19499 and SEQ ID:17081 respectively, to the nucleotide sequence of GAM7957 RNA, herein designated GAM RNA, also designated SEQ ID:297.

Another function of GAM7957 is therefore inhibition of LOC348843 (Accession XP_302903.1). Accordingly, utilities of GAM7957 include diagnosis, prevention and treatment of diseases and clinical conditions associated with LOC348843.

LOC348899 (Accession XP_302914.1) is another GAM7957 target gene, herein designated TARGET GENE. LOC348899 BINDING SITE is a target binding site found in the 5' untranslated region of mRNA encoded by LOC348899, corresponding to a target binding site such as BINDING SITE I, BINDING SITE II or BINDING SITE III of FIG. 8. Table 4 illustrates the complementarity of the nucleotide sequences of LOC348899 BINDING SITE, designated SEQ ID:8189, to the nucleotide sequence of GAM7957 RNA, herein designated GAM RNA, also designated SEQ ID:297.

Another function of GAM7957 is therefore inhibition of LOC348899 (Accession XP_302914.1). Accordingly, utilities of GAM7957 include diagnosis, prevention and treatment of diseases and clinical conditions associated with LOC348899.

LOC349050 (Accession XP_300917.1) is another GAM7957 target gene, herein designated TARGET GENE. LOC349050 BINDING SITE is a target binding site found in the 3' untranslated region of mRNA encoded by LOC349050, corresponding to a target binding site such as BINDING SITE I, BINDING SITE II or BINDING SITE III of FIG. 8. Table 4 illustrates the complementarity of the nucleotide sequences of LOC349050 BINDING SITE, designated SEQ ID:15984, to the nucleotide sequence of GAM7957 RNA, herein designated GAM RNA, also designated SEQ ID:297.

Another function of GAM7957 is therefore inhibition of LOC349050 (Accession XP_300917.1). Accordingly, utilities of GAM7957 include diagnosis, prevention and treatment of diseases and clinical conditions associated with LOC349050.

LOC349063 (Accession XP_302949.1) is another GAM7957 target gene, herein designated TARGET GENE. LOC349063 BINDING SITE is a target binding site found in the 3' untranslated region of mRNA encoded by LOC349063, corresponding to a target binding site such as BINDING SITE I, BINDING SITE II or BINDING SITE III of FIG. 8. Table 4 illustrates the complementarity of the nucleotide sequences of LOC349063 BINDING SITE, designated SEQ ID:14367, to the nucleotide sequence of GAM7957 RNA, herein designated GAM RNA, also designated SEQ ID:297.

Another function of GAM7957 is therefore inhibition of LOC349063 (Accession XP_302949.1). Accordingly, utilities of GAM7957 include diagnosis, prevention and treatment of diseases and clinical conditions associated with LOC349063.

LOC349096 (Accession XP_300937.1) is another GAM7957 target gene, herein designated TARGET GENE. LOC349096 BINDING SITE1 and LOC349096 BINDING SITE2 are target binding sites found in untranslated regions of mRNA encoded by LOC349096, corresponding to target binding sites such as BINDING SITE I, BINDING SITE II or BINDING SITE III of FIG. 8. Table 4 illustrates the complementarity of the nucleotide sequences of LOC349096 BINDING SITE1 and LOC349096 BINDING SITE2, designated SEQ ID:7908 and SEQ ID:2306 respectively, to the nucleotide sequence of GAM7957 RNA, herein designated GAM RNA, also designated SEQ ID:297.

Another function of GAM7957 is therefore inhibition of LOC349096 (Accession XP_300937.1). Accordingly, utilities of GAM7957 include diagnosis, prevention and treatment of diseases and clinical conditions associated with LOC349096.

LOC349151 (Accession XP_302967.1) is another GAM7957 target gene, herein designated TARGET GENE. LOC349151 BINDING SITE1 and LOC349151 BINDING SITE2 are target binding sites found in untranslated regions of mRNA encoded by LOC349151, corresponding to target binding sites such as BINDING SITE I, BINDING SITE II or BINDING SITE III of FIG. 8. Table 4 illustrates the complementarity of the nucleotide sequences of LOC349151 BINDING SITE1 and LOC349151 BINDING SITE2, designated SEQ ID:9421 and SEQ ID:12920 respectively, to the nucleotide sequence of GAM7957 RNA, herein designated GAM RNA, also designated SEQ ID:297.

Another function of GAM7957 is therefore inhibition of LOC349151 (Accession XP_302967.1). Accordingly, utilities of GAM7957 include diagnosis, prevention and treatment of diseases and clinical conditions associated with LOC349151.

LOC349169 (Accession XP_302978.1) is another GAM7957 target gene, herein designated TARGET GENE. LOC349169 BINDING SITE is a target binding site found in the 3' untranslated region of mRNA encoded by LOC349169, corresponding to a target binding site such as BINDING SITE I, BINDING SITE II or BINDING SITE III of FIG. 8. Table 4 illustrates the complementarity of the nucleotide sequences of LOC349169 BINDING SITE, designated SEQ ID:10438, to the nucleotide sequence of GAM7957 RNA, herein designated GAM RNA, also designated SEQ ID:297.

Another function of GAM7957 is therefore inhibition of LOC349169 (Accession XP_302978.1). Accordingly, utilities of GAM7957 include diagnosis, prevention and treatment of diseases and clinical conditions associated with LOC349169.

LOC349170 (Accession XP_300969.1) is another GAM7957 target gene, herein designated TARGET GENE. LOC349170 BINDING SITE is a target binding site found in the 3' untranslated region of mRNA encoded by LOC349170, corresponding to a target binding site such as BINDING SITE I, BINDING SITE II or BINDING SITE III of FIG. 8. Table 4 illustrates the complementarity of the nucleotide sequences of LOC349170 BINDING SITE, designated SEQ ID:4313, to the nucleotide sequence of GAM7957 RNA, herein designated GAM RNA, also designated SEQ ID:297.

Another function of GAM7957 is therefore inhibition of LOC349170 (Accession XP_300969.1). Accordingly, utilities of GAM7957 include diagnosis, prevention and treatment of diseases and clinical conditions associated with LOC349170.

LOC349186 (Accession XP_302985.1) is another GAM7957 target gene, herein designated TARGET GENE. LOC349186 BINDING SITE is a target binding site found in the 3' untranslated region of mRNA encoded by LOC349186, corresponding to a target binding site such as BINDING SITE I, BINDING SITE II or BINDING SITE III of FIG. 8. Table 4 illustrates the complementarity of the nucleotide sequences of LOC349186 BINDING SITE, designated SEQ ID:10440, to the nucleotide sequence of GAM7957 RNA, herein designated GAM RNA, also designated SEQ ID:297.

Another function of GAM7957 is therefore inhibition of LOC349186 (Accession XP_302985.1). Accordingly, utilities of GAM7957 include diagnosis, prevention and treatment of diseases and clinical conditions associated with LOC349186.

LOC349197 (Accession XP_300974.1) is another GAM7957 target gene, herein designated TARGET GENE. LOC349197 BINDING SITE is a target binding site found in the 3' untranslated region of mRNA encoded by LOC349197, corresponding to a target binding site such as BINDING SITE I, BINDING SITE II or BINDING SITE III of FIG. 8. Table 4 illustrates the complementarity of the nucleotide sequences of LOC349197 BINDING SITE, designated SEQ ID:18689, to the nucleotide sequence of GAM7957 RNA, herein designated GAM RNA, also designated SEQ ID:297.

Another function of GAM7957 is therefore inhibition of LOC349197 (Accession XP_300974.1). Accordingly, utilities of GAM7957 include diagnosis, prevention and treatment of diseases and clinical conditions associated with LOC349197.

LOC349276 (Accession XP_301005.1) is another GAM7957 target gene, herein designated TARGET GENE. LOC349276 BINDING SITE is a target binding site found in the 3' untranslated region of mRNA encoded by LOC349276, corresponding to a target binding site such as BINDING SITE I, BINDING SITE II or BINDING SITE III of FIG. 8. Table 4 illustrates the complementarity of the nucleotide sequences of LOC349276 BINDING SITE, designated SEQ ID:3491, to the nucleotide sequence of GAM7957 RNA, herein designated GAM RNA, also designated SEQ ID:297.

Another function of GAM7957 is therefore inhibition of LOC349276 (Accession XP_301005.1). Accordingly, utilities of GAM7957 include diagnosis, prevention and treatment of diseases and clinical conditions associated with LOC349276.

LOC349282 (Accession XP_301008.1) is another GAM7957 target gene, herein designated TARGET GENE. LOC349282 BINDING SITE is a target binding site found in the 3' untranslated region of mRNA encoded by LOC349282, corresponding to a target binding site such as BINDING SITE I, BINDING SITE II or BINDING SITE III of FIG. 8. Table 4 illustrates the complementarity of the nucleotide sequences of LOC349282 BINDING SITE, designated SEQ ID:17262, to the nucleotide sequence of GAM7957 RNA, herein designated GAM RNA, also designated SEQ ID:297.

Another function of GAM7957 is therefore inhibition of LOC349282 (Accession XP_301008.1). Accordingly, utilities of GAM7957 include diagnosis, prevention and treatment of diseases and clinical conditions associated with LOC349282.

LOC349298 (Accession XP_301016.1) is another GAM7957 target gene, herein designated TARGET GENE. LOC349298 BINDING SITE is a target binding site found in the 3' untranslated region of mRNA encoded by LOC349298, corresponding to a target binding site such as BINDING SITE I, BINDING SITE II or BINDING SITE III of FIG. 8. Table 4 illustrates the complementarity of the nucleotide sequences of LOC349298 BINDING SITE, designated SEQ ID:1755, to the nucleotide sequence of GAM7957 RNA, herein designated GAM RNA, also designated SEQ ID:297.

Another function of GAM7957 is therefore inhibition of LOC349298 (Accession XP_301016.1). Accordingly, utilities of GAM7957 include diagnosis, prevention and treatment of diseases and clinical conditions associated with LOC349298.

LOC349313 (Accession XP_301024.1) is another GAM7957 target gene, herein designated TARGET GENE. LOC349313 BINDING SITE is a target binding site found in the 3' untranslated region of mRNA encoded by LOC349313, corresponding to a target binding site such as BINDING SITE I, BINDING SITE II or BINDING SITE III of FIG. 8. Table 4 illustrates the complementarity of the nucleotide sequences of LOC349313 BINDING SITE, designated SEQ ID:17262, to the nucleotide sequence of GAM7957 RNA, herein designated GAM RNA, also designated SEQ ID:297.

Another function of GAM7957 is therefore inhibition of LOC349313 (Accession XP_301024.1). Accordingly, utilities of GAM7957 include diagnosis, prevention and treatment of diseases and clinical conditions associated with LOC349313.

LOC349332 (Accession XP_301033.1) is another GAM7957 target gene, herein designated TARGET GENE. LOC349332 BINDING SITE is a target binding site found in the 5' untranslated region of mRNA encoded by LOC349332, corresponding to a target binding site such as BINDING SITE I, BINDING SITE II or BINDING SITE III of FIG. 8. Table 4 illustrates the complementarity of the nucleotide sequences of LOC349332 BINDING SITE, designated SEQ ID:10438, to the nucleotide sequence of GAM7957 RNA, herein designated GAM RNA, also designated SEQ ID:297.

Another function of GAM7957 is therefore inhibition of LOC349332 (Accession XP_301033.1). Accordingly, utilities of GAM7957 include diagnosis, prevention and treatment of diseases and clinical conditions associated with LOC349332.

LOC349381 (Accession XP_303039.1) is another GAM7957 target gene, herein designated TARGET GENE. LOC349381 BINDING SITE is a target binding site found in the 5' untranslated region of mRNA encoded by LOC349381, corresponding to a target binding site such as BINDING SITE I, BINDING SITE II or BINDING SITE III of FIG. 8. Table 4 illustrates the complementarity of the nucleotide sequences of LOC349381 BINDING SITE, designated SEQ ID:11100, to the nucleotide sequence of GAM7957 RNA, herein designated GAM RNA, also designated SEQ ID:297.

Another function of GAM7957 is therefore inhibition of LOC349381 (Accession XP_303039.1). Accordingly, utilities of GAM7957 include diagnosis, prevention and treatment of diseases and clinical conditions associated with LOC349381.

LOC349420 (Accession XP_301075.1) is another GAM7957 target gene, herein designated TARGET GENE. LOC349420 BINDING SITE is a target binding site found in the 3' untranslated region of mRNA encoded by LOC349420, corresponding to a target binding site such as BINDING SITE I, BINDING SITE II or BINDING SITE III of FIG. 8. Table 4 illustrates the complementarity of the nucleotide sequences of LOC349420 BINDING SITE, designated SEQ ID:18825, to the nucleotide sequence of GAM7957 RNA, herein designated GAM RNA, also designated SEQ ID:297.

Another function of GAM7957 is therefore inhibition of LOC349420 (Accession XP_301075.1). Accordingly, utilities of GAM7957 include diagnosis, prevention and treatment of diseases and clinical conditions associated with LOC349420.

LOC349430 (Accession XP_301084.1) is another GAM7957 target gene, herein designated TARGET GENE. LOC349430 BINDING SITE1 through LOC349430 BINDING SITE3 are target binding sites found in untranslated regions of mRNA encoded by LOC349430, corresponding to target binding sites such as BINDING SITE I, BINDING SITE II or BINDING SITE III of FIG. 8. Table 4 illustrates the complementarity of the nucleotide sequences of LOC349430 BINDING SITE1 through LOC349430 BINDING SITE3, designated SEQ ID:9769, SEQ ID:13491 and SEQ ID:5210 respectively, to the nucleotide sequence of GAM7957 RNA, herein designated GAM RNA, also designated SEQ ID:297.

Another function of GAM7957 is therefore inhibition of LOC349430 (Accession XP_301084.1). Accordingly, utilities of GAM7957 include diagnosis, prevention and treatment of diseases and clinical conditions associated with LOC349430.

LOC349432 (Accession XP_301086.1) is another GAM7957 target gene, herein designated TARGET GENE. LOC349432 BINDING SITE is a target binding site found in the 3' untranslated region of mRNA encoded by LOC349432, corresponding to a target binding site such as BINDING SITE I, BINDING SITE II or BINDING SITE III of FIG. 8. Table 4 illustrates the complementarity of the nucleotide sequences of LOC349432 BINDING SITE, designated SEQ ID:13491, to the nucleotide sequence of GAM7957 RNA, herein designated GAM RNA, also designated SEQ ID:297.

Another function of GAM7957 is therefore inhibition of LOC349432 (Accession XP_301086.1). Accordingly, utilities of GAM7957 include diagnosis, prevention and treatment of diseases and clinical conditions associated with LOC349432.

LOC349447 (Accession XP_088752.1) is another GAM7957 target gene, herein designated TARGET GENE. LOC349447 BINDING SITE is a target binding site found in the 3' untranslated region of mRNA encoded by LOC349447, corresponding to a target binding site such as BINDING SITE I, BINDING SITE II or BINDING SITE III of FIG. 8. Table 4 illustrates the complementarity of the nucleotide sequences of LOC349447 BINDING SITE, designated SEQ ID:18709, to the nucleotide sequence of GAM7957 RNA, herein designated GAM RNA, also designated SEQ ID:297.

Another function of GAM7957 is therefore inhibition of LOC349447 (Accession XP_088752.1). Accordingly, utilities of GAM7957 include diagnosis, prevention and treatment of diseases and clinical conditions associated with LOC349447.

LOC351012 (Accession XP_304617.1) is another GAM7957 target gene, herein designated TARGET GENE. LOC351012 BINDING SITE is a target binding site found in the 5' untranslated region of mRNA encoded by LOC351012, corresponding to a target binding site such as BINDING SITE I, BINDING SITE II or BINDING SITE III of FIG. 8. Table 4 illustrates the complementarity of the nucleotide sequences of LOC351012 BINDING SITE, designated SEQ ID:10900, to the nucleotide sequence of GAM7957 RNA, herein designated GAM RNA, also designated SEQ ID:297.

Another function of GAM7957 is therefore inhibition of LOC351012 (Accession XP_304617.1). Accordingly, utilities of GAM7957 include diagnosis, prevention and treatment of diseases and clinical conditions associated with LOC351012.

LOC51145 (Accession NP_057242.1) is another GAM7957 target gene, herein designated TARGET GENE. LOC51145 BINDING SITE is a target binding site found in the 3' untranslated region of mRNA encoded by LOC51145, corresponding to a target binding site such as BINDING SITE I, BINDING SITE II or BINDING SITE III of FIG. 8. Table 4 illustrates the complementarity of the nucleotide sequences of LOC51145 BINDING SITE, designated SEQ ID:12025, to the nucleotide sequence of GAM7957 RNA, herein designated GAM RNA, also designated SEQ ID:297.

Another function of GAM7957 is therefore inhibition of LOC51145 (Accession NP_057242.1). Accordingly, utilities of GAM7957 include diagnosis, prevention and treatment of diseases and clinical conditions associated with LOC51145.

LOC51212 (Accession NP_057464.1) is another GAM7957 target gene, herein designated TARGET GENE. LOC51212 BINDING SITE is a target binding site found in the 3' untranslated region of mRNA encoded by LOC51212, corresponding to a target binding site such as BINDING SITE I, BINDING SITE II or BINDING SITE III of FIG. 8. Table 4 illustrates the complementarity of the nucleotide sequences of LOC51212 BINDING SITE, designated SEQ ID:7047, to the nucleotide sequence of GAM7957 RNA, herein designated GAM RNA, also designated SEQ ID:297.

Another function of GAM7957 is therefore inhibition of LOC51212 (Accession NP_057464.1). Accordingly, utilities of GAM7957 include diagnosis, prevention and treatment of diseases and clinical conditions associated with LOC51212.

LOC51279 (Accession NP_057630.1) is another GAM7957 target gene, herein designated TARGET GENE. LOC51279 BINDING SITE1 and LOC51279 BINDING SITE2 are target binding sites found in untranslated regions of mRNA encoded by LOC51279, corresponding to target binding sites such as BINDING SITE I, BINDING SITE II or BINDING SITE III of FIG. 8. Table 4 illustrates the complementarity of the nucleotide sequences of LOC51279 BINDING SITE1 and LOC51279 BINDING SITE2, designated SEQ ID:19061 and SEQ ID:1492 respectively, to the nucleotide sequence of GAM7957 RNA, herein designated GAM RNA, also designated SEQ ID:297.

Another function of GAM7957 is therefore inhibition of LOC51279 (Accession NP_057630.1). Accordingly, utilities of GAM7957 include diagnosis, prevention and treatment of diseases and clinical conditions associated with LOC51279.

LOC51333 (Accession NP_057727.1) is another GAM7957 target gene, herein designated TARGET GENE. LOC51333 BINDING SITE is a target binding site found in the 3' untranslated region of mRNA encoded by LOC51333, corresponding to a target binding site such as BINDING SITE I, BINDING SITE II or BINDING SITE III of FIG. 8. Table 4 illustrates the complementarity of the nucleotide sequences of LOC51333 BINDING SITE, designated SEQ ID:4982, to the nucleotide sequence of GAM7957 RNA, herein designated GAM RNA, also designated SEQ ID:297.

Another function of GAM7957 is therefore inhibition of LOC51333 (Accession NP_057727.1). Accordingly, utilities of GAM7957 include diagnosis, prevention and treatment of diseases and clinical conditions associated with LOC51333.

LOC55974 (Accession NP_061333.1) is another GAM7957 target gene, herein designated TARGET GENE. LOC55974 BINDING SITE is a target binding site found in the 3' untranslated region of mRNA encoded by LOC55974, corresponding to a target binding site such as BINDING SITE I, BINDING SITE II or BINDING SITE III of FIG. 8. Table 4 illustrates the complementarity of the nucleotide sequences of LOC55974 BINDING SITE, designated SEQ ID:15223, to the nucleotide sequence of GAM7957 RNA, herein designated GAM RNA, also designated SEQ ID:297.

Another function of GAM7957 is therefore inhibition of LOC55974 (Accession NP_061333.1). Accordingly, utilities of GAM7957 include diagnosis, prevention and treatment of diseases and clinical conditions associated with LOC55974.

LOC57090 (Accession NP_065088.1) is another GAM7957 target gene, herein designated TARGET GENE. LOC57090 BINDING SITE is a target binding site found in the 3' untranslated region of mRNA encoded by LOC57090, corresponding to a target binding site such as BINDING SITE I, BINDING SITE II or BINDING SITE III of FIG. 8. Table 4 illustrates the complementarity of the nucleotide sequences of LOC57090 BINDING SITE, designated SEQ ID:18987, to the nucleotide sequence of GAM7957 RNA, herein designated GAM RNA, also designated SEQ ID:297.

Another function of GAM7957 is therefore inhibition of LOC57090 (Accession NP_065088.1). Accordingly, utilities of GAM7957 include diagnosis, prevention and treatment of diseases and clinical conditions associated with LOC57090.

LOC63929 (Accession NP_071381.1) is another GAM7957 target gene, herein designated TARGET GENE. LOC63929 BINDING SITE is a target binding site found in the 3' untranslated region of mRNA encoded by LOC63929, corresponding to a target binding site such as BINDING SITE I, BINDING SITE II or BINDING SITE III of FIG. 8. Table 4 illustrates the complementarity of the nucleotide sequences of LOC63929 BINDING SITE, designated SEQ ID:9770, to the nucleotide sequence of GAM7957 RNA, herein designated GAM RNA, also designated SEQ ID:297.

Another function of GAM7957 is therefore inhibition of LOC63929 (Accession NP_071381.1). Accordingly, utilities of GAM7957 include diagnosis, prevention and treatment of diseases and clinical conditions associated with LOC63929.

LOC64167 (Accession NP_071745.1) is another GAM7957 target gene, herein designated TARGET GENE. LOC64167 BINDING SITE is a target binding site found in the 3' untranslated region of mRNA encoded by LOC64167, corresponding to a target binding site such as BINDING SITE I, BINDING SITE II or BINDING SITE III of FIG. 8. Table 4 illustrates the complementarity of the nucleotide sequences of LOC64167 BINDING SITE, designated SEQ ID:17267, to the nucleotide sequence of GAM7957 RNA, herein designated GAM RNA, also designated SEQ ID:297.

Another function of GAM7957 is therefore inhibition of LOC64167 (Accession NP_071745.1). Accordingly, utilities of GAM7957 include diagnosis, prevention and treatment of diseases and clinical conditions associated with LOC64167.

LOC81569 (Accession XP_030465.1) is another GAM7957 target gene, herein designated TARGET GENE. LOC81569 BINDING SITE is a target binding site found in the 3' untranslated region of mRNA encoded by LOC81569, corresponding to a target binding site such as BINDING SITE I, BINDING SITE II or BINDING SITE III of FIG. 8. Table 4 illustrates the complementarity of the nucleotide sequences of LOC81569 BINDING SITE, designated SEQ ID:15437, to the nucleotide sequence of GAM7957 RNA, herein designated GAM RNA, also designated SEQ ID:297.

Another function of GAM7957 is therefore inhibition of LOC81569 (Accession XP_030465.1). Accordingly, utilities of GAM7957 include diagnosis, prevention and treatment of diseases and clinical conditions associated with LOC81569.

LOC83693 (Accession NP_113651.3) is another GAM7957 target gene, herein designated TARGET GENE. LOC83693 BINDING SITE is a target binding site found in the 3' untranslated region of mRNA encoded by LOC83693, corresponding to a target binding site such as BINDING SITE I, BINDING SITE II or BINDING SITE III of FIG. 8. Table 4 illustrates the complementarity of the nucleotide sequences of LOC83693 BINDING SITE, designated SEQ ID:17437, to the nucleotide sequence of GAM7957 RNA, herein designated GAM RNA, also designated SEQ ID:297.

Another function of GAM7957 is therefore inhibition of LOC83693 (Accession NP_113651.3). Accordingly, utilities of GAM7957 include diagnosis, prevention and treatment of diseases and clinical conditions associated with LOC83693.

LOC90120 (Accession XP_291299.1) is another GAM7957 target gene, herein designated TARGET GENE. LOC90120 BINDING SITE is a target binding site found in the 3' untranslated region of mRNA encoded by LOC90120, corresponding to a target binding site such as BINDING SITE I, BINDING SITE II or BINDING SITE III of FIG. 8. Table 4 illustrates the complementarity of the nucleotide sequences of LOC90120 BINDING SITE, designated SEQ ID:19914, to the nucleotide sequence of GAM7957 RNA, herein designated GAM RNA, also designated SEQ ID:297.

Another function of GAM7957 is therefore inhibition of LOC90120 (Accession XP_291299.1). Accordingly, utilities of GAM7957 include diagnosis, prevention and treatment of diseases and clinical conditions associated with LOC90120.

LOC90233 (Accession NP_612356.1) is another GAM7957 target gene, herein designated TARGET GENE. LOC90233 BINDING SITE is a target binding site found in the 3' untranslated region of mRNA encoded by LOC90233, corresponding to a target binding site such as BINDING SITE I, BINDING SITE II or BINDING SITE III of FIG. 8. Table 4 illustrates the complementarity of the nucleotide sequences of LOC90233 BINDING SITE, designated SEQ ID:14788, to the nucleotide sequence of GAM7957 RNA, herein designated GAM RNA, also designated SEQ ID:297.

Another function of GAM7957 is therefore inhibition of LOC90233 (Accession NP_612356.1). Accordingly, utilities of GAM7957 include diagnosis, prevention and treatment of diseases and clinical conditions associated with LOC90233.

LOC90321 (Accession XP_030896.3) is another GAM7957 target gene, herein designated TARGET GENE. LOC90321 BINDING SITE is a target binding site found in the 5' untranslated region of mRNA encoded by LOC90321, corresponding to a target binding site such as BINDING SITE I, BINDING SITE II or BINDING SITE III of FIG. 8. Table 4 illustrates the complementarity of the nucleotide sequences of LOC90321 BINDING SITE, designated SEQ ID:2487, to the nucleotide sequence of GAM7957 RNA, herein designated GAM RNA, also designated SEQ ID:297.

Another function of GAM7957 is therefore inhibition of LOC90321 (Accession XP_030896.3). Accordingly, utilities of GAM7957 include diagnosis, prevention and treatment of diseases and clinical conditions associated with LOC90321.

LOC90573 (Accession XP_032669.1) is another GAM7957 target gene, herein designated TARGET GENE. LOC90573 BINDING SITE is a target binding site found in the 3' untranslated region of mRNA encoded by LOC90573, corresponding to a target binding site such as BINDING SITE I, BINDING SITE II or BINDING SITE III of FIG. 8. Table 4 illustrates the complementarity of the nucleotide sequences of LOC90573 BINDING SITE, designated SEQ ID:17837, to the nucleotide sequence of GAM7957 RNA, herein designated GAM RNA, also designated SEQ ID:297.

Another function of GAM7957 is therefore inhibition of LOC90573 (Accession XP_032669.1). Accordingly, utilities of GAM7957 include diagnosis, prevention and treatment of diseases and clinical conditions associated with LOC90573.

LOC90784 (Accession XP_034109.1) is another GAM7957 target gene, herein designated TARGET GENE. LOC90784 BINDING SITE is a target binding site found in the 5' untranslated region of mRNA encoded by LOC90784, corresponding to a target binding site such as BINDING SITE I, BINDING SITE II or BINDING SITE III of FIG. 8. Table 4 illustrates the complementarity of the nucleotide sequences of LOC90784 BINDING SITE, designated SEQ ID:11847, to the nucleotide sequence of GAM7957 RNA, herein designated GAM RNA, also designated SEQ ID:297.

Another function of GAM7957 is therefore inhibition of LOC90784 (Accession XP_034109.1). Accordingly, utilities of GAM7957 include diagnosis, prevention and treatment of diseases and clinical conditions associated with LOC90784.

LOC90785 (Accession XP_034110.1) is another GAM7957 target gene, herein designated TARGET GENE. LOC90785 BINDING SITE1 and LOC90785 BINDING SITE2 are target binding sites found in untranslated regions of mRNA encoded by LOC90785, corresponding to target binding sites such as BINDING SITE I, BINDING SITE II or BINDING SITE III of FIG. 8. Table 4 illustrates the complementarity of the nucleotide sequences of LOC90785 BINDING SITE1 and LOC90785 BINDING SITE2, designated SEQ ID:13437 and SEQ ID:12572 respectively, to the nucleotide sequence of GAM7957 RNA, herein designated GAM RNA, also designated SEQ ID:297.

Another function of GAM7957 is therefore inhibition of LOC90785 (Accession XP_034110.1). Accordingly, utilities of GAM7957 include diagnosis, prevention and treatment of diseases and clinical conditions associated with LOC90785.

LOC90918 (Accession XP_034863.1) is another GAM7957 target gene, herein designated TARGET GENE. LOC90918 BINDING SITE is a target binding site found in the 5' untranslated region of mRNA encoded by LOC90918, corresponding to a target binding site such as BINDING SITE I, BINDING SITE II or BINDING SITE III of FIG. 8. Table 4 illustrates the complementarity of the nucleotide sequences of LOC90918 BINDING SITE, designated SEQ ID:7710, to the nucleotide sequence of GAM7957 RNA, herein designated GAM RNA, also designated SEQ ID:297.

Another function of GAM7957 is therefore inhibition of LOC90918 (Accession XP_034863.1). Accordingly, utilities of GAM7957 include diagnosis, prevention and treatment of diseases and clinical conditions associated with LOC90918.

LOC91035 (Accession XP_035622.1) is another GAM7957 target gene, herein designated TARGET GENE. LOC91035 BINDING SITE1 and LOC91035 BINDING SITE2 are target binding sites found in untranslated regions of mRNA encoded by LOC91035, corresponding to target binding sites such as BINDING SITE I, BINDING SITE II or BINDING SITE III of FIG. 8. Table 4 illustrates the complementarity of the nucleotide sequences of LOC91035 BINDING SITE1 and LOC91035 BINDING SITE2, designated SEQ ID:16454 and SEQ ID:10462 respectively, to the nucleotide sequence of GAM7957 RNA, herein designated GAM RNA, also designated SEQ ID:297.

Another function of GAM7957 is therefore inhibition of LOC91035 (Accession XP_035622.1). Accordingly, utilities of GAM7957 include diagnosis, prevention and treatment of diseases and clinical conditions associated with LOC91035.

LOC91056 (Accession NP_612377.1) is another GAM7957 target gene, herein designated TARGET GENE. LOC91056 BINDING SITE is a target binding site found in the 3' untranslated region of multiple transcripts of mRNA encoded by LOC91056, corresponding to a target binding site such as BINDING SITE I, BINDING SITE II or BINDING SITE III of FIG. 8. Table 4 illustrates the complementarity of the nucleotide sequences of LOC91056 BINDING SITE, designated SEQ ID:15158, to the nucleotide sequence of GAM7957 RNA, herein designated GAM RNA, also designated SEQ ID:297.

Another function of GAM7957 is therefore inhibition of LOC91056 (Accession NP_612377.1). Accordingly, utilities of GAM7957 include diagnosis, prevention and treatment of diseases and clinical conditions associated with LOC91056.

LOC91250 (Accession XP_037135.1) is another GAM7957 target gene, herein designated TARGET GENE. LOC91250 BINDING SITE is a target binding site found in the 5' untranslated region of mRNA encoded by LOC91250, corresponding to a target binding site such as BINDING SITE I, BINDING SITE II or BINDING SITE III of FIG. 8. Table 4 illustrates the complementarity of the nucleotide sequences of LOC91250 BINDING SITE, designated SEQ ID:5988, to the nucleotide sequence of GAM7957 RNA, herein designated GAM RNA, also designated SEQ ID:297.

Another function of GAM7957 is therefore inhibition of LOC91250 (Accession XP_037135.1). Accordingly, utilities of GAM7957 include diagnosis, prevention and treatment of diseases and clinical conditions associated with LOC91250.

LOC91319 (Accession XP_037686.2) is another GAM7957 target gene, herein designated TARGET GENE. LOC91319 BINDING SITE is a target binding site found in the 3' untranslated region of mRNA encoded by LOC91319, corresponding to a target binding site such as BINDING SITE I, BINDING SITE II or BINDING SITE III of FIG. 8. Table 4 illustrates the complementarity of the nucleotide sequences of LOC91319 BINDING SITE, designated SEQ ID:7955, to the nucleotide sequence of GAM7957 RNA, herein designated GAM RNA, also designated SEQ ID:297.

Another function of GAM7957 is therefore inhibition of LOC91319 (Accession XP_037686.2). Accordingly, utilities of GAM7957 include diagnosis, prevention and treatment of diseases and clinical conditions associated with LOC91319.

LOC91526 (Accession NP_710181.1) is another GAM7957 target gene, herein designated TARGET GENE. LOC91526 BINDING SITE is a target binding site found in the 3' untranslated region of mRNA encoded by LOC91526, corresponding to a target binding site such as BINDING SITE I, BINDING SITE II or BINDING SITE III of FIG. 8. Table 4 illustrates the complementarity of the nucleotide sequences of LOC91526 BINDING SITE, designated SEQ ID:13402, to the nucleotide sequence of GAM7957 RNA, herein designated GAM RNA, also designated SEQ ID:297.

Another function of GAM7957 is therefore inhibition of LOC91526 (Accession NP_710181.1). Accordingly, utilities of GAM7957 include diagnosis, prevention and treatment of diseases and clinical conditions associated with LOC91526.

LOC91862 (Accession NP_443090.1) is another GAM7957 target gene, herein designated TARGET GENE. LOC91862 BINDING SITE is a target binding site found in the 3' untranslated region of mRNA encoded by LOC91862, corresponding to a target binding site such as BINDING SITE I, BINDING SITE II or BINDING SITE III of FIG. 8. Table 4 illustrates the complementarity of the nucleotide sequences of LOC91862 BINDING SITE, designated SEQ ID:6686, to the nucleotide sequence of GAM7957 RNA, herein designated GAM RNA, also designated SEQ ID:297.

Another function of GAM7957 is therefore inhibition of LOC91862 (Accession NP_443090.1). Accordingly, utilities of GAM7957 include diagnosis, prevention and treatment of diseases and clinical conditions associated with LOC91862.

LOC92078 (Accession XP_042684.1) is another GAM7957 target gene, herein designated TARGET GENE. LOC92078 BINDING SITE is a target binding site found in the 3' untranslated region of mRNA encoded by LOC92078, corresponding to a target binding site such as BINDING SITE I, BINDING SITE II or BINDING SITE III of FIG. 8. Table 4 illustrates the complementarity of the nucleotide sequences of LOC92078 BINDING SITE, designated SEQ ID:15724, to the nucleotide sequence of GAM7957 RNA, herein designated GAM RNA, also designated SEQ ID:297.

Another function of GAM7957 is therefore inhibition of LOC92078 (Accession XP_042684.1). Accordingly, utilities of GAM7957 include diagnosis, prevention and treatment of diseases and clinical conditions associated with LOC92078.

LOC92228 (Accession XP_043731.1) is another GAM7957 target gene, herein designated TARGET GENE. LOC92228 BINDING SITE is a target binding site found in the 3' untranslated region of mRNA encoded by LOC92228, corresponding to a target binding site such as BINDING SITE I, BINDING SITE II or BINDING SITE III of FIG. 8. Table 4 illustrates the complementarity of the nucleotide sequences of LOC92228 BINDING SITE, designated SEQ ID:9420, to the nucleotide sequence of GAM7957 RNA, herein designated GAM RNA, also designated SEQ ID:297.

Another function of GAM7957 is therefore inhibition of LOC92228 (Accession XP_043731.1). Accordingly, utilities of GAM7957 include diagnosis, prevention and treatment of diseases and clinical conditions associated with LOC92228.

LOC92230 (Accession XP_043733.1) is another GAM7957 target gene, herein designated TARGET GENE. LOC92230 BINDING SITE is a target binding site found in the 5' untranslated region of mRNA encoded by LOC92230, corresponding to a target binding site such as BINDING SITE I, BINDING SITE II or BINDING SITE III of FIG. 8. Table 4 illustrates the complementarity of the nucleotide sequences of LOC92230 BINDING SITE, designated SEQ ID:15751, to the nucleotide sequence of GAM7957 RNA, herein designated GAM RNA, also designated SEQ ID:297.

Another function of GAM7957 is therefore inhibition of LOC92230 (Accession XP_043733.1). Accordingly, utilities of GAM7957 include diagnosis, prevention and treatment of diseases and clinical conditions associated with LOC92230.

LOC92235 (Accession XP_043739.2) is another GAM7957 target gene, herein designated TARGET GENE. LOC92235 BINDING SITE is a target binding site found in the 3' untranslated region of mRNA encoded by LOC92235, corresponding to a target binding site such as BINDING SITE I, BINDING SITE II or BINDING SITE III of FIG. 8. Table 4 illustrates the complementarity of the nucleotide sequences of LOC92235 BINDING SITE, designated SEQ ID:1042, to the nucleotide sequence of GAM7957 RNA, herein designated GAM RNA, also designated SEQ ID:297.

Another function of GAM7957 is therefore inhibition of LOC92235 (Accession XP_043739.2). Accordingly, utilities of GAM7957 include diagnosis, prevention and treatment of diseases and clinical conditions associated with LOC92235.

LOC92299 (Accession XP_044075.1) is another GAM7957 target gene, herein designated TARGET GENE. LOC92299 BINDING SITE1 and LOC92299 BINDING SITE2 are target binding sites found in untranslated regions of mRNA encoded by LOC92299, corresponding to target binding sites such as BINDING SITE I, BINDING SITE II or BINDING SITE III of FIG. 8. Table 4 illustrates the complementarity of the nucleotide sequences of LOC92299 BINDING SITE1 and LOC92299 BINDING SITE2, designated SEQ ID:8662 and SEQ ID:15089 respectively, to the nucleotide sequence of GAM7957 RNA, herein designated GAM RNA, also designated SEQ ID:297.

Another function of GAM7957 is therefore inhibition of LOC92299 (Accession XP_044075.1). Accordingly, utilities of GAM7957 include diagnosis, prevention and treatment of diseases and clinical conditions associated with LOC92299.

LOC92312 (Accession XP_044166.4) is another GAM7957 target gene, herein designated TARGET GENE. LOC92312 BINDING SITE is a target binding site found in the 3' untranslated region of mRNA encoded by LOC92312, corresponding to a target binding site such as BINDING SITE I, BINDING SITE II or BINDING SITE III of FIG. 8. Table 4 illustrates the complementarity of the nucleotide sequences of LOC92312 BINDING SITE, designated SEQ ID:15597, to the nucleotide sequence of GAM7957 RNA, herein designated GAM RNA, also designated SEQ ID:297.

Another function of GAM7957 is therefore inhibition of LOC92312 (Accession XP_044166.4). Accordingly, utilities of GAM7957 include diagnosis, prevention and treatment of diseases and clinical conditions associated with LOC92312.

LOC92360 (Accession XP_044589.1) is another GAM7957 target gene, herein designated TARGET GENE. LOC92360 BINDING SITE1 and LOC92360 BINDING SITE2 are target binding sites found in untranslated regions of mRNA encoded by LOC92360, corresponding to target binding sites such as BINDING SITE I, BINDING SITE II or BINDING SITE III of FIG. 8. Table 4 illustrates the complementarity of the nucleotide sequences of LOC92360 BINDING SITE1 and LOC92360 BINDING SITE2, designated SEQ ID:11410 and SEQ ID:722 respectively, to the nucleotide sequence of GAM7957 RNA, herein designated GAM RNA, also designated SEQ ID:297.

Another function of GAM7957 is therefore inhibition of LOC92360 (Accession XP_044589.1). Accordingly, utilities of GAM7957 include diagnosis, prevention and treatment of diseases and clinical conditions associated with LOC92360.

LOC92405 (Accession XP_044914.1) is another GAM7957 target gene, herein designated TARGET GENE. LOC92405 BINDING SITE is a target binding site found in the 3' untranslated region of mRNA encoded by LOC92405, corresponding to a target binding site such as BINDING SITE I, BINDING SITE II or BINDING SITE III of FIG. 8. Table 4 illustrates the complementarity of the nucleotide sequences of LOC92405 BINDING SITE, designated SEQ ID:12688, to the nucleotide sequence of GAM7957 RNA, herein designated GAM RNA, also designated SEQ ID:297.

Another function of GAM7957 is therefore inhibition of LOC92405 (Accession XP_044914.1). Accordingly, utilities of GAM7957 include diagnosis, prevention and treatment of diseases and clinical conditions associated with LOC92405.

LOC92482 (Accession XP_045310.1) is another GAM7957 target gene, herein designated TARGET GENE. LOC92482 BINDING SITE is a target binding site found in the 3' untranslated region of mRNA encoded by LOC92482, corresponding to a target binding site such as BINDING SITE I, BINDING SITE II or BINDING SITE III of FIG. 8. Table 4 illustrates the complementarity of the nucleotide sequences of LOC92482 BINDING SITE, designated SEQ ID:15548, to the nucleotide sequence of GAM7957 RNA, herein designated GAM RNA, also designated SEQ ID:297.

Another function of GAM7957 is therefore inhibition of LOC92482 (Accession XP_045310.1). Accordingly, utilities of GAM7957 include diagnosis, prevention and treatment of diseases and clinical conditions associated with LOC92482.

LOC92499 (Accession XP_045450.1) is another GAM7957 target gene, herein designated TARGET GENE. LOC92499 BINDING SITE1 and LOC92499 BINDING SITE2 are target binding sites found in untranslated regions of mRNA encoded by LOC92499, corresponding to target binding sites such as BINDING SITE I, BINDING SITE II or BINDING SITE III of FIG. 8. Table 4 illustrates the complementarity of the nucleotide sequences of LOC92499 BINDING SITE1 and LOC92499 BINDING SITE2, designated SEQ ID:4848 and SEQ ID:5830 respectively, to the nucleotide sequence of GAM7957 RNA, herein designated GAM RNA, also designated SEQ ID:297.

Another function of GAM7957 is therefore inhibition of LOC92499 (Accession XP_045450.1). Accordingly, utilities of GAM7957 include diagnosis, prevention and treatment of diseases and clinical conditions associated with LOC92499.

LOC92659 (Accession XP_046434.3) is another GAM7957 target gene, herein designated TARGET GENE. LOC92659 BINDING SITE is a target binding site found in the 3' untranslated region of mRNA encoded by LOC92659, corresponding to a target binding site such as BINDING SITE I, BINDING SITE II or BINDING SITE III of FIG. 8. Table 4 illustrates the complementarity of the nucleotide sequences of LOC92659 BINDING SITE, designated SEQ ID:11153, to the nucleotide sequence of GAM7957 RNA, herein designated GAM RNA, also designated SEQ ID:297.

Another function of GAM7957 is therefore inhibition of LOC92659 (Accession XP_046434.3). Accordingly, utilities of GAM7957 include diagnosis, prevention and treatment of diseases and clinical conditions associated with LOC92659.

LOC92973 (Accession XP_048529.2) is another GAM7957 target gene, herein designated TARGET GENE. LOC92973 BINDING SITE is a target binding site found in the 5' untranslated region of mRNA encoded by LOC92973, corresponding to a target binding site such as BINDING SITE I, BINDING SITE II or BINDING SITE III of FIG. 8. Table 4 illustrates the complementarity of the nucleotide sequences of LOC92973 BINDING SITE, designated SEQ ID:12985, to the nucleotide sequence of GAM7957 RNA, herein designated GAM RNA, also designated SEQ ID:297.

Another function of GAM7957 is therefore inhibition of LOC92973 (Accession XP_048529.2). Accordingly, utilities of GAM7957 include diagnosis, prevention and treatment of diseases and clinical conditions associated with LOC92973.

LOC93132 (Accession XP_049396.1) is another GAM7957 target gene, herein designated TARGET GENE. LOC93132 BINDING SITE1 and LOC93132 BINDING SITE2 are target binding sites found in untranslated regions of mRNA encoded by LOC93132, corresponding to target binding sites such as BINDING SITE I, BINDING SITE II or BINDING SITE III of FIG. 8. Table 4 illustrates the complementarity of the nucleotide sequences of LOC93132 BINDING SITE1 and LOC93132 BINDING SITE2, designated SEQ ID:10438 and SEQ ID:14699 respectively, to the nucleotide sequence of GAM7957 RNA, herein designated GAM RNA, also designated SEQ ID:297.

Another function of GAM7957 is therefore inhibition of LOC93132 (Accession XP_049396.1). Accordingly, utilities of GAM7957 include diagnosis, prevention and treatment of diseases and clinical conditions associated with LOC93132.

LOC93613 (Accession XP_052568.1) is another GAM7957 target gene, herein designated TARGET GENE. LOC93613 BINDING SITE is a target binding site found in the 3' untranslated region of mRNA encoded by LOC93613, corresponding to a target binding site such as BINDING SITE I, BINDING SITE II or BINDING SITE III of FIG. 8. Table 4 illustrates the complementarity of the nucleotide sequences of LOC93613 BINDING SITE, designated SEQ ID:19262, to the nucleotide sequence of GAM7957 RNA, herein designated GAM RNA, also designated SEQ ID:297.

Another function of GAM7957 is therefore inhibition of LOC93613 (Accession XP_052568.1). Accordingly, utilities of GAM7957 include diagnosis, prevention and treatment of diseases and clinical conditions associated with LOC93613.

LOC94431 (Accession NP_660280.1) is another GAM7957 target gene, herein designated TARGET GENE. LOC94431 BINDING SITE is a target binding site found in the 5' untranslated region of mRNA encoded by LOC94431, corresponding to a target binding site such as BINDING SITE I, BINDING SITE II or BINDING SITE III of FIG. 8. Table 4 illustrates the complementarity of the nucleotide sequences of LOC94431 BINDING SITE, designated SEQ ID:9856, to the nucleotide sequence of GAM7957 RNA, herein designated GAM RNA, also designated SEQ ID:297.

Another function of GAM7957 is therefore inhibition of LOC94431 (Accession NP_660280.1). Accordingly, utilities of GAM7957 include diagnosis, prevention and treatment of diseases and clinical conditions associated with LOC94431.

LOC96597 (Accession XP_039922.1) is another GAM7957 target gene, herein designated TARGET GENE. LOC96597 BINDING SITE is a target binding site found in the 5' untranslated region of mRNA encoded by LOC96597, corresponding to a target binding site such as BINDING SITE I, BINDING SITE II or BINDING SITE III of FIG. 8. Table 4 illustrates the complementarity of the nucleotide sequences of LOC96597 BINDING SITE, designated SEQ ID:17714, to the nucleotide sequence of GAM7957 RNA, herein designated GAM RNA, also designated SEQ ID:297.

Another function of GAM7957 is therefore inhibition of LOC96597 (Accession XP_039922.1). Accordingly, utilities of GAM7957 include diagnosis, prevention and treatment of diseases and clinical conditions associated with LOC96597.

LOST1 (Accession NP_758955.1) is another GAM7957 target gene, herein designated TARGET GENE. LOST1 BINDING SITE is a target binding site found in the 3' untranslated region of mRNA encoded by LOST1, corresponding to a target binding site such as BINDING SITE I, BINDING SITE II or BINDING SITE III of FIG. 8. Table 4 illustrates the complementarity of the nucleotide sequences of LOST1 BINDING SITE, designated SEQ ID:1927, to the nucleotide sequence of GAM7957 RNA, herein designated GAM RNA, also designated SEQ ID:297.

Another function of GAM7957 is therefore inhibition of LOST1 (Accession NP_758955.1). Accordingly, utilities of GAM7957 include diagnosis, prevention and treatment of diseases and clinical conditions associated with LOST1.

LRG (Accession NP_443204.1) is another GAM7957 target gene, herein designated TARGET GENE. LRG BINDING SITE is a target binding site found in the 3' untranslated region of mRNA encoded by LRG, corresponding to a target binding site such as BINDING SITE I, BINDING SITE II or BINDING SITE III of FIG. 8. Table 4 illustrates the complementarity of the nucleotide sequences of LRG BINDING SITE, designated SEQ ID:16201, to the nucleotide sequence of GAM7957 RNA, herein designated GAM RNA, also designated SEQ ID:297.

Another function of GAM7957 is therefore inhibition of LRG (Accession NP_443204.1). Accordingly, utilities of GAM7957 include diagnosis, prevention and treatment of diseases and clinical conditions associated with LRG.

Leucine-rich repeat-containing 2 (LRRC2, Accession NP_079026.2) is another GAM7957 target gene, herein designated TARGET GENE. LRRC2 BINDING SITE is a target binding site found in the 3' untranslated region of multiple transcripts of mRNA encoded by LRRC2, corresponding to a target binding site such as BINDING SITE I, BINDING SITE II or BINDING SITE III of FIG. 8. Table 4 illustrates the complementarity of the nucleotide sequences of LRRC2 BINDING SITE, designated SEQ ID:10418, to the nucleotide sequence of GAM7957 RNA, herein designated GAM RNA, also designated SEQ ID:297.

Another function of GAM7957 is therefore inhibition of Leucine-rich repeat-containing 2 (LRRC2, Accession NP_079026.2). Accordingly, utilities of GAM7957 include diagnosis, prevention and treatment of diseases and clinical conditions associated with LRRC2.

Leucine-rich repeat-containing 2 (LRRC2, Accession NP_078788.1) is another GAM7957 target gene, herein designated TARGET GENE. LRRC2 BINDING SITE is a target binding site found in the 3' untranslated region of multiple transcripts of mRNA encoded by LRRC2, corresponding to a target binding site such as BINDING SITE I, BINDING SITE II or BINDING SITE III of FIG. 8. Table 4 illustrates the complementarity of the nucleotide sequences of LRRC2 BINDING SITE, designated SEQ ID:10418, to the nucleotide sequence of GAM7957 RNA, herein designated GAM RNA, also designated SEQ ID:297.

Another function of GAM7957 is therefore inhibition of Leucine-rich repeat-containing 2 (LRRC2, Accession NP_078788.1). Accordingly, utilities of GAM7957 include diagnosis, prevention and treatment of diseases and clinical conditions associated with LRRC2.

Leucine rich repeat (in flii) interacting protein 1 (LRRFIP1, Accession NP_004726.1) is another GAM7957 target gene, herein designated TARGET GENE. LRRFIP1 BINDING SITE is a target binding site found in the 3' untranslated region of mRNA encoded by LRRFIP1, corresponding to a target binding site such as BINDING SITE I, BINDING SITE II or BINDING SITE III of FIG. 8. Table 4 illustrates the complementarity of the nucleotide sequences of LRRFIP1 BINDING SITE, designated SEQ ID:14509, to the nucleotide sequence of GAM7957 RNA, herein designated GAM RNA, also designated SEQ ID:297.

Another function of GAM7957 is therefore inhibition of Leucine rich repeat (in flii) interacting protein 1 (LRRFIP1, Accession NP_004726.1). Accordingly, utilities of GAM7957 include diagnosis, prevention and treatment of diseases and clinical conditions associated with LRRFIP1.

Leucine zipper protein 1 (LUZP1, Accession NP_361013.1) is another GAM7957 target gene, herein designated TARGET GENE. LUZP1 BINDING SITE is a target binding site found in the 3' untranslated region of mRNA encoded by LUZP1, corresponding to a target binding site such as BINDING SITE I, BINDING SITE II or BINDING SITE III of FIG. 8. Table 4 illustrates the complementarity of the nucleotide sequences of LUZP1 BINDING SITE, designated SEQ ID:9422, to the nucleotide sequence of GAM7957 RNA, herein designated GAM RNA, also designated SEQ ID:297.

Another function of GAM7957 is therefore inhibition of Leucine zipper protein 1 (LUZP1, Accession NP_361013.1). Accordingly, utilities of GAM7957 include diagnosis, prevention and treatment of diseases and clinical conditions associated with LUZP1.

LYNX1 (Accession NP_076435.1) is another GAM7957 target gene, herein designated TARGET GENE. LYNX1 BINDING SITE is a target binding site found in the 5' untranslated region of multiple transcripts of mRNA encoded by LYNX1, corresponding to a target binding site such as BINDING SITE I, BINDING SITE II or BINDING SITE III of FIG. 8. Table 4 illustrates the complementarity of the nucleotide sequences of LYNX1 BINDING SITE, designated SEQ ID:2417, to the nucleotide sequence of GAM7957 RNA, herein designated GAM RNA, also designated SEQ ID:297.

Another function of GAM7957 is therefore inhibition of LYNX1 (Accession NP_076435.1). Accordingly, utilities of GAM7957 include diagnosis, prevention and treatment of diseases and clinical conditions associated with LYNX1.

LYNX1 (Accession NP_803252.1) is another GAM7957 target gene, herein designated TARGET GENE. LYNX1 BINDING SITE is a target binding site found in the 5' untranslated region of multiple transcripts of mRNA encoded by LYNX1, corresponding to a target binding site such as BINDING SITE I, BINDING SITE II or BINDING SITE III of FIG. 8. Table 4 illustrates the complementarity of the nucleotide sequences of LYNX1 BINDING SITE, designated SEQ ID:2417, to the nucleotide sequence of GAM7957 RNA, herein designated GAM RNA, also designated SEQ ID:297.

Another function of GAM7957 is therefore inhibition of LYNX1 (Accession NP_803252.1). Accordingly, utilities of GAM7957 include diagnosis, prevention and treatment of diseases and clinical conditions associated with LYNX1.

LZLP (Accession NP_037476.1) is another GAM7957 target gene, herein designated TARGET GENE. LZLP BINDING SITE is a target binding site found in the 3' untranslated region of mRNA encoded by LZLP, corresponding to a target binding site such as BINDING SITE I, BINDING SITE II or BINDING SITE III of FIG. 8. Table 4 illustrates the complementarity of the nucleotide sequences of LZLP BINDING SITE, designated SEQ ID:16039, to the nucleotide sequence of GAM7957 RNA, herein designated GAM RNA, also designated SEQ ID:297.

Another function of GAM7957 is therefore inhibition of LZLP (Accession NP_037476.1). Accordingly, utilities of GAM7957 include diagnosis, prevention and treatment of diseases and clinical conditions associated with LZLP.

Leucine zipper, putative tumor suppressor 1 (LZTS1, Accession NP_066300.1) is another GAM7957 target gene, herein designated TARGET GENE. LZTS1 BINDING SITE is a target binding site found in the 3' untranslated region of mRNA encoded by LZTS1, corresponding to a target binding site such as BINDING SITE I, BINDING SITE II or BINDING SITE III of FIG. 8. Table 4 illustrates the complementarity of the nucleotide sequences of LZTS1 BINDING SITE, designated SEQ ID:8918, to the nucleotide sequence of GAM7957 RNA, herein designated GAM RNA, also designated SEQ ID:297.

Another function of GAM7957 is therefore inhibition of Leucine zipper, putative tumor suppressor 1 (LZTS1, Accession NP_066300.1), a gene which is an essential component of the nucleoskeleton. potential role in crosslinking filaments or anchoring other molecules. it is essential for growth. Accordingly, utilities of GAM7957 include diagnosis, prevention and treatment of diseases and clinical conditions associated with LZTS1.

The function of LZTS1 and its association with various diseases and clinical conditions, has been established by previous studies, as described hereinabove with reference to GAM130.1. Microtubule-actin crosslinking factor 1 (MACF1, Accession NP_149033.1) is another GAM7957 target gene, herein designated TARGET GENE. MACF1 BINDING SITE1 and MACF1 BINDING SITE2 are target binding sites found in untranslated regions of multiple transcripts of mRNA encoded by MACF1, corresponding to target binding sites such as BINDING SITE I, BINDING SITE II or BINDING SITE III of FIG. 8. Table 4 illustrates the complementarity of the nucleotide sequences of MACF1 BINDING SITE1 and MACF1 BINDING SITE2, designated SEQ ID:11920 and SEQ ID:1172 respectively, to the nucleotide sequence of GAM7957 RNA, herein designated GAM RNA, also designated SEQ ID:297.

Another function of GAM7957 is therefore inhibition of Microtubule-actin crosslinking factor 1 (MACF1, Accession NP_149033.1). Accordingly, utilities of GAM7957 include diagnosis, prevention and treatment of diseases and clinical conditions associated with MACF1.

V-maf musculoaponeurotic fibrosarcoma oncogene homolog f (avian) (MAFF, Accession NP_036455.1) is another GAM7957 target gene, herein designated TARGET GENE. MAFF BINDING SITE is a target binding site found in the 3' untranslated region of multiple transcripts of mRNA encoded by MAFF, corresponding to a target binding site such as BINDING SITE I, BINDING SITE II or BINDING SITE III of FIG. 8. Table 4 illustrates the complementarity of the nucleotide sequences of MAFF BINDING SITE, designated SEQ ID:5558, to the nucleotide sequence of GAM7957 RNA, herein designated GAM RNA, also designated SEQ ID:297.

Another function of GAM7957 is therefore inhibition of V-maf musculoaponeurotic fibrosarcoma oncogene homolog f (avian) (MAFF, Accession NP_036455.1), a gene which Binds to the US-2 motif of the oxytocin receptor gene; has a leucine zipper structure. Accordingly, utilities of GAM7957 include diagnosis, prevention and treatment of diseases and clinical conditions associated with MAFF.

The function of MAFF and its association with various diseases and clinical conditions, has been established by previous studies, as described hereinabove with reference to GAM200.1. V-maf musculoaponeurotic fibrosarcoma oncogene homolog f (avian) (MAFF, Accession NP_690617.1) is another GAM7957 target gene, herein designated TARGET GENE. MAFF BINDING SITE is a target binding site found in the 3' untranslated region of multiple transcripts of mRNA encoded by MAFF, corresponding to a target binding site such as BINDING SITE I, BINDING SITE II or BINDING SITE III of FIG. 8. Table 4 illustrates the complementarity of the nucleotide sequences of MAFF BINDING SITE, designated SEQ ID:5558, to the nucleotide sequence of GAM7957 RNA, herein designated GAM RNA, also designated SEQ ID:297.

Another function of GAM7957 is therefore inhibition of V-maf musculoaponeurotic fibrosarcoma oncogene homolog f (avian) (MAFF, Accession NP_690617.1), a gene which Binds to the US-2 motif of the oxytocin receptor gene; has a leucine zipper structure. Accordingly, utilities of GAM7957 include diagnosis, prevention and treatment of diseases and clinical conditions associated with MAFF.

The function of MAFF and its association with various diseases and clinical conditions, has been established by previous studies, as described hereinabove with reference to GAM200.1. Mal, t-cell differentiation protein 2 (MAL2, Accession NP_443118.1) is another GAM7957 target gene, herein designated TARGET GENE. MAL2 BINDING SITE is a target binding site found in the 5' untranslated region of mRNA encoded by MAL2, corresponding to a target binding site such as BINDING SITE I, BINDING SITE II or BINDING SITE III of FIG. 8. Table 4 illustrates the complementarity of the nucleotide sequences of MAL2 BINDING SITE, designated SEQ ID:6717, to the nucleotide sequence of GAM7957 RNA, herein designated GAM RNA, also designated SEQ ID:297.

Another function of GAM7957 is therefore inhibition of Mal, t-cell differentiation protein 2 (MAL2, Accession NP_443118.1). Accordingly, utilities of GAM7957 include diagnosis, prevention and treatment of diseases and clinical conditions associated with MAL2.

Mitogen-activated protein kinase kinase 7 (MAP2K7, Accession NP_663302.1) is another GAM7957 target gene, herein designated TARGET GENE. MAP2K7 BINDING SITE1 and MAP2K7 BINDING SITE2 are target binding sites found in untranslated regions of multiple transcripts of mRNA encoded by MAP2K7, corresponding to target binding sites such as BINDING SITE I, BINDING SITE II or BINDING SITE III of FIG. 8. Table 4 illustrates the complementarity of the nucleotide sequences of MAP2K7 BINDING SITE1 and MAP2K7 BINDING SITE2, designated SEQ ID:19795 and SEQ ID:8514 respectively, to the nucleotide sequence of GAM7957 RNA, herein designated GAM RNA, also designated SEQ ID:297.

Another function of GAM7957 is therefore inhibition of Mitogen-activated protein kinase kinase 7 (MAP2K7, Accession NP_663302.1). Accordingly, utilities of GAM7957 include diagnosis, prevention and treatment of diseases and clinical conditions associated with MAP2K7.

Mitogen-activated protein kinase kinase kinase 9 (MAP3K9, Accession XP_027237.1) is another GAM7957 target gene, herein designated TARGET GENE. MAP3K9 BINDING SITE1 through MAP3K9 BINDING SITE3 are target binding sites found in untranslated regions of mRNA encoded by MAP3K9, corresponding to target binding sites such as BINDING SITE I, BINDING SITE II or BINDING SITE III of FIG. 8. Table 4 illustrates the complementarity of the nucleotide sequences of MAP3K9 BINDING SITE1 through MAP3K9 BINDING SITE3, designated SEQ ID:14786, SEQ ID:17642 and SEQ ID:9732 respectively, to the nucleotide sequence of GAM7957 RNA, herein designated GAM RNA, also designated SEQ ID:297.

Another function of GAM7957 is therefore inhibition of Mitogen-activated protein kinase kinase kinase 9 (MAP3K9, Accession XP_027237.1), a gene which is a MIXED-LINEAGE KINASE 1. Accordingly, utilities of GAM7957 include diagnosis, prevention and treatment of diseases and clinical conditions associated with MAP3K9.

The function of MAP3K9 and its association with various diseases and clinical conditions, has been established by previous studies, as described hereinabove with reference to GAM347.1. Microtubule-associated protein 4 (MAP4, Accession NP_112146.1) is another GAM7957 target gene, herein designated TARGET GENE. MAP4 BINDING SITE is a target binding site found in the 5' untranslated region of multiple transcripts of mRNA encoded by MAP4, corresponding to a target binding site such as BINDING SITE I, BINDING SITE II or BINDING SITE III of FIG. 8. Table 4 illustrates the complementarity of the nucleotide sequences of MAP4 BINDING SITE, designated SEQ ID:16329, to the nucleotide sequence of GAM7957 RNA, herein designated GAM RNA, also designated SEQ ID:297.

Another function of GAM7957 is therefore inhibition of Microtubule-associated protein 4 (MAP4, Accession NP_112146.1), a gene which is a MICROTUBULE-ASSOCIATED PROTEIN. Accordingly, utilities of GAM7957 include diagnosis, prevention and treatment of diseases and clinical conditions associated with MAP4.

The function of MAP4 and its association with various diseases and clinical conditions, has been established by previous studies, as described hereinabove with reference to GAM401.1. Microtubule-associated protein 4 (MAP4, Accession NP_112245.1) is another GAM7957 target gene, herein designated TARGET GENE. MAP4 BINDING SITE is a target binding site found in the 5' untranslated region of multiple transcripts of mRNA encoded by MAP4, corresponding to a target binding site such as BINDING SITE I, BINDING SITE II or BINDING SITE III of FIG. 8. Table 4 illustrates the complementarity of the nucleotide sequences of MAP4 BINDING SITE, designated SEQ ID:16329, to the nucleotide sequence of GAM7957 RNA, herein designated GAM RNA, also designated SEQ ID:297.

Another function of GAM7957 is therefore inhibition of Microtubule-associated protein 4 (MAP4, Accession NP_112245.1), a gene which is a MICROTUBULE-ASSOCIATED PROTEIN. Accordingly, utilities of GAM7957 include diagnosis, prevention and treatment of diseases and clinical conditions associated with MAP4.

The function of MAP4 and its association with various diseases and clinical conditions, has been established by previous studies, as described hereinabove with reference to GAM401.1. Microtubule-associated protein 4 (MAP4, Accession NP_002366.1) is another GAM7957 target gene, herein designated TARGET GENE. MAP4 BINDING SITE is a target binding site found in the 5' untranslated region of multiple transcripts of mRNA encoded by MAP4, corresponding to a target binding site such as BINDING SITE I, BINDING SITE II or BINDING SITE III of FIG. 8. Table 4 illustrates the complementarity of the nucleotide sequences of MAP4 BINDING SITE, designated SEQ ID:16329, to the nucleotide sequence of GAM7957 RNA, herein designated GAM RNA, also designated SEQ ID:297.

Another function of GAM7957 is therefore inhibition of Microtubule-associated protein 4 (MAP4, Accession NP_002366.1), a gene which is a MICROTUBULE-ASSOCIATED PROTEIN. Accordingly, utilities of GAM7957 include diagnosis, prevention and treatment of diseases and clinical conditions associated with MAP4.

The function of MAP4 and its association with various diseases and clinical conditions, has been established by previous studies, as described hereinabove with reference to GAM401.1. Microtubule-associated protein 4 (MAP4, Accession NP_112147.1) is another GAM7957 target gene, herein designated TARGET GENE. MAP4 BINDING SITE is a target binding site found in the 5' untranslated region of multiple transcripts of mRNA encoded by MAP4, corresponding to a target binding site such as BINDING SITE I, BINDING SITE II or BINDING SITE III of FIG. 8. Table 4 illustrates the complementarity of the nucleotide sequences of MAP4 BINDING SITE, designated SEQ ID:16329, to the nucleotide sequence of GAM7957 RNA, herein designated GAM RNA, also designated SEQ ID:297.

Another function of GAM7957 is therefore inhibition of Microtubule-associated protein 4 (MAP4, Accession NP_112147.1), a gene which is a MICROTUBULE-ASSOCIATED PROTEIN. Accordingly, utilities of GAM7957 include diagnosis, prevention and treatment of diseases and clinical conditions associated with MAP4.

The function of MAP4 and its association with various diseases and clinical conditions, has been established by previous studies, as described hereinabove with reference to GAM401.1. Mitogen-activated protein kinase 8 interacting protein 3 (MAPK8IP3, Accession NP_203750.1) is another GAM7957 target gene, herein designated TARGET GENE. MAPK8IP3 BINDING SITE is a target binding site found in the 3' untranslated region of multiple transcripts of mRNA encoded by MAPK8IP3, corresponding to a target binding site such as BINDING SITE I, BINDING SITE II or BINDING SITE III of FIG. 8. Table 4 illustrates the complementarity of the nucleotide sequences of MAPK8IP3 BINDING SITE, designated SEQ ID:6843, to the nucleotide sequence of GAM7957 RNA, herein designated GAM RNA, also designated SEQ ID:297.

Another function of GAM7957 is therefore inhibition of Mitogen-activated protein kinase 8 interacting protein 3 (MAPK8IP3, Accession NP_203750.1). Accordingly, utilities of GAM7957 include diagnosis, prevention and treatment of diseases and clinical conditions associated with MAPK8IP3.

MAPKBP1 (Accession XP_031706.7) is another GAM7957 target gene, herein designated TARGET GENE. MAPKBP1 BINDING SITE is a target binding site found in the 3' untranslated region of mRNA encoded by MAPKBP1, corresponding to a target binding site such as BINDING SITE I, BINDING SITE II or BINDING SITE III of FIG. 8. Table 4 illustrates the complementarity of the nucleotide sequences of MAPKBP1 BINDING SITE, designated SEQ ID:8123, to the nucleotide sequence of GAM7957 RNA, herein designated GAM RNA, also designated SEQ ID:297.

Another function of GAM7957 is therefore inhibition of MAPKBP1 (Accession XP_031706.7). Accordingly, utilities of GAM7957 include diagnosis, prevention and treatment of diseases and clinical conditions associated with MAPKBP1.

MAWBP (Accession NP_071412.1) is another GAM7957 target gene, herein designated TARGET GENE. MAWBP BINDING SITE is a target binding site found in the 3' untranslated region of mRNA encoded by MAWBP, corresponding to a target binding site such as BINDING SITE I, BINDING SITE II or BINDING SITE III of FIG. 8. Table 4 illustrates the complementarity of the nucleotide sequences of MAWBP BINDING SITE, designated SEQ ID:14181, to the nucleotide sequence of GAM7957 RNA, herein designated GAM RNA, also designated SEQ ID:297.

Another function of GAM7957 is therefore inhibition of MAWBP (Accession NP_071412.1). Accordingly, utilities of GAM7957 include diagnosis, prevention and treatment of diseases and clinical conditions associated with MAWBP.

MBTD1 (Accession NP_060113.1) is another GAM7957 target gene, herein designated TARGET GENE. MBTD1 BINDING SITE is a target binding site found in the 3' untranslated region of mRNA encoded by MBTD1, corresponding to a target binding site such as BINDING SITE I, BINDING SITE II or BINDING SITE III of FIG. 8. Table 4 illustrates the complementarity of the nucleotide sequences of MBTD1 BINDING SITE, designated SEQ ID:2975, to the nucleotide sequence of GAM7957 RNA, herein designated GAM RNA, also designated SEQ ID:297.

Another function of GAM7957 is therefore inhibition of MBTD1 (Accession NP_060113.1). Accordingly, utilities of GAM7957 include diagnosis, prevention and treatment of diseases and clinical conditions associated with MBTD1.

Melanoma cell adhesion molecule (MCAM, Accession NP_006491.1) is another GAM7957 target gene, herein designated TARGET GENE. MCAM BINDING SITE is a target binding site found in the 3' untranslated region of mRNA encoded by MCAM, corresponding to a target binding site such as BINDING SITE I, BINDING SITE II or BINDING SITE III of FIG. 8. Table 4 illustrates the complementarity of the nucleotide sequences of MCAM BINDING SITE, designated SEQ ID:3363, to the nucleotide sequence of GAM7957 RNA, herein designated GAM RNA, also designated SEQ ID:297.

Another function of GAM7957 is therefore inhibition of Melanoma cell adhesion molecule (MCAM, Accession NP_006491.1). Accordingly, utilities of GAM7957 include diagnosis, prevention and treatment of diseases and clinical conditions associated with MCAM.

Mcm4 minichromosome maintenance deficient 4 (s. cerevisiae) (MCM4, Accession XP_030274.1) is another GAM7957 target gene, herein designated TARGET GENE. MCM4 BINDING SITE is a target binding site found in the 3' untranslated region of mRNA encoded by MCM4, corresponding to a target binding site such as BINDING SITE I, BINDING SITE II or BINDING SITE III of FIG. 8. Table 4 illustrates the complementarity of the nucleotide sequences of MCM4 BINDING SITE, designated SEQ ID:8108, to the nucleotide sequence of GAM7957 RNA, herein designated GAM RNA, also designated SEQ ID:297.

Another function of GAM7957 is therefore inhibition of Mcm4 minichromosome maintenance deficient 4 (s. cerevisiae) (MCM4, Accession XP_030274.1), a gene which involved in the control of dna replication. Accordingly, utilities of GAM7957 include diagnosis, prevention and treatment of diseases and clinical conditions associated with MCM4.

The function of MCM4 and its association with various diseases and clinical conditions, has been established by previous studies, as described hereinabove with reference to GAM347.1. Methyl cpg binding protein 2 (rett syndrome) (MECP2, Accession NP_004983.1) is another GAM7957 target gene, herein designated TARGET GENE. MECP2 BINDING SITE is a target binding site found in the 3' untranslated region of mRNA encoded by MECP2, corresponding to a target binding site such as BINDING SITE I, BINDING SITE II or BINDING SITE III of FIG. 8. Table 4 illustrates the complementarity of the nucleotide sequences of MECP2 BINDING SITE, designated SEQ ID:3575, to the nucleotide sequence of GAM7957 RNA, herein designated GAM RNA, also designated SEQ ID:297.

Another function of GAM7957 is therefore inhibition of Methyl cpg binding protein 2 (rett syndrome) (MECP2, Accession NP_004983.1). Accordingly, utilities of GAM7957 include diagnosis, prevention and treatment of diseases and clinical conditions associated with MECP2.

MEGF10 (Accession NP_115822.1) is another GAM7957 target gene, herein designated TARGET GENE. MEGF10 BINDING SITE is a target binding site found in the 3' untranslated region of mRNA encoded by MEGF10, corresponding to a target binding site such as BINDING SITE I, BINDING SITE II or BINDING SITE III of FIG. 8. Table 4 illustrates the complementarity of the nucleotide sequences of MEGF10 BINDING SITE, designated SEQ ID:11788, to the nucleotide sequence of GAM7957 RNA, herein designated GAM RNA, also designated SEQ ID:297.

Another function of GAM7957 is therefore inhibition of MEGF10 (Accession NP_115822.1). Accordingly, utilities of GAM7957 include diagnosis, prevention and treatment of diseases and clinical conditions associated with MEGF10.

MEGF11 (Accession NP_115821.1) is another GAM7957 target gene, herein designated TARGET GENE. MEGF11 BINDING SITE is a target binding site found in the 3' untranslated region of mRNA encoded by MEGF11, corresponding to a target binding site such as BINDING SITE I, BINDING SITE II or BINDING SITE III of FIG. 8. Table 4 illustrates the complementarity of the nucleotide sequences of MEGF11 BINDING SITE, designated SEQ ID:5685, to the nucleotide sequence of GAM7957 RNA, herein designated GAM RNA, also designated SEQ ID:297.

Another function of GAM7957 is therefore inhibition of MEGF11 (Accession NP_115821.1). Accordingly, utilities of GAM7957 include diagnosis, prevention and treatment of diseases and clinical conditions associated with MEGF11.

Multiple endocrine neoplasia i (MEN1, Accession NP_570715.1) is another GAM7957 target gene, herein designated TARGET GENE. MEN1 BINDING SITE is a target binding site found in the 5' untranslated region of multiple transcripts of mRNA encoded by MEN1, corresponding to a target binding site such as BINDING SITE I, BINDING SITE II or BINDING SITE III of FIG. 8. Table 4 illustrates the complementarity of the nucleotide sequences of MEN1 BINDING SITE, designated SEQ ID:7241, to the nucleotide sequence of GAM7957 RNA, herein designated GAM RNA, also designated SEQ ID:297.

Another function of GAM7957 is therefore inhibition of Multiple endocrine neoplasia i (MEN1, Accession NP_570715.1). Accordingly, utilities of GAM7957 include diagnosis, prevention and treatment of diseases and clinical conditions associated with MEN1.

Multiple endocrine neoplasia i (MEN1, Accession NP_570716.1) is another GAM7957 target gene, herein designated TARGET GENE. MEN1 BINDING SITE is a target binding site found in the 5' untranslated region of multiple transcripts of mRNA encoded by MEN1, corresponding to a target binding site such as BINDING SITE I, BINDING SITE II or BINDING SITE III of FIG. 8. Table 4 illustrates the complementarity of the nucleotide sequences of MEN1 BINDING SITE, designated SEQ ID:7241, to the nucleotide sequence of GAM7957 RNA, herein designated GAM RNA, also designated SEQ ID:297.

Another function of GAM7957 is therefore inhibition of Multiple endocrine neoplasia i (MEN1, Accession NP_570716.1). Accordingly, utilities of GAM7957 include diagnosis, prevention and treatment of diseases and clinical conditions associated with MEN1.

MGC10200 (Accession NP_659497.1) is another GAM7957 target gene, herein designated TARGET GENE. MGC10200 BINDING SITE is a target binding site found in the 3' untranslated region of mRNA encoded by MGC10200, corresponding to a target binding site such as BINDING SITE I, BINDING SITE II or BINDING SITE III of FIG. 8. Table 4 illustrates the complementarity of the nucleotide sequences of MGC10200 BINDING SITE, designated SEQ ID:17423, to the nucleotide sequence of GAM7957 RNA, herein designated GAM RNA, also designated SEQ ID:297.

Another function of GAM7957 is therefore inhibition of MGC10200 (Accession NP_659497.1). Accordingly, utilities of GAM7957 include diagnosis, prevention and treatment of diseases and clinical conditions associated with MGC10200.

MGC10765 (Accession NP_077321.1) is another GAM7957 target gene, herein designated TARGET GENE. MGC10765 BINDING SITE is a target binding site found in the 3' untranslated region of mRNA encoded by MGC10765, corresponding to a target binding site such as BINDING SITE I, BINDING SITE II or BINDING SITE III of FIG. 8. Table 4 illustrates the complementarity of the nucleotide sequences of MGC10765 BINDING SITE, designated SEQ ID:7629, to the nucleotide sequence of GAM7957 RNA, herein designated GAM RNA, also designated SEQ ID:297.

Another function of GAM7957 is therefore inhibition of MGC10765 (Accession NP_077321.1). Accordingly, utilities of GAM7957 include diagnosis, prevention and treatment of diseases and clinical conditions associated with MGC10765.

MGC10771 (Accession NP_078782.2) is another GAM7957 target gene, herein designated TARGET GENE. MGC10771 BINDING SITE is a target binding site found in the 3' untranslated region of mRNA encoded by MGC10771, corresponding to a target binding site such as BINDING SITE I, BINDING SITE II or BINDING SITE III of FIG. 8. Table 4 illustrates the complementarity of the nucleotide sequences of MGC10771 BINDING SITE, designated SEQ ID:19103, to the nucleotide sequence of GAM7957 RNA, herein designated GAM RNA, also designated SEQ ID:297.

Another function of GAM7957 is therefore inhibition of MGC10771 (Accession NP_078782.2). Accordingly, utilities of GAM7957 include diagnosis, prevention and treatment of diseases and clinical conditions associated with MGC10771.

MGC10814 (Accession NP_116060.1) is another GAM7957 target gene, herein designated TARGET GENE. MGC10814 BINDING SITE1 and MGC10814 BINDING SITE2 are target binding sites found in untranslated regions of mRNA encoded by MGC10814, corresponding to target binding sites such as BINDING SITE I, BINDING SITE II or BINDING SITE III of FIG. 8. Table 4 illustrates the complementarity of the nucleotide sequences of MGC10814 BINDING SITE1 and MGC10814 BINDING SITE2, designated SEQ ID:15216 and SEQ ID:14900 respectively, to the nucleotide sequence of GAM7957 RNA, herein designated GAM RNA, also designated SEQ ID:297.

Another function of GAM7957 is therefore inhibition of MGC10814 (Accession NP_116060.1). Accordingly, utilities of GAM7957 include diagnosis, prevention and treatment of diseases and clinical conditions associated with MGC10814.

MGC10997 (Accession NP_116044.1) is another GAM7957 target gene, herein designated TARGET GENE. MGC10997 BINDING SITE is a target binding site found in the 5' untranslated region of mRNA encoded by MGC10997, corresponding to a target binding site such as BINDING SITE I, BINDING SITE II or BINDING SITE III of FIG. 8. Table 4 illustrates the complementarity of the nucleotide sequences of MGC10997 BINDING SITE, designated SEQ ID:10844, to the nucleotide sequence of GAM7957 RNA, herein designated GAM RNA, also designated SEQ ID:297.

Another function of GAM7957 is therefore inhibition of MGC10997 (Accession NP_116044.1). Accordingly, utilities of GAM7957 include diagnosis, prevention and treatment of diseases and clinical conditions associated with MGC10997.

MGC10999 (Accession NP_115683.2) is another GAM7957 target gene, herein designated TARGET GENE. MGC10999 BINDING SITE is a target binding site found in the 3' untranslated region of mRNA encoded by MGC10999, corresponding to a target binding site such as BINDING SITE I, BINDING SITE II or BINDING SITE III of FIG. 8. Table 4 illustrates the complementarity of the nucleotide sequences of MGC10999 BINDING SITE, designated SEQ ID:11306, to the nucleotide sequence of GAM7957 RNA, herein designated GAM RNA, also designated SEQ ID:297.

Another function of GAM7957 is therefore inhibition of MGC10999 (Accession NP_115683.2). Accordingly, utilities of GAM7957 include diagnosis, prevention and treatment of diseases and clinical conditions associated with MGC10999.

MGC1136 (Accession NP_076930.1) is another GAM7957 target gene, herein designated TARGET GENE. MGC1136 BINDING SITE is a target binding site found in the 3' untranslated region of mRNA encoded by MGC1136, corresponding to a target binding site such as BINDING SITE I, BINDING SITE II or BINDING SITE III of FIG. 8. Table 4 illustrates the complementarity of the nucleotide sequences of MGC1136 BINDING SITE, designated SEQ ID:15748, to the nucleotide sequence of GAM7957 RNA, herein designated GAM RNA, also designated SEQ ID:297.

Another function of GAM7957 is therefore inhibition of MGC1136 (Accession NP_076930.1). Accordingly, utilities of GAM7957 include diagnosis, prevention and treatment of diseases and clinical conditions associated with MGC1136.

MGC11386 (Accession NP_116322.1) is another GAM7957 target gene, herein designated TARGET GENE. MGC11386 BINDING SITE is a target binding site found in the 3' untranslated region of mRNA encoded by MGC11386, corresponding to a target binding site such as BINDING SITE I, BINDING SITE II or BINDING SITE III of FIG. 8. Table 4 illustrates the complementarity of the nucleotide sequences of MGC11386 BINDING SITE, designated SEQ ID:14786, to the nucleotide sequence of GAM7957 RNA, herein designated GAM RNA, also designated SEQ ID:297.

Another function of GAM7957 is therefore inhibition of MGC11386 (Accession NP_116322.1). Accordingly, utilities of GAM7957 include diagnosis, prevention and treatment of diseases and clinical conditions associated with MGC11386.

MGC12945 (Accession NP_115694.1) is another GAM7957 target gene, herein designated TARGET GENE. MGC12945 BINDING SITE is a target binding site found in the 3' untranslated region of mRNA encoded by MGC12945, corresponding to a target binding site such as BINDING SITE I, BINDING SITE II or BINDING SITE III of FIG. 8. Table 4 illustrates the complementarity of the nucleotide sequences of MGC12945 BINDING SITE, designated SEQ ID:11532, to the nucleotide sequence of GAM7957 RNA, herein designated GAM RNA, also designated SEQ ID:297.

Another function of GAM7957 is therefore inhibition of MGC12945 (Accession NP_115694.1). Accordingly, utilities of GAM7957 include diagnosis, prevention and treatment of diseases and clinical conditions associated with MGC12945.

MGC13024 (Accession NP_689501.1) is another GAM7957 target gene, herein designated TARGET GENE. MGC13024 BINDING SITE is a target binding site found in the 3' untranslated region of mRNA encoded by MGC13024, corresponding to a target binding site such as BINDING SITE I, BINDING SITE II or BINDING SITE III of FIG. 8. Table 4 illustrates the complementarity of the nucleotide sequences of MGC13024 BINDING SITE, designated SEQ ID:804, to the nucleotide sequence of GAM7957 RNA, herein designated GAM RNA, also designated SEQ ID:297.

Another function of GAM7957 is therefore inhibition of MGC13024 (Accession NP_689501.1). Accordingly, utilities of GAM7957 include diagnosis, prevention and treatment of diseases and clinical conditions associated with MGC13024.

MGC13053 (Accession NP_116099.1) is another GAM7957 target gene, herein designated TARGET GENE. MGC13053 BINDING SITE1 and MGC13053 BINDING SITE2 are target binding sites found in untranslated regions of mRNA encoded by MGC13053, corresponding to target binding sites such as BINDING SITE I, BINDING SITE II or BINDING SITE III of FIG. 8. Table 4 illustrates the complementarity of the nucleotide sequences of MGC13053 BINDING SITE1 and MGC13053 BINDING SITE2, designated SEQ ID:8676 and SEQ ID:10475 respectively, to the nucleotide sequence of GAM7957 RNA, herein designated GAM RNA, also designated SEQ ID:297.

Another function of GAM7957 is therefore inhibition of MGC13053 (Accession NP_116099.1). Accordingly, utilities of GAM7957 include diagnosis, prevention and treatment of diseases and clinical conditions associated with MGC13053.

MGC13272 (Accession NP_115731.1) is another GAM7957 target gene, herein designated TARGET GENE. MGC13272 BINDING SITE is a target binding site found in the 5' untranslated region of mRNA encoded by MGC13272, corresponding to a target binding site such as BINDING SITE I, BINDING SITE II or BINDING SITE III of FIG. 8. Table 4 illustrates the complementarity of the nucleotide sequences of MGC13272 BINDING SITE, designated SEQ ID:2998, to the nucleotide sequence of GAM7957 RNA, herein designated GAM RNA, also designated SEQ ID:297.

Another function of GAM7957 is therefore inhibition of MGC13272 (Accession NP_115731.1). Accordingly, utilities of GAM7957 include diagnosis, prevention and treatment of diseases and clinical conditions associated with MGC13272.

MGC14126 (Accession NP_116287.1) is another GAM7957 target gene, herein designated TARGET GENE. MGC14126 BINDING SITE is a target binding site found in the 3' untranslated region of mRNA encoded by MGC14126, corresponding to a target binding site such as BINDING SITE I, BINDING SITE II or BINDING SITE III of FIG. 8. Table 4 illustrates the complementarity of the nucleotide sequences of MGC14126 BINDING SITE, designated SEQ ID:12370, to the nucleotide sequence of GAM7957 RNA, herein designated GAM RNA, also designated SEQ ID:297.

Another function of GAM7957 is therefore inhibition of MGC14126 (Accession NP_116287.1). Accordingly, utilities of GAM7957 include diagnosis, prevention and treatment of diseases and clinical conditions associated with MGC14126.

MGC14276 (Accession NP_694980.1) is another GAM7957 target gene, herein designated TARGET GENE. MGC14276 BINDING SITE is a target binding site found in the 3' untranslated region of mRNA encoded by MGC14276, corresponding to a target binding site such as BINDING SITE I, BINDING SITE II or BINDING SITE III of FIG. 8. Table 4 illustrates the complementarity of the nucleotide sequences of MGC14276 BINDING SITE, designated SEQ ID:12189, to the nucleotide sequence of GAM7957 RNA, herein designated GAM RNA, also designated SEQ ID:297.

Another function of GAM7957 is therefore inhibition of MGC14276 (Accession NP_694980.1). Accordingly, utilities of GAM7957 include diagnosis, prevention and treatment of diseases and clinical conditions associated with MGC14276.

MGC14407 (Accession NP_116297.1) is another GAM7957 target gene, herein designated TARGET GENE. MGC14407 BINDING SITE1 and MGC14407 BINDING SITE2 are target binding sites found in untranslated regions of mRNA encoded by MGC14407, corresponding to target binding sites such as BINDING SITE I, BINDING SITE II or BINDING SITE III of FIG. 8. Table 4 illustrates the complementarity of the nucleotide sequences of MGC14407 BIND- ING SITE1 and MGC14407 BINDING SITE2, designated SEQ ID:4378 and SEQ ID:10435 respectively, to the nucleotide sequence of GAM7957 RNA, herein designated GAM RNA, also designated SEQ ID:297.

Another function of GAM7957 is therefore inhibition of MGC14407 (Accession NP_116297.1). Accordingly, utilities of GAM7957 include diagnosis, prevention and treatment of diseases and clinical conditions associated with MGC14407.

MGC14436 (Accession NP_116286.1) is another GAM7957 target gene, herein designated TARGET GENE. MGC14436 BINDING SITE is a target binding site found in the 3' untranslated region of mRNA encoded by MGC14436, corresponding to a target binding site such as BINDING SITE I, BINDING SITE II or BINDING SITE III of FIG. 8. Table 4 illustrates the complementarity of the nucleotide sequences of MGC14436 BINDING SITE, designated SEQ ID:18050, to the nucleotide sequence of GAM7957 RNA, herein designated GAM RNA, also designated SEQ ID:297.

Another function of GAM7957 is therefore inhibition of MGC14436 (Accession NP_116286.1). Accordingly, utilities of GAM7957 include diagnosis, prevention and treatment of diseases and clinical conditions associated with MGC14436.

MGC14799 (Accession NP_115712.1) is another GAM7957 target gene, herein designated TARGET GENE. MGC14799 BINDING SITE is a target binding site found in the 3' untranslated region of mRNA encoded by MGC14799, corresponding to a target binding site such as BINDING SITE I, BINDING SITE II or BINDING SITE III of FIG. 8. Table 4 illustrates the complementarity of the nucleotide sequences of MGC14799 BINDING SITE, designated SEQ ID:6876, to the nucleotide sequence of GAM7957 RNA, herein designated GAM RNA, also designated SEQ ID:297.

Another function of GAM7957 is therefore inhibition of MGC14799 (Accession NP_115712.1). Accordingly, utilities of GAM7957 include diagnosis, prevention and treatment of diseases and clinical conditions associated with MGC14799.

MGC14817 (Accession NP_115714.1) is another GAM7957 target gene, herein designated TARGET GENE. MGC14817 BINDING SITE1 and MGC14817 BINDING SITE2 are target binding sites found in untranslated regions of mRNA encoded by MGC14817, corresponding to target binding sites such as BINDING SITE I, BINDING SITE II or BINDING SITE III of FIG. 8. Table 4 illustrates the complementarity of the nucleotide sequences of MGC14817 BINDING SITE1 and MGC14817 BINDING SITE2, designated SEQ ID:6787 and SEQ ID:13584 respectively, to the nucleotide sequence of GAM7957 RNA, herein designated GAM RNA, also designated SEQ ID:297.

Another function of GAM7957 is therefore inhibition of MGC14817 (Accession NP_115714.1). Accordingly, utilities of GAM7957 include diagnosis, prevention and treatment of diseases and clinical conditions associated with MGC14817.

MGC14836 (Accession NP_219480.1) is another GAM7957 target gene, herein designated TARGET GENE. MGC14836 BINDING SITE is a target binding site found in the 3' untranslated region of mRNA encoded by MGC14836, corresponding to a target binding site such as BINDING SITE I, BINDING SITE II or BINDING SITE III of FIG. 8. Table 4 illustrates the complementarity of the nucleotide sequences of MGC14836 BINDING SITE, designated SEQ ID:17854, to the nucleotide sequence of GAM7957 RNA, herein designated GAM RNA, also designated SEQ ID:297.

Another function of GAM7957 is therefore inhibition of MGC14836 (Accession NP_219480.1). Accordingly, utilities of GAM7957 include diagnosis, prevention and treatment of diseases and clinical conditions associated with MGC14836.

MGC15397 (Accession NP_542383.1) is another GAM7957 target gene, herein designated TARGET GENE. MGC15397 BINDING SITE is a target binding site found in the 3' untranslated region of mRNA encoded by MGC15397, corresponding to a target binding site such as BINDING SITE I, BINDING SITE II or BINDING SITE III of FIG. 8. Table 4 illustrates the complementarity of the nucleotide sequences of MGC15397 BINDING SITE, designated SEQ ID:15089, to the nucleotide sequence of GAM7957 RNA, herein designated GAM RNA, also designated SEQ ID:297.

Another function of GAM7957 is therefore inhibition of MGC15397 (Accession NP_542383.1). Accordingly, utilities of GAM7957 include diagnosis, prevention and treatment of diseases and clinical conditions associated with MGC15397.

MGC16037 (Accession NP_116276.1) is another GAM7957 target gene, herein designated TARGET GENE. MGC16037 BINDING SITE is a target binding site found in the 3' untranslated region of mRNA encoded by MGC16037, corresponding to a target binding site such as BINDING SITE I, BINDING SITE II or BINDING SITE III of FIG. 8. Table 4 illustrates the complementarity of the nucleotide sequences of MGC16037 BINDING SITE, designated SEQ ID:10438, to the nucleotide sequence of GAM7957 RNA, herein designated GAM RNA, also designated SEQ ID:297.

Another function of GAM7957 is therefore inhibition of MGC16037 (Accession NP_116276.1). Accordingly, utilities of GAM7957 include diagnosis, prevention and treatment of diseases and clinical conditions associated with MGC16037.

MGC16142 (Accession NP_116152.1) is another GAM7957 target gene, herein designated TARGET GENE. MGC16142 BINDING SITE is a target binding site found in the 3' untranslated region of mRNA encoded by MGC16142, corresponding to a target binding site such as BINDING SITE I, BINDING SITE II or BINDING SITE III of FIG. 8. Table 4 illustrates the complementarity of the nucleotide sequences of MGC16142 BINDING SITE, designated SEQ ID:14332, to the nucleotide sequence of GAM7957 RNA, herein designated GAM RNA, also designated SEQ ID:297.

Another function of GAM7957 is therefore inhibition of MGC16142 (Accession NP_116152.1). Accordingly, utilities of GAM7957 include diagnosis, prevention and treatment of diseases and clinical conditions associated with MGC16142.

MGC16332 (Accession NP_612635.2) is another GAM7957 target gene, herein designated TARGET GENE. MGC16332 BINDING SITE is a target binding site found in the 3' untranslated region of mRNA encoded by MGC16332, corresponding to a target binding site such as BINDING SITE I, BINDING SITE II or BINDING SITE III of FIG. 8. Table 4 illustrates the complementarity of the nucleotide sequences of MGC16332 BINDING SITE, designated SEQ ID:17692, to the nucleotide sequence of GAM7957 RNA, herein designated GAM RNA, also designated SEQ ID:297.

Another function of GAM7957 is therefore inhibition of MGC16332 (Accession NP_612635.2). Accordingly, utilities of GAM7957 include diagnosis, prevention and treatment of diseases and clinical conditions associated with MGC16332.

MGC16384 (Accession NP_444276.1) is another GAM7957 target gene, herein designated TARGET GENE.

MGC16384 BINDING SITE is a target binding site found in the 3' untranslated region of mRNA encoded by MGC16384, corresponding to a target binding site such as BINDING SITE I, BINDING SITE II or BINDING SITE III of FIG. 8. Table 4 illustrates the complementarity of the nucleotide sequences of MGC16384 BINDING SITE, designated SEQ ID:11946, to the nucleotide sequence of GAM7957 RNA, herein designated GAM RNA, also designated SEQ ID:297.

Another function of GAM7957 is therefore inhibition of MGC16384 (Accession NP_444276.1). Accordingly, utilities of GAM7957 include diagnosis, prevention and treatment of diseases and clinical conditions associated with MGC16384.

MGC16703 (Accession NP_659479.1) is another GAM7957 target gene, herein designated TARGET GENE. MGC16703 BINDING SITE1 and MGC16703 BINDING SITE2 are target binding sites found in untranslated regions of mRNA encoded by MGC16703, corresponding to target binding sites such as BINDING SITE I, BINDING SITE II or BINDING SITE III of FIG. 8. Table 4 illustrates the complementarity of the nucleotide sequences of MGC16703 BINDING SITE1 and MGC16703 BINDING SITE2, designated SEQ ID:18312 and SEQ ID:4657 respectively, to the nucleotide sequence of GAM7957 RNA, herein designated GAM RNA, also designated SEQ ID:297.

Another function of GAM7957 is therefore inhibition of MGC16703 (Accession NP_659479.1). Accordingly, utilities of GAM7957 include diagnosis, prevention and treatment of diseases and clinical conditions associated with MGC16703.

MGC17791 (Accession NP_689575.1) is another GAM7957 target gene, herein designated TARGET GENE. MGC17791 BINDING SITE1 through MGC17791 BINDING SITE5 are target binding sites found in untranslated regions of mRNA encoded by MGC17791, corresponding to target binding sites such as BINDING SITE I, BINDING SITE II or BINDING SITE III of FIG. 8. Table 4 illustrates the complementarity of the nucleotide sequences of MGC17791 BINDING SITE1 through MGC17791 BINDING SITE5, designated SEQ ID:11137, SEQ ID:6756, SEQ ID:10818, SEQ ID:16675 and SEQ ID:646 respectively, to the nucleotide sequence of GAM7957 RNA, herein designated GAM RNA, also designated SEQ ID:297.

Another function of GAM7957 is therefore inhibition of MGC17791 (Accession NP_689575.1). Accordingly, utilities of GAM7957 include diagnosis, prevention and treatment of diseases and clinical conditions associated with MGC17791.

MGC17986 (Accession NP_705836.1) is another GAM7957 target gene, herein designated TARGET GENE. MGC17986 BINDING SITE is a target binding site found in the 3' untranslated region of mRNA encoded by MGC17986, corresponding to a target binding site such as BINDING SITE I, BINDING SITE II or BINDING SITE III of FIG. 8. Table 4 illustrates the complementarity of the nucleotide sequences of MGC17986 BINDING SITE, designated SEQ ID:9086, to the nucleotide sequence of GAM7957 RNA, herein designated GAM RNA, also designated SEQ ID:297.

Another function of GAM7957 is therefore inhibition of MGC17986 (Accession NP_705836.1). Accordingly, utilities of GAM7957 include diagnosis, prevention and treatment of diseases and clinical conditions associated with MGC17986.

MGC20235 (Accession NP_659478.1) is another GAM7957 target gene, herein designated TARGET GENE. MGC20235 BINDING SITE is a target binding site found in the 3' untranslated region of mRNA encoded by MGC20235, corresponding to a target binding site such as BINDING SITE I, BINDING SITE II or BINDING SITE III of FIG. 8. Table 4 illustrates the complementarity of the nucleotide sequences of MGC20235 BINDING SITE, designated SEQ ID:6648, to the nucleotide sequence of GAM7957 RNA, herein designated GAM RNA, also designated SEQ ID:297.

Another function of GAM7957 is therefore inhibition of MGC20235 (Accession NP_659478.1). Accordingly, utilities of GAM7957 include diagnosis, prevention and treatment of diseases and clinical conditions associated with MGC20235.

MGC20481 (Accession NP_443081.1) is another GAM7957 target gene, herein designated TARGET GENE. MGC20481 BINDING SITE1 and MGC20481 BINDING SITE2 are target binding sites found in untranslated regions of mRNA encoded by MGC20481, corresponding to target binding sites such as BINDING SITE I, BINDING SITE II or BINDING SITE III of FIG. 8. Table 4 illustrates the complementarity of the nucleotide sequences of MGC20481 BINDING SITE1 and MGC20481 BINDING SITE2, designated SEQ ID:19193 and SEQ ID:973 respectively, to the nucleotide sequence of GAM7957 RNA, herein designated GAM RNA, also designated SEQ ID:297.

Another function of GAM7957 is therefore inhibition of MGC20481 (Accession NP_443081.1). Accordingly, utilities of GAM7957 include diagnosis, prevention and treatment of diseases and clinical conditions associated with MGC20481.

MGC20741 (Accession NP_061031.2) is another GAM7957 target gene, herein designated TARGET GENE. MGC20741 BINDING SITE1 and MGC20741 BINDING SITE2 are target binding sites found in untranslated regions of mRNA encoded by MGC20741, corresponding to target binding sites such as BINDING SITE I, BINDING SITE II or BINDING SITE III of FIG. 8. Table 4 illustrates the complementarity of the nucleotide sequences of MGC20741 BINDING SITE1 and MGC20741 BINDING SITE2, designated SEQ ID:17399 and SEQ ID:11529 respectively, to the nucleotide sequence of GAM7957 RNA, herein designated GAM RNA, also designated SEQ ID:297.

Another function of GAM7957 is therefore inhibition of MGC20741 (Accession NP_061031.2). Accordingly, utilities of GAM7957 include diagnosis, prevention and treatment of diseases and clinical conditions associated with MGC20741.

MGC20781 (Accession NP_443167.1) is another GAM7957 target gene, herein designated TARGET GENE. MGC20781 BINDING SITE is a target binding site found in the 5' untranslated region of mRNA encoded by MGC20781, corresponding to a target binding site such as BINDING SITE I, BINDING SITE II or BINDING SITE III of FIG. 8. Table 4 illustrates the complementarity of the nucleotide sequences of MGC20781 BINDING SITE, designated SEQ ID:19781, to the nucleotide sequence of GAM7957 RNA, herein designated GAM RNA, also designated SEQ ID:297.

Another function of GAM7957 is therefore inhibition of MGC20781 (Accession NP_443167.1). Accordingly, utilities of GAM7957 include diagnosis, prevention and treatment of diseases and clinical conditions associated with MGC20781.

MGC23244 (Accession NP_653216.1) is another GAM7957 target gene, herein designated TARGET GENE. MGC23244 BINDING SITE is a target binding site found in the 3' untranslated region of mRNA encoded by MGC23244, corresponding to a target binding site such as BINDING SITE I, BINDING SITE II or BINDING SITE III of FIG. 8. Table 4 illustrates the complementarity of the nucleotide sequences of MGC23244 BINDING SITE, designated SEQ ID:18691, to the nucleotide sequence of GAM7957 RNA, herein designated GAM RNA, also designated SEQ ID:297.

Another function of GAM7957 is therefore inhibition of MGC23244 (Accession NP_653216.1). Accordingly, utilities of GAM7957 include diagnosis, prevention and treatment of diseases and clinical conditions associated with MGC23244.

MGC23885 (Accession NP_689714.1) is another GAM7957 target gene, herein designated TARGET GENE. MGC23885 BINDING SITE is a target binding site found in the 3' untranslated region of mRNA encoded by MGC23885, corresponding to a target binding site such as BINDING SITE I, BINDING SITE II or BINDING SITE III of FIG. 8. Table 4 illustrates the complementarity of the nucleotide sequences of MGC23885 BINDING SITE, designated SEQ ID:11744, to the nucleotide sequence of GAM7957 RNA, herein designated GAM RNA, also designated SEQ ID:297.

Another function of GAM7957 is therefore inhibition of MGC23885 (Accession NP_689714.1). Accordingly, utilities of GAM7957 include diagnosis, prevention and treatment of diseases and clinical conditions associated with MGC23885.

MGC2396 (Accession NP_443084.1) is another GAM7957 target gene, herein designated TARGET GENE. MGC2396 BINDING SITE is a target binding site found in the 3' untranslated region of mRNA encoded by MGC2396, corresponding to a target binding site such as BINDING SITE I, BINDING SITE II or BINDING SITE III of FIG. 8. Table 4 illustrates the complementarity of the nucleotide sequences of MGC2396 BINDING SITE, designated SEQ ID:8496, to the nucleotide sequence of GAM7957 RNA, herein designated GAM RNA, also designated SEQ ID:297.

Another function of GAM7957 is therefore inhibition of MGC2396 (Accession NP_443084.1). Accordingly, utilities of GAM7957 include diagnosis, prevention and treatment of diseases and clinical conditions associated with MGC2396.

MGC2562 (Accession NP_115750.1) is another GAM7957 target gene, herein designated TARGET GENE. MGC2562 BINDING SITE1 through MGC2562 BINDING SITE3 are target binding sites found in untranslated regions of mRNA encoded by MGC2562, corresponding to target binding sites such as BINDING SITE I, BINDING SITE II or BINDING SITE III of FIG. 8. Table 4 illustrates the complementarity of the nucleotide sequences of MGC2562 BINDING SITE1 through MGC2562 BINDING SITE3, designated SEQ ID:15818, SEQ ID:19241 and SEQ ID:6525 respectively, to the nucleotide sequence of GAM7957 RNA, herein designated GAM RNA, also designated SEQ ID:297.

Another function of GAM7957 is therefore inhibition of MGC2562 (Accession NP_115750.1). Accordingly, utilities of GAM7957 include diagnosis, prevention and treatment of diseases and clinical conditions associated with MGC2562.

MGC26877 (Accession NP_653228.1) is another GAM7957 target gene, herein designated TARGET GENE. MGC26877 BINDING SITE is a target binding site found in the 5' untranslated region of mRNA encoded by MGC26877, corresponding to a target binding site such as BINDING SITE I, BINDING SITE II or BINDING SITE III of FIG. 8. Table 4 illustrates the complementarity of the nucleotide sequences of MGC26877 BINDING SITE, designated SEQ ID:16438, to the nucleotide sequence of GAM7957 RNA, herein designated GAM RNA, also designated SEQ ID:297.

Another function of GAM7957 is therefore inhibition of MGC26877 (Accession NP_653228.1). Accordingly, utilities of GAM7957 include diagnosis, prevention and treatment of diseases and clinical conditions associated with MGC26877.

MGC2731 (Accession NP_076973.1) is another GAM7957 target gene, herein designated TARGET GENE. MGC2731 BINDING SITE is a target binding site found in the 3' untranslated region of mRNA encoded by MGC2731, corresponding to a target binding site such as BINDING SITE I, BINDING SITE II or BINDING SITE III of FIG. 8. Table 4 illustrates the complementarity of the nucleotide sequences of MGC2731 BINDING SITE, designated SEQ ID:6364, to the nucleotide sequence of GAM7957 RNA, herein designated GAM RNA, also designated SEQ ID:297.

Another function of GAM7957 is therefore inhibition of MGC2731 (Accession NP_076973.1). Accordingly, utilities of GAM7957 include diagnosis, prevention and treatment of diseases and clinical conditions associated with MGC2731.

MGC29891 (Accession NP_653219.1) is another GAM7957 target gene, herein designated TARGET GENE. MGC29891 BINDING SITE1 and MGC29891 BINDING SITE2 are target binding sites found in untranslated regions of mRNA encoded by MGC29891, corresponding to target binding sites such as BINDING SITE I, BINDING SITE II or BINDING SITE III of FIG. 8. Table 4 illustrates the complementarity of the nucleotide sequences of MGC29891 BINDING SITE1 and MGC29891 BINDING SITE2, designated SEQ ID:18690 and SEQ ID:15224 respectively, to the nucleotide sequence of GAM7957 RNA, herein designated GAM RNA, also designated SEQ ID:297.

Another function of GAM7957 is therefore inhibition of MGC29891 (Accession NP_653219.1). Accordingly, utilities of GAM7957 include diagnosis, prevention and treatment of diseases and clinical conditions associated with MGC29891.

MGC3169 (Accession NP_076979.1) is another GAM7957 target gene, herein designated TARGET GENE. MGC3169 BINDING SITE1 and MGC3169 BINDING SITE2 are target binding sites found in untranslated regions of mRNA encoded by MGC3169, corresponding to target binding sites such as BINDING SITE I, BINDING SITE II or BINDING SITE III of FIG. 8. Table 4 illustrates the complementarity of the nucleotide sequences of MGC3169 BINDING SITE1 and MGC3169 BINDING SITE2, designated SEQ ID:11898 and SEQ ID:6847 respectively, to the nucleotide sequence of GAM7957 RNA, herein designated GAM RNA, also designated SEQ ID:297.

Another function of GAM7957 is therefore inhibition of MGC3169 (Accession NP_076979.1). Accordingly, utilities of GAM7957 include diagnosis, prevention and treatment of diseases and clinical conditions associated with MGC3169.

MGC3195 (Accession NP_114111.2) is another GAM7957 target gene, herein designated TARGET GENE. MGC3195 BINDING SITE is a target binding site found in the 3' untranslated region of mRNA encoded by MGC3195, corresponding to a target binding site such as BINDING SITE I, BINDING SITE II or BINDING SITE III of FIG. 8. Table 4 illustrates the complementarity of the nucleotide sequences of MGC3195 BINDING SITE, designated SEQ ID:8791, to the nucleotide sequence of GAM7957 RNA, herein designated GAM RNA, also designated SEQ ID:297.

Another function of GAM7957 is therefore inhibition of MGC3195 (Accession NP_114111.2). Accordingly, utilities of GAM7957 include diagnosis, prevention and treatment of diseases and clinical conditions associated with MGC3195.

MGC32020 (Accession NP_689479.1) is another GAM7957 target gene, herein designated TARGET GENE. MGC32020 BINDING SITE is a target binding site found in the 3' untranslated region of mRNA encoded by MGC32020, corresponding to a target binding site such as BINDING SITE I, BINDING SITE II or BINDING SITE III of FIG. 8. Table 4 illustrates the complementarity of the nucleotide sequences of MGC32020 BINDING SITE, designated SEQ ID:18690, to the nucleotide sequence of GAM7957 RNA, herein designated GAM RNA, also designated SEQ ID:297.

Another function of GAM7957 is therefore inhibition of MGC32020 (Accession NP_689479.1). Accordingly, utilities of GAM7957 include diagnosis, prevention and treatment of diseases and clinical conditions associated with MGC32020.

MGC3207 (Accession NP_115661.1) is another GAM7957 target gene, herein designated TARGET GENE. MGC3207 BINDING SITE is a target binding site found in the 3' untranslated region of mRNA encoded by MGC3207, corresponding to a target binding site such as BINDING SITE I, BINDING SITE II or BINDING SITE III of FIG. 8. Table 4 illustrates the complementarity of the nucleotide sequences of MGC3207 BINDING SITE, designated SEQ ID:2485, to the nucleotide sequence of GAM7957 RNA, herein designated GAM RNA, also designated SEQ ID:297.

Another function of GAM7957 is therefore inhibition of MGC3207 (Accession NP_115661.1). Accordingly, utilities of GAM7957 include diagnosis, prevention and treatment of diseases and clinical conditions associated with MGC3207.

MGC3329 (Accession NP_076991.2) is another GAM7957 target gene, herein designated TARGET GENE. MGC3329 BINDING SITE is a target binding site found in the 3' untranslated region of mRNA encoded by MGC3329, corresponding to a target binding site such as BINDING SITE I, BINDING SITE II or BINDING SITE III of FIG. 8. Table 4 illustrates the complementarity of the nucleotide sequences of MGC3329 BINDING SITE, designated SEQ ID:17423, to the nucleotide sequence of GAM7957 RNA, herein designated GAM RNA, also designated SEQ ID:297.

Another function of GAM7957 is therefore inhibition of MGC3329 (Accession NP_076991.2). Accordingly, utilities of GAM7957 include diagnosis, prevention and treatment of diseases and clinical conditions associated with MGC3329.

MGC33488 (Accession NP_612359.1) is another GAM7957 target gene, herein designated TARGET GENE. MGC33488 BINDING SITE is a target binding site found in the 3' untranslated region of mRNA encoded by MGC33488, corresponding to a target binding site such as BINDING SITE I, BINDING SITE II or BINDING SITE III of FIG. 8. Table 4 illustrates the complementarity of the nucleotide sequences of MGC33488 BINDING SITE, designated SEQ ID:16907, to the nucleotide sequence of GAM7957 RNA, herein designated GAM RNA, also designated SEQ ID:297.

Another function of GAM7957 is therefore inhibition of MGC33488 (Accession NP_612359.1). Accordingly, utilities of GAM7957 include diagnosis, prevention and treatment of diseases and clinical conditions associated with MGC33488.

MGC33547 (Accession NP_653262.1) is another GAM7957 target gene, herein designated TARGET GENE. MGC33547 BINDING SITE is a target binding site found in the 5' untranslated region of mRNA encoded by MGC33547, corresponding to a target binding site such as BINDING SITE I, BINDING SITE II or BINDING SITE III of FIG. 8. Table 4 illustrates the complementarity of the nucleotide sequences of MGC33547 BINDING SITE, designated SEQ ID:20039, to the nucleotide sequence of GAM7957 RNA, herein designated GAM RNA, also designated SEQ ID:297.

Another function of GAM7957 is therefore inhibition of MGC33547 (Accession NP_653262.1). Accordingly, utilities of GAM7957 include diagnosis, prevention and treatment of diseases and clinical conditions associated with MGC33547.

MGC33653 (Accession NP_699177.1) is another GAM7957 target gene, herein designated TARGET GENE. MGC33653 BINDING SITE is a target binding site found in the 3' untranslated region of mRNA encoded by MGC33653, corresponding to a target binding site such as BINDING SITE I, BINDING SITE II or BINDING SITE III of FIG. 8. Table 4 illustrates the complementarity of the nucleotide sequences of MGC33653 BINDING SITE, designated SEQ ID:4802, to the nucleotide sequence of GAM7957 RNA, herein designated GAM RNA, also designated SEQ ID:297.

Another function of GAM7957 is therefore inhibition of MGC33653 (Accession NP_699177.1). Accordingly, utilities of GAM7957 include diagnosis, prevention and treatment of diseases and clinical conditions associated with MGC33653.

MGC33971 (Accession NP_699174.1) is another GAM7957 target gene, herein designated TARGET GENE. MGC33971 BINDING SITE is a target binding site found in the 3' untranslated region of mRNA encoded by MGC33971, corresponding to a target binding site such as BINDING SITE I, BINDING SITE II or BINDING SITE III of FIG. 8. Table 4 illustrates the complementarity of the nucleotide sequences of MGC33971 BINDING SITE, designated SEQ ID:14635, to the nucleotide sequence of GAM7957 RNA, herein designated GAM RNA, also designated SEQ ID:297.

Another function of GAM7957 is therefore inhibition of MGC33971 (Accession NP_699174.1). Accordingly, utilities of GAM7957 include diagnosis, prevention and treatment of diseases and clinical conditions associated with MGC33971.

MGC34034 (Accession NP_694956.1) is another GAM7957 target gene, herein designated TARGET GENE. MGC34034 BINDING SITE is a target binding site found in the 3' untranslated region of mRNA encoded by MGC34034, corresponding to a target binding site such as BINDING SITE I, BINDING SITE II or BINDING SITE III of FIG. 8. Table 4 illustrates the complementarity of the nucleotide sequences of MGC34034 BINDING SITE, designated SEQ ID:3186, to the nucleotide sequence of GAM7957 RNA, herein designated GAM RNA, also designated SEQ ID:297.

Another function of GAM7957 is therefore inhibition of MGC34034 (Accession NP_694956.1). Accordingly, utilities of GAM7957 include diagnosis, prevention and treatment of diseases and clinical conditions associated with MGC34034.

MGC34079 (Accession NP_689688.1) is another GAM7957 target gene, herein designated TARGET GENE. MGC34079 BINDING SITE is a target binding site found in the 3' untranslated region of mRNA encoded by MGC34079, corresponding to a target binding site such as BINDING SITE I, BINDING SITE II or BINDING SITE III of FIG. 8. Table 4 illustrates the complementarity of the nucleotide sequences of MGC34079 BINDING SITE, designated SEQ ID:743, to the nucleotide sequence of GAM7957 RNA, herein designated GAM RNA, also designated SEQ ID:297.

Another function of GAM7957 is therefore inhibition of MGC34079 (Accession NP_689688.1). Accordingly, utilities of GAM7957 include diagnosis, prevention and treatment of diseases and clinical conditions associated with MGC34079.

MGC34725 (Accession NP_775908.1) is another GAM7957 target gene, herein designated TARGET GENE. MGC34725 BINDING SITE1 and MGC34725 BINDING SITE2 are target binding sites found in untranslated regions of mRNA encoded by MGC34725, corresponding to target binding sites such as BINDING SITE I, BINDING SITE II or BINDING SITE III of FIG. 8. Table 4 illustrates the complementarity of the nucleotide sequences of MGC34725 BINDING SITE1 and MGC34725 BINDING SITE2, designated SEQ ID:6790 and SEQ ID:18691 respectively, to the nucleotide sequence of GAM7957 RNA, herein designated GAM RNA, also designated SEQ ID:297.

Another function of GAM7957 is therefore inhibition of MGC34725 (Accession NP_775908.1). Accordingly, utilities of GAM7957 include diagnosis, prevention and treatment of diseases and clinical conditions associated with MGC34725.

MGC35295 (Accession NP_689930.1) is another GAM7957 target gene, herein designated TARGET GENE. MGC35295 BINDING SITE is a target binding site found in the 3' untranslated region of mRNA encoded by MGC35295, corresponding to a target binding site such as BINDING SITE I, BINDING SITE II or BINDING SITE III of FIG. 8. Table 4 illustrates the complementarity of the nucleotide sequences of MGC35295 BINDING SITE, designated SEQ ID:15007, to the nucleotide sequence of GAM7957 RNA, herein designated GAM RNA, also designated SEQ ID:297.

Another function of GAM7957 is therefore inhibition of MGC35295 (Accession NP_689930.1). Accordingly, utilities of GAM7957 include diagnosis, prevention and treatment of diseases and clinical conditions associated with MGC35295.

MGC35352 (Accession NP_689773.1) is another GAM7957 target gene, herein designated TARGET GENE. MGC35352 BINDING SITE is a target binding site found in the 3' untranslated region of mRNA encoded by MGC35352, corresponding to a target binding site such as BINDING SITE I, BINDING SITE II or BINDING SITE III of FIG. 8. Table 4 illustrates the complementarity of the nucleotide sequences of MGC35352 BINDING SITE, designated SEQ ID:6472, to the nucleotide sequence of GAM7957 RNA, herein designated GAM RNA, also designated SEQ ID:297.

Another function of GAM7957 is therefore inhibition of MGC35352 (Accession NP_689773.1). Accordingly, utilities of GAM7957 include diagnosis, prevention and treatment of diseases and clinical conditions associated with MGC35352.

MGC35361 (Accession NP_671727.1) is another GAM7957 target gene, herein designated TARGET GENE. MGC35361 BINDING SITE is a target binding site found in the 3' untranslated region of mRNA encoded by MGC35361, corresponding to a target binding site such as BINDING SITE I, BINDING SITE II or BINDING SITE III of FIG. 8. Table 4 illustrates the complementarity of the nucleotide sequences of MGC35361 BINDING SITE, designated SEQ ID:9208, to the nucleotide sequence of GAM7957 RNA, herein designated GAM RNA, also designated SEQ ID:297.

Another function of GAM7957 is therefore inhibition of MGC35361 (Accession NP_671727.1). Accordingly, utilities of GAM7957 include diagnosis, prevention and treatment of diseases and clinical conditions associated with MGC35361.

MGC35440 (Accession NP_694952.1) is another GAM7957 target gene, herein designated TARGET GENE. MGC35440 BINDING SITE is a target binding site found in the 3' untranslated region of mRNA encoded by MGC35440, corresponding to a target binding site such as BINDING SITE I, BINDING SITE II or BINDING SITE III of FIG. 8. Table 4 illustrates the complementarity of the nucleotide sequences of MGC35440 BINDING SITE, designated SEQ ID:12759, to the nucleotide sequence of GAM7957 RNA, herein designated GAM RNA, also designated SEQ ID:297.

Another function of GAM7957 is therefore inhibition of MGC35440 (Accession NP_694952.1). Accordingly, utilities of GAM7957 include diagnosis, prevention and treatment of diseases and clinical conditions associated with MGC35440.

MGC39518 (Accession NP_776183.1) is another GAM7957 target gene, herein designated TARGET GENE. MGC39518 BINDING SITE is a target binding site found in the 5' untranslated region of mRNA encoded by MGC39518, corresponding to a target binding site such as BINDING SITE I, BINDING SITE II or BINDING SITE III of FIG. 8. Table 4 illustrates the complementarity of the nucleotide sequences of MGC39518 BINDING SITE, designated SEQ ID:8988, to the nucleotide sequence of GAM7957 RNA, herein designated GAM RNA, also designated SEQ ID:297.

Another function of GAM7957 is therefore inhibition of MGC39518 (Accession NP_776183.1). Accordingly, utilities of GAM7957 include diagnosis, prevention and treatment of diseases and clinical conditions associated with MGC39518.

MGC39633 (Accession NP_689762.1) is another GAM7957 target gene, herein designated TARGET GENE. MGC39633 BINDING SITE is a target binding site found in the 5' untranslated region of mRNA encoded by MGC39633, corresponding to a target binding site such as BINDING SITE I, BINDING SITE II or BINDING SITE III of FIG. 8. Table 4 illustrates the complementarity of the nucleotide sequences of MGC39633 BINDING SITE, designated SEQ ID:5211, to the nucleotide sequence of GAM7957 RNA, herein designated GAM RNA, also designated SEQ ID:297.

Another function of GAM7957 is therefore inhibition of MGC39633 (Accession NP_689762.1). Accordingly, utilities of GAM7957 include diagnosis, prevention and treatment of diseases and clinical conditions associated with MGC39633.

MGC4248 (Accession NP_115709.2) is another GAM7957 target gene, herein designated TARGET GENE. MGC4248 BINDING SITE1 and MGC4248 BINDING SITE2 are target binding sites found in untranslated regions of mRNA encoded by MGC4248, corresponding to target binding sites such as BINDING SITE I, BINDING SITE II or BINDING SITE III of FIG. 8. Table 4 illustrates the complementarity of the nucleotide sequences of MGC4248 BINDING SITE1 and MGC4248 BINDING SITE2, designated SEQ ID:5210 and SEQ ID:15981 respectively, to the nucleotide sequence of GAM7957 RNA, herein designated GAM RNA, also designated SEQ ID:297.

Another function of GAM7957 is therefore inhibition of MGC4248 (Accession NP_115709.2). Accordingly, utilities of GAM7957 include diagnosis, prevention and treatment of diseases and clinical conditions associated with MGC4248.

MGC43033 (Accession NP_689924.1) is another GAM7957 target gene, herein designated TARGET GENE. MGC43033 BINDING SITE is a target binding site found in the 3' untranslated region of mRNA encoded by MGC43033, corresponding to a target binding site such as BINDING SITE I, BINDING SITE II or BINDING SITE III of FIG. 8. Table 4 illustrates the complementarity of the nucleotide sequences of MGC43033 BINDING SITE, designated SEQ ID:11412, to the nucleotide sequence of GAM7957 RNA, herein designated GAM RNA, also designated SEQ ID:297.

Another function of GAM7957 is therefore inhibition of MGC43033 (Accession NP_689924.1). Accordingly, utilities of GAM7957 include diagnosis, prevention and treatment of diseases and clinical conditions associated with MGC43033.

MGC43537 (Accession NP_848639.1) is another GAM7957 target gene, herein designated TARGET GENE. MGC43537 BINDING SITE is a target binding site found in the 3' untranslated region of mRNA encoded by MGC43537, corresponding to a target binding site such as BINDING SITE I, BINDING SITE II or BINDING SITE III of FIG. 8. Table 4 illustrates the complementarity of the nucleotide sequences of MGC43537 BINDING SITE, designated SEQ ID:1686, to the nucleotide sequence of GAM7957 RNA, herein designated GAM RNA, also designated SEQ ID:297.

Another function of GAM7957 is therefore inhibition of MGC43537 (Accession NP_848639.1). Accordingly, utilities of GAM7957 include diagnosis, prevention and treatment of diseases and clinical conditions associated with MGC43537.

MGC4562 (Accession NP_588616.1) is another GAM7957 target gene, herein designated TARGET GENE. MGC4562 BINDING SITE is a target binding site found in the 3' untranslated region of mRNA encoded by MGC4562, corresponding to a target binding site such as BINDING SITE I, BINDING SITE II or BINDING SITE III of FIG. 8. Table 4 illustrates the complementarity of the nucleotide sequences of MGC4562 BINDING SITE, designated SEQ ID:972, to the nucleotide sequence of GAM7957 RNA, herein designated GAM RNA, also designated SEQ ID:297.

Another function of GAM7957 is therefore inhibition of MGC4562 (Accession NP_588616.1). Accordingly, utilities of GAM7957 include diagnosis, prevention and treatment of diseases and clinical conditions associated with MGC4562.

MGC45806 (Accession NP_689517.1) is another GAM7957 target gene, herein designated TARGET GENE. MGC45806 BINDING SITE is a target binding site found in the 3' untranslated region of mRNA encoded by MGC45806, corresponding to a target binding site such as BINDING SITE I, BINDING SITE II or BINDING SITE III of FIG. 8. Table 4 illustrates the complementarity of the nucleotide sequences of MGC45806 BINDING SITE, designated SEQ ID:13687, to the nucleotide sequence of GAM7957 RNA, herein designated GAM RNA, also designated SEQ ID:297.

Another function of GAM7957 is therefore inhibition of MGC45806 (Accession NP_689517.1). Accordingly, utilities of GAM7957 include diagnosis, prevention and treatment of diseases and clinical conditions associated with MGC45806.

MGC46336 (Accession XP_290712.1) is another GAM7957 target gene, herein designated TARGET GENE. MGC46336 BINDING SITE is a target binding site found in the 3' untranslated region of mRNA encoded by MGC46336, corresponding to a target binding site such as BINDING SITE I, BINDING SITE II or BINDING SITE III of FIG. 8. Table 4 illustrates the complementarity of the nucleotide sequences of MGC46336 BINDING SITE, designated SEQ ID:15343, to the nucleotide sequence of GAM7957 RNA, herein designated GAM RNA, also designated SEQ ID:297.

Another function of GAM7957 is therefore inhibition of MGC46336 (Accession XP_290712.1). Accordingly, utilities of GAM7957 include diagnosis, prevention and treatment of diseases and clinical conditions associated with MGC46336.

MGC4771 (Accession NP_116057.1) is another GAM7957 target gene, herein designated TARGET GENE. MGC4771 BINDING SITE1 and MGC4771 BINDING SITE2 are target binding sites found in untranslated regions of mRNA encoded by MGC4771, corresponding to target binding sites such as BINDING SITE I, BINDING SITE II or BINDING SITE III of FIG. 8. Table 4 illustrates the complementarity of the nucleotide sequences of MGC4771 BINDING SITE1 and MGC4771 BINDING SITE2, designated SEQ ID:13162 and SEQ ID:9499 respectively, to the nucleotide sequence of GAM7957 RNA, herein designated GAM RNA, also designated SEQ ID:297.

Another function of GAM7957 is therefore inhibition of MGC4771 (Accession NP_116057.1). Accordingly, utilities of GAM7957 include diagnosis, prevention and treatment of diseases and clinical conditions associated with MGC4771.

MGC4840 (Accession NP_113678.2) is another GAM7957 target gene, herein designated TARGET GENE. MGC4840 BINDING SITE1 and MGC4840 BINDING SITE2 are target binding sites found in untranslated regions of mRNA encoded by MGC4840, corresponding to target binding sites such as BINDING SITE I, BINDING SITE II or BINDING SITE III of FIG. 8. Table 4 illustrates the complementarity of the nucleotide sequences of MGC4840 BINDING SITE1 and MGC4840 BINDING SITE2, designated SEQ ID:2546 and SEQ ID:9736 respectively, to the nucleotide sequence of GAM7957 RNA, herein designated GAM RNA, also designated SEQ ID:297.

Another function of GAM7957 is therefore inhibition of MGC4840 (Accession NP_113678.2). Accordingly, utilities of GAM7957 include diagnosis, prevention and treatment of diseases and clinical conditions associated with MGC4840.

MGC50836 (Accession XP_171060.1) is another GAM7957 target gene, herein designated TARGET GENE. MGC50836 BINDING SITE is a target binding site found in the 3' untranslated region of mRNA encoded by MGC50836, corresponding to a target binding site such as BINDING SITE I, BINDING SITE II or BINDING SITE III of FIG. 8. Table 4 illustrates the complementarity of the nucleotide sequences of MGC50836 BINDING SITE, designated SEQ ID:5072, to the nucleotide sequence of GAM7957 RNA, herein designated GAM RNA, also designated SEQ ID:297.

Another function of GAM7957 is therefore inhibition of MGC50836 (Accession XP_171060.1). Accordingly, utilities of GAM7957 include diagnosis, prevention and treatment of diseases and clinical conditions associated with MGC50836.

Matrix metalloproteinase 8 (neutrophil collagenase) (MMP8, Accession NP_002415.1) is another GAM7957 target gene, herein designated TARGET GENE. MMP8 BINDING SITE is a target binding site found in the 3' untranslated region of mRNA encoded by MMP8, corresponding to a target binding site such as BINDING SITE I, BINDING SITE II or BINDING SITE III of FIG. 8. Table 4 illustrates the complementarity of the nucleotide sequences of MMP8 BINDING SITE, designated SEQ ID:6716, to the nucleotide sequence of GAM7957 RNA, herein designated GAM RNA, also designated SEQ ID:297.

Another function of GAM7957 is therefore inhibition of Matrix metalloproteinase 8 (neutrophil collagenase) (MMP8, Accession NP_002415.1). Accordingly, utilities of GAM7957 include diagnosis, prevention and treatment of diseases and clinical conditions associated with MMP8.

Myelin oligodendrocyte glycoprotein (MOG, Accession NP_002424.1) is another GAM7957 target gene, herein designated TARGET GENE. MOG BINDING SITE is a target binding site found in the 3' untranslated region of mRNA encoded by MOG, corresponding to a target binding site such as BINDING SITE I, BINDING SITE II or BINDING SITE III of FIG. 8. Table 4 illustrates the complementarity of the nucleotide sequences of MOG BINDING SITE, designated SEQ ID:17403, to the nucleotide sequence of GAM7957 RNA, herein designated GAM RNA, also designated SEQ ID:297.

Another function of GAM7957 is therefore inhibition of Myelin oligodendrocyte glycoprotein (MOG, Accession NP_002424.1). Accordingly, utilities of GAM7957 include diagnosis, prevention and treatment of diseases and clinical conditions associated with MOG.

MOST2 (Accession NP_064635.1) is another GAM7957 target gene, herein designated TARGET GENE. MOST2 BINDING SITE is a target binding site found in the 5' untranslated region of mRNA encoded by MOST2, corresponding to a target binding site such as BINDING SITE I, BINDING SITE II or BINDING SITE III of FIG. 8. Table 4 illustrates the complementarity of the nucleotide sequences of MOST2 BINDING SITE, designated SEQ ID:18624, to the nucleotide sequence of GAM7957 RNA, herein designated GAM RNA, also designated SEQ ID:297.

Another function of GAM7957 is therefore inhibition of MOST2 (Accession NP_064635.1). Accordingly, utilities of GAM7957 include diagnosis, prevention and treatment of diseases and clinical conditions associated with MOST2.

Mre11 meiotic recombination 11 homolog a (s. cerevisiae) (MRE11A, Accession NP_005582.1) is another GAM7957 target gene, herein designated TARGET GENE. MRE11A BINDING SITE is a target binding site found in the 3' untranslated region of multiple transcripts of mRNA encoded by MRE11A, corresponding to a target binding site such as BINDING SITE I, BINDING SITE II or BINDING SITE III of FIG. 8. Table 4 illustrates the complementarity of the nucleotide sequences of MRE11A BINDING SITE, designated SEQ ID:5020, to the nucleotide sequence of GAM7957 RNA, herein designated GAM RNA, also designated SEQ ID:297.

Another function of GAM7957 is therefore inhibition of Mre11 meiotic recombination 11 homolog a (s. cerevisiae) (MRE11A, Accession NP_005582.1). Accordingly, utilities of GAM7957 include diagnosis, prevention and treatment of diseases and clinical conditions associated with MRE11A.

Mre11 meiotic recombination 11 homolog a (s. cerevisiae) (MRE11A, Accession NP_005581.2) is another GAM7957 target gene, herein designated TARGET GENE. MRE11A BINDING SITE is a target binding site found in the 3' untranslated region of multiple transcripts of mRNA encoded by MRE11A, corresponding to a target binding site such as BINDING SITE I, BINDING SITE II or BINDING SITE III of FIG. 8. Table 4 illustrates the complementarity of the nucleotide sequences of MRE11A BINDING SITE, designated SEQ ID:5020, to the nucleotide sequence of GAM7957 RNA, herein designated GAM RNA, also designated SEQ ID:297.

Another function of GAM7957 is therefore inhibition of Mre11 meiotic recombination 11 homolog a (s. cerevisiae) (MRE11A, Accession NP_005581.2). Accordingly, utilities of GAM7957 include diagnosis, prevention and treatment of diseases and clinical conditions associated with MRE11A.

Mitochondrial ribosomal protein 63 (MRP63, Accession NP_076931.1) is another GAM7957 target gene, herein designated TARGET GENE. MRP63 BINDING SITE1 and MRP63 BINDING SITE2 are target binding sites found in untranslated regions of mRNA encoded by MRP63, corresponding to target binding sites such as BINDING SITE I, BINDING SITE II or BINDING SITE III of FIG. 8. Table 4 illustrates the complementarity of the nucleotide sequences of MRP63 BINDING SITE1 and MRP63 BINDING SITE2, designated SEQ ID:4181 and SEQ ID:4128 respectively, to the nucleotide sequence of GAM7957 RNA, herein designated GAM RNA, also designated SEQ ID:297.

Another function of GAM7957 is therefore inhibition of Mitochondrial ribosomal protein 63 (MRP63, Accession NP_076931.1). Accordingly, utilities of GAM7957 include diagnosis, prevention and treatment of diseases and clinical conditions associated with MRP63.

Mitochondrial ribosomal protein l24 (MRPL24, Accession NP_663781.1) is another GAM7957 target gene, herein designated TARGET GENE. MRPL24 BINDING SITE is a target binding site found in the 5' untranslated region of multiple transcripts of mRNA encoded by MRPL24, corresponding to a target binding site such as BINDING SITE I, BINDING SITE II or BINDING SITE III of FIG. 8. Table 4 illustrates the complementarity of the nucleotide sequences of MRPL24 BINDING SITE, designated SEQ ID:16165, to the nucleotide sequence of GAM7957 RNA, herein designated GAM RNA, also designated SEQ ID:297.

Another function of GAM7957 is therefore inhibition of Mitochondrial ribosomal protein 124 (MRPL24, Accession NP_663781.1). Accordingly, utilities of GAM7957 include diagnosis, prevention and treatment of diseases and clinical conditions associated with MRPL24.

Mitochondrial ribosomal protein l30 (MRPL30, Accession NP_660213.1) is another GAM7957 target gene, herein designated TARGET GENE. MRPL30 BINDING SITE1 and MRPL30 BINDING SITE2 are target binding sites found in untranslated regions of multiple transcripts of mRNA encoded by MRPL30, corresponding to target binding sites such as BINDING SITE I, BINDING SITE II or BINDING SITE III of FIG. 8. Table 4 illustrates the complementarity of the nucleotide sequences of MRPL30 BINDING SITE1 and MRPL30 BINDING SITE2, designated SEQ ID:2031 and SEQ ID:13065 respectively, to the nucleotide sequence of GAM7957 RNA, herein designated GAM RNA, also designated SEQ ID:297.

Another function of GAM7957 is therefore inhibition of Mitochondrial ribosomal protein l30 (MRPL30, Accession NP_660213.1). Accordingly, utilities of GAM7957 include diagnosis, prevention and treatment of diseases and clinical conditions associated with MRPL30.

Mitochondrial ribosomal protein l4 (MRPL4, Accession NP_666500.1) is another GAM7957 target gene, herein designated TARGET GENE. MRPL4 BINDING SITE is a target binding site found in the 3' untranslated region of multiple transcripts of mRNA encoded by MRPL4, corresponding to a target binding site such as BINDING SITE I, BINDING SITE II or BINDING SITE III of FIG. 8. Table 4 illustrates the complementarity of the nucleotide sequences of MRPL4 BINDING SITE, designated SEQ ID:1750, to the nucleotide sequence of GAM7957 RNA, herein designated GAM RNA, also designated SEQ ID:297.

Another function of GAM7957 is therefore inhibition of Mitochondrial ribosomal protein l4 (MRPL4, Accession NP_666500.1). Accordingly, utilities of GAM7957 include diagnosis, prevention and treatment of diseases and clinical conditions associated with MRPL4.

Mitochondrial ribosomal protein l52 (MRPL52, Accession NP_851823.1) is another GAM7957 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:6651, to the nucleotide sequence of GAM7957 RNA, herein designated GAM RNA, also designated SEQ ID:297.

Another function of GAM7957 is therefore inhibition of Mitochondrial ribosomal protein l52 (MRPL52, Accession NP__851823.1). Accordingly, utilities of GAM7957 include diagnosis, prevention and treatment of diseases and clinical conditions associated with MRPL52.

Mitochondrial ribosomal protein l52 (MRPL52, Accession NP_851821.1) is another GAM7957 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:6651, to the nucleotide sequence of GAM7957 RNA, herein designated GAM RNA, also designated SEQ ID:297.

Another function of GAM7957 is therefore inhibition of Mitochondrial ribosomal protein l52 (MRPL52, Accession NP__851821.1). Accordingly, utilities of GAM7957 include diagnosis, prevention and treatment of diseases and clinical conditions associated with MRPL52.

Mitochondrial ribosomal protein l52 (MRPL52, Accession NP_851312.1) is another GAM7957 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:6651, to the nucleotide sequence of GAM7957 RNA, herein designated GAM RNA, also designated SEQ ID:297.

Another function of GAM7957 is therefore inhibition of Mitochondrial ribosomal protein l52 (MRPL52, Accession NP__851312.1). Accordingly, utilities of GAM7957 include diagnosis, prevention and treatment of diseases and clinical conditions associated with MRPL52.

Mitochondrial ribosomal protein l52 (MRPL52, Accession NP_848026.1) is another GAM7957 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:6651, to the nucleotide sequence of GAM7957 RNA, herein designated GAM RNA, also designated SEQ ID:297.

Another function of GAM7957 is therefore inhibition of Mitochondrial ribosomal protein l52 (MRPL52, Accession NP__848026.1). Accordingly, utilities of GAM7957 include diagnosis, prevention and treatment of diseases and clinical conditions associated with MRPL52.

Mitochondrial ribosomal protein l52 (MRPL52, Accession NP_851313.1) is another GAM7957 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:6651, to the nucleotide sequence of GAM7957 RNA, herein designated GAM RNA, also designated SEQ ID:297.

Another function of GAM7957 is therefore inhibition of Mitochondrial ribosomal protein l52 (MRPL52, Accession NP__851313.1). Accordingly, utilities of GAM7957 include diagnosis, prevention and treatment of diseases and clinical conditions associated with MRPL52.

Mitochondrial ribosomal protein l52 (MRPL52, Accession NP_851824.1) is another GAM7957 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:6651, to the nucleotide sequence of GAM7957 RNA, herein designated GAM RNA, also designated SEQ ID:297.

Another function of GAM7957 is therefore inhibition of Mitochondrial ribosomal protein l52 (MRPL52, Accession NP__851824.1). Accordingly, utilities of GAM7957 include diagnosis, prevention and treatment of diseases and clinical conditions associated with MRPL52.

Mitochondrial ribosomal protein l52 (MRPL52, Accession NP_851822.1) is another GAM7957 target gene, herein designated TARGET GENE. MRPL52 BINDING SITE is a target binding site found in the 3' untranslated region of multiple transcripts of mRNA encoded by MRPL52, corresponding to a target binding site such as BINDING SITE I, BINDING SITE II or BINDING SITE III of FIG. 8. Table 4 illustrates the complementarity of the nucleotide sequences of MRPL52 BINDING SITE, designated SEQ ID:6651, to the nucleotide sequence of GAM7957 RNA, herein designated GAM RNA, also designated SEQ ID:297.

Another function of GAM7957 is therefore inhibition of Mitochondrial ribosomal protein l52 (MRPL52, Accession NP__851822.1). Accordingly, utilities of GAM7957 include diagnosis, prevention and treatment of diseases and clinical conditions associated with MRPL52.

Mitochondrial ribosomal protein s10 (MRPS10, Accession NP__060611.2) is another GAM7957 target gene, herein designated TARGET GENE. MRPS10 BINDING SITE is a target binding site found in the 3' untranslated region of mRNA encoded by MRPS10, corresponding to a target binding site such as BINDING SITE I, BINDING SITE II or BINDING SITE III of FIG. 8. Table 4 illustrates the complementarity of the nucleotide sequences of MRPS10 BINDING SITE, designated SEQ ID:3585, to the nucleotide sequence of GAM7957 RNA, herein designated GAM RNA, also designated SEQ ID:297.

Another function of GAM7957 is therefore inhibition of Mitochondrial ribosomal protein s10 (MRPS10, Accession NP__060611.2). Accordingly, utilities of GAM7957 include diagnosis, prevention and treatment of diseases and clinical conditions associated with MRPS10.

Mitochondrial ribosomal protein s18b (MRPS18B, Accession NP_054765.1) is another GAM7957 target gene, herein designated TARGET GENE. MRPS18B BINDING SITE1 and MRPS18B BINDING SITE2 are target binding sites found in untranslated regions of mRNA encoded by MRPS18B, corresponding to target binding sites such as BINDING SITE I, BINDING SITE II or BINDING SITE III of FIG. 8. Table 4 illustrates the complementarity of the nucleotide sequences of MRPS18B BINDING SITE1 and MRPS18B BINDING SITE2, designated SEQ ID:13965 and SEQ ID:12993 respectively, to the nucleotide sequence of GAM7957 RNA, herein designated GAM RNA, also designated SEQ ID:297.

Another function of GAM7957 is therefore inhibition of Mitochondrial ribosomal protein s18b (MRPS18B, Accession NP_054765.1). Accordingly, utilities of GAM7957 include diagnosis, prevention and treatment of diseases and clinical conditions associated with MRPS18B.

Membrane-spanning 4-domains, subfamily a, member 2 (fc fragment of ige, high affinity i, receptor for; beta polypeptide) (MS4A2, Accession NP_000130.1) is another GAM7957 target gene, herein designated TARGET GENE. MS4A2 BINDING SITE is a target binding site found in the 3' untranslated region of mRNA encoded by MS4A2, corresponding to a target binding site such as BINDING SITE I, BINDING SITE II or BINDING SITE III of FIG. 8. Table 4 illustrates the complementarity of the nucleotide sequences of MS4A2 BINDING SITE, designated SEQ ID:18691, to the nucleotide sequence of GAM7957 RNA, herein designated GAM RNA, also designated SEQ ID:297.

Another function of GAM7957 is therefore inhibition of Membrane-spanning 4-domains, subfamily a, member 2 (fc fragment of ige, high affinity i, receptor for; beta polypeptide) (MS4A2, Accession NP_000130.1), a gene which binds to the fc region of immunoglobulins epsilon. and therefore may be associated with Atopic asthma, atopic dermatitis. Accordingly, utilities of GAM7957 include diagnosis, prevention and treatment of Atopic asthma, atopic dermatitis, and of other diseases and clinical conditions associated with MS4A2.

The function of MS4A2 and its association with various diseases and clinical conditions, has been established by previous studies, as described hereinabove with reference to GAM63.1. MSCP (Accession NP_057696.1) is another GAM7957 target gene, herein designated TARGET GENE. MSCP BINDING SITE is a target binding site found in the 3' untranslated region of multiple transcripts of mRNA encoded by MSCP, corresponding to a target binding site such as BINDING SITE I, BINDING SITE II or BINDING SITE III of FIG. 8. Table 4 illustrates the complementarity of the nucleotide sequences of MSCP BINDING SITE, designated SEQ ID:5159, to the nucleotide sequence of GAM7957 RNA, herein designated GAM RNA, also designated SEQ ID:297.

Another function of GAM7957 is therefore inhibition of MSCP (Accession NP_057696.1). Accordingly, utilities of GAM7957 include diagnosis, prevention and treatment of diseases and clinical conditions associated with MSCP.

MSCP (Accession NP_061049.2) is another GAM7957 target gene, herein designated TARGET GENE. MSCP BINDING SITE is a target binding site found in the 3' untranslated region of multiple transcripts of mRNA encoded by MSCP, corresponding to a target binding site such as BINDING SITE I, BINDING SITE II or BINDING SITE III of FIG. 8. Table 4 illustrates the complementarity of the nucleotide sequences of MSCP BINDING SITE, designated SEQ ID:5159, to the nucleotide sequence of GAM7957 RNA, herein designated GAM RNA, also designated SEQ ID:297.

Another function of GAM7957 is therefore inhibition of MSCP (Accession NP_061049.2). Accordingly, utilities of GAM7957 include diagnosis, prevention and treatment of diseases and clinical conditions associated with MSCP.

Muts homolog 3 (e. coli) (MSH3, Accession NP_002430.1) is another GAM7957 target gene, herein designated TARGET GENE. MSH3 BINDING SITE is a target binding site found in the 3' untranslated region of mRNA encoded by MSH3, corresponding to a target binding site such as BINDING SITE I, BINDING SITE II or BINDING SITE III of FIG. 8. Table 4 illustrates the complementarity of the nucleotide sequences of MSH3 BINDING SITE, designated SEQ ID:6752, to the nucleotide sequence of GAM7957 RNA, herein designated GAM RNA, also designated SEQ ID:297.

Another function of GAM7957 is therefore inhibition of Muts homolog 3 (e. coli) (MSH3, Accession NP_002430.1), a gene which belongs to the dna mismatch repair muts family. and therefore may be associated with Hereditary nonpolyposis colorectal cancer. Accordingly, utilities of GAM7957 include diagnosis, prevention and treatment of Hereditary nonpolyposis colorectal cancer, and of other diseases and clinical conditions associated with MSH3.

The function of MSH3 and its association with various diseases and clinical conditions, has been established by previous studies, as described hereinabove with reference to GAM347.1. Muts homolog 5 (e. coli) (MSH5, Accession NP_002432.1) is another GAM7957 target gene, herein designated TARGET GENE. MSH5 BINDING SITE is a target binding site found in the 5' untranslated region of multiple transcripts of mRNA encoded by MSH5, corresponding to a target binding site such as BINDING SITE I, BINDING SITE II or BINDING SITE III of FIG. 8. Table 4 illustrates the complementarity of the nucleotide sequences of MSH5 BINDING SITE, designated SEQ ID:12084, to the nucleotide sequence of GAM7957 RNA, herein designated GAM RNA, also designated SEQ ID:297.

Another function of GAM7957 is therefore inhibition of Muts homolog 5 (e. coli) (MSH5, Accession NP_002432.1). Accordingly, utilities of GAM7957 include diagnosis, prevention and treatment of diseases and clinical conditions associated with MSH5.

Myotubularin related protein 9 (MTMR9, Accession NP_056273.2) is another GAM7957 target gene, herein designated TARGET GENE. MTMR9 BINDING SITE1 and MTMR9 BINDING SITE2 are target binding sites found in untranslated regions of mRNA encoded by MTMR9, corresponding to target binding sites such as BINDING SITE I, BINDING SITE II or BINDING SITE III of FIG. 8. Table 4 illustrates the complementarity of the nucleotide sequences of MTMR9 BINDING SITE1 and MTMR9 BINDING SITE2, designated SEQ ID:19031 and SEQ ID:14781 respectively, to the nucleotide sequence of GAM7957 RNA, herein designated GAM RNA, also designated SEQ ID:297.

Another function of GAM7957 is therefore inhibition of Myotubularin related protein 9 (MTMR9, Accession NP_056273.2). Accordingly, utilities of GAM7957 include diagnosis, prevention and treatment of diseases and clinical conditions associated with MTMR9.

Melatonin receptor 1a (MTNR1A, Accession NP_005949.1) is another GAM7957 target gene, herein designated TARGET GENE. MTNR1A BINDING SITE is a target binding site found in the 3' untranslated region of mRNA encoded by MTNR1A, corresponding to a target binding site such as BINDING SITE I, BINDING SITE II or BINDING SITE III of FIG. 8. Table 4 illustrates the complementarity of the nucleotide sequences of MTNR1A BINDING SITE, designated SEQ ID:4731, to the nucleotide sequence of GAM7957 RNA, herein designated GAM RNA, also designated SEQ ID:297.

Another function of GAM7957 is therefore inhibition of Melatonin receptor 1a (MTNR1A, Accession NP_005949.1), a gene which likely mediates the reproductive and circadian actions of melatonin. Accordingly, utilities of GAM7957 include diagnosis, prevention and treatment of diseases and clinical conditions associated with MTNR1A.

The function of MTNR1A and its association with various diseases and clinical conditions, has been established by previous studies, as described hereinabove with reference to GAM401.1. MU (Accession NP_071368.1) is another GAM7957 target gene, herein designated TARGET GENE. MU BINDING SITE is a target binding site found in the 3' untranslated region of mRNA encoded by MU, corresponding to a target binding site such as BINDING SITE I, BINDING SITE II or BINDING SITE III of FIG. 8. Table 4 illustrates the complementarity of the nucleotide sequences of MU BINDING SITE, designated SEQ ID:17421, to the nucleotide sequence of GAM7957 RNA, herein designated GAM RNA, also designated SEQ ID:297.

Another function of GAM7957 is therefore inhibition of MU (Accession NP_071368.1). Accordingly, utilities of GAM7957 include diagnosis, prevention and treatment of diseases and clinical conditions associated with MU.

Mucin 13, epithelial transmembrane (MUC13, Accession NP_149038.1) is another GAM7957 target gene, herein designated TARGET GENE. MUC13 BINDING SITE is a target binding site found in the 3' untranslated region of mRNA encoded by MUC13, corresponding to a target binding site such as BINDING SITE I, BINDING SITE II or BINDING SITE III of FIG. 8. Table 4 illustrates the complementarity of the nucleotide sequences of MUC13 BINDING SITE, designated SEQ ID:13548, to the nucleotide sequence of GAM7957 RNA, herein designated GAM RNA, also designated SEQ ID:297.

Another function of GAM7957 is therefore inhibition of Mucin 13, epithelial transmembrane (MUC13, Accession NP_149038.1). Accordingly, utilities of GAM7957 include diagnosis, prevention and treatment of diseases and clinical conditions associated with MUC13.

Mucin 6, gastric (MUC6, Accession XP_290540.1) is another GAM7957 target gene, herein designated TARGET GENE. MUC6 BINDING SITE is a target binding site found in the 3' untranslated region of mRNA encoded by MUC6, corresponding to a target binding site such as BINDING SITE I, BINDING SITE II or BINDING SITE III of FIG. 8. Table 4 illustrates the complementarity of the nucleotide sequences of MUC6 BINDING SITE, designated SEQ ID:2101, to the nucleotide sequence of GAM7957 RNA, herein designated GAM RNA, also designated SEQ ID:297.

Another function of GAM7957 is therefore inhibition of Mucin 6, gastric (MUC6, Accession XP_290540.1). Accordingly, utilities of GAM7957 include diagnosis, prevention and treatment of diseases and clinical conditions associated with MUC6.

Mucin and cadherin-like (MUCDHL, Accession NP_112555.1) is another GAM7957 target gene, herein designated TARGET GENE. MUCDHL BINDING SITE is a target binding site found in the 3' untranslated region of multiple transcripts of mRNA encoded by MUCDHL, corresponding to a target binding site such as BINDING SITE I, BINDING SITE II or BINDING SITE III of FIG. 8. Table 4 illustrates the complementarity of the nucleotide sequences of MUCDHL BINDING SITE, designated SEQ ID:3704, to the nucleotide sequence of GAM7957 RNA, herein designated GAM RNA, also designated SEQ ID:297.

Another function of GAM7957 is therefore inhibition of Mucin and cadherin-like (MUCDHL, Accession NP_112555.1). Accordingly, utilities of GAM7957 include diagnosis, prevention and treatment of diseases and clinical conditions associated with MUCDHL.

Max interacting protein 1 (MXI1, Accession NP_005953.2) is another GAM7957 target gene, herein designated TARGET GENE. MXI1 BINDING SITE is a target binding site found in the 5' untranslated region of multiple transcripts of mRNA encoded by MXI1, corresponding to a target binding site such as BINDING SITE I, BINDING SITE II or BINDING SITE III of FIG. 8. Table 4 illustrates the complementarity of the nucleotide sequences of MXI1 BINDING SITE, designated SEQ ID:17318, to the nucleotide sequence of GAM7957 RNA, herein designated GAM RNA, also designated SEQ ID:297.

Another function of GAM7957 is therefore inhibition of Max interacting protein 1 (MXI1, Accession NP_005953.2), a gene which acts as a tumor suppressor in vivo, engages the MYC network in a functionally relevant manner and therefore may be associated with Prostate cancer, neurofibrosarcoma. Accordingly, utilities of GAM7957 include diagnosis, prevention and treatment of Prostate cancer, neurofibrosarcoma, and of other diseases and clinical conditions associated with MXI1.

The function of MXI1 and its association with various diseases and clinical conditions, has been established by previous studies, as described hereinabove with reference to GAM94.1. V-myb myeloblastosis viral oncogene homolog (avian)-like 2 (MYBL2, Accession NP_002457.1) is another GAM7957 target gene, herein designated TARGET GENE. MYBL2 BINDING SITE is a target binding site found in the 3' untranslated region of mRNA encoded by MYBL2, corresponding to a target binding site such as BINDING SITE I, BINDING SITE II or BINDING SITE III of FIG. 8. Table 4 illustrates the complementarity of the nucleotide sequences of MYBL2 BINDING SITE, designated SEQ ID:14569, to the nucleotide sequence of GAM7957 RNA, herein designated GAM RNA, also designated SEQ ID:297.

Another function of GAM7957 is therefore inhibition of V-myb myeloblastosis viral oncogene homolog (avian)-like 2 (MYBL2, Accession NP_002457.1), a gene which plays an essential role during cell cycle progression. Accordingly, utilities of GAM7957 include diagnosis, prevention and treatment of diseases and clinical conditions associated with MYBL2.

The function of MYBL2 and its association with various diseases and clinical conditions, has been established by previous studies, as described hereinabove with reference to GAM215.1. Myosin, heavy polypeptide 7b, cardiac muscle, beta (MYH7B, Accession NP_219492.1) is another GAM7957 target gene, herein designated TARGET GENE. MYH7B BINDING SITE is a target binding site found in the 3' untranslated region of mRNA encoded by MYH7B, corresponding to a target binding site such as BINDING SITE I, BINDING SITE II or BINDING SITE III of FIG. 8. Table 4 illustrates the complementarity of the nucleotide sequences of MYH7B BINDING SITE, designated SEQ ID:8697, to the nucleotide sequence of GAM7957 RNA, herein designated GAM RNA, also designated SEQ ID:297.

Another function of GAM7957 is therefore inhibition of Myosin, heavy polypeptide 7b, cardiac muscle, beta (MYH7B, Accession NP_219492.1). Accordingly, utilities of GAM7957 include diagnosis, prevention and treatment of diseases and clinical conditions associated with MYH7B.

Myosin id (MYO1D, Accession XP_050041.4) is another GAM7957 target gene, herein designated TARGET GENE. MYO1D BINDING SITE is a target binding site found in the 3' untranslated region of mRNA encoded by MYO1D, corresponding to a target binding site such as BINDING SITE I, BINDING SITE II or BINDING SITE III of FIG. 8. Table 4 illustrates the complementarity of the nucleotide sequences of MYO1D BINDING SITE, designated SEQ ID:1521, to the nucleotide sequence of GAM7957 RNA, herein designated GAM RNA, also designated SEQ ID:297.

Another function of GAM7957 is therefore inhibition of Myosin id (MYO1D, Accession XP_050041.4), a gene which is an unconventional myosin. Accordingly, utilities of GAM7957 include diagnosis, prevention and treatment of diseases and clinical conditions associated with MYO1D.

The function of MYO1D and its association with various diseases and clinical conditions, has been established by previous studies, as described hereinabove with reference to GAM227.1. Myozenin 3 (MYOZ3, Accession NP_588612.1) is another GAM7957 target gene, herein designated TARGET GENE. MYOZ3 BINDING SITE is a target binding site found in the 3' untranslated region of mRNA encoded by MYOZ3, corresponding to a target binding site such as BINDING SITE I, BINDING SITE II or BINDING SITE III of FIG. 8. Table 4 illustrates the complementarity of the nucleotide sequences of MYOZ3 BINDING SITE, designated SEQ ID:8407, to the nucleotide sequence of GAM7957 RNA, herein designated GAM RNA, also designated SEQ ID:297.

Another function of GAM7957 is therefore inhibition of Myozenin 3 (MYOZ3, Accession NP_588612.1). Accordingly, utilities of GAM7957 include diagnosis, prevention and treatment of diseases and clinical conditions associated with MYOZ3.

N4BP2 (Accession NP_060647.2) is another GAM7957 target gene, herein designated TARGET GENE. N4BP2 BINDING SITE is a target binding site found in the 3' untranslated region of mRNA encoded by N4BP2, corresponding to a target binding site such as BINDING SITE I, BINDING SITE II or BINDING SITE III of FIG. 8. Table 4 illustrates the complementarity of the nucleotide sequences of N4BP2 BINDING SITE, designated SEQ ID:4033, to the nucleotide sequence of GAM7957 RNA, herein designated GAM RNA, also designated SEQ ID:297.

Another function of GAM7957 is therefore inhibition of N4BP2 (Accession NP_060647.2). Accordingly, utilities of GAM7957 include diagnosis, prevention and treatment of diseases and clinical conditions associated with N4BP2.

N4BP3 (Accession XP_038920.2) is another GAM7957 target gene, herein designated TARGET GENE. N4BP3 BINDING SITE is a target binding site found in the 3' untranslated region of mRNA encoded by N4BP3, corresponding to a target binding site such as BINDING SITE I, BINDING SITE II or BINDING SITE III of FIG. 8. Table 4 illustrates the complementarity of the nucleotide sequences of N4BP3 BINDING SITE, designated SEQ ID:10245, to the nucleotide sequence of GAM7957 RNA, herein designated GAM RNA, also designated SEQ ID:297.

Another function of GAM7957 is therefore inhibition of N4BP3 (Accession XP_038920.2). Accordingly, utilities of GAM7957 include diagnosis, prevention and treatment of diseases and clinical conditions associated with N4BP3.

NALP12 (Accession NP_653288.1) is another GAM7957 target gene, herein designated TARGET GENE. NALP12 BINDING SITE1 and NALP12 BINDING SITE2 are target binding sites found in untranslated regions of multiple transcripts of mRNA encoded by NALP12, corresponding to target binding sites such as BINDING SITE I, BINDING SITE II or BINDING SITE III of FIG. 8. Table 4 illustrates the complementarity of the nucleotide sequences of NALP12 BINDING SITE1 and NALP12 BINDING SITE2, designated SEQ ID:9765 and SEQ ID:19050 respectively, to the nucleotide sequence of GAM7957 RNA, herein designated GAM RNA, also designated SEQ ID:297.

Another function of GAM7957 is therefore inhibition of NALP12 (Accession NP_653288.1). Accordingly, utilities of GAM7957 include diagnosis, prevention and treatment of diseases and clinical conditions associated with NALP12.

NAP4 (Accession XP_294897.2) is another GAM7957 target gene, herein designated TARGET GENE. NAP4 BINDING SITE is a target binding site found in the 3' untranslated region of mRNA encoded by NAP4, corresponding to a target binding site such as BINDING SITE I, BINDING SITE II or BINDING SITE III of FIG. 8. Table 4 illustrates the complementarity of the nucleotide sequences of NAP4 BINDING SITE, designated SEQ ID:9627, to the nucleotide sequence of GAM7957 RNA, herein designated GAM RNA, also designated SEQ ID:297.

Another function of GAM7957 is therefore inhibition of NAP4 (Accession XP_294897.2). Accordingly, utilities of GAM7957 include diagnosis, prevention and treatment of diseases and clinical conditions associated with NAP4.

N-acetyltransferase 5 (ard1 homolog, s. cerevisiae) (NAT5, Accession NP_852668.1) is another GAM7957 target gene, herein designated TARGET GENE. NAT5 BINDING SITE is a target binding site found in the 3' untranslated region of multiple transcripts of mRNA encoded by NAT5, corresponding to a target binding site such as BINDING SITE I, BINDING SITE II or BINDING SITE III of FIG. 8. Table 4 illustrates the complementarity of the nucleotide sequences of NAT5 BINDING SITE, designated SEQ ID:19510, to the nucleotide sequence of GAM7957 RNA, herein designated GAM RNA, also designated SEQ ID:297.

Another function of GAM7957 is therefore inhibition of N-acetyltransferase 5 (ard1 homolog, s. cerevisiae) (NAT5, Accession NP_852668.1). Accordingly, utilities of GAM7957 include diagnosis, prevention and treatment of diseases and clinical conditions associated with NAT5.

N-acetyltransferase 5 (ard1 homolog, s. cerevisiae) (NAT5, Accession NP_852669.1) is another GAM7957 target gene, herein designated TARGET GENE. NAT5 BINDING SITE is a target binding site found in the 3' untranslated region of multiple transcripts of mRNA encoded by NAT5, corresponding to a target binding site such as BINDING SITE I, BINDING SITE II or BINDING SITE III of FIG. 8. Table 4 illustrates the complementarity of the nucleotide sequences of NAT5 BINDING SITE, designated SEQ ID:19510, to the nucleotide sequence of GAM7957 RNA, herein designated GAM RNA, also designated SEQ ID:297.

Another function of GAM7957 is therefore inhibition of N-acetyltransferase 5 (ard1 homolog, s. cerevisiae) (NAT5, Accession NP_852669.1). Accordingly, utilities of GAM7957 include diagnosis, prevention and treatment of diseases and clinical conditions associated with NAT5.

N-acetyltransferase 5 (ard1 homolog, s. cerevisiae) (NAT5, Accession NP_057184.1) is another GAM7957 target gene, herein designated TARGET GENE. NAT5 BINDING SITE is a target binding site found in the 3' untranslated region of multiple transcripts of mRNA encoded by NAT5, corresponding to a target binding site such as BINDING SITE I, BINDING SITE II or BINDING SITE III of FIG. 8. Table 4 illustrates the complementarity of the nucleotide sequences of NAT5 BINDING SITE, designated SEQ ID:19510, to the nucleotide sequence of GAM7957 RNA, herein designated GAM RNA, also designated SEQ ID:297.

Another function of GAM7957 is therefore inhibition of N-acetyltransferase 5 (ard1 homolog, s. cerevisiae) (NAT5, Accession NP_057184.1). Accordingly, utilities of GAM7957 include diagnosis, prevention and treatment of diseases and clinical conditions associated with NAT5.

NCAG1 (Accession NP_115536.1) is another GAM7957 target gene, herein designated TARGET GENE. NCAG1 BINDING SITE1 and NCAG1 BINDING SITE2 are target binding sites found in untranslated regions of mRNA encoded by NCAG1, corresponding to target binding sites such as BINDING SITE I, BINDING SITE II or BINDING SITE III of FIG. 8. Table 4 illustrates the complementarity of the nucleotide sequences of NCAG1 BINDING SITE1 and NCAG1 BINDING SITE2, designated SEQ ID:20079 and SEQ ID:12727 respectively, to the nucleotide sequence of GAM7957 RNA, herein designated GAM RNA, also designated SEQ ID:297.

Another function of GAM7957 is therefore inhibition of NCAG1 (Accession NP_115536.1). Accordingly, utilities of GAM7957 include diagnosis, prevention and treatment of diseases and clinical conditions associated with NCAG1.

Nadh dehydrogenase (ubiquinone) fe-s protein 2, 49 kda (nadh-coenzyme q reductase) (NDUFS2, Accession NP_004541.1) is another GAM7957 target gene, herein designated TARGET GENE. NDUFS2 BINDING SITE is a target binding site found in the 5' untranslated region of mRNA encoded by NDUFS2, corresponding to a target binding site such as BINDING SITE I, BINDING SITE II or BINDING SITE III of FIG. 8. Table 4 illustrates the complementarity of the nucleotide sequences of NDUFS2 BINDING SITE, designated SEQ ID:4978, to the nucleotide sequence of GAM7957 RNA, herein designated GAM RNA, also designated SEQ ID:297.

Another function of GAM7957 is therefore inhibition of Nadh dehydrogenase (ubiquinone) fe-s protein 2, 49 kda (nadh-coenzyme q reductase) (NDUFS2, Accession NP_004541.1). Accordingly, utilities of GAM7957 include diagnosis, prevention and treatment of diseases and clinical conditions associated with NDUFS2.

Nuclear factor of activated t-cells, cytoplasmic, calcineurin-dependent 3 (NFATC3, Accession NP_775187.1) is another GAM7957 target gene, herein designated TARGET GENE. NFATC3 BINDING SITE is a target binding site found in the 3' untranslated region of multiple transcripts of mRNA encoded by NFATC3, corresponding to a target binding site such as BINDING SITE I, BINDING SITE II or BINDING SITE III of FIG. 8. Table 4 illustrates the complementarity of the nucleotide sequences of NFATC3 BINDING SITE, designated SEQ ID:10867, to the nucleotide sequence of GAM7957 RNA, herein designated GAM RNA, also designated SEQ ID:297.

Another function of GAM7957 is therefore inhibition of Nuclear factor of activated t-cells, cytoplasmic, calcineurin-dependent 3 (NFATC3, Accession NP_775187.1), a gene which plays a role in the inducible expression of cytokine genes in t cells. Accordingly, utilities of GAM7957 include diagnosis, prevention and treatment of diseases and clinical conditions associated with NFATC3.

The function of NFATC3 and its association with various diseases and clinical conditions, has been established by previous studies, as described hereinabove with reference to GAM347.1. Nuclear factor of kappa light polypeptide gene enhancer in b-cells inhibitor-like 2 (NFKBIL2, Accession NP_038460.2) is another GAM7957 target gene, herein designated TARGET GENE. NFKBIL2 BINDING SITE is a target binding site found in the 3' untranslated region of mRNA encoded by NFKBIL2, corresponding to a target binding site such as BINDING SITE I, BINDING SITE II or BINDING SITE III of FIG. 8. Table 4 illustrates the complementarity of the nucleotide sequences of NFKBIL2 BINDING SITE, designated SEQ ID:15343, to the nucleotide sequence of GAM7957 RNA, herein designated GAM RNA, also designated SEQ ID:297.

Another function of GAM7957 is therefore inhibition of Nuclear factor of kappa light polypeptide gene enhancer in b-cells inhibitor-like 2 (NFKBIL2, Accession NP_038460.2), a gene which may have a role in regulating NF-kappa B function in epithelial cells. Accordingly, utilities of GAM7957 include diagnosis, prevention and treatment of diseases and clinical conditions associated with NFKBIL2.

The function of NFKBIL2 and its association with various diseases and clinical conditions, has been established by previous studies, as described hereinabove with reference to GAM347.2. Nuclear transcription factor, x-box binding 1 (NFX1, Accession NP_667345.1) is another GAM7957 target gene, herein designated TARGET GENE. NFX1 BINDING SITE is a target binding site found in the 3' untranslated region of multiple transcripts of mRNA encoded by NFX1, corresponding to a target binding site such as BINDING SITE I, BINDING SITE II or BINDING SITE III of FIG. 8. Table 4 illustrates the complementarity of the nucleotide sequences of NFX1 BINDING SITE, designated SEQ ID:12058, to the nucleotide sequence of GAM7957 RNA, herein designated GAM RNA, also designated SEQ ID:297.

Another function of GAM7957 is therefore inhibition of Nuclear transcription factor, x-box binding 1 (NFX1, Accession NP_667345.1) . Accordingly, utilities of GAM7957 include diagnosis, prevention and treatment of diseases and clinical conditions associated with NFX1.

Nescient helix loop helix 1 (NHLH1, Accession NP_005589.1) is another GAM7957 target gene, herein designated TARGET GENE. NHLH1 BINDING SITE is a target binding site found in the 3' untranslated region of mRNA encoded by NHLH1, corresponding to a target binding site such as BINDING SITE I, BINDING SITE II or BINDING SITE III of FIG. 8. Table 4 illustrates the complementarity of the nucleotide sequences of NHLH1 BINDING SITE, designated SEQ ID:5156, to the nucleotide sequence of GAM7957 RNA, herein designated GAM RNA, also designated SEQ ID:297.

Another function of GAM7957 is therefore inhibition of Nescient helix loop helix 1 (NHLH1, Accession NP_005589.1), a gene which may have a role in development of the nervous system. Accordingly, utilities of GAM7957 include diagnosis, prevention and treatment of diseases and clinical conditions associated with NHLH1.

The function of NHLH1 and its association with various diseases and clinical conditions, has been established by previous studies, as described hereinabove with reference to GAM354.1. NMNAT1 (Accession NP_073624.2) is another GAM7957 target gene, herein designated TARGET GENE. NMNAT1 BINDING SITE1 through NMNAT1 BINDING SITE3 are target binding sites found in untranslated regions of mRNA encoded by NMNAT1, corresponding to target binding sites such as BINDING SITE I, BINDING SITE II or BINDING SITE III of FIG. 8. Table 4 illustrates the complementarity of the nucleotide sequences of NMNAT1 BINDING SITE1 through NMNAT1 BINDING SITE3, designated SEQ ID:13691, SEQ ID:16965 and SEQ ID:15904 respectively, to the nucleotide sequence of GAM7957 RNA, herein designated GAM RNA, also designated SEQ ID:297.

Another function of GAM7957 is therefore inhibition of NMNAT1 (Accession NP_073624.2). Accordingly, utilities of GAM7957 include diagnosis, prevention and treatment of diseases and clinical conditions associated with NMNAT1.

N-myristoyltransferase 2 (NMT2, Accession NP_004799.1) is another GAM7957 target gene, herein designated TARGET GENE. NMT2 BINDING SITE is a target binding site found in the 3' untranslated region of mRNA encoded by NMT2, corresponding to a target binding site such as BINDING SITE I, BINDING SITE II or BINDING SITE III of FIG. 8. Table 4 illustrates the complementarity of the nucleotide sequences of NMT2 BINDING SITE, designated SEQ ID:8031, to the nucleotide sequence of GAM7957 RNA, herein designated GAM RNA, also designated SEQ ID:297.

Another function of GAM7957 is therefore inhibition of N-myristoyltransferase 2 (NMT2, Accession NP_004799.1). Accordingly, utilities of GAM7957 include diagnosis, prevention and treatment of diseases and clinical conditions associated with NMT2.

Nodal homolog (mouse) (NODAL, Accession NP_060525.2) is another GAM7957 target gene, herein designated TARGET GENE. NODAL BINDING SITE is a target binding site found in the 3' untranslated region of mRNA encoded by NODAL, corresponding to a target binding site such as BINDING SITE I, BINDING SITE II or BINDING SITE III of FIG. 8. Table 4 illustrates the complementarity of the nucleotide sequences of NODAL BINDING SITE, designated SEQ ID:12796, to the nucleotide sequence of GAM7957 RNA, herein designated GAM RNA, also designated SEQ ID:297.

Another function of GAM7957 is therefore inhibition of Nodal homolog (mouse) (NODAL, Accession NP_060525.2). Accordingly, utilities of GAM7957 include diagnosis, prevention and treatment of diseases and clinical conditions associated with NODAL.

Non-pou domain containing, octamer-binding (NONO, Accession NP_031389.2) is another GAM7957 target gene, herein designated TARGET GENE. NONO BINDING SITE is a target binding site found in the 3' untranslated region of mRNA encoded by NONO, corresponding to a target binding site such as BINDING SITE I, BINDING SITE II or BINDING SITE III of FIG. 8. Table 4 illustrates the complementarity of the nucleotide sequences of NONO BINDING SITE, designated SEQ ID:5857, to the nucleotide sequence of GAM7957 RNA, herein designated GAM RNA, also designated SEQ ID:297.

Another function of GAM7957 is therefore inhibition of Non-pou domain containing, octamer-binding (NONO, Accession NP_031389.2), a gene which is a nuclear protein which contains RNA recognition motifs. Accordingly, utilities of GAM7957 include diagnosis, prevention and treatment of diseases and clinical conditions associated with NONO.

The function of NONO and its association with various diseases and clinical conditions, has been established by previous studies, as described hereinabove with reference to GAM189.1. Nephronophthisis 1 (juvenile) (NPHP1, Accession NP_000263.1) is another GAM7957 target gene, herein designated TARGET GENE. NPHP1 BINDING SITE is a target binding site found in the 3' untranslated region of mRNA encoded by NPHP1, corresponding to a target binding site such as BINDING SITE I, BINDING SITE II or BINDING SITE III of FIG. 8. Table 4 illustrates the complementarity of the nucleotide sequences of NPHP1 BINDING SITE, designated SEQ ID:15224, to the nucleotide sequence of GAM7957 RNA, herein designated GAM RNA, also designated SEQ ID:297.

Another function of GAM7957 is therefore inhibition of Nephronophthisis 1 (juvenile) (NPHP1, Accession NP_000263.1). Accordingly, utilities of GAM7957 include diagnosis, prevention and treatment of diseases and clinical conditions associated with NPHP1.

Nephrosis 1, congenital, finnish type (nephrin) (NPHS1, Accession NP_004637.1) is another GAM7957 target gene, herein designated TARGET GENE. NPHS1 BINDING SITE is a target binding site found in the 3' untranslated region of mRNA encoded by NPHS1, corresponding to a target binding site such as BINDING SITE I, BINDING SITE II or BINDING SITE III of FIG. 8. Table 4 illustrates the complementarity of the nucleotide sequences of NPHS1 BINDING SITE, designated SEQ ID:14789, to the nucleotide sequence of GAM7957 RNA, herein designated GAM RNA, also designated SEQ ID:297.

Another function of GAM7957 is therefore inhibition of Nephrosis 1, congenital, finnish type (nephrin) (NPHS1, Accession NP_004637.1). Accordingly, utilities of GAM7957 include diagnosis, prevention and treatment of diseases and clinical conditions associated with NPHS1.

Neuronal pentraxin receptor (NPTXR, Accession NP_055108.2) is another GAM7957 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:5234, to the nucleotide sequence of GAM7957 RNA, herein designated GAM RNA, also designated SEQ ID:297.

Another function of GAM7957 is therefore inhibition of Neuronal pentraxin receptor (NPTXR, Accession NP_055108.2). Accordingly, utilities of GAM7957 include diagnosis, prevention and treatment of diseases and clinical conditions associated with NPTXR.

Neuronal pentraxin receptor (NPTXR, Accession NP_478058.1) is another GAM7957 target gene, herein designated TARGET GENE. NPTXR BINDING SITE is a target binding site found in the 3' untranslated region of multiple transcripts of mRNA encoded by NPTXR, corresponding to a target binding site such as BINDING SITE I, BINDING SITE II or BINDING SITE III of FIG. 8. Table 4 illustrates the complementarity of the nucleotide sequences of NPTXR BINDING SITE, designated SEQ ID:5234, to the nucleotide sequence of GAM7957 RNA, herein designated GAM RNA, also designated SEQ ID:297.

Another function of GAM7957 is therefore inhibition of Neuronal pentraxin receptor (NPTXR, Accession NP_478058.1). Accordingly, utilities of GAM7957 include diagnosis, prevention and treatment of diseases and clinical conditions associated with NPTXR.

Neuropeptide y receptor y2 (NPY2R, Accession NP_000901.1) is another GAM7957 target gene, herein designated TARGET GENE. NPY2R BINDING SITE is a target binding site found in the 3' untranslated region of mRNA encoded by NPY2R, corresponding to a target binding site such as BINDING SITE I, BINDING SITE II or BINDING SITE III of FIG. 8. Table 4 illustrates the complementarity of the nucleotide sequences of NPY2R BINDING SITE, designated SEQ ID:11027, to the nucleotide sequence of GAM7957 RNA, herein designated GAM RNA, also designated SEQ ID:297.

Another function of GAM7957 is therefore inhibition of Neuropeptide y receptor y2 (NPY2R, Accession NP_000901.1), a gene which stimulates intracellular calcium flux and may modulate psychomotor activity, food intake, endocrine secretion and vasoconstriction. Accordingly, utilities of GAM7957 include diagnosis, prevention and treatment of diseases and clinical conditions associated with NPY2R.

The function of NPY2R and its association with various diseases and clinical conditions, has been established by previous studies, as described hereinabove with reference to GAM401.1.5'-nucleotidase, cytosolic ii (NT5C2, Accession NP_036361.1) is another GAM7957 target gene, herein designated TARGET GENE. NT5C2 BINDING SITE is a target binding site found in the 3' untranslated region of mRNA encoded by NT5C2, corresponding to a target binding site such as BINDING SITE I, BINDING SITE II or BINDING SITE III of FIG. 8. Table 4 illustrates the complementarity of the nucleotide sequences of NT5C2 BINDING SITE, designated SEQ ID:19192, to the nucleotide sequence of GAM7957 RNA, herein designated GAM RNA, also designated SEQ ID:297.

Another function of GAM7957 is therefore inhibition of 5'-nucleotidase, cytosolic ii (NT5C2, Accession NP_036361.1). Accordingly, utilities of GAM7957 include diagnosis, prevention and treatment of diseases and clinical conditions associated with NT5C2.

NUP43 (Accession NP_078923.2) is another GAM7957 target gene, herein designated TARGET GENE. NUP43 BINDING SITE is a target binding site found in the 3' untranslated region of mRNA encoded by NUP43, corresponding to a target binding site such as BINDING SITE I, BINDING SITE II or BINDING SITE III of FIG. 8. Table 4 illustrates the complementarity of the nucleotide sequences of NUP43 BINDING SITE, designated SEQ ID:2851, to the nucleotide sequence of GAM7957 RNA, herein designated GAM RNA, also designated SEQ ID:297.

Another function of GAM7957 is therefore inhibition of NUP43 (Accession NP_078923.2). Accordingly, utilities of GAM7957 include diagnosis, prevention and treatment of diseases and clinical conditions associated with NUP43.

Nucleoporin 62 kda (NUP62, Accession NP_036478.2) is another GAM7957 target gene, herein designated TARGET GENE. NUP62 BINDING SITE1 and NUP62 BINDING SITE2 are target binding sites found in untranslated regions of multiple transcripts of mRNA encoded by NUP62, corresponding to target binding sites such as BINDING SITE I, BINDING SITE II or BINDING SITE III of FIG. 8. Table 4 illustrates the complementarity of the nucleotide sequences of NUP62 BINDING SITE1 and NUP62 BINDING SITE2, designated SEQ ID:12360 and SEQ ID:1492 respectively, to the nucleotide sequence of GAM7957 RNA, herein designated GAM RNA, also designated SEQ ID:297.

Another function of GAM7957 is therefore inhibition of Nucleoporin 62 kda (NUP62, Accession NP_036478.2). Accordingly, utilities of GAM7957 include diagnosis, prevention and treatment of diseases and clinical conditions associated with NUP62.

Nucleoporin 62 kda (NUP62, Accession NP_714941.1) is another GAM7957 target gene, herein designated TARGET GENE. NUP62 BINDING SITE1 and NUP62 BINDING SITE2 are target binding sites found in untranslated regions of multiple transcripts of mRNA encoded by NUP62, corresponding to target binding sites such as BINDING SITE I, BINDING SITE II or BINDING SITE III of FIG. 8. Table 4 illustrates the complementarity of the nucleotide sequences of NUP62 BINDING SITE1 and NUP62 BINDING SITE2, designated SEQ ID:1492 and SEQ ID:12360 respectively, to the nucleotide sequence of GAM7957 RNA, herein designated GAM RNA, also designated SEQ ID:297.

Another function of GAM7957 is therefore inhibition of Nucleoporin 62 kda (NUP62, Accession NP_714941.1). Accordingly, utilities of GAM7957 include diagnosis, prevention and treatment of diseases and clinical conditions associated with NUP62.

Nucleoporin 62 kda (NUP62, Accession NP_714940.1) is another GAM7957 target gene, herein designated TARGET GENE. NUP62 BINDING SITE1 and NUP62 BINDING SITE2 are target binding sites found in untranslated regions of multiple transcripts of mRNA encoded by NUP62, corresponding to target binding sites such as BINDING SITE I, BINDING SITE II or BINDING SITE III of FIG. 8. Table 4 illustrates the complementarity of the nucleotide sequences of NUP62 BINDING SITE1 and NUP62 BINDING SITE2, designated SEQ ID:1492 and SEQ ID:12360 respectively, to the nucleotide sequence of GAM7957 RNA, herein designated GAM RNA, also designated SEQ ID:297.

Another function of GAM7957 is therefore inhibition of Nucleoporin 62 kda (NUP62, Accession NP_714940.1). Accordingly, utilities of GAM7957 include diagnosis, prevention and treatment of diseases and clinical conditions associated with NUP62.

Nucleoporin 62 kda (NUP62, Accession NP_057637.2) is another GAM7957 target gene, herein designated TARGET GENE. NUP62 BINDING SITE1 and NUP62 BINDING SITE2 are target binding sites found in untranslated regions of multiple transcripts of mRNA encoded by NUP62, corresponding to target binding sites such as BINDING SITE I, BINDING SITE II or BINDING SITE III of FIG. 8. Table 4 illustrates the complementarity of the nucleotide sequences of NUP62 BINDING SITE1 and NUP62 BINDING SITE2, designated SEQ ID:12360 and SEQ ID:1492 respectively, to the nucleotide sequence of GAM7957 RNA, herein designated GAM RNA, also designated SEQ ID:297.

Another function of GAM7957 is therefore inhibition of Nucleoporin 62 kda (NUP62, Accession NP_057637.2). Accordingly, utilities of GAM7957 include diagnosis, prevention and treatment of diseases and clinical conditions associated with NUP62.

NUPL1 (Accession NP_054808.1) is another GAM7957 target gene, herein designated TARGET GENE. NUPL1 BINDING SITE is a target binding site found in the 3' untranslated region of multiple transcripts of mRNA encoded by NUPL1, corresponding to a target binding site such as BINDING SITE I, BINDING SITE II or BINDING SITE III of FIG. 8. Table 4 illustrates the complementarity of the nucleotide sequences of NUPL1 BINDING SITE, designated SEQ ID:4937, to the nucleotide sequence of GAM7957 RNA, herein designated GAM RNA, also designated SEQ ID:297.

Another function of GAM7957 is therefore inhibition of NUPL1 (Accession NP_054808.1). Accordingly, utilities of GAM7957 include diagnosis, prevention and treatment of diseases and clinical conditions associated with NUPL1.

ODAG (Accession NP_066990.2) is another GAM7957 target gene, herein designated TARGET GENE. ODAG BINDING SITE1 and ODAG BINDING SITE2 are target binding sites found in untranslated regions of mRNA encoded by ODAG, corresponding to target binding sites such as BINDING SITE I, BINDING SITE II or BINDING SITE III of FIG. 8. Table 4 illustrates the complementarity of the nucleotide sequences of ODAG BINDING SITE1 and ODAG BINDING SITE2, designated SEQ ID:15089 and SEQ ID:6298 respectively, to the nucleotide sequence of GAM7957 RNA, herein designated GAM RNA, also designated SEQ ID:297.

Another function of GAM7957 is therefore inhibition of ODAG (Accession NP_066990.2). Accordingly, utilities of GAM7957 include diagnosis, prevention and treatment of diseases and clinical conditions associated with ODAG.

8-oxoguanine dna glycosylase (OGG1, Accession NP_058213.1) is another GAM7957 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:15343, to the nucleotide sequence of GAM7957 RNA, herein designated GAM RNA, also designated SEQ ID:297.

Another function of GAM7957 is therefore inhibition of 8-oxoguanine dna glycosylase (OGG1, Accession NP_058213.1), a gene which is involved in base excision DNA repair and removal of 8-oxyguanine and therefore may be associated with Tumorigenesis. Accordingly, utilities of GAM7957 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_058212.1) is another GAM7957 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:15343, to the nucleotide sequence of GAM7957 RNA, herein designated GAM RNA, also designated SEQ ID:297.

Another function of GAM7957 is therefore inhibition of 8-oxoguanine dna glycosylase (OGG1, Accession NP_058212.1), a gene which is involved in base excision DNA repair and removal of 8-oxyguanine and therefore may be associated with Tumorigenesis. Accordingly, utilities of GAM7957 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1.8-oxoguanine dna glycosylase (OGG1, Accession NP_002533.1) is another GAM7957 target gene, herein designated TARGET GENE. OGG1 BINDING SITE is a target binding site found in the 5' untranslated region of multiple transcripts of mRNA encoded by OGG1, corresponding to a target binding site such as BINDING SITE I, BINDING SITE II or BINDING SITE III of FIG. 8. Table 4 illustrates the complementarity of the nucleotide sequences of OGG1 BINDING SITE, designated SEQ ID:15343, to the nucleotide sequence of GAM7957 RNA, herein designated GAM RNA, also designated SEQ ID:297.

Another function of GAM7957 is therefore inhibition of 8-oxoguanine dna glycosylase (OGG1, Accession NP_002533.1), a gene which is involved in base excision DNA repair and removal of 8-oxyguanine and therefore may be associated with Tumorigenesis. Accordingly, utilities of GAM7957 include diagnosis, prevention and treatment of Tumorigenesis, and of other diseases and clinical conditions associated with OGG1.

The function of OGG1 and its association with various diseases and clinical conditions, has been established by previous studies, as described hereinabove with reference to GAM63.1. Optic atrophy 3 (autosomal recessive, with chorea and spastic paraplegia) (OPA3, Accession NP_079412.1) is another GAM7957 target gene, herein designated TARGET GENE. OPA3 BINDING SITE1 and OPA3 BINDING SITE2 are target binding sites found in untranslated regions of mRNA encoded by OPA3, corresponding to target binding sites such as BINDING SITE I, BINDING SITE II or BINDING SITE III of FIG. 8. Table 4 illustrates the complementarity of the nucleotide sequences of OPA3 BINDING SITE1 and OPA3 BINDING SITE2, designated SEQ ID:1507 and SEQ ID:15089 respectively, to the nucleotide sequence of GAM7957 RNA, herein designated GAM RNA, also designated SEQ ID:297.

Another function of GAM7957 is therefore inhibition of Optic atrophy 3 (autosomal recessive, with chorea and spastic paraplegia) (OPA3, Accession NP_079412.1). Accordingly, utilities of GAM7957 include diagnosis, prevention and treatment of diseases and clinical conditions associated with OPA3.

Origin recognition complex, subunit 6 homolog-like (yeast) (ORC6L, Accession NP_055136.1) is another GAM7957 target gene, herein designated TARGET GENE. ORC6L BINDING SITE is a target binding site found in the 3' untranslated region of mRNA encoded by ORC6L, corresponding to a target binding site such as BINDING SITE I, BINDING SITE II or BINDING SITE III of FIG. 8. Table 4 illustrates the complementarity of the nucleotide sequences of ORC6L BINDING SITE, designated SEQ ID:8790, to the nucleotide sequence of GAM7957 RNA, herein designated GAM RNA, also designated SEQ ID:297.

Another function of GAM7957 is therefore inhibition of Origin recognition complex, subunit 6 homolog-like (yeast) (ORC6L, Accession NP_055136.1). Accordingly, utilities of GAM7957 include diagnosis, prevention and treatment of diseases and clinical conditions associated with ORC6L.

OS4 (Accession NP_005721.2) is another GAM7957 target gene, herein designated TARGET GENE. OS4 BINDING SITE is a target binding site found in the 3' untranslated region of mRNA encoded by OS4, corresponding to a target binding site such as BINDING SITE I, BINDING SITE II or BINDING SITE III of FIG. 8. Table 4 illustrates the complementarity of the nucleotide sequences of OS4 BINDING SITE, designated SEQ ID:18554, to the nucleotide sequence of GAM7957 RNA, herein designated GAM RNA, also designated SEQ ID:297.

Another function of GAM7957 is therefore inhibition of OS4 (Accession NP_005721.2). Accordingly, utilities of GAM7957 include diagnosis, prevention and treatment of diseases and clinical conditions associated with OS4.

Orthodenticle homolog 3 (drosophila) (OTX3, Accession NP_671725.1) is another GAM7957 target gene, herein designated TARGET GENE. OTX3 BINDING SITE is a target binding site found in the 3' untranslated region of multiple transcripts of mRNA encoded by OTX3, corresponding to a target binding site such as BINDING SITE I, BINDING SITE II or BINDING SITE III of FIG. 8. Table 4 illustrates the complementarity of the nucleotide sequences of OTX3 BINDING SITE, designated SEQ ID:12921, to the nucleotide sequence of GAM7957 RNA, herein designated GAM RNA, also designated SEQ ID:297.

Another function of GAM7957 is therefore inhibition of Orthodenticle homolog 3 (drosophila) (OTX3, Accession NP_671725.1). Accordingly, utilities of GAM7957 include diagnosis, prevention and treatment of diseases and clinical conditions associated with OTX3.

Orthodenticle homolog 3 (drosophila) (OTX3, Accession NP_757379.1) is another GAM7957 target gene, herein designated TARGET GENE. OTX3 BINDING SITE is a target binding site found in the 3' untranslated region of multiple transcripts of mRNA encoded by OTX3, corresponding to a target binding site such as BINDING SITE I, BINDING SITE II or BINDING SITE III of FIG. 8. Table 4 illustrates the complementarity of the nucleotide sequences of OTX3 BINDING SITE, designated SEQ ID:12921, to the nucleotide sequence of GAM7957 RNA, herein designated GAM RNA, also designated SEQ ID:297.

Another function of GAM7957 is therefore inhibition of Orthodenticle homolog 3 (drosophila) (OTX3, Accession NP_757379.1). Accordingly, utilities of GAM7957 include diagnosis, prevention and treatment of diseases and clinical conditions associated with OTX3.

Purinergic receptor p2x, ligand-gated ion channel, 7 (P2RX7, Accession NP_002553.2) is another GAM7957 target gene, herein designated TARGET GENE. P2RX7 BINDING SITE1 and P2RX7 BINDING SITE2 are target binding sites found in untranslated regions of multiple transcripts of mRNA encoded by P2RX7, corresponding to target binding sites such as BINDING SITE I, BINDING SITE II or BINDING SITE III of FIG. 8. Table 4 illustrates the complementarity of the nucleotide sequences of P2RX7 BINDING SITE1 and P2RX7 BINDING SITE2, designated SEQ ID:15480 and SEQ ID:11148 respectively, to the nucleotide sequence of GAM7957 RNA, herein designated GAM RNA, also designated SEQ ID:297.

Another function of GAM7957 is therefore inhibition of Purinergic receptor p2x, ligand-gated ion channel, 7 (P2RX7, Accession NP_002553.2), a gene which responsible for atp-dependent lysis of macrophages and therefore may be associated with Chronic lymphatic leukemia. Accordingly, utilities of GAM7957 include diagnosis, prevention and treatment of Chronic lymphatic leukemia, and of other diseases and clinical conditions associated with P2RX7.

The function of P2RX7 and its association with various diseases and clinical conditions, has been established by previous studies, as described hereinabove with reference to GAM72.1. Purinergic receptor p2x, ligand-gated ion channel, 7 (P2RX7, Accession NP_803176.1) is another GAM7957 target gene, herein designated TARGET GENE. P2RX7 BINDING SITE1 and P2RX7 BINDING SITE2 are target binding sites found in untranslated regions of multiple transcripts of mRNA encoded by P2RX7, corresponding to target binding sites such as BINDING SITE I, BINDING SITE II or BINDING SITE III of FIG. 8. Table 4 illustrates the complementarity of the nucleotide sequences of P2RX7 BINDING SITE1 and P2RX7 BINDING SITE2, designated SEQ ID:15480 and SEQ ID:11148 respectively, to the nucleotide sequence of GAM7957 RNA, herein designated GAM RNA, also designated SEQ ID:297.

Another function of GAM7957 is therefore inhibition of Purinergic receptor p2x, ligand-gated ion channel, 7 (P2RX7, Accession NP_803176.1), a gene which responsible for atp-dependent lysis of macrophages and therefore may be associated with Chronic lymphatic leukemia. Accordingly, utilities of GAM7957 include diagnosis, prevention and treatment of Chronic lymphatic leukemia, and of other diseases and clinical conditions associated with P2RX7.

The function of P2RX7 and its association with various diseases and clinical conditions, has been established by previous studies, as described hereinabove with reference to GAM72.1. Purinergic receptor p2y, g-protein coupled, 11 (P2RY11, Accession NP_002557.2) is another GAM7957 target gene, herein designated TARGET GENE. P2RY11 BINDING SITE is a target binding site found in the 3' untranslated region of mRNA encoded by P2RY11, corresponding to a target binding site such as BINDING SITE I, BINDING SITE II or BINDING SITE III of FIG. 8. Table 4 illustrates the complementarity of the nucleotide sequences of P2RY11 BINDING SITE, designated SEQ ID:11772, to the nucleotide sequence of GAM7957 RNA, herein designated GAM RNA, also designated SEQ ID:297.

Another function of GAM7957 is therefore inhibition of Purinergic receptor p2y, g-protein coupled, 11 (P2RY11, Accession NP_002557.2). Accordingly, utilities of GAM7957 include diagnosis, prevention and treatment of diseases and clinical conditions associated with P2RY11.

Poly(a) binding protein, nuclear 1 (PABPN1, Accession NP_004634.1) is another GAM7957 target gene, herein designated TARGET GENE. PABPN1 BINDING SITE is a target binding site found in the 5' untranslated region of mRNA encoded by PABPN1, corresponding to a target binding site such as BINDING SITE I, BINDING SITE II or BINDING SITE III of FIG. 8. Table 4 illustrates the complementarity of the nucleotide sequences of PABPN1 BINDING SITE, designated SEQ ID:18682, to the nucleotide sequence of GAM7957 RNA, herein designated GAM RNA, also designated SEQ ID:297.

Another function of GAM7957 is therefore inhibition of Poly(a) binding protein, nuclear 1 (PABPN1, Accession NP_004634.1), a gene which binds to Poly(A) and therefore is associated with Oculopharyngeal muscular dystrophy. Accordingly, utilities of GAM7957 include diagnosis, prevention and treatment of Oculopharyngeal muscular dystrophy, and of other diseases and clinical conditions associated with PABPN1.

The function of PABPN1 and its association with various diseases and clinical conditions, has been established by previous studies, as described hereinabove with reference to GAM401.1. PAF53 (Accession NP_071935.1) is another GAM7957 target gene, herein designated TARGET GENE. PAF53 BINDING SITE1 and PAF53 BINDING SITE2 are target binding sites found in untranslated regions of mRNA encoded by PAF53, corresponding to target binding sites such as BINDING SITE I, BINDING SITE II or BINDING SITE III of FIG. 8. Table 4 illustrates the complementarity of the nucleotide sequences of PAF53 BINDING SITE1 and PAF53 BINDING SITE2, designated SEQ ID:1595 and SEQ ID:9204 respectively, to the nucleotide sequence of GAM7957 RNA, herein designated GAM RNA, also designated SEQ ID:297.

Another function of GAM7957 is therefore inhibition of PAF53 (Accession NP_071935.1). Accordingly, utilities of GAM7957 include diagnosis, prevention and treatment of diseases and clinical conditions associated with PAF53.

Platelet-activating factor acetylhydrolase 2, 40 kda (PAFAH2, Accession NP_000428.2) is another GAM7957 target gene, herein designated TARGET GENE. PAFAH2 BINDING SITE is a target binding site found in the 3' untranslated region of mRNA encoded by PAFAH2, corresponding to a target binding site such as BINDING SITE I, BINDING SITE II or BINDING SITE III of FIG. 8. Table 4 illustrates the complementarity of the nucleotide sequences of PAFAH2 BINDING SITE, designated SEQ ID:17420, to the nucleotide sequence of GAM7957 RNA, herein designated GAM RNA, also designated SEQ ID:297.

Another function of GAM7957 is therefore inhibition of Platelet-activating factor acetylhydrolase 2, 40 kda (PAFAH2, Accession NP_000428.2). Accordingly, utilities of GAM7957 include diagnosis, prevention and treatment of diseases and clinical conditions associated with PAFAH2.

Phosphoribosylaminoimidazole carboxylase, phosphoribosylaminoimidazole succinocarboxamide synthetase (PAICS, Accession NP_006443.1) is another GAM7957 target gene, herein designated TARGET GENE. PAICS BINDING SITE is a target binding site found in the 3' untranslated region of mRNA encoded by PAICS, corresponding to a target binding site such as BINDING SITE I, BINDING SITE II or BINDING SITE III of FIG. 8. Table 4 illustrates the complementarity of the nucleotide sequences of PAICS BINDING SITE, designated SEQ ID:16560, to the nucleotide sequence of GAM7957 RNA, herein designated GAM RNA, also designated SEQ ID:297.

Another function of GAM7957 is therefore inhibition of Phosphoribosylaminoimidazole carboxylase, phosphoribosylaminoimidazole succinocarboxamide synthetase (PAICS, Accession NP_006443.1), a gene which is required for purine biosynthesis. Accordingly, utilities of GAM7957 include diagnosis, prevention and treatment of diseases and clinical conditions associated with PAICS.

The function of PAICS and its association with various diseases and clinical conditions, has been established by previous studies, as described hereinabove with reference to GAM96.1. Protocadherin 11 x-linked (PCDH11X, Accession NP_116749.1) is another GAM7957 target gene, herein designated TARGET GENE. PCDH11X BINDING SITE1 and PCDH11X BINDING SITE2 are target binding sites found in untranslated regions of multiple transcripts of mRNA encoded by PCDH11X, corresponding to target binding sites such as BINDING SITE I, BINDING SITE II or BINDING SITE III of FIG. 8. Table 4 illustrates the complementarity of the nucleotide sequences of PCDH11X BINDING SITE1 and PCDH11X BINDING SITE2, designated SEQ ID:4124 and SEQ ID:15343 respectively, to the nucleotide sequence of GAM7957 RNA, herein designated GAM RNA, also designated SEQ ID:297.

Another function of GAM7957 is therefore inhibition of Protocadherin 11 x-linked (PCDH11X, Accession NP_116749.1), a gene which is thought to play a fundamental role in cell-cell recognition essential for the segmental development and function of the central nervous system. Accordingly, utilities of GAM7957 include diagnosis, prevention and treatment of diseases and clinical conditions associated with PCDH11X.

The function of PCDH11X and its association with various diseases and clinical conditions, has been established by previous studies, as described hereinabove with reference to GAM347.2. Protocadherin 11 y-linked (PCDH11Y, Accession NP_116753.1) is another GAM7957 target gene, herein designated TARGET GENE. PCDH11Y BINDING SITE1 and PCDH11Y BINDING SITE2 are target binding sites found in untranslated regions of multiple transcripts of mRNA encoded by PCDH11Y, corresponding to target binding sites such as BINDING SITE I, BINDING SITE II or BINDING SITE III of FIG. 8. Table 4 illustrates the complementarity of the nucleotide sequences of PCDH11Y BINDING SITE1 and PCDH11Y BINDING SITE2, designated SEQ ID:15343 and SEQ ID:15343 respectively, to the nucleotide sequence of GAM7957 RNA, herein designated GAM RNA, also designated SEQ ID:297.

Another function of GAM7957 is therefore inhibition of Protocadherin 11 y-linked (PCDH11Y, Accession NP_116753.1). Accordingly, utilities of GAM7957 include diagnosis, prevention and treatment of diseases and clinical conditions associated with PCDH11Y.

Protocadherin 11 y-linked (PCDH11Y, Accession NP_116753.1) is another GAM7957 target gene, herein designated TARGET GENE. PCDH11Y BINDING SITE1 and PCDH11Y BINDING SITE2 are target binding sites found in untranslated regions of multiple transcripts of mRNA encoded by PCDH11Y, corresponding to target binding sites such as BINDING SITE I, BINDING SITE II or BINDING SITE III of FIG. 8. Table 4 illustrates the complementarity of the nucleotide sequences of PCDH11Y BINDING SITE1 and PCDH11Y BINDING SITE2, designated SEQ ID:13155 and SEQ ID:13155 respectively, to the nucleotide sequence of GAM7957 RNA, herein designated GAM RNA, also designated SEQ ID:297.

Another function of GAM7957 is therefore inhibition of Protocadherin 11 y-linked (PCDH11Y, Accession NP_116753.1). Accordingly, utilities of GAM7957 include diagnosis, prevention and treatment of diseases and clinical conditions associated with PCDH11Y.

Protocadherin alpha 9 (PCDHA9, Accession NP_054724.1) is another GAM7957 target gene, herein designated TARGET GENE. PCDHA9 BINDING SITE is a target binding site found in the 3' untranslated region of multiple transcripts of mRNA encoded by PCDHA9, corresponding to a target binding site such as BINDING SITE I, BINDING SITE II or BINDING SITE III of FIG. 8. Table 4 illustrates the complementarity of the nucleotide sequences of PCDHA9 BINDING SITE, designated SEQ ID:3570, to the nucleotide sequence of GAM7957 RNA, herein designated GAM RNA, also designated SEQ ID:297.

Another function of GAM7957 is therefore inhibition of Protocadherin alpha 9 (PCDHA9, Accession NP_054724.1), a gene which is a calcium-dependent cell-adhesion protein. Accordingly, utilities of GAM7957 include diagnosis, prevention and treatment of diseases and clinical conditions associated with PCDHA9.

The function of PCDHA9 and its association with various diseases and clinical conditions, has been established by previous studies, as described hereinabove with reference to GAM30.1. Protocadherin beta 9 (PCDHB9, Accession NP_061992.2) is another GAM7957 target gene, herein designated TARGET GENE. PCDHB9 BINDING SITE is a target binding site found in the 3' untranslated region of mRNA encoded by PCDHB9, corresponding to a target binding site such as BINDING SITE I, BINDING SITE II or BINDING SITE III of FIG. 8. Table 4 illustrates the complementarity of the nucleotide sequences of PCDHB9 BINDING SITE, designated SEQ ID:5830, to the nucleotide sequence of GAM7957 RNA, herein designated GAM RNA, also designated SEQ ID:297.

Another function of GAM7957 is therefore inhibition of Protocadherin beta 9 (PCDHB9, Accession NP_061992.2), a gene which is a potential calcium-dependent cell-adhesion protein. Accordingly, utilities of GAM7957 include diagnosis, prevention and treatment of diseases and clinical conditions associated with PCDHB9.

The function of PCDHB9 and its association with various diseases and clinical conditions, has been established by previous studies, as described hereinabove with reference to GAM72.1. Programmed cell death 7 (PDCD7, Accession NP_005698.1) is another GAM7957 target gene, herein designated TARGET GENE. PDCD7 BINDING SITE is a target binding site found in the 3' untranslated region of mRNA encoded by PDCD7, corresponding to a target binding site such as BINDING SITE I, BINDING SITE II or BINDING SITE III of FIG. 8. Table 4 illustrates the complementarity of the nucleotide sequences of PDCD7 BINDING SITE, designated SEQ ID:18337, to the nucleotide sequence of GAM7957 RNA, herein designated GAM RNA, also designated SEQ ID:297.

Another function of GAM7957 is therefore inhibition of Programmed cell death 7 (PDCD7, Accession NP_005698.1). Accordingly, utilities of GAM7957 include diagnosis, prevention and treatment of diseases and clinical conditions associated with PDCD7.

Phosducin-like (PDCL, Accession NP_005379.2) is another GAM7957 target gene, herein designated TARGET GENE. PDCL BINDING SITE is a target binding site found in the 3' untranslated region of mRNA encoded by PDCL, corresponding to a target binding site such as BINDING SITE I, BINDING SITE II or BINDING SITE III of FIG. 8. Table 4 illustrates the complementarity of the nucleotide sequences of PDCL BINDING SITE, designated SEQ ID:9532, to the nucleotide sequence of GAM7957 RNA, herein designated GAM RNA, also designated SEQ ID:297.

Another function of GAM7957 is therefore inhibition of Phosducin-like (PDCL, Accession NP_005379.2), a gene which may regulate G-protein signaling and similar to phosducins. Accordingly, utilities of GAM7957 include diagnosis, prevention and treatment of diseases and clinical conditions associated with PDCL.

The function of PDCL and its association with various diseases and clinical conditions, has been established by previous studies, as described hereinabove with reference to GAM30.1. Phosphodiesterase 4a, camp-specific (phosphodiesterase e2 dunce homolog, drosophila) (PDE4A, Accession NP_006193.1) is another GAM7957 target gene, herein designated TARGET GENE. PDE4A BINDING SITE is a target binding site found in the 3' untranslated region of mRNA encoded by PDE4A, corresponding to a target binding site such as BINDING SITE I, BINDING SITE II or BINDING SITE III of FIG. 8. Table 4 illustrates the complementarity of the nucleotide sequences of PDE4A BINDING SITE, designated SEQ ID:8124, to the nucleotide sequence of GAM7957 RNA, herein designated GAM RNA, also designated SEQ ID:297.

Another function of GAM7957 is therefore inhibition of Phosphodiesterase 4a, camp-specific (phosphodiesterase e2 dunce homolog, drosophila) (PDE4A, Accession NP_006193.1), a gene which is a CAMP-specific phosphodiesterase. Accordingly, utilities of GAM7957 include diagnosis, prevention and treatment of diseases and clinical conditions associated with PDE4A.

The function of PDE4A and its association with various diseases and clinical conditions, has been established by previous studies, as described hereinabove with reference to GAM197.1. Phosphodiesterase 4c, camp-specific (phosphodiesterase e1 dunce homolog, drosophila) (PDE4C, Accession NP_000914.1) is another GAM7957 target gene, herein designated TARGET GENE. PDE4C BINDING SITE is a target binding site found in the 3' untranslated region of mRNA encoded by PDE4C, corresponding to a target binding site such as BINDING SITE I, BINDING SITE II or BINDING SITE III of FIG. 8. Table 4 illustrates the complementarity of the nucleotide sequences of PDE4C BINDING SITE, designated SEQ ID:1567, to the nucleotide sequence of GAM7957 RNA, herein designated GAM RNA, also designated SEQ ID:297.

Another function of GAM7957 is therefore inhibition of Phosphodiesterase 4c, camp-specific (phosphodiesterase e1 dunce homolog, drosophila) (PDE4C, Accession NP_000914.1), a gene which is a cAMP-specific phosphodiesterase and may be a protein involved in learning and memory. Accordingly, utilities of GAM7957 include diagnosis, prevention and treatment of diseases and clinical conditions associated with PDE4C.

The function of PDE4C and its association with various diseases and clinical conditions, has been established by previous studies, as described hereinabove with reference to GAM65.1. Phosphodiesterase 7a (PDE7A, Accession NP_002595.1) is another GAM7957 target gene, herein designated TARGET GENE. PDE7A BINDING SITE is a target binding site found in the 3' untranslated region of multiple transcripts of mRNA encoded by PDE7A, corresponding to a target binding site such as BINDING SITE I, BINDING SITE II or BINDING SITE III of FIG. 8. Table 4 illustrates the complementarity of the nucleotide sequences of PDE7A BINDING SITE, designated SEQ ID:17399, to the nucleotide sequence of GAM7957 RNA, herein designated GAM RNA, also designated SEQ ID:297.

Another function of GAM7957 is therefore inhibition of Phosphodiesterase 7a (PDE7A, Accession NP_002595.1), a gene which is a CAMP- specific phosphodiesterase 7A and plays a role in signal transduction. Accordingly, utilities of GAM7957 include diagnosis, prevention and treatment of diseases and clinical conditions associated with PDE7A.

The function of PDE7A and its association with various diseases and clinical conditions, has been established by previous studies, as described hereinabove with reference to GAM347.1. PECR (Accession NP_060911.2) is another GAM7957 target gene, herein designated TARGET GENE. PECR BINDING SITE is a target binding site found in the 3' untranslated region of mRNA encoded by PECR, corresponding to a target binding site such as BINDING SITE I, BINDING SITE II or BINDING SITE III of FIG. 8. Table 4 illustrates the complementarity of the nucleotide sequences of PECR BINDING SITE, designated SEQ ID:4310, to the nucleotide sequence of GAM7957 RNA, herein designated GAM RNA, also designated SEQ ID:297.

Another function of GAM7957 is therefore inhibition of PECR (Accession NP_060911.2). Accordingly, utilities of GAM7957 include diagnosis, prevention and treatment of diseases and clinical conditions associated with PECR.

PHAX (Accession NP_115553.1) is another GAM7957 target gene, herein designated TARGET GENE. PHAX BINDING SITE1 and PHAX BINDING SITE2 are target binding sites found in untranslated regions of mRNA encoded by PHAX, corresponding to target binding sites such as BINDING SITE I, BINDING SITE II or BINDING SITE III of FIG. 8. Table 4 illustrates the complementarity of the nucleotide sequences of PHAX BINDING SITE1 and PHAX BINDING SITE2, designated SEQ ID:15984 and SEQ ID:4459 respectively, to the nucleotide sequence of GAM7957 RNA, herein designated GAM RNA, also designated SEQ ID:297.

Another function of GAM7957 is therefore inhibition of PHAX (Accession NP_115553.1). Accordingly, utilities of GAM7957 include diagnosis, prevention and treatment of diseases and clinical conditions associated with PHAX.

Phosphorylase kinase, beta (PHKB, Accession NP_000284.1) is another GAM7957 target gene, herein designated TARGET GENE. PHKB BINDING SITE1 and PHKB BINDING SITE2 are target binding sites found in untranslated regions of mRNA encoded by PHKB, corresponding to target binding sites such as BINDING SITE I, BINDING SITE II or BINDING SITE III of FIG. 8. Table 4 illustrates the complementarity of the nucleotide sequences of PHKB BINDING SITE1 and PHKB BINDING SITE2, designated SEQ ID:14137 and SEQ ID:12490 respectively, to the nucleotide sequence of GAM7957 RNA, herein designated GAM RNA, also designated SEQ ID:297.

Another function of GAM7957 is therefore inhibition of Phosphorylase kinase, beta (PHKB, Accession NP_000284.1). Accordingly, utilities of GAM7957 include diagnosis, prevention and treatment of diseases and clinical conditions associated with PHKB.

PIGO (Accession NP_690577.1) is another GAM7957 target gene, herein designated TARGET GENE. PIGO BINDING SITE is a target binding site found in the 3' untranslated region of multiple transcripts of mRNA encoded by PIGO, corresponding to a target binding site such as BINDING SITE I, BINDING SITE II or BINDING SITE III of FIG. 8. Table 4 illustrates the complementarity of the nucleotide sequences of PIGO BINDING SITE, designated SEQ ID:5114, to the nucleotide sequence of GAM7957 RNA, herein designated GAM RNA, also designated SEQ ID:297.

Another function of GAM7957 is therefore inhibition of PIGO (Accession NP_690577.1). Accordingly, utilities of GAM7957 include diagnosis, prevention and treatment of diseases and clinical conditions associated with PIGO.

PIGO (Accession NP_116023.2) is another GAM7957 target gene, herein designated TARGET GENE. PIGO BINDING SITE is a target binding site found in the 3' untranslated region of multiple transcripts of mRNA encoded by PIGO, corresponding to a target binding site such as BINDING SITE I, BINDING SITE II or BINDING SITE III of FIG. 8. Table 4 illustrates the complementarity of the nucleotide sequences of PIGO BINDING SITE, designated SEQ ID:5114, to the nucleotide sequence of GAM7957 RNA, herein designated GAM RNA, also designated SEQ ID:297.

Another function of GAM7957 is therefore inhibition of PIGO (Accession NP_116023.2). Accordingly, utilities of GAM7957 include diagnosis, prevention and treatment of diseases and clinical conditions associated with PIGO.

Phosphatidylinositol-4-phosphate 5-kinase, type ii, beta (PIP5K2B, Accession NP_619632.1) is another GAM7957 target gene, herein designated TARGET GENE. PIP5K2B BINDING SITE is a target binding site found in the 3' untranslated region of multiple transcripts of mRNA encoded by PIP5K2B, corresponding to a target binding site such as BINDING SITE I, BINDING SITE II or BINDING SITE III of FIG. 8. Table 4 illustrates the complementarity of the nucleotide sequences of PIP5K2B BINDING SITE, designated SEQ ID:3903, to the nucleotide sequence of GAM7957 RNA, herein designated GAM RNA, also designated SEQ ID:297.

Another function of GAM7957 is therefore inhibition of Phosphatidylinositol-4-phosphate 5-kinase, type ii, beta (PIP5K2B, Accession NP_619632.1). Accordingly, utilities of GAM7957 include diagnosis, prevention and treatment of diseases and clinical conditions associated with PIP5K2B.

Piwi-like 2 (drosophila) (PIWIL2, Accession NP_060538.2) is another GAM7957 target gene, herein designated TARGET GENE. PIWIL2 BINDING SITE is a target binding site found in the 3' untranslated region of mRNA encoded by PIWIL2, corresponding to a target binding site such as BINDING SITE I, BINDING SITE II or BINDING SITE III of FIG. 8. Table 4 illustrates the complementarity of the nucleotide sequences of PIWIL2 BINDING SITE, designated SEQ ID:9765, to the nucleotide sequence of GAM7957 RNA, herein designated GAM RNA, also designated SEQ ID:297.

Another function of GAM7957 is therefore inhibition of Piwi-like 2 (drosophila) (PIWIL2, Accession NP_060538.2). Accordingly, utilities of GAM7957 include diagnosis, prevention and treatment of diseases and clinical conditions associated with PIWIL2.

Phospholipase a2, group iid (PLA2G2D, Accession NP_036532.1) is another GAM7957 target gene, herein designated TARGET GENE. PLA2G2D BINDING SITE is a target binding site found in the 3' untranslated region of mRNA encoded by PLA2G2D, corresponding to a target binding site such as BINDING SITE I, BINDING SITE II or BINDING SITE III of FIG. 8. Table 4 illustrates the complementarity of the nucleotide sequences of PLA2G2D BINDING SITE, designated SEQ ID:15631, to the nucleotide sequence of GAM7957 RNA, herein designated GAM RNA, also designated SEQ ID:297.

Another function of GAM7957 is therefore inhibition of Phospholipase a2, group iid (PLA2G2D, Accession NP_036532.1), a gene which is involved in phospholipid digestion, remodeling of cell membranes, and host defense, as well as pathophysiologic processes. Accordingly, utilities of GAM7957 include diagnosis, prevention and treatment of diseases and clinical conditions associated with PLA2G2D.

The function of PLA2G2D and its association with various diseases and clinical conditions, has been established by previous studies, as described hereinabove with reference to GAM72.1. Pleckstrin homology domain containing, family b (evectins) member 2 (PLEKHB2, Accession NP_060428.1) is another GAM7957 target gene, herein designated TARGET GENE. PLEKHB2 BINDING SITE1 and PLEKHB2 BINDING SITE2 are target binding sites found in untranslated regions of mRNA encoded by PLEKHB2, corresponding to target binding sites such as BINDING SITE I, BINDING SITE II or BINDING SITE III of FIG. 8. Table 4 illustrates the complementarity of the nucleotide sequences of PLEKHB2 BINDING SITE1 and PLEKHB2 BINDING SITE2, designated SEQ ID:8068 and SEQ ID:15340 respectively, to the nucleotide sequence of GAM7957 RNA, herein designated GAM RNA, also designated SEQ ID:297.

Another function of GAM7957 is therefore inhibition of Pleckstrin homology domain containing, family b (evectins) member 2 (PLEKHB2, Accession NP_060428.1). Accordingly, utilities of GAM7957 include diagnosis, prevention and treatment of diseases and clinical conditions associated with PLEKHB2.

Polo-like kinase (drosophila) (PLK, Accession NP_005021.2) is another GAM7957 target gene, herein designated TARGET GENE. PLK BINDING SITE is a target binding site found in the 5' untranslated region of mRNA encoded by PLK, corresponding to a target binding site such as BINDING SITE I, BINDING SITE II or BINDING SITE III of FIG. 8. Table 4 illustrates the complementarity of the nucleotide sequences of PLK BINDING SITE, designated SEQ ID:1508, to the nucleotide sequence of GAM7957 RNA, herein designated GAM RNA, also designated SEQ ID:297.

Another function of GAM7957 is therefore inhibition of Polo-like kinase (drosophila) (PLK, Accession NP_005021.2). Accordingly, utilities of GAM7957 include diagnosis, prevention and treatment of diseases and clinical conditions associated with PLK.

PLPL (Accession NP_064566.1) is another GAM7957 target gene, herein designated TARGET GENE. PLPL BINDING SITE is a target binding site found in the 3' untranslated region of mRNA encoded by PLPL, corresponding to a target binding site such as BINDING SITE I, BINDING SITE II or BINDING SITE III of FIG. 8. Table 4 illustrates the complementarity of the nucleotide sequences of PLPL BINDING SITE, designated SEQ ID:699, to the nucleotide sequence of GAM7957 RNA, herein designated GAM RNA, also designated SEQ ID:297.

Another function of GAM7957 is therefore inhibition of PLPL (Accession NP_064566.1). Accordingly, utilities of GAM7957 include diagnosis, prevention and treatment of diseases and clinical conditions associated with PLPL.

PNPLA1 (Accession NP_775947.1) is another GAM7957 target gene, herein designated TARGET GENE. PNPLA1 BINDING SITE1 and PNPLA1 BINDING SITE2 are target binding sites found in untranslated regions of mRNA encoded by PNPLA1, corresponding to target binding sites such as BINDING SITE I, BINDING SITE II or BINDING SITE III of FIG. 8. Table 4 illustrates the complementarity of the nucleotide sequences of PNPLA1 BINDING SITE1 and PNPLA1 BINDING SITE2, designated SEQ ID:1493 and SEQ ID:18749 respectively, to the nucleotide sequence of GAM7957 RNA, herein designated GAM RNA, also designated SEQ ID:297.

Another function of GAM7957 is therefore inhibition of PNPLA1 (Accession NP_775947.1). Accordingly, utilities of GAM7957 include diagnosis, prevention and treatment of diseases and clinical conditions associated with PNPLA1.

Podocalyxin-like (PODXL, Accession NP_005388.1) is another GAM7957 target gene, herein designated TARGET GENE. PODXL BINDING SITE is a target binding site found in the 3' untranslated region of mRNA encoded by PODXL, corresponding to a target binding site such as BINDING SITE I, BINDING SITE II or BINDING SITE III of FIG. 8. Table 4 illustrates the complementarity of the nucleotide sequences of PODXL BINDING SITE, designated SEQ ID:19168, to the nucleotide sequence of GAM7957 RNA, herein designated GAM RNA, also designated SEQ ID:297.

Another function of GAM7957 is therefore inhibition of Podocalyxin-like (PODXL, Accession NP_005388.1), a gene which is an antiadhesin. Accordingly, utilities of GAM7957 include diagnosis, prevention and treatment of diseases and clinical conditions associated with PODXL.

The function of PODXL and its association with various diseases and clinical conditions, has been established by previous studies, as described hereinabove with reference to GAM335.1. Protein o-fucosyltransferase 1 (POFUT1, Accession NP_056167.1) is another GAM7957 target gene, herein designated TARGET GENE. POFUT1 BINDING SITE is a target binding site found in the 3' untranslated region of multiple transcripts of mRNA encoded by POFUT1, corresponding to a target binding site such as BINDING SITE I, BINDING SITE II or BINDING SITE III of FIG. 8. Table 4 illustrates the complementarity of the nucleotide sequences of POFUT1 BINDING SITE, designated SEQ ID:17423, to the nucleotide sequence of GAM7957 RNA, herein designated GAM RNA, also designated SEQ ID:297.

Another function of GAM7957 is therefore inhibition of Protein o-fucosyltransferase 1 (POFUT1, Accession NP_056167.1). Accordingly, utilities of GAM7957 include diagnosis, prevention and treatment of diseases and clinical conditions associated with POFUT1.

POLA2 (Accession NP_002680.2) is another GAM7957 target gene, herein designated TARGET GENE. POLA2 BINDING SITE is a target binding site found in the 3' untranslated region of mRNA encoded by POLA2, corresponding to a target binding site such as BINDING SITE I, BINDING SITE II or BINDING SITE III of FIG. 8. Table 4 illustrates the complementarity of the nucleotide sequences of POLA2 BINDING SITE, designated SEQ ID:3957, to the nucleotide sequence of GAM7957 RNA, herein designated GAM RNA, also designated SEQ ID:297.

Another function of GAM7957 is therefore inhibition of POLA2 (Accession NP_002680.2). Accordingly, utilities of GAM7957 include diagnosis, prevention and treatment of diseases and clinical conditions associated with POLA2.

Polymerase (dna directed), eta (POLH, Accession NP_006493.1) is another GAM7957 target gene, herein designated TARGET GENE. POLH BINDING SITE1 through POLH BINDING SITE3 are target binding sites found in untranslated regions of mRNA encoded by POLH, corresponding to target binding sites such as BINDING SITE I, BINDING SITE II or BINDING SITE III of FIG. 8. Table 4 illustrates the complementarity of the nucleotide sequences of POLH BINDING SITE1 through POLH BINDING SITE3, designated SEQ ID:6653, SEQ ID:8681 and SEQ ID:10896 respectively, to the nucleotide sequence of GAM7957 RNA, herein designated GAM RNA, also designated SEQ ID:297.

Another function of GAM7957 is therefore inhibition of Polymerase (dna directed), eta (POLH, Accession NP_006493.1). Accordingly, utilities of GAM7957 include diagnosis, prevention and treatment of diseases and clinical conditions associated with POLH.

POLR1B (Accession NP_061887.1) is another GAM7957 target gene, herein designated TARGET GENE. POLR1B BINDING SITE is a target binding site found in the 3' untranslated region of multiple transcripts of mRNA encoded by POLR1B, corresponding to a target binding site such as BINDING SITE I, BINDING SITE II or BINDING SITE III of FIG. 8. Table 4 illustrates the complementarity of the nucleotide sequences of POLR1B BINDING SITE, designated SEQ ID:732, to the nucleotide sequence of GAM7957 RNA, herein designated GAM RNA, also designated SEQ ID:297.

Another function of GAM7957 is therefore inhibition of POLR1B (Accession NP_061887.1). Accordingly, utilities of GAM7957 include diagnosis, prevention and treatment of diseases and clinical conditions associated with POLR1B.

Peroxisome proliferative activated receptor, delta (PPARD, Accession NP_006229.1) is another GAM7957 target gene, herein designated TARGET GENE. PPARD BINDING SITE1 and PPARD BINDING SITE2 are target binding sites found in untranslated regions of multiple transcripts of mRNA encoded by PPARD, corresponding to target binding sites such as BINDING SITE I, BINDING SITE II or BINDING SITE III of FIG. 8. Table 4 illustrates the complementarity of the nucleotide sequences of PPARD BINDING SITE1 and PPARD BINDING SITE2, designated SEQ ID:8364 and SEQ ID:1622 respectively, to the nucleotide sequence of GAM7957 RNA, herein designated GAM RNA, also designated SEQ ID:297.

Another function of GAM7957 is therefore inhibition of Peroxisome proliferative activated receptor, delta (PPARD, Accession NP_006229.1). Accordingly, utilities of GAM7957 include diagnosis, prevention and treatment of diseases and clinical conditions associated with PPARD.

Protein phosphatase 1f (pp2c domain containing) (PPM1F, Accession NP_055449.1) is another GAM7957 target gene, herein designated TARGET GENE. PPM1F BINDING SITE is a target binding site found in the 3' untranslated region of mRNA encoded by PPM1F, corresponding to a target binding site such as BINDING SITE I, BINDING SITE II or BINDING SITE III of FIG. 8. Table 4 illustrates the complementarity of the nucleotide sequences of PPM1F BINDING SITE, designated SEQ ID:2607, to the nucleotide sequence of GAM7957 RNA, herein designated GAM RNA, also designated SEQ ID:297.

Another function of GAM7957 is therefore inhibition of Protein phosphatase 1f (pp2c domain containing) (PPM1F, Accession NP_055449.1). Accordingly, utilities of GAM7957 include diagnosis, prevention and treatment of diseases and clinical conditions associated with PPM1F.

Protein phosphatase 1, regulatory (inhibitor) subunit 12b (PPP1R12B, Accession NP_002472.1) is another GAM7957 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:8779, to the nucleotide sequence of GAM7957 RNA, herein designated GAM RNA, also designated SEQ ID:297.

Another function of GAM7957 is therefore inhibition of Protein phosphatase 1, regulatory (inhibitor) subunit 12b (PPP1R12B, Accession NP_002472.1). Accordingly, utilities of GAM7957 include diagnosis, prevention and treatment of diseases and clinical conditions associated with PPP1R12B.

Protein phosphatase 1, regulatory (inhibitor) subunit 12b (PPP1R12B, Accession NP_115288.1) is another GAM7957 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:8779, to the nucleotide sequence of GAM7957 RNA, herein designated GAM RNA, also designated SEQ ID:297.

Another function of GAM7957 is therefore inhibition of Protein phosphatase 1, regulatory (inhibitor) subunit 12b (PPP1R12B, Accession NP_115288.1). Accordingly, utilities of GAM7957 include diagnosis, prevention and treatment of diseases and clinical conditions associated with PPP1R12B.

Protein phosphatase 1, regulatory (inhibitor) subunit 3b (PPP1R3B, Accession NP_078883.1) is another GAM7957 target gene, herein designated TARGET GENE. PPP1R3B BINDING SITE1 and PPP1R3B BINDING SITE2 are target binding sites found in untranslated regions of mRNA encoded by PPP1R3B, corresponding to target binding sites such as BINDING SITE I, BINDING SITE II or BINDING SITE III of FIG. 8. Table 4 illustrates the complementarity of the nucleotide sequences of PPP1R3B BINDING SITE1 and PPP1R3B BINDING SITE2, designated SEQ ID:15984 and SEQ ID:1492 respectively, to the nucleotide sequence of GAM7957 RNA, herein designated GAM RNA, also designated SEQ ID:297.

Another function of GAM7957 is therefore inhibition of Protein phosphatase 1, regulatory (inhibitor) subunit 3b (PPP1R3B, Accession NP_078883.1). Accordingly, utilities of GAM7957 include diagnosis, prevention and treatment of diseases and clinical conditions associated with PPP1R3B.

Protein phosphatase 2 (formerly 2a), regulatory subunit a (pr 65), beta isoform (PPP2R1B, Accession NP_002707.2) is another GAM7957 target gene, herein designated TARGET GENE. PPP2R1B BINDING SITE is a target binding site found in the 3' untranslated region of mRNA encoded by PPP2R1B, corresponding to a target binding site such as BINDING SITE I, BINDING SITE II or BINDING SITE III of FIG. 8. Table 4 illustrates the complementarity of the nucleotide sequences of PPP2R1B BINDING SITE, designated SEQ ID:9028, to the nucleotide sequence of GAM7957 RNA, herein designated GAM RNA, also designated SEQ ID:297.

Another function of GAM7957 is therefore inhibition of Protein phosphatase 2 (formerly 2a), regulatory subunit a (pr 65), beta isoform (PPP2R1B, Accession NP_002707.2), a gene which is necessary for interaction of the catalytic PP2A-C and variable PP2A-B subunits. Accordingly, utilities of GAM7957 include diagnosis, prevention and treatment of diseases and clinical conditions associated with PPP2R1B.

The function of PPP2R1B and its association with various diseases and clinical conditions, has been established by previous studies, as described hereinabove with reference to GAM94.1. Polyglutamine binding protein 1 (PQBP1, Accession NP_005701.1) is another GAM7957 target gene, herein designated TARGET GENE. PQBP1 BINDING SITE is a target binding site found in the 5' untranslated region of mRNA encoded by PQBP1, corresponding to a target binding site such as BINDING SITE I, BINDING SITE II or BINDING SITE III of FIG. 8. Table 4 illustrates the complementarity of the nucleotide sequences of PQBP1 BINDING SITE, designated SEQ ID:15439, to the nucleotide sequence of GAM7957 RNA, herein designated GAM RNA, also designated SEQ ID:297.

Another function of GAM7957 is therefore inhibition of Polyglutamine binding protein 1 (PQBP1, Accession NP_005701.1). Accordingly, utilities of GAM7957 include diagnosis, prevention and treatment of diseases and clinical conditions associated with PQBP1.

Pr domain containing 14 (PRDM14, Accession NP_078780.1) is another GAM7957 target gene, herein designated TARGET GENE. PRDM14 BINDING SITE is a target binding site found in the 3' untranslated region of mRNA encoded by PRDM14, corresponding to a target binding site such as BINDING SITE I, BINDING SITE II or BINDING SITE III of FIG. 8. Table 4 illustrates the complementarity of the nucleotide sequences of PRDM14 BINDING SITE, designated SEQ ID:13304, to the nucleotide sequence of GAM7957 RNA, herein designated GAM RNA, also designated SEQ ID:297.

Another function of GAM7957 is therefore inhibition of Pr domain containing 14 (PRDM14, Accession NP_078780.1). Accordingly, utilities of GAM7957 include diagnosis, prevention and treatment of diseases and clinical conditions associated with PRDM14.

PRIC285 (Accession NP_208384.1) is another GAM7957 target gene, herein designated TARGET GENE. PRIC285 BINDING SITE is a target binding site found in the 3' untranslated region of mRNA encoded by PRIC285, corresponding to a target binding site such as BINDING SITE I, BINDING SITE II or BINDING SITE III of FIG. 8. Table 4 illustrates the complementarity of the nucleotide sequences of PRIC285 BINDING SITE, designated SEQ ID:13230, to the nucleotide sequence of GAM7957 RNA, herein designated GAM RNA, also designated SEQ ID:297.

Another function of GAM7957 is therefore inhibition of PRIC285 (Accession NP_208384.1). Accordingly, utilities of GAM7957 include diagnosis, prevention and treatment of diseases and clinical conditions associated with PRIC285.

Protein kinase, x-linked (PRKX, Accession NP_005035.1) is another GAM7957 target gene, herein designated TARGET GENE. PRKX BINDING SITE1 and PRKX BINDING SITE2 are target binding sites found in untranslated regions of mRNA encoded by PRKX, corresponding to target binding sites such as BINDING SITE I, BINDING SITE II or BINDING SITE III of FIG. 8. Table 4 illustrates the complementarity of the nucleotide sequences of PRKX BINDING SITE1 and PRKX BINDING SITE2, designated SEQ ID:5830 and SEQ ID:13758 respectively, to the nucleotide sequence of GAM7957 RNA, herein designated GAM RNA, also designated SEQ ID:297.

Another function of GAM7957 is therefore inhibition of Protein kinase, x-linked (PRKX, Accession NP_005035.1). Accordingly, utilities of GAM7957 include diagnosis, prevention and treatment of diseases and clinical conditions associated with PRKX.

Protein kinase, y-linked (PRKY, Accession NP_002751.1) is another GAM7957 target gene, herein designated TARGET GENE. PRKY BINDING SITE1 and PRKY BINDING SITE2 are target binding sites found in untranslated regions of mRNA encoded by PRKY, corresponding to target binding sites such as BINDING SITE I, BINDING SITE II or BINDING SITE III of FIG. 8. Table 4 illustrates the complementarity of the nucleotide sequences of PRKY BINDING SITE1 and PRKY BINDING SITE2, designated SEQ ID:5494 and SEQ ID:1053 respectively, to the nucleotide sequence of GAM7957 RNA, herein designated GAM RNA, also designated SEQ ID:297.

Another function of GAM7957 is therefore inhibition of Protein kinase, y-linked (PRKY, Accession NP_002751.1), a gene which is a putative protein kinase. Accordingly, utilities of GAM7957 include diagnosis, prevention and treatment of diseases and clinical conditions associated with PRKY.

The function of PRKY and its association with various diseases and clinical conditions, has been established by previous studies, as described hereinabove with reference to GAM72.1. PRO0255 (Accession NP_054843.1) is another GAM7957 target gene, herein designated TARGET GENE. PRO0255 BINDING SITE1 and PRO0255 BINDING SITE2 are target binding sites found in untranslated regions of mRNA encoded by PRO0255, corresponding to target binding sites such as BINDING SITE I, BINDING SITE II or BINDING SITE III of FIG. 8. Table 4 illustrates the complementarity of the nucleotide sequences of PRO0255 BINDING SITE1 and PRO0255 BINDING SITE2, designated SEQ ID:5830 and SEQ ID:18286 respectively, to the nucleotide sequence of GAM7957 RNA, herein designated GAM RNA, also designated SEQ ID:297.

Another function of GAM7957 is therefore inhibition of PRO0255 (Accession NP_054843.1). Accordingly, utilities of GAM7957 include diagnosis, prevention and treatment of diseases and clinical conditions associated with PRO0255.

PRO0478 (Accession NP_054848.1) is another GAM7957 target gene, herein designated TARGET GENE. PRO0478 BINDING SITE1 through PRO0478 BINDING SITE5 are target binding sites found in untranslated regions of mRNA encoded by PRO0478, corresponding to target binding sites such as BINDING SITE I, BINDING SITE II or BINDING SITE III of FIG. 8. Table 4 illustrates the complementarity of the nucleotide sequences of PRO0478 BINDING SITE1 through PRO0478 BINDING SITE5, designated SEQ ID:12922, SEQ ID:12098, SEQ ID:1171, SEQ ID:3871 and SEQ ID:5635 respectively, to the nucleotide sequence of GAM7957 RNA, herein designated GAM RNA, also designated SEQ ID:297.

Another function of GAM7957 is therefore inhibition of PRO0478 (Accession NP_054848.1). Accordingly, utilities of GAM7957 include diagnosis, prevention and treatment of diseases and clinical conditions associated with PRO0478.

PRO0483 (Accession NP_054849.1) is another GAM7957 target gene, herein designated TARGET GENE. PRO0483 BINDING SITE1 and PRO0483 BINDING SITE2 are target binding sites found in untranslated regions of mRNA encoded by PRO0483, corresponding to target binding sites such as BINDING SITE I, BINDING SITE II or BINDING SITE III of FIG. 8. Table 4 illustrates the complementarity of the nucleotide sequences of PRO0483 BINDING SITE1 and PRO0483 BINDING SITE2, designated SEQ ID:8189 and SEQ ID:4309 respectively, to the nucleotide sequence of GAM7957 RNA, herein designated GAM RNA, also designated SEQ ID:297.

Another function of GAM7957 is therefore inhibition of PRO0483 (Accession NP_054849.1). Accordingly, utilities of GAM7957 include diagnosis, prevention and treatment of diseases and clinical conditions associated with PRO0483.

PRO0618 (Accession NP_054852.1) is another GAM7957 target gene, herein designated TARGET GENE. PRO0618 BINDING SITE1 and PRO0618 BINDING SITE2 are target binding sites found in untranslated regions of mRNA encoded by PRO0618, corresponding to target binding sites such as BINDING SITE I, BINDING SITE II or BINDING SITE III of FIG. 8. Table 4 illustrates the complementarity of the nucleotide sequences of PRO0618 BINDING SITE1 and PRO0618 BINDING SITE2, designated SEQ ID:12796 and SEQ ID:5830 respectively, to the nucleotide sequence of GAM7957 RNA, herein designated GAM RNA, also designated SEQ ID:297.

Another function of GAM7957 is therefore inhibition of PRO0618 (Accession NP_054852.1). Accordingly, utilities of GAM7957 include diagnosis, prevention and treatment of diseases and clinical conditions associated with PRO0618.

PRO1048 (Accession NP_060967.1) is another GAM7957 target gene, herein designated TARGET GENE. PRO1048 BINDING SITE1 through PRO1048 BINDING SITE3 are target binding sites found in untranslated regions of mRNA encoded by PRO1048, corresponding to target binding sites such as BINDING SITE I, BINDING SITE II or BINDING SITE III of FIG. 8. Table 4 illustrates the complementarity of the nucleotide sequences of PRO1048 BINDING SITE1 through PRO1048 BINDING SITE3, designated SEQ ID:11467, SEQ ID:7048 and SEQ ID:12433 respectively, to the nucleotide sequence of GAM7957 RNA, herein designated GAM RNA, also designated SEQ ID:297.

Another function of GAM7957 is therefore inhibition of PRO1048 (Accession NP_060967.1). Accordingly, utilities of GAM7957 include diagnosis, prevention and treatment of diseases and clinical conditions associated with PRO1048.

PRO1496 (Accession NP_061073.1) is another GAM7957 target gene, herein designated TARGET GENE. PRO1496 BINDING SITE is a target binding site found in the 3' untranslated region of mRNA encoded by PRO1496, corresponding to a target binding site such as BINDING SITE I, BINDING SITE II or BINDING SITE III of FIG. 8. Table 4 illustrates the complementarity of the nucleotide sequences of PRO1496 BINDING SITE, designated SEQ ID:4729, to the nucleotide sequence of GAM7957 RNA, herein designated GAM RNA, also designated SEQ ID:297.

Another function of GAM7957 is therefore inhibition of PRO1496 (Accession NP_061073.1). Accordingly, utilities of GAM7957 include diagnosis, prevention and treatment of diseases and clinical conditions associated with PRO1496.

PRO2015 (Accession NP_060982.1) is another GAM7957 target gene, herein designated TARGET GENE. PRO2015 BINDING SITE is a target binding site found in the 3' untranslated region of mRNA encoded by PRO2015, corresponding to a target binding site such as BINDING SITE I, BINDING SITE II or BINDING SITE III of FIG. 8. Table 4 illustrates the complementarity of the nucleotide sequences of PRO2015 BINDING SITE, designated SEQ ID:18687, to the nucleotide sequence of GAM7957 RNA, herein designated GAM RNA, also designated SEQ ID:297.

Another function of GAM7957 is therefore inhibition of PRO2015 (Accession NP_060982.1). Accordingly, utilities of GAM7957 include diagnosis, prevention and treatment of diseases and clinical conditions associated with PRO2015.

PRO2198 (Accession NP_061091.1) is another GAM7957 target gene, herein designated TARGET GENE. PRO2198 BINDING SITE is a target binding site found in the 5' untranslated region of mRNA encoded by PRO2198, corresponding to a target binding site such as BINDING SITE I, BINDING SITE II or BINDING SITE III of FIG. 8. Table 4 illustrates the complementarity of the nucleotide sequences of PRO2198 BINDING SITE, designated SEQ ID:8909, to the nucleotide sequence of GAM7957 RNA, herein designated GAM RNA, also designated SEQ ID:297.

Another function of GAM7957 is therefore inhibition of PRO2198 (Accession NP_061091.1). Accordingly, utilities of GAM7957 include diagnosis, prevention and treatment of diseases and clinical conditions associated with PRO2198.

PRO2730 (Accession NP_079498.1) is another GAM7957 target gene, herein designated TARGET GENE. PRO2730 BINDING SITE is a target binding site found in the 3' untranslated region of mRNA encoded by PRO2730, corresponding to a target binding site such as BINDING SITE I, BINDING SITE II or BINDING SITE III of FIG. 8. Table 4 illustrates the complementarity of the nucleotide sequences of PRO2730 BINDING SITE, designated SEQ ID:17419, to the nucleotide sequence of GAM7957 RNA, herein designated GAM RNA, also designated SEQ ID:297.

Another function of GAM7957 is therefore inhibition of PRO2730 (Accession NP_079498.1). Accordingly, utilities of GAM7957 include diagnosis, prevention and treatment of diseases and clinical conditions associated with PRO2730.

PRO2964 (Accession NP_061017.1) is another GAM7957 target gene, herein designated TARGET GENE. PRO2964 BINDING SITE1 and PRO2964 BINDING SITE2 are target binding sites found in untranslated regions of mRNA encoded by PRO2964, corresponding to target binding sites such as BINDING SITE I, BINDING SITE II or BINDING SITE III of FIG. 8. Table 4 illustrates the complementarity of the nucleotide sequences of PRO2964 BINDING SITE1 and PRO2964 BINDING SITE2, designated SEQ ID:15343 and SEQ ID:13155 respectively, to the nucleotide sequence of GAM7957 RNA, herein designated GAM RNA, also designated SEQ ID:297.

Another function of GAM7957 is therefore inhibition of PRO2964 (Accession NP_061017.1). Accordingly, utilities of GAM7957 include diagnosis, prevention and treatment of diseases and clinical conditions associated with PRO2964.

Prp4 pre-mrna processing factor 4 homolog (yeast) (PRPF4, Accession NP_004688.2) is another GAM7957 target gene, herein designated TARGET GENE. PRPF4 BINDING SITE is a target binding site found in the 3' untranslated region of mRNA encoded by PRPF4, corresponding to a target binding site such as BINDING SITE I, BINDING SITE II or BINDING SITE III of FIG. 8. Table 4 illustrates the complementarity of the nucleotide sequences of PRPF4 BINDING SITE, designated SEQ ID:3935, to the nucleotide sequence of GAM7957 RNA, herein designated GAM RNA, also designated SEQ ID:297.

Another function of GAM7957 is therefore inhibition of Prp4 pre-mrna processing factor 4 homolog (yeast) (PRPF4, Accession NP_004688.2). Accordingly, utilities of GAM7957 include diagnosis, prevention and treatment of diseases and clinical conditions associated with PRPF4.

Periaxin (PRX, Accession NP_066007.1) is another GAM7957 target gene, herein designated TARGET GENE. PRX BINDING SITE1 and PRX BINDING SITE2 are target binding sites found in untranslated regions of mRNA encoded by PRX, corresponding to target binding sites such as BINDING SITE I, BINDING SITE II or BINDING SITE III of FIG. 8. Table 4 illustrates the complementarity of the nucleotide sequences of PRX BINDING SITE1 and PRX BINDING SITE2, designated SEQ ID:14564 and SEQ ID:6121 respectively, to the nucleotide sequence of GAM7957 RNA, herein designated GAM RNA, also designated SEQ ID:297.

Another function of GAM7957 is therefore inhibition of Periaxin (PRX, Accession NP_066007.1), a gene which seems to be required for maintenance of peripheral nerve myelin sheath. may have a role in axon-glial interactions, possibly by interacting with the cytoplasmic domains of integral membrane proteins such as myelin- associated glycoprotein in the periaxonal regions of the schwann cell plasma membrane. may have a role in the early phases of myelin deposition and therefore is associated with Dejerine-sottas neuropathy, autosomal recessive. Accordingly, utilities of GAM7957 include diagnosis, prevention and treatment of Dejerine-sottas neuropathy, autosomal recessive, and of other diseases and clinical conditions associated with PRX.

The function of PRX and its association with various diseases and clinical conditions, has been established by previous studies, as described hereinabove with reference to GAM30.1. Pleckstrin homology, sec7 and coiled/coil domains 3 (PSCD3, Accession NP_004218.1) is another GAM7957 target gene, herein designated TARGET GENE. PSCD3 BINDING SITE is a target binding site found in the 3' untranslated region of mRNA encoded by PSCD3, corresponding to a target binding site such as BINDING SITE I, BINDING SITE II or BINDING SITE III of FIG. 8. Table 4 illustrates the complementarity of the nucleotide sequences of PSCD3 BINDING SITE, designated SEQ ID:1543, to the nucleotide sequence of GAM7957 RNA, herein designated GAM RNA, also designated SEQ ID:297.

Another function of GAM7957 is therefore inhibition of Pleckstrin homology, sec7 and coiled/coil domains 3 (PSCD3, Accession NP_004218.1), a gene which regulates vesicle trafficking in eukaryotic cells. Accordingly, utilities of GAM7957 include diagnosis, prevention and treatment of diseases and clinical conditions associated with PSCD3.

The function of PSCD3 and its association with various diseases and clinical conditions, has been established by previous studies, as described hereinabove with reference to GAM650.2. PSK (Accession NP_057235.1) is another GAM7957 target gene, herein designated TARGET GENE. PSK BINDING SITE is a target binding site found in the 5' untranslated region of mRNA encoded by PSK, corresponding to a target binding site such as BINDING SITE I, BINDING SITE II or BINDING SITE III of FIG. 8. Table 4 illustrates the complementarity of the nucleotide sequences of PSK BINDING SITE, designated SEQ ID:2797, to the nucleotide sequence of GAM7957 RNA, herein designated GAM RNA, also designated SEQ ID:297.

Another function of GAM7957 is therefore inhibition of PSK (Accession NP_057235.1). Accordingly, utilities of GAM7957 include diagnosis, prevention and treatment of diseases and clinical conditions associated with PSK.

Proteasome (prosome, macropain) 26s subunit, non-atpase, 5 (PSMD5, Accession NP_005038.1) is another GAM7957 target gene, herein designated TARGET GENE. PSMD5 BINDING SITE is a target binding site found in the 3' untranslated region of mRNA encoded by PSMD5, corresponding to a target binding site such as BINDING SITE I, BINDING SITE II or BINDING SITE III of FIG. 8. Table 4 illustrates the complementarity of the nucleotide sequences of PSMD5 BINDING SITE, designated SEQ ID:2976, to the nucleotide sequence of GAM7957 RNA, herein designated GAM RNA, also designated SEQ ID:297.

Another function of GAM7957 is therefore inhibition of Proteasome (prosome, macropain) 26s subunit, non-atpase, 5 (PSMD5, Accession NP_005038.1), a gene which is the non-ATPase subunit 5 of the 26S proteasome (prosome macropain). Accordingly, utilities of GAM7957 include diagnosis, prevention and treatment of diseases and clinical conditions associated with PSMD5.

The function of PSMD5 and its association with various diseases and clinical conditions, has been established by previous studies, as described hereinabove with reference to GAM190.1. Platelet-activating factor receptor (PTAFR, Accession NP_000943.1) is another GAM7957 target gene, herein designated TARGET GENE. PTAFR BINDING SITE is a target binding site found in the 3' untranslated region of mRNA encoded by PTAFR, corresponding to a target binding site such as BINDING SITE I, BINDING SITE II or BINDING SITE III of FIG. 8. Table 4 illustrates the complementarity of the nucleotide sequences of PTAFR BINDING SITE, designated SEQ ID:18066, to the nucleotide sequence of GAM7957 RNA, herein designated GAM RNA, also designated SEQ ID:297.

Another function of GAM7957 is therefore inhibition of Platelet-activating factor receptor (PTAFR, Accession NP_000943.1), a gene which is a platelet-activating factor receptor. Accordingly, utilities of GAM7957 include diagnosis, prevention and treatment of diseases and clinical conditions associated with PTAFR.

The function of PTAFR and its association with various diseases and clinical conditions, has been established by previous studies, as described hereinabove with reference to GAM347.1. Prostaglandin i2 (prostacyclin) synthase (PTGIS, Accession NP_000952.1) is another GAM7957 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:7315, to the nucleotide sequence of GAM7957 RNA, herein designated GAM RNA, also designated SEQ ID:297.

Another function of GAM7957 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM7957 include diagnosis, prevention and treatment of diseases and clinical conditions associated with PTGIS.

The function of PTGIS and its association with various diseases and clinical conditions, has been established by previous studies, as described hereinabove with reference to GAM30.1. Prostaglandin-endoperoxide synthase 1 (prostaglandin g/h synthase and cyclooxygenase) (PTGS1, Accession NP_542158.1) is another GAM7957 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:12185, to the nucleotide sequence of GAM7957 RNA, herein designated GAM RNA, also designated SEQ ID:297.

Another function of GAM7957 is therefore inhibition of Prostaglandin-endoperoxide synthase 1 (prostaglandin g/h synthase and cyclooxygenase) (PTGS1, Accession NP_542158.1), a gene which may play an important role in regulating or promoting cell proliferation in some normal and neoplastically transformed cells. Accordingly, utilities of GAM7957 include diagnosis, prevention and treatment of diseases and clinical conditions associated with PTGS1.

The function of PTGS1 and its association with various diseases and clinical conditions, has been established by previous studies, as described hereinabove with reference to GAM40.1. Prostaglandin-endoperoxide synthase 1 (prostaglandin g/h synthase and cyclooxygenase) (PTGS1, Accession NP_000953.2) is another GAM7957 target gene, herein designated TARGET GENE. PTGS1 BINDING SITE is a target binding site found in the 3' untranslated region of multiple transcripts of mRNA encoded by PTGS1, corresponding to a target binding site such as BINDING SITE I, BINDING SITE II or BINDING SITE III of FIG. 8. Table 4 illustrates the complementarity of the nucleotide sequences of PTGS1 BINDING SITE, designated SEQ ID:12185, to the nucleotide sequence of GAM7957 RNA, herein designated GAM RNA, also designated SEQ ID:297.

Another function of GAM7957 is therefore inhibition of Prostaglandin-endoperoxide synthase 1 (prostaglandin g/h synthase and cyclooxygenase) (PTGS1, Accession NP_000953.2), a gene which may play an important role in regulating or promoting cell proliferation in some normal and neoplastically transformed cells. Accordingly, utilities of GAM7957 include diagnosis, prevention and treatment of diseases and clinical conditions associated with PTGS1.

The function of PTGS1 and its association with various diseases and clinical conditions, has been established by previous studies, as described hereinabove with reference to GAM40.1. Ptk6 protein tyrosine kinase 6 (PTK6, Accession NP_005966.1) is another GAM7957 target gene, herein designated TARGET GENE. PTK6 BINDING SITE is a target binding site found in the 3' untranslated region of mRNA encoded by PTK6, corresponding to a target binding site such as BINDING SITE I, BINDING SITE II or BINDING SITE III of FIG. 8. Table 4 illustrates the complementarity of the nucleotide sequences of PTK6 BINDING SITE, designated SEQ ID:15675, to the nucleotide sequence of GAM7957 RNA, herein designated GAM RNA, also designated SEQ ID:297.

Another function of GAM7957 is therefore inhibition of Ptk6 protein tyrosine kinase 6 (PTK6, Accession NP_005966.1). Accordingly, utilities of GAM7957 include diagnosis, prevention and treatment of diseases and clinical conditions associated with PTK6.

Polymerase i and transcript release factor (PTRF, Accession NP_036364.1) is another GAM7957 target gene, herein designated TARGET GENE. PTRF BINDING SITE is a target binding site found in the 3' untranslated region of mRNA encoded by PTRF, corresponding to a target binding site such as BINDING SITE I, BINDING SITE II or BINDING SITE III of FIG. 8. Table 4 illustrates the complementarity of the nucleotide sequences of PTRF BINDING SITE, designated SEQ ID:11379, to the nucleotide sequence of GAM7957 RNA, herein designated GAM RNA, also designated SEQ ID:297.

Another function of GAM7957 is therefore inhibition of Polymerase i and transcript release factor (PTRF, Accession NP_036364.1). Accordingly, utilities of GAM7957 include diagnosis, prevention and treatment of diseases and clinical conditions associated with PTRF.

QRSL1 (Accession NP_060762.2) is another GAM7957 target gene, herein designated TARGET GENE. QRSL1 BINDING SITE is a target binding site found in the 3' untranslated region of mRNA encoded by QRSL1, corresponding to a target binding site such as BINDING SITE I, BINDING SITE II or BINDING SITE III of FIG. 8. Table 4 illustrates the complementarity of the nucleotide sequences of QRSL1 BINDING SITE, designated SEQ ID:17699, to the nucleotide sequence of GAM7957 RNA, herein designated GAM RNA, also designated SEQ ID:297.

Another function of GAM7957 is therefore inhibition of QRSL1 (Accession NP_060762.2). Accordingly, utilities of GAM7957 include diagnosis, prevention and treatment of diseases and clinical conditions associated with QRSL1.

Rab3d, member ras oncogene family (RAB3D, Accession NP_004274.1) is another GAM7957 target gene, herein designated TARGET GENE. RAB3D BINDING SITE is a target binding site found in the 3' untranslated region of mRNA encoded by RAB3D, corresponding to a target binding site such as BINDING SITE I, BINDING SITE II or BINDING SITE III of FIG. 8. Table 4 illustrates the complementarity of the nucleotide sequences of RAB3D BINDING SITE, designated SEQ ID:19319, to the nucleotide sequence of GAM7957 RNA, herein designated GAM RNA, also designated SEQ ID:297.

Another function of GAM7957 is therefore inhibition of Rab3d, member ras oncogene family (RAB3D, Accession NP_004274.1). Accordingly, utilities of GAM7957 include diagnosis, prevention and treatment of diseases and clinical conditions associated with RAB3D.

Rab4b, member ras oncogene family (RAB4B, Accession NP_057238.2) is another GAM7957 target gene, herein designated TARGET GENE. RAB4B BINDING SITE1 and RAB4B BINDING SITE2 are target binding sites found in untranslated regions of mRNA encoded by RAB4B, corresponding to target binding sites such as BINDING SITE I, BINDING SITE II or BINDING SITE III of FIG. 8. Table 4 illustrates the complementarity of the nucleotide sequences of RAB4B BINDING SITE1 and RAB4B BINDING SITE2, designated SEQ ID:15221 and SEQ ID:15089 respectively, to the nucleotide sequence of GAM7957 RNA, herein designated GAM RNA, also designated SEQ ID:297.

Another function of GAM7957 is therefore inhibition of Rab4b, member ras oncogene family (RAB4B, Accession NP_057238.2). Accordingly, utilities of GAM7957 include diagnosis, prevention and treatment of diseases and clinical conditions associated with RAB4B.

Rab5b, member ras oncogene family (RAB5B, Accession NP_002859.1) is another GAM7957 target gene, herein designated TARGET GENE. RAB5B BINDING SITE is a target binding site found in the 3' untranslated region of mRNA encoded by RAB5B, corresponding to a target binding site such as BINDING SITE I, BINDING SITE II or BINDING SITE III of FIG. 8. Table 4 illustrates the complementarity of the nucleotide sequences of RAB5B BINDING SITE, designated SEQ ID:14174, to the nucleotide sequence of GAM7957 RNA, herein designated GAM RNA, also designated SEQ ID:297.

Another function of GAM7957 is therefore inhibition of Rab5b, member ras oncogene family (RAB5B, Accession NP_002859.1), a gene which is presumably involved in vesicular trafficking at the plasma membrane. Accordingly, utilities of GAM7957 include diagnosis, prevention and treatment of diseases and clinical conditions associated with RAB5B.

The function of RAB5B and its association with various diseases and clinical conditions, has been established by previous studies, as described hereinabove with reference to GAM408.1. Rab7, member ras oncogene family-like 1 (RAB7L1, Accession NP_003920.1) is another GAM7957 target gene, herein designated TARGET GENE. RAB7L1 BINDING SITE1 and RAB7L1 BINDING SITE2 are target binding sites found in untranslated regions of mRNA encoded by RAB7L1, corresponding to target binding sites such as BINDING SITE I, BINDING SITE II or BINDING SITE III of FIG. 8. Table 4 illustrates the complementarity of the nucleotide sequences of RAB7L1 BINDING SITE1 and RAB7L1 BINDING SITE2, designated SEQ ID:2925 and SEQ ID:16970 respectively, to the nucleotide sequence of GAM7957 RNA, herein designated GAM RNA, also designated SEQ ID:297.

Another function of GAM7957 is therefore inhibition of Rab7, member ras oncogene family-like 1 (RAB7L1, Accession NP_003920.1). Accordingly, utilities of GAM7957 include diagnosis, prevention and treatment of diseases and clinical conditions associated with RAB7L1.

Rab9b, member ras oncogene family (RAB9B, Accession NP_057454.1) is another GAM7957 target gene, herein designated TARGET GENE. RAB9B BINDING SITE is a target binding site found in the 5' untranslated region of mRNA encoded by RAB9B, corresponding to a target binding site such as BINDING SITE I, BINDING SITE II or BINDING SITE III of FIG. 8. Table 4 illustrates the complementarity of the nucleotide sequences of RAB9B BINDING SITE, designated SEQ ID:20013, to the nucleotide sequence of GAM7957 RNA, herein designated GAM RNA, also designated SEQ ID:297.

Another function of GAM7957 is therefore inhibition of Rab9b, member ras oncogene family (RAB9B, Accession NP_057454.1). Accordingly, utilities of GAM7957 include diagnosis, prevention and treatment of diseases and clinical conditions associated with RAB9B.

Rad1 homolog (s. pombe) (RAD1, Accession NP_002844.1) is another GAM7957 target gene, herein designated TARGET GENE. RAD1 BINDING SITE1 and RAD1 BINDING SITE2 are target binding sites found in untranslated regions of multiple transcripts of mRNA encoded by RAD1, corresponding to target binding sites such as BINDING SITE I, BINDING SITE II or BINDING SITE III of FIG. 8. Table 4 illustrates the complementarity of the nucleotide sequences of RAD1 BINDING SITE1 and RAD1 BINDING SITE2, designated SEQ ID:19050 and SEQ ID:19050 respectively, to the nucleotide sequence of GAM7957 RNA, herein designated GAM RNA, also designated SEQ ID:297.

Another function of GAM7957 is therefore inhibition of Rad1 homolog (s. pombe) (RAD1, Accession NP_002844.1), a gene which has important roles in DNA damage-activated mitotic and meiotic cell cycle checkpoints. Accordingly, utilities of GAM7957 include diagnosis, prevention and treatment of diseases and clinical conditions associated with RAD1.

The function of RAD1 and its association with various diseases and clinical conditions, has been established by previous studies, as described hereinabove with reference to GAM39.1. Rad1 homolog (s. pombe) (RAD1, Accession NP_596868.1) is another GAM7957 target gene, herein designated TARGET GENE. RAD1 BINDING SITE1 and RAD1 BINDING SITE2 are target binding sites found in untranslated regions of multiple transcripts of mRNA encoded by RAD1, corresponding to target binding sites such as BINDING SITE I, BINDING SITE II or BINDING SITE III of FIG. 8. Table 4 illustrates the complementarity of the nucleotide sequences of RAD1 BINDING SITE1 and RAD1 BINDING SITE2, designated SEQ ID:20138 and SEQ ID:19050 respectively, to the nucleotide sequence of GAM7957 RNA, herein designated GAM RNA, also designated SEQ ID:297.

Another function of GAM7957 is therefore inhibition of Rad1 homolog (s. pombe) (RAD1, Accession NP_596868.1), a gene which has important roles in DNA damage-activated mitotic and meiotic cell cycle checkpoints. Accordingly, utilities of GAM7957 include diagnosis, prevention and treatment of diseases and clinical conditions associated with RAD1.

The function of RAD1 and its association with various diseases and clinical conditions, has been established by previous studies, as described hereinabove with reference to GAM39.1. Rad1 homolog (s. pombe) (RAD1, Accession NP_579816.1) is another GAM7957 target gene, herein designated TARGET GENE. RAD1 BINDING SITE1 and RAD1 BINDING SITE2 are target binding sites found in untranslated regions of multiple transcripts of mRNA encoded by RAD1, corresponding to target binding sites such as BINDING SITE I, BINDING SITE II or BINDING SITE III of FIG. 8. Table 4 illustrates the complementarity of the nucleotide sequences of RAD1 BINDING SITE1 and RAD1 BINDING SITE2, designated SEQ ID:20138 and SEQ ID:20138 respectively, to the nucleotide sequence of GAM7957 RNA, herein designated GAM RNA, also designated SEQ ID:297.

Another function of GAM7957 is therefore inhibition of Rad1 homolog (s. pombe) (RAD1, Accession NP_579816.1), a gene which has important roles in DNA damage-activated mitotic and meiotic cell cycle checkpoints. Accordingly, utilities of GAM7957 include diagnosis, prevention and treatment of diseases and clinical conditions associated with RAD1.

The function of RAD1 and its association with various diseases and clinical conditions, has been established by previous studies, as described hereinabove with reference to GAM39.1. Rad51 homolog (reca homolog, e. coli) (s. cerevisiae) (RAD51, Accession NP_002866.2) is another GAM7957 target gene, herein designated TARGET GENE. RAD51 BINDING SITE is a target binding site found in the 3' untranslated region of multiple transcripts of mRNA encoded by RAD51, corresponding to a target binding site such as BINDING SITE I, BINDING SITE II or BINDING SITE III of FIG. 8. Table 4 illustrates the complementarity of the nucleotide sequences of RAD51 BINDING SITE, designated SEQ ID:3609, to the nucleotide sequence of GAM7957 RNA, herein designated GAM RNA, also designated SEQ ID:297.

Another function of GAM7957 is therefore inhibition of Rad51 homolog (reca homolog, e. coli) (s. cerevisiae) (RAD51, Accession NP_002866.2). Accordingly, utilities of GAM7957 include diagnosis, prevention and treatment of diseases and clinical conditions associated with RAD51.

Rad51 homolog (reca homolog, e. coli) (s. cerevisiae) (RAD51, Accession NP_597994.1) is another GAM7957 target gene, herein designated TARGET GENE. RAD51 BINDING SITE is a target binding site found in the 3' untranslated region of multiple transcripts of mRNA encoded by RAD51, corresponding to a target binding site such as BINDING SITE I, BINDING SITE II or BINDING SITE III of FIG. 8. Table 4 illustrates the complementarity of the nucleotide sequences of RAD51 BINDING SITE, designated SEQ ID:3609, to the nucleotide sequence of GAM7957 RNA, herein designated GAM RNA, also designated SEQ ID:297.

Another function of GAM7957 is therefore inhibition of Rad51 homolog (reca homolog, e. coli) (s. cerevisiae) (RAD51, Accession NP_597994.1). Accordingly, utilities of GAM7957 include diagnosis, prevention and treatment of diseases and clinical conditions associated with RAD51.

Retinoblastoma binding protein 5 (RBBP5, Accession NP_005048.1) is another GAM7957 target gene, herein designated TARGET GENE. RBBP5 BINDING SITE is a target binding site found in the 3' untranslated region of mRNA encoded by RBBP5, corresponding to a target binding site such as BINDING SITE I, BINDING SITE II or BINDING SITE III of FIG. 8. Table 4 illustrates the complementarity of the nucleotide sequences of RBBP5 BINDING SITE, designated SEQ ID:6786, to the nucleotide sequence of GAM7957 RNA, herein designated GAM RNA, also designated SEQ ID:297.

Another function of GAM7957 is therefore inhibition of Retinoblastoma binding protein 5 (RBBP5, Accession NP_005048.1). Accordingly, utilities of GAM7957 include diagnosis, prevention and treatment of diseases and clinical conditions associated with RBBP5.

Retinoblastoma-like 1 (p107) (RBL1, Accession NP_002886.1) is another GAM7957 target gene, herein designated TARGET GENE. RBL1 BINDING SITE is a target binding site found in the 3' untranslated region of mRNA encoded by RBL1, corresponding to a target binding site such as BINDING SITE I, BINDING SITE II or BINDING SITE III of FIG. 8. Table 4 illustrates the complementarity of the nucleotide sequences of RBL1 BINDING SITE, designated SEQ ID:19648, to the nucleotide sequence of GAM7957 RNA, herein designated GAM RNA, also designated SEQ ID:297.

Another function of GAM7957 is therefore inhibition of Retinoblastoma-like 1 (p107) (RBL1, Accession NP_002886.1), a gene which has an important role in negatively regulating the rate of progression of the cell cycle. Accordingly, utilities of GAM7957 include diagnosis, prevention and treatment of diseases and clinical conditions associated with RBL1.

The function of RBL1 and its association with various diseases and clinical conditions, has been established by previous studies, as described hereinabove with reference to GAM72.1. Rna binding motif protein 10 (RBM10, Accession NP_690595.1) is another GAM7957 target gene, herein designated TARGET GENE. RBM10 BINDING SITE is a target binding site found in the 5' untranslated region of multiple transcripts of mRNA encoded by RBM10, corresponding to a target binding site such as BINDING SITE I, BINDING SITE II or BINDING SITE III of FIG. 8. Table 4 illustrates the complementarity of the nucleotide sequences of RBM10 BINDING SITE, designated SEQ ID:14218, to the nucleotide sequence of GAM7957 RNA, herein designated GAM RNA, also designated SEQ ID:297.

Another function of GAM7957 is therefore inhibition of Rna binding motif protein 10 (RBM10, Accession NP_690595.1), a gene which has RNA-binding activity. Accordingly, utilities of GAM7957 include diagnosis, prevention and treatment of diseases and clinical conditions associated with RBM10.

The function of RBM10 and its association with various diseases and clinical conditions, has been established by previous studies, as described hereinabove with reference to GAM234.1. Rna binding motif protein 10 (RBM10, Accession NP_005667.2) is another GAM7957 target gene, herein designated TARGET GENE. RBM10 BINDING SITE is a target binding site found in the 5' untranslated region of multiple transcripts of mRNA encoded by RBM10, corresponding to a target binding site such as BINDING SITE I, BINDING SITE II or BINDING SITE III of FIG. 8. Table 4 illustrates the complementarity of the nucleotide sequences of RBM10 BINDING SITE, designated SEQ ID:14218, to the nucleotide sequence of GAM7957 RNA, herein designated GAM RNA, also designated SEQ ID:297.

Another function of GAM7957 is therefore inhibition of Rna binding motif protein 10 (RBM10, Accession NP_005667.2), a gene which has RNA-binding activity. Accordingly, utilities of GAM7957 include diagnosis, prevention and treatment of diseases and clinical conditions associated with RBM10.

The function of RBM10 and its association with various diseases and clinical conditions, has been established by previous studies, as described hereinabove with reference to GAM234.1. Rna binding motif protein 3 (RBM3, Accession NP_006734.1) is another GAM7957 target gene, herein designated TARGET GENE. RBM3 BINDING SITE is a target binding site found in the 3' untranslated region of mRNA encoded by RBM3, corresponding to a target binding site such as BINDING SITE I, BINDING SITE II or BINDING SITE III of FIG. 8. Table 4 illustrates the complementarity of the nucleotide sequences of RBM3 BINDING SITE, designated SEQ ID:14780, to the nucleotide sequence of GAM7957 RNA, herein designated GAM RNA, also designated SEQ ID:297.

Another function of GAM7957 is therefore inhibition of Rna binding motif protein 3 (RBM3, Accession NP_006734.1). Accordingly, utilities of GAM7957 include diagnosis, prevention and treatment of diseases and clinical conditions associated with RBM3.

Reticulocalbin 1, ef-hand calcium binding domain (RCN1, Accession NP_002892.1) is another GAM7957 target gene, herein designated TARGET GENE. RCN1 BINDING SITE is a target binding site found in the 3' untranslated region of mRNA encoded by RCN1, corresponding to a target binding site such as BINDING SITE I, BINDING SITE II or BINDING SITE III of FIG. 8. Table 4 illustrates the complementarity of the nucleotide sequences of RCN1 BINDING SITE, designated SEQ ID:904, to the nucleotide sequence of GAM7957 RNA, herein designated GAM RNA, also designated SEQ ID:297.

Another function of GAM7957 is therefore inhibition of Reticulocalbin 1, ef-hand calcium binding domain (RCN1, Accession NP_002892.1), a gene which may regulate calcium-dependent activities in the ER lumen or post-ER compartment. Accordingly, utilities of GAM7957 include diagnosis, prevention and treatment of diseases and clinical conditions associated with RCN1.

The function of RCN1 and its association with various diseases and clinical conditions, has been established by previous studies, as described hereinabove with reference to GAM767.1. RDC1 (Accession XP_051522.2) is another GAM7957 target gene, herein designated TARGET GENE. RDC1 BINDING SITE is a target binding site found in the 3' untranslated region of multiple transcripts of mRNA encoded by RDC1, corresponding to a target binding site such as BINDING SITE I, BINDING SITE II or BINDING SITE III of FIG. 8. Table 4 illustrates the complementarity of the nucleotide sequences of RDC1 BINDING SITE, designated SEQ ID:15888, to the nucleotide sequence of GAM7957 RNA, herein designated GAM RNA, also designated SEQ ID:297.

Another function of GAM7957 is therefore inhibition of RDC1 (Accession XP_051522.2). Accordingly, utilities of GAM7957 include diagnosis, prevention and treatment of diseases and clinical conditions associated with RDC1.

RDC1 (Accession NP_064707.1) is another GAM7957 target gene, herein designated TARGET GENE. RDC1 BINDING SITE is a target binding site found in the 3' untranslated region of multiple transcripts of mRNA encoded by RDC1, corresponding to a target binding site such as BINDING SITE I, BINDING SITE II or BINDING SITE III of FIG. 8. Table 4 illustrates the complementarity of the nucleotide sequences of RDC1 BINDING SITE, designated SEQ ID:15888, to the nucleotide sequence of GAM7957 RNA, herein designated GAM RNA, also designated SEQ ID:297.

Another function of GAM7957 is therefore inhibition of RDC1 (Accession NP_064707.1). Accordingly, utilities of GAM7957 include diagnosis, prevention and treatment of diseases and clinical conditions associated with RDC1.

Arginine-glutamic acid dipeptide (re) repeats (RERE, Accession NP_036234.2) is another GAM7957 target gene, herein designated TARGET GENE. RERE BINDING SITE is a target binding site found in the 3' untranslated region of mRNA encoded by RERE, corresponding to a target binding site such as BINDING SITE I, BINDING SITE II or BINDING SITE III of FIG. 8. Table 4 illustrates the complementarity of the nucleotide sequences of RERE BINDING SITE, designated SEQ ID:9174, to the nucleotide sequence of GAM7957 RNA, herein designated GAM RNA, also designated SEQ ID:297.

Another function of GAM7957 is therefore inhibition of Arginine-glutamic acid dipeptide (re) repeats (RERE, Accession NP_036234.2), a gene which binds DRPLA and locates in the nucleus and therefore may be associated with Dentatorubral-pallidoluysian atrophy. Accordingly, utilities of GAM7957 include diagnosis, prevention and treatment of Dentatorubral-pallidoluysian atrophy, and of other diseases and clinical conditions associated with RERE.

The function of RERE and its association with various diseases and clinical conditions, has been established by previous studies, as described hereinabove with reference to GAM47.1. Ret proto - oncogene (multiple endocrine neoplasia and medullary thyroid carcinoma 1, hirschsprung disease) (RET, Accession NP_065681.1) is another GAM7957 target gene, herein designated TARGET GENE. RET BINDING SITE is a target binding site found in the 3' untranslated region of multiple transcripts of mRNA encoded by RET, corresponding to a target binding site such as BINDING SITE I, BINDING SITE II or BINDING SITE III of FIG. 8. Table 4 illustrates the complementarity of the nucleotide sequences of RET BINDING SITE, designated SEQ ID:17434, to the nucleotide sequence of GAM7957 RNA, herein designated GAM RNA, also designated SEQ ID:297.

Another function of GAM7957 is therefore inhibition of Ret proto - oncogene (multiple endocrine neoplasia and medullary thyroid carcinoma 1, hirschsprung disease) (RET, Accession NP_065681.1), a gene which transduces signals for cell growth and differentiation. and therefore may be associated with Multiple endocrine neoplasia. Accordingly, utilities of GAM7957 include diagnosis, prevention and treatment of Multiple endocrine neoplasia, and of other diseases and clinical conditions associated with RET.

The function of RET and its association with various diseases and clinical conditions, has been established by previous studies, as described hereinabove with reference to GAM47.1. Rev3-like, catalytic subunit of dna polymerase zeta (yeast) (REV3L, Accession NP_002903.1) is another GAM7957 target gene, herein designated TARGET GENE. REV3L BINDING SITE is a target binding site found in the 5' untranslated region of mRNA encoded by REV3L, corresponding to a target binding site such as BINDING SITE I, BINDING SITE II or BINDING SITE III of FIG. 8. Table 4 illustrates the complementarity of the nucleotide sequences of REV3L BINDING SITE, designated SEQ ID:6680, to the nucleotide sequence of GAM7957 RNA, herein designated GAM RNA, also designated SEQ ID:297.

Another function of GAM7957 is therefore inhibition of Rev3-like, catalytic subunit of dna polymerase zeta (yeast) (REV3L, Accession NP_002903.1), a gene which is a catalytic subunit of DNA polymerase zeta and acts in translation replication and mutagenesis. Accordingly, utilities of GAM7957 include diagnosis, prevention and treatment of diseases and clinical conditions associated with REV3L.

The function of REV3L and its association with various diseases and clinical conditions, has been established by previous studies, as described hereinabove with reference to GAM275.1. Replication factor c (activator 1) 2, 40 kda (RFC2, Accession NP_852136.1) is another GAM7957 target gene, herein designated TARGET GENE. RFC2 BINDING SITE1 and RFC2 BINDING SITE2 are target binding sites found in untranslated regions of multiple transcripts of mRNA encoded by RFC2, corresponding to target binding sites such as BINDING SITE I, BINDING SITE II or BINDING SITE III of FIG. 8. Table 4 illustrates the complementarity of the nucleotide sequences of RFC2 BINDING SITE1 and RFC2 BINDING SITE2, designated SEQ ID:9763 and SEQ ID:9763 respectively, to the nucleotide sequence of GAM7957 RNA, herein designated GAM RNA, also designated SEQ ID:297.

Another function of GAM7957 is therefore inhibition of Replication factor c (activator 1) 2, 40 kda (RFC2, Accession NP_852136.1), a gene which is needed for the elongation of primed dna templates by dna polymerase and therefore may be associated with Williams-beuren syndrome. Accordingly, utilities of GAM7957 include diagnosis, prevention and treatment of Williams- beuren syndrome, and of other diseases and clinical conditions associated with RFC2.

The function of RFC2 and its association with various diseases and clinical conditions, has been established by previous studies, as described hereinabove with reference to GAM257.1. Replication factor c (activator 1) 2, 40 kda (RFC2, Accession NP_002905.2) is another GAM7957 target gene, herein designated TARGET GENE. RFC2 BINDING SITE1 and RFC2 BINDING SITE2 are target binding sites found in untranslated regions of multiple transcripts of mRNA encoded by RFC2, corresponding to target binding sites such as BINDING SITE I, BINDING SITE II or BINDING SITE III of FIG. 8. Table 4 illustrates the complementarity of the nucleotide sequences of RFC2 BINDING SITE1 and RFC2 BINDING SITE2, designated SEQ ID:9778 and SEQ ID:9778 respectively, to the nucleotide sequence of GAM7957 RNA, herein designated GAM RNA, also designated SEQ ID:297.

Another function of GAM7957 is therefore inhibition of Replication factor c (activator 1) 2, 40 kda (RFC2, Accession NP_002905.2), a gene which is needed for the elongation of primed dna templates by dna polymerase and therefore may be associated with Williams-beuren syndrome. Accordingly, utilities of GAM7957 include diagnosis, prevention and treatment of Williams- beuren syndrome, and of other diseases and clinical conditions associated with RFC2.

The function of RFC2 and its association with various diseases and clinical conditions, has been established by previous studies, as described hereinabove with reference to GAM257.1. RGSL2 (Accession NP_115643.1) is another GAM7957 target gene, herein designated TARGET GENE. RGSL2 BINDING SITE is a target binding site found in the 3' untranslated region of mRNA encoded by RGSL2, corresponding to a target binding site such as BINDING SITE I, BINDING SITE II or BINDING SITE III of FIG. 8. Table 4 illustrates the complementarity of the nucleotide sequences of RGSL2 BINDING SITE, designated SEQ ID:15343, to the nucleotide sequence of GAM7957 RNA, herein designated GAM RNA, also designated SEQ ID:297.

Another function of GAM7957 is therefore inhibition of RGSL2 (Accession NP_115643.1). Accordingly, utilities of GAM7957 include diagnosis, prevention and treatment of diseases and clinical conditions associated with RGSL2.

RHO6 (Accession NP_055285.1) is another GAM7957 target gene, herein designated TARGET GENE. RHO6 BINDING SITE is a target binding site found in the 5' untranslated region of mRNA encoded by RHO6, corresponding to a target binding site such as BINDING SITE I, BINDING SITE II or BINDING SITE III of FIG. 8. Table 4 illustrates the complementarity of the nucleotide sequences of RHO6 BINDING SITE, designated SEQ ID:1080, to the nucleotide sequence of GAM7957 RNA, herein designated GAM RNA, also designated SEQ ID:297.

Another function of GAM7957 is therefore inhibition of RHO6 (Accession NP_055285.1). Accordingly, utilities of GAM7957 include diagnosis, prevention and treatment of diseases and clinical conditions associated with RHO6.

Rho-related btb domain containing 3 (RHOBTB3, Accession NP_055714.1) is another GAM7957 target gene, herein designated TARGET GENE. RHOBTB3 BINDING SITE is a target binding site found in the 3' untranslated region of mRNA encoded by RHOBTB3, corresponding to a target binding site such as BINDING SITE I, BINDING SITE II or BINDING SITE III of FIG. 8. Table 4 illustrates the complementarity of the nucleotide sequences of RHOBTB3 BINDING SITE, designated SEQ ID:18151, to the nucleotide sequence of GAM7957 RNA, herein designated GAM RNA, also designated SEQ ID:297.

Another function of GAM7957 is therefore inhibition of Rho-related btb domain containing 3 (RHOBTB3, Accession NP_055714.1). Accordingly, utilities of GAM7957 include diagnosis, prevention and treatment of diseases and clinical conditions associated with RHOBTB3.

Regulating synaptic membrane exocytosis 1 (RIMS1, Accession NP_055804.1) is another GAM7957 target gene, herein designated TARGET GENE. RIMS1 BINDING SITE is a target binding site found in the 3' untranslated region of mRNA encoded by RIMS1, corresponding to a target binding site such as BINDING SITE I, BINDING SITE II or BINDING SITE III of FIG. 8. Table 4 illustrates the complementarity of the nucleotide sequences of RIMS1 BINDING SITE, designated SEQ ID:10435, to the nucleotide sequence of GAM7957 RNA, herein designated GAM RNA, also designated SEQ ID:297.

Another function of GAM7957 is therefore inhibition of Regulating synaptic membrane exocytosis 1 (RIMS1, Accession NP_055804.1), a gene which may have a regulatory role in the membrane interactions during trafficking of synaptic vesicles. Accordingly, utilities of GAM7957 include diagnosis, prevention and treatment of diseases and clinical conditions associated with RIMS1.

The function of RIMS1 and its association with various diseases and clinical conditions, has been established by previous studies, as described hereinabove with reference to GAM264.1. RNF125 (Accession NP_060301.1) is another GAM7957 target gene, herein designated TARGET GENE. RNF125 BINDING SITE is a target binding site found in the 3' untranslated region of mRNA encoded by RNF125, corresponding to a target binding site such as BINDING SITE I, BINDING SITE II or BINDING SITE III of FIG. 8. Table 4 illustrates the complementarity of the nucleotide sequences of RNF125 BINDING SITE, designated SEQ ID:11101, to the nucleotide sequence of GAM7957 RNA, herein designated GAM RNA, also designated SEQ ID:297.

Another function of GAM7957 is therefore inhibition of RNF125 (Accession NP_060301.1). Accordingly, utilities of GAM7957 include diagnosis, prevention and treatment of diseases and clinical conditions associated with RNF125.

Rho-associated, coiled-coil containing protein kinase 2 (ROCK2, Accession NP_004841.1) is another GAM7957 target gene, herein designated TARGET GENE. ROCK2 BINDING SITE is a target binding site found in the 3' untranslated region of mRNA encoded by ROCK2, corresponding to a target binding site such as BINDING SITE I, BINDING SITE II or BINDING SITE III of FIG. 8. Table 4 illustrates the complementarity of the nucleotide sequences of ROCK2 BINDING SITE, designated SEQ ID:9205, to the nucleotide sequence of GAM7957 RNA, herein designated GAM RNA, also designated SEQ ID:297.

Another function of GAM7957 is therefore inhibition of Rho-associated, coiled-coil containing protein kinase 2 (ROCK2, Accession NP_004841.1), a gene which regulates cytokinesis, smooth muscle contraction, the formation of actin stress fibers and focal adhesions. Accordingly, utilities of GAM7957 include diagnosis, prevention and treatment of diseases and clinical conditions associated with ROCK2.

The function of ROCK2 and its association with various diseases and clinical conditions, has been established by previous studies, as described hereinabove with reference to GAM90.1. RoXaN (Accession NP_060060.3) is another GAM7957 target gene, herein designated TARGET GENE. RoXaN BINDING SITE is a target binding site found in the 3' untranslated region of mRNA encoded by RoXaN, corresponding to a target binding site such as BINDING SITE I, BINDING SITE II or BINDING SITE III of FIG. 8. Table 4 illustrates the complementarity of the nucleotide sequences of RoXaN BINDING SITE, designated SEQ ID:9947, to the nucleotide sequence of GAM7957 RNA, herein designated GAM RNA, also designated SEQ ID:297.

Another function of GAM7957 is therefore inhibition of RoXaN (Accession NP_060060.3). Accordingly, utilities of GAM7957 include diagnosis, prevention and treatment of diseases and clinical conditions associated with RoXaN.

Ribophorin i (RPN1, Accession NP_002941.1) is another GAM7957 target gene, herein designated TARGET GENE. RPN1 BINDING SITE1 and RPN1 BINDING SITE2 are target binding sites found in untranslated regions of mRNA encoded by RPN1, corresponding to target binding sites such as BINDING SITE I, BINDING SITE II or BINDING SITE III of FIG. 8. Table 4 illustrates the complementarity of the nucleotide sequences of RPN1 BINDING SITE1 and RPN1 BINDING SITE2, designated SEQ ID:15089 and SEQ ID:9619 respectively, to the nucleotide sequence of GAM7957 RNA, herein designated GAM RNA, also designated SEQ ID:297.

Another function of GAM7957 is therefore inhibition of Ribophorin i (RPN1, Accession NP_002941.1), a gene which is a subunit of oligosaccharyltransferase that binds ribosomes. Accordingly, utilities of GAM7957 include diagnosis, prevention and treatment of diseases and clinical conditions associated with RPN1.

The function of RPN1 and its association with various diseases and clinical conditions, has been established by previous studies, as described hereinabove with reference to GAM221.1. Ribosomal protein s6 kinase, 52 kda, polypeptide 1 (RPS6KC1, Accession NP_036556.2) is another GAM7957 target gene, herein designated TARGET GENE. RPS6KC1 BINDING SITE is a target binding site found in the 5' untranslated region of mRNA encoded by RPS6KC1, corresponding to a target binding site such as BINDING SITE I, BINDING SITE II or BINDING SITE III of FIG. 8. Table 4 illustrates the complementarity of the nucleotide sequences of RPS6KC1 BINDING SITE, designated SEQ ID:2652, to the nucleotide sequence of GAM7957 RNA, herein designated GAM RNA, also designated SEQ ID:297.

Another function of GAM7957 is therefore inhibition of Ribosomal protein s6 kinase, 52 kda, polypeptide 1 (RPS6KC1, Accession NP_036556.2). Accordingly, utilities of GAM7957 include diagnosis, prevention and treatment of diseases and clinical conditions associated with RPS6KC1.

RRP4 (Accession NP_055100.2) is another GAM7957 target gene, herein designated TARGET GENE. RRP4 BINDING SITE is a target binding site found in the 3' untranslated region of mRNA encoded by RRP4, corresponding to a target binding site such as BINDING SITE I, BINDING SITE II or BINDING SITE III of FIG. 8. Table 4 illustrates the complementarity of the nucleotide sequences of RRP4 BINDING SITE, designated SEQ ID:9420, to the nucleotide sequence of GAM7957 RNA, herein designated GAM RNA, also designated SEQ ID:297.

Another function of GAM7957 is therefore inhibition of RRP4 (Accession NP_055100.2). Accordingly, utilities of GAM7957 include diagnosis, prevention and treatment of diseases and clinical conditions associated with RRP4.

SBP1 (Accession NP_835222.1) is another GAM7957 target gene, herein designated TARGET GENE. SBP1 BINDING SITE is a target binding site found in the 5' untranslated region of mRNA encoded by SBP1, corresponding to a target binding site such as BINDING SITE I, BINDING SITE II or BINDING SITE III of FIG. 8. Table 4 illustrates the complementarity of the nucleotide sequences of SBP1 BINDING SITE, designated SEQ ID:15055, to the nucleotide sequence of GAM7957 RNA, herein designated GAM RNA, also designated SEQ ID:297.

Another function of GAM7957 is therefore inhibition of SBP1 (Accession NP_835222.1). Accordingly, utilities of GAM7957 include diagnosis, prevention and treatment of diseases and clinical conditions associated with SBP1.

SC65 (Accession NP_006446.1) is another GAM7957 target gene, herein designated TARGET GENE. SC65 BINDING SITE1 and SC65 BINDING SITE2 are target binding sites found in untranslated regions of mRNA encoded by SC65, corresponding to target binding sites such as BINDING SITE I, BINDING SITE II or BINDING SITE III of FIG. 8. Table 4 illustrates the complementarity of the nucleotide sequences of SC65 BINDING SITE1 and SC65 BINDING SITE2, designated SEQ ID:10571 and SEQ ID:15304 respectively, to the nucleotide sequence of GAM7957 RNA, herein designated GAM RNA, also designated SEQ ID:297.

Another function of GAM7957 is therefore inhibition of SC65 (Accession NP_006446.1). Accordingly, utilities of GAM7957 include diagnosis, prevention and treatment of diseases and clinical conditions associated with SC65.

Scan domain containing 2 (SCAND2, Accession NP_378666.1) is another GAM7957 target gene, herein designated TARGET GENE. SCAND2 BINDING SITE is a target binding site found in the 3' untranslated region of multiple transcripts of mRNA encoded by SCAND2, corresponding to a target binding site such as BINDING SITE I, BINDING SITE II or BINDING SITE III of FIG. 8. Table 4 illustrates the complementarity of the nucleotide sequences of SCAND2 BINDING SITE, designated SEQ ID:12555, to the nucleotide sequence of GAM7957 RNA, herein designated GAM RNA, also designated SEQ ID:297.

Another function of GAM7957 is therefore inhibition of Scan domain containing 2 (SCAND2, Accession NP_378666.1). Accordingly, utilities of GAM7957 include diagnosis, prevention and treatment of diseases and clinical conditions associated with SCAND2.

Src family associated phosphoprotein 2 (SCAP2, Accession NP_003921.2) is another GAM7957 target gene, herein designated TARGET GENE. SCAP2 BINDING SITE is a target binding site found in the 3' untranslated region of mRNA encoded by SCAP2, corresponding to a target binding site such as BINDING SITE I, BINDING SITE II or BINDING SITE III of FIG. 8. Table 4 illustrates the complementarity of the nucleotide sequences of SCAP2 BINDING SITE, designated SEQ ID:16383, to the nucleotide sequence of GAM7957 RNA, herein designated GAM RNA, also designated SEQ ID:297.

Another function of GAM7957 is therefore inhibition of Src family associated phosphoprotein 2 (SCAP2, Accession NP_003921.2), a gene which interacts with Src family protein tyrosine kinases and SLAP/FYB (SLA). Accordingly, utilities of GAM7957 include diagnosis, prevention and treatment of diseases and clinical conditions associated with SCAP2.

The function of SCAP2 and its association with various diseases and clinical conditions, has been established by previous studies, as described hereinabove with reference to GAM257.1. SCIN (Accession NP_149119.1) is another GAM7957 target gene, herein designated TARGET GENE. SCIN BINDING SITE is a target binding site found in the 3' untranslated region of mRNA encoded by SCIN, corresponding to a target binding site such as BINDING SITE I, BINDING SITE II or BINDING SITE III of FIG. 8. Table 4 illustrates the complementarity of the nucleotide sequences of SCIN BINDING SITE, designated SEQ ID:17536, to the nucleotide sequence of GAM7957 RNA, herein designated GAM RNA, also designated SEQ ID:297.

Another function of GAM7957 is therefore inhibition of SCIN (Accession NP_149119.1). Accordingly, utilities of GAM7957 include diagnosis, prevention and treatment of diseases and clinical conditions associated with SCIN.

Sodium channel, voltage-gated, type xi, alpha polypeptide (SCN11A, Accession NP_054858.1) is another GAM7957 target gene, herein designated TARGET GENE. SCN11A BINDING SITE is a target binding site found in the 3' untranslated region of mRNA encoded by SCN11A, corresponding to a target binding site such as BINDING SITE I, BINDING SITE II or BINDING SITE III of FIG. 8. Table 4 illustrates the complementarity of the nucleotide sequences of SCN11A BINDING SITE, designated SEQ ID:15992, to the nucleotide sequence of GAM7957 RNA, herein designated GAM RNA, also designated SEQ ID:297.

Another function of GAM7957 is therefore inhibition of Sodium channel, voltage-gated, type xi, alpha polypeptide (SCN11A, Accession NP_054858.1). Accordingly, utilities of GAM7957 include diagnosis, prevention and treatment of diseases and clinical conditions associated with SCN11A.

Sodium channel, voltage-gated, type ii, beta polypeptide (SCN2B, Accession NP_004579.1) is another GAM7957 target gene, herein designated TARGET GENE. SCN2B BINDING SITE1 and SCN2B BINDING SITE2 are target binding sites found in untranslated regions of mRNA encoded by SCN2B, corresponding to target binding sites such as BINDING SITE I, BINDING SITE II or BINDING SITE III of FIG. 8. Table 4 illustrates the complementarity of the nucleotide sequences of SCN2B BINDING SITE1 and SCN2B BINDING SITE2, designated SEQ ID:3358 and SEQ ID:1782 respectively, to the nucleotide sequence of GAM7957 RNA, herein designated GAM RNA, also designated SEQ ID:297.

Another function of GAM7957 is therefore inhibition of Sodium channel, voltage-gated, type ii, beta polypeptide (SCN2B, Accession NP_004579.1), a gene which modulates channel properties. Accordingly, utilities of GAM7957 include diagnosis, prevention and treatment of diseases and clinical conditions associated with SCN2B.

The function of SCN2B and its association with various diseases and clinical conditions, has been established by previous studies, as described hereinabove with reference to GAM189.1. SCR59 (Accession NP_075559.1) is another GAM7957 target gene, herein designated TARGET GENE. SCR59 BINDING SITE is a target binding site found in the 3' untranslated region of mRNA encoded by SCR59, corresponding to a target binding site such as BINDING SITE I, BINDING SITE II or BINDING SITE III of FIG. 8. Table 4 illustrates the complementarity of the nucleotide sequences of SCR59 BINDING SITE, designated SEQ ID:3264, to the nucleotide sequence of GAM7957 RNA, herein designated GAM RNA, also designated SEQ ID:297.

Another function of GAM7957 is therefore inhibition of SCR59 (Accession NP_075559.1). Accordingly, utilities of GAM7957 include diagnosis, prevention and treatment of diseases and clinical conditions associated with SCR59.

Sec24 related gene family, member c (s. cerevisiae) (SEC24C, Accession NP_004913.1) is another GAM7957 target gene, herein designated TARGET GENE. SEC24C BINDING SITE is a target binding site found in the 3' untranslated region of mRNA encoded by SEC24C, corresponding to a target binding site such as BINDING SITE I, BINDING SITE II or BINDING SITE III of FIG. 8. Table 4 illustrates the complementarity of the nucleotide sequences of SEC24C BINDING SITE, designated SEQ ID:7132, to the nucleotide sequence of GAM7957 RNA, herein designated GAM RNA, also designated SEQ ID:297.

Another function of GAM7957 is therefore inhibition of Sec24 related gene family, member c (s. cerevisiae) (SEC24C, Accession NP_004913.1). Accordingly, utilities of GAM7957 include diagnosis, prevention and treatment of diseases and clinical conditions associated with SEC24C.

SEC61A1 (Accession NP_037468.1) is another GAM7957 target gene, herein designated TARGET GENE. SEC61A1 BINDING SITE is a target binding site found in the 3' untranslated region of mRNA encoded by SEC61A1, corresponding to a target binding site such as BINDING SITE I, BINDING SITE II or BINDING SITE III of FIG. 8. Table 4 illustrates the complementarity of the nucleotide sequences of SEC61A1 BINDING SITE, designated SEQ ID:7817, to the nucleotide sequence of GAM7957 RNA, herein designated GAM RNA, also designated SEQ ID:297.

Another function of GAM7957 is therefore inhibition of SEC61A1 (Accession NP_037468.1). Accordingly, utilities of GAM7957 include diagnosis, prevention and treatment of diseases and clinical conditions associated with SEC61A1.

Sema domain, immunoglobulin domain (ig), short basic domain, secreted, (semaphorin) 3e (SEMA3E, Accession NP_036563.1) is another GAM7957 target gene, herein designated TARGET GENE. SEMA3E BINDING SITE is a target binding site found in the 3' untranslated region of mRNA encoded by SEMA3E, corresponding to a target binding site such as BINDING SITE I, BINDING SITE II or BINDING SITE III of FIG. 8. Table 4 illustrates the complementarity of the nucleotide sequences of SEMA3E BINDING SITE, designated SEQ ID:8019, to the nucleotide sequence of GAM7957 RNA, herein designated GAM RNA, also designated SEQ ID:297.

Another function of GAM7957 is therefore inhibition of Sema domain, immunoglobulin domain (ig), short basic domain, secreted, (semaphorin) 3e (SEMA3E, Accession NP_036563.1). Accordingly, utilities of GAM7957 include diagnosis, prevention and treatment of diseases and clinical conditions associated with SEMA3E.

Sema domain, seven thrombospondin repeats (type 1 and type 1-like), transmembrane domain (tm) and short cytoplasmic domain, (semaphorin) 5a (SEMA5A, Accession NP_003957.1) is another GAM7957 target gene, herein designated TARGET GENE. SEMA5A BINDING SITE is a target binding site found in the 3' untranslated region of mRNA encoded by SEMA5A, corresponding to a target binding site such as BINDING SITE I, BINDING SITE II or BINDING SITE III of FIG. 8. Table 4 illustrates the complementarity of the nucleotide sequences of SEMA5A BINDING SITE, designated SEQ ID:5826, to the nucleotide sequence of GAM7957 RNA, herein designated GAM RNA, also designated SEQ ID:297.

Another function of GAM7957 is therefore inhibition of Sema domain, seven thrombospondin repeats (type 1 and type 1-like), transmembrane domain (tm) and short cytoplasmic domain, (semaphorin) 5a (SEMA5A, Accession NP_003957.1). Accordingly, utilities of GAM7957 include diagnosis, prevention and treatment of diseases and clinical conditions associated with SEMA5A.

Septin 1 (SEPT1, Accession NP_443070.1) is another GAM7957 target gene, herein designated TARGET GENE. SEPT1 BINDING SITE is a target binding site found in the 5' untranslated region of mRNA encoded by SEPT1, corresponding to a target binding site such as BINDING SITE I, BINDING SITE II or BINDING SITE III of FIG. 8. Table 4 illustrates the complementarity of the nucleotide sequences of SEPT1 BINDING SITE, designated SEQ ID:19489, to the nucleotide sequence of GAM7957 RNA, herein designated GAM RNA, also designated SEQ ID:297.

Another function of GAM7957 is therefore inhibition of Septin 1 (SEPT1, Accession NP_443070.1). Accordingly, utilities of GAM7957 include diagnosis, prevention and treatment of diseases and clinical conditions associated with SEPT1.

Serum/glucocorticoid regulated kinase-like (SGKL, Accession NP_733827.2) is another GAM7957 target gene, herein designated TARGET GENE. SGKL BINDING SITE1 and SGKL BINDING SITE2 are target binding sites found in untranslated regions of multiple transcripts of mRNA encoded by SGKL, corresponding to target binding sites such as BINDING SITE I, BINDING SITE II or BINDING SITE III of FIG. 8. Table 4 illustrates the complementarity of the nucleotide sequences of SGKL BINDING SITE1 and SGKL BINDING SITE2, designated SEQ ID:15249 and SEQ ID:9421 respectively, to the nucleotide sequence of GAM7957 RNA, herein designated GAM RNA, also designated SEQ ID:297.

Another function of GAM7957 is therefore inhibition of Serum/glucocorticoid regulated kinase-like (SGKL, Accession NP_733827.2). Accordingly, utilities of GAM7957 include diagnosis, prevention and treatment of diseases and clinical conditions associated with SGKL.

Serum/glucocorticoid regulated kinase-like (SGKL, Accession NP_733827.2) is another GAM7957 target gene, herein designated TARGET GENE. SGKL BINDING SITE1 and SGKL BINDING SITE2 are target binding sites found in untranslated regions of multiple transcripts of mRNA encoded by SGKL, corresponding to target binding sites such as BINDING SITE I, BINDING SITE II or BINDING SITE III of FIG. 8. Table 4 illustrates the complementarity of the nucleotide sequences of SGKL BINDING SITE1 and SGKL BINDING SITE2, designated SEQ ID:9421 and SEQ ID:15249 respectively, to the nucleotide sequence of GAM7957 RNA, herein designated GAM RNA, also designated SEQ ID:297.

Another function of GAM7957 is therefore inhibition of Serum/glucocorticoid regulated kinase-like (SGKL, Accession NP_733827.2). Accordingly, utilities of GAM7957 include diagnosis, prevention and treatment of diseases and clinical conditions associated with SGKL.

SH3YL1 (Accession NP_056492.1) is another GAM7957 target gene, herein designated TARGET GENE. SH3YL1 BINDING SITE is a target binding site found in the 5' untranslated region of mRNA encoded by SH3YL1, corresponding to a target binding site such as BINDING SITE I, BINDING SITE II or BINDING SITE III of FIG. 8. Table 4 illustrates the complementarity of the nucleotide sequences of SH3YL1 BINDING SITE, designated SEQ ID:1043, to the nucleotide sequence of GAM7957 RNA, herein designated GAM RNA, also designated SEQ ID:297.

Another function of GAM7957 is therefore inhibition of SH3YL1 (Accession NP_056492.1). Accordingly, utilities of GAM7957 include diagnosis, prevention and treatment of diseases and clinical conditions associated with SH3YL1.

SHCBP1 (Accession NP_079021.2) is another GAM7957 target gene, herein designated TARGET GENE. SHCBP1 BINDING SITE is a target binding site found in the 3' untranslated region of mRNA encoded by SHCBP1, corresponding to a target binding site such as BINDING SITE I, BINDING SITE II or BINDING SITE III of FIG. 8. Table 4 illustrates the complementarity of the nucleotide sequences of SHCBP1 BINDING SITE, designated SEQ ID:4225, to the nucleotide sequence of GAM7957 RNA, herein designated GAM RNA, also designated SEQ ID:297.

Another function of GAM7957 is therefore inhibition of SHCBP1 (Accession NP_079021.2). Accordingly, utilities of GAM7957 include diagnosis, prevention and treatment of diseases and clinical conditions associated with SHCBP1.

Split hand/foot malformation (ectrodactyly) type 3 (SHFM3, Accession NP_071322.1) is another GAM7957 target gene, herein designated TARGET GENE. SHFM3 BINDING SITE is a target binding site found in the 5' untranslated region of mRNA encoded by SHFM3, corresponding to a target binding site such as BINDING SITE I, BINDING SITE II or BINDING SITE III of FIG. 8. Table 4 illustrates the complementarity of the nucleotide sequences of SHFM3 BINDING SITE, designated SEQ ID:15889, to the nucleotide sequence of GAM7957 RNA, herein designated GAM RNA, also designated SEQ ID:297.

Another function of GAM7957 is therefore inhibition of Split hand/foot malformation (ectrodactyly) type 3 (SHFM3, Accession NP_071322.1), a gene which probably binds to some phosphorylated proteins and promotes their degradation. and therefore may be associated with Split-hand/split-foot malformation. Accordingly, utilities of GAM7957 include diagnosis, prevention and treatment of Split-hand/split-foot malformation, and of other diseases and clinical conditions associated with SHFM3.

The function of SHFM3 and its association with various diseases and clinical conditions, has been established by previous studies, as described hereinabove with reference to GAM47.1. Soc-2 suppressor of clear homolog (c. elegans) (SHOC2, Accession NP_031399.1) is another GAM7957 target gene, herein designated TARGET GENE. SHOC2 BINDING SITE is a target binding site found in the 3' untranslated region of mRNA encoded by SHOC2, corresponding to a target binding site such as BINDING SITE I, BINDING SITE II or BINDING SITE III of FIG. 8. Table 4 illustrates the complementarity of the nucleotide sequences of SHOC2 BINDING SITE, designated SEQ ID:10301, to the nucleotide sequence of GAM7957 RNA, herein designated GAM RNA, also designated SEQ ID:297.

Another function of GAM7957 is therefore inhibition of Soc-2 suppressor of clear homolog (c. elegans) (SHOC2, Accession NP_031399.1), a gene which may be a regulator of the let-60 ras pathway. Accordingly, utilities of GAM7957 include diagnosis, prevention and treatment of diseases and clinical conditions associated with SHOC2.

The function of SHOC2 and its association with various diseases and clinical conditions, has been established by previous studies, as described hereinabove with reference to GAM657.1. Sialyltransferase 8a (alpha-n-acetylneuraminate: alpha-2,8-sialyltransferase, gd3 synthase) (SIAT8A, Accession NP_003025.1) is another GAM7957 target gene, herein designated TARGET GENE. SIAT8A BINDING SITE is a target binding site found in the 5' untranslated region of mRNA encoded by SIAT8A, corresponding to a target binding site such as BINDING SITE I, BINDING SITE II or BINDING SITE III of FIG. 8. Table 4 illustrates the complementarity of the nucleotide sequences of SIAT8A BINDING SITE, designated SEQ ID:4881, to the nucleotide sequence of GAM7957 RNA, herein designated GAM RNA, also designated SEQ ID:297.

Another function of GAM7957 is therefore inhibition of Sialyltransferase 8a (alpha-n-acetylneuraminate: alpha-2,8-sialytransferase, gd3 synthase) (SIAT8A, Accession NP_003025.1). Accordingly, utilities of GAM7957 include diagnosis, prevention and treatment of diseases and clinical conditions associated with SIAT8A.

Sialic acid binding ig-like lectin 11 (SIGLEC11, Accession NP_443116.1) is another GAM7957 target gene, herein designated TARGET GENE. SIGLEC11 BINDING SITE is a target binding site found in the 3' untranslated region of mRNA encoded by SIGLEC11, corresponding to a target binding site such as BINDING SITE I, BINDING SITE II or BINDING SITE III of FIG. 8. Table 4 illustrates the complementarity of the nucleotide sequences of SIGLEC11 BINDING SITE, designated SEQ ID:9765, to the nucleotide sequence of GAM7957 RNA, herein designated GAM RNA, also designated SEQ ID:297.

Another function of GAM7957 is therefore inhibition of Sialic acid binding ig-like lectin 11 (SIGLEC11, Accession NP_443116.1). Accordingly, utilities of GAM7957 include diagnosis, prevention and treatment of diseases and clinical conditions associated with SIGLEC11.

Single-minded homolog 2 (drosophila) (SIM2, Accession NP_033664.1) is another GAM7957 target gene, herein designated TARGET GENE. SIM2 BINDING SITE is a target binding site found in the 3' untranslated region of multiple transcripts of mRNA encoded by SIM2, corresponding to a target binding site such as BINDING SITE I, BINDING SITE II or BINDING SITE III of FIG. 8. Table 4 illustrates the complementarity of the nucleotide sequences of SIM2 BINDING SITE, designated SEQ ID:15218, to the nucleotide sequence of GAM7957 RNA, herein designated GAM RNA, also designated SEQ ID:297.

Another function of GAM7957 is therefore inhibition of Single-minded homolog 2 (drosophila) (SIM2, Accession NP_033664.1), a gene which may be a master gene of cns development. and therefore may be associated with Dysmorphic features, abnormalities of brain development, down syndrome. Accordingly, utilities of GAM7957 include diagnosis, prevention and treatment of Dysmorphic features, abnormalities of brain development, down syndrome., and of other diseases and clinical conditions associated with SIM2.

The function of SIM2 and its association with various diseases and clinical conditions, has been established by previous studies, as described hereinabove with reference to GAM347.1. Solute carrier family 14 (urea transporter), member 1 (kidd blood group) (SLC14A1, Accession NP_056949.1) is another GAM7957 target gene, herein designated TARGET GENE. SLC14A1 BINDING SITE is a target binding site found in the 3' untranslated region of mRNA encoded by SLC14A1, corresponding to a target binding site such as BINDING SITE I, BINDING SITE II or BINDING SITE III of FIG. 8. Table 4 illustrates the complementarity of the nucleotide sequences of SLC14A1 BINDING SITE, designated SEQ ID:4653, to the nucleotide sequence of GAM7957 RNA, herein designated GAM RNA, also designated SEQ ID:297.

Another function of GAM7957 is therefore inhibition of Solute carrier family 14 (urea transporter), member 1 (kidd blood group) (SLC14A1, Accession NP_056949.1), a gene which is a urea transporters in spermatogenesis. and therefore may be associated with Urine concentration defect. Accordingly, utilities of GAM7957 include diagnosis, prevention and treatment of Urine concentration defect, and of other diseases and clinical conditions associated with SLC14A1.

The function of SLC14A1 and its association with various diseases and clinical conditions, has been established by previous studies, as described hereinabove with reference to GAM94.1. Solute carrier family 14 (urea transporter), member 2 (SLC14A2, Accession NP_009094.2) is another GAM7957 target gene, herein designated TARGET GENE. SLC14A2 BINDING SITE is a target binding site found in the 3' untranslated region of mRNA encoded by SLC14A2, corresponding to a target binding site such as BINDING SITE I, BINDING SITE II or BINDING SITE III of FIG. 8. Table 4 illustrates the complementarity of the nucleotide sequences of SLC14A2 BINDING SITE, designated SEQ ID:9991, to the nucleotide sequence of GAM7957 RNA, herein designated GAM RNA, also designated SEQ ID:297.

Another function of GAM7957 is therefore inhibition of Solute carrier family 14 (urea transporter), member 2 (SLC14A2, Accession NP_009094.2), a gene which is a renal urea transporter 2. and therefore may be associated with Orthostatic hypotension. Accordingly, utilities of GAM7957 include diagnosis, prevention and treatment of Orthostatic hypotension, and of other diseases and clinical conditions associated with SLC14A2.

The function of SLC14A2 and its association with various diseases and clinical conditions, has been established by previous studies, as described hereinabove with reference to GAM97.1. Solute carrier family 16 (monocarboxylic acid transporters), member 2 (putative transporter) (SLC16A2, Accession NP_006508.1) is another GAM7957 target gene, herein designated TARGET GENE. SLC16A2 BINDING SITE is a target binding site found in the 5' untranslated region of mRNA encoded by SLC16A2, corresponding to a target binding site such as BINDING SITE I, BINDING SITE II or BINDING SITE III of FIG. 8. Table 4 illustrates the complementarity of the nucleotide sequences of SLC16A2 BINDING SITE, designated SEQ ID:8449, to the nucleotide sequence of GAM7957 RNA, herein designated GAM RNA, also designated SEQ ID:297.

Another function of GAM7957 is therefore inhibition of Solute carrier family 16 (monocarboxylic acid transporters), member 2 (putative transporter) (SLC16A2, Accession NP_006508.1). Accordingly, utilities of GAM7957 include diagnosis, prevention and treatment of diseases and clinical conditions associated with SLC16A2.

Solute carrier family 17 (anion/sugar transporter), member 5 (SLC17A5, Accession NP_036566.1) is another GAM7957 target gene, herein designated TARGET GENE. SLC17A5 BINDING SITE is a target binding site found in the 3' untranslated region of mRNA encoded by SLC17A5, corresponding to a target binding site such as BINDING SITE I, BINDING SITE II or BINDING SITE III of FIG. 8. Table 4 illustrates the complementarity of the nucleotide sequences of SLC17A5 BINDING SITE, designated SEQ ID:7865, to the nucleotide sequence of GAM7957 RNA, herein designated GAM RNA, also designated SEQ ID:297.

Another function of GAM7957 is therefore inhibition of Solute carrier family 17 (anion/sugar transporter), member 5 (SLC17A5, Accession NP_036566.1), a gene which is a member of a family of anion/cation symporters and therefore may be associated with Salla disease ; infantile sialic acid storage disorder. Accordingly, utilities of GAM7957 include diagnosis, prevention and treatment of Salla disease ; infantile sialic acid storage disorder, and of other diseases and clinical conditions associated with SLC17A5.

The function of SLC17A5 and its association with various diseases and clinical conditions, has been established by previous studies, as described hereinabove with reference to GAM347.2. Solute carrier family 21 (organic anion transporter), member 9 (SLC21A9, Accession NP_009187.1) is another GAM7957 target gene, herein designated TARGET GENE. SLC21A9 BINDING SITE is a target binding site found in the 3' untranslated region of mRNA encoded by SLC21A9, corresponding to a target binding site such as BINDING SITE I, BINDING SITE II or BINDING SITE III of FIG. 8. Table 4 illustrates the complementarity of the nucleotide sequences of SLC21A9 BINDING SITE, designated SEQ ID:19542, to the nucleotide sequence of GAM7957 RNA, herein designated GAM RNA, also designated SEQ ID:297.

Another function of GAM7957 is therefore inhibition of Solute carrier family 21 (organic anion transporter), member 9 (SLC21A9, Accession NP_009187.1), a gene which is Moderately similar to SLC21A2 prostaglandin transporter. Accordingly, utilities of GAM7957 include diagnosis, prevention and treatment of diseases and clinical conditions associated with SLC21A9.

The function of SLC21A9 and its association with various diseases and clinical conditions, has been established by previous studies, as described hereinabove with reference to GAM71.1. Solute carrier family 22 (organic cation transporter), member 2 (SLC22A2, Accession NP_694861.1) is another GAM7957 target gene, herein designated TARGET GENE. SLC22A2 BINDING SITE is a target binding site found in the 3' untranslated region of multiple transcripts of mRNA encoded by SLC22A2, corresponding to a target binding site such as BINDING SITE I, BINDING SITE II or BINDING SITE III of FIG. 8. Table 4 illustrates the complementarity of the nucleotide sequences of SLC22A2 BINDING SITE, designated SEQ ID:2052, to the nucleotide sequence of GAM7957 RNA, herein designated GAM RNA, also designated SEQ ID:297.

Another function of GAM7957 is therefore inhibition of Solute carrier family 22 (organic cation transporter), member 2 (SLC22A2, Accession NP_694861.1), a gene which is an organic cation transporter that may mediate first step in cation resorption. Accordingly, utilities of GAM7957 include diagnosis, prevention and treatment of diseases and clinical conditions associated with SLC22A2.

The function of SLC22A2 and its association with various diseases and clinical conditions, has been established by previous studies, as described hereinabove with reference to GAM247.2. SLC23A3 (Accession NP_653313.1) is another GAM7957 target gene, herein designated TARGET GENE. SLC23A3 BINDING SITE is a target binding site found in the 3' untranslated region of mRNA encoded by SLC23A3, corresponding to a target binding site such as BINDING SITE I, BINDING SITE II or BINDING SITE III of FIG. 8. Table 4 illustrates the complementarity of the nucleotide sequences of SLC23A3 BINDING SITE, designated SEQ ID:7727, to the nucleotide sequence of GAM7957 RNA, herein designated GAM RNA, also designated SEQ ID:297.

Another function of GAM7957 is therefore inhibition of SLC23A3 (Accession NP_653313.1). Accordingly, utilities of GAM7957 include diagnosis, prevention and treatment of diseases and clinical conditions associated with SLC23A3.

Solute carrier family 25 (mitochondrial carrier; ornithine transporter) member 15 (SLC25A15, Accession NP_055067.1) is another GAM7957 target gene, herein designated TARGET GENE. SLC25A15 BINDING SITE is a target binding site found in the 3' untranslated region of mRNA encoded by SLC25A15, corresponding to a target binding site such as BINDING SITE I, BINDING SITE II or BINDING SITE III of FIG. 8. Table 4 illustrates the complementarity of the nucleotide sequences of SLC25A15 BINDING SITE, designated SEQ ID:12480, to the nucleotide sequence of GAM7957 RNA, herein designated GAM RNA, also designated SEQ ID:297.

Another function of GAM7957 is therefore inhibition of Solute carrier family 25 (mitochondrial carrier; ornithine transporter) member 15 (SLC25A15, Accession NP_055067.1), a gene which participates theornithine transport across inner mitochondrial membrane, from the cytoplasm to the matrix and therefore is associated with Hyperornithinemia-hyperammonemia- homocitrullinuria syndrome (hhh syndrome). Accordingly, utilities of GAM7957 include diagnosis, prevention and treatment of Hyperornithinemia-hyperammonemia- homocitrullinuria syndrome (hhh syndrome), and of other diseases and clinical conditions associated with SLC25A15.

The function of SLC25A15 and its association with various diseases and clinical conditions, has been established by previous studies, as described hereinabove with reference to GAM99.1. Solute carrier family 26, member 4 (SLC26A4, Accession NP_000432.1) is another GAM7957 target gene, herein designated TARGET GENE. SLC26A4 BINDING SITE is a target binding site found in the 3' untranslated region of mRNA encoded by SLC26A4, corresponding to a target binding site such as BINDING SITE I, BINDING SITE II or BINDING SITE III of FIG. 8. Table 4 illustrates the complementarity of the nucleotide sequences of SLC26A4 BINDING SITE, designated SEQ ID:15343, to the nucleotide sequence of GAM7957 RNA, herein designated GAM RNA, also designated SEQ ID:297.

Another function of GAM7957 is therefore inhibition of Solute carrier family 26, member 4 (SLC26A4, Accession NP_000432.1). Accordingly, utilities of GAM7957 include diagnosis, prevention and treatment of diseases and clinical conditions associated with SLC26A4.

Solute carrier family 28 (sodium-coupled nucleoside transporter), member 2 (SLC28A2, Accession NP_004203.1) is another GAM7957 target gene, herein designated TARGET GENE. SLC28A2 BINDING SITE is a target binding site found in the 3' untranslated region of mRNA encoded by SLC28A2, corresponding to a target binding site such as BINDING SITE I, BINDING SITE II or BINDING SITE III of FIG. 8. Table 4 illustrates the complementarity of the nucleotide sequences of SLC28A2 BINDING SITE, designated SEQ ID:16463, to the nucleotide sequence of GAM7957 RNA, herein designated GAM RNA, also designated SEQ ID:297.

Another function of GAM7957 is therefore inhibition of Solute carrier family 28 (sodium-coupled nucleoside transporter), member 2 (SLC28A2, Accession NP_004203.1). Accordingly, utilities of GAM7957 include diagnosis, prevention and treatment of diseases and clinical conditions associated with SLC28A2.

Solute carrier family 2 (facilitated glucose transporter), member 3 (SLC2A3, Accession NP_008862.1) is another GAM7957 target gene, herein designated TARGET GENE. SLC2A3 BINDING SITE is a target binding site found in the 3' untranslated region of mRNA encoded by SLC2A3, corresponding to a target binding site such as BINDING SITE I, BINDING SITE II or BINDING SITE III of FIG. 8. Table 4 illustrates the complementarity of the nucleotide sequences of SLC2A3 BINDING SITE, designated SEQ ID:15860, to the nucleotide sequence of GAM7957 RNA, herein designated GAM RNA, also designated SEQ ID:297.

Another function of GAM7957 is therefore inhibition of Solute carrier family 2 (facilitated glucose transporter), member 3 (SLC2A3, Accession NP_008862.1), a gene which probably is a neuronal glucose transporter. Accordingly, utilities of GAM7957 include diagnosis, prevention and treatment of diseases and clinical conditions associated with SLC2A3.

The function of SLC2A3 and its association with various diseases and clinical conditions, has been established by previous studies, as described hereinabove with reference to GAM207.2. Solute carrier family 31 (copper transporters), member 1 (SLC31A1, Accession NP_001850.1) is another GAM7957 target gene, herein designated TARGET GENE. SLC31A1 BINDING SITE is a target binding site found in the 3' untranslated region of mRNA encoded by SLC31A1, corresponding to a target binding site such as BINDING SITE I, BINDING SITE II or BINDING SITE III of FIG. 8. Table 4 illustrates the complementarity of the nucleotide sequences of SLC31A1 BINDING SITE, designated SEQ ID:18685, to the nucleotide sequence of GAM7957 RNA, herein designated GAM RNA, also designated SEQ ID:297.

Another function of GAM7957 is therefore inhibition of Solute carrier family 31 (copper transporters), member 1 (SLC31A1, Accession NP_001850.1), a gene which is involved in high-affinity copper uptake. Accordingly, utilities of GAM7957 include diagnosis, prevention and treatment of diseases and clinical conditions associated with SLC31A1.

The function of SLC31A1 and its association with various diseases and clinical conditions, has been established by previous studies, as described hereinabove with reference to GAM257.1. SLC35E1 (Accession NP_079157.2) is another GAM7957 target gene, herein designated TARGET GENE. SLC35E1 BINDING SITE is a target binding site found in the 3' untranslated region of mRNA encoded by SLC35E1, corresponding to a target binding site such as BINDING SITE I, BINDING SITE II or BINDING SITE III of FIG. 8. Table 4 illustrates the complementarity of the nucleotide sequences of SLC35E1 BINDING SITE, designated SEQ ID:6652, to the nucleotide sequence of GAM7957 RNA, herein designated GAM RNA, also designated SEQ ID:297.

Another function of GAM7957 is therefore inhibition of SLC35E1 (Accession NP_079157.2). Accordingly, utilities of GAM7957 include diagnosis, prevention and treatment of diseases and clinical conditions associated with SLC35E1.

SLC35E2 (Accession XP_049733.6) is another GAM7957 target gene, herein designated TARGET GENE. SLC35E2 BINDING SITE is a target binding site found in the 3' untranslated region of mRNA encoded by SLC35E2, corresponding to a target binding site such as BINDING SITE I, BINDING SITE II or BINDING SITE III of FIG. 8. Table 4 illustrates the complementarity of the nucleotide sequences of SLC35E2 BINDING SITE, designated SEQ ID:6363, to the nucleotide sequence of GAM7957 RNA, herein designated GAM RNA, also designated SEQ ID:297.

Another function of GAM7957 is therefore inhibition of SLC35E2 (Accession XP_049733.6). Accordingly, utilities of GAM7957 include diagnosis, prevention and treatment of diseases and clinical conditions associated with SLC35E2.

SLC35E3 (Accession NP_061126.1) is another GAM7957 target gene, herein designated TARGET GENE. SLC35E3 BINDING SITE1 and SLC35E3 BINDING SITE2 are target binding sites found in untranslated regions of mRNA encoded by SLC35E3, corresponding to target binding sites such as BINDING SITE I, BINDING SITE II or BINDING SITE III of FIG. 8. Table 4 illustrates the complementarity of the nucleotide sequences of SLC35E3 BINDING SITE1 and SLC35E3 BINDING SITE2, designated SEQ ID:4801 and SEQ ID:16325 respectively, to the nucleotide sequence of GAM7957 RNA, herein designated GAM RNA, also designated SEQ ID:297.

Another function of GAM7957 is therefore inhibition of SLC35E3 (Accession NP_061126.1). Accordingly, utilities of GAM7957 include diagnosis, prevention and treatment of diseases and clinical conditions associated with SLC35E3.

Solute carrier family 6 (neurotransmitter transporter, taurine), member 6 (SLC6A6, Accession NP_003034.1) is another GAM7957 target gene, herein designated TARGET GENE. SLC6A6 BINDING SITE1 and SLC6A6 BINDING SITE2 are target binding sites found in untranslated regions of mRNA encoded by SLC6A6, corresponding to target binding sites such as BINDING SITE I, BINDING SITE II or BINDING SITE III of FIG. 8. Table 4 illustrates the complementarity of the nucleotide sequences of SLC6A6 BINDING SITE1 and SLC6A6 BINDING SITE2, designated SEQ ID:10881 and SEQ ID:11013 respectively, to the nucleotide sequence of GAM7957 RNA, herein designated GAM RNA, also designated SEQ ID:297.

Another function of GAM7957 is therefore inhibition of Solute carrier family 6 (neurotransmitter transporter, taurine), member 6 (SLC6A6, Accession NP_003034.1), a gene which transports taurine and other beta-amino acids like beta-alanine. Accordingly, utilities of GAM7957 include diagnosis, prevention and treatment of diseases and clinical conditions associated with SLC6A6.

The function of SLC6A6 and its association with various diseases and clinical conditions, has been established by previous studies, as described hereinabove with reference to GAM374.2. Solute carrier family 7, (cationic amino acid transporter, y+ system) member 11 (SLC7A11, Accession NP_055146.1) is another GAM7957 target gene, herein designated TARGET GENE. SLC7A11 BINDING SITE is a target binding site found in the 3' untranslated region of mRNA encoded by SLC7A11, corresponding to a target binding site such as BINDING SITE I, BINDING SITE II or BINDING SITE III of FIG. 8. Table 4 illustrates the complementarity of the nucleotide sequences of SLC7A11 BINDING SITE, designated SEQ ID:19054, to the nucleotide sequence of GAM7957 RNA, herein designated GAM RNA, also designated SEQ ID:297.

Another function of GAM7957 is therefore inhibition of Solute carrier family 7, (cationic amino acid transporter, y+ system) member 11 (SLC7A11, Accession NP_055146.1). Accordingly, utilities of GAM7957 include diagnosis, prevention and treatment of diseases and clinical conditions associated with SLC7A11.

SMA3 (Accession NP_006771.1) is another GAM7957 target gene, herein designated TARGET GENE. SMA3 BINDING SITE is a target binding site found in the 3' untranslated region of mRNA encoded by SMA3, corresponding to a target binding site such as BINDING SITE I, BINDING SITE II or BINDING SITE III of FIG. 8. Table 4 illustrates the complementarity of the nucleotide sequences of SMA3 BINDING SITE, designated SEQ ID:18653, to the nucleotide sequence of GAM7957 RNA, herein designated GAM RNA, also designated SEQ ID:297.

Another function of GAM7957 is therefore inhibition of SMA3 (Accession NP_006771.1). Accordingly, utilities of GAM7957 include diagnosis, prevention and treatment of diseases and clinical conditions associated with SMA3.

SMAP-5 (Accession NP_110426.3) is another GAM7957 target gene, herein designated TARGET GENE. SMAP-5 BINDING SITE is a target binding site found in the 3' untranslated region of mRNA encoded by SMAP-5, corresponding to a target binding site such as BINDING SITE I, BINDING SITE II or BINDING SITE III of FIG. 8. Table 4 illustrates the complementarity of the nucleotide sequences of SMAP-5 BINDING SITE, designated SEQ ID:10571, to the nucleotide sequence of GAM7957 RNA, herein designated GAM RNA, also designated SEQ ID:297.

Another function of GAM7957 is therefore inhibition of SMAP-5 (Accession NP_110426.3). Accordingly, utilities of GAM7957 include diagnosis, prevention and treatment of diseases and clinical conditions associated with SMAP-5.

Smc1 structural maintenance of chromosomes 1-like 1 (yeast) (SMC1L1, Accession NP_006297.2) is another GAM7957 target gene, herein designated TARGET GENE. SMC1L1 BINDING SITE is a target binding site found in the 3' untranslated region of mRNA encoded by SMC1L1, corresponding to a target binding site such as BINDING SITE I, BINDING SITE II or BINDING SITE III of FIG. 8. Table 4 illustrates the complementarity of the nucleotide sequences of SMC1L1 BINDING SITE, designated SEQ ID:938, to the nucleotide sequence of GAM7957 RNA, herein designated GAM RNA, also designated SEQ ID:297.

Another function of GAM7957 is therefore inhibition of Smc1 structural maintenance of chromosomes 1-like 1 (yeast) (SMC1L1, Accession NP_006297.2). Accordingly, utilities of GAM7957 include diagnosis, prevention and treatment of diseases and clinical conditions associated with SMC1L1.

SMG1 (Accession NP_054725.1) is another GAM7957 target gene, herein designated TARGET GENE. SMG1 BINDING SITE1 and SMG1 BINDING SITE2 are target binding sites found in untranslated regions of multiple transcripts of mRNA encoded by SMG1, corresponding to target binding sites such as BINDING SITE I, BINDING SITE II or BINDING SITE III of FIG. 8. Table 4 illustrates the complementarity of the nucleotide sequences of SMG1 BINDING SITE1 and SMG1 BINDING SITE2, designated SEQ ID:10571 and SEQ ID:13155 respectively, to the nucleotide sequence of GAM7957 RNA, herein designated GAM RNA, also designated SEQ ID:297.

Another function of GAM7957 is therefore inhibition of SMG1 (Accession NP_054725.1), a gene which acts as the target for the cell-cycle arrest and immunosuppressive effects. Accordingly, utilities of GAM7957 include diagnosis, prevention and treatment of diseases and clinical conditions associated with SMG1.

The function of SMG1 and its association with various diseases and clinical conditions, has been established by previous studies, as described hereinabove with reference to GAM207.2. SMG1 (Accession NP_054725.1) is another GAM7957 target gene, herein designated TARGET GENE. SMG1 BINDING SITE1 and SMG1 BINDING SITE2 are target binding sites found in untranslated regions of multiple transcripts of mRNA encoded by SMG1, corresponding to target binding sites such as BINDING SITE I, BINDING SITE II or BINDING SITE III of FIG. 8. Table 4 illustrates the complementarity of the nucleotide sequences of SMG1 BINDING SITE1 and SMG1 BINDING SITE2, designated SEQ ID:13155 and SEQ ID:10571 respectively, to the nucleotide sequence of GAM7957 RNA, herein designated GAM RNA, also designated SEQ ID:297.

Another function of GAM7957 is therefore inhibition of SMG1 (Accession NP_054725.1), a gene which acts as the target for the cell- cycle arrest and immunosuppressive effects. Accordingly, utilities of GAM7957 include diagnosis, prevention and treatment of diseases and clinical conditions associated with SMG1.

The function of SMG1 and its association with various diseases and clinical conditions, has been established by previous studies, as described hereinabove with reference to GAM207.2. Small nuclear rna activating complex, polypeptide 2, 45 kda (SNAPC2, Accession NP_003074.1) is another GAM7957 target gene, herein designated TARGET GENE. SNAPC2 BINDING SITE is a target binding site found in the 3' untranslated region of mRNA encoded by SNAPC2, corresponding to a target binding site such as BINDING SITE I, BINDING SITE II or BINDING SITE III of FIG. 8. Table 4 illustrates the complementarity of the nucleotide sequences of SNAPC2 BINDING SITE, designated SEQ ID:5533, to the nucleotide sequence of GAM7957 RNA, herein designated GAM RNA, also designated SEQ ID:297.

Another function of GAM7957 is therefore inhibition of Small nuclear rna activating complex, polypeptide 2, 45 kda (SNAPC2, Accession NP_003074.1). Accordingly, utilities of GAM7957 include diagnosis, prevention and treatment of diseases and clinical conditions associated with SNAPC2.

SNX22 (Accession NP_079074.1) is another GAM7957 target gene, herein designated TARGET GENE. SNX22 BINDING SITE is a target binding site found in the 3' untranslated region of mRNA encoded by SNX22, corresponding to a target binding site such as BINDING SITE I, BINDING SITE II or BINDING SITE III of FIG. 8. Table 4 illustrates the complementarity of the nucleotide sequences of SNX22 BINDING SITE, designated SEQ ID:876, to the nucleotide sequence of GAM7957 RNA, herein designated GAM RNA, also designated SEQ ID:297.

Another function of GAM7957 is therefore inhibition of SNX22 (Accession NP_079074.1). Accordingly, utilities of GAM7957 include diagnosis, prevention and treatment of diseases and clinical conditions associated with SNX22.

Sry (sex determining region y)-box 7 (SOX7, Accession NP_113627.1) is another GAM7957 target gene, herein designated TARGET GENE. SOX7 BINDING SITE is a target binding site found in the 3' untranslated region of mRNA encoded by SOX7, corresponding to a target binding site such as BINDING SITE I, BINDING SITE II or BINDING SITE III of FIG. 8. Table 4 illustrates the complementarity of the nucleotide sequences of SOX7 BINDING SITE, designated SEQ ID:15980, to the nucleotide sequence of GAM7957 RNA, herein designated GAM RNA, also designated SEQ ID:297.

Another function of GAM7957 is therefore inhibition of Sry (sex determining region y)-box 7 (SOX7, Accession NP_113627.1). Accordingly, utilities of GAM7957 include diagnosis, prevention and treatment of diseases and clinical conditions associated with SOX7.

Spastic paraplegia 4 (autosomal dominant; spastin) (SPG4, Accession NP_055761.2) is another GAM7957 target gene, herein designated TARGET GENE. SPG4 BINDING SITE is a target binding site found in the 5' untranslated region of mRNA encoded by SPG4, corresponding to a target binding site such as BINDING SITE I, BINDING SITE II or BINDING SITE III of FIG. 8. Table 4 illustrates the complementarity of the nucleotide sequences of SPG4 BINDING SITE, designated SEQ ID:12724, to the nucleotide sequence of GAM7957 RNA, herein designated GAM RNA, also designated SEQ ID:297.

Another function of GAM7957 is therefore inhibition of Spastic paraplegia 4 (autosomal dominant; spastin) (SPG4, Accession NP_055761.2), a gene which is probably an ATPase involved in the assembly or function of nuclear protein complexes and therefore may be associated with Spastic paraparesis. Accordingly, utilities of GAM7957 include diagnosis, prevention and treatment of Spastic paraparesis, and of other diseases and clinical conditions associated with SPG4.

The function of SPG4 and its association with various diseases and clinical conditions, has been established by previous studies, as described hereinabove with reference to GAM374.1. Spi-b transcription factor (spi-1/pu.1 related) (SPIB, Accession NP_003112.1) is another GAM7957 target gene, herein designated TARGET GENE. SPIB BINDING SITE is a target binding site found in the 3' untranslated region of mRNA encoded by SPIB, corresponding to a target binding site such as BINDING SITE I, BINDING SITE II or BINDING SITE III of FIG. 8. Table 4 illustrates the complementarity of the nucleotide sequences of SPIB BINDING SITE, designated SEQ ID:7007, to the nucleotide sequence of GAM7957 RNA, herein designated GAM RNA, also designated SEQ ID:297.

Another function of GAM7957 is therefore inhibition of Spi-b transcription factor (spi-1/pu.1 related) (SPIB, Accession NP_003112.1). Accordingly, utilities of GAM7957 include diagnosis, prevention and treatment of diseases and clinical conditions associated with SPIB.

Spir-2 (Accession XP_047462.4) is another GAM7957 target gene, herein designated TARGET GENE. Spir-2 BINDING SITE is a target binding site found in the 3' untranslated region of mRNA encoded by Spir-2, corresponding to a target binding site such as BINDING SITE I, BINDING SITE II or BINDING SITE III of FIG. 8. Table 4 illustrates the complementarity of the nucleotide sequences of Spir-2 BINDING SITE, designated SEQ ID:17700, to the nucleotide sequence of GAM7957 RNA, herein designated GAM RNA, also designated SEQ ID:297.

Another function of GAM7957 is therefore inhibition of Spir-2 (Accession XP_047462.4). Accordingly, utilities of GAM7957 include diagnosis, prevention and treatment of diseases and clinical conditions associated with Spir-2.

Serine palmitoyltransferase, long chain base subunit 1 (SPTLC1, Accession NP_847894.1) is another GAM7957 target gene, herein designated TARGET GENE. SPTLC1 BINDING SITE is a target binding site found in the 3' untranslated region of multiple transcripts of mRNA encoded by SPTLC1, corresponding to a target binding site such as BINDING SITE I, BINDING SITE II or BINDING SITE III of FIG. 8. Table 4 illustrates the complementarity of the nucleotide sequences of SPTLC1 BINDING SITE, designated SEQ ID:13585, to the nucleotide sequence of GAM7957 RNA, herein designated GAM RNA, also designated SEQ ID:297.

Another function of GAM7957 is therefore inhibition of Serine palmitoyltransferase, long chain base subunit 1 (SPTLC1, Accession NP_847894.1). Accordingly, utilities of GAM7957 include diagnosis, prevention and treatment of diseases and clinical conditions associated with SPTLC1.

Serine palmitoyltransferase, long chain base subunit 2 (SPTLC2, Accession NP_004854.1) is another GAM7957 target gene, herein designated TARGET GENE. SPTLC2 BINDING SITE1 through SPTLC2 BINDING SITE3 are target binding sites found in untranslated regions of mRNA encoded by SPTLC2, corresponding to target binding sites such as BINDING SITE I, BINDING SITE II or BINDING SITE III of FIG. 8. Table 4 illustrates the complementarity of the nucleotide sequences of SPTLC2 BINDING SITE1 through SPTLC2 BINDING SITE3, designated SEQ ID:6941, SEQ ID:14784 and SEQ ID:15328 respectively, to the nucleotide sequence of GAM7957 RNA, herein designated GAM RNA, also designated SEQ ID:297.

Another function of GAM7957 is therefore inhibition of Serine palmitoyltransferase, long chain base subunit 2 (SPTLC2, Accession NP_004854.1). Accordingly, utilities of GAM7957 include diagnosis, prevention and treatment of diseases and clinical conditions associated with SPTLC2.

SRGAP1 (Accession XP_051143.3) is another GAM7957 target gene, herein designated TARGET GENE. SRGAP1 BINDING SITE is a target binding site found in the 5' untranslated region of mRNA encoded by SRGAP1, corresponding to a target binding site such as BINDING SITE I, BINDING SITE II or BINDING SITE III of FIG. 8. Table 4 illustrates the complementarity of the nucleotide sequences of SRGAP1 BINDING SITE, designated SEQ ID:10721, to the nucleotide sequence of GAM7957 RNA, herein designated GAM RNA, also designated SEQ ID:297.

Another function of GAM7957 is therefore inhibition of SRGAP1 (Accession XP_051143.3). Accordingly, utilities of GAM7957 include diagnosis, prevention and treatment of diseases and clinical conditions associated with SRGAP1.

Synovial sarcoma translocation gene on chromosome 18-like 1 (SS18L1, Accession NP_056373.1) is another GAM7957 target gene, herein designated TARGET GENE. SS18L1 BINDING SITE is a target binding site found in the 3' untranslated region of mRNA encoded by SS18L1, corresponding to a target binding site such as BINDING SITE I, BINDING SITE II or BINDING SITE III of FIG. 8. Table 4 illustrates the complementarity of the nucleotide sequences of SS18L1 BINDING SITE, designated SEQ ID:7922, to the nucleotide sequence of GAM7957 RNA, herein designated GAM RNA, also designated SEQ ID:297.

Another function of GAM7957 is therefore inhibition of Synovial sarcoma translocation gene on chromosome 18-like 1 (SS18L1, Accession NP_056373.1). Accordingly, utilities of GAM7957 include diagnosis, prevention and treatment of diseases and clinical conditions associated with SS18L1.

SSH2 (Accession NP_203747.1) is another GAM7957 target gene, herein designated TARGET GENE. SSH2 BINDING SITE is a target binding site found in the 3' untranslated region of multiple transcripts of mRNA encoded by SSH2, corresponding to a target binding site such as BINDING SITE I, BINDING SITE II or BINDING SITE III of FIG. 8. Table 4 illustrates the complementarity of the nucleotide sequences of SSH2 BINDING SITE, designated SEQ ID:10439, to the nucleotide sequence of GAM7957 RNA, herein designated GAM RNA, also designated SEQ ID:297.

Another function of GAM7957 is therefore inhibition of SSH2 (Accession NP_203747.1). Accordingly, utilities of GAM7957 include diagnosis, prevention and treatment of diseases and clinical conditions associated with SSH2.

Signal sequence receptor, gamma (translocon-associated protein gamma) (SSR3, Accession NP_009038.1) is another GAM7957 target gene, herein designated TARGET GENE. SSR3 BINDING SITE is a target binding site found in the 3' untranslated region of mRNA encoded by SSR3, corresponding to a target binding site such as BINDING SITE I, BINDING SITE II or BINDING SITE III of FIG. 8. Table 4 illustrates the complementarity of the nucleotide sequences of SSR3 BINDING SITE, designated SEQ ID:12338, to the nucleotide sequence of GAM7957 RNA, herein designated GAM RNA, also designated SEQ ID:297.

Another function of GAM7957 is therefore inhibition of Signal sequence receptor, gamma (translocon-associated protein gamma) (SSR3, Accession NP_009038.1). Accordingly, utilities of GAM7957 include diagnosis, prevention and treatment of diseases and clinical conditions associated with SSR3.

Structure specific recognition protein 1 (SSRP1, Accession NP_003137.1) is another GAM7957 target gene, herein designated TARGET GENE. SSRP1 BINDING SITE is a target binding site found in the 3' untranslated region of mRNA encoded by SSRP1, corresponding to a target binding site such as BINDING SITE I, BINDING SITE II or BINDING SITE III of FIG. 8. Table 4 illustrates the complementarity of the nucleotide sequences of SSRP1 BINDING SITE, designated SEQ ID:11518, to the nucleotide sequence of GAM7957 RNA, herein designated GAM RNA, also designated SEQ ID:297.

Another function of GAM7957 is therefore inhibition of Structure specific recognition protein 1 (SSRP1, Accession NP_003137.1), a gene which has specific affinity for DNA modified with cisplatin and has a region of homology to HMG-box DNA binding proteins. Accordingly, utilities of GAM7957 include diagnosis, prevention and treatment of diseases and clinical conditions associated with SSRP1.

The function of SSRP1 and its association with various diseases and clinical conditions, has been established by previous studies, as described hereinabove with reference to GAM711.1. Synovial sarcoma, x breakpoint 2 interacting protein (SSX2IP, Accession NP_054740.1) is another GAM7957 target gene, herein designated TARGET GENE. SSX2IP BINDING SITE is a target binding site found in the 5' untranslated region of mRNA encoded by SSX2IP, corresponding to a target binding site such as BINDING SITE I, BINDING SITE II or BINDING SITE III of FIG. 8. Table 4 illustrates the complementarity of the nucleotide sequences of SSX2IP BINDING SITE, designated SEQ ID:8979, to the nucleotide sequence of GAM7957 RNA, herein designated GAM RNA, also designated SEQ ID:297.

Another function of GAM7957 is therefore inhibition of Synovial sarcoma, x breakpoint 2 interacting protein (SSX2IP, Accession NP_054740.1). Accordingly, utilities of GAM7957 include diagnosis, prevention and treatment of diseases and clinical conditions associated with SSX2IP.

Signal transducer and activator of transcription 3 (acute-phase response factor) (STAT3, Accession NP_003141.2) is another GAM7957 target gene, herein designated TARGET GENE. STAT3 BINDING SITE1 and STAT3 BINDING SITE2 are target binding sites found in untranslated regions of multiple transcripts of mRNA encoded by STAT3, corresponding to target binding sites such as BINDING SITE I, BINDING SITE II or BINDING SITE III of FIG. 8. Table 4 illustrates the complementarity of the nucleotide sequences of STAT3 BINDING SITE1 and STAT3 BINDING SITE2, designated SEQ ID:5830 and SEQ ID:5830 respectively, to the nucleotide sequence of GAM7957 RNA, herein designated GAM RNA, also designated SEQ ID:297.

Another function of GAM7957 is therefore inhibition of Signal transducer and activator of transcription 3 (acute-phase response factor) (STAT3, Accession NP_003141.2), a gene which carries out a dual function: signal transduction and activation of transcription. Accordingly, utilities of GAM7957 include diagnosis, prevention and treatment of diseases and clinical conditions associated with STAT3.

The function of STAT3 and its association with various diseases and clinical conditions, has been established by previous studies, as described hereinabove with reference to GAM47.1. Signal transducer and activator of transcription 3 (acute-phase response factor) (STAT3, Accession NP_003141.2) is another GAM7957 target gene, herein designated TARGET GENE. STAT3 BINDING SITE1 and STAT3 BINDING SITE2 are target binding sites found in untranslated regions of multiple transcripts of mRNA encoded by STAT3, corresponding to target binding sites such as BINDING SITE I, BINDING SITE II or BINDING SITE III of FIG. 8. Table 4 illustrates the complementarity of the nucleotide sequences of STAT3 BINDING SITE1 and STAT3 BINDING SITE2, designated SEQ ID:18951 and SEQ ID:18951 respectively, to the nucleotide sequence of GAM7957 RNA, herein designated GAM RNA, also designated SEQ ID:297.

Another function of GAM7957 is therefore inhibition of Signal transducer and activator of transcription 3 (acute-phase response factor) (STAT3, Accession NP_003141.2), a gene which carries out a dual function: signal transduction and activation of transcription. Accordingly, utilities of GAM7957 include diagnosis, prevention and treatment of diseases and clinical conditions associated with STAT3.

The function of STAT3 and its association with various diseases and clinical conditions, has been established by previous studies, as described hereinabove with reference to GAM47.1. Syntaxin 1a (brain) (STX1A, Accession NP_004594.1) is another GAM7957 target gene, herein designated TARGET GENE. STX1A BINDING SITE is a target binding site found in the 3' untranslated region of mRNA encoded by STX1A, corresponding to a target binding site such as BINDING SITE I, BINDING SITE II or BINDING SITE III of FIG. 8. Table 4 illustrates the complementarity of the nucleotide sequences of STX1A BINDING SITE, designated SEQ ID:5464, to the nucleotide sequence of GAM7957 RNA, herein designated GAM RNA, also designated SEQ ID:297.

Another function of GAM7957 is therefore inhibition of Syntaxin 1a (brain) (STX1A, Accession NP_004594.1), a gene which may play a critical role in neurotransmitter exocytosis. Accordingly, utilities of GAM7957 include diagnosis, prevention and treatment of diseases and clinical conditions associated with STX1A.

The function of STX1A and its association with various diseases and clinical conditions, has been established by previous studies, as described hereinabove with reference to GAM158.1. Sudd suppressor of bimd6 homolog (a. nidulans) (SUDD, Accession NP_665913.1) is another GAM7957 target gene, herein designated TARGET GENE. SUDD BINDING SITE is a target binding site found in the 3' untranslated region of multiple transcripts of mRNA encoded by SUDD, corresponding to a target binding site such as BINDING SITE I, BINDING SITE II or BINDING SITE III of FIG. 8. Table 4 illustrates the complementarity of the nucleotide sequences of SUDD BINDING SITE, designated SEQ ID:13065, to the nucleotide sequence of GAM7957 RNA, herein designated GAM RNA, also designated SEQ ID:297.

Another function of GAM7957 is therefore inhibition of Sudd suppressor of bimd6 homolog (a. nidulans) (SUDD, Accession NP_665913.1). Accordingly, utilities of GAM7957 include diagnosis, prevention and treatment of diseases and clinical conditions associated with SUDD.

Sudd suppressor of bimd6 homolog (a. nidulans) (SUDD, Accession NP_003822.2) is another GAM7957 target gene, herein designated TARGET GENE. SUDD BINDING SITE is a target binding site found in the 3' untranslated region of multiple transcripts of mRNA encoded by SUDD, corresponding to a target binding site such as BINDING SITE I, BINDING SITE II or BINDING SITE III of FIG. 8. Table 4 illustrates the complementarity of the nucleotide sequences of SUDD BINDING SITE, designated SEQ ID:13065, to the nucleotide sequence of GAM7957 RNA, herein designated GAM RNA, also designated SEQ ID:297.

Another function of GAM7957 is therefore inhibition of Sudd suppressor of bimd6 homolog (a. nidulans) (SUDD, Accession NP_003822.2). Accordingly, utilities of GAM7957 include diagnosis, prevention and treatment of diseases and clinical conditions associated with SUDD.

Sulfotransferase family, cytosolic, 2a, dehydroepiandrosterone (dhea) -preferring, member 1 (SULT2A1, Accession NP_003158.2) is another GAM7957 target gene, herein designated TARGET GENE. SULT2A1 BINDING SITE1 and SULT2A1 BINDING SITE2 are target binding sites found in untranslated regions of mRNA encoded by SULT2A1, corresponding to target binding sites such as BINDING SITE I, BINDING SITE II or BINDING SITE III of FIG. 8. Table 4 illustrates the complementarity of the nucleotide sequences of SULT2A1 BINDING SITE1 and SULT2A1 BINDING SITE2, designated SEQ ID:11833 and SEQ ID:16320 respectively, to the nucleotide sequence of GAM7957 RNA, herein designated GAM RNA, also designated SEQ ID:297.

Another function of GAM7957 is therefore inhibition of Sulfotransferase family, cytosolic, 2a, dehydroepiandrosterone (dhea) -preferring, member 1 (SULT2A1, Accession NP_003158.2), a gene which catalyzes the sulfation of steroids and bile acids in the liver and adrenal glands. Accordingly, utilities of GAM7957 include diagnosis, prevention and treatment of diseases and clinical conditions associated with SULT2A1.

The function of SULT2A1 and its association with various diseases and clinical conditions, has been established by previous studies, as described hereinabove with reference to GAM257.1. SUV39H2 (Accession NP_078946.1) is another GAM7957 target gene, herein designated TARGET GENE. SUV39H2 BINDING SITE is a target binding site found in the 3' untranslated region of mRNA encoded by SUV39H2, corresponding to a target binding site such as BINDING SITE I, BINDING SITE II or BINDING SITE III of FIG. 8. Table 4 illustrates the complementarity of the nucleotide sequences of SUV39H2 BINDING SITE, designated SEQ ID:2697, to the nucleotide sequence of GAM7957 RNA, herein designated GAM RNA, also designated SEQ ID:297.

Another function of GAM7957 is therefore inhibition of SUV39H2 (Accession NP_078946.1), a gene which is involved in gene repression and the modification of position-effect-variegation. Accordingly, utilities of GAM7957 include diagnosis, prevention and treatment of diseases and clinical conditions associated with SUV39H2.

The function of SUV39H2 and its association with various diseases and clinical conditions, has been established by previous studies, as described hereinabove with reference to GAM190.1. SV2A (Accession NP_055664.1) is another GAM7957 target gene, herein designated TARGET GENE. SV2A BINDING SITE is a target binding site found in the 3' untranslated region of mRNA encoded by SV2A, corresponding to a target binding site such as BINDING SITE I, BINDING SITE II or BINDING SITE III of FIG. 8. Table 4 illustrates the complementarity of the nucleotide sequences of SV2A BINDING SITE, designated SEQ ID:15941, to the nucleotide sequence of GAM7957 RNA, herein designated GAM RNA, also designated SEQ ID:297.

Another function of GAM7957 is therefore inhibition of SV2A (Accession NP_055664.1). Accordingly, utilities of GAM7957 include diagnosis, prevention and treatment of diseases and clinical conditions associated with SV2A.

SWAP70 (Accession XP_049197.2) is another GAM7957 target gene, herein designated TARGET GENE. SWAP70 BINDING SITE is a target binding site found in the 3' untranslated region of multiple transcripts of mRNA encoded by SWAP70, corresponding to a target binding site such as BINDING SITE I, BINDING SITE II or BINDING SITE III of FIG. 8. Table 4 illustrates the complementarity of the nucleotide sequences of SWAP70 BINDING SITE, designated SEQ ID:18423, to the nucleotide sequence of GAM7957 RNA, herein designated GAM RNA, also designated SEQ ID:297.

Another function of GAM7957 is therefore inhibition of SWAP70 (Accession XP_049197.2), a gene which is involved not only in nuclear events but also in signaling in B-cell activation. Accordingly, utilities of GAM7957 include diagnosis, prevention and treatment of diseases and clinical conditions associated with SWAP70.

The function of SWAP70 and its association with various diseases and clinical conditions, has been established by previous studies, as described hereinabove with reference to GAM257.1. SWAP70 (Accession NP_055870.1) is another GAM7957 target gene, herein designated TARGET GENE. SWAP70 BINDING SITE is a target binding site found in the 3' untranslated region of multiple transcripts of mRNA encoded by SWAP70, corresponding to a target binding site such as BINDING SITE I, BINDING SITE II or BINDING SITE III of FIG. 8. Table 4 illustrates the complementarity of the nucleotide sequences of SWAP70 BINDING SITE, designated SEQ ID:18423, to the nucleotide sequence of GAM7957 RNA, herein designated GAM RNA, also designated SEQ ID:297.

Another function of GAM7957 is therefore inhibition of SWAP70 (Accession NP_055870.1), a gene which is involved not only in nuclear events but also in signaling in B-cell activation. Accordingly, utilities of GAM7957 include diagnosis, prevention and treatment of diseases and clinical conditions associated with SWAP70.

The function of SWAP70 and its association with various diseases and clinical conditions, has been established by previous studies, as described hereinabove with reference to GAM257.1. Reserved (SYAP1, Accession NP_116185.2) is another GAM7957 target gene, herein designated TARGET GENE. SYAP1 BINDING SITE is a target binding site found in the 3' untranslated region of mRNA encoded by SYAP1, corresponding to a target binding site such as BINDING SITE I, BINDING SITE II or BINDING SITE III of FIG. 8. Table 4 illustrates the complementarity of the nucleotide sequences of SYAP1 BINDING SITE, designated SEQ ID:4339, to the nucleotide sequence of GAM7957 RNA, herein designated GAM RNA, also designated SEQ ID:297.

Another function of GAM7957 is therefore inhibition of Reserved (SYAP1, Accession NP_116185.2). Accordingly, utilities of GAM7957 include diagnosis, prevention and treatment of diseases and clinical conditions associated with SYAP1.

Synaptogyrin 1 (SYNGR1, Accession NP_004702.2) is another GAM7957 target gene, herein designated TARGET GENE. SYNGR1 BINDING SITE is a target binding site found in the 3' untranslated region of multiple transcripts of mRNA encoded by SYNGR1, corresponding to a target binding site such as BINDING SITE I, BINDING SITE II or BINDING SITE III of FIG. 8. Table 4 illustrates the complementarity of the nucleotide sequences of SYNGR1 BINDING SITE, designated SEQ ID:18392, to the nucleotide sequence of GAM7957 RNA, herein designated GAM RNA, also designated SEQ ID:297.

Another function of GAM7957 is therefore inhibition of Synaptogyrin 1 (SYNGR1, Accession NP_004702.2), a gene which belongs to transmembrane synaptic vesicle protein and may function in membrane recycling. Accordingly, utilities of GAM7957 include diagnosis, prevention and treatment of diseases and clinical conditions associated with SYNGR1.

The function of SYNGR1 and its association with various diseases and clinical conditions, has been established by previous studies, as described hereinabove with reference to GAM63.1. Synaptotagmin xi (SYT11, Accession NP_689493.2) is another GAM7957 target gene, herein designated TARGET GENE. SYT11 BINDING SITE is a target binding site found in the 3' untranslated region of mRNA encoded by SYT11, corresponding to a target binding site such as BINDING SITE I, BINDING SITE II or BINDING SITE III of FIG. 8. Table 4 illustrates the complementarity of the nucleotide sequences of SYT11 BINDING SITE, designated SEQ ID:18126, to the nucleotide sequence of GAM7957 RNA, herein designated GAM RNA, also designated SEQ ID:297.

Another function of GAM7957 is therefore inhibition of Synaptotagmin xi (SYT11, Accession NP_689493.2). Accordingly, utilities of GAM7957 include diagnosis, prevention and treatment of diseases and clinical conditions associated with SYT11.

TA-LRRP (Accession NP_056165.1) is another GAM7957 target gene, herein designated TARGET GENE. TA-LRRP BINDING SITE is a target binding site found in the 3' untranslated region of mRNA encoded by TA-LRRP, corresponding to a target binding site such as BINDING SITE I, BINDING SITE II or BINDING SITE III of FIG. 8. Table 4 illustrates the complementarity of the nucleotide sequences of TA-LRRP BINDING SITE, designated SEQ ID:4246, to the nucleotide sequence of GAM7957 RNA, herein designated GAM RNA, also designated SEQ ID:297.

Another function of GAM7957 is therefore inhibition of TA-LRRP (Accession NP_056165.1). Accordingly, utilities of GAM7957 include diagnosis, prevention and treatment of diseases and clinical conditions associated with TA-LRRP.

Transforming, acidic coiled-coil containing protein 1 (TACC1, Accession NP_006274.1) is another GAM7957 target gene, herein designated TARGET GENE. TACC1 BINDING SITE is a target binding site found in the 3' untranslated region of mRNA encoded by TACC1, corresponding to a target binding site such as BINDING SITE I, BINDING SITE II or BINDING SITE III of FIG. 8. Table 4 illustrates the complementarity of the nucleotide sequences of TACC1 BINDING SITE, designated SEQ ID:14784, to the nucleotide sequence of GAM7957 RNA, herein designated GAM RNA, also designated SEQ ID:297.

Another function of GAM7957 is therefore inhibition of Transforming, acidic coiled-coil containing protein 1 (TACC1, Accession NP_006274.1). Accordingly, utilities of GAM7957 include diagnosis, prevention and treatment of diseases and clinical conditions associated with TACC1.

TACTILE (Accession NP_005807.1) is another GAM7957 target gene, herein designated TARGET GENE. TACTILE BINDING SITE is a target binding site found in the 3' untranslated region of mRNA encoded by TACTILE, corresponding to a target binding site such as BINDING SITE I, BINDING SITE II or BINDING SITE III of FIG. 8. Table 4 illustrates the complementarity of the nucleotide sequences of TACTILE BINDING SITE, designated SEQ ID:19031, to the nucleotide sequence of GAM7957 RNA, herein designated GAM RNA, also designated SEQ ID:297.

Another function of GAM7957 is therefore inhibition of TACTILE (Accession NP_005807.1). Accordingly, utilities of GAM7957 include diagnosis, prevention and treatment of diseases and clinical conditions associated with TACTILE.

Transcriptional adaptor 2 (ada2 homolog, yeast)-like (TADA2L, Accession NP_001479.2) is another GAM7957 target gene, herein designated TARGET GENE. TADA2L BINDING SITE is a target binding site found in the 3' untranslated region of multiple transcripts of mRNA encoded by TADA2L, corresponding to a target binding site such as BINDING SITE I, BINDING SITE II or BINDING SITE III of FIG. 8. Table 4 illustrates the complementarity of the nucleotide sequences of TADA2L BINDING SITE, designated SEQ ID:9344, to the nucleotide sequence of GAM7957 RNA, herein designated GAM RNA, also designated SEQ ID:297.

Another function of GAM7957 is therefore inhibition of Transcriptional adaptor 2 (ada2 homolog, yeast)-like (TADA2L, Accession NP_001479.2), a gene which is one PCAF histone acetylase complex subunit, and a probable transcriptional adaptor protein. Accordingly, utilities of GAM7957 include diagnosis, prevention and treatment of diseases and clinical conditions associated with TADA2L.

The function of TADA2L and its association with various diseases and clinical conditions, has been established by previous studies, as described hereinabove with reference to GAM347.1. TADA3L (Accession NP_597814.1) is another GAM7957 target gene, herein designated TARGET GENE. TADA3L BINDING SITE is a target binding site found in the 3' untranslated region of multiple transcripts of mRNA encoded by TADA3L, corresponding to a target binding site such as BINDING SITE I, BINDING SITE II or BINDING SITE III of FIG. 8. Table 4 illustrates the complementarity of the nucleotide sequences of TADA3L BINDING SITE, designated SEQ ID:9420, to the nucleotide sequence of GAM7957 RNA, herein designated GAM RNA, also designated SEQ ID:297.

Another function of GAM7957 is therefore inhibition of TADA3L (Accession NP_597814.1). Accordingly, utilities of GAM7957 include diagnosis, prevention and treatment of diseases and clinical conditions associated with TADA3L.

Taf1-like rna polymerase ii, tata box binding protein (tbp)-associated factor, 210 kda (TAF1L, Accession NP_722516.1) is another GAM7957 target gene, herein designated TARGET GENE. TAF1L BINDING SITE1 and TAF1L BINDING SITE2 are target binding sites found in untranslated regions of mRNA encoded by TAF1L, corresponding to target binding sites such as BINDING SITE I, BINDING SITE II or BINDING SITE III of FIG. 8. Table 4 illustrates the complementarity of the nucleotide sequences of TAF1L BINDING SITE1 and TAF1L BINDING SITE2, designated SEQ ID:4247 and SEQ ID:585 respectively, to the nucleotide sequence of GAM7957 RNA, herein designated GAM RNA, also designated SEQ ID:297.

Another function of GAM7957 is therefore inhibition of Taf1-like rna polymerase ii, tata box binding protein (tbp)-associated factor, 210 kda (TAF1L, Accession NP_722516.1). Accordingly, utilities of GAM7957 include diagnosis, prevention and treatment of diseases and clinical conditions associated with TAF1L.

TARSH (Accession NP_079077.1) is another GAM7957 target gene, herein designated TARGET GENE. TARSH BINDING SITE is a target binding site found in the 3' untranslated region of multiple transcripts of mRNA encoded by TARSH, corresponding to a target binding site such as BINDING SITE I, BINDING SITE II or BINDING SITE III of FIG. 8. Table 4 illustrates the complementarity of the nucleotide sequences of TARSH BINDING SITE, designated SEQ ID:9763, to the nucleotide sequence of GAM7957 RNA, herein designated GAM RNA, also designated SEQ ID:297.

Another function of GAM7957 is therefore inhibition of TARSH (Accession NP_079077.1). Accordingly, utilities of GAM7957 include diagnosis, prevention and treatment of diseases and clinical conditions associated with TARSH.

TBRG1 (Accession NP_116200.1) is another GAM7957 target gene, herein designated TARGET GENE. TBRG1 BINDING SITE1 and TBRG1 BINDING SITE2 are target binding sites found in untranslated regions of mRNA encoded by TBRG1, corresponding to target binding sites such as BINDING SITE I, BINDING SITE II or BINDING SITE III of FIG. 8. Table 4 illustrates the complementarity of the nucleotide sequences of TBRG1 BINDING SITE1 and TBRG1 BINDING SITE2, designated SEQ ID:10438 and SEQ ID:19130 respectively, to the nucleotide sequence of GAM7957 RNA, herein designated GAM RNA, also designated SEQ ID:297.

Another function of GAM7957 is therefore inhibition of TBRG1 (Accession NP_116200.1). Accordingly, utilities of GAM7957 include diagnosis, prevention and treatment of diseases and clinical conditions associated with TBRG1.

T-box 1 (TBX1, Accession NP_005983.1) is another GAM7957 target gene, herein designated TARGET GENE. TBX1 BINDING SITE is a target binding site found in the 3' untranslated region of multiple transcripts of mRNA encoded by TBX1, corresponding to a target binding site such as BINDING SITE I, BINDING SITE II or BINDING SITE III of FIG. 8. Table 4 illustrates the complementarity of the nucleotide sequences of TBX1 BINDING SITE, designated SEQ ID:9841, to the nucleotide sequence of GAM7957 RNA, herein designated GAM RNA, also designated SEQ ID:297.

Another function of GAM7957 is therefore inhibition of T-box 1 (TBX1, Accession NP_005983.1), a gene which may act as a transcription factor and contains a T-box DNA binding domain. Accordingly, utilities of GAM7957 include diagnosis, prevention and treatment of diseases and clinical conditions associated with TBX1.

The function of TBX1 and its association with various diseases and clinical conditions, has been established by previous studies, as described hereinabove with reference to GAM139.1. T-box 19 (TBX19, Accession NP_005140.1) is another GAM7957 target gene, herein designated TARGET GENE. TBX19 BINDING SITE is a target binding site found in the 3' untranslated region of mRNA encoded by TBX19, corresponding to a target binding site such as BINDING SITE I, BINDING SITE II or BINDING SITE III of FIG. 8. Table 4 illustrates the complementarity of the nucleotide sequences of TBX19 BINDING SITE, designated SEQ ID:7816, to the nucleotide sequence of GAM7957 RNA, herein designated GAM RNA, also designated SEQ ID:297.

Another function of GAM7957 is therefore inhibition of T-box 19 (TBX19, Accession NP_005140.1). Accordingly, utilities of GAM7957 include diagnosis, prevention and treatment of diseases and clinical conditions associated with TBX19.

T-box 6 (TBX6, Accession NP_542936.1) is another GAM7957 target gene, herein designated TARGET GENE. TBX6 BINDING SITE is a target binding site found in the 3' untranslated region of multiple transcripts of mRNA encoded by TBX6, corresponding to a target binding site such as BINDING SITE I, BINDING SITE II or BINDING SITE III of FIG. 8. Table 4 illustrates the complementarity of the nucleotide sequences of TBX6 BINDING SITE, designated SEQ ID:19047, to the nucleotide sequence of GAM7957 RNA, herein designated GAM RNA, also designated SEQ ID:297.

Another function of GAM7957 is therefore inhibition of T-box 6 (TBX6, Accession NP_542936.1), a gene which is a probable transcriptional regulator involved in developmental processes. Accordingly, utilities of GAM7957 include diagnosis, prevention and treatment of diseases and clinical conditions associated with TBX6.

The function of TBX6 and its association with various diseases and clinical conditions, has been established by previous studies, as described hereinabove with reference to GAM59.1. Transcription factor 4 (TCF4, Accession NP_003190.1) is another GAM7957 target gene, herein designated TARGET GENE. TCF4 BINDING SITE is a target binding site found in the 5' untranslated region of mRNA encoded by TCF4, corresponding to a target binding site such as BINDING SITE I, BINDING SITE II or BINDING SITE III of FIG. 8. Table 4 illustrates the complementarity of the nucleotide sequences of TCF4 BINDING SITE, designated SEQ ID:839, to the nucleotide sequence of GAM7957 RNA, herein designated GAM RNA, also designated SEQ ID:297.

Another function of GAM7957 is therefore inhibition of Transcription factor 4 (TCF4, Accession NP_003190.1), a gene which is a transcriptional activator; interacts with ITF1 (TCF3); and contains basic helix-loop-helix domain. Accordingly, utilities of GAM7957 include diagnosis, prevention and treatment of diseases and clinical conditions associated with TCF4.

The function of TCF4 and its association with various diseases and clinical conditions, has been established by previous studies, as described hereinabove with reference to GAM180.1. Transcription factor 7 (t-cell specific, hmg-box) (TCF7, Accession NP_003193.1) is another GAM7957 target gene, herein designated TARGET GENE. TCF7 BINDING SITE is a target binding site found in the 3' untranslated region of mRNA encoded by TCF7, corresponding to a target binding site such as BINDING SITE I, BINDING SITE II or BINDING SITE III of FIG. 8. Table 4 illustrates the complementarity of the nucleotide sequences of TCF7 BINDING SITE, designated SEQ ID:2362, to the nucleotide sequence of GAM7957 RNA, herein designated GAM RNA, also designated SEQ ID:297.

Another function of GAM7957 is therefore inhibition of Transcription factor 7 (t-cell specific, hmg-box) (TCF7, Accession NP_003193.1). Accordingly, utilities of GAM7957 include diagnosis, prevention and treatment of diseases and clinical conditions associated with TCF7.

T-cell leukemia translocation altered gene (TCTA, Accession NP_071503.1) is another GAM7957 target gene, herein designated TARGET GENE. TCTA BINDING SITE1 and TCTA BINDING SITE2 are target binding sites found in untranslated regions of mRNA encoded by TCTA, corresponding to target binding sites such as BINDING SITE I, BINDING SITE II or BINDING SITE III of FIG. 8. Table 4 illustrates the complementarity of the nucleotide sequences of TCTA BINDING SITE1 and TCTA BINDING SITE2, designated SEQ ID:20025 and SEQ ID:17399 respectively, to the nucleotide sequence of GAM7957 RNA, herein designated GAM RNA, also designated SEQ ID:297.

Another function of GAM7957 is therefore inhibition of T-cell leukemia translocation altered gene (TCTA, Accession NP_071503.1). Accordingly, utilities of GAM7957 include diagnosis, prevention and treatment of diseases and clinical conditions associated with TCTA.

TDE1L (Accession NP_065806.1) is another GAM7957 target gene, herein designated TARGET GENE. TDE1L BINDING SITE is a target binding site found in the 3' untranslated region of mRNA encoded by TDE1L, corresponding to a target binding site such as BINDING SITE I, BINDING SITE II or BINDING SITE III of FIG. 8. Table 4 illustrates the complementarity of the nucleotide sequences of TDE1L BINDING SITE, designated SEQ ID:2974, to the nucleotide sequence of GAM7957 RNA, herein designated GAM RNA, also designated SEQ ID:297.

Another function of GAM7957 is therefore inhibition of TDE1L (Accession NP_065806.1). Accordingly, utilities of GAM7957 include diagnosis, prevention and treatment of diseases and clinical conditions associated with TDE1L.

TEM6 (Accession NP_073585.6) is another GAM7957 target gene, herein designated TARGET GENE. TEM6 BINDING SITE is a target binding site found in the 3' untranslated region of mRNA encoded by TEM6, corresponding to a target binding site such as BINDING SITE I, BINDING SITE II or BINDING SITE III of FIG. 8. Table 4 illustrates the complementarity of the nucleotide sequences of TEM6 BINDING SITE, designated SEQ ID:19194, to the nucleotide sequence of GAM7957 RNA, herein designated GAM RNA, also designated SEQ ID:297.

Another function of GAM7957 is therefore inhibition of TEM6 (Accession NP_073585.6), a gene which displays elevated expression during tumor angiogenesis. Accordingly, utilities of GAM7957 include diagnosis, prevention and treatment of diseases and clinical conditions associated with TEM6.

The function of TEM6 and its association with various diseases and clinical conditions, has been established by previous studies, as described hereinabove with reference to GAM401.1. TEM7 (Accession NP_065138.2) is another GAM7957 target gene, herein designated TARGET GENE. TEM7 BINDING SITE is a target binding site found in the 3' untranslated region of mRNA encoded by TEM7, corresponding to a target binding site such as BINDING SITE I, BINDING SITE II or BINDING SITE III of FIG. 8. Table 4 illustrates the complementarity of the nucleotide sequences of TEM7 BINDING SITE, designated SEQ ID:17985, to the nucleotide sequence of GAM7957 RNA, herein designated GAM RNA, also designated SEQ ID:297.

Another function of GAM7957 is therefore inhibition of TEM7 (Accession NP_065138.2), a gene which involves in angiogenesis and therefore may be associated with Colorectal cancer. Accordingly, utilities of GAM7957 include diagnosis, prevention and treatment of Colorectal cancer, and of other diseases and clinical conditions associated with TEM7.

The function of TEM7 and its association with various diseases and clinical conditions, has been established by previous studies, as described hereinabove with reference to GAM63.1. TIP47 (Accession NP_005808.2) is another GAM7957 target gene, herein designated TARGET GENE. TIP47 BINDING SITE is a target binding site found in the 3' untranslated region of mRNA encoded by TIP47, corresponding to a target binding site such as BINDING SITE I, BINDING SITE II or BINDING SITE III of FIG. 8. Table 4 illustrates the complementarity of the nucleotide sequences of TIP47 BINDING SITE, designated SEQ ID:18951, to the nucleotide sequence of GAM7957 RNA, herein designated GAM RNA, also designated SEQ ID:297.

Another function of GAM7957 is therefore inhibition of TIP47 (Accession NP_005808.2). Accordingly, utilities of GAM7957 include diagnosis, prevention and treatment of diseases and clinical conditions associated with TIP47.

Triple homeobox 1 (TIX1, Accession NP_055850.1) is another GAM7957 target gene, herein designated TARGET GENE. TIX1 BINDING SITE is a target binding site found in the 3' untranslated region of mRNA encoded by TIX1, corresponding to a target binding site such as BINDING SITE I, BINDING SITE II or BINDING SITE III of FIG. 8. Table 4 illustrates the complementarity of the nucleotide sequences of TIX1 BINDING SITE, designated SEQ ID:17424, to the nucleotide sequence of GAM7957 RNA, herein designated GAM RNA, also designated SEQ ID:297.

Another function of GAM7957 is therefore inhibition of Triple homeobox 1 (TIX1, Accession NP_055850.1). Accordingly, utilities of GAM7957 include diagnosis, prevention and treatment of diseases and clinical conditions associated with TIX1.

Tight junction protein 1 (zona occludens 1) (TJP1, Accession NP_783297.1) is another GAM7957 target gene, herein designated TARGET GENE. TJP1 BINDING SITE1 and TJP1 BINDING SITE2 are target binding sites found in untranslated regions of multiple transcripts of mRNA encoded by TJP1, corresponding to target binding sites such as BINDING SITE I, BINDING SITE II or BINDING SITE III of FIG. 8. Table 4 illustrates the complementarity of the nucleotide sequences of TJP1 BINDING SITE1 and TJP1 BINDING SITE2, designated SEQ ID:7287 and SEQ ID:18566 respectively, to the nucleotide sequence of GAM7957 RNA, herein designated GAM RNA, also designated SEQ ID:297.

Another function of GAM7957 is therefore inhibition of Tight junction protein 1 (zona occludens 1) (TJP1, Accession NP_783297.1), a gene which colocalizes and interacts with cadherins in cells lacking tight junctions. Accordingly, utilities of GAM7957 include diagnosis, prevention and treatment of diseases and clinical conditions associated with TJP1.

The function of TJP1 and its association with various diseases and clinical conditions, has been established by previous studies, as described hereinabove with reference to GAM136.1. Tight junction protein 1 (zona occludens 1) (TJP1, Accession NP_003248.2) is another GAM7957 target gene, herein designated TARGET GENE. TJP1 BINDING SITE1 and TJP1 BINDING SITE2 are target binding sites found in untranslated regions of multiple transcripts of mRNA encoded by TJP1, corresponding to target binding sites such as BINDING SITE I, BINDING SITE II or BINDING SITE III of FIG. 8. Table 4 illustrates the complementarity of the nucleotide sequences of TJP1 BINDING SITE1 and TJP1 BINDING SITE2, designated SEQ ID:18566 and SEQ ID:7287 respectively, to the nucleotide sequence of GAM7957 RNA, herein designated GAM RNA, also designated SEQ ID:297.

Another function of GAM7957 is therefore inhibition of Tight junction protein 1 (zona occludens 1) (TJP1, Accession NP_003248.2), a gene which colocalizes and interacts with cadherins in cells lacking tight junctions. Accordingly, utilities of GAM7957 include diagnosis, prevention and treatment of diseases and clinical conditions associated with TJP1.

The function of TJP1 and its association with various diseases and clinical conditions, has been established by previous studies, as described hereinabove with reference to GAM136.1. Transmembrane protein 1 (TMEM1, Accession NP_003265.2) is another GAM7957 target gene, herein designated TARGET GENE. TMEM1 BINDING SITE is a target binding site found in the 3' untranslated region of mRNA encoded by TMEM1, corresponding to a target binding site such as BINDING SITE I, BINDING SITE II or BINDING SITE III of FIG. 8. Table 4 illustrates the complementarity of the nucleotide sequences of TMEM1 BINDING SITE, designated SEQ ID:19683, to the nucleotide sequence of GAM7957 RNA, herein designated GAM RNA, also designated SEQ ID:297.

Another function of GAM7957 is therefore inhibition of Transmembrane protein 1 (TMEM1, Accession NP_003265.2). Accordingly, utilities of GAM7957 include diagnosis, prevention and treatment of diseases and clinical conditions associated with TMEM1.

Transmembrane protein 4 (TMEM4, Accession NP_055070.1) is another GAM7957 target gene, herein designated TARGET GENE. TMEM4 BINDING SITE is a target binding site found in the 5' untranslated region of mRNA encoded by TMEM4, corresponding to a target binding site such as BINDING SITE I, BINDING SITE II or BINDING SITE III of FIG. 8. Table 4 illustrates the complementarity of the nucleotide sequences of TMEM4 BINDING SITE, designated SEQ ID:12891, to the nucleotide sequence of GAM7957 RNA, herein designated GAM RNA, also designated SEQ ID:297.

Another function of GAM7957 is therefore inhibition of Transmembrane protein 4 (TMEM4, Accession NP_055070.1), a gene which is a putative type II membrane protein. Accordingly, utilities of GAM7957 include diagnosis, prevention and treatment of diseases and clinical conditions associated with TMEM4.

The function of TMEM4 and its association with various diseases and clinical conditions, has been established by previous studies, as described hereinabove with reference to GAM401.1. TMG4 (Accession NP_076986.1) is another GAM7957 target gene, herein designated TARGET GENE. TMG4 BINDING SITE is a target binding site found in the 3' untranslated region of mRNA encoded by TMG4, corresponding to a target binding site such as BINDING SITE I, BINDING SITE II or BINDING SITE III of FIG. 8. Table 4 illustrates the complementarity of the nucleotide sequences of TMG4 BINDING SITE, designated SEQ ID:3326, to the nucleotide sequence of GAM7957 RNA, herein designated GAM RNA, also designated SEQ ID:297.

Another function of GAM7957 is therefore inhibition of TMG4 (Accession NP_076986.1). Accordingly, utilities of GAM7957 include diagnosis, prevention and treatment of diseases and clinical conditions associated with TMG4.

Tumor necrosis factor receptor superfamily, member 1b (TNFRSF1B, Accession NP_001057.1) is another GAM7957 target gene, herein designated TARGET GENE. TNFRSF1B BINDING SITE is a target binding site found in the 3' untranslated region of mRNA encoded by TNFRSF1B, corresponding to a target binding site such as BINDING SITE I, BINDING SITE II or BINDING SITE III of FIG. 8. Table 4 illustrates the complementarity of the nucleotide sequences of TNFRSF1B BINDING SITE, designated SEQ ID:13649, to the nucleotide sequence of GAM7957 RNA, herein designated GAM RNA, also designated SEQ ID:297.

Another function of GAM7957 is therefore inhibition of Tumor necrosis factor receptor superfamily, member 1b (TNFRSF1B, Accession NP_001057.1), a gene which mediates proinflammatory cellular responses. and therefore may be associated with Familial combined hyperlipidemia. Accordingly, utilities of GAM7957 include diagnosis, prevention and treatment of Familial combined hyperlipidemia, and of other diseases and clinical conditions associated with TNFRSF1B.

The function of TNFRSF1B and its association with various diseases and clinical conditions, has been established by previous studies, as described hereinabove with reference to GAM72.1. Tumor necrosis factor (ligand) superfamily, member 10 (TNFSF10, Accession NP_003801.1) is another GAM7957 target gene, herein designated TARGET GENE. TNFSF10 BINDING SITE is a target binding site found in the 3' untranslated region of mRNA encoded by TNFSF10, corresponding to a target binding site such as BINDING SITE I, BINDING SITE II or BINDING SITE III of FIG. 8. Table 4 illustrates the complementarity of the nucleotide sequences of TNFSF10 BINDING SITE, designated SEQ ID:6521, to the nucleotide sequence of GAM7957 RNA, herein designated GAM RNA, also designated SEQ ID:297.

Another function of GAM7957 is therefore inhibition of Tumor necrosis factor (ligand) superfamily, member 10 (TNFSF10, Accession NP_003801.1), a gene which mediates cell death. Accordingly, utilities of GAM7957 include diagnosis, prevention and treatment of diseases and clinical conditions associated with TNFSF10.

The function of TNFSF10 and its association with various diseases and clinical conditions, has been established by previous studies, as described hereinabove with reference to GAM72.1. Tumor necrosis factor (ligand) superfamily, member 14 (TNFSF14, Accession NP_003798.2) is another GAM7957 target gene, herein designated TARGET GENE. TNFSF14 BINDING SITE is a target binding site found in the 3' untranslated region of multiple transcripts of mRNA encoded by TNFSF14, corresponding to a target binding site such as BINDING SITE I, BINDING SITE II or BINDING SITE III of FIG. 8. Table 4 illustrates the complementarity of the nucleotide sequences of TNFSF14 BINDING SITE, designated SEQ ID:722, to the nucleotide sequence of GAM7957 RNA, herein designated GAM RNA, also designated SEQ ID:297.

Another function of GAM7957 is therefore inhibition of Tumor necrosis factor (ligand) superfamily, member 14 (TNFSF14, Accession NP_003798.2), a gene which acts as a receptor for herpes simplex virus. Accordingly, utilities of GAM7957 include diagnosis, prevention and treatment of diseases and clinical conditions associated with TNFSF14.

The function of TNFSF14 and its association with various diseases and clinical conditions, has been established by previous studies, as described hereinabove with reference to GAM236.1. Tumor necrosis factor (ligand) superfamily, member 14 (TNFSF14, Accession NP_742011.1) is another GAM7957 target gene, herein designated TARGET GENE. TNFSF14 BINDING SITE is a target binding site found in the 3' untranslated region of multiple transcripts of mRNA encoded by TNFSF14, corresponding to a target binding site such as BINDING SITE I, BINDING SITE II or BINDING SITE III of FIG. 8. Table 4 illustrates the complementarity of the nucleotide sequences of TNFSF14 BINDING SITE, designated SEQ ID:722, to the nucleotide sequence of GAM7957 RNA, herein designated GAM RNA, also designated SEQ ID:297.

Another function of GAM7957 is therefore inhibition of Tumor necrosis factor (ligand) superfamily, member 14 (TNFSF14, Accession NP_742011.1), a gene which acts as a receptor for herpes simplex virus. Accordingly, utilities of GAM7957 include diagnosis, prevention and treatment of diseases and clinical conditions associated with TNFSF14.

The function of TNFSF14 and its association with various diseases and clinical conditions, has been established by previous studies, as described hereinabove with reference to GAM236.1. Tumor necrosis factor (ligand) superfamily, member 15 (TNFSF15, Accession NP_005109.2) is another GAM7957 target gene, herein designated TARGET GENE. TNFSF15 BINDING SITE is a target binding site found in the 3' untranslated region of mRNA encoded by TNFSF15, corresponding to a target binding site such as BINDING SITE I, BINDING SITE II or BINDING SITE III of FIG. 8. Table 4 illustrates the complementarity of the nucleotide sequences of TNFSF15 BINDING SITE, designated SEQ ID:1981, to the nucleotide sequence of GAM7957 RNA, herein designated GAM RNA, also designated SEQ ID:297.

Another function of GAM7957 is therefore inhibition of Tumor necrosis factor (ligand) superfamily, member 15 (TNFSF15, Accession NP_005109.2), a gene which acts as an autocrine factor to induce apoptosis in endothelial cells. Accordingly, utilities of GAM7957 include diagnosis, prevention and treatment of diseases and clinical conditions associated with TNFSF15.

The function of TNFSF15 and its association with various diseases and clinical conditions, has been established by previous studies, as described hereinabove with reference to GAM100.1. Tnfaip3 interacting protein 3 (TNIP3, Accession NP_079149.2) is another GAM7957 target gene, herein designated TARGET GENE. TNIP3 BINDING SITE is a target binding site found in the 3' untranslated region of mRNA encoded by TNIP3, corresponding to a target binding site such as BINDING SITE I, BINDING SITE II or BINDING SITE III of FIG. 8. Table 4 illustrates the complementarity of the nucleotide sequences of TNIP3 BINDING SITE, designated SEQ ID:16969, to the nucleotide sequence of GAM7957 RNA, herein designated GAM RNA, also designated SEQ ID:297.

Another function of GAM7957 is therefore inhibition of Tnfaip3 interacting protein 3 (TNIP3, Accession NP_079149.2). Accordingly, utilities of GAM7957 include diagnosis, prevention and treatment of diseases and clinical conditions associated with TNIP3.

Trinucleotide repeat containing 5 (TNRC5, Accession NP_006577.1) is another GAM7957 target gene, herein designated TARGET GENE. TNRC5 BINDING SITE is a target binding site found in the 5' untranslated region of mRNA encoded by TNRC5, corresponding to a target binding site such as BINDING SITE I, BINDING SITE II or BINDING SITE III of FIG. 8. Table 4 illustrates the complementarity of the nucleotide sequences of TNRC5 BINDING SITE, designated SEQ ID:17344, to the nucleotide sequence of GAM7957 RNA, herein designated GAM RNA, also designated SEQ ID:297.

Another function of GAM7957 is therefore inhibition of Trinucleotide repeat containing 5 (TNRC5, Accession NP_006577.1). Accordingly, utilities of GAM7957 include diagnosis, prevention and treatment of diseases and clinical conditions associated with TNRC5.

TP53I5 (Accession XP_290532.2) is another GAM7957 target gene, herein designated TARGET GENE. TP53I5 BINDING SITE is a target binding site found in the 3' untranslated region of mRNA encoded by TP53I5, corresponding to a target binding site such as BINDING SITE I, BINDING SITE II or BINDING SITE III of FIG. 8. Table 4 illustrates the complementarity of the nucleotide sequences of TP53I5 BINDING SITE, designated SEQ ID:13608, to the nucleotide sequence of GAM7957 RNA, herein designated GAM RNA, also designated SEQ ID:297.

Another function of GAM7957 is therefore inhibition of TP53I5 (Accession XP_290532.2). Accordingly, utilities of GAM7957 include diagnosis, prevention and treatment of diseases and clinical conditions associated with TP53I5.

Tropomyosin 4 (TPM4, Accession NP_003281.1) is another GAM7957 target gene, herein designated TARGET GENE. TPM4 BINDING SITE is a target binding site found in the 3' untranslated region of mRNA encoded by TPM4, corresponding to a target binding site such as BINDING SITE I, BINDING SITE II or BINDING SITE III of FIG. 8. Table 4 illustrates the complementarity of the nucleotide sequences of TPM4 BINDING SITE, designated SEQ ID:19193, to the nucleotide sequence of GAM7957 RNA, herein designated GAM RNA, also designated SEQ ID:297.

Another function of GAM7957 is therefore inhibition of Tropomyosin 4 (TPM4, Accession NP_003281.1), a gene which plays a central role, in association with the troponin complex, in the calcium dependent regulation of vertebrate striated muscle contraction. Accordingly, utilities of GAM7957 include diagnosis, prevention and treatment of diseases and clinical conditions associated with TPM4.

The function of TPM4 and its association with various diseases and clinical conditions, has been established by previous studies, as described hereinabove with reference to GAM72.1. Tnfrsf1a-associated via death domain (TRADD, Accession NP_003780.1) is another GAM7957 target gene, herein designated TARGET GENE. TRADD BINDING SITE is a target binding site found in the 3' untranslated region of multiple transcripts of mRNA encoded by TRADD, corresponding to a target binding site such as BINDING SITE I, BINDING SITE II or BINDING SITE III of FIG. 8. Table 4 illustrates the complementarity of the nucleotide sequences of TRADD BINDING SITE, designated SEQ ID:15543, to the nucleotide sequence of GAM7957 RNA, herein designated GAM RNA, also designated SEQ ID:297.

Another function of GAM7957 is therefore inhibition of Tnfrsf1a-associated via death domain (TRADD, Accession NP_003780.1), a gene which specifically interacts with the cytoplasmic domain of activated tnfr1. interacts with trafs (traf1 and traf2), fadd and rip. acts as an adaptor molecule for tnfr1 mediating its interaction with fadd. overexpression of tradd leads to two major tnf-induced responses, apoptosis and activation of nf-kappa b. Accordingly, utilities of GAM7957 include diagnosis, prevention and treatment of diseases and clinical conditions associated with TRADD.

The function of TRADD and its association with various diseases and clinical conditions, has been established by previous studies, as described hereinabove with reference to GAM40.1. Tnfrsf1a-associated via death domain (TRADD, Accession NP_700474.1) is another GAM7957 target gene, herein designated TARGET GENE. TRADD BINDING SITE is a target binding site found in the 3' untranslated region of multiple transcripts of mRNA encoded by TRADD, corresponding to a target binding site such as BINDING SITE I, BINDING SITE II or BINDING SITE III of FIG. 8. Table 4 illustrates the complementarity of the nucleotide sequences of TRADD BINDING SITE, designated SEQ ID:15543, to the nucleotide sequence of GAM7957 RNA, herein designated GAM RNA, also designated SEQ ID:297.

Another function of GAM7957 is therefore inhibition of Tnfrsf1a-associated via death domain (TRADD, Accession NP_700474.1), a gene which specifically interacts with the cytoplasmic domain of activated tnfr1. interacts with trafs (traf1 and traf2), fadd and rip. acts as an adaptor molecule for tnfr1 mediating its interaction with fadd. overexpression of tradd leads to two major tnf-induced responses, apoptosis and activation of nf-kappa b. Accordingly, utilities of GAM7957 include diagnosis, prevention and treatment of diseases and clinical conditions associated with TRADD.

The function of TRADD and its association with various diseases and clinical conditions, has been established by previous studies, as described hereinabove with reference to GAM40.1. TRAM2 (Accession NP_036420.1) is another GAM7957 target gene, herein designated TARGET GENE. TRAM2 BINDING SITE1 and TRAM2 BINDING SITE2 are target binding sites found in untranslated regions of mRNA encoded by TRAM2, corresponding to target binding sites such as BINDING SITE I, BINDING SITE II or BINDING SITE III of FIG. 8. Table 4 illustrates the complementarity of the nucleotide sequences of TRAM2 BINDING SITE1 and TRAM2 BINDING SITE2, designated SEQ ID:5830 and SEQ ID:9810 respectively, to the nucleotide sequence of GAM7957 RNA, herein designated GAM RNA, also designated SEQ ID:297.

Another function of GAM7957 is therefore inhibition of TRAM2 (Accession NP_036420.1). Accordingly, utilities of GAM7957 include diagnosis, prevention and treatment of diseases and clinical conditions associated with TRAM2.

TRB2 (Accession NP_067675.1) is another GAM7957 target gene, herein designated TARGET GENE. TRB2 BINDING SITE is a target binding site found in the 3' untranslated region of mRNA encoded by TRB2, corresponding to a target binding site such as BINDING SITE I, BINDING SITE II or BINDING SITE III of FIG. 8. Table 4 illustrates the complementarity of the nucleotide sequences of TRB2 BINDING SITE, designated SEQ ID:15438, to the nucleotide sequence of GAM7957 RNA, herein designated GAM RNA, also designated SEQ ID:297.

Another function of GAM7957 is therefore inhibition of TRB2 (Accession NP_067675.1). Accordingly, utilities of GAM7957 include diagnosis, prevention and treatment of diseases and clinical conditions associated with TRB2.

TRIAD3 (Accession NP_061884.2) is another GAM7957 target gene, herein designated TARGET GENE. TRIAD3 BINDING SITE is a target binding site found in the 3' untranslated region of mRNA encoded by TRIAD3, corresponding to a target binding site such as BINDING SITE I, BINDING SITE II or BINDING SITE III of FIG. 8. Table 4 illustrates the complementarity of the nucleotide sequences of TRIAD3 BINDING SITE, designated SEQ ID:17399, to the nucleotide sequence of GAM7957 RNA, herein designated GAM RNA, also designated SEQ ID:297.

Another function of GAM7957 is therefore inhibition of TRIAD3 (Accession NP_061884.2). Accordingly, utilities of GAM7957 include diagnosis, prevention and treatment of diseases and clinical conditions associated with TRIAD3.

Tripartite motif-containing 14 (TRIM14, Accession NP_150089.1) is another GAM7957 target gene, herein designated TARGET GENE. TRIM14 BINDING SITE1 and TRIM14 BINDING SITE2 are target binding sites found in untranslated regions of multiple transcripts of mRNA encoded by TRIM14, corresponding to target binding sites such as BINDING SITE I, BINDING SITE II or BINDING SITE III of FIG. 8. Table 4 illustrates the complementarity of the nucleotide sequences of TRIM14 BINDING SITE1 and TRIM14 BINDING SITE2, designated SEQ ID:17397 and SEQ ID:2835 respectively, to the nucleotide sequence of GAM7957 RNA, herein designated GAM RNA, also designated SEQ ID:297.

Another function of GAM7957 is therefore inhibition of Tripartite motif-containing 14 (TRIM14, Accession NP_150089.1), a gene which is composed of 3 zinc-binding domains and is involved in development and cell growth. Accordingly, utilities of GAM7957 include diagnosis, prevention and treatment of diseases and clinical conditions associated with TRIM14.

The function of TRIM14 and its association with various diseases and clinical conditions, has been established by previous studies, as described hereinabove with reference to GAM144.1. Tripartite motif-containing 14 (TRIM14, Accession NP_055603.2) is another GAM7957 target gene, herein designated TARGET GENE. TRIM14 BINDING SITE1 and TRIM14 BINDING SITE2 are target binding sites found in untranslated regions of multiple transcripts of mRNA encoded by TRIM14, corresponding to target binding sites such as BINDING SITE I, BINDING SITE II or BINDING SITE III of FIG. 8. Table 4 illustrates the complementarity of the nucleotide sequences of TRIM14 BINDING SITE1 and TRIM14 BINDING SITE2, designated SEQ ID:2835 and SEQ ID:8138 respectively, to the nucleotide sequence of GAM7957 RNA, herein designated GAM RNA, also designated SEQ ID:297.

Another function of GAM7957 is therefore inhibition of Tripartite motif-containing 14 (TRIM14, Accession NP_055603.2), a gene which is composed of 3 zinc-binding domains and is involved in development and cell growth. Accordingly, utilities of GAM7957 include diagnosis, prevention and treatment of diseases and clinical conditions associated with TRIM14.

The function of TRIM14 and its association with various diseases and clinical conditions, has been established by previous studies, as described hereinabove with reference to GAM144.1. Tripartite motif-containing 35 (TRIM35, Accession NP_741983.1) is another GAM7957 target gene, herein designated TARGET GENE. TRIM35 BINDING SITE is a target binding site found in the 3' untranslated region of multiple transcripts of mRNA encoded by TRIM35, corresponding to a target binding site such as BINDING SITE I, BINDING SITE II or BINDING SITE III of FIG. 8. Table 4 illustrates the complementarity of the nucleotide sequences of TRIM35 BINDING SITE, designated SEQ ID:16080, to the nucleotide sequence of GAM7957 RNA, herein designated GAM RNA, also designated SEQ ID:297.

Another function of GAM7957 is therefore inhibition of Tripartite motif-containing 35 (TRIM35, Accession NP_741983.1). Accordingly, utilities of GAM7957 include diagnosis, prevention and treatment of diseases and clinical conditions associated with TRIM35.

Tripartite motif-containing 35 (TRIM35, Accession NP_055881.1) is another GAM7957 target gene, herein designated TARGET GENE. TRIM35 BINDING SITE is a target binding site found in the 3' untranslated region of multiple transcripts of mRNA encoded by TRIM35, corresponding to a target binding site such as BINDING SITE I, BINDING SITE II or BINDING SITE III of FIG. 8. Table 4 illustrates the complementarity of the nucleotide sequences of TRIM35 BINDING SITE, designated SEQ ID:16080, to the nucleotide sequence of GAM7957 RNA, herein designated GAM RNA, also designated SEQ ID:297.

Another function of GAM7957 is therefore inhibition of Tripartite motif-containing 35 (TRIM35, Accession NP_055881.1). Accordingly, utilities of GAM7957 include diagnosis, prevention and treatment of diseases and clinical conditions associated with TRIM35.

TRIM46 (Accession NP_079334.1) is another GAM7957 target gene, herein designated TARGET GENE. TRIM46 BINDING SITE is a target binding site found in the 3' untranslated region of mRNA encoded by TRIM46, corresponding to a target binding site such as BINDING SITE I, BINDING SITE II or BINDING SITE III of FIG. 8. Table 4 illustrates the complementarity of the nucleotide sequences of TRIM46 BINDING SITE, designated SEQ ID:9420, to the nucleotide sequence of GAM7957 RNA, herein designated GAM RNA, also designated SEQ ID:297.

Another function of GAM7957 is therefore inhibition of TRIM46 (Accession NP_079334.1). Accordingly, utilities of GAM7957 include diagnosis, prevention and treatment of diseases and clinical conditions associated with TRIM46.

TRIM56 (Accession XP_168586.1) is another GAM7957 target gene, herein designated TARGET GENE. TRIM56 BINDING SITE is a target binding site found in the 3' untranslated region of multiple transcripts of mRNA encoded by TRIM56, corresponding to a target binding site such as BINDING SITE I, BINDING SITE II or BINDING SITE III of FIG. 8. Table 4 illustrates the complementarity of the nucleotide sequences of TRIM56 BINDING SITE, designated SEQ ID:1762, to the nucleotide sequence of GAM7957 RNA, herein designated GAM RNA, also designated SEQ ID:297.

Another function of GAM7957 is therefore inhibition of TRIM56 (Accession XP_168586.1). Accordingly, utilities of GAM7957 include diagnosis, prevention and treatment of diseases and clinical conditions associated with TRIM56.

TRIM56 (Accession NP_112223.1) is another GAM7957 target gene, herein designated TARGET GENE. TRIM56 BINDING SITE is a target binding site found in the 3' untranslated region of multiple transcripts of mRNA encoded by TRIM56, corresponding to a target binding site such as BINDING SITE I, BINDING SITE II or BINDING SITE III of FIG. 8. Table 4 illustrates the complementarity of the nucleotide sequences of TRIM56 BINDING SITE, designated SEQ ID:1762, to the nucleotide sequence of GAM7957 RNA, herein designated GAM RNA, also designated SEQ ID:297.

Another function of GAM7957 is therefore inhibition of TRIM56 (Accession NP_112223.1). Accordingly, utilities of GAM7957 include diagnosis, prevention and treatment of diseases and clinical conditions associated with TRIM56.

Tripartite motif-containing 8 (TRIM8, Accession NP_112174.1) is another GAM7957 target gene, herein designated TARGET GENE. TRIM8 BINDING SITE is a target binding site found in the 3' untranslated region of mRNA encoded by TRIM8, corresponding to a target binding site such as BINDING SITE I, BINDING SITE II or BINDING SITE III of FIG. 8. Table 4 illustrates the complementarity of the nucleotide sequences of TRIM8 BINDING SITE, designated SEQ ID:6715, to the nucleotide sequence of GAM7957 RNA, herein designated GAM RNA, also designated SEQ ID:297.

Another function of GAM7957 is therefore inhibition of Tripartite motif-containing 8 (TRIM8, Accession NP_112174.1). Accordingly, utilities of GAM7957 include diagnosis, prevention and treatment of diseases and clinical conditions associated with TRIM8.

Transient receptor potential cation channel, subfamily m, member 2 (TRPM2, Accession NP_003298.1) is another GAM7957 target gene, herein designated TARGET GENE. TRPM2 BINDING SITE is a target binding site found in the 5' untranslated region of mRNA encoded by TRPM2, corresponding to a target binding site such as BINDING SITE I, BINDING SITE II or BINDING SITE III of FIG. 8. Table 4 illustrates the complementarity of the nucleotide sequences of TRPM2 BINDING SITE, designated SEQ ID:782, to the nucleotide sequence of GAM7957 RNA, herein designated GAM RNA, also designated SEQ ID:297.

Another function of GAM7957 is therefore inhibition of Transient receptor potential cation channel, subfamily m, member 2 (TRPM2, Accession NP_003298.1), a gene which may be a calcium channel. Accordingly, utilities of GAM7957 include diagnosis, prevention and treatment of diseases and clinical conditions associated with TRPM2.

The function of TRPM2 and its association with various diseases and clinical conditions, has been established by previous studies, as described hereinabove with reference to GAM335.1. Transient receptor potential cation channel, subfamily m, member 3 (TRPM3, Accession NP_079247.2) is another GAM7957 target gene, herein designated TARGET GENE. TRPM3 BINDING SITE is a target binding site found in the 3' untranslated region of mRNA encoded by TRPM3, corresponding to a target binding site such as BINDING SITE I, BINDING SITE II or BINDING SITE III of FIG. 8. Table 4 illustrates the complementarity of the nucleotide sequences of TRPM3 BINDING SITE, designated SEQ ID:16946, to the nucleotide sequence of GAM7957 RNA, herein designated GAM RNA, also designated SEQ ID:297.

Another function of GAM7957 is therefore inhibition of Transient receptor potential cation channel, subfamily m, member 3 (TRPM3, Accession NP_079247.2). Accordingly, utilities of GAM7957 include diagnosis, prevention and treatment of diseases and clinical conditions associated with TRPM3.

Transient receptor potential cation channel, subfamily m, member 4 (TRPM4, Accession NP_060106.2) is another GAM7957 target gene, herein designated TARGET GENE. TRPM4 BINDING SITE is a target binding site found in the 5' untranslated region of mRNA encoded by TRPM4, corresponding to a target binding site such as BINDING SITE I, BINDING SITE II or BINDING SITE III of FIG. 8. Table 4 illustrates the complementarity of the nucleotide sequences of TRPM4 BINDING SITE, designated SEQ ID:2740, to the nucleotide sequence of GAM7957 RNA, herein designated GAM RNA, also designated SEQ ID:297.

Another function of GAM7957 is therefore inhibition of Transient receptor potential cation channel, subfamily m, member 4 (TRPM4, Accession NP_060106.2), a gene which contains two transient receptor domains. Accordingly, utilities of GAM7957 include diagnosis, prevention and treatment of diseases and clinical conditions associated with TRPM4.

The function of TRPM4 and its association with various diseases and clinical conditions, has been established by previous studies, as described hereinabove with reference to GAM607.2. Transient receptor potential cation channel, subfamily m, member 8 (TRPM8, Accession NP_076985.3) is another GAM7957 target gene, herein designated TARGET GENE. TRPM8 BINDING SITE is a target binding site found in the 3' untranslated region of mRNA encoded by TRPM8, corresponding to a target binding site such as BINDING SITE I, BINDING SITE II or BINDING SITE III of FIG. 8. Table 4 illustrates the complementarity of the nucleotide sequences of TRPM8 BINDING SITE, designated SEQ ID:9731, to the nucleotide sequence of GAM7957 RNA, herein designated GAM RNA, also designated SEQ ID:297.

Another function of GAM7957 is therefore inhibition of Transient receptor potential cation channel, subfamily m, member 8 (TRPM8, Accession NP_076985.3), a gene which is thought to form a receptor-activated calcium permeant cation channel. Accordingly, utilities of GAM7957 include diagnosis, prevention and treatment of diseases and clinical conditions associated with TRPM8.

The function of TRPM8 and its association with various diseases and clinical conditions, has been established by previous studies, as described hereinabove with reference to GAM223.2. Transient receptor potential cation channel, subfamily v, member 1 (TRPV1, Accession NP_542437.1) is another GAM7957 target gene, herein designated TARGET GENE. TRPV1 BINDING SITE is a target binding site found in the 5' untranslated region of multiple transcripts of mRNA encoded by TRPV1, corresponding to a target binding site such as BINDING SITE I, BINDING SITE II or BINDING SITE III of FIG. 8. Table 4 illustrates the complementarity of the nucleotide sequences of TRPV1 BINDING SITE, designated SEQ ID:14712, to the nucleotide sequence of GAM7957 RNA, herein designated GAM RNA, also designated SEQ ID:297.

Another function of GAM7957 is therefore inhibition of Transient receptor potential cation channel, subfamily v, member 1 (TRPV1, Accession NP_542437.1), a gene which functions as a receptor for capsaicin. Accordingly, utilities of GAM7957 include diagnosis, prevention and treatment of diseases and clinical conditions associated with TRPV1.

The function of TRPV1 and its association with various diseases and clinical conditions, has been established by previous studies, as described hereinabove with reference to GAM130.1. TSAP6 (Accession NP_060704.1) is another GAM7957 target gene, herein designated TARGET GENE. TSAP6 BINDING SITE is a target binding site found in the 5' untranslated region of mRNA encoded by TSAP6, corresponding to a target binding site such as BINDING SITE I, BINDING SITE II or BINDING SITE III of FIG. 8. Table 4 illustrates the complementarity of the nucleotide sequences of TSAP6 BINDING SITE, designated SEQ ID:15578, to the nucleotide sequence of GAM7957 RNA, herein designated GAM RNA, also designated SEQ ID:297.

Another function of GAM7957 is therefore inhibition of TSAP6 (Accession NP_060704.1). Accordingly, utilities of GAM7957 include diagnosis, prevention and treatment of diseases and clinical conditions associated with TSAP6.

Translin-associated factor x (TSNAX, Accession NP_005990.1) is another GAM7957 target gene, herein designated TARGET GENE. TSNAX BINDING SITE is a target binding site found in the 3' untranslated region of mRNA encoded by TSNAX, corresponding to a target binding site such as BINDING SITE I, BINDING SITE II or BINDING SITE III of FIG. 8. Table 4 illustrates the complementarity of the nucleotide sequences of TSNAX BINDING SITE, designated SEQ ID:13066, to the nucleotide sequence of GAM7957 RNA, herein designated GAM RNA, also designated SEQ ID:297.

Another function of GAM7957 is therefore inhibition of Translin-associated factor x (TSNAX, Accession NP_005990.1), a gene which Interacts with translin (TSN). Accordingly, utilities of GAM7957 include diagnosis, prevention and treatment of diseases and clinical conditions associated with TSNAX.

The function of TSNAX and its association with various diseases and clinical conditions, has been established by previous studies, as described hereinabove with reference to GAM257.1. Transcription termination factor, rna polymerase ii (TTF2, Accession NP_003585.2) is another GAM7957 target gene, herein designated TARGET GENE. TTF2 BINDING SITE is a target binding site found in the 3' untranslated region of mRNA encoded by TTF2, corresponding to a target binding site such as BINDING SITE I, BINDING SITE II or BINDING SITE III of FIG. 8. Table 4 illustrates the complementarity of the nucleotide sequences of TTF2 BINDING SITE, designated SEQ ID:6501, to the nucleotide sequence of GAM7957 RNA, herein designated GAM RNA, also designated SEQ ID:297.

Another function of GAM7957 is therefore inhibition of Transcription termination factor, rna polymerase ii (TTF2, Accession NP_003585.2), a gene which is involved either in promoting the migration process or in repressing differentiation of the TFCs until migration has occurred and therefore may be associated with Bamforth-lazarus syndrome. Accordingly, utilities of GAM7957 include diagnosis, prevention and treatment of Bamforth-lazarus syndrome, and of other diseases and clinical conditions associated with TTF2.

The function of TTF2 and its association with various diseases and clinical conditions, has been established by previous studies, as described hereinabove with reference to GAM270.1. TU12B1-TY (Accession NP_057659.1) is another GAM7957 target gene, herein designated TARGET GENE. TU12B1-TY BINDING SITE is a target binding site found in the 5' untranslated region of mRNA encoded by TU12B1-TY, corresponding to a target binding site such as BINDING SITE I, BINDING SITE II or BINDING SITE III of FIG. 8. Table 4 illustrates the complementarity of the nucleotide sequences of TU12B1-TY BINDING SITE, designated SEQ ID:9085, to the nucleotide sequence of GAM7957 RNA, herein designated GAM RNA, also designated SEQ ID:297.

Another function of GAM7957 is therefore inhibition of TU12B1-TY (Accession NP_057659.1). Accordingly, utilities of GAM7957 include diagnosis, prevention and treatment of diseases and clinical conditions associated with TU12B1-TY.

U1SNRNPBP (Accession NP_851030.1) is another GAM7957 target gene, herein designated TARGET GENE. U1SNRNPBP BINDING SITE1 and U1SNRNPBP BINDING SITE2 are target binding sites found in untranslated regions of multiple transcripts of mRNA encoded by U1SNRNPBP, corresponding to target binding sites such as BINDING SITE I, BINDING SITE II or BINDING SITE III of FIG. 8. Table 4 illustrates the complementarity of the nucleotide sequences of U1SNRNPBP BINDING SITE1 and U1SNRNPBP BINDING SITE2, designated SEQ ID:13066 and SEQ ID:1492 respectively, to the nucleotide sequence of GAM7957 RNA, herein designated GAM RNA, also designated SEQ ID:297.

Another function of GAM7957 is therefore inhibition of U1SNRNPBP (Accession NP_851030.1). Accordingly, utilities of GAM7957 include diagnosis, prevention and treatment of diseases and clinical conditions associated with U1SNRNPBP.

U1SNRNPBP (Accession NP_851034.1) is another GAM7957 target gene, herein designated TARGET GENE. U1SNRNPBP BINDING SITE1 and U1SNRNPBP BINDING SITE2 are target binding sites found in untranslated regions of multiple transcripts of mRNA encoded by U1SNRNPBP, corresponding to target binding sites such as BINDING SITE I, BINDING SITE II or BINDING SITE III of FIG. 8. Table 4 illustrates the complementarity of the nucleotide sequences of U1SNRNPBP BINDING SITE1 and U1SNRNPBP BINDING SITE2, designated SEQ ID:13066 and SEQ ID:12063 respectively, to the nucleotide sequence of GAM7957 RNA, herein designated GAM RNA, also designated SEQ ID:297.

Another function of GAM7957 is therefore inhibition of U1SNRNPBP (Accession NP_851034.1). Accordingly, utilities of GAM7957 include diagnosis, prevention and treatment of diseases and clinical conditions associated with U1SNRNPBP.

UBCE7IP5 (Accession NP_055763.1) is another GAM7957 target gene, herein designated TARGET GENE. UBCE7IP5 BINDING SITE is a target binding site found in the 3' untranslated region of mRNA encoded by UBCE7IP5, corresponding to a target binding site such as BINDING SITE I, BINDING SITE II or BINDING SITE III of FIG. 8. Table 4 illustrates the complementarity of the nucleotide sequences of UBCE7IP5 BINDING SITE, designated SEQ ID:14779, to the nucleotide sequence of GAM7957 RNA, herein designated GAM RNA, also designated SEQ ID:297.

Another function of GAM7957 is therefore inhibition of UBCE7IP5 (Accession NP_055763.1). Accordingly, utilities of GAM7957 include diagnosis, prevention and treatment of diseases and clinical conditions associated with UBCE7IP5.

Ubiquitin-conjugating enzyme e2b (rad6 homolog) (UBE2B, Accession NP_003328.1) is another GAM7957 target gene, herein designated TARGET GENE. UBE2B BINDING SITE1 and UBE2B BINDING SITE2 are target binding sites found in untranslated regions of mRNA encoded by UBE2B, corresponding to target binding sites such as BINDING SITE I, BINDING SITE II or BINDING SITE III of FIG. 8. Table 4 illustrates the complementarity of the nucleotide sequences of UBE2B BINDING SITE1 and UBE2B BINDING SITE2, designated SEQ ID:1890 and SEQ ID:12734 respectively, to the nucleotide sequence of GAM7957 RNA, herein designated GAM RNA, also designated SEQ ID:297.

Another function of GAM7957 is therefore inhibition of Ubiquitin-conjugating enzyme e2b (rad6 homolog) (UBE2B, Accession NP_003328.1), a gene which catalyzes the covalent attachment of ubiquitin to other proteins and is required for postreplication repair of uv-damaged dna. Accordingly, utilities of GAM7957 include diagnosis, prevention and treatment of diseases and clinical conditions associated with UBE2B.

The function of UBE2B and its association with various diseases and clinical conditions, has been established by previous studies, as described hereinabove with reference to GAM72.1. Ubiquitin-conjugating enzyme e2g 2 (ubc7 homolog, yeast) (UBE2G2, Accession NP_003334.2) is another GAM7957 target gene, herein designated TARGET GENE. UBE2G2 BINDING SITE1 and UBE2G2 BINDING SITE2 are target binding sites found in untranslated regions of mRNA encoded by UBE2G2, corresponding to target binding sites such as BINDING SITE I, BINDING SITE II or BINDING SITE III of FIG. 8. Table 4 illustrates the complementarity of the nucleotide sequences of UBE2G2 BINDING SITE1 and UBE2G2 BINDING SITE2, designated SEQ ID:11556 and SEQ ID:8877 respectively, to the nucleotide sequence of GAM7957 RNA, herein designated GAM RNA, also designated SEQ ID:297.

Another function of GAM7957 is therefore inhibition of Ubiquitin-conjugating enzyme e2g 2 (ubc7 homolog, yeast) (UBE2G2, Accession NP_003334.2), a gene which catalyzes the covalent attachment of ubiquitin to other proteins. Accordingly, utilities of GAM7957 include diagnosis, prevention and treatment of diseases and clinical conditions associated with UBE2G2.

The function of UBE2G2 and its association with various diseases and clinical conditions, has been established by previous studies, as described hereinabove with reference to GAM72.1. UNC5CL (Accession NP_775832.1) is another GAM7957 target gene, herein designated TARGET GENE. UNC5CL BINDING SITE is a target binding site found in the 3' untranslated region of mRNA encoded by UNC5CL, corresponding to a target binding site such as BINDING SITE I, BINDING SITE II or BINDING SITE III of FIG. 8. Table 4 illustrates the complementarity of the nucleotide sequences of UNC5CL BINDING SITE, designated SEQ ID:8143, to the nucleotide sequence of GAM7957 RNA, herein designated GAM RNA, also designated SEQ ID:297.

Another function of GAM7957 is therefore inhibition of UNC5CL (Accession NP_775832.1). Accordingly, utilities of GAM7957 include diagnosis, prevention and treatment of diseases and clinical conditions associated with UNC5CL.

UNC5H2 (Accession NP_734465.1) is another GAM7957 target gene, herein designated TARGET GENE. UNC5H2 BINDING SITE is a target binding site found in the 3' untranslated region of mRNA encoded by UNC5H2, corresponding to a target binding site such as BINDING SITE I, BINDING SITE II or BINDING SITE III of FIG. 8. Table 4 illustrates the complementarity of the nucleotide sequences of UNC5H2 BINDING SITE, designated SEQ ID:14996, to the nucleotide sequence of GAM7957 RNA, herein designated GAM RNA, also designated SEQ ID:297.

Another function of GAM7957 is therefore inhibition of UNC5H2 (Accession NP_734465.1). Accordingly, utilities of GAM7957 include diagnosis, prevention and treatment of diseases and clinical conditions associated with UNC5H2.

Uroplakin 1b (UPK1B, Accession NP_008883.1) is another GAM7957 target gene, herein designated TARGET GENE. UPK1B BINDING SITE is a target binding site found in the 3' untranslated region of mRNA encoded by UPK1B, corresponding to a target binding site such as BINDING SITE I, BINDING SITE II or BINDING SITE III of FIG. 8. Table 4 illustrates the complementarity of the nucleotide sequences of UPK1B BINDING SITE, designated SEQ ID:19696, to the nucleotide sequence of GAM7957 RNA, herein designated GAM RNA, also designated SEQ ID:297.

Another function of GAM7957 is therefore inhibition of Uroplakin 1b (UPK1B, Accession NP_008883.1), a gene which strengthens and stabilizes the urothelial apical surface of the asymmetric unit membrane of mammalian bladder epithelium. Accordingly, utilities of GAM7957 include diagnosis, prevention and treatment of diseases and clinical conditions associated with UPK1B.

The function of UPK1B and its association with various diseases and clinical conditions, has been established by previous studies, as described hereinabove with reference to GAM223.1. Ubiquitin specific protease 14 (trna-guanine transglycosylase) (USP14, Accession NP_005142.1) is another GAM7957 target gene, herein designated TARGET GENE. USP14 BINDING SITE is a target binding site found in the 3' untranslated region of mRNA encoded by USP14, corresponding to a target binding site such as BINDING SITE I, BINDING SITE II or BINDING SITE III of FIG. 8. Table 4 illustrates the complementarity of the nucleotide sequences of USP14 BINDING SITE, designated SEQ ID:10433, to the nucleotide sequence of GAM7957 RNA, herein designated GAM RNA, also designated SEQ ID:297.

Another function of GAM7957 is therefore inhibition of Ubiquitin specific protease 14 (trna-guanine transglycosylase) (USP14, Accession NP_005142.1), a gene which is similar to ubiquitin-specific cysteine (thiol) proteases and tRNA-guanine transglycosylase. Accordingly, utilities of GAM7957 include diagnosis, prevention and treatment of diseases and clinical conditions associated with USP14.

The function of USP14 and its association with various diseases and clinical conditions, has been established by previous studies, as described hereinabove with reference to GAM94.1. Uronyl-2-sulfotransferase (UST, Accession NP_005706.1) is another GAM7957 target gene, herein designated TARGET GENE. UST BINDING SITE1 and UST BINDING SITE2 are target binding sites found in untranslated regions of mRNA encoded by UST, corresponding to target binding sites such as BINDING SITE I, BINDING SITE II or BINDING SITE III of FIG. 8. Table 4 illustrates the complementarity of the nucleotide sequences of UST BINDING SITE1 and UST BINDING SITE2, designated SEQ ID:19210 and SEQ ID:11817 respectively, to the nucleotide sequence of GAM7957 RNA, herein designated GAM RNA, also designated SEQ ID:297.

Another function of GAM7957 is therefore inhibition of Uronyl-2-sulfotransferase (UST, Accession NP_005706.1). Accordingly, utilities of GAM7957 include diagnosis, prevention and treatment of diseases and clinical conditions associated with UST.

Vitamin d (1,25-dihydroxyvitamin d3) receptor (VDR, Accession NP_000367.1) is another GAM7957 target gene, herein designated TARGET GENE. VDR BINDING SITE is a target binding site found in the 3' untranslated region of mRNA encoded by VDR, corresponding to a target binding site such as BINDING SITE I, BINDING SITE II or BINDING SITE III of FIG. 8. Table 4 illustrates the complementarity of the nucleotide sequences of VDR BINDING SITE, designated SEQ ID:15223, to the nucleotide sequence of GAM7957 RNA, herein designated GAM RNA, also designated SEQ ID:297.

Another function of GAM7957 is therefore inhibition of Vitamin d (1,25-dihydroxyvitamin d3) receptor (VDR, Accession NP_000367.1). Accordingly, utilities of GAM7957 include diagnosis, prevention and treatment of diseases and clinical conditions associated with VDR.

Vascular endothelial growth factor (VEGF, Accession NP_003367.3) is another GAM7957 target gene, herein designated TARGET GENE. VEGF BINDING SITE is a target binding site found in the 5' untranslated region of mRNA encoded by VEGF, corresponding to a target binding site such as BINDING SITE I, BINDING SITE II or BINDING SITE III of FIG. 8. Table 4 illustrates the complementarity of the nucleotide sequences of VEGF BINDING SITE, designated SEQ ID:13604, to the nucleotide sequence of GAM7957 RNA, herein designated GAM RNA, also designated SEQ ID:297.

Another function of GAM7957 is therefore inhibition of Vascular endothelial growth factor (VEGF, Accession NP_003367.3), a gene which induces endothelial cell proliferation and vascular permeability and therefore may be associated with Tumors. Accordingly, utilities of GAM7957 include diagnosis, prevention and treatment of Tumors, and of other diseases and clinical conditions associated with VEGF.

The function of VEGF and its association with various diseases and clinical conditions, has been established by previous studies, as described hereinabove with reference to GAM500.1. Von hippel-lindau syndrome (VHL, Accession NP_000542.1) is another GAM7957 target gene, herein designated TARGET GENE. VHL BINDING SITE1 through VHL BINDING SITE3 are target binding sites found in untranslated regions of mRNA encoded by VHL, corresponding to target binding sites such as BINDING SITE I, BINDING SITE II or BINDING SITE III of FIG. 8. Table 4 illustrates the complementarity of the nucleotide sequences of VHL BINDING SITE1 through VHL BINDING SITE3, designated SEQ ID:19054, SEQ ID:5896 and SEQ ID:17264 respectively, to the nucleotide sequence of GAM7957 RNA, herein designated GAM RNA, also designated SEQ ID:297.

Another function of GAM7957 is therefore inhibition of Von hippel-lindau syndrome (VHL, Accession NP_000542.1), a gene which may control rna stability through the selective degradation of rna-bound proteins. and therefore is associated with Von hippel-lindau disease. Accordingly, utilities of GAM7957 include diagnosis, prevention and treatment of Von hippel-lindau disease, and of other diseases and clinical conditions associated with VHL.

The function of VHL and its association with various diseases and clinical conditions, has been established by previous studies, as described hereinabove with reference to GAM72.1. VIK (Accession NP_612503.1) is another GAM7957 target gene, herein designated TARGET GENE. VIK BINDING SITE is a target binding site found in the 3' untranslated region of multiple transcripts of mRNA encoded by VIK, corresponding to a target binding site such as BINDING SITE I, BINDING SITE II or BINDING SITE III of FIG. 8. Table 4 illustrates the complementarity of the nucleotide sequences of VIK BINDING SITE, designated SEQ ID:18691, to the nucleotide sequence of GAM7957 RNA, herein designated GAM RNA, also designated SEQ ID:297.

Another function of GAM7957 is therefore inhibition of VIK (Accession NP_612503.1). Accordingly, utilities of GAM7957 include diagnosis, prevention and treatment of diseases and clinical conditions associated with VIK.

VIPL (Accession NP_110432.1) is another GAM7957 target gene, herein designated TARGET GENE. VIPL BINDING SITE is a target binding site found in the 3' untranslated region of mRNA encoded by VIPL, corresponding to a target binding site such as BINDING SITE I, BINDING SITE II or BINDING SITE III of FIG. 8. Table 4 illustrates the complementarity of the nucleotide sequences of VIPL BINDING SITE, designated SEQ ID:19197, to the nucleotide sequence of GAM7957 RNA, herein designated GAM RNA, also designated SEQ ID:297.

Another function of GAM7957 is therefore inhibition of VIPL (Accession NP_110432.1). Accordingly, utilities of GAM7957 include diagnosis, prevention and treatment of diseases and clinical conditions associated with VIPL.

VprBP (Accession NP_055518.1) is another GAM7957 target gene, herein designated TARGET GENE. VprBP BINDING SITE is a target binding site found in the 3' untranslated region of mRNA encoded by VprBP, corresponding to a target binding site such as BINDING SITE I, BINDING SITE II or BINDING SITE III of FIG. 8. Table 4 illustrates the complementarity of the nucleotide sequences of VprBP BINDING SITE, designated SEQ ID:5044, to the nucleotide sequence of GAM7957 RNA, herein designated GAM RNA, also designated SEQ ID:297.

Another function of GAM7957 is therefore inhibition of VprBP (Accession NP_055518.1). Accordingly, utilities of GAM7957 include diagnosis, prevention and treatment of diseases and clinical conditions associated with VprBP.

Vacuolar protein sorting 4b (yeast) (VPS4B, Accession NP_004860.2) is another GAM7957 target gene, herein designated TARGET GENE. VPS4B BINDING SITE is a target binding site found in the 3' untranslated region of mRNA encoded by VPS4B, corresponding to a target binding site such as BINDING SITE I, BINDING SITE II or BINDING SITE III of FIG. 8. Table 4 illustrates the complementarity of the nucleotide sequences of VPS4B BINDING SITE, designated SEQ ID:10439, to the nucleotide sequence of GAM7957 RNA, herein designated GAM RNA, also designated SEQ ID:297.

Another function of GAM7957 is therefore inhibition of Vacuolar protein sorting 4b (yeast) (VPS4B, Accession NP_004860.2). Accordingly, utilities of GAM7957 include diagnosis, prevention and treatment of diseases and clinical conditions associated with VPS4B.

Williams-beuren syndrome chromosome region 1 (WBSCR1, Accession NP_114381.1) is another GAM7957 target gene, herein designated TARGET GENE. WBSCR1 BINDING SITE is a target binding site found in the 3' untranslated region of multiple transcripts of mRNA encoded by WBSCR1, corresponding to a target binding site such as BINDING SITE I, BINDING SITE II or BINDING SITE III of FIG. 8. Table 4 illustrates the complementarity of the nucleotide sequences of WBSCR1 BINDING SITE, designated SEQ ID:8562, to the nucleotide sequence of GAM7957 RNA, herein designated GAM RNA, also designated SEQ ID:297.

Another function of GAM7957 is therefore inhibition of Williams-beuren syndrome chromosome region 1 (WBSCR1, Accession NP_114381.1), a gene which stimulates protein translation and therefore may be associated with Williams syndrome. Accordingly, utilities of GAM7957 include diagnosis, prevention and treatment of Williams syndrome, and of other diseases and clinical conditions associated with WBSCR1.

The function of WBSCR1 and its association with various diseases and clinical conditions, has been established by previous studies, as described hereinabove with reference to GAM47.1. Williams-beuren syndrome chromosome region 1 (WBSCR1, Accession NP_071496.1) is another GAM7957 target gene, herein designated TARGET GENE. WBSCR1

BINDING SITE is a target binding site found in the 3' untranslated region of multiple transcripts of mRNA encoded by WBSCR1, corresponding to a target binding site such as BINDING SITE I, BINDING SITE II or BINDING SITE III of FIG. 8. Table 4 illustrates the complementarity of the nucleotide sequences of WBSCR1 BINDING SITE, designated SEQ ID:8562, to the nucleotide sequence of GAM7957 RNA, herein designated GAM RNA, also designated SEQ ID:297.

Another function of GAM7957 is therefore inhibition of Williams-beuren syndrome chromosome region 1 (WBSCR1, Accession NP_071496.1), a gene which stimulates protein translation and therefore may be associated with Williams syndrome. Accordingly, utilities of GAM7957 include diagnosis, prevention and treatment of Williams syndrome, and of other diseases and clinical conditions associated with WBSCR1.

The function of WBSCR1 and its association with various diseases and clinical conditions, has been established by previous studies, as described hereinabove with reference to GAM47.1. Williams beuren syndrome chromosome region 21 (WBSCR21, Accession NP_112585.2) is another GAM7957 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:15303, to the nucleotide sequence of GAM7957 RNA, herein designated GAM RNA, also designated SEQ ID:297.

Another function of GAM7957 is therefore inhibition of Williams beuren syndrome chromosome region 21 (WBSCR21, Accession NP_112585.2). Accordingly, utilities of GAM7957 include diagnosis, prevention and treatment of diseases and clinical conditions associated with WBSCR21.

Williams beuren syndrome chromosome region 21 (WBSCR21, Accession NP_683710.1) is another GAM7957 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:15303, to the nucleotide sequence of GAM7957 RNA, herein designated GAM RNA, also designated SEQ ID:297.

Another function of GAM7957 is therefore inhibition of Williams beuren syndrome chromosome region 21 (WBSCR21, Accession NP_683710.1). Accordingly, utilities of GAM7957 include diagnosis, prevention and treatment of diseases and clinical conditions associated with WBSCR21.

Williams beuren syndrome chromosome region 21 (WBSCR21, Accession NP_683711.1) is another GAM7957 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:15303, to the nucleotide sequence of GAM7957 RNA, herein designated GAM RNA, also designated SEQ ID:297.

Another function of GAM7957 is therefore inhibition of Williams beuren syndrome chromosome region 21 (WBSCR21, Accession NP_683711.1). Accordingly, utilities of GAM7957 include diagnosis, prevention and treatment of diseases and clinical conditions associated with WBSCR21.

Williams beuren syndrome chromosome region 21 (WBSCR21, Accession NP_683713.1) is another GAM7957 target gene, herein designated TARGET GENE. WBSCR21 BINDING SITE is a target binding site found in the 3' untranslated region of multiple transcripts of mRNA encoded by WBSCR21, corresponding to a target binding site such as BINDING SITE I, BINDING SITE II or BINDING SITE III of FIG. 8. Table 4 illustrates the complementarity of the nucleotide sequences of WBSCR21 BINDING SITE, designated SEQ ID:15303, to the nucleotide sequence of GAM7957 RNA, herein designated GAM RNA, also designated SEQ ID:297.

Another function of GAM7957 is therefore inhibition of Williams beuren syndrome chromosome region 21 (WBSCR21, Accession NP_683713.1). Accordingly, utilities of GAM7957 include diagnosis, prevention and treatment of diseases and clinical conditions associated with WBSCR21.

Williams-beuren syndrome chromosome region 23 (WBSCR23, Accession NP_079318.1) is another GAM7957 target gene, herein designated TARGET GENE. WBSCR23 BINDING SITE1 and WBSCR23 BINDING SITE2 are target binding sites found in untranslated regions of mRNA encoded by WBSCR23, corresponding to target binding sites such as BINDING SITE I, BINDING SITE II or BINDING SITE III of FIG. 8. Table 4 illustrates the complementarity of the nucleotide sequences of WBSCR23 BINDING SITE1 and WBSCR23 BINDING SITE2, designated SEQ ID:19838 and SEQ ID:14797 respectively, to the nucleotide sequence of GAM7957 RNA, herein designated GAM RNA, also designated SEQ ID:297.

Another function of GAM7957 is therefore inhibition of Williams-beuren syndrome chromosome region 23 (WBSCR23, Accession NP_079318.1). Accordingly, utilities of GAM7957 include diagnosis, prevention and treatment of diseases and clinical conditions associated with WBSCR23.

WDR23 (Accession NP_079506.3) is another GAM7957 target gene, herein designated TARGET GENE. WDR23 BINDING SITE1 and WDR23 BINDING SITE2 are target binding sites found in untranslated regions of multiple transcripts of mRNA encoded by WDR23, corresponding to target binding sites such as BINDING SITE I, BINDING SITE II or BINDING SITE III of FIG. 8. Table 4 illustrates the complementarity of the nucleotide sequences of WDR23 BINDING SITE1 and WDR23 BINDING SITE2, designated SEQ ID:14277 and SEQ ID:14277 respectively, to the nucleotide sequence of GAM7957 RNA, herein designated GAM RNA, also designated SEQ ID:297.

Another function of GAM7957 is therefore inhibition of WDR23 (Accession NP_079506.3). Accordingly, utilities of GAM7957 include diagnosis, prevention and treatment of diseases and clinical conditions associated with WDR23.

WDR23 (Accession NP_079506.3) is another GAM7957 target gene, herein designated TARGET GENE. WDR23 BINDING SITE1 and WDR23 BINDING SITE2 are target binding sites found in untranslated regions of multiple transcripts of mRNA encoded by WDR23, corresponding to target binding sites such as BINDING SITE I, BINDING SITE II or BINDING SITE III of FIG. 8. Table 4 illustrates the complementarity of the nucleotide sequences of WDR23 BINDING SITE1 and WDR23 BINDING SITE2, designated SEQ ID:10486 and SEQ ID:10486 respectively, to the nucleotide sequence of GAM7957 RNA, herein designated GAM RNA, also designated SEQ ID:297.

Another function of GAM7957 is therefore inhibition of WDR23 (Accession NP_079506.3). Accordingly, utilities of GAM7957 include diagnosis, prevention and treatment of diseases and clinical conditions associated with WDR23.

WIG1 (Accession NP_689426.1) is another GAM7957 target gene, herein designated TARGET GENE. WIG1 BINDING SITE is a target binding site found in the 3' untranslated region of multiple transcripts of mRNA encoded by WIG1, corresponding to a target binding site such as BINDING SITE I, BINDING SITE II or BINDING SITE III of FIG. 8. Table 4 illustrates the complementarity of the nucleotide sequences of WIG1 BINDING SITE, designated SEQ ID:15343, to the nucleotide sequence of GAM7957 RNA, herein designated GAM RNA, also designated SEQ ID:297.

Another function of GAM7957 is therefore inhibition of WIG1 (Accession NP_689426.1), a gene which is a sensor of cellular stress conditions including oncogenic activation, DNA damage and hypoxia. Accordingly, utilities of GAM7957 include diagnosis, prevention and treatment of diseases and clinical conditions associated with WIG1.

The function of WIG1 and its association with various diseases and clinical conditions, has been established by previous studies, as described hereinabove with reference to GAM347.2. WIG1 (Accession NP_071915.1) is another GAM7957 target gene, herein designated TARGET GENE. WIG1 BINDING SITE is a target binding site found in the 3' untranslated region of multiple transcripts of mRNA encoded by WIG1, corresponding to a target binding site such as BINDING SITE I, BINDING SITE II or BINDING SITE III of FIG. 8. Table 4 illustrates the complementarity of the nucleotide sequences of WIG1 BINDING SITE, designated SEQ ID:15343, to the nucleotide sequence of GAM7957 RNA, herein designated GAM RNA, also designated SEQ ID:297.

Another function of GAM7957 is therefore inhibition of WIG1 (Accession NP_071915.1), a gene which is a sensor of cellular stress conditions including oncogenic activation, DNA damage and hypoxia. Accordingly, utilities of GAM7957 include diagnosis, prevention and treatment of diseases and clinical conditions associated with WIG1.

The function of WIG1 and its association with various diseases and clinical conditions, has been established by previous studies, as described hereinabove with reference to GAM347.2. Wingless-type mmtv integration site family, member 7b (WNT7B, Accession NP_478679.1) is another GAM7957 target gene, herein designated TARGET GENE. WNT7B BINDING SITE is a target binding site found in the 3' untranslated region of mRNA encoded by WNT7B, corresponding to a target binding site such as BINDING SITE I, BINDING SITE II or BINDING SITE III of FIG. 8. Table 4 illustrates the complementarity of the nucleotide sequences of WNT7B BINDING SITE, designated SEQ ID:1621, to the nucleotide sequence of GAM7957 RNA, herein designated GAM RNA, also designated SEQ ID:297.

Another function of GAM7957 is therefore inhibition of Wingless-type mmtv integration site family, member 7b (WNT7B, Accession NP_478679.1). Accordingly, utilities of GAM7957 include diagnosis, prevention and treatment of diseases and clinical conditions associated with WNT7B.

Wingless-type mmtv integration site family, member 8b (WNT8B, Accession NP_003384.1) is another GAM7957 target gene, herein designated TARGET GENE. WNT8B BINDING SITE is a target binding site found in the 3' untranslated region of mRNA encoded by WNT8B, corresponding to a target binding site such as BINDING SITE I, BINDING SITE II or BINDING SITE III of FIG. 8. Table 4 illustrates the complementarity of the nucleotide sequences of WNT8B BINDING SITE, designated SEQ ID:3133, to the nucleotide sequence of GAM7957 RNA, herein designated GAM RNA, also designated SEQ ID:297.

Another function of GAM7957 is therefore inhibition of Wingless-type mmtv integration site family, member 8b (WNT8B, Accession NP_003384.1), a gene which is the ligand for members of the frizzled family of seven transmembrane receptors and may play an important role in the development and differentiation of certain forebrain structures. Accordingly, utilities of GAM7957 include diagnosis, prevention and treatment of diseases and clinical conditions associated with WNT8B.

The function of WNT8B and its association with various diseases and clinical conditions, has been established by previous studies, as described hereinabove with reference to GAM223.1. X-ray repair complementing defective repair in chinese hamster cells 2 (XRCC2, Accession NP_005422.1) is another GAM7957 target gene, herein designated TARGET GENE. XRCC2 BINDING SITE is a target binding site found in the 3' untranslated region of mRNA encoded by XRCC2, corresponding to a target binding site such as BINDING SITE I, BINDING SITE II or BINDING SITE III of FIG. 8. Table 4 illustrates the complementarity of the nucleotide sequences of XRCC2 BINDING SITE, designated SEQ ID:15223, to the nucleotide sequence of GAM7957 RNA, herein designated GAM RNA, also designated SEQ ID:297.

Another function of GAM7957 is therefore inhibition of X-ray repair complementing defective repair in chinese hamster cells 2 (XRCC2, Accession NP_005422.1), a gene which involves in the homologous recombination repair (hrr) pathway of double-stranded dna. Accordingly, utilities of GAM7957 include diagnosis, prevention and treatment of diseases and clinical conditions associated with XRCC2.

The function of XRCC2 and its association with various diseases and clinical conditions, has been established by previous studies, as described hereinabove with reference to GAM72.1. YEA (Accession NP_116215.1) is another GAM7957 target gene, herein designated TARGET GENE. YEA BINDING SITE is a target binding site found in the 3' untranslated region of mRNA encoded by YEA, corresponding to a target binding site such as BINDING SITE I, BINDING SITE II or BINDING SITE III of FIG. 8. Table 4 illustrates the complementarity of the nucleotide sequences of YEA BINDING SITE, designated SEQ ID:7319, to the nucleotide sequence of GAM7957 RNA, herein designated GAM RNA, also designated SEQ ID:297.

Another function of GAM7957 is therefore inhibition of YEA (Accession NP_116215.1). Accordingly, utilities of GAM7957 include diagnosis, prevention and treatment of diseases and clinical conditions associated with YEA.

Yme1-like 1 (s. cerevisiae) (YME1L1, Accession NP_055078.1) is another GAM7957 target gene, herein designated TARGET GENE. YME1L1 BINDING SITE1 and YME1L1 BINDING SITE2 are target binding sites found in untranslated regions of multiple transcripts of mRNA encoded by YME1L1, corresponding to target binding sites such as BINDING SITE I, BINDING SITE II or BINDING SITE III of FIG. 8. Table 4 illustrates the complementarity of the nucleotide sequences of YME1L1 BINDING SITE1 and YME1L1 BINDING SITE2, designated SEQ ID:9763 and SEQ ID:9763 respectively, to the nucleotide sequence of GAM7957 RNA, herein designated GAM RNA, also designated SEQ ID:297.

Another function of GAM7957 is therefore inhibition of Yme1-like 1 (s. cerevisiae) (YME1L1, Accession NP_055078.1). Accordingly, utilities of GAM7957 include diagnosis, prevention and treatment of diseases and clinical conditions associated with YME1L1.

Yme1-like 1 (s. cerevisiae) (YME1L1, Accession NP_055078.1) is another GAM7957 target gene, herein designated TARGET GENE. YME1L1 BINDING SITE1 and YME1L1 BINDING SITE2 are target binding sites found in untranslated regions of multiple transcripts of mRNA encoded by YME1L1, corresponding to target binding sites such as BINDING SITE I, BINDING SITE II or BINDING SITE III of FIG. 8. Table 4 illustrates the complementarity of the nucleotide sequences of YME1L1 BINDING SITE1 and YME1L1 BINDING SITE2, designated SEQ ID:18286 and SEQ ID:18286 respectively, to the nucleotide sequence of GAM7957 RNA, herein designated GAM RNA, also designated SEQ ID:297.

Another function of GAM7957 is therefore inhibition of Yme1-like 1 (s. cerevisiae) (YME1L1, Accession NP_055078.1). Accordingly, utilities of GAM7957 include diagnosis, prevention and treatment of diseases and clinical conditions associated with YME1L1.

ZADH1 (Accession NP_689657.1) is another GAM7957 target gene, herein designated TARGET GENE. ZADH1 BINDING SITE is a target binding site found in the 3' untranslated region of mRNA encoded by ZADH1, corresponding to a target binding site such as BINDING SITE I, BINDING SITE II or BINDING SITE III of FIG. 8. Table 4 illustrates the complementarity of the nucleotide sequences of ZADH1 BINDING SITE, designated SEQ ID:9120, to the nucleotide sequence of GAM7957 RNA, herein designated GAM RNA, also designated SEQ ID:297.

Another function of GAM7957 is therefore inhibition of ZADH1 (Accession NP_689657.1). Accordingly, utilities of GAM7957 include diagnosis, prevention and treatment of diseases and clinical conditions associated with ZADH1.

ZAK (Accession NP_598407.1) is another GAM7957 target gene, herein designated TARGET GENE. ZAK BINDING SITE is a target binding site found in the 3' untranslated region of multiple transcripts of mRNA encoded by ZAK, corresponding to a target binding site such as BINDING SITE I, BINDING SITE II or BINDING SITE III of FIG. 8. Table 4 illustrates the complementarity of the nucleotide sequences of ZAK BINDING SITE, designated SEQ ID:13065, to the nucleotide sequence of GAM7957 RNA, herein designated GAM RNA, also designated SEQ ID:297.

Another function of GAM7957 is therefore inhibition of ZAK (Accession NP_598407.1). Accordingly, utilities of GAM7957 include diagnosis, prevention and treatment of diseases and clinical conditions associated with ZAK.

ZBTB2 (Accession NP_065912.1) is another GAM7957 target gene, herein designated TARGET GENE. ZBTB2 BINDING SITE is a target binding site found in the 5' untranslated region of mRNA encoded by ZBTB2, corresponding to a target binding site such as BINDING SITE I, BINDING SITE II or BINDING SITE III of FIG. 8. Table 4 illustrates the complementarity of the nucleotide sequences of ZBTB2 BINDING SITE, designated SEQ ID:15154, to the nucleotide sequence of GAM7957 RNA, herein designated GAM RNA, also designated SEQ ID:297.

Another function of GAM7957 is therefore inhibition of ZBTB2 (Accession NP_065912.1). Accordingly, utilities of GAM7957 include diagnosis, prevention and treatment of diseases and clinical conditions associated with ZBTB2.

ZFD25 (Accession NP_057304.1) is another GAM7957 target gene, herein designated TARGET GENE. ZFD25 BINDING SITE is a target binding site found in the 3' untranslated region of mRNA encoded by ZFD25, corresponding to a target binding site such as BINDING SITE I, BINDING SITE II or BINDING SITE III of FIG. 8. Table 4 illustrates the complementarity of the nucleotide sequences of ZFD25 BINDING SITE, designated SEQ ID:19287, to the nucleotide sequence of GAM7957 RNA, herein designated GAM RNA, also designated SEQ ID:297.

Another function of GAM7957 is therefore inhibition of ZFD25 (Accession NP_057304.1). Accordingly, utilities of GAM7957 include diagnosis, prevention and treatment of diseases and clinical conditions associated with ZFD25.

ZFP106 (Accession NP_071918.1) is another GAM7957 target gene, herein designated TARGET GENE. ZFP106 BINDING SITE1 and ZFP106 BINDING SITE2 are target binding sites found in untranslated regions of mRNA encoded by ZFP106, corresponding to target binding sites such as BINDING SITE I, BINDING SITE II or BINDING SITE III of FIG. 8. Table 4 illustrates the complementarity of the nucleotide sequences of ZFP106 BINDING SITE1 and ZFP106 BINDING SITE2, designated SEQ ID:13058 and SEQ ID:17808 respectively, to the nucleotide sequence of GAM7957 RNA, herein designated GAM RNA, also designated SEQ ID:297.

Another function of GAM7957 is therefore inhibition of ZFP106 (Accession NP_071918.1). Accordingly, utilities of GAM7957 include diagnosis, prevention and treatment of diseases and clinical conditions associated with ZFP106.

ZFP30 (Accession NP_055713.1) is another GAM7957 target gene, herein designated TARGET GENE. ZFP30 BINDING SITE is a target binding site found in the 3' untranslated region of mRNA encoded by ZFP30, corresponding to a target binding site such as BINDING SITE I, BINDING SITE II or BINDING SITE III of FIG. 8. Table 4 illustrates the complementarity of the nucleotide sequences of ZFP30 BINDING SITE, designated SEQ ID:14388, to the nucleotide sequence of GAM7957 RNA, herein designated GAM RNA, also designated SEQ ID:297.

Another function of GAM7957 is therefore inhibition of ZFP30 (Accession NP_055713.1). Accordingly, utilities of GAM7957 include diagnosis, prevention and treatment of diseases and clinical conditions associated with ZFP30.

Zinc finger protein 91 homolog (mouse) (ZFP91, Accession NP_444251.1) is another GAM7957 target gene, herein designated TARGET GENE. ZFP91 BINDING SITE is a target binding site found in the 3' untranslated region of multiple transcripts of mRNA encoded by ZFP91, corresponding to a target binding site such as BINDING SITE I, BINDING SITE II or BINDING SITE III of FIG. 8. Table 4 illustrates the complementarity of the nucleotide sequences of ZFP91 BINDING SITE, designated SEQ ID:883, to the nucleotide sequence of GAM7957 RNA, herein designated GAM RNA, also designated SEQ ID:297.

Another function of GAM7957 is therefore inhibition of Zinc finger protein 91 homolog (mouse) (ZFP91, Accession NP_444251.1). Accordingly, utilities of GAM7957 include diagnosis, prevention and treatment of diseases and clinical conditions associated with ZFP91.

Zinc finger, imprinted 3 (ZIM3, Accession NP_443114.1) is another GAM7957 target gene, herein designated TARGET GENE. ZIM3 BINDING SITE1 and ZIM3 BINDING SITE2 are target binding sites found in untranslated regions of mRNA encoded by ZIM3, corresponding to target binding sites such as BINDING SITE I, BINDING SITE II or BINDING SITE III of FIG. 8. Table 4 illustrates the complementarity of the nucleotide sequences of ZIM3 BINDING SITE1 and ZIM3 BINDING SITE2, designated SEQ ID:19880 and SEQ ID:10267 respectively, to the nucleotide sequence of GAM7957 RNA, herein designated GAM RNA, also designated SEQ ID:297.

Another function of GAM7957 is therefore inhibition of Zinc finger, imprinted 3 (ZIM3, Accession NP_443114.1). Accordingly, utilities of GAM7957 include diagnosis, prevention and treatment of diseases and clinical conditions associated with ZIM3.

Zinc finger protein 11b (kox 2) (ZNF11B, Accession NP_008886.1) is another GAM7957 target gene, herein designated TARGET GENE. ZNF11B BINDING SITE is a target binding site found in the 3' untranslated region of mRNA encoded by ZNF11B, corresponding to a target binding site such as BINDING SITE I, BINDING SITE II or BINDING SITE III of FIG. 8. Table 4 illustrates the complementarity of the nucleotide sequences of ZNF11B BINDING SITE, designated SEQ ID:15224, to the nucleotide sequence of GAM7957 RNA, herein designated GAM RNA, also designated SEQ ID:297.

Another function of GAM7957 is therefore inhibition of Zinc finger protein 11b (kox 2) (ZNF11B, Accession NP_008886.1). Accordingly, utilities of GAM7957 include diagnosis, prevention and treatment of diseases and clinical conditions associated with ZNF11B.

Zinc finger protein 14 (kox 6) (ZNF14, Accession NP_066358.1) is another GAM7957 target gene, herein designated TARGET GENE. ZNF14 BINDING SITE is a target binding site found in the 3' untranslated region of mRNA encoded by ZNF14, corresponding to a target binding site such as BINDING SITE I, BINDING SITE II or BINDING SITE III of FIG. 8. Table 4 illustrates the complementarity of the nucleotide sequences of ZNF14 BINDING SITE, designated SEQ ID:5303, to the nucleotide sequence of GAM7957 RNA, herein designated GAM RNA, also designated SEQ ID:297.

Another function of GAM7957 is therefore inhibition of Zinc finger protein 14 (kox 6) (ZNF14, Accession NP_066358.1). Accordingly, utilities of GAM7957 include diagnosis, prevention and treatment of diseases and clinical conditions associated with ZNF14.

Zinc finger protein 197 (ZNF197, Accession NP_008922.1) is another GAM7957 target gene, herein designated TARGET GENE. ZNF197 BINDING SITE is a target binding site found in the 3' untranslated region of mRNA encoded by ZNF197, corresponding to a target binding site such as BINDING SITE I, BINDING SITE II or BINDING SITE III of FIG. 8. Table 4 illustrates the complementarity of the nucleotide sequences of ZNF197 BINDING SITE, designated SEQ ID:2173, to the nucleotide sequence of GAM7957 RNA, herein designated GAM RNA, also designated SEQ ID:297.

Another function of GAM7957 is therefore inhibition of Zinc finger protein 197 (ZNF197, Accession NP_008922.1). Accordingly, utilities of GAM7957 include diagnosis, prevention and treatment of diseases and clinical conditions associated with ZNF197.

Zinc finger protein 264 (ZNF264, Accession NP_003408.1) is another GAM7957 target gene, herein designated TARGET GENE. ZNF264 BINDING SITE is a target binding site found in the 3' untranslated region of mRNA encoded by ZNF264, corresponding to a target binding site such as BINDING SITE I, BINDING SITE II or BINDING SITE III of FIG. 8. Table 4 illustrates the complementarity of the nucleotide sequences of ZNF264 BINDING SITE, designated SEQ ID:2367, to the nucleotide sequence of GAM7957 RNA, herein designated GAM RNA, also designated SEQ ID:297.

Another function of GAM7957 is therefore inhibition of Zinc finger protein 264 (ZNF264, Accession NP_003408.1). Accordingly, utilities of GAM7957 include diagnosis, prevention and treatment of diseases and clinical conditions associated with ZNF264.

Zinc finger protein 271 (ZNF271, Accession NP_006620.2) is another GAM7957 target gene, herein designated TARGET GENE. ZNF271 BINDING SITE is a target binding site found in the 3' untranslated region of mRNA encoded by ZNF271, corresponding to a target binding site such as BINDING SITE I, BINDING SITE II or BINDING SITE III of FIG. 8. Table 4 illustrates the complementarity of the nucleotide sequences of ZNF271 BINDING SITE, designated SEQ ID:13091, to the nucleotide sequence of GAM7957 RNA, herein designated GAM RNA, also designated SEQ ID:297.

Another function of GAM7957 is therefore inhibition of Zinc finger protein 271 (ZNF271, Accession NP_006620.2). Accordingly, utilities of GAM7957 include diagnosis, prevention and treatment of diseases and clinical conditions associated with ZNF271.

Zinc finger protein 297b (ZNF297B, Accession NP_054726.1) is another GAM7957 target gene, herein designated TARGET GENE. ZNF297B BINDING SITE1 and ZNF297B BINDING SITE2 are target binding sites found in untranslated regions of mRNA encoded by ZNF297B, corresponding to target binding sites such as BINDING SITE I, BINDING SITE II or BINDING SITE III of FIG. 8. Table 4 illustrates the complementarity of the nucleotide sequences of ZNF297B BINDING SITE1 and ZNF297B BINDING SITE2, designated SEQ ID:3235 and SEQ ID:15000 respectively, to the nucleotide sequence of GAM7957 RNA, herein designated GAM RNA, also designated SEQ ID:297.

Another function of GAM7957 is therefore inhibition of Zinc finger protein 297b (ZNF297B, Accession NP_054726.1). Accordingly, utilities of GAM7957 include diagnosis, prevention and treatment of diseases and clinical conditions associated with ZNF297B.

ZNF333 (Accession NP_115809.1) is another GAM7957 target gene, herein designated TARGET GENE. ZNF333 BINDING SITE is a target binding site found in the 3' untranslated region of mRNA encoded by ZNF333, corresponding to a target binding site such as BINDING SITE I, BINDING SITE II or BINDING SITE III of FIG. 8. Table 4 illustrates the complementarity of the nucleotide sequences of ZNF333 BINDING SITE, designated SEQ ID:12792, to the nucleotide sequence of GAM7957 RNA, herein designated GAM RNA, also designated SEQ ID:297.

Another function of GAM7957 is therefore inhibition of ZNF333 (Accession NP_115809.1). Accordingly, utilities of GAM7957 include diagnosis, prevention and treatment of diseases and clinical conditions associated with ZNF333.

Zinc finger protein 339 (ZNF339, Accession NP_067043.1) is another GAM7957 target gene, herein designated TARGET GENE. ZNF339 BINDING SITE is a target binding site found in the 3' untranslated region of mRNA encoded by ZNF339, corresponding to a target binding site such as BINDING SITE I, BINDING SITE II or BINDING SITE III of FIG. 8. Table 4 illustrates the complementarity of the nucleotide sequences of ZNF339 BINDING SITE, designated SEQ ID:2484, to the nucleotide sequence of GAM7957 RNA, herein designated GAM RNA, also designated SEQ ID:297.

Another function of GAM7957 is therefore inhibition of Zinc finger protein 339 (ZNF339, Accession NP_067043.1).

Accordingly, utilities of GAM7957 include diagnosis, prevention and treatment of diseases and clinical conditions associated with ZNF339.

Zinc finger protein 33a (kox 31) (ZNF33A, Accession NP_008905.1) is another GAM7957 target gene, herein designated TARGET GENE. ZNF33A BINDING SITE is a target binding site found in the 3' untranslated region of mRNA encoded by ZNF33A, corresponding to a target binding site such as BINDING SITE I, BINDING SITE II or BINDING SITE III of FIG. 8. Table 4 illustrates the complementarity of the nucleotide sequences of ZNF33A BINDING SITE, designated SEQ ID:19246, to the nucleotide sequence of GAM7957 RNA, herein designated GAM RNA, also designated SEQ ID:297.

Another function of GAM7957 is therefore inhibition of Zinc finger protein 33a (kox 31) (ZNF33A, Accession NP_008905.1). Accordingly, utilities of GAM7957 include diagnosis, prevention and treatment of diseases and clinical conditions associated with ZNF33A.

Zinc finger protein 347 (ZNF347, Accession NP_115973.1) is another GAM7957 target gene, herein designated TARGET GENE. ZNF347 BINDING SITE is a target binding site found in the 3' untranslated region of mRNA encoded by ZNF347, corresponding to a target binding site such as BINDING SITE I, BINDING SITE II or BINDING SITE III of FIG. 8. Table 4 illustrates the complementarity of the nucleotide sequences of ZNF347 BINDING SITE, designated SEQ ID:9422, to the nucleotide sequence of GAM7957 RNA, herein designated GAM RNA, also designated SEQ ID:297.

Another function of GAM7957 is therefore inhibition of Zinc finger protein 347 (ZNF347, Accession NP_115973.1). Accordingly, utilities of GAM7957 include diagnosis, prevention and treatment of diseases and clinical conditions associated with ZNF347.

Zinc finger protein 36 (kox 18) (ZNF36, Accession XP_168302.1) is another GAM7957 target gene, herein designated TARGET GENE. ZNF36 BINDING SITE is a target binding site found in the 3' untranslated region of mRNA encoded by ZNF36, corresponding to a target binding site such as BINDING SITE I, BINDING SITE II or BINDING SITE III of FIG. 8. Table 4 illustrates the complementarity of the nucleotide sequences of ZNF36 BINDING SITE, designated SEQ ID:10435, to the nucleotide sequence of GAM7957 RNA, herein designated GAM RNA, also designated SEQ ID:297.

Another function of GAM7957 is therefore inhibition of Zinc finger protein 36 (kox 18) (ZNF36, Accession XP_168302.1), a gene which may be involved in transcriptional regulation. Accordingly, utilities of GAM7957 include diagnosis, prevention and treatment of diseases and clinical conditions associated with ZNF36.

The function of ZNF36 and its association with various diseases and clinical conditions, has been established by previous studies, as described hereinabove with reference to GAM31.1. ZNF409 (Accession NP_055709.1) is another GAM7957 target gene, herein designated TARGET GENE. ZNF409 BINDING SITE is a target binding site found in the 3' untranslated region of mRNA encoded by ZNF409, corresponding to a target binding site such as BINDING SITE I, BINDING SITE II or BINDING SITE III of FIG. 8. Table 4 illustrates the complementarity of the nucleotide sequences of ZNF409 BINDING SITE, designated SEQ ID:15207, to the nucleotide sequence of GAM7957 RNA, herein designated GAM RNA, also designated SEQ ID:297.

Another function of GAM7957 is therefore inhibition of ZNF409 (Accession NP_055709.1). Accordingly, utilities of GAM7957 include diagnosis, prevention and treatment of diseases and clinical conditions associated with ZNF409.

ZNF426 (Accession NP_077011.1) is another GAM7957 target gene, herein designated TARGET GENE. ZNF426 BINDING SITE is a target binding site found in the 3' untranslated region of mRNA encoded by ZNF426, corresponding to a target binding site such as BINDING SITE I, BINDING SITE II or BINDING SITE III of FIG. 8. Table 4 illustrates the complementarity of the nucleotide sequences of ZNF426 BINDING SITE, designated SEQ ID:9759, to the nucleotide sequence of GAM7957 RNA, herein designated GAM RNA, also designated SEQ ID:297.

Another function of GAM7957 is therefore inhibition of ZNF426 (Accession NP_077011.1). Accordingly, utilities of GAM7957 include diagnosis, prevention and treatment of diseases and clinical conditions associated with ZNF426.

ZNF430 (Accession NP_079465.1) is another GAM7957 target gene, herein designated TARGET GENE. ZNF430 BINDING SITE1 and ZNF430 BINDING SITE2 are target binding sites found in untranslated regions of mRNA encoded by ZNF430, corresponding to target binding sites such as BINDING SITE I, BINDING SITE II or BINDING SITE III of FIG. 8. Table 4 illustrates the complementarity of the nucleotide sequences of ZNF430 BINDING SITE1 and ZNF430 BINDING SITE2, designated SEQ ID:10917 and SEQ ID:15089 respectively, to the nucleotide sequence of GAM7957 RNA, herein designated GAM RNA, also designated SEQ ID:297.

Another function of GAM7957 is therefore inhibition of ZNF430 (Accession NP_079465.1). Accordingly, utilities of GAM7957 include diagnosis, prevention and treatment of diseases and clinical conditions associated with ZNF430.

ZNF431 (Accession XP_086098.2) is another GAM7957 target gene, herein designated TARGET GENE. ZNF431 BINDING SITE is a target binding site found in the 3' untranslated region of mRNA encoded by ZNF431, corresponding to a target binding site such as BINDING SITE I, BINDING SITE II or BINDING SITE III of FIG. 8. Table 4 illustrates the complementarity of the nucleotide sequences of ZNF431 BINDING SITE, designated SEQ ID:7868, to the nucleotide sequence of GAM7957 RNA, herein designated GAM RNA, also designated SEQ ID:297.

Another function of GAM7957 is therefore inhibition of ZNF431 (Accession XP_086098.2). Accordingly, utilities of GAM7957 include diagnosis, prevention and treatment of diseases and clinical conditions associated with ZNF431.

ZNF432 (Accession NP_055465.1) is another GAM7957 target gene, herein designated TARGET GENE. ZNF432 BINDING SITE is a target binding site found in the 3' untranslated region of mRNA encoded by ZNF432, corresponding to a target binding site such as BINDING SITE I, BINDING SITE II or BINDING SITE III of FIG. 8. Table 4 illustrates the complementarity of the nucleotide sequences of ZNF432 BINDING SITE, designated SEQ ID:5251, to the nucleotide sequence of GAM7957 RNA, herein designated GAM RNA, also designated SEQ ID:297.

Another function of GAM7957 is therefore inhibition of ZNF432 (Accession NP_055465.1). Accordingly, utilities of GAM7957 include diagnosis, prevention and treatment of diseases and clinical conditions associated with ZNF432.

ZNF440 (Accession NP_689570.1) is another GAM7957 target gene, herein designated TARGET GENE. ZNF440 BINDING SITE is a target binding site found in the 3' untranslated region of mRNA encoded by ZNF440, corresponding to a target binding site such as BINDING SITE I, BINDING SITE II or BINDING SITE III of FIG. 8. Table 4 illustrates the complementarity of the nucleotide sequences of ZNF440 BINDING SITE, designated SEQ ID:14055, to the nucleotide sequence of GAM7957 RNA, herein designated GAM RNA, also designated SEQ ID:297.

Another function of GAM7957 is therefore inhibition of ZNF440 (Accession NP_689570.1). Accordingly, utilities of GAM7957 include diagnosis, prevention and treatment of diseases and clinical conditions associated with ZNF440.

ZNF444 (Accession NP_060807.1) is another GAM7957 target gene, herein designated TARGET GENE. ZNF444 BINDING SITE is a target binding site found in the 3' untranslated region of mRNA encoded by ZNF444, corresponding to a target binding site such as BINDING SITE I, BINDING SITE II or BINDING SITE III of FIG. 8. Table 4 illustrates the complementarity of the nucleotide sequences of ZNF444 BINDING SITE, designated SEQ ID:7772, to the nucleotide sequence of GAM7957 RNA, herein designated GAM RNA, also designated SEQ ID:297.

Another function of GAM7957 is therefore inhibition of ZNF444 (Accession NP_060807.1). Accordingly, utilities of GAM7957 include diagnosis, prevention and treatment of diseases and clinical conditions associated with ZNF444.

ZNF450 (Accession NP_055612.1) is another GAM7957 target gene, herein designated TARGET GENE. ZNF450 BINDING SITE1 and ZNF450 BINDING SITE2 are target binding sites found in untranslated regions of mRNA encoded by ZNF450, corresponding to target binding sites such as BINDING SITE I, BINDING SITE II or BINDING SITE III of FIG. 8. Table 4 illustrates the complementarity of the nucleotide sequences of ZNF450 BINDING SITE1 and ZNF450 BINDING SITE2, designated SEQ ID:6071 and SEQ ID:10867 respectively, to the nucleotide sequence of GAM7957 RNA, herein designated GAM RNA, also designated SEQ ID:297.

Another function of GAM7957 is therefore inhibition of ZNF450 (Accession NP_055612.1). Accordingly, utilities of GAM7957 include diagnosis, prevention and treatment of diseases and clinical conditions associated with ZNF450.

Zinc finger protein 74 (cos52) (ZNF74, Accession NP_003417.1) is another GAM7957 target gene, herein designated TARGET GENE. ZNF74 BINDING SITE is a target binding site found in the 3' untranslated region of mRNA encoded by ZNF74, corresponding to a target binding site such as BINDING SITE I, BINDING SITE II or BINDING SITE III of FIG. 8. Table 4 illustrates the complementarity of the nucleotide sequences of ZNF74 BINDING SITE, designated SEQ ID:12062, to the nucleotide sequence of GAM7957 RNA, herein designated GAM RNA, also designated SEQ ID:297.

Another function of GAM7957 is therefore inhibition of Zinc finger protein 74 (cos52) (ZNF74, Accession NP_003417.1). Accordingly, utilities of GAM7957 include diagnosis, prevention and treatment of diseases and clinical conditions associated with ZNF74.

Zinc finger protein 91 (hpf7, htf10) (ZNF91, Accession NP_003421.1) is another GAM7957 target gene, herein designated TARGET GENE. ZNF91 BINDING SITE is a target binding site found in the 3' untranslated region of mRNA encoded by ZNF91, corresponding to a target binding site such as BINDING SITE I, BINDING SITE II or BINDING SITE III of FIG. 8. Table 4 illustrates the complementarity of the nucleotide sequences of ZNF91 BINDING SITE, designated SEQ ID:15343, to the nucleotide sequence of GAM7957 RNA, herein designated GAM RNA, also designated SEQ ID:297.

Another function of GAM7957 is therefore inhibition of Zinc finger protein 91 (hpf7, htf10) (ZNF91, Accession NP_003421.1). Accordingly, utilities of GAM7957 include diagnosis, prevention and treatment of diseases and clinical conditions associated with ZNF91.

FIG. 8 further provides a conceptual description of a novel bioinformatically detected of the present invention, referred to here as Genomic Address Messenger 8145 (GAM8145), which modulates expression of respective target genes thereof, the function and utility of which target genes is known in the art.

GAM8145 is a novel bioinformatically detected regulatory, non protein coding, micro RNA (miRNA) gene. The method by which GAM8145 was detected is described hereinabove with reference to FIGS. 8-15.

GAM8145 gene, herein designated GAM GENE, and GAM8145 target gene, herein designated TARGET GENE, are human genes contained in the human genome.

GAM8145 gene encodes a GAM8145 precursor RNA, herein designated GAM PRECURSOR RNA. Similar to other miRNA genes, and unlike most ordinary genes, GAM8145 precursor RNA does not encode a protein. A nucleotide sequence identical or highly similar to the nucleotide sequence of GAM8145 precursor RNA is designated SEQ ID:112, and is provided hereinbelow with reference to the sequence listing part.

GAM8145 precursor RNA folds onto itself, forming GAM8145 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM8145 precursor RNA folds onto itself, forming GAM8145 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM8145 precursor RNA, designated SEQ-ID:112, and a schematic representation of a predicted secondary folding of GAM8145 folded precursor RNA are further described with reference to Table 2, hereby incorporated by reference.

An enzyme complex designated DICER COMPLEX, 'dices' the GAM8145 folded precursor RNA into GAM8145 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM8145 RNA is designated SEQ ID:328, and is provided hereinbelow with references to the sequence listing part and Table 3, hereby incorporated by reference.

GAM8145 target gene, herein designated TARGET GENE, encodes a corresponding messenger RNA, GAM8145 target RNA, herein designated GAM TARGET RNA. GAM8145 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM8145 RNA, herein designated GAM RNA, binds complementarily to one or more target binding sites located in untranslated regions of GAM8145 target RNA, herein designated GAM TARGET RNA. This complementary binding is due to the fact that the nucleotide sequence of GAM8145 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM8145 RNA may have a different number of target binding sites in untranslated regions of a GAM8145 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM8145 RNA, herein designated GAM RNA, to target binding sites on GAM8145 target RNA, herein designated GAM TARGET RNA, such as BINDING SITE I, BINDING SITE II and BINDING SITE III, inhibits translation of GAM8145 target RNA into GAM8145 target protein, herein designated GAM TARGET PROTEIN. GAM target protein is therefore outlined by a broken line.

It is appreciated that GAM8145 target gene, herein designated TARGET GENE, in fact represents a plurality of GAM8145 target genes. The mRNA of each one of this plurality of GAM8145 target genes comprises one or more target binding sites, each having a nucleotide sequence which is at least partly complementary to GAM8145 RNA, herein designated GAM RNA, and which when bound by GAM8145 RNA causes inhibition of translation of respective one or more GAM8145 target proteins.

It is further appreciated by one skilled in the art that the mode of translational inhibition illustrated by FIG. 8 with specific reference to translational inhibition exerted by GAM8145 gene, herein designated GAM GENE, on one or more GAM8145 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM8145 correlate with, and may be deduced from, the identity of the target genes which GAM8145 binds and inhibits, and the function of these target genes, as elaborated hereinbelow.

(Accession NP_061085.1) is a GAM8145 target gene, herein designated TARGET GENE. BINDING SITE is a target binding site found in the 3' untranslated region of multiple transcripts of mRNA encoded by, corresponding to a target binding site such as BINDING SITE I, BINDING SITE II or BINDING SITE III of FIG. 8. Table 4 illustrates the complementarity of the nucleotide sequences of BINDING SITE, designated SEQ ID:1692, to the nucleotide sequence of GAM8145 RNA, herein designated GAM RNA, also designated SEQ ID:328.

A function of GAM8145 is therefore inhibition of (Accession NP_061085.1). Accordingly, utilities of GAM8145 include diagnosis, prevention and treatment of diseases and clinical conditions associated with .

Adrenergic, alpha-2a-, receptor (ADRA2A, Accession NP_000672.2) is another GAM8145 target gene, herein designated TARGET GENE. ADRA2A BINDING SITE is a target binding site found in the 3' untranslated region of mRNA encoded by ADRA2A, corresponding to a target binding site such as BINDING SITE I, BINDING SITE II or BINDING SITE III of FIG. 8. Table 4 illustrates the complementarity of the nucleotide sequences of ADRA2A BINDING SITE, designated SEQ ID:4823, to the nucleotide sequence of GAM8145 RNA, herein designated GAM RNA, also designated SEQ ID:328.

Another function of GAM8145 is therefore inhibition of Adrenergic, alpha-2a-, receptor (ADRA2A, Accession NP_000672.2), a gene which mediates the effects of epinephrine and norepinephrine. Accordingly, utilities of GAM8145 include diagnosis, prevention and treatment of diseases and clinical conditions associated with ADRA2A.

The function of ADRA2A and its association with various diseases and clinical conditions, has been established by previous studies, as described hereinabove with reference to GAM450.2. Adrenergic, beta-1-, receptor (ADRB1, Accession NP_000675.1) is another GAM8145 target gene, herein designated TARGET GENE. ADRB1 BINDING SITE is a target binding site found in the 3' untranslated region of mRNA encoded by ADRB1, corresponding to a target binding site such as BINDING SITE I, BINDING SITE II or BINDING SITE III of FIG. 8. Table 4 illustrates the complementarity of the nucleotide sequences of ADRB1 BINDING SITE, designated SEQ ID:10737, to the nucleotide sequence of GAM8145 RNA, herein designated GAM RNA, also designated SEQ ID:328.

Another function of GAM8145 is therefore inhibition of Adrenergic, beta-1-, receptor (ADRB1, Accession NP_000675.1), a gene which stimulates adenylyl cyclase activity and mediates catecholamine function. Accordingly, utilities of GAM8145 include diagnosis, prevention and treatment of diseases and clinical conditions associated with ADRB1.

The function of ADRB1 and its association with various diseases and clinical conditions, has been established by previous studies, as described hereinabove with reference to GAM1045.1. Arylsulfatase b (ARSB, Accession NP_000037.1) is another GAM8145 target gene, herein designated TARGET GENE. ARSB BINDING SITE is a target binding site found in the 3' untranslated region of mRNA encoded by ARSB, corresponding to a target binding site such as BINDING SITE I, BINDING SITE II or BINDING SITE III of FIG. 8. Table 4 illustrates the complementarity of the nucleotide sequences of ARSB BINDING SITE, designated SEQ ID:9103, to the nucleotide sequence of GAM8145 RNA, herein designated GAM RNA, also designated SEQ ID:328.

Another function of GAM8145 is therefore inhibition of Arylsulfatase b (ARSB, Accession NP_000037.1). Accordingly, utilities of GAM8145 include diagnosis, prevention and treatment of diseases and clinical conditions associated with ARSB.

Atpase, h+ transporting, lysosomal interacting protein 2 (ATP6IP2, Accession NP_005756.2) is another GAM8145 target gene, herein designated TARGET GENE. ATP6IP2 BINDING SITE is a target binding site found in the 3' untranslated region of mRNA encoded by ATP6IP2, corresponding to a target binding site such as BINDING SITE I, BINDING SITE II or BINDING SITE III of FIG. 8. Table 4 illustrates the complementarity of the nucleotide sequences of ATP6IP2 BINDING SITE, designated SEQ ID:7285, to the nucleotide sequence of GAM8145 RNA, herein designated GAM RNA, also designated SEQ ID:328.

Another function of GAM8145 is therefore inhibition of Atpase, h+ transporting, lysosomal interacting protein 2 (ATP6IP2, Accession NP_005756.2). Accordingly, utilities of GAM8145 include diagnosis, prevention and treatment of diseases and clinical conditions associated with ATP6IP2.

BSPRY (Accession NP_060158.1) is another GAM8145 target gene, herein designated TARGET GENE. BSPRY BINDING SITE is a target binding site found in the 3' untranslated region of mRNA encoded by BSPRY, corresponding to a target binding site such as BINDING SITE I, BINDING SITE II or BINDING SITE III of FIG. 8. Table 4 illustrates the complementarity of the nucleotide sequences of BSPRY BINDING SITE, designated SEQ ID:5340, to the nucleotide sequence of GAM8145 RNA, herein designated GAM RNA, also designated SEQ ID:328.

Another function of GAM8145 is therefore inhibition of BSPRY (Accession NP_060158.1). Accordingly, utilities of GAM8145 include diagnosis, prevention and treatment of diseases and clinical conditions associated with BSPRY.

Chromosome 1 open reading frame 1 (C1orf1, Accession NP_001204.1) is another GAM8145 target gene, herein designated TARGET GENE. C1orf1 BINDING SITE is a target binding site found in the 3' untranslated region of mRNA encoded by C1orf1, corresponding to a target binding site such as BINDING SITE I, BINDING SITE II or BINDING SITE III of FIG. 8. Table 4 illustrates the complementarity of the nucleotide sequences of C1orf1 BINDING SITE, designated SEQ ID:14716, to the nucleotide sequence of GAM8145 RNA, herein designated GAM RNA, also designated SEQ ID:328.

Another function of GAM8145 is therefore inhibition of Chromosome 1 open reading frame 1 (C1orf1, Accession NP_001204.1). Accordingly, utilities of GAM8145 include diagnosis, prevention and treatment of diseases and clinical conditions associated with C1orf1.

Chromosome 1 open reading frame 22 (C1orf22, Accession NP_079467.2) is another GAM8145 target gene, herein designated TARGET GENE. C1orf22 BINDING SITE is a target binding site found in the 3' untranslated region of mRNA encoded by C1orf22, corresponding to a target binding site such as BINDING SITE I, BINDING SITE II or BINDING SITE III of FIG. 8. Table 4 illustrates the complementarity of the nucleotide sequences of C1orf22 BINDING SITE, designated SEQ ID:10321, to the nucleotide sequence of GAM8145 RNA, herein designated GAM RNA, also designated SEQ ID:328.

Another function of GAM8145 is therefore inhibition of Chromosome 1 open reading frame 22 (C1orf22, Accession NP_079467.2). Accordingly, utilities of GAM8145 include diagnosis, prevention and treatment of diseases and clinical conditions associated with C1orf22.

C1QDC1 (Accession NP_076414.2) is another GAM8145 target gene, herein designated TARGET GENE. C1QDC1 BINDING SITE is a target binding site found in the 5' untranslated region of multiple transcripts of mRNA encoded by C1QDC1, corresponding to a target binding site such as BINDING SITE I, BINDING SITE II or BINDING SITE III of FIG. 8. Table 4 illustrates the complementarity of the nucleotide sequences of C1QDC1 BINDING SITE, designated SEQ ID:11118, to the nucleotide sequence of GAM8145 RNA, herein designated GAM RNA, also designated SEQ ID:328.

Another function of GAM8145 is therefore inhibition of C1QDC1 (Accession NP_076414.2). Accordingly, utilities of GAM8145 include diagnosis, prevention and treatment of diseases and clinical conditions associated with C1QDC1.

C1QDC1 (Accession NP_115532.1) is another GAM8145 target gene, herein designated TARGET GENE. C1QDC1 BINDING SITE is a target binding site found in the 5' untranslated region of multiple transcripts of mRNA encoded by C1QDC1, corresponding to a target binding site such as BINDING SITE I, BINDING SITE II or BINDING SITE III of FIG. 8. Table 4 illustrates the complementarity of the nucleotide sequences of C1QDC1 BINDING SITE, designated SEQ ID:11118, to the nucleotide sequence of GAM8145 RNA, herein designated GAM RNA, also designated SEQ ID:328.

Another function of GAM8145 is therefore inhibition of C1QDC1 (Accession NP_115532.1). Accordingly, utilities of GAM8145 include diagnosis, prevention and treatment of diseases and clinical conditions associated with C1QDC1.

Chromosome 20 open reading frame 72 (C20orf72, Accession NP_443097.1) is another GAM8145 target gene, herein designated TARGET GENE. C20orf72 BINDING SITE is a target binding site found in the 3' untranslated region of mRNA encoded by C20orf72, corresponding to a target binding site such as BINDING SITE I, BINDING SITE II or BINDING SITE III of FIG. 8. Table 4 illustrates the complementarity of the nucleotide sequences of C20orf72 BINDING SITE, designated SEQ ID:3280, to the nucleotide sequence of GAM8145 RNA, herein designated GAM RNA, also designated SEQ ID:328.

Another function of GAM8145 is therefore inhibition of Chromosome 20 open reading frame 72 (C20orf72, Accession NP_443097.1). Accordingly, utilities of GAM8145 include diagnosis, prevention and treatment of diseases and clinical conditions associated with C20orf72.

C6orf5 (Accession NP_056339.2) is another GAM8145 target gene, herein designated TARGET GENE. C6orf5 BINDING SITE is a target binding site found in the 3' untranslated region of mRNA encoded by C6orf5, corresponding to a target binding site such as BINDING SITE I, BINDING SITE II or BINDING SITE III of FIG. 8. Table 4 illustrates the complementarity of the nucleotide sequences of C6orf5 BINDING SITE, designated SEQ ID:4879, to the nucleotide sequence of GAM8145 RNA, herein designated GAM RNA, also designated SEQ ID:328.

Another function of GAM8145 is therefore inhibition of C6orf5 (Accession NP_056339.2). Accordingly, utilities of GAM8145 include diagnosis, prevention and treatment of diseases and clinical conditions associated with C6orf5.

Chaperone, abc1 activity of bc1 complex like (s. pombe) (CABC1, Accession NP_064632.1) is another GAM8145 target gene, herein designated TARGET GENE. CABC1 BINDING SITE is a target binding site found in the 3' untranslated region of mRNA encoded by CABC1, corresponding to a target binding site such as BINDING SITE I, BINDING SITE II or BINDING SITE III of FIG. 8. Table 4 illustrates the complementarity of the nucleotide sequences of CABC1 BINDING SITE, designated SEQ ID:14186, to the nucleotide sequence of GAM8145 RNA, herein designated GAM RNA, also designated SEQ ID:328.

Another function of GAM8145 is therefore inhibition of Chaperone, abc1 activity of bc1 complex like (s. pombe) (CABC1, Accession NP_064632.1). Accordingly, utilities of GAM8145 include diagnosis, prevention and treatment of diseases and clinical conditions associated with CABC1.

Calcium channel, voltage-dependent, gamma subunit 3 (CACNG3, Accession NP_006530.1) is another GAM8145 target gene, herein designated TARGET GENE. CACNG3 BINDING SITE is a target binding site found in the 5' untranslated region of mRNA encoded by CACNG3, corresponding to a target binding site such as BINDING SITE I, BINDING SITE II or BINDING SITE III of FIG. 8. Table 4 illustrates the complementarity of the nucleotide sequences of CACNG3 BINDING SITE, designated SEQ ID:8825, to the nucleotide sequence of GAM8145 RNA, herein designated GAM RNA, also designated SEQ ID:328.

Another function of GAM8145 is therefore inhibition of Calcium channel, voltage-dependent, gamma subunit 3 (CACNG3, Accession NP_006530.1), a gene which is thought to stabilize the calcium channel in an inactivated state. Accordingly, utilities of GAM8145 include diagnosis, prevention and treatment of diseases and clinical conditions associated with CACNG3.

The function of CACNG3 and its association with various diseases and clinical conditions, has been established by previous studies, as described hereinabove with reference to GAM335.1. Calpain 1, (mu/i) large subunit (CAPN1, Accession NP_005177.2) is another GAM8145 target gene, herein designated TARGET GENE. CAPN1 BINDING SITE is a target binding site found in the 5' untranslated region of mRNA encoded by CAPN1, corresponding to a target binding site such as BINDING SITE I, BINDING SITE II or BINDING SITE III of FIG. 8. Table 4 illustrates the complementarity of the nucleotide sequences of CAPN1 BINDING SITE, designated SEQ ID:3309, to the nucleotide sequence of GAM8145 RNA, herein designated GAM RNA, also designated SEQ ID:328.

Another function of GAM8145 is therefore inhibition of Calpain 1, (mu/i) large subunit (CAPN1, Accession NP_005177.2), a gene which is an intracellular protease that requires calcium for its catalytic activity. Accordingly, utilities of GAM8145 include diagnosis, prevention and treatment of diseases and clinical conditions associated with CAPN1.

The function of CAPN1 and its association with various diseases and clinical conditions, has been established by previous studies, as described hereinabove with reference to GAM41.1. Caspase 2, apoptosis-related cysteine protease (neural precursor cell expressed, developmentally down-regulated 2) (CASP2, Accession NP_116764.1) is another GAM8145 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:7205, to the nucleotide sequence of GAM8145 RNA, herein designated GAM RNA, also designated SEQ ID:328.

Another function of GAM8145 is therefore inhibition of Caspase 2, apoptosis-related cysteine protease (neural precursor cell expressed, developmentally down-regulated 2) (CASP2, Accession NP_116764.1), a gene which involves in the activation cascade of caspases responsible for apoptosis execution. Accordingly, utilities of GAM8145 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_001215.1) is another GAM8145 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:7205, to the nucleotide sequence of GAM8145 RNA, herein designated GAM RNA, also designated SEQ ID:328.

Another function of GAM8145 is therefore inhibition of Caspase 2, apoptosis-related cysteine protease (neural precursor cell expressed, developmentally down-regulated 2) (CASP2, Accession NP_001215.1), a gene which involves in the activation cascade of caspases responsible for apoptosis execution. Accordingly, utilities of GAM8145 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116766.1) is another GAM8145 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:7205, to the nucleotide sequence of GAM8145 RNA, herein designated GAM RNA, also designated SEQ ID:328.

Another function of GAM8145 is therefore inhibition of Caspase 2, apoptosis-related cysteine protease (neural precursor cell expressed, developmentally down-regulated 2) (CASP2, Accession NP_116766.1), a gene which involves in the activation cascade of caspases responsible for apoptosis execution. Accordingly, utilities of GAM8145 include diagnosis, prevention and treatment of diseases and clinical conditions associated with CASP2.

The function of CASP2 and its association with various diseases and clinical conditions, has been established by previous studies, as described hereinabove with reference to GAM139.1. Caspase 2, apoptosis-related cysteine protease (neural precursor cell expressed, developmentally down-regulated 2) (CASP2, Accession NP_116765.1) is another GAM8145 target gene, herein designated TARGET GENE. CASP2 BINDING SITE is a target binding site found in the 3' untranslated region of multiple transcripts of mRNA encoded by CASP2, corresponding to a target binding site such as BINDING SITE I, BINDING SITE II or BINDING SITE III of FIG. 8. Table 4 illustrates the complementarity of the nucleotide sequences of CASP2 BINDING SITE, designated SEQ ID:7205, to the nucleotide sequence of GAM8145 RNA, herein designated GAM RNA, also designated SEQ ID:328.

Another function of GAM8145 is therefore inhibition of Caspase 2, apoptosis-related cysteine protease (neural precursor cell expressed, developmentally down-regulated 2) (CASP2, Accession NP_116765.1), a gene which involves in the activation cascade of caspases responsible for apoptosis execution. Accordingly, utilities of GAM8145 include diagnosis, prevention and treatment of diseases and clinical conditions associated with CASP2.

The function of CASP2 and its association with various diseases and clinical conditions, has been established by previous studies, as described hereinabove with reference to GAM139.1. Cd151 antigen (CD151, Accession NP_004348.2) is another GAM8145 target gene, herein designated TARGET GENE. CD151 BINDING SITE is a target binding site found in the 5' untranslated region of multiple transcripts of mRNA encoded by CD151, corresponding to a target binding site such as BINDING SITE I, BINDING SITE II or BINDING SITE III of FIG. 8. Table 4 illustrates the complementarity of the nucleotide sequences of CD151 BINDING SITE, designated SEQ ID:12932, to the nucleotide sequence of GAM8145 RNA, herein designated GAM RNA, also designated SEQ ID:328.

Another function of GAM8145 is therefore inhibition of Cd151 antigen (CD151, Accession NP_004348.2). Accordingly, utilities of GAM8145 include diagnosis, prevention and treatment of diseases and clinical conditions associated with CD151.

CG012 (Accession XP_096710.1) is another GAM8145 target gene, herein designated TARGET GENE. CG012 BINDING SITE is a target binding site found in the 5' untranslated region of mRNA encoded by CG012, corresponding to a target binding site such as BINDING SITE I, BINDING SITE II or BINDING SITE III of FIG. 8. Table 4 illustrates the complementarity of the nucleotide sequences of CG012 BINDING SITE, designated SEQ ID:2753, to the nucleotide sequence of GAM8145 RNA, herein designated GAM RNA, also designated SEQ ID:328.

Another function of GAM8145 is therefore inhibition of CG012 (Accession XP_096710.1). Accordingly, utilities of GAM8145 include diagnosis, prevention and treatment of diseases and clinical conditions associated with CG012.

Chk1 checkpoint homolog (s. pombe) (CHEK1, Accession NP_001265.1) is another GAM8145 target gene, herein designated TARGET GENE. CHEK1 BINDING SITE is a target binding site found in the 3' untranslated region of mRNA encoded by CHEK1, corresponding to a target binding site such as BINDING SITE I, BINDING SITE II or BINDING SITE III of FIG. 8. Table 4 illustrates the complementarity of the nucleotide sequences of CHEK1 BINDING SITE, designated SEQ ID:15806, to the nucleotide sequence of GAM8145 RNA, herein designated GAM RNA, also designated SEQ ID:328.

Another function of GAM8145 is therefore inhibition of Chk1 checkpoint homolog (s. pombe) (CHEK1, Accession NP_001265.1), a gene which a protein kinase that is required for the DNA damage checkpoint. Accordingly, utilities of GAM8145 include diagnosis, prevention and treatment of diseases and clinical conditions associated with CHEK1.

The function of CHEK1 and its association with various diseases and clinical conditions, has been established by previous studies, as described hereinabove with reference to GAM3154.1. Cytochrome c oxidase subunit viii (COX8, Accession NP_004065.1) is another GAM8145 target gene, herein designated TARGET GENE. COX8 BINDING SITE is a target binding site found in the 3' untranslated region of mRNA encoded by COX8, corresponding to a target binding site such as BINDING SITE I, BINDING SITE II or BINDING SITE III of FIG. 8. Table 4 illustrates the complementarity of the nucleotide sequences of COX8 BINDING SITE, designated SEQ ID:15358, to the nucleotide sequence of GAM8145 RNA, herein designated GAM RNA, also designated SEQ ID:328.

Another function of GAM8145 is therefore inhibition of Cytochrome c oxidase subunit viii (COX8, Accession NP_004065.1), a gene which is a nuclear-coded polypeptide chain of cytochrome c oxidase. Accordingly, utilities of GAM8145 include diagnosis, prevention and treatment of diseases and clinical conditions associated with COX8.

The function of COX8 and its association with various diseases and clinical conditions, has been established by previous studies, as described hereinabove with reference to GAM2154.1. DKFZp727A071 (Accession NP_689481.1) is another GAM8145 target gene, herein designated TARGET GENE. DKFZp727A071 BINDING SITE is a target binding site found in the 3' untranslated region of mRNA encoded by DKFZp727A071, corresponding to a target binding site such as BINDING SITE I, BINDING SITE II or BINDING SITE III of FIG. 8. Table 4 illustrates the complementarity of the nucleotide sequences of DKFZp727A071 BINDING SITE, designated SEQ ID:18597, to the nucleotide sequence of GAM8145 RNA, herein designated GAM RNA, also designated SEQ ID:328.

Another function of GAM8145 is therefore inhibition of DKFZp727A071 (Accession NP_689481.1). Accordingly, utilities of GAM8145 include diagnosis, prevention and treatment of diseases and clinical conditions associated with DKFZp727A071.

Dystrophia myotonica-containing wd repeat motif (DMWD, Accession XP_027569.1) is another GAM8145 target gene, herein designated TARGET GENE. DMWD BINDING SITE is a target binding site found in the 3' untranslated region of mRNA encoded by DMWD, corresponding to a target binding site such as BINDING SITE I, BINDING SITE II or BINDING SITE III of FIG. 8. Table 4 illustrates the complementarity of the nucleotide sequences of DMWD BINDING SITE, designated SEQ ID:17090, to the nucleotide sequence of GAM8145 RNA, herein designated GAM RNA, also designated SEQ ID:328.

Another function of GAM8145 is therefore inhibition of Dystrophia myotonica-containing wd repeat motif (DMWD, Accession XP_027569.1). Accordingly, utilities of GAM8145 include diagnosis, prevention and treatment of diseases and clinical conditions associated with DMWD.

DPF3 (Accession NP_036206.1) is another GAM8145 target gene, herein designated TARGET GENE. DPF3 BINDING SITE is a target binding site found in the 3' untranslated region of mRNA encoded by DPF3, corresponding to a target binding site such as BINDING SITE I, BINDING SITE II or BINDING SITE III of FIG. 8. Table 4 illustrates the complementarity of the nucleotide sequences of DPF3 BINDING SITE, designated SEQ ID:15298, to the nucleotide sequence of GAM8145 RNA, herein designated GAM RNA, also designated SEQ ID:328.

Another function of GAM8145 is therefore inhibition of DPF3 (Accession NP_036206.1). Accordingly, utilities of GAM8145 include diagnosis, prevention and treatment of diseases and clinical conditions associated with DPF3.

Ells1 (Accession NP_690006.1) is another GAM8145 target gene, herein designated TARGET GENE. Ells1 BINDING SITE1 and Ells1 BINDING SITE2 are target binding sites found in untranslated regions of mRNA encoded by Ells1, corresponding to target binding sites such as BINDING SITE I, BINDING SITE II or BINDING SITE III of FIG. 8. Table 4 illustrates the complementarity of the nucleotide sequences of Ells1 BINDING SITE1 and Ells1 BINDING SITE2, designated SEQ ID:19837 and SEQ ID:18457 respectively, to the nucleotide sequence of GAM8145 RNA, herein designated GAM RNA, also designated SEQ ID:328.

Another function of GAM8145 is therefore inhibition of Ells1 (Accession NP_690006.1). Accordingly, utilities of GAM8145 include diagnosis, prevention and treatment of diseases and clinical conditions associated with Ells1.

ERAP140 (Accession XP_059748.2) is another GAM8145 target gene, herein designated TARGET GENE. ERAP140 BINDING SITE is a target binding site found in the 3' untranslated region of mRNA encoded by ERAP140, corresponding to a target binding site such as BINDING SITE I, BINDING SITE II or BINDING SITE III of FIG. 8. Table 4 illustrates the complementarity of the nucleotide sequences of ERAP140 BINDING SITE, designated SEQ ID:7182, to the nucleotide sequence of GAM8145 RNA, herein designated GAM RNA, also designated SEQ ID:328.

Another function of GAM8145 is therefore inhibition of ERAP140 (Accession XP_059748.2). Accordingly, utilities of GAM8145 include diagnosis, prevention and treatment of diseases and clinical conditions associated with ERAP140.

F-box only protein 11 (FBXO11, Accession NP_061163.2) is another GAM8145 target gene, herein designated TARGET GENE. FBXO11 BINDING SITE is a target binding site found in the 3' untranslated region of multiple transcripts of mRNA encoded by FBXO11, corresponding to a target binding site such as BINDING SITE I, BINDING SITE II or BINDING SITE III of FIG. 8. Table 4 illustrates the complementarity of the nucleotide sequences of FBXO11 BINDING SITE, designated SEQ ID:11365, to the nucleotide sequence of GAM8145 RNA, herein designated GAM RNA, also designated SEQ ID:328.

Another function of GAM8145 is therefore inhibition of F-box only protein 11 (FBXO11, Accession NP_061163.2). Accordingly, utilities of GAM8145 include diagnosis, prevention and treatment of diseases and clinical conditions associated with FBXO11.

FLJ10460 (Accession NP_060567.1) is another GAM8145 target gene, herein designated TARGET GENE. FLJ10460 BINDING SITE is a target binding site found in the 3' untranslated region of mRNA encoded by FLJ10460, corresponding to a target binding site such as BINDING SITE I, BINDING SITE II or BINDING SITE III of FIG. 8. Table 4 illustrates the complementarity of the nucleotide sequences of FLJ10460 BINDING SITE, designated SEQ ID:455, to the nucleotide sequence of GAM8145 RNA, herein designated GAM RNA, also designated SEQ ID:328.

Another function of GAM8145 is therefore inhibition of FLJ10460 (Accession NP_060567.1). Accordingly, utilities of GAM8145 include diagnosis, prevention and treatment of diseases and clinical conditions associated with FLJ10460.

FLJ11274 (Accession NP_060845.1) is another GAM8145 target gene, herein designated TARGET GENE. FLJ11274 BINDING SITE is a target binding site found in the 3' untranslated region of mRNA encoded by FLJ11274, corresponding to a target binding site such as BINDING SITE I, BINDING SITE II or BINDING SITE III of FIG. 8. Table 4 illustrates the complementarity of the nucleotide sequences of FLJ11274 BINDING SITE, designated SEQ ID:13401, to the nucleotide sequence of GAM8145 RNA, herein designated GAM RNA, also designated SEQ ID:328.

Another function of GAM8145 is therefore inhibition of FLJ11274 (Accession NP_060845.1). Accordingly, utilities of GAM8145 include diagnosis, prevention and treatment of diseases and clinical conditions associated with FLJ11274.

FLJ20671 (Accession NP_060394.1) is another GAM8145 target gene, herein designated TARGET GENE. FLJ20671 BINDING SITE is a target binding site found in the 3' untranslated region of mRNA encoded by FLJ20671, corresponding to a target binding site such as BINDING SITE I, BINDING SITE II or BINDING SITE III of FIG. 8. Table 4 illustrates the complementarity of the nucleotide sequences of FLJ20671 BINDING SITE, designated SEQ ID:11719, to the nucleotide sequence of GAM8145 RNA, herein designated GAM RNA, also designated SEQ ID:328.

Another function of GAM8145 is therefore inhibition of FLJ20671 (Accession NP_060394.1). Accordingly, utilities of GAM8145 include diagnosis, prevention and treatment of diseases and clinical conditions associated with FLJ20671.

FLJ23584 (Accession NP_078864.1) is another GAM8145 target gene, herein designated TARGET GENE. FLJ23584 BINDING SITE is a target binding site found in the 3' untranslated region of mRNA encoded by FLJ23584, corresponding to a target binding site such as BINDING SITE I, BINDING SITE II or BINDING SITE III of FIG. 8. Table 4 illustrates the complementarity of the nucleotide sequences of FLJ23584 BINDING SITE, designated SEQ ID:14763, to the nucleotide sequence of GAM8145 RNA, herein designated GAM RNA, also designated SEQ ID:328.

Another function of GAM8145 is therefore inhibition of FLJ23584 (Accession NP_078864.1). Accordingly, utilities of GAM8145 include diagnosis, prevention and treatment of diseases and clinical conditions associated with FLJ23584.

FLJ31882 (Accession NP_689673.1) is another GAM8145 target gene, herein designated TARGET GENE. FLJ31882 BINDING SITE is a target binding site found in the 3' untranslated region of mRNA encoded by FLJ31882, corresponding to a target binding site such as BINDING SITE I, BINDING SITE II or BINDING SITE III of FIG. 8. Table 4 illustrates the complementarity of the nucleotide sequences of FLJ31882 BINDING SITE, designated SEQ ID:3175, to the nucleotide sequence of GAM8145 RNA, herein designated GAM RNA, also designated SEQ ID:328.

Another function of GAM8145 is therefore inhibition of FLJ31882 (Accession NP_689673.1). Accordingly, utilities of GAM8145 include diagnosis, prevention and treatment of diseases and clinical conditions associated with FLJ31882.

FLJ31952 (Accession NP_653283.1) is another GAM8145 target gene, herein designated TARGET GENE. FLJ31952 BINDING SITE is a target binding site found in the 3' untranslated region of mRNA encoded by FLJ31952, corresponding to a target binding site such as BINDING SITE I, BINDING SITE II or BINDING SITE III of FIG. 8. Table 4 illustrates the complementarity of the nucleotide sequences of FLJ31952 BINDING SITE, designated SEQ ID:15807, to the nucleotide sequence of GAM8145 RNA, herein designated GAM RNA, also designated SEQ ID:328.

Another function of GAM8145 is therefore inhibition of FLJ31952 (Accession NP_653283.1). Accordingly, utilities of GAM8145 include diagnosis, prevention and treatment of diseases and clinical conditions associated with FLJ31952.

FLJ33996 (Accession NP_787090.1) is another GAM8145 target gene, herein designated TARGET GENE. FLJ33996 BINDING SITE is a target binding site found in the 3' untranslated region of mRNA encoded by FLJ33996, corresponding to a target binding site such as BINDING SITE I, BINDING SITE II or BINDING SITE III of FIG. 8. Table 4 illustrates the complementarity of the nucleotide sequences of FLJ33996 BINDING SITE, designated SEQ ID:10522, to the nucleotide sequence of GAM8145 RNA, herein designated GAM RNA, also designated SEQ ID:328.

Another function of GAM8145 is therefore inhibition of FLJ33996 (Accession NP_787090.1). Accordingly, utilities of GAM8145 include diagnosis, prevention and treatment of diseases and clinical conditions associated with FLJ33996.

Forkhead box 12 (FOXL2, Accession NP_075555.1) is another GAM8145 target gene, herein designated TARGET GENE. FOXL2 BINDING SITE is a target binding site found in the 3' untranslated region of mRNA encoded by FOXL2, corresponding to a target binding site such as BINDING SITE I, BINDING SITE II or BINDING SITE III of FIG. 8. Table 4 illustrates the complementarity of the nucleotide sequences of FOXL2 BINDING SITE, designated SEQ ID:2486, to the nucleotide sequence of GAM8145 RNA, herein designated GAM RNA, also designated SEQ ID:328.

Another function of GAM8145 is therefore inhibition of Forkhead box 12 (FOXL2, Accession NP_075555.1). Accordingly, utilities of GAM8145 include diagnosis, prevention and treatment of diseases and clinical conditions associated with FOXL2.

Fucosyltransferase 10 (alpha (1,3) fucosyltransferase) (FUT10, Accession NP_116053.2) is another GAM8145 target gene, herein designated TARGET GENE. FUT10 BINDING SITE is a target binding site found in the 3' untranslated region of mRNA encoded by FUT10, corresponding to a target binding site such as BINDING SITE I, BINDING SITE II or BINDING SITE III of FIG. 8. Table 4 illustrates the complementarity of the nucleotide sequences of FUT10 BINDING SITE, designated SEQ ID:3533, to the nucleotide sequence of GAM8145 RNA, herein designated GAM RNA, also designated SEQ ID:328.

Another function of GAM8145 is therefore inhibition of Fucosyltransferase 10 (alpha (1,3) fucosyltransferase) (FUT10, Accession NP_116053.2). Accordingly, utilities of GAM8145 include diagnosis, prevention and treatment of diseases and clinical conditions associated with FUT10.

GALNT13 (Accession XP_054951.3) is another GAM8145 target gene, herein designated TARGET GENE. GALNT13 BINDING SITE is a target binding site found in the 3' untranslated region of mRNA encoded by GALNT13, corresponding to a target binding site such as BINDING SITE I, BINDING SITE II or BINDING SITE III of FIG. 8. Table 4 illustrates the complementarity of the nucleotide sequences of GALNT13 BINDING SITE, designated SEQ ID:16038, to the nucleotide sequence of GAM8145 RNA, herein designated GAM RNA, also designated SEQ ID:328.

Another function of GAM8145 is therefore inhibition of GALNT13 (Accession XP_054951.3). Accordingly, utilities of GAM8145 include diagnosis, prevention and treatment of diseases and clinical conditions associated with GALNT13.

Glucosaminyl (n-acetyl) transferase 2, i-branching enzyme (GCNT2, Accession NP_001482.1) is another GAM8145 target gene, herein designated TARGET GENE. GCNT2 BINDING SITE is a target binding site found in the 3' untranslated region of multiple transcripts of mRNA encoded by GCNT2, corresponding to a target binding site such as BINDING SITE I, BINDING SITE II or BINDING SITE III of FIG. 8. Table 4 illustrates the complementarity of the nucleotide sequences of GCNT2 BINDING SITE, designated SEQ ID:12041, to the nucleotide sequence of GAM8145 RNA, herein designated GAM RNA, also designated SEQ ID:328.

Another function of GAM8145 is therefore inhibition of Glucosaminyl (n-acetyl) transferase 2, i-branching enzyme (GCNT2, Accession NP_001482.1), a gene which converts linear into branched poly-n- acetyllactosaminoglycans. Accordingly, utilities of GAM8145 include diagnosis, prevention and treatment of diseases and clinical conditions associated with GCNT2.

The function of GCNT2 and its association with various diseases and clinical conditions, has been established by previous studies, as described hereinabove with reference to GAM205.2. Glucosaminyl (n-acetyl) transferase 2, i-branching enzyme (GCNT2, Accession NP_663624.1) is another GAM8145 target gene, herein designated TARGET GENE. GCNT2 BINDING SITE is a target binding site found in the 3' untranslated region of multiple transcripts of mRNA encoded by GCNT2, corresponding to a target binding site such as BINDING SITE I, BINDING SITE II or BINDING SITE III of FIG. 8. Table 4 illustrates the complementarity of the nucleotide sequences of GCNT2 BINDING SITE, designated SEQ ID:12041, to the nucleotide sequence of GAM8145 RNA, herein designated GAM RNA, also designated SEQ ID:328.

Another function of GAM8145 is therefore inhibition of Glucosaminyl (n-acetyl) transferase 2, i-branching enzyme (GCNT2, Accession NP_663624.1), a gene which converts linear into branched poly-n- acetyllactosaminoglycans. Accordingly, utilities of GAM8145 include diagnosis, prevention and treatment of diseases and clinical conditions associated with GCNT2.

The function of GCNT2 and its association with various diseases and clinical conditions, has been established by previous studies, as described hereinabove with reference to GAM205.2. Glucosaminyl (n-acetyl) transferase 2, i-branching enzyme (GCNT2, Accession NP_663630.1) is another GAM8145 target gene, herein designated TARGET GENE. GCNT2 BINDING SITE is a target binding site found in the 3' untranslated region of multiple transcripts of mRNA encoded by GCNT2, corresponding to a target binding site such as BINDING SITE I, BINDING SITE II or BINDING SITE III of FIG. 8. Table 4 illustrates the complementarity of the nucleotide sequences of GCNT2 BINDING SITE, designated SEQ ID:12041, to the nucleotide sequence of GAM8145 RNA, herein designated GAM RNA, also designated SEQ ID:328.

Another function of GAM8145 is therefore inhibition of Glucosaminyl (n-acetyl) transferase 2, i-branching enzyme (GCNT2, Accession NP_663630.1), a gene which converts linear into branched poly-n- acetyllactosaminoglycans. Accordingly, utilities of GAM8145 include diagnosis, prevention and treatment of diseases and clinical conditions associated with GCNT2.

The function of GCNT2 and its association with various diseases and clinical conditions, has been established by previous studies, as described hereinabove with reference to GAM205.2. Glycosylphosphatidylinositol specific phospholipase d1 (GPLD1, Accession NP_803436.1) is another GAM8145 target gene, herein designated TARGET GENE. GPLD1 BINDING SITE is a target binding site found in the 5' untranslated region of multiple transcripts of mRNA encoded by GPLD1, corresponding to a target binding site such as BINDING SITE I, BINDING SITE II or BINDING SITE III of FIG. 8. Table 4 illustrates the complementarity of the nucleotide sequences of GPLD1 BINDING SITE, designated SEQ ID:1243, to the nucleotide sequence of GAM8145 RNA, herein designated GAM RNA, also designated SEQ ID:328.

Another function of GAM8145 is therefore inhibition of Glycosylphosphatidylinositol specific phospholipase d1 (GPLD1, Accession NP_803436.1), a gene which hydrolyses the inositol phosphate linkage in proteins anchored by phosphatidylinositol glycans to release these proteins from the membrane. Accordingly, utilities of GAM8145 include diagnosis, prevention and treatment of diseases and clinical conditions associated with GPLD1.

The function of GPLD1 and its association with various diseases and clinical conditions, has been established by previous studies, as described hereinabove with reference to GAM44.1. Glycosylphosphatidylinositol specific phospholipase d1 (GPLD1, Accession NP_001494.2) is another GAM8145 target gene, herein designated TARGET GENE. GPLD1 BINDING SITE is a target binding site found in the 5' untranslated region of multiple transcripts of mRNA encoded by GPLD1, corresponding to a target binding site such as BINDING SITE I, BINDING SITE II or BINDING SITE III of FIG. 8. Table 4 illustrates the complementarity of the nucleotide sequences of GPLD1 BINDING SITE, designated SEQ ID:1243, to the nucleotide sequence of GAM8145 RNA, herein designated GAM RNA, also designated SEQ ID:328.

Another function of GAM8145 is therefore inhibition of Glycosylphosphatidylinositol specific phospholipase d1 (GPLD1, Accession NP_001494.2), a gene which hydrolyses the inositol phosphate linkage in proteins anchored by phosphatidylinositol glycans to release these proteins from the membrane. Accordingly, utilities of GAM8145 include diagnosis, prevention and treatment of diseases and clinical conditions associated with GPLD1.

The function of GPLD1 and its association with various diseases and clinical conditions, has been established by previous studies, as described hereinabove with reference to GAM44.1. G protein-coupled receptor 30 (GPR30, Accession NP_001496.1) is another GAM8145 target gene, herein designated TARGET GENE. GPR30 BINDING SITE is a target binding site found in the 5' untranslated region of mRNA encoded by GPR30, corresponding to a target binding site such as BINDING SITE I, BINDING SITE II or BINDING SITE III of FIG. 8. Table 4 illustrates the complementarity of the nucleotide sequences of GPR30 BINDING SITE, designated SEQ ID:7529, to the nucleotide sequence of GAM8145 RNA, herein designated GAM RNA, also designated SEQ ID:328.

Another function of GAM8145 is therefore inhibition of G protein-coupled receptor 30 (GPR30, Accession NP_001496.1), a gene which receives chemical signals in cell communication in both CNS and peripheral tissues. Accordingly, utilities of GAM8145 include diagnosis, prevention and treatment of diseases and clinical conditions associated with GPR30.

The function of GPR30 and its association with various diseases and clinical conditions, has been established by previous studies, as described hereinabove with reference to GAM475.2. G protein-coupled receptor 55 (GPR55, Accession NP_005674.1) is another GAM8145 target gene, herein designated TARGET GENE. GPR55 BINDING SITE is a target binding site found in the 3' untranslated region of mRNA encoded by GPR55, corresponding to a target binding site such as BINDING SITE I, BINDING SITE II or BINDING SITE III of FIG. 8. Table 4 illustrates the complementarity of the nucleotide sequences of GPR55 BINDING SITE, designated SEQ ID:8432, to the nucleotide sequence of GAM8145 RNA, herein designated GAM RNA, also designated SEQ ID:328.

Another function of GAM8145 is therefore inhibition of G protein-coupled receptor 55 (GPR55, Accession NP_005674.1). Accordingly, utilities of GAM8145 include diagnosis, prevention and treatment of diseases and clinical conditions associated with GPR55.

General transcription factor iif, polypeptide 1, 74 kda (GTF2F1, Accession NP_002087.1) is another GAM8145 target gene, herein designated TARGET GENE. GTF2F1 BINDING SITE is a target binding site found in the 3' untranslated region of mRNA encoded by GTF2F1, corresponding to a target binding site such as BINDING SITE I, BINDING SITE II or BINDING SITE III of FIG. 8. Table 4 illustrates the complementarity of the nucleotide sequences of GTF2F1 BINDING SITE, designated SEQ ID:8940, to the nucleotide sequence of GAM8145 RNA, herein designated GAM RNA, also designated SEQ ID:328.

Another function of GAM8145 is therefore inhibition of General transcription factor iif, polypeptide 1, 74 kda (GTF2F1, Accession NP_002087.1), a gene which helps to recruit it to the initiation complex in collaboration with tfiib. it promotes transcription elongation. Accordingly, utilities of GAM8145 include diagnosis, prevention and treatment of diseases and clinical conditions associated with GTF2F1.

The function of GTF2F1 and its association with various diseases and clinical conditions, has been established by previous studies, as described hereinabove with reference to GAM223.1. Hypermethylated in cancer 2 (HIC2, Accession XP_036937.2) is another GAM8145 target gene, herein designated TARGET GENE. HIC2 BINDING SITE is a target binding site found in the 3' untranslated region of multiple transcripts of mRNA encoded by HIC2, corresponding to a target binding site such as BINDING SITE I, BINDING SITE II or BINDING SITE III of FIG. 8. Table 4 illustrates the complementarity of the nucleotide sequences of HIC2 BINDING SITE, designated SEQ ID:18759, to the nucleotide sequence of GAM8145 RNA, herein designated GAM RNA, also designated SEQ ID:328.

Another function of GAM8145 is therefore inhibition of Hypermethylated in cancer 2 (HIC2, Accession XP_036937.2). Accordingly, utilities of GAM8145 include diagnosis, prevention and treatment of diseases and clinical conditions associated with HIC2.

Hypermethylated in cancer 2 (HIC2, Accession NP_055909.1) is another GAM8145 target gene, herein designated TARGET GENE. HIC2 BINDING SITE is a target binding site found in the 3' untranslated region of multiple transcripts of mRNA encoded by HIC2, corresponding to a target binding site such as BINDING SITE I, BINDING SITE II or BINDING SITE III of FIG. 8. Table 4 illustrates the complementarity of the nucleotide sequences of HIC2 BINDING SITE, designated SEQ ID:18759, to the nucleotide sequence of GAM8145 RNA, herein designated GAM RNA, also designated SEQ ID:328.

Another function of GAM8145 is therefore inhibition of Hypermethylated in cancer 2 (HIC2, Accession NP_055909.1). Accordingly, utilities of GAM8145 include diagnosis, prevention and treatment of diseases and clinical conditions associated with HIC2.

Heparanase (HPSE, Accession NP_006656.1) is another GAM8145 target gene, herein designated TARGET GENE. HPSE BINDING SITE is a target binding site found in the 3' untranslated region of mRNA encoded by HPSE, corresponding to a target binding site such as BINDING SITE I, BINDING SITE II or BINDING SITE III of FIG. 8. Table 4 illustrates the complementarity of the nucleotide sequences of HPSE BINDING SITE, designated SEQ ID:454, to the nucleotide sequence of GAM8145 RNA, herein designated GAM RNA, also designated SEQ ID:328.

Another function of GAM8145 is therefore inhibition of Heparanase (HPSE, Accession NP_006656.1), a gene which is an endoglycosidase that cleaves heparan sulfate, and therefore may be associated with Breast cancer. Accordingly, utilities of GAM8145 include diagnosis, prevention and treatment of Breast cancer, and of other diseases and clinical conditions associated with HPSE.

The function of HPSE and its association with various diseases and clinical conditions, has been established by previous studies, as described hereinabove with reference to GAM66.2. HSPC009 (Accession NP_054738.1) is another GAM8145 target gene, herein designated TARGET GENE. HSPC009 BINDING SITE is a target binding site found in the 3' untranslated region of mRNA encoded by HSPC009, corresponding to a target binding site such as BINDING SITE I, BINDING SITE II or BINDING SITE III of FIG. 8 Table 4 illustrates the complementarity of the nucleotide sequences of HSPC009 BINDING SITE, designated SEQ ID:6013, to the nucleotide sequence of GAM8145 RNA, herein designated GAM RNA, also designated SEQ ID:328.

Another function of GAM8145 is therefore inhibition of HSPC009 (Accession NP_054738.1). Accordingly, utilities of GAM8145 include diagnosis, prevention and treatment of diseases and clinical conditions associated with HSPC009.

KIAA0265 (Accession XP_045954.2) is another GAM8145 target gene, herein designated TARGET GENE. KIAA0265 BINDING SITE is a target binding site found in the 3' untranslated region of mRNA encoded by KIAA0265, corresponding to a target binding site such as BINDING SITE I, BINDING SITE II or BINDING SITE III of FIG. 8. Table 4 illustrates the complementarity of the nucleotide sequences of KIAA0265 BINDING SITE, designated SEQ ID:16213, to the nucleotide sequence of GAM8145 RNA, herein designated GAM RNA, also designated SEQ ID:328.

Another function of GAM8145 is therefore inhibition of KIAA0265 (Accession XP_045954.2). Accordingly, utilities of GAM8145 include diagnosis, prevention and treatment of diseases and clinical conditions associated with KIAA0265.

KIAA0354 (Accession NP_055687.1) is another GAM8145 target gene, herein designated TARGET GENE. KIAA0354 BINDING SITE is a target binding site found in the 3' untranslated region of mRNA encoded by KIAA0354, corresponding to a target binding site such as BINDING SITE I, BINDING SITE II or BINDING SITE III of FIG. 8. Table 4 illustrates the complementarity of the nucleotide sequences of KIAA0354 BINDING SITE, designated SEQ ID:18748, to the nucleotide sequence of GAM8145 RNA, herein designated GAM RNA, also designated SEQ ID:328.

Another function of GAM8145 is therefore inhibition of KIAA0354 (Accession NP_055687.1). Accordingly, utilities of GAM8145 include diagnosis, prevention and treatment of diseases and clinical conditions associated with KIAA0354.

KIAA0564 (Accession XP_038664.6) is another GAM8145 target gene, herein designated TARGET GENE. KIAA0564 BINDING SITE is a target binding site found in the 3' untranslated region of mRNA encoded by KIAA0564, corresponding to a target binding site such as BINDING SITE I, BINDING SITE II or BINDING SITE III of FIG. 8. Table 4 illustrates the complementarity of the nucleotide sequences of KIAA0564 BINDING SITE, designated SEQ ID:16594, to the nucleotide sequence of GAM8145 RNA, herein designated GAM RNA, also designated SEQ ID:328.

Another function of GAM8145 is therefore inhibition of KIAA0564 (Accession XP_038664.6). Accordingly, utilities of GAM8145 include diagnosis, prevention and treatment of diseases and clinical conditions associated with KIAA0564.

KIAA0570 (Accession XP_291018.1) is another GAM8145 target gene, herein designated TARGET GENE. KIAA0570 BINDING SITE is a target binding site found in the 3' untranslated region of mRNA encoded by KIAA0570, corresponding to a target binding site such as BINDING SITE I, BINDING SITE II or BINDING SITE III of FIG. 8. Table 4 illustrates the complementarity of the nucleotide sequences of KIAA0570 BINDING SITE, designated SEQ ID:16814, to the nucleotide sequence of GAM8145 RNA, herein designated GAM RNA, also designated SEQ ID:328.

Another function of GAM8145 is therefore inhibition of KIAA0570 (Accession XP_291018.1). Accordingly, utilities of GAM8145 include diagnosis, prevention and treatment of diseases and clinical conditions associated with KIAA0570.

KIAA0795 (Accession NP_079286.1) is another GAM8145 target gene, herein designated TARGET GENE. KIAA0795 BINDING SITE is a target binding site found in the 3' untranslated region of mRNA encoded by KIAA0795, corresponding to a target binding site such as BINDING SITE I, BINDING SITE II or BINDING SITE III of FIG. 8. Table 4 illustrates the complementarity of the nucleotide sequences of KIAA0795 BINDING SITE, designated SEQ ID:8567, to the nucleotide sequence of GAM8145 RNA, herein designated GAM RNA, also designated SEQ ID:328.

Another function of GAM8145 is therefore inhibition of KIAA0795 (Accession NP_079286.1). Accordingly, utilities of GAM8145 include diagnosis, prevention and treatment of diseases and clinical conditions associated with KIAA0795.

KIAA0872 (Accession NP_055755.1) is another GAM8145 target gene, herein designated TARGET GENE. KIAA0872 BINDING SITE is a target binding site found in the 3' untranslated region of mRNA encoded by KIAA0872, corresponding to a target binding site such as BINDING SITE I, BINDING SITE II or BINDING SITE III of FIG. 8. Table 4 illustrates the complementarity of the nucleotide sequences of KIAA0872 BINDING SITE, designated SEQ ID:3812, to the nucleotide sequence of GAM8145 RNA, herein designated GAM RNA, also designated SEQ ID:328.

Another function of GAM8145 is therefore inhibition of KIAA0872 (Accession NP_055755.1). Accordingly, utilities of GAM8145 include diagnosis, prevention and treatment of diseases and clinical conditions associated with KIAA0872.

KIAA1039 (Accession XP_085748.1) is another GAM8145 target gene, herein designated TARGET GENE. KIAA1039 BINDING SITE is a target binding site found in the 5' untranslated region of mRNA encoded by KIAA1039, corresponding to a target binding site such as BINDING SITE I, BINDING SITE II or BINDING SITE III of FIG. 8. Table 4 illustrates the complementarity of the nucleotide sequences of KIAA1039 BINDING SITE, designated SEQ ID:14136, to the nucleotide sequence of GAM8145 RNA, herein designated GAM RNA, also designated SEQ ID:328.

Another function of GAM8145 is therefore inhibition of KIAA1039 (Accession XP_085748.1). Accordingly, utilities of GAM8145 include diagnosis, prevention and treatment of diseases and clinical conditions associated with KIAA1039.

KIAA1822 (Accession XP_041566.2) is another GAM8145 target gene, herein designated TARGET GENE. KIAA1822 BINDING SITE is a target binding site found in the 3' untranslated region of mRNA encoded by KIAA1822, corresponding to a target binding site such as BINDING SITE I, BINDING SITE II or BINDING SITE III of FIG. 8. Table 4 illustrates the complementarity of the nucleotide sequences of KIAA1822 BINDING SITE, designated SEQ ID:15750, to the nucleotide sequence of GAM8145 RNA, herein designated GAM RNA, also designated SEQ ID:328.

Another function of GAM8145 is therefore inhibition of KIAA1822 (Accession XP_041566.2). Accordingly, utilities of GAM8145 include diagnosis, prevention and treatment of diseases and clinical conditions associated with KIAA1822.

KIAA1841 (Accession XP_087056.4) is another GAM8145 target gene, herein designated TARGET GENE. KIAA1841 BINDING SITE is a target binding site found in the 3' untranslated region of mRNA encoded by KIAA1841, corresponding to a target binding site such as BINDING SITE I, BINDING SITE II or BINDING SITE III of FIG. 8. Table 4 illustrates the complementarity of the nucleotide sequences of KIAA1841 BINDING SITE, designated SEQ ID:5943, to the nucleotide sequence of GAM8145 RNA, herein designated GAM RNA, also designated SEQ ID:328.

Another function of GAM8145 is therefore inhibition of KIAA1841 (Accession XP_087056.4). Accordingly, utilities of GAM8145 include diagnosis, prevention and treatment of diseases and clinical conditions associated with KIAA1841.

KIAA1892 (Accession NP_056212.1) is another GAM8145 target gene, herein designated TARGET GENE. KIAA1892 BINDING SITE is a target binding site found in the 3' untranslated region of mRNA encoded by KIAA1892, corresponding to a target binding site such as BINDING SITE I, BINDING SITE II or BINDING SITE III of FIG. 8. Table 4 illustrates the complementarity of the nucleotide sequences of KIAA1892 BINDING SITE, designated SEQ ID:4184, to the nucleotide sequence of GAM8145 RNA, herein designated GAM RNA, also designated SEQ ID:328.

Another function of GAM8145 is therefore inhibition of KIAA1892 (Accession NP_056212.1). Accordingly, utilities of GAM8145 include diagnosis, prevention and treatment of diseases and clinical conditions associated with KIAA1892.

KIAA1981 (Accession XP_114000.1) is another GAM8145 target gene, herein designated TARGET GENE. KIAA1981 BINDING SITE is a target binding site found in the 3' untranslated region of mRNA encoded by KIAA1981, corresponding to a target binding site such as BINDING SITE I, BINDING SITE II or BINDING SITE III of FIG. 8. Table 4 illustrates the complementarity of the nucleotide sequences of KIAA1981 BINDING SITE, designated SEQ ID:15733, to the nucleotide sequence of GAM8145 RNA, herein designated GAM RNA, also designated SEQ ID:328.

Another function of GAM8145 is therefore inhibition of KIAA1981 (Accession XP_114000.1). Accordingly, utilities of GAM8145 include diagnosis, prevention and treatment of diseases and clinical conditions associated with KIAA1981.

Kelch-like 8 (drosophila) (KLHL8, Accession NP_065854.1) is another GAM8145 target gene, herein designated TARGET GENE. KLHL8 BINDING SITE is a target binding site found in the 3' untranslated region of mRNA encoded by KLHL8, corresponding to a target binding site such as BINDING SITE I, BINDING SITE II or BINDING SITE III of FIG. 8. Table 4 illustrates the complementarity of the nucleotide sequences of KLHL8 BINDING SITE, designated SEQ ID:12192, to the nucleotide sequence of GAM8145 RNA, herein designated GAM RNA, also designated SEQ ID:328.

Another function of GAM8145 is therefore inhibition of Kelch-like 8 (drosophila) (KLHL8, Accession NP_065854.1). Accordingly, utilities of GAM8145 include diagnosis, prevention and treatment of diseases and clinical conditions associated with KLHL8.

Kininogen (KNG, Accession NP_000884.1) is another GAM8145 target gene, herein designated TARGET GENE. KNG BINDING SITE is a target binding site found in the 5' untranslated region of mRNA encoded by KNG, corresponding to a target binding site such as BINDING SITE I, BINDING SITE II or BINDING SITE III of FIG. 8. Table 4 illustrates the complementarity of the nucleotide sequences of KNG BINDING SITE, designated SEQ ID:1846, to the nucleotide sequence of GAM8145 RNA, herein designated GAM RNA, also designated SEQ ID:328.

Another function of GAM8145 is therefore inhibition of Kininogen (KNG, Accession NP_000884.1), a gene which plays an important role in blood coagulation by helping to position optimally prekallikrein and factor xi next to factor xii; are inhibitors of thiol proteases and therefore may be associated with Williams trait. Accordingly, utilities of GAM8145 include diagnosis, prevention and treatment of Williams trait, and of other diseases and clinical conditions associated with KNG.

The function of KNG and its association with various diseases and clinical conditions, has been established by previous studies, as described hereinabove with reference to GAM1394.1. KRTHBP2 (Accession XP_303553.1) is another GAM8145 target gene, herein designated TARGET GENE. KRTHBP2 BINDING SITE is a target binding site found in the 3' untranslated region of mRNA encoded by KRTHBP2, corresponding to a target binding site such as BINDING SITE I, BINDING SITE II or BINDING SITE III of FIG. 8. Table 4 illustrates the complementarity of the nucleotide sequences of KRTHBP2 BINDING SITE, designated SEQ ID:11295, to the nucleotide sequence of GAM8145 RNA, herein designated GAM RNA, also designated SEQ ID:328.

Another function of GAM8145 is therefore inhibition of KRTHBP2 (Accession XP_303553.1). Accordingly, utilities of GAM8145 include diagnosis, prevention and treatment of diseases and clinical conditions associated with KRTHBP2.

LOC134492 (Accession NP_660309.1) is another GAM8145 target gene, herein designated TARGET GENE. LOC134492 BINDING SITE is a target binding site found in the 3' untranslated region of mRNA encoded by LOC134492, corresponding to a target binding site such as BINDING SITE I, BINDING SITE II or BINDING SITE III of FIG. 8. Table 4 illustrates the complementarity of the nucleotide sequences of LOC134492 BINDING SITE, designated SEQ ID:8992, to the nucleotide sequence of GAM8145 RNA, herein designated GAM RNA, also designated SEQ ID:328.

Another function of GAM8145 is therefore inhibition of LOC134492 (Accession NP_660309.1). Accordingly, utilities of GAM8145 include diagnosis, prevention and treatment of diseases and clinical conditions associated with LOC134492.

LOC149149 (Accession XP_097598.1) is another GAM8145 target gene, herein designated TARGET GENE. LOC149149 BINDING SITE is a target binding site found in the 5' untranslated region of mRNA encoded by LOC149149, corresponding to a target binding site such as BINDING SITE I, BINDING SITE II or BINDING SITE III of FIG. 8. Table 4 illustrates the complementarity of the nucleotide sequences of LOC149149 BINDING SITE, designated SEQ ID:12363, to the nucleotide sequence of GAM8145 RNA, herein designated GAM RNA, also designated SEQ ID:328.

Another function of GAM8145 is therefore inhibition of LOC149149 (Accession XP_097598.1). Accordingly, utilities of GAM8145 include diagnosis, prevention and treatment of diseases and clinical conditions associated with LOC149149.

LOC149351 (Accession XP_086503.1) is another GAM8145 target gene, herein designated TARGET GENE. LOC149351 BINDING SITE is a target binding site found in the 3' untranslated region of mRNA encoded by LOC149351, corresponding to a target binding site such as BINDING SITE I, BINDING SITE II or BINDING SITE III of FIG. 8. Table 4 illustrates the complementarity of the nucleotide sequences of LOC149351 BINDING SITE, designated SEQ ID:12288, to the nucleotide sequence of GAM8145 RNA, herein designated GAM RNA, also designated SEQ ID:328.

Another function of GAM8145 is therefore inhibition of LOC149351 (Accession XP_086503.1). Accordingly, utilities of GAM8145 include diagnosis, prevention and treatment of diseases and clinical conditions associated with LOC149351.

LOC149670 (Accession XP_086647.4) is another GAM8145 target gene, herein designated TARGET GENE. LOC149670 BINDING SITE is a target binding site found in the 5' untranslated region of mRNA encoded by LOC149670, corresponding to a target binding site such as BINDING SITE I, BINDING SITE II or BINDING SITE III of FIG. 8. Table 4 illustrates the complementarity of the nucleotide sequences of LOC149670 BINDING SITE, designated SEQ ID:20142, to the nucleotide sequence of GAM8145 RNA, herein designated GAM RNA, also designated SEQ ID:328.

Another function of GAM8145 is therefore inhibition of LOC149670 (Accession XP_086647.4). Accordingly, utilities of GAM8145 include diagnosis, prevention and treatment of diseases and clinical conditions associated with LOC149670.

LOC150946 (Accession XP_097977.2) is another GAM8145 target gene, herein designated TARGET GENE. LOC150946 BINDING SITE is a target binding site found in the 3' untranslated region of mRNA encoded by LOC150946, corresponding to a target binding site such as BINDING SITE I, BINDING SITE II or BINDING SITE III of FIG. 8. Table 4 illustrates the complementarity of the nucleotide sequences of LOC150946 BINDING SITE, designated SEQ ID:11545, to the nucleotide sequence of GAM8145 RNA, herein designated GAM RNA, also designated SEQ ID:328.

Another function of GAM8145 is therefore inhibition of LOC150946 (Accession XP_097977.2). Accordingly, utilities of GAM8145 include diagnosis, prevention and treatment of diseases and clinical conditions associated with LOC150946.

LOC154062 (Accession XP_087842.1) is another GAM8145 target gene, herein designated TARGET GENE. LOC154062 BINDING SITE is a target binding site found in the 3' untranslated region of mRNA encoded by LOC154062, corresponding to a target binding site such as BINDING SITE I, BINDING SITE II or BINDING SITE III of FIG. 8. Table 4 illustrates the complementarity of the nucleotide sequences of LOC154062 BINDING SITE, designated SEQ ID:17934, to the nucleotide sequence of GAM8145 RNA, herein designated GAM RNA, also designated SEQ ID:328.

Another function of GAM8145 is therefore inhibition of LOC154062 (Accession XP_087842.1). Accordingly, utilities of GAM8145 include diagnosis, prevention and treatment of diseases and clinical conditions associated with LOC154062.

LOC158402 (Accession XP_098936.1) is another GAM8145 target gene, herein designated TARGET GENE. LOC158402 BINDING SITE is a target binding site found in the 5' untranslated region of mRNA encoded by LOC158402, corresponding to a target binding site such as BINDING SITE I, BINDING SITE II or BINDING SITE III of FIG. 8. Table 4 illustrates the complementarity of the nucleotide sequences of LOC158402 BINDING SITE, designated SEQ ID:12592, to the nucleotide sequence of GAM8145 RNA, herein designated GAM RNA, also designated SEQ ID:328.

Another function of GAM8145 is therefore inhibition of LOC158402 (Accession XP_098936.1). Accordingly, utilities of GAM8145 include diagnosis, prevention and treatment of diseases and clinical conditions associated with LOC158402.

LOC221405 (Accession XP_168138.1) is another GAM8145 target gene, herein designated TARGET GENE. LOC221405 BINDING SITE is a target binding site found in the 3' untranslated region of mRNA encoded by LOC221405, corresponding to a target binding site such as BINDING SITE I, BINDING SITE II or BINDING SITE III of FIG. 8. Table 4 illustrates the complementarity of the nucleotide sequences of LOC221405 BINDING SITE, designated SEQ ID:5393, to the nucleotide sequence of GAM8145 RNA, herein designated GAM RNA, also designated SEQ ID:328.

Another function of GAM8145 is therefore inhibition of LOC221405 (Accession XP_168138.1). Accordingly, utilities of GAM8145 include diagnosis, prevention and treatment of diseases and clinical conditions associated with LOC221405.

LOC221710 (Accession XP_166471.2) is another GAM8145 target gene, herein designated TARGET GENE. LOC221710 BINDING SITE is a target binding site found in the 5' untranslated region of mRNA encoded by LOC221710, corresponding to a target binding site such as BINDING SITE I, BINDING SITE II or BINDING SITE III of FIG. 8. Table 4 illustrates the complementarity of the nucleotide sequences of LOC221710 BINDING SITE, designated SEQ ID:17794, to the nucleotide sequence of GAM8145 RNA, herein designated GAM RNA, also designated SEQ ID:328.

Another function of GAM8145 is therefore inhibition of LOC221710 (Accession XP_166471.2). Accordingly, utilities of GAM8145 include diagnosis, prevention and treatment of diseases and clinical conditions associated with LOC221710.

LOC222225 (Accession XP_168633.1) is another GAM8145 target gene, herein designated TARGET GENE. LOC222225 BINDING SITE is a target binding site found in the 3' untranslated region of mRNA encoded by LOC222225, corresponding to a target binding site such as BINDING SITE I, BINDING SITE II or BINDING SITE III of FIG. 8. Table 4 illustrates the complementarity of the nucleotide sequences of LOC222225 BINDING SITE, designated SEQ ID:10921, to the nucleotide sequence of GAM8145 RNA, herein designated GAM RNA, also designated SEQ ID:328.

Another function of GAM8145 is therefore inhibition of LOC222225 (Accession XP_168633.1). Accordingly, utilities of GAM8145 include diagnosis, prevention and treatment of diseases and clinical conditions associated with LOC222225.

LOC253228 (Accession XP_171113.3) is another GAM8145 target gene, herein designated TARGET GENE. LOC253228 BINDING SITE is a target binding site found in the 3' untranslated region of mRNA encoded by LOC253228, corresponding to a target binding site such as BINDING SITE I, BINDING SITE II or BINDING SITE III of FIG. 8. Table 4 illustrates the complementarity of the nucleotide sequences of LOC253228 BINDING SITE, designated SEQ ID:4153, to the nucleotide sequence of GAM8145 RNA, herein designated GAM RNA, also designated SEQ ID:328.

Another function of GAM8145 is therefore inhibition of LOC253228 (Accession XP_171113.3). Accordingly, utilities of GAM8145 include diagnosis, prevention and treatment of diseases and clinical conditions associated with LOC253228.

LOC254946 (Accession XP_171161.2) is another GAM8145 target gene, herein designated TARGET GENE. LOC254946 BINDING SITE is a target binding site found in the 5' untranslated region of mRNA encoded by LOC254946, corresponding to a target binding site such as BINDING SITE I, BINDING SITE II or BINDING SITE III of FIG. 8. Table 4 illustrates the complementarity of the nucleotide sequences of LOC254946 BINDING SITE, designated SEQ ID:18473, to the nucleotide sequence of GAM8145 RNA, herein designated GAM RNA, also designated SEQ ID:328.

Another function of GAM8145 is therefore inhibition of LOC254946 (Accession XP_171161.2). Accordingly, utilities of GAM8145 include diagnosis, prevention and treatment of diseases and clinical conditions associated with LOC254946.

LOC283167 (Accession XP_210921.1) is another GAM8145 target gene, herein designated TARGET GENE. LOC283167 BINDING SITE is a target binding site found in the 3' untranslated region of mRNA encoded by LOC283167, corresponding to a target binding site such as BINDING SITE I, BINDING SITE II or BINDING SITE III of FIG. 8. Table 4 illustrates the complementarity of the nucleotide sequences of LOC283167 BINDING SITE, designated SEQ ID:9794, to the nucleotide sequence of GAM8145 RNA, herein designated GAM RNA, also designated SEQ ID:328.

Another function of GAM8145 is therefore inhibition of LOC283167 (Accession XP_210921.1). Accordingly, utilities of GAM8145 include diagnosis, prevention and treatment of diseases and clinical conditions associated with LOC283167.

LOC283331 (Accession XP_210977.1) is another GAM8145 target gene, herein designated TARGET GENE. LOC283331 BINDING SITE is a target binding site found in the 5' untranslated region of mRNA encoded by LOC283331, corresponding to a target binding site such as BINDING SITE I, BINDING SITE II or BINDING SITE III of FIG. 8. Table 4 illustrates the complementarity of the nucleotide sequences of LOC283331 BINDING SITE, designated SEQ ID:9046, to the nucleotide sequence of GAM8145 RNA, herein designated GAM RNA, also designated SEQ ID:328.

Another function of GAM8145 is therefore inhibition of LOC283331 (Accession XP_210977.1). Accordingly, utilities of GAM8145 include diagnosis, prevention and treatment of diseases and clinical conditions associated with LOC283331.

LOC283514 (Accession XP_210264.2) is another GAM8145 target gene, herein designated TARGET GENE. LOC283514 BINDING SITE is a target binding site found in the 3' untranslated region of mRNA encoded by LOC283514, corresponding to a target binding site such as BINDING SITE I, BINDING SITE II or BINDING SITE III of FIG. 8. Table 4 illustrates the complementarity of the nucleotide sequences of LOC283514 BINDING SITE, designated SEQ ID:13165, to the nucleotide sequence of GAM8145 RNA, herein designated GAM RNA, also designated SEQ ID:328.

Another function of GAM8145 is therefore inhibition of LOC283514 (Accession XP_210264.2). Accordingly, utilities of GAM8145 include diagnosis, prevention and treatment of diseases and clinical conditions associated with LOC283514.

LOC283893 (Accession XP_211247.1) is another GAM8145 target gene, herein designated TARGET GENE. LOC283893 BINDING SITE is a target binding site found in the 3' untranslated region of mRNA encoded by LOC283893, corresponding to a target binding site such as BINDING SITE I, BINDING SITE II or BINDING SITE III of FIG. 8. Table 4 illustrates the complementarity of the nucleotide sequences of LOC283893 BINDING SITE, designated SEQ ID:15479, to the nucleotide sequence of GAM8145 RNA, herein designated GAM RNA, also designated SEQ ID:328.

Another function of GAM8145 is therefore inhibition of LOC283893 (Accession XP_211247.1). Accordingly, utilities of GAM8145 include diagnosis, prevention and treatment of diseases and clinical conditions associated with LOC283893.

LOC283908 (Accession XP_211252.3) is another GAM8145 target gene, herein designated TARGET GENE. LOC283908 BINDING SITE is a target binding site found in the 3' untranslated region of mRNA encoded by LOC283908, corresponding to a target binding site such as BINDING SITE I, BINDING SITE II or BINDING SITE III of FIG. 8. Table 4 illustrates the complementarity of the nucleotide sequences of LOC283908 BINDING SITE, designated SEQ ID:15479, to the nucleotide sequence of GAM8145 RNA, herein designated GAM RNA, also designated SEQ ID:328.

Another function of GAM8145 is therefore inhibition of LOC283908 (Accession XP_211252.3). Accordingly, utilities of GAM8145 include diagnosis, prevention and treatment of diseases and clinical conditions associated with LOC283908.

LOC284320 (Accession XP_209156.1) is another GAM8145 target gene, herein designated TARGET GENE. LOC284320 BINDING SITE is a target binding site found in the 5' untranslated region of mRNA encoded by LOC284320, corresponding to a target binding site such as BINDING SITE I, BINDING SITE II or BINDING SITE III of FIG. 8. Table 4 illustrates the complementarity of the nucleotide sequences of LOC284320 BINDING SITE, designated SEQ ID:1483, to the nucleotide sequence of GAM8145 RNA, herein designated GAM RNA, also designated SEQ ID:328.

Another function of GAM8145 is therefore inhibition of LOC284320 (Accession XP_209156.1). Accordingly, utilities of GAM8145 include diagnosis, prevention and treatment of diseases and clinical conditions associated with LOC284320.

LOC284445 (Accession XP_209212.1) is another GAM8145 target gene, herein designated TARGET GENE. LOC284445 BINDING SITE is a target binding site found in the 3' untranslated region of mRNA encoded by LOC284445, corresponding to a target binding site such as BINDING SITE I, BINDING SITE II or BINDING SITE III of FIG. 8. Table 4 illustrates the complementarity of the nucleotide sequences of LOC284445 BINDING SITE, designated SEQ ID:7639, to the nucleotide sequence of GAM8145 RNA, herein designated GAM RNA, also designated SEQ ID:328.

Another function of GAM8145 is therefore inhibition of LOC284445 (Accession XP_209212.1). Accordingly, utilities of GAM8145 include diagnosis, prevention and treatment of diseases and clinical conditions associated with LOC284445.

LOC284475 (Accession XP_211478.1) is another GAM8145 target gene, herein designated TARGET GENE. LOC284475 BINDING SITE is a target binding site found in the 5' untranslated region of mRNA encoded by LOC284475, corresponding to a target binding site such as BINDING SITE I, BINDING SITE II or BINDING SITE III of FIG. 8. Table 4 illustrates the complementarity of the nucleotide sequences of LOC284475 BINDING SITE, designated SEQ ID:10899, to the nucleotide sequence of GAM8145 RNA, herein designated GAM RNA, also designated SEQ ID:328.

Another function of GAM8145 is therefore inhibition of LOC284475 (Accession XP_211478.1). Accordingly, utilities of GAM8145 include diagnosis, prevention and treatment of diseases and clinical conditions associated with LOC284475.

LOC284682 (Accession XP_211586.1) is another GAM8145 target gene, herein designated TARGET GENE. LOC284682 BINDING SITE is a target binding site found in the 5' untranslated region of mRNA encoded by LOC284682, corresponding to a target binding site such as BINDING SITE I, BINDING SITE II or BINDING SITE III of FIG. 8. Table 4 illustrates the complementarity of the nucleotide sequences of LOC284682 BINDING SITE, designated SEQ ID:13805, to the nucleotide sequence of GAM8145 RNA, herein designated GAM RNA, also designated SEQ ID:328.

Another function of GAM8145 is therefore inhibition of LOC284682 (Accession XP_211586.1). Accordingly, utilities of GAM8145 include diagnosis, prevention and treatment of diseases and clinical conditions associated with LOC284682.

LOC285099 (Accession XP_209474.1) is another GAM8145 target gene, herein designated TARGET GENE. LOC285099 BINDING SITE is a target binding site found in the 3' untranslated region of mRNA encoded by LOC285099, corresponding to a target binding site such as BINDING SITE I, BINDING SITE II or BINDING SITE III of FIG. 8. Table 4 illustrates the complementarity of the nucleotide sequences of LOC285099 BINDING SITE, designated SEQ ID:16224, to the nucleotide sequence of GAM8145 RNA, herein designated GAM RNA, also designated SEQ ID:328.

Another function of GAM8145 is therefore inhibition of LOC285099 (Accession XP_209474.1). Accordingly, utilities of GAM8145 include diagnosis, prevention and treatment of diseases and clinical conditions associated with LOC285099.

LOC285103 (Accession XP_211766.1) is another GAM8145 target gene, herein designated TARGET GENE. LOC285103 BINDING SITE is a target binding site found in the 5' untranslated region of mRNA encoded by LOC285103, corresponding to a target binding site such as BINDING SITE I, BINDING SITE II or BINDING SITE III of FIG. 8. Table 4 illustrates the complementarity of the nucleotide sequences of LOC285103 BINDING SITE, designated SEQ ID:8036, to the nucleotide sequence of GAM8145 RNA, herein designated GAM RNA, also designated SEQ ID:328.

Another function of GAM8145 is therefore inhibition of LOC285103 (Accession XP_211766.1). Accordingly, utilities of GAM8145 include diagnosis, prevention and treatment of diseases and clinical conditions associated with LOC285103.

LOC285485 (Accession XP_211913.1) is another GAM8145 target gene, herein designated TARGET GENE. LOC285485 BINDING SITE is a target binding site found in the 3' untranslated region of mRNA encoded by LOC285485, corresponding to a target binding site such as BINDING SITE I, BINDING SITE II or BINDING SITE III of FIG. 8. Table 4 illustrates the complementarity of the nucleotide sequences of LOC285485 BINDING SITE, designated SEQ ID:19642, to the nucleotide sequence of GAM8145 RNA, herein designated GAM RNA, also designated SEQ ID:328.

Another function of GAM8145 is therefore inhibition of LOC285485 (Accession XP_211913.1). Accordingly, utilities of GAM8145 include diagnosis, prevention and treatment of diseases and clinical conditions associated with LOC285485.

LOC285662 (Accession XP_209713.1) is another GAM8145 target gene, herein designated TARGET GENE. LOC285662 BINDING SITE is a target binding site found in the 3' untranslated region of mRNA encoded by LOC285662, corresponding to a target binding site such as BINDING SITE I, BINDING SITE II or BINDING SITE III of FIG. 8. Table 4 illustrates the complementarity of the nucleotide sequences of LOC285662 BINDING SITE, designated SEQ ID:5278, to the nucleotide sequence of GAM8145 RNA, herein designated GAM RNA, also designated SEQ ID:328.

Another function of GAM8145 is therefore inhibition of LOC285662 (Accession XP_209713.1). Accordingly, utilities of GAM8145 include diagnosis, prevention and treatment of diseases and clinical conditions associated with LOC285662.

LOC285692 (Accession XP_211984.1) is another GAM8145 target gene, herein designated TARGET GENE. LOC285692 BINDING SITE is a target binding site found in the 3' untranslated region of mRNA encoded by LOC285692, corresponding to a target binding site such as BINDING SITE I, BINDING SITE II or BINDING SITE III of FIG. 8. Table 4 illustrates the complementarity of the nucleotide sequences of LOC285692 BINDING SITE, designated SEQ ID:12958, to the nucleotide sequence of GAM8145 RNA, herein designated GAM RNA, also designated SEQ ID:328.

Another function of GAM8145 is therefore inhibition of LOC285692 (Accession XP_211984.1). Accordingly, utilities of GAM8145 include diagnosis, prevention and treatment of diseases and clinical conditions associated with LOC285692.

LOC285889 (Accession XP_212070.1) is another GAM8145 target gene, herein designated TARGET GENE. LOC285889 BINDING SITE is a target binding site found in the 3' untranslated region of mRNA encoded by LOC285889, corresponding to a target binding site such as BINDING SITE I, BINDING SITE II or BINDING SITE III of FIG. 8. Table 4 illustrates the complementarity of the nucleotide sequences of LOC285889 BINDING SITE, designated SEQ ID:6980, to the nucleotide sequence of GAM8145 RNA, herein designated GAM RNA, also designated SEQ ID:328.

Another function of GAM8145 is therefore inhibition of LOC285889 (Accession XP_212070.1). Accordingly, utilities of GAM8145 include diagnosis, prevention and treatment of diseases and clinical conditions associated with LOC285889.

LOC285978 (Accession XP_212131.1) is another GAM8145 target gene, herein designated TARGET GENE. LOC285978 BINDING SITE is a target binding site found in the 3' untranslated region of mRNA encoded by LOC285978, corresponding to a target binding site such as BINDING SITE I, BINDING SITE II or BINDING SITE III of FIG. 8. Table 4 illustrates the complementarity of the nucleotide sequences of LOC285978 BINDING SITE, designated SEQ ID:18029, to the nucleotide sequence of GAM8145 RNA, herein designated GAM RNA, also designated SEQ ID:328.

Another function of GAM8145 is therefore inhibition of LOC285978 (Accession XP_212131.1). Accordingly, utilities of GAM8145 include diagnosis, prevention and treatment of diseases and clinical conditions associated with LOC285978.

LOC285981 (Accession XP_212114.1) is another GAM8145 target gene, herein designated TARGET GENE. LOC285981 BINDING SITE is a target binding site found in the 3' untranslated region of mRNA encoded by LOC285981, corresponding to a target binding site such as BINDING SITE I, BINDING SITE II or BINDING SITE III of FIG. 8. Table 4 illustrates the complementarity of the nucleotide sequences of LOC285981 BINDING SITE, designated SEQ ID:18029, to the nucleotide sequence of GAM8145 RNA, herein designated GAM RNA, also designated SEQ ID:328.

Another function of GAM8145 is therefore inhibition of LOC285981 (Accession XP_212114.1). Accordingly, utilities of GAM8145 include diagnosis, prevention and treatment of diseases and clinical conditions associated with LOC285981.

LOC286022 (Accession XP_212130.1) is another GAM8145 target gene, herein designated TARGET GENE. LOC286022 BINDING SITE is a target binding site found in the 3' untranslated region of mRNA encoded by LOC286022, corresponding to a target binding site such as BINDING SITE I, BINDING SITE II or BINDING SITE III of FIG. 8. Table 4 illustrates the complementarity of the nucleotide sequences of LOC286022 BINDING SITE, designated SEQ ID:3075, to the nucleotide sequence of GAM8145 RNA, herein designated GAM RNA, also designated SEQ ID:328.

Another function of GAM8145 is therefore inhibition of LOC286022 (Accession XP_212130.1). Accordingly, utilities of GAM8145 include diagnosis, prevention and treatment of diseases and clinical conditions associated with LOC286022.

LOC286112 (Accession XP_212176.1) is another GAM8145 target gene, herein designated TARGET GENE. LOC286112 BINDING SITE is a target binding site found in the 5' untranslated region of mRNA encoded by LOC286112, corresponding to a target binding site such as BINDING SITE I, BINDING SITE II or BINDING SITE III of FIG. 8. Table 4 illustrates the complementarity of the nucleotide sequences of LOC286112 BINDING SITE, designated SEQ ID:12097, to the nucleotide sequence of GAM8145 RNA, herein designated GAM RNA, also designated SEQ ID:328.

Another function of GAM8145 is therefore inhibition of LOC286112 (Accession XP_212176.1). Accordingly, utilities of GAM8145 include diagnosis, prevention and treatment of diseases and clinical conditions associated with LOC286112.

LOC286399 (Accession NP_789789.1) is another GAM8145 target gene, herein designated TARGET GENE. LOC286399 BINDING SITE is a target binding site found in the 3' untranslated region of mRNA encoded by LOC286399, corresponding to a target binding site such as BINDING SITE I, BINDING SITE II or BINDING SITE III of FIG. 8. Table 4 illustrates the complementarity of the nucleotide sequences of LOC286399 BINDING SITE, designated SEQ ID:19146, to the nucleotide sequence of GAM8145 RNA, herein designated GAM RNA, also designated SEQ ID:328.

Another function of GAM8145 is therefore inhibition of LOC286399 (Accession NP_789789.1). Accordingly, utilities of GAM8145 include diagnosis, prevention and treatment of diseases and clinical conditions associated with LOC286399.

LOC286430 (Accession XP_210044.1) is another GAM8145 target gene, herein designated TARGET GENE. LOC286430 BINDING SITE is a target binding site found in the 5' untranslated region of mRNA encoded by LOC286430, corresponding to a target binding site such as BINDING SITE I, BINDING SITE II or BINDING SITE III of FIG. 8. Table 4 illustrates the complementarity of the nucleotide sequences of LOC286430 BINDING SITE, designated SEQ ID:19962, to the nucleotide sequence of GAM8145 RNA, herein designated GAM RNA, also designated SEQ ID:328.

Another function of GAM8145 is therefore inhibition of LOC286430 (Accession XP_210044.1). Accordingly, utilities of GAM8145 include diagnosis, prevention and treatment of diseases and clinical conditions associated with LOC286430.

LOC340133 (Accession XP_291151.1) is another GAM8145 target gene, herein designated TARGET GENE. LOC340133 BINDING SITE is a target binding site found in the 3' untranslated region of mRNA encoded by LOC340133, corresponding to a target binding site such as BINDING SITE I, BINDING SITE II or BINDING SITE III of FIG. 8. Table 4 illustrates the complementarity of the nucleotide sequences of LOC340133 BINDING SITE, designated SEQ ID:17436, to the nucleotide sequence of GAM8145 RNA, herein designated GAM RNA, also designated SEQ ID:328.

Another function of GAM8145 is therefore inhibition of LOC340133 (Accession XP_291151.1). Accordingly, utilities of GAM8145 include diagnosis, prevention and treatment of diseases and clinical conditions associated with LOC340133.

LOC340276 (Accession XP_295197.1) is another GAM8145 target gene, herein designated TARGET GENE. LOC340276 BINDING SITE is a target binding site found in the 5' untranslated region of mRNA encoded by LOC340276, corresponding to a target binding site such as BINDING SITE I, BINDING SITE II or BINDING SITE III of FIG. 8. Table 4 illustrates the complementarity of the nucleotide sequences of LOC340276 BINDING SITE, designated SEQ ID:17407, to the nucleotide sequence of GAM8145 RNA, herein designated GAM RNA, also designated SEQ ID:328.

Another function of GAM8145 is therefore inhibition of LOC340276 (Accession XP_295197.1). Accordingly, utilities of GAM8145 include diagnosis, prevention and treatment of diseases and clinical conditions associated with LOC340276.

LOC340528 (Accession XP_295268.1) is another GAM8145 target gene, herein designated TARGET GENE. LOC340528 BINDING SITE is a target binding site found in the 3' untranslated region of mRNA encoded by LOC340528, corresponding to a target binding site such as BINDING SITE I, BINDING SITE II or BINDING SITE III of FIG. 8. Table 4 illustrates the complementarity of the nucleotide sequences of LOC340528 BINDING SITE, designated SEQ ID:4381, to the nucleotide sequence of GAM8145 RNA, herein designated GAM RNA, also designated SEQ ID:328.

Another function of GAM8145 is therefore inhibition of LOC340528 (Accession XP_295268.1). Accordingly, utilities of GAM8145 include diagnosis, prevention and treatment of diseases and clinical conditions associated with LOC340528.

LOC347941 (Accession XP_301398.1) is another GAM8145 target gene, herein designated TARGET GENE. LOC347941 BINDING SITE is a target binding site found in the 5' untranslated region of mRNA encoded by LOC347941, corresponding to a target binding site such as BINDING SITE I, BINDING SITE II or BINDING SITE III of FIG. 8. Table 4 illustrates the complementarity of the nucleotide sequences of LOC347941 BINDING SITE, designated SEQ ID:16665, to the nucleotide sequence of GAM8145 RNA, herein designated GAM RNA, also designated SEQ ID:328.

Another function of GAM8145 is therefore inhibition of LOC347941 (Accession XP_301398.1). Accordingly, utilities of GAM8145 include diagnosis, prevention and treatment of diseases and clinical conditions associated with LOC347941.

LOC348378 (Accession XP_300723.1) is another GAM8145 target gene, herein designated TARGET GENE. LOC348378 BINDING SITE is a target binding site found in the 3' untranslated region of mRNA encoded by LOC348378, corresponding to a target binding site such as BINDING SITE I, BINDING SITE II or BINDING SITE III of FIG. 8. Table 4 illustrates the complementarity of the nucleotide sequences of LOC348378 BINDING SITE, designated SEQ ID:5706, to the nucleotide sequence of GAM8145 RNA, herein designated GAM RNA, also designated SEQ ID:328.

Another function of GAM8145 is therefore inhibition of LOC348378 (Accession XP_300723.1). Accordingly, utilities of GAM8145 include diagnosis, prevention and treatment of diseases and clinical conditions associated with LOC348378.

LOC349339 (Accession XP_301042.1) is another GAM8145 target gene, herein designated TARGET GENE. LOC349339 BINDING SITE is a target binding site found in the 3' untranslated region of mRNA encoded by LOC349339, corresponding to a target binding site such as BINDING SITE I, BINDING SITE II or BINDING SITE III of FIG. 8. Table 4 illustrates the complementarity of the nucleotide sequences of LOC349339 BINDING SITE, designated SEQ ID:7639, to the nucleotide sequence of GAM8145 RNA, herein designated GAM RNA, also designated SEQ ID:328.

Another function of GAM8145 is therefore inhibition of LOC349339 (Accession XP_301042.1). Accordingly, utilities of GAM8145 include diagnosis, prevention and treatment of diseases and clinical conditions associated with LOC349339.

LOC351743 (Accession XP_305099.1) is another GAM8145 target gene, herein designated TARGET GENE. LOC351743 BINDING SITE is a target binding site found in the 5' untranslated region of mRNA encoded by LOC351743, corresponding to a target binding site such as BINDING SITE I, BINDING SITE II or BINDING SITE III of FIG. 8. Table 4 illustrates the complementarity of the nucleotide sequences of LOC351743 BINDING SITE, designated SEQ ID:20137, to the nucleotide sequence of GAM8145 RNA, herein designated GAM RNA, also designated SEQ ID:328.

Another function of GAM8145 is therefore inhibition of LOC351743 (Accession XP_305099.1). Accordingly, utilities of GAM8145 include diagnosis, prevention and treatment of diseases and clinical conditions associated with LOC351743.

LOC352287 (Accession XP_305558.1) is another GAM8145 target gene, herein designated TARGET GENE. LOC352287 BINDING SITE is a target binding site found in the 5' untranslated region of mRNA encoded by LOC352287, corresponding to a target binding site such as BINDING SITE I, BINDING SITE II or BINDING SITE III of FIG. 8. Table 4 illustrates the complementarity of the nucleotide sequences of LOC352287 BINDING SITE, designated SEQ ID:1767, to the nucleotide sequence of GAM8145 RNA, herein designated GAM RNA, also designated SEQ ID:328.

Another function of GAM8145 is therefore inhibition of LOC352287 (Accession XP_305558.1). Accordingly, utilities of GAM8145 include diagnosis, prevention and treatment of diseases and clinical conditions associated with LOC352287.

LOC51279 (Accession NP_057630.1) is another GAM8145 target gene, herein designated TARGET GENE. LOC51279 BINDING SITE is a target binding site found in the 3' untranslated region of mRNA encoded by LOC51279, corresponding to a target binding site such as BINDING SITE I, BINDING SITE II or BINDING SITE III of FIG. 8. Table 4 illustrates the complementarity of the nucleotide sequences of LOC51279 BINDING SITE, designated SEQ ID:16462, to the nucleotide sequence of GAM8145 RNA, herein designated GAM RNA, also designated SEQ ID:328.

Another function of GAM8145 is therefore inhibition of LOC51279 (Accession NP_057630.1). Accordingly, utilities of GAM8145 include diagnosis, prevention and treatment of diseases and clinical conditions associated with LOC51279.

LOC89944 (Accession NP_612351.2) is another GAM8145 target gene, herein designated TARGET GENE. LOC89944 BINDING SITE is a target binding site found in the 3' untranslated region of mRNA encoded by LOC89944, corresponding to a target binding site such as BINDING SITE I, BINDING SITE II or BINDING SITE III of FIG. 8. Table 4 illustrates the complementarity of the nucleotide sequences of LOC89944 BINDING SITE, designated SEQ ID:19307, to the nucleotide sequence of GAM8145 RNA, herein designated GAM RNA, also designated SEQ ID:328.

Another function of GAM8145 is therefore inhibition of LOC89944 (Accession NP_612351.2). Accordingly, utilities of GAM8145 include diagnosis, prevention and treatment of diseases and clinical conditions associated with LOC89944.

LOC90826 (Accession NP_612373.1) is another GAM8145 target gene, herein designated TARGET GENE. LOC90826 BINDING SITE is a target binding site found in the 5' untranslated region of mRNA encoded by LOC90826, corresponding to a target binding site such as BINDING SITE I, BINDING SITE II or BINDING SITE III of FIG. 8. Table 4 illustrates the complementarity of the nucleotide sequences of LOC90826 BINDING SITE, designated SEQ ID:3263, to the nucleotide sequence of GAM8145 RNA, herein designated GAM RNA, also designated SEQ ID:328.

Another function of GAM8145 is therefore inhibition of LOC90826 (Accession NP_612373.1). Accordingly, utilities of GAM8145 include diagnosis, prevention and treatment of diseases and clinical conditions associated with LOC90826.

LOC91464 (Accession XP_038589.1) is another GAM8145 target gene, herein designated TARGET GENE. LOC91464 BINDING SITE is a target binding site found in the 3' untranslated region of mRNA encoded by LOC91464, corresponding to a target binding site such as BINDING SITE I, BINDING SITE II or BINDING SITE III of FIG. 8. Table 4 illustrates the complementarity of the nucleotide sequences of LOC91464 BINDING SITE, designated SEQ ID:6655, to the nucleotide sequence of GAM8145 RNA, herein designated GAM RNA, also designated SEQ ID:328.

Another function of GAM8145 is therefore inhibition of LOC91464 (Accession XP_038589.1). Accordingly, utilities of GAM8145 include diagnosis, prevention and treatment of diseases and clinical conditions associated with LOC91464.

LOC95803 (Accession XP_047816.5) is another GAM8145 target gene, herein designated TARGET GENE. LOC95803 BINDING SITE is a target binding site found in the 3' untranslated region of mRNA encoded by LOC95803, corresponding to a target binding site such as BINDING SITE I, BINDING SITE II or BINDING SITE III of FIG. 8. Table 4 illustrates the complementarity of the nucleotide sequences of LOC95803 BINDING SITE, designated SEQ ID:9601, to the nucleotide sequence of GAM8145 RNA, herein designated GAM RNA, also designated SEQ ID:328.

Another function of GAM8145 is therefore inhibition of LOC95803 (Accession XP_047816.5). Accordingly, utilities of GAM8145 include diagnosis, prevention and treatment of diseases and clinical conditions associated with LOC95803.

Mannosidase, alpha, class 1a, member 1 (MAN1A1, Accession NP_005898.2) is another GAM8145 target gene, herein designated TARGET GENE. MAN1A1 BINDING SITE is a target binding site found in the 3' untranslated region of mRNA encoded by MAN1A1, corresponding to a target binding site such as BINDING SITE I, BINDING SITE II or BINDING SITE III of FIG. 8. Table 4 illustrates the complementarity of the nucleotide sequences of MAN1A1 BINDING SITE, designated SEQ ID:14751, to the nucleotide sequence of GAM8145 RNA, herein designated GAM RNA, also designated SEQ ID:328.

Another function of GAM8145 is therefore inhibition of Mannosidase, alpha, class 1a, member 1 (MAN1A1, Accession NP_005898.2), a gene which removes 3 distinct mannose residues from peptide- bound Man(9)-GlcNAc(2) oligosaccharides. Accordingly, utilities of GAM8145 include diagnosis, prevention and treatment of diseases and clinical conditions associated with MAN1A1.

The function of MAN1A1 and its association with various diseases and clinical conditions, has been established by previous studies, as described hereinabove with reference to GAM129.1. Mannosidase, alpha, class 2a, member 1 (MAN2A1, Accession NP_002363.1) is another GAM8145 target gene, herein designated TARGET GENE. MAN2A1 BINDING SITE is a target binding site found in the 5' untranslated region of mRNA encoded by MAN2A1, corresponding to a target binding site such as BINDING SITE I, BINDING SITE II or BINDING SITE III of FIG. 8. Table 4 illustrates the complementarity of the nucleotide sequences of MAN2A1 BINDING SITE, designated SEQ ID:9444, to the nucleotide sequence of GAM8145 RNA, herein designated GAM RNA, also designated SEQ ID:328.

Another function of GAM8145 is therefore inhibition of Mannosidase, alpha, class 2a, member 1 (MAN2A1, Accession NP_002363.1), a gene which catalyzes the final hydrolytic step in the asparagine-linked oligosaccharide (N-glycan) maturation pathway and therefore may be associated with Lupus erythematosus. Accordingly, utilities of GAM8145 include diagnosis, prevention and treatment of Lupus erythematosus, and of other diseases and clinical conditions associated with MAN2A1.

The function of MAN2A1 and its association with various diseases and clinical conditions, has been established by previous studies, as described hereinabove with reference to GAM2565.2. MBNL2 (Accession NP_659002.1) is another GAM8145 target gene, herein designated TARGET GENE. MBNL2 BINDING SITE is a target binding site found in the 3' untranslated region of multiple transcripts of mRNA encoded by MBNL2, corresponding to a target binding site such as BINDING SITE I, BINDING SITE II or BINDING SITE III of FIG. 8. Table 4 illustrates the complementarity of the nucleotide sequences of MBNL2 BINDING SITE, designated SEQ ID:1692, to the nucleotide sequence of GAM8145 RNA, herein designated GAM RNA, also designated SEQ ID:328.

Another function of GAM8145 is therefore inhibition of MBNL2 (Accession NP_659002.1). Accordingly, utilities of GAM8145 include diagnosis, prevention and treatment of diseases and clinical conditions associated with MBNL2.

Mesenchyme homeo box 2 (growth arrest-specific homeo box) (MEOX2, Accession NP_005915.1) is another GAM8145 target gene, herein designated TARGET GENE. MEOX2 BINDING SITE is a target binding site found in the 3' untranslated region of mRNA encoded by MEOX2, corresponding to a target binding site such as BINDING SITE I, BINDING SITE II or BINDING SITE III of FIG. 8. Table 4 illustrates the complementarity of the nucleotide sequences of MEOX2 BINDING SITE, designated SEQ ID:10706, to the nucleotide sequence of GAM8145 RNA, herein designated GAM RNA, also designated SEQ ID:328.

Another function of GAM8145 is therefore inhibition of Mesenchyme homeo box 2 (growth arrest-specific homeo box) (MEOX2, Accession NP_005915.1), a gene which roles in mesoderm induction and, somitogenesis, and myogenic and sclerotomal differentiation. Accordingly, utilities of GAM8145 include diagnosis, prevention and treatment of diseases and clinical conditions associated with MEOX2.

The function of MEOX2 and its association with various diseases and clinical conditions, has been established by previous studies, as described hereinabove with reference to GAM538.1. MGC11102 (Accession NP_115701.2) is another GAM8145 target gene, herein designated TARGET GENE. MGC11102 BINDING SITE is a target binding site found in the 3' untranslated region of mRNA encoded by MGC11102, corresponding to a target binding site such as BINDING SITE I, BINDING SITE II or BINDING SITE III of FIG. 8. Table 4 illustrates the complementarity of the nucleotide sequences of MGC11102 BINDING SITE, designated SEQ ID:11974, to the nucleotide sequence of GAM8145 RNA, herein designated GAM RNA, also designated SEQ ID:328.

Another function of GAM8145 is therefore inhibition of MGC11102 (Accession NP_115701.2). Accordingly, utilities of GAM8145 include diagnosis, prevention and treatment of diseases and clinical conditions associated with MGC11102.

MGC20781 (Accession NP_443167.1) is another GAM8145 target gene, herein designated TARGET GENE. MGC20781 BINDING SITE is a target binding site found in the 5' untranslated region of mRNA encoded by MGC20781, corresponding to a target binding site such as BINDING SITE I, BINDING SITE II or BINDING SITE III of FIG. 8. Table 4 illustrates the complementarity of the nucleotide sequences of MGC20781 BINDING SITE, designated SEQ ID:1066, to the nucleotide sequence of GAM8145 RNA, herein designated GAM RNA, also designated SEQ ID:328.

Another function of GAM8145 is therefore inhibition of MGC20781 (Accession NP_443167.1). Accordingly, utilities of GAM8145 include diagnosis, prevention and treatment of diseases and clinical conditions associated with MGC20781.

MGC27434 (Accession NP_659487.1) is another GAM8145 target gene, herein designated TARGET GENE. MGC27434 BINDING SITE is a target binding site found in the 3' untranslated region of mRNA encoded by MGC27434, corresponding to a target binding site such as BINDING SITE I, BINDING SITE II or BINDING SITE III of FIG. 8. Table 4 illustrates the complementarity of the nucleotide sequences of MGC27434 BINDING SITE, designated SEQ ID:7480, to the nucleotide sequence of GAM8145 RNA, herein designated GAM RNA, also designated SEQ ID:328.

Another function of GAM8145 is therefore inhibition of MGC27434 (Accession NP_659487.1). Accordingly, utilities of GAM8145 include diagnosis, prevention and treatment of diseases and clinical conditions associated with MGC27434.

Nuclear receptor coactivator 6 (NCOA6, Accession NP_054790.1) is another GAM8145 target gene, herein designated TARGET GENE. NCOA6 BINDING SITE is a target binding site found in the 5' untranslated region of mRNA encoded by NCOA6, corresponding to a target binding site such as BINDING SITE I, BINDING SITE II or BINDING SITE III of FIG. 8. Table 4 illustrates the complementarity of the nucleotide sequences of NCOA6 BINDING SITE, designated SEQ ID:11974, to the nucleotide sequence of GAM8145 RNA, herein designated GAM RNA, also designated SEQ ID:328.

Another function of GAM8145 is therefore inhibition of Nuclear receptor coactivator 6 (NCOA6, Accession NP_054790.1), a gene which activates gene transcription through ligand-dependent association with coactivators. and therefore may be associated with Breast cancer. Accordingly, utilities of GAM8145 include diagnosis, prevention and treatment of Breast cancer, and of other diseases and clinical conditions associated with NCOA6.

The function of NCOA6 and its association with various diseases and clinical conditions, has been established by previous studies, as described hereinabove with reference to GAM161.1. Oculocerebrorenal syndrome of lowe (OCRL, Accession NP_001578.2) is another GAM8145 target gene, herein designated TARGET GENE. OCRL BINDING SITE is a target binding site found in the 3' untranslated region of multiple transcripts of mRNA encoded by OCRL, corresponding to a target binding site such as BINDING SITE I, BINDING SITE II or BINDING SITE III of FIG. 8. Table 4 illustrates the complementarity of the nucleotide sequences of OCRL BINDING SITE, designated SEQ ID:11613, to the nucleotide sequence of GAM8145 RNA, herein designated GAM RNA, also designated SEQ ID:328.

Another function of GAM8145 is therefore inhibition of Oculocerebrorenal syndrome of lowe (OCRL, Accession NP_001578.2). Accordingly, utilities of GAM8145 include diagnosis, prevention and treatment of diseases and clinical conditions associated with OCRL.

Oculocerebrorenal syndrome of lowe (OCRL, Accession NP_000267.2) is another GAM8145 target gene, herein designated TARGET GENE. OCRL BINDING SITE is a target binding site found in the 3' untranslated region of multiple transcripts of mRNA encoded by OCRL, corresponding to a target binding site such as BINDING SITE I, BINDING SITE II or BINDING SITE III of FIG. 8. Table 4 illustrates the complementarity of the nucleotide sequences of OCRL BINDING SITE, designated SEQ ID:11613, to the nucleotide sequence of GAM8145 RNA, herein designated GAM RNA, also designated SEQ ID:328.

Another function of GAM8145 is therefore inhibition of Oculocerebrorenal syndrome of lowe (OCRL, Accession NP_000267.2). Accordingly, utilities of GAM8145 include diagnosis, prevention and treatment of diseases and clinical conditions associated with OCRL.

Protocadherin alpha 11 (PCDHA11, Accession NP_061725.1) is another GAM8145 target gene, herein designated TARGET GENE. PCDHA11 BINDING SITE is a target binding site found in the 5' untranslated region of multiple transcripts of mRNA encoded by PCDHA11, corresponding to a target binding site such as BINDING SITE I, BINDING SITE II or BINDING SITE III of FIG. 8. Table 4 illustrates the complementarity of the nucleotide sequences of PCDHA11 BINDING SITE, designated SEQ ID:10904, to the nucleotide sequence of GAM8145 RNA, herein designated GAM RNA, also designated SEQ ID:328.

Another function of GAM8145 is therefore inhibition of Protocadherin alpha 11 (PCDHA11, Accession NP_061725.1). Accordingly, utilities of GAM8145 include diagnosis, prevention and treatment of diseases and clinical conditions associated with PCDHA11.

Protocadherin alpha 11 (PCDHA11, Accession NP_114067.1) is another GAM8145 target gene, herein designated TARGET GENE. PCDHA11 BINDING SITE is a target binding site found in the 5' untranslated region of multiple transcripts of mRNA encoded by PCDHA11, corresponding to a target binding site such as BINDING SITE I, BINDING SITE II or BINDING SITE III of FIG. 8. Table 4 illustrates the complementarity of the nucleotide sequences of PCDHA11 BINDING SITE, designated SEQ ID:10904, to the nucleotide sequence of GAM8145 RNA, herein designated GAM RNA, also designated SEQ ID:328.

Another function of GAM8145 is therefore inhibition of Protocadherin alpha 11 (PCDHA11, Accession NP_114067.1). Accordingly, utilities of GAM8145 include diagnosis, prevention and treatment of diseases and clinical conditions associated with PCDHA11.

PEF (Accession NP_036524.1) is another GAM8145 target gene, herein designated TARGET GENE. PEF BINDING SITE is a target binding site found in the 3' untranslated region of mRNA encoded by PEF, corresponding to a target binding site such as BINDING SITE I, BINDING SITE II or BINDING SITE III of FIG. 8. Table 4 illustrates the complementarity of the nucleotide sequences of PEF BINDING SITE, designated SEQ ID:5634, to the nucleotide sequence of GAM8145 RNA, herein designated GAM RNA, also designated SEQ ID:328.

Another function of GAM8145 is therefore inhibition of PEF (Accession NP_036524.1). Accordingly, utilities of GAM8145 include diagnosis, prevention and treatment of diseases and clinical conditions associated with PEF.

PKD1-like (Accession NP_079150.2) is another GAM8145 target gene, herein designated TARGET GENE. PKD1-like BINDING SITE is a target binding site found in the 3' untranslated region of mRNA encoded by PKD1-like, corresponding to a target binding site such as BINDING SITE I, BINDING SITE II or BINDING SITE III of FIG. 8. Table 4 illustrates the complementarity of the nucleotide sequences of PKD1-like BINDING SITE, designated SEQ ID:2164, to the nucleotide sequence of GAM8145 RNA, herein designated GAM RNA, also designated SEQ ID:328.

Another function of GAM8145 is therefore inhibition of PKD1-like (Accession NP_079150.2). Accordingly, utilities of GAM8145 include diagnosis, prevention and treatment of diseases and clinical conditions associated with PKD1-like.

Phospholipid scramblase 3 (PLSCR3, Accession NP_065093.2) is another GAM8145 target gene, herein designated TARGET GENE. PLSCR3 BINDING SITE is a target binding site found in the 3' untranslated region of mRNA encoded by PLSCR3, corresponding to a target binding site such as BINDING SITE I, BINDING SITE II or BINDING SITE III of FIG. 8. Table 4 illustrates the complementarity of the nucleotide sequences of PLSCR3 BINDING SITE, designated SEQ ID:11017, to the nucleotide sequence of GAM8145 RNA, herein designated GAM RNA, also designated SEQ ID:328.

Another function of GAM8145 is therefore inhibition of Phospholipid scramblase 3 (PLSCR3, Accession NP_065093.2). Accordingly, utilities of GAM8145 include diagnosis, prevention and treatment of diseases and clinical conditions associated with PLSCR3.

Promyelocytic leukemia (PML, Accession NP_150241.1) is another GAM8145 target gene, herein designated TARGET GENE. PML BINDING SITE is a target binding site found in the 3' untranslated region of multiple transcripts of mRNA encoded by PML, corresponding to a target binding site such as BINDING SITE I, BINDING SITE II or BINDING SITE III of FIG. 8. Table 4 illustrates the complementarity of the nucleotide sequences of PML BINDING SITE, designated SEQ ID:18322, to the nucleotide sequence of GAM8145 RNA, herein designated GAM RNA, also designated SEQ ID:328.

Another function of GAM8145 is therefore inhibition of Promyelocytic leukemia (PML, Accession NP_150241.1). Accordingly, utilities of GAM8145 include diagnosis, prevention and treatment of diseases and clinical conditions associated with PML.

PNPLA1 (Accession NP_775947.1) is another GAM8145 target gene, herein designated TARGET GENE. PNPLA1 BINDING SITE is a target binding site found in the 5' untranslated region of mRNA encoded by PNPLA1, corresponding to a target binding site such as BINDING SITE I, BINDING SITE II or BINDING SITE III of FIG. 8. Table 4 illustrates the complementarity of the nucleotide sequences of PNPLA1 BINDING SITE, designated SEQ ID:17384, to the nucleotide sequence of GAM8145 RNA, herein designated GAM RNA, also designated SEQ ID:328.

Another function of GAM8145 is therefore inhibition of PNPLA1 (Accession NP_775947.1). Accordingly, utilities of GAM8145 include diagnosis, prevention and treatment of diseases and clinical conditions associated with PNPLA1.

Pou domain, class 3, transcription factor 2 (POU3F2, Accession NP_005595.1) is another GAM8145 target gene, herein designated TARGET GENE. POU3F2 BINDING SITE is a target binding site found in the 3' untranslated region of mRNA encoded by POU3F2, corresponding to a target binding site such as BINDING SITE I, BINDING SITE II or BINDING SITE III of FIG. 8. Table 4 illustrates the complementarity of the nucleotide sequences of POU3F2 BINDING SITE, designated SEQ ID:19075, to the nucleotide sequence of GAM8145 RNA, herein designated GAM RNA, also designated SEQ ID:328.

Another function of GAM8145 is therefore inhibition of Pou domain, class 3, transcription factor 2 (POU3F2, Accession NP_005595.1), a gene which positively regulates the genes under the control of corticotropin-releasing hormone. Accordingly, utilities of GAM8145 include diagnosis, prevention and treatment of diseases and clinical conditions associated with POU3F2.

The function of POU3F2 and its association with various diseases and clinical conditions, has been established by previous studies, as described hereinabove with reference to GAM94.1. Protein phosphatase, ef hand calcium-binding domain 2 (PPEF2, Accession NP_690911.1) is another GAM8145 target gene, herein designated TARGET GENE. PPEF2 BINDING SITE is a target binding site found in the 3' untranslated region of multiple transcripts of mRNA encoded by PPEF2, corresponding to a target binding site such as BINDING SITE I, BINDING SITE II or BINDING SITE III of FIG. 8. Table 4 illustrates the complementarity of the nucleotide sequences of PPEF2 BINDING SITE, designated SEQ ID:9035, to the nucleotide sequence of GAM8145 RNA, herein designated GAM RNA, also designated SEQ ID:328.

Another function of GAM8145 is therefore inhibition of Protein phosphatase, ef hand calcium-binding domain 2 (PPEF2, Accession NP_690911.1), a gene which is a homolog of Drosophila rdgC. Accordingly, utilities of GAM8145 include diagnosis, prevention and treatment of diseases and clinical conditions associated with PPEF2.

The function of PPEF2 and its association with various diseases and clinical conditions, has been established by previous studies, as described hereinabove with reference to GAM66.2. Protein kinase, camp-dependent, regulatory, type ii, beta (PRKAR2B, Accession NP_002727.1) is another GAM8145 target gene, herein designated TARGET GENE. PRKAR2B BINDING SITE is a target binding site found in the 3' untranslated region of mRNA encoded by PRKAR2B, corresponding to a target binding site such as BINDING SITE I, BINDING SITE II or BINDING SITE III of FIG. 8. Table 4 illustrates the complementarity of the nucleotide sequences of PRKAR2B BINDING SITE, designated SEQ ID:6242, to the nucleotide sequence of GAM8145 RNA, herein designated GAM RNA, also designated SEQ ID:328.

Another function of GAM8145 is therefore inhibition of Protein kinase, camp-dependent, regulatory, type ii, beta (PRKAR2B, Accession NP_002727.1), a gene which type ii regulatory chains mediate membrane association by binding to anchoring proteins, including the map2 kinase. Accordingly, utilities of GAM8145 include diagnosis, prevention and treatment of diseases and clinical conditions associated with PRKAR2B.

The function of PRKAR2B and its association with various diseases and clinical conditions, has been established by previous studies, as described hereinabove with reference to GAM357.2. Protein tyrosine phosphatase, non-receptor type 9 (PTPN9, Accession NP_002824.1) is another GAM8145 target gene, herein designated TARGET GENE. PTPN9 BINDING SITE is a target binding site found in the 3' untranslated region of mRNA encoded by PTPN9, corresponding to a target binding site such as BINDING SITE I, BINDING SITE II or BINDING SITE III of FIG. 8. Table 4 illustrates the complementarity of the nucleotide sequences of PTPN9 BINDING SITE, designated SEQ ID:6603, to the nucleotide sequence of GAM8145 RNA, herein designated GAM RNA, also designated SEQ ID:328.

Another function of GAM8145 is therefore inhibition of Protein tyrosine phosphatase, non-receptor type 9 (PTPN9, Accession NP_002824.1). Accordingly, utilities of GAM8145 include diagnosis, prevention and treatment of diseases and clinical conditions associated with PTPN9.

Protein tyrosine phosphatase, receptor type, t (PTPRT, Accession NP_573400.1) is another GAM8145 target gene, herein designated TARGET GENE. PTPRT BINDING SITE1 and PTPRT BINDING SITE2 are target binding sites found in untranslated regions of multiple transcripts of mRNA encoded by PTPRT, corresponding to target binding sites such as BINDING SITE I, BINDING SITE II or BINDING SITE III of FIG. 8. Table 4 illustrates the complementarity of the nucleotide sequences of PTPRT BINDING SITE1 and PTPRT BINDING SITE2, designated SEQ ID:6604 and SEQ ID:6604 respectively, to the nucleotide sequence of GAM8145 RNA, herein designated GAM RNA, also designated SEQ ID:328.

Another function of GAM8145 is therefore inhibition of Protein tyrosine phosphatase, receptor type, t (PTPRT, Accession NP_573400.1). Accordingly, utilities of GAM8145 include diagnosis, prevention and treatment of diseases and clinical conditions associated with PTPRT.

Protein tyrosine phosphatase, receptor type, t (PTPRT, Accession NP_573400.1) is another GAM8145 target gene, herein designated TARGET GENE. PTPRT BINDING SITE1 and PTPRT BINDING SITE2 are target binding sites found in untranslated regions of multiple transcripts of mRNA encoded by PTPRT, corresponding to target binding sites such as BINDING SITE I, BINDING SITE II or BINDING SITE III of FIG. 8. Table 4 illustrates the complementarity of the nucleotide sequences of PTPRT BINDING SITE1 and PTPRT BINDING SITE2, designated SEQ ID:19034 and SEQ ID:19034 respectively, to the nucleotide sequence of GAM8145 RNA, herein designated GAM RNA, also designated SEQ ID:328.

Another function of GAM8145 is therefore inhibition of Protein tyrosine phosphatase, receptor type, t (PTPRT, Accession NP_573400.1). Accordingly, utilities of GAM8145 include diagnosis, prevention and treatment of diseases and clinical conditions associated with PTPRT.

Rho-related btb domain containing 3 (RHOBTB3, Accession NP_055714.1) is another GAM8145 target gene, herein designated TARGET GENE. RHOBTB3 BINDING SITE is a target binding site found in the 5' untranslated region of mRNA encoded by RHOBTB3, corresponding to a target binding site such as BINDING SITE I, BINDING SITE II or BINDING SITE III of FIG. 8. Table 4 illustrates the complementarity of the nucleotide sequences of RHOBTB3 BINDING SITE, designated SEQ ID:10064, to the nucleotide sequence of GAM8145 RNA, herein designated GAM RNA, also designated SEQ ID:328.

Another function of GAM8145 is therefore inhibition of Rho-related btb domain containing 3 (RHOBTB3, Accession NP_055714.1). Accordingly, utilities of GAM8145 include diagnosis, prevention and treatment of diseases and clinical conditions associated with RHOBTB3.

Ring finger protein 14 (RNF14, Accession NP_004281.1) is another GAM8145 target gene, herein designated TARGET GENE. RNF14 BINDING SITE is a target binding site found in the 3' untranslated region of mRNA encoded by RNF14, corresponding to a target binding site such as BINDING SITE I, BINDING SITE II or BINDING SITE III of FIG. 8. Table 4 illustrates the complementarity of the nucleotide sequences of RNF14 BINDING SITE, designated SEQ ID:11351, to the nucleotide sequence of GAM8145 RNA, herein designated GAM RNA, also designated SEQ ID:328.

Another function of GAM8145 is therefore inhibition of Ring finger protein 14 (RNF14, Accession NP_004281.1), a gene which associates with the androgen receptor (AR); functions as a transcriptional coactivator. Accordingly, utilities of GAM8145 include diagnosis, prevention and treatment of diseases and clinical conditions associated with RNF14.

The function of RNF14 and its association with various diseases and clinical conditions, has been established by previous studies, as described hereinabove with reference to GAM205.2. Sodium channel, nonvoltage-gated 1, gamma (SCNN1G, Accession NP_001030.1) is another GAM8145 target gene, herein designated TARGET GENE. SCNN1G BINDING SITE is a target binding site found in the 3' untranslated region of mRNA encoded by SCNN1G, corresponding to a target binding site such as BINDING SITE I, BINDING SITE II or BINDING SITE III of FIG. 8. Table 4 illustrates the complementarity of the nucleotide sequences of SCNN1G BINDING SITE, designated SEQ ID:1599, to the nucleotide sequence of GAM8145 RNA, herein designated GAM RNA, also designated SEQ ID:328.

Another function of GAM8145 is therefore inhibition of Sodium channel, nonvoltage-gated 1, gamma (SCNN1G, Accession NP_001030.1) . Accordingly, utilities of GAM8145 include diagnosis, prevention and treatment of diseases and clinical conditions associated with SCNN1G.

Sh3-domain grb2-like 2 (SH3GL2, Accession NP_003017.1) is another GAM8145 target gene, herein designated TARGET GENE. SH3GL2 BINDING SITE is a target binding site found in the 3' untranslated region of mRNA encoded by SH3GL2, corresponding to a target binding site such as BINDING SITE I, BINDING SITE II or BINDING SITE III of FIG. 8. Table 4 illustrates the complementarity of the nucleotide sequences of SH3GL2 BINDING SITE, designated SEQ ID:10145, to the nucleotide sequence of GAM8145 RNA, herein designated GAM RNA, also designated SEQ ID:328.

Another function of GAM8145 is therefore inhibition of Sh3-domain grb2-like 2 (SH3GL2, Accession NP_003017.1), a gene which plays a role in synaptic vesicle recycling, in particular in clathrin-mediated vesicle endocytosis. Accordingly, utilities of GAM8145 include diagnosis, prevention and treatment of diseases and clinical conditions associated with SH3GL2.

The function of SH3GL2 and its association with various diseases and clinical conditions, has been established by previous studies, as described hereinabove with reference to GAM513.1. TACTILE (Accession NP_005807.1) is another GAM8145 target gene, herein designated TARGET GENE. TACTILE BINDING SITE is a target binding site found in the 3' untranslated region of mRNA encoded by TACTILE, corresponding to a target binding site such as BINDING SITE I, BINDING SITE II or BINDING SITE III of FIG. 8. Table 4 illustrates the complementarity of the nucleotide sequences of TACTILE BINDING SITE, designated SEQ ID:16831, to the nucleotide sequence of GAM8145 RNA, herein designated GAM RNA, also designated SEQ ID:328.

Another function of GAM8145 is therefore inhibition of TACTILE (Accession NP_005807.1). Accordingly, utilities of GAM8145 include diagnosis, prevention and treatment of diseases and clinical conditions associated with TACTILE.

Taf6 rna polymerase ii, tata box binding protein (tbp)-associated factor, 80 kda (TAF6, Accession NP_620835.1) is another GAM8145 target gene, herein designated TARGET GENE. TAF6 BINDING SITE is a target binding site found in the 5' untranslated region of multiple transcripts of mRNA encoded by TAF6, corresponding to a target binding site such as BINDING SITE I, BINDING SITE II or BINDING SITE III of FIG. 8. Table 4 illustrates the complementarity of the nucleotide sequences of TAF6 BINDING SITE, designated SEQ ID:1733, to the nucleotide sequence of GAM8145 RNA, herein designated GAM RNA, also designated SEQ ID:328.

Another function of GAM8145 is therefore inhibition of Taf6 rna polymerase ii, tata box binding protein (tbp)-associated factor, 80 kda (TAF6, Accession NP_620835.1), a gene which plays a central role in mediating promoter responses to various activators and repressors. Accordingly, utilities of GAM8145 include diagnosis, prevention and treatment of diseases and clinical conditions associated with TAF6.

The function of TAF6 and its association with various diseases and clinical conditions, has been established by previous studies, as described hereinabove with reference to GAM507.1. Taf6 rna polymerase ii, tata box binding protein (tbp)-associated factor, 80 kda (TAF6, Accession NP_005632.1) is another GAM8145 target gene, herein designated TARGET GENE. TAF6 BINDING SITE is a target binding site found in the 5' untranslated region of multiple transcripts of mRNA encoded by TAF6, corresponding to a target binding site such as BINDING SITE I, BINDING SITE II or BINDING SITE III of FIG. 8. Table 4 illustrates the complementarity of the nucleotide sequences of TAF6 BINDING SITE, designated SEQ ID:1733, to the nucleotide sequence of GAM8145 RNA, herein designated GAM RNA, also designated SEQ ID:328.

Another function of GAM8145 is therefore inhibition of Taf6 rna polymerase ii, tata box binding protein (tbp)-associated factor, 80 kda (TAF6, Accession NP_005632.1), a gene which plays a central role in mediating promoter responses to various activators and repressors. Accordingly, utilities of GAM8145 include diagnosis, prevention and treatment of diseases and clinical conditions associated with TAF6.

The function of TAF6 and its association with various diseases and clinical conditions, has been established by previous studies, as described hereinabove with reference to GAM507.1. Transducin (beta)-like 1x-linked (TBL1X, Accession NP_005638.1) is another GAM8145 target gene, herein designated TARGET GENE. TBL1X BINDING SITE is a target binding site found in the 3' untranslated region of mRNA encoded by TBL1X, corresponding to a target binding site such as BINDING SITE I, BINDING SITE II or BINDING SITE III of FIG. 8. Table 4 illustrates the complementarity of the nucleotide sequences of TBL1X BINDING SITE, designated SEQ ID:2978, to the nucleotide sequence of GAM8145 RNA, herein designated GAM RNA, also designated SEQ ID:328.

Another function of GAM8145 is therefore inhibition of Transducin (beta)-like 1x-linked (TBL1X, Accession NP_005638.1), a gene which activates latent HDAC3 activity. Accordingly, utilities of GAM8145 include diagnosis, prevention and treatment of diseases and clinical conditions associated with TBL1X.

The function of TBL1X and its association with various diseases and clinical conditions, has been established by previous studies, as described hereinabove with reference to GAM28.1. T-cell leukemia/lymphoma 1b (TCL1B, Accession NP_004909.1) is another GAM8145 target gene, herein designated TARGET GENE. TCL1B BINDING SITE is a target binding site found in the 3' untranslated region of mRNA encoded by TCL1B, corresponding to a target binding site such as BINDING SITE I, BINDING SITE II or BINDING SITE III of FIG. 8. Table 4 illustrates the complementarity of the nucleotide sequences of TCL1B BINDING SITE, designated SEQ ID:4847, to the nucleotide sequence of GAM8145 RNA, herein designated GAM RNA, also designated SEQ ID:328.

Another function of GAM8145 is therefore inhibition of T-cell leukemia/lymphoma 1b (TCL1B, Accession NP_004909.1), a gene which is a a member of the TCL1 family that is activated in chronic t-cell leukemias (t-cll) and therefore may be associated with Chronic t-cell leukemias. Accordingly, utilities of GAM8145 include diagnosis, prevention and treatment of Chronic t-cell leukemias, and of other diseases and clinical conditions associated with TCL1B.

The function of TCL1B and its association with various diseases and clinical conditions, has been established by previous studies, as described hereinabove with reference to GAM47.1. Transketolase-like 1 (TKTL1, Accession NP_036385.1) is another GAM8145 target gene, herein designated TARGET GENE. TKTL1 BINDING SITE is a target binding site found in the 5' untranslated region of mRNA encoded by TKTL1, corresponding to a target binding site such as BINDING SITE I, BINDING SITE II or BINDING SITE III of FIG. 8. Table 4 illustrates the complementarity of the nucleotide sequences of TKTL1 BINDING SITE, designated SEQ ID:10570, to the nucleotide sequence of GAM8145 RNA, herein designated GAM RNA, also designated SEQ ID:328.

Another function of GAM8145 is therefore inhibition of Transketolase-like 1 (TKTL1, Accession NP_036385.1), a gene which involves in pentose phosphate pathway and therefore may be associated with Wernicke-korsakoff syndrome. Accordingly, utilities of GAM8145 include diagnosis, prevention and treatment of Wernicke-korsakoff syndrome, and of other diseases and clinical conditions associated with TKTL1.

The function of TKTL1 and its association with various diseases and clinical conditions, has been established by previous studies, as described hereinabove with reference to GAM608.2. Testis-specific transcript, y-linked 9 (TTTY9, Accession NP_114133.1) is another GAM8145 target gene, herein designated TARGET GENE. TTTY9 BINDING SITE is a target binding site found in the 3' untranslated region of mRNA encoded by TTTY9, corresponding to a target binding site such as BINDING SITE I, BINDING SITE II or BINDING SITE III of FIG. 8. Table 4 illustrates the complementarity of the nucleotide sequences of TTTY9 BINDING SITE, designated SEQ ID:17970, to the nucleotide sequence of GAM8145 RNA, herein designated GAM RNA, also designated SEQ ID:328.

Another function of GAM8145 is therefore inhibition of Testis-specific transcript, y-linked 9 (TTTY9, Accession NP_114133.1) . Accordingly, utilities of GAM8145 include diagnosis, prevention and treatment of diseases and clinical conditions associated with TTTY9.

Udp-glucuronate decarboxylase 1 (UXS1, Accession NP_079352.1) is another GAM8145 target gene, herein designated TARGET GENE. UXS1 BINDING SITE is a target binding site found in the 5' untranslated region of mRNA encoded by UXS1, corresponding to a target binding site such as BINDING SITE I, BINDING SITE II or BINDING SITE III of FIG. 8. Table 4 illustrates the complementarity of the nucleotide sequences of UXS1 BINDING SITE, designated SEQ ID:9295, to the nucleotide sequence of GAM8145 RNA, herein designated GAM RNA, also designated SEQ ID:328.

Another function of GAM8145 is therefore inhibition of Udp-glucuronate decarboxylase 1 (UXS1, Accession NP_079352.1). Accordingly, utilities of GAM8145 include diagnosis, prevention and treatment of diseases and clinical conditions associated with UXS1.

Vacuolar protein sorting 4a (yeast) (VPS4A, Accession NP_037377.1) is another GAM8145 target gene, herein designated TARGET GENE. VPS4A BINDING SITE is a target binding site found in the 3' untranslated region of mRNA encoded by VPS4A, corresponding to a target binding site such as BINDING SITE I, BINDING SITE II or BINDING SITE III of FIG. 8. Table 4 illustrates the complementarity of the nucleotide sequences of VPS4A BINDING SITE, designated SEQ ID:12450, to the nucleotide sequence of GAM8145 RNA, herein designated GAM RNA, also designated SEQ ID:328.

Another function of GAM8145 is therefore inhibition of Vacuolar protein sorting 4a (yeast) (VPS4A, Accession NP_037377.1). Accordingly, utilities of GAM8145 include diagnosis, prevention and treatment of diseases and clinical conditions associated with VPS4A.

Reserved (WDR17, Accession NP_851782.1) is another GAM8145 target gene, herein designated TARGET GENE. WDR17 BINDING SITE is a target binding site found in the 3' untranslated region of multiple transcripts of mRNA encoded by WDR17, corresponding to a target binding site such as BINDING SITE I, BINDING SITE II or BINDING SITE III of FIG. 8. Table 4 illustrates the complementarity of the nucleotide sequences of WDR17 BINDING SITE, designated SEQ ID:15836, to the nucleotide sequence of GAM8145 RNA, herein designated GAM RNA, also designated SEQ ID:328.

Another function of GAM8145 is therefore inhibition of Reserved (WDR17, Accession NP_851782.1). Accordingly, utilities of GAM8145 include diagnosis, prevention and treatment of diseases and clinical conditions associated with WDR17.

Zinc finger protein 187 (ZNF187, Accession NP_689949.1) is another GAM8145 target gene, herein designated TARGET GENE. ZNF187 BINDING SITE is a target binding site found in the 3' untranslated region of mRNA encoded by ZNF187, corresponding to a target binding site such as BINDING SITE I, BINDING SITE II or BINDING SITE III of FIG. 8. Table 4 illustrates the complementarity of the nucleotide sequences of ZNF187 BINDING SITE, designated SEQ ID:1570, to the nucleotide sequence of GAM8145 RNA, herein designated GAM RNA, also designated SEQ ID:328.

Another function of GAM8145 is therefore inhibition of Zinc finger protein 187 (ZNF187, Accession NP_689949.1). Accordingly, utilities of GAM8145 include diagnosis, prevention and treatment of diseases and clinical conditions associated with ZNF187.

FIG. 8 further provides a conceptual description of a novel bioinformatically detected of the present invention, referred to here as Genomic Address Messenger 8297 (GAM8297), which modulates expression of respective target genes thereof, the function and utility of which target genes is known in the art.

GAM8297 is a novel bioinformatically detected regulatory, non protein coding, micro RNA (miRNA) gene. The method by which GAM8297 was detected is described hereinabove with reference to FIGS. 8-15.

GAM8297 gene, herein designated GAM GENE, and GAM8297 target gene, herein designated TARGET GENE, are human genes contained in the human genome.

GAM8297 gene encodes a GAM8297 precursor RNA, herein designated GAM PRECURSOR RNA. Similar to other miRNA genes, and unlike most ordinary genes, GAM8297 precursor RNA does not encode a protein. A nucleotide sequence identical or highly similar to the nucleotide sequence of GAM8297 precursor RNA is designated SEQ ID:154, and is provided hereinbelow with reference to the sequence listing part.

GAM8297 precursor RNA folds onto itself, forming GAM8297 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM8297 precursor RNA folds onto itself, forming GAM8297 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM8297 precursor RNA, designated SEQ-ID:154, and a schematic representation of a predicted secondary folding of GAM8297 folded precursor RNA are further described with reference to Table 2, hereby incorporated by reference.

An enzyme complex designated DICER COMPLEX, 'dices' the GAM8297 folded precursor RNA into GAM8297 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM8297 RNA is designated SEQ ID:367, and is provided hereinbelow with references to the sequence listing part and Table 3, hereby incorporated by reference.

GAM8297 target gene, herein designated TARGET GENE, encodes a corresponding messenger RNA, GAM8297 target RNA, herein designated GAM TARGET RNA. GAM8297 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM8297 RNA, herein designated GAM RNA, binds complementarily to one or more target binding sites located in untranslated regions of GAM8297 target RNA, herein designated GAM TARGET RNA. This complementary binding is due to the fact that the nucleotide sequence of GAM8297 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM8297 RNA may have a different number of target binding sites in untranslated regions of a GAM8297 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM8297 RNA, herein designated GAM RNA, to target binding sites on GAM8297 target RNA, herein designated GAM TARGET RNA, such as BINDING SITE I, BINDING SITE II and BINDING SITE III, inhibits translation of GAM8297 target RNA into GAM8297 target protein, herein designated GAM TARGET PROTEIN. GAM target protein is therefore outlined by a broken line.

It is appreciated that GAM8297 target gene, herein designated TARGET GENE, in fact represents a plurality of GAM8297 target genes. The mRNA of each one of this plurality of GAM8297 target genes comprises one or more target binding sites, each having a nucleotide sequence which is at least partly complementary to GAM8297 RNA, herein designated GAM RNA, and which when bound by GAM8297 RNA causes inhibition of translation of respective one or more GAM8297 target proteins.

It is further appreciated by one skilled in the art that the mode of translational inhibition illustrated by FIG. 8 with specific reference to translational inhibition exerted by GAM8297 gene, herein designated GAM GENE, on one or more GAM8297 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM8297 correlate with, and may be deduced from, the identity of the target genes which GAM8297 binds and inhibits, and the function of these target genes, as elaborated hereinbelow.

Atp-binding cassette, sub-family f (gcn20), member 2 (ABCF2, Accession NP_005683.2) is a GAM8297 target gene, herein designated TARGET GENE. ABCF2 BINDING SITE is a target binding site found in the 5' untranslated region of multiple transcripts of mRNA encoded by ABCF2, corresponding to a target binding site such as BINDING SITE I, BINDING SITE II or BINDING SITE III of FIG. 8. Table 4 illustrates the complementarity of the nucleotide sequences of ABCF2 BINDING SITE, designated SEQ ID:2015, to the nucleotide sequence of GAM8297 RNA, herein designated GAM RNA, also designated SEQ ID:367.

A function of GAM8297 is therefore inhibition of Atp-binding cassette, sub-family f (gcn20), member 2 (ABCF2, Accession NP_005683.2). Accordingly, utilities of GAM8297 include diagnosis, prevention and treatment of diseases and clinical conditions associated with ABCF2.

Atp-binding cassette, sub-family f (gcn20), member 2 (ABCF2, Accession NP_009120.1) is another GAM8297 target gene, herein designated TARGET GENE. ABCF2 BINDING SITE is a target binding site found in the 5' untranslated region of multiple transcripts of mRNA encoded by ABCF2, corresponding to a target binding site such as BINDING SITE I, BINDING SITE II or BINDING SITE III of FIG. 8. Table 4 illustrates the complementarity of the nucleotide sequences of ABCF2 BINDING SITE, designated SEQ ID:2015, to the nucleotide sequence of GAM8297 RNA, herein designated GAM RNA, also designated SEQ ID:367.

Another function of GAM8297 is therefore inhibition of Atp-binding cassette, sub-family f (gcn20), member 2 (ABCF2, Accession NP_009120.1). Accordingly, utilities of GAM8297 include diagnosis, prevention and treatment of diseases and clinical conditions associated with ABCF2.

A disintegrin and metalloproteinase domain 2 (fertilin beta) (ADAM2, Accession NP_001455.2) is another GAM8297 target gene, herein designated TARGET GENE. ADAM2 BINDING SITE is a target binding site found in the 5' untranslated region of mRNA encoded by ADAM2, corresponding to a target binding site such as BINDING SITE I, BINDING SITE II or BINDING SITE III of FIG. 8. Table 4 illustrates the complementarity of the nucleotide sequences of ADAM2 BINDING SITE, designated SEQ ID:6042, to the nucleotide sequence of GAM8297 RNA, herein designated GAM RNA, also designated SEQ ID:367.

Another function of GAM8297 is therefore inhibition of A disintegrin and metalloproteinase domain 2 (fertilin beta) (ADAM2, Accession NP_001455.2), a gene which sperm surface membrane protein that may be involved in sperm-egg plasma membrane adhesion and fusion during fertilization. Accordingly, utilities of GAM8297 include diagnosis, prevention and treatment of diseases and clinical conditions associated with ADAM2.

The function of ADAM2 and its association with various diseases and clinical conditions, has been established by previous studies, as described hereinabove with reference to GAM3026.1. Adenylate cyclase 1 (brain) (ADCY1, Accession NP_066939.1) is another GAM8297 target gene, herein designated TARGET GENE. ADCY1 BINDING SITE is a target binding site found in the 3' untranslated region of multiple transcripts of mRNA encoded by ADCY1, corresponding to a target binding site such as BINDING SITE I, BINDING SITE II or BINDING SITE III of FIG. 8. Table 4 illustrates the complementarity of the nucleotide sequences of ADCY1 BINDING SITE, designated SEQ ID:13856, to the nucleotide sequence of GAM8297 RNA, herein designated GAM RNA, also designated SEQ ID:367.

Another function of GAM8297 is therefore inhibition of Adenylate cyclase 1 (brain) (ADCY1, Accession NP_066939.1), a gene which a calmodulin-sensitive adenylyl cyclase. it may play a role in memory acquisition and learning. Accordingly, utilities of GAM8297 include diagnosis, prevention and treatment of diseases and clinical conditions associated with ADCY1.

The function of ADCY1 and its association with various diseases and clinical conditions, has been established by previous studies, as described hereinabove with reference to GAM144.1. Adenosine a3 receptor (ADORA3, Accession NP_000668.1) is another GAM8297 target gene, herein designated TARGET GENE. ADORA3 BINDING SITE is a target binding site found in the 5' untranslated region of mRNA encoded by ADORA3, corresponding to a target binding site such as BINDING SITE I, BINDING SITE II or BINDING SITE III of FIG. 8. Table 4 illustrates the complementarity of the nucleotide sequences of ADORA3 BINDING SITE, designated SEQ ID:2855, to the nucleotide sequence of GAM8297 RNA, herein designated GAM RNA, also designated SEQ ID:367.

Another function of GAM8297 is therefore inhibition of Adenosine a3 receptor (ADORA3, Accession NP_000668.1), a gene which the activity of this receptor is mediated by g proteins which inhibits adenylyl cyclase. Accordingly, utilities of GAM8297 include diagnosis, prevention and treatment of diseases and clinical conditions associated with ADORA3.

The function of ADORA3 and its association with various diseases and clinical conditions, has been established by previous studies, as described hereinabove with reference to GAM291.1. ALK7 (Accession NP_660302.1) is another GAM8297 target gene, herein designated TARGET GENE. ALK7 BINDING SITE is a target binding site found in the 3' untranslated region of mRNA encoded by ALK7, corresponding to a target binding site such as BINDING SITE I, BINDING SITE II or BINDING SITE III of FIG. 8. Table 4 illustrates the complementarity of the nucleotide sequences of ALK7 BINDING SITE, designated SEQ ID:7726, to the nucleotide sequence of GAM8297 RNA, herein designated GAM RNA, also designated SEQ ID:367.

Another function of GAM8297 is therefore inhibition of ALK7 (Accession NP_660302.1). Accordingly, utilities of GAM8297 include diagnosis, prevention and treatment of diseases and clinical conditions associated with ALK7.

Ras homolog gene family, member f (in filopodia) (ARHF, Accession NP_061907.1) is another GAM8297 target gene, herein designated TARGET GENE. ARHF BINDING SITE is a target binding site found in the 3' untranslated region of mRNA encoded by ARHF, corresponding to a target binding site such as BINDING SITE I, BINDING SITE II or BINDING SITE III of FIG. 8. Table 4 illustrates the complementarity of the nucleotide sequences of ARHF BINDING SITE, designated SEQ ID:11640, to the nucleotide sequence of GAM8297 RNA, herein designated GAM RNA, also designated SEQ ID:367.

Another function of GAM8297 is therefore inhibition of Ras homolog gene family, member f (in filopodia) (ARHF, Accession NP_061907.1). Accordingly, utilities of GAM8297 include diagnosis, prevention and treatment of diseases and clinical conditions associated with ARHF.

Rho guanine nucleotide exchange factor (gef) 10 (ARHGEF10, Accession NP_055444.1) is another GAM8297 target gene, herein designated TARGET GENE. ARHGEF10 BINDING SITE is a target binding site found in the 5' untranslated region of mRNA encoded by ARHGEF10, corresponding to a target binding site such as BINDING SITE I, BINDING SITE II or BINDING SITE III of FIG. 8. Table 4 illustrates the complementarity of the nucleotide sequences of ARHGEF10 BINDING SITE, designated SEQ ID:19384, to the nucleotide sequence of GAM8297 RNA, herein designated GAM RNA, also designated SEQ ID:367.

Another function of GAM8297 is therefore inhibition of Rho guanine nucleotide exchange factor (gef) 10 (ARHGEF10, Accession NP_055444.1). Accordingly, utilities of GAM8297 include diagnosis, prevention and treatment of diseases and clinical conditions associated with ARHGEF10.

Ankyrin repeat and socs box-containing 17 (ASB17, Accession NP_543144.1) is another GAM8297 target gene, herein designated TARGET GENE. ASB17 BINDING SITE is a target binding site found in the 3' untranslated region of mRNA encoded by ASB17, corresponding to a target binding site such as BINDING SITE I, BINDING SITE II or BINDING SITE III of FIG. 8. Table 4 illustrates the complementarity of the nucleotide sequences of ASB17 BINDING SITE, designated SEQ ID:491, to the nucleotide sequence of GAM8297 RNA, herein designated GAM RNA, also designated SEQ ID:367.

Another function of GAM8297 is therefore inhibition of Ankyrin repeat and socs box-containing 17 (ASB17, Accession NP_543144.1) . Accordingly, utilities of GAM8297 include diagnosis, prevention and treatment of diseases and clinical conditions associated with ASB17.

Beta-1,3-glucuronyltransferase 1 (glucuronosyltransferase p) (B3GAT1, Accession NP_473366.1) is another GAM8297 target gene, herein designated TARGET GENE. B3GAT1 BINDING SITE is a target binding site found in the 3' untranslated region of multiple transcripts of mRNA encoded by B3GAT1, corresponding to a target binding site such as BINDING SITE I, BINDING SITE II or BINDING SITE III of FIG. 8. Table 4 illustrates the complementarity of the nucleotide sequences of B3GAT1 BINDING SITE, designated SEQ ID:1556, to the nucleotide sequence of GAM8297 RNA, herein designated GAM RNA, also designated SEQ ID:367.

Another function of GAM8297 is therefore inhibition of Beta-1,3-glucuronyltransferase 1 (glucuronosyltransferase p) (B3GAT1, Accession NP_473366.1). Accordingly, utilities of GAM8297 include diagnosis, prevention and treatment of diseases and clinical conditions associated with B3GAT1.

Beta-1,3-glucuronyltransferase 1 (glucuronosyltransferase p) (B3GAT1, Accession NP_061114.1) is another GAM8297 target gene, herein designated TARGET GENE. B3GAT1 BINDING SITE is a target binding site found in the 3' untranslated region of multiple transcripts of mRNA encoded by B3GAT1, corresponding to a target binding site such as BINDING SITE I, BINDING SITE II or BINDING SITE III of FIG. 8. Table 4 illustrates the complementarity of the nucleotide sequences of B3GAT1 BINDING SITE, designated SEQ ID:1556, to the nucleotide sequence of GAM8297 RNA, herein designated GAM RNA, also designated SEQ ID:367.

Another function of GAM8297 is therefore inhibition of Beta-1,3-glucuronyltransferase 1 (glucuronosyltransferase p) (B3GAT1, Accession NP_061114.1). Accordingly, utilities of GAM8297 include diagnosis, prevention and treatment of diseases and clinical conditions associated with B3GAT1.

Biglycan (BGN, Accession NP_001702.1) is another GAM8297 target gene, herein designated TARGET GENE. BGN BINDING SITE is a target binding site found in the 3' untranslated region of mRNA encoded by BGN, corresponding to a target binding site such as BINDING SITE I, BINDING SITE II or BINDING SITE III of FIG. 8. Table 4 illustrates the complementarity of the nucleotide sequences of BGN BINDING SITE, designated SEQ ID:14465, to the nucleotide sequence of GAM8297 RNA, herein designated GAM RNA, also designated SEQ ID:367.

Another function of GAM8297 is therefore inhibition of Biglycan (BGN, Accession NP_001702.1), a gene which is involved in collagen fiber assembly. Accordingly, utilities of GAM8297 include diagnosis, prevention and treatment of diseases and clinical conditions associated with BGN.

The function of BGN and its association with various diseases and clinical conditions, has been established by previous studies, as described hereinabove with reference to GAM282.2Burkitt lymphoma receptor 1, gtp binding protein (chemokine (c-x-c motif) receptor 5) (BLR1, Accession NP_001707.1) is another GAM8297 target gene, herein designated TARGET GENE. BLR1 BINDING SITE is a target binding site found in the 3' untranslated region of multiple transcripts of mRNA encoded by BLR1, corresponding to a target binding site such as BINDING SITE I, BINDING SITE II or BINDING SITE III of FIG. 8. Table 4 illustrates the complementarity of the nucleotide sequences of BLR1 BINDING SITE, designated SEQ ID:18216, to the nucleotide sequence of GAM8297 RNA, herein designated GAM RNA, also designated SEQ ID:367.

Another function of GAM8297 is therefore inhibition of Burkitt lymphoma receptor 1, gtp binding protein (chemokine (c-x-c motif) receptor 5) (BLR1, Accession NP_001707.1). Accordingly, utilities of GAM8297 include diagnosis, prevention and treatment of diseases and clinical conditions associated with BLR1.

Burkitt lymphoma receptor 1, gtp binding protein (chemokine (c-x-c motif) receptor 5) (BLR1, Accession NP_116743.1) is another GAM8297 target gene, herein designated TARGET GENE. BLR1 BINDING SITE is a target binding site found in the 3' untranslated region of multiple transcripts of mRNA encoded by BLR1, corresponding to a target binding site such as BINDING SITE I, BINDING SITE II or BINDING SITE III of FIG. 8. Table 4 illustrates the complementarity of the nucleotide sequences of BLR1 BINDING SITE, designated SEQ ID:18216, to the nucleotide sequence of GAM8297 RNA, herein designated GAM RNA, also designated SEQ ID:367.

Another function of GAM8297 is therefore inhibition of Burkitt lymphoma receptor 1, gtp binding protein (chemokine (c-x-c motif) receptor 5) (BLR1, Accession NP_116743.1). Accordingly, utilities of GAM8297 include diagnosis, prevention and treatment of diseases and clinical conditions associated with BLR1.

Chromosome 1 open reading frame 2 (C1orf2, Accession NP_006580.1) is another GAM8297 target gene, herein designated TARGET GENE. C1orf2 BINDING SITE is a target binding site found in the 5' untranslated region of mRNA encoded by C1orf2, corresponding to a target binding site such as BINDING SITE I, BINDING SITE II or BINDING SITE III of FIG. 8. Table 4 illustrates the complementarity of the nucleotide sequences of C1orf2 BINDING SITE, designated SEQ ID:11170, to the nucleotide sequence of GAM8297 RNA, herein designated GAM RNA, also designated SEQ ID:367.

Another function of GAM8297 is therefore inhibition of Chromosome 1 open reading frame 2 (C1orf2, Accession NP_006580.1). Accordingly, utilities of GAM8297 include diagnosis, prevention and treatment of diseases and clinical conditions associated with C1orf2.

Chromosome 21 open reading frame 108 (C21orf108, Accession XP_114191.2) is another GAM8297 target gene, herein designated TARGET GENE. C21orf108 BINDING SITE is a target binding site found in the 3' untranslated region of mRNA encoded by C21orf108, corresponding to a target binding site such as BINDING SITE I, BINDING SITE II or BINDING SITE III of FIG. 8. Table 4 illustrates the complementarity of the nucleotide sequences of C21orf108 BINDING SITE, designated SEQ ID:3476, to the nucleotide sequence of GAM8297 RNA, herein designated GAM RNA, also designated SEQ ID:367.

Another function of GAM8297 is therefore inhibition of Chromosome 21 open reading frame 108 (C21orf108, Accession XP_114191.2). Accordingly, utilities of GAM8297 include diagnosis, prevention and treatment of diseases and clinical conditions associated with C21orf108.

Chromosome 6 open reading frame 33 (C6orf33, Accession NP_588608.1) is another GAM8297 target gene, herein designated TARGET GENE. C6orf33 BINDING SITE is a target binding site found in the 3' untranslated region of mRNA encoded by C6orf33, corresponding to a target binding site such as BINDING SITE I, BINDING SITE II or BINDING SITE III of FIG. 8. Table 4 illustrates the complementarity of the nucleotide sequences of C6orf33 BINDING SITE, designated SEQ ID:10725, to the nucleotide sequence of GAM8297 RNA, herein designated GAM RNA, also designated SEQ ID:367.

Another function of GAM8297 is therefore inhibition of Chromosome 6 open reading frame 33 (C6orf33, Accession NP_588608.1). Accordingly, utilities of GAM8297 include diagnosis, prevention and treatment of diseases and clinical conditions associated with C6orf33.

C6orf50 (Accession XP_166460.1) is another GAM8297 target gene, herein designated TARGET GENE. C6orf50 BINDING SITE is a target binding site found in the 3' untranslated region of mRNA encoded by C6orf50, corresponding to a target binding site such as BINDING SITE I, BINDING SITE II or BINDING SITE III of FIG. 8. Table 4 illustrates the complementarity of the nucleotide sequences of C6orf50 BINDING SITE, designated SEQ ID:16763, to the nucleotide sequence of GAM8297 RNA, herein designated GAM RNA, also designated SEQ ID:367.

Another function of GAM8297 is therefore inhibition of C6orf50 (Accession XP_166460.1). Accordingly, utilities of GAM8297 include diagnosis, prevention and treatment of diseases and clinical conditions associated with C6orf50.

Chromosome 9 open reading frame 14 (C9orf14, Accession XP_098859.2) is another GAM8297 target gene, herein designated TARGET GENE. C9orf14 BINDING SITE is a target binding site found in the 5' untranslated region of mRNA encoded by C9orf14, corresponding to a target binding site such as BINDING SITE I, BINDING SITE II or BINDING SITE III of FIG. 8. Table 4 illustrates the complementarity of the nucleotide sequences of C9orf14 BINDING SITE, designated SEQ ID:17546, to the nucleotide sequence of GAM8297 RNA, herein designated GAM RNA, also designated SEQ ID:367.

Another function of GAM8297 is therefore inhibition of Chromosome 9 open reading frame 14 (C9orf14, Accession XP_098859.2). Accordingly, utilities of GAM8297 include diagnosis, prevention and treatment of diseases and clinical conditions associated with C9orf14.

Calcium channel, voltage-dependent, l type, alpha 1d subunit (CACNA1D, Accession NP_000711.1) is another GAM8297 target gene, herein designated TARGET GENE. CACNA1D BINDING SITE is a target binding site found in the 5' untranslated region of mRNA encoded by CACNA1D, corresponding to a target binding site such as BINDING SITE I, BINDING SITE II or BINDING SITE III of FIG. 8. Table 4 illustrates the complementarity of the nucleotide sequences of CACNA1D BINDING SITE, designated SEQ ID:7620, to the nucleotide sequence of GAM8297 RNA, herein designated GAM RNA, also designated SEQ ID:367.

Another function of GAM8297 is therefore inhibition of Calcium channel, voltage-dependent, l type, alpha 1d subunit (CACNA1D, Accession NP_000711.1), a gene which mediates the entry of calcium ions into excitable cells and therefore may be associated with Self-biting and other self-injurious behaviors. Accordingly, utilities of GAM8297 include diagnosis, prevention and treatment of Self-biting and other self-injurious behaviors, and of other diseases and clinical conditions associated with CACNA1D.

The function of CACNA1D and its association with various diseases and clinical conditions, has been established by previous studies, as described hereinabove with reference to GAM1095.1. Calcium channel, voltage-dependent, alpha 1h subunit (CACNA1H, Accession NP_066921.1) is another GAM8297 target gene, herein designated TARGET GENE. CACNA1H BINDING SITE is a target binding site found in the 3' untranslated region of mRNA encoded by CACNA1H, corresponding to a target binding site such as BINDING SITE I, BINDING SITE II or BINDING SITE III of FIG. 8. Table 4 illustrates the complementarity of the nucleotide sequences of CACNA1H BINDING SITE, designated SEQ ID:14959, to the nucleotide sequence of GAM8297 RNA, herein designated GAM RNA, also designated SEQ ID:367.

Another function of GAM8297 is therefore inhibition of Calcium channel, voltage-dependent, alpha 1h subunit (CACNA1H, Accession NP_066921.1). Accordingly, utilities of GAM8297 include diagnosis, prevention and treatment of diseases and clinical conditions associated with CACNA1H.

Calcium channel, voltage-dependent, beta 1 subunit (CACNB1, Accession NP_000714.2) is another GAM8297 target gene, herein designated TARGET GENE. CACNB1 BINDING SITE is a target binding site found in the 3' untranslated region of mRNA encoded by CACNB1, corresponding to a target binding site such as BINDING SITE I, BINDING SITE II or BINDING SITE III of FIG. 8. Table 4 illustrates the complementarity of the nucleotide sequences of CACNB1 BINDING SITE, designated SEQ ID:17887, to the nucleotide sequence of GAM8297 RNA, herein designated GAM RNA, also designated SEQ ID:367.

Another function of GAM8297 is therefore inhibition of Calcium channel, voltage-dependent, beta 1 subunit (CACNB1, Accession NP_000714.2), a gene which may not only play an important role in the transport/insertion of the alpha-1S subunit into the membrane. Accordingly, utilities of GAM8297 include diagnosis, prevention and treatment of diseases and clinical conditions associated with CACNB1.

The function of CACNB1 and its association with various diseases and clinical conditions, has been established by previous studies, as described hereinabove with reference to GAM347.2. Chemokine (c-c motif) ligand 14 (CCL14, Accession NP_116738.1) is another GAM8297 target gene, herein designated TARGET GENE. CCL14 BINDING SITE is a target binding site found in the 5' untranslated region of multiple transcripts of mRNA encoded by CCL14, corresponding to a target binding site such as BINDING SITE I, BINDING SITE II or BINDING SITE III of FIG. 8. Table 4 illustrates the complementarity of the nucleotide sequences of CCL14 BINDING SITE, designated SEQ ID:12494, to the nucleotide sequence of GAM8297 RNA, herein designated GAM RNA, also designated SEQ ID:367.

Another function of GAM8297 is therefore inhibition of Chemokine (c-c motif) ligand 14 (CCL14, Accession NP_116738.1). Accordingly, utilities of GAM8297 include diagnosis, prevention and treatment of diseases and clinical conditions associated with CCL14.

Chemokine (c-c motif) ligand 14 (CCL14, Accession NP_004157.1) is another GAM8297 target gene, herein designated TARGET GENE. CCL14 BINDING SITE is a target binding site found in the 5' untranslated region of multiple transcripts of mRNA encoded by CCL14, corresponding to a target binding site such as BINDING SITE I, BINDING SITE II or BINDING SITE III of FIG. 8. Table 4 illustrates the complementarity of the nucleotide sequences of CCL14 BINDING SITE, designated SEQ ID:12494, to the nucleotide sequence of GAM8297 RNA, herein designated GAM RNA, also designated SEQ ID:367.

Another function of GAM8297 is therefore inhibition of Chemokine (c-c motif) ligand 14 (CCL14, Accession NP_004157.1). Accordingly, utilities of GAM8297 include diagnosis, prevention and treatment of diseases and clinical conditions associated with CCL14.

Chemokine (c-c motif) ligand 14 (CCL14, Accession NP_116739.1) is another GAM8297 target gene, herein designated TARGET GENE. CCL14 BINDING SITE is a target binding site found in the 5' untranslated region of multiple transcripts of mRNA encoded by CCL14, corresponding to a target binding site such as BINDING SITE I, BINDING SITE II or BINDING SITE III of FIG. 8. Table 4 illustrates the complementarity of the nucleotide sequences of CCL14 BINDING SITE, designated SEQ ID:12494, to the nucleotide sequence of GAM8297 RNA, herein designated GAM RNA, also designated SEQ ID:367.

Another function of GAM8297 is therefore inhibition of Chemokine (c-c motif) ligand 14 (CCL14, Accession NP_116739.1). Accordingly, utilities of GAM8297 include diagnosis, prevention and treatment of diseases and clinical conditions associated with CCL14.

Chemokine (c-c motif) ligand 15 (CCL15, Accession NP_116740.1) is another GAM8297 target gene, herein designated TARGET GENE. CCL15 BINDING SITE is a target binding site found in the 3' untranslated region of multiple transcripts of mRNA encoded by CCL15, corresponding to a target binding site such as BINDING SITE I, BINDING SITE II or BINDING SITE III of FIG. 8. Table 4 illustrates the complementarity of the nucleotide sequences of CCL15 BINDING SITE, designated SEQ ID:12494, to the nucleotide sequence of GAM8297 RNA, herein designated GAM RNA, also designated SEQ ID:367.

Another function of GAM8297 is therefore inhibition of Chemokine (c-c motif) ligand 15 (CCL15, Accession NP_116740.1). Accordingly, utilities of GAM8297 include diagnosis, prevention and treatment of diseases and clinical conditions associated with CCL15.

Chemokine (c-c motif) ligand 15 (CCL15, Accession NP_004158.1) is another GAM8297 target gene, herein designated TARGET GENE. CCL15 BINDING SITE is a target binding site found in the 3' untranslated region of multiple transcripts of mRNA encoded by CCL15, corresponding to a target binding site such as BINDING SITE I, BINDING SITE II or BINDING SITE III of FIG. 8. Table 4 illustrates the complementarity of the nucleotide sequences of CCL15 BINDING SITE, designated SEQ ID:12494, to the nucleotide sequence of GAM8297 RNA, herein designated GAM RNA, also designated SEQ ID:367.

Another function of GAM8297 is therefore inhibition of Chemokine (c-c motif) ligand 15 (CCL15, Accession NP_004158.1). Accordingly, utilities of GAM8297 include diagnosis, prevention and treatment of diseases and clinical conditions associated with CCL15.

Cdk5 regulatory subunit associated protein 3 (CDK5RAP3, Accession NP_079473.2) is another GAM8297 target gene, herein designated TARGET GENE. CDK5RAP3 BINDING SITE is a target binding site found in the 3' untranslated region of multiple transcripts of mRNA encoded by CDK5RAP3, corresponding to a target binding site such as BINDING SITE I, BINDING SITE II or BINDING SITE III of FIG. 8. Table 4 illustrates the complementarity of the nucleotide sequences of CDK5RAP3 BINDING SITE, designated SEQ ID:3296, to the nucleotide sequence of GAM8297 RNA, herein designated GAM RNA, also designated SEQ ID:367.

Another function of GAM8297 is therefore inhibition of Cdk5 regulatory subunit associated protein 3 (CDK5RAP3, Accession NP_079473.2). Accordingly, utilities of GAM8297 include diagnosis, prevention and treatment of diseases and clinical conditions associated with CDK5RAP3.

Cdk5 regulatory subunit associated protein 3 (CDK5RAP3, Accession NP_788275.1) is another GAM8297 target gene, herein designated TARGET GENE. CDK5RAP3 BINDING SITE is a target binding site found in the 3' untranslated region of multiple transcripts of mRNA encoded by CDK5RAP3, corresponding to a target binding site such as BINDING SITE I, BINDING SITE II or BINDING SITE III of FIG. 8. Table 4 illustrates the complementarity of the nucleotide sequences of CDK5RAP3 BINDING SITE, designated SEQ ID:3296, to the nucleotide sequence of GAM8297 RNA, herein designated GAM RNA, also designated SEQ ID:367.

Another function of GAM8297 is therefore inhibition of Cdk5 regulatory subunit associated protein 3 (CDK5RAP3, Accession NP_788275.1). Accordingly, utilities of GAM8297 include diagnosis, prevention and treatment of diseases and clinical conditions associated with CDK5RAP3.

Glycoprotein hormones, alpha polypeptide (CGA, Accession NP_000726.1) is another GAM8297 target gene, herein designated TARGET GENE. CGA BINDING SITE is a target binding site found in the 3' untranslated region of mRNA encoded by CGA, corresponding to a target binding site such as BINDING SITE I, BINDING SITE II or BINDING SITE III of FIG. 8. Table 4 illustrates the complementarity of the nucleotide sequences of CGA BINDING SITE, designated SEQ ID:6094, to the nucleotide sequence of GAM8297 RNA, herein designated GAM RNA, also designated SEQ ID:367.

Another function of GAM8297 is therefore inhibition of Glycoprotein hormones, alpha polypeptide (CGA, Accession NP_000726.1), a gene which is a precursor for the alpha subunit of chorionic gonadotropin hormone. and therefore may be associated with Secondary infertility. Accordingly, utilities of GAM8297 include diagnosis, prevention and treatment of Secondary infertility, and of other diseases and clinical conditions associated with CGA.

The function of CGA and its association with various diseases and clinical conditions, has been established by previous studies, as described hereinabove with reference to GAM47.1. CGI-69 (Accession NP_057100.1) is another GAM8297 target gene, herein designated TARGET GENE. CGI-69 BINDING SITE is a target binding site found in the 3' untranslated region of mRNA encoded by CGI-69, corresponding to a target binding site such as BINDING SITE I, BINDING SITE II or BINDING SITE III of FIG. 8. Table 4 illustrates the complementarity of the nucleotide sequences of CGI-69 BINDING SITE, designated SEQ ID:15577, to the nucleotide sequence of GAM8297 RNA, herein designated GAM RNA, also designated SEQ ID:367.

Another function of GAM8297 is therefore inhibition of CGI-69 (Accession NP_057100.1). Accordingly, utilities of GAM8297 include diagnosis, prevention and treatment of diseases and clinical conditions associated with CGI-69.

Cyclin m2 (CNNM2, Accession NP_060119.2) is another GAM8297 target gene, herein designated TARGET GENE. CNNM2 BINDING SITE is a target binding site found in the 3' untranslated region of mRNA encoded by CNNM2, corresponding to a target binding site such as BINDING SITE I, BINDING SITE II or BINDING SITE III of FIG. 8. Table 4 illustrates the complementarity of the nucleotide sequences of CNNM2 BINDING SITE, designated SEQ ID:9355, to the nucleotide sequence of GAM8297 RNA, herein designated GAM RNA, also designated SEQ ID:367.

Another function of GAM8297 is therefore inhibition of Cyclin m2 (CNNM2, Accession NP_060119.2). Accordingly, utilities of GAM8297 include diagnosis, prevention and treatment of diseases and clinical conditions associated with CNNM2.

Cannabinoid receptor 1 (brain) (CNR1, Accession NP_057167.1) is another GAM8297 target gene, herein designated TARGET GENE. CNR1 BINDING SITE is a target binding site found in the 3' untranslated region of multiple transcripts of mRNA encoded by CNR1, corresponding to a target binding site such as BINDING SITE I, BINDING SITE II or BINDING SITE III of FIG. 8. Table 4 illustrates the complementarity of the nucleotide sequences of CNR1 BINDING SITE, designated SEQ ID:8385, to the nucleotide sequence of GAM8297 RNA, herein designated GAM RNA, also designated SEQ ID:367.

Another function of GAM8297 is therefore inhibition of Cannabinoid receptor 1 (brain) (CNR1, Accession NP_057167.1), a gene which is involved in the cannabinoid-induced CNS effects. Accordingly, utilities of GAM8297 include diagnosis, prevention and treatment of diseases and clinical conditions associated with CNR1.

The function of CNR1 and its association with various diseases and clinical conditions, has been established by previous studies, as described hereinabove with reference to GAM282.2. Collagen, type i, alpha 1 (COL1A1, Accession NP_000079.1) is another GAM8297 target gene, herein designated TARGET GENE. COL1A1 BINDING SITE is a target binding site found in the 3' untranslated region of mRNA encoded by COL1A1, corresponding to a target binding site such as BINDING SITE I, BINDING SITE II or BINDING SITE III of FIG. 8. Table 4 illustrates the complementarity of the nucleotide sequences of COL1A1 BINDING SITE, designated SEQ ID:10598, to the nucleotide sequence of GAM8297 RNA, herein designated GAM RNA, also designated SEQ ID:367.

Another function of GAM8297 is therefore inhibition of Collagen, type i, alpha 1 (COL1A1, Accession NP_000079.1). Accordingly, utilities of GAM8297 include diagnosis, prevention and treatment of diseases and clinical conditions associated with COL1A1.

CPR2 (Accession NP_112162.1) is another GAM8297 target gene, herein designated TARGET GENE. CPR2 BINDING SITE is a target binding site found in the 3' untranslated region of multiple transcripts of mRNA encoded by CPR2, corresponding to a target binding site such as BINDING SITE I, BINDING SITE II or BINDING SITE III of FIG. 8. Table 4 illustrates the complementarity of the nucleotide sequences of CPR2 BINDING SITE, designated SEQ ID:19074, to the nucleotide sequence of GAM8297 RNA, herein designated GAM RNA, also designated SEQ ID:367.

Another function of GAM8297 is therefore inhibition of CPR2 (Accession NP_112162.1). Accordingly, utilities of GAM8297 include diagnosis, prevention and treatment of diseases and clinical conditions associated with CPR2.

Corticotropin releasing hormone receptor 1 (CRHR1, Accession NP_004373.2) is another GAM8297 target gene, herein designated TARGET GENE. CRHR1 BINDING SITE is a target binding site found in the 3' untranslated region of mRNA encoded by CRHR1, corresponding to a target binding site such as BINDING SITE I, BINDING SITE II or BINDING SITE III of FIG. 8. Table 4 illustrates the complementarity of the nucleotide sequences of CRHR1 BINDING SITE, designated SEQ ID:6267, to the nucleotide sequence of GAM8297 RNA, herein designated GAM RNA, also designated SEQ ID:367.

Another function of GAM8297 is therefore inhibition of Corticotropin releasing hormone receptor 1 (CRHR1, Accession NP_004373.2), a gene which likely mediates physiological and behavioral response to stress. and therefore may be associated with Adenomas. Accordingly, utilities of GAM8297 include diagnosis, prevention and treatment of Adenomas, and of other diseases and clinical conditions associated with CRHR1.

The function of CRHR1 and its association with various diseases and clinical conditions, has been established by previous studies, as described hereinabove with reference to GAM852.1. Cartilage linking protein 1 (CRTL1, Accession NP_001875.1) is another GAM8297 target gene, herein designated TARGET GENE. CRTL1 BINDING SITE is a target binding site found in the 3' untranslated region of mRNA encoded by CRTL1, corresponding to a target binding site such as BINDING SITE I, BINDING SITE II or BINDING SITE III of FIG. 8. Table 4 illustrates the complementarity of the nucleotide sequences of CRTL1 BINDING SITE, designated SEQ ID:1537, to the nucleotide sequence of GAM8297 RNA, herein designated GAM RNA, also designated SEQ ID:367.

Another function of GAM8297 is therefore inhibition of Cartilage linking protein 1 (CRTL1, Accession NP_001875.1), a gene which stabilize the aggregates of proteoglycan monomers with hyaluronic acid. and therefore may be associated with Several heritable chondrodysplasias. Accordingly, utilities of GAM8297 include diagnosis, prevention and treatment of Several heritable chondrodysplasias, and of other diseases and clinical conditions associated with CRTL1.

The function of CRTL1 and its association with various diseases and clinical conditions, has been established by previous studies, as described hereinabove with reference to GAM1144.1. Casein kinase 1, gamma 2 (CSNK1G2, Accession NP_001310.2) is another GAM8297 target gene, herein designated TARGET GENE. CSNK1G2 BINDING SITE is a target binding site found in the 3' untranslated region of mRNA encoded by CSNK1G2, corresponding to a target binding site such as BINDING SITE I, BINDING SITE II or BINDING SITE III of FIG. 8. Table 4 illustrates the complementarity of the nucleotide sequences of CSNK1G2 BINDING SITE, designated SEQ ID:10903, to the nucleotide sequence of GAM8297 RNA, herein designated GAM RNA, also designated SEQ ID:367.

Another function of GAM8297 is therefore inhibition of Casein kinase 1, gamma 2 (CSNK1G2, Accession NP_001310.2). Accordingly, utilities of GAM8297 include diagnosis, prevention and treatment of diseases and clinical conditions associated with CSNK1G2.

Cytochrome c-1 (CYC1, Accession NP_001907.2) is another GAM8297 target gene, herein designated TARGET GENE. CYC1 BINDING SITE is a target binding site found in the 3' untranslated region of mRNA encoded by CYC1, corresponding to a target binding site such as BINDING SITE I, BINDING SITE II or BINDING SITE III of FIG. 8. Table 4 illustrates the complementarity of the nucleotide sequences of CYC1 BINDING SITE, designated SEQ ID:2163, to the nucleotide sequence of GAM8297 RNA, herein designated GAM RNA, also designated SEQ ID:367.

Another function of GAM8297 is therefore inhibition of Cytochrome c-1 (CYC1, Accession NP_001907.2). Accordingly, utilities of GAM8297 include diagnosis, prevention and treatment of diseases and clinical conditions associated with CYC1.

Cytoplasmic fmr1 interacting protein 2 (CYFIP2, Accession NP_055191.1) is another GAM8297 target gene, herein designated TARGET GENE. CYFIP2 BINDING SITE is a target binding site found in the 5' untranslated region of mRNA encoded by CYFIP2, corresponding to a target binding site such as BINDING SITE I, BINDING SITE II or BINDING SITE III of FIG. 8. Table 4 illustrates the complementarity of the nucleotide sequences of CYFIP2 BINDING SITE, designated SEQ ID:7131, to the nucleotide sequence of GAM8297 RNA, herein designated GAM RNA, also designated SEQ ID:367.

Another function of GAM8297 is therefore inhibition of Cytoplasmic fmr1 interacting protein 2 (CYFIP2, Accession NP_055191.1). Accordingly, utilities of GAM8297 include diagnosis, prevention and treatment of diseases and clinical conditions associated with CYFIP2.

Dishevelled associated activator of morphogenesis 1 (DAAM1, Accession NP_055807.1) is another GAM8297 target gene, herein designated TARGET GENE. DAAM1 BINDING SITE is a target binding site found in the 3' untranslated region of mRNA encoded by DAAM1, corresponding to a target binding site such as BINDING SITE I, BINDING SITE II or BINDING SITE III of FIG. 8. Table 4 illustrates the complementarity of the nucleotide sequences of DAAM1 BINDING SITE, designated SEQ ID:13477, to the nucleotide sequence of GAM8297 RNA, herein designated GAM RNA, also designated SEQ ID:367.

Another function of GAM8297 is therefore inhibition of Dishevelled associated activator of morphogenesis 1 (DAAM1, Accession NP_055807.1), a gene which controls cell polarity and movement during development. Accordingly, utilities of GAM8297 include diagnosis, prevention and treatment of diseases and clinical conditions associated with DAAM1.

The function of DAAM1 and its association with various diseases and clinical conditions, has been established by previous studies, as described hereinabove with reference to GAM801.1. Defensin, beta 1 (DEFB1, Accession NP_005209.1) is another GAM8297 target gene, herein designated TARGET GENE. DEFB1 BINDING SITE is a target binding site found in the 3' untranslated region of mRNA encoded by DEFB1, corresponding to a target binding site such as BINDING SITE I, BINDING SITE II or BINDING SITE III of FIG. 8. Table 4 illustrates the complementarity of the nucleotide sequences of DEFB1 BINDING SITE, designated SEQ ID:7595, to the nucleotide sequence of GAM8297 RNA, herein designated GAM RNA, also designated SEQ ID:367.

Another function of GAM8297 is therefore inhibition of Defensin, beta 1 (DEFB1, Accession NP_005209.1), a gene which has salt- dependent antimicrobial activity and may act in innate immunity. Accordingly, utilities of GAM8297 include diagnosis, prevention and treatment of diseases and clinical conditions associated with DEFB1.

The function of DEFB1 and its association with various diseases and clinical conditions, has been established by previous studies, as described hereinabove with reference to GAM537.2. DEPC-1 (Accession NP_631917.1) is another GAM8297 target gene, herein designated TARGET GENE. DEPC-1 BINDING SITE is a target binding site found in the 5' untranslated region of mRNA encoded by DEPC-1, corresponding to a target binding site such as BINDING SITE I, BINDING SITE II or BINDING SITE III of FIG. 8. Table 4 illustrates the complementarity of the nucleotide sequences of DEPC-1 BINDING SITE, designated SEQ ID:9065, to the nucleotide sequence of GAM8297 RNA, herein designated GAM RNA, also designated SEQ ID:367.

Another function of GAM8297 is therefore inhibition of DEPC-1 (Accession NP_631917.1). Accordingly, utilities of GAM8297 include diagnosis, prevention and treatment of diseases and clinical conditions associated with DEPC-1.

Deiodinase, iodothyronine, type iii (DIO3, Accession NP_001353.2) is another GAM8297 target gene, herein designated TARGET GENE. DIO3 BINDING SITE is a target binding site found in the 3' untranslated region of mRNA encoded by DIO3, corresponding to a target binding site such as BINDING SITE I, BINDING SITE II or BINDING SITE III of FIG. 8. Table 4 illustrates the complementarity of the nucleotide sequences of DIO3 BINDING SITE, designated SEQ ID:3054, to the nucleotide sequence of GAM8297 RNA, herein designated GAM RNA, also designated SEQ ID:367.

Another function of GAM8297 is therefore inhibition of Deiodinase, iodothyronine, type iii (DIO3, Accession NP_001353.2), a gene which regulates circulating fetal thyroid hormone concentrations. Accordingly, utilities of GAM8297 include diagnosis, prevention and treatment of diseases and clinical conditions associated with DIO3.

The function of DIO3 and its association with various diseases and clinical conditions, has been established by previous studies, as described hereinabove with reference to GAM291.1. DKFZP434A0131 (Accession NP_061864.1) is another GAM8297 target gene, herein designated TARGET GENE. DKFZP434A0131 BINDING SITE is a target binding site found in the 3' untranslated region of mRNA encoded by DKFZP434A0131, corresponding to a target binding site such as BINDING SITE I, BINDING SITE II or BINDING SITE III of FIG. 8. Table 4 illustrates the complementarity of the nucleotide sequences of DKFZP434A0131 BINDING SITE, designated SEQ ID:2459, to the nucleotide sequence of GAM8297 RNA, herein designated GAM RNA, also designated SEQ ID:367.

Another function of GAM8297 is therefore inhibition of DKFZP434A0131 (Accession NP_061864.1). Accordingly, utilities of GAM8297 include diagnosis, prevention and treatment of diseases and clinical conditions associated with DKFZP434A0131.

DKFZp547J144 (Accession XP_091486.2) is another GAM8297 target gene, herein designated TARGET GENE. DKFZp547J144 BINDING SITE is a target binding site found in the 3' untranslated region of mRNA encoded by DKFZp547J144, corresponding to a target binding site such as BINDING SITE I, BINDING SITE II or BINDING SITE III of FIG. 8. Table 4 illustrates the complementarity of the nucleotide sequences of DKFZp547J144 BINDING SITE, designated SEQ ID:9218, to the nucleotide sequence of GAM8297 RNA, herein designated GAM RNA, also designated SEQ ID:367.

Another function of GAM8297 is therefore inhibition of DKFZp547J144 (Accession XP_091486.2). Accordingly, utilities of GAM8297 include diagnosis, prevention and treatment of diseases and clinical conditions associated with DKFZp547J144.

DKFZP564M082 (Accession NP_054761.1) is another GAM8297 target gene, herein designated TARGET GENE. DKFZP564M082 BINDING SITE is a target binding site found in the 3' untranslated region of mRNA encoded by DKFZP564M082, corresponding to a target binding site such as BINDING SITE I, BINDING SITE II or BINDING SITE III of FIG. 8. Table 4 illustrates the complementarity of the nucleotide sequences of DKFZP564M082 BINDING SITE, designated SEQ ID:17456, to the nucleotide sequence of GAM8297 RNA, herein designated GAM RNA, also designated SEQ ID:367.

Another function of GAM8297 is therefore inhibition of DKFZP564M082 (Accession NP_054761.1). Accordingly, utilities of GAM8297 include diagnosis, prevention and treatment of diseases and clinical conditions associated with DKFZP564M082.

DKFZp761N1114 (Accession XP_086327.6) is another GAM8297 target gene, herein designated TARGET GENE. DKFZp761N1114 BINDING SITE is a target binding site found in the 3' untranslated region of mRNA encoded by DKFZp761N1114, corresponding to a target binding site such as BINDING SITE I, BINDING SITE II or BINDING SITE III of FIG. 8. Table 4 illustrates the complementarity of the nucleotide sequences of DKFZp761N1114 BINDING SITE, designated SEQ ID:1345, to the nucleotide sequence of GAM8297 RNA, herein designated GAM RNA, also designated SEQ ID:367.

Another function of GAM8297 is therefore inhibition of DKFZp761N1114 (Accession XP_086327.6). Accordingly, utilities of GAM8297 include diagnosis, prevention and treatment of diseases and clinical conditions associated with DKFZp761N1114.

DKFZp762A217 (Accession NP_689801.1) is another GAM8297 target gene, herein designated TARGET GENE. DKFZp762A217 BINDING SITE is a target binding site found in the 3' untranslated region of mRNA encoded by DKFZp762A217, corresponding to a target binding site such as BINDING SITE I, BINDING SITE II or BINDING SITE III of FIG. 8. Table 4 illustrates the complementarity of the nucleotide sequences of DKFZp762A217 BINDING SITE, designated SEQ ID:20098, to the nucleotide sequence of GAM8297 RNA, herein designated GAM RNA, also designated SEQ ID:367.

Another function of GAM8297 is therefore inhibition of DKFZp762A217 (Accession NP_689801.1). Accordingly, utilities of GAM8297 include diagnosis, prevention and treatment of diseases and clinical conditions associated with DKFZp762A217.

Dedicator of cyto - kinesis 3 (DOCK3, Accession XP_039259.5) is another GAM8297 target gene, herein designated TARGET GENE. DOCK3 BINDING SITE is a target binding site found in the 3' untranslated region of mRNA encoded by DOCK3, corresponding to a target binding site such as BINDING SITE I, BINDING SITE II or BINDING SITE III of FIG. 8. Table 4 illustrates the complementarity of the nucleotide sequences of DOCK3 BINDING SITE, designated SEQ ID:3680, to the nucleotide sequence of GAM8297 RNA, herein designated GAM RNA, also designated SEQ ID:367.

Another function of GAM8297 is therefore inhibition of Dedicator of cyto - kinesis 3 (DOCK3, Accession XP_039259.5). Accordingly, utilities of GAM8297 include diagnosis, prevention and treatment of diseases and clinical conditions associated with DOCK3.

DRIL2 (Accession NP_006456.1) is another GAM8297 target gene, herein designated TARGET GENE. DRIL2 BINDING SITE is a target binding site found in the 3' untranslated region of mRNA encoded by DRIL2, corresponding to a target binding site such as BINDING SITE I, BINDING SITE II or BINDING SITE III of FIG. 8. Table 4 illustrates the complementarity of the nucleotide sequences of DRIL2 BINDING SITE, designated SEQ ID:1268, to the nucleotide sequence of GAM8297 RNA, herein designated GAM RNA, also designated SEQ ID:367.

Another function of GAM8297 is therefore inhibition of DRIL2 (Accession NP_006456.1). Accordingly, utilities of GAM8297 include diagnosis, prevention and treatment of diseases and clinical conditions associated with DRIL2.

Endothelial differentiation, sphingolipid g-protein-coupled receptor, 1 (EDG1, Accession NP_001391.2) is another GAM8297 target gene, herein designated TARGET GENE. EDG1 BINDING SITE is a target binding site found in the 3' untranslated region of mRNA encoded by EDG1, corresponding to a target binding site such as BINDING SITE I, BINDING SITE II or BINDING SITE III of FIG. 8. Table 4 illustrates the complementarity of the nucleotide sequences of EDG1 BINDING SITE, designated SEQ ID:11979, to the nucleotide sequence of GAM8297 RNA, herein designated GAM RNA, also designated SEQ ID:367.

Another function of GAM8297 is therefore inhibition of Endothelial differentiation, sphingolipid g-protein-coupled receptor, 1 (EDG1, Accession NP_001391.2). Accordingly, utilities of GAM8297 include diagnosis, prevention and treatment of diseases and clinical conditions associated with EDG1.

Endothelin 3 (EDN3, Accession NP_000105.1) is another GAM8297 target gene, herein designated TARGET GENE. EDN3 BINDING SITE is a target binding site found in the 5' untranslated region of mRNA encoded by EDN3, corresponding to a target binding site such as BINDING SITE I, BINDING SITE II or BINDING SITE III of FIG. 8. Table 4 illustrates the complementarity of the nucleotide sequences of EDN3 BINDING SITE, designated SEQ ID:18442, to the nucleotide sequence of GAM8297 RNA, herein designated GAM RNA, also designated SEQ ID:367.

Another function of GAM8297 is therefore inhibition of Endothelin 3 (EDN3, Accession NP_000105.1). Accordingly, utilities of GAM8297 include diagnosis, prevention and treatment of diseases and clinical conditions associated with EDN3.

Endothelin receptor type a (EDNRA, Accession NP_001948.1) is another GAM8297 target gene, herein designated TARGET GENE. EDNRA BINDING SITE is a target binding site found in the 3' untranslated region of mRNA encoded by EDNRA, corresponding to a target binding site such as BINDING SITE I, BINDING SITE II or BINDING SITE III of FIG. 8. Table 4 illustrates the complementarity of the nucleotide sequences of EDNRA BINDING SITE, designated SEQ ID:14062, to the nucleotide sequence of GAM8297 RNA, herein designated GAM RNA, also designated SEQ ID:367.

Another function of GAM8297 is therefore inhibition of Endothelin receptor type a (EDNRA, Accession NP_001948.1), a gene which binds endothelins, and induces intracellular calcium flux and arachidonic acid accumulation and therefore may be associated with Resistance to migraine. Accordingly, utilities of GAM8297 include diagnosis, prevention and treatment of Resistance to migraine, and of other diseases and clinical conditions associated with EDNRA.

The function of EDNRA and its association with various diseases and clinical conditions, has been established by previous studies, as described hereinabove with reference to GAM627.1. Egf-like-domain, multiple 4 (EGFL4, Accession XP_290821.1) is another GAM8297 target gene, herein designated TARGET GENE. EGFL4 BINDING SITE is a target binding site found in the 3' untranslated region of mRNA encoded by EGFL4, corresponding to a target binding site such as BINDING SITE I, BINDING SITE II or BINDING SITE III of FIG. 8. Table 4 illustrates the complementarity of the nucleotide sequences of EGFL4 BINDING SITE, designated SEQ ID:15348, to the nucleotide sequence of GAM8297 RNA, herein designated GAM RNA, also designated SEQ ID:367.

Another function of GAM8297 is therefore inhibition of Egf-like-domain, multiple 4 (EGFL4, Accession XP_290821.1). Accordingly, utilities of GAM8297 include diagnosis, prevention and treatment of diseases and clinical conditions associated with EGFL4.

Er to nucleus signalling 1 (ERN1, Accession NP_001424.1) is another GAM8297 target gene, herein designated TARGET GENE. ERN1 BINDING SITE is a target binding site found in the 3' untranslated region of mRNA encoded by ERN1, corresponding to a target binding site such as BINDING SITE I, BINDING SITE II or BINDING SITE III of FIG. 8. Table 4 illustrates the complementarity of the nucleotide sequences of ERN1 BINDING SITE, designated SEQ ID:14185, to the nucleotide sequence of GAM8297 RNA, herein designated GAM RNA, also designated SEQ ID:367.

Another function of GAM8297 is therefore inhibition of Er to nucleus signalling 1 (ERN1, Accession NP_001424.1). Accordingly, utilities of GAM8297 include diagnosis, prevention and treatment of diseases and clinical conditions associated with ERN1.

FLJ10521 (Accession NP_060595.1) is another GAM8297 target gene, herein designated TARGET GENE. FLJ10521 BINDING SITE is a target binding site found in the 3' untranslated region of mRNA encoded by FLJ10521, corresponding to a target binding site such as BINDING SITE I, BINDING SITE II or BINDING SITE III of FIG. 8. Table 4 illustrates the complementarity of the nucleotide sequences of FLJ10521 BINDING SITE, designated SEQ ID:9343, to the nucleotide sequence of GAM8297 RNA, herein designated GAM RNA, also designated SEQ ID:367.

Another function of GAM8297 is therefore inhibition of FLJ10521 (Accession NP_060595.1). Accordingly, utilities of GAM8297 include diagnosis, prevention and treatment of diseases and clinical conditions associated with FLJ10521.

FLJ10786 (Accession NP_060689.1) is another GAM8297 target gene, herein designated TARGET GENE. FLJ10786 BINDING SITE is a target binding site found in the 3' untranslated region of mRNA encoded by FLJ10786, corresponding to a target binding site such as BINDING SITE I, BINDING SITE II or BINDING SITE III of FIG. 8. Table 4 illustrates the complementarity of the nucleotide sequences of FLJ10786 BINDING SITE, designated SEQ ID:3362, to the nucleotide sequence of GAM8297 RNA, herein designated GAM RNA, also designated SEQ ID:367.

Another function of GAM8297 is therefore inhibition of FLJ10786 (Accession NP_060689.1). Accordingly, utilities of GAM8297 include diagnosis, prevention and treatment of diseases and clinical conditions associated with FLJ10786.

FLJ10803 (Accession NP_060694.1) is another GAM8297 target gene, herein designated TARGET GENE. FLJ10803 BINDING SITE is a target binding site found in the 3' untranslated region of mRNA encoded by FLJ10803, corresponding to a target binding site such as BINDING SITE I, BINDING SITE II or BINDING SITE III of FIG. 8. Table 4 illustrates the complementarity of the nucleotide sequences of FLJ10803 BINDING SITE, designated SEQ ID:13516, to the nucleotide sequence of GAM8297 RNA, herein designated GAM RNA, also designated SEQ ID:367.

Another function of GAM8297 is therefore inhibition of FLJ10803 (Accession NP_060694.1). Accordingly, utilities of GAM8297 include diagnosis, prevention and treatment of diseases and clinical conditions associated with FLJ10803.

FLJ10895 (Accession NP_061957.1) is another GAM8297 target gene, herein designated TARGET GENE. FLJ10895 BINDING SITE is a target binding site found in the 3' untranslated region of mRNA encoded by FLJ10895, corresponding to a target binding site such as BINDING SITE I, BINDING SITE II or BINDING SITE III of FIG. 8. Table 4 illustrates the complementarity of the nucleotide sequences of FLJ10895 BINDING SITE, designated SEQ ID:15940, to the nucleotide sequence of GAM8297 RNA, herein designated GAM RNA, also designated SEQ ID:367.

Another function of GAM8297 is therefore inhibition of FLJ10895 (Accession NP_061957.1). Accordingly, utilities of GAM8297 include diagnosis, prevention and treatment of diseases and clinical conditions associated with FLJ10895.

FLJ11539 (Accession NP_079024.1) is another GAM8297 target gene, herein designated TARGET GENE. FLJ11539 BINDING SITE is a target binding site found in the 3' untranslated region of mRNA encoded by FLJ11539, corresponding to a target binding site such as BINDING SITE I, BINDING SITE II or BINDING SITE III of FIG. 8. Table 4 illustrates the complementarity of the nucleotide sequences of FLJ11539 BINDING SITE, designated SEQ ID:12818, to the nucleotide sequence of GAM8297 RNA, herein designated GAM RNA, also designated SEQ ID:367.

Another function of GAM8297 is therefore inhibition of FLJ11539 (Accession NP_079024.1). Accordingly, utilities of GAM8297 include diagnosis, prevention and treatment of diseases and clinical conditions associated with FLJ11539.

FLJ12660 (Accession NP_079428.1) is another GAM8297 target gene, herein designated TARGET GENE. FLJ12660 BINDING SITE is a target binding site found in the 3' untranslated region of mRNA encoded by FLJ12660, corresponding to a target binding site such as BINDING SITE I, BINDING SITE II or BINDING SITE III of FIG. 8. Table 4 illustrates the complementarity of the nucleotide sequences of FLJ12660 BINDING SITE, designated SEQ ID:1015, to the nucleotide sequence of GAM8297 RNA, herein designated GAM RNA, also designated SEQ ID:367.

Another function of GAM8297 is therefore inhibition of FLJ12660 (Accession NP_079428.1). Accordingly, utilities of GAM8297 include diagnosis, prevention and treatment of diseases and clinical conditions associated with FLJ12660.

FLJ12788 (Accession NP_071937.1) is another GAM8297 target gene, herein designated TARGET GENE. FLJ12788 BINDING SITE is a target binding site found in the 3' untranslated region of mRNA encoded by FLJ12788, corresponding to a target binding site such as BINDING SITE I, BINDING SITE II or BINDING SITE III of FIG. 8. Table 4 illustrates the complementarity of the nucleotide sequences of FLJ12788 BINDING SITE, designated SEQ ID:16212, to the nucleotide sequence of GAM8297 RNA, herein designated GAM RNA, also designated SEQ ID:367.

Another function of GAM8297 is therefore inhibition of FLJ12788 (Accession NP_071937.1). Accordingly, utilities of GAM8297 include diagnosis, prevention and treatment of diseases and clinical conditions associated with FLJ12788.

FLJ14260 (Accession NP_079303.2) is another GAM8297 target gene, herein designated TARGET GENE. FLJ14260 BINDING SITE is a target binding site found in the 5' untranslated region of mRNA encoded by FLJ14260, corresponding to a target binding site such as BINDING SITE I, BINDING SITE II or BINDING SITE III of FIG. 8. Table 4 illustrates the complementarity of the nucleotide sequences of FLJ14260 BINDING SITE, designated SEQ ID:10780, to the nucleotide sequence of GAM8297 RNA, herein designated GAM RNA, also designated SEQ ID:367.

Another function of GAM8297 is therefore inhibition of FLJ14260 (Accession NP_079303.2). Accordingly, utilities of GAM8297 include diagnosis, prevention and treatment of diseases and clinical conditions associated with FLJ14260.

FLJ14827 (Accession NP_116237.1) is another GAM8297 target gene, herein designated TARGET GENE. FLJ14827 BINDING SITE is a target binding site found in the 3' untranslated region of mRNA encoded by FLJ14827, corresponding to a target binding site such as BINDING SITE I, BINDING SITE II or BINDING SITE III of FIG. 8. Table 4 illustrates the complementarity of the nucleotide sequences of FLJ14827 BINDING SITE, designated SEQ ID:5731, to the nucleotide sequence of GAM8297 RNA, herein designated GAM RNA, also designated SEQ ID:367.

Another function of GAM8297 is therefore inhibition of FLJ14827 (Accession NP_116237.1). Accordingly, utilities of GAM8297 include diagnosis, prevention and treatment of diseases and clinical conditions associated with FLJ14827.

FLJ20079 (Accession NP_060126.1) is another GAM8297 target gene, herein designated TARGET GENE. FLJ20079 BINDING SITE is a target binding site found in the 3' untranslated region of mRNA encoded by FLJ20079, corresponding to a target binding site such as BINDING SITE I, BINDING SITE II or BINDING SITE III of FIG. 8. Table 4 illustrates the complementarity of the nucleotide sequences of FLJ20079 BINDING SITE, designated SEQ ID:2651, to the nucleotide sequence of GAM8297 RNA, herein designated GAM RNA, also designated SEQ ID:367.

Another function of GAM8297 is therefore inhibition of FLJ20079 (Accession NP_060126.1). Accordingly, utilities of GAM8297 include diagnosis, prevention and treatment of diseases and clinical conditions associated with FLJ20079.

FLJ20364 (Accession NP_060255.2) is another GAM8297 target gene, herein designated TARGET GENE. FLJ20364 BINDING SITE is a target binding site found in the 3' untranslated region of mRNA encoded by FLJ20364, corresponding to a target binding site such as BINDING SITE I, BINDING SITE II or BINDING SITE III of FIG. 8. Table 4 illustrates the complementarity of the nucleotide sequences of FLJ20364 BINDING SITE, designated SEQ ID:12890, to the nucleotide sequence of GAM8297 RNA, herein designated GAM RNA, also designated SEQ ID:367.

Another function of GAM8297 is therefore inhibition of FLJ20364 (Accession NP_060255.2). Accordingly, utilities of GAM8297 include diagnosis, prevention and treatment of diseases and clinical conditions associated with FLJ20364.

FLJ20502 (Accession NP_060315.1) is another GAM8297 target gene, herein designated TARGET GENE. FLJ20502 BINDING SITE is a target binding site found in the 3' untranslated region of mRNA encoded by FLJ20502, corresponding to a target binding site such as BINDING SITE I, BINDING SITE II or BINDING SITE III of FIG. 8. Table 4 illustrates the complementarity of the nucleotide sequences of FLJ20502 BINDING SITE, designated SEQ ID:19215, to the nucleotide sequence of GAM8297 RNA, herein designated GAM RNA, also designated SEQ ID:367.

Another function of GAM8297 is therefore inhibition of FLJ20502 (Accession NP_060315.1). Accordingly, utilities of GAM8297 include diagnosis, prevention and treatment of diseases and clinical conditions associated with FLJ20502.

FLJ20605 (Accession NP_060368.2) is another GAM8297 target gene, herein designated TARGET GENE. FLJ20605 BINDING SITE is a target binding site found in the 3' untranslated region of mRNA encoded by FLJ20605, corresponding to a target binding site such as BINDING SITE I, BINDING SITE II or BINDING SITE III of FIG. 8. Table 4 illustrates the complementarity of the nucleotide sequences of FLJ20605 BINDING SITE, designated SEQ ID:2121, to the nucleotide sequence of GAM8297 RNA, herein designated GAM RNA, also designated SEQ ID:367.

Another function of GAM8297 is therefore inhibition of FLJ20605 (Accession NP_060368.2). Accordingly, utilities of GAM8297 include diagnosis, prevention and treatment of diseases and clinical conditions associated with FLJ20605.

FLJ23056 (Accession NP_078858.1) is another GAM8297 target gene, herein designated TARGET GENE. FLJ23056 BINDING SITE is a target binding site found in the 5' untranslated region of mRNA encoded by FLJ23056, corresponding to a target binding site such as BINDING SITE I, BINDING SITE II or BINDING SITE III of FIG. 8. Table 4 illustrates the complementarity of the nucleotide sequences of FLJ23056 BINDING SITE, designated SEQ ID:15786, to the nucleotide sequence of GAM8297 RNA, herein designated GAM RNA, also designated SEQ ID:367.

Another function of GAM8297 is therefore inhibition of FLJ23056 (Accession NP_078858.1). Accordingly, utilities of GAM8297 include diagnosis, prevention and treatment of diseases and clinical conditions associated with FLJ23056.

FLJ23323 (Accession NP_078930.1) is another GAM8297 target gene, herein designated TARGET GENE. FLJ23323 BINDING SITE is a target binding site found in the 3' untranslated region of mRNA encoded by FLJ23323, corresponding to a target binding site such as BINDING SITE I, BINDING SITE II or BINDING SITE III of FIG. 8. Table 4 illustrates the complementarity of the nucleotide sequences of FLJ23323 BINDING SITE, designated SEQ ID:18937, to the nucleotide sequence of GAM8297 RNA, herein designated GAM RNA, also designated SEQ ID:367.

Another function of GAM8297 is therefore inhibition of FLJ23323 (Accession NP_078930.1). Accordingly, utilities of GAM8297 include diagnosis, prevention and treatment of diseases and clinical conditions associated with FLJ23323.

FLJ30934 (Accession NP_689973.1) is another GAM8297 target gene, herein designated TARGET GENE. FLJ30934 BINDING SITE is a target binding site found in the 3' untranslated region of mRNA encoded by FLJ30934, corresponding to a target binding site such as BINDING SITE I, BINDING SITE II or BINDING SITE III of FIG. 8. Table 4 illustrates the complementarity of the nucleotide sequences of FLJ30934 BINDING SITE, designated SEQ ID:18669, to the nucleotide sequence of GAM8297 RNA, herein designated GAM RNA, also designated SEQ ID:367.

Another function of GAM8297 is therefore inhibition of FLJ30934 (Accession NP_689973.1). Accordingly, utilities of GAM8297 include diagnosis, prevention and treatment of diseases and clinical conditions associated with FLJ30934.

FLJ31349 (Accession NP_775786.1) is another GAM8297 target gene, herein designated TARGET GENE. FLJ31349 BINDING SITE is a target binding site found in the 3' untranslated region of mRNA encoded by FLJ31349, corresponding to a target binding site such as BINDING SITE I, BINDING SITE II or BINDING SITE III of FIG. 8. Table 4 illustrates the complementarity of the nucleotide sequences of FLJ31349 BINDING SITE, designated SEQ ID:10144, to the nucleotide sequence of GAM8297 RNA, herein designated GAM RNA, also designated SEQ ID:367.

Another function of GAM8297 is therefore inhibition of FLJ31349 (Accession NP_775786.1). Accordingly, utilities of GAM8297 include diagnosis, prevention and treatment of diseases and clinical conditions associated with FLJ31349.

FLJ32029 (Accession NP_775853.2) is another GAM8297 target gene, herein designated TARGET GENE. FLJ32029 BINDING SITE is a target binding site found in the 3' untranslated region of mRNA encoded by FLJ32029, corresponding to a target binding site such as BINDING SITE I, BINDING SITE II or BINDING SITE III of FIG. 8. Table 4 illustrates the complementarity of the nucleotide sequences of FLJ32029 BINDING SITE, designated SEQ ID:15817, to the nucleotide sequence of GAM8297 RNA, herein designated GAM RNA, also designated SEQ ID:367.

Another function of GAM8297 is therefore inhibition of FLJ32029 (Accession NP_775853.2). Accordingly, utilities of GAM8297 include diagnosis, prevention and treatment of diseases and clinical conditions associated with FLJ32029.

FLJ33298 (Accession NP_775907.1) is another GAM8297 target gene, herein designated TARGET GENE. FLJ33298 BINDING SITE is a target binding site found in the 3' untranslated region of mRNA encoded by FLJ33298, corresponding to a target binding site such as BINDING SITE I, BINDING SITE II or BINDING SITE III of FIG. 8. Table 4 illustrates the complementarity of the nucleotide sequences of FLJ33298 BINDING SITE, designated SEQ ID:10479, to the nucleotide sequence of GAM8297 RNA, herein designated GAM RNA, also designated SEQ ID:367.

Another function of GAM8297 is therefore inhibition of FLJ33298 (Accession NP_775907.1). Accordingly, utilities of GAM8297 include diagnosis, prevention and treatment of diseases and clinical conditions associated with FLJ33298.

FLJ33610 (Accession NP_775968.1) is another GAM8297 target gene, herein designated TARGET GENE. FLJ33610 BINDING SITE is a target binding site found in the 3' untranslated region of mRNA encoded by FLJ33610, corresponding to a target binding site such as BINDING SITE I, BINDING SITE II or BINDING SITE III of FIG. 8. Table 4 illustrates the complementarity of the nucleotide sequences of FLJ33610 BINDING SITE, designated SEQ ID:2606, to the nucleotide sequence of GAM8297 RNA, herein designated GAM RNA, also designated SEQ ID:367.

Another function of GAM8297 is therefore inhibition of FLJ33610 (Accession NP_775968.1). Accordingly, utilities of GAM8297 include diagnosis, prevention and treatment of diseases and clinical conditions associated with FLJ33610.

FLJ35838 (Accession NP_775803.1) is another GAM8297 target gene, herein designated TARGET GENE. FLJ35838 BINDING SITE is a target binding site found in the 3' untranslated region of mRNA encoded by FLJ35838, corresponding to a target binding site such as BINDING SITE I, BINDING SITE II or BINDING SITE III of FIG. 8. Table 4 illustrates the complementarity of the nucleotide sequences of FLJ35838 BINDING SITE, designated SEQ ID:6529, to the nucleotide sequence of GAM8297 RNA, herein designated GAM RNA, also designated SEQ ID:367.

Another function of GAM8297 is therefore inhibition of FLJ35838 (Accession NP_775803.1). Accordingly, utilities of GAM8297 include diagnosis, prevention and treatment of diseases and clinical conditions associated with FLJ35838.

FLJ36576 (Accession NP_775793.1) is another GAM8297 target gene, herein designated TARGET GENE. FLJ36576 BINDING SITE is a target binding site found in the 3' untranslated region of mRNA encoded by FLJ36576, corresponding to a target binding site such as BINDING SITE I, BINDING SITE II or BINDING SITE III of FIG. 8. Table 4 illustrates the complementarity of the nucleotide sequences of FLJ36576 BINDING SITE, designated SEQ ID:8645, to the nucleotide sequence of GAM8297 RNA, herein designated GAM RNA, also designated SEQ ID:367.

Another function of GAM8297 is therefore inhibition of FLJ36576 (Accession NP_775793.1). Accordingly, utilities of GAM8297 include diagnosis, prevention and treatment of diseases and clinical conditions associated with FLJ36576.

FLJ37318 (Accession NP_689799.1) is another GAM8297 target gene, herein designated TARGET GENE. FLJ37318 BINDING SITE is a target binding site found in the 5' untranslated region of mRNA encoded by FLJ37318, corresponding to a target binding site such as BINDING SITE I, BINDING SITE II or BINDING SITE III of FIG. 8. Table 4 illustrates the complementarity of the nucleotide sequences of FLJ37318 BINDING SITE, designated SEQ ID:5684, to the nucleotide sequence of GAM8297 RNA, herein designated GAM RNA, also designated SEQ ID:367.

Another function of GAM8297 is therefore inhibition of FLJ37318 (Accession NP_689799.1). Accordingly, utilities of GAM8297 include diagnosis, prevention and treatment of diseases and clinical conditions associated with FLJ37318.

FLJ38608 (Accession NP_694947.1) is another GAM8297 target gene, herein designated TARGET GENE. FLJ38608 BINDING SITE is a target binding site found in the 3' untranslated region of mRNA encoded by FLJ38608, corresponding to a target binding site such as BINDING SITE I, BINDING SITE II or BINDING SITE III of FIG. 8. Table 4 illustrates the complementarity of the nucleotide sequences of FLJ38608 BINDING SITE, designated SEQ ID:5277, to the nucleotide sequence of GAM8297 RNA, herein designated GAM RNA, also designated SEQ ID:367.

Another function of GAM8297 is therefore inhibition of FLJ38608 (Accession NP_694947.1). Accordingly, utilities of GAM8297 include diagnosis, prevention and treatment of diseases and clinical conditions associated with FLJ38608.

FLJ39117 (Accession NP_689577.1) is another GAM8297 target gene, herein designated TARGET GENE. FLJ39117 BINDING SITE is a target binding site found in the 3' untranslated region of mRNA encoded by FLJ39117, corresponding to a target binding site such as BINDING SITE I, BINDING SITE II or BINDING SITE III of FIG. 8. Table 4 illustrates the complementarity of the nucleotide sequences of FLJ39117 BINDING SITE, designated SEQ ID:8551, to the nucleotide sequence of GAM8297 RNA, herein designated GAM RNA, also designated SEQ ID:367.

Another function of GAM8297 is therefore inhibition of FLJ39117 (Accession NP_689577.1). Accordingly, utilities of GAM8297 include diagnosis, prevention and treatment of diseases and clinical conditions associated with FLJ39117.

FLJ40160 (Accession NP_775755.2) is another GAM8297 target gene, herein designated TARGET GENE. FLJ40160 BINDING SITE is a target binding site found in the 3' untranslated region of mRNA encoded by FLJ40160, corresponding to a target binding site such as BINDING SITE I, BINDING SITE II or BINDING SITE III of FIG. 8. Table 4 illustrates the complementarity of the nucleotide sequences of FLJ40160 BINDING SITE, designated SEQ ID:14835, to the nucleotide sequence of GAM8297 RNA, herein designated GAM RNA, also designated SEQ ID:367.

Another function of GAM8297 is therefore inhibition of FLJ40160 (Accession NP_775755.2). Accordingly, utilities of GAM8297 include diagnosis, prevention and treatment of diseases and clinical conditions associated with FLJ40160.

Forkhead box d2 (FOXD2, Accession NP_004465.1) is another GAM8297 target gene, herein designated TARGET GENE. FOXD2 BINDING SITE is a target binding site found in the 5' untranslated region of mRNA encoded by FOXD2, corresponding to a target binding site such as BINDING SITE I, BINDING SITE II or BINDING SITE III of FIG. 8. Table 4 illustrates the complementarity of the nucleotide sequences of FOXD2 BINDING SITE, designated SEQ ID:11152, to the nucleotide sequence of GAM8297 RNA, herein designated GAM RNA, also designated SEQ ID:367.

Another function of GAM8297 is therefore inhibition of Forkhead box d2 (FOXD2, Accession NP_004465.1). Accordingly, utilities of GAM8297 include diagnosis, prevention and treatment of diseases and clinical conditions associated with FOXD2.

FRABIN (Accession NP_640334.1) is another GAM8297 target gene, herein designated TARGET GENE. FRABIN BINDING SITE is a target binding site found in the 5' untranslated region of mRNA encoded by FRABIN, corresponding to a target binding site such as BINDING SITE I, BINDING SITE II or BINDING SITE III of FIG. 8. Table 4 illustrates the complementarity of the nucleotide sequences of FRABIN BINDING SITE, designated SEQ ID:6720, to the nucleotide sequence of GAM8297 RNA, herein designated GAM RNA, also designated SEQ ID:367.

Another function of GAM8297 is therefore inhibition of FRABIN (Accession NP_640334.1). Accordingly, utilities of GAM8297 include diagnosis, prevention and treatment of diseases and clinical conditions associated with FRABIN.

FRCP2 (Accession NP__715637.1) is another GAM8297 target gene, herein designated TARGET GENE. FRCP2 BINDING SITE is a target binding site found in the 3' untranslated region of mRNA encoded by FRCP2, corresponding to a target binding site such as BINDING SITE I, BINDING SITE II or BINDING SITE III of FIG. 8. Table 4 illustrates the complementarity of the nucleotide sequences of FRCP2 BINDING SITE, designated SEQ ID:9651, to the nucleotide sequence of GAM8297 RNA, herein designated GAM RNA, also designated SEQ ID:367.

Another function of GAM8297 is therefore inhibition of FRCP2 (Accession NP__715637.1). Accordingly, utilities of GAM8297 include diagnosis, prevention and treatment of diseases and clinical conditions associated with FRCP2.

Follistatin-like 1 (FSTL1, Accession NP__009016.1) is another GAM8297 target gene, herein designated TARGET GENE. FSTL1 BINDING SITE is a target binding site found in the 3' untranslated region of mRNA encoded by FSTL1, corresponding to a target binding site such as BINDING SITE I, BINDING SITE II or BINDING SITE III of FIG. 8. Table 4 illustrates the complementarity of the nucleotide sequences of FSTL1 BINDING SITE, designated SEQ ID:17836, to the nucleotide sequence of GAM8297 RNA, herein designated GAM RNA, also designated SEQ ID:367.

Another function of GAM8297 is therefore inhibition of Follistatin-like 1 (FSTL1, Accession NP__009016.1), a gene which may modulate the action of some growth factors on cell proliferation and differentiation. and therefore may be associated with Rheumatoid arthritis. Accordingly, utilities of GAM8297 include diagnosis, prevention and treatment of Rheumatoid arthritis, and of other diseases and clinical conditions associated with FSTL1.

The function of FSTL1 and its association with various diseases and clinical conditions, has been established by previous studies, as described hereinabove with reference to GAM279.1. G2A (Accession NP__037477.1) is another GAM8297 target gene, herein designated TARGET GENE. G2A BINDING SITE is a target binding site found in the 3' untranslated region of mRNA encoded by G2A, corresponding to a target binding site such as BINDING SITE I, BINDING SITE II or BINDING SITE III of FIG. 8. Table 4 illustrates the complementarity of the nucleotide sequences of G2A BINDING SITE, designated SEQ ID:18565, to the nucleotide sequence of GAM8297 RNA, herein designated GAM RNA, also designated SEQ ID:367.

Another function of GAM8297 is therefore inhibition of G2A (Accession NP__037477.1), a gene which may mediate some of the effects of extracellular atp on insulin secretion. and therefore may be associated with Autoimmune disease. Accordingly, utilities of GAM8297 include diagnosis, prevention and treatment of Autoimmune disease, and of other diseases and clinical conditions associated with G2A.

The function of G2A and its association with various diseases and clinical conditions, has been established by previous studies, as described hereinabove with reference to GAM189.1. Grb2-associated binding protein 3 (GAB3, Accession NP__542179.1) is another GAM8297 target gene, herein designated TARGET GENE. GAB3 BINDING SITE is a target binding site found in the 3' untranslated region of mRNA encoded by GAB3, corresponding to a target binding site such as BINDING SITE I, BINDING SITE II or BINDING SITE III of FIG. 8. Table 4 illustrates the complementarity of the nucleotide sequences of GAB3 BINDING SITE, designated SEQ ID:14391, to the nucleotide sequence of GAM8297 RNA, herein designated GAM RNA, also designated SEQ ID:367.

Another function of GAM8297 is therefore inhibition of Grb2-associated binding protein 3 (GAB3, Accession NP__542179.1). Accordingly, utilities of GAM8297 include diagnosis, prevention and treatment of diseases and clinical conditions associated with GAB3.

Glutamine-fructose-6-phosphate transaminase 2 (GFPT2, Accession NP__005101.1) is another GAM8297 target gene, herein designated TARGET GENE. GFPT2 BINDING SITE is a target binding site found in the 3' untranslated region of mRNA encoded by GFPT2, corresponding to a target binding site such as BINDING SITE I, BINDING SITE II or BINDING SITE III of FIG. 8. Table 4 illustrates the complementarity of the nucleotide sequences of GFPT2 BINDING SITE, designated SEQ ID:12066, to the nucleotide sequence of GAM8297 RNA, herein designated GAM RNA, also designated SEQ ID:367.

Another function of GAM8297 is therefore inhibition of Glutamine-fructose-6-phosphate transaminase 2 (GFPT2, Accession NP__005101.1). Accordingly, utilities of GAM8297 include diagnosis, prevention and treatment of diseases and clinical conditions associated with GFPT2.

G protein-coupled receptor 87 (GPR87, Accession NP__076404.2) is another GAM8297 target gene, herein designated TARGET GENE. GPR87 BINDING SITE is a target binding site found in the 5' untranslated region of mRNA encoded by GPR87, corresponding to a target binding site such as BINDING SITE I, BINDING SITE II or BINDING SITE III of FIG. 8. Table 4 illustrates the complementarity of the nucleotide sequences of GPR87 BINDING SITE, designated SEQ ID:11836, to the nucleotide sequence of GAM8297 RNA, herein designated GAM RNA, also designated SEQ ID:367.

Another function of GAM8297 is therefore inhibition of G protein-coupled receptor 87 (GPR87, Accession NP__076404.2), a gene which plays a role in cell communication. Accordingly, utilities of GAM8297 include diagnosis, prevention and treatment of diseases and clinical conditions associated with GPR87.

The function of GPR87 and its association with various diseases and clinical conditions, has been established by previous studies, as described hereinabove with reference to GAM588.1. G protein-coupled receptor, family c, group 5, member c (GPRC5C, Accession NP__061123.2) is another GAM8297 target gene, herein designated TARGET GENE. GPRC5C BINDING SITE is a target binding site found in the 5' untranslated region of multiple transcripts of mRNA encoded by GPRC5C, corresponding to a target binding site such as BINDING SITE I, BINDING SITE II or BINDING SITE III of FIG. 8. Table 4 illustrates the complementarity of the nucleotide sequences of GPRC5C BINDING SITE, designated SEQ ID:8211, to the nucleotide sequence of GAM8297 RNA, herein designated GAM RNA, also designated SEQ ID:367.

Another function of GAM8297 is therefore inhibition of G protein-coupled receptor, family c, group 5, member c (GPRC5C, Accession NP__061123.2). Accordingly, utilities of GAM8297 include diagnosis, prevention and treatment of diseases and clinical conditions associated with GPRC5C.

G protein pathway suppressor 2 (GPS2, Accession NP__004480.1) is another GAM8297 target gene, herein designated TARGET GENE. GPS2 BINDING SITE is a target binding site found in the 5' untranslated region of multiple transcripts of mRNA encoded by GPS2, corresponding to a target binding site such as BINDING SITE I, BINDING SITE II or BINDING SITE III of FIG. 8. Table 4 illustrates the complementarity of the nucleotide sequences of GPS2 BINDING SITE, designated SEQ ID:13607, to the nucleotide sequence of GAM8297 RNA, herein designated GAM RNA, also designated SEQ ID:367.

Another function of GAM8297 is therefore inhibition of G protein pathway suppressor 2 (GPS2, Accession NP_004480.1). Accordingly, utilities of GAM8297 include diagnosis, prevention and treatment of diseases and clinical conditions associated with GPS2.

Guanylate kinase 1 (GUK1, Accession NP_000849.1) is another GAM8297 target gene, herein designated TARGET GENE. GUK1 BINDING SITE is a target binding site found in the 3' untranslated region of mRNA encoded by GUK1, corresponding to a target binding site such as BINDING SITE I, BINDING SITE II or BINDING SITE III of FIG. 8. Table 4 illustrates the complementarity of the nucleotide sequences of GUK1 BINDING SITE, designated SEQ ID:11774, to the nucleotide sequence of GAM8297 RNA, herein designated GAM RNA, also designated SEQ ID:367.

Another function of GAM8297 is therefore inhibition of Guanylate kinase 1 (GUK1, Accession NP_000849.1), a gene which converts GMP to GTP as part of the cGMP cycle and essential for recycling gmp and indirectly, cgmp. Accordingly, utilities of GAM8297 include diagnosis, prevention and treatment of diseases and clinical conditions associated with GUK1.

The function of GUK1 and its association with various diseases and clinical conditions, has been established by previous studies, as described hereinabove with reference to GAM849.1. Histone deacetylase 1 (HDAC1, Accession NP_004955.2) is another GAM8297 target gene, herein designated TARGET GENE. HDAC1 BINDING SITE is a target binding site found in the 3' untranslated region of mRNA encoded by HDAC1, corresponding to a target binding site such as BINDING SITE I, BINDING SITE II or BINDING SITE III of FIG. 8. Table 4 illustrates the complementarity of the nucleotide sequences of HDAC1 BINDING SITE, designated SEQ ID:4562, to the nucleotide sequence of GAM8297 RNA, herein designated GAM RNA, also designated SEQ ID:367.

Another function of GAM8297 is therefore inhibition of Histone deacetylase 1 (HDAC1, Accession NP_004955.2), a gene which is responsible for the deacetylation of lysine residues on the n-terminal part of the core histones (h2a, h2b, h3 and h4) which plays an important role in transcriptional regulation, cell cycle progression and developmental events. Accordingly, utilities of GAM8297 include diagnosis, prevention and treatment of diseases and clinical conditions associated with HDAC1.

The function of HDAC1 and its association with various diseases and clinical conditions, has been established by previous studies, as described hereinabove with reference to GAM445.2. Hedgehog interacting protein (HHIP, Accession NP_071920.1) is another GAM8297 target gene, herein designated TARGET GENE. HHIP BINDING SITE is a target binding site found in the 5' untranslated region of mRNA encoded by HHIP, corresponding to a target binding site such as BINDING SITE I, BINDING SITE II or BINDING SITE III of FIG. 8. Table 4 illustrates the complementarity of the nucleotide sequences of HHIP BINDING SITE, designated SEQ ID:842, to the nucleotide sequence of GAM8297 RNA, herein designated GAM RNA, also designated SEQ ID:367.

Another function of GAM8297 is therefore inhibition of Hedgehog interacting protein (HHIP, Accession NP_071920.1), a gene which is involved in many fundamental processes in embryonic development, including antero-posterior patterns of limbs and regulation of left-right asymmetry. Accordingly, utilities of GAM8297 include diagnosis, prevention and treatment of diseases and clinical conditions associated with HHIP.

The function of HHIP and its association with various diseases and clinical conditions, has been established by previous studies, as described hereinabove with reference to GAM700.1. Heterogeneous nuclear ribonucleoprotein h3 (2h9) (HNRPH3, Accession NP_036339.1) is another GAM8297 target gene, herein designated TARGET GENE. HNRPH3 BINDING SITE is a target binding site found in the 3' untranslated region of multiple transcripts of mRNA encoded by HNRPH3, corresponding to a target binding site such as BINDING SITE I, BINDING SITE II or BINDING SITE III of FIG. 8. Table 4 illustrates the complementarity of the nucleotide sequences of HNRPH3 BINDING SITE, designated SEQ ID:13944, to the nucleotide sequence of GAM8297 RNA, herein designated GAM RNA, also designated SEQ ID:367.

Another function of GAM8297 is therefore inhibition of Heterogeneous nuclear ribonucleoprotein h3 (2h9) (HNRPH3, Accession NP_036339.1). Accordingly, utilities of GAM8297 include diagnosis, prevention and treatment of diseases and clinical conditions associated with HNRPH3.

Heterogeneous nuclear ribonucleoprotein h3 (2h9) (HNRPH3, Accession NP_067676.2) is another GAM8297 target gene, herein designated TARGET GENE. HNRPH3 BINDING SITE is a target binding site found in the 3' untranslated region of multiple transcripts of mRNA encoded by HNRPH3, corresponding to a target binding site such as BINDING SITE I, BINDING SITE II or BINDING SITE III of FIG. 8. Table 4 illustrates the complementarity of the nucleotide sequences of HNRPH3 BINDING SITE, designated SEQ ID:13944, to the nucleotide sequence of GAM8297 RNA, herein designated GAM RNA, also designated SEQ ID:367.

Another function of GAM8297 is therefore inhibition of Heterogeneous nuclear ribonucleoprotein h3 (2h9) (HNRPH3, Accession NP_067676.2). Accordingly, utilities of GAM8297 include diagnosis, prevention and treatment of diseases and clinical conditions associated with HNRPH3.

Homeo box a1 (HOXA1, Accession NP_705873.1) is another GAM8297 target gene, herein designated TARGET GENE. HOXA1 BINDING SITE is a target binding site found in the 3' untranslated region of multiple transcripts of mRNA encoded by HOXA1, corresponding to a target binding site such as BINDING SITE I, BINDING SITE II or BINDING SITE III of FIG. 8. Table 4 illustrates the complementarity of the nucleotide sequences of HOXA1 BINDING SITE, designated SEQ ID:18845, to the nucleotide sequence of GAM8297 RNA, herein designated GAM RNA, also designated SEQ ID:367.

Another function of GAM8297 is therefore inhibition of Homeo box a1 (HOXA1, Accession NP_705873.1). Accordingly, utilities of GAM8297 include diagnosis, prevention and treatment of diseases and clinical conditions associated with HOXA1.

Hydroxysteroid (11-beta) dehydrogenase 2 (HSD11B2, Accession NP_000187.2) is another GAM8297 target gene, herein designated TARGET GENE. HSD11B2 BINDING SITE1 and HSD11B2 BINDING SITE2 are target binding sites found in untranslated regions of mRNA encoded by HSD11B2, corresponding to target binding sites such as BINDING SITE I, BINDING SITE II or BINDING SITE III of FIG. 8. Table 4 illustrates the complementarity of the nucleotide sequences of HSD11B2 BINDING SITE1 and HSD11B2 BINDING SITE2, designated SEQ ID:13964 and SEQ ID:15068 respectively, to the nucleotide sequence of GAM8297 RNA, herein designated GAM RNA, also designated SEQ ID:367.

Another function of GAM8297 is therefore inhibition of Hydroxysteroid (11-beta) dehydrogenase 2 (HSD11B2, Accession NP_000187.2). Accordingly, utilities of GAM8297 include diagnosis, prevention and treatment of diseases and clinical conditions associated with HSD11B2.

Heat shock 70 kda protein 5 (glucose-regulated protein, 78 kda) (HSPA5, Accession NP_005338.1) is another GAM8297 target gene, herein designated TARGET GENE. HSPA5 BINDING SITE is a target binding site found in the 3' untranslated region of mRNA encoded by HSPA5, corresponding to a target binding site such as BINDING SITE I, BINDING SITE II or BINDING SITE III of FIG. 8. Table 4 illustrates the complementarity of the nucleotide sequences of HSPA5 BINDING SITE, designated SEQ ID:12356, to the nucleotide sequence of GAM8297 RNA, herein designated GAM RNA, also designated SEQ ID:367.

Another function of GAM8297 is therefore inhibition of Heat shock 70 kda protein 5 (glucose-regulated protein, 78 kda) (HSPA5, Accession NP_005338.1), a gene which is involved in the folding and assembly of proteins in the endoplasmic reticulum (ER). Accordingly, utilities of GAM8297 include diagnosis, prevention and treatment of diseases and clinical conditions associated with HSPA5.

The function of HSPA5 and its association with various diseases and clinical conditions, has been established by previous studies, as described hereinabove with reference to GAM72.1. Interferon-induced protein with tetratricopeptide repeats 2 (IFIT2, Accession NP_001538.2) is another GAM8297 target gene, herein designated TARGET GENE. IFIT2 BINDING SITE is a target binding site found in the 3' untranslated region of mRNA encoded by IFIT2, corresponding to a target binding site such as BINDING SITE I, BINDING SITE II or BINDING SITE III of FIG. 8. Table 4 illustrates the complementarity of the nucleotide sequences of IFIT2 BINDING SITE, designated SEQ ID:13164, to the nucleotide sequence of GAM8297 RNA, herein designated GAM RNA, also designated SEQ ID:367.

Another function of GAM8297 is therefore inhibition of Interferon-induced protein with tetratricopeptide repeats 2 (IFIT2, Accession NP_001538.2). Accordingly, utilities of GAM8297 include diagnosis, prevention and treatment of diseases and clinical conditions associated with IFIT2.

Interleukin 17d (IL17D, Accession NP_612141.1) is another GAM8297 target gene, herein designated TARGET GENE. IL17D BINDING SITE is a target binding site found in the 3' untranslated region of mRNA encoded by IL17D, corresponding to a target binding site such as BINDING SITE I, BINDING SITE II or BINDING SITE III of FIG. 8. Table 4 illustrates the complementarity of the nucleotide sequences of IL17D BINDING SITE, designated SEQ ID:1766, to the nucleotide sequence of GAM8297 RNA, herein designated GAM RNA, also designated SEQ ID:367.

Another function of GAM8297 is therefore inhibition of Interleukin 17d (IL17D, Accession NP_612141.1). Accordingly, utilities of GAM8297 include diagnosis, prevention and treatment of diseases and clinical conditions associated with IL17D.

Interleukin 8 receptor, alpha (IL8RA, Accession NP_000625.1) is another GAM8297 target gene, herein designated TARGET GENE. IL8RA BINDING SITE is a target binding site found in the 5' untranslated region of mRNA encoded by IL8RA, corresponding to a target binding site such as BINDING SITE I, BINDING SITE II or BINDING SITE III of FIG. 8. Table 4 illustrates the complementarity of the nucleotide sequences of IL8RA BINDING SITE, designated SEQ ID:1110, to the nucleotide sequence of GAM8297 RNA, herein designated GAM RNA, also designated SEQ ID:367.

Another function of GAM8297 is therefore inhibition of Interleukin 8 receptor, alpha (IL8RA, Accession NP_000625.1), a gene which is the receptor to interleukin-8, which is a powerful neutrophils chemotactic factor. Accordingly, utilities of GAM8297 include diagnosis, prevention and treatment of diseases and clinical conditions associated with IL8RA.

The function of IL8RA and its association with various diseases and clinical conditions, has been established by previous studies, as described hereinabove with reference to GAM680.1. Insulin receptor substrate 3-like (IRS3L, Accession XP_295210.1) is another GAM8297 target gene, herein designated TARGET GENE. IRS3L BINDING SITE is a target binding site found in the 5' untranslated region of mRNA encoded by IRS3L, corresponding to a target binding site such as BINDING SITE I, BINDING SITE II or BINDING SITE III of FIG. 8. Table 4 illustrates the complementarity of the nucleotide sequences of IRS3L BINDING SITE, designated SEQ ID:14904, to the nucleotide sequence of GAM8297 RNA, herein designated GAM RNA, also designated SEQ ID:367.

Another function of GAM8297 is therefore inhibition of Insulin receptor substrate 3-like (IRS3L, Accession XP_295210.1). Accordingly, utilities of GAM8297 include diagnosis, prevention and treatment of diseases and clinical conditions associated with IRS3L.

Jade-1 (Accession NP_079176.2) is another GAM8297 target gene, herein designated TARGET GENE. Jade-1 BINDING SITE is a target binding site found in the 3' untranslated region of mRNA encoded by Jade-1, corresponding to a target binding site such as BINDING SITE I, BINDING SITE II or BINDING SITE III of FIG. 8. Table 4 illustrates the complementarity of the nucleotide sequences of Jade-1 BINDING SITE, designated SEQ ID:7801, to the nucleotide sequence of GAM8297 RNA, herein designated GAM RNA, also designated SEQ ID:367.

Another function of GAM8297 is therefore inhibition of Jade-1 (Accession NP_079176.2). Accordingly, utilities of GAM8297 include diagnosis, prevention and treatment of diseases and clinical conditions associated with Jade-1.

Potassium voltage-gated channel, shaker-related subfamily, member 6 (KCNA6, Accession NP_002226.1) is another GAM8297 target gene, herein designated TARGET GENE. KCNA6 BINDING SITE is a target binding site found in the 3' untranslated region of mRNA encoded by KCNA6, corresponding to a target binding site such as BINDING SITE I, BINDING SITE II or BINDING SITE III of FIG. 8. Table 4 illustrates the complementarity of the nucleotide sequences of KCNA6 BINDING SITE, designated SEQ ID:12111, to the nucleotide sequence of GAM8297 RNA, herein designated GAM RNA, also designated SEQ ID:367.

Another function of GAM8297 is therefore inhibition of Potassium voltage-gated channel, shaker-related subfamily, member 6 (KCNA6, Accession NP_002226.1), a gene which mediates the voltage-dependent potassium ion permeability of excitable membranes. Accordingly, utilities of GAM8297 include diagnosis, prevention and treatment of diseases and clinical conditions associated with KCNA6.

The function of KCNA6 and its association with various diseases and clinical conditions, has been established by previous studies, as described hereinabove with reference to GAM63.1. KCNIP4 (Accession NP_671711.1) is another GAM8297 target gene, herein designated TARGET GENE.

KCNIP4 BINDING SITE is a target binding site found in the 5' untranslated region of multiple transcripts of mRNA encoded by KCNIP4, corresponding to a target binding site such as BINDING SITE I, BINDING SITE II or BINDING SITE III of FIG. 8. Table 4 illustrates the complementarity of the nucleotide sequences of KCNIP4 BINDING SITE, designated SEQ ID:4158, to the nucleotide sequence of GAM8297 RNA, herein designated GAM RNA, also designated SEQ ID:367.

Another function of GAM8297 is therefore inhibition of KCNIP4 (Accession NP_671711.1). Accordingly, utilities of GAM8297 include diagnosis, prevention and treatment of diseases and clinical conditions associated with KCNIP4.

KIAA0040 (Accession NP_055471.1) is another GAM8297 target gene, herein designated TARGET GENE. KIAA0040 BINDING SITE is a target binding site found in the 3' untranslated region of mRNA encoded by KIAA0040, corresponding to a target binding site such as BINDING SITE I, BINDING SITE II or BINDING SITE III of FIG. 8. Table 4 illustrates the complementarity of the nucleotide sequences of KIAA0040 BINDING SITE, designated SEQ ID:1670, to the nucleotide sequence of GAM8297 RNA, herein designated GAM RNA, also designated SEQ ID:367.

Another function of GAM8297 is therefore inhibition of KIAA0040 (Accession NP_055471.1). Accordingly, utilities of GAM8297 include diagnosis, prevention and treatment of diseases and clinical conditions associated with KIAA0040.

KIAA0125 (Accession NP_055607.1) is another GAM8297 target gene, herein designated TARGET GENE. KIAA0125 BINDING SITE is a target binding site found in the 3' untranslated region of mRNA encoded by KIAA0125, corresponding to a target binding site such as BINDING SITE I, BINDING SITE II or BINDING SITE III of FIG. 8. Table 4 illustrates the complementarity of the nucleotide sequences of KIAA0125 BINDING SITE, designated SEQ ID:5670, to the nucleotide sequence of GAM8297 RNA, herein designated GAM RNA, also designated SEQ ID:367.

Another function of GAM8297 is therefore inhibition of KIAA0125 (Accession NP_055607.1). Accordingly, utilities of GAM8297 include diagnosis, prevention and treatment of diseases and clinical conditions associated with KIAA0125.

KIAA0265 (Accession XP_045954.2) is another GAM8297 target gene, herein designated TARGET GENE. KIAA0265 BINDING SITE is a target binding site found in the 3' untranslated region of mRNA encoded by KIAA0265, corresponding to a target binding site such as BINDING SITE I, BINDING SITE II or BINDING SITE III of FIG. 8. Table 4 illustrates the complementarity of the nucleotide sequences of KIAA0265 BINDING SITE, designated SEQ ID:7732, to the nucleotide sequence of GAM8297 RNA, herein designated GAM RNA, also designated SEQ ID:367.

Another function of GAM8297 is therefore inhibition of KIAA0265 (Accession XP_045954.2). Accordingly, utilities of GAM8297 include diagnosis, prevention and treatment of diseases and clinical conditions associated with KIAA0265.

KIAA0295 (Accession XP_042833.2) is another GAM8297 target gene, herein designated TARGET GENE. KIAA0295 BINDING SITE is a target binding site found in the 3' untranslated region of mRNA encoded by KIAA0295, corresponding to a target binding site such as BINDING SITE I, BINDING SITE II or BINDING SITE III of FIG. 8. Table 4 illustrates the complementarity of the nucleotide sequences of KIAA0295 BINDING SITE, designated SEQ ID:12348, to the nucleotide sequence of GAM8297 RNA, herein designated GAM RNA, also designated SEQ ID:367.

Another function of GAM8297 is therefore inhibition of KIAA0295 (Accession XP_042833.2). Accordingly, utilities of GAM8297 include diagnosis, prevention and treatment of diseases and clinical conditions associated with KIAA0295.

KIAA0296 (Accession NP_055514.1) is another GAM8297 target gene, herein designated TARGET GENE. KIAA0296 BINDING SITE is a target binding site found in the 3' untranslated region of mRNA encoded by KIAA0296, corresponding to a target binding site such as BINDING SITE I, BINDING SITE II or BINDING SITE III of FIG. 8. Table 4 illustrates the complementarity of the nucleotide sequences of KIAA0296 BINDING SITE, designated SEQ ID:19626, to the nucleotide sequence of GAM8297 RNA, herein designated GAM RNA, also designated SEQ ID:367.

Another function of GAM8297 is therefore inhibition of KIAA0296 (Accession NP_055514.1). Accordingly, utilities of GAM8297 include diagnosis, prevention and treatment of diseases and clinical conditions associated with KIAA0296.

KIAA0377 (Accession NP_055474.1) is another GAM8297 target gene, herein designated TARGET GENE. KIAA0377 BINDING SITE is a target binding site found in the 3' untranslated region of mRNA encoded by KIAA0377, corresponding to a target binding site such as BINDING SITE I, BINDING SITE II or BINDING SITE III of FIG. 8. Table 4 illustrates the complementarity of the nucleotide sequences of KIAA0377 BINDING SITE, designated SEQ ID:4379, to the nucleotide sequence of GAM8297 RNA, herein designated GAM RNA, also designated SEQ ID:367.

Another function of GAM8297 is therefore inhibition of KIAA0377 (Accession NP_055474.1). Accordingly, utilities of GAM8297 include diagnosis, prevention and treatment of diseases and clinical conditions associated with KIAA0377.

KIAA0657 (Accession XP_051017.2) is another GAM8297 target gene, herein designated TARGET GENE. KIAA0657 BINDING SITE is a target binding site found in the 3' untranslated region of mRNA encoded by KIAA0657, corresponding to a target binding site such as BINDING SITE I, BINDING SITE II or BINDING SITE III of FIG. 8. Table 4 illustrates the complementarity of the nucleotide sequences of KIAA0657 BINDING SITE, designated SEQ ID:15617, to the nucleotide sequence of GAM8297 RNA, herein designated GAM RNA, also designated SEQ ID:367.

Another function of GAM8297 is therefore inhibition of KIAA0657 (Accession XP_051017.2). Accordingly, utilities of GAM8297 include diagnosis, prevention and treatment of diseases and clinical conditions associated with KIAA0657.

KIAA0795 (Accession NP_079286.1) is another GAM8297 target gene, herein designated TARGET GENE. KIAA0795 BINDING SITE is a target binding site found in the 5' untranslated region of mRNA encoded by KIAA0795, corresponding to a target binding site such as BINDING SITE I, BINDING SITE II or BINDING SITE III of FIG. 8. Table 4 illustrates the complementarity of the nucleotide sequences of KIAA0795 BINDING SITE, designated SEQ ID:18730, to the nucleotide sequence of GAM8297 RNA, herein designated GAM RNA, also designated SEQ ID:367.

Another function of GAM8297 is therefore inhibition of KIAA0795 (Accession NP_079286.1). Accordingly, utilities of GAM8297 include diagnosis, prevention and treatment of diseases and clinical conditions associated with KIAA0795.

KIAA0953 (Accession XP_039733.2) is another GAM8297 target gene, herein designated TARGET GENE. KIAA0953 BINDING SITE is a target binding site found in the 3' untranslated region of mRNA encoded by KIAA0953, corresponding to a target binding site such as BINDING SITE I, BINDING SITE II or BINDING SITE III of FIG. 8. Table 4 illustrates the complementarity of the nucleotide sequences of KIAA0953 BINDING SITE, designated SEQ ID:4538, to the nucleotide sequence of GAM8297 RNA, herein designated GAM RNA, also designated SEQ ID:367.

Another function of GAM8297 is therefore inhibition of KIAA0953 (Accession XP_039733.2). Accordingly, utilities of GAM8297 include diagnosis, prevention and treatment of diseases and clinical conditions associated with KIAA0953.

KIAA1010 (Accession XP_050742.5) is another GAM8297 target gene, herein designated TARGET GENE. KIAA1010 BINDING SITE is a target binding site found in the 3' untranslated region of mRNA encoded by KIAA1010, corresponding to a target binding site such as BINDING SITE I, BINDING SITE II or BINDING SITE III of FIG. 8. Table 4 illustrates the complementarity of the nucleotide sequences of KIAA1010 BINDING SITE, designated SEQ ID:19015, to the nucleotide sequence of GAM8297 RNA, herein designated GAM RNA, also designated SEQ ID:367.

Another function of GAM8297 is therefore inhibition of KIAA1010 (Accession XP_050742.5). Accordingly, utilities of GAM8297 include diagnosis, prevention and treatment of diseases and clinical conditions associated with KIAA1010.

KIAA1069 (Accession XP_042635.3) is another GAM8297 target gene, herein designated TARGET GENE. KIAA1069 BINDING SITE is a target binding site found in the 3' untranslated region of mRNA encoded by KIAA1069, corresponding to a target binding site such as BINDING SITE I, BINDING SITE II or BINDING SITE III of FIG. 8. Table 4 illustrates the complementarity of the nucleotide sequences of KIAA1069 BINDING SITE, designated SEQ ID:5233, to the nucleotide sequence of GAM8297 RNA, herein designated GAM RNA, also designated SEQ ID:367.

Another function of GAM8297 is therefore inhibition of KIAA1069 (Accession XP_042635.3). Accordingly, utilities of GAM8297 include diagnosis, prevention and treatment of diseases and clinical conditions associated with KIAA1069.

KIAA1126 (Accession XP_050325.1) is another GAM8297 target gene, herein designated TARGET GENE. KIAA1126 BINDING SITE is a target binding site found in the 3' untranslated region of mRNA encoded by KIAA1126, corresponding to a target binding site such as BINDING SITE I, BINDING SITE II or BINDING SITE III of FIG. 8. Table 4 illustrates the complementarity of the nucleotide sequences of KIAA1126 BINDING SITE, designated SEQ ID:18824, to the nucleotide sequence of GAM8297 RNA, herein designated GAM RNA, also designated SEQ ID:367.

Another function of GAM8297 is therefore inhibition of KIAA1126 (Accession XP_050325.1). Accordingly, utilities of GAM8297 include diagnosis, prevention and treatment of diseases and clinical conditions associated with KIAA1126.

KIAA1198 (Accession NP_065765.1) is another GAM8297 target gene, herein designated TARGET GENE. KIAA1198 BINDING SITE is a target binding site found in the 3' untranslated region of mRNA encoded by KIAA1198, corresponding to a target binding site such as BINDING SITE I, BINDING SITE II or BINDING SITE III of FIG. 8. Table 4 illustrates the complementarity of the nucleotide sequences of KIAA1198 BINDING SITE, designated SEQ ID:12870, to the nucleotide sequence of GAM8297 RNA, herein designated GAM RNA, also designated SEQ ID:367.

Another function of GAM8297 is therefore inhibition of KIAA1198 (Accession NP_065765.1). Accordingly, utilities of GAM8297 include diagnosis, prevention and treatment of diseases and clinical conditions associated with KIAA1198.

KIAA1271 (Accession XP_045472.1) is another GAM8297 target gene, herein designated TARGET GENE. KIAA1271 BINDING SITE is a target binding site found in the 3' untranslated region of mRNA encoded by KIAA1271, corresponding to a target binding site such as BINDING SITE I, BINDING SITE II or BINDING SITE III of FIG. 8. Table 4 illustrates the complementarity of the nucleotide sequences of KIAA1271 BINDING SITE, designated SEQ ID:11062, to the nucleotide sequence of GAM8297 RNA, herein designated GAM RNA, also designated SEQ ID:367.

Another function of GAM8297 is therefore inhibition of KIAA1271 (Accession XP_045472.1). Accordingly, utilities of GAM8297 include diagnosis, prevention and treatment of diseases and clinical conditions associated with KIAA1271.

KIAA1322 (Accession NP_065824.1) is another GAM8297 target gene, herein designated TARGET GENE. KIAA1322 BINDING SITE is a target binding site found in the 3' untranslated region of mRNA encoded by KIAA1322, corresponding to a target binding site such as BINDING SITE I, BINDING SITE II or BINDING SITE III of FIG. 8. Table 4 illustrates the complementarity of the nucleotide sequences of KIAA1322 BINDING SITE, designated SEQ ID:6018, to the nucleotide sequence of GAM8297 RNA, herein designated GAM RNA, also designated SEQ ID:367.

Another function of GAM8297 is therefore inhibition of KIAA1322 (Accession NP_065824.1). Accordingly, utilities of GAM8297 include diagnosis, prevention and treatment of diseases and clinical conditions associated with KIAA1322.

KIAA1328 (Accession XP_029429.4) is another GAM8297 target gene, herein designated TARGET GENE. KIAA1328 BINDING SITE is a target binding site found in the 3' untranslated region of mRNA encoded by KIAA1328, corresponding to a target binding site such as BINDING SITE I, BINDING SITE II or BINDING SITE III of FIG. 8. Table 4 illustrates the complementarity of the nucleotide sequences of KIAA1328 BINDING SITE, designated SEQ ID:11039, to the nucleotide sequence of GAM8297 RNA, herein designated GAM RNA, also designated SEQ ID:367.

Another function of GAM8297 is therefore inhibition of KIAA1328 (Accession XP_029429.4). Accordingly, utilities of GAM8297 include diagnosis, prevention and treatment of diseases and clinical conditions associated with KIAA1328.

KIAA1372 (Accession XP_290527.1) is another GAM8297 target gene, herein designated TARGET GENE. KIAA1372 BINDING SITE is a target binding site found in the 3' untranslated region of mRNA encoded by KIAA1372, corresponding to a target binding site such as BINDING SITE I, BINDING SITE II or BINDING SITE III of FIG. 8. Table 4 illustrates the complementarity of the nucleotide sequences of KIAA1372 BINDING SITE, designated SEQ ID:11705, to the nucleotide sequence of GAM8297 RNA, herein designated GAM RNA, also designated SEQ ID:367.

Another function of GAM8297 is therefore inhibition of KIAA1372 (Accession XP_290527.1). Accordingly, utilities of GAM8297 include diagnosis, prevention and treatment of diseases and clinical conditions associated with KIAA1372.

KIAA1798 (Accession XP_027074.3) is another GAM8297 target gene, herein designated TARGET GENE. KIAA1798 BINDING SITE is a target binding site found in the 3' untranslated region of mRNA encoded by KIAA1798, corresponding to a target binding site such as BINDING SITE I, BINDING SITE II or BINDING SITE III of FIG. 8. Table 4 illustrates the complementarity of the nucleotide sequences of KIAA1798 BINDING SITE, designated SEQ ID:8257, to the nucleotide sequence of GAM8297 RNA, herein designated GAM RNA, also designated SEQ ID:367.

Another function of GAM8297 is therefore inhibition of KIAA1798 (Accession XP_027074.3). Accordingly, utilities of GAM8297 include diagnosis, prevention and treatment of diseases and clinical conditions associated with KIAA1798.

KIAA1937 (Accession XP_057107.3) is another GAM8297 target gene, herein designated TARGET GENE. KIAA1937 BINDING SITE is a target binding site found in the 3' untranslated region of mRNA encoded by KIAA1937, corresponding to a target binding site such as BINDING SITE I, BINDING SITE II or BINDING SITE III of FIG. 8. Table 4 illustrates the complementarity of the nucleotide sequences of KIAA1937 BINDING SITE, designated SEQ ID:15618, to the nucleotide sequence of GAM8297 RNA, herein designated GAM RNA, also designated SEQ ID:367.

Another function of GAM8297 is therefore inhibition of KIAA1937 (Accession XP_057107.3). Accordingly, utilities of GAM8297 include diagnosis, prevention and treatment of diseases and clinical conditions associated with KIAA1937.

KIAA1999 (Accession XP_114447.2) is another GAM8297 target gene, herein designated TARGET GENE. KIAA1999 BINDING SITE is a target binding site found in the 3' untranslated region of mRNA encoded by KIAA1999, corresponding to a target binding site such as BINDING SITE I, BINDING SITE II or BINDING SITE III of FIG. 8. Table 4 illustrates the complementarity of the nucleotide sequences of KIAA1999 BINDING SITE, designated SEQ ID:7678, to the nucleotide sequence of GAM8297 RNA, herein designated GAM RNA, also designated SEQ ID:367.

Another function of GAM8297 is therefore inhibition of KIAA1999 (Accession XP_114447.2). Accordingly, utilities of GAM8297 include diagnosis, prevention and treatment of diseases and clinical conditions associated with KIAA1999.

Kinesin heavy chain member 2 (KIF2, Accession NP_004511.1) is another GAM8297 target gene, herein designated TARGET GENE. KIF2 BINDING SITE is a target binding site found in the 3' untranslated region of mRNA encoded by KIF2, corresponding to a target binding site such as BINDING SITE I, BINDING SITE II or BINDING SITE III of FIG. 8. Table 4 illustrates the complementarity of the nucleotide sequences of KIF2 BINDING SITE, designated SEQ ID:4157, to the nucleotide sequence of GAM8297 RNA, herein designated GAM RNA, also designated SEQ ID:367.

Another function of GAM8297 is therefore inhibition of Kinesin heavy chain member 2 (KIF2, Accession NP_004511.1). Accordingly, utilities of GAM8297 include diagnosis, prevention and treatment of diseases and clinical conditions associated with KIF2.

Kallikrein 10 (KLK10, Accession NP_002767.2) is another GAM8297 target gene, herein designated TARGET GENE. KLK10 BINDING SITE is a target binding site found in the 3' untranslated region of multiple transcripts of mRNA encoded by KLK10, corresponding to a target binding site such as BINDING SITE I, BINDING SITE II or BINDING SITE III of FIG. 8. Table 4 illustrates the complementarity of the nucleotide sequences of KLK10 BINDING SITE, designated SEQ ID:17457, to the nucleotide sequence of GAM8297 RNA, herein designated GAM RNA, also designated SEQ ID:367.

Another function of GAM8297 is therefore inhibition of Kallikrein 10 (KLK10, Accession NP_002767.2), a gene which has a tumor-suppressor role in breast and prostate cancer. Accordingly, utilities of GAM8297 include diagnosis, prevention and treatment of diseases and clinical conditions associated with KLK10.

The function of KLK10 and its association with various diseases and clinical conditions, has been established by previous studies, as described hereinabove with reference to GAM234.1. Kallikrein 10 (KLK10, Accession NP_665895.1) is another GAM8297 target gene, herein designated TARGET GENE. KLK10 BINDING SITE is a target binding site found in the 3' untranslated region of multiple transcripts of mRNA encoded by KLK10, corresponding to a target binding site such as BINDING SITE I, BINDING SITE II or BINDING SITE III of FIG. 8. Table 4 illustrates the complementarity of the nucleotide sequences of KLK10 BINDING SITE, designated SEQ ID:17457, to the nucleotide sequence of GAM8297 RNA, herein designated GAM RNA, also designated SEQ ID:367.

Another function of GAM8297 is therefore inhibition of Kallikrein 10 (KLK10, Accession NP_665895.1), a gene which has a tumor-suppressor role in breast and prostate cancer. Accordingly, utilities of GAM8297 include diagnosis, prevention and treatment of diseases and clinical conditions associated with KLK10.

The function of KLK10 and its association with various diseases and clinical conditions, has been established by previous studies, as described hereinabove with reference to GAM234.1. Karyopherin alpha 3 (importin alpha 4) (KPNA3, Accession NP_002258.1) is another GAM8297 target gene, herein designated TARGET GENE. KPNA3 BINDING SITE is a target binding site found in the 3' untranslated region of mRNA encoded by KPNA3, corresponding to a target binding site such as BINDING SITE I, BINDING SITE II or BINDING SITE III of FIG. 8. Table 4 illustrates the complementarity of the nucleotide sequences of KPNA3 BINDING SITE, designated SEQ ID:3939, to the nucleotide sequence of GAM8297 RNA, herein designated GAM RNA, also designated SEQ ID:367.

Another function of GAM8297 is therefore inhibition of Karyopherin alpha 3 (importin alpha 4) (KPNA3, Accession NP_002258.1), a gene which seems to act as a cytosolic receptor for both simple and bipartite nls motifs. Accordingly, utilities of GAM8297 include diagnosis, prevention and treatment of diseases and clinical conditions associated with KPNA3.

The function of KPNA3 and its association with various diseases and clinical conditions, has been established by previous studies, as described hereinabove with reference to GAM67.1. Keratin 8 (KRT8, Accession NP_002264.1) is another GAM8297 target gene, herein designated TARGET GENE. KRT8 BINDING SITE is a target binding site found in the 3' untranslated region of mRNA encoded by KRT8, corresponding to a target binding site such as BINDING SITE I, BINDING SITE II or BINDING SITE III of FIG. 8. Table 4 illustrates the complementarity of the nucleotide sequences of KRT8 BINDING SITE, designated SEQ ID:9986, to the nucleotide sequence of GAM8297 RNA, herein designated GAM RNA, also designated SEQ ID:367.

Another function of GAM8297 is therefore inhibition of Keratin 8 (KRT8, Accession NP_002264.1), a gene which may form intermediate filaments; type II keratin, member of a family of structural proteins and therefore may be associated with Cirrhosis, cryptogenic. Accordingly, utilities of GAM8297 include diagnosis, prevention and treatment of Cirrhosis, cryptogenic, and of other diseases and clinical conditions associated with KRT8.

The function of KRT8 and its association with various diseases and clinical conditions, has been established by previous studies, as described hereinabove with reference to GAM374.2. Lag1 longevity assurance homolog 1 (s. cerevisiae) (LASS1, Accession NP_067090.1) is another GAM8297 target gene, herein designated TARGET GENE. LASS1 BINDING SITE is a target binding site found in the 3' untranslated region of mRNA encoded by LASS1, corresponding to a target binding site such as BINDING SITE I, BINDING SITE II or BINDING SITE III of FIG. 8. Table 4 illustrates the complementarity of the nucleotide sequences of LASS1 BINDING SITE, designated SEQ ID:8142, to the nucleotide sequence of GAM8297 RNA, herein designated GAM RNA, also designated SEQ ID:367.

Another function of GAM8297 is therefore inhibition of Lag1 longevity assurance homolog 1 (s. cerevisiae) (LASS1, Accession NP_067090.1), a gene which may mediate cell differentiation events during embryonic development. Accordingly, utilities of GAM8297 include diagnosis, prevention and treatment of diseases and clinical conditions associated with LASS1.

The function of LASS1 and its association with various diseases and clinical conditions, has been established by previous studies, as described hereinabove with reference to GAM223.1. Leucine-rich repeat lgi family, member 3 (LGI3, Accession NP_644807.1) is another GAM8297 target gene, herein designated TARGET GENE. LGI3 BINDING SITE is a target binding site found in the 3' untranslated region of mRNA encoded by LGI3, corresponding to a target binding site such as BINDING SITE I, BINDING SITE II or BINDING SITE III of FIG. 8. Table 4 illustrates the complementarity of the nucleotide sequences of LGI3 BINDING SITE, designated SEQ ID:566, to the nucleotide sequence of GAM8297 RNA, herein designated GAM RNA, also designated SEQ ID:367.

Another function of GAM8297 is therefore inhibition of Leucine-rich repeat lgi family, member 3 (LGI3, Accession NP_644807.1). Accordingly, utilities of GAM8297 include diagnosis, prevention and treatment of diseases and clinical conditions associated with LGI3.

Lim and senescent cell antigen-like domains 1 (LIMS1, Accession NP_004978.2) is another GAM8297 target gene, herein designated TARGET GENE. LIMS1 BINDING SITE is a target binding site found in the 5' untranslated region of mRNA encoded by LIMS1, corresponding to a target binding site such as BINDING SITE I, BINDING SITE II or BINDING SITE III of FIG. 8. Table 4 illustrates the complementarity of the nucleotide sequences of LIMS1 BINDING SITE, designated SEQ ID:9951, to the nucleotide sequence of GAM8297 RNA, herein designated GAM RNA, also designated SEQ ID:367.

Another function of GAM8297 is therefore inhibition of Lim and senescent cell antigen-like domains 1 (LIMS1, Accession NP_004978.2). Accordingly, utilities of GAM8297 include diagnosis, prevention and treatment of diseases and clinical conditions associated with LIMS1.

LOC114987 (Accession NP_660284.1) is another GAM8297 target gene, herein designated TARGET GENE. LOC114987 BINDING SITE is a target binding site found in the 3' untranslated region of mRNA encoded by LOC114987, corresponding to a target binding site such as BINDING SITE I, BINDING SITE II or BINDING SITE III of FIG. 8. Table 4 illustrates the complementarity of the nucleotide sequences of LOC114987 BINDING SITE, designated SEQ ID:7181, to the nucleotide sequence of GAM8297 RNA, herein designated GAM RNA, also designated SEQ ID:367.

Another function of GAM8297 is therefore inhibition of LOC114987 (Accession NP_660284.1). Accordingly, utilities of GAM8297 include diagnosis, prevention and treatment of diseases and clinical conditions associated with LOC114987.

LOC115219 (Accession XP_055499.2) is another GAM8297 target gene, herein designated TARGET GENE. LOC115219 BINDING SITE is a target binding site found in the 5' untranslated region of mRNA encoded by LOC115219, corresponding to a target binding site such as BINDING SITE I, BINDING SITE II or BINDING SITE III of FIG. 8. Table 4 illustrates the complementarity of the nucleotide sequences of LOC115219 BINDING SITE, designated SEQ ID:12944, to the nucleotide sequence of GAM8297 RNA, herein designated GAM RNA, also designated SEQ ID:367.

Another function of GAM8297 is therefore inhibition of LOC115219 (Accession XP_055499.2). Accordingly, utilities of GAM8297 include diagnosis, prevention and treatment of diseases and clinical conditions associated with LOC115219.

LOC121301 (Accession XP_062574.2) is another GAM8297 target gene, herein designated TARGET GENE. LOC121301 BINDING SITE is a target binding site found in the 5' untranslated region of mRNA encoded by LOC121301, corresponding to a target binding site such as BINDING SITE I, BINDING SITE II or BINDING SITE III of FIG. 8. Table 4 illustrates the complementarity of the nucleotide sequences of LOC121301 BINDING SITE, designated SEQ ID:18517, to the nucleotide sequence of GAM8297 RNA, herein designated GAM RNA, also designated SEQ ID:367.

Another function of GAM8297 is therefore inhibition of LOC121301 (Accession XP_062574.2). Accordingly, utilities of GAM8297 include diagnosis, prevention and treatment of diseases and clinical conditions associated with LOC121301.

LOC122664 (Accession NP_776245.1) is another GAM8297 target gene, herein designated TARGET GENE. LOC122664 BINDING SITE is a target binding site found in the 5' untranslated region of mRNA encoded by LOC122664, corresponding to a target binding site such as BINDING SITE I, BINDING SITE II or BINDING SITE III of FIG. 8. Table 4 illustrates the complementarity of the nucleotide sequences of LOC122664 BINDING SITE, designated SEQ ID:10278, to the nucleotide sequence of GAM8297 RNA, herein designated GAM RNA, also designated SEQ ID:367.

Another function of GAM8297 is therefore inhibition of LOC122664 (Accession NP_776245.1). Accordingly, utilities of GAM8297 include diagnosis, prevention and treatment of diseases and clinical conditions associated with LOC122664.

LOC126616 (Accession XP_059059.1) is another GAM8297 target gene, herein designated TARGET GENE. LOC126616 BINDING SITE is a target binding site found in the 5' untranslated region of mRNA encoded by LOC126616, corresponding to a target binding site such as BINDING SITE I, BINDING SITE II or BINDING SITE III of FIG. 8. Table 4 illustrates the complementarity of the nucleotide sequences of LOC126616 BINDING SITE, designated SEQ ID:17931, to the nucleotide sequence of GAM8297 RNA, herein designated GAM RNA, also designated SEQ ID:367.

Another function of GAM8297 is therefore inhibition of LOC126616 (Accession XP_059059.1). Accordingly, utilities of GAM8297 include diagnosis, prevention and treatment of diseases and clinical conditions associated with LOC126616.

LOC127540 (Accession XP_059164.6) is another GAM8297 target gene, herein designated TARGET GENE. LOC127540 BINDING SITE is a target binding site found in the 5' untranslated region of multiple transcripts of mRNA encoded by LOC127540, corresponding to a target binding site such as BINDING SITE I, BINDING SITE II or BINDING SITE III of FIG. 8. Table 4 illustrates the complementarity of the nucleotide sequences of LOC127540 BINDING SITE, designated SEQ ID:8397, to the nucleotide sequence of GAM8297 RNA, herein designated GAM RNA, also designated SEQ ID:367.

Another function of GAM8297 is therefore inhibition of LOC127540 (Accession XP_059164.6). Accordingly, utilities of GAM8297 include diagnosis, prevention and treatment of diseases and clinical conditions associated with LOC127540.

LOC136345 (Accession XP_072455.2) is another GAM8297 target gene, herein designated TARGET GENE. LOC136345 BINDING SITE is a target binding site found in the 3' untranslated region of mRNA encoded by LOC136345, corresponding to a target binding site such as BINDING SITE I, BINDING SITE II or BINDING SITE III of FIG. 8. Table 4 illustrates the complementarity of the nucleotide sequences of LOC136345 BINDING SITE, designated SEQ ID:12191, to the nucleotide sequence of GAM8297 RNA, herein designated GAM RNA, also designated SEQ ID:367.

Another function of GAM8297 is therefore inhibition of LOC136345 (Accession XP_072455.2). Accordingly, utilities of GAM8297 include diagnosis, prevention and treatment of diseases and clinical conditions associated with LOC136345.

LOC139201 (Accession XP_208439.1) is another GAM8297 target gene, herein designated TARGET GENE. LOC139201 BINDING SITE is a target binding site found in the 3' untranslated region of mRNA encoded by LOC139201, corresponding to a target binding site such as BINDING SITE I, BINDING SITE II or BINDING SITE III of FIG. 8. Table 4 illustrates the complementarity of the nucleotide sequences of LOC139201 BINDING SITE, designated SEQ ID:10411, to the nucleotide sequence of GAM8297 RNA, herein designated GAM RNA, also designated SEQ ID:367.

Another function of GAM8297 is therefore inhibition of LOC139201 (Accession XP_208439.1). Accordingly, utilities of GAM8297 include diagnosis, prevention and treatment of diseases and clinical conditions associated with LOC139201.

LOC143458 (Accession NP_777562.1) is another GAM8297 target gene, herein designated TARGET GENE. LOC143458 BINDING SITE is a target binding site found in the 3' untranslated region of mRNA encoded by LOC143458, corresponding to a target binding site such as BINDING SITE I, BINDING SITE II or BINDING SITE III of FIG. 8. Table 4 illustrates the complementarity of the nucleotide sequences of LOC143458 BINDING SITE, designated SEQ ID:10575, to the nucleotide sequence of GAM8297 RNA, herein designated GAM RNA, also designated SEQ ID:367.

Another function of GAM8297 is therefore inhibition of LOC143458 (Accession NP_777562.1). Accordingly, utilities of GAM8297 include diagnosis, prevention and treatment of diseases and clinical conditions associated with LOC143458.

LOC145828 (Accession XP_096879.1) is another GAM8297 target gene, herein designated TARGET GENE. LOC145828 BINDING SITE is a target binding site found in the 5' untranslated region of mRNA encoded by LOC145828, corresponding to a target binding site such as BINDING SITE I, BINDING SITE II or BINDING SITE III of FIG. 8. Table 4 illustrates the complementarity of the nucleotide sequences of LOC145828 BINDING SITE, designated SEQ ID:7193, to the nucleotide sequence of GAM8297 RNA, herein designated GAM RNA, also designated SEQ ID:367.

Another function of GAM8297 is therefore inhibition of LOC145828 (Accession XP_096879.1). Accordingly, utilities of GAM8297 include diagnosis, prevention and treatment of diseases and clinical conditions associated with LOC145828.

LOC147991 (Accession XP_085993.3) is another GAM8297 target gene, herein designated TARGET GENE. LOC147991 BINDING SITE is a target binding site found in the 3' untranslated region of mRNA encoded by LOC147991, corresponding to a target binding site such as BINDING SITE I, BINDING SITE II or BINDING SITE III of FIG. 8. Table 4 illustrates the complementarity of the nucleotide sequences of LOC147991 BINDING SITE, designated SEQ ID:9617, to the nucleotide sequence of GAM8297 RNA, herein designated GAM RNA, also designated SEQ ID:367.

Another function of GAM8297 is therefore inhibition of LOC147991 (Accession XP_085993.3). Accordingly, utilities of GAM8297 include diagnosis, prevention and treatment of diseases and clinical conditions associated with LOC147991.

LOC149420 (Accession NP_690048.1) is another GAM8297 target gene, herein designated TARGET GENE. LOC149420 BINDING SITE is a target binding site found in the 3' untranslated region of mRNA encoded by LOC149420, corresponding to a target binding site such as BINDING SITE I, BINDING SITE II or BINDING SITE III of FIG. 8. Table 4 illustrates the complementarity of the nucleotide sequences of LOC149420 BINDING SITE, designated SEQ ID:8650, to the nucleotide sequence of GAM8297 RNA, herein designated GAM RNA, also designated SEQ ID:367.

Another function of GAM8297 is therefore inhibition of LOC149420 (Accession NP_690048.1). Accordingly, utilities of GAM8297 include diagnosis, prevention and treatment of diseases and clinical conditions associated with LOC149420.

LOC149703 (Accession XP_097719.1) is another GAM8297 target gene, herein designated TARGET GENE. LOC149703 BINDING SITE is a target binding site found in the 5' untranslated region of mRNA encoded by LOC149703, corresponding to a target binding site such as BINDING SITE I, BINDING SITE II or BINDING SITE III of FIG. 8. Table 4 illustrates the complementarity of the nucleotide sequences of LOC149703 BINDING SITE, designated SEQ ID:18798, to the nucleotide sequence of GAM8297 RNA, herein designated GAM RNA, also designated SEQ ID:367.

Another function of GAM8297 is therefore inhibition of LOC149703 (Accession XP_097719.1). Accordingly, utilities of GAM8297 include diagnosis, prevention and treatment of diseases and clinical conditions associated with LOC149703.

LOC150763 (Accession XP_086996.2) is another GAM8297 target gene, herein designated TARGET GENE. LOC150763 BINDING SITE is a target binding site found in the 5' untranslated region of mRNA encoded by LOC150763, corresponding to a target binding site such as BINDING SITE I, BINDING SITE II or BINDING SITE III of FIG. 8. Table 4 illustrates the complementarity of the nucleotide sequences of LOC150763 BINDING SITE, designated SEQ ID:18707, to the nucleotide sequence of GAM8297 RNA, herein designated GAM RNA, also designated SEQ ID:367.

Another function of GAM8297 is therefore inhibition of LOC150763 (Accession XP_086996.2). Accordingly, utilities of GAM8297 include diagnosis, prevention and treatment of diseases and clinical conditions associated with LOC150763.

LOC151154 (Accession XP_098008.1) is another GAM8297 target gene, herein designated TARGET GENE. LOC151154 BINDING SITE is a target binding site found in the 5' untranslated region of mRNA encoded by LOC151154, corresponding to a target binding site such as BINDING SITE I, BINDING SITE II or BINDING SITE III of FIG. 8. Table 4 illustrates the complementarity of the nucleotide sequences of LOC151154 BINDING SITE, designated SEQ ID:798, to the nucleotide sequence of GAM8297 RNA, herein designated GAM RNA, also designated SEQ ID:367.

Another function of GAM8297 is therefore inhibition of LOC151154 (Accession XP_098008.1). Accordingly, utilities of GAM8297 include diagnosis, prevention and treatment of diseases and clinical conditions associated with LOC151154.

LOC151178 (Accession XP_087117.1) is another GAM8297 target gene, herein designated TARGET GENE. LOC151178 BINDING SITE is a target binding site found in the 5' untranslated region of mRNA encoded by LOC151178, corresponding to a target binding site such as BINDING SITE I, BINDING SITE II or BINDING SITE III of FIG. 8. Table 4 illustrates the complementarity of the nucleotide sequences of LOC151178 BINDING SITE, designated SEQ ID:4822, to the nucleotide sequence of GAM8297 RNA, herein designated GAM RNA, also designated SEQ ID:367.

Another function of GAM8297 is therefore inhibition of LOC151178 (Accession XP_087117.1). Accordingly, utilities of GAM8297 include diagnosis, prevention and treatment of diseases and clinical conditions associated with LOC151178.

LOC153516 (Accession NP_612500.1) is another GAM8297 target gene, herein designated TARGET GENE. LOC153516 BINDING SITE1 and LOC153516 BINDING SITE2 are target binding sites found in untranslated regions of mRNA encoded by LOC153516, corresponding to target binding sites such as BINDING SITE I, BINDING SITE II or BINDING SITE III of FIG. 8. Table 4 illustrates the complementarity of the nucleotide sequences of LOC153516 BINDING SITE1 and LOC153516 BINDING SITE2, designated SEQ ID:7669 and SEQ ID:9799 respectively, to the nucleotide sequence of GAM8297 RNA, herein designated GAM RNA, also designated SEQ ID:367.

Another function of GAM8297 is therefore inhibition of LOC153516 (Accession NP_612500.1). Accordingly, utilities of GAM8297 include diagnosis, prevention and treatment of diseases and clinical conditions associated with LOC153516.

LOC155008 (Accession XP_088116.2) is another GAM8297 target gene, herein designated TARGET GENE. LOC155008 BINDING SITE is a target binding site found in the 5' untranslated region of mRNA encoded by LOC155008, corresponding to a target binding site such as BINDING SITE I, BINDING SITE II or BINDING SITE III of FIG. 8. Table 4 illustrates the complementarity of the nucleotide sequences of LOC155008 BINDING SITE, designated SEQ ID:7006, to the nucleotide sequence of GAM8297 RNA, herein designated GAM RNA, also designated SEQ ID:367.

Another function of GAM8297 is therefore inhibition of LOC155008 (Accession XP_088116.2). Accordingly, utilities of GAM8297 include diagnosis, prevention and treatment of diseases and clinical conditions associated with LOC155008.

LOC155032 (Accession XP_098647.1) is another GAM8297 target gene, herein designated TARGET GENE. LOC155032 BINDING SITE is a target binding site found in the 5' untranslated region of mRNA encoded by LOC155032, corresponding to a target binding site such as BINDING SITE I, BINDING SITE II or BINDING SITE III of FIG. 8. Table 4 illustrates the complementarity of the nucleotide sequences of LOC155032 BINDING SITE, designated SEQ ID:12191, to the nucleotide sequence of GAM8297 RNA, herein designated GAM RNA, also designated SEQ ID:367.

Another function of GAM8297 is therefore inhibition of LOC155032 (Accession XP_098647.1). Accordingly, utilities of GAM8297 include diagnosis, prevention and treatment of diseases and clinical conditions associated with LOC155032.

LOC158014 (Accession XP_088442.1) is another GAM8297 target gene, herein designated TARGET GENE. LOC158014 BINDING SITE is a target binding site found in the 5' untranslated region of mRNA encoded by LOC158014, corresponding to a target binding site such as BINDING SITE I, BINDING SITE II or BINDING SITE III of FIG. 8. Table 4 illustrates the complementarity of the nucleotide sequences of LOC158014 BINDING SITE, designated SEQ ID:13911, to the nucleotide sequence of GAM8297 RNA, herein designated GAM RNA, also designated SEQ ID:367.

Another function of GAM8297 is therefore inhibition of LOC158014 (Accession XP_088442.1). Accordingly, utilities of GAM8297 include diagnosis, prevention and treatment of diseases and clinical conditions associated with LOC158014.

LOC158062 (Accession XP_098861.2) is another GAM8297 target gene, herein designated TARGET GENE. LOC158062 BINDING SITE is a target binding site found in the 3' untranslated region of mRNA encoded by LOC158062, corresponding to a target binding site such as BINDING SITE I, BINDING SITE II or BINDING SITE III of FIG. 8. Table 4 illustrates the complementarity of the nucleotide sequences of LOC158062 BINDING SITE, designated SEQ ID:6216, to the nucleotide sequence of GAM8297 RNA, herein designated GAM RNA, also designated SEQ ID:367.

Another function of GAM8297 is therefore inhibition of LOC158062 (Accession XP_098861.2). Accordingly, utilities of GAM8297 include diagnosis, prevention and treatment of diseases and clinical conditions associated with LOC158062.

LOC158436 (Accession XP_098942.1) is another GAM8297 target gene, herein designated TARGET GENE. LOC158436 BINDING SITE is a target binding site found in the 5' untranslated region of mRNA encoded by LOC158436, corresponding to a target binding site such as BINDING SITE I, BINDING SITE II or BINDING SITE III of FIG. 8. Table 4 illustrates the complementarity of the nucleotide sequences of LOC158436 BINDING SITE, designated SEQ ID:17142, to the nucleotide sequence of GAM8297 RNA, herein designated GAM RNA, also designated SEQ ID:367.

Another function of GAM8297 is therefore inhibition of LOC158436 (Accession XP_098942.1). Accordingly, utilities of GAM8297 include diagnosis, prevention and treatment of diseases and clinical conditions associated with LOC158436.

LOC159121 (Accession XP_099028.1) is another GAM8297 target gene, herein designated TARGET GENE. LOC159121 BINDING SITE is a target binding site found in the 5' untranslated region of mRNA encoded by LOC159121, corresponding to a target binding site such as BINDING SITE I, BINDING SITE II or BINDING SITE III of FIG. 8. Table 4 illustrates the complementarity of the nucleotide sequences of LOC159121 BINDING SITE, designated SEQ ID:16800, to the nucleotide sequence of GAM8297 RNA, herein designated GAM RNA, also designated SEQ ID:367.

Another function of GAM8297 is therefore inhibition of LOC159121 (Accession XP_099028.1). Accordingly, utilities of GAM8297 include diagnosis, prevention and treatment of diseases and clinical conditions associated with LOC159121.

LOC168667 (Accession XP_166592.1) is another GAM8297 target gene, herein designated TARGET GENE. LOC168667 BINDING SITE is a target binding site found in the 3' untranslated region of mRNA encoded by LOC168667, corresponding to a target binding site such as BINDING SITE I, BINDING SITE II or BINDING SITE III of FIG. 8. Table 4 illustrates the complementarity of the nucleotide sequences of LOC168667 BINDING SITE, designated SEQ ID:1796, to the nucleotide sequence of GAM8297 RNA, herein designated GAM RNA, also designated SEQ ID:367.

Another function of GAM8297 is therefore inhibition of LOC168667 (Accession XP_166592.1). Accordingly, utilities of GAM8297 include diagnosis, prevention and treatment of diseases and clinical conditions associated with LOC168667.

LOC197322 (Accession NP_777577.1) is another GAM8297 target gene, herein designated TARGET GENE. LOC197322 BINDING SITE is a target binding site found in the 3' untranslated region of mRNA encoded by LOC197322, corresponding to a target binding site such as BINDING SITE I, BINDING SITE II or BINDING SITE III of FIG. 8. Table 4 illustrates the complementarity of the nucleotide sequences of LOC197322 BINDING SITE, designated SEQ ID:16515, to the nucleotide sequence of GAM8297 RNA, herein designated GAM RNA, also designated SEQ ID:367.

Another function of GAM8297 is therefore inhibition of LOC197322 (Accession NP_777577.1). Accordingly, utilities of GAM8297 include diagnosis, prevention and treatment of diseases and clinical conditions associated with LOC197322.

LOC200197 (Accession XP_114148.1) is another GAM8297 target gene, herein designated TARGET GENE. LOC200197 BINDING SITE is a target binding site found in the 3' untranslated region of mRNA encoded by LOC200197, corresponding to a target binding site such as BINDING SITE I, BINDING SITE II or BINDING SITE III of FIG. 8. Table 4 illustrates the complementarity of the nucleotide sequences of LOC200197 BINDING SITE, designated SEQ ID:9656, to the nucleotide sequence of GAM8297 RNA, herein designated GAM RNA, also designated SEQ ID:367.

Another function of GAM8297 is therefore inhibition of LOC200197 (Accession XP_114148.1). Accordingly, utilities of GAM8297 include diagnosis, prevention and treatment of diseases and clinical conditions associated with LOC200197.

LOC202024 (Accession XP_114422.3) is another GAM8297 target gene, herein designated TARGET GENE. LOC202024 BINDING SITE is a target binding site found in the 3' untranslated region of mRNA encoded by LOC202024, corresponding to a target binding site such as BINDING SITE I, BINDING SITE II or BINDING SITE III of FIG. 8. Table 4 illustrates the complementarity of the nucleotide sequences of LOC202024 BINDING SITE, designated SEQ ID:5326, to the nucleotide sequence of GAM8297 RNA, herein designated GAM RNA, also designated SEQ ID:367.

Another function of GAM8297 is therefore inhibition of LOC202024 (Accession XP_114422.3). Accordingly, utilities of GAM8297 include diagnosis, prevention and treatment of diseases and clinical conditions associated with LOC202024.

LOC219347 (Accession XP_167564.2) is another GAM8297 target gene, herein designated TARGET GENE. LOC219347 BINDING SITE is a target binding site found in the 3' untranslated region of mRNA encoded by LOC219347, corresponding to a target binding site such as BINDING SITE I, BINDING SITE II or BINDING SITE III of FIG. 8. Table 4 illustrates the complementarity of the nucleotide sequences of LOC219347 BINDING SITE, designated SEQ ID:9192, to the nucleotide sequence of GAM8297 RNA, herein designated GAM RNA, also designated SEQ ID:367.

Another function of GAM8297 is therefore inhibition of LOC219347 (Accession XP_167564.2). Accordingly, utilities of GAM8297 include diagnosis, prevention and treatment of diseases and clinical conditions associated with LOC219347.

LOC220686 (Accession XP_167540.4) is another GAM8297 target gene, herein designated TARGET GENE. LOC220686 BINDING SITE is a target binding site found in the 3' untranslated region of mRNA encoded by LOC220686, corresponding to a target binding site such as BINDING SITE I, BINDING SITE II or BINDING SITE III of FIG. 8. Table 4 illustrates the complementarity of the nucleotide sequences of LOC220686 BINDING SITE, designated SEQ ID:10547, to the nucleotide sequence of GAM8297 RNA, herein designated GAM RNA, also designated SEQ ID:367.

Another function of GAM8297 is therefore inhibition of LOC220686 (Accession XP_167540.4). Accordingly, utilities of GAM8297 include diagnosis, prevention and treatment of diseases and clinical conditions associated with LOC220686.

LOC221061 (Accession XP_167709.1) is another GAM8297 target gene, herein designated TARGET GENE. LOC221061 BINDING SITE1 and LOC221061 BINDING SITE2 are target binding sites found in untranslated regions of mRNA encoded by LOC221061, corresponding to target binding sites such as BINDING SITE I, BINDING SITE II or BINDING SITE III of FIG. 8. Table 4 illustrates the complementarity of the nucleotide sequences of LOC221061 BINDING SITE1 and LOC221061 BINDING SITE2, designated SEQ ID:19881 and SEQ ID:6759 respectively, to the nucleotide sequence of GAM8297 RNA, herein designated GAM RNA, also designated SEQ ID:367.

Another function of GAM8297 is therefore inhibition of LOC221061 (Accession XP_167709.1). Accordingly, utilities of GAM8297 include diagnosis, prevention and treatment of diseases and clinical conditions associated with LOC221061.

LOC221405 (Accession XP_168138.1) is another GAM8297 target gene, herein designated TARGET GENE. LOC221405 BINDING SITE is a target binding site found in the 5' untranslated region of mRNA encoded by LOC221405, corresponding to a target binding site such as BINDING SITE I, BINDING SITE II or BINDING SITE III of FIG. 8. Table 4 illustrates the complementarity of the nucleotide sequences of LOC221405 BINDING SITE, designated SEQ ID:8039, to the nucleotide sequence of GAM8297 RNA, herein designated GAM RNA, also designated SEQ ID:367.

Another function of GAM8297 is therefore inhibition of LOC221405 (Accession XP_168138.1). Accordingly, utilities of GAM8297 include diagnosis, prevention and treatment of diseases and clinical conditions associated with LOC221405.

LOC253017 (Accession XP_171068.2) is another GAM8297 target gene, herein designated TARGET GENE. LOC253017 BINDING SITE is a target binding site found in the 3' untranslated region of mRNA encoded by LOC253017, corresponding to a target binding site such as BINDING SITE I, BINDING SITE II or BINDING SITE III of FIG. 8. Table 4 illustrates the complementarity of the nucleotide sequences of LOC253017 BINDING SITE, designated SEQ ID:18869, to the nucleotide sequence of GAM8297 RNA, herein designated GAM RNA, also designated SEQ ID:367.

Another function of GAM8297 is therefore inhibition of LOC253017 (Accession XP_171068.2). Accordingly, utilities of GAM8297 include diagnosis, prevention and treatment of diseases and clinical conditions associated with LOC253017.

LOC253392 (Accession XP_172857.1) is another GAM8297 target gene, herein designated TARGET GENE. LOC253392 BINDING SITE is a target binding site found in the 5' untranslated region of mRNA encoded by LOC253392, corresponding to a target binding site such as BINDING SITE I, BINDING SITE II or BINDING SITE III of FIG. 8. Table 4 illustrates the complementarity of the nucleotide sequences of LOC253392 BINDING SITE, designated SEQ ID:8311, to the nucleotide sequence of GAM8297 RNA, herein designated GAM RNA, also designated SEQ ID:367.

Another function of GAM8297 is therefore inhibition of LOC253392 (Accession XP_172857.1). Accordingly, utilities of GAM8297 include diagnosis, prevention and treatment of diseases and clinical conditions associated with LOC253392.

LOC254111 (Accession XP_171440.3) is another GAM8297 target gene, herein designated TARGET GENE. LOC254111 BINDING SITE is a target binding site found in the 5' untranslated region of mRNA encoded by LOC254111, corresponding to a target binding site such as BINDING SITE I, BINDING SITE II or BINDING SITE III of FIG. 8. Table 4 illustrates the complementarity of the nucleotide sequences of LOC254111 BINDING SITE, designated SEQ ID:5139, to the nucleotide sequence of GAM8297 RNA, herein designated GAM RNA, also designated SEQ ID:367.

Another function of GAM8297 is therefore inhibition of LOC254111 (Accession XP_171440.3). Accordingly, utilities of GAM8297 include diagnosis, prevention and treatment of diseases and clinical conditions associated with LOC254111.

LOC255167 (Accession XP_173156.1) is another GAM8297 target gene, herein designated TARGET GENE. LOC255167 BINDING SITE is a target binding site found in the 5' untranslated region of mRNA encoded by LOC255167, corresponding to a target binding site such as BINDING SITE I, BINDING SITE II or BINDING SITE III of FIG. 8. Table 4 illustrates the complementarity of the nucleotide sequences of LOC255167 BINDING SITE, designated SEQ ID:7969, to the nucleotide sequence of GAM8297 RNA, herein designated GAM RNA, also designated SEQ ID:367.

Another function of GAM8297 is therefore inhibition of LOC255167 (Accession XP_173156.1). Accordingly, utilities of GAM8297 include diagnosis, prevention and treatment of diseases and clinical conditions associated with LOC255167.

LOC255975 (Accession XP_171083.2) is another GAM8297 target gene, herein designated TARGET GENE. LOC255975 BINDING SITE is a target binding site found in the 5' untranslated region of mRNA encoded by LOC255975, corresponding to a target binding site such as BINDING SITE I, BINDING SITE II or BINDING SITE III of FIG. 8. Table 4 illustrates the complementarity of the nucleotide sequences of LOC255975 BINDING SITE, designated SEQ ID:3149, to the nucleotide sequence of GAM8297 RNA, herein designated GAM RNA, also designated SEQ ID:367.

Another function of GAM8297 is therefore inhibition of LOC255975 (Accession XP_171083.2). Accordingly, utilities of GAM8297 include diagnosis, prevention and treatment of diseases and clinical conditions associated with LOC255975.

LOC256905 (Accession XP_173031.1) is another GAM8297 target gene, herein designated TARGET GENE. LOC256905 BINDING SITE is a target binding site found in the 3' untranslated region of mRNA encoded by LOC256905, corresponding to a target binding site such as BINDING SITE I, BINDING SITE II or BINDING SITE III of FIG. 8. Table 4 illustrates the complementarity of the nucleotide sequences of LOC256905 BINDING SITE, designated SEQ ID:18153, to the nucleotide sequence of GAM8297 RNA, herein designated GAM RNA, also designated SEQ ID:367.

Another function of GAM8297 is therefore inhibition of LOC256905 (Accession XP_173031.1). Accordingly, utilities of GAM8297 include diagnosis, prevention and treatment of diseases and clinical conditions associated with LOC256905.

LOC257085 (Accession XP_173226.1) is another GAM8297 target gene, herein designated TARGET GENE. LOC257085 BINDING SITE is a target binding site found in the 3' untranslated region of mRNA encoded by LOC257085, corresponding to a target binding site such as BINDING SITE I, BINDING SITE II or BINDING SITE III of FIG. 8. Table 4 illustrates the complementarity of the nucleotide sequences of LOC257085 BINDING SITE, designated SEQ ID:11089, to the nucleotide sequence of GAM8297 RNA, herein designated GAM RNA, also designated SEQ ID:367.

Another function of GAM8297 is therefore inhibition of LOC257085 (Accession XP_173226.1). Accordingly, utilities of GAM8297 include diagnosis, prevention and treatment of diseases and clinical conditions associated with LOC257085.

LOC283046 (Accession XP_208495.1) is another GAM8297 target gene, herein designated TARGET GENE. LOC283046 BINDING SITE is a target binding site found in the 5' untranslated region of mRNA encoded by LOC283046, corresponding to a target binding site such as BINDING SITE I, BINDING SITE II or BINDING SITE III of FIG. 8. Table 4 illustrates the complementarity of the nucleotide sequences of LOC283046 BINDING SITE, designated SEQ ID:7748, to the nucleotide sequence of GAM8297 RNA, herein designated GAM RNA, also designated SEQ ID:367.

Another function of GAM8297 is therefore inhibition of LOC283046 (Accession XP_208495.1). Accordingly, utilities of GAM8297 include diagnosis, prevention and treatment of diseases and clinical conditions associated with LOC283046.

LOC283073 (Accession XP_210880.1) is another GAM8297 target gene, herein designated TARGET GENE. LOC283073 BINDING SITE is a target binding site found in the 5' untranslated region of mRNA encoded by LOC283073, corresponding to a target binding site such as BINDING SITE I, BINDING SITE II or BINDING SITE III of FIG. 8. Table 4 illustrates the complementarity of the nucleotide sequences of LOC283073 BINDING SITE, designated SEQ ID:6474, to the nucleotide sequence of GAM8297 RNA, herein designated GAM RNA, also designated SEQ ID:367.

Another function of GAM8297 is therefore inhibition of LOC283073 (Accession XP_210880.1). Accordingly, utilities of GAM8297 include diagnosis, prevention and treatment of diseases and clinical conditions associated with LOC283073.

LOC283168 (Accession XP_210910.1) is another GAM8297 target gene, herein designated TARGET GENE. LOC283168 BINDING SITE is a target binding site found in the 5' untranslated region of mRNA encoded by LOC283168, corresponding to a target binding site such as BINDING SITE I, BINDING SITE II or BINDING SITE III of FIG. 8. Table 4 illustrates the complementarity of the nucleotide sequences of LOC283168 BINDING SITE, designated SEQ ID:7758, to the nucleotide sequence of GAM8297 RNA, herein designated GAM RNA, also designated SEQ ID:367.

Another function of GAM8297 is therefore inhibition of LOC283168 (Accession XP_210910.1). Accordingly, utilities of GAM8297 include diagnosis, prevention and treatment of diseases and clinical conditions associated with LOC283168.

LOC283205 (Accession XP_210941.1) is another GAM8297 target gene, herein designated TARGET GENE. LOC283205 BINDING SITE is a target binding site found in the 5' untranslated region of mRNA encoded by LOC283205, corresponding to a target binding site such as BINDING SITE I, BINDING SITE II or BINDING SITE III of FIG. 8. Table 4 illustrates the complementarity of the nucleotide sequences of LOC283205 BINDING SITE, designated SEQ ID:12493, to the nucleotide sequence of GAM8297 RNA, herein designated GAM RNA, also designated SEQ ID:367.

Another function of GAM8297 is therefore inhibition of LOC283205 (Accession XP_210941.1). Accordingly, utilities of GAM8297 include diagnosis, prevention and treatment of diseases and clinical conditions associated with LOC283205.

LOC283271 (Accession XP_208600.1) is another GAM8297 target gene, herein designated TARGET GENE. LOC283271 BINDING SITE is a target binding site found in the 3' untranslated region of mRNA encoded by LOC283271, corresponding to a target binding site such as BINDING SITE I, BINDING SITE II or BINDING SITE III of FIG. 8. Table 4 illustrates the complementarity of the nucleotide sequences of LOC283271 BINDING SITE, designated SEQ ID:17415, to the nucleotide sequence of GAM8297 RNA, herein designated GAM RNA, also designated SEQ ID:367.

Another function of GAM8297 is therefore inhibition of LOC283271 (Accession XP_208600.1). Accordingly, utilities of GAM8297 include diagnosis, prevention and treatment of diseases and clinical conditions associated with LOC283271.

LOC283274 (Accession XP_210957.1) is another GAM8297 target gene, herein designated TARGET GENE. LOC283274 BINDING SITE is a target binding site found in the 5' untranslated region of mRNA encoded by LOC283274, corresponding to a target binding site such as BINDING SITE I, BINDING SITE II or BINDING SITE III of FIG. 8. Table 4 illustrates the complementarity of the nucleotide sequences of LOC283274 BINDING SITE, designated SEQ ID:3938, to the nucleotide sequence of GAM8297 RNA, herein designated GAM RNA, also designated SEQ ID:367.

Another function of GAM8297 is therefore inhibition of LOC283274 (Accession XP_210957.1). Accordingly, utilities of GAM8297 include diagnosis, prevention and treatment of diseases and clinical conditions associated with LOC283274.

LOC283376 (Accession XP_211002.1) is another GAM8297 target gene, herein designated TARGET GENE. LOC283376 BINDING SITE is a target binding site found in the 5' untranslated region of mRNA encoded by LOC283376, corresponding to a target binding site such as BINDING SITE I, BINDING SITE II or BINDING SITE III of FIG. 8. Table 4 illustrates the complementarity of the nucleotide sequences of LOC283376 BINDING SITE, designated SEQ ID:17261, to the nucleotide sequence of GAM8297 RNA, herein designated GAM RNA, also designated SEQ ID:367.

Another function of GAM8297 is therefore inhibition of LOC283376 (Accession XP_211002.1). Accordingly, utilities of GAM8297 include diagnosis, prevention and treatment of diseases and clinical conditions associated with LOC283376.

LOC283532 (Accession XP_208096.1) is another GAM8297 target gene, herein designated TARGET GENE. LOC283532 BINDING SITE is a target binding site found in the 3' untranslated region of mRNA encoded by LOC283532, corresponding to a target binding site such as BINDING SITE I, BINDING SITE II or BINDING SITE III of FIG. 8. Table 4 illustrates the complementarity of the nucleotide sequences of LOC283532 BINDING SITE, designated SEQ ID:6241, to the nucleotide sequence of GAM8297 RNA, herein designated GAM RNA, also designated SEQ ID:367.

Another function of GAM8297 is therefore inhibition of LOC283532 (Accession XP_208096.1). Accordingly, utilities of GAM8297 include diagnosis, prevention and treatment of diseases and clinical conditions associated with LOC283532.

LOC283534 (Accession XP_211083.1) is another GAM8297 target gene, herein designated TARGET GENE. LOC283534 BINDING SITE is a target binding site found in the 3' untranslated region of mRNA encoded by LOC283534, corresponding to a target binding site such as BINDING SITE I, BINDING SITE II or BINDING SITE III of FIG. 8. Table 4 illustrates the complementarity of the nucleotide sequences of LOC283534 BINDING SITE, designated SEQ ID:16651, to the nucleotide sequence of GAM8297 RNA, herein designated GAM RNA, also designated SEQ ID:367.

Another function of GAM8297 is therefore inhibition of LOC283534 (Accession XP_211083.1). Accordingly, utilities of GAM8297 include diagnosis, prevention and treatment of diseases and clinical conditions associated with LOC283534.

LOC283744 (Accession XP_208817.1) is another GAM8297 target gene, herein designated TARGET GENE. LOC283744 BINDING SITE is a target binding site found in the 3' untranslated region of mRNA encoded by LOC283744, corresponding to a target binding site such as BINDING SITE I, BINDING SITE II or BINDING SITE III of FIG. 8. Table 4 illustrates the complementarity of the nucleotide sequences of LOC283744 BINDING SITE, designated SEQ ID:8051, to the nucleotide sequence of GAM8297 RNA, herein designated GAM RNA, also designated SEQ ID:367.

Another function of GAM8297 is therefore inhibition of LOC283744 (Accession XP_208817.1). Accordingly, utilities of GAM8297 include diagnosis, prevention and treatment of diseases and clinical conditions associated with LOC283744.

LOC283776 (Accession XP_211196.1) is another GAM8297 target gene, herein designated TARGET GENE. LOC283776 BINDING SITE is a target binding site found in the 5' untranslated region of mRNA encoded by LOC283776, corresponding to a target binding site such as BINDING SITE I, BINDING SITE II or BINDING SITE III of FIG. 8. Table 4 illustrates the complementarity of the nucleotide sequences of LOC283776 BINDING SITE, designated SEQ ID:9843, to the nucleotide sequence of GAM8297 RNA, herein designated GAM RNA, also designated SEQ ID:367.

Another function of GAM8297 is therefore inhibition of LOC283776 (Accession XP_211196.1). Accordingly, utilities of GAM8297 include diagnosis, prevention and treatment of diseases and clinical conditions associated with LOC283776.

LOC283778 (Accession XP_211199.1) is another GAM8297 target gene, herein designated TARGET GENE. LOC283778 BINDING SITE is a target binding site found in the 5' untranslated region of mRNA encoded by LOC283778, corresponding to a target binding site such as BINDING SITE I, BINDING SITE II or BINDING SITE III of FIG. 8. Table 4 illustrates the complementarity of the nucleotide sequences of LOC283778 BINDING SITE, designated SEQ ID:13762, to the nucleotide sequence of GAM8297 RNA, herein designated GAM RNA, also designated SEQ ID:367.

Another function of GAM8297 is therefore inhibition of LOC283778 (Accession XP_211199.1). Accordingly, utilities of GAM8297 include diagnosis, prevention and treatment of diseases and clinical conditions associated with LOC283778.

LOC283841 (Accession XP_211227.1) is another GAM8297 target gene, herein designated TARGET GENE. LOC283841 BINDING SITE is a target binding site found in the 3' untranslated region of mRNA encoded by LOC283841, corresponding to a target binding site such as BINDING SITE I, BINDING SITE II or BINDING SITE III of FIG. 8. Table 4 illustrates the complementarity of the nucleotide sequences of LOC283841 BINDING SITE, designated SEQ ID:10880, to the nucleotide sequence of GAM8297 RNA, herein designated GAM RNA, also designated SEQ ID:367.

Another function of GAM8297 is therefore inhibition of LOC283841 (Accession XP_211227.1). Accordingly, utilities of GAM8297 include diagnosis, prevention and treatment of diseases and clinical conditions associated with LOC283841.

LOC283932 (Accession NP_787097.1) is another GAM8297 target gene, herein designated TARGET GENE. LOC283932 BINDING SITE is a target binding site found in the 3' untranslated region of mRNA encoded by LOC283932, corresponding to a target binding site such as BINDING SITE I, BINDING SITE II or BINDING SITE III of FIG. 8. Table 4 illustrates the complementarity of the nucleotide sequences of LOC283932 BINDING SITE, designated SEQ ID:10210, to the nucleotide sequence of GAM8297 RNA, herein designated GAM RNA, also designated SEQ ID:367.

Another function of GAM8297 is therefore inhibition of LOC283932 (Accession NP_787097.1). Accordingly, utilities of GAM8297 include diagnosis, prevention and treatment of diseases and clinical conditions associated with LOC283932.

LOC284015 (Accession XP_210324.1) is another GAM8297 target gene, herein designated TARGET GENE. LOC284015 BINDING SITE is a target binding site found in the 5' untranslated region of mRNA encoded by LOC284015, corresponding to a target binding site such as BINDING SITE I, BINDING SITE II or BINDING SITE III of FIG. 8. Table 4 illustrates the complementarity of the nucleotide sequences of LOC284015 BINDING SITE, designated SEQ ID:14152, to the nucleotide sequence of GAM8297 RNA, herein designated GAM RNA, also designated SEQ ID:367.

Another function of GAM8297 is therefore inhibition of LOC284015 (Accession XP_210324.1). Accordingly, utilities of GAM8297 include diagnosis, prevention and treatment of diseases and clinical conditions associated with LOC284015.

LOC284061 (Accession XP_211318.1) is another GAM8297 target gene, herein designated TARGET GENE. LOC284061 BINDING SITE is a target binding site found in the 5' untranslated region of mRNA encoded by LOC284061, corresponding to a target binding site such as BINDING SITE I, BINDING SITE II or BINDING SITE III of FIG. 8. Table 4 illustrates the complementarity of the nucleotide sequences of LOC284061 BINDING SITE, designated SEQ ID:6093, to the nucleotide sequence of GAM8297 RNA, herein designated GAM RNA, also designated SEQ ID:367.

Another function of GAM8297 is therefore inhibition of LOC284061 (Accession XP_211318.1). Accordingly, utilities of GAM8297 include diagnosis, prevention and treatment of diseases and clinical conditions associated with LOC284061.

LOC284080 (Accession XP_211322.1) is another GAM8297 target gene, herein designated TARGET GENE. LOC284080 BINDING SITE is a target binding site found in the 5' untranslated region of mRNA encoded by LOC284080, corresponding to a target binding site such as BINDING SITE I, BINDING SITE II or BINDING SITE III of FIG. 8. Table 4 illustrates the complementarity of the nucleotide sequences of LOC284080 BINDING SITE, designated SEQ ID:875, to the nucleotide sequence of GAM8297 RNA, herein designated GAM RNA, also designated SEQ ID:367.

Another function of GAM8297 is therefore inhibition of LOC284080 (Accession XP_211322.1). Accordingly, utilities of GAM8297 include diagnosis, prevention and treatment of diseases and clinical conditions associated with LOC284080.

LOC284095 (Accession XP_211324.1) is another GAM8297 target gene, herein designated TARGET GENE. LOC284095 BINDING SITE1 and LOC284095 BINDING SITE2 are target binding sites found in untranslated regions of mRNA encoded by LOC284095, corresponding to target binding sites such as BINDING SITE I, BINDING SITE II or BINDING SITE III of FIG. 8. Table 4 illustrates the complementarity of the nucleotide sequences of LOC284095 BINDING SITE1 and LOC284095 BINDING SITE2, designated SEQ ID:812 and SEQ ID:3574 respectively, to the nucleotide sequence of GAM8297 RNA, herein designated GAM RNA, also designated SEQ ID:367.

Another function of GAM8297 is therefore inhibition of LOC284095 (Accession XP_211324.1). Accordingly, utilities of GAM8297 include diagnosis, prevention and treatment of diseases and clinical conditions associated with LOC284095.

LOC284113 (Accession XP_209021.1) is another GAM8297 target gene, herein designated TARGET GENE. LOC284113 BINDING SITE is a target binding site found in the 5' untranslated region of mRNA encoded by LOC284113, corresponding to a target binding site such as BINDING SITE I, BINDING SITE II or BINDING SITE III of FIG. 8. Table 4 illustrates the complementarity of the nucleotide sequences of LOC284113 BINDING SITE, designated SEQ ID:8034, to the nucleotide sequence of GAM8297 RNA, herein designated GAM RNA, also designated SEQ ID:367.

Another function of GAM8297 is therefore inhibition of LOC284113 (Accession XP_209021.1). Accordingly, utilities of GAM8297 include diagnosis, prevention and treatment of diseases and clinical conditions associated with LOC284113.

LOC284133 (Accession XP_211346.1) is another GAM8297 target gene, herein designated TARGET GENE. LOC284133 BINDING SITE is a target binding site found in the 3' untranslated region of mRNA encoded by LOC284133, corresponding to a target binding site such as BINDING SITE I, BINDING SITE II or BINDING SITE III of FIG. 8. Table 4 illustrates the complementarity of the nucleotide sequences of LOC284133 BINDING SITE, designated SEQ ID:7562, to the nucleotide sequence of GAM8297 RNA, herein designated GAM RNA, also designated SEQ ID:367.

Another function of GAM8297 is therefore inhibition of LOC284133 (Accession XP_211346.1). Accordingly, utilities of GAM8297 include diagnosis, prevention and treatment of diseases and clinical conditions associated with LOC284133.

LOC284252 (Accession XP_209091.1) is another GAM8297 target gene, herein designated TARGET GENE. LOC284252 BINDING SITE is a target binding site found in the 3' untranslated region of mRNA encoded by LOC284252, corresponding to a target binding site such as BINDING SITE I, BINDING SITE II or BINDING SITE III of FIG. 8. Table 4 illustrates the complementarity of the nucleotide sequences of LOC284252 BINDING SITE, designated SEQ ID:17032, to the nucleotide sequence of GAM8297 RNA, herein designated GAM RNA, also designated SEQ ID:367.

Another function of GAM8297 is therefore inhibition of LOC284252 (Accession XP_209091.1). Accordingly, utilities of GAM8297 include diagnosis, prevention and treatment of diseases and clinical conditions associated with LOC284252.

LOC284613 (Accession XP_209289.1) is another GAM8297 target gene, herein designated TARGET GENE. LOC284613 BINDING SITE is a target binding site found in the 3' untranslated region of mRNA encoded by LOC284613, corresponding to a target binding site such as BINDING SITE I, BINDING SITE II or BINDING SITE III of FIG. 8. Table 4 illustrates the complementarity of the nucleotide sequences of LOC284613 BINDING SITE, designated SEQ ID:6319, to the nucleotide sequence of GAM8297 RNA, herein designated GAM RNA, also designated SEQ ID:367.

Another function of GAM8297 is therefore inhibition of LOC284613 (Accession XP_209289.1). Accordingly, utilities of GAM8297 include diagnosis, prevention and treatment of diseases and clinical conditions associated with LOC284613.

LOC284642 (Accession XP_208231.1) is another GAM8297 target gene, herein designated TARGET GENE. LOC284642 BINDING SITE is a target binding site found in the 3' untranslated region of mRNA encoded by LOC284642, corresponding to a target binding site such as BINDING SITE I, BINDING SITE II or BINDING SITE III of FIG. 8. Table 4 illustrates the complementarity of the nucleotide sequences of LOC284642 BINDING SITE, designated SEQ ID:1268, to the nucleotide sequence of GAM8297 RNA, herein designated GAM RNA, also designated SEQ ID:367.

Another function of GAM8297 is therefore inhibition of LOC284642 (Accession XP_208231.1). Accordingly, utilities of GAM8297 include diagnosis, prevention and treatment of diseases and clinical conditions associated with LOC284642.

LOC284667 (Accession XP_010647.5) is another GAM8297 target gene, herein designated TARGET GENE. LOC284667 BINDING SITE is a target binding site found in the 3' untranslated region of multiple transcripts of mRNA encoded by LOC284667, corresponding to a target binding site such as BINDING SITE I, BINDING SITE II or BINDING SITE III of FIG. 8. Table 4 illustrates the complementarity of the nucleotide sequences of LOC284667 BINDING SITE, designated SEQ ID:16211, to the nucleotide sequence of GAM8297 RNA, herein designated GAM RNA, also designated SEQ ID:367.

Another function of GAM8297 is therefore inhibition of LOC284667 (Accession XP_010647.5). Accordingly, utilities of GAM8297 include diagnosis, prevention and treatment of diseases and clinical conditions associated with LOC284667.

LOC284732 (Accession XP_211608.1) is another GAM8297 target gene, herein designated TARGET GENE. LOC284732 BINDING SITE is a target binding site found in the 3' untranslated region of mRNA encoded by LOC284732, corresponding to a target binding site such as BINDING SITE I, BINDING SITE II or BINDING SITE III of FIG. 8. Table 4 illustrates the complementarity of the nucleotide sequences of LOC284732 BINDING SITE, designated SEQ ID:9135, to the nucleotide sequence of GAM8297 RNA, herein designated GAM RNA, also designated SEQ ID:367.

Another function of GAM8297 is therefore inhibition of LOC284732 (Accession XP_211608.1). Accordingly, utilities of GAM8297 include diagnosis, prevention and treatment of diseases and clinical conditions associated with LOC284732.

LOC284930 (Accession XP_211692.1) is another GAM8297 target gene, herein designated TARGET GENE. LOC284930 BINDING SITE is a target binding site found in the 5' untranslated region of mRNA encoded by LOC284930, corresponding to a target binding site such as BINDING SITE I, BINDING SITE II or BINDING SITE III of FIG. 8. Table 4 illustrates the complementarity of the nucleotide sequences of LOC284930 BINDING SITE, designated SEQ ID:11674, to the nucleotide sequence of GAM8297 RNA, herein designated GAM RNA, also designated SEQ ID:367.

Another function of GAM8297 is therefore inhibition of LOC284930 (Accession XP_211692.1). Accordingly, utilities of GAM8297 include diagnosis, prevention and treatment of diseases and clinical conditions associated with LOC284930.

LOC285033 (Accession XP_211739.1) is another GAM8297 target gene, herein designated TARGET GENE. LOC285033 BINDING SITE is a target binding site found in the 5' untranslated region of mRNA encoded by LOC285033, corresponding to a target binding site such as BINDING SITE I, BINDING SITE II or BINDING SITE III of FIG. 8. Table 4 illustrates the complementarity of the nucleotide sequences of LOC285033 BINDING SITE, designated SEQ ID:13545, to the nucleotide sequence of GAM8297 RNA, herein designated GAM RNA, also designated SEQ ID:367.

Another function of GAM8297 is therefore inhibition of LOC285033 (Accession XP_211739.1). Accordingly, utilities of GAM8297 include diagnosis, prevention and treatment of diseases and clinical conditions associated with LOC285033.

LOC285052 (Accession XP_211751.1) is another GAM8297 target gene, herein designated TARGET GENE. LOC285052 BINDING SITE is a target binding site found in the 3' untranslated region of mRNA encoded by LOC285052, corresponding to a target binding site such as BINDING SITE I, BINDING SITE II or BINDING SITE III of FIG. 8. Table 4 illustrates the complementarity of the nucleotide sequences of LOC285052 BINDING SITE, designated SEQ ID:20075, to the nucleotide sequence of GAM8297 RNA, herein designated GAM RNA, also designated SEQ ID:367.

Another function of GAM8297 is therefore inhibition of LOC285052 (Accession XP_211751.1). Accordingly, utilities of GAM8297 include diagnosis, prevention and treatment of diseases and clinical conditions associated with LOC285052.

LOC285152 (Accession XP_211783.1) is another GAM8297 target gene, herein designated TARGET GENE. LOC285152 BINDING SITE is a target binding site found in the 5' untranslated region of mRNA encoded by LOC285152, corresponding to a target binding site such as BINDING SITE I, BINDING SITE II or BINDING SITE III of FIG. 8. Table 4 illustrates the complementarity of the nucleotide sequences of LOC285152 BINDING SITE, designated SEQ ID:20164, to the nucleotide sequence of GAM8297 RNA, herein designated GAM RNA, also designated SEQ ID:367.

Another function of GAM8297 is therefore inhibition of LOC285152 (Accession XP_211783.1). Accordingly, utilities of GAM8297 include diagnosis, prevention and treatment of diseases and clinical conditions associated with LOC285152.

LOC285397 (Accession XP_211876.1) is another GAM8297 target gene, herein designated TARGET GENE. LOC285397 BINDING SITE is a target binding site found in the 5' untranslated region of mRNA encoded by LOC285397, corresponding to a target binding site such as BINDING SITE I, BINDING SITE II or BINDING SITE III of FIG. 8. Table 4 illustrates the complementarity of the nucleotide sequences of LOC285397 BINDING SITE, designated SEQ ID:5993, to the nucleotide sequence of GAM8297 RNA, herein designated GAM RNA, also designated SEQ ID:367.

Another function of GAM8297 is therefore inhibition of LOC285397 (Accession XP_211876.1). Accordingly, utilities of GAM8297 include diagnosis, prevention and treatment of diseases and clinical conditions associated with LOC285397.

LOC285467 (Accession XP_211907.1) is another GAM8297 target gene, herein designated TARGET GENE. LOC285467 BINDING SITE is a target binding site found in the 3' untranslated region of mRNA encoded by LOC285467, corresponding to a target binding site such as BINDING SITE I, BINDING SITE II or BINDING SITE III of FIG. 8. Table 4 illustrates the complementarity of the nucleotide sequences of LOC285467 BINDING SITE, designated SEQ ID:19782, to the nucleotide sequence of GAM8297 RNA, herein designated GAM RNA, also designated SEQ ID:367.

Another function of GAM8297 is therefore inhibition of LOC285467 (Accession XP_211907.1). Accordingly, utilities of GAM8297 include diagnosis, prevention and treatment of diseases and clinical conditions associated with LOC285467.

LOC285488 (Accession XP_211914.1) is another GAM8297 target gene, herein designated TARGET GENE. LOC285488 BINDING SITE is a target binding site found in the 3' untranslated region of mRNA encoded by LOC285488, corresponding to a target binding site such as BINDING SITE I, BINDING SITE II or BINDING SITE III of FIG. 8. Table 4 illustrates the complementarity of the nucleotide sequences of LOC285488 BINDING SITE, designated SEQ ID:15176, to the nucleotide sequence of GAM8297 RNA, herein designated GAM RNA, also designated SEQ ID:367.

Another function of GAM8297 is therefore inhibition of LOC285488 (Accession XP_211914.1). Accordingly, utilities of GAM8297 include diagnosis, prevention and treatment of diseases and clinical conditions associated with LOC285488.

LOC285638 (Accession XP_209693.1) is another GAM8297 target gene, herein designated TARGET GENE. LOC285638 BINDING SITE is a target binding site found in the 5' untranslated region of mRNA encoded by LOC285638, corresponding to a target binding site such as BINDING SITE I, BINDING SITE II or BINDING SITE III of FIG. 8. Table 4 illustrates the complementarity of the nucleotide sequences of LOC285638 BINDING SITE, designated SEQ ID:12828, to the nucleotide sequence of GAM8297 RNA, herein designated GAM RNA, also designated SEQ ID:367.

Another function of GAM8297 is therefore inhibition of LOC285638 (Accession XP_209693.1). Accordingly, utilities of GAM8297 include diagnosis, prevention and treatment of diseases and clinical conditions associated with LOC285638.

LOC285708 (Accession XP_209729.1) is another GAM8297 target gene, herein designated TARGET GENE. LOC285708 BINDING SITE is a target binding site found in the 5' untranslated region of mRNA encoded by LOC285708, corresponding to a target binding site such as BINDING SITE I, BINDING SITE II or BINDING SITE III of FIG. 8. Table 4 illustrates the complementarity of the nucleotide sequences of LOC285708 BINDING SITE, designated SEQ ID:1780, to the nucleotide sequence of GAM8297 RNA, herein designated GAM RNA, also designated SEQ ID:367.

Another function of GAM8297 is therefore inhibition of LOC285708 (Accession XP_209729.1). Accordingly, utilities of GAM8297 include diagnosis, prevention and treatment of diseases and clinical conditions associated with LOC285708.

LOC285843 (Accession XP_212034.1) is another GAM8297 target gene, herein designated TARGET GENE. LOC285843 BINDING SITE is a target binding site found in the 5' untranslated region of mRNA encoded by LOC285843, corresponding to a target binding site such as BINDING SITE I, BINDING SITE II or BINDING SITE III of FIG. 8. Table 4 illustrates the complementarity of the nucleotide sequences of LOC285843 BINDING SITE, designated SEQ ID:679, to the nucleotide sequence of GAM8297 RNA, herein designated GAM RNA, also designated SEQ ID:367.

Another function of GAM8297 is therefore inhibition of LOC285843 (Accession XP_212034.1). Accordingly, utilities of GAM8297 include diagnosis, prevention and treatment of diseases and clinical conditions associated with LOC285843.

LOC286044 (Accession XP_212150.1) is another GAM8297 target gene, herein designated TARGET GENE. LOC286044 BINDING SITE is a target binding site found in the 3' untranslated region of mRNA encoded by LOC286044, corresponding to a target binding site such as BINDING SITE I, BINDING SITE II or BINDING SITE III of FIG. 8. Table 4 illustrates the complementarity of the nucleotide sequences of LOC286044 BINDING SITE, designated SEQ ID:5140, to the nucleotide sequence of GAM8297 RNA, herein designated GAM RNA, also designated SEQ ID:367.

Another function of GAM8297 is therefore inhibition of LOC286044 (Accession XP_212150.1). Accordingly, utilities of GAM8297 include diagnosis, prevention and treatment of diseases and clinical conditions associated with LOC286044.

LOC286055 (Accession XP_210815.1) is another GAM8297 target gene, herein designated TARGET GENE. LOC286055 BINDING SITE is a target binding site found in the 5' untranslated region of mRNA encoded by LOC286055, corresponding to a target binding site such as BINDING SITE I, BINDING SITE II or BINDING SITE III of FIG. 8. Table 4 illustrates the complementarity of the nucleotide sequences of LOC286055 BINDING SITE, designated SEQ ID:4656, to the nucleotide sequence of GAM8297 RNA, herein designated GAM RNA, also designated SEQ ID:367.

Another function of GAM8297 is therefore inhibition of LOC286055 (Accession XP_210815.1). Accordingly, utilities of GAM8297 include diagnosis, prevention and treatment of diseases and clinical conditions associated with LOC286055.

LOC286059 (Accession XP_212156.1) is another GAM8297 target gene, herein designated TARGET GENE.

LOC286059 BINDING SITE is a target binding site found in the 3' untranslated region of mRNA encoded by LOC286059, corresponding to a target binding site such as BINDING SITE I, BINDING SITE II or BINDING SITE III of FIG. 8. Table 4 illustrates the complementarity of the nucleotide sequences of LOC286059 BINDING SITE, designated SEQ ID:8210, to the nucleotide sequence of GAM8297 RNA, herein designated GAM RNA, also designated SEQ ID:367.

Another function of GAM8297 is therefore inhibition of LOC286059 (Accession XP_212156.1). Accordingly, utilities of GAM8297 include diagnosis, prevention and treatment of diseases and clinical conditions associated with LOC286059.

LOC286402 (Accession XP_208415.1) is another GAM8297 target gene, herein designated TARGET GENE. LOC286402 BINDING SITE is a target binding site found in the 3' untranslated region of mRNA encoded by LOC286402, corresponding to a target binding site such as BINDING SITE I, BINDING SITE II or BINDING SITE III of FIG. 8. Table 4 illustrates the complementarity of the nucleotide sequences of LOC286402 BINDING SITE, designated SEQ ID:10137, to the nucleotide sequence of GAM8297 RNA, herein designated GAM RNA, also designated SEQ ID:367.

Another function of GAM8297 is therefore inhibition of LOC286402 (Accession XP_208415.1). Accordingly, utilities of GAM8297 include diagnosis, prevention and treatment of diseases and clinical conditions associated with LOC286402.

LOC286532 (Accession XP_210093.1) is another GAM8297 target gene, herein designated TARGET GENE. LOC286532 BINDING SITE is a target binding site found in the 3' untranslated region of mRNA encoded by LOC286532, corresponding to a target binding site such as BINDING SITE I, BINDING SITE II or BINDING SITE III of FIG. 8. Table 4 illustrates the complementarity of the nucleotide sequences of LOC286532 BINDING SITE, designated SEQ ID:4342, to the nucleotide sequence of GAM8297 RNA, herein designated GAM RNA, also designated SEQ ID:367.

Another function of GAM8297 is therefore inhibition of LOC286532 (Accession XP_210093.1). Accordingly, utilities of GAM8297 include diagnosis, prevention and treatment of diseases and clinical conditions associated with LOC286532.

LOC338817 (Accession XP_290588.1) is another GAM8297 target gene, herein designated TARGET GENE. LOC338817 BINDING SITE is a target binding site found in the 3' untranslated region of mRNA encoded by LOC338817, corresponding to a target binding site such as BINDING SITE I, BINDING SITE II or BINDING SITE III of FIG. 8. Table 4 illustrates the complementarity of the nucleotide sequences of LOC338817 BINDING SITE, designated SEQ ID:17184, to the nucleotide sequence of GAM8297 RNA, herein designated GAM RNA, also designated SEQ ID:367.

Another function of GAM8297 is therefore inhibition of LOC338817 (Accession XP_290588.1). Accordingly, utilities of GAM8297 include diagnosis, prevention and treatment of diseases and clinical conditions associated with LOC338817.

LOC338913 (Accession XP_292272.2) is another GAM8297 target gene, herein designated TARGET GENE. LOC338913 BINDING SITE is a target binding site found in the 5' untranslated region of mRNA encoded by LOC338913, corresponding to a target binding site such as BINDING SITE I, BINDING SITE II or BINDING SITE III of FIG. 8. Table 4 illustrates the complementarity of the nucleotide sequences of LOC338913 BINDING SITE, designated SEQ ID:4981, to the nucleotide sequence of GAM8297 RNA, herein designated GAM RNA, also designated SEQ ID:367.

Another function of GAM8297 is therefore inhibition of LOC338913 (Accession XP_292272.2). Accordingly, utilities of GAM8297 include diagnosis, prevention and treatment of diseases and clinical conditions associated with LOC338913.

LOC339154 (Accession XP_294832.1) is another GAM8297 target gene, herein designated TARGET GENE. LOC339154 BINDING SITE is a target binding site found in the 3' untranslated region of mRNA encoded by LOC339154, corresponding to a target binding site such as BINDING SITE I, BINDING SITE II or BINDING SITE III of FIG. 8. Table 4 illustrates the complementarity of the nucleotide sequences of LOC339154 BINDING SITE, designated SEQ ID:11902, to the nucleotide sequence of GAM8297 RNA, herein designated GAM RNA, also designated SEQ ID:367.

Another function of GAM8297 is therefore inhibition of LOC339154 (Accession XP_294832.1). Accordingly, utilities of GAM8297 include diagnosis, prevention and treatment of diseases and clinical conditions associated with LOC339154.

LOC339287 (Accession XP_290800.1) is another GAM8297 target gene, herein designated TARGET GENE. LOC339287 BINDING SITE is a target binding site found in the 3' untranslated region of mRNA encoded by LOC339287, corresponding to a target binding site such as BINDING SITE I, BINDING SITE II or BINDING SITE III of FIG. 8. Table 4 illustrates the complementarity of the nucleotide sequences of LOC339287 BINDING SITE, designated SEQ ID:19822, to the nucleotide sequence of GAM8297 RNA, herein designated GAM RNA, also designated SEQ ID:367.

Another function of GAM8297 is therefore inhibition of LOC339287 (Accession XP_290800.1). Accordingly, utilities of GAM8297 include diagnosis, prevention and treatment of diseases and clinical conditions associated with LOC339287.

LOC339400 (Accession XP_294926.1) is another GAM8297 target gene, herein designated TARGET GENE. LOC339400 BINDING SITE is a target binding site found in the 3' untranslated region of mRNA encoded by LOC339400, corresponding to a target binding site such as BINDING SITE I, BINDING SITE II or BINDING SITE III of FIG. 8. Table 4 illustrates the complementarity of the nucleotide sequences of LOC339400 BINDING SITE, designated SEQ ID:2239, to the nucleotide sequence of GAM8297 RNA, herein designated GAM RNA, also designated SEQ ID:367.

Another function of GAM8297 is therefore inhibition of LOC339400 (Accession XP_294926.1). Accordingly, utilities of GAM8297 include diagnosis, prevention and treatment of diseases and clinical conditions associated with LOC339400.

LOC339445 (Accession XP_291487.1) is another GAM8297 target gene, herein designated TARGET GENE. LOC339445 BINDING SITE is a target binding site found in the 5' untranslated region of mRNA encoded by LOC339445, corresponding to a target binding site such as BINDING SITE I, BINDING SITE II or BINDING SITE III of FIG. 8. Table 4 illustrates the complementarity of the nucleotide sequences of LOC339445 BINDING SITE, designated SEQ ID:14065, to the nucleotide sequence of GAM8297 RNA, herein designated GAM RNA, also designated SEQ ID:367.

Another function of GAM8297 is therefore inhibition of LOC339445 (Accession XP_291487.1). Accordingly, utilities of GAM8297 include diagnosis, prevention and treatment of diseases and clinical conditions associated with LOC339445.

LOC339458 (Accession XP_290911.1) is another GAM8297 target gene, herein designated TARGET GENE. LOC339458 BINDING SITE is a target binding site found in the 3' untranslated region of mRNA encoded by LOC339458, corresponding to a target binding site such as BINDING SITE I, BINDING SITE II or BINDING SITE III of FIG. 8. Table 4 illustrates the complementarity of the nucleotide sequences of LOC339458 BINDING SITE, designated SEQ ID:11960, to the nucleotide sequence of GAM8297 RNA, herein designated GAM RNA, also designated SEQ ID:367.

Another function of GAM8297 is therefore inhibition of LOC339458 (Accession XP_290911.1). Accordingly, utilities of GAM8297 include diagnosis, prevention and treatment of diseases and clinical conditions associated with LOC339458.

LOC339887 (Accession XP_295094.1) is another GAM8297 target gene, herein designated TARGET GENE. LOC339887 BINDING SITE is a target binding site found in the 3' untranslated region of mRNA encoded by LOC339887, corresponding to a target binding site such as BINDING SITE I, BINDING SITE II or BINDING SITE III of FIG. 8. Table 4 illustrates the complementarity of the nucleotide sequences of LOC339887 BINDING SITE, designated SEQ ID:11787, to the nucleotide sequence of GAM8297 RNA, herein designated GAM RNA, also designated SEQ ID:367.

Another function of GAM8297 is therefore inhibition of LOC339887 (Accession XP_295094.1). Accordingly, utilities of GAM8297 include diagnosis, prevention and treatment of diseases and clinical conditions associated with LOC339887.

LOC339942 (Accession XP_295107.1) is another GAM8297 target gene, herein designated TARGET GENE. LOC339942 BINDING SITE is a target binding site found in the 3' untranslated region of mRNA encoded by LOC339942, corresponding to a target binding site such as BINDING SITE I, BINDING SITE II or BINDING SITE III of FIG. 8. Table 4 illustrates the complementarity of the nucleotide sequences of LOC339942 BINDING SITE, designated SEQ ID:1575, to the nucleotide sequence of GAM8297 RNA, herein designated GAM RNA, also designated SEQ ID:367.

Another function of GAM8297 is therefore inhibition of LOC339942 (Accession XP_295107.1). Accordingly, utilities of GAM8297 include diagnosis, prevention and treatment of diseases and clinical conditions associated with LOC339942.

LOC339978 (Accession XP_295116.1) is another GAM8297 target gene, herein designated TARGET GENE. LOC339978 BINDING SITE is a target binding site found in the 5' untranslated region of mRNA encoded by LOC339978, corresponding to a target binding site such as BINDING SITE I, BINDING SITE II or BINDING SITE III of FIG. 8. Table 4 illustrates the complementarity of the nucleotide sequences of LOC339978 BINDING SITE, designated SEQ ID:9814, to the nucleotide sequence of GAM8297 RNA, herein designated GAM RNA, also designated SEQ ID:367.

Another function of GAM8297 is therefore inhibition of LOC339978 (Accession XP_295116.1). Accordingly, utilities of GAM8297 include diagnosis, prevention and treatment of diseases and clinical conditions associated with LOC339978.

LOC341333 (Accession XP_296117.1) is another GAM8297 target gene, herein designated TARGET GENE. LOC341333 BINDING SITE is a target binding site found in the 5' untranslated region of mRNA encoded by LOC341333, corresponding to a target binding site such as BINDING SITE I, BINDING SITE II or BINDING SITE III of FIG. 8. Table 4 illustrates the complementarity of the nucleotide sequences of LOC341333 BINDING SITE, designated SEQ ID:18471, to the nucleotide sequence of GAM8297 RNA, herein designated GAM RNA, also designated SEQ ID:367.

Another function of GAM8297 is therefore inhibition of LOC341333 (Accession XP_296117.1). Accordingly, utilities of GAM8297 include diagnosis, prevention and treatment of diseases and clinical conditions associated with LOC341333.

LOC341867 (Accession XP_292256.1) is another GAM8297 target gene, herein designated TARGET GENE. LOC341867 BINDING SITE is a target binding site found in the 5' untranslated region of mRNA encoded by LOC341867, corresponding to a target binding site such as BINDING SITE I, BINDING SITE II or BINDING SITE III of FIG. 8. Table 4 illustrates the complementarity of the nucleotide sequences of LOC341867 BINDING SITE, designated SEQ ID:17370, to the nucleotide sequence of GAM8297 RNA, herein designated GAM RNA, also designated SEQ ID:367.

Another function of GAM8297 is therefore inhibition of LOC341867 (Accession XP_292256.1). Accordingly, utilities of GAM8297 include diagnosis, prevention and treatment of diseases and clinical conditions associated with LOC341867.

LOC342490 (Accession XP_296905.2) is another GAM8297 target gene, herein designated TARGET GENE. LOC342490 BINDING SITE is a target binding site found in the 3' untranslated region of mRNA encoded by LOC342490, corresponding to a target binding site such as BINDING SITE I, BINDING SITE II or BINDING SITE III of FIG. 8. Table 4 illustrates the complementarity of the nucleotide sequences of LOC342490 BINDING SITE, designated SEQ ID:5255, to the nucleotide sequence of GAM8297 RNA, herein designated GAM RNA, also designated SEQ ID:367.

Another function of GAM8297 is therefore inhibition of LOC342490 (Accession XP_296905.2). Accordingly, utilities of GAM8297 include diagnosis, prevention and treatment of diseases and clinical conditions associated with LOC342490.

LOC342663 (Accession XP_297028.1) is another GAM8297 target gene, herein designated TARGET GENE. LOC342663 BINDING SITE is a target binding site found in the 5' untranslated region of mRNA encoded by LOC342663, corresponding to a target binding site such as BINDING SITE I, BINDING SITE II or BINDING SITE III of FIG. 8. Table 4 illustrates the complementarity of the nucleotide sequences of LOC342663 BINDING SITE, designated SEQ ID:7400, to the nucleotide sequence of GAM8297 RNA, herein designated GAM RNA, also designated SEQ ID:367.

Another function of GAM8297 is therefore inhibition of LOC342663 (Accession XP_297028.1). Accordingly, utilities of GAM8297 include diagnosis, prevention and treatment of diseases and clinical conditions associated with LOC342663.

LOC343141 (Accession XP_291421.1) is another GAM8297 target gene, herein designated TARGET GENE. LOC343141 BINDING SITE is a target binding site found in the 5' untranslated region of mRNA encoded by LOC343141, corresponding to a target binding site such as BINDING SITE I, BINDING SITE II or BINDING SITE III of FIG. 8. Table 4 illustrates the complementarity of the nucleotide sequences of LOC343141 BINDING SITE, designated SEQ ID:3845, to the nucleotide sequence of GAM8297 RNA, herein designated GAM RNA, also designated SEQ ID:367.

Another function of GAM8297 is therefore inhibition of LOC343141 (Accession XP_291421.1). Accordingly, utilities of GAM8297 include diagnosis, prevention and treatment of diseases and clinical conditions associated with LOC343141.

LOC343532 (Accession XP_291629.1) is another GAM8297 target gene, herein designated TARGET GENE. LOC343532 BINDING SITE is a target binding site found in the 5' untranslated region of mRNA encoded by LOC343532, corresponding to a target binding site such as BINDING SITE I, BINDING SITE II or BINDING SITE III of FIG. 8. Table 4 illustrates the complementarity of the nucleotide sequences of LOC343532 BINDING SITE, designated SEQ ID:7356, to the nucleotide sequence of GAM8297 RNA, herein designated GAM RNA, also designated SEQ ID:367.

Another function of GAM8297 is therefore inhibition of LOC343532 (Accession XP_291629.1). Accordingly, utilities of GAM8297 include diagnosis, prevention and treatment of diseases and clinical conditions associated with LOC343532.

LOC345422 (Accession XP_298768.2) is another GAM8297 target gene, herein designated TARGET GENE. LOC345422 BINDING SITE is a target binding site found in the 5' untranslated region of mRNA encoded by LOC345422, corresponding to a target binding site such as BINDING SITE I, BINDING SITE II or BINDING SITE III of FIG. 8. Table 4 illustrates the complementarity of the nucleotide sequences of LOC345422 BINDING SITE, designated SEQ ID:19581, to the nucleotide sequence of GAM8297 RNA, herein designated GAM RNA, also designated SEQ ID:367.

Another function of GAM8297 is therefore inhibition of LOC345422 (Accession XP_298768.2). Accordingly, utilities of GAM8297 include diagnosis, prevention and treatment of diseases and clinical conditions associated with LOC345422.

LOC346351 (Accession XP_299473.1) is another GAM8297 target gene, herein designated TARGET GENE. LOC346351 BINDING SITE is a target binding site found in the 3' untranslated region of mRNA encoded by LOC346351, corresponding to a target binding site such as BINDING SITE I, BINDING SITE II or BINDING SITE III of FIG. 8. Table 4 illustrates the complementarity of the nucleotide sequences of LOC346351 BINDING SITE, designated SEQ ID:13991, to the nucleotide sequence of GAM8297 RNA, herein designated GAM RNA, also designated SEQ ID:367.

Another function of GAM8297 is therefore inhibition of LOC346351 (Accession XP_299473.1). Accordingly, utilities of GAM8297 include diagnosis, prevention and treatment of diseases and clinical conditions associated with LOC346351.

LOC346430 (Accession XP_299501.1) is another GAM8297 target gene, herein designated TARGET GENE. LOC346430 BINDING SITE is a target binding site found in the 5' untranslated region of mRNA encoded by LOC346430, corresponding to a target binding site such as BINDING SITE I, BINDING SITE II or BINDING SITE III of FIG. 8. Table 4 illustrates the complementarity of the nucleotide sequences of LOC346430 BINDING SITE, designated SEQ ID:2854, to the nucleotide sequence of GAM8297 RNA, herein designated GAM RNA, also designated SEQ ID:367.

Another function of GAM8297 is therefore inhibition of LOC346430 (Accession XP_299501.1). Accordingly, utilities of GAM8297 include diagnosis, prevention and treatment of diseases and clinical conditions associated with LOC346430.

LOC348155 (Accession XP_211219.1) is another GAM8297 target gene, herein designated TARGET GENE. LOC348155 BINDING SITE is a target binding site found in the 5' untranslated region of mRNA encoded by LOC348155, corresponding to a target binding site such as BINDING SITE I, BINDING SITE II or BINDING SITE III of FIG. 8. Table 4 illustrates the complementarity of the nucleotide sequences of LOC348155 BINDING SITE, designated SEQ ID:2548, to the nucleotide sequence of GAM8297 RNA, herein designated GAM RNA, also designated SEQ ID:367.

Another function of GAM8297 is therefore inhibition of LOC348155 (Accession XP_211219.1). Accordingly, utilities of GAM8297 include diagnosis, prevention and treatment of diseases and clinical conditions associated with LOC348155.

LOC348525 (Accession XP_300778.1) is another GAM8297 target gene, herein designated TARGET GENE. LOC348525 BINDING SITE is a target binding site found in the 3' untranslated region of mRNA encoded by LOC348525, corresponding to a target binding site such as BINDING SITE I, BINDING SITE II or BINDING SITE III of FIG. 8. Table 4 illustrates the complementarity of the nucleotide sequences of LOC348525 BINDING SITE, designated SEQ ID:11960, to the nucleotide sequence of GAM8297 RNA, herein designated GAM RNA, also designated SEQ ID:367.

Another function of GAM8297 is therefore inhibition of LOC348525 (Accession XP_300778.1). Accordingly, utilities of GAM8297 include diagnosis, prevention and treatment of diseases and clinical conditions associated with LOC348525.

LOC348600 (Accession XP_300790.1) is another GAM8297 target gene, herein designated TARGET GENE. LOC348600 BINDING SITE is a target binding site found in the 3' untranslated region of mRNA encoded by LOC348600, corresponding to a target binding site such as BINDING SITE I, BINDING SITE II or BINDING SITE III of FIG. 8. Table 4 illustrates the complementarity of the nucleotide sequences of LOC348600 BINDING SITE, designated SEQ ID:10547, to the nucleotide sequence of GAM8297 RNA, herein designated GAM RNA, also designated SEQ ID:367.

Another function of GAM8297 is therefore inhibition of LOC348600 (Accession XP_300790.1). Accordingly, utilities of GAM8297 include diagnosis, prevention and treatment of diseases and clinical conditions associated with LOC348600.

LOC349079 (Accession XP_302954.1) is another GAM8297 target gene, herein designated TARGET GENE. LOC349079 BINDING SITE is a target binding site found in the 5' untranslated region of mRNA encoded by LOC349079, corresponding to a target binding site such as BINDING SITE I, BINDING SITE II or BINDING SITE III of FIG. 8. Table 4 illustrates the complementarity of the nucleotide sequences of LOC349079 BINDING SITE, designated SEQ ID:17698, to the nucleotide sequence of GAM8297 RNA, herein designated GAM RNA, also designated SEQ ID:367.

Another function of GAM8297 is therefore inhibition of LOC349079 (Accession XP_302954.1). Accordingly, utilities of GAM8297 include diagnosis, prevention and treatment of diseases and clinical conditions associated with LOC349079.

LOC349213 (Accession XP_303002.1) is another GAM8297 target gene, herein designated TARGET GENE. LOC349213 BINDING SITE is a target binding site found in the 5' untranslated region of mRNA encoded by LOC349213, corresponding to a target binding site such as BINDING SITE I, BINDING SITE II or BINDING SITE III of FIG. 8. Table 4 illustrates the complementarity of the nucleotide sequences of LOC349213 BINDING SITE, designated SEQ ID:9993, to the nucleotide sequence of GAM8297 RNA, herein designated GAM RNA, also designated SEQ ID:367.

Another function of GAM8297 is therefore inhibition of LOC349213 (Accession XP_303002.1). Accordingly, utilities of GAM8297 include diagnosis, prevention and treatment of diseases and clinical conditions associated with LOC349213.

LOC349262 (Accession XP_303011.1) is another GAM8297 target gene, herein designated TARGET GENE. LOC349262 BINDING SITE is a target binding site found in the 5' untranslated region of mRNA encoded by LOC349262, corresponding to a target binding site such as BINDING SITE I, BINDING SITE II or BINDING SITE III of FIG. 8. Table 4 illustrates the complementarity of the nucleotide sequences of LOC349262 BINDING SITE, designated SEQ ID:14405, to the nucleotide sequence of GAM8297 RNA, herein designated GAM RNA, also designated SEQ ID:367.

Another function of GAM8297 is therefore inhibition of LOC349262 (Accession XP_303011.1). Accordingly, utilities of GAM8297 include diagnosis, prevention and treatment of diseases and clinical conditions associated with LOC349262.

LOC349269 (Accession XP_303012.1) is another GAM8297 target gene, herein designated TARGET GENE. LOC349269 BINDING SITE is a target binding site found in the 5' untranslated region of mRNA encoded by LOC349269, corresponding to a target binding site such as BINDING SITE I, BINDING SITE II or BINDING SITE III of FIG. 8. Table 4 illustrates the complementarity of the nucleotide sequences of LOC349269 BINDING SITE, designated SEQ ID:14405, to the nucleotide sequence of GAM8297 RNA, herein designated GAM RNA, also designated SEQ ID:367.

Another function of GAM8297 is therefore inhibition of LOC349269 (Accession XP_303012.1). Accordingly, utilities of GAM8297 include diagnosis, prevention and treatment of diseases and clinical conditions associated with LOC349269.

LOC349288 (Accession XP_300476.1) is another GAM8297 target gene, herein designated TARGET GENE. LOC349288 BINDING SITE is a target binding site found in the 5' untranslated region of mRNA encoded by LOC349288, corresponding to a target binding site such as BINDING SITE I, BINDING SITE II or BINDING SITE III of FIG. 8. Table 4 illustrates the complementarity of the nucleotide sequences of LOC349288 BINDING SITE, designated SEQ ID:14140, to the nucleotide sequence of GAM8297 RNA, herein designated GAM RNA, also designated SEQ ID:367.

Another function of GAM8297 is therefore inhibition of LOC349288 (Accession XP_300476.1). Accordingly, utilities of GAM8297 include diagnosis, prevention and treatment of diseases and clinical conditions associated with LOC349288.

LOC349291 (Accession XP_303017.1) is another GAM8297 target gene, herein designated TARGET GENE. LOC349291 BINDING SITE is a target binding site found in the 5' untranslated region of mRNA encoded by LOC349291, corresponding to a target binding site such as BINDING SITE I, BINDING SITE II or BINDING SITE III of FIG. 8. Table 4 illustrates the complementarity of the nucleotide sequences of LOC349291 BINDING SITE, designated SEQ ID:14405, to the nucleotide sequence of GAM8297 RNA, herein designated GAM RNA, also designated SEQ ID:367.

Another function of GAM8297 is therefore inhibition of LOC349291 (Accession XP_303017.1). Accordingly, utilities of GAM8297 include diagnosis, prevention and treatment of diseases and clinical conditions associated with LOC349291.

LOC349408 (Accession XP_303044.1) is another GAM8297 target gene, herein designated TARGET GENE. LOC349408 BINDING SITE is a target binding site found in the 5' untranslated region of mRNA encoded by LOC349408, corresponding to a target binding site such as BINDING SITE I, BINDING SITE II or BINDING SITE III of FIG. 8. Table 4 illustrates the complementarity of the nucleotide sequences of LOC349408 BINDING SITE, designated SEQ ID:2271, to the nucleotide sequence of GAM8297 RNA, herein designated GAM RNA, also designated SEQ ID:367.

Another function of GAM8297 is therefore inhibition of LOC349408 (Accession XP_303044.1). Accordingly, utilities of GAM8297 include diagnosis, prevention and treatment of diseases and clinical conditions associated with LOC349408.

LOC350598 (Accession XP_304238.1) is another GAM8297 target gene, herein designated TARGET GENE. LOC350598 BINDING SITE is a target binding site found in the 5' untranslated region of mRNA encoded by LOC350598, corresponding to a target binding site such as BINDING SITE I, BINDING SITE II or BINDING SITE III of FIG. 8. Table 4 illustrates the complementarity of the nucleotide sequences of LOC350598 BINDING SITE, designated SEQ ID:3074, to the nucleotide sequence of GAM8297 RNA, herein designated GAM RNA, also designated SEQ ID:367.

Another function of GAM8297 is therefore inhibition of LOC350598 (Accession XP_304238.1). Accordingly, utilities of GAM8297 include diagnosis, prevention and treatment of diseases and clinical conditions associated with LOC350598.

LOC51063 (Accession NP_057000.2) is another GAM8297 target gene, herein designated TARGET GENE. LOC51063 BINDING SITE is a target binding site found in the 5' untranslated region of mRNA encoded by LOC51063, corresponding to a target binding site such as BINDING SITE I, BINDING SITE II or BINDING SITE III of FIG. 8. Table 4 illustrates the complementarity of the nucleotide sequences of LOC51063 BINDING SITE, designated SEQ ID:17350, to the nucleotide sequence of GAM8297 RNA, herein designated GAM RNA, also designated SEQ ID:367.

Another function of GAM8297 is therefore inhibition of LOC51063 (Accession NP_057000.2). Accordingly, utilities of GAM8297 include diagnosis, prevention and treatment of diseases and clinical conditions associated with LOC51063.

LOC90768 (Accession NP_849160.1) is another GAM8297 target gene, herein designated TARGET GENE. LOC90768 BINDING SITE is a target binding site found in the 3' untranslated region of multiple transcripts of mRNA encoded by LOC90768, corresponding to a target binding site such as BINDING SITE I, BINDING SITE II or BINDING SITE III of FIG. 8. Table 4 illustrates the complementarity of the nucleotide sequences of LOC90768 BINDING SITE, designated SEQ ID:4499, to the nucleotide sequence of GAM8297 RNA, herein designated GAM RNA, also designated SEQ ID:367.

Another function of GAM8297 is therefore inhibition of LOC90768 (Accession NP_849160.1). Accordingly, utilities of GAM8297 include diagnosis, prevention and treatment of diseases and clinical conditions associated with LOC90768.

LOC92606 (Accession XP_046097.1) is another GAM8297 target gene, herein designated TARGET GENE. LOC92606 BINDING SITE is a target binding site found in the 3' untranslated region of mRNA encoded by LOC92606, corresponding to a target binding site such as BINDING SITE I, BINDING SITE II or BINDING SITE III of FIG. 8. Table 4 illustrates the complementarity of the nucleotide sequences of LOC92606 BINDING SITE, designated SEQ ID:1231, to the nucleotide sequence of GAM8297 RNA, herein designated GAM RNA, also designated SEQ ID:367.

Another function of GAM8297 is therefore inhibition of LOC92606 (Accession XP_046097.1). Accordingly, utilities of GAM8297 include diagnosis, prevention and treatment of diseases and clinical conditions associated with LOC92606.

LOC93082 (Accession NP_612406.1) is another GAM8297 target gene, herein designated TARGET GENE. LOC93082 BINDING SITE is a target binding site found in the 3' untranslated region of mRNA encoded by LOC93082, corresponding to a target binding site such as BINDING SITE I, BINDING SITE II or BINDING SITE III of FIG. 8. Table 4 illustrates the complementarity of the nucleotide sequences of LOC93082 BINDING SITE, designated SEQ ID:16872, to the nucleotide sequence of GAM8297 RNA, herein designated GAM RNA, also designated SEQ ID:367.

Another function of GAM8297 is therefore inhibition of LOC93082 (Accession NP_612406.1). Accordingly, utilities of GAM8297 include diagnosis, prevention and treatment of diseases and clinical conditions associated with LOC93082.

LYRIC (Accession NP_848927.1) is another GAM8297 target gene, herein designated TARGET GENE. LYRIC BINDING SITE is a target binding site found in the 3' untranslated region of multiple transcripts of mRNA encoded by LYRIC, corresponding to a target binding site such as BINDING SITE I, BINDING SITE II or BINDING SITE III of FIG. 8. Table 4 illustrates the complementarity of the nucleotide sequences of LYRIC BINDING SITE, designated SEQ ID:7749, to the nucleotide sequence of GAM8297 RNA, herein designated GAM RNA, also designated SEQ ID:367.

Another function of GAM8297 is therefore inhibition of LYRIC (Accession NP_848927.1). Accordingly, utilities of GAM8297 include diagnosis, prevention and treatment of diseases and clinical conditions associated with LYRIC.

LYRIC (Accession XP_043070.5) is another GAM8297 target gene, herein designated TARGET GENE. LYRIC BINDING SITE is a target binding site found in the 3' untranslated region of multiple transcripts of mRNA encoded by LYRIC, corresponding to a target binding site such as BINDING SITE I, BINDING SITE II or BINDING SITE III of FIG. 8. Table 4 illustrates the complementarity of the nucleotide sequences of LYRIC BINDING SITE, designated SEQ ID:7749, to the nucleotide sequence of GAM8297 RNA, herein designated GAM RNA, also designated SEQ ID:367.

Another function of GAM8297 is therefore inhibition of LYRIC (Accession XP_043070.5). Accordingly, utilities of GAM8297 include diagnosis, prevention and treatment of diseases and clinical conditions associated with LYRIC.

Mad, mothers against decapentaplegic homolog 7 (drosophila) (MADH7, Accession NP_005895.1) is another GAM8297 target gene, herein designated TARGET GENE. MADH7 BINDING SITE is a target binding site found in the 3' untranslated region of mRNA encoded by MADH7, corresponding to a target binding site such as BINDING SITE I, BINDING SITE II or BINDING SITE III of FIG. 8. Table 4 illustrates the complementarity of the nucleotide sequences of MADH7 BINDING SITE, designated SEQ ID:7744, to the nucleotide sequence of GAM8297 RNA, herein designated GAM RNA, also designated SEQ ID:367.

Another function of GAM8297 is therefore inhibition of Mad, mothers against decapentaplegic homolog 7 (drosophila) (MADH7, Accession NP_005895.1), a gene which may affect transcription in response to TGF-beta superfamily signaling pathway, inhibits BMP/Smad1 (MADH1) signaling and therefore may be associated with Scleroderma. Accordingly, utilities of GAM8297 include diagnosis, prevention and treatment of Scleroderma, and of other diseases and clinical conditions associated with MADH7.

The function of MADH7 and its association with various diseases and clinical conditions, has been established by previous studies, as described hereinabove with reference to GAM354.1. Mitogen-activated protein kinase kinase 3 (MAP2K3, Accession NP_002747.2) is another GAM8297 target gene, herein designated TARGET GENE. MAP2K3 BINDING SITE is a target binding site found in the 5' untranslated region of multiple transcripts of mRNA encoded by MAP2K3, corresponding to a target binding site such as BINDING SITE I, BINDING SITE II or BINDING SITE III of FIG. 8. Table 4 illustrates the complementarity of the nucleotide sequences of MAP2K3 BINDING SITE, designated SEQ ID:7679, to the nucleotide sequence of GAM8297 RNA, herein designated GAM RNA, also designated SEQ ID:367.

Another function of GAM8297 is therefore inhibition of Mitogen-activated protein kinase kinase 3 (MAP2K3, Accession NP_002747.2). Accordingly, utilities of GAM8297 include diagnosis, prevention and treatment of diseases and clinical conditions associated with MAP2K3.

Mitogen-activated protein kinase-activated protein kinase 3 (MAPKAPK3, Accession NP_004626.1) is another GAM8297 target gene, herein designated TARGET GENE. MAPKAPK3 BINDING SITE is a target binding site found in the 3' untranslated region of mRNA encoded by MAPKAPK3, corresponding to a target binding site such as BINDING SITE I, BINDING SITE II or BINDING SITE III of FIG. 8. Table 4 illustrates the complementarity of the nucleotide sequences of MAPKAPK3 BINDING SITE, designated SEQ ID:1041, to the nucleotide sequence of GAM8297 RNA, herein designated GAM RNA, also designated SEQ ID:367.

Another function of GAM8297 is therefore inhibition of Mitogen-activated protein kinase-activated protein kinase 3 (MAPKAPK3, Accession NP_004626.1). Accordingly, utilities of GAM8297 include diagnosis, prevention and treatment of diseases and clinical conditions associated with MAPKAPK3.

Mutated in colorectal cancers (MCC, Accession NP_002378.1) is another GAM8297 target gene, herein designated TARGET GENE. MCC BINDING SITE is a target binding site found in the 3' untranslated region of mRNA encoded by MCC, corresponding to a target binding site such as BINDING SITE I, BINDING SITE II or BINDING SITE III of FIG. 8. Table 4 illustrates the complementarity of the nucleotide sequences of MCC BINDING SITE, designated SEQ ID:5308, to the nucleotide sequence of GAM8297 RNA, herein designated GAM RNA, also designated SEQ ID:367.

Another function of GAM8297 is therefore inhibition of Mutated in colorectal cancers (MCC, Accession NP_002378.1). Accordingly, utilities of GAM8297 include diagnosis, prevention and treatment of diseases and clinical conditions associated with MCC.

MDA5 (Accession NP_071451.2) is another GAM8297 target gene, herein designated TARGET GENE. MDA5 BINDING SITE is a target binding site found in the 5' untranslated region of mRNA encoded by MDA5, corresponding to a target binding site such as BINDING SITE I, BINDING SITE II or BINDING SITE III of FIG. 8. Table 4 illustrates the complementarity of the nucleotide sequences of MDA5 BINDING SITE, designated SEQ ID:15518, to the nucleotide sequence of GAM8297 RNA, herein designated GAM RNA, also designated SEQ ID:367.

Another function of GAM8297 is therefore inhibition of MDA5 (Accession NP_071451.2). Accordingly, utilities of GAM8297 include diagnosis, prevention and treatment of diseases and clinical conditions associated with MDA5.

Mesoderm development candidate 1 (MESDC1, Accession NP_072088.1) is another GAM8297 target gene, herein designated TARGET GENE. MESDC1 BINDING SITE is a target binding site found in the 5' untranslated region of mRNA encoded by MESDC1, corresponding to a target binding site such as BINDING SITE I, BINDING SITE II or BINDING SITE III of FIG. 8. Table 4 illustrates the complementarity of the nucleotide sequences of MESDC1 BINDING SITE, designated SEQ ID:17738, to the nucleotide sequence of GAM8297 RNA, herein designated GAM RNA, also designated SEQ ID:367.

Another function of GAM8297 is therefore inhibition of Mesoderm development candidate 1 (MESDC1, Accession NP_072088.1). Accordingly, utilities of GAM8297 include diagnosis, prevention and treatment of diseases and clinical conditions associated with MESDC1.

MGC10646 (Accession NP_116082.1) is another GAM8297 target gene, herein designated TARGET GENE. MGC10646 BINDING SITE is a target binding site found in the 3' untranslated region of mRNA encoded by MGC10646, corresponding to a target binding site such as BINDING SITE I, BINDING SITE II or BINDING SITE III of FIG. 8. Table 4 illustrates the complementarity of the nucleotide sequences of MGC10646 BINDING SITE, designated SEQ ID:8894, to the nucleotide sequence of GAM8297 RNA, herein designated GAM RNA, also designated SEQ ID:367.

Another function of GAM8297 is therefore inhibition of MGC10646 (Accession NP_116082.1). Accordingly, utilities of GAM8297 include diagnosis, prevention and treatment of diseases and clinical conditions associated with MGC10646.

MGC10818 (Accession NP_085045.2) is another GAM8297 target gene, herein designated TARGET GENE. MGC10818 BINDING SITE is a target binding site found in the 3' untranslated region of mRNA encoded by MGC10818, corresponding to a target binding site such as BINDING SITE I, BINDING SITE II or BINDING SITE III of FIG. 8. Table 4 illustrates the complementarity of the nucleotide sequences of MGC10818 BINDING SITE, designated SEQ ID:2986, to the nucleotide sequence of GAM8297 RNA, herein designated GAM RNA, also designated SEQ ID:367.

Another function of GAM8297 is therefore inhibition of MGC10818 (Accession NP_085045.2). Accordingly, utilities of GAM8297 include diagnosis, prevention and treatment of diseases and clinical conditions associated with MGC10818.

MGC10981 (Accession NP_116043.1) is another GAM8297 target gene, herein designated TARGET GENE. MGC10981 BINDING SITE1 and MGC10981 BINDING SITE2 are target binding sites found in untranslated regions of mRNA encoded by MGC10981, corresponding to target binding sites such as BINDING SITE I, BINDING SITE II or BINDING SITE III of FIG. 8. Table 4 illustrates the complementarity of the nucleotide sequences of MGC10981 BINDING SITE1 and MGC10981 BINDING SITE2, designated SEQ ID:5612 and SEQ ID:1625 respectively, to the nucleotide sequence of GAM8297 RNA, herein designated GAM RNA, also designated SEQ ID:367.

Another function of GAM8297 is therefore inhibition of MGC10981 (Accession NP_116043.1). Accordingly, utilities of GAM8297 include diagnosis, prevention and treatment of diseases and clinical conditions associated with MGC10981.

MGC12904 (Accession NP_112496.1) is another GAM8297 target gene, herein designated TARGET GENE. MGC12904 BINDING SITE is a target binding site found in the 5' untranslated region of mRNA encoded by MGC12904, corresponding to a target binding site such as BINDING SITE I, BINDING SITE II or BINDING SITE III of FIG. 8. Table 4 illustrates the complementarity of the nucleotide sequences of MGC12904 BINDING SITE, designated SEQ ID:6475, to the nucleotide sequence of GAM8297 RNA, herein designated GAM RNA, also designated SEQ ID:367.

Another function of GAM8297 is therefore inhibition of MGC12904 (Accession NP_112496.1). Accordingly, utilities of GAM8297 include diagnosis, prevention and treatment of diseases and clinical conditions associated with MGC12904.

MGC12966 (Accession NP_116095.1) is another GAM8297 target gene, herein designated TARGET GENE. MGC12966 BINDING SITE is a target binding site found in the 3' untranslated region of mRNA encoded by MGC12966, corresponding to a target binding site such as BINDING SITE I, BINDING SITE II or BINDING SITE III of FIG. 8. Table 4 illustrates the complementarity of the nucleotide sequences of MGC12966 BINDING SITE, designated SEQ ID:4628, to the nucleotide sequence of GAM8297 RNA, herein designated GAM RNA, also designated SEQ ID:367.

Another function of GAM8297 is therefore inhibition of MGC12966 (Accession NP_116095.1). Accordingly, utilities of GAM8297 include diagnosis, prevention and treatment of diseases and clinical conditions associated with MGC12966.

MGC13047 (Accession NP_116098.1) is another GAM8297 target gene, herein designated TARGET GENE. MGC13047 BINDING SITE is a target binding site found in the 3' untranslated region of mRNA encoded by MGC13047, corresponding to a target binding site such as BINDING SITE I, BINDING SITE II or BINDING SITE III of FIG. 8. Table 4 illustrates the complementarity of the nucleotide sequences of MGC13047 BINDING SITE, designated SEQ ID:13016, to the nucleotide sequence of GAM8297 RNA, herein designated GAM RNA, also designated SEQ ID:367.

Another function of GAM8297 is therefore inhibition of MGC13047 (Accession NP_116098.1). Accordingly, utilities of GAM8297 include diagnosis, prevention and treatment of diseases and clinical conditions associated with MGC13047.

MGC14832 (Accession NP_115715.1) is another GAM8297 target gene, herein designated TARGET GENE. MGC14832 BINDING SITE is a target binding site found in the 3' untranslated region of mRNA encoded by MGC14832, corresponding to a target binding site such as BINDING SITE I, BINDING SITE II or BINDING SITE III of FIG. 8. Table 4 illustrates the complementarity of the nucleotide sequences of MGC14832 BINDING SITE, designated SEQ ID:11725, to the nucleotide sequence of GAM8297 RNA, herein designated GAM RNA, also designated SEQ ID:367.

Another function of GAM8297 is therefore inhibition of MGC14832 (Accession NP_115715.1). Accordingly, utilities of GAM8297 include diagnosis, prevention and treatment of diseases and clinical conditions associated with MGC14832.

MGC16291 (Accession NP_116159.2) is another GAM8297 target gene, herein designated TARGET GENE. MGC16291 BINDING SITE is a target binding site found in the 3' untranslated region of mRNA encoded by MGC16291, corresponding to a target binding site such as BINDING SITE I, BINDING SITE II or BINDING SITE III of FIG. 8. Table 4 illustrates the complementarity of the nucleotide sequences of MGC16291 BINDING SITE, designated SEQ ID:1591, to the nucleotide sequence of GAM8297 RNA, herein designated GAM RNA, also designated SEQ ID:367.

Another function of GAM8297 is therefore inhibition of MGC16291 (Accession NP_116159.2). Accordingly, utilities of GAM8297 include diagnosis, prevention and treatment of diseases and clinical conditions associated with MGC16291.

MGC16638 (Accession NP_777593.1) is another GAM8297 target gene, herein designated TARGET GENE. MGC16638 BINDING SITE is a target binding site found in the 5' untranslated region of mRNA encoded by MGC16638, corresponding to a target binding site such as BINDING SITE I, BINDING SITE II or BINDING SITE III of FIG. 8. Table 4 illustrates the complementarity of the nucleotide sequences of MGC16638 BINDING SITE, designated SEQ ID:13782, to the nucleotide sequence of GAM8297 RNA, herein designated GAM RNA, also designated SEQ ID:367.

Another function of GAM8297 is therefore inhibition of MGC16638 (Accession NP_777593.1). Accordingly, utilities of GAM8297 include diagnosis, prevention and treatment of diseases and clinical conditions associated with MGC16638.

MGC20460 (Accession NP_444271.1) is another GAM8297 target gene, herein designated TARGET GENE. MGC20460 BINDING SITE is a target binding site found in the 5' untranslated region of mRNA encoded by MGC20460, corresponding to a target binding site such as BINDING SITE I, BINDING SITE II or BINDING SITE III of FIG. 8. Table 4 illustrates the complementarity of the nucleotide sequences of MGC20460 BINDING SITE, designated SEQ ID:14116, to the nucleotide sequence of GAM8297 RNA, herein designated GAM RNA, also designated SEQ ID:367.

Another function of GAM8297 is therefore inhibition of MGC20460 (Accession NP_444271.1). Accordingly, utilities of GAM8297 include diagnosis, prevention and treatment of diseases and clinical conditions associated with MGC20460.

MGC2452 (Accession NP_116033.1) is another GAM8297 target gene, herein designated TARGET GENE. MGC2452 BINDING SITE is a target binding site found in the 5' untranslated region of mRNA encoded by MGC2452, corresponding to a target binding site such as BINDING SITE I, BINDING SITE II or BINDING SITE III of FIG. 8. Table 4 illustrates the complementarity of the nucleotide sequences of MGC2452 BINDING SITE, designated SEQ ID:10266, to the nucleotide sequence of GAM8297 RNA, herein designated GAM RNA, also designated SEQ ID:367.

Another function of GAM8297 is therefore inhibition of MGC2452 (Accession NP_116033.1). Accordingly, utilities of GAM8297 include diagnosis, prevention and treatment of diseases and clinical conditions associated with MGC2452.

MGC26706 (Accession NP_689794.1) is another GAM8297 target gene, herein designated TARGET GENE. MGC26706 BINDING SITE is a target binding site found in the 3' untranslated region of mRNA encoded by MGC26706, corresponding to a target binding site such as BINDING SITE I, BINDING SITE II or BINDING SITE III of FIG. 8. Table 4 illustrates the complementarity of the nucleotide sequences of MGC26706 BINDING SITE, designated SEQ ID:5445, to the nucleotide sequence of GAM8297 RNA, herein designated GAM RNA, also designated SEQ ID:367.

Another function of GAM8297 is therefore inhibition of MGC26706 (Accession NP_689794.1). Accordingly, utilities of GAM8297 include diagnosis, prevention and treatment of diseases and clinical conditions associated with MGC26706.

MGC3067 (Accession NP_077271.1) is another GAM8297 target gene, herein designated TARGET GENE. MGC3067 BINDING SITE is a target binding site found in the 3' untranslated region of mRNA encoded by MGC3067, corresponding to a target binding site such as BINDING SITE I, BINDING SITE II or BINDING SITE III of FIG. 8. Table 4 illustrates the complementarity of the nucleotide sequences of MGC3067 BINDING SITE, designated SEQ ID:13227, to the nucleotide sequence of GAM8297 RNA, herein designated GAM RNA, also designated SEQ ID:367.

Another function of GAM8297 is therefore inhibition of MGC3067 (Accession NP_077271.1). Accordingly, utilities of GAM8297 include diagnosis, prevention and treatment of diseases and clinical conditions associated with MGC3067.

MGC33182 (Accession NP_660204.1) is another GAM8297 target gene, herein designated TARGET GENE. MGC33182 BINDING SITE is a target binding site found in the 5' untranslated region of mRNA encoded by MGC33182, corresponding to a target binding site such as BINDING SITE I, BINDING SITE II or BINDING SITE III of FIG. 8. Table 4 illustrates the complementarity of the nucleotide sequences of MGC33182 BINDING SITE, designated SEQ ID:17019, to the nucleotide sequence of GAM8297 RNA, herein designated GAM RNA, also designated SEQ ID:367.

Another function of GAM8297 is therefore inhibition of MGC33182 (Accession NP_660204.1). Accordingly, utilities of GAM8297 include diagnosis, prevention and treatment of diseases and clinical conditions associated with MGC33182.

MGC33202 (Accession NP_775811.1) is another GAM8297 target gene, herein designated TARGET GENE. MGC33202 BINDING SITE is a target binding site found in the 3' untranslated region of mRNA encoded by MGC33202, corresponding to a target binding site such as BINDING SITE I, BINDING SITE II or BINDING SITE III of FIG. 8. Table 4 illustrates the complementarity of the nucleotide sequences of MGC33202 BINDING SITE, designated SEQ ID:17059, to the nucleotide sequence of GAM8297 RNA, herein designated GAM RNA, also designated SEQ ID:367.

Another function of GAM8297 is therefore inhibition of MGC33202 (Accession NP_775811.1). Accordingly, utilities of GAM8297 include diagnosis, prevention and treatment of diseases and clinical conditions associated with MGC33202.

MGC39696 (Accession NP_689984.1) is another GAM8297 target gene, herein designated TARGET GENE. MGC39696 BINDING SITE is a target binding site found in the 5' untranslated region of mRNA encoded by MGC39696, corresponding to a target binding site such as BINDING SITE I, BINDING SITE II or BINDING SITE III of FIG. 8. Table 4 illustrates the complementarity of the nucleotide sequences of MGC39696 BINDING SITE, designated SEQ ID:13115, to the nucleotide sequence of GAM8297 RNA, herein designated GAM RNA, also designated SEQ ID:367.

Another function of GAM8297 is therefore inhibition of MGC39696 (Accession NP_689984.1). Accordingly, utilities of GAM8297 include diagnosis, prevention and treatment of diseases and clinical conditions associated with MGC39696.

MGC40053 (Accession NP_689796.1) is another GAM8297 target gene, herein designated TARGET GENE. MGC40053 BINDING SITE is a target binding site found in the 3' untranslated region of mRNA encoded by MGC40053, corresponding to a target binding site such as BINDING SITE I, BINDING SITE II or BINDING SITE III of FIG. 8. Table 4 illustrates the complementarity of the nucleotide sequences of MGC40053 BINDING SITE, designated SEQ ID:16179, to the nucleotide sequence of GAM8297 RNA, herein designated GAM RNA, also designated SEQ ID:367.

Another function of GAM8297 is therefore inhibition of MGC40053 (Accession NP_689796.1). Accordingly, utilities of GAM8297 include diagnosis, prevention and treatment of diseases and clinical conditions associated with MGC40053.

MGC45408 (Accession NP_689502.1) is another GAM8297 target gene, herein designated TARGET GENE. MGC45408 BINDING SITE is a target binding site found in the 3' untranslated region of mRNA encoded by MGC45408, corresponding to a target binding site such as BINDING SITE I, BINDING SITE II or BINDING SITE III of FIG. 8. Table 4 illustrates the complementarity of the nucleotide sequences of MGC45408 BINDING SITE, designated SEQ ID:2651, to the nucleotide sequence of GAM8297 RNA, herein designated GAM RNA, also designated SEQ ID:367.

Another function of GAM8297 is therefore inhibition of MGC45408 (Accession NP_689502.1). Accordingly, utilities of GAM8297 include diagnosis, prevention and treatment of diseases and clinical conditions associated with MGC45408.

MGC45840 (Accession NP_775855.1) is another GAM8297 target gene, herein designated TARGET GENE. MGC45840 BINDING SITE is a target binding site found in the 3' untranslated region of mRNA encoded by MGC45840, corresponding to a target binding site such as BINDING SITE I, BINDING SITE II or BINDING SITE III of FIG. 8. Table 4 illustrates the complementarity of the nucleotide sequences of MGC45840 BINDING SITE, designated SEQ ID:19671, to the nucleotide sequence of GAM8297 RNA, herein designated GAM RNA, also designated SEQ ID:367.

Another function of GAM8297 is therefore inhibition of MGC45840 (Accession NP_775855.1). Accordingly, utilities of GAM8297 include diagnosis, prevention and treatment of diseases and clinical conditions associated with MGC45840.

MGC4737 (Accession NP_113654.1) is another GAM8297 target gene, herein designated TARGET GENE. MGC4737 BINDING SITE is a target binding site found in the 5' untranslated region of mRNA encoded by MGC4737, corresponding to a target binding site such as BINDING SITE I, BINDING SITE II or BINDING SITE III of FIG. 8. Table 4 illustrates the complementarity of the nucleotide sequences of MGC4737 BINDING SITE, designated SEQ ID:4951, to the nucleotide sequence of GAM8297 RNA, herein designated GAM RNA, also designated SEQ ID:367.

Another function of GAM8297 is therefore inhibition of MGC4737 (Accession NP_113654.1). Accordingly, utilities of GAM8297 include diagnosis, prevention and treatment of diseases and clinical conditions associated with MGC4737.

MGC4796 (Accession NP_114406.1) is another GAM8297 target gene, herein designated TARGET GENE. MGC4796 BINDING SITE is a target binding site found in the 3' untranslated region of multiple transcripts of mRNA encoded by MGC4796, corresponding to a target binding site such as BINDING SITE I, BINDING SITE II or BINDING SITE III of FIG. 8. Table 4 illustrates the complementarity of the nucleotide sequences of MGC4796 BINDING SITE, designated SEQ ID:4380, to the nucleotide sequence of GAM8297 RNA, herein designated GAM RNA, also designated SEQ ID:367.

Another function of GAM8297 is therefore inhibition of MGC4796 (Accession NP_114406.1). Accordingly, utilities of GAM8297 include diagnosis, prevention and treatment of diseases and clinical conditions associated with MGC4796.

MGC5391 (Accession NP_116129.2) is another GAM8297 target gene, herein designated TARGET GENE. MGC5391 BINDING SITE is a target binding site found in the 3' untranslated region of mRNA encoded by MGC5391, corresponding to a target binding site such as BINDING SITE I, BINDING SITE II or BINDING SITE III of FIG. 8. Table 4 illustrates the complementarity of the nucleotide sequences of MGC5391 BINDING SITE, designated SEQ ID:13373, to the nucleotide sequence of GAM8297 RNA, herein designated GAM RNA, also designated SEQ ID:367.

Another function of GAM8297 is therefore inhibition of MGC5391 (Accession NP_116129.2). Accordingly, utilities of GAM8297 include diagnosis, prevention and treatment of diseases and clinical conditions associated with MGC5391.

MGC5508 (Accession NP_076997.1) is another GAM8297 target gene, herein designated TARGET GENE. MGC5508 BINDING SITE is a target binding site found in the 3' untranslated region of mRNA encoded by MGC5508, corresponding to a target binding site such as BINDING SITE I, BINDING SITE II or BINDING SITE III of FIG. 8. Table 4 illustrates the complementarity of the nucleotide sequences of MGC5508 BINDING SITE, designated SEQ ID:4031, to the nucleotide sequence of GAM8297 RNA, herein designated GAM RNA, also designated SEQ ID:367.

Another function of GAM8297 is therefore inhibition of MGC5508 (Accession NP_076997.1). Accordingly, utilities of GAM8297 include diagnosis, prevention and treatment of diseases and clinical conditions associated with MGC5508.

MIRO-2 (Accession NP_620124.1) is another GAM8297 target gene, herein designated TARGET GENE. MIRO-2 BINDING SITE is a target binding site found in the 3' untranslated region of mRNA encoded by MIRO-2, corresponding to a target binding site such as BINDING SITE I, BINDING SITE II or BINDING SITE III of FIG. 8. Table 4 illustrates the complementarity of the nucleotide sequences of MIRO-2 BINDING SITE, designated SEQ ID:10083, to the nucleotide sequence of GAM8297 RNA, herein designated GAM RNA, also designated SEQ ID:367.

Another function of GAM8297 is therefore inhibition of MIRO-2 (Accession NP_620124.1). Accordingly, utilities of GAM8297 include diagnosis, prevention and treatment of diseases and clinical conditions associated with MIRO-2.

Megalencephalic leukoencephalopathy with subcortical cysts 1 (MLC1, Accession NP_631941.1) is another GAM8297 target gene, herein designated TARGET GENE. MLC1 BINDING SITE is a target binding site found in the 5' untranslated region of multiple transcripts of mRNA encoded by MLC1, corresponding to a target binding site such as BINDING SITE I, BINDING SITE II or BINDING SITE III of FIG. 8. Table 4 illustrates the complementarity of the nucleotide sequences of MLC1 BINDING SITE, designated SEQ ID:1467, to the nucleotide sequence of GAM8297 RNA, herein designated GAM RNA, also designated SEQ ID:367.

Another function of GAM8297 is therefore inhibition of Megalencephalic leukoencephalopathy with subcortical cysts 1 (MLC1, Accession NP_631941.1). Accordingly, utilities of GAM8297 include diagnosis, prevention and treatment of diseases and clinical conditions associated with MLC1.

Megalencephalic leukoencephalopathy with subcortical cysts 1 (MLC1, Accession NP_055981.1) is another GAM8297 target gene, herein designated TARGET GENE. MLC1 BINDING SITE is a target binding site found in the 5' untranslated region of multiple transcripts of mRNA encoded by MLC1, corresponding to a target binding site such as BINDING SITE I, BINDING SITE II or BINDING SITE III of FIG. 8. Table 4 illustrates the complementarity of the nucleotide sequences of MLC1 BINDING SITE, designated SEQ ID:1467, to the nucleotide sequence of GAM8297 RNA, herein designated GAM RNA, also designated SEQ ID:367.

Another function of GAM8297 is therefore inhibition of Megalencephalic leukoencephalopathy with subcortical cysts 1 (MLC1, Accession NP_055981.1). Accordingly, utilities of GAM8297 include diagnosis, prevention and treatment of diseases and clinical conditions associated with MLC1.

Mitochondrial ribosomal protein s27 (MRPS27, Accession NP_055899.1) is another GAM8297 target gene, herein designated TARGET GENE. MRPS27 BINDING SITE is a target binding site found in the 3' untranslated region of mRNA encoded by MRPS27, corresponding to a target binding site such as BINDING SITE I, BINDING SITE II or BINDING SITE III of FIG. 8. Table 4 illustrates the complementarity of the nucleotide sequences of MRPS27 BINDING SITE, designated SEQ ID:15026, to the nucleotide sequence of GAM8297 RNA, herein designated GAM RNA, also designated SEQ ID:367.

Another function of GAM8297 is therefore inhibition of Mitochondrial ribosomal protein s27 (MRPS27, Accession NP_055899.1). Accordingly, utilities of GAM8297 include diagnosis, prevention and treatment of diseases and clinical conditions associated with MRPS27.

MSTP028 (Accession NP_114160.1) is another GAM8297 target gene, herein designated TARGET GENE. MSTP028 BINDING SITE is a target binding site found in the 3' untranslated region of mRNA encoded by MSTP028, corresponding to a target binding site such as BINDING SITE I, BINDING SITE II or BINDING SITE III of FIG. 8. Table 4 illustrates the complementarity of the nucleotide sequences of MSTP028 BINDING SITE, designated SEQ ID:2725, to the nucleotide sequence of GAM8297 RNA, herein designated GAM RNA, also designated SEQ ID:367.

Another function of GAM8297 is therefore inhibition of MSTP028 (Accession NP_114160.1). Accordingly, utilities of GAM8297 include diagnosis, prevention and treatment of diseases and clinical conditions associated with MSTP028.

Methylene tetrahydrofolate dehydrogenase (nad+ dependent), methenyltetrahydrofolate cyclohydrolase (MTHFD2, Accession NP_006627.1) is another GAM8297 target gene, herein designated TARGET GENE. MTHFD2 BINDING SITE is a target binding site found in the 3' untranslated region of mRNA encoded by MTHFD2, corresponding to a target binding site such as BINDING SITE I, BINDING SITE II or BINDING SITE III of FIG. 8. Table 4 illustrates the complementarity of the nucleotide sequences of MTHFD2 BINDING SITE, designated SEQ ID:11949, to the nucleotide sequence of GAM8297 RNA, herein designated GAM RNA, also designated SEQ ID:367.

Another function of GAM8297 is therefore inhibition of Methylene tetrahydrofolate dehydrogenase (nad+ dependent), methenyltetrahydrofolate cyclohydrolase (MTHFD2, Accession NP_006627.1). Accordingly, utilities of GAM8297 include diagnosis, prevention and treatment of diseases and clinical conditions associated with MTHFD2.

Mucin 6, gastric (MUC6, Accession XP_290540.1) is another GAM8297 target gene, herein designated TARGET GENE. MUC6 BINDING SITE is a target binding site found in the 3' untranslated region of mRNA encoded by MUC6, corresponding to a target binding site such as BINDING SITE I, BINDING SITE II or BINDING SITE III of FIG. 8. Table 4 illustrates the complementarity of the nucleotide sequences of MUC6 BINDING SITE, designated SEQ ID:5705, to the nucleotide sequence of GAM8297 RNA, herein designated GAM RNA, also designated SEQ ID:367.

Another function of GAM8297 is therefore inhibition of Mucin 6, gastric (MUC6, Accession XP_290540.1). Accordingly, utilities of GAM8297 include diagnosis, prevention and treatment of diseases and clinical conditions associated with MUC6.

Myosin id (MYO1D, Accession XP_050041.4) is another GAM8297 target gene, herein designated TARGET GENE. MYO1D BINDING SITE is a target binding site found in the 3' untranslated region of mRNA encoded by MYO1D, corresponding to a target binding site such as BINDING SITE I, BINDING SITE II or BINDING SITE III of FIG. 8. Table 4 illustrates the complementarity of the nucleotide sequences of MYO1D BINDING SITE, designated SEQ ID:12931, to the nucleotide sequence of GAM8297 RNA, herein designated GAM RNA, also designated SEQ ID:367.

Another function of GAM8297 is therefore inhibition of Myosin id (MYO1D, Accession XP_050041.4), a gene which is an unconventional myosin. Accordingly, utilities of GAM8297 include diagnosis, prevention and treatment of diseases and clinical conditions associated with MYO1D.

The function of MYO1D and its association with various diseases and clinical conditions, has been established by previous studies, as described hereinabove with reference to GAM227.1. Myosin iiia (MYO3A, Accession NP_059129.2) is another GAM8297 target gene, herein designated TARGET GENE. MYO3A BINDING SITE is a target binding site found in the 3' untranslated region of mRNA encoded by MYO3A, corresponding to a target binding site such as BINDING SITE I, BINDING SITE II or BINDING SITE III of FIG. 8. Table 4 illustrates the complementarity of the nucleotide sequences of MYO3A BINDING SITE, designated SEQ ID:9274, to the nucleotide sequence of GAM8297 RNA, herein designated GAM RNA, also designated SEQ ID:367.

Another function of GAM8297 is therefore inhibition of Myosin iiia (MYO3A, Accession NP_059129.2), a gene which may have a role in photoreceptor function and/or maintenance. and therefore is associated with Deafness, autosomal recessive 30. Accordingly, utilities of GAM8297 include diagnosis, prevention and treatment of Deafness, autosomal recessive 30, and of other diseases and clinical conditions associated with MYO3A.

The function of MYO3A and its association with various diseases and clinical conditions, has been established by previous studies, as described hereinabove with reference to GAM1195.1. Myozenin 2 (MYOZ2, Accession NP_057683.1) is another GAM8297 target gene, herein designated TARGET GENE. MYOZ2 BINDING SITE is a target binding site found in the 5' untranslated region of mRNA encoded by MYOZ2, corresponding to a target binding site such as BINDING SITE I, BINDING SITE II or BINDING SITE III of FIG. 8. Table 4 illustrates the complementarity of the nucleotide sequences of MYOZ2 BINDING SITE, designated SEQ ID:7556, to the nucleotide sequence of GAM8297 RNA, herein designated GAM RNA, also designated SEQ ID:367.

Another function of GAM8297 is therefore inhibition of Myozenin 2 (MYOZ2, Accession NP_057683.1). Accordingly, utilities of GAM8297 include diagnosis, prevention and treatment of diseases and clinical conditions associated with MYOZ2.

Neuron navigator 3 (NAV3, Accession NP_055718.2) is another GAM8297 target gene, herein designated TARGET GENE. NAV3 BINDING SITE is a target binding site found in the 3' untranslated region of mRNA encoded by NAV3, corresponding to a target binding site such as BINDING SITE I, BINDING SITE II or BINDING SITE III of FIG. 8. Table 4 illustrates the complementarity of the nucleotide sequences of NAV3 BINDING SITE, designated SEQ ID:5758, to the nucleotide sequence of GAM8297 RNA, herein designated GAM RNA, also designated SEQ ID:367.

Another function of GAM8297 is therefore inhibition of Neuron navigator 3 (NAV3, Accession NP_055718.2). Accordingly, utilities of GAM8297 include diagnosis, prevention and treatment of diseases and clinical conditions associated with NAV3.

Norrie disease (pseudoglioma) (NDP, Accession NP_000257.1) is another GAM8297 target gene, herein designated TARGET GENE. NDP BINDING SITE is a target binding site found in the 5' untranslated region of mRNA encoded by NDP, corresponding to a target binding site such as BINDING SITE I, BINDING SITE II or BINDING SITE III of FIG. 8. Table 4 illustrates the complementarity of the nucleotide sequences of NDP BINDING SITE, designated SEQ ID:17354, to the nucleotide sequence of GAM8297 RNA, herein designated GAM RNA, also designated SEQ ID:367.

Another function of GAM8297 is therefore inhibition of Norrie disease (pseudoglioma) (NDP, Accession NP_000257.1), a gene which may be involved in a pathway that regulates neural cell differentiation and proliferation and therefore is associated with Norrie disease (nd), familial exudative vitreoretinopathy. Accordingly, utilities of GAM8297 include diagnosis, prevention and treatment of Norrie disease (nd), familial exudative vitreoretinopathy, and of other diseases and clinical conditions associated with NDP.

The function of NDP and its association with various diseases and clinical conditions, has been established by previous studies, as described hereinabove with reference to GAM206.1. Neuropilin (nrp) and tolloid (tll)-like 1 (NETO1, Accession NP_620552.1) is another GAM8297 target gene, herein designated TARGET GENE. NETO1 BINDING SITE is a target binding site found in the 3' untranslated region of multiple transcripts of mRNA encoded by NETO1, corresponding to a target binding site such as BINDING SITE I, BINDING SITE II or BINDING SITE III of FIG. 8. Table 4 illustrates the complementarity of the nucleotide sequences of NETO1 BINDING SITE, designated SEQ ID:3758, to the nucleotide sequence of GAM8297 RNA, herein designated GAM RNA, also designated SEQ ID:367.

Another function of GAM8297 is therefore inhibition of Neuropilin (nrp) and tolloid (tll)-like 1 (NETO1, Accession NP_620552.1). Accordingly, utilities of GAM8297 include diagnosis, prevention and treatment of diseases and clinical conditions associated with NETO1.

Nuclear factor of kappa light polypeptide gene enhancer in b-cells inhibitor-like 1 (NFKBIL1, Accession NP_004998.2) is another GAM8297 target gene, herein designated TARGET GENE. NFKBIL1 BINDING SITE is a target binding site found in the 3' untranslated region of mRNA encoded by NFKBIL1, corresponding to a target binding site such as BINDING SITE I, BINDING SITE II or BINDING SITE III of FIG. 8. Table 4 illustrates the complementarity of the nucleotide sequences of NFKBIL1 BINDING SITE, designated SEQ ID:7331, to the nucleotide sequence of GAM8297 RNA, herein designated GAM RNA, also designated SEQ ID:367.

Another function of GAM8297 is therefore inhibition of Nuclear factor of kappa light polypeptide gene enhancer in b-cells inhibitor-like 1 (NFKBIL1, Accession NP_004998.2), a gene which is similar to the I kappa B family of proteins and contains ankyrin repeats. Accordingly, utilities of GAM8297 include diagnosis, prevention and treatment of diseases and clinical conditions associated with NFKBIL1.

The function of NFKBIL1 and its association with various diseases and clinical conditions, has been established by previous studies, as described hereinabove with reference to GAM500.1. Natural killer-tumor recognition sequence (NKTR, Accession NP_005376.2) is another GAM8297 target gene, herein designated TARGET GENE. NKTR BINDING SITE is a target binding site found in the 3' untranslated region of mRNA encoded by NKTR, corresponding to a target binding site such as BINDING SITE I, BINDING SITE II or BINDING SITE III of FIG. 8. Table 4 illustrates the complementarity of the nucleotide sequences of NKTR BINDING SITE, designated SEQ ID:4907, to the nucleotide sequence of GAM8297 RNA, herein designated GAM RNA, also designated SEQ ID:367.

Another function of GAM8297 is therefore inhibition of Natural killer-tumor recognition sequence (NKTR, Accession NP_005376.2), a gene which is involved in the function of nk cells. Accordingly, utilities of GAM8297 include diagnosis, prevention and treatment of diseases and clinical conditions associated with NKTR.

The function of NKTR and its association with various diseases and clinical conditions, has been established by previous studies, as described hereinabove with reference to GAM467.2. NLI-IF (Accession NP_067021.1) is another GAM8297 target gene, herein designated TARGET GENE. NLI-IF BINDING SITE is a target binding site found in the 3' untranslated region of mRNA encoded by NLI-IF, corresponding to a target binding site such as BINDING SITE I, BINDING SITE II or BINDING SITE III of FIG. 8. Table 4 illustrates the complementarity of the nucleotide sequences of NLI-IF BINDING SITE, designated SEQ ID:15666, to the nucleotide sequence of GAM8297 RNA, herein designated GAM RNA, also designated SEQ ID:367.

Another function of GAM8297 is therefore inhibition of NLI-IF (Accession NP_067021.1). Accordingly, utilities of GAM8297 include diagnosis, prevention and treatment of diseases and clinical conditions associated with NLI-IF.

Niemann-pick disease, type c2 (NPC2, Accession NP_006423.1) is another GAM8297 target gene, herein designated TARGET GENE. NPC2 BINDING SITE is a target binding site found in the 3' untranslated region of mRNA encoded by NPC2, corresponding to a target binding site such as BINDING SITE I, BINDING SITE II or BINDING SITE III of FIG. 8. Table 4 illustrates the complementarity of the nucleotide sequences of NPC2 BINDING SITE, designated SEQ ID:14591, to the nucleotide sequence of GAM8297 RNA, herein designated GAM RNA, also designated SEQ ID:367.

Another function of GAM8297 is therefore inhibition of Niemann-pick disease, type c2 (NPC2, Accession NP_006423.1). Accordingly, utilities of GAM8297 include diagnosis, prevention and treatment of diseases and clinical conditions associated with NPC2.

NSG-X (Accession NP_055226.1) is another GAM8297 target gene, herein designated TARGET GENE. NSG-X BINDING SITE is a target binding site found in the 3' untranslated region of mRNA encoded by NSG-X, corresponding to a target binding site such as BINDING SITE I, BINDING SITE II or BINDING SITE III of FIG. 8. Table 4 illustrates the complementarity of the nucleotide sequences of NSG-X BINDING SITE, designated SEQ ID:2106, to the nucleotide sequence of GAM8297 RNA, herein designated GAM RNA, also designated SEQ ID:367.

Another function of GAM8297 is therefore inhibition of NSG-X (Accession NP_055226.1). Accordingly, utilities of GAM8297 include diagnosis, prevention and treatment of diseases and clinical conditions associated with NSG-X.

Neurexophilin 3 (NXPH3, Accession NP_009156.1) is another GAM8297 target gene, herein designated TARGET GENE. NXPH3 BINDING SITE is a target binding site found in the 3' untranslated region of mRNA encoded by NXPH3, corresponding to a target binding site such as BINDING SITE I, BINDING SITE II or BINDING SITE III of FIG. 8. Table 4 illustrates the complementarity of the nucleotide sequences of NXPH3 BINDING SITE, designated SEQ ID:12898, to the nucleotide sequence of GAM8297 RNA, herein designated GAM RNA, also designated SEQ ID:367.

Another function of GAM8297 is therefore inhibition of Neurexophilin 3 (NXPH3, Accession NP_009156.1). Accordingly, utilities of GAM8297 include diagnosis, prevention and treatment of diseases and clinical conditions associated with NXPH3.

NYD-SP11 (Accession NP_114157.2) is another GAM8297 target gene, herein designated TARGET GENE. NYD-SP11 BINDING SITE is a target binding site found in the 3' untranslated region of mRNA encoded by NYD-SP11, corresponding to a target binding site such as BINDING SITE I, BINDING SITE II or BINDING SITE III of FIG. 8. Table 4 illustrates the complementarity of the nucleotide sequences of NYD-SP11 BINDING SITE, designated SEQ ID:9259, to the nucleotide sequence of GAM8297 RNA, herein designated GAM RNA, also designated SEQ ID:367.

Another function of GAM8297 is therefore inhibition of NYD-SP11 (Accession NP_114157.2). Accordingly, utilities of GAM8297 include diagnosis, prevention and treatment of diseases and clinical conditions associated with NYD-SP11.

2'-5'-oligoadenylate synthetase 3, 100 kda (OAS3, Accession NP_006178.1) is another GAM8297 target gene, herein designated TARGET GENE. OAS3 BINDING SITE is a target binding site found in the 3' untranslated region of mRNA encoded by OAS3, corresponding to a target binding site such as BINDING SITE I, BINDING SITE II or BINDING SITE III of FIG. 8. Table 4 illustrates the complementarity of the nucleotide sequences of OAS3 BINDING SITE, designated SEQ ID:3720, to the nucleotide sequence of GAM8297 RNA, herein designated GAM RNA, also designated SEQ ID:367.

Another function of GAM8297 is therefore inhibition of 2'-5'-oligoadenylate synthetase 3, 100 kda (OAS3, Accession NP_006178.1), a gene which may play a role in mediating resistance to virus infection, control of cell growth, differentiation, and apoptosis. Accordingly, utilities of GAM8297 include diagnosis, prevention and treatment of diseases and clinical conditions associated with OAS3.

The function of OAS3 and its association with various diseases and clinical conditions, has been established by previous studies, as described hereinabove with reference to GAM63.1. Purinergic receptor p2x, ligand-gated ion channel, 1 (P2RX1, Accession NP_002549.1) is another GAM8297 target gene, herein designated TARGET GENE. P2RX1 BINDING SITE is a target binding site found in the 5' untranslated region of mRNA encoded by P2RX1, corresponding to a target binding site such as BINDING SITE I, BINDING SITE II or BINDING SITE III of FIG. 8. Table 4 illustrates the complementarity of the nucleotide sequences of P2RX1 BINDING SITE, designated SEQ ID:2491, to the nucleotide sequence of GAM8297 RNA, herein designated GAM RNA, also designated SEQ ID:367.

Another function of GAM8297 is therefore inhibition of Puringergic receptor p2x, ligand-gated ion channel, 1 (P2RX1, Accession NP_002549.1). Accordingly, utilities of GAM8297 include diagnosis, prevention and treatment of diseases and clinical conditions associated with P2RX1.

Protocadherin 11 x-linked (PCDH11X, Accession NP_116751.1) is another GAM8297 target gene, herein designated TARGET GENE. PCDH11X BINDING SITE is a target binding site found in the 3' untranslated region of multiple transcripts of mRNA encoded by PCDH11X, corresponding to a target binding site such as BINDING SITE I, BINDING SITE II or BINDING SITE III of FIG. 8. Table 4 illustrates the complementarity of the nucleotide sequences of PCDH11X BINDING SITE, designated SEQ ID:11504, to the nucleotide sequence of GAM8297 RNA, herein designated GAM RNA, also designated SEQ ID:367.

Another function of GAM8297 is therefore inhibition of Protocadherin 11 x-linked (PCDH11X, Accession NP_116751.1), a gene which is thought to play a fundamental role in cell-cell recognition essential for the segmental development and function of the central nervous system. Accordingly, utilities of GAM8297 include diagnosis, prevention and treatment of diseases and clinical conditions associated with PCDH11X.

The function of PCDH11X and its association with various diseases and clinical conditions, has been established by previous studies, as described hereinabove with reference to GAM347.2. Protocadherin 11 x-linked (PCDH11X, Accession NP_116750.1) is another GAM8297 target gene, herein designated TARGET GENE. PCDH11X BINDING SITE is a target binding site found in the 3' untranslated region of multiple transcripts of mRNA encoded by PCDH11X, corresponding to a target binding site such as BINDING SITE I, BINDING SITE II or BINDING SITE III of FIG. 8. Table 4 illustrates the complementarity of the nucleotide sequences of PCDH11X BINDING SITE, designated SEQ ID:11504, to the nucleotide sequence of GAM8297 RNA, herein designated GAM RNA, also designated SEQ ID:367.

Another function of GAM8297 is therefore inhibition of Protocadherin 11 x-linked (PCDH11X, Accession NP_116750.1), a gene which is thought to play a fundamental role in cell-cell recognition essential for the segmental development and function of the central nervous system. Accordingly, utilities of GAM8297 include diagnosis, prevention and treatment of diseases and clinical conditions associated with PCDH11X.

The function of PCDH11X and its association with various diseases and clinical conditions, has been established by previous studies, as described hereinabove with reference to GAM347.2. Protocadherin 11 y-linked (PCDH11Y, Accession NP_116755.1) is another GAM8297 target gene, herein designated TARGET GENE. PCDH11Y BINDING SITE is a target binding site found in the 3' untranslated region of multiple transcripts of mRNA encoded by PCDH11Y, corresponding to a target binding site such as BINDING SITE I, BINDING SITE II or BINDING SITE III of FIG. 8. Table 4 illustrates the complementarity of the nucleotide sequences of PCDH11Y BINDING SITE, designated SEQ ID:11504, to the nucleotide sequence of GAM8297 RNA, herein designated GAM RNA, also designated SEQ ID:367.

Another function of GAM8297 is therefore inhibition of Protocadherin 11 y-linked (PCDH11Y, Accession NP_116755.1). Accordingly, utilities of GAM8297 include diagnosis, prevention and treatment of diseases and clinical conditions associated with PCDH11Y.

Protocadherin gamma subfamily a, 1 (PCDHGA1, Accession NP_061735.1) is another GAM8297 target gene, herein designated TARGET GENE. PCDHGA1 BINDING SITE is a target binding site found in the 3' untranslated region of mRNA encoded by PCDHGA1, corresponding to a target binding site such as BINDING SITE I, BINDING SITE II or BINDING SITE III of FIG. 8. Table 4 illustrates the complementarity of the nucleotide sequences of PCDHGA1 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 1 (PCDHGA1, Accession NP_061735.1). Accordingly, utilities of GAM8297 include diagnosis, prevention and treatment of diseases and clinical conditions associated with PCDHGA1.

Protocadherin gamma subfamily a, 10 (PCDHGA10, Accession NP_061736.1) is another GAM8297 target gene, herein designated TARGET GENE. PCDHGA10 BINDING SITE is a target binding site found in the 3' untranslated region of mRNA encoded by PCDHGA10, corresponding to a target binding site such as BINDING SITE I, BINDING SITE II or BINDING SITE III of FIG. 8. Table 4 illustrates the complementarity of the nucleotide sequences of PCDHGA10 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 10 (PCDHGA10, Accession NP_061736.1). Accordingly, utilities of GAM8297 include diagnosis, prevention and treatment of diseases and clinical conditions associated with PCDHGA10.

Protocadherin gamma subfamily a, 11 (PCDHGA11, Accession NP_061737.1) is another GAM8297 target gene, herein designated TARGET GENE. PCDHGA11 BINDING SITE is a target binding site found in the 3' untranslated region of multiple transcripts of mRNA encoded by PCDHGA11, corresponding to a target binding site such as BINDING SITE I, BINDING SITE II or BINDING SITE III of FIG. 8. Table 4 illustrates the complementarity of the nucleotide sequences of PCDHGA11 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 11 (PCDHGA11, Accession NP_061737.1). Accordingly, utilities of GAM8297 include diagnosis, prevention and treatment of diseases and clinical conditions associated with PCDHGA11.

Protocadherin gamma subfamily a, 11 (PCDHGA11, Accession NP_114481.1) is another GAM8297 target gene, herein designated TARGET GENE. PCDHGA11 BINDING SITE is a target binding site found in the 3' untranslated region of multiple transcripts of mRNA encoded by PCDHGA11, corresponding to a target binding site such as BINDING SITE I, BINDING SITE II or BINDING SITE III of FIG. 8. Table 4 illustrates the complementarity of the nucleotide sequences of PCDHGA11 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 11 (PCDHGA11, Accession NP_114481.1). Accordingly, utilities of GAM8297 include diagnosis, prevention and treatment of diseases and clinical conditions associated with PCDHGA11.

Protocadherin gamma subfamily a, 12 (PCDHGA12, Accession NP_003726.1) is another GAM8297 target gene, herein designated TARGET GENE. PCDHGA12 BINDING SITE is a target binding site found in the 3' untranslated region of multiple transcripts of mRNA encoded by PCDHGA12, corresponding to a target binding site such as BINDING SITE I, BINDING SITE II or BINDING SITE III of FIG. 8. Table 4 illustrates the complementarity of the nucleotide sequences of PCDHGA12 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 12 (PCDHGA12, Accession NP_003726.1), a gene which potential calcium-dependent cell-adhesion protein. Accordingly, utilities of GAM8297 include diagnosis, prevention and treatment of diseases and clinical conditions associated with PCDHGA12.

The function of PCDHGA12 and its association with various diseases and clinical conditions, has been established by previous studies, as described hereinabove with reference to GAM607.2. Protocadherin gamma subfamily a, 2 (PCDHGA2, Accession NP_061738.1) is another GAM8297 target gene, herein designated TARGET GENE. PCDHGA2 BINDING SITE is a target binding site found in the 3' untranslated region of multiple transcripts of mRNA encoded by PCDHGA2, corresponding to a target binding site such as BINDING SITE I, BINDING SITE II or BINDING SITE III of FIG. 8. Table 4 illustrates the complementarity of the nucleotide sequences of PCDHGA2 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 2 (PCDHGA2, Accession NP_061738.1). Accordingly, utilities of GAM8297 include diagnosis, prevention and treatment of diseases and clinical conditions associated with PCDHGA2.

Protocadherin gamma subfamily a, 3 (PCDHGA3, Accession NP_061739.2) is another GAM8297 target gene, herein designated TARGET GENE. PCDHGA3 BINDING SITE is a target binding site found in the 3' untranslated region of mRNA encoded by PCDHGA3, corresponding to a target binding site such as BINDING SITE I, BINDING SITE II or BINDING SITE III of FIG. 8. Table 4 illustrates the complementarity of the nucleotide sequences of PCDHGA3 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 3 (PCDHGA3, Accession NP_061739.2), a gene which is a potential calcium-dependent cell-adhesion protein. Accordingly, utilities of GAM8297 include diagnosis, prevention and treatment of diseases and clinical conditions associated with PCDHGA3.

The function of PCDHGA3 and its association with various diseases and clinical conditions, has been established by previous studies, as described hereinabove with reference to GAM607.2. Protocadherin gamma subfamily a, 4 (PCDHGA4, Accession NP_061740.1) is another GAM8297 target gene, herein designated TARGET GENE. PCDHGA4 BINDING SITE is a target binding site found in the 3' untranslated region of multiple transcripts of mRNA encoded by PCDHGA4, corresponding to a target binding site such as BINDING SITE I, BINDING SITE II or BINDING SITE III of FIG. 8. Table 4 illustrates the complementarity of the nucleotide sequences of PCDHGA4 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 4 (PCDHGA4, Accession NP_061740.1). Accordingly, utilities of GAM8297 include diagnosis, prevention and treatment of diseases and clinical conditions associated with PCDHGA4.

Protocadherin gamma subfamily a, 5 (PCDHGA5, Accession NP_061741.1) is another GAM8297 target gene, herein designated TARGET GENE. PCDHGA5 BINDING SITE is a target binding site found in the 3' untranslated region of mRNA encoded by PCDHGA5, corresponding to a target binding site such as BINDING SITE I, BINDING SITE II or BINDING SITE III of FIG. 8. Table 4 illustrates the complementarity of the nucleotide sequences of PCDHGA5 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 5 (PCDHGA5, Accession NP_061741.1), a gene which is a potential calcium-dependent cell-adhesion protein. Accordingly, utilities of GAM8297 include diagnosis, prevention and treatment of diseases and clinical conditions associated with PCDHGA5.

The function of PCDHGA5 and its association with various diseases and clinical conditions, has been established by previous studies, as described hereinabove with reference to GAM607.2. Protocadherin gamma subfamily a, 6 (PCDHGA6, Accession NP_061742.1) is another GAM8297 target gene, herein designated TARGET GENE. PCDHGA6 BINDING SITE is a target binding site found in the 3' untranslated region of mRNA encoded by PCDHGA6, corresponding to a target binding site such as BINDING SITE I, BINDING SITE II or BINDING SITE III of FIG. 8. Table 4 illustrates the complementarity of the nucleotide sequences of PCDHGA6 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 6 (PCDHGA6, Accession NP_061742.1). Accordingly, utilities of GAM8297 include diagnosis, prevention and treatment of diseases and clinical conditions associated with PCDHGA6.

Protocadherin gamma subfamily a, 7 (PCDHGA7, Accession NP_061743.1) is another GAM8297 target gene, herein designated TARGET GENE. PCDHGA7 BINDING SITE is a target binding site found in the 3' untranslated region of multiple transcripts of mRNA encoded by PCDHGA7, corresponding to a target binding site such as BINDING SITE I, BINDING SITE II or BINDING SITE III of FIG. 8. Table 4 illustrates the complementarity of the nucleotide sequences of PCDHGA7 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 7 (PCDHGA7, Accession NP_061743.1). Accordingly, utilities of GAM8297 include diagnosis, prevention and treatment of diseases and clinical conditions associated with PCDHGA7.

Protocadherin gamma subfamily a, 8 (PCDHGA8, Accession NP_114477.1) is another GAM8297 target gene, herein designated TARGET GENE. PCDHGA8 BINDING SITE is a target binding site found in the 3' untranslated region of multiple transcripts of mRNA encoded by PCDHGA8, corresponding to a target binding site such as BINDING SITE I, BINDING SITE II or BINDING SITE III of FIG. 8. Table 4 illustrates the complementarity of the nucleotide sequences of PCDHGA8 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 8 (PCDHGA8, Accession NP_114477.1), a gene which is a potential calcium-dependent cell-adhesion protein. Accordingly, utilities of GAM8297 include diagnosis, prevention and treatment of diseases and clinical conditions associated with PCDHGA8.

The function of PCDHGA8 and its association with various diseases and clinical conditions, has been established by previous studies, as described hereinabove with reference to GAM607.2. Protocadherin gamma subfamily a, 9 (PCDHGA9, Accession NP_061744.1) is another GAM8297 target gene, herein designated TARGET GENE. PCDHGA9 BINDING SITE is a target binding site found in the 3' untranslated region of mRNA encoded by PCDHGA9, corresponding to a target binding site such as BINDING SITE I, BINDING SITE II or BINDING SITE III of FIG. 8. Table 4 illustrates the complementarity of the nucleotide sequences of PCDHGA9 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily a, 9 (PCDHGA9, Accession NP_061744.1). Accordingly, utilities of GAM8297 include diagnosis, prevention and treatment of diseases and clinical conditions associated with PCDHGA9.

Protocadherin gamma subfamily b, 1 (PCDHGB1, Accession NP_061745.1) is another GAM8297 target gene, herein designated TARGET GENE. PCDHGB1 BINDING SITE is a target binding site found in the 3' untranslated region of mRNA encoded by PCDHGB1, corresponding to a target binding site such as BINDING SITE I, BINDING SITE II or BINDING SITE III of FIG. 8. Table 4 illustrates the complementarity of the nucleotide sequences of PCDHGB1 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily b, 1 (PCDHGB1, Accession NP_061745.1). Accordingly, utilities of GAM8297 include diagnosis, prevention and treatment of diseases and clinical conditions associated with PCDHGB1.

Protocadherin gamma subfamily b, 2 (PCDHGB2, Accession NP_061746.1) is another GAM8297 target gene, herein designated TARGET GENE. PCDHGB2 BINDING SITE is a target binding site found in the 3' untranslated region of mRNA encoded by PCDHGB2, corresponding to a target binding site such as BINDING SITE I, BINDING SITE II or BINDING SITE III of FIG. 8. Table 4 illustrates the complementarity of the nucleotide sequences of PCDHGB2 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily b, 2 (PCDHGB2, Accession NP_061746.1). Accordingly, utilities of GAM8297 include diagnosis, prevention and treatment of diseases and clinical conditions associated with PCDHGB2.

Protocadherin gamma subfamily b, 3 (PCDHGB3, Accession NP_061747.1) is another GAM8297 target gene, herein designated TARGET GENE. PCDHGB3 BINDING SITE is a target binding site found in the 3' untranslated region of mRNA encoded by PCDHGB3, corresponding to a target binding site such as BINDING SITE I, BINDING SITE II or BINDING SITE III of FIG. 8. Table 4 illustrates the complementarity of the nucleotide sequences of PCDHGB3 BIND- ING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily b, 3 (PCDHGB3, Accession NP_061747.1). Accordingly, utilities of GAM8297 include diagnosis, prevention and treatment of diseases and clinical conditions associated with PCDHGB3.

Protocadherin gamma subfamily b, 4 (PCDHGB4, Accession NP_003727.1) is another GAM8297 target gene, herein designated TARGET GENE. PCDHGB4 BINDING SITE is a target binding site found in the 3' untranslated region of mRNA encoded by PCDHGB4, corresponding to a target binding site such as BINDING SITE I, BINDING SITE II or BINDING SITE III of FIG. 8. Table 4 illustrates the complementarity of the nucleotide sequences of PCDHGB4 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily b, 4 (PCDHGB4, Accession NP_003727.1), a gene which is a potential calcium-dependent cell-adhesion protein. Accordingly, utilities of GAM8297 include diagnosis, prevention and treatment of diseases and clinical conditions associated with PCDHGB4.

The function of PCDHGB4 and its association with various diseases and clinical conditions, has been established by previous studies, as described hereinabove with reference to GAM607.2. Protocadherin gamma subfamily b, 5 (PCDHGB5, Accession NP_061748.1) is another GAM8297 target gene, herein designated TARGET GENE. PCDHGB5 BINDING SITE is a target binding site found in the 3' untranslated region of mRNA encoded by PCDHGB5, corresponding to a target binding site such as BINDING SITE I, BINDING SITE II or BINDING SITE III of FIG. 8. Table 4 illustrates the complementarity of the nucleotide sequences of PCDHGB5 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily b, 5 (PCDHGB5, Accession NP_061748.1). Accordingly, utilities of GAM8297 include diagnosis, prevention and treatment of diseases and clinical conditions associated with PCDHGB5.

Protocadherin gamma subfamily b, 6 (PCDHGB6, Accession NP_061749.1) is another GAM8297 target gene, herein designated TARGET GENE. PCDHGB6 BINDING SITE is a target binding site found in the 3' untranslated region of mRNA encoded by PCDHGB6, corresponding to a target binding site such as BINDING SITE I, BINDING SITE II or BINDING SITE III of FIG. 8. Table 4 illustrates the complementarity of the nucleotide sequences of PCDHGB6 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily b, 6 (PCDHGB6, Accession NP_061749.1). Accordingly, utilities of GAM8297 include diagnosis, prevention and treatment of diseases and clinical conditions associated with PCDHGB6.

Protocadherin gamma subfamily b, 7 (PCDHGB7, Accession NP_061750.1) is another GAM8297 target gene, herein designated TARGET GENE. PCDHGB7 BINDING SITE is a target binding site found in the 3' untranslated region of multiple transcripts of mRNA encoded by PCDHGB7, corresponding to a target binding site such as BINDING SITE I, BINDING SITE II or BINDING SITE III of FIG. 8. Table 4 illustrates the complementarity of the nucleotide sequences of PCDHGB7 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily b, 7 (PCDHGB7, Accession NP_061750.1), a gene which is a potential calcium-dependent cell-adhesion protein. Accordingly, utilities of GAM8297 include diagnosis, prevention and treatment of diseases and clinical conditions associated with PCDHGB7.

The function of PCDHGB7 and its association with various diseases and clinical conditions, has been established by previous studies, as described hereinabove with reference to GAM607.2. Protocadherin gamma subfamily c, 3 (PCDHGC3, Accession NP_115779.1) is another GAM8297 target gene, herein designated TARGET GENE. PCDHGC3 BINDING SITE is a target binding site found in the 3' untranslated region of multiple transcripts of mRNA encoded by PCDHGC3, corresponding to a target binding site such as BINDING SITE I, BINDING SITE II or BINDING SITE III of FIG. 8. Table 4 illustrates the complementarity of the nucleotide sequences of PCDHGC3 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily c, 3 (PCDHGC3, Accession NP_115779.1), a gene which is a potential calcium-dependent cell-adhesion protein. Accordingly, utilities of GAM8297 include diagnosis, prevention and treatment of diseases and clinical conditions associated with PCDHGC3.

The function of PCDHGC3 and its association with various diseases and clinical conditions, has been established by previous studies, as described hereinabove with reference to GAM607.2. Protocadherin gamma subfamily c, 3 (PCDHGC3, Accession NP_002579.2) is another GAM8297 target gene, herein designated TARGET GENE. PCDHGC3 BINDING SITE is a target binding site found in the 3' untranslated region of multiple transcripts of mRNA encoded by PCDHGC3, corresponding to a target binding site such as BINDING SITE I, BINDING SITE II or BINDING SITE III of FIG. 8. Table 4 illustrates the complementarity of the nucleotide sequences of PCDHGC3 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily c, 3 (PCDHGC3, Accession NP_002579.2), a gene which is a potential calcium-dependent cell-adhesion protein. Accordingly, utilities of GAM8297 include diagnosis, prevention and treatment of diseases and clinical conditions associated with PCDHGC3.

The function of PCDHGC3 and its association with various diseases and clinical conditions, has been established by previous studies, as described hereinabove with reference to GAM607.2. Protocadherin gamma subfamily c, 4 (PCDHGC4, Accession NP_061751.1) is another GAM8297 target gene, herein designated TARGET GENE. PCDHGC4 BINDING SITE is a target binding site found in the 3' untranslated region of mRNA encoded by PCDHGC4, corresponding to a target binding site such as BINDING SITE I, BINDING SITE II or BINDING SITE III of FIG. 8. Table 4 illustrates the complementarity of the nucleotide sequences of PCDHGC4 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily c, 4 (PCDHGC4, Accession NP_061751.1), a gene which is a potential calcium-dependent cell-adhesion protein. Accordingly, utilities of GAM8297 include diagnosis, prevention and treatment of diseases and clinical conditions associated with PCDHGC4.

The function of PCDHGC4 and its association with various diseases and clinical conditions, has been established by previous studies, as described hereinabove with reference to GAM607.2. Protocadherin gamma subfamily c, 5 (PCDHGC5, Accession NP_061752.1) is another GAM8297 target gene, herein designated TARGET GENE. PCDHGC5 BINDING SITE is a target binding site found in the 3' untranslated region of mRNA encoded by PCDHGC5, corresponding to a target binding site such as BINDING SITE I, BINDING SITE II or BINDING SITE III of FIG. 8. Table 4 illustrates the complementarity of the nucleotide sequences of PCDHGC5 BINDING SITE, designated SEQ ID:3215, to the nucleotide sequence of GAM8297 RNA, herein designated GAM RNA, also designated SEQ ID:367.

Another function of GAM8297 is therefore inhibition of Protocadherin gamma subfamily c, 5 (PCDHGC5, Accession NP_061752.1). Accordingly, utilities of GAM8297 include diagnosis, prevention and treatment of diseases and clinical conditions associated with PCDHGC5.

Platelet-derived growth factor receptor, beta polypeptide (PDGFRB, Accession NP_002600.1) is another GAM8297 target gene, herein designated TARGET GENE. PDGFRB BINDING SITE is a target binding site found in the 3' untranslated region of mRNA encoded by PDGFRB, corresponding to a target binding site such as BINDING SITE I, BINDING SITE II or BINDING SITE III of FIG. 8. Table 4 illustrates the complementarity of the nucleotide sequences of PDGFRB BINDING SITE, designated SEQ ID:10084, to the nucleotide sequence of GAM8297 RNA, herein designated GAM RNA, also designated SEQ ID:367.

Another function of GAM8297 is therefore inhibition of Platelet-derived growth factor receptor, beta polypeptide (PDGFRB, Accession NP_002600.1), a gene which Platelet-derived growth factor receptor beta chain; tyrosine kinase receptor. and therefore may be associated with Chronic myeloproliferative diseases. Accordingly, utilities of GAM8297 include diagnosis, prevention and treatment of Chronic myeloproliferative diseases, and of other diseases and clinical conditions associated with PDGFRB.

The function of PDGFRB and its association with various diseases and clinical conditions, has been established by previous studies, as described hereinabove with reference to GAM579.1. Pelota homolog (drosophila) (PELO, Accession NP_057030.2) is another GAM8297 target gene, herein designated TARGET GENE. PELO BINDING SITE is a target binding site found in the 5' untranslated region of mRNA encoded by PELO, corresponding to a target binding site such as BINDING SITE I, BINDING SITE II or BINDING SITE III of FIG. 8. Table 4 illustrates the complementarity of the nucleotide sequences of PELO BINDING SITE, designated SEQ ID:2948, to the nucleotide sequence of GAM8297 RNA, herein designated GAM RNA, also designated SEQ ID:367.

Another function of GAM8297 is therefore inhibition of Pelota homolog (drosophila) (PELO, Accession NP_057030.2), a gene which may has a role in spermatogenesis, mitotic division, and patterning. Accordingly, utilities of GAM8297 include diagnosis, prevention and treatment of diseases and clinical conditions associated with PELO.

The function of PELO and its association with various diseases and clinical conditions, has been established by previous studies, as described hereinabove with reference to GAM702.1. Prohibitin (PHB, Accession NP_002625.1) is another GAM8297 target gene, herein designated TARGET GENE. PHB BINDING SITE is a target binding site found in the 3' untranslated region of mRNA encoded by PHB, corresponding to a target binding site such as BINDING SITE I, BINDING SITE II or BINDING SITE III of FIG. 8. Table 4 illustrates the complementarity of the nucleotide sequences of PHB BINDING SITE, designated SEQ ID:9136, to the nucleotide sequence of GAM8297 RNA, herein designated GAM RNA, also designated SEQ ID:367.

Another function of GAM8297 is therefore inhibition of Prohibitin (PHB, Accession NP_002625.1). Accordingly, utilities of GAM8297 include diagnosis, prevention and treatment of diseases and clinical conditions associated with PHB.

Polymeric immunoglobulin receptor (PIGR, Accession NP_002635.2) is another GAM8297 target gene, herein designated TARGET GENE. PIGR BINDING SITE is a target binding site found in the 5' untranslated region of mRNA encoded by PIGR, corresponding to a target binding site such as BINDING SITE I, BINDING SITE II or BINDING SITE III of FIG. 8. Table 4 illustrates the complementarity of the nucleotide sequences of PIGR BINDING SITE, designated SEQ ID:15327, to the nucleotide sequence of GAM8297 RNA, herein designated GAM RNA, also designated SEQ ID:367.

Another function of GAM8297 is therefore inhibition of Polymeric immunoglobulin receptor (PIGR, Accession NP_002635.2). Accordingly, utilities of GAM8297 include diagnosis, prevention and treatment of diseases and clinical conditions associated with PIGR.

Pim-2 oncogene (PIM2, Accession NP_006866.1) is another GAM8297 target gene, herein designated TARGET GENE. PIM2 BINDING SITE is a target binding site found in the 3' untranslated region of mRNA encoded by PIM2, corresponding to a target binding site such as BINDING SITE I, BINDING SITE II or BINDING SITE III of FIG. 8. Table 4 illustrates the complementarity of the nucleotide sequences of PIM2 BINDING SITE, designated SEQ ID:12815, to the nucleotide sequence of GAM8297 RNA, herein designated GAM RNA, also designated SEQ ID:367.

Another function of GAM8297 is therefore inhibition of Pim-2 oncogene (PIM2, Accession NP_006866.1). Accordingly, utilities of GAM8297 include diagnosis, prevention and treatment of diseases and clinical conditions associated with PIM2.

Pleiomorphic adenoma gene 1 (PLAG1, Accession NP_002646.1) is another GAM8297 target gene, herein designated TARGET GENE. PLAG1 BINDING SITE is a target binding site found in the 5' untranslated region of mRNA encoded by PLAG1, corresponding to a target binding site such as BINDING SITE I, BINDING SITE II or BINDING SITE III of FIG. 8. Table 4 illustrates the complementarity of the nucleotide sequences of PLAG1 BINDING SITE, designated SEQ ID:12375, to the nucleotide sequence of GAM8297 RNA, herein designated GAM RNA, also designated SEQ ID:367.

Another function of GAM8297 is therefore inhibition of Pleiomorphic adenoma gene 1 (PLAG1, Accession NP_002646.1), a gene which contains a zinc finger domain. Accordingly, utilities of GAM8297 include diagnosis, prevention and treatment of diseases and clinical conditions associated with PLAG1.

The function of PLAG1 and its association with various diseases and clinical conditions, has been established by previous studies, as described hereinabove with reference to GAM47.1. PP2CE (Accession NP_640338.1) is another GAM8297 target gene, herein designated TARGET GENE.

PP2CE BINDING SITE is a target binding site found in the 5' untranslated region of mRNA encoded by PP2CE, corresponding to a target binding site such as BINDING SITE I, BINDING SITE II or BINDING SITE III of FIG. 8. Table 4 illustrates the complementarity of the nucleotide sequences of PP2CE BINDING SITE, designated SEQ ID:6865, to the nucleotide sequence of GAM8297 RNA, herein designated GAM RNA, also designated SEQ ID:367.

Another function of GAM8297 is therefore inhibition of PP2CE (Accession NP_640338.1). Accordingly, utilities of GAM8297 include diagnosis, prevention and treatment of diseases and clinical conditions associated with PP2CE.

Phosphatidic acid phosphatase type 2b (PPAP2B, Accession NP_803133.1) is another GAM8297 target gene, herein designated TARGET GENE. PPAP2B BINDING SITE is a target binding site found in the 3' untranslated region of multiple transcripts of mRNA encoded by PPAP2B, corresponding to a target binding site such as BINDING SITE I, BINDING SITE II or BINDING SITE III of FIG. 8. Table 4 illustrates the complementarity of the nucleotide sequences of PPAP2B BINDING SITE, designated SEQ ID:4950, to the nucleotide sequence of GAM8297 RNA, herein designated GAM RNA, also designated SEQ ID:367.

Another function of GAM8297 is therefore inhibition of Phosphatidic acid phosphatase type 2b (PPAP2B, Accession NP_803133.1). Accordingly, utilities of GAM8297 include diagnosis, prevention and treatment of diseases and clinical conditions associated with PPAP2B.

Phosphatidic acid phosphatase type 2b (PPAP2B, Accession NP_003704.3) is another GAM8297 target gene, herein designated TARGET GENE. PPAP2B BINDING SITE is a target binding site found in the 3' untranslated region of multiple transcripts of mRNA encoded by PPAP2B, corresponding to a target binding site such as BINDING SITE I, BINDING SITE II or BINDING SITE III of FIG. 8. Table 4 illustrates the complementarity of the nucleotide sequences of PPAP2B BINDING SITE, designated SEQ ID:4950, to the nucleotide sequence of GAM8297 RNA, herein designated GAM RNA, also designated SEQ ID:367.

Another function of GAM8297 is therefore inhibition of Phosphatidic acid phosphatase type 2b (PPAP2B, Accession NP_003704.3). Accordingly, utilities of GAM8297 include diagnosis, prevention and treatment of diseases and clinical conditions associated with PPAP2B.

Peptidylprolyl isomerase (cyclophilin)-like 3 (PPIL3, Accession NP_572028.1) is another GAM8297 target gene, herein designated TARGET GENE. PPIL3 BINDING SITE is a target binding site found in the 5' untranslated region of multiple transcripts of mRNA encoded by PPIL3, corresponding to a target binding site such as BINDING SITE I, BINDING SITE II or BINDING SITE III of FIG. 8. Table 4 illustrates the complementarity of the nucleotide sequences of PPIL3 BINDING SITE, designated SEQ ID:2401, to the nucleotide sequence of GAM8297 RNA, herein designated GAM RNA, also designated SEQ ID:367.

Another function of GAM8297 is therefore inhibition of Peptidylprolyl isomerase (cyclophilin)-like 3 (PPIL3, Accession NP_572028.1). Accordingly, utilities of GAM8297 include diagnosis, prevention and treatment of diseases and clinical conditions associated with PPIL3.

Peptidylprolyl isomerase (cyclophilin)-like 3 (PPIL3, Accession NP_115861.1) is another GAM8297 target gene, herein designated TARGET GENE. PPIL3 BINDING SITE is a target binding site found in the 5' untranslated region of multiple transcripts of mRNA encoded by PPIL3, corresponding to a target binding site such as BINDING SITE I, BINDING SITE II or BINDING SITE III of FIG. 8. Table 4 illustrates the complementarity of the nucleotide sequences of PPIL3 BINDING SITE, designated SEQ ID:2401, to the nucleotide sequence of GAM8297 RNA, herein designated GAM RNA, also designated SEQ ID:367.

Another function of GAM8297 is therefore inhibition of Peptidylprolyl isomerase (cyclophilin)-like 3 (PPIL3, Accession NP_115861.1). Accordingly, utilities of GAM8297 include diagnosis, prevention and treatment of diseases and clinical conditions associated with PPIL3.

Peptidylprolyl isomerase (cyclophilin)-like 3 (PPIL3, Accession NP_570981.1) is another GAM8297 target gene, herein designated TARGET GENE. PPIL3 BINDING SITE is a target binding site found in the 5' untranslated region of multiple transcripts of mRNA encoded by PPIL3, corresponding to a target binding site such as BINDING SITE I, BINDING SITE II or BINDING SITE III of FIG. 8. Table 4 illustrates the complementarity of the nucleotide sequences of PPIL3 BINDING SITE, designated SEQ ID:2401, to the nucleotide sequence of GAM8297 RNA, herein designated GAM RNA, also designated SEQ ID:367.

Another function of GAM8297 is therefore inhibition of Peptidylprolyl isomerase (cyclophilin)-like 3 (PPIL3, Accession NP_570981.1). Accordingly, utilities of GAM8297 include diagnosis, prevention and treatment of diseases and clinical conditions associated with PPIL3.

Protein phosphatase 1f (pp2c domain containing) (PPM1F, Accession NP_055449.1) is another GAM8297 target gene, herein designated TARGET GENE. PPM1F BINDING SITE is a target binding site found in the 3' untranslated region of mRNA encoded by PPM1F, corresponding to a target binding site such as BINDING SITE I, BINDING SITE II or BINDING SITE III of FIG. 8. Table 4 illustrates the complementarity of the nucleotide sequences of PPM1F BINDING SITE, designated SEQ ID:13090, to the nucleotide sequence of GAM8297 RNA, herein designated GAM RNA, also designated SEQ ID:367.

Another function of GAM8297 is therefore inhibition of Protein phosphatase 1f (pp2c domain containing) (PPM1F, Accession NP_055449.1). Accordingly, utilities of GAM8297 include diagnosis, prevention and treatment of diseases and clinical conditions associated with PPM1F.

Pr domain containing 1, with znf domain (PRDM1, Accession NP_001189.1) is another GAM8297 target gene, herein designated TARGET GENE. PRDM1 BINDING SITE is a target binding site found in the 5' untranslated region of mRNA encoded by PRDM1, corresponding to a target binding site such as BINDING SITE I, BINDING SITE II or BINDING SITE III of FIG. 8. Table 4 illustrates the complementarity of the nucleotide sequences of PRDM1 BINDING SITE, designated SEQ ID:6451, to the nucleotide sequence of GAM8297 RNA, herein designated GAM RNA, also designated SEQ ID:367.

Another function of GAM8297 is therefore inhibition of Pr domain containing 1, with znf domain (PRDM1, Accession NP_001189.1), a gene which may be involved in transcriptional regulation and is critical for commitment to a plasma cell fate. Accordingly, utilities of GAM8297 include diagnosis, prevention and treatment of diseases and clinical conditions associated with PRDM1.

The function of PRDM1 and its association with various diseases and clinical conditions, has been established by previous studies, as described hereinabove with reference to GAM2205.1. Prion protein 2 (dublet) (PRND, Accession NP_036541.1) is another GAM8297 target gene, herein designated TARGET GENE. PRND BINDING SITE is a target binding site found in the 3' untranslated region of mRNA encoded by PRND, corresponding to a target binding site such as BINDING SITE I, BINDING SITE II or BINDING SITE III of FIG. 8. Table 4 illustrates the complementarity of the nucleotide sequences of PRND BINDING SITE, designated SEQ ID:937, to the nucleotide sequence of GAM8297 RNA, herein designated GAM RNA, also designated SEQ ID:367.

Another function of GAM8297 is therefore inhibition of Prion protein 2 (dublet) (PRND, Accession NP_036541.1), a gene which is similar to prion protein PRNP. Accordingly, utilities of GAM8297 include diagnosis, prevention and treatment of diseases and clinical conditions associated with PRND.

The function of PRND and its association with various diseases and clinical conditions, has been established by previous studies, as described hereinabove with reference to GAM116.1. PRO0149 (Accession NP_054836.1) is another GAM8297 target gene, herein designated TARGET GENE. PRO0149 BINDING SITE is a target binding site found in the 3' untranslated region of mRNA encoded by PRO0149, corresponding to a target binding site such as BINDING SITE I, BINDING SITE II or BINDING SITE III of FIG. 8. Table 4 illustrates the complementarity of the nucleotide sequences of PRO0149 BINDING SITE, designated SEQ ID:7715, to the nucleotide sequence of GAM8297 RNA, herein designated GAM RNA, also designated SEQ ID:367.

Another function of GAM8297 is therefore inhibition of PRO0149 (Accession NP_054836.1). Accordingly, utilities of GAM8297 include diagnosis, prevention and treatment of diseases and clinical conditions associated with PRO0149.

Prostein (Accession NP_149093.1) is another GAM8297 target gene, herein designated TARGET GENE. Prostein BINDING SITE is a target binding site found in the 3' untranslated region of mRNA encoded by Prostein, corresponding to a target binding site such as BINDING SITE I, BINDING SITE II or BINDING SITE III of FIG. 8. Table 4 illustrates the complementarity of the nucleotide sequences of Prostein BINDING SITE, designated SEQ ID:10314, to the nucleotide sequence of GAM8297 RNA, herein designated GAM RNA, also designated SEQ ID:367.

Another function of GAM8297 is therefore inhibition of Prostein (Accession NP_149093.1). Accordingly, utilities of GAM8297 include diagnosis, prevention and treatment of diseases and clinical conditions associated with Prostein.

Periaxin (PRX, Accession NP_066007.1) is another GAM8297 target gene, herein designated TARGET GENE. PRX BINDING SITE is a target binding site found in the 3' untranslated region of mRNA encoded by PRX, corresponding to a target binding site such as BINDING SITE I, BINDING SITE II or BINDING SITE III of FIG. 8. Table 4 illustrates the complementarity of the nucleotide sequences of PRX BINDING SITE, designated SEQ ID:13569, to the nucleotide sequence of GAM8297 RNA, herein designated GAM RNA, also designated SEQ ID:367.

Another function of GAM8297 is therefore inhibition of Periaxin (PRX, Accession NP_066007.1), a gene which seems to be required for maintenance of peripheral nerve myelin sheath. may have a role in axon-glial interactions, possibly by interacting with the cytoplasmic domains of integral membrane proteins such as myelin- associated glycoprotein in the periaxonal regions of the schwann cell plasma membrane. may have a role in the early phases of myelin deposition and therefore is associated with Dejerine-sottas neuropathy, autosomal recessive. Accordingly, utilities of GAM8297 include diagnosis, prevention and treatment of Dejerine-sottas neuropathy, autosomal recessive, and of other diseases and clinical conditions associated with PRX.

The function of PRX and its association with various diseases and clinical conditions, has been established by previous studies, as described hereinabove with reference to GAM30.1. Pleckstrin homology, sec7 and coiled/coil domains 1(cytohesin 1) (PSCD1, Accession NP_059430.1) is another GAM8297 target gene, herein designated TARGET GENE. PSCD1 BINDING SITE is a target binding site found in the 3' untranslated region of multiple transcripts of mRNA encoded by PSCD1, corresponding to a target binding site such as BINDING SITE I, BINDING SITE II or BINDING SITE III of FIG. 8. Table 4 illustrates the complementarity of the nucleotide sequences of PSCD1 BINDING SITE, designated SEQ ID:20040, to the nucleotide sequence of GAM8297 RNA, herein designated GAM RNA, also designated SEQ ID:367.

Another function of GAM8297 is therefore inhibition of Pleckstrin homology, sec7 and coiled/coil domains 1(cytohesin 1) (PSCD1, Accession NP_059430.1). Accordingly, utilities of GAM8297 include diagnosis, prevention and treatment of diseases and clinical conditions associated with PSCD1.

Pleckstrin homology, sec7 and coiled/coil domains 1(cytohesin 1) (PSCD1, Accession NP_004753.1) is another GAM8297 target gene, herein designated TARGET GENE. PSCD1 BINDING SITE is a target binding site found in the 3' untranslated region of multiple transcripts of mRNA encoded by PSCD1, corresponding to a target binding site such as BINDING SITE I, BINDING SITE II or BINDING SITE III of FIG. 8. Table 4 illustrates the complementarity of the nucleotide sequences of PSCD1 BINDING SITE, designated SEQ ID:20040, to the nucleotide sequence of GAM8297 RNA, herein designated GAM RNA, also designated SEQ ID:367.

Another function of GAM8297 is therefore inhibition of Pleckstrin homology, sec7 and coiled/coil domains 1(cytohesin 1) (PSCD1, Accession NP_004753.1). Accordingly, utilities of GAM8297 include diagnosis, prevention and treatment of diseases and clinical conditions associated with PSCD1.

Protein tyrosine phosphatase type iva, member 1 (PTP4A1, Accession NP_003454.1) is another GAM8297 target gene, herein designated TARGET GENE. PTP4A1 BINDING SITE is a target binding site found in the 3' untranslated region of mRNA encoded by PTP4A1, corresponding to a target binding site such as BINDING SITE I, BINDING SITE II or BINDING SITE III of FIG. 8. Table 4 illustrates the complementarity of the nucleotide sequences of PTP4A1 BINDING SITE, designated SEQ ID:7509, to the nucleotide sequence of GAM8297 RNA, herein designated GAM RNA, also designated SEQ ID:367.

Another function of GAM8297 is therefore inhibition of Protein tyrosine phosphatase type iva, member 1 (PTP4A1, Accession NP_003454.1). Accordingly, utilities of GAM8297 include diagnosis, prevention and treatment of diseases and clinical conditions associated with PTP4A1.

Protein tyrosine phosphatase, receptor type, u (PTPRU, Accession NP_573439.1) is another GAM8297 target gene, herein designated TARGET GENE. PTPRU BINDING SITE is a target binding site found in the 3' untranslated region of multiple transcripts of mRNA encoded by PTPRU, corresponding to a target binding site such as BINDING SITE I, BINDING SITE II or BINDING SITE III of FIG. 8. Table 4 illustrates the complementarity of the nucleotide sequences of PTPRU BINDING SITE, designated SEQ ID:3003, to the nucleotide sequence of GAM8297 RNA, herein designated GAM RNA, also designated SEQ ID:367.

Another function of GAM8297 is therefore inhibition of Protein tyrosine phosphatase, receptor type, u (PTPRU, Accession NP_573439.1). Accordingly, utilities of GAM8297 include diagnosis, prevention and treatment of diseases and clinical conditions associated with PTPRU.

Protein tyrosine phosphatase, receptor type, u (PTPRU, Accession NP_573438.1) is another GAM8297 target gene, herein designated TARGET GENE. PTPRU BINDING SITE is a target binding site found in the 3' untranslated region of multiple transcripts of mRNA encoded by PTPRU, corresponding to a target binding site such as BINDING SITE I, BINDING SITE II or BINDING SITE III of FIG. 8. Table 4 illustrates the complementarity of the nucleotide sequences of PTPRU BINDING SITE, designated SEQ ID:3003, to the nucleotide sequence of GAM8297 RNA, herein designated GAM RNA, also designated SEQ ID:367.

Another function of GAM8297 is therefore inhibition of Protein tyrosine phosphatase, receptor type, u (PTPRU, Accession NP_573438.1). Accordingly, utilities of GAM8297 include diagnosis, prevention and treatment of diseases and clinical conditions associated with PTPRU.

Protein tyrosine phosphatase, receptor type, u (PTPRU, Accession NP_005695.2) is another GAM8297 target gene, herein designated TARGET GENE. PTPRU BINDING SITE is a target binding site found in the 3' untranslated region of multiple transcripts of mRNA encoded by PTPRU, corresponding to a target binding site such as BINDING SITE I, BINDING SITE II or BINDING SITE III of FIG. 8. Table 4 illustrates the complementarity of the nucleotide sequences of PTPRU BINDING SITE, designated SEQ ID:3003, to the nucleotide sequence of GAM8297 RNA, herein designated GAM RNA, also designated SEQ ID:367.

Another function of GAM8297 is therefore inhibition of Protein tyrosine phosphatase, receptor type, u (PTPRU, Accession NP_005695.2). Accordingly, utilities of GAM8297 include diagnosis, prevention and treatment of diseases and clinical conditions associated with PTPRU.

PYC1 (Accession NP_690865.1) is another GAM8297 target gene, herein designated TARGET GENE. PYC1 BINDING SITE is a target binding site found in the 3' untranslated region of mRNA encoded by PYC1, corresponding to a target binding site such as BINDING SITE I, BINDING SITE II or BINDING SITE III of FIG. 8. Table 4 illustrates the complementarity of the nucleotide sequences of PYC1 BINDING SITE, designated SEQ ID:15258, to the nucleotide sequence of GAM8297 RNA, herein designated GAM RNA, also designated SEQ ID:367.

Another function of GAM8297 is therefore inhibition of PYC1 (Accession NP_690865.1). Accordingly, utilities of GAM8297 include diagnosis, prevention and treatment of diseases and clinical conditions associated with PYC1.

RAB-R (Accession NP_006067.2) is another GAM8297 target gene, herein designated TARGET GENE. RAB-R BINDING SITE is a target binding site found in the 3' untranslated region of mRNA encoded by RAB-R, corresponding to a target binding site such as BINDING SITE I, BINDING SITE II or BINDING SITE III of FIG. 8. Table 4 illustrates the complementarity of the nucleotide sequences of RAB-R BINDING SITE, designated SEQ ID:14904, to the nucleotide sequence of GAM8297 RNA, herein designated GAM RNA, also designated SEQ ID:367.

Another function of GAM8297 is therefore inhibition of RAB-R (Accession NP_006067.2). Accordingly, utilities of GAM8297 include diagnosis, prevention and treatment of diseases and clinical conditions associated with RAB-R.

Retinoic acid induced 1 (RAI1, Accession NP_109590.2) is another GAM8297 target gene, herein designated TARGET GENE. RAI1 BINDING SITE is a target binding site found in the 3' untranslated region of multiple transcripts of mRNA encoded by RAI1, corresponding to a target binding site such as BINDING SITE I, BINDING SITE II or BINDING SITE III of FIG. 8. Table 4 illustrates the complementarity of the nucleotide sequences of RAI1 BINDING SITE, designated SEQ ID:5307, to the nucleotide sequence of GAM8297 RNA, herein designated GAM RNA, also designated SEQ ID:367.

Another function of GAM8297 is therefore inhibition of Retinoic acid induced 1 (RAI1, Accession NP_109590.2). Accordingly, utilities of GAM8297 include diagnosis, prevention and treatment of diseases and clinical conditions associated with RAI1.

Ras association (ralgds/af-6) domain family 2 (RASSF2, Accession NP_739580.1) is another GAM8297 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:8667, to the nucleotide sequence of GAM8297 RNA, herein designated GAM RNA, also designated SEQ ID:367.

Another function of GAM8297 is therefore inhibition of Ras association (ralgds/af-6) domain family 2 (RASSF2, Accession NP_739580.1). Accordingly, utilities of GAM8297 include diagnosis, prevention and treatment of diseases and clinical conditions associated with RASSF2.

Ras association (ralgds/af-6) domain family 2 (RASSF2, Accession NP_739579.1) is another GAM8297 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:8667, to the nucleotide sequence of GAM8297 RNA, herein designated GAM RNA, also designated SEQ ID:367.

Another function of GAM8297 is therefore inhibition of Ras association (ralgds/af-6) domain family 2 (RASSF2, Accession NP_739579.1). Accordingly, utilities of GAM8297 include diagnosis, prevention and treatment of diseases and clinical conditions associated with RASSF2.

Ras association (ralgds/af-6) domain family 2 (RASSF2, Accession NP_055552.1) is another GAM8297 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:8667, to the nucleotide sequence of GAM8297 RNA, herein designated GAM RNA, also designated SEQ ID:367.

Another function of GAM8297 is therefore inhibition of Ras association (ralgds/af-6) domain family 2 (RASSF2, Accession NP_055552.1). Accordingly, utilities of GAM8297 include diagnosis, prevention and treatment of diseases and clinical conditions associated with RASSF2.

Rna binding motif protein 3 (RBM3, Accession NP_006734.1) is another GAM8297 target gene, herein designated TARGET GENE. RBM3 BINDING SITE is a target binding site found in the 3' untranslated region of mRNA encoded by RBM3, corresponding to a target binding site such as BINDING SITE I, BINDING SITE II or BINDING SITE III of FIG. 8. Table 4 illustrates the complementarity of the nucleotide sequences of RBM3 BINDING SITE, designated SEQ ID:9588, to the nucleotide sequence of GAM8297 RNA, herein designated GAM RNA, also designated SEQ ID:367.

Another function of GAM8297 is therefore inhibition of Rna binding motif protein 3 (RBM3, Accession NP_006734.1). Accordingly, utilities of GAM8297 include diagnosis, prevention and treatment of diseases and clinical conditions associated with RBM3.

RDH-E2 (Accession NP_620419.1) is another GAM8297 target gene, herein designated TARGET GENE. RDH-E2 BINDING SITE is a target binding site found in the 3' untranslated region of mRNA encoded by RDH-E2, corresponding to a target binding site such as BINDING SITE I, BINDING SITE II or BINDING SITE III of FIG. 8. Table 4 illustrates the complementarity of the nucleotide sequences of RDH-E2 BINDING SITE, designated SEQ ID:6845, to the nucleotide sequence of GAM8297 RNA, herein designated GAM RNA, also designated SEQ ID:367.

Another function of GAM8297 is therefore inhibition of RDH-E2 (Accession NP_620419.1). Accordingly, utilities of GAM8297 include diagnosis, prevention and treatment of diseases and clinical conditions associated with RDH-E2.

Ras-like, estrogen-regulated, growth-inhibitor (RERG, Accession NP_116307.1) is another GAM8297 target gene, herein designated TARGET GENE. RERG BINDING SITE is a target binding site found in the 5' untranslated region of mRNA encoded by RERG, corresponding to a target binding site such as BINDING SITE I, BINDING SITE II or BINDING SITE III of FIG. 8. Table 4 illustrates the complementarity of the nucleotide sequences of RERG BINDING SITE, designated SEQ ID:16494, to the nucleotide sequence of GAM8297 RNA, herein designated GAM RNA, also designated SEQ ID:367.

Another function of GAM8297 is therefore inhibition of Ras-like, estrogen-regulated, growth-inhibitor (RERG, Accession NP_116307.1). Accordingly, utilities of GAM8297 include diagnosis, prevention and treatment of diseases and clinical conditions associated with RERG.

RGL (Accession NP_055964.2) is another GAM8297 target gene, herein designated TARGET GENE. RGL BINDING SITE is a target binding site found in the 5' untranslated region of mRNA encoded by RGL, corresponding to a target binding site such as BINDING SITE I, BINDING SITE II or BINDING SITE III of FIG. 8. Table 4 illustrates the complementarity of the nucleotide sequences of RGL BINDING SITE, designated SEQ ID:5364, to the nucleotide sequence of GAM8297 RNA, herein designated GAM RNA, also designated SEQ ID:367.

Another function of GAM8297 is therefore inhibition of RGL (Accession NP_055964.2), a gene which is involved in nucleotide exchange factor. Accordingly, utilities of GAM8297 include diagnosis, prevention and treatment of diseases and clinical conditions associated with RGL.

The function of RGL and its association with various diseases and clinical conditions, has been established by previous studies, as described hereinabove with reference to GAM51.1. Regulator of g-protein signalling 11 (RGS11, Accession NP_003825.1) is another GAM8297 target gene, herein designated TARGET GENE. RGS11 BINDING SITE is a target binding site found in the 3' untranslated region of mRNA encoded by RGS11, corresponding to a target binding site such as BINDING SITE I, BINDING SITE II or BINDING SITE III of FIG. 8. Table 4 illustrates the complementarity of the nucleotide sequences of RGS11 BINDING SITE, designated SEQ ID:2788, to the nucleotide sequence of GAM8297 RNA, herein designated GAM RNA, also designated SEQ ID:367.

Another function of GAM8297 is therefore inhibition of Regulator of g-protein signalling 11 (RGS11, Accession NP_003825.1). Accordingly, utilities of GAM8297 include diagnosis, prevention and treatment of diseases and clinical conditions associated with RGS11.

Ring finger protein 7 (RNF7, Accession NP_055060.1) is another GAM8297 target gene, herein designated TARGET GENE. RNF7 BINDING SITE is a target binding site found in the 3' untranslated region of mRNA encoded by RNF7, corresponding to a target binding site such as BINDING SITE I, BINDING SITE II or BINDING SITE III of FIG. 8. Table 4 illustrates the complementarity of the nucleotide sequences of RNF7 BINDING SITE, designated SEQ ID:1071, to the nucleotide sequence of GAM8297 RNA, herein designated GAM RNA, also designated SEQ ID:367.

Another function of GAM8297 is therefore inhibition of Ring finger protein 7 (RNF7, Accession NP_055060.1). Accordingly, utilities of GAM8297 include diagnosis, prevention and treatment of diseases and clinical conditions associated with RNF7.

Roundabout, axon guidance receptor, homolog 1 (drosophila) (ROBO1, Accession NP_598334.1) is another GAM8297 target gene, herein designated TARGET GENE. ROBO1 BINDING SITE is a target binding site found in the 5' untranslated region of multiple transcripts of mRNA encoded by ROBO1, corresponding to a target binding site such as BINDING SITE I, BINDING SITE II or BINDING SITE III of FIG. 8. Table 4 illustrates the complementarity of the nucleotide sequences of ROBO1 BINDING SITE, designated SEQ ID:17266, to the nucleotide sequence of GAM8297 RNA, herein designated GAM RNA, also designated SEQ ID:367.

Another function of GAM8297 is therefore inhibition of Roundabout, axon guidance receptor, homolog 1 (drosophila) (ROBO1, Accession NP_598334.1), a gene which is an axon guidance receptor. Accordingly, utilities of GAM8297 include diagnosis, prevention and treatment of diseases and clinical conditions associated with ROBO1.

The function of ROBO1 and its association with various diseases and clinical conditions, has been established by previous studies, as described hereinabove with reference to GAM67.2. Ryanodine receptor 1 (skeletal) (RYR1, Accession NP_000531.1) is another GAM8297 target gene, herein designated TARGET GENE. RYR1 BINDING SITE is a target binding site found in the 3' untranslated region of mRNA encoded by RYR1, corresponding to a target binding site such as BINDING SITE I, BINDING SITE II or BINDING SITE III of FIG. 8. Table 4 illustrates the complementarity of the nucleotide sequences of RYR1 BINDING SITE, designated SEQ ID:5163, to the nucleotide sequence of GAM8297 RNA, herein designated GAM RNA, also designated SEQ ID:367.

Another function of GAM8297 is therefore inhibition of Ryanodine receptor 1 (skeletal) (RYR1, Accession NP_000531.1), a gene which acts as a calcium release channel of sarcoplasmic reticulum and therefore may be associated with Malignant hyperthermia (mh) and of central core disease of muscle (ccd). mh. Accordingly, utilities of GAM8297 include diagnosis, prevention and treatment of Malignant hyperthermia (mh) and of central core disease of muscle (ccd). mh, and of other diseases and clinical conditions associated with RYR1.

The function of RYR1 and its association with various diseases and clinical conditions, has been established by previous studies, as described hereinabove with reference to GAM1975.2. SARM1 (Accession NP_055892.1) is another GAM8297 target gene, herein designated TARGET GENE. SARM1 BINDING SITE is a target binding site found in the 3' untranslated region of mRNA encoded by SARM1, corresponding to a target binding site such as BINDING SITE I, BINDING SITE II or BINDING SITE III of FIG. 8. Table 4 illustrates the complementarity of the nucleotide sequences of SARM1 BINDING SITE, designated SEQ ID:3114, to the nucleotide sequence of GAM8297 RNA, herein designated GAM RNA, also designated SEQ ID:367.

Another function of GAM8297 is therefore inhibition of SARM1 (Accession NP_055892.1). Accordingly, utilities of GAM8297 include diagnosis, prevention and treatment of diseases and clinical conditions associated with SARM1.

Syndecan 3 (n-syndecan) (SDC3, Accession NP_055469.1) is another GAM8297 target gene, herein designated TARGET GENE. SDC3 BINDING SITE is a target binding site found in the 3' untranslated region of mRNA encoded by SDC3, corresponding to a target binding site such as BINDING SITE I, BINDING SITE II or BINDING SITE III of FIG. 8. Table 4 illustrates the complementarity of the nucleotide sequences of SDC3 BINDING SITE, designated SEQ ID:2696, to the nucleotide sequence of GAM8297 RNA, herein designated GAM RNA, also designated SEQ ID:367.

Another function of GAM8297 is therefore inhibition of Syndecan 3 (n-syndecan) (SDC3, Accession NP_055469.1). Accordingly, utilities of GAM8297 include diagnosis, prevention and treatment of diseases and clinical conditions associated with SDC3.

SEF (Accession NP_060033.1) is another GAM8297 target gene, herein designated TARGET GENE. SEF BINDING SITE is a target binding site found in the 3' untranslated region of mRNA encoded by SEF, corresponding to a target binding site such as BINDING SITE I, BINDING SITE II or BINDING SITE III of FIG. 8. Table 4 illustrates the complementarity of the nucleotide sequences of SEF BINDING SITE, designated SEQ ID:2366, to the nucleotide sequence of GAM8297 RNA, herein designated GAM RNA, also designated SEQ ID:367.

Another function of GAM8297 is therefore inhibition of SEF (Accession NP_060033.1). Accordingly, utilities of GAM8297 include diagnosis, prevention and treatment of diseases and clinical conditions associated with SEF.

Sema domain, immunoglobulin domain (ig), transmembrane domain (tm) and short cytoplasmic domain, (semaphorin) 4f (SEMA4F, Accession NP_004254.2) is another GAM8297 target gene, herein designated TARGET GENE. SEMA4F BINDING SITE is a target binding site found in the 3' untranslated region of mRNA encoded by SEMA4F, corresponding to a target binding site such as BINDING SITE I, BINDING SITE II or BINDING SITE III of FIG. 8. Table 4 illustrates the complementarity of the nucleotide sequences of SEMA4F BINDING SITE, designated SEQ ID:17986, to the nucleotide sequence of GAM8297 RNA, herein designated GAM RNA, also designated SEQ ID:367.

Another function of GAM8297 is therefore inhibition of Sema domain, immunoglobulin domain (ig), transmembrane domain (tm) and short cytoplasmic domain, (semaphorin) 4f (SEMA4F, Accession NP_004254.2). Accordingly, utilities of GAM8297 include diagnosis, prevention and treatment of diseases and clinical conditions associated with SEMA4F.

Serine (or cysteine) proteinase inhibitor, clade b (ovalbumin), member 6 (SERPINB6, Accession NP_004559.3) is another GAM8297 target gene, herein designated TARGET GENE. SERPINB6 BINDING SITE is a target binding site found in the 3' untranslated region of mRNA encoded by SERPINB6, corresponding to a target binding site such as BINDING SITE I, BINDING SITE II or BINDING SITE III of FIG. 8. Table 4 illustrates the complementarity of the nucleotide sequences of SERPINB6 BINDING SITE, designated SEQ ID:16752, to the nucleotide sequence of GAM8297 RNA, herein designated GAM RNA, also designated SEQ ID:367.

Another function of GAM8297 is therefore inhibition of Serine (or cysteine) proteinase inhibitor, clade b (ovalbumin), member 6 (SERPINB6, Accession NP_004559.3), a gene which inhibits thrombin. Accordingly, utilities of GAM8297 include diagnosis, prevention and treatment of diseases and clinical conditions associated with SERPINB6.

The function of SERPINB6 and its association with various diseases and clinical conditions, has been established by previous studies, as described hereinabove with reference to GAM830.1. SH2B (Accession NP_056318.1) is another GAM8297 target gene, herein designated TARGET GENE. SH2B BINDING SITE is a target binding site found in the 3' untranslated region of mRNA encoded by SH2B, corresponding to a target binding site such as BINDING SITE I, BINDING SITE II or BINDING SITE III of FIG. 8. Table 4 illustrates the complementarity of the nucleotide sequences of SH2B BINDING SITE, designated SEQ ID:4036, to the nucleotide sequence of GAM8297 RNA, herein designated GAM RNA, also designated SEQ ID:367.

Another function of GAM8297 is therefore inhibition of SH2B (Accession NP_056318.1). Accordingly, utilities of GAM8297 include diagnosis, prevention and treatment of diseases and clinical conditions associated with SH2B.

Sh3-domain binding protein 2 (SH3BP2, Accession NP_003014.2) is another GAM8297 target gene, herein designated TARGET GENE. SH3BP2 BINDING SITE is a target binding site found in the 3' untranslated region of mRNA encoded by SH3BP2, corresponding to a target binding site such as BINDING SITE I, BINDING SITE II or BINDING SITE III of FIG. 8. Table 4 illustrates the complementarity of the nucleotide sequences of SH3BP2 BINDING SITE, designated SEQ ID:14484, to the nucleotide sequence of GAM8297 RNA, herein designated GAM RNA, also designated SEQ ID:367.

Another function of GAM8297 is therefore inhibition of Sh3-domain binding protein 2 (SH3BP2, Accession NP_003014.2). Accordingly, utilities of GAM8297 include diagnosis, prevention and treatment of diseases and clinical conditions associated with SH3BP2.

SHAPY (Accession NP_620148.1) is another GAM8297 target gene, herein designated TARGET GENE. SHAPY BINDING SITE is a target binding site found in the 3' untranslated region of mRNA encoded by SHAPY, corresponding to a target binding site such as BINDING SITE I, BINDING SITE II or BINDING SITE III of FIG. 8. Table 4 illustrates the complementarity of the nucleotide sequences of SHAPY BINDING SITE, designated SEQ ID:18309, to the nucleotide sequence of GAM8297 RNA, herein designated GAM RNA, also designated SEQ ID:367.

Another function of GAM8297 is therefore inhibition of SHAPY (Accession NP_620148.1). Accordingly, utilities of GAM8297 include diagnosis, prevention and treatment of diseases and clinical conditions associated with SHAPY.

Solute carrier family 17 (sodium phosphate), member 2 (SLC17A2, Accession NP_005826.1) is another GAM8297 target gene, herein designated TARGET GENE. SLC17A2 BINDING SITE is a target binding site found in the 3' untranslated region of mRNA encoded by SLC17A2, corresponding to a target binding site such as BINDING SITE I, BINDING SITE II or BINDING SITE III of FIG. 8. Table 4 illustrates the complementarity of the nucleotide sequences of SLC17A2 BINDING SITE, designated SEQ ID:2863, to the nucleotide sequence of GAM8297 RNA, herein designated GAM RNA, also designated SEQ ID:367.

Another function of GAM8297 is therefore inhibition of Solute carrier family 17 (sodium phosphate), member 2 (SLC17A2, Accession NP_005826.1), a gene which is a putative type 1 sodium phosphate transporter and therefore may be associated with Autosomally mendelian hypophosphatemias. Accordingly, utilities of GAM8297 include diagnosis, prevention and treatment of Autosomally mendelian hypophosphatemias, and of other diseases and clinical conditions associated with SLC17A2.

The function of SLC17A2 and its association with various diseases and clinical conditions, has been established by previous studies, as described hereinabove with reference to GAM1975.1. Solute carrier family 26 (sulfate transporter), member 1 (SLC26A1, Accession NP_071325.2) is another GAM8297 target gene, herein designated TARGET GENE. SLC26A1 BINDING SITE is a target binding site found in the 3' untranslated region of multiple transcripts of mRNA encoded by SLC26A1, corresponding to a target binding site such as BINDING SITE I, BINDING SITE II or BINDING SITE III of FIG. 8. Table 4 illustrates the complementarity of the nucleotide sequences of SLC26A1 BINDING SITE, designated SEQ ID:8035, to the nucleotide sequence of GAM8297 RNA, herein designated GAM RNA, also designated SEQ ID:367.

Another function of GAM8297 is therefore inhibition of Solute carrier family 26 (sulfate transporter), member 1 (SLC26A1, Accession NP_071325.2). Accordingly, utilities of GAM8297 include diagnosis, prevention and treatment of diseases and clinical conditions associated with SLC26A1.

Solute carrier family 6 (neurotransmitter transporter, gaba), member 1 (SLC6A1, Accession NP_003033.1) is another GAM8297 target gene, herein designated TARGET GENE. SLC6A1 BINDING SITE is a target binding site found in the 5' untranslated region of mRNA encoded by SLC6A1, corresponding to a target binding site such as BINDING SITE I, BINDING SITE II or BINDING SITE III of FIG. 8. Table 4 illustrates the complementarity of the nucleotide sequences of SLC6A1 BINDING SITE, designated SEQ ID:2172, to the nucleotide sequence of GAM8297 RNA, herein designated GAM RNA, also designated SEQ ID:367.

Another function of GAM8297 is therefore inhibition of Solute carrier family 6 (neurotransmitter transporter, gaba), member 1 (SLC6A1, Accession NP_003033.1), a gene which terminates the action of gaba by its high affinity sodium-dependent reuptake into presynaptic terminals. Accordingly, utilities of GAM8297 include diagnosis, prevention and treatment of diseases and clinical conditions associated with SLC6A1.

The function of SLC6A1 and its association with various diseases and clinical conditions, has been established by previous studies, as described hereinabove with reference to GAM969.2. SLC9A8 (Accession XP_030524.2) is another GAM8297 target gene, herein designated TARGET GENE. SLC9A8 BINDING SITE is a target binding site found in the 3' untranslated region of mRNA encoded by SLC9A8, corresponding to a target binding site such as BINDING SITE I, BINDING SITE II or BINDING SITE III of FIG. 8. Table 4 illustrates the complementarity of the nucleotide sequences of SLC9A8 BINDING SITE, designated SEQ ID:1781, to the nucleotide sequence of GAM8297 RNA, herein designated GAM RNA, also designated SEQ ID:367.

Another function of GAM8297 is therefore inhibition of SLC9A8 (Accession XP_030524.2). Accordingly, utilities of GAM8297 include diagnosis, prevention and treatment of diseases and clinical conditions associated with SLC9A8.

Son dna binding protein (SON, Accession NP_115571.1) is another GAM8297 target gene, herein designated TARGET GENE. SON BINDING SITE is a target binding site found in the 3' untranslated region of multiple transcripts of mRNA encoded by SON, corresponding to a target binding site such as BINDING SITE I, BINDING SITE II or BINDING SITE III of FIG. 8. Table 4 illustrates the complementarity of the nucleotide sequences of SON BINDING SITE, designated SEQ ID:2947, to the nucleotide sequence of GAM8297 RNA, herein designated GAM RNA, also designated SEQ ID:367.

Another function of GAM8297 is therefore inhibition of Son dna binding protein (SON, Accession NP_115571.1). Accordingly, utilities of GAM8297 include diagnosis, prevention and treatment of diseases and clinical conditions associated with SON.

Spir-1 (Accession XP_290818.1) is another GAM8297 target gene, herein designated TARGET GENE. Spir-1 BINDING SITE is a target binding site found in the 3' untranslated region of mRNA encoded by Spir-1, corresponding to a target binding site such as BINDING SITE I, BINDING SITE II or BINDING SITE III of FIG. 8. Table 4 illustrates the complementarity of the nucleotide sequences of Spir-1 BINDING SITE, designated SEQ ID:18344, to the nucleotide sequence of GAM8297 RNA, herein designated GAM RNA, also designated SEQ ID:367.

Another function of GAM8297 is therefore inhibition of Spir-1 (Accession XP_290818.1). Accordingly, utilities of GAM8297 include diagnosis, prevention and treatment of diseases and clinical conditions associated with Spir-1.

Sprouty homolog 3 (drosophila) (SPRY3, Accession NP_005831.1) is another GAM8297 target gene, herein designated TARGET GENE. SPRY3 BINDING SITE is a target binding site found in the 3' untranslated region of mRNA encoded by SPRY3, corresponding to a target binding site such as BINDING SITE I, BINDING SITE II or BINDING SITE III of FIG. 8. Table 4 illustrates the complementarity of the nucleotide sequences of SPRY3 BINDING SITE, designated SEQ ID:16967, to the nucleotide sequence of GAM8297 RNA, herein designated GAM RNA, also designated SEQ ID:367.

Another function of GAM8297 is therefore inhibition of Sprouty homolog 3 (drosophila) (SPRY3, Accession NP_005831.1). Accordingly, utilities of GAM8297 include diagnosis, prevention and treatment of diseases and clinical conditions associated with SPRY3.

Serine/arginine repetitive matrix 1 (SRRM1, Accession NP_005830.1) is another GAM8297 target gene, herein designated TARGET GENE. SRRM1 BINDING SITE is a target binding site found in the 3' untranslated region of mRNA encoded by SRRM1, corresponding to a target binding site such as BINDING SITE I, BINDING SITE II or BINDING SITE III of FIG. 8. Table 4 illustrates the complementarity of the nucleotide sequences of SRRM1 BINDING SITE, designated SEQ ID:4656, to the nucleotide sequence of GAM8297 RNA, herein designated GAM RNA, also designated SEQ ID:367.

Another function of GAM8297 is therefore inhibition of Serine/arginine repetitive matrix 1 (SRRM1, Accession NP_005830.1). Accordingly, utilities of GAM8297 include diagnosis, prevention and treatment of diseases and clinical conditions associated with SRRM1.

SSB1 (Accession NP_079382.2) is another GAM8297 target gene, herein designated TARGET GENE. SSB1 BINDING SITE is a target binding site found in the 3' untranslated region of mRNA encoded by SSB1, corresponding to a target binding site such as BINDING SITE I, BINDING SITE II or BINDING SITE III of FIG. 8. Table 4 illustrates the complementarity of the nucleotide sequences of SSB1 BINDING SITE, designated SEQ ID:8921, to the nucleotide sequence of GAM8297 RNA, herein designated GAM RNA, also designated SEQ ID:367.

Another function of GAM8297 is therefore inhibition of SSB1 (Accession NP_079382.2). Accordingly, utilities of GAM8297 include diagnosis, prevention and treatment of diseases and clinical conditions associated with SSB1.

Synaptotagmin viii (SYT8, Accession NP_612634.1) is another GAM8297 target gene, herein designated TARGET GENE. SYT8 BINDING SITE is a target binding site found in the 3' untranslated region of mRNA encoded by SYT8, corresponding to a target binding site such as BINDING SITE I, BINDING SITE II or BINDING SITE III of FIG. 8. Table 4 illustrates the complementarity of the nucleotide sequences of SYT8 BINDING SITE, designated SEQ ID:6528, to the nucleotide sequence of GAM8297 RNA, herein designated GAM RNA, also designated SEQ ID:367.

Another function of GAM8297 is therefore inhibition of Synaptotagmin viii (SYT8, Accession NP_612634.1). Accordingly, utilities of GAM8297 include diagnosis, prevention and treatment of diseases and clinical conditions associated with SYT8.

Tafazzin (cardiomyopathy, dilated 3a (x-linked); endocardial fibroelastosis 2; barth syndrome) (TAZ, Accession NP_000107.1) is another GAM8297 target gene, herein designated TARGET GENE. TAZ BINDING SITE is a target binding site found in the 3' untranslated region of multiple transcripts of mRNA encoded by TAZ, corresponding to a target binding site such as BINDING SITE I, BINDING SITE II or BINDING SITE III of FIG. 8. Table 4 illustrates the complementarity of the nucleotide sequences of TAZ BINDING SITE, designated SEQ ID:490, to the nucleotide sequence of GAM8297 RNA, herein designated GAM RNA, also designated SEQ ID:367.

Another function of GAM8297 is therefore inhibition of Tafazzin (cardiomyopathy, dilated 3a (x-linked); endocardial fibroelastosis 2; barth syndrome) (TAZ, Accession NP_000107.1). Accordingly, utilities of GAM8297 include diagnosis, prevention and treatment of diseases and clinical conditions associated with TAZ.

Tafazzin (cardiomyopathy, dilated 3a (x-linked); endocardial fibroelastosis 2; barth syndrome) (TAZ, Accession NP_851829.1) is another GAM8297 target gene, herein designated TARGET GENE. TAZ BINDING SITE is a target binding site found in the 3' untranslated region of multiple transcripts of mRNA encoded by TAZ, corresponding to a target binding site such as BINDING SITE I, BINDING SITE II or BINDING SITE III of FIG. 8. Table 4 illustrates the complementarity of the nucleotide sequences of TAZ BINDING SITE, designated SEQ ID:490, to the nucleotide sequence of GAM8297 RNA, herein designated GAM RNA, also designated SEQ ID:367.

Another function of GAM8297 is therefore inhibition of Tafazzin (cardiomyopathy, dilated 3a (x-linked); endocardial fibroelastosis 2; barth syndrome) (TAZ, Accession NP_851829.1). Accordingly, utilities of GAM8297 include diagnosis, prevention and treatment of diseases and clinical conditions associated with TAZ.

Tafazzin (cardiomyopathy, dilated 3a (x-linked); endocardial fibroelastosis 2; barth syndrome) (TAZ, Accession NP_851830.1) is another GAM8297 target gene, herein designated TARGET GENE. TAZ BINDING SITE is a target binding site found in the 3' untranslated region of multiple transcripts of mRNA encoded by TAZ, corresponding to a target binding site such as BINDING SITE I, BINDING SITE II or BINDING SITE III of FIG. 8. Table 4 illustrates the complementarity of the nucleotide sequences of TAZ BINDING SITE, designated SEQ ID:490, to the nucleotide sequence of GAM8297 RNA, herein designated GAM RNA, also designated SEQ ID:367.

Another function of GAM8297 is therefore inhibition of Tafazzin (cardiomyopathy, dilated 3a (x-linked); endocardial fibroelastosis 2; barth syndrome) (TAZ, Accession NP_851830.1). Accordingly, utilities of GAM8297 include diagnosis, prevention and treatment of diseases and clinical conditions associated with TAZ.

Tafazzin (cardiomyopathy, dilated 3a (x-linked); endocardial fibroelastosis 2; barth syndrome) (TAZ, Accession NP_851828.1) is another GAM8297 target gene, herein designated TARGET GENE. TAZ BINDING SITE is a target binding site found in the 3' untranslated region of multiple transcripts of mRNA encoded by TAZ, corresponding to a target binding site such as BINDING SITE I, BINDING SITE II or BINDING SITE III of FIG. 8. Table 4 illustrates the complementarity of the nucleotide sequences of TAZ BINDING SITE, designated SEQ ID:490, to the nucleotide sequence of GAM8297 RNA, herein designated GAM RNA, also designated SEQ ID:367.

Another function of GAM8297 is therefore inhibition of Tafazzin (cardiomyopathy, dilated 3a (x-linked); endocardial fibroelastosis 2; barth syndrome) (TAZ, Accession NP_851828.1). Accordingly, utilities of GAM8297 include diagnosis, prevention and treatment of diseases and clinical conditions associated with TAZ.

Tafazzin (cardiomyopathy, dilated 3a (x-linked); endocardial fibroelastosis 2; barth syndrome) (TAZ, Accession NP_851831.1) is another GAM8297 target gene, herein designated TARGET GENE. TAZ BINDING SITE is a target binding site found in the 3' untranslated region of multiple transcripts of mRNA encoded by TAZ, corresponding to a target binding site such as BINDING SITE I, BINDING SITE II or BINDING SITE III of FIG. 8. Table 4 illustrates the complementarity of the nucleotide sequences of TAZ BINDING SITE, designated SEQ ID:490, to the nucleotide sequence of GAM8297 RNA, herein designated GAM RNA, also designated SEQ ID:367.

Another function of GAM8297 is therefore inhibition of Tafazzin (cardiomyopathy, dilated 3a (x-linked); endocardial fibroelastosis 2; barth syndrome) (TAZ, Accession NP_851831.1). Accordingly, utilities of GAM8297 include diagnosis, prevention and treatment of diseases and clinical conditions associated with TAZ.

Tbc1 domain family, member 4 (TBC1D4, Accession NP_055647.1) is another GAM8297 target gene, herein designated TARGET GENE. TBC1D4 BINDING SITE is a target binding site found in the 3' untranslated region of mRNA encoded by TBC1D4, corresponding to a target binding site such as BINDING SITE I, BINDING SITE II or BINDING SITE III of FIG. 8. Table 4 illustrates the complementarity of the nucleotide sequences of TBC1D4 BINDING SITE, designated SEQ ID:748, to the nucleotide sequence of GAM8297 RNA, herein designated GAM RNA, also designated SEQ ID:367.

Another function of GAM8297 is therefore inhibition of Tbc1 domain family, member 4 (TBC1D4, Accession NP_055647.1). Accordingly, utilities of GAM8297 include diagnosis, prevention and treatment of diseases and clinical conditions associated with TBC1D4.

T-box 6 (TBX6, Accession NP_004599.2) is another GAM8297 target gene, herein designated TARGET GENE. TBX6 BINDING SITE is a target binding site found in the 5' untranslated region of multiple transcripts of mRNA encoded by TBX6, corresponding to a target binding site such as BINDING SITE I, BINDING SITE II or BINDING SITE III of FIG. 8. Table 4 illustrates the complementarity of the nucleotide sequences of TBX6 BINDING SITE, designated SEQ ID:6888, to the nucleotide sequence of GAM8297 RNA, herein designated GAM RNA, also designated SEQ ID:367.

Another function of GAM8297 is therefore inhibition of T-box 6 (TBX6, Accession NP_004599.2), a gene which is a probable transcriptional regulator involved in developmental processes. Accordingly, utilities of GAM8297 include diagnosis, prevention and treatment of diseases and clinical conditions associated with TBX6.

The function of TBX6 and its association with various diseases and clinical conditions, has been established by previous studies, as described hereinabove with reference to GAM59.1. T-box 6 (TBX6, Accession NP_542936.1) is another GAM8297 target gene, herein designated TARGET GENE. TBX6 BINDING SITE is a target binding site found in the 5' untranslated region of multiple transcripts of mRNA encoded by TBX6, corresponding to a target binding site such as BINDING SITE I, BINDING SITE II or BINDING SITE III of FIG. 8. Table 4 illustrates the complementarity of the nucleotide sequences of TBX6 BINDING SITE, designated SEQ ID:6888, to the nucleotide sequence of GAM8297 RNA, herein designated GAM RNA, also designated SEQ ID:367.

Another function of GAM8297 is therefore inhibition of T-box 6 (TBX6, Accession NP_542936.1), a gene which is a probable transcriptional regulator involved in developmental processes. Accordingly, utilities of GAM8297 include diagnosis, prevention and treatment of diseases and clinical conditions associated with TBX6.

The function of TBX6 and its association with various diseases and clinical conditions, has been established by previous studies, as described hereinabove with reference to GAM59.1. T-cell leukemia/lymphoma 6 (TCL6, Accession NP_036600.2) is another GAM8297 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:18755, to the nucleotide sequence of GAM8297 RNA, herein designated GAM RNA, also designated SEQ ID:367.

Another function of GAM8297 is therefore inhibition of T-cell leukemia/lymphoma 6 (TCL6, Accession NP_036600.2). Accordingly, utilities of GAM8297 include diagnosis, prevention and treatment of diseases and clinical conditions associated with TCL6.

T-cell leukemia/lymphoma 6 (TCL6, Accession NP_055233.1) is another GAM8297 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:18755, to the nucleotide sequence of GAM8297 RNA, herein designated GAM RNA, also designated SEQ ID:367.

Another function of GAM8297 is therefore inhibition of T-cell leukemia/lymphoma 6 (TCL6, Accession NP_055233.1). Accordingly, utilities of GAM8297 include diagnosis, prevention and treatment of diseases and clinical conditions associated with TCL6.

T-cell leukemia/lymphoma 6 (TCL6, Accession NP_065577.2) is another GAM8297 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:18755, to the nucleotide sequence of GAM8297 RNA, herein designated GAM RNA, also designated SEQ ID:367.

Another function of GAM8297 is therefore inhibition of T-cell leukemia/lymphoma 6 (TCL6, Accession NP_065577.2). Accordingly, utilities of GAM8297 include diagnosis, prevention and treatment of diseases and clinical conditions associated with TCL6.

T-cell leukemia/lymphoma 6 (TCL6, Accession NP_065575.1) is another GAM8297 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:18755, to the nucleotide sequence of GAM8297 RNA, herein designated GAM RNA, also designated SEQ ID:367.

Another function of GAM8297 is therefore inhibition of T-cell leukemia/lymphoma 6 (TCL6, Accession NP_065575.1). Accordingly, utilities of GAM8297 include diagnosis, prevention and treatment of diseases and clinical conditions associated with TCL6.

Tight junction protein 2 (zona occludens 2) (TJP2, Accession NP_004808.1) is another GAM8297 target gene, herein designated TARGET GENE. TJP2 BINDING SITE is a target binding site found in the 3' untranslated region of mRNA encoded by TJP2, corresponding to a target binding site such as BINDING SITE I, BINDING SITE II or BINDING SITE III of FIG. 8. Table 4 illustrates the complementarity of the nucleotide sequences of TJP2 BINDING SITE, designated SEQ ID:15651, to the nucleotide sequence of GAM8297 RNA, herein designated GAM RNA, also designated SEQ ID:367.

Another function of GAM8297 is therefore inhibition of Tight junction protein 2 (zona occludens 2) (TJP2, Accession NP_004808.1). Accordingly, utilities of GAM8297 include diagnosis, prevention and treatment of diseases and clinical conditions associated with TJP2.

Transmembrane protein 2 (TMEM2, Accession NP_037522.1) is another GAM8297 target gene, herein designated TARGET GENE. TMEM2 BINDING SITE is a target binding site found in the 3' untranslated region of mRNA encoded by TMEM2, corresponding to a target binding site such as BINDING SITE I, BINDING SITE II or BINDING SITE III of FIG. 8. Table 4 illustrates the complementarity of the nucleotide sequences of TMEM2 BINDING SITE, designated SEQ ID:1387, to the nucleotide sequence of GAM8297 RNA, herein designated GAM RNA, also designated SEQ ID:367.

Another function of GAM8297 is therefore inhibition of Transmembrane protein 2 (TMEM2, Accession NP_037522.1). Accordingly, utilities of GAM8297 include diagnosis, prevention and treatment of diseases and clinical conditions associated with TMEM2.

Transmembrane protease, serine 2 (TMPRSS2, Accession NP_005647.2) is another GAM8297 target gene, herein designated TARGET GENE. TMPRSS2 BINDING SITE is a target binding site found in the 3' untranslated region of mRNA encoded by TMPRSS2, corresponding to a target binding site such as BINDING SITE I, BINDING SITE II or BINDING SITE III of FIG. 8. Table 4 illustrates the complementarity of the nucleotide sequences of TMPRSS2 BINDING SITE, designated SEQ ID:5188, to the nucleotide sequence of GAM8297 RNA, herein designated GAM RNA, also designated SEQ ID:367.

Another function of GAM8297 is therefore inhibition of Transmembrane protease, serine 2 (TMPRSS2, Accession NP_005647.2). Accordingly, utilities of GAM8297 include diagnosis, prevention and treatment of diseases and clinical conditions associated with TMPRSS2.

Tumor necrosis factor receptor superfamily, member 1b (TNFRSF1B, Accession NP_001057.1) is another GAM8297 target gene, herein designated TARGET GENE. TNFRSF1B BINDING SITE is a target binding site found in the 3' untranslated region of mRNA encoded by TNFRSF1B, corresponding to a target binding site such as BINDING SITE I, BINDING SITE II or BINDING SITE III of FIG. 8. Table 4 illustrates the complementarity of the nucleotide sequences of TNFRSF1B BINDING SITE, designated SEQ ID:11026, to the nucleotide sequence of GAM8297 RNA, herein designated GAM RNA, also designated SEQ ID:367.

Another function of GAM8297 is therefore inhibition of Tumor necrosis factor receptor superfamily, member 1b (TNFRSF1B, Accession NP_001057.1), a gene which mediates proinflammatory cellular responses. and therefore may be associated with Familial combined hyperlipidemia. Accordingly, utilities of GAM8297 include diagnosis, prevention and treatment of Familial combined hyperlipidemia, and of other diseases and clinical conditions associated with TNFRSF1B.

The function of TNFRSF1B and its association with various diseases and clinical conditions, has been established by previous studies, as described hereinabove with reference to GAM72.1. Translocase of outer mitochondrial membrane 70 homolog a (yeast) (TOMM70A, Accession NP_055635.1) is another GAM8297 target gene, herein designated TARGET GENE. TOMM70A BINDING SITE is a target binding site found in the 3' untranslated region of mRNA encoded by TOMM70A, corresponding to a target binding site such as BINDING SITE I, BINDING SITE II or BINDING SITE III of FIG. 8. Table 4 illustrates the complementarity of the nucleotide sequences of TOMM70A BINDING SITE, designated SEQ ID:18168, to the nucleotide sequence of GAM8297 RNA, herein designated GAM RNA, also designated SEQ ID:367.

Another function of GAM8297 is therefore inhibition of Translocase of outer mitochondrial membrane 70 homolog a (yeast) (TOMM70A, Accession NP_055635.1). Accordingly, utilities of GAM8297 include diagnosis, prevention and treatment of diseases and clinical conditions associated with TOMM70A.

Topoisomerase (dna) ii alpha 170 kda (TOP2A, Accession NP_001058.2) is another GAM8297 target gene, herein designated TARGET GENE. TOP2A BINDING SITE is a target binding site found in the 3' untranslated region of mRNA encoded by TOP2A, corresponding to a target binding site such as BINDING SITE I, BINDING SITE II or BINDING SITE III of FIG. 8. Table 4 illustrates the complementarity of the nucleotide sequences of TOP2A BINDING SITE, designated SEQ ID:15250, to the nucleotide sequence of GAM8297 RNA, herein designated GAM RNA, also designated SEQ ID:367.

Another function of GAM8297 is therefore inhibition of Topoisomerase (dna) ii alpha 170 kda (TOP2A, Accession NP_001058.2). Accordingly, utilities of GAM8297 include diagnosis, prevention and treatment of diseases and clinical conditions associated with TOP2A.

Tripartite motif-containing 26 (TRIM26, Accession NP_003440.1) is another GAM8297 target gene, herein designated TARGET GENE. TRIM26 BINDING SITE is a target binding site found in the 3' untranslated region of mRNA encoded by TRIM26, corresponding to a target binding site such as BINDING SITE I, BINDING SITE II or BINDING SITE III of FIG. 8. Table 4 illustrates the complementarity of the nucleotide sequences of TRIM26 BINDING SITE, designated SEQ ID:6153, to the nucleotide sequence of GAM8297 RNA, herein designated GAM RNA, also designated SEQ ID:367.

Another function of GAM8297 is therefore inhibition of Tripartite motif-containing 26 (TRIM26, Accession NP_003440.1). Accordingly, utilities of GAM8297 include diagnosis, prevention and treatment of diseases and clinical conditions associated with TRIM26.

TRIPIN (Accession NP_689737.1) is another GAM8297 target gene, herein designated TARGET GENE. TRIPIN BINDING SITE is a target binding site found in the 3' untranslated region of mRNA encoded by TRIPIN, corresponding to a target binding site such as BINDING SITE I, BINDING SITE II or BINDING SITE III of FIG. 8. Table 4 illustrates the complementarity of the nucleotide sequences of TRIPIN BINDING SITE, designated SEQ ID:13987, to the nucleotide sequence of GAM8297 RNA, herein designated GAM RNA, also designated SEQ ID:367.

Another function of GAM8297 is therefore inhibition of TRIPIN (Accession NP_689737.1). Accordingly, utilities of GAM8297 include diagnosis, prevention and treatment of diseases and clinical conditions associated with TRIPIN.

Tubby homolog (mouse) (TUB, Accession NP_813977.1) is another GAM8297 target gene, herein designated TARGET GENE. TUB BINDING SITE is a target binding site found in the 3' untranslated region of multiple transcripts of mRNA encoded by TUB, corresponding to a target binding site such as BINDING SITE I, BINDING SITE II or BINDING SITE III of FIG. 8. Table 4 illustrates the complementarity of the nucleotide sequences of TUB BINDING SITE, designated SEQ ID:4633, to the nucleotide sequence of GAM8297 RNA, herein designated GAM RNA, also designated SEQ ID:367.

Another function of GAM8297 is therefore inhibition of Tubby homolog (mouse) (TUB, Accession NP_813977.1). Accordingly, utilities of GAM8297 include diagnosis, prevention and treatment of diseases and clinical conditions associated with TUB.

Tubby homolog (mouse) (TUB, Accession NP_003311.2) is another GAM8297 target gene, herein designated TARGET GENE. TUB BINDING SITE is a target binding site found in the 3' untranslated region of multiple transcripts of mRNA encoded by TUB, corresponding to a target binding site such as BINDING SITE I, BINDING SITE II or BINDING SITE III of FIG. 8. Table 4 illustrates the complementarity of the nucleotide sequences of TUB BINDING SITE, designated SEQ ID:4633, to the nucleotide sequence of GAM8297 RNA, herein designated GAM RNA, also designated SEQ ID:367.

Another function of GAM8297 is therefore inhibition of Tubby homolog (mouse) (TUB, Accession NP_003311.2).

Accordingly, utilities of GAM8297 include diagnosis, prevention and treatment of diseases and clinical conditions associated with TUB.

Ubiquitin-conjugating enzyme e2 variant 1 (UBE2V1, Accession NP_071887.1) is another GAM8297 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8584, to the nucleotide sequence of GAM8297 RNA, herein designated GAM RNA, also designated SEQ ID:367.

Another function of GAM8297 is therefore inhibition of Ubiquitin-conjugating enzyme e2 variant 1 (UBE2V1, Accession NP_071887.1), a gene which may play a role in signaling for DNA repair. Accordingly, utilities of GAM8297 include diagnosis, prevention and treatment of diseases and clinical conditions associated with UBE2V1.

The function of UBE2V1 and its association with various diseases and clinical conditions, has been established by previous studies, as described hereinabove with reference to GAM44.1. Ubiquitin-conjugating enzyme e2 variant 1 (UBE2V1, Accession NP_003340.1) is another GAM8297 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8584, to the nucleotide sequence of GAM8297 RNA, herein designated GAM RNA, also designated SEQ ID:367.

Another function of GAM8297 is therefore inhibition of Ubiquitin-conjugating enzyme e2 variant 1 (UBE2V1, Accession NP_003340.1), a gene which may play a role in signaling for DNA repair. Accordingly, utilities of GAM8297 include diagnosis, prevention and treatment of diseases and clinical conditions associated with UBE2V1.

The function of UBE2V1 and its association with various diseases and clinical conditions, has been established by previous studies, as described hereinabove with reference to GAM44.1. Ubiquitin-conjugating enzyme e2 variant 1 (UBE2V1, Accession NP_068823.1) is another GAM8297 target gene, herein designated TARGET GENE. UBE2V1 BINDING SITE is a target binding site found in the 3' untranslated region of multiple transcripts of mRNA encoded by UBE2V1, corresponding to a target binding site such as BINDING SITE I, BINDING SITE II or BINDING SITE III of FIG. 8. Table 4 illustrates the complementarity of the nucleotide sequences of UBE2V1 BINDING SITE, designated SEQ ID:8584, to the nucleotide sequence of GAM8297 RNA, herein designated GAM RNA, also designated SEQ ID:367.

Another function of GAM8297 is therefore inhibition of Ubiquitin-conjugating enzyme e2 variant 1 (UBE2V1, Accession NP_068823.1), a gene which may play a role in signaling for DNA repair. Accordingly, utilities of GAM8297 include diagnosis, prevention and treatment of diseases and clinical conditions associated with UBE2V1.

The function of UBE2V1 and its association with various diseases and clinical conditions, has been established by previous studies, as described hereinabove with reference to GAM44.1. UEV3 (Accession NP_060784.2) is another GAM8297 target gene, herein designated TARGET GENE. UEV3 BINDING SITE is a target binding site found in the 3' untranslated region of mRNA encoded by UEV3, corresponding to a target binding site such as BINDING SITE I, BINDING SITE II or BINDING SITE III of FIG. 8. Table 4 illustrates the complementarity of the nucleotide sequences of UEV3 BINDING SITE, designated SEQ ID:10736, to the nucleotide sequence of GAM8297 RNA, herein designated GAM RNA, also designated SEQ ID:367.

Another function of GAM8297 is therefore inhibition of UEV3 (Accession NP_060784.2). Accordingly, utilities of GAM8297 include diagnosis, prevention and treatment of diseases and clinical conditions associated with UEV3.

Unc-5 homolog b (c. elegans) (UNC5C, Accession NP_003719.2) is another GAM8297 target gene, herein designated TARGET GENE. UNC5C BINDING SITE is a target binding site found in the 3' untranslated region of mRNA encoded by UNC5C, corresponding to a target binding site such as BINDING SITE I, BINDING SITE II or BINDING SITE III of FIG. 8. Table 4 illustrates the complementarity of the nucleotide sequences of UNC5C BINDING SITE, designated SEQ ID:8079, to the nucleotide sequence of GAM8297 RNA, herein designated GAM RNA, also designated SEQ ID:367.

Another function of GAM8297 is therefore inhibition of Unc-5 homolog b (c. elegans) (UNC5C, Accession NP_003719.2), a gene which is a putative receptor for netrin, which is involved in axon guidance. Accordingly, utilities of GAM8297 include diagnosis, prevention and treatment of diseases and clinical conditions associated with UNC5C.

The function of UNC5C and its association with various diseases and clinical conditions, has been established by previous studies, as described hereinabove with reference to GAM190.1. Uroporphyrinogen iii synthase (congenital erythropoietic porphyria) (UROS, Accession NP_000366.1) is another GAM8297 target gene, herein designated TARGET GENE. UROS BINDING SITE is a target binding site found in the 5' untranslated region of mRNA encoded by UROS, corresponding to a target binding site such as BINDING SITE I, BINDING SITE II or BINDING SITE III of FIG. 8. Table 4 illustrates the complementarity of the nucleotide sequences of UROS BINDING SITE, designated SEQ ID:1029, to the nucleotide sequence of GAM8297 RNA, herein designated GAM RNA, also designated SEQ ID:367.

Another function of GAM8297 is therefore inhibition of Uroporphyrinogen iii synthase (congenital erythropoietic porphyria) (UROS, Accession NP_000366.1), a gene which is the fourth enzyme in heme biosynthesis pathway and therefore is associated with Congenital erythropoietic porphyria (cep). Accordingly, utilities of GAM8297 include diagnosis, prevention and treatment of Congenital erythropoietic porphyria (cep), and of other diseases and clinical conditions associated with UROS.

The function of UROS and its association with various diseases and clinical conditions, has been established by previous studies, as described hereinabove with reference to GAM264.1. Vimentin (VIM, Accession NP_003371.1) is another GAM8297 target gene, herein designated TARGET GENE. VIM BINDING SITE is a target binding site found in the 3' untranslated region of mRNA encoded by VIM, corresponding to a target binding site such as BINDING SITE I, BINDING SITE II or BINDING SITE III of FIG. 8. Table 4 illustrates the complementarity of the nucleotide sequences of VIM BINDING SITE, designated SEQ ID:14629, to the nucleotide sequence of GAM8297 RNA, herein designated GAM RNA, also designated SEQ ID:367.

Another function of GAM8297 is therefore inhibition of Vimentin (VIM, Accession NP_003371.1), a gene which is the class-iii intermediate filaments found in various non-epithelial cells. Accordingly, utilities of GAM8297 include diagnosis, prevention and treatment of diseases and clinical conditions associated with VIM.

The function of VIM and its association with various diseases and clinical conditions, has been established by previous studies, as described hereinabove with reference to GAM3533.1. VIP32 (Accession NP_068378.1) is another GAM8297 target gene, herein designated TARGET GENE. VIP32 BINDING SITE is a target binding site found in the 5' untranslated region of mRNA encoded by VIP32, corresponding to a target binding site such as BINDING SITE I, BINDING SITE II or BINDING SITE III of FIG. 8. Table 4 illustrates the complementarity of the nucleotide sequences of VIP32 BINDING SITE, designated SEQ ID:14426, to the nucleotide sequence of GAM8297 RNA, herein designated GAM RNA, also designated SEQ ID:367.

Another function of GAM8297 is therefore inhibition of VIP32 (Accession NP_068378.1). Accordingly, utilities of GAM8297 include diagnosis, prevention and treatment of diseases and clinical conditions associated with VIP32.

Wnt1 inducible signaling pathway protein 1 (WISP1, Accession NP_003873.1) is another GAM8297 target gene, herein designated TARGET GENE. WISP1 BINDING SITE is a target binding site found in the 3' untranslated region of multiple transcripts of mRNA encoded by WISP1, corresponding to a target binding site such as BINDING SITE I, BINDING SITE II or BINDING SITE III of FIG. 8. Table 4 illustrates the complementarity of the nucleotide sequences of WISP1 BINDING SITE, designated SEQ ID:2051, to the nucleotide sequence of GAM8297 RNA, herein designated GAM RNA, also designated SEQ ID:367.

Another function of GAM8297 is therefore inhibition of Wnt1 inducible signaling pathway protein 1 (WISP1, Accession NP_003873.1), a gene which is a member of connective tissue growth factor family. Accordingly, utilities of GAM8297 include diagnosis, prevention and treatment of diseases and clinical conditions associated with WISP1.

The function of WISP1 and its association with various diseases and clinical conditions, has been established by previous studies, as described hereinabove with reference to GAM629.1. Zinc finger protein 282 (ZNF282, Accession NP_003566.1) is another GAM8297 target gene, herein designated TARGET GENE. ZNF282 BINDING SITE is a target binding site found in the 3' untranslated region of multiple transcripts of mRNA encoded by ZNF282, corresponding to a target binding site such as BINDING SITE I, BINDING SITE II or BINDING SITE III of FIG. 8. Table 4 illustrates the complementarity of the nucleotide sequences of ZNF282 BINDING SITE, designated SEQ ID:11281, to the nucleotide sequence of GAM8297 RNA, herein designated GAM RNA, also designated SEQ ID:367.

Another function of GAM8297 is therefore inhibition of Zinc finger protein 282 (ZNF282, Accession NP_003566.1). Accordingly, utilities of GAM8297 include diagnosis, prevention and treatment of diseases and clinical conditions associated with ZNF282.

Zinc finger protein 282 (ZNF282, Accession XP_114578.1) is another GAM8297 target gene, herein designated TARGET GENE. ZNF282 BINDING SITE is a target binding site found in the 3' untranslated region of multiple transcripts of mRNA encoded by ZNF282, corresponding to a target binding site such as BINDING SITE I, BINDING SITE II or BINDING SITE III of FIG. 8. Table 4 illustrates the complementarity of the nucleotide sequences of ZNF282 BINDING SITE, designated SEQ ID:11281, to the nucleotide sequence of GAM8297 RNA, herein designated GAM RNA, also designated SEQ ID:367.

Another function of GAM8297 is therefore inhibition of Zinc finger protein 282 (ZNF282, Accession XP_114578.1). Accordingly, utilities of GAM8297 include diagnosis, prevention and treatment of diseases and clinical conditions associated with ZNF282.

Zinc finger protein 337 (ZNF337, Accession NP_056470.1) is another GAM8297 target gene, herein designated TARGET GENE. ZNF337 BINDING SITE is a target binding site found in the 3' untranslated region of mRNA encoded by ZNF337, corresponding to a target binding site such as BINDING SITE I, BINDING SITE II or BINDING SITE III of FIG. 8. Table 4 illustrates the complementarity of the nucleotide sequences of ZNF337 BINDING SITE, designated SEQ ID:5587, to the nucleotide sequence of GAM8297 RNA, herein designated GAM RNA, also designated SEQ ID:367.

Another function of GAM8297 is therefore inhibition of Zinc finger protein 337 (ZNF337, Accession NP_056470.1). Accordingly, utilities of GAM8297 include diagnosis, prevention and treatment of diseases and clinical conditions associated with ZNF337.

Zinc finger protein 76 (expressed in testis) (ZNF76, Accession NP_003418.2) is another GAM8297 target gene, herein designated TARGET GENE. ZNF76 BINDING SITE is a target binding site found in the 3' untranslated region of mRNA encoded by ZNF76, corresponding to a target binding site such as BINDING SITE I, BINDING SITE II or BINDING SITE III of FIG. 8. Table 4 illustrates the complementarity of the nucleotide sequences of ZNF76 BINDING SITE, designated SEQ ID:14384, to the nucleotide sequence of GAM8297 RNA, herein designated GAM RNA, also designated SEQ ID:367.

Another function of GAM8297 is therefore inhibition of Zinc finger protein 76 (expressed in testis) (ZNF76, Accession NP_003418.2). Accordingly, utilities of GAM8297 include diagnosis, prevention and treatment of diseases and clinical conditions associated with ZNF76.

Zinc finger protein, subfamily 1a, 1 (ikaros) (ZNFN1A1, Accession NP_006051.1) is another GAM8297 target gene, herein designated TARGET GENE. ZNFN1A1 BINDING SITE is a target binding site found in the 3' untranslated region of mRNA encoded by ZNFN1A1, corresponding to a target binding site such as BINDING SITE I, BINDING SITE II or BINDING SITE III of FIG. 8. Table 4 illustrates the complementarity of the nucleotide sequences of ZNFN1A1 BINDING SITE, designated SEQ ID:1221, to the nucleotide sequence of GAM8297 RNA, herein designated GAM RNA, also designated SEQ ID:367.

Another function of GAM8297 is therefore inhibition of Zinc finger protein, subfamily 1a, 1 (ikaros) (ZNFN1A1, Accession NP_006051.1). Accordingly, utilities of GAM8297 include diagnosis, prevention and treatment of diseases and clinical conditions associated with ZNFN1A1.

FIG. 8 further provides a conceptual description of a novel bioinformatically detected of the present invention, referred to here as Genomic Address Messenger 8358 (GAM8358), which modulates expression of respective target genes thereof, the function and utility of which target genes is known in the art.

GAM8358 is a novel bioinformatically detected regulatory, non protein coding, micro RNA (miRNA) gene. The method by which GAM8358 was detected is described hereinabove with reference to FIGS. 8-15.

GAM8358 gene, herein designated GAM GENE, and GAM8358 target gene, herein designated TARGET GENE, are human genes contained in the human genome.

GAM8358 gene encodes a GAM8358 precursor RNA, herein designated GAM PRECURSOR RNA. Similar to other miRNA genes, and unlike most ordinary genes, GAM8358 precursor RNA does not encode a protein. A nucleotide sequence identical or highly similar to the nucleotide sequence of GAM8358 precursor RNA is designated SEQ ID:189, and is provided hereinbelow with reference to the sequence listing part.

GAM8358 precursor RNA folds onto itself, forming GAM8358 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM8358 precursor RNA folds onto itself, forming GAM8358 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM8358 precursor RNA, designated SEQ-ID:189, and a schematic representation of a predicted secondary folding of GAM8358 folded precursor RNA are further described with reference to Table 2, hereby incorporated by reference.

An enzyme complex designated DICER COMPLEX, 'dices' the GAM8358 folded precursor RNA into GAM8358 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM8358 RNA is designated SEQ ID:255, and is provided hereinbelow with references to the sequence listing part and Table 3, hereby incorporated by reference.

GAM8358 target gene, herein designated TARGET GENE, encodes a corresponding messenger RNA, GAM8358 target RNA, herein designated GAM TARGET RNA. GAM8358 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM8358 RNA, herein designated GAM RNA, binds complementarily to one or more target binding sites located in untranslated regions of GAM8358 target RNA, herein designated GAM TARGET RNA. This complementary binding is due to the fact that the nucleotide sequence of GAM8358 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM8358 RNA may have a different number of target binding sites in untranslated regions of a GAM8358 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM8358 RNA, herein designated GAM RNA, to target binding sites on GAM8358 target RNA, herein designated GAM TARGET RNA, such as BINDING SITE I, BINDING SITE II and BINDING SITE III, inhibits translation of GAM8358 target RNA into GAM8358 target protein, herein designated GAM TARGET PROTEIN. GAM target protein is therefore outlined by a broken line.

It is appreciated that GAM8358 target gene, herein designated TARGET GENE, in fact represents a plurality of GAM8358 target genes. The mRNA of each one of this plurality of GAM8358 target genes comprises one or more target binding sites, each having a nucleotide sequence which is at least partly complementary to GAM8358 RNA, herein designated GAM RNA, and which when bound by GAM8358 RNA causes inhibition of translation of respective one or more GAM8358 target proteins.

It is further appreciated by one skilled in the art that the mode of translational inhibition illustrated by FIG. 8 with specific reference to translational inhibition exerted by GAM8358 gene, herein designated GAM GENE, on one or more GAM8358 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM8358 correlate with, and may be deduced from, the identity of the target genes which GAM8358 binds and inhibits, and the function of these target genes, as elaborated hereinbelow.

(Accession NP_061052.1) is a GAM8358 target gene, herein designated TARGET GENE. BINDING SITE is a target binding site found in the 5' untranslated region of multiple transcripts of mRNA encoded by, corresponding to a target binding site such as BINDING SITE I, BINDING SITE II or BINDING SITE III of FIG. 8. Table 4 illustrates the complementarity of the nucleotide sequences of BINDING SITE, designated SEQ ID:11587, to the nucleotide sequence of GAM8358 RNA, herein designated GAM RNA, also designated SEQ ID:255.

A function of GAM8358 is therefore inhibition of (Accession NP_061052.1). Accordingly, utilities of GAM8358 include diagnosis, prevention and treatment of diseases and clinical conditions associated with .

Alpha-1-b glycoprotein (A1BG, Accession NP_570602.2) is another GAM8358 target gene, herein designated TARGET GENE. A1BG BINDING SITE is a target binding site found in the 3' untranslated region of mRNA encoded by A1BG, corresponding to a target binding site such as BINDING SITE I, BINDING SITE II or BINDING SITE III of FIG. 8. Table 4 illustrates the complementarity of the nucleotide sequences of A1BG BINDING SITE, designated SEQ ID:18906, to the nucleotide sequence of GAM8358 RNA, herein designated GAM RNA, also designated SEQ ID:255.

Another function of GAM8358 is therefore inhibition of Alpha-1-b glycoprotein (A1BG, Accession NP_570602.2), a gene which a plasma protein of unknown function. Accordingly, utilities of GAM8358 include diagnosis, prevention and treatment of diseases and clinical conditions associated with A1BG.

The function of A1BG and its association with various diseases and clinical conditions, has been established by previous studies, as described hereinabove with reference to GAM130.1. Atp-binding cassette, sub-family c (cftr/mrp), member 3 (ABCC3, Accession NP_064422.1) is another GAM8358 target gene, herein designated TARGET GENE. ABCC3 BINDING SITE is a target binding site found in the 3' untranslated region of multiple transcripts of mRNA encoded by ABCC3, corresponding to a target binding site such as BINDING SITE I, BINDING SITE II or BINDING SITE III of FIG. 8. Table 4 illustrates the complementarity of the nucleotide sequences of ABCC3 BINDING SITE, designated SEQ ID:12771, to the nucleotide sequence of GAM8358 RNA, herein designated GAM RNA, also designated SEQ ID:255.

Another function of GAM8358 is therefore inhibition of Atp-binding cassette, sub-family c (cftr/mrp), member 3 (ABCC3, Accession NP_064422.1), a gene which may act as an inducible transporter in the biliary and intestinal excretion of organic anions. Accordingly, utilities of GAM8358 include diagnosis, prevention and treatment of diseases and clinical conditions associated with ABCC3.

The function of ABCC3 and its association with various diseases and clinical conditions, has been established by previous studies, as described hereinabove with reference to GAM66.2. Atp-binding cassette, sub-family c (cftr/mrp), member 3 (ABCC3, Accession NP_003777.2) is another GAM8358 target gene, herein designated TARGET GENE. ABCC3 BINDING SITE is a target binding site found in the 3' untranslated region of multiple transcripts of mRNA encoded by ABCC3, corresponding to a target binding site such as BINDING SITE I, BINDING SITE II or BINDING SITE III of FIG. 8. Table 4 illustrates the complementarity of the nucleotide sequences of ABCC3 BINDING SITE, designated SEQ ID:12771, to the nucleotide sequence of GAM8358 RNA, herein designated GAM RNA, also designated SEQ ID:255.

Another function of GAM8358 is therefore inhibition of Atp-binding cassette, sub-family c (cftr/mrp), member 3 (ABCC3, Accession NP_003777.2), a gene which may act as an inducible transporter in the biliary and intestinal excretion of organic anions. Accordingly, utilities of GAM8358 include diagnosis, prevention and treatment of diseases and clinical conditions associated with ABCC3.

The function of ABCC3 and its association with various diseases and clinical conditions, has been established by previous studies, as described hereinabove with reference to GAM66.2. Atp-binding cassette, sub-family c (cftr/mrp), member 3 (ABCC3, Accession NP_064421.1) is another GAM8358 target gene, herein designated TARGET GENE. ABCC3 BINDING SITE is a target binding site found in the 3' untranslated region of multiple transcripts of mRNA encoded by ABCC3, corresponding to a target binding site such as BINDING SITE I, BINDING SITE II or BINDING SITE III of FIG. 8. Table 4 illustrates the complementarity of the nucleotide sequences of ABCC3 BINDING SITE, designated SEQ ID:12771, to the nucleotide sequence of GAM8358 RNA, herein designated GAM RNA, also designated SEQ ID:255.

Another function of GAM8358 is therefore inhibition of Atp-binding cassette, sub-family c (cftr/mrp), member 3 (ABCC3, Accession NP_064421.1), a gene which may act as an inducible transporter in the biliary and intestinal excretion of organic anions. Accordingly, utilities of GAM8358 include diagnosis, prevention and treatment of diseases and clinical conditions associated with ABCC3.

The function of ABCC3 and its association with various diseases and clinical conditions, has been established by previous studies, as described hereinabove with reference to GAM66.2. ACATE2 (Accession NP_036464.1) is another GAM8358 target gene, herein designated TARGET GENE. ACATE2 BINDING SITE is a target binding site found in the 5' untranslated region of mRNA encoded by ACATE2, corresponding to a target binding site such as BINDING SITE I, BINDING SITE II or BINDING SITE III of FIG. 8. Table 4 illustrates the complementarity of the nucleotide sequences of ACATE2 BINDING SITE, designated SEQ ID:11855, to the nucleotide sequence of GAM8358 RNA, herein designated GAM RNA, also designated SEQ ID:255.

Another function of GAM8358 is therefore inhibition of ACATE2 (Accession NP_036464.1). Accordingly, utilities of GAM8358 include diagnosis, prevention and treatment of diseases and clinical conditions associated with ACATE2.

Arp1 actin-related protein 1 homolog a, centractin alpha (yeast) (ACTR1A, Accession NP_005727.1) is another GAM8358 target gene, herein designated TARGET GENE. ACTR1A BINDING SITE is a target binding site found in the 3' untranslated region of mRNA encoded by ACTR1A, corresponding to a target binding site such as BINDING SITE I, BINDING SITE II or BINDING SITE III of FIG. 8. Table 4 illustrates the complementarity of the nucleotide sequences of ACTR1A BINDING SITE, designated SEQ ID:19684, to the nucleotide sequence of GAM8358 RNA, herein designated GAM RNA, also designated SEQ ID:255.

Another function of GAM8358 is therefore inhibition of Arp1 actin-related protein 1 homolog a, centractin alpha (yeast) (ACTR1A, Accession NP_005727.1). Accordingly, utilities of GAM8358 include diagnosis, prevention and treatment of diseases and clinical conditions associated with ACTR1A.

Adenosine deaminase, rna-specific (ADAR, Accession NP_056656.1) is another GAM8358 target gene, herein designated TARGET GENE. ADAR BINDING SITE is a target binding site found in the 3' untranslated region of multiple transcripts of mRNA encoded by ADAR, corresponding to a target binding site such as BINDING SITE I, BINDING SITE II or BINDING SITE III of FIG. 8. Table 4 illustrates the complementarity of the nucleotide sequences of ADAR BINDING SITE, designated SEQ ID:12787, to the nucleotide sequence of GAM8358 RNA, herein designated GAM RNA, also designated SEQ ID:255.

Another function of GAM8358 is therefore inhibition of Adenosine deaminase, rna-specific (ADAR, Accession NP_056656.1), a gene which converts adenosine to inosine in double-stranded RNA. Accordingly, utilities of GAM8358 include diagnosis, prevention and treatment of diseases and clinical conditions associated with ADAR.

The function of ADAR and its association with various diseases and clinical conditions, has been established by previous studies, as described hereinabove with reference to GAM175.1. Adenosine deaminase, rna-specific (ADAR, Accession NP_001102.1) is another GAM8358 target gene, herein designated TARGET GENE. ADAR BINDING SITE is a target binding site found in the 3' untranslated region of multiple transcripts of mRNA encoded by ADAR, corresponding to a target binding site such as BINDING SITE I, BINDING SITE II or BINDING SITE III of FIG. 8. Table 4 illustrates the complementarity of the nucleotide sequences of ADAR BINDING SITE, designated SEQ ID:12787, to the nucleotide sequence of GAM8358 RNA, herein designated GAM RNA, also designated SEQ ID:255.

Another function of GAM8358 is therefore inhibition of Adenosine deaminase, rna-specific (ADAR, Accession NP_001102.1), a gene which converts adenosine to inosine in double-stranded RNA. Accordingly, utilities of GAM8358 include diagnosis, prevention and treatment of diseases and clinical conditions associated with ADAR.

The function of ADAR and its association with various diseases and clinical conditions, has been established by previous studies, as described hereinabove with reference to GAM175.1. Adenosine deaminase, rna-specific (ADAR, Accession NP_056655.1) is another GAM8358 target gene, herein designated TARGET GENE. ADAR BINDING SITE is a target binding site found in the 3' untranslated region of multiple transcripts of mRNA encoded by ADAR, corresponding to a target binding site such as BINDING SITE I, BINDING SITE II or BINDING SITE III of FIG. 8. Table 4 illustrates the complementarity of the nucleotide sequences of ADAR BINDING SITE, designated SEQ ID:12787, to the nucleotide sequence of GAM8358 RNA, herein designated GAM RNA, also designated SEQ ID:255.

Another function of GAM8358 is therefore inhibition of Adenosine deaminase, rna-specific (ADAR, Accession NP_056655.1), a gene which converts adenosine to inosine in double-stranded RNA. Accordingly, utilities of GAM8358 include diagnosis, prevention and treatment of diseases and clinical conditions associated with ADAR.

The function of ADAR and its association with various diseases and clinical conditions, has been established by previous studies, as described hereinabove with reference to GAM175.1. Adenylate kinase 2 (AK2, Accession NP_037543.1) is another GAM8358 target gene, herein designated TARGET GENE. AK2 BINDING SITE is a target binding site found in the 3' untranslated region of multiple transcripts of mRNA encoded by AK2, corresponding to a target binding site such as BINDING SITE I, BINDING SITE II or BINDING SITE III of FIG. 8. Table 4 illustrates the complementarity of the nucleotide sequences of AK2 BINDING SITE, designated SEQ ID:1267, to the nucleotide sequence of GAM8358 RNA, herein designated GAM RNA, also designated SEQ ID:255.

Another function of GAM8358 is therefore inhibition of Adenylate kinase 2 (AK2, Accession NP_037543.1), a gene which essential for maintenance and cell growth. Accordingly, utilities of GAM8358 include diagnosis, prevention and treatment of diseases and clinical conditions associated with AK2.

The function of AK2 and its association with various diseases and clinical conditions, has been established by previous studies, as described hereinabove with reference to GAM385.2. A kinase (prka) anchor protein 6 (AKAP6, Accession NP_004265.3) is another GAM8358 target gene, herein designated TARGET GENE. AKAP6 BINDING SITE is a target binding site found in the 3' untranslated region of mRNA encoded by AKAP6, corresponding to a target binding site such as BINDING SITE I, BINDING SITE II or BINDING SITE III of FIG. 8. Table 4 illustrates the complementarity of the nucleotide sequences of AKAP6 BINDING SITE, designated SEQ ID:19508, to the nucleotide sequence of GAM8358 RNA, herein designated GAM RNA, also designated SEQ ID:255.

Another function of GAM8358 is therefore inhibition of A kinase (prka) anchor protein 6 (AKAP6, Accession NP_004265.3). Accordingly, utilities of GAM8358 include diagnosis, prevention and treatment of diseases and clinical conditions associated with AKAP6.

ALEX1 (Accession NP_057692.1) is another GAM8358 target gene, herein designated TARGET GENE. ALEX1 BINDING SITE is a target binding site found in the 5' untranslated region of mRNA encoded by ALEX1, corresponding to a target binding site such as BINDING SITE I, BINDING SITE II or BINDING SITE III of FIG. 8. Table 4 illustrates the complementarity of the nucleotide sequences of ALEX1 BINDING SITE, designated SEQ ID:14775, to the nucleotide sequence of GAM8358 RNA, herein designated GAM RNA, also designated SEQ ID:255.

Another function of GAM8358 is therefore inhibition of ALEX1 (Accession NP_057692.1). Accordingly, utilities of GAM8358 include diagnosis, prevention and treatment of diseases and clinical conditions associated with ALEX1.

Angiomotin (AMOT, Accession NP_573572.1) is another GAM8358 target gene, herein designated TARGET GENE. AMOT BINDING SITE is a target binding site found in the 3' untranslated region of mRNA encoded by AMOT, corresponding to a target binding site such as BINDING SITE I, BINDING SITE II or BINDING SITE III of FIG. 8. Table 4 illustrates the complementarity of the nucleotide sequences of AMOT BINDING SITE, designated SEQ ID:13810, to the nucleotide sequence of GAM8358 RNA, herein designated GAM RNA, also designated SEQ ID:255.

Another function of GAM8358 is therefore inhibition of Angiomotin (AMOT, Accession NP_573572.1). Accordingly, utilities of GAM8358 include diagnosis, prevention and treatment of diseases and clinical conditions associated with AMOT.

Annexin a13 (ANXA13, Accession NP_004297.1) is another GAM8358 target gene, herein designated TARGET GENE. ANXA13 BINDING SITE is a target binding site found in the 3' untranslated region of mRNA encoded by ANXA13, corresponding to a target binding site such as BINDING SITE I, BINDING SITE II or BINDING SITE III of FIG. 8. Table 4 illustrates the complementarity of the nucleotide sequences of ANXA13 BINDING SITE, designated SEQ ID:17250, to the nucleotide sequence of GAM8358 RNA, herein designated GAM RNA, also designated SEQ ID:255.

Another function of GAM8358 is therefore inhibition of Annexin a13 (ANXA13, Accession NP_004297.1). Accordingly, utilities of GAM8358 include diagnosis, prevention and treatment of diseases and clinical conditions associated with ANXA13.

Adaptor-related protein complex 3, sigma 2 subunit (AP3S2, Accession NP_005820.1) is another GAM8358 target gene, herein designated TARGET GENE. AP3S2 BINDING SITE is a target binding site found in the 3' untranslated region of mRNA encoded by AP3S2, corresponding to a target binding site such as BINDING SITE I, BINDING SITE II or BINDING SITE III of FIG. 8. Table 4 illustrates the complementarity of the nucleotide sequences of AP3S2 BINDING SITE, designated SEQ ID:3119, to the nucleotide sequence of GAM8358 RNA, herein designated GAM RNA, also designated SEQ ID:255.

Another function of GAM8358 is therefore inhibition of Adaptor-related protein complex 3, sigma 2 subunit (AP3S2, Accession NP_005820.1). Accordingly, utilities of GAM8358 include diagnosis, prevention and treatment of diseases and clinical conditions associated with AP3S2.

APM1 (Accession NP_004788.1) is another GAM8358 target gene, herein designated TARGET GENE. APM1 BINDING SITE is a target binding site found in the 3' untranslated region of mRNA encoded by APM1, corresponding to a target binding site such as BINDING SITE I, BINDING SITE II or BINDING SITE III of FIG. 8. Table 4 illustrates the complementarity of the nucleotide sequences of APM1 BINDING SITE, designated SEQ ID:12520, to the nucleotide sequence of GAM8358 RNA, herein designated GAM RNA, also designated SEQ ID:255.

Another function of GAM8358 is therefore inhibition of APM1 (Accession NP_004788.1). Accordingly, utilities of GAM8358 include diagnosis, prevention and treatment of diseases and clinical conditions associated with APM1.

APPL (Accession NP_036228.1) is another GAM8358 target gene, herein designated TARGET GENE. APPL BINDING SITE is a target binding site found in the 3' untranslated region of mRNA encoded by APPL, corresponding to a target binding site such as BINDING SITE I, BINDING SITE II or BINDING SITE III of FIG. 8. Table 4 illustrates the complementarity of the nucleotide sequences of APPL BINDING SITE, designated SEQ ID:1547, to the nucleotide sequence of GAM8358 RNA, herein designated GAM RNA, also designated SEQ ID:255.

Another function of GAM8358 is therefore inhibition of APPL (Accession NP_036228.1). Accordingly, utilities of GAM8358 include diagnosis, prevention and treatment of diseases and clinical conditions associated with APPL.

Androgen receptor (dihydrotestosterone receptor; testicular feminization; spinal and bulbar muscular atrophy; kennedy disease) (AR, Accession NP_000035.2) is another GAM8358 target gene, herein designated TARGET GENE. AR BINDING SITE is a target binding site found in the 5' untranslated region of mRNA encoded by AR, corresponding to a target binding site such as BINDING SITE I, BINDING SITE II or BINDING SITE III of FIG. 8. Table 4 illustrates the complementarity of the nucleotide sequences of AR BINDING SITE, designated SEQ ID:6654, to the nucleotide sequence of GAM8358 RNA, herein designated GAM RNA, also designated SEQ ID:255.

Another function of GAM8358 is therefore inhibition of Androgen receptor (dihydrotestosterone receptor; testicular feminization; spinal and bulbar muscular atrophy; kennedy disease) (AR, Accession NP_000035.2), a gene which are involved in the regulation of eukaryotic gene expression and affect cellular proliferation and differentiation in target tissues. and therefore is associated with Androgen insensitivity syndrome. Accordingly, utilities of GAM8358 include diagnosis, prevention and treatment of Androgen insensitivity syndrome, and of other diseases and clinical conditions associated with AR.

The function of AR and its association with various diseases and clinical conditions, has been established by previous studies, as described hereinabove with reference to GAM47.1. BHD (Accession NP_653207.1) is another GAM8358 target gene, herein designated TARGET GENE. BHD BINDING SITE is a target binding site found in the 3' untranslated region of multiple transcripts of mRNA encoded by BHD, corresponding to a target binding site such as BINDING SITE I, BINDING SITE II or BINDING SITE III of FIG. 8. Table 4 illustrates the complementarity of the nucleotide sequences of BHD BINDING SITE, designated SEQ ID:13544, to the nucleotide sequence of GAM8358 RNA, herein designated GAM RNA, also designated SEQ ID:255.

Another function of GAM8358 is therefore inhibition of BHD (Accession NP_653207.1). Accordingly, utilities of GAM8358 include diagnosis, prevention and treatment of diseases and clinical conditions associated with BHD.

B lymphoma mo-mlv insertion region (mouse) (BMI1, Accession NP_005171.4) is another GAM8358 target gene, herein designated TARGET GENE. BMI1 BINDING SITE is a target binding site found in the 3' untranslated region of mRNA encoded by BMI1, corresponding to a target binding site such as BINDING SITE I, BINDING SITE II or BINDING SITE III of FIG. 8. Table 4 illustrates the complementarity of the nucleotide sequences of BMI1 BINDING SITE, designated SEQ ID:19346, to the nucleotide sequence of GAM8358 RNA, herein designated GAM RNA, also designated SEQ ID:255.

Another function of GAM8358 is therefore inhibition of B lymphoma mo-mlv insertion region (mouse) (BMI1, Accession NP_005171.4). Accordingly, utilities of GAM8358 include diagnosis, prevention and treatment of diseases and clinical conditions associated with BMI1.

Brf1 homolog, subunit of rna polymerase iii transcription initiation factor iiib (s. cerevisiae) (BRF1, Accession NP_663718.1) is another GAM8358 target gene, herein designated TARGET GENE. BRF1 BINDING SITE1 and BRF1 BINDING SITE2 are target binding sites found in untranslated regions of multiple transcripts of mRNA encoded by BRF1, corresponding to target binding sites such as BINDING SITE I, BINDING SITE II or BINDING SITE III of FIG. 8. Table 4 illustrates the complementarity of the nucleotide sequences of BRF1 BINDING SITE1 and BRF1 BINDING SITE2, designated SEQ ID:674 and SEQ ID:13302 respectively, to the nucleotide sequence of GAM8358 RNA, herein designated GAM RNA, also designated SEQ ID:255.

Another function of GAM8358 is therefore inhibition of Brf1 homolog, subunit of rna polymerase iii transcription initiation factor iiib (s. cerevisiae) (BRF1, Accession NP_663718.1), a gene which is a general activator of RNA polymerase III. Accordingly, utilities of GAM8358 include diagnosis, prevention and treatment of diseases and clinical conditions associated with BRF1.

The function of BRF1 and its association with various diseases and clinical conditions, has been established by previous studies, as described hereinabove with reference to GAM140.1. Brf1 homolog, subunit of rna polymerase iii transcription initiation factor iiib (s. cerevisiae) (BRF1, Accession NP_663734.1) is another GAM8358 target gene, herein designated TARGET GENE. BRF1 BINDING SITE1 and BRF1 BINDING SITE2 are target binding sites found in untranslated regions of multiple transcripts of mRNA encoded by BRF1, corresponding to target binding sites such as BINDING SITE I, BINDING SITE II or BINDING SITE III of FIG. 8. Table 4 illustrates the complementarity of the nucleotide sequences of BRF1 BINDING SITE1 and BRF1 BINDING SITE2, designated SEQ ID:13302 and SEQ ID:3850 respectively, to the nucleotide sequence of GAM8358 RNA, herein designated GAM RNA, also designated SEQ ID:255.

Another function of GAM8358 is therefore inhibition of Brf1 homolog, subunit of rna polymerase iii transcription initiation factor iiib (s. cerevisiae) (BRF1, Accession NP_663734.1), a gene which is a general activator of RNA polymerase III. Accordingly, utilities of GAM8358 include diagnosis, prevention and treatment of diseases and clinical conditions associated with BRF1.

The function of BRF1 and its association with various diseases and clinical conditions, has been established by previous studies, as described hereinabove with reference to GAM140.1. Btb (poz) domain containing 5 (BTBD5, Accession NP_060128.1) is another GAM8358 target gene, herein designated TARGET GENE. BTBD5 BINDING SITE is a target binding site found in the 3' untranslated region of mRNA encoded by BTBD5, corresponding to a target binding site such as BINDING SITE I, BINDING SITE II or BINDING SITE III of FIG. 8. Table 4 illustrates the complementarity of the nucleotide sequences of BTBD5 BINDING SITE, designated SEQ ID:9813, to the nucleotide sequence of GAM8358 RNA, herein designated GAM RNA, also designated SEQ ID:255.

Another function of GAM8358 is therefore inhibition of Btb (poz) domain containing 5 (BTBD5, Accession NP_060128.1). Accordingly, utilities of GAM8358 include diagnosis, prevention and treatment of diseases and clinical conditions associated with BTBD5.

BTBD9 (Accession NP_689946.1) is another GAM8358 target gene, herein designated TARGET GENE. BTBD9 BINDING SITE is a target binding site found in the 5' untranslated region of mRNA encoded by BTBD9, corresponding to a target binding site such as BINDING SITE I, BINDING SITE II or BINDING SITE III of FIG. 8. Table 4 illustrates the complementarity of the nucleotide sequences of BTBD9 BINDING SITE, designated SEQ ID:9655, to the nucleotide sequence of GAM8358 RNA, herein designated GAM RNA, also designated SEQ ID:255.

Another function of GAM8358 is therefore inhibition of BTBD9 (Accession NP_689946.1). Accordingly, utilities of GAM8358 include diagnosis, prevention and treatment of diseases and clinical conditions associated with BTBD9.

Butyrophilin, subfamily 1, member a1 (BTN1A1, Accession NP_001723.1) is another GAM8358 target gene, herein designated TARGET GENE. BTN1A1 BINDING SITE is a target binding site found in the 3' untranslated region of mRNA encoded by BTN1A1, corresponding to a target binding site such as BINDING SITE I, BINDING SITE II or BINDING SITE III of FIG. 8. Table 4 illustrates the complementarity of the nucleotide sequences of BTN1A1 BINDING SITE, designated SEQ ID:19954, to the nucleotide sequence of GAM8358 RNA, herein designated GAM RNA, also designated SEQ ID:255.

Another function of GAM8358 is therefore inhibition of Butyrophilin, subfamily 1, member a1 (BTN1A1, Accession NP_001723.1). Accordingly, utilities of GAM8358 include diagnosis, prevention and treatment of diseases and clinical conditions associated with BTN1A1.

BZRAP1 (Accession NP_004749.1) is another GAM8358 target gene, herein designated TARGET GENE. BZRAP1 BINDING SITE is a target binding site found in the 3' untranslated region of mRNA encoded by BZRAP1, corresponding to a target binding site such as BINDING SITE I, BINDING SITE II or BINDING SITE III of FIG. 8. Table 4 illustrates the complementarity of the nucleotide sequences of BZRAP1 BINDING SITE, designated SEQ ID:2350, to the nucleotide sequence of GAM8358 RNA, herein designated GAM RNA, also designated SEQ ID:255.

Another function of GAM8358 is therefore inhibition of BZRAP1 (Accession NP_004749.1). Accordingly, utilities of GAM8358 include diagnosis, prevention and treatment of diseases and clinical conditions associated with BZRAP1.

c-MIR (Accession NP_659458.1) is another GAM8358 target gene, herein designated TARGET GENE. c-MIR BINDING SITE is a target binding site found in the 3' untranslated region of mRNA encoded by c-MIR, corresponding to a target binding site such as BINDING SITE I, BINDING SITE II or BINDING SITE III of FIG. 8. Table 4 illustrates the complementarity of the nucleotide sequences of c-MIR BINDING SITE, designated SEQ ID:6685, to the nucleotide sequence of GAM8358 RNA, herein designated GAM RNA, also designated SEQ ID:255.

Another function of GAM8358 is therefore inhibition of c-MIR (Accession NP_659458.1). Accordingly, utilities of GAM8358 include diagnosis, prevention and treatment of diseases and clinical conditions associated with c-MIR.

C10orf6 (Accession NP_060591.2) is another GAM8358 target gene, herein designated TARGET GENE. C10orf6 BINDING SITE is a target binding site found in the 5' untranslated region of multiple transcripts of mRNA encoded by C10orf6, corresponding to a target binding site such as BINDING SITE I, BINDING SITE II or BINDING SITE III of FIG. 8. Table 4 illustrates the complementarity of the nucleotide sequences of C10orf6 BINDING SITE, designated SEQ ID:14001, to the nucleotide sequence of GAM8358 RNA, herein designated GAM RNA, also designated SEQ ID:255.

Another function of GAM8358 is therefore inhibition of C10orf6 (Accession NP_060591.2). Accordingly, utilities of GAM8358 include diagnosis, prevention and treatment of diseases and clinical conditions associated with C10orf6.

Chromosome 11 open reading frame 11 (C11orf11, Accession NP_006124.1) is another GAM8358 target gene, herein designated TARGET GENE. C11orf11 BINDING SITE is a target binding site found in the 3' untranslated region of mRNA encoded by C11orf11, corresponding to a target binding site such as BINDING SITE I, BINDING SITE II or BINDING SITE III of FIG. 8. Table 4 illustrates the complementarity of the nucleotide sequences of C11orf11 BINDING SITE, designated SEQ ID:11350, to the nucleotide sequence of GAM8358 RNA, herein designated GAM RNA, also designated SEQ ID:255.

Another function of GAM8358 is therefore inhibition of Chromosome 11 open reading frame 11 (C11orf11, Accession NP_006124.1). Accordingly, utilities of GAM8358 include diagnosis, prevention and treatment of diseases and clinical conditions associated with C11orf11.

Chromosome 11 open reading frame 14 (C11orf14, Accession NP_065696.1) is another GAM8358 target gene, herein designated TARGET GENE. C11orf14 BINDING SITE is a target binding site found in the 3' untranslated region of mRNA encoded by C11orf14, corresponding to a target binding site such as BINDING SITE I, BINDING SITE II or BINDING SITE III of FIG. 8. Table 4 illustrates the complementarity of the nucleotide sequences of C11orf14 BINDING SITE, designated SEQ ID:19991, to the nucleotide sequence of GAM8358 RNA, herein designated GAM RNA, also designated SEQ ID:255.

Another function of GAM8358 is therefore inhibition of Chromosome 11 open reading frame 14 (C11orf14, Accession NP_065696.1). Accordingly, utilities of GAM8358 include diagnosis, prevention and treatment of diseases and clinical conditions associated with C11orf14.

C14orf58 (Accession NP_060261.1) is another GAM8358 target gene, herein designated TARGET GENE. C14orf58 BINDING SITE is a target binding site found in the 3' untranslated region of mRNA encoded by C14orf58, corresponding to a target binding site such as BINDING SITE I, BINDING SITE II or BINDING SITE III of FIG. 8. Table 4 illustrates the complementarity of the nucleotide sequences of C14orf58 BINDING SITE, designated SEQ ID:9425, to the nucleotide sequence of GAM8358 RNA, herein designated GAM RNA, also designated SEQ ID:255.

Another function of GAM8358 is therefore inhibition of C14orf58 (Accession NP_060261.1). Accordingly, utilities of GAM8358 include diagnosis, prevention and treatment of diseases and clinical conditions associated with C14orf58.

C14orf73 (Accession XP_040910.3) is another GAM8358 target gene, herein designated TARGET GENE. C14orf73 BINDING SITE is a target binding site found in the 3' untranslated region of mRNA encoded by C14orf73, corresponding to a target binding site such as BINDING SITE I, BINDING SITE II or BINDING SITE III of FIG. 8. Table 4 illustrates the complementarity of the nucleotide sequences of C14orf73 BINDING SITE, designated SEQ ID:2248, to the nucleotide sequence of GAM8358 RNA, herein designated GAM RNA, also designated SEQ ID:255.

Another function of GAM8358 is therefore inhibition of C14orf73 (Accession XP_040910.3). Accordingly, utilities of GAM8358 include diagnosis, prevention and treatment of diseases and clinical conditions associated with C14orf73.

C14orf94 (Accession NP_060285.1) is another GAM8358 target gene, herein designated TARGET GENE. C14orf94 BINDING SITE is a target binding site found in the 3' untranslated region of mRNA encoded by C14orf94, corresponding to a target binding site such as BINDING SITE I, BINDING SITE II or BINDING SITE III of FIG. 8. Table 4 illustrates the complementarity of the nucleotide sequences of C14orf94 BINDING SITE, designated SEQ ID:10799, to the nucleotide sequence of GAM8358 RNA, herein designated GAM RNA, also designated SEQ ID:255.

Another function of GAM8358 is therefore inhibition of C14orf94 (Accession NP_060285.1). Accordingly, utilities of GAM8358 include diagnosis, prevention and treatment of diseases and clinical conditions associated with C14orf94.

Chromosome 18 open reading frame 1 (C18orf1, Accession NP_004329.1) is another GAM8358 target gene, herein designated TARGET GENE. C18orf1 BINDING SITE is a target binding site found in the 3' untranslated region of mRNA encoded by C18orf1, corresponding to a target binding site such as BINDING SITE I, BINDING SITE II or BINDING SITE III of FIG. 8. Table 4 illustrates the complementarity of the nucleotide sequences of C18orf1 BINDING SITE, designated SEQ ID:18134, to the nucleotide sequence of GAM8358 RNA, herein designated GAM RNA, also designated SEQ ID:255.

Another function of GAM8358 is therefore inhibition of Chromosome 18 open reading frame 1 (C18orf1, Accession NP_004329.1), a gene which displays selective expression, regulated spatially and temporally. Accordingly, utilities of GAM8358 include diagnosis, prevention and treatment of diseases and clinical conditions associated with C18orf1.

The function of C18orf1 and its association with various diseases and clinical conditions, has been established by previous studies, as described hereinabove with reference to GAM88.1. Chromosome 18 open reading frame 2 (C18orf2, Accession NP_113604.1) is another GAM8358 target gene, herein designated TARGET GENE. C18orf2 BINDING SITE is a target binding site found in the 3' untranslated region of mRNA encoded by C18orf2, corresponding to a target binding site such as BINDING SITE I, BINDING SITE II or BINDING SITE III of FIG. 8. Table 4 illustrates the complementarity of the nucleotide sequences of C18orf2 BINDING SITE, designated SEQ ID:8513, to the nucleotide sequence of GAM8358 RNA, herein designated GAM RNA, also designated SEQ ID:255.

Another function of GAM8358 is therefore inhibition of Chromosome 18 open reading frame 2 (C18orf2, Accession NP_113604.1). Accordingly, utilities of GAM8358 include diagnosis, prevention and treatment of diseases and clinical conditions associated with C18orf2.

Chromosome 1 open reading frame 17 (C1orf17, Accession NP_055916.1) is another GAM8358 target gene, herein designated TARGET GENE. C1orf17 BINDING SITE is a target binding site found in the 3' untranslated region of mRNA encoded by C1orf17, corresponding to a target binding site such as BINDING SITE I, BINDING SITE II or BINDING SITE III of FIG. 8. Table 4 illustrates the complementarity of the nucleotide sequences of C1orf17 BINDING SITE, designated SEQ ID:7471, to the nucleotide sequence of GAM8358 RNA, herein designated GAM RNA, also designated SEQ ID:255.

Another function of GAM8358 is therefore inhibition of Chromosome 1 open reading frame 17 (C1orf17, Accession NP_055916.1). Accordingly, utilities of GAM8358 include diagnosis, prevention and treatment of diseases and clinical conditions associated with C1orf17.

Chromosome 20 open reading frame 14 (C20orf14, Accession NP_036601.1) is another GAM8358 target gene, herein designated TARGET GENE. C20orf14 BINDING SITE is a target binding site found in the 5' untranslated region of mRNA encoded by C20orf14, corresponding to a target binding site such as BINDING SITE I, BINDING SITE II or BINDING SITE III of FIG. 8. Table 4 illustrates the complementarity of the nucleotide sequences of C20orf14 BINDING SITE, designated SEQ ID:14369, to the nucleotide sequence of GAM8358 RNA, herein designated GAM RNA, also designated SEQ ID:255.

Another function of GAM8358 is therefore inhibition of Chromosome 20 open reading frame 14 (C20orf14, Accession NP_036601.1). Accordingly, utilities of GAM8358 include diagnosis, prevention and treatment of diseases and clinical conditions associated with C20orf14.

Chromosome 20 open reading frame 150 (C20orf150, Accession XP_037265.1) is another GAM8358 target gene, herein designated TARGET GENE. C20orf150 BINDING SITE is a target binding site found in the 3' untranslated region of mRNA encoded by C20orf150, corresponding to a target binding site such as BINDING SITE I, BINDING SITE II or BINDING SITE III of FIG. 8. Table 4 illustrates the complementarity of the nucleotide sequences of C20orf150 BINDING SITE, designated SEQ ID:1203, to the nucleotide sequence of GAM8358 RNA, herein designated GAM RNA, also designated SEQ ID:255.

Another function of GAM8358 is therefore inhibition of Chromosome 20 open reading frame 150 (C20orf150, Accession XP_037265.1). Accordingly, utilities of GAM8358 include diagnosis, prevention and treatment of diseases and clinical conditions associated with C20orf150.

Chromosome 20 open reading frame 166 (C20orf166, Accession NP_848558.1) is another GAM8358 target gene, herein designated TARGET GENE. C20orf166 BINDING SITE is a target binding site found in the 5' untranslated region of multiple transcripts of mRNA encoded by C20orf166, corresponding to a target binding site such as BINDING SITE I, BINDING SITE II or BINDING SITE III of FIG. 8. Table 4 illustrates the complementarity of the nucleotide sequences of C20orf166 BINDING SITE, designated SEQ ID:15257, to the nucleotide sequence of GAM8358 RNA, herein designated GAM RNA, also designated SEQ ID:255.

Another function of GAM8358 is therefore inhibition of Chromosome 20 open reading frame 166 (C20orf166, Accession NP_848558.1). Accordingly, utilities of GAM8358 include diagnosis, prevention and treatment of diseases and clinical conditions associated with C20orf166.

Chromosome 20 open reading frame 166 (C20orf166, Accession XP_170976.2) is another GAM8358 target gene, herein designated TARGET GENE. C20orf166 BINDING SITE is a target binding site found in the 5' untranslated region of multiple transcripts of mRNA encoded by C20orf166, corresponding to a target binding site such as BINDING SITE I, BINDING SITE II or BINDING SITE III of FIG. 8. Table 4 illustrates the complementarity of the nucleotide sequences of C20orf166 BINDING SITE, designated SEQ ID:15257, to the nucleotide sequence of GAM8358 RNA, herein designated GAM RNA, also designated SEQ ID:255.

Another function of GAM8358 is therefore inhibition of Chromosome 20 open reading frame 166 (C20orf166, Accession XP_170976.2). Accordingly, utilities of GAM8358 include diagnosis, prevention and treatment of diseases and clinical conditions associated with C20orf166.

Chromosome 20 open reading frame 177 (C20orf177, Accession XP_290955.1) is another GAM8358 target gene, herein designated TARGET GENE. C20orf177 BINDING SITE is a target binding site found in the 3' untranslated region of mRNA encoded by C20orf177, corresponding to a target binding site such as BINDING SITE I, BINDING SITE II or BINDING SITE III of FIG. 8. Table 4 illustrates the complementarity of the nucleotide sequences of C20orf177 BINDING SITE, designated SEQ ID:14749, to the nucleotide sequence of GAM8358 RNA, herein designated GAM RNA, also designated SEQ ID:255.

Another function of GAM8358 is therefore inhibition of Chromosome 20 open reading frame 177 (C20orf177, Accession XP_290955.1). Accordingly, utilities of GAM8358 include diagnosis, prevention and treatment of diseases and clinical conditions associated with C20orf177.

Chromosome 20 open reading frame 24 (C20orf24, Accession NP_061328.1) is another GAM8358 target gene, herein designated TARGET GENE. C20orf24 BINDING SITE is a target binding site found in the 3' untranslated region of mRNA encoded by C20orf24, corresponding to a target binding site such as BINDING SITE I, BINDING SITE II or BINDING SITE III of FIG. 8. Table 4 illustrates the complementarity of the nucleotide sequences of C20orf24 BINDING SITE, designated SEQ ID:15423, to the nucleotide sequence of GAM8358 RNA, herein designated GAM RNA, also designated SEQ ID:255.

Another function of GAM8358 is therefore inhibition of Chromosome 20 open reading frame 24 (C20orf24, Accession NP_061328.1). Accordingly, utilities of GAM8358 include diagnosis, prevention and treatment of diseases and clinical conditions associated with C20orf24.

Chromosome 21 open reading frame 90 (C21orf90, Accession NP_694936.1) is another GAM8358 target gene, herein designated TARGET GENE. C21orf90 BINDING SITE is a target binding site found in the 3' untranslated region of mRNA encoded by C21orf90, corresponding to a target binding site such as BINDING SITE I, BINDING SITE II or BINDING SITE III of FIG. 8. Table 4 illustrates the complementarity of the nucleotide sequences of C21orf90 BINDING SITE, designated SEQ ID:2575, to the nucleotide sequence of GAM8358 RNA, herein designated GAM RNA, also designated SEQ ID:255.

Another function of GAM8358 is therefore inhibition of Chromosome 21 open reading frame 90 (C21orf90, Accession NP_694936.1). Accordingly, utilities of GAM8358 include diagnosis, prevention and treatment of diseases and clinical conditions associated with C21orf90.

Chromosome 22 open reading frame 5 (C22orf5, Accession NP_036396.1) is another GAM8358 target gene, herein designated TARGET GENE. C22orf5 BINDING SITE is a target binding site found in the 3' untranslated region of mRNA encoded by C22orf5, corresponding to a target binding site such as BINDING SITE I, BINDING SITE II or BINDING SITE III of FIG. 8. Table 4 illustrates the complementarity of the nucleotide sequences of C22orf5 BINDING SITE, designated SEQ ID:8084, to the nucleotide sequence of GAM8358 RNA, herein designated GAM RNA, also designated SEQ ID:255.

Another function of GAM8358 is therefore inhibition of Chromosome 22 open reading frame 5 (C22orf5, Accession NP_036396.1). Accordingly, utilities of GAM8358 include diagnosis, prevention and treatment of diseases and clinical conditions associated with C22orf5.

C6orf55 (Accession NP_057569.2) is another GAM8358 target gene, herein designated TARGET GENE. C6orf55 BINDING SITE is a target binding site found in the 3' untranslated region of mRNA encoded by C6orf55, corresponding to a target binding site such as BINDING SITE I, BINDING SITE II or BINDING SITE III of FIG. 8. Table 4 illustrates the complementarity of the nucleotide sequences of C6orf55 BINDING SITE, designated SEQ ID:6070, to the nucleotide sequence of GAM8358 RNA, herein designated GAM RNA, also designated SEQ ID:255.

Another function of GAM8358 is therefore inhibition of C6orf55 (Accession NP_057569.2). Accordingly, utilities of GAM8358 include diagnosis, prevention and treatment of diseases and clinical conditions associated with C6orf55.

Calcium/calmodulin-dependent protein kinase kinase 1, alpha (CAMKK1, Accession NP_115670.1) is another GAM8358 target gene, herein designated TARGET GENE. CAMKK1 BINDING SITE is a target binding site found in the 3' untranslated region of multiple transcripts of mRNA encoded by CAMKK1, corresponding to a target binding site such as BINDING SITE I, BINDING SITE II or BINDING SITE III of FIG. 8. Table 4 illustrates the complementarity of the nucleotide sequences of CAMKK1 BINDING SITE, designated SEQ ID:8178, to the nucleotide sequence of GAM8358 RNA, herein designated GAM RNA, also designated SEQ ID:255.

Another function of GAM8358 is therefore inhibition of Calcium/calmodulin-dependent protein kinase kinase 1, alpha (CAMKK1, Accession NP_115670.1). Accordingly, utilities of GAM8358 include diagnosis, prevention and treatment of diseases and clinical conditions associated with CAMKK1.

Calcium/calmodulin-dependent protein kinase kinase 1, alpha (CAMKK1, Accession NP_757343.1) is another GAM8358 target gene, herein designated TARGET GENE. CAMKK1 BINDING SITE is a target binding site found in the 3' untranslated region of multiple transcripts of mRNA encoded by CAMKK1, corresponding to a target binding site such as BINDING SITE I, BINDING SITE II or BINDING SITE III of FIG. 8. Table 4 illustrates the complementarity of the nucleotide sequences of CAMKK1 BINDING SITE, designated SEQ ID:8178, to the nucleotide sequence of GAM8358 RNA, herein designated GAM RNA, also designated SEQ ID:255.

Another function of GAM8358 is therefore inhibition of Calcium/calmodulin-dependent protein kinase kinase 1, alpha (CAMKK1, Accession NP_757343.1). Accordingly, utilities of GAM8358 include diagnosis, prevention and treatment of diseases and clinical conditions associated with CAMKK1.

Chemokine binding protein 2 (CCBP2, Accession NP_001287.2) is another GAM8358 target gene, herein designated TARGET GENE. CCBP2 BINDING SITE is a target binding site found in the 5' untranslated region of mRNA encoded by CCBP2, corresponding to a target binding site such as BINDING SITE I, BINDING SITE II or BINDING SITE III of FIG. 8. Table 4 illustrates the complementarity of the nucleotide sequences of CCBP2 BINDING SITE, designated SEQ ID:17116, to the nucleotide sequence of GAM8358 RNA, herein designated GAM RNA, also designated SEQ ID:255.

Another function of GAM8358 is therefore inhibition of Chemokine binding protein 2 (CCBP2, Accession NP_001287.2), a gene which binds with relatively high-affinity to the majority of members of the beta-chemokine family. Accordingly, utilities of GAM8358 include diagnosis, prevention and treatment of diseases and clinical conditions associated with CCBP2.

The function of CCBP2 and its association with various diseases and clinical conditions, has been established by previous studies, as described hereinabove with reference to GAM377.2. Cyclin e1 (CCNE1, Accession NP_476530.1) is another GAM8358 target gene, herein designated TARGET GENE. CCNE1 BINDING SITE is a target binding site found in the 3' untranslated region of multiple transcripts of mRNA encoded by CCNE1, corresponding to a target binding site such as BINDING SITE I, BINDING SITE II or BINDING SITE III of FIG. 8. Table 4 illustrates the complementarity of the nucleotide sequences of CCNE1 BINDING SITE, designated SEQ ID:6758, to the nucleotide sequence of GAM8358 RNA, herein designated GAM RNA, also designated SEQ ID:255.

Another function of GAM8358 is therefore inhibition of Cyclin e1 (CCNE1, Accession NP_476530.1). Accordingly, utilities of GAM8358 include diagnosis, prevention and treatment of diseases and clinical conditions associated with CCNE1.

Cyclin e1 (CCNE1, Accession NP_001229.1) is another GAM8358 target gene, herein designated TARGET GENE. CCNE1 BINDING SITE is a target binding site found in the 3' untranslated region of multiple transcripts of mRNA encoded by CCNE1, corresponding to a target binding site such as BINDING SITE I, BINDING SITE II or BINDING SITE III of FIG. 8. Table 4 illustrates the complementarity of the nucleotide sequences of CCNE1 BINDING SITE, designated SEQ ID:6758, to the nucleotide sequence of GAM8358 RNA, herein designated GAM RNA, also designated SEQ ID:255.

Another function of GAM8358 is therefore inhibition of Cyclin e1 (CCNE1, Accession NP_001229.1). Accordingly, utilities of GAM8358 include diagnosis, prevention and treatment of diseases and clinical conditions associated with CCNE1.

Cyclin t2 (CCNT2, Accession NP_001232.1) is another GAM8358 target gene, herein designated TARGET GENE. CCNT2 BINDING SITE is a target binding site found in the 3' untranslated region of multiple transcripts of mRNA encoded by CCNT2, corresponding to a target binding site such as BINDING SITE I, BINDING SITE II or BINDING SITE III of FIG. 8. Table 4 illustrates the complementarity of the nucleotide sequences of CCNT2 BINDING SITE, designated SEQ ID:2221, to the nucleotide sequence of GAM8358 RNA, herein designated GAM RNA, also designated SEQ ID:255.

Another function of GAM8358 is therefore inhibition of Cyclin t2 (CCNT2, Accession NP_001232.1), a gene which is a regulatory subunit of the cyclin-dependent kinase pair (cdk9/cyclin t) complex. Accordingly, utilities of GAM8358 include diagnosis, prevention and treatment of diseases and clinical conditions associated with CCNT2.

The function of CCNT2 and its association with various diseases and clinical conditions, has been established by previous studies, as described hereinabove with reference to GAM179.1. Cyclin t2 (CCNT2, Accession NP_490595.1) is another GAM8358 target gene, herein designated TARGET GENE. CCNT2 BINDING SITE is a target binding site found in the 3' untranslated region of multiple transcripts of mRNA encoded by CCNT2, corresponding to a target binding site such as BINDING SITE I, BINDING SITE II or BINDING SITE III of FIG. 8. Table 4 illustrates the complementarity of the nucleotide sequences of CCNT2 BINDING SITE, designated SEQ ID:2221, to the nucleotide sequence of GAM8358 RNA, herein designated GAM RNA, also designated SEQ ID:255.

Another function of GAM8358 is therefore inhibition of Cyclin t2 (CCNT2, Accession NP_490595.1), a gene which is a regulatory subunit of the cyclin-dependent kinase pair (cdk9/cyclin t) complex. Accordingly, utilities of GAM8358 include diagnosis, prevention and treatment of diseases and clinical conditions associated with CCNT2.

The function of CCNT2 and its association with various diseases and clinical conditions, has been established by previous studies, as described hereinabove with reference to GAM179.1. Chemokine (c-c motif) receptor 9 (CCR9, Accession NP_006632.2) is another GAM8358 target gene, herein designated TARGET GENE. CCR9 BINDING SITE is a target binding site found in the 3' untranslated region of multiple transcripts of mRNA encoded by CCR9, corresponding to a target binding site such as BINDING SITE I, BINDING SITE II or BINDING SITE III of FIG. 8. Table 4 illustrates the complementarity of the nucleotide sequences of CCR9 BINDING SITE, designated SEQ ID:8222, to the nucleotide sequence of GAM8358 RNA, herein designated GAM RNA, also designated SEQ ID:255.

Another function of GAM8358 is therefore inhibition of Chemokine (c-c motif) receptor 9 (CCR9, Accession NP_006632.2), a gene which binds beta-chemokine family and subsequently transduces a signal by increasing the intracellular calcium ions level. Accordingly, utilities of GAM8358 include diagnosis, prevention and treatment of diseases and clinical conditions associated with CCR9.

The function of CCR9 and its association with various diseases and clinical conditions, has been established by previous studies, as described hereinabove with reference to GAM100.1. Chemokine (c-c motif) receptor 9 (CCR9, Accession NP_112477.1) is another GAM8358 target gene, herein designated TARGET GENE. CCR9 BINDING SITE is a target binding site found in the 3' untranslated region of multiple transcripts of mRNA encoded by CCR9, corresponding to a target binding site such as BINDING SITE I, BINDING SITE II or BINDING SITE III of FIG. 8. Table 4 illustrates the complementarity of the nucleotide sequences of CCR9 BINDING SITE, designated SEQ ID:8222, to the nucleotide sequence of GAM8358 RNA, herein designated GAM RNA, also designated SEQ ID:255.

Another function of GAM8358 is therefore inhibition of Chemokine (c-c motif) receptor 9 (CCR9, Accession NP_112477.1), a gene which binds beta-chemokine family and subsequently transduces a signal by increasing the intracellular calcium ions level. Accordingly, utilities of GAM8358 include diagnosis, prevention and treatment of diseases and clinical conditions associated with CCR9.

The function of CCR9 and its association with various diseases and clinical conditions, has been established by previous studies, as described hereinabove with reference to GAM100.1. CCRK (Accession NP_036251.2) is another GAM8358 target gene, herein designated TARGET GENE. CCRK BINDING SITE is a target binding site found in the 3' untranslated region of multiple transcripts of mRNA encoded by CCRK, corresponding to a target binding site such as BINDING SITE I, BINDING SITE II or BINDING SITE III of FIG. 8. Table 4 illustrates the complementarity of the nucleotide sequences of CCRK BINDING SITE, designated SEQ ID:14303, to the nucleotide sequence of GAM8358 RNA, herein designated GAM RNA, also designated SEQ ID:255.

Another function of GAM8358 is therefore inhibition of CCRK (Accession NP_036251.2). Accordingly, utilities of GAM8358 include diagnosis, prevention and treatment of diseases and clinical conditions associated with CCRK.

CCRK (Accession NP_848519.1) is another GAM8358 target gene, herein designated TARGET GENE. CCRK BINDING SITE is a target binding site found in the 3' untranslated region of multiple transcripts of mRNA encoded by CCRK, corresponding to a target binding site such as BINDING SITE I, BINDING SITE II or BINDING SITE III of FIG. 8. Table 4 illustrates the complementarity of the nucleotide sequences of CCRK BINDING SITE, designated SEQ ID:14303, to the nucleotide sequence of GAM8358 RNA, herein designated GAM RNA, also designated SEQ ID:255.

Another function of GAM8358 is therefore inhibition of CCRK (Accession NP_848519.1). Accordingly, utilities of GAM8358 include diagnosis, prevention and treatment of diseases and clinical conditions associated with CCRK.

Cd34 antigen (CD34, Accession NP_001764.1) is another GAM8358 target gene, herein designated TARGET GENE. CD34 BINDING SITE is a target binding site found in the 3' untranslated region of mRNA encoded by CD34, corresponding to a target binding site such as BINDING SITE I, BINDING SITE II or BINDING SITE III of FIG. 8. Table 4 illustrates the complementarity of the nucleotide sequences of CD34 BINDING SITE, designated SEQ ID:18960, to the nucleotide sequence of GAM8358 RNA, herein designated GAM RNA, also designated SEQ ID:255.

Another function of GAM8358 is therefore inhibition of Cd34 antigen (CD34, Accession NP_001764.1), a gene which is a monomeric cell surface antigen that is selectively expressed on human hematopoietic progenitor cells. Accordingly, utilities of GAM8358 include diagnosis, prevention and treatment of diseases and clinical conditions associated with CD34.

The function of CD34 and its association with various diseases and clinical conditions, has been established by previous studies, as described hereinabove with reference to GAM38.1. Cdc42 effector protein (rho gtpase binding) 2 (CDC42EP2, Accession NP_006770.1) is another GAM8358 target gene, herein designated TARGET GENE. CDC42EP2 BINDING SITE is a target binding site found in the 3' untranslated region of mRNA encoded by CDC42EP2, corresponding to a target binding site such as BINDING SITE I, BINDING SITE II or BINDING SITE III of FIG. 8. Table 4 illustrates the complementarity of the nucleotide sequences of CDC42EP2 BINDING SITE, designated SEQ ID:19471, to the nucleotide sequence of GAM8358 RNA, herein designated GAM RNA, also designated SEQ ID:255.

Another function of GAM8358 is therefore inhibition of Cdc42 effector protein (rho gtpase binding) 2 (CDC42EP2, Accession NP_006770.1). Accordingly, utilities of GAM8358 include diagnosis, prevention and treatment of diseases and clinical conditions associated with CDC42EP2.

CDK11 (Accession XP_166324.1) is another GAM8358 target gene, herein designated TARGET GENE. CDK11 BINDING SITE is a target binding site found in the 3' untranslated region of multiple transcripts of mRNA encoded by CDK11, corresponding to a target binding site such as BINDING SITE I, BINDING SITE II or BINDING SITE III of FIG. 8. Table 4 illustrates the complementarity of the nucleotide sequences of CDK11 BINDING SITE, designated SEQ ID:18586, to the nucleotide sequence of GAM8358 RNA, herein designated GAM RNA, also designated SEQ ID:255.

Another function of GAM8358 is therefore inhibition of CDK11 (Accession XP_166324.1). Accordingly, utilities of GAM8358 include diagnosis, prevention and treatment of diseases and clinical conditions associated with CDK11.

CGN (Accession NP_065821.1) is another GAM8358 target gene, herein designated TARGET GENE. CGN BINDING SITE is a target binding site found in the 3' untranslated region of mRNA encoded by CGN, corresponding to a target binding site such as BINDING SITE I, BINDING SITE II or BINDING SITE III of FIG. 8. Table 4 illustrates the complementarity of the nucleotide sequences of CGN BINDING SITE, designated SEQ ID:16231, to the nucleotide sequence of GAM8358 RNA, herein designated GAM RNA, also designated SEQ ID:255.

Another function of GAM8358 is therefore inhibition of CGN (Accession NP_065821.1). Accordingly, utilities of GAM8358 include diagnosis, prevention and treatment of diseases and clinical conditions associated with CGN.

Chordin (CHRD, Accession NP_817088.1) is another GAM8358 target gene, herein designated TARGET GENE. CHRD BINDING SITE is a target binding site found in the 3' untranslated region of multiple transcripts of mRNA encoded by CHRD, corresponding to a target binding site such as BINDING SITE I, BINDING SITE II or BINDING SITE III of FIG. 8. Table 4 illustrates the complementarity of the nucleotide sequences of CHRD BINDING SITE, designated SEQ ID:18550, to the nucleotide sequence of GAM8358 RNA, herein designated GAM RNA, also designated SEQ ID:255.

Another function of GAM8358 is therefore inhibition of Chordin (CHRD, Accession NP_817088.1). Accordingly, utilities of GAM8358 include diagnosis, prevention and treatment of diseases and clinical conditions associated with CHRD.

Chordin (CHRD, Accession NP_817087.1) is another GAM8358 target gene, herein designated TARGET GENE. CHRD BINDING SITE is a target binding site found in the 3' untranslated region of multiple transcripts of mRNA encoded by CHRD, corresponding to a target binding site such as BINDING SITE I, BINDING SITE II or BINDING SITE III of FIG. 8. Table 4 illustrates the complementarity of the nucleotide sequences of CHRD BINDING SITE, designated SEQ ID:18550, to the nucleotide sequence of GAM8358 RNA, herein designated GAM RNA, also designated SEQ ID:255.

Another function of GAM8358 is therefore inhibition of Chordin (CHRD, Accession NP_817087.1). Accordingly, utilities of GAM8358 include diagnosis, prevention and treatment of diseases and clinical conditions associated with CHRD.

Carbohydrate (n-acetylglucosamine 6-o) sulfotransferase 7 (CHST7, Accession NP_063939.2) is another GAM8358 target gene, herein designated TARGET GENE. CHST7 BINDING SITE is a target binding site found in the 3' untranslated region of mRNA encoded by CHST7, corresponding to a target binding site such as BINDING SITE I, BINDING SITE II or BINDING SITE III of FIG. 8. Table 4 illustrates the complementarity of the nucleotide sequences of CHST7 BINDING SITE, designated SEQ ID:12624, to the nucleotide sequence of GAM8358 RNA, herein designated GAM RNA, also designated SEQ ID:255.

Another function of GAM8358 is therefore inhibition of Carbohydrate (n-acetylglucosamine 6-o) sulfotransferase 7 (CHST7, Accession NP_063939.2). Accordingly, utilities of GAM8358 include diagnosis, prevention and treatment of diseases and clinical conditions associated with CHST7.

Cockayne syndrome 1 (classical) (CKN1, Accession NP_000073.1) is another GAM8358 target gene, herein designated TARGET GENE. CKN1 BINDING SITE is a target binding site found in the 3' untranslated region of mRNA encoded by CKN1, corresponding to a target binding site such as BINDING SITE I, BINDING SITE II or BINDING SITE III of FIG. 8. Table 4 illustrates the complementarity of the nucleotide sequences of CKN1 BINDING SITE, designated SEQ ID:10649, to the nucleotide sequence of GAM8358 RNA, herein designated GAM RNA, also designated SEQ ID:255.

Another function of GAM8358 is therefore inhibition of Cockayne syndrome 1 (classical) (CKN1, Accession NP_000073.1). Accordingly, utilities of GAM8358 include diagnosis, prevention and treatment of diseases and clinical conditions associated with CKN1.

C-type (calcium dependent, carbohydrate-recognition domain) lectin, superfamily member 11 (CLECSF11, Accession NP_569708.1) is another GAM8358 target gene, herein designated TARGET GENE. CLECSF11 BINDING SITE is a target binding site found in the 5' untranslated region of mRNA encoded by CLECSF11, corresponding to a target binding site such as BINDING SITE I, BINDING SITE II or BINDING SITE III of FIG. 8. Table 4 illustrates the complementarity of the nucleotide sequences of CLECSF11 BINDING SITE, designated SEQ ID:16381, to the nucleotide sequence of GAM8358 RNA, herein designated GAM RNA, also designated SEQ ID:255.

Another function of GAM8358 is therefore inhibition of C-type (calcium dependent, carbohydrate-recognition domain) lectin, superfamily member 11 (CLECSF11, Accession NP_569708.1), a gene which may play a role in ligand internalization and presentation. Accordingly, utilities of GAM8358 include diagnosis, prevention and treatment of diseases and clinical conditions associated with CLECSF11.

The function of CLECSF11 and its association with various diseases and clinical conditions, has been established by previous studies, as described hereinabove with reference to GAM571.1. CLONE25003 (Accession NP_056196.1) is another GAM8358 target gene, herein designated TARGET GENE. CLONE25003 BINDING SITE is a target binding site found in the 3' untranslated region of mRNA encoded by CLONE25003, corresponding to a target binding site such as BINDING SITE I, BINDING SITE II or BINDING SITE III of FIG. 8. Table 4 illustrates the complementarity of the nucleotide sequences of CLONE25003 BINDING SITE, designated SEQ ID:3547, to the nucleotide sequence of GAM8358 RNA, herein designated GAM RNA, also designated SEQ ID:255.

Another function of GAM8358 is therefore inhibition of CLONE25003 (Accession NP_056196.1). Accordingly, utilities of GAM8358 include diagnosis, prevention and treatment of diseases and clinical conditions associated with CLONE25003.

Contactin 2 (axonal) (CNTN2, Accession NP_005067.1) is another GAM8358 target gene, herein designated TARGET GENE. CNTN2 BINDING SITE is a target binding site found in the 3' untranslated region of mRNA encoded by CNTN2, corresponding to a target binding site such as BINDING SITE I, BINDING SITE II or BINDING SITE III of FIG. 8. Table 4 illustrates the complementarity of the nucleotide sequences of CNTN2 BINDING SITE, designated SEQ ID:19963, to the nucleotide sequence of GAM8358 RNA, herein designated GAM RNA, also designated SEQ ID:255.

Another function of GAM8358 is therefore inhibition of Contactin 2 (axonal) (CNTN2, Accession NP_005067.1), a gene which may play a role in axonal growth and cell adhesion. and therefore may be associated with Malignant gliomas. Accordingly, utilities of GAM8358 include diagnosis, prevention and treatment of Malignant gliomas, and of other diseases and clinical conditions associated with CNTN2.

The function of CNTN2 and its association with various diseases and clinical conditions, has been established by previous studies, as described hereinabove with reference to GAM223.2. COBRA1 (Accession NP_056271.2) is another GAM8358 target gene, herein designated TARGET GENE. COBRA1 BINDING SITE is a target binding site found in the 3' untranslated region of mRNA encoded by COBRA1, corresponding to a target binding site such as BINDING SITE I, BINDING SITE II or BINDING SITE III of FIG. 8. Table 4 illustrates the complementarity of the nucleotide sequences of COBRA1 BINDING SITE, designated SEQ ID:9964, to the nucleotide sequence of GAM8358 RNA, herein designated GAM RNA, also designated SEQ ID:255.

Another function of GAM8358 is therefore inhibition of COBRA1 (Accession NP_056271.2). Accordingly, utilities of GAM8358 include diagnosis, prevention and treatment of diseases and clinical conditions associated with COBRA1.

Collagen, type v, alpha 3 (COL5A3, Accession NP_056534.1) is another GAM8358 target gene, herein designated TARGET GENE. COL5A3 BINDING SITE is a target binding site found in the 3' untranslated region of mRNA encoded by COL5A3, corresponding to a target binding site such as BINDING SITE I, BINDING SITE II or BINDING SITE III of FIG. 8. Table 4 illustrates the complementarity of the nucleotide sequences of COL5A3 BINDING SITE, designated SEQ ID:12577, to the nucleotide sequence of GAM8358 RNA, herein designated GAM RNA, also designated SEQ ID:255.

Another function of GAM8358 is therefore inhibition of Collagen, type v, alpha 3 (COL5A3, Accession NP_056534.1). Accordingly, utilities of GAM8358 include diagnosis, prevention and treatment of diseases and clinical conditions associated with COL5A3.

Cop9 constitutive photomorphogenic homolog subunit 7b (arabidopsis) (COPS7B, Accession NP_073567.1) is another GAM8358 target gene, herein designated TARGET GENE. COPS7B BINDING SITE is a target binding site found in the 3' untranslated region of mRNA encoded by COPS7B, corresponding to a target binding site such as BINDING SITE I, BINDING SITE II or BINDING SITE III of FIG. 8. Table 4 illustrates the complementarity of the nucleotide sequences of COPS7B BINDING SITE, designated SEQ ID:10817, to the nucleotide sequence of GAM8358 RNA, herein designated GAM RNA, also designated SEQ ID:255.

Another function of GAM8358 is therefore inhibition of Cop9 constitutive photomorphogenic homolog subunit 7b (arabidopsis) (COPS7B, Accession NP_073567.1). Accordingly, utilities of GAM8358 include diagnosis, prevention and treatment of diseases and clinical conditions associated with COPS7B.

Crm, cramped-like (drosophila) (CRAMP1L, Accession XP_034570.4) is another GAM8358 target gene, herein designated TARGET GENE. CRAMP1L BINDING SITE is a target binding site found in the 3' untranslated region of mRNA encoded by CRAMP1L, corresponding to a target binding site such as BINDING SITE I, BINDING SITE II or BINDING SITE III of FIG. 8. Table 4 illustrates the complementarity of the nucleotide sequences of CRAMP1L BINDING SITE, designated SEQ ID:8892, to the nucleotide sequence of GAM8358 RNA, herein designated GAM RNA, also designated SEQ ID:255.

Another function of GAM8358 is therefore inhibition of Crm, cramped-like (drosophila) (CRAMP1L, Accession XP_034570.4). Accordingly, utilities of GAM8358 include diagnosis, prevention and treatment of diseases and clinical conditions associated with CRAMP1L.

Casein kinase 1, gamma 1 (CSNK1G1, Accession NP_071331.1) is another GAM8358 target gene, herein designated TARGET GENE. CSNK1G1 BINDING SITE is a target binding site found in the 3' untranslated region of mRNA encoded by CSNK1G1, corresponding to a target binding site such as BINDING SITE I, BINDING SITE II or BINDING SITE III of FIG. 8. Table 4 illustrates the complementarity of the nucleotide sequences of CSNK1G1 BINDING SITE, designated SEQ ID:2519, to the nucleotide sequence of GAM8358 RNA, herein designated GAM RNA, also designated SEQ ID:255.

Another function of GAM8358 is therefore inhibition of Casein kinase 1, gamma 1 (CSNK1G1, Accession NP_071331.1). Accordingly, utilities of GAM8358 include diagnosis, prevention and treatment of diseases and clinical conditions associated with CSNK1G1.

CT120 (Accession NP_079068.1) is another GAM8358 target gene, herein designated TARGET GENE. CT120 BINDING SITE is a target binding site found in the 3' untranslated region of mRNA encoded by CT120, corresponding to a target binding site such as BINDING SITE I, BINDING SITE II or BINDING SITE III of FIG. 8. Table 4 illustrates the complementarity of the nucleotide sequences of CT120 BINDING SITE, designated SEQ ID:4706, to the nucleotide sequence of GAM8358 RNA, herein designated GAM RNA, also designated SEQ ID:255.

Another function of GAM8358 is therefore inhibition of CT120 (Accession NP_079068.1). Accordingly, utilities of GAM8358 include diagnosis, prevention and treatment of diseases and clinical conditions associated with CT120.

Cytochrome p450, subfamily iib (phenobarbital-inducible), polypeptide 6 (CYP2B6, Accession NP_000758.1) is another GAM8358 target gene, herein designated TARGET GENE. CYP2B6 BINDING SITE is a target binding site found in the 3' untranslated region of mRNA encoded by CYP2B6, corresponding to a target binding site such as BINDING SITE I, BINDING SITE II or BINDING SITE III of FIG. 8. Table 4 illustrates the complementarity of the nucleotide sequences of CYP2B6 BINDING SITE, designated SEQ ID:11117, to the nucleotide sequence of GAM8358 RNA, herein designated GAM RNA, also designated SEQ ID:255.

Another function of GAM8358 is therefore inhibition of Cytochrome p450, subfamily iib (phenobarbital-inducible), polypeptide 6 (CYP2B6, Accession NP_000758.1), a gene which oxidizes a variety of structurally unrelated compounds, including steroids, fatty acids, and xenobiotics. Accordingly, utilities of GAM8358 include diagnosis, prevention and treatment of diseases and clinical conditions associated with CYP2B6.

The function of CYP2B6 and its association with various diseases and clinical conditions, has been established by previous studies, as described hereinabove with reference to GAM30.1. D12S2489E (Accession NP_031386.1) is another GAM8358 target gene, herein designated TARGET GENE. D12S2489E BINDING SITE is a target binding site found in the 3' untranslated region of mRNA encoded by D12S2489E, corresponding to a target binding site such as BINDING SITE I, BINDING SITE II or BINDING SITE III of FIG. 8. Table 4 illustrates the complementarity of the nucleotide sequences of D12S2489E BINDING SITE, designated SEQ ID:712, to the nucleotide sequence of GAM8358 RNA, herein designated GAM RNA, also designated SEQ ID:255.

Another function of GAM8358 is therefore inhibition of D12S2489E (Accession NP_031386.1), a gene which interacts in the inhibition and activation of NK cells. Accordingly, utilities of GAM8358 include diagnosis, prevention and treatment of diseases and clinical conditions associated with D12S2489E.

The function of D12S2489E and its association with various diseases and clinical conditions, has been established by previous studies, as described hereinabove with reference to GAM715.2. Dead/h (asp-glu-ala-asp/his) box polypeptide 11 (chl1-like helicase homolog, s. cerevisiae) (DDX11, Accession NP_085913.1) is another GAM8358 target gene, herein designated TARGET GENE. DDX11 BINDING SITE is a target binding site found in the 3' untranslated region of multiple transcripts of mRNA encoded by DDX11, corresponding to a target binding site such as BINDING SITE I, BINDING SITE II or BINDING SITE III of FIG. 8. Table 4 illustrates the complementarity of the nucleotide sequences of DDX11 BINDING SITE, designated SEQ ID:7256, to the nucleotide sequence of GAM8358 RNA, herein designated GAM RNA, also designated SEQ ID:255.

Another function of GAM8358 is therefore inhibition of Dead/h (asp-glu-ala-asp/his) box polypeptide 11 (chl1-like helicase homolog, s. cerevisiae) (DDX11, Accession NP_085913.1), a gene which could be an ATP-dependent DNA-binding helicase and may intervene in cell cycle regulation. Accordingly, utilities of GAM8358 include diagnosis, prevention and treatment of diseases and clinical conditions associated with DDX11.

The function of DDX11 and its association with various diseases and clinical conditions, has been established by previous studies, as described hereinabove with reference to GAM63.1. Dead/h (asp-glu-ala-asp/his) box polypeptide 20, 103 kda (DDX20, Accession NP_009135.3) is another GAM8358 target gene, herein designated TARGET GENE. DDX20 BINDING SITE is a target binding site found in the 5' untranslated region of mRNA encoded by DDX20, corresponding to a target binding site such as BINDING SITE I, BINDING SITE II or BINDING SITE III of FIG. 8. Table 4 illustrates the complementarity of the nucleotide sequences of DDX20 BINDING SITE, designated SEQ ID:2897, to the nucleotide sequence of GAM8358 RNA, herein designated GAM RNA, also designated SEQ ID:255.

Another function of GAM8358 is therefore inhibition of Dead/h (asp-glu-ala-asp/his) box polypeptide 20, 103 kda (DDX20, Accession NP_009135.3), a gene which interacts with SMN and is required for pre- mRNA splicing in the nucleus. Accordingly, utilities of GAM8358 include diagnosis, prevention and treatment of diseases and clinical conditions associated with DDX20.

The function of DDX20 and its association with various diseases and clinical conditions, has been established by previous studies, as described hereinabove with reference to GAM869.1. DKFZp434F142 (Accession NP_115630.1) is another GAM8358 target gene, herein designated TARGET GENE. DKFZp434F142 BINDING SITE is a target binding site found in the 5' untranslated region of mRNA encoded by DKFZp434F142, corresponding to a target binding site such as BINDING SITE I, BINDING SITE II or BINDING SITE III of FIG. 8. Table 4 illustrates the complementarity of the nucleotide sequences of DKFZp434F142 BINDING SITE, designated SEQ ID:6913, to the nucleotide sequence of GAM8358 RNA, herein designated GAM RNA, also designated SEQ ID:255.

Another function of GAM8358 is therefore inhibition of DKFZp434F142 (Accession NP_115630.1). Accordingly, utilities of GAM8358 include diagnosis, prevention and treatment of diseases and clinical conditions associated with DKFZp434F142.

DKFZp434I1930 (Accession NP_115631.1) is another GAM8358 target gene, herein designated TARGET GENE. DKFZp434I1930 BINDING SITE is a target binding site found in the 3' untranslated region of mRNA encoded by DKFZp434I1930, corresponding to a target binding site such as BINDING SITE I, BINDING SITE II or BINDING SITE III of FIG. 8. Table 4 illustrates the complementarity of the nucleotide sequences of DKFZp434I1930 BINDING SITE, designated SEQ ID:16331, to the nucleotide sequence of GAM8358 RNA, herein designated GAM RNA, also designated SEQ ID:255.

Another function of GAM8358 is therefore inhibition of DKFZp434I1930 (Accession NP_115631.1). Accordingly, utilities of GAM8358 include diagnosis, prevention and treatment of diseases and clinical conditions associated with DKFZp434I1930.

DKFZp434O0320 (Accession XP_097012.2) is another GAM8358 target gene, herein designated TARGET GENE. DKFZp434O0320 BINDING SITE is a target binding site found in the 5' untranslated region of mRNA encoded by DKFZp434O0320, corresponding to a target binding site such as BINDING SITE I, BINDING SITE II or BINDING SITE III of FIG. 8. Table 4 illustrates the complementarity of the nucleotide sequences of DKFZp434O0320 BINDING SITE, designated SEQ ID:9070, to the nucleotide sequence of GAM8358 RNA, herein designated GAM RNA, also designated SEQ ID:255.

Another function of GAM8358 is therefore inhibition of DKFZp434O0320 (Accession XP_097012.2). Accordingly, utilities of GAM8358 include diagnosis, prevention and treatment of diseases and clinical conditions associated with DKFZp434O0320.

DKFZp547C176 (Accession XP_040799.2) is another GAM8358 target gene, herein designated TARGET GENE. DKFZp547C176 BINDING SITE1 and DKFZp547C176 BINDING SITE2 are target binding sites found in untranslated regions of mRNA encoded by DKFZp547C176, corresponding to target binding sites such as BINDING SITE I, BINDING SITE II or BINDING SITE III of FIG. 8. Table 4 illustrates the complementarity of the nucleotide sequences of DKFZp547C176 BINDING SITE1 and DKFZp547C176 BINDING SITE2, designated SEQ ID:9992 and SEQ ID:13108 respectively, to the nucleotide sequence of GAM8358 RNA, herein designated GAM RNA, also designated SEQ ID:255.

Another function of GAM8358 is therefore inhibition of DKFZp547C176 (Accession XP_040799.2). Accordingly, utilities of GAM8358 include diagnosis, prevention and treatment of diseases and clinical conditions associated with DKFZp547C176.

DKFZP564K0322 (Accession NP_114429.1) is another GAM8358 target gene, herein designated TARGET GENE. DKFZP564K0322 BINDING SITE is a target binding site found in the 5' untranslated region of mRNA encoded by DKFZP564K0322, corresponding to a target binding site such as BINDING SITE I, BINDING SITE II or BINDING SITE III of FIG. 8. Table 4 illustrates the complementarity of the nucleotide sequences of DKFZP564K0322 BINDING SITE, designated SEQ ID:5804, to the nucleotide sequence of GAM8358 RNA, herein designated GAM RNA, also designated SEQ ID:255.

Another function of GAM8358 is therefore inhibition of DKFZP564K0322 (Accession NP_114429.1). Accordingly, utilities of GAM8358 include diagnosis, prevention and treatment of diseases and clinical conditions associated with DKFZP564K0322.

DKFZP564O043 (Accession NP_064715.1) is another GAM8358 target gene, herein designated TARGET GENE. DKFZP564O043 BINDING SITE is a target binding site found in the 5' untranslated region of mRNA encoded by DKFZP564O043, corresponding to a target binding site such as BINDING SITE I, BINDING SITE II or BINDING SITE III of FIG. 8. Table 4 illustrates the complementarity of the nucleotide sequences of DKFZP564O043 BINDING SITE, designated SEQ ID:15465, to the nucleotide sequence of GAM8358 RNA, herein designated GAM RNA, also designated SEQ ID:255.

Another function of GAM8358 is therefore inhibition of DKFZP564O043 (Accession NP_064715.1). Accordingly, utilities of GAM8358 include diagnosis, prevention and treatment of diseases and clinical conditions associated with DKFZP564O043.

DKFZP566C0424 (Accession NP_056424.1) is another GAM8358 target gene, herein designated TARGET GENE. DKFZP566C0424 BINDING SITE is a target binding site found in the 3' untranslated region of mRNA encoded by DKFZP566C0424, corresponding to a target binding site such as BINDING SITE I, BINDING SITE II or BINDING SITE III of FIG. 8. Table 4 illustrates the complementarity of the nucleotide sequences of DKFZP566C0424 BINDING SITE, designated SEQ ID:8396, to the nucleotide sequence of GAM8358 RNA, herein designated GAM RNA, also designated SEQ ID:255.

Another function of GAM8358 is therefore inhibition of DKFZP566C0424 (Accession NP_056424.1). Accordingly, utilities of GAM8358 include diagnosis, prevention and treatment of diseases and clinical conditions associated with DKFZP566C0424.

DKFZP727G051 (Accession XP_045308.2) is another GAM8358 target gene, herein designated TARGET GENE. DKFZP727G051 BINDING SITE is a target binding site found in the 3' untranslated region of mRNA encoded by DKFZP727G051, corresponding to a target binding site such as BINDING SITE I, BINDING SITE II or BINDING SITE III of FIG. 8. Table 4 illustrates the complementarity of the nucleotide sequences of DKFZP727G051 BINDING SITE, designated SEQ ID:6607, to the nucleotide sequence of GAM8358 RNA, herein designated GAM RNA, also designated SEQ ID:255.

Another function of GAM8358 is therefore inhibition of DKFZP727G051 (Accession XP_045308.2). Accordingly, utilities of GAM8358 include diagnosis, prevention and treatment of diseases and clinical conditions associated with DKFZP727G051.

DKFZp761B0514 (Accession NP_115665.1) is another GAM8358 target gene, herein designated TARGET GENE. DKFZp761B0514 BINDING SITE is a target binding site found in the 3' untranslated region of mRNA encoded by DKFZp761B0514, corresponding to a target binding site such as BINDING SITE I, BINDING SITE II or BINDING SITE III of FIG. 8. Table 4 illustrates the complementarity of the nucleotide sequences of DKFZp761B0514 BINDING SITE, designated SEQ ID:3724, to the nucleotide sequence of GAM8358 RNA, herein designated GAM RNA, also designated SEQ ID:255.

Another function of GAM8358 is therefore inhibition of DKFZp761B0514 (Accession NP_115665.1). Accordingly, utilities of GAM8358 include diagnosis, prevention and treatment of diseases and clinical conditions associated with DKFZp761B0514.

DKFZp761E1217 (Accession NP_848634.1) is another GAM8358 target gene, herein designated TARGET GENE. DKFZp761E1217 BINDING SITE is a target binding site found in the 3' untranslated region of mRNA encoded by DKFZp761E1217, corresponding to a target binding site such as BINDING SITE I, BINDING SITE II or BINDING SITE III of FIG. 8. Table 4 illustrates the complementarity of the nucleotide sequences of DKFZp761E1217 BINDING SITE, designated SEQ ID:1697, to the nucleotide sequence of GAM8358 RNA, herein designated GAM RNA, also designated SEQ ID:255.

Another function of GAM8358 is therefore inhibition of DKFZp761E1217 (Accession NP_848634.1). Accordingly, utilities of GAM8358 include diagnosis, prevention and treatment of diseases and clinical conditions associated with DKFZp761E1217.

DKFZp761H2121 (Accession NP_612212.1) is another GAM8358 target gene, herein designated TARGET GENE. DKFZp761H2121 BINDING SITE is a target binding site found in the 3' untranslated region of mRNA encoded by DKFZp761H2121, corresponding to a target binding site such as BINDING SITE I, BINDING SITE II or BINDING SITE III of FIG. 8. Table 4 illustrates the complementarity of the nucleotide sequences of DKFZp761H2121 BINDING SITE, designated SEQ ID:7508, to the nucleotide sequence of GAM8358 RNA, herein designated GAM RNA, also designated SEQ ID:255.

Another function of GAM8358 is therefore inhibition of DKFZp761H2121 (Accession NP_612212.1). Accordingly, utilities of GAM8358 include diagnosis, prevention and treatment of diseases and clinical conditions associated with DKFZp761H2121.

DKFZp761K1423 (Accession NP_060892.1) is another GAM8358 target gene, herein designated TARGET GENE. DKFZp761K1423 BINDING SITE is a target binding site found in the 3' untranslated region of mRNA encoded by DKFZp761K1423, corresponding to a target binding site such as BINDING SITE I, BINDING SITE II or BINDING SITE III of FIG. 8. Table 4 illustrates the complementarity of the nucleotide sequences of DKFZp761K1423 BINDING SITE, designated SEQ ID:1386, to the nucleotide sequence of GAM8358 RNA, herein designated GAM RNA, also designated SEQ ID:255.

Another function of GAM8358 is therefore inhibition of DKFZp761K1423 (Accession NP_060892.1). Accordingly, utilities of GAM8358 include diagnosis, prevention and treatment of diseases and clinical conditions associated with DKFZp761K1423.

Dystrophia myotonica-protein kinase (DMPK, Accession NP_004400.3) is another GAM8358 target gene, herein designated TARGET GENE. DMPK BINDING SITE is a target binding site found in the 5' untranslated region of mRNA encoded by DMPK, corresponding to a target binding site such as BINDING SITE I, BINDING SITE II or BINDING SITE III of FIG. 8. Table 4 illustrates the complementarity of the nucleotide sequences of DMPK BINDING SITE, designated SEQ ID:2249, to the nucleotide sequence of GAM8358 RNA, herein designated GAM RNA, also designated SEQ ID:255.

Another function of GAM8358 is therefore inhibition of Dystrophia myotonica-protein kinase (DMPK, Accession NP_004400.3). Accordingly, utilities of GAM8358 include diagnosis, prevention and treatment of diseases and clinical conditions associated with DMPK.

Doublesex and mab-3 related transcription factor 2 (DMRT2, Accession NP_006548.1) is another GAM8358 target gene, herein designated TARGET GENE. DMRT2 BINDING SITE is a target binding site found in the 3' untranslated region of mRNA encoded by DMRT2, corresponding to a target binding site such as BINDING SITE I, BINDING SITE II or BINDING SITE III of FIG. 8. Table 4 illustrates the complementarity of the nucleotide sequences of DMRT2 BINDING SITE, designated SEQ ID:2892, to the nucleotide sequence of GAM8358 RNA, herein designated GAM RNA, also designated SEQ ID:255.

Another function of GAM8358 is therefore inhibition of Doublesex and mab-3 related transcription factor 2 (DMRT2, Accession NP_006548.1), a gene which May be involved in male sexual development. Accordingly, utilities of GAM8358 include diagnosis, prevention and treatment of diseases and clinical conditions associated with DMRT2.

The function of DMRT2 and its association with various diseases and clinical conditions, has been established by previous studies, as described hereinabove with reference to GAM439.1. Dnaj (hsp40) homolog, subfamily b, member 2 (DNAJB2, Accession NP_006727.2) is another GAM8358 target gene, herein designated TARGET GENE. DNAJB2 BINDING SITE is a target binding site found in the 3' untranslated region of mRNA encoded by DNAJB2, corresponding to a target binding site such as BINDING SITE I, BINDING SITE II or BINDING SITE III of FIG. 8. Table 4 illustrates the complementarity of the nucleotide sequences of DNAJB2 BINDING SITE, designated SEQ ID:960, to the nucleotide sequence of GAM8358 RNA, herein designated GAM RNA, also designated SEQ ID:255.

Another function of GAM8358 is therefore inhibition of Dnaj (hsp40) homolog, subfamily b, member 2 (DNAJB2, Accession NP_006727.2). Accordingly, utilities of GAM8358 include diagnosis, prevention and treatment of diseases and clinical conditions associated with DNAJB2.

Dnaj (hsp40) homolog, subfamily c, member 8 (DNAJC8, Accession NP_055095.1) is another GAM8358 target gene, herein designated TARGET GENE. DNAJC8 BINDING SITE is a target binding site found in the 3' untranslated region of mRNA encoded by DNAJC8, corresponding to a target binding site such as BINDING SITE I, BINDING SITE II or BINDING SITE III of FIG. 8. Table 4 illustrates the complementarity of the nucleotide sequences of DNAJC8 BINDING SITE, designated SEQ ID:9424, to the nucleotide sequence of GAM8358 RNA, herein designated GAM RNA, also designated SEQ ID:255.

Another function of GAM8358 is therefore inhibition of Dnaj (hsp40) homolog, subfamily c, member 8 (DNAJC8, Accession NP_055095.1). Accordingly, utilities of GAM8358 include diagnosis, prevention and treatment of diseases and clinical conditions associated with DNAJC8.

Dna (cytosine-5-)-methyltransferase 2 (DNMT2, Accession NP_788274.1) is another GAM8358 target gene, herein designated TARGET GENE. DNMT2 BINDING SITE is a target binding site found in the 3' untranslated region of multiple transcripts of mRNA encoded by DNMT2, corresponding to a target binding site such as BINDING SITE I, BINDING SITE II or BINDING SITE III of FIG. 8. Table 4 illustrates the complementarity of the nucleotide sequences of DNMT2 BINDING SITE, designated SEQ ID:5113, to the nucleotide sequence of GAM8358 RNA, herein designated GAM RNA, also designated SEQ ID:255.

Another function of GAM8358 is therefore inhibition of Dna (cytosine-5-)-methyltransferase 2 (DNMT2, Accession NP_788274.1), a gene which may mark specific sequences in the genome. Accordingly, utilities of GAM8358 include diagnosis, prevention and treatment of diseases and clinical conditions associated with DNMT2.

The function of DNMT2 and its association with various diseases and clinical conditions, has been established by previous studies, as described hereinabove with reference to GAM264.1. Dna (cytosine-5-)-methyltransferase 2 (DNMT2, Accession NP_004403.1) is another GAM8358 target gene, herein designated TARGET GENE. DNMT2 BINDING SITE is a target binding site found in the 3' untranslated region of multiple transcripts of mRNA encoded by DNMT2, corresponding to a target binding site such as BINDING SITE I, BINDING SITE II or BINDING SITE III of FIG. 8. Table 4 illustrates the complementarity of the nucleotide sequences of DNMT2 BINDING SITE, designated SEQ ID:5113, to the nucleotide sequence of GAM8358 RNA, herein designated GAM RNA, also designated SEQ ID:255.

Another function of GAM8358 is therefore inhibition of Dna (cytosine-5-)-methyltransferase 2 (DNMT2, Accession NP_004403.1), a gene which may mark specific sequences in the genome. Accordingly, utilities of GAM8358 include diagnosis, prevention and treatment of diseases and clinical conditions associated with DNMT2.

The function of DNMT2 and its association with various diseases and clinical conditions, has been established by previous studies, as described hereinabove with reference to GAM264.1. Dna (cytosine-5-)-methyltransferase 2 (DNMT2, Accession NP_788270.1) is another GAM8358 target gene, herein designated TARGET GENE. DNMT2 BINDING SITE is a target binding site found in the 3' untranslated region of multiple transcripts of mRNA encoded by DNMT2, corresponding to a target binding site such as BINDING SITE I, BINDING SITE II or BINDING SITE III of FIG. 8. Table 4 illustrates the complementarity of the nucleotide sequences of DNMT2 BINDING SITE, designated SEQ ID:5113, to the nucleotide sequence of GAM8358 RNA, herein designated GAM RNA, also designated SEQ ID:255.

Another function of GAM8358 is therefore inhibition of Dna (cytosine-5-)-methyltransferase 2 (DNMT2, Accession NP_788270.1), a gene which may mark specific sequences in the genome. Accordingly, utilities of GAM8358 include diagnosis, prevention and treatment of diseases and clinical conditions associated with DNMT2.

The function of DNMT2 and its association with various diseases and clinical conditions, has been established by previous studies, as described hereinabove with reference to GAM264.1. Dna (cytosine-5-)-methyltransferase 2 (DNMT2, Accession NP_788271.1) is another GAM8358 target gene, herein designated TARGET GENE. DNMT2 BINDING SITE is a target binding site found in the 3' untranslated region of multiple transcripts of mRNA encoded by DNMT2, corresponding to a target binding site such as BINDING SITE I, BINDING SITE II or BINDING SITE III of FIG. 8. Table 4 illustrates the complementarity of the nucleotide sequences of DNMT2 BINDING SITE, designated SEQ ID:5113, to the nucleotide sequence of GAM8358 RNA, herein designated GAM RNA, also designated SEQ ID:255.

Another function of GAM8358 is therefore inhibition of Dna (cytosine-5-)-methyltransferase 2 (DNMT2, Accession NP_788271.1), a gene which may mark specific sequences in the genome. Accordingly, utilities of GAM8358 include diagnosis, prevention and treatment of diseases and clinical conditions associated with DNMT2.

The function of DNMT2 and its association with various diseases and clinical conditions, has been established by previous studies, as described hereinabove with reference to GAM264.1. Dna (cytosine-5-)-methyltransferase 2 (DNMT2, Accession NP_788272.1) is another GAM8358 target gene, herein designated TARGET GENE. DNMT2 BINDING SITE is a target binding site found in the 3' untranslated region of multiple transcripts of mRNA encoded by DNMT2, corresponding to a target binding site such as BINDING SITE I, BINDING SITE II or BINDING SITE III of FIG. 8. Table 4 illustrates the complementarity of the nucleotide sequences of DNMT2 BINDING SITE, designated SEQ ID:5113, to the nucleotide sequence of GAM8358 RNA, herein designated GAM RNA, also designated SEQ ID:255.

Another function of GAM8358 is therefore inhibition of Dna (cytosine-5-)-methyltransferase 2 (DNMT2, Accession NP_788272.1), a gene which may mark specific sequences in the genome. Accordingly, utilities of GAM8358 include diagnosis, prevention and treatment of diseases and clinical conditions associated with DNMT2.

The function of DNMT2 and its association with various diseases and clinical conditions, has been established by previous studies, as described hereinabove with reference to GAM264.1. Dna (cytosine-5-)-methyltransferase 2 (DNMT2, Accession NP_788273.1) is another GAM8358 target gene, herein designated TARGET GENE. DNMT2 BINDING SITE is a target binding site found in the 3' untranslated region of multiple transcripts of mRNA encoded by DNMT2, corresponding to a target binding site such as BINDING SITE I, BINDING SITE II or BINDING SITE III of FIG. 8. Table 4 illustrates the complementarity of the nucleotide sequences of DNMT2 BINDING SITE, designated SEQ ID:5113, to the nucleotide sequence of GAM8358 RNA, herein designated GAM RNA, also designated SEQ ID:255.

Another function of GAM8358 is therefore inhibition of Dna (cytosine-5-)-methyltransferase 2 (DNMT2, Accession NP_788273.1), a gene which may mark specific sequences in the genome. Accordingly, utilities of GAM8358 include diagnosis, prevention and treatment of diseases and clinical conditions associated with DNMT2.

The function of DNMT2 and its association with various diseases and clinical conditions, has been established by previous studies, as described hereinabove with reference to GAM264.1. DPF3 (Accession NP_036206.1) is another GAM8358 target gene, herein designated TARGET GENE. DPF3 BINDING SITE is a target binding site found in the 3' untranslated region of mRNA encoded by DPF3, corresponding to a target binding site such as BINDING SITE I, BINDING SITE II or BINDING SITE III of FIG. 8. Table 4 illustrates the complementarity of the nucleotide sequences of DPF3 BINDING SITE, designated SEQ ID:15008, to the nucleotide sequence of GAM8358 RNA, herein designated GAM RNA, also designated SEQ ID:255.

Another function of GAM8358 is therefore inhibition of DPF3 (Accession NP_036206.1). Accordingly, utilities of GAM8358 include diagnosis, prevention and treatment of diseases and clinical conditions associated with DPF3.

Diptheria toxin resistance protein required for diphthamide biosynthesis-like 2 (s. cerevisiae) (DPH2L2, Accession NP_001375.2) is another GAM8358 target gene, herein designated TARGET GENE. DPH2L2 BINDING SITE is a target binding site found in the 5' untranslated region of mRNA encoded by DPH2L2, corresponding to a target binding site such as BINDING SITE I, BINDING SITE II or BINDING SITE III of FIG. 8. Table 4 illustrates the complementarity of the nucleotide sequences of DPH2L2 BINDING SITE, designated SEQ ID:14115, to the nucleotide sequence of GAM8358 RNA, herein designated GAM RNA, also designated SEQ ID:255.

Another function of GAM8358 is therefore inhibition of Diptheria toxin resistance protein required for diphthamide biosynthesis-like 2 (s. cerevisiae) (DPH2L2, Accession NP_001375.2), a gene which is required for diphthamide biosynthesis. Accordingly, utilities of GAM8358 include diagnosis, prevention and treatment of diseases and clinical conditions associated with DPH2L2.

The function of DPH2L2 and its association with various diseases and clinical conditions, has been established by previous studies, as described hereinabove with reference to GAM673.1. Dopamine receptor d5 (DRD5, Accession NP_000789.1) is another GAM8358 target gene, herein designated TARGET GENE. DRD5 BINDING SITE is a target binding site found in the 3' untranslated region of mRNA encoded by DRD5, corresponding to a target binding site such as BINDING SITE I, BINDING SITE II or BINDING SITE III of FIG. 8. Table 4 illustrates the complementarity of the nucleotide sequences of DRD5 BINDING SITE, designated SEQ ID:14601, to the nucleotide sequence of GAM8358 RNA, herein designated GAM RNA, also designated SEQ ID:255.

Another function of GAM8358 is therefore inhibition of Dopamine receptor d5 (DRD5, Accession NP_000789.1), a gene which is a dopamine receptor. and therefore may be associated with Primary cervical dystonia and schizophrenia. Accordingly, utilities of GAM8358 include diagnosis, prevention and treatment of Primary cervical dystonia and schizophrenia, and of other diseases and clinical conditions associated with DRD5.

The function of DRD5 and its association with various diseases and clinical conditions, has been established by previous studies, as described hereinabove with reference to GAM1571.1. Down syndrome critical region gene 6 (DSCR6, Accession NP_061835.1) is another GAM8358 target gene, herein designated TARGET GENE. DSCR6 BINDING SITE is a target binding site found in the 3' untranslated region of mRNA encoded by DSCR6, corresponding to a target binding site such as BINDING SITE I, BINDING SITE II or BINDING SITE III of FIG. 8. Table 4 illustrates the complementarity of the nucleotide sequences of DSCR6 BINDING SITE, designated SEQ ID:3793, to the nucleotide sequence of GAM8358 RNA, herein designated GAM RNA, also designated SEQ ID:255.

Another function of GAM8358 is therefore inhibition of Down syndrome critical region gene 6 (DSCR6, Accession NP_061835.1). Accordingly, utilities of GAM8358 include diagnosis, prevention and treatment of diseases and clinical conditions associated with DSCR6.

DT1P1A10 (Accession NP_477511.1) is another GAM8358 target gene, herein designated TARGET GENE. DT1P1A10 BINDING SITE is a target binding site found in the 3' untranslated region of mRNA encoded by DT1P1A10, corresponding to a target binding site such as BINDING SITE I, BINDING SITE II or BINDING SITE III of FIG. 8. Table 4 illustrates the complementarity of the nucleotide sequences of DT1P1A10 BINDING SITE, designated SEQ ID:15919, to the nucleotide sequence of GAM8358 RNA, herein designated GAM RNA, also designated SEQ ID:255.

Another function of GAM8358 is therefore inhibition of DT1P1A10 (Accession NP_477511.1). Accordingly, utilities of GAM8358 include diagnosis, prevention and treatment of diseases and clinical conditions associated with DT1P1A10.

Dishevelled, dsh homolog 3 (drosophila) (DVL3, Accession NP_004414.2) is another GAM8358 target gene, herein designated TARGET GENE. DVL3 BINDING SITE is a target binding site found in the 3' untranslated region of mRNA encoded by DVL3, corresponding to a target binding site such as BINDING SITE I, BINDING SITE II or BINDING SITE III of FIG. 8. Table 4 illustrates the complementarity of the nucleotide sequences of DVL3 BINDING SITE, designated SEQ ID:10388, to the nucleotide sequence of GAM8358 RNA, herein designated GAM RNA, also designated SEQ ID:255.

Another function of GAM8358 is therefore inhibition of Dishevelled, dsh homolog 3 (drosophila) (DVL3, Accession NP_004414.2), a gene which regulates cell proliferation. Accordingly, utilities of GAM8358 include diagnosis, prevention and treatment of diseases and clinical conditions associated with DVL3.

The function of DVL3 and its association with various diseases and clinical conditions, has been established by previous studies, as described hereinabove with reference to GAM47.1. E2IG4 (Accession NP_056331.1) is another GAM8358 target gene, herein designated TARGET GENE. E2IG4 BINDING SITE is a target binding site found in the 3' untranslated region of mRNA encoded by E2IG4, corresponding to a target binding site such as BINDING SITE I, BINDING SITE II or BINDING SITE III of FIG. 8. Table 4 illustrates the complementarity of the nucleotide sequences of E2IG4 BINDING SITE, designated SEQ ID:5803, to the nucleotide sequence of GAM8358 RNA, herein designated GAM RNA, also designated SEQ ID:255.

Another function of GAM8358 is therefore inhibition of E2IG4 (Accession NP_056331.1). Accordingly, utilities of GAM8358 include diagnosis, prevention and treatment of diseases and clinical conditions associated with E2IG4.

EB-1 (Accession NP_690001.1) is another GAM8358 target gene, herein designated TARGET GENE. EB-1 BINDING SITE is a target binding site found in the 3' untranslated region of multiple transcripts of mRNA encoded by EB-1, corresponding to a target binding site such as BINDING SITE I, BINDING SITE II or BINDING SITE III of FIG. 8. Table 4 illustrates the complementarity of the nucleotide sequences of EB-1 BINDING SITE, designated SEQ ID:571, to the nucleotide sequence of GAM8358 RNA, herein designated GAM RNA, also designated SEQ ID:255.

Another function of GAM8358 is therefore inhibition of EB-1 (Accession NP_690001.1). Accordingly, utilities of GAM8358 include diagnosis, prevention and treatment of diseases and clinical conditions associated with EB-1.

EDEM (Accession NP_055489.1) is another GAM8358 target gene, herein designated TARGET GENE. EDEM BINDING SITE is a target binding site found in the 3' untranslated region of mRNA encoded by EDEM, corresponding to a target binding site such as BINDING SITE I, BINDING SITE II or BINDING SITE III of FIG. 8. Table 4 illustrates the complementarity of the nucleotide sequences of EDEM BINDING SITE, designated SEQ ID:3301, to the nucleotide sequence of GAM8358 RNA, herein designated GAM RNA, also designated SEQ ID:255.

Another function of GAM8358 is therefore inhibition of EDEM (Accession NP_055489.1). Accordingly, utilities of GAM8358 include diagnosis, prevention and treatment of diseases and clinical conditions associated with EDEM.

Eukaryotic translation initiation factor 2b, subunit 5 epsilon, 82 kda (EIF2B5, Accession XP_291076.1) is another GAM8358 target gene, herein designated TARGET GENE. EIF2B5 BINDING SITE is a target binding site found in the 5' untranslated region of mRNA encoded by EIF2B5, corresponding to a target binding site such as BINDING SITE I, BINDING SITE II or BINDING SITE III of FIG. 8. Table 4 illustrates the complementarity of the nucleotide sequences of EIF2B5 BINDING SITE, designated SEQ ID:6190, to the nucleotide sequence of GAM8358 RNA, herein designated GAM RNA, also designated SEQ ID:255.

Another function of GAM8358 is therefore inhibition of Eukaryotic translation initiation factor 2b, subunit 5 epsilon, 82 kda (EIF2B5, Accession XP_291076.1). Accordingly, utilities of GAM8358 include diagnosis, prevention and treatment of diseases and clinical conditions associated with EIF2B5.

Ectonucleoside triphosphate diphosphohydrolase 6 (putative function) (ENTPD6, Accession NP_001238.1) is another GAM8358 target gene, herein designated TARGET GENE. ENTPD6 BINDING SITE is a target binding site found in the 3' untranslated region of mRNA encoded by ENTPD6, corresponding to a target binding site such as BINDING SITE I, BINDING SITE II or BINDING SITE III of FIG. 8. Table 4 illustrates the complementarity of the nucleotide sequences of ENTPD6 BINDING SITE, designated SEQ ID:10345, to the nucleotide sequence of GAM8358 RNA, herein designated GAM RNA, also designated SEQ ID:255.

Another function of GAM8358 is therefore inhibition of Ectonucleoside triphosphate diphosphohydrolase 6 (putative function) (ENTPD6, Accession NP_001238.1), a gene which might support glycosylation reactions in the golgi apparatus and, when released from cells, might catalyze the hydrolysis of extracellular nucleotides. Accordingly, utilities of GAM8358 include diagnosis, prevention and treatment of diseases and clinical conditions associated with ENTPD6.

The function of ENTPD6 and its association with various diseases and clinical conditions, has been established by previous studies, as described hereinabove with reference to GAM65.2. Ephb4 (EPHB4, Accession NP_004435.2) is another GAM8358 target gene, herein designated TARGET GENE. EPHB4 BINDING SITE is a target binding site found in the 3' untranslated region of mRNA encoded by EPHB4, corresponding to a target binding site such as BINDING SITE I, BINDING SITE II or BINDING SITE III of FIG. 8. Table 4 illustrates the complementarity of the nucleotide sequences of EPHB4 BINDING SITE, designated SEQ ID:1248, to the nucleotide sequence of GAM8358 RNA, herein designated GAM RNA, also designated SEQ ID:255.

Another function of GAM8358 is therefore inhibition of Ephb4 (EPHB4, Accession NP_004435.2), a gene which receptor for members of the ephrin-b family. binds to ephrin-b2. Accordingly, utilities of GAM8358 include diagnosis, prevention and treatment of diseases and clinical conditions associated with EPHB4.

The function of EPHB4 and its association with various diseases and clinical conditions, has been established by previous studies, as described hereinabove with reference to GAM767.1. ERAP140 (Accession XP_059748.2) is another GAM8358 target gene, herein designated TARGET GENE. ERAP140 BINDING SITE is a target binding site found in the 3' untranslated region of mRNA encoded by ERAP140, corresponding to a target binding site such as BINDING SITE I, BINDING SITE II or BINDING SITE III of FIG. 8. Table 4 illustrates the complementarity of the nucleotide sequences of ERAP140 BINDING SITE, designated SEQ ID:5927, to the nucleotide sequence of GAM8358 RNA, herein designated GAM RNA, also designated SEQ ID:255.

Another function of GAM8358 is therefore inhibition of ERAP140 (Accession XP_059748.2). Accordingly, utilities of GAM8358 include diagnosis, prevention and treatment of diseases and clinical conditions associated with ERAP140.

Envoplakin (EVPL, Accession NP_001979.1) is another GAM8358 target gene, herein designated TARGET GENE. EVPL BINDING SITE is a target binding site found in the 3' untranslated region of mRNA encoded by EVPL, corresponding to a target binding site such as BINDING SITE I, BINDING SITE II or BINDING SITE III of FIG. 8. Table 4 illustrates the complementarity of the nucleotide sequences of EVPL BINDING SITE, designated SEQ ID:6608, to the nucleotide sequence of GAM8358 RNA, herein designated GAM RNA, also designated SEQ ID:255.

Another function of GAM8358 is therefore inhibition of Envoplakin (EVPL, Accession NP_001979.1), a gene which is a membrane-associated protein . Accordingly, utilities of GAM8358 include diagnosis, prevention and treatment of diseases and clinical conditions associated with EVPL.

The function of EVPL and its association with various diseases and clinical conditions, has been established by previous studies, as described hereinabove with reference to GAM869.1. FBXW5 (Accession NP_839891.1) is another GAM8358 target gene, herein designated TARGET GENE. FBXW5 BINDING SITE is a target binding site found in the 3' untranslated region of multiple transcripts of mRNA encoded by FBXW5, corresponding to a target binding site such as BINDING SITE I, BINDING SITE II or BINDING SITE III of FIG. 8. Table 4 illustrates the complementarity of the nucleotide sequences of FBXW5 BINDING SITE, designated SEQ ID:13135, to the nucleotide sequence of GAM8358 RNA, herein designated GAM RNA, also designated SEQ ID:255.

Another function of GAM8358 is therefore inhibition of FBXW5 (Accession NP_839891.1). Accordingly, utilities of GAM8358 include diagnosis, prevention and treatment of diseases and clinical conditions associated with FBXW5.

FLJ00001 (Accession XP_088525.2) is another GAM8358 target gene, herein designated TARGET GENE. FLJ00001 BINDING SITE is a target binding site found in the 3' untranslated region of mRNA encoded by FLJ00001, corresponding to a target binding site such as BINDING SITE I, BINDING SITE II or BINDING SITE III of FIG. 8. Table 4 illustrates the complementarity of the nucleotide sequences of FLJ00001 BINDING SITE, designated SEQ ID:19793, to the nucleotide sequence of GAM8358 RNA, herein designated GAM RNA, also designated SEQ ID:255.

Another function of GAM8358 is therefore inhibition of FLJ00001 (Accession XP_088525.2). Accordingly, utilities of GAM8358 include diagnosis, prevention and treatment of diseases and clinical conditions associated with FLJ00001.

FLJ10346 (Accession NP_060535.1) is another GAM8358 target gene, herein designated TARGET GENE. FLJ10346 BINDING SITE is a target binding site found in the 5' untranslated region of mRNA encoded by FLJ10346, corresponding to a target binding site such as BINDING SITE I, BINDING SITE II or BINDING SITE III of FIG. 8. Table 4 illustrates the complementarity of the nucleotide sequences of FLJ10346 BINDING SITE, designated SEQ ID:14374, to the nucleotide sequence of GAM8358 RNA, herein designated GAM RNA, also designated SEQ ID:255.

Another function of GAM8358 is therefore inhibition of FLJ10346 (Accession NP_060535.1). Accordingly, utilities of GAM8358 include diagnosis, prevention and treatment of diseases and clinical conditions associated with FLJ10346.

FLJ10539 (Accession NP_060600.1) is another GAM8358 target gene, herein designated TARGET GENE. FLJ10539 BINDING SITE is a target binding site found in the 3' untranslated region of mRNA encoded by FLJ10539, corresponding to a target binding site such as BINDING SITE I, BINDING SITE II or BINDING SITE III of FIG. 8. Table 4 illustrates the complementarity of the nucleotide sequences of FLJ10539 BINDING SITE, designated SEQ ID:11608, to the nucleotide sequence of GAM8358 RNA, herein designated GAM RNA, also designated SEQ ID:255.

Another function of GAM8358 is therefore inhibition of FLJ10539 (Accession NP_060600.1). Accordingly, utilities of GAM8358 include diagnosis, prevention and treatment of diseases and clinical conditions associated with FLJ10539.

FLJ10980 (Accession XP_035527.2) is another GAM8358 target gene, herein designated TARGET GENE. FLJ10980 BINDING SITE is a target binding site found in the 3' untranslated region of mRNA encoded by FLJ10980, corresponding to a target binding site such as BINDING SITE I, BINDING SITE II or BINDING SITE III of FIG. 8. Table 4 illustrates the complementarity of the nucleotide sequences of FLJ10980 BINDING SITE, designated SEQ ID:6098, to the nucleotide sequence of GAM8358 RNA, herein designated GAM RNA, also designated SEQ ID:255.

Another function of GAM8358 is therefore inhibition of FLJ10980 (Accession XP_035527.2). Accordingly, utilities of GAM8358 include diagnosis, prevention and treatment of diseases and clinical conditions associated with FLJ10980.

FLJ11783 (Accession NP_079167.1) is another GAM8358 target gene, herein designated TARGET GENE. FLJ11783 BINDING SITE is a target binding site found in the 5' untranslated region of mRNA encoded by FLJ11783, corresponding to a target binding site such as BINDING SITE I, BINDING SITE II or BINDING SITE III of FIG. 8. Table 4 illustrates the complementarity of the nucleotide sequences of FLJ11783 BINDING SITE, designated SEQ ID:6450, to the nucleotide sequence of GAM8358 RNA, herein designated GAM RNA, also designated SEQ ID:255.

Another function of GAM8358 is therefore inhibition of FLJ11783 (Accession NP_079167.1). Accordingly, utilities of GAM8358 include diagnosis, prevention and treatment of diseases and clinical conditions associated with FLJ11783.

FLJ12076 (Accession NP_079463.2) is another GAM8358 target gene, herein designated TARGET GENE. FLJ12076 BINDING SITE is a target binding site found in the 3' untranslated region of mRNA encoded by FLJ12076, corresponding to a target binding site such as BINDING SITE I, BINDING SITE II or BINDING SITE III of FIG. 8. Table 4 illustrates the complementarity of the nucleotide sequences of FLJ12076 BINDING SITE, designated SEQ ID:1230, to the nucleotide sequence of GAM8358 RNA, herein designated GAM RNA, also designated SEQ ID:255.

Another function of GAM8358 is therefore inhibition of FLJ12076 (Accession NP_079463.2). Accordingly, utilities of GAM8358 include diagnosis, prevention and treatment of diseases and clinical conditions associated with FLJ12076.

FLJ12547 (Accession NP_079268.1) is another GAM8358 target gene, herein designated TARGET GENE. FLJ12547 BINDING SITE is a target binding site found in the 3' untranslated region of mRNA encoded by FLJ12547, corresponding to a target binding site such as BINDING SITE I, BINDING SITE II or BINDING SITE III of FIG. 8. Table 4 illustrates the complementarity of the nucleotide sequences of FLJ12547 BINDING SITE, designated SEQ ID:19280, to the nucleotide sequence of GAM8358 RNA, herein designated GAM RNA, also designated SEQ ID:255.

Another function of GAM8358 is therefore inhibition of FLJ12547 (Accession NP_079268.1). Accordingly, utilities of GAM8358 include diagnosis, prevention and treatment of diseases and clinical conditions associated with FLJ12547.

FLJ12687 (Accession NP_079193.2) is another GAM8358 target gene, herein designated TARGET GENE. FLJ12687 BINDING SITE is a target binding site found in the 5' untranslated region of mRNA encoded by FLJ12687, corresponding to a target binding site such as BINDING SITE I, BINDING SITE II or BINDING SITE III of FIG. 8. Table 4 illustrates the complementarity of the nucleotide sequences of FLJ12687 BINDING SITE, designated SEQ ID:3627, to the nucleotide sequence of GAM8358 RNA, herein designated GAM RNA, also designated SEQ ID:255.

Another function of GAM8358 is therefore inhibition of FLJ12687 (Accession NP_079193.2). Accordingly, utilities of GAM8358 include diagnosis, prevention and treatment of diseases and clinical conditions associated with FLJ12687.

FLJ12800 (Accession NP_075054.1) is another GAM8358 target gene, herein designated TARGET GENE. FLJ12800 BINDING SITE1 through FLJ12800 BINDING SITE3 are target binding sites found in untranslated regions of mRNA encoded by FLJ12800, corresponding to target binding sites such as BINDING SITE I, BINDING SITE II or BINDING SITE III of FIG. 8. Table 4 illustrates the complementarity of the nucleotide sequences of FLJ12800 BINDING SITE1 through FLJ12800 BINDING SITE3, SEQ ID:14600, SEQ ID:10088 and SEQ ID:7968 respectively, to the nucleotide sequence of GAM8358 RNA, herein designated GAM RNA, also designated SEQ ID:255.

Another function of GAM8358 is therefore inhibition of FLJ12800 (Accession NP_075054.1). Accordingly, utilities of GAM8358 include diagnosis, prevention and treatment of diseases and clinical conditions associated with FLJ12800.

FLJ12875 (Accession NP_078820.1) is another GAM8358 target gene, herein designated TARGET GENE. FLJ12875 BINDING SITE is a target binding site found in the 3' untranslated region of mRNA encoded by FLJ12875, corresponding to a target binding site such as BINDING SITE I, BINDING SITE II or BINDING SITE III of FIG. 8. Table 4 illustrates the complementarity of the nucleotide sequences of FLJ12875 BINDING SITE, designated SEQ ID:12746, to the nucleotide sequence of GAM8358 RNA, herein designated GAM RNA, also designated SEQ ID:255.

Another function of GAM8358 is therefore inhibition of FLJ12875 (Accession NP_078820.1). Accordingly, utilities of GAM8358 include diagnosis, prevention and treatment of diseases and clinical conditions associated with FLJ12875.

FLJ12985 (Accession NP_079200.1) is another GAM8358 target gene, herein designated TARGET GENE. FLJ12985 BINDING SITE is a target binding site found in the 3' untranslated region of mRNA encoded by FLJ12985, corresponding to a target binding site such as BINDING SITE I, BINDING SITE II or BINDING SITE III of FIG. 8. Table 4 illustrates the complementarity of the nucleotide sequences of FLJ12985 BINDING SITE, designated SEQ ID:4980, to the nucleotide sequence of GAM8358 RNA, herein designated GAM RNA, also designated SEQ ID:255.

Another function of GAM8358 is therefore inhibition of FLJ12985 (Accession NP_079200.1). Accordingly, utilities of GAM8358 include diagnosis, prevention and treatment of diseases and clinical conditions associated with FLJ12985.

FLJ13072 (Accession XP_117117.2) is another GAM8358 target gene, herein designated TARGET GENE. FLJ13072 BINDING SITE is a target binding site found in the 3' untranslated region of mRNA encoded by FLJ13072, corresponding to a target binding site such as BINDING SITE I, BINDING SITE II or BINDING SITE III of FIG. 8. Table 4 illustrates the complementarity of the nucleotide sequences of FLJ13072 BINDING SITE, designated SEQ ID:14989, to the nucleotide sequence of GAM8358 RNA, herein designated GAM RNA, also designated SEQ ID:255.

Another function of GAM8358 is therefore inhibition of FLJ13072 (Accession XP_117117.2). Accordingly, utilities of GAM8358 include diagnosis, prevention and treatment of diseases and clinical conditions associated with FLJ13072.

FLJ13197 (Accession NP_078890.1) is another GAM8358 target gene, herein designated TARGET GENE. FLJ13197 BINDING SITE is a target binding site found in the 3' untranslated region of mRNA encoded by FLJ13197, corresponding to a target binding site such as BINDING SITE I, BINDING SITE II or BINDING SITE III of FIG. 8. Table 4 illustrates the complementarity of the nucleotide sequences of FLJ13197 BINDING SITE, designated SEQ ID:7714, to the nucleotide sequence of GAM8358 RNA, herein designated GAM RNA, also designated SEQ ID:255.

Another function of GAM8358 is therefore inhibition of FLJ13197 (Accession NP_078890.1). Accordingly, utilities of GAM8358 include diagnosis, prevention and treatment of diseases and clinical conditions associated with FLJ13197.

FLJ13639 (Accession NP_078981.1) is another GAM8358 target gene, herein designated TARGET GENE. FLJ13639 BINDING SITE is a target binding site found in the 3' untranslated region of mRNA encoded by FLJ13639, corresponding to a target binding site such as BINDING SITE I, BINDING SITE II or BINDING SITE III of FIG. 8. Table 4 illustrates the complementarity of the nucleotide sequences of FLJ13639 BINDING SITE, designated SEQ ID:9712, to the nucleotide sequence of GAM8358 RNA, herein designated GAM RNA, also designated SEQ ID:255.

Another function of GAM8358 is therefore inhibition of FLJ13639 (Accession NP_078981.1). Accordingly, utilities of GAM8358 include diagnosis, prevention and treatment of diseases and clinical conditions associated with FLJ13639.

FLJ13848 (Accession NP_079047.1) is another GAM8358 target gene, herein designated TARGET GENE. FLJ13848 BINDING SITE is a target binding site found in the 3' untranslated region of mRNA encoded by FLJ13848, corresponding to a target binding site such as BINDING SITE I, BINDING SITE II or BINDING SITE III of FIG. 8. Table 4 illustrates the complementarity of the nucleotide sequences of FLJ13848 BINDING SITE, designated SEQ ID:8727, to the nucleotide sequence of GAM8358 RNA, herein designated GAM RNA, also designated SEQ ID:255.

Another function of GAM8358 is therefore inhibition of FLJ13848 (Accession NP_079047.1). Accordingly, utilities of GAM8358 include diagnosis, prevention and treatment of diseases and clinical conditions associated with FLJ13848.

FLJ13852 (Accession NP_075566.1) is another GAM8358 target gene, herein designated TARGET GENE. FLJ13852 BINDING SITE is a target binding site found in the 3' untranslated region of mRNA encoded by FLJ13852, corresponding to a target binding site such as BINDING SITE I, BINDING SITE II or BINDING SITE III of FIG. 8. Table 4 illustrates the complementarity of the nucleotide sequences of FLJ13852 BINDING SITE, designated SEQ ID:1028, to the nucleotide sequence of GAM8358 RNA, herein designated GAM RNA, also designated SEQ ID:255.

Another function of GAM8358 is therefore inhibition of FLJ13852 (Accession NP_075566.1). Accordingly, utilities of GAM8358 include diagnosis, prevention and treatment of diseases and clinical conditions associated with FLJ13852.

FLJ14399 (Accession NP_116169.2) is another GAM8358 target gene, herein designated TARGET GENE. FLJ14399 BINDING SITE is a target binding site found in the 3' untranslated region of mRNA encoded by FLJ14399, corresponding to a target binding site such as BINDING SITE I, BINDING SITE II or BINDING SITE III of FIG. 8. Table 4 illustrates the complementarity of the nucleotide sequences of FLJ14399 BINDING SITE, designated SEQ ID:15886, to the nucleotide sequence of GAM8358 RNA, herein designated GAM RNA, also designated SEQ ID:255.

Another function of GAM8358 is therefore inhibition of FLJ14399 (Accession NP_116169.2). Accordingly, utilities of GAM8358 include diagnosis, prevention and treatment of diseases and clinical conditions associated with FLJ14399.

FLJ14816 (Accession NP_116234.1) is another GAM8358 target gene, herein designated TARGET GENE. FLJ14816 BINDING SITE is a target binding site found in the 3' untranslated region of mRNA encoded by FLJ14816, corresponding to a target binding site such as BINDING SITE I, BINDING SITE II or BINDING SITE III of FIG. 8. Table 4 illustrates the complementarity of the nucleotide sequences of FLJ14816 BINDING SITE, designated SEQ ID:3978, to the nucleotide sequence of GAM8358 RNA, herein designated GAM RNA, also designated SEQ ID:255.

Another function of GAM8358 is therefore inhibition of FLJ14816 (Accession NP_116234.1). Accordingly, utilities of GAM8358 include diagnosis, prevention and treatment of diseases and clinical conditions associated with FLJ14816.

FLJ20232 (Accession NP_061881.2) is another GAM8358 target gene, herein designated TARGET GENE. FLJ20232 BINDING SITE is a target binding site found in the 3' untranslated region of mRNA encoded by FLJ20232, corresponding to a target binding site such as BINDING SITE I, BINDING SITE II or BINDING SITE III of FIG. 8. Table 4 illustrates the complementarity of the nucleotide sequences of FLJ20232 BINDING SITE, designated SEQ ID:17239, to the nucleotide sequence of GAM8358 RNA, herein designated GAM RNA, also designated SEQ ID:255.

Another function of GAM8358 is therefore inhibition of FLJ20232 (Accession NP_061881.2). Accordingly, utilities of GAM8358 include diagnosis, prevention and treatment of diseases and clinical conditions associated with FLJ20232.

FLJ20300 (Accession NP_060223.1) is another GAM8358 target gene, herein designated TARGET GENE. FLJ20300 BINDING SITE is a target binding site found in the 3' untranslated region of mRNA encoded by FLJ20300, corresponding to a target binding site such as BINDING SITE I, BINDING SITE II or BINDING SITE III of FIG. 8. Table 4 illustrates the complementarity of the nucleotide sequences of FLJ20300 BINDING SITE, designated SEQ ID:10271, to the nucleotide sequence of GAM8358 RNA, herein designated GAM RNA, also designated SEQ ID:255.

Another function of GAM8358 is therefore inhibition of FLJ20300 (Accession NP_060223.1). Accordingly, utilities of GAM8358 include diagnosis, prevention and treatment of diseases and clinical conditions associated with FLJ20300.

FLJ20303 (Accession NP_060225.2) is another GAM8358 target gene, herein designated TARGET GENE. FLJ20303 BINDING SITE is a target binding site found in the 5' untranslated region of mRNA encoded by FLJ20303, corresponding to a target binding site such as BINDING SITE I, BINDING SITE II or BINDING SITE III of FIG. 8. Table 4 illustrates the complementarity of the nucleotide sequences of FLJ20303 BINDING SITE, designated SEQ ID:952, to the nucleotide sequence of GAM8358 RNA, herein designated GAM RNA, also designated SEQ ID:255.

Another function of GAM8358 is therefore inhibition of FLJ20303 (Accession NP_060225.2). Accordingly, utilities of GAM8358 include diagnosis, prevention and treatment of diseases and clinical conditions associated with FLJ20303.

FLJ20508 (Accession NP_060320.1) is another GAM8358 target gene, herein designated TARGET GENE.

FLJ20508 BINDING SITE is a target binding site found in the 3' untranslated region of mRNA encoded by FLJ20508, corresponding to a target binding site such as BINDING SITE I, BINDING SITE II or BINDING SITE III of FIG. 8. Table 4 illustrates the complementarity of the nucleotide sequences of FLJ20508 BINDING SITE, designated SEQ ID:2977, to the nucleotide sequence of GAM8358 RNA, herein designated GAM RNA, also designated SEQ ID:255.

Another function of GAM8358 is therefore inhibition of FLJ20508 (Accession NP_060320.1). Accordingly, utilities of GAM8358 include diagnosis, prevention and treatment of diseases and clinical conditions associated with FLJ20508.

FLJ20511 (Accession NP_060323.1) is another GAM8358 target gene, herein designated TARGET GENE. FLJ20511 BINDING SITE is a target binding site found in the 3' untranslated region of mRNA encoded by FLJ20511, corresponding to a target binding site such as BINDING SITE I, BINDING SITE II or BINDING SITE III of FIG. 8. Table 4 illustrates the complementarity of the nucleotide sequences of FLJ20511 BINDING SITE, designated SEQ ID:11948, to the nucleotide sequence of GAM8358 RNA, herein designated GAM RNA, also designated SEQ ID:255.

Another function of GAM8358 is therefore inhibition of FLJ20511 (Accession NP_060323.1). Accordingly, utilities of GAM8358 include diagnosis, prevention and treatment of diseases and clinical conditions associated with FLJ20511.

FLJ20802 (Accession NP_060429.1) is another GAM8358 target gene, herein designated TARGET GENE. FLJ20802 BINDING SITE is a target binding site found in the 5' untranslated region of mRNA encoded by FLJ20802, corresponding to a target binding site such as BINDING SITE I, BINDING SITE II or BINDING SITE III of FIG. 8. Table 4 illustrates the complementarity of the nucleotide sequences of FLJ20802 BINDING SITE, designated SEQ ID:19763, to the nucleotide sequence of GAM8358 RNA, herein designated GAM RNA, also designated SEQ ID:255.

Another function of GAM8358 is therefore inhibition of FLJ20802 (Accession NP_060429.1). Accordingly, utilities of GAM8358 include diagnosis, prevention and treatment of diseases and clinical conditions associated with FLJ20802.

FLJ21438 (Accession XP_029084.5) is another GAM8358 target gene, herein designated TARGET GENE. FLJ21438 BINDING SITE is a target binding site found in the 3' untranslated region of mRNA encoded by FLJ21438, corresponding to a target binding site such as BINDING SITE I, BINDING SITE II or BINDING SITE III of FIG. 8. Table 4 illustrates the complementarity of the nucleotide sequences of FLJ21438 BINDING SITE, designated SEQ ID:7158, to the nucleotide sequence of GAM8358 RNA, herein designated GAM RNA, also designated SEQ ID:255.

Another function of GAM8358 is therefore inhibition of FLJ21438 (Accession XP_029084.5). Accordingly, utilities of GAM8358 include diagnosis, prevention and treatment of diseases and clinical conditions associated with FLJ21438.

FLJ23231 (Accession NP_079355.1) is another GAM8358 target gene, herein designated TARGET GENE. FLJ23231 BINDING SITE is a target binding site found in the 3' untranslated region of mRNA encoded by FLJ23231, corresponding to a target binding site such as BINDING SITE I, BINDING SITE II or BINDING SITE III of FIG. 8. Table 4 illustrates the complementarity of the nucleotide sequences of FLJ23231 BINDING SITE, designated SEQ ID:3342, to the nucleotide sequence of GAM8358 RNA, herein designated GAM RNA, also designated SEQ ID:255.

Another function of GAM8358 is therefore inhibition of FLJ23231 (Accession NP_079355.1). Accordingly, utilities of GAM8358 include diagnosis, prevention and treatment of diseases and clinical conditions associated with FLJ23231.

FLJ23322 (Accession NP_079231.3) is another GAM8358 target gene, herein designated TARGET GENE. FLJ23322 BINDING SITE is a target binding site found in the 3' untranslated region of mRNA encoded by FLJ23322, corresponding to a target binding site such as BINDING SITE I, BINDING SITE II or BINDING SITE III of FIG. 8. Table 4 illustrates the complementarity of the nucleotide sequences of FLJ23322 BINDING SITE, designated SEQ ID:14095, to the nucleotide sequence of GAM8358 RNA, herein designated GAM RNA, also designated SEQ ID:255.

Another function of GAM8358 is therefore inhibition of FLJ23322 (Accession NP_079231.3). Accordingly, utilities of GAM8358 include diagnosis, prevention and treatment of diseases and clinical conditions associated with FLJ23322.

FLJ25371 (Accession NP_689756.1) is another GAM8358 target gene, herein designated TARGET GENE. FLJ25371 BINDING SITE is a target binding site found in the 3' untranslated region of mRNA encoded by FLJ25371, corresponding to a target binding site such as BINDING SITE I, BINDING SITE II or BINDING SITE III of FIG. 8. Table 4 illustrates the complementarity of the nucleotide sequences of FLJ25371 BINDING SITE, designated SEQ ID:18933, to the nucleotide sequence of GAM8358 RNA, herein designated GAM RNA, also designated SEQ ID:255.

Another function of GAM8358 is therefore inhibition of FLJ25371 (Accession NP_689756.1). Accordingly, utilities of GAM8358 include diagnosis, prevention and treatment of diseases and clinical conditions associated with FLJ25371.

FLJ30313 (Accession NP_689970.1) is another GAM8358 target gene, herein designated TARGET GENE. FLJ30313 BINDING SITE is a target binding site found in the 3' untranslated region of mRNA encoded by FLJ30313, corresponding to a target binding site such as BINDING SITE I, BINDING SITE II or BINDING SITE III of FIG. 8. Table 4 illustrates the complementarity of the nucleotide sequences of FLJ30313 BINDING SITE, designated SEQ ID:5561, to the nucleotide sequence of GAM8358 RNA, herein designated GAM RNA, also designated SEQ ID:255.

Another function of GAM8358 is therefore inhibition of FLJ30313 (Accession NP_689970.1). Accordingly, utilities of GAM8358 include diagnosis, prevention and treatment of diseases and clinical conditions associated with FLJ30313.

FLJ30634 (Accession NP_694559.1) is another GAM8358 target gene, herein designated TARGET GENE. FLJ30634 BINDING SITE is a target binding site found in the 3' untranslated region of mRNA encoded by FLJ30634, corresponding to a target binding site such as BINDING SITE I, BINDING SITE II or BINDING SITE III of FIG. 8. Table 4 illustrates the complementarity of the nucleotide sequences of FLJ30634 BINDING SITE, designated SEQ ID:3937, to the nucleotide sequence of GAM8358 RNA, herein designated GAM RNA, also designated SEQ ID:255.

Another function of GAM8358 is therefore inhibition of FLJ30634 (Accession NP_694559.1). Accordingly, utilities of GAM8358 include diagnosis, prevention and treatment of diseases and clinical conditions associated with FLJ30634.

FLJ31715 (Accession NP_689745.1) is another GAM8358 target gene, herein designated TARGET GENE. FLJ31715 BINDING SITE is a target binding site found in the 3' untranslated region of mRNA encoded by FLJ31715, corresponding to a target binding site such as BINDING SITE I, BINDING SITE II or BINDING SITE III of FIG. 8. Table 4 illustrates the complementarity of the nucleotide sequences of FLJ31715 BINDING SITE, designated SEQ ID:15771, to the nucleotide sequence of GAM8358 RNA, herein designated GAM RNA, also designated SEQ ID:255.

Another function of GAM8358 is therefore inhibition of FLJ31715 (Accession NP_689745.1). Accordingly, utilities of GAM8358 include diagnosis, prevention and treatment of diseases and clinical conditions associated with FLJ31715.

FLJ31958 (Accession NP_694575.1) is another GAM8358 target gene, herein designated TARGET GENE. FLJ31958 BINDING SITE is a target binding site found in the 3' untranslated region of mRNA encoded by FLJ31958, corresponding to a target binding site such as BINDING SITE I, BINDING SITE II or BINDING SITE III of FIG. 8. Table 4 illustrates the complementarity of the nucleotide sequences of FLJ31958 BINDING SITE, designated SEQ ID:17080, to the nucleotide sequence of GAM8358 RNA, herein designated GAM RNA, also designated SEQ ID:255.

Another function of GAM8358 is therefore inhibition of FLJ31958 (Accession NP_694575.1). Accordingly, utilities of GAM8358 include diagnosis, prevention and treatment of diseases and clinical conditions associated with FLJ31958.

FLJ32334 (Accession NP_653166.1) is another GAM8358 target gene, herein designated TARGET GENE. FLJ32334 BINDING SITE is a target binding site found in the 3' untranslated region of mRNA encoded by FLJ32334, corresponding to a target binding site such as BINDING SITE I, BINDING SITE II or BINDING SITE III of FIG. 8. Table 4 illustrates the complementarity of the nucleotide sequences of FLJ32334 BINDING SITE, designated SEQ ID:18443, to the nucleotide sequence of GAM8358 RNA, herein designated GAM RNA, also designated SEQ ID:255.

Another function of GAM8358 is therefore inhibition of FLJ32334 (Accession NP_653166.1). Accordingly, utilities of GAM8358 include diagnosis, prevention and treatment of diseases and clinical conditions associated with FLJ32334.

FLJ32796 (Accession NP_705834.1) is another GAM8358 target gene, herein designated TARGET GENE. FLJ32796 BINDING SITE is a target binding site found in the 5' untranslated region of mRNA encoded by FLJ32796, corresponding to a target binding site such as BINDING SITE I, BINDING SITE II or BINDING SITE III of FIG. 8. Table 4 illustrates the complementarity of the nucleotide sequences of FLJ32796 BINDING SITE, designated SEQ ID:6527, to the nucleotide sequence of GAM8358 RNA, herein designated GAM RNA, also designated SEQ ID:255.

Another function of GAM8358 is therefore inhibition of FLJ32796 (Accession NP_705834.1). Accordingly, utilities of GAM8358 include diagnosis, prevention and treatment of diseases and clinical conditions associated with FLJ32796.

FLJ36666 (Accession NP_689695.1) is another GAM8358 target gene, herein designated TARGET GENE. FLJ36666 BINDING SITE is a target binding site found in the 3' untranslated region of mRNA encoded by FLJ36666, corresponding to a target binding site such as BINDING SITE I, BINDING SITE II or BINDING SITE III of FIG. 8. Table 4 illustrates the complementarity of the nucleotide sequences of FLJ36666 BINDING SITE, designated SEQ ID:19178, to the nucleotide sequence of GAM8358 RNA, herein designated GAM RNA, also designated SEQ ID:255.

Another function of GAM8358 is therefore inhibition of FLJ36666 (Accession NP_689695.1). Accordingly, utilities of GAM8358 include diagnosis, prevention and treatment of diseases and clinical conditions associated with FLJ36666.

Fibromodulin (FMOD, Accession NP_002014.1) is another GAM8358 target gene, herein designated TARGET GENE. FMOD BINDING SITE is a target binding site found in the 3' untranslated region of mRNA encoded by FMOD, corresponding to a target binding site such as BINDING SITE I, BINDING SITE II or BINDING SITE III of FIG. 8. Table 4 illustrates the complementarity of the nucleotide sequences of FMOD BINDING SITE, designated SEQ ID:1281, to the nucleotide sequence of GAM8358 RNA, herein designated GAM RNA, also designated SEQ ID:255.

Another function of GAM8358 is therefore inhibition of Fibromodulin (FMOD, Accession NP_002014.1), a gene which affects the rate of fibrils formation. Accordingly, utilities of GAM8358 include diagnosis, prevention and treatment of diseases and clinical conditions associated with FMOD.

The function of FMOD and its association with various diseases and clinical conditions, has been established by previous studies, as described hereinabove with reference to GAM369.1. Forkhead box o1a (rhabdomyosarcoma) (FOXO1A, Accession NP_002006.2) is another GAM8358 target gene, herein designated TARGET GENE. FOXO1A BINDING SITE is a target binding site found in the 5' untranslated region of mRNA encoded by FOXO1A, corresponding to a target binding site such as BINDING SITE I, BINDING SITE II or BINDING SITE III of FIG. 8. Table 4 illustrates the complementarity of the nucleotide sequences of FOXO1A BINDING SITE, designated SEQ ID:4341, to the nucleotide sequence of GAM8358 RNA, herein designated GAM RNA, also designated SEQ ID:255.

Another function of GAM8358 is therefore inhibition of Forkhead box o1a (rhabdomyosarcoma) (FOXO1A, Accession NP_002006.2), a gene which is a probable transcription factor. and therefore may be associated with Alveolar rhabdomyosarcoma-2. Accordingly, utilities of GAM8358 include diagnosis, prevention and treatment of Alveolar rhabdomyosarcoma-2., and of other diseases and clinical conditions associated with FOXO1A.

The function of FOXO1A and its association with various diseases and clinical conditions, has been established by previous studies, as described hereinabove with reference to GAM189.1. Fucosyltransferase 6 (alpha (1,3) fucosyltransferase) (FUT6, Accession NP_000141.1) is another GAM8358 target gene, herein designated TARGET GENE. FUT6 BINDING SITE is a target binding site found in the 3' untranslated region of mRNA encoded by FUT6, corresponding to a target binding site such as BINDING SITE I, BINDING SITE II or BINDING SITE III of FIG. 8. Table 4 illustrates the complementarity of the nucleotide sequences of FUT6 BINDING SITE, designated SEQ ID:5232, to the nucleotide sequence of GAM8358 RNA, herein designated GAM RNA, also designated SEQ ID:255.

Another function of GAM8358 is therefore inhibition of Fucosyltransferase 6 (alpha (1,3) fucosyltransferase) (FUT6, Accession NP_000141.1), a gene which is involved in the biosynthesis of the e-selectin ligand, sialyl-lewis x. catalyzes the transfer of fucose from gdp-beta-fucose to alpha-2,3 sialylated substrates. Accordingly, utilities of GAM8358 include diagnosis, prevention and treatment of diseases and clinical conditions associated with FUT6.

The function of FUT6 and its association with various diseases and clinical conditions, has been established by previous studies, as described hereinabove with reference to GAM47.1. Gamma-aminobutyric acid (gaba) b receptor, 1 (GABBR1, Accession NP_068703.1) is another GAM8358 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:7815, to the nucleotide sequence of GAM8358 RNA, herein designated GAM RNA, also designated SEQ ID:255.

Another function of GAM8358 is therefore inhibition of Gamma-aminobutyric acid (gaba) b receptor, 1 (GABBR1, Accession NP_068703.1). Accordingly, utilities of GAM8358 include diagnosis, prevention and treatment of diseases and clinical conditions associated with GABBR1.

Gamma-aminobutyric acid (gaba) b receptor, 1 (GABBR1, Accession NP_001461.1) is another GAM8358 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:7815, to the nucleotide sequence of GAM8358 RNA, herein designated GAM RNA, also designated SEQ ID:255.

Another function of GAM8358 is therefore inhibition of Gamma-aminobutyric acid (gaba) b receptor, 1 (GABBR1, Accession NP_001461.1). Accordingly, utilities of GAM8358 include diagnosis, prevention and treatment of diseases and clinical conditions associated with GABBR1.

Gamma-aminobutyric acid (gaba) b receptor, 1 (GABBR1, Accession NP_068704.1) is another GAM8358 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:7815, to the nucleotide sequence of GAM8358 RNA, herein designated GAM RNA, also designated SEQ ID:255.

Another function of GAM8358 is therefore inhibition of Gamma-aminobutyric acid (gaba) b receptor, 1 (GABBR1, Accession NP_068704.1). Accordingly, utilities of GAM8358 include diagnosis, prevention and treatment of diseases and clinical conditions associated with GABBR1.

Gamma-aminobutyric acid (gaba) b receptor, 1 (GABBR1, Accession NP_068705.1) is another GAM8358 target gene, herein designated TARGET GENE. GABBR1 BINDING SITE is a target binding site found in the 3' untranslated region of multiple transcripts of mRNA encoded by GABBR1, corresponding to a target binding site such as BINDING SITE I, BINDING SITE II or BINDING SITE III of FIG. 8. Table 4 illustrates the complementarity of the nucleotide sequences of GABBR1 BINDING SITE, designated SEQ ID:7815, to the nucleotide sequence of GAM8358 RNA, herein designated GAM RNA, also designated SEQ ID:255.

Another function of GAM8358 is therefore inhibition of Gamma-aminobutyric acid (gaba) b receptor, 1 (GABBR1, Accession NP_068705.1). Accordingly, utilities of GAM8358 include diagnosis, prevention and treatment of diseases and clinical conditions associated with GABBR1.

GAC1 (Accession NP_006329.1) is another GAM8358 target gene, herein designated TARGET GENE. GAC1 BINDING SITE is a target binding site found in the 3' untranslated region of mRNA encoded by GAC1, corresponding to a target binding site such as BINDING SITE I, BINDING SITE II or BINDING SITE III of FIG. 8. Table 4 illustrates the complementarity of the nucleotide sequences of GAC1 BINDING SITE, designated SEQ ID:18086, to the nucleotide sequence of GAM8358 RNA, herein designated GAM RNA, also designated SEQ ID:255.

Another function of GAM8358 is therefore inhibition of GAC1 (Accession NP_006329.1). Accordingly, utilities of GAM8358 include diagnosis, prevention and treatment of diseases and clinical conditions associated with GAC1.

GAL3ST2 (Accession NP_149025.1) is another GAM8358 target gene, herein designated TARGET GENE. GAL3ST2 BINDING SITE is a target binding site found in the 3' untranslated region of mRNA encoded by GAL3ST2, corresponding to a target binding site such as BINDING SITE I, BINDING SITE II or BINDING SITE III of FIG. 8. Table 4 illustrates the complementarity of the nucleotide sequences of GAL3ST2 BINDING SITE, designated SEQ ID:19391, to the nucleotide sequence of GAM8358 RNA, herein designated GAM RNA, also designated SEQ ID:255.

Another function of GAM8358 is therefore inhibition of GAL3ST2 (Accession NP_149025.1). Accordingly, utilities of GAM8358 include diagnosis, prevention and treatment of diseases and clinical conditions associated with GAL3ST2.

GALNAC4S-6ST (Accession NP_055678.1) is another GAM8358 target gene, herein designated TARGET GENE. GALNAC4S-6ST BINDING SITE is a target binding site found in the 3' untranslated region of multiple transcripts of mRNA encoded by GALNAC4S-6ST, corresponding to a target binding site such as BINDING SITE I, BINDING SITE II or BINDING SITE III of FIG. 8. Table 4 illustrates the complementarity of the nucleotide sequences of GALNAC4S-6ST BINDING SITE, designated SEQ ID:14898, to the nucleotide sequence of GAM8358 RNA, herein designated GAM RNA, also designated SEQ ID:255.

Another function of GAM8358 is therefore inhibition of GALNAC4S-6ST (Accession NP_055678.1). Accordingly, utilities of GAM8358 include diagnosis, prevention and treatment of diseases and clinical conditions associated with GALNAC4S-6ST.

GALNAC4S-6ST (Accession NP_056976.1) is another GAM8358 target gene, herein designated TARGET GENE. GALNAC4S-6ST BINDING SITE is a target binding site found in the 3' untranslated region of multiple transcripts of mRNA encoded by GALNAC4S-6ST, corresponding to a target binding site such as BINDING SITE I, BINDING SITE II or BINDING SITE III of FIG. 8. Table 4 illustrates the complementarity of the nucleotide sequences of GALNAC4S-6ST BINDING SITE, designated SEQ ID:14898, to the nucleotide sequence of GAM8358 RNA, herein designated GAM RNA, also designated SEQ ID:255.

Another function of GAM8358 is therefore inhibition of GALNAC4S-6ST (Accession NP_056976.1). Accordingly, utilities of GAM8358 include diagnosis, prevention and treatment of diseases and clinical conditions associated with GALNAC4S-6ST.

Udp-n-acetyl-alpha-d-galactosamine:polypeptide n-acetylgalactosaminyltransferase 3 (galnac-t3) (GALNT3, Accession NP_004473.1) is another GAM8358 target gene, herein designated TARGET GENE. GALNT3 BINDING SITE is a target binding site found in the 3' untranslated region of mRNA encoded by GALNT3, corresponding to a target binding site such as BINDING SITE I, BINDING SITE II or BINDING SITE III of FIG. 8. Table 4 illustrates the complementarity of the nucleotide sequences of GALNT3 BINDING SITE, designated SEQ ID:1308, to the nucleotide sequence of GAM8358 RNA, herein designated GAM RNA, also designated SEQ ID:255.

Another function of GAM8358 is therefore inhibition of Udp-n-acetyl-alpha-d-galactosamine:polypeptide n-acetyl-galactosaminyltransferase 3 (galnac-t3) (GALNT3, Accession NP_004473.1), a gene which initiates O-glycosylation of serine and threonine residues. Accordingly, utilities of GAM8358 include diagnosis, prevention and treatment of diseases and clinical conditions associated with GALNT3.

The function of GALNT3 and its association with various diseases and clinical conditions, has been established by previous studies, as described hereinabove with reference to GAM72.1. Glycoprotein a repetitions predominant (GARP, Accession NP_005503.1) is another GAM8358 target gene, herein designated TARGET GENE. GARP BINDING SITE is a target binding site found in the 3' untranslated region of mRNA encoded by GARP, corresponding to a target binding site such as BINDING SITE I, BINDING SITE II or BINDING SITE III of FIG. 8. Table 4 illustrates the complementarity of the nucleotide sequences of GARP BINDING SITE, designated SEQ ID:18213, to the nucleotide sequence of GAM8358 RNA, herein designated GAM RNA, also designated SEQ ID:255.

Another function of GAM8358 is therefore inhibition of Glycoprotein a repetitions predominant (GARP, Accession NP_005503.1). Accordingly, utilities of GAM8358 include diagnosis, prevention and treatment of diseases and clinical conditions associated with GARP.

Gata binding protein 4 (GATA4, Accession NP_002043.1) is another GAM8358 target gene, herein designated TARGET GENE. GATA4 BINDING SITE is a target binding site found in the 3' untranslated region of mRNA encoded by GATA4, corresponding to a target binding site such as BINDING SITE I, BINDING SITE II or BINDING SITE III of FIG. 8. Table 4 illustrates the complementarity of the nucleotide sequences of GATA4 BINDING SITE, designated SEQ ID:17802, to the nucleotide sequence of GAM8358 RNA, herein designated GAM RNA, also designated SEQ ID:255.

Another function of GAM8358 is therefore inhibition of Gata binding protein 4 (GATA4, Accession NP_002043.1), a gene which regulates genes critical for myocardial differentiation and function. and therefore may be associated with Cardiac hypertrophy and sex cord-derived ovarian tumors. Accordingly, utilities of GAM8358 include diagnosis, prevention and treatment of Cardiac hypertrophy and sex cord-derived ovarian tumors, and of other diseases and clinical conditions associated with GATA4.

The function of GATA4 and its association with various diseases and clinical conditions, has been established by previous studies, as described hereinabove with reference to GAM63.1. Gtp cyclohydrolase i feedback regulatory protein (GCHFR, Accession NP_005249.1) is another GAM8358 target gene, herein designated TARGET GENE. GCHFR BINDING SITE is a target binding site found in the 3' untranslated region of mRNA encoded by GCHFR, corresponding to a target binding site such as BINDING SITE I, BINDING SITE II or BINDING SITE III of FIG. 8. Table 4 illustrates the complementarity of the nucleotide sequences of GCHFR BINDING SITE, designated SEQ ID:18283, to the nucleotide sequence of GAM8358 RNA, herein designated GAM RNA, also designated SEQ ID:255.

Another function of GAM8358 is therefore inhibition of Gtp cyclohydrolase i feedback regulatory protein (GCHFR, Accession NP_005249.1). Accordingly, utilities of GAM8358 include diagnosis, prevention and treatment of diseases and clinical conditions associated with GCHFR.

Gamma-glutamyltransferase 1 (GGT1, Accession NP_005256.1) is another GAM8358 target gene, herein designated TARGET GENE. GGT1 BINDING SITE is a target binding site found in the 5' untranslated region of multiple transcripts of mRNA encoded by GGT1, corresponding to a target binding site such as BINDING SITE I, BINDING SITE II or BINDING SITE III of FIG. 8. Table 4 illustrates the complementarity of the nucleotide sequences of GGT1 BINDING SITE, designated SEQ ID:5411, to the nucleotide sequence of GAM8358 RNA, herein designated GAM RNA, also designated SEQ ID:255.

Another function of GAM8358 is therefore inhibition of Gamma-glutamyltransferase 1 (GGT1, Accession NP_005256.1), a gene which catalyzes the transfer of the glutamyl moiety of glutathione to a variety of amino acids and dipeptide acceptors and therefore is associated with Glutathionuria. Accordingly, utilities of GAM8358 include diagnosis, prevention and treatment of Glutathionuria, and of other diseases and clinical conditions associated with GGT1.

The function of GGT1 and its association with various diseases and clinical conditions, has been established by previous studies, as described hereinabove with reference to GAM234.1. Gamma-glutamyltransferase 1 (GGT1, Accession NP_038265.1) is another GAM8358 target gene, herein designated TARGET GENE. GGT1 BINDING SITE is a target binding site found in the 5' untranslated region of multiple transcripts of mRNA encoded by GGT1, corresponding to a target binding site such as BINDING SITE I, BINDING SITE II or BINDING SITE III of FIG. 8. Table 4 illustrates the complementarity of the nucleotide sequences of GGT1 BINDING SITE, designated SEQ ID:5411, to the nucleotide sequence of GAM8358 RNA, herein designated GAM RNA, also designated SEQ ID:255.

Another function of GAM8358 is therefore inhibition of Gamma-glutamyltransferase 1 (GGT1, Accession NP_038265.1), a gene which catalyzes the transfer of the glutamyl moiety of glutathione to a variety of amino acids and dipeptide acceptors and therefore is associated with Glutathionuria. Accordingly, utilities of GAM8358 include diagnosis, prevention and treatment of Glutathionuria, and of other diseases and clinical conditions associated with GGT1.

The function of GGT1 and its association with various diseases and clinical conditions, has been established by previous studies, as described hereinabove with reference to GAM234.1. Gamma-glutamyltransferase 1 (GGT1, Accession NP_038347.1) is another GAM8358 target gene, herein designated TARGET GENE. GGT1 BINDING SITE is a target binding site found in the 5' untranslated region of multiple transcripts of mRNA encoded by GGT1, corresponding to a target binding site such as BINDING SITE I, BINDING SITE II or BINDING SITE III of FIG. 8. Table 4 illustrates the complementarity of the nucleotide sequences of GGT1 BINDING SITE, designated SEQ ID:5411, to the nucleotide sequence of GAM8358 RNA, herein designated GAM RNA, also designated SEQ ID:255.

Another function of GAM8358 is therefore inhibition of Gamma-glutamyltransferase 1 (GGT1, Accession NP_038347.1), a gene which catalyzes the transfer of the glutamyl moiety of glutathione to a variety of amino acids and dipeptide acceptors and therefore is associated with Glutathionuria. Accordingly, utilities of GAM8358 include diagnosis, prevention and treatment of Glutathionuria, and of other diseases and clinical conditions associated with GGT1.

The function of GGT1 and its association with various diseases and clinical conditions, has been established by previous studies, as described hereinabove with reference to GAM234.1. Gamma-glutamyltransferase 2 (GGT2, Accession XP_290331.1) is another GAM8358 target gene, herein designated TARGET GENE. GGT2 BINDING SITE is a target binding site found in the 5' untranslated region of mRNA encoded by GGT2, corresponding to a target binding site such as BINDING SITE I, BINDING SITE II or BIND- ING SITE III of FIG. 8. Table 4 illustrates the complementarity of the nucleotide sequences of GGT2 BINDING SITE, designated SEQ ID:5411, to the nucleotide sequence of GAM8358 RNA, herein designated GAM RNA, also designated SEQ ID:255.

Another function of GAM8358 is therefore inhibition of Gamma-glutamyltransferase 2 (GGT2, Accession XP_290331.1). Accordingly, utilities of GAM8358 include diagnosis, prevention and treatment of diseases and clinical conditions associated with GGT2.

G protein-coupled receptor kinase-interactor 1 (GIT1, Accession NP_054749.1) is another GAM8358 target gene, herein designated TARGET GENE. GIT1 BINDING SITE is a target binding site found in the 3' untranslated region of mRNA encoded by GIT1, corresponding to a target binding site such as BINDING SITE I, BINDING SITE II or BINDING SITE III of FIG. 8. Table 4 illustrates the complementarity of the nucleotide sequences of GIT1 BINDING SITE, designated SEQ ID:599, to the nucleotide sequence of GAM8358 RNA, herein designated GAM RNA, also designated SEQ ID:255.

Another function of GAM8358 is therefore inhibition of G protein-coupled receptor kinase-interactor 1 (GIT1, Accession NP_054749.1). Accordingly, utilities of GAM8358 include diagnosis, prevention and treatment of diseases and clinical conditions associated with GIT1.

G protein pathway suppressor 2 (GPS2, Accession NP_004480.1) is another GAM8358 target gene, herein designated TARGET GENE. GPS2 BINDING SITE is a target binding site found in the 5' untranslated region of multiple transcripts of mRNA encoded by GPS2, corresponding to a target binding site such as BINDING SITE I, BINDING SITE II or BINDING SITE III of FIG. 8. Table 4 illustrates the complementarity of the nucleotide sequences of GPS2 BINDING SITE, designated SEQ ID:16530, to the nucleotide sequence of GAM8358 RNA, herein designated GAM RNA, also designated SEQ ID:255.

Another function of GAM8358 is therefore inhibition of G protein pathway suppressor 2 (GPS2, Accession NP_004480.1). Accordingly, utilities of GAM8358 include diagnosis, prevention and treatment of diseases and clinical conditions associated with GPS2.

Glutamate receptor, metabotropic 4 (GRM4, Accession NP_000832.1) is another GAM8358 target gene, herein designated TARGET GENE. GRM4 BINDING SITE is a target binding site found in the 3' untranslated region of mRNA encoded by GRM4, corresponding to a target binding site such as BINDING SITE I, BINDING SITE II or BINDING SITE III of FIG. 8. Table 4 illustrates the complementarity of the nucleotide sequences of GRM4 BINDING SITE, designated SEQ ID:1955, to the nucleotide sequence of GAM8358 RNA, herein designated GAM RNA, also designated SEQ ID:255.

Another function of GAM8358 is therefore inhibition of Glutamate receptor, metabotropic 4 (GRM4, Accession NP_000832.1), a gene which is mediated by a g-protein that inhibits adenylate cyclase activity. Accordingly, utilities of GAM8358 include diagnosis, prevention and treatment of diseases and clinical conditions associated with GRM4.

The function of GRM4 and its association with various diseases and clinical conditions, has been established by previous studies, as described hereinabove with reference to GAM223.1. General transcription factor iie, polypeptide 1, alpha 56 kda (GTF2E1, Accession NP_005504.1) is another GAM8358 target gene, herein designated TARGET GENE. GTF2E1 BINDING SITE is a target binding site found in the 3' untranslated region of mRNA encoded by GTF2E1, corresponding to a target binding site such as BINDING SITE I, BINDING SITE II or BINDING SITE III of FIG. 8. Table 4 illustrates the complementarity of the nucleotide sequences of GTF2E1 BINDING SITE, designated SEQ ID:17008, to the nucleotide sequence of GAM8358 RNA, herein designated GAM RNA, also designated SEQ ID:255.

Another function of GAM8358 is therefore inhibition of General transcription factor iie, polypeptide 1, alpha 56 kda (GTF2E1, Accession NP_005504.1). Accordingly, utilities of GAM8358 include diagnosis, prevention and treatment of diseases and clinical conditions associated with GTF2E1.

Glycophorin b (includes ss blood group) (GYPB, Accession NP_002091.1) is another GAM8358 target gene, herein designated TARGET GENE. GYPB BINDING SITE is a target binding site found in the 3' untranslated region of mRNA encoded by GYPB, corresponding to a target binding site such as BINDING SITE I, BINDING SITE II or BINDING SITE III of FIG. 8. Table 4 illustrates the complementarity of the nucleotide sequences of GYPB BINDING SITE, designated SEQ ID:731, to the nucleotide sequence of GAM8358 RNA, herein designated GAM RNA, also designated SEQ ID:255.

Another function of GAM8358 is therefore inhibition of Glycophorin b (includes ss blood group) (GYPB, Accession NP_002091.1), a gene which is a minor sialoglycoprotein in human erythrocyte membranes and determines the Ss blood group antigens. Accordingly, utilities of GAM8358 include diagnosis, prevention and treatment of diseases and clinical conditions associated with GYPB.

The function of GYPB and its association with various diseases and clinical conditions, has been established by previous studies, as described hereinabove with reference to GAM1095.1. Glycophorin e (GYPE, Accession NP_002093.1) is another GAM8358 target gene, herein designated TARGET GENE. GYPE BINDING SITE is a target binding site found in the 3' untranslated region of mRNA encoded by GYPE, corresponding to a target binding site such as BINDING SITE I, BINDING SITE II or BINDING SITE III of FIG. 8. Table 4 illustrates the complementarity of the nucleotide sequences of GYPE BINDING SITE, designated SEQ ID:14090, to the nucleotide sequence of GAM8358 RNA, herein designated GAM RNA, also designated SEQ ID:255.

Another function of GAM8358 is therefore inhibition of Glycophorin e (GYPE, Accession NP_002093.1), a gene which is a minor sialoglycoprotein in human erythrocyte membranes. Accordingly, utilities of GAM8358 include diagnosis, prevention and treatment of diseases and clinical conditions associated with GYPE.

The function of GYPE and its association with various diseases and clinical conditions, has been established by previous studies, as described hereinabove with reference to GAM1361.1. Huntingtin (huntington disease) (HD, Accession NP_002102.2) is another GAM8358 target gene, herein designated TARGET GENE. HD BINDING SITE is a target binding site found in the 3' untranslated region of mRNA encoded by HD, corresponding to a target binding site such as BINDING SITE I, BINDING SITE II or BINDING SITE III of FIG. 8. Table 4 illustrates the complementarity of the nucleotide sequences of HD BINDING SITE, designated SEQ ID:11900, to the nucleotide sequence of GAM8358 RNA, herein designated GAM RNA, also designated SEQ ID:255.

Another function of GAM8358 is therefore inhibition of Huntingtin (huntington disease) (HD, Accession NP_002102.2). Accordingly, utilities of GAM8358 include diagnosis, prevention and treatment of diseases and clinical conditions associated with HD.

HECA (Accession NP_057301.1) is another GAM8358 target gene, herein designated TARGET GENE. HECA BINDING SITE is a target binding site found in the 3' untranslated region of mRNA encoded by HECA, corresponding to a target binding site such as BINDING SITE I, BINDING SITE II or BINDING SITE III of FIG. 8. Table 4 illustrates the complementarity of the nucleotide sequences of HECA BINDING SITE, designated SEQ ID:2910, to the nucleotide sequence of GAM8358 RNA, herein designated GAM RNA, also designated SEQ ID:255.

Another function of GAM8358 is therefore inhibition of HECA (Accession NP_057301.1). Accordingly, utilities of GAM8358 include diagnosis, prevention and treatment of diseases and clinical conditions associated with HECA.

Hematopoietic protein 1 (HEM1, Accession NP_005328.1) is another GAM8358 target gene, herein designated TARGET GENE. HEM1 BINDING SITE is a target binding site found in the 5' untranslated region of mRNA encoded by HEM1, corresponding to a target binding site such as BINDING SITE I, BINDING SITE II or BINDING SITE III of FIG. 8. Table 4 illustrates the complementarity of the nucleotide sequences of HEM1 BINDING SITE, designated SEQ ID:7159, to the nucleotide sequence of GAM8358 RNA, herein designated GAM RNA, also designated SEQ ID:255.

Another function of GAM8358 is therefore inhibition of Hematopoietic protein 1 (HEM1, Accession NP_005328.1). Accordingly, utilities of GAM8358 include diagnosis, prevention and treatment of diseases and clinical conditions associated with HEM1.

Hairy/enhancer-of-split related with yrpw motif-like (HEy, Accession NP_055386.1) is another GAM8358 target gene, herein designated TARGET GENE. HEYL BINDING SITE is a target binding site found in the 3' untranslated region of mRNA encoded by HEy, corresponding to a target binding site such as BINDING SITE I, BINDING SITE II or BINDING SITE III of FIG. 8. Table 4 illustrates the complementarity of the nucleotide sequences of HEYL BINDING SITE, designated SEQ ID:781, to the nucleotide sequence of GAM8358 RNA, herein designated GAM RNA, also designated SEQ ID:255.

Another function of GAM8358 is therefore inhibition of Hairy/enhancer-of-split related with yrpw motif-like (HEy, Accession NP_055386.1). Accordingly, utilities of GAM8358 include diagnosis, prevention and treatment of diseases and clinical conditions associated with HEYL.

Herv-h ltr-associating 1 (HHLA1, Accession NP_005703.1) is another GAM8358 target gene, herein designated TARGET GENE. HHLA1 BINDING SITE is a target binding site found in the 3' untranslated region of mRNA encoded by HHLA1, corresponding to a target binding site such as BINDING SITE I, BINDING SITE II or BINDING SITE III of FIG. 8. Table 4 illustrates the complementarity of the nucleotide sequences of HHLA1 BINDING SITE, designated SEQ ID:11901, to the nucleotide sequence of GAM8358 RNA, herein designated GAM RNA, also designated SEQ ID:255.

Another function of GAM8358 is therefore inhibition of Herv-h ltr-associating 1 (HHLA1, Accession NP_005703.1), a gene which has unknown function and with low similarity to a region of S. cerevisiae WSC4. Accordingly, utilities of GAM8358 include diagnosis, prevention and treatment of diseases and clinical conditions associated with HHLA1.

The function of HHLA1 and its association with various diseases and clinical conditions, has been established by previous studies, as described hereinabove with reference to GAM223.1. Major histocompatibility complex, class ii, dr alpha (HLA-DRA, Accession NP_061984.1) is another GAM8358 target gene, herein designated TARGET GENE. HLA-DRA BINDING SITE is a target binding site found in the 3' untranslated region of mRNA encoded by HLA-DRA, corresponding to a target binding site such as BINDING SITE I, BINDING SITE II or BINDING SITE III of FIG. 8. Table 4 illustrates the complementarity of the nucleotide sequences of HLA-DRA BINDING SITE, designated SEQ ID:9798, to the nucleotide sequence of GAM8358 RNA, herein designated GAM RNA, also designated SEQ ID:255.

Another function of GAM8358 is therefore inhibition of Major histocompatibility complex, class ii, dr alpha (HLA-DRA, Accession NP_061984.1), a gene which plays a central role in the immune system by presenting peptides derived from extracellular proteins. Accordingly, utilities of GAM8358 include diagnosis, prevention and treatment of diseases and clinical conditions associated with HLA-DRA.

The function of HLA-DRA and its association with various diseases and clinical conditions, has been established by previous studies, as described hereinabove with reference to GAM969.1. Homeo box c13 (HOXC13, Accession NP_059106.2) is another GAM8358 target gene, herein designated TARGET GENE. HOXC13 BINDING SITE is a target binding site found in the 3' untranslated region of mRNA encoded by HOXC13, corresponding to a target binding site such as BINDING SITE I, BINDING SITE II or BINDING SITE III of FIG. 8. Table 4 illustrates the complementarity of the nucleotide sequences of HOXC13 BINDING SITE, designated SEQ ID:12196, to the nucleotide sequence of GAM8358 RNA, herein designated GAM RNA, also designated SEQ ID:255.

Another function of GAM8358 is therefore inhibition of Homeo box c13 (HOXC13, Accession NP_059106.2). Accordingly, utilities of GAM8358 include diagnosis, prevention and treatment of diseases and clinical conditions associated with HOXC13.

Histidine rich calcium binding protein (HRC, Accession NP_002143.1) is another GAM8358 target gene, herein designated TARGET GENE. HRC BINDING SITE is a target binding site found in the 5' untranslated region of mRNA encoded by HRC, corresponding to a target binding site such as BINDING SITE I, BINDING SITE II or BINDING SITE III of FIG. 8. Table 4 illustrates the complementarity of the nucleotide sequences of HRC BINDING SITE, designated SEQ ID:7926, to the nucleotide sequence of GAM8358 RNA, herein designated GAM RNA, also designated SEQ ID:255.

Another function of GAM8358 is therefore inhibition of Histidine rich calcium binding protein (HRC, Accession NP_002143.1), a gene which is a histidine-rich calcium-binding protein. Accordingly, utilities of GAM8358 include diagnosis, prevention and treatment of diseases and clinical conditions associated with HRC.

The function of HRC and its association with various diseases and clinical conditions, has been established by previous studies, as described hereinabove with reference to GAM1722.1. Histamine receptor h1 (HRH1, Accession NP_000852.1) is another GAM8358 target gene, herein designated TARGET GENE. HRH1 BINDING SITE is a target binding site found in the 3' untranslated region of mRNA encoded by HRH1, corresponding to a target binding site such as BINDING SITE I, BINDING SITE II or BINDING SITE III of FIG. 8. Table 4 illustrates the complementarity of the nucleotide sequences of HRH1 BINDING SITE, designated SEQ ID:9207, to the nucleotide sequence of GAM8358 RNA, herein designated GAM RNA, also designated SEQ ID:255.

Another function of GAM8358 is therefore inhibition of Histamine receptor h1 (HRH1, Accession NP_000852.1), a gene which stimulates the synthesis of inositol phosphate. Accordingly, utilities of GAM8358 include diagnosis, prevention and treatment of diseases and clinical conditions associated with HRH1.

The function of HRH1 and its association with various diseases and clinical conditions, has been established by previous studies, as described hereinabove with reference to GAM47.1. HRI (Accession NP_055228.2) is another GAM8358 target gene, herein designated TARGET GENE. HRI BINDING SITE is a target binding site found in the 3' untranslated region of mRNA encoded by HRI, corresponding to a target binding site such as BINDING SITE I, BINDING SITE II or BINDING SITE III of FIG. 8. Table 4 illustrates the complementarity of the nucleotide sequences of HRI BINDING SITE, designated SEQ ID:17628, to the nucleotide sequence of GAM8358 RNA, herein designated GAM RNA, also designated SEQ ID:255.

Another function of GAM8358 is therefore inhibition of HRI (Accession NP_055228.2). Accordingly, utilities of GAM8358 include diagnosis, prevention and treatment of diseases and clinical conditions associated with HRI.

Heparan sulfate (glucosamine) 3-o-sulfotransferase 3b1 (HS3ST3B1, Accession NP_006032.1) is another GAM8358 target gene, herein designated TARGET GENE. HS3ST3B1 BINDING SITE is a target binding site found in the 3' untranslated region of mRNA encoded by HS3ST3B1, corresponding to a target binding site such as BINDING SITE I, BINDING SITE II or BINDING SITE III of FIG. 8. Table 4 illustrates the complementarity of the nucleotide sequences of HS3ST3B1 BINDING SITE, designated SEQ ID:16195, to the nucleotide sequence of GAM8358 RNA, herein designated GAM RNA, also designated SEQ ID:255.

Another function of GAM8358 is therefore inhibition of Heparan sulfate (glucosamine) 3-o-sulfotransferase 3b1 (HS3ST3B1, Accession NP_006032.1), a gene which plays a role in the generation of heparan sulfate proteoglycan. Accordingly, utilities of GAM8358 include diagnosis, prevention and treatment of diseases and clinical conditions associated with HS3ST3B1.

The function of HS3ST3B1 and its association with various diseases and clinical conditions, has been established by previous studies, as described hereinabove with reference to GAM354.1. Hydroxy-delta-5-steroid dehydrogenase, 3 beta- and steroid delta-isomerase 2 (HSD3B2, Accession NP_000189.1) is another GAM8358 target gene, herein designated TARGET GENE. HSD3B2 BINDING SITE is a target binding site found in the 3' untranslated region of mRNA encoded by HSD3B2, corresponding to a target binding site such as BINDING SITE I, BINDING SITE II or BINDING SITE III of FIG. 8. Table 4 illustrates the complementarity of the nucleotide sequences of HSD3B2 BINDING SITE, designated SEQ ID:3135, to the nucleotide sequence of GAM8358 RNA, herein designated GAM RNA, also designated SEQ ID:255.

Another function of GAM8358 is therefore inhibition of Hydroxy-delta-5-steroid dehydrogenase, 3 beta- and steroid delta-isomerase 2 (HSD3B2, Accession NP_000189.1). Accordingly, utilities of GAM8358 include diagnosis, prevention and treatment of diseases and clinical conditions associated with HSD3B2.

Inhibitor of dna binding 2, dominant negative helix-loop-helix protein (ID2, Accession NP_002157.1) is another GAM8358 target gene, herein designated TARGET GENE. ID2 BINDING SITE is a target binding site found in the 3' untranslated region of mRNA encoded by ID2, corresponding to a target binding site such as BINDING SITE I, BINDING SITE II or BINDING SITE III of FIG. 8. Table 4 illustrates the complementarity of the nucleotide sequences of ID2 BINDING SITE, designated SEQ ID:19404, to the nucleotide sequence of GAM8358 RNA, herein designated GAM RNA, also designated SEQ ID:255.

Another function of GAM8358 is therefore inhibition of Inhibitor of dna binding 2, dominant negative helix-loop-helix protein (ID2, Accession NP_002157.1), a gene which may be an inhibitor of tissue-specific gene expression. Accordingly, utilities of GAM8358 include diagnosis, prevention and treatment of diseases and clinical conditions associated with ID2.

The function of ID2 and its association with various diseases and clinical conditions, has been established by previous studies, as described hereinabove with reference to GAM475.2. Isocitrate dehydrogenase 3 (nad+) alpha (IDH3A, Accession NP_005521.1) is another GAM8358 target gene, herein designated TARGET GENE. IDH3A BINDING SITE is a target binding site found in the 3' untranslated region of mRNA encoded by IDH3A, corresponding to a target binding site such as BINDING SITE I, BINDING SITE II or BINDING SITE III of FIG. 8. Table 4 illustrates the complementarity of the nucleotide sequences of IDH3A BINDING SITE, designated SEQ ID:14914, to the nucleotide sequence of GAM8358 RNA, herein designated GAM RNA, also designated SEQ ID:255.

Another function of GAM8358 is therefore inhibition of Isocitrate dehydrogenase 3 (nad+) alpha (IDH3A, Accession NP_005521.1), a gene which decarboxylates isocitrate into alpha-ketoglutarate in the TCA cycle. Accordingly, utilities of GAM8358 include diagnosis, prevention and treatment of diseases and clinical conditions associated with IDH3A.

The function of IDH3A and its association with various diseases and clinical conditions, has been established by previous studies, as described hereinabove with reference to GAM248.1. Interferon (alpha, beta and omega) receptor 2 (IFNAR2, Accession NP_000865.2) is another GAM8358 target gene, herein designated TARGET GENE. IFNAR2 BINDING SITE is a target binding site found in the 3' untranslated region of mRNA encoded by IFNAR2, corresponding to a target binding site such as BINDING SITE I, BINDING SITE II or BINDING SITE III of FIG. 8. Table 4 illustrates the complementarity of the nucleotide sequences of IFNAR2 BINDING SITE, designated SEQ ID:11246, to the nucleotide sequence of GAM8358 RNA, herein designated GAM RNA, also designated SEQ ID:255.

Another function of GAM8358 is therefore inhibition of Interferon (alpha, beta and omega) receptor 2 (IFNAR2, Accession NP_000865.2), a gene which is a receptor for interferons alpha and beta. Accordingly, utilities of GAM8358 include diagnosis, prevention and treatment of diseases and clinical conditions associated with IFNAR2.

The function of IFNAR2 and its association with various diseases and clinical conditions, has been established by previous studies, as described hereinabove with reference to GAM30.1. Immunoglobulin superfamily, member 2 (IGSF2, Accession NP_004249.1) is another GAM8358 target gene, herein designated TARGET GENE. IGSF2 BINDING SITE is a target binding site found in the 3' untranslated region of mRNA encoded by IGSF2, corresponding to a target binding site such as BINDING SITE I, BINDING SITE II or BINDING SITE III of FIG. 8. Table 4 illustrates the complementarity of the nucleotide sequences of IGSF2 BINDING SITE, designated SEQ ID:15726, to the nucleotide sequence of GAM8358 RNA, herein designated GAM RNA, also designated SEQ ID:255.

Another function of GAM8358 is therefore inhibition of Immunoglobulin superfamily, member 2 (IGSF2, Accession NP_004249.1). Accordingly, utilities of GAM8358 include diagnosis, prevention and treatment of diseases and clinical conditions associated with IGSF2.

Interleukin 16 (lymphocyte chemoattractant factor) (IL16, Accession NP_757366.1) is another GAM8358 target gene, herein designated TARGET GENE. IL16 BINDING SITE is a target binding site found in the 3' untranslated region of multiple transcripts of mRNA encoded by IL16, corresponding to a target binding site such as BINDING SITE I, BINDING SITE II or BINDING SITE III of FIG. 8. Table 4 illustrates the complementarity of the nucleotide sequences of IL16 BINDING SITE, designated SEQ ID:10757, to the nucleotide sequence of GAM8358 RNA, herein designated GAM RNA, also designated SEQ ID:255.

Another function of GAM8358 is therefore inhibition of Interleukin 16 (lymphocyte chemoattractant factor) (IL16, Accession NP_757366.1), a gene which modulates T-cell activation. Accordingly, utilities of GAM8358 include diagnosis, prevention and treatment of diseases and clinical conditions associated with IL16.

The function of IL16 and its association with various diseases and clinical conditions, has been established by previous studies, as described hereinabove with reference to GAM66.1. Interleukin 17c (IL17C, Accession NP_037410.1) is another GAM8358 target gene, herein designated TARGET GENE. IL17C BINDING SITE1 and IL17C BINDING SITE2 are target binding sites found in untranslated regions of mRNA encoded by IL17C, corresponding to target binding sites such as BINDING SITE I, BINDING SITE II or BINDING SITE III of FIG. 8. Table 4 illustrates the complementarity of the nucleotide sequences of IL17C BINDING SITE1 and IL17C BINDING SITE2, designated SEQ ID:15783 and SEQ ID:17730 respectively, to the nucleotide sequence of GAM8358 RNA, herein designated GAM RNA, also designated SEQ ID:255.

Another function of GAM8358 is therefore inhibition of Interleukin 17c (IL17C, Accession NP_037410.1). Accordingly, utilities of GAM8358 include diagnosis, prevention and treatment of diseases and clinical conditions associated with IL17C.

Itchy homolog e3 ubiquitin protein ligase (mouse) (ITCH, Accession NP_113671.3) is another GAM8358 target gene, herein designated TARGET GENE. ITCH BINDING SITE is a target binding site found in the 3' untranslated region of mRNA encoded by ITCH, corresponding to a target binding site such as BINDING SITE I, BINDING SITE II or BINDING SITE III of FIG. 8. Table 4 illustrates the complementarity of the nucleotide sequences of ITCH BINDING SITE, designated SEQ ID:8893, to the nucleotide sequence of GAM8358 RNA, herein designated GAM RNA, also designated SEQ ID:255.

Another function of GAM8358 is therefore inhibition of Itchy homolog e3 ubiquitin protein ligase (mouse) (ITCH, Accession NP_113671.3), a gene which accepts ubiquitin from an e2 ubiquitin-conjugating enzyme in the form of a thioester and then directly transfers the ubiquitin to targeted substrates. Accordingly, utilities of GAM8358 include diagnosis, prevention and treatment of diseases and clinical conditions associated with ITCH.

The function of ITCH and its association with various diseases and clinical conditions, has been established by previous studies, as described hereinabove with reference to GAM72.1. Inositol 1,4,5-triphosphate receptor, type 2 (ITPR2, Accession NP_002214.1) is another GAM8358 target gene, herein designated TARGET GENE. ITPR2 BINDING SITE is a target binding site found in the 5' untranslated region of mRNA encoded by ITPR2, corresponding to a target binding site such as BINDING SITE I, BINDING SITE II or BINDING SITE III of FIG. 8. Table 4 illustrates the complementarity of the nucleotide sequences of ITPR2 BINDING SITE, designated SEQ ID:7682, to the nucleotide sequence of GAM8358 RNA, herein designated GAM RNA, also designated SEQ ID:255.

Another function of GAM8358 is therefore inhibition of Inositol 1,4,5-triphosphate receptor, type 2 (ITPR2, Accession NP_002214.1). Accordingly, utilities of GAM8358 include diagnosis, prevention and treatment of diseases and clinical conditions associated with ITPR2.

Jumonji homolog (mouse) (JMJ, Accession NP_004964.2) is another GAM8358 target gene, herein designated TARGET GENE. JMJ BINDING SITE is a target binding site found in the 3' untranslated region of mRNA encoded by JMJ, corresponding to a target binding site such as BINDING SITE I, BINDING SITE II or BINDING SITE III of FIG. 8. Table 4 illustrates the complementarity of the nucleotide sequences of JMJ BINDING SITE, designated SEQ ID:1204, to the nucleotide sequence of GAM8358 RNA, herein designated GAM RNA, also designated SEQ ID:255.

Another function of GAM8358 is therefore inhibition of Jumonji homolog (mouse) (JMJ, Accession NP_004964.2), a gene which participates in the negative regulation of cell growth. Accordingly, utilities of GAM8358 include diagnosis, prevention and treatment of diseases and clinical conditions associated with JMJ.

The function of JMJ and its association with various diseases and clinical conditions, has been established by previous studies, as described hereinabove with reference to GAM47.1. Potassium voltage-gated channel, isk-related family, member 1-like (KCNE1L, Accession NP_036414.1) is another GAM8358 target gene, herein designated TARGET GENE. KCNE1L BINDING SITE is a target binding site found in the 3' untranslated region of mRNA encoded by KCNE1L, corresponding to a target binding site such as BINDING SITE I, BINDING SITE II or BINDING SITE III of FIG. 8. Table 4 illustrates the complementarity of the nucleotide sequences of KCNE1L BINDING SITE, designated SEQ ID:5757, to the nucleotide sequence of GAM8358 RNA, herein designated GAM RNA, also designated SEQ ID:255.

Another function of GAM8358 is therefore inhibition of Potassium voltage-gated channel, isk-related family, member 1-like (KCNE1L, Accession NP_036414.1), a gene which is a potassium voltage-gated channel. Accordingly, utilities of GAM8358 include diagnosis, prevention and treatment of diseases and clinical conditions associated with KCNE1L.

The function of KCNE1L and its association with various diseases and clinical conditions, has been established by previous studies, as described hereinabove with reference to GAM223.1. KIAA0193 (Accession NP_055581.2) is another GAM8358 target gene, herein designated TARGET GENE. KIAA0193 BINDING SITE is a target binding site found in the 3' untranslated region of mRNA encoded by KIAA0193, corresponding to a target binding site such as BINDING SITE I, BINDING SITE II or BINDING SITE III of FIG. 8. Table 4 illustrates the complementarity of the nucleotide sequences of KIAA0193 BINDING SITE, designated SEQ ID:19449, to the nucleotide sequence of GAM8358 RNA, herein designated GAM RNA, also designated SEQ ID:255.

Another function of GAM8358 is therefore inhibition of KIAA0193 (Accession NP_055581.2). Accordingly, utilities of GAM8358 include diagnosis, prevention and treatment of diseases and clinical conditions associated with KIAA0193.

KIAA0237 (Accession NP_055562.1) is another GAM8358 target gene, herein designated TARGET GENE. KIAA0237 BINDING SITE is a target binding site found in the 3' untranslated region of mRNA encoded by KIAA0237, corresponding to a target binding site such as BINDING SITE I, BINDING SITE II or BINDING SITE III of FIG. 8. Table 4 illustrates the complementarity of the nucleotide sequences of KIAA0237 BINDING SITE, designated SEQ ID:19327, to the nucleotide sequence of GAM8358 RNA, herein designated GAM RNA, also designated SEQ ID:255.

Another function of GAM8358 is therefore inhibition of KIAA0237 (Accession NP_055562.1). Accordingly, utilities of GAM8358 include diagnosis, prevention and treatment of diseases and clinical conditions associated with KIAA0237.

KIAA0298 (Accession XP_084529.6) is another GAM8358 target gene, herein designated TARGET GENE. KIAA0298 BINDING SITE is a target binding site found in the 3' untranslated region of mRNA encoded by KIAA0298, corresponding to a target binding site such as BINDING SITE I, BINDING SITE II or BINDING SITE III of FIG. 8. Table 4 illustrates the complementarity of the nucleotide sequences of KIAA0298 BINDING SITE, designated SEQ ID:19243, to the nucleotide sequence of GAM8358 RNA, herein designated GAM RNA, also designated SEQ ID:255.

Another function of GAM8358 is therefore inhibition of KIAA0298 (Accession XP_084529.6). Accordingly, utilities of GAM8358 include diagnosis, prevention and treatment of diseases and clinical conditions associated with KIAA0298.

KIAA0329 (Accession NP_055659.1) is another GAM8358 target gene, herein designated TARGET GENE. KIAA0329 BINDING SITE is a target binding site found in the 3' untranslated region of mRNA encoded by KIAA0329, corresponding to a target binding site such as BINDING SITE I, BINDING SITE II or BINDING SITE III of FIG. 8. Table 4 illustrates the complementarity of the nucleotide sequences of KIAA0329 BINDING SITE, designated SEQ ID:4476, to the nucleotide sequence of GAM8358 RNA, herein designated GAM RNA, also designated SEQ ID:255.

Another function of GAM8358 is therefore inhibition of KIAA0329 (Accession NP_055659.1). Accordingly, utilities of GAM8358 include diagnosis, prevention and treatment of diseases and clinical conditions associated with KIAA0329.

KIAA0377 (Accession NP_055474.1) is another GAM8358 target gene, herein designated TARGET GENE. KIAA0377 BINDING SITE is a target binding site found in the 3' untranslated region of mRNA encoded by KIAA0377, corresponding to a target binding site such as BINDING SITE I, BINDING SITE II or BINDING SITE III of FIG. 8. Table 4 illustrates the complementarity of the nucleotide sequences of KIAA0377 BINDING SITE, designated SEQ ID:1638, to the nucleotide sequence of GAM8358 RNA, herein designated GAM RNA, also designated SEQ ID:255.

Another function of GAM8358 is therefore inhibition of KIAA0377 (Accession NP_055474.1). Accordingly, utilities of GAM8358 include diagnosis, prevention and treatment of diseases and clinical conditions associated with KIAA0377.

KIAA0404 (Accession XP_290517.1) is another GAM8358 target gene, herein designated TARGET GENE. KIAA0404 BINDING SITE is a target binding site found in the 3' untranslated region of mRNA encoded by KIAA0404, corresponding to a target binding site such as BINDING SITE I, BINDING SITE II or BINDING SITE III of FIG. 8. Table 4 illustrates the complementarity of the nucleotide sequences of KIAA0404 BINDING SITE, designated SEQ ID:18934, to the nucleotide sequence of GAM8358 RNA, herein designated GAM RNA, also designated SEQ ID:255.

Another function of GAM8358 is therefore inhibition of KIAA0404 (Accession XP_290517.1). Accordingly, utilities of GAM8358 include diagnosis, prevention and treatment of diseases and clinical conditions associated with KIAA0404.

KIAA0472 (Accession XP_290898.1) is another GAM8358 target gene, herein designated TARGET GENE. KIAA0472 BINDING SITE is a target binding site found in the 5' untranslated region of mRNA encoded by KIAA0472, corresponding to a target binding site such as BINDING SITE I, BINDING SITE II or BINDING SITE III of FIG. 8. Table 4 illustrates the complementarity of the nucleotide sequences of KIAA0472 BINDING SITE, designated SEQ ID:10981, to the nucleotide sequence of GAM8358 RNA, herein designated GAM RNA, also designated SEQ ID:255.

Another function of GAM8358 is therefore inhibition of KIAA0472 (Accession XP_290898.1). Accordingly, utilities of GAM8358 include diagnosis, prevention and treatment of diseases and clinical conditions associated with KIAA0472.

KIAA0495 (Accession XP_031397.1) is another GAM8358 target gene, herein designated TARGET GENE. KIAA0495 BINDING SITE is a target binding site found in the 5' untranslated region of mRNA encoded by KIAA0495, corresponding to a target binding site such as BINDING SITE I, BINDING SITE II or BINDING SITE III of FIG. 8. Table 4 illustrates the complementarity of the nucleotide sequences of KIAA0495 BINDING SITE, designated SEQ ID:7638, to the nucleotide sequence of GAM8358 RNA, herein designated GAM RNA, also designated SEQ ID:255.

Another function of GAM8358 is therefore inhibition of KIAA0495 (Accession XP_031397.1). Accordingly, utilities of GAM8358 include diagnosis, prevention and treatment of diseases and clinical conditions associated with KIAA0495.

KIAA0534 (Accession XP_049349.8) is another GAM8358 target gene, herein designated TARGET GENE. KIAA0534 BINDING SITE is a target binding site found in the 3' untranslated region of mRNA encoded by KIAA0534, corresponding to a target binding site such as BINDING SITE I, BINDING SITE II or BINDING SITE III of FIG. 8. Table 4 illustrates the complementarity of the nucleotide sequences of KIAA0534 BINDING SITE, designated SEQ ID:14353, to the nucleotide sequence of GAM8358 RNA, herein designated GAM RNA, also designated SEQ ID:255.

Another function of GAM8358 is therefore inhibition of KIAA0534 (Accession XP_049349.8). Accordingly, utilities of GAM8358 include diagnosis, prevention and treatment of diseases and clinical conditions associated with KIAA0534.

KIAA0551 (Accession XP_039796.7) is another GAM8358 target gene, herein designated TARGET GENE. KIAA0551 BINDING SITE is a target binding site found in the 3' untranslated region of mRNA encoded by KIAA0551, corresponding to a target binding site such as BINDING SITE I, BINDING SITE II or BINDING SITE III of FIG. 8. Table 4 illustrates the complementarity of the nucleotide sequences of KIAA0551 BINDING SITE, designated SEQ ID:14105, to the nucleotide sequence of GAM8358 RNA, herein designated GAM RNA, also designated SEQ ID:255.

Another function of GAM8358 is therefore inhibition of KIAA0551 (Accession XP_039796.7). Accordingly, utilities of GAM8358 include diagnosis, prevention and treatment of diseases and clinical conditions associated with KIAA0551.

KIAA0555 (Accession NP_055605.1) is another GAM8358 target gene, herein designated TARGET GENE. KIAA0555 BINDING SITE is a target binding site found in the 3' untranslated region of mRNA encoded by KIAA0555, corresponding to a target binding site such as BINDING SITE I, BINDING SITE II or BINDING SITE III of FIG. 8. Table 4 illustrates the complementarity of the nucleotide sequences of KIAA0555 BINDING SITE, designated SEQ ID:10997, to the nucleotide sequence of GAM8358 RNA, herein designated GAM RNA, also designated SEQ ID:255.

Another function of GAM8358 is therefore inhibition of KIAA0555 (Accession NP_055605.1). Accordingly, utilities of GAM8358 include diagnosis, prevention and treatment of diseases and clinical conditions associated with KIAA0555.

KIAA0721 (Accession NP_067680.2) is another GAM8358 target gene, herein designated TARGET GENE. KIAA0721 BINDING SITE is a target binding site found in the 3' untranslated region of mRNA encoded by KIAA0721, corresponding to a target binding site such as BINDING SITE I, BINDING SITE II or BINDING SITE III of FIG. 8. Table 4 illustrates the complementarity of the nucleotide sequences of KIAA0721 BINDING SITE, designated SEQ ID:13136, to the nucleotide sequence of GAM8358 RNA, herein designated GAM RNA, also designated SEQ ID:255.

Another function of GAM8358 is therefore inhibition of KIAA0721 (Accession NP_067680.2). Accordingly, utilities of GAM8358 include diagnosis, prevention and treatment of diseases and clinical conditions associated with KIAA0721.

KIAA0843 (Accession NP_055760.1) is another GAM8358 target gene, herein designated TARGET GENE. KIAA0843 BINDING SITE is a target binding site found in the 3' untranslated region of mRNA encoded by KIAA0843, corresponding to a target binding site such as BINDING SITE I, BINDING SITE II or BINDING SITE III of FIG. 8. Table 4 illustrates the complementarity of the nucleotide sequences of KIAA0843 BINDING SITE, designated SEQ ID:3729, to the nucleotide sequence of GAM8358 RNA, herein designated GAM RNA, also designated SEQ ID:255.

Another function of GAM8358 is therefore inhibition of KIAA0843 (Accession NP_055760.1). Accordingly, utilities of GAM8358 include diagnosis, prevention and treatment of diseases and clinical conditions associated with KIAA0843.

KIAA0962 (Accession XP_290942.1) is another GAM8358 target gene, herein designated TARGET GENE. KIAA0962 BINDING SITE1 and KIAA0962 BINDING SITE2 are target binding sites found in untranslated regions of mRNA encoded by KIAA0962, corresponding to target binding sites such as BINDING SITE I, BINDING SITE II or BINDING SITE III of FIG. 8. Table 4 illustrates the complementarity of the nucleotide sequences of KIAA0962 BINDING SITE1 and KIAA0962 BINDING SITE2, designated SEQ ID:9385 and SEQ ID:18634 respectively, to the nucleotide sequence of GAM8358 RNA, herein designated GAM RNA, also designated SEQ ID:255.

Another function of GAM8358 is therefore inhibition of KIAA0962 (Accession XP_290942.1). Accordingly, utilities of GAM8358 include diagnosis, prevention and treatment of diseases and clinical conditions associated with KIAA0962.

KIAA1045 (Accession XP_048592.1) is another GAM8358 target gene, herein designated TARGET GENE. KIAA1045 BINDING SITE is a target binding site found in the 3' untranslated region of mRNA encoded by KIAA1045, corresponding to a target binding site such as BINDING SITE I, BINDING SITE II or BINDING SITE III of FIG. 8. Table 4 illustrates the complementarity of the nucleotide sequences of KIAA1045 BINDING SITE, designated SEQ ID:16854, to the nucleotide sequence of GAM8358 RNA, herein designated GAM RNA, also designated SEQ ID:255.

Another function of GAM8358 is therefore inhibition of KIAA1045 (Accession XP_048592.1). Accordingly, utilities of GAM8358 include diagnosis, prevention and treatment of diseases and clinical conditions associated with KIAA1045.

KIAA1191 (Accession NP_065177.2) is another GAM8358 target gene, herein designated TARGET GENE. KIAA1191 BINDING SITE is a target binding site found in the 3' untranslated region of mRNA encoded by KIAA1191, corresponding to a target binding site such as BINDING SITE I, BINDING SITE II or BINDING SITE III of FIG. 8. Table 4 illustrates the complementarity of the nucleotide sequences of KIAA1191 BINDING SITE, designated SEQ ID:18347, to the nucleotide sequence of GAM8358 RNA, herein designated GAM RNA, also designated SEQ ID:255.

Another function of GAM8358 is therefore inhibition of KIAA1191 (Accession NP_065177.2). Accordingly, utilities of GAM8358 include diagnosis, prevention and treatment of diseases and clinical conditions associated with KIAA1191.

KIAA1328 (Accession XP_029429.4) is another GAM8358 target gene, herein designated TARGET GENE. KIAA1328 BINDING SITE is a target binding site found in the 3' untranslated region of mRNA encoded by KIAA1328, corresponding to a target binding site such as BINDING SITE I, BINDING SITE II or BINDING SITE III of FIG. 8. Table 4 illustrates the complementarity of the nucleotide sequences of KIAA1328 BINDING SITE, designated SEQ ID:19188, to the nucleotide sequence of GAM8358 RNA, herein designated GAM RNA, also designated SEQ ID:255.

Another function of GAM8358 is therefore inhibition of KIAA1328 (Accession XP_029429.4). Accordingly, utilities of GAM8358 include diagnosis, prevention and treatment of diseases and clinical conditions associated with KIAA1328.

KIAA1394 (Accession XP_208522.1) is another GAM8358 target gene, herein designated TARGET GENE. KIAA1394 BINDING SITE is a target binding site found in the 3' untranslated region of mRNA encoded by KIAA1394, corresponding to a target binding site such as BINDING SITE I, BINDING SITE II or BINDING SITE III of FIG. 8. Table 4 illustrates the complementarity of the nucleotide sequences of KIAA1394 BINDING SITE, designated SEQ ID:17260, to the nucleotide sequence of GAM8358 RNA, herein designated GAM RNA, also designated SEQ ID:255.

Another function of GAM8358 is therefore inhibition of KIAA1394 (Accession XP_208522.1). Accordingly, utilities of GAM8358 include diagnosis, prevention and treatment of diseases and clinical conditions associated with KIAA1394.

KIAA1404 (Accession NP_066363.1) is another GAM8358 target gene, herein designated TARGET GENE. KIAA1404 BINDING SITE1 and KIAA1404 BINDING SITE2 are target binding sites found in untranslated regions of mRNA encoded by KIAA1404, corresponding to target binding sites such as BINDING SITE I, BINDING SITE II or BINDING SITE III of FIG. 8. Table 4 illustrates the complementarity of the nucleotide sequences of KIAA1404 BINDING SITE1 and KIAA1404 BINDING SITE2, designated SEQ ID:1732 and SEQ ID:7163 respectively, to the nucleotide sequence of GAM8358 RNA, herein designated GAM RNA, also designated SEQ ID:255.

Another function of GAM8358 is therefore inhibition of KIAA1404 (Accession NP_066363.1). Accordingly, utilities of GAM8358 include diagnosis, prevention and treatment of diseases and clinical conditions associated with KIAA1404.

KIAA1441 (Accession NP_065883.1) is another GAM8358 target gene, herein designated TARGET GENE. KIAA1441 BINDING SITE is a target binding site found in the 3' untranslated region of mRNA encoded by KIAA1441, corresponding to a target binding site such as BINDING SITE I, BINDING SITE II or BINDING SITE III of FIG. 8. Table 4 illustrates the complementarity of the nucleotide sequences of KIAA1441 BINDING SITE, designated SEQ ID:16287, to the nucleotide sequence of GAM8358 RNA, herein designated GAM RNA, also designated SEQ ID:255.

Another function of GAM8358 is therefore inhibition of KIAA1441 (Accession NP_065883.1). Accordingly, utilities of GAM8358 include diagnosis, prevention and treatment of diseases and clinical conditions associated with KIAA1441.

KIAA1554 (Accession XP_290768.1) is another GAM8358 target gene, herein designated TARGET GENE. KIAA1554 BINDING SITE is a target binding site found in the 3' untranslated region of mRNA encoded by KIAA1554, corresponding to a target binding site such as BINDING SITE I, BINDING SITE II or BINDING SITE III of FIG. 8. Table 4 illustrates the complementarity of the nucleotide sequences of KIAA1554 BINDING SITE, designated SEQ ID:19407, to the nucleotide sequence of GAM8358 RNA, herein designated GAM RNA, also designated SEQ ID:255.

Another function of GAM8358 is therefore inhibition of KIAA1554 (Accession XP_290768.1). Accordingly, utilities of GAM8358 include diagnosis, prevention and treatment of diseases and clinical conditions associated with KIAA1554.

KIAA1683 (Accession XP_290870.2) is another GAM8358 target gene, herein designated TARGET GENE. KIAA1683 BINDING SITE is a target binding site found in the 5' untranslated region of mRNA encoded by KIAA1683, corresponding to a target binding site such as BINDING SITE I, BINDING SITE II or BINDING SITE III of FIG. 8. Table 4 illustrates the complementarity of the nucleotide sequences of KIAA1683 BINDING SITE, designated SEQ ID:6606, to the nucleotide sequence of GAM8358 RNA, herein designated GAM RNA, also designated SEQ ID:255.

Another function of GAM8358 is therefore inhibition of KIAA1683 (Accession XP_290870.2). Accordingly, utilities of GAM8358 include diagnosis, prevention and treatment of diseases and clinical conditions associated with KIAA1683.

KIAA1735 (Accession XP_290496.1) is another GAM8358 target gene, herein designated TARGET GENE. KIAA1735 BINDING SITE is a target binding site found in the 3' untranslated region of mRNA encoded by KIAA1735, corresponding to a target binding site such as BINDING SITE I, BINDING SITE II or BINDING SITE III of FIG. 8. Table 4 illustrates the complementarity of the nucleotide sequences of KIAA1735 BINDING SITE, designated SEQ ID:8127, to the nucleotide sequence of GAM8358 RNA, herein designated GAM RNA, also designated SEQ ID:255.

Another function of GAM8358 is therefore inhibition of KIAA1735 (Accession XP_290496.1). Accordingly, utilities of GAM8358 include diagnosis, prevention and treatment of diseases and clinical conditions associated with KIAA1735.

KIAA1750 (Accession NP_277047.1) is another GAM8358 target gene, herein designated TARGET GENE. KIAA1750 BINDING SITE is a target binding site found in the 3' untranslated region of mRNA encoded by KIAA1750, corresponding to a target binding site such as BINDING SITE I, BINDING SITE II or BINDING SITE III of FIG. 8. Table 4 illustrates the complementarity of the nucleotide sequences of KIAA1750 BINDING SITE, designated SEQ ID:2837, to the nucleotide sequence of GAM8358 RNA, herein designated GAM RNA, also designated SEQ ID:255.

Another function of GAM8358 is therefore inhibition of KIAA1750 (Accession NP_277047.1). Accordingly, utilities of GAM8358 include diagnosis, prevention and treatment of diseases and clinical conditions associated with KIAA1750.

KIAA1872 (Accession NP_149053.1) is another GAM8358 target gene, herein designated TARGET GENE. KIAA1872 BINDING SITE is a target binding site found in the 3' untranslated region of mRNA encoded by KIAA1872, corresponding to a target binding site such as BINDING SITE I, BINDING SITE II or BINDING SITE III of FIG. 8. Table 4 illustrates the complementarity of the nucleotide sequences of KIAA1872 BINDING SITE, designated SEQ ID:2574, to the nucleotide sequence of GAM8358 RNA, herein designated GAM RNA, also designated SEQ ID:255.

Another function of GAM8358 is therefore inhibition of KIAA1872 (Accession NP_149053.1). Accordingly, utilities of GAM8358 include diagnosis, prevention and treatment of diseases and clinical conditions associated with KIAA1872.

KIAA1915 (Accession XP_055481.1) is another GAM8358 target gene, herein designated TARGET GENE. KIAA1915 BINDING SITE is a target binding site found in the 3' untranslated region of mRNA encoded by KIAA1915, corresponding to a target binding site such as BINDING SITE I, BINDING SITE II or BINDING SITE III of FIG. 8. Table 4 illustrates the complementarity of the nucleotide sequences of KIAA1915 BINDING SITE, designated SEQ ID:8633, to the nucleotide sequence of GAM8358 RNA, herein designated GAM RNA, also designated SEQ ID:255.

Another function of GAM8358 is therefore inhibition of KIAA1915 (Accession XP_055481.1). Accordingly, utilities of GAM8358 include diagnosis, prevention and treatment of diseases and clinical conditions associated with KIAA1915.

KIAA1940 (Accession XP_086981.2) is another GAM8358 target gene, herein designated TARGET GENE. KIAA1940 BINDING SITE is a target binding site found in the 3' untranslated region of mRNA encoded by KIAA1940, corresponding to a target binding site such as BINDING SITE I, BINDING SITE II or BINDING SITE III of FIG. 8. Table 4 illustrates the complementarity of the nucleotide sequences of KIAA1940 BINDING SITE, designated SEQ ID:20086, to the nucleotide sequence of GAM8358 RNA, herein designated GAM RNA, also designated SEQ ID:255.

Another function of GAM8358 is therefore inhibition of KIAA1940 (Accession XP_086981.2). Accordingly, utilities of GAM8358 include diagnosis, prevention and treatment of diseases and clinical conditions associated with KIAA1940.

KIAA1949 (Accession XP_166376.1) is another GAM8358 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:18390, to the nucleotide sequence of GAM8358 RNA, herein designated GAM RNA, also designated SEQ ID:255.

Another function of GAM8358 is therefore inhibition of KIAA1949 (Accession XP_166376.1). Accordingly, utilities of GAM8358 include diagnosis, prevention and treatment of diseases and clinical conditions associated with KIAA1949.

KIAA1949 (Accession XP_300167.1) is another GAM8358 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:18390, to the nucleotide sequence of GAM8358 RNA, herein designated GAM RNA, also designated SEQ ID:255.

Another function of GAM8358 is therefore inhibition of KIAA1949 (Accession XP_300167.1). Accordingly, utilities of GAM8358 include diagnosis, prevention and treatment of diseases and clinical conditions associated with KIAA1949.

KIAA1949 (Accession XP_300202.1) is another GAM8358 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:18390, to the nucleotide sequence of GAM8358 RNA, herein designated GAM RNA, also designated SEQ ID:255.

Another function of GAM8358 is therefore inhibition of KIAA1949 (Accession XP_300202.1). Accordingly, utilities of GAM8358 include diagnosis, prevention and treatment of diseases and clinical conditions associated with KIAA1949.

KIAA2018 (Accession XP_291062.1) is another GAM8358 target gene, herein designated TARGET GENE. KIAA2018 BINDING SITE is a target binding site found in the 3' untranslated region of mRNA encoded by KIAA2018, corresponding to a target binding site such as BINDING SITE I, BINDING SITE II or BINDING SITE III of FIG. 8. Table 4 illustrates the complementarity of the nucleotide sequences of KIAA2018 BINDING SITE, designated SEQ ID:14076, to the nucleotide sequence of GAM8358 RNA, herein designated GAM RNA, also designated SEQ ID:255.

Another function of GAM8358 is therefore inhibition of KIAA2018 (Accession XP_291062.1). Accordingly, utilities of GAM8358 include diagnosis, prevention and treatment of diseases and clinical conditions associated with KIAA2018.

Kinesin family member 5b (KIF5B, Accession NP_004512.1) is another GAM8358 target gene, herein designated TARGET GENE. KIF5B BINDING SITE is a target binding site found in the 5' untranslated region of mRNA encoded by KIF5B, corresponding to a target binding site such as BINDING SITE I, BINDING SITE II or BINDING SITE III of FIG. 8. Table 4 illustrates the complementarity of the nucleotide sequences of KIF5B BINDING SITE, designated SEQ ID:13109, to the nucleotide sequence of GAM8358 RNA, herein designated GAM RNA, also designated SEQ ID:255.

Another function of GAM8358 is therefore inhibition of Kinesin family member 5b (KIF5B, Accession NP_004512.1), a gene which is a microtubule-associated force-producing protein that may play a role in organelle transport. Accordingly, utilities of GAM8358 include diagnosis, prevention and treatment of diseases and clinical conditions associated with KIF5B.

The function of KIF5B and its association with various diseases and clinical conditions, has been established by previous studies, as described hereinabove with reference to GAM861.2. Karyopherin alpha 6 (importin alpha 7) (KPNA6, Accession NP_036448.1) is another GAM8358 target gene, herein designated TARGET GENE. KPNA6 BINDING SITE is a target binding site found in the 3' untranslated region of mRNA encoded by KPNA6, corresponding to a target binding site such as BINDING SITE I, BINDING SITE II or BINDING SITE III of FIG. 8. Table 4 illustrates the complementarity of the nucleotide sequences of KPNA6 BINDING SITE, designated SEQ ID:15175, to the nucleotide sequence of GAM8358 RNA, herein designated GAM RNA, also designated SEQ ID:255.

Another function of GAM8358 is therefore inhibition of Karyopherin alpha 6 (importin alpha 7) (KPNA6, Accession NP_036448.1). Accordingly, utilities of GAM8358 include diagnosis, prevention and treatment of diseases and clinical conditions associated with KPNA6.

LBP-9 (Accession NP_055368.1) is another GAM8358 target gene, herein designated TARGET GENE. LBP-9 BINDING SITE is a target binding site found in the 3' untranslated region of mRNA encoded by LBP-9, corresponding to a target binding site such as BINDING SITE I, BINDING SITE II or BINDING SITE III of FIG. 8. Table 4 illustrates the complementarity of the nucleotide sequences of LBP-9 BINDING SITE, designated SEQ ID:18984, to the nucleotide sequence of GAM8358 RNA, herein designated GAM RNA, also designated SEQ ID:255.

Another function of GAM8358 is therefore inhibition of LBP-9 (Accession NP_055368.1). Accordingly, utilities of GAM8358 include diagnosis, prevention and treatment of diseases and clinical conditions associated with LBP-9.

Low density lipoprotein receptor (familial hypercholesterolemia) (LDLR, Accession NP_000518.1) is another GAM8358 target gene, herein designated TARGET GENE. LDLR BINDING SITE is a target binding site found in the 3' untranslated region of mRNA encoded by LDLR, corresponding to a target binding site such as BINDING SITE I, BINDING SITE II or BINDING SITE III of FIG. 8. Table 4 illustrates the complementarity of the nucleotide sequences of LDLR BINDING SITE, designated SEQ ID:13935, to the nucleotide sequence of GAM8358 RNA, herein designated GAM RNA, also designated SEQ ID:255.

Another function of GAM8358 is therefore inhibition of Low density lipoprotein receptor (familial hypercholesterolemia) (LDLR, Accession NP_000518.1), a gene which also acts as a tumor suppressor. and therefore is associated with Familial hypercholesterolemia. Accordingly, utilities of GAM8358 include diagnosis, prevention and treatment of Familial hypercholesterolemia, and of other diseases and clinical conditions associated with LDLR.

The function of LDLR and its association with various diseases and clinical conditions, has been established by previous studies, as described hereinabove with reference to GAM99.1. Leiomodin 1 (smooth muscle) (LMOD1, Accession NP_036266.1) is another GAM8358 target gene, herein designated TARGET GENE. LMOD1 BINDING SITE is a target binding site found in the 3' untranslated region of mRNA encoded by LMOD1, corresponding to a target binding site such as BINDING SITE I, BINDING SITE II or BINDING SITE III of FIG. 8. Table 4 illustrates the complementarity of the nucleotide sequences of LMOD1 BINDING SITE, designated SEQ ID:15622, to the nucleotide sequence of GAM8358 RNA, herein designated GAM RNA, also designated SEQ ID:255.

Another function of GAM8358 is therefore inhibition of Leiomodin 1 (smooth muscle) (LMOD1, Accession NP_036266.1). Accordingly, utilities of GAM8358 include diagnosis, prevention and treatment of diseases and clinical conditions associated with LMOD1.

LOC112885 (Accession NP_612424.1) is another GAM8358 target gene, herein designated TARGET GENE. LOC112885 BINDING SITE is a target binding site found in the 3' untranslated region of mRNA encoded by LOC112885, corresponding to a target binding site such as BINDING SITE I, BINDING SITE II or BINDING SITE III of FIG. 8. Table 4 illustrates the complementarity of the nucleotide sequences of LOC112885 BINDING SITE, designated SEQ ID:8726, to the nucleotide sequence of GAM8358 RNA, herein designated GAM RNA, also designated SEQ ID:255.

Another function of GAM8358 is therefore inhibition of LOC112885 (Accession NP_612424.1). Accordingly, utilities of GAM8358 include diagnosis, prevention and treatment of diseases and clinical conditions associated with LOC112885.

LOC115110 (Accession XP_049825.5) is another GAM8358 target gene, herein designated TARGET GENE. LOC115110 BINDING SITE is a target binding site found in the 3' untranslated region of mRNA encoded by LOC115110, corresponding to a target binding site such as BINDING SITE I, BINDING SITE II or BINDING SITE III of FIG. 8. Table 4 illustrates the complementarity of the nucleotide sequences of LOC115110 BINDING SITE, designated SEQ ID:5560, to the nucleotide sequence of GAM8358 RNA, herein designated GAM RNA, also designated SEQ ID:255.

Another function of GAM8358 is therefore inhibition of LOC115110 (Accession XP_049825.5). Accordingly, utilities of GAM8358 include diagnosis, prevention and treatment of diseases and clinical conditions associated with LOC115110.

LOC121838 (Accession XP_071772.1) is another GAM8358 target gene, herein designated TARGET GENE. LOC121838 BINDING SITE is a target binding site found in the 5' untranslated region of mRNA encoded by LOC121838, corresponding to a target binding site such as BINDING SITE I, BINDING SITE II or BINDING SITE III of FIG. 8. Table 4 illustrates the complementarity of the nucleotide sequences of LOC121838 BINDING SITE, designated SEQ ID:9861, to the nucleotide sequence of GAM8358 RNA, herein designated GAM RNA, also designated SEQ ID:255.

Another function of GAM8358 is therefore inhibition of LOC121838 (Accession XP_071772.1). Accordingly, utilities of GAM8358 include diagnosis, prevention and treatment of diseases and clinical conditions associated with LOC121838.

LOC128308 (Accession XP_059233.2) is another GAM8358 target gene, herein designated TARGET GENE. LOC128308 BINDING SITE is a target binding site found in the 5' untranslated region of mRNA encoded by LOC128308, corresponding to a target binding site such as BINDING SITE I, BINDING SITE II or BINDING SITE III of FIG. 8. Table 4 illustrates the complementarity of the nucleotide sequences of LOC128308 BINDING SITE, designated SEQ ID:8512, to the nucleotide sequence of GAM8358 RNA, herein designated GAM RNA, also designated SEQ ID:255.

Another function of GAM8358 is therefore inhibition of LOC128308 (Accession XP_059233.2). Accordingly, utilities of GAM8358 include diagnosis, prevention and treatment of diseases and clinical conditions associated with LOC128308.

LOC134147 (Accession NP_620164.1) is another GAM8358 target gene, herein designated TARGET GENE. LOC134147 BINDING SITE is a target binding site found in the 3' untranslated region of mRNA encoded by LOC134147, corresponding to a target binding site such as BINDING SITE I, BINDING SITE II or BINDING SITE III of FIG. 8. Table 4 illustrates the complementarity of the nucleotide sequences of LOC134147 BINDING SITE, designated SEQ ID:13019, to the nucleotide sequence of GAM8358 RNA, herein designated GAM RNA, also designated SEQ ID:255.

Another function of GAM8358 is therefore inhibition of LOC134147 (Accession NP_620164.1). Accordingly, utilities of GAM8358 include diagnosis, prevention and treatment of diseases and clinical conditions associated with LOC134147.

LOC139231 (Accession XP_060020.3) is another GAM8358 target gene, herein designated TARGET GENE. LOC139231 BINDING SITE is a target binding site found in the 3' untranslated region of mRNA encoded by LOC139231, corresponding to a target binding site such as BINDING SITE I, BINDING SITE II or BINDING SITE III of FIG. 8. Table 4 illustrates the complementarity of the nucleotide sequences of LOC139231 BINDING SITE, designated SEQ ID:7841, to the nucleotide sequence of GAM8358 RNA, herein designated GAM RNA, also designated SEQ ID:255.

Another function of GAM8358 is therefore inhibition of LOC139231 (Accession XP_060020.3). Accordingly, utilities of GAM8358 include diagnosis, prevention and treatment of diseases and clinical conditions associated with LOC139231.

LOC146488 (Accession XP_047748.5) is another GAM8358 target gene, herein designated TARGET GENE. LOC146488 BINDING SITE is a target binding site found in the 3' untranslated region of mRNA encoded by LOC146488, corresponding to a target binding site such as BINDING SITE I, BINDING SITE II or BINDING SITE III of FIG. 8. Table 4 illustrates the complementarity of the nucleotide sequences of LOC146488 BINDING SITE, designated SEQ ID:17130, to the nucleotide sequence of GAM8358 RNA, herein designated GAM RNA, also designated SEQ ID:255.

Another function of GAM8358 is therefore inhibition of LOC146488 (Accession XP_047748.5). Accordingly, utilities of GAM8358 include diagnosis, prevention and treatment of diseases and clinical conditions associated with LOC146488.

LOC146850 (Accession XP_097109.2) is another GAM8358 target gene, herein designated TARGET GENE. LOC146850 BINDING SITE is a target binding site found in the 3' untranslated region of mRNA encoded by LOC146850, corresponding to a target binding site such as BINDING SITE I, BINDING SITE II or BINDING SITE III of FIG. 8. Table 4 illustrates the complementarity of the nucleotide sequences of LOC146850 BINDING SITE, designated SEQ ID:19317, to the nucleotide sequence of GAM8358 RNA, herein designated GAM RNA, also designated SEQ ID:255.

Another function of GAM8358 is therefore inhibition of LOC146850 (Accession XP_097109.2). Accordingly, utilities of GAM8358 include diagnosis, prevention and treatment of diseases and clinical conditions associated with LOC146850.

LOC147975 (Accession XP_097351.2) is another GAM8358 target gene, herein designated TARGET GENE. LOC147975 BINDING SITE is a target binding site found in the 3' untranslated region of mRNA encoded by LOC147975, corresponding to a target binding site such as BINDING SITE I, BINDING SITE II or BINDING SITE III of FIG. 8. Table 4 illustrates the complementarity of the nucleotide sequences of LOC147975 BINDING SITE, designated SEQ ID:12919, to the nucleotide sequence of GAM8358 RNA, herein designated GAM RNA, also designated SEQ ID:255.

Another function of GAM8358 is therefore inhibition of LOC147975 (Accession XP_097351.2). Accordingly, utilities of GAM8358 include diagnosis, prevention and treatment of diseases and clinical conditions associated with LOC147975.

LOC148189 (Accession XP_086087.1) is another GAM8358 target gene, herein designated TARGET GENE. LOC148189 BINDING SITE is a target binding site found in the 5' untranslated region of mRNA encoded by LOC148189, corresponding to a target binding site such as BINDING SITE I, BINDING SITE II or BINDING SITE III of FIG. 8. Table 4 illustrates the complementarity of the nucleotide sequences of LOC148189 BINDING SITE, designated SEQ ID:1685, to the nucleotide sequence of GAM8358 RNA, herein designated GAM RNA, also designated SEQ ID:255.

Another function of GAM8358 is therefore inhibition of LOC148189 (Accession XP_086087.1). Accordingly, utilities of GAM8358 include diagnosis, prevention and treatment of diseases and clinical conditions associated with LOC148189.

LOC148930 (Accession XP_086369.1) is another GAM8358 target gene, herein designated TARGET GENE. LOC148930 BINDING SITE is a target binding site found in the 3' untranslated region of mRNA encoded by LOC148930, corresponding to a target binding site such as BINDING SITE I, BINDING SITE II or BINDING SITE III of FIG. 8. Table 4 illustrates the complementarity of the nucleotide sequences of LOC148930 BINDING SITE, designated SEQ ID:8018, to the nucleotide sequence of GAM8358 RNA, herein designated GAM RNA, also designated SEQ ID:255.

Another function of GAM8358 is therefore inhibition of LOC148930 (Accession XP_086369.1). Accordingly, utilities of GAM8358 include diagnosis, prevention and treatment of diseases and clinical conditions associated with LOC148930.

LOC149271 (Accession XP_086475.1) is another GAM8358 target gene, herein designated TARGET GENE. LOC149271 BINDING SITE is a target binding site found in the 3' untranslated region of mRNA encoded by LOC149271, corresponding to a target binding site such as BINDING SITE I, BINDING SITE II or BINDING SITE III of FIG. 8. Table 4 illustrates the complementarity of the nucleotide sequences of LOC149271 BINDING SITE, designated SEQ ID:1162, to the nucleotide sequence of GAM8358 RNA, herein designated GAM RNA, also designated SEQ ID:255.

Another function of GAM8358 is therefore inhibition of LOC149271 (Accession XP_086475.1). Accordingly, utilities of GAM8358 include diagnosis, prevention and treatment of diseases and clinical conditions associated with LOC149271.

LOC149448 (Accession XP_097642.1) is another GAM8358 target gene, herein designated TARGET GENE. LOC149448 BINDING SITE is a target binding site found in the 3' untranslated region of mRNA encoded by LOC149448, corresponding to a target binding site such as BINDING SITE I, BINDING SITE II or BINDING SITE III of FIG. 8. Table 4 illustrates the complementarity of the nucleotide sequences of LOC149448 BINDING SITE, designated SEQ ID:3902, to the nucleotide sequence of GAM8358 RNA, herein designated GAM RNA, also designated SEQ ID:255.

Another function of GAM8358 is therefore inhibition of LOC149448 (Accession XP_097642.1). Accordingly, utilities of GAM8358 include diagnosis, prevention and treatment of diseases and clinical conditions associated with LOC149448.

LOC149464 (Accession XP_097645.1) is another GAM8358 target gene, herein designated TARGET GENE. LOC149464 BINDING SITE is a target binding site found in the 5' untranslated region of mRNA encoded by LOC149464, corresponding to a target binding site such as BINDING SITE I, BINDING SITE II or BINDING SITE III of FIG. 8. Table 4 illustrates the complementarity of the nucleotide sequences of LOC149464 BINDING SITE, designated SEQ ID:19340, to the nucleotide sequence of GAM8358 RNA, herein designated GAM RNA, also designated SEQ ID:255.

Another function of GAM8358 is therefore inhibition of LOC149464 (Accession XP_097645.1). Accordingly, utilities of GAM8358 include diagnosis, prevention and treatment of diseases and clinical conditions associated with LOC149464.

LOC150946 (Accession XP_097977.2) is another GAM8358 target gene, herein designated TARGET GENE. LOC150946 BINDING SITE is a target binding site found in the 3' untranslated region of mRNA encoded by LOC150946, corresponding to a target binding site such as BINDING SITE I, BINDING SITE II or BINDING SITE III of FIG. 8. Table 4 illustrates the complementarity of the nucleotide sequences of LOC150946 BINDING SITE, designated SEQ ID:12653, to the nucleotide sequence of GAM8358 RNA, herein designated GAM RNA, also designated SEQ ID:255.

Another function of GAM8358 is therefore inhibition of LOC150946 (Accession XP_097977.2). Accordingly, utilities of GAM8358 include diagnosis, prevention and treatment of diseases and clinical conditions associated with LOC150946.

LOC151154 (Accession XP_098008.1) is another GAM8358 target gene, herein designated TARGET GENE. LOC151154 BINDING SITE is a target binding site found in the 5' untranslated region of mRNA encoded by LOC151154, corresponding to a target binding site such as BINDING SITE I, BINDING SITE II or BINDING SITE III of FIG. 8. Table 4 illustrates the complementarity of the nucleotide sequences of LOC151154 BINDING SITE, designated SEQ ID:12623, to the nucleotide sequence of GAM8358 RNA, herein designated GAM RNA, also designated SEQ ID:255.

Another function of GAM8358 is therefore inhibition of LOC151154 (Accession XP_098008.1). Accordingly, utilities of GAM8358 include diagnosis, prevention and treatment of diseases and clinical conditions associated with LOC151154.

LOC152190 (Accession XP_045692.1) is another GAM8358 target gene, herein designated TARGET GENE. LOC152190 BINDING SITE is a target binding site found in the 5' untranslated region of mRNA encoded by LOC152190, corresponding to a target binding site such as BINDING SITE I, BINDING SITE II or BINDING SITE III of FIG. 8. Table 4 illustrates the complementarity of the nucleotide sequences of LOC152190 BINDING SITE, designated SEQ ID:9697, to the nucleotide sequence of GAM8358 RNA, herein designated GAM RNA, also designated SEQ ID:255.

Another function of GAM8358 is therefore inhibition of LOC152190 (Accession XP_045692.1). Accordingly, utilities of GAM8358 include diagnosis, prevention and treatment of diseases and clinical conditions associated with LOC152190.

LOC154877 (Accession XP_098626.1) is another GAM8358 target gene, herein designated TARGET GENE. LOC154877 BINDING SITE is a target binding site found in the 3' untranslated region of mRNA encoded by LOC154877, corresponding to a target binding site such as BINDING SITE I, BINDING SITE II or BINDING SITE III of FIG. 8. Table 4 illustrates the complementarity of the nucleotide sequences of LOC154877 BINDING SITE, designated SEQ ID:12900, to the nucleotide sequence of GAM8358 RNA, herein designated GAM RNA, also designated SEQ ID:255.

Another function of GAM8358 is therefore inhibition of LOC154877 (Accession XP_098626.1). Accordingly, utilities of GAM8358 include diagnosis, prevention and treatment of diseases and clinical conditions associated with LOC154877.

LOC157381 (Accession XP_098754.5) is another GAM8358 target gene, herein designated TARGET GENE. LOC157381 BINDING SITE1 and LOC157381 BINDING SITE2 are target binding sites found in untranslated regions of mRNA encoded by LOC157381, corresponding to target binding sites such as BINDING SITE I, BINDING SITE II or BINDING SITE III of FIG. 8. Table 4 illustrates the complementarity of the nucleotide sequences of LOC157381 BINDING SITE1 and LOC157381 BINDING SITE2, designated SEQ ID:11073 and SEQ ID:13288 respectively, to the nucleotide sequence of GAM8358 RNA, herein designated GAM RNA, also designated SEQ ID:255.

Another function of GAM8358 is therefore inhibition of LOC157381 (Accession XP_098754.5). Accordingly, utilities of GAM8358 include diagnosis, prevention and treatment of diseases and clinical conditions associated with LOC157381.

LOC157531 (Accession XP_212210.1) is another GAM8358 target gene, herein designated TARGET GENE. LOC157531 BINDING SITE is a target binding site found in the 5' untranslated region of multiple transcripts of mRNA encoded by LOC157531, corresponding to a target binding site such as BINDING SITE I, BINDING SITE II or BINDING SITE III of FIG. 8. Table 4 illustrates the complementarity of the nucleotide sequences of LOC157531 BINDING SITE, designated SEQ ID:8038, to the nucleotide sequence of GAM8358 RNA, herein designated GAM RNA, also designated SEQ ID:255.

Another function of GAM8358 is therefore inhibition of LOC157531 (Accession XP_212210.1). Accordingly, utilities of GAM8358 include diagnosis, prevention and treatment of diseases and clinical conditions associated with LOC157531.

LOC158318 (Accession XP_098925.7) is another GAM8358 target gene, herein designated TARGET GENE. LOC158318 BINDING SITE is a target binding site found in the 3' untranslated region of mRNA encoded by LOC158318, corresponding to a target binding site such as BINDING SITE I, BINDING SITE II or BINDING SITE III of FIG. 8. Table 4 illustrates the complementarity of the nucleotide sequences of LOC158318 BINDING SITE, designated SEQ ID:10509, to the nucleotide sequence of GAM8358 RNA, herein designated GAM RNA, also designated SEQ ID:255.

Another function of GAM8358 is therefore inhibition of LOC158318 (Accession XP_098925.7). Accordingly, utilities of GAM8358 include diagnosis, prevention and treatment of diseases and clinical conditions associated with LOC158318.

LOC164714 (Accession XP_104657.1) is another GAM8358 target gene, herein designated TARGET GENE. LOC164714 BINDING SITE is a target binding site found in the 5' untranslated region of mRNA encoded by LOC164714, corresponding to a target binding site such as BINDING SITE I, BINDING SITE II or BINDING SITE III of FIG. 8. Table 4 illustrates the complementarity of the nucleotide sequences of LOC164714 BINDING SITE, designated SEQ ID:3977, to the nucleotide sequence of GAM8358 RNA, herein designated GAM RNA, also designated SEQ ID:255.

Another function of GAM8358 is therefore inhibition of LOC164714 (Accession XP_104657.1). Accordingly, utilities of GAM8358 include diagnosis, prevention and treatment of diseases and clinical conditions associated with LOC164714.

LOC164729 (Accession XP_092976.1) is another GAM8358 target gene, herein designated TARGET GENE. LOC164729 BINDING SITE is a target binding site found in the 3' untranslated region of mRNA encoded by LOC164729, corresponding to a target binding site such as BINDING SITE I, BINDING SITE II or BINDING SITE III of FIG. 8. Table 4 illustrates the complementarity of the nucleotide sequences of LOC164729 BINDING SITE, designated SEQ ID:1980, to the nucleotide sequence of GAM8358 RNA, herein designated GAM RNA, also designated SEQ ID:255.

Another function of GAM8358 is therefore inhibition of LOC164729 (Accession XP_092976.1). Accordingly, utilities of GAM8358 include diagnosis, prevention and treatment of diseases and clinical conditions associated with LOC164729.

LOC170371 (Accession XP_096316.5) is another GAM8358 target gene, herein designated TARGET GENE. LOC170371 BINDING SITE is a target binding site found in the 3' untranslated region of mRNA encoded by LOC170371, corresponding to a target binding site such as BINDING SITE I, BINDING SITE II or BINDING SITE III of FIG. 8. Table 4 illustrates the complementarity of the nucleotide sequences of LOC170371 BINDING SITE, designated SEQ ID:3757, to the nucleotide sequence of GAM8358 RNA, herein designated GAM RNA, also designated SEQ ID:255.

Another function of GAM8358 is therefore inhibition of LOC170371 (Accession XP_096316.5). Accordingly, utilities of GAM8358 include diagnosis, prevention and treatment of diseases and clinical conditions associated with LOC170371.

LOC170394 (Accession XP_096329.1) is another GAM8358 target gene, herein designated TARGET GENE. LOC170394 BINDING SITE is a target binding site found in the 5' untranslated region of mRNA encoded by LOC170394, corresponding to a target binding site such as BINDING SITE I, BINDING SITE II or BINDING SITE III of FIG. 8. Table 4 illustrates the complementarity of the nucleotide sequences of LOC170394 BINDING SITE, designated SEQ ID:20058, to the nucleotide sequence of GAM8358 RNA, herein designated GAM RNA, also designated SEQ ID:255.

Another function of GAM8358 is therefore inhibition of LOC170394 (Accession XP_096329.1). Accordingly, utilities of GAM8358 include diagnosis, prevention and treatment of diseases and clinical conditions associated with LOC170394.

LOC196996 (Accession XP_113796.1) is another GAM8358 target gene, herein designated TARGET GENE. LOC196996 BINDING SITE is a target binding site found in the 3' untranslated region of mRNA encoded by LOC196996, corresponding to a target binding site such as BINDING SITE I, BINDING SITE II or BINDING SITE III of FIG. 8. Table 4 illustrates the complementarity of the nucleotide sequences of LOC196996 BINDING SITE, designated SEQ ID:10671, to the nucleotide sequence of GAM8358 RNA, herein designated GAM RNA, also designated SEQ ID:255.

Another function of GAM8358 is therefore inhibition of LOC196996 (Accession XP_113796.1). Accordingly, utilities of GAM8358 include diagnosis, prevention and treatment of diseases and clinical conditions associated with LOC196996.

LOC200312 (Accession XP_117224.3) is another GAM8358 target gene, herein designated TARGET GENE. LOC200312 BINDING SITE is a target binding site found in the 3' untranslated region of mRNA encoded by LOC200312, corresponding to a target binding site such as BINDING SITE I, BINDING SITE II or BINDING SITE III of FIG. 8. Table 4 illustrates the complementarity of the nucleotide sequences of LOC200312 BINDING SITE, designated SEQ ID:4936, to the nucleotide sequence of GAM8358 RNA, herein designated GAM RNA, also designated SEQ ID:255.

Another function of GAM8358 is therefore inhibition of LOC200312 (Accession XP_117224.3). Accordingly, utilities of GAM8358 include diagnosis, prevention and treatment of diseases and clinical conditions associated with LOC200312.

LOC221122 (Accession XP_167867.1) is another GAM8358 target gene, herein designated TARGET GENE. LOC221122 BINDING SITE is a target binding site found in the 3' untranslated region of mRNA encoded by LOC221122, corresponding to a target binding site such as BINDING SITE I, BINDING SITE II or BINDING SITE III of FIG. 8. Table 4 illustrates the complementarity of the nucleotide sequences of LOC221122 BINDING SITE, designated SEQ ID:14736, to the nucleotide sequence of GAM8358 RNA, herein designated GAM RNA, also designated SEQ ID:255.

Another function of GAM8358 is therefore inhibition of LOC221122 (Accession XP_167867.1). Accordingly, utilities of GAM8358 include diagnosis, prevention and treatment of diseases and clinical conditions associated with LOC221122.

LOC253216 (Accession XP_170765.2) is another GAM8358 target gene, herein designated TARGET GENE. LOC253216 BINDING SITE is a target binding site found in the 3' untranslated region of mRNA encoded by LOC253216, corresponding to a target binding site such as BINDING SITE I, BINDING SITE II or BINDING SITE III of FIG. 8. Table 4 illustrates the complementarity of the nucleotide sequences of LOC253216 BINDING SITE, designated SEQ ID:16497, to the nucleotide sequence of GAM8358 RNA, herein designated GAM RNA, also designated SEQ ID:255.

Another function of GAM8358 is therefore inhibition of LOC253216 (Accession XP_170765.2). Accordingly, utilities of GAM8358 include diagnosis, prevention and treatment of diseases and clinical conditions associated with LOC253216.

LOC256614 (Accession XP_172864.1) is another GAM8358 target gene, herein designated TARGET GENE. LOC256614 BINDING SITE is a target binding site found in the 3' untranslated region of mRNA encoded by LOC256614, corresponding to a target binding site such as BINDING SITE I, BINDING SITE II or BINDING SITE III of FIG. 8. Table 4 illustrates the complementarity of the nucleotide sequences of LOC256614 BINDING SITE, designated SEQ ID:7454, to the nucleotide sequence of GAM8358 RNA, herein designated GAM RNA, also designated SEQ ID:255.

Another function of GAM8358 is therefore inhibition of LOC256614 (Accession XP_172864.1). Accordingly, utilities of GAM8358 include diagnosis, prevention and treatment of diseases and clinical conditions associated with LOC256614.

LOC256949 (Accession XP_170882.3) is another GAM8358 target gene, herein designated TARGET GENE. LOC256949 BINDING SITE is a target binding site found in the 3' untranslated region of mRNA encoded by LOC256949, corresponding to a target binding site such as BINDING SITE I, BINDING SITE II or BINDING SITE III of FIG. 8. Table 4 illustrates the complementarity of the nucleotide sequences of LOC256949 BINDING SITE, designated SEQ ID:1184, to the nucleotide sequence of GAM8358 RNA, herein designated GAM RNA, also designated SEQ ID:255.

Another function of GAM8358 is therefore inhibition of LOC256949 (Accession XP_170882.3). Accordingly, utilities of GAM8358 include diagnosis, prevention and treatment of diseases and clinical conditions associated with LOC256949.

LOC282972 (Accession XP_210837.1) is another GAM8358 target gene, herein designated TARGET GENE. LOC282972 BINDING SITE is a target binding site found in the 3' untranslated region of mRNA encoded by LOC282972, corresponding to a target binding site such as BINDING SITE I, BINDING SITE II or BINDING SITE III of FIG. 8. Table 4 illustrates the complementarity of the nucleotide sequences of LOC282972 BINDING SITE, designated SEQ ID:8517, to the nucleotide sequence of GAM8358 RNA, herein designated GAM RNA, also designated SEQ ID:255.

Another function of GAM8358 is therefore inhibition of LOC282972 (Accession XP_210837.1). Accordingly, utilities of GAM8358 include diagnosis, prevention and treatment of diseases and clinical conditions associated with LOC282972.

LOC282997 (Accession XP_208473.1) is another GAM8358 target gene, herein designated TARGET GENE. LOC282997 BINDING SITE is a target binding site found in the 3' untranslated region of mRNA encoded by LOC282997, corresponding to a target binding site such as BINDING SITE I, BINDING SITE II or BINDING SITE III of FIG. 8. Table 4 illustrates the complementarity of the nucleotide sequences of LOC282997 BINDING SITE, designated SEQ ID:17627, to the nucleotide sequence of GAM8358 RNA, herein designated GAM RNA, also designated SEQ ID:255.

Another function of GAM8358 is therefore inhibition of LOC282997 (Accession XP_208473.1). Accordingly, utilities of GAM8358 include diagnosis, prevention and treatment of diseases and clinical conditions associated with LOC282997.

LOC283166 (Accession XP_210906.1) is another GAM8358 target gene, herein designated TARGET GENE. LOC283166 BINDING SITE is a target binding site found in the 3' untranslated region of mRNA encoded by LOC283166, corresponding to a target binding site such as BINDING SITE I, BINDING SITE II or BINDING SITE III of FIG. 8. Table 4 illustrates the complementarity of the nucleotide sequences of LOC283166 BINDING SITE, designated SEQ ID:17655, to the nucleotide sequence of GAM8358 RNA, herein designated GAM RNA, also designated SEQ ID:255.

Another function of GAM8358 is therefore inhibition of LOC283166 (Accession XP_210906.1). Accordingly, utilities of GAM8358 include diagnosis, prevention and treatment of diseases and clinical conditions associated with LOC283166.

LOC283357 (Accession XP_210991.1) is another GAM8358 target gene, herein designated TARGET GENE.

LOC283357 BINDING SITE is a target binding site found in the 3' untranslated region of mRNA encoded by LOC283357, corresponding to a target binding site such as BINDING SITE I, BINDING SITE II or BINDING SITE III of FIG. 8. Table 4 illustrates the complementarity of the nucleotide sequences of LOC283357 BINDING SITE, designated SEQ ID:13210, to the nucleotide sequence of GAM8358 RNA, herein designated GAM RNA, also designated SEQ ID:255.

Another function of GAM8358 is therefore inhibition of LOC283357 (Accession XP_210991.1). Accordingly, utilities of GAM8358 include diagnosis, prevention and treatment of diseases and clinical conditions associated with LOC283357.

LOC283437 (Accession XP_211038.1) is another GAM8358 target gene, herein designated TARGET GENE. LOC283437 BINDING SITE is a target binding site found in the 3' untranslated region of mRNA encoded by LOC283437, corresponding to a target binding site such as BINDING SITE I, BINDING SITE II or BINDING SITE III of FIG. 8. Table 4 illustrates the complementarity of the nucleotide sequences of LOC283437 BINDING SITE, designated SEQ ID:3817, to the nucleotide sequence of GAM8358 RNA, herein designated GAM RNA, also designated SEQ ID:255.

Another function of GAM8358 is therefore inhibition of LOC283437 (Accession XP_211038.1). Accordingly, utilities of GAM8358 include diagnosis, prevention and treatment of diseases and clinical conditions associated with LOC283437.

LOC283584 (Accession XP_211108.1) is another GAM8358 target gene, herein designated TARGET GENE. LOC283584 BINDING SITE is a target binding site found in the 3' untranslated region of mRNA encoded by LOC283584, corresponding to a target binding site such as BINDING SITE I, BINDING SITE II or BINDING SITE III of FIG. 8. Table 4 illustrates the complementarity of the nucleotide sequences of LOC283584 BINDING SITE, designated SEQ ID:1675, to the nucleotide sequence of GAM8358 RNA, herein designated GAM RNA, also designated SEQ ID:255.

Another function of GAM8358 is therefore inhibition of LOC283584 (Accession XP_211108.1). Accordingly, utilities of GAM8358 include diagnosis, prevention and treatment of diseases and clinical conditions associated with LOC283584.

LOC283816 (Accession XP_208859.1) is another GAM8358 target gene, herein designated TARGET GENE. LOC283816 BINDING SITE is a target binding site found in the 5' untranslated region of mRNA encoded by LOC283816, corresponding to a target binding site such as BINDING SITE I, BINDING SITE II or BINDING SITE III of FIG. 8. Table 4 illustrates the complementarity of the nucleotide sequences of LOC283816 BINDING SITE, designated SEQ ID:4085, to the nucleotide sequence of GAM8358 RNA, herein designated GAM RNA, also designated SEQ ID:255.

Another function of GAM8358 is therefore inhibition of LOC283816 (Accession XP_208859.1). Accordingly, utilities of GAM8358 include diagnosis, prevention and treatment of diseases and clinical conditions associated with LOC283816.

LOC283908 (Accession XP_211252.3) is another GAM8358 target gene, herein designated TARGET GENE. LOC283908 BINDING SITE is a target binding site found in the 3' untranslated region of mRNA encoded by LOC283908, corresponding to a target binding site such as BINDING SITE I, BINDING SITE II or BINDING SITE III of FIG. 8. Table 4 illustrates the complementarity of the nucleotide sequences of LOC283908 BINDING SITE, designated SEQ ID:3468, to the nucleotide sequence of GAM8358 RNA, herein designated GAM RNA, also designated SEQ ID:255.

Another function of GAM8358 is therefore inhibition of LOC283908 (Accession XP_211252.3). Accordingly, utilities of GAM8358 include diagnosis, prevention and treatment of diseases and clinical conditions associated with LOC283908.

LOC284113 (Accession XP_209021.1) is another GAM8358 target gene, herein designated TARGET GENE. LOC284113 BINDING SITE is a target binding site found in the 5' untranslated region of mRNA encoded by LOC284113, corresponding to a target binding site such as BINDING SITE I, BINDING SITE II or BINDING SITE III of FIG. 8. Table 4 illustrates the complementarity of the nucleotide sequences of LOC284113 BINDING SITE, designated SEQ ID:9360, to the nucleotide sequence of GAM8358 RNA, herein designated GAM RNA, also designated SEQ ID:255.

Another function of GAM8358 is therefore inhibition of LOC284113 (Accession XP_209021.1). Accordingly, utilities of GAM8358 include diagnosis, prevention and treatment of diseases and clinical conditions associated with LOC284113.

LOC284167 (Accession XP_208171.1) is another GAM8358 target gene, herein designated TARGET GENE. LOC284167 BINDING SITE is a target binding site found in the 5' untranslated region of mRNA encoded by LOC284167, corresponding to a target binding site such as BINDING SITE I, BINDING SITE II or BINDING SITE III of FIG. 8. Table 4 illustrates the complementarity of the nucleotide sequences of LOC284167 BINDING SITE, designated SEQ ID:15015, to the nucleotide sequence of GAM8358 RNA, herein designated GAM RNA, also designated SEQ ID:255.

Another function of GAM8358 is therefore inhibition of LOC284167 (Accession XP_208171.1). Accordingly, utilities of GAM8358 include diagnosis, prevention and treatment of diseases and clinical conditions associated with LOC284167.

LOC284214 (Accession XP_302709.1) is another GAM8358 target gene, herein designated TARGET GENE. LOC284214 BINDING SITE is a target binding site found in the 5' untranslated region of mRNA encoded by LOC284214, corresponding to a target binding site such as BINDING SITE I, BINDING SITE II or BINDING SITE III of FIG. 8. Table 4 illustrates the complementarity of the nucleotide sequences of LOC284214 BINDING SITE, designated SEQ ID:5281, to the nucleotide sequence of GAM8358 RNA, herein designated GAM RNA, also designated SEQ ID:255.

Another function of GAM8358 is therefore inhibition of LOC284214 (Accession XP_302709.1). Accordingly, utilities of GAM8358 include diagnosis, prevention and treatment of diseases and clinical conditions associated with LOC284214.

LOC284297 (Accession XP_209112.1) is another GAM8358 target gene, herein designated TARGET GENE. LOC284297 BINDING SITE is a target binding site found in the 5' untranslated region of mRNA encoded by LOC284297, corresponding to a target binding site such as BINDING SITE I, BINDING SITE II or BINDING SITE III of FIG. 8. Table 4 illustrates the complementarity of the nucleotide sequences of LOC284297 BINDING SITE, designated SEQ ID:2290, to the nucleotide sequence of GAM8358 RNA, herein designated GAM RNA, also designated SEQ ID:255.

Another function of GAM8358 is therefore inhibition of LOC284297 (Accession XP_209112.1). Accordingly, utilities of GAM8358 include diagnosis, prevention and treatment of diseases and clinical conditions associated with LOC284297.

LOC284360 (Accession XP_211433.1) is another GAM8358 target gene, herein designated TARGET GENE. LOC284360 BINDING SITE is a target binding site found in the 5' untranslated region of mRNA encoded by LOC284360, corresponding to a target binding site such as BINDING SITE I, BINDING SITE II or BINDING SITE III of FIG. 8. Table 4 illustrates the complementarity of the nucleotide sequences of LOC284360 BINDING SITE, designated SEQ ID:6189, to the nucleotide sequence of GAM8358 RNA, herein designated GAM RNA, also designated SEQ ID:255.

Another function of GAM8358 is therefore inhibition of LOC284360 (Accession XP_211433.1). Accordingly, utilities of GAM8358 include diagnosis, prevention and treatment of diseases and clinical conditions associated with LOC284360.

LOC284515 (Accession XP_208210.1) is another GAM8358 target gene, herein designated TARGET GENE. LOC284515 BINDING SITE is a target binding site found in the 3' untranslated region of mRNA encoded by LOC284515, corresponding to a target binding site such as BINDING SITE I, BINDING SITE II or BINDING SITE III of FIG. 8. Table 4 illustrates the complementarity of the nucleotide sequences of LOC284515 BINDING SITE, designated SEQ ID:1267, to the nucleotide sequence of GAM8358 RNA, herein designated GAM RNA, also designated SEQ ID:255.

Another function of GAM8358 is therefore inhibition of LOC284515 (Accession XP_208210.1). Accordingly, utilities of GAM8358 include diagnosis, prevention and treatment of diseases and clinical conditions associated with LOC284515.

LOC284541 (Accession XP_208213.1) is another GAM8358 target gene, herein designated TARGET GENE. LOC284541 BINDING SITE is a target binding site found in the 5' untranslated region of mRNA encoded by LOC284541, corresponding to a target binding site such as BINDING SITE I, BINDING SITE II or BINDING SITE III of FIG. 8. Table 4 illustrates the complementarity of the nucleotide sequences of LOC284541 BINDING SITE, designated SEQ ID:13630, to the nucleotide sequence of GAM8358 RNA, herein designated GAM RNA, also designated SEQ ID:255.

Another function of GAM8358 is therefore inhibition of LOC284541 (Accession XP_208213.1). Accordingly, utilities of GAM8358 include diagnosis, prevention and treatment of diseases and clinical conditions associated with LOC284541.

LOC284613 (Accession XP_209289.1) is another GAM8358 target gene, herein designated TARGET GENE. LOC284613 BINDING SITE is a target binding site found in the 3' untranslated region of mRNA encoded by LOC284613, corresponding to a target binding site such as BINDING SITE I, BINDING SITE II or BINDING SITE III of FIG. 8. Table 4 illustrates the complementarity of the nucleotide sequences of LOC284613 BINDING SITE, designated SEQ ID:7866, to the nucleotide sequence of GAM8358 RNA, herein designated GAM RNA, also designated SEQ ID:255.

Another function of GAM8358 is therefore inhibition of LOC284613 (Accession XP_209289.1). Accordingly, utilities of GAM8358 include diagnosis, prevention and treatment of diseases and clinical conditions associated with LOC284613.

LOC284647 (Accession XP_211569.1) is another GAM8358 target gene, herein designated TARGET GENE. LOC284647 BINDING SITE is a target binding site found in the 3' untranslated region of mRNA encoded by LOC284647, corresponding to a target binding site such as BINDING SITE I, BINDING SITE II or BINDING SITE III of FIG. 8. Table 4 illustrates the complementarity of the nucleotide sequences of LOC284647 BINDING SITE, designated SEQ ID:8597, to the nucleotide sequence of GAM8358 RNA, herein designated GAM RNA, also designated SEQ ID:255.

Another function of GAM8358 is therefore inhibition of LOC284647 (Accession XP_211569.1). Accordingly, utilities of GAM8358 include diagnosis, prevention and treatment of diseases and clinical conditions associated with LOC284647.

LOC284691 (Accession XP_209321.1) is another GAM8358 target gene, herein designated TARGET GENE. LOC284691 BINDING SITE is a target binding site found in the 3' untranslated region of mRNA encoded by LOC284691, corresponding to a target binding site such as BINDING SITE I, BINDING SITE II or BINDING SITE III of FIG. 8. Table 4 illustrates the complementarity of the nucleotide sequences of LOC284691 BINDING SITE, designated SEQ ID:19474, to the nucleotide sequence of GAM8358 RNA, herein designated GAM RNA, also designated SEQ ID:255.

Another function of GAM8358 is therefore inhibition of LOC284691 (Accession XP_209321.1). Accordingly, utilities of GAM8358 include diagnosis, prevention and treatment of diseases and clinical conditions associated with LOC284691.

LOC284693 (Accession XP_209323.1) is another GAM8358 target gene, herein designated TARGET GENE. LOC284693 BINDING SITE is a target binding site found in the 5' untranslated region of mRNA encoded by LOC284693, corresponding to a target binding site such as BINDING SITE I, BINDING SITE II or BINDING SITE III of FIG. 8. Table 4 illustrates the complementarity of the nucleotide sequences of LOC284693 BINDING SITE, designated SEQ ID:8248, to the nucleotide sequence of GAM8358 RNA, herein designated GAM RNA, also designated SEQ ID:255.

Another function of GAM8358 is therefore inhibition of LOC284693 (Accession XP_209323.1). Accordingly, utilities of GAM8358 include diagnosis, prevention and treatment of diseases and clinical conditions associated with LOC284693.

LOC284731 (Accession XP_211604.2) is another GAM8358 target gene, herein designated TARGET GENE. LOC284731 BINDING SITE is a target binding site found in the 3' untranslated region of mRNA encoded by LOC284731, corresponding to a target binding site such as BINDING SITE I, BINDING SITE II or BINDING SITE III of FIG. 8. Table 4 illustrates the complementarity of the nucleotide sequences of LOC284731 BINDING SITE, designated SEQ ID:10087, to the nucleotide sequence of GAM8358 RNA, herein designated GAM RNA, also designated SEQ ID:255.

Another function of GAM8358 is therefore inhibition of LOC284731 (Accession XP_211604.2). Accordingly, utilities of GAM8358 include diagnosis, prevention and treatment of diseases and clinical conditions associated with LOC284731.

LOC284732 (Accession XP_211608.1) is another GAM8358 target gene, herein designated TARGET GENE. LOC284732 BINDING SITE is a target binding site found in the 5' untranslated region of mRNA encoded by LOC284732, corresponding to a target binding site such as BINDING SITE I, BINDING SITE II or BINDING SITE III of FIG. 8. Table 4 illustrates the complementarity of the nucleotide sequences of LOC284732 BINDING SITE, designated SEQ ID:19911, to the nucleotide sequence of GAM8358 RNA, herein designated GAM RNA, also designated SEQ ID:255.

Another function of GAM8358 is therefore inhibition of LOC284732 (Accession XP_211608.1). Accordingly, utilities of GAM8358 include diagnosis, prevention and treatment of diseases and clinical conditions associated with LOC284732.

LOC284805 (Accession XP_209371.1) is another GAM8358 target gene, herein designated TARGET GENE. LOC284805 BINDING SITE is a target binding site found in the 5' untranslated region of mRNA encoded by LOC284805, corresponding to a target binding site such as BINDING SITE I, BINDING SITE II or BINDING SITE III of FIG. 8. Table 4 illustrates the complementarity of the nucleotide sequences of LOC284805 BINDING SITE, designated SEQ ID:1280, to the nucleotide sequence of GAM8358 RNA, herein designated GAM RNA, also designated SEQ ID:255.

Another function of GAM8358 is therefore inhibition of LOC284805 (Accession XP_209371.1). Accordingly, utilities of GAM8358 include diagnosis, prevention and treatment of diseases and clinical conditions associated with LOC284805.

LOC284899 (Accession XP_211680.1) is another GAM8358 target gene, herein designated TARGET GENE. LOC284899 BINDING SITE is a target binding site found in the 3' untranslated region of mRNA encoded by LOC284899, corresponding to a target binding site such as BINDING SITE I, BINDING SITE II or BINDING SITE III of FIG. 8. Table 4 illustrates the complementarity of the nucleotide sequences of LOC284899 BINDING SITE, designated SEQ ID:9090, to the nucleotide sequence of GAM8358 RNA, herein designated GAM RNA, also designated SEQ ID:255.

Another function of GAM8358 is therefore inhibition of LOC284899 (Accession XP_211680.1). Accordingly, utilities of GAM8358 include diagnosis, prevention and treatment of diseases and clinical conditions associated with LOC284899.

LOC285036 (Accession XP_210798.1) is another GAM8358 target gene, herein designated TARGET GENE. LOC285036 BINDING SITE is a target binding site found in the 3' untranslated region of mRNA encoded by LOC285036, corresponding to a target binding site such as BINDING SITE I, BINDING SITE II or BINDING SITE III of FIG. 8. Table 4 illustrates the complementarity of the nucleotide sequences of LOC285036 BINDING SITE, designated SEQ ID:5411, to the nucleotide sequence of GAM8358 RNA, herein designated GAM RNA, also designated SEQ ID:255.

Another function of GAM8358 is therefore inhibition of LOC285036 (Accession XP_210798.1). Accordingly, utilities of GAM8358 include diagnosis, prevention and treatment of diseases and clinical conditions associated with LOC285036.

LOC285392 (Accession XP_211879.1) is another GAM8358 target gene, herein designated TARGET GENE. LOC285392 BINDING SITE is a target binding site found in the 5' untranslated region of mRNA encoded by LOC285392, corresponding to a target binding site such as BINDING SITE I, BINDING SITE II or BINDING SITE III of FIG. 8. Table 4 illustrates the complementarity of the nucleotide sequences of LOC285392 BINDING SITE, designated SEQ ID:19896, to the nucleotide sequence of GAM8358 RNA, herein designated GAM RNA, also designated SEQ ID:255.

Another function of GAM8358 is therefore inhibition of LOC285392 (Accession XP_211879.1). Accordingly, utilities of GAM8358 include diagnosis, prevention and treatment of diseases and clinical conditions associated with LOC285392.

LOC285397 (Accession XP_211876.1) is another GAM8358 target gene, herein designated TARGET GENE. LOC285397 BINDING SITE is a target binding site found in the 5' untranslated region of mRNA encoded by LOC285397, corresponding to a target binding site such as BINDING SITE I, BINDING SITE II or BINDING SITE III of FIG. 8. Table 4 illustrates the complementarity of the nucleotide sequences of LOC285397 BINDING SITE, designated SEQ ID:19532, to the nucleotide sequence of GAM8358 RNA, herein designated GAM RNA, also designated SEQ ID:255.

Another function of GAM8358 is therefore inhibition of LOC285397 (Accession XP_211876.1). Accordingly, utilities of GAM8358 include diagnosis, prevention and treatment of diseases and clinical conditions associated with LOC285397.

LOC285478 (Accession XP_211909.1) is another GAM8358 target gene, herein designated TARGET GENE. LOC285478 BINDING SITE is a target binding site found in the 3' untranslated region of mRNA encoded by LOC285478, corresponding to a target binding site such as BINDING SITE I, BINDING SITE II or BINDING SITE III of FIG. 8. Table 4 illustrates the complementarity of the nucleotide sequences of LOC285478 BINDING SITE, designated SEQ ID:11311, to the nucleotide sequence of GAM8358 RNA, herein designated GAM RNA, also designated SEQ ID:255.

Another function of GAM8358 is therefore inhibition of LOC285478 (Accession XP_211909.1). Accordingly, utilities of GAM8358 include diagnosis, prevention and treatment of diseases and clinical conditions associated with LOC285478.

LOC285587 (Accession XP_211947.1) is another GAM8358 target gene, herein designated TARGET GENE. LOC285587 BINDING SITE is a target binding site found in the 3' untranslated region of mRNA encoded by LOC285587, corresponding to a target binding site such as BINDING SITE I, BINDING SITE II or BINDING SITE III of FIG. 8. Table 4 illustrates the complementarity of the nucleotide sequences of LOC285587 BINDING SITE, designated SEQ ID:18189, to the nucleotide sequence of GAM8358 RNA, herein designated GAM RNA, also designated SEQ ID:255.

Another function of GAM8358 is therefore inhibition of LOC285587 (Accession XP_211947.1). Accordingly, utilities of GAM8358 include diagnosis, prevention and treatment of diseases and clinical conditions associated with LOC285587.

LOC285602 (Accession XP_209676.1) is another GAM8358 target gene, herein designated TARGET GENE. LOC285602 BINDING SITE is a target binding site found in the 5' untranslated region of mRNA encoded by LOC285602, corresponding to a target binding site such as BINDING SITE I, BINDING SITE II or BINDING SITE III of FIG. 8. Table 4 illustrates the complementarity of the nucleotide sequences of LOC285602 BINDING SITE, designated SEQ ID:4457, to the nucleotide sequence of GAM8358 RNA, herein designated GAM RNA, also designated SEQ ID:255.

Another function of GAM8358 is therefore inhibition of LOC285602 (Accession XP_209676.1). Accordingly, utilities of GAM8358 include diagnosis, prevention and treatment of diseases and clinical conditions associated with LOC285602.

LOC285705 (Accession XP_209726.1) is another GAM8358 target gene, herein designated TARGET GENE. LOC285705 BINDING SITE is a target binding site found in the 3' untranslated region of mRNA encoded by LOC285705, corresponding to a target binding site such as BINDING SITE I, BINDING SITE II or BINDING SITE III of FIG. 8. Table 4 illustrates the complementarity of the nucleotide sequences of LOC285705 BINDING SITE, designated SEQ ID:13089, to the nucleotide sequence of GAM8358 RNA, herein designated GAM RNA, also designated SEQ ID:255.

Another function of GAM8358 is therefore inhibition of LOC285705 (Accession XP_209726.1). Accordingly, utilities of GAM8358 include diagnosis, prevention and treatment of diseases and clinical conditions associated with LOC285705.

LOC285762 (Accession XP_212011.1) is another GAM8358 target gene, herein designated TARGET GENE. LOC285762 BINDING SITE is a target binding site found in the 3' untranslated region of mRNA encoded by LOC285762, corresponding to a target binding site such as BINDING SITE I, BINDING SITE II or BINDING SITE III of FIG. 8. Table 4 illustrates the complementarity of the nucleotide sequences of LOC285762 BINDING SITE, designated SEQ ID:12096, to the nucleotide sequence of GAM8358 RNA, herein designated GAM RNA, also designated SEQ ID:255.

Another function of GAM8358 is therefore inhibition of LOC285762 (Accession XP_212011.1). Accordingly, utilities of GAM8358 include diagnosis, prevention and treatment of diseases and clinical conditions associated with LOC285762.

LOC285858 (Accession XP_212037.1) is another GAM8358 target gene, herein designated TARGET GENE. LOC285858 BINDING SITE1 and LOC285858 BINDING SITE2 are target binding sites found in untranslated regions of mRNA encoded by LOC285858, corresponding to target binding sites such as BINDING SITE I, BINDING SITE II or BINDING SITE III of FIG. 8. Table 4 illustrates the complementarity of the nucleotide sequences of LOC285858 BINDING SITE1 and LOC285858 BINDING SITE2, designated SEQ ID:4884 and SEQ ID:6422 respectively, to the nucleotide sequence of GAM8358 RNA, herein designated GAM RNA, also designated SEQ ID:255.

Another function of GAM8358 is therefore inhibition of LOC285858 (Accession XP_212037.1). Accordingly, utilities of GAM8358 include diagnosis, prevention and treatment of diseases and clinical conditions associated with LOC285858.

LOC285924 (Accession XP_209816.1) is another GAM8358 target gene, herein designated TARGET GENE. LOC285924 BINDING SITE is a target binding site found in the 3' untranslated region of mRNA encoded by LOC285924, corresponding to a target binding site such as BINDING SITE I, BINDING SITE II or BINDING SITE III of FIG. 8. Table 4 illustrates the complementarity of the nucleotide sequences of LOC285924 BINDING SITE, designated SEQ ID:7453, to the nucleotide sequence of GAM8358 RNA, herein designated GAM RNA, also designated SEQ ID:255.

Another function of GAM8358 is therefore inhibition of LOC285924 (Accession XP_209816.1). Accordingly, utilities of GAM8358 include diagnosis, prevention and treatment of diseases and clinical conditions associated with LOC285924.

LOC285931 (Accession NP_777609.1) is another GAM8358 target gene, herein designated TARGET GENE. LOC285931 BINDING SITE is a target binding site found in the 3' untranslated region of mRNA encoded by LOC285931, corresponding to a target binding site such as BINDING SITE I, BINDING SITE II or BINDING SITE III of FIG. 8. Table 4 illustrates the complementarity of the nucleotide sequences of LOC285931 BINDING SITE, designated SEQ ID:17650, to the nucleotide sequence of GAM8358 RNA, herein designated GAM RNA, also designated SEQ ID:255.

Another function of GAM8358 is therefore inhibition of LOC285931 (Accession NP_777609.1). Accordingly, utilities of GAM8358 include diagnosis, prevention and treatment of diseases and clinical conditions associated with LOC285931.

LOC285940 (Accession XP_208366.1) is another GAM8358 target gene, herein designated TARGET GENE. LOC285940 BINDING SITE is a target binding site found in the 5' untranslated region of mRNA encoded by LOC285940, corresponding to a target binding site such as BINDING SITE I, BINDING SITE II or BINDING SITE III of FIG. 8. Table 4 illustrates the complementarity of the nucleotide sequences of LOC285940 BINDING SITE, designated SEQ ID:13769, to the nucleotide sequence of GAM8358 RNA, herein designated GAM RNA, also designated SEQ ID:255.

Another function of GAM8358 is therefore inhibition of LOC285940 (Accession XP_208366.1). Accordingly, utilities of GAM8358 include diagnosis, prevention and treatment of diseases and clinical conditions associated with LOC285940.

LOC286016 (Accession XP_209853.1) is another GAM8358 target gene, herein designated TARGET GENE. LOC286016 BINDING SITE is a target binding site found in the 3' untranslated region of mRNA encoded by LOC286016, corresponding to a target binding site such as BINDING SITE I, BINDING SITE II or BINDING SITE III of FIG. 8. Table 4 illustrates the complementarity of the nucleotide sequences of LOC286016 BINDING SITE, designated SEQ ID:3955, to the nucleotide sequence of GAM8358 RNA, herein designated GAM RNA, also designated SEQ ID:255.

Another function of GAM8358 is therefore inhibition of LOC286016 (Accession XP_209853.1). Accordingly, utilities of GAM8358 include diagnosis, prevention and treatment of diseases and clinical conditions associated with LOC286016.

LOC286052 (Accession XP_212152.1) is another GAM8358 target gene, herein designated TARGET GENE. LOC286052 BINDING SITE1 and LOC286052 BINDING SITE2 are target binding sites found in untranslated regions of mRNA encoded by LOC286052, corresponding to target binding sites such as BINDING SITE I, BINDING SITE II or BINDING SITE III of FIG. 8. Table 4 illustrates the complementarity of the nucleotide sequences of LOC286052 BINDING SITE1 and LOC286052 BINDING SITE2, designated SEQ ID:4733 and SEQ ID:1344 respectively, to the nucleotide sequence of GAM8358 RNA, herein designated GAM RNA, also designated SEQ ID:255.

Another function of GAM8358 is therefore inhibition of LOC286052 (Accession XP_212152.1). Accordingly, utilities of GAM8358 include diagnosis, prevention and treatment of diseases and clinical conditions associated with LOC286052.

LOC286076 (Accession XP_209889.1) is another GAM8358 target gene, herein designated TARGET GENE. LOC286076 BINDING SITE is a target binding site found in the 3' untranslated region of mRNA encoded by LOC286076, corresponding to a target binding site such as BINDING SITE I, BINDING SITE II or BINDING SITE III of FIG. 8. Table 4 illustrates the complementarity of the nucleotide sequences of LOC286076 BINDING SITE, designated SEQ ID:10597, to the nucleotide sequence of GAM8358 RNA, herein designated GAM RNA, also designated SEQ ID:255.

Another function of GAM8358 is therefore inhibition of LOC286076 (Accession XP_209889.1). Accordingly, utilities of GAM8358 include diagnosis, prevention and treatment of diseases and clinical conditions associated with LOC286076.

LOC286078 (Accession XP_212163.1) is another GAM8358 target gene, herein designated TARGET GENE. LOC286078 BINDING SITE is a target binding site found in the 5' untranslated region of mRNA encoded by LOC286078, corresponding to a target binding site such as BINDING SITE I, BINDING SITE II or BINDING SITE III of FIG. 8. Table 4 illustrates the complementarity of the nucleotide sequences of LOC286078 BINDING SITE, designated SEQ ID:6499, to the nucleotide sequence of GAM8358 RNA, herein designated GAM RNA, also designated SEQ ID:255.

Another function of GAM8358 is therefore inhibition of LOC286078 (Accession XP_212163.1). Accordingly, utilities of GAM8358 include diagnosis, prevention and treatment of diseases and clinical conditions associated with LOC286078.

LOC286121 (Accession XP_212184.3) is another GAM8358 target gene, herein designated TARGET GENE. LOC286121 BINDING SITE is a target binding site found in the 3' untranslated region of mRNA encoded by LOC286121, corresponding to a target binding site such as BINDING SITE I, BINDING SITE II or BINDING SITE III of FIG. 8. Table 4 illustrates the complementarity of the nucleotide sequences of LOC286121 BINDING SITE, designated SEQ ID:9669, to the nucleotide sequence of GAM8358 RNA, herein designated GAM RNA, also designated SEQ ID:255.

Another function of GAM8358 is therefore inhibition of LOC286121 (Accession XP_212184.3). Accordingly, utilities of GAM8358 include diagnosis, prevention and treatment of diseases and clinical conditions associated with LOC286121.

LOC286217 (Accession XP_212232.1) is another GAM8358 target gene, herein designated TARGET GENE. LOC286217 BINDING SITE is a target binding site found in the 3' untranslated region of mRNA encoded by LOC286217, corresponding to a target binding site such as BINDING SITE I, BINDING SITE II or BINDING SITE III of FIG. 8. Table 4 illustrates the complementarity of the nucleotide sequences of LOC286217 BINDING SITE, designated SEQ ID:4906, to the nucleotide sequence of GAM8358 RNA, herein designated GAM RNA, also designated SEQ ID:255.

Another function of GAM8358 is therefore inhibition of LOC286217 (Accession XP_212232.1). Accordingly, utilities of GAM8358 include diagnosis, prevention and treatment of diseases and clinical conditions associated with LOC286217.

LOC286374 (Accession XP_212293.1) is another GAM8358 target gene, herein designated TARGET GENE. LOC286374 BINDING SITE is a target binding site found in the 5' untranslated region of mRNA encoded by LOC286374, corresponding to a target binding site such as BINDING SITE I, BINDING SITE II or BINDING SITE III of FIG. 8. Table 4 illustrates the complementarity of the nucleotide sequences of LOC286374 BINDING SITE, designated SEQ ID:18959, to the nucleotide sequence of GAM8358 RNA, herein designated GAM RNA, also designated SEQ ID:255.

Another function of GAM8358 is therefore inhibition of LOC286374 (Accession XP_212293.1). Accordingly, utilities of GAM8358 include diagnosis, prevention and treatment of diseases and clinical conditions associated with LOC286374.

LOC286404 (Accession XP_210036.1) is another GAM8358 target gene, herein designated TARGET GENE. LOC286404 BINDING SITE1 and LOC286404 BINDING SITE2 are target binding sites found in untranslated regions of multiple transcripts of mRNA encoded by LOC286404, corresponding to target binding sites such as BINDING SITE I, BINDING SITE II or BINDING SITE III of FIG. 8. Table 4 illustrates the complementarity of the nucleotide sequences of LOC286404 BINDING SITE1 and LOC286404 BINDING SITE2, designated SEQ ID:4632 and SEQ ID:4632 respectively, to the nucleotide sequence of GAM8358 RNA, herein designated GAM RNA, also designated SEQ ID:255.

Another function of GAM8358 is therefore inhibition of LOC286404 (Accession XP_210036.1). Accordingly, utilities of GAM8358 include diagnosis, prevention and treatment of diseases and clinical conditions associated with LOC286404.

LOC286404 (Accession XP_210036.1) is another GAM8358 target gene, herein designated TARGET GENE. LOC286404 BINDING SITE1 and LOC286404 BINDING SITE2 are target binding sites found in untranslated regions of multiple transcripts of mRNA encoded by LOC286404, corresponding to target binding sites such as BINDING SITE I, BINDING SITE II or BINDING SITE III of FIG. 8. Table 4 illustrates the complementarity of the nucleotide sequences of LOC286404 BINDING SITE1 and LOC286404 BINDING SITE2, designated SEQ ID:3416 and SEQ ID:1033 respectively, to the nucleotide sequence of GAM8358 RNA, herein designated GAM RNA, also designated SEQ ID:255.

Another function of GAM8358 is therefore inhibition of LOC286404 (Accession XP_210036.1). Accordingly, utilities of GAM8358 include diagnosis, prevention and treatment of diseases and clinical conditions associated with LOC286404.

LOC286456 (Accession XP_210057.1) is another GAM8358 target gene, herein designated TARGET GENE. LOC286456 BINDING SITE is a target binding site found in the 3' untranslated region of mRNA encoded by LOC286456, corresponding to a target binding site such as BINDING SITE I, BINDING SITE II or BINDING SITE III of FIG. 8. Table 4 illustrates the complementarity of the nucleotide sequences of LOC286456 BINDING SITE, designated SEQ ID:3469, to the nucleotide sequence of GAM8358 RNA, herein designated GAM RNA, also designated SEQ ID:255.

Another function of GAM8358 is therefore inhibition of LOC286456 (Accession XP_210057.1). Accordingly, utilities of GAM8358 include diagnosis, prevention and treatment of diseases and clinical conditions associated with LOC286456.

LOC286493 (Accession XP_208437.1) is another GAM8358 target gene, herein designated TARGET GENE. LOC286493 BINDING SITE is a target binding site found in the 3' untranslated region of mRNA encoded by LOC286493, corresponding to a target binding site such as BINDING SITE I, BINDING SITE II or BINDING SITE III of FIG. 8. Table 4 illustrates the complementarity of the nucleotide sequences of LOC286493 BINDING SITE, designated SEQ ID:1737, to the nucleotide sequence of GAM8358 RNA, herein designated GAM RNA, also designated SEQ ID:255.

Another function of GAM8358 is therefore inhibition of LOC286493 (Accession XP_208437.1). Accordingly, utilities of GAM8358 include diagnosis, prevention and treatment of diseases and clinical conditions associated with LOC286493.

LOC286529 (Accession XP_210090.1) is another GAM8358 target gene, herein designated TARGET GENE. LOC286529 BINDING SITE is a target binding site found in the 5' untranslated region of mRNA encoded by LOC286529, corresponding to a target binding site such as BINDING SITE I, BINDING SITE II or BINDING SITE III of FIG. 8. Table 4 illustrates the complementarity of the nucleotide sequences of LOC286529 BINDING SITE, designated SEQ ID:13990, to the nucleotide sequence of GAM8358 RNA, herein designated GAM RNA, also designated SEQ ID:255.

Another function of GAM8358 is therefore inhibition of LOC286529 (Accession XP_210090.1). Accordingly, utilities of GAM8358 include diagnosis, prevention and treatment of diseases and clinical conditions associated with LOC286529.

LOC338588 (Accession XP_294659.1) is another GAM8358 target gene, herein designated TARGET GENE. LOC338588 BINDING SITE is a target binding site found in the 5' untranslated region of mRNA encoded by LOC338588, corresponding to a target binding site such as BINDING SITE I, BINDING SITE II or BINDING SITE III of FIG. 8. Table 4 illustrates the complementarity of the nucleotide sequences of LOC338588 BINDING SITE, designated SEQ ID:12673, to the nucleotide sequence of GAM8358 RNA, herein designated GAM RNA, also designated SEQ ID:255.

Another function of GAM8358 is therefore inhibition of LOC338588 (Accession XP_294659.1). Accordingly, utilities of GAM8358 include diagnosis, prevention and treatment of diseases and clinical conditions associated with LOC338588.

LOC338773 (Accession XP_290570.1) is another GAM8358 target gene, herein designated TARGET GENE. LOC338773 BINDING SITE is a target binding site found in the 3' untranslated region of mRNA encoded by LOC338773, corresponding to a target binding site such as BINDING SITE I, BINDING SITE II or BINDING SITE III of FIG. 8. Table 4 illustrates the complementarity of the nucleotide sequences of LOC338773 BINDING SITE, designated SEQ ID:5276, to the nucleotide sequence of GAM8358 RNA, herein designated GAM RNA, also designated SEQ ID:255.

Another function of GAM8358 is therefore inhibition of LOC338773 (Accession XP_290570.1). Accordingly, utilities of GAM8358 include diagnosis, prevention and treatment of diseases and clinical conditions associated with LOC338773.

LOC338811 (Accession XP_290586.1) is another GAM8358 target gene, herein designated TARGET GENE. LOC338811 BINDING SITE is a target binding site found in the 3' untranslated region of mRNA encoded by LOC338811, corresponding to a target binding site such as BINDING SITE I, BINDING SITE II or BINDING SITE III of FIG. 8. Table 4 illustrates the complementarity of the nucleotide sequences of LOC338811 BINDING SITE, designated SEQ ID:1697, to the nucleotide sequence of GAM8358 RNA, herein designated GAM RNA, also designated SEQ ID:255.

Another function of GAM8358 is therefore inhibition of LOC338811 (Accession XP_290586.1). Accordingly, utilities of GAM8358 include diagnosis, prevention and treatment of diseases and clinical conditions associated with LOC338811.

LOC338959 (Accession XP_294754.1) is another GAM8358 target gene, herein designated TARGET GENE. LOC338959 BINDING SITE is a target binding site found in the 3' untranslated region of mRNA encoded by LOC338959, corresponding to a target binding site such as BINDING SITE I, BINDING SITE II or BINDING SITE III of FIG. 8. Table 4 illustrates the complementarity of the nucleotide sequences of LOC338959 BINDING SITE, designated SEQ ID:4800, to the nucleotide sequence of GAM8358 RNA, herein designated GAM RNA, also designated SEQ ID:255.

Another function of GAM8358 is therefore inhibition of LOC338959 (Accession XP_294754.1). Accordingly, utilities of GAM8358 include diagnosis, prevention and treatment of diseases and clinical conditions associated with LOC338959.

LOC339059 (Accession XP_290682.1) is another GAM8358 target gene, herein designated TARGET GENE. LOC339059 BINDING SITE is a target binding site found in the 3' untranslated region of mRNA encoded by LOC339059, corresponding to a target binding site such as BINDING SITE I, BINDING SITE II or BINDING SITE III of FIG. 8. Table 4 illustrates the complementarity of the nucleotide sequences of LOC339059 BINDING SITE, designated SEQ ID:20096, to the nucleotide sequence of GAM8358 RNA, herein designated GAM RNA, also designated SEQ ID:255.

Another function of GAM8358 is therefore inhibition of LOC339059 (Accession XP_290682.1). Accordingly, utilities of GAM8358 include diagnosis, prevention and treatment of diseases and clinical conditions associated with LOC339059.

LOC339149 (Accession XP_294830.1) is another GAM8358 target gene, herein designated TARGET GENE. LOC339149 BINDING SITE is a target binding site found in the 5' untranslated region of mRNA encoded by LOC339149, corresponding to a target binding site such as BINDING SITE I, BINDING SITE II or BINDING SITE III of FIG. 8. Table 4 illustrates the complementarity of the nucleotide sequences of LOC339149 BINDING SITE, designated SEQ ID:10008, to the nucleotide sequence of GAM8358 RNA, herein designated GAM RNA, also designated SEQ ID:255.

Another function of GAM8358 is therefore inhibition of LOC339149 (Accession XP_294830.1). Accordingly, utilities of GAM8358 include diagnosis, prevention and treatment of diseases and clinical conditions associated with LOC339149.

LOC339161 (Accession XP_294835.1) is another GAM8358 target gene, herein designated TARGET GENE. LOC339161 BINDING SITE is a target binding site found in the 5' untranslated region of mRNA encoded by LOC339161, corresponding to a target binding site such as BINDING SITE I, BINDING SITE II or BINDING SITE III of FIG. 8. Table 4 illustrates the complementarity of the nucleotide sequences of LOC339161 BINDING SITE, designated SEQ ID:13786, to the nucleotide sequence of GAM8358 RNA, herein designated GAM RNA, also designated SEQ ID:255.

Another function of GAM8358 is therefore inhibition of LOC339161 (Accession XP_294835.1). Accordingly, utilities of GAM8358 include diagnosis, prevention and treatment of diseases and clinical conditions associated with LOC339161.

LOC339290 (Accession XP_294901.1) is another GAM8358 target gene, herein designated TARGET GENE. LOC339290 BINDING SITE is a target binding site found in the 5' untranslated region of mRNA encoded by LOC339290, corresponding to a target binding site such as BINDING SITE I, BINDING SITE II or BINDING SITE III of FIG. 8. Table 4 illustrates the complementarity of the nucleotide sequences of LOC339290 BINDING SITE, designated SEQ ID:11490, to the nucleotide sequence of GAM8358 RNA, herein designated GAM RNA, also designated SEQ ID:255.

Another function of GAM8358 is therefore inhibition of LOC339290 (Accession XP_294901.1). Accordingly, utilities of GAM8358 include diagnosis, prevention and treatment of diseases and clinical conditions associated with LOC339290.

LOC339305 (Accession XP_297112.1) is another GAM8358 target gene, herein designated TARGET GENE. LOC339305 BINDING SITE is a target binding site found in the 5' untranslated region of mRNA encoded by LOC339305, corresponding to a target binding site such as BINDING SITE I, BINDING SITE II or BINDING SITE III of FIG. 8. Table 4 illustrates the complementarity of the nucleotide sequences of LOC339305 BINDING SITE, designated SEQ ID:11710, to the nucleotide sequence of GAM8358 RNA, herein designated GAM RNA, also designated SEQ ID:255.

Another function of GAM8358 is therefore inhibition of LOC339305 (Accession XP_297112.1). Accordingly, utilities of GAM8358 include diagnosis, prevention and treatment of diseases and clinical conditions associated with LOC339305.

LOC339442 (Accession XP_294957.1) is another GAM8358 target gene, herein designated TARGET GENE. LOC339442 BINDING SITE is a target binding site found in the 3' untranslated region of mRNA encoded by LOC339442, corresponding to a target binding site such as BINDING SITE I, BINDING SITE II or BINDING SITE III of FIG. 8. Table 4 illustrates the complementarity of the nucleotide sequences of LOC339442 BINDING SITE, designated SEQ ID:14243, to the nucleotide sequence of GAM8358 RNA, herein designated GAM RNA, also designated SEQ ID:255.

Another function of GAM8358 is therefore inhibition of LOC339442 (Accession XP_294957.1). Accordingly, utilities of GAM8358 include diagnosis, prevention and treatment of diseases and clinical conditions associated with LOC339442.

LOC339459 (Accession XP_290907.2) is another GAM8358 target gene, herein designated TARGET GENE. LOC339459 BINDING SITE is a target binding site found in the 3' untranslated region of mRNA encoded by LOC339459, corresponding to a target binding site such as BINDING SITE I, BINDING SITE II or BINDING SITE III of FIG. 8. Table 4 illustrates the complementarity of the nucleotide sequences of LOC339459 BINDING SITE, designated SEQ ID:10510, to the nucleotide sequence of GAM8358 RNA, herein designated GAM RNA, also designated SEQ ID:255.

Another function of GAM8358 is therefore inhibition of LOC339459 (Accession XP_290907.2). Accordingly, utilities of GAM8358 include diagnosis, prevention and treatment of diseases and clinical conditions associated with LOC339459.

LOC339607 (Accession XP_290962.1) is another GAM8358 target gene, herein designated TARGET GENE. LOC339607 BINDING SITE is a target binding site found in the 5' untranslated region of mRNA encoded by LOC339607, corresponding to a target binding site such as BINDING SITE I, BINDING SITE II or BINDING SITE III of FIG. 8. Table 4 illustrates the complementarity of the nucleotide sequences of LOC339607 BINDING SITE, designated SEQ ID:9001, to the nucleotide sequence of GAM8358 RNA, herein designated GAM RNA, also designated SEQ ID:255.

Another function of GAM8358 is therefore inhibition of LOC339607 (Accession XP_290962.1). Accordingly, utilities of GAM8358 include diagnosis, prevention and treatment of diseases and clinical conditions associated with LOC339607.

LOC339685 (Accession XP_295032.1) is another GAM8358 target gene, herein designated TARGET GENE. LOC339685 BINDING SITE is a target binding site found in the 5' untranslated region of mRNA encoded by LOC339685, corresponding to a target binding site such as BINDING SITE I, BINDING SITE II or BINDING SITE III of FIG. 8. Table 4 illustrates the complementarity of the nucleotide sequences of LOC339685 BINDING SITE, designated SEQ ID:18585, to the nucleotide sequence of GAM8358 RNA, herein designated GAM RNA, also designated SEQ ID:255.

Another function of GAM8358 is therefore inhibition of LOC339685 (Accession XP_295032.1). Accordingly, utilities of GAM8358 include diagnosis, prevention and treatment of diseases and clinical conditions associated with LOC339685.

LOC339914 (Accession XP_295099.1) is another GAM8358 target gene, herein designated TARGET GENE. LOC339914 BINDING SITE is a target binding site found in the 5' untranslated region of mRNA encoded by LOC339914, corresponding to a target binding site such as BINDING SITE I, BINDING SITE II or BINDING SITE III of FIG. 8. Table 4 illustrates the complementarity of the nucleotide sequences of LOC339914 BINDING SITE, designated SEQ ID:7941, to the nucleotide sequence of GAM8358 RNA, herein designated GAM RNA, also designated SEQ ID:255.

Another function of GAM8358 is therefore inhibition of LOC339914 (Accession XP_295099.1). Accordingly, utilities of GAM8358 include diagnosis, prevention and treatment of diseases and clinical conditions associated with LOC339914.

LOC340204 (Accession XP_291169.1) is another GAM8358 target gene, herein designated TARGET GENE. LOC340204 BINDING SITE is a target binding site found in the 3' untranslated region of mRNA encoded by LOC340204, corresponding to a target binding site such as BINDING SITE I, BINDING SITE II or BINDING SITE III of FIG. 8. Table 4 illustrates the complementarity of the nucleotide sequences of LOC340204 BINDING SITE, designated SEQ ID:4985, to the nucleotide sequence of GAM8358 RNA, herein designated GAM RNA, also designated SEQ ID:255.

Another function of GAM8358 is therefore inhibition of LOC340204 (Accession XP_291169.1). Accordingly, utilities of GAM8358 include diagnosis, prevention and treatment of diseases and clinical conditions associated with LOC340204.

LOC340232 (Accession XP_290386.1) is another GAM8358 target gene, herein designated TARGET GENE. LOC340232 BINDING SITE is a target binding site found in the 5' untranslated region of mRNA encoded by LOC340232, corresponding to a target binding site such as BINDING SITE I, BINDING SITE II or BINDING SITE III of FIG. 8. Table 4 illustrates the complementarity of the nucleotide sequences of LOC340232 BINDING SITE, designated SEQ ID:6120, to the nucleotide sequence of GAM8358 RNA, herein designated GAM RNA, also designated SEQ ID:255.

Another function of GAM8358 is therefore inhibition of LOC340232 (Accession XP_290386.1). Accordingly, utilities of GAM8358 include diagnosis, prevention and treatment of diseases and clinical conditions associated with LOC340232.

LOC340290 (Accession XP_291214.1) is another GAM8358 target gene, herein designated TARGET GENE. LOC340290 BINDING SITE is a target binding site found in the 3' untranslated region of mRNA encoded by LOC340290, corresponding to a target binding site such as BINDING SITE I, BINDING SITE II or BINDING SITE III of FIG. 8. Table 4 illustrates the complementarity of the nucleotide sequences of LOC340290 BINDING SITE, designated SEQ ID:14581, to the nucleotide sequence of GAM8358 RNA, herein designated GAM RNA, also designated SEQ ID:255.

Another function of GAM8358 is therefore inhibition of LOC340290 (Accession XP_291214.1). Accordingly, utilities of GAM8358 include diagnosis, prevention and treatment of diseases and clinical conditions associated with LOC340290.

LOC344782 (Accession XP_298281.2) is another GAM8358 target gene, herein designated TARGET GENE. LOC344782 BINDING SITE is a target binding site found in the 5' untranslated region of mRNA encoded by LOC344782, corresponding to a target binding site such as BINDING SITE I, BINDING SITE II or BINDING SITE III of FIG. 8. Table 4 illustrates the complementarity of the nucleotide sequences of LOC344782 BINDING SITE, designated SEQ ID:17217, to the nucleotide sequence of GAM8358 RNA, herein designated GAM RNA, also designated SEQ ID:255.

Another function of GAM8358 is therefore inhibition of LOC344782 (Accession XP_298281.2). Accordingly, utilities of GAM8358 include diagnosis, prevention and treatment of diseases and clinical conditions associated with LOC344782.

LOC345749 (Accession XP_298978.1) is another GAM8358 target gene, herein designated TARGET GENE. LOC345749 BINDING SITE is a target binding site found in the 5' untranslated region of mRNA encoded by LOC345749, corresponding to a target binding site such as BINDING SITE I, BINDING SITE II or BINDING SITE III of FIG. 8. Table 4 illustrates the complementarity of the nucleotide sequences of LOC345749 BINDING SITE, designated SEQ ID:9069, to the nucleotide sequence of GAM8358 RNA, herein designated GAM RNA, also designated SEQ ID:255.

Another function of GAM8358 is therefore inhibition of LOC345749 (Accession XP_298978.1). Accordingly, utilities of GAM8358 include diagnosis, prevention and treatment of diseases and clinical conditions associated with LOC345749.

LOC347166 (Accession XP_294530.1) is another GAM8358 target gene, herein designated TARGET GENE. LOC347166 BINDING SITE is a target binding site found in the 5' untranslated region of mRNA encoded by LOC347166, corresponding to a target binding site such as BINDING SITE I, BINDING SITE II or BINDING SITE III of FIG. 8. Table 4 illustrates the complementarity of the nucleotide sequences of LOC347166 BINDING SITE, designated SEQ ID:13274, to the nucleotide sequence of GAM8358 RNA, herein designated GAM RNA, also designated SEQ ID:255.

Another function of GAM8358 is therefore inhibition of LOC347166 (Accession XP_294530.1). Accordingly, utilities of GAM8358 include diagnosis, prevention and treatment of diseases and clinical conditions associated with LOC347166.

LOC347767 (Accession XP_300531.1) is another GAM8358 target gene, herein designated TARGET GENE. LOC347767 BINDING SITE is a target binding site found in the 3' untranslated region of mRNA encoded by LOC347767, corresponding to a target binding site such as BINDING SITE I, BINDING SITE II or BINDING SITE III of FIG. 8. Table 4 illustrates the complementarity of the nucleotide sequences of LOC347767 BINDING SITE, designated SEQ ID:6985, to the nucleotide sequence of GAM8358 RNA, herein designated GAM RNA, also designated SEQ ID:255.

Another function of GAM8358 is therefore inhibition of LOC347767 (Accession XP_300531.1). Accordingly, utilities of GAM8358 include diagnosis, prevention and treatment of diseases and clinical conditions associated with LOC347767.

LOC347803 (Accession XP_302604.1) is another GAM8358 target gene, herein designated TARGET GENE. LOC347803 BINDING SITE is a target binding site found in the 3' untranslated region of mRNA encoded by LOC347803, corresponding to a target binding site such as BINDING SITE I, BINDING SITE II or BINDING SITE III of FIG. 8. Table 4 illustrates the complementarity of the nucleotide sequences of LOC347803 BINDING SITE, designated SEQ ID:13761, to the nucleotide sequence of GAM8358 RNA, herein designated GAM RNA, also designated SEQ ID:255.

Another function of GAM8358 is therefore inhibition of LOC347803 (Accession XP_302604.1). Accordingly, utilities of GAM8358 include diagnosis, prevention and treatment of diseases and clinical conditions associated with LOC347803.

LOC348121 (Accession XP_302567.1) is another GAM8358 target gene, herein designated TARGET GENE. LOC348121 BINDING SITE is a target binding site found in the 3' untranslated region of mRNA encoded by LOC348121, corresponding to a target binding site such as BINDING SITE I, BINDING SITE II or BINDING SITE III of FIG. 8. Table 4 illustrates the complementarity of the nucleotide sequences of LOC348121 BINDING SITE, designated SEQ ID:17997, to the nucleotide sequence of GAM8358 RNA, herein designated GAM RNA, also designated SEQ ID:255.

Another function of GAM8358 is therefore inhibition of LOC348121 (Accession XP_302567.1). Accordingly, utilities of GAM8358 include diagnosis, prevention and treatment of diseases and clinical conditions associated with LOC348121.

LOC348155 (Accession XP_211219.1) is another GAM8358 target gene, herein designated TARGET GENE. LOC348155 BINDING SITE is a target binding site found in the 5' untranslated region of mRNA encoded by LOC348155, corresponding to a target binding site such as BINDING SITE I, BINDING SITE II or BINDING SITE III of FIG. 8. Table 4 illustrates the complementarity of the nucleotide sequences of LOC348155 BINDING SITE, designated SEQ ID:2553, to the nucleotide sequence of GAM8358 RNA, herein designated GAM RNA, also designated SEQ ID:255.

Another function of GAM8358 is therefore inhibition of LOC348155 (Accession XP_211219.1). Accordingly, utilities of GAM8358 include diagnosis, prevention and treatment of diseases and clinical conditions associated with LOC348155.

LOC348209 (Accession XP_300304.1) is another GAM8358 target gene, herein designated TARGET GENE. LOC348209 BINDING SITE is a target binding site found in the 3' untranslated region of mRNA encoded by LOC348209, corresponding to a target binding site such as BINDING SITE I, BINDING SITE II or BINDING SITE III of FIG. 8. Table 4 illustrates the complementarity of the nucleotide sequences of LOC348209 BINDING SITE, designated SEQ ID:17130, to the nucleotide sequence of GAM8358 RNA, herein designated GAM RNA, also designated SEQ ID:255.

Another function of GAM8358 is therefore inhibition of LOC348209 (Accession XP_300304.1). Accordingly, utilities of GAM8358 include diagnosis, prevention and treatment of diseases and clinical conditions associated with LOC348209.

LOC348258 (Accession XP_300686.1) is another GAM8358 target gene, herein designated TARGET GENE. LOC348258 BINDING SITE is a target binding site found in the 5' untranslated region of mRNA encoded by LOC348258, corresponding to a target binding site such as BINDING SITE I, BINDING SITE II or BINDING SITE III of FIG. 8. Table 4 illustrates the complementarity of the nucleotide sequences of LOC348258 BINDING SITE, designated SEQ ID:12407, to the nucleotide sequence of GAM8358 RNA, herein designated GAM RNA, also designated SEQ ID:255.

Another function of GAM8358 is therefore inhibition of LOC348258 (Accession XP_300686.1). Accordingly, utilities of GAM8358 include diagnosis, prevention and treatment of diseases and clinical conditions associated with LOC348258.

LOC348389 (Accession XP_302739.1) is another GAM8358 target gene, herein designated TARGET GENE. LOC348389 BINDING SITE is a target binding site found in the 5' untranslated region of mRNA encoded by LOC348389, corresponding to a target binding site such as BINDING SITE I, BINDING SITE II or BINDING SITE III of FIG. 8. Table 4 illustrates the complementarity of the nucleotide sequences of LOC348389 BINDING SITE, designated SEQ ID:7856, to the nucleotide sequence of GAM8358 RNA, herein designated GAM RNA, also designated SEQ ID:255.

Another function of GAM8358 is therefore inhibition of LOC348389 (Accession XP_302739.1). Accordingly, utilities of GAM8358 include diagnosis, prevention and treatment of diseases and clinical conditions associated with LOC348389.

LOC348396 (Accession XP_300729.1) is another GAM8358 target gene, herein designated TARGET GENE. LOC348396 BINDING SITE is a target binding site found in the 3' untranslated region of mRNA encoded by LOC348396, corresponding to a target binding site such as BINDING SITE I, BINDING SITE II or BINDING SITE III of FIG. 8. Table 4 illustrates the complementarity of the nucleotide sequences of LOC348396 BINDING SITE, designated SEQ ID:10069, to the nucleotide sequence of GAM8358 RNA, herein designated GAM RNA, also designated SEQ ID:255.

Another function of GAM8358 is therefore inhibition of LOC348396 (Accession XP_300729.1). Accordingly, utilities of GAM8358 include diagnosis, prevention and treatment of diseases and clinical conditions associated with LOC348396.

LOC348761 (Accession XP_302869.1) is another GAM8358 target gene, herein designated TARGET GENE. LOC348761 BINDING SITE is a target binding site found in the 3' untranslated region of mRNA encoded by LOC348761, corresponding to a target binding site such as BINDING SITE I, BINDING SITE II or BINDING SITE III of FIG. 8. Table 4 illustrates the complementarity of the nucleotide sequences of LOC348761 BINDING SITE, designated SEQ ID:17866, to the nucleotide sequence of GAM8358 RNA, herein designated GAM RNA, also designated SEQ ID:255.

Another function of GAM8358 is therefore inhibition of LOC348761 (Accession XP_302869.1). Accordingly, utilities of GAM8358 include diagnosis, prevention and treatment of diseases and clinical conditions associated with LOC348761.

LOC348768 (Accession XP_302883.1) is another GAM8358 target gene, herein designated TARGET GENE. LOC348768 BINDING SITE is a target binding site found in the 5' untranslated region of mRNA encoded by LOC348768, corresponding to a target binding site such as BINDING SITE I, BINDING SITE II or BINDING SITE III of FIG. 8. Table 4 illustrates the complementarity of the nucleotide sequences of LOC348768 BINDING SITE, designated SEQ ID:6580, to the nucleotide sequence of GAM8358 RNA, herein designated GAM RNA, also designated SEQ ID:255.

Another function of GAM8358 is therefore inhibition of LOC348768 (Accession XP_302883.1). Accordingly, utilities of GAM8358 include diagnosis, prevention and treatment of diseases and clinical conditions associated with LOC348768.

LOC349101 (Accession XP_173186.2) is another GAM8358 target gene, herein designated TARGET GENE. LOC349101 BINDING SITE is a target binding site found in the 3' untranslated region of mRNA encoded by LOC349101, corresponding to a target binding site such as BINDING SITE I, BINDING SITE II or BINDING SITE III of FIG. 8. Table 4 illustrates the complementarity of the nucleotide sequences of LOC349101 BINDING SITE, designated SEQ ID:7453, to the nucleotide sequence of GAM8358 RNA, herein designated GAM RNA, also designated SEQ ID:255.

Another function of GAM8358 is therefore inhibition of LOC349101 (Accession XP_173186.2). Accordingly, utilities of GAM8358 include diagnosis, prevention and treatment of diseases and clinical conditions associated with LOC349101.

LOC349278 (Accession XP_301004.1) is another GAM8358 target gene, herein designated TARGET GENE. LOC349278 BINDING SITE is a target binding site found in the 3' untranslated region of mRNA encoded by LOC349278, corresponding to a target binding site such as BINDING SITE I, BINDING SITE II or BINDING SITE III of FIG. 8. Table 4 illustrates the complementarity of the nucleotide sequences of LOC349278 BINDING SITE, designated SEQ ID:10509, to the nucleotide sequence of GAM8358 RNA, herein designated GAM RNA, also designated SEQ ID:255.

Another function of GAM8358 is therefore inhibition of LOC349278 (Accession XP_301004.1). Accordingly, utilities of GAM8358 include diagnosis, prevention and treatment of diseases and clinical conditions associated with LOC349278.

LOC349302 (Accession XP_301017.1) is another GAM8358 target gene, herein designated TARGET GENE. LOC349302 BINDING SITE is a target binding site found in the 3' untranslated region of mRNA encoded by LOC349302, corresponding to a target binding site such as BINDING SITE I, BINDING SITE II or BINDING SITE III of FIG. 8. Table 4 illustrates the complementarity of the nucleotide sequences of LOC349302 BINDING SITE, designated SEQ ID:10509, to the nucleotide sequence of GAM8358 RNA, herein designated GAM RNA, also designated SEQ ID:255.

Another function of GAM8358 is therefore inhibition of LOC349302 (Accession XP_301017.1). Accordingly, utilities of GAM8358 include diagnosis, prevention and treatment of diseases and clinical conditions associated with LOC349302.

LOC349337 (Accession XP_301037.1) is another GAM8358 target gene, herein designated TARGET GENE. LOC349337 BINDING SITE is a target binding site found in the 5' untranslated region of mRNA encoded by LOC349337, corresponding to a target binding site such as BINDING SITE I, BINDING SITE II or BINDING SITE III of FIG. 8. Table 4 illustrates the complementarity of the nucleotide sequences of LOC349337 BINDING SITE, designated SEQ ID:13247, to the nucleotide sequence of GAM8358 RNA, herein designated GAM RNA, also designated SEQ ID:255.

Another function of GAM8358 is therefore inhibition of LOC349337 (Accession XP_301037.1). Accordingly, utilities of GAM8358 include diagnosis, prevention and treatment of diseases and clinical conditions associated with LOC349337.

LOC349430 (Accession XP_301084.1) is another GAM8358 target gene, herein designated TARGET GENE. LOC349430 BINDING SITE is a target binding site found in the 5' untranslated region of mRNA encoded by LOC349430, corresponding to a target binding site such as BINDING SITE I, BINDING SITE II or BINDING SITE III of FIG. 8. Table 4 illustrates the complementarity of the nucleotide sequences of LOC349430 BINDING SITE, designated SEQ ID:1033, to the nucleotide sequence of GAM8358 RNA, herein designated GAM RNA, also designated SEQ ID:255.

Another function of GAM8358 is therefore inhibition of LOC349430 (Accession XP_301084.1). Accordingly, utilities of GAM8358 include diagnosis, prevention and treatment of diseases and clinical conditions associated with LOC349430.

LOC350176 (Accession XP_303855.1) is another GAM8358 target gene, herein designated TARGET GENE. LOC350176 BINDING SITE is a target binding site found in the 5' untranslated region of mRNA encoded by LOC350176, corresponding to a target binding site such as BINDING SITE I, BINDING SITE II or BINDING SITE III of FIG. 8. Table 4 illustrates the complementarity of the nucleotide sequences of LOC350176 BINDING SITE, designated SEQ ID:16322, to the nucleotide sequence of GAM8358 RNA, herein designated GAM RNA, also designated SEQ ID:255.

Another function of GAM8358 is therefore inhibition of LOC350176 (Accession XP_303855.1). Accordingly, utilities of GAM8358 include diagnosis, prevention and treatment of diseases and clinical conditions associated with LOC350176.

LOC350717 (Accession XP_303117.1) is another GAM8358 target gene, herein designated TARGET GENE. LOC350717 BINDING SITE is a target binding site found in the 5' untranslated region of mRNA encoded by LOC350717, corresponding to a target binding site such as BINDING SITE I, BINDING SITE II or BINDING SITE III of FIG. 8. Table 4 illustrates the complementarity of the nucleotide sequences of LOC350717 BINDING SITE, designated SEQ ID:1938, to the nucleotide sequence of GAM8358 RNA, herein designated GAM RNA, also designated SEQ ID:255.

Another function of GAM8358 is therefore inhibition of LOC350717 (Accession XP_303117.1). Accordingly, utilities of GAM8358 include diagnosis, prevention and treatment of diseases and clinical conditions associated with LOC350717.

LOC350897 (Accession XP_303256.1) is another GAM8358 target gene, herein designated TARGET GENE. LOC350897 BINDING SITE is a target binding site found in the 5' untranslated region of mRNA encoded by LOC350897, corresponding to a target binding site such as BINDING SITE I, BINDING SITE II or BINDING SITE III of FIG. 8. Table 4 illustrates the complementarity of the nucleotide sequences of LOC350897 BINDING SITE, designated SEQ ID:18754, to the nucleotide sequence of GAM8358 RNA, herein designated GAM RNA, also designated SEQ ID:255.

Another function of GAM8358 is therefore inhibition of LOC350897 (Accession XP_303256.1). Accordingly, utilities of GAM8358 include diagnosis, prevention and treatment of diseases and clinical conditions associated with LOC350897.

LOC350935 (Accession XP_304543.1) is another GAM8358 target gene, herein designated TARGET GENE. LOC350935 BINDING SITE is a target binding site found in the 5' untranslated region of mRNA encoded by LOC350935, corresponding to a target binding site such as BINDING SITE I, BINDING SITE II or BINDING SITE III of FIG. 8. Table 4 illustrates the complementarity of the nucleotide sequences of LOC350935 BINDING SITE, designated SEQ ID:17196, to the nucleotide sequence of GAM8358 RNA, herein designated GAM RNA, also designated SEQ ID:255.

Another function of GAM8358 is therefore inhibition of LOC350935 (Accession XP_304543.1). Accordingly, utilities of GAM8358 include diagnosis, prevention and treatment of diseases and clinical conditions associated with LOC350935.

LOC51236 (Accession NP_057542.2) is another GAM8358 target gene, herein designated TARGET GENE. LOC51236 BINDING SITE is a target binding site found in the 3' untranslated region of mRNA encoded by LOC51236, corresponding to a target binding site such as BINDING SITE I, BINDING SITE II or BINDING SITE III of FIG. 8. Table 4 illustrates the complementarity of the nucleotide sequences of LOC51236 BINDING SITE, designated SEQ ID:19076, to the nucleotide sequence of GAM8358 RNA, herein designated GAM RNA, also designated SEQ ID:255.

Another function of GAM8358 is therefore inhibition of LOC51236 (Accession NP_057542.2). Accordingly, utilities of GAM8358 include diagnosis, prevention and treatment of diseases and clinical conditions associated with LOC51236.

LOC55954 (Accession NP_061976.1) is another GAM8358 target gene, herein designated TARGET GENE. LOC55954 BINDING SITE is a target binding site found in the 3' untranslated region of mRNA encoded by LOC55954, corresponding to a target binding site such as BINDING SITE I, BINDING SITE II or BINDING SITE III of FIG. 8. Table 4 illustrates the complementarity of the nucleotide sequences of LOC55954 BINDING SITE, designated SEQ ID:17880, to the nucleotide sequence of GAM8358 RNA, herein designated GAM RNA, also designated SEQ ID:255.

Another function of GAM8358 is therefore inhibition of LOC55954 (Accession NP_061976.1). Accordingly, utilities of GAM8358 include diagnosis, prevention and treatment of diseases and clinical conditions associated with LOC55954.

LOC81558 (Accession NP_110429.1) is another GAM8358 target gene, herein designated TARGET GENE. LOC81558 BINDING SITE is a target binding site found in the 3' untranslated region of mRNA encoded by LOC81558, corresponding to a target binding site such as BINDING SITE I, BINDING SITE II or BINDING SITE III of FIG. 8. Table 4 illustrates the complementarity of the nucleotide sequences of LOC81558 BINDING SITE, designated SEQ ID:16662, to the nucleotide sequence of GAM8358 RNA, herein designated GAM RNA, also designated SEQ ID:255.

Another function of GAM8358 is therefore inhibition of LOC81558 (Accession NP_110429.1). Accordingly, utilities of GAM8358 include diagnosis, prevention and treatment of diseases and clinical conditions associated with LOC81558.

LOC90167 (Accession XP_029570.1) is another GAM8358 target gene, herein designated TARGET GENE. LOC90167 BINDING SITE is a target binding site found in the 3' untranslated region of mRNA encoded by LOC90167, corresponding to a target binding site such as BINDING SITE I, BINDING SITE II or BINDING SITE III of FIG. 8. Table 4 illustrates the complementarity of the nucleotide sequences of LOC90167 BINDING SITE, designated SEQ ID:4312, to the nucleotide sequence of GAM8358 RNA, herein designated GAM RNA, also designated SEQ ID:255.

Another function of GAM8358 is therefore inhibition of LOC90167 (Accession XP_029570.1). Accordingly, utilities of GAM8358 include diagnosis, prevention and treatment of diseases and clinical conditions associated with LOC90167.

LOC92078 (Accession XP_042684.1) is another GAM8358 target gene, herein designated TARGET GENE. LOC92078 BINDING SITE is a target binding site found in the 5' untranslated region of mRNA encoded by LOC92078, corresponding to a target binding site such as BINDING SITE I, BINDING SITE II or BINDING SITE III of FIG. 8. Table 4 illustrates the complementarity of the nucleotide sequences of LOC92078 BINDING SITE, designated SEQ ID:1696, to the nucleotide sequence of GAM8358 RNA, herein designated GAM RNA, also designated SEQ ID:255.

Another function of GAM8358 is therefore inhibition of LOC92078 (Accession XP_042684.1). Accordingly, utilities of GAM8358 include diagnosis, prevention and treatment of diseases and clinical conditions associated with LOC92078.

LOC92267 (Accession XP_043979.3) is another GAM8358 target gene, herein designated TARGET GENE. LOC92267 BINDING SITE is a target binding site found in the 3' untranslated region of mRNA encoded by LOC92267, corresponding to a target binding site such as BINDING SITE I, BINDING SITE II or BINDING SITE III of FIG. 8. Table 4 illustrates the complementarity of the nucleotide sequences of LOC92267 BINDING SITE, designated SEQ ID:2289, to the nucleotide sequence of GAM8358 RNA, herein designated GAM RNA, also designated SEQ ID:255.

Another function of GAM8358 is therefore inhibition of LOC92267 (Accession XP_043979.3). Accordingly, utilities of GAM8358 include diagnosis, prevention and treatment of diseases and clinical conditions associated with LOC92267.

LOC92973 (Accession XP_048529.2) is another GAM8358 target gene, herein designated TARGET GENE. LOC92973 BINDING SITE is a target binding site found in the 5' untranslated region of mRNA encoded by LOC92973, corresponding to a target binding site such as BINDING SITE I, BINDING SITE II or BINDING SITE III of FIG. 8. Table 4 illustrates the complementarity of the nucleotide sequences of LOC92973 BINDING SITE, designated SEQ ID:7336, to the nucleotide sequence of GAM8358 RNA, herein designated GAM RNA, also designated SEQ ID:255.

Another function of GAM8358 is therefore inhibition of LOC92973 (Accession XP_048529.2). Accordingly, utilities of GAM8358 include diagnosis, prevention and treatment of diseases and clinical conditions associated with LOC92973.

Leukotriene b4 receptor 2 (LTB4R2, Accession NP_062813.1) is another GAM8358 target gene, herein designated TARGET GENE. LTB4R2 BINDING SITE is a target binding site found in the 5' untranslated region of mRNA encoded by LTB4R2, corresponding to a target binding site such as BINDING SITE I, BINDING SITE II or BINDING SITE III of FIG. 8. Table 4 illustrates the complementarity of the nucleotide sequences of LTB4R2 BINDING SITE, designated SEQ ID:15287, to the nucleotide sequence of GAM8358 RNA, herein designated GAM RNA, also designated SEQ ID:255.

Another function of GAM8358 is therefore inhibition of Leukotriene b4 receptor 2 (LTB4R2, Accession NP_062813.1). Accordingly, utilities of GAM8358 include diagnosis, prevention and treatment of diseases and clinical conditions associated with LTB4R2.

Lymphocyte antigen 9 (LY9, Accession NP_002339.1) is another GAM8358 target gene, herein designated TARGET GENE. LY9 BINDING SITE is a target binding site found in the 3' untranslated region of mRNA encoded by LY9, corresponding to a target binding site such as BINDING SITE I, BINDING SITE II or BINDING SITE III of FIG. 8. Table 4 illustrates the complementarity of the nucleotide sequences of LY9 BINDING SITE, designated SEQ ID:3090, to the nucleotide sequence of GAM8358 RNA, herein designated GAM RNA, also designated SEQ ID:255.

Another function of GAM8358 is therefore inhibition of Lymphocyte antigen 9 (LY9, Accession NP_002339.1), a gene which may participate in adhesion reactions between t lymphocytes and accessory cells by homophilic interaction. Accordingly, utilities of GAM8358 include diagnosis, prevention and treatment of diseases and clinical conditions associated with LY9.

The function of LY9 and its association with various diseases and clinical conditions, has been established by previous studies, as described hereinabove with reference to GAM304.1. V-yes-1 yamaguchi sarcoma viral related oncogene homolog (Ly, Accession NP_002341.1) is another GAM8358 target gene, herein designated TARGET GENE. LYN BINDING SITE is a target binding site found in the 3' untranslated region of mRNA encoded by Ly, corresponding to a target binding site such as BINDING SITE I, BINDING SITE II or BINDING SITE III of FIG. 8. Table 4 illustrates the complementarity of the nucleotide sequences of LYN BINDING SITE, designated SEQ ID:12638, to the nucleotide sequence of GAM8358 RNA, herein designated GAM RNA, also designated SEQ ID:255.

Another function of GAM8358 is therefore inhibition of V-yes-1 yamaguchi sarcoma viral related oncogene homolog (Ly, Accession NP_002341.1), a gene which is a Tyrosine kinase with similarity to murine tyrosine kinase p56lck; similar to v-yes protein and the gene products of v-fgr and v-src. Accordingly, utilities of GAM8358 include diagnosis, prevention and treatment of diseases and clinical conditions associated with LYN.

The function of LYN and its association with various diseases and clinical conditions, has been established by previous studies, as described hereinabove with reference to GAM374.2. Mad, mothers against decapentaplegic homolog 6 (drosophila) (MADH6, Accession NP_005576.2) is another GAM8358 target gene, herein designated TARGET GENE. MADH6 BINDING SITE is a target binding site found in the 5' untranslated region of mRNA encoded by MADH6, corresponding to a target binding site such as BINDING SITE I, BINDING SITE II or BINDING SITE III of FIG. 8. Table 4 illustrates the complementarity of the nucleotide sequences of MADH6 BINDING SITE, designated SEQ ID:17896, to the nucleotide sequence of GAM8358 RNA, herein designated GAM RNA, also designated SEQ ID:255.

Another function of GAM8358 is therefore inhibition of Mad, mothers against decapentaplegic homolog 6 (drosophila) (MADH6, Accession NP_005576.2), a gene which may affect transcription in response to TGF-beta superfamily signaling pathway, inhibits BMP/Smad1 (MADH1) signaling. Accordingly, utilities of GAM8358 include diagnosis, prevention and treatment of diseases and clinical conditions associated with MADH6.

The function of MADH6 and its association with various diseases and clinical conditions, has been established by previous studies, as described hereinabove with reference to GAM357.2. MAGEB6 (Accession NP_775794.2) is another GAM8358 target gene, herein designated TARGET GENE. MAGEB6 BINDING SITE is a target binding site found in the 5' untranslated region of mRNA encoded by MAGEB6, corresponding to a target binding site such as BINDING SITE I, BINDING SITE II or BINDING SITE III of FIG. 8. Table 4 illustrates the complementarity of the nucleotide sequences of MAGEB6 BINDING SITE, designated SEQ ID:12419, to the nucleotide sequence of GAM8358 RNA, herein designated GAM RNA, also designated SEQ ID:255.

Another function of GAM8358 is therefore inhibition of MAGEB6 (Accession NP_775794.2). Accordingly, utilities of GAM8358 include diagnosis, prevention and treatment of diseases and clinical conditions associated with MAGEB6.

Mitogen-activated protein kinase kinase 5 (MAP2K5, Accession NP_660143.1) is another GAM8358 target gene, herein designated TARGET GENE. MAP2K5 BINDING SITE is a target binding site found in the 5' untranslated region of multiple transcripts of mRNA encoded by MAP2K5, corresponding to a target binding site such as BINDING SITE I, BINDING SITE II or BINDING SITE III of FIG. 8. Table 4 illustrates the complementarity of the nucleotide sequences of MAP2K5 BINDING SITE, designated SEQ ID:3777, to the nucleotide sequence of GAM8358 RNA, herein designated GAM RNA, also designated SEQ ID:255.

Another function of GAM8358 is therefore inhibition of Mitogen-activated protein kinase kinase 5 (MAP2K5, Accession NP_660143.1). Accordingly, utilities of GAM8358 include diagnosis, prevention and treatment of diseases and clinical conditions associated with MAP2K5.

Mitogen-activated protein kinase kinase 5 (MAP2K5, Accession NP_002748.1) is another GAM8358 target gene, herein designated TARGET GENE. MAP2K5 BINDING SITE is a target binding site found in the 5' untranslated region of multiple transcripts of mRNA encoded by MAP2K5, corresponding to a target binding site such as BINDING SITE I, BINDING SITE II or BINDING SITE III of FIG. 8. Table 4 illustrates the complementarity of the nucleotide sequences of MAP2K5 BINDING SITE, designated SEQ ID:3777, to the nucleotide sequence of GAM8358 RNA, herein designated GAM RNA, also designated SEQ ID:255.

Another function of GAM8358 is therefore inhibition of Mitogen-activated protein kinase kinase 5 (MAP2K5, Accession NP_002748.1). Accordingly, utilities of GAM8358 include diagnosis, prevention and treatment of diseases and clinical conditions associated with MAP2K5.

Mitogen-activated protein kinase kinase 5 (MAP2K5, Accession NP_660144.1) is another GAM8358 target gene, herein designated TARGET GENE. MAP2K5 BINDING SITE is a target binding site found in the 5' untranslated region of multiple transcripts of mRNA encoded by MAP2K5, corresponding to a target binding site such as BINDING SITE I, BINDING SITE II or BINDING SITE III of FIG. 8. Table 4 illustrates the complementarity of the nucleotide sequences of MAP2K5 BINDING SITE, designated SEQ ID:3777, to the nucleotide sequence of GAM8358 RNA, herein designated GAM RNA, also designated SEQ ID:255.

Another function of GAM8358 is therefore inhibition of Mitogen-activated protein kinase kinase 5 (MAP2K5, Accession NP_660144.1). Accordingly, utilities of GAM8358 include diagnosis, prevention and treatment of diseases and clinical conditions associated with MAP2K5.

MAPBPIP (Accession NP_054736.1) is another GAM8358 target gene, herein designated TARGET GENE. MAPBPIP BINDING SITE is a target binding site found in the 3' untranslated region of mRNA encoded by MAPBPIP, corresponding to a target binding site such as BINDING SITE I, BINDING SITE II or BINDING SITE III of FIG. 8. Table 4 illustrates the complementarity of the nucleotide sequences of MAPBPIP BINDING SITE, designated SEQ ID:6096, to the nucleotide sequence of GAM8358 RNA, herein designated GAM RNA, also designated SEQ ID:255.

Another function of GAM8358 is therefore inhibition of MAPBPIP (Accession NP_054736.1). Accordingly, utilities of GAM8358 include diagnosis, prevention and treatment of diseases and clinical conditions associated with MAPBPIP.

Mitogen-activated protein kinase 13 (MAPK13, Accession NP_002745.1) is another GAM8358 target gene, herein designated TARGET GENE. MAPK13 BINDING SITE is a target binding site found in the 5' untranslated region of mRNA encoded by MAPK13, corresponding to a target binding site such as BINDING SITE I, BINDING SITE II or BINDING SITE III of FIG. 8. Table 4 illustrates the complementarity of the nucleotide sequences of MAPK13 BINDING SITE, designated SEQ ID:6864, to the nucleotide sequence of GAM8358 RNA, herein designated GAM RNA, also designated SEQ ID:255.

Another function of GAM8358 is therefore inhibition of Mitogen-activated protein kinase 13 (MAPK13, Accession NP_002745.1). Accordingly, utilities of GAM8358 include diagnosis, prevention and treatment of diseases and clinical conditions associated with MAPK13.

MAST205 (Accession NP_055927.1) is another GAM8358 target gene, herein designated TARGET GENE. MAST205 BINDING SITE is a target binding site found in the 3' untranslated region of mRNA encoded by MAST205, corresponding to a target binding site such as BINDING SITE I, BINDING SITE II or BINDING SITE III of FIG. 8. Table 4 illustrates the complementarity of the nucleotide sequences of MAST205 BINDING SITE, designated SEQ ID:6973, to the nucleotide sequence of GAM8358 RNA, herein designated GAM RNA, also designated SEQ ID:255.

Another function of GAM8358 is therefore inhibition of MAST205 (Accession NP_055927.1). Accordingly, utilities of GAM8358 include diagnosis, prevention and treatment of diseases and clinical conditions associated with MAST205.

MBIP (Accession NP_057670.1) is another GAM8358 target gene, herein designated TARGET GENE. MBIP BINDING SITE is a target binding site found in the 3' untranslated region of mRNA encoded by MBIP, corresponding to a target binding site such as BINDING SITE I, BINDING SITE II or BINDING SITE III of FIG. 8. Table 4 illustrates the complementarity of the nucleotide sequences of MBIP BINDING SITE, designated SEQ ID:6554, to the nucleotide sequence of GAM8358 RNA, herein designated GAM RNA, also designated SEQ ID:255.

Another function of GAM8358 is therefore inhibition of MBIP (Accession NP_057670.1). Accordingly, utilities of GAM8358 include diagnosis, prevention and treatment of diseases and clinical conditions associated with MBIP.

Mannosyl (alpha-1,3-)-glycoprotein beta-1,4-n-acetylglucosaminyltransferase, isoenzyme b (MGAT4B, Accession NP_463459.1) is another GAM8358 target gene, herein designated TARGET GENE. MGAT4B BINDING SITE is a target binding site found in the 5' untranslated region of multiple transcripts of mRNA encoded by MGAT4B, corresponding to a target binding site such as BINDING SITE I, BINDING SITE II or BINDING SITE III of FIG. 8. Table 4 illustrates the complementarity of the nucleotide sequences of MGAT4B BINDING SITE, designated SEQ ID:6555, to the nucleotide sequence of GAM8358 RNA, herein designated GAM RNA, also designated SEQ ID:255.

Another function of GAM8358 is therefore inhibition of Mannosyl (alpha-1,3-)-glycoprotein beta-1,4-n-acetylglucosaminyltransferase, isoenzyme b (MGAT4B, Accession NP_463459.1). Accordingly, utilities of GAM8358 include diagnosis, prevention and treatment of diseases and clinical conditions associated with MGAT4B.

MGC1136 (Accession NP_076930.1) is another GAM8358 target gene, herein designated TARGET GENE. MGC1136 BINDING SITE is a target binding site found in the 3' untranslated region of mRNA encoded by MGC1136, corresponding to a target binding site such as BINDING SITE I, BINDING SITE II or BINDING SITE III of FIG. 8. Table 4 illustrates the complementarity of the nucleotide sequences of MGC1136 BINDING SITE, designated SEQ ID:2422, to the nucleotide sequence of GAM8358 RNA, herein designated GAM RNA, also designated SEQ ID:255.

Another function of GAM8358 is therefore inhibition of MGC1136 (Accession NP_076930.1). Accordingly, utilities of GAM8358 include diagnosis, prevention and treatment of diseases and clinical conditions associated with MGC1136.

MGC14859 (Accession XP_030295.3) is another GAM8358 target gene, herein designated TARGET GENE. MGC14859 BINDING SITE is a target binding site found in the 3' untranslated region of mRNA encoded by MGC14859, corresponding to a target binding site such as BINDING SITE I, BINDING SITE II or BINDING SITE III of FIG. 8. Table 4 illustrates the complementarity of the nucleotide sequences of MGC14859 BINDING SITE, designated SEQ ID:2435, to the nucleotide sequence of GAM8358 RNA, herein designated GAM RNA, also designated SEQ ID:255.

Another function of GAM8358 is therefore inhibition of MGC14859 (Accession XP_030295.3). Accordingly, utilities of GAM8358 include diagnosis, prevention and treatment of diseases and clinical conditions associated with MGC14859.

MGC15523 (Accession NP_612637.1) is another GAM8358 target gene, herein designated TARGET GENE. MGC15523 BINDING SITE is a target binding site found in the 5' untranslated region of mRNA encoded by MGC15523, corresponding to a target binding site such as BINDING SITE I, BINDING SITE II or BINDING SITE III of FIG. 8. Table 4 illustrates the complementarity of the nucleotide sequences of MGC15523 BINDING SITE, designated SEQ ID:19724, to the nucleotide sequence of GAM8358 RNA, herein designated GAM RNA, also designated SEQ ID:255.

Another function of GAM8358 is therefore inhibition of MGC15523 (Accession NP_612637.1). Accordingly, utilities of GAM8358 include diagnosis, prevention and treatment of diseases and clinical conditions associated with MGC15523.

MGC15885 (Accession XP_294758.1) is another GAM8358 target gene, herein designated TARGET GENE. MGC15885 BINDING SITE is a target binding site found in the 3' untranslated region of mRNA encoded by MGC15885, corresponding to a target binding site such as BINDING SITE I, BINDING SITE II or BINDING SITE III of FIG. 8. Table 4 illustrates the complementarity of the nucleotide sequences of MGC15885 BINDING SITE, designated SEQ ID:2341, to the nucleotide sequence of GAM8358 RNA, herein designated GAM RNA, also designated SEQ ID:255.

Another function of GAM8358 is therefore inhibition of MGC15885 (Accession XP_294758.1). Accordingly, utilities of GAM8358 include diagnosis, prevention and treatment of diseases and clinical conditions associated with MGC15885.

MGC17330 (Accession NP_443112.1) is another GAM8358 target gene, herein designated TARGET GENE. MGC17330 BINDING SITE is a target binding site found in the 3' untranslated region of mRNA encoded by MGC17330, corresponding to a target binding site such as BINDING SITE I, BINDING SITE II or BINDING SITE III of FIG. 8. Table 4 illustrates the complementarity of the nucleotide sequences of MGC17330 BINDING SITE, designated SEQ ID:4035, to the nucleotide sequence of GAM8358 RNA, herein designated GAM RNA, also designated SEQ ID:255.

Another function of GAM8358 is therefore inhibition of MGC17330 (Accession NP_443112.1). Accordingly, utilities of GAM8358 include diagnosis, prevention and treatment of diseases and clinical conditions associated with MGC17330.

MGC20398 (Accession NP_443089.1) is another GAM8358 target gene, herein designated TARGET GENE. MGC20398 BINDING SITE is a target binding site found in the 3' untranslated region of mRNA encoded by MGC20398, corresponding to a target binding site such as BINDING SITE I, BINDING SITE II or BINDING SITE III of FIG. 8. Table 4 illustrates the complementarity of the nucleotide sequences of MGC20398 BINDING SITE, designated SEQ ID:1889, to the nucleotide sequence of GAM8358 RNA, herein designated GAM RNA, also designated SEQ ID:255.

Another function of GAM8358 is therefore inhibition of MGC20398 (Accession NP_443089.1). Accordingly, utilities of GAM8358 include diagnosis, prevention and treatment of diseases and clinical conditions associated with MGC20398.

MGC23885 (Accession NP_689714.1) is another GAM8358 target gene, herein designated TARGET GENE. MGC23885 BINDING SITE is a target binding site found in the 3' untranslated region of mRNA encoded by MGC23885, corresponding to a target binding site such as BINDING SITE I, BINDING SITE II or BINDING SITE III of FIG. 8. Table 4 illustrates the complementarity of the nucleotide sequences of MGC23885 BINDING SITE, designated SEQ ID:11074, to the nucleotide sequence of GAM8358 RNA, herein designated GAM RNA, also designated SEQ ID:255.

Another function of GAM8358 is therefore inhibition of MGC23885 (Accession NP_689714.1). Accordingly, utilities of GAM8358 include diagnosis, prevention and treatment of diseases and clinical conditions associated with MGC23885.

MGC32065 (Accession NP_695003.1) is another GAM8358 target gene, herein designated TARGET GENE. MGC32065 BINDING SITE is a target binding site found in the 3' untranslated region of mRNA encoded by MGC32065, corresponding to a target binding site such as BINDING SITE I, BINDING SITE II or BINDING SITE III of FIG. 8. Table 4 illustrates the complementarity of the nucleotide sequences of MGC32065 BINDING SITE, designated SEQ ID:15890, to the nucleotide sequence of GAM8358 RNA, herein designated GAM RNA, also designated SEQ ID:255.

Another function of GAM8358 is therefore inhibition of MGC32065 (Accession NP_695003.1). Accordingly, utilities of GAM8358 include diagnosis, prevention and treatment of diseases and clinical conditions associated with MGC32065.

MGC34830 (Accession NP_689527.1) is another GAM8358 target gene, herein designated TARGET GENE. MGC34830 BINDING SITE is a target binding site found in the 3' untranslated region of mRNA encoded by MGC34830, corresponding to a target binding site such as BINDING SITE I, BINDING SITE II or BINDING SITE III of FIG. 8. Table 4 illustrates the complementarity of the nucleotide sequences of MGC34830 BINDING SITE, designated SEQ ID:12612, to the nucleotide sequence of GAM8358 RNA, herein designated GAM RNA, also designated SEQ ID:255.

Another function of GAM8358 is therefore inhibition of MGC34830 (Accession NP_689527.1). Accordingly, utilities of GAM8358 include diagnosis, prevention and treatment of diseases and clinical conditions associated with MGC34830.

MGC39325 (Accession NP_671722.1) is another GAM8358 target gene, herein designated TARGET GENE. MGC39325 BINDING SITE1 and MGC39325 BINDING SITE2 are target binding sites found in untranslated regions of mRNA encoded by MGC39325, corresponding to target binding sites such as BINDING SITE I, BINDING SITE II or BINDING SITE III of FIG. 8. Table 4 illustrates the complementarity of the nucleotide sequences of MGC39325 BINDING SITE1 and MGC39325 BINDING SITE2, designated SEQ ID:7913 and SEQ ID:15215 respectively, to the nucleotide sequence of GAM8358 RNA, herein designated GAM RNA, also designated SEQ ID:255.

Another function of GAM8358 is therefore inhibition of MGC39325 (Accession NP_671722.1). Accordingly, utilities of GAM8358 include diagnosis, prevention and treatment of diseases and clinical conditions associated with MGC39325.

MGC40555 (Accession NP_689498.1) is another GAM8358 target gene, herein designated TARGET GENE.

MGC40555 BINDING SITE is a target binding site found in the 3' untranslated region of mRNA encoded by MGC40555, corresponding to a target binding site such as BINDING SITE I, BINDING SITE II or BINDING SITE III of FIG. 8. Table 4 illustrates the complementarity of the nucleotide sequences of MGC40555 BINDING SITE, designated SEQ ID:10027, to the nucleotide sequence of GAM8358 RNA, herein designated GAM RNA, also designated SEQ ID:255.

Another function of GAM8358 is therefore inhibition of MGC40555 (Accession NP_689498.1). Accordingly, utilities of GAM8358 include diagnosis, prevention and treatment of diseases and clinical conditions associated with MGC40555.

MGC42630 (Accession NP_787119.1) is another GAM8358 target gene, herein designated TARGET GENE. MGC42630 BINDING SITE is a target binding site found in the 3' untranslated region of mRNA encoded by MGC42630, corresponding to a target binding site such as BINDING SITE I, BINDING SITE II or BINDING SITE III of FIG. 8. Table 4 illustrates the complementarity of the nucleotide sequences of MGC42630 BINDING SITE, designated SEQ ID:10509, to the nucleotide sequence of GAM8358 RNA, herein designated GAM RNA, also designated SEQ ID:255.

Another function of GAM8358 is therefore inhibition of MGC42630 (Accession NP_787119.1). Accordingly, utilities of GAM8358 include diagnosis, prevention and treatment of diseases and clinical conditions associated with MGC42630.

MGC5391 (Accession NP_116129.2) is another GAM8358 target gene, herein designated TARGET GENE. MGC5391 BINDING SITE is a target binding site found in the 3' untranslated region of mRNA encoded by MGC5391, corresponding to a target binding site such as BINDING SITE I, BINDING SITE II or BINDING SITE III of FIG. 8. Table 4 illustrates the complementarity of the nucleotide sequences of MGC5391 BINDING SITE, designated SEQ ID:12983, to the nucleotide sequence of GAM8358 RNA, herein designated GAM RNA, also designated SEQ ID:255.

Another function of GAM8358 is therefore inhibition of MGC5391 (Accession NP_116129.2). Accordingly, utilities of GAM8358 include diagnosis, prevention and treatment of diseases and clinical conditions associated with MGC5391.

Membrane metallo-endopeptidase (neutral endopeptidase, enkephalinase, calla, cd10) (MME, Accession NP_009220.1) is another GAM8358 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:4104, to the nucleotide sequence of GAM8358 RNA, herein designated GAM RNA, also designated SEQ ID:255.

Another function of GAM8358 is therefore inhibition of Membrane metallo-endopeptidase (neutral endopeptidase, enkephalinase, calla, cd10) (MME, Accession NP_009220.1), a gene which is thermolysin-like specificity. and therefore is associated with Acute lymphocytic leukemia. Accordingly, utilities of GAM8358 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_009219.1) is another GAM8358 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:4104, to the nucleotide sequence of GAM8358 RNA, herein designated GAM RNA, also designated SEQ ID:255.

Another function of GAM8358 is therefore inhibition of Membrane metallo-endopeptidase (neutral endopeptidase, enkephalinase, calla, cd10) (MME, Accession NP_009219.1), a gene which is thermolysin-like specificity. and therefore is associated with Acute lymphocytic leukemia. Accordingly, utilities of GAM8358 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_000893.1) is another GAM8358 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:4104, to the nucleotide sequence of GAM8358 RNA, herein designated GAM RNA, also designated SEQ ID:255.

Another function of GAM8358 is therefore inhibition of Membrane metallo-endopeptidase (neutral endopeptidase, enkephalinase, calla, cd10) (MME, Accession NP_000893.1), a gene which is thermolysin-like specificity. and therefore is associated with Acute lymphocytic leukemia. Accordingly, utilities of GAM8358 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_009218.1) is another GAM8358 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:4104, to the nucleotide sequence of GAM8358 RNA, herein designated GAM RNA, also designated SEQ ID:255.

Another function of GAM8358 is therefore inhibition of Membrane metallo-endopeptidase (neutral endopeptidase, enkephalinase, calla, cd10) (MME, Accession NP_009218.1), a gene which is thermolysin-like specificity. and therefore is associated with Acute lymphocytic leukemia. Accordingly, utilities of GAM8358 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Matrix metalloproteinase 2 (gelatinase a, 72 kda gelatinase, 72 kda type iv collagenase) (MMP2, Accession NP_004521.1) is another GAM8358 target gene, herein designated TARGET GENE. MMP2 BINDING SITE is a target binding site found in the 3' untranslated region of mRNA encoded by MMP2, corresponding to a target binding site such as BINDING SITE I, BINDING SITE II or BINDING SITE III of FIG. 8. Table 4 illustrates the complementarity of the nucleotide sequences of MMP2 BINDING SITE, designated SEQ ID:17651, to the nucleotide sequence of GAM8358 RNA, herein designated GAM RNA, also designated SEQ ID:255.

Another function of GAM8358 is therefore inhibition of Matrix metalloproteinase 2 (gelatinase a, 72 kda gelatinase, 72 kda type iv collagenase) (MMP2, Accession NP_004521.1). Accordingly, utilities of GAM8358 include diagnosis, prevention and treatment of diseases and clinical conditions associated with MMP2.

MOST2 (Accession NP_064635.1) is another GAM8358 target gene, herein designated TARGET GENE. MOST2 BINDING SITE is a target binding site found in the 5' untranslated region of mRNA encoded by MOST2, corresponding to a target binding site such as BINDING SITE I, BINDING SITE II or BINDING SITE III of FIG. 8. Table 4 illustrates the complementarity of the nucleotide sequences of MOST2 BINDING SITE, designated SEQ ID:993, to the nucleotide sequence of GAM8358 RNA, herein designated GAM RNA, also designated SEQ ID:255.

Another function of GAM8358 is therefore inhibition of MOST2 (Accession NP_064635.1). Accordingly, utilities of GAM8358 include diagnosis, prevention and treatment of diseases and clinical conditions associated with MOST2.

Membrane protein, palmitoylated 2 (maguk p55 subfamily member 2) (MPP2, Accession NP_005365.2) is another GAM8358 target gene, herein designated TARGET GENE. MPP2 BINDING SITE is a target binding site found in the 3' untranslated region of mRNA encoded by MPP2, corresponding to a target binding site such as BINDING SITE I, BINDING SITE II or BINDING SITE III of FIG. 8. Table 4 illustrates the complementarity of the nucleotide sequences of MPP2 BINDING SITE, designated SEQ ID:3308, to the nucleotide sequence of GAM8358 RNA, herein designated GAM RNA, also designated SEQ ID:255.

Another function of GAM8358 is therefore inhibition of Membrane protein, palmitoylated 2 (maguk p55 subfamily member 2) (MPP2, Accession NP_005365.2). Accordingly, utilities of GAM8358 include diagnosis, prevention and treatment of diseases and clinical conditions associated with MPP2.

Mitochondrial ribosomal protein l9 (MRPL9, Accession NP_113608.1) is another GAM8358 target gene, herein designated TARGET GENE. MRPL9 BINDING SITE is a target binding site found in the 3' untranslated region of mRNA encoded by MRPL9, corresponding to a target binding site such as BINDING SITE I, BINDING SITE II or BINDING SITE III of FIG. 8. Table 4 illustrates the complementarity of the nucleotide sequences of MRPL9 BINDING SITE, designated SEQ ID:14139, to the nucleotide sequence of GAM8358 RNA, herein designated GAM RNA, also designated SEQ ID:255.

Another function of GAM8358 is therefore inhibition of Mitochondrial ribosomal protein l9 (MRPL9, Accession NP_113608.1). Accordingly, utilities of GAM8358 include diagnosis, prevention and treatment of diseases and clinical conditions associated with MRPL9.

Musashi homolog 2 (drosophila) (MSI2, Accession NP_733839.1) is another GAM8358 target gene, herein designated TARGET GENE. MSI2 BINDING SITE is a target binding site found in the 3' untranslated region of multiple transcripts of mRNA encoded by MSI2, corresponding to a target binding site such as BINDING SITE I, BINDING SITE II or BINDING SITE III of FIG. 8. Table 4 illustrates the complementarity of the nucleotide sequences of MSI2 BINDING SITE, designated SEQ ID:13149, to the nucleotide sequence of GAM8358 RNA, herein designated GAM RNA, also designated SEQ ID:255.

Another function of GAM8358 is therefore inhibition of Musashi homolog 2 (drosophila) (MSI2, Accession NP_733839.1). Accordingly, utilities of GAM8358 include diagnosis, prevention and treatment of diseases and clinical conditions associated with MSI2.

5,10-methylenetetrahydrofolate reductase (nadph) (MTHFR, Accession NP_005948.1) is another GAM8358 target gene, herein designated TARGET GENE. MTHFR BINDING SITE is a target binding site found in the 3' untranslated region of mRNA encoded by MTHFR, corresponding to a target binding site such as BINDING SITE I, BINDING SITE II or BINDING SITE III of FIG. 8. Table 4 illustrates the complementarity of the nucleotide sequences of MTHFR BINDING SITE, designated SEQ ID:8401, to the nucleotide sequence of GAM8358 RNA, herein designated GAM RNA, also designated SEQ ID:255.

Another function of GAM8358 is therefore inhibition of 5,10-methylenetetrahydrofolate reductase (nadph) (MTHFR, Accession NP_005948.1). Accordingly, utilities of GAM8358 include diagnosis, prevention and treatment of diseases and clinical conditions associated with MTHFR.

V-myb myeloblastosis viral oncogene homolog (avian)-like 2 (MYBL2, Accession NP_002457.1) is another GAM8358 target gene, herein designated TARGET GENE. MYBL2 BINDING SITE1 and MYBL2 BINDING SITE2 are target binding sites found in untranslated regions of mRNA encoded by MYBL2, corresponding to target binding sites such as BINDING SITE I, BINDING SITE II or BINDING SITE III of FIG. 8. Table 4 illustrates the complementarity of the nucleotide sequences of MYBL2 BINDING SITE1 and MYBL2 BINDING SITE2, designated SEQ ID:18152 and SEQ ID:6152 respectively, to the nucleotide sequence of GAM8358 RNA, herein designated GAM RNA, also designated SEQ ID:255.

Another function of GAM8358 is therefore inhibition of V-myb myeloblastosis viral oncogene homolog (avian)-like 2 (MYBL2, Accession NP_002457.1), a gene which plays an essential role during cell cycle progression. Accordingly, utilities of GAM8358 include diagnosis, prevention and treatment of diseases and clinical conditions associated with MYBL2.

The function of MYBL2 and its association with various diseases and clinical conditions, has been established by previous studies, as described hereinabove with reference to GAM215.1. Myosin binding protein c, slow type (MYBPC1, Accession NP_002456.1) is another GAM8358 target gene, herein designated TARGET GENE. MYBPC1 BINDING SITE is a target binding site found in the 3' untranslated region of mRNA encoded by MYBPC1, corresponding to a target binding site such as BINDING SITE I, BINDING SITE II or BINDING SITE III of FIG. 8. Table 4 illustrates the complementarity of the nucleotide sequences of MYBPC1 BINDING SITE, designated SEQ ID:14764, to the nucleotide sequence of GAM8358 RNA, herein designated GAM RNA, also designated SEQ ID:255.

Another function of GAM8358 is therefore inhibition of Myosin binding protein c, slow type (MYBPC1, Accession NP_002456.1). Accordingly, utilities of GAM8358 include diagnosis, prevention and treatment of diseases and clinical conditions associated with MYBPC1.

Myosin ib (MYO1B, Accession XP_290989.1) is another GAM8358 target gene, herein designated TARGET GENE. MYO1B BINDING SITE is a target binding site found in the 5' untranslated region of mRNA encoded by MYO1B, corresponding to a target binding site such as BINDING SITE I, BINDING SITE II or BINDING SITE III of FIG. 8. Table 4 illustrates the complementarity of the nucleotide sequences of MYO1B BINDING SITE, designated SEQ ID:15695, to the nucleotide sequence of GAM8358 RNA, herein designated GAM RNA, also designated SEQ ID:255.

Another function of GAM8358 is therefore inhibition of Myosin ib (MYO1B, Accession XP_290989.1). Accordingly, utilities of GAM8358 include diagnosis, prevention and treatment of diseases and clinical conditions associated with MYO1B.

N4BP2 (Accession NP_060647.2) is another GAM8358 target gene, herein designated TARGET GENE. N4BP2 BINDING SITE is a target binding site found in the 3' untranslated region of mRNA encoded by N4BP2, corresponding to a target binding site such as BINDING SITE I, BINDING SITE II or BINDING SITE III of FIG. 8. Table 4 illustrates the complementarity of the nucleotide sequences of N4BP2 BINDING SITE, designated SEQ ID:13301, to the nucleotide sequence of GAM8358 RNA, herein designated GAM RNA, also designated SEQ ID:255.

Another function of GAM8358 is therefore inhibition of N4BP2 (Accession NP_060647.2). Accordingly, utilities of GAM8358 include diagnosis, prevention and treatment of diseases and clinical conditions associated with N4BP2.

N4BP3 (Accession XP_038920.2) is another GAM8358 target gene, herein designated TARGET GENE. N4BP3 BINDING SITE is a target binding site found in the 3' untranslated region of mRNA encoded by N4BP3, corresponding to a target binding site such as BINDING SITE I, BINDING SITE II or BINDING SITE III of FIG. 8. Table 4 illustrates the complementarity of the nucleotide sequences of N4BP3 BINDING SITE, designated SEQ ID:1115, to the nucleotide sequence of GAM8358 RNA, herein designated GAM RNA, also designated SEQ ID:255.

Another function of GAM8358 is therefore inhibition of N4BP3 (Accession XP_038920.2). Accordingly, utilities of GAM8358 include diagnosis, prevention and treatment of diseases and clinical conditions associated with N4BP3.

Ngfi-a binding protein 1 (egr1 binding protein 1) (NAB1, Accession NP_005957.2) is another GAM8358 target gene, herein designated TARGET GENE. NAB1 BINDING SITE is a target binding site found in the 3' untranslated region of mRNA encoded by NAB1, corresponding to a target binding site such as BINDING SITE I, BINDING SITE II or BINDING SITE III of FIG. 8. Table 4 illustrates the complementarity of the nucleotide sequences of NAB1 BINDING SITE, designated SEQ ID:3469, to the nucleotide sequence of GAM8358 RNA, herein designated GAM RNA, also designated SEQ ID:255.

Another function of GAM8358 is therefore inhibition of Ngfi-a binding protein 1 (egr1 binding protein 1) (NAB1, Accession NP_005957.2), a gene which acts as a transcriptional repressor for zinc finger transcription factors egr1 and egr2 (by similarity). Accordingly, utilities of GAM8358 include diagnosis, prevention and treatment of diseases and clinical conditions associated with NAB1.

The function of NAB1 and its association with various diseases and clinical conditions, has been established by previous studies, as described hereinabove with reference to GAM499.1. NDFIP1 (Accession NP_085048.1) is another GAM8358 target gene, herein designated TARGET GENE. NDFIP1 BINDING SITE is a target binding site found in the 3' untranslated region of mRNA encoded by NDFIP1, corresponding to a target binding site such as BINDING SITE I, BINDING SITE II or BINDING SITE III of FIG. 8. Table 4 illustrates the complementarity of the nucleotide sequences of NDFIP1 BINDING SITE, designated SEQ ID:8122, to the nucleotide sequence of GAM8358 RNA, herein designated GAM RNA, also designated SEQ ID:255.

Another function of GAM8358 is therefore inhibition of NDFIP1 (Accession NP_085048.1). Accordingly, utilities of GAM8358 include diagnosis, prevention and treatment of diseases and clinical conditions associated with NDFIP1.

NEBL (Accession NP_006384.1) is another GAM8358 target gene, herein designated TARGET GENE. NEBL BINDING SITE is a target binding site found in the 3' untranslated region of mRNA encoded by NEBL, corresponding to a target binding site such as BINDING SITE I, BINDING SITE II or BINDING SITE III of FIG. 8. Table 4 illustrates the complementarity of the nucleotide sequences of NEBL BINDING SITE, designated SEQ ID:7080, to the nucleotide sequence of GAM8358 RNA, herein designated GAM RNA, also designated SEQ ID:255.

Another function of GAM8358 is therefore inhibition of NEBL (Accession NP_006384.1). Accordingly, utilities of GAM8358 include diagnosis, prevention and treatment of diseases and clinical conditions associated with NEBL.

Neuropilin (nrp) and tolloid (tll)-like 2 (NETO2, Accession NP_060562.3) is another GAM8358 target gene, herein designated TARGET GENE. NETO2 BINDING SITE is a target binding site found in the 3' untranslated region of mRNA encoded by NETO2, corresponding to a target binding site such as BINDING SITE I, BINDING SITE II or BINDING SITE III of FIG. 8. Table 4 illustrates the complementarity of the nucleotide sequences of NETO2 BINDING SITE, designated SEQ ID:2069, to the nucleotide sequence of GAM8358 RNA, herein designated GAM RNA, also designated SEQ ID:255.

Another function of GAM8358 is therefore inhibition of Neuropilin (nrp) and tolloid (tll)-like 2 (NETO2, Accession NP_060562.3). Accordingly, utilities of GAM8358 include diagnosis, prevention and treatment of diseases and clinical conditions associated with NETO2.

NFASC (Accession XP_046808.8) is another GAM8358 target gene, herein designated TARGET GENE. NFASC BINDING SITE is a target binding site found in the 3' untranslated region of mRNA encoded by NFASC, corresponding to a target binding site such as BINDING SITE I, BINDING SITE II or BINDING SITE III of FIG. 8. Table 4 illustrates the complementarity of the nucleotide sequences of NFASC BINDING SITE, designated SEQ ID:521, to the nucleotide sequence of GAM8358 RNA, herein designated GAM RNA, also designated SEQ ID:255.

Another function of GAM8358 is therefore inhibition of NFASC (Accession XP_046808.8). Accordingly, utilities of GAM8358 include diagnosis, prevention and treatment of diseases and clinical conditions associated with NFASC.

Ninjurin 1 (NINJ1, Accession NP_004139.1) is another GAM8358 target gene, herein designated TARGET GENE. NINJ1 BINDING SITE is a target binding site found in the 3' untranslated region of mRNA encoded by NINJ1, corresponding to a target binding site such as BINDING SITE I, BINDING SITE II or BINDING SITE III of FIG. 8. Table 4 illustrates the complementarity of the nucleotide sequences of NINJ1 BINDING SITE, designated SEQ ID:16214, to the nucleotide sequence of GAM8358 RNA, herein designated GAM RNA, also designated SEQ ID:255.

Another function of GAM8358 is therefore inhibition of Ninjurin 1 (NINJ1, Accession NP_004139.1), a gene which may play a role in nerve regeneration and in the formation and function of other tissues. Accordingly, utilities of GAM8358 include diagnosis, prevention and treatment of diseases and clinical conditions associated with NINJ1.

The function of NINJ1 and its association with various diseases and clinical conditions, has been established by previous studies, as described hereinabove with reference to GAM558.1. Natural killer-tumor recognition sequence (NKTR, Accession NP_005376.2) is another GAM8358 target gene, herein designated TARGET GENE. NKTR BINDING SITE is a target binding site found in the 3' untranslated region of mRNA encoded by NKTR, corresponding to a target binding site such as BINDING SITE I, BINDING SITE II or BINDING SITE III of FIG. 8. Table 4 illustrates the complementarity of the nucleotide sequences of NKTR BINDING SITE, designated SEQ ID:8666, to the nucleotide sequence of GAM8358 RNA, herein designated GAM RNA, also designated SEQ ID:255.

Another function of GAM8358 is therefore inhibition of Natural killer-tumor recognition sequence (NKTR, Accession NP_005376.2), a gene which is involved in the function of nk cells. Accordingly, utilities of GAM8358 include diagnosis, prevention and treatment of diseases and clinical conditions associated with NKTR.

The function of NKTR and its association with various diseases and clinical conditions, has been established by previous studies, as described hereinabove with reference to GAM467.2. Nucleoredoxin (NXN, Accession NP_071908.1) is another GAM8358 target gene, herein designated TARGET GENE. NXN BINDING SITE is a target binding site found in the 3' untranslated region of mRNA encoded by NXN, corresponding to a target binding site such as BINDING SITE I, BINDING SITE II or BINDING SITE III of FIG. 8. Table 4 illustrates the complementarity of the nucleotide sequences of NXN BINDING SITE, designated SEQ ID:18637, to the nucleotide sequence of GAM8358 RNA, herein designated GAM RNA, also designated SEQ ID:255.

Another function of GAM8358 is therefore inhibition of Nucleoredoxin (NXN, Accession NP_071908.1). Accordingly, utilities of GAM8358 include diagnosis, prevention and treatment of diseases and clinical conditions associated with NXN.

Ornithine decarboxylase antizyme 3 (OAZ3, Accession NP_057262.1) is another GAM8358 target gene, herein designated TARGET GENE. OAZ3 BINDING SITE is a target binding site found in the 5' untranslated region of mRNA encoded by OAZ3, corresponding to a target binding site such as BINDING SITE I, BINDING SITE II or BINDING SITE III of FIG. 8. Table 4 illustrates the complementarity of the nucleotide sequences of OAZ3 BINDING SITE, designated SEQ ID:7561, to the nucleotide sequence of GAM8358 RNA, herein designated GAM RNA, also designated SEQ ID:255.

Another function of GAM8358 is therefore inhibition of Ornithine decarboxylase antizyme 3 (OAZ3, Accession NP_057262.1). Accordingly, utilities of GAM8358 include diagnosis, prevention and treatment of diseases and clinical conditions associated with OAZ3.

Outer dense fiber of sperm tails 2 (ODF2, Accession NP_002531.3) is another GAM8358 target gene, herein designated TARGET GENE. ODF2 BINDING SITE is a target binding site found in the 5' untranslated region of multiple transcripts of mRNA encoded by ODF2, corresponding to a target binding site such as BINDING SITE I, BINDING SITE II or BINDING SITE III of FIG. 8. Table 4 illustrates the complementarity of the nucleotide sequences of ODF2 BINDING SITE, designated SEQ ID:2038, to the nucleotide sequence of GAM8358 RNA, herein designated GAM RNA, also designated SEQ ID:255.

Another function of GAM8358 is therefore inhibition of Outer dense fiber of sperm tails 2 (ODF2, Accession NP_002531.3), a gene which is very strongly similar to rat Odf2. Accordingly, utilities of GAM8358 include diagnosis, prevention and treatment of diseases and clinical conditions associated with ODF2.

The function of ODF2 and its association with various diseases and clinical conditions, has been established by previous studies, as described hereinabove with reference to GAM515.2. Outer dense fiber of sperm tails 2 (ODF2, Accession NP_702915.1) is another GAM8358 target gene, herein designated TARGET GENE. ODF2 BINDING SITE is a target binding site found in the 5' untranslated region of multiple transcripts of mRNA encoded by ODF2, corresponding to a target binding site such as BINDING SITE I, BINDING SITE II or BINDING SITE III of FIG. 8. Table 4 illustrates the complementarity of the nucleotide sequences of ODF2 BINDING SITE, designated SEQ ID:2038, to the nucleotide sequence of GAM8358 RNA, herein designated GAM RNA, also designated SEQ ID:255.

Another function of GAM8358 is therefore inhibition of Outer dense fiber of sperm tails 2 (ODF2, Accession NP_702915.1), a gene which is very strongly similar to rat Odf2. Accordingly, utilities of GAM8358 include diagnosis, prevention and treatment of diseases and clinical conditions associated with ODF2.

The function of ODF2 and its association with various diseases and clinical conditions, has been established by previous studies, as described hereinabove with reference to GAM515.2. OIP106 (Accession NP_055780.1) is another GAM8358 target gene, herein designated TARGET GENE. OIP106 BINDING SITE is a target binding site found in the 3' untranslated region of mRNA encoded by OIP106, corresponding to a target binding site such as BINDING SITE I, BINDING SITE II or BINDING SITE III of FIG. 8. Table 4 illustrates the complementarity of the nucleotide sequences of OIP106 BINDING SITE, designated SEQ ID:14387, to the nucleotide sequence of GAM8358 RNA, herein designated GAM RNA, also designated SEQ ID:255.

Another function of GAM8358 is therefore inhibition of OIP106 (Accession NP_055780.1). Accordingly, utilities of GAM8358 include diagnosis, prevention and treatment of diseases and clinical conditions associated with OIP106.

Optic atrophy 1 (autosomal dominant) (OPA1, Accession NP_056375.1) is another GAM8358 target gene, herein designated TARGET GENE. OPA1 BINDING SITE is a target binding site found in the 3' untranslated region of multiple transcripts of mRNA encoded by OPA1, corresponding to a target binding site such as BINDING SITE I, BINDING SITE II or BINDING SITE III of FIG. 8. Table 4 illustrates the complementarity of the nucleotide sequences of OPA1 BINDING SITE, designated SEQ ID:6097, to the nucleotide sequence of GAM8358 RNA, herein designated GAM RNA, also designated SEQ ID:255.

Another function of GAM8358 is therefore inhibition of Optic atrophy 1 (autosomal dominant) (OPA1, Accession NP_056375.1). Accordingly, utilities of GAM8358 include diagnosis, prevention and treatment of diseases and clinical conditions associated with OPA1.

Optic atrophy 1 (autosomal dominant) (OPA1, Accession NP_570850.1) is another GAM8358 target gene, herein designated TARGET GENE. OPA1 BINDING SITE is a target binding site found in the 3' untranslated region of multiple transcripts of mRNA encoded by OPA1, corresponding to a target binding site such as BINDING SITE I, BINDING SITE II or BINDING SITE III of FIG. 8. Table 4 illustrates the complementarity of the nucleotide sequences of OPA1 BINDING SITE, designated SEQ ID:6097, to the nucleotide sequence of GAM8358 RNA, herein designated GAM RNA, also designated SEQ ID:255.

Another function of GAM8358 is therefore inhibition of Optic atrophy 1 (autosomal dominant) (OPA1, Accession NP__570850.1). Accordingly, utilities of GAM8358 include diagnosis, prevention and treatment of diseases and clinical conditions associated with OPA1.

Optic atrophy 1 (autosomal dominant) (OPA1, Accession NP_570849.1) is another GAM8358 target gene, herein designated TARGET GENE. OPA1 BINDING SITE is a target binding site found in the 3' untranslated region of multiple transcripts of mRNA encoded by OPA1, corresponding to a target binding site such as BINDING SITE I, BINDING SITE II or BINDING SITE III of FIG. 8. Table 4 illustrates the complementarity of the nucleotide sequences of OPA1 BINDING SITE, designated SEQ ID:6097, to the nucleotide sequence of GAM8358 RNA, herein designated GAM RNA, also designated SEQ ID:255.

Another function of GAM8358 is therefore inhibition of Optic atrophy 1 (autosomal dominant) (OPA1, Accession NP__570849.1). Accordingly, utilities of GAM8358 include diagnosis, prevention and treatment of diseases and clinical conditions associated with OPA1.

Optic atrophy 1 (autosomal dominant) (OPA1, Accession NP_570844.1) is another GAM8358 target gene, herein designated TARGET GENE. OPA1 BINDING SITE is a target binding site found in the 3' untranslated region of multiple transcripts of mRNA encoded by OPA1, corresponding to a target binding site such as BINDING SITE I, BINDING SITE II or BINDING SITE III of FIG. 8. Table 4 illustrates the complementarity of the nucleotide sequences of OPA1 BINDING SITE, designated SEQ ID:6097, to the nucleotide sequence of GAM8358 RNA, herein designated GAM RNA, also designated SEQ ID:255.

Another function of GAM8358 is therefore inhibition of Optic atrophy 1 (autosomal dominant) (OPA1, Accession NP__570844.1). Accordingly, utilities of GAM8358 include diagnosis, prevention and treatment of diseases and clinical conditions associated with OPA1.

Optic atrophy 1 (autosomal dominant) (OPA1, Accession NP_570845.1) is another GAM8358 target gene, herein designated TARGET GENE. OPA1 BINDING SITE is a target binding site found in the 3' untranslated region of multiple transcripts of mRNA encoded by OPA1, corresponding to a target binding site such as BINDING SITE I, BINDING SITE II or BINDING SITE III of FIG. 8. Table 4 illustrates the complementarity of the nucleotide sequences of OPA1 BINDING SITE, designated SEQ ID:6097, to the nucleotide sequence of GAM8358 RNA, herein designated GAM RNA, also designated SEQ ID:255.

Another function of GAM8358 is therefore inhibition of Optic atrophy 1 (autosomal dominant) (OPA1, Accession NP__570845.1). Accordingly, utilities of GAM8358 include diagnosis, prevention and treatment of diseases and clinical conditions associated with OPA1.

Optic atrophy 1 (autosomal dominant) (OPA1, Accession NP_570848.1) is another GAM8358 target gene, herein designated TARGET GENE. OPA1 BINDING SITE is a target binding site found in the 3' untranslated region of multiple transcripts of mRNA encoded by OPA1, corresponding to a target binding site such as BINDING SITE I, BINDING SITE II or BINDING SITE III of FIG. 8. Table 4 illustrates the complementarity of the nucleotide sequences of OPA1 BINDING SITE, designated SEQ ID:6097, to the nucleotide sequence of GAM8358 RNA, herein designated GAM RNA, also designated SEQ ID:255.

Another function of GAM8358 is therefore inhibition of Optic atrophy 1 (autosomal dominant) (OPA1, Accession NP__570848.1). Accordingly, utilities of GAM8358 include diagnosis, prevention and treatment of diseases and clinical conditions associated with OPA1.

Optic atrophy 1 (autosomal dominant) (OPA1, Accession NP_570847.1) is another GAM8358 target gene, herein designated TARGET GENE. OPA1 BINDING SITE is a target binding site found in the 3' untranslated region of multiple transcripts of mRNA encoded by OPA1, corresponding to a target binding site such as BINDING SITE I, BINDING SITE II or BINDING SITE III of FIG. 8. Table 4 illustrates the complementarity of the nucleotide sequences of OPA1 BINDING SITE, designated SEQ ID:6097, to the nucleotide sequence of GAM8358 RNA, herein designated GAM RNA, also designated SEQ ID:255.

Another function of GAM8358 is therefore inhibition of Optic atrophy 1 (autosomal dominant) (OPA1, Accession NP__570847.1). Accordingly, utilities of GAM8358 include diagnosis, prevention and treatment of diseases and clinical conditions associated with OPA1.

Optic atrophy 1 (autosomal dominant) (OPA1, Accession NP_570846.1) is another GAM8358 target gene, herein designated TARGET GENE. OPA1 BINDING SITE is a target binding site found in the 3' untranslated region of multiple transcripts of mRNA encoded by OPA1, corresponding to a target binding site such as BINDING SITE I, BINDING SITE II or BINDING SITE III of FIG. 8. Table 4 illustrates the complementarity of the nucleotide sequences of OPA1 BINDING SITE, designated SEQ ID:6097, to the nucleotide sequence of GAM8358 RNA, herein designated GAM RNA, also designated SEQ ID:255.

Another function of GAM8358 is therefore inhibition of Optic atrophy 1 (autosomal dominant) (OPA1, Accession NP__570846.1). Accordingly, utilities of GAM8358 include diagnosis, prevention and treatment of diseases and clinical conditions associated with OPA1.

OSCAR (Accession NP__573398.1) is another GAM8358 target gene, herein designated TARGET GENE. OSCAR BINDING SITE is a target binding site found in the 5' untranslated region of multiple transcripts of mRNA encoded by OSCAR, corresponding to a target binding site such as BINDING SITE I, BINDING SITE II or BINDING SITE III of FIG. 8. Table 4 illustrates the complementarity of the nucleotide sequences of OSCAR BINDING SITE, designated SEQ ID:18649, to the nucleotide sequence of GAM8358 RNA, herein designated GAM RNA, also designated SEQ ID:255.

Another function of GAM8358 is therefore inhibition of OSCAR (Accession NP__573398.1). Accordingly, utilities of GAM8358 include diagnosis, prevention and treatment of diseases and clinical conditions associated with OSCAR.

OSCAR (Accession NP__570127.1) is another GAM8358 target gene, herein designated TARGET GENE. OSCAR BINDING SITE is a target binding site found in the 5' untranslated region of multiple transcripts of mRNA encoded by OSCAR, corresponding to a target binding site such as BINDING SITE I, BINDING SITE II or BINDING SITE III of FIG. 8. Table 4 illustrates the complementarity of the nucleotide sequences of OSCAR BINDING SITE, designated SEQ ID:18649, to the nucleotide sequence of GAM8358 RNA, herein designated GAM RNA, also designated SEQ ID:255.

Another function of GAM8358 is therefore inhibition of OSCAR (Accession NP_570127.1). Accordingly, utilities of GAM8358 include diagnosis, prevention and treatment of diseases and clinical conditions associated with OSCAR.

OSCAR (Accession NP_573399.1) is another GAM8358 target gene, herein designated TARGET GENE. OSCAR BINDING SITE is a target binding site found in the 5' untranslated region of multiple transcripts of mRNA encoded by OSCAR, corresponding to a target binding site such as BINDING SITE I, BINDING SITE II or BINDING SITE III of FIG. 8. Table 4 illustrates the complementarity of the nucleotide sequences of OSCAR BINDING SITE, designated SEQ ID:18649, to the nucleotide sequence of GAM8358 RNA, herein designated GAM RNA, also designated SEQ ID:255.

Another function of GAM8358 is therefore inhibition of OSCAR (Accession NP_573399.1). Accordingly, utilities of GAM8358 include diagnosis, prevention and treatment of diseases and clinical conditions associated with OSCAR.

OTOP3 (Accession XP_292588.2) is another GAM8358 target gene, herein designated TARGET GENE. OTOP3 BINDING SITE is a target binding site found in the 5' untranslated region of mRNA encoded by OTOP3, corresponding to a target binding site such as BINDING SITE I, BINDING SITE II or BINDING SITE III of FIG. 8. Table 4 illustrates the complementarity of the nucleotide sequences of OTOP3 BINDING SITE, designated SEQ ID:13034, to the nucleotide sequence of GAM8358 RNA, herein designated GAM RNA, also designated SEQ ID:255.

Another function of GAM8358 is therefore inhibition of OTOP3 (Accession XP_292588.2). Accordingly, utilities of GAM8358 include diagnosis, prevention and treatment of diseases and clinical conditions associated with OTOP3.

Purinergic receptor p2x, ligand-gated ion channel, 4 (P2RX4, Accession NP_002551.2) is another GAM8358 target gene, herein designated TARGET GENE. P2RX4 BINDING SITE is a target binding site found in the 5' untranslated region of multiple transcripts of mRNA encoded by P2RX4, corresponding to a target binding site such as BINDING SITE I, BINDING SITE II or BINDING SITE III of FIG. 8. Table 4 illustrates the complementarity of the nucleotide sequences of P2RX4 BINDING SITE, designated SEQ ID:5900, to the nucleotide sequence of GAM8358 RNA, herein designated GAM RNA, also designated SEQ ID:255.

Another function of GAM8358 is therefore inhibition of Purinergic receptor p2x, ligand-gated ion channel, 4 (P2RX4, Accession NP_002551.2), a gene which acts as a ligand gated ion channel. Accordingly, utilities of GAM8358 include diagnosis, prevention and treatment of diseases and clinical conditions associated with P2RX4.

The function of P2RX4 and its association with various diseases and clinical conditions, has been established by previous studies, as described hereinabove with reference to GAM212.1. Purinergic receptor p2x, ligand-gated ion channel, 4 (P2RX4, Accession NP_780776.1) is another GAM8358 target gene, herein designated TARGET GENE. P2RX4 BINDING SITE is a target binding site found in the 5' untranslated region of multiple transcripts of mRNA encoded by P2RX4, corresponding to a target binding site such as BINDING SITE I, BINDING SITE II or BINDING SITE III of FIG. 8. Table 4 illustrates the complementarity of the nucleotide sequences of P2RX4 BINDING SITE, designated SEQ ID:5900, to the nucleotide sequence of GAM8358 RNA, herein designated GAM RNA, also designated SEQ ID:255.

Another function of GAM8358 is therefore inhibition of Purinergic receptor p2x, ligand-gated ion channel, 4 (P2RX4, Accession NP_780776.1), a gene which acts as a ligand gated ion channel. Accordingly, utilities of GAM8358 include diagnosis, prevention and treatment of diseases and clinical conditions associated with P2RX4.

The function of P2RX4 and its association with various diseases and clinical conditions, has been established by previous studies, as described hereinabove with reference to GAM212.1. Purinergic receptor p2x, ligand-gated ion channel, 4 (P2RX4, Accession NP_780777.1) is another GAM8358 target gene, herein designated TARGET GENE. P2RX4 BINDING SITE is a target binding site found in the 5' untranslated region of multiple transcripts of mRNA encoded by P2RX4, corresponding to a target binding site such as BINDING SITE I, BINDING SITE II or BINDING SITE III of FIG. 8. Table 4 illustrates the complementarity of the nucleotide sequences of P2RX4 BINDING SITE, designated SEQ ID:5900, to the nucleotide sequence of GAM8358 RNA, herein designated GAM RNA, also designated SEQ ID:255.

Another function of GAM8358 is therefore inhibition of Purinergic receptor p2x, ligand-gated ion channel, 4 (P2RX4, Accession NP_780777.1), a gene which acts as a ligand gated ion channel. Accordingly, utilities of GAM8358 include diagnosis, prevention and treatment of diseases and clinical conditions associated with P2RX4.

The function of P2RX4 and its association with various diseases and clinical conditions, has been established by previous studies, as described hereinabove with reference to GAM212.1. Pyrimidinergic receptor p2y, g-protein coupled, 6 (P2RY6, Accession NP_004145.1) is another GAM8358 target gene, herein designated TARGET GENE. P2RY6 BINDING SITE is a target binding site found in the 5' untranslated region of multiple transcripts of mRNA encoded by P2RY6, corresponding to a target binding site such as BINDING SITE I, BINDING SITE II or BINDING SITE III of FIG. 8. Table 4 illustrates the complementarity of the nucleotide sequences of P2RY6 BINDING SITE, designated SEQ ID:985, to the nucleotide sequence of GAM8358 RNA, herein designated GAM RNA, also designated SEQ ID:255.

Another function of GAM8358 is therefore inhibition of Pyrimidinergic receptor p2y, g-protein coupled, 6 (P2RY6, Accession NP_004145.1), a gene which mediates cellular responses to nucleotides. Accordingly, utilities of GAM8358 include diagnosis, prevention and treatment of diseases and clinical conditions associated with P2RY6.

The function of P2RY6 and its association with various diseases and clinical conditions, has been established by previous studies, as described hereinabove with reference to GAM72.1. Pyrimidinergic receptor p2y, g-protein coupled, 6 (P2RY6, Accession NP_789768.1) is another GAM8358 target gene, herein designated TARGET GENE. P2RY6 BINDING SITE is a target binding site found in the 5' untranslated region of multiple transcripts of mRNA encoded by P2RY6, corresponding to a target binding site such as BINDING SITE I, BINDING SITE II or BINDING SITE III of FIG. 8. Table 4 illustrates the complementarity of the nucleotide sequences of P2RY6 BINDING SITE, designated SEQ ID:985, to the nucleotide sequence of GAM8358 RNA, herein designated GAM RNA, also designated SEQ ID:255.

Another function of GAM8358 is therefore inhibition of Pyrimidinergic receptor p2y, g-protein coupled, 6 (P2RY6, Accession NP_789768.1), a gene which mediates cellular responses to nucleotides. Accordingly, utilities of GAM8358 include diagnosis, prevention and treatment of diseases and clinical conditions associated with P2RY6.

The function of P2RY6 and its association with various diseases and clinical conditions, has been established by previous studies, as described hereinabove with reference to GAM72.1. Pyrimidinergic receptor p2y, g-protein coupled, 6

(P2RY6, Accession NP_789766.1) is another GAM8358 target gene, herein designated TARGET GENE. P2RY6 BINDING SITE is a target binding site found in the 5' untranslated region of multiple transcripts of mRNA encoded by P2RY6, corresponding to a target binding site such as BINDING SITE I, BINDING SITE II or BINDING SITE III of FIG. 8. Table 4 illustrates the complementarity of the nucleotide sequences of P2RY6 BINDING SITE, designated SEQ ID:985, to the nucleotide sequence of GAM8358 RNA, herein designated GAM RNA, also designated SEQ ID:255.

Another function of GAM8358 is therefore inhibition of Pyrimidinergic receptor p2y, g-protein coupled, 6 (P2RY6, Accession NP_789766.1), a gene which mediates cellular responses to nucleotides. Accordingly, utilities of GAM8358 include diagnosis, prevention and treatment of diseases and clinical conditions associated with P2RY6.

The function of P2RY6 and its association with various diseases and clinical conditions, has been established by previous studies, as described hereinabove with reference to GAM72.1. P5-1 (Accession NP_006665.1) is another GAM8358 target gene, herein designated TARGET GENE. P5-1 BINDING SITE is a target binding site found in the 3' untranslated region of mRNA encoded by P5-1, corresponding to a target binding site such as BINDING SITE I, BINDING SITE II or BINDING SITE III of FIG. 8. Table 4 illustrates the complementarity of the nucleotide sequences of P5-1 BINDING SITE, designated SEQ ID:18467, to the nucleotide sequence of GAM8358 RNA, herein designated GAM RNA, also designated SEQ ID:255.

Another function of GAM8358 is therefore inhibition of P5-1 (Accession NP_006665.1). Accordingly, utilities of GAM8358 include diagnosis, prevention and treatment of diseases and clinical conditions associated with P5-1.

Peptidylglycine alpha-amidating monooxygenase (PAM, Accession NP_055872.1) is another GAM8358 target gene, herein designated TARGET GENE. PAM BINDING SITE is a target binding site found in the 3' untranslated region of multiple transcripts of mRNA encoded by PAM, corresponding to a target binding site such as BINDING SITE I, BINDING SITE II or BINDING SITE III of FIG. 8. Table 4 illustrates the complementarity of the nucleotide sequences of PAM BINDING SITE, designated SEQ ID:8824, to the nucleotide sequence of GAM8358 RNA, herein designated GAM RNA, also designated SEQ ID:255.

Another function of GAM8358 is therefore inhibition of Peptidylglycine alpha-amidating monooxygenase (PAM, Accession NP_055872.1), a gene which converts neuroendocrine peptides to active alpha-amidated products. Accordingly, utilities of GAM8358 include diagnosis, prevention and treatment of diseases and clinical conditions associated with PAM.

The function of PAM and its association with various diseases and clinical conditions, has been established by previous studies, as described hereinabove with reference to GAM322.1. PC326 (Accession NP_060912.1) is another GAM8358 target gene, herein designated TARGET GENE. PC326 BINDING SITE is a target binding site found in the 5' untranslated region of mRNA encoded by PC326, corresponding to a target binding site such as BINDING SITE I, BINDING SITE II or BINDING SITE III of FIG. 8. Table 4 illustrates the complementarity of the nucleotide sequences of PC326 BINDING SITE, designated SEQ ID:13648, to the nucleotide sequence of GAM8358 RNA, herein designated GAM RNA, also designated SEQ ID:255.

Another function of GAM8358 is therefore inhibition of PC326 (Accession NP_060912.1). Accordingly, utilities of GAM8358 include diagnosis, prevention and treatment of diseases and clinical conditions associated with PC326.

Protocadherin 17 (PCDH17, Accession NP_055274.2) is another GAM8358 target gene, herein designated TARGET GENE. PCDH17 BINDING SITE is a target binding site found in the 5' untranslated region of mRNA encoded by PCDH17, corresponding to a target binding site such as BINDING SITE I, BINDING SITE II or BINDING SITE III of FIG. 8. Table 4 illustrates the complementarity of the nucleotide sequences of PCDH17 BINDING SITE, designated SEQ ID:14897, to the nucleotide sequence of GAM8358 RNA, herein designated GAM RNA, also designated SEQ ID:255.

Another function of GAM8358 is therefore inhibition of Protocadherin 17 (PCDH17, Accession NP_055274.2). Accordingly, utilities of GAM8358 include diagnosis, prevention and treatment of diseases and clinical conditions associated with PCDH17.

Pecanex homolog (drosophila) (PCNX, Accession NP_055797.1) is another GAM8358 target gene, herein designated TARGET GENE. PCNX BINDING SITE is a target binding site found in the 5' untranslated region of mRNA encoded by PCNX, corresponding to a target binding site such as BINDING SITE I, BINDING SITE II or BINDING SITE III of FIG. 8. Table 4 illustrates the complementarity of the nucleotide sequences of PCNX BINDING SITE, designated SEQ ID:2623, to the nucleotide sequence of GAM8358 RNA, herein designated GAM RNA, also designated SEQ ID:255.

Another function of GAM8358 is therefore inhibition of Pecanex homolog (drosophila) (PCNX, Accession NP_055797.1). Accordingly, utilities of GAM8358 include diagnosis, prevention and treatment of diseases and clinical conditions associated with PCNX.

Procollagen c-endopeptidase enhancer (PCOLCE, Accession NP_002584.1) is another GAM8358 target gene, herein designated TARGET GENE. PCOLCE BINDING SITE is a target binding site found in the 5' untranslated region of mRNA encoded by PCOLCE, corresponding to a target binding site such as BINDING SITE I, BINDING SITE II or BINDING SITE III of FIG. 8. Table 4 illustrates the complementarity of the nucleotide sequences of PCOLCE BINDING SITE, designated SEQ ID:16049, to the nucleotide sequence of GAM8358 RNA, herein designated GAM RNA, also designated SEQ ID:255.

Another function of GAM8358 is therefore inhibition of Procollagen c-endopeptidase enhancer (PCOLCE, Accession NP_002584.1), a gene which binds to the cooh-terminal propeptide of type i procollagen and enhances procollagen c-proteinase activity. Accordingly, utilities of GAM8358 include diagnosis, prevention and treatment of diseases and clinical conditions associated with PCOLCE.

The function of PCOLCE and its association with various diseases and clinical conditions, has been established by previous studies, as described hereinabove with reference to GAM148.1. Phosphodiesterase 1b, calmodulin-dependent (PDE1B, Accession NP_000915.1) is another GAM8358 target gene, herein designated TARGET GENE. PDE1B BINDING SITE is a target binding site found in the 3' untranslated region of mRNA encoded by PDE1B, corresponding to a target binding site such as BINDING SITE I, BINDING SITE II or BINDING SITE III of FIG. 8. Table 4 illustrates the complementarity of the nucleotide sequences of PDE1B BINDING SITE, designated SEQ ID:11070, to the nucleotide sequence of GAM8358 RNA, herein designated GAM RNA, also designated SEQ ID:255.

Another function of GAM8358 is therefore inhibition of Phosphodiesterase 1b, calmodulin-dependent (PDE1B, Accession NP_000915.1), a gene which is a ca2+-calmodulin dependent phosphodiesterase 1B with a preferred substrate of cGMP. Accordingly, utilities of GAM8358 include diagnosis, prevention and treatment of diseases and clinical conditions associated with PDE1B.

The function of PDE1B and its association with various diseases and clinical conditions, has been established by previous studies, as described hereinabove with reference to GAM259.2. Platelet-derived growth factor receptor, beta polypeptide (PDGFRB, Accession NP_002600.1) is another GAM8358 target gene, herein designated TARGET GENE. PDGFRB BINDING SITE is a target binding site found in the 3' untranslated region of mRNA encoded by PDGFRB, corresponding to a target binding site such as BINDING SITE I, BINDING SITE II or BINDING SITE III of FIG. 8. Table 4 illustrates the complementarity of the nucleotide sequences of PDGFRB BINDING SITE, designated SEQ ID:1574, to the nucleotide sequence of GAM8358 RNA, herein designated GAM RNA, also designated SEQ ID:255.

Another function of GAM8358 is therefore inhibition of Platelet-derived growth factor receptor, beta polypeptide (PDGFRB, Accession NP_002600.1), a gene which Platelet-derived growth factor receptor beta chain; tyrosine kinase receptor. and therefore may be associated with Chronic myeloproliferative diseases. Accordingly, utilities of GAM8358 include diagnosis, prevention and treatment of Chronic myeloproliferative diseases, and of other diseases and clinical conditions associated with PDGFRB.

The function of PDGFRB and its association with various diseases and clinical conditions, has been established by previous studies, as described hereinabove with reference to GAM579.1. Paternally expressed 10 (PEG10, Accession NP_055883.1) is another GAM8358 target gene, herein designated TARGET GENE. PEG10 BINDING SITE is a target binding site found in the 3' untranslated region of mRNA encoded by PEG10, corresponding to a target binding site such as BINDING SITE I, BINDING SITE II or BINDING SITE III of FIG. 8. Table 4 illustrates the complementarity of the nucleotide sequences of PEG10 BINDING SITE, designated SEQ ID:15770, to the nucleotide sequence of GAM8358 RNA, herein designated GAM RNA, also designated SEQ ID:255.

Another function of GAM8358 is therefore inhibition of Paternally expressed 10 (PEG10, Accession NP_055883.1). Accordingly, utilities of GAM8358 include diagnosis, prevention and treatment of diseases and clinical conditions associated with PEG10.

Pet112-like (yeast) (PET112L, Accession NP_004555.1) is another GAM8358 target gene, herein designated TARGET GENE. PET112L BINDING SITE is a target binding site found in the 3' untranslated region of mRNA encoded by PET112L, corresponding to a target binding site such as BINDING SITE I, BINDING SITE II or BINDING SITE III of FIG. 8. Table 4 illustrates the complementarity of the nucleotide sequences of PET112L BINDING SITE, designated SEQ ID:6659, to the nucleotide sequence of GAM8358 RNA, herein designated GAM RNA, also designated SEQ ID:255.

Another function of GAM8358 is therefore inhibition of Pet112-like (yeast) (PET112L, Accession NP_004555.1). Accordingly, utilities of GAM8358 include diagnosis, prevention and treatment of diseases and clinical conditions associated with PET112L.

Phd finger protein 1 (PHF1, Accession NP_002627.1) is another GAM8358 target gene, herein designated TARGET GENE. PHF1 BINDING SITE is a target binding site found in the 3' untranslated region of multiple transcripts of mRNA encoded by PHF1, corresponding to a target binding site such as BINDING SITE I, BINDING SITE II or BINDING SITE III of FIG. 8. Table 4 illustrates the complementarity of the nucleotide sequences of PHF1 BINDING SITE, designated SEQ ID:13506, to the nucleotide sequence of GAM8358 RNA, herein designated GAM RNA, also designated SEQ ID:255.

Another function of GAM8358 is therefore inhibition of Phd finger protein 1 (PHF1, Accession NP_002627.1). Accordingly, utilities of GAM8358 include diagnosis, prevention and treatment of diseases and clinical conditions associated with PHF1.

PI4KII (Accession NP_060895.1) is another GAM8358 target gene, herein designated TARGET GENE. PI4KII BINDING SITE is a target binding site found in the 3' untranslated region of mRNA encoded by PI4KII, corresponding to a target binding site such as BINDING SITE I, BINDING SITE II or BINDING SITE III of FIG. 8. Table 4 illustrates the complementarity of the nucleotide sequences of PI4KII BINDING SITE, designated SEQ ID:17573, to the nucleotide sequence of GAM8358 RNA, herein designated GAM RNA, also designated SEQ ID:255.

Another function of GAM8358 is therefore inhibition of PI4KII (Accession NP_060895.1). Accordingly, utilities of GAM8358 include diagnosis, prevention and treatment of diseases and clinical conditions associated with PI4KII.

PILRB (Accession NP_038468.3) is another GAM8358 target gene, herein designated TARGET GENE. PILRB BINDING SITE1 and PILRB BINDING SITE2 are target binding sites found in untranslated regions of multiple transcripts of mRNA encoded by PILRB, corresponding to target binding sites such as BINDING SITE I, BINDING SITE II or BINDING SITE III of FIG. 8. Table 4 illustrates the complementarity of the nucleotide sequences of PILRB BINDING SITE1 and PILRB BINDING SITE2, designated SEQ ID:15545 and SEQ ID:5463 respectively, to the nucleotide sequence of GAM8358 RNA, herein designated GAM RNA, also designated SEQ ID:255.

Another function of GAM8358 is therefore inhibition of PILRB (Accession NP_038468.3). Accordingly, utilities of GAM8358 include diagnosis, prevention and treatment of diseases and clinical conditions associated with PILRB.

PILRB (Accession NP_778212.2) is another GAM8358 target gene, herein designated TARGET GENE. PILRB BINDING SITE1 and PILRB BINDING SITE2 are target binding sites found in untranslated regions of multiple transcripts of mRNA encoded by PILRB, corresponding to target binding sites such as BINDING SITE I, BINDING SITE II or BINDING SITE III of FIG. 8. Table 4 illustrates the complementarity of the nucleotide sequences of PILRB BINDING SITE1 and PILRB BINDING SITE2, designated SEQ ID:15545 and SEQ ID:5463 respectively, to the nucleotide sequence of GAM8358 RNA, herein designated GAM RNA, also designated SEQ ID:255.

Another function of GAM8358 is therefore inhibition of PILRB (Accession NP_778212.2). Accordingly, utilities of GAM8358 include diagnosis, prevention and treatment of diseases and clinical conditions associated with PILRB.

Pim-2 oncogene (PIM2, Accession NP_006866.1) is another GAM8358 target gene, herein designated TARGET GENE. PIM2 BINDING SITE is a target binding site found in the 3' untranslated region of mRNA encoded by PIM2, corresponding to a target binding site such as BINDING SITE I, BINDING SITE II or BINDING SITE III of FIG. 8. Table 4 illustrates the complementarity of the nucleotide sequences of PIM2 BINDING SITE, designated SEQ ID:584, to the nucleotide sequence of GAM8358 RNA, herein designated GAM RNA, also designated SEQ ID:255.

Another function of GAM8358 is therefore inhibition of Pim-2 oncogene (PIM2, Accession NP__006866.1). Accordingly, utilities of GAM8358 include diagnosis, prevention and treatment of diseases and clinical conditions associated with PIM2.

PIP5K2C (Accession NP__079055.2) is another GAM8358 target gene, herein designated TARGET GENE. PIP5K2C BINDING SITE is a target binding site found in the 3' untranslated region of mRNA encoded by PIP5K2C, corresponding to a target binding site such as BINDING SITE I, BINDING SITE II or BINDING SITE III of FIG. 8. Table 4 illustrates the complementarity of the nucleotide sequences of PIP5K2C BINDING SITE, designated SEQ ID:13606, to the nucleotide sequence of GAM8358 RNA, herein designated GAM RNA, also designated SEQ ID:255.

Another function of GAM8358 is therefore inhibition of PIP5K2C (Accession NP__079055.2). Accordingly, utilities of GAM8358 include diagnosis, prevention and treatment of diseases and clinical conditions associated with PIP5K2C.

Pleiomorphic adenoma gene-like 1 (PLAGL1, Accession NP__006709.2) is another GAM8358 target gene, herein designated TARGET GENE. PLAGL1 BINDING SITE is a target binding site found in the 5' untranslated region of multiple transcripts of mRNA encoded by PLAGL1, corresponding to a target binding site such as BINDING SITE I, BINDING SITE II or BINDING SITE III of FIG. 8. Table 4 illustrates the complementarity of the nucleotide sequences of PLAGL1 BINDING SITE, designated SEQ ID:2458, to the nucleotide sequence of GAM8358 RNA, herein designated GAM RNA, also designated SEQ ID:255.

Another function of GAM8358 is therefore inhibition of Pleiomorphic adenoma gene-like 1 (PLAGL1, Accession NP__006709.2), a gene which regulates apoptosis and cell cycle arrest. Accordingly, utilities of GAM8358 include diagnosis, prevention and treatment of diseases and clinical conditions associated with PLAGL1.

The function of PLAGL1 and its association with various diseases and clinical conditions, has been established by previous studies, as described hereinabove with reference to GAM96.1. Promyelocytic leukemia (PML, Accession NP__150245.1) is another GAM8358 target gene, herein designated TARGET GENE. PML BINDING SITE1 and PML BINDING SITE2 are target binding sites found in untranslated regions of multiple transcripts of mRNA encoded by PML, corresponding to target binding sites such as BINDING SITE I, BINDING SITE II or BINDING SITE III of FIG. 8. Table 4 illustrates the complementarity of the nucleotide sequences of PML BINDING SITE1 and PML BINDING SITE2, designated SEQ ID:1247 and SEQ ID:1247 respectively, to the nucleotide sequence of GAM8358 RNA, herein designated GAM RNA, also designated SEQ ID:255.

Another function of GAM8358 is therefore inhibition of Promyelocytic leukemia (PML, Accession NP__150245.1). Accordingly, utilities of GAM8358 include diagnosis, prevention and treatment of diseases and clinical conditions associated with PML.

Promyelocytic leukemia (PML, Accession NP__150242.1) is another GAM8358 target gene, herein designated TARGET GENE. PML BINDING SITE1 and PML BINDING SITE2 are target binding sites found in untranslated regions of multiple transcripts of mRNA encoded by PML, corresponding to target binding sites such as BINDING SITE I, BINDING SITE II or BINDING SITE III of FIG. 8. Table 4 illustrates the complementarity of the nucleotide sequences of PML BINDING SITE1 and PML BINDING SITE2, designated SEQ ID:1247 and SEQ ID:1247 respectively, to the nucleotide sequence of GAM8358 RNA, herein designated GAM RNA, also designated SEQ ID:255.

Another function of GAM8358 is therefore inhibition of Promyelocytic leukemia (PML, Accession NP__150242.1). Accordingly, utilities of GAM8358 include diagnosis, prevention and treatment of diseases and clinical conditions associated with PML.

Promyelocytic leukemia (PML, Accession NP__150241.1) is another GAM8358 target gene, herein designated TARGET GENE. PML BINDING SITE1 and PML BINDING SITE2 are target binding sites found in untranslated regions of multiple transcripts of mRNA encoded by PML, corresponding to target binding sites such as BINDING SITE I, BINDING SITE II or BINDING SITE III of FIG. 8. Table 4 illustrates the complementarity of the nucleotide sequences of PML BINDING SITE1 and PML BINDING SITE2, designated SEQ ID:2434 and SEQ ID:1247 respectively, to the nucleotide sequence of GAM8358 RNA, herein designated GAM RNA, also designated SEQ ID:255.

Another function of GAM8358 is therefore inhibition of Promyelocytic leukemia (PML, Accession NP__150241.1). Accordingly, utilities of GAM8358 include diagnosis, prevention and treatment of diseases and clinical conditions associated with PML.

Promyelocytic leukemia (PML, Accession NP__150253.1) is another GAM8358 target gene, herein designated TARGET GENE. PML BINDING SITE1 and PML BINDING SITE2 are target binding sites found in untranslated regions of multiple transcripts of mRNA encoded by PML, corresponding to target binding sites such as BINDING SITE I, BINDING SITE II or BINDING SITE III of FIG. 8. Table 4 illustrates the complementarity of the nucleotide sequences of PML BINDING SITE1 and PML BINDING SITE2, designated SEQ ID:1247 and SEQ ID:13657 respectively, to the nucleotide sequence of GAM8358 RNA, herein designated GAM RNA, also designated SEQ ID:255.

Another function of GAM8358 is therefore inhibition of Promyelocytic leukemia (PML, Accession NP__150253.1). Accordingly, utilities of GAM8358 include diagnosis, prevention and treatment of diseases and clinical conditions associated with PML.

Polymerase (dna directed), theta (POLQ, Accession NP__006587.2) is another GAM8358 target gene, herein designated TARGET GENE. POLQ BINDING SITE is a target binding site found in the 3' untranslated region of mRNA encoded by POLQ, corresponding to a target binding site such as BINDING SITE I, BINDING SITE II or BINDING SITE III of FIG. 8. Table 4 illustrates the complementarity of the nucleotide sequences of POLQ BINDING SITE, designated SEQ ID:2177, to the nucleotide sequence of GAM8358 RNA, herein designated GAM RNA, also designated SEQ ID:255.

Another function of GAM8358 is therefore inhibition of Polymerase (dna directed), theta (POLQ, Accession NP__006587.2), a gene which enhances untargeted mutagenesis. Accordingly, utilities of GAM8358 include diagnosis, prevention and treatment of diseases and clinical conditions associated with POLQ.

The function of POLQ and its association with various diseases and clinical conditions, has been established by previous studies, as described hereinabove with reference to GAM1609.1. POLR3D (Accession NP__001713.1) is another GAM8358 target gene, herein designated TARGET GENE. POLR3D BINDING SITE is a target binding site found in the 3' untranslated region of mRNA encoded by POLR3D, corresponding to a target binding site such as BINDING SITE I, BINDING SITE II or BINDING SITE III of FIG. 8. Table 4 illustrates the complementarity of the nucleotide sequences of POLR3D BINDING SITE, designated SEQ ID:5565, to the nucleotide sequence of GAM8358 RNA, herein designated GAM RNA, also designated SEQ ID:255.

Another function of GAM8358 is therefore inhibition of POLR3D (Accession NP_001713.1). Accordingly, utilities of GAM8358 include diagnosis, prevention and treatment of diseases and clinical conditions associated with POLR3D.

Peptidylprolyl isomerase (cyclophilin)-like 2 (PPIL2, Accession NP_680480.1) is another GAM8358 target gene, herein designated TARGET GENE. PPIL2 BINDING SITE is a target binding site found in the 3' untranslated region of multiple transcripts of mRNA encoded by PPIL2, corresponding to a target binding site such as BINDING SITE I, BINDING SITE II or BINDING SITE III of FIG. 8. Table 4 illustrates the complementarity of the nucleotide sequences of PPIL2 BINDING SITE, designated SEQ ID:13963, to the nucleotide sequence of GAM8358 RNA, herein designated GAM RNA, also designated SEQ ID:255.

Another function of GAM8358 is therefore inhibition of Peptidylprolyl isomerase (cyclophilin)-like 2 (PPIL2, Accession NP_680480.1). Accordingly, utilities of GAM8358 include diagnosis, prevention and treatment of diseases and clinical conditions associated with PPIL2.

Protein phosphatase 1e (pp2c domain containing) (PPM1E, Accession NP_055721.3) is another GAM8358 target gene, herein designated TARGET GENE. PPM1E BINDING SITE is a target binding site found in the 3' untranslated region of mRNA encoded by PPM1E, corresponding to a target binding site such as BINDING SITE I, BINDING SITE II or BINDING SITE III of FIG. 8. Table 4 illustrates the complementarity of the nucleotide sequences of PPM1E BINDING SITE, designated SEQ ID:5899, to the nucleotide sequence of GAM8358 RNA, herein designated GAM RNA, also designated SEQ ID:255.

Another function of GAM8358 is therefore inhibition of Protein phosphatase 1e (pp2c domain containing) (PPM1E, Accession NP_055721.3). Accordingly, utilities of GAM8358 include diagnosis, prevention and treatment of diseases and clinical conditions associated with PPM1E.

Protein phosphatase 1, regulatory subunit 3d (PPP1R3D, Accession NP_006233.1) is another GAM8358 target gene, herein designated TARGET GENE. PPP1R3D BINDING SITE is a target binding site found in the 5' untranslated region of mRNA encoded by PPP1R3D, corresponding to a target binding site such as BINDING SITE I, BINDING SITE II or BINDING SITE III of FIG. 8. Table 4 illustrates the complementarity of the nucleotide sequences of PPP1R3D BINDING SITE, designated SEQ ID:5493, to the nucleotide sequence of GAM8358 RNA, herein designated GAM RNA, also designated SEQ ID:255.

Another function of GAM8358 is therefore inhibition of Protein phosphatase 1, regulatory subunit 3d (PPP1R3D, Accession NP_006233.1). Accordingly, utilities of GAM8358 include diagnosis, prevention and treatment of diseases and clinical conditions associated with PPP1R3D.

Protein phosphatase 3 (formerly 2b), regulatory subunit b, 19 kda, alpha isoform (calcineurin b, type i) (PPP3R1, Accession NP_000936.1) is another GAM8358 target gene, herein designated TARGET GENE. PPP3R1 BINDING SITE is a target binding site found in the 3' untranslated region of mRNA encoded by PPP3R1, corresponding to a target binding site such as BINDING SITE I, BINDING SITE II or BINDING SITE III of FIG. 8. Table 4 illustrates the complementarity of the nucleotide sequences of PPP3R1 BINDING SITE, designated SEQ ID:3148, to the nucleotide sequence of GAM8358 RNA, herein designated GAM RNA, also designated SEQ ID:255.

Another function of GAM8358 is therefore inhibition of Protein phosphatase 3 (formerly 2b), regulatory subunit b, 19 kda, alpha isoform (calcineurin b, type i) (PPP3R1, Accession NP_000936.1), a gene which is a regulatory subunit of calcineurim, a calcium-dependent, calmodulin stimulated protein phosphatase 3. Accordingly, utilities of GAM8358 include diagnosis, prevention and treatment of diseases and clinical conditions associated with PPP3R1.

The function of PPP3R1 and its association with various diseases and clinical conditions, has been established by previous studies, as described hereinabove with reference to GAM369.1. Papillary renal cell carcinoma (translocation-associated) (PRCC, Accession NP_005964.2) is another GAM8358 target gene, herein designated TARGET GENE. PRCC BINDING SITE is a target binding site found in the 5' untranslated region of mRNA encoded by PRCC, corresponding to a target binding site such as BINDING SITE I, BINDING SITE II or BINDING SITE III of FIG. 8. Table 4 illustrates the complementarity of the nucleotide sequences of PRCC BINDING SITE, designated SEQ ID:9455, to the nucleotide sequence of GAM8358 RNA, herein designated GAM RNA, also designated SEQ ID:255.

Another function of GAM8358 is therefore inhibition of Papillary renal cell carcinoma (translocation-associated) (PRCC, Accession NP_005964.2). Accordingly, utilities of GAM8358 include diagnosis, prevention and treatment of diseases and clinical conditions associated with PRCC.

Pr domain containing 7 (PRDM7, Accession NP_443722.1) is another GAM8358 target gene, herein designated TARGET GENE. PRDM7 BINDING SITE is a target binding site found in the 3' untranslated region of mRNA encoded by PRDM7, corresponding to a target binding site such as BINDING SITE I, BINDING SITE II or BINDING SITE III of FIG. 8. Table 4 illustrates the complementarity of the nucleotide sequences of PRDM7 BINDING SITE, designated SEQ ID:4427, to the nucleotide sequence of GAM8358 RNA, herein designated GAM RNA, also designated SEQ ID:255.

Another function of GAM8358 is therefore inhibition of Pr domain containing 7 (PRDM7, Accession NP_443722.1). Accordingly, utilities of GAM8358 include diagnosis, prevention and treatment of diseases and clinical conditions associated with PRDM7.

Pr domain containing 9 (PRDM9, Accession NP_064612.1) is another GAM8358 target gene, herein designated TARGET GENE. PRDM9 BINDING SITE is a target binding site found in the 3' untranslated region of mRNA encoded by PRDM9, corresponding to a target binding site such as BINDING SITE I, BINDING SITE II or BINDING SITE III of FIG. 8. Table 4 illustrates the complementarity of the nucleotide sequences of PRDM9 BINDING SITE, designated SEQ ID:4427, to the nucleotide sequence of GAM8358 RNA, herein designated GAM RNA, also designated SEQ ID:255.

Another function of GAM8358 is therefore inhibition of Pr domain containing 9 (PRDM9, Accession NP_064612.1). Accordingly, utilities of GAM8358 include diagnosis, prevention and treatment of diseases and clinical conditions associated with PRDM9.

Protein-kinase, interferon-inducible double stranded rna dependent inhibitor, repressor of (p58 repressor) (PRKRIR, Accession NP_004696.2) is another GAM8358 target gene, herein designated TARGET GENE. PRKRIR BINDING SITE is a target binding site found in the 3' untranslated region of mRNA encoded by PRKRIR, corresponding to a target binding site such as BINDING SITE I, BINDING SITE II or BINDING SITE III of FIG. 8. Table 4 illustrates the complementarity of the nucleotide sequences of PRKRIR BINDING SITE, designated SEQ ID:2605, to the nucleotide sequence of GAM8358 RNA, herein designated GAM RNA, also designated SEQ ID:255.

Another function of GAM8358 is therefore inhibition of Protein-kinase, interferon-inducible double stranded rna dependent inhibitor, repressor of (p58 repressor) (PRKRIR, Accession NP_004696.2). Accordingly, utilities of GAM8358 include diagnosis, prevention and treatment of diseases and clinical conditions associated with PRKRIR.

PRO0461 (Accession NP_112558.1) is another GAM8358 target gene, herein designated TARGET GENE. PRO0461 BINDING SITE is a target binding site found in the 5' untranslated region of mRNA encoded by PRO0461, corresponding to a target binding site such as BINDING SITE I, BINDING SITE II or BINDING SITE III of FIG. 8. Table 4 illustrates the complementarity of the nucleotide sequences of PRO0461 BINDING SITE, designated SEQ ID:7800, to the nucleotide sequence of GAM8358 RNA, herein designated GAM RNA, also designated SEQ ID:255.

Another function of GAM8358 is therefore inhibition of PRO0461 (Accession NP_112558.1). Accordingly, utilities of GAM8358 include diagnosis, prevention and treatment of diseases and clinical conditions associated with PRO0461.

PRO0650 (Accession NP_054856.1) is another GAM8358 target gene, herein designated TARGET GENE. PRO0650 BINDING SITE is a target binding site found in the 5' untranslated region of mRNA encoded by PRO0650, corresponding to a target binding site such as BINDING SITE I, BINDING SITE II or BINDING SITE III of FIG. 8. Table 4 illustrates the complementarity of the nucleotide sequences of PRO0650 BINDING SITE, designated SEQ ID:12955, to the nucleotide sequence of GAM8358 RNA, herein designated GAM RNA, also designated SEQ ID:255.

Another function of GAM8358 is therefore inhibition of PRO0650 (Accession NP_054856.1). Accordingly, utilities of GAM8358 include diagnosis, prevention and treatment of diseases and clinical conditions associated with PRO0650.

Proteasome (prosome, macropain) subunit, alpha type, 5 (PSMA5, Accession NP_002781.2) is another GAM8358 target gene, herein designated TARGET GENE. PSMA5 BINDING SITE is a target binding site found in the 5' untranslated region of mRNA encoded by PSMA5, corresponding to a target binding site such as BINDING SITE I, BINDING SITE II or BINDING SITE III of FIG. 8. Table 4 illustrates the complementarity of the nucleotide sequences of PSMA5 BINDING SITE, designated SEQ ID:11290, to the nucleotide sequence of GAM8358 RNA, herein designated GAM RNA, also designated SEQ ID:255.

Another function of GAM8358 is therefore inhibition of Proteasome (prosome, macropain) subunit, alpha type, 5 (PSMA5, Accession NP_002781.2). Accordingly, utilities of GAM8358 include diagnosis, prevention and treatment of diseases and clinical conditions associated with PSMA5.

Phosphatidylserine synthase 2 (PTDSS2, Accession NP_110410.1) is another GAM8358 target gene, herein designated TARGET GENE. PTDSS2 BINDING SITE is a target binding site found in the 3' untranslated region of mRNA encoded by PTDSS2, corresponding to a target binding site such as BINDING SITE I, BINDING SITE II or BINDING SITE III of FIG. 8. Table 4 illustrates the complementarity of the nucleotide sequences of PTDSS2 BINDING SITE, designated SEQ ID:14935, to the nucleotide sequence of GAM8358 RNA, herein designated GAM RNA, also designated SEQ ID:255.

Another function of GAM8358 is therefore inhibition of Phosphatidylserine synthase 2 (PTDSS2, Accession NP_110410.1). Accordingly, utilities of GAM8358 include diagnosis, prevention and treatment of diseases and clinical conditions associated with PTDSS2.

Prostaglandin i2 (prostacyclin) synthase (PTGIS, Accession NP_000952.1) is another GAM8358 target gene, herein designated TARGET GENE. PTGIS BINDING SITE is a target binding site found in the 3' untranslated region of mRNA encoded by PTGIS, corresponding to a target binding site such as BINDING SITE I, BINDING SITE II or BINDING SITE III of FIG. 8. Table 4 illustrates the complementarity of the nucleotide sequences of PTGIS BINDING SITE, designated SEQ ID:3522, to the nucleotide sequence of GAM8358 RNA, herein designated GAM RNA, also designated SEQ ID:255.

Another function of GAM8358 is therefore inhibition of Prostaglandin i2 (prostacyclin) synthase (PTGIS, Accession NP_000952.1), a gene which catalyzes the isomerization of prostaglandin h2 to prostacyclin (=prostaglandin i2). Accordingly, utilities of GAM8358 include diagnosis, prevention and treatment of diseases and clinical conditions associated with PTGIS.

The function of PTGIS and its association with various diseases and clinical conditions, has been established by previous studies, as described hereinabove with reference to GAM30.1. Phosphorylase, glycogen; muscle (mcardle syndrome, glycogen storage disease type v) (PYGM, Accession NP_005600.1) is another GAM8358 target gene, herein designated TARGET GENE. PYGM BINDING SITE is a target binding site found in the 5' untranslated region of mRNA encoded by PYGM, corresponding to a target binding site such as BINDING SITE I, BINDING SITE II or BINDING SITE III of FIG. 8. Table 4 illustrates the complementarity of the nucleotide sequences of PYGM BINDING SITE, designated SEQ ID:6017, to the nucleotide sequence of GAM8358 RNA, herein designated GAM RNA, also designated SEQ ID:255.

Another function of GAM8358 is therefore inhibition of Phosphorylase, glycogen; muscle (mcardle syndrome, glycogen storage disease type v) (PYGM, Accession NP_005600.1). Accordingly, utilities of GAM8358 include diagnosis, prevention and treatment of diseases and clinical conditions associated with PYGM.

RAB2B (Accession NP_116235.2) is another GAM8358 target gene, herein designated TARGET GENE. RAB2B BINDING SITE is a target binding site found in the 3' untranslated region of mRNA encoded by RAB2B, corresponding to a target binding site such as BINDING SITE I, BINDING SITE II or BINDING SITE III of FIG. 8. Table 4 illustrates the complementarity of the nucleotide sequences of RAB2B BINDING SITE, designated SEQ ID:19612, to the nucleotide sequence of GAM8358 RNA, herein designated GAM RNA, also designated SEQ ID:255.

Another function of GAM8358 is therefore inhibition of RAB2B (Accession NP_116235.2). Accordingly, utilities of GAM8358 include diagnosis, prevention and treatment of diseases and clinical conditions associated with RAB2B.

Rab36, member ras oncogene family (RAB36, Accession NP_004905.1) is another GAM8358 target gene, herein designated TARGET GENE. RAB36 BINDING SITE is a target binding site found in the 3' untranslated region of mRNA encoded by RAB36, corresponding to a target binding site such as BINDING SITE I, BINDING SITE II or BINDING SITE III of FIG. 8. Table 4 illustrates the complementarity of the nucleotide sequences of RAB36 BINDING SITE, designated SEQ ID:8203, to the nucleotide sequence of GAM8358 RNA, herein designated GAM RNA, also designated SEQ ID:255.

Another function of GAM8358 is therefore inhibition of Rab36, member ras oncogene family (RAB36, Accession NP_004905.1), a gene which is involved in protein transport. Accordingly, utilities of GAM8358 include diagnosis, prevention and treatment of diseases and clinical conditions associated with RAB36.

The function of RAB36 and its association with various diseases and clinical conditions, has been established by previous studies, as described hereinabove with reference to GAM130.1. Rae1 rna export 1 homolog (s. pombe) (RAE1, Accession NP_003601.1) is another GAM8358 target gene, herein designated TARGET GENE. RAE1 BINDING SITE is a target binding site found in the 3' untranslated region of mRNA encoded by RAE1, corresponding to a target binding site such as BINDING SITE I, BINDING SITE II or BINDING SITE III of FIG. 8. Table 4 illustrates the complementarity of the nucleotide sequences of RAE1 BINDING SITE, designated SEQ ID:12024, to the nucleotide sequence of GAM8358 RNA, herein designated GAM RNA, also designated SEQ ID:255.

Another function of GAM8358 is therefore inhibition of Rae1 rna export 1 homolog (s. pombe) (RAE1, Accession NP_003601.1). Accordingly, utilities of GAM8358 include diagnosis, prevention and treatment of diseases and clinical conditions associated with RAE1.

Recombination activating gene 2 (RAG2, Accession NP_000527.1) is another GAM8358 target gene, herein designated TARGET GENE. RAG2 BINDING SITE is a target binding site found in the 5' untranslated region of mRNA encoded by RAG2, corresponding to a target binding site such as BINDING SITE I, BINDING SITE II or BINDING SITE III of FIG. 8. Table 4 illustrates the complementarity of the nucleotide sequences of RAG2 BINDING SITE, designated SEQ ID:15119, to the nucleotide sequence of GAM8358 RNA, herein designated GAM RNA, also designated SEQ ID:255.

Another function of GAM8358 is therefore inhibition of Recombination activating gene 2 (RAG2, Accession NP_000527.1). Accordingly, utilities of GAM8358 include diagnosis, prevention and treatment of diseases and clinical conditions associated with RAG2.

RALGPS1A (Accession NP_055451.1) is another GAM8358 target gene, herein designated TARGET GENE. RALGPS1A BINDING SITE1 and RALGPS1A BINDING SITE2 are target binding sites found in untranslated regions of mRNA encoded by RALGPS1A, corresponding to target binding sites such as BINDING SITE I, BINDING SITE II or BINDING SITE III of FIG. 8. Table 4 illustrates the complementarity of the nucleotide sequences of RALGPS1A BINDING SITE1 and RALGPS1A BINDING SITE2, designated SEQ ID:12537 and SEQ ID:3361 respectively, to the nucleotide sequence of GAM8358 RNA, herein designated GAM RNA, also designated SEQ ID:255.

Another function of GAM8358 is therefore inhibition of RALGPS1A (Accession NP_055451.1). Accordingly, utilities of GAM8358 include diagnosis, prevention and treatment of diseases and clinical conditions associated with RALGPS1A.

Ras association (ralgds/af-6) domain family 2 (RASSF2, Accession NP_055552.1) is another GAM8358 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:11773, to the nucleotide sequence of GAM8358 RNA, herein designated GAM RNA, also designated SEQ ID:255.

Another function of GAM8358 is therefore inhibition of Ras association (ralgds/af-6) domain family 2 (RASSF2, Accession NP_055552.1). Accordingly, utilities of GAM8358 include diagnosis, prevention and treatment of diseases and clinical conditions associated with RASSF2.

Ras association (ralgds/af-6) domain family 2 (RASSF2, Accession NP_739580.1) is another GAM8358 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:11773, to the nucleotide sequence of GAM8358 RNA, herein designated GAM RNA, also designated SEQ ID:255.

Another function of GAM8358 is therefore inhibition of Ras association (ralgds/af-6) domain family 2 (RASSF2, Accession NP_739580.1). Accordingly, utilities of GAM8358 include diagnosis, prevention and treatment of diseases and clinical conditions associated with RASSF2.

Ras association (ralgds/af-6) domain family 2 (RASSF2, Accession NP_739579.1) is another GAM8358 target gene, herein designated TARGET GENE. RASSF2 BINDING SITE is a target binding site found in the 3' untranslated region of multiple transcripts of mRNA encoded by RASSF2, corresponding to a target binding site such as BINDING SITE I, BINDING SITE II or BINDING SITE III of FIG. 8. Table 4 illustrates the complementarity of the nucleotide sequences of RASSF2 BINDING SITE, designated SEQ ID:11773, to the nucleotide sequence of GAM8358 RNA, herein designated GAM RNA, also designated SEQ ID:255.

Another function of GAM8358 is therefore inhibition of Ras association (ralgds/af-6) domain family 2 (RASSF2, Accession NP_739579.1). Accordingly, utilities of GAM8358 include diagnosis, prevention and treatment of diseases and clinical conditions associated with RASSF2.

Rna binding motif protein 7 (RBM7, Accession NP_057174.1) is another GAM8358 target gene, herein designated TARGET GENE. RBM7 BINDING SITE is a target binding site found in the 3' untranslated region of mRNA encoded by RBM7, corresponding to a target binding site such as BINDING SITE I, BINDING SITE II or BINDING SITE III of FIG. 8. Table 4 illustrates the complementarity of the nucleotide sequences of RBM7 BINDING SITE, designated SEQ ID:8778, to the nucleotide sequence of GAM8358 RNA, herein designated GAM RNA, also designated SEQ ID:255.

Another function of GAM8358 is therefore inhibition of Rna binding motif protein 7 (RBM7, Accession NP_057174.1). Accordingly, utilities of GAM8358 include diagnosis, prevention and treatment of diseases and clinical conditions associated with RBM7.

Retinol dehydrogenase 5 (11-cis and 9-cis) (RDH5, Accession NP_002896.1) is another GAM8358 target gene, herein designated TARGET GENE. RDH5 BINDING SITE is a target binding site found in the 5' untranslated region of mRNA encoded by RDH5, corresponding to a target binding site such as BINDING SITE I, BINDING SITE II or BINDING SITE III of FIG. 8. Table 4 illustrates the complementarity of the nucleotide sequences of RDH5 BINDING SITE, designated SEQ ID:5992, to the nucleotide sequence of GAM8358 RNA, herein designated GAM RNA, also designated SEQ ID:255.

Another function of GAM8358 is therefore inhibition of Retinol dehydrogenase 5 (11-cis and 9-cis) (RDH5, Accession NP_002896.1). Accordingly, utilities of GAM8358 include diagnosis, prevention and treatment of diseases and clinical conditions associated with RDH5.

Regulator of g-protein signalling 11 (RGS11, Accession NP_003825.1) is another GAM8358 target gene, herein designated TARGET GENE. RGS11 BINDING SITE is a target binding site found in the 3' untranslated region of mRNA encoded by RGS11, corresponding to a target binding site such as BINDING SITE I, BINDING SITE II or BINDING SITE III of FIG. 8. Table 4 illustrates the complementarity of the nucleotide sequences of RGS11 BINDING SITE, designated SEQ ID:11687, to the nucleotide sequence of GAM8358 RNA, herein designated GAM RNA, also designated SEQ ID:255.

Another function of GAM8358 is therefore inhibition of Regulator of g-protein signalling 11 (RGS11, Accession NP_003825.1). Accordingly, utilities of GAM8358 include diagnosis, prevention and treatment of diseases and clinical conditions associated with RGS11.

Ring finger protein 1 (RING1, Accession NP_002922.1) is another GAM8358 target gene, herein designated TARGET GENE. RING1 BINDING SITE is a target binding site found in the 3' untranslated region of mRNA encoded by RING1, corresponding to a target binding site such as BINDING SITE I, BINDING SITE II or BINDING SITE III of FIG. 8. Table 4 illustrates the complementarity of the nucleotide sequences of RING1 BINDING SITE, designated SEQ ID:14960, to the nucleotide sequence of GAM8358 RNA, herein designated GAM RNA, also designated SEQ ID:255.

Another function of GAM8358 is therefore inhibition of Ring finger protein 1 (RING1, Accession NP_002922.1), a gene which involves in transcriptional regulation. Accordingly, utilities of GAM8358 include diagnosis, prevention and treatment of diseases and clinical conditions associated with RING1.

The function of RING1 and its association with various diseases and clinical conditions, has been established by previous studies, as described hereinabove with reference to GAM44.1. Receptor (tnfrsf)-interacting serine-threonine kinase 1 (RIPK1, Accession NP_003795.1) is another GAM8358 target gene, herein designated TARGET GENE. RIPK1 BINDING SITE is a target binding site found in the 3' untranslated region of mRNA encoded by RIPK1, corresponding to a target binding site such as BINDING SITE I, BINDING SITE II or BINDING SITE III of FIG. 8. Table 4 illustrates the complementarity of the nucleotide sequences of RIPK1 BINDING SITE, designated SEQ ID:13476, to the nucleotide sequence of GAM8358 RNA, herein designated GAM RNA, also designated SEQ ID:255.

Another function of GAM8358 is therefore inhibition of Receptor (tnfrsf)-interacting serine-threonine kinase 1 (RIPK1, Accession NP_003795.1). Accordingly, utilities of GAM8358 include diagnosis, prevention and treatment of diseases and clinical conditions associated with RIPK1.

Ribonuclease, rnase a family, 1 (pancreatic) (RNASE1, Accession NP_002924.1) is another GAM8358 target gene, herein designated TARGET GENE. RNASE1 BINDING SITE is a target binding site found in the 3' untranslated region of mRNA encoded by RNASE1, corresponding to a target binding site such as BINDING SITE I, BINDING SITE II or BINDING SITE III of FIG. 8. Table 4 illustrates the complementarity of the nucleotide sequences of RNASE1 BINDING SITE, designated SEQ ID:1512, to the nucleotide sequence of GAM8358 RNA, herein designated GAM RNA, also designated SEQ ID:255.

Another function of GAM8358 is therefore inhibition of Ribonuclease, rnase a family, 1 (pancreatic) (RNASE1, Accession NP_002924.1), a gene which is a Pancreatic ribonuclease; a pyrimidine-specific endonuclease that generates 2',3'-cyclic phosphate products. Accordingly, utilities of GAM8358 include diagnosis, prevention and treatment of diseases and clinical conditions associated with RNASE1.

The function of RNASE1 and its association with various diseases and clinical conditions, has been established by previous studies, as described hereinabove with reference to GAM483.1. Ring finger protein 38 (RNF38, Accession NP_073618.2) is another GAM8358 target gene, herein designated TARGET GENE. RNF38 BINDING SITE is a target binding site found in the 3' untranslated region of mRNA encoded by RNF38, corresponding to a target binding site such as BINDING SITE I, BINDING SITE II or BINDING SITE III of FIG. 8. Table 4 illustrates the complementarity of the nucleotide sequences of RNF38 BINDING SITE, designated SEQ ID:2759, to the nucleotide sequence of GAM8358 RNA, herein designated GAM RNA, also designated SEQ ID:255.

Another function of GAM8358 is therefore inhibition of Ring finger protein 38 (RNF38, Accession NP_073618.2). Accordingly, utilities of GAM8358 include diagnosis, prevention and treatment of diseases and clinical conditions associated with RNF38.

RNPC4 (Accession NP_060577.2) is another GAM8358 target gene, herein designated TARGET GENE. RNPC4 BINDING SITE is a target binding site found in the 5' untranslated region of mRNA encoded by RNPC4, corresponding to a target binding site such as BINDING SITE I, BINDING SITE II or BINDING SITE III of FIG. 8. Table 4 illustrates the complementarity of the nucleotide sequences of RNPC4 BINDING SITE, designated SEQ ID:18636, to the nucleotide sequence of GAM8358 RNA, herein designated GAM RNA, also designated SEQ ID:255.

Another function of GAM8358 is therefore inhibition of RNPC4 (Accession NP_060577.2). Accordingly, utilities of GAM8358 include diagnosis, prevention and treatment of diseases and clinical conditions associated with RNPC4.

RODH (Accession NP_003716.2) is another GAM8358 target gene, herein designated TARGET GENE. RODH BINDING SITE is a target binding site found in the 5' untranslated region of mRNA encoded by RODH, corresponding to a target binding site such as BINDING SITE I, BINDING SITE II or BINDING SITE III of FIG. 8. Table 4 illustrates the complementarity of the nucleotide sequences of RODH BINDING SITE, designated SEQ ID:19289, to the nucleotide sequence of GAM8358 RNA, herein designated GAM RNA, also designated SEQ ID:255.

Another function of GAM8358 is therefore inhibition of RODH (Accession NP_003716.2). Accordingly, utilities of GAM8358 include diagnosis, prevention and treatment of diseases and clinical conditions associated with RODH.

RP4-622L5 (Accession NP_061991.2) is another GAM8358 target gene, herein designated TARGET GENE. RP4-622L5 BINDING SITE is a target binding site found in the 3' untranslated region of mRNA encoded by RP4-622L5, corresponding to a target binding site such as BINDING SITE I, BINDING SITE II or BINDING SITE III of FIG. 8. Table 4 illustrates the complementarity of the nucleotide sequences of RP4-622L5 BINDING SITE, designated SEQ ID:17249, to the nucleotide sequence of GAM8358 RNA, herein designated GAM RNA, also designated SEQ ID:255.

Another function of GAM8358 is therefore inhibition of RP4-622L5 (Accession NP_061991.2). Accordingly, utilities of GAM8358 include diagnosis, prevention and treatment of diseases and clinical conditions associated with RP4-622L5.

S100A15 (Accession NP_789793.1) is another GAM8358 target gene, herein designated TARGET GENE. S100A15 BINDING SITE is a target binding site found in the 3' untranslated region of mRNA encoded by S100A15, corresponding to a target binding site such as BINDING SITE I, BINDING SITE II or BINDING SITE III of FIG. 8. Table 4 illustrates the complementarity of the nucleotide sequences of S100A15 BINDING SITE, designated SEQ ID:13112, to the nucleotide sequence of GAM8358 RNA, herein designated GAM RNA, also designated SEQ ID:255.

Another function of GAM8358 is therefore inhibition of S100A15 (Accession NP_789793.1). Accordingly, utilities of GAM8358 include diagnosis, prevention and treatment of diseases and clinical conditions associated with S100A15.

SARM1 (Accession NP_055892.1) is another GAM8358 target gene, herein designated TARGET GENE. SARM1 BINDING SITE is a target binding site found in the 3' untranslated region of mRNA encoded by SARM1, corresponding to a target binding site such as BINDING SITE I, BINDING SITE II or BINDING SITE III of FIG. 8. Table 4 illustrates the complementarity of the nucleotide sequences of SARM1 BINDING SITE, designated SEQ ID:7757, to the nucleotide sequence of GAM8358 RNA, herein designated GAM RNA, also designated SEQ ID:255.

Another function of GAM8358 is therefore inhibition of SARM1 (Accession NP_055892.1). Accordingly, utilities of GAM8358 include diagnosis, prevention and treatment of diseases and clinical conditions associated with SARM1.

SBZF3 (Accession XP_300732.1) is another GAM8358 target gene, herein designated TARGET GENE. SBZF3 BINDING SITE is a target binding site found in the 5' untranslated region of multiple transcripts of mRNA encoded by SBZF3, corresponding to a target binding site such as BINDING SITE I, BINDING SITE II or BINDING SITE III of FIG. 8. Table 4 illustrates the complementarity of the nucleotide sequences of SBZF3 BINDING SITE, designated SEQ ID:9443, to the nucleotide sequence of GAM8358 RNA, herein designated GAM RNA, also designated SEQ ID:255.

Another function of GAM8358 is therefore inhibition of SBZF3 (Accession XP_300732.1). Accordingly, utilities of GAM8358 include diagnosis, prevention and treatment of diseases and clinical conditions associated with SBZF3.

Sec14-like 1 (s. cerevisiae) (SEC14L1, Accession NP_002994.1) is another GAM8358 target gene, herein designated TARGET GENE. SEC14L1 BINDING SITE is a target binding site found in the 3' untranslated region of mRNA encoded by SEC14L1, corresponding to a target binding site such as BINDING SITE I, BINDING SITE II or BINDING SITE III of FIG. 8. Table 4 illustrates the complementarity of the nucleotide sequences of SEC14L1 BINDING SITE, designated SEQ ID:13770, to the nucleotide sequence of GAM8358 RNA, herein designated GAM RNA, also designated SEQ ID:255.

Another function of GAM8358 is therefore inhibition of Sec14-like 1 (s. cerevisiae) (SEC14L1, Accession NP_002994.1). Accordingly, utilities of GAM8358 include diagnosis, prevention and treatment of diseases and clinical conditions associated with SEC14L1.

Serine (or cysteine) proteinase inhibitor, clade b (ovalbumin), member 6 (SERPINB6, Accession NP_004559.3) is another GAM8358 target gene, herein designated TARGET GENE. SERPINB6 BINDING SITE is a target binding site found in the 3' untranslated region of mRNA encoded by SERPINB6, corresponding to a target binding site such as BINDING SITE I, BINDING SITE II or BINDING SITE III of FIG. 8. Table 4 illustrates the complementarity of the nucleotide sequences of SERPINB6 BINDING SITE, designated SEQ ID:11491, to the nucleotide sequence of GAM8358 RNA, herein designated GAM RNA, also designated SEQ ID:255.

Another function of GAM8358 is therefore inhibition of Serine (or cysteine) proteinase inhibitor, clade b (ovalbumin), member 6 (SERPINB6, Accession NP_004559.3), a gene which inhibits thrombin. Accordingly, utilities of GAM8358 include diagnosis, prevention and treatment of diseases and clinical conditions associated with SERPINB6.

The function of SERPINB6 and its association with various diseases and clinical conditions, has been established by previous studies, as described hereinabove with reference to GAM830.1. Sh3 domain binding glutamic acid-rich protein like (SH3BGRL, Accession NP_003013.1) is another GAM8358 target gene, herein designated TARGET GENE. SH3BGRL BINDING SITE is a target binding site found in the 3' untranslated region of mRNA encoded by SH3BGRL, corresponding to a target binding site such as BINDING SITE I, BINDING SITE II or BINDING SITE III of FIG. 8. Table 4 illustrates the complementarity of the nucleotide sequences of SH3BGRL BINDING SITE, designated SEQ ID:16703, to the nucleotide sequence of GAM8358 RNA, herein designated GAM RNA, also designated SEQ ID:255.

Another function of GAM8358 is therefore inhibition of Sh3 domain binding glutamic acid-rich protein like (SH3BGRL, Accession NP_003013.1). Accordingly, utilities of GAM8358 include diagnosis, prevention and treatment of diseases and clinical conditions associated with SH3BGRL.

Sh3-domain kinase binding protein 1 (SH3KBP1, Accession NP_114098.1) is another GAM8358 target gene, herein designated TARGET GENE. SH3KBP1 BINDING SITE is a target binding site found in the 3' untranslated region of mRNA encoded by SH3KBP1, corresponding to a target binding site such as BINDING SITE I, BINDING SITE II or BINDING SITE III of FIG. 8. Table 4 illustrates the complementarity of the nucleotide sequences of SH3KBP1 BINDING SITE, designated SEQ ID:15834, to the nucleotide sequence of GAM8358 RNA, herein designated GAM RNA, also designated SEQ ID:255.

Another function of GAM8358 is therefore inhibition of Sh3-domain kinase binding protein 1 (SH3KBP1, Accession NP_114098.1). Accordingly, utilities of GAM8358 include diagnosis, prevention and treatment of diseases and clinical conditions associated with SH3KBP1.

Solute carrier family 25 (mitochondrial carrier; dicarboxylate transporter), member 10 (SLC25A10, Accession NP_036272.2) is another GAM8358 target gene, herein designated TARGET GENE. SLC25A10 BINDING SITE is a target binding site found in the 3' untranslated region of mRNA encoded by SLC25A10, corresponding to a target binding site such as BINDING SITE I, BINDING SITE II or BINDING SITE III of FIG. 8. Table 4 illustrates the complementarity of the nucleotide sequences of SLC25A10 BINDING SITE, designated SEQ ID:6324, to the nucleotide sequence of GAM8358 RNA, herein designated GAM RNA, also designated SEQ ID:255.

Another function of GAM8358 is therefore inhibition of Solute carrier family 25 (mitochondrial carrier; dicarboxylate transporter), member 10 (SLC25A10, Accession NP_036272.2). Accordingly, utilities of GAM8358 include diagnosis, prevention and treatment of diseases and clinical conditions associated with SLC25A10.

Solute carrier family 25 (mitochondrial carrier; ornithine transporter) member 15 (SLC25A15, Accession NP_055067.1) is another GAM8358 target gene, herein designated TARGET GENE. SLC25A15 BINDING SITE is a target binding site found in the 3' untranslated region of mRNA encoded by SLC25A15, corresponding to a target binding site such as BINDING SITE I, BINDING SITE II or BINDING SITE III of FIG. 8. Table 4 illustrates the complementarity of the nucleotide sequences of SLC25A15 BINDING SITE, designated SEQ ID:14932, to the nucleotide sequence of GAM8358 RNA, herein designated GAM RNA, also designated SEQ ID:255.

Another function of GAM8358 is therefore inhibition of Solute carrier family 25 (mitochondrial carrier; ornithine transporter) member 15 (SLC25A15, Accession NP_055067.1), a gene which participates the ornithine transport across inner mitochondrial membrane, from the cytoplasm to the matrix and therefore is associated with Hyperornithinemia-hyperammonemia- homocitrullinuria syndrome (hhh syndrome). Accordingly, utilities of GAM8358 include diagnosis, prevention and treatment of Hyperornithinemia-hyperammonemia- homocitrullinuria syndrome (hhh syndrome), and of other diseases and clinical conditions associated with SLC25A15.

The function of SLC25A15 and its association with various diseases and clinical conditions, has been established by previous studies, as described hereinabove with reference to GAM99.1. Solute carrier family 39 (zinc transporter), member 3 (SLC39A3, Accession NP_653165.1) is another GAM8358 target gene, herein designated TARGET GENE. SLC39A3 BINDING SITE is a target binding site found in the 3' untranslated region of mRNA encoded by SLC39A3, corresponding to a target binding site such as BINDING SITE I, BINDING SITE II or BINDING SITE III of FIG. 8. Table 4 illustrates the complementarity of the nucleotide sequences of SLC39A3 BINDING SITE, designated SEQ ID:11947, to the nucleotide sequence of GAM8358 RNA, herein designated GAM RNA, also designated SEQ ID:255.

Another function of GAM8358 is therefore inhibition of Solute carrier family 39 (zinc transporter), member 3 (SLC39A3, Accession NP_653165.1). Accordingly, utilities of GAM8358 include diagnosis, prevention and treatment of diseases and clinical conditions associated with SLC39A3.

Solute carrier family 6 (neurotransmitter transporter, creatine), member 8 (SLC6A8, Accession NP_005620.1) is another GAM8358 target gene, herein designated TARGET GENE. SLC6A8 BINDING SITE is a target binding site found in the 3' untranslated region of mRNA encoded by SLC6A8, corresponding to a target binding site such as BINDING SITE I, BINDING SITE II or BINDING SITE III of FIG. 8. Table 4 illustrates the complementarity of the nucleotide sequences of SLC6A8 BINDING SITE, designated SEQ ID:17130, to the nucleotide sequence of GAM8358 RNA, herein designated GAM RNA, also designated SEQ ID:255.

Another function of GAM8358 is therefore inhibition of Solute carrier family 6 (neurotransmitter transporter, creatine), member 8 (SLC6A8, Accession NP_005620.1). Accordingly, utilities of GAM8358 include diagnosis, prevention and treatment of diseases and clinical conditions associated with SLC6A8.

Swi/snf related, matrix associated, actin dependent regulator of chromatin, subfamily d, member 2 (SMARCD2, Accession NP_003068.2) is another GAM8358 target gene, herein designated TARGET GENE. SMARCD2 BINDING SITE is a target binding site found in the 3' untranslated region of mRNA encoded by SMARCD2, corresponding to a target binding site such as BINDING SITE I, BINDING SITE II or BINDING SITE III of FIG. 8. Table 4 illustrates the complementarity of the nucleotide sequences of SMARCD2 BINDING SITE, designated SEQ ID:7747, to the nucleotide sequence of GAM8358 RNA, herein designated GAM RNA, also designated SEQ ID:255.

Another function of GAM8358 is therefore inhibition of Swi/snf related, matrix associated, actin dependent regulator of chromatin, subfamily d, member 2 (SMARCD2, Accession NP_003068.2), a gene which is involved in chromatin remodeling. Accordingly, utilities of GAM8358 include diagnosis, prevention and treatment of diseases and clinical conditions associated with SMARCD2.

The function of SMARCD2 and its association with various diseases and clinical conditions, has been established by previous studies, as described hereinabove with reference to GAM537.1. Smith-magenis syndrome chromosome region, candidate 7 (SMCR7, Accession NP_631901.2) is another GAM8358 target gene, herein designated TARGET GENE. SMCR7 BINDING SITE is a target binding site found in the 3' untranslated region of multiple transcripts of mRNA encoded by SMCR7, corresponding to a target binding site such as BINDING SITE I, BINDING SITE II or BINDING SITE III of FIG. 8. Table 4 illustrates the complementarity of the nucleotide sequences of SMCR7 BINDING SITE, designated SEQ ID:6215, to the nucleotide sequence of GAM8358 RNA, herein designated GAM RNA, also designated SEQ ID:255.

Another function of GAM8358 is therefore inhibition of Smith-magenis syndrome chromosome region, candidate 7 (SMCR7, Accession NP_631901.2). Accordingly, utilities of GAM8358 include diagnosis, prevention and treatment of diseases and clinical conditions associated with SMCR7.

Smith-magenis syndrome chromosome region, candidate 7 (SMCR7, Accession NP_683684.1) is another GAM8358 target gene, herein designated TARGET GENE. SMCR7 BINDING SITE is a target binding site found in the 3' untranslated region of multiple transcripts of mRNA encoded by SMCR7, corresponding to a target binding site such as BINDING SITE I, BINDING SITE II or BINDING SITE III of FIG. 8. Table 4 illustrates the complementarity of the nucleotide sequences of SMCR7 BINDING SITE, designated SEQ ID:6215, to the nucleotide sequence of GAM8358 RNA, herein designated GAM RNA, also designated SEQ ID:255.

Another function of GAM8358 is therefore inhibition of Smith-magenis syndrome chromosome region, candidate 7 (SMCR7, Accession NP_683684.1). Accordingly, utilities of GAM8358 include diagnosis, prevention and treatment of diseases and clinical conditions associated with SMCR7.

SMP3 (Accession NP_079439.2) is another GAM8358 target gene, herein designated TARGET GENE. SMP3 BINDING SITE is a target binding site found in the 3' untranslated region of mRNA encoded by SMP3, corresponding to a target binding site such as BINDING SITE I, BINDING SITE II or BINDING SITE III of FIG. 8. Table 4 illustrates the complementarity of the nucleotide sequences of SMP3 BINDING SITE, designated SEQ ID:2105, to the nucleotide sequence of GAM8358 RNA, herein designated GAM RNA, also designated SEQ ID:255.

Another function of GAM8358 is therefore inhibition of SMP3 (Accession NP_079439.2). Accordingly, utilities of GAM8358 include diagnosis, prevention and treatment of diseases and clinical conditions associated with SMP3.

Sry (sex determining region y)-box 12 (SOX12, Accession NP_008874.2) is another GAM8358 target gene, herein designated TARGET GENE. SOX12 BINDING SITE is a target binding site found in the 3' untranslated region of mRNA encoded by SOX12, corresponding to a target binding site such as BINDING SITE I, BINDING SITE II or BINDING SITE III of FIG. 8. Table 4 illustrates the complementarity of the nucleotide sequences of SOX12 BINDING SITE, designated SEQ ID:2490, to the nucleotide sequence of GAM8358 RNA, herein designated GAM RNA, also designated SEQ ID:255.

Another function of GAM8358 is therefore inhibition of Sry (sex determining region y)-box 12 (SOX12, Accession NP_008874.2). Accordingly, utilities of GAM8358 include diagnosis, prevention and treatment of diseases and clinical conditions associated with SOX12.

Sp3 transcription factor (SP3, Accession XP_092672.2) is another GAM8358 target gene, herein designated TARGET GENE. SP3 BINDING SITE is a target binding site found in the 5' untranslated region of mRNA encoded by SP3, corresponding to a target binding site such as BINDING SITE I, BINDING SITE II or BINDING SITE III of FIG. 8. Table 4 illustrates the complementarity of the nucleotide sequences of SP3 BINDING SITE, designated SEQ ID:18359, to the nucleotide sequence of GAM8358 RNA, herein designated GAM RNA, also designated SEQ ID:255.

Another function of GAM8358 is therefore inhibition of Sp3 transcription factor (SP3, Accession XP_092672.2), a gene which binds to gt and gc boxes promoters elements. Accordingly, utilities of GAM8358 include diagnosis, prevention and treatment of diseases and clinical conditions associated with SP3.

The function of SP3 and its association with various diseases and clinical conditions, has been established by previous studies, as described hereinabove with reference to GAM96.1. Sialophorin (gpl115, leukosialin, cd43) (SPN, Accession NP_003114.1) is another GAM8358 target gene, herein designated TARGET GENE. SPN BINDING SITE is a target binding site found in the 5' untranslated region of mRNA encoded by SPN, corresponding to a target binding site such as BINDING SITE I, BINDING SITE II or BINDING SITE III of FIG. 8. Table 4 illustrates the complementarity of the nucleotide sequences of SPN BINDING SITE, designated SEQ ID:15664, to the nucleotide sequence of GAM8358 RNA, herein designated GAM RNA, also designated SEQ ID:255.

Another function of GAM8358 is therefore inhibition of Sialophorin (gpl115, leukosialin, cd43) (SPN, Accession NP_003114.1), a gene which plays a role in the physicochemical properties of the t-cell surface and in lectin binding. presents carbohydrate ligands to selectins. . and therefore may be associated with Wiskott-aldrich syndrome. Accordingly, utilities of GAM8358 include diagnosis, prevention and treatment of Wiskott-aldrich syndrome, and of other diseases and clinical conditions associated with SPN.

The function of SPN and its association with various diseases and clinical conditions, has been established by previous studies, as described hereinabove with reference to GAM130.1. Spectrin, beta, non-erythrocytic 4 (SPTBN4, Accession NP_079489.1) is another GAM8358 target gene, herein designated TARGET GENE. SPTBN4 BINDING SITE is a target binding site found in the 3' untranslated region of mRNA encoded by SPTBN4, corresponding to a target binding site such as BINDING SITE I, BINDING SITE II or BINDING SITE III of FIG. 8. Table 4 illustrates the complementarity of the nucleotide sequences of SPTBN4 BINDING SITE, designated SEQ ID:14455, to the nucleotide sequence of GAM8358 RNA, herein designated GAM RNA, also designated SEQ ID:255.

Another function of GAM8358 is therefore inhibition of Spectrin, beta, non-erythrocytic 4 (SPTBN4, Accession NP_079489.1), a gene which is critical for the maintenance of plasma membrane shape and lipid asymmetry. Accordingly, utilities of GAM8358 include diagnosis, prevention and treatment of diseases and clinical conditions associated with SPTBN4.

The function of SPTBN4 and its association with various diseases and clinical conditions, has been established by previous studies, as described hereinabove with reference to GAM347.2. Sulfotransferase family, cytosolic, 1c, member 2 (SULT1C2, Accession NP_006579.2) is another GAM8358 target gene, herein designated TARGET GENE. SULT1C2 BINDING SITE is a target binding site found in the 5' untranslated region of mRNA encoded by SULT1C2, corresponding to a target binding site such as BINDING SITE I, BINDING SITE II or BINDING SITE III of FIG. 8. Table 4 illustrates the complementarity of the nucleotide sequences of SULT1C2 BINDING SITE, designated SEQ ID:17465, to the nucleotide sequence of GAM8358 RNA, herein designated GAM RNA, also designated SEQ ID:255.

Another function of GAM8358 is therefore inhibition of Sulfotransferase family, cytosolic, 1c, member 2 (SULT1C2, Accession NP_006579.2). Accordingly, utilities of GAM8358 include diagnosis, prevention and treatment of diseases and clinical conditions associated with SULT1C2.

Synapsin iii (SYN3, Accession NP_598344.1) is another GAM8358 target gene, herein designated TARGET GENE. SYN3 BINDING SITE is a target binding site found in the 3' untranslated region of multiple transcripts of mRNA encoded by SYN3, corresponding to a target binding site such as BINDING SITE I, BINDING SITE II or BINDING SITE III of FIG. 8. Table 4 illustrates the complementarity of the nucleotide sequences of SYN3 BINDING SITE, designated SEQ ID:2991, to the nucleotide sequence of GAM8358 RNA, herein designated GAM RNA, also designated SEQ ID:255.

Another function of GAM8358 is therefore inhibition of Synapsin iii (SYN3, Accession NP_598344.1), a gene which may be involved in the regulation of neurotransmitter release and synaptogenesis. Accordingly, utilities of GAM8358 include diagnosis, prevention and treatment of diseases and clinical conditions associated with SYN3.

The function of SYN3 and its association with various diseases and clinical conditions, has been established by previous studies, as described hereinabove with reference to GAM1089.2. Synapsin iii (SYN3, Accession NP_003481.2) is another GAM8358 target gene, herein designated TARGET GENE. SYN3 BINDING SITE is a target binding site found in the 3' untranslated region of multiple transcripts of mRNA encoded by SYN3, corresponding to a target binding site such as BINDING SITE I, BINDING SITE II or BINDING SITE III of FIG. 8. Table 4 illustrates the complementarity of the nucleotide sequences of SYN3 BINDING SITE, designated SEQ ID:2991, to the nucleotide sequence of GAM8358 RNA, herein designated GAM RNA, also designated SEQ ID:255.

Another function of GAM8358 is therefore inhibition of Synapsin iii (SYN3, Accession NP_003481.2), a gene which may be involved in the regulation of neurotransmitter release and synaptogenesis. Accordingly, utilities of GAM8358 include diagnosis, prevention and treatment of diseases and clinical conditions associated with SYN3.

The function of SYN3 and its association with various diseases and clinical conditions, has been established by previous studies, as described hereinabove with reference to GAM1089.2. Synapsin iii (SYN3, Accession NP_598343.1) is another GAM8358 target gene, herein designated TARGET GENE. SYN3 BINDING SITE is a target binding site found in the 3' untranslated region of multiple transcripts of mRNA encoded by SYN3, corresponding to a target binding site such as BINDING SITE I, BINDING SITE II or BINDING SITE III of FIG. 8. Table 4 illustrates the complementarity of the nucleotide sequences of SYN3 BINDING SITE, designated SEQ ID:2991, to the nucleotide sequence of GAM8358 RNA, herein designated GAM RNA, also designated SEQ ID:255.

Another function of GAM8358 is therefore inhibition of Synapsin iii (SYN3, Accession NP_598343.1), a gene which may be involved in the regulation of neurotransmitter release and synaptogenesis. Accordingly, utilities of GAM8358 include diagnosis, prevention and treatment of diseases and clinical conditions associated with SYN3.

The function of SYN3 and its association with various diseases and clinical conditions, has been established by previous studies, as described hereinabove with reference to GAM1089.2. Tar (hiv) rna binding protein 2 (TARBP2, Accession NP_599151.1) is another GAM8358 target gene, herein designated TARGET GENE. TARBP2 BINDING SITE is a target binding site found in the 5' untranslated region of multiple transcripts of mRNA encoded by TARBP2, corresponding to a target binding site such as BINDING SITE I, BINDING SITE II or BINDING SITE III of FIG. 8. Table 4 illustrates the complementarity of the nucleotide sequences of TARBP2 BINDING SITE, designated SEQ ID:15955, to the nucleotide sequence of GAM8358 RNA, herein designated GAM RNA, also designated SEQ ID:255.

Another function of GAM8358 is therefore inhibition of Tar (hiv) rna binding protein 2 (TARBP2, Accession NP_599151.1), a gene which is involved in the regulation of HIV replication. Accordingly, utilities of GAM8358 include diagnosis, prevention and treatment of diseases and clinical conditions associated with TARBP2.

The function of TARBP2 and its association with various diseases and clinical conditions, has been established by previous studies, as described hereinabove with reference to GAM309.1. Tar (hiv) rna binding protein 2 (TARBP2, Accession NP_599150.1) is another GAM8358 target gene, herein designated TARGET GENE. TARBP2 BINDING SITE is a target binding site found in the 5' untranslated region of multiple transcripts of mRNA encoded by TARBP2, corresponding to a target binding site such as BINDING SITE I, BINDING SITE II or BINDING SITE III of FIG. 8. Table 4 illustrates the complementarity of the nucleotide sequences of TARBP2 BINDING SITE, designated SEQ ID:15955, to the nucleotide sequence of GAM8358 RNA, herein designated GAM RNA, also designated SEQ ID:255.

Another function of GAM8358 is therefore inhibition of Tar (hiv) rna binding protein 2 (TARBP2, Accession NP_599150.1), a gene which is involved in the regulation of HIV replication. Accordingly, utilities of GAM8358 include diagnosis, prevention and treatment of diseases and clinical conditions associated with TARBP2.

The function of TARBP2 and its association with various diseases and clinical conditions, has been established by previous studies, as described hereinabove with reference to GAM309.1. Transducin (beta)-like 2 (TBL2, Accession NP_116783.1) is another GAM8358 target gene, herein designated TARGET GENE. TBL2 BINDING SITE is a target binding site found in the 3' untranslated region of multiple transcripts of mRNA encoded by TBL2, corresponding to a target binding site such as BINDING SITE I, BINDING SITE II or BINDING SITE III of FIG. 8. Table 4 illustrates the complementarity of the nucleotide sequences of TBL2 BINDING SITE, designated SEQ ID:4498, to the nucleotide sequence of GAM8358 RNA, herein designated GAM RNA, also designated SEQ ID:255.

Another function of GAM8358 is therefore inhibition of Transducin (beta)-like 2 (TBL2, Accession NP_116783.1), a gene which is of unknown function. Accordingly, utilities of GAM8358 include diagnosis, prevention and treatment of diseases and clinical conditions associated with TBL2.

The function of TBL2 and its association with various diseases and clinical conditions, has been established by previous studies, as described hereinabove with reference to GAM467.2. Transcription factor 6-like 1 (mitochondrial transcription factor 1-like) (TCF6L1, Accession NP_003192.1) is another GAM8358 target gene, herein designated TARGET GENE. TCF6L1 BINDING SITE is a target binding site found in the 5' untranslated region of mRNA encoded by TCF6L1, corresponding to a target binding site such as BINDING SITE I, BINDING SITE II or BINDING SITE III of FIG. 8. Table 4 illustrates the complementarity of the nucleotide sequences of TCF6L1 BINDING SITE, designated SEQ ID:4205, to the nucleotide sequence of GAM8358 RNA, herein designated GAM RNA, also designated SEQ ID:255.

Another function of GAM8358 is therefore inhibition of Transcription factor 6-like 1 (mitochondrial transcription factor 1-like) (TCF6L1, Accession NP_003192.1). Accordingly, utilities of GAM8358 include diagnosis, prevention and treatment of diseases and clinical conditions associated with TCF6L1.

Treacher collins-franceschetti syndrome 1 (TCOF1, Accession NP_000347.1) is another GAM8358 target gene, herein designated TARGET GENE. TCOF1 BINDING SITE is a target binding site found in the 3' untranslated region of mRNA encoded by TCOF1, corresponding to a target binding site such as BINDING SITE I, BINDING SITE II or BINDING SITE III of FIG. 8. Table 4 illustrates the complementarity of the nucleotide sequences of TCOF1 BINDING SITE, designated SEQ ID:12390, to the nucleotide sequence of GAM8358 RNA, herein designated GAM RNA, also designated SEQ ID:255.

Another function of GAM8358 is therefore inhibition of Treacher collins-franceschetti syndrome 1 (TCOF1, Accession NP_000347.1). Accordingly, utilities of GAM8358 include diagnosis, prevention and treatment of diseases and clinical conditions associated with TCOF1.

Tgfb1-induced anti-apoptotic factor 1 (TIAF1, Accession NP_510880.2) is another GAM8358 target gene, herein designated TARGET GENE. TIAF1 BINDING SITE is a target binding site found in the 3' untranslated region of multiple transcripts of mRNA encoded by TIAF1, corresponding to a target binding site such as BINDING SITE I, BINDING SITE II or BINDING SITE III of FIG. 8. Table 4 illustrates the complementarity of the nucleotide sequences of TIAF1 BINDING SITE, designated SEQ ID:16620, to the nucleotide sequence of GAM8358 RNA, herein designated GAM RNA, also designated SEQ ID:255.

Another function of GAM8358 is therefore inhibition of Tgfb1-induced anti-apoptotic factor 1 (TIAF1, Accession NP_510880.2) . Accordingly, utilities of GAM8358 include diagnosis, prevention and treatment of diseases and clinical conditions associated with TIAF1.

Tgfb1-induced anti-apoptotic factor 1 (TIAF1, Accession NP_004731.2) is another GAM8358 target gene, herein designated TARGET GENE. TIAF1 BINDING SITE is a target binding site found in the 3' untranslated region of multiple transcripts of mRNA encoded by TIAF1, corresponding to a target binding site such as BINDING SITE I, BINDING SITE II or BINDING SITE III of FIG. 8. Table 4 illustrates the complementarity of the nucleotide sequences of TIAF1 BINDING SITE, designated SEQ ID:16620, to the nucleotide sequence of GAM8358 RNA, herein designated GAM RNA, also designated SEQ ID:255.

Another function of GAM8358 is therefore inhibition of Tgfb1-induced anti-apoptotic factor 1 (TIAF1, Accession NP_004731.2). Accordingly, utilities of GAM8358 include diagnosis, prevention and treatment of diseases and clinical conditions associated with TIAF1.

Thyroid transcription factor 1 (TITF1, Accession NP_003308.1) is another GAM8358 target gene, herein designated TARGET GENE. TITF1 BINDING SITE is a target binding site found in the 3' untranslated region of mRNA encoded by TITF1, corresponding to a target binding site such as BINDING SITE I, BINDING SITE II or BINDING SITE III of FIG. 8. Table 4 illustrates the complementarity of the nucleotide sequences of TITF1 BINDING SITE, designated SEQ ID:11075, to the nucleotide sequence of GAM8358 RNA, herein designated GAM RNA, also designated SEQ ID:255.

Another function of GAM8358 is therefore inhibition of Thyroid transcription factor 1 (TITF1, Accession NP_003308.1), a gene which plays a role in thyroid and lung development; and surfactant homeostasis and therefore may be associated with Thyroglobulin defect. Accordingly, utilities of GAM8358 include diagnosis, prevention and treatment of Thyroglobulin defect, and of other diseases and clinical conditions associated with TITF1.

The function of TITF1 and its association with various diseases and clinical conditions, has been established by previous studies, as described hereinabove with reference to GAM148.2. Thymidine kinase 2, mitochondrial (TK2, Accession NP_004605.1) is another GAM8358 target gene, herein designated TARGET GENE. TK2 BINDING SITE is a target binding site found in the 3' untranslated region of mRNA encoded by TK2, corresponding to a target binding site such as BINDING SITE I, BINDING SITE II or BINDING SITE III of FIG. 8. Table 4 illustrates the complementarity of the nucleotide sequences of TK2 BINDING SITE, designated SEQ ID:9571, to the nucleotide sequence of GAM8358 RNA, herein designated GAM RNA, also designated SEQ ID:255.

Another function of GAM8358 is therefore inhibition of Thymidine kinase 2, mitochondrial (TK2, Accession NP_004605.1), a gene which phosphorylates thymidine, deoxycytidine, deoxyuridine, and also anti-viral and anticancer nucleoside analogs and therefore may be associated with Mitochondrial dna depletion myopathy. Accordingly, utilities of GAM8358 include diagnosis, prevention and treatment of Mitochondrial dna depletion myopathy, and of other diseases and clinical conditions associated with TK2.

The function of TK2 and its association with various diseases and clinical conditions, has been established by previous studies, as described hereinabove with reference to GAM281.1. Talin 1 (TLN1, Accession NP_006280.2) is another GAM8358 target gene, herein designated TARGET GENE. TLN1 BINDING SITE is a target binding site found in the 3' untranslated region of mRNA encoded by TLN1, corresponding to a target binding site such as BINDING SITE I, BINDING SITE II or BINDING SITE III of FIG. 8. Table 4 illustrates the complementarity of the nucleotide sequences of TLN1 BINDING SITE, designated SEQ ID:2014, to the nucleotide sequence of GAM8358 RNA, herein designated GAM RNA, also designated SEQ ID:255.

Another function of GAM8358 is therefore inhibition of Talin 1 (TLN1, Accession NP_006280.2). Accordingly, utilities of GAM8358 include diagnosis, prevention and treatment of diseases and clinical conditions associated with TLN1.

Trinucleotide repeat containing 4 (TNRC4, Accession NP_009116.2) is another GAM8358 target gene, herein designated TARGET GENE. TNRC4 BINDING SITE is a target binding site found in the 3' untranslated region of mRNA encoded by TNRC4, corresponding to a target binding site such as BINDING SITE I, BINDING SITE II or BINDING SITE III of FIG. 8. Table 4 illustrates the complementarity of the nucleotide sequences of TNRC4 BINDING SITE, designated SEQ ID:3329, to the nucleotide sequence of GAM8358 RNA, herein designated GAM RNA, also designated SEQ ID:255.

Another function of GAM8358 is therefore inhibition of Trinucleotide repeat containing 4 (TNRC4, Accession NP_009116.2). Accordingly, utilities of GAM8358 include diagnosis, prevention and treatment of diseases and clinical conditions associated with TNRC4.

TP53I5 (Accession XP_290532.2) is another GAM8358 target gene, herein designated TARGET GENE. TP53I5 BINDING SITE is a target binding site found in the 5' untranslated region of mRNA encoded by TP53I5, corresponding to a target binding site such as BINDING SITE I, BINDING SITE II or BINDING SITE III of FIG. 8. Table 4 illustrates the complementarity of the nucleotide sequences of TP53I5 BINDING SITE, designated SEQ ID:19129, to the nucleotide sequence of GAM8358 RNA, herein designated GAM RNA, also designated SEQ ID:255.

Another function of GAM8358 is therefore inhibition of TP53I5 (Accession XP_290532.2). Accordingly, utilities of GAM8358 include diagnosis, prevention and treatment of diseases and clinical conditions associated with TP53I5.

Tnf receptor-associated factor 5 (TRAF5, Accession NP_004610.1) is another GAM8358 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:12305, to the nucleotide sequence of GAM8358 RNA, herein designated GAM RNA, also designated SEQ ID:255.

Another function of GAM8358 is therefore inhibition of Tnf receptor-associated factor 5 (TRAF5, Accession NP_004610.1), a gene which Member of a family of proteins that interact with TNF receptors; binds the lymphotoxin beta receptor (LTBR). Accordingly, utilities of GAM8358 include diagnosis, prevention and treatment of diseases and clinical conditions associated with TRAF5.

The function of TRAF5 and its association with various diseases and clinical conditions, has been established by previous studies, as described hereinabove with reference to GAM69.2. Tnf receptor-associated factor 5 (TRAF5, Accession NP_665702.1) is another GAM8358 target gene, herein designated TARGET GENE. TRAF5 BINDING SITE is a target binding site found in the 3' untranslated region of multiple transcripts of mRNA encoded by TRAF5, corresponding to a target binding site such as BINDING SITE I, BINDING SITE II or BINDING SITE III of FIG. 8. Table 4 illustrates the complementarity of the nucleotide sequences of TRAF5 BINDING SITE, designated SEQ ID:12305, to the nucleotide sequence of GAM8358 RNA, herein designated GAM RNA, also designated SEQ ID:255.

Another function of GAM8358 is therefore inhibition of Tnf receptor-associated factor 5 (TRAF5, Accession NP_665702.1), a gene which Member of a family of proteins that interact with TNF receptors; binds the lymphotoxin beta receptor (LTBR). Accordingly, utilities of GAM8358 include diagnosis, prevention and treatment of diseases and clinical conditions associated with TRAF5.

The function of TRAF5 and its association with various diseases and clinical conditions, has been established by previous studies, as described hereinabove with reference to GAM69.2. TRAM2 (Accession NP_036420.1) is another GAM8358 target gene, herein designated TARGET GENE. TRAM2 BINDING SITE is a target binding site found in the 3' untranslated region of mRNA encoded by TRAM2, corresponding to a target binding site such as BINDING SITE I, BINDING SITE II or BINDING SITE III of FIG. 8. Table 4 illustrates the complementarity of the nucleotide sequences of TRAM2 BINDING SITE, designated SEQ ID:5325, to the nucleotide sequence of GAM8358 RNA, herein designated GAM RNA, also designated SEQ ID:255.

Another function of GAM8358 is therefore inhibition of TRAM2 (Accession NP_036420.1). Accordingly, utilities of GAM8358 include diagnosis, prevention and treatment of diseases and clinical conditions associated with TRAM2.

Tripartite motif-containing 29 (TRIM29, Accession NP_036233.2) is another GAM8358 target gene, herein designated TARGET GENE. TRIM29 BINDING SITE is a target binding site found in the 3' untranslated region of multiple transcripts of mRNA encoded by TRIM29, corresponding to a target binding site such as BINDING SITE I, BINDING SITE II or BINDING SITE III of FIG. 8. Table 4 illustrates the complementarity of the nucleotide sequences of TRIM29 BINDING SITE, designated SEQ ID:673, to the nucleotide sequence of GAM8358 RNA, herein designated GAM RNA, also designated SEQ ID:255.

Another function of GAM8358 is therefore inhibition of Tripartite motif-containing 29 (TRIM29, Accession NP_036233.2). Accordingly, utilities of GAM8358 include diagnosis, prevention and treatment of diseases and clinical conditions associated with TRIM29.

TRIM47 (Accession XP_290731.1) is another GAM8358 target gene, herein designated TARGET GENE. TRIM47 BINDING SITE is a target binding site found in the 3' untranslated region of mRNA encoded by TRIM47, corresponding to a target binding site such as BINDING SITE I, BINDING SITE II or BINDING SITE III of FIG. 8. Table 4 illustrates the complementarity of the nucleotide sequences of TRIM47 BINDING SITE, designated SEQ ID:3214, to the nucleotide sequence of GAM8358 RNA, herein designated GAM RNA, also designated SEQ ID:255.

Another function of GAM8358 is therefore inhibition of TRIM47 (Accession XP_290731.1). Accordingly, utilities of GAM8358 include diagnosis, prevention and treatment of diseases and clinical conditions associated with TRIM47.

Ubiquitin-conjugating enzyme e2q (putative) (UBE2Q, Accession NP_060052.3) is another GAM8358 target gene, herein designated TARGET GENE. UBE2Q BINDING SITE is a target binding site found in the 3' untranslated region of mRNA encoded by UBE2Q, corresponding to a target binding site such as BINDING SITE I, BINDING SITE II or BINDING SITE III of FIG. 8. Table 4 illustrates the complementarity of the nucleotide sequences of UBE2Q BINDING SITE, designated SEQ ID:13750, to the nucleotide sequence of GAM8358 RNA, herein designated GAM RNA, also designated SEQ ID:255.

Another function of GAM8358 is therefore inhibition of Ubiquitin-conjugating enzyme e2q (putative) (UBE2Q, Accession NP_060052.3). Accordingly, utilities of GAM8358 include diagnosis, prevention and treatment of diseases and clinical conditions associated with UBE2Q.

Usher syndrome 1g (autosomal recessive) (USH1G, Accession NP_775748.1) is another GAM8358 target gene, herein designated TARGET GENE. USH1G BINDING SITE1 and USH1G BINDING SITE2 are target binding sites found in untranslated regions of mRNA encoded by USH1G, corresponding to target binding sites such as BINDING SITE I, BINDING SITE II or BINDING SITE III of FIG. 8. Table 4 illustrates the complementarity of the nucleotide sequences of USH1G BINDING SITE1 and USH1G BINDING SITE2, designated SEQ ID:12873 and SEQ ID:4086 respectively, to the nucleotide sequence of GAM8358 RNA, herein designated GAM RNA, also designated SEQ ID:255.

Another function of GAM8358 is therefore inhibition of Usher syndrome 1g (autosomal recessive) (USH1G, Accession NP_775748.1). Accordingly, utilities of GAM8358 include diagnosis, prevention and treatment of diseases and clinical conditions associated with USH1G.

Vang-like 2 (van gogh, drosophila) (VANGL2, Accession XP_049695.4) is another GAM8358 target gene, herein designated TARGET GENE. VANGL2 BINDING SITE is a target binding site found in the 3' untranslated region of mRNA encoded by VANGL2, corresponding to a target binding site such as BINDING SITE I, BINDING SITE II or BINDING SITE III of FIG. 8. Table 4 illustrates the complementarity of the nucleotide sequences of VANGL2 BINDING SITE, designated SEQ ID:17930, to the nucleotide sequence of GAM8358 RNA, herein designated GAM RNA, also designated SEQ ID:255.

Another function of GAM8358 is therefore inhibition of Vang-like 2 (van gogh, drosophila) (VANGL2, Accession XP_049695.4), a gene which may take part in defining the lateral boundary of floorplate differentiation and therefore may be associated with Neural tube defects. Accordingly, utilities of GAM8358 include diagnosis, prevention and treatment of Neural tube defects, and of other diseases and clinical conditions associated with VANGL2.

The function of VANGL2 and its association with various diseases and clinical conditions, has been established by previous studies, as described hereinabove with reference to GAM47.1. Vesicle amine transport protein 1 homolog (t californica) (VAT1, Accession NP_006364.2) is another GAM8358 target gene, herein designated TARGET GENE. VAT1 BINDING SITE is a target binding site found in the 3' untranslated region of mRNA encoded by VAT1, corresponding to a target binding site such as BINDING SITE I, BINDING SITE II or BINDING SITE III of FIG. 8. Table 4 illustrates the complementarity of the nucleotide sequences of VAT1 BINDING SITE, designated SEQ ID:7020, to the nucleotide sequence of GAM8358 RNA, herein designated GAM RNA, also designated SEQ ID:255.

Another function of GAM8358 is therefore inhibition of Vesicle amine transport protein 1 homolog (t californica) (VAT1, Accession NP_006364.2), a gene which is a membrane protein of cholinergic synaptic vesicles. Accordingly, utilities of GAM8358 include diagnosis, prevention and treatment of diseases and clinical conditions associated with VAT1.

The function of VAT1 and its association with various diseases and clinical conditions, has been established by previous studies, as described hereinabove with reference to GAM330.2. Von willebrand factor (VWF, Accession NP_000543.1) is another GAM8358 target gene, herein designated TARGET GENE. VWF BINDING SITE is a target binding site found in the 3' untranslated region of mRNA encoded by VWF, corresponding to a target binding site such as BINDING SITE I, BINDING SITE II or BINDING SITE III of FIG. 8. Table 4 illustrates the complementarity of the nucleotide sequences of VWF BINDING SITE, designated SEQ ID:13033, to the nucleotide sequence of GAM8358 RNA, herein designated GAM RNA, also designated SEQ ID:255.

Another function of GAM8358 is therefore inhibition of Von willebrand factor (VWF, Accession NP_000543.1). Accordingly, utilities of GAM8358 include diagnosis, prevention and treatment of diseases and clinical conditions associated with VWF.

WDR22 (Accession XP_031102.1) is another GAM8358 target gene, herein designated TARGET GENE. WDR22 BINDING SITE is a target binding site found in the 3' untranslated region of mRNA encoded by WDR22, corresponding to a target binding site such as BINDING SITE I, BINDING SITE II or BINDING SITE III of FIG. 8. Table 4 illustrates the complementarity of the nucleotide sequences of WDR22 BINDING SITE, designated SEQ ID:16841, to the nucleotide sequence of GAM8358 RNA, herein designated GAM RNA, also designated SEQ ID:255.

Another function of GAM8358 is therefore inhibition of WDR22 (Accession XP_031102.1). Accordingly, utilities of GAM8358 include diagnosis, prevention and treatment of diseases and clinical conditions associated with WDR22.

Wd repeat domain 7 (WDR7, Accession NP_056100.1) is another GAM8358 target gene, herein designated TARGET GENE. WDR7 BINDING SITE is a target binding site found in the 3' untranslated region of multiple transcripts of mRNA encoded by WDR7, corresponding to a target binding site such as BINDING SITE I, BINDING SITE II or BINDING SITE III of FIG. 8. Table 4 illustrates the complementarity of the nucleotide sequences of WDR7 BINDING SITE, designated SEQ ID:570, to the nucleotide sequence of GAM8358 RNA, herein designated GAM RNA, also designated SEQ ID:255.

Another function of GAM8358 is therefore inhibition of Wd repeat domain 7 (WDR7, Accession NP_056100.1). Accordingly, utilities of GAM8358 include diagnosis, prevention and treatment of diseases and clinical conditions associated with WDR7.

Wd repeat domain 7 (WDR7, Accession NP_443066.1) is another GAM8358 target gene, herein designated TARGET GENE. WDR7 BINDING SITE is a target binding site found in the 3' untranslated region of multiple transcripts of mRNA encoded by WDR7, corresponding to a target binding site such as BINDING SITE I, BINDING SITE II or BINDING SITE III of FIG. 8. Table 4 illustrates the complementarity of the nucleotide sequences of WDR7 BINDING SITE, designated SEQ ID:570, to the nucleotide sequence of GAM8358 RNA, herein designated GAM RNA, also designated SEQ ID:255.

Another function of GAM8358 is therefore inhibition of Wd repeat domain 7 (WDR7, Accession NP_443066.1). Accordingly, utilities of GAM8358 include diagnosis, prevention and treatment of diseases and clinical conditions associated with WDR7.

Wd repeat domain 9 (WDR9, Accession NP_061836.2) is another GAM8358 target gene, herein designated TARGET GENE. WDR9 BINDING SITE is a target binding site found in the 3' untranslated region of multiple transcripts of mRNA encoded by WDR9, corresponding to a target binding site such as BINDING SITE I, BINDING SITE II or BINDING SITE III of FIG. 8. Table 4 illustrates the complementarity of the nucleotide sequences of WDR9 BINDING SITE, designated SEQ ID:15650, to the nucleotide sequence of GAM8358 RNA, herein designated GAM RNA, also designated SEQ ID:255.

Another function of GAM8358 is therefore inhibition of Wd repeat domain 9 (WDR9, Accession NP_061836.2). Accordingly, utilities of GAM8358 include diagnosis, prevention and treatment of diseases and clinical conditions associated with WDR9.

Wolfram syndrome 1 (wolframin) (WFS1, Accession NP_005996.1) is another GAM8358 target gene, herein designated TARGET GENE. WFS1 BINDING SITE is a target binding site found in the 3' untranslated region of mRNA encoded by WFS1, corresponding to a target binding site such as BINDING SITE I, BINDING SITE II or BINDING SITE III of FIG. 8. Table 4 illustrates the complementarity of the nucleotide sequences of WFS1 BINDING SITE, designated SEQ ID:6581, to the nucleotide sequence of GAM8358 RNA, herein designated GAM RNA, also designated SEQ ID:255.

Another function of GAM8358 is therefore inhibition of Wolfram syndrome 1 (wolframin) (WFS1, Accession NP_005996.1). Accordingly, utilities of GAM8358 include diagnosis, prevention and treatment of diseases and clinical conditions associated with WFS1.

Winged-helix nude (WHN, Accession NP_003584.2) is another GAM8358 target gene, herein designated TARGET GENE. WHN BINDING SITE is a target binding site found in the 3' untranslated region of mRNA encoded by WHN, corresponding to a target binding site such as BINDING SITE I, BINDING SITE II or BINDING SITE III of FIG. 8. Table 4 illustrates the complementarity of the nucleotide sequences of WHN BINDING SITE, designated SEQ ID:18123, to the nucleotide sequence of GAM8358 RNA, herein designated GAM RNA, also designated SEQ ID:255.

Another function of GAM8358 is therefore inhibition of Winged-helix nude (WHN, Accession NP_003584.2), a gene which plays a role in transcriptional regulation and therefore may be associated with T-cell immunodeficiency, the skin disorder congenital alopecia, and nail dystrophy. Accordingly, utilities of GAM8358 include diagnosis, prevention and treatment of T-cell immunodeficiency, the skin disorder congenital alopecia, and nail dystrophy, and of other diseases and clinical conditions associated with WHN.

The function of WHN and its association with various diseases and clinical conditions, has been established by previous studies, as described hereinabove with reference to GAM40.1. Wolf-hirschhorn syndrome candidate 1-like 1 (WHSC1L1, Accession NP_060248.2) is another GAM8358 target gene, herein designated TARGET GENE. WHSC1L1 BINDING SITE is a target binding site found in the 3' untranslated region of multiple transcripts of mRNA encoded by WHSC1L1, corresponding to a target binding site such as BINDING SITE I, BINDING SITE II or BINDING SITE III of FIG. 8. Table 4 illustrates the complementarity of the nucleotide sequences of WHSC1L1 BINDING SITE, designated SEQ ID:1808, to the nucleotide sequence of GAM8358 RNA, herein designated GAM RNA, also designated SEQ ID:255.

Another function of GAM8358 is therefore inhibition of Wolf-hirschhorn syndrome candidate 1-like 1 (WHSC1L1, Accession NP_060248.2), a gene which restores repair of base-base and single-nucleotide insertion-deletion mismatches, and increases the proficiency to process heteroduplexes with insertion-deletion mismatches. Accordingly, utilities of GAM8358 include diagnosis, prevention and treatment of diseases and clinical conditions associated with WHSC1L1.

The function of WHSC1L1 and its association with various diseases and clinical conditions, has been established by previous studies, as described hereinabove with reference to GAM412.1. WSB2 (Accession NP_061109.1) is another GAM8358 target gene, herein designated TARGET GENE. WSB2 BINDING SITE is a target binding site found in the 3' untranslated region of mRNA encoded by WSB2, corresponding to a target binding site such as BINDING SITE I, BINDING SITE II or BINDING SITE III of FIG. 8. Table 4 illustrates the complementarity of the nucleotide sequences of WSB2 BINDING SITE, designated SEQ ID:17131, to the nucleotide sequence of GAM8358 RNA, herein designated GAM RNA, also designated SEQ ID:255.

Another function of GAM8358 is therefore inhibition of WSB2 (Accession NP_061109.1). Accordingly, utilities of GAM8358 include diagnosis, prevention and treatment of diseases and clinical conditions associated with WSB2.

Tyrosine 3-monooxygenase/tryptophan 5-monooxygenase activation protein, beta polypeptide (YWHAB, Accession NP_647539.1) is another GAM8358 target gene, herein designated TARGET GENE. YWHAB BINDING SITE is a target binding site found in the 3' untranslated region of multiple transcripts of mRNA encoded by YWHAB, corresponding to a target binding site such as BINDING SITE I, BINDING SITE II or BINDING SITE III of FIG. 8. Table 4 illustrates the complementarity of the nucleotide sequences of YWHAB BINDING SITE, designated SEQ ID:8275, to the nucleotide sequence of GAM8358 RNA, herein designated GAM RNA, also designated SEQ ID:255.

Another function of GAM8358 is therefore inhibition of Tyrosine 3-monooxygenase/tryptophan 5-monooxygenase activation protein, beta polypeptide (YWHAB, Accession NP_647539.1), a gene which activates tyrosine and tryptophan hydroxylases in the presence of protein kinase ii, and strongly activates protein kinase c. Accordingly, utilities of GAM8358 include diagnosis, prevention and treatment of diseases and clinical conditions associated with YWHAB.

The function of YWHAB and its association with various diseases and clinical conditions, has been established by previous studies, as described hereinabove with reference to GAM374.2. Tyrosine 3-monooxygenase/tryptophan 5-monooxygenase activation protein, beta polypeptide (YWHAB, Accession NP_003395.1) is another GAM8358 target gene, herein designated TARGET GENE. YWHAB BINDING SITE is a target binding site found in the 3' untranslated region of multiple transcripts of mRNA encoded by YWHAB, corresponding to a target binding site such as BINDING SITE I, BINDING SITE II or BINDING SITE III of FIG. 8. Table 4 illustrates the complementarity of the nucleotide sequences of YWHAB BINDING SITE, designated SEQ ID:8275, to the nucleotide sequence of GAM8358 RNA, herein designated GAM RNA, also designated SEQ ID:255.

Another function of GAM8358 is therefore inhibition of Tyrosine 3-monooxygenase/tryptophan 5-monooxygenase activation protein, beta polypeptide (YWHAB, Accession NP_003395.1), a gene which activates tyrosine and tryptophan hydroxylases in the presence of protein kinase ii, and strongly activates protein kinase c. Accordingly, utilities of GAM8358 include diagnosis, prevention and treatment of diseases and clinical conditions associated with YWHAB.

The function of YWHAB and its association with various diseases and clinical conditions, has been established by previous studies, as described hereinabove with reference to GAM374.2. Tyrosine 3-monooxygenase/tryptophan 5-monooxygenase activation protein, beta polypeptide (YWHAB, Accession NP_003395.1) is another GAM8358 target gene, herein designated TARGET GENE. YWHAB BINDING SITE is a target binding site found in the 3' untranslated region of multiple transcripts of mRNA encoded by YWHAB, corresponding to a target binding site such as BINDING SITE I, BINDING SITE II or BINDING SITE III of FIG. 8. Table 4 illustrates the complementarity of the nucleotide sequences of YWHAB BINDING SITE, designated SEQ ID:8275, to the nucleotide sequence of GAM8358 RNA, herein designated GAM RNA, also designated SEQ ID:255.

Another function of GAM8358 is therefore inhibition of Tyrosine 3-monooxygenase/tryptophan 5-monooxygenase activation protein, beta polypeptide (YWHAB, Accession NP_003395.1), a gene which activates tyrosine and tryptophan hydroxylases in the presence of protein kinase ii, and strongly activates protein kinase c. Accordingly, utilities of GAM8358 include diagnosis, prevention and treatment of diseases and clinical conditions associated with YWHAB.

The function of YWHAB and its association with various diseases and clinical conditions, has been established by previous studies, as described hereinabove with reference to GAM374.2. ZDHHC14 (Accession NP_714968.1) is another GAM8358 target gene, herein designated TARGET GENE. ZDHHC14 BINDING SITE is a target binding site found in the 3' untranslated region of multiple transcripts of mRNA encoded by ZDHHC14, corresponding to a target binding site such as BINDING SITE I, BINDING SITE II or BINDING SITE III of FIG. 8. Table 4 illustrates the complementarity of the nucleotide sequences of ZDHHC14 BINDING SITE, designated SEQ ID:11339, to the nucleotide sequence of GAM8358 RNA, herein designated GAM RNA, also designated SEQ ID:255.

Another function of GAM8358 is therefore inhibition of ZDHHC14 (Accession NP_714968.1). Accordingly, utilities of GAM8358 include diagnosis, prevention and treatment of diseases and clinical conditions associated with ZDHHC14.

ZDHHC14 (Accession NP_078906.2) is another GAM8358 target gene, herein designated TARGET GENE. ZDHHC14 BINDING SITE is a target binding site found in the 3' untranslated region of multiple transcripts of mRNA encoded by ZDHHC14, corresponding to a target binding site such as BINDING SITE I, BINDING SITE II or BINDING SITE III of FIG. 8. Table 4 illustrates the complementarity of the nucleotide sequences of ZDHHC14 BINDING SITE, designated SEQ ID:11339, to the nucleotide sequence of GAM8358 RNA, herein designated GAM RNA, also designated SEQ ID:255.

Another function of GAM8358 is therefore inhibition of ZDHHC14 (Accession NP_078906.2). Accordingly, utilities of GAM8358 include diagnosis, prevention and treatment of diseases and clinical conditions associated with ZDHHC14.

Zinc finger protein 302 (ZNF302, Accession NP_061145.1) is another GAM8358 target gene, herein designated TARGET GENE. ZNF302 BINDING SITE is a target binding site found in the 3' untranslated region of multiple transcripts of mRNA encoded by ZNF302, corresponding to a target binding site such as BINDING SITE I, BINDING SITE II or BINDING SITE III of FIG. 8. Table 4 illustrates the complementarity of the nucleotide sequences of ZNF302 BINDING SITE, designated SEQ ID:15235, to the nucleotide sequence of GAM8358 RNA, herein designated GAM RNA, also designated SEQ ID:255.

Another function of GAM8358 is therefore inhibition of Zinc finger protein 302 (ZNF302, Accession NP_061145.1).

Accordingly, utilities of GAM8358 include diagnosis, prevention and treatment of diseases and clinical conditions associated with ZNF302.

Zinc finger protein 302 (ZNF302, Accession NP_060913.1) is another GAM8358 target gene, herein designated TARGET GENE. ZNF302 BINDING SITE is a target binding site found in the 3' untranslated region of multiple transcripts of mRNA encoded by ZNF302, corresponding to a target binding site such as BINDING SITE I, BINDING SITE II or BINDING SITE III of FIG. 8. Table 4 illustrates the complementarity of the nucleotide sequences of ZNF302 BINDING SITE, designated SEQ ID:15235, to the nucleotide sequence of GAM8358 RNA, herein designated GAM RNA, also designated SEQ ID:255.

Another function of GAM8358 is therefore inhibition of Zinc finger protein 302 (ZNF302, Accession NP_060913.1). Accordingly, utilities of GAM8358 include diagnosis, prevention and treatment of diseases and clinical conditions associated with ZNF302.

Zinc finger protein 313 (ZNF313, Accession NP_061153.1) is another GAM8358 target gene, herein designated TARGET GENE. ZNF313 BINDING SITE is a target binding site found in the 3' untranslated region of mRNA encoded by ZNF313, corresponding to a target binding site such as BINDING SITE I, BINDING SITE II or BINDING SITE III of FIG. 8. Table 4 illustrates the complementarity of the nucleotide sequences of ZNF313 BINDING SITE, designated SEQ ID:13901, to the nucleotide sequence of GAM8358 RNA, herein designated GAM RNA, also designated SEQ ID:255.

Another function of GAM8358 is therefore inhibition of Zinc finger protein 313 (ZNF313, Accession NP_061153.1). Accordingly, utilities of GAM8358 include diagnosis, prevention and treatment of diseases and clinical conditions associated with ZNF313.

FIG. 8 further provides a conceptual description of a novel bioinformatically detected of the present invention, referred to here as Genomic Address Messenger 8554 (GAM8554), which modulates expression of respective target genes thereof, the function and utility of which target genes is known in the art.

GAM8554 is a novel bioinformatically detected regulatory, non protein coding, micro RNA (miRNA) gene. The method by which GAM8554 was detected is described hereinabove with reference to FIGS. 8-15.

GAM8554 gene, herein designated GAM GENE, and GAM8554 target gene, herein designated TARGET GENE, are human genes contained in the human genome.

GAM8554 gene encodes a GAM8554 precursor RNA, herein designated GAM PRECURSOR RNA. Similar to other miRNA genes, and unlike most ordinary genes, GAM8554 precursor RNA does not encode a protein. A nucleotide sequence identical or highly similar to the nucleotide sequence of GAM8554 precursor RNA is designated SEQ ID:1, and is provided hereinbelow with reference to the sequence listing part.

GAM8554 precursor RNA folds onto itself, forming GAM8554 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM8554 precursor RNA folds onto itself, forming GAM8554 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM8554 precursor RNA, designated SEQ-ID:1, and a schematic representation of a predicted secondary folding of GAM8554 folded precursor RNA are further described with reference to Table 2, hereby incorporated by reference.

An enzyme complex designated DICER COMPLEX, 'dices' the GAM8554 folded precursor RNA into GAM8554 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: B) nucleotide sequence of GAM8554 RNA is designated SEQ ID:388, and is provided hereinbelow with references to the sequence listing part and Table 3, hereby incorporated by reference.

GAM8554 target gene, herein designated TARGET GENE, encodes a corresponding messenger RNA, GAM8554 target RNA, herein designated GAM TARGET RNA. GAM8554 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM8554 RNA, herein designated GAM RNA, binds complementarily to one or more target binding sites located in untranslated regions of GAM8554 target RNA, herein designated GAM TARGET RNA. This complementary binding is due to the fact that the nucleotide sequence of GAM8554 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM8554 RNA may have a different number of target binding sites in untranslated regions of a GAM8554 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM8554 RNA, herein designated GAM RNA, to target binding sites on GAM8554 target RNA, herein designated GAM TARGET RNA, such as BINDING SITE I, BINDING SITE II and BINDING SITE III, inhibits translation of GAM8554 target RNA into GAM8554 target protein, herein designated GAM TARGET PROTEIN. GAM target protein is therefore outlined by a broken line.

It is appreciated that GAM8554 target gene, herein designated TARGET GENE, in fact represents a plurality of GAM8554 target genes. The mRNA of each one of this plurality of GAM8554 target genes comprises one or more target binding sites, each having a nucleotide sequence which is at least partly complementary to GAM8554 RNA, herein designated GAM RNA, and which when bound by GAM8554 RNA causes inhibition of translation of respective one or more GAM8554 target proteins.

It is further appreciated by one skilled in the art that the mode of translational inhibition illustrated by FIG. 8 with specific reference to translational inhibition exerted by GAM8554 gene, herein designated GAM GENE, on one or more GAM8554 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM8554 correlate with, and may be deduced from, the identity of the target genes which GAM8554 binds and inhibits, and the function of these target genes, as elaborated hereinbelow.

V-abl abelson murine leukemia viral oncogene homolog 1 (ABL1, Accession NP_005148.1) is a GAM8554 target gene, herein designated TARGET GENE. ABL1 BINDING SITE is a target binding site found in the 3' untranslated region of multiple transcripts of mRNA encoded by ABL1, corresponding to a target binding site such as BINDING SITE I, BINDING SITE II or BINDING SITE III of FIG. 8. Table 4 illustrates the complementarity of the nucleotide sequences of ABL1 BINDING SITE, designated SEQ ID:4735, to the nucleotide sequence of GAM8554 RNA, herein designated GAM RNA, also designated SEQ ID:388.

A function of GAM8554 is therefore inhibition of V-abl abelson murine leukemia viral oncogene homolog 1 (ABL1, Accession NP_005148.1). Accordingly, utilities of GAM8554 include diagnosis, prevention and treatment of diseases and clinical conditions associated with ABL1.

V-abl abelson murine leukemia viral oncogene homolog 1 (ABL1, Accession NP_009297.1) is another GAM8554 target gene, herein designated TARGET GENE. ABL1 BINDING SITE is a target binding site found in the 3' untranslated region of multiple transcripts of mRNA encoded by ABL1, corresponding to a target binding site such as BINDING SITE I, BINDING SITE II or BINDING SITE III of FIG. 8. Table 4 illustrates the complementarity of the nucleotide sequences of ABL1 BINDING SITE, designated SEQ ID:4735, to the nucleotide sequence of GAM8554 RNA, herein designated GAM RNA, also designated SEQ ID:388.

Another function of GAM8554 is therefore inhibition of V-abl abelson murine leukemia viral oncogene homolog 1 (ABL1, Accession NP_009297.1). Accordingly, utilities of GAM8554 include diagnosis, prevention and treatment of diseases and clinical conditions associated with ABL1.

Afg3 atpase family gene 3-like 1 (yeast) (AFG3L1, Accession NP_001123.1) is another GAM8554 target gene, herein designated TARGET GENE. AFG3L1 BINDING SITE is a target binding site found in the 3' untranslated region of mRNA encoded by AFG3L1, corresponding to a target binding site such as BINDING SITE I, BINDING SITE II or BINDING SITE III of FIG. 8. Table 4 illustrates the complementarity of the nucleotide sequences of AFG3L1 BINDING SITE, designated SEQ ID:4913, to the nucleotide sequence of GAM8554 RNA, herein designated GAM RNA, also designated SEQ ID:388.

Another function of GAM8554 is therefore inhibition of Afg3 atpase family gene 3-like 1 (yeast) (AFG3L1, Accession NP_001123.1). Accordingly, utilities of GAM8554 include diagnosis, prevention and treatment of diseases and clinical conditions associated with AFG3L1.

Aldehyde dehydrogenase 4 family, member a1 (ALDH4A1, Accession NP_003739.2) is another GAM8554 target gene, herein designated TARGET GENE. ALDH4A1 BINDING SITE is a target binding site found in the 3' untranslated region of multiple transcripts of mRNA encoded by ALDH4A1, corresponding to a target binding site such as BINDING SITE I, BINDING SITE II or BINDING SITE III of FIG. 8. Table 4 illustrates the complementarity of the nucleotide sequences of ALDH4A1 BINDING SITE, designated SEQ ID:4955, to the nucleotide sequence of GAM8554 RNA, herein designated GAM RNA, also designated SEQ ID:388.

Another function of GAM8554 is therefore inhibition of Aldehyde dehydrogenase 4 family, member a1 (ALDH4A1, Accession NP_003739.2). Accordingly, utilities of GAM8554 include diagnosis, prevention and treatment of diseases and clinical conditions associated with ALDH4A1.

Aldehyde dehydrogenase 4 family, member a1 (ALDH4A1, Accession NP_733844.1) is another GAM8554 target gene, herein designated TARGET GENE. ALDH4A1 BINDING SITE is a target binding site found in the 3' untranslated region of multiple transcripts of mRNA encoded by ALDH4A1, corresponding to a target binding site such as BINDING SITE I, BINDING SITE II or BINDING SITE III of FIG. 8. Table 4 illustrates the complementarity of the nucleotide sequences of ALDH4A1 BINDING SITE, designated SEQ ID:4955, to the nucleotide sequence of GAM8554 RNA, herein designated GAM RNA, also designated SEQ ID:388.

Another function of GAM8554 is therefore inhibition of Aldehyde dehydrogenase 4 family, member a1 (ALDH4A1, Accession NP_733844.1). Accordingly, utilities of GAM8554 include diagnosis, prevention and treatment of diseases and clinical conditions associated with ALDH4A1.

Adaptor-related protein complex 1, gamma 1 subunit (AP1G1, Accession NP_001119.2) is another GAM8554 target gene, herein designated TARGET GENE. AP1G1 BINDING SITE is a target binding site found in the 3' untranslated region of mRNA encoded by AP1G1, corresponding to a target binding site such as BINDING SITE I, BINDING SITE II or BINDING SITE III of FIG. 8. Table 4 illustrates the complementarity of the nucleotide sequences of AP1G1 BINDING SITE, designated SEQ ID:18932, to the nucleotide sequence of GAM8554 RNA, herein designated GAM RNA, also designated SEQ ID:388.

Another function of GAM8554 is therefore inhibition of Adaptor-related protein complex 1, gamma 1 subunit (AP1G1, Accession NP_001119.2), a gene which promotes the formation of clathrin-coated pits and vesicles. Accordingly, utilities of GAM8554 include diagnosis, prevention and treatment of diseases and clinical conditions associated with AP1G1.

The function of AP1G1 and its association with various diseases and clinical conditions, has been established by previous studies, as described hereinabove with reference to GAM388.2. Adaptor-related protein complex 1, mu 1 subunit (AP1M1, Accession NP_115882.1) is another GAM8554 target gene, herein designated TARGET GENE. AP1M1 BINDING SITE is a target binding site found in the 3' untranslated region of mRNA encoded by AP1M1, corresponding to a target binding site such as BINDING SITE I, BINDING SITE II or BINDING SITE III of FIG. 8. Table 4 illustrates the complementarity of the nucleotide sequences of AP1M1 BINDING SITE, designated SEQ ID:7039, to the nucleotide sequence of GAM8554 RNA, herein designated GAM RNA, also designated SEQ ID:388.

Another function of GAM8554 is therefore inhibition of Adaptor-related protein complex 1, mu 1 subunit (AP1M1, Accession NP_115882.1), a gene which promotes the formation of clathrin-coated pits and vesicles. Accordingly, utilities of GAM8554 include diagnosis, prevention and treatment of diseases and clinical conditions associated with AP1M1.

The function of AP1M1 and its association with various diseases and clinical conditions, has been established by previous studies, as described hereinabove with reference to GAM130.1. APRG1 (Accession NP_848029.1) is another GAM8554 target gene, herein designated TARGET GENE. APRG1 BINDING SITE is a target binding site found in the 5' untranslated region of multiple transcripts of mRNA encoded by APRG1, corresponding to a target binding site such as BINDING SITE I, BINDING SITE II or BINDING SITE III of FIG. 8. Table 4 illustrates the complementarity of the nucleotide sequences of APRG1 BINDING SITE, designated SEQ ID:9637, to the nucleotide sequence of GAM8554 RNA, herein designated GAM RNA, also designated SEQ ID:388.

Another function of GAM8554 is therefore inhibition of APRG1 (Accession NP_848029.1). Accordingly, utilities of GAM8554 include diagnosis, prevention and treatment of diseases and clinical conditions associated with APRG1.

APRG1 (Accession NP_848028.1) is another GAM8554 target gene, herein designated TARGET GENE. APRG1 BINDING SITE is a target binding site found in the 5' untranslated region of multiple transcripts of mRNA encoded by APRG1, corresponding to a target binding site such as BINDING SITE I, BINDING SITE II or BINDING SITE III of FIG. 8. Table 4 illustrates the complementarity of the nucleotide sequences of APRG1 BINDING SITE, designated SEQ ID:9637, to the nucleotide sequence of GAM8554 RNA, herein designated GAM RNA, also designated SEQ ID:388.

Another function of GAM8554 is therefore inhibition of APRG1 (Accession NP_848028.1). Accordingly, utilities of GAM8554 include diagnosis, prevention and treatment of diseases and clinical conditions associated with APRG1.

APRG1 (Accession NP_848032.1) is another GAM8554 target gene, herein designated TARGET GENE. APRG1 BINDING SITE is a target binding site found in the 5' untranslated region of multiple transcripts of mRNA encoded by APRG1, corresponding to a target binding site such as BINDING SITE I, BINDING SITE II or BINDING SITE III of FIG. 8. Table 4 illustrates the complementarity of the nucleotide sequences of APRG1 BINDING SITE, designated SEQ ID:9637, to the nucleotide sequence of GAM8554 RNA, herein designated GAM RNA, also designated SEQ ID:388.

Another function of GAM8554 is therefore inhibition of APRG1 (Accession NP_848032.1). Accordingly, utilities of GAM8554 include diagnosis, prevention and treatment of diseases and clinical conditions associated with APRG1.

ARH (Accession NP_056442.1) is another GAM8554 target gene, herein designated TARGET GENE. ARH BINDING SITE is a target binding site found in the 3' untranslated region of mRNA encoded by ARH, corresponding to a target binding site such as BINDING SITE I, BINDING SITE II or BINDING SITE III of FIG. 8. Table 4 illustrates the complementarity of the nucleotide sequences of ARH BINDING SITE, designated SEQ ID:18536, to the nucleotide sequence of GAM8554 RNA, herein designated GAM RNA, also designated SEQ ID:388.

Another function of GAM8554 is therefore inhibition of ARH (Accession NP_056442.1). Accordingly, utilities of GAM8554 include diagnosis, prevention and treatment of diseases and clinical conditions associated with ARH.

Adp-ribosylation factor-like 2 (ARL2, Accession NP_001658.1) is another GAM8554 target gene, herein designated TARGET GENE. ARL2 BINDING SITE is a target binding site found in the 3' untranslated region of mRNA encoded by ARL2, corresponding to a target binding site such as BINDING SITE I, BINDING SITE II or BINDING SITE III of FIG. 8. Table 4 illustrates the complementarity of the nucleotide sequences of ARL2 BINDING SITE, designated SEQ ID:9268, to the nucleotide sequence of GAM8554 RNA, herein designated GAM RNA, also designated SEQ ID:388.

Another function of GAM8554 is therefore inhibition of Adp-ribosylation factor-like 2 (ARL2, Accession NP_001658.1). Accordingly, utilities of GAM8554 include diagnosis, prevention and treatment of diseases and clinical conditions associated with ARL2.

Actin related protein 2/3 complex, subunit 3, 21 kda (ARPC3, Accession NP_005710.1) is another GAM8554 target gene, herein designated TARGET GENE. ARPC3 BINDING SITE is a target binding site found in the 5' untranslated region of mRNA encoded by ARPC3, corresponding to a target binding site such as BINDING SITE I, BINDING SITE II or BINDING SITE III of FIG. 8. Table 4 illustrates the complementarity of the nucleotide sequences of ARPC3 BINDING SITE, designated SEQ ID:10193, to the nucleotide sequence of GAM8554 RNA, herein designated GAM RNA, also designated SEQ ID:388.

Another function of GAM8554 is therefore inhibition of Actin related protein 2/3 complex, subunit 3, 21 kda (ARPC3, Accession NP_005710.1). Accordingly, utilities of GAM8554 include diagnosis, prevention and treatment of diseases and clinical conditions associated with ARPC3.

ASF1B (Accession NP_060624.1) is another GAM8554 target gene, herein designated TARGET GENE. ASF1B BINDING SITE is a target binding site found in the 3' untranslated region of mRNA encoded by ASF1B, corresponding to a target binding site such as BINDING SITE I, BINDING SITE II or BINDING SITE III of FIG. 8. Table 4 illustrates the complementarity of the nucleotide sequences of ASF1B BINDING SITE, designated SEQ ID:4386, to the nucleotide sequence of GAM8554 RNA, herein designated GAM RNA, also designated SEQ ID:388.

Another function of GAM8554 is therefore inhibition of ASF1B (Accession NP_060624.1). Accordingly, utilities of GAM8554 include diagnosis, prevention and treatment of diseases and clinical conditions associated with ASF1B.

Atpase, class v, type 10a (ATP10A, Accession NP_077816.1) is another GAM8554 target gene, herein designated TARGET GENE. ATP10A BINDING SITE is a target binding site found in the 3' untranslated region of mRNA encoded by ATP10A, corresponding to a target binding site such as BINDING SITE I, BINDING SITE II or BINDING SITE III of FIG. 8. Table 4 illustrates the complementarity of the nucleotide sequences of ATP10A BINDING SITE, designated SEQ ID:12086, to the nucleotide sequence of GAM8554 RNA, herein designated GAM RNA, also designated SEQ ID:388.

Another function of GAM8554 is therefore inhibition of Atpase, class v, type 10a (ATP10A, Accession NP_077816.1). Accordingly, utilities of GAM8554 include diagnosis, prevention and treatment of diseases and clinical conditions associated with ATP10A.

Atpase inhibitory factor 1 (ATPIF1, Accession NP_835498.1) is another GAM8554 target gene, herein designated TARGET GENE. ATPIF1 BINDING SITE is a target binding site found in the 3' untranslated region of multiple transcripts of mRNA encoded by ATPIF1, corresponding to a target binding site such as BINDING SITE I, BINDING SITE II or BINDING SITE III of FIG. 8. Table 4 illustrates the complementarity of the nucleotide sequences of ATPIF1 BINDING SITE, designated SEQ ID:19002, to the nucleotide sequence of GAM8554 RNA, herein designated GAM RNA, also designated SEQ ID:388.

Another function of GAM8554 is therefore inhibition of Atpase inhibitory factor 1 (ATPIF1, Accession NP_835498.1). Accordingly, utilities of GAM8554 include diagnosis, prevention and treatment of diseases and clinical conditions associated with ATPIF1.

Btb and cnc homology 1, basic leucine zipper transcription factor 2 (BACH2, Accession NP_068585.1) is another GAM8554 target gene, herein designated TARGET GENE. BACH2 BINDING SITE1 and BACH2 BINDING SITE2 are target binding sites found in untranslated regions of mRNA encoded by BACH2, corresponding to target binding sites such as BINDING SITE I, BINDING SITE II or BINDING SITE III of FIG. 8. Table 4 illustrates the complementarity of the nucleotide sequences of BACH2 BINDING SITE1 and BACH2 BINDING SITE2, designated SEQ ID:17751 and SEQ ID:19189 respectively, to the nucleotide sequence of GAM8554 RNA, herein designated GAM RNA, also designated SEQ ID:388.

Another function of GAM8554 is therefore inhibition of Btb and cnc homology 1, basic leucine zipper transcription factor 2 (BACH2, Accession NP_068585.1), a gene which acts as repressor or activator, binds to maf recognition elements and therefore may be associated with Non-hodgkin lymphoma. Accordingly, utilities of GAM8554 include diagnosis, prevention and treatment of Non-hodgkin lymphoma, and of other diseases and clinical conditions associated with BACH2.

The function of BACH2 and its association with various diseases and clinical conditions, has been established by previous studies, as described hereinabove with reference to GAM44.1. BOP (Accession XP_097915.2) is another GAM8554 target gene, herein designated TARGET GENE. BOP BINDING SITE is a target binding site found in the 3' untranslated region of mRNA encoded by BOP, corresponding to a target binding site such as BINDING SITE I, BINDING SITE II or BINDING SITE III of FIG. 8. Table 4 illustrates the complementarity of the nucleotide sequences of BOP BINDING SITE, designated SEQ ID:3691, to the nucleotide sequence of GAM8554 RNA, herein designated GAM RNA, also designated SEQ ID:388.

Another function of GAM8554 is therefore inhibition of BOP (Accession XP_097915.2). Accordingly, utilities of GAM8554 include diagnosis, prevention and treatment of diseases and clinical conditions associated with BOP.

C14orf113 (Accession NP_060100.1) is another GAM8554 target gene, herein designated TARGET GENE. C14orf113 BINDING SITE is a target binding site found in the 3' untranslated region of mRNA encoded by C14orf113, corresponding to a target binding site such as BINDING SITE I, BINDING SITE II or BINDING SITE III of FIG. 8. Table 4 illustrates the complementarity of the nucleotide sequences of C14orf113 BINDING SITE, designated SEQ ID:13492, to the nucleotide sequence of GAM8554 RNA, herein designated GAM RNA, also designated SEQ ID:388.

Another function of GAM8554 is therefore inhibition of C14orf113 (Accession NP_060100.1). Accordingly, utilities of GAM8554 include diagnosis, prevention and treatment of diseases and clinical conditions associated with C14orf113.

Chromosome 9 open reading frame 19 (C9orf19, Accession NP_071738.1) is another GAM8554 target gene, herein designated TARGET GENE. C9orf19 BINDING SITE is a target binding site found in the 3' untranslated region of mRNA encoded by C9orf19, corresponding to a target binding site such as BINDING SITE I, BINDING SITE II or BINDING SITE III of FIG. 8. Table 4 illustrates the complementarity of the nucleotide sequences of C9orf19 BINDING SITE, designated SEQ ID:4682, to the nucleotide sequence of GAM8554 RNA, herein designated GAM RNA, also designated SEQ ID:388.

Another function of GAM8554 is therefore inhibition of Chromosome 9 open reading frame 19 (C9orf19, Accession NP_071738.1). Accordingly, utilities of GAM8554 include diagnosis, prevention and treatment of diseases and clinical conditions associated with C9orf19.

Chromosome 9 open reading frame 25 (C9orf25, Accession NP_671735.1) is another GAM8554 target gene, herein designated TARGET GENE. C9orf25 BINDING SITE is a target binding site found in the 3' untranslated region of mRNA encoded by C9orf25, corresponding to a target binding site such as BINDING SITE I, BINDING SITE II or BINDING SITE III of FIG. 8. Table 4 illustrates the complementarity of the nucleotide sequences of C9orf25 BINDING SITE, designated SEQ ID:1932, to the nucleotide sequence of GAM8554 RNA, herein designated GAM RNA, also designated SEQ ID:388.

Another function of GAM8554 is therefore inhibition of Chromosome 9 open reading frame 25 (C9orf25, Accession NP_671735.1). Accordingly, utilities of GAM8554 include diagnosis, prevention and treatment of diseases and clinical conditions associated with C9orf25.

Carbonic anhydrase vi (CA6, Accession NP_001206.1) is another GAM8554 target gene, herein designated TARGET GENE. CA6 BINDING SITE is a target binding site found in the 3' untranslated region of mRNA encoded by CA6, corresponding to a target binding site such as BINDING SITE I, BINDING SITE II or BINDING SITE III of FIG. 8. Table 4 illustrates the complementarity of the nucleotide sequences of CA6 BINDING SITE, designated SEQ ID:4909, to the nucleotide sequence of GAM8554 RNA, herein designated GAM RNA, also designated SEQ ID:388.

Another function of GAM8554 is therefore inhibition of Carbonic anhydrase vi (CA6, Accession NP_001206.1), a gene which has a function of reversible hydratation of carbon dioxide. Accordingly, utilities of GAM8554 include diagnosis, prevention and treatment of diseases and clinical conditions associated with CA6.

The function of CA6 and its association with various diseases and clinical conditions, has been established by previous studies, as described hereinabove with reference to GAM1617.1. Calcium channel, voltage-dependent, alpha 2/delta subunit 2 (CACNA2D2, Accession NP_006021.1) is another GAM8554 target gene, herein designated TARGET GENE. CACNA2D2 BINDING SITE is a target binding site found in the 3' untranslated region of mRNA encoded by CACNA2D2, corresponding to a target binding site such as BINDING SITE I, BINDING SITE II or BINDING SITE III of FIG. 8. Table 4 illustrates the complementarity of the nucleotide sequences of CACNA2D2 BINDING SITE, designated SEQ ID:8973, to the nucleotide sequence of GAM8554 RNA, herein designated GAM RNA, also designated SEQ ID:388.

Another function of GAM8554 is therefore inhibition of Calcium channel, voltage-dependent, alpha 2/delta subunit 2 (CACNA2D2, Accession NP_006021.1), a gene which is a calcium channel protein which plays an important role in excitation-contraction coupling. Accordingly, utilities of GAM8554 include diagnosis, prevention and treatment of diseases and clinical conditions associated with CACNA2D2.

The function of CACNA2D2 and its association with various diseases and clinical conditions, has been established by previous studies, as described hereinabove with reference to GAM374.2. CAP350 (Accession NP_055625.2) is another GAM8554 target gene, herein designated TARGET GENE. CAP350 BINDING SITE is a target binding site found in the 3' untranslated region of mRNA encoded by CAP350, corresponding to a target binding site such as BINDING SITE I, BINDING SITE II or BINDING SITE III of FIG. 8. Table 4 illustrates the complementarity of the nucleotide sequences of CAP350 BINDING SITE, designated SEQ ID:11531, to the nucleotide sequence of GAM8554 RNA, herein designated GAM RNA, also designated SEQ ID:388.

Another function of GAM8554 is therefore inhibition of CAP350 (Accession NP_055625.2). Accordingly, utilities of GAM8554 include diagnosis, prevention and treatment of diseases and clinical conditions associated with CAP350.

Caspase 8, apoptosis-related cysteine protease (CASP8, Accession NP_203521.1) is another GAM8554 target gene, herein designated TARGET GENE. CASP8 BINDING SITE is a target binding site found in the 3' untranslated region of multiple transcripts of mRNA encoded by CASP8, corresponding to a target binding site such as BINDING SITE I, BINDING SITE II or BINDING SITE III of FIG. 8. Table 4 illustrates the complementarity of the nucleotide sequences of CASP8 BINDING SITE, designated SEQ ID:14684, to the nucleotide sequence of GAM8554 RNA, herein designated GAM RNA, also designated SEQ ID:388.

Another function of GAM8554 is therefore inhibition of Caspase 8, apoptosis-related cysteine protease (CASP8, Accession NP_203521.1), a gene which is an apoptosis-related caspase and an upstream component of Fas receptor and tumor necrosis factor (TNF) receptor-induced apoptosis. and therefore may be associated with Huntington-related neurodegenerative diseases. Accordingly, utilities of GAM8554 include diagnosis, prevention and treatment of Huntington-related neurodegenerative diseases, and of other diseases and clinical conditions associated with CASP8.

The function of CASP8 and its association with various diseases and clinical conditions, has been established by previous studies, as described hereinabove with reference to GAM72.1. Chemokine (c-c motif) receptor 7 (CCR7, Accession NP_001829.1) is another GAM8554 target gene, herein designated TARGET GENE. CCR7 BINDING SITE is a target binding site found in the 3' untranslated region of mRNA encoded by CCR7, corresponding to a target binding site such as BINDING SITE I, BINDING SITE II or BINDING SITE III of FIG. 8. Table 4 illustrates the complementarity of the nucleotide sequences of CCR7 BINDING SITE, designated SEQ ID:1279, to the nucleotide sequence of GAM8554 RNA, herein designated GAM RNA, also designated SEQ ID:388.

Another function of GAM8554 is therefore inhibition of Chemokine (c-c motif) receptor 7 (CCR7, Accession NP_001829.1). Accordingly, utilities of GAM8554 include diagnosis, prevention and treatment of diseases and clinical conditions associated with CCR7.

Chromodomain helicase dna binding protein 4 (CHD4, Accession NP_001264.1) is another GAM8554 target gene, herein designated TARGET GENE. CHD4 BINDING SITE is a target binding site found in the 3' untranslated region of mRNA encoded by CHD4, corresponding to a target binding site such as BINDING SITE I, BINDING SITE II or BINDING SITE III of FIG. 8. Table 4 illustrates the complementarity of the nucleotide sequences of CHD4 BINDING SITE, designated SEQ ID:2554, to the nucleotide sequence of GAM8554 RNA, herein designated GAM RNA, also designated SEQ ID:388.

Another function of GAM8554 is therefore inhibition of Chromodomain helicase dna binding protein 4 (CHD4, Accession NP_001264.1), a gene which may regulate gene expression and chromatin structure and therefore may be associated with Dermatomyositis. Accordingly, utilities of GAM8554 include diagnosis, prevention and treatment of Dermatomyositis, and of other diseases and clinical conditions associated with CHD4.

The function of CHD4 and its association with various diseases and clinical conditions, has been established by previous studies, as described hereinabove with reference to GAM63.1. Carbohydrate (n-acetylglucosamine-6-o) sulfotransferase 2 (CHST2, Accession NP_004258.2) is another GAM8554 target gene, herein designated TARGET GENE. CHST2 BINDING SITE is a target binding site found in the 3' untranslated region of mRNA encoded by CHST2, corresponding to a target binding site such as BINDING SITE I, BINDING SITE II or BINDING SITE III of FIG. 8. Table 4 illustrates the complementarity of the nucleotide sequences of CHST2 BINDING SITE, designated SEQ ID:5960, to the nucleotide sequence of GAM8554 RNA, herein designated GAM RNA, also designated SEQ ID:388.

Another function of GAM8554 is therefore inhibition of Carbohydrate (n-acetylglucosamine-6-o) sulfotransferase 2 (CHST2, Accession NP_004258.2), a gene which may serve as a transmembrane domain for a type II protein or as a Golgi retention signal. Accordingly, utilities of GAM8554 include diagnosis, prevention and treatment of diseases and clinical conditions associated with CHST2.

The function of CHST2 and its association with various diseases and clinical conditions, has been established by previous studies, as described hereinabove with reference to GAM1191.1. Ciliary neurotrophic factor (CNTF, Accession NP_000605.1) is another GAM8554 target gene, herein designated TARGET GENE. CNTF BINDING SITE is a target binding site found in the 3' untranslated region of mRNA encoded by CNTF, corresponding to a target binding site such as BINDING SITE I, BINDING SITE II or BINDING SITE III of FIG. 8. Table 4 illustrates the complementarity of the nucleotide sequences of CNTF BINDING SITE, designated SEQ ID:19190, to the nucleotide sequence of GAM8554 RNA, herein designated GAM RNA, also designated SEQ ID:388.

Another function of GAM8554 is therefore inhibition of Ciliary neurotrophic factor (CNTF, Accession NP_000605.1), a gene which is a survival factor for various neuronal cell types. and therefore may be associated with Ciliary neurotrophic factor polymorphism. Accordingly, utilities of GAM8554 include diagnosis, prevention and treatment of Ciliary neurotrophic factor polymorphism, and of other diseases and clinical conditions associated with CNTF.

The function of CNTF and its association with various diseases and clinical conditions, has been established by previous studies, as described hereinabove with reference to GAM148.1. Carnitine acetyltransferase (CRAT, Accession NP_003994.2) is another GAM8554 target gene, herein designated TARGET GENE. CRAT BINDING SITE is a target binding site found in the 5' untranslated region of multiple transcripts of mRNA encoded by CRAT, corresponding to a target binding site such as BINDING SITE I, BINDING SITE II or BINDING SITE III of FIG. 8. Table 4 illustrates the complementarity of the nucleotide sequences of CRAT BINDING SITE, designated SEQ ID:8044, to the nucleotide sequence of GAM8554 RNA, herein designated GAM RNA, also designated SEQ ID:388.

Another function of GAM8554 is therefore inhibition of Carnitine acetyltransferase (CRAT, Accession NP_003994.2), a gene which catalyzes the reversible transfer of acyl groups from an acyl-CoA thioester to carnitine. and therefore may be associated with Alzheimer's disease. Accordingly, utilities of GAM8554 include diagnosis, prevention and treatment of Alzheimer's disease, and of other diseases and clinical conditions associated with CRAT.

The function of CRH and its association with various diseases and clinical conditions, has been established by previous studies, as described hereinabove with reference to GAM229.1. Corticotropin releasing hormone (CRH, Accession NP_000747.1) is another GAM8554 target gene, herein designated TARGET GENE. CRH BINDING SITE is a target binding site found in the 3' untranslated region of mRNA encoded by CRH, corresponding to a target binding site such as BINDING SITE I, BINDING SITE II or BINDING SITE III of FIG. 8. Table 4 illustrates the complementarity of the nucleotide sequences of CRH BINDING SITE, designated SEQ ID:7497, to the nucleotide sequence of GAM8554 RNA, herein designated GAM RNA, also designated SEQ ID:388.

Another function of GAM8554 is therefore inhibition of Corticotropin releasing hormone (CRH, Accession NP_000747.1), a gene which regulates the release of corticotropin from pituitary gland. and therefore may be associated with Alzheimer's disease. Accordingly, utilities of GAM8554 include diagnosis, prevention and treatment of Alzheimer's disease, and of other diseases and clinical conditions associated with CRH.

The function of CRH and its association with various diseases and clinical conditions, has been established by previous studies, as described hereinabove with reference to GAM371.1. Chemokine (c-x-c motif) ligand 9 (CXCL9, Accession NP_002407.1) is another GAM8554 target gene, herein designated TARGET GENE. CXCL9 BINDING SITE is a target binding site found in the 3' untranslated region of mRNA encoded by CXCL9, corresponding to a target binding site such as BINDING SITE I, BINDING SITE II or BINDING SITE III of FIG. 8. Table 4 illustrates the complementarity of the nucleotide sequences of CXCL9 BINDING SITE, designated SEQ ID:548, to the nucleotide sequence of GAM8554 RNA, herein designated GAM RNA, also designated SEQ ID:388.

Another function of GAM8554 is therefore inhibition of Chemokine (c-x-c motif) ligand 9 (CXCL9, Accession NP_002407.1). Accordingly, utilities of GAM8554 include diagnosis, prevention and treatment of diseases and clinical conditions associated with CXCL9.

Daz associated protein 2 (DAZAP2, Accession NP_055579.1) is another GAM8554 target gene, herein designated TARGET GENE. DAZAP2 BINDING SITE is a target binding site found in the 3' untranslated region of mRNA encoded by DAZAP2, corresponding to a target binding site such as BINDING SITE I, BINDING SITE II or BINDING SITE III of FIG. 8. Table 4 illustrates the complementarity of the nucleotide sequences of DAZAP2 BINDING SITE, designated SEQ ID:12754, to the nucleotide sequence of GAM8554 RNA, herein designated GAM RNA, also designated SEQ ID:388.

Another function of GAM8554 is therefore inhibition of Daz associated protein 2 (DAZAP2, Accession NP_055579.1). Accordingly, utilities of GAM8554 include diagnosis, prevention and treatment of diseases and clinical conditions associated with DAZAP2.

DC2 (Accession NP_067050.1) is another GAM8554 target gene, herein designated TARGET GENE. DC2 BINDING SITE is a target binding site found in the 3' untranslated region of mRNA encoded by DC2, corresponding to a target binding site such as BINDING SITE I, BINDING SITE II or BINDING SITE III of FIG. 8. Table 4 illustrates the complementarity of the nucleotide sequences of DC2 BINDING SITE, designated SEQ ID:4382, to the nucleotide sequence of GAM8554 RNA, herein designated GAM RNA, also designated SEQ ID:388.

Another function of GAM8554 is therefore inhibition of DC2 (Accession NP_067050.1). Accordingly, utilities of GAM8554 include diagnosis, prevention and treatment of diseases and clinical conditions associated with DC2.

Desmin (DES, Accession NP_001918.2) is another GAM8554 target gene, herein designated TARGET GENE. DES BINDING SITE is a target binding site found in the 3' untranslated region of mRNA encoded by DES, corresponding to a target binding site such as BINDING SITE I, BINDING SITE II or BINDING SITE III of FIG. 8. Table 4 illustrates the complementarity of the nucleotide sequences of DES BINDING SITE, designated SEQ ID:17929, to the nucleotide sequence of GAM8554 RNA, herein designated GAM RNA, also designated SEQ ID:388.

Another function of GAM8554 is therefore inhibition of Desmin (DES, Accession NP_001918.2). Accordingly, utilities of GAM8554 include diagnosis, prevention and treatment of diseases and clinical conditions associated with DES.

Deoxyguanosine kinase (DGUOK, Accession NP_550440.1) is another GAM8554 target gene, herein designated TARGET GENE. DGUOK BINDING SITE is a target binding site found in the 3' untranslated region of multiple transcripts of mRNA encoded by DGUOK, corresponding to a target binding site such as BINDING SITE I, BINDING SITE II or BINDING SITE III of FIG. 8. Table 4 illustrates the complementarity of the nucleotide sequences of DGUOK BINDING SITE, designated SEQ ID:2183, to the nucleotide sequence of GAM8554 RNA, herein designated GAM RNA, also designated SEQ ID:388.

Another function of GAM8554 is therefore inhibition of Deoxyguanosine kinase (DGUOK, Accession NP_550440.1), a gene which is deoxyguanosine kinase and mediates phosphorylation of several deoxyribonucleosides and therefore may be associated with Mitochondrial dna depletion syndromes. Accordingly, utilities of GAM8554 include diagnosis, prevention and treatment of Mitochondrial dna depletion syndromes ., and of other diseases and clinical conditions associated with DGUOK.

The function of DGUOK and its association with various diseases and clinical conditions, has been established by previous studies, as described hereinabove with reference to GAM385.2. Deoxyguanosine kinase (DGUOK, Accession NP_550438.1) is another GAM8554 target gene, herein designated TARGET GENE. DGUOK BINDING SITE is a target binding site found in the 3' untranslated region of multiple transcripts of mRNA encoded by DGUOK, corresponding to a target binding site such as BINDING SITE I, BINDING SITE II or BINDING SITE III of FIG. 8. Table 4 illustrates the complementarity of the nucleotide sequences of DGUOK BINDING SITE, designated SEQ ID:2183, to the nucleotide sequence of GAM8554 RNA, herein designated GAM RNA, also designated SEQ ID:388.

Another function of GAM8554 is therefore inhibition of Deoxyguanosine kinase (DGUOK, Accession NP_550438.1), a gene which is deoxyguanosine kinase and mediates phosphorylation of several deoxyribonucleosides and therefore may be associated with Mitochondrial dna depletion syndromes. Accordingly, utilities of GAM8554 include diagnosis, prevention and treatment of Mitochondrial dna depletion syndromes ., and of other diseases and clinical conditions associated with DGUOK.

The function of DGUOK and its association with various diseases and clinical conditions, has been established by previous studies, as described hereinabove with reference to GAM385.2. DHDDS (Accession NP_079163.1) is another GAM8554 target gene, herein designated TARGET GENE. DHDDS BINDING SITE is a target binding site found in the 3' untranslated region of mRNA encoded by DHDDS, corresponding to a target binding site such as BINDING SITE I, BINDING SITE II or BINDING SITE III of FIG. 8. Table 4 illustrates the complementarity of the nucleotide sequences of DHDDS BINDING SITE, designated SEQ ID:6851, to the nucleotide sequence of GAM8554 RNA, herein designated GAM RNA, also designated SEQ ID:388.

Another function of GAM8554 is therefore inhibition of DHDDS (Accession NP_079163.1). Accordingly, utilities of GAM8554 include diagnosis, prevention and treatment of diseases and clinical conditions associated with DHDDS.

DHRS1 (Accession NP_612461.1) is another GAM8554 target gene, herein designated TARGET GENE. DHRS1 BINDING SITE is a target binding site found in the 5' untranslated region of mRNA encoded by DHRS1, corresponding to a target binding site such as BINDING SITE I, BINDING SITE II or BINDING SITE III of FIG. 8. Table 4 illustrates the complementarity of the nucleotide sequences of DHRS1 BINDING SITE, designated SEQ ID:10467, to the nucleotide sequence of GAM8554 RNA, herein designated GAM RNA, also designated SEQ ID:388.

Another function of GAM8554 is therefore inhibition of DHRS1 (Accession NP_612461.1). Accordingly, utilities of GAM8554 include diagnosis, prevention and treatment of diseases and clinical conditions associated with DHRS1.

DKFZP434F2021 (Accession NP_056227.1) is another GAM8554 target gene, herein designated TARGET GENE. DKFZP434F2021 BINDING SITE is a target binding site found in the 3' untranslated region of mRNA encoded by DKFZP434F2021, corresponding to a target binding site such as BINDING SITE I, BINDING SITE II or BINDING SITE III of FIG. 8. Table 4 illustrates the complementarity of the nucleotide sequences of DKFZP434F2021 BINDING SITE, designated SEQ ID:10822, to the nucleotide sequence of GAM8554 RNA, herein designated GAM RNA, also designated SEQ ID:388.

Another function of GAM8554 is therefore inhibition of DKFZP434F2021 (Accession NP_056227.1). Accordingly, utilities of GAM8554 include diagnosis, prevention and treatment of diseases and clinical conditions associated with DKFZP434F2021.

DKFZP434H132 (Accession NP_056307.1) is another GAM8554 target gene, herein designated TARGET GENE. DKFZP434H132 BINDING SITE is a target binding site found in the 3' untranslated region of mRNA encoded by DKFZP434H132, corresponding to a target binding site such as BINDING SITE I, BINDING SITE II or BINDING SITE III of FIG. 8. Table 4 illustrates the complementarity of the nucleotide sequences of DKFZP434H132 BINDING SITE, designated SEQ ID:12087, to the nucleotide sequence of GAM8554 RNA, herein designated GAM RNA, also designated SEQ ID:388.

Another function of GAM8554 is therefore inhibition of DKFZP434H132 (Accession NP_056307.1). Accordingly, utilities of GAM8554 include diagnosis, prevention and treatment of diseases and clinical conditions associated with DKFZP434H132.

DKFZP434J046 (Accession NP_056486.1) is another GAM8554 target gene, herein designated TARGET GENE. DKFZP434J046 BINDING SITE is a target binding site found in the 5' untranslated region of mRNA encoded by DKFZP434J046, corresponding to a target binding site such as BINDING SITE I, BINDING SITE II or BINDING SITE III of FIG. 8. Table 4 illustrates the complementarity of the nucleotide sequences of DKFZP434J046 BINDING SITE, designated SEQ ID:12435, to the nucleotide sequence of GAM8554 RNA, herein designated GAM RNA, also designated SEQ ID:388.

Another function of GAM8554 is therefore inhibition of DKFZP434J046 (Accession NP_056486.1). Accordingly, utilities of GAM8554 include diagnosis, prevention and treatment of diseases and clinical conditions associated with DKFZP434J046.

DKFZP564O0423 (Accession XP_166254.2) is another GAM8554 target gene, herein designated TARGET GENE. DKFZP564O0423 BINDING SITE is a target binding site found in the 3' untranslated region of mRNA encoded by DKFZP564O0423, corresponding to a target binding site such as BINDING SITE I, BINDING SITE II or BINDING SITE III of FIG. 8. Table 4 illustrates the complementarity of the nucleotide sequences of DKFZP564O0423 BINDING SITE, designated SEQ ID:2580, to the nucleotide sequence of GAM8554 RNA, herein designated GAM RNA, also designated SEQ ID:388.

Another function of GAM8554 is therefore inhibition of DKFZP564O0423 (Accession XP_166254.2). Accordingly, utilities of GAM8554 include diagnosis, prevention and treatment of diseases and clinical conditions associated with DKFZP564O0423.

DKFZP566K1924 (Accession NP_056278.1) is another GAM8554 target gene, herein designated TARGET GENE. DKFZP566K1924 BINDING SITE is a target binding site found in the 3' untranslated region of mRNA encoded by DKFZP566K1924, corresponding to a target binding site such as BINDING SITE I, BINDING SITE II or BINDING SITE III of FIG. 8. Table 4 illustrates the complementarity of the nucleotide sequences of DKFZP566K1924 BINDING SITE, designated SEQ ID:2609, to the nucleotide sequence of GAM8554 RNA, herein designated GAM RNA, also designated SEQ ID:388.

Another function of GAM8554 is therefore inhibition of DKFZP566K1924 (Accession NP_056278.1). Accordingly, utilities of GAM8554 include diagnosis, prevention and treatment of diseases and clinical conditions associated with DKFZP566K1924.

DKFZP586I2223 (Accession NP_542768.1) is another GAM8554 target gene, herein designated TARGET GENE. DKFZP586I2223 BINDING SITE is a target binding site found in the 3' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:8692, to the nucleotide sequence of GAM8554 RNA, herein designated GAM RNA, also designated SEQ ID:388.

Another function of GAM8554 is therefore inhibition of DKFZP586I2223 (Accession NP_542768.1). Accordingly, utilities of GAM8554 include diagnosis, prevention and treatment of diseases and clinical conditions associated with DKFZP586I2223.

DKFZP586I2223 (Accession NP_542769.1) is another GAM8554 target gene, herein designated TARGET GENE. DKFZP586I2223 BINDING SITE is a target binding site found in the 3' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:8692, to the nucleotide sequence of GAM8554 RNA, herein designated GAM RNA, also designated SEQ ID:388.

Another function of GAM8554 is therefore inhibition of DKFZP586I2223 (Accession NP_542769.1). Accordingly, utilities of GAM8554 include diagnosis, prevention and treatment of diseases and clinical conditions associated with DKFZP586I2223.

DKFZP586I2223 (Accession NP_056253.2) is another GAM8554 target gene, herein designated TARGET GENE. DKFZP586I2223 BINDING SITE is a target binding site found in the 3' untranslated region of multiple transcripts of mRNA encoded by DKFZP586I2223, corresponding to a target binding site such as BINDING SITE I, BINDING SITE II or BINDING SITE III of FIG. 8. Table 4 illustrates the complementarity of the nucleotide sequences of DKFZP586I2223 BINDING SITE, designated SEQ ID:8692, to the nucleotide sequence of GAM8554 RNA, herein designated GAM RNA, also designated SEQ ID:388.

Another function of GAM8554 is therefore inhibition of DKFZP586I2223 (Accession NP_056253.2). Accordingly, utilities of GAM8554 include diagnosis, prevention and treatment of diseases and clinical conditions associated with DKFZP586I2223.

DKFZp761B107 (Accession NP_775734.1) is another GAM8554 target gene, herein designated TARGET GENE. DKFZp761B107 BINDING SITE is a target binding site found in the 3' untranslated region of mRNA encoded by DKFZp761B107, corresponding to a target binding site such as BINDING SITE I, BINDING SITE II or BINDING SITE III of FIG. 8. Table 4 illustrates the complementarity of the nucleotide sequences of DKFZp761B107 BINDING SITE, designated SEQ ID:11144, to the nucleotide sequence of GAM8554 RNA, herein designated GAM RNA, also designated SEQ ID:388.

Another function of GAM8554 is therefore inhibition of DKFZp761B107 (Accession NP_775734.1). Accordingly, utilities of GAM8554 include diagnosis, prevention and treatment of diseases and clinical conditions associated with DKFZp761B107.

DKFZp761O2018 (Accession XP_044062.3) is another GAM8554 target gene, herein designated TARGET GENE. DKFZp761O2018 BINDING SITE is a target binding site found in the 3' untranslated region of mRNA encoded by DKFZp761O2018, corresponding to a target binding site such as BINDING SITE I, BINDING SITE II or BINDING SITE III of FIG. 8. Table 4 illustrates the complementarity of the nucleotide sequences of DKFZp761O2018 BINDING SITE, designated SEQ ID:14901, to the nucleotide sequence of GAM8554 RNA, herein designated GAM RNA, also designated SEQ ID:388.

Another function of GAM8554 is therefore inhibition of DKFZp761O2018 (Accession XP_044062.3). Accordingly, utilities of GAM8554 include diagnosis, prevention and treatment of diseases and clinical conditions associated with DKFZp761O2018.

DKFZP762N2316 (Accession NP_067047.2) is another GAM8554 target gene, herein designated TARGET GENE. DKFZP762N2316 BINDING SITE is a target binding site found in the 3' untranslated region of multiple transcripts of mRNA encoded by DKFZP762N2316, corresponding to a target binding site such as BINDING SITE I, BINDING SITE II or BINDING SITE III of FIG. 8. Table 4 illustrates the complementarity of the nucleotide sequences of DKFZP762N2316 BINDING SITE, designated SEQ ID:19658, to the nucleotide sequence of GAM8554 RNA, herein designated GAM RNA, also designated SEQ ID:388.

Another function of GAM8554 is therefore inhibition of DKFZP762N2316 (Accession NP_067047.2). Accordingly, utilities of GAM8554 include diagnosis, prevention and treatment of diseases and clinical conditions associated with DKFZP762N2316.

Eukaryotic translation initiation factor 4 gamma, 1 (EIF4G1, Accession NP_004944.1) is another GAM8554 target gene, herein designated TARGET GENE. EIF4G1 BINDING SITE is a target binding site found in the 3' untranslated region of mRNA encoded by EIF4G1, corresponding to a target binding site such as BINDING SITE I, BINDING SITE II or BINDING SITE III of FIG. 8. Table 4 illustrates the complementarity of the nucleotide sequences of EIF4G1 BINDING SITE, designated SEQ ID:7541, to the nucleotide sequence of GAM8554 RNA, herein designated GAM RNA, also designated SEQ ID:388.

Another function of GAM8554 is therefore inhibition of Eukaryotic translation initiation factor 4 gamma, 1 (EIF4G1, Accession NP_004944.1), a gene which is a Translation initiation factor. Accordingly, utilities of GAM8554 include diagnosis, prevention and treatment of diseases and clinical conditions associated with EIF4G1.

The function of EIF4G1 and its association with various diseases and clinical conditions, has been established by previous studies, as described hereinabove with reference to GAM221.1. Ectonucleoside triphosphate diphosphohydrolase 6 (putative function) (ENTPD6, Accession NP_001238.1) is another GAM8554 target gene, herein designated TARGET GENE. ENTPD6 BINDING SITE is a target binding site found in the 5' untranslated region of mRNA encoded by ENTPD6, corresponding to a target binding site such as BINDING SITE I, BINDING SITE II or BINDING SITE III of FIG. 8. Table 4 illustrates the complementarity of the nucleotide sequences of ENTPD6 BINDING SITE, designated SEQ ID:12576, to the nucleotide sequence of GAM8554 RNA, herein designated GAM RNA, also designated SEQ ID:388.

Another function of GAM8554 is therefore inhibition of Ectonucleoside triphosphate diphosphohydrolase 6 (putative function) (ENTPD6, Accession NP_001238.1), a gene which might support glycosylation reactions in the golgi apparatus and, when released from cells, might catalyze the hydrolysis of extracellular nucleotides. Accordingly, utilities of GAM8554 include diagnosis, prevention and treatment of diseases and clinical conditions associated with ENTPD6.

The function of ENTPD6 and its association with various diseases and clinical conditions, has been established by previous studies, as described hereinabove with reference to GAM65.2. ERK8 (Accession NP_620590.1) is another GAM8554 target gene, herein designated TARGET GENE. ERK8 BINDING SITE is a target binding site found in the 3' untranslated region of mRNA encoded by ERK8, corresponding to a target binding site such as BINDING SITE I, BINDING SITE II or BINDING SITE III of FIG. 8. Table 4 illustrates the complementarity of the nucleotide sequences of ERK8 BINDING SITE, designated SEQ ID:15517, to the nucleotide sequence of GAM8554 RNA, herein designated GAM RNA, also designated SEQ ID:388.

Another function of GAM8554 is therefore inhibition of ERK8 (Accession NP_620590.1). Accordingly, utilities of GAM8554 include diagnosis, prevention and treatment of diseases and clinical conditions associated with ERK8.

Ecotropic viral integration site 5 (EVI5, Accession NP_005656.2) is another GAM8554 target gene, herein designated TARGET GENE. EVI5 BINDING SITE is a target binding site found in the 3' untranslated region of mRNA encoded by EVI5, corresponding to a target binding site such as BINDING SITE I, BINDING SITE II or BINDING SITE III of FIG. 8. Table 4 illustrates the complementarity of the nucleotide sequences of EVI5 BINDING SITE, designated SEQ ID:5538, to the nucleotide sequence of GAM8554 RNA, herein designated GAM RNA, also designated SEQ ID:388.

Another function of GAM8554 is therefore inhibition of Ecotropic viral integration site 5 (EVI5, Accession NP_005656.2). Accordingly, utilities of GAM8554 include diagnosis, prevention and treatment of diseases and clinical conditions associated with EVI5.

Family with sequence similarity 10, member a3 (FAM10A3, Accession XP_015334.4) is another GAM8554 target gene, herein designated TARGET GENE. FAM10A3 BINDING SITE is a target binding site found in the 5' untranslated region of mRNA encoded by FAM10A3, corresponding to a target binding site such as BINDING SITE I, BINDING SITE II or BINDING SITE III of FIG. 8. Table 4 illustrates the complementarity of the nucleotide sequences of FAM10A3 BINDING SITE, designated SEQ ID:874, to the nucleotide sequence of GAM8554 RNA, herein designated GAM RNA, also designated SEQ ID:388.

Another function of GAM8554 is therefore inhibition of Family with sequence similarity 10, member a3 (FAM10A3, Accession XP_015334.4). Accordingly, utilities of GAM8554 include diagnosis, prevention and treatment of diseases and clinical conditions associated with FAM10A3.

FBXO16 (Accession NP_758954.1) is another GAM8554 target gene, herein designated TARGET GENE. FBXO16 BINDING SITE is a target binding site found in the 3' untranslated region of mRNA encoded by FBXO16, corresponding to a target binding site such as BINDING SITE I, BINDING SITE II or BINDING SITE III of FIG. 8. Table 4 illustrates the complementarity of the nucleotide sequences of FBXO16 BINDING SITE, designated SEQ ID:9967, to the nucleotide sequence of GAM8554 RNA, herein designated GAM RNA, also designated SEQ ID:388.

Another function of GAM8554 is therefore inhibition of FBXO16 (Accession NP_758954.1). Accordingly, utilities of GAM8554 include diagnosis, prevention and treatment of diseases and clinical conditions associated with FBXO16.

FLJ00007 (Accession NP_258260.1) is another GAM8554 target gene, herein designated TARGET GENE. FLJ00007 BINDING SITE is a target binding site found in the 3' untranslated region of mRNA encoded by FLJ00007, corresponding to a target binding site such as BINDING SITE I, BINDING SITE II or BINDING SITE III of FIG. 8. Table 4 illustrates the complementarity of the nucleotide sequences of FLJ00007 BINDING SITE, designated SEQ ID:4850, to the nucleotide sequence of GAM8554 RNA, herein designated GAM RNA, also designated SEQ ID:388.

Another function of GAM8554 is therefore inhibition of FLJ00007 (Accession NP_258260.1). Accordingly, utilities of GAM8554 include diagnosis, prevention and treatment of diseases and clinical conditions associated with FLJ00007.

FLJ11301 (Accession NP_060855.1) is another GAM8554 target gene, herein designated TARGET GENE. FLJ11301 BINDING SITE is a target binding site found in the 3' untranslated region of mRNA encoded by FLJ11301, corresponding to a target binding site such as BINDING SITE I, BINDING SITE II or BINDING SITE III of FIG. 8. Table 4 illustrates the complementarity of the nucleotide sequences of FLJ11301 BINDING SITE, designated SEQ ID:18187, to the nucleotide sequence of GAM8554 RNA, herein designated GAM RNA, also designated SEQ ID:388.

Another function of GAM8554 is therefore inhibition of FLJ11301 (Accession NP_060855.1). Accordingly, utilities of GAM8554 include diagnosis, prevention and treatment of diseases and clinical conditions associated with FLJ11301.

FLJ12895 (Accession NP_076415.2) is another GAM8554 target gene, herein designated TARGET GENE. FLJ12895 BINDING SITE is a target binding site found in the 5' untranslated region of mRNA encoded by FLJ12895, corresponding to a target binding site such as BINDING SITE I, BINDING SITE II or BINDING SITE III of FIG. 8. Table 4 illustrates the complementarity of the nucleotide sequences of FLJ12895 BINDING SITE, designated SEQ ID:18925, to the nucleotide sequence of GAM8554 RNA, herein designated GAM RNA, also designated SEQ ID:388.

Another function of GAM8554 is therefore inhibition of FLJ12895 (Accession NP_076415.2). Accordingly, utilities of GAM8554 include diagnosis, prevention and treatment of diseases and clinical conditions associated with FLJ12895.

FLJ12960 (Accession NP_078914.1) is another GAM8554 target gene, herein designated TARGET GENE. FLJ12960 BINDING SITE is a target binding site found in the 3' untranslated region of mRNA encoded by FLJ12960, corresponding to a target binding site such as BINDING SITE I, BINDING SITE II or BINDING SITE III of FIG. 8. Table 4 illustrates the complementarity of the nucleotide sequences of FLJ12960 BINDING SITE, designated SEQ ID:13088, to the nucleotide sequence of GAM8554 RNA, herein designated GAM RNA, also designated SEQ ID:388.

Another function of GAM8554 is therefore inhibition of FLJ12960 (Accession NP_078914.1). Accordingly, utilities of GAM8554 include diagnosis, prevention and treatment of diseases and clinical conditions associated with FLJ12960.

FLJ20707 (Accession NP_060406.1) is another GAM8554 target gene, herein designated TARGET GENE. FLJ20707 BINDING SITE is a target binding site found in the 3' untranslated region of multiple transcripts of mRNA encoded by FLJ20707, corresponding to a target binding site such as BINDING SITE I, BINDING SITE II or BINDING SITE III of FIG. 8. Table 4 illustrates the complementarity of the nucleotide sequences of FLJ20707 BINDING SITE, designated SEQ ID:16918, to the nucleotide sequence of GAM8554 RNA, herein designated GAM RNA, also designated SEQ ID:388.

Another function of GAM8554 is therefore inhibition of FLJ20707 (Accession NP_060406.1). Accordingly, utilities of GAM8554 include diagnosis, prevention and treatment of diseases and clinical conditions associated with FLJ20707.

FLJ20898 (Accession NP_078876.1) is another GAM8554 target gene, herein designated TARGET GENE. FLJ20898 BINDING SITE is a target binding site found in the 5' untranslated region of mRNA encoded by FLJ20898, corresponding to a target binding site such as BINDING SITE I, BINDING SITE II or BINDING SITE III of FIG. 8. Table 4 illustrates the complementarity of the nucleotide sequences of FLJ20898 BINDING SITE, designated SEQ ID:12410, to the nucleotide sequence of GAM8554 RNA, herein designated GAM RNA, also designated SEQ ID:388.

Another function of GAM8554 is therefore inhibition of FLJ20898 (Accession NP_078876.1). Accordingly, utilities of GAM8554 include diagnosis, prevention and treatment of diseases and clinical conditions associated with FLJ20898.

FLJ22944 (Accession NP_079421.2) is another GAM8554 target gene, herein designated TARGET GENE. FLJ22944 BINDING SITE is a target binding site found in the 5' untranslated region of mRNA encoded by FLJ22944, corresponding to a target binding site such as BINDING SITE I, BINDING SITE II or BINDING SITE III of FIG. 8. Table 4 illustrates the complementarity of the nucleotide sequences of FLJ22944 BINDING SITE, designated SEQ ID:10158, to the nucleotide sequence of GAM8554 RNA, herein designated GAM RNA, also designated SEQ ID:388.

Another function of GAM8554 is therefore inhibition of FLJ22944 (Accession NP_079421.2). Accordingly, utilities of GAM8554 include diagnosis, prevention and treatment of diseases and clinical conditions associated with FLJ22944.

FLJ23867 (Accession NP_689875.1) is another GAM8554 target gene, herein designated TARGET GENE. FLJ23867 BINDING SITE is a target binding site found in the 3' untranslated region of mRNA encoded by FLJ23867, corresponding to a target binding site such as BINDING SITE I, BINDING SITE II or BINDING SITE III of FIG. 8. Table 4 illustrates the complementarity of the nucleotide sequences of FLJ23867 BINDING SITE, designated SEQ ID:13980, to the nucleotide sequence of GAM8554 RNA, herein designated GAM RNA, also designated SEQ ID:388.

Another function of GAM8554 is therefore inhibition of FLJ23867 (Accession NP_689875.1). Accordingly, utilities of GAM8554 include diagnosis, prevention and treatment of diseases and clinical conditions associated with FLJ23867.

FLJ25756 (Accession NP_776175.1) is another GAM8554 target gene, herein designated TARGET GENE. FLJ25756 BINDING SITE is a target binding site found in the 5' untranslated region of mRNA encoded by FLJ25756, corresponding to a target binding site such as BINDING SITE I, BINDING SITE II or BINDING SITE III of FIG. 8. Table 4 illustrates the complementarity of the nucleotide sequences of FLJ25756 BINDING SITE, designated SEQ ID:3815, to the nucleotide sequence of GAM8554 RNA, herein designated GAM RNA, also designated SEQ ID:388.

Another function of GAM8554 is therefore inhibition of FLJ25756 (Accession NP_776175.1). Accordingly, utilities of GAM8554 include diagnosis, prevention and treatment of diseases and clinical conditions associated with FLJ25756.

FLJ30934 (Accession NP_689973.1) is another GAM8554 target gene, herein designated TARGET GENE. FLJ30934 BINDING SITE is a target binding site found in the 3' untranslated region of mRNA encoded by FLJ30934, corresponding to a target binding site such as BINDING SITE I, BINDING SITE II or BINDING SITE III of FIG. 8. Table 4 illustrates the complementarity of the nucleotide sequences of FLJ30934 BINDING SITE, designated SEQ ID:13660, to the nucleotide sequence of GAM8554 RNA, herein designated GAM RNA, also designated SEQ ID:388.

Another function of GAM8554 is therefore inhibition of FLJ30934 (Accession NP_689973.1). Accordingly, utilities of GAM8554 include diagnosis, prevention and treatment of diseases and clinical conditions associated with FLJ30934.

FLJ31166 (Accession NP_694567.1) is another GAM8554 target gene, herein designated TARGET GENE. FLJ31166 BINDING SITE is a target binding site found in the 3' untranslated region of mRNA encoded by FLJ31166, corresponding to a target binding site such as BINDING SITE I, BINDING SITE II or BINDING SITE III of FIG. 8. Table 4 illustrates the complementarity of the nucleotide sequences of FLJ31166 BINDING SITE, designated SEQ ID:17040, to the nucleotide sequence of GAM8554 RNA, herein designated GAM RNA, also designated SEQ ID:388.

Another function of GAM8554 is therefore inhibition of FLJ31166 (Accession NP_694567.1). Accordingly, utilities of GAM8554 include diagnosis, prevention and treatment of diseases and clinical conditions associated with FLJ31166.

FLJ31318 (Accession NP_689499.1) is another GAM8554 target gene, herein designated TARGET GENE. FLJ31318 BINDING SITE is a target binding site found in the 3' untranslated region of mRNA encoded by FLJ31318, corresponding to a target binding site such as BINDING SITE I, BINDING SITE II or BINDING SITE III of FIG. 8. Table 4 illustrates the complementarity of the nucleotide sequences of FLJ31318 BINDING SITE, designated SEQ ID:10740, to the nucleotide sequence of GAM8554 RNA, herein designated GAM RNA, also designated SEQ ID:388.

Another function of GAM8554 is therefore inhibition of FLJ31318 (Accession NP_689499.1). Accordingly, utilities of GAM8554 include diagnosis, prevention and treatment of diseases and clinical conditions associated with FLJ31318.

FLJ32825 (Accession NP_689705.1) is another GAM8554 target gene, herein designated TARGET GENE. FLJ32825 BINDING SITE is a target binding site found in the 5' untranslated region of mRNA encoded by FLJ32825, corresponding to a target binding site such as BINDING SITE I, BINDING SITE II or BINDING SITE III of FIG. 8. Table 4 illustrates the complementarity of the nucleotide sequences of FLJ32825 BINDING SITE, designated SEQ ID:11776, to the nucleotide sequence of GAM8554 RNA, herein designated GAM RNA, also designated SEQ ID:388.

Another function of GAM8554 is therefore inhibition of FLJ32825 (Accession NP_689705.1). Accordingly, utilities of GAM8554 include diagnosis, prevention and treatment of diseases and clinical conditions associated with FLJ32825.

FLJ35936 (Accession NP_775735.1) is another GAM8554 target gene, herein designated TARGET GENE. FLJ35936 BINDING SITE is a target binding site found in the 3' untranslated region of mRNA encoded by FLJ35936, corresponding to a target binding site such as BINDING SITE I, BINDING SITE II or BINDING SITE III of FIG. 8. Table 4 illustrates the complementarity of the nucleotide sequences of FLJ35936 BINDING SITE, designated SEQ ID:1674, to the nucleotide sequence of GAM8554 RNA, herein designated GAM RNA, also designated SEQ ID:388.

Another function of GAM8554 is therefore inhibition of FLJ35936 (Accession NP_775735.1). Accordingly, utilities of GAM8554 include diagnosis, prevention and treatment of diseases and clinical conditions associated with FLJ35936.

FLJ38499 (Accession NP_776158.1) is another GAM8554 target gene, herein designated TARGET GENE. FLJ38499 BINDING SITE is a target binding site found in the 3' untranslated region of mRNA encoded by FLJ38499, corresponding to a target binding site such as BINDING SITE I, BINDING SITE II or BINDING SITE III of FIG. 8. Table 4 illustrates the complementarity of the nucleotide sequences of FLJ38499 BINDING SITE, designated SEQ ID:16881, to the nucleotide sequence of GAM8554 RNA, herein designated GAM RNA, also designated SEQ ID:388.

Another function of GAM8554 is therefore inhibition of FLJ38499 (Accession NP_776158.1). Accordingly, utilities of GAM8554 include diagnosis, prevention and treatment of diseases and clinical conditions associated with FLJ38499.

FLJ39106 (Accession NP_775900.1) is another GAM8554 target gene, herein designated TARGET GENE. FLJ39106 BINDING SITE is a target binding site found in the 3' untranslated region of mRNA encoded by FLJ39106, corresponding to a target binding site such as BINDING SITE I, BINDING SITE II or BINDING SITE III of FIG. 8. Table 4 illustrates the complementarity of the nucleotide sequences of FLJ39106 BINDING SITE, designated SEQ ID:8062, to the nucleotide sequence of GAM8554 RNA, herein designated GAM RNA, also designated SEQ ID:388.

Another function of GAM8554 is therefore inhibition of FLJ39106 (Accession NP_775900.1). Accordingly, utilities of GAM8554 include diagnosis, prevention and treatment of diseases and clinical conditions associated with FLJ39106.

FLJ40852 (Accession NP_775948.1) is another GAM8554 target gene, herein designated TARGET GENE. FLJ40852 BINDING SITE is a target binding site found in the 3' untranslated region of mRNA encoded by FLJ40852, corresponding to a target binding site such as BINDING SITE I, BINDING SITE II or BINDING SITE III of FIG. 8. Table 4 illustrates the complementarity of the nucleotide sequences of FLJ40852 BINDING SITE, designated SEQ ID:1720, to the nucleotide sequence of GAM8554 RNA, herein designated GAM RNA, also designated SEQ ID:388.

Another function of GAM8554 is therefore inhibition of FLJ40852 (Accession NP_775948.1). Accordingly, utilities of GAM8554 include diagnosis, prevention and treatment of diseases and clinical conditions associated with FLJ40852.

Forkhead box d4 (FOXD4, Accession XP_095746.6) is another GAM8554 target gene, herein designated TARGET GENE. FOXD4 BINDING SITE is a target binding site found in the 5' untranslated region of mRNA encoded by FOXD4, corresponding to a target binding site such as BINDING SITE I, BINDING SITE II or BINDING SITE III of FIG. 8. Table 4 illustrates the complementarity of the nucleotide sequences of FOXD4 BINDING SITE, designated SEQ ID:10798, to the nucleotide sequence of GAM8554 RNA, herein designated GAM RNA, also designated SEQ ID:388.

Another function of GAM8554 is therefore inhibition of Forkhead box d4 (FOXD4, Accession XP_095746.6). Accordingly, utilities of GAM8554 include diagnosis, prevention and treatment of diseases and clinical conditions associated with FOXD4.

FOXD4L1 (Accession NP_036316.1) is another GAM8554 target gene, herein designated TARGET GENE. FOXD4L1 BINDING SITE is a target binding site found in the 5' untranslated region of mRNA encoded by FOXD4L1, corresponding to a target binding site such as BINDING SITE I, BINDING SITE II or BINDING SITE III of FIG. 8. Table 4 illustrates the complementarity of the nucleotide sequences of FOXD4L1 BINDING SITE, designated SEQ ID:14436, to the nucleotide sequence of GAM8554 RNA, herein designated GAM RNA, also designated SEQ ID:388.

Another function of GAM8554 is therefore inhibition of FOXD4L1 (Accession NP_036316.1). Accordingly, utilities of GAM8554 include diagnosis, prevention and treatment of diseases and clinical conditions associated with FOXD4L1.

FUK (Accession NP_659496.1) is another GAM8554 target gene, herein designated TARGET GENE. FUK BINDING SITE is a target binding site found in the 3' untranslated region of mRNA encoded by FUK, corresponding to a target binding site such as BINDING SITE I, BINDING SITE II or BINDING SITE III of FIG. 8. Table 4 illustrates the complementarity of the nucleotide sequences of FUK BINDING SITE, designated SEQ ID:16844, to the nucleotide sequence of GAM8554 RNA, herein designated GAM RNA, also designated SEQ ID:388.

Another function of GAM8554 is therefore inhibition of FUK (Accession NP_659496.1). Accordingly, utilities of GAM8554 include diagnosis, prevention and treatment of diseases and clinical conditions associated with FUK.

Fucosyltransferase 3 (galactoside 3(4)-l-fucosyltransferase, lewis blood group included) (FUT3, Accession NP_000140.1) is another GAM8554 target gene, herein designated TARGET GENE. FUT3 BINDING SITE is a target binding site found in the 3' untranslated region of mRNA encoded by FUT3, corresponding to a target binding site such as BINDING SITE I, BINDING SITE II or BINDING SITE III of FIG. 8. Table 4 illustrates the complementarity of the nucleotide sequences of FUT3 BINDING SITE, designated SEQ ID:2915, to the nucleotide sequence of GAM8554 RNA, herein designated GAM RNA, also designated SEQ ID:388.

Another function of GAM8554 is therefore inhibition of Fucosyltransferase 3 (galactoside 3(4)-l-fucosyltransferase, lewis blood group included) (FUT3, Accession NP_000140.1), a gene which may catalyze alpha-1,3 and alpha-1,4 glycosidic linkages involved in the expression of vim-2, lewis a, lewis b, sialyl lewis x and lewis x/ssea-1 antigens. and therefore may be associated with Lewis-negative disease. Accordingly, utilities of GAM8554 include diagnosis, prevention and treatment of Lewis- negative disease, and of other diseases and clinical conditions associated with FUT3.

The function of FUT3 and its association with various diseases and clinical conditions, has been established by previous studies, as described hereinabove with reference to GAM180.1. Fucosyltransferase 5 (alpha (1,3) fucosyltransferase) (FUT5, Accession NP_002025.1) is another GAM8554 target gene, herein designated TARGET GENE. FUT5 BINDING SITE is a target binding site found in the 3' untranslated region of mRNA encoded by FUT5, corresponding to a target binding site such as BINDING SITE I, BINDING SITE II or BINDING SITE III of FIG. 8. Table 4 illustrates the complementarity of the nucleotide sequences of FUT5 BINDING SITE, designated SEQ ID:2915, to the nucleotide sequence of GAM8554 RNA, herein designated GAM RNA, also designated SEQ ID:388.

Another function of GAM8554 is therefore inhibition of Fucosyltransferase 5 (alpha (1,3) fucosyltransferase) (FUT5, Accession NP_002025.1), a gene which may catalyse alpha-1,3 glycosidic linkages involved in the expression of vim-2, lewis x/ssea-1 and sialyl lewis x antigens. Accordingly, utilities of GAM8554 include diagnosis, prevention and treatment of diseases and clinical conditions associated with FUT5.

The function of FUT5 and its association with various diseases and clinical conditions, has been established by previous studies, as described hereinabove with reference to GAM180.1. Fucosyltransferase 6 (alpha (1,3) fucosyltransferase) (FUT6, Accession NP_000141.1) is another GAM8554 target gene, herein designated TARGET GENE. FUT6 BINDING SITE is a target binding site found in the 3' untranslated region of mRNA encoded by FUT6, corresponding to a target binding site such as BINDING SITE I, BINDING SITE II or BINDING SITE III of FIG. 8. Table 4 illustrates the complementarity of the nucleotide sequences of FUT6 BINDING SITE, designated SEQ ID:7499, to the nucleotide sequence of GAM8554 RNA, herein designated GAM RNA, also designated SEQ ID:388.

Another function of GAM8554 is therefore inhibition of Fucosyltransferase 6 (alpha (1,3) fucosyltransferase) (FUT6, Accession NP_000141.1), a gene which is involved in the biosynthesis of the e-selectin ligand, sialyl-lewis x. catalyzes the transfer of fucose from gdp-beta-fucose to alpha-2,3 sialylated substrates. Accordingly, utilities of GAM8554 include diagnosis, prevention and treatment of diseases and clinical conditions associated with FUT6.

The function of FUT6 and its association with various diseases and clinical conditions, has been established by previous studies, as described hereinabove with reference to GAM47.1. Fucosyltransferase 9 (alpha (1,3) fucosyltransferase) (FUT9, Accession NP_006572.1) is another GAM8554 target gene, herein designated TARGET GENE. FUT9 BINDING SITE is a target binding site found in the 5' untranslated region of mRNA encoded by FUT9, corresponding to a target binding site such as BINDING SITE I, BINDING SITE II or BINDING SITE III of FIG. 8. Table 4 illustrates the complementarity of the nucleotide sequences of FUT9 BINDING SITE, designated SEQ ID:16065, to the nucleotide sequence of GAM8554 RNA, herein designated GAM RNA, also designated SEQ ID:388.

Another function of GAM8554 is therefore inhibition of Fucosyltransferase 9 (alpha (1,3) fucosyltransferase) (FUT9, Accession NP_006572.1), a gene which catalyzes alpha-1,3 glycosidic linkages. Accordingly, utilities of GAM8554 include diagnosis, prevention and treatment of diseases and clinical conditions associated with FUT9.

The function of FUT9 and its association with various diseases and clinical conditions, has been established by previous studies, as described hereinabove with reference to GAM31.1. Grb2-associated binding protein 2 (GAB2, Accession NP_036428.1) is another GAM8554 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:7231, to the nucleotide sequence of GAM8554 RNA, herein designated GAM RNA, also designated SEQ ID:388.

Another function of GAM8554 is therefore inhibition of Grb2-associated binding protein 2 (GAB2, Accession NP_036428.1), a gene which act as adapters for transmitting various signals. Accordingly, utilities of GAM8554 include diagnosis, prevention and treatment of diseases and clinical conditions associated with GAB2.

The function of GAB2 and its association with various diseases and clinical conditions, has been established by previous studies, as described hereinabove with reference to GAM63.1. Grb2-associated binding protein 2 (GAB2, Accession NP_536739.1) is another GAM8554 target gene, herein designated TARGET GENE. GAB2 BINDING SITE is a target binding site found in the 3' untranslated region of multiple transcripts of mRNA encoded by GAB2, corresponding to a target binding site such as BINDING SITE I, BINDING SITE II or BINDING SITE III of FIG. 8. Table 4 illustrates the complementarity of the nucleotide sequences of GAB2 BINDING SITE, designated SEQ ID:7231, to the nucleotide sequence of GAM8554 RNA, herein designated GAM RNA, also designated SEQ ID:388.

Another function of GAM8554 is therefore inhibition of Grb2-associated binding protein 2 (GAB2, Accession NP_536739.1), a gene which act as adapters for transmitting various signals. Accordingly, utilities of GAM8554 include diagnosis, prevention and treatment of diseases and clinical conditions associated with GAB2.

The function of GAB2 and its association with various diseases and clinical conditions, has been established by previous studies, as described hereinabove with reference to GAM63.1. Growth arrest-specific 7 (GAS7, Accession NP_005881.1) is another GAM8554 target gene, herein designated TARGET GENE. GAS7 BINDING SITE is a target binding site found in the 3' untranslated region of multiple transcripts of mRNA encoded by GAS7, corresponding to a target binding site such as BINDING SITE I, BINDING SITE II or BINDING SITE III of FIG. 8. Table 4 illustrates the complementarity of the nucleotide sequences of GAS7 BINDING SITE, designated SEQ ID:19750, to the nucleotide sequence of GAM8554 RNA, herein designated GAM RNA, also designated SEQ ID:388.

Another function of GAM8554 is therefore inhibition of Growth arrest-specific 7 (GAS7, Accession NP_005881.1), a gene which may play a role in promoting maturation and morphological differentiation of cerebellar neurons. and therefore may be associated with Leukemias with myeloid/lymphoid (mll). Accordingly, utilities of GAM8554 include diagnosis, prevention and treatment of Leukemias with myeloid/lymphoid (mll), and of other diseases and clinical conditions associated with GAS7.

The function of GAS7 and its association with various diseases and clinical conditions, has been established by previous studies, as described hereinabove with reference to GAM72.1. Growth arrest-specific 7 (GAS7, Accession NP_003635.1) is another GAM8554 target gene, herein designated TARGET GENE. GAS7 BINDING SITE is a target binding site found in the 3' untranslated region of multiple transcripts of mRNA encoded by GAS7, corresponding to a target binding site such as BINDING SITE I, BINDING SITE II or BINDING SITE III of FIG. 8. Table 4 illustrates the complementarity of the nucleotide sequences of GAS7 BINDING SITE, designated SEQ ID:19750, to the nucleotide sequence of GAM8554 RNA, herein designated GAM RNA, also designated SEQ ID:388.

Another function of GAM8554 is therefore inhibition of Growth arrest-specific 7 (GAS7, Accession NP_003635.1), a gene which may play a role in promoting maturation and morphological differentiation of cerebellar neurons. and therefore may be associated with Leukemias with myeloid/lymphoid (mll). Accordingly, utilities of GAM8554 include diagnosis, prevention and treatment of Leukemias with myeloid/lymphoid (mll), and of other diseases and clinical conditions associated with GAS7.

The function of GAS7 and its association with various diseases and clinical conditions, has been established by previous studies, as described hereinabove with reference to GAM72.1. Golgi autoantigen, golgin subfamily a, 1 (GOLGA1, Accession NP_002068.1) is another GAM8554 target gene, herein designated TARGET GENE. GOLGA1 BINDING SITE is a target binding site found in the 3' untranslated region of mRNA encoded by GOLGA1, corresponding to a target binding site such as BINDING SITE I, BINDING SITE II or BINDING SITE III of FIG. 8. Table 4 illustrates the complementarity of the nucleotide sequences of GOLGA1 BINDING SITE, designated SEQ ID:5615, to the nucleotide sequence of GAM8554 RNA, herein designated GAM RNA, also designated SEQ ID:388.

Another function of GAM8554 is therefore inhibition of Golgi autoantigen, golgin subfamily a, 1 (GOLGA1, Accession NP_002068.1) . Accordingly, utilities of GAM8554 include diagnosis, prevention and treatment of diseases and clinical conditions associated with GOLGA1.

Glutamate receptor, ionotropic, n-methyl d-aspartate 2b (GRIN2B, Accession NP_000825.1) is another GAM8554 target gene, herein designated TARGET GENE. GRIN2B BINDING SITE is a target binding site found in the 3' untranslated region of mRNA encoded by GRIN2B, corresponding to a target binding site such as BINDING SITE I, BINDING SITE II or BINDING SITE III of FIG. 8. Table 4 illustrates the complementarity of the nucleotide sequences of GRIN2B BINDING SITE, designated SEQ ID:10992, to the nucleotide sequence of GAM8554 RNA, herein designated GAM RNA, also designated SEQ ID:388.

Another function of GAM8554 is therefore inhibition of Glutamate receptor, ionotropic, n-methyl d-aspartate 2b (GRIN2B, Accession NP_000825.1). Accordingly, utilities of GAM8554 include diagnosis, prevention and treatment of diseases and clinical conditions associated with GRIN2B.

G1 to s phase transition 2 (GSPT2, Accession NP_060564.1) is another GAM8554 target gene, herein designated TARGET GENE. GSPT2 BINDING SITE is a target binding site found in the 3' untranslated region of mRNA encoded by GSPT2, corresponding to a target binding site such as BINDING SITE I, BINDING SITE II or BINDING SITE III of FIG. 8. Table 4 illustrates the complementarity of the nucleotide sequences of GSPT2 BINDING SITE, designated SEQ ID:8094, to the nucleotide sequence of GAM8554 RNA, herein designated GAM RNA, also designated SEQ ID:388.

Another function of GAM8554 is therefore inhibition of G1 to s phase transition 2 (GSPT2, Accession NP_060564.1). Accordingly, utilities of GAM8554 include diagnosis, prevention and treatment of diseases and clinical conditions associated with GSPT2.

Hepatoma-derived growth factor (high-mobility group protein 1-like) (HDGF, Accession NP_004485.1) is another GAM8554 target gene, herein designated TARGET GENE. HDGF BINDING SITE is a target binding site found in the 3' untranslated region of mRNA encoded by HDGF, corresponding to a target binding site such as BINDING SITE I, BINDING SITE II or BINDING SITE III of FIG. 8. Table 4 illustrates the complementarity of the nucleotide sequences of HDGF BINDING SITE, designated SEQ ID:2702, to the nucleotide sequence of GAM8554 RNA, herein designated GAM RNA, also designated SEQ ID:388.

Another function of GAM8554 is therefore inhibition of Hepatoma-derived growth factor (high-mobility group protein 1-like) (HDGF, Accession NP_004485.1), a gene which is a heparin-binding protein, with mitogenic activity for fibroblasts. Accordingly, utilities of GAM8554 include diagnosis, prevention and treatment of diseases and clinical conditions associated with HDGF.

The function of HDGF and its association with various diseases and clinical conditions, has been established by previous studies, as described hereinabove with reference to GAM204.2. HELSNF1 (Accession XP_033511.7) is another GAM8554 target gene, herein designated TARGET GENE. HELSNF1 BINDING SITE is a target binding site found in the 3' untranslated region of mRNA encoded by HELSNF1, corresponding to a target binding site such as BINDING SITE I, BINDING SITE II or BINDING SITE III of FIG. 8. Table 4 illustrates the complementarity of the nucleotide sequences of HELSNF1 BINDING SITE, designated SEQ ID:18562, to the nucleotide sequence of GAM8554 RNA, herein designated GAM RNA, also designated SEQ ID:388.

Another function of GAM8554 is therefore inhibition of HELSNF1 (Accession XP_033511.7). Accordingly, utilities of GAM8554 include diagnosis, prevention and treatment of diseases and clinical conditions associated with HELSNF1.

HEMK (Accession NP_057257.1) is another GAM8554 target gene, herein designated TARGET GENE. HEMK BINDING SITE is a target binding site found in the 3' untranslated region of mRNA encoded by HEMK, corresponding to a target binding site such as BINDING SITE I, BINDING SITE II or BINDING SITE III of FIG. 8. Table 4 illustrates the complementarity of the nucleotide sequences of HEMK BINDING SITE, designated SEQ ID:15386, to the nucleotide sequence of GAM8554 RNA, herein designated GAM RNA, also designated SEQ ID:388.

Another function of GAM8554 is therefore inhibition of HEMK (Accession NP_057257.1). Accordingly, utilities of GAM8554 include diagnosis, prevention and treatment of diseases and clinical conditions associated with HEMK.

High mobility group at-hook 1 (HMGA1, Accession NP_665909.1) is another GAM8554 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:13844, to the nucleotide sequence of GAM8554 RNA, herein designated GAM RNA, also designated SEQ ID:388.

Another function of GAM8554 is therefore inhibition of High mobility group at-hook 1 (HMGA1, Accession NP_665909.1), a gene which orchestrates the assembly of a virus-induced enhanceosome by mediating a network of protein-DNA and protein-protein interactions. Accordingly, utilities of GAM8554 include diagnosis, prevention and treatment of diseases and clinical conditions associated with HMGA1.

The function of HMGA1 and its association with various diseases and clinical conditions, has been established by previous studies, as described hereinabove with reference to GAM139.1. High mobility group at-hook 1 (HMGA1, Accession NP_002122.1) is another GAM8554 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:13844, to the nucleotide sequence of GAM8554 RNA, herein designated GAM RNA, also designated SEQ ID:388.

Another function of GAM8554 is therefore inhibition of High mobility group at-hook 1 (HMGA1, Accession NP_002122.1), a gene which orchestrates the assembly of a virus-induced enhanceosome by mediating a network of protein-DNA and protein-protein interactions. Accordingly, utilities of GAM8554 include diagnosis, prevention and treatment of diseases and clinical conditions associated with HMGA1.

The function of HMGA1 and its association with various diseases and clinical conditions, has been established by previous studies, as described hereinabove with reference to GAM139.1. High mobility group at-hook 1 (HMGA1, Accession NP_665912.1) is another GAM8554 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:13844, to the nucleotide sequence of GAM8554 RNA, herein designated GAM RNA, also designated SEQ ID:388.

Another function of GAM8554 is therefore inhibition of High mobility group at-hook 1 (HMGA1, Accession NP_665912.1), a gene which orchestrates the assembly of a virus-induced enhanceosome by mediating a network of protein-DNA and protein-protein interactions. Accordingly, utilities of GAM8554 include diagnosis, prevention and treatment of diseases and clinical conditions associated with HMGA1.

The function of HMGA1 and its association with various diseases and clinical conditions, has been established by previous studies, as described hereinabove with reference to GAM139.1. High mobility group at-hook 1 (HMGA1, Accession NP_665906.1) is another GAM8554 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:13844, to the nucleotide sequence of GAM8554 RNA, herein designated GAM RNA, also designated SEQ ID:388.

Another function of GAM8554 is therefore inhibition of High mobility group at-hook 1 (HMGA1, Accession NP_665906.1), a gene which orchestrates the assembly of a virus-induced enhanceosome by mediating a network of protein-DNA and protein-protein interactions. Accordingly, utilities of GAM8554 include diagnosis, prevention and treatment of diseases and clinical conditions associated with HMGA1.

The function of HMGA1 and its association with various diseases and clinical conditions, has been established by previous studies, as described hereinabove with reference to GAM139.1. High mobility group at-hook 1 (HMGA1, Accession NP_665911.1) is another GAM8554 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:13844, to the nucleotide sequence of GAM8554 RNA, herein designated GAM RNA, also designated SEQ ID:388.

Another function of GAM8554 is therefore inhibition of High mobility group at-hook 1 (HMGA1, Accession NP_665911.1), a gene which orchestrates the assembly of a virus-induced enhanceosome by mediating a network of protein-DNA and protein-protein interactions. Accordingly, utilities of GAM8554 include diagnosis, prevention and treatment of diseases and clinical conditions associated with HMGA1.

The function of HMGA1 and its association with various diseases and clinical conditions, has been established by previous studies, as described hereinabove with reference to GAM139.1. High mobility group at-hook 1 (HMGA1, Accession NP_665910.1) is another GAM8554 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:13844, to the nucleotide sequence of GAM8554 RNA, herein designated GAM RNA, also designated SEQ ID:388.

Another function of GAM8554 is therefore inhibition of High mobility group at-hook 1 (HMGA1, Accession NP_665910.1), a gene which orchestrates the assembly of a virus-induced enhanceosome by mediating a network of protein-DNA and protein-protein interactions. Accordingly, utilities of GAM8554 include diagnosis, prevention and treatment of diseases and clinical conditions associated with HMGA1.

The function of HMGA1 and its association with various diseases and clinical conditions, has been established by previous studies, as described hereinabove with reference to GAM139.1. High mobility group at-hook 1 (HMGA1, Accession NP_665907.1) is another GAM8554 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:13844, to the nucleotide sequence of GAM8554 RNA, herein designated GAM RNA, also designated SEQ ID:388.

Another function of GAM8554 is therefore inhibition of High mobility group at-hook 1 (HMGA1, Accession NP_665907.1), a gene which orchestrates the assembly of a virus-induced enhanceosome by mediating a network of protein-DNA and protein-protein interactions. Accordingly, utilities of GAM8554 include diagnosis, prevention and treatment of diseases and clinical conditions associated with HMGA1.

The function of HMGA1 and its association with various diseases and clinical conditions, has been established by previous studies, as described hereinabove with reference to GAM139.1. High mobility group at-hook 1 (HMGA1, Accession NP_665908.1) is another GAM8554 target gene, herein designated TARGET GENE. HMGA1 BINDING SITE is a target binding site found in the 3' untranslated region of multiple transcripts of mRNA encoded by HMGA1, corresponding to a target binding site such as BINDING SITE I, BINDING SITE II or BINDING SITE III of FIG. 8. Table 4 illustrates the complementarity of the nucleotide sequences of HMGA1 BINDING SITE, designated SEQ ID:13844, to the nucleotide sequence of GAM8554 RNA, herein designated GAM RNA, also designated SEQ ID:388.

Another function of GAM8554 is therefore inhibition of High mobility group at-hook 1 (HMGA1, Accession NP_665908.1), a gene which orchestrates the assembly of a virus-induced enhanceosome by mediating a network of protein-DNA and protein-protein interactions. Accordingly, utilities of GAM8554 include diagnosis, prevention and treatment of diseases and clinical conditions associated with HMGA1.

The function of HMGA1 and its association with various diseases and clinical conditions, has been established by previous studies, as described hereinabove with reference to GAM139.1. Hermansky-pudlak syndrome 1 (HPS1, Accession NP_000186.1) is another GAM8554 target gene, herein designated TARGET GENE. HPS1 BINDING SITE is a target binding site found in the 5' untranslated region of mRNA encoded by HPS1, corresponding to a target binding site such as BINDING SITE I, BINDING SITE II or BINDING SITE III of FIG. 8. Table 4 illustrates the complementarity of the nucleotide sequences of HPS1 BINDING SITE, designated SEQ ID:8078, to the nucleotide sequence of GAM8554 RNA, herein designated GAM RNA, also designated SEQ ID:388.

Another function of GAM8554 is therefore inhibition of Hermansky-pudlak syndrome 1 (HPS1, Accession NP_000186.1). Accordingly, utilities of GAM8554 include diagnosis, prevention and treatment of diseases and clinical conditions associated with HPS1.

HRIHFB2122 (Accession NP_008963.2) is another GAM8554 target gene, herein designated TARGET GENE. HRIHFB2122 BINDING SITE is a target binding site found in the 3' untranslated region of multiple transcripts of mRNA encoded by HRIHFB2122, corresponding to a target binding site such as BINDING SITE I, BINDING SITE II or BINDING SITE III of FIG. 8. Table 4 illustrates the complementarity of the nucleotide sequences of HRIHFB2122 BINDING SITE, designated SEQ ID:3658, to the nucleotide sequence of GAM8554 RNA, herein designated GAM RNA, also designated SEQ ID:388.

Another function of GAM8554 is therefore inhibition of HRIHFB2122 (Accession NP_008963.2). Accordingly, utilities of GAM8554 include diagnosis, prevention and treatment of diseases and clinical conditions associated with HRIHFB2122.

Heparan sulfate (glucosamine) 3-o-sulfotransferase 2 (HS3ST2, Accession NP_006034.1) is another GAM8554 target gene, herein designated TARGET GENE. HS3ST2 BINDING SITE is a target binding site found in the 3' untranslated region of mRNA encoded by HS3ST2, corresponding to a target binding site such as BINDING SITE I, BINDING SITE II or BINDING SITE III of FIG. 8. Table 4 illustrates the complementarity of the nucleotide sequences of HS3ST2 BINDING SITE, designated SEQ ID:3906, to the nucleotide sequence of GAM8554 RNA, herein designated GAM RNA, also designated SEQ ID:388.

Another function of GAM8554 is therefore inhibition of Heparan sulfate (glucosamine) 3-o-sulfotransferase 2 (HS3ST2, Accession NP_006034.1), a gene which plays a role in the generation of heparan sulfate proteoglycan. Accordingly, utilities of GAM8554 include diagnosis, prevention and treatment of diseases and clinical conditions associated with HS3ST2.

The function of HS3ST2 and its association with various diseases and clinical conditions, has been established by previous studies, as described hereinabove with reference to GAM767.1. Heparan sulfate 6-o-sulfotransferase 2 (HS6ST2, Accession NP_671704.2) is another GAM8554 target gene, herein designated TARGET GENE. HS6ST2 BINDING SITE is a target binding site found in the 5' untranslated region of multiple transcripts of mRNA encoded by HS6ST2, corresponding to a target binding site such as BINDING SITE I, BINDING SITE II or BINDING SITE III of FIG. 8. Table 4 illustrates the complementarity of the nucleotide sequences of HS6ST2 BINDING SITE, designated SEQ ID:13150, to the nucleotide sequence of GAM8554 RNA, herein designated GAM RNA, also designated SEQ ID:388.

Another function of GAM8554 is therefore inhibition of Heparan sulfate 6-o-sulfotransferase 2 (HS6ST2, Accession NP_671704.2). Accordingly, utilities of GAM8554 include diagnosis, prevention and treatment of diseases and clinical conditions associated with HS6ST2.

Inducible t-cell co-stimulator (ICOS, Accession NP_036224.1) is another GAM8554 target gene, herein designated TARGET GENE. ICOS BINDING SITE is a target binding site found in the 3' untranslated region of mRNA encoded by ICOS, corresponding to a target binding site such as BINDING SITE I, BINDING SITE II or BINDING SITE III of FIG. 8. Table 4 illustrates the complementarity of the nucleotide sequences of ICOS BINDING SITE, designated SEQ ID:16504, to the nucleotide sequence of GAM8554 RNA, herein designated GAM RNA, also designated SEQ ID:388.

Another function of GAM8554 is therefore inhibition of Inducible t-cell co-stimulator (ICOS, Accession NP_036224.1), a gene which forms homodimers and functions as an inducible T-cell co-stimulator. Accordingly, utilities of GAM8554 include diagnosis, prevention and treatment of diseases and clinical conditions associated with ICOS.

The function of ICOS and its association with various diseases and clinical conditions, has been established by previous studies, as described hereinabove with reference to GAM369.2. Interleukin 18 receptor 1 (IL18R1, Accession NP_003846.1) is another GAM8554 target gene, herein designated TARGET GENE. IL18R1 BINDING SITE is a target binding site found in the 3' untranslated region of mRNA encoded by IL18R1, corresponding to a target binding site such as BINDING SITE I, BINDING SITE II or BINDING SITE III of FIG. 8. Table 4 illustrates the complementarity of the nucleotide sequences of IL18R1 BINDING SITE, designated SEQ ID:950, to the nucleotide sequence of GAM8554 RNA, herein designated GAM RNA, also designated SEQ ID:388.

Another function of GAM8554 is therefore inhibition of Interleukin 18 receptor 1 (IL18R1, Accession NP_003846.1), a gene which is required for dorsal-ventral embryonic polarity and promotes heterophilic cellular adhesion. Accordingly, utilities of GAM8554 include diagnosis, prevention and treatment of diseases and clinical conditions associated with IL18R1.

The function of IL18R1 and its association with various diseases and clinical conditions, has been established by previous studies, as described hereinabove with reference to GAM190.1. Integrin beta 3 binding protein (beta3-endonexin) (ITGB3BP, Accession NP_055103.3) is another GAM8554 target gene, herein designated TARGET GENE. ITGB3BP BINDING SITE is a target binding site found in the 3' untranslated region of mRNA encoded by ITGB3BP, corresponding to a target binding site such as BINDING SITE I, BINDING SITE II or BINDING SITE III of FIG. 8. Table 4 illustrates the complementarity of the nucleotide sequences of ITGB3BP BINDING SITE, designated SEQ ID:6219, to the nucleotide sequence of GAM8554 RNA, herein designated GAM RNA, also designated SEQ ID:388.

Another function of GAM8554 is therefore inhibition of Integrin beta 3 binding protein (beta3-endonexin) (ITGB3BP, Accession NP_055103.3), a gene which interacts swith the cytoplasmic tail of the integrin beta- 3 subunit. Accordingly, utilities of GAM8554 include diagnosis, prevention and treatment of diseases and clinical conditions associated with ITGB3BP.

The function of ITGB3BP and its association with various diseases and clinical conditions, has been established by previous studies, as described hereinabove with reference to GAM1701.2. Jun d proto - oncogene (JUND, Accession NP_005345.2) is another GAM8554 target gene, herein designated TARGET GENE. JUND BINDING SITE is a target binding site found in the 3' untranslated region of mRNA encoded by JUND, corresponding to a target binding site such as BINDING SITE I, BINDING SITE II or BINDING SITE III of FIG. 8. Table 4 illustrates the complementarity of the nucleotide sequences of JUND BINDING SITE, designated SEQ ID:9711, to the nucleotide sequence of GAM8554 RNA, herein designated GAM RNA, also designated SEQ ID:388.

Another function of GAM8554 is therefore inhibition of Jun d proto - oncogene (JUND, Accession NP_005345.2), a gene which binds an ap-1 site. Accordingly, utilities of GAM8554 include diagnosis, prevention and treatment of diseases and clinical conditions associated with JUND.

The function of JUND and its association with various diseases and clinical conditions, has been established by previous studies, as described hereinabove with reference to GAM104.1. KAB (Accession NP_055627.1) is another GAM8554 target gene, herein designated TARGET GENE. KAB BINDING SITE is a target binding site found in the 3' untranslated region of mRNA encoded by KAB, corresponding to a target binding site such as BINDING SITE I, BINDING SITE II or BINDING SITE III of FIG. 8. Table 4 illustrates the complementarity of the nucleotide sequences of KAB BINDING SITE, designated SEQ ID:6558, to the nucleotide sequence of GAM8554 RNA, herein designated GAM RNA, also designated SEQ ID:388.

Another function of GAM8554 is therefore inhibition of KAB (Accession NP_055627.1). Accordingly, utilities of GAM8554 include diagnosis, prevention and treatment of diseases and clinical conditions associated with KAB.

KIAA0375 (Accession XP_048462.1) is another GAM8554 target gene, herein designated TARGET GENE. KIAA0375 BINDING SITE is a target binding site found in the 3' untranslated region of mRNA encoded by KIAA0375, corresponding to a target binding site such as BINDING SITE I, BINDING SITE II or BINDING SITE III of FIG. 8. Table 4 illustrates the complementarity of the nucleotide sequences of KIAA0375 BINDING SITE, designated SEQ ID:12790, to the nucleotide sequence of GAM8554 RNA, herein designated GAM RNA, also designated SEQ ID:388.

Another function of GAM8554 is therefore inhibition of KIAA0375 (Accession XP_048462.1). Accordingly, utilities of GAM8554 include diagnosis, prevention and treatment of diseases and clinical conditions associated with KIAA0375.

KIAA0599 (Accession XP_085127.6) is another GAM8554 target gene, herein designated TARGET GENE. KIAA0599 BINDING SITE is a target binding site found in the 5' untranslated region of mRNA encoded by KIAA0599, corresponding to a target binding site such as BINDING SITE I, BINDING SITE II or BINDING SITE III of FIG. 8. Table 4 illustrates the complementarity of the nucleotide sequences of KIAA0599 BINDING SITE, designated SEQ ID:16996, to the nucleotide sequence of GAM8554 RNA, herein designated GAM RNA, also designated SEQ ID:388.

Another function of GAM8554 is therefore inhibition of KIAA0599 (Accession XP_085127.6). Accordingly, utilities of GAM8554 include diagnosis, prevention and treatment of diseases and clinical conditions associated with KIAA0599.

KIAA0953 (Accession XP_039733.2) is another GAM8554 target gene, herein designated TARGET GENE. KIAA0953 BINDING SITE is a target binding site found in the 3' untranslated region of mRNA encoded by KIAA0953, corresponding to a target binding site such as BINDING SITE I, BINDING SITE II or BINDING SITE III of FIG. 8. Table 4 illustrates the complementarity of the nucleotide sequences of KIAA0953 BINDING SITE, designated SEQ ID:2253, to the nucleotide sequence of GAM8554 RNA, herein designated GAM RNA, also designated SEQ ID:388.

Another function of GAM8554 is therefore inhibition of KIAA0953 (Accession XP_039733.2). Accordingly, utilities of GAM8554 include diagnosis, prevention and treatment of diseases and clinical conditions associated with KIAA0953.

KIAA0984 (Accession XP_037557.2) is another GAM8554 target gene, herein designated TARGET GENE. KIAA0984 BINDING SITE is a target binding site found in the 5' untranslated region of mRNA encoded by KIAA0984, corresponding to a target binding site such as BINDING SITE I, BINDING SITE II or BINDING SITE III of FIG. 8. Table 4 illustrates the complementarity of the nucleotide sequences of KIAA0984 BINDING SITE, designated SEQ ID:4106, to the nucleotide sequence of GAM8554 RNA, herein designated GAM RNA, also designated SEQ ID:388.

Another function of GAM8554 is therefore inhibition of KIAA0984 (Accession XP_037557.2). Accordingly, utilities of GAM8554 include diagnosis, prevention and treatment of diseases and clinical conditions associated with KIAA0984.

KIAA1045 (Accession XP_048592.1) is another GAM8554 target gene, herein designated TARGET GENE. KIAA1045 BINDING SITE is a target binding site found in the 3' untranslated region of mRNA encoded by KIAA1045, corresponding to a target binding site such as BINDING SITE I, BINDING SITE II or BINDING SITE III of FIG. 8. Table 4 illustrates the complementarity of the nucleotide sequences of KIAA1045 BINDING SITE, designated SEQ ID:5832, to the nucleotide sequence of GAM8554 RNA, herein designated GAM RNA, also designated SEQ ID:388.

Another function of GAM8554 is therefore inhibition of KIAA1045 (Accession XP_048592.1). Accordingly, utilities of GAM8554 include diagnosis, prevention and treatment of diseases and clinical conditions associated with KIAA1045.

KIAA1394 (Accession XP_208522.1) is another GAM8554 target gene, herein designated TARGET GENE. KIAA1394 BINDING SITE is a target binding site found in the 3' untranslated region of mRNA encoded by KIAA1394, corresponding to a target binding site such as BINDING SITE I, BINDING SITE II or BINDING SITE III of FIG. 8. Table 4 illustrates the complementarity of the nucleotide sequences of KIAA1394 BINDING SITE, designated SEQ ID:3139, to the nucleotide sequence of GAM8554 RNA, herein designated GAM RNA, also designated SEQ ID:388.

Another function of GAM8554 is therefore inhibition of KIAA1394 (Accession XP_208522.1). Accordingly, utilities of GAM8554 include diagnosis, prevention and treatment of diseases and clinical conditions associated with KIAA1394.

KIAA1713 (Accession XP_290811.1) is another GAM8554 target gene, herein designated TARGET GENE. KIAA1713 BINDING SITE is a target binding site found in the 5' untranslated region of mRNA encoded by KIAA1713, corresponding to a target binding site such as BINDING SITE I, BINDING SITE II or BINDING SITE III of FIG. 8. Table 4 illustrates the complementarity of the nucleotide sequences of KIAA1713 BINDING SITE, designated SEQ ID:10338, to the nucleotide sequence of GAM8554 RNA, herein designated GAM RNA, also designated SEQ ID:388.

Another function of GAM8554 is therefore inhibition of KIAA1713 (Accession XP_290811.1). Accordingly, utilities of GAM8554 include diagnosis, prevention and treatment of diseases and clinical conditions associated with KIAA1713.

KIAA1843 (Accession XP_030838.3) is another GAM8554 target gene, herein designated TARGET GENE. KIAA1843 BINDING SITE is a target binding site found in the 3' untranslated region of mRNA encoded by KIAA1843, corresponding to a target binding site such as BINDING SITE I, BINDING SITE II or BINDING SITE III of FIG. 8. Table 4 illustrates the complementarity of the nucleotide sequences of KIAA1843 BINDING SITE, designated SEQ ID:15579, to the nucleotide sequence of GAM8554 RNA, herein designated GAM RNA, also designated SEQ ID:388.

Another function of GAM8554 is therefore inhibition of KIAA1843 (Accession XP_030838.3). Accordingly, utilities of GAM8554 include diagnosis, prevention and treatment of diseases and clinical conditions associated with KIAA1843.

KIAA1870 (Accession NP_116277.1) is another GAM8554 target gene, herein designated TARGET GENE. KIAA1870 BINDING SITE is a target binding site found in the 5' untranslated region of multiple transcripts of mRNA encoded by KIAA1870, corresponding to a target binding site such as BINDING SITE I, BINDING SITE II or BINDING SITE III of FIG. 8. Table 4 illustrates the complementarity of the nucleotide sequences of KIAA1870 BINDING SITE, designated SEQ ID:11147, to the nucleotide sequence of GAM8554 RNA, herein designated GAM RNA, also designated SEQ ID:388.

Another function of GAM8554 is therefore inhibition of KIAA1870 (Accession NP_116277.1). Accordingly, utilities of GAM8554 include diagnosis, prevention and treatment of diseases and clinical conditions associated with KIAA1870.

KIAA1940 (Accession XP_086981.2) is another GAM8554 target gene, herein designated TARGET GENE. KIAA1940 BINDING SITE is a target binding site found in the 3' untranslated region of mRNA encoded by KIAA1940, corresponding to a target binding site such as BINDING SITE I, BINDING SITE II or BINDING SITE III of FIG. 8. Table 4 illustrates the complementarity of the nucleotide sequences of KIAA1940 BINDING SITE, designated SEQ ID:16455, to the nucleotide sequence of GAM8554 RNA, herein designated GAM RNA, also designated SEQ ID:388.

Another function of GAM8554 is therefore inhibition of KIAA1940 (Accession XP_086981.2). Accordingly, utilities of GAM8554 include diagnosis, prevention and treatment of diseases and clinical conditions associated with KIAA1940.

Kinesin family member 13b (KIF13B, Accession NP_056069.1) is another GAM8554 target gene, herein designated TARGET GENE. KIF13B BINDING SITE is a target binding site found in the 3' untranslated region of mRNA encoded by KIF13B, corresponding to a target binding site such as BINDING SITE I, BINDING SITE II or BINDING SITE III of FIG. 8. Table 4 illustrates the complementarity of the nucleotide sequences of KIF13B BINDING SITE, designated SEQ ID:11786, to the nucleotide sequence of GAM8554 RNA, herein designated GAM RNA, also designated SEQ ID:388.

Another function of GAM8554 is therefore inhibition of Kinesin family member 13b (KIF13B, Accession NP_056069.1). Accordingly, utilities of GAM8554 include diagnosis, prevention and treatment of diseases and clinical conditions associated with KIF13B.

Kinesin family member 3c (KIF3C, Accession NP_002245.2) is another GAM8554 target gene, herein designated TARGET GENE. KIF3C BINDING SITE is a target binding site found in the 3' untranslated region of mRNA encoded by KIF3C, corresponding to a target binding site such as BINDING SITE I, BINDING SITE II or BINDING SITE III of FIG. 8. Table 4 illustrates the complementarity of the nucleotide sequences of KIF3C BINDING SITE, designated SEQ ID:16548, to the nucleotide sequence of GAM8554 RNA, herein designated GAM RNA, also designated SEQ ID:388.

Another function of GAM8554 is therefore inhibition of Kinesin family member 3c (KIF3C, Accession NP_002245.2). Accordingly, utilities of GAM8554 include diagnosis, prevention and treatment of diseases and clinical conditions associated with KIF3C.

Kallikrein 3, (prostate specific antigen) (KLK3, Accession NP_665863.1) is another GAM8554 target gene, herein designated TARGET GENE. KLK3 BINDING SITE is a target binding site found in the 5' untranslated region of multiple transcripts of mRNA encoded by KLK3, corresponding to a target binding site such as BINDING SITE I, BINDING SITE II or BINDING SITE III of FIG. 8. Table 4 illustrates the complementarity of the nucleotide sequences of KLK3 BINDING SITE, designated SEQ ID:14566, to the nucleotide sequence of GAM8554 RNA, herein designated GAM RNA, also designated SEQ ID:388.

Another function of GAM8554 is therefore inhibition of Kallikrein 3, (prostate specific antigen) (KLK3, Accession NP_665863.1), a gene which functions in the liquefaction of seminal coagulum and therefore may be associated with Prostatic carcinoma. Accordingly, utilities of GAM8554 include diagnosis, prevention and treatment of Prostatic carcinoma, and of other diseases and clinical conditions associated with KLK3.

The function of KLK3 and its association with various diseases and clinical conditions, has been established by previous studies, as described hereinabove with reference to GAM205.2. Kallikrein 3, (prostate specific antigen) (KLK3, Accession NP_001639.1) is another GAM8554 target gene, herein designated TARGET GENE. KLK3 BINDING SITE is a target binding site found in the 5' untranslated region of multiple transcripts of mRNA encoded by KLK3, corresponding to a target binding site such as BINDING SITE I, BINDING SITE II or BINDING SITE III of FIG. 8. Table 4 illustrates the complementarity of the nucleotide sequences of KLK3 BINDING SITE, designated SEQ ID:14566, to the nucleotide sequence of GAM8554 RNA, herein designated GAM RNA, also designated SEQ ID:388.

Another function of GAM8554 is therefore inhibition of Kallikrein 3, (prostate specific antigen) (KLK3, Accession NP_001639.1), a gene which functions in the liquefaction of seminal coagulum and therefore may be associated with Prostatic carcinoma. Accordingly, utilities of GAM8554 include diagnosis, prevention and treatment of Prostatic carcinoma, and of other diseases and clinical conditions associated with KLK3.

The function of KLK3 and its association with various diseases and clinical conditions, has been established by previous studies, as described hereinabove with reference to GAM205.2. L(3)mbt-like 2 (drosophila) (L3MBTL2, Accession NP_113676.2) is another GAM8554 target gene, herein designated TARGET GENE. L3MBTL2 BINDING SITE is a target binding site found in the 3' untranslated region of mRNA encoded by L3MBTL2, corresponding to a target binding site such as BINDING SITE I, BINDING SITE II or BINDING SITE III of FIG. 8. Table 4 illustrates the complementarity of the nucleotide sequences of L3MBTL2 BINDING SITE, designated SEQ ID:796, to the nucleotide sequence of GAM8554 RNA, herein designated GAM RNA, also designated SEQ ID:388.

Another function of GAM8554 is therefore inhibition of L(3)mbt-like 2 (drosophila) (L3MBTL2, Accession NP_113676.2). Accordingly, utilities of GAM8554 include diagnosis, prevention and treatment of diseases and clinical conditions associated with L3MBTL2.

Laminin, gamma 2 (LAMC2, Accession NP_005553.1) is another GAM8554 target gene, herein designated TARGET GENE. LAMC2 BINDING SITE is a target binding site found in the 3' untranslated region of multiple transcripts of mRNA encoded by LAMC2, corresponding to a target binding site such as BINDING SITE I, BINDING SITE II or BINDING SITE III of FIG. 8. Table 4 illustrates the complementarity of the nucleotide sequences of LAMC2 BINDING SITE, designated SEQ ID:13196, to the nucleotide sequence of GAM8554 RNA, herein designated GAM RNA, also designated SEQ ID:388.

Another function of GAM8554 is therefore inhibition of Laminin, gamma 2 (LAMC2, Accession NP_005553.1). Accordingly, utilities of GAM8554 include diagnosis, prevention and treatment of diseases and clinical conditions associated with LAMC2.

Lymphocyte cytosolic protein 2 (sh2 domain containing leukocyte protein of 76 kda) (LCP2, Accession NP_005556.1) is another GAM8554 target gene, herein designated TARGET GENE. LCP2 BINDING SITE is a target binding site found in the 3' untranslated region of mRNA encoded by LCP2, corresponding to a target binding site such as BINDING SITE I, BINDING SITE II or BINDING SITE III of FIG. 8. Table 4 illustrates the complementarity of the nucleotide sequences of LCP2 BINDING SITE, designated SEQ ID:7204, to the nucleotide sequence of GAM8554 RNA, herein designated GAM RNA, also designated SEQ ID:388.

Another function of GAM8554 is therefore inhibition of Lymphocyte cytosolic protein 2 (sh2 domain containing leukocyte protein of 76 kda) (LCP2, Accession NP_005556.1), a gene which involved in t cell antigen receptor mediated signaling. and therefore may be associated with Fetal hemorrhage and platelet dysfunction. Accordingly, utilities of GAM8554 include diagnosis, prevention and treatment of Fetal hemorrhage and platelet dysfunction, and of other diseases and clinical conditions associated with LCP2.

The function of LCP2 and its association with various diseases and clinical conditions, has been established by previous studies, as described hereinabove with reference to GAM175.1. Lim domains containing 1 (LIMD1, Accession NP_055055.1) is another GAM8554 target gene, herein designated TARGET GENE. LIMD1 BINDING SITE is a target binding site found in the 3' untranslated region of mRNA encoded by LIMD1, corresponding to a target binding site such as BINDING SITE I, BINDING SITE II or BINDING SITE III of FIG. 8. Table 4 illustrates the complementarity of the nucleotide sequences of LIMD1 BINDING SITE, designated SEQ ID:8280, to the nucleotide sequence of GAM8554 RNA, herein designated GAM RNA, also designated SEQ ID:388.

Another function of GAM8554 is therefore inhibition of Lim domains containing 1 (LIMD1, Accession NP_055055.1). Accordingly, utilities of GAM8554 include diagnosis, prevention and treatment of diseases and clinical conditions associated with LIMD1.

LOC116123 (Accession NP_620139.1) is another GAM8554 target gene, herein designated TARGET GENE. LOC116123 BINDING SITE is a target binding site found in the 5' untranslated region of mRNA encoded by LOC116123, corresponding to a target binding site such as BINDING SITE I, BINDING SITE II or BINDING SITE III of FIG. 8. Table 4 illustrates the complementarity of the nucleotide sequences of LOC116123 BINDING SITE, designated SEQ ID:3173, to the nucleotide sequence of GAM8554 RNA, herein designated GAM RNA, also designated SEQ ID:388.

Another function of GAM8554 is therefore inhibition of LOC116123 (Accession NP_620139.1). Accordingly, utilities of GAM8554 include diagnosis, prevention and treatment of diseases and clinical conditions associated with LOC116123.

LOC121952 (Accession XP_062872.2) is another GAM8554 target gene, herein designated TARGET GENE. LOC121952 BINDING SITE is a target binding site found in the 5' untranslated region of mRNA encoded by LOC121952, corresponding to a target binding site such as BINDING SITE I, BINDING SITE II or BINDING SITE III of FIG. 8. Table 4 illustrates the complementarity of the nucleotide sequences of LOC121952 BINDING SITE, designated SEQ ID:15313, to the nucleotide sequence of GAM8554 RNA, herein designated GAM RNA, also designated SEQ ID:388.

Another function of GAM8554 is therefore inhibition of LOC121952 (Accession XP_062872.2). Accordingly, utilities of GAM8554 include diagnosis, prevention and treatment of diseases and clinical conditions associated with LOC121952.

LOC130752 (Accession XP_059468.3) is another GAM8554 target gene, herein designated TARGET GENE. LOC130752 BINDING SITE is a target binding site found in the 3' untranslated region of mRNA encoded by LOC130752, corresponding to a target binding site such as BINDING SITE I, BINDING SITE II or BINDING SITE III of FIG. 8. Table 4 illustrates the complementarity of the nucleotide sequences of LOC130752 BINDING SITE, designated SEQ ID:10806, to the nucleotide sequence of GAM8554 RNA, herein designated GAM RNA, also designated SEQ ID:388.

Another function of GAM8554 is therefore inhibition of LOC130752 (Accession XP_059468.3). Accordingly, utilities of GAM8554 include diagnosis, prevention and treatment of diseases and clinical conditions associated with LOC130752.

LOC139547 (Accession XP_066756.4) is another GAM8554 target gene, herein designated TARGET GENE. LOC139547 BINDING SITE is a target binding site found in the 3' untranslated region of mRNA encoded by LOC139547, corresponding to a target binding site such as BINDING SITE I, BINDING SITE II or BINDING SITE III of FIG. 8. Table 4 illustrates the complementarity of the nucleotide sequences of LOC139547 BINDING SITE, designated SEQ ID:6100, to the nucleotide sequence of GAM8554 RNA, herein designated GAM RNA, also designated SEQ ID:388.

Another function of GAM8554 is therefore inhibition of LOC139547 (Accession XP_066756.4). Accordingly, utilities of GAM8554 include diagnosis, prevention and treatment of diseases and clinical conditions associated with LOC139547.

LOC146909 (Accession XP_085634.2) is another GAM8554 target gene, herein designated TARGET GENE. LOC146909 BINDING SITE is a target binding site found in the 3' untranslated region of mRNA encoded by LOC146909, corresponding to a target binding site such as BINDING SITE I, BINDING SITE II or BINDING SITE III of FIG. 8. Table 4 illustrates the complementarity of the nucleotide sequences of LOC146909 BINDING SITE, designated SEQ ID:14000, to the nucleotide sequence of GAM8554 RNA, herein designated GAM RNA, also designated SEQ ID:388.

Another function of GAM8554 is therefore inhibition of LOC146909 (Accession XP_085634.2). Accordingly, utilities of GAM8554 include diagnosis, prevention and treatment of diseases and clinical conditions associated with LOC146909.

LOC148710 (Accession XP_097506.1) is another GAM8554 target gene, herein designated TARGET GENE. LOC148710 BINDING SITE is a target binding site found in the 3' untranslated region of mRNA encoded by LOC148710, corresponding to a target binding site such as BINDING SITE I, BINDING SITE II or BINDING SITE III of FIG. 8. Table 4 illustrates the complementarity of the nucleotide sequences of LOC148710 BINDING SITE, designated SEQ ID:17195, to the nucleotide sequence of GAM8554 RNA, herein designated GAM RNA, also designated SEQ ID:388.

Another function of GAM8554 is therefore inhibition of LOC148710 (Accession XP_097506.1). Accordingly, utilities of GAM8554 include diagnosis, prevention and treatment of diseases and clinical conditions associated with LOC148710.

LOC149603 (Accession XP_047499.3) is another GAM8554 target gene, herein designated TARGET GENE. LOC149603 BINDING SITE is a target binding site found in the 3' untranslated region of mRNA encoded by LOC149603, corresponding to a target binding site such as BINDING SITE I, BINDING SITE II or BINDING SITE III of FIG. 8. Table 4 illustrates the complementarity of the nucleotide sequences of LOC149603 BINDING SITE, designated SEQ ID:7264, to the nucleotide sequence of GAM8554 RNA, herein designated GAM RNA, also designated SEQ ID:388.

Another function of GAM8554 is therefore inhibition of LOC149603 (Accession XP_047499.3). Accordingly, utilities of GAM8554 include diagnosis, prevention and treatment of diseases and clinical conditions associated with LOC149603.

LOC150819 (Accession XP_097954.1) is another GAM8554 target gene, herein designated TARGET GENE. LOC150819 BINDING SITE is a target binding site found in the 5' untranslated region of mRNA encoded by LOC150819, corresponding to a target binding site such as BINDING SITE I, BINDING SITE II or BINDING SITE III of FIG. 8. Table 4 illustrates the complementarity of the nucleotide sequences of LOC150819 BINDING SITE, designated SEQ ID:9583, to the nucleotide sequence of GAM8554 RNA, herein designated GAM RNA, also designated SEQ ID:388.

Another function of GAM8554 is therefore inhibition of LOC150819 (Accession XP_097954.1). Accordingly, utilities of GAM8554 include diagnosis, prevention and treatment of diseases and clinical conditions associated with LOC150819.

LOC152765 (Accession XP_087519.1) is another GAM8554 target gene, herein designated TARGET GENE. LOC152765 BINDING SITE is a target binding site found in the 5' untranslated region of mRNA encoded by LOC152765, corresponding to a target binding site such as BINDING SITE I, BINDING SITE II or BINDING SITE III of FIG. 8. Table 4 illustrates the complementarity of the nucleotide sequences of LOC152765 BINDING SITE, designated SEQ ID:4063, to the nucleotide sequence of GAM8554 RNA, herein designated GAM RNA, also designated SEQ ID:388.

Another function of GAM8554 is therefore inhibition of LOC152765 (Accession XP_087519.1). Accordingly, utilities of GAM8554 include diagnosis, prevention and treatment of diseases and clinical conditions associated with LOC152765.

LOC158298 (Accession XP_098916.1) is another GAM8554 target gene, herein designated TARGET GENE. LOC158298 BINDING SITE is a target binding site found in the 5' untranslated region of mRNA encoded by LOC158298, corresponding to a target binding site such as BINDING SITE I, BINDING SITE II or BINDING SITE III of FIG. 8. Table 4 illustrates the complementarity of the nucleotide sequences of LOC158298 BINDING SITE, designated SEQ ID:7028, to the nucleotide sequence of GAM8554 RNA, herein designated GAM RNA, also designated SEQ ID:388.

Another function of GAM8554 is therefore inhibition of LOC158298 (Accession XP_098916.1). Accordingly, utilities of GAM8554 include diagnosis, prevention and treatment of diseases and clinical conditions associated with LOC158298.

LOC203082 (Accession XP_114620.1) is another GAM8554 target gene, herein designated TARGET GENE. LOC203082 BINDING SITE is a target binding site found in the 5' untranslated region of mRNA encoded by LOC203082, corresponding to a target binding site such as BINDING SITE I, BINDING SITE II or BINDING SITE III of FIG. 8. Table 4 illustrates the complementarity of the nucleotide sequences of LOC203082 BINDING SITE, designated SEQ ID:4227, to the nucleotide sequence of GAM8554 RNA, herein designated GAM RNA, also designated SEQ ID:388.

Another function of GAM8554 is therefore inhibition of LOC203082 (Accession XP_114620.1). Accordingly, utilities of GAM8554 include diagnosis, prevention and treatment of diseases and clinical conditions associated with LOC203082.

LOC253499 (Accession XP_172902.2) is another GAM8554 target gene, herein designated TARGET GENE. LOC253499 BINDING SITE is a target binding site found in the 3' untranslated region of mRNA encoded by LOC253499, corresponding to a target binding site such as BINDING SITE I, BINDING SITE II or BINDING SITE III of FIG. 8. Table 4 illustrates the complementarity of the nucleotide sequences of LOC253499 BINDING SITE, designated SEQ ID:16092, to the nucleotide sequence of GAM8554 RNA, herein designated GAM RNA, also designated SEQ ID:388.

Another function of GAM8554 is therefore inhibition of LOC253499 (Accession XP_172902.2). Accordingly, utilities of GAM8554 include diagnosis, prevention and treatment of diseases and clinical conditions associated with LOC253499.

LOC253992 (Accession XP_172953.2) is another GAM8554 target gene, herein designated TARGET GENE. LOC253992 BINDING SITE is a target binding site found in the 3' untranslated region of mRNA encoded by LOC253992, corresponding to a target binding site such as BINDING SITE I, BINDING SITE II or BINDING SITE III of FIG. 8. Table 4 illustrates the complementarity of the nucleotide sequences of LOC253992 BINDING SITE, designated SEQ ID:3239, to the nucleotide sequence of GAM8554 RNA, herein designated GAM RNA, also designated SEQ ID:388.

Another function of GAM8554 is therefore inhibition of LOC253992 (Accession XP_172953.2). Accordingly, utilities of GAM8554 include diagnosis, prevention and treatment of diseases and clinical conditions associated with LOC253992.

LOC255849 (Accession XP_172855.1) is another GAM8554 target gene, herein designated TARGET GENE. LOC255849 BINDING SITE is a target binding site found in the 3' untranslated region of mRNA encoded by LOC255849, corresponding to a target binding site such as BINDING SITE I, BINDING SITE II or BINDING SITE III of FIG. 8. Table 4 illustrates the complementarity of the nucleotide sequences of LOC255849 BINDING SITE, designated SEQ ID:9954, to the nucleotide sequence of GAM8554 RNA, herein designated GAM RNA, also designated SEQ ID:388.

Another function of GAM8554 is therefore inhibition of LOC255849 (Accession XP_172855.1). Accordingly, utilities of GAM8554 include diagnosis, prevention and treatment of diseases and clinical conditions associated with LOC255849.

LOC256861 (Accession XP_173004.1) is another GAM8554 target gene, herein designated TARGET GENE. LOC256861 BINDING SITE is a target binding site found in the 3' untranslated region of mRNA encoded by LOC256861, corresponding to a target binding site such as BINDING SITE I, BINDING SITE II or BINDING SITE III of FIG. 8. Table 4 illustrates the complementarity of the nucleotide sequences of LOC256861 BINDING SITE, designated SEQ ID:14030, to the nucleotide sequence of GAM8554 RNA, herein designated GAM RNA, also designated SEQ ID:388.

Another function of GAM8554 is therefore inhibition of LOC256861 (Accession XP_173004.1). Accordingly, utilities of GAM8554 include diagnosis, prevention and treatment of diseases and clinical conditions associated with LOC256861.

LOC282915 (Accession XP_212579.1) is another GAM8554 target gene, herein designated TARGET GENE. LOC282915 BINDING SITE is a target binding site found in the 3' untranslated region of mRNA encoded by LOC282915, corresponding to a target binding site such as BINDING SITE I, BINDING SITE II or BINDING SITE III of FIG. 8. Table 4 illustrates the complementarity of the nucleotide sequences of LOC282915 BINDING SITE, designated SEQ ID:8045, to the nucleotide sequence of GAM8554 RNA, herein designated GAM RNA, also designated SEQ ID:388.

Another function of GAM8554 is therefore inhibition of LOC282915 (Accession XP_212579.1). Accordingly, utilities of GAM8554 include diagnosis, prevention and treatment of diseases and clinical conditions associated with LOC282915.

LOC282951 (Accession XP_212627.1) is another GAM8554 target gene, herein designated TARGET GENE. LOC282951 BINDING SITE is a target binding site found in the 3' untranslated region of mRNA encoded by LOC282951, corresponding to a target binding site such as BINDING SITE I, BINDING SITE II or BINDING SITE III of FIG. 8. Table 4 illustrates the complementarity of the nucleotide sequences of LOC282951 BINDING SITE, designated SEQ ID:8045, to the nucleotide sequence of GAM8554 RNA, herein designated GAM RNA, also designated SEQ ID:388.

Another function of GAM8554 is therefore inhibition of LOC282951 (Accession XP_212627.1). Accordingly, utilities of GAM8554 include diagnosis, prevention and treatment of diseases and clinical conditions associated with LOC282951.

LOC283028 (Accession XP_210862.1) is another GAM8554 target gene, herein designated TARGET GENE. LOC283028 BINDING SITE is a target binding site found in the 3' untranslated region of mRNA encoded by LOC283028, corresponding to a target binding site such as BINDING SITE I, BINDING SITE II or BINDING SITE III of FIG. 8. Table 4 illustrates the complementarity of the nucleotide sequences of LOC283028 BINDING SITE, designated SEQ ID:19511, to the nucleotide sequence of GAM8554 RNA, herein designated GAM RNA, also designated SEQ ID:388.

Another function of GAM8554 is therefore inhibition of LOC283028 (Accession XP_210862.1). Accordingly, utilities of GAM8554 include diagnosis, prevention and treatment of diseases and clinical conditions associated with LOC283028.

LOC283278 (Accession XP_210961.1) is another GAM8554 target gene, herein designated TARGET GENE. LOC283278 BINDING SITE is a target binding site found in the 3' untranslated region of mRNA encoded by LOC283278, corresponding to a target binding site such as BINDING SITE I, BINDING SITE II or BINDING SITE III of FIG. 8. Table 4 illustrates the complementarity of the nucleotide sequences of LOC283278 BINDING SITE, designated SEQ ID:18729, to the nucleotide sequence of GAM8554 RNA, herein designated GAM RNA, also designated SEQ ID:388.

Another function of GAM8554 is therefore inhibition of LOC283278 (Accession XP_210961.1). Accordingly, utilities of GAM8554 include diagnosis, prevention and treatment of diseases and clinical conditions associated with LOC283278.

LOC283314 (Accession XP_210969.1) is another GAM8554 target gene, herein designated TARGET GENE. LOC283314 BINDING SITE is a target binding site found in the 3' untranslated region of mRNA encoded by LOC283314, corresponding to a target binding site such as BINDING SITE I, BINDING SITE II or BINDING SITE III of FIG. 8. Table 4 illustrates the complementarity of the nucleotide sequences of LOC283314 BINDING SITE, designated SEQ ID:8601, to the nucleotide sequence of GAM8554 RNA, herein designated GAM RNA, also designated SEQ ID:388.

Another function of GAM8554 is therefore inhibition of LOC283314 (Accession XP_210969.1). Accordingly, utilities of GAM8554 include diagnosis, prevention and treatment of diseases and clinical conditions associated with LOC283314.

LOC283690 (Accession XP_211167.1) is another GAM8554 target gene, herein designated TARGET GENE. LOC283690 BINDING SITE is a target binding site found in the 3' untranslated region of mRNA encoded by LOC283690, corresponding to a target binding site such as BINDING SITE I, BINDING SITE II or BINDING SITE III of FIG. 8. Table 4 illustrates the complementarity of the nucleotide sequences of LOC283690 BINDING SITE, designated SEQ ID:11309, to the nucleotide sequence of GAM8554 RNA, herein designated GAM RNA, also designated SEQ ID:388.

Another function of GAM8554 is therefore inhibition of LOC283690 (Accession XP_211167.1). Accordingly, utilities of GAM8554 include diagnosis, prevention and treatment of diseases and clinical conditions associated with LOC283690.

LOC283849 (Accession NP_848611.1) is another GAM8554 target gene, herein designated TARGET GENE. LOC283849 BINDING SITE is a target binding site found in the 3' untranslated region of multiple transcripts of mRNA encoded by LOC283849, corresponding to a target binding site such as BINDING SITE I, BINDING SITE II or BINDING SITE III of FIG. 8. Table 4 illustrates the complementarity of the nucleotide sequences of LOC283849 BINDING SITE, designated SEQ ID:2526, to the nucleotide sequence of GAM8554 RNA, herein designated GAM RNA, also designated SEQ ID:388.

Another function of GAM8554 is therefore inhibition of LOC283849 (Accession NP_848611.1). Accordingly, utilities of GAM8554 include diagnosis, prevention and treatment of diseases and clinical conditions associated with LOC283849.

LOC283861 (Accession NP_787095.1) is another GAM8554 target gene, herein designated TARGET GENE. LOC283861 BINDING SITE is a target binding site found in the 3' untranslated region of mRNA encoded by LOC283861, corresponding to a target binding site such as BINDING SITE I, BINDING SITE II or BINDING SITE III of FIG. 8. Table 4 illustrates the complementarity of the nucleotide sequences of LOC283861 BINDING SITE, designated SEQ ID:13934, to the nucleotide sequence of GAM8554 RNA, herein designated GAM RNA, also designated SEQ ID:388.

Another function of GAM8554 is therefore inhibition of LOC283861 (Accession NP_787095.1). Accordingly, utilities of GAM8554 include diagnosis, prevention and treatment of diseases and clinical conditions associated with LOC283861.

LOC283911 (Accession XP_211259.2) is another GAM8554 target gene, herein designated TARGET GENE. LOC283911 BINDING SITE is a target binding site found in the 5' untranslated region of mRNA encoded by LOC283911, corresponding to a target binding site such as BINDING SITE I, BINDING SITE II or BINDING SITE III of FIG. 8. Table 4 illustrates the complementarity of the nucleotide sequences of LOC283911 BINDING SITE, designated SEQ ID:17942, to the nucleotide sequence of GAM8554 RNA, herein designated GAM RNA, also designated SEQ ID:388.

Another function of GAM8554 is therefore inhibition of LOC283911 (Accession XP_211259.2). Accordingly, utilities of GAM8554 include diagnosis, prevention and treatment of diseases and clinical conditions associated with LOC283911.

LOC284109 (Accession XP_211330.2) is another GAM8554 target gene, herein designated TARGET GENE. LOC284109 BINDING SITE is a target binding site found in the 5' untranslated region of mRNA encoded by LOC284109, corresponding to a target binding site such as BINDING SITE I, BINDING SITE II or BINDING SITE III of FIG. 8. Table 4 illustrates the complementarity of the nucleotide sequences of LOC284109 BINDING SITE, designated SEQ ID:18036, to the nucleotide sequence of GAM8554 RNA, herein designated GAM RNA, also designated SEQ ID:388.

Another function of GAM8554 is therefore inhibition of LOC284109 (Accession XP_211330.2). Accordingly, utilities of GAM8554 include diagnosis, prevention and treatment of diseases and clinical conditions associated with LOC284109.

LOC284999 (Accession XP_211728.1) is another GAM8554 target gene, herein designated TARGET GENE. LOC284999 BINDING SITE is a target binding site found in the 5' untranslated region of mRNA encoded by LOC284999, corresponding to a target binding site such as BINDING SITE I, BINDING SITE II or BINDING SITE III of FIG. 8. Table 4 illustrates the complementarity of the nucleotide sequences of LOC284999 BINDING SITE, designated SEQ ID:11242, to the nucleotide sequence of GAM8554 RNA, herein designated GAM RNA, also designated SEQ ID:388.

Another function of GAM8554 is therefore inhibition of LOC284999 (Accession XP_211728.1). Accordingly, utilities of GAM8554 include diagnosis, prevention and treatment of diseases and clinical conditions associated with LOC284999.

LOC285281 (Accession XP_211829.1) is another GAM8554 target gene, herein designated TARGET GENE. LOC285281 BINDING SITE is a target binding site found in the 5' untranslated region of mRNA encoded by LOC285281, corresponding to a target binding site such as BINDING SITE I, BINDING SITE II or BINDING SITE III of FIG. 8. Table 4 illustrates the complementarity of the nucleotide sequences of LOC285281 BINDING SITE, designated SEQ ID:8759, to the nucleotide sequence of GAM8554 RNA, herein designated GAM RNA, also designated SEQ ID:388.

Another function of GAM8554 is therefore inhibition of LOC285281 (Accession XP_211829.1). Accordingly, utilities of GAM8554 include diagnosis, prevention and treatment of diseases and clinical conditions associated with LOC285281.

LOC285456 (Accession XP_209617.1) is another GAM8554 target gene, herein designated TARGET GENE. LOC285456 BINDING SITE is a target binding site found in the 5' untranslated region of mRNA encoded by LOC285456, corresponding to a target binding site such as BINDING SITE I, BINDING SITE II or BINDING SITE III of FIG. 8. Table 4 illustrates the complementarity of the nucleotide sequences of LOC285456 BINDING SITE, designated SEQ ID:683, to the nucleotide sequence of GAM8554 RNA, herein designated GAM RNA, also designated SEQ ID:388.

Another function of GAM8554 is therefore inhibition of LOC285456 (Accession XP_209617.1). Accordingly, utilities of GAM8554 include diagnosis, prevention and treatment of diseases and clinical conditions associated with LOC285456.

LOC285602 (Accession XP_209676.1) is another GAM8554 target gene, herein designated TARGET GENE. LOC285602 BINDING SITE is a target binding site found in the 5' untranslated region of mRNA encoded by LOC285602, corresponding to a target binding site such as BINDING SITE I, BINDING SITE II or BINDING SITE III of FIG. 8. Table 4 illustrates the complementarity of the nucleotide sequences of LOC285602 BINDING SITE, designated SEQ ID:7057, to the nucleotide sequence of GAM8554 RNA, herein designated GAM RNA, also designated SEQ ID:388.

Another function of GAM8554 is therefore inhibition of LOC285602 (Accession XP_209676.1). Accordingly, utilities of GAM8554 include diagnosis, prevention and treatment of diseases and clinical conditions associated with LOC285602.

LOC285727 (Accession XP_212000.1) is another GAM8554 target gene, herein designated TARGET GENE. LOC285727 BINDING SITE is a target binding site found in the 3' untranslated region of mRNA encoded by LOC285727, corresponding to a target binding site such as BINDING SITE I, BINDING SITE II or BINDING SITE III of FIG. 8. Table 4 illustrates the complementarity of the nucleotide sequences of LOC285727 BINDING SITE, designated SEQ ID:16880, to the nucleotide sequence of GAM8554 RNA, herein designated GAM RNA, also designated SEQ ID:388.

Another function of GAM8554 is therefore inhibition of LOC285727 (Accession XP_212000.1). Accordingly, utilities of GAM8554 include diagnosis, prevention and treatment of diseases and clinical conditions associated with LOC285727.

LOC285733 (Accession XP_212006.1) is another GAM8554 target gene, herein designated TARGET GENE. LOC285733 BINDING SITE is a target binding site found in the 3' untranslated region of mRNA encoded by LOC285733, corresponding to a target binding site such as BINDING SITE I, BINDING SITE II or BINDING SITE III of FIG. 8. Table 4 illustrates the complementarity of the nucleotide sequences of LOC285733 BINDING SITE, designated SEQ ID:18454, to the nucleotide sequence of GAM8554 RNA, herein designated GAM RNA, also designated SEQ ID:388.

Another function of GAM8554 is therefore inhibition of LOC285733 (Accession XP_212006.1). Accordingly, utilities of GAM8554 include diagnosis, prevention and treatment of diseases and clinical conditions associated with LOC285733.

LOC285779 (Accession XP_212016.1) is another GAM8554 target gene, herein designated TARGET GENE. LOC285779 BINDING SITE is a target binding site found in the 5' untranslated region of mRNA encoded by LOC285779, corresponding to a target binding site such as BINDING SITE I, BINDING SITE II or BINDING SITE III of FIG. 8. Table 4 illustrates the complementarity of the nucleotide sequences of LOC285779 BINDING SITE, designated SEQ ID:10046, to the nucleotide sequence of GAM8554 RNA, herein designated GAM RNA, also designated SEQ ID:388.

Another function of GAM8554 is therefore inhibition of LOC285779 (Accession XP_212016.1). Accordingly, utilities of GAM8554 include diagnosis, prevention and treatment of diseases and clinical conditions associated with LOC285779.

LOC285804 (Accession XP_212029.1) is another GAM8554 target gene, herein designated TARGET GENE. LOC285804 BINDING SITE is a target binding site found in the 5' untranslated region of mRNA encoded by LOC285804, corresponding to a target binding site such as BINDING SITE I, BINDING SITE II or BINDING SITE III of FIG. 8. Table 4 illustrates the complementarity of the nucleotide sequences of LOC285804 BINDING SITE, designated SEQ ID:15481, to the nucleotide sequence of GAM8554 RNA, herein designated GAM RNA, also designated SEQ ID:388.

Another function of GAM8554 is therefore inhibition of LOC285804 (Accession XP_212029.1). Accordingly, utilities of GAM8554 include diagnosis, prevention and treatment of diseases and clinical conditions associated with LOC285804.

LOC285833 (Accession XP_209790.1) is another GAM8554 target gene, herein designated TARGET GENE. LOC285833 BINDING SITE is a target binding site found in the 3' untranslated region of mRNA encoded by LOC285833, corresponding to a target binding site such as BINDING SITE I, BINDING SITE II or BINDING SITE III of FIG. 8. Table 4 illustrates the complementarity of the nucleotide sequences of LOC285833 BINDING SITE, designated SEQ ID:8045, to the nucleotide sequence of GAM8554 RNA, herein designated GAM RNA, also designated SEQ ID:388.

Another function of GAM8554 is therefore inhibition of LOC285833 (Accession XP_209790.1). Accordingly, utilities of GAM8554 include diagnosis, prevention and treatment of diseases and clinical conditions associated with LOC285833.

LOC285843 (Accession XP_212034.1) is another GAM8554 target gene, herein designated TARGET GENE. LOC285843 BINDING SITE is a target binding site found in the 5' untranslated region of mRNA encoded by LOC285843, corresponding to a target binding site such as BINDING SITE I, BINDING SITE II or BINDING SITE III of FIG. 8. Table 4 illustrates the complementarity of the nucleotide sequences of LOC285843 BINDING SITE, designated SEQ ID:2900, to the nucleotide sequence of GAM8554 RNA, herein designated GAM RNA, also designated SEQ ID:388.

Another function of GAM8554 is therefore inhibition of LOC285843 (Accession XP_212034.1). Accordingly, utilities of GAM8554 include diagnosis, prevention and treatment of diseases and clinical conditions associated with LOC285843.

LOC285946 (Accession XP_212103.1) is another GAM8554 target gene, herein designated TARGET GENE. LOC285946 BINDING SITE is a target binding site found in the 3' untranslated region of mRNA encoded by LOC285946, corresponding to a target binding site such as BINDING SITE I, BINDING SITE II or BINDING SITE III of FIG. 8. Table 4 illustrates the complementarity of the nucleotide sequences of LOC285946 BINDING SITE, designated SEQ ID:1695, to the nucleotide sequence of GAM8554 RNA, herein designated GAM RNA, also designated SEQ ID:388.

Another function of GAM8554 is therefore inhibition of LOC285946 (Accession XP_212103.1). Accordingly, utilities of GAM8554 include diagnosis, prevention and treatment of diseases and clinical conditions associated with LOC285946.

LOC286040 (Accession XP_209870.2) is another GAM8554 target gene, herein designated TARGET GENE. LOC286040 BINDING SITE is a target binding site found in the 5' untranslated region of mRNA encoded by LOC286040, corresponding to a target binding site such as BINDING SITE I, BINDING SITE II or BINDING SITE III of FIG. 8. Table 4 illustrates the complementarity of the nucleotide sequences of LOC286040 BINDING SITE, designated SEQ ID:11421, to the nucleotide sequence of GAM8554 RNA, herein designated GAM RNA, also designated SEQ ID:388.

Another function of GAM8554 is therefore inhibition of LOC286040 (Accession XP_209870.2). Accordingly, utilities of GAM8554 include diagnosis, prevention and treatment of diseases and clinical conditions associated with LOC286040.

LOC286258 (Accession XP_209972.1) is another GAM8554 target gene, herein designated TARGET GENE. LOC286258 BINDING SITE is a target binding site found in the 3' untranslated region of mRNA encoded by LOC286258, corresponding to a target binding site such as BINDING SITE I, BINDING SITE II or BINDING SITE III of FIG. 8. Table 4 illustrates the complementarity of the nucleotide sequences of LOC286258 BINDING SITE, designated SEQ ID:15299, to the nucleotide sequence of GAM8554 RNA, herein designated GAM RNA, also designated SEQ ID:388.

Another function of GAM8554 is therefore inhibition of LOC286258 (Accession XP_209972.1). Accordingly, utilities of GAM8554 include diagnosis, prevention and treatment of diseases and clinical conditions associated with LOC286258.

LOC286374 (Accession XP_212293.1) is another GAM8554 target gene, herein designated TARGET GENE. LOC286374 BINDING SITE is a target binding site found in the 5' untranslated region of mRNA encoded by LOC286374, corresponding to a target binding site such as BINDING SITE I, BINDING SITE II or BINDING SITE III of FIG. 8. Table 4 illustrates the complementarity of the nucleotide sequences of LOC286374 BINDING SITE, designated SEQ ID:10194, to the nucleotide sequence of GAM8554 RNA, herein designated GAM RNA, also designated SEQ ID:388.

Another function of GAM8554 is therefore inhibition of LOC286374 (Accession XP_212293.1). Accordingly, utilities of GAM8554 include diagnosis, prevention and treatment of diseases and clinical conditions associated with LOC286374.

LOC286380 (Accession XP_208412.1) is another GAM8554 target gene, herein designated TARGET GENE. LOC286380 BINDING SITE is a target binding site found in the 5' untranslated region of mRNA encoded by LOC286380, corresponding to a target binding site such as BINDING SITE I, BINDING SITE II or BINDING SITE III of FIG. 8. Table 4 illustrates the complementarity of the nucleotide sequences of LOC286380 BINDING SITE, designated SEQ ID:867, to the nucleotide sequence of GAM8554 RNA, herein designated GAM RNA, also designated SEQ ID:388.

Another function of GAM8554 is therefore inhibition of LOC286380 (Accession XP_208412.1). Accordingly, utilities of GAM8554 include diagnosis, prevention and treatment of diseases and clinical conditions associated with LOC286380.

LOC338682 (Accession XP_290521.1) is another GAM8554 target gene, herein designated TARGET GENE. LOC338682 BINDING SITE is a target binding site found in the 3' untranslated region of mRNA encoded by LOC338682, corresponding to a target binding site such as BINDING SITE I, BINDING SITE II or BINDING SITE III of FIG. 8. Table 4 illustrates the complementarity of the nucleotide sequences of LOC338682 BINDING SITE, designated SEQ ID:10670, to the nucleotide sequence of GAM8554 RNA, herein designated GAM RNA, also designated SEQ ID:388.

Another function of GAM8554 is therefore inhibition of LOC338682 (Accession XP_290521.1). Accordingly, utilities of GAM8554 include diagnosis, prevention and treatment of diseases and clinical conditions associated with LOC338682.

LOC339483 (Accession NP_848641.1) is another GAM8554 target gene, herein designated TARGET GENE. LOC339483 BINDING SITE is a target binding site found in the 3' untranslated region of multiple transcripts of mRNA encoded by LOC339483, corresponding to a target binding site such as BINDING SITE I, BINDING SITE II or BINDING SITE III of FIG. 8. Table 4 illustrates the complementarity of the nucleotide sequences of LOC339483 BINDING SITE, designated SEQ ID:10107, to the nucleotide sequence of GAM8554 RNA, herein designated GAM RNA, also designated SEQ ID:388.

Another function of GAM8554 is therefore inhibition of LOC339483 (Accession NP_848641.1). Accordingly, utilities of GAM8554 include diagnosis, prevention and treatment of diseases and clinical conditions associated with LOC339483.

LOC339883 (Accession XP_291056.2) is another GAM8554 target gene, herein designated TARGET GENE. LOC339883 BINDING SITE is a target binding site found in the 5' untranslated region of mRNA encoded by LOC339883, corresponding to a target binding site such as BINDING SITE I, BINDING SITE II or BINDING SITE III of FIG. 8. Table 4 illustrates the complementarity of the nucleotide sequences of LOC339883 BINDING SITE, designated SEQ ID:9637, to the nucleotide sequence of GAM8554 RNA, herein designated GAM RNA, also designated SEQ ID:388.

Another function of GAM8554 is therefore inhibition of LOC339883 (Accession XP_291056.2). Accordingly, utilities of GAM8554 include diagnosis, prevention and treatment of diseases and clinical conditions associated with LOC339883.

LOC340319 (Accession XP_295216.1) is another GAM8554 target gene, herein designated TARGET GENE. LOC340319 BINDING SITE is a target binding site found in the 5' untranslated region of mRNA encoded by LOC340319, corresponding to a target binding site such as BINDING SITE I, BINDING SITE II or BINDING SITE III of FIG. 8. Table 4 illustrates the complementarity of the nucleotide sequences of LOC340319 BINDING SITE, designated SEQ ID:4660, to the nucleotide sequence of GAM8554 RNA, herein designated GAM RNA, also designated SEQ ID:388.

Another function of GAM8554 is therefore inhibition of LOC340319 (Accession XP_295216.1). Accordingly, utilities of GAM8554 include diagnosis, prevention and treatment of diseases and clinical conditions associated with LOC340319.

LOC340390 (Accession XP_291269.1) is another GAM8554 target gene, herein designated TARGET GENE. LOC340390 BINDING SITE is a target binding site found in the 5' untranslated region of mRNA encoded by LOC340390, corresponding to a target binding site such as BINDING SITE I, BINDING SITE II or BINDING SITE III of FIG. 8. Table 4 illustrates the complementarity of the nucleotide sequences of LOC340390 BINDING SITE, designated SEQ ID:2836, to the nucleotide sequence of GAM8554 RNA, herein designated GAM RNA, also designated SEQ ID:388.

Another function of GAM8554 is therefore inhibition of LOC340390 (Accession XP_291269.1). Accordingly, utilities of GAM8554 include diagnosis, prevention and treatment of diseases and clinical conditions associated with LOC340390.

LOC348428 (Accession XP_302753.1) is another GAM8554 target gene, herein designated TARGET GENE. LOC348428 BINDING SITE is a target binding site found in the 5' untranslated region of mRNA encoded by LOC348428, corresponding to a target binding site such as BINDING SITE I, BINDING SITE II or BINDING SITE III of FIG. 8. Table 4 illustrates the complementarity of the nucleotide sequences of LOC348428 BINDING SITE, designated SEQ ID:2990, to the nucleotide sequence of GAM8554 RNA, herein designated GAM RNA, also designated SEQ ID:388.

Another function of GAM8554 is therefore inhibition of LOC348428 (Accession XP_302753.1). Accordingly, utilities of GAM8554 include diagnosis, prevention and treatment of diseases and clinical conditions associated with LOC348428.

LOC348797 (Accession XP_302888.1) is another GAM8554 target gene, herein designated TARGET GENE. LOC348797 BINDING SITE is a target binding site found in the 3' untranslated region of mRNA encoded by LOC348797, corresponding to a target binding site such as BINDING SITE I, BINDING SITE II or BINDING SITE III of FIG. 8. Table 4 illustrates the complementarity of the nucleotide sequences of LOC348797 BINDING SITE, designated SEQ ID:1312, to the nucleotide sequence of GAM8554 RNA, herein designated GAM RNA, also designated SEQ ID:388.

Another function of GAM8554 is therefore inhibition of LOC348797 (Accession XP_302888.1). Accordingly, utilities of GAM8554 include diagnosis, prevention and treatment of diseases and clinical conditions associated with LOC348797.

LOC349192 (Accession XP_300973.1) is another GAM8554 target gene, herein designated TARGET GENE. LOC349192 BINDING SITE is a target binding site found in the 5' untranslated region of mRNA encoded by LOC349192, corresponding to a target binding site such as BINDING SITE I, BINDING SITE II or BINDING SITE III of FIG. 8. Table 4 illustrates the complementarity of the nucleotide sequences of LOC349192 BINDING SITE, designated SEQ ID:13730, to the nucleotide sequence of GAM8554 RNA, herein designated GAM RNA, also designated SEQ ID:388.

Another function of GAM8554 is therefore inhibition of LOC349192 (Accession XP_300973.1). Accordingly, utilities of GAM8554 include diagnosis, prevention and treatment of diseases and clinical conditions associated with LOC349192.

LOC349308 (Accession XP_302590.1) is another GAM8554 target gene, herein designated TARGET GENE. LOC349308 BINDING SITE is a target binding site found in the 5' untranslated region of mRNA encoded by LOC349308, corresponding to a target binding site such as BINDING SITE I, BINDING SITE II or BINDING SITE III of FIG. 8. Table 4 illustrates the complementarity of the nucleotide sequences of LOC349308 BINDING SITE, designated SEQ ID:8798, to the nucleotide sequence of GAM8554 RNA, herein designated GAM RNA, also designated SEQ ID:388.

Another function of GAM8554 is therefore inhibition of LOC349308 (Accession XP_302590.1). Accordingly, utilities of GAM8554 include diagnosis, prevention and treatment of diseases and clinical conditions associated with LOC349308.

LOC349318 (Accession XP_300480.1) is another GAM8554 target gene, herein designated TARGET GENE. LOC349318 BINDING SITE is a target binding site found in the 5' untranslated region of mRNA encoded by LOC349318, corresponding to a target binding site such as BINDING SITE I, BINDING SITE II or BINDING SITE III of FIG. 8. Table 4 illustrates the complementarity of the nucleotide sequences of LOC349318 BINDING SITE, designated SEQ ID:867, to the nucleotide sequence of GAM8554 RNA, herein designated GAM RNA, also designated SEQ ID:388.

Another function of GAM8554 is therefore inhibition of LOC349318 (Accession XP_300480.1). Accordingly, utilities of GAM8554 include diagnosis, prevention and treatment of diseases and clinical conditions associated with LOC349318.

LOC349334 (Accession XP_300488.1) is another GAM8554 target gene, herein designated TARGET GENE. LOC349334 BINDING SITE is a target binding site found in the 5' untranslated region of mRNA encoded by LOC349334, corresponding to a target binding site such as BINDING SITE I, BINDING SITE II or BINDING SITE III of FIG. 8. Table 4 illustrates the complementarity of the nucleotide sequences of LOC349334 BINDING SITE, designated SEQ ID:867, to the nucleotide sequence of GAM8554 RNA, herein designated GAM RNA, also designated SEQ ID:388.

Another function of GAM8554 is therefore inhibition of LOC349334 (Accession XP_300488.1). Accordingly, utilities of GAM8554 include diagnosis, prevention and treatment of diseases and clinical conditions associated with LOC349334.

LOC349466 (Accession XP_303269.1) is another GAM8554 target gene, herein designated TARGET GENE. LOC349466 BINDING SITE is a target binding site found in the 5' untranslated region of mRNA encoded by LOC349466, corresponding to a target binding site such as BINDING SITE I, BINDING SITE II or BINDING SITE III of FIG. 8. Table 4 illustrates the complementarity of the nucleotide sequences of LOC349466 BINDING SITE, designated SEQ ID:7281, to the nucleotide sequence of GAM8554 RNA, herein designated GAM RNA, also designated SEQ ID:388.

Another function of GAM8554 is therefore inhibition of LOC349466 (Accession XP_303269.1). Accordingly, utilities of GAM8554 include diagnosis, prevention and treatment of diseases and clinical conditions associated with LOC349466.

LOC51161 (Accession NP_057294.1) is another GAM8554 target gene, herein designated TARGET GENE. LOC51161 BINDING SITE is a target binding site found in the 3' untranslated region of mRNA encoded by LOC51161, corresponding to a target binding site such as BINDING SITE I, BINDING SITE II or BINDING SITE III of FIG. 8. Table 4 illustrates the complementarity of the nucleotide sequences of LOC51161 BINDING SITE, designated SEQ ID:12236, to the nucleotide sequence of GAM8554 RNA, herein designated GAM RNA, also designated SEQ ID:388.

Another function of GAM8554 is therefore inhibition of LOC51161 (Accession NP_057294.1). Accordingly, utilities of GAM8554 include diagnosis, prevention and treatment of diseases and clinical conditions associated with LOC51161.

LOC90268 (Accession NP_612357.1) is another GAM8554 target gene, herein designated TARGET GENE. LOC90268 BINDING SITE is a target binding site found in the 3' untranslated region of mRNA encoded by LOC90268, corresponding to a target binding site such as BINDING SITE I, BINDING SITE II or BINDING SITE III of FIG. 8. Table 4 illustrates the complementarity of the nucleotide sequences of LOC90268 BINDING SITE, designated SEQ ID:12418, to the nucleotide sequence of GAM8554 RNA, herein designated GAM RNA, also designated SEQ ID:388.

Another function of GAM8554 is therefore inhibition of LOC90268 (Accession NP_612357.1). Accordingly, utilities of GAM8554 include diagnosis, prevention and treatment of diseases and clinical conditions associated with LOC90268.

LOC90499 (Accession XP_032170.1) is another GAM8554 target gene, herein designated TARGET GENE. LOC90499 BINDING SITE is a target binding site found in the 3' untranslated region of mRNA encoded by LOC90499, corresponding to a target binding site such as BINDING SITE I, BINDING SITE II or BINDING SITE III of FIG. 8. Table 4 illustrates the complementarity of the nucleotide sequences of LOC90499 BINDING SITE, designated SEQ ID:2928, to the nucleotide sequence of GAM8554 RNA, herein designated GAM RNA, also designated SEQ ID:388.

Another function of GAM8554 is therefore inhibition of LOC90499 (Accession XP_032170.1). Accordingly, utilities of GAM8554 include diagnosis, prevention and treatment of diseases and clinical conditions associated with LOC90499.

Lysyl oxidase-like 3 (LOXL3, Accession NP_115992.1) is another GAM8554 target gene, herein designated TARGET GENE. LOXL3 BINDING SITE is a target binding site found in the 3' untranslated region of mRNA encoded by LOXL3, corresponding to a target binding site such as BINDING SITE I, BINDING SITE II or BINDING SITE III of FIG. 8. Table 4 illustrates the complementarity of the nucleotide sequences of LOXL3 BINDING SITE, designated SEQ ID:11442, to the nucleotide sequence of GAM8554 RNA, herein designated GAM RNA, also designated SEQ ID:388.

Another function of GAM8554 is therefore inhibition of Lysyl oxidase-like 3 (LOXL3, Accession NP_115992.1), a gene which is expressed in many tissues, the highest levels seen in placenta, heart, ovary, testis, small intestine and spleen. Accordingly, utilities of GAM8554 include diagnosis, prevention and treatment of diseases and clinical conditions associated with LOXL3.

The function of LOXL3 and its association with various diseases and clinical conditions, has been established by previous studies, as described hereinabove with reference to GAM664.2. LPHN1 (Accession NP_055736.1) is another GAM8554 target gene, herein designated TARGET GENE. LPHN1 BINDING SITE is a target binding site found in the 3' untranslated region of mRNA encoded by LPHN1, corresponding to a target binding site such as BINDING SITE I, BINDING SITE II or BINDING SITE III of FIG. 8. Table 4 illustrates the complementarity of the nucleotide sequences of LPHN1 BINDING SITE, designated SEQ ID:7496, to the nucleotide sequence of GAM8554 RNA, herein designated GAM RNA, also designated SEQ ID:388.

Another function of GAM8554 is therefore inhibition of LPHN1 (Accession NP_055736.1). Accordingly, utilities of GAM8554 include diagnosis, prevention and treatment of diseases and clinical conditions associated with LPHN1.

LRRC8 (Accession XP_026998.2) is another GAM8554 target gene, herein designated TARGET GENE. LRRC8 BINDING SITE is a target binding site found in the 3' untranslated region of mRNA encoded by LRRC8, corresponding to a target binding site such as BINDING SITE I, BINDING SITE II or BINDING SITE III of FIG. 8. Table 4 illustrates the complementarity of the nucleotide sequences of LRRC8 BINDING SITE, designated SEQ ID:14275, to the nucleotide sequence of GAM8554 RNA, herein designated GAM RNA, also designated SEQ ID:388.

Another function of GAM8554 is therefore inhibition of LRRC8 (Accession XP_026998.2). Accordingly, utilities of GAM8554 include diagnosis, prevention and treatment of diseases and clinical conditions associated with LRRC8.

LYK5 (Accession NP_699166.1) is another GAM8554 target gene, herein designated TARGET GENE. LYK5 BINDING SITE is a target binding site found in the 3' untranslated region of mRNA encoded by LYK5, corresponding to a target binding site such as BINDING SITE I, BINDING SITE II or BINDING SITE III of FIG. 8. Table 4 illustrates the complementarity of the nucleotide sequences of LYK5 BINDING SITE, designated SEQ ID:15716, to the nucleotide sequence of GAM8554 RNA, herein designated GAM RNA, also designated SEQ ID:388.

Another function of GAM8554 is therefore inhibition of LYK5 (Accession NP_699166.1). Accordingly, utilities of GAM8554 include diagnosis, prevention and treatment of diseases and clinical conditions associated with LYK5.

Mad, mothers against decapentaplegic homolog 9 (drosophila) (MADH9, Accession NP_005896.1) is another GAM8554 target gene, herein designated TARGET GENE. MADH9 BINDING SITE is a target binding site found in the 5' untranslated region of mRNA encoded by MADH9, corresponding to a target binding site such as BINDING SITE I, BINDING SITE II or BINDING SITE III of FIG. 8. Table 4 illustrates the complementarity of the nucleotide sequences of MADH9 BINDING SITE, designated SEQ ID:15488, to the nucleotide sequence of GAM8554 RNA, herein designated GAM RNA, also designated SEQ ID:388.

Another function of GAM8554 is therefore inhibition of Mad, mothers against decapentaplegic homolog 9 (drosophila) (MADH9, Accession NP_005896.1). Accordingly, utilities of GAM8554 include diagnosis, prevention and treatment of diseases and clinical conditions associated with MADH9.

Mitogen-activated protein kinase kinase 1 interacting protein 1 (MAP2K1IP1, Accession NP_068805.1) is another GAM8554 target gene, herein designated TARGET GENE. MAP2K1IP1 BINDING SITE is a target binding site found in the 3' untranslated region of mRNA encoded by MAP2K1IP1, corresponding to a target binding site such as BINDING SITE I, BINDING SITE II or BINDING SITE III of FIG. 8. Table 4 illustrates the complementarity of the nucleotide sequences of MAP2K1IP1 BINDING SITE, designated SEQ ID:5192, to the nucleotide sequence of GAM8554 RNA, herein designated GAM RNA, also designated SEQ ID:388.

Another function of GAM8554 is therefore inhibition of Mitogen-activated protein kinase kinase 1 interacting protein 1 (MAP2K1IP1, Accession NP_068805.1). Accordingly, utilities of GAM8554 include diagnosis, prevention and treatment of diseases and clinical conditions associated with MAP2K1IP1.

Mitogen-activated protein kinase kinase kinase 8 (MAP3K8, Accession NP_005195.2) is another GAM8554 target gene, herein designated TARGET GENE. MAP3K8 BINDING SITE is a target binding site found in the 3' untranslated region of mRNA encoded by MAP3K8, corresponding to a target binding site such as BINDING SITE I, BINDING SITE II or BINDING SITE III of FIG. 8. Table 4 illustrates the complementarity of the nucleotide sequences of MAP3K8 BINDING SITE, designated SEQ ID:13588, to the nucleotide sequence of GAM8554 RNA, herein designated GAM RNA, also designated SEQ ID:388.

Another function of GAM8554 is therefore inhibition of Mitogen-activated protein kinase kinase kinase 8 (MAP3K8, Accession NP_005195.2), a gene which is able to activate nf-kappa-b 1 by stimulating proteasome-mediated p. Accordingly, utilities of GAM8554 include diagnosis, prevention and treatment of diseases and clinical conditions associated with MAP3K8.

The function of MAP3K8 and its association with various diseases and clinical conditions, has been established by previous studies, as described hereinabove with reference to GAM55.1. Mcm3 minichromosome maintenance deficient 3 (s. cerevisiae) associated protein, antisense (MCM3APAS, Accession NP_060588.1) is another GAM8554 target gene, herein designated TARGET GENE. MCM3APAS BINDING SITE is a target binding site found in the 3' untranslated region of mRNA encoded by MCM3APAS, corresponding to a target binding site such as BINDING SITE I, BINDING SITE II or BINDING SITE III of FIG. 8. Table 4 illustrates the complementarity of the nucleotide sequences of MCM3APAS BINDING SITE, designated SEQ ID:5637, to the nucleotide sequence of GAM8554 RNA, herein designated GAM RNA, also designated SEQ ID:388.

Another function of GAM8554 is therefore inhibition of Mcm3 minichromosome maintenance deficient 3 (s. cerevisiae) associated protein, antisense (MCM3APAS, Accession NP_060588.1). Accordingly, utilities of GAM8554 include diagnosis, prevention and treatment of diseases and clinical conditions associated with MCM3APAS.

Microfibrillar-associated protein 3 (MFAP3, Accession NP_005918.1) is another GAM8554 target gene, herein designated TARGET GENE. MFAP3 BINDING SITE is a target binding site found in the 5' untranslated region of mRNA encoded by MFAP3, corresponding to a target binding site such as BINDING SITE I, BINDING SITE II or BINDING SITE III of FIG. 8. Table 4 illustrates the complementarity of the nucleotide sequences of MFAP3 BINDING SITE, designated SEQ ID:18666, to the nucleotide sequence of GAM8554 RNA, herein designated GAM RNA, also designated SEQ ID:388.

Another function of GAM8554 is therefore inhibition of Microfibrillar-associated protein 3 (MFAP3, Accession NP_005918.1). Accordingly, utilities of GAM8554 include diagnosis, prevention and treatment of diseases and clinical conditions associated with MFAP3.

MGC29898 (Accession NP_659485.1) is another GAM8554 target gene, herein designated TARGET GENE. MGC29898 BINDING SITE is a target binding site found in the 3' untranslated region of mRNA encoded by MGC29898, corresponding to a target binding site such as BINDING SITE I, BINDING SITE II or BINDING SITE III of FIG. 8. Table 4 illustrates the complementarity of the nucleotide sequences of MGC29898 BINDING SITE, designated SEQ ID:817, to the nucleotide sequence of GAM8554 RNA, herein designated GAM RNA, also designated SEQ ID:388.

Another function of GAM8554 is therefore inhibition of MGC29898 (Accession NP_659485.1). Accordingly, utilities of GAM8554 include diagnosis, prevention and treatment of diseases and clinical conditions associated with MGC29898.

MGC3101 (Accession NP_076948.1) is another GAM8554 target gene, herein designated TARGET GENE. MGC3101 BINDING SITE is a target binding site found in the 3' untranslated region of mRNA encoded by MGC3101, corresponding to a target binding site such as BINDING SITE I, BINDING SITE II or BINDING SITE III of FIG. 8. Table 4 illustrates the complementarity of the nucleotide sequences of MGC3101 BINDING SITE, designated SEQ ID:10658, to the nucleotide sequence of GAM8554 RNA, herein designated GAM RNA, also designated SEQ ID:388.

Another function of GAM8554 is therefore inhibition of MGC3101 (Accession NP_076948.1). Accordingly, utilities of GAM8554 include diagnosis, prevention and treatment of diseases and clinical conditions associated with MGC3101.

MGC3234 (Accession NP_076436.2) is another GAM8554 target gene, herein designated TARGET GENE. MGC3234 BINDING SITE is a target binding site found in the 3' untranslated region of mRNA encoded by MGC3234, corresponding to a target binding site such as BINDING SITE I, BINDING SITE II or BINDING SITE III of FIG. 8. Table 4 illustrates the complementarity of the nucleotide sequences of MGC3234 BINDING SITE, designated SEQ ID:4854, to the nucleotide sequence of GAM8554 RNA, herein designated GAM RNA, also designated SEQ ID:388.

Another function of GAM8554 is therefore inhibition of MGC3234 (Accession NP_076436.2). Accordingly, utilities of GAM8554 include diagnosis, prevention and treatment of diseases and clinical conditions associated with MGC3234.

MGC35048 (Accession NP_694940.1) is another GAM8554 target gene, herein designated TARGET GENE. MGC35048 BINDING SITE is a target binding site found in the 5' untranslated region of mRNA encoded by MGC35048, corresponding to a target binding site such as BINDING SITE I, BINDING SITE II or BINDING SITE III of FIG. 8. Table 4 illustrates the complementarity of the nucleotide sequences of MGC35048 BINDING SITE, designated SEQ ID:13468, to the nucleotide sequence of GAM8554 RNA, herein designated GAM RNA, also designated SEQ ID:388.

Another function of GAM8554 is therefore inhibition of MGC35048 (Accession NP_694940.1). Accordingly, utilities of GAM8554 include diagnosis, prevention and treatment of diseases and clinical conditions associated with MGC35048.

MGC7036 (Accession NP_659495.1) is another GAM8554 target gene, herein designated TARGET GENE. MGC7036 BINDING SITE is a target binding site found in the 3' untranslated region of mRNA encoded by MGC7036, corresponding to a target binding site such as BINDING SITE I, BINDING SITE II or BINDING SITE III of FIG. 8. Table 4 illustrates the complementarity of the nucleotide sequences of MGC7036 BINDING SITE, designated SEQ ID:14389, to the nucleotide sequence of GAM8554 RNA, herein designated GAM RNA, also designated SEQ ID:388.

Another function of GAM8554 is therefore inhibition of MGC7036 (Accession NP_659495.1). Accordingly, utilities of GAM8554 include diagnosis, prevention and treatment of diseases and clinical conditions associated with MGC7036.

Membrane metallo-endopeptidase (neutral endopeptidase, enkephalinase, calla, cd10) (MME, Accession NP_009218.1) is another GAM8554 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:10848, to the nucleotide sequence of GAM8554 RNA, herein designated GAM RNA, also designated SEQ ID:388.

Another function of GAM8554 is therefore inhibition of Membrane metallo-endopeptidase (neutral endopeptidase, enkephalinase, calla, cd10) (MME, Accession NP_009218.1), a gene which is thermolysin-like specificity. and therefore is associated with Acute lymphocytic leukemia. Accordingly, utilities of GAM8554 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_009220.1) is another GAM8554 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:10848, to the nucleotide sequence of GAM8554 RNA, herein designated GAM RNA, also designated SEQ ID:388.

Another function of GAM8554 is therefore inhibition of Membrane metallo-endopeptidase (neutral endopeptidase, enkephalinase, calla, cd10) (MME, Accession NP_009220.1), a gene which is thermolysin-like specificity. and therefore is associated with Acute lymphocytic leukemia. Accordingly, utilities of GAM8554 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_000893.1) is another GAM8554 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:10848, to the nucleotide sequence of GAM8554 RNA, herein designated GAM RNA, also designated SEQ ID:388.

Another function of GAM8554 is therefore inhibition of Membrane metallo-endopeptidase (neutral endopeptidase, enkephalinase, calla, cd10) (MME, Accession NP_000893.1), a gene which is thermolysin-like specificity. and therefore is associated with Acute lymphocytic leukemia. Accordingly, utilities of GAM8554 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Membrane metallo-endopeptidase (neutral endopeptidase, enkephalinase, calla, cd10) (MME, Accession NP_009219.1) is another GAM8554 target gene, herein designated TARGET GENE. MME BINDING SITE is a target binding site found in the 3' untranslated region of multiple transcripts of mRNA encoded by MME, corresponding to a target binding site such as BINDING SITE I, BINDING SITE II or BINDING SITE III of FIG. 8. Table 4 illustrates the complementarity of the nucleotide sequences of MME BINDING SITE, designated SEQ ID:10848, to the nucleotide sequence of GAM8554 RNA, herein designated GAM RNA, also designated SEQ ID:388.

Another function of GAM8554 is therefore inhibition of Membrane metallo-endopeptidase (neutral endopeptidase, enkephalinase, calla, cd10) (MME, Accession NP_009219.1), a gene which is thermolysin-like specificity. and therefore is associated with Acute lymphocytic leukemia. Accordingly, utilities of GAM8554 include diagnosis, prevention and treatment of Acute lymphocytic leukemia, and of other diseases and clinical conditions associated with MME.

The function of MME and its association with various diseases and clinical conditions, has been established by previous studies, as described hereinabove with reference to GAM63.1. Msh homeo box homolog 2 (drosophila) (MSX2, Accession NP_002440.2) is another GAM8554 target gene, herein designated TARGET GENE. MSX2 BINDING SITE is a target binding site found in the 3' untranslated region of mRNA encoded by MSX2, corresponding to a target binding site such as BINDING SITE I, BINDING SITE II or BINDING SITE III of FIG. 8. Table 4 illustrates the complementarity of the nucleotide sequences of MSX2 BINDING SITE, designated SEQ ID:14467, to the nucleotide sequence of GAM8554 RNA, herein designated GAM RNA, also designated SEQ ID:388.

Another function of GAM8554 is therefore inhibition of Msh homeo box homolog 2 (drosophila) (MSX2, Accession NP_002440.2). Accordingly, utilities of GAM8554 include diagnosis, prevention and treatment of diseases and clinical conditions associated with MSX2.

C-myc binding protein (MYCBP, Accession NP_036465.1) is another GAM8554 target gene, herein designated TARGET GENE. MYCBP BINDING SITE is a target binding site found in the 3' untranslated region of mRNA encoded by MYCBP, corresponding to a target binding site such as BINDING SITE I, BINDING SITE II or BINDING SITE III of FIG. 8. Table 4 illustrates the complementarity of the nucleotide sequences of MYCBP BINDING SITE, designated SEQ ID:6531, to the nucleotide sequence of GAM8554 RNA, herein designated GAM RNA, also designated SEQ ID:388.

Another function of GAM8554 is therefore inhibition of C-myc binding protein (MYCBP, Accession NP_036465.1), a gene which binds c-Myc stimulating the activation of E-box-dependent transcription. Accordingly, utilities of GAM8554 include diagnosis, prevention and treatment of diseases and clinical conditions associated with MYCBP.

The function of MYCBP and its association with various diseases and clinical conditions, has been established by previous studies, as described hereinabove with reference to GAM378.2. Neuroligin 4 (NLGN4, Accession NP_065793.1) is another GAM8554 target gene, herein designated TARGET GENE. NLGN4 BINDING SITE is a target binding site found in the 5' untranslated region of multiple transcripts of mRNA encoded by NLGN4, corresponding to a target binding site such as BINDING SITE I, BINDING SITE II or BINDING SITE III of FIG. 8. Table 4 illustrates the complementarity of the nucleotide sequences of NLGN4 BINDING SITE, designated SEQ ID:425, to the nucleotide sequence of GAM8554 RNA, herein designated GAM RNA, also designated SEQ ID:388.

Another function of GAM8554 is therefore inhibition of Neuroligin 4 (NLGN4, Accession NP_065793.1). Accordingly, utilities of GAM8554 include diagnosis, prevention and treatment of diseases and clinical conditions associated with NLGN4.

Neuroligin 4 (NLGN4, Accession NP_851849.1) is another GAM8554 target gene, herein designated TARGET GENE. NLGN4 BINDING SITE is a target binding site found in the 5' untranslated region of multiple transcripts of mRNA encoded by NLGN4, corresponding to a target binding site such as BINDING SITE I, BINDING SITE II or BINDING SITE III of FIG. 8. Table 4 illustrates the complementarity of the nucleotide sequences of NLGN4 BINDING SITE, designated SEQ ID:425, to the nucleotide sequence of GAM8554 RNA, herein designated GAM RNA, also designated SEQ ID:388.

Another function of GAM8554 is therefore inhibition of Neuroligin 4 (NLGN4, Accession NP_851849.1). Accordingly, utilities of GAM8554 include diagnosis, prevention and treatment of diseases and clinical conditions associated with NLGN4.

P5326 (Accession NP_113638.1) is another GAM8554 target gene, herein designated TARGET GENE. P5326 BINDING SITE is a target binding site found in the 3' untranslated region of mRNA encoded by P5326, corresponding to a target binding site such as BINDING SITE I, BINDING SITE II or BINDING SITE III of FIG. 8. Table 4 illustrates the complementarity of the nucleotide sequences of P5326 BINDING SITE, designated SEQ ID:7667, to the nucleotide sequence of GAM8554 RNA, herein designated GAM RNA, also designated SEQ ID:388.

Another function of GAM8554 is therefore inhibition of P5326 (Accession NP_113638.1). Accordingly, utilities of GAM8554 include diagnosis, prevention and treatment of diseases and clinical conditions associated with P5326.

PACAP (Accession NP_057543.1) is another GAM8554 target gene, herein designated TARGET GENE. PACAP BINDING SITE is a target binding site found in the 5' untranslated region of mRNA encoded by PACAP, corresponding to a target binding site such as BINDING SITE I, BINDING SITE II or BINDING SITE III of FIG. 8. Table 4 illustrates the complementarity of the nucleotide sequences of PACAP BINDING SITE, designated SEQ ID:19792, to the nucleotide sequence of GAM8554 RNA, herein designated GAM RNA, also designated SEQ ID:388.

Another function of GAM8554 is therefore inhibition of PACAP (Accession NP_057543.1). Accordingly, utilities of GAM8554 include diagnosis, prevention and treatment of diseases and clinical conditions associated with PACAP.

Programmed cell death 2 (PDCD2, Accession NP_659005.1) is another GAM8554 target gene, herein designated TARGET GENE. PDCD2 BINDING SITE is a target binding site found in the 3' untranslated region of multiple transcripts of mRNA encoded by PDCD2, corresponding to a target binding site such as BINDING SITE I, BINDING SITE II or BINDING SITE III of FIG. 8. Table 4 illustrates the complementarity of the nucleotide sequences of PDCD2 BINDING SITE, designated SEQ ID:11383, to the nucleotide sequence of GAM8554 RNA, herein designated GAM RNA, also designated SEQ ID:388.

Another function of GAM8554 is therefore inhibition of Programmed cell death 2 (PDCD2, Accession NP_659005.1), a gene which may be a dna-binding protein with a regulatory function. Accordingly, utilities of GAM8554 include diagnosis, prevention and treatment of diseases and clinical conditions associated with PDCD2.

The function of PDCD2 and its association with various diseases and clinical conditions, has been established by previous studies, as described hereinabove with reference to GAM451.1. PEPP3 (Accession NP_055750.1) is another GAM8554 target gene, herein designated TARGET GENE. PEPP3 BINDING SITE is a target binding site found in the 3' untranslated region of mRNA encoded by PEPP3, corresponding to a target binding site such as BINDING SITE I, BINDING SITE II or BINDING SITE III of FIG. 8. Table 4 illustrates the complementarity of the nucleotide sequences of PEPP3 BINDING SITE, designated SEQ ID:1056, to the nucleotide sequence of GAM8554 RNA, herein designated GAM RNA, also designated SEQ ID:388.

Another function of GAM8554 is therefore inhibition of PEPP3 (Accession NP_055750.1). Accordingly, utilities of GAM8554 include diagnosis, prevention and treatment of diseases and clinical conditions associated with PEPP3.

Phosphatidylserine decarboxylase (PISD, Accession NP_055153.1) is another GAM8554 target gene, herein designated TARGET GENE. PISD BINDING SITE is a target binding site found in the 5' untranslated region of mRNA encoded by PISD, corresponding to a target binding site such as BINDING SITE I, BINDING SITE II or BINDING SITE III of FIG. 8. Table 4 illustrates the complementarity of the nucleotide sequences of PISD BINDING SITE, designated SEQ ID:1719, to the nucleotide sequence of GAM8554 RNA, herein designated GAM RNA, also designated SEQ ID:388.

Another function of GAM8554 is therefore inhibition of Phosphatidylserine decarboxylase (PISD, Accession NP_055153.1). Accordingly, utilities of GAM8554 include diagnosis, prevention and treatment of diseases and clinical conditions associated with PISD.

PLPL (Accession NP_064566.1) is another GAM8554 target gene, herein designated TARGET GENE. PLPL BINDING SITE is a target binding site found in the 3' untranslated region of mRNA encoded by PLPL, corresponding to a target binding site such as BINDING SITE I, BINDING SITE II or BINDING SITE III of FIG. 8. Table 4 illustrates the complementarity of the nucleotide sequences of PLPL BINDING SITE, designated SEQ ID:5391, to the nucleotide sequence of GAM8554 RNA, herein designated GAM RNA, also designated SEQ ID:388.

Another function of GAM8554 is therefore inhibition of PLPL (Accession NP_064566.1). Accordingly, utilities of GAM8554 include diagnosis, prevention and treatment of diseases and clinical conditions associated with PLPL.

Plexin b1 (PLXNB1, Accession NP_002664.1) is another GAM8554 target gene, herein designated TARGET GENE. PLXNB1 BINDING SITE is a target binding site found in the 3' untranslated region of mRNA encoded by PLXNB1, corresponding to a target binding site such as BINDING SITE I, BINDING SITE II or BINDING SITE III of FIG. 8. Table 4 illustrates the complementarity of the nucleotide sequences of PLXNB1 BINDING SITE, designated SEQ ID:15214, to the nucleotide sequence of GAM8554 RNA, herein designated GAM RNA, also designated SEQ ID:388.

Another function of GAM8554 is therefore inhibition of Plexin b1 (PLXNB1, Accession NP_002664.1). Accordingly, utilities of GAM8554 include diagnosis, prevention and treatment of diseases and clinical conditions associated with PLXNB1.

Peroxisome proliferative activated receptor, delta (PPARD, Accession NP_006229.1) is another GAM8554 target gene, herein designated TARGET GENE. PPARD BINDING SITE is a target binding site found in the 3' untranslated region of multiple transcripts of mRNA encoded by PPARD, corresponding to a target binding site such as BINDING SITE I, BINDING SITE II or BINDING SITE III of FIG. 8. Table 4 illustrates the complementarity of the nucleotide sequences of PPARD BINDING SITE, designated SEQ ID:5618, to the nucleotide sequence of GAM8554 RNA, herein designated GAM RNA, also designated SEQ ID:388.

Another function of GAM8554 is therefore inhibition of Peroxisome proliferative activated receptor, delta (PPARD, Accession NP_006229.1). Accordingly, utilities of GAM8554 include diagnosis, prevention and treatment of diseases and clinical conditions associated with PPARD.

Protein phosphatase 1, regulatory (inhibitor) subunit 12b (PPP1R12B, Accession NP_115288.1) is another GAM8554 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:18026, to the nucleotide sequence of GAM8554 RNA, herein designated GAM RNA, also designated SEQ ID:388.

Another function of GAM8554 is therefore inhibition of Protein phosphatase 1, regulatory (inhibitor) subunit 12b (PPP1R12B, Accession NP_115288.1). Accordingly, utilities of GAM8554 include diagnosis, prevention and treatment of diseases and clinical conditions associated with PPP1R12B.

Protein phosphatase 1, regulatory (inhibitor) subunit 12b (PPP1R12B, Accession NP_002472.1) is another GAM8554 target gene, herein designated TARGET GENE. PPP1R12B BINDING SITE is a target binding site found in the 3' untranslated region of multiple transcripts of mRNA encoded by PPP1R12B, corresponding to a target binding site such as BINDING SITE I, BINDING SITE II or BINDING SITE III of FIG. 8. Table 4 illustrates the complementarity of the nucleotide sequences of PPP1R12B BINDING SITE, designated SEQ ID:18026, to the nucleotide sequence of GAM8554 RNA, herein designated GAM RNA, also designated SEQ ID:388.

Another function of GAM8554 is therefore inhibition of Protein phosphatase 1, regulatory (inhibitor) subunit 12b (PPP1R12B, Accession NP_002472.1). Accordingly, utilities of GAM8554 include diagnosis, prevention and treatment of diseases and clinical conditions associated with PPP1R12B.

Protein kinase, camp-dependent, catalytic, beta (PRKACB, Accession NP_002722.1) is another GAM8554 target gene, herein designated TARGET GENE. PRKACB BINDING SITE is a target binding site found in the 3' untranslated region of mRNA encoded by PRKACB, corresponding to a target binding site such as BINDING SITE I, BINDING SITE II or BINDING SITE III of FIG. 8. Table 4 illustrates the complementarity of the nucleotide sequences of PRKACB BINDING SITE, designated SEQ ID:19320, to the nucleotide sequence of GAM8554 RNA, herein designated GAM RNA, also designated SEQ ID:388.

Another function of GAM8554 is therefore inhibition of Protein kinase, camp-dependent, catalytic, beta (PRKACB, Accession NP_002722.1), a gene which is the catalytic beta subunit of cAMP-dependent protein kinase (PKA). Accordingly, utilities of GAM8554 include diagnosis, prevention and treatment of diseases and clinical conditions associated with PRKACB.

The function of PRKACB and its association with various diseases and clinical conditions, has been established by previous studies, as described hereinabove with reference to GAM133.2. ProSAPiP1 (Accession NP_055546.1) is another GAM8554 target gene, herein designated TARGET GENE. ProSAPiP1 BINDING SITE is a target binding site found in the 3' untranslated region of mRNA encoded by ProSAPiP1, corresponding to a target binding site such as BINDING SITE I, BINDING SITE II or BINDING SITE III of FIG. 8. Table 4 illustrates the complementarity of the nucleotide sequences of ProSAPiP1 BINDING SITE, designated SEQ ID:13653, to the nucleotide sequence of GAM8554 RNA, herein designated GAM RNA, also designated SEQ ID:388.

Another function of GAM8554 is therefore inhibition of ProSAPiP1 (Accession NP_055546.1). Accordingly, utilities of GAM8554 include diagnosis, prevention and treatment of diseases and clinical conditions associated with ProSAPiP1.

PRTD-NY3 (Accession NP_112186.2) is another GAM8554 target gene, herein designated TARGET GENE. PRTD-NY3 BINDING SITE is a target binding site found in the 3' untranslated region of mRNA encoded by PRTD-NY3, corresponding to a target binding site such as BINDING SITE I, BINDING SITE II or BINDING SITE III of FIG. 8. Table 4 illustrates the complementarity of the nucleotide sequences of PRTD-NY3 BINDING SITE, designated SEQ ID:13126, to the nucleotide sequence of GAM8554 RNA, herein designated GAM RNA, also designated SEQ ID:388.

Another function of GAM8554 is therefore inhibition of PRTD-NY3 (Accession NP_112186.2). Accordingly, utilities of GAM8554 include diagnosis, prevention and treatment of diseases and clinical conditions associated with PRTD-NY3.

Protein tyrosine phosphatase, receptor type, t (PTPRT, Accession NP_573400.1) is another GAM8554 target gene, herein designated TARGET GENE. PTPRT BINDING SITE is a target binding site found in the 3' untranslated region of multiple transcripts of mRNA encoded by PTPRT, corresponding to a target binding site such as BINDING SITE I, BINDING SITE II or BINDING SITE III of FIG. 8. Table 4 illustrates the complementarity of the nucleotide sequences of PTPRT BINDING SITE, designated SEQ ID:17911, to the nucleotide sequence of GAM8554 RNA, herein designated GAM RNA, also designated SEQ ID:388.

Another function of GAM8554 is therefore inhibition of Protein tyrosine phosphatase, receptor type, t (PTPRT, Accession NP_573400.1). Accordingly, utilities of GAM8554 include diagnosis, prevention and treatment of diseases and clinical conditions associated with PTPRT.

Protein tyrosine phosphatase, receptor type, t (PTPRT, Accession NP_008981.2) is another GAM8554 target gene, herein designated TARGET GENE. PTPRT BINDING SITE is a target binding site found in the 3' untranslated region of multiple transcripts of mRNA encoded by PTPRT, corresponding to a target binding site such as BINDING SITE I, BINDING SITE II or BINDING SITE III of FIG. 8. Table 4 illustrates the complementarity of the nucleotide sequences of PTPRT BINDING SITE, designated SEQ ID:17911, to the nucleotide sequence of GAM8554 RNA, herein designated GAM RNA, also designated SEQ ID:388.

Another function of GAM8554 is therefore inhibition of Protein tyrosine phosphatase, receptor type, t (PTPRT, Accession NP_008981.2). Accordingly, utilities of GAM8554 include diagnosis, prevention and treatment of diseases and clinical conditions associated with PTPRT.

RAB11-FIP4 (Accession NP_116321.2) is another GAM8554 target gene, herein designated TARGET GENE. RAB11-FIP4 BINDING SITE is a target binding site found in the 3' untranslated region of mRNA encoded by RAB11-FIP4, corresponding to a target binding site such as BINDING SITE I, BINDING SITE II or BINDING SITE III of FIG. 8. Table 4 illustrates the complementarity of the nucleotide sequences of RAB11-FIP4 BINDING SITE, designated SEQ ID:5886, to the nucleotide sequence of GAM8554 RNA, herein designated GAM RNA, also designated SEQ ID:388.

Another function of GAM8554 is therefore inhibition of RAB11-FIP4 (Accession NP_116321.2). Accordingly, utilities of GAM8554 include diagnosis, prevention and treatment of diseases and clinical conditions associated with RAB11-FIP4.

Receptor (calcitonin) activity modifying protein 3 (RAMP3, Accession NP_005847.1) is another GAM8554 target gene, herein designated TARGET GENE. RAMP3 BINDING SITE is a target binding site found in the 3' untranslated region of mRNA encoded by RAMP3, corresponding to a target binding site such as BINDING SITE I, BINDING SITE II or BINDING SITE III of FIG. 8. Table 4 illustrates the complementarity of the nucleotide sequences of RAMP3 BINDING SITE, designated SEQ ID:19598, to the nucleotide sequence of GAM8554 RNA, herein designated GAM RNA, also designated SEQ ID:388.

Another function of GAM8554 is therefore inhibition of Receptor (calcitonin) activity modifying protein 3 (RAMP3, Accession NP_005847.1), a gene which is required to transport calcitonin-receptor-like receptor (crlr) to the plasma membrane. Accordingly, utilities of GAM8554 include diagnosis, prevention and treatment of diseases and clinical conditions associated with RAMP3.

The function of RAMP3 and its association with various diseases and clinical conditions, has been established by previous studies, as described hereinabove with reference to GAM625.1. Regulator of g-protein signalling 16 (RGS16, Accession NP_002919.1) is another GAM8554 target gene, herein designated TARGET GENE. RGS16 BINDING SITE is a target binding site found in the 3' untranslated region of mRNA encoded by RGS16, corresponding to a target binding site such as BINDING SITE I, BINDING SITE II or BINDING SITE III of FIG. 8. Table 4 illustrates the complementarity of the nucleotide sequences of RGS16 BINDING SITE, designated SEQ ID:14356, to the nucleotide sequence of GAM8554 RNA, herein designated GAM RNA, also designated SEQ ID:388.

Another function of GAM8554 is therefore inhibition of Regulator of g-protein signalling 16 (RGS16, Accession NP_002919.1), a gene which inhibits signal transduction. Accordingly, utilities of GAM8554 include diagnosis, prevention and treatment of diseases and clinical conditions associated with RGS16.

The function of RGS16 and its association with various diseases and clinical conditions, has been established by previous studies, as described hereinabove with reference to GAM281.1. RIS (Accession NP_057647.1) is another GAM8554 target gene, herein designated TARGET GENE. RIS BINDING SITE is a target binding site found in the 3' untranslated region of mRNA encoded by RIS, corresponding to a target binding site such as BINDING SITE I, BINDING SITE II or BINDING SITE III of FIG. 8. Table 4 illustrates the complementarity of the nucleotide sequences of RIS BINDING SITE, designated SEQ ID:4407, to the nucleotide sequence of GAM8554 RNA, herein designated GAM RNA, also designated SEQ ID:388.

Another function of GAM8554 is therefore inhibition of RIS (Accession NP_057647.1). Accordingly, utilities of GAM8554 include diagnosis, prevention and treatment of diseases and clinical conditions associated with RIS.

Rna (guanine-7-) methyltransferase (RNMT, Accession NP_003790.1) is another GAM8554 target gene, herein designated TARGET GENE. RNMT BINDING SITE is a target binding site found in the 3' untranslated region of mRNA encoded by RNMT, corresponding to a target binding site such as BINDING SITE I, BINDING SITE II or BINDING SITE III of FIG. 8. Table 4 illustrates the complementarity of the nucleotide sequences of RNMT BINDING SITE, designated SEQ ID:12208, to the nucleotide sequence of GAM8554 RNA, herein designated GAM RNA, also designated SEQ ID:388.

Another function of GAM8554 is therefore inhibition of Rna (guanine-7-) methyltransferase (RNMT, Accession NP_003790.1), a gene which catalyzes the methylation of GpppN-at the guanine N7 position. Accordingly, utilities of GAM8554 include diagnosis, prevention and treatment of diseases and clinical conditions associated with RNMT.

The function of RNMT and its association with various diseases and clinical conditions, has been established by previous studies, as described hereinabove with reference to GAM133.2. Receptor tyrosine kinase-like orphan receptor 2 (ROR2, Accession NP_004551.2) is another GAM8554 target gene, herein designated TARGET GENE. ROR2 BINDING SITE is a target binding site found in the 3' untranslated region of mRNA encoded by ROR2, corresponding to a target binding site such as BINDING SITE I, BINDING SITE II or BINDING SITE III of FIG. 8. Table 4 illustrates the complementarity of the nucleotide sequences of ROR2 BINDING SITE, designated SEQ ID:6454, to the nucleotide sequence of GAM8554 RNA, herein designated GAM RNA, also designated SEQ ID:388.

Another function of GAM8554 is therefore inhibition of Receptor tyrosine kinase-like orphan receptor 2 (ROR2, Accession NP_004551.2), a gene which may be involved in the early formayion of the chonrocytes. and therefore is associated with Robinow syndrome, autosomal recessive; brachydactyly, type. Accordingly, utilities of GAM8554 include diagnosis, prevention and treatment of Robinow syndrome, autosomal recessive ;brachydactyly, type, and of other diseases and clinical conditions associated with ROR2.

The function of ROR2 and its association with various diseases and clinical conditions, has been established by previous studies, as described hereinabove with reference to GAM500.2. RP4-622L5 (Accession NP_061991.2) is another GAM8554 target gene, herein designated TARGET GENE. RP4-622L5 BINDING SITE is a target binding site found in the 3' untranslated region of mRNA encoded by RP4-622L5, corresponding to a target binding site such as BINDING SITE I, BINDING SITE II or BINDING SITE III of FIG. 8. Table 4 illustrates the complementarity of the nucleotide sequences of RP4-622L5 BINDING SITE, designated SEQ ID:7263, to the nucleotide sequence of GAM8554 RNA, herein designated GAM RNA, also designated SEQ ID:388.

Another function of GAM8554 is therefore inhibition of RP4-622L5 (Accession NP_061991.2). Accordingly, utilities of GAM8554 include diagnosis, prevention and treatment of diseases and clinical conditions associated with RP4-622L5.

Retinoschisis (x-linked, juvenile) 1 (RS1, Accession NP_000321.1) is another GAM8554 target gene, herein designated TARGET GENE. RS1 BINDING SITE is a target binding site found in the 3' untranslated region of mRNA encoded by RS1, corresponding to a target binding site such as BINDING SITE I, BINDING SITE II or BINDING SITE III of FIG. 8. Table 4 illustrates the complementarity of the nucleotide sequences of RS1 BINDING SITE, designated SEQ ID:17639, to the nucleotide sequence of GAM8554 RNA, herein designated GAM RNA, also designated SEQ ID:388.

Another function of GAM8554 is therefore inhibition of Retinoschisis (x-linked, juvenile) 1 (RS1, Accession NP_000321.1). Accordingly, utilities of GAM8554 include diagnosis, prevention and treatment of diseases and clinical conditions associated with RS1.

S164 (Accession XP_027330.5) is another GAM8554 target gene, herein designated TARGET GENE. S164 BINDING SITE is a target binding site found in the 5' untranslated region of mRNA encoded by S164, corresponding to a target binding site such as BINDING SITE I, BINDING SITE II or BINDING SITE III of FIG. 8. Table 4 illustrates the complementarity of the nucleotide sequences of S164 BINDING SITE, designated SEQ ID:15155, to the nucleotide sequence of GAM8554 RNA, herein designated GAM RNA, also designated SEQ ID:388.

Another function of GAM8554 is therefore inhibition of S164 (Accession XP_027330.5). Accordingly, utilities of GAM8554 include diagnosis, prevention and treatment of diseases and clinical conditions associated with S164.

Squamous cell carcinoma antigen recognised by t cells 3 (SART3, Accession NP_055521.1) is another GAM8554 target gene, herein designated TARGET GENE. SART3 BINDING SITE is a target binding site found in the 3' untranslated region of mRNA encoded by SART3, corresponding to a target binding site such as BINDING SITE I, BINDING SITE II or BINDING SITE III of FIG. 8. Table 4 illustrates the complementarity of the nucleotide sequences of SART3 BINDING SITE, designated SEQ ID:16857, to the nucleotide sequence of GAM8554 RNA, herein designated GAM RNA, also designated SEQ ID:388.

Another function of GAM8554 is therefore inhibition of Squamous cell carcinoma antigen recognised by t cells 3 (SART3, Accession NP_055521.1). Accordingly, utilities of GAM8554 include diagnosis, prevention and treatment of diseases and clinical conditions associated with SART3.

SBZF3 (Accession NP_065127.2) is another GAM8554 target gene, herein designated TARGET GENE. SBZF3 BINDING SITE is a target binding site found in the 3' untranslated region of multiple transcripts of mRNA encoded by SBZF3, corresponding to a target binding site such as BINDING SITE I, BINDING SITE II or BINDING SITE III of FIG. 8. Table 4 illustrates the complementarity of the nucleotide sequences of SBZF3 BINDING SITE, designated SEQ ID:420, to the nucleotide sequence of GAM8554 RNA, herein designated GAM RNA, also designated SEQ ID:388.

Another function of GAM8554 is therefore inhibition of SBZF3 (Accession NP_065127.2). Accordingly, utilities of GAM8554 include diagnosis, prevention and treatment of diseases and clinical conditions associated with SBZF3.

SBZF3 (Accession XP_300732.1) is another GAM8554 target gene, herein designated TARGET GENE. SBZF3 BINDING SITE is a target binding site found in the 3' untranslated region of multiple transcripts of mRNA encoded by SBZF3, corresponding to a target binding site such as BINDING SITE I, BINDING SITE II or BINDING SITE III of FIG. 8. Table 4 illustrates the complementarity of the nucleotide sequences of SBZF3 BINDING SITE, designated SEQ ID:420, to the nucleotide sequence of GAM8554 RNA, herein designated GAM RNA, also designated SEQ ID:388.

Another function of GAM8554 is therefore inhibition of SBZF3 (Accession XP_300732.1). Accordingly, utilities of GAM8554 include diagnosis, prevention and treatment of diseases and clinical conditions associated with SBZF3.

Sodium channel, voltage-gated, type iv, beta polypeptide (SCN4B, Accession NP_777594.1) is another GAM8554 target gene, herein designated TARGET GENE. SCN4B BINDING SITE is a target binding site found in the 3' untranslated region of mRNA encoded by SCN4B, corresponding to a target binding site such as BINDING SITE I, BINDING SITE II or BINDING SITE III of FIG. 8. Table 4 illustrates the complementarity of the nucleotide sequences of SCN4B BINDING SITE, designated SEQ ID:6820, to the nucleotide sequence of GAM8554 RNA, herein designated GAM RNA, also designated SEQ ID:388.

Another function of GAM8554 is therefore inhibition of Sodium channel, voltage-gated, type iv, beta polypeptide (SCN4B, Accession NP_777594.1). Accordingly, utilities of GAM8554 include diagnosis, prevention and treatment of diseases and clinical conditions associated with SCN4B.

Syndecan 3 (n-syndecan) (SDC3, Accession NP_055469.1) is another GAM8554 target gene, herein designated TARGET GENE. SDC3 BINDING SITE is a target binding site found in the 5' untranslated region of mRNA encoded by SDC3, corresponding to a target binding site such as BINDING SITE I, BINDING SITE II or BINDING SITE III of FIG. 8. Table 4 illustrates the complementarity of the nucleotide sequences of SDC3 BINDING SITE, designated SEQ ID:13246, to the nucleotide sequence of GAM8554 RNA, herein designated GAM RNA, also designated SEQ ID:388.

Another function of GAM8554 is therefore inhibition of Syndecan 3 (n-syndecan) (SDC3, Accession NP_055469.1). Accordingly, utilities of GAM8554 include diagnosis, prevention and treatment of diseases and clinical conditions associated with SDC3.

SFMBT (Accession NP_057413.1) is another GAM8554 target gene, herein designated TARGET GENE. SFMBT BINDING SITE is a target binding site found in the 3' untranslated region of mRNA encoded by SFMBT, corresponding to a target binding site such as BINDING SITE I, BINDING SITE II or BINDING SITE III of FIG. 8. Table 4 illustrates the complementarity of the nucleotide sequences of SFMBT BINDING SITE, designated SEQ ID:18612, to the nucleotide sequence of GAM8554 RNA, herein designated GAM RNA, also designated SEQ ID:388.

Another function of GAM8554 is therefore inhibition of SFMBT (Accession NP_057413.1). Accordingly, utilities of GAM8554 include diagnosis, prevention and treatment of diseases and clinical conditions associated with SFMBT.

Sh3-domain grb2-like 2 (SH3GL2, Accession NP_003017.1) is another GAM8554 target gene, herein designated TARGET GENE. SH3GL2 BINDING SITE is a target binding site found in the 3' untranslated region of mRNA encoded by SH3GL2, corresponding to a target binding site such as BINDING SITE I, BINDING SITE II or BINDING SITE III of FIG. 8. Table 4 illustrates the complementarity of the nucleotide sequences of SH3GL2 BINDING SITE, designated SEQ ID:1385, to the nucleotide sequence of GAM8554 RNA, herein designated GAM RNA, also designated SEQ ID:388.

Another function of GAM8554 is therefore inhibition of Sh3-domain grb2-like 2 (SH3GL2, Accession NP_003017.1), a gene which plays a role in synaptic vesicle recycling, in particular in clathrin-mediated vesicle endocytosis. Accordingly, utilities of GAM8554 include diagnosis, prevention and treatment of diseases and clinical conditions associated with SH3GL2.

The function of SH3GL2 and its association with various diseases and clinical conditions, has been established by previous studies, as described hereinabove with reference to GAM513.1. Signal-induced proliferation-associated gene 1 (SIPA1, Accession NP_694985.28) is another GAM8554 target gene, herein designated TARGET GENE. SIPA1 BINDING SITE is a target binding site found in the 3' untranslated region of multiple transcripts of mRNA encoded by SIPA1, corresponding to a target binding site such as BINDING SITE I, BINDING SITE II or BINDING SITE III of FIG. 8. Table 4 illustrates the complementarity of the nucleotide sequences of SIPA1 BINDING SITE, designated SEQ ID:4806, to the nucleotide sequence of GAM8554 RNA, herein designated GAM RNA, also designated SEQ ID:388.

Another function of GAM8554 is therefore inhibition of Signal-induced proliferation-associated gene 1 (SIPA1, Accession NP_694985.28). Accordingly, utilities of GAM8554 include diagnosis, prevention and treatment of diseases and clinical conditions associated with SIPA1.

Signal-induced proliferation-associated gene 1 (SIPA1, Accession NP_006738.2) is another GAM8554 target gene, herein designated TARGET GENE. SIPA1 BINDING SITE is a target binding site found in the 3' untranslated region of multiple transcripts of mRNA encoded by SIPA1, corresponding to a target binding site such as BINDING SITE I, BINDING SITE II or BINDING SITE III of FIG. 8. Table 4 illustrates the complementarity of the nucleotide sequences of SIPA1 BINDING SITE, designated SEQ ID:4806, to the nucleotide sequence of GAM8554 RNA, herein designated GAM RNA, also designated SEQ ID:388.

Another function of GAM8554 is therefore inhibition of Signal-induced proliferation-associated gene 1 (SIPA1, Accession NP_006738.2). Accordingly, utilities of GAM8554 include diagnosis, prevention and treatment of diseases and clinical conditions associated with SIPA1.

Solute carrier family 20 (phosphate transporter), member 1 (SLC20A1, Accession NP_005406.3) is another GAM8554 target gene, herein designated TARGET GENE. SLC20A1 BINDING SITE is a target binding site found in the 3' untranslated region of mRNA encoded by SLC20A1, corresponding to a target binding site such as BINDING SITE I, BINDING SITE II or BINDING SITE III of FIG. 8. Table 4 illustrates the complementarity of the nucleotide sequences of SLC20A1 BINDING SITE, designated SEQ ID:17340, to the nucleotide sequence of GAM8554 RNA, herein designated GAM RNA, also designated SEQ ID:388.

Another function of GAM8554 is therefore inhibition of Solute carrier family 20 (phosphate transporter), member 1 (SLC20A1, Accession NP_005406.3), a gene which could be a sodium-phosphate symporter. Accordingly, utilities of GAM8554 include diagnosis, prevention and treatment of diseases and clinical conditions associated with SLC20A1.

The function of SLC20A1 and its association with various diseases and clinical conditions, has been established by previous studies, as described hereinabove with reference to GAM391.1. Solute carrier family 25 (mitochondrial carrier; peroxisomal membrane protein, 34 kda), member 17 (SLC25A17, Accession NP_006349.1) is another GAM8554 target gene, herein designated TARGET GENE. SLC25A17 BINDING SITE is a target binding site found in the 3' untranslated region of mRNA encoded by SLC25A17, corresponding to a target binding site such as BINDING SITE I, BINDING SITE II or BINDING SITE III of FIG. 8. Table 4 illustrates the complementarity of the nucleotide sequences of SLC25A17 BINDING SITE, designated SEQ ID:2699, to the nucleotide sequence of GAM8554 RNA, herein designated GAM RNA, also designated SEQ ID:388.

Another function of GAM8554 is therefore inhibition of Solute carrier family 25 (mitochondrial carrier; peroxisomal membrane protein, 34 kda), member 17 (SLC25A17, Accession NP_006349.1). Accordingly, utilities of GAM8554 include diagnosis, prevention and treatment of diseases and clinical conditions associated with SLC25A17.

Swi/snf related, matrix associated, actin dependent regulator of chromatin, subfamily f, member 1 (SMARCF1, Accession NP_060920.4) is another GAM8554 target gene, herein designated TARGET GENE. SMARCF1 BINDING SITE is a target binding site found in the 3' untranslated region of multiple transcripts of mRNA encoded by SMARCF1, corresponding to a target binding site such as BINDING SITE I, BINDING SITE II or BINDING SITE III of FIG. 8. Table 4 illustrates the complementarity of the nucleotide sequences of SMARCF1 BINDING SITE, designated SEQ ID:11978, to the nucleotide sequence of GAM8554 RNA, herein designated GAM RNA, also designated SEQ ID:388.

Another function of GAM8554 is therefore inhibition of Swi/snf related, matrix associated, actin dependent regulator of chromatin, subfamily f, member 1 (SMARCF1, Accession NP_060920.4). Accordingly, utilities of GAM8554 include diagnosis, prevention and treatment of diseases and clinical conditions associated with SMARCF1.

SPBPBP (Accession NP_006683.1) is another GAM8554 target gene, herein designated TARGET GENE. SPBPBP BINDING SITE is a target binding site found in the 3' untranslated region of mRNA encoded by SPBPBP, corresponding to a target binding site such as BINDING SITE I, BINDING SITE II or BINDING SITE III of FIG. 8. Table 4 illustrates the complementarity of the nucleotide sequences of SPBPBP BINDING SITE, designated SEQ ID:9243, to the nucleotide sequence of GAM8554 RNA, herein designated GAM RNA, also designated SEQ ID:388.

Another function of GAM8554 is therefore inhibition of SPBPBP (Accession NP_006683.1). Accordingly, utilities of GAM8554 include diagnosis, prevention and treatment of diseases and clinical conditions associated with SPBPBP.

Synaptojanin 2 (SYNJ2, Accession NP_003889.1) is another GAM8554 target gene, herein designated TARGET GENE. SYNJ2 BINDING SITE is a target binding site found in the 3' untranslated region of mRNA encoded by SYNJ2, corresponding to a target binding site such as BINDING SITE I, BINDING SITE II or BINDING SITE III of FIG. 8. Table 4 illustrates the complementarity of the nucleotide sequences of SYNJ2 BINDING SITE, designated SEQ ID:7330, to the nucleotide sequence of GAM8554 RNA, herein designated GAM RNA, also designated SEQ ID:388.

Another function of GAM8554 is therefore inhibition of Synaptojanin 2 (SYNJ2, Accession NP_003889.1). Accordingly, utilities of GAM8554 include diagnosis, prevention and treatment of diseases and clinical conditions associated with SYNJ2.

Treacher collins-franceschetti syndrome 1 (TCOF1, Accession NP_000347.1) is another GAM8554 target gene, herein designated TARGET GENE. TCOF1 BINDING SITE is a target binding site found in the 3' untranslated region of mRNA encoded by TCOF1, corresponding to a target binding site such as BINDING SITE I, BINDING SITE II or BINDING SITE III of FIG. 8. Table 4 illustrates the complementarity of the nucleotide sequences of TCOF1 BINDING SITE, designated SEQ ID:1511, to the nucleotide sequence of GAM8554 RNA, herein designated GAM RNA, also designated SEQ ID:388.

Another function of GAM8554 is therefore inhibition of Treacher collins-franceschetti syndrome 1 (TCOF1, Accession NP_000347.1). Accordingly, utilities of GAM8554 include diagnosis, prevention and treatment of diseases and clinical conditions associated with TCOF1.

Transforming growth factor, beta 3 (TGFB3, Accession NP_003230.1) is another GAM8554 target gene, herein designated TARGET GENE. TGFB3 BINDING SITE is a target binding site found in the 3' untranslated region of mRNA encoded by TGFB3, corresponding to a target binding site such as BINDING SITE I, BINDING SITE II or BINDING SITE III of FIG. 8. Table 4 illustrates the complementarity of the nucleotide sequences of TGFB3 BINDING SITE, designated SEQ ID:3958, to the nucleotide sequence of GAM8554 RNA, herein designated GAM RNA, also designated SEQ ID:388.

Another function of GAM8554 is therefore inhibition of Transforming growth factor, beta 3 (TGFB3, Accession NP_003230.1), a gene which is involved in embryogenesis and cell differentiation. Accordingly, utilities of GAM8554 include diagnosis, prevention and treatment of diseases and clinical conditions associated with TGFB3.

The function of TGFB3 and its association with various diseases and clinical conditions, has been established by previous studies, as described hereinabove with reference to GAM483.1. TOLLIP (Accession NP_061882.2) is another GAM8554 target gene, herein designated TARGET GENE. TOLLIP BINDING SITE is a target binding site found in the 3' untranslated region of mRNA encoded by TOLLIP, corresponding to a target binding site such as BINDING SITE I, BINDING SITE II or BINDING SITE III of FIG. 8. Table 4 illustrates the complementarity of the nucleotide sequences of TOLLIP BINDING SITE, designated SEQ ID:1045, to the nucleotide sequence of GAM8554 RNA, herein designated GAM RNA, also designated SEQ ID:388.

Another function of GAM8554 is therefore inhibition of TOLLIP (Accession NP_061882.2). Accordingly, utilities of GAM8554 include diagnosis, prevention and treatment of diseases and clinical conditions associated with TOLLIP.

TU3A (Accession NP_009108.1) is another GAM8554 target gene, herein designated TARGET GENE. TU3A BINDING SITE is a target binding site found in the 3' untranslated region of mRNA encoded by TU3A, corresponding to a target binding site such as BINDING SITE I, BINDING SITE II or BINDING SITE III of FIG. 8. Table 4 illustrates the complementarity of the nucleotide sequences of TU3A BINDING SITE, designated SEQ ID:17216, to the nucleotide sequence of GAM8554 RNA, herein designated GAM RNA, also designated SEQ ID:388.

Another function of GAM8554 is therefore inhibition of TU3A (Accession NP_009108.1). Accordingly, utilities of GAM8554 include diagnosis, prevention and treatment of diseases and clinical conditions associated with TU3A.

Udp-glucose dehydrogenase (UGDH, Accession NP_003350.1) is another GAM8554 target gene, herein designated TARGET GENE. UGDH BINDING SITE is a target binding site found in the 3' untranslated region of mRNA encoded by UGDH, corresponding to a target binding site such as BINDING SITE I, BINDING SITE II or BINDING SITE III of FIG. 8. Table 4 illustrates the complementarity of the nucleotide sequences of UGDH BINDING SITE, designated SEQ ID:18136, to the nucleotide sequence of GAM8554 RNA, herein designated GAM RNA, also designated SEQ ID:388.

Another function of GAM8554 is therefore inhibition of Udp-glucose dehydrogenase (UGDH, Accession NP_003350.1), a gene which is an UDP- glucose dehydrogenase. Accordingly, utilities of GAM8554 include diagnosis, prevention and treatment of diseases and clinical conditions associated with UGDH.

The function of UGDH and its association with various diseases and clinical conditions, has been established by previous studies, as described hereinabove with reference to GAM69.2. Unc-84 homolog a (c. elegans) (UNC84A, Accession XP_291219.1) is another GAM8554 target gene, herein designated TARGET GENE. UNC84A BINDING SITE is a target binding site found in the 3' untranslated region of mRNA encoded by UNC84A, corresponding to a target binding site such as BINDING SITE I, BINDING SITE II or BINDING SITE III of FIG. 8. Table 4 illustrates the complementarity of the nucleotide sequences of UNC84A BINDING SITE, designated SEQ ID:4603, to the nucleotide sequence of GAM8554 RNA, herein designated GAM RNA, also designated SEQ ID:388.

Another function of GAM8554 is therefore inhibition of Unc-84 homolog a (c. elegans) (UNC84A, Accession XP_291219.1). Accordingly, utilities of GAM8554 include diagnosis, prevention and treatment of diseases and clinical conditions associated with UNC84A.

URF2 (Accession NP_689519.2) is another GAM8554 target gene, herein designated TARGET GENE. URF2 BINDING SITE is a target binding site found in the 3' untranslated region of multiple transcripts of mRNA encoded by URF2, corresponding to a target binding site such as BINDING SITE I, BINDING SITE II or BINDING SITE III of FIG. 8. Table 4 illustrates the complementarity of the nucleotide sequences of URF2 BINDING SITE, designated SEQ ID:2555, to the nucleotide sequence of GAM8554 RNA, herein designated GAM RNA, also designated SEQ ID:388.

Another function of GAM8554 is therefore inhibition of URF2 (Accession NP_689519.2). Accordingly, utilities of GAM8554 include diagnosis, prevention and treatment of diseases and clinical conditions associated with URF2.

VprBP (Accession NP_055518.1) is another GAM8554 target gene, herein designated TARGET GENE. VprBP BINDING SITE is a target binding site found in the 3' untranslated region of mRNA encoded by VprBP, corresponding to a target binding site such as BINDING SITE I, BINDING SITE II or BINDING SITE III of FIG. 8. Table 4 illustrates the complementarity of the nucleotide sequences of VprBP BINDING SITE, designated SEQ ID:5213, to the nucleotide sequence of GAM8554 RNA, herein designated GAM RNA, also designated SEQ ID:388.

Another function of GAM8554 is therefore inhibition of VprBP (Accession NP_055518.1). Accordingly, utilities of GAM8554 include diagnosis, prevention and treatment of diseases and clinical conditions associated with VprBP.

WDFY1 (Accession NP_065881.1) is another GAM8554 target gene, herein designated TARGET GENE. WDFY1 BINDING SITE is a target binding site found in the 3' untranslated region of multiple transcripts of mRNA encoded by WDFY1, corresponding to a target binding site such as BINDING SITE I, BINDING SITE II or BINDING SITE III of FIG. 8. Table 4 illustrates the complementarity of the nucleotide sequences of WDFY1 BINDING SITE, designated SEQ ID:18013, to the nucleotide sequence of GAM8554 RNA, herein designated GAM RNA, also designated SEQ ID:388.

Another function of GAM8554 is therefore inhibition of WDFY1 (Accession NP_065881.1). Accordingly, utilities of GAM8554 include diagnosis, prevention and treatment of diseases and clinical conditions associated with WDFY1.

WDFY1 (Accession NP_848127.1) is another GAM8554 target gene, herein designated TARGET GENE. WDFY1 BINDING SITE is a target binding site found in the 3' untranslated region of multiple transcripts of mRNA encoded by WDFY1, corresponding to a target binding site such as BINDING SITE I, BINDING SITE II or BINDING SITE III of FIG. 8. Table 4 illustrates the complementarity of the nucleotide sequences of WDFY1 BINDING SITE, designated SEQ ID:18013, to the nucleotide sequence of GAM8554 RNA, herein designated GAM RNA, also designated SEQ ID:388.

Another function of GAM8554 is therefore inhibition of WDFY1 (Accession NP_848127.1). Accordingly, utilities of GAM8554 include diagnosis, prevention and treatment of diseases and clinical conditions associated with WDFY1.

WFDC10B (Accession NP_742143.1) is another GAM8554 target gene, herein designated TARGET GENE. WFDC10B BINDING SITE is a target binding site found in the 3' untranslated region of multiple transcripts of mRNA encoded by WFDC10B, corresponding to a target binding site such as BINDING SITE I, BINDING SITE II or BINDING SITE III of FIG. 8. Table 4 illustrates the complementarity of the nucleotide sequences of WFDC10B BINDING SITE, designated SEQ ID:7903, to the nucleotide sequence of GAM8554 RNA, herein designated GAM RNA, also designated SEQ ID:388.

Another function of GAM8554 is therefore inhibition of WFDC10B (Accession NP_742143.1). Accordingly, utilities of GAM8554 include diagnosis, prevention and treatment of diseases and clinical conditions associated with WFDC10B.

WFDC10B (Accession NP_742003.1) is another GAM8554 target gene, herein designated TARGET GENE. WFDC10B BINDING SITE is a target binding site found in the 3' untranslated region of multiple transcripts of mRNA encoded by WFDC10B, corresponding to a target binding site such as BINDING SITE I, BINDING SITE II or BINDING SITE III of FIG. 8. Table 4 illustrates the complementarity of the nucleotide sequences of WFDC10B BINDING SITE, designated SEQ ID:7903, to the nucleotide sequence of GAM8554 RNA, herein designated GAM RNA, also designated SEQ ID:388.

Another function of GAM8554 is therefore inhibition of WFDC10B (Accession NP_742003.1). Accordingly, utilities of GAM8554 include diagnosis, prevention and treatment of diseases and clinical conditions associated with WFDC10B.

Wolf-hirschhorn syndrome candidate 1 (WHSC1, Accession NP_579889.1) is another GAM8554 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:16764, to the nucleotide sequence of GAM8554 RNA, herein designated GAM RNA, also designated SEQ ID:388.

Another function of GAM8554 is therefore inhibition of Wolf-hirschhorn syndrome candidate 1 (WHSC1, Accession NP_579889.1), a gene which binds covalently to and repairs g/t mismatches. and therefore may be associated with Wolf-hirschhorn syndrome. Accordingly, utilities of GAM8554 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Zinc finger protein 91 homolog (mouse) (ZFP91, Accession NP_739574.1) is another GAM8554 target gene, herein designated TARGET GENE. ZFP91 BINDING SITE is a target binding site found in the 3' untranslated region of multiple transcripts of mRNA encoded by ZFP91, corresponding to a target binding site such as BINDING SITE I, BINDING SITE II or BINDING SITE III of FIG. 8. Table 4 illustrates the complementarity of the nucleotide sequences of ZFP91 BINDING SITE, designated SEQ ID:19190, to the nucleotide sequence of GAM8554 RNA, herein designated GAM RNA, also designated SEQ ID:388.

Another function of GAM8554 is therefore inhibition of Zinc finger protein 91 homolog (mouse) (ZFP91, Accession NP_739574.1). Accordingly, utilities of GAM8554 include diagnosis, prevention and treatment of diseases and clinical conditions associated with ZFP91.

Zinc finger protein 124 (hzf-16) (ZNF124, Accession NP_003422.1) is another GAM8554 target gene, herein designated TARGET GENE. ZNF124 BINDING SITE is a target binding site found in the 5' untranslated region of mRNA encoded by ZNF124, corresponding to a target binding site such as BINDING SITE I, BINDING SITE II or BINDING SITE III of FIG. 8. Table 4 illustrates the complementarity of the nucleotide sequences of ZNF124 BINDING SITE, designated SEQ ID:18483, to the nucleotide sequence of GAM8554 RNA, herein designated GAM RNA, also designated SEQ ID:388.

Another function of GAM8554 is therefore inhibition of Zinc finger protein 124 (hzf-16) (ZNF124, Accession NP_003422.1). Accordingly, utilities of GAM8554 include diagnosis, prevention and treatment of diseases and clinical conditions associated with ZNF124.

Zinc finger protein 239 (ZNF239, Accession NP_005665.1) is another GAM8554 target gene, herein designated TARGET GENE. ZNF239 BINDING SITE is a target binding site found in the 5' untranslated region of mRNA encoded by ZNF239, corresponding to a target binding site such as BINDING SITE I, BINDING SITE II or BINDING SITE III of FIG. 8. Table 4 illustrates the complementarity of the nucleotide sequences of ZNF239 BINDING SITE, designated SEQ ID:13975, to the nucleotide sequence of GAM8554 RNA, herein designated GAM RNA, also designated SEQ ID:388.

Another function of GAM8554 is therefore inhibition of Zinc finger protein 239 (ZNF239, Accession NP_005665.1). Accordingly, utilities of GAM8554 include diagnosis, prevention and treatment of diseases and clinical conditions associated with ZNF239.

Zinc finger protein 289, id1 regulated (ZNF289, Accession NP_115765.2) is another GAM8554 target gene, herein designated TARGET GENE. ZNF289 BINDING SITE is a target binding site found in the 3' untranslated region of mRNA encoded by ZNF289, corresponding to a target binding site such as BINDING SITE I, BINDING SITE II or BINDING SITE III of FIG. 8. Table 4 illustrates the complementarity of the nucleotide sequences of ZNF289 BINDING SITE, designated SEQ ID:14798, to the nucleotide sequence of GAM8554 RNA, herein designated GAM RNA, also designated SEQ ID:388.

Another function of GAM8554 is therefore inhibition of Zinc finger protein 289, id1 regulated (ZNF289, Accession NP_115765.2). Accordingly, utilities of GAM8554 include diagnosis, prevention and treatment of diseases and clinical conditions associated with ZNF289.

Zinc finger protein 297 (ZNF297, Accession NP_005444.3) is another GAM8554 target gene, herein designated TARGET GENE. ZNF297 BINDING SITE is a target binding site found in the 3' untranslated region of mRNA encoded by ZNF297, corresponding to a target binding site such as BINDING SITE I, BINDING SITE II or BINDING SITE III of FIG. 8. Table 4 illustrates the complementarity of the nucleotide sequences of ZNF297 BINDING SITE, designated SEQ ID:17593, to the nucleotide sequence of GAM8554 RNA, herein designated GAM RNA, also designated SEQ ID:388.

Another function of GAM8554 is therefore inhibition of Zinc finger protein 297 (ZNF297, Accession NP_005444.3). Accordingly, utilities of GAM8554 include diagnosis, prevention and treatment of diseases and clinical conditions associated with ZNF297.

FIG. 8 further provides a conceptual description of a novel bioinformatically detected of the present invention, referred to here as Genomic Address Messenger 8678 (GAM8678), which modulates expression of respective target genes thereof, the function and utility of which target genes is known in the art.

GAM8678 is a novel bioinformatically detected regulatory, non protein coding, micro RNA (miRNA) gene. The method by which GAM8678 was detected is described hereinabove with reference to FIGS. 8-15.

GAM8678 gene, herein designated GAM GENE, and GAM8678 target gene, herein designated TARGET GENE, are human genes contained in the human genome.

GAM8678 gene encodes a GAM8678 precursor RNA, herein designated GAM PRECURSOR RNA. Similar to other miRNA genes, and unlike most ordinary genes, GAM8678 precursor RNA does not encode a protein. A nucleotide sequence identical or highly similar to the nucleotide sequence of GAM8678 precursor RNA is designated SEQ ID:11, and is provided hereinbelow with reference to the sequence listing part.

GAM8678 precursor RNA folds onto itself, forming GAM8678 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

GAM8678 precursor RNA folds onto itself, forming GAM8678 folded precursor RNA, herein designated GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial reverse-complementary sequence of the nucleotide sequence of the second half thereof.

Nucleotide sequence of GAM8678 precursor RNA, designated SEQ-ID:11, and a schematic representation of a predicted secondary folding of GAM8678 folded precursor RNA are further described with reference to Table 2, hereby incorporated by reference.

An enzyme complex designated DICER COMPLEX, 'dices' the GAM8678 folded precursor RNA into GAM8678 RNA, herein designated GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (GAM Prediction Accuracy Group: C) nucleotide sequence of GAM8678 RNA is designated SEQ ID:347, and is provided hereinbelow with references to the sequence listing part and Table 3, hereby incorporated by reference.

GAM8678 target gene, herein designated TARGET GENE, encodes a corresponding messenger RNA, GAM8678 target RNA, herein designated GAM TARGET RNA. GAM8678 target RNA comprises three regions, as is typical of mRNA of a protein coding gene: a 5' untranslated region, a protein coding region and a 3' untranslated region, designated 5'UTR, PROTEIN CODING and 3'UTR respectively.

GAM8678 RNA, herein designated GAM RNA, binds complementarily to one or more target binding sites located in untranslated regions of GAM8678 target RNA, herein designated GAM TARGET RNA. This complementary binding is due to the fact that the nucleotide sequence of GAM8678 RNA is an accurate or a partial inversed-reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM8678 RNA may have a different number of target binding sites in untranslated regions of a GAM8678 target RNA. It is further appreciated that while FIG. 8 depicts target binding sites in the 3'UTR region, this is meant as an example only these target binding sites may be located in the 3'UTR region, the 5'UTR region, or in both 3'UTR and 5'UTR regions.

The complementary binding of GAM8678 RNA, herein designated GAM RNA, to target binding sites on GAM8678 target RNA, herein designated GAM TARGET RNA, such as BINDING SITE I, BINDING SITE II and BINDING SITE III, inhibits translation of GAM8678 target RNA into GAM8678 target protein, herein designated GAM TARGET PROTEIN. GAM target protein is therefore outlined by a broken line.

It is appreciated that GAM8678 target gene, herein designated TARGET GENE, in fact represents a plurality of GAM8678 target genes. The mRNA of each one of this plurality of GAM8678 target genes comprises one or more target binding sites, each having a nucleotide sequence which is at least partly complementary to GAM8678 RNA, herein designated GAM RNA, and which when bound by GAM8678 RNA causes inhibition of translation of respective one or more GAM8678 target proteins.

It is further appreciated by one skilled in the art that the mode of translational inhibition illustrated by FIG. 8 with specific reference to translational inhibition exerted by GAM8678 gene, herein designated GAM GENE, on one or more GAM8678 target genes, herein collectively designated TARGET GENE, is common to other known miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective:Glimpses of a tiny RNA world, Science 294,779 (2001)).

It is appreciated that specific functions and accordingly utilities of GAM8678 correlate with, and may be deduced from, the identity of the target genes which GAM8678 binds and inhibits, and the function of these target genes, as elaborated hereinbelow.

Atp-binding cassette, sub-family a (abc1), member 4 (ABCA4, Accession NP_000341.1) is a GAM8678 target gene, herein designated TARGET GENE. ABCA4 BINDING SITE is a target binding site found in the 3' untranslated region of mRNA encoded by ABCA4, corresponding to a target binding site such as BINDING SITE I, BINDING SITE II or BINDING SITE III of FIG. 8. Table 4 illustrates the complementarity of the nucleotide sequences of ABCA4 BINDING SITE, designated SEQ ID:14902, to the nucleotide sequence of GAM8678 RNA, herein designated GAM RNA, also designated SEQ ID:347.

A function of GAM8678 is therefore inhibition of Atp-binding cassette, sub-family a (abc1), member 4 (ABCA4, Accession NP_000341.1). Accordingly, utilities of GAM8678 include diagnosis, prevention and treatment of diseases and clinical conditions associated with ABCA4.

Adenylate cyclase 1 (brain) (ADCY1, Accession NP_066939.1) is another GAM8678 target gene, herein designated TARGET GENE. ADCY1 BINDING SITE is a target binding site found in the 3' untranslated region of multiple transcripts of mRNA encoded by ADCY1, corresponding to a target binding site such as BINDING SITE I, BINDING SITE II or BINDING SITE III of FIG. 8. Table 4 illustrates the complementarity of the nucleotide sequences of ADCY1 BINDING SITE, designated SEQ ID:11743, to the nucleotide sequence of GAM8678 RNA, herein designated GAM RNA, also designated SEQ ID:347.

Another function of GAM8678 is therefore inhibition of Adenylate cyclase 1 (brain) (ADCY1, Accession NP_066939.1), a gene which a calmodulin-sensitive adenylyl cyclase. it may play a role in memory acquisition and learning. Accordingly, utilities of GAM8678 include diagnosis, prevention and treatment of diseases and clinical conditions associated with ADCY1.

The function of ADCY1 and its association with various diseases and clinical conditions, has been established by previous studies, as described hereinabove with reference to GAM144.1. Alanine-glyoxylate aminotransferase (oxalosis i; hyperoxaluria i; glycolicaciduria; serine-pyruvate aminotransferase) (AGXT, Accession NP_000021.1) is another GAM8678 target gene, herein designated TARGET GENE. AGXT BINDING SITE is a target binding site found in the 3' untranslated region of mRNA encoded by AGXT, corresponding to a target binding site such as BINDING SITE I, BINDING SITE II or BINDING SITE III of FIG. 8. Table 4 illustrates the complementarity of the nucleotide sequences of AGXT BINDING SITE, designated SEQ ID:15028, to the nucleotide sequence of GAM8678 RNA, herein designated GAM RNA, also designated SEQ ID:347.

Another function of GAM8678 is therefore inhibition of Alanine-glyoxylate aminotransferase (oxalosis i; hyperoxaluria i; glycolicaciduria; serine-pyruvate aminotransferase) (AGXT, Accession NP_000021.1), a gene which referred to the a enzyme is expressed only in the liver. and therefore is associated with Primary hyperoxaluria type i (ph1). Accordingly, utilities of GAM8678 include diagnosis, prevention and treatment of Primary hyperoxaluria type i (ph1), and of other diseases and clinical conditions associated with AGXT.

The function of AGXT and its association with various diseases and clinical conditions, has been established by previous studies, as described hereinabove with reference to GAM929.2. S-adenosylmethionine decarboxylase 1 (AMD1, Accession NP_001625.1) is another GAM8678 target gene, herein designated TARGET GENE. AMD1 BINDING SITE is a target binding site found in the 3' untranslated region of mRNA encoded by AMD1, corresponding to a target binding site such as BINDING SITE I, BINDING SITE II or BINDING SITE III of FIG. 8. Table 4 illustrates the complementarity of the nucleotide sequences of AMD1 BINDING SITE, designated SEQ ID:8863, to the nucleotide sequence of GAM8678 RNA, herein designated GAM RNA, also designated SEQ ID:347.

Another function of GAM8678 is therefore inhibition of S-adenosylmethionine decarboxylase 1 (AMD1, Accession NP_001625.1), a gene which catalyzes the removal of the carboxylate group of S-adenosylmethionine in the polyamine biosynthesis pathway. Accordingly, utilities of GAM8678 include diagnosis, prevention and treatment of diseases and clinical conditions associated with AMD1.

The function of AMD1 and its association with various diseases and clinical conditions, has been established by previous studies, as described hereinabove with reference to GAM100.1. ANKRD10 (Accession NP_060134.1) is another GAM8678 target gene, herein designated TARGET GENE. ANKRD10 BINDING SITE is a target binding site found in the 3' untranslated region of mRNA encoded by ANKRD10, corresponding to a target binding site such as BINDING SITE I, BINDING SITE II or BINDING SITE III of FIG. 8. Table 4 illustrates the complementarity of the nucleotide sequences of ANKRD10 BINDING SITE, designated SEQ ID:2626, to the nucleotide sequence of GAM8678 RNA, herein designated GAM RNA, also designated SEQ ID:347.

Another function of GAM8678 is therefore inhibition of ANKRD10 (Accession NP_060134.1). Accordingly, utilities of GAM8678 include diagnosis, prevention and treatment of diseases and clinical conditions associated with ANKRD10.

Ankyrin-like with transmembrane domains 1 (ANKTM1, Accession NP_015628.1) is another GAM8678 target gene, herein designated TARGET GENE. ANKTM1 BINDING SITE is a target binding site found in the 3' untranslated region of mRNA encoded by ANKTM1, corresponding to a target binding site such as BINDING SITE I, BINDING SITE II or BINDING SITE III of FIG. 8. Table 4 illustrates the complementarity of the nucleotide sequences of ANKTM1 BINDING SITE, designated SEQ ID:18718, to the nucleotide sequence of GAM8678 RNA, herein designated GAM RNA, also designated SEQ ID:347.

Another function of GAM8678 is therefore inhibition of Ankyrin-like with transmembrane domains 1 (ANKTM1, Accession NP_015628.1), a gene which attaches integral membrane proteins to cytoskeletal elements. Accordingly, utilities of GAM8678 include diagnosis, prevention and treatment of diseases and clinical conditions associated with ANKTM1.

The function of ANKTM1 and its association with various diseases and clinical conditions, has been established by previous studies, as described hereinabove with reference to GAM190.1. APOB48R (Accession NP_061160.1) is another GAM8678 target gene, herein designated TARGET GENE. APOB48R BINDING SITE is a target binding site found in the 5' untranslated region of mRNA encoded by APOB48R, corresponding to a target binding site such as BINDING SITE I, BINDING SITE II or BINDING SITE III of FIG. 8. Table 4 illustrates the complementarity of the nucleotide sequences of APOB48R BINDING SITE, designated SEQ ID:14532, to the nucleotide sequence of GAM8678 RNA, herein designated GAM RNA, also designated SEQ ID:347.

Another function of GAM8678 is therefore inhibition of APOB48R (Accession NP_061160.1). Accordingly, utilities of GAM8678 include diagnosis, prevention and treatment of diseases and clinical conditions associated with APOB48R.

Atpase, cu++ transporting, alpha polypeptide (menkes syndrome) (ATP7A, Accession NP_000043.1) is another GAM8678 target gene, herein designated TARGET GENE. ATP7A BINDING SITE is a target binding site found in the 3' untranslated region of mRNA encoded by ATP7A, corresponding to a target binding site such as BINDING SITE I, BINDING SITE II or BINDING SITE III of FIG. 8. Table 4 illustrates the complementarity of the nucleotide sequences of ATP7A BINDING SITE, designated SEQ ID:14456, to the nucleotide sequence of GAM8678 RNA, herein designated GAM RNA, also designated SEQ ID:347.

Another function of GAM8678 is therefore inhibition of Atpase, cu++ transporting, alpha polypeptide (menkes syndrome) (ATP7A, Accession NP_000043.1). Accordingly, utilities of GAM8678 include diagnosis, prevention and treatment of diseases and clinical conditions associated with ATP7A.

Bone morphogenetic protein 1 (BMP1, Accession NP_006122.1) is another GAM8678 target gene, herein designated TARGET GENE. BMP1 BINDING SITE is a target binding site found in the 3' untranslated region of multiple transcripts of mRNA encoded by BMP1, corresponding to a target binding site such as BINDING SITE I, BINDING SITE II or BINDING SITE III of FIG. 8. Table 4 illustrates the complementarity of the nucleotide sequences of BMP1 BINDING SITE, designated SEQ ID:18997, to the nucleotide sequence of GAM8678 RNA, herein designated GAM RNA, also designated SEQ ID:347.

Another function of GAM8678 is therefore inhibition of Bone morphogenetic protein 1 (BMP1, Accession NP_006122.1), a gene which cleaves procollagens leading to formation of extracellular matrix. Accordingly, utilities of GAM8678 include diagnosis, prevention and treatment of diseases and clinical conditions associated with BMP1.

The function of BMP1 and its association with various diseases and clinical conditions, has been established by previous studies, as described hereinabove with reference to GAM51.1. Bone morphogenetic protein 1 (BMP1, Accession NP_006123.1) is another GAM8678 target gene, herein designated TARGET GENE. BMP1 BINDING SITE is a target binding site found in the 3' untranslated region of multiple transcripts of mRNA encoded by BMP1, corresponding to a target binding site such as BINDING SITE I, BINDING SITE II or BINDING SITE III of FIG. 8. Table 4 illustrates the complementarity of the nucleotide sequences of BMP1 BINDING SITE, designated SEQ ID:18997, to the nucleotide sequence of GAM8678 RNA, herein designated GAM RNA, also designated SEQ ID:347.

Another function of GAM8678 is therefore inhibition of Bone morphogenetic protein 1 (BMP1, Accession NP_006123.1), a gene which cleaves procollagens leading to formation of extracellular matrix. Accordingly, utilities of GAM8678 include diagnosis, prevention and treatment of diseases and clinical conditions associated with BMP1.

The function of BMP1 and its association with various diseases and clinical conditions, has been established by previous studies, as described hereinabove with reference to GAM51.1. Breast cancer 1, early onset (BRCA1, Accession NP_009230.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009230.1). Accordingly, utilities of GAM8678 include diagnosis, prevention and treatment of diseases and clinical conditions associated with BRCA1.

Breast cancer 1, early onset (BRCA1, Accession NP_009225.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009225.1). Accordingly, utilities of GAM8678 include diagnosis, prevention and treatment of diseases and clinical conditions associated with BRCA1.

Breast cancer 1, early onset (BRCA1, Accession NP_009235.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009235.1). Accordingly, utilities of GAM8678 include diagnosis, prevention and treatment of diseases and clinical conditions associated with BRCA1.

Breast cancer 1, early onset (BRCA1, Accession NP_009227.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009227.1). Accordingly, utilities of GAM8678 include diagnosis, prevention and treatment of diseases and clinical conditions associated with BRCA1.

Breast cancer 1, early onset (BRCA1, Accession NP_009236.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009236.1). Accordingly, utilities of GAM8678 include diagnosis, prevention and treatment of diseases and clinical conditions associated with BRCA1.

Breast cancer 1, early onset (BRCA1, Accession NP_009231.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009231.1). Accordingly, utilities of GAM8678 include diagnosis, prevention and treatment of diseases and clinical conditions associated with BRCA1.

Breast cancer 1, early onset (BRCA1, Accession NP_009233.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009233.1). Accordingly, utilities of GAM8678 include diagnosis, prevention and treatment of diseases and clinical conditions associated with BRCA1.

Breast cancer 1, early onset (BRCA1, Accession NP_009229.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009229.1). Accordingly, utilities of GAM8678 include diagnosis, prevention and treatment of diseases and clinical conditions associated with BRCA1.

Breast cancer 1, early onset (BRCA1, Accession NP_009232.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009232.1). Accordingly, utilities of GAM8678 include diagnosis, prevention and treatment of diseases and clinical conditions associated with BRCA1.

Breast cancer 1, early onset (BRCA1, Accession NP_009237.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009237.1). Accordingly, utilities of GAM8678 include diagnosis, prevention and treatment of diseases and clinical conditions associated with BRCA1.

Breast cancer 1, early onset (BRCA1, Accession NP_009234.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1 BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009234.1). Accordingly, utilities of GAM8678 include diagnosis, prevention and treatment of diseases and clinical conditions associated with BRCA1.

Breast cancer 1, early onset (BRCA1, Accession NP_009228.1) is another GAM8678 target gene, herein designated TARGET GENE. BRCA1 BINDING SITE is a target binding site found in the 5' untranslated region of multiple transcripts of mRNA encoded by BRCA1, corresponding to a target binding site such as BINDING SITE I, BINDING SITE II or BINDING SITE III of FIG. 8. Table 4 illustrates the complementarity of the nucleotide sequences of BRCA1

BINDING SITE, designated SEQ ID:16053, to the nucleotide sequence of GAM8678 RNA, herein designated GAM RNA, also designated SEQ ID:347.

Another function of GAM8678 is therefore inhibition of Breast cancer 1, early onset (BRCA1, Accession NP_009228.1). Accordingly, utilities of GAM8678 include diagnosis, prevention and treatment of diseases and clinical conditions associated with BRCA1.

C14orf73 (Accession XP_040910.3) is another GAM8678 target gene, herein designated TARGET GENE. C14orf73 BINDING SITE is a target binding site found in the 5' untranslated region of mRNA encoded by C14orf73, corresponding to a target binding site such as BINDING SITE I, BINDING SITE II or BINDING SITE III of FIG. 8. Table 4 illustrates the complementarity of the nucleotide sequences of C14orf73 BINDING SITE, designated SEQ ID:1099, to the nucleotide sequence of GAM8678 RNA, herein designated GAM RNA, also designated SEQ ID:347.

Another function of GAM8678 is therefore inhibition of C14orf73 (Accession XP_040910.3). Accordingly, utilities of GAM8678 include diagnosis, prevention and treatment of diseases and clinical conditions associated with C14orf73.

Chromosome 20 open reading frame 142 (C20orf142, Accession XP_300782.1) is another GAM8678 target gene, herein designated TARGET GENE. C20orf142 BINDING SITE is a target binding site found in the 3' untranslated region of mRNA encoded by C20orf142, corresponding to a target binding site such as BINDING SITE I, BINDING SITE II or BINDING SITE III of FIG. 8. Table 4 illustrates the complementarity of the nucleotide sequences of C20orf142 BINDING SITE, designated SEQ ID:14457, to the nucleotide sequence of GAM8678 RNA, herein designated GAM RNA, also designated SEQ ID:347.

Another function of GAM8678 is therefore inhibition of Chromosome 20 open reading frame 142 (C20orf142, Accession XP_300782.1). Accordingly, utilities of GAM8678 include diagnosis, prevention and treatment of diseases and clinical conditions associated with C20orf142.

Chromosome 20 open reading frame 155 (C20orf155, Accession NP_061968.1) is another GAM8678 target gene, herein designated TARGET GENE. C20orf155 BINDING SITE is a target binding site found in the 5' untranslated region of mRNA encoded by C20orf155, corresponding to a target binding site such as BINDING SITE I, BINDING SITE II or BINDING SITE III of FIG. 8. Table 4 illustrates the complementarity of the nucleotide sequences of C20orf155 BINDING SITE, designated SEQ ID:13151, to the nucleotide sequence of GAM8678 RNA, herein designated GAM RNA, also designated SEQ ID:347.

Another function of GAM8678 is therefore inhibition of Chromosome 20 open reading frame 155 (C20orf155, Accession NP_061968.1). Accordingly, utilities of GAM8678 include diagnosis, prevention and treatment of diseases and clinical conditions associated with C20orf155.

Chromosome 21 open reading frame 81 (C21orf81, Accession NP_715631.1) is another GAM8678 target gene, herein designated TARGET GENE. C21orf81 BINDING SITE is a target binding site found in the 5' untranslated region of mRNA encoded by C21orf81, corresponding to a target binding site such as BINDING SITE I, BINDING SITE II or BINDING SITE III of FIG. 8. Table 4 illustrates the complementarity of the nucleotide sequences of C21orf81 BINDING SITE, designated SEQ ID:14253, to the nucleotide sequence of GAM8678 RNA, herein designated GAM RNA, also designated SEQ ID:347.

Another function of GAM8678 is therefore inhibition of Chromosome 21 open reading frame 81 (C21orf81, Accession NP_715631.1). Accordingly, utilities of GAM8678 include diagnosis, prevention and treatment of diseases and clinical conditions associated with C21orf81.

Chromosome 4 open reading frame 6 (C4orf6, Accession NP_005741.1) is another GAM8678 target gene, herein designated TARGET GENE. C4orf6 BINDING SITE is a target binding site found in the 5' untranslated region of mRNA encoded by C4orf6, corresponding to a target binding site such as BINDING SITE I, BINDING SITE II or BINDING SITE III of FIG. 8. Table 4 illustrates the complementarity of the nucleotide sequences of C4orf6 BINDING SITE, designated SEQ ID:2254, to the nucleotide sequence of GAM8678 RNA, herein designated GAM RNA, also designated SEQ ID:347.

Another function of GAM8678 is therefore inhibition of Chromosome 4 open reading frame 6 (C4orf6, Accession NP_005741.1). Accordingly, utilities of GAM8678 include diagnosis, prevention and treatment of diseases and clinical conditions associated with C4orf6.

Chromosome 5 open reading frame 5 (C5orf5, Accession NP_057687.1) is another GAM8678 target gene, herein designated TARGET GENE. C5orf5 BINDING SITE is a target binding site found in the 3' untranslated region of mRNA encoded by C5orf5, corresponding to a target binding site such as BINDING SITE I, BINDING SITE II or BINDING SITE III of FIG. 8. Table 4 illustrates the complementarity of the nucleotide sequences of C5orf5 BINDING SITE, designated SEQ ID:19983, to the nucleotide sequence of GAM8678 RNA, herein designated GAM RNA, also designated SEQ ID:347.

Another function of GAM8678 is therefore inhibition of Chromosome 5 open reading frame 5 (C5orf5, Accession NP_057687.1). Accordingly, utilities of GAM8678 include diagnosis, prevention and treatment of diseases and clinical conditions associated with C5orf5.

Chromosome 5 open reading frame 6 (C5orf6, Accession NP_057689.1) is another GAM8678 target gene, herein designated TARGET GENE. C5orf6 BINDING SITE is a target binding site found in the 3' untranslated region of mRNA encoded by C5orf6, corresponding to a target binding site such as BINDING SITE I, BINDING SITE II or BINDING SITE III of FIG. 8. Table 4 illustrates the complementarity of the nucleotide sequences of C5orf6 BINDING SITE, designated SEQ ID:5117, to the nucleotide sequence of GAM8678 RNA, herein designated GAM RNA, also designated SEQ ID:347.

Another function of GAM8678 is therefore inhibition of Chromosome 5 open reading frame 6 (C5orf6, Accession NP_057689.1). Accordingly, utilities of GAM8678 include diagnosis, prevention and treatment of diseases and clinical conditions associated with C5orf6.

Caspase recruitment domain family, member 15 (CARD15, Accession NP_071445.1) is another GAM8678 target gene, herein designated TARGET GENE. CARD15 BINDING SITE is a target binding site found in the 3' untranslated region of mRNA encoded by CARD15, corresponding to a target binding site such as BINDING SITE I, BINDING SITE II or BINDING SITE III of FIG. 8. Table 4 illustrates the complementarity of the nucleotide sequences of CARD15 BINDING SITE, designated SEQ ID:7952, to the nucleotide sequence of GAM8678 RNA, herein designated GAM RNA, also designated SEQ ID:347.

Another function of GAM8678 is therefore inhibition of Caspase recruitment domain family, member 15 (CARD15, Accession NP_071445.1), a gene which serves as an intracellular receptor for bacterial products in monocytes and transduces signals leading to NFKB activation. and therefore is associated with Blau syndrome. Accordingly, utilities of GAM8678 include diagnosis, prevention and treatment of Blau syndrome, and of other diseases and clinical conditions associated with CARD15.

The function of CARD15 and its association with various diseases and clinical conditions, has been established by previous studies, as described hereinabove with reference to GAM374.2. Caspase recruitment domain family, member 9 (CARD9, Accession NP_434701.1) is another GAM8678 target gene, herein designated TARGET GENE. CARD9 BINDING SITE is a target binding site found in the 5' untranslated region of multiple transcripts of mRNA encoded by CARD9, corresponding to a target binding site such as BINDING SITE I, BINDING SITE II or BINDING SITE III of FIG. 8. Table 4 illustrates the complementarity of the nucleotide sequences of CARD9 BINDING SITE, designated SEQ ID:18998, to the nucleotide sequence of GAM8678 RNA, herein designated GAM RNA, also designated SEQ ID:347.

Another function of GAM8678 is therefore inhibition of Caspase recruitment domain family, member 9 (CARD9, Accession NP_434701.1) . Accordingly, utilities of GAM8678 include diagnosis, prevention and treatment of diseases and clinical conditions associated with CARD9.

Caspase recruitment domain family, member 9 (CARD9, Accession NP_434700.1) is another GAM8678 target gene, herein designated TARGET GENE. CARD9 BINDING SITE is a target binding site found in the 5' untranslated region of multiple transcripts of mRNA encoded by CARD9, corresponding to a target binding site such as BINDING SITE I, BINDING SITE II or BINDING SITE III of FIG. 8. Table 4 illustrates the complementarity of the nucleotide sequences of CARD9 BINDING SITE, designated SEQ ID:18998, to the nucleotide sequence of GAM8678 RNA, herein designated GAM RNA, also designated SEQ ID:347.

Another function of GAM8678 is therefore inhibition of Caspase recruitment domain family, member 9 (CARD9, Accession NP_434700.1) . Accordingly, utilities of GAM8678 include diagnosis, prevention and treatment of diseases and clinical conditions associated with CARD9.

Caspase recruitment domain family, member 9 (CARD9, Accession NP_071747.2) is another GAM8678 target gene, herein designated TARGET GENE. CARD9 BINDING SITE is a target binding site found in the 5' untranslated region of multiple transcripts of mRNA encoded by CARD9, corresponding to a target binding site such as BINDING SITE I, BINDING SITE II or BINDING SITE III of FIG. 8. Table 4 illustrates the complementarity of the nucleotide sequences of CARD9 BINDING SITE, designated SEQ ID:18998, to the nucleotide sequence of GAM8678 RNA, herein designated GAM RNA, also designated SEQ ID:347.

Another function of GAM8678 is therefore inhibition of Caspase recruitment domain family, member 9 (CARD9, Accession NP_071747.2) . Accordingly, utilities of GAM8678 include diagnosis, prevention and treatment of diseases and clinical conditions associated with CARD9.

Carbonyl reductase 1 (CBR1, Accession NP_001748.1) is another GAM8678 target gene, herein designated TARGET GENE. CBR1 BINDING SITE is a target binding site found in the 5' untranslated region of mRNA encoded by CBR1, corresponding to a target binding site such as BINDING SITE I, BINDING SITE II or BINDING SITE III of FIG. 8. Table 4 illustrates the complementarity of the nucleotide sequences of CBR1 BINDING SITE, designated SEQ ID:3247, to the nucleotide sequence of GAM8678 RNA, herein designated GAM RNA, also designated SEQ ID:347.

Another function of GAM8678 is therefore inhibition of Carbonyl reductase 1 (CBR1, Accession NP_001748.1), a gene which catalyze the reduction of a wide variety of carbonyl compounds including the antitumor anthracycline antibiotics. Accordingly, utilities of GAM8678 include diagnosis, prevention and treatment of diseases and clinical conditions associated with CBR1.

The function of CBR1 and its association with various diseases and clinical conditions, has been established by previous studies, as described hereinabove with reference to GAM139.1. CDCP1 (Accession NP_073753.3) is another GAM8678 target gene, herein designated TARGET GENE. CDCP1 BINDING SITE is a target binding site found in the 3' untranslated region of multiple transcripts of mRNA encoded by CDCP1, corresponding to a target binding site such as BINDING SITE I, BINDING SITE II or BINDING SITE III of FIG. 8. Table 4 illustrates the complementarity of the nucleotide sequences of CDCP1 BINDING SITE, designated SEQ ID:4987, to the nucleotide sequence of GAM8678 RNA, herein designated GAM RNA, also designated SEQ ID:347.

Another function of GAM8678 is therefore inhibition of CDCP1 (Accession NP_073753.3). Accordingly, utilities of GAM8678 include diagnosis, prevention and treatment of diseases and clinical conditions associated with CDCP1.

Cyclin-dependent kinase inhibitor 2a (melanoma, p16, inhibits cdk4) (CDKN2A, Accession NP_478104.1) is another GAM8678 target gene, herein designated TARGET GENE. CDKN2A BINDING SITE is a target binding site found in the 3' untranslated region of multiple transcripts of mRNA encoded by CDKN2A, corresponding to a target binding site such as BINDING SITE I, BINDING SITE II or BINDING SITE III of FIG. 8. Table 4 illustrates the complementarity of the nucleotide sequences of CDKN2A BINDING SITE, designated SEQ ID:18494, to the nucleotide sequence of GAM8678 RNA, herein designated GAM RNA, also designated SEQ ID:347.

Another function of GAM8678 is therefore inhibition of Cyclin-dependent kinase inhibitor 2a (melanoma, p16, inhibits cdk4) (CDKN2A, Accession NP_478104.1). Accordingly, utilities of GAM8678 include diagnosis, prevention and treatment of diseases and clinical conditions associated with CDKN2A.

Cyclin-dependent kinase inhibitor 2b (p15, inhibits cdk4) (CDKN2B, Accession NP_511042.1) is another GAM8678 target gene, herein designated TARGET GENE. CDKN2B BINDING SITE is a target binding site found in the 3' untranslated region of multiple transcripts of mRNA encoded by CDKN2B, corresponding to a target binding site such as BINDING SITE I, BINDING SITE II or BINDING SITE III of FIG. 8. Table 4 illustrates the complementarity of the nucleotide sequences of CDKN2B BINDING SITE, designated SEQ ID:18494, to the nucleotide sequence of GAM8678 RNA, herein designated GAM RNA, also designated SEQ ID:347.

Another function of GAM8678 is therefore inhibition of Cyclin-dependent kinase inhibitor 2b (p15, inhibits cdk4) (CDKN2B, Accession NP_511042.1). Accordingly, utilities of GAM8678 include diagnosis, prevention and treatment of diseases and clinical conditions associated with CDKN2B.

Cerebellar degeneration-related protein 1, 34 kda (CDR1, Accession NP_004056.1) is another GAM8678 target gene, herein designated TARGET GENE. CDR1 BINDING SITE is a target binding site found in the 3' untranslated region of mRNA encoded by CDR1, corresponding to a target binding site such as BINDING SITE I, BINDING SITE II or BINDING SITE III of FIG. 8. Table 4 illustrates the complementarity of the nucleotide sequences of CDR1 BINDING SITE, designated SEQ ID:18037, to the nucleotide sequence of GAM8678 RNA, herein designated GAM RNA, also designated SEQ ID:347.

Another function of GAM8678 is therefore inhibition of Cerebellar degeneration-related protein 1, 34 kda (CDR1, Accession NP_004056.1). Accordingly, utilities of GAM8678 include diagnosis, prevention and treatment of diseases and clinical conditions associated with CDR1.

Carcinoembryonic antigen-related cell adhesion molecule 1 (biliary glycoprotein) (CEACAM1, Accession NP_001703.2) is another GAM8678 target gene, herein designated TARGET GENE. CEACAM1 BINDING SITE is a target binding site found in the 5' untranslated region of mRNA encoded by CEACAM1, corresponding to a target binding site such as BINDING SITE I, BINDING SITE II or BINDING SITE III of FIG. 8. Table 4 illustrates the complementarity of the nucleotide sequences of CEACAM1 BINDING SITE, designated SEQ ID:13671, to the nucleotide sequence of GAM8678 RNA, herein designated GAM RNA, also designated SEQ ID:347.

Another function of GAM8678 is therefore inhibition of Carcinoembryonic antigen-related cell adhesion molecule 1 (biliary glycoprotein) (CEACAM1, Accession NP_001703.2), a gene which is a major effector of VEGF and may be a target for the inhibition of tumor angiogenesis. Accordingly, utilities of GAM8678 include diagnosis, prevention and treatment of diseases and clinical conditions associated with CEACAM1.

The function of CEACAM1 and its association with various diseases and clinical conditions, has been established by previous studies, as described hereinabove with reference to GAM335.2. Carcinoembryonic antigen-related cell adhesion molecule 5 (CEACAM5, Accession NP_004354.1) is another GAM8678 target gene, herein designated TARGET GENE. CEACAM5 BINDING SITE is a target binding site found in the 5' untranslated region of mRNA encoded by CEACAM5, corresponding to a target binding site such as BINDING SITE I, BINDING SITE II or BINDING SITE III of FIG. 8. Table 4 illustrates the complementarity of the nucleotide sequences of CEACAM5 BINDING SITE, designated SEQ ID:12584, to the nucleotide sequence of GAM8678 RNA, herein designated GAM RNA, also designated SEQ ID:347.

Another function of GAM8678 is therefore inhibition of Carcinoembryonic antigen-related cell adhesion molecule 5 (CEACAM5, Accession NP_004354.1), a gene which is a complex immunoreactive glycoprotein and therefore may be associated with Liver metastasis. Accordingly, utilities of GAM8678 include diagnosis, prevention and treatment of Liver metastasis, and of other diseases and clinical conditions associated with CEACAM5.

The function of CEACAM5 and its association with various diseases and clinical conditions, has been established by previous studies, as described hereinabove with reference to GAM347.1. Cgg triplet repeat binding protein 1 (CGGBP1, Accession NP_003654.2) is another GAM8678 target gene, herein designated TARGET GENE. CGGBP1 BINDING SITE is a target binding site found in the 5' untranslated region of mRNA encoded by CGGBP1, corresponding to a target binding site such as BINDING SITE I, BINDING SITE II or BINDING SITE III of FIG. 8. Table 4 illustrates the complementarity of the nucleotide sequences of CGGBP1 BINDING SITE, designated SEQ ID:14778, to the nucleotide sequence of GAM8678 RNA, herein designated GAM RNA, also designated SEQ ID:347.

Another function of GAM8678 is therefore inhibition of Cgg triplet repeat binding protein 1 (CGGBP1, Accession NP_003654.2). Accordingly, utilities of GAM8678 include diagnosis, prevention and treatment of diseases and clinical conditions associated with CGGBP1.

Carbohydrate (n-acetylglucosamine 6-o) sulfotransferase 5 (CHST5, Accession NP_036258.1) is another GAM8678 target gene, herein designated TARGET GENE. CHST5 BINDING SITE is a target binding site found in the 5' untranslated region of mRNA encoded by CHST5, corresponding to a target binding site such as BINDING SITE I, BINDING SITE II or BINDING SITE III of FIG. 8. Table 4 illustrates the complementarity of the nucleotide sequences of CHST5 BINDING SITE, designated SEQ ID:9412, to the nucleotide sequence of GAM8678 RNA, herein designated GAM RNA, also designated SEQ ID:347.

Another function of GAM8678 is therefore inhibition of Carbohydrate (n-acetylglucosamine 6-o) sulfotransferase 5 (CHST5, Accession NP_036258.1), a gene which may be involved in sulfation of glycoproteins and proteoglycans. Accordingly, utilities of GAM8678 include diagnosis, prevention and treatment of diseases and clinical conditions associated with CHST5.

The function of CHST5 and its association with various diseases and clinical conditions, has been established by previous studies, as described hereinabove with reference to GAM175.1. Carbohydrate (n-acetylglucosamine 6-o) sulfotransferase 6 (CHST6, Accession NP_067628.1) is another GAM8678 target gene, herein designated TARGET GENE. CHST6 BINDING SITE is a target binding site found in the 3' untranslated region of mRNA encoded by CHST6, corresponding to a target binding site such as BINDING SITE I, BINDING SITE II or BINDING SITE III of FIG. 8. Table 4 illustrates the complementarity of the nucleotide sequences of CHST6 BINDING SITE, designated SEQ ID:20149, to the nucleotide sequence of GAM8678 RNA, herein designated GAM RNA, also designated SEQ ID:347.

Another function of GAM8678 is therefore inhibition of Carbohydrate (n-acetylglucosamine 6-o) sulfotransferase 6 (CHST6, Accession NP_067628.1). Accordingly, utilities of GAM8678 include diagnosis, prevention and treatment of diseases and clinical conditions associated with CHST6.

Claudin 12 (CLDN12, Accession NP_036261.1) is another GAM8678 target gene, herein designated TARGET GENE. CLDN12 BINDING SITE is a target binding site found in the 5' untranslated region of mRNA encoded by CLDN12, corresponding to a target binding site such as BINDING SITE I, BINDING SITE II or BINDING SITE III of FIG. 8. Table 4 illustrates the complementarity of the nucleotide sequences of CLDN12 BINDING SITE, designated SEQ ID:8628, to the nucleotide sequence of GAM8678 RNA, herein designated GAM RNA, also designated SEQ ID:347.

Another function of GAM8678 is therefore inhibition of Claudin 12 (CLDN12, Accession NP_036261.1). Accordingly, utilities of GAM8678 include diagnosis, prevention and treatment of diseases and clinical conditions associated with CLDN12.

Cannabinoid receptor 2 (macrophage) (CNR2, Accession NP_001832.1) is another GAM8678 target gene, herein designated TARGET GENE. CNR2 BINDING SITE is a target binding site found in the 3' untranslated region of mRNA encoded by CNR2, corresponding to a target binding site such as BINDING SITE I, BINDING SITE II or BINDING SITE III of FIG. 8. Table 4 illustrates the complementarity of the nucleotide sequences of CNR2 BINDING SITE, designated SEQ ID:11056, to the nucleotide sequence of GAM8678 RNA, herein designated GAM RNA, also designated SEQ ID:347.

Another function of GAM8678 is therefore inhibition of Cannabinoid receptor 2 (macrophage) (CNR2, Accession NP_001832.1). Accordingly, utilities of GAM8678 include diagnosis, prevention and treatment of diseases and clinical conditions associated with CNR2.

Collagen, type xvii, alpha 1 (COL17A1, Accession NP_000485.2) is another GAM8678 target gene, herein designated TARGET GENE. COL17A1 BINDING SITE is a target binding site found in the 3' untranslated region of multiple transcripts of mRNA encoded by COL17A1, corresponding to a target binding site such as BINDING SITE I, BINDING SITE II or BINDING SITE III of FIG. 8. Table 4 illustrates the complementarity of the nucleotide sequences of COL17A1 BINDING SITE, designated SEQ ID:6300, to the nucleotide sequence of GAM8678 RNA, herein designated GAM RNA, also designated SEQ ID:347.

Another function of GAM8678 is therefore inhibition of Collagen, type xvii, alpha 1 (COL17A1, Accession NP_000485.2). Accordingly, utilities of GAM8678 include diagnosis, prevention and treatment of diseases and clinical conditions associated with COL17A1.

Collectin sub-family member 12 (COLEC12, Accession NP_110408.2) is another GAM8678 target gene, herein designated TARGET GENE. COLEC12 BINDING SITE is a target binding site found in the 5' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:19564, to the nucleotide sequence of GAM8678 RNA, herein designated GAM RNA, also designated SEQ ID:347.

Another function of GAM8678 is therefore inhibition of Collectin sub-family member 12 (COLEC12, Accession NP_110408.2). Accordingly, utilities of GAM8678 include diagnosis, prevention and treatment of diseases and clinical conditions associated with COLEC12.

Collectin sub-family member 12 (COLEC12, Accession NP_569057.1) is another GAM8678 target gene, herein designated TARGET GENE. COLEC12 BINDING SITE is a target binding site found in the 5' untranslated region of multiple transcripts of mRNA encoded by COLEC12, corresponding to a target binding site such as BINDING SITE I, BINDING SITE II or BINDING SITE III of FIG. 8. Table 4 illustrates the complementarity of the nucleotide sequences of COLEC12 BINDING SITE, designated SEQ ID:19564, to the nucleotide sequence of GAM8678 RNA, herein designated GAM RNA, also designated SEQ ID:347.

Another function of GAM8678 is therefore inhibition of Collectin sub-family member 12 (COLEC12, Accession NP_569057.1). Accordingly, utilities of GAM8678 include diagnosis, prevention and treatment of diseases and clinical conditions associated with COLEC12.

Cellular repressor of e1a-stimulated genes (CREG, Accession NP_003842.1) is another GAM8678 target gene, herein designated TARGET GENE. CREG BINDING SITE is a target binding site found in the 5' untranslated region of mRNA encoded by CREG, corresponding to a target binding site such as BINDING SITE I, BINDING SITE II or BINDING SITE III of FIG. 8. Table 4 illustrates the complementarity of the nucleotide sequences of CREG BINDING SITE, designated SEQ ID:5534, to the nucleotide sequence of GAM8678 RNA, herein designated GAM RNA, also designated SEQ ID:347.

Another function of GAM8678 is therefore inhibition of Cellular repressor of e1a-stimulated genes (CREG, Accession NP_003842.1). Accordingly, utilities of GAM8678 include diagnosis, prevention and treatment of diseases and clinical conditions associated with CREG.

Cytochrome p450, subfamily ivb, polypeptide 1 (CYP4B1, Accession NP_000770.1) is another GAM8678 target gene, herein designated TARGET GENE. CYP4B1 BINDING SITE is a target binding site found in the 3' untranslated region of mRNA encoded by CYP4B1, corresponding to a target binding site such as BINDING SITE I, BINDING SITE II or BINDING SITE III of FIG. 8. Table 4 illustrates the complementarity of the nucleotide sequences of CYP4B1 BINDING SITE, designated SEQ ID:16905, to the nucleotide sequence of GAM8678 RNA, herein designated GAM RNA, also designated SEQ ID:347.

Another function of GAM8678 is therefore inhibition of Cytochrome p450, subfamily ivb, polypeptide 1 (CYP4B1, Accession NP_000770.1), a gene which intervenes in an NADPH-dependent electron transport pathway. Accordingly, utilities of GAM8678 include diagnosis, prevention and treatment of diseases and clinical conditions associated with CYP4B1.

The function of CYP4B1 and its association with various diseases and clinical conditions, has been established by previous studies, as described hereinabove with reference to GAM1035.1. Doublecortex; lissencephaly, x-linked (doublecortin) (DCX, Accession NP_000546.2) is another GAM8678 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:18999, to the nucleotide sequence of GAM8678 RNA, herein designated GAM RNA, also designated SEQ ID:347.

Another function of GAM8678 is therefore inhibition of Doublecortex; lissencephaly, x-linked (doublecortin) (DCX, Accession NP_000546.2). Accordingly, utilities of GAM8678 include diagnosis, prevention and treatment of diseases and clinical conditions associated with DCX.

Doublecortex; lissencephaly, x-linked (doublecortin) (DCX, Accession NP_835365.1) is another GAM8678 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:18999, to the nucleotide sequence of GAM8678 RNA, herein designated GAM RNA, also designated SEQ ID:347.

Another function of GAM8678 is therefore inhibition of Doublecortex; lissencephaly, x-linked (doublecortin) (DCX, Accession NP_835365.1). Accordingly, utilities of GAM8678 include diagnosis, prevention and treatment of diseases and clinical conditions associated with DCX.

Doublecortex; lissencephaly, x-linked (doublecortin) (DCX, Accession NP_835366.1) is another GAM8678 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:18999, to the nucleotide sequence of GAM8678 RNA, herein designated GAM RNA, also designated SEQ ID:347.

Another function of GAM8678 is therefore inhibition of Doublecortex; lissencephaly, x-linked (doublecortin) (DCX, Accession NP_835366.1). Accordingly, utilities of GAM8678 include diagnosis, prevention and treatment of diseases and clinical conditions associated with DCX.

Doublecortex; lissencephaly, x-linked (doublecortin) (DCX, Accession NP_835364.1) is another GAM8678 target gene, herein designated TARGET GENE. DCX BINDING SITE is a target binding site found in the 3' untranslated region of multiple transcripts of mRNA encoded by DCX, corresponding to a target binding site such as BINDING SITE I, BINDING SITE II or BINDING SITE III of FIG. 8. Table 4 illustrates the complementarity of the nucleotide sequences of DCX BINDING SITE, designated SEQ ID:18999, to the nucleotide sequence of GAM8678 RNA, herein designated GAM RNA, also designated SEQ ID:347.

Another function of GAM8678 is therefore inhibition of Doublecortex; lissencephaly, x-linked (doublecortin) (DCX, Accession NP_835364.1). Accordingly, utilities of GAM8678 include diagnosis, prevention and treatment of diseases and clinical conditions associated with DCX.

Digeorge syndrome critical region gene 9 (DGCR9, Accession XP_097827.1) is another GAM8678 target gene, herein designated TARGET GENE. DGCR9 BINDING SITE is a target binding site found in the 3' untranslated region of mRNA encoded by DGCR9, corresponding to a target binding site such as BINDING SITE I, BINDING SITE II or BINDING SITE III of FIG. 8. Table 4 illustrates the complementarity of the nucleotide sequences of DGCR9 BINDING SITE, designated SEQ ID:17341, to the nucleotide sequence of GAM8678 RNA, herein designated GAM RNA, also designated SEQ ID:347.

Another function of GAM8678 is therefore inhibition of Digeorge syndrome critical region gene 9 (DGCR9, Accession XP_097827.1). Accordingly, utilities of GAM8678 include diagnosis, prevention and treatment of diseases and clinical conditions associated with DGCR9.

DKFZP434F0318 (Accession NP_110444.1) is another GAM8678 target gene, herein designated TARGET GENE. DKFZP434F0318 BINDING SITE is a target binding site found in the 3' untranslated region of mRNA encoded by DKFZP434F0318, corresponding to a target binding site such as BINDING SITE I, BINDING SITE II or BINDING SITE III of FIG. 8. Table 4 illustrates the complementarity of the nucleotide sequences of DKFZP434F0318 BINDING SITE, designated SEQ ID:9302, to the nucleotide sequence of GAM8678 RNA, herein designated GAM RNA, also designated SEQ ID:347.

Another function of GAM8678 is therefore inhibition of DKFZP434F0318 (Accession NP_110444.1). Accordingly, utilities of GAM8678 include diagnosis, prevention and treatment of diseases and clinical conditions associated with DKFZP434F0318.

DKFZP434G1411 (Accession XP_166383.1) is another GAM8678 target gene, herein designated TARGET GENE. DKFZP434G1411 BINDING SITE is a target binding site found in the 3' untranslated region of mRNA encoded by DKFZP434G1411, corresponding to a target binding site such as BINDING SITE I, BINDING SITE II or BINDING SITE III of FIG. 8. Table 4 illustrates the complementarity of the nucleotide sequences of DKFZP434G1411 BINDING SITE, designated SEQ ID:1085, to the nucleotide sequence of GAM8678 RNA, herein designated GAM RNA, also designated SEQ ID:347.

Another function of GAM8678 is therefore inhibition of DKFZP434G1411 (Accession XP_166383.1). Accordingly, utilities of GAM8678 include diagnosis, prevention and treatment of diseases and clinical conditions associated with DKFZP434G1411.

DKFZP564C103 (Accession NP_056469.2) is another GAM8678 target gene, herein designated TARGET GENE. DKFZP564C103 BINDING SITE is a target binding site found in the 3' untranslated region of mRNA encoded by DKFZP564C103, corresponding to a target binding site such as BINDING SITE I, BINDING SITE II or BINDING SITE III of FIG. 8. Table 4 illustrates the complementarity of the nucleotide sequences of DKFZP564C103 BINDING SITE, designated SEQ ID:8255, to the nucleotide sequence of GAM8678 RNA, herein designated GAM RNA, also designated SEQ ID:347.

Another function of GAM8678 is therefore inhibition of DKFZP564C103 (Accession NP_056469.2). Accordingly, utilities of GAM8678 include diagnosis, prevention and treatment of diseases and clinical conditions associated with DKFZP564C103.

DKFZP586M1120 (Accession NP_112584.1) is another GAM8678 target gene, herein designated TARGET GENE. DKFZP586M1120 BINDING SITE is a target binding site found in the 3' untranslated region of mRNA encoded by DKFZP586M1120, corresponding to a target binding site such as BINDING SITE I, BINDING SITE II or BINDING SITE III of FIG. 8. Table 4 illustrates the complementarity of the nucleotide sequences of DKFZP586M1120 BINDING SITE, designated SEQ ID:9451, to the nucleotide sequence of GAM8678 RNA, herein designated GAM RNA, also designated SEQ ID:347.

Another function of GAM8678 is therefore inhibition of DKFZP586M1120 (Accession NP_112584.1). Accordingly, utilities of GAM8678 include diagnosis, prevention and treatment of diseases and clinical conditions associated with DKFZP586M1120.

DKFZp667E0512 (Accession XP_117353.1) is another GAM8678 target gene, herein designated TARGET GENE. DKFZp667E0512 BINDING SITE is a target binding site found in the 3' untranslated region of mRNA encoded by DKFZp667E0512, corresponding to a target binding site such as BINDING SITE I, BINDING SITE II or BINDING SITE III of FIG. 8. Table 4 illustrates the complementarity of the nucleotide sequences of DKFZp667E0512 BINDING SITE, designated SEQ ID:4910, to the nucleotide sequence of GAM8678 RNA, herein designated GAM RNA, also designated SEQ ID:347.

Another function of GAM8678 is therefore inhibition of DKFZp667E0512 (Accession XP_117353.1). Accordingly, utilities of GAM8678 include diagnosis, prevention and treatment of diseases and clinical conditions associated with DKFZp667E0512.

DKFZp761K1423 (Accession NP_060892.1) is another GAM8678 target gene, herein designated TARGET GENE. DKFZp761K1423 BINDING SITE is a target binding site found in the 5' untranslated region of mRNA encoded by DKFZp761K1423, corresponding to a target binding site such as BINDING SITE I, BINDING SITE II or BINDING SITE III of FIG. 8. Table 4 illustrates the complementarity of the nucleotide sequences of DKFZp761K1423 BINDING SITE, designated SEQ ID:16429, to the nucleotide sequence of GAM8678 RNA, herein designated GAM RNA, also designated SEQ ID:347.

Another function of GAM8678 is therefore inhibition of DKFZp761K1423 (Accession NP_060892.1). Accordingly, utilities of GAM8678 include diagnosis, prevention and treatment of diseases and clinical conditions associated with DKFZp761K1423.

Dystrobrevin, alpha (DTNA, Accession NP_116763.1) is another GAM8678 target gene, herein designated TARGET GENE. DTNA BINDING SITE is a target binding site found in the 5' untranslated region of multiple transcripts of mRNA encoded by DTNA, corresponding to a target binding site such as BINDING SITE I, BINDING SITE II or BINDING SITE III of FIG. 8. Table 4 illustrates the complementarity of the nucleotide sequences of DTNA BINDING SITE, designated SEQ ID:7785, to the nucleotide sequence of GAM8678 RNA, herein designated GAM RNA, also designated SEQ ID:347.

Another function of GAM8678 is therefore inhibition of Dystrobrevin, alpha (DTNA, Accession NP_116763.1), a gene which may be involved in the formation and stability of synapses. and therefore may be associated with Limb-girdle muscular dystrophy and congenital heart defects. Accordingly, utilities of GAM8678 include diagnosis, prevention and treatment of Limb-girdle muscular dystrophy and congenital heart defects, and of other diseases and clinical conditions associated with DTNA.

The function of DTNA and its association with various diseases and clinical conditions, has been established by previous studies, as described hereinabove with reference to GAM492.2. Dystrobrevin, alpha (DTNA, Accession NP_116762.1) is another GAM8678 target gene, herein designated TARGET GENE. DTNA BINDING SITE is a target binding site found in the 5' untranslated region of multiple transcripts of mRNA encoded by DTNA, corresponding to a target binding site such as BINDING SITE I, BINDING SITE II or BINDING SITE III of FIG. 8. Table 4 illustrates the complementarity of the nucleotide sequences of DTNA BINDING SITE, designated SEQ ID:7785, to the nucleotide sequence of GAM8678 RNA, herein designated GAM RNA, also designated SEQ ID:347.

Another function of GAM8678 is therefore inhibition of Dystrobrevin, alpha (DTNA, Accession NP_116762.1), a gene which may be involved in the formation and stability of synapses. and therefore may be associated with Limb-girdle muscular dystrophy and congenital heart defects. Accordingly, utilities of GAM8678 include diagnosis, prevention and treatment of Limb-girdle muscular dystrophy and congenital heart defects, and of other diseases and clinical conditions associated with DTNA.

The function of DTNA and its association with various diseases and clinical conditions, has been established by previous studies, as described hereinabove with reference to GAM492.2. EAT2 (Accession NP_444512.1) is another GAM8678 target gene, herein designated TARGET GENE. EAT2 BINDING SITE is a target binding site found in the 5' untranslated region of mRNA encoded by EAT2, corresponding to a target binding site such as BINDING SITE I, BINDING SITE II or BINDING SITE III of FIG. 8. Table 4 illustrates the complementarity of the nucleotide sequences of EAT2 BINDING SITE, designated SEQ ID:9613, to the nucleotide sequence of GAM8678 RNA, herein designated GAM RNA, also designated SEQ ID:347.

Another function of GAM8678 is therefore inhibition of EAT2 (Accession NP_444512.1). Accordingly, utilities of GAM8678 include diagnosis, prevention and treatment of diseases and clinical conditions associated with EAT2.

Ephrin-a5 (EFNA5, Accession NP_001953.1) is another GAM8678 target gene, herein designated TARGET GENE. EFNA5 BINDING SITE is a target binding site found in the 3' untranslated region of mRNA encoded by EFNA5, corresponding to a target binding site such as BINDING SITE I, BINDING SITE II or BINDING SITE III of FIG. 8. Table 4 illustrates the complementarity of the nucleotide sequences of EFNA5 BINDING SITE, designated SEQ ID:2962, to the nucleotide sequence of GAM8678 RNA, herein designated GAM RNA, also designated SEQ ID:347.

Another function of GAM8678 is therefore inhibition of Ephrin-a5 (EFNA5, Accession NP_001953.1). Accordingly, utilities of GAM8678 include diagnosis, prevention and treatment of diseases and clinical conditions associated with EFNA5.

E1a binding protein p300 (EP300, Accession NP_001420.1) is another GAM8678 target gene, herein designated TARGET GENE. EP300 BINDING SITE is a target binding site found in the 3' untranslated region of mRNA encoded by EP300, corresponding to a target binding site such as BINDING SITE I, BINDING SITE II or BINDING SITE III of FIG. 8. Table 4 illustrates the complementarity of the nucleotide sequences of EP300 BINDING SITE, designated SEQ ID:5735, to the nucleotide sequence of GAM8678 RNA, herein designated GAM RNA, also designated SEQ ID:347.

Another function of GAM8678 is therefore inhibition of E1a binding protein p300 (EP300, Accession NP_001420.1), a gene which may have a function in cell cycle regulation. and therefore may be associated with Colorectal cancer. Accordingly, utilities of GAM8678 include diagnosis, prevention and treatment of Colorectal cancer, and of other diseases and clinical conditions associated with EP300.

The function of EP300 and its association with various diseases and clinical conditions, has been established by previous studies, as described hereinabove with reference to GAM473.1. Coagulation factor xiii, a1 polypeptide (F13A1, Accession NP_000120.1) is another GAM8678 target gene, herein designated TARGET GENE. F13A1 BINDING SITE is a target binding site found in the 3' untranslated region of mRNA encoded by F13A1, corresponding to a target binding site such as BINDING SITE I, BINDING SITE II or BINDING SITE III of FIG. 8. Table 4 illustrates the complementarity of the nucleotide sequences of F13A1 BINDING SITE, designated SEQ ID:5593, to the nucleotide sequence of GAM8678 RNA, herein designated GAM RNA, also designated SEQ ID:347.

Another function of GAM8678 is therefore inhibition of Coagulation factor xiii, a1 polypeptide (F13A1, Accession NP_000120.1). Accordingly, utilities of GAM8678 include diagnosis, prevention and treatment of diseases and clinical conditions associated with F13A1.

Ferm, rhogef (arhgef) and pleckstrin domain protein 1 (chondrocyte-derived) (FARP1, Accession NP_005757.1) is another GAM8678 target gene, herein designated TARGET GENE. FARP1 BINDING SITE is a target binding site found in the 3' untranslated region of mRNA encoded by FARP1, corresponding to a target binding site such as BINDING SITE I, BINDING SITE II or BINDING SITE III of FIG. 8. Table 4 illustrates the complementarity of the nucleotide sequences of FARP1 BINDING SITE, designated SEQ ID:14652, to the nucleotide sequence of GAM8678 RNA, herein designated GAM RNA, also designated SEQ ID:347.

Another function of GAM8678 is therefore inhibition of Ferm, rhogef (arhgef) and pleckstrin domain protein 1 (chondrocyte-derived) (FARP1, Accession NP_005757.1). Accordingly, utilities of GAM8678 include diagnosis, prevention and treatment of diseases and clinical conditions associated with FARP1.

FLJ00103 (Accession XP_036104.5) is another GAM8678 target gene, herein designated TARGET GENE. FLJ00103 BINDING SITE is a target binding site found in the 3' untranslated region of mRNA encoded by FLJ00103, corresponding to a target binding site such as BINDING SITE I, BINDING SITE II or BINDING SITE III of FIG. 8. Table 4 illustrates the complementarity of the nucleotide sequences of FLJ00103 BINDING SITE, designated SEQ ID:4563, to the nucleotide sequence of GAM8678 RNA, herein designated GAM RNA, also designated SEQ ID:347.

Another function of GAM8678 is therefore inhibition of FLJ00103 (Accession XP_036104.5). Accordingly, utilities of GAM8678 include diagnosis, prevention and treatment of diseases and clinical conditions associated with FLJ00103.

FLJ00225 (Accession XP_084552.3) is another GAM8678 target gene, herein designated TARGET GENE. FLJ00225 BINDING SITE is a target binding site found in the 5' untranslated region of mRNA encoded by FLJ00225, corresponding to a target binding site such as BINDING SITE I, BINDING SITE II or BINDING SITE III of FIG. 8. Table 4 illustrates the complementarity of the nucleotide sequences of FLJ00225 BINDING SITE, designated SEQ ID:19498, to the nucleotide sequence of GAM8678 RNA, herein designated GAM RNA, also designated SEQ ID:347.

Another function of GAM8678 is therefore inhibition of FLJ00225 (Accession XP_084552.3). Accordingly, utilities of GAM8678 include diagnosis, prevention and treatment of diseases and clinical conditions associated with FLJ00225.

FLJ10290 (Accession NP_060517.1) is another GAM8678 target gene, herein designated TARGET GENE. FLJ10290 BINDING SITE is a target binding site found in the 3' untranslated region of mRNA encoded by FLJ10290, corresponding to a target binding site such as BINDING SITE I, BINDING SITE II or BINDING SITE III of FIG. 8. Table 4 illustrates the complementarity of the nucleotide sequences of FLJ10290 BINDING SITE, designated SEQ ID:15918, to the nucleotide sequence of GAM8678 RNA, herein designated GAM RNA, also designated SEQ ID:347.

Another function of GAM8678 is therefore inhibition of FLJ10290 (Accession NP_060517.1). Accordingly, utilities of GAM8678 include diagnosis, prevention and treatment of diseases and clinical conditions associated with FLJ10290.

FLJ10496 (Accession NP_060584.2) is another GAM8678 target gene, herein designated TARGET GENE. FLJ10496 BINDING SITE is a target binding site found in the 3' untranslated region of mRNA encoded by FLJ10496, corresponding to a target binding site such as BINDING SITE I, BINDING SITE II or BINDING SITE III of FIG. 8. Table 4 illustrates the complementarity of the nucleotide sequences of FLJ10496 BINDING SITE, designated SEQ ID:2494, to the nucleotide sequence of GAM8678 RNA, herein designated GAM RNA, also designated SEQ ID:347.

Another function of GAM8678 is therefore inhibition of FLJ10496 (Accession NP_060584.2). Accordingly, utilities of GAM8678 include diagnosis, prevention and treatment of diseases and clinical conditions associated with FLJ10496.

FLJ11301 (Accession NP_060855.1) is another GAM8678 target gene, herein designated TARGET GENE. FLJ11301 BINDING SITE is a target binding site found in the 3' untranslated region of mRNA encoded by FLJ11301, corresponding to a target binding site such as BINDING SITE I, BINDING SITE II or BINDING SITE III of FIG. 8. Table 4 illustrates the complementarity of the nucleotide sequences of FLJ11301 BINDING SITE, designated SEQ ID:6745, to the nucleotide sequence of GAM8678 RNA, herein designated GAM RNA, also designated SEQ ID:347.

Another function of GAM8678 is therefore inhibition of FLJ11301 (Accession NP_060855.1). Accordingly, utilities of GAM8678 include diagnosis, prevention and treatment of diseases and clinical conditions associated with FLJ11301.

FLJ11871 (Accession NP_079393.1) is another GAM8678 target gene, herein designated TARGET GENE. FLJ11871 BINDING SITE is a target binding site found in the 3' untranslated region of mRNA encoded by FLJ11871, corresponding to a target binding site such as BINDING SITE I, BINDING SITE II or BINDING SITE III of FIG. 8. Table 4 illustrates the complementarity of the nucleotide sequences of FLJ11871 BINDING SITE, designated SEQ ID:4130, to the nucleotide sequence of GAM8678 RNA, herein designated GAM RNA, also designated SEQ ID:347.

Another function of GAM8678 is therefore inhibition of FLJ11871 (Accession NP_079393.1). Accordingly, utilities of GAM8678 include diagnosis, prevention and treatment of diseases and clinical conditions associated with FLJ11871.

FLJ12476 (Accession NP_073621.1) is another GAM8678 target gene, herein designated TARGET GENE. FLJ12476 BINDING SITE is a target binding site found in the 3' untranslated region of mRNA encoded by FLJ12476, corresponding to a target binding site such as BINDING SITE I, BINDING SITE II or BINDING SITE III of FIG. 8. Table 4 illustrates the complementarity of the nucleotide sequences of FLJ12476 BINDING SITE, designated SEQ ID:17053, to the nucleotide sequence of GAM8678 RNA, herein designated GAM RNA, also designated SEQ ID:347.

Another function of GAM8678 is therefore inhibition of FLJ12476 (Accession NP_073621.1). Accordingly, utilities of GAM8678 include diagnosis, prevention and treatment of diseases and clinical conditions associated with FLJ12476.

FLJ13197 (Accession NP_078890.1) is another GAM8678 target gene, herein designated TARGET GENE. FLJ13197 BINDING SITE is a target binding site found in the 3' untranslated region of mRNA encoded by FLJ13197, corresponding to a target binding site such as BINDING SITE I, BINDING SITE II or BINDING SITE III of FIG. 8. Table 4 illustrates the complementarity of the nucleotide sequences of FLJ13197 BINDING SITE, designated SEQ ID:9668, to the nucleotide sequence of GAM8678 RNA, herein designated GAM RNA, also designated SEQ ID:347.

Another function of GAM8678 is therefore inhibition of FLJ13197 (Accession NP_078890.1). Accordingly, utilities of GAM8678 include diagnosis, prevention and treatment of diseases and clinical conditions associated with FLJ13197.

FLJ13744 (Accession NP_079287.1) is another GAM8678 target gene, herein designated TARGET GENE. FLJ13744 BINDING SITE is a target binding site found in the 3' untranslated region of mRNA encoded by FLJ13744, corresponding to a target binding site such as BINDING SITE I, BINDING SITE II or BINDING SITE III of FIG. 8. Table 4 illustrates the complementarity of the nucleotide sequences of FLJ13744 BINDING SITE, designated SEQ ID:7904, to the nucleotide sequence of GAM8678 RNA, herein designated GAM RNA, also designated SEQ ID:347.

Another function of GAM8678 is therefore inhibition of FLJ13744 (Accession NP_079287.1). Accordingly, utilities of GAM8678 include diagnosis, prevention and treatment of diseases and clinical conditions associated with FLJ13744.

FLJ14001 (Accession NP_078953.2) is another GAM8678 target gene, herein designated TARGET GENE. FLJ14001 BINDING SITE is a target binding site found in the 5' untranslated region of mRNA encoded by FLJ14001, corresponding to a target binding site such as BINDING SITE I, BINDING SITE II or BINDING SITE III of FIG. 8. Table 4 illustrates the complementarity of the nucleotide sequences of FLJ14001 BINDING SITE, designated SEQ ID:5786, to the nucleotide sequence of GAM8678 RNA, herein designated GAM RNA, also designated SEQ ID:347.

Another function of GAM8678 is therefore inhibition of FLJ14001 (Accession NP_078953.2). Accordingly, utilities of GAM8678 include diagnosis, prevention and treatment of diseases and clinical conditions associated with FLJ14001.

FLJ20618 (Accession NP_060373.1) is another GAM8678 target gene, herein designated TARGET GENE. FLJ20618 BINDING SITE is a target binding site found in the 3' untranslated region of mRNA encoded by FLJ20618, corresponding to a target binding site such as BINDING SITE I, BINDING SITE II or BINDING SITE III of FIG. 8. Table 4 illustrates the complementarity of the nucleotide sequences of FLJ20618 BINDING SITE, designated SEQ ID:8115, to the nucleotide sequence of GAM8678 RNA, herein designated GAM RNA, also designated SEQ ID:347.

Another function of GAM8678 is therefore inhibition of FLJ20618 (Accession NP_060373.1). Accordingly, utilities of GAM8678 include diagnosis, prevention and treatment of diseases and clinical conditions associated with FLJ20618.

FLJ20699 (Accession NP_060401.1) is another GAM8678 target gene, herein designated TARGET GENE. FLJ20699 BINDING SITE is a target binding site found in the 3' untranslated region of mRNA encoded by FLJ20699, corresponding to a target binding site such as BINDING SITE I, BINDING SITE II or BINDING SITE III of FIG. 8. Table 4 illustrates the complementarity of the nucleotide sequences of FLJ20699 BINDING SITE, designated SEQ ID:18495, to the nucleotide sequence of GAM8678 RNA, herein designated GAM RNA, also designated SEQ ID:347.

Another function of GAM8678 is therefore inhibition of FLJ20699 (Accession NP_060401.1). Accordingly, utilities of GAM8678 include diagnosis, prevention and treatment of diseases and clinical conditions associated with FLJ20699.

FLJ22031 (Accession NP_079350.1) is another GAM8678 target gene, herein designated TARGET GENE. FLJ22031 BINDING SITE1 and FLJ22031 BINDING SITE2 are target binding sites found in untranslated regions of mRNA encoded by FLJ22031, corresponding to target binding sites such as BINDING SITE I, BINDING SITE II or BINDING SITE III of FIG. 8. Table 4 illustrates the complementarity of the nucleotide sequences of FLJ22031 BINDING SITE1 and FLJ22031 BINDING SITE2, designated SEQ ID:6101 and SEQ ID:19363 respectively, to the nucleotide sequence of GAM8678 RNA, herein designated GAM RNA, also designated SEQ ID:347.

Another function of GAM8678 is therefore inhibition of FLJ22031 (Accession NP_079350.1). Accordingly, utilities of GAM8678 include diagnosis, prevention and treatment of diseases and clinical conditions associated with FLJ22031.

FLJ22167 (Accession NP_078809.2) is another GAM8678 target gene, herein designated TARGET GENE. FLJ22167 BINDING SITE is a target binding site found in the 5' untranslated region of mRNA encoded by FLJ22167, corresponding to a target binding site such as BINDING SITE I, BINDING SITE II or BINDING SITE III of FIG. 8. Table 4 illustrates the complementarity of the nucleotide sequences of FLJ22167 BINDING SITE, designated SEQ ID:9412, to the nucleotide sequence of GAM8678 RNA, herein designated GAM RNA, also designated SEQ ID:347.

Another function of GAM8678 is therefore inhibition of FLJ22167 (Accession NP_078809.2). Accordingly, utilities of GAM8678 include diagnosis, prevention and treatment of diseases and clinical conditions associated with FLJ22167.

FLJ22246 (Accession NP_079508.2) is another GAM8678 target gene, herein designated TARGET GENE. FLJ22246 BINDING SITE is a target binding site found in the 5' untranslated region of mRNA encoded by FLJ22246, corresponding to a target binding site such as BINDING SITE I, BINDING SITE II or BINDING SITE III of FIG. 8. Table 4 illustrates the complementarity of the nucleotide sequences of FLJ22246 BINDING SITE, designated SEQ ID:11816, to the nucleotide sequence of GAM8678 RNA, herein designated GAM RNA, also designated SEQ ID:347.

Another function of GAM8678 is therefore inhibition of FLJ22246 (Accession NP_079508.2). Accordingly, utilities of GAM8678 include diagnosis, prevention and treatment of diseases and clinical conditions associated with FLJ22246.

FLJ23342 (Accession NP_078907.1) is another GAM8678 target gene, herein designated TARGET GENE. FLJ23342 BINDING SITE is a target binding site found in the 3' untranslated region of mRNA encoded by FLJ23342, corresponding to a target binding site such as BINDING SITE I, BINDING SITE II or BINDING SITE III of FIG. 8. Table 4 illustrates the complementarity of the nucleotide sequences of FLJ23342 BINDING SITE, designated SEQ ID:18137, to the nucleotide sequence of GAM8678 RNA, herein designated GAM RNA, also designated SEQ ID:347.

Another function of GAM8678 is therefore inhibition of FLJ23342 (Accession NP_078907.1). Accordingly, utilities of GAM8678 include diagnosis, prevention and treatment of diseases and clinical conditions associated with FLJ23342.

FLJ23614 (Accession NP_689908.2) is another GAM8678 target gene, herein designated TARGET GENE. FLJ23614 BINDING SITE is a target binding site found in the 3' untranslated region of mRNA encoded by FLJ23614, corresponding to a target binding site such as BINDING SITE I, BINDING SITE II or BINDING SITE III of FIG. 8. Table 4 illustrates the complementarity of the nucleotide sequences of FLJ23614 BINDING SITE, designated SEQ ID:5496, to the nucleotide sequence of GAM8678 RNA, herein designated GAM RNA, also designated SEQ ID:347.

Another function of GAM8678 is therefore inhibition of FLJ23614 (Accession NP_689908.2). Accordingly, utilities of GAM8678 include diagnosis, prevention and treatment of diseases and clinical conditions associated with FLJ23614.

FLJ25410 (Accession NP_653206.1) is another GAM8678 target gene, herein designated TARGET GENE. FLJ25410 BINDING SITE is a target binding site found in the 5' untranslated region of mRNA encoded by FLJ25410, corresponding to a target binding site such as BINDING SITE I, BINDING SITE II or BINDING SITE III of FIG. 8. Table 4 illustrates the complementarity of the nucleotide sequences of FLJ25410 BINDING SITE, designated SEQ ID:3189, to the nucleotide sequence of GAM8678 RNA, herein designated GAM RNA, also designated SEQ ID:347.

Another function of GAM8678 is therefore inhibition of FLJ25410 (Accession NP_653206.1). Accordingly, utilities of GAM8678 include diagnosis, prevention and treatment of diseases and clinical conditions associated with FLJ25410.

FLJ30313 (Accession NP_689970.1) is another GAM8678 target gene, herein designated TARGET GENE. FLJ30313 BINDING SITE is a target binding site found in the 5' untranslated region of mRNA encoded by FLJ30313, corresponding to a target binding site such as BINDING SITE I, BINDING SITE II or BINDING SITE III of FIG. 8. Table 4 illustrates the complementarity of the nucleotide sequences of FLJ30313 BINDING SITE, designated SEQ ID:12845, to the nucleotide sequence of GAM8678 RNA, herein designated GAM RNA, also designated SEQ ID:347.

Another function of GAM8678 is therefore inhibition of FLJ30313 (Accession NP_689970.1). Accordingly, utilities of GAM8678 include diagnosis, prevention and treatment of diseases and clinical conditions associated with FLJ30313.

FLJ31364 (Accession NP_689676.1) is another GAM8678 target gene, herein designated TARGET GENE. FLJ31364 BINDING SITE is a target binding site found in the 3' untranslated region of mRNA encoded by FLJ31364, corresponding to a target binding site such as BINDING SITE I, BINDING SITE II or BINDING SITE III of FIG. 8. Table 4 illustrates the complementarity of the nucleotide sequences of FLJ31364 BINDING SITE, designated SEQ ID:14150, to the nucleotide sequence of GAM8678 RNA, herein designated GAM RNA, also designated SEQ ID:347.

Another function of GAM8678 is therefore inhibition of FLJ31364 (Accession NP_689676.1). Accordingly, utilities of GAM8678 include diagnosis, prevention and treatment of diseases and clinical conditions associated with FLJ31364.

FLJ32063 (Accession NP_694576.1) is another GAM8678 target gene, herein designated TARGET GENE. FLJ32063 BINDING SITE1 and FLJ32063 BINDING SITE2 are target binding sites found in untranslated regions of mRNA encoded by FLJ32063, corresponding to target binding sites such as BINDING SITE I, BINDING SITE II or BINDING SITE III of FIG. 8. Table 4 illustrates the complementarity of the nucleotide sequences of FLJ32063 BINDING SITE1 and FLJ32063 BINDING SITE2, designated SEQ ID:7129 and SEQ ID:12524 respectively, to the nucleotide sequence of GAM8678 RNA, herein designated GAM RNA, also designated SEQ ID:347.

Another function of GAM8678 is therefore inhibition of FLJ32063 (Accession NP_694576.1). Accordingly, utilities of GAM8678 include diagnosis, prevention and treatment of diseases and clinical conditions associated with FLJ32063.

FLJ35487 (Accession NP_776181.1) is another GAM8678 target gene, herein designated TARGET GENE. FLJ35487 BINDING SITE is a target binding site found in the 3' untranslated region of mRNA encoded by FLJ35487, corresponding to a target binding site such as BINDING SITE I, BINDING SITE II or BINDING SITE III of FIG. 8. Table 4 illustrates the complementarity of the nucleotide sequences of FLJ35487 BINDING SITE, designated SEQ ID:8392, to the nucleotide sequence of GAM8678 RNA, herein designated GAM RNA, also designated SEQ ID:347.

Another function of GAM8678 is therefore inhibition of FLJ35487 (Accession NP_776181.1). Accordingly, utilities of GAM8678 include diagnosis, prevention and treatment of diseases and clinical conditions associated with FLJ35487.

Ferritin, heavy polypeptide 1 (FTH1, Accession NP_002023.1) is another GAM8678 target gene, herein designated TARGET GENE. FTH1 BINDING SITE is a target binding site found in the 3' untranslated region of mRNA encoded by FTH1, corresponding to a target binding site such as BINDING SITE I, BINDING SITE II or BINDING SITE III of FIG. 8. Table 4 illustrates the complementarity of the nucleotide sequences of FTH1 BINDING SITE, designated SEQ ID:9044, to the nucleotide sequence of GAM8678 RNA, herein designated GAM RNA, also designated SEQ ID:347.

Another function of GAM8678 is therefore inhibition of Ferritin, heavy polypeptide 1 (FTH1, Accession NP_002023.1), a gene which stores iron in a soluble, non-toxic, readily available form. and therefore is associated with Iron overload, autosomal dominant . Accordingly, utilities of GAM8678 include diagnosis, prevention and treatment of Iron overload, autosomal dominant ., and of other diseases and clinical conditions associated with FTH1.

The function of FTH1 and its association with various diseases and clinical conditions, has been established by previous studies, as described hereinabove with reference to GAM3177.1. Gamma-glutamyltransferase 1 (GGT1, Accession NP_038347.1) is another GAM8678 target gene, herein designated TARGET GENE. GGT1 BINDING SITE is a target binding site found in the 5' untranslated region of multiple transcripts of mRNA encoded by GGT1, corresponding to a target binding site such as BINDING SITE I, BINDING SITE II or BINDING SITE III of FIG. 8. Table 4 illustrates the complementarity of the nucleotide sequences of GGT1 BINDING SITE, designated SEQ ID:4886, to the nucleotide sequence of GAM8678 RNA, herein designated GAM RNA, also designated SEQ ID:347.

Another function of GAM8678 is therefore inhibition of Gamma-glutamyltransferase 1 (GGT1, Accession NP_038347.1), a gene which catalyzes the transfer of the glutamyl moiety of glutathione to a variety of amino acids and dipeptide acceptors and therefore is associated with Glutathionuria. Accordingly, utilities of GAM8678 include diagnosis, prevention and treatment of Glutathionuria, and of other diseases and clinical conditions associated with GGT1.

The function of GGT1 and its association with various diseases and clinical conditions, has been established by previous studies, as described hereinabove with reference to GAM234.1. Guanine nucleotide binding protein (g protein), alpha inhibiting activity polypeptide 2 (GNAI2, Accession NP_002061.1) is another GAM8678 target gene, herein designated TARGET GENE. GNAI2 BINDING SITE is a target binding site found in the 3' untranslated region of mRNA encoded by GNAI2, corresponding to a target binding site such as BINDING SITE I, BINDING SITE II or BINDING SITE III of FIG. 8. Table 4 illustrates the complementarity of the nucleotide sequences of GNAI2 BINDING SITE, designated SEQ ID:12292, to the nucleotide sequence of GAM8678 RNA, herein designated GAM RNA, also designated SEQ ID:347.

Another function of GAM8678 is therefore inhibition of Guanine nucleotide binding protein (g protein), alpha inhibiting activity polypeptide 2 (GNAI2, Accession NP_002061.1), a gene which is a human G-alpha inhibitory protein and therefore may be associated with Adrenal cortical tumor. Accordingly, utilities of GAM8678 include diagnosis, prevention and treatment of Adrenal cortical tumor, and of other diseases and clinical conditions associated with GNAI2.

The function of GNAI2 and its association with various diseases and clinical conditions, has been established by previous studies, as described hereinabove with reference to GAM71.1. Granulysin (GNLY, Accession NP_036615.1) is another GAM8678 target gene, herein designated TARGET GENE. GNLY BINDING SITE is a target binding site found in the 5' untranslated region of multiple transcripts of mRNA encoded by GNLY, corresponding to a target binding site such as BINDING SITE I, BINDING SITE II or BINDING SITE III of FIG. 8. Table 4 illustrates the complementarity of the nucleotide sequences of GNLY BINDING SITE, designated SEQ ID:10225, to the nucleotide sequence of GAM8678 RNA, herein designated GAM RNA, also designated SEQ ID:347.

Another function of GAM8678 is therefore inhibition of Granulysin (GNLY, Accession NP_036615.1). Accordingly, utilities of GAM8678 include diagnosis, prevention and treatment of diseases and clinical conditions associated with GNLY.

Glycoprotein a33 (transmembrane) (GPA33, Accession NP_005805.1) is another GAM8678 target gene, herein designated TARGET GENE. GPA33 BINDING SITE is a target binding site found in the 3' untranslated region of mRNA encoded by GPA33, corresponding to a target binding site such as BINDING SITE I, BINDING SITE II or BINDING SITE III of FIG. 8. Table 4 illustrates the complementarity of the nucleotide sequences of GPA33 BINDING SITE, designated SEQ ID:8463, to the nucleotide sequence of GAM8678 RNA, herein designated GAM RNA, also designated SEQ ID:347.

Another function of GAM8678 is therefore inhibition of Glycoprotein a33 (transmembrane) (GPA33, Accession NP_005805.1). Accordingly, utilities of GAM8678 include diagnosis, prevention and treatment of diseases and clinical conditions associated with GPA33.

G protein-coupled receptor 81 (GPR81, Accession NP_115943.1) is another GAM8678 target gene, herein designated TARGET GENE. GPR81 BINDING SITE is a target binding site found in the 3' untranslated region of mRNA encoded by GPR81, corresponding to a target binding site such as BINDING SITE I, BINDING SITE II or BINDING SITE III of FIG. 8. Table 4 illustrates the complementarity of the nucleotide sequences of GPR81 BINDING SITE, designated SEQ ID:13989, to the nucleotide sequence of GAM8678 RNA, herein designated GAM RNA, also designated SEQ ID:347.

Another function of GAM8678 is therefore inhibition of G protein-coupled receptor 81 (GPR81, Accession NP_115943.1). Accordingly, utilities of GAM8678 include diagnosis, prevention and treatment of diseases and clinical conditions associated with GPR81.

G protein-coupled receptor 86 (GPR86, Accession NP_795713.1) is another GAM8678 target gene, herein designated TARGET GENE. GPR86 BINDING SITE is a target binding site found in the 3' untranslated region of multiple transcripts of mRNA encoded by GPR86, corresponding to a target binding site such as BINDING SITE I, BINDING SITE II or BINDING SITE III of FIG. 8. Table 4 illustrates the complementarity of the nucleotide sequences of GPR86 BINDING SITE, designated SEQ ID:9168, to the nucleotide sequence of GAM8678 RNA, herein designated GAM RNA, also designated SEQ ID:347.

Another function of GAM8678 is therefore inhibition of G protein-coupled receptor 86 (GPR86, Accession NP_795713.1), a gene which plays a role in cell communication. Accordingly, utilities of GAM8678 include diagnosis, prevention and treatment of diseases and clinical conditions associated with GPR86.

The function of GPR86 and its association with various diseases and clinical conditions, has been established by previous studies, as described hereinabove with reference to GAM592.1. G protein-coupled receptor 86 (GPR86, Accession NP_076403.2) is another GAM8678 target gene, herein designated TARGET GENE. GPR86 BINDING SITE is a target binding site found in the 3' untranslated region of multiple transcripts of mRNA encoded by GPR86, corresponding to a target binding site such as BINDING SITE I, BINDING SITE II or BINDING SITE III of FIG. 8. Table 4 illustrates the complementarity of the nucleotide sequences of GPR86 BINDING SITE, designated SEQ ID:9168, to the nucleotide sequence of GAM8678 RNA, herein designated GAM RNA, also designated SEQ ID:347.

Another function of GAM8678 is therefore inhibition of G protein-coupled receptor 86 (GPR86, Accession NP_076403.2), a gene which plays a role in cell communication. Accordingly, utilities of GAM8678 include diagnosis, prevention and treatment of diseases and clinical conditions associated with GPR86.

The function of GPR86 and its association with various diseases and clinical conditions, has been established by previous studies, as described hereinabove with reference to GAM592.1. Grip1 associated protein 1 (GRIPAP1, Accession NP_064522.2) is another GAM8678 target gene, herein designated TARGET GENE. GRIPAP1 BINDING SITE is a target binding site found in the 5' untranslated region of mRNA encoded by GRIPAP1, corresponding to a target binding site such as BINDING SITE I, BINDING SITE II or BINDING SITE III of FIG. 8. Table 4 illustrates the complementarity of the nucleotide sequences of GRIPAP1 BINDING SITE, designated SEQ ID:474, to the nucleotide sequence of GAM8678 RNA, herein designated GAM RNA, also designated SEQ ID:347.

Another function of GAM8678 is therefore inhibition of Grip1 associated protein 1 (GRIPAP1, Accession NP_064522.2) . Accordingly, utilities of GAM8678 include diagnosis, prevention and treatment of diseases and clinical conditions associated with GRIPAP1.

Histone deacetylase 9 (HDAC9, Accession NP_055522.1) is another GAM8678 target gene, herein designated TARGET GENE. HDAC9 BINDING SITE is a target binding site found in the 3' untranslated region of multiple transcripts of mRNA encoded by HDAC9, corresponding to a target binding site such as BINDING SITE I, BINDING SITE II or BINDING SITE III of FIG. 8. Table 4 illustrates the complementarity of the nucleotide sequences of HDAC9 BINDING SITE, designated SEQ ID:747, to the nucleotide sequence of GAM8678 RNA, herein designated GAM RNA, also designated SEQ ID:347.

Another function of GAM8678 is therefore inhibition of Histone deacetylase 9 (HDAC9, Accession NP_055522.1). Accordingly, utilities of GAM8678 include diagnosis, prevention and treatment of diseases and clinical conditions associated with HDAC9.

Homeo box a1 (HOXA1, Accession NP_705873.1) is another GAM8678 target gene, herein designated TARGET GENE. HOXA1 BINDING SITE is a target binding site found in the 5' untranslated region of multiple transcripts of mRNA encoded by HOXA1, corresponding to a target binding site such as BINDING SITE I, BINDING SITE II or BINDING SITE III of FIG. 8. Table 4 illustrates the complementarity of the nucleotide sequences of HOXA1 BINDING SITE, designated SEQ ID:16330, to the nucleotide sequence of GAM8678 RNA, herein designated GAM RNA, also designated SEQ ID:347.

Another function of GAM8678 is therefore inhibition of Homeo box a1 (HOXA1, Accession NP_705873.1). Accordingly, utilities of GAM8678 include diagnosis, prevention and treatment of diseases and clinical conditions associated with HOXA1.

HPS6 (Accession NP_079023.1) is another GAM8678 target gene, herein designated TARGET GENE. HPS6 BINDING SITE is a target binding site found in the 5' untranslated region of mRNA encoded by HPS6, corresponding to a target binding site such as BINDING SITE I, BINDING SITE II or BINDING SITE III of FIG. 8. Table 4 illustrates the complementarity of the nucleotide sequences of HPS6 BINDING SITE, designated SEQ ID:16321, to the nucleotide sequence of GAM8678 RNA, herein designated GAM RNA, also designated SEQ ID:347.

Another function of GAM8678 is therefore inhibition of HPS6 (Accession NP_079023.1). Accordingly, utilities of GAM8678 include diagnosis, prevention and treatment of diseases and clinical conditions associated with HPS6.

HSPC023 (Accession NP_054766.1) is another GAM8678 target gene, herein designated TARGET GENE. HSPC023 BINDING SITE is a target binding site found in the 3' untranslated region of mRNA encoded by HSPC023, corresponding to a target binding site such as BINDING SITE I, BINDING SITE II or BINDING SITE III of FIG. 8. Table 4 illustrates the complementarity of the nucleotide sequences of HSPC023 BINDING SITE, designated SEQ ID:3781, to the nucleotide sequence of GAM8678 RNA, herein designated GAM RNA, also designated SEQ ID:347.

Another function of GAM8678 is therefore inhibition of HSPC023 (Accession NP_054766.1). Accordingly, utilities of GAM8678 include diagnosis, prevention and treatment of diseases and clinical conditions associated with HSPC023.

HSPC063 (Accession NP_054874.1) is another GAM8678 target gene, herein designated TARGET GENE. HSPC063 BINDING SITE is a target binding site found in the 3' untranslated region of mRNA encoded by HSPC063, corresponding to a target binding site such as BINDING SITE I, BINDING SITE II or BINDING SITE III of FIG. 8. Table 4 illustrates the complementarity of the nucleotide sequences of HSPC063 BINDING SITE, designated SEQ ID:7756, to the nucleotide sequence of GAM8678 RNA, herein designated GAM RNA, also designated SEQ ID:347.

Another function of GAM8678 is therefore inhibition of HSPC063 (Accession NP_054874.1). Accordingly, utilities of GAM8678 include diagnosis, prevention and treatment of diseases and clinical conditions associated with HSPC063.

HUMPPA (Accession XP_290730.2) is another GAM8678 target gene, herein designated TARGET GENE. HUMPPA BINDING SITE is a target binding site found in the 3' untranslated region of mRNA encoded by HUMPPA, corresponding to a target binding site such as BINDING SITE I, BINDING SITE II or BINDING SITE III of FIG. 8. Table 4 illustrates the complementarity of the nucleotide sequences of HUMPPA BINDING SITE, designated SEQ ID:3912, to the nucleotide sequence of GAM8678 RNA, herein designated GAM RNA, also designated SEQ ID:347.

Another function of GAM8678 is therefore inhibition of HUMPPA (Accession XP_290730.2). Accordingly, utilities of GAM8678 include diagnosis, prevention and treatment of diseases and clinical conditions associated with HUMPPA.

Il2-inducible t-cell kinase (ITK, Accession NP_005537.3) is another GAM8678 target gene, herein designated TARGET GENE. ITK BINDING SITE is a target binding site found in the 3' untranslated region of mRNA encoded by ITK, corresponding to a target binding site such as BINDING SITE I, BINDING SITE II or BINDING SITE III of FIG. 8. Table 4 illustrates the complementarity of the nucleotide sequences of ITK BINDING SITE, designated SEQ ID:14377, to the nucleotide sequence of GAM8678 RNA, herein designated GAM RNA, also designated SEQ ID:347.

Another function of GAM8678 is therefore inhibition of Il2-inducible t-cell kinase (ITK, Accession NP_005537.3), a gene which plays a role in t cell proliferation and differentiation. and therefore may be associated with Myelodysplastic syndrome. Accordingly, utilities of GAM8678 include diagnosis, prevention and treatment of Myelodysplastic syndrome, and of other diseases and clinical conditions associated with ITK.

The function of ITK and its association with various diseases and clinical conditions, has been established by previous studies, as described hereinabove with reference to GAM44.1. JPHL1 (Accession XP_033366.1) is another GAM8678 target gene, herein designated TARGET GENE. JPHL1 BINDING SITE is a target binding site found in the 3' untranslated region of mRNA encoded by JPHL1, corresponding to a target binding site such as BINDING SITE I, BINDING SITE II or BINDING SITE III of FIG. 8. Table 4 illustrates the complementarity of the nucleotide sequences of JPHL1 BINDING SITE, designated SEQ ID:2745, to the nucleotide sequence of GAM8678 RNA, herein designated GAM RNA, also designated SEQ ID:347.

Another function of GAM8678 is therefore inhibition of JPHL1 (Accession XP_033366.1). Accordingly, utilities of GAM8678 include diagnosis, prevention and treatment of diseases and clinical conditions associated with JPHL1.

KIAA0258 (Accession NP_055600.1) is another GAM8678 target gene, herein designated TARGET GENE. KIAA0258 BINDING SITE is a target binding site found in the 3' untranslated region of mRNA encoded by KIAA0258, corresponding to a target binding site such as BINDING SITE I, BINDING SITE II or BINDING SITE III of FIG. 8. Table 4 illustrates the complementarity of the nucleotide sequences of KIAA0258 BINDING SITE, designated SEQ ID:824, to the nucleotide sequence of GAM8678 RNA, herein designated GAM RNA, also designated SEQ ID:347.

Another function of GAM8678 is therefore inhibition of KIAA0258 (Accession NP_055600.1). Accordingly, utilities of GAM8678 include diagnosis, prevention and treatment of diseases and clinical conditions associated with KIAA0258.

KIAA0664 (Accession NP_056044.1) is another GAM8678 target gene, herein designated TARGET GENE. KIAA0664 BINDING SITE is a target binding site found in the 3' untranslated region of mRNA encoded by KIAA0664, corresponding to a target binding site such as BINDING SITE I, BINDING SITE II or BINDING SITE III of FIG. 8. Table 4 illustrates the complementarity of the nucleotide sequences of KIAA0664 BINDING SITE, designated SEQ ID:13478, to the nucleotide sequence of GAM8678 RNA, herein designated GAM RNA, also designated SEQ ID:347.

Another function of GAM8678 is therefore inhibition of KIAA0664 (Accession NP_056044.1). Accordingly, utilities of GAM8678 include diagnosis, prevention and treatment of diseases and clinical conditions associated with KIAA0664.

KIAA1033 (Accession XP_035313.5) is another GAM8678 target gene, herein designated TARGET GENE. KIAA1033 BINDING SITE is a target binding site found in the 3' untranslated region of mRNA encoded by KIAA1033, corresponding to a target binding site such as BINDING SITE I, BINDING SITE II or BINDING SITE III of FIG. 8. Table 4 illustrates the complementarity of the nucleotide sequences of KIAA1033 BINDING SITE, designated SEQ ID:16075, to the nucleotide sequence of GAM8678 RNA, herein designated GAM RNA, also designated SEQ ID:347.

Another function of GAM8678 is therefore inhibition of KIAA1033 (Accession XP_035313.5). Accordingly, utilities of GAM8678 include diagnosis, prevention and treatment of diseases and clinical conditions associated with KIAA1033.

KIAA1069 (Accession XP_042635.3) is another GAM8678 target gene, herein designated TARGET GENE. KIAA1069 BINDING SITE is a target binding site found in the 3' untranslated region of mRNA encoded by KIAA1069, corresponding to a target binding site such as BINDING SITE I, BINDING SITE II or BINDING SITE III of FIG. 8. Table 4 illustrates the complementarity of the nucleotide sequences of KIAA1069 BINDING SITE, designated SEQ ID:12231, to the nucleotide sequence of GAM8678 RNA, herein designated GAM RNA, also designated SEQ ID:347.

Another function of GAM8678 is therefore inhibition of KIAA1069 (Accession XP_042635.3). Accordingly, utilities of GAM8678 include diagnosis, prevention and treatment of diseases and clinical conditions associated with KIAA1069.

KIAA1172 (Accession XP_047889.5) is another GAM8678 target gene, herein designated TARGET GENE. KIAA1172 BINDING SITE is a target binding site found in the 3' untranslated region of mRNA encoded by KIAA1172, corresponding to a target binding site such as BINDING SITE I, BINDING SITE II or BINDING SITE III of FIG. 8. Table 4 illustrates the complementarity of the nucleotide sequences of KIAA1172 BINDING SITE, designated SEQ ID:19048, to the nucleotide sequence of GAM8678 RNA, herein designated GAM RNA, also designated SEQ ID:347.

Another function of GAM8678 is therefore inhibition of KIAA1172 (Accession XP_047889.5). Accordingly, utilities of GAM8678 include diagnosis, prevention and treatment of diseases and clinical conditions associated with KIAA1172.

KIAA1404 (Accession NP_066363.1) is another GAM8678 target gene, herein designated TARGET GENE. KIAA1404 BINDING SITE is a target binding site found in the 3' untranslated region of mRNA encoded by KIAA1404, corresponding to a target binding site such as BINDING SITE I, BINDING SITE II or BINDING SITE III of FIG. 8. Table 4 illustrates the complementarity of the nucleotide sequences of KIAA1404 BINDING SITE, designated SEQ ID:18334, to the nucleotide sequence of GAM8678 RNA, herein designated GAM RNA, also designated SEQ ID:347.

Another function of GAM8678 is therefore inhibition of KIAA1404 (Accession NP_066363.1). Accordingly, utilities of GAM8678 include diagnosis, prevention and treatment of diseases and clinical conditions associated with KIAA1404.

KIAA1673 (Accession XP_047672.4) is another GAM8678 target gene, herein designated TARGET GENE. KIAA1673 BINDING SITE is a target binding site found in the 3' untranslated region of mRNA encoded by KIAA1673, corresponding to a target binding site such as BINDING SITE I, BINDING SITE II or BINDING SITE III of FIG. 8. Table 4 illustrates the complementarity of the nucleotide sequences of KIAA1673 BINDING SITE, designated SEQ ID:3546, to the nucleotide sequence of GAM8678 RNA, herein designated GAM RNA, also designated SEQ ID:347.

Another function of GAM8678 is therefore inhibition of KIAA1673 (Accession XP_047672.4). Accordingly, utilities of GAM8678 include diagnosis, prevention and treatment of diseases and clinical conditions associated with KIAA1673.

KIAA1679 (Accession XP_046570.3) is another GAM8678 target gene, herein designated TARGET GENE. KIAA1679 BINDING SITE is a target binding site found in the 3' untranslated region of mRNA encoded by KIAA1679, corresponding to a target binding site such as BINDING SITE I, BINDING SITE II or BINDING SITE III of FIG. 8. Table 4 illustrates the complementarity of the nucleotide sequences of KIAA1679 BINDING SITE, designated SEQ ID:12115, to the nucleotide sequence of GAM8678 RNA, herein designated GAM RNA, also designated SEQ ID:347.

Another function of GAM8678 is therefore inhibition of KIAA1679 (Accession XP_046570.3). Accordingly, utilities of GAM8678 include diagnosis, prevention and treatment of diseases and clinical conditions associated with KIAA1679.

KIAA1908 (Accession XP_055834.1) is another GAM8678 target gene, herein designated TARGET GENE. KIAA1908 BINDING SITE is a target binding site found in the 5' untranslated region of mRNA encoded by KIAA1908, corresponding to a target binding site such as BINDING SITE I, BINDING SITE II or BINDING SITE III of FIG. 8. Table 4 illustrates the complementarity of the nucleotide sequences of KIAA1908 BINDING SITE, designated SEQ ID:13611, to the nucleotide sequence of GAM8678 RNA, herein designated GAM RNA, also designated SEQ ID:347.

Another function of GAM8678 is therefore inhibition of KIAA1908 (Accession XP_055834.1). Accordingly, utilities of GAM8678 include diagnosis, prevention and treatment of diseases and clinical conditions associated with KIAA1908.

KIAA1920 (Accession XP_085210.1) is another GAM8678 target gene, herein designated TARGET GENE. KIAA1920 BINDING SITE is a target binding site found in the 5' untranslated region of mRNA encoded by KIAA1920, corresponding to a target binding site such as BINDING SITE I, BINDING SITE II or BINDING SITE III of FIG. 8. Table 4 illustrates the complementarity of the nucleotide sequences of KIAA1920 BINDING SITE, designated SEQ ID:11223, to the nucleotide sequence of GAM8678 RNA, herein designated GAM RNA, also designated SEQ ID:347.

Another function of GAM8678 is therefore inhibition of KIAA1920 (Accession XP_085210.1). Accordingly, utilities of GAM8678 include diagnosis, prevention and treatment of diseases and clinical conditions associated with KIAA1920.

KIAA1949 (Accession XP_300202.1) is another GAM8678 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:1491, to the nucleotide sequence of GAM8678 RNA, herein designated GAM RNA, also designated SEQ ID:347.

Another function of GAM8678 is therefore inhibition of KIAA1949 (Accession XP_300202.1). Accordingly, utilities of GAM8678 include diagnosis, prevention and treatment of diseases and clinical conditions associated with KIAA1949.

KIAA1949 (Accession XP_166376.1) is another GAM8678 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:1491, to the nucleotide sequence of GAM8678 RNA, herein designated GAM RNA, also designated SEQ ID:347.

Another function of GAM8678 is therefore inhibition of KIAA1949 (Accession XP_166376.1). Accordingly, utilities of GAM8678 include diagnosis, prevention and treatment of diseases and clinical conditions associated with KIAA1949.

KIAA1949 (Accession XP_300167.1) is another GAM8678 target gene, herein designated TARGET GENE. KIAA1949 BINDING SITE is a target binding site found in the 5' untranslated region of multiple transcripts of mRNA encoded by KIAA1949, corresponding to a target binding site such as BINDING SITE I, BINDING SITE II or BINDING SITE III of FIG. 8. Table 4 illustrates the complementarity of the nucleotide sequences of KIAA1949 BINDING SITE, designated SEQ ID:1491, to the nucleotide sequence of GAM8678 RNA, herein designated GAM RNA, also designated SEQ ID:347.

Another function of GAM8678 is therefore inhibition of KIAA1949 (Accession XP_300167.1). Accordingly, utilities of GAM8678 include diagnosis, prevention and treatment of diseases and clinical conditions associated with KIAA1949.

KIAA1998 (Accession XP_068710.3) is another GAM8678 target gene, herein designated TARGET GENE. KIAA1998 BINDING SITE is a target binding site found in the 3' untranslated region of mRNA encoded by KIAA1998, corresponding to a target binding site such as BINDING SITE I, BINDING SITE II or BINDING SITE III of FIG. 8. Table 4 illustrates the complementarity of the nucleotide sequences of KIAA1998 BINDING SITE, designated SEQ ID:4429, to the nucleotide sequence of GAM8678 RNA, herein designated GAM RNA, also designated SEQ ID:347.

Another function of GAM8678 is therefore inhibition of KIAA1998 (Accession XP_068710.3). Accordingly, utilities of GAM8678 include diagnosis, prevention and treatment of diseases and clinical conditions associated with KIAA1998.

LAPTM4B (Accession NP_060877.3) is another GAM8678 target gene, herein designated TARGET GENE. LAPTM4B BINDING SITE is a target binding site found in the 3' untranslated region of mRNA encoded by LAPTM4B, corresponding to a target binding site such as BINDING SITE I, BINDING SITE II or BINDING SITE III of FIG. 8. Table 4 illustrates the complementarity of the nucleotide sequences of LAPTM4B BINDING SITE, designated SEQ ID:3312, to the nucleotide sequence of GAM8678 RNA, herein designated GAM RNA, also designated SEQ ID:347.

Another function of GAM8678 is therefore inhibition of LAPTM4B (Accession NP_060877.3). Accordingly, utilities of GAM8678 include diagnosis, prevention and treatment of diseases and clinical conditions associated with LAPTM4B.

Lim domain kinase 1 (LIMK1, Accession NP_058015.1) is another GAM8678 target gene, herein designated TARGET GENE. LIMK1 BINDING SITE is a target binding site found in the 3' untranslated region of multiple transcripts of mRNA encoded by LIMK1, corresponding to a target binding site such as BINDING SITE I, BINDING SITE II or BINDING SITE III of FIG. 8. Table 4 illustrates the complementarity of the nucleotide sequences of LIMK1 BINDING SITE, designated SEQ ID:9080, to the nucleotide sequence of GAM8678 RNA, herein designated GAM RNA, also designated SEQ ID:347.

Another function of GAM8678 is therefore inhibition of Lim domain kinase 1 (LIMK1, Accession NP_058015.1). Accordingly, utilities of GAM8678 include diagnosis, prevention and treatment of diseases and clinical conditions associated with LIMK1.

Lim and senescent cell antigen-like domains 2 (LIMS2, Accession NP_060450.1) is another GAM8678 target gene, herein designated TARGET GENE. LIMS2 BINDING SITE is a target binding site found in the 3' untranslated region of mRNA encoded by LIMS2, corresponding to a target binding site such as BINDING SITE I, BINDING SITE II or BINDING SITE III of FIG. 8. Table 4 illustrates the complementarity of the nucleotide sequences of LIMS2 BINDING SITE, designated SEQ ID:4540, to the nucleotide sequence of GAM8678 RNA, herein designated GAM RNA, also designated SEQ ID:347.

Another function of GAM8678 is therefore inhibition of Lim and senescent cell antigen-like domains 2 (LIMS2, Accession NP_060450.1). Accordingly, utilities of GAM8678 include diagnosis, prevention and treatment of diseases and clinical conditions associated with LIMS2.

LOC128387 (Accession XP_059243.2) is another GAM8678 target gene, herein designated TARGET GENE. LOC128387 BINDING SITE is a target binding site found in the 3' untranslated region of mRNA encoded by LOC128387, corresponding to a target binding site such as BINDING SITE I, BINDING SITE II or BINDING SITE III of FIG. 8. Table 4 illustrates the complementarity of the nucleotide sequences of LOC128387 BINDING SITE, designated SEQ ID:6611, to the nucleotide sequence of GAM8678 RNA, herein designated GAM RNA, also designated SEQ ID:347.

Another function of GAM8678 is therefore inhibition of LOC128387 (Accession XP_059243.2). Accordingly, utilities of GAM8678 include diagnosis, prevention and treatment of diseases and clinical conditions associated with LOC128387.

LOC142779 (Accession XP_084337.1) is another GAM8678 target gene, herein designated TARGET GENE. LOC142779 BINDING SITE is a target binding site found in the 5' untranslated region of mRNA encoded by LOC142779, corresponding to a target binding site such as BINDING SITE I, BINDING SITE II or BINDING SITE III of FIG. 8. Table 4 illustrates the complementarity of the nucleotide sequences of LOC142779 BINDING SITE, designated SEQ ID:18014, to the nucleotide sequence of GAM8678 RNA, herein designated GAM RNA, also designated SEQ ID:347.

Another function of GAM8678 is therefore inhibition of LOC142779 (Accession XP_084337.1). Accordingly, utilities of GAM8678 include diagnosis, prevention and treatment of diseases and clinical conditions associated with LOC142779.

LOC144248 (Accession XP_084786.1) is another GAM8678 target gene, herein designated TARGET GENE. LOC144248 BINDING SITE is a target binding site found in the 5' untranslated region of mRNA encoded by LOC144248, corresponding to a target binding site such as BINDING SITE I, BINDING SITE II or BINDING SITE III of FIG. 8. Table 4 illustrates the complementarity of the nucleotide sequences of LOC144248 BINDING SITE, designated SEQ ID:5074, to the nucleotide sequence of GAM8678 RNA, herein designated GAM RNA, also designated SEQ ID:347.

Another function of GAM8678 is therefore inhibition of LOC144248 (Accession XP_084786.1). Accordingly, utilities of GAM8678 include diagnosis, prevention and treatment of diseases and clinical conditions associated with LOC144248.

LOC144486 (Accession XP_096608.1) is another GAM8678 target gene, herein designated TARGET GENE. LOC144486 BINDING SITE is a target binding site found in the 5' untranslated region of mRNA encoded by LOC144486, corresponding to a target binding site such as BINDING SITE I, BINDING SITE II or BINDING SITE III of FIG. 8. Table 4 illustrates the complementarity of the nucleotide sequences of LOC144486 BINDING SITE, designated SEQ ID:9860, to the nucleotide sequence of GAM8678 RNA, herein designated GAM RNA, also designated SEQ ID:347.

Another function of GAM8678 is therefore inhibition of LOC144486 (Accession XP_096608.1). Accordingly, utilities of GAM8678 include diagnosis, prevention and treatment of diseases and clinical conditions associated with LOC144486.

LOC144678 (Accession XP_096656.1) is another GAM8678 target gene, herein designated TARGET GENE. LOC144678 BINDING SITE is a target binding site found in the 5' untranslated region of mRNA encoded by LOC144678, corresponding to a target binding site such as BINDING SITE I, BINDING SITE II or BINDING SITE III of FIG. 8. Table 4 illustrates the complementarity of the nucleotide sequences of LOC144678 BINDING SITE, designated SEQ ID:17626, to the nucleotide sequence of GAM8678 RNA, herein designated GAM RNA, also designated SEQ ID:347.

Another function of GAM8678 is therefore inhibition of LOC144678 (Accession XP_096656.1). Accordingly, utilities of GAM8678 include diagnosis, prevention and treatment of diseases and clinical conditions associated with LOC144678.

LOC145609 (Accession XP_096817.1) is another GAM8678 target gene, herein designated TARGET GENE. LOC145609 BINDING SITE is a target binding site found in the 3' untranslated region of mRNA encoded by LOC145609, corresponding to a target binding site such as BINDING SITE I, BINDING SITE II or BINDING SITE III of FIG. 8. Table 4 illustrates the complementarity of the nucleotide sequences of LOC145609 BINDING SITE, designated SEQ ID:16478, to the nucleotide sequence of GAM8678 RNA, herein designated GAM RNA, also designated SEQ ID:347.

Another function of GAM8678 is therefore inhibition of LOC145609 (Accession XP_096817.1). Accordingly, utilities of GAM8678 include diagnosis, prevention and treatment of diseases and clinical conditions associated with LOC145609.

LOC150630 (Accession XP_097931.1) is another GAM8678 target gene, herein designated TARGET GENE. LOC150630 BINDING SITE is a target binding site found in the 5' untranslated region of mRNA encoded by LOC150630, corresponding to a target binding site such as BINDING SITE I, BINDING SITE II or BINDING SITE III of FIG. 8. Table 4 illustrates the complementarity of the nucleotide sequences of LOC150630 BINDING SITE, designated SEQ ID:3341, to the nucleotide sequence of GAM8678 RNA, herein designated GAM RNA, also designated SEQ ID:347.

Another function of GAM8678 is therefore inhibition of LOC150630 (Accession XP_097931.1). Accordingly, utilities of GAM8678 include diagnosis, prevention and treatment of diseases and clinical conditions associated with LOC150630.

LOC152445 (Accession XP_098231.1) is another GAM8678 target gene, herein designated TARGET GENE. LOC152445 BINDING SITE is a target binding site found in the 5' untranslated region of mRNA encoded by LOC152445, corresponding to a target binding site such as BINDING SITE I, BINDING SITE II or BINDING SITE III of FIG. 8. Table 4 illustrates the complementarity of the nucleotide sequences of LOC152445 BINDING SITE, designated SEQ ID:13305, to the nucleotide sequence of GAM8678 RNA, herein designated GAM RNA, also designated SEQ ID:347.

Another function of GAM8678 is therefore inhibition of LOC152445 (Accession XP_098231.1). Accordingly, utilities of GAM8678 include diagnosis, prevention and treatment of diseases and clinical conditions associated with LOC152445.

LOC153684 (Accession XP_098412.1) is another GAM8678 target gene, herein designated TARGET GENE. LOC153684 BINDING SITE is a target binding site found in the 5' untranslated region of mRNA encoded by LOC153684, corresponding to a target binding site such as BINDING SITE I, BINDING SITE II or BINDING SITE III of FIG. 8. Table 4 illustrates the complementarity of the nucleotide sequences of LOC153684 BINDING SITE, designated SEQ ID:2941, to the nucleotide sequence of GAM8678 RNA, herein designated GAM RNA, also designated SEQ ID:347.

Another function of GAM8678 is therefore inhibition of LOC153684 (Accession XP_098412.1). Accordingly, utilities of GAM8678 include diagnosis, prevention and treatment of diseases and clinical conditions associated with LOC153684.

LOC154467 (Accession XP_166346.1) is another GAM8678 target gene, herein designated TARGET GENE. LOC154467 BINDING SITE is a target binding site found in the 3' untranslated region of mRNA encoded by LOC154467, corresponding to a target binding site such as BINDING SITE I, BINDING SITE II or BINDING SITE III of FIG. 8. Table 4 illustrates the complementarity of the nucleotide sequences of LOC154467 BINDING SITE, designated SEQ ID:17572, to the nucleotide sequence of GAM8678 RNA, herein designated GAM RNA, also designated SEQ ID:347.

Another function of GAM8678 is therefore inhibition of LOC154467 (Accession XP_166346.1). Accordingly, utilities of GAM8678 include diagnosis, prevention and treatment of diseases and clinical conditions associated with LOC154467.

LOC157376 (Accession XP_088301.1) is another GAM8678 target gene, herein designated TARGET GENE. LOC157376 BINDING SITE is a target binding site found in the 3' untranslated region of mRNA encoded by LOC157376, corresponding to a target binding site such as BINDING SITE I, BINDING SITE II or BINDING SITE III of FIG. 8. Table 4 illustrates the complementarity of the nucleotide sequences of LOC157376 BINDING SITE, designated SEQ ID:12155, to the nucleotide sequence of GAM8678 RNA, herein designated GAM RNA, also designated SEQ ID:347.

Another function of GAM8678 is therefore inhibition of LOC157376 (Accession XP_088301.1). Accordingly, utilities of GAM8678 include diagnosis, prevention and treatment of diseases and clinical conditions associated with LOC157376.

LOC158107 (Accession XP_098873.1) is another GAM8678 target gene, herein designated TARGET GENE. LOC158107 BINDING SITE is a target binding site found in the 5' untranslated region of mRNA encoded by LOC158107, corresponding to a target binding site such as BINDING SITE I, BINDING SITE II or BINDING SITE III of FIG. 8. Table 4 illustrates the complementarity of the nucleotide sequences of LOC158107 BINDING SITE, designated SEQ ID:10149, to the nucleotide sequence of GAM8678 RNA, herein designated GAM RNA, also designated SEQ ID:347.

Another function of GAM8678 is therefore inhibition of LOC158107 (Accession XP_098873.1). Accordingly, utilities of GAM8678 include diagnosis, prevention and treatment of diseases and clinical conditions associated with LOC158107.

LOC158527 (Accession XP_088594.1) is another GAM8678 target gene, herein designated TARGET GENE. LOC158527 BINDING SITE is a target binding site found in the 5' untranslated region of mRNA encoded by LOC158527, corresponding to a target binding site such as BINDING SITE I, BINDING SITE II or BINDING SITE III of FIG. 8. Table 4 illustrates the complementarity of the nucleotide sequences of LOC158527 BINDING SITE, designated SEQ ID:17834, to the nucleotide sequence of GAM8678 RNA, herein designated GAM RNA, also designated SEQ ID:347.

Another function of GAM8678 is therefore inhibition of LOC158527 (Accession XP_088594.1). Accordingly, utilities of GAM8678 include diagnosis, prevention and treatment of diseases and clinical conditions associated with LOC158527.

LOC159121 (Accession XP_099028.1) is another GAM8678 target gene, herein designated TARGET GENE. LOC159121 BINDING SITE is a target binding site found in the 3' untranslated region of mRNA encoded by LOC159121, corresponding to a target binding site such as BINDING SITE I, BINDING SITE II or BINDING SITE III of FIG. 8. Table 4 illustrates the complementarity of the nucleotide sequences of LOC159121 BINDING SITE, designated SEQ ID:15930, to the nucleotide sequence of GAM8678 RNA, herein designated GAM RNA, also designated SEQ ID:347.

Another function of GAM8678 is therefore inhibition of LOC159121 (Accession XP_099028.1). Accordingly, utilities of GAM8678 include diagnosis, prevention and treatment of diseases and clinical conditions associated with LOC159121.

LOC199777 (Accession NP_660340.1) is another GAM8678 target gene, herein designated TARGET GENE. LOC199777 BINDING SITE is a target binding site found in the 5' untranslated region of mRNA encoded by LOC199777, corresponding to a target binding site such as BINDING SITE I, BINDING SITE II or BINDING SITE III of FIG. 8. Table 4 illustrates the complementarity of the nucleotide sequences of LOC199777 BINDING SITE, designated SEQ ID:13813, to the nucleotide sequence of GAM8678 RNA, herein designated GAM RNA, also designated SEQ ID:347.

Another function of GAM8678 is therefore inhibition of LOC199777 (Accession NP_660340.1). Accordingly, utilities of GAM8678 include diagnosis, prevention and treatment of diseases and clinical conditions associated with LOC199777.

LOC199796 (Accession XP_058994.3) is another GAM8678 target gene, herein designated TARGET GENE. LOC199796 BINDING SITE is a target binding site found in the 5' untranslated region of mRNA encoded by LOC199796, corresponding to a target binding site such as BINDING SITE I, BINDING SITE II or BINDING SITE III of FIG. 8. Table 4 illustrates the complementarity of the nucleotide sequences of LOC199796 BINDING SITE, designated SEQ ID:16496, to the nucleotide sequence of GAM8678 RNA, herein designated GAM RNA, also designated SEQ ID:347.

Another function of GAM8678 is therefore inhibition of LOC199796 (Accession XP_058994.3). Accordingly, utilities of GAM8678 include diagnosis, prevention and treatment of diseases and clinical conditions associated with LOC199796.

LOC219397 (Accession XP_167889.2) is another GAM8678 target gene, herein designated TARGET GENE. LOC219397 BINDING SITE is a target binding site found in the 3' untranslated region of mRNA encoded by LOC219397, corresponding to a target binding site such as BINDING SITE I, BINDING SITE II or BINDING SITE III of FIG. 8. Table 4 illustrates the complementarity of the nucleotide sequences of LOC219397 BINDING SITE, designated SEQ ID:13531, to the nucleotide sequence of GAM8678 RNA, herein designated GAM RNA, also designated SEQ ID:347.

Another function of GAM8678 is therefore inhibition of LOC219397 (Accession XP_167889.2). Accordingly, utilities of GAM8678 include diagnosis, prevention and treatment of diseases and clinical conditions associated with LOC219397.

LOC220758 (Accession XP_165466.1) is another GAM8678 target gene, herein designated TARGET GENE. LOC220758 BINDING SITE is a target binding site found in the 5' untranslated region of mRNA encoded by LOC220758, corresponding to a target binding site such as BINDING SITE I, BINDING SITE II or BINDING SITE III of FIG. 8. Table 4 illustrates the complementarity of the nucleotide sequences of LOC220758 BINDING SITE, designated SEQ ID:5833, to the nucleotide sequence of GAM8678 RNA, herein designated GAM RNA, also designated SEQ ID:347.

Another function of GAM8678 is therefore inhibition of LOC220758 (Accession XP_165466.1). Accordingly, utilities of GAM8678 include diagnosis, prevention and treatment of diseases and clinical conditions associated with LOC220758.

LOC221122 (Accession XP_167867.1) is another GAM8678 target gene, herein designated TARGET GENE. LOC221122 BINDING SITE is a target binding site found in the 3' untranslated region of mRNA encoded by LOC221122, corresponding to a target binding site such as BINDING SITE I, BINDING SITE II or BINDING SITE III of FIG. 8. Table 4 illustrates the complementarity of the nucleotide sequences of LOC221122 BINDING SITE, designated SEQ ID:15261, to the nucleotide sequence of GAM8678 RNA, herein designated GAM RNA, also designated SEQ ID:347.

Another function of GAM8678 is therefore inhibition of LOC221122 (Accession XP_167867.1). Accordingly, utilities of GAM8678 include diagnosis, prevention and treatment of diseases and clinical conditions associated with LOC221122.

LOC253609 (Accession XP_172986.2) is another GAM8678 target gene, herein designated TARGET GENE. LOC253609 BINDING SITE is a target binding site found in the 5' untranslated region of mRNA encoded by LOC253609, corresponding to a target binding site such as BINDING SITE I, BINDING SITE II or BINDING SITE III of FIG. 8. Table 4 illustrates the complementarity of the nucleotide sequences of LOC253609 BINDING SITE, designated SEQ ID:9081, to the nucleotide sequence of GAM8678 RNA, herein designated GAM RNA, also designated SEQ ID:347.

Another function of GAM8678 is therefore inhibition of LOC253609 (Accession XP_172986.2). Accordingly, utilities of GAM8678 include diagnosis, prevention and treatment of diseases and clinical conditions associated with LOC253609.

LOC283012 (Accession XP_210847.1) is another GAM8678 target gene, herein designated TARGET GENE. LOC283012 BINDING SITE is a target binding site found in the 5' untranslated region of mRNA encoded by LOC283012, corresponding to a target binding site such as BINDING SITE I, BINDING SITE II or BINDING SITE III of FIG. 8. Table 4 illustrates the complementarity of the nucleotide sequences of LOC283012 BINDING SITE, designated SEQ ID:11131, to the nucleotide sequence of GAM8678 RNA, herein designated GAM RNA, also designated SEQ ID:347.

Another function of GAM8678 is therefore inhibition of LOC283012 (Accession XP_210847.1). Accordingly, utilities of GAM8678 include diagnosis, prevention and treatment of diseases and clinical conditions associated with LOC283012.

LOC283351 (Accession XP_210988.1) is another GAM8678 target gene, herein designated TARGET GENE. LOC283351 BINDING SITE is a target binding site found in the 3' untranslated region of mRNA encoded by LOC283351, corresponding to a target binding site such as BINDING SITE I, BINDING SITE II or BINDING SITE III of FIG. 8. Table 4 illustrates the complementarity of the nucleotide sequences of LOC283351 BINDING SITE, designated SEQ ID:9921, to the nucleotide sequence of GAM8678 RNA, herein designated GAM RNA, also designated SEQ ID:347.

Another function of GAM8678 is therefore inhibition of LOC283351 (Accession XP_210988.1). Accordingly, utilities of GAM8678 include diagnosis, prevention and treatment of diseases and clinical conditions associated with LOC283351.

LOC283500 (Accession XP_211067.1) is another GAM8678 target gene, herein designated TARGET GENE.

LOC283500 BINDING SITE is a target binding site found in the 5' untranslated region of mRNA encoded by LOC283500, corresponding to a target binding site such as BINDING SITE I, BINDING SITE II or BINDING SITE III of FIG. 8. Table 4 illustrates the complementarity of the nucleotide sequences of LOC283500 BINDING SITE, designated SEQ ID:11164, to the nucleotide sequence of GAM8678 RNA, herein designated GAM RNA, also designated SEQ ID:347.

Another function of GAM8678 is therefore inhibition of LOC283500 (Accession XP_211067.1). Accordingly, utilities of GAM8678 include diagnosis, prevention and treatment of diseases and clinical conditions associated with LOC283500.

LOC283568 (Accession XP_211098.1) is another GAM8678 target gene, herein designated TARGET GENE. LOC283568 BINDING SITE is a target binding site found in the 3' untranslated region of mRNA encoded by LOC283568, corresponding to a target binding site such as BINDING SITE I, BINDING SITE II or BINDING SITE III of FIG. 8. Table 4 illustrates the complementarity of the nucleotide sequences of LOC283568 BINDING SITE, designated SEQ ID:5947, to the nucleotide sequence of GAM8678 RNA, herein designated GAM RNA, also designated SEQ ID:347.

Another function of GAM8678 is therefore inhibition of LOC283568 (Accession XP_211098.1). Accordingly, utilities of GAM8678 include diagnosis, prevention and treatment of diseases and clinical conditions associated with LOC283568.

LOC283686 (Accession XP_211164.1) is another GAM8678 target gene, herein designated TARGET GENE. LOC283686 BINDING SITE is a target binding site found in the 5' untranslated region of mRNA encoded by LOC283686, corresponding to a target binding site such as BINDING SITE I, BINDING SITE II or BINDING SITE III of FIG. 8. Table 4 illustrates the complementarity of the nucleotide sequences of LOC283686 BINDING SITE, designated SEQ ID:10535, to the nucleotide sequence of GAM8678 RNA, herein designated GAM RNA, also designated SEQ ID:347.

Another function of GAM8678 is therefore inhibition of LOC283686 (Accession XP_211164.1). Accordingly, utilities of GAM8678 include diagnosis, prevention and treatment of diseases and clinical conditions associated with LOC283686.

LOC283801 (Accession XP_208122.1) is another GAM8678 target gene, herein designated TARGET GENE. LOC283801 BINDING SITE is a target binding site found in the 5' untranslated region of mRNA encoded by LOC283801, corresponding to a target binding site such as BINDING SITE I, BINDING SITE II or BINDING SITE III of FIG. 8. Table 4 illustrates the complementarity of the nucleotide sequences of LOC283801 BINDING SITE, designated SEQ ID:19380, to the nucleotide sequence of GAM8678 RNA, herein designated GAM RNA, also designated SEQ ID:347.

Another function of GAM8678 is therefore inhibition of LOC283801 (Accession XP_208122.1). Accordingly, utilities of GAM8678 include diagnosis, prevention and treatment of diseases and clinical conditions associated with LOC283801.

LOC283806 (Accession XP_208846.1) is another GAM8678 target gene, herein designated TARGET GENE. LOC283806 BINDING SITE is a target binding site found in the 5' untranslated region of mRNA encoded by LOC283806, corresponding to a target binding site such as BINDING SITE I, BINDING SITE II or BINDING SITE III of FIG. 8. Table 4 illustrates the complementarity of the nucleotide sequences of LOC283806 BINDING SITE, designated SEQ ID:15140, to the nucleotide sequence of GAM8678 RNA, herein designated GAM RNA, also designated SEQ ID:347.

Another function of GAM8678 is therefore inhibition of LOC283806 (Accession XP_208846.1). Accordingly, utilities of GAM8678 include diagnosis, prevention and treatment of diseases and clinical conditions associated with LOC283806.

LOC283863 (Accession XP_208875.1) is another GAM8678 target gene, herein designated TARGET GENE. LOC283863 BINDING SITE is a target binding site found in the 3' untranslated region of mRNA encoded by LOC283863, corresponding to a target binding site such as BINDING SITE I, BINDING SITE II or BINDING SITE III of FIG. 8. Table 4 illustrates the complementarity of the nucleotide sequences of LOC283863 BINDING SITE, designated SEQ ID:14458, to the nucleotide sequence of GAM8678 RNA, herein designated GAM RNA, also designated SEQ ID:347.

Another function of GAM8678 is therefore inhibition of LOC283863 (Accession XP_208875.1). Accordingly, utilities of GAM8678 include diagnosis, prevention and treatment of diseases and clinical conditions associated with LOC283863.

LOC283875 (Accession XP_211241.1) is another GAM8678 target gene, herein designated TARGET GENE. LOC283875 BINDING SITE is a target binding site found in the 3' untranslated region of mRNA encoded by LOC283875, corresponding to a target binding site such as BINDING SITE I, BINDING SITE II or BINDING SITE III of FIG. 8. Table 4 illustrates the complementarity of the nucleotide sequences of LOC283875 BINDING SITE, designated SEQ ID:1114, to the nucleotide sequence of GAM8678 RNA, herein designated GAM RNA, also designated SEQ ID:347.

Another function of GAM8678 is therefore inhibition of LOC283875 (Accession XP_211241.1). Accordingly, utilities of GAM8678 include diagnosis, prevention and treatment of diseases and clinical conditions associated with LOC283875.

LOC283927 (Accession XP_208904.1) is another GAM8678 target gene, herein designated TARGET GENE. LOC283927 BINDING SITE is a target binding site found in the 3' untranslated region of mRNA encoded by LOC283927, corresponding to a target binding site such as BINDING SITE I, BINDING SITE II or BINDING SITE III of FIG. 8. Table 4 illustrates the complementarity of the nucleotide sequences of LOC283927 BINDING SITE, designated SEQ ID:3174, to the nucleotide sequence of GAM8678 RNA, herein designated GAM RNA, also designated SEQ ID:347.

Another function of GAM8678 is therefore inhibition of LOC283927 (Accession XP_208904.1). Accordingly, utilities of GAM8678 include diagnosis, prevention and treatment of diseases and clinical conditions associated with LOC283927.

LOC284046 (Accession XP_208155.1) is another GAM8678 target gene, herein designated TARGET GENE. LOC284046 BINDING SITE is a target binding site found in the 5' untranslated region of mRNA encoded by LOC284046, corresponding to a target binding site such as BINDING SITE I, BINDING SITE II or BINDING SITE III of FIG. 8. Table 4 illustrates the complementarity of the nucleotide sequences of LOC284046 BINDING SITE, designated SEQ ID:16474, to the nucleotide sequence of GAM8678 RNA, herein designated GAM RNA, also designated SEQ ID:347.

Another function of GAM8678 is therefore inhibition of LOC284046 (Accession XP_208155.1). Accordingly, utilities of GAM8678 include diagnosis, prevention and treatment of diseases and clinical conditions associated with LOC284046.

LOC284473 (Accession XP_211474.1) is another GAM8678 target gene, herein designated TARGET GENE. LOC284473 BINDING SITE is a target binding site found in the 3' untranslated region of mRNA encoded by LOC284473, corresponding to a target binding site such as BINDING SITE I, BINDING SITE II or BINDING SITE III of FIG. 8. Table 4 illustrates the complementarity of the nucleotide sequences of LOC284473 BINDING SITE, designated SEQ ID:14734, to the nucleotide sequence of GAM8678 RNA, herein designated GAM RNA, also designated SEQ ID:347.

Another function of GAM8678 is therefore inhibition of LOC284473 (Accession XP_211474.1). Accordingly, utilities of GAM8678 include diagnosis, prevention and treatment of diseases and clinical conditions associated with LOC284473.

LOC284752 (Accession XP_211628.1) is another GAM8678 target gene, herein designated TARGET GENE. LOC284752 BINDING SITE is a target binding site found in the 3' untranslated region of mRNA encoded by LOC284752, corresponding to a target binding site such as BINDING SITE I, BINDING SITE II or BINDING SITE III of FIG. 8. Table 4 illustrates the complementarity of the nucleotide sequences of LOC284752 BINDING SITE, designated SEQ ID:17078, to the nucleotide sequence of GAM8678 RNA, herein designated GAM RNA, also designated SEQ ID:347.

Another function of GAM8678 is therefore inhibition of LOC284752 (Accession XP_211628.1). Accordingly, utilities of GAM8678 include diagnosis, prevention and treatment of diseases and clinical conditions associated with LOC284752.

LOC285138 (Accession XP_211778.1) is another GAM8678 target gene, herein designated TARGET GENE. LOC285138 BINDING SITE is a target binding site found in the 5' untranslated region of mRNA encoded by LOC285138, corresponding to a target binding site such as BINDING SITE I, BINDING SITE II or BINDING SITE III of FIG. 8. Table 4 illustrates the complementarity of the nucleotide sequences of LOC285138 BINDING SITE, designated SEQ ID:18958, to the nucleotide sequence of GAM8678 RNA, herein designated GAM RNA, also designated SEQ ID:347.

Another function of GAM8678 is therefore inhibition of LOC285138 (Accession XP_211778.1). Accordingly, utilities of GAM8678 include diagnosis, prevention and treatment of diseases and clinical conditions associated with LOC285138.

LOC285205 (Accession XP_211805.1) is another GAM8678 target gene, herein designated TARGET GENE. LOC285205 BINDING SITE is a target binding site found in the 3' untranslated region of mRNA encoded by LOC285205, corresponding to a target binding site such as BINDING SITE I, BINDING SITE II or BINDING SITE III of FIG. 8. Table 4 illustrates the complementarity of the nucleotide sequences of LOC285205 BINDING SITE, designated SEQ ID:8095, to the nucleotide sequence of GAM8678 RNA, herein designated GAM RNA, also designated SEQ ID:347.

Another function of GAM8678 is therefore inhibition of LOC285205 (Accession XP_211805.1). Accordingly, utilities of GAM8678 include diagnosis, prevention and treatment of diseases and clinical conditions associated with LOC285205.

LOC285717 (Accession XP_211991.1) is another GAM8678 target gene, herein designated TARGET GENE. LOC285717 BINDING SITE is a target binding site found in the 3' untranslated region of mRNA encoded by LOC285717, corresponding to a target binding site such as BINDING SITE I, BINDING SITE II or BINDING SITE III of FIG. 8. Table 4 illustrates the complementarity of the nucleotide sequences of LOC285717 BINDING SITE, designated SEQ ID:1765, to the nucleotide sequence of GAM8678 RNA, herein designated GAM RNA, also designated SEQ ID:347.

Another function of GAM8678 is therefore inhibition of LOC285717 (Accession XP_211991.1). Accordingly, utilities of GAM8678 include diagnosis, prevention and treatment of diseases and clinical conditions associated with LOC285717.

LOC285731 (Accession XP_208347.1) is another GAM8678 target gene, herein designated TARGET GENE. LOC285731 BINDING SITE is a target binding site found in the 3' untranslated region of mRNA encoded by LOC285731, corresponding to a target binding site such as BINDING SITE I, BINDING SITE II or BINDING SITE III of FIG. 8. Table 4 illustrates the complementarity of the nucleotide sequences of LOC285731 BINDING SITE, designated SEQ ID:942, to the nucleotide sequence of GAM8678 RNA, herein designated GAM RNA, also designated SEQ ID:347.

Another function of GAM8678 is therefore inhibition of LOC285731 (Accession XP_208347.1). Accordingly, utilities of GAM8678 include diagnosis, prevention and treatment of diseases and clinical conditions associated with LOC285731.

LOC285760 (Accession XP_209750.1) is another GAM8678 target gene, herein designated TARGET GENE. LOC285760 BINDING SITE is a target binding site found in the 3' untranslated region of mRNA encoded by LOC285760, corresponding to a target binding site such as BINDING SITE I, BINDING SITE II or BINDING SITE III of FIG. 8. Table 4 illustrates the complementarity of the nucleotide sequences of LOC285760 BINDING SITE, designated SEQ ID:2013, to the nucleotide sequence of GAM8678 RNA, herein designated GAM RNA, also designated SEQ ID:347.

Another function of GAM8678 is therefore inhibition of LOC285760 (Accession XP_209750.1). Accordingly, utilities of GAM8678 include diagnosis, prevention and treatment of diseases and clinical conditions associated with LOC285760.

LOC285786 (Accession XP_208349.1) is another GAM8678 target gene, herein designated TARGET GENE. LOC285786 BINDING SITE is a target binding site found in the 3' untranslated region of mRNA encoded by LOC285786, corresponding to a target binding site such as BINDING SITE I, BINDING SITE II or BINDING SITE III of FIG. 8. Table 4 illustrates the complementarity of the nucleotide sequences of LOC285786 BINDING SITE, designated SEQ ID:5902, to the nucleotide sequence of GAM8678 RNA, herein designated GAM RNA, also designated SEQ ID:347.

Another function of GAM8678 is therefore inhibition of LOC285786 (Accession XP_208349.1). Accordingly, utilities of GAM8678 include diagnosis, prevention and treatment of diseases and clinical conditions associated with LOC285786.

LOC285915 (Accession XP_209802.1) is another GAM8678 target gene, herein designated TARGET GENE. LOC285915 BINDING SITE is a target binding site found in the 5' untranslated region of mRNA encoded by LOC285915, corresponding to a target binding site such as BINDING SITE I, BINDING SITE II or BINDING SITE III of FIG. 8. Table 4 illustrates the complementarity of the nucleotide sequences of LOC285915 BINDING SITE, designated SEQ ID:5143, to the nucleotide sequence of GAM8678 RNA, herein designated GAM RNA, also designated SEQ ID:347.

Another function of GAM8678 is therefore inhibition of LOC285915 (Accession XP_209802.1). Accordingly, utilities of GAM8678 include diagnosis, prevention and treatment of diseases and clinical conditions associated with LOC285915.

LOC286058 (Accession XP_212158.1) is another GAM8678 target gene, herein designated TARGET GENE. LOC286058 BINDING SITE is a target binding site found in the 3' untranslated region of mRNA encoded by LOC286058, corresponding to a target binding site such as BINDING SITE I, BINDING SITE II or BINDING SITE III of FIG. 8. Table 4 illustrates the complementarity of the nucleotide sequences of LOC286058 BINDING SITE, designated SEQ ID:14887, to the nucleotide sequence of GAM8678 RNA, herein designated GAM RNA, also designated SEQ ID:347.

Another function of GAM8678 is therefore inhibition of LOC286058 (Accession XP_212158.1). Accordingly, utilities of GAM8678 include diagnosis, prevention and treatment of diseases and clinical conditions associated with LOC286058.

LOC286208 (Accession XP_212230.1) is another GAM8678 target gene, herein designated TARGET GENE. LOC286208 BINDING SITE is a target binding site found in the 3' untranslated region of mRNA encoded by LOC286208, corresponding to a target binding site such as BINDING SITE I, BINDING SITE II or BINDING SITE III of FIG. 8. Table 4 illustrates the complementarity of the nucleotide sequences of LOC286208 BINDING SITE, designated SEQ ID:8543, to the nucleotide sequence of GAM8678 RNA, herein designated GAM RNA, also designated SEQ ID:347.

Another function of GAM8678 is therefore inhibition of LOC286208 (Accession XP_212230.1). Accordingly, utilities of GAM8678 include diagnosis, prevention and treatment of diseases and clinical conditions associated with LOC286208.

LOC286370 (Accession XP_212295.1) is another GAM8678 target gene, herein designated TARGET GENE. LOC286370 BINDING SITE is a target binding site found in the 3' untranslated region of mRNA encoded by LOC286370, corresponding to a target binding site such as BINDING SITE I, BINDING SITE II or BINDING SITE III of FIG. 8. Table 4 illustrates the complementarity of the nucleotide sequences of LOC286370 BINDING SITE, designated SEQ ID:12258, to the nucleotide sequence of GAM8678 RNA, herein designated GAM RNA, also designated SEQ ID:347.

Another function of GAM8678 is therefore inhibition of LOC286370 (Accession XP_212295.1). Accordingly, utilities of GAM8678 include diagnosis, prevention and treatment of diseases and clinical conditions associated with LOC286370.

LOC286371 (Accession XP_212291.1) is another GAM8678 target gene, herein designated TARGET GENE. LOC286371 BINDING SITE1 and LOC286371 BINDING SITE2 are target binding sites found in untranslated regions of mRNA encoded by LOC286371, corresponding to target binding sites such as BINDING SITE I, BINDING SITE II or BINDING SITE III of FIG. 8. Table 4 illustrates the complementarity of the nucleotide sequences of LOC286371 BINDING SITE1 and LOC286371 BINDING SITE2, designated SEQ ID:569 and SEQ ID:8936 respectively, to the nucleotide sequence of GAM8678 RNA, herein designated GAM RNA, also designated SEQ ID:347.

Another function of GAM8678 is therefore inhibition of LOC286371 (Accession XP_212291.1). Accordingly, utilities of GAM8678 include diagnosis, prevention and treatment of diseases and clinical conditions associated with LOC286371.

LOC338651 (Accession XP_294672.2) is another GAM8678 target gene, herein designated TARGET GENE. LOC338651 BINDING SITE is a target binding site found in the 3' untranslated region of mRNA encoded by LOC338651, corresponding to a target binding site such as BINDING SITE I, BINDING SITE II or BINDING SITE III of FIG. 8. Table 4 illustrates the complementarity of the nucleotide sequences of LOC338651 BINDING SITE, designated SEQ ID:5468, to the nucleotide sequence of GAM8678 RNA, herein designated GAM RNA, also designated SEQ ID:347.

Another function of GAM8678 is therefore inhibition of LOC338651 (Accession XP_294672.2). Accordingly, utilities of GAM8678 include diagnosis, prevention and treatment of diseases and clinical conditions associated with LOC338651.

LOC338799 (Accession NP_848633.1) is another GAM8678 target gene, herein designated TARGET GENE. LOC338799 BINDING SITE is a target binding site found in the 3' untranslated region of multiple transcripts of mRNA encoded by LOC338799, corresponding to a target binding site such as BINDING SITE I, BINDING SITE II or BINDING SITE III of FIG. 8. Table 4 illustrates the complementarity of the nucleotide sequences of LOC338799 BINDING SITE, designated SEQ ID:2042, to the nucleotide sequence of GAM8678 RNA, herein designated GAM RNA, also designated SEQ ID:347.

Another function of GAM8678 is therefore inhibition of LOC338799 (Accession NP_848633.1). Accordingly, utilities of GAM8678 include diagnosis, prevention and treatment of diseases and clinical conditions associated with LOC338799.

LOC339223 (Accession XP_290774.1) is another GAM8678 target gene, herein designated TARGET GENE. LOC339223 BINDING SITE is a target binding site found in the 5' untranslated region of mRNA encoded by LOC339223, corresponding to a target binding site such as BINDING SITE I, BINDING SITE II or BINDING SITE III of FIG. 8. Table 4 illustrates the complementarity of the nucleotide sequences of LOC339223 BINDING SITE, designated SEQ ID:5193, to the nucleotide sequence of GAM8678 RNA, herein designated GAM RNA, also designated SEQ ID:347.

Another function of GAM8678 is therefore inhibition of LOC339223 (Accession XP_290774.1). Accordingly, utilities of GAM8678 include diagnosis, prevention and treatment of diseases and clinical conditions associated with LOC339223.

LOC339290 (Accession XP_294901.1) is another GAM8678 target gene, herein designated TARGET GENE. LOC339290 BINDING SITE1 and LOC339290 BINDING SITE2 are target binding sites found in untranslated regions of mRNA encoded by LOC339290, corresponding to target binding sites such as BINDING SITE I, BINDING SITE II or BINDING SITE III of FIG. 8. Table 4 illustrates the complementarity of the nucleotide sequences of LOC339290 BINDING SITE1 and LOC339290 BINDING SITE2, designated SEQ ID:8529 and SEQ ID:19490 respectively, to the nucleotide sequence of GAM8678 RNA, herein designated GAM RNA, also designated SEQ ID:347.

Another function of GAM8678 is therefore inhibition of LOC339290 (Accession XP_294901.1). Accordingly, utilities of GAM8678 include diagnosis, prevention and treatment of diseases and clinical conditions associated with LOC339290.

LOC339556 (Accession XP_290951.1) is another GAM8678 target gene, herein designated TARGET GENE. LOC339556 BINDING SITE is a target binding site found in the 5' untranslated region of mRNA encoded by LOC339556, corresponding to a target binding site such as BINDING SITE I, BINDING SITE II or BINDING SITE III of FIG. 8. Table 4 illustrates the complementarity of the nucleotide sequences of LOC339556 BINDING SITE, designated SEQ ID:19228, to the nucleotide sequence of GAM8678 RNA, herein designated GAM RNA, also designated SEQ ID:347.

Another function of GAM8678 is therefore inhibition of LOC339556 (Accession XP_290951.1). Accordingly, utilities of GAM8678 include diagnosis, prevention and treatment of diseases and clinical conditions associated with LOC339556.

LOC340156 (Accession XP_291158.1) is another GAM8678 target gene, herein designated TARGET GENE. LOC340156 BINDING SITE is a target binding site found in the 3' untranslated region of mRNA encoded by LOC340156, corresponding to a target binding site such as BINDING SITE I, BINDING SITE II or BINDING SITE III of FIG. 8. Table 4 illustrates the complementarity of the nucleotide sequences of LOC340156 BINDING SITE, designated SEQ ID:5194, to the nucleotide sequence of GAM8678 RNA, herein designated GAM RNA, also designated SEQ ID:347.

Another function of GAM8678 is therefore inhibition of LOC340156 (Accession XP_291158.1). Accordingly, utilities of GAM8678 include diagnosis, prevention and treatment of diseases and clinical conditions associated with LOC340156.

LOC340158 (Accession XP_295175.1) is another GAM8678 target gene, herein designated TARGET GENE. LOC340158 BINDING SITE is a target binding site found in the 5' untranslated region of mRNA encoded by LOC340158, corresponding to a target binding site such as BINDING SITE I, BINDING SITE II or BINDING SITE III of FIG. 8. Table 4 illustrates the complementarity of the nucleotide sequences of LOC340158 BINDING SITE, designated SEQ ID:19672, to the nucleotide sequence of GAM8678 RNA, herein designated GAM RNA, also designated SEQ ID:347.

Another function of GAM8678 is therefore inhibition of LOC340158 (Accession XP_295175.1). Accordingly, utilities of GAM8678 include diagnosis, prevention and treatment of diseases and clinical conditions associated with LOC340158.

LOC340276 (Accession XP_295197.1) is another GAM8678 target gene, herein designated TARGET GENE. LOC340276 BINDING SITE is a target binding site found in the 5' untranslated region of mRNA encoded by LOC340276, corresponding to a target binding site such as BINDING SITE I, BINDING SITE II or BINDING SITE III of FIG. 8. Table 4 illustrates the complementarity of the nucleotide sequences of LOC340276 BINDING SITE, designated SEQ ID:8760, to the nucleotide sequence of GAM8678 RNA, herein designated GAM RNA, also designated SEQ ID:347.

Another function of GAM8678 is therefore inhibition of LOC340276 (Accession XP_295197.1). Accordingly, utilities of GAM8678 include diagnosis, prevention and treatment of diseases and clinical conditions associated with LOC340276.

LOC343265 (Accession XP_291488.1) is another GAM8678 target gene, herein designated TARGET GENE. LOC343265 BINDING SITE is a target binding site found in the 5' untranslated region of mRNA encoded by LOC343265, corresponding to a target binding site such as BINDING SITE I, BINDING SITE II or BINDING SITE III of FIG. 8. Table 4 illustrates the complementarity of the nucleotide sequences of LOC343265 BINDING SITE, designated SEQ ID:14724, to the nucleotide sequence of GAM8678 RNA, herein designated GAM RNA, also designated SEQ ID:347.

Another function of GAM8678 is therefore inhibition of LOC343265 (Accession XP_291488.1). Accordingly, utilities of GAM8678 include diagnosis, prevention and treatment of diseases and clinical conditions associated with LOC343265.

LOC344865 (Accession XP_298324.1) is another GAM8678 target gene, herein designated TARGET GENE. LOC344865 BINDING SITE is a target binding site found in the 5' untranslated region of mRNA encoded by LOC344865, corresponding to a target binding site such as BINDING SITE I, BINDING SITE II or BINDING SITE III of FIG. 8. Table 4 illustrates the complementarity of the nucleotide sequences of LOC344865 BINDING SITE, designated SEQ ID:727, to the nucleotide sequence of GAM8678 RNA, herein designated GAM RNA, also designated SEQ ID:347.

Another function of GAM8678 is therefore inhibition of LOC344865 (Accession XP_298324.1). Accordingly, utilities of GAM8678 include diagnosis, prevention and treatment of diseases and clinical conditions associated with LOC344865.

LOC348144 (Accession XP_300638.1) is another GAM8678 target gene, herein designated TARGET GENE. LOC348144 BINDING SITE is a target binding site found in the 3' untranslated region of mRNA encoded by LOC348144, corresponding to a target binding site such as BINDING SITE I, BINDING SITE II or BINDING SITE III of FIG. 8. Table 4 illustrates the complementarity of the nucleotide sequences of LOC348144 BINDING SITE, designated SEQ ID:4130, to the nucleotide sequence of GAM8678 RNA, herein designated GAM RNA, also designated SEQ ID:347.

Another function of GAM8678 is therefore inhibition of LOC348144 (Accession XP_300638.1). Accordingly, utilities of GAM8678 include diagnosis, prevention and treatment of diseases and clinical conditions associated with LOC348144.

LOC348166 (Accession XP_300293.1) is another GAM8678 target gene, herein designated TARGET GENE. LOC348166 BINDING SITE is a target binding site found in the 5' untranslated region of mRNA encoded by LOC348166, corresponding to a target binding site such as BINDING SITE I, BINDING SITE II or BINDING SITE III of FIG. 8. Table 4 illustrates the complementarity of the nucleotide sequences of LOC348166 BINDING SITE, designated SEQ ID:14532, to the nucleotide sequence of GAM8678 RNA, herein designated GAM RNA, also designated SEQ ID:347.

Another function of GAM8678 is therefore inhibition of LOC348166 (Accession XP_300293.1). Accordingly, utilities of GAM8678 include diagnosis, prevention and treatment of diseases and clinical conditions associated with LOC348166.

LOC349440 (Accession XP_300513.1) is another GAM8678 target gene, herein designated TARGET GENE. LOC349440 BINDING SITE is a target binding site found in the 3' untranslated region of mRNA encoded by LOC349440, corresponding to a target binding site such as BINDING SITE I, BINDING SITE II or BINDING SITE III of FIG. 8. Table 4 illustrates the complementarity of the nucleotide sequences of LOC349440 BINDING SITE, designated SEQ ID:14456, to the nucleotide sequence of GAM8678 RNA, herein designated GAM RNA, also designated SEQ ID:347.

Another function of GAM8678 is therefore inhibition of LOC349440 (Accession XP_300513.1). Accordingly, utilities of GAM8678 include diagnosis, prevention and treatment of diseases and clinical conditions associated with LOC349440.

LOC351012 (Accession XP_304617.1) is another GAM8678 target gene, herein designated TARGET GENE. LOC351012 BINDING SITE is a target binding site found in the 3' untranslated region of mRNA encoded by LOC351012, corresponding to a target binding site such as BINDING SITE I, BINDING SITE II or BINDING SITE III of FIG. 8. Table 4 illustrates the complementarity of the nucleotide sequences of LOC351012 BINDING SITE, designated SEQ ID:8029, to the nucleotide sequence of GAM8678 RNA, herein designated GAM RNA, also designated SEQ ID:347.

Another function of GAM8678 is therefore inhibition of LOC351012 (Accession XP_304617.1). Accordingly, utilities of GAM8678 include diagnosis, prevention and treatment of diseases and clinical conditions associated with LOC351012.

LOC351833 (Accession XP_305187.1) is another GAM8678 target gene, herein designated TARGET GENE. LOC351833 BINDING SITE is a target binding site found in the 5' untranslated region of mRNA encoded by LOC351833, corresponding to a target binding site such as BINDING SITE I, BINDING SITE II or BINDING SITE III of FIG. 8. Table 4 illustrates the complementarity of the nucleotide sequences of LOC351833 BINDING SITE, designated SEQ ID:18089, to the nucleotide sequence of GAM8678 RNA, herein designated GAM RNA, also designated SEQ ID:347.

Another function of GAM8678 is therefore inhibition of LOC351833 (Accession XP_305187.1). Accordingly, utilities of GAM8678 include diagnosis, prevention and treatment of diseases and clinical conditions associated with LOC351833.

LOC352905 (Accession XP_302020.1) is another GAM8678 target gene, herein designated TARGET GENE. LOC352905 BINDING SITE is a target binding site found in the 5' untranslated region of mRNA encoded by LOC352905, corresponding to a target binding site such as BINDING SITE I, BINDING SITE II or BINDING SITE III of FIG. 8. Table 4 illustrates the complementarity of the nucleotide sequences of LOC352905 BINDING SITE, designated SEQ ID:18393, to the nucleotide sequence of GAM8678 RNA, herein designated GAM RNA, also designated SEQ ID:347.

Another function of GAM8678 is therefore inhibition of LOC352905 (Accession XP_302020.1). Accordingly, utilities of GAM8678 include diagnosis, prevention and treatment of diseases and clinical conditions associated with LOC352905.

LOC51122 (Accession NP_057178.1) is another GAM8678 target gene, herein designated TARGET GENE. LOC51122 BINDING SITE is a target binding site found in the 3' untranslated region of mRNA encoded by LOC51122, corresponding to a target binding site such as BINDING SITE I, BINDING SITE II or BINDING SITE III of FIG. 8. Table 4 illustrates the complementarity of the nucleotide sequences of LOC51122 BINDING SITE, designated SEQ ID:14155, to the nucleotide sequence of GAM8678 RNA, herein designated GAM RNA, also designated SEQ ID:347.

Another function of GAM8678 is therefore inhibition of LOC51122 (Accession NP_057178.1). Accordingly, utilities of GAM8678 include diagnosis, prevention and treatment of diseases and clinical conditions associated with LOC51122.

LOC51236 (Accession NP_057542.2) is another GAM8678 target gene, herein designated TARGET GENE. LOC51236 BINDING SITE is a target binding site found in the 3' untranslated region of mRNA encoded by LOC51236, corresponding to a target binding site such as BINDING SITE I, BINDING SITE II or BINDING SITE III of FIG. 8. Table 4 illustrates the complementarity of the nucleotide sequences of LOC51236 BINDING SITE, designated SEQ ID:17817, to the nucleotide sequence of GAM8678 RNA, herein designated GAM RNA, also designated SEQ ID:347.

Another function of GAM8678 is therefore inhibition of LOC51236 (Accession NP_057542.2). Accordingly, utilities of GAM8678 include diagnosis, prevention and treatment of diseases and clinical conditions associated with LOC51236.

LOC90355 (Accession NP_149988.1) is another GAM8678 target gene, herein designated TARGET GENE. LOC90355 BINDING SITE is a target binding site found in the 3' untranslated region of mRNA encoded by LOC90355, corresponding to a target binding site such as BINDING SITE I, BINDING SITE II or BINDING SITE III of FIG. 8. Table 4 illustrates the complementarity of the nucleotide sequences of LOC90355 BINDING SITE, designated SEQ ID:8431, to the nucleotide sequence of GAM8678 RNA, herein designated GAM RNA, also designated SEQ ID:347.

Another function of GAM8678 is therefore inhibition of LOC90355 (Accession NP_149988.1). Accordingly, utilities of GAM8678 include diagnosis, prevention and treatment of diseases and clinical conditions associated with LOC90355.

LOC93320 (Accession XP_050534.6) is another GAM8678 target gene, herein designated TARGET GENE. LOC93320 BINDING SITE is a target binding site found in the 5' untranslated region of mRNA encoded by LOC93320, corresponding to a target binding site such as BINDING SITE I, BINDING SITE II or BINDING SITE III of FIG. 8. Table 4 illustrates the complementarity of the nucleotide sequences of LOC93320 BINDING SITE, designated SEQ ID:2120, to the nucleotide sequence of GAM8678 RNA, herein designated GAM RNA, also designated SEQ ID:347.

Another function of GAM8678 is therefore inhibition of LOC93320 (Accession XP_050534.6). Accordingly, utilities of GAM8678 include diagnosis, prevention and treatment of diseases and clinical conditions associated with LOC93320.

LYG2 (Accession NP_783862.2) is another GAM8678 target gene, herein designated TARGET GENE. LYG2 BINDING SITE is a target binding site found in the 5' untranslated region of mRNA encoded by LYG2, corresponding to a target binding site such as BINDING SITE I, BINDING SITE II or BINDING SITE III of FIG. 8. Table 4 illustrates the complementarity of the nucleotide sequences of LYG2 BINDING SITE, designated SEQ ID:1943, to the nucleotide sequence of GAM8678 RNA, herein designated GAM RNA, also designated SEQ ID:347.

Another function of GAM8678 is therefore inhibition of LYG2 (Accession NP_783862.2). Accordingly, utilities of GAM8678 include diagnosis, prevention and treatment of diseases and clinical conditions associated with LYG2.

Mitogen-activated protein kinase 4 (MAPK4, Accession NP_002738.1) is another GAM8678 target gene, herein designated TARGET GENE. MAPK4 BINDING SITE is a target binding site found in the 5' untranslated region of mRNA encoded by MAPK4, corresponding to a target binding site such as BINDING SITE I, BINDING SITE II or BINDING SITE III of FIG. 8. Table 4 illustrates the complementarity of the nucleotide sequences of MAPK4 BINDING SITE, designated SEQ ID:18963, to the nucleotide sequence of GAM8678 RNA, herein designated GAM RNA, also designated SEQ ID:347.

Another function of GAM8678 is therefore inhibition of Mitogen-activated protein kinase 4 (MAPK4, Accession NP_002738.1), a gene which phosphorylates microtubule-associated protein-2 may promote entry into the cell cycle. Accordingly, utilities of GAM8678 include diagnosis, prevention and treatment of diseases and clinical conditions associated with MAPK4.

The function of MAPK4 and its association with various diseases and clinical conditions, has been established by previous studies, as described hereinabove with reference to GAM179.1. MGC14141 (Accession NP_116317.1) is another GAM8678 target gene, herein designated TARGET GENE. MGC14141 BINDING SITE is a target binding site found in the 3' untranslated region of mRNA encoded by MGC14141, corresponding to a target binding site such as BINDING SITE I, BINDING SITE II or BINDING SITE III of FIG. 8. Table 4 illustrates the complementarity of the nucleotide sequences of MGC14141 BINDING SITE, designated SEQ ID:13489, to the nucleotide sequence of GAM8678 RNA, herein designated GAM RNA, also designated SEQ ID:347.

Another function of GAM8678 is therefore inhibition of MGC14141 (Accession NP_116317.1). Accordingly, utilities of GAM8678 include diagnosis, prevention and treatment of diseases and clinical conditions associated with MGC14141.

MGC4238 (Accession NP_115708.1) is another GAM8678 target gene, herein designated TARGET GENE. MGC4238 BINDING SITE is a target binding site found in the 3' untranslated region of mRNA encoded by MGC4238, corresponding to a target binding site such as BINDING SITE I, BINDING SITE II or BINDING SITE III of FIG. 8. Table 4 illustrates the complementarity of the nucleotide sequences of MGC4238 BINDING SITE, designated SEQ ID:14031, to the nucleotide sequence of GAM8678 RNA, herein designated GAM RNA, also designated SEQ ID:347.

Another function of GAM8678 is therefore inhibition of MGC4238 (Accession NP_115708.1). Accordingly, utilities of GAM8678 include diagnosis, prevention and treatment of diseases and clinical conditions associated with MGC4238.

MGC51025 (Accession NP_848666.1) is another GAM8678 target gene, herein designated TARGET GENE. MGC51025 BINDING SITE is a target binding site found in the 3' untranslated region of mRNA encoded by MGC51025, corresponding to a target binding site such as BINDING SITE I, BINDING SITE II or BINDING SITE III of FIG. 8. Table 4 illustrates the complementarity of the nucleotide sequences of MGC51025 BINDING SITE, designated SEQ ID:3328, to the nucleotide sequence of GAM8678 RNA, herein designated GAM RNA, also designated SEQ ID:347.

Another function of GAM8678 is therefore inhibition of MGC51025 (Accession NP_848666.1). Accordingly, utilities of GAM8678 include diagnosis, prevention and treatment of diseases and clinical conditions associated with MGC51025.

MGC8902 (Accession NP_775909.1) is another GAM8678 target gene, herein designated TARGET GENE. MGC8902 BINDING SITE is a target binding site found in the 5' untranslated region of mRNA encoded by MGC8902, corresponding to a target binding site such as BINDING SITE I, BINDING SITE II or BINDING SITE III of FIG. 8. Table 4 illustrates the complementarity of the nucleotide sequences of MGC8902 BINDING SITE, designated SEQ ID:19518, to the nucleotide sequence of GAM8678 RNA, herein designated GAM RNA, also designated SEQ ID:347.

Another function of GAM8678 is therefore inhibition of MGC8902 (Accession NP_775909.1). Accordingly, utilities of GAM8678 include diagnosis, prevention and treatment of diseases and clinical conditions associated with MGC8902.

MSCP (Accession NP_061049.2) is another GAM8678 target gene, herein designated TARGET GENE. MSCP BINDING SITE is a target binding site found in the 3' untranslated region of multiple transcripts of mRNA encoded by MSCP, corresponding to a target binding site such as BINDING SITE I, BINDING SITE II or BINDING SITE III of FIG. 8. Table 4 illustrates the complementarity of the nucleotide sequences of MSCP BINDING SITE, designated SEQ ID:16919, to the nucleotide sequence of GAM8678 RNA, herein designated GAM RNA, also designated SEQ ID:347.

Another function of GAM8678 is therefore inhibition of MSCP (Accession NP_061049.2). Accordingly, utilities of GAM8678 include diagnosis, prevention and treatment of diseases and clinical conditions associated with MSCP.

Musashi homolog 1 (drosophila) (MSI1, Accession NP_002433.1) is another GAM8678 target gene, herein designated TARGET GENE. MSI1 BINDING SITE is a target binding site found in the 3' untranslated region of mRNA encoded by MSI1, corresponding to a target binding site such as BINDING SITE I, BINDING SITE II or BINDING SITE III of FIG. 8. Table 4 illustrates the complementarity of the nucleotide sequences of MSI1 BINDING SITE, designated SEQ ID:6193, to the nucleotide sequence of GAM8678 RNA, herein designated GAM RNA, also designated SEQ ID:347.

Another function of GAM8678 is therefore inhibition of Musashi homolog 1 (drosophila) (MSI1, Accession NP_002433.1). Accordingly, utilities of GAM8678 include diagnosis, prevention and treatment of diseases and clinical conditions associated with MSI1.

Mature t-cell proliferation 1 (MTCP1, Accession NP_055036.1) is another GAM8678 target gene, herein designated TARGET GENE. MTCP1 BINDING SITE is a target binding site found in the 5' untranslated region of mRNA encoded by MTCP1, corresponding to a target binding site such as BINDING SITE I, BINDING SITE II or BINDING SITE III of FIG. 8. Table 4 illustrates the complementarity of the nucleotide sequences of MTCP1 BINDING SITE, designated SEQ ID:1715, to the nucleotide sequence of GAM8678 RNA, herein designated GAM RNA, also designated SEQ ID:347.

Another function of GAM8678 is therefore inhibition of Mature t-cell proliferation 1 (MTCP1, Accession NP_055036.1). Accordingly, utilities of GAM8678 include diagnosis, prevention and treatment of diseases and clinical conditions associated with MTCP1.

NaGLT1 (Accession NP_699200.1) is another GAM8678 target gene, herein designated TARGET GENE. NaGLT1 BINDING SITE is a target binding site found in the 5' untranslated region of mRNA encoded by NaGLT1, corresponding to a target binding site such as BINDING SITE I, BINDING SITE II or BINDING SITE III of FIG. 8. Table 4 illustrates the complementarity of the nucleotide sequences of NaGLT1 BINDING SITE, designated SEQ ID:2522, to the nucleotide sequence of GAM8678 RNA, herein designated GAM RNA, also designated SEQ ID:347.

Another function of GAM8678 is therefore inhibition of NaGLT1 (Accession NP_699200.1). Accordingly, utilities of GAM8678 include diagnosis, prevention and treatment of diseases and clinical conditions associated with NaGLT1.

Neuron navigator 2 (NAV2, Accession NP_660093.1) is another GAM8678 target gene, herein designated TARGET GENE. NAV2 BINDING SITE is a target binding site found in the 3' untranslated region of multiple transcripts of mRNA encoded by NAV2, corresponding to a target binding site such as BINDING SITE I, BINDING SITE II or BINDING SITE III of FIG. 8. Table 4 illustrates the complementarity of the nucleotide sequences of NAV2 BINDING SITE, designated SEQ ID:18122, to the nucleotide sequence of GAM8678 RNA, herein designated GAM RNA, also designated SEQ ID:347.

Another function of GAM8678 is therefore inhibition of Neuron navigator 2 (NAV2, Accession NP_660093.1), a gene which plays an important role in neuronal development, including neurite outgrowth. Accordingly, utilities of GAM8678 include diagnosis, prevention and treatment of diseases and clinical conditions associated with NAV2.

The function of NAV2 and its association with various diseases and clinical conditions, has been established by previous studies, as described hereinabove with reference to GAM1510.1. Neuron navigator 2 (NAV2, Accession NP_060632.2) is another GAM8678 target gene, herein designated TARGET GENE. NAV2 BINDING SITE is a target binding site found in the 3' untranslated region of multiple transcripts of mRNA encoded by NAV2, corresponding to a target binding site such as BINDING SITE I, BINDING SITE II or BINDING SITE III of FIG. 8. Table 4 illustrates the complementarity of the nucleotide sequences of NAV2 BINDING SITE, designated SEQ ID:18122, to the nucleotide sequence of GAM8678 RNA, herein designated GAM RNA, also designated SEQ ID:347.

Another function of GAM8678 is therefore inhibition of Neuron navigator 2 (NAV2, Accession NP_060632.2), a gene which plays an important role in neuronal development, including neurite outgrowth. Accordingly, utilities of GAM8678 include diagnosis, prevention and treatment of diseases and clinical conditions associated with NAV2.

The function of NAV2 and its association with various diseases and clinical conditions, has been established by previous studies, as described hereinabove with reference to GAM1510.1. NECAB2 (Accession NP_061938.1) is another GAM8678 target gene, herein designated TARGET GENE. NECAB2 BINDING SITE is a target binding site found in the 3' untranslated region of mRNA encoded by NECAB2, corresponding to a target binding site such as BINDING SITE I, BINDING SITE II or BINDING SITE III of FIG. 8. Table 4 illustrates the complementarity of the nucleotide sequences of NECAB2 BINDING SITE, designated SEQ ID:5863, to the nucleotide sequence of GAM8678 RNA, herein designated GAM RNA, also designated SEQ ID:347.

Another function of GAM8678 is therefore inhibition of NECAB2 (Accession NP_061938.1). Accordingly, utilities of GAM8678 include diagnosis, prevention and treatment of diseases and clinical conditions associated with NECAB2.

Nuclear receptor subfamily 4, group a, member 3 (NR4A3, Accession NP_008912.2) is another GAM8678 target gene, herein designated TARGET GENE. NR4A3 BINDING SITE is a target binding site found in the 3' untranslated region of multiple transcripts of mRNA encoded by NR4A3, corresponding to a target binding site such as BINDING SITE I, BINDING SITE II or BINDING SITE III of FIG. 8. Table 4 illustrates the complementarity of the nucleotide sequences of NR4A3 BINDING SITE, designated SEQ ID:10007, to the nucleotide sequence of GAM8678 RNA, herein designated GAM RNA, also designated SEQ ID:347.

Another function of GAM8678 is therefore inhibition of Nuclear receptor subfamily 4, group a, member 3 (NR4A3, Accession NP_008912.2). Accordingly, utilities of GAM8678 include diagnosis, prevention and treatment of diseases and clinical conditions associated with NR4A3.

Nuclear receptor subfamily 4, group a, member 3 (NR4A3, Accession NP_775290.1) is another GAM8678 target gene, herein designated TARGET GENE. NR4A3 BINDING SITE is a target binding site found in the 3' untranslated region of multiple transcripts of mRNA encoded by NR4A3, corresponding to a target binding site such as BINDING SITE I, BINDING SITE II or BINDING SITE III of FIG. 8. Table 4 illustrates the complementarity of the nucleotide sequences of NR4A3 BINDING SITE, designated SEQ ID:10007, to the nucleotide sequence of GAM8678 RNA, herein designated GAM RNA, also designated SEQ ID:347.

Another function of GAM8678 is therefore inhibition of Nuclear receptor subfamily 4, group a, member 3 (NR4A3, Accession NP_775290.1). Accordingly, utilities of GAM8678 include diagnosis, prevention and treatment of diseases and clinical conditions associated with NR4A3.

Nuclear receptor subfamily 4, group a, member 3 (NR4A3, Accession NP_775292.1) is another GAM8678 target gene, herein designated TARGET GENE. NR4A3 BINDING SITE is a target binding site found in the 3' untranslated region of multiple transcripts of mRNA encoded by NR4A3, corresponding to a target binding site such as BINDING SITE I, BINDING SITE II or BINDING SITE III of FIG. 8. Table 4 illustrates the complementarity of the nucleotide sequences of NR4A3 BINDING SITE, designated SEQ ID:10007, to the nucleotide sequence of GAM8678 RNA, herein designated GAM RNA, also designated SEQ ID:347.

Another function of GAM8678 is therefore inhibition of Nuclear receptor subfamily 4, group a, member 3 (NR4A3, Accession NP_775292.1). Accordingly, utilities of GAM8678 include diagnosis, prevention and treatment of diseases and clinical conditions associated with NR4A3.

Nudix (nucleoside diphosphate linked moiety x)-type motif 9 (NUDT9, Accession NP_076952.1) is another GAM8678 target gene, herein designated TARGET GENE. NUDT9 BINDING SITE is a target binding site found in the 3' untranslated region of mRNA encoded by NUDT9, corresponding to a target binding site such as BINDING SITE I, BINDING SITE II or BINDING SITE III of FIG. 8. Table 4 illustrates the complementarity of the nucleotide sequences of NUDT9 BINDING SITE, designated SEQ ID:4160, to the nucleotide sequence of GAM8678 RNA, herein designated GAM RNA, also designated SEQ ID:347.

Another function of GAM8678 is therefore inhibition of Nudix (nucleoside diphosphate linked moiety x)-type motif 9 (NUDT9, Accession NP_076952.1). Accordingly, utilities of GAM8678 include diagnosis, prevention and treatment of diseases and clinical conditions associated with NUDT9.

Oculocutaneous albinism ii (pink-eye dilution homolog, mouse) (OCA2, Accession NP_000266.1) is another GAM8678 target gene, herein designated TARGET GENE. OCA2 BINDING SITE is a target binding site found in the 3' untranslated region of mRNA encoded by OCA2, corresponding to a target binding site such as BINDING SITE I, BINDING SITE II or BINDING SITE III of FIG. 8. Table 4 illustrates the complementarity of the nucleotide sequences of OCA2 BINDING SITE, designated SEQ ID:19737, to the nucleotide sequence of GAM8678 RNA, herein designated GAM RNA, also designated SEQ ID:347.

Another function of GAM8678 is therefore inhibition of Oculocutaneous albinism ii (pink-eye dilution homolog, mouse) (OCA2, Accession NP_000266.1), a gene which is believed to be an integral membrane protein involved in small molecule transport, specifically tyrosine -a precursor of melanin. and therefore is associated with Type 2 oculocutaneous albinism. Accordingly, utilities of GAM8678 include diagnosis, prevention and treatment of Type 2 oculocutaneous albinism., and of other diseases and clinical conditions associated with OCA2.

The function of OCA2 and its association with various diseases and clinical conditions, has been established by previous studies, as described hereinabove with reference to GAM259.2. Oxysterol binding protein-like 2 (OSBPL2, Accession NP_653081.1) is another GAM8678 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:2305, to the nucleotide sequence of GAM8678 RNA, herein designated GAM RNA, also designated SEQ ID:347.

Another function of GAM8678 is therefore inhibition of Oxysterol binding protein-like 2 (OSBPL2, Accession NP_653081.1). Accordingly, utilities of GAM8678 include diagnosis, prevention and treatment of diseases and clinical conditions associated with OSBPL2.

Oxysterol binding protein-like 2 (OSBPL2, Accession NP_055650.1) is another GAM8678 target gene, herein designated TARGET GENE. OSBPL2 BINDING SITE is a target binding site found in the 3' untranslated region of multiple transcripts of mRNA encoded by OSBPL2, corresponding to a target binding site such as BINDING SITE I, BINDING SITE II or BINDING SITE III of FIG. 8. Table 4 illustrates the complementarity of the nucleotide sequences of OSBPL2 BINDING SITE, designated SEQ ID:2305, to the nucleotide sequence of GAM8678 RNA, herein designated GAM RNA, also designated SEQ ID:347.

Another function of GAM8678 is therefore inhibition of Oxysterol binding protein-like 2 (OSBPL2, Accession NP_055650.1). Accordingly, utilities of GAM8678 include diagnosis, prevention and treatment of diseases and clinical conditions associated with OSBPL2.

Pdz and lim domain 2 (mystique) (PDLIM2, Accession NP_789847.1) is another GAM8678 target gene, herein designated TARGET GENE. PDLIM2 BINDING SITE is a target binding site found in the 3' untranslated region of multiple transcripts of mRNA encoded by PDLIM2, corresponding to a target binding site such as BINDING SITE I, BINDING SITE II or BINDING SITE III of FIG. 8. Table 4 illustrates the complementarity of the nucleotide sequences of PDLIM2 BINDING SITE, designated SEQ ID:12274, to the nucleotide sequence of GAM8678 RNA, herein designated GAM RNA, also designated SEQ ID:347.

Another function of GAM8678 is therefore inhibition of Pdz and lim domain 2 (mystique) (PDLIM2, Accession NP_789847.1). Accordingly, utilities of GAM8678 include diagnosis, prevention and treatment of diseases and clinical conditions associated with PDLIM2.

Pellino homolog 2 (drosophila) (PELI2, Accession NP_067078.1) is another GAM8678 target gene, herein designated TARGET GENE. PELI2 BINDING SITE is a target binding site found in the 3' untranslated region of mRNA encoded by PELI2, corresponding to a target binding site such as BINDING SITE I, BINDING SITE II or BINDING SITE III of FIG. 8. Table 4 illustrates the complementarity of the nucleotide sequences of PELI2 BINDING SITE, designated SEQ ID:5142, to the nucleotide sequence of GAM8678 RNA, herein designated GAM RNA, also designated SEQ ID:347.

Another function of GAM8678 is therefore inhibition of Pellino homolog 2 (drosophila) (PELI2, Accession NP_067078.1). Accordingly, utilities of GAM8678 include diagnosis, prevention and treatment of diseases and clinical conditions associated with PELI2.

PHGDHL1 (Accession NP_808882.1) is another GAM8678 target gene, herein designated TARGET GENE. PHGDHL1 BINDING SITE is a target binding site found in the 3' untranslated region of mRNA encoded by PHGDHL1, corresponding to a target binding site such as BINDING SITE I, BINDING SITE II or BINDING SITE III of FIG. 8. Table 4 illustrates the complementarity of the nucleotide sequences of PHGDHL1 BINDING SITE, designated SEQ ID:2130, to the nucleotide sequence of GAM8678 RNA, herein designated GAM RNA, also designated SEQ ID:347.

Another function of GAM8678 is therefore inhibition of PHGDHL1 (Accession NP_808882.1). Accordingly, utilities of GAM8678 include diagnosis, prevention and treatment of diseases and clinical conditions associated with PHGDHL1.

Polycystic kidney and hepatic disease 1 (autosomal recessive) (PKHD1, Accession NP_619639.2) is another GAM8678 target gene, herein designated TARGET GENE. PKHD1 BINDING SITE is a target binding site found in the 3' untranslated region of multiple transcripts of mRNA encoded by PKHD1, corresponding to a target binding site such as BINDING SITE I, BINDING SITE II or BINDING SITE III of FIG. 8. Table 4 illustrates the complementarity of the nucleotide sequences of PKHD1 BINDING SITE, designated SEQ ID:4107, to the nucleotide sequence of GAM8678 RNA, herein designated GAM RNA, also designated SEQ ID:347.

Another function of GAM8678 is therefore inhibition of Polycystic kidney and hepatic disease 1 (autosomal recessive) (PKHD1, Accession NP_619639.2). Accordingly, utilities of GAM8678 include diagnosis, prevention and treatment of diseases and clinical conditions associated with PKHD1.

Plakophilin 2 (PKP2, Accession NP_004563.1) is another GAM8678 target gene, herein designated TARGET GENE. PKP2 BINDING SITE is a target binding site found in the 3' untranslated region of mRNA encoded by PKP2, corresponding to a target binding site such as BINDING SITE I, BINDING SITE II or BINDING SITE III of FIG. 8. Table 4 illustrates the complementarity of the nucleotide sequences of PKP2 BINDING SITE, designated SEQ ID:6155, to the nucleotide sequence of GAM8678 RNA, herein designated GAM RNA, also designated SEQ ID:347.

Another function of GAM8678 is therefore inhibition of Plakophilin 2 (PKP2, Accession NP_004563.1), a gene which may play a role in junctional plaques. Accordingly, utilities of GAM8678 include diagnosis, prevention and treatment of diseases and clinical conditions associated with PKP2.

The function of PKP2 and its association with various diseases and clinical conditions, has been established by previous studies, as described hereinabove with reference to GAM93.1. Polymyositis/scleroderma autoantigen 2, 100 kda (PMSCL2, Accession NP_002676.1) is another GAM8678 target gene, herein designated TARGET GENE. PMSCL2 BINDING SITE is a target binding site found in the 3' untranslated region of mRNA encoded by PMSCL2, corresponding to a target binding site such as BINDING SITE I, BINDING SITE II or BINDING SITE III of FIG. 8. Table 4 illustrates the complementarity of the nucleotide sequences of PMSCL2 BINDING SITE, designated SEQ ID:8871, to the nucleotide sequence of GAM8678 RNA, herein designated GAM RNA, also designated SEQ ID:347.

Another function of GAM8678 is therefore inhibition of Polymyositis/scleroderma autoantigen 2, 100 kda (PMSCL2, Accession NP_002676.1). Accordingly, utilities of GAM8678 include diagnosis, prevention and treatment of diseases and clinical conditions associated with PMSCL2.

Peanut-like 2 (drosophila) (PNUTL2, Accession NP_536341.1) is another GAM8678 target gene, herein designated TARGET GENE. PNUTL2 BINDING SITE is a target binding site found in the 5' untranslated region of multiple transcripts of mRNA encoded by PNUTL2, corresponding to a target binding site such as BINDING SITE I, BINDING SITE II or BINDING SITE III of FIG. 8. Table 4 illustrates the complementarity of the nucleotide sequences of PNUTL2 BINDING SITE, designated SEQ ID:15639, to the nucleotide sequence of GAM8678 RNA, herein designated GAM RNA, also designated SEQ ID:347.

Another function of GAM8678 is therefore inhibition of Peanut-like 2 (drosophila) (PNUTL2, Accession NP_536341.1), a gene which is involved in cytokinesis. Accordingly, utilities of GAM8678 include diagnosis, prevention and treatment of diseases and clinical conditions associated with PNUTL2.

The function of PNUTL2 and its association with various diseases and clinical conditions, has been established by previous studies, as described hereinabove with reference to GAM223.1. Peanut-like 2 (drosophila) (PNUTL2, Accession NP_536340.1) is another GAM8678 target gene, herein designated TARGET GENE. PNUTL2 BINDING SITE is a target binding site found in the 5' untranslated region of multiple transcripts of mRNA encoded by PNUTL2, corresponding to a target binding site such as BINDING SITE I, BINDING SITE II or BINDING SITE III of FIG. 8. Table 4 illustrates the complementarity of the nucleotide sequences of PNUTL2 BINDING SITE, designated SEQ ID:15639, to the nucleotide sequence of GAM8678 RNA, herein designated GAM RNA, also designated SEQ ID:347.

Another function of GAM8678 is therefore inhibition of Peanut-like 2 (drosophila) (PNUTL2, Accession NP_536340.1), a gene which is involved in cytokinesis. Accordingly, utilities of GAM8678 include diagnosis, prevention and treatment of diseases and clinical conditions associated with PNUTL2.

The function of PNUTL2 and its association with various diseases and clinical conditions, has been established by previous studies, as described hereinabove with reference to GAM223.1. Protein phosphatase 2, regulatory subunit b (b56), gamma isoform (PPP2R5C, Accession NP_848701.1) is another GAM8678 target gene, herein designated TARGET GENE. PPP2R5C BINDING SITE is a target binding site found in the 3' untranslated region of multiple transcripts of mRNA encoded by PPP2R5C, corresponding to a target binding site such as BINDING SITE I, BINDING SITE II or BINDING SITE III of FIG. 8. Table 4 illustrates the complementarity of the nucleotide sequences of PPP2R5C BINDING SITE, designated SEQ ID:2895, to the nucleotide sequence of GAM8678 RNA, herein designated GAM RNA, also designated SEQ ID:347.

Another function of GAM8678 is therefore inhibition of Protein phosphatase 2, regulatory subunit b (b56), gamma isoform (PPP2R5C, Accession NP_848701.1), a gene which is a regulatory subunit of protein phosphatase 2A. Accordingly, utilities of GAM8678 include diagnosis, prevention and treatment of diseases and clinical conditions associated with PPP2R5C.

The function of PPP2R5C and its association with various diseases and clinical conditions, has been established by previous studies, as described hereinabove with reference to GAM99.1. Protein phosphatase 2, regulatory subunit b (b56), gamma isoform (PPP2R5C, Accession NP_002710.2) is another GAM8678 target gene, herein designated TARGET GENE. PPP2R5C BINDING SITE is a target binding site found in the 3' untranslated region of multiple transcripts of mRNA encoded by PPP2R5C, corresponding to a target binding site such as BINDING SITE I, BINDING SITE II or BINDING SITE III of FIG. 8. Table 4 illustrates the complementarity of the nucleotide sequences of PPP2R5C BINDING SITE, designated SEQ ID:2895, to the nucleotide sequence of GAM8678 RNA, herein designated GAM RNA, also designated SEQ ID:347.

Another function of GAM8678 is therefore inhibition of Protein phosphatase 2, regulatory subunit b (b56), gamma isoform (PPP2R5C, Accession NP_002710.2), a gene which is a regulatory subunit of protein phosphatase 2A. Accordingly, utilities of GAM8678 include diagnosis, prevention and treatment of diseases and clinical conditions associated with PPP2R5C.

The function of PPP2R5C and its association with various diseases and clinical conditions, has been established by previous studies, as described hereinabove with reference to GAM99.1. Prp4 pre-mrna processing factor 4 homolog (yeast) (PRPF4, Accession NP_004688.2) is another GAM8678 target gene, herein designated TARGET GENE. PRPF4 BINDING SITE is a target binding site found in the 3' untranslated region of mRNA encoded by PRPF4, corresponding to a target binding site such as BINDING SITE I, BINDING SITE II or BINDING SITE III of FIG. 8. Table 4 illustrates the complementarity of the nucleotide sequences of PRPF4 BINDING SITE, designated SEQ ID:9758, to the nucleotide sequence of GAM8678 RNA, herein designated GAM RNA, also designated SEQ ID:347.

Another function of GAM8678 is therefore inhibition of Prp4 pre-mrna processing factor 4 homolog (yeast) (PRPF4, Accession NP_004688.2). Accordingly, utilities of GAM8678 include diagnosis, prevention and treatment of diseases and clinical conditions associated with PRPF4.

Protein tyrosine phosphatase, non-receptor type 1 (PTPN1, Accession NP_002818.1) is another GAM8678 target gene, herein designated TARGET GENE. PTPN1 BINDING SITE is a target binding site found in the 3' untranslated region of mRNA encoded by PTPN1, corresponding to a target binding site such as BINDING SITE I, BINDING SITE II or BINDING SITE III of FIG. 8. Table 4 illustrates the complementarity of the nucleotide sequences of PTPN1 BINDING SITE, designated SEQ ID:8916, to the nucleotide sequence of GAM8678 RNA, herein designated GAM RNA, also designated SEQ ID:347.

Another function of GAM8678 is therefore inhibition of Protein tyrosine phosphatase, non-receptor type 1 (PTPN1, Accession NP_002818.1), a gene which is a non-receptor type 1 protein tyrosine phosphatase and inhibits insulin signaling. Accordingly, utilities of GAM8678 include diagnosis, prevention and treatment of diseases and clinical conditions associated with PTPN1.

The function of PTPN1 and its association with various diseases and clinical conditions, has been established by previous studies, as described hereinabove with reference to GAM71.1. Peptide y, 2 (seminalplasmin) (PYY2, Accession NP_066579.1) is another GAM8678 target gene, herein designated TARGET GENE. PYY2 BINDING SITE is a target binding site found in the 3' untranslated region of mRNA encoded by PYY2, corresponding to a target binding site such as BINDING SITE I, BINDING SITE II or BINDING SITE III of FIG. 8. Table 4 illustrates the complementarity of the nucleotide sequences of PYY2 BINDING SITE, designated SEQ ID:18282, to the nucleotide sequence of GAM8678 RNA, herein designated GAM RNA, also designated SEQ ID:347.

Another function of GAM8678 is therefore inhibition of Peptide y, 2 (seminalplasmin) (PYY2, Accession NP_066579.1). Accordingly, utilities of GAM8678 include diagnosis, prevention and treatment of diseases and clinical conditions associated with PYY2.

Rna binding motif protein 15 (RBM15, Accession NP_073605.3) is another GAM8678 target gene, herein designated TARGET GENE. RBM15 BINDING SITE is a target binding site found in the 5' untranslated region of mRNA encoded by RBM15, corresponding to a target binding site such as BINDING SITE I, BINDING SITE II or BINDING SITE III of FIG. 8. Table 4 illustrates the complementarity of the nucleotide sequences of RBM15 BINDING SITE, designated SEQ ID:16706, to the nucleotide sequence of GAM8678 RNA, herein designated GAM RNA, also designated SEQ ID:347.

Another function of GAM8678 is therefore inhibition of Rna binding motif protein 15 (RBM15, Accession NP_073605.3), a gene which is a candidate oncoprotein and therefore may be associated with Acute megakaryoblastic leukemia (amkl). Accordingly, utilities of GAM8678 include diagnosis, prevention and treatment of Acute megakaryoblastic leukemia (amkl), and of other diseases and clinical conditions associated with RBM15.

The function of RBM15 and its association with various diseases and clinical conditions, has been established by previous studies, as described hereinabove with reference to GAM5039.2. RDH11 (Accession NP_057110.2) is another GAM8678 target gene, herein designated TARGET GENE. RDH11 BINDING SITE is a target binding site found in the 3' untranslated region of mRNA encoded by RDH11, corresponding to a target binding site such as BINDING SITE I, BINDING SITE II or BINDING SITE III of FIG. 8. Table 4 illustrates the complementarity of the nucleotide sequences of RDH11 BINDING SITE, designated SEQ ID:12781, to the nucleotide sequence of GAM8678 RNA, herein designated GAM RNA, also designated SEQ ID:347.

Another function of GAM8678 is therefore inhibition of RDH11 (Accession NP_057110.2). Accordingly, utilities of GAM8678 include diagnosis, prevention and treatment of diseases and clinical conditions associated with RDH11.

RNF144 (Accession NP_055561.1) is another GAM8678 target gene, herein designated TARGET GENE. RNF144 BINDING SITE is a target binding site found in the 3' untranslated region of mRNA encoded by RNF144, corresponding to a target binding site such as BINDING SITE I, BINDING SITE II or BINDING SITE III of FIG. 8. Table 4 illustrates the complementarity of the nucleotide sequences of RNF144 BINDING SITE, designated SEQ ID:9320, to the nucleotide sequence of GAM8678 RNA, herein designated GAM RNA, also designated SEQ ID:347.

Another function of GAM8678 is therefore inhibition of RNF144 (Accession NP_055561.1). Accordingly, utilities of GAM8678 include diagnosis, prevention and treatment of diseases and clinical conditions associated with RNF144.

Retinoid x receptor, alpha (RXRA, Accession NP_002948.1) is another GAM8678 target gene, herein designated TARGET GENE. RXRA BINDING SITE is a target binding site found in the 3' untranslated region of mRNA encoded by RXRA, corresponding to a target binding site such as BINDING SITE I, BINDING SITE II or BINDING SITE III of FIG. 8. Table 4 illustrates the complementarity of the nucleotide sequences of RXRA BINDING SITE, designated SEQ ID:19924, to the nucleotide sequence of GAM8678 RNA, herein designated GAM RNA, also designated SEQ ID:347.

Another function of GAM8678 is therefore inhibition of Retinoid x receptor, alpha (RXRA, Accession NP_002948.1), a gene which activates genes required for vitamin A metabolism, binds 9-cis retinoic acid. Accordingly, utilities of GAM8678 include diagnosis, prevention and treatment of diseases and clinical conditions associated with RXRA.

The function of RXRA and its association with various diseases and clinical conditions, has been established by previous studies, as described hereinabove with reference to GAM146.1. Splicing factor, arginine/serine-rich 2, interacting protein (SFRS2IP, Accession NP_004710.1) is another GAM8678 target gene, herein designated TARGET GENE. SFRS2IP BINDING SITE is a target binding site found in the 5' untranslated region of mRNA encoded by SFRS2IP, corresponding to a target binding site such as BINDING SITE I, BINDING SITE II or BINDING SITE III of FIG. 8. Table 4 illustrates the complementarity of the nucleotide sequences of SFRS2IP BINDING SITE, designated SEQ ID:4478, to the nucleotide sequence of GAM8678 RNA, herein designated GAM RNA, also designated SEQ ID:347.

Another function of GAM8678 is therefore inhibition of Splicing factor, arginine/serine-rich 2, interacting protein (SFRS2IP, Accession NP_004710.1), a gene which plays an essential role in pre-mRNA splicing. Accordingly, utilities of GAM8678 include diagnosis, prevention and treatment of diseases and clinical conditions associated with SFRS2IP.

The function of SFRS2IP and its association with various diseases and clinical conditions, has been established by previous studies, as described hereinabove with reference to GAM44.1. Solute carrier family 4, anion exchanger, member 3 (SLC4A3, Accession NP_005061.1) is another GAM8678 target gene, herein designated TARGET GENE. SLC4A3 BINDING SITE is a target binding site found in the 3' untranslated region of mRNA encoded by SLC4A3, corresponding to a target binding site such as BINDING SITE I, BINDING SITE II or BINDING SITE III of FIG. 8. Table 4 illustrates the complementarity of the nucleotide sequences of SLC4A3 BINDING SITE, designated SEQ ID:10313, to the nucleotide sequence of GAM8678 RNA, herein designated GAM RNA, also designated SEQ ID:347.

Another function of GAM8678 is therefore inhibition of Solute carrier family 4, anion exchanger, member 3 (SLC4A3, Accession NP_005061.1). Accordingly, utilities of GAM8678 include diagnosis, prevention and treatment of diseases and clinical conditions associated with SLC4A3.

SMBP (Accession NP_064508.1) is another GAM8678 target gene, herein designated TARGET GENE. SMBP BINDING SITE is a target binding site found in the 3' untranslated region of mRNA encoded by SMBP, corresponding to a target binding site such as BINDING SITE I, BINDING SITE II or BINDING SITE III of FIG. 8. Table 4 illustrates the complementarity of the nucleotide sequences of SMBP BINDING SITE, designated SEQ ID:2093, to the nucleotide sequence of GAM8678 RNA, herein designated GAM RNA, also designated SEQ ID:347.

Another function of GAM8678 is therefore inhibition of SMBP (Accession NP_064508.1). Accordingly, utilities of GAM8678 include diagnosis, prevention and treatment of diseases and clinical conditions associated with SMBP.

Small nuclear ribonucleoprotein polypeptide n (SNRPN, Accession NP_073718.1) is another GAM8678 target gene, herein designated TARGET GENE. SNRPN BINDING SITE is a target binding site found in the 5' untranslated region of multiple transcripts of mRNA encoded by SNRPN, corresponding to a target binding site such as BINDING SITE I, BINDING SITE II or BINDING SITE III of FIG. 8. Table 4 illustrates the complementarity of the nucleotide sequences of SNRPN BINDING SITE, designated SEQ ID:15260, to the nucleotide sequence of GAM8678 RNA, herein designated GAM RNA, also designated SEQ ID:347.

Another function of GAM8678 is therefore inhibition of Small nuclear ribonucleoprotein polypeptide n (SNRPN, Accession NP_073718.1), a gene which may be involved in tissue-specific alternative RNA processing events and therefore may be associated with Prader-willi syndrome, angelman syndrome. Accordingly, utilities of GAM8678 include diagnosis, prevention and treatment of Prader-willi syndrome, angelman syndrome, and of other diseases and clinical conditions associated with SNRPN.

The function of SNRPN and its association with various diseases and clinical conditions, has been established by previous studies, as described hereinabove with reference to GAM507.1. Small nuclear ribonucleoprotein polypeptide n (SNRPN, Accession NP_073719.1) is another GAM8678 target gene, herein designated TARGET GENE. SNRPN BINDING SITE is a target binding site found in the 5' untranslated region of multiple transcripts of mRNA encoded by SNRPN, corresponding to a target binding site such as BINDING SITE I, BINDING SITE II or BINDING SITE III of FIG. 8. Table 4 illustrates the complementarity of the nucleotide sequences of SNRPN BINDING SITE, designated SEQ ID:15260, to the nucleotide sequence of GAM8678 RNA, herein designated GAM RNA, also designated SEQ ID:347.

Another function of GAM8678 is therefore inhibition of Small nuclear ribonucleoprotein polypeptide n (SNRPN, Accession NP_073719.1), a gene which may be involved in tissue-specific alternative RNA processing events and therefore may be associated with Prader-willi syndrome, angelman syndrome. Accordingly, utilities of GAM8678 include diagnosis, prevention and treatment of Prader-willi syndrome, angelman syndrome, and of other diseases and clinical conditions associated with SNRPN.

The function of SNRPN and its association with various diseases and clinical conditions, has been established by previous studies, as described hereinabove with reference to GAM507.1. Serine/arginine repetitive matrix 1 (SRRM1, Accession NP_005830.1) is another GAM8678 target gene, herein designated TARGET GENE. SRRM1 BINDING SITE is a target binding site found in the 3' untranslated region of mRNA encoded by SRRM1, corresponding to a target binding site such as BINDING SITE I, BINDING SITE II or BINDING SITE III of FIG. 8. Table 4 illustrates the complementarity of the nucleotide sequences of SRRM1 BINDING SITE, designated SEQ ID:9316, to the nucleotide sequence of GAM8678 RNA, herein designated GAM RNA, also designated SEQ ID:347.

Another function of GAM8678 is therefore inhibition of Serine/arginine repetitive matrix 1 (SRRM1, Accession NP_005830.1). Accordingly, utilities of GAM8678 include diagnosis, prevention and treatment of diseases and clinical conditions associated with SRRM1.

ST18 (Accession NP_055497.1) is another GAM8678 target gene, herein designated TARGET GENE. ST18 BINDING SITE is a target binding site found in the 5' untranslated region of mRNA encoded by ST18, corresponding to a target binding site such as BINDING SITE I, BINDING SITE II or BINDING SITE III of FIG. 8. Table 4 illustrates the complementarity of the nucleotide sequences of ST18 BINDING SITE, designated SEQ ID:7850, to the nucleotide sequence of GAM8678 RNA, herein designated GAM RNA, also designated SEQ ID:347.

Another function of GAM8678 is therefore inhibition of ST18 (Accession NP_055497.1). Accordingly, utilities of GAM8678 include diagnosis, prevention and treatment of diseases and clinical conditions associated with ST18.

Staufen, rna binding protein (drosophila) (STAU, Accession NP_059346.1) is another GAM8678 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:13032, to the nucleotide sequence of GAM8678 RNA, herein designated GAM RNA, also designated SEQ ID:347.

Another function of GAM8678 is therefore inhibition of Staufen, rna binding protein (drosophila) (STAU, Accession NP_059346.1), a gene which may play a role in specific positioning of mrnas at given sites in the cell and in stimulating their translation at the site. Accordingly, utilities of GAM8678 include diagnosis, prevention and treatment of diseases and clinical conditions associated with STAU.

The function of STAU and its association with various diseases and clinical conditions, has been established by previous studies, as described hereinabove with reference to GAM37.1. Staufen, rna binding protein (drosophila) (STAU, Accession NP_059347.1) is another GAM8678 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:13032, to the nucleotide sequence of GAM8678 RNA, herein designated GAM RNA, also designated SEQ ID:347.

Another function of GAM8678 is therefore inhibition of Staufen, rna binding protein (drosophila) (STAU, Accession NP_059347.1), a gene which may play a role in specific positioning of mrnas at given sites in the cell and in stimulating their translation at the site. Accordingly, utilities of GAM8678 include diagnosis, prevention and treatment of diseases and clinical conditions associated with STAU.

The function of STAU and its association with various diseases and clinical conditions, has been established by previous studies, as described hereinabove with reference to GAM37.1. Staufen, rna binding protein (drosophila) (STAU, Accession NP_004593.1) is another GAM8678 target gene, herein designated TARGET GENE. STAU BINDING SITE is a target binding site found in the 5' untranslated region of multiple transcripts of mRNA encoded by STAU, corresponding to a target binding site such as BINDING SITE I, BINDING SITE II or BINDING SITE III of FIG. 8. Table 4 illustrates the complementarity of the nucleotide sequences of STAU BINDING SITE, designated SEQ ID:13032, to the nucleotide sequence of GAM8678 RNA, herein designated GAM RNA, also designated SEQ ID:347.

Another function of GAM8678 is therefore inhibition of Staufen, rna binding protein (drosophila) (STAU, Accession NP_004593.1), a gene which may play a role in specific positioning of mrnas at given sites in the cell and in stimulating their translation at the site. Accordingly, utilities of GAM8678 include diagnosis, prevention and treatment of diseases and clinical conditions associated with STAU.

The function of STAU and its association with various diseases and clinical conditions, has been established by previous studies, as described hereinabove with reference to GAM37.1. STN2 (Accession NP_149095.2) is another GAM8678 target gene, herein designated TARGET GENE. STN2 BINDING SITE is a target binding site found in the 5' untranslated region of mRNA encoded by STN2, corresponding to a target binding site such as BINDING SITE I, BINDING SITE II or BINDING SITE III of FIG. 8. Table 4 illustrates the complementarity of the nucleotide sequences of STN2 BINDING SITE, designated SEQ ID:7040, to the nucleotide sequence of GAM8678 RNA, herein designated GAM RNA, also designated SEQ ID:347.

Another function of GAM8678 is therefore inhibition of STN2 (Accession NP_149095.2). Accordingly, utilities of GAM8678 include diagnosis, prevention and treatment of diseases and clinical conditions associated with STN2.

T1A-2 (Accession NP_006465.1) is another GAM8678 target gene, herein designated TARGET GENE. T1A-2 BINDING SITE is a target binding site found in the 3' untranslated region of mRNA encoded by T1A-2, corresponding to a target binding site such as BINDING SITE I, BINDING SITE II or BINDING SITE III of FIG. 8. Table 4 illustrates the complementarity of the nucleotide sequences of T1A-2 BINDING SITE, designated SEQ ID:7465, to the nucleotide sequence of GAM8678 RNA, herein designated GAM RNA, also designated SEQ ID:347.

Another function of GAM8678 is therefore inhibition of T1A-2 (Accession NP_006465.1). Accordingly, utilities of GAM8678 include diagnosis, prevention and treatment of diseases and clinical conditions associated with T1A-2.

T-cell leukemia/lymphoma 6 (TCL6, Accession NP_065578.2) is another GAM8678 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:19762, to the nucleotide sequence of GAM8678 RNA, herein designated GAM RNA, also designated SEQ ID:347.

Another function of GAM8678 is therefore inhibition of T-cell leukemia/lymphoma 6 (TCL6, Accession NP_065578.2). Accordingly, utilities of GAM8678 include diagnosis, prevention and treatment of diseases and clinical conditions associated with TCL6.

T-cell leukemia/lymphoma 6 (TCL6, Accession NP_065579.2) is another GAM8678 target gene, herein designated TARGET GENE. TCL6 BINDING SITE is a target binding site found in the 5' untranslated region of multiple transcripts of mRNA encoded by TCL6, corresponding to a target binding site such as BINDING SITE I, BINDING SITE II or BINDING SITE III of FIG. 8. Table 4 illustrates the complementarity of the nucleotide sequences of TCL6 BINDING SITE, designated SEQ ID:19762, to the nucleotide sequence of GAM8678 RNA, herein designated GAM RNA, also designated SEQ ID:347.

Another function of GAM8678 is therefore inhibition of T-cell leukemia/lymphoma 6 (TCL6, Accession NP_065579.2). Accordingly, utilities of GAM8678 include diagnosis, prevention and treatment of diseases and clinical conditions associated with TCL6.

TEM6 (Accession NP_073585.6) is another GAM8678 target gene, herein designated TARGET GENE. TEM6 BINDING SITE is a target binding site found in the 3' untranslated region of mRNA encoded by TEM6, corresponding to a target binding site such as BINDING SITE I, BINDING SITE II or BINDING SITE III of FIG. 8. Table 4 illustrates the complementarity of the nucleotide sequences of TEM6 BINDING SITE, designated SEQ ID:3134, to the nucleotide sequence of GAM8678 RNA, herein designated GAM RNA, also designated SEQ ID:347.

Another function of GAM8678 is therefore inhibition of TEM6 (Accession NP_073585.6), a gene which displayes elevated expression during tumor angiogenesis. Accordingly, utilities of GAM8678 include diagnosis, prevention and treatment of diseases and clinical conditions associated with TEM6.

The function of TEM6 and its association with various diseases and clinical conditions, has been established by previous studies, as described hereinabove with reference to GAM401.1. Transmembrane protein 2 (TMEM2, Accession NP_037522.1) is another GAM8678 target gene, herein designated TARGET GENE. TMEM2 BINDING SITE is a target binding site found in the 5' untranslated region of mRNA encoded by TMEM2, corresponding to a target binding site such as BINDING SITE I, BINDING SITE II or BINDING SITE III of FIG. 8. Table 4 illustrates the complementarity of the nucleotide sequences of TMEM2 BINDING SITE, designated SEQ ID:15174, to the nucleotide sequence of GAM8678 RNA, herein designated GAM RNA, also designated SEQ ID:347.

Another function of GAM8678 is therefore inhibition of Transmembrane protein 2 (TMEM2, Accession NP_037522.1). Accordingly, utilities of GAM8678 include diagnosis, prevention and treatment of diseases and clinical conditions associated with TMEM2.

Thymopoietin (TMPO, Accession NP_003267.1) is another GAM8678 target gene, herein designated TARGET GENE. TMPO BINDING SITE is a target binding site found in the 5' untranslated region of mRNA encoded by TMPO, corresponding to a target binding site such as BINDING SITE I, BINDING SITE II or BINDING SITE III of FIG. 8. Table 4 illustrates the complementarity of the nucleotide sequences of TMPO BINDING SITE, designated SEQ ID:17228, to the nucleotide sequence of GAM8678 RNA, herein designated GAM RNA, also designated SEQ ID:347.

Another function of GAM8678 is therefore inhibition of Thymopoietin (TMPO, Accession NP_003267.1), a gene which plays important roles in T-cell development and function. Accordingly, utilities of GAM8678 include diagnosis, prevention and treatment of diseases and clinical conditions associated with TMPO.

The function of TMPO and its association with various diseases and clinical conditions, has been established by previous studies, as described hereinabove with reference to GAM884.1. TMPRSS6 (Accession NP_705837.1) is another GAM8678 target gene, herein designated TARGET GENE. TMPRSS6 BINDING SITE is a target binding site found in the 3' untranslated region of multiple transcripts of mRNA encoded by TMPRSS6, corresponding to a target binding site such as BINDING SITE I, BINDING SITE II or BINDING SITE III of FIG. 8. Table 4 illustrates the complementarity of the nucleotide sequences of TMPRSS6 BINDING SITE, designated SEQ ID:7953, to the nucleotide sequence of GAM8678 RNA, herein designated GAM RNA, also designated SEQ ID:347.

Another function of GAM8678 is therefore inhibition of TMPRSS6 (Accession NP_705837.1). Accordingly, utilities of GAM8678 include diagnosis, prevention and treatment of diseases and clinical conditions associated with TMPRSS6.

Tumor necrosis factor receptor superfamily, member 21 (TNFRSF21, Accession NP_055267.1) is another GAM8678 target gene, herein designated TARGET GENE. TNFRSF21 BINDING SITE is a target binding site found in the 3' untranslated region of mRNA encoded by TNFRSF21, corresponding to a target binding site such as BINDING SITE I, BINDING SITE II or BINDING SITE III of FIG. 8. Table 4 illustrates the complementarity of the nucleotide sequences of TNFRSF21 BINDING SITE, designated SEQ ID:13399, to the nucleotide sequence of GAM8678 RNA, herein designated GAM RNA, also designated SEQ ID:347.

Another function of GAM8678 is therefore inhibition of Tumor necrosis factor receptor superfamily, member 21 (TNFRSF21, Accession NP_055267.1). Accordingly, utilities of GAM8678 include diagnosis, prevention and treatment of diseases and clinical conditions associated with TNFRSF21.

TP53I5 (Accession XP_290532.2) is another GAM8678 target gene, herein designated TARGET GENE. TP53I5 BINDING SITE is a target binding site found in the 5' untranslated region of mRNA encoded by TP53I5, corresponding to a target binding site such as BINDING SITE I, BINDING SITE II or BINDING SITE III of FIG. 8. Table 4 illustrates the complementarity of the nucleotide sequences of TP53I5 BINDING SITE, designated SEQ ID:13005, to the nucleotide sequence of GAM8678 RNA, herein designated GAM RNA, also designated SEQ ID:347.

Another function of GAM8678 is therefore inhibition of TP53I5 (Accession XP_290532.2). Accordingly, utilities of GAM8678 include diagnosis, prevention and treatment of diseases and clinical conditions associated with TP53I5.

TREM5 (Accession NP_777552.1) is another GAM8678 target gene, herein designated TARGET GENE. TREM5 BINDING SITE is a target binding site found in the 3' untranslated region of mRNA encoded by TREM5, corresponding to a target binding site such as BINDING SITE I, BINDING SITE II or BINDING SITE III of FIG. 8. Table 4 illustrates the complementarity of the nucleotide sequences of TREM5 BINDING SITE, designated SEQ ID:16803, to the nucleotide sequence of GAM8678 RNA, herein designated GAM RNA, also designated SEQ ID:347.

Another function of GAM8678 is therefore inhibition of TREM5 (Accession NP_777552.1). Accordingly, utilities of GAM8678 include diagnosis, prevention and treatment of diseases and clinical conditions associated with TREM5.

TRIM (Accession NP_057472.1) is another GAM8678 target gene, herein designated TARGET GENE. TRIM BINDING SITE is a target binding site found in the 3' untranslated region of mRNA encoded by TRIM, corresponding to a target binding site such as BINDING SITE I, BINDING SITE II or BINDING SITE III of FIG. 8. Table 4 illustrates the complementarity of the nucleotide sequences of TRIM BINDING SITE, designated SEQ ID:12763, to the nucleotide sequence of GAM8678 RNA, herein designated GAM RNA, also designated SEQ ID:347.

Another function of GAM8678 is therefore inhibition of TRIM (Accession NP_057472.1), a gene which plays a role in recruiting signaling proteins to the plasma membrane upon T-cell receptor (TCR) complex activation in T cells. Accordingly, utilities of GAM8678 include diagnosis, prevention and treatment of diseases and clinical conditions associated with TRIM.

The function of TRIM and its association with various diseases and clinical conditions, has been established by previous studies, as described hereinabove with reference to GAM519.1. Tripartite motif-containing 9 (TRIM9, Accession NP_443210.1) is another GAM8678 target gene, herein designated TARGET GENE. TRIM9 BINDING SITE is a target binding site found in the 3' untranslated region of multiple transcripts of mRNA encoded by TRIM9, corresponding to a target binding site such as BINDING SITE I, BINDING SITE II or BINDING SITE III of FIG. 8. Table 4 illustrates the complementarity of the nucleotide sequences of TRIM9 BINDING SITE, designated SEQ ID:5946, to the nucleotide sequence of GAM8678 RNA, herein designated GAM RNA, also designated SEQ ID:347.

Another function of GAM8678 is therefore inhibition of Tripartite motif-containing 9 (TRIM9, Accession NP_443210.1), a gene which may function as a positive regulator for mannosylphosphate transferase and is required to mediate mannosylphosphate transfer in both the core and outer chain portions of n-linked. oligosaccharides. Accordingly, utilities of GAM8678 include diagnosis, prevention and treatment of diseases and clinical conditions associated with TRIM9.

The function of TRIM9 and its association with various diseases and clinical conditions, has been established by previous studies, as described hereinabove with reference to GAM72.1. TU12B1-TY (Accession NP_057659.1) is another GAM8678 target gene, herein designated TARGET GENE. TU12B1-TY BINDING SITE is a target binding site found in the 3' untranslated region of mRNA encoded by TU12B1-TY, corresponding to a target binding site such as BINDING SITE I, BINDING SITE II or BINDING SITE III of FIG. 8. Table 4 illustrates the complementarity of the nucleotide sequences of TU12B1-TY BINDING SITE, designated SEQ ID:16134, to the nucleotide sequence of GAM8678 RNA, herein designated GAM RNA, also designated SEQ ID:347.

Another function of GAM8678 is therefore inhibition of TU12B1-TY (Accession NP_057659.1). Accordingly, utilities of GAM8678 include diagnosis, prevention and treatment of diseases and clinical conditions associated with TU12B1-TY.

Uridine phosphorylase (UP, Accession NP_853628.1) is another GAM8678 target gene, herein designated TARGET GENE. UP BINDING SITE is a target binding site found in the 5' untranslated region of multiple transcripts of mRNA encoded by UP, corresponding to a target binding site such as BINDING SITE I, BINDING SITE II or BINDING SITE III of FIG. 8. Table 4 illustrates the complementarity of the nucleotide sequences of UP BINDING SITE, designated SEQ ID:18427, to the nucleotide sequence of GAM8678 RNA, herein designated GAM RNA, also designated SEQ ID:347.

Another function of GAM8678 is therefore inhibition of Uridine phosphorylase (UP, Accession NP_853628.1). Accordingly, utilities of GAM8678 include diagnosis, prevention and treatment of diseases and clinical conditions associated with UP.

Uridine phosphorylase (UP, Accession NP_003355.1) is another GAM8678 target gene, herein designated TARGET GENE. UP BINDING SITE is a target binding site found in the 5' untranslated region of multiple transcripts of mRNA encoded by UP, corresponding to a target binding site such as BINDING SITE I, BINDING SITE II or BINDING SITE III of FIG. 8. Table 4 illustrates the complementarity of the nucleotide sequences of UP BINDING SITE, designated SEQ ID:18427, to the nucleotide sequence of GAM8678 RNA, herein designated GAM RNA, also designated SEQ ID:347.

Another function of GAM8678 is therefore inhibition of Uridine phosphorylase (UP, Accession NP_003355.1). Accordingly, utilities of GAM8678 include diagnosis, prevention and treatment of diseases and clinical conditions associated with UP.

Ubiquitin specific protease 24 (USP24, Accession XP_165973.3) is another GAM8678 target gene, herein designated TARGET GENE. USP24 BINDING SITE is a target binding site found in the 3' untranslated region of mRNA encoded by USP24, corresponding to a target binding site such as BINDING SITE I, BINDING SITE II or BINDING SITE III of FIG. 8. Table 4 illustrates the complementarity of the nucleotide sequences of USP24 BINDING SITE, designated SEQ ID:4851, to the nucleotide sequence of GAM8678 RNA, herein designated GAM RNA, also designated SEQ ID:347.

Another function of GAM8678 is therefore inhibition of Ubiquitin specific protease 24 (USP24, Accession XP__165973.3). Accordingly, utilities of GAM8678 include diagnosis, prevention and treatment of diseases and clinical conditions associated with USP24.

Williams beuren syndrome chromosome region 18 (WBSCR18, Accession NP__115693.2) is another GAM8678 target gene, herein designated TARGET GENE. WBSCR18 BINDING SITE is a target binding site found in the 3' untranslated region of mRNA encoded by WBSCR18, corresponding to a target binding site such as BINDING SITE I, BINDING SITE II or BINDING SITE III of FIG. 8. Table 4 illustrates the complementarity of the nucleotide sequences of WBSCR18 BINDING SITE, designated SEQ ID:18022, to the nucleotide sequence of GAM8678 RNA, herein designated GAM RNA, also designated SEQ ID:347.

Another function of GAM8678 is therefore inhibition of Williams beuren syndrome chromosome region 18 (WBSCR18, Accession NP__115693.2). Accordingly, utilities of GAM8678 include diagnosis, prevention and treatment of diseases and clinical conditions associated with WBSCR18.

Wolf-hirschhorn syndrome candidate 1 (WHSC1, Accession NP_579877.1) is another GAM8678 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:2577, to the nucleotide sequence of GAM8678 RNA, herein designated GAM RNA, also designated SEQ ID:347.

Another function of GAM8678 is therefore inhibition of Wolf-hirschhorn syndrome candidate 1 (WHSC1, Accession NP__579877.1), a gene which binds covalently to and repairs g/t mismatches. and therefore may be associated with Wolf-hirschhorn syndrome. Accordingly, utilities of GAM8678 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wolf-hirschhorn syndrome candidate 1 (WHSC1, Accession NP__579888.1) is another GAM8678 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:2577, to the nucleotide sequence of GAM8678 RNA, herein designated GAM RNA, also designated SEQ ID:347.

Another function of GAM8678 is therefore inhibition of Wolf-hirschhorn syndrome candidate 1 (WHSC1, Accession NP__579888.1), a gene which binds covalently to and repairs g/t mismatches. and therefore may be associated with Wolf-hirschhorn syndrome. Accordingly, utilities of GAM8678 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wolf-hirschhorn syndrome candidate 1 (WHSC1, Accession NP__055734.1) is another GAM8678 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:2577, to the nucleotide sequence of GAM8678 RNA, herein designated GAM RNA, also designated SEQ ID:347.

Another function of GAM8678 is therefore inhibition of Wolf-hirschhorn syndrome candidate 1 (WHSC1, Accession NP__055734.1), a gene which binds covalently to and repairs g/t mismatches. and therefore may be associated with Wolf-hirschhorn syndrome. Accordingly, utilities of GAM8678 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wolf-hirschhorn syndrome candidate 1 (WHSC1, Accession NP__579890.1) is another GAM8678 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:2577, to the nucleotide sequence of GAM8678 RNA, herein designated GAM RNA, also designated SEQ ID:347.

Another function of GAM8678 is therefore inhibition of Wolf-hirschhorn syndrome candidate 1 (WHSC1, Accession NP__579890.1), a gene which binds covalently to and repairs g/t mismatches. and therefore may be associated with Wolf-hirschhorn syndrome. Accordingly, utilities of GAM8678 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wolf-hirschhorn syndrome candidate 1 (WHSC1, Accession NP__579878.1) is another GAM8678 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:2577, to the nucleotide sequence of GAM8678 RNA, herein designated GAM RNA, also designated SEQ ID:347.

Another function of GAM8678 is therefore inhibition of Wolf-hirschhorn syndrome candidate 1 (WHSC1, Accession NP__579878.1), a gene which binds covalently to and repairs g/t mismatches. and therefore may be associated with Wolf-hirschhorn syndrome. Accordingly, utilities of GAM8678 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. Wolf-hirschhorn syndrome candidate 1 (WHSC1, Accession NP_579879.1) is another GAM8678 target gene, herein designated TARGET GENE. WHSC1 BINDING SITE is a target binding site found in the 3' untranslated region of multiple transcripts of mRNA encoded by WHSC1, corresponding to a target binding site such as BINDING SITE I, BINDING SITE II or BINDING SITE III of FIG. 8. Table 4 illustrates the complementarity of the nucleotide sequences of WHSC1 BINDING SITE, designated SEQ ID:2577, to the nucleotide sequence of GAM8678 RNA, herein designated GAM RNA, also designated SEQ ID:347.

Another function of GAM8678 is therefore inhibition of Wolf-hirschhorn syndrome candidate 1 (WHSC1, Accession NP_579879.1), a gene which binds covalently to and repairs g/t mismatches. and therefore may be associated with Wolf-hirschhorn syndrome. Accordingly, utilities of GAM8678 include diagnosis, prevention and treatment of Wolf-hirschhorn syndrome, and of other diseases and clinical conditions associated with WHSC1.

The function of WHSC1 and its association with various diseases and clinical conditions, has been established by previous studies, as described hereinabove with reference to GAM30.1. WSB2 (Accession NP_061109.1) is another GAM8678 target gene, herein designated TARGET GENE. WSB2 BINDING SITE is a target binding site found in the 3' untranslated region of mRNA encoded by WSB2, corresponding to a target binding site such as BINDING SITE I, BINDING SITE II or BINDING SITE III of FIG. 8. Table 4 illustrates the complementarity of the nucleotide sequences of WSB2 BINDING SITE, designated SEQ ID:7154, to the nucleotide sequence of GAM8678 RNA, herein designated GAM RNA, also designated SEQ ID:347.

Another function of GAM8678 is therefore inhibition of WSB2 (Accession NP_061109.1). Accordingly, utilities of GAM8678 include diagnosis, prevention and treatment of diseases and clinical conditions associated with WSB2.

ZFP106 (Accession NP_071918.1) is another GAM8678 target gene, herein designated TARGET GENE. ZFP106 BINDING SITE is a target binding site found in the 3' untranslated region of mRNA encoded by ZFP106, corresponding to a target binding site such as BINDING SITE I, BINDING SITE II or BINDING SITE III of FIG. 8. Table 4 illustrates the complementarity of the nucleotide sequences of ZFP106 BINDING SITE, designated SEQ ID:19973, to the nucleotide sequence of GAM8678 RNA, herein designated GAM RNA, also designated SEQ ID:347.

Another function of GAM8678 is therefore inhibition of ZFP106 (Accession NP_071918.1). Accordingly, utilities of GAM8678 include diagnosis, prevention and treatment of diseases and clinical conditions associated with ZFP106.

Zinc finger protein 211 (ZNF211, Accession NP_006376.1) is another GAM8678 target gene, herein designated TARGET GENE. ZNF211 BINDING SITE is a target binding site found in the 5' untranslated region of multiple transcripts of mRNA encoded by ZNF211, corresponding to a target binding site such as BINDING SITE I, BINDING SITE II or BINDING SITE III of FIG. 8. Table 4 illustrates the complementarity of the nucleotide sequences of ZNF211 BINDING SITE, designated SEQ ID:19228, to the nucleotide sequence of GAM8678 RNA, herein designated GAM RNA, also designated SEQ ID:347.

Another function of GAM8678 is therefore inhibition of Zinc finger protein 211 (ZNF211, Accession NP_006376.1). Accordingly, utilities of GAM8678 include diagnosis, prevention and treatment of diseases and clinical conditions associated with ZNF211.

Zinc finger protein 211 (ZNF211, Accession XP_290823.1) is another GAM8678 target gene, herein designated TARGET GENE. ZNF211 BINDING SITE is a target binding site found in the 5' untranslated region of multiple transcripts of mRNA encoded by ZNF211, corresponding to a target binding site such as BINDING SITE I, BINDING SITE II or BINDING SITE III of FIG. 8. Table 4 illustrates the complementarity of the nucleotide sequences of ZNF211 BINDING SITE, designated SEQ ID:19228, to the nucleotide sequence of GAM8678 RNA, herein designated GAM RNA, also designated SEQ ID:347.

Another function of GAM8678 is therefore inhibition of Zinc finger protein 211 (ZNF211, Accession XP_290823.1). Accordingly, utilities of GAM8678 include diagnosis, prevention and treatment of diseases and clinical conditions associated with ZNF211.

Zinc finger protein 79 (pt7) (ZNF79, Accession NP_009066.1) is another GAM8678 target gene, herein designated TARGET GENE. ZNF79 BINDING SITE is a target binding site found in the 5' untranslated region of mRNA encoded by ZNF79, corresponding to a target binding site such as BINDING SITE I, BINDING SITE II or BINDING SITE III of FIG. 8. Table 4 illustrates the complementarity of the nucleotide sequences of ZNF79 BINDING SITE, designated SEQ ID:9053, to the nucleotide sequence of GAM8678 RNA, herein designated GAM RNA, also designated SEQ ID:347.

Another function of GAM8678 is therefore inhibition of Zinc finger protein 79 (pt7) (ZNF79, Accession NP_009066.1). Accordingly, utilities of GAM8678 include diagnosis, prevention and treatment of diseases and clinical conditions associated with ZNF79.

Zinc finger protein 84 (hpf2) (ZNF84, Accession NP_003419.1) is another GAM8678 target gene, herein designated TARGET GENE. ZNF84 BINDING SITE is a target binding site found in the 5' untranslated region of mRNA encoded by ZNF84, corresponding to a target binding site such as BINDING SITE I, BINDING SITE II or BINDING SITE III of FIG. 8. Table 4 illustrates the complementarity of the nucleotide sequences of ZNF84 BINDING SITE, designated SEQ ID:852, to the nucleotide sequence of GAM8678 RNA, herein designated GAM RNA, also designated SEQ ID:347.

Another function of GAM8678 is therefore inhibition of Zinc finger protein 84 (hpf2) (ZNF84, Accession NP_003419.1). Accordingly, utilities of GAM8678 include diagnosis, prevention and treatment of diseases and clinical conditions associated with ZNF84.

Zw10 homolog, centromere/kinetochore protein (drosophila) (ZW10, Accession NP_004715.1) is another GAM8678 target gene, herein designated TARGET GENE. ZW10 BINDING SITE is a target binding site found in the 3' untranslated region of mRNA encoded by ZW10, corresponding to a target binding site such as BINDING SITE I, BINDING SITE II or BINDING SITE III of FIG. 8. Table 4 illustrates the complementarity of the nucleotide sequences of ZW10 BINDING SITE, designated SEQ ID:10937, to the nucleotide sequence of GAM8678 RNA, herein designated GAM RNA, also designated SEQ ID:347.

Another function of GAM8678 is therefore inhibition of Zw10 homolog, centromere/kinetochore protein (drosophila) (ZW10, Accession NP_004715.1). Accordingly, utilities of GAM8678 include diagnosis, prevention and treatment of diseases and clinical conditions associated with ZW10.

It is appreciated by persons skilled in the art that the present invention is not limited by what has been particularly shown and described hereinabove. Rather the scope of the present invention includes both combinations and subcombinations of the various features described hereinabove as well as variations and modifications which would occur to persons skilled in the art upon reading the specifications and which are not in the prior art.

DETAILED DESCRIPTION OF LARGE TABLES

Table 1 comprises data relating to the source and location of novel GAM genes of the present invention, and contains the following fields:GENE NAME: Rosetta Genomics Ltd. gene nomenclature (see below); GAM SEQ-ID:GAM Seq-ID, as in the Sequence Listing; PRECUR SEQ-ID: GAM precursor Seq-ID, as in the Sequence Listing; ORGANISM: Abbreviated (hsa =Homo sapiens); CHR: Chromosome encoding the GAM gene; CHROMOSOME OFFSET: Offset of GAM precursor sequence on chromosome; SOURCE_REF-ID: Accession number of source sequence; SOURCE_OFFSET: Offset of GAM precursor sequence on source sequence; SRC: Source-type of GAM precursor sequence (see below); GAM ACC:GAM Prediction Accuracy Group (see below);

Table 2 comprises data relating to GAM precursors of novel GAM genes of the present invention, and contains the following fields:GENE NAME: Rosetta Genomics Ltd. gene nomenclature (see below); PRECUR SEQ-ID: GAM precursor Seq-ID, as in the Sequence Listing; PRECURSOR SEQUENCE: GAM precursor nucleotide sequence (5' to 3'); FOLDED-PRECURSOR: Schematic representation of the GAM folded precursor, beginning 5' end (beginning of upper row) to 3' end (beginning of lower row), where the hairpin loop is positioned at the right part of the draw; SRC: Source-type of GAM precursor sequence (see below); GAM ACC: GAM Prediction Accuracy Group (see below);

Table 3 comprises data relating to GAM genes of the present invention, and contains the following fields: GENE NAME: Rosetta Genomics Ltd. gene nomenclature (see below); GAM SEQ-ID: GAM Seq-ID, as in the Sequence Listing; GENE_SEQUENCE: Sequence (5' to 3') of the mature, 'diced' GAM gene; PRECUR SEQ-ID : GAM precursor Seq-ID, as in the Sequence Listing; SOURCE_REF-ID: Accession number of the source sequence; SRC Source-type of GAM precursor sequence (see below); GAM ACC: GAM Prediction Accuracy Group (see below);

Table 4 comprises data relating to target-genes and binding sites of GAM genes of the present invention, and contains the following fields: GENE NAME: Rosetta Genomics Ltd. gene nomenclature (see below); GAM SEQ-ID: GAM Seq-ID, as in the Sequence Listing; TARGET: GAM target protein name; #BS: Number of unique binding sites of GAM onto Target; TARGET SEQ-ID: Target binding site Seq-ID, as in the Sequence Listing; TARGET REF-ID: Target accession number (GenBank); UTR: Untranslated region of binding site/s (3" or 5"); UTR OFFSET: Offset of GAM binding site relative to UTR; TAR-BINDING-SITE-SEQ: Nucleotide sequence (5' to 3') of the target binding site; BINDING-SITE-DRAW: Schematic representation of the binding site, upper row present 5' to 3' sequence of the GAM, lower row present 3' to 5' sequence of the target; SRC: Source-type of GAM precursor sequence (see below); GAM ACC: GAM Prediction Accuracy Group (see below) ;BS ACC: Binding-Site Accuracy Group (see below);TAR ACC: Target Accuracy Group (see below);

Table 5 comprises data of gene function references-Bibliography and contains the following fields: GENE NAME: Rosetta Genomics Ltd. gene nomenclature (see below); TARGET: GAM target protein name; REFERENCES: list of references relating to the target gene; SRC: Source-type of GAM precursor sequence (see below); GAM ACC: GAM Prediction Accuracy Group (see below); TAR ACC: Target Accuracy Group (see below); and The following conventions and abbreviations are used in the tables:

GENE NAME is a RosettaGenomics Ltd. gene nomenclature. All GAMs are designated by GAMx where x is the unique SEQ-ID.

SRC is a field indicating the type of source in which novel genes were detected, as one of the following options: (1) TIGR Intergenic, (3) EST or Unigene Intron Intergenic, (4) TIGR Intron, (6) DNA Intergenic, (7) DNA Intron, (8) DNA Exon. Sequences are based on NCBI Build33 of the human genome. TIGR source is based on "Tentative Human Consensus" (THC) The Institute for Genomic Research which are not found in mRNA Intron/Exon according to NCBI GenBank genome annotation.

GAM ACC (GAM Prediction Accuracy Group) of gene prediction system: A-very high accuracy, B-high accuracy,C-moderate accuracy, D-low accuracy, as described hereinbelow with reference to FIG. 21.

BS ACC (Binding-Site Accuracy Group) indicates accuracy of target binding site prediction, a-very high accuracy, b-high accuracy, c-moderate accuracy, as described hereinabove with reference to FIG. 14B.

TAR ACC (Target Accuracy Group) indicates accuracy of total GAM-target binding prediction, considering the number of binding sites a GAM has on the target's UTR; a-very high accuracy, b-high accuracy, c-moderate accuracy, as described hereinabove with reference to FIG. 14B.

SEQUENCE LISTING (20216 sequences)

SEQ ID NO: 1 - DNA, 79 bp, Homo sapiens
gttttgaccacttccacctatgaaaattatctgaacattattcagatttaagagttcatgggagcaggtggtacagaac

SEQ ID NO: 2 - DNA, 112 bp, Homo sapiens
tccagttttatcctgactgattcttttctgttgtcctttgttttctttctcctcttctagatctctaaatgatctttgggggtgggagtgagagaacgacgtcagtcctgga

SEQ ID NO: 3 - DNA, 94 bp, Homo sapiens
tcagccttggtcatctgcgatggagcgctttctcagaactgtaggacatagaactgtgcacaggaacagcttccagagccgaaaaccaggttga

SEQ ID NO: 4 - DNA, 78 bp, Homo sapiens
gtaatggcataagaatactgacttattctcgtttagaaagccctctggcagaatacaagtcatttcaatttccgttac

SEQ ID NO: 5 - DNA, 92 bp, Homo sapiens
actggaaatcactgccatttccaggagatcacctatcctagttttgaggaatagtcattgaggtgggtttccttaatggcatctcttctagt

SEQ ID NO: 6 - DNA, 92 bp, Homo sapiens
ctggaaatgtattccatttcaagaaagtacgactatcagcagccacaaaaccaagctgacagtgtgcaactctcattggaatgaaacctcag

SEQ ID NO: 7 - DNA, 108 bp, Homo sapiens
tttgtgaagatgattgggaaatcaaataagtaaaaacgctgggtcaaaactttaaaaattttggctactttaaggtttttctttgcctttttcagtctgctttacaag

SEQ ID NO: 8 - DNA, 86 bp, Homo sapiens
tctcttacacaggctgaccgatttctcctggtgttcagagtctgtttttgtctagcaccatttgaaatcggttatgatgtaggggg

SEQ ID NO: 9 - DNA, 72 bp, Homo sapiens
gaagttccaggctgtagtgcactatgatgatcgtacgtatgaacagccattgcactccagcctgggcaattc

SEQ ID NO: 10 - DNA, 82 bp, Homo sapiens
ggtgcacgcatgtaatcccagctactcaggaggctgaggcaggggaatcgcctgaacctgggaggcggaggttgcggtgacc

SEQ ID NO: 11 - DNA, 79 bp, Homo sapiens
gtgagatgtgttccaggaagtcgtcttgagcacccattgctcagagtttatattggacttgctttctagcacataccac

SEQ ID NO: 12 - DNA, 92 bp, Homo sapiens
aattcctgccagaatgcgcacagaacataagtcagccaagtgtgtcgtgccagggatactttgactttggtttgctgctgctgctagggatt

SEQ ID NO: 13 - DNA, 90 bp, Homo sapiens
ggctaaatttattttcttgtgtctgcctagcaagataatttctctattctttgacagtattgtctcaggcacctgaatcagacctaagcc

SEQ ID NO: 14 - DNA, 65 bp, Homo sapiens
tgtgcattttcagcaacttgccaagtataattttcctgataaaggctgggctgctgatatgtata

SEQ ID NO: 15 - DNA, 81 bp, Homo sapiens
gtgccatcagtcaggtaccacttaaaggatgtacaggcgacttctagatatctgttgagagcctggtaaggggtgaaacac

SEQ ID NO: 16 - DNA, 64 bp, Homo sapiens
tcccgtggaggctcgcgccgacggcggcggggacgagactgccgagcggacggaggctccggga

SEQ ID NO: 17 - DNA, 65 bp, Homo sapiens
caggtgttccgggccccttcacctggggctcaagtgagagcaggtgttctgggccccttcacctg

SEQ ID NO: 18 - DNA, 78 bp, Homo sapiens
gggaaatttgcctttaccactgaagattatgacatgtttgaagtgtgttttgagagcaagggaacagggcggatacct

SEQ ID NO: 19 - DNA, 110 bp, Homo sapiens
ctctttgagatgactggtattgaatggagcagtctttgaaaggcaccaacccttcctaactgatggtggtctcttgaaagaggctcttccaaatttgtcttctgaaagtg

SEQ ID NO: 20 - DNA, 60 bp, Homo sapiens
gccatcacgccacagtttcccggaggggccatccacagtcttctgggtggcagtgatggc

SEQ ID NO: 21 - DNA, 65 bp, Homo sapiens
ggaagccatgaagcagtcttcttgccgtgaatggggtaaatatggactgcgcattcatgggttcc

SEQ ID NO: 22 - DNA, 76 bp, Homo sapiens
cagtgggaaggggggccgatacactgtacgagagtgagtagcaggtctcacagtgaaccggtctctttccctactg

SEQ ID NO: 23 - DNA, 73 bp, Homo sapiens
gcttcattcatggctgtgtttgagataactaaagtaaattttttttcaggtatttggtgtcatgttttggagt

SEQ ID NO: 24 - DNA, 92 bp, Homo sapiens
ggaggatcgcttgagcccaggaggcggaggttgcagtgagctgagatggcaccacttattgcactccagcccgggcgacagagcgagactcc

SEQ ID NO: 25 - DNA, 63 bp, Homo sapiens
acaagtcttgggaagtccatctgactctctgaaacagtttgtctctgacctcccaggaagtgt

SEQ ID NO: 26 - DNA, 80 bp, Homo sapiens
gggtcaagctgaaaaggcaaggtttcttcaactggcttgagagctatgaggtaggctgtttccttctttcgctttgtccc

SEQ ID NO: 27 - DNA, 92 bp, Homo sapiens
gtatgcacagacagagttgggacatgggacatatcttcagggcctggagactgaagccacctatgacgcagccacccaggagtttgtgatac

SEQ ID NO: 28 - DNA, 110 bp, Homo sapiens
tgaaccagcttctcagctctactgtgtttgaccctgtgttcaaggttaggggaattatagtttcccaggtctccatcgtgggggtaatcagaggggcagagaaggcttca

SEQ ID NO: 29 - DNA, 93 bp, Homo sapiens
gcatgtgctcctgcggcgtgggggtttgtagacttggaaaaccctgttggcagaaagttaagagctcccaggcctgaaggcaggacacagtgc

SEQ ID NO: 30 - DNA, 73 bp, Homo sapiens
cgacctcgggtccacgtgtcccggtactcgccggccggagcctccggcttcccggggccgggggaccttagcg

SEQ ID NO: 31 - DNA, 99 bp, Homo sapiens
attgtgatttccttcgttggagctgtgagcagcagcacattggccctaatcctgccacctttggttgaaattcttacattttcgaaggaacattataat

SEQ ID NO: 32 - DNA, 82 bp, Homo sapiens
ggacgaggagatgaaccgcatgcatgagagcatgaagctattcgatagcatctgcaacaacaagtggttcacagacacgtcc

SEQ ID NO: 33 - DNA, 77 bp, Homo sapiens
tctgctgcttcaacaacagtgacttgctctccaatggtatccagtgattcgttgaagaggaggtgctctgtagcaga

SEQ ID NO: 34 - DNA, 82 bp, Homo sapiens
ggtccacattcactttcccgtggaaggttcaggaagcgacaccgttgttatcaggggcccttcctcggatgtggagaaggcc

SEQ ID NO: 35 - DNA, 74 bp, Homo sapiens
gttgttattggtgcaggagtaataggtgtagaactgggttcagtttggcaaagacttggtgcagatgtgacagc

SEQ ID NO: 36 - DNA, 88 bp, Homo sapiens
ggagaatggcatgaacccgggaggtggagcttgcagtgagcagagatcacgccactgcactccagcctgggcaacagagcgagactcc

SEQ ID NO: 37 - DNA, 86 bp, Homo sapiens
ggatgggcttgtggttagcagtttttgccaggatcataggctgcttcacttagagtagtggcaaagatgctgacctacattcttcc

SEQ ID NO: 38 - DNA, 84 bp, Homo sapiens
gcttgtaactttccaaagaattctccttttgggctttctggttttattttaagcccaaaggtgaattttttgggaagtttgagc

SEQ ID NO: 39 - DNA, 90 bp, Homo sapiens
tgtcccgttcatcaatttctcctctgcagggtgagctgtggtgcccgcagccaaactgggttccagttaggggcagtagagttggggaca

SEQ ID NO: 40 - DNA, 90 bp, Homo sapiens
cacatattcatacaaatgacttagtaatctaatatgagaagtggtccttcacttatattaggaacttggtaaatatttgttgaatgaatg

SEQ ID NO: 41 - DNA, 72 bp, Homo sapiens
tttgggtggatgctgctctcgaataagtcggacatcttctactctttgttcgaaggtgcggcgctgcttgaa

SEQ ID NO: 42 - DNA, 88 bp, Homo sapiens
ggagtctccctctgtcgcccaggctggagtgcagtggtgtgatctcggttcactgcaacctctgcctcccgggttccagtgattctcc

SEQ ID NO: 43 - DNA, 76 bp, Homo sapiens
gaggctgtcttcacgctgacccagacctggggggtgtttgtgtccttacaggatgttcagtttgcaaggaggcttt

SEQ ID NO: 44 - DNA, 64 bp, Homo sapiens
gtccatattacccttcagcacctgagtcccaagctgaggtctcaacatgggtgatgtgaaggac

SEQ ID NO: 45 - DNA, 98 bp, Homo sapiens
gcccaggcttggagttgcgggtggcgttgaccttcagtttcacgtgcaaagcctccggccttcacagggttcaccgccatttcttccgtgcctcgggc

SEQ ID NO: 46 - DNA, 102 bp, Homo sapiens
tgaggtgggagaattgcttgaacccaggaggcagaggttgcagtgagctgagattgcaccactgcactccagcctgggtaacagagtgagactcttgtctca

SEQ ID NO: 47 - DNA, 68 bp, Homo sapiens
taggggagggaagagaactaagatgatactaacaaatgctatcactggttttgtggctgcctccctta

SEQ ID NO: 48 - DNA, 84 bp, Homo sapiens
aactggtcggtgatttaggtagtttcctgttgttgggatccacctttctctcgacagcacgacactgccttcattacttcagtt

SEQ ID NO: 49 - DNA, 61 bp, Homo sapiens
tgtggggtgcccccgatgggaggctgtcccatctcccagtccccatctctttttccccaca

SEQ ID NO: 50 - DNA, 71 bp, Homo sapiens
ttcaaaaccagaagcagtcgagacataggacaacctagcagttggccttataagtggctctttgttttgaa

SEQ ID NO: 51 - DNA, 64 bp, Homo sapiens
agggtctttccaactgttctggtcagtgaggaccctgactgcaaggaggagttctggagaccct

SEQ ID NO: 52 - DNA, 79 bp, Homo sapiens
aaagtcttgtgatttcctctcatcttttagagattcctgccaaaaattctaccaagcagagatggaggagctcgacttt

SEQ ID NO: 53 - DNA, 78 bp, Homo sapiens
caatgtgcaactgacatctgctagtgatgatctggtaatatacaacctgtccagtagccgaacagtttgtttttattg

SEQ ID NO: 54 - DNA, 88 bp, Homo sapiens
gccaaggaaacaggatgctgatagtctccagcagggcctggacatgtgggctggtgtgtggaactgctgcaactttcttcctggtggc

SEQ ID NO: 55 - DNA, 62 bp, Homo sapiens
ggctagtgtaatactccacagagaagtagacaccccaaactggagagcatgttgcatttgcc

SEQ ID NO: 56 - DNA, 80 bp, Homo sapiens
gtgtaatgtggttctagtgtcgctgcgtgttcatcctctcgagcttgtctgtcacgtaggtcacactagactctgggcac

SEQ ID NO: 57 - DNA, 61 bp, Homo sapiens
tagcattgggtgccaatttcgtggtgtggaatggtgacaacatgcgtggagccaagtgcta

SEQ ID NO: 58 - DNA, 67 bp, Homo sapiens
gacgaaccttggccgcagtccttgcgaactgttcgcaaaacagtgcgggctgcggtgggtcagcgtc

SEQ ID NO: 59 - DNA, 89 bp, Homo sapiens
cctgggcctgcccactcccacgcccttcaccaatgccgtccagctgctgctgacgctgaagctggtgagcctggccagtgaagtccagg

SEQ ID NO: 60 - DNA, 72 bp, Homo sapiens
cagtgtcccattgtcatctactcagtctctaatagggctaaggagcatgatagtatctatttataagcactg

SEQ ID NO: 61 - DNA, 73 bp, Homo sapiens
cagcttctccttccgggacagctccacctgttcctcgtccatggtggtgtcgatgggccggaagtaggacatg

SEQ ID NO: 62 - DNA, 74 bp, Homo sapiens
agttttgcacctgagacagatagcctcactcgcctcaccctagtcctggtggcatttgtctcaggtgcaaaatt

SEQ ID NO: 63 - DNA, 79 bp, Homo sapiens
ctggcagcgcttcaagtcatggtccccatcatgcaggatctcaggctccacgatgggcacaatgccattctgctggcag

SEQ ID NO: 64 - DNA, 74 bp, Homo sapiens
cacatgtgattgcattaccttatgtgtattagagactgacttaagctgcaacaaggtgataaaggtgatatgtg

SEQ ID NO: 65 - DNA, 80 bp, Homo sapiens
gtcagagtcttctcatctgtgccagcacccttcatggatttgtaaagtttgttcggcaagaagagagggctgttcttgac

SEQ ID NO: 66 - DNA, 92 bp, Homo sapiens
tgtttgtgccgtctttggtctgggaggagtcggattggcagttatcatgggctgtaaagtggctggtgcttcccggatcattggtgtggaca

SEQ ID NO: 67 - DNA, 98 bp, Homo sapiens
gcggaggtgggggtctggcttcagggtctcagtccttccctttagaatatctgagaggggaaggtcaggaaggtccaagcgttgagtcacccctctgc

SEQ ID NO: 68 - DNA, 117 bp, Homo sapiens
ggtatttcccaagtctctgggtggttggaaggctgtggctggtctcagttgggttactcaatgcccaggaggggctgagcaccagccatatctttgcttggttcacatgatgatacc

SEQ ID NO: 69 - DNA, 72 bp, Homo sapiens
ggcttggccatggcggctggtgctgataaccatttcttggcagaagtgcccgccaaagctgtggccctagtc

SEQ ID NO: 70 - DNA, 86 bp, Homo sapiens
ttttttctaaatgggaaaagggttaataagggcttatgttcattcttgtattgctctctaaactttgttccttgtcacagaagaaa

SEQ ID NO: 71 - DNA, 86 bp, Homo sapiens
ctgcagcccttgtacctcaaagcgatcccacaatgtccactcttggttatagtactggtgacgtggtgcggcaaggggtacagcag

SEQ ID NO: 72 - DNA, 87 bp, Homo sapiens
gtggggtgaagggtcattaagggcacgcagtagccataatgccacaccctttgtgccagccactgcgcttctggaaacctaccccac

SEQ ID NO: 73 - DNA, 69 bp, Homo sapiens
ctcttcatcagtacaccactgtgagccgactgaaatgataatcacttgaagctatcattggtgggagag

SEQ ID NO: 74 - DNA, 73 bp, Homo sapiens
gttagttcagtacttattagctgcaggagctaacgttcatgcaagaacagcaacaggggatacagcgactaac

SEQ ID NO: 75 - DNA, 66 bp, Homo sapiens
agtgatggtcagtatttctttgaaattctacaaggaacttcaggcacatggtgctgatgagttatt

SEQ ID NO: 76 - DNA, 61 bp, Homo sapiens
gatgtcagtcccaaggaccagtagctgccatcagtttggattctgaaaactaactggcatc

SEQ ID NO: 77 - DNA, 64 bp, Homo sapiens
cacaacactgccatgcaacaccttcagagtcgttggagtcaagttgcaggatcagcaggttgtg

SEQ ID NO: 78 - DNA, 71 bp, Homo sapiens
tttcttcagttccaacaaaaggtctgtcatctgataacaaacctatggttaacttggataagctgaaggaa

SEQ ID NO: 79 - DNA, 91 bp, Homo sapiens
gcactctgtgtccagactttaactaaaggcggatttcccgagactacgggtgtgctgttagaagggttctgggtctgtgcactaaagaggt

SEQ ID NO: 80 - DNA, 61 bp, Homo sapiens
tgcgtgtcctaactggttggaaaaactgtgatcaccacttcaagtgtagggactcctcgca

SEQ ID NO: 81 - DNA, 78 bp, Homo sapiens
tggtggtggcagactttgggctgtcacggctcataatggaagagaggaaaagggcccccatggagaaggccaccccca

SEQ ID NO: 82 - DNA, 83 bp, Homo sapiens
ggcccagggatcggcagggctgctggcagaggaatcccagctggggttcccatgccccaggctcctgcaggacttgctgggcc

SEQ ID NO: 83 - DNA, 68 bp, Homo sapiens
agcttcaaaagcacaactacacactttgcccaaggtctgattctgtgtatctgtgcatctgaggagct

SEQ ID NO: 84 - DNA, 105 bp, Homo sapiens
ttgtggtccatggcgagcccaggcctcagacaatggctgtggtgttgctcagacatgcacacagctctctgtaccttgagccaggtctccaccatggcaccacag

SEQ ID NO: 85 - DNA, 88 bp, Homo sapiens
gtggctcggctcagctgcctgggttgtggccgccctagcatcctgtatgcccacagctactgtaatccccgctgctgctccgggccac

SEQ ID NO: 86 - DNA, 73 bp, Homo sapiens
aaaaagacattggactaaatgctaatatatggaatagaagatttcccaatgttaatttagttaacaacttttt

SEQ ID NO: 87 - DNA, 60 bp, Homo sapiens
caggataataatatggggtcttgtccttcaccttttaagttcaggcaacagtttgtcctg

SEQ ID NO: 88 - DNA, 107 bp, Homo sapiens
actgcaggtcgtataaacgtgataaatgaatgctaccctgctggctctccgagagagtgtaattagtatttatatcaaaatttatgaaacaaattttcggccgcagt

SEQ ID NO: 89 - DNA, 83 bp, Homo sapiens
gctgggcctgttggtcaggcatggaggagctgtgtggtcactggccactggctctcttctgcaccaccgccggctctgacagt

SEQ ID NO: 90 - DNA, 81 bp, Homo sapiens
cctgcccctctgcctgtgctcctggcagtgtggcttcccggtgctcacctgcacagcagttaacagcagaggccgagcggg

SEQ ID NO: 91 - DNA, 131 bp, Homo sapiens
atcaacacaataattgaaatattttcaagctgattacaccgcagcccgaggctagcctggttgctaagggtgagctccgcggttgctagggggagtaaatcatcttgcattatttgatttttgttatagat

SEQ ID NO: 92 - DNA, 84 bp, Homo sapiens
gctcaaacttcccaaaaaattcacctttgggcttaaaataaaaccagaaagcccaaaaggagaattctttggaaagttacaagc

SEQ ID NO: 93 - DNA, 98 bp, Homo sapiens
cctgtagaccaccttattcttttcttatgggtatgtggcatgaatgccatcatttatttacccagctgccagttgaagaacattttggtctttccagg

SEQ ID NO: 94 - DNA, 77 bp, Homo sapiens
cattgactcagcacaccaggtatgtcacagcttgtgcttttgcacctaatacccttttacttgctactgggtcaatg

SEQ ID NO: 95 - DNA, 99 bp, Homo sapiens
actttaagaactcgaatataggtcttttaaattaaccagtcagacaaagtaacaagtaggactgaaacgaacaaggcttgagaatccggttggtaaagt

SEQ ID NO: 96 - DNA, 80 bp, Homo sapiens
taacaacgaggccaggagggatttttacacagacccgagtgagtggggggacaatattttccctcctagttgtgttgttg

SEQ ID NO: 97 - DNA, 83 bp, Homo sapiens
agatgttatgtaaaagtttgaggttgagatgacatatctgacactctgttgttactctcagaagctactacatgtgaaattct

SEQ ID NO: 98 - DNA, 80 bp, Homo sapiens
gactccaccttctccctggaccagcccggtggcaccctggatctgaccctgatccgtgcccgcctccaggagaagttgtc

SEQ ID NO: 99 - DNA, 100 bp, Homo sapiens
ttatttagtaaacattctttgagtctacactatgtacagatgtgctgctatgtagtagcaaagattcaggatgtgccctcaaggaatgtctgtcaagtaa

SEQ ID NO: 100 - DNA, 87 bp, Homo sapiens
ctctaacaaggtgcagagcttagctgattggtgaacagtgattggtttccgctttgttcacagtggctaagttctgcacctgaagag

SEQ ID NO: 101 - DNA, 60 bp, Homo sapiens
tggtgaggaatgtatcatctttttgtctcatattacaaatgggccaatacggacttgcca

SEQ ID NO: 102 - DNA, 72 bp, Homo sapiens
gcttgaacccaggaggtggaggttgcagtgagctgagatcctgccactgcactccagtctgggtgacagagc

SEQ ID NO: 103 - DNA, 84 bp, Homo sapiens
gcctgaccgaggcgaacgcgtggacaaagtgaagctgatcaaggaaatcaagaactacatccaaggcatcaacctcgtccaggc

SEQ ID NO: 104 - DNA, 78 bp, Homo sapiens
ggagcccttgatgtcctgcaaatgaaggaggaggatgtccttaagttccttgcagcaggaacccacttaggtggcacc

SEQ ID NO: 105 - DNA, 86 bp, Homo sapiens
gggcgggggccctcgtcttacccagcagtgtttgggtgcggttgggagtctctaatactgccgggtaatgatggaggcccctgtcc

SEQ ID NO: 106 - DNA, 72 bp, Homo sapiens
ggaacaaggtgttaacaggcctgggaatctagaaaatcccatcagcttcaccattttgttttcattttgtct

SEQ ID NO: 107 - DNA, 114 bp, Homo sapiens
gaccgcctcttccttgtgtctcctctgatcatctcccatgagatcaaccagaagagccctttctgggagatgtctcaggctcagctgcatcaggaagagtttgaagttgtggtc

SEQ ID NO: 108 - DNA, 72 bp, Homo sapiens
ggaggcggggcagacgggctgcaagagggagccggcccgacgcggaccgcttccctgcagtgccccgagtcc

SEQ ID NO: 109 - DNA, 83 bp, Homo sapiens
tctcctccatgtgtcttggcaggcactcatttctgtggctgtcggcagagggaatgttctggagctgccaaggagggaggaga

SEQ ID NO: 110 - DNA, 100 bp, Homo sapiens
gaggcaggagaatcgcttgaacccaggaggcggaggttgtggtgagcgaagatcgtgccattgcactccagcctgggcaacaagagcaaaactctgtctc

SEQ ID NO: 111 - DNA, 93 bp, Homo sapiens
ttgggtcctagtagtaccaaagtgctcatagtgcaggtagttttggcatgactctactgtagtatgggcacttccagtactcttggataacaa

SEQ ID NO: 112 - DNA, 85 bp, Homo sapiens
ggaccagactattgtgacatggagaatgtagaggaattattcaatgttcaggatcaacatgatctcctcactctaggatggatcc

SEQ ID NO: 113 - DNA, 105 bp, Homo sapiens
gcctactgacttaataaatttcagaggcagaagagaagctgcagagctcagtccttgacactgaactttctcactgcttctaagggtggaagaggtcagtttggt

SEQ ID NO: 114 - DNA, 71 bp, Homo sapiens
gcttgctcatgatgtacgcgcagtccaaaggcatctactacgtgcagtggaggatgacatcgtgggcaagc

SEQ ID NO: 115 - DNA, 66 bp, Homo sapiens
ggcagcgagtcctcagggcgcccgggagccaccagtctgctctcgggctctactcagactagcgcc

SEQ ID NO: 116 - DNA, 76 bp, Homo sapiens
gcccactgtgacgatgtcaccgatctggacgtccctgaagcagggggacaggtgtacagacatgttcttgtggcgc

SEQ ID NO: 117 - DNA, 76 bp, Homo sapiens
gaagaagaagaatgggtttggtgagagggttccaatattaacaacccaacttcaagctcattcctctaacctcttc

SEQ ID NO: 118 - DNA, 84 bp, Homo sapiens
ggctgtggctggattcaagtaatccaggataggctgtttccatctgtgaggcctattcttgattacttgtttctggaggcagct

SEQ ID NO: 119 - DNA, 75 bp, Homo sapiens
ggttagagaaactcatcagaagaaagtttcaatcacttcactgttattttctgcaattcttattctcttatagcc

SEQ ID NO: 120 - DNA, 61 bp, Homo sapiens
gctccgcgtgaatggggctggatcttatgccggcgtacaagattaggcctctcaaaagagc

SEQ ID NO: 121 - DNA, 131 bp, Homo sapiens
ccgaggtcgtgccactgcagtccacctggccaacacagcaggcctctctctaaaataataattattattattgttattcttgacaggccagtgtagaacaggtggggcatctgtggtatgacagaactggg

SEQ ID NO: 122 - DNA, 107 bp, Homo sapiens
aagccttgttttttcccagagcaaccatgttttagcataatgggatgacctggtgtcccattataaataaagggtggtatggctagaagggtatgagcagtaggctt

SEQ ID NO: 123 - DNA, 65 bp, Homo sapiens
atctgtaacttaaattgggccaatcagaatggttatctttgttcaggtcacatgagttgcaagat

SEQ ID NO: 124 - DNA, 78 bp, Homo sapiens
tgtccagttcccattttggtcctcataatcaaaacagcttaacatgacagtcatcaccagtaatagtggcattggata

SEQ ID NO: 125 - DNA, 100 bp, Homo sapiens
tgaggcgagagaatcgcttgaactgggaggcagaagttgcagtgagccaagatcgtatcattgcactccagcctgggccacagagcgagactctgtctca

SEQ ID NO: 126 - DNA, 74 bp, Homo sapiens
ggtacagttggtggctatcaaattaggactcagtaattacttgtgtcactgagtgaaagctgctcattgctgcc

SEQ ID NO: 127 - DNA, 73 bp, Homo sapiens
ttttgagacagagtctcactctgttgcccagactggacggcagtggcaacaagagcgaaactccatctcaaaa

SEQ ID NO: 128 - DNA, 80 bp, Homo sapiens
ggtcagacagggggacagggcagagctagcataactcaggcttttggggatgtgcatggcagctgttttcctttggggcc

SEQ ID NO: 129 - DNA, 109 bp, Homo sapiens
ctgtgcacctcgtggtaaaactctttggggttcgccagctgtagctcatatttcatgttggggtcatgccgaacacccatgaagttgtagttccacgaggactgggcag

SEQ ID NO: 130 - DNA, 109 bp, Homo sapiens
ctgcggagcccgcgtcgcagcagcccggacaggaagattggtctggatgtgggtccggtcttacagtcgcgggccaggatgagggcaggttgcgacagcgcgcacccgg

SEQ ID NO: 131 - DNA, 68 bp, Homo sapiens
ccttcccttccacagagtttagtttcctcatttgtaaaatgaagacaaacctcgtgagagagggaagg

SEQ ID NO: 132 - DNA, 80 bp, Homo sapiens
tctggtgtggagacttcgtggtggtgctaagaaaaggaagaagaagtcttacaccactcccaagaagaataagcacaaga

SEQ ID NO: 133 - DNA, 73 bp, Homo sapiens
cttcctgggccattgtggctggaggtgctggtgctggtcaccatcatcttcatctacgagaagcgccgggaag

SEQ ID NO: 134 - DNA, 75 bp, Homo sapiens
gccgtctcccctgctcccggtgctctgcgagatctcccctgaccagatctccacagcccggacccgggggctggc

SEQ ID NO: 135 - DNA, 109 bp, Homo sapiens
ccttcaaaaagtttgtagcctatcggggtggagagataagccaagtatccagataaccatggcataaggcagaatattttctgtactatgagaggtacaaaggggaggg

SEQ ID NO: 136 - DNA, 87 bp, Homo sapiens
tctgcaatggctgccaggcggatcactcctccactggagccatcccgctccatggccaaagcgagagcattggcagtgaattgcaga

SEQ ID NO: 137 - DNA, 79 bp, Homo sapiens
tcggagaccccaccaagtttgccacatttgttttcaacgtctttgatgaaaacaaggacgggcgaattgagttctccga

SEQ ID NO: 138 - DNA, 66 bp, Homo sapiens
tggctgtggtgtctgggtgtggcctggggctccctctgcaggggcccccctcggcagccacagcca

SEQ ID NO: 139 - DNA, 99 bp, Homo sapiens
gctggatattgctaagaattcaggtagtctcgggatctccagagtctccatactaggacaggagatcttcagaacctggaggaatggaaatagtctagt

SEQ ID NO: 140 - DNA, 61 bp, Homo sapiens
tttctgtcaagaagcagtttgaagaattaacccttggtgaatttttgaaactggacagaga

SEQ ID NO: 141 - DNA, 85 bp, Homo sapiens
gggttatctgcaactgagaggggctggttaaggcgtccccaagttggaagggcgctttgcttctgttttctggatgcagagtcct

SEQ ID NO: 142 - DNA, 82 bp, Homo sapiens
gtttgagttcaaagatggagcgagggtggatatggtgggaaggggcacacgggttctcacgcaacaacggaggaaggcaggc

SEQ ID NO: 143 - DNA, 78 bp, Homo sapiens
gtgatccacacgctggcccaggagttcgacatttaccgcgaggtgggcggagagcctgtgcctgtgacgagggatgat

SEQ ID NO: 144 - DNA, 66 bp, Homo sapiens
cggctgcccaggccctgccttggcatgtgtgtctccagagcgtgcccggccaggccatcccagccg

SEQ ID NO: 145 - DNA, 76 bp, Homo sapiens
ggcttcctcaccaccttgtgcactgctgctcccacaccacagtgactagcagcacataatggtttgaattaaagct

SEQ ID NO: 146 - DNA, 68 bp, Homo sapiens
ttaggataacattgctgtcggaggtcacgcaagctaacggcaagtgtgtctatcagtagtggtcctgg

SEQ ID NO: 147 - DNA, 60 bp, Homo sapiens
tgggttcctggcatgctgatttgtgacttaagattaaaatcacattgccagggattacca

SEQ ID NO: 148 - DNA, 76 bp, Homo sapiens
tgtacggcagttcagtagttatcaaatcagttggtctcaggacccctgtgtactcataattattgagacccaaaca

SEQ ID NO: 149 - DNA, 60 bp, Homo sapiens
gaagtggtaaagcctggggcttcagtgaagttgtcctgcaaggcttctggctacatcttc

SEQ ID NO: 150 - DNA, 80 bp, Homo sapiens
atgtggtcagtgggttgcatcttcggggagctgctgactcagaagcctctgttccccgggaagtcagaaatcgatcagat

SEQ ID NO: 151 - DNA, 71 bp, Homo sapiens
ggctaagtgccagctcctctttgccctcaaggtgctcaagcatgatgcccgaggagaagctggttgaggcc

SEQ ID NO: 152 - DNA, 91 bp, Homo sapiens
ttgtggatattgaagtttgaagcctgttgttcatctatagatgcactggatgggattggaagtcttcagatttcagtagggttttccacaa

SEQ ID NO: 153 - DNA, 131 bp, Homo sapiens
cttttgagctgcttcttataatgtgtctcttgtgttaaggtgcatctagtgcagttagtgaagcagcttagaatctactgccctaaatgccccttctggcacaggctgcctaatatacagcattttaaaag

SEQ ID NO: 154 - DNA, 87 bp, Homo sapiens
aggcaacatgctgttgttaagggcacttgggccattggtgttttgtgacagctgggctcaggcatctcaacaagcagcggtgtgcct

SEQ ID NO: 155 - DNA, 85 bp, Homo sapiens
gtgagaaagcactggggtccagatggggagaagatgttctgccataagaaaatctcctggtctggtccgtgccttggcttagcac

SEQ ID NO: 156 - DNA, 100 bp, Homo sapiens
gaggcaggagaattgcttgaacccaggaagtggaggcttcagtgagctgagaacacgccactgcactccagtcctgggcaacagagcaagactctgtctc

SEQ ID NO: 157 - DNA, 79 bp, Homo sapiens
gcttgggtgacagagtgaaagccccatctctaaataaataaataaagagaggtcctgattcagtttatcaatcccatgt

SEQ ID NO: 158 - DNA, 78 bp, Homo sapiens
cagagtatatgggggcctctgccaccccccaggctgggactggggcctgtgaccttgagaacctcatctcacattctg

SEQ ID NO: 159 - DNA, 77 bp, Homo sapiens
gagaagggaggctgcagtgagccaagatcgtgccattgcattcaaggcctgggtgacaagaagcagaattccatctc

SEQ ID NO: 160 - DNA, 64 bp, Homo sapiens
attcagcggcagtggtgctttcccgaatctcagaatgcctgttaaaagatcactgaagttggat

SEQ ID NO: 161 - DNA, 85 bp, Homo sapiens
gagatggtgccttggacacccttgcctggaactcgttagcaactgcgagcagaagctttccagtcacacatcaaggcgcttgatc

SEQ ID NO: 162 - DNA, 110 bp, Homo sapiens
gttgcctttgctccagatctaggtgagatcagatggaatggaggctccatctggtcttcaggaagtctcaagttttcactgatctacataaaatctcagagcaaggcaat

SEQ ID NO: 163 - DNA, 72 bp, Homo sapiens
gcagttgtcaaataccaggagggcatcagccgcaaactcctctgagctggtgtacctggacagggcaggggc

SEQ ID NO: 164 - DNA, 98 bp, Homo sapiens
gaggtgggaggattgcttgttccccggaggttgaagctacagtgagccttgattgtgtcactgcactccagcctgggcaacaggtaagactctgtctc

SEQ ID NO: 165 - DNA, 76 bp, Homo sapiens
gagggtactgtagaatctttattatctcaacaatctaaaaaatgatgtttatttccttagttagatagtgccactt

SEQ ID NO: 166 - DNA, 89 bp, Homo sapiens
agggttttaaacactaatcacaaactggaatgacttgacttcaaaaggcaacaaccttaaagggccgtcatttccattaggtattccct

SEQ ID NO: 167 - DNA, 63 bp, Homo sapiens
ggagtggagggggctgcccaccctcgctgtacacagctgggcccagatggccccttctgatcc

SEQ ID NO: 168 - DNA, 71 bp, Homo sapiens
gacgaatccttagtactgtggaaaagagcagacagaaatataaaccagcttctctcacagtggaattcgtc

SEQ ID NO: 169 - DNA, 131 bp, Homo sapiens
gctagtcactggggcaaagatgactaaaacacttttcctgccctcgaggagctcacagtctagtatgtctcatcccctactagactgaagctccttgaggacagggatggtcatactcacctcggtgttgc

SEQ ID NO: 170 - DNA, 97 bp, Homo sapiens
cgagtgtgcctcggcaggagggcttgactttcttcggcacagagctagccccagtgcggtcaacaggagtcgggcctctctgctaagaacatacttg

SEQ ID NO: 171 - DNA, 87 bp, Homo sapiens
gtccttgaacttggaacctgacaatgttggtgttgtcgtgtttggaaatgataaactaattaaggaaggagatatagtgaagaggac

SEQ ID NO: 172 - DNA, 79 bp, Homo sapiens
aaaggatgaaaaggtggtgtcatgttttggggagaatcttacttctcaaatggaaattgcactttttgctgaatccttt

SEQ ID NO: 173 - DNA, 99 bp, Homo sapiens
tggggccttggtaatataggaaaccttcttgccaatataggaatatgttgacatattagctatagcaaaaggcttatattagcaccgaatgaggctctg

SEQ ID NO: 174 - DNA, 82 bp, Homo sapiens
tgtggtacttcaggaactctttttcaaactcacatcacagtacatctggagattgtctaagaggcagcctcctgacaccaca

SEQ ID NO: 175 - DNA, 65 bp, Homo sapiens
gagatgggtttcaccatgttggtcaggctggtctcgaactcctgacctcatgatccgcccacctc

SEQ ID NO: 176 - DNA, 65 bp, Homo sapiens
gtcttgctaggccaggtcttccaggtggttaccggggtcacatggatttctgggcggagcgagat

SEQ ID NO: 177 - DNA, 78 bp, Homo sapiens
gtcctttctctggagaggcttgtggggcctcaggacgctacccactgctctccgggcctctcctgccgcctctgggac

SEQ ID NO: 178 - DNA, 77 bp, Homo sapiens
tcttaagtcacatggcttctgtcttggaaattttacctttaaaagattatttaagacaggaaccaggaggcttggga

SEQ ID NO: 179 - DNA, 75 bp, Homo sapiens
ctggccagggtggtggctaacgcctgtaatcccagcactttgggaggccgaggcgggtggatcaactgtggtcag

SEQ ID NO: 180 - DNA, 90 bp, Homo sapiens
gtaccaccttgtcgggtagcttatcagactgatgttgactgttgaatctcatggcaacaccagtcgatgggctgtctgacattttggtat

SEQ ID NO: 181 - DNA, 73 bp, Homo sapiens
cagggaggctgcatggggccagcgctaggtggctgactcagcagcagccatggggctggaagaagcttccctg

SEQ ID NO: 182 - DNA, 75 bp, Homo sapiens
cccagggcatgaagatcacaatgggcctggttcagatttttctccagggccgtggcagctttcatggcatctggg

SEQ ID NO: 183 - DNA, 118 bp, Homo sapiens
ccatttttttgtaggtcagaagtggttgcaaactggatttttagactcttcctgttgggggtctcggacatttgctcttttccacagcggccaattcttcagagccacaaagaactgg

SEQ ID NO: 184 - DNA, 82 bp, Homo sapiens
atgcgtgacgccatcccgcagctcatccagctggaccaggcgaagcccctggccgctgtgctgaaggaggtgtgcgacgcgt

SEQ ID NO: 185 - DNA, 78 bp, Homo sapiens
gcaattcaactttgagttatcttttaaatatgtcttgtatagttcatattcatggctgaaacttgaccacactattgc

SEQ ID NO: 186 - DNA, 93 bp, Homo sapiens
gacaagaaatgccccttcactggtaatgtgtccattcgagggcggatcctctctggcgtggtgaccaagatgaagatgcagaggaccattgtc

SEQ ID NO: 187 - DNA, 71 bp, Homo sapiens
tgcatcttcatcttggtcaccacgccagagaggatccgccctcgaatggacacattaccagtgaaggggca

SEQ ID NO: 188 - DNA, 60 bp, Homo sapiens
gaaaaggtggtgtcatgttttggggagaatcttacttctcaaatggaaattgcacttttt

SEQ ID NO: 189 - DNA, 80 bp, Homo sapiens
cccaagcccttgacctccttttccttatctgaaatgttgctgtgattcctgtggtgagatcagatgaggcagcacttggg

SEQ ID NO: 190 - DNA, 74 bp, Homo sapiens
gtagtctccactggagaagttaattgatgagtagtagcctacaactcaggctctagcttctccaggaacactac

SEQ ID NO: 191 - DNA, 70 bp, Homo sapiens
ggctctcggccttggcaacggccgtcgtcatggttactggcccctaggcgccgatggccgaggccgcgcc

SEQ ID NO: 192 - DNA, 65 bp, Homo sapiens
ccaccattaagcagttcatggacatcttctcgctaccggagatgctctgctgtcctgtgtggtgg

SEQ ID NO: 193 - DNA, 104 bp, Homo sapiens
gggtcggcaggaagttgcggctgatgagcagctcccggagcggtggggcggggcctcctcttctccagttccagtacgctcatcagtcgtcctcctgctgattt

SEQ ID NO: 194 - DNA, 98 bp, Homo sapiens
cctcggccgactttcccaggcagtgcaggctagcccagtccaggagtgtgcagcctggcttgggtcgagctctgtcacatctggataagcaactgggg

SEQ ID NO: 195 - DNA, 92 bp, Homo sapiens
cagtaaacataagttcctcaggagagtttgatgtgtgtcaggtgcttagaacagggcctgatatataatcagcccatgatgagctattactg

SEQ ID NO: 196 - DNA, 87 bp, Homo sapiens
gtccttgaacttggaacctgacaatgttggtgttgtcgtgtttgggaatgataaactaattaaggaaggagatatagtgaagaggac

SEQ ID NO: 197 - DNA, 66 bp, Homo sapiens
ggcgctatatatggatccaatggcaagatcatcatgacagatctgcgcgcgatcgatatcagcgct

SEQ ID NO: 198 - DNA, 71 bp, Homo sapiens
tcgaactcctgacctcgtgatctgcccgccttggcctcccaaagtgctgggattacaggcatgagcctcgg

SEQ ID NO: 199 - DNA, 130 bp, Homo sapiens
aggagcagacttttctcttgtcactttggaaggagaggattgtgaggctgcccctttaaatagcattcccgtaggaggcagatcacatccatccgtcacctactgccaaagcatcatttttggtttctat

SEQ ID NO: 200 - DNA, 80 bp, Homo sapiens
tccatgcgtatatcggacgtggtctcatacgcgttgctgcagtgctgttgcacgcggacatgaccatgcacgacgtagga

SEQ ID NO: 201 - DNA, 22 bp, Homo sapiens
tccccatctctttttccccaca

SEQ ID NO: 202 - DNA, 24 bp, Homo sapiens
tttggattctgaaaactaactggc

SEQ ID NO: 203 - DNA, 22 bp, Homo sapiens
tagcagcacataatggtttgaa

SEQ ID NO: 204 - DNA, 24 bp, Homo sapiens
tccctggaccagcccggtggcacc

SEQ ID NO: 205 - DNA, 24 bp, Homo sapiens
atagtactggtgacgtggtgcggc

SEQ ID NO: 206 - DNA, 22 bp, Homo sapiens
aattgcttgaacccaggaagtg

SEQ ID NO: 207 - DNA, 24 bp, Homo sapiens
tgaggtaggctgtttccttctttc

SEQ ID NO: 208 - DNA, 24 bp, Homo sapiens
tcaccagtaatagtggcattggat

SEQ ID NO: 209 - DNA, 24 bp, Homo sapiens
ggggaaggtcaggaaggtccaagc

SEQ ID NO: 210 - DNA, 24 bp, Homo sapiens
cactgctctccgggcctctcctgc

SEQ ID NO: 211 - DNA, 22 bp, Homo sapiens
tgaatgctaccctgctggctct

SEQ ID NO: 212 - DNA, 24 bp, Homo sapiens
ttaaagggccgtcatttccattag

SEQ ID NO: 213 - DNA, 21 bp, Homo sapiens
gggctggaagaagcttccctg

SEQ ID NO: 214 - DNA, 22 bp, Homo sapiens
tttctgggagatgtctcaggct

SEQ ID NO: 215 - DNA, 24 bp, Homo sapiens
tgtctcaggcacctgaatcagacc

SEQ ID NO: 216 - DNA, 24 bp, Homo sapiens
tgcccgaggagaagctggttgagg

SEQ ID NO: 217 - DNA, 24 bp, Homo sapiens
tcagaagctactacatgtgaaatt

SEQ ID NO: 218 - DNA, 22 bp, Homo sapiens
tcacagtgaaccggtctctttc

SEQ ID NO: 219 - DNA, 22 bp, Homo sapiens
caaaaaattcacctttgggctt

SEQ ID NO: 220 - DNA, 24 bp, Homo sapiens
tggcttgggtcgagctctgtcaca

SEQ ID NO: 221 - DNA, 22 bp, Homo sapiens
tgaggtgggagaattgcttgaa

SEQ ID NO: 222 - DNA, 24 bp, Homo sapiens
gccagggtggtggctaacgcctgt

SEQ ID NO: 223 - DNA, 24 bp, Homo sapiens
tctgcaacaacaagtggttcacag

SEQ ID NO: 224 - DNA, 24 bp, Homo sapiens
caactcaggctctagcttctccag

SEQ ID NO: 225 - DNA, 24 bp, Homo sapiens
tctccagttccagtacgctcatca

SEQ ID NO: 226 - DNA, 22 bp, Homo sapiens
aaagaattctccttttgggctt

SEQ ID NO: 227 - DNA, 24 bp, Homo sapiens
gggcatgaagatcacaatgggcct

SEQ ID NO: 228 - DNA, 24 bp, Homo sapiens
tcacatggatttctgggcggagcg

SEQ ID NO: 229 - DNA, 24 bp, Homo sapiens
aagaactacatccaaggcatcaac

SEQ ID NO: 230 - DNA, 24 bp, Homo sapiens
gggaatgttctggagctgccaagg

SEQ ID NO: 231 - DNA, 22 bp, Homo sapiens
attagctatagcaaaaggctta

SEQ ID NO: 232 - DNA, 24 bp, Homo sapiens
tttccagtcacacatcaaggcgct

SEQ ID NO: 233 - DNA, 24 bp, Homo sapiens
cagtacttattagctgcaggagct

SEQ ID NO: 234 - DNA, 24 bp, Homo sapiens
tgaaacgaacaaggcttgagaatc

SEQ ID NO: 235 - DNA, 24 bp, Homo sapiens
cttcaccattttgttttcattttg

SEQ ID NO: 236 - DNA, 24 bp, Homo sapiens
tgaatttttgaaactggacagaga

SEQ ID NO: 237 - DNA, 24 bp, Homo sapiens
aagtgtgtctatcagtagtggtcc

SEQ ID NO: 238 - DNA, 22 bp, Homo sapiens
tttgcacctgagacagatagcc

SEQ ID NO: 239 - DNA, 24 bp, Homo sapiens
cagctgcctgggttgtggccgccc

SEQ ID NO: 240 - DNA, 24 bp, Homo sapiens
taagtaaaaacgctgggtcaaaac

SEQ ID NO: 241 - DNA, 22 bp, Homo sapiens
cggcgtgggggtttgtagactt

SEQ ID NO: 242 - DNA, 22 bp, Homo sapiens
tagcaccatttgaaatcggtta

SEQ ID NO: 243 - DNA, 22 bp, Homo sapiens
tgaaatattttcaagctgatta

SEQ ID NO: 244 - DNA, 24 bp, Homo sapiens
tggcgtggtgaccaagatgaagat

SEQ ID NO: 245 - DNA, 22 bp, Homo sapiens
taaggtgcatctagtgcagtta

SEQ ID NO: 246 - DNA, 22 bp, Homo sapiens
cattgcactccagcctgggcaa

SEQ ID NO: 247 - DNA, 24 bp, Homo sapiens
tgaggaatgtatcatctttttgtc

SEQ ID NO: 248 - DNA, 24 bp, Homo sapiens
cgggttctcacgcaacaacggagg

SEQ ID NO: 249 - DNA, 24 bp, Homo sapiens
catgcacacagctctctgtacctt

SEQ ID NO: 250 - DNA, 22 bp, Homo sapiens
tcaagtaatccaggataggctg

SEQ ID NO: 251 - DNA, 24 bp, Homo sapiens
tgtgcatggcagctgttttccttt

SEQ ID NO: 252 - DNA, 24 bp, Homo sapiens
tgccgagcggacggaggctccggg

SEQ ID NO: 253 - DNA, 24 bp, Homo sapiens
ccaatgttaatttagttaacaact

SEQ ID NO: 254 - DNA, 21 bp, Homo sapiens
ttcaggcaacagtttgtcctg

SEQ ID NO: 255 - DNA, 18 bp, Homo sapiens
gatgaggcagcacttggg

SEQ ID NO: 256 - DNA, 24 bp, Homo sapiens
agatgctctgctgtcctgtgtggt

SEQ ID NO: 257 - DNA, 20 bp, Homo sapiens
tacctggacagggcaggggc

SEQ ID NO: 258 - DNA, 21 bp, Homo sapiens
tccctcctagttgtgttgttg

SEQ ID NO: 259 - DNA, 22 bp, Homo sapiens
aaagtgctcatagtgcaggtag

SEQ ID NO: 260 - DNA, 24 bp, Homo sapiens
ctttgcttctgttttctggatgca

SEQ ID NO: 261 - DNA, 24 bp, Homo sapiens
tgacagtgtgcaactctcattgga

SEQ ID NO: 262 - DNA, 24 bp, Homo sapiens
tgatagtctccagcagggcctgga

SEQ ID NO: 263 - DNA, 22 bp, Homo sapiens
tgatatataatcagcccatgat

SEQ ID NO: 264 - DNA, 24 bp, Homo sapiens
tgagagcaagggaacagggcggat

SEQ ID NO: 265 - DNA, 22 bp, Homo sapiens
gaccctgtgttcaaggttaggg

SEQ ID NO: 266 - DNA, 24 bp, Homo sapiens
tatatggatccaatggcaagatca

SEQ ID NO: 267 - DNA, 24 bp, Homo sapiens
atgcccgaggagaagctggttgag

SEQ ID NO: 268 - DNA, 22 bp, Homo sapiens
tattgctaagaattcaggtagt

SEQ ID NO: 269 - DNA, 22 bp, Homo sapiens
aggcagaagagaagctgcagag

SEQ ID NO: 270 - DNA, 24 bp, Homo sapiens
tcccggtgctctgcgagatctccc

SEQ ID NO: 271 - DNA, 24 bp, Homo sapiens
aggcatggaggagctgtgtggtca

SEQ ID NO: 272 - DNA, 22 bp, Homo sapiens
acagtgacttgctctccaatgg

SEQ ID NO: 273 - DNA, 24 bp, Homo sapiens
ttccttgcagcaggaacccactta

SEQ ID NO: 274 - DNA, 24 bp, Homo sapiens
gatgggtttcaccatgttggtcag

SEQ ID NO: 275 - DNA, 24 bp, Homo sapiens
ctgggcccagatggccccttctga

SEQ ID NO: 276 - DNA, 24 bp, Homo sapiens
tacaccactcccaagaagaataag

SEQ ID NO: 277 - DNA, 24 bp, Homo sapiens
tctgcaattcttattctcttatag

SEQ ID NO: 278 - DNA, 22 bp, Homo sapiens
cactgcactccagcctgggcaa

SEQ ID NO: 279 - DNA, 24 bp, Homo sapiens
ctgcagtgagccaagatcgtgcca

SEQ ID NO: 280 - DNA, 22 bp, Homo sapiens
tgttcggcaagaagagagggct

SEQ ID NO: 281 - DNA, 22 bp, Homo sapiens
aagttaagagctcccaggcctg

SEQ ID NO: 282 - DNA, 22 bp, Homo sapiens
tggcaaagatgctgacctacat

SEQ ID NO: 283 - DNA, 24 bp, Homo sapiens
ccactgcgcttctggaaacctacc

SEQ ID NO: 284 - DNA, 24 bp, Homo sapiens
ttataagtggctctttgttttgaa

SEQ ID NO: 285 - DNA, 24 bp, Homo sapiens
tctcggccttggcaacggccgtcg

SEQ ID NO: 286 - DNA, 24 bp, Homo sapiens
tactttgactttggtttgctgctg

SEQ ID NO: 287 - DNA, 22 bp, Homo sapiens
aaggtggtgtcatgttttgggg

SEQ ID NO: 288 - DNA, 24 bp, Homo sapiens
acttcaggcacatggtgctgatga

SEQ ID NO: 289 - DNA, 22 bp, Homo sapiens
gtagcaaagattcaggatgtgc

SEQ ID NO: 290 - DNA, 24 bp, Homo sapiens
cacctgcacagcagttaacagcag

SEQ ID NO: 291 - DNA, 22 bp, Homo sapiens
atcacattgccagggattacca

SEQ ID NO: 292 - DNA, 24 bp, Homo sapiens
tggggtcatgccgaacacccatga

SEQ ID NO: 293 - DNA, 24 bp, Homo sapiens
cacgatgggcacaatgccattctg

SEQ ID NO: 294 - DNA, 24 bp, Homo sapiens
aagcacaactacacactttgccca

SEQ ID NO: 295 - DNA, 24 bp, Homo sapiens
tgcaaggaggagttctggagaccc

SEQ ID NO: 296 - DNA, 22 bp, Homo sapiens
catgtaatcccagctactcagg

SEQ ID NO: 297 - DNA, 22 bp, Homo sapiens
tcactgcaacctctgcctcccg

SEQ ID NO: 298 - DNA, 24 bp, Homo sapiens
tggaacctgacaatgttggtgttg

SEQ ID NO: 299 - DNA, 22 bp, Homo sapiens
gagatcagatggaatggaggct

SEQ ID NO: 300 - DNA, 22 bp, Homo sapiens
tggtctcttgaaagaggctctt

SEQ ID NO: 301 - DNA, 22 bp, Homo sapiens
ttcacagtggctaagttctgca

SEQ ID NO: 302 - DNA, 24 bp, Homo sapiens
tacaggatgttcagtttgcaagga

SEQ ID NO: 303 - DNA, 22 bp, Homo sapiens
ctagactgaagctccttgagga

SEQ ID NO: 304 - DNA, 24 bp, Homo sapiens
ttattgcactccagcccgggcgac

SEQ ID NO: 305 - DNA, 22 bp, Homo sapiens
tcaagctcattcctctaacctc

SEQ ID NO: 306 - DNA, 24 bp, Homo sapiens
tgagttatcttttaaatatgtctt

SEQ ID NO: 307 - DNA, 24 bp, Homo sapiens
aggccctgccttggcatgtgtgtc

SEQ ID NO: 308 - DNA, 24 bp, Homo sapiens
aaggagcatgatagtatctattta

SEQ ID NO: 309 - DNA, 24 bp, Homo sapiens
aagtgcccgccaaagctgtggccc

SEQ ID NO: 310 - DNA, 22 bp, Homo sapiens
atggcttctgtcttggaaattt

SEQ ID NO: 311 - DNA, 24 bp, Homo sapiens
gaactgtgcacaggaacagcttcc

SEQ ID NO: 312 - DNA, 24 bp, Homo sapiens
cctgtgtactcataattattgaga

SEQ ID NO: 313 - DNA, 24 bp, Homo sapiens
ggtcaacaggagtcgggcctctct

SEQ ID NO: 314 - DNA, 24 bp, Homo sapiens
tgacgctgaagctggtgagcctgg

SEQ ID NO: 315 - DNA, 24 bp, Homo sapiens
aggtatttggtgtcatgttttgga

SEQ ID NO: 316 - DNA, 17 bp, Homo sapiens
tcacagtggaattcgtc

SEQ ID NO: 317 - DNA, 24 bp, Homo sapiens
agtcaagttgcaggatcagcaggt

SEQ ID NO: 318 - DNA, 24 bp, Homo sapiens
gctgtggtgtctgggtgtggcctg

SEQ ID NO: 319 - DNA, 22 bp, Homo sapiens
gaagtttgaagcctgttgttca

SEQ ID NO: 320 - DNA, 22 bp, Homo sapiens
tggagagataagccaagtatcc

SEQ ID NO: 321 - DNA, 24 bp, Homo sapiens
tgtccagtagccgaacagtttgtt

SEQ ID NO: 322 - DNA, 24 bp, Homo sapiens
tgtaaagtggctggtgcttcccgg

SEQ ID NO: 323 - DNA, 24 bp, Homo sapiens
gaccgcttccctgcagtgccccga

SEQ ID NO: 324 - DNA, 24 bp, Homo sapiens
tttgtctctgacctcccaggaagt

SEQ ID NO: 325 - DNA, 23 bp, Homo sapiens
tggactgcgcattcatgggttcc

SEQ ID NO: 326 - DNA, 22 bp, Homo sapiens
cagatcacatccatccgtcacc

SEQ ID NO: 327 - DNA, 22 bp, Homo sapiens
tggagctgtgagcagcagcaca

SEQ ID NO: 328 - DNA, 22 bp, Homo sapiens
acatgatctcctcactctagga

SEQ ID NO: 329 - DNA, 24 bp, Homo sapiens
agaggtcctgattcagtttatcaa

SEQ ID NO: 330 - DNA, 24 bp, Homo sapiens
tattacccttcagcacctgagtcc

SEQ ID NO: 331 - DNA, 22 bp, Homo sapiens
ggcaacaagagcgaaactccat

SEQ ID NO: 332 - DNA, 22 bp, Homo sapiens
ttgttttctttctcctcttcta

SEQ ID NO: 333 - DNA, 24 bp, Homo sapiens
aagctgcaacaaggtgataaaggt

SEQ ID NO: 334 - DNA, 22 bp, Homo sapiens
aaccatgttttagcataatggg

SEQ ID NO: 335 - DNA, 24 bp, Homo sapiens
ttcccatgccccaggctcctgcag

SEQ ID NO: 336 - DNA, 24 bp, Homo sapiens
tcgcagcagcccggacaggaagat

SEQ ID NO: 337 - DNA, 24 bp, Homo sapiens
ttatcaggggcccttcctcggatg

SEQ ID NO: 338 - DNA, 24 bp, Homo sapiens
gccgctgtgctgaaggaggtgtgc

SEQ ID NO: 339 - DNA, 24 bp, Homo sapiens
cacagggttcaccgccatttcttc

SEQ ID NO: 340 - DNA, 24 bp, Homo sapiens
ctgagcaccagccatatctttgct

SEQ ID NO: 341 - DNA, 24 bp, Homo sapiens
gtgtgctgttagaagggttctggg

SEQ ID NO: 342 - DNA, 24 bp, Homo sapiens
aaagtgctgggattacaggcatga

SEQ ID NO: 343 - DNA, 24 bp, Homo sapiens
tacttcaggaactctttttcaaac

SEQ ID NO: 344 - DNA, 24 bp, Homo sapiens
tggtgtcgatgggccggaagtagg

SEQ ID NO: 345 - DNA, 24 bp, Homo sapiens
tacaccactgtgagccgactgaaa

SEQ ID NO: 346 - DNA, 24 bp, Homo sapiens
attgcactccagcctgggccacag

SEQ ID NO: 347 - DNA, 22 bp, Homo sapiens
gtgttccaggaagtcgtcttga

SEQ ID NO: 348 - DNA, 22 bp, Homo sapiens
ggtccagatggggagaagatgt

SEQ ID NO: 349 - DNA, 24 bp, Homo sapiens
tctgttgagagcctggtaaggggt

SEQ ID NO: 350 - DNA, 24 bp, Homo sapiens
caaatgacttagtaatctaatatg

SEQ ID NO: 351 - DNA, 24 bp, Homo sapiens
ctgcaaggcttctggctacatctt

SEQ ID NO: 352 - DNA, 24 bp, Homo sapiens
ttgcacgcggacatgaccatgcac

SEQ ID NO: 353 - DNA, 24 bp, Homo sapiens
tgggtgccaatttcgtggtgtgga

SEQ ID NO: 354 - DNA, 22 bp, Homo sapiens
taggtagtttcctgttgttggg

SEQ ID NO: 355 - DNA, 22 bp, Homo sapiens
tgaaaacaaggacgggcgaatt

SEQ ID NO: 356 - DNA, 22 bp, Homo sapiens
taatactgccgggtaatgatgg

SEQ ID NO: 357 - DNA, 24 bp, Homo sapiens
accaggtatgtcacagcttgtgct

SEQ ID NO: 358 - DNA, 24 bp, Homo sapiens
gggcctgtgaccttgagaacctca

SEQ ID NO: 359 - DNA, 23 bp, Homo sapiens
gagcattggcagtgaattgcaga

SEQ ID NO: 360 - DNA, 22 bp, Homo sapiens
actgcactccagcctgggcaac

SEQ ID NO: 361 - DNA, 22 bp, Homo sapiens
ctgtgcctgtgacgagggatga

SEQ ID NO: 362 - DNA, 24 bp, Homo sapiens
ggggacaggtgtacagacatgttc

SEQ ID NO: 363 - DNA, 23 bp, Homo sapiens
ttaaaagatcactgaagttggat

SEQ ID NO: 364 - DNA, 24 bp, Homo sapiens
tgggtggatgctgctctcgaataa

SEQ ID NO: 365 - DNA, 21 bp, Homo sapiens
ggagagcatgttgcatttgcc

SEQ ID NO: 366 - DNA, 24 bp, Homo sapiens
caagattaggcctctcaaaagagc

SEQ ID NO: 367 - DNA, 22 bp, Homo sapiens
gctgttgttaagggcacttggg

SEQ ID NO: 368 - DNA, 24 bp, Homo sapiens
ccccgggaagtcagaaatcgatca

SEQ ID NO: 369 - DNA, 24 bp, Homo sapiens
ctcatgatgtacgcgcagtccaaa

SEQ ID NO: 370 - DNA, 20 bp, Homo sapiens
ttctgggtggcagtgatggc

SEQ ID NO: 371 - DNA, 22 bp, Homo sapiens
actgcactccagtctgggtgac

SEQ ID NO: 372 - DNA, 24 bp, Homo sapiens
tcttcagttccaacaaaaggtctg

SEQ ID NO: 373 - DNA, 24 bp, Homo sapiens
gttccagttaggggcagtagagtt

SEQ ID NO: 374 - DNA, 24 bp, Homo sapiens
tccacagagtttagtttcctcatt

SEQ ID NO: 375 - DNA, 24 bp, Homo sapiens
tctcgggctctactcagactagcg

SEQ ID NO: 376 - DNA, 24 bp, Homo sapiens
tggccgcagtccttgcgaactgtt

SEQ ID NO: 377 - DNA, 24 bp, Homo sapiens
tcccggggccgggggaccttagcg

SEQ ID NO: 378 - DNA, 24 bp, Homo sapiens
attctaccaagcagagatggagga

SEQ ID NO: 379 - DNA, 22 bp, Homo sapiens
agctgccagttgaagaacattt

SEQ ID NO: 380 - DNA, 24 bp, Homo sapiens
gtggtggcagactttgggctgtca

SEQ ID NO: 381 - DNA, 24 bp, Homo sapiens
cttcaagtgtagggactcctcgca

SEQ ID NO: 382 - DNA, 24 bp, Homo sapiens
tgtcacgtaggtcacactagactc

SEQ ID NO: 383 - DNA, 24 bp, Homo sapiens
tcactggttttgtggctgcctccc

SEQ ID NO: 384 - DNA, 24 bp, Homo sapiens
tcgaatggacacattaccagtgaa

SEQ ID NO: 385 - DNA, 24 bp, Homo sapiens
cattgtggctggaggtgctggtgc

SEQ ID NO: 386 - DNA, 24 bp, Homo sapiens
aagccacctatgacgcagccaccc

SEQ ID NO: 387 - DNA, 22 bp, Homo sapiens
ctgccatttccaggagatcacc

SEQ ID NO: 388 - DNA, 22 bp, Homo sapiens
ttcatgggagcaggtggtacag

SEQ ID NO: 389 - DNA, 24 bp, Homo sapiens
tgtagaatctttattatctcaaca

SEQ ID NO: 390 - DNA, 24 bp, Homo sapiens
ttcaggtcacatgagttgcaagat

SEQ ID NO: 391 - DNA, 24 bp, Homo sapiens
tggcagaatacaagtcatttcaat

SEQ ID NO: 392 - DNA, 24 bp, Homo sapiens
gagcaggtgttctgggccccttca

SEQ ID NO: 393 - DNA, 24 bp, Homo sapiens
tattgctctctaaactttgttcct

SEQ ID NO: 394 - DNA, 22 bp, Homo sapiens
tctgtggtatgacagaactggg

SEQ ID NO: 395 - DNA, 24 bp, Homo sapiens
tttggcaaagacttggtgcagatg

SEQ ID NO: 396 - DNA, 22 bp, Homo sapiens
tgtgtcactgagtgaaagctgc

SEQ ID NO: 397 - DNA, 24 bp, Homo sapiens
aaggctgggctgctgatatgtata

SEQ ID NO: 398 - DNA, 22 bp, Homo sapiens
tagcttatcagactgatgttga

SEQ ID NO: 399 - DNA, 22 bp, Homo sapiens
tttccacagcggccaattcttc

SEQ ID NO: 400 - DNA, 32 bp, Homo sapiens
acctccacctcacaggttcaagcgattctcgt

SEQ ID NO: 401 - DNA, 32 bp, Homo sapiens
cctctgtcacccgagctggagtgcagtggtgc

SEQ ID NO: 402 - DNA, 24 bp, Homo sapiens
tcacgcctgttatcccagcacttt

SEQ ID NO: 403 - DNA, 24 bp, Homo sapiens
tcatgcctataatcctagcacttt

SEQ ID NO: 404 - DNA, 32 bp, Homo sapiens
ctaggctcaagcaatccttccacctcagtctc

SEQ ID NO: 405 - DNA, 32 bp, Homo sapiens
tctcttcatgctctccccatcccagtttttag

SEQ ID NO: 406 - DNA, 24 bp, Homo sapiens
tcatgcctgtaatcctggcacttt

SEQ ID NO: 407 - DNA, 24 bp, Homo sapiens
tcatgcccataatcccagcacttt

SEQ ID NO: 408 - DNA, 32 bp, Homo sapiens
ttgaacatcctgcagtcacagggtcaggggtc

SEQ ID NO: 409 - DNA, 18 bp, Homo sapiens
gcaaatgctcagctctcc

SEQ ID NO: 410 - DNA, 21 bp, Homo sapiens
tgtggggaagcaggaacggga

SEQ ID NO: 411 - DNA, 23 bp, Homo sapiens
tggtgcgatcttggctcactgca

SEQ ID NO: 412 - DNA, 23 bp, Homo sapiens
tggcacgatctcagctcactgca

SEQ ID NO: 413 - DNA, 23 bp, Homo sapiens
tggcatgatctcagctcactgta

SEQ ID NO: 414 - DNA, 23 bp, Homo sapiens
tggcgcgatctcagctcactaca

SEQ ID NO: 415 - DNA, 23 bp, Homo sapiens
tggctcgatctctgctcactgca

SEQ ID NO: 416 - DNA, 23 bp, Homo sapiens
tggcgcgatctcggctcactgca

SEQ ID NO: 417 - DNA, 32 bp, Homo sapiens
tcaggtgatgaacaggctgaaatcagtacttc

SEQ ID NO: 418 - DNA, 32 bp, Homo sapiens
cgctctgtcaccaggctggagtacagtgatga

SEQ ID NO: 419 - DNA, 32 bp, Homo sapiens
tttttccccttctcttaaaaccacagaggacc

SEQ ID NO: 420 - DNA, 32 bp, Homo sapiens
agtgcctggactccctgctccgtgaggcgaat

SEQ ID NO: 421 - DNA, 32 bp, Homo sapiens
atctccacctcctgggttcaagcgattctcct

SEQ ID NO: 422 - DNA, 32 bp, Homo sapiens
aggaatgtctgacaggcttaagctttcgtccc

SEQ ID NO: 423 - DNA, 32 bp, Homo sapiens
ctctgcagtctacaaaatcgccccagtcaact

SEQ ID NO: 424 - DNA, 32 bp, Homo sapiens
aagttggaggtaggggcctgtggaaacatgaa

SEQ ID NO: 425 - DNA, 32 bp, Homo sapiens
ctctcccaggtctactgctccctggaaagccc

SEQ ID NO: 426 - DNA, 32 bp, Homo sapiens
cacagtgctgctaatatcccagctccagccag

SEQ ID NO: 427 - DNA, 22 bp, Homo sapiens
tcacacctatagtcccagcact

SEQ ID NO: 428 - DNA, 32 bp, Homo sapiens
caagcctcaaatggtgaataattctttcccta

SEQ ID NO: 429 - DNA, 32 bp, Homo sapiens
gctctgttgcccagactggagtgcagtggcgt

SEQ ID NO: 430 - DNA, 32 bp, Homo sapiens
gctctgttgcccaggttggagtgcagtggcac

SEQ ID NO: 431 - DNA, 32 bp, Homo sapiens
actctgtcacccagactggagtgcagtggcgc

SEQ ID NO: 432 - DNA, 32 bp, Homo sapiens
gctctttcgcccaggctggcgtgcagtggcac

SEQ ID NO: 433 - DNA, 32 bp, Homo sapiens
actctatcacccaagctggagtgcagtggcac

SEQ ID NO: 434 - DNA, 32 bp, Homo sapiens
agtctgccacccaggctggagtccagtggcgt

SEQ ID NO: 435 - DNA, 32 bp, Homo sapiens
gctctgttgcccaggctggagtgcagtggcat

SEQ ID NO: 436 - DNA, 32 bp, Homo sapiens
gctctgtcgcccaggctggagtgcagtggcac

SEQ ID NO: 437 - DNA, 32 bp, Homo sapiens
actctgtcacccaggctggagtgtagtggcat

SEQ ID NO: 438 - DNA, 32 bp, Homo sapiens
actctgtcacccaggctggagtgcagtggcac

SEQ ID NO: 439 - DNA, 32 bp, Homo sapiens
tgttcatgcccaggatctgctgcgctcatgga

SEQ ID NO: 440 - DNA, 32 bp, Homo sapiens
aatagaagctggattccatcagatttcaaatg

SEQ ID NO: 441 - DNA, 32 bp, Homo sapiens
gctctttcgccaaggctggagtgcagtggcac

SEQ ID NO: 442 - DNA, 32 bp, Homo sapiens
actctgtcacccaggctagagtgcaatggcac

SEQ ID NO: 443 - DNA, 32 bp, Homo sapiens
gggcggagaacaagtcggctgtggagatgcgg

SEQ ID NO: 444 - DNA, 32 bp, Homo sapiens
ctccatcactcaggctggagtacagtgctgag

SEQ ID NO: 445 - DNA, 32 bp, Homo sapiens
ctttgttgctcaggctggagtacagtggcata

SEQ ID NO: 446 - DNA, 32 bp, Homo sapiens
aagtggcatcttctctcccaccgggtctacac

SEQ ID NO: 447 - DNA, 32 bp, Homo sapiens
ccctcctgtcttctccccgtaccttgtagtta

SEQ ID NO: 448 - DNA, 32 bp, Homo sapiens
gcaagtcatccctcagtgaaagcaccagtctc

SEQ ID NO: 449 - DNA, 32 bp, Homo sapiens
ccctacagtgttcaaggtcacagggtcaaaat

SEQ ID NO: 450 - DNA, 20 bp, Homo sapiens
tcacacacaactggcaccca

SEQ ID NO: 451 - DNA, 32 bp, Homo sapiens
aagggccagaaatgtggagacatggtttttgt

SEQ ID NO: 452 - DNA, 32 bp, Homo sapiens
tggattcagactgaattataccacaggccttc

SEQ ID NO: 453 - DNA, 32 bp, Homo sapiens
ttctgcaaatatggcttaaatatttcatggca

SEQ ID NO: 454 - DNA, 32 bp, Homo sapiens
gacaattcagaggcgaggagattctgtaaact

SEQ ID NO: 455 - DNA, 32 bp, Homo sapiens
tgggaggcctaggtgggcagatcatgaggtca

SEQ ID NO: 456 - DNA, 32 bp, Homo sapiens
ctctgttgcccaggctggagtgcagcggcatg

SEQ ID NO: 457 - DNA, 21 bp, Homo sapiens
gcccctcaccttgtccacgta

SEQ ID NO: 458 - DNA, 24 bp, Homo sapiens
tcacgcctgtcatctcagcacttt

SEQ ID NO: 459 - DNA, 32 bp, Homo sapiens
agggctggaggatcgctcctgtggaaagggag

SEQ ID NO: 460 - DNA, 32 bp, Homo sapiens
ttccttcacagctttgcttttctgcctcttct

SEQ ID NO: 461 - DNA, 20 bp, Homo sapiens
tgtgggggtgggagtggaga

SEQ ID NO: 462 - DNA, 31 bp, Homo sapiens
gagcttcaaaaacatgtgaggagggaagagt

SEQ ID NO: 463 - DNA, 32 bp, Homo sapiens
cctttgtgtgtcctgctcacattgtctccagg

SEQ ID NO: 464 - DNA, 25 bp, Homo sapiens
catctgcatatgcgtatttgccaaa

SEQ ID NO: 465 - DNA, 32 bp, Homo sapiens
ccagtccccagctcactcagccacacacacca

SEQ ID NO: 466 - DNA, 32 bp, Homo sapiens
ctacacggcaggggcagacactgtgagtataa

SEQ ID NO: 467 - DNA, 32 bp, Homo sapiens
gctttgttgcccaggctggggtgcagtggcac

SEQ ID NO: 468 - DNA, 32 bp, Homo sapiens
gctttgttgcccaggctggagtgcagtagcac

SEQ ID NO: 469 - DNA, 32 bp, Homo sapiens
tctctgtcacccaggctggaatgcagtggcgt

SEQ ID NO: 470 - DNA, 32 bp, Homo sapiens
gaacctgggaggcagagtttacagtgagccga

SEQ ID NO: 471 - DNA, 32 bp, Homo sapiens
gaaccgaggaggcgaaggttgcagtgagccga

SEQ ID NO: 472 - DNA, 32 bp, Homo sapiens
gagtccaggaattagaggttgcagtgaggtat

SEQ ID NO: 473 - DNA, 32 bp, Homo sapiens
cagcctcctgagtagctggattacagggcctg

SEQ ID NO: 474 - DNA, 32 bp, Homo sapiens
cagcggcagggggagcgcctggaacatgcagc

SEQ ID NO: 475 - DNA, 32 bp, Homo sapiens
gaacccaggaggccgaggttgcagtgagccaa

SEQ ID NO: 476 - DNA, 32 bp, Homo sapiens
agaaagccagattcccagggaagccatggagc

SEQ ID NO: 477 - DNA, 32 bp, Homo sapiens
gagacaggggagagagaaagacaaagagggga

SEQ ID NO: 478 - DNA, 32 bp, Homo sapiens
ggctcatgcctgtaatcccagcactttcaaag

SEQ ID NO: 479 - DNA, 32 bp, Homo sapiens
agtgcgggccggcagaggctggcggggagcag

SEQ ID NO: 480 - DNA, 32 bp, Homo sapiens
catacgtgctggaaatgctgtgatctgccctg

SEQ ID NO: 481 - DNA, 32 bp, Homo sapiens
ccggatctctggctcctcatctctccggtctc

SEQ ID NO: 482 - DNA, 32 bp, Homo sapiens
taccataagaggttggaatgagaggatgactg

SEQ ID NO: 483 - DNA, 32 bp, Homo sapiens
attctgtcacccaggctagagtacagtgggaa

SEQ ID NO: 484 - DNA, 32 bp, Homo sapiens
tttctcaggcctgtgattcacagactttaaca

SEQ ID NO: 485 - DNA, 32 bp, Homo sapiens
tctcaacacacaaagtgccaccaccttccctg

SEQ ID NO: 486 - DNA, 19 bp, Homo sapiens
aagggagcccccatgcaca

SEQ ID NO: 487 - DNA, 18 bp, Homo sapiens
gcccagcctgtcctggta

SEQ ID NO: 488 - DNA, 32 bp, Homo sapiens
cgcaggggagccggctggagtgagctggctgg

SEQ ID NO: 489 - DNA, 23 bp, Homo sapiens
cccagaacccttggtcttgccac

SEQ ID NO: 490 - DNA, 32 bp, Homo sapiens
accctctcaagtgccctctccgagctggtagg

SEQ ID NO: 491 - DNA, 32 bp, Homo sapiens
cagtgtcctaagttccttaacaatgcttacca

SEQ ID NO: 492 - DNA, 32 bp, Homo sapiens
accttaaattgaaagccagtgctgctactttc

SEQ ID NO: 493 - DNA, 32 bp, Homo sapiens
ccctgatctctagcttctcagcctccagaact

SEQ ID NO: 494 - DNA, 32 bp, Homo sapiens
taccaccatcattcttcacagaattacaaaaa

SEQ ID NO: 495 - DNA, 32 bp, Homo sapiens
atcaaaagtctacataactaatacagctgagc

SEQ ID NO: 496 - DNA, 32 bp, Homo sapiens
ggagcacccaattcttcttgagaacaccaacc

SEQ ID NO: 497 - DNA, 32 bp, Homo sapiens
atctgttacccaggctggagtgcagtggtgct

SEQ ID NO: 498 - DNA, 32 bp, Homo sapiens
tctcgtcgcccaggctggaatgcagtggtgcg

SEQ ID NO: 499 - DNA, 32 bp, Homo sapiens
caaaaagaattgcccacgctgtggaagataaa

SEQ ID NO: 500 - DNA, 32 bp, Homo sapiens
gttatctcaaaccagtctgctggttaaatgga

SEQ ID NO: 501 - DNA, 32 bp, Homo sapiens
tcttattgcccagactagagtgcgatggtgcg

SEQ ID NO: 502 - DNA, 18 bp, Homo sapiens
catccctaccacccagga

SEQ ID NO: 503 - DNA, 23 bp, Homo sapiens
tgaggctcaccagccacaggcct

SEQ ID NO: 504 - DNA, 24 bp, Homo sapiens
tcatgcctattatcccagcacttt

SEQ ID NO: 505 - DNA, 32 bp, Homo sapiens
aatcagaggtaatgtattttggcagcttgttt

SEQ ID NO: 506 - DNA, 32 bp, Homo sapiens
tgtgtaaaggtttcatgttcactgtgagtgaa

SEQ ID NO: 507 - DNA, 32 bp, Homo sapiens
agcctcccaagtagctgggattacagtttcca

SEQ ID NO: 508 - DNA, 32 bp, Homo sapiens
ttctgatgcccaggttgcaccccatgccaatg

SEQ ID NO: 509 - DNA, 32 bp, Homo sapiens
ctttgcttcccaggctggagtgcagtggtgcg

SEQ ID NO: 510 - DNA, 23 bp, Homo sapiens
ggagagcgccagggcctgagctg

SEQ ID NO: 511 - DNA, 32 bp, Homo sapiens
ctacccaccctcttctctcttctcttctccct

SEQ ID NO: 512 - DNA, 32 bp, Homo sapiens
ttgatttcaacattttctcccaccctctcggc

SEQ ID NO: 513 - DNA, 32 bp, Homo sapiens
tagagccatccctcagtcagctggcagggaca

SEQ ID NO: 514 - DNA, 32 bp, Homo sapiens
tgaatagtcctaggctggacagcaatgggctg

SEQ ID NO: 515 - DNA, 32 bp, Homo sapiens
ctttggctcccaggctggagtccagtggtgtg

SEQ ID NO: 516 - DNA, 32 bp, Homo sapiens
gctctgtcactcaggctggagtgcagtggtat

SEQ ID NO: 517 - DNA, 32 bp, Homo sapiens
gctctgtcattcaggcaagagtgcagtagtgt

SEQ ID NO: 518 - DNA, 32 bp, Homo sapiens
ttagcaatgaggaggaaatgtgatctggctgt

SEQ ID NO: 519 - DNA, 32 bp, Homo sapiens
ctcttgtcgcccaggctgtagtgcagtggtac

SEQ ID NO: 520 - DNA, 32 bp, Homo sapiens
actctgtcactcaggctggagtgcggtggtat

SEQ ID NO: 521 - DNA, 28 bp, Homo sapiens
cagaccgaaggtgctgccttcatcctcc

SEQ ID NO: 522 - DNA, 32 bp, Homo sapiens
tccccactggccagctggagtagatgaagttc

SEQ ID NO: 523 - DNA, 32 bp, Homo sapiens
ctctttcgcccaggctggagtgcagtggtatg

SEQ ID NO: 524 - DNA, 32 bp, Homo sapiens
ggaggtagaagaggggaaggaagatggtttct

SEQ ID NO: 525 - DNA, 32 bp, Homo sapiens
ggctcctgtctataatcgcagcactttgggag

SEQ ID NO: 526 - DNA, 32 bp, Homo sapiens
aacaagaacctgaggccgctggagaaaaggaa

SEQ ID NO: 527 - DNA, 32 bp, Homo sapiens
cttcaaattattgacctggacagggtccaagt

SEQ ID NO: 528 - DNA, 32 bp, Homo sapiens
taaattcagtatgttggcattacttggacctg

SEQ ID NO: 529 - DNA, 32 bp, Homo sapiens
agccacaccacacctgcacttctgcctcactt

SEQ ID NO: 530 - DNA, 32 bp, Homo sapiens
gaagcctgcagggaaagccactggagagtttt

SEQ ID NO: 531 - DNA, 32 bp, Homo sapiens
ctgggggttgggggctgtgtctctccatccct

SEQ ID NO: 532 - DNA, 21 bp, Homo sapiens
caacaccaggatgaggtccca

SEQ ID NO: 533 - DNA, 32 bp, Homo sapiens
acaccatcatgggctgtattttcaagttgatt

SEQ ID NO: 534 - DNA, 32 bp, Homo sapiens
gaagaaaatgttcttccagttactttccaatt

SEQ ID NO: 535 - DNA, 32 bp, Homo sapiens
cgaaatcagtgcgctccagctgatctcgttcc

SEQ ID NO: 536 - DNA, 32 bp, Homo sapiens
gtgctgttgcccaagggcgtggtccacggtac

SEQ ID NO: 537 - DNA, 32 bp, Homo sapiens
ccgggctcaagcaatcctcctgcctcagctcc

SEQ ID NO: 538 - DNA, 32 bp, Homo sapiens
ctcagtcgcccaggctggagtgcagcagcaca

SEQ ID NO: 539 - DNA, 32 bp, Homo sapiens
caaggccatgggcatggatgtgctgaacgagg

SEQ ID NO: 540 - DNA, 32 bp, Homo sapiens
cccctccatcttctacctctgaatggccaccc

SEQ ID NO: 541 - DNA, 32 bp, Homo sapiens
gggtcagtctccaaactggagtttggtggcta

SEQ ID NO: 542 - DNA, 32 bp, Homo sapiens
ttggcctcaagcaatccttcctctttggcctc

SEQ ID NO: 543 - DNA, 32 bp, Homo sapiens
aagagctccagaaatctgcacagggttctctt

SEQ ID NO: 544 - DNA, 32 bp, Homo sapiens
ttgtaagcctgagatcaataagaaatgttcag

SEQ ID NO: 545 - DNA, 32 bp, Homo sapiens
agtgttattttctttctcagtgacacataaca

SEQ ID NO: 546 - DNA, 32 bp, Homo sapiens
gcactgttgcccaggctggagtgcagtggcgt

SEQ ID NO: 547 - DNA, 32 bp, Homo sapiens
gggtaacaccctgggagttttagtagcttgag

SEQ ID NO: 548 - DNA, 32 bp, Homo sapiens
atcaattaccacaccatctcccatgaagaaag

SEQ ID NO: 549 - DNA, 32 bp, Homo sapiens
agccactgtgctgaattctgcaatgttttcct

SEQ ID NO: 550 - DNA, 32 bp, Homo sapiens
ggcttccagcagggagcttcccctctggcgtc

SEQ ID NO: 551 - DNA, 32 bp, Homo sapiens
atctccagaagaggggagcagagtccgagctt

SEQ ID NO: 552 - DNA, 32 bp, Homo sapiens
caactccatcattcacactggaggattagagg

SEQ ID NO: 553 - DNA, 32 bp, Homo sapiens
acaccttccctctctgaatgctgagcagaggc

SEQ ID NO: 554 - DNA, 21 bp, Homo sapiens
cccggagccccgaagactcgg

SEQ ID NO: 555 - DNA, 32 bp, Homo sapiens
tccccggccatgtggaactcccagagacagaa

SEQ ID NO: 556 - DNA, 32 bp, Homo sapiens
ctctgttacccaggctagagtgcagtggcgcg

SEQ ID NO: 557 - DNA, 32 bp, Homo sapiens
cctttgtcgcccaggctggagtgcaatggcgt

SEQ ID NO: 558 - DNA, 32 bp, Homo sapiens
catgcaggctcaacataacataagctagaaaa

SEQ ID NO: 559 - DNA, 32 bp, Homo sapiens
ctctgtcacccaggctggagtgcaatggcgtg

SEQ ID NO: 560 - DNA, 32 bp, Homo sapiens
gtccgttgtcttctccagcatccttgggccca

SEQ ID NO: 561 - DNA, 22 bp, Homo sapiens
tgagggggtcagacacaggccc

SEQ ID NO: 562 - DNA, 32 bp, Homo sapiens
gaaatggtgagggcacagtgagcttgaaggct

SEQ ID NO: 563 - DNA, 32 bp, Homo sapiens
acgcaggctgccaggctggcgtacagtggcgc

SEQ ID NO: 564 - DNA, 32 bp, Homo sapiens
cttttgttgcccaggctggagtgcaatgatgc

SEQ ID NO: 565 - DNA, 32 bp, Homo sapiens
caaggaggggcttttgctgtgctaattaggat

SEQ ID NO: 566 - DNA, 32 bp, Homo sapiens
ccctctgcccgaagcaataacaacagcagcag

SEQ ID NO: 567 - DNA, 32 bp, Homo sapiens
cagtctacctcctattcgtctgatcttgctta

SEQ ID NO: 568 - DNA, 32 bp, Homo sapiens
ctcttgttgcccaggctggagtgcattggcgc

SEQ ID NO: 569 - DNA, 32 bp, Homo sapiens
acattcaaggaaggtttcctggaagatttagt

SEQ ID NO: 570 - DNA, 28 bp, Homo sapiens
cacctctgaagtgctgcttgaatctggc

SEQ ID NO: 571 - DNA, 28 bp, Homo sapiens
aggcccggaagtgctgacgcagccatca

SEQ ID NO: 572 - DNA, 22 bp, Homo sapiens
tcacacctgtaatcccaatact

SEQ ID NO: 573 - DNA, 32 bp, Homo sapiens
ggtaggggaagaggaggggcaggagggagagt

SEQ ID NO: 574 - DNA, 32 bp, Homo sapiens
ggaggaagaagaggcgagaacgatccccgaac

SEQ ID NO: 575 - DNA, 32 bp, Homo sapiens
agtcgtgtcttgtgactctcccaggaatcaga

SEQ ID NO: 576 - DNA, 32 bp, Homo sapiens
gccctgcagctttaacagagtgaaccatgtgt

SEQ ID NO: 577 - DNA, 32 bp, Homo sapiens
ctcccaggttcaagcattcttctgcctcagcc

SEQ ID NO: 578 - DNA, 22 bp, Homo sapiens
caggttctggctccttccagcc

SEQ ID NO: 579 - DNA, 20 bp, Homo sapiens
gccatcacccggcatcagag

SEQ ID NO: 580 - DNA, 32 bp, Homo sapiens
tgagagcgcctctcttttgagcaaacaagcat

SEQ ID NO: 581 - DNA, 32 bp, Homo sapiens
tcttgttgcccaggctggagtgcaatggcgca

SEQ ID NO: 582 - DNA, 32 bp, Homo sapiens
gacccttgagttctgttggcccactgacttta

SEQ ID NO: 583 - DNA, 32 bp, Homo sapiens
acccccacatcccgggttcaagtgattctcct

SEQ ID NO: 584 - DNA, 28 bp, Homo sapiens
gttatcccaagtgctcttattctggtga

SEQ ID NO: 585 - DNA, 32 bp, Homo sapiens
atactcgggaggctgaagcaggagaattgctt

SEQ ID NO: 586 - DNA, 32 bp, Homo sapiens
taacaacgtgtctcctggattttactttgaag

SEQ ID NO: 587 - DNA, 23 bp, Homo sapiens
tcatgcctgtcatcccagcattt

SEQ ID NO: 588 - DNA, 32 bp, Homo sapiens
cttcactcacccagcaggtcagttttctgtgc

SEQ ID NO: 589 - DNA, 32 bp, Homo sapiens
tttcttccatctcccttgcaggcacagggcca

SEQ ID NO: 590 - DNA, 32 bp, Homo sapiens
ccactaagtgcctctttgcatagcaccagtcc

SEQ ID NO: 591 - DNA, 32 bp, Homo sapiens
tcttgttgcccagactggagtgcaatggcaca

SEQ ID NO: 592 - DNA, 32 bp, Homo sapiens
tgaagctggaggcagagattggagtgatacat

SEQ ID NO: 593 - DNA, 32 bp, Homo sapiens
ccaggctgtcttctcctcatcacagggacgag

SEQ ID NO: 594 - DNA, 32 bp, Homo sapiens
cacagaagaattggaccaggtcactgtacgta

SEQ ID NO: 595 - DNA, 32 bp, Homo sapiens
agcatgggcagaggagacaggaacaagcgtag

SEQ ID NO: 596 - DNA, 27 bp, Homo sapiens
cgatgagtgcctccttcgtgccgaacg

SEQ ID NO: 597 - DNA, 32 bp, Homo sapiens
ccatagcagctttgtctctgtcacatcagcaa

SEQ ID NO: 598 - DNA, 32 bp, Homo sapiens
gacttcctcttccttctgattctgcctgaata

SEQ ID NO: 599 - DNA, 28 bp, Homo sapiens
agtgcccttagtgctgccacactccctg

SEQ ID NO: 600 - DNA, 32 bp, Homo sapiens
cttaaagaacaacagtcttttcttcaggactc

SEQ ID NO: 601 - DNA, 32 bp, Homo sapiens
gctctgtcgccaaggctggagtgcagtggtgt

SEQ ID NO: 602 - DNA, 22 bp, Homo sapiens
tgatctccatgtagtccatata

SEQ ID NO: 603 - DNA, 32 bp, Homo sapiens
ctgggttcaggcaattctcccacctcagcctc

SEQ ID NO: 604 - DNA, 32 bp, Homo sapiens
gcggttgaattgccatggcaatgcggtgggcg

SEQ ID NO: 605 - DNA, 32 bp, Homo sapiens
ggcgagagcccctcttcttcccgagcagtggg

SEQ ID NO: 606 - DNA, 32 bp, Homo sapiens
tgctatttcccaagctggagtgcagtggtgcg

SEQ ID NO: 607 - DNA, 32 bp, Homo sapiens
tgccccagcctatctgatggcatggtccctgg

SEQ ID NO: 608 - DNA, 32 bp, Homo sapiens
ccacaagccaatcagttggatatttcattcat

SEQ ID NO: 609 - DNA, 32 bp, Homo sapiens
gaacctgggaggcagagcttgcagtgagccga

SEQ ID NO: 610 - DNA, 32 bp, Homo sapiens
tgtgctattcagccaatagtgctgctggccca

SEQ ID NO: 611 - DNA, 32 bp, Homo sapiens
ctctttcgcccaggctggagtgcagtggcgca

SEQ ID NO: 612 - DNA, 32 bp, Homo sapiens
acctccgcctctcgggttcaagcgattctcct

SEQ ID NO: 613 - DNA, 32 bp, Homo sapiens
gtctcgaacttctgggctcaagcaattgtccc

SEQ ID NO: 614 - DNA, 32 bp, Homo sapiens
gaacccgggaggcagagcttgcagtgagctga

SEQ ID NO: 615 - DNA, 32 bp, Homo sapiens
gtaatatcagttacagtggcagtattgacaat

SEQ ID NO: 616 - DNA, 32 bp, Homo sapiens
agggaagcaagagtagggttgtggaaagacca

SEQ ID NO: 617 - DNA, 32 bp, Homo sapiens
aactttccccatacaggaaaacttgaaaatta

SEQ ID NO: 618 - DNA, 32 bp, Homo sapiens
agagcttcaagcaatggccccatcctcaaaga

SEQ ID NO: 619 - DNA, 32 bp, Homo sapiens
caggattcaagcagttctcctgcctcagtctc

SEQ ID NO: 620 - DNA, 32 bp, Homo sapiens
ctgggttcaagcgattcacccacctcagcctc

SEQ ID NO: 621 - DNA, 32 bp, Homo sapiens
gcctatttctgctcctctcttctctcttggac

SEQ ID NO: 622 - DNA, 27 bp, Homo sapiens
ggtgcagagaagctggacttctgtggg

SEQ ID NO: 623 - DNA, 32 bp, Homo sapiens
taaatggttaactttcaaatgatgctgctgcc

SEQ ID NO: 624 - DNA, 32 bp, Homo sapiens
tccacgtccttatcttcttgatgcaagacaat

SEQ ID NO: 625 - DNA, 32 bp, Homo sapiens
ctctgtcacccgagctggagtgcagtggtgca

SEQ ID NO: 626 - DNA, 32 bp, Homo sapiens
caaaatgctcaaggaattagctctgggaatat

SEQ ID NO: 627 - DNA, 32 bp, Homo sapiens
gaacccgggaggcggaggtttcagtgagccga

SEQ ID NO: 628 - DNA, 18 bp, Homo sapiens
ccacatggtgaaacccat

SEQ ID NO: 629 - DNA, 32 bp, Homo sapiens
gaacccaggaggtggaggttgcagtgaggcaa

SEQ ID NO: 630 - DNA, 32 bp, Homo sapiens
gaacctgggaggcagaggttacaatgagccga

SEQ ID NO: 631 - DNA, 32 bp, Homo sapiens
ctactcgggaggctgaggcaggaaaatcgctt

SEQ ID NO: 632 - DNA, 32 bp, Homo sapiens
tttaggagaagaggagagacaggcaggaaagg

SEQ ID NO: 633 - DNA, 32 bp, Homo sapiens
actctgtcacccaggctgcagtgcaatggcgc

SEQ ID NO: 634 - DNA, 32 bp, Homo sapiens
accttgacgtcccaggttcaagcgattctctc

SEQ ID NO: 635 - DNA, 32 bp, Homo sapiens
gcagctttctttggggcttcagtgagaactct

SEQ ID NO: 636 - DNA, 32 bp, Homo sapiens
cttcctcatcctgcttctcttttcctcgcaga

SEQ ID NO: 637 - DNA, 32 bp, Homo sapiens
gagccgcatcttctccatctggcagggtggga

SEQ ID NO: 638 - DNA, 21 bp, Homo sapiens
cgactcattggctcactgcag

SEQ ID NO: 639 - DNA, 32 bp, Homo sapiens
tggggacatccctctctaggcctaggccatgt

SEQ ID NO: 640 - DNA, 32 bp, Homo sapiens
ctcttagccctctactgttgaccaatcaccaa

SEQ ID NO: 641 - DNA, 32 bp, Homo sapiens
gagcccaggagttcgaggctgcagtgagctat

SEQ ID NO: 642 - DNA, 32 bp, Homo sapiens
cttgccgcctccatatcatcaagctctggtgg

SEQ ID NO: 643 - DNA, 32 bp, Homo sapiens
agtgctgtttcctggctggagtgcagtggcat

SEQ ID NO: 644 - DNA, 32 bp, Homo sapiens
acctctgcctcctgggttcaagcaattctcgt

SEQ ID NO: 645 - DNA, 32 bp, Homo sapiens
gagcccaggagtttgaggctgcagtgagccat

SEQ ID NO: 646 - DNA, 32 bp, Homo sapiens
gttgcagggaggcggaggttgcagtgagccga

SEQ ID NO: 647 - DNA, 32 bp, Homo sapiens
atgcataggttagagaaatggagagaggcttg

SEQ ID NO: 648 - DNA, 32 bp, Homo sapiens
agattcctgagtagctgggaccacagattact

SEQ ID NO: 649 - DNA, 32 bp, Homo sapiens
agcttcccaagtagctgggattacaggcgtac

SEQ ID NO: 650 - DNA, 21 bp, Homo sapiens
acaggcatgagccaccacggc

SEQ ID NO: 651 - DNA, 32 bp, Homo sapiens
acagagcagctttacaagttgtcacatttctt

SEQ ID NO: 652 - DNA, 32 bp, Homo sapiens
tcctccgctgcagctttccatctcatctcctt

SEQ ID NO: 653 - DNA, 32 bp, Homo sapiens
ggggcctgggacattccatctgaggtccttcc

SEQ ID NO: 654 - DNA, 32 bp, Homo sapiens
cttgtgtcacccaggctggcgtgcagggccct

SEQ ID NO: 655 - DNA, 32 bp, Homo sapiens
ctgagctcaagcaatctgcctgcttcagcctc

SEQ ID NO: 656 - DNA, 32 bp, Homo sapiens
gggatctgcccaggaatgttgtcaagtgtaat

SEQ ID NO: 657 - DNA, 32 bp, Homo sapiens
tttgctagaagagtggtcaagggaaaaacgag

SEQ ID NO: 658 - DNA, 32 bp, Homo sapiens
atgataagaagatggagaagaaaacccgcaaa

SEQ ID NO: 659 - DNA, 32 bp, Homo sapiens
attctatcgcccaggctggagtgcaatggcac

SEQ ID NO: 660 - DNA, 32 bp, Homo sapiens
cctctgagagcctctttggggtgagcagcctt

SEQ ID NO: 661 - DNA, 32 bp, Homo sapiens
cccttctccatcgccctctcccagaaagctcc

SEQ ID NO: 662 - DNA, 32 bp, Homo sapiens
attaaagcctgagactcaggccagaattagga

SEQ ID NO: 663 - DNA, 32 bp, Homo sapiens
cactgtttgcccaggggatgactgcaggaggc

SEQ ID NO: 664 - DNA, 32 bp, Homo sapiens
ctcttgttgcccaggctggagtgcaatgcgcg

SEQ ID NO: 665 - DNA, 20 bp, Homo sapiens
ccaaatggtgaaaccccatc

SEQ ID NO: 666 - DNA, 32 bp, Homo sapiens
gctcatgcctgtaaatcccagcactttggtag

SEQ ID NO: 667 - DNA, 32 bp, Homo sapiens
acgtccgcctcccaggttcaagcgattctcat

SEQ ID NO: 668 - DNA, 32 bp, Homo sapiens
gtgggaaacatcctggattttgttacttggca

SEQ ID NO: 669 - DNA, 23 bp, Homo sapiens
tggcataatcacagctcactgca

SEQ ID NO: 670 - DNA, 32 bp, Homo sapiens
gtccctctgtttccttctcttctctttcctcc

SEQ ID NO: 671 - DNA, 32 bp, Homo sapiens
aacactactttagcttctctcctgaagcctta

SEQ ID NO: 672 - DNA, 32 bp, Homo sapiens
ggctgttatggtgatggatggatgtggatttg

SEQ ID NO: 673 - DNA, 28 bp, Homo sapiens
gccccatcagaggctgcctcctccttct

SEQ ID NO: 674 - DNA, 28 bp, Homo sapiens
tcactgaccccaggggcctcatcctccc

SEQ ID NO: 675 - DNA, 32 bp, Homo sapiens
ttatagagcctaggctggaggaggtacatggg

SEQ ID NO: 676 - DNA, 32 bp, Homo sapiens
gcccagctgcagggagcttctggcctgggacc

SEQ ID NO: 677 - DNA, 32 bp, Homo sapiens
aaaaagagaagaggaaataaaccagacagtgc

SEQ ID NO: 678 - DNA, 32 bp, Homo sapiens
ctcagttgaagaggacgagaggacgaccttct

SEQ ID NO: 679 - DNA, 32 bp, Homo sapiens
gatatcccaagtgacacagaaacacagctcct

SEQ ID NO: 680 - DNA, 32 bp, Homo sapiens
tgctgccccgttctgtcacccagggctcctag

SEQ ID NO: 681 - DNA, 22 bp, Homo sapiens
ctgaccaacatggtgaaaaccc

SEQ ID NO: 682 - DNA, 32 bp, Homo sapiens
cattgccaggcaacaggactaaactacctcca

SEQ ID NO: 683 - DNA, 32 bp, Homo sapiens
ctctagcctgtggcctgctcctggttgaagaa

SEQ ID NO: 684 - DNA, 32 bp, Homo sapiens
atctccgcctccccagttcaagcgattctcct

SEQ ID NO: 685 - DNA, 32 bp, Homo sapiens
tcgtgttcaagcagctcccatgacaacttcca

SEQ ID NO: 686 - DNA, 32 bp, Homo sapiens
agcctccccagtagctgggattacaggcgccc

SEQ ID NO: 687 - DNA, 32 bp, Homo sapiens
tgttcctgagggaggccggtgtggaaagcctt

SEQ ID NO: 688 - DNA, 32 bp, Homo sapiens
ttgagacagggtttcgctgtgttgctccagct

SEQ ID NO: 689 - DNA, 32 bp, Homo sapiens
tgggctcccaaaacacctgacagcccctccct

SEQ ID NO: 690 - DNA, 32 bp, Homo sapiens
aggcctcagtgaggcatctaccaccttctaca

SEQ ID NO: 691 - DNA, 32 bp, Homo sapiens
tcagacccagttctgtcagctctagaggcacc

SEQ ID NO: 692 - DNA, 22 bp, Homo sapiens
ctgaccacttatcaaacccatc

SEQ ID NO: 693 - DNA, 32 bp, Homo sapiens
aaatcaagtcagcttggatcattcaccttaac

SEQ ID NO: 694 - DNA, 32 bp, Homo sapiens
gttgtggatgagctgcaggtgcagtgactcca

SEQ ID NO: 695 - DNA, 32 bp, Homo sapiens
ccatgttggccaggctggtctcgaatgcctgg

SEQ ID NO: 696 - DNA, 32 bp, Homo sapiens
cagatcctaattggaaatttagcaataaggag

SEQ ID NO: 697 - DNA, 32 bp, Homo sapiens
ggcctcctgagtagctggggttgcaggtgtgc

SEQ ID NO: 698 - DNA, 32 bp, Homo sapiens
ctactcgggaggtggaggttgcagtgagccaa

SEQ ID NO: 699 - DNA, 32 bp, Homo sapiens
tggagggggaggcaggaggattgctgtcagcc

SEQ ID NO: 700 - DNA, 32 bp, Homo sapiens
gagctgagcctgattcaaatggtttttctgct

SEQ ID NO: 701 - DNA, 24 bp, Homo sapiens
ctgctgcccaggctagagtgcagt

SEQ ID NO: 702 - DNA, 32 bp, Homo sapiens
agcctcccaagtagctgggattacaggcacat

SEQ ID NO: 703 - DNA, 32 bp, Homo sapiens
ggaggccaaggcgggtcgattacttgaggtca

SEQ ID NO: 704 - DNA, 32 bp, Homo sapiens
ttgctttctgtgtcttggtttctgcctgctgc

SEQ ID NO: 705 - DNA, 32 bp, Homo sapiens
tccagctctgcagtgtggctgcttcttgattc

SEQ ID NO: 706 - DNA, 32 bp, Homo sapiens
tatgttgtgctgctgtccagctgctaagatcc

SEQ ID NO: 707 - DNA, 32 bp, Homo sapiens
aaatcatctccatattctcaggcacagagaaa

SEQ ID NO: 708 - DNA, 32 bp, Homo sapiens
cgatctcctgaccttgaatcacaagagtctta

SEQ ID NO: 709 - DNA, 32 bp, Homo sapiens
gaggtgctcatcctgactcgattgttctgcca

SEQ ID NO: 710 - DNA, 32 bp, Homo sapiens
ctcttattgcccaggctggagtgcagtggcgt

SEQ ID NO: 711 - DNA, 32 bp, Homo sapiens
gttctgtcacctagggtggagtgcagtggcac

SEQ ID NO: 712 - DNA, 28 bp, Homo sapiens
gatatccccaaggctgcctctcccacca

SEQ ID NO: 713 - DNA, 32 bp, Homo sapiens
ctctgtcccccatgctggagtgcagtggcatg

SEQ ID NO: 714 - DNA, 32 bp, Homo sapiens
cagaatcgcccaggccaggctgtggcagatga

SEQ ID NO: 715 - DNA, 32 bp, Homo sapiens
tcttcatctgcagcacgtttcttcctcctgca

SEQ ID NO: 716 - DNA, 32 bp, Homo sapiens
ggaccagatgaggatctgaaatggcagccttt

SEQ ID NO: 717 - DNA, 32 bp, Homo sapiens
ccgggctcacgccattcttccacctcagcctc

SEQ ID NO: 718 - DNA, 32 bp, Homo sapiens
cacagatacctgctgttctcagctccagcttc

SEQ ID NO: 719 - DNA, 32 bp, Homo sapiens
tctgaagaagtccaggtgaattcagctttgga

SEQ ID NO: 720 - DNA, 32 bp, Homo sapiens
aggtatgtagccctgtcacaggacagctcact

SEQ ID NO: 721 - DNA, 32 bp, Homo sapiens
ggtctgttgcccaggctggaatgcagtggtgt

SEQ ID NO: 722 - DNA, 32 bp, Homo sapiens
aaacccgggaggcggaggttgcagtgagccga

SEQ ID NO: 723 - DNA, 32 bp, Homo sapiens
gaacctgggaggcggaagttgcagtgagctga

SEQ ID NO: 724 - DNA, 32 bp, Homo sapiens
ctatattgtccaggctagagtgcagtggctat

SEQ ID NO: 725 - DNA, 32 bp, Homo sapiens
cgacccaggcctgaggggccaggaacttgctg

SEQ ID NO: 726 - DNA, 32 bp, Homo sapiens
ggcctcccagagtgctgggatttacaggcatg

SEQ ID NO: 727 - DNA, 32 bp, Homo sapiens
cagctagaacaagaattcctggagctcaaccc

SEQ ID NO: 728 - DNA, 32 bp, Homo sapiens
agtagccccaaaagcagaaccttgatttgtct

SEQ ID NO: 729 - DNA, 21 bp, Homo sapiens
tgcctgtaatcgcagcacttt

SEQ ID NO: 730 - DNA, 32 bp, Homo sapiens
gatttgggaccttcatatcagcactttggacc

SEQ ID NO: 731 - DNA, 28 bp, Homo sapiens
tattgcctgcatgctgcctgatcttgcg

SEQ ID NO: 732 - DNA, 32 bp, Homo sapiens
gaacccaagaggtcgaggctgcagtgagccaa

SEQ ID NO: 733 - DNA, 24 bp, Homo sapiens
tcacacctgtaatcccagcagttt

SEQ ID NO: 734 - DNA, 32 bp, Homo sapiens
tgggcaggggaaagagaaagaagatgagagat

SEQ ID NO: 735 - DNA, 32 bp, Homo sapiens
gaacccaggttagaaggatgggaagagaaaag

SEQ ID NO: 736 - DNA, 32 bp, Homo sapiens
agctgggtgtcaggctggggttagtgagcagg

SEQ ID NO: 737 - DNA, 24 bp, Homo sapiens
ctgtcgcccagactagagtgcaat

SEQ ID NO: 738 - DNA, 24 bp, Homo sapiens
tcagaaggagggctgggtgcccag

SEQ ID NO: 739 - DNA, 32 bp, Homo sapiens
ttgagacagagtttcactcttgttgtccagtc

SEQ ID NO: 740 - DNA, 32 bp, Homo sapiens
ggatgagagccagtggatgaaattcactaata

SEQ ID NO: 741 - DNA, 18 bp, Homo sapiens
gccatcatcaaccaagaa

SEQ ID NO: 742 - DNA, 32 bp, Homo sapiens
agtgggtgtcagtatggatgtgtctgaatgtg

SEQ ID NO: 743 - DNA, 32 bp, Homo sapiens
gggcctgggaggcataggttgcagtgagccga

SEQ ID NO: 744 - DNA, 32 bp, Homo sapiens
gaacccagcaggcggaggttgcggtgagtcga

SEQ ID NO: 745 - DNA, 32 bp, Homo sapiens
cccacccacccaggctggagccatggataaat

SEQ ID NO: 746 - DNA, 32 bp, Homo sapiens
ccctcgagagctctgtgctccacgccgaggat

SEQ ID NO: 747 - DNA, 32 bp, Homo sapiens
atttaatcaagaaactacctggaaccagtgaa

SEQ ID NO: 748 - DNA, 32 bp, Homo sapiens
atagctcagtgtgcccttgaatccatacagtt

SEQ ID NO: 749 - DNA, 32 bp, Homo sapiens
cggggcaggttagagtcccgatcttggccagg

SEQ ID NO: 750 - DNA, 32 bp, Homo sapiens
ccgggttcaagcagttctcctgcctcaacctc

SEQ ID NO: 751 - DNA, 32 bp, Homo sapiens
aatgatgggttttccatgaaatgtgatgcttc

SEQ ID NO: 752 - DNA, 32 bp, Homo sapiens
tccaccatatttctccccactctgtaccttct

SEQ ID NO: 753 - DNA, 19 bp, Homo sapiens
gcccctgcccctgctgcgg

SEQ ID NO: 754 - DNA, 32 bp, Homo sapiens
cgaggaggaagaggaggaggacagcggccctc

SEQ ID NO: 755 - DNA, 32 bp, Homo sapiens
ttgtagactttcacctggattattgatattct

SEQ ID NO: 756 - DNA, 32 bp, Homo sapiens
gcccagcagctttctctttcagtcccataagg

SEQ ID NO: 757 - DNA, 32 bp, Homo sapiens
ttcctcgcacttctccccactcgtcatctttt

SEQ ID NO: 758 - DNA, 32 bp, Homo sapiens
acagaggagtctcttcccaagagactgctggc

SEQ ID NO: 759 - DNA, 32 bp, Homo sapiens
ttgccaggcccaggctgggtgccctgtggcct

SEQ ID NO: 760 - DNA, 32 bp, Homo sapiens
tcgcagcctgaagcctggattccagcagtgaa

SEQ ID NO: 761 - DNA, 32 bp, Homo sapiens
acctctgtctcctgggttcaagcgattctcct

SEQ ID NO: 762 - DNA, 32 bp, Homo sapiens
tggggagggcccattccatccatcttaggccc

SEQ ID NO: 763 - DNA, 32 bp, Homo sapiens
cttctaggacagcatttctcaaactttaatgt

SEQ ID NO: 764 - DNA, 32 bp, Homo sapiens
aggagagggcctggggctcttgcttcccgaga

SEQ ID NO: 765 - DNA, 32 bp, Homo sapiens
agcctcccgagtagctgggattacaggcgcac

SEQ ID NO: 766 - DNA, 32 bp, Homo sapiens
cacagggtttcacagtctgatgagactgtgcc

SEQ ID NO: 767 - DNA, 23 bp, Homo sapiens
tcacacctgtactcccagcactt

SEQ ID NO: 768 - DNA, 22 bp, Homo sapiens
ggtgaggaaactgcgactggga

SEQ ID NO: 769 - DNA, 32 bp, Homo sapiens
ccttggtcgcctagactggatagtgggggtgg

SEQ ID NO: 770 - DNA, 32 bp, Homo sapiens
ttgacaccggatttagctcttgtcggccttcg

SEQ ID NO: 771 - DNA, 32 bp, Homo sapiens
ggggatttcagctgtgtgcaggcacagatgca

SEQ ID NO: 772 - DNA, 18 bp, Homo sapiens
gcccccacccggtgggta

SEQ ID NO: 773 - DNA, 32 bp, Homo sapiens
gcagatgctaagtctgtaaactgtgaattaac

SEQ ID NO: 774 - DNA, 32 bp, Homo sapiens
cgcctggcagaactgagctcctctgggcagga

SEQ ID NO: 775 - DNA, 32 bp, Homo sapiens
caaaccaaagagaccgttcgtggagtctaatg

SEQ ID NO: 776 - DNA, 32 bp, Homo sapiens
gctctcttgcccaggctggagtgcaatggcac

SEQ ID NO: 777 - DNA, 32 bp, Homo sapiens
tgctctgtcaccaggctggagtgcggtggcat

SEQ ID NO: 778 - DNA, 32 bp, Homo sapiens
aagctgcccttgctgtcctgtgcagtgaaggg

SEQ ID NO: 779 - DNA, 32 bp, Homo sapiens
tcgtatatgaaatgttccttggcagctggact

SEQ ID NO: 780 - DNA, 32 bp, Homo sapiens
cactagaatacatcagcttcaaacattcacaa

SEQ ID NO: 781 - DNA, 28 bp, Homo sapiens
ccagacgtctgtgctgcctggtttgcat

SEQ ID NO: 782 - DNA, 32 bp, Homo sapiens
tgagggcagcaggcctggttgcagctggcgtg

SEQ ID NO: 783 - DNA, 32 bp, Homo sapiens
cactgttgcccaggctggcgtgcagtggtgcg

SEQ ID NO: 784 - DNA, 32 bp, Homo sapiens
tacactctttcaggcctctttctgccttttgt

SEQ ID NO: 785 - DNA, 32 bp, Homo sapiens
taacctcatcttcttcaccatttggcaatgcc

SEQ ID NO: 786 - DNA, 32 bp, Homo sapiens
ggaaggggaagaggaagaagagtgaacaaagc

SEQ ID NO: 787 - DNA, 32 bp, Homo sapiens
ggggaagcctgaggtagtcaacccaggagcca

SEQ ID NO: 788 - DNA, 32 bp, Homo sapiens
taatgagtctgttctggctcccagaagatgcc

SEQ ID NO: 789 - DNA, 32 bp, Homo sapiens
gtcctcagcctatcccctggagcttggatact

SEQ ID NO: 790 - DNA, 32 bp, Homo sapiens
cttctggtgctgctgctgggtggctgctccgg

SEQ ID NO: 791 - DNA, 32 bp, Homo sapiens
ttcctgtccctctctccctttgttgggcaaag

SEQ ID NO: 792 - DNA, 32 bp, Homo sapiens
gggtccagagcctcgtgagaggtcaccgggat

SEQ ID NO: 793 - DNA, 32 bp, Homo sapiens
aaaactggtaacaggctgggtgcaatggctca

SEQ ID NO: 794 - DNA, 32 bp, Homo sapiens
gctttgtcacccaggctggagtgctgtggtgt

SEQ ID NO: 795 - DNA, 32 bp, Homo sapiens
actcttgttgcctagctggagtgcaatggcgc

SEQ ID NO: 796 - DNA, 32 bp, Homo sapiens
tttggctctgctacctgctcctgaagccccgc

SEQ ID NO: 797 - DNA, 32 bp, Homo sapiens
gccttgagctcctgggctcaagcaatcctccc

SEQ ID NO: 798 - DNA, 32 bp, Homo sapiens
gtccgcccaagtgccctcctctcagcaggcgg

SEQ ID NO: 799 - DNA, 32 bp, Homo sapiens
ttgagacagagtctcactcttgttgcccaagc

SEQ ID NO: 800 - DNA, 32 bp, Homo sapiens
tgtttttagagtatgattcagagaccaattta

SEQ ID NO: 801 - DNA, 32 bp, Homo sapiens
catctccatcattactggcttagttttgcttt

SEQ ID NO: 802 - DNA, 32 bp, Homo sapiens
gacttgcacatcctgtcatctgctgtgttaca

SEQ ID NO: 803 - DNA, 32 bp, Homo sapiens
tgctttgttgccaggctggagtgcagtggcgc

SEQ ID NO: 804 - DNA, 32 bp, Homo sapiens
atagaggggaggcagggagagcttgtgggacc

SEQ ID NO: 805 - DNA, 32 bp, Homo sapiens
gggtacaggtgggcataggtgcagtgagtgca

SEQ ID NO: 806 - DNA, 32 bp, Homo sapiens
agcttctgcccagggtgggtgggactgagcag

SEQ ID NO: 807 - DNA, 32 bp, Homo sapiens
aactaatggagtttcattgtaactgtcctttg

SEQ ID NO: 808 - DNA, 32 bp, Homo sapiens
ccttgttgcccaggctggagtgcaatggcgta

SEQ ID NO: 809 - DNA, 32 bp, Homo sapiens
agcctcctgagtagctggggctacaggtgtgt

SEQ ID NO: 810 - DNA, 32 bp, Homo sapiens
gcttgttgcccaggctggagtgcagtggtgca

SEQ ID NO: 811 - DNA, 32 bp, Homo sapiens
gctgtgtcacacaggctggagtgcagtggcgt

SEQ ID NO: 812 - DNA, 32 bp, Homo sapiens
agcctcccaagtggctaagacttaacaaacag

SEQ ID NO: 813 - DNA, 32 bp, Homo sapiens
acttgtcacccaggctggagtgcaatggtgtg

SEQ ID NO: 814 - DNA, 32 bp, Homo sapiens
atggccatgctgggctggagtggctgtggggt

SEQ ID NO: 815 - DNA, 32 bp, Homo sapiens
ggctcatacctgtaatcccagcactttgggag

SEQ ID NO: 816 - DNA, 32 bp, Homo sapiens
ggctcatgcctgtaatcccagcactttgggaa

SEQ ID NO: 817 - DNA, 32 bp, Homo sapiens
gtgagccaccatgcctggccccatgaatacac

SEQ ID NO: 818 - DNA, 19 bp, Homo sapiens
tgtggagataagaagggga

SEQ ID NO: 819 - DNA, 21 bp, Homo sapiens
tgtgggaagggttgccaggga

SEQ ID NO: 820 - DNA, 32 bp, Homo sapiens
gcctgccatcttctccccgaggctgccccagg

SEQ ID NO: 821 - DNA, 32 bp, Homo sapiens
cagcctgaagaaaagaggccactgtgactaca

SEQ ID NO: 822 - DNA, 32 bp, Homo sapiens
cgctctgttgccaggctggagtgcagtggtgc

SEQ ID NO: 823 - DNA, 32 bp, Homo sapiens
tacagagttccttttgctatgtttggtaacat

SEQ ID NO: 824 - DNA, 32 bp, Homo sapiens
gggggtccaggggacatcctggaaggctgggc

SEQ ID NO: 825 - DNA, 32 bp, Homo sapiens
gaacccgggaggcggaagtttcagcgagccga

SEQ ID NO: 826 - DNA, 32 bp, Homo sapiens
cctcagggcccaggcctgagtggtgctgctca

SEQ ID NO: 827 - DNA, 15 bp, Homo sapiens
ccctccctccaggta

SEQ ID NO: 828 - DNA, 32 bp, Homo sapiens
ccgggttcaagcagttctcctgcctcagcccc

SEQ ID NO: 829 - DNA, 32 bp, Homo sapiens
ccaggctgaagtgattctcccatctcaacctc

SEQ ID NO: 830 - DNA, 32 bp, Homo sapiens
ctggtcctgctgctggctgcctctctgctcca

SEQ ID NO: 831 - DNA, 32 bp, Homo sapiens
aatagttctaaaacatgctaacctgacctttt

SEQ ID NO: 832 - DNA, 32 bp, Homo sapiens
atctgaattcttgcttctctctccttttcctt

SEQ ID NO: 833 - DNA, 32 bp, Homo sapiens
taggggccgcctctgtcatctcactagacatt

SEQ ID NO: 834 - DNA, 32 bp, Homo sapiens
tcctgtcacccaggctggagtacagtggcgtg

SEQ ID NO: 835 - DNA, 32 bp, Homo sapiens
tgttcgaggactcgcgggtgtgcagtgcacct

SEQ ID NO: 836 - DNA, 32 bp, Homo sapiens
tctctgtcacccaggctggagtgcagtgcaca

SEQ ID NO: 837 - DNA, 32 bp, Homo sapiens
gaacctgggaggtggaggctgcagtgaaccga

SEQ ID NO: 838 - DNA, 32 bp, Homo sapiens
gaacctgggaagtgcaggttgcagtgagccaa

SEQ ID NO: 839 - DNA, 32 bp, Homo sapiens
gcggcggggaggcagcaggcgcgggagcgggc

SEQ ID NO: 840 - DNA, 32 bp, Homo sapiens
ggctcatgcctgtaatcctagcactttgggag

SEQ ID NO: 841 - DNA, 32 bp, Homo sapiens
ggttcatgcctgtaatcccagcactttgggag

SEQ ID NO: 842 - DNA, 32 bp, Homo sapiens
tgtctctggagtgccctacagccccgcaaact

SEQ ID NO: 843 - DNA, 32 bp, Homo sapiens
tcggctcctcaaggtggtggttgaggagacag

SEQ ID NO: 844 - DNA, 32 bp, Homo sapiens
ttatttgaggagacgaagtgaaaacaaatcta

SEQ ID NO: 845 - DNA, 32 bp, Homo sapiens
ctgggctcaagcaaccctcccgcctccctgct

SEQ ID NO: 846 - DNA, 32 bp, Homo sapiens
cagccgcatccctcccgcagcgacggcggccc

SEQ ID NO: 847 - DNA, 20 bp, Homo sapiens
ctgcagatcgaggcatggga

SEQ ID NO: 848 - DNA, 24 bp, Homo sapiens
gtcacccaggctggagtacaatag

SEQ ID NO: 849 - DNA, 32 bp, Homo sapiens
gcaggctgtccaggctgggcttggtggtcagg

SEQ ID NO: 850 - DNA, 32 bp, Homo sapiens
taactcttgtccaggctggaggagtgcagtcg

SEQ ID NO: 851 - DNA, 32 bp, Homo sapiens
aaatcatgtacatttgaaaatatttgcacaca

SEQ ID NO: 852 - DNA, 32 bp, Homo sapiens
tgagataagaaagagttcctggaaccaggaat

SEQ ID NO: 853 - DNA, 32 bp, Homo sapiens
tttgcccaggctggatggagtgcagtggcgtg

SEQ ID NO: 854 - DNA, 32 bp, Homo sapiens
attagcctggtaaggccgggtgcagtggctca

SEQ ID NO: 855 - DNA, 32 bp, Homo sapiens
aacatctttactcttattgtctggaccttcaa

SEQ ID NO: 856 - DNA, 32 bp, Homo sapiens
ccaggtttaagcaatcctcccacctcagcccc

SEQ ID NO: 857 - DNA, 32 bp, Homo sapiens
agccacccaaagtgctggaattacatgggtga

SEQ ID NO: 858 - DNA, 32 bp, Homo sapiens
gactgtggccttcttctcacagctccactagg

SEQ ID NO: 859 - DNA, 21 bp, Homo sapiens
gggtacaggaagctgtgtgca

SEQ ID NO: 860 - DNA, 32 bp, Homo sapiens
tcaggacctcaaggggctcggctatgagaagg

SEQ ID NO: 861 - DNA, 32 bp, Homo sapiens
gctctgtcgcccaggctggagtgcagtggcct

SEQ ID NO: 862 - DNA, 32 bp, Homo sapiens
tgtttgttttcgaatgccttgttttcatagag

SEQ ID NO: 863 - DNA, 32 bp, Homo sapiens
accttgtcctccatttccttttctcatccaaa

SEQ ID NO: 864 - DNA, 32 bp, Homo sapiens
gttctgttgcctgggctggagtgcagtggcgt

SEQ ID NO: 865 - DNA, 32 bp, Homo sapiens
tctatgttgcccaggctggtctcaggctcctg

SEQ ID NO: 866 - DNA, 32 bp, Homo sapiens
ggtctaattctctcacccaggtgcaaatgacc

SEQ ID NO: 867 - DNA, 32 bp, Homo sapiens
gactgaagcacctgctcctccatgaacctgcc

SEQ ID NO: 868 - DNA, 32 bp, Homo sapiens
gagcctgggaggtggagtttgcagtgagctaa

SEQ ID NO: 869 - DNA, 32 bp, Homo sapiens
gtcagagccctctgggtttgtggagcacacag

SEQ ID NO: 870 - DNA, 32 bp, Homo sapiens
ctcacatggcttgcactcagtgacaccaaatc

SEQ ID NO: 871 - DNA, 32 bp, Homo sapiens
ctgacctctgcagcctctctcatctgccaatt

SEQ ID NO: 872 - DNA, 32 bp, Homo sapiens
cgccgttgcccaggctggagtgcggtggcatg

SEQ ID NO: 873 - DNA, 32 bp, Homo sapiens
gttctgtcacccaggctggagtgcagtgactc

SEQ ID NO: 874 - DNA, 32 bp, Homo sapiens
gggtaaagtaccacctgctactcagaaagcta

SEQ ID NO: 875 - DNA, 32 bp, Homo sapiens
gcctctgcaggtgaccgtaacaacatgcaaat

SEQ ID NO: 876 - DNA, 32 bp, Homo sapiens
gaagccgggaggcggaagttgtggtgagccga

SEQ ID NO: 877 - DNA, 24 bp, Homo sapiens
tcatgcctgtaatcctaacacttt

SEQ ID NO: 878 - DNA, 32 bp, Homo sapiens
cacctgaggttaggagtttgagaccagcctgg

SEQ ID NO: 879 - DNA, 32 bp, Homo sapiens
ttttgaaggtagctatactagcacttttgatc

SEQ ID NO: 880 - DNA, 32 bp, Homo sapiens
ctgctggagccagcgaggggtgcctgcagccg

SEQ ID NO: 881 - DNA, 32 bp, Homo sapiens
cgtgagaagccaaaggtagtttatgtgaaagg

SEQ ID NO: 882 - DNA, 18 bp, Homo sapiens
gccccctccctgtccagg

SEQ ID NO: 883 - DNA, 32 bp, Homo sapiens
atttccttgggatagaggttgtgttggggaat

SEQ ID NO: 884 - DNA, 32 bp, Homo sapiens
tcccctgaacaacctcttggaactctccacat

SEQ ID NO: 885 - DNA, 32 bp, Homo sapiens
agtaatgatttccttagcagaagccgtatttg

SEQ ID NO: 886 - DNA, 32 bp, Homo sapiens
agaggagagagaggagagaggagagagggagg

SEQ ID NO: 887 - DNA, 32 bp, Homo sapiens
acctccgcctcccgggttcaagaagtttccct

SEQ ID NO: 888 - DNA, 32 bp, Homo sapiens
ggactactctggagggctcttctgcctggcat

SEQ ID NO: 889 - DNA, 32 bp, Homo sapiens
gcctttattctgtcttctcttgtcctatctca

SEQ ID NO: 890 - DNA, 32 bp, Homo sapiens
cccttccacctctgttggtttctgcctccctt

SEQ ID NO: 891 - DNA, 32 bp, Homo sapiens
ggccccactgtgctgctcttcaggtccccaca

SEQ ID NO: 892 - DNA, 32 bp, Homo sapiens
aaaggcaacatcctgtcacaggccatgctctg

SEQ ID NO: 893 - DNA, 32 bp, Homo sapiens
gtgactttgcttgtttactttctgcctcagat

SEQ ID NO: 894 - DNA, 32 bp, Homo sapiens
ttcttcaaccagtgatcccccacctcggtcac

SEQ ID NO: 895 - DNA, 32 bp, Homo sapiens
tagcagaagaattggagttggaaggttgcata

SEQ ID NO: 896 - DNA, 32 bp, Homo sapiens
actctgtcacccaggctggaatgcagtggtgt

SEQ ID NO: 897 - DNA, 20 bp, Homo sapiens
ggcaaaagcacttgctctcc

SEQ ID NO: 898 - DNA, 32 bp, Homo sapiens
taaaaagcctgagacgccttacaaaaagcaag

SEQ ID NO: 899 - DNA, 24 bp, Homo sapiens
atcttcctgtccgggctgctgcga

SEQ ID NO: 900 - DNA, 32 bp, Homo sapiens
aaaacgctcagaatttcacactgtgaatccac

SEQ ID NO: 901 - DNA, 32 bp, Homo sapiens
attctgttgcccaagttggagtgcagtggcat

SEQ ID NO: 902 - DNA, 32 bp, Homo sapiens
ctctgttgtccaaggctggagtgtagtagtgc

SEQ ID NO: 903 - DNA, 32 bp, Homo sapiens
gacactctcgttctgtcacccaggctggagtg

SEQ ID NO: 904 - DNA, 32 bp, Homo sapiens
ggttgagggaggcagtaatatgaagtgactgc

SEQ ID NO: 905 - DNA, 32 bp, Homo sapiens
agctcttgcccagagctgtgcagtgcagtggc

SEQ ID NO: 906 - DNA, 32 bp, Homo sapiens
taccccgcctccattccgttgctctctcagtc

SEQ ID NO: 907 - DNA, 32 bp, Homo sapiens
acctccacttcccaggttcaagcgattctcat

SEQ ID NO: 908 - DNA, 32 bp, Homo sapiens
cctccgcgatggcagaggtggaggaaacctta

SEQ ID NO: 909 - DNA, 32 bp, Homo sapiens
gaatccaggaggcagaggttgcaatgagccaa

SEQ ID NO: 910 - DNA, 32 bp, Homo sapiens
catgaggggagaggagacggaggggagtagag

SEQ ID NO: 911 - DNA, 32 bp, Homo sapiens
cccggggcaagaggagggagaaggcagggccg

SEQ ID NO: 912 - DNA, 32 bp, Homo sapiens
ggcccatgcctgtaatcccagcactttggggg

SEQ ID NO: 913 - DNA, 32 bp, Homo sapiens
ttttctgtatgtccttctgttctgccttccgc

SEQ ID NO: 914 - DNA, 32 bp, Homo sapiens
cttgaaggtctgtcttccatctggcaccataa

SEQ ID NO: 915 - DNA, 23 bp, Homo sapiens
tcatgcttgtaatcccaacactt

SEQ ID NO: 916 - DNA, 16 bp, Homo sapiens
agggagggctcagccc

SEQ ID NO: 917 - DNA, 32 bp, Homo sapiens
ccagctgcgccgcggctcacagctgacgatgg

SEQ ID NO: 918 - DNA, 32 bp, Homo sapiens
aagctggtgtccaacagacaccacctgtcaaa

SEQ ID NO: 919 - DNA, 32 bp, Homo sapiens
ctctgtcactcaggctgcagtgcagtggcatg

SEQ ID NO: 920 - DNA, 32 bp, Homo sapiens
tgtgcagggtggcagaggtgcctctgcagaga

SEQ ID NO: 921 - DNA, 32 bp, Homo sapiens
tgttttgcatcaagctggagtactggatggaa

SEQ ID NO: 922 - DNA, 32 bp, Homo sapiens
cagattgcaacaggctgggcttcagtggcagc

SEQ ID NO: 923 - DNA, 23 bp, Homo sapiens
catgcctgtgttacagcagctcc

SEQ ID NO: 924 - DNA, 32 bp, Homo sapiens
ggctcggggcctgggatggcctgtaatcagct

SEQ ID NO: 925 - DNA, 32 bp, Homo sapiens
gagctcaggaggcagaggttgcagtgagccaa

SEQ ID NO: 926 - DNA, 32 bp, Homo sapiens
tcctgttgtgcaggctggagtgcagtggcaca

SEQ ID NO: 927 - DNA, 32 bp, Homo sapiens
gaacactctgcggcttctctgagaaaccctat

SEQ ID NO: 928 - DNA, 32 bp, Homo sapiens
tccagctatcttctcctttccactggtgccag

SEQ ID NO: 929 - DNA, 18 bp, Homo sapiens
tggactgtgtacatctga

SEQ ID NO: 930 - DNA, 23 bp, Homo sapiens
gtcgcccaggctggaatgcagtg

SEQ ID NO: 931 - DNA, 32 bp, Homo sapiens
gttggtgcctgagacaccaaatggaagaagca

SEQ ID NO: 932 - DNA, 32 bp, Homo sapiens
atgctgctgcccaggctggagtgcagtggtgc

SEQ ID NO: 933 - DNA, 32 bp, Homo sapiens
ctgaaacagattctgtcatggaactcaacaga

SEQ ID NO: 934 - DNA, 32 bp, Homo sapiens
ctctgtctcccaggccggagtgcagtggcacg

SEQ ID NO: 935 - DNA, 32 bp, Homo sapiens
ctctgtcgcccaggctggagtgcagtggcacc

SEQ ID NO: 936 - DNA, 32 bp, Homo sapiens
ctctgtcacccaggctggagtgccgtggcacg

SEQ ID NO: 937 - DNA, 32 bp, Homo sapiens
cgctctcctaagtttaattacaacagcacgtg

SEQ ID NO: 938 - DNA, 32 bp, Homo sapiens
gatcaggacaggcagaggtggtcagggagaag

SEQ ID NO: 939 - DNA, 32 bp, Homo sapiens
tctgtcaacgcagactggagtgcagtggcacg

SEQ ID NO: 940 - DNA, 32 bp, Homo sapiens
ccaggttcaagtaattctcctgcctcagcctc

SEQ ID NO: 941 - DNA, 32 bp, Homo sapiens
ccaggttcaagcaattctcttgcctcagcctc

SEQ ID NO: 942 - DNA, 32 bp, Homo sapiens
gaccatgactaccttcacctggaacatcaacc

SEQ ID NO: 943 - DNA, 32 bp, Homo sapiens
tggcctgtgctgctgtcacggtgctaaggggc

SEQ ID NO: 944 - DNA, 32 bp, Homo sapiens
cactcttgcccaggctggagtgcagtggtgcg

SEQ ID NO: 945 - DNA, 32 bp, Homo sapiens
accacccagcttctccctgagggcccaccagc

SEQ ID NO: 946 - DNA, 32 bp, Homo sapiens
tgtttattagttctgtatacagtacaggatct

SEQ ID NO: 947 - DNA, 32 bp, Homo sapiens
ggacccgggaggcggaggttgcagtgagccga

SEQ ID NO: 948 - DNA, 32 bp, Homo sapiens
gaacccgggaggcggaggttgcagtaagccga

SEQ ID NO: 949 - DNA, 32 bp, Homo sapiens
agggtttgcccagtttgcagatgagaaaccca

SEQ ID NO: 950 - DNA, 32 bp, Homo sapiens
tgggctgtggtcacgtgctcccagaagacctg

SEQ ID NO: 951 - DNA, 32 bp, Homo sapiens
gtttcaaactcctggcctcaagcaatcctcct

SEQ ID NO: 952 - DNA, 28 bp, Homo sapiens
gctcctcaacgtgcggcctcatcataag

SEQ ID NO: 953 - DNA, 32 bp, Homo sapiens
tctgtgcttcaaggagcttcagagagattgcc

SEQ ID NO: 954 - DNA, 24 bp, Homo sapiens
aatgaggaaactgaggctcagggg

SEQ ID NO: 955 - DNA, 32 bp, Homo sapiens
ccaggttcaagcgattctcccgcctcagcctc

SEQ ID NO: 956 - DNA, 32 bp, Homo sapiens
acctcatgcaggtgaagccactgtggaaacag

SEQ ID NO: 957 - DNA, 32 bp, Homo sapiens
ctacttgggaggcagaggcaggagaatcgttt

SEQ ID NO: 958 - DNA, 32 bp, Homo sapiens
ctctattactcaggctggagtaaaatggtgcc

SEQ ID NO: 959 - DNA, 32 bp, Homo sapiens
ttctgtcgcccaggctggagtgcaggggcatt

SEQ ID NO: 960 - DNA, 28 bp, Homo sapiens
aggcctctcgctgcctcatcctctgaca

SEQ ID NO: 961 - DNA, 32 bp, Homo sapiens
tgggagcccaggcagaggaggcaccgagagtg

SEQ ID NO: 962 - DNA, 32 bp, Homo sapiens
gaacccaggaggcggaggctgcagtgagccca

SEQ ID NO: 963 - DNA, 32 bp, Homo sapiens
ctgaaccctagtaattctcctatctcagcctc

SEQ ID NO: 964 - DNA, 32 bp, Homo sapiens
atctactaaagtacaaaggaattctttggaag

SEQ ID NO: 965 - DNA, 32 bp, Homo sapiens
ggaggaagagtttgggggctgtggagggaagg

SEQ ID NO: 966 - DNA, 32 bp, Homo sapiens
ctcccagccctctcctcattctctgaacccac

SEQ ID NO: 967 - DNA, 32 bp, Homo sapiens
caagttcgaccagcttctttgtgcctcttttc

SEQ ID NO: 968 - DNA, 32 bp, Homo sapiens
caagtacatcttctcccagattctctggcctt

SEQ ID NO: 969 - DNA, 32 bp, Homo sapiens
ctcttgtcacccaggctggagtgcagtggcgc

SEQ ID NO: 970 - DNA, 32 bp, Homo sapiens
ctcttgtcacccaggctggagtacagtggcac

SEQ ID NO: 971 - DNA, 32 bp, Homo sapiens
ctcttgttacccaggctggagtgcagtggcgt

SEQ ID NO: 972 - DNA, 32 bp, Homo sapiens
gaacccaggaagaggaggttgcagtgagccga

SEQ ID NO: 973 - DNA, 32 bp, Homo sapiens
gggcctgggaggcggaggttgcagtgagccga

SEQ ID NO: 974 - DNA, 32 bp, Homo sapiens
tacagccaagggcactgctcactgtggcccgt

SEQ ID NO: 975 - DNA, 32 bp, Homo sapiens
ggccctcagcgtctccccatgctgggctcact

SEQ ID NO: 976 - DNA, 32 bp, Homo sapiens
tctgtccaggttgaggaatgggctgaacgtgt

SEQ ID NO: 977 - DNA, 32 bp, Homo sapiens
tatgggaagaattccagttgttaggaagagat

SEQ ID NO: 978 - DNA, 32 bp, Homo sapiens
agatgatttctggaacattcagtctagaaaga

SEQ ID NO: 979 - DNA, 32 bp, Homo sapiens
tcacctgttgcagcttcacctgcctggggatt

SEQ ID NO: 980 - DNA, 32 bp, Homo sapiens
agctggcaacttctcccccaggtgccttcccc

SEQ ID NO: 981 - DNA, 32 bp, Homo sapiens
ctctgtcgcccaagctgaagtgcagtggtgcg

SEQ ID NO: 982 - DNA, 32 bp, Homo sapiens
actctgttgcccaggctggagtgcaatggcac

SEQ ID NO: 983 - DNA, 32 bp, Homo sapiens
cttttattgcccaggctggagtgtagtggcgc

SEQ ID NO: 984 - DNA, 32 bp, Homo sapiens
ggcacagggggtcaggcactgtggaaagaagg

SEQ ID NO: 985 - DNA, 28 bp, Homo sapiens
gtttcctcatctgctgcctctccagact

SEQ ID NO: 986 - DNA, 32 bp, Homo sapiens
ctctgtcgccaaagttggagtgcagtggcgcg

SEQ ID NO: 987 - DNA, 32 bp, Homo sapiens
gctctgtcacccaggctggagtgcaatggcat

SEQ ID NO: 988 - DNA, 32 bp, Homo sapiens
gaggatcacctgagactggagatgtagaggct

SEQ ID NO: 989 - DNA, 32 bp, Homo sapiens
ttaacaattttcatgtcccccacctcatgttt

SEQ ID NO: 990 - DNA, 32 bp, Homo sapiens
catgcctgtgttctcccccggggccacttaga

SEQ ID NO: 991 - DNA, 24 bp, Homo sapiens
tcacacccataatcccagcacttt

SEQ ID NO: 992 - DNA, 32 bp, Homo sapiens
ggagctggaagaggaggaggaggagaggcggc

SEQ ID NO: 993 - DNA, 28 bp, Homo sapiens
ccagctcccagtgctgctgtcctctgat

SEQ ID NO: 994 - DNA, 32 bp, Homo sapiens
tgcaaagattgatggtagagagcttgactttt

SEQ ID NO: 995 - DNA, 32 bp, Homo sapiens
caaatcaggcctgcctcctgaatttgtaaata

SEQ ID NO: 996 - DNA, 32 bp, Homo sapiens
caactgggatttggggagctgtggagggtgca

SEQ ID NO: 997 - DNA, 32 bp, Homo sapiens
tggtaagacttctgggttcatgaagtttcggc

SEQ ID NO: 998 - DNA, 32 bp, Homo sapiens
tttcttgcagcagaagaaagaagagacaggag

SEQ ID NO: 999 - DNA, 32 bp, Homo sapiens
aggccaaggaaggaggaatgcttgagcccaag

SEQ ID NO: 1000 - DNA, 32 bp, Homo sapiens
tctgagttaattggactggagcgcagtcggac

SEQ ID NO: 1001 - DNA, 32 bp, Homo sapiens
tcagcatttccttgtcccgtctggacctgggg

SEQ ID NO: 1002 - DNA, 32 bp, Homo sapiens
gagagacattggagagaaaatgactgtctcct

SEQ ID NO: 1003 - DNA, 32 bp, Homo sapiens
tgtaggcagtttagtgcatctttgcctctcag

SEQ ID NO: 1004 - DNA, 32 bp, Homo sapiens
tctccctgcatgacagtcccccagaaacttag

SEQ ID NO: 1005 - DNA, 32 bp, Homo sapiens
gacgtgtccatggacttctcccaggaggagtg

SEQ ID NO: 1006 - DNA, 32 bp, Homo sapiens
tgggccttcttagagggttcagtctaggaccc

SEQ ID NO: 1007 - DNA, 32 bp, Homo sapiens
ctcacggagccagcggccgggtaggatgcaga

SEQ ID NO: 1008 - DNA, 32 bp, Homo sapiens
ccggctcaagtgctgctctggcaaagctccgg

SEQ ID NO: 1009 - DNA, 32 bp, Homo sapiens
cctaagcctggccctatccacagggtccctgg

SEQ ID NO: 1010 - DNA, 32 bp, Homo sapiens
tgaattacaggcagctgttcaaactcttcagg

SEQ ID NO: 1011 - DNA, 32 bp, Homo sapiens
tcactgtcaccaggctggagtgcagtggtgca

SEQ ID NO: 1012 - DNA, 32 bp, Homo sapiens
ttgcaaaatgttctttcagtttttagaacctc

SEQ ID NO: 1013 - DNA, 32 bp, Homo sapiens
cttttaaatgttctctctgggagcttcatata

SEQ ID NO: 1014 - DNA, 32 bp, Homo sapiens
ggccgctagcgcacaggaaaatcctacctgat

SEQ ID NO: 1015 - DNA, 32 bp, Homo sapiens
tgttccccaagtgtcctggaaatttgcctggt

SEQ ID NO: 1016 - DNA, 32 bp, Homo sapiens
cccccatgcccaggtgtggtgaagtgaatccc

SEQ ID NO: 1017 - DNA, 32 bp, Homo sapiens
ggcacatgcctgtgatcccagcactttgggat

SEQ ID NO: 1018 - DNA, 32 bp, Homo sapiens
cgagccggaggcagctgggaaacatgaagagc

SEQ ID NO: 1019 - DNA, 32 bp, Homo sapiens
caccttgaccaccaaaggaactacctatccag

SEQ ID NO: 1020 - DNA, 32 bp, Homo sapiens
ctagcagcatccctgcagcaggcacagagcca

SEQ ID NO: 1021 - DNA, 32 bp, Homo sapiens
gagagggagcctgtcgtctcccagggaataaa

SEQ ID NO: 1022 - DNA, 32 bp, Homo sapiens
ctctgtcattcaggctggagtgcagtggtgcg

SEQ ID NO: 1023 - DNA, 32 bp, Homo sapiens
actttagcagttcttccatctgactcaggttt

SEQ ID NO: 1024 - DNA, 32 bp, Homo sapiens
gctgcaggtttagaggaccagtgagttgggag

SEQ ID NO: 1025 - DNA, 32 bp, Homo sapiens
ctttgttgcccaggctggagtgcaatggcgca

SEQ ID NO: 1026 - DNA, 32 bp, Homo sapiens
ctttgtcacccaggctggagtgcaatggcgtg

SEQ ID NO: 1027 - DNA, 32 bp, Homo sapiens
ctctgtctcccaggctggagttgcagtggtgc

SEQ ID NO: 1028 - DNA, 28 bp, Homo sapiens
acagccaggccggctgcctcatctcagc

SEQ ID NO: 1029 - DNA, 32 bp, Homo sapiens
ggtcccgcgagtgccctataaggactgccagg

SEQ ID NO: 1030 - DNA, 32 bp, Homo sapiens
gggaggctgaggcagaagtattgcttgaaccc

SEQ ID NO: 1031 - DNA, 32 bp, Homo sapiens
ctcttgtcacctagactggagtgcaatggcgt

SEQ ID NO: 1032 - DNA, 32 bp, Homo sapiens
ggcagatcatgcatctttgagtgcagtttggt

SEQ ID NO: 1033 - DNA, 28 bp, Homo sapiens
gggctcccctgtgctgcctagctcgtct

SEQ ID NO: 1034 - DNA, 32 bp, Homo sapiens
atgacttcctcaaactgacaccatcttaatta

SEQ ID NO: 1035 - DNA, 32 bp, Homo sapiens
gaatgaatatgtttccccatcttgtgcccttt

SEQ ID NO: 1036 - DNA, 32 bp, Homo sapiens
agaaaaggaagaggaaggaaggaaatattttg

SEQ ID NO: 1037 - DNA, 32 bp, Homo sapiens
gcgccatcatgggctgatttttattaccaggt

SEQ ID NO: 1038 - DNA, 32 bp, Homo sapiens
tcttgttgcccaggctagagggcaatggtgca

SEQ ID NO: 1039 - DNA, 32 bp, Homo sapiens
ggttagcattaccttaatctttgttgctcaag

SEQ ID NO: 1040 - DNA, 32 bp, Homo sapiens
tgggctgcatgggctgcttttattcatggtgg

SEQ ID NO: 1041 - DNA, 32 bp, Homo sapiens
tgcctgacaagtgcctgacacgcagcctagtt

SEQ ID NO: 1042 - DNA, 32 bp, Homo sapiens
gcataagggcagcagaggtggagtagggagga

SEQ ID NO: 1043 - DNA, 32 bp, Homo sapiens
tgccagaggaggcagcgggattgtagtggcgc

SEQ ID NO: 1044 - DNA, 32 bp, Homo sapiens
ttgtcccccagaacatgacctagaggtacctg

SEQ ID NO: 1045 - DNA, 32 bp, Homo sapiens
agcctctgctgctcctgctcctgggtttgaag

SEQ ID NO: 1046 - DNA, 32 bp, Homo sapiens
gtcttgaactcctgggttcaagcagtcttcct

SEQ ID NO: 1047 - DNA, 32 bp, Homo sapiens
ttgagatggagtttcgtgcttgttgcccaggc

SEQ ID NO: 1048 - DNA, 32 bp, Homo sapiens
agaggcgccttctcttctctgggcattccccg

SEQ ID NO: 1049 - DNA, 32 bp, Homo sapiens
cccagctgcccaggctgaggcaagagaaggcc

SEQ ID NO: 1050 - DNA, 32 bp, Homo sapiens
tttaatttggttgaacatttgctgctaatggg

SEQ ID NO: 1051 - DNA, 32 bp, Homo sapiens
gtctccaactcctggactcaagcaatctgccc

SEQ ID NO: 1052 - DNA, 32 bp, Homo sapiens
gaacccgggagggagaggttgcagtgagccaa

SEQ ID NO: 1053 - DNA, 32 bp, Homo sapiens
ttagtcgggaggctgaggcaggagaatatgga

SEQ ID NO: 1054 - DNA, 32 bp, Homo sapiens
tccctcaggcctgggcggtgcagcttccagag

SEQ ID NO: 1055 - DNA, 32 bp, Homo sapiens
atccaggtcttggggagctcaggacttgggct

SEQ ID NO: 1056 - DNA, 32 bp, Homo sapiens
ctctcatgatccacctgccccgggagggcagc

SEQ ID NO: 1057 - DNA, 32 bp, Homo sapiens
actcattgcacatcttctcttcagtttagaga

SEQ ID NO: 1058 - DNA, 32 bp, Homo sapiens
gtgatagttaccttcacaatggtgctacccct

SEQ ID NO: 1059 - DNA, 32 bp, Homo sapiens
ctggactcaagcaatctgcccaccttggcctt

SEQ ID NO: 1060 - DNA, 32 bp, Homo sapiens
agcatggtactttcactcagcttaacatgcag

SEQ ID NO: 1061 - DNA, 22 bp, Homo sapiens
ctggagaggtgatcctgaattg

SEQ ID NO: 1062 - DNA, 32 bp, Homo sapiens
gaaccccctgcagctctcttgtggacccctgc

SEQ ID NO: 1063 - DNA, 23 bp, Homo sapiens
gtcacccaggctggagtacagtg

SEQ ID NO: 1064 - DNA, 23 bp, Homo sapiens
gtcacccagactggagtgcagtg

SEQ ID NO: 1065 - DNA, 32 bp, Homo sapiens
ctccaccttctctggtcttcagtccagcactg

SEQ ID NO: 1066 - DNA, 32 bp, Homo sapiens
agcctgggcgggtgcaggagatcgtgggcgcc

SEQ ID NO: 1067 - DNA, 32 bp, Homo sapiens
gctctgtcaccaggcttgagtgcagtggtgtg

SEQ ID NO: 1068 - DNA, 32 bp, Homo sapiens
gtcaccctcgttctgtctgccacctgaaggga

SEQ ID NO: 1069 - DNA, 32 bp, Homo sapiens
ctgggttcaagcaattctcctgcctcagcttc

SEQ ID NO: 1070 - DNA, 32 bp, Homo sapiens
ccgcaattaacaacaggaaacaatctgaacag

SEQ ID NO: 1071 - DNA, 32 bp, Homo sapiens
ttgtaatccagtgccctacaaaggctagaaca

SEQ ID NO: 1072 - DNA, 24 bp, Homo sapiens
tcacgccactaatcccaacatttt

SEQ ID NO: 1073 - DNA, 32 bp, Homo sapiens
ctgggctcaagcaatcctcctgcctcagcctt

SEQ ID NO: 1074 - DNA, 32 bp, Homo sapiens
ttcccttcaagcatctccctcatcctggactc

SEQ ID NO: 1075 - DNA, 32 bp, Homo sapiens
gacacgtcttccctgtgaaaggcacaggaaga

SEQ ID NO: 1076 - DNA, 32 bp, Homo sapiens
tcactgtctgcagctgcctgtctggtgtctgt

SEQ ID NO: 1077 - DNA, 32 bp, Homo sapiens
cctagacatcttctccctcccttgcctcagat

SEQ ID NO: 1078 - DNA, 32 bp, Homo sapiens
agcacaggaatcttcttcttggcagctgcagt

SEQ ID NO: 1079 - DNA, 32 bp, Homo sapiens
ggctataaaataaaggcttcaaattcttcaaa

SEQ ID NO: 1080 - DNA, 32 bp, Homo sapiens
gttggagggaggcagggaatctggcttgattg

SEQ ID NO: 1081 - DNA, 32 bp, Homo sapiens
ctctgttgcccaggttagagtgcagtggcttg

SEQ ID NO: 1082 - DNA, 32 bp, Homo sapiens
ggatggtgatgtcggctgggtgcagtggctca

SEQ ID NO: 1083 - DNA, 32 bp, Homo sapiens
agcctcccaggtagctgggactatgggtgcac

SEQ ID NO: 1084 - DNA, 32 bp, Homo sapiens
tcttccccaacaacagatagctcaccttggac

SEQ ID NO: 1085 - DNA, 32 bp, Homo sapiens
atggcaagatgccatatcctggaaacatatta

SEQ ID NO: 1086 - DNA, 32 bp, Homo sapiens
gaagagagaagaggaagaggaagaggaagaga

SEQ ID NO: 1087 - DNA, 32 bp, Homo sapiens
ggctcatgcctgtaatcctagcactttgggaa

SEQ ID NO: 1088 - DNA, 32 bp, Homo sapiens
tcaaattaaggaagctctgaatgtgatttgtg

SEQ ID NO: 1089 - DNA, 32 bp, Homo sapiens
aatggcgagatctcctggagtgggggatattc

SEQ ID NO: 1090 - DNA, 24 bp, Homo sapiens
tcatgcctgtaatccaagcatttt

SEQ ID NO: 1091 - DNA, 17 bp, Homo sapiens
caggacaagccacctga

SEQ ID NO: 1092 - DNA, 23 bp, Homo sapiens
ctgtcaccaggctagagtgcagt

SEQ ID NO: 1093 - DNA, 23 bp, Homo sapiens
ctgtcgccaggctggagtgcagt

SEQ ID NO: 1094 - DNA, 24 bp, Homo sapiens
caggcagggacctcctgggcccag

SEQ ID NO: 1095 - DNA, 32 bp, Homo sapiens
tagaaatagacttagctgggtgcagtggctca

SEQ ID NO: 1096 - DNA, 32 bp, Homo sapiens
gatggatctttctcaggactggcagttacccg

SEQ ID NO: 1097 - DNA, 32 bp, Homo sapiens
agcctcccaagtagctggtaccacaggcgcca

SEQ ID NO: 1098 - DNA, 32 bp, Homo sapiens
ctaaagtcaagcaaatgttctagcccttcagg

SEQ ID NO: 1099 - DNA, 32 bp, Homo sapiens
cccgacgacggcgacttcctgcgcacgccgcg

SEQ ID NO: 1100 - DNA, 32 bp, Homo sapiens
gtctcaaactcctgggctcaagcaatccaccc

SEQ ID NO: 1101 - DNA, 32 bp, Homo sapiens
ggcgtgtggggctctttcagggaccacagagg

SEQ ID NO: 1102 - DNA, 32 bp, Homo sapiens
ataatcctatattgagcttcagtggagaataa

SEQ ID NO: 1103 - DNA, 24 bp, Homo sapiens
tcacgcctgaaatcccagcacttt

SEQ ID NO: 1104 - DNA, 32 bp, Homo sapiens
acagagatggggtcttgctttgttgcccaggc

SEQ ID NO: 1105 - DNA, 32 bp, Homo sapiens
tatctgtgtccggcggccccagctccagccca

SEQ ID NO: 1106 - DNA, 32 bp, Homo sapiens
tcctccacctgagacgagcacagggtctccac

SEQ ID NO: 1107 - DNA, 32 bp, Homo sapiens
tctttgttacccaggctggagtacagtggtgt

SEQ ID NO: 1108 - DNA, 32 bp, Homo sapiens
tataaaaatcagctcttggaatatatgttgca

SEQ ID NO: 1109 - DNA, 32 bp, Homo sapiens
tgaatgcagaagcagagccactgtgaagtaag

SEQ ID NO: 1110 - DNA, 32 bp, Homo sapiens
tattcatcaagtgccctctagctgttaagtca

SEQ ID NO: 1111 - DNA, 32 bp, Homo sapiens
tctcgttgccaaggctggagtgcaatggcacg

SEQ ID NO: 1112 - DNA, 32 bp, Homo sapiens
aattgaaatgttcttaatagctaagttttaaa

SEQ ID NO: 1113 - DNA, 32 bp, Homo sapiens
agcctcccgagtagctgggattacaggaagat

SEQ ID NO: 1114 - DNA, 32 bp, Homo sapiens
tggggagtcggggccttcctgggagctggaac

SEQ ID NO: 1115 - DNA, 28 bp, Homo sapiens
ccctagaagtgctctgcctcattccctg

SEQ ID NO: 1116 - DNA, 32 bp, Homo sapiens
atatgaaatttccaaaacaggcaaatccataa

SEQ ID NO: 1117 - DNA, 32 bp, Homo sapiens
cagtactcacccagggactccagttcacaggc

SEQ ID NO: 1118 - DNA, 32 bp, Homo sapiens
ctgggctcaagtgatcctcccacctctgcctc

SEQ ID NO: 1119 - DNA, 32 bp, Homo sapiens
attcctcctcaaggcaccagtgtggagggcat

SEQ ID NO: 1120 - DNA, 32 bp, Homo sapiens
aattctcatcttctctcctcttctccctttta

SEQ ID NO: 1121 - DNA, 32 bp, Homo sapiens
gctcaccattggagaatcagctcactgctctc

SEQ ID NO: 1122 - DNA, 32 bp, Homo sapiens
ctctgtcgcccaggctagagtggattggcgtg

SEQ ID NO: 1123 - DNA, 32 bp, Homo sapiens
catgagccaattctgtcacagtccgaaataga

SEQ ID NO: 1124 - DNA, 32 bp, Homo sapiens
cattgttcagtcaaaacataccacagaatggg

SEQ ID NO: 1125 - DNA, 32 bp, Homo sapiens
acctccgcctcccgggttcaagtgattcccct

SEQ ID NO: 1126 - DNA, 32 bp, Homo sapiens
acctccgcctcctgggttcaagcgattctctt

SEQ ID NO: 1127 - DNA, 32 bp, Homo sapiens
tggggctgcccaggcaaagtcagtgaacatga

SEQ ID NO: 1128 - DNA, 32 bp, Homo sapiens
acctcctcctcttgggttcaagcgattctcct

SEQ ID NO: 1129 - DNA, 32 bp, Homo sapiens
gcctccgcctcctgggttcaagtggttctcct

SEQ ID NO: 1130 - DNA, 32 bp, Homo sapiens
acctccgcctcctgggttcaagtgattctcct

SEQ ID NO: 1131 - DNA, 22 bp, Homo sapiens
tcacgcctgtaatcccagcact

SEQ ID NO: 1132 - DNA, 32 bp, Homo sapiens
aagggtaaccgattggggtaggtggtggtagt

SEQ ID NO: 1133 - DNA, 32 bp, Homo sapiens
tgggtatcaagcaaatctgaccacatcacctc

SEQ ID NO: 1134 - DNA, 32 bp, Homo sapiens
gaggtgatgcccaaggtgcaccacctttcaag

SEQ ID NO: 1135 - DNA, 32 bp, Homo sapiens
ttgtctcttcacgcccatcttctgcctcatag

SEQ ID NO: 1136 - DNA, 32 bp, Homo sapiens
cctggggctgacagagcaagacactgtctcaa

SEQ ID NO: 1137 - DNA, 32 bp, Homo sapiens
gctctgttgcccaggctggagtccagtggcat

SEQ ID NO: 1138 - DNA, 32 bp, Homo sapiens
ttttgattctgggctgagttattacaattatg

SEQ ID NO: 1139 - DNA, 32 bp, Homo sapiens
agtacccgttttaagtaagacatggttttcca

SEQ ID NO: 1140 - DNA, 22 bp, Homo sapiens
gctttgacccccaaccttctcc

SEQ ID NO: 1141 - DNA, 32 bp, Homo sapiens
gctctgtcgcccagcctggagtgcagtggcac

SEQ ID NO: 1142 - DNA, 32 bp, Homo sapiens
ctctattgcccaggctggagtgcactggcgtg

SEQ ID NO: 1143 - DNA, 32 bp, Homo sapiens
gcaggtctccagctgaatctgtgcctacaaat

SEQ ID NO: 1144 - DNA, 32 bp, Homo sapiens
acccgtgtatgttatgaaaacatggtttgata

SEQ ID NO: 1145 - DNA, 32 bp, Homo sapiens
gcactttcacccagaaccaatgcggtgtttct

SEQ ID NO: 1146 - DNA, 32 bp, Homo sapiens
gaattcgcgaggcagaggttgcagcgaaccca

SEQ ID NO: 1147 - DNA, 32 bp, Homo sapiens
gaacctgggaggtggaggttgcagcgagccaa

SEQ ID NO: 1148 - DNA, 32 bp, Homo sapiens
taaaatagcattagagcaagttgcttgtcatg

SEQ ID NO: 1149 - DNA, 32 bp, Homo sapiens
agggctgggcaaggaaaaagaaaataaagaca

SEQ ID NO: 1150 - DNA, 32 bp, Homo sapiens
tatacaagcattaaactggagtgcagtaaacc

SEQ ID NO: 1151 - DNA, 32 bp, Homo sapiens
cgagcaactgtcagcatttttctgcctgcctg

SEQ ID NO: 1152 - DNA, 21 bp, Homo sapiens
tgtggaagggggaaaagggga

SEQ ID NO: 1153 - DNA, 32 bp, Homo sapiens
acattctcatttctaaacatctggatctgggt

SEQ ID NO: 1154 - DNA, 32 bp, Homo sapiens
gtttgcgccgactccgtctcccagaaatcaac

SEQ ID NO: 1155 - DNA, 32 bp, Homo sapiens
ttctccattcaaggagcttgtagctctgagct

SEQ ID NO: 1156 - DNA, 32 bp, Homo sapiens
catcctcagcccctctgccaccaccttaaata

SEQ ID NO: 1157 - DNA, 32 bp, Homo sapiens
ttgtgacggagtttccctcttgttgcccaggc

SEQ ID NO: 1158 - DNA, 32 bp, Homo sapiens
agggaaaagccaccttcccaggcacagccata

SEQ ID NO: 1159 - DNA, 32 bp, Homo sapiens
cattagctagagagcaaaccccagaaagccta

SEQ ID NO: 1160 - DNA, 19 bp, Homo sapiens
tgctggtgacgtgcaggtg

SEQ ID NO: 1161 - DNA, 32 bp, Homo sapiens
acctctgcctcttgggttcaagcaattctcat

SEQ ID NO: 1162 - DNA, 28 bp, Homo sapiens
aagttcccaagtgattgctggtccaggg

SEQ ID NO: 1163 - DNA, 32 bp, Homo sapiens
gtgtgtcgggggcagagggaaggagggaagga

SEQ ID NO: 1164 - DNA, 24 bp, Homo sapiens
tgatacaatcttggctcactgcag

SEQ ID NO: 1165 - DNA, 32 bp, Homo sapiens
ctgggttcaagcaattcttctgcctcagcctc

SEQ ID NO: 1166 - DNA, 24 bp, Homo sapiens
ttgttgtccaggctggagtgcagt

SEQ ID NO: 1167 - DNA, 32 bp, Homo sapiens
taatcagaagctaagctgggtgcagtggctca

SEQ ID NO: 1168 - DNA, 32 bp, Homo sapiens
agaggacacagtctgtcatccccactggaaag

SEQ ID NO: 1169 - DNA, 32 bp, Homo sapiens
gagggattgatgctggttatctctctgaatct

SEQ ID NO: 1170 - DNA, 32 bp, Homo sapiens
accaaatcaacaacaacctatttagctgttcc

SEQ ID NO: 1171 - DNA, 32 bp, Homo sapiens
gagcccaggaagcggaggttgcaatgagccga

SEQ ID NO: 1172 - DNA, 32 bp, Homo sapiens
aggagaatggtgcggagcttgcagtgagccga

SEQ ID NO: 1173 - DNA, 32 bp, Homo sapiens
gcagcagctgacactttttcccagaagggaga

SEQ ID NO: 1174 - DNA, 32 bp, Homo sapiens
atgattctgagcacatggtttctgcctccagc

SEQ ID NO: 1175 - DNA, 21 bp, Homo sapiens
tgtgggaaggggaaatggagg

SEQ ID NO: 1176 - DNA, 32 bp, Homo sapiens
ccacgcccagttctaccagtgccacagccttc

SEQ ID NO: 1177 - DNA, 32 bp, Homo sapiens
aaggactggacttggcttatttcttcctgtct

SEQ ID NO: 1178 - DNA, 32 bp, Homo sapiens
ctcatggtggcttggctttgactctccaaaga

SEQ ID NO: 1179 - DNA, 32 bp, Homo sapiens
gttagatcaccatgctgcaacatggtttatat

SEQ ID NO: 1180 - DNA, 32 bp, Homo sapiens
ccacacgtttgtctgttgagtgcagcgacaag

SEQ ID NO: 1181 - DNA, 32 bp, Homo sapiens
gaaatggagggtggaaggtgtgatctgtggga

SEQ ID NO: 1182 - DNA, 32 bp, Homo sapiens
atgccttaatatttgcatgataagctagtttt

SEQ ID NO: 1183 - DNA, 32 bp, Homo sapiens
acctctgccacccatgttcaagcgattctcct

SEQ ID NO: 1184 - DNA, 28 bp, Homo sapiens
ccaggttcagtagctgcctcgtctggct

SEQ ID NO: 1185 - DNA, 24 bp, Homo sapiens
tcacacctgtaatcccaggacttt

SEQ ID NO: 1186 - DNA, 32 bp, Homo sapiens
gcaccaggttgctctggaagagcttgaggatg

SEQ ID NO: 1187 - DNA, 32 bp, Homo sapiens
agcctcccaagtagctgggattacaggcaccc

SEQ ID NO: 1188 - DNA, 20 bp, Homo sapiens
tgaccacacagcctacaccc

SEQ ID NO: 1189 - DNA, 32 bp, Homo sapiens
gtcccattagagatgtatcaccaccttgtcac

SEQ ID NO: 1190 - DNA, 32 bp, Homo sapiens
cagggctgactccctctcaggtggaaggcagg

SEQ ID NO: 1191 - DNA, 32 bp, Homo sapiens
gtctgccaggctgggagctggagcttgctgag

SEQ ID NO: 1192 - DNA, 32 bp, Homo sapiens
ggcccagggggcagctggagtggtgctctggg

SEQ ID NO: 1193 - DNA, 24 bp, Homo sapiens
tcacgtatgtaatcccagcacttt

SEQ ID NO: 1194 - DNA, 32 bp, Homo sapiens
gaaagaaagaaagagaaaagaaaagaaaagca

SEQ ID NO: 1195 - DNA, 32 bp, Homo sapiens
gtaacctcaagtgatgctcccacctcagcctc

SEQ ID NO: 1196 - DNA, 32 bp, Homo sapiens
ttcagagcctccacaccatgacctccaagaag

SEQ ID NO: 1197 - DNA, 32 bp, Homo sapiens
ttagtggatacttgggctacttccaccttttg

SEQ ID NO: 1198 - DNA, 32 bp, Homo sapiens
ctccccttatgattactaaatattttattttg

SEQ ID NO: 1199 - DNA, 32 bp, Homo sapiens
gcagaggctgggggagggatgcagtgactttt

SEQ ID NO: 1200 - DNA, 32 bp, Homo sapiens
gaacccgggaggcggagcttacagtgagctga

SEQ ID NO: 1201 - DNA, 32 bp, Homo sapiens
gggcccgggagtttgaagttgcagtgagctat

SEQ ID NO: 1202 - DNA, 32 bp, Homo sapiens
acctccgcctcccatgttcaagcgattctcct

SEQ ID NO: 1203 - DNA, 28 bp, Homo sapiens
gcgctccagctagctgcctcatcaaaaa

SEQ ID NO: 1204 - DNA, 28 bp, Homo sapiens
acatttataagtgctgcttacatcactg

SEQ ID NO: 1205 - DNA, 32 bp, Homo sapiens
tcgatctcctctgagcctcttctgccccctgt

SEQ ID NO: 1206 - DNA, 32 bp, Homo sapiens
cagctcctgagtagctgggcctgtgcactggg

SEQ ID NO: 1207 - DNA, 32 bp, Homo sapiens
acctccacctcccaggttcaagtgattctcat

SEQ ID NO: 1208 - DNA, 32 bp, Homo sapiens
ctcttgtcaaccagattggagtgcagtggtgc

SEQ ID NO: 1209 - DNA, 32 bp, Homo sapiens
ggtcaggattgaaagagaaatatttcaacacc

SEQ ID NO: 1210 - DNA, 32 bp, Homo sapiens
ctccctttggtgacctgaagtcactgtgacag

SEQ ID NO: 1211 - DNA, 32 bp, Homo sapiens
gtgttgggcagggtggtttcaaacttctggcc

SEQ ID NO: 1212 - DNA, 32 bp, Homo sapiens
agcttcttgcccaggcagagagagcaggagcg

SEQ ID NO: 1213 - DNA, 19 bp, Homo sapiens
gaggcagccaccccagaga

SEQ ID NO: 1214 - DNA, 32 bp, Homo sapiens
tcctctagcctctgctggagtgcagtgaggat

SEQ ID NO: 1215 - DNA, 32 bp, Homo sapiens
actcggcagctttgagccctggcacagcttcg

SEQ ID NO: 1216 - DNA, 18 bp, Homo sapiens
cagggccctcttcagccc

SEQ ID NO: 1217 - DNA, 32 bp, Homo sapiens
tcgccccagttagcagggtggctgcattccag

SEQ ID NO: 1218 - DNA, 32 bp, Homo sapiens
aatctacatccctctgttgtatacaggaatct

SEQ ID NO: 1219 - DNA, 32 bp, Homo sapiens
aatgagacaggaagctgttcactgtgaaacag

SEQ ID NO: 1220 - DNA, 32 bp, Homo sapiens
tcggcggatttgaccaaattgttttcaagttc

SEQ ID NO: 1221 - DNA, 32 bp, Homo sapiens
cgccacccaagtgccaagacacagcagggcca

SEQ ID NO: 1222 - DNA, 32 bp, Homo sapiens
ggagccgtggggcctggatgtggactgtgcag

SEQ ID NO: 1223 - DNA, 32 bp, Homo sapiens
ccaggatggtctcgatcccctgatctcgtgat

SEQ ID NO: 1224 - DNA, 31 bp, Homo sapiens
actggcaaccacacaactcagggaaaggaat

SEQ ID NO: 1225 - DNA, 32 bp, Homo sapiens
tccaaaatttactaatacagaagcttgacaag

SEQ ID NO: 1226 - DNA, 32 bp, Homo sapiens
catttgctgtgtagctgggacagttacatttc

SEQ ID NO: 1227 - DNA, 24 bp, Homo sapiens
tggcacaatcattgctcactgtag

SEQ ID NO: 1228 - DNA, 32 bp, Homo sapiens
tttagcctgaaccttgaaggtgtttgttcaga

SEQ ID NO: 1229 - DNA, 32 bp, Homo sapiens
cttatccgttaaggctggaggcacatgtgggt

SEQ ID NO: 1230 - DNA, 28 bp, Homo sapiens
attaactcatgtacagcctcatcctgta

SEQ ID NO: 1231 - DNA, 32 bp, Homo sapiens
attaccaatttgaggcccaacaacagtgtatt

SEQ ID NO: 1232 - DNA, 32 bp, Homo sapiens
ggcctagcagccattccactccatgtctcact

SEQ ID NO: 1233 - DNA, 24 bp, Homo sapiens
caggactggatcccattgcctgga

SEQ ID NO: 1234 - DNA, 32 bp, Homo sapiens
agcctcccgagtagctgggattacaggcacgc

SEQ ID NO: 1235 - DNA, 32 bp, Homo sapiens
gtctcaaacttctgggctcaagcaattcatct

SEQ ID NO: 1236 - DNA, 32 bp, Homo sapiens
ggggagcagcttttggggctcagaggccagtc

SEQ ID NO: 1237 - DNA, 32 bp, Homo sapiens
ttaaagcttaaatttatgaaccacctttgtgg

SEQ ID NO: 1238 - DNA, 17 bp, Homo sapiens
cccgctgcttccaggta

SEQ ID NO: 1239 - DNA, 32 bp, Homo sapiens
gtaaaaagcagctttggaaactgtgaatgatc

SEQ ID NO: 1240 - DNA, 32 bp, Homo sapiens
ttgagacggagattcgctctgtcgccaggctg

SEQ ID NO: 1241 - DNA, 32 bp, Homo sapiens
cggaaggccagctcttcttggaggacaagaca

SEQ ID NO: 1242 - DNA, 32 bp, Homo sapiens
catttttctactttgcttttctctccatactt

SEQ ID NO: 1243 - DNA, 32 bp, Homo sapiens
agaagccggtgggcaatgagatcatgtctgct

SEQ ID NO: 1244 - DNA, 32 bp, Homo sapiens
ctattcgggaggctgagacaggagaatcactt

SEQ ID NO: 1245 - DNA, 32 bp, Homo sapiens
cctctgtcgcccaggctggagtgcagtggcga

SEQ ID NO: 1246 - DNA, 32 bp, Homo sapiens
aacttgcagaattgggtgtgtgggagagcaaa

SEQ ID NO: 1247 - DNA, 28 bp, Homo sapiens
cccggcccctgagctgcctcctccagcc

SEQ ID NO: 1248 - DNA, 28 bp, Homo sapiens
cctcccccagctgctgccttcatattga

SEQ ID NO: 1249 - DNA, 32 bp, Homo sapiens
agccttctgagtagctgggattacaggcatgc

SEQ ID NO: 1250 - DNA, 32 bp, Homo sapiens
agcctcctgagtagctgggattataggcacgt

SEQ ID NO: 1251 - DNA, 32 bp, Homo sapiens
agcctcctgagtagctgggattacaggcacgc

SEQ ID NO: 1252 - DNA, 24 bp, Homo sapiens
tcacatttgtaatcccagcacttt

SEQ ID NO: 1253 - DNA, 32 bp, Homo sapiens
ctatatcttaaagaagaaagaaaacaattaag

SEQ ID NO: 1254 - DNA, 32 bp, Homo sapiens
gcaaggaagctatttaacatggtgctgagcta

SEQ ID NO: 1255 - DNA, 32 bp, Homo sapiens
tcttgtcccccaggctggagtggtgcagtggc

SEQ ID NO: 1256 - DNA, 32 bp, Homo sapiens
gtggcctctgcaggagcaaaactgcctcaagt

SEQ ID NO: 1257 - DNA, 32 bp, Homo sapiens
cccttccgtcttctccctcatcctttccaaac

SEQ ID NO: 1258 - DNA, 24 bp, Homo sapiens
cctccgttgttgcgtgagaacccg

SEQ ID NO: 1259 - DNA, 32 bp, Homo sapiens
cctctggctttcctggaacacagatgtcgaga

SEQ ID NO: 1260 - DNA, 32 bp, Homo sapiens
cagccagtccctacagcatacagggtctcctt

SEQ ID NO: 1261 - DNA, 32 bp, Homo sapiens
aggcccacaggtctgtcatcccataggccacc

SEQ ID NO: 1262 - DNA, 32 bp, Homo sapiens
aatcccaggagacagaggttgcagtgagccga

SEQ ID NO: 1263 - DNA, 32 bp, Homo sapiens
ctctgtcactcaggctggagtgcagtggcgcg

SEQ ID NO: 1264 - DNA, 32 bp, Homo sapiens
acacagctcttcattccattgacttagaggca

SEQ ID NO: 1265 - DNA, 22 bp, Homo sapiens
ggtttgggaaggtcctggggca

SEQ ID NO: 1266 - DNA, 32 bp, Homo sapiens
cacctctctgcagctccttctccaatctcatg

SEQ ID NO: 1267 - DNA, 28 bp, Homo sapiens
aactgaccaaatgctgccttgtttggcc

SEQ ID NO: 1268 - DNA, 32 bp, Homo sapiens
accctcactgccctcaaggacaacagcagggt

SEQ ID NO: 1269 - DNA, 32 bp, Homo sapiens
gagcctgggaggtggaggttgcagtgagtgga

SEQ ID NO: 1270 - DNA, 32 bp, Homo sapiens
gaccaatgtccttgtggtctttgctgctgctc

SEQ ID NO: 1271 - DNA, 32 bp, Homo sapiens
acaggctctgcaggctatctccccctctggct

SEQ ID NO: 1272 - DNA, 32 bp, Homo sapiens
gagccgcgtcttctcccggctccgccaccagc

SEQ ID NO: 1273 - DNA, 31 bp, Homo sapiens
cagaagcggcagccaccgaggagggagcagt

SEQ ID NO: 1274 - DNA, 20 bp, Homo sapiens
ccctggcagctgcagatccc

SEQ ID NO: 1275 - DNA, 32 bp, Homo sapiens
agttagctttcttcctggattcctcactttga

SEQ ID NO: 1276 - DNA, 32 bp, Homo sapiens
cgtacccttccccacacataccaccttggctt

SEQ ID NO: 1277 - DNA, 32 bp, Homo sapiens
gggatgcctggctgctggagtacatgtgttca

SEQ ID NO: 1278 - DNA, 32 bp, Homo sapiens
tgctctgtcaccaggctggagtgcagtggagg

SEQ ID NO: 1279 - DNA, 32 bp, Homo sapiens
gaaactgttcccacctgctggagtgaaggggc

SEQ ID NO: 1280 - DNA, 28 bp, Homo sapiens
aagggatccaaggctgcctcttcctctt

SEQ ID NO: 1281 - DNA, 28 bp, Homo sapiens
acctcttgcccagctgcctcttctgaaa

SEQ ID NO: 1282 - DNA, 32 bp, Homo sapiens
tgtttatttgctccttctcttcatgcctgtgg

SEQ ID NO: 1283 - DNA, 32 bp, Homo sapiens
cttcttcagctgtctggccgcaccttaaaaac

SEQ ID NO: 1284 - DNA, 32 bp, Homo sapiens
cccggttcaagcaattctcctgcctcagcctg

SEQ ID NO: 1285 - DNA, 23 bp, Homo sapiens
cctggaacacctgtcctcgggca

SEQ ID NO: 1286 - DNA, 32 bp, Homo sapiens
ctatcggtgctgcttctgcccgctttaaggag

SEQ ID NO: 1287 - DNA, 32 bp, Homo sapiens
gctttctctctggcttctctcttttcctcctc

SEQ ID NO: 1288 - DNA, 32 bp, Homo sapiens
acagccaggcttctgtcatacaggtagatccc

SEQ ID NO: 1289 - DNA, 32 bp, Homo sapiens
ggcagggaggcacgcaggtactgtgaaaatcc

SEQ ID NO: 1290 - DNA, 32 bp, Homo sapiens
agatccccaacaagaccgagaccctggacgag

SEQ ID NO: 1291 - DNA, 32 bp, Homo sapiens
ggcgccgggaggcgcgggctttgctcctgggg

SEQ ID NO: 1292 - DNA, 32 bp, Homo sapiens
aagatgagctggcactctgcaaacttctttaa

SEQ ID NO: 1293 - DNA, 32 bp, Homo sapiens
cctggatcatctctccccatcacttgccttgg

SEQ ID NO: 1294 - DNA, 18 bp, Homo sapiens
gcctctgcctcccaagta

SEQ ID NO: 1295 - DNA, 32 bp, Homo sapiens
caaggaggaggctgccaaagaaaacaaaggcc

SEQ ID NO: 1296 - DNA, 32 bp, Homo sapiens
tagagatggggtttcgctatgttggccaggct

SEQ ID NO: 1297 - DNA, 25 bp, Homo sapiens
cgtcgcccaggctggagtacagtgg

SEQ ID NO: 1298 - DNA, 32 bp, Homo sapiens
ctctgtcacccaagttggagtgcagtggcccc

SEQ ID NO: 1299 - DNA, 32 bp, Homo sapiens
actctgttgcccaggctggagtgcgatggcat

SEQ ID NO: 1300 - DNA, 32 bp, Homo sapiens
gagggcaaggcaagagcttgagcttgagccta

SEQ ID NO: 1301 - DNA, 32 bp, Homo sapiens
gctctgttgcccaggctggagtgcaatggcat

SEQ ID NO: 1302 - DNA, 32 bp, Homo sapiens
gctctgttgcccaggctagagtgcagtggcat

SEQ ID NO: 1303 - DNA, 32 bp, Homo sapiens
tttgagttgcccacatactgcagttattctgt

SEQ ID NO: 1304 - DNA, 27 bp, Homo sapiens
aaatgttgcccaggaaggacaggtgtg

SEQ ID NO: 1305 - DNA, 32 bp, Homo sapiens
gacgggcacccaggctgcagtgtgtgaggggg

SEQ ID NO: 1306 - DNA, 32 bp, Homo sapiens
gcactatcacccaggctggagtgcagtggcat

SEQ ID NO: 1307 - DNA, 32 bp, Homo sapiens
acctgcacctcccgggttcaagtgattctcat

SEQ ID NO: 1308 - DNA, 28 bp, Homo sapiens
cttattccaagtgcatttttcttattta

SEQ ID NO: 1309 - DNA, 32 bp, Homo sapiens
ttttgttgcccaggctggagtgcaatgatgca

SEQ ID NO: 1310 - DNA, 32 bp, Homo sapiens
ggcccttgcctgtagtctcagcactttgggag

SEQ ID NO: 1311 - DNA, 32 bp, Homo sapiens
ccacttaacagatgaggaaactgaggcctaga

SEQ ID NO: 1312 - DNA, 32 bp, Homo sapiens
taggatgtgcccacctgcattggtgaaggtca

SEQ ID NO: 1313 - DNA, 32 bp, Homo sapiens
cacccaacacccagaatctgtgcagttatttg

SEQ ID NO: 1314 - DNA, 32 bp, Homo sapiens
ctgggttcaagcaattgtcctgccccagcctc

SEQ ID NO: 1315 - DNA, 32 bp, Homo sapiens
ctgggttcaagcaattctcctgccgcagcctc

SEQ ID NO: 1316 - DNA, 32 bp, Homo sapiens
ggatggacagcttggctctcccagagaggtga

SEQ ID NO: 1317 - DNA, 32 bp, Homo sapiens
acttcagctccaggctgcagtaatgtgttggt

SEQ ID NO: 1318 - DNA, 32 bp, Homo sapiens
gctctgtcgcccaggctggagtgcaatggcac

SEQ ID NO: 1319 - DNA, 23 bp, Homo sapiens
tgacacaatctcagctcactgca

SEQ ID NO: 1320 - DNA, 32 bp, Homo sapiens
tcctccctctgcctctgttcagctccaccttg

SEQ ID NO: 1321 - DNA, 32 bp, Homo sapiens
ttcaggagcctaagaccctcccagagcccagg

SEQ ID NO: 1322 - DNA, 23 bp, Homo sapiens
tgatgcaatcttggctcactgca

SEQ ID NO: 1323 - DNA, 23 bp, Homo sapiens
tgacgcaatctcggctcactgca

SEQ ID NO: 1324 - DNA, 19 bp, Homo sapiens
cgatctcggctcactgcag

SEQ ID NO: 1325 - DNA, 32 bp, Homo sapiens
gtcttcgggaggcagaattgaagtgaacatga

SEQ ID NO: 1326 - DNA, 32 bp, Homo sapiens
ttacagtgacctggctggagttacctggtgca

SEQ ID NO: 1327 - DNA, 24 bp, Homo sapiens
tcacgcctataattccagcacttt

SEQ ID NO: 1328 - DNA, 32 bp, Homo sapiens
gggactcagcccagactgccctggggcagctt

SEQ ID NO: 1329 - DNA, 32 bp, Homo sapiens
ggtttttcaagcaaattctgataccaacctct

SEQ ID NO: 1330 - DNA, 23 bp, Homo sapiens
tggcctgatctcggctcactgca

SEQ ID NO: 1331 - DNA, 23 bp, Homo sapiens
ggcaggtttcagggtgccagtgg

SEQ ID NO: 1332 - DNA, 32 bp, Homo sapiens
gacaccctttgtaactctcttctcctccctag

SEQ ID NO: 1333 - DNA, 32 bp, Homo sapiens
actccatcagccaggctggagtgcagtggtgc

SEQ ID NO: 1334 - DNA, 24 bp, Homo sapiens
agtgaagagcacagactctgtggg

SEQ ID NO: 1335 - DNA, 19 bp, Homo sapiens
gcccaggctggagtacaat

SEQ ID NO: 1336 - DNA, 32 bp, Homo sapiens
caaaagataacattggtgtcactgtggtatta

SEQ ID NO: 1337 - DNA, 32 bp, Homo sapiens
ttgagacggagtttcgctcttgtcgcccaggc

SEQ ID NO: 1338 - DNA, 32 bp, Homo sapiens
tccctctggagtttccttcatctgccccacac

SEQ ID NO: 1339 - DNA, 32 bp, Homo sapiens
gcccaggatggccttgaactcctgggctcaag

SEQ ID NO: 1340 - DNA, 32 bp, Homo sapiens
gttctgtcgcttagctggagtgcggtggcgtg

SEQ ID NO: 1341 - DNA, 32 bp, Homo sapiens
gctccatcgcccaggctgcagtgcagtgacac

SEQ ID NO: 1342 - DNA, 32 bp, Homo sapiens
agccctgttgttctgtcatggccagtgggcag

SEQ ID NO: 1343 - DNA, 32 bp, Homo sapiens
tcatcctgaagtagctggattgatagaatgac

SEQ ID NO: 1344 - DNA, 28 bp, Homo sapiens
tggtcatcaggagctgcctcttctgtta

SEQ ID NO: 1345 - DNA, 32 bp, Homo sapiens
cctgtcccaagtgctgtgattcacacgcctga

SEQ ID NO: 1346 - DNA, 32 bp, Homo sapiens
gggttgagcagaggagaaaatcagacagatgg

SEQ ID NO: 1347 - DNA, 32 bp, Homo sapiens
atttcttgcctgtaaccctagcactttgggag

SEQ ID NO: 1348 - DNA, 32 bp, Homo sapiens
tggagccctgatgaatgggattagtgctttat

SEQ ID NO: 1349 - DNA, 24 bp, Homo sapiens
gtctcccaggctggagtgcaatag

SEQ ID NO: 1350 - DNA, 24 bp, Homo sapiens
tcacgcttgtaatcgcagcacttt

SEQ ID NO: 1351 - DNA, 32 bp, Homo sapiens
ggtaggagataaggagaaagaacagatacggt

SEQ ID NO: 1352 - DNA, 32 bp, Homo sapiens
tagaaagaaagaggagggacaagcaagcccat

SEQ ID NO: 1353 - DNA, 32 bp, Homo sapiens
ctgttgtctcccaggctggagtgcagtggcgt

SEQ ID NO: 1354 - DNA, 32 bp, Homo sapiens
ggccctggcccagctctggagtgcatgtgtgt

SEQ ID NO: 1355 - DNA, 32 bp, Homo sapiens
gctctgttgccccagcttgagtgcagtggcgt

SEQ ID NO: 1356 - DNA, 32 bp, Homo sapiens
gaacccgggaagcagagtctgcagtgagccaa

SEQ ID NO: 1357 - DNA, 32 bp, Homo sapiens
aaccactcctcatgtaatctttgcctctctct

SEQ ID NO: 1358 - DNA, 32 bp, Homo sapiens
catttttgagaacaggcttttgataaactcac

SEQ ID NO: 1359 - DNA, 32 bp, Homo sapiens
agcctcctgagtagctgggactataggcgcgt

SEQ ID NO: 1360 - DNA, 32 bp, Homo sapiens
agcctcccaagtagctgggattacaggtgtga

SEQ ID NO: 1361 - DNA, 32 bp, Homo sapiens
agcttcctgagtagctgggactacaggtgcgc

SEQ ID NO: 1362 - DNA, 32 bp, Homo sapiens
gctctgtcaccaaggctggagtgcagcggtgt

SEQ ID NO: 1363 - DNA, 32 bp, Homo sapiens
tgtgacctcatctttctcatggtgctatcctg

SEQ ID NO: 1364 - DNA, 32 bp, Homo sapiens
ccggattcaagcagttttcctgcctcagcctc

SEQ ID NO: 1365 - DNA, 24 bp, Homo sapiens
tcacacctgtattcccagcacttt

SEQ ID NO: 1366 - DNA, 24 bp, Homo sapiens
tcacacctgtaatcccagctcttt

SEQ ID NO: 1367 - DNA, 32 bp, Homo sapiens
gatctggaaagaaaggaaggaaaacaaaggcg

SEQ ID NO: 1368 - DNA, 32 bp, Homo sapiens
ttgagacagagtttcgcacttcttgcccaggc

SEQ ID NO: 1369 - DNA, 32 bp, Homo sapiens
agagctctccacgagtgttcagtcttagaact

SEQ ID NO: 1370 - DNA, 32 bp, Homo sapiens
ggctgctctgcagattctagtttggctttcag

SEQ ID NO: 1371 - DNA, 32 bp, Homo sapiens
catgcccagcttctgtcatatgaatgagatat

SEQ ID NO: 1372 - DNA, 32 bp, Homo sapiens
ttgtgcagtcatgtgttaaatatttcacattt

SEQ ID NO: 1373 - DNA, 32 bp, Homo sapiens
acctccacctcctgggttcaagacaatcctcc

SEQ ID NO: 1374 - DNA, 32 bp, Homo sapiens
ggtgggggtccaggctggaggggcccaatgta

SEQ ID NO: 1375 - DNA, 32 bp, Homo sapiens
actgcagcctccacctcctgggctcatgtgat

SEQ ID NO: 1376 - DNA, 25 bp, Homo sapiens
tcacacctgtggaatcccagcactt

SEQ ID NO: 1377 - DNA, 24 bp, Homo sapiens
tcatgcctgtaatcgcagcacttt

SEQ ID NO: 1378 - DNA, 32 bp, Homo sapiens
ggttccaggcctgggggtcgcttccagctgcc

SEQ ID NO: 1379 - DNA, 32 bp, Homo sapiens
ttccccctgcttctgccagcagctccatcttg

SEQ ID NO: 1380 - DNA, 32 bp, Homo sapiens
agggtggcatggctccccatctcgggtccatc

SEQ ID NO: 1381 - DNA, 22 bp, Homo sapiens
aggttctccaacatcacagccc

SEQ ID NO: 1382 - DNA, 32 bp, Homo sapiens
actcactcaaaaccagcagtgctgctatcaga

SEQ ID NO: 1383 - DNA, 32 bp, Homo sapiens
agacaggatctcaggctggagtgcagtggcac

SEQ ID NO: 1384 - DNA, 32 bp, Homo sapiens
ctagtgtcacccaggctggagtgcagtgatcc

SEQ ID NO: 1385 - DNA, 32 bp, Homo sapiens
ttccgatgtgccacctgcagtagtggatcatg

SEQ ID NO: 1386 - DNA, 28 bp, Homo sapiens
gaatactcaagtgctagcttagcagctt

SEQ ID NO: 1387 - DNA, 32 bp, Homo sapiens
ctaattgtaagtgcccttactaagggcacatg

SEQ ID NO: 1388 - DNA, 17 bp, Homo sapiens
gcccctgctgctgcagg

SEQ ID NO: 1389 - DNA, 32 bp, Homo sapiens
ctgggttcaagcaattctcctgtctcagcctc

SEQ ID NO: 1390 - DNA, 32 bp, Homo sapiens
tctaactgctcaacaggaaatgaacctagaaa

SEQ ID NO: 1391 - DNA, 32 bp, Homo sapiens
tctcctgctcattcttcttgacagaacaacca

SEQ ID NO: 1392 - DNA, 32 bp, Homo sapiens
gaacaatttaaccttgaagtctatatccgtga

SEQ ID NO: 1393 - DNA, 32 bp, Homo sapiens
ctgcaacattttatccccatcattccaaaatg

SEQ ID NO: 1394 - DNA, 20 bp, Homo sapiens
cagggaagccccctcagccc

SEQ ID NO: 1395 - DNA, 32 bp, Homo sapiens
tggtgtggcctgctgcttccaggctgcaaacc

SEQ ID NO: 1396 - DNA, 32 bp, Homo sapiens
caactccatccctcaccacagttgtctaggaa

SEQ ID NO: 1397 - DNA, 32 bp, Homo sapiens
tactgtcatacaggctggcgtgcagtagtggg

SEQ ID NO: 1398 - DNA, 32 bp, Homo sapiens
tttgccaccatctcctcctctgatctcctttc

SEQ ID NO: 1399 - DNA, 24 bp, Homo sapiens
ctgtcacccaggctggagtgcgat

SEQ ID NO: 1400 - DNA, 32 bp, Homo sapiens
gaacctgggaagcagagtttgcagtgagccaa

SEQ ID NO: 1401 - DNA, 32 bp, Homo sapiens
ctctgtcgtccaggctggagtgcagtggcacg

SEQ ID NO: 1402 - DNA, 22 bp, Homo sapiens
gcagggtgtccggagagcggtg

SEQ ID NO: 1403 - DNA, 32 bp, Homo sapiens
aacgtcttgggaaaggggagagcttgacctcc

SEQ ID NO: 1404 - DNA, 31 bp, Homo sapiens
aagaccatgtctgggagcttctactttgtaa

SEQ ID NO: 1405 - DNA, 24 bp, Homo sapiens
ctgtcgcccaggctggagtgcaat

SEQ ID NO: 1406 - DNA, 32 bp, Homo sapiens
cagggtcctgcagcttgtcctttctggctgga

SEQ ID NO: 1407 - DNA, 32 bp, Homo sapiens
gagagagccacttaacctctctggaccttgtt

SEQ ID NO: 1408 - DNA, 22 bp, Homo sapiens
tccttgcaaagagaatcctgta

SEQ ID NO: 1409 - DNA, 32 bp, Homo sapiens
gctctgttacccagattggagtgcagtggcgc

SEQ ID NO: 1410 - DNA, 32 bp, Homo sapiens
actctgttgcccaggctggagtacagtggcgt

SEQ ID NO: 1411 - DNA, 32 bp, Homo sapiens
tacctgaggttaggagtttgagaccagcctga

SEQ ID NO: 1412 - DNA, 32 bp, Homo sapiens
actctgtcgcccaggctggagtgtagtggcat

SEQ ID NO: 1413 - DNA, 32 bp, Homo sapiens
gctctgtcacccaggctggagtgcagtggcac

SEQ ID NO: 1414 - DNA, 32 bp, Homo sapiens
actctgttgcccaggctggagtgcagtggcat

SEQ ID NO: 1415 - DNA, 32 bp, Homo sapiens
tcctgctcacatctgaatctccttgttgttct

SEQ ID NO: 1416 - DNA, 32 bp, Homo sapiens
gtgtttagaagtaggaagtcactgtgagcaat

SEQ ID NO: 1417 - DNA, 32 bp, Homo sapiens
gctctgttgcccaggctggagtgcggtggcat

SEQ ID NO: 1418 - DNA, 32 bp, Homo sapiens
gaacccaggaggtggtggttgcagtgagccta

SEQ ID NO: 1419 - DNA, 32 bp, Homo sapiens
gaacccgggtggcagaggttgcagtgagctga

SEQ ID NO: 1420 - DNA, 32 bp, Homo sapiens
tgatgggaacggcagaggctggcaggtgactg

SEQ ID NO: 1421 - DNA, 32 bp, Homo sapiens
gctctgtcacccaggctagagtgcaatggcac

SEQ ID NO: 1422 - DNA, 32 bp, Homo sapiens
ccgggttcaagcaattaactgcctcagcttcc

SEQ ID NO: 1423 - DNA, 32 bp, Homo sapiens
gagcccaggaggcagaggctgcagtgagccat

SEQ ID NO: 1424 - DNA, 32 bp, Homo sapiens
aagaagcttgcagcttacatctgtcctgggct

SEQ ID NO: 1425 - DNA, 21 bp, Homo sapiens
tcatggcaagggctggcccca

SEQ ID NO: 1426 - DNA, 32 bp, Homo sapiens
taggtaaggtaagaggaatcaagttctgagtg

SEQ ID NO: 1427 - DNA, 32 bp, Homo sapiens
aggtgtgtccctagggcttcagtcctggggca

SEQ ID NO: 1428 - DNA, 32 bp, Homo sapiens
cccagcctgtatacccagattactttggtgaa

SEQ ID NO: 1429 - DNA, 23 bp, Homo sapiens
gggcggctgcgtagctgtggtcc

SEQ ID NO: 1430 - DNA, 17 bp, Homo sapiens
cagggaagccccagccc

SEQ ID NO: 1431 - DNA, 32 bp, Homo sapiens
cctagggttctcgttctcccagctccagcctt

SEQ ID NO: 1432 - DNA, 32 bp, Homo sapiens
ataacacttcctgacatctcctttggaaaaga

SEQ ID NO: 1433 - DNA, 32 bp, Homo sapiens
aggcctggattcttttgagtggtgctactgcc

SEQ ID NO: 1434 - DNA, 32 bp, Homo sapiens
agcctcttgagtagctgggactacaggcgcac

SEQ ID NO: 1435 - DNA, 32 bp, Homo sapiens
ttctgtcacctaggctggagtgtagtgacatg

SEQ ID NO: 1436 - DNA, 23 bp, Homo sapiens
tgatgagctcatggaacttgaga

SEQ ID NO: 1437 - DNA, 32 bp, Homo sapiens
caggagctaacaggaaaaagaaaatcaatggc

SEQ ID NO: 1438 - DNA, 32 bp, Homo sapiens
catgtgacactcaggctggagtggtggtaagg

SEQ ID NO: 1439 - DNA, 32 bp, Homo sapiens
agcagcttgcccagctcttgagtacagtggtg

SEQ ID NO: 1440 - DNA, 32 bp, Homo sapiens
cgcccccaggctgtgccccaccacagattctg

SEQ ID NO: 1441 - DNA, 32 bp, Homo sapiens
acctctgcctcctgggttcaagcgattctcag

SEQ ID NO: 1442 - DNA, 32 bp, Homo sapiens
ctactcgggaggctgaggccgtaggatccctt

SEQ ID NO: 1443 - DNA, 32 bp, Homo sapiens
ggaggagagtggcggctgacactgtgaaggag

SEQ ID NO: 1444 - DNA, 21 bp, Homo sapiens
ggtgaggacgggatctgtgga

SEQ ID NO: 1445 - DNA, 32 bp, Homo sapiens
aaagaaagaaagaaagaaagaaaagaaagaaa

SEQ ID NO: 1446 - DNA, 32 bp, Homo sapiens
ataaattcaagcactaccactggtcagttttg

SEQ ID NO: 1447 - DNA, 32 bp, Homo sapiens
catcttagcctggctcctcttctgtctctagg

SEQ ID NO: 1448 - DNA, 24 bp, Homo sapiens
tcacgcctgtaatccgagcacttt

SEQ ID NO: 1449 - DNA, 22 bp, Homo sapiens
tcacacctataatcccagcact

SEQ ID NO: 1450 - DNA, 32 bp, Homo sapiens
cacggacttctgctgctgccacctgcgccagc

SEQ ID NO: 1451 - DNA, 32 bp, Homo sapiens
ttccttagtgagctccacattacttgatggta

SEQ ID NO: 1452 - DNA, 32 bp, Homo sapiens
gactggcagcttttatttcagtattagcacag

SEQ ID NO: 1453 - DNA, 32 bp, Homo sapiens
gaacccaggaggtggagactgcagtgagccaa

SEQ ID NO: 1454 - DNA, 32 bp, Homo sapiens
tgaagccagaggcagaggttgcaatgagccgg

SEQ ID NO: 1455 - DNA, 32 bp, Homo sapiens
tgtgctcacccaggctgagggtgcctttgtgg

SEQ ID NO: 1456 - DNA, 32 bp, Homo sapiens
attaagaataaaggaggaggaaaacaacaaag

SEQ ID NO: 1457 - DNA, 32 bp, Homo sapiens
ctcccgctccaggcacatcccaccttacctct

SEQ ID NO: 1458 - DNA, 32 bp, Homo sapiens
gcttcttcaagcaaaccacctcaccacactat

SEQ ID NO: 1459 - DNA, 32 bp, Homo sapiens
ctctgctgtcagcttcccatctggctcagcat

SEQ ID NO: 1460 - DNA, 23 bp, Homo sapiens
tcatgcctgtaatcccagcactt

SEQ ID NO: 1461 - DNA, 32 bp, Homo sapiens
agaagatgcccagggcccagaagccatcagaa

SEQ ID NO: 1462 - DNA, 17 bp, Homo sapiens
caggacagcttccagcc

SEQ ID NO: 1463 - DNA, 32 bp, Homo sapiens
gattttcatccctcgcacaaggactacgggtt

SEQ ID NO: 1464 - DNA, 32 bp, Homo sapiens
cgaaggtctgcagcttcactcctgaagccagc

SEQ ID NO: 1465 - DNA, 20 bp, Homo sapiens
tcacgcctgtaatcccagca

SEQ ID NO: 1466 - DNA, 32 bp, Homo sapiens
agcctcctgagtagctgggattacaaccgtgt

SEQ ID NO: 1467 - DNA, 32 bp, Homo sapiens
gtgtccccaagtgccatgacccaggagccatt

SEQ ID NO: 1468 - DNA, 32 bp, Homo sapiens
actgtgctgctgctgtggagcggcgccgacct

SEQ ID NO: 1469 - DNA, 32 bp, Homo sapiens
aggttccccaaaaggctgcccagccttacagc

SEQ ID NO: 1470 - DNA, 32 bp, Homo sapiens
gcgcaatctgaaacttctcttctgttttcttt

SEQ ID NO: 1471 - DNA, 32 bp, Homo sapiens
actctgtcacctaggctagagtgcagtggtgt

SEQ ID NO: 1472 - DNA, 32 bp, Homo sapiens
tgccctgtcgcctggctggagtggagtggcac

SEQ ID NO: 1473 - DNA, 32 bp, Homo sapiens
ccggattcaagcaattctccttcctcagcctc

SEQ ID NO: 1474 - DNA, 32 bp, Homo sapiens
cccacaatttcctgggttccaccaagcagcga

SEQ ID NO: 1475 - DNA, 32 bp, Homo sapiens
cactgtctcctaggctggagtgcagtggtgtg

SEQ ID NO: 1476 - DNA, 32 bp, Homo sapiens
agccgtctgctgctgctgcaggaggctccact

SEQ ID NO: 1477 - DNA, 26 bp, Homo sapiens
ctgcaggaaacactgaggcttgggaa

SEQ ID NO: 1478 - DNA, 32 bp, Homo sapiens
cagcctcccagaagctctcttctgcttcaaaa

SEQ ID NO: 1479 - DNA, 32 bp, Homo sapiens
gacgctgggaggtggatgctgcagtgagcagt

SEQ ID NO: 1480 - DNA, 32 bp, Homo sapiens
ttaaatgtcccaggctggaaggtggagcgaga

SEQ ID NO: 1481 - DNA, 32 bp, Homo sapiens
gaccggaggagaggagagcggggaagaggaga

SEQ ID NO: 1482 - DNA, 32 bp, Homo sapiens
agcctccctagtagctgggattacaggcgccc

SEQ ID NO: 1483 - DNA, 32 bp, Homo sapiens
tattgttcaagagtgagatcttgtagagtggc

SEQ ID NO: 1484 - DNA, 32 bp, Homo sapiens
ccatttggctgtttctctcttgttctcagaca

SEQ ID NO: 1485 - DNA, 32 bp, Homo sapiens
tagagacagagtttcgtcatgttgcccaggct

SEQ ID NO: 1486 - DNA, 32 bp, Homo sapiens
tttcttggaacgggggaaagaaaatgaaactt

SEQ ID NO: 1487 - DNA, 32 bp, Homo sapiens
tcaatggtgtccaggctggagtgcagtggcgt

SEQ ID NO: 1488 - DNA, 32 bp, Homo sapiens
ccacagtccctttaaagaaacatggtttgact

SEQ ID NO: 1489 - DNA, 32 bp, Homo sapiens
tcttgtcggccaggctagagtgcagtggcgct

SEQ ID NO: 1490 - DNA, 32 bp, Homo sapiens
aagaattggtatgtatgatgtgatctggtcca

SEQ ID NO: 1491 - DNA, 32 bp, Homo sapiens
tcacctcaagacgaccatggccaccatcccag

SEQ ID NO: 1492 - DNA, 32 bp, Homo sapiens
ctactcgggaggctgaggcaggagaatcactt

SEQ ID NO: 1493 - DNA, 32 bp, Homo sapiens
ctactcgggaggctgaggcaagagaatcgctt

SEQ ID NO: 1494 - DNA, 24 bp, Homo sapiens
ctgtctcccaggctggagtgcaat

SEQ ID NO: 1495 - DNA, 32 bp, Homo sapiens
agcctcccaagtagctgggactacatgcacat

SEQ ID NO: 1496 - DNA, 32 bp, Homo sapiens
agcctcccaagtagctgggattacaggcgtgt

SEQ ID NO: 1497 - DNA, 18 bp, Homo sapiens
gcccctgtgggtcccagg

SEQ ID NO: 1498 - DNA, 32 bp, Homo sapiens
cttgtgtcatccagactggagcagtggtgcaa

SEQ ID NO: 1499 - DNA, 24 bp, Homo sapiens
ctgccacccaggctggagtacagt

SEQ ID NO: 1500 - DNA, 32 bp, Homo sapiens
ctgacccctccaaggaaagaccaccttctggg

SEQ ID NO: 1501 - DNA, 32 bp, Homo sapiens
tatttccccaaaacaacccagcttcaccccat

SEQ ID NO: 1502 - DNA, 32 bp, Homo sapiens
ggccgccccaaaagagccgctttgaccaggct

SEQ ID NO: 1503 - DNA, 32 bp, Homo sapiens
caaacctcagttctgaaagagctacagaatgc

SEQ ID NO: 1504 - DNA, 32 bp, Homo sapiens
gctctttcacccaggctggagtgcagtggcac

SEQ ID NO: 1505 - DNA, 32 bp, Homo sapiens
actctcttgcccaggctggagtgcagtggtat

SEQ ID NO: 1506 - DNA, 32 bp, Homo sapiens
agaggtgggatagaggaagggaggtttgagcc

SEQ ID NO: 1507 - DNA, 32 bp, Homo sapiens
gaacccatgaggtggaggttgcggtgagccaa

SEQ ID NO: 1508 - DNA, 32 bp, Homo sapiens
gcttcgggagcatgagtgctgcagtgactgca

SEQ ID NO: 1509 - DNA, 32 bp, Homo sapiens
gggacatcgggggcaagtttgcagtggggccg

SEQ ID NO: 1510 - DNA, 32 bp, Homo sapiens
tagtcctactgagaaaatgagcactttgatca

SEQ ID NO: 1511 - DNA, 32 bp, Homo sapiens
aggagaaagtggaccagctcccatgacctcac

SEQ ID NO: 1512 - DNA, 28 bp, Homo sapiens
atcctctccacagctgcctcttccctct

SEQ ID NO: 1513 - DNA, 18 bp, Homo sapiens
gccatcaccctgtcagga

SEQ ID NO: 1514 - DNA, 32 bp, Homo sapiens
aacgtttagtttcagctcagtgatcagctacc

SEQ ID NO: 1515 - DNA, 32 bp, Homo sapiens
ccaggttcaagcaattctcctgcctcagcctt

SEQ ID NO: 1516 - DNA, 32 bp, Homo sapiens
cactcaccagttctgctgcctcaggtcaggcc

SEQ ID NO: 1517 - DNA, 32 bp, Homo sapiens
cggggactcccaggctggagagcactgccagg

SEQ ID NO: 1518 - DNA, 32 bp, Homo sapiens
ctgacagaacaacaaggttaagcttcatctgc

SEQ ID NO: 1519 - DNA, 32 bp, Homo sapiens
tggctgtttcccaggctgaagtgcagtggcat

SEQ ID NO: 1520 - DNA, 32 bp, Homo sapiens
acctccacctcctaggttcaagtgattctact

SEQ ID NO: 1521 - DNA, 32 bp, Homo sapiens
aggtggagtgggcagaggtgcaagagagggat

SEQ ID NO: 1522 - DNA, 32 bp, Homo sapiens
gttgtcttagatctgatgatgctgctatttac

SEQ ID NO: 1523 - DNA, 32 bp, Homo sapiens
ggcctcctgagtggctgggattgcaggtgtgc

SEQ ID NO: 1524 - DNA, 32 bp, Homo sapiens
ctatttctgggaagctgggagtatgtgacatt

SEQ ID NO: 1525 - DNA, 32 bp, Homo sapiens
ggcctcctgagtagctgggattgcaggtatgc

SEQ ID NO: 1526 - DNA, 32 bp, Homo sapiens
agcctttggaacgtgagccactgtgggctggc

SEQ ID NO: 1527 - DNA, 32 bp, Homo sapiens
tatggcagaggccacagccactgtggggcacc

SEQ ID NO: 1528 - DNA, 32 bp, Homo sapiens
gcgctgcattttctcccctctccctccctcct

SEQ ID NO: 1529 - DNA, 32 bp, Homo sapiens
actctgttgaccaggctggagtgaagtggtgt

SEQ ID NO: 1530 - DNA, 32 bp, Homo sapiens
gctctgtcactcaggctgcagtgcagtggcat

SEQ ID NO: 1531 - DNA, 32 bp, Homo sapiens
actctgttgcccaggctggagtgcaggggcac

SEQ ID NO: 1532 - DNA, 32 bp, Homo sapiens
gccacttagtcgggatagaacatggttcgcaa

SEQ ID NO: 1533 - DNA, 32 bp, Homo sapiens
aggctgaggaaacaggctcaaactcagctggt

SEQ ID NO: 1534 - DNA, 32 bp, Homo sapiens
aagcagggatggcctgttccactgtgatctta

SEQ ID NO: 1535 - DNA, 32 bp, Homo sapiens
agccagtctcaccagttgattctgccttaatc

SEQ ID NO: 1536 - DNA, 18 bp, Homo sapiens
caggcctctctgcctgaa

SEQ ID NO: 1537 - DNA, 32 bp, Homo sapiens
tacaactgatgtgcccttagagcgcactagtt

SEQ ID NO: 1538 - DNA, 32 bp, Homo sapiens
ggagctcatcccttgtgttctgccagggtggg

SEQ ID NO: 1539 - DNA, 32 bp, Homo sapiens
tcttgttgcccaggctggagtgcaacggcatg

SEQ ID NO: 1540 - DNA, 32 bp, Homo sapiens
ggcttccccaaaatgggcaacttcagcttaag

SEQ ID NO: 1541 - DNA, 32 bp, Homo sapiens
gccatgtccgttatctcatctgatcttttgct

SEQ ID NO: 1542 - DNA, 32 bp, Homo sapiens
gcttgggtagcttggcttatattctagagcag

SEQ ID NO: 1543 - DNA, 32 bp, Homo sapiens
gtggcagggaggcagtcgccctgcggtgcaag

SEQ ID NO: 1544 - DNA, 32 bp, Homo sapiens
ctctgctgctcaggctggagtgcagtggtgca

SEQ ID NO: 1545 - DNA, 32 bp, Homo sapiens
atttcaaattcacattagctttgctaccacta

SEQ ID NO: 1546 - DNA, 32 bp, Homo sapiens
ctctcacaaggaaggccgctgtggagcgtgga

SEQ ID NO: 1547 - DNA, 28 bp, Homo sapiens
atggtagcaagtgctgccctttatcagc

SEQ ID NO: 1548 - DNA, 32 bp, Homo sapiens
gggcccaggagttcaaggctgcagtgagctat

SEQ ID NO: 1549 - DNA, 22 bp, Homo sapiens
tttactggtagtgtcctcattc

SEQ ID NO: 1550 - DNA, 32 bp, Homo sapiens
ccaggttcaagggattctcccacctcagcctc

SEQ ID NO: 1551 - DNA, 32 bp, Homo sapiens
atatctggtttatctgggtattacatgcgttt

SEQ ID NO: 1552 - DNA, 24 bp, Homo sapiens
tggcacagtcatagctcactgcag

SEQ ID NO: 1553 - DNA, 18 bp, Homo sapiens
gccgtaagtgccacccag

SEQ ID NO: 1554 - DNA, 32 bp, Homo sapiens
gagacagcctgagatatggcctcatgggaagg

SEQ ID NO: 1555 - DNA, 21 bp, Homo sapiens
tcacgcctgtaaccccagcac

SEQ ID NO: 1556 - DNA, 32 bp, Homo sapiens
agccagccaagtgccaaggtcagcttggctgg

SEQ ID NO: 1557 - DNA, 32 bp, Homo sapiens
ataagagggaggcaggagggttagagtgagta

SEQ ID NO: 1558 - DNA, 32 bp, Homo sapiens
tcaccctttgttgggggccaggcacagggcat

SEQ ID NO: 1559 - DNA, 32 bp, Homo sapiens
acacctagggaaacatgaggccccttatggga

SEQ ID NO: 1560 - DNA, 32 bp, Homo sapiens
caattagtctttctcccctggactagaaatcc

SEQ ID NO: 1561 - DNA, 32 bp, Homo sapiens
tagagactgggtttcgctgtgttagcctggat

SEQ ID NO: 1562 - DNA, 23 bp, Homo sapiens
tggcaggatctcggctcactgca

SEQ ID NO: 1563 - DNA, 23 bp, Homo sapiens
tggcacgatctcgcctcactgca

SEQ ID NO: 1564 - DNA, 32 bp, Homo sapiens
aagcaccagctatgtaatcacatggttgttct

SEQ ID NO: 1565 - DNA, 32 bp, Homo sapiens
atctgcgcctccattttctatctgcacttttt

SEQ ID NO: 1566 - DNA, 32 bp, Homo sapiens
agagccgcctccatgtggtttcggagtcgagg

SEQ ID NO: 1567 - DNA, 32 bp, Homo sapiens
gaattcaggaggtggaggttgcagtgagccga

SEQ ID NO: 1568 - DNA, 32 bp, Homo sapiens
gaatccaggaggcggaggttgcagtgagccga

SEQ ID NO: 1569 - DNA, 32 bp, Homo sapiens
ctctgtcacccaggctggaatgcagtgcagtg

SEQ ID NO: 1570 - DNA, 32 bp, Homo sapiens
aaagtcagcttggagaggagatcatgatcttt

SEQ ID NO: 1571 - DNA, 32 bp, Homo sapiens
gaaccccggaggtagaggttgcagtgagccga

SEQ ID NO: 1572 - DNA, 32 bp, Homo sapiens
gggtgggggaggcaggaggaggctgagcgtag

SEQ ID NO: 1573 - DNA, 32 bp, Homo sapiens
agtctcctgagtagctgggattacaggtgccc

SEQ ID NO: 1574 - DNA, 28 bp, Homo sapiens
gccttgagcagtgttgcctcatccagaa

SEQ ID NO: 1575 - DNA, 32 bp, Homo sapiens
cctagcagctctgtccttaacacacagcaggt

SEQ ID NO: 1576 - DNA, 32 bp, Homo sapiens
ctcgggtctgtcctccccgtctggaccctccc

SEQ ID NO: 1577 - DNA, 32 bp, Homo sapiens
agaggagggccaagaaaatgagcttggtttcc

SEQ ID NO: 1578 - DNA, 32 bp, Homo sapiens
agccttctgagtagctgggattacaggcaagc

SEQ ID NO: 1579 - DNA, 32 bp, Homo sapiens
gtggagtgttctactgggaaatggagttatga

SEQ ID NO: 1580 - DNA, 32 bp, Homo sapiens
aaagcgcatcttctccacatgggcttcacgtg

SEQ ID NO: 1581 - DNA, 32 bp, Homo sapiens
agcgactgtctccgaaccttctggacctgccc

SEQ ID NO: 1582 - DNA, 32 bp, Homo sapiens
gcagaatgggctccagggtagctctcagaaca

SEQ ID NO: 1583 - DNA, 32 bp, Homo sapiens
ctcgttcctcaaggtttagccgagacactgcc

SEQ ID NO: 1584 - DNA, 32 bp, Homo sapiens
tctttgagactatcctgaacttgaaatcccac

SEQ ID NO: 1585 - DNA, 32 bp, Homo sapiens
actatgttgcccaggctggtctcaagttcctg

SEQ ID NO: 1586 - DNA, 32 bp, Homo sapiens
agaggtaaggggtgaggatgtgattgatttcc

SEQ ID NO: 1587 - DNA, 32 bp, Homo sapiens
ctcttctcacccaggctggaatgcagtggcac

SEQ ID NO: 1588 - DNA, 32 bp, Homo sapiens
gcccaggccggagtacagtggcatgtctcagc

SEQ ID NO: 1589 - DNA, 32 bp, Homo sapiens
accgagagaagaagagaaagaaaagaaaaaga

SEQ ID NO: 1590 - DNA, 32 bp, Homo sapiens
cttggttcaagcaattctcctgcctcagcctc

SEQ ID NO: 1591 - DNA, 32 bp, Homo sapiens
atgagtggcctgagccttaacaacatgttttt

SEQ ID NO: 1592 - DNA, 21 bp, Homo sapiens
tccagtagttgaacactgtca

SEQ ID NO: 1593 - DNA, 32 bp, Homo sapiens
agagcagcttagaggatctcccaaggatgaaa

SEQ ID NO: 1594 - DNA, 32 bp, Homo sapiens
agggtctcctgcagtgccattctgccttctca

SEQ ID NO: 1595 - DNA, 32 bp, Homo sapiens
ctactcgggaggctgaggcaggacgattactt

SEQ ID NO: 1596 - DNA, 32 bp, Homo sapiens
ccctgttgcccaggctgaagtgcagtggtgcg

SEQ ID NO: 1597 - DNA, 32 bp, Homo sapiens
tgagctgagacttcggggctgtggagaccagc

SEQ ID NO: 1598 - DNA, 32 bp, Homo sapiens
acgtccacctcctgggttcaagcgattctcct

SEQ ID NO: 1599 - DNA, 32 bp, Homo sapiens
cccttggagtgttggtggagatcagagtgccg

SEQ ID NO: 1600 - DNA, 23 bp, Homo sapiens
ggcaccaccccctcatccaggga

SEQ ID NO: 1601 - DNA, 32 bp, Homo sapiens
ctgggttcaagcagttctcgtgccgcagcctc

SEQ ID NO: 1602 - DNA, 32 bp, Homo sapiens
ccagcatgctctgcccaccccacgccgaggtg

SEQ ID NO: 1603 - DNA, 32 bp, Homo sapiens
ttgagacggagtttcgctcttgtcaccccagc

SEQ ID NO: 1604 - DNA, 32 bp, Homo sapiens
aggaagtaagcatcacctcaggcacagaagaa

SEQ ID NO: 1605 - DNA, 32 bp, Homo sapiens
atggccaacaaaacatgaaacaccttgaaccc

SEQ ID NO: 1606 - DNA, 32 bp, Homo sapiens
gtagggggtctcccctggcaattcttgatcgg

SEQ ID NO: 1607 - DNA, 32 bp, Homo sapiens
aactgcctgagtagctgggactacaggcatgc

SEQ ID NO: 1608 - DNA, 32 bp, Homo sapiens
gcgtgcacccgcgttccatctgtcttctgaga

SEQ ID NO: 1609 - DNA, 32 bp, Homo sapiens
gtgacctctgcagtactccttagcctgcgttt

SEQ ID NO: 1610 - DNA, 24 bp, Homo sapiens
tcatgcctataatcccggcacttt

SEQ ID NO: 1611 - DNA, 24 bp, Homo sapiens
tcatgcctgtaatcccagcacttt

SEQ ID NO: 1612 - DNA, 32 bp, Homo sapiens
ccagctgtttttgtgctcacaagctctagcga

SEQ ID NO: 1613 - DNA, 32 bp, Homo sapiens
gaaggtggccagaaaccgtcccagaaactgcc

SEQ ID NO: 1614 - DNA, 32 bp, Homo sapiens
gggacactttcagcttctacttttgccttcta

SEQ ID NO: 1615 - DNA, 32 bp, Homo sapiens
gctctgtcacccaggctggaatgcagtgcagt

SEQ ID NO: 1616 - DNA, 32 bp, Homo sapiens
tgctagcctgagttggcacactgtgagaaccc

SEQ ID NO: 1617 - DNA, 32 bp, Homo sapiens
gaacccaagaggtggaggttgcggtgagccaa

SEQ ID NO: 1618 - DNA, 32 bp, Homo sapiens
aggacaagcccaggcagggctgcatggagagg

SEQ ID NO: 1619 - DNA, 32 bp, Homo sapiens
atgtgaggaagacaggcttcccttccttcccc

SEQ ID NO: 1620 - DNA, 32 bp, Homo sapiens
gaacccaggaggcgggggttgcagtgagtcga

SEQ ID NO: 1621 - DNA, 32 bp, Homo sapiens
gaacccgggaggtggaggttgcaatgagccaa

SEQ ID NO: 1622 - DNA, 32 bp, Homo sapiens
gaacccgagaggtggaggttgcagtgagccaa

SEQ ID NO: 1623 - DNA, 32 bp, Homo sapiens
cctgaacaacatcactgtggttactcatccat

SEQ ID NO: 1624 - DNA, 32 bp, Homo sapiens
acctccgtttcctgggttcgagtgattctcct

SEQ ID NO: 1625 - DNA, 32 bp, Homo sapiens
caaatcccaagtggcgatggcatgtaaccaca

SEQ ID NO: 1626 - DNA, 32 bp, Homo sapiens
cctactgtagcctcagcatcttgctaggaggc

SEQ ID NO: 1627 - DNA, 32 bp, Homo sapiens
aggctcaaatgatctcctcccacctcagcctc

SEQ ID NO: 1628 - DNA, 32 bp, Homo sapiens
taggccaggcctggggcttggtgtctgactgt

SEQ ID NO: 1629 - DNA, 32 bp, Homo sapiens
agtgcaagtcagagcaaagcccagaaagcaga

SEQ ID NO: 1630 - DNA, 32 bp, Homo sapiens
cactcagtgtgtgtttctcttccccttcttag

SEQ ID NO: 1631 - DNA, 32 bp, Homo sapiens
caactggcaaaagcttcttttctgcctatctt

SEQ ID NO: 1632 - DNA, 32 bp, Homo sapiens
gtgttttcctccgtaccatctgacgtttctgg

SEQ ID NO: 1633 - DNA, 32 bp, Homo sapiens
atctgttacccaggctggagtgcagtgacaca

SEQ ID NO: 1634 - DNA, 32 bp, Homo sapiens
ctctgtcacccaggctgtagtggagtggtgtg

SEQ ID NO: 1635 - DNA, 32 bp, Homo sapiens
ctctgtcgaccaggctggagtgcaggggcaca

SEQ ID NO: 1636 - DNA, 25 bp, Homo sapiens
ctgtgttgcccaggctagagtgcag

SEQ ID NO: 1637 - DNA, 32 bp, Homo sapiens
accactgtctcccgggttcaagcgattctccc

SEQ ID NO: 1638 - DNA, 28 bp, Homo sapiens
tcatccccaagtgccccttctgcctcag

SEQ ID NO: 1639 - DNA, 19 bp, Homo sapiens
caaatgctctgtgctctct

SEQ ID NO: 1640 - DNA, 32 bp, Homo sapiens
gtgaccttgagatcctgataccaccttcaagg

SEQ ID NO: 1641 - DNA, 32 bp, Homo sapiens
tttcttttgttagaggagagcttgatgtgatt

SEQ ID NO: 1642 - DNA, 32 bp, Homo sapiens
ttgctggaacaacaactgacttcatgatttgc

SEQ ID NO: 1643 - DNA, 32 bp, Homo sapiens
ttccctggttttctgtcactggcacaggaggg

SEQ ID NO: 1644 - DNA, 32 bp, Homo sapiens
ctctgtcgcccaggctagagtgcagtggcaca

SEQ ID NO: 1645 - DNA, 32 bp, Homo sapiens
ctctgttgcccaggctggagtgcgatggcatg

SEQ ID NO: 1646 - DNA, 32 bp, Homo sapiens
ggagctgccccaggctttagtgcagctgccaa

SEQ ID NO: 1647 - DNA, 32 bp, Homo sapiens
gtggggtaaggaggagaaaataaaccaacaat

SEQ ID NO: 1648 - DNA, 32 bp, Homo sapiens
cctggttcaagcaattctcctgcctcagcgat

SEQ ID NO: 1649 - DNA, 32 bp, Homo sapiens
agcctcctgagtagctgggattacagggcgct

SEQ ID NO: 1650 - DNA, 32 bp, Homo sapiens
aagccagagccagcctgctggcctcagctccg

SEQ ID NO: 1651 - DNA, 32 bp, Homo sapiens
ctctgtcgcccaggctggagtgcaatggcaca

SEQ ID NO: 1652 - DNA, 32 bp, Homo sapiens
ctctgtcacccaggctggagtgcaatggcacg

SEQ ID NO: 1653 - DNA, 32 bp, Homo sapiens
ctctgttgcccaggctggactacagtggcaca

SEQ ID NO: 1654 - DNA, 32 bp, Homo sapiens
gctctgtcacctaggctggagtgcagtggcgc

SEQ ID NO: 1655 - DNA, 32 bp, Homo sapiens
attggctcccaagcttcccccacctcatatgt

SEQ ID NO: 1656 - DNA, 32 bp, Homo sapiens
agcttcccgagtagctgggattacaggcacac

SEQ ID NO: 1657 - DNA, 32 bp, Homo sapiens
tttttgacagcttcctgtcaagcaatcaagaa

SEQ ID NO: 1658 - DNA, 32 bp, Homo sapiens
tttgtgggaagacatacctcccagaggggcat

SEQ ID NO: 1659 - DNA, 32 bp, Homo sapiens
atgatgaaatttccagacagaaagagcccttt

SEQ ID NO: 1660 - DNA, 32 bp, Homo sapiens
taatggaagaggaaagtgaacagtatcttcat

SEQ ID NO: 1661 - DNA, 32 bp, Homo sapiens
gccaaagtgctgctgattcccactcccttggt

SEQ ID NO: 1662 - DNA, 25 bp, Homo sapiens
tgatgaggaatctgagaactggaga

SEQ ID NO: 1663 - DNA, 19 bp, Homo sapiens
ggaaacagccgcacagtga

SEQ ID NO: 1664 - DNA, 32 bp, Homo sapiens
gctctgtcgctcaggctggagtgcagtggcgt

SEQ ID NO: 1665 - DNA, 32 bp, Homo sapiens
gaccaacacagaggagagaaaacaaaaatagc

SEQ ID NO: 1666 - DNA, 32 bp, Homo sapiens
atgggaccagttctgctgcctaagaaggtctg

SEQ ID NO: 1667 - DNA, 32 bp, Homo sapiens
ctttggtgcccaggccaagtagaatgagatga

SEQ ID NO: 1668 - DNA, 32 bp, Homo sapiens
tgggtggcctgtgatggatgggggctctgtgg

SEQ ID NO: 1669 - DNA, 32 bp, Homo sapiens
acgcaggcctccataacaattatttcagtgca

SEQ ID NO: 1670 - DNA, 32 bp, Homo sapiens
gctcaggcaagtgccttgcacacagtaggtac

SEQ ID NO: 1671 - DNA, 32 bp, Homo sapiens
aggtggggcaggcggaggttgcagtaagccaa

SEQ ID NO: 1672 - DNA, 32 bp, Homo sapiens
tcttgttgcccacgctggagtgcaatggtgca

SEQ ID NO: 1673 - DNA, 32 bp, Homo sapiens
ctcagccttctggctagctcttagcttccagc

SEQ ID NO: 1674 - DNA, 32 bp, Homo sapiens
tcttgttcctctgccattccccatgaagccgt

SEQ ID NO: 1675 - DNA, 28 bp, Homo sapiens
aacctttcaagtgctacgtccatttgtg

SEQ ID NO: 1676 - DNA, 32 bp, Homo sapiens
aggccttcacccagactttaccgcggaggcgg

SEQ ID NO: 1677 - DNA, 32 bp, Homo sapiens
gatgtaagcgatctggttcccacctcagcctc

SEQ ID NO: 1678 - DNA, 32 bp, Homo sapiens
gaggaaacaagcccctgtcccacgccgtctgc

SEQ ID NO: 1679 - DNA, 32 bp, Homo sapiens
tcttgtcacccacgctggagtgcaatggtgtg

SEQ ID NO: 1680 - DNA, 32 bp, Homo sapiens
tattctcctcatctccccatcattggtaccca

SEQ ID NO: 1681 - DNA, 32 bp, Homo sapiens
ttcttctacatcctccccatttctgtactgaa

SEQ ID NO: 1682 - DNA, 32 bp, Homo sapiens
gttaacaatgttctcagcctcagcttccttac

SEQ ID NO: 1683 - DNA, 32 bp, Homo sapiens
cacactgtcgccaggctggagtgcagtggtgc

SEQ ID NO: 1684 - DNA, 32 bp, Homo sapiens
acatccacctcctgggttcaagcaattctcct

SEQ ID NO: 1685 - DNA, 28 bp, Homo sapiens
cctcgttatccggctgcctcctcctccc

SEQ ID NO: 1686 - DNA, 32 bp, Homo sapiens
gaacctaagtggcagaggttgcagtgagctga

SEQ ID NO: 1687 - DNA, 32 bp, Homo sapiens
cgtgttcatcccttgtaaggtgagttcagtct

SEQ ID NO: 1688 - DNA, 32 bp, Homo sapiens
ttaaactccctctcttcttaaatggaacagct

SEQ ID NO: 1689 - DNA, 32 bp, Homo sapiens
cactgcggtaggtcattcttttgccacatccc

SEQ ID NO: 1690 - DNA, 32 bp, Homo sapiens
ctcttgttgcccgggctggagtgcaatggtga

SEQ ID NO: 1691 - DNA, 32 bp, Homo sapiens
gctctgtctcctaggctggagcgcagtggtgc

SEQ ID NO: 1692 - DNA, 32 bp, Homo sapiens
aggaagctgtaggtgaggagatctgtataata

SEQ ID NO: 1693 - DNA, 32 bp, Homo sapiens
aaaccaggaaggcagagattgcagtgagctga

SEQ ID NO: 1694 - DNA, 32 bp, Homo sapiens
gaatccaggaggcagaggctgtggtgagccaa

SEQ ID NO: 1695 - DNA, 32 bp, Homo sapiens
gcaagctgtaccagcagctcctggggacgtgc

SEQ ID NO: 1696 - DNA, 28 bp, Homo sapiens
cagaggcctaaggctgcctcagcaccct

SEQ ID NO: 1697 - DNA, 28 bp, Homo sapiens
tgtatcccaagtgcactgtccttctgtc

SEQ ID NO: 1698 - DNA, 32 bp, Homo sapiens
cctaagaaatgccagaacaaccaccttatttc

SEQ ID NO: 1699 - DNA, 32 bp, Homo sapiens
ggaggaagaggaggagaaggtagctacagcaa

SEQ ID NO: 1700 - DNA, 32 bp, Homo sapiens
gctctttcacccaggccggactgcagcggcgc

SEQ ID NO: 1701 - DNA, 32 bp, Homo sapiens
agaggtgctgtgctgctccacaaggcaaaaca

SEQ ID NO: 1702 - DNA, 32 bp, Homo sapiens
taagcattccttctttcacaggcatcaggaat

SEQ ID NO: 1703 - DNA, 32 bp, Homo sapiens
cactcctgtcttctggcttcagtctggaagat

SEQ ID NO: 1704 - DNA, 32 bp, Homo sapiens
acttctgaggtacggtatctctctccagccac

SEQ ID NO: 1705 - DNA, 32 bp, Homo sapiens
agcctccctagtagctgggattacaggcgcgc

SEQ ID NO: 1706 - DNA, 32 bp, Homo sapiens
ctactcgggaggctgaggcaggagaatgtcgt

SEQ ID NO: 1707 - DNA, 32 bp, Homo sapiens
catcaccttcctgaattctttaaatatgaaat

SEQ ID NO: 1708 - DNA, 32 bp, Homo sapiens
aactcattagcagatatgtagtgcagtgattt

SEQ ID NO: 1709 - DNA, 32 bp, Homo sapiens
tggggctcccacaggctggagtgcaatggtgt

SEQ ID NO: 1710 - DNA, 32 bp, Homo sapiens
atgtgttataagctaggagaatccctttggac

SEQ ID NO: 1711 - DNA, 32 bp, Homo sapiens
cagcgtgtctacaacgtctcccagaagctcta

SEQ ID NO: 1712 - DNA, 19 bp, Homo sapiens
tgtggaggaggaagatggg

SEQ ID NO: 1713 - DNA, 32 bp, Homo sapiens
ctctttttacccaggctggagtgcaatgatgc

SEQ ID NO: 1714 - DNA, 25 bp, Homo sapiens
gctctgtagcccaggctggagtgca

SEQ ID NO: 1715 - DNA, 32 bp, Homo sapiens
gccctttaagacgacatctccgcgaacgccgg

SEQ ID NO: 1716 - DNA, 32 bp, Homo sapiens
gcacggacgaggcagaggagtggccggtccca

SEQ ID NO: 1717 - DNA, 22 bp, Homo sapiens
gcctggacccccctctttctcc

SEQ ID NO: 1718 - DNA, 32 bp, Homo sapiens
aggcagaagaattgcttgaactggggaggcag

SEQ ID NO: 1719 - DNA, 32 bp, Homo sapiens
gaagctggagccacctgcggctctgagaggga

SEQ ID NO: 1720 - DNA, 32 bp, Homo sapiens
cagtgtatgttctcctgctccctggacaaatc

SEQ ID NO: 1721 - DNA, 31 bp, Homo sapiens
gggccaaacaacacggccgggaggcggccgc

SEQ ID NO: 1722 - DNA, 31 bp, Homo sapiens
aaaaaggaacaagtaactaggagagaaaaat

SEQ ID NO: 1723 - DNA, 32 bp, Homo sapiens
cgggcatgagctgagagcaccacgccgaggcc

SEQ ID NO: 1724 - DNA, 32 bp, Homo sapiens
ctaaaacatccctgagttcaccaccttggcca

SEQ ID NO: 1725 - DNA, 32 bp, Homo sapiens
gctcttcggcagctgcaccttctgcctcaaca

SEQ ID NO: 1726 - DNA, 32 bp, Homo sapiens
cagagtgctgcagctgtttctgtctcgaacgg

SEQ ID NO: 1727 - DNA, 32 bp, Homo sapiens
aaatgttgcccagtatgtgcgcattgccagtg

SEQ ID NO: 1728 - DNA, 32 bp, Homo sapiens
gatctaagctgctttccatcttttctcccagc

SEQ ID NO: 1729 - DNA, 32 bp, Homo sapiens
ctctgtcacccaggctggagtacagtggcatg

SEQ ID NO: 1730 - DNA, 32 bp, Homo sapiens
ctctgttgcccaggctggagtacagtggcaca

SEQ ID NO: 1731 - DNA, 32 bp, Homo sapiens
ttctgtcgtccaggctggagtgcggtggcgtg

SEQ ID NO: 1732 - DNA, 28 bp, Homo sapiens
cctatcccaagtgtgatccttcatccca

SEQ ID NO: 1733 - DNA, 32 bp, Homo sapiens
gcctccactgatctgaggagatcctgtgactg

SEQ ID NO: 1734 - DNA, 32 bp, Homo sapiens
gaccccaggaggcagaggttgaagtgagccag

SEQ ID NO: 1735 - DNA, 32 bp, Homo sapiens
ctaggttcaagcaattctcctgccccagcctc

SEQ ID NO: 1736 - DNA, 32 bp, Homo sapiens
gggctgtctgcagaaacccccatcaagagctg

SEQ ID NO: 1737 - DNA, 28 bp, Homo sapiens
tgactcttatctactgcctcatcttgat

SEQ ID NO: 1738 - DNA, 19 bp, Homo sapiens
gcccctgcccccaaaggtg

SEQ ID NO: 1739 - DNA, 32 bp, Homo sapiens
gcattcagagaagagtcaggaaaacaattgta

SEQ ID NO: 1740 - DNA, 32 bp, Homo sapiens
cataaaagacccagactcagctgcagtgagga

SEQ ID NO: 1741 - DNA, 32 bp, Homo sapiens
ctctgtcgcccaggttggagtgcagtggcgca

SEQ ID NO: 1742 - DNA, 32 bp, Homo sapiens
accacagagcttgccctcagtgaccaaataat

SEQ ID NO: 1743 - DNA, 32 bp, Homo sapiens
caacaagttggctcttgagaatggcagtaaac

SEQ ID NO: 1744 - DNA, 32 bp, Homo sapiens
ctctgtcacccaggctggagtgcagtggcgtg

SEQ ID NO: 1745 - DNA, 32 bp, Homo sapiens
ctctgttgcccaggctggagtgcagtggcgca

SEQ ID NO: 1746 - DNA, 32 bp, Homo sapiens
ctctgtcacccagactggagtgcagtggcatg

SEQ ID NO: 1747 - DNA, 22 bp, Homo sapiens
cgacggccattaccaatcgcga

SEQ ID NO: 1748 - DNA, 32 bp, Homo sapiens
ggggtggtgctgctgctatgagctgcaccatc

SEQ ID NO: 1749 - DNA, 17 bp, Homo sapiens
ccccatgtcacccagaa

SEQ ID NO: 1750 - DNA, 32 bp, Homo sapiens
gagctcagggggccaaggctgcagtgagtcat

SEQ ID NO: 1751 - DNA, 32 bp, Homo sapiens
ggtgcctgcccaggatgggtaggaaatgctga

SEQ ID NO: 1752 - DNA, 32 bp, Homo sapiens
tcttcatgaatggaggcttcagatttttctga

SEQ ID NO: 1753 - DNA, 32 bp, Homo sapiens
ctcccaccctctgagcctcttctgctcctgca

SEQ ID NO: 1754 - DNA, 32 bp, Homo sapiens
acctccacccgccgggttcaagcgattctcct

SEQ ID NO: 1755 - DNA, 32 bp, Homo sapiens
gggcggcggtgctggaggttgcggcggcggct

SEQ ID NO: 1756 - DNA, 32 bp, Homo sapiens
ttagacggagttttgctctttgttgcccaggc

SEQ ID NO: 1757 - DNA, 24 bp, Homo sapiens
tggcgtgatcacagctcactgcag

SEQ ID NO: 1758 - DNA, 32 bp, Homo sapiens
ttcacctaagtttctgccacagctccacatga

SEQ ID NO: 1759 - DNA, 32 bp, Homo sapiens
gctctgtctcccaggttggagtgcagtggcac

SEQ ID NO: 1760 - DNA, 32 bp, Homo sapiens
gctctgtctcccaggctggagtgcagtggcat

SEQ ID NO: 1761 - DNA, 32 bp, Homo sapiens
tctctgttgcccaggctggagtgcagtggcac

SEQ ID NO: 1762 - DNA, 32 bp, Homo sapiens
gagccgaggagtttgagtctgcagtgagctat

SEQ ID NO: 1763 - DNA, 32 bp, Homo sapiens
ggttgcgggaggctggactctggtgactgtaa

SEQ ID NO: 1764 - DNA, 32 bp, Homo sapiens
ttaccagtgaggaaaccgacactgtgagctct

SEQ ID NO: 1765 - DNA, 32 bp, Homo sapiens
ctggattaagatgacttccttacgtagcttgg

SEQ ID NO: 1766 - DNA, 32 bp, Homo sapiens
agcaaaccaagtgccggagcaccagcgccgcc

SEQ ID NO: 1767 - DNA, 32 bp, Homo sapiens
ctttcttgaagttaggttagatcatgttctca

SEQ ID NO: 1768 - DNA, 32 bp, Homo sapiens
agtaggtcctggaaaagtaaattctttatttt

SEQ ID NO: 1769 - DNA, 23 bp, Homo sapiens
ctgttgctaggctggagtgcagt

SEQ ID NO: 1770 - DNA, 32 bp, Homo sapiens
agttctccgagtagctgggaccacatgtgtaa

SEQ ID NO: 1771 - DNA, 32 bp, Homo sapiens
tgggcctctcagagggctcttctgccatccct

SEQ ID NO: 1772 - DNA, 24 bp, Homo sapiens
tcatgcctgtattctcagcacttt

SEQ ID NO: 1773 - DNA, 32 bp, Homo sapiens
tgcagggtgggaggagaagaccaaacgaagta

SEQ ID NO: 1774 - DNA, 32 bp, Homo sapiens
gctcaggatatatcctggtgttgcttgacctg

SEQ ID NO: 1775 - DNA, 23 bp, Homo sapiens
ccaggctctgtctcctcagctca

SEQ ID NO: 1776 - DNA, 32 bp, Homo sapiens
actgggaccccaggcatgcaccacctcaccaa

SEQ ID NO: 1777 - DNA, 32 bp, Homo sapiens
tccagtgctccaggctgggggccgtggatcct

SEQ ID NO: 1778 - DNA, 32 bp, Homo sapiens
actggaaatgttcaactgtagttttattaagg

SEQ ID NO: 1779 - DNA, 32 bp, Homo sapiens
agaatatggtccattccatctgagttttcaaa

SEQ ID NO: 1780 - DNA, 32 bp, Homo sapiens
aattccctgtctccccttaaccagcactggaa

SEQ ID NO: 1781 - DNA, 32 bp, Homo sapiens
tctcccccaagtgagctgcaagaggcccctgt

SEQ ID NO: 1782 - DNA, 32 bp, Homo sapiens
gagcccgggaagcagaggttgcagtgaactga

SEQ ID NO: 1783 - DNA, 32 bp, Homo sapiens
tagtgaaaaactcagttctataagctagctgt

SEQ ID NO: 1784 - DNA, 32 bp, Homo sapiens
acctccgcctcccgggttcaagtgattctcca

SEQ ID NO: 1785 - DNA, 32 bp, Homo sapiens
acctccgcctcctgggttcaagcgatcctcct

SEQ ID NO: 1786 - DNA, 32 bp, Homo sapiens
ttgagatggagtttcactcttgtcacctagac

SEQ ID NO: 1787 - DNA, 32 bp, Homo sapiens
tctggggaaaaaggagaaaggagaggagagtt

SEQ ID NO: 1788 - DNA, 32 bp, Homo sapiens
ataggccaacccagacacagtgcggtaccaga

SEQ ID NO: 1789 - DNA, 32 bp, Homo sapiens
attattgctcacaggctggggaggcagaatga

SEQ ID NO: 1790 - DNA, 32 bp, Homo sapiens
tcaaggccagttctgcagtgacaggcccaggg

SEQ ID NO: 1791 - DNA, 32 bp, Homo sapiens
ttgctgctgcagtattgaaactgtgaagaact

SEQ ID NO: 1792 - DNA, 32 bp, Homo sapiens
gagggaaggaggcaggggtgctgagaaggcgg

SEQ ID NO: 1793 - DNA, 32 bp, Homo sapiens
tctgtaatttaaaatattttgctgctagttaa

SEQ ID NO: 1794 - DNA, 32 bp, Homo sapiens
gtgggtttcctggatggatgtgaagttgggcc

SEQ ID NO: 1795 - DNA, 32 bp, Homo sapiens
cctgagtctccacagagccccacgcctggcat

SEQ ID NO: 1796 - DNA, 32 bp, Homo sapiens
gatttaccaagtgcttcaatgagagcagtcct

SEQ ID NO: 1797 - DNA, 32 bp, Homo sapiens
gaacccgggagacggaggttgcagtgagctga

SEQ ID NO: 1798 - DNA, 32 bp, Homo sapiens
gggggaggtagggaagaatgagctgaatttgt

SEQ ID NO: 1799 - DNA, 32 bp, Homo sapiens
gctctgtcacccaggctggagtgctatggctc

SEQ ID NO: 1800 - DNA, 32 bp, Homo sapiens
cccagttcaagcaattctcctgcctcagcctc

SEQ ID NO: 1801 - DNA, 32 bp, Homo sapiens
taacagtctctgctttgccttctgcctggtag

SEQ ID NO: 1802 - DNA, 32 bp, Homo sapiens
cagaggtgtcttctccccctaacctacagctt

SEQ ID NO: 1803 - DNA, 32 bp, Homo sapiens
tggacatgtaatgtcacatctttgtggagtgt

SEQ ID NO: 1804 - DNA, 32 bp, Homo sapiens
tagagatggagtttcaccatgttggccaggat

SEQ ID NO: 1805 - DNA, 32 bp, Homo sapiens
cccgatcctgcagctctttctggaccttcagg

SEQ ID NO: 1806 - DNA, 32 bp, Homo sapiens
accatctctgcagacccctctcctcctccttc

SEQ ID NO: 1807 - DNA, 32 bp, Homo sapiens
gaaagatggaggagaaaaagaaaaggaagaaa

SEQ ID NO: 1808 - DNA, 28 bp, Homo sapiens
tatgttccaagtgctactctcactcagc

SEQ ID NO: 1809 - DNA, 32 bp, Homo sapiens
tcctgtggaaggcagaggcagtgagggaggtg

SEQ ID NO: 1810 - DNA, 32 bp, Homo sapiens
ggatatgctccccataaataccaccttgccac

SEQ ID NO: 1811 - DNA, 32 bp, Homo sapiens
aactctgccctggcttctctggttcttccctg

SEQ ID NO: 1812 - DNA, 32 bp, Homo sapiens
ccatcctctcccacttccatctggcatcccac

SEQ ID NO: 1813 - DNA, 24 bp, Homo sapiens
acaggcgttagccactgcgcccgg

SEQ ID NO: 1814 - DNA, 19 bp, Homo sapiens
gggagattgcagaagcacc

SEQ ID NO: 1815 - DNA, 18 bp, Homo sapiens
gcaaagcagtatgctccc

SEQ ID NO: 1816 - DNA, 32 bp, Homo sapiens
gagctggggagatggaggctgcagtgagctat

SEQ ID NO: 1817 - DNA, 32 bp, Homo sapiens
ctcttgtcacccaggcaggagtgcagtggcgt

SEQ ID NO: 1818 - DNA, 32 bp, Homo sapiens
aggagtggaagaggagacaatttgaatgaatc

SEQ ID NO: 1819 - DNA, 32 bp, Homo sapiens
gccggaaagcatttgtctcccacctcatcata

SEQ ID NO: 1820 - DNA, 32 bp, Homo sapiens
ctgggctcaagcaattcttctgcctcagcctc

SEQ ID NO: 1821 - DNA, 32 bp, Homo sapiens
tcctggcctcaagtgatccttctgcctcagtc

SEQ ID NO: 1822 - DNA, 19 bp, Homo sapiens
cccgtaatcccagcacttt

SEQ ID NO: 1823 - DNA, 19 bp, Homo sapiens
cctgtaatcctagcacttt

SEQ ID NO: 1824 - DNA, 19 bp, Homo sapiens
cagggaggatccgcagccc

SEQ ID NO: 1825 - DNA, 32 bp, Homo sapiens
ggtttagtgctgctgctttcactgctgcaccc

SEQ ID NO: 1826 - DNA, 32 bp, Homo sapiens
gctcagagacctggcagacaccaccttaaccc

SEQ ID NO: 1827 - DNA, 32 bp, Homo sapiens
gagatgttgagaatgttcatctctccagcccc

SEQ ID NO: 1828 - DNA, 32 bp, Homo sapiens
agctccgcctcccgagttcaagcaattctcct

SEQ ID NO: 1829 - DNA, 32 bp, Homo sapiens
gggacccgttggcagaggtggcggcggcggca

SEQ ID NO: 1830 - DNA, 32 bp, Homo sapiens
acaacccggaaagaaccatcactgtgaagggc

SEQ ID NO: 1831 - DNA, 32 bp, Homo sapiens
agcctcctgagtagctgggactacaggcatga

SEQ ID NO: 1832 - DNA, 32 bp, Homo sapiens
agcccccagagtagctgggattacaggcatgt

SEQ ID NO: 1833 - DNA, 32 bp, Homo sapiens
agaattaaaaggcagttgctgtggaaacagtt

SEQ ID NO: 1834 - DNA, 32 bp, Homo sapiens
tcttatagcactggaggaggaaaacaaattct

SEQ ID NO: 1835 - DNA, 32 bp, Homo sapiens
ccagattcaagcaattctcctgtttcagcctc

SEQ ID NO: 1836 - DNA, 32 bp, Homo sapiens
cctgagcaggcaaggagctcttgcatttgctg

SEQ ID NO: 1837 - DNA, 32 bp, Homo sapiens
tctgtccgcccaggctgggtgcagtcacggct

SEQ ID NO: 1838 - DNA, 32 bp, Homo sapiens
gttttctctcaaacatgaacactttagaattg

SEQ ID NO: 1839 - DNA, 32 bp, Homo sapiens
gcggggagagagagggatagaaaacaagcgca

SEQ ID NO: 1840 - DNA, 32 bp, Homo sapiens
ttgagacagagtttcactcttgttgcccacgc

SEQ ID NO: 1841 - DNA, 32 bp, Homo sapiens
ctgaaattgctgctgcccatcgcatgagccca

SEQ ID NO: 1842 - DNA, 32 bp, Homo sapiens
gggttattatgccacatctccatgaaaatgca

SEQ ID NO: 1843 - DNA, 32 bp, Homo sapiens
aaaagaatattgaggctgggtgcaatgcatca

SEQ ID NO: 1844 - DNA, 32 bp, Homo sapiens
agtctgtgggtgaatggatgtgtgttgaattt

SEQ ID NO: 1845 - DNA, 32 bp, Homo sapiens
ctcttgtgaccctcatgtgagcacttttgaga

SEQ ID NO: 1846 - DNA, 32 bp, Homo sapiens
tcagctcctagagggagattgttagatcatga

SEQ ID NO: 1847 - DNA, 32 bp, Homo sapiens
ctctgttgcccaggatggaatgcagtggcaca

SEQ ID NO: 1848 - DNA, 24 bp, Homo sapiens
tgaggttctcaaggtcacaggccc

SEQ ID NO: 1849 - DNA, 24 bp, Homo sapiens
tcacacccataatcccaacacttt

SEQ ID NO: 1850 - DNA, 32 bp, Homo sapiens
aaacactcatcagaaattaagtgcagtctagt

SEQ ID NO: 1851 - DNA, 32 bp, Homo sapiens
caaggaagcccaagtaggagatttgggaaaca

SEQ ID NO: 1852 - DNA, 28 bp, Homo sapiens
tcagaaggaggagagacaccgggcccag

SEQ ID NO: 1853 - DNA, 32 bp, Homo sapiens
tcaaagcatctcccccatctgcatacccagca

SEQ ID NO: 1854 - DNA, 32 bp, Homo sapiens
aaaggaaagccttttcctgtctgatcctgaga

SEQ ID NO: 1855 - DNA, 32 bp, Homo sapiens
acccccgcttcccgggttcaagcaattctcct

SEQ ID NO: 1856 - DNA, 32 bp, Homo sapiens
ctctgtcacccaggctggagtgcagtggcgaa

SEQ ID NO: 1857 - DNA, 32 bp, Homo sapiens
ctctgtcgcccaggatggagtgcagtggcgcg

SEQ ID NO: 1858 - DNA, 32 bp, Homo sapiens
gctctgtcacccaagctggaatacagtggcat

SEQ ID NO: 1859 - DNA, 32 bp, Homo sapiens
gccatccttaagtctgctcccaccctcagtag

SEQ ID NO: 1860 - DNA, 32 bp, Homo sapiens
tgcttgggtaatcccttttaatggtgactgaa

SEQ ID NO: 1861 - DNA, 32 bp, Homo sapiens
ctctgtcgcccaggctggagtgcagtggcgag

SEQ ID NO: 1862 - DNA, 32 bp, Homo sapiens
tgtttgctgggagcttctctgctgcttaaatt

SEQ ID NO: 1863 - DNA, 32 bp, Homo sapiens
cctcagcagcttctccctgtcttcctctcctc

SEQ ID NO: 1864 - DNA, 32 bp, Homo sapiens
tagagacagggtttcgctatgttggccaggct

SEQ ID NO: 1865 - DNA, 32 bp, Homo sapiens
ttaaatgtgccagcaggtaacatttacagtct

SEQ ID NO: 1866 - DNA, 32 bp, Homo sapiens
ccatgttggccaggctggtctcgaatgtctga

SEQ ID NO: 1867 - DNA, 32 bp, Homo sapiens
ctttgtcacccagggtggtgtgcagtggagct

SEQ ID NO: 1868 - DNA, 32 bp, Homo sapiens
ctcttgttgcccaggctggagtgcaacggcac

SEQ ID NO: 1869 - DNA, 32 bp, Homo sapiens
gaaacaatgaagtggaaaagaaaacagctaaa

SEQ ID NO: 1870 - DNA, 32 bp, Homo sapiens
attttaaagaattgacctaaggaaagcttatg

SEQ ID NO: 1871 - DNA, 32 bp, Homo sapiens
ttttctgttctggatgtcagtgcagtgcactg

SEQ ID NO: 1872 - DNA, 32 bp, Homo sapiens
gtgccacatcttccctccactcccctgcttaa

SEQ ID NO: 1873 - DNA, 23 bp, Homo sapiens
caaaatgagagacaaaaatgaag

SEQ ID NO: 1874 - DNA, 32 bp, Homo sapiens
ttggtgggaggaggagaaaacaattgttttta

SEQ ID NO: 1875 - DNA, 21 bp, Homo sapiens
agccctaatgatgactggaaa

SEQ ID NO: 1876 - DNA, 32 bp, Homo sapiens
ggcctaacatatggcatatcccagaaaatgtt

SEQ ID NO: 1877 - DNA, 32 bp, Homo sapiens
cagagtcacccaggctggagtgcagtggtgag

SEQ ID NO: 1878 - DNA, 32 bp, Homo sapiens
tagagatggagtttcaccatgttgcccaggct

SEQ ID NO: 1879 - DNA, 32 bp, Homo sapiens
tacttacggagtttcgctcttattgcccagac

SEQ ID NO: 1880 - DNA, 32 bp, Homo sapiens
aatgtgttgctgctgccacccctgccccaaag

SEQ ID NO: 1881 - DNA, 32 bp, Homo sapiens
tgtttgggtagatcggaatgagttgttgagct

SEQ ID NO: 1882 - DNA, 32 bp, Homo sapiens
gctacaatccatctggtctcctccagctcctt

SEQ ID NO: 1883 - DNA, 32 bp, Homo sapiens
tgcgtggagctgcaggcttcagctgccttcaa

SEQ ID NO: 1884 - DNA, 32 bp, Homo sapiens
gtggaggaggaaggaggatcactgtggaaatc

SEQ ID NO: 1885 - DNA, 32 bp, Homo sapiens
tcttgttacccaggcaggagtgcagtggcgtg

SEQ ID NO: 1886 - DNA, 32 bp, Homo sapiens
tgttgatacattttgaatctttagacacttac

SEQ ID NO: 1887 - DNA, 32 bp, Homo sapiens
acagttgtgacggatgtatggatgttcttgaa

SEQ ID NO: 1888 - DNA, 32 bp, Homo sapiens
acctctgccttccaggttcaagcaattatcct

SEQ ID NO: 1889 - DNA, 28 bp, Homo sapiens
tgtataaaaagtgctgtctctcagtagt

SEQ ID NO: 1890 - DNA, 32 bp, Homo sapiens
cactttgggaggcaaaggcgggaggatcactt

SEQ ID NO: 1891 - DNA, 32 bp, Homo sapiens
gcggaggtgagaggagaggaggagaaaactgc

SEQ ID NO: 1892 - DNA, 32 bp, Homo sapiens
agcctccagagtagctgggattacaggcacgc

SEQ ID NO: 1893 - DNA, 32 bp, Homo sapiens
tgcaacaggtccaggctgctgtggaagctgct

SEQ ID NO: 1894 - DNA, 32 bp, Homo sapiens
ttttcacatcttcattcactgggattctggac

SEQ ID NO: 1895 - DNA, 32 bp, Homo sapiens
agttgagattggagagcagcgccgtctgtact

SEQ ID NO: 1896 - DNA, 24 bp, Homo sapiens
tcatgcctgtaatcgtagcacttt

SEQ ID NO: 1897 - DNA, 22 bp, Homo sapiens
atccaacctggggattttttaa

SEQ ID NO: 1898 - DNA, 32 bp, Homo sapiens
tgagccatctcagcttctcaaccttgcctgtt

SEQ ID NO: 1899 - DNA, 32 bp, Homo sapiens
taaaatatgtaatctcttaaatggcagtaaga

SEQ ID NO: 1900 - DNA, 32 bp, Homo sapiens
agagtcttgctctgctggagtgcggtggtgca

SEQ ID NO: 1901 - DNA, 32 bp, Homo sapiens
actgtctgctcaggctggtggtgacaggatcc

SEQ ID NO: 1902 - DNA, 32 bp, Homo sapiens
cactcttcagttctgaaatagacagacttgag

SEQ ID NO: 1903 - DNA, 32 bp, Homo sapiens
atacctgggaggcggagattgcagtgagccga

SEQ ID NO: 1904 - DNA, 32 bp, Homo sapiens
gaacccaggaagtggaggttgcagtgagccga

SEQ ID NO: 1905 - DNA, 32 bp, Homo sapiens
gacggtggcgccggctggagaatggactgtga

SEQ ID NO: 1906 - DNA, 32 bp, Homo sapiens
gaacccaggaggtggaggttgcagtgggccga

SEQ ID NO: 1907 - DNA, 32 bp, Homo sapiens
gagcccaggaggtggaggttgcagtgagccga

SEQ ID NO: 1908 - DNA, 32 bp, Homo sapiens
gagcctgggaggtggaggttgcagtgagctaa

SEQ ID NO: 1909 - DNA, 32 bp, Homo sapiens
gaacctagggcccttggccaatgtgattaaag

SEQ ID NO: 1910 - DNA, 32 bp, Homo sapiens
ttgtcaagcaatttgtccatgtggaaagaatt

SEQ ID NO: 1911 - DNA, 32 bp, Homo sapiens
gaacctgggaggtggaggttgcagtgggctaa

SEQ ID NO: 1912 - DNA, 32 bp, Homo sapiens
gacgtcattcttctccaggctggcccgccccc

SEQ ID NO: 1913 - DNA, 32 bp, Homo sapiens
atgggctccttgagagcaagcattgtttccca

SEQ ID NO: 1914 - DNA, 32 bp, Homo sapiens
ttctgattcagtagactggaggtgaagtcagg

SEQ ID NO: 1915 - DNA, 23 bp, Homo sapiens
tggcatgatctcggcttactgca

SEQ ID NO: 1916 - DNA, 32 bp, Homo sapiens
ttccctgcctgagacacgtatggaagccaaga

SEQ ID NO: 1917 - DNA, 32 bp, Homo sapiens
cccgctgctggccgctctcttctctgcctctc

SEQ ID NO: 1918 - DNA, 32 bp, Homo sapiens
cgctacccaattctgtcatctccaagctgagt

SEQ ID NO: 1919 - DNA, 32 bp, Homo sapiens
ggcggctcagttctgcggtgccagggagtgga

SEQ ID NO: 1920 - DNA, 32 bp, Homo sapiens
ggctcatgcctgtggtcccagcactttgggag

SEQ ID NO: 1921 - DNA, 32 bp, Homo sapiens
ggctcgtgcctgtagtcccagcactttgggag

SEQ ID NO: 1922 - DNA, 32 bp, Homo sapiens
agttccaacttctgctaaaattggttaattgg

SEQ ID NO: 1923 - DNA, 32 bp, Homo sapiens
caaccctgtctgctgctccggagctccgagca

SEQ ID NO: 1924 - DNA, 32 bp, Homo sapiens
aatgagccatggcattgggacagggtcacttc

SEQ ID NO: 1925 - DNA, 32 bp, Homo sapiens
ccaggttcaagcaattttcgtgcctcagcctc

SEQ ID NO: 1926 - DNA, 32 bp, Homo sapiens
cttctgtcacctaggctggagtgtagtgacat

SEQ ID NO: 1927 - DNA, 32 bp, Homo sapiens
caccgcgggaggccagggtgctgactgtcaag

SEQ ID NO: 1928 - DNA, 32 bp, Homo sapiens
ctactcgggaggctgaggcgggagaattgctt

SEQ ID NO: 1929 - DNA, 32 bp, Homo sapiens
tcaggccgcatcctgaactgcttctccaagga

SEQ ID NO: 1930 - DNA, 32 bp, Homo sapiens
ccaacctatcgctgctggcagcactttttgag

SEQ ID NO: 1931 - DNA, 32 bp, Homo sapiens
aggtctccccgagaaggagaagttctttaatt

SEQ ID NO: 1932 - DNA, 32 bp, Homo sapiens
atgtgctggtggatccactcccatggatccac

SEQ ID NO: 1933 - DNA, 32 bp, Homo sapiens
gtgccagcctgagactcaactatcaggaaaaa

SEQ ID NO: 1934 - DNA, 20 bp, Homo sapiens
caggatgtttgttgccagaa

SEQ ID NO: 1935 - DNA, 32 bp, Homo sapiens
ctgggttcaagcaattttcttgcctcagcctc

SEQ ID NO: 1936 - DNA, 32 bp, Homo sapiens
ctcggggtgacggaatgttctggaccttgata

SEQ ID NO: 1937 - DNA, 32 bp, Homo sapiens
ggggaatggcccaggcgggctgcggttcctcc

SEQ ID NO: 1938 - DNA, 28 bp, Homo sapiens
agcagcccctgcgctgcctcatctacat

SEQ ID NO: 1939 - DNA, 32 bp, Homo sapiens
ctctgttgccaaggctggagtgcagtggaacg

SEQ ID NO: 1940 - DNA, 32 bp, Homo sapiens
cccaggtgatctggttacagtgcagtgctgac

SEQ ID NO: 1941 - DNA, 32 bp, Homo sapiens
agccttccgagtagctgggactacaggcgcat

SEQ ID NO: 1942 - DNA, 32 bp, Homo sapiens
agcttcctgagtagctgggactacaggtgtac

SEQ ID NO: 1943 - DNA, 32 bp, Homo sapiens
aaggttgcaaacaaggtcctggaagataagat

SEQ ID NO: 1944 - DNA, 32 bp, Homo sapiens
atcccaacacaaaacaaacaccacctccgatt

SEQ ID NO: 1945 - DNA, 32 bp, Homo sapiens
actctgtcacccaagatggagtgcaatggcac

SEQ ID NO: 1946 - DNA, 32 bp, Homo sapiens
caagctccataactccttttggtgctaatgat

SEQ ID NO: 1947 - DNA, 32 bp, Homo sapiens
cagagatggagtttcaccacgttggccaagct

SEQ ID NO: 1948 - DNA, 32 bp, Homo sapiens
gtgaattcatcagctctgcaggcacagacctt

SEQ ID NO: 1949 - DNA, 32 bp, Homo sapiens
ataccagcctgaggtgtctcaggggaggctgg

SEQ ID NO: 1950 - DNA, 32 bp, Homo sapiens
gcagtagggaggcagagtatcttggtggggag

SEQ ID NO: 1951 - DNA, 32 bp, Homo sapiens
gagcccaggaggttgagaatgcagtgagcttg

SEQ ID NO: 1952 - DNA, 32 bp, Homo sapiens
cttgttatatgccagaatctttgctatgtgtt

SEQ ID NO: 1953 - DNA, 32 bp, Homo sapiens
aatcctcctcaggcaggtcccacctgcaggcc

SEQ ID NO: 1954 - DNA, 32 bp, Homo sapiens
gcctcacccagtagctgggaaattaggtgggg

SEQ ID NO: 1955 - DNA, 28 bp, Homo sapiens
gtgttgccaagtgctgcgtcctcctggt

SEQ ID NO: 1956 - DNA, 32 bp, Homo sapiens
aataggccacagaaggtgaactttgtgcttca

SEQ ID NO: 1957 - DNA, 32 bp, Homo sapiens
gtgtagcagcctctccccatctacctagcaac

SEQ ID NO: 1958 - DNA, 32 bp, Homo sapiens
ccttctgcacccagagtaggggtggagtatac

SEQ ID NO: 1959 - DNA, 32 bp, Homo sapiens
gctctgttgcccaggctggagtgcagtgacgt

SEQ ID NO: 1960 - DNA, 32 bp, Homo sapiens
gctctgtcgcccaggctggaatgcagtggcgc

SEQ ID NO: 1961 - DNA, 32 bp, Homo sapiens
taactggcctccatcttgggtcatctcatctt

SEQ ID NO: 1962 - DNA, 32 bp, Homo sapiens
actctgtcacccaggctggagtacagtgacac

SEQ ID NO: 1963 - DNA, 32 bp, Homo sapiens
gctctgttgcccaggctggaatgcagtggcgt

SEQ ID NO: 1964 - DNA, 32 bp, Homo sapiens
tggtcaggagggtcgctgctgtggaaggggtc

SEQ ID NO: 1965 - DNA, 32 bp, Homo sapiens
aacctgggagacagaagtttgcagtgatccga

SEQ ID NO: 1966 - DNA, 32 bp, Homo sapiens
ccctgtcgcccaggctggagtgccatggcgcg

SEQ ID NO: 1967 - DNA, 32 bp, Homo sapiens
cagcagtgttaaccagtcatggtgctagattg

SEQ ID NO: 1968 - DNA, 32 bp, Homo sapiens
caccttaaactggtttctatggtgcttcatcg

SEQ ID NO: 1969 - DNA, 23 bp, Homo sapiens
ctgttgccaggctggaatgcagt

SEQ ID NO: 1970 - DNA, 24 bp, Homo sapiens
ctgtcgccctggctggagtgcaat

SEQ ID NO: 1971 - DNA, 23 bp, Homo sapiens
tcatgcctacaatcccagcattt

SEQ ID NO: 1972 - DNA, 32 bp, Homo sapiens
actctgtcgcccagactggaatgtggtggcat

SEQ ID NO: 1973 - DNA, 16 bp, Homo sapiens
agggaggtgccagccc

SEQ ID NO: 1974 - DNA, 32 bp, Homo sapiens
ctggggaccgcagcagggctgcagtcacatcc

SEQ ID NO: 1975 - DNA, 32 bp, Homo sapiens
tccctttccctctctgctgagcatttaaccat

SEQ ID NO: 1976 - DNA, 32 bp, Homo sapiens
aattgggttatatctggcttctctccagacct

SEQ ID NO: 1977 - DNA, 32 bp, Homo sapiens
cactatcacatcctgaatatcactcacagaat

SEQ ID NO: 1978 - DNA, 32 bp, Homo sapiens
gctggtattattatgttcttagcaataaatgc

SEQ ID NO: 1979 - DNA, 32 bp, Homo sapiens
tgtagccacttcagtccatctgccctccagag

SEQ ID NO: 1980 - DNA, 28 bp, Homo sapiens
gtggctgccggagctgcctcctcctcct

SEQ ID NO: 1981 - DNA, 32 bp, Homo sapiens
gaactggggaggcagaggttgcggtgagccca

SEQ ID NO: 1982 - DNA, 32 bp, Homo sapiens
ctctaccacccaggctggagtgcagtggtgtg

SEQ ID NO: 1983 - DNA, 32 bp, Homo sapiens
cctgcagagcctgggagctgcaggaactgtct

SEQ ID NO: 1984 - DNA, 32 bp, Homo sapiens
gggggccagagtagctgatgtaggagtactgg

SEQ ID NO: 1985 - DNA, 32 bp, Homo sapiens
tgcctcctgagtagctgggattacaggtgcat

SEQ ID NO: 1986 - DNA, 32 bp, Homo sapiens
aggattagaagaggaaacagaaacaggtaaca

SEQ ID NO: 1987 - DNA, 32 bp, Homo sapiens
ccatagagaggaggagaagaaactaaccaaca

SEQ ID NO: 1988 - DNA, 32 bp, Homo sapiens
ttaaagagaagaggcgagagcatgaagataaa

SEQ ID NO: 1989 - DNA, 32 bp, Homo sapiens
ctcttgtgtccaggctggagtgcagtggcact

SEQ ID NO: 1990 - DNA, 32 bp, Homo sapiens
tcttcagtgtccaaatctcttctgtctccttt

SEQ ID NO: 1991 - DNA, 32 bp, Homo sapiens
ccagggtatatgtggcagcctttgccatatca

SEQ ID NO: 1992 - DNA, 32 bp, Homo sapiens
acaataaactctcttttgcaccacagacttct

SEQ ID NO: 1993 - DNA, 32 bp, Homo sapiens
ataatttgtgtcgatggatgttctgtgaaggc

SEQ ID NO: 1994 - DNA, 32 bp, Homo sapiens
gctccattgcccaggctggactgcagcagcgt

SEQ ID NO: 1995 - DNA, 32 bp, Homo sapiens
cagtctgtcaccaggctggagtgcagtggcat

SEQ ID NO: 1996 - DNA, 32 bp, Homo sapiens
gagcccaggaggttgaggctgcagtgaactaa

SEQ ID NO: 1997 - DNA, 32 bp, Homo sapiens
ctctatcacctaggctggagtgcagcggcatg

SEQ ID NO: 1998 - DNA, 32 bp, Homo sapiens
cggggctgggcaggctggatgtggtggtgtac

SEQ ID NO: 1999 - DNA, 32 bp, Homo sapiens
ccgaggccagctggctgcaggtgcagggctat

SEQ ID NO: 2000 - DNA, 22 bp, Homo sapiens
tcacgcctgtaataccagcact

SEQ ID NO: 2001 - DNA, 32 bp, Homo sapiens
gggtccaggaggtggaggctgcagtgagctat

SEQ ID NO: 2002 - DNA, 32 bp, Homo sapiens
ccactccccaaaactgaccccaatctctgtgt

SEQ ID NO: 2003 - DNA, 32 bp, Homo sapiens
gcactccccaaaacatcccattttgcaggtgt

SEQ ID NO: 2004 - DNA, 32 bp, Homo sapiens
ccttccctgagactgtctcttctcctgtgaaa

SEQ ID NO: 2005 - DNA, 22 bp, Homo sapiens
ctctgtccttctccttgggcat

SEQ ID NO: 2006 - DNA, 32 bp, Homo sapiens
cttttgtttgcccttgaacagggcagtgttgt

SEQ ID NO: 2007 - DNA, 32 bp, Homo sapiens
cctcctcagacactcagacaccactccaggct

SEQ ID NO: 2008 - DNA, 32 bp, Homo sapiens
gtcttgtttcccaggctggagtgcaatggcac

SEQ ID NO: 2009 - DNA, 32 bp, Homo sapiens
actctctcggatccgtgcttctctccattgta

SEQ ID NO: 2010 - DNA, 32 bp, Homo sapiens
gtctgttacccaggctggagtgcagtggcatg

SEQ ID NO: 2011 - DNA, 32 bp, Homo sapiens
tgttaccacttcctgaatcagttattatttct

SEQ ID NO: 2012 - DNA, 32 bp, Homo sapiens
ctctcgtcgcccaggctggaatgcagtggtgc

SEQ ID NO: 2013 - DNA, 32 bp, Homo sapiens
acagcatgtctcgacttcctgaggaatatctg

SEQ ID NO: 2014 - DNA, 28 bp, Homo sapiens
ccaaccccaagtgccttcatgccctagg

SEQ ID NO: 2015 - DNA, 32 bp, Homo sapiens
cgaggcccagctccctgaaacaacagtaacct

SEQ ID NO: 2016 - DNA, 32 bp, Homo sapiens
acatcccttggcccctccatctgggctcctgt

SEQ ID NO: 2017 - DNA, 32 bp, Homo sapiens
cagggtagaagaggctgagggacacacagagg

SEQ ID NO: 2018 - DNA, 32 bp, Homo sapiens
cctgcttcaagctattctcccacctcatcctc

SEQ ID NO: 2019 - DNA, 32 bp, Homo sapiens
ttttgttgcccaggctggagtgtagtggcgcg

SEQ ID NO: 2020 - DNA, 32 bp, Homo sapiens
aagcgcaccctgtcgttcagtgacgtcattct

SEQ ID NO: 2021 - DNA, 32 bp, Homo sapiens
tgatgaagtagatcatgcagtgacatacaaag

SEQ ID NO: 2022 - DNA, 20 bp, Homo sapiens
cagggaagtccttccagcct

SEQ ID NO: 2023 - DNA, 24 bp, Homo sapiens
tggcatgattgtagctcactgcag

SEQ ID NO: 2024 - DNA, 32 bp, Homo sapiens
acttatgtgctgctagtctctactcgaagttc

SEQ ID NO: 2025 - DNA, 32 bp, Homo sapiens
caaaggcctgagagctggagtcagtgtggtgt

SEQ ID NO: 2026 - DNA, 32 bp, Homo sapiens
ctactcgggaggctgaggcaggaggatcactt

SEQ ID NO: 2027 - DNA, 32 bp, Homo sapiens
ctctgttgcccaggctggagtgcaggggcgta

SEQ ID NO: 2028 - DNA, 32 bp, Homo sapiens
ctctgtcgcccaggctggagtgcaggggcgca

SEQ ID NO: 2029 - DNA, 32 bp, Homo sapiens
ctggctgaatggtgaggagaattttctttaaa

SEQ ID NO: 2030 - DNA, 32 bp, Homo sapiens
tgtcttcaacatcatttgatactatagactta

SEQ ID NO: 2031 - DNA, 32 bp, Homo sapiens
ctactcgggaggctgaagcaggagaatcactt

SEQ ID NO: 2032 - DNA, 15 bp, Homo sapiens
ttcctgcctcaggta

SEQ ID NO: 2033 - DNA, 32 bp, Homo sapiens
gaatggtcaagcaatcccaacttatgattact

SEQ ID NO: 2034 - DNA, 32 bp, Homo sapiens
ccgggttcaagcaatttcctgcctcagcctca

SEQ ID NO: 2035 - DNA, 32 bp, Homo sapiens
catggccagagcttctcccaggcacaggtgtt

SEQ ID NO: 2036 - DNA, 22 bp, Homo sapiens
ccatcttccggctccagcgtca

SEQ ID NO: 2037 - DNA, 20 bp, Homo sapiens
ccccagggactgtccaggtg

SEQ ID NO: 2038 - DNA, 28 bp, Homo sapiens
tgcctagccatgtctgcctcatcctcag

SEQ ID NO: 2039 - DNA, 32 bp, Homo sapiens
cccccttgcccaggcccttgggggagggggtg

SEQ ID NO: 2040 - DNA, 32 bp, Homo sapiens
ttggggaaagagaagagaatttcctgtggatt

SEQ ID NO: 2041 - DNA, 32 bp, Homo sapiens
ggcaaggtcattaaatttgccacctcacacgt

SEQ ID NO: 2042 - DNA, 32 bp, Homo sapiens
ccctaagactgtgacctcctggaaggctggag

SEQ ID NO: 2043 - DNA, 32 bp, Homo sapiens
tctcttcctttgtcatttcaagcaattttcat

SEQ ID NO: 2044 - DNA, 32 bp, Homo sapiens
tctcgttgccgaggctggagtgtagtagtgtg

SEQ ID NO: 2045 - DNA, 32 bp, Homo sapiens
catgcgccggaaggagcttcaggtgagcactg

SEQ ID NO: 2046 - DNA, 32 bp, Homo sapiens
caggggcccatggactcttcagtctggagggt

SEQ ID NO: 2047 - DNA, 32 bp, Homo sapiens
ggatgcttctaattcagccactgtgaaccatt

SEQ ID NO: 2048 - DNA, 32 bp, Homo sapiens
tggtcaggcccaggctgagtgagatgagctgc

SEQ ID NO: 2049 - DNA, 32 bp, Homo sapiens
tcctatgaacaacgtaccaacactttctgatt

SEQ ID NO: 2050 - DNA, 32 bp, Homo sapiens
gaatttgagccttggcttctttccacccagat

SEQ ID NO: 2051 - DNA, 32 bp, Homo sapiens
caagaagtgggtgcccttggtagcagcctggg

SEQ ID NO: 2052 - DNA, 32 bp, Homo sapiens
catgtgtgggggcagaggttatgtgggaaatc

SEQ ID NO: 2053 - DNA, 32 bp, Homo sapiens
ctcttatgcccacgctggagtgcagtgagccg

SEQ ID NO: 2054 - DNA, 24 bp, Homo sapiens
tcacatctgtaatgccagcacttt

SEQ ID NO: 2055 - DNA, 32 bp, Homo sapiens
ctggactcaagcagtctgcccacctcagactc

SEQ ID NO: 2056 - DNA, 32 bp, Homo sapiens
ctggtttcaagcgatcctcccacctcggcctc

SEQ ID NO: 2057 - DNA, 32 bp, Homo sapiens
taaccctcgcactttctccactgtggagatgg

SEQ ID NO: 2058 - DNA, 32 bp, Homo sapiens
tttagatggagtttcactcttgttgcccaggc

SEQ ID NO: 2059 - DNA, 32 bp, Homo sapiens
gcatttcccgaaggccgacaccactcctgcca

SEQ ID NO: 2060 - DNA, 32 bp, Homo sapiens
agcctcctgagtaggtgggattacagatgccc

SEQ ID NO: 2061 - DNA, 32 bp, Homo sapiens
ctctgttgcctgggctggagtgcagtggccca

SEQ ID NO: 2062 - DNA, 32 bp, Homo sapiens
ctgggttttggagcctcccttctgccttggct

SEQ ID NO: 2063 - DNA, 32 bp, Homo sapiens
ggaggaggaggaggagaaggaggagagagagg

SEQ ID NO: 2064 - DNA, 32 bp, Homo sapiens
ccgggttcaagcagttctctgcctcagcctcc

SEQ ID NO: 2065 - DNA, 32 bp, Homo sapiens
ttgagatggagtttcaccttattcccaggctg

SEQ ID NO: 2066 - DNA, 32 bp, Homo sapiens
atgggagagccagcaggggttctggagaaaaa

SEQ ID NO: 2067 - DNA, 32 bp, Homo sapiens
actctgttgctaggctggagtgcagtggtgcg

SEQ ID NO: 2068 - DNA, 32 bp, Homo sapiens
aattccaaggtttttgctacagttagtttctc

SEQ ID NO: 2069 - DNA, 28 bp, Homo sapiens
agccaggctcaggctgcctcttcgtttt

SEQ ID NO: 2070 - DNA, 32 bp, Homo sapiens
aaacctgggaggcagaggtgagctgagatcgc

SEQ ID NO: 2071 - DNA, 32 bp, Homo sapiens
gtgggagggaggcagtgggaagtagttgaatc

SEQ ID NO: 2072 - DNA, 32 bp, Homo sapiens
ctgggttcaagcaagtctcctgcctcagcctc

SEQ ID NO: 2073 - DNA, 32 bp, Homo sapiens
tacaattatcaagcagagaccacctcagatta

SEQ ID NO: 2074 - DNA, 32 bp, Homo sapiens
cggagttgagcaaacaacgccacgccgcgtgc

SEQ ID NO: 2075 - DNA, 22 bp, Homo sapiens
tcatgaatgtggccatggcccc

SEQ ID NO: 2076 - DNA, 32 bp, Homo sapiens
caaaacagaagagggaacggaaaaagacagtc

SEQ ID NO: 2077 - DNA, 32 bp, Homo sapiens
agcaggctccctgagtgatgagcttgaacctg

SEQ ID NO: 2078 - DNA, 32 bp, Homo sapiens
gaggaatggagtttccttgatgagcctgagag

SEQ ID NO: 2079 - DNA, 32 bp, Homo sapiens
cctactcttggccttgaacctacctctgggtt

SEQ ID NO: 2080 - DNA, 32 bp, Homo sapiens
ttcactttgttcatttctcttctgttttctgt

SEQ ID NO: 2081 - DNA, 32 bp, Homo sapiens
ttgagatggagtttcacccttgttgcccaggc

SEQ ID NO: 2082 - DNA, 32 bp, Homo sapiens
ttgagacagagttttgctcttgttgtccaggc

SEQ ID NO: 2083 - DNA, 32 bp, Homo sapiens
ttgagacagagttttgcccttgttgcccaggc

SEQ ID NO: 2084 - DNA, 20 bp, Homo sapiens
ctgctgttggctgcaccagg

SEQ ID NO: 2085 - DNA, 32 bp, Homo sapiens
gctctgacgcacaggctggagtgcagtggctc

SEQ ID NO: 2086 - DNA, 32 bp, Homo sapiens
actctgtcacacaggctggagtgcagtggcac

SEQ ID NO: 2087 - DNA, 32 bp, Homo sapiens
agaaagaggttaggagtagatattgattacta

SEQ ID NO: 2088 - DNA, 32 bp, Homo sapiens
cctcgccagccctgctggagtttgctgtgggc

SEQ ID NO: 2089 - DNA, 32 bp, Homo sapiens
tcgggaccctcttcattctctgatctcatcct

SEQ ID NO: 2090 - DNA, 32 bp, Homo sapiens
aactaaaaagagactgtgccatggtgagaaaa

SEQ ID NO: 2091 - DNA, 32 bp, Homo sapiens
cgggaggctgaggcaggagaattgtttgaacc

SEQ ID NO: 2092 - DNA, 32 bp, Homo sapiens
tgcccctcaaagtgctgggattacgtgatcca

SEQ ID NO: 2093 - DNA, 32 bp, Homo sapiens
acatgaataggaatcttcctggcacttagtgt

SEQ ID NO: 2094 - DNA, 32 bp, Homo sapiens
agctgaggacgaacagcatcttagccaagacc

SEQ ID NO: 2095 - DNA, 32 bp, Homo sapiens
attacaggagcaagagaaagaagataatttaa

SEQ ID NO: 2096 - DNA, 32 bp, Homo sapiens
ctggcctcaaactatcctcccaccttagcctc

SEQ ID NO: 2097 - DNA, 32 bp, Homo sapiens
cttttagtttctcttctttctaaagaaggctc

SEQ ID NO: 2098 - DNA, 32 bp, Homo sapiens
ctcttcccttggagagtcactgttcacctcag

SEQ ID NO: 2099 - DNA, 32 bp, Homo sapiens
atggcatttgtctgtctctgtgtcaaagcact

SEQ ID NO: 2100 - DNA, 32 bp, Homo sapiens
gatctgtcacccaggctggagtgcagtggcac

SEQ ID NO: 2101 - DNA, 32 bp, Homo sapiens
agtcagggagggcagagggtggcagcgagggc

SEQ ID NO: 2102 - DNA, 32 bp, Homo sapiens
ctaccgcctcctggacctctttgctcgtcctt

SEQ ID NO: 2103 - DNA, 32 bp, Homo sapiens
gatctgttacccaggctggagtgcagtggcat

SEQ ID NO: 2104 - DNA, 32 bp, Homo sapiens
cagcctgccaagtagctggattacaggcacgt

SEQ ID NO: 2105 - DNA, 28 bp, Homo sapiens
atgactcccactgctgcctctcctgggc

SEQ ID NO: 2106 - DNA, 32 bp, Homo sapiens
ccttccccaagtgagctcagcagcatgtgcta

SEQ ID NO: 2107 - DNA, 32 bp, Homo sapiens
agcctcccaagtagctgggattacaggcatgc

SEQ ID NO: 2108 - DNA, 32 bp, Homo sapiens
agcctcctgagtagctgggattacgggcatgt

SEQ ID NO: 2109 - DNA, 32 bp, Homo sapiens
agcctcctgagtagctaggattacaggcatgt

SEQ ID NO: 2110 - DNA, 32 bp, Homo sapiens
gagggtggagcctcctggaagtgaccagagcc

SEQ ID NO: 2111 - DNA, 25 bp, Homo sapiens
tcacaccttgtaatcccagcacttt

SEQ ID NO: 2112 - DNA, 32 bp, Homo sapiens
tgcttgtcacccaggctggagtgcaatggcat

SEQ ID NO: 2113 - DNA, 32 bp, Homo sapiens
tgccctgtggagctgctcacctaagttcctgc

SEQ ID NO: 2114 - DNA, 32 bp, Homo sapiens
ctctctcacccaggctggagtggagtggcgct

SEQ ID NO: 2115 - DNA, 20 bp, Homo sapiens
tgtgggcagaaggatgggga

SEQ ID NO: 2116 - DNA, 32 bp, Homo sapiens
gaacccaggaggttgaggctgcagtgagtcat

SEQ ID NO: 2117 - DNA, 32 bp, Homo sapiens
atcaggaagggacatggatgtgctcctgccac

SEQ ID NO: 2118 - DNA, 32 bp, Homo sapiens
gctttgttgcccaggctggagtggagtggcgt

SEQ ID NO: 2119 - DNA, 32 bp, Homo sapiens
ctgggttcaagcaattctctggggcagcagtt

SEQ ID NO: 2120 - DNA, 32 bp, Homo sapiens
agtttcgagcgccgcttcctggcggcgcgcac

SEQ ID NO: 2121 - DNA, 32 bp, Homo sapiens
gggattgactgagatcttaacaacagcagcaa

SEQ ID NO: 2122 - DNA, 32 bp, Homo sapiens
agattagcagggtgactttcaccctgcaacag

SEQ ID NO: 2123 - DNA, 24 bp, Homo sapiens
tcacatctgtaatctcaacacttt

SEQ ID NO: 2124 - DNA, 32 bp, Homo sapiens
cacaaagggagaggagagaacagggcaagacg

SEQ ID NO: 2125 - DNA, 32 bp, Homo sapiens
ctactcgggaggctgaggcaggagaatggagt

SEQ ID NO: 2126 - DNA, 32 bp, Homo sapiens
gaggccgggaggcgaggaaaccgtggaaattg

SEQ ID NO: 2127 - DNA, 32 bp, Homo sapiens
agaagagaaacttggcttctgttttcgcaaag

SEQ ID NO: 2128 - DNA, 32 bp, Homo sapiens
ggcctcctgaagtgctgggattacaggcgtgg

SEQ ID NO: 2129 - DNA, 32 bp, Homo sapiens
tctggacggaagtggtggctgtggaaggcgta

SEQ ID NO: 2130 - DNA, 32 bp, Homo sapiens
agaacaacagcaggcttcctggagccacatgg

SEQ ID NO: 2131 - DNA, 32 bp, Homo sapiens
ccacctccatgggactgacaccatgttcaagc

SEQ ID NO: 2132 - DNA, 19 bp, Homo sapiens
ctctttggacctgatcttg

SEQ ID NO: 2133 - DNA, 32 bp, Homo sapiens
ggaggagcagagggagaaagcgagggggcggg

SEQ ID NO: 2134 - DNA, 24 bp, Homo sapiens
tggcgtgatctcgagtcactgcag

SEQ ID NO: 2135 - DNA, 23 bp, Homo sapiens
tggcacgatcttggctttctgca

SEQ ID NO: 2136 - DNA, 32 bp, Homo sapiens
tgcctccctaaccttttctagggctcagtttg

SEQ ID NO: 2137 - DNA, 32 bp, Homo sapiens
gctctgtcgcccaggctggagtgcagaggtgc

SEQ ID NO: 2138 - DNA, 32 bp, Homo sapiens
ttcttacagtccctgtcatattaccaacagag

SEQ ID NO: 2139 - DNA, 32 bp, Homo sapiens
cgctgttgcccaggctgtagtgcagtggtgcg

SEQ ID NO: 2140 - DNA, 32 bp, Homo sapiens
ggaggccacatcctgaatatgaatgttctact

SEQ ID NO: 2141 - DNA, 32 bp, Homo sapiens
aaatccctgcttcttttgggtgcagtggctca

SEQ ID NO: 2142 - DNA, 32 bp, Homo sapiens
ttctgtcgtccaggctggagtgcagtggtgtg

SEQ ID NO: 2143 - DNA, 32 bp, Homo sapiens
ctctgttgcccaggctggagtgtagtggtgtg

SEQ ID NO: 2144 - DNA, 32 bp, Homo sapiens
ctctgttgcccaggatggagtgcagtggtgag

SEQ ID NO: 2145 - DNA, 32 bp, Homo sapiens
acctctgcttcccgagttcaagcaattctcct

SEQ ID NO: 2146 - DNA, 32 bp, Homo sapiens
tcttgtcacccaggctggagtacaatgatgcg

SEQ ID NO: 2147 - DNA, 32 bp, Homo sapiens
ctctgtcacccaggctggagtgtagtggtgca

SEQ ID NO: 2148 - DNA, 32 bp, Homo sapiens
tccctgtcttctgtccccatcttcctgccgat

SEQ ID NO: 2149 - DNA, 32 bp, Homo sapiens
gcctcttgtcctctccccagtggctccaggcc

SEQ ID NO: 2150 - DNA, 32 bp, Homo sapiens
tgacccctggaggagccactgtggaagcagag

SEQ ID NO: 2151 - DNA, 32 bp, Homo sapiens
cgtgcagccctctcttggcttgcaagataacg

SEQ ID NO: 2152 - DNA, 32 bp, Homo sapiens
ctctgttgcccaggctggagtgcagtggtgcg

SEQ ID NO: 2153 - DNA, 32 bp, Homo sapiens
ctctgtcgcccaggctggagtgcagtggtgtg

SEQ ID NO: 2154 - DNA, 24 bp, Homo sapiens
tggcgtgatcttggctcactgcag

SEQ ID NO: 2155 - DNA, 32 bp, Homo sapiens
tcagtctgcctgctgctgtgcggtagctccag

SEQ ID NO: 2156 - DNA, 20 bp, Homo sapiens
gccatcaccagccacagaga

SEQ ID NO: 2157 - DNA, 32 bp, Homo sapiens
ttggtaacctccattctagttctgtctctgtg

SEQ ID NO: 2158 - DNA, 32 bp, Homo sapiens
gttttgtcacccaggctggagtgcagtggggc

SEQ ID NO: 2159 - DNA, 32 bp, Homo sapiens
gaacctgggagacggagcttgcagtgagctga

SEQ ID NO: 2160 - DNA, 32 bp, Homo sapiens
gaacccgggaggcggagcttgcagtgaaccga

SEQ ID NO: 2161 - DNA, 32 bp, Homo sapiens
tgtccgcggcagctgtctttttgctactataa

SEQ ID NO: 2162 - DNA, 32 bp, Homo sapiens
gatacaaagaattgaaaagtgtggaggatctg

SEQ ID NO: 2163 - DNA, 32 bp, Homo sapiens
ggccgcccaagtgccctgtccagtgtctgctt

SEQ ID NO: 2164 - DNA, 32 bp, Homo sapiens
ggagcccgcgggaggagatcctgtaccacctg

SEQ ID NO: 2165 - DNA, 16 bp, Homo sapiens
gcccctgccatgcagg

SEQ ID NO: 2166 - DNA, 23 bp, Homo sapiens
tcacacctgtaatcctaacactt

SEQ ID NO: 2167 - DNA, 32 bp, Homo sapiens
cattgctctgggggctgggattcctggctaag

SEQ ID NO: 2168 - DNA, 32 bp, Homo sapiens
tccagatggagtttcgctcttgtcccccaggc

SEQ ID NO: 2169 - DNA, 32 bp, Homo sapiens
gagcctccacagacttctcttcagcctccgct

SEQ ID NO: 2170 - DNA, 32 bp, Homo sapiens
cacccccactctgcctcatttctgcctccagg

SEQ ID NO: 2171 - DNA, 32 bp, Homo sapiens
tcagccccagttcagaacacagaacttcacac

SEQ ID NO: 2172 - DNA, 32 bp, Homo sapiens
tcctcctagggtgcccttgagccgcaaaactg

SEQ ID NO: 2173 - DNA, 32 bp, Homo sapiens
aacctgggagggcggaggttgcagtgagccag

SEQ ID NO: 2174 - DNA, 32 bp, Homo sapiens
ttctgtcacccaggctagagcgcagtggcaag

SEQ ID NO: 2175 - DNA, 32 bp, Homo sapiens
gactcagagccagacagggcagcctcagaccc

SEQ ID NO: 2176 - DNA, 32 bp, Homo sapiens
agcctccggagtagctgggattacaggcacat

SEQ ID NO: 2177 - DNA, 28 bp, Homo sapiens
gaaaatgaagctgctgcctcaatcgacc

SEQ ID NO: 2178 - DNA, 32 bp, Homo sapiens
atttctgtggatgcctttttctctccaacctc

SEQ ID NO: 2179 - DNA, 32 bp, Homo sapiens
tccagcggcccaggcgggggacagtgccgttc

SEQ ID NO: 2180 - DNA, 32 bp, Homo sapiens
ataaccggaggcaggctgggtgcagtggctca

SEQ ID NO: 2181 - DNA, 32 bp, Homo sapiens
ataagcctcagttttccatctgtttttgataa

SEQ ID NO: 2182 - DNA, 32 bp, Homo sapiens
cagcctcctgagagctgggactacaggcgcct

SEQ ID NO: 2183 - DNA, 32 bp, Homo sapiens
agaatctgtaccaataccatgaagttcaggct

SEQ ID NO: 2184 - DNA, 32 bp, Homo sapiens
tcttgttgcccaagctggagtgcagtggcgcg

SEQ ID NO: 2185 - DNA, 17 bp, Homo sapiens
aggacatgctgcctgaa

SEQ ID NO: 2186 - DNA, 32 bp, Homo sapiens
actgataataagctttgaatggtgctaataag

SEQ ID NO: 2187 - DNA, 32 bp, Homo sapiens
ctggccttcagcaatcctcccacctcaacctc

SEQ ID NO: 2188 - DNA, 20 bp, Homo sapiens
tgtggggagacaggtggaga

SEQ ID NO: 2189 - DNA, 32 bp, Homo sapiens
tgctgccatcttctccgcgctatggctgcgtt

SEQ ID NO: 2190 - DNA, 23 bp, Homo sapiens
tcagcttctaatcccagcacttt

SEQ ID NO: 2191 - DNA, 32 bp, Homo sapiens
gctctgtcatcaggctggagtgcagtggctca

SEQ ID NO: 2192 - DNA, 32 bp, Homo sapiens
gcccacttgtcttcctggatatttgggggtga

SEQ ID NO: 2193 - DNA, 32 bp, Homo sapiens
ctctgagcttctctgagccttgtttgctcatc

SEQ ID NO: 2194 - DNA, 32 bp, Homo sapiens
ctctgtctcccaggctggagtgctatggtgca

SEQ ID NO: 2195 - DNA, 32 bp, Homo sapiens
ctctttcactcaggctggaatgtagtggagag

SEQ ID NO: 2196 - DNA, 32 bp, Homo sapiens
ctctgtcacccaggctggagtgcaatggtgca

SEQ ID NO: 2197 - DNA, 32 bp, Homo sapiens
gacttctcttgcctggagggtgcagtgatagc

SEQ ID NO: 2198 - DNA, 32 bp, Homo sapiens
gctctattgcccagtctggagtgcagtggcat

SEQ ID NO: 2199 - DNA, 32 bp, Homo sapiens
ctctgtcgcccaggctggagtacaatggtgcg

SEQ ID NO: 2200 - DNA, 32 bp, Homo sapiens
ggctctggcccaggctagagtgcagtggtgcg

SEQ ID NO: 2201 - DNA, 32 bp, Homo sapiens
ctctgtcgcccagactggagtgcaatggtgcg

SEQ ID NO: 2202 - DNA, 32 bp, Homo sapiens
tgctcctggcctgggctctgatttcactgtgt

SEQ ID NO: 2203 - DNA, 32 bp, Homo sapiens
tctggtgagggtggctgggatatacctgaccc

SEQ ID NO: 2204 - DNA, 32 bp, Homo sapiens
agcctcccaagtagctgggattacagatcatg

SEQ ID NO: 2205 - DNA, 32 bp, Homo sapiens
ctcttgccctccccatcccaccaccttggagc

SEQ ID NO: 2206 - DNA, 32 bp, Homo sapiens
atgctcactactttctctcttctctctccctg

SEQ ID NO: 2207 - DNA, 32 bp, Homo sapiens
ttttgctcttttctccccttgagaccctaata

SEQ ID NO: 2208 - DNA, 32 bp, Homo sapiens
tgcttaatcaagagctggagttcaatgagtcc

SEQ ID NO: 2209 - DNA, 32 bp, Homo sapiens
ctctgtcgcccaggctagagtatagtggtgtg

SEQ ID NO: 2210 - DNA, 23 bp, Homo sapiens
ccagtcgcccagctccagtgtca

SEQ ID NO: 2211 - DNA, 32 bp, Homo sapiens
ctgccagccctctctttgtgcattagcaacag

SEQ ID NO: 2212 - DNA, 32 bp, Homo sapiens
taccctgcctgagattcctcaggagaaaaggc

SEQ ID NO: 2213 - DNA, 32 bp, Homo sapiens
cctcgggccatggtgctctcccaggaggagcc

SEQ ID NO: 2214 - DNA, 32 bp, Homo sapiens
ttctctgtttgcccgtgattgttttctttatt

SEQ ID NO: 2215 - DNA, 32 bp, Homo sapiens
ctgtgttggccaggctggtcttgaatgcctga

SEQ ID NO: 2216 - DNA, 32 bp, Homo sapiens
cttgccccgaggctgcactaccacaggaaata

SEQ ID NO: 2217 - DNA, 32 bp, Homo sapiens
caaatgccagttctgccactgaagagctggat

SEQ ID NO: 2218 - DNA, 32 bp, Homo sapiens
gaggtctgcccagggtgggagcagtgtcactg

SEQ ID NO: 2219 - DNA, 32 bp, Homo sapiens
ctctgtcgcccaggctcgagtgcagtggcatg

SEQ ID NO: 2220 - DNA, 32 bp, Homo sapiens
ctctgtcgcccaggctgcagtgcggtggtgcg

SEQ ID NO: 2221 - DNA, 28 bp, Homo sapiens
atatttgtaagtgctgctttattcttca

SEQ ID NO: 2222 - DNA, 32 bp, Homo sapiens
ggaacgcggaggcagggagaggctccgtgacg

SEQ ID NO: 2223 - DNA, 32 bp, Homo sapiens
ctctgtcggccaggctggagtgcagtggcatg

SEQ ID NO: 2224 - DNA, 32 bp, Homo sapiens
ctgcaccacccacctccagagtgcagtgctgg

SEQ ID NO: 2225 - DNA, 32 bp, Homo sapiens
gctccacacctgcctccatagcactttgcctg

SEQ ID NO: 2226 - DNA, 32 bp, Homo sapiens
ttcggtccaacaacaggaaacctgactggggc

SEQ ID NO: 2227 - DNA, 32 bp, Homo sapiens
ttggagtttccagcagggtggtgtgcaccact

SEQ ID NO: 2228 - DNA, 32 bp, Homo sapiens
tatctccccaaaaatgtatagtgccttgtttt

SEQ ID NO: 2229 - DNA, 32 bp, Homo sapiens
gtacaggcaacaggagaaaggaatcaaaccac

SEQ ID NO: 2230 - DNA, 32 bp, Homo sapiens
ctctgaacagaacttggccttttgttgtgaat

SEQ ID NO: 2231 - DNA, 18 bp, Homo sapiens
ccagcttctccttgggca

SEQ ID NO: 2232 - DNA, 21 bp, Homo sapiens
cagcgacctcccttccagccc

SEQ ID NO: 2233 - DNA, 32 bp, Homo sapiens
tcttaacatttgcagtccttgtgtcactgtct

SEQ ID NO: 2234 - DNA, 32 bp, Homo sapiens
ttgggatgcccaggccgcagaggaagctgggc

SEQ ID NO: 2235 - DNA, 32 bp, Homo sapiens
gagtcttgaggcccattgagtgcagtgtgaga

SEQ ID NO: 2236 - DNA, 32 bp, Homo sapiens
gtaacccctgttctgtcttcattgacaggatt

SEQ ID NO: 2237 - DNA, 32 bp, Homo sapiens
gtggtccctgctgaaacccccacgcctccgct

SEQ ID NO: 2238 - DNA, 32 bp, Homo sapiens
tgagggcccgcggggagctcttaagttgggca

SEQ ID NO: 2239 - DNA, 32 bp, Homo sapiens
gttaagtcaagtgcctggaacagaacagccat

SEQ ID NO: 2240 - DNA, 32 bp, Homo sapiens
tatctgtgtaggtcatatcttctctagtaaac

SEQ ID NO: 2241 - DNA, 19 bp, Homo sapiens
tctgtaatcctagcacttt

SEQ ID NO: 2242 - DNA, 32 bp, Homo sapiens
acctaggagaaacaagacagaaaacaaatctt

SEQ ID NO: 2243 - DNA, 32 bp, Homo sapiens
attttaatttttctgtctttgttttcataaga

SEQ ID NO: 2244 - DNA, 32 bp, Homo sapiens
ttttgttgcgcaggctggagtgcaatggtgca

SEQ ID NO: 2245 - DNA, 32 bp, Homo sapiens
ctttgttgcccaggctggttgaactcccgtga

SEQ ID NO: 2246 - DNA, 32 bp, Homo sapiens
taagaacagcatagagcttcaaaatgcaaagt

SEQ ID NO: 2247 - DNA, 32 bp, Homo sapiens
actaccacctcctgggttcaagcgattcgcct

SEQ ID NO: 2248 - DNA, 28 bp, Homo sapiens
agagctctcaatgctgcctatcgggcgg

SEQ ID NO: 2249 - DNA, 28 bp, Homo sapiens
aggggccatggtgctgcctgtccaacat

SEQ ID NO: 2250 - DNA, 32 bp, Homo sapiens
acctccacctcccaggttcaagcgattctcgt

SEQ ID NO: 2251 - DNA, 32 bp, Homo sapiens
acctccacctcccaggttcaagcagttctcct

SEQ ID NO: 2252 - DNA, 32 bp, Homo sapiens
tcctccacctcccaggttcaagcgattctctt

SEQ ID NO: 2253 - DNA, 32 bp, Homo sapiens
tgttagggtcctccctgctcccatgaggatat

SEQ ID NO: 2254 - DNA, 32 bp, Homo sapiens
aagaaaaacaaggacttcctgggaggctgtgg

SEQ ID NO: 2255 - DNA, 32 bp, Homo sapiens
gcctccacctcccaggttcaagcaattctcct

SEQ ID NO: 2256 - DNA, 32 bp, Homo sapiens
tgcaccagaagagggaaaattaaacaattaaa

SEQ ID NO: 2257 - DNA, 32 bp, Homo sapiens
tgcctcctgagtagctggaattacaggcatgt

SEQ ID NO: 2258 - DNA, 32 bp, Homo sapiens
agcctcctgagtagctggggctacaggcgcct

SEQ ID NO: 2259 - DNA, 32 bp, Homo sapiens
tgaactgtgtagtgctcttctttgccatttgc

SEQ ID NO: 2260 - DNA, 24 bp, Homo sapiens
tcacgcctgtaaacccagcacttt

SEQ ID NO: 2261 - DNA, 32 bp, Homo sapiens
gaggaggggagaggagaagggaaatggaggtg

SEQ ID NO: 2262 - DNA, 32 bp, Homo sapiens
caaagacagagtcttgctcttgttgtccaggc

SEQ ID NO: 2263 - DNA, 32 bp, Homo sapiens
tttggagccctcttgcttagttgaaggagttt

SEQ ID NO: 2264 - DNA, 32 bp, Homo sapiens
gcgctgtccttgccgggaagtcactgttgaag

SEQ ID NO: 2265 - DNA, 32 bp, Homo sapiens
gctctgtcatctaggctggagtgcagtggtgt

SEQ ID NO: 2266 - DNA, 32 bp, Homo sapiens
gttttgtcacccaggctggagtgcagtggtgt

SEQ ID NO: 2267 - DNA, 32 bp, Homo sapiens
ggagggggcacagttggattctctccagtgaa

SEQ ID NO: 2268 - DNA, 32 bp, Homo sapiens
gttctgtggccctggctggagttcagtggtgt

SEQ ID NO: 2269 - DNA, 32 bp, Homo sapiens
gagctgttcccagggctggagcaggtgtaccc

SEQ ID NO: 2270 - DNA, 32 bp, Homo sapiens
cccggcctaaccaggctggagtgcagtggtgg

SEQ ID NO: 2271 - DNA, 32 bp, Homo sapiens
aaaacaccaagtgcctggaatcagttgtttgt

SEQ ID NO: 2272 - DNA, 32 bp, Homo sapiens
agagccgggaggcagagggagtagtgaccgcc

SEQ ID NO: 2273 - DNA, 32 bp, Homo sapiens
cctcagcagatcctgaagatcttcgtggacaa

SEQ ID NO: 2274 - DNA, 32 bp, Homo sapiens
tgacggagaaggagagaaagagacgggagaga

SEQ ID NO: 2275 - DNA, 32 bp, Homo sapiens
gaggaggggagaggagaggaaagtgggaggag

SEQ ID NO: 2276 - DNA, 32 bp, Homo sapiens
tggacttcacccaggaggagtggggtcaacta

SEQ ID NO: 2277 - DNA, 24 bp, Homo sapiens
tcatgcctgtaatcccagtgcttt

SEQ ID NO: 2278 - DNA, 24 bp, Homo sapiens
tcacacttgtaatcccaacacttt

SEQ ID NO: 2279 - DNA, 32 bp, Homo sapiens
agagaaagaaagaaagaaagaaagggaaagat

SEQ ID NO: 2280 - DNA, 32 bp, Homo sapiens
ccttttctgcagtcactcagggacccagactt

SEQ ID NO: 2281 - DNA, 32 bp, Homo sapiens
gcatggctgagctcctggagacgagggcgggc

SEQ ID NO: 2282 - DNA, 32 bp, Homo sapiens
gggctacagatgtctgctctctggaccccacg

SEQ ID NO: 2283 - DNA, 32 bp, Homo sapiens
ttgagatggagtttcgctctgttgcccaggct

SEQ ID NO: 2284 - DNA, 32 bp, Homo sapiens
ttgagacggagtttcgctctgtcgcccaggct

SEQ ID NO: 2285 - DNA, 32 bp, Homo sapiens
gttaactggttcctgctcacactccagaatta

SEQ ID NO: 2286 - DNA, 32 bp, Homo sapiens
gaagagatatccaggccaggtgcagtggctca

SEQ ID NO: 2287 - DNA, 32 bp, Homo sapiens
tctctgttgcccaagcttgagggcagtggtgc

SEQ ID NO: 2288 - DNA, 32 bp, Homo sapiens
cctgtgtgagttctgtcttcacagactcctca

SEQ ID NO: 2289 - DNA, 28 bp, Homo sapiens
ccagccccaagtggctttttcaattaca

SEQ ID NO: 2290 - DNA, 28 bp, Homo sapiens
cctctctccccagctgcctcctcctctt

SEQ ID NO: 2291 - DNA, 32 bp, Homo sapiens
gccactcacatcctcactttgctgccccacca

SEQ ID NO: 2292 - DNA, 22 bp, Homo sapiens
gctcttttgagaggaggcctaa

SEQ ID NO: 2293 - DNA, 32 bp, Homo sapiens
tcagggcattagagagaatgagcctggtgggt

SEQ ID NO: 2294 - DNA, 32 bp, Homo sapiens
ctcgtcctagcaacaggagacctgacagatgc

SEQ ID NO: 2295 - DNA, 32 bp, Homo sapiens
acccccagcttttcttggtgtgacacaaaggt

SEQ ID NO: 2296 - DNA, 32 bp, Homo sapiens
tctccctttctgcttgctcttctgtttgcggt

SEQ ID NO: 2297 - DNA, 32 bp, Homo sapiens
taagaggtgatctctgggagttataggtcatg

SEQ ID NO: 2298 - DNA, 32 bp, Homo sapiens
gaccatgtgctgccgcccaacctgctctagtg

SEQ ID NO: 2299 - DNA, 32 bp, Homo sapiens
aatttgggtttttaactttacagggtcagttc

SEQ ID NO: 2300 - DNA, 32 bp, Homo sapiens
gccaaatgaggcctactgattacttgaggtgt

SEQ ID NO: 2301 - DNA, 32 bp, Homo sapiens
ctggatgaacaacacacttaggccacactcag

SEQ ID NO: 2302 - DNA, 32 bp, Homo sapiens
ctgttgttgcccaggctggagtgcaatggcac

SEQ ID NO: 2303 - DNA, 32 bp, Homo sapiens
ctctcgttgcccaggctggagtgcaatggcgc

SEQ ID NO: 2304 - DNA, 32 bp, Homo sapiens
acctggagagggttagaaagaaccaacagctg

SEQ ID NO: 2305 - DNA, 32 bp, Homo sapiens
ctgacgaggctggacttcctcgagtggccact

SEQ ID NO: 2306 - DNA, 32 bp, Homo sapiens
gagcctgggaggaagaggttgcagtgagccga

SEQ ID NO: 2307 - DNA, 32 bp, Homo sapiens
accgtgcagctttggcctgggcacagaccctg

SEQ ID NO: 2308 - DNA, 32 bp, Homo sapiens
gcaccatctgttctccccagggacctgctgac

SEQ ID NO: 2309 - DNA, 32 bp, Homo sapiens
gtggaagattcaggagaaagaaaggagaggct

SEQ ID NO: 2310 - DNA, 32 bp, Homo sapiens
tgggaaccagttcttagccacttggacactga

SEQ ID NO: 2311 - DNA, 32 bp, Homo sapiens
gacagtgtgagcctgctcaccttcatcctgct

SEQ ID NO: 2312 - DNA, 24 bp, Homo sapiens
gtcacccaggctggactgcaatga

SEQ ID NO: 2313 - DNA, 32 bp, Homo sapiens
gccctgtcgcctggctggagtggagtggcaca

SEQ ID NO: 2314 - DNA, 32 bp, Homo sapiens
tgctccgttgcctagctggagtgcacgatctc

SEQ ID NO: 2315 - DNA, 32 bp, Homo sapiens
acagaacagctttctgctcattgaacccagag

SEQ ID NO: 2316 - DNA, 32 bp, Homo sapiens
tactctagaagagtagggaaaataatgcttgt

SEQ ID NO: 2317 - DNA, 32 bp, Homo sapiens
agggacacctcccgggttcaagcagttctcct

SEQ ID NO: 2318 - DNA, 32 bp, Homo sapiens
ctccctgtgctgcttgtagacagttcccataa

SEQ ID NO: 2319 - DNA, 32 bp, Homo sapiens
cacgcccctaaccctaacggggatcccagtcc

SEQ ID NO: 2320 - DNA, 32 bp, Homo sapiens
tctctggggtcctctttcaaggatgtccacgg

SEQ ID NO: 2321 - DNA, 32 bp, Homo sapiens
ctcttgctgcccaggctggagtgcaatggtgc

SEQ ID NO: 2322 - DNA, 32 bp, Homo sapiens
ggctcatgcctgtgatcctagcactttgcgag

SEQ ID NO: 2323 - DNA, 30 bp, Homo sapiens
ggggcatgcccaggcagagtgacaggagag

SEQ ID NO: 2324 - DNA, 32 bp, Homo sapiens
actctgtcacccaaggcggagtgcagtgacga

SEQ ID NO: 2325 - DNA, 32 bp, Homo sapiens
agagcctgagtcactctccccaggagacccag

SEQ ID NO: 2326 - DNA, 32 bp, Homo sapiens
aggactcccaaaaccagagacaccaggagcct

SEQ ID NO: 2327 - DNA, 16 bp, Homo sapiens
aggagaattgcctgaa

SEQ ID NO: 2328 - DNA, 32 bp, Homo sapiens
gccctgtcacccaggctggagtgcagtggcac

SEQ ID NO: 2329 - DNA, 32 bp, Homo sapiens
gaacccttataacttggaaactaactgaatgg

SEQ ID NO: 2330 - DNA, 32 bp, Homo sapiens
gcctccacctcccgggttcaatcaattctcct

SEQ ID NO: 2331 - DNA, 32 bp, Homo sapiens
gaacctgtaaggcggaggttgcagtgagccga

SEQ ID NO: 2332 - DNA, 32 bp, Homo sapiens
gaaacattccttctcccggacagctggaccca

SEQ ID NO: 2333 - DNA, 32 bp, Homo sapiens
ctggcctcaagcaatcctcttgcctcggcctc

SEQ ID NO: 2334 - DNA, 32 bp, Homo sapiens
tcgagtgtggtcaaaggagagagtctttgtca

SEQ ID NO: 2335 - DNA, 19 bp, Homo sapiens
gacaagagtggcactgtgg

SEQ ID NO: 2336 - DNA, 32 bp, Homo sapiens
ggagtgcccaggatggagtgcagtggctattc

SEQ ID NO: 2337 - DNA, 32 bp, Homo sapiens
tgccagcctgcagctctcctgcttgacactga

SEQ ID NO: 2338 - DNA, 32 bp, Homo sapiens
ctctggcgcccaggctggagtacagtggcatg

SEQ ID NO: 2339 - DNA, 32 bp, Homo sapiens
gttgcctgtcaaaggctggagggcaggaggag

SEQ ID NO: 2340 - DNA, 32 bp, Homo sapiens
ctgggtttcagcaattctcctgcctcagcctc

SEQ ID NO: 2341 - DNA, 28 bp, Homo sapiens
actgagctgagtgctgccctttattaaa

SEQ ID NO: 2342 - DNA, 32 bp, Homo sapiens
gagcccaggaagttgaggctgcagtgagctgt

SEQ ID NO: 2343 - DNA, 32 bp, Homo sapiens
ttaccaggaggaagagaaagaggacaaaatca

SEQ ID NO: 2344 - DNA, 32 bp, Homo sapiens
cagagttcaagcacattcctacctgcagggca

SEQ ID NO: 2345 - DNA, 32 bp, Homo sapiens
ctggcttcaagcgattctcccacctcagcctc

SEQ ID NO: 2346 - DNA, 32 bp, Homo sapiens
aatgcccccaaaatatgcagacctttgggaat

SEQ ID NO: 2347 - DNA, 32 bp, Homo sapiens
catgcactccttctccccaaggccagggcaga

SEQ ID NO: 2348 - DNA, 32 bp, Homo sapiens
caaggacattggagagatagagtcactattac

SEQ ID NO: 2349 - DNA, 32 bp, Homo sapiens
gggcctctctgcccgtggagtgcaggagcgaa

SEQ ID NO: 2350 - DNA, 28 bp, Homo sapiens
gtgtcccacagtgctgcgctagtccctt

SEQ ID NO: 2351 - DNA, 32 bp, Homo sapiens
ccttcttgcccaggctggagtgcaagggcgca

SEQ ID NO: 2352 - DNA, 32 bp, Homo sapiens
ctaaacttccctgaattggcttagtcaatgcc

SEQ ID NO: 2353 - DNA, 32 bp, Homo sapiens
tcacactgcccaggctggagcatagtggcaag

SEQ ID NO: 2354 - DNA, 23 bp, Homo sapiens
tcacgcctgtaatcccagtactt

SEQ ID NO: 2355 - DNA, 32 bp, Homo sapiens
ggagaaagaagagggtgaggaggcgacagagg

SEQ ID NO: 2356 - DNA, 21 bp, Homo sapiens
cagggcctcgccctccagccc

SEQ ID NO: 2357 - DNA, 32 bp, Homo sapiens
gaggcaagcaagctctcttgccgaggagccag

SEQ ID NO: 2358 - DNA, 32 bp, Homo sapiens
ggaaggtggccggctatgtcccagaaaccgtc

SEQ ID NO: 2359 - DNA, 32 bp, Homo sapiens
ccgtgtgccagatgagcttgtgatctgggaag

SEQ ID NO: 2360 - DNA, 32 bp, Homo sapiens
gctgtgttgtccaggctggagtgcaatggtgt

SEQ ID NO: 2361 - DNA, 22 bp, Homo sapiens
ctgctggatgtgctgtgcaggt

SEQ ID NO: 2362 - DNA, 32 bp, Homo sapiens
gaacccgggaggcggaggttccagtgagccga

SEQ ID NO: 2363 - DNA, 32 bp, Homo sapiens
ctactcgggaggctgaggcaggagaatcaatc

SEQ ID NO: 2364 - DNA, 32 bp, Homo sapiens
cctgcacacatccttatctttgttacatatga

SEQ ID NO: 2365 - DNA, 32 bp, Homo sapiens
agctccgccatctgggttcaagcgattctcct

SEQ ID NO: 2366 - DNA, 32 bp, Homo sapiens
ggcatgtccataaggtctgacaacagcttgcc

SEQ ID NO: 2367 - DNA, 32 bp, Homo sapiens
gaacgtgggaggcggaggttgcagtgagctga

SEQ ID NO: 2368 - DNA, 32 bp, Homo sapiens
ctgggctcaagcaatccacccacctctgcctc

SEQ ID NO: 2369 - DNA, 32 bp, Homo sapiens
agcctcctgagtagctgggattacagactcca

SEQ ID NO: 2370 - DNA, 32 bp, Homo sapiens
gccttgacctcctgggttccggtgattctcat

SEQ ID NO: 2371 - DNA, 32 bp, Homo sapiens
ttaggatccaaagcttctctgctccttttgtt

SEQ ID NO: 2372 - DNA, 32 bp, Homo sapiens
ctgggcttctttctccccagagggccctctgc

SEQ ID NO: 2373 - DNA, 32 bp, Homo sapiens
accgacgtgtttctccccgaccgtggctttgc

SEQ ID NO: 2374 - DNA, 32 bp, Homo sapiens
tggggtcagccctcgtcacactgcggcacagg

SEQ ID NO: 2375 - DNA, 19 bp, Homo sapiens
gccatcacgtatccctgaa

SEQ ID NO: 2376 - DNA, 32 bp, Homo sapiens
cagcaagtctgaagagtttcccagaagccctg

SEQ ID NO: 2377 - DNA, 32 bp, Homo sapiens
aggctgaggtttgggtggtgtgatctgtccta

SEQ ID NO: 2378 - DNA, 32 bp, Homo sapiens
ctagcctcctcaccaccatctgatctatcttg

SEQ ID NO: 2379 - DNA, 32 bp, Homo sapiens
ttggtcccaacaaggcccaggaaacagaccct

SEQ ID NO: 2380 - DNA, 32 bp, Homo sapiens
acctccgcctcctgggttcaggcaattttcct

SEQ ID NO: 2381 - DNA, 32 bp, Homo sapiens
cctcatgccccaggctggagcagctctcctag

SEQ ID NO: 2382 - DNA, 32 bp, Homo sapiens
actcacctggggcctccatcccagaagcgcag

SEQ ID NO: 2383 - DNA, 32 bp, Homo sapiens
ttaagctaataaatataagaattcttttggaa

SEQ ID NO: 2384 - DNA, 32 bp, Homo sapiens
taagaagctctgttgtcgatgtggaaaaatat

SEQ ID NO: 2385 - DNA, 32 bp, Homo sapiens
cccttgtcacccaggctgtagtgcggtggcgc

SEQ ID NO: 2386 - DNA, 32 bp, Homo sapiens
gtgctgctgcccaggctggagtgcagtggcac

SEQ ID NO: 2387 - DNA, 32 bp, Homo sapiens
ctgggctcatgtgatcctcccacctcagcctc

SEQ ID NO: 2388 - DNA, 32 bp, Homo sapiens
agcgagtgcccagggtgaatcaatggaaaccc

SEQ ID NO: 2389 - DNA, 32 bp, Homo sapiens
ctctgtcacccaggctggagtgtgcagtggcg

SEQ ID NO: 2390 - DNA, 32 bp, Homo sapiens
atgaggcctcaatacttttcagtcttaattgt

SEQ ID NO: 2391 - DNA, 32 bp, Homo sapiens
tactcactccttctccctctttctggatttta

SEQ ID NO: 2392 - DNA, 32 bp, Homo sapiens
tagagaagaagaggacaaaacaagggaaaagc

SEQ ID NO: 2393 - DNA, 32 bp, Homo sapiens
gggtggaggataacagggtagattcacttgtg

SEQ ID NO: 2394 - DNA, 32 bp, Homo sapiens
aataaagtttaactggaacacagcggttcatg

SEQ ID NO: 2395 - DNA, 32 bp, Homo sapiens
gggcctgagatcttgagagacagggtctcact

SEQ ID NO: 2396 - DNA, 32 bp, Homo sapiens
agaagtaagccttggactgtagctgattataa

SEQ ID NO: 2397 - DNA, 32 bp, Homo sapiens
gctctgtctcccaggctggaggtcagtggcac

SEQ ID NO: 2398 - DNA, 32 bp, Homo sapiens
gagacaccagttctgcctacaggagtgagttt

SEQ ID NO: 2399 - DNA, 32 bp, Homo sapiens
tgtaatggatcaatttaaaatattttatttct

SEQ ID NO: 2400 - DNA, 32 bp, Homo sapiens
gcctcctgagtagctgggactacaagtgtgta

SEQ ID NO: 2401 - DNA, 32 bp, Homo sapiens
ttgcatttttcctgttttaacaacggctgtgc

SEQ ID NO: 2402 - DNA, 32 bp, Homo sapiens
tctctgttgcccaggctagagtgcactggtgg

SEQ ID NO: 2403 - DNA, 32 bp, Homo sapiens
acctatgaaaagaagcggggaaaacaacaaca

SEQ ID NO: 2404 - DNA, 32 bp, Homo sapiens
ctgggttcaaacaattctcatgcctcagcctc

SEQ ID NO: 2405 - DNA, 32 bp, Homo sapiens
ggctcatacctgttataccagcactttgggag

SEQ ID NO: 2406 - DNA, 23 bp, Homo sapiens
tgacacgatctcagctcactgca

SEQ ID NO: 2407 - DNA, 24 bp, Homo sapiens
tcatgcctgtaatcccaacacttt

SEQ ID NO: 2408 - DNA, 21 bp, Homo sapiens
tcacacctgtaatcctagcat

SEQ ID NO: 2409 - DNA, 32 bp, Homo sapiens
ctctgtcacccaggctggagtgcagtgcacaa

SEQ ID NO: 2410 - DNA, 32 bp, Homo sapiens
aggagtgctgagggctggagtgggtgggccct

SEQ ID NO: 2411 - DNA, 32 bp, Homo sapiens
tctgaatgtttgtcccccatctaggattccag

SEQ ID NO: 2412 - DNA, 32 bp, Homo sapiens
agcttgttcccaagaggataattctttatact

SEQ ID NO: 2413 - DNA, 32 bp, Homo sapiens
ctcctggagactagctggggcttatgggtggc

SEQ ID NO: 2414 - DNA, 32 bp, Homo sapiens
gtcctgtagctgctgctgctggctccactcct

SEQ ID NO: 2415 - DNA, 32 bp, Homo sapiens
ccttgcactgtgctgctctcacagatcggtgt

SEQ ID NO: 2416 - DNA, 19 bp, Homo sapiens
ccacacacacaggcaccca

SEQ ID NO: 2417 - DNA, 32 bp, Homo sapiens
gcgcaggggaggcaggcggaggccatgggcag

SEQ ID NO: 2418 - DNA, 32 bp, Homo sapiens
gcatgaactgaacaggctttcatttccacaga

SEQ ID NO: 2419 - DNA, 32 bp, Homo sapiens
gcattaccactgttagcaaatatttcatgata

SEQ ID NO: 2420 - DNA, 32 bp, Homo sapiens
ctgcagcttcacttgctggagtgccaagtaga

SEQ ID NO: 2421 - DNA, 32 bp, Homo sapiens
acctctgcttcctgggttcaaacaattctcat

SEQ ID NO: 2422 - DNA, 28 bp, Homo sapiens
ttgtgcccaagtgtttccctctctccct

SEQ ID NO: 2423 - DNA, 32 bp, Homo sapiens
ttttgcattactgtatgtcttctgcctccaca

SEQ ID NO: 2424 - DNA, 24 bp, Homo sapiens
aatgaggaagtgagtgttcttgga

SEQ ID NO: 2425 - DNA, 32 bp, Homo sapiens
cagcaggagagaggagagggcagaacaggatc

SEQ ID NO: 2426 - DNA, 32 bp, Homo sapiens
gggtctgtgctgctgttactgttaaccattta

SEQ ID NO: 2427 - DNA, 32 bp, Homo sapiens
tgctcatatcaatcctataaggcacagggaac

SEQ ID NO: 2428 - DNA, 32 bp, Homo sapiens
taaaatgtcttcaaggcttcagtctcatattt

SEQ ID NO: 2429 - DNA, 32 bp, Homo sapiens
actccgtcatccaagctggagtgcagtggtgc

SEQ ID NO: 2430 - DNA, 32 bp, Homo sapiens
gctctgttgtccaggctagagtgcagtggtgt

SEQ ID NO: 2431 - DNA, 32 bp, Homo sapiens
atccttcggagtagctgggattacaggcaggt

SEQ ID NO: 2432 - DNA, 32 bp, Homo sapiens
aagagaggcccaggctggggcagccctgagag

SEQ ID NO: 2433 - DNA, 32 bp, Homo sapiens
gtccttgcacattgggcttcaaactcctcttc

SEQ ID NO: 2434 - DNA, 28 bp, Homo sapiens
tttcatcccagaggggcctcatcagcaa

SEQ ID NO: 2435 - DNA, 28 bp, Homo sapiens
gctgccctcagctccgcctcatcagcta

SEQ ID NO: 2436 - DNA, 32 bp, Homo sapiens
tctgttgctgaggctggagtgcagtgatgtga

SEQ ID NO: 2437 - DNA, 32 bp, Homo sapiens
ttttctgtttggcctggctcttaatttgcttt

SEQ ID NO: 2438 - DNA, 32 bp, Homo sapiens
aaaattgcaacaacactttactacctaacgga

SEQ ID NO: 2439 - DNA, 32 bp, Homo sapiens
agttgtctaaccactgaaaactacctagccag

SEQ ID NO: 2440 - DNA, 32 bp, Homo sapiens
atttatacacttctcccattttgtatcaggtg

SEQ ID NO: 2441 - DNA, 32 bp, Homo sapiens
tctagaaaacaaaatgaaagaaaacaaatatg

SEQ ID NO: 2442 - DNA, 32 bp, Homo sapiens
actctgtcactcaggctggagtgcaatgacgt

SEQ ID NO: 2443 - DNA, 32 bp, Homo sapiens
acagtgtttgtgtccctgattacttgagatta

SEQ ID NO: 2444 - DNA, 32 bp, Homo sapiens
ggaggctgcgcccctccagttctgccttcata

SEQ ID NO: 2445 - DNA, 32 bp, Homo sapiens
agcccctctgcagatctcctctggccactgca

SEQ ID NO: 2446 - DNA, 32 bp, Homo sapiens
agccggcccctgctgctgctcgggcagctgca

SEQ ID NO: 2447 - DNA, 22 bp, Homo sapiens
ggcagggggcgaagtgcagtgg

SEQ ID NO: 2448 - DNA, 32 bp, Homo sapiens
cctttccatcaaggaggcgtccttctcagaca

SEQ ID NO: 2449 - DNA, 32 bp, Homo sapiens
atggggacaccagtggcttcaaacttcctgat

SEQ ID NO: 2450 - DNA, 32 bp, Homo sapiens
acactgttgcccaggctggagtgcagtgacgc

SEQ ID NO: 2451 - DNA, 20 bp, Homo sapiens
cagacgggcttctcccaccc

SEQ ID NO: 2452 - DNA, 32 bp, Homo sapiens
actctgtcgccaggctggagtgcagtggtgtg

SEQ ID NO: 2453 - DNA, 32 bp, Homo sapiens
cagtctaatttgaggctgggtgcagtggctca

SEQ ID NO: 2454 - DNA, 32 bp, Homo sapiens
ctttctgcaaccattcagactgatctcgggct

SEQ ID NO: 2455 - DNA, 32 bp, Homo sapiens
tgaacccggggacggaggttgcagtgaaccga

SEQ ID NO: 2456 - DNA, 32 bp, Homo sapiens
gctacttgcccaggtagtgatcagtgagagtt

SEQ ID NO: 2457 - DNA, 32 bp, Homo sapiens
gctctgtcaccaggctggagtgcagtggtgtg

SEQ ID NO: 2458 - DNA, 28 bp, Homo sapiens
caggcccacgatgctgcctctcccgtgg

SEQ ID NO: 2459 - DNA, 32 bp, Homo sapiens
agccaccctcggagagtccacaacagcagcca

SEQ ID NO: 2460 - DNA, 32 bp, Homo sapiens
gaatccaggaggtggagcctgcagtgagccaa

SEQ ID NO: 2461 - DNA, 32 bp, Homo sapiens
caacacccaacaacaggaagaaatctcaaaat

SEQ ID NO: 2462 - DNA, 32 bp, Homo sapiens
cccacaagcagagtaggagaatactcttttct

SEQ ID NO: 2463 - DNA, 32 bp, Homo sapiens
tcttaccaagagtgggctttgtggaaacagct

SEQ ID NO: 2464 - DNA, 32 bp, Homo sapiens
ggcctaacaacaacaaaaatacttacaggtca

SEQ ID NO: 2465 - DNA, 32 bp, Homo sapiens
cctctgtctgcagctgctgctgcctggaccta

SEQ ID NO: 2466 - DNA, 32 bp, Homo sapiens
aggaatgaaagaggagaagaaacgcaactacc

SEQ ID NO: 2467 - DNA, 32 bp, Homo sapiens
atatatctacccagactagatgtagtattttg

SEQ ID NO: 2468 - DNA, 32 bp, Homo sapiens
taagtcttgctgctgctcactctttgggtcca

SEQ ID NO: 2469 - DNA, 32 bp, Homo sapiens
cagctgccatcgccgctacaggcaccagtgcc

SEQ ID NO: 2470 - DNA, 32 bp, Homo sapiens
aggaaaatgggcagctgtcttctgcctaatgt

SEQ ID NO: 2471 - DNA, 24 bp, Homo sapiens
tggtgcgatctcagctcactgcag

SEQ ID NO: 2472 - DNA, 24 bp, Homo sapiens
tggcacgatcttggctcactgcag

SEQ ID NO: 2473 - DNA, 22 bp, Homo sapiens
tggcgcaaccagctcactgcag

SEQ ID NO: 2474 - DNA, 32 bp, Homo sapiens
attctgtcgcccaggctggagtgtagtgacgc

SEQ ID NO: 2475 - DNA, 32 bp, Homo sapiens
gcttatgcagaacatctctgtgaaacgctgct

SEQ ID NO: 2476 - DNA, 32 bp, Homo sapiens
accagctctggggaaagctactgtgaactagg

SEQ ID NO: 2477 - DNA, 32 bp, Homo sapiens
ctctgtcacccatgctggtgtgcagtggcgtg

SEQ ID NO: 2478 - DNA, 32 bp, Homo sapiens
gggtccttgcccagtcagatggtgtgccagtc

SEQ ID NO: 2479 - DNA, 32 bp, Homo sapiens
actgtgtcccccaggctggagtgcagtggcac

SEQ ID NO: 2480 - DNA, 21 bp, Homo sapiens
gcctggttactgacctttccc

SEQ ID NO: 2481 - DNA, 32 bp, Homo sapiens
gctgtactgccaggctgcgatgcgtgctggcc

SEQ ID NO: 2482 - DNA, 32 bp, Homo sapiens
cgggtgattacaggcaccagtgcagtgatgat

SEQ ID NO: 2483 - DNA, 32 bp, Homo sapiens
gaacctgggaggcggagcttgcagtgagccga

SEQ ID NO: 2484 - DNA, 32 bp, Homo sapiens
gaaactgggaggcaggggttggagtgagccag

SEQ ID NO: 2485 - DNA, 32 bp, Homo sapiens
gaaactgggaggcggagcttgcagtgagccga

SEQ ID NO: 2486 - DNA, 32 bp, Homo sapiens
caagtcctggaggcagggagatcactgcctgc

SEQ ID NO: 2487 - DNA, 32 bp, Homo sapiens
gaacccgggaggcggagcttgcagtgagctga

SEQ ID NO: 2488 - DNA, 32 bp, Homo sapiens
gaacccgggaggcggagcttgtagtgagccga

SEQ ID NO: 2489 - DNA, 32 bp, Homo sapiens
gtcttaaactcctggcctcaagcaatccttct

SEQ ID NO: 2490 - DNA, 28 bp, Homo sapiens
tggcttcggggtgctgcctctccctccc

SEQ ID NO: 2491 - DNA, 32 bp, Homo sapiens
tccaacccaagtgcctccagctgacctctggc

SEQ ID NO: 2492 - DNA, 32 bp, Homo sapiens
agcctgccaaagtgctgggattactggcgtga

SEQ ID NO: 2493 - DNA, 32 bp, Homo sapiens
tattgtgatggaaaggctgtgtggaaattcat

SEQ ID NO: 2494 - DNA, 32 bp, Homo sapiens
ggctcctcaagggacttcctggagagtagcgc

SEQ ID NO: 2495 - DNA, 32 bp, Homo sapiens
tgaggaggaagaggaggcgagggaatcagaaa

SEQ ID NO: 2496 - DNA, 32 bp, Homo sapiens
tcaaaagaaagaggagaaaggaagggaagcat

SEQ ID NO: 2497 - DNA, 32 bp, Homo sapiens
ctgatctcaagtgatctgcccacctcagcctc

SEQ ID NO: 2498 - DNA, 21 bp, Homo sapiens
tcacgcctgtaatcctagcac

SEQ ID NO: 2499 - DNA, 23 bp, Homo sapiens
caggactctccctactgcctgag

SEQ ID NO: 2500 - DNA, 32 bp, Homo sapiens
ggcacgaggaggagaagagcaaagaaaagcag

SEQ ID NO: 2501 - DNA, 31 bp, Homo sapiens
ctgccccaggaataggccaggagggaaggcc

SEQ ID NO: 2502 - DNA, 20 bp, Homo sapiens
tcatgcctgtaatctcagca

SEQ ID NO: 2503 - DNA, 20 bp, Homo sapiens
tcatgcctgtaatcccagca

SEQ ID NO: 2504 - DNA, 32 bp, Homo sapiens
tttaagctgctgctgcatacacatttcacttt

SEQ ID NO: 2505 - DNA, 32 bp, Homo sapiens
gccacctccaggctggcttcagtctcccatcc

SEQ ID NO: 2506 - DNA, 32 bp, Homo sapiens
gtgcatggtctgtgctgccttctgcctgggtc

SEQ ID NO: 2507 - DNA, 32 bp, Homo sapiens
caggacttgggaaacagtcactgtgaaatgcg

SEQ ID NO: 2508 - DNA, 32 bp, Homo sapiens
tgtcattcagaacacagccactgtgaaagtgc

SEQ ID NO: 2509 - DNA, 32 bp, Homo sapiens
atgtctgtgctgctgtcaccaggcacctttgt

SEQ ID NO: 2510 - DNA, 32 bp, Homo sapiens
caaactcaagttatgtcatacctttggatacg

SEQ ID NO: 2511 - DNA, 32 bp, Homo sapiens
gagccccaggcctcgggataccacagagaaac

SEQ ID NO: 2512 - DNA, 32 bp, Homo sapiens
aggcgggatactttcagctttccatgtaactg

SEQ ID NO: 2513 - DNA, 32 bp, Homo sapiens
ggcttgcccaaaaggctggagagggcagggag

SEQ ID NO: 2514 - DNA, 32 bp, Homo sapiens
gctctgtcgtcgaggctggagtgtagtggtgc

SEQ ID NO: 2515 - DNA, 32 bp, Homo sapiens
ctggagttgcccaggccctgtgagcaagtggc

SEQ ID NO: 2516 - DNA, 32 bp, Homo sapiens
atctgcatagagctggtctcactgtggcgcag

SEQ ID NO: 2517 - DNA, 32 bp, Homo sapiens
ctctctcacccaggcctgaagtgcagtggcat

SEQ ID NO: 2518 - DNA, 32 bp, Homo sapiens
cgctttgtcaccaggctggagtgcagtggtgc

SEQ ID NO: 2519 - DNA, 28 bp, Homo sapiens
aggaagctaagtgctgctgtttctttaa

SEQ ID NO: 2520 - DNA, 32 bp, Homo sapiens
atgagggaggcaggcaatatgcagtgaaaacc

SEQ ID NO: 2521 - DNA, 32 bp, Homo sapiens
acacaggggaggcaggggaagaggcaggaggg

SEQ ID NO: 2522 - DNA, 32 bp, Homo sapiens
cggcagcaagacgacttctccggagccgccga

SEQ ID NO: 2523 - DNA, 32 bp, Homo sapiens
acctccgcctcctgggttcaagtgattctcgt

SEQ ID NO: 2524 - DNA, 32 bp, Homo sapiens
cagctggaggctgggagcgttgtggcttcctc

SEQ ID NO: 2525 - DNA, 26 bp, Homo sapiens
ctgtgttgcccaggctagagtgcagt

SEQ ID NO: 2526 - DNA, 32 bp, Homo sapiens
aggatgtggaccacctgcggccccatggggtg

SEQ ID NO: 2527 - DNA, 32 bp, Homo sapiens
tcggcgggcagaggagagggaggccgcggaat

SEQ ID NO: 2528 - DNA, 32 bp, Homo sapiens
aaaaagggagagtgagaaagaggatgagaggg

SEQ ID NO: 2529 - DNA, 32 bp, Homo sapiens
actctgtcacccaggctggaatccagtggcac

SEQ ID NO: 2530 - DNA, 25 bp, Homo sapiens
ggttcctgaggggtgatttgggaca

SEQ ID NO: 2531 - DNA, 32 bp, Homo sapiens
acaaatgttcagaattctcaccaccttctggt

SEQ ID NO: 2532 - DNA, 32 bp, Homo sapiens
aagcatctgggcctttctcttcctcttggtcc

SEQ ID NO: 2533 - DNA, 32 bp, Homo sapiens
cgatgaaatccaaaggtgaatcttttggttgg

SEQ ID NO: 2534 - DNA, 32 bp, Homo sapiens
cactgtcacccaggctggagtgcagtgttgca

SEQ ID NO: 2535 - DNA, 26 bp, Homo sapiens
ctgtgttgcccaggctggagtgcaat

SEQ ID NO: 2536 - DNA, 32 bp, Homo sapiens
ccaagatggagttttgctctgtcacccaggct

SEQ ID NO: 2537 - DNA, 23 bp, Homo sapiens
tggcgcaatttcagctcactgca

SEQ ID NO: 2538 - DNA, 23 bp, Homo sapiens
tggcgtcatctcagctcactgca

SEQ ID NO: 2539 - DNA, 32 bp, Homo sapiens
atattgtcctagatgctggagtgagattatat

SEQ ID NO: 2540 - DNA, 32 bp, Homo sapiens
atgttcccagttccaacaagccaaataccaga

SEQ ID NO: 2541 - DNA, 32 bp, Homo sapiens
ctttcaccatgggcttcattatcttgtcagaa

SEQ ID NO: 2542 - DNA, 32 bp, Homo sapiens
tcttgtcacccaggctggagtgtagtggtgtg

SEQ ID NO: 2543 - DNA, 32 bp, Homo sapiens
tctttagaacagtggttctcaaactttagtac

SEQ ID NO: 2544 - DNA, 32 bp, Homo sapiens
gccctgcgggaggaccattcactgtgagaaaa

SEQ ID NO: 2545 - DNA, 32 bp, Homo sapiens
gaacccgggaggcggagattgcggtgagccga

SEQ ID NO: 2546 - DNA, 32 bp, Homo sapiens
gaacccaggaggtggaggttgcagtgagctgg

SEQ ID NO: 2547 - DNA, 32 bp, Homo sapiens
ggacccgggaggcggaggttgcagtgagccaa

SEQ ID NO: 2548 - DNA, 32 bp, Homo sapiens
caaatcccaagtgttgacacagccatcttgtc

SEQ ID NO: 2549 - DNA, 32 bp, Homo sapiens
gaacccaggaggcggagattgcagtgagccga

SEQ ID NO: 2550 - DNA, 32 bp, Homo sapiens
gaacccgggaggtggaggttgcgatgagctga

SEQ ID NO: 2551 - DNA, 32 bp, Homo sapiens
acctccacctcccaggttcaagtgattcttct

SEQ ID NO: 2552 - DNA, 32 bp, Homo sapiens
acctcctcctcctgggttcaagcgattctcct

SEQ ID NO: 2553 - DNA, 28 bp, Homo sapiens
caaatcccaagtgttgacacagccatct

SEQ ID NO: 2554 - DNA, 32 bp, Homo sapiens
cagactgataccacctccaccgctgagcagtg

SEQ ID NO: 2555 - DNA, 32 bp, Homo sapiens
agatgatgttgaacctgctccttggacctctg

SEQ ID NO: 2556 - DNA, 32 bp, Homo sapiens
ttgagctcaagcaatccacctgcctcaacctc

SEQ ID NO: 2557 - DNA, 24 bp, Homo sapiens
ctgttgtccaggctggagtgcagt

SEQ ID NO: 2558 - DNA, 32 bp, Homo sapiens
agacttccgagtggctgggattacaggcgccc

SEQ ID NO: 2559 - DNA, 32 bp, Homo sapiens
agctctggccaaagcgcgtaccacctttcatc

SEQ ID NO: 2560 - DNA, 32 bp, Homo sapiens
ctcgcctctgcagtgtgctgcctacacctcca

SEQ ID NO: 2561 - DNA, 32 bp, Homo sapiens
gtttctcagcggcctagatgcctcttggtctg

SEQ ID NO: 2562 - DNA, 30 bp, Homo sapiens
taatttcacatgtagtataggagcttctga

SEQ ID NO: 2563 - DNA, 32 bp, Homo sapiens
gccctctcgccaggctggagtgtagtggcaca

SEQ ID NO: 2564 - DNA, 24 bp, Homo sapiens
ctgtcgtccaggttagagtgcaat

SEQ ID NO: 2565 - DNA, 32 bp, Homo sapiens
gttaaataatctgcctaaaatattttagaaat

SEQ ID NO: 2566 - DNA, 32 bp, Homo sapiens
tgtttgcccatctcttcttagtggaactttag

SEQ ID NO: 2567 - DNA, 22 bp, Homo sapiens
gtcacccaggctggagtgcaat

SEQ ID NO: 2568 - DNA, 32 bp, Homo sapiens
ccttcctgccaaggctggaggccgccaggtgt

SEQ ID NO: 2569 - DNA, 32 bp, Homo sapiens
caaagttgaagggacaaggcactgtgagggga

SEQ ID NO: 2570 - DNA, 32 bp, Homo sapiens
tattaagtgcagcttgacattatgttttattt

SEQ ID NO: 2571 - DNA, 32 bp, Homo sapiens
aaattttgcccaggtggataaatgtgtacatg

SEQ ID NO: 2572 - DNA, 32 bp, Homo sapiens
ttctgtcacccaggctggagtccaatggggcg

SEQ ID NO: 2573 - DNA, 32 bp, Homo sapiens
accccttgcccaggcaaggaaagacagcagtg

SEQ ID NO: 2574 - DNA, 28 bp, Homo sapiens
cccagatctcatcctgcctcatcctgag

SEQ ID NO: 2575 - DNA, 28 bp, Homo sapiens
atgattggaagtgctgcctacgtcttct

SEQ ID NO: 2576 - DNA, 32 bp, Homo sapiens
caacccgggaggcggagcttgcagtgagccga

SEQ ID NO: 2577 - DNA, 32 bp, Homo sapiens
tgaggacgtggtgacttcctgaacatcagctt

SEQ ID NO: 2578 - DNA, 32 bp, Homo sapiens
gacacctggaatgggagcttgtaacttttaca

SEQ ID NO: 2579 - DNA, 32 bp, Homo sapiens
actgtgtcaacaacaggaaactatttgtattt

SEQ ID NO: 2580 - DNA, 32 bp, Homo sapiens
ggagtctgtaccaagctgcttctggatgacca

SEQ ID NO: 2581 - DNA, 32 bp, Homo sapiens
gtgacgatgggaagacatggaaaacaaggaga

SEQ ID NO: 2582 - DNA, 32 bp, Homo sapiens
aaagacggaaagaaagaaagaaaacgagcgcg

SEQ ID NO: 2583 - DNA, 32 bp, Homo sapiens
tctgagaagccatttcaaagttgctgataact

SEQ ID NO: 2584 - DNA, 23 bp, Homo sapiens
cacacctgtaatcccagcacttt

SEQ ID NO: 2585 - DNA, 32 bp, Homo sapiens
aacataatttcagttatcagaagccattccat

SEQ ID NO: 2586 - DNA, 32 bp, Homo sapiens
cgagaaccagcggagaaaagaaaaagcaacgt

SEQ ID NO: 2587 - DNA, 32 bp, Homo sapiens
gctaaacgtttgttccccatctctgtgcctcc

SEQ ID NO: 2588 - DNA, 32 bp, Homo sapiens
caaaggtgttggagagcagctttgggttctgt

SEQ ID NO: 2589 - DNA, 23 bp, Homo sapiens
tcacgcctgtaatcccatcattt

SEQ ID NO: 2590 - DNA, 32 bp, Homo sapiens
ctccaggagccatcctggaatttctgaccttg

SEQ ID NO: 2591 - DNA, 32 bp, Homo sapiens
taagggcagcttttataggttccacatgtaag

SEQ ID NO: 2592 - DNA, 32 bp, Homo sapiens
acagcctctgcagggcctgctcttgcctccca

SEQ ID NO: 2593 - DNA, 32 bp, Homo sapiens
agccgggtgctgctgctcctgctgctgctgcc

SEQ ID NO: 2594 - DNA, 32 bp, Homo sapiens
tatttgactgtatttggagacagggtctttac

SEQ ID NO: 2595 - DNA, 32 bp, Homo sapiens
ctctgtcacccaggctggagtgcagtgacatg

SEQ ID NO: 2596 - DNA, 32 bp, Homo sapiens
accttgtcacccaggctagagtgcagtggcac

SEQ ID NO: 2597 - DNA, 32 bp, Homo sapiens
aactaggatactttctactttttctagctaca

SEQ ID NO: 2598 - DNA, 32 bp, Homo sapiens
gtcccagtgctgctgcagctctgagcattccc

SEQ ID NO: 2599 - DNA, 32 bp, Homo sapiens
tgagcctgcacagagccaggtgcaatgggcag

SEQ ID NO: 2600 - DNA, 32 bp, Homo sapiens
ctctgttgcccaggctggaatgcagtggcaca

SEQ ID NO: 2601 - DNA, 32 bp, Homo sapiens
taacactgaacaaaggcttcacttgtcctcat

SEQ ID NO: 2602 - DNA, 32 bp, Homo sapiens
ttactcgggaggctgaggcaggagaatcactt

SEQ ID NO: 2603 - DNA, 32 bp, Homo sapiens
gaacctaggaggtcgaggctgcagtgagccaa

SEQ ID NO: 2604 - DNA, 32 bp, Homo sapiens
ctctgtcacccaggctggaatgcagtggcatg

SEQ ID NO: 2605 - DNA, 28 bp, Homo sapiens
tgactcttatatactgcctcatcttgat

SEQ ID NO: 2606 - DNA, 32 bp, Homo sapiens
aagaccagggaggcccttaagaaaatatagca

SEQ ID NO: 2607 - DNA, 32 bp, Homo sapiens
ttgttagggaggcatgattttggtgagatctt

SEQ ID NO: 2608 - DNA, 32 bp, Homo sapiens
gtaaagactgggatggttgtgtggaaaacttt

SEQ ID NO: 2609 - DNA, 32 bp, Homo sapiens
tggtgatgtaccactcccgagaatattcccat

SEQ ID NO: 2610 - DNA, 32 bp, Homo sapiens
acctctgcctgccgggttcaagcagttctcct

SEQ ID NO: 2611 - DNA, 21 bp, Homo sapiens
tcacacctgtaatctcagcac

SEQ ID NO: 2612 - DNA, 32 bp, Homo sapiens
ggaggaggaagaggaaaacaagacaaacagcc

SEQ ID NO: 2613 - DNA, 32 bp, Homo sapiens
caaaacggaagaggagaaactcaatacaaaga

SEQ ID NO: 2614 - DNA, 32 bp, Homo sapiens
ctttgttgcccaggctggggtgcagtggcacg

SEQ ID NO: 2615 - DNA, 32 bp, Homo sapiens
ctttgttgcccaggctggagtgcagtagcacg

SEQ ID NO: 2616 - DNA, 32 bp, Homo sapiens
caccactatctctgttccatctgggcttatat

SEQ ID NO: 2617 - DNA, 32 bp, Homo sapiens
actttgttgcccagaggatgtgcagttgtcat

SEQ ID NO: 2618 - DNA, 32 bp, Homo sapiens
gagctagggctgctgcttctgctccagcccct

SEQ ID NO: 2619 - DNA, 20 bp, Homo sapiens
ggcaaatgtgatgtgctccc

SEQ ID NO: 2620 - DNA, 32 bp, Homo sapiens
ttgcacagtcggctgggcggtgcaatggcgga

SEQ ID NO: 2621 - DNA, 32 bp, Homo sapiens
ctgattttacctgaaaatggtagtagtttaca

SEQ ID NO: 2622 - DNA, 32 bp, Homo sapiens
taaatctggctgtattcagtagcaatacaaga

SEQ ID NO: 2623 - DNA, 28 bp, Homo sapiens
tcctcctcgtttgctgcctcctcctcct

SEQ ID NO: 2624 - DNA, 32 bp, Homo sapiens
ctgtgttgcccaggctagagtgcagcagtgac

SEQ ID NO: 2625 - DNA, 32 bp, Homo sapiens
ttctgtcacccaggctggggtgcagtggcgtg

SEQ ID NO: 2626 - DNA, 32 bp, Homo sapiens
gaaacgcaggagtccttcctggtagccagctc

SEQ ID NO: 2627 - DNA, 23 bp, Homo sapiens
ataggaaactgaaactctgtgga

SEQ ID NO: 2628 - DNA, 32 bp, Homo sapiens
atttgtggaggatgagaaagatgaagaagaca

SEQ ID NO: 2629 - DNA, 32 bp, Homo sapiens
tctggtcctgcagatgtgtagcactttgtagt

SEQ ID NO: 2630 - DNA, 32 bp, Homo sapiens
tctgcatagtttctttctcttccttcatagat

SEQ ID NO: 2631 - DNA, 32 bp, Homo sapiens
gggccctctgcagcccatcctttccttccgtc

SEQ ID NO: 2632 - DNA, 32 bp, Homo sapiens
ctaggaactgcctcagtgtctttgccagaaaa

SEQ ID NO: 2633 - DNA, 32 bp, Homo sapiens
cctgcccagccctcgtcaccacagggactcct

SEQ ID NO: 2634 - DNA, 17 bp, Homo sapiens
gccatcttcacccagaa

SEQ ID NO: 2635 - DNA, 21 bp, Homo sapiens
catttgtcagcccttgccaaa

SEQ ID NO: 2636 - DNA, 32 bp, Homo sapiens
ccagagaggctgctgctcattgagctgcactc

SEQ ID NO: 2637 - DNA, 32 bp, Homo sapiens
tggccctgctgtggctccccagctccagtcgg

SEQ ID NO: 2638 - DNA, 32 bp, Homo sapiens
tcctggttctagctgctcacatgtacaaatca

SEQ ID NO: 2639 - DNA, 32 bp, Homo sapiens
gcccaggctggagtatagtagtgcagtggtgt

SEQ ID NO: 2640 - DNA, 21 bp, Homo sapiens
ccaacatggcgaaaacccatc

SEQ ID NO: 2641 - DNA, 32 bp, Homo sapiens
tgtctgagactctggcttattccaggttggct

SEQ ID NO: 2642 - DNA, 32 bp, Homo sapiens
cagtaagcatccattccattgatattcgctaa

SEQ ID NO: 2643 - DNA, 32 bp, Homo sapiens
ggcttcttgcccaggtttcaaagctgaagtac

SEQ ID NO: 2644 - DNA, 32 bp, Homo sapiens
cctctattgcccaggctggagtgcagtggtgt

SEQ ID NO: 2645 - DNA, 32 bp, Homo sapiens
ttctgtccccgaggccggagtgcaatggcgtg

SEQ ID NO: 2646 - DNA, 32 bp, Homo sapiens
aatctacccaataattgcaacatggttctttg

SEQ ID NO: 2647 - DNA, 32 bp, Homo sapiens
aaacaatgaattcttcaacagggaaaacagct

SEQ ID NO: 2648 - DNA, 32 bp, Homo sapiens
gctctgtcgccaggctggagtgcagtggcgca

SEQ ID NO: 2649 - DNA, 32 bp, Homo sapiens
tactctcgcccaggctagagtgcagtggcatg

SEQ ID NO: 2650 - DNA, 32 bp, Homo sapiens
actctgtcaccaggctggagtgcagtggcgca

SEQ ID NO: 2651 - DNA, 32 bp, Homo sapiens
ataactgccagtgccctttcacagctgattat

SEQ ID NO: 2652 - DNA, 32 bp, Homo sapiens
tggcggcggcggcagaggcggcgggaggatga

SEQ ID NO: 2653 - DNA, 32 bp, Homo sapiens
agactagagggagtggggttgcagtggctgcc

SEQ ID NO: 2654 - DNA, 32 bp, Homo sapiens
tcccctaatcattacttggtagttattaatcc

SEQ ID NO: 2655 - DNA, 32 bp, Homo sapiens
gcctccgcttccctggttcaagcgattctctt

SEQ ID NO: 2656 - DNA, 21 bp, Homo sapiens
caggagaattaggagagagtg

SEQ ID NO: 2657 - DNA, 32 bp, Homo sapiens
aggctggggttagagtggggagtgggcttctt

SEQ ID NO: 2658 - DNA, 32 bp, Homo sapiens
aggagggggttagagagtctgttttgattgat

SEQ ID NO: 2659 - DNA, 32 bp, Homo sapiens
tcccctccgtaggagctcacagtctagattag

SEQ ID NO: 2660 - DNA, 32 bp, Homo sapiens
tctgtgcagctttcgagcggtagactcaccct

SEQ ID NO: 2661 - DNA, 32 bp, Homo sapiens
taaggcctgatctccaggaggggtaggggaga

SEQ ID NO: 2662 - DNA, 32 bp, Homo sapiens
tcttgtcgcccaggctgtagtgcagtggtaca

SEQ ID NO: 2663 - DNA, 32 bp, Homo sapiens
ctgtgtcacacaggctggagtgcagtggcgtg

SEQ ID NO: 2664 - DNA, 32 bp, Homo sapiens
ctctgtcacccaggctggagtgcagtggtatg

SEQ ID NO: 2665 - DNA, 32 bp, Homo sapiens
ctgcaggtctcaaaggtgggatttggcgaggg

SEQ ID NO: 2666 - DNA, 20 bp, Homo sapiens
ggcacacgcacctgctctcc

SEQ ID NO: 2667 - DNA, 18 bp, Homo sapiens
ggcaaatgcccaacctcc

SEQ ID NO: 2668 - DNA, 32 bp, Homo sapiens
tttagatggagtttctttttgcccaggctgga

SEQ ID NO: 2669 - DNA, 32 bp, Homo sapiens
cgagatgggagtttcactcttattgcccaggc

SEQ ID NO: 2670 - DNA, 32 bp, Homo sapiens
ttctgtgtgtccgccctcccagctccagccct

SEQ ID NO: 2671 - DNA, 32 bp, Homo sapiens
ctggcaccgagagggctggagtgcagtggcgt

SEQ ID NO: 2672 - DNA, 32 bp, Homo sapiens
gtaacatggtattggcttatcgtttttatctc

SEQ ID NO: 2673 - DNA, 32 bp, Homo sapiens
cctaagtatcaacttagccgtactttgaactc

SEQ ID NO: 2674 - DNA, 32 bp, Homo sapiens
ctctgtcacccagactggagtgcagtggtgtg

SEQ ID NO: 2675 - DNA, 32 bp, Homo sapiens
tatgaacccattggttagagtgcagtggcttc

SEQ ID NO: 2676 - DNA, 22 bp, Homo sapiens
agcaaagatgacagtgctgcag

SEQ ID NO: 2677 - DNA, 32 bp, Homo sapiens
gcttcaccatcctgggtcaagcagtgttcctt

SEQ ID NO: 2678 - DNA, 32 bp, Homo sapiens
aagggcaggaggcagcaggtgcaccaggagca

SEQ ID NO: 2679 - DNA, 32 bp, Homo sapiens
gaacctgggaggcggaggctgcagtgagctgg

SEQ ID NO: 2680 - DNA, 32 bp, Homo sapiens
acctctgcctcacgggttcaagcaattctcct

SEQ ID NO: 2681 - DNA, 32 bp, Homo sapiens
ggaggaggaagaggaggaggaggaagggagca

SEQ ID NO: 2682 - DNA, 32 bp, Homo sapiens
cggcggggaggaggagaaggaggagggtggcg

SEQ ID NO: 2683 - DNA, 32 bp, Homo sapiens
agcctcccgagtagctgggattacaggagcgt

SEQ ID NO: 2684 - DNA, 32 bp, Homo sapiens
aggagagccctctgctgctttccaacacacaa

SEQ ID NO: 2685 - DNA, 32 bp, Homo sapiens
gaccatctgccagcttctctcgttccgtcgat

SEQ ID NO: 2686 - DNA, 32 bp, Homo sapiens
agggcgtctcatctccccacaggcatctgctg

SEQ ID NO: 2687 - DNA, 32 bp, Homo sapiens
ccgagggttcgcccgcccttggttttccttac

SEQ ID NO: 2688 - DNA, 32 bp, Homo sapiens
gagatggagccagcaggctggtagcctggcag

SEQ ID NO: 2689 - DNA, 19 bp, Homo sapiens
ggtctccagaacccctttg

SEQ ID NO: 2690 - DNA, 32 bp, Homo sapiens
tagtggtgaactcagataacaaacttcccttc

SEQ ID NO: 2691 - DNA, 32 bp, Homo sapiens
tctggcttgcccaggctggagtgcggtggcta

SEQ ID NO: 2692 - DNA, 32 bp, Homo sapiens
gctctgctgcccaggctggaatgcagtggtgc

SEQ ID NO: 2693 - DNA, 32 bp, Homo sapiens
ctctgtcgctcgcgctggagtgcagtggcatg

SEQ ID NO: 2694 - DNA, 32 bp, Homo sapiens
tttttggcaccatagtagaacatggttgcttt

SEQ ID NO: 2695 - DNA, 32 bp, Homo sapiens
atctttgttggcgatctgagtgcagtgtggca

SEQ ID NO: 2696 - DNA, 32 bp, Homo sapiens
gccccagactgtgcccttacgagctcatctct

SEQ ID NO: 2697 - DNA, 32 bp, Homo sapiens
gaattcaggaggcggaggttgcagtgagccaa

SEQ ID NO: 2698 - DNA, 32 bp, Homo sapiens
ctctgtctcccaggctggagtgcagtgacaca

SEQ ID NO: 2699 - DNA, 32 bp, Homo sapiens
caccaacactggacgccttcccatgaaaaatt

SEQ ID NO: 2700 - DNA, 32 bp, Homo sapiens
aagtcaggacatcagtctgattaaaggtggtg

SEQ ID NO: 2701 - DNA, 32 bp, Homo sapiens
tcagctcaacatcttctgttagttatagctgc

SEQ ID NO: 2702 - DNA, 32 bp, Homo sapiens
agagcctgtaccaccaatgtttcaagaggagc

SEQ ID NO: 2703 - DNA, 32 bp, Homo sapiens
tcaggctcaagcgattctcccacctcagccat

SEQ ID NO: 2704 - DNA, 32 bp, Homo sapiens
gttggccaggctgttctgcccacctcaccctc

SEQ ID NO: 2705 - DNA, 32 bp, Homo sapiens
ccaggctcaagccatctttccacctcagcctg

SEQ ID NO: 2706 - DNA, 32 bp, Homo sapiens
ccaggccatcatctccccacctctcctcccct

SEQ ID NO: 2707 - DNA, 24 bp, Homo sapiens
tcatgcctgtaatccctgcacttt

SEQ ID NO: 2708 - DNA, 32 bp, Homo sapiens
ggagaagagtgaggagaaaggaaactcaagtc

SEQ ID NO: 2709 - DNA, 23 bp, Homo sapiens
gtcgcccaagctagagtgcagtg

SEQ ID NO: 2710 - DNA, 32 bp, Homo sapiens
tggcctctgcagggagcttcgtagaggtgagg

SEQ ID NO: 2711 - DNA, 32 bp, Homo sapiens
gcggctgctgccctccctcttctgcctcccct

SEQ ID NO: 2712 - DNA, 32 bp, Homo sapiens
tttagatggagttttactcttgttgcccaggc

SEQ ID NO: 2713 - DNA, 32 bp, Homo sapiens
tttagacggagtttcactcttgttgcccaggc

SEQ ID NO: 2714 - DNA, 20 bp, Homo sapiens
gccacccactcagcccagaa

SEQ ID NO: 2715 - DNA, 32 bp, Homo sapiens
aggggcccagttctcagcagcagacactctgt

SEQ ID NO: 2716 - DNA, 32 bp, Homo sapiens
aaactttgtaacttttgttactgtgaattcaa

SEQ ID NO: 2717 - DNA, 32 bp, Homo sapiens
tcaggcccagaacttgccctccagtggacctt

SEQ ID NO: 2718 - DNA, 32 bp, Homo sapiens
ccgtttgtcgccaggctggagtgcagtggtgc

SEQ ID NO: 2719 - DNA, 32 bp, Homo sapiens
gactgttgcaccaggctgagaaagcagcaata

SEQ ID NO: 2720 - DNA, 32 bp, Homo sapiens
agaggtctgcccagggtgggagcagtgtcact

SEQ ID NO: 2721 - DNA, 32 bp, Homo sapiens
gaacacgggaggcagaggttgcagtgagcaga

SEQ ID NO: 2722 - DNA, 32 bp, Homo sapiens
ccctgttgcccaggctacagtgcaatggcatg

SEQ ID NO: 2723 - DNA, 32 bp, Homo sapiens
ttgtttgcatttatgaatcttgctgcctttta

SEQ ID NO: 2724 - DNA, 32 bp, Homo sapiens
agctccgcctcctgggttcacgtgattctcat

SEQ ID NO: 2725 - DNA, 32 bp, Homo sapiens
caggacccaagtgtgaacaacactcagcccgc

SEQ ID NO: 2726 - DNA, 32 bp, Homo sapiens
gaacctggcaggtggaggttgcagtgagtgga

SEQ ID NO: 2727 - DNA, 32 bp, Homo sapiens
agcccagtgacacttagcccctgggacaatga

SEQ ID NO: 2728 - DNA, 32 bp, Homo sapiens
gctgtgtcgcccagactggagtgcagtggtgg

SEQ ID NO: 2729 - DNA, 32 bp, Homo sapiens
ctcttgttacccaggctggagtgcagtggcgc

SEQ ID NO: 2730 - DNA, 32 bp, Homo sapiens
cctaagaagtcacatgaacatatttcacattt

SEQ ID NO: 2731 - DNA, 32 bp, Homo sapiens
tccgggcccacctgcgggtgcaccttaaatcg

SEQ ID NO: 2732 - DNA, 32 bp, Homo sapiens
cagcccaggaggtggaggttgcagtgagcgga

SEQ ID NO: 2733 - DNA, 32 bp, Homo sapiens
cactcttcactcaggctgcagtgcagtggcgc

SEQ ID NO: 2734 - DNA, 20 bp, Homo sapiens
aactgttcggctactggaca

SEQ ID NO: 2735 - DNA, 21 bp, Homo sapiens
tgagcgtactgtaactggaga

SEQ ID NO: 2736 - DNA, 23 bp, Homo sapiens
cccggagccccgcagctcgggca

SEQ ID NO: 2737 - DNA, 32 bp, Homo sapiens
accaaaggagctcagttttcaaactttaatgg

SEQ ID NO: 2738 - DNA, 32 bp, Homo sapiens
actctgctgcccaggctggagtacagtggcac

SEQ ID NO: 2739 - DNA, 32 bp, Homo sapiens
aggcgcattcgcccttcctagtttgcagcaat

SEQ ID NO: 2740 - DNA, 32 bp, Homo sapiens
gccctgggctgcaggaggttgcggcggccgcg

SEQ ID NO: 2741 - DNA, 32 bp, Homo sapiens
actgaagccacaggctggtggccatgttctct

SEQ ID NO: 2742 - DNA, 32 bp, Homo sapiens
cccagagccttgtttggccctgatctctgact

SEQ ID NO: 2743 - DNA, 32 bp, Homo sapiens
aaatgccattggatagaaggggactgttcttc

SEQ ID NO: 2744 - DNA, 32 bp, Homo sapiens
ccaaaacatttccaacacagaacttccattca

SEQ ID NO: 2745 - DNA, 32 bp, Homo sapiens
ggtgtcctaaggagactcctggaagctgaatg

SEQ ID NO: 2746 - DNA, 32 bp, Homo sapiens
acagcccccgtgggcatggaccacctttattt

SEQ ID NO: 2747 - DNA, 32 bp, Homo sapiens
gtgggtctctgcggcactcttctgcctggtga

SEQ ID NO: 2748 - DNA, 32 bp, Homo sapiens
tgaggacatcagggccacctctggaccccttg

SEQ ID NO: 2749 - DNA, 32 bp, Homo sapiens
cttgcctagggggcagagggtgcagtggcagt

SEQ ID NO: 2750 - DNA, 32 bp, Homo sapiens
atggctgtgacggataaggggtgtggggtgcg

SEQ ID NO: 2751 - DNA, 32 bp, Homo sapiens
tgctctgcgcccaggatggagtgcagtggcat

SEQ ID NO: 2752 - DNA, 32 bp, Homo sapiens
ccgggttcaagcaattctgtctcagcctcccg

SEQ ID NO: 2753 - DNA, 32 bp, Homo sapiens
gttgttgcctggatttccagatcatgtgacag

SEQ ID NO: 2754 - DNA, 32 bp, Homo sapiens
gtgctgtttcctggctggagtgcagtggcatg

SEQ ID NO: 2755 - DNA, 21 bp, Homo sapiens
caggacccgagcctccagcct

SEQ ID NO: 2756 - DNA, 25 bp, Homo sapiens
cgtcgcccaagctggagtacagtgg

SEQ ID NO: 2757 - DNA, 22 bp, Homo sapiens
gtgcctacctctggtctagaga

SEQ ID NO: 2758 - DNA, 32 bp, Homo sapiens
atgctgttgcccaggctggagtgcagtggtgc

SEQ ID NO: 2759 - DNA, 28 bp, Homo sapiens
gatggatcaagtgctgttacagctcatg

SEQ ID NO: 2760 - DNA, 32 bp, Homo sapiens
cttcttcaggcttcttagctgctgctatccat

SEQ ID NO: 2761 - DNA, 32 bp, Homo sapiens
agacctagcccaggcttggaggccagctggag

SEQ ID NO: 2762 - DNA, 18 bp, Homo sapiens
gcaggagagactgagcag

SEQ ID NO: 2763 - DNA, 32 bp, Homo sapiens
cgagctggaggaggagaagtaagcggtggggg

SEQ ID NO: 2764 - DNA, 32 bp, Homo sapiens
gctcagaagtcacctcctcagtgcagttagcc

SEQ ID NO: 2765 - DNA, 32 bp, Homo sapiens
cagggagcactgctgctccatgctccattctc

SEQ ID NO: 2766 - DNA, 32 bp, Homo sapiens
cccggccctcaagggacgctgtctggggccgg

SEQ ID NO: 2767 - DNA, 32 bp, Homo sapiens
ctatcctcatctctccccagatgtgactactg

SEQ ID NO: 2768 - DNA, 32 bp, Homo sapiens
aaaatagtggtgcttctttctgatctctagtg

SEQ ID NO: 2769 - DNA, 32 bp, Homo sapiens
tcttgttgctgaggctggagtgcagtggcacc

SEQ ID NO: 2770 - DNA, 32 bp, Homo sapiens
ctcgagtagatcctgaaatcctacatttctat

SEQ ID NO: 2771 - DNA, 32 bp, Homo sapiens
gtgggctgcccaggatgcggtgcgtgcttctg

SEQ ID NO: 2772 - DNA, 32 bp, Homo sapiens
gggagaaaaggaggagaacaggagacgagaag

SEQ ID NO: 2773 - DNA, 32 bp, Homo sapiens
gaacccgggaggtggaggttgcagtgaaccaa

SEQ ID NO: 2774 - DNA, 32 bp, Homo sapiens
ttgcatgggaggcaggtggggcttggatcagt

SEQ ID NO: 2775 - DNA, 26 bp, Homo sapiens
gccagtttgttctctcagaacccaga

SEQ ID NO: 2776 - DNA, 32 bp, Homo sapiens
agcgtgcgtccgttcgcacaggcagcgggagg

SEQ ID NO: 2777 - DNA, 24 bp, Homo sapiens
gtcgcccaggctggagtgcagtag

SEQ ID NO: 2778 - DNA, 32 bp, Homo sapiens
ccgggttcaagcaattctcctgccttagcctc

SEQ ID NO: 2779 - DNA, 32 bp, Homo sapiens
gggtgaacaggaaatgccttgtggaaacagga

SEQ ID NO: 2780 - DNA, 32 bp, Homo sapiens
ggacctgggaggcggagcttgcagtgagctga

SEQ ID NO: 2781 - DNA, 32 bp, Homo sapiens
tcagtccgtctgtcttctctttcctctgccct

SEQ ID NO: 2782 - DNA, 32 bp, Homo sapiens
atggggcttcttctccccttcttcctttcccc

SEQ ID NO: 2783 - DNA, 32 bp, Homo sapiens
ctgggttcaagcaattctcctgcctcagcctc

SEQ ID NO: 2784 - DNA, 32 bp, Homo sapiens
gagtccaggaggtcgaggctgcagtgagccaa

SEQ ID NO: 2785 - DNA, 32 bp, Homo sapiens
ttagcctctgcttcaagcttagcaatatattc

SEQ ID NO: 2786 - DNA, 32 bp, Homo sapiens
ctctcctgcccaggggctagagagcagtctcc

SEQ ID NO: 2787 - DNA, 32 bp, Homo sapiens
tgtgtctgggatccagggcaatgtgaattttc

SEQ ID NO: 2788 - DNA, 32 bp, Homo sapiens
catcccccaagtgcctcaccagtcccccagac

SEQ ID NO: 2789 - DNA, 32 bp, Homo sapiens
gaaccagggaggcggaggttgcagtgagccga

SEQ ID NO: 2790 - DNA, 32 bp, Homo sapiens
cacctgcccaaaaccaaacgcagcatcttccc

SEQ ID NO: 2791 - DNA, 32 bp, Homo sapiens
tcatttctgccagcttcttatggtcctgaggc

SEQ ID NO: 2792 - DNA, 32 bp, Homo sapiens
gtaggtggagaggtggaaagaaaagacaaatg

SEQ ID NO: 2793 - DNA, 22 bp, Homo sapiens
gggccacgggctcgcgggcact

SEQ ID NO: 2794 - DNA, 22 bp, Homo sapiens
ggcatgatctcagctcactgca

SEQ ID NO: 2795 - DNA, 32 bp, Homo sapiens
agggaggtcctggccgtccacagggtcggccc

SEQ ID NO: 2796 - DNA, 32 bp, Homo sapiens
cgtgtcggttccattccatttccatttctgca

SEQ ID NO: 2797 - DNA, 32 bp, Homo sapiens
gaagaggagaggcagagagggcgcggggaccg

SEQ ID NO: 2798 - DNA, 32 bp, Homo sapiens
aactcttgtccaggctggaggagtgcagtcgt

SEQ ID NO: 2799 - DNA, 22 bp, Homo sapiens
gcctggacctccctccttcctc

SEQ ID NO: 2800 - DNA, 32 bp, Homo sapiens
ctgggtttgagcaatcctcccacctcagcctc

SEQ ID NO: 2801 - DNA, 32 bp, Homo sapiens
tgagcgctggcaagacctcaatgtgatcaaca

SEQ ID NO: 2802 - DNA, 32 bp, Homo sapiens
acctctgtcttccaggttcaagcaattctgcc

SEQ ID NO: 2803 - DNA, 32 bp, Homo sapiens
ttgagacggagtttccctcttgttgcccgggc

SEQ ID NO: 2804 - DNA, 32 bp, Homo sapiens
gtgcggcagctgctgctcaggtgccatgccct

SEQ ID NO: 2805 - DNA, 32 bp, Homo sapiens
tgtagtagctgcactaggtgattcttggagcg

SEQ ID NO: 2806 - DNA, 32 bp, Homo sapiens
cgtatctgcagaatgggccactgtaggggttg

SEQ ID NO: 2807 - DNA, 32 bp, Homo sapiens
tactgggaaaggcagagggtggagggaagatt

SEQ ID NO: 2808 - DNA, 32 bp, Homo sapiens
ctctttcgcccaggatggagtgcagtggtgcg

SEQ ID NO: 2809 - DNA, 32 bp, Homo sapiens
cagggaaatgggcctcttccactgtgatctcc

SEQ ID NO: 2810 - DNA, 32 bp, Homo sapiens
gagctgactgagggaagatgcaccttgatctc

SEQ ID NO: 2811 - DNA, 32 bp, Homo sapiens
agctacaagcacgcactgaagcactttactga

SEQ ID NO: 2812 - DNA, 32 bp, Homo sapiens
gagctcaggaggcagaggttgcagtgagctga

SEQ ID NO: 2813 - DNA, 19 bp, Homo sapiens
tgtgggtgaagagagaggg

SEQ ID NO: 2814 - DNA, 32 bp, Homo sapiens
agcggtggtcagacgtggaaatggtggggaga

SEQ ID NO: 2815 - DNA, 32 bp, Homo sapiens
cgccccacgcttctcccgctccgggccccgca

SEQ ID NO: 2816 - DNA, 19 bp, Homo sapiens
ccatcattaacaccaagaa

SEQ ID NO: 2817 - DNA, 32 bp, Homo sapiens
tgaacccctccccatgaacacaagggttttat

SEQ ID NO: 2818 - DNA, 32 bp, Homo sapiens
aggtgtatgcagggccctcttctgccttagcg

SEQ ID NO: 2819 - DNA, 32 bp, Homo sapiens
aaatgcatcacctttgaaaatatttcacatat

SEQ ID NO: 2820 - DNA, 32 bp, Homo sapiens
agcctcccgagtagctgggattacgggcatat

SEQ ID NO: 2821 - DNA, 32 bp, Homo sapiens
acctccgcctgctgggttcaagcgattctcct

SEQ ID NO: 2822 - DNA, 32 bp, Homo sapiens
gaacccaagaggcagaggttgcagtgaactga

SEQ ID NO: 2823 - DNA, 32 bp, Homo sapiens
agcctcccgagtagctgggattacaggtgccc

SEQ ID NO: 2824 - DNA, 32 bp, Homo sapiens
agcctctcgagtagctgggattacaggcatgc

SEQ ID NO: 2825 - DNA, 32 bp, Homo sapiens
agcctcctgagtagctgggattacaggtgcct

SEQ ID NO: 2826 - DNA, 32 bp, Homo sapiens
accgcccagcttctccctgagggcccaccagc

SEQ ID NO: 2827 - DNA, 32 bp, Homo sapiens
cctgttccttgtaattctcccactgttctcag

SEQ ID NO: 2828 - DNA, 32 bp, Homo sapiens
attaccagtcattaaagtccagtattactaag

SEQ ID NO: 2829 - DNA, 32 bp, Homo sapiens
gttgtgtgagcctcttcaggggttcatccagc

SEQ ID NO: 2830 - DNA, 32 bp, Homo sapiens
cgtgggccgccagatctgcaccaccttcgagc

SEQ ID NO: 2831 - DNA, 17 bp, Homo sapiens
gtggggagaaagaggga

SEQ ID NO: 2832 - DNA, 32 bp, Homo sapiens
ccctagacctccattcactctgtttctcttct

SEQ ID NO: 2833 - DNA, 32 bp, Homo sapiens
gaacctgggaggtggagattgcagtgagtcaa

SEQ ID NO: 2834 - DNA, 32 bp, Homo sapiens
aggaggcggaggcagaggctgcagtgacccaa

SEQ ID NO: 2835 - DNA, 32 bp, Homo sapiens
gaacccaggaggcggagattgcagtgagctga

SEQ ID NO: 2836 - DNA, 32 bp, Homo sapiens
ctcaaactgtatgcctgctccagcctggactg

SEQ ID NO: 2837 - DNA, 28 bp, Homo sapiens
taagacccaagtgcctcctgctgtttcc

SEQ ID NO: 2838 - DNA, 32 bp, Homo sapiens
aaccctgggaggcagaggttgcagtgagtcga

SEQ ID NO: 2839 - DNA, 32 bp, Homo sapiens
tatttgaggttaggtgtggccttgaccttacc

SEQ ID NO: 2840 - DNA, 32 bp, Homo sapiens
ggcctccccaagtgctgggattataggcatga

SEQ ID NO: 2841 - DNA, 32 bp, Homo sapiens
caattcctgagtagggccttgcttgagttctt

SEQ ID NO: 2842 - DNA, 32 bp, Homo sapiens
cacctcaagccctattcacaggcaccaggaaa

SEQ ID NO: 2843 - DNA, 32 bp, Homo sapiens
ggctccttctcttctcccatctgctaccagag

SEQ ID NO: 2844 - DNA, 32 bp, Homo sapiens
gcagatagacttgaggacagaaaacaaaaaca

SEQ ID NO: 2845 - DNA, 32 bp, Homo sapiens
ctctgtcgcccaggctggaatgcagttgtgag

SEQ ID NO: 2846 - DNA, 32 bp, Homo sapiens
gctctgtctcccaggctggagtgcaggcttgg

SEQ ID NO: 2847 - DNA, 32 bp, Homo sapiens
atcttccagcttctgtcagaactttaggtcag

SEQ ID NO: 2848 - DNA, 32 bp, Homo sapiens
gtgctcttaaccttctgagtgctgctagccca

SEQ ID NO: 2849 - DNA, 32 bp, Homo sapiens
ctctgtcacccaggctggagtgcagtgtcaca

SEQ ID NO: 2850 - DNA, 32 bp, Homo sapiens
ttttcctttgctacttgaatagcaataaaagc

SEQ ID NO: 2851 - DNA, 32 bp, Homo sapiens
aaacccgggaggcagaggttgcagtgacccaa

SEQ ID NO: 2852 - DNA, 32 bp, Homo sapiens
cttgaactgaggcagaggctacagtgagtgga

SEQ ID NO: 2853 - DNA, 32 bp, Homo sapiens
gaggccaggagtttgaggctgcagtgagttat

SEQ ID NO: 2854 - DNA, 32 bp, Homo sapiens
tcctgcccaagtggacccagcggcaaaggtga

SEQ ID NO: 2855 - DNA, 32 bp, Homo sapiens
tgggaaggcaagatgcccaacaacagcactgc

SEQ ID NO: 2856 - DNA, 32 bp, Homo sapiens
ctcctgctgaggcggagactgcagtgagctga

SEQ ID NO: 2857 - DNA, 32 bp, Homo sapiens
ctctggtcataaggaacccccacggtgcgtgg

SEQ ID NO: 2858 - DNA, 32 bp, Homo sapiens
agcctctcgagtagctgggattataggcgtcc

SEQ ID NO: 2859 - DNA, 32 bp, Homo sapiens
gatgtccctggaacaggaactcgcctgaccct

SEQ ID NO: 2860 - DNA, 23 bp, Homo sapiens
gacacacatccgtgacacagcct

SEQ ID NO: 2861 - DNA, 24 bp, Homo sapiens
ctgctgcccaggctggagtgcagt

SEQ ID NO: 2862 - DNA, 24 bp, Homo sapiens
tcacgcctgtaatcgcagcacttt

SEQ ID NO: 2863 - DNA, 32 bp, Homo sapiens
tagcatgcgcccggggttgacaacagctggac

SEQ ID NO: 2864 - DNA, 32 bp, Homo sapiens
tctccctgcatcctgaatgatgcttagtcaga

SEQ ID NO: 2865 - DNA, 32 bp, Homo sapiens
tgactgttgcccaagctggaatgcagtggcac

SEQ ID NO: 2866 - DNA, 32 bp, Homo sapiens
cataatgcctttgagattcttctgcttgtatc

SEQ ID NO: 2867 - DNA, 32 bp, Homo sapiens
cctcagcagagccgcttcctggtgctacgcag

SEQ ID NO: 2868 - DNA, 32 bp, Homo sapiens
tttctgggtacctctggttagcactttctact

SEQ ID NO: 2869 - DNA, 18 bp, Homo sapiens
cagagaagggtccagctc

SEQ ID NO: 2870 - DNA, 32 bp, Homo sapiens
ttgagacagagtttcactcttgttgcccaggc

SEQ ID NO: 2871 - DNA, 32 bp, Homo sapiens
ttgagatggagttttgctcttgttgcccaggc

SEQ ID NO: 2872 - DNA, 32 bp, Homo sapiens
tcatgagttccaagttgaaacatggttgtgca

SEQ ID NO: 2873 - DNA, 32 bp, Homo sapiens
gcagcaagcccaggcggcggtggaaaggctgg

SEQ ID NO: 2874 - DNA, 32 bp, Homo sapiens
tttcaagggagctcctggagttgacagtagca

SEQ ID NO: 2875 - DNA, 32 bp, Homo sapiens
ggactctctcacacaggaaacttccctatact

SEQ ID NO: 2876 - DNA, 32 bp, Homo sapiens
tgctgtgggaggcatgagctggagatgggggc

SEQ ID NO: 2877 - DNA, 19 bp, Homo sapiens
cagaggagctctccagccc

SEQ ID NO: 2878 - DNA, 23 bp, Homo sapiens
cccggagcccccgcatatcagca

SEQ ID NO: 2879 - DNA, 32 bp, Homo sapiens
cttcggcagccttagggaacccagaaagtagt

SEQ ID NO: 2880 - DNA, 32 bp, Homo sapiens
catatagtcagtgaagtaaatattttaaagga

SEQ ID NO: 2881 - DNA, 32 bp, Homo sapiens
gggcccacaaagtcaaggctgcagtgagctgt

SEQ ID NO: 2882 - DNA, 32 bp, Homo sapiens
ctctgtagcccagtctggagtgcagtggtaca

SEQ ID NO: 2883 - DNA, 32 bp, Homo sapiens
gctctgtcacccagtctggagtgcagtggcaa

SEQ ID NO: 2884 - DNA, 24 bp, Homo sapiens
tcacacctgtaatcccagcacttt

SEQ ID NO: 2885 - DNA, 24 bp, Homo sapiens
gatgaggaaactaaggctcctagg

SEQ ID NO: 2886 - DNA, 32 bp, Homo sapiens
actcaggtccccagactgcagtgagctgacct

SEQ ID NO: 2887 - DNA, 32 bp, Homo sapiens
ttttgatggagtttcactattttgcccaggct

SEQ ID NO: 2888 - DNA, 32 bp, Homo sapiens
tacctgactcaaggagtgtctggagcacctcc

SEQ ID NO: 2889 - DNA, 32 bp, Homo sapiens
gtatatttgaggacagcatcttgctagagaaa

SEQ ID NO: 2890 - DNA, 32 bp, Homo sapiens
gcacttaatacctgcaatgtttgctactgtac

SEQ ID NO: 2891 - DNA, 32 bp, Homo sapiens
cctcttaatgcctttgctagtgcagtgtattt

SEQ ID NO: 2892 - DNA, 28 bp, Homo sapiens
tttggcccaagtgtggccccattagcga

SEQ ID NO: 2893 - DNA, 32 bp, Homo sapiens
cttcctgggaggcaggtgtgggtgaccggggc

SEQ ID NO: 2894 - DNA, 32 bp, Homo sapiens
ctctgtcgcccaggctggcgtgaagtggcgca

SEQ ID NO: 2895 - DNA, 32 bp, Homo sapiens
ttgtgagatgaatacttcctgagaaacttgac

SEQ ID NO: 2896 - DNA, 32 bp, Homo sapiens
gtcttgaactcctggactcaagcaatcccccc

SEQ ID NO: 2897 - DNA, 28 bp, Homo sapiens
agcgactcaccagttgcctcatctttcc

SEQ ID NO: 2898 - DNA, 32 bp, Homo sapiens
ggtcttctgagtagctgggactacaggcatgc

SEQ ID NO: 2899 - DNA, 32 bp, Homo sapiens
atgtccccaacaagattgcttaataaattgtg

SEQ ID NO: 2900 - DNA, 32 bp, Homo sapiens
ggcagtgacctactctgctccccagaggctcc

SEQ ID NO: 2901 - DNA, 32 bp, Homo sapiens
tgagatggaagaggaggaggaggaggagctgg

SEQ ID NO: 2902 - DNA, 32 bp, Homo sapiens
ctctccatctacaaagttgcagtattatgcaa

SEQ ID NO: 2903 - DNA, 32 bp, Homo sapiens
agcctcccaagtagctgggattacaggcatac

SEQ ID NO: 2904 - DNA, 32 bp, Homo sapiens
atcagaagcccaaggggtacatttattgcttt

SEQ ID NO: 2905 - DNA, 32 bp, Homo sapiens
tactcagtgtcagacatctacaggaaagaaac

SEQ ID NO: 2906 - DNA, 32 bp, Homo sapiens
acaaggtgggtctcctgggtaagggaagcaag

SEQ ID NO: 2907 - DNA, 32 bp, Homo sapiens
tcttgttgcccaggctggagtgcaatagcatg

SEQ ID NO: 2908 - DNA, 32 bp, Homo sapiens
gaagtaaatgttctgagtggagttactagaat

SEQ ID NO: 2909 - DNA, 32 bp, Homo sapiens
accggtctacatcgcacccccacccccacccc

SEQ ID NO: 2910 - DNA, 28 bp, Homo sapiens
agtggcacaagtgctgtttctatcacta

SEQ ID NO: 2911 - DNA, 32 bp, Homo sapiens
catcggaggtgggcggggttgcagtgactggt

SEQ ID NO: 2912 - DNA, 32 bp, Homo sapiens
ctcagccctcccagcccacttctgcctgtttt

SEQ ID NO: 2913 - DNA, 32 bp, Homo sapiens
gggaaactgagcttctttcttctgcactgggg

SEQ ID NO: 2914 - DNA, 32 bp, Homo sapiens
agcgcttcagcaaccgctcccacctcctccag

SEQ ID NO: 2915 - DNA, 32 bp, Homo sapiens
ttacctgctgggacctgctcccagagaccttg

SEQ ID NO: 2916 - DNA, 32 bp, Homo sapiens
gctcacctggggcctccatcccagaagcgcag

SEQ ID NO: 2917 - DNA, 32 bp, Homo sapiens
caacgtcctcaaggatgccgtagccgtcaaga

SEQ ID NO: 2918 - DNA, 32 bp, Homo sapiens
tattaatggagttattgctatttttgctgtga

SEQ ID NO: 2919 - DNA, 22 bp, Homo sapiens
aaggttgtgtagctgtgtcatg

SEQ ID NO: 2920 - DNA, 32 bp, Homo sapiens
gaaggagatgattctttcaagggacacaggca

SEQ ID NO: 2921 - DNA, 32 bp, Homo sapiens
agcccagggaggtcaaggctgcagtgagcaat

SEQ ID NO: 2922 - DNA, 32 bp, Homo sapiens
atctgttgcccaggctggagtgcagtggagca

SEQ ID NO: 2923 - DNA, 32 bp, Homo sapiens
cccttcttgcccaggctggagtgcaagggcgc

SEQ ID NO: 2924 - DNA, 32 bp, Homo sapiens
agccccaggaggtcgaggctgcagtgagccat

SEQ ID NO: 2925 - DNA, 32 bp, Homo sapiens
gagactgggaggcagaggttgcagtgaaccga

SEQ ID NO: 2926 - DNA, 32 bp, Homo sapiens
tttaggggagggcagaggcctgcagtttggct

SEQ ID NO: 2927 - DNA, 32 bp, Homo sapiens
agcctcctgagtagctgggactacaggcacgc

SEQ ID NO: 2928 - DNA, 32 bp, Homo sapiens
ttgaatgctgcttcctgctccctccatggacc

SEQ ID NO: 2929 - DNA, 32 bp, Homo sapiens
gcctcaaactcctgggctcaagcaatcctccc

SEQ ID NO: 2930 - DNA, 32 bp, Homo sapiens
tctcagagtttccaagcagggaaacattactg

SEQ ID NO: 2931 - DNA, 32 bp, Homo sapiens
aaaagttaattttgggctgagtgcagtggctt

SEQ ID NO: 2932 - DNA, 32 bp, Homo sapiens
cctgccaggcctgcgtggccttaggttgttcc

SEQ ID NO: 2933 - DNA, 32 bp, Homo sapiens
cacatcccacctacagactaccacctttcgag

SEQ ID NO: 2934 - DNA, 32 bp, Homo sapiens
attccatgttttcttcccatctgccttatata

SEQ ID NO: 2935 - DNA, 15 bp, Homo sapiens
gcccctgccctgagg

SEQ ID NO: 2936 - DNA, 32 bp, Homo sapiens
gaacctgggaggcagaggttgcaatgagccaa

SEQ ID NO: 2937 - DNA, 32 bp, Homo sapiens
gaacctgagaggcagaggttgcagtgagccaa

SEQ ID NO: 2938 - DNA, 32 bp, Homo sapiens
gaatgggaaagacagaggttacagaggagccg

SEQ ID NO: 2939 - DNA, 32 bp, Homo sapiens
ggaagcccattcctccccatcagttggcctct

SEQ ID NO: 2940 - DNA, 32 bp, Homo sapiens
gagagtagaagagaagggagcaacttatcctt

SEQ ID NO: 2941 - DNA, 32 bp, Homo sapiens
cagtgcagcctcgacttcctgggatccagcga

SEQ ID NO: 2942 - DNA, 32 bp, Homo sapiens
gaggtaaaagagacatctgcagtgtgacagaa

SEQ ID NO: 2943 - DNA, 32 bp, Homo sapiens
agtctgtcacccaggctggagtgcagtggcgt

SEQ ID NO: 2944 - DNA, 32 bp, Homo sapiens
gagcccgggaggcagaggttgcagtgagccgt

SEQ ID NO: 2945 - DNA, 32 bp, Homo sapiens
gggctctgggggcagaggtggcaggaatggtg

SEQ ID NO: 2946 - DNA, 32 bp, Homo sapiens
gccacacttcaaactactttgctgctaatatt

SEQ ID NO: 2947 - DNA, 32 bp, Homo sapiens
acatagcccattgcccttaatgatggtttctt

SEQ ID NO: 2948 - DNA, 32 bp, Homo sapiens
cgccaggcaagtgcccttagaaaccgggcccc

SEQ ID NO: 2949 - DNA, 32 bp, Homo sapiens
tgaacagggaagcagaggttgcggtgaaccgg

SEQ ID NO: 2950 - DNA, 32 bp, Homo sapiens
actctgtcacccaggctgggaattgcagtggc

SEQ ID NO: 2951 - DNA, 32 bp, Homo sapiens
tctgggtaccagactactgagcactttctgac

SEQ ID NO: 2952 - DNA, 32 bp, Homo sapiens
actttcagcctgcacttgagtattccttatgt

SEQ ID NO: 2953 - DNA, 32 bp, Homo sapiens
cttgtctctaacctttaaaagaggggtcaatc

SEQ ID NO: 2954 - DNA, 32 bp, Homo sapiens
tcttgttgcccaggctggagtgcattggcgcg

SEQ ID NO: 2955 - DNA, 32 bp, Homo sapiens
ccagggaaaggagaaaagagaaaacaggctgg

SEQ ID NO: 2956 - DNA, 32 bp, Homo sapiens
agcactgagccagcaggaaggatctcacaggt

SEQ ID NO: 2957 - DNA, 32 bp, Homo sapiens
agcccaggtgcactgctcacacccccacctgc

SEQ ID NO: 2958 - DNA, 32 bp, Homo sapiens
tcatcagccctcttttccggtgccggaactat

SEQ ID NO: 2959 - DNA, 32 bp, Homo sapiens
ctctgtcgcccaggctggagtgcaatactgca

SEQ ID NO: 2960 - DNA, 32 bp, Homo sapiens
ctcttcccagttctctttatagaagctctagg

SEQ ID NO: 2961 - DNA, 32 bp, Homo sapiens
gccgtctcaacaacaggcatcacctgaatatc

SEQ ID NO: 2962 - DNA, 32 bp, Homo sapiens
acagaaaacatcagggtcttggaacaccagag

SEQ ID NO: 2963 - DNA, 32 bp, Homo sapiens
tgggcagggtggggcaggatgcagtgagccag

SEQ ID NO: 2964 - DNA, 32 bp, Homo sapiens
gcttgtcatgggagactggagtgcagattctt

SEQ ID NO: 2965 - DNA, 32 bp, Homo sapiens
ctgtgctcaagcaatcctcccatctccatctc

SEQ ID NO: 2966 - DNA, 32 bp, Homo sapiens
gcgccgcgtcgacaaacccccatcctgggaaa

SEQ ID NO: 2967 - DNA, 32 bp, Homo sapiens
tttgcctccctctcttctctttgcctgtatgc

SEQ ID NO: 2968 - DNA, 32 bp, Homo sapiens
tgctaagggaaaggggaaagaaagggaaaagg

SEQ ID NO: 2969 - DNA, 32 bp, Homo sapiens
ttgcttactttttaccaggagtgcagttcatt

SEQ ID NO: 2970 - DNA, 32 bp, Homo sapiens
cacagacccccagcaggtagcattccccagcc

SEQ ID NO: 2971 - DNA, 23 bp, Homo sapiens
tgacgtgatctcagctcactgca

SEQ ID NO: 2972 - DNA, 32 bp, Homo sapiens
agaagcttggcctgagtctcccagcagagaaa

SEQ ID NO: 2973 - DNA, 32 bp, Homo sapiens
ctaccccacatcctgtcttagccgcagtctcc

SEQ ID NO: 2974 - DNA, 32 bp, Homo sapiens
gagcccaggaggcagaggttgcagtgagccaa

SEQ ID NO: 2975 - DNA, 32 bp, Homo sapiens
gaacccaggaggcagaggttgcagtgggccaa

SEQ ID NO: 2976 - DNA, 32 bp, Homo sapiens
gagcctgggaggcagaggttgcagtgagctga

SEQ ID NO: 2977 - DNA, 28 bp, Homo sapiens
tttccaaggtctgctgccttcatctatg

SEQ ID NO: 2978 - DNA, 32 bp, Homo sapiens
gaccttcctagagtgtttggtcgggttcacag

SEQ ID NO: 2979 - DNA, 32 bp, Homo sapiens
tgagtcaggaggttgaggctgcagtgagctat

SEQ ID NO: 2980 - DNA, 25 bp, Homo sapiens
acaggcatgcaccaccacgcctggc

SEQ ID NO: 2981 - DNA, 32 bp, Homo sapiens
ccttggggatctgggagctgagcacttgtcta

SEQ ID NO: 2982 - DNA, 32 bp, Homo sapiens
accccgcccacaacagggagttaaactggagg

SEQ ID NO: 2983 - DNA, 32 bp, Homo sapiens
acgcgctgtcctggctggaggaggtggagcag

SEQ ID NO: 2984 - DNA, 32 bp, Homo sapiens
ggagcctatcctgaattttgtaaaatatccca

SEQ ID NO: 2985 - DNA, 32 bp, Homo sapiens
gcttagccgtccaggctagagtgcagtagtgc

SEQ ID NO: 2986 - DNA, 32 bp, Homo sapiens
atgggaacaagtgccctcagcaagaagccgtg

SEQ ID NO: 2987 - DNA, 32 bp, Homo sapiens
gaaccttggaggcagaggttgcagtgagctga

SEQ ID NO: 2988 - DNA, 32 bp, Homo sapiens
ccgggcaggcctcctgggttgcagggacttga

SEQ ID NO: 2989 - DNA, 32 bp, Homo sapiens
agcctccaaagtagctgggattacaggcatgc

SEQ ID NO: 2990 - DNA, 32 bp, Homo sapiens
caagtgtgtaccaccatgcctggctgaacact

SEQ ID NO: 2991 - DNA, 28 bp, Homo sapiens
actcgtccccctcctgcctcatcttcct

SEQ ID NO: 2992 - DNA, 32 bp, Homo sapiens
ggtttcagtcatctccccatttggtcccctgg

SEQ ID NO: 2993 - DNA, 32 bp, Homo sapiens
gaaccacatcttcttcagggatcgatatggag

SEQ ID NO: 2994 - DNA, 31 bp, Homo sapiens
agagagtggagaggagagagagcaaatattg

SEQ ID NO: 2995 - DNA, 32 bp, Homo sapiens
atgctgtgagaaatctctcttgttgctgtcct

SEQ ID NO: 2996 - DNA, 23 bp, Homo sapiens
tggtacaatctggctcactgcag

SEQ ID NO: 2997 - DNA, 32 bp, Homo sapiens
acgtgtgtgctgcgtgcttcacatcctctatt

SEQ ID NO: 2998 - DNA, 32 bp, Homo sapiens
ccatgggtccggcagagggcagtgaccggcac

SEQ ID NO: 2999 - DNA, 32 bp, Homo sapiens
gtgcccaggaagaggaagtagtgtacgataca

SEQ ID NO: 3000 - DNA, 32 bp, Homo sapiens
tgagcgctgtgagatggatgtatttgtagcca

SEQ ID NO: 3001 - DNA, 32 bp, Homo sapiens
gaggatgacctgcaccgtgtgcctttaatgca

SEQ ID NO: 3002 - DNA, 32 bp, Homo sapiens
ttaaatccaactcaactttataagctaaggaa

SEQ ID NO: 3003 - DNA, 32 bp, Homo sapiens
tgacaatctgcaaggctgaacaacagcccctg

SEQ ID NO: 3004 - DNA, 32 bp, Homo sapiens
gcccagggcccagcagggggcagtggcacctg

SEQ ID NO: 3005 - DNA, 21 bp, Homo sapiens
tcatgcctataatcccaacac

SEQ ID NO: 3006 - DNA, 22 bp, Homo sapiens
ggtgccacaggcagccctggga

SEQ ID NO: 3007 - DNA, 32 bp, Homo sapiens
gcactgtcacccaggctggagtgcagtggcgc

SEQ ID NO: 3008 - DNA, 32 bp, Homo sapiens
cctttgtcagccaggctggagtgcaatgtgca

SEQ ID NO: 3009 - DNA, 32 bp, Homo sapiens
gcaagcaagcctgagaggcattacatgggctg

SEQ ID NO: 3010 - DNA, 32 bp, Homo sapiens
tcttattgcccaggctagagtgcaatggtgcg

SEQ ID NO: 3011 - DNA, 32 bp, Homo sapiens
acactgttgcccaggctggagtgcagtggcgt

SEQ ID NO: 3012 - DNA, 32 bp, Homo sapiens
agctttcttctccaccaccaccaccttccttc

SEQ ID NO: 3013 - DNA, 32 bp, Homo sapiens
ctggcctcaagcaatccgcctacctcagcctc

SEQ ID NO: 3014 - DNA, 32 bp, Homo sapiens
caaggtgaggccttgagctctttgtttttata

SEQ ID NO: 3015 - DNA, 24 bp, Homo sapiens
gttgatgccttgcagggcattctt

SEQ ID NO: 3016 - DNA, 32 bp, Homo sapiens
acaggtgcagaaggtgcaggtgcagtgggtac

SEQ ID NO: 3017 - DNA, 32 bp, Homo sapiens
agtctcttacccaggctagggtgcagtggtgt

SEQ ID NO: 3018 - DNA, 32 bp, Homo sapiens
ctggagtgggtagaggaaagggctagggtgac

SEQ ID NO: 3019 - DNA, 32 bp, Homo sapiens
ggggctcagattggcacagaattcttttgtga

SEQ ID NO: 3020 - DNA, 32 bp, Homo sapiens
tgcctagtgctacaaaccttcctgtgggactc

SEQ ID NO: 3021 - DNA, 32 bp, Homo sapiens
attctgtcatcaaatcctgtgctgctgttcct

SEQ ID NO: 3022 - DNA, 32 bp, Homo sapiens
cagaattcttcaccttctcttcccctttccat

SEQ ID NO: 3023 - DNA, 18 bp, Homo sapiens
cctgtaatccagcacttt

SEQ ID NO: 3024 - DNA, 24 bp, Homo sapiens
tcatgcctgtaattctagcacttt

SEQ ID NO: 3025 - DNA, 32 bp, Homo sapiens
ctacttgagaggcagaggcaggagaatcgctt

SEQ ID NO: 3026 - DNA, 32 bp, Homo sapiens
cttttaccgcccaggctggagtgcagtgccat

SEQ ID NO: 3027 - DNA, 32 bp, Homo sapiens
cttggttcgcccggttttctgttttcagtaaa

SEQ ID NO: 3028 - DNA, 32 bp, Homo sapiens
agcctcctgagtagctgggattacaggtgccc

SEQ ID NO: 3029 - DNA, 32 bp, Homo sapiens
agcttcccgagtagctgggattacaggcgcct

SEQ ID NO: 3030 - DNA, 32 bp, Homo sapiens
cttcagccttcccaggttcaagcaattctcct

SEQ ID NO: 3031 - DNA, 24 bp, Homo sapiens
tcacacctgtagtcccagcacttt

SEQ ID NO: 3032 - DNA, 32 bp, Homo sapiens
agcctcccgagtagctgggattacaggtgcct

SEQ ID NO: 3033 - DNA, 32 bp, Homo sapiens
ggcctcccaagtagctgggattacaggtgcct

SEQ ID NO: 3034 - DNA, 32 bp, Homo sapiens
tcatcagaggcagccttccaggcacagctctg

SEQ ID NO: 3035 - DNA, 32 bp, Homo sapiens
cgccccacctgtgtccccatctcggccggccc

SEQ ID NO: 3036 - DNA, 24 bp, Homo sapiens
tcacacctgtaatcccagcgcttt

SEQ ID NO: 3037 - DNA, 32 bp, Homo sapiens
gctctgtcacccaggctggagtgcagtggctt

SEQ ID NO: 3038 - DNA, 32 bp, Homo sapiens
actctgttgcccagtctggagtgcagtggcgc

SEQ ID NO: 3039 - DNA, 32 bp, Homo sapiens
tccagaagatgccagcttctctctccagggtg

SEQ ID NO: 3040 - DNA, 32 bp, Homo sapiens
ttcattcattattacctgacagtattaaacta

SEQ ID NO: 3041 - DNA, 32 bp, Homo sapiens
agcctcccaagtagctgggaccacacgcatgc

SEQ ID NO: 3042 - DNA, 32 bp, Homo sapiens
ccaggacctcgctttccatctgttcttgttgc

SEQ ID NO: 3043 - DNA, 32 bp, Homo sapiens
gcttccagccctacattgaaccaccttctttc

SEQ ID NO: 3044 - DNA, 32 bp, Homo sapiens
cgtctcagaaaaaggaaaagaaaaacaatcta

SEQ ID NO: 3045 - DNA, 32 bp, Homo sapiens
acactgagaccagaaaagatggtgctatgctt

SEQ ID NO: 3046 - DNA, 32 bp, Homo sapiens
agcccagttgtcctcgcccacagggtcctgca

SEQ ID NO: 3047 - DNA, 32 bp, Homo sapiens
ccaatgtcctgagacatgaacccaaaaagaga

SEQ ID NO: 3048 - DNA, 32 bp, Homo sapiens
gcaacatttcttcaattagcagtctagacatt

SEQ ID NO: 3049 - DNA, 32 bp, Homo sapiens
gctctcttgcccagactggaatacagtggtgt

SEQ ID NO: 3050 - DNA, 32 bp, Homo sapiens
gctctgtcgcccacgttggagtgcagtgatgt

SEQ ID NO: 3051 - DNA, 32 bp, Homo sapiens
gagcccaagaggttgaggctgcagtgagccat

SEQ ID NO: 3052 - DNA, 32 bp, Homo sapiens
ctaccctggtgggatggatggttctgtaaatg

SEQ ID NO: 3053 - DNA, 32 bp, Homo sapiens
cctggagcctccactgcctctggaattgctca

SEQ ID NO: 3054 - DNA, 32 bp, Homo sapiens
cctcagccaagtgctttggcccggtgcttccc

SEQ ID NO: 3055 - DNA, 32 bp, Homo sapiens
gagcctgtgaggtcgaggctgcagtgagccga

SEQ ID NO: 3056 - DNA, 32 bp, Homo sapiens
aggatggggaggcagggctgggggctttgagg

SEQ ID NO: 3057 - DNA, 32 bp, Homo sapiens
tcttgggagccagcggtatggcgtcgggctgc

SEQ ID NO: 3058 - DNA, 32 bp, Homo sapiens
aacaagcagctttcccaaagcgatacacttgc

SEQ ID NO: 3059 - DNA, 32 bp, Homo sapiens
ttttaaggttggcttcagaggtgcaagtatat

SEQ ID NO: 3060 - DNA, 32 bp, Homo sapiens
aacctctgcctccgggttcaagcaattctcct

SEQ ID NO: 3061 - DNA, 32 bp, Homo sapiens
ctttaactgcacctgaatcctttgtgtactga

SEQ ID NO: 3062 - DNA, 28 bp, Homo sapiens
catatgctcttcctgaatcttgccactg

SEQ ID NO: 3063 - DNA, 24 bp, Homo sapiens
ctgtggcccctggacgggtacaat

SEQ ID NO: 3064 - DNA, 32 bp, Homo sapiens
agcctcctgggtagctgggactacaggcttgc

SEQ ID NO: 3065 - DNA, 32 bp, Homo sapiens
ggatgccatacaacaggactatgtgatgattt

SEQ ID NO: 3066 - DNA, 24 bp, Homo sapiens
ctgtcacccaggctagagtgcaat

SEQ ID NO: 3067 - DNA, 32 bp, Homo sapiens
aagtgaagaggaggagaaagagtcaaccaagg

SEQ ID NO: 3068 - DNA, 32 bp, Homo sapiens
ggcaaggtaggaacaagatgagcttgaaatat

SEQ ID NO: 3069 - DNA, 32 bp, Homo sapiens
atgccaaggggagaacaatgagctgaaattgt

SEQ ID NO: 3070 - DNA, 32 bp, Homo sapiens
tattctgatctttggcttactactccattgca

SEQ ID NO: 3071 - DNA, 32 bp, Homo sapiens
ctccatcgtccaggctggagtgcagtggcgcg

SEQ ID NO: 3072 - DNA, 32 bp, Homo sapiens
ctagttcctccaattccatcttctcccatgga

SEQ ID NO: 3073 - DNA, 32 bp, Homo sapiens
atggagaggttagtgtgatgaggtggtgtctg

SEQ ID NO: 3074 - DNA, 32 bp, Homo sapiens
aaaaccccaagtgcctggagacccgagcccca

SEQ ID NO: 3075 - DNA, 32 bp, Homo sapiens
ctcctggagtgagtgaggattcaatgagatat

SEQ ID NO: 3076 - DNA, 32 bp, Homo sapiens
gaacctgtgaggtggagcttgcagtgagccaa

SEQ ID NO: 3077 - DNA, 32 bp, Homo sapiens
tcatcttcaagcacgccaacttcaggcagtgt

SEQ ID NO: 3078 - DNA, 32 bp, Homo sapiens
agcgttctgagtagctgggattagaggcgtgt

SEQ ID NO: 3079 - DNA, 32 bp, Homo sapiens
ctcagcctgagtagctgggatgggactacaga

SEQ ID NO: 3080 - DNA, 32 bp, Homo sapiens
tggggagtgatctcttggacacagagccccca

SEQ ID NO: 3081 - DNA, 32 bp, Homo sapiens
tgatgaggaagaggataaaatggaagatcaaa

SEQ ID NO: 3082 - DNA, 32 bp, Homo sapiens
aattttagaagaggaagtacagaattcagttt

SEQ ID NO: 3083 - DNA, 32 bp, Homo sapiens
tatatccccagcacctaaaacagggtcacaca

SEQ ID NO: 3084 - DNA, 32 bp, Homo sapiens
tatcatcctcaaggacattactagtgactcag

SEQ ID NO: 3085 - DNA, 32 bp, Homo sapiens
taggtttttggagcttctctgcttcatgtctt

SEQ ID NO: 3086 - DNA, 15 bp, Homo sapiens
ggcccaggcgggcac

SEQ ID NO: 3087 - DNA, 32 bp, Homo sapiens
gtagggacggggtctcgttttgttgccaaagc

SEQ ID NO: 3088 - DNA, 26 bp, Homo sapiens
tccaggcttcatcctagagactgtca

SEQ ID NO: 3089 - DNA, 32 bp, Homo sapiens
gataaaaacacccagctgggtgcagtggctcg

SEQ ID NO: 3090 - DNA, 28 bp, Homo sapiens
ggaaaagcagctgctgcctctctcctgg

SEQ ID NO: 3091 - DNA, 32 bp, Homo sapiens
aataaccggaggcaggctgggtgcagtggctc

SEQ ID NO: 3092 - DNA, 32 bp, Homo sapiens
gaacccgggaggcggaggttgcagtgaggtaa

SEQ ID NO: 3093 - DNA, 18 bp, Homo sapiens
gcccctgcccatgtacag

SEQ ID NO: 3094 - DNA, 32 bp, Homo sapiens
aaaaagaagagaagagaaagaagaaacaatgc

SEQ ID NO: 3095 - DNA, 32 bp, Homo sapiens
atgagctcaagtgatcctcccacctcagccta

SEQ ID NO: 3096 - DNA, 18 bp, Homo sapiens
cccaggctggagtgcagt

SEQ ID NO: 3097 - DNA, 32 bp, Homo sapiens
ctactctcagctgcctatcttctgcctttcac

SEQ ID NO: 3098 - DNA, 32 bp, Homo sapiens
ctcttgcatcttcttccactgggctctggatt

SEQ ID NO: 3099 - DNA, 21 bp, Homo sapiens
gccagttagttctcagctgag

SEQ ID NO: 3100 - DNA, 32 bp, Homo sapiens
gaatggtgcctgctgctcagggctcgcccccg

SEQ ID NO: 3101 - DNA, 32 bp, Homo sapiens
tggtgtcacccaggctggagtgcagtggtgtg

SEQ ID NO: 3102 - DNA, 32 bp, Homo sapiens
gctctgttgcccaggctggagtgcagtggcgt

SEQ ID NO: 3103 - DNA, 32 bp, Homo sapiens
actctgtcacccaggctggagtacagtggcac

SEQ ID NO: 3104 - DNA, 32 bp, Homo sapiens
caattcatcagtttctgagaccacagaatcag

SEQ ID NO: 3105 - DNA, 32 bp, Homo sapiens
actctgtcacccagactggagtgcagtggcac

SEQ ID NO: 3106 - DNA, 32 bp, Homo sapiens
actctgtcacccaggctggagtgcagtggcgc

SEQ ID NO: 3107 - DNA, 32 bp, Homo sapiens
gctctgtcgcccaggttggagtgcagtggcgt

SEQ ID NO: 3108 - DNA, 32 bp, Homo sapiens
aatcagagagagctcgactcactgtgggtcag

SEQ ID NO: 3109 - DNA, 32 bp, Homo sapiens
gctctgtcgcccaggctggagtgcagtggcgc

SEQ ID NO: 3110 - DNA, 32 bp, Homo sapiens
gctctgtcacccaggctggagtgcggtggcgc

SEQ ID NO: 3111 - DNA, 32 bp, Homo sapiens
tcctgttacccaggctggaggacagtgatgtg

SEQ ID NO: 3112 - DNA, 32 bp, Homo sapiens
gtcttcagtgttcttcagggtagttgggatct

SEQ ID NO: 3113 - DNA, 32 bp, Homo sapiens
gctcatgatgttctttctggaggttcaacact

SEQ ID NO: 3114 - DNA, 32 bp, Homo sapiens
taatcactcagtgcccttagctagcctgacta

SEQ ID NO: 3115 - DNA, 32 bp, Homo sapiens
tttaatcagtgtagctatgtgctgctgctgct

SEQ ID NO: 3116 - DNA, 32 bp, Homo sapiens
ctctgttgcccacgcaggagtgcagtggcatg

SEQ ID NO: 3117 - DNA, 32 bp, Homo sapiens
ccaggcttaagcaattctcctgcctcagcctc

SEQ ID NO: 3118 - DNA, 32 bp, Homo sapiens
cccccagaggccaggagctctgcccttgacct

SEQ ID NO: 3119 - DNA, 28 bp, Homo sapiens
actaggagcagggctgcctcttctccct

SEQ ID NO: 3120 - DNA, 32 bp, Homo sapiens
ggtcgcggaagaggaggctgagagggtcaaaa

SEQ ID NO: 3121 - DNA, 32 bp, Homo sapiens
agctcaccacccagaatgatgcagtcagcctc

SEQ ID NO: 3122 - DNA, 32 bp, Homo sapiens
ctgacctgaggcgatctgcccacctcggcctc

SEQ ID NO: 3123 - DNA, 23 bp, Homo sapiens
gggcctccgggactccccccgca

SEQ ID NO: 3124 - DNA, 18 bp, Homo sapiens
gccaaccgccacccagag

SEQ ID NO: 3125 - DNA, 32 bp, Homo sapiens
gtcagtaatttccaatgggcgggaggcattaa

SEQ ID NO: 3126 - DNA, 21 bp, Homo sapiens
cagggcttccctctccagccc

SEQ ID NO: 3127 - DNA, 23 bp, Homo sapiens
tggcaagatcttggctcactgca

SEQ ID NO: 3128 - DNA, 32 bp, Homo sapiens
tccattgtgctgccgccctccgcgctctccag

SEQ ID NO: 3129 - DNA, 32 bp, Homo sapiens
gaggtaattatagggattttagcaataacatt

SEQ ID NO: 3130 - DNA, 32 bp, Homo sapiens
tctcactatgttgtctggagtgctgtggtgga

SEQ ID NO: 3131 - DNA, 32 bp, Homo sapiens
ggacccaggaggcagagcttgcagtgagccga

SEQ ID NO: 3132 - DNA, 32 bp, Homo sapiens
gaacctggcaggcagaggttgcagtgagccaa

SEQ ID NO: 3133 - DNA, 32 bp, Homo sapiens
ggttcctagaggcagaggttgaagatggaaga

SEQ ID NO: 3134 - DNA, 32 bp, Homo sapiens
tgtgcaagtcaggcccttctggaacacagcag

SEQ ID NO: 3135 - DNA, 28 bp, Homo sapiens
agcccaggtcctgctgcctctctttcac

SEQ ID NO: 3136 - DNA, 32 bp, Homo sapiens
caacctgggaggcagaggttgcagtgagccaa

SEQ ID NO: 3137 - DNA, 32 bp, Homo sapiens
gtaacctctgcagacttaagtgtccctgtctg

SEQ ID NO: 3138 - DNA, 32 bp, Homo sapiens
tcatcagcaacaacaaaacctgatattccaag

SEQ ID NO: 3139 - DNA, 32 bp, Homo sapiens
cactgtggtgccctctgctccctggagctctt

SEQ ID NO: 3140 - DNA, 23 bp, Homo sapiens
tggcgtgatctcggctcaccgca

SEQ ID NO: 3141 - DNA, 23 bp, Homo sapiens
tggcgtgatcttggctcactgca

SEQ ID NO: 3142 - DNA, 32 bp, Homo sapiens
gttttccccaaaacatatcagtttgaatactt

SEQ ID NO: 3143 - DNA, 22 bp, Homo sapiens
tgatgagggccatgtagttctt

SEQ ID NO: 3144 - DNA, 32 bp, Homo sapiens
ccgctgggctggagaagccactgtgggcacca

SEQ ID NO: 3145 - DNA, 32 bp, Homo sapiens
agccagcacatcctgcctgctgttgcagcctg

SEQ ID NO: 3146 - DNA, 32 bp, Homo sapiens
ctatattgcccaggctggtcttgaagtcctgg

SEQ ID NO: 3147 - DNA, 32 bp, Homo sapiens
tttctggatcctaggcttatctccacagagga

SEQ ID NO: 3148 - DNA, 28 bp, Homo sapiens
cttcaactgagtgctgcacatcatgggc

SEQ ID NO: 3149 - DNA, 32 bp, Homo sapiens
cagatgagcctactgcctcacaacagcctcca

SEQ ID NO: 3150 - DNA, 32 bp, Homo sapiens
ctttgtcacccaggccggagtgcagtggcatg

SEQ ID NO: 3151 - DNA, 32 bp, Homo sapiens
gagaagaagagaaagaaaagaaaaagaaaaag

SEQ ID NO: 3152 - DNA, 32 bp, Homo sapiens
ctgatttcaggcgatccacccacctcgacttc

SEQ ID NO: 3153 - DNA, 32 bp, Homo sapiens
tcgggttcaagcaattctcctgcatcagcctc

SEQ ID NO: 3154 - DNA, 32 bp, Homo sapiens
tacagttagctgtcactcagctgacaccatga

SEQ ID NO: 3155 - DNA, 32 bp, Homo sapiens
ctagccccatccctccccatgaggggccaaga

SEQ ID NO: 3156 - DNA, 24 bp, Homo sapiens
tcatgcctatcatcccagcacttt

SEQ ID NO: 3157 - DNA, 32 bp, Homo sapiens
gcctgggaacaacagtcattcttcctctttgt

SEQ ID NO: 3158 - DNA, 32 bp, Homo sapiens
agcctccagagtatctgggattacatatgtcg

SEQ ID NO: 3159 - DNA, 32 bp, Homo sapiens
ctctttcgcccaggctggagtgcaatggtgtg

SEQ ID NO: 3160 - DNA, 32 bp, Homo sapiens
tatgctgcatttggctggagcccggtgttcag

SEQ ID NO: 3161 - DNA, 32 bp, Homo sapiens
ctgagctcagatgatctgcccacctcggcctc

SEQ ID NO: 3162 - DNA, 32 bp, Homo sapiens
tccagcctcacaaaaggattctttcaacttct

SEQ ID NO: 3163 - DNA, 24 bp, Homo sapiens
ctgtcaaccaggccagagtgcagt

SEQ ID NO: 3164 - DNA, 32 bp, Homo sapiens
ctcagccctcctggcccttcagtcttggtgcc

SEQ ID NO: 3165 - DNA, 23 bp, Homo sapiens
tcatgcctgtaaccctggcactt

SEQ ID NO: 3166 - DNA, 32 bp, Homo sapiens
ttctttgcaggaggagaagagaaggggtgcaa

SEQ ID NO: 3167 - DNA, 32 bp, Homo sapiens
tgaatctgtccctcgtgacaattataggagga

SEQ ID NO: 3168 - DNA, 22 bp, Homo sapiens
ctcctcgagtaaatccatgtga

SEQ ID NO: 3169 - DNA, 32 bp, Homo sapiens
atctgttacccaggctggagtgcagtggcatg

SEQ ID NO: 3170 - DNA, 32 bp, Homo sapiens
cataaatatgttctttactgagggagcttaga

SEQ ID NO: 3171 - DNA, 32 bp, Homo sapiens
ccagcagcctccacagcctttatctcaacagc

SEQ ID NO: 3172 - DNA, 32 bp, Homo sapiens
attctgtcactcaggctagagtgcagtggcat

SEQ ID NO: 3173 - DNA, 32 bp, Homo sapiens
gatctggagcccacctgctttgaaagaaatga

SEQ ID NO: 3174 - DNA, 32 bp, Homo sapiens
tattgatgtaagggtttcctggacactcatga

SEQ ID NO: 3175 - DNA, 32 bp, Homo sapiens
caacctggatggagttggagatcattattcta

SEQ ID NO: 3176 - DNA, 32 bp, Homo sapiens
cctcatccacccctccccatctggaccataat

SEQ ID NO: 3177 - DNA, 32 bp, Homo sapiens
tttctagcatctctccccaccctctgagagct

SEQ ID NO: 3178 - DNA, 32 bp, Homo sapiens
cgcgcagtccgcgaggtccccacgccgggcga

SEQ ID NO: 3179 - DNA, 32 bp, Homo sapiens
cccaggactctggcttctctcctcagacttct

SEQ ID NO: 3180 - DNA, 32 bp, Homo sapiens
ggtttttctgcagctattttctagcatttgcc

SEQ ID NO: 3181 - DNA, 32 bp, Homo sapiens
cctttgcatgttccatctcttctctttctccc

SEQ ID NO: 3182 - DNA, 32 bp, Homo sapiens
ctttgttgcccaggctggagtgcggtggtgca

SEQ ID NO: 3183 - DNA, 32 bp, Homo sapiens
ctttgtcgcccaggctggagtgcagtggtgtg

SEQ ID NO: 3184 - DNA, 32 bp, Homo sapiens
actgataatcagctttattttacaaaagagtt

SEQ ID NO: 3185 - DNA, 32 bp, Homo sapiens
acctccgcctcctgggttcaagcgattctcct

SEQ ID NO: 3186 - DNA, 32 bp, Homo sapiens
gaggccaggaggttgaggctgcagtgagctgt

SEQ ID NO: 3187 - DNA, 32 bp, Homo sapiens
ctttgtcacccaggctggagtgctgtggtgtt

SEQ ID NO: 3188 - DNA, 32 bp, Homo sapiens
ctgacctcaggcaatccacccacctcagcctc

SEQ ID NO: 3189 - DNA, 32 bp, Homo sapiens
gccaggacaaggcagctcctggaagctccacc

SEQ ID NO: 3190 - DNA, 32 bp, Homo sapiens
gtctcaaactcctgggttcaagcagtcctccc

SEQ ID NO: 3191 - DNA, 32 bp, Homo sapiens
aacgaccctggccttgaacgtcagagccgggg

SEQ ID NO: 3192 - DNA, 32 bp, Homo sapiens
agatgctttccaacatgacacctgaacatctt

SEQ ID NO: 3193 - DNA, 32 bp, Homo sapiens
actttgctaggagatactcttctgcctcctag

SEQ ID NO: 3194 - DNA, 32 bp, Homo sapiens
aaaatgctcagaatttcacactgtgaatccac

SEQ ID NO: 3195 - DNA, 32 bp, Homo sapiens
atgctcggcctgctgctgctctgcacccccag

SEQ ID NO: 3196 - DNA, 32 bp, Homo sapiens
ccccaccccctctcttttccattgaacaaaca

SEQ ID NO: 3197 - DNA, 32 bp, Homo sapiens
tatcaaagtgttcttcctcctgtcagttcagt

SEQ ID NO: 3198 - DNA, 32 bp, Homo sapiens
taaaggaaagagatgtggcttttgtgatattc

SEQ ID NO: 3199 - DNA, 32 bp, Homo sapiens
ctctgtcacccaggctggagtgcagtggcttg

SEQ ID NO: 3200 - DNA, 32 bp, Homo sapiens
ctctgttgcccagtctggagtgcagtggcgca

SEQ ID NO: 3201 - DNA, 32 bp, Homo sapiens
tcatataagacagatggatgatctgtgaacat

SEQ ID NO: 3202 - DNA, 32 bp, Homo sapiens
tctgtgagacatggctcgctgtggggaaggca

SEQ ID NO: 3203 - DNA, 32 bp, Homo sapiens
ccctctcaggcagagaggttgccgagtgattc

SEQ ID NO: 3204 - DNA, 32 bp, Homo sapiens
gtggctgtgggacagaggttggaaggaaagga

SEQ ID NO: 3205 - DNA, 32 bp, Homo sapiens
ctttcctcaagcaatcctcccaccttggcctc

SEQ ID NO: 3206 - DNA, 32 bp, Homo sapiens
cttaagaagggacggggccccacgctgcgcac

SEQ ID NO: 3207 - DNA, 32 bp, Homo sapiens
attctggggagagcagccttgtggaaattgat

SEQ ID NO: 3208 - DNA, 32 bp, Homo sapiens
tgagcatttaaaacatgaaaacactcttgttt

SEQ ID NO: 3209 - DNA, 24 bp, Homo sapiens
tcacacctggaatcccagcatttt

SEQ ID NO: 3210 - DNA, 32 bp, Homo sapiens
ggggagggaagaggaggagaggggaggggacc

SEQ ID NO: 3211 - DNA, 32 bp, Homo sapiens
ctctgtcacccgggctggagtgtaacgtggca

SEQ ID NO: 3212 - DNA, 32 bp, Homo sapiens
aggcctccactccttccatctcttccttcaga

SEQ ID NO: 3213 - DNA, 32 bp, Homo sapiens
tccctaatttcccagtccttgtcttgaacaat

SEQ ID NO: 3214 - DNA, 28 bp, Homo sapiens
ctgctccaggaagctgcctcctctgggc

SEQ ID NO: 3215 - DNA, 32 bp, Homo sapiens
aaccccagacctgcccttacagtagtgtagcg

SEQ ID NO: 3216 - DNA, 32 bp, Homo sapiens
cagtactaggagcattggttgcagtggaggag

SEQ ID NO: 3217 - DNA, 32 bp, Homo sapiens
gggaggaaaagaggaggagacggaggagaact

SEQ ID NO: 3218 - DNA, 32 bp, Homo sapiens
tttagagaactggtatagctgtggagagggag

SEQ ID NO: 3219 - DNA, 32 bp, Homo sapiens
cagtacaccagcagaggaaacttataacctcg

SEQ ID NO: 3220 - DNA, 32 bp, Homo sapiens
tggatgagagcctctttggagatatcaagtcc

SEQ ID NO: 3221 - DNA, 32 bp, Homo sapiens
gatgctcagactccctgataccacctttcctg

SEQ ID NO: 3222 - DNA, 32 bp, Homo sapiens
taaaacatgcttcagaagaactggcacccctt

SEQ ID NO: 3223 - DNA, 25 bp, Homo sapiens
acaggcgtgagccaccacacctggc

SEQ ID NO: 3224 - DNA, 25 bp, Homo sapiens
acaggtgtgagccaccacacccggc

SEQ ID NO: 3225 - DNA, 32 bp, Homo sapiens
tcgaagtccctctcttttgccaaccctcattt

SEQ ID NO: 3226 - DNA, 18 bp, Homo sapiens
gaagaaatggcggccttg

SEQ ID NO: 3227 - DNA, 23 bp, Homo sapiens
tggctcaatctcggctcactgca

SEQ ID NO: 3228 - DNA, 24 bp, Homo sapiens
acaggcgccagccaccatgcctgg

SEQ ID NO: 3229 - DNA, 32 bp, Homo sapiens
ttatcaaatgttccttcagccctgcagttgcc

SEQ ID NO: 3230 - DNA, 32 bp, Homo sapiens
ctcttgttgctgaggctggagtgcagtggcac

SEQ ID NO: 3231 - DNA, 32 bp, Homo sapiens
ctcttcttcccatgctggagtgcaatggcgca

SEQ ID NO: 3232 - DNA, 32 bp, Homo sapiens
tcttgtcgcccaggctggagtgcaatggcgtg

SEQ ID NO: 3233 - DNA, 32 bp, Homo sapiens
ttttgttgcccaggctggagtgcaacggcgcg

SEQ ID NO: 3234 - DNA, 32 bp, Homo sapiens
acctctgcctcctgggttcaggcaattctccc

SEQ ID NO: 3235 - DNA, 32 bp, Homo sapiens
ctactcgggaggcggaggcaggagaatcactt

SEQ ID NO: 3236 - DNA, 32 bp, Homo sapiens
tcttgttgcccaggctggagtgcaatggcgcg

SEQ ID NO: 3237 - DNA, 32 bp, Homo sapiens
agagctgttctgtcttctcttctgtctcttct

SEQ ID NO: 3238 - DNA, 32 bp, Homo sapiens
gttacagcatcagtccttgcagtattaaaaac

SEQ ID NO: 3239 - DNA, 32 bp, Homo sapiens
cccgtgtactccacctgccccaggagctggag

SEQ ID NO: 3240 - DNA, 32 bp, Homo sapiens
tttggagacagttttgctcttgtctccccggc

SEQ ID NO: 3241 - DNA, 18 bp, Homo sapiens
gccccttgcctcccagaa

SEQ ID NO: 3242 - DNA, 32 bp, Homo sapiens
gcacagtctgcagcttcctgagtcctgttctg

SEQ ID NO: 3243 - DNA, 32 bp, Homo sapiens
attctgtcactcaggctggagtgcagtggcgt

SEQ ID NO: 3244 - DNA, 32 bp, Homo sapiens
ctcttgttgcctagctggagtgcaatggcgca

SEQ ID NO: 3245 - DNA, 32 bp, Homo sapiens
attgtttacatcctgagactgttctacagttt

SEQ ID NO: 3246 - DNA, 32 bp, Homo sapiens
agaatttgaggaactggatgtgactgtcattg

SEQ ID NO: 3247 - DNA, 32 bp, Homo sapiens
cagactcgagcagtctctggaacacgctgcgg

SEQ ID NO: 3248 - DNA, 32 bp, Homo sapiens
gccttgaattcctgggcccaagcaattctccc

SEQ ID NO: 3249 - DNA, 32 bp, Homo sapiens
tctctgtcgccaggctggaatgcagtgcagtg

SEQ ID NO: 3250 - DNA, 32 bp, Homo sapiens
tgaggaaggagaggagagggtggcaatgatgc

SEQ ID NO: 3251 - DNA, 32 bp, Homo sapiens
tggatttcacccaggaggagtggcggcaactg

SEQ ID NO: 3252 - DNA, 32 bp, Homo sapiens
ctgacctccggtgatctgcccacctcagtctc

SEQ ID NO: 3253 - DNA, 32 bp, Homo sapiens
acctggattctgagtttttcagtctagcccag

SEQ ID NO: 3254 - DNA, 32 bp, Homo sapiens
agcattacacttctcccagtggagcccatgac

SEQ ID NO: 3255 - DNA, 19 bp, Homo sapiens
cctgtaatcccagctcttt

SEQ ID NO: 3256 - DNA, 32 bp, Homo sapiens
aacctagatccctcgcatgcgcagttcacaat

SEQ ID NO: 3257 - DNA, 32 bp, Homo sapiens
accaaagagccctctttccacgagactgaagt

SEQ ID NO: 3258 - DNA, 32 bp, Homo sapiens
aagtcagcctgaggatttagcccagaggtgat

SEQ ID NO: 3259 - DNA, 32 bp, Homo sapiens
gctctgtcccccaggctggagtgcagtggctc

SEQ ID NO: 3260 - DNA, 32 bp, Homo sapiens
ctcagctgcccaggctggagtgtggtggcgcc

SEQ ID NO: 3261 - DNA, 32 bp, Homo sapiens
gcacggggcccaggctagagtgcagtggcgtg

SEQ ID NO: 3262 - DNA, 32 bp, Homo sapiens
agctactgcccagggcccgcagtgttggctgc

SEQ ID NO: 3263 - DNA, 32 bp, Homo sapiens
ccacaagtcctagtgaggaaacatgttgggaa

SEQ ID NO: 3264 - DNA, 32 bp, Homo sapiens
gaacccaggaggcggaggctgcagtgagctga

SEQ ID NO: 3265 - DNA, 32 bp, Homo sapiens
gaacccgggaggtggaggctgcagtgagttaa

SEQ ID NO: 3266 - DNA, 32 bp, Homo sapiens
tcttggagaagagggaggaataggagcaaatc

SEQ ID NO: 3267 - DNA, 32 bp, Homo sapiens
cttagaccacccagactagtcaagtatcttct

SEQ ID NO: 3268 - DNA, 32 bp, Homo sapiens
ctttcaaacttgattcaaatgatgttagtgaa

SEQ ID NO: 3269 - DNA, 32 bp, Homo sapiens
tagagatggagttttactatgttggccaggct

SEQ ID NO: 3270 - DNA, 32 bp, Homo sapiens
tttggtactcttaaagcttcagtggcctagca

SEQ ID NO: 3271 - DNA, 32 bp, Homo sapiens
atgtggcttctctgtctctgtggaaaagccat

SEQ ID NO: 3272 - DNA, 32 bp, Homo sapiens
agtctgaatgttctttgaaaataactggagtt

SEQ ID NO: 3273 - DNA, 32 bp, Homo sapiens
agcccttttagattttggcactgtgaaacccc

SEQ ID NO: 3274 - DNA, 32 bp, Homo sapiens
tacatttgtaagaaataacactgtgaatgtaa

SEQ ID NO: 3275 - DNA, 32 bp, Homo sapiens
ttccgagggaggcaggggacggccagcggcag

SEQ ID NO: 3276 - DNA, 32 bp, Homo sapiens
acgtgcatactcctgaatcggatgtaaatgca

SEQ ID NO: 3277 - DNA, 32 bp, Homo sapiens
atgctggcttggaggccgggtgcagtggctca

SEQ ID NO: 3278 - DNA, 32 bp, Homo sapiens
cccagttcaagcaattcttctgcctcagcctc

SEQ ID NO: 3279 - DNA, 32 bp, Homo sapiens
agggagtttaatacaggaaattgacttacata

SEQ ID NO: 3280 - DNA, 32 bp, Homo sapiens
tttctggcgtgagtcaacagatcatgtagata

SEQ ID NO: 3281 - DNA, 32 bp, Homo sapiens
tccccatctcttctcctttgtacctgtcaaca

SEQ ID NO: 3282 - DNA, 16 bp, Homo sapiens
aggagcattgcttgaa

SEQ ID NO: 3283 - DNA, 32 bp, Homo sapiens
ggggaaggggaggaaagaggaaaacaaaggga

SEQ ID NO: 3284 - DNA, 21 bp, Homo sapiens
acacacgaggaggcaggacct

SEQ ID NO: 3285 - DNA, 32 bp, Homo sapiens
caggaatctcaggatgaatcagtctagatcga

SEQ ID NO: 3286 - DNA, 32 bp, Homo sapiens
ccttggttctccccatgacaccacctgaacgt

SEQ ID NO: 3287 - DNA, 23 bp, Homo sapiens
tggcaccatctcggctcactgca

SEQ ID NO: 3288 - DNA, 32 bp, Homo sapiens
tcttcaatactgctgctgcttacgcgccggga

SEQ ID NO: 3289 - DNA, 32 bp, Homo sapiens
accccctagtgatggaatgacagggtctggtg

SEQ ID NO: 3290 - DNA, 32 bp, Homo sapiens
agccttggggtcctgttaaaccacagacagtt

SEQ ID NO: 3291 - DNA, 32 bp, Homo sapiens
ctgaggcttgcttggcttgtgtccatgcttaa

SEQ ID NO: 3292 - DNA, 32 bp, Homo sapiens
ctgaatgctggaattggcaatatttcaggttc

SEQ ID NO: 3293 - DNA, 32 bp, Homo sapiens
attcttttgcccaggctggagtgcagtggcac

SEQ ID NO: 3294 - DNA, 32 bp, Homo sapiens
ggagaatcgcttgagctggagtgcagtggtgc

SEQ ID NO: 3295 - DNA, 32 bp, Homo sapiens
gctatgttgcccaggctggttgcaaacttctg

SEQ ID NO: 3296 - DNA, 32 bp, Homo sapiens
agattgccaagtgccagcagctgcagcaagaa

SEQ ID NO: 3297 - DNA, 32 bp, Homo sapiens
gaacctggaaggaagaggttgcagtgagccaa

SEQ ID NO: 3298 - DNA, 32 bp, Homo sapiens
gacatctgtgttcttcctgtcagctccacgcc

SEQ ID NO: 3299 - DNA, 32 bp, Homo sapiens
attctgtcacccaggctggagtccaatggggc

SEQ ID NO: 3300 - DNA, 32 bp, Homo sapiens
ctcaactcaagcaatcctcccacctcagccac

SEQ ID NO: 3301 - DNA, 28 bp, Homo sapiens
tctgctctctgtgaggcctcatcttgaa

SEQ ID NO: 3302 - DNA, 19 bp, Homo sapiens
cagggaagcctgtggaccc

SEQ ID NO: 3303 - DNA, 32 bp, Homo sapiens
ctctgttgcctaggctggaggacagtggcaca

SEQ ID NO: 3304 - DNA, 32 bp, Homo sapiens
ttcatgcatgcattcatccgtgacacatgagt

SEQ ID NO: 3305 - DNA, 32 bp, Homo sapiens
caccgttgcccaggctggagggcagtgacgtg

SEQ ID NO: 3306 - DNA, 32 bp, Homo sapiens
ctgctgtgcccaggacgtgggttcagcgtggg

SEQ ID NO: 3307 - DNA, 32 bp, Homo sapiens
ggaaggttgaggctgaaatgagctgtgatcat

SEQ ID NO: 3308 - DNA, 28 bp, Homo sapiens
ttgtgcccaggtgctgcccactcctgat

SEQ ID NO: 3309 - DNA, 32 bp, Homo sapiens
cccccaggatgtcggaggagatcatcacgccg

SEQ ID NO: 3310 - DNA, 32 bp, Homo sapiens
gaactcagaaggcggaggctgcagtgagccga

SEQ ID NO: 3311 - DNA, 32 bp, Homo sapiens
ccaaaagagagaggagaaaatacagctctgat

SEQ ID NO: 3312 - DNA, 32 bp, Homo sapiens
ttttcaacatatgctttgctggaacactgtga

SEQ ID NO: 3313 - DNA, 32 bp, Homo sapiens
ctatatacttcctgtgagtagtaattttagtt

SEQ ID NO: 3314 - DNA, 32 bp, Homo sapiens
agtgaacctcaaggggttttacaggaggagct

SEQ ID NO: 3315 - DNA, 32 bp, Homo sapiens
caacactccccagccttgcttctgcctaaccc

SEQ ID NO: 3316 - DNA, 32 bp, Homo sapiens
ccaggctgcagcttctgtgggactgccttaag

SEQ ID NO: 3317 - DNA, 23 bp, Homo sapiens
ctgctggccttgctgcagaagtg

SEQ ID NO: 3318 - DNA, 32 bp, Homo sapiens
tcaaaaattcaggctgattgtcttttatcaga

SEQ ID NO: 3319 - DNA, 32 bp, Homo sapiens
ctctgtcacccacgctggagtgctgtgatgcg

SEQ ID NO: 3320 - DNA, 32 bp, Homo sapiens
actctgtcatccaggctggagtgcagtggcaa

SEQ ID NO: 3321 - DNA, 32 bp, Homo sapiens
gcctgagatcagcttagtgtttgaaattgctc

SEQ ID NO: 3322 - DNA, 32 bp, Homo sapiens
ggacccgggaggcagaggttgcagtgagccga

SEQ ID NO: 3323 - DNA, 32 bp, Homo sapiens
gaacctgggaggcagagattgcagtgagctga

SEQ ID NO: 3324 - DNA, 32 bp, Homo sapiens
cactcttgcccaggctggggtgtcgtggcgtg

SEQ ID NO: 3325 - DNA, 32 bp, Homo sapiens
gaacccaggaggcagaggttgcagtaagccaa

SEQ ID NO: 3326 - DNA, 32 bp, Homo sapiens
gaacctgggaggcagaggttgcagtaagctga

SEQ ID NO: 3327 - DNA, 32 bp, Homo sapiens
accccagggaggcacagggggagcatgaagag

SEQ ID NO: 3328 - DNA, 32 bp, Homo sapiens
gcacctcatgaagctttcctggagcactgtct

SEQ ID NO: 3329 - DNA, 28 bp, Homo sapiens
ggagccctgagggctgcctctctgccag

SEQ ID NO: 3330 - DNA, 32 bp, Homo sapiens
gaacccaggaggcagagattgcagtgagccaa

SEQ ID NO: 3331 - DNA, 24 bp, Homo sapiens
tcatgcctgtaatcccaacatttt

SEQ ID NO: 3332 - DNA, 32 bp, Homo sapiens
tttctgtcacccaggttagagtagatttcagt

SEQ ID NO: 3333 - DNA, 32 bp, Homo sapiens
atttctctgagtagcttctgctatgatattct

SEQ ID NO: 3334 - DNA, 19 bp, Homo sapiens
gccacagattcacccagga

SEQ ID NO: 3335 - DNA, 32 bp, Homo sapiens
gcataaatctgaagtggttcagtctagaagaa

SEQ ID NO: 3336 - DNA, 32 bp, Homo sapiens
ggaaggtctgcagcttcactcctgagccagcg

SEQ ID NO: 3337 - DNA, 32 bp, Homo sapiens
gagccctggaggttgaggctgcagtgagctgg

SEQ ID NO: 3338 - DNA, 32 bp, Homo sapiens
aattgactgccaggctgggtgcagtggctcac

SEQ ID NO: 3339 - DNA, 32 bp, Homo sapiens
cctgccccaggcgggctagagtgcagtggcat

SEQ ID NO: 3340 - DNA, 32 bp, Homo sapiens
agcctcccaagtagctgggtttatatgtgccc

SEQ ID NO: 3341 - DNA, 32 bp, Homo sapiens
taagatgcaggcattctcatggaacacagacg

SEQ ID NO: 3342 - DNA, 28 bp, Homo sapiens
ctctacgccaatgaggcctcatctgtgc

SEQ ID NO: 3343 - DNA, 32 bp, Homo sapiens
cagtattggagttttgttctttattgctccct

SEQ ID NO: 3344 - DNA, 32 bp, Homo sapiens
gtgctcatgccaggctgacgggtccagtgcgg

SEQ ID NO: 3345 - DNA, 32 bp, Homo sapiens
aacacatcctttctcccctgggcttgtaagaa

SEQ ID NO: 3346 - DNA, 32 bp, Homo sapiens
taattttaagcatgttcagtggcagctcccct

SEQ ID NO: 3347 - DNA, 32 bp, Homo sapiens
agcctcccgagtagctgggattacaggtggtg

SEQ ID NO: 3348 - DNA, 32 bp, Homo sapiens
actgaagtcccaggctgggggtgtcaatggac

SEQ ID NO: 3349 - DNA, 32 bp, Homo sapiens
ccctattgcccaggctggagtgcaatggcgtg

SEQ ID NO: 3350 - DNA, 32 bp, Homo sapiens
ggcatcacagaagtgaaatgaaaacaaaatta

SEQ ID NO: 3351 - DNA, 32 bp, Homo sapiens
ccttgtataactgaatttatggtgctatttaa

SEQ ID NO: 3352 - DNA, 24 bp, Homo sapiens
ctgtcatccaaactggagtgcagt

SEQ ID NO: 3353 - DNA, 24 bp, Homo sapiens
gtcacccaggctagagtgcagtag

SEQ ID NO: 3354 - DNA, 24 bp, Homo sapiens
ctgtgtctcaggctggagtacagt

SEQ ID NO: 3355 - DNA, 32 bp, Homo sapiens
aggttgggaagaggatgaagattgaataactg

SEQ ID NO: 3356 - DNA, 32 bp, Homo sapiens
tgtccagcagttctgtatatactcagaatgaa

SEQ ID NO: 3357 - DNA, 32 bp, Homo sapiens
atatttccgccttttgctaagctaatatatag

SEQ ID NO: 3358 - DNA, 32 bp, Homo sapiens
gtcctggggaggcaggaggcacatgtgagggt

SEQ ID NO: 3359 - DNA, 32 bp, Homo sapiens
ctagggatgcagggctggaggccagaggtgtc

SEQ ID NO: 3360 - DNA, 32 bp, Homo sapiens
gctccacatccttcattcactgatctctggga

SEQ ID NO: 3361 - DNA, 28 bp, Homo sapiens
tgggagttaagtgctgcttgtcttccca

SEQ ID NO: 3362 - DNA, 32 bp, Homo sapiens
accaggcccagtgccctcaaatgcctccctca

SEQ ID NO: 3363 - DNA, 32 bp, Homo sapiens
gaatccaggaggtggagcttgcagtgagccga

SEQ ID NO: 3364 - DNA, 32 bp, Homo sapiens
ggaggaagaagaggaggaggagaaagaagcag

SEQ ID NO: 3365 - DNA, 32 bp, Homo sapiens
ctaggagagtaggaagagctgtggaggacaca

SEQ ID NO: 3366 - DNA, 32 bp, Homo sapiens
gatctcggctcctgggttcaagcaattctcct

SEQ ID NO: 3367 - DNA, 32 bp, Homo sapiens
tttttccgcagctgcatctttctgcctggact

SEQ ID NO: 3368 - DNA, 32 bp, Homo sapiens
agccgtcattctctccccactccacgctcccc

SEQ ID NO: 3369 - DNA, 23 bp, Homo sapiens
gctctttgtttaggcctaatctt

SEQ ID NO: 3370 - DNA, 32 bp, Homo sapiens
gagctagggctgctgcctcagctccaagacaa

SEQ ID NO: 3371 - DNA, 24 bp, Homo sapiens
ctgtcggccaggctggaatgcaat

SEQ ID NO: 3372 - DNA, 32 bp, Homo sapiens
tggctcaatctatcctgtgcttgatgctagaa

SEQ ID NO: 3373 - DNA, 32 bp, Homo sapiens
aggatcttggataggatcatctctccaaactt

SEQ ID NO: 3374 - DNA, 32 bp, Homo sapiens
tgggaggtcccaggctgtgtgcacagtgacag

SEQ ID NO: 3375 - DNA, 32 bp, Homo sapiens
tgctctgtcaccaggctggagtgcagtggcat

SEQ ID NO: 3376 - DNA, 32 bp, Homo sapiens
actcttgttgcccaggcggagtgcagtggaac

SEQ ID NO: 3377 - DNA, 32 bp, Homo sapiens
atctccgcctcccaggttcaagcgattctctt

SEQ ID NO: 3378 - DNA, 32 bp, Homo sapiens
gaacccaggaggtggagattgcagtgagctga

SEQ ID NO: 3379 - DNA, 32 bp, Homo sapiens
gaactcagggggtggaggttgcagtgagttga

SEQ ID NO: 3380 - DNA, 32 bp, Homo sapiens
atgcaggtggtctcctgggaaagtgtagagga

SEQ ID NO: 3381 - DNA, 32 bp, Homo sapiens
agatgtcactttctccccctctgccttttagt

SEQ ID NO: 3382 - DNA, 32 bp, Homo sapiens
agcctctcgagtggctgggattacaggcatcc

SEQ ID NO: 3383 - DNA, 32 bp, Homo sapiens
cattggaggtgcttgagtaactgtgaatacag

SEQ ID NO: 3384 - DNA, 32 bp, Homo sapiens
gctctgagccctccttcttgccctgagctttc

SEQ ID NO: 3385 - DNA, 24 bp, Homo sapiens
ctgtcgcccaggctggagcgcaat

SEQ ID NO: 3386 - DNA, 32 bp, Homo sapiens
ctctctcgcccaggctggagtgcagtggcgtg

SEQ ID NO: 3387 - DNA, 32 bp, Homo sapiens
tttgagaaaagccaggcttcagagttcctgct

SEQ ID NO: 3388 - DNA, 32 bp, Homo sapiens
ttttgagacctagggctggagtgcagttgagc

SEQ ID NO: 3389 - DNA, 32 bp, Homo sapiens
cgcccaggcagcggaatagagtgcagtgcttg

SEQ ID NO: 3390 - DNA, 32 bp, Homo sapiens
aatgtgaacttgcctagtaagcactttgtctc

SEQ ID NO: 3391 - DNA, 32 bp, Homo sapiens
agcctcctgagtagctgggactacaggtgccc

SEQ ID NO: 3392 - DNA, 32 bp, Homo sapiens
ccccacgtcgacctgtcacaggcctggctgta

SEQ ID NO: 3393 - DNA, 32 bp, Homo sapiens
ttcagccttaagggtacttcagtcttaactgt

SEQ ID NO: 3394 - DNA, 32 bp, Homo sapiens
acacttagaagagggaaaatgacaagttcagg

SEQ ID NO: 3395 - DNA, 32 bp, Homo sapiens
ctctgtcaccaaggctggagtgcaggggcaca

SEQ ID NO: 3396 - DNA, 32 bp, Homo sapiens
taaagggtgcagtgcagccactgagggacagc

SEQ ID NO: 3397 - DNA, 32 bp, Homo sapiens
agcccgggaggcagaggctgcagtggctgaga

SEQ ID NO: 3398 - DNA, 32 bp, Homo sapiens
gaacctgggagccggaggctgcagtgagccaa

SEQ ID NO: 3399 - DNA, 32 bp, Homo sapiens
gtccgttttactgtgaatatagcaatatagta

SEQ ID NO: 3400 - DNA, 32 bp, Homo sapiens
cttggcttaagtgattctcccacctcagcctc

SEQ ID NO: 3401 - DNA, 32 bp, Homo sapiens
ctaggttcaagcagttctcctgcctcagcctc

SEQ ID NO: 3402 - DNA, 32 bp, Homo sapiens
ggagcctcagtctgacattccacgccggggtg

SEQ ID NO: 3403 - DNA, 32 bp, Homo sapiens
gagctggggtgttcctggaagaggtcggggag

SEQ ID NO: 3404 - DNA, 32 bp, Homo sapiens
agaggcttgactcgtctcaggtgcaatcctta

SEQ ID NO: 3405 - DNA, 32 bp, Homo sapiens
gtttggatgtgaggagaatgaaactacaaaaa

SEQ ID NO: 3406 - DNA, 32 bp, Homo sapiens
ctagcagccctctctctcagcttagcagttcg

SEQ ID NO: 3407 - DNA, 21 bp, Homo sapiens
gtcgcccaggctggagtgcag

SEQ ID NO: 3408 - DNA, 32 bp, Homo sapiens
gcagcagcagcagtactcagtgatagggggct

SEQ ID NO: 3409 - DNA, 32 bp, Homo sapiens
ctctgtcaacgcagactggagtgcagtggcac

SEQ ID NO: 3410 - DNA, 32 bp, Homo sapiens
ctcttattgcccaggctggagtgcaatggtgc

SEQ ID NO: 3411 - DNA, 20 bp, Homo sapiens
gaagctgtttgcagcagctc

SEQ ID NO: 3412 - DNA, 32 bp, Homo sapiens
gaacccgtgaggcagaggttgcagtgaaccga

SEQ ID NO: 3413 - DNA, 32 bp, Homo sapiens
tgaaccgggaggcggaggttgcagtgagccga

SEQ ID NO: 3414 - DNA, 32 bp, Homo sapiens
ctgtgttcaggatgttgaagtgcagtgtcaga

SEQ ID NO: 3415 - DNA, 32 bp, Homo sapiens
tggaagttaagaggggtgagaaaacaaagaag

SEQ ID NO: 3416 - DNA, 28 bp, Homo sapiens
ccactcccaagtgtgccctcttccctct

SEQ ID NO: 3417 - DNA, 32 bp, Homo sapiens
gaactggggaggagaaggttgcagtgagccga

SEQ ID NO: 3418 - DNA, 32 bp, Homo sapiens
ccgaaagccgtctcttctatgcaataacacaa

SEQ ID NO: 3419 - DNA, 32 bp, Homo sapiens
agactttcattatttctcatctggattaccag

SEQ ID NO: 3420 - DNA, 23 bp, Homo sapiens
caatattgtaatcctagcacttt

SEQ ID NO: 3421 - DNA, 32 bp, Homo sapiens
tttgagactgggtctcgctttgttgcccaggc

SEQ ID NO: 3422 - DNA, 23 bp, Homo sapiens
tggcgtgatctcagatcactgca

SEQ ID NO: 3423 - DNA, 21 bp, Homo sapiens
ctgcagggggcggggcaggaa

SEQ ID NO: 3424 - DNA, 32 bp, Homo sapiens
ccagccccagttcttttatccctgggcccaac

SEQ ID NO: 3425 - DNA, 32 bp, Homo sapiens
ctctgttgcccaggctggagtgcaggggcacg

SEQ ID NO: 3426 - DNA, 32 bp, Homo sapiens
gctctatcaccaggtgggagtgcagtggcaca

SEQ ID NO: 3427 - DNA, 32 bp, Homo sapiens
gtcttgttgcccaggctggagtgcaatggcgt

SEQ ID NO: 3428 - DNA, 32 bp, Homo sapiens
aagttccctccaacaggaactctctgacctgt

SEQ ID NO: 3429 - DNA, 32 bp, Homo sapiens
ctctgtcacccaggctgtagtgcagtggcata

SEQ ID NO: 3430 - DNA, 32 bp, Homo sapiens
ctttgtcacccaggctggaatgcagtggcaca

SEQ ID NO: 3431 - DNA, 32 bp, Homo sapiens
ctggattccagcaattctcctgcctcggcttc

SEQ ID NO: 3432 - DNA, 32 bp, Homo sapiens
tcatcgagcaccttcgctcccacccgggggag

SEQ ID NO: 3433 - DNA, 32 bp, Homo sapiens
gcctcatgcctgtaatcccagcactttcggag

SEQ ID NO: 3434 - DNA, 20 bp, Homo sapiens
ccccatgccaatgtccaggt

SEQ ID NO: 3435 - DNA, 32 bp, Homo sapiens
ggggcagggttagagggttgtgaggggaagag

SEQ ID NO: 3436 - DNA, 32 bp, Homo sapiens
ctcttgtcccccagactggagtgcaatggcac

SEQ ID NO: 3437 - DNA, 32 bp, Homo sapiens
tgaatgcagctttgccagtggcatatctgtca

SEQ ID NO: 3438 - DNA, 32 bp, Homo sapiens
tctctccttctctcttctcttcttcttgcctg

SEQ ID NO: 3439 - DNA, 32 bp, Homo sapiens
tgtaatcattgaacctcgagtcactgtaaaag

SEQ ID NO: 3440 - DNA, 32 bp, Homo sapiens
ctacccgggaggctgaggcaggagaatcgctt

SEQ ID NO: 3441 - DNA, 32 bp, Homo sapiens
gctctgtcacctaggctggagtgcagtggggc

SEQ ID NO: 3442 - DNA, 32 bp, Homo sapiens
gctttgttgcccaggctggagtgtggtggggc

SEQ ID NO: 3443 - DNA, 32 bp, Homo sapiens
ttgtcctcaacaacagcaaagcttcttgggag

SEQ ID NO: 3444 - DNA, 32 bp, Homo sapiens
acctccgcctcccgggttcaagtgattctcct

SEQ ID NO: 3445 - DNA, 32 bp, Homo sapiens
gggaggtggaggtggaggttgcagtgagccga

SEQ ID NO: 3446 - DNA, 32 bp, Homo sapiens
ctgtcattttgccatttcatctggagctttca

SEQ ID NO: 3447 - DNA, 32 bp, Homo sapiens
gggtgaagttggcaggggagagcttgacactt

SEQ ID NO: 3448 - DNA, 32 bp, Homo sapiens
tggggaagaactgggagctccccaacttggac

SEQ ID NO: 3449 - DNA, 32 bp, Homo sapiens
ttttgatggagtttcctctcatagtgatttgc

SEQ ID NO: 3450 - DNA, 18 bp, Homo sapiens
gtctccacactctttgca

SEQ ID NO: 3451 - DNA, 26 bp, Homo sapiens
aatttccattttgtaaaagcttctga

SEQ ID NO: 3452 - DNA, 32 bp, Homo sapiens
gtttgtccagttctttgttcaacacgccaaga

SEQ ID NO: 3453 - DNA, 32 bp, Homo sapiens
tgaagtcacatcctgaatgtgcatgccagaca

SEQ ID NO: 3454 - DNA, 32 bp, Homo sapiens
agctggcatgcttggctgtgtgcagtggccag

SEQ ID NO: 3455 - DNA, 32 bp, Homo sapiens
ctcctgaaagagatggattcattaaggaaatt

SEQ ID NO: 3456 - DNA, 32 bp, Homo sapiens
gaggacgcttccccttccttgtttctgctcag

SEQ ID NO: 3457 - DNA, 32 bp, Homo sapiens
cccctgggtttctcttggaaatggtcagtttc

SEQ ID NO: 3458 - DNA, 32 bp, Homo sapiens
ctgggttcaagcgattctcccaccccagcctc

SEQ ID NO: 3459 - DNA, 32 bp, Homo sapiens
ctgagctcaagcaatcctcccacctcagcctc

SEQ ID NO: 3460 - DNA, 25 bp, Homo sapiens
gaccacagccatccctctccatgcc

SEQ ID NO: 3461 - DNA, 32 bp, Homo sapiens
agaggcccagtagacatgcaccacctgcttga

SEQ ID NO: 3462 - DNA, 32 bp, Homo sapiens
gtgtctttgagcatttctcttcattcctggaa

SEQ ID NO: 3463 - DNA, 32 bp, Homo sapiens
tgatgaatgattttattggtggcagctgggtg

SEQ ID NO: 3464 - DNA, 32 bp, Homo sapiens
gaacccgggaggcagaggttgtgttgagccaa

SEQ ID NO: 3465 - DNA, 32 bp, Homo sapiens
ttctgtcacccaggctggagtgcagtgactca

SEQ ID NO: 3466 - DNA, 32 bp, Homo sapiens
gttggttattgcttaagaagtgcagtgtgtct

SEQ ID NO: 3467 - DNA, 32 bp, Homo sapiens
agcctctggagtagctgggattacagatggga

SEQ ID NO: 3468 - DNA, 28 bp, Homo sapiens
acgggcggcaatgctgcctccttccccg

SEQ ID NO: 3469 - DNA, 28 bp, Homo sapiens
ttaataaccagtgttgcctcattcagct

SEQ ID NO: 3470 - DNA, 32 bp, Homo sapiens
ggctaccggatcggtcggaaatggcagaggtg

SEQ ID NO: 3471 - DNA, 32 bp, Homo sapiens
gggaaacaacttctccccaggggcccctggga

SEQ ID NO: 3472 - DNA, 32 bp, Homo sapiens
tttcatagaagagccctggagaagacagtaga

SEQ ID NO: 3473 - DNA, 32 bp, Homo sapiens
aaggaatggagtttttcagcctgtggcccagc

SEQ ID NO: 3474 - DNA, 32 bp, Homo sapiens
gttggccaggcccagtcacaggggcagtgtca

SEQ ID NO: 3475 - DNA, 21 bp, Homo sapiens
tggcctaggctggagtgcagt

SEQ ID NO: 3476 - DNA, 32 bp, Homo sapiens
cttgacctaggtgccctttctgctacatgcaa

SEQ ID NO: 3477 - DNA, 32 bp, Homo sapiens
ctgtgttgcccaggctggagtgcaatggcgca

SEQ ID NO: 3478 - DNA, 32 bp, Homo sapiens
ctacggagatgagacaggcgtgcagtgtgcgc

SEQ ID NO: 3479 - DNA, 32 bp, Homo sapiens
ctgggttcaagcaattcttctgactcagcctc

SEQ ID NO: 3480 - DNA, 32 bp, Homo sapiens
ggacagggaggagagcggctgtggagaaactt

SEQ ID NO: 3481 - DNA, 32 bp, Homo sapiens
gtcttgaactcctggcctcaagcaatcctctc

SEQ ID NO: 3482 - DNA, 22 bp, Homo sapiens
ggcgcaatctcagctcactgca

SEQ ID NO: 3483 - DNA, 32 bp, Homo sapiens
acaagtgatttgcattctcttcttcacgcttt

SEQ ID NO: 3484 - DNA, 32 bp, Homo sapiens
atattcaggtttcaggaatgagccttgtaata

SEQ ID NO: 3485 - DNA, 32 bp, Homo sapiens
acaacattctccctctccctgttttcactttc

SEQ ID NO: 3486 - DNA, 32 bp, Homo sapiens
tctgacccctggaggagccactgtggaagcag

SEQ ID NO: 3487 - DNA, 32 bp, Homo sapiens
tagtttgtttagttaaggtgtgcagtgttttt

SEQ ID NO: 3488 - DNA, 32 bp, Homo sapiens
cgagcggctgctgagatgagtgcagtgtcgca

SEQ ID NO: 3489 - DNA, 32 bp, Homo sapiens
ccagtagcatctctgtcatcattcagattttg

SEQ ID NO: 3490 - DNA, 32 bp, Homo sapiens
gcggcaggaagaggagcgggagcaggagcgcg

SEQ ID NO: 3491 - DNA, 32 bp, Homo sapiens
gtgcggcggtgctggaggttgcggcggcggct

SEQ ID NO: 3492 - DNA, 32 bp, Homo sapiens
ctgcttgggaggcagaggcaggagaattgctt

SEQ ID NO: 3493 - DNA, 18 bp, Homo sapiens
cggggcccgctccagccc

SEQ ID NO: 3494 - DNA, 32 bp, Homo sapiens
gaggggcctaacctagagcaggtttccatagt

SEQ ID NO: 3495 - DNA, 32 bp, Homo sapiens
cagcctgcaccctcttctcttctggcttccct

SEQ ID NO: 3496 - DNA, 32 bp, Homo sapiens
ttgaggataataaaggtgtgtgatctggtttg

SEQ ID NO: 3497 - DNA, 32 bp, Homo sapiens
gccatgttgcccaggctggtcttgagaactcc

SEQ ID NO: 3498 - DNA, 32 bp, Homo sapiens
ggggaggctgaggcaggagaattgctttgaac

SEQ ID NO: 3499 - DNA, 32 bp, Homo sapiens
acctccgcttcctgggttcaaacaattctcct

SEQ ID NO: 3500 - DNA, 32 bp, Homo sapiens
tgtgtgaccttaggctggagtgcaatggcatg

SEQ ID NO: 3501 - DNA, 32 bp, Homo sapiens
tagtcatcacccagctgggcttctgcagtgtt

SEQ ID NO: 3502 - DNA, 32 bp, Homo sapiens
ctgggatcaagcaatccttccaccttgccctc

SEQ ID NO: 3503 - DNA, 32 bp, Homo sapiens
ctgggtgcaagcaattatcctgcctcagcctc

SEQ ID NO: 3504 - DNA, 17 bp, Homo sapiens
gtggggcaggagatggg

SEQ ID NO: 3505 - DNA, 21 bp, Homo sapiens
cagaaggggttctgggcctag

SEQ ID NO: 3506 - DNA, 32 bp, Homo sapiens
gagggagggagaggagagagagtgcgagaccg

SEQ ID NO: 3507 - DNA, 32 bp, Homo sapiens
cacgcctcagtgtctcctcaggcacaggaagt

SEQ ID NO: 3508 - DNA, 32 bp, Homo sapiens
ggcgtcgcctgagatcagggcccgggaagccc

SEQ ID NO: 3509 - DNA, 32 bp, Homo sapiens
ctctgttgcccagctggagtgcagtggtgtga

SEQ ID NO: 3510 - DNA, 32 bp, Homo sapiens
cctgaaccagttctttcttgagacagactata

SEQ ID NO: 3511 - DNA, 32 bp, Homo sapiens
ggggttaataaatggcttatccttctctccaa

SEQ ID NO: 3512 - DNA, 32 bp, Homo sapiens
cttgctctcccaggctggagtgcagtggtgta

SEQ ID NO: 3513 - DNA, 32 bp, Homo sapiens
tagttggtgctggatggatgtttgttgaatga

SEQ ID NO: 3514 - DNA, 32 bp, Homo sapiens
ttgggccttatcagcccatctgatccagatca

SEQ ID NO: 3515 - DNA, 24 bp, Homo sapiens
tcacgcctataatcccaacagttt

SEQ ID NO: 3516 - DNA, 32 bp, Homo sapiens
tggggttcaagcaatcctcccacctcaaccca

SEQ ID NO: 3517 - DNA, 32 bp, Homo sapiens
gtctcaaactcctggactcaagcaatctgccc

SEQ ID NO: 3518 - DNA, 32 bp, Homo sapiens
gtgaagtttgaaaacttttcaaacttttctag

SEQ ID NO: 3519 - DNA, 32 bp, Homo sapiens
tactttcattcaggctggagtgcagtggcatg

SEQ ID NO: 3520 - DNA, 32 bp, Homo sapiens
cagaccacattctataatctttgaacatgctg

SEQ ID NO: 3521 - DNA, 32 bp, Homo sapiens
ttggcctcaggagctgggggtgcagtggggga

SEQ ID NO: 3522 - DNA, 28 bp, Homo sapiens
tggcaaccctcagctgcctcatcgtggc

SEQ ID NO: 3523 - DNA, 32 bp, Homo sapiens
ctactcgggaggctgtggcaggagaattgctt

SEQ ID NO: 3524 - DNA, 32 bp, Homo sapiens
gaacccaggaggctgaggttgcagtgagccca

SEQ ID NO: 3525 - DNA, 32 bp, Homo sapiens
actgcatctgcagctctcgctctgcctcttcc

SEQ ID NO: 3526 - DNA, 32 bp, Homo sapiens
gctctgtcgcccagactagaatgcagtggtgc

SEQ ID NO: 3527 - DNA, 32 bp, Homo sapiens
cctggagctgtggcctggctgtggagggccgg

SEQ ID NO: 3528 - DNA, 19 bp, Homo sapiens
ggccacagccttgccattt

SEQ ID NO: 3529 - DNA, 32 bp, Homo sapiens
gtgagtgtggcagtccccacagctccacaatg

SEQ ID NO: 3530 - DNA, 32 bp, Homo sapiens
ctgattgaagctgacatctccaagaggtacag

SEQ ID NO: 3531 - DNA, 32 bp, Homo sapiens
agcctccctggtagctgggattacaggtgtga

SEQ ID NO: 3532 - DNA, 32 bp, Homo sapiens
gctgagtgagaaggcagtttgtggaaatggaa

SEQ ID NO: 3533 - DNA, 32 bp, Homo sapiens
aattcacctagagtgagtactttccttgtgca

SEQ ID NO: 3534 - DNA, 32 bp, Homo sapiens
ggagaaggtatagtggaatgagtgtgagcatc

SEQ ID NO: 3535 - DNA, 32 bp, Homo sapiens
ctggcctcaagcgatcctcccacctgtcctcc

SEQ ID NO: 3536 - DNA, 32 bp, Homo sapiens
ggggctcagattggcacagaattctttgtgaa

SEQ ID NO: 3537 - DNA, 32 bp, Homo sapiens
ctcttccccaaaatccagcaccaccttggtta

SEQ ID NO: 3538 - DNA, 32 bp, Homo sapiens
caaacgtctgcagcttcactcctgaagccagc

SEQ ID NO: 3539 - DNA, 32 bp, Homo sapiens
agtcccatctgactccccatgaggctcctggc

SEQ ID NO: 3540 - DNA, 22 bp, Homo sapiens
gggtctcttatccatccctgca

SEQ ID NO: 3541 - DNA, 32 bp, Homo sapiens
cacccattccaggtgccacaggcaggggatgt

SEQ ID NO: 3542 - DNA, 32 bp, Homo sapiens
ctggctcctcaaggagtctcccctctcctgta

SEQ ID NO: 3543 - DNA, 18 bp, Homo sapiens
cagggaagcctgcatccc

SEQ ID NO: 3544 - DNA, 23 bp, Homo sapiens
tggcatgatctcagctcgctgca

SEQ ID NO: 3545 - DNA, 23 bp, Homo sapiens
tggcatgatctcggctcgctaca

SEQ ID NO: 3546 - DNA, 32 bp, Homo sapiens
caagaggatccaaacttcctgcaacattttct

SEQ ID NO: 3547 - DNA, 28 bp, Homo sapiens
tctcccgtgactgctgcctcatcgatac

SEQ ID NO: 3548 - DNA, 32 bp, Homo sapiens
actctgttacccaggccggagtgcagtggcgc

SEQ ID NO: 3549 - DNA, 32 bp, Homo sapiens
ggtaaagtaaggggagaaagtgaagtgacttc

SEQ ID NO: 3550 - DNA, 32 bp, Homo sapiens
tcaggttcaagcaattctcatgcttcagcctc

SEQ ID NO: 3551 - DNA, 32 bp, Homo sapiens
caaacaaccatgtggttggattacatggagtc

SEQ ID NO: 3552 - DNA, 20 bp, Homo sapiens
tgggatctcggctcactgca

SEQ ID NO: 3553 - DNA, 32 bp, Homo sapiens
gaagccataccctcccccatctgggggccctg

SEQ ID NO: 3554 - DNA, 32 bp, Homo sapiens
ctcccacttcttctcccctcccccaccgcatc

SEQ ID NO: 3555 - DNA, 32 bp, Homo sapiens
ggctcgcctctctggccgggtgcagtgaacgg

SEQ ID NO: 3556 - DNA, 32 bp, Homo sapiens
ggtctgttacccaggctggagtgcagtggcat

SEQ ID NO: 3557 - DNA, 32 bp, Homo sapiens
gcactatattggtaattcttacaatggcatta

SEQ ID NO: 3558 - DNA, 32 bp, Homo sapiens
aggagatgcccaggttcaggtgtatcgtgcat

SEQ ID NO: 3559 - DNA, 32 bp, Homo sapiens
gtcgcccaggctggagtgagtgcagtggcgca

SEQ ID NO: 3560 - DNA, 32 bp, Homo sapiens
gttgagggcaggcagaggtagctgagggtagc

SEQ ID NO: 3561 - DNA, 32 bp, Homo sapiens
gtactcgggaggctgaggcagagaattgcttg

SEQ ID NO: 3562 - DNA, 32 bp, Homo sapiens
ttactcgggaggctgaggcaggagaatcgctt

SEQ ID NO: 3563 - DNA, 24 bp, Homo sapiens
tcatgcctataaccccagcacttt

SEQ ID NO: 3564 - DNA, 24 bp, Homo sapiens
tcaagcccataatcccagcacttt

SEQ ID NO: 3565 - DNA, 32 bp, Homo sapiens
taaatttcaagcatctgatcacatcacatggt

SEQ ID NO: 3566 - DNA, 32 bp, Homo sapiens
ggtttctctgcagaagctctctttttgcctcc

SEQ ID NO: 3567 - DNA, 32 bp, Homo sapiens
tcgaggcctcttctccccagcaccgctgtggt

SEQ ID NO: 3568 - DNA, 21 bp, Homo sapiens
gcccccacctgccctcccggg

SEQ ID NO: 3569 - DNA, 32 bp, Homo sapiens
tggagggtcgcctggcttattcccatgtgtga

SEQ ID NO: 3570 - DNA, 32 bp, Homo sapiens
gagcctgggacattgaggctgcagtgaactgt

SEQ ID NO: 3571 - DNA, 32 bp, Homo sapiens
tttttctacatcctgaactatttttcctattt

SEQ ID NO: 3572 - DNA, 32 bp, Homo sapiens
aaccttaaagttctgttggtatcacagaagac

SEQ ID NO: 3573 - DNA, 32 bp, Homo sapiens
ttggggtcaagccatcctcccacctcagcttt

SEQ ID NO: 3574 - DNA, 32 bp, Homo sapiens
cccaagtggctaagacttaacaaacaggcaca

SEQ ID NO: 3575 - DNA, 32 bp, Homo sapiens
ctgggataggggcagaggaggcgaggaggccg

SEQ ID NO: 3576 - DNA, 32 bp, Homo sapiens
tgagacgggagtttctctcttgtctcccaggc

SEQ ID NO: 3577 - DNA, 24 bp, Homo sapiens
tggcacaatcatagctcgctgcag

SEQ ID NO: 3578 - DNA, 32 bp, Homo sapiens
gggattgttgcgtcccatatctggacccagaa

SEQ ID NO: 3579 - DNA, 32 bp, Homo sapiens
tttagtagagacggggtttcactgtggtctca

SEQ ID NO: 3580 - DNA, 32 bp, Homo sapiens
ctctgtcgcccaggctggagcgcaatggcatg

SEQ ID NO: 3581 - DNA, 32 bp, Homo sapiens
ctctgtcgcccaggctagagtgcagtggtatg

SEQ ID NO: 3582 - DNA, 32 bp, Homo sapiens
ctctgtcacccaggctggagcgtaatggcaca

SEQ ID NO: 3583 - DNA, 32 bp, Homo sapiens
ccttggggccctgggagatctgggacttcaga

SEQ ID NO: 3584 - DNA, 32 bp, Homo sapiens
gaacacagaaggtggaggttgcagtgagccaa

SEQ ID NO: 3585 - DNA, 32 bp, Homo sapiens
acccgggcccggtggaggctgcagtgagacga

SEQ ID NO: 3586 - DNA, 32 bp, Homo sapiens
attttagcacccagatggcattgcagtgccag

SEQ ID NO: 3587 - DNA, 32 bp, Homo sapiens
tagcattagggttctttgcaatgtggtatcta

SEQ ID NO: 3588 - DNA, 32 bp, Homo sapiens
agaggtagcccaaaaaggggagtgatctttca

SEQ ID NO: 3589 - DNA, 32 bp, Homo sapiens
cctcacagccagcacgacccccagaaagaggc

SEQ ID NO: 3590 - DNA, 32 bp, Homo sapiens
caggcagcctgagattgcttctagagatcttt

SEQ ID NO: 3591 - DNA, 32 bp, Homo sapiens
aagctgagaagaggaagatgaagaggaggaag

SEQ ID NO: 3592 - DNA, 32 bp, Homo sapiens
taggatatgtagatgagtttttgctacagagc

SEQ ID NO: 3593 - DNA, 32 bp, Homo sapiens
actgcggatgagaccggtgcgactcatgaagg

SEQ ID NO: 3594 - DNA, 32 bp, Homo sapiens
tttcctgacagatggataagaaaacaatagaa

SEQ ID NO: 3595 - DNA, 32 bp, Homo sapiens
gcccccgcaggcttctgtgtgctgctaactgt

SEQ ID NO: 3596 - DNA, 32 bp, Homo sapiens
taggagtcaggtgtccgtttgctgctatcagt

SEQ ID NO: 3597 - DNA, 31 bp, Homo sapiens
agttaaattccatacactaggagggagtttt

SEQ ID NO: 3598 - DNA, 24 bp, Homo sapiens
tcacacctgtaataccagcagttt

SEQ ID NO: 3599 - DNA, 32 bp, Homo sapiens
aggttaagaagaggaggaagtgagacggggaa

SEQ ID NO: 3600 - DNA, 32 bp, Homo sapiens
ggtagaacaggtgtcgtacactgtgaaatgtt

SEQ ID NO: 3601 - DNA, 32 bp, Homo sapiens
ctaggacttaaccttgaaatggaaagtcttgc

SEQ ID NO: 3602 - DNA, 32 bp, Homo sapiens
tgaaggctttagttctgctttctgcctctcct

SEQ ID NO: 3603 - DNA, 32 bp, Homo sapiens
tgtcccccaggctggagtggtgcagtggcacg

SEQ ID NO: 3604 - DNA, 32 bp, Homo sapiens
actctgttgcccaggctggagtgcagtgtcac

SEQ ID NO: 3605 - DNA, 32 bp, Homo sapiens
gagcccggaaggcggaggttgcagtgagctga

SEQ ID NO: 3606 - DNA, 32 bp, Homo sapiens
gtcaagggggaccagaggttgaccactgtgga

SEQ ID NO: 3607 - DNA, 32 bp, Homo sapiens
ttataccatggatgctaaaaatggttctaact

SEQ ID NO: 3608 - DNA, 32 bp, Homo sapiens
atcaagatcaaagattctccccatctcacaga

SEQ ID NO: 3609 - DNA, 32 bp, Homo sapiens
aagcctggaaggtggaagttgcagtgagtcga

SEQ ID NO: 3610 - DNA, 32 bp, Homo sapiens
aaacctgggatgtggaggttgcagtgaactga

SEQ ID NO: 3611 - DNA, 32 bp, Homo sapiens
tgatcatctcctcaccccatctcccaccttgt

SEQ ID NO: 3612 - DNA, 32 bp, Homo sapiens
acattccttccttctcccatctggattcctaa

SEQ ID NO: 3613 - DNA, 31 bp, Homo sapiens
cccagcgtcacttctgctaggagggacccgt

SEQ ID NO: 3614 - DNA, 24 bp, Homo sapiens
tggcacgattatggctcattgcag

SEQ ID NO: 3615 - DNA, 31 bp, Homo sapiens
agatccatgctgctgctgactcggagcccca

SEQ ID NO: 3616 - DNA, 32 bp, Homo sapiens
gccgggagctgggtttctcttccctttttatc

SEQ ID NO: 3617 - DNA, 32 bp, Homo sapiens
ggcccatgcccaggatgagggacaggtgcagc

SEQ ID NO: 3618 - DNA, 32 bp, Homo sapiens
acccccatctcccaggttcaagcgattctcct

SEQ ID NO: 3619 - DNA, 32 bp, Homo sapiens
gaacctgagaggcagaggttacagtgagctga

SEQ ID NO: 3620 - DNA, 32 bp, Homo sapiens
ctaggatgcccagggctgggtgcagccagctg

SEQ ID NO: 3621 - DNA, 24 bp, Homo sapiens
gcaggagcatcacccagagagcag

SEQ ID NO: 3622 - DNA, 32 bp, Homo sapiens
agagaaacggggagagaaagaaacgattctaa

SEQ ID NO: 3623 - DNA, 32 bp, Homo sapiens
agcctctcaagtagctgggattacaggcgccc

SEQ ID NO: 3624 - DNA, 32 bp, Homo sapiens
tagaggcggagtttcgccatgttggtcaggct

SEQ ID NO: 3625 - DNA, 32 bp, Homo sapiens
gacctggtgcccctgctcactgggcccgagcc

SEQ ID NO: 3626 - DNA, 22 bp, Homo sapiens
ggatctccaggagtcccctgca

SEQ ID NO: 3627 - DNA, 28 bp, Homo sapiens
gtgccggagcctgctgcctcgccgacgc

SEQ ID NO: 3628 - DNA, 32 bp, Homo sapiens
gctaccacattcaattaactttgctattaatt

SEQ ID NO: 3629 - DNA, 32 bp, Homo sapiens
caggcaaatgttcatttctcctggtacctgta

SEQ ID NO: 3630 - DNA, 32 bp, Homo sapiens
gtcagatgtagaggagagagagcgagagaaca

SEQ ID NO: 3631 - DNA, 32 bp, Homo sapiens
aaggcaaagaagggggaaggaaaacaaacttc

SEQ ID NO: 3632 - DNA, 32 bp, Homo sapiens
tcactgtcacccagtctggagtggagtggcat

SEQ ID NO: 3633 - DNA, 32 bp, Homo sapiens
caaccctctctgctgctgtttccatggcccag

SEQ ID NO: 3634 - DNA, 32 bp, Homo sapiens
tcattgctgaggtcaaggcacagtagaggaga

SEQ ID NO: 3635 - DNA, 32 bp, Homo sapiens
tcaagccttgactgttcttgcccggcaagaga

SEQ ID NO: 3636 - DNA, 32 bp, Homo sapiens
agcacagggaggcagaggcttgggtaaactca

SEQ ID NO: 3637 - DNA, 32 bp, Homo sapiens
tgtctcccagttctagaggttcccagagaaga

SEQ ID NO: 3638 - DNA, 32 bp, Homo sapiens
agcctcccaagtagctgggattacaggtgccc

SEQ ID NO: 3639 - DNA, 32 bp, Homo sapiens
agcctcctgagtagctaggattacaggtgcct

SEQ ID NO: 3640 - DNA, 32 bp, Homo sapiens
gaacccaggcggcagaggttgcagtgagtcga

SEQ ID NO: 3641 - DNA, 32 bp, Homo sapiens
tatgagagagcctcaaaagagagggcaagaat

SEQ ID NO: 3642 - DNA, 21 bp, Homo sapiens
ggtggctgctttgcagggctt

SEQ ID NO: 3643 - DNA, 32 bp, Homo sapiens
actccagttcattcactcagtggctcatccac

SEQ ID NO: 3644 - DNA, 32 bp, Homo sapiens
ctggttccagttctgtagccattcaggtccag

SEQ ID NO: 3645 - DNA, 32 bp, Homo sapiens
tgccagttccacagactggagtgagaacttat

SEQ ID NO: 3646 - DNA, 32 bp, Homo sapiens
ccgtggaagaatttcgtgccatgtggaaactt

SEQ ID NO: 3647 - DNA, 32 bp, Homo sapiens
ctatgttgcccaggctggcctcaagcaatcct

SEQ ID NO: 3648 - DNA, 32 bp, Homo sapiens
gtggtggtggctgcgcacacagctccacaggt

SEQ ID NO: 3649 - DNA, 32 bp, Homo sapiens
ggttcccaggagggagaaagagaagacaagag

SEQ ID NO: 3650 - DNA, 32 bp, Homo sapiens
gcattttaccatagattggagtgcatccttag

SEQ ID NO: 3651 - DNA, 32 bp, Homo sapiens
cactggctgcccaggctgaatggcagtgcctg

SEQ ID NO: 3652 - DNA, 32 bp, Homo sapiens
taaagatgctcctggcttatcttctgcatgtc

SEQ ID NO: 3653 - DNA, 32 bp, Homo sapiens
ccctgttgcccaggctggagtgcagtggcacg

SEQ ID NO: 3654 - DNA, 32 bp, Homo sapiens
cctcggagcccaggcagctgtgtccagtgaga

SEQ ID NO: 3655 - DNA, 32 bp, Homo sapiens
ctccttccctcctttccatctgggggtctcgg

SEQ ID NO: 3656 - DNA, 32 bp, Homo sapiens
acctaaggtcttagaaaatcttaacttgaaaa

SEQ ID NO: 3657 - DNA, 32 bp, Homo sapiens
gcttgttaatgtcagtctgtgctgaggacctc

SEQ ID NO: 3658 - DNA, 32 bp, Homo sapiens
aaggtgtttctcttctgctccctgaacctctt

SEQ ID NO: 3659 - DNA, 22 bp, Homo sapiens
ggttatgggggtgccagaggca

SEQ ID NO: 3660 - DNA, 32 bp, Homo sapiens
tgtgatctctgcgtttctcttctacactgctg

SEQ ID NO: 3661 - DNA, 32 bp, Homo sapiens
cctttccctctgtcttctcttcattacctttt

SEQ ID NO: 3662 - DNA, 19 bp, Homo sapiens
cagggaagcccctcctgcc

SEQ ID NO: 3663 - DNA, 32 bp, Homo sapiens
taaaaggtagcctcttcataggaaccaggagg

SEQ ID NO: 3664 - DNA, 32 bp, Homo sapiens
tcgcggcctgcctctgccaagagaccagcatc

SEQ ID NO: 3665 - DNA, 32 bp, Homo sapiens
acaaggtgcacaggctggaagtcttttgtgaa

SEQ ID NO: 3666 - DNA, 32 bp, Homo sapiens
aatggtgctctggggctggaggctagtaagga

SEQ ID NO: 3667 - DNA, 32 bp, Homo sapiens
attctatcggccaggctggagtgcagtggtgc

SEQ ID NO: 3668 - DNA, 24 bp, Homo sapiens
tcatgcttgtaatcccaacacttt

SEQ ID NO: 3669 - DNA, 32 bp, Homo sapiens
agcacttcacccagagcctggcacacagtagg

SEQ ID NO: 3670 - DNA, 24 bp, Homo sapiens
ctgtggcccagcctggagtacagt

SEQ ID NO: 3671 - DNA, 32 bp, Homo sapiens
ggcccggagccagccaggcagttttattgaaa

SEQ ID NO: 3672 - DNA, 32 bp, Homo sapiens
gccccaggacccctcttcaagagccactgcgt

SEQ ID NO: 3673 - DNA, 32 bp, Homo sapiens
ctctgcctttgagcttctcctctgctccaaca

SEQ ID NO: 3674 - DNA, 32 bp, Homo sapiens
ggaggagagaagtgcggctgtgatctggggaa

SEQ ID NO: 3675 - DNA, 32 bp, Homo sapiens
gctctgttgcccaggctggagtgcagtcgcac

SEQ ID NO: 3676 - DNA, 32 bp, Homo sapiens
ctactcgggaggccgaggcaggaaaatttatt

SEQ ID NO: 3677 - DNA, 32 bp, Homo sapiens
ctctgttgcccaggctggagtgcagtgacgtg

SEQ ID NO: 3678 - DNA, 32 bp, Homo sapiens
ctctgtcgcccaggctggaatgcagtggcgcg

SEQ ID NO: 3679 - DNA, 32 bp, Homo sapiens
tttctgctgagtagtatttcattgtatggatg

SEQ ID NO: 3680 - DNA, 32 bp, Homo sapiens
catctcccaagtggccacatacagcaacccac

SEQ ID NO: 3681 - DNA, 32 bp, Homo sapiens
ctacgtgggaggcagaggcaggagaatcattt

SEQ ID NO: 3682 - DNA, 32 bp, Homo sapiens
caccaccctgaaggagcttcttttcctctggg

SEQ ID NO: 3683 - DNA, 32 bp, Homo sapiens
cagcttcaggtcgctaccatctggacctctcg

SEQ ID NO: 3684 - DNA, 32 bp, Homo sapiens
ggagctagaagagtggccaggagatgaaagca

SEQ ID NO: 3685 - DNA, 23 bp, Homo sapiens
tggcacaatctcggttcactgca

SEQ ID NO: 3686 - DNA, 32 bp, Homo sapiens
ctctgttgcccaggctggaatgcagtggcgtg

SEQ ID NO: 3687 - DNA, 32 bp, Homo sapiens
ttctccaagtcctgagcttcagaactagggaa

SEQ ID NO: 3688 - DNA, 32 bp, Homo sapiens
gctcttcctccaaggctggagtgcagtgacgc

SEQ ID NO: 3689 - DNA, 21 bp, Homo sapiens
ctgtccaacatggtgaaaccc

SEQ ID NO: 3690 - DNA, 32 bp, Homo sapiens
agatgaggtgcttggctttcttcccaggaccc

SEQ ID NO: 3691 - DNA, 32 bp, Homo sapiens
ttagactctatcatgggcccccatgaagctcc

SEQ ID NO: 3692 - DNA, 32 bp, Homo sapiens
ctccatcgcccaggctgcagtgcagtgacacg

SEQ ID NO: 3693 - DNA, 32 bp, Homo sapiens
gtccgcgcctccattgcgctctcctcttcact

SEQ ID NO: 3694 - DNA, 18 bp, Homo sapiens
tccgcccctcctgctcca

SEQ ID NO: 3695 - DNA, 24 bp, Homo sapiens
aatgaggaaactaaactctgtgga

SEQ ID NO: 3696 - DNA, 32 bp, Homo sapiens
accctttcaagtagctgggattacaggtacct

SEQ ID NO: 3697 - DNA, 32 bp, Homo sapiens
cttggcaagccagcaggctggtactcggaccg

SEQ ID NO: 3698 - DNA, 32 bp, Homo sapiens
tgaggagcctgcggtgctccccagaaaagggg

SEQ ID NO: 3699 - DNA, 32 bp, Homo sapiens
ctcctccccatcctctccctctgtccctctgt

SEQ ID NO: 3700 - DNA, 32 bp, Homo sapiens
aaaggatgcacccaaacttcaaacttcaagca

SEQ ID NO: 3701 - DNA, 32 bp, Homo sapiens
ctcctctcgcccaggctggagtgcagtggtgt

SEQ ID NO: 3702 - DNA, 32 bp, Homo sapiens
ggctcatacctgtaatcccagcactttgggaa

SEQ ID NO: 3703 - DNA, 32 bp, Homo sapiens
ggctcatgcttgtaatctcagcactttgggag

SEQ ID NO: 3704 - DNA, 32 bp, Homo sapiens
tccggatggagggagaggttgtgctgaccacc

SEQ ID NO: 3705 - DNA, 32 bp, Homo sapiens
ctgctttttcctctccccactggcctaaatgg

SEQ ID NO: 3706 - DNA, 32 bp, Homo sapiens
ggctcatgcctgtaatcccagcactttgggag

SEQ ID NO: 3707 - DNA, 32 bp, Homo sapiens
ggctcatgcctgtagtcccagcactttggggg

SEQ ID NO: 3708 - DNA, 32 bp, Homo sapiens
taattgccctacctacctcacagggttgttgt

SEQ ID NO: 3709 - DNA, 32 bp, Homo sapiens
gggtcagcccaagattcttcagtctggactat

SEQ ID NO: 3710 - DNA, 32 bp, Homo sapiens
ttcagccccaaaacatctctgcctgcctttat

SEQ ID NO: 3711 - DNA, 24 bp, Homo sapiens
gaagaaatatagtagaaccctttg

SEQ ID NO: 3712 - DNA, 32 bp, Homo sapiens
agttttcatcccttttccagtacacacagcta

SEQ ID NO: 3713 - DNA, 32 bp, Homo sapiens
gccgcatccctctctacctgccaacatcctgt

SEQ ID NO: 3714 - DNA, 32 bp, Homo sapiens
gttcacccagttcatactaagcagagccaggc

SEQ ID NO: 3715 - DNA, 32 bp, Homo sapiens
ggccagattttatgctaaaaatggtagtttgt

SEQ ID NO: 3716 - DNA, 32 bp, Homo sapiens
actctgttgtccaggctggagtgcagcgatat

SEQ ID NO: 3717 - DNA, 32 bp, Homo sapiens
actctgttgccaaggctggaatgcagtggcga

SEQ ID NO: 3718 - DNA, 24 bp, Homo sapiens
tcacgcctgtcatcctagcacttt

SEQ ID NO: 3719 - DNA, 32 bp, Homo sapiens
agtccctcacccccaacccccatgctgtttgt

SEQ ID NO: 3720 - DNA, 32 bp, Homo sapiens
tctcctgacctcaagtccaacaacagtgtcca

SEQ ID NO: 3721 - DNA, 32 bp, Homo sapiens
ctgcttggggcctctttctggaaaccagatca

SEQ ID NO: 3722 - DNA, 32 bp, Homo sapiens
gagatctgcaggctgcctcttctgccccggag

SEQ ID NO: 3723 - DNA, 32 bp, Homo sapiens
ccaatgtagatctcctgtgaagcagaaccaac

SEQ ID NO: 3724 - DNA, 28 bp, Homo sapiens
atgcccaggtctcctgcctcacatcaca

SEQ ID NO: 3725 - DNA, 32 bp, Homo sapiens
ctttgtcgccctggctggagtgcagttgcgca

SEQ ID NO: 3726 - DNA, 32 bp, Homo sapiens
gctctgtcactcatgctggagtgcagtggcgt

SEQ ID NO: 3727 - DNA, 32 bp, Homo sapiens
gcctccgcttcctgggttcaagcaattctccc

SEQ ID NO: 3728 - DNA, 32 bp, Homo sapiens
gcctccgcctcctgggctcaagcaattctccc

SEQ ID NO: 3729 - DNA, 28 bp, Homo sapiens
tcttttctaagtgctgtgggatctggga

SEQ ID NO: 3730 - DNA, 32 bp, Homo sapiens
ctgagctcacccaggccagcaggtggggtatc

SEQ ID NO: 3731 - DNA, 32 bp, Homo sapiens
aaagtaactgttttcttcttggtgctatgaca

SEQ ID NO: 3732 - DNA, 32 bp, Homo sapiens
acttctgccttccaggttcaagcgattctcct

SEQ ID NO: 3733 - DNA, 32 bp, Homo sapiens
ctttgttctcaaggaatttgcattctagaaag

SEQ ID NO: 3734 - DNA, 32 bp, Homo sapiens
cgaaggtctgcagcttcactcctgagccaggg

SEQ ID NO: 3735 - DNA, 32 bp, Homo sapiens
gaatgtcgtcttctcctatggactcaattgct

SEQ ID NO: 3736 - DNA, 23 bp, Homo sapiens
tgatgcgatctcagctcactgca

SEQ ID NO: 3737 - DNA, 23 bp, Homo sapiens
tgacacgatcttggctcactgca

SEQ ID NO: 3738 - DNA, 32 bp, Homo sapiens
caggtgcctaacctgggacctgtggtcatgtg

SEQ ID NO: 3739 - DNA, 32 bp, Homo sapiens
atatgttgcaaacttagccatatgtagagtgg

SEQ ID NO: 3740 - DNA, 32 bp, Homo sapiens
tgcgtttgcaatggctgctactgtgaacttgg

SEQ ID NO: 3741 - DNA, 32 bp, Homo sapiens
gtggatgggcagaaggtgtagcattcggagat

SEQ ID NO: 3742 - DNA, 32 bp, Homo sapiens
gacagtgagaccaccccgctgtggaaacatgg

SEQ ID NO: 3743 - DNA, 32 bp, Homo sapiens
aaaagataatctatcttgaatatttcatatgt

SEQ ID NO: 3744 - DNA, 32 bp, Homo sapiens
gggcggagtttccaagataacagctattgtgt

SEQ ID NO: 3745 - DNA, 32 bp, Homo sapiens
tatgccctgagtagcgagtccatgtcactcag

SEQ ID NO: 3746 - DNA, 32 bp, Homo sapiens
acagagtgctggagctgggaatactgacccag

SEQ ID NO: 3747 - DNA, 32 bp, Homo sapiens
ccatccgtcaggtggcgttcagtctcagaata

SEQ ID NO: 3748 - DNA, 31 bp, Homo sapiens
tccagctgaacatcacctaggagggccatgc

SEQ ID NO: 3749 - DNA, 18 bp, Homo sapiens
cccctgattgtccaggtg

SEQ ID NO: 3750 - DNA, 32 bp, Homo sapiens
ctgctgctgctgctgctcgtcgcgccggggca

SEQ ID NO: 3751 - DNA, 32 bp, Homo sapiens
agtttcagtgccagaatgaattttcttgtttc

SEQ ID NO: 3752 - DNA, 32 bp, Homo sapiens
aatgcacctcaaggaattagagtagcatgaac

SEQ ID NO: 3753 - DNA, 32 bp, Homo sapiens
gaacccaggaggtggaggctgcagtgagctga

SEQ ID NO: 3754 - DNA, 32 bp, Homo sapiens
ttttgtcacccaggctggagtgcagtggggca

SEQ ID NO: 3755 - DNA, 32 bp, Homo sapiens
gaatgtaaagagacgcccttcacatgttgaga

SEQ ID NO: 3756 - DNA, 32 bp, Homo sapiens
aggctcctgagtagctgggattacaggcacgt

SEQ ID NO: 3757 - DNA, 28 bp, Homo sapiens
ttgcatctcagtgctgctttggggtctc

SEQ ID NO: 3758 - DNA, 32 bp, Homo sapiens
accacgatttgtgcccttgaaaatgctgtttg

SEQ ID NO: 3759 - DNA, 32 bp, Homo sapiens
ctcttgtctcccagactggagtgcaatggcat

SEQ ID NO: 3760 - DNA, 32 bp, Homo sapiens
gtcatttgtgatccctggctcttgtgatatgc

SEQ ID NO: 3761 - DNA, 24 bp, Homo sapiens
ctgccgcccaggctggagtgcagt

SEQ ID NO: 3762 - DNA, 32 bp, Homo sapiens
ttgacccctcagagagcttcagcccagacctg

SEQ ID NO: 3763 - DNA, 32 bp, Homo sapiens
gtggatccttagttttctcttcactgcctgcc

SEQ ID NO: 3764 - DNA, 32 bp, Homo sapiens
acatccctctgttcttctcttcctccttcagc

SEQ ID NO: 3765 - DNA, 32 bp, Homo sapiens
tgaacccgggaggcgagcttgcagtgagccga

SEQ ID NO: 3766 - DNA, 32 bp, Homo sapiens
ctttgttgcccaggctggagtgcagtggtctg

SEQ ID NO: 3767 - DNA, 32 bp, Homo sapiens
cctctcctgcccaggggctagagagcagtctc

SEQ ID NO: 3768 - DNA, 24 bp, Homo sapiens
tcacgcctgtgatcccagcacttt

SEQ ID NO: 3769 - DNA, 24 bp, Homo sapiens
tcatgcctacaatcccagcacttt

SEQ ID NO: 3770 - DNA, 32 bp, Homo sapiens
ccttcctgcacgccattctccacctcagtatc

SEQ ID NO: 3771 - DNA, 32 bp, Homo sapiens
aagaagggatcctctttcaaaggctaccttta

SEQ ID NO: 3772 - DNA, 32 bp, Homo sapiens
aatcaacttcaaggagcaccttcattagtaca

SEQ ID NO: 3773 - DNA, 24 bp, Homo sapiens
tcgcgcctgtaatcccagcacttt

SEQ ID NO: 3774 - DNA, 23 bp, Homo sapiens
tggcacaatctcggctcattgca

SEQ ID NO: 3775 - DNA, 32 bp, Homo sapiens
atacagcatcccacctcacaggcgaggaagct

SEQ ID NO: 3776 - DNA, 32 bp, Homo sapiens
taacccttgccttcctgtcacagggtttgctt

SEQ ID NO: 3777 - DNA, 28 bp, Homo sapiens
agtccttgccctgctgcctcctcatacc

SEQ ID NO: 3778 - DNA, 32 bp, Homo sapiens
gaacccgggaggcggatcttgcattgagccaa

SEQ ID NO: 3779 - DNA, 24 bp, Homo sapiens
tggcaagatctcggctcactgcag

SEQ ID NO: 3780 - DNA, 32 bp, Homo sapiens
gagtttcatccctgacaggtggatgggtgaaa

SEQ ID NO: 3781 - DNA, 32 bp, Homo sapiens
ctcctccaagacaccttcctgggacgctggcc

SEQ ID NO: 3782 - DNA, 32 bp, Homo sapiens
acttgatcacccaggctagagtgcagtggcgt

SEQ ID NO: 3783 - DNA, 32 bp, Homo sapiens
agtggaccttaggccttcctctctccagatgt

SEQ ID NO: 3784 - DNA, 32 bp, Homo sapiens
ctgtgatgtgactcctggaagtgacgtaggag

SEQ ID NO: 3785 - DNA, 32 bp, Homo sapiens
ttctggtgtccaggctgaagtcctcgtgtgac

SEQ ID NO: 3786 - DNA, 32 bp, Homo sapiens
gctctgtcgcccaggctagagtgcagtggtat

SEQ ID NO: 3787 - DNA, 23 bp, Homo sapiens
tggcgagatcacggctcactgca

SEQ ID NO: 3788 - DNA, 32 bp, Homo sapiens
tagagcctgcaaggagctcccgagtctgagga

SEQ ID NO: 3789 - DNA, 32 bp, Homo sapiens
ttgaataccccagcttctgcagcttcacttgc

SEQ ID NO: 3790 - DNA, 32 bp, Homo sapiens
gcaagcagcccaggcagctgtgggcagtgctg

SEQ ID NO: 3791 - DNA, 32 bp, Homo sapiens
actggcccagttcactgtacctggacttaccc

SEQ ID NO: 3792 - DNA, 32 bp, Homo sapiens
tacctcaggcctgggggctcccccgacttgtt

SEQ ID NO: 3793 - DNA, 28 bp, Homo sapiens
gtggcaagtgctcctcatccaaatgatc

SEQ ID NO: 3794 - DNA, 32 bp, Homo sapiens
ctactcgggaggctgaggcaggagatcgctgg

SEQ ID NO: 3795 - DNA, 32 bp, Homo sapiens
cccaactgctgtctgctcaggtgtagcccgcg

SEQ ID NO: 3796 - DNA, 32 bp, Homo sapiens
ttgcccaggttagagtgcagtggcttgatcat

SEQ ID NO: 3797 - DNA, 32 bp, Homo sapiens
ccgggttcgagcaattctcctgcctcagcctc

SEQ ID NO: 3798 - DNA, 32 bp, Homo sapiens
cacaaggtgctgcttttcagatccactatgca

SEQ ID NO: 3799 - DNA, 32 bp, Homo sapiens
gctttgccttttgctgacacagctccataaag

SEQ ID NO: 3800 - DNA, 32 bp, Homo sapiens
tcagtgctctcagctggcagtgcaatgcttgt

SEQ ID NO: 3801 - DNA, 32 bp, Homo sapiens
ccaggctcaagcaattcttacgcctcagcctc

SEQ ID NO: 3802 - DNA, 32 bp, Homo sapiens
ctctgccacccagactgaagtgcagtggtgcg

SEQ ID NO: 3803 - DNA, 32 bp, Homo sapiens
acctgctcctccatttccatttattctcaaca

SEQ ID NO: 3804 - DNA, 17 bp, Homo sapiens
cagggaagcctcctccc

SEQ ID NO: 3805 - DNA, 32 bp, Homo sapiens
tagagacggggtctccccatattggccaggct

SEQ ID NO: 3806 - DNA, 32 bp, Homo sapiens
ccgacctcaggtgatccgcccacctcggcctc

SEQ ID NO: 3807 - DNA, 32 bp, Homo sapiens
ctgcctgggaaacaggcttcattcagcacagc

SEQ ID NO: 3808 - DNA, 32 bp, Homo sapiens
gctttgtcgcccaggctggagcgcagtcccgc

SEQ ID NO: 3809 - DNA, 32 bp, Homo sapiens
gagcccaggaggtggaggttgcagtgagctga

SEQ ID NO: 3810 - DNA, 32 bp, Homo sapiens
ctctgtcgcccaggctggagtgcagtggagcg

SEQ ID NO: 3811 - DNA, 32 bp, Homo sapiens
gaaaaatgtctttgctccttggcagctaccag

SEQ ID NO: 3812 - DNA, 32 bp, Homo sapiens
ggaggttgcagtgagccgagatcatgtcactg

SEQ ID NO: 3813 - DNA, 32 bp, Homo sapiens
gaacctgggaggtggaggttgcagtgggccaa

SEQ ID NO: 3814 - DNA, 32 bp, Homo sapiens
gaacccaggaagtggaggttgcagtgagctga

SEQ ID NO: 3815 - DNA, 32 bp, Homo sapiens
ctgaactgtaccaccatttctgtgaggtggca

SEQ ID NO: 3816 - DNA, 32 bp, Homo sapiens
acctccactttccaggttcaagcaattctcct

SEQ ID NO: 3817 - DNA, 28 bp, Homo sapiens
tttctgcccatgttcgcctcatctaacc

SEQ ID NO: 3818 - DNA, 23 bp, Homo sapiens
tggtgcgatcttgactcactgca

SEQ ID NO: 3819 - DNA, 32 bp, Homo sapiens
ctctgtcacccaggctggagtgcagtggagca

SEQ ID NO: 3820 - DNA, 32 bp, Homo sapiens
ctaggctgcttctgagcttcagcctgggagca

SEQ ID NO: 3821 - DNA, 16 bp, Homo sapiens
aggggctgtccagccc

SEQ ID NO: 3822 - DNA, 23 bp, Homo sapiens
tggcacgatctcaactcactgca

SEQ ID NO: 3823 - DNA, 23 bp, Homo sapiens
tggcgcgatctcgactcactgca

SEQ ID NO: 3824 - DNA, 32 bp, Homo sapiens
ttcccaatcagcactgaaaataccatcaggcc

SEQ ID NO: 3825 - DNA, 32 bp, Homo sapiens
aaagctggcagccctggaagtgcagtgttggg

SEQ ID NO: 3826 - DNA, 32 bp, Homo sapiens
ggtgctcatgccaggctgacgggtccagtgcg

SEQ ID NO: 3827 - DNA, 32 bp, Homo sapiens
gctctaccagttctcgttttgggccagaggca

SEQ ID NO: 3828 - DNA, 32 bp, Homo sapiens
gctttgtcacccagggtggtgtgcagtggagc

SEQ ID NO: 3829 - DNA, 32 bp, Homo sapiens
ctggcttcaggcaattctcctgcctttgcctc

SEQ ID NO: 3830 - DNA, 32 bp, Homo sapiens
gaacccaggaggtgggcattgcagtgagccga

SEQ ID NO: 3831 - DNA, 32 bp, Homo sapiens
agattgagaccatcctggataacatggtgaaa

SEQ ID NO: 3832 - DNA, 17 bp, Homo sapiens
gcccctgccctacctgg

SEQ ID NO: 3833 - DNA, 21 bp, Homo sapiens
atcttcccacccgggctgtgc

SEQ ID NO: 3834 - DNA, 32 bp, Homo sapiens
actctgtcaccccggctggagtgcagtggtgt

SEQ ID NO: 3835 - DNA, 32 bp, Homo sapiens
aaaagaaagaagccagaaaatattatcaaccc

SEQ ID NO: 3836 - DNA, 32 bp, Homo sapiens
ccctgtcgcccaggctggagtgcaatgccgtg

SEQ ID NO: 3837 - DNA, 32 bp, Homo sapiens
gcaaatctacagttctgtttttgctactctat

SEQ ID NO: 3838 - DNA, 32 bp, Homo sapiens
gtccttacacattgtgtcctttgctaccatca

SEQ ID NO: 3839 - DNA, 32 bp, Homo sapiens
tggagccatcttctccatagcattacggactt

SEQ ID NO: 3840 - DNA, 32 bp, Homo sapiens
ctgacctcaagtgatctgcccacctcagcctc

SEQ ID NO: 3841 - DNA, 32 bp, Homo sapiens
ttgacctcaggtgatccacccacctcagcctc

SEQ ID NO: 3842 - DNA, 21 bp, Homo sapiens
cccagagcctccgcctgtggc

SEQ ID NO: 3843 - DNA, 32 bp, Homo sapiens
attgttctgcagttctctcttcttttcctcag

SEQ ID NO: 3844 - DNA, 32 bp, Homo sapiens
ctcctcccatctgtccccatcttcctccccac

SEQ ID NO: 3845 - DNA, 32 bp, Homo sapiens
acacccgcgagtgccctttcaagcctgctggg

SEQ ID NO: 3846 - DNA, 32 bp, Homo sapiens
gctctgtcgccaggctggagtacagtggtgtg

SEQ ID NO: 3847 - DNA, 32 bp, Homo sapiens
agcagaacctgaggagaaaagcaggtggaagg

SEQ ID NO: 3848 - DNA, 32 bp, Homo sapiens
atgttgaaaactaatccccaatgtgattgtat

SEQ ID NO: 3849 - DNA, 32 bp, Homo sapiens
tgtcgcccgacaacaggtacctgtacgtgaac

SEQ ID NO: 3850 - DNA, 28 bp, Homo sapiens
ccgcagcgcgaggctgcctcatcaacgg

SEQ ID NO: 3851 - DNA, 32 bp, Homo sapiens
gcctaggctgaccttgaactcctgggctcaag

SEQ ID NO: 3852 - DNA, 32 bp, Homo sapiens
cagggaccacttctccctctggctcccatctt

SEQ ID NO: 3853 - DNA, 18 bp, Homo sapiens
gcccctgttcatccaagt

SEQ ID NO: 3854 - DNA, 23 bp, Homo sapiens
tttggaccatttagcatcatgag

SEQ ID NO: 3855 - DNA, 32 bp, Homo sapiens
tgccggtggctcctgctcacatgtcttcgggt

SEQ ID NO: 3856 - DNA, 32 bp, Homo sapiens
cttgcccctaacctcagcccgagggtctccag

SEQ ID NO: 3857 - DNA, 32 bp, Homo sapiens
aaaacctttgtcaggctgggcgcggtggctca

SEQ ID NO: 3858 - DNA, 32 bp, Homo sapiens
gctctgtaactcaggctggagtgcagtggcgc

SEQ ID NO: 3859 - DNA, 32 bp, Homo sapiens
ttttgaagggagaagacactgcagtgaccact

SEQ ID NO: 3860 - DNA, 32 bp, Homo sapiens
ctctgtcgcccaggctggagggcagtggcgtg

SEQ ID NO: 3861 - DNA, 32 bp, Homo sapiens
ctctctcgcccaggctggagtgcagtggtgtg

SEQ ID NO: 3862 - DNA, 32 bp, Homo sapiens
ttttgagtttgaaatctctcccagaagacaaa

SEQ ID NO: 3863 - DNA, 16 bp, Homo sapiens
gcccctgccccccggg

SEQ ID NO: 3864 - DNA, 32 bp, Homo sapiens
agaactgaaagcactagagcagccttggggac

SEQ ID NO: 3865 - DNA, 32 bp, Homo sapiens
agggagtagctgctgcttcacggcgtctccac

SEQ ID NO: 3866 - DNA, 21 bp, Homo sapiens
gggtctcccctcacccctgca

SEQ ID NO: 3867 - DNA, 32 bp, Homo sapiens
ctcaagaattgcttgttacaggcacagtagcc

SEQ ID NO: 3868 - DNA, 32 bp, Homo sapiens
ctcttgtctcccaggctggagtgcaatcgcgc

SEQ ID NO: 3869 - DNA, 32 bp, Homo sapiens
taactaatcatatttaaatatatttcactttg

SEQ ID NO: 3870 - DNA, 32 bp, Homo sapiens
aggctcaggcatccctggtgacctgtggttct

SEQ ID NO: 3871 - DNA, 32 bp, Homo sapiens
gtactcgggaggctgaagcaggagaatcgctt

SEQ ID NO: 3872 - DNA, 32 bp, Homo sapiens
ccacctgaacaactggagcaacctttagtctc

SEQ ID NO: 3873 - DNA, 32 bp, Homo sapiens
ctctgttgcccaggctggagtgcagaggtgcg

SEQ ID NO: 3874 - DNA, 20 bp, Homo sapiens
gggcggccacaatttcgcgc

SEQ ID NO: 3875 - DNA, 32 bp, Homo sapiens
agtgggcacctgcactaccactttttagagga

SEQ ID NO: 3876 - DNA, 32 bp, Homo sapiens
ttgagacagagtttcgctcttgtcacccaggc

SEQ ID NO: 3877 - DNA, 32 bp, Homo sapiens
ttgagacggagtttcactcttgtcacccaggc

SEQ ID NO: 3878 - DNA, 32 bp, Homo sapiens
tgccgtgtgctgcttctcatcactgcacacaa

SEQ ID NO: 3879 - DNA, 32 bp, Homo sapiens
agtaccacggaaggaagggcactgtgaagcag

SEQ ID NO: 3880 - DNA, 32 bp, Homo sapiens
ctcctgaactgcactacaagacactttgtaga

SEQ ID NO: 3881 - DNA, 32 bp, Homo sapiens
cccggttcaggcaattctcctgcctcagcctc

SEQ ID NO: 3882 - DNA, 32 bp, Homo sapiens
tctcccttcaggcggaggttgcagtgagccga

SEQ ID NO: 3883 - DNA, 32 bp, Homo sapiens
tctttgcacatcctgctctttctgcctgaaaa

SEQ ID NO: 3884 - DNA, 19 bp, Homo sapiens
cctgtaatcccagcacttt

SEQ ID NO: 3885 - DNA, 32 bp, Homo sapiens
ggagggaggaagaatagaggaaaacaatgggc

SEQ ID NO: 3886 - DNA, 24 bp, Homo sapiens
agcaaagacagccagcgtgctcag

SEQ ID NO: 3887 - DNA, 32 bp, Homo sapiens
aatctgtcacccaggctggagtgcagtggcat

SEQ ID NO: 3888 - DNA, 32 bp, Homo sapiens
gcgctgttgcccaggctctagtgcaatggcac

SEQ ID NO: 3889 - DNA, 32 bp, Homo sapiens
actctgtcagccaggctggagtgcaatggcat

SEQ ID NO: 3890 - DNA, 32 bp, Homo sapiens
cgggaggccaaggcaggagaattgctcgaact

SEQ ID NO: 3891 - DNA, 32 bp, Homo sapiens
agggccagtgtacaaaccagcacctgctagga

SEQ ID NO: 3892 - DNA, 24 bp, Homo sapiens
tcacacctgtaatcctaacacttt

SEQ ID NO: 3893 - DNA, 32 bp, Homo sapiens
gagggaatttcttttcgcagaagccattactc

SEQ ID NO: 3894 - DNA, 32 bp, Homo sapiens
gctctgtcacccaggctgtagtacagtggtgc

SEQ ID NO: 3895 - DNA, 32 bp, Homo sapiens
ccaacatctatggtgtcccaggcacagtgcca

SEQ ID NO: 3896 - DNA, 32 bp, Homo sapiens
gtttttcttactggagcttcattttggtaaga

SEQ ID NO: 3897 - DNA, 32 bp, Homo sapiens
gcgcgggcgatttgtaggtaatggcaggcgtt

SEQ ID NO: 3898 - DNA, 32 bp, Homo sapiens
ctcttgtgcccaggctggagtgcaatagctcg

SEQ ID NO: 3899 - DNA, 32 bp, Homo sapiens
ttctgtcacccaggccggagtgcagtggtgta

SEQ ID NO: 3900 - DNA, 32 bp, Homo sapiens
tgagtaagatgacttgttgactgtgaaagtga

SEQ ID NO: 3901 - DNA, 32 bp, Homo sapiens
acctccgcctcctgggttcacatgattctcct

SEQ ID NO: 3902 - DNA, 28 bp, Homo sapiens
tgcggcccaagtgatactttctttaccg

SEQ ID NO: 3903 - DNA, 32 bp, Homo sapiens
tgacccaggaggcggaggttgcggtgaccctc

SEQ ID NO: 3904 - DNA, 32 bp, Homo sapiens
actctgtcacccaagctggagtgcactggcat

SEQ ID NO: 3905 - DNA, 32 bp, Homo sapiens
agcctccgaagtagctgggattacaggcgccc

SEQ ID NO: 3906 - DNA, 32 bp, Homo sapiens
ctttgtgattctccctgctccctgtggacaaa

SEQ ID NO: 3907 - DNA, 21 bp, Homo sapiens
agagacggactcctgttcacc

SEQ ID NO: 3908 - DNA, 21 bp, Homo sapiens
gcgcgatctgggctcactgca

SEQ ID NO: 3909 - DNA, 32 bp, Homo sapiens
gccaagctagtgggcttcaggtgcaagggtac

SEQ ID NO: 3910 - DNA, 32 bp, Homo sapiens
cttgctgaaaacaggctggggtgttgagacac

SEQ ID NO: 3911 - DNA, 32 bp, Homo sapiens
gaaccccggaggcggagcttgcagtgagccga

SEQ ID NO: 3912 - DNA, 32 bp, Homo sapiens
agctgtttcaggggtttcctggaccacccact

SEQ ID NO: 3913 - DNA, 32 bp, Homo sapiens
ggcctcccaaagtgctgggattataggcatga

SEQ ID NO: 3914 - DNA, 32 bp, Homo sapiens
ggcagtgctgagggctgggatgctctgtgacc

SEQ ID NO: 3915 - DNA, 32 bp, Homo sapiens
ggctcccaggaagggccgctgctggagatggg

SEQ ID NO: 3916 - DNA, 32 bp, Homo sapiens
caactcggaagaggaaagaaaggaagtcagga

SEQ ID NO: 3917 - DNA, 32 bp, Homo sapiens
ttattaggaagaggaagaagaggtagaaaaca

SEQ ID NO: 3918 - DNA, 32 bp, Homo sapiens
ctgggctcaggtgattctcccatctcagcctc

SEQ ID NO: 3919 - DNA, 18 bp, Homo sapiens
cagaaggaatgggtccag

SEQ ID NO: 3920 - DNA, 32 bp, Homo sapiens
aagggacgtcttctccacgccgctccgactcc

SEQ ID NO: 3921 - DNA, 32 bp, Homo sapiens
cttaccaatttccaagtagaaattatccatta

SEQ ID NO: 3922 - DNA, 32 bp, Homo sapiens
agcaaatctgcatcttctcttatttctgacct

SEQ ID NO: 3923 - DNA, 32 bp, Homo sapiens
tacccattttcagcttctctgcctctcttctg

SEQ ID NO: 3924 - DNA, 32 bp, Homo sapiens
tcctgggcttaaatgactcttctgcctcagcc

SEQ ID NO: 3925 - DNA, 22 bp, Homo sapiens
tggcgtgatctcggctcactgc

SEQ ID NO: 3926 - DNA, 32 bp, Homo sapiens
tggattgtgctgctgttagccttagtttcagt

SEQ ID NO: 3927 - DNA, 32 bp, Homo sapiens
ctctgttgaccaggctggagtgaagtggtgtg

SEQ ID NO: 3928 - DNA, 32 bp, Homo sapiens
cattgaggtctcggtggatgtgtctgcgccga

SEQ ID NO: 3929 - DNA, 32 bp, Homo sapiens
gaaaccgaaaaacaggcttgtgtccttccatt

SEQ ID NO: 3930 - DNA, 32 bp, Homo sapiens
cagctcttgcccagagctgtgcagtgcagtgg

SEQ ID NO: 3931 - DNA, 32 bp, Homo sapiens
tcttgttgcccaggctggagtgcagtgacaca

SEQ ID NO: 3932 - DNA, 32 bp, Homo sapiens
tgtcttggcatcttctgcctttgctactgagc

SEQ ID NO: 3933 - DNA, 32 bp, Homo sapiens
tgtacctgttggcggccgggtgcagtggctca

SEQ ID NO: 3934 - DNA, 32 bp, Homo sapiens
gagccagagaggtagaggctgcagtgagctat

SEQ ID NO: 3935 - DNA, 32 bp, Homo sapiens
aagcctgggaggcagaggttgcagtgagccga

SEQ ID NO: 3936 - DNA, 32 bp, Homo sapiens
gagcccggaaggcagaggttgcagtgagctga

SEQ ID NO: 3937 - DNA, 28 bp, Homo sapiens
ctggcccctgctgctgcctcccgtcctc

SEQ ID NO: 3938 - DNA, 32 bp, Homo sapiens
tggtacccaggtgcccttcaggctctaaccaa

SEQ ID NO: 3939 - DNA, 32 bp, Homo sapiens
tggctaccaaatgataagaacaacagcaacaa

SEQ ID NO: 3940 - DNA, 32 bp, Homo sapiens
ctagttaactgcagcaggagcatgtccttaag

SEQ ID NO: 3941 - DNA, 32 bp, Homo sapiens
ctgagctcaagcagtcttcccaccttggcctc

SEQ ID NO: 3942 - DNA, 32 bp, Homo sapiens
agccaaaggcctggggcttccttggctcttct

SEQ ID NO: 3943 - DNA, 24 bp, Homo sapiens
tcacgcctctaatcccaggacttt

SEQ ID NO: 3944 - DNA, 32 bp, Homo sapiens
ctgtgtcatccagagctggagtgcagcggcac

SEQ ID NO: 3945 - DNA, 32 bp, Homo sapiens
ctatctttagccagactgttgcagttattgct

SEQ ID NO: 3946 - DNA, 32 bp, Homo sapiens
cagcttctcctgcctcttcttctgcaatcctc

SEQ ID NO: 3947 - DNA, 32 bp, Homo sapiens
catgtttttcttctccctcagtctggcccttc

SEQ ID NO: 3948 - DNA, 31 bp, Homo sapiens
tcgaccaacaacaacgaggaggagaagtccc

SEQ ID NO: 3949 - DNA, 32 bp, Homo sapiens
acccgggccctctctgtttgaaccgaacccga

SEQ ID NO: 3950 - DNA, 32 bp, Homo sapiens
tcttgtcgcccaggctggagtgcagtggcgtg

SEQ ID NO: 3951 - DNA, 32 bp, Homo sapiens
tcttgtttcccaggctggagtgcaatgggtga

SEQ ID NO: 3952 - DNA, 32 bp, Homo sapiens
tcttgtcacccaggcaggagtgcagtggcgtt

SEQ ID NO: 3953 - DNA, 32 bp, Homo sapiens
ctaaacttccctgaattggcttggtcaatgcc

SEQ ID NO: 3954 - DNA, 18 bp, Homo sapiens
gccatgctggcacccaga

SEQ ID NO: 3955 - DNA, 28 bp, Homo sapiens
ctgcaccctattgtggcctcatccaaac

SEQ ID NO: 3956 - DNA, 32 bp, Homo sapiens
ctgctcgggaggctaaggcaggagaattgctt

SEQ ID NO: 3957 - DNA, 32 bp, Homo sapiens
ccagccagggaggggcagctgcagtgaccagg

SEQ ID NO: 3958 - DNA, 32 bp, Homo sapiens
cattgctgtaccacatctgctctagggaatct

SEQ ID NO: 3959 - DNA, 32 bp, Homo sapiens
ccaagttcaagtaattctccagcctcagcctc

SEQ ID NO: 3960 - DNA, 32 bp, Homo sapiens
tctggctcaagcaatcctctcacttcagcctc

SEQ ID NO: 3961 - DNA, 32 bp, Homo sapiens
ctgggttcaagcaattctcatgcctcagtccc

SEQ ID NO: 3962 - DNA, 23 bp, Homo sapiens
caggactcgttctactgcctgga

SEQ ID NO: 3963 - DNA, 32 bp, Homo sapiens
gcactgtcacccgggctggagtgcaatggctc

SEQ ID NO: 3964 - DNA, 32 bp, Homo sapiens
accaggtcaagcaagatgccatgtcacccctg

SEQ ID NO: 3965 - DNA, 16 bp, Homo sapiens
cctcctgcacccagaa

SEQ ID NO: 3966 - DNA, 22 bp, Homo sapiens
ctgggaaccagtgcctgagtca

SEQ ID NO: 3967 - DNA, 32 bp, Homo sapiens
gctttggttttcatttctcttcttcactgcct

SEQ ID NO: 3968 - DNA, 32 bp, Homo sapiens
gttttgttgcccaggctggtctccagcttcta

SEQ ID NO: 3969 - DNA, 32 bp, Homo sapiens
actttgtcgcccgggcaggagtgcagtggctc

SEQ ID NO: 3970 - DNA, 32 bp, Homo sapiens
caagacccagttcattctgccaaagggaaaag

SEQ ID NO: 3971 - DNA, 32 bp, Homo sapiens
ggtcatgaccatggtgtgggtgcagtgactgc

SEQ ID NO: 3972 - DNA, 32 bp, Homo sapiens
gctccgttgcccaggttggagtgcagtggccc

SEQ ID NO: 3973 - DNA, 32 bp, Homo sapiens
cactctgttgcccagctggagtgcagtggcgt

SEQ ID NO: 3974 - DNA, 32 bp, Homo sapiens
gaacccaggaggcggaggttgcagtgacccga

SEQ ID NO: 3975 - DNA, 32 bp, Homo sapiens
ctactcgggaggctgaggcagggagaatcgct

SEQ ID NO: 3976 - DNA, 32 bp, Homo sapiens
gagctgagcccaggctgcgtagtgaccacaag

SEQ ID NO: 3977 - DNA, 28 bp, Homo sapiens
caggaggcaggtgctgcccgtctgcaac

SEQ ID NO: 3978 - DNA, 28 bp, Homo sapiens
acggtcctgagatgagcctcatccctgg

SEQ ID NO: 3979 - DNA, 32 bp, Homo sapiens
gaagccaggaggcggaggttgcagtgagccga

SEQ ID NO: 3980 - DNA, 32 bp, Homo sapiens
cctccgccttcctggttcaagtgattctcctg

SEQ ID NO: 3981 - DNA, 32 bp, Homo sapiens
tgggctgagccaccttgtgagtgcagttactg

SEQ ID NO: 3982 - DNA, 32 bp, Homo sapiens
ccaggctcaggtgatcctcccacctcagcctc

SEQ ID NO: 3983 - DNA, 32 bp, Homo sapiens
catggctgcctgtaatcccagcactttgggag

SEQ ID NO: 3984 - DNA, 32 bp, Homo sapiens
aatatacaatgatcctggaaattgcagtaaca

SEQ ID NO: 3985 - DNA, 32 bp, Homo sapiens
tagttggctttgtctgtcaggtgcagtctggc

SEQ ID NO: 3986 - DNA, 32 bp, Homo sapiens
gggataggtagaggagagagacagcaagaaaa

SEQ ID NO: 3987 - DNA, 32 bp, Homo sapiens
ggtttgcttaaaggagcttggctggtttgggc

SEQ ID NO: 3988 - DNA, 32 bp, Homo sapiens
agagagcagctttaaactcagggacagagcca

SEQ ID NO: 3989 - DNA, 32 bp, Homo sapiens
ttctctgacccagcgttgcttctgcctctcat

SEQ ID NO: 3990 - DNA, 32 bp, Homo sapiens
cgaggcctcgggaagctgaattttccttgacg

SEQ ID NO: 3991 - DNA, 32 bp, Homo sapiens
gaaccttctccctcgtacagcacaggaacctg

SEQ ID NO: 3992 - DNA, 24 bp, Homo sapiens
gtcacccagactggaatgcagtga

SEQ ID NO: 3993 - DNA, 32 bp, Homo sapiens
taagactataatcccttaaatattttagaaga

SEQ ID NO: 3994 - DNA, 32 bp, Homo sapiens
ttgagatggagtttcattcttgttgcctaggc

SEQ ID NO: 3995 - DNA, 23 bp, Homo sapiens
tggcgcgatttcagctcactgca

SEQ ID NO: 3996 - DNA, 32 bp, Homo sapiens
ctctctaacccgagctagagtgcagtgacgcg

SEQ ID NO: 3997 - DNA, 32 bp, Homo sapiens
ctctcattgcccaggctggagtgcagtgagct

SEQ ID NO: 3998 - DNA, 32 bp, Homo sapiens
aggagaccccaaatttgacaccacagaaagca

SEQ ID NO: 3999 - DNA, 32 bp, Homo sapiens
cactgtcacccgggctggagtgcaatggctcg

SEQ ID NO: 4000 - DNA, 32 bp, Homo sapiens
tttcctccattgttgtaaaacatgtgttttgc

SEQ ID NO: 4001 - DNA, 32 bp, Homo sapiens
gcccgtgaatagtgacaaaacatggtttgcag

SEQ ID NO: 4002 - DNA, 32 bp, Homo sapiens
aagcaggggcggcagaggctcaacgggatgct

SEQ ID NO: 4003 - DNA, 32 bp, Homo sapiens
taacccaaaaggcggaggttgcagtgagccaa

SEQ ID NO: 4004 - DNA, 32 bp, Homo sapiens
ccgctggtcccaggctggattgccgtggcaca

SEQ ID NO: 4005 - DNA, 32 bp, Homo sapiens
agcctctcgagtagctgggattacaggcgcat

SEQ ID NO: 4006 - DNA, 32 bp, Homo sapiens
caagagaattgtaaaatgttgtggaaaatgat

SEQ ID NO: 4007 - DNA, 32 bp, Homo sapiens
attgagactggctgctgatgcaccttggtaat

SEQ ID NO: 4008 - DNA, 32 bp, Homo sapiens
ccgggcccaggtagtcctcccacctcagcctc

SEQ ID NO: 4009 - DNA, 32 bp, Homo sapiens
tgccaggggcctgggggtgggtctcttgctgt

SEQ ID NO: 4010 - DNA, 32 bp, Homo sapiens
gacagcttcgctctttctcttcctgcctttcc

SEQ ID NO: 4011 - DNA, 32 bp, Homo sapiens
gatcggatttgcttttctcttctgcctcggat

SEQ ID NO: 4012 - DNA, 32 bp, Homo sapiens
gagcagaagaattgagaaagagaatgagacca

SEQ ID NO: 4013 - DNA, 21 bp, Homo sapiens
cgcccaggctggagtgcagtg

SEQ ID NO: 4014 - DNA, 32 bp, Homo sapiens
ctttgttacccaggctggagtacagtggtgtc

SEQ ID NO: 4015 - DNA, 24 bp, Homo sapiens
ctgtcctccaggctggagtgcaat

SEQ ID NO: 4016 - DNA, 32 bp, Homo sapiens
tggttcaaagtctttgctattgtgaataatgc

SEQ ID NO: 4017 - DNA, 20 bp, Homo sapiens
ggcaatctcggctcactgca

SEQ ID NO: 4018 - DNA, 32 bp, Homo sapiens
ctttccgtgcgcgagtgcacagctccggaggc

SEQ ID NO: 4019 - DNA, 32 bp, Homo sapiens
gctctgtcacccaggctggggtgcagtggcgc

SEQ ID NO: 4020 - DNA, 32 bp, Homo sapiens
actctgtcgcccaggctggagtgcagtagcgc

SEQ ID NO: 4021 - DNA, 32 bp, Homo sapiens
cattcagatacttggtcatttacttaccaaat

SEQ ID NO: 4022 - DNA, 32 bp, Homo sapiens
actctgtcccccaggctggagtgcagtggcgc

SEQ ID NO: 4023 - DNA, 32 bp, Homo sapiens
actctgtcgcccaggctggggtgcagtggcgc

SEQ ID NO: 4024 - DNA, 32 bp, Homo sapiens
agctccactccttggctggaggcagtgctgag

SEQ ID NO: 4025 - DNA, 32 bp, Homo sapiens
actctgtcgccaggctggagtgcagtggcgtg

SEQ ID NO: 4026 - DNA, 32 bp, Homo sapiens
ctgtgttgcccaggctggagtgcagtagctat

SEQ ID NO: 4027 - DNA, 32 bp, Homo sapiens
tatcttgcctccatatcaatccattctcatga

SEQ ID NO: 4028 - DNA, 32 bp, Homo sapiens
gctctgtcgccaggctggagtgcaatggcgtg

SEQ ID NO: 4029 - DNA, 32 bp, Homo sapiens
ctttgtcccccaggctggagtgcagtggtaca

SEQ ID NO: 4030 - DNA, 32 bp, Homo sapiens
ctctgctgcccaggctggagtacagtgatgtg

SEQ ID NO: 4031 - DNA, 32 bp, Homo sapiens
tctctttcaagtgccttaatccgagccagcag

SEQ ID NO: 4032 - DNA, 32 bp, Homo sapiens
tgaaacgggaggcggaggttgcagtgagccga

SEQ ID NO: 4033 - DNA, 32 bp, Homo sapiens
aaacctgggaggtggaggttgcagtgacccga

SEQ ID NO: 4034 - DNA, 32 bp, Homo sapiens
gtcttgaactcctgggcccaagcaatcttccc

SEQ ID NO: 4035 - DNA, 28 bp, Homo sapiens
tgctccccaagtgggcctgatttagcag

SEQ ID NO: 4036 - DNA, 32 bp, Homo sapiens
ggccaccccagggccattaacaaccagtactc

SEQ ID NO: 4037 - DNA, 32 bp, Homo sapiens
ccttcacaagggtcaagcaattgtgcttgggt

SEQ ID NO: 4038 - DNA, 32 bp, Homo sapiens
gtctccacctcctgagctcaagcaattctcat

SEQ ID NO: 4039 - DNA, 32 bp, Homo sapiens
gtcacccatcattcttgcgtgttgtatgcttt

SEQ ID NO: 4040 - DNA, 32 bp, Homo sapiens
aacttgaagtttgaaacccccagcttgctgag

SEQ ID NO: 4041 - DNA, 32 bp, Homo sapiens
agcctcccaagtagctgggattacaggcacag

SEQ ID NO: 4042 - DNA, 32 bp, Homo sapiens
ctgccaggaagaggaggggaggaggaggagga

SEQ ID NO: 4043 - DNA, 32 bp, Homo sapiens
ctgacctcaagtgatcggcccacctcagcctc

SEQ ID NO: 4044 - DNA, 32 bp, Homo sapiens
ctgaactcaggctgtctgcccacctcagcctc

SEQ ID NO: 4045 - DNA, 24 bp, Homo sapiens
tcacgcctctaatctcagcacttt

SEQ ID NO: 4046 - DNA, 32 bp, Homo sapiens
aaccatagaagagaggaagaaaacaaagggca

SEQ ID NO: 4047 - DNA, 32 bp, Homo sapiens
aggtggagaagaggtacaaaggaaaacgagag

SEQ ID NO: 4048 - DNA, 32 bp, Homo sapiens
acaacctcagcagcttctccctgtcttcctct

SEQ ID NO: 4049 - DNA, 32 bp, Homo sapiens
tttcaccattttctccccacttccagtgactg

SEQ ID NO: 4050 - DNA, 32 bp, Homo sapiens
aatttcttttagctccccatctggctgtgaaa

SEQ ID NO: 4051 - DNA, 32 bp, Homo sapiens
caaacaccagaaggagctgtctggaaggtttg

SEQ ID NO: 4052 - DNA, 32 bp, Homo sapiens
ccacatccccaggcataacaccaccttcccac

SEQ ID NO: 4053 - DNA, 32 bp, Homo sapiens
cagggactactgcacccgcttctgccttgttt

SEQ ID NO: 4054 - DNA, 23 bp, Homo sapiens
tggcgctatcttggctcactgca

SEQ ID NO: 4055 - DNA, 32 bp, Homo sapiens
tagaaaggagcctctttcttaaaaccaaccaa

SEQ ID NO: 4056 - DNA, 32 bp, Homo sapiens
ctctgtggcccaggctgaagtgcagtggtgtg

SEQ ID NO: 4057 - DNA, 32 bp, Homo sapiens
tctctgtcgcccaggctggagtgcagtggctc

SEQ ID NO: 4058 - DNA, 19 bp, Homo sapiens
cagggactgactccagccc

SEQ ID NO: 4059 - DNA, 32 bp, Homo sapiens
tccaaatggagtttcgctctcgttgccgaggc

SEQ ID NO: 4060 - DNA, 32 bp, Homo sapiens
gaacccgggaggtggagcttgcagtgagctga

SEQ ID NO: 4061 - DNA, 32 bp, Homo sapiens
gaacctgggaggtggagcttgcagtgagccga

SEQ ID NO: 4062 - DNA, 32 bp, Homo sapiens
gctcaaagccaactgtatgtgctgactgggtg

SEQ ID NO: 4063 - DNA, 32 bp, Homo sapiens
tgcctctgaagcacctgctcacagaagggtga

SEQ ID NO: 4064 - DNA, 32 bp, Homo sapiens
ccgagcaggcctggccgcgctctccccgcttc

SEQ ID NO: 4065 - DNA, 32 bp, Homo sapiens
cgctccccgcctgggagctcagctttcctcag

SEQ ID NO: 4066 - DNA, 32 bp, Homo sapiens
tggggtcaaggaacaggaagctgacctggatg

SEQ ID NO: 4067 - DNA, 32 bp, Homo sapiens
aaaggaaaggagacagaatgagctttggttat

SEQ ID NO: 4068 - DNA, 32 bp, Homo sapiens
cggagctcaagcagtcttcccaccttggcctc

SEQ ID NO: 4069 - DNA, 32 bp, Homo sapiens
tgggaggctgaagcaggagaatcactttaacc

SEQ ID NO: 4070 - DNA, 31 bp, Homo sapiens
ccaacttgcaacacaagaccctaggagggag

SEQ ID NO: 4071 - DNA, 32 bp, Homo sapiens
gcagccagaagaggtgggaaaagcggaggagg

SEQ ID NO: 4072 - DNA, 32 bp, Homo sapiens
cacctgaggttagaagtttgagaccagcctgg

SEQ ID NO: 4073 - DNA, 21 bp, Homo sapiens
agttgttaacttctacattca

SEQ ID NO: 4074 - DNA, 32 bp, Homo sapiens
tgcagattctcattagcttcagctgggtcatg

SEQ ID NO: 4075 - DNA, 24 bp, Homo sapiens
ctgtcgctcaggctggagtgcagt

SEQ ID NO: 4076 - DNA, 32 bp, Homo sapiens
gcccgctgccctctgtcatcccattcaagatt

SEQ ID NO: 4077 - DNA, 31 bp, Homo sapiens
gaagtggccttgctgctctcaggcccggcca

SEQ ID NO: 4078 - DNA, 32 bp, Homo sapiens
ttatgtcatcccttcttctccagacagaagat

SEQ ID NO: 4079 - DNA, 32 bp, Homo sapiens
ctctgtcatccaaactggagtgcagtggcaca

SEQ ID NO: 4080 - DNA, 32 bp, Homo sapiens
ctctgttgcccaaggtagagtgcagtggcgtg

SEQ ID NO: 4081 - DNA, 32 bp, Homo sapiens
tcacccaggctggaatgcagtgcagtggcaca

SEQ ID NO: 4082 - DNA, 32 bp, Homo sapiens
gagcccaggaggtcgaggctgcagtgagccct

SEQ ID NO: 4083 - DNA, 32 bp, Homo sapiens
gaaccagggaggcagaggttgtggtgagccga

SEQ ID NO: 4084 - DNA, 32 bp, Homo sapiens
gaacccgggaggctaaggttgcagtgagccga

SEQ ID NO: 4085 - DNA, 28 bp, Homo sapiens
cgtccaccgtctgctgcctacatccgcc

SEQ ID NO: 4086 - DNA, 28 bp, Homo sapiens
agagccccaggtgctgccccttctctcc

SEQ ID NO: 4087 - DNA, 32 bp, Homo sapiens
gaacctgggaggccaaggttgcagtgagccga

SEQ ID NO: 4088 - DNA, 32 bp, Homo sapiens
tgcggtagaagaggaagggaaacacgaacaaa

SEQ ID NO: 4089 - DNA, 32 bp, Homo sapiens
cacagcagtgaacaaacccccactccgttgta

SEQ ID NO: 4090 - DNA, 32 bp, Homo sapiens
gcctcaccaaagtgttgggattactggtgtga

SEQ ID NO: 4091 - DNA, 32 bp, Homo sapiens
agggatcgacaggcacctcttctgcctttact

SEQ ID NO: 4092 - DNA, 32 bp, Homo sapiens
tttcgccatcttctccatggaccactatatac

SEQ ID NO: 4093 - DNA, 32 bp, Homo sapiens
cctctccgtcttctcccctccttcttccccac

SEQ ID NO: 4094 - DNA, 32 bp, Homo sapiens
aaaagaagagcctctttctgcagccgacttag

SEQ ID NO: 4095 - DNA, 32 bp, Homo sapiens
tcttgttgcccaggctgggagggcaatggcac

SEQ ID NO: 4096 - DNA, 32 bp, Homo sapiens
gctctgtcaccaggctggagtgcagtggcgcg

SEQ ID NO: 4097 - DNA, 32 bp, Homo sapiens
ccctgccgcccaggctagagtgcagtggcacg

SEQ ID NO: 4098 - DNA, 32 bp, Homo sapiens
ggaaacccactgtctgaagaccacagaggggt

SEQ ID NO: 4099 - DNA, 32 bp, Homo sapiens
ttcttagacattttgtcataccattctagaag

SEQ ID NO: 4100 - DNA, 32 bp, Homo sapiens
tgacctccccatcagcctgtgctgctaggtct

SEQ ID NO: 4101 - DNA, 32 bp, Homo sapiens
ttaatgtcttaatgattggtgctgctaacttg

SEQ ID NO: 4102 - DNA, 32 bp, Homo sapiens
gctctgtcgccaggctggagtgcaatggcgcg

SEQ ID NO: 4103 - DNA, 32 bp, Homo sapiens
gtctccaactcctcgcctcaagcaattcgccc

SEQ ID NO: 4104 - DNA, 28 bp, Homo sapiens
tatgtgtccaatgctgccttcccatgaa

SEQ ID NO: 4105 - DNA, 32 bp, Homo sapiens
gcatccaggagatagaagttgcagtgagctga

SEQ ID NO: 4106 - DNA, 32 bp, Homo sapiens
cggctgtgcgctccctgctcccacgggccggt

SEQ ID NO: 4107 - DNA, 32 bp, Homo sapiens
caaccacaaggcaacttcctggctttttacaa

SEQ ID NO: 4108 - DNA, 32 bp, Homo sapiens
gcctctgcctcctgggttccaagcgattctcc

SEQ ID NO: 4109 - DNA, 32 bp, Homo sapiens
gttcttcataggagagcaactgtaggtgatca

SEQ ID NO: 4110 - DNA, 32 bp, Homo sapiens
ctgagctcaagcaatcctcccgactcggcttc

SEQ ID NO: 4111 - DNA, 32 bp, Homo sapiens
tccccagctctacaaaccaggacagctgaatc

SEQ ID NO: 4112 - DNA, 32 bp, Homo sapiens
ttttgcagcccaggctggagtgcagtggcacc

SEQ ID NO: 4113 - DNA, 22 bp, Homo sapiens
tgtggggaagaaaagatagggg

SEQ ID NO: 4114 - DNA, 32 bp, Homo sapiens
agataattcttctcccctgactggacctctgg

SEQ ID NO: 4115 - DNA, 32 bp, Homo sapiens
ttgagatggagttttcactcttatcgcccagg

SEQ ID NO: 4116 - DNA, 32 bp, Homo sapiens
tctgcccatccctcttcattcacacacagttc

SEQ ID NO: 4117 - DNA, 20 bp, Homo sapiens
cagcagcagaaagctcaaag

SEQ ID NO: 4118 - DNA, 22 bp, Homo sapiens
caggaaattagctttccagccc

SEQ ID NO: 4119 - DNA, 32 bp, Homo sapiens
aaaccacggagttctgctcttgttgcccaggt

SEQ ID NO: 4120 - DNA, 32 bp, Homo sapiens
tagggacgaagtttcactcttgttgcccaggc

SEQ ID NO: 4121 - DNA, 32 bp, Homo sapiens
cttccaccagttctgttctgcaggtcgggagt

SEQ ID NO: 4122 - DNA, 32 bp, Homo sapiens
gaattgagagccactgctatagctgatccttc

SEQ ID NO: 4123 - DNA, 32 bp, Homo sapiens
gggaacttcagcactactgtgaaagagacaat

SEQ ID NO: 4124 - DNA, 32 bp, Homo sapiens
ctactcgggaggctgaggcaggagaatagcgt

SEQ ID NO: 4125 - DNA, 32 bp, Homo sapiens
agagaagggccaaggccgggtgcagtggttca

SEQ ID NO: 4126 - DNA, 32 bp, Homo sapiens
ccagtgtaatttctgtcaaccacggacgtttg

SEQ ID NO: 4127 - DNA, 32 bp, Homo sapiens
ctactcgggaggctaaggcaggagaatcgctt

SEQ ID NO: 4128 - DNA, 32 bp, Homo sapiens
gaacctcagaggcagaggttgcaatgaagcgg

SEQ ID NO: 4129 - DNA, 32 bp, Homo sapiens
ctcgggaaagggcagaggtcactgggggtggg

SEQ ID NO: 4130 - DNA, 32 bp, Homo sapiens
gacaaggtctgtggcttcctggaaatgtcact

SEQ ID NO: 4131 - DNA, 32 bp, Homo sapiens
acctctgcctcctgggtttaagcgattctcct

SEQ ID NO: 4132 - DNA, 32 bp, Homo sapiens
gggtctcacctgtcgctggagtgcagtggtgt

SEQ ID NO: 4133 - DNA, 24 bp, Homo sapiens
ctgttgcccaggctggagtgcgat

SEQ ID NO: 4134 - DNA, 32 bp, Homo sapiens
tgctgactggagagctgggaatatggcatttg

SEQ ID NO: 4135 - DNA, 24 bp, Homo sapiens
tcacacttatcatctcagcacttt

SEQ ID NO: 4136 - DNA, 32 bp, Homo sapiens
ggaccaggagaagagcaaagaaaagcagcccg

SEQ ID NO: 4137 - DNA, 32 bp, Homo sapiens
gctctgtcacccagactagagtgcagtggcac

SEQ ID NO: 4138 - DNA, 32 bp, Homo sapiens
atggacctcaggtcagcttcagcgtgagaagc

SEQ ID NO: 4139 - DNA, 24 bp, Homo sapiens
ctgttacccaggctggagtgcaat

SEQ ID NO: 4140 - DNA, 32 bp, Homo sapiens
tactctgctgtaggaaagcctttgccaatgct

SEQ ID NO: 4141 - DNA, 23 bp, Homo sapiens
gtcgcccaggctggagtacaatg

SEQ ID NO: 4142 - DNA, 23 bp, Homo sapiens
ggcaaaagtccacatagctctcc

SEQ ID NO: 4143 - DNA, 32 bp, Homo sapiens
actctgtcaccaggctggagtgcagtgccgca

SEQ ID NO: 4144 - DNA, 32 bp, Homo sapiens
ctcttgttgcccaggctggagtgcaatagcat

SEQ ID NO: 4145 - DNA, 32 bp, Homo sapiens
ctggaaagtctgctgcttctccaagctttcag

SEQ ID NO: 4146 - DNA, 23 bp, Homo sapiens
gtcacccagactggagtgcgatg

SEQ ID NO: 4147 - DNA, 32 bp, Homo sapiens
gtcacactctccaggctggagtgcagtggcac

SEQ ID NO: 4148 - DNA, 32 bp, Homo sapiens
tcacttttgcccaggctggagtgcagtggcgt

SEQ ID NO: 4149 - DNA, 32 bp, Homo sapiens
actctgtcgcccaggctagagtgcagtggcgc

SEQ ID NO: 4150 - DNA, 32 bp, Homo sapiens
ctactcgggaggctgaggcaggagaatagcct

SEQ ID NO: 4151 - DNA, 32 bp, Homo sapiens
ctgtgtcccccaggctggagtgcagtggcaca

SEQ ID NO: 4152 - DNA, 32 bp, Homo sapiens
cgggacaaagagactgttggtaactgtggatt

SEQ ID NO: 4153 - DNA, 32 bp, Homo sapiens
ccaaggaccgcagtgaggaggaatgtaccact

SEQ ID NO: 4154 - DNA, 32 bp, Homo sapiens
aagtctgggaggttgaggctgcagtgagctgt

SEQ ID NO: 4155 - DNA, 32 bp, Homo sapiens
ctgcttgggaggcacaggtcctgggacatgaa

SEQ ID NO: 4156 - DNA, 32 bp, Homo sapiens
acttctgcctcctgggttcaagcgattctcct

SEQ ID NO: 4157 - DNA, 32 bp, Homo sapiens
aagagaccccgtgccctttaaccggcatttgc

SEQ ID NO: 4158 - DNA, 32 bp, Homo sapiens
tgtgtaccaagtgctgtccttgacaagaagac

SEQ ID NO: 4159 - DNA, 32 bp, Homo sapiens
aaacaaagattctgccaactgtggaaacttca

SEQ ID NO: 4160 - DNA, 32 bp, Homo sapiens
taacatgagtaagatgaactggaacacaaaat

SEQ ID NO: 4161 - DNA, 32 bp, Homo sapiens
gcttcaacttcctgggctcaagtaatcctccc

SEQ ID NO: 4162 - DNA, 32 bp, Homo sapiens
aaagggagaagagggaaaacagaaaacctgat

SEQ ID NO: 4163 - DNA, 32 bp, Homo sapiens
actcttagaagagagaaaataaggtttcataa

SEQ ID NO: 4164 - DNA, 32 bp, Homo sapiens
tcctgcaggcctgagggggcttccctctgctt

SEQ ID NO: 4165 - DNA, 32 bp, Homo sapiens
tgcccatggtgggagcgtggtcactgtgcagt

SEQ ID NO: 4166 - DNA, 32 bp, Homo sapiens
cctctcgacggcctctccaggtgcaaaacttc

SEQ ID NO: 4167 - DNA, 31 bp, Homo sapiens
acgaacaggccaataaggagggagcagtgcg

SEQ ID NO: 4168 - DNA, 21 bp, Homo sapiens
ctgaccaacatggcgaaaccc

SEQ ID NO: 4169 - DNA, 32 bp, Homo sapiens
gtcactgtgctgctctgcagagttacttcagg

SEQ ID NO: 4170 - DNA, 32 bp, Homo sapiens
ttctgttgcccaggctggagtgcagtggcgtg

SEQ ID NO: 4171 - DNA, 32 bp, Homo sapiens
ttctgtcgcccaggctggagtgcagtggcgcg

SEQ ID NO: 4172 - DNA, 32 bp, Homo sapiens
attgccatctccattcctctgccctcttgagc

SEQ ID NO: 4173 - DNA, 32 bp, Homo sapiens
ctcttgtttcccaggctggagtgcaatgggtg

SEQ ID NO: 4174 - DNA, 32 bp, Homo sapiens
ctctgtcatccaggctggagtgcagtggcgca

SEQ ID NO: 4175 - DNA, 32 bp, Homo sapiens
tcttgttgtccaggctggagtgcaatggcgca

SEQ ID NO: 4176 - DNA, 32 bp, Homo sapiens
ttgtgttccccaggctgaagtgcagtggcatg

SEQ ID NO: 4177 - DNA, 32 bp, Homo sapiens
tagaacgggaggctgctgaagtgagtagctga

SEQ ID NO: 4178 - DNA, 32 bp, Homo sapiens
cgccgtcgcccaggcgccccgcaatgtagctg

SEQ ID NO: 4179 - DNA, 32 bp, Homo sapiens
ttctgtcacccaggctggagtgcagtggcgca

SEQ ID NO: 4180 - DNA, 32 bp, Homo sapiens
aacagtggaagcaagaggttggggtgatgtgg

SEQ ID NO: 4181 - DNA, 32 bp, Homo sapiens
gttgcaatgaagcggaggttgcagtgagccga

SEQ ID NO: 4182 - DNA, 32 bp, Homo sapiens
ctacacgggaggctgaggcaggagaatggcgt

SEQ ID NO: 4183 - DNA, 32 bp, Homo sapiens
acctctgcctcttgggttcaagcaattcttct

SEQ ID NO: 4184 - DNA, 32 bp, Homo sapiens
aaattacctggagtgaggattacttgtaatta

SEQ ID NO: 4185 - DNA, 32 bp, Homo sapiens
caacccaggaggcagacgttgcagcgagccaa

SEQ ID NO: 4186 - DNA, 32 bp, Homo sapiens
attttgagatggtggaatctgtggaaactttc

SEQ ID NO: 4187 - DNA, 32 bp, Homo sapiens
cattttggaagagacgaaagaaaggaaaataa

SEQ ID NO: 4188 - DNA, 32 bp, Homo sapiens
gggaggaccgctaactggtgcaccttgtcctt

SEQ ID NO: 4189 - DNA, 32 bp, Homo sapiens
agcctcctgagtaactgggactgtaaacatga

SEQ ID NO: 4190 - DNA, 32 bp, Homo sapiens
ccggctcatcaaggaggccgtctgggaaaaga

SEQ ID NO: 4191 - DNA, 32 bp, Homo sapiens
cttctttgttgtgtcctcgaatggcagaaaaa

SEQ ID NO: 4192 - DNA, 32 bp, Homo sapiens
tttccccatcttcttctttcagatcattaatg

SEQ ID NO: 4193 - DNA, 32 bp, Homo sapiens
agcctagatccctcgcatgcacagttcatagt

SEQ ID NO: 4194 - DNA, 32 bp, Homo sapiens
ttctgttgcccaggctggagtgcagtggtgcg

SEQ ID NO: 4195 - DNA, 32 bp, Homo sapiens
atttagtgcccagggagtccagcgaatgacgt

SEQ ID NO: 4196 - DNA, 32 bp, Homo sapiens
aaagctcgcccagggctgggtgcagtggctca

SEQ ID NO: 4197 - DNA, 32 bp, Homo sapiens
accctattgcccaggctggagtgcaatggcgt

SEQ ID NO: 4198 - DNA, 23 bp, Homo sapiens
cttgtttttctccttttggtgta

SEQ ID NO: 4199 - DNA, 32 bp, Homo sapiens
ttgctacaatcttgacccctttgctacattcc

SEQ ID NO: 4200 - DNA, 29 bp, Homo sapiens
ggccatggcccaggccggcgtcgtcggtg

SEQ ID NO: 4201 - DNA, 32 bp, Homo sapiens
tcacaatgtgaagctgtgggtgcagtggcgcc

SEQ ID NO: 4202 - DNA, 32 bp, Homo sapiens
cagctgcaggcaagcattatgctgctattgaa

SEQ ID NO: 4203 - DNA, 32 bp, Homo sapiens
ttgtgtcacccaggctggagtgcaatggcgca

SEQ ID NO: 4204 - DNA, 32 bp, Homo sapiens
acctatcacccaggctggagtggagtggcacg

SEQ ID NO: 4205 - DNA, 28 bp, Homo sapiens
tggggtcgggtcactgcctcatccaccg

SEQ ID NO: 4206 - DNA, 32 bp, Homo sapiens
ctactcgggaggctgaggcgggagcatggcat

SEQ ID NO: 4207 - DNA, 32 bp, Homo sapiens
gccccggggaggcaggctggcaggtggacagg

SEQ ID NO: 4208 - DNA, 32 bp, Homo sapiens
cctgcaacatcagcgtgggccgctaggactcc

SEQ ID NO: 4209 - DNA, 32 bp, Homo sapiens
ccgtgcttgtactgctagaagcactttatgtt

SEQ ID NO: 4210 - DNA, 32 bp, Homo sapiens
ggctcatgcctgtaatctgagcactttgggag

SEQ ID NO: 4211 - DNA, 32 bp, Homo sapiens
aaccgtcaacatcagtgttgtaaatttgctaa

SEQ ID NO: 4212 - DNA, 32 bp, Homo sapiens
cccctcagtctcctccccatcaccctcctcag

SEQ ID NO: 4213 - DNA, 27 bp, Homo sapiens
tcacacctgtgatccccccagcacttt

SEQ ID NO: 4214 - DNA, 32 bp, Homo sapiens
ggaacactgtcaatggactgcaccttgtgaag

SEQ ID NO: 4215 - DNA, 32 bp, Homo sapiens
gcaacagacaggcttggcaactgtgaatacct

SEQ ID NO: 4216 - DNA, 32 bp, Homo sapiens
ctgaagccagctctgagtcacagggttgcctt

SEQ ID NO: 4217 - DNA, 24 bp, Homo sapiens
acttcctgggaggtcagagacaaa

SEQ ID NO: 4218 - DNA, 32 bp, Homo sapiens
tggggatgagccaggctggggacagtggggct

SEQ ID NO: 4219 - DNA, 32 bp, Homo sapiens
attggaccagttctgctgcctaagaaggtctg

SEQ ID NO: 4220 - DNA, 32 bp, Homo sapiens
ctcttttcttcccttcctttgttttcataagc

SEQ ID NO: 4221 - DNA, 32 bp, Homo sapiens
taagcttcaaaccagactctgtgctgcttctg

SEQ ID NO: 4222 - DNA, 32 bp, Homo sapiens
gtttatgcctccattgccccagttcttatctg

SEQ ID NO: 4223 - DNA, 32 bp, Homo sapiens
gccgtgtcatccaggctggagtgcggtggtgg

SEQ ID NO: 4224 - DNA, 32 bp, Homo sapiens
gtctcaaactcctgggttcaagcaatcctccc

SEQ ID NO: 4225 - DNA, 32 bp, Homo sapiens
gagcccaggaggttgaggctgcagtgaggtgt

SEQ ID NO: 4226 - DNA, 32 bp, Homo sapiens
ggaagaggcaggcagaggctgaggctgattcc

SEQ ID NO: 4227 - DNA, 32 bp, Homo sapiens
gagcctgtgaccacctgtgctgtggagatgga

SEQ ID NO: 4228 - DNA, 32 bp, Homo sapiens
cccgggtcaagcaattctcctgcctcagcttc

SEQ ID NO: 4229 - DNA, 32 bp, Homo sapiens
ctgggctcaagcaatcctcccacctcccagtg

SEQ ID NO: 4230 - DNA, 32 bp, Homo sapiens
ccaaaacatcattatgtggcacatgattataa

SEQ ID NO: 4231 - DNA, 21 bp, Homo sapiens
tcagaaggaaattgggtccag

SEQ ID NO: 4232 - DNA, 32 bp, Homo sapiens
cccgagcgccttctccccaggaccccggtgtc

SEQ ID NO: 4233 - DNA, 24 bp, Homo sapiens
tcacgcctgtaatgccagcacttt

SEQ ID NO: 4234 - DNA, 32 bp, Homo sapiens
cgctgttgcccaggctggagtgcagtggcgtg

SEQ ID NO: 4235 - DNA, 21 bp, Homo sapiens
ctgtcacccaggctggagtgc

SEQ ID NO: 4236 - DNA, 32 bp, Homo sapiens
attctctcagcggtctctcttctcctcaagtt

SEQ ID NO: 4237 - DNA, 23 bp, Homo sapiens
tggcgcgatctccgctcactgca

SEQ ID NO: 4238 - DNA, 32 bp, Homo sapiens
taaatgttgctgctgggtagctccacagtgtt

SEQ ID NO: 4239 - DNA, 32 bp, Homo sapiens
ctggctgtgctgctggctgcaaatctatcccc

SEQ ID NO: 4240 - DNA, 32 bp, Homo sapiens
agggaaaatgttcattcttcatcagctttgct

SEQ ID NO: 4241 - DNA, 32 bp, Homo sapiens
agactcctattttcctttctgttttcaggcct

SEQ ID NO: 4242 - DNA, 32 bp, Homo sapiens
tgttcagcagaacaccaccactgtgacatggg

SEQ ID NO: 4243 - DNA, 32 bp, Homo sapiens
cagactcacatcctgaccttgcacaaacagcc

SEQ ID NO: 4244 - DNA, 32 bp, Homo sapiens
taggaggctctgggcggaggtgcagtgacccc

SEQ ID NO: 4245 - DNA, 32 bp, Homo sapiens
tcctccgcggcgggtttgggtgcagtggaccc

SEQ ID NO: 4246 - DNA, 32 bp, Homo sapiens
gaaccagggaggtggaggttgcagtgagccga

SEQ ID NO: 4247 - DNA, 32 bp, Homo sapiens
gaacccgggaggcagaggttgcagtgagtgga

SEQ ID NO: 4248 - DNA, 32 bp, Homo sapiens
ctgtgtcaccaaggctggagggcaatagcatg

SEQ ID NO: 4249 - DNA, 32 bp, Homo sapiens
aggacctggaggggtgctctgtggaaactgct

SEQ ID NO: 4250 - DNA, 32 bp, Homo sapiens
ggctcatgcctgtcatcccagcactttgggaa

SEQ ID NO: 4251 - DNA, 32 bp, Homo sapiens
tgacaggagcttgggagctcgggagcttggga

SEQ ID NO: 4252 - DNA, 24 bp, Homo sapiens
ctgtcgcccaagctggagtgcagt

SEQ ID NO: 4253 - DNA, 32 bp, Homo sapiens
cacttgcctcaaggctttatatttggctgctt

SEQ ID NO: 4254 - DNA, 22 bp, Homo sapiens
tgcggggagatttgagagggga

SEQ ID NO: 4255 - DNA, 32 bp, Homo sapiens
gagtggatcatctcttggaaatgcagaacttc

SEQ ID NO: 4256 - DNA, 32 bp, Homo sapiens
tctttttgcccaggccggagtgcaatggcacg

SEQ ID NO: 4257 - DNA, 32 bp, Homo sapiens
ctcccagtgctgctgtcctctgatccaccctc

SEQ ID NO: 4258 - DNA, 32 bp, Homo sapiens
tagaattgcccagtgctgccagagtgagtgag

SEQ ID NO: 4259 - DNA, 32 bp, Homo sapiens
acctccacttcctaggttcaagcaattctcct

SEQ ID NO: 4260 - DNA, 32 bp, Homo sapiens
gagcccaggaggtggaggttgcagtgagccat

SEQ ID NO: 4261 - DNA, 32 bp, Homo sapiens
actggctgcccaggctgaatggcagtgcctgg

SEQ ID NO: 4262 - DNA, 32 bp, Homo sapiens
caatcttcaagcaatcttggaatcctcaactg

SEQ ID NO: 4263 - DNA, 32 bp, Homo sapiens
ccaggctcaagtgatcctcccacctcagcctc

SEQ ID NO: 4264 - DNA, 32 bp, Homo sapiens
ctgatcccatttctccccaccctggggctctt

SEQ ID NO: 4265 - DNA, 31 bp, Homo sapiens
cttgagatgggaggagaacggaaggaaaaca

SEQ ID NO: 4266 - DNA, 32 bp, Homo sapiens
gctgtgttgccctgactggagttcagtggtgc

SEQ ID NO: 4267 - DNA, 32 bp, Homo sapiens
gttttgcagctttgtacaagtaacataaattg

SEQ ID NO: 4268 - DNA, 32 bp, Homo sapiens
tactctctctcctaaagacaccaccttcctgc

SEQ ID NO: 4269 - DNA, 23 bp, Homo sapiens
caaaaggaggcgaatgggctcag

SEQ ID NO: 4270 - DNA, 32 bp, Homo sapiens
ccataggctgagatgaggcacagggtctggtt

SEQ ID NO: 4271 - DNA, 32 bp, Homo sapiens
ctgtgttgcccaggctggagtgcaaatggctt

SEQ ID NO: 4272 - DNA, 32 bp, Homo sapiens
agtggttgcccaggcctagtttcagtggcaga

SEQ ID NO: 4273 - DNA, 32 bp, Homo sapiens
attccaagctggcactgccactgtggagggcg

SEQ ID NO: 4274 - DNA, 21 bp, Homo sapiens
cgacagccacgtgggccgaga

SEQ ID NO: 4275 - DNA, 32 bp, Homo sapiens
ttgagacggagtttcgcttttgtcccccaagc

SEQ ID NO: 4276 - DNA, 32 bp, Homo sapiens
ctctctgtcgccaggctggaatgcagtgcagt

SEQ ID NO: 4277 - DNA, 32 bp, Homo sapiens
accacgttgcccaggctggtctccagctcctg

SEQ ID NO: 4278 - DNA, 32 bp, Homo sapiens
gtaaaaagtacactttaaaatattttaatcag

SEQ ID NO: 4279 - DNA, 32 bp, Homo sapiens
aagaagaaggtgggaggatgtgaattgttagt

SEQ ID NO: 4280 - DNA, 32 bp, Homo sapiens
ccacgagcctccatccgttctggttcgggttt

SEQ ID NO: 4281 - DNA, 32 bp, Homo sapiens
acaccgttgcccaggctggagggcagtgacgt

SEQ ID NO: 4282 - DNA, 32 bp, Homo sapiens
ctctgttgtccaggctggagggcagtgacata

SEQ ID NO: 4283 - DNA, 32 bp, Homo sapiens
tgcagattcccaggctgggtgcagtggctcac

SEQ ID NO: 4284 - DNA, 21 bp, Homo sapiens
aggaacaaggagaaagcaatg

SEQ ID NO: 4285 - DNA, 32 bp, Homo sapiens
tatgttaagtcacaaacccacttgacttctgg

SEQ ID NO: 4286 - DNA, 32 bp, Homo sapiens
agtcttccgagtagctgggattacaggcgtgt

SEQ ID NO: 4287 - DNA, 32 bp, Homo sapiens
agcctcccaagtagctgggattacagatgtgt

SEQ ID NO: 4288 - DNA, 32 bp, Homo sapiens
taatggatctactgacattagcactttgtaca

SEQ ID NO: 4289 - DNA, 32 bp, Homo sapiens
gctgctgataggttcaaggaattctttaaacc

SEQ ID NO: 4290 - DNA, 32 bp, Homo sapiens
ttcaagagcccaaaaacagttctcctccatgc

SEQ ID NO: 4291 - DNA, 32 bp, Homo sapiens
ttgtagagggggataaaaagaaaagaaattgg

SEQ ID NO: 4292 - DNA, 32 bp, Homo sapiens
cagaagagatgatggcaatgcaccttgcaggt

SEQ ID NO: 4293 - DNA, 32 bp, Homo sapiens
ctggactcaagcaatcctcccaccttggcctt

SEQ ID NO: 4294 - DNA, 32 bp, Homo sapiens
gtgagccgcatcttctccatctggcagggtgg

SEQ ID NO: 4295 - DNA, 23 bp, Homo sapiens
tcacgcctggaatcccagcactt

SEQ ID NO: 4296 - DNA, 32 bp, Homo sapiens
ttaagaagctaaaaggaaagaaaataaatcta

SEQ ID NO: 4297 - DNA, 32 bp, Homo sapiens
gaaacatctctctcttctccaagcataaagga

SEQ ID NO: 4298 - DNA, 32 bp, Homo sapiens
gctctgtcgccaggctggagtgcagtggcgcg

SEQ ID NO: 4299 - DNA, 32 bp, Homo sapiens
gttaagtaccttgactcaggtgacacagcaat

SEQ ID NO: 4300 - DNA, 32 bp, Homo sapiens
gtccgggagcggggcacccactgtgggtctcc

SEQ ID NO: 4301 - DNA, 32 bp, Homo sapiens
agcccctttctgctgctgcatccctccagtgt

SEQ ID NO: 4302 - DNA, 32 bp, Homo sapiens
agaaatcacatttttggccaggcacagtggct

SEQ ID NO: 4303 - DNA, 32 bp, Homo sapiens
gctggcggactcaggctggggtctgcagtgca

SEQ ID NO: 4304 - DNA, 32 bp, Homo sapiens
gttctgttgcccaggcaagagtgcagtggtat

SEQ ID NO: 4305 - DNA, 32 bp, Homo sapiens
taaccaacggcaagctgccactgtgggcaaag

SEQ ID NO: 4306 - DNA, 32 bp, Homo sapiens
gctctatcgccaggctggagtgtagtggcatg

SEQ ID NO: 4307 - DNA, 32 bp, Homo sapiens
gctctgtcgccaggttggagtgcagtggcgtg

SEQ ID NO: 4308 - DNA, 32 bp, Homo sapiens
tggagttgcccaggccctgtgagcaagtggca

SEQ ID NO: 4309 - DNA, 32 bp, Homo sapiens
gaacccgggaggtggagattgcagtgagctga

SEQ ID NO: 4310 - DNA, 32 bp, Homo sapiens
gaacccaggaagcagaggttgcagtgagctga

SEQ ID NO: 4311 - DNA, 32 bp, Homo sapiens
tctctgttcatggcctgtttgctgctatgagg

SEQ ID NO: 4312 - DNA, 28 bp, Homo sapiens
aaagatccagctgttgcctcattccttg

SEQ ID NO: 4313 - DNA, 32 bp, Homo sapiens
gagcctgggaggcagaggttgcagtgagccaa

SEQ ID NO: 4314 - DNA, 32 bp, Homo sapiens
gaacccgggaagcagaggttgcggtgagctga

SEQ ID NO: 4315 - DNA, 32 bp, Homo sapiens
acctccgcctcctgggttcaaacgattctcct

SEQ ID NO: 4316 - DNA, 32 bp, Homo sapiens
gctctgtcacccaggctgtcgtaagtggcaat

SEQ ID NO: 4317 - DNA, 32 bp, Homo sapiens
agcctcccaagtagctgggaccaccatgccca

SEQ ID NO: 4318 - DNA, 32 bp, Homo sapiens
cagcccaggaattggcagaggaagtaggtgtc

SEQ ID NO: 4319 - DNA, 32 bp, Homo sapiens
ggggcaggttgctaagtcaggtgcagaggttc

SEQ ID NO: 4320 - DNA, 24 bp, Homo sapiens
tcacacctgtaatccctgcacttt

SEQ ID NO: 4321 - DNA, 32 bp, Homo sapiens
gagaggagaagaggaggaggcagaggaagaaa

SEQ ID NO: 4322 - DNA, 21 bp, Homo sapiens
tgtaagacaggaggatgggga

SEQ ID NO: 4323 - DNA, 32 bp, Homo sapiens
ggcctggtgttctaccccatctggcccctggc

SEQ ID NO: 4324 - DNA, 23 bp, Homo sapiens
gggcggcttgtcccaggctgctg

SEQ ID NO: 4325 - DNA, 32 bp, Homo sapiens
actactcagctttctttcagtcaacccataag

SEQ ID NO: 4326 - DNA, 32 bp, Homo sapiens
gtttaccaaaataaaggaaaccacctttgtag

SEQ ID NO: 4327 - DNA, 32 bp, Homo sapiens
taattacccttttgcaggcaccacctttaatc

SEQ ID NO: 4328 - DNA, 21 bp, Homo sapiens
gcacaatctcggctcactgca

SEQ ID NO: 4329 - DNA, 23 bp, Homo sapiens
gtcacccaagctggagtgcagtg

SEQ ID NO: 4330 - DNA, 32 bp, Homo sapiens
ggccaacctcaaggcagtgctctctggtttgc

SEQ ID NO: 4331 - DNA, 32 bp, Homo sapiens
tatagcccagttcttacaagcagagaagccta

SEQ ID NO: 4332 - DNA, 32 bp, Homo sapiens
ggccaagaagcatatgaaaatatgttcaatct

SEQ ID NO: 4333 - DNA, 32 bp, Homo sapiens
aaatataagccttttatactgattattctttt

SEQ ID NO: 4334 - DNA, 32 bp, Homo sapiens
gaacctggtaggcagaggttgcagtgagccga

SEQ ID NO: 4335 - DNA, 32 bp, Homo sapiens
gtcaggagcccaggccagtgagatggggcctg

SEQ ID NO: 4336 - DNA, 32 bp, Homo sapiens
ctaccatcagaaaagaggccaaacttctatca

SEQ ID NO: 4337 - DNA, 32 bp, Homo sapiens
cagcctaggacgttgaggctgcagtgagctgt

SEQ ID NO: 4338 - DNA, 32 bp, Homo sapiens
gaacctgggaggcagatgttgcagtgagccga

SEQ ID NO: 4339 - DNA, 32 bp, Homo sapiens
gaacccaggaggcagaggttgcagcgagctga

SEQ ID NO: 4340 - DNA, 32 bp, Homo sapiens
acctccacctcttatgttcaagcaattctcct

SEQ ID NO: 4341 - DNA, 28 bp, Homo sapiens
tccgcccccagtgctgcgttctccccct

SEQ ID NO: 4342 - DNA, 32 bp, Homo sapiens
cccctcccaagggcccttaaagcgacctgtca

SEQ ID NO: 4343 - DNA, 32 bp, Homo sapiens
agcctcccgagtagctgggattacagacatgt

SEQ ID NO: 4344 - DNA, 32 bp, Homo sapiens
agcctcctgagtagctgggattacagacatgc

SEQ ID NO: 4345 - DNA, 32 bp, Homo sapiens
agcctcccgggtagctgggattacaggcatgt

SEQ ID NO: 4346 - DNA, 32 bp, Homo sapiens
cctcagagacttagatcttccacctcactccc

SEQ ID NO: 4347 - DNA, 32 bp, Homo sapiens
ctcactgttgcctggctggagcactttggttt

SEQ ID NO: 4348 - DNA, 24 bp, Homo sapiens
ctgtcactcaggctggagtacagt

SEQ ID NO: 4349 - DNA, 32 bp, Homo sapiens
agaggagtagaaggtaaaagaaaatgctggga

SEQ ID NO: 4350 - DNA, 32 bp, Homo sapiens
cttggaagaggatgataaagaaaatgataagg

SEQ ID NO: 4351 - DNA, 32 bp, Homo sapiens
tagctaggaagggtttgtagaaaacaagataa

SEQ ID NO: 4352 - DNA, 32 bp, Homo sapiens
taggtgactgtctcctggaaatgttatgcagc

SEQ ID NO: 4353 - DNA, 32 bp, Homo sapiens
agggctggggtctcctggatacaatggagcag

SEQ ID NO: 4354 - DNA, 21 bp, Homo sapiens
atcctcccatccgtgttgtga

SEQ ID NO: 4355 - DNA, 32 bp, Homo sapiens
ctccttagccaagcttctctctgtcttccctc

SEQ ID NO: 4356 - DNA, 32 bp, Homo sapiens
ccttcttctgcagctcctggtgctgcttgtgt

SEQ ID NO: 4357 - DNA, 20 bp, Homo sapiens
tgtggggaggtgggtggaga

SEQ ID NO: 4358 - DNA, 32 bp, Homo sapiens
tctgtttccttctcttctctttcctccctctc

SEQ ID NO: 4359 - DNA, 32 bp, Homo sapiens
ttacccactccatcttctctttccttcttact

SEQ ID NO: 4360 - DNA, 32 bp, Homo sapiens
ggatttgccagcatccctcttctgcttctcag

SEQ ID NO: 4361 - DNA, 32 bp, Homo sapiens
atgcctcctccctctgaccacagggtcatgcc

SEQ ID NO: 4362 - DNA, 32 bp, Homo sapiens
ctctgtggcccaggctggagtgcagtggcgcg

SEQ ID NO: 4363 - DNA, 32 bp, Homo sapiens
ctctgtcgcccaggctggagtgcagtggctcg

SEQ ID NO: 4364 - DNA, 32 bp, Homo sapiens
accttgtagacacttagccatcaagaatcaag

SEQ ID NO: 4365 - DNA, 32 bp, Homo sapiens
gtgtctgtgctgcgtttgtgagctgcaacgct

SEQ ID NO: 4366 - DNA, 17 bp, Homo sapiens
gccagccccacccagga

SEQ ID NO: 4367 - DNA, 32 bp, Homo sapiens
caggtcacaaactccaatctttgtttgggtag

SEQ ID NO: 4368 - DNA, 32 bp, Homo sapiens
ctctgtcgcctaggctgcagtgcagtggcggg

SEQ ID NO: 4369 - DNA, 32 bp, Homo sapiens
gtttccccatttctgtcagagccaagggcttg

SEQ ID NO: 4370 - DNA, 32 bp, Homo sapiens
ctctgtcgcccaggctggagtgcagtggcggg

SEQ ID NO: 4371 - DNA, 32 bp, Homo sapiens
ctctgtggcccaggctggagtgtagtggcgtg

SEQ ID NO: 4372 - DNA, 32 bp, Homo sapiens
ctctgtcgcccaggctggagttcagtggcgcg

SEQ ID NO: 4373 - DNA, 32 bp, Homo sapiens
aaatccagcaggtggaggttgcagtgagccaa

SEQ ID NO: 4374 - DNA, 32 bp, Homo sapiens
ttctgtcctccaggctggagtgcaatgacatg

SEQ ID NO: 4375 - DNA, 32 bp, Homo sapiens
gcccaggctggagtataatggcatgtctcgac

SEQ ID NO: 4376 - DNA, 32 bp, Homo sapiens
gagccttggaggcggaggttgcagtgagctga

SEQ ID NO: 4377 - DNA, 32 bp, Homo sapiens
gaacccgggaagtggaggttgccgtgagtcga

SEQ ID NO: 4378 - DNA, 32 bp, Homo sapiens
ctactcgggaggcggagtcaggagactctctt

SEQ ID NO: 4379 - DNA, 32 bp, Homo sapiens
tcatccccaagtgccccttctgcctcagtcct

SEQ ID NO: 4380 - DNA, 32 bp, Homo sapiens
acatatcccagtgcccttgcctcataatagat

SEQ ID NO: 4381 - DNA, 32 bp, Homo sapiens
acatctcctagagctgggaatgtgtccctaac

SEQ ID NO: 4382 - DNA, 32 bp, Homo sapiens
aaaggctgtaccaatcctctaatatgaaatgt

SEQ ID NO: 4383 - DNA, 32 bp, Homo sapiens
gtctccacctcccgggttcaagcgattctcct

SEQ ID NO: 4384 - DNA, 32 bp, Homo sapiens
agcctcctgagtagctggcactgtaggcatgt

SEQ ID NO: 4385 - DNA, 32 bp, Homo sapiens
gtttttcagagaactgaactgtggaaaaatga

SEQ ID NO: 4386 - DNA, 32 bp, Homo sapiens
atcccatttctgtcctgctcccaggaagattc

SEQ ID NO: 4387 - DNA, 32 bp, Homo sapiens
tgaacgtcacccagagactgtaatttgtgtag

SEQ ID NO: 4388 - DNA, 24 bp, Homo sapiens
ctgttgaccaggctggagtgcagt

SEQ ID NO: 4389 - DNA, 32 bp, Homo sapiens
agcctcccaagtagctgggattacaggcgtcc

SEQ ID NO: 4390 - DNA, 32 bp, Homo sapiens
cgtgttttgtcatcagcatcttttctattaag

SEQ ID NO: 4391 - DNA, 32 bp, Homo sapiens
agaaaaggaagaggaggaaaaacaagtgtgtg

SEQ ID NO: 4392 - DNA, 32 bp, Homo sapiens
gggcaaggaagaggagttggccaacaggcagc

SEQ ID NO: 4393 - DNA, 21 bp, Homo sapiens
tggcccaggctagagtgcagt

SEQ ID NO: 4394 - DNA, 32 bp, Homo sapiens
cgcaactcagtggccattcttctgccttccca

SEQ ID NO: 4395 - DNA, 32 bp, Homo sapiens
ccagcccatcttctcccgcttcttgcgctcct

SEQ ID NO: 4396 - DNA, 32 bp, Homo sapiens
cactcgtcaccccagctggagtgcagtggtgc

SEQ ID NO: 4397 - DNA, 32 bp, Homo sapiens
ttcacagatacttgaattaattcatccaaatg

SEQ ID NO: 4398 - DNA, 32 bp, Homo sapiens
ctctgtctcccaggctggagtgcaatggtgca

SEQ ID NO: 4399 - DNA, 32 bp, Homo sapiens
ctctgtctcccaggctagagtgcagtggtgca

SEQ ID NO: 4400 - DNA, 32 bp, Homo sapiens
agaattgctttgtggctgggtgcagtggttca

SEQ ID NO: 4401 - DNA, 32 bp, Homo sapiens
ttaaaattgcccagggatggtggtgcacactt

SEQ ID NO: 4402 - DNA, 32 bp, Homo sapiens
gaacccgggaagcggaggttgcagtgagccaa

SEQ ID NO: 4403 - DNA, 32 bp, Homo sapiens
tcggtggggaggcaagagggcggcgaggaggt

SEQ ID NO: 4404 - DNA, 32 bp, Homo sapiens
gaacccaggaagcggaggttgcagtgagccga

SEQ ID NO: 4405 - DNA, 32 bp, Homo sapiens
gtgccaatcccatgccatgcagtattatgtcc

SEQ ID NO: 4406 - DNA, 32 bp, Homo sapiens
atgcagagtctacagcctgacccagctgcccg

SEQ ID NO: 4407 - DNA, 32 bp, Homo sapiens
tgtgtgtgtaccactgccatctgaacaaacta

SEQ ID NO: 4408 - DNA, 32 bp, Homo sapiens
ggtgggaagctggcaatctgcaccttggggcc

SEQ ID NO: 4409 - DNA, 32 bp, Homo sapiens
ctgggttccagcaattctcctgcctcagcctc

SEQ ID NO: 4410 - DNA, 32 bp, Homo sapiens
ctgagctcaagcaatccacctgcctcagccta

SEQ ID NO: 4411 - DNA, 32 bp, Homo sapiens
ctgctggcacttctcccctccctggcccttct

SEQ ID NO: 4412 - DNA, 31 bp, Homo sapiens
caaaacagtctacacagcaggagggatggct

SEQ ID NO: 4413 - DNA, 22 bp, Homo sapiens
tcacgtctataatcccagcact

SEQ ID NO: 4414 - DNA, 32 bp, Homo sapiens
gatttgcctcaaggcctcttcagtataaggaa

SEQ ID NO: 4415 - DNA, 21 bp, Homo sapiens
tgtgtttgacagagatgggga

SEQ ID NO: 4416 - DNA, 32 bp, Homo sapiens
cagtctcaccttctccccaccctacctcacct

SEQ ID NO: 4417 - DNA, 32 bp, Homo sapiens
atgcaggtgaaacccagtcactgtgagctccc

SEQ ID NO: 4418 - DNA, 22 bp, Homo sapiens
gtcgcccaggctggagcgcagt

SEQ ID NO: 4419 - DNA, 32 bp, Homo sapiens
ataaggggttactctttcaagagtaacaaaaa

SEQ ID NO: 4420 - DNA, 32 bp, Homo sapiens
ctctgttgcccaggctggagtccagtggcatg

SEQ ID NO: 4421 - DNA, 32 bp, Homo sapiens
tcttgtcgcccaggctggagtgcaacggtatg

SEQ ID NO: 4422 - DNA, 32 bp, Homo sapiens
atctcaggggaaatgtggctctctccatcttg

SEQ ID NO: 4423 - DNA, 32 bp, Homo sapiens
gaacctgtgaggcagaggttgcagtgagccaa

SEQ ID NO: 4424 - DNA, 32 bp, Homo sapiens
tggcggcagaggcagagatgggagtgatgcgg

SEQ ID NO: 4425 - DNA, 32 bp, Homo sapiens
gctctgatcccaggctggatggagtggctgga

SEQ ID NO: 4426 - DNA, 32 bp, Homo sapiens
ttttccaccttgggagttcaagcgattttccc

SEQ ID NO: 4427 - DNA, 28 bp, Homo sapiens
tgaaccccaagtgtgtacctcattcttc

SEQ ID NO: 4428 - DNA, 32 bp, Homo sapiens
ctactcgggaggctgaggcaggagaatcgttt

SEQ ID NO: 4429 - DNA, 32 bp, Homo sapiens
cagaagaatggcttgaacctggaacgcggagg

SEQ ID NO: 4430 - DNA, 32 bp, Homo sapiens
aggaagtcacccagctgtttctcagtcccaga

SEQ ID NO: 4431 - DNA, 32 bp, Homo sapiens
gcgctgccttcactcctggagtgagtttccat

SEQ ID NO: 4432 - DNA, 32 bp, Homo sapiens
gtgctttaacatcagttgaaacctaaattttc

SEQ ID NO: 4433 - DNA, 32 bp, Homo sapiens
cgagggaggctctgtctcaaaagcaaagcaaa

SEQ ID NO: 4434 - DNA, 32 bp, Homo sapiens
agatataatttccaatataccattcaactaca

SEQ ID NO: 4435 - DNA, 32 bp, Homo sapiens
tggtttgtaagaggggaaagaaaaggagaaag

SEQ ID NO: 4436 - DNA, 32 bp, Homo sapiens
ccttccttccgaggagctttctggctgcctaa

SEQ ID NO: 4437 - DNA, 32 bp, Homo sapiens
agagttcatcttcttgacctttggccactgcc

SEQ ID NO: 4438 - DNA, 32 bp, Homo sapiens
ctttacatccttctccctaacatctagactat

SEQ ID NO: 4439 - DNA, 32 bp, Homo sapiens
tgtccaagagcctgtttttgaaacacaagctg

SEQ ID NO: 4440 - DNA, 32 bp, Homo sapiens
ttagaaatcctgaagaattcagtcttcgtcta

SEQ ID NO: 4441 - DNA, 32 bp, Homo sapiens
ccttgcctcaagtgagcttcaaccttagcctc

SEQ ID NO: 4442 - DNA, 23 bp, Homo sapiens
tggcacaattttggctccctgca

SEQ ID NO: 4443 - DNA, 23 bp, Homo sapiens
tggggcaatcttggctccctgca

SEQ ID NO: 4444 - DNA, 32 bp, Homo sapiens
ccttctttgccttcttgccacagggtccttac

SEQ ID NO: 4445 - DNA, 18 bp, Homo sapiens
cagggaagaatcccaccc

SEQ ID NO: 4446 - DNA, 32 bp, Homo sapiens
ccttgctggagttttgttttgttgctccaatt

SEQ ID NO: 4447 - DNA, 32 bp, Homo sapiens
ccactgggaccagcaggtgaagcgttgcaaca

SEQ ID NO: 4448 - DNA, 32 bp, Homo sapiens
aagaaccagggtctgtcatccccacagcccct

SEQ ID NO: 4449 - DNA, 32 bp, Homo sapiens
ctggggccagttcttctgtttcacctagaatt

SEQ ID NO: 4450 - DNA, 32 bp, Homo sapiens
gagctaggctgttttgctagagataattgcaa

SEQ ID NO: 4451 - DNA, 32 bp, Homo sapiens
tctctgttgcccaggctggagtacaatggcgt

SEQ ID NO: 4452 - DNA, 32 bp, Homo sapiens
tctctgttgcccaggctggagtgcaatggcat

SEQ ID NO: 4453 - DNA, 32 bp, Homo sapiens
ctggactgttgtcaccttcagtgcagtcactg

SEQ ID NO: 4454 - DNA, 32 bp, Homo sapiens
cactatcacccaggctagagggcagtggcaca

SEQ ID NO: 4455 - DNA, 32 bp, Homo sapiens
gctcagttgcatctggaaggtgcagtgtgcac

SEQ ID NO: 4456 - DNA, 32 bp, Homo sapiens
agctggaaagagagagaagggcctcacagtga

SEQ ID NO: 4457 - DNA, 28 bp, Homo sapiens
atgtacacaggtgctgcctctccctgat

SEQ ID NO: 4458 - DNA, 32 bp, Homo sapiens
cgcggccggaggcagaggccaggcgagacacc

SEQ ID NO: 4459 - DNA, 32 bp, Homo sapiens
ctactcgggaggctgaggcaggagaatcacct

SEQ ID NO: 4460 - DNA, 32 bp, Homo sapiens
agcttcctgagtagctgggattacaggtgcgc

SEQ ID NO: 4461 - DNA, 32 bp, Homo sapiens
accctcctgagtagctgggactacaggtgtgc

SEQ ID NO: 4462 - DNA, 32 bp, Homo sapiens
ggggtgaaaaattggcccttgtatgggaggtg

SEQ ID NO: 4463 - DNA, 24 bp, Homo sapiens
gctcaagaggcccagggagcaatg

SEQ ID NO: 4464 - DNA, 32 bp, Homo sapiens
ctgacctcaagtaatctgcccacctcggcctc

SEQ ID NO: 4465 - DNA, 32 bp, Homo sapiens
caagaggctgaggcaggagaattgtttgaacc

SEQ ID NO: 4466 - DNA, 32 bp, Homo sapiens
tcttctcatccctaggacaagcatagtgcctg

SEQ ID NO: 4467 - DNA, 20 bp, Homo sapiens
gccaccgagtgcacccagga

SEQ ID NO: 4468 - DNA, 32 bp, Homo sapiens
tctatctctgcagttctgtctgacttagctga

SEQ ID NO: 4469 - DNA, 23 bp, Homo sapiens
tggcgcaatcttggctcactaca

SEQ ID NO: 4470 - DNA, 23 bp, Homo sapiens
tggtacaatctcggctcactgca

SEQ ID NO: 4471 - DNA, 32 bp, Homo sapiens
aaggttgggctggtgctcacagctgtaatccc

SEQ ID NO: 4472 - DNA, 32 bp, Homo sapiens
agcagaaatgttcctgcactagacaattaaag

SEQ ID NO: 4473 - DNA, 23 bp, Homo sapiens
tggcacaatcttggctcactgca

SEQ ID NO: 4474 - DNA, 23 bp, Homo sapiens
tggtgcaatctcagctcactgca

SEQ ID NO: 4475 - DNA, 32 bp, Homo sapiens
acctccgcctcccgggttcaagcgattctcca

SEQ ID NO: 4476 - DNA, 28 bp, Homo sapiens
gattacccacgtgctgccgtcctggtct

SEQ ID NO: 4477 - DNA, 32 bp, Homo sapiens
tcttgttgtctaggctggagtgccgtggtgcg

SEQ ID NO: 4478 - DNA, 32 bp, Homo sapiens
gaggatcaagacgaaaacctgcaatgacaact

SEQ ID NO: 4479 - DNA, 32 bp, Homo sapiens
acctccacctcctgggttcaagcgattcttat

SEQ ID NO: 4480 - DNA, 32 bp, Homo sapiens
ccaccgtcacaggccaccaccacgccgtcaat

SEQ ID NO: 4481 - DNA, 32 bp, Homo sapiens
gaggtgcctgaaagctgggagcgtgggctcag

SEQ ID NO: 4482 - DNA, 32 bp, Homo sapiens
aatttactgagtagctgcaacatgccagcctc

SEQ ID NO: 4483 - DNA, 32 bp, Homo sapiens
ggccatttccagccagctcccacccatctttt

SEQ ID NO: 4484 - DNA, 32 bp, Homo sapiens
gatgcctttggcaattcttcttctcaagcact

SEQ ID NO: 4485 - DNA, 32 bp, Homo sapiens
tgctcaagtctacacacctgtacagcacgtta

SEQ ID NO: 4486 - DNA, 32 bp, Homo sapiens
gtcagtgcctgagatacacctacaagagcgcc

SEQ ID NO: 4487 - DNA, 32 bp, Homo sapiens
ctctgtcacccaggctggggcgcaatggcacg

SEQ ID NO: 4488 - DNA, 32 bp, Homo sapiens
gtttaagcagagggctacagaaaacagggaag

SEQ ID NO: 4489 - DNA, 32 bp, Homo sapiens
acaggagagccagcagggtggatgcaaggggc

SEQ ID NO: 4490 - DNA, 32 bp, Homo sapiens
gcaacatgtggcctgttcacagctacataatt

SEQ ID NO: 4491 - DNA, 17 bp, Homo sapiens
gccatcaccccctccag

SEQ ID NO: 4492 - DNA, 24 bp, Homo sapiens
ctgctgttccagcctctgcaggtg

SEQ ID NO: 4493 - DNA, 32 bp, Homo sapiens
gttttatttgtagacatggactgtgaaataaa

SEQ ID NO: 4494 - DNA, 32 bp, Homo sapiens
ttgagatgaagttttgctcttgttccccaggc

SEQ ID NO: 4495 - DNA, 32 bp, Homo sapiens
ctccctcacccaggctgcagtgccatgcagac

SEQ ID NO: 4496 - DNA, 32 bp, Homo sapiens
acagcagccctgggggtgggtgcaatgaggat

SEQ ID NO: 4497 - DNA, 32 bp, Homo sapiens
actctgttgcccaggctggagtgcaggggcgt

SEQ ID NO: 4498 - DNA, 28 bp, Homo sapiens
gaagggtcaagtgctgtctaccatcaac

SEQ ID NO: 4499 - DNA, 32 bp, Homo sapiens
aagttgctaagtgcccgagcgcagcgcgttaa

SEQ ID NO: 4500 - DNA, 32 bp, Homo sapiens
ttgtatctattattacatgtgctgctgaaggg

SEQ ID NO: 4501 - DNA, 32 bp, Homo sapiens
ctgggttcaagcatttctcctgcctcagcctc

SEQ ID NO: 4502 - DNA, 32 bp, Homo sapiens
gtttcaaggcctgggagtaatcttcagctcac

SEQ ID NO: 4503 - DNA, 32 bp, Homo sapiens
accctcccgagtagctgggattacaggcgccc

SEQ ID NO: 4504 - DNA, 32 bp, Homo sapiens
ctgacctcaagtgatcctcccacctcagcctg

SEQ ID NO: 4505 - DNA, 32 bp, Homo sapiens
atgggctcaagcagtcctcccacctcagcctc

SEQ ID NO: 4506 - DNA, 32 bp, Homo sapiens
ctgggctcaagcagtcatcccacctcagcctc

SEQ ID NO: 4507 - DNA, 32 bp, Homo sapiens
gaataagtctctcataatgagtgcagtgtcag

SEQ ID NO: 4508 - DNA, 32 bp, Homo sapiens
actgaggctgctttttagttggtgctaaccta

SEQ ID NO: 4509 - DNA, 32 bp, Homo sapiens
ctgggttcaagccatcctcccacctcagcctc

SEQ ID NO: 4510 - DNA, 32 bp, Homo sapiens
tgaaaacagcctctagcttcaggctgggcacg

SEQ ID NO: 4511 - DNA, 23 bp, Homo sapiens
tcaggcctgtaatcccagcactt

SEQ ID NO: 4512 - DNA, 32 bp, Homo sapiens
tccaaggattaggtgatcggagcttgaaaaga

SEQ ID NO: 4513 - DNA, 32 bp, Homo sapiens
ctctgtcacctaggctggagtgcagtggggca

SEQ ID NO: 4514 - DNA, 32 bp, Homo sapiens
ctctgtcacccaggctggagtacactggcact

SEQ ID NO: 4515 - DNA, 32 bp, Homo sapiens
acctggcttccgggagcttcatagaccgattg

SEQ ID NO: 4516 - DNA, 32 bp, Homo sapiens
ggctgagcctgaggccttccagaaagcaggag

SEQ ID NO: 4517 - DNA, 32 bp, Homo sapiens
ctctgttgcccaggctggagtgcagtggcacc

SEQ ID NO: 4518 - DNA, 32 bp, Homo sapiens
ctctgtcccccaggctggagtgcagtggcatg

SEQ ID NO: 4519 - DNA, 17 bp, Homo sapiens
taggccaggcgcagtgg

SEQ ID NO: 4520 - DNA, 32 bp, Homo sapiens
cttcttgccgaccttgaagcagagttgacgtt

SEQ ID NO: 4521 - DNA, 32 bp, Homo sapiens
cgcctcagagcctctcagggcaggccaacttc

SEQ ID NO: 4522 - DNA, 32 bp, Homo sapiens
accaaactgtaccttagccactttggacacat

SEQ ID NO: 4523 - DNA, 32 bp, Homo sapiens
cacagacagccagcagggggcgtcggagaact

SEQ ID NO: 4524 - DNA, 20 bp, Homo sapiens
ctgcaagggcgagcatggga

SEQ ID NO: 4525 - DNA, 32 bp, Homo sapiens
gacatgttggccaggctggtggtgagctcctg

SEQ ID NO: 4526 - DNA, 32 bp, Homo sapiens
gctctgtcacccaggctggagtgaggtggtac

SEQ ID NO: 4527 - DNA, 32 bp, Homo sapiens
ctcttgttgcccgggctggagtgcaatggcgc

SEQ ID NO: 4528 - DNA, 32 bp, Homo sapiens
ccctgtcacccaggctggaatgcaatggcacg

SEQ ID NO: 4529 - DNA, 32 bp, Homo sapiens
ttacacactttcctgttcatagcaatattaaa

SEQ ID NO: 4530 - DNA, 32 bp, Homo sapiens
aactttgcttcaggctgggtagtggtagaggt

SEQ ID NO: 4531 - DNA, 32 bp, Homo sapiens
ctttgttgcccaggctggagtgtggtggggca

SEQ ID NO: 4532 - DNA, 32 bp, Homo sapiens
ctctgttgcccaggctggagtgcagtgatgtg

SEQ ID NO: 4533 - DNA, 32 bp, Homo sapiens
ctctgttgcccgggctggagtgcagtggtgtg

SEQ ID NO: 4534 - DNA, 32 bp, Homo sapiens
gaacctgggaggcagaggttacagtgagccga

SEQ ID NO: 4535 - DNA, 32 bp, Homo sapiens
tgaacccgggagcggaggttgcagtgagctga

SEQ ID NO: 4536 - DNA, 32 bp, Homo sapiens
ctctgtcgcccaggctggaatgcagtggtgcg

SEQ ID NO: 4537 - DNA, 32 bp, Homo sapiens
acttgcgcctcccgggttcaagcgattctcca

SEQ ID NO: 4538 - DNA, 32 bp, Homo sapiens
tacagttcaacctgccttaacacaacagtatc

SEQ ID NO: 4539 - DNA, 32 bp, Homo sapiens
gggcccaggaggcagctgggttgcatggagag

SEQ ID NO: 4540 - DNA, 32 bp, Homo sapiens
atccttcggaaggccttcctggaatcccacct

SEQ ID NO: 4541 - DNA, 32 bp, Homo sapiens
gcctccgcctcctgggttcaagcaattctacc

SEQ ID NO: 4542 - DNA, 32 bp, Homo sapiens
ttaagagacagaggagaaagtggagcggggag

SEQ ID NO: 4543 - DNA, 32 bp, Homo sapiens
ccggcttgcctgtaatcccagcactttgggag

SEQ ID NO: 4544 - DNA, 32 bp, Homo sapiens
gtggacagtcctgggagaacctcaggcttcct

SEQ ID NO: 4545 - DNA, 32 bp, Homo sapiens
ggctgcagtattgactccagtgacataaagtt

SEQ ID NO: 4546 - DNA, 32 bp, Homo sapiens
aaggtgtttaaaacatgtcaaccttatgtaag

SEQ ID NO: 4547 - DNA, 32 bp, Homo sapiens
cacctccactcctaggcttttctgcctagagc

SEQ ID NO: 4548 - DNA, 22 bp, Homo sapiens
gaagaggggcagtgaccctgtg

SEQ ID NO: 4549 - DNA, 32 bp, Homo sapiens
ctctgtcgctcaggctggagtgcagtggcgcg

SEQ ID NO: 4550 - DNA, 32 bp, Homo sapiens
tctgtgcattattcactcagacatatttttag

SEQ ID NO: 4551 - DNA, 32 bp, Homo sapiens
gtgggaaggggtgatggatgatgaacctggca

SEQ ID NO: 4552 - DNA, 32 bp, Homo sapiens
atgtaaaatgttctcagccgggcacggtggct

SEQ ID NO: 4553 - DNA, 32 bp, Homo sapiens
tcactcttgcccaggctggggtgtcgtggcgt

SEQ ID NO: 4554 - DNA, 32 bp, Homo sapiens
tcttgtttcccaggctggagtgcaatggcaca

SEQ ID NO: 4555 - DNA, 32 bp, Homo sapiens
ctctgtcccccagtctggcgtgcaatggtttg

SEQ ID NO: 4556 - DNA, 32 bp, Homo sapiens
ctctgtcactcaggctggagtacagtggcaca

SEQ ID NO: 4557 - DNA, 32 bp, Homo sapiens
gaacccgggaggcagaggttatcgtgagctga

SEQ ID NO: 4558 - DNA, 32 bp, Homo sapiens
gagccagggaggtcaaggctgcagtgagccgt

SEQ ID NO: 4559 - DNA, 32 bp, Homo sapiens
ctgctcgggaggctgaggcaggagaatagcat

SEQ ID NO: 4560 - DNA, 32 bp, Homo sapiens
accttcacctccccggttcaagcaattctcct

SEQ ID NO: 4561 - DNA, 32 bp, Homo sapiens
acctccacctcctgggttcaagcgattctcct

SEQ ID NO: 4562 - DNA, 32 bp, Homo sapiens
gaaatgccaagtgcctgcttagtagctttgga

SEQ ID NO: 4563 - DNA, 32 bp, Homo sapiens
ttgtggtgtgagatgttcctggaactcagcca

SEQ ID NO: 4564 - DNA, 32 bp, Homo sapiens
gcaggttcaagcaatcctcccacttcagcctc

SEQ ID NO: 4565 - DNA, 32 bp, Homo sapiens
ctggattcaaacaattctcatgtctcagcctc

SEQ ID NO: 4566 - DNA, 32 bp, Homo sapiens
aagcctccagaactgtgagaattcttttgttt

SEQ ID NO: 4567 - DNA, 32 bp, Homo sapiens
ggaggcagaagaggaagtcagagcgatgtgct

SEQ ID NO: 4568 - DNA, 32 bp, Homo sapiens
ggcagctcgcccagactccgggcagtgagagg

SEQ ID NO: 4569 - DNA, 32 bp, Homo sapiens
ttgcagttactgatacaaatggtgttaactgg

SEQ ID NO: 4570 - DNA, 21 bp, Homo sapiens
tttactgctttgtccattgga

SEQ ID NO: 4571 - DNA, 32 bp, Homo sapiens
tttctttctttgactcctcttctgcctgcctt

SEQ ID NO: 4572 - DNA, 18 bp, Homo sapiens
tgacagagacctaagcca

SEQ ID NO: 4573 - DNA, 32 bp, Homo sapiens
ggccacatggactggggtgcaatgggacagct

SEQ ID NO: 4574 - DNA, 32 bp, Homo sapiens
tcttgttgcccaggctggagtacaatggtgcg

SEQ ID NO: 4575 - DNA, 23 bp, Homo sapiens
ctgtggcttttctggaatggaat

SEQ ID NO: 4576 - DNA, 19 bp, Homo sapiens
ctgaccaacatggtgaaat

SEQ ID NO: 4577 - DNA, 32 bp, Homo sapiens
cttctggatacttttgtcttccaccctgccct

SEQ ID NO: 4578 - DNA, 23 bp, Homo sapiens
tccagaccctgctgaacgagcta

SEQ ID NO: 4579 - DNA, 32 bp, Homo sapiens
cagcctgctcagaatttgttagcaataattaa

SEQ ID NO: 4580 - DNA, 32 bp, Homo sapiens
catgctcagatgtcataagtggcagctatctt

SEQ ID NO: 4581 - DNA, 32 bp, Homo sapiens
actctgttgcccaggttggagtacagcagtgc

SEQ ID NO: 4582 - DNA, 32 bp, Homo sapiens
accggctcaagcaatcctcccatctcagcctc

SEQ ID NO: 4583 - DNA, 32 bp, Homo sapiens
ggcctcccaaagtgctgggattactggtatga

SEQ ID NO: 4584 - DNA, 32 bp, Homo sapiens
gggacagactggccgttgctgtggagacgcct

SEQ ID NO: 4585 - DNA, 32 bp, Homo sapiens
tcataaagaggaggagaaacagggtgagtcaa

SEQ ID NO: 4586 - DNA, 32 bp, Homo sapiens
ccgggttcaagcaattctcctgcctcaccctc

SEQ ID NO: 4587 - DNA, 32 bp, Homo sapiens
ccgggttcaggcaattctcttgcatcagcctc

SEQ ID NO: 4588 - DNA, 32 bp, Homo sapiens
tctggagctgcagcttcctccctggctgtggg

SEQ ID NO: 4589 - DNA, 17 bp, Homo sapiens
gcccctgtgatccaggt

SEQ ID NO: 4590 - DNA, 24 bp, Homo sapiens
tcatgcctgcaatcccagcacttt

SEQ ID NO: 4591 - DNA, 18 bp, Homo sapiens
tgcttactgctgcaggtg

SEQ ID NO: 4592 - DNA, 32 bp, Homo sapiens
ctgggatctcaaggagctttaaagtcttaatg

SEQ ID NO: 4593 - DNA, 32 bp, Homo sapiens
cctttctctgcaggcatctgtttgtttgtgtc

SEQ ID NO: 4594 - DNA, 32 bp, Homo sapiens
caagcgctgcccaggtcctggggtggtggcag

SEQ ID NO: 4595 - DNA, 32 bp, Homo sapiens
tggagtctcgttctgtcacccaggctggcgtg

SEQ ID NO: 4596 - DNA, 32 bp, Homo sapiens
cggtctgagcctttttggataattaataaata

SEQ ID NO: 4597 - DNA, 32 bp, Homo sapiens
attgtaagtgtttactgactggcagcttttat

SEQ ID NO: 4598 - DNA, 32 bp, Homo sapiens
ctgcctgcctccatgggatctgtctttatatt

SEQ ID NO: 4599 - DNA, 32 bp, Homo sapiens
ggaagaaaagagaccaggtctcagcttgacta

SEQ ID NO: 4600 - DNA, 32 bp, Homo sapiens
gctgcaaggaggcaggggccagcgggaaggag

SEQ ID NO: 4601 - DNA, 32 bp, Homo sapiens
cactgttgcccaggctggagagcagtggcgcg

SEQ ID NO: 4602 - DNA, 32 bp, Homo sapiens
actccttgcctaggctggagtttacagagaca

SEQ ID NO: 4603 - DNA, 32 bp, Homo sapiens
actcgctgtaccaatatccatggaggaatatg

SEQ ID NO: 4604 - DNA, 32 bp, Homo sapiens
agggcggggctggaggaatgtgggggattgaa

SEQ ID NO: 4605 - DNA, 32 bp, Homo sapiens
tggggcacaaggggactggaggcagttgcttt

SEQ ID NO: 4606 - DNA, 32 bp, Homo sapiens
ctggccttaagtgatcctcccacctcagcctc

SEQ ID NO: 4607 - DNA, 24 bp, Homo sapiens
tcatgtctgtaatcccagcacttt

SEQ ID NO: 4608 - DNA, 24 bp, Homo sapiens
tcatgcctgtaattccagcacttt

SEQ ID NO: 4609 - DNA, 20 bp, Homo sapiens
caggagcagggaagagcagt

SEQ ID NO: 4610 - DNA, 24 bp, Homo sapiens
tcaagcctgtaatcccagcagttt

SEQ ID NO: 4611 - DNA, 24 bp, Homo sapiens
tcacacctgtaatcccaacacttt

SEQ ID NO: 4612 - DNA, 19 bp, Homo sapiens
cttgtaatcctagcacttt

SEQ ID NO: 4613 - DNA, 32 bp, Homo sapiens
ccatgcctcttgaagctttttctgcctcctga

SEQ ID NO: 4614 - DNA, 32 bp, Homo sapiens
tagtacctggcagcttctcccttagcctggaa

SEQ ID NO: 4615 - DNA, 32 bp, Homo sapiens
cctcgtctcccctgccccatctggtgcttaca

SEQ ID NO: 4616 - DNA, 32 bp, Homo sapiens
ctcactgcctgagaccccttccttagagagca

SEQ ID NO: 4617 - DNA, 32 bp, Homo sapiens
tcttgtcacccaggctggagtgcagtggcaca

SEQ ID NO: 4618 - DNA, 32 bp, Homo sapiens
gcaggcagggttcattctggtgacacagcaac

SEQ ID NO: 4619 - DNA, 32 bp, Homo sapiens
tgctcatggagttgcagttcttgcctaacagg

SEQ ID NO: 4620 - DNA, 32 bp, Homo sapiens
cagctgagcctagaggtgaatttcattgggga

SEQ ID NO: 4621 - DNA, 25 bp, Homo sapiens
cgtcacccgagctggagtgcagtgg

SEQ ID NO: 4622 - DNA, 32 bp, Homo sapiens
gaaggaggaggcggggctgcactgtgagcccg

SEQ ID NO: 4623 - DNA, 32 bp, Homo sapiens
aacatgaaagagatctttgtgaataaattcaa

SEQ ID NO: 4624 - DNA, 32 bp, Homo sapiens
tagaccccagttctgttttccaggaggaactc

SEQ ID NO: 4625 - DNA, 32 bp, Homo sapiens
tcttgtcgcccaggctggagtgcagtggcacg

SEQ ID NO: 4626 - DNA, 32 bp, Homo sapiens
taaaattgcccagtcttcagcggagcagtttt

SEQ ID NO: 4627 - DNA, 32 bp, Homo sapiens
ctctgtcacccaggctggagtacaatagcgtg

SEQ ID NO: 4628 - DNA, 32 bp, Homo sapiens
gacccaccaagtgcttttcccaagggtctggg

SEQ ID NO: 4629 - DNA, 32 bp, Homo sapiens
gcacccaggaggtggaggttgcagtgagccga

SEQ ID NO: 4630 - DNA, 32 bp, Homo sapiens
tcttgttgcccaggctagagtgcaatggcatg

SEQ ID NO: 4631 - DNA, 32 bp, Homo sapiens
acctccacctcctgggttccagcgattctcct

SEQ ID NO: 4632 - DNA, 28 bp, Homo sapiens
ctatatccaagtgcttcctccaagtcac

SEQ ID NO: 4633 - DNA, 32 bp, Homo sapiens
tggccaagcctggcccttaaacaactgcagaa

SEQ ID NO: 4634 - DNA, 32 bp, Homo sapiens
cagtgaaggcataatgggctgtggagaccttc

SEQ ID NO: 4635 - DNA, 32 bp, Homo sapiens
actttgagacccagaaataaattctttccttt

SEQ ID NO: 4636 - DNA, 32 bp, Homo sapiens
agccttctgagtagctgggattacacgcgtgt

SEQ ID NO: 4637 - DNA, 32 bp, Homo sapiens
gagcttgcagtgagctgggattgcatcactgc

SEQ ID NO: 4638 - DNA, 31 bp, Homo sapiens
acggcagcgacagcgggcaggagggagaaag

SEQ ID NO: 4639 - DNA, 17 bp, Homo sapiens
gcccctgccgtggcagg

SEQ ID NO: 4640 - DNA, 32 bp, Homo sapiens
gaagatgtggcaggagaaagaaagaaaacggg

SEQ ID NO: 4641 - DNA, 32 bp, Homo sapiens
aaggagaaacctggcagataccaccttaacca

SEQ ID NO: 4642 - DNA, 32 bp, Homo sapiens
ggatatactgcagctttactgccttcctcctt

SEQ ID NO: 4643 - DNA, 32 bp, Homo sapiens
gcttttagtctccccttccttctgccttgggg

SEQ ID NO: 4644 - DNA, 32 bp, Homo sapiens
tgggtgacgtccaggtcacaggctgcagcgag

SEQ ID NO: 4645 - DNA, 27 bp, Homo sapiens
ccatgcctgtgtcagggacaggcacag

SEQ ID NO: 4646 - DNA, 32 bp, Homo sapiens
ccctcaggcctctcttcttatccaaataaatg

SEQ ID NO: 4647 - DNA, 32 bp, Homo sapiens
atctattttgaatctgtaaatattttaaatgt

SEQ ID NO: 4648 - DNA, 32 bp, Homo sapiens
agccgatttgtgctgctctcagcagccaccgg

SEQ ID NO: 4649 - DNA, 32 bp, Homo sapiens
acaagctcaaggagtctgaatttttcacttta

SEQ ID NO: 4650 - DNA, 32 bp, Homo sapiens
caaaggcaggcctggctgggtgcagtggctca

SEQ ID NO: 4651 - DNA, 32 bp, Homo sapiens
tgaaaaggaggatcgagctcactgtggagtat

SEQ ID NO: 4652 - DNA, 32 bp, Homo sapiens
actattttgcccaggctggagtgcgatggtgc

SEQ ID NO: 4653 - DNA, 32 bp, Homo sapiens
gagcccaggaggaggaggctgcagtgagctaa

SEQ ID NO: 4654 - DNA, 32 bp, Homo sapiens
ctttgttgcccaggctggagtggagtggcgtg

SEQ ID NO: 4655 - DNA, 32 bp, Homo sapiens
tcctctcgcccaggctggagtgcagtggtgtc

SEQ ID NO: 4656 - DNA, 32 bp, Homo sapiens
gaaggcccaagtgtccccacagtcttaggggg

SEQ ID NO: 4657 - DNA, 32 bp, Homo sapiens
ctattcgggaggctgaggcaggaggatggcgt

SEQ ID NO: 4658 - DNA, 32 bp, Homo sapiens
gaacccatgaggcggaggttgcagtgagccga

SEQ ID NO: 4659 - DNA, 32 bp, Homo sapiens
cccatgaagaattgcctggaaagatgttttca

SEQ ID NO: 4660 - DNA, 32 bp, Homo sapiens
ccactgggcaccacctgggccctgagtctccc

SEQ ID NO: 4661 - DNA, 32 bp, Homo sapiens
ccacatcaaaacagtgtgtccacctcagtcac

SEQ ID NO: 4662 - DNA, 32 bp, Homo sapiens
agcttcccgagtagctgggattataggcaccc

SEQ ID NO: 4663 - DNA, 32 bp, Homo sapiens
agccacctgagtagctgggattacacgcacat

SEQ ID NO: 4664 - DNA, 32 bp, Homo sapiens
ttctggtttcaagcaactcttctgcctcagca

SEQ ID NO: 4665 - DNA, 32 bp, Homo sapiens
ccttcacatcttcaacgccatcagtgggactc

SEQ ID NO: 4666 - DNA, 32 bp, Homo sapiens
gacccgagccgatttctcttggatttggctac

SEQ ID NO: 4667 - DNA, 32 bp, Homo sapiens
tgtatacacttacattttgacagggtcttcat

SEQ ID NO: 4668 - DNA, 32 bp, Homo sapiens
ctgacatcctgagacactgagaaatgtcctga

SEQ ID NO: 4669 - DNA, 32 bp, Homo sapiens
gagccgcctgcctgaggctcccagacagactg

SEQ ID NO: 4670 - DNA, 32 bp, Homo sapiens
aatgatgttagctgtggccactgtggattttt

SEQ ID NO: 4671 - DNA, 32 bp, Homo sapiens
ggccagcaggggcgtcgttttgttgccatttt

SEQ ID NO: 4672 - DNA, 19 bp, Homo sapiens
ggcaccaggactgctctcc

SEQ ID NO: 4673 - DNA, 32 bp, Homo sapiens
taagaggccctgggccgaggtgcagtgaccct

SEQ ID NO: 4674 - DNA, 32 bp, Homo sapiens
actccattgcccaggctggagtacaatggtgc

SEQ ID NO: 4675 - DNA, 32 bp, Homo sapiens
ctaccagtggccctgtgataccacagactgtg

SEQ ID NO: 4676 - DNA, 32 bp, Homo sapiens
ctctgtccccaaggctggagtgcagtggtgca

SEQ ID NO: 4677 - DNA, 32 bp, Homo sapiens
ctgtgttgcccaggctaatatcgaatgcttgg

SEQ ID NO: 4678 - DNA, 32 bp, Homo sapiens
ctctgtcatccaggctggagtgcagtggcaaa

SEQ ID NO: 4679 - DNA, 32 bp, Homo sapiens
aggagggggatgcagaggtgatgcagctgggg

SEQ ID NO: 4680 - DNA, 32 bp, Homo sapiens
gaacccgggaggcagaggttacagtgagccaa

SEQ ID NO: 4681 - DNA, 32 bp, Homo sapiens
ctctgtcacccagtctggagtgcagtggcaaa

SEQ ID NO: 4682 - DNA, 32 bp, Homo sapiens
ctgcagctgtgctcctgctccctcctggaatg

SEQ ID NO: 4683 - DNA, 32 bp, Homo sapiens
gccactgcctcctgggttcaggtgattctcct

SEQ ID NO: 4684 - DNA, 32 bp, Homo sapiens
ctgggttcaagtaatcctcccacctcagcctc

SEQ ID NO: 4685 - DNA, 32 bp, Homo sapiens
gaaaaacatcattactggaaacctattaaaca

SEQ ID NO: 4686 - DNA, 32 bp, Homo sapiens
agcctcctgagtagctgggactataggctccc

SEQ ID NO: 4687 - DNA, 32 bp, Homo sapiens
agaagaggaagaggaaagcaaaggagtcaggg

SEQ ID NO: 4688 - DNA, 32 bp, Homo sapiens
caggactgttgtactagatgttcttaggaaat

SEQ ID NO: 4689 - DNA, 32 bp, Homo sapiens
ctggattcaagtgatcctcccacctcagcctc

SEQ ID NO: 4690 - DNA, 20 bp, Homo sapiens
tcacgtctgtaatcccagca

SEQ ID NO: 4691 - DNA, 24 bp, Homo sapiens
tcatgcctgtaatctcagtacttt

SEQ ID NO: 4692 - DNA, 32 bp, Homo sapiens
tgacaagatttggaagaaagaaaataacagac

SEQ ID NO: 4693 - DNA, 25 bp, Homo sapiens
ggtctatatgctgggtgctgagaca

SEQ ID NO: 4694 - DNA, 32 bp, Homo sapiens
ggtgcccatcttctctctcctagagcccatac

SEQ ID NO: 4695 - DNA, 24 bp, Homo sapiens
tcatgcttgtaatcccagtacttt

SEQ ID NO: 4696 - DNA, 32 bp, Homo sapiens
caggagctgctgctgcagttgcagaaggataa

SEQ ID NO: 4697 - DNA, 20 bp, Homo sapiens
cccggagcccggagcccggc

SEQ ID NO: 4698 - DNA, 32 bp, Homo sapiens
ctctgttgcctaggctggagtacagtggcctg

SEQ ID NO: 4699 - DNA, 32 bp, Homo sapiens
attgtgagcctggagaagtagcatttagttgg

SEQ ID NO: 4700 - DNA, 16 bp, Homo sapiens
cacgaggctcactgca

SEQ ID NO: 4701 - DNA, 32 bp, Homo sapiens
atcgtcctgctgctgctgccgttccggtgtca

SEQ ID NO: 4702 - DNA, 32 bp, Homo sapiens
gaattcgggaggtggaggttgcagtgagccga

SEQ ID NO: 4703 - DNA, 32 bp, Homo sapiens
ttctgctgcccaggttggagtgcagtggcacg

SEQ ID NO: 4704 - DNA, 32 bp, Homo sapiens
ttcggtgtggaggggtggagtgctgtgatctc

SEQ ID NO: 4705 - DNA, 32 bp, Homo sapiens
tcctccgcctcccgggttcaagcgattctccc

SEQ ID NO: 4706 - DNA, 28 bp, Homo sapiens
agcctcacaccagctgcctcctccactc

SEQ ID NO: 4707 - DNA, 32 bp, Homo sapiens
gaatccgggaggcggaggttgcggtgagccaa

SEQ ID NO: 4708 - DNA, 22 bp, Homo sapiens
tgcacccagaagcagagaaaag

SEQ ID NO: 4709 - DNA, 32 bp, Homo sapiens
agcctccaaagtagctgggattacaggtttgc

SEQ ID NO: 4710 - DNA, 32 bp, Homo sapiens
tcatctcaacatcggctggtggttggtagggg

SEQ ID NO: 4711 - DNA, 32 bp, Homo sapiens
gacctacccaggccactggagtgagtctagag

SEQ ID NO: 4712 - DNA, 32 bp, Homo sapiens
tccaatactgcttaattatagcactttatttt

SEQ ID NO: 4713 - DNA, 32 bp, Homo sapiens
ttagctcacatgcactgagaattctttacagc

SEQ ID NO: 4714 - DNA, 25 bp, Homo sapiens
tcacaccctgtaatcccagcacttt

SEQ ID NO: 4715 - DNA, 32 bp, Homo sapiens
gaagaaggaagaggaaagggaggaggaggatt

SEQ ID NO: 4716 - DNA, 32 bp, Homo sapiens
tctaaagatagagtaaaaagaaaacaaaacca

SEQ ID NO: 4717 - DNA, 32 bp, Homo sapiens
cccggagcctgagccactgacaggagaggaga

SEQ ID NO: 4718 - DNA, 31 bp, Homo sapiens
aagacacaccagatatttaggagggaattag

SEQ ID NO: 4719 - DNA, 31 bp, Homo sapiens
accaggaacaacacacatctgggacaggagg

SEQ ID NO: 4720 - DNA, 24 bp, Homo sapiens
acaggcaccagccaccatgcctgg

SEQ ID NO: 4721 - DNA, 32 bp, Homo sapiens
tttggatcatagcttaacaaggcacaggaagg

SEQ ID NO: 4722 - DNA, 32 bp, Homo sapiens
tgtaaaagagcctagtttttaatagctatgga

SEQ ID NO: 4723 - DNA, 32 bp, Homo sapiens
tccaggacctccattccactcatctctggcct

SEQ ID NO: 4724 - DNA, 23 bp, Homo sapiens
tggcatgaactcagctcactgca

SEQ ID NO: 4725 - DNA, 23 bp, Homo sapiens
tgatgcgatctcggctctctgca

SEQ ID NO: 4726 - DNA, 32 bp, Homo sapiens
ctgtgtcgcccaggctggagtgcagtgagctg

SEQ ID NO: 4727 - DNA, 32 bp, Homo sapiens
ttttgtcccccaagctggagtacaatgacagg

SEQ ID NO: 4728 - DNA, 32 bp, Homo sapiens
cagaaccacatcctgaggagtctcagcttatc

SEQ ID NO: 4729 - DNA, 32 bp, Homo sapiens
agccctgggaggtcaaggctgcagtgagctgc

SEQ ID NO: 4730 - DNA, 32 bp, Homo sapiens
gagcctgggagatcgaggctgcagtgagccaa

SEQ ID NO: 4731 - DNA, 32 bp, Homo sapiens
gagccccagaggcagaggttgtggtgagccga

SEQ ID NO: 4732 - DNA, 32 bp, Homo sapiens
acctccacctcctgggtttaagcgattctcct

SEQ ID NO: 4733 - DNA, 28 bp, Homo sapiens
gggaactcatttgctgcctcttggtcat

SEQ ID NO: 4734 - DNA, 32 bp, Homo sapiens
aggccagggaggcaggggaggcaggagaggct

SEQ ID NO: 4735 - DNA, 32 bp, Homo sapiens
tatctgtggagttcctgctccgtggactgcag

SEQ ID NO: 4736 - DNA, 32 bp, Homo sapiens
gcagagggagaggagacaggaaggaaagatga

SEQ ID NO: 4737 - DNA, 32 bp, Homo sapiens
ctggactcaagcaatccgcccaccttgacttc

SEQ ID NO: 4738 - DNA, 32 bp, Homo sapiens
agcctcccaagtagctgggagcctgggcatgc

SEQ ID NO: 4739 - DNA, 32 bp, Homo sapiens
cattaaggtaggtcagcgtcatttgtctctgt

SEQ ID NO: 4740 - DNA, 24 bp, Homo sapiens
tcacgcctatacacccagcacttt

SEQ ID NO: 4741 - DNA, 24 bp, Homo sapiens
tcacacctgtaatccgagtacttt

SEQ ID NO: 4742 - DNA, 32 bp, Homo sapiens
agtctcaggcagggacagacccagaaagaaca

SEQ ID NO: 4743 - DNA, 32 bp, Homo sapiens
ggcctctctgcagtcctctcaccctccctcag

SEQ ID NO: 4744 - DNA, 32 bp, Homo sapiens
ttgtcttctgcagcttcctttccctagagctt

SEQ ID NO: 4745 - DNA, 32 bp, Homo sapiens
gtctgatggaggtttgctcttgttgcccaggc

SEQ ID NO: 4746 - DNA, 19 bp, Homo sapiens
gccaccagcaccacccaga

SEQ ID NO: 4747 - DNA, 32 bp, Homo sapiens
tggcaccagctagtcacctcccagaagaaact

SEQ ID NO: 4748 - DNA, 32 bp, Homo sapiens
gctctgtcacccaggctggagtgcagtgctgt

SEQ ID NO: 4749 - DNA, 32 bp, Homo sapiens
tggcctgcagaactgtgagacaataaactctc

SEQ ID NO: 4750 - DNA, 32 bp, Homo sapiens
acggcagcagaactgtctcttctgaaaaccag

SEQ ID NO: 4751 - DNA, 32 bp, Homo sapiens
agactgttttgcatcactctttgctattgaag

SEQ ID NO: 4752 - DNA, 32 bp, Homo sapiens
cagttggatgttcttgcctctgacagtagctt

SEQ ID NO: 4753 - DNA, 32 bp, Homo sapiens
ctcttgtcacccaggctggagtgcagtggcac

SEQ ID NO: 4754 - DNA, 32 bp, Homo sapiens
tgcctcccaagtagctgggattacaggcaccc

SEQ ID NO: 4755 - DNA, 32 bp, Homo sapiens
tgcaggccagtaacaggaagggcctggggaga

SEQ ID NO: 4756 - DNA, 32 bp, Homo sapiens
tatagtaacatgcagtctgaagtcctagttac

SEQ ID NO: 4757 - DNA, 32 bp, Homo sapiens
tcaggttcaagcaattctcctgcctccgcctc

SEQ ID NO: 4758 - DNA, 32 bp, Homo sapiens
gtgtctattcctgcttcctccacctcaccttg

SEQ ID NO: 4759 - DNA, 32 bp, Homo sapiens
agcctcctgagtagctgggactacaggtgtgc

SEQ ID NO: 4760 - DNA, 16 bp, Homo sapiens
gccctctgcccaggtg

SEQ ID NO: 4761 - DNA, 23 bp, Homo sapiens
gcagtgtgatccagagagcagtg

SEQ ID NO: 4762 - DNA, 32 bp, Homo sapiens
cagacagcacccagagtgagctggagtgggtc

SEQ ID NO: 4763 - DNA, 32 bp, Homo sapiens
agcattcatccctttccatataacaggaggga

SEQ ID NO: 4764 - DNA, 32 bp, Homo sapiens
ctgtcacccagactggaacacagtggcacgat

SEQ ID NO: 4765 - DNA, 32 bp, Homo sapiens
agcccttggtagagcttgaaccaccttctata

SEQ ID NO: 4766 - DNA, 24 bp, Homo sapiens
ctggccaacatggtgaaacccatc

SEQ ID NO: 4767 - DNA, 32 bp, Homo sapiens
tagtccaatcagctgaaattaaatcacttggg

SEQ ID NO: 4768 - DNA, 32 bp, Homo sapiens
gaacctcatccctgcacagatgaggaaaccaa

SEQ ID NO: 4769 - DNA, 32 bp, Homo sapiens
cccaatctgccaggctggactgtgctgttcct

SEQ ID NO: 4770 - DNA, 32 bp, Homo sapiens
taagcagctaccattccatggacttgcctccc

SEQ ID NO: 4771 - DNA, 32 bp, Homo sapiens
cctctgttgcccaggctggagtgcagtggtgc

SEQ ID NO: 4772 - DNA, 32 bp, Homo sapiens
aactccacctcccaggttcaaggaattcctgt

SEQ ID NO: 4773 - DNA, 32 bp, Homo sapiens
gctctgtcaccaggctggagtacagtgatgac

SEQ ID NO: 4774 - DNA, 32 bp, Homo sapiens
ctcacagtatcctataatctttgtgctctcac

SEQ ID NO: 4775 - DNA, 32 bp, Homo sapiens
agcctccagagtagctgggattacaggcacgt

SEQ ID NO: 4776 - DNA, 32 bp, Homo sapiens
ggctcatgcctgtcatcccagcactttgggag

SEQ ID NO: 4777 - DNA, 32 bp, Homo sapiens
ggctcctgcctgtaatcccagcactttgggag

SEQ ID NO: 4778 - DNA, 32 bp, Homo sapiens
agcctcctgagtagctgggactgcaggcaccc

SEQ ID NO: 4779 - DNA, 32 bp, Homo sapiens
ccaggttcaagcaattctcctgtttcagcctc

SEQ ID NO: 4780 - DNA, 32 bp, Homo sapiens
ctgggttcaagcagttctcttgcctcagcctc

SEQ ID NO: 4781 - DNA, 32 bp, Homo sapiens
gcatatctactgcatgccaagcactttctgca

SEQ ID NO: 4782 - DNA, 32 bp, Homo sapiens
ctttgtagccatcaacccgagtgcagtttcga

SEQ ID NO: 4783 - DNA, 32 bp, Homo sapiens
ccagcgtctcccagacttctcgtacagttaat

SEQ ID NO: 4784 - DNA, 32 bp, Homo sapiens
ccaggttcaagcgattctcccgcctcaggttc

SEQ ID NO: 4785 - DNA, 32 bp, Homo sapiens
tctttcattacatttaatctctggaccctgga

SEQ ID NO: 4786 - DNA, 32 bp, Homo sapiens
aagtgtcatcttctgccctccctgtcccaata

SEQ ID NO: 4787 - DNA, 32 bp, Homo sapiens
ggaagagggggaggagaaggaggaagaggggg

SEQ ID NO: 4788 - DNA, 32 bp, Homo sapiens
gcgagtgcatgggctaattatcatcaatcttt

SEQ ID NO: 4789 - DNA, 32 bp, Homo sapiens
gacctggaatcttttgctcttgtttttgcagt

SEQ ID NO: 4790 - DNA, 32 bp, Homo sapiens
ctctgttgcccaggctggagtgcaatgacaca

SEQ ID NO: 4791 - DNA, 24 bp, Homo sapiens
ctgaccaacatggtgaaactccat

SEQ ID NO: 4792 - DNA, 32 bp, Homo sapiens
gtgttatggagatgcttcctctctccaacctc

SEQ ID NO: 4793 - DNA, 32 bp, Homo sapiens
atatattaagcttttgctgtagattgcctagt

SEQ ID NO: 4794 - DNA, 32 bp, Homo sapiens
accgtggagaggaggcattcactgtggggtgt

SEQ ID NO: 4795 - DNA, 32 bp, Homo sapiens
tctgtcacccccaggccagagtgcagtggtgc

SEQ ID NO: 4796 - DNA, 32 bp, Homo sapiens
ttgctctcgcccaggctggagtgcagtgggtg

SEQ ID NO: 4797 - DNA, 32 bp, Homo sapiens
gacatgcccatcctgacattgtatgctacgag

SEQ ID NO: 4798 - DNA, 32 bp, Homo sapiens
aaaaagcatacctttcaattttgctacttggt

SEQ ID NO: 4799 - DNA, 32 bp, Homo sapiens
ctcccagaacaacaactatcctgacttctaat

SEQ ID NO: 4800 - DNA, 28 bp, Homo sapiens
atagcctcgggtgctgcctgtagtcatg

SEQ ID NO: 4801 - DNA, 32 bp, Homo sapiens
gaacccgggaggaggaggttgcactgagccga

SEQ ID NO: 4802 - DNA, 32 bp, Homo sapiens
gaacctgggaggtggagactgcagtgagccga

SEQ ID NO: 4803 - DNA, 32 bp, Homo sapiens
acctccacctcctgggttcaagcaattcttgt

SEQ ID NO: 4804 - DNA, 32 bp, Homo sapiens
acctctgcctcctgggttcaagaaattctcct

SEQ ID NO: 4805 - DNA, 32 bp, Homo sapiens
acctctgcctcctgggttcaagcaattctcat

SEQ ID NO: 4806 - DNA, 32 bp, Homo sapiens
ccgtctggaaccacctgggcccctgagggcac

SEQ ID NO: 4807 - DNA, 21 bp, Homo sapiens
gatgtaaactagctttgtgga

SEQ ID NO: 4808 - DNA, 32 bp, Homo sapiens
atagagggaagaggaagaggaggacgaacaga

SEQ ID NO: 4809 - DNA, 32 bp, Homo sapiens
agcctcacgagtagctgggattacaggcatgc

SEQ ID NO: 4810 - DNA, 25 bp, Homo sapiens
cgtcgcccaggctagagtgcagtgg

SEQ ID NO: 4811 - DNA, 32 bp, Homo sapiens
cggccagcctgaggctgcctgaggaaggaagg

SEQ ID NO: 4812 - DNA, 32 bp, Homo sapiens
tttaattgtctggcttctctctggactgggag

SEQ ID NO: 4813 - DNA, 32 bp, Homo sapiens
gcacaactacctcggcctgaccacagagctct

SEQ ID NO: 4814 - DNA, 32 bp, Homo sapiens
ttgagtgcagaactagctagtagaagccagat

SEQ ID NO: 4815 - DNA, 19 bp, Homo sapiens
ggaacccacagcgcaatcc

SEQ ID NO: 4816 - DNA, 32 bp, Homo sapiens
ccagattgcaacaggctgggcttcagtggcag

SEQ ID NO: 4817 - DNA, 32 bp, Homo sapiens
acacctcttgccaggctgcagagctatgcagt

SEQ ID NO: 4818 - DNA, 32 bp, Homo sapiens
tatgatggaagaggagagttggataggctgtg

SEQ ID NO: 4819 - DNA, 32 bp, Homo sapiens
atacaagttgttaggccaggtgcaatggctcg

SEQ ID NO: 4820 - DNA, 32 bp, Homo sapiens
gctctgtcaccaggctggagtgcagtggtgca

SEQ ID NO: 4821 - DNA, 32 bp, Homo sapiens
actatgtcaccctggctggagtgcagtagtgc

SEQ ID NO: 4822 - DNA, 32 bp, Homo sapiens
aacgcgatgagtgcccttacacaaaagcctgg

SEQ ID NO: 4823 - DNA, 32 bp, Homo sapiens
tccgtgcttttctggttgagatcatgtcattg

SEQ ID NO: 4824 - DNA, 32 bp, Homo sapiens
atactcgggaggctgaggcaggagaattgctt

SEQ ID NO: 4825 - DNA, 32 bp, Homo sapiens
ataaacaagaattggaagacatgaggaaagct

SEQ ID NO: 4826 - DNA, 32 bp, Homo sapiens
ggctcatgcctgtaattccagcactttaggag

SEQ ID NO: 4827 - DNA, 32 bp, Homo sapiens
gccccagtcccagagacccccacctggtgccc

SEQ ID NO: 4828 - DNA, 32 bp, Homo sapiens
agcctcccgagtagctgggattacaggatgac

SEQ ID NO: 4829 - DNA, 32 bp, Homo sapiens
gcagtcctcagagcttctctgcctatggagta

SEQ ID NO: 4830 - DNA, 32 bp, Homo sapiens
aggggctgaagaggaaggtggaaggagataaa

SEQ ID NO: 4831 - DNA, 32 bp, Homo sapiens
tgagttttacccagactcaaggagttggtaaa

SEQ ID NO: 4832 - DNA, 32 bp, Homo sapiens
gctgctcagctttctcagggaagcaactccag

SEQ ID NO: 4833 - DNA, 32 bp, Homo sapiens
tgtatacccttctcttctcttatcttctgtct

SEQ ID NO: 4834 - DNA, 32 bp, Homo sapiens
gtcacagcccctcagtctcttctccttcccct

SEQ ID NO: 4835 - DNA, 32 bp, Homo sapiens
tattcccctgggtgtgcacacagggcgggtgt

SEQ ID NO: 4836 - DNA, 32 bp, Homo sapiens
aaagaagcctgagactctccaacaggagagct

SEQ ID NO: 4837 - DNA, 32 bp, Homo sapiens
ctctgtcgcccaggctggagtgcagtggtgag

SEQ ID NO: 4838 - DNA, 32 bp, Homo sapiens
acctggaagacttggctttacgtactcccaat

SEQ ID NO: 4839 - DNA, 23 bp, Homo sapiens
tggcacaattttggctcactgca

SEQ ID NO: 4840 - DNA, 23 bp, Homo sapiens
tggcacaatctcaactcactgca

SEQ ID NO: 4841 - DNA, 32 bp, Homo sapiens
cagccatgaacggatggatgtgatgcctgcta

SEQ ID NO: 4842 - DNA, 32 bp, Homo sapiens
cagttaaggcctcatccatctgagctctgaat

SEQ ID NO: 4843 - DNA, 32 bp, Homo sapiens
cctctgtcgcccaggctagagtatagtggtgt

SEQ ID NO: 4844 - DNA, 32 bp, Homo sapiens
ttgaaacacatcctaagcgtctggtgctgcag

SEQ ID NO: 4845 - DNA, 32 bp, Homo sapiens
ttgtcacccttttaccatctttgctatactat

SEQ ID NO: 4846 - DNA, 32 bp, Homo sapiens
gtgccgttattctgctggaacatggtgccaat

SEQ ID NO: 4847 - DNA, 32 bp, Homo sapiens
catgccccctcagtgaggatcttcatgtacct

SEQ ID NO: 4848 - DNA, 32 bp, Homo sapiens
gaacctgggcggcagaggttgcagtgagtcaa

SEQ ID NO: 4849 - DNA, 32 bp, Homo sapiens
tcttattgcccaggctggagtgcagtgacgag

SEQ ID NO: 4850 - DNA, 32 bp, Homo sapiens
agcacctgccccacctgcccacagagaacaca

SEQ ID NO: 4851 - DNA, 32 bp, Homo sapiens
gcatctcaccacgacttctcctggagtcctca

SEQ ID NO: 4852 - DNA, 32 bp, Homo sapiens
agtcactctcccagacttgcgtgggtcagttc

SEQ ID NO: 4853 - DNA, 32 bp, Homo sapiens
tgcagcattatgctttgggcagtattacaaaa

SEQ ID NO: 4854 - DNA, 32 bp, Homo sapiens
ccatgtgactccccatcctcccatgaggggtc

SEQ ID NO: 4855 - DNA, 32 bp, Homo sapiens
acaagcagcggaggagaaggaggaggaggcga

SEQ ID NO: 4856 - DNA, 32 bp, Homo sapiens
gtcatcagaagaggaaaaatgaaggtaatgtt

SEQ ID NO: 4857 - DNA, 32 bp, Homo sapiens
tgctgagtcctcagcactgagtgcagtgcgtg

SEQ ID NO: 4858 - DNA, 32 bp, Homo sapiens
gggatgggtgttccttggaaatggcattgtat

(The sequence listing continues in the following parts.)

The invention claimed is:

1. An isolated nucleic acid selected from the group consisting of:
   (a) SEQ ID NO:354;
   (b) a RNA encoded by SEQ ID NO:354, wherein the RNA is identical in length to the sequence of SEQ ID NO:354; and
   (c) the complement of (a) or (b), wherein the complement is identical in length to the sequence of SEQ ID NO:354.

2. An isolated nucleic acid selected from the group consisting of:
   (a) SEQ ID NO:48;
   (b) a RNA encoded by SEQ ID NO:48, wherein the RNA is identical in length to the sequence of SEQ ID NO:48; and
   (c) the complement of (a) or (b), wherein the complement is identical in length to the sequence of SEQ ID NO:48.

3. A vector comprising a human insert, wherein the human insert consists of the nucleic acid of claim 1, wherein the vector comprises no other insert.

4. A vector comprising a human insert, wherein the human insert consists of the nucleic acid of claim 2, wherein the vector comprises no other insert.

5. A probe comprising a human insert, wherein the human insert consists of the nucleic acid of claim 1, wherein the probe comprises no other insert.

6. A probe comprising a human insert, wherein the human insert consists of the nucleic acid of claim 2, wherein the probe comprises no other insert.

* * * * *